US007576176B1

(12) United States Patent
Fraser et al.

(10) Patent No.: US 7,576,176 B1
(45) Date of Patent: Aug. 18, 2009

(54) *NEISSERIA MENINGITIDIS* ANTIGENS AND COMPOSITIONS

(75) Inventors: Claire Fraser, Potomac, MD (US); Cesira Galeotti, Poggibonsi (IT); Guido Grandi, Segrate (IT); Erin Hickey, Palatine, IL (US); Vega Masignani, Siena (IT); Marirosa Mora, Siena (IT); Jeremy Petersen, Arlington, VA (US); Mariagrazia Pizza, Siena (IT); Rino Rappuoli, Vagliasli (IT); Giulio Ratti, Siena (IT); Vincenzo Scarlato, Colle Val d'Elsa (IT); Maria Scarselli, Siena (IT); Herve Tettelin, Gaithersburg, MD (US); J. Craig Venter, Potomac, MD (US)

(73) Assignee: Novartis Vaccines and Diagnostics, Inc., Emeryville, CA (US)

( * ) Notice: Subject to any disclaimer, the term of this patent is extended or adjusted under 35 U.S.C. 154(b) by 0 days.

(21) Appl. No.: 09/674,546

(22) PCT Filed: Apr. 30, 1999

(86) PCT No.: PCT/US99/09346

§ 371 (c)(1), (2), (4) Date: Nov. 4, 2002

(87) PCT Pub. No.: WO99/57280

PCT Pub. Date: Nov. 11, 1999

Related U.S. Application Data

(60) Provisional application No. 60/121,528, filed on Feb. 25, 1999, provisional application No. 60/103,796, filed on Oct. 9, 1998, provisional application No. 60/103,794, filed on Oct. 9, 1998, provisional application No. 60/103,749, filed on Oct. 9, 1998, provisional application No. 60/099,062, filed on Sep. 2, 1998, provisional application No. 60/098,994, filed on Sep. 2, 1998, provisional application No. 60/094,869, filed on Jul. 31, 1998, provisional application No. 60/083,758, filed on May 1, 1998.

(51) Int. Cl.

| | |
|---|---|
| ***C07K 1/00*** | (2006.01) |
| ***A61K 38/04*** | (2006.01) |
| ***A61K 39/02*** | (2006.01) |
| ***A61K 39/095*** | (2006.01) |
| ***A61K 38/00*** | (2006.01) |

(52) U.S. Cl. ....................... 530/350; 530/328; 530/327; 530/326; 530/325; 530/324; 530/300; 530/806; 530/825; 424/234.1; 424/250.1; 424/190.1; 514/2

(58) Field of Classification Search ................. 530/300, 530/350, 324–328, 825, 806; 514/2; 424/234.1, 424/190.1, 249.1, 184.1

See application file for complete search history.

(56) References Cited

U.S. PATENT DOCUMENTS

| | | | | |
|---|---|---|---|---|
| 5,514,581 | A | 5/1996 | Ferrari et al. | 435/252.3 |
| 5,550,213 | A | 8/1996 | Anderson et al. | 530/324 |
| 5,554,372 | A | 9/1996 | Hunter | |
| 5,668,004 | A | 9/1997 | O'Donnell | 435/194 |
| 6,060,065 | A * | 5/2000 | Barney et al. | 424/209.1 |
| 6,355,253 | B1 | 3/2002 | Zlotnick | |
| 7,018,636 | B1 | 3/2006 | Bhattacharjee et al. | |
| 2004/0033234 | A1 | 2/2004 | Berinstein et al. | |
| 2007/0026021 | A1 | 2/2007 | Fraser et al. | |

FOREIGN PATENT DOCUMENTS

| | | |
|---|---|---|
| EP | 0 818 465 | 1/1998 |
| JP | 01144977 | 6/1989 |
| WO | WO-92/13871 | 8/1992 |
| WO | WO-94/08013 | 4/1994 |
| WO | WO-96/01901 | 1/1996 |
| WO | WO-96/29412 | 9/1996 |
| WO | WO-96/33276 | 10/1996 |
| WO | WO-97/13860 | 4/1997 |
| WO | WO-97/37044 | 10/1997 |
| WO | WO-2006024954 | 3/2006 |

OTHER PUBLICATIONS

Sambrook et al. Molecular Cloning, A Laboratory Manual, Second Edition, Cold Spring Harbor, pp. 17.1-17.44, 1989.*

Campbell AM In: Monoclonal Antibody Technology. Elsevier Science Publishers, The Netherlands, Chapter 1, pp. 1-32, 1984.*

The printed output from the NCBI open reading frame finder (12 pages provided as attachment).*

Kohara Y. (Aug. 12, 1994). "Caenorhabditis elegans cDNA clone yk26f2: 5' end, single read," Database accession No. D35881. Database EMBL [Online] EBI.

Smith C.J. et al. (1995). "Nucleotide sequence determination and genetic analysis of the Bacteroides plasmid, pBI143," Plasmid 34(3):211-222.

Dempsey J.A. et al. (Nov. 1995). "The physical map of the chromosome of a serogroup A strain of *Neisseria meningitidis* shows complex rearrangement relative to the chromosomes of the two mapped strains of the closely related species *N. gonorrhoeae*," Journal of Bacteriology 177(22):6390-6400.

Moxon, R.E. (Oct. 25, 1997). "Applications of molecular microbiology to vaccinology," Lancet (North American Edition) 350(9086): 1240-1244.

(Continued)

*Primary Examiner*—S. Devi
(74) *Attorney, Agent, or Firm*—Amy Hessler; Helen Lee; Robert Gorman

(57) ABSTRACT

The invention provides proteins from *Neisseria meningitidis*, including the amino acid sequences and the corresponding nucleotide sequences. The proteins are predicted to be useful antigens for vaccines and/or diagnostics.

8 Claims, 31 Drawing Sheets

OTHER PUBLICATIONS

Bernfield L. et al. (Sep. 2002). "Identification of a novel vaccine candidate for group B *Neisseria meningitidis*," Thirteenth International Pathogenic *Neisseria* Conference, Norwegian Institute of Public Health, Oslo, Norway, p. 116.

Farley J. et al. (Sep. 2002). "Characterization, cloning and expression of different subfamilies of the ORF 2086 gene from *Neisseria meningitidis*," Thirteenth International Pathogenic *Neisseria* Conference, Norwegian Institute of Public Health, Oslo, Norway, p. 124.

Masignani V. (Mar. 17, 2003). "Vaccination against *Neisseria meningitidis* using three variants of the lipoprotein GNA1870," J. Exp. Med. 197(6):789-799.

Fletcher L.D. et al. (Apr. 2004). "Vaccine potential of the *Neisseria meningitidis* 2086 lipoprotein," Infection and Immunity 72(4):2088-2100.

Baeumler, A. J. et al. (1993). "Hypothetical 29.6 kD Protein in PCP 5' Region (ORF1)," Database Swissprot AC P31485.

Baumler, A. J. and K. Hantke (1992). "A Lipoprotein of Yersinia Enterocolitica Facilitates Ferrioxamine.Uptake in *Escherichia coli*," Journal of Bacteriology 174(3): 1029-1035.

Blake, M. S. and L. M. Wetzler. (1995). "Vaccines for Gonorrhoea: Where are We on the Curve?" Trends in Microbiology 3(12): 469-474.

Burland, V. et al. (1994). "*Escherichia coli* K-12 Chromosomal Region From 92.8 to 00.1 Minutes," Database Empro1 AC U14003.

Conlin, C. A. et al. (1992). "*Escherichia coli* prlC Encodes an Endopeptidase and is Homologous to the *Salmonella typhimurium* opdA Gene," Journal of Bacteriology 174(18): 5881-5997.

Dillard, J. P. et al. (1997) "A Peptidoglcan Hydrolase Similar to Bacteriophage Endolysins Acts as an Autolysin in *Neisseria gonorrhoeae*," Molecular Microbiology 25(5): 893-907.

Fleischmann, R. D. et al. (1995). "Hypothetical Protein HI0753," Database Swissprot AC P44861.

Fleischmann, R. D. et al. (1995). "Oligopeptidase A (EC 3.4.24.70)," Database Swissprot AC P44573.

Hacker, J. et al. (1993). "Immunophilins: structure-function relationship and possible role in microbial pathogenicity," Molecular Microbiology 10(3): 445-456.

Huang, M. et al. (1995). "A Stomatin-Like Protein Necessary for Mechanosensation in C. Elegans," Nature 378(6554); 292-295.

Kaneko, T. (1996). "Membrane-Bound Lytic Transglycosylase A MItA Synechocystis sp. Strain PCC 6803," Database TrEMBLE AC Q55666.

Lommatzsch, J. et al. (1997). "Outer Membrane Localization of Murein Hydrolases: MItA, A Third Lipoprotein Lytic Transglycosynlase in *Escherichia coli*," Journal of Bacteriology 179(17): 5465-5470.

Mcallister, C. F. and D. S. Stephens. (1993). "Analysis in *Neisseria meningitidis* and other *Neisseria* species of genes homologous to the FKBP Immunophilin family," Molecular Microbiology 10(1): 13-23.

Mcallister, C. F. et al. (1993). "*Neisseria* Elongata NRL FKBP Immunophilin Homolog Gene," Database Empro2 AC U001198.

Poolman, J. T. (1995). "Development of a Meningococcal Vaccine," Infectious Agents and Disease 4(1): 13-28.

Quentin-Millet, M. J. et al. (1998) "*N. Meningitidis* HTR Tbp2 (de13777-385, de1407-465, de 1488-508)," *Database GCQ_GenesEQ* AC W14640.

Rokbi et al. (1998). "Transferrin Binding Protein B, TbpB, *Neisseria Meningitidis* , " Database TrEMBL AC 069750.

Rokbi, B. et al. (1997). "Evaluation of Recombinant Transferrin-Binding Protein B Variants from *Neisseria Meningitidis* for their Ability to Induce Cross-Reactive and Bactericidal Antibodies Against a Genetically Diverse Collection of Serogroup B Strains," Infection and Immunity 65(1): 55-63.

Rokbi, B. et al. (1997). "Heterogenelty of tbpB, the transferrin-binding protein B gene, among serogroup B *Neisseria meningitidis* strains of the ET-5 complex," Clinical and Diagnostic Laboratory Immunology 4(5): 522-529.

Sampson, B. and E. C. Gotschlich. (1992). "*Neisseria meningitidis* encodes an FK506-inhibitable rotamase," Proc. Natl. Acad, Sci. USA 89(4): 1164-1168.

Wong, C. Y. et al, (1997). "Cloning and characterization of two immunophilin-like genes, IlpA and fkpA, on a single 3.9-kilobase fragment of Aeromonas hydrophila genomic DNA," Journal of Bacteriology 179(11): 3397-3403.

You, Z. et al. (1997). "*Rhizobium Etli* Stomatin like Protein (slp) gene, complete cds.," Database Empro1 AC AF034831.

You, Z. et al. (1998). "A Stomatin-Like Protein Encoded by the slp Gene of *Rhizobium Etli* is Required for Nodulation Competitiveness on the Common Bean," Microbiology 144(9): 2619-2627.

1997-11-17-NM_shotgun.dbs (1928 pages) and 1997-12-15-NM.dbs (576 pages), located at <ftp://ftp.sanger.ac.uk/pub/pathogens/nm/old data/>.

Declaration by Dr. Julian Parkhill dated Jun. 12, 2008. 2 pages.

Bernfield et al., and Farley et al. (Sep. 1-6, 2002). *Thirteenth International Pathogenic Neisseria Conference*, pp. 116 and 124.

Cantini et a l. (Mar. 2006). "Solution Structure of the Immunodominant Domain of Protective Antigen GNA 1870 of *Neisseria meningitidis," Journal of Biological Chemistry* 281 (11): 7220-7227.

Fletcher et al. (2004). "Vaccine Potential of the *Neisseria meningitidis* 2086 Lipoprotein," *Infection and Immunity* 72(4): 2088-2100.

Giuliani et al. (Feb. 2005). "The Region Comprising Amino Acids 100 to 255 of *Neisseria meningitidis* Lipoprotein GNA 1870 Elicits Bactericidal Antibodies," Infection and Immunity 73(2): 1151-1160.

Lawrence, E. (1997). Henderson's Dictionary of Biological Terms, Eleventh Edition (1997). Longman Ltd. Definition of "epitope," Cover pages, Table of Contents, and pp. 37 and 184.

Tettelin et al. (Mar. 2000). "Complete Genome Sequence of *Neisseria meningitidis* Serogroup B Strain MC58," Science 287: 1809-1815.

Welsch et al. (2004). "Protective Activity of Monoclonal Antibodies to Genome-Derived Neisserial Antigen 1870, a *Neisseria meningitidis* Candidate Vaccine," The Journal of Immunology 172: 5606-5615.

Notice of Opposition mailed on Jul. 23, 2008 on behalf of Wyeth, directed to European Patent EP 1645631, granted on Oct. 24, 2007. 20 pages.

Houghten et al. New Approaches to Immunization, Vaccines86, Cold Spring Harbor Laboratory, p. 21-25, 1986.

McGuinness et al. (Feb. 1993). "Class 1 outer membrane protein of Neisseria meningitidis: epitope analysis of the antigenic diversity between strains, implications for subtype definition and molecular epidemiology," Mol. Microbiol. 7:505-514.

McGuinness et al. (Mar. 1991). "Point mutation in meningococcal porA gene associated with increased endemic disease," Lancet 337:514-517.

Rudinger et al. (Jun. 1976). Peptide Hormones. (Ed) JA Parsons, University Park Press.

* cited by examiner

FIGURE 1

919 (46 kDa)

A) PURIFICATION

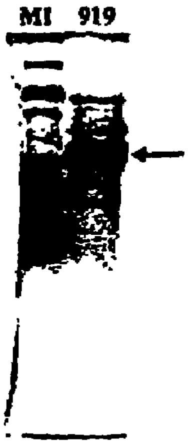

B) EXPRESSION

C) FACS.

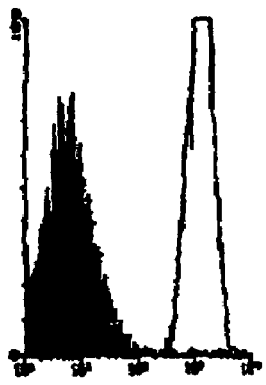

D) BACTERICIDAL ASSAY

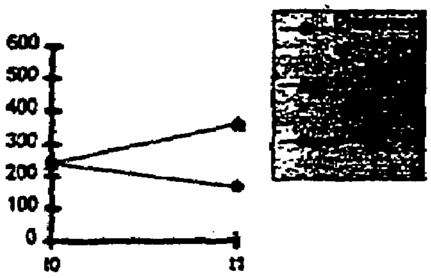

E) WESTERN BLOT

F) ELISA assay: positive

919

The predicted orf *919* was cloned in pET and pGex vectors and expressed in *E. coli*. The products of protein expression and purification were analyzed by SDS-PAGE. In panels A) and B) is shown the analysis of 919-His fusion protein purified on affinity column and 919-GST fusion protein expressed in *E. coli*, respectively. Mice were immunized with the purified 919-His and sera were used ELISA assay (panel F), Western blot (panel E) FACS analysis (panel C) and bactericidal assay (panel D). Results show that 919 is a surface-exposed protein. Symbols: M1, molecular weight markers; PP, purified protein, TP, *N. meningitidis* total protein extract; OMV, *N. meningitidis* outer membrane vesicle preparation. Arrows indicate the position of the main recombinant protein product (A and B) and the *N. meningitidis* immunoreactive band (E).

dc-132995

FIG. 2A
279 (10.5 kDa)
PURIFICATION
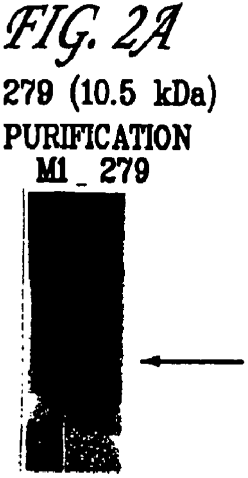
FIG. 2B
279 (10.5 kDa)
WESTERN BLOT
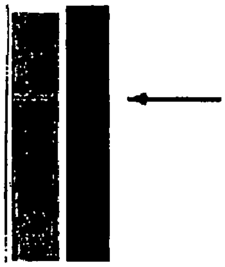
FIG. 2C
279 (10.5 kDa)
FACS
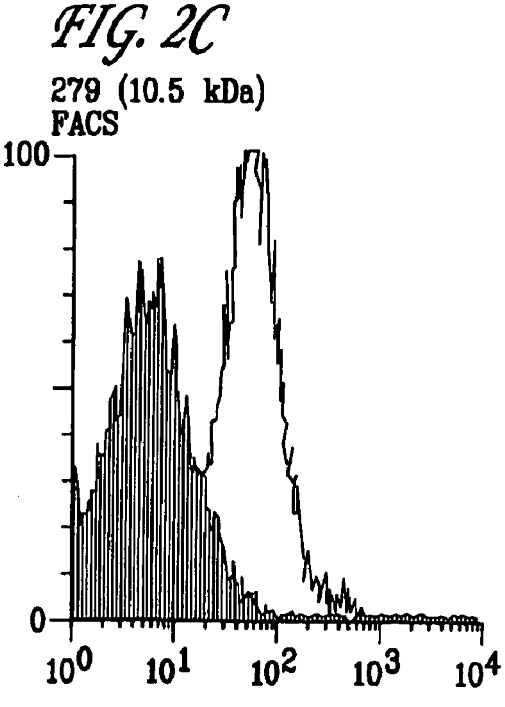
FIG. 2D
279 (10.5 kDa)
BACTERICIDAL ASSAY
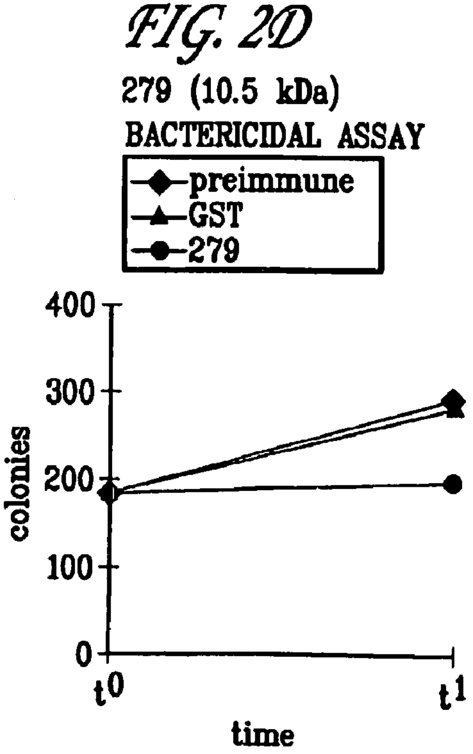
FIG. 2E
279 (10.5 kDa)
ELISA assay: positive FIG. 3A
576 (27.8 kDa)
PURIFICATION
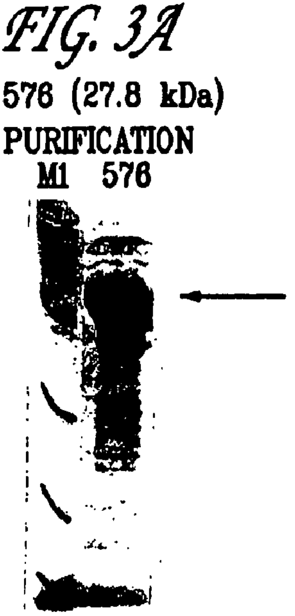
FIG. 3B
576 (27.8 kDa)
WESTERN BLOT
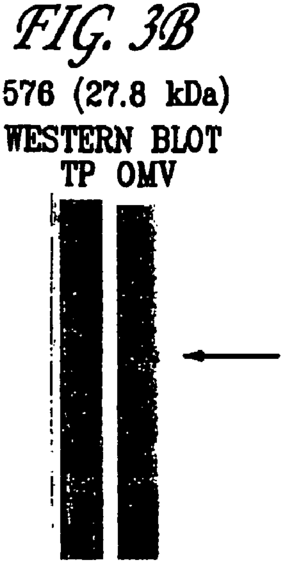
FIG. 3C
576 (27.8 kDa)
FACS
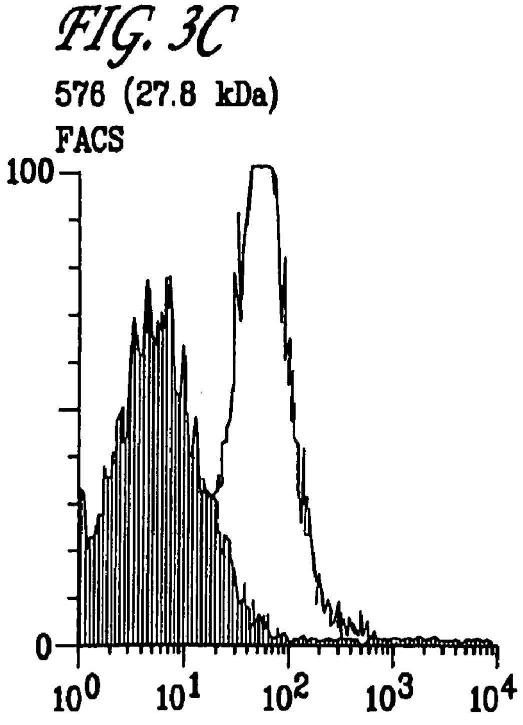
FIG. 3D
576 (27.8 kDa)
BACTERICIDAL ASSAY
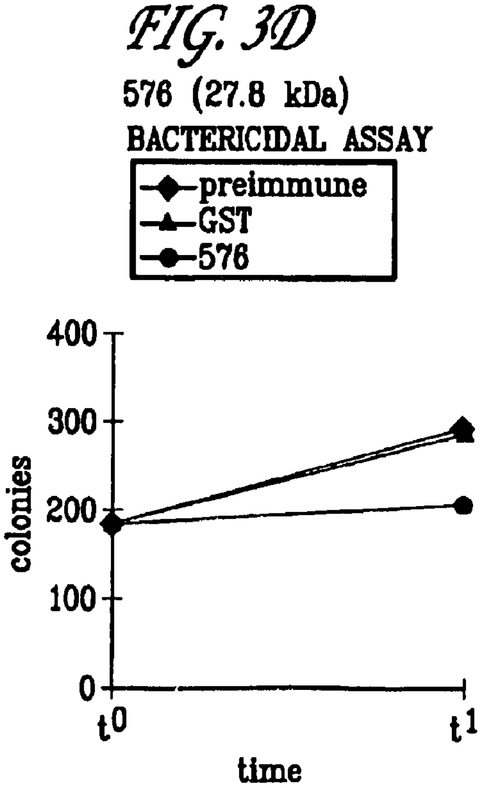
FIG. 3E
576 (27.8 kDa)
ELISA assay: <u>positive</u>

FIG. 4A
519 (33 kDa)
PURIFICATION
M1 519
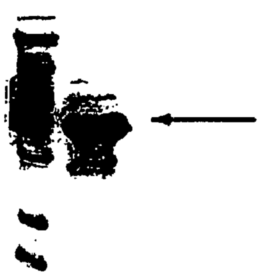
FIG. 4B
519 (33 kDa)
WESTERN BLOT
TP OMV
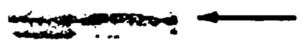
FIG. 4C
519 (33 kDa)
FACS
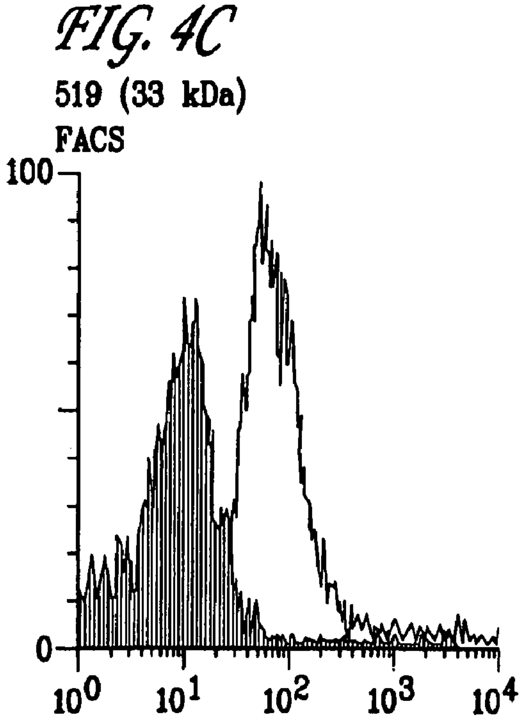
FIG. 4D
519 (33 kDa)
BACTERICIDAL ASSAY
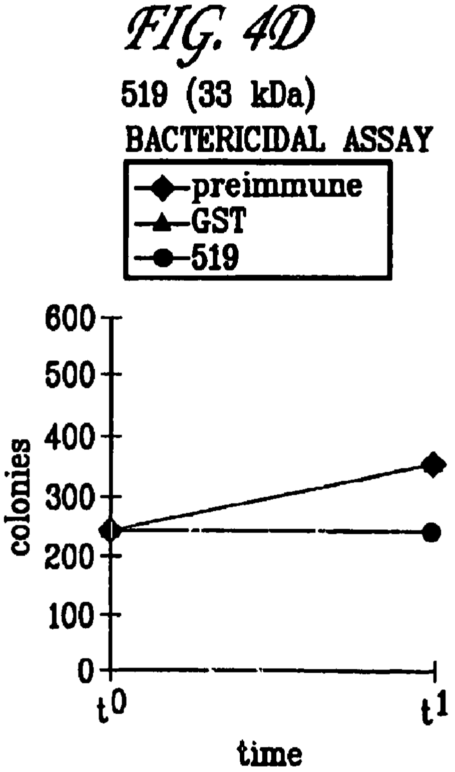
FIG. 4E
519 (33 kDa)
ELISA assay: <u>positive</u>

FIG. 5A
121 (40 kDa)
PURIFICATION
M1 121
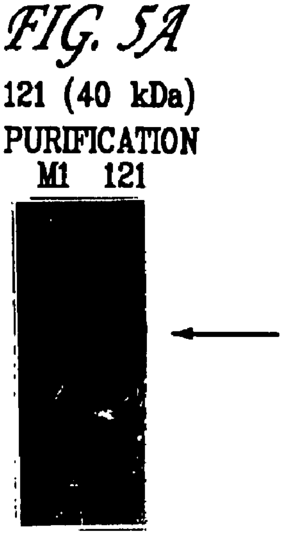
FIG. 5B
121 (40 kDa)
WESTERN BLOT
TP OMV
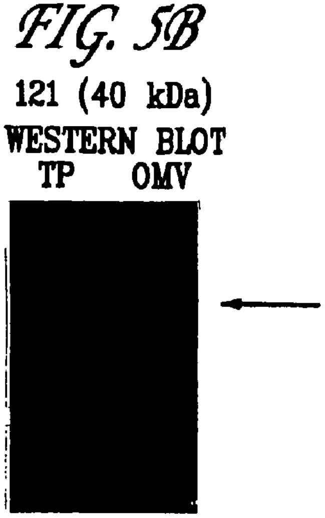
FIG. 5C
121 (40 kDa)
FACS
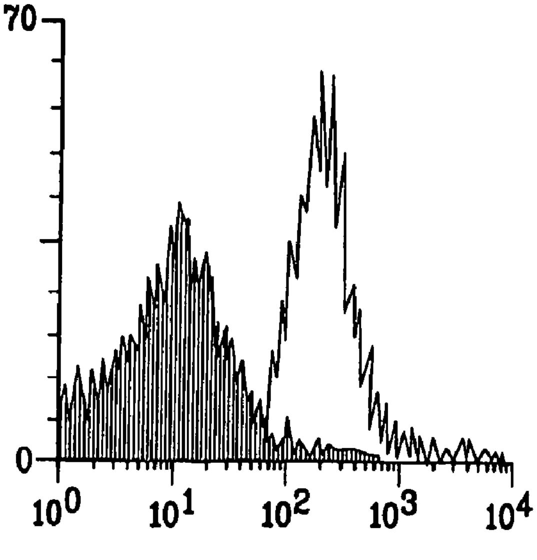
FIG. 5D
121 (40 kDa)
BACTERICIDAL ASSAY
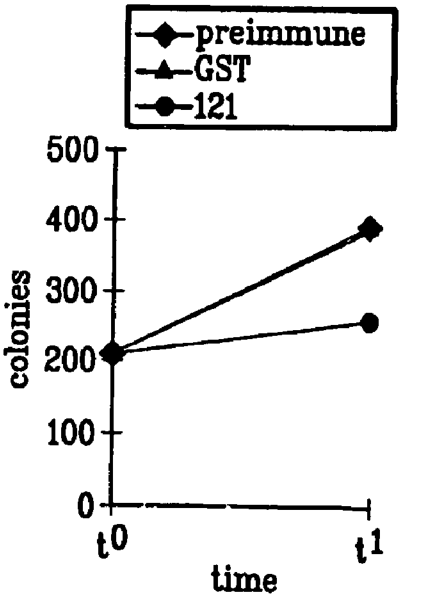
FIG. 5E
121 (40 kDa)
ELISA assay: <u>positive</u>

FIG. 6A
128 (101 kDa)
PURIFICATION
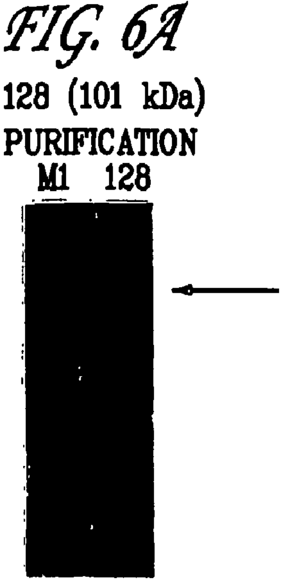
FIG. 6B
128 (101 kDa)
WESTERN BLOT
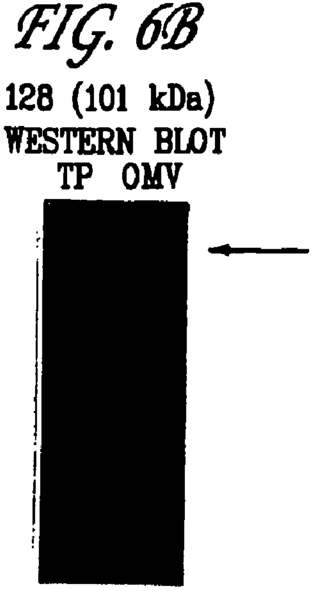
FIG. 6C
128 (101 kDa)
FACS
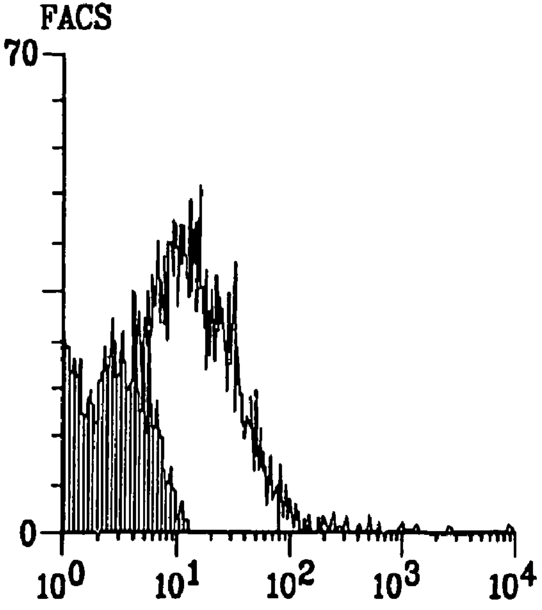
FIG. 6D
128 (101 kDa)
BACTERICIDAL ASSAY
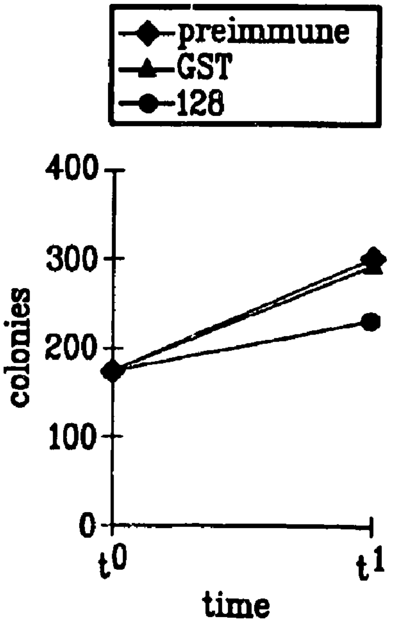
FIG. 6E
128 (101 kDa)
ELISA assay: positive FIG. 7A
206 (17 kDa)
PURIFICATION
M1 206
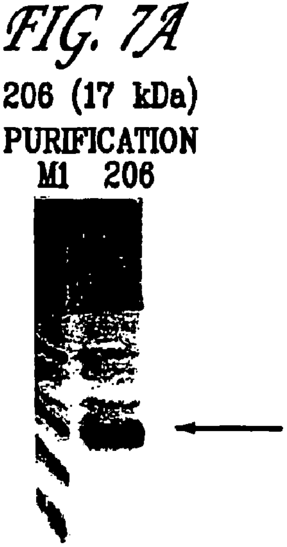
FIG. 7B
206 (17 kDa)
WESTERN BLOT
TP OMV
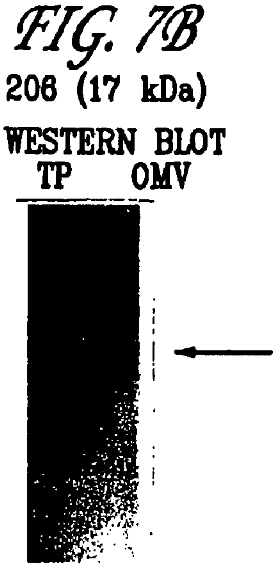
FIG. 7C
206 (17 kDa)
FACS
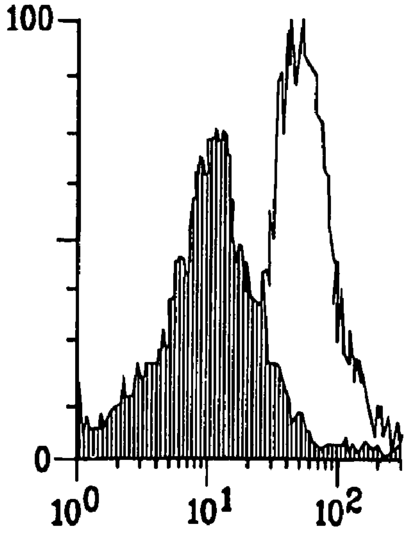
FIG. 7D
206 (17 kDa)
BACTERICIDAL ASSAY
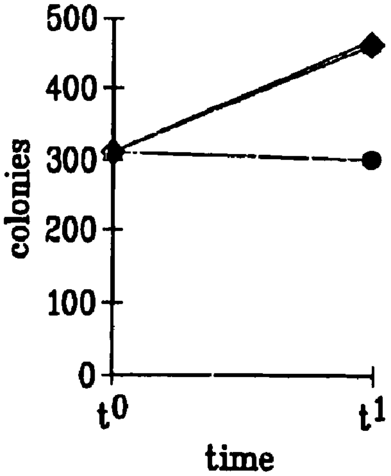
FIG. 7E
206 (17 kDa)
ELISA assay: positive FIG. 8A
287 (78 kDa)
PURIFICATION
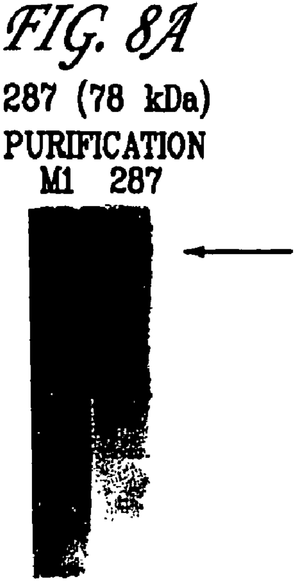
FIG. 8B
287 (78 kDa)
FACS
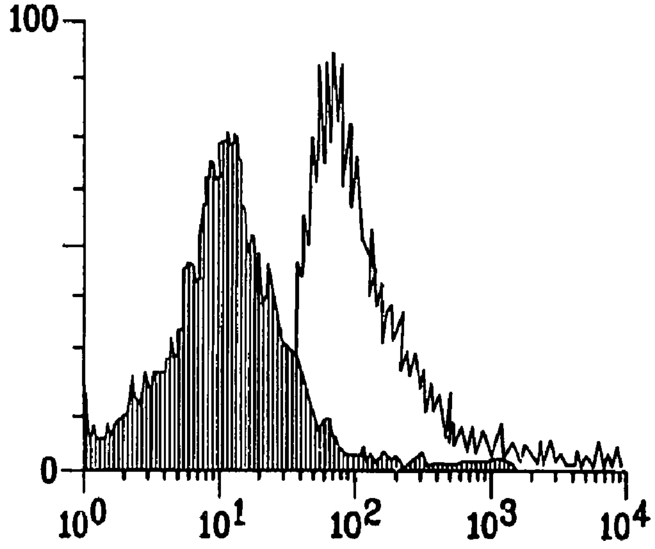
FIG. 8C
287 (78 kDa)
BACTERICIDAL ASSAY
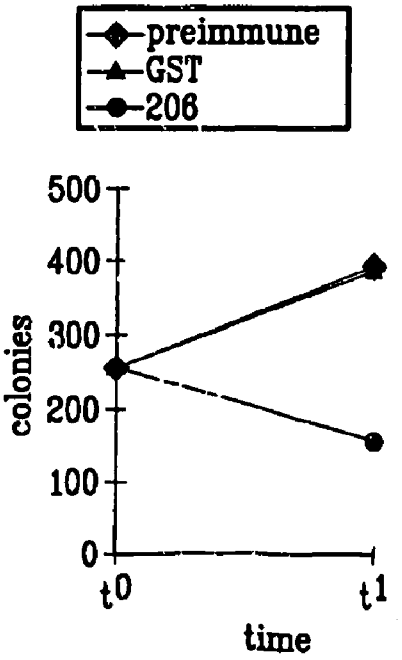
FIG. 8D
287 (78 kDa)
ELISA assay: positive FIG. 9A
406 (33 kDa)
PURIFICATION
M1 406
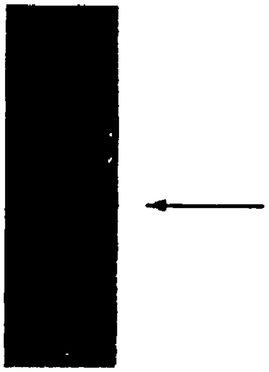
FIG. 9B
406 (33 kDa)
WESTERN BLOT
TP OMV
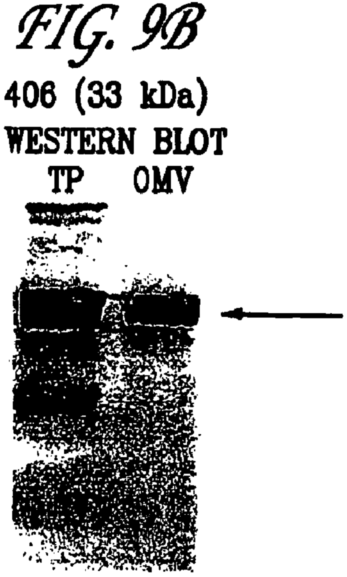
FIG. 9C
406 (33 kDa)
FACS
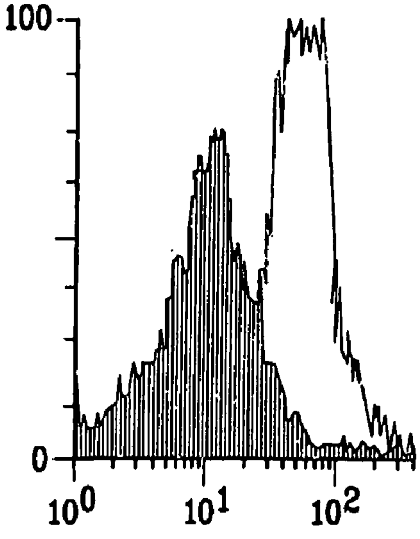
FIG. 9D
406 (33 kDa)
BACTERICIDAL ASSAY
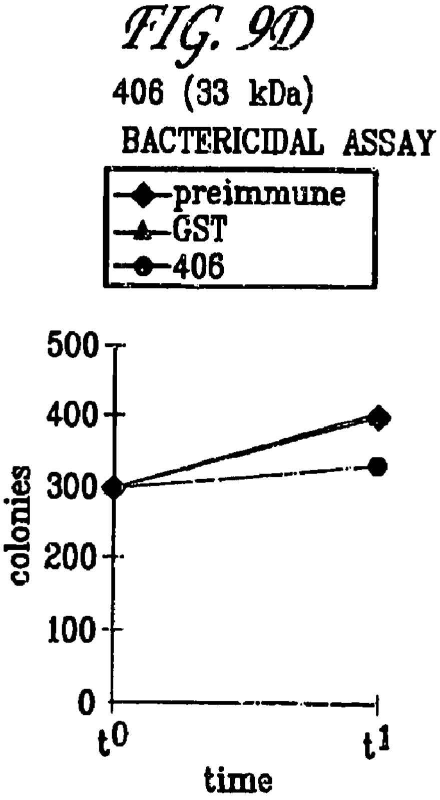
FIG. 9E
406 (33 kDa)
ELISA assay: positive

919

Hydrophilicity Plot, Antigenic Index and AMPHI Regions

279

Hydrophilicity Plot, Antigenic Index and AMPHI Regions

576-1
Hydrophilicity Plot, Antigenic Index and AMPHI Regions

519-1
Hydrophilicity Plot, Antigenic Index and AMPHI Regions

121-1
Hydrophilicity Plot, Antigenic Index and AMPHI Regions

128-1
Hydrophilicity Plot, Antigenic Index and AMPHI Regions

206

Hydrophilicity Plot, Antigenic Index and AMPHI Regions

287

Hydrophilicity Plot, Antigenic Index and AMPHI Regions

406
Hydrophilicity Plot, Antigenic Index and AMPHI Regions

```
zo05_225   1 MDSFFKPAVWAVLWLMFAVRPALADELTNLLSSREQILRQFAEDEQPVLPINRAPARRAG
zo08_225   1 MDSFFKPAVWAVLWLMFAVRPALADELTNLLSSREQILRQFAEDEQPVLPINRAPARRAG
z2491      1 MDSFFKPAVWAVLWLMFAVRPALADELTNLLSSREQILRQFAEDEQPVLPINRAPARRAG
zo11_225   1 MDSFFKPAVWAVLWLMFAVRPALADELTNLLSSREQILRQFAEDEQPVLPINRAPARRAG
zo20_225   1 MDSFFKPAVWAVLWLMFAVRPALADELTNLLSSREQILRQFAEDEQPVLPINRAPARRAG
zo01_225   1 MDSFFKPAVWAVLWLMFAVRPALADELTNLLSSREQILRQFAEDEQPVLPINRAPARRAG
zo09_225   1 MDSFFKPAVWAVLWLMFAVRPALADELTNLLSSREQILRQFAEDEQPVLPINRAPARRAG
zo12_225   1 MDSFFKPAVWAVLWLMFAVRPALADELTNLLSSREQILRQFAEDEQPVLPINRAPARRAG
zo22_225   1 MDSFFKPAVWAVLWLMFAVRPALADELTNLLSSREQILRQFAEDEQPVLPINRAPARRAG
zo23_225   1 MDSFFKPAVWAVLWLMFAVRPALADELTNLLSSREQILRQFAEDEQPVLPINRAPARRAG
zo24_225   1 MDSFFKPAVWAVLWLMFAVRPALADELTNLLSSREQILRQFAEDEQPVLPINRAPARRAG
zo25_225   1 MDSFFKPAVWAVLWLMFAVRPALADELTNLLSSREQILRQFAEDEQPVLPINRAPARRAG
zo26_225   1 MDSFFKPAVWAVLWLMFAVRPALADELTNLLSSREQILRQFAEDEQPVLPINRAPARRAG
zo96_225   1 MDSFFKPAVWAVLWLMFAVRPALADELTNLLSSREQILRQFAEDEQPVLPINRAPARRAG
zo02_225   1 MDSFFKPAVWAVLWLMFAVRPALADELTNLLSSREQILRQFAEDEQPVLPINRAPARRAG
zo04_225   1 MDSFFKPAVWAVLWLMFAVRPALADELTNLLSSREQILRQFAEDEQPVLPINRAPARRAG
zo06_225   1 MDSFFKPAVWAVLWLMFAVRPALADELTNLLSSREQILRQFAEDEQPVLPINRAPARRAG
zo07_225   1 MDSFFKPAVWAVLWLMFAVRPALADELTNLLSSREQILRQFAEDEQPVLPINRAPARRAG
zo10_225   1 MDSFFKPAVWAVLWLMFAVRPALADELTNLLSSREQILRQFAEDEQPVLPINRAPARRAG
zo14_225   1 MDSFFKPAVWAVLWLMFAVRPALADELTNLLSSREQILRQFAEDEQPVLPINRAPARRAG
zo16_225   1 MDSFFKPAVWAVLWLMFAVRPALADELTNLLSSREQILRQFAEDEQPVLPINRAPARRAG
zo17_225   1 MDSFFKPAVWAVLWLMFAVRPALADELTNLLSSREQILRQFAEDEQPVLPINRAPARRAG
zo18_225   1 MDSFFKPAVWAVLWLMFAVRPALADELTNLLSSREQILRQFAEDEQPVLPINRAPARRAG
zo19_225   1 MDSFFKPAVWAVLWLMFAVRPALADELTNLLSSREQILRQFAEDEQPVLPINRAPARRAG
zo21_225   1 MDSFFKPAVWAVLWLMFAVRPALADELTNLLSSREQILRQFAEDEQPVLPINRAPARRAG
zo27_225   1 MDSFFKPAVWAVLWLMFAVRPALADELTNLLSSREQILRQFAEDEQPVLPINRAPARRAG
zo28_225   1 MDSFFKPAVWAVLWLMFAVRPALADELTNLLSSREQILRQFAEDEQPVLPINRAPARRAG
zo29_225   1 MDSFFKPAVWAVLWLMFAVRPALADELTNLLSSREQILRQFAEDEQPVLPINRAPARRAG
zo13_225   1 MDSFFKPAVWAVLWLMFAVRPALADELTNLLSSREQILRQFAEDEQPVLPVNRAPARRAG
zo03_225   1 MDSFFKPAVWAVLWLMFAVRLALADELTNLLSSREQILRQFAEDEQPVLPINRAPARRAG
zo15_225   1 MDSFFKPAVWAVLWLMFAVRPALADELTNLLSSREQILRQFAEDEQPVLPINRAPARRAG
fa1090     1 MDSFFKPAVWAVLWLMFAVRPALADELTNLLSSREQILRQFAEDEQPVLPVNRAPARRAG
zo32_225   1 MDSFFKPAVWAVLWLMFAVRPALADELTNLLSSREQILRQFAEDEQPVLPVNRAPARRAG
zo33_225   1 MDSFFKPAVWAVLWLMFAVRSALADELTNLLSSREQILRQFAEDEQPVLPVNRAPARRAG

zo05_225  61 NADELIGSAMGLNE.............................QPVLPVNRVPARRAGNA
zo08_225  61 NADELIGSAMGLNE.............................QPVLPVNRVPARRAGNA
z2491     61 NADELIGSAMGLNEQPVLPVNRVPARRAGNADELIGNAMGLNEQPVLPVNRVPARRAGNA
zo11_225  61 NADELIGSAMGLNEQPVLPVNRVPARRAGNADELIGNAMGLNEQPVLPVNRAPARRAGNA
zo20_225  61 NADELIGSAMGLNEQPVLPINRAPARRAGNADELIGSAMGLNEQPVLPVNRVPARRAGNA
zo01_225  61 NADELIGSAMGLNE.............................QPVLPVNRVPARRAGNA
zo09_225  61 NADELIGSAMGLNE.............................QPVLPVNRVPARRAGNA
zo12_225  61 NADELIGSAMGLNE.............................QPVLPVNRVPARRAGNA
zo22_225  61 NADELIGSAMGLNE.............................QPVLPVNRVPARRAGNA
zo23_225  61 NADELIGSAMGLNE.............................QPVLPVNRVPARRAGNA
zo24_225  61 NADELIGSAMGLNE.............................QPVLPVNRVPARRAGNA
zo25_225  61 NADELIGSAMGLNE.............................QPVLPVNRVPARRAGNA
zo26_225  61 NADELIGSAMGLNE.............................QPVLPVNRVPARRAGNA
zo96_225  61 NADELIGSAMGLNE.............................QPVLPVNRVPARRAGNA
zo02_225  61 NADELIGSAMGLNE.............................QPVLPVNRVPARRAGNA
zo04_225  61 NADELIGSAMGLNE.............................QPVLPVNRVPARRAGNA
zo06_225  61 NADELIGSAMGLNE.............................QPVLPVNRVPARRAGNA
zo07_225  61 NADELIGSAMGLNE.............................QPVLPVNRVPARRAGNA
zo10_225  61 NADELIGSAMGLNE.............................QPVLPVNRVPARRAGNA
zo14_225  61 NADELIGSAMGLNE.............................QPVLPVNRVPARRAGNA
zo16_225  61 NADELIGSAMGLNE.............................QPVLPVNRVPARRAGNA
zo17_225  61 NADELIGSAMGLNE.............................QPVLPVNRVPARRAGNA
zo18_225  61 NADELIGSAMGLNE.............................QPVLPVNRVPARRAGNA
zo19_225  61 NADELIGSAMGLNE.............................QPVLPVNRVPARRAGNA
zo21_225  61 NADELIGSAMGLNE.............................QPVLPVNRVPARRAGNA
zo27_225  61 NADELIGSAMGLNE.............................QPVLPVNRVPARRAGNA
zo28_225  61 NADELIGSAMGLNE.............................QPVLPVNRVPARRAGNA
zo29_225  61 NADELIGSAMGLNE.............................QPVLPVNRVPARRAGNA
zo13_225  61 NADELIGSAMGLNE.............................QPVLPVNRVPARRAGNA
zo03_225  61 NADELIGSAMGLNE.............................QPVLPVNRVPARRAGNA
zo15_225  61 NADELIGSAMGLNE..............................................
fa1090    61 NADELIGSAMGLNE..............................................
zo32_225  61 NADELIGSAMGLNE..............................................
zo33_225  61 NADELIGSAMGLNE..............................................
```

FIG. 19A

| | | |
|---|---|---|
| zo05_225 | 92 | DELIGSAMGLNEQPVLPVNRAPARRAGNADELIGNAMGLLGIAYRYGGTSISTGFDCSGF |
| zo08_225 | 92 | DELIGSAMGLNEQPVLPVNRAPARRAGNADELIGNAMGLLGIAYRYGGTSISTGFDCSGF |
| z2491 | 121 | DELIGNAMGLNEQPVLPVNRAPARRAGNADELIGNAMGLLGIAYRYGGTSISTGFDCSGF |
| zo11_225 | 121 | DELIGNAMGLNEQPVLPVNRAPARRAGNADELIGNAMGLLGIAYRYGGTSVSTGFDCSGF |
| zo20_225 | 121 | DELIGNAMGLNEQPVLPVNRAPARRAGNADELIGNAMGLLGIAYRYGGTSVSTGFDCSGF |
| zo01_225 | 92 | DELIGNAMGLNEQPVLPVNRAPARRAGNADELIGNAMGLLGIAYRYGGTSISTGFDCSGF |
| zo09_225 | 92 | DELIGNAMGLNEQPVLPVNRAPARRAGNADELIGNAMGLLGIAYRYGGTSISTGFDCSGF |
| zo12_225 | 92 | DELIGNAMGLNEQPVLPVNRAPARRAGNADELIGNAMGLLGIAYRYGGTSISTGFDCSGF |
| zo22_225 | 92 | DELIGNAMGLNEQPVLPVNRAPARRAGNADELIGNAMGLLGIAYRYGGTSISTGFDCSGF |
| zo23_225 | 92 | DELIGNAMGLNEQPVLPVNRAPARRAGNADELIGNAMGLLGIAYRYGGTSISTGFDCSGF |
| zo24_225 | 92 | DELIGNAMGLNEQPVLPVNRAPARRAGNADELIGNAMGLLGIAYRYGGTSISTGFDCSGF |
| zo25_225 | 92 | DELIGNAMGLNEQPVLPVNRAPARRAGNADELIGNAMGLLGIAYRYGGTSISTGFDCSGF |
| zo26_225 | 92 | DELIGNAMGLNEQPVLPVNRAPARRAGNADELIGNAMGLLGIAYRYGGTSISTGFDCSGF |
| zo96_225 | 92 | DELIGNAMGLNEQPVLPVNRAPARRAGNADELIGNAMGLLGIAYRYGGTSISTGFDCSGF |
| zo02_225 | 92 | DELIGNAMGLNEQPVLPVNRAPARRAGNADELIGNAMGLLGIAYRYGGTSVSTGFDCSGF |
| zo04_225 | 92 | DELIGNAMGLNEQPVLPVNRAPARRAGNADELIGNAMGLLGIAYRYGGTSVSTGFDCSGF |
| zo06_225 | 92 | DELIGNAMGLNEQPVLPVNRAPARRAGNADELIGNAMGLLGIAYRYGGTSVSTGFDCSGF |
| zo07_225 | 92 | DELIGNAMGLNEQPVLPVNRAPARRAGNADELIGNAMGLLGIAYRYGGTSVSTGFDCSGF |
| zo10_225 | 92 | DELIGNAMGLNEQPVLPVNRAPARRAGNADELIGNAMGLLGIAYRYGGTSVSTGFDCSGF |
| zo14_225 | 92 | DELIGNAMGLNEQPVLPVNRAPARRAGNADELIGNAMGLLGIAYRYGGTSVSTGFDCSGF |
| zo16_225 | 92 | DELIGNAMGLNEQPVLPVNRAPARRAGNADELIGNAMGLLGIAYRYGGTSVSTGFDCSGF |
| zo17_225 | 92 | DELIGNAMGLNEQPVLPVNRAPARRAGNADELIGNAMGLLGIAYRYGGTSVSTGFDCSGF |
| zo18_225 | 92 | DELIGNAMGLNEQPVLPVNRAPARRAGNADELIGNAMGLLGIAYRYGGTSVSTGFDCSGF |
| zo19_225 | 92 | DELIGNAMGLNEQPVLPVNRAPARRAGNADELIGNAMGLLGIAYRYGGTSVSTGFDCSGF |
| zo21_225 | 92 | DELIGNAMGLNEQPVLPVNRAPARRAGNADELIGNAMGLLGIAYRYGGTSVSTGFDCSGF |
| zo27_225 | 92 | DELIGNAMGLNEQPVLPVNRAPARRAGNADELIGNAMGLLGIAYRYGGTSVSTGFDCSGF |
| zo28_225 | 92 | DELIGNAMGLNEQPVLPVNRAPARRAGNADELIGNAMGLLGIAYRYGGTSVSTGFDCSGF |
| zo29_225 | 92 | DELIGNAMGLNEQPVLPVNRAPARRAGNADELIGNAMGLLGIAYRYGGTSVSTGFDCSGF |
| zo13_225 | 92 | DELIGNAMGLNEQPVLPVNRAPARRAGNADELIGNAMGLLGIAYRYGGTSVSTGFDCSGF |
| zo03_225 | 92 | DELIGNAMGLNEQPVLPVNRAPARRAGNADELIGNAMGLLGIAYRYGGTSVSTGFDCSGF |
| zo15_225 | 75 | ............QPVLPVNRVPARRAGNADELIGNAMGLLGIAYRYGGTSVSTGFDCSGF |
| fa1090 | 75 | ............QPVLPVNRAPARRAGNADELIGSAMGLLGIAYRYGGTSVSTGFDCSGF |
| zo32_225 | 75 | ............QPVLPVNRAPARRAGNADELIGSAMGLLGIAYRYGGTSVSTGFDCSGF |
| zo33_225 | 75 | ............QPVLPVNRAPARRAGNADELIGSAMGLLGIAYRYGGTSVSTGFDCSGF |

| | | |
|---|---|---|
| zo05_225 | 152 | MQHIFKRAMGINLPRTSAEQARMGTPVARSELQPGDMVFFRTLGGSRISHVGLYIGNNRF |
| zo08_225 | 152 | MQHIFKRAMGINLPRTSAEQARMGTPVARSELQPGDMVFFRTLGGSRISHVGLYIGNNRF |
| z2491 | 181 | MQHIFKRAMGINLPRTSAEQARMGTPVARSELQPGDMVFFRTLGGSRISHVGLYIGNNRF |
| zo11_225 | 181 | MQHIFKRAMGINLPRTSAEQARMGTPVARSELQPGDMVFFRTLGGSRISHVGLYIGNNRF |
| zo20_225 | 181 | MQHIFKRAMGINLPRTSAEQARMGTPVARSELQPGDMVFFRTLGGSRISHVGLYIGNNRF |
| zo01_225 | 152 | MQHIFKRAMGINLPRTSAEQARMGTPVARSELQPGDMVFFRTLGGSRISHVGLYIGNNRF |
| zo09_225 | 152 | MQHIFKRAMGINLPRTSAEQARMGTPVARSELQPGDMVFFRTLGGSRISHVGLYIGNNRF |
| zo12_225 | 152 | MQHIFKRAMGINLPRTSAEQARMGTPVARSELQPGDMVFFRTLGGSRISHVGLYIGNNRF |
| zo22_225 | 152 | MQHIFKRAMGINLPRTSAEQARMGTPVARSELQPGDMVFFRTLGGSRISHVGLYIGNNRF |
| zo23_225 | 152 | MQHIFKRAMGINLPRTSAEQARMGTPVARSELQPGDMVFFRTLGGSRISHVGLYIGNNRF |
| zo24_225 | 152 | MQHIFKRAMGINLPRTSAEQARMGTPVARSELQPGDMVFFRTLGGSRISHVGLYIGNNRF |
| zo25_225 | 152 | MQHIFKRAMGINLPRTSAEQARMGTPVARSELQPGDMVFFRTLGGSRISHVGLYIGNNRF |
| zo26_225 | 152 | MQHIFKRAMGINLPRTSAEQARMGTPVARSELQPGDMVFFRTLGGSRISHVGLYIGNNRF |
| zo96_225 | 152 | MQHIFKRAMGINLPRTSAEQARMGTPVARSELQPGDMVFFRTLGGSRISHVGLYIGNNRF |
| zo02_225 | 152 | MQHIFKRAMGINLPRTSAEQARMGTPVARSELQPGDMVFFRTLGGSRISHVGLYIGNNRF |
| zo04_225 | 152 | MQHIFKRAMGINLPRTSAEQARMGTPVARSELQPGDMVFFRTLGGSRISHVGLYIGNNRF |
| zo06_225 | 152 | MQHIFKRAMGINLPRTSAEQARMGTPVARSELQPGDMVFFRTLGGSRISHVGLYIGNNRF |
| zo07_225 | 152 | MQHIFKRAMGINLPRTSAEQARMGTPVARSELQPGDMVFFRTLGGSRISHVGLYIGNNRF |
| zo10_225 | 152 | MQHIFKRAMGINLPRTSAEQARMGTPVARSELQPGDMVFFRTLGGSRISHVGLYIGNNRF |
| zo14_225 | 152 | MQHIFKRAMGINLPRTSAEQARMGTPVARSELQPGDMVFFRTLGGSRISHVGLYIGNNRF |
| zo16_225 | 152 | MQHIFKRAMGINLPRTSAEQARMGTPVARSELQPGDMVFFRTLGGSRISHVGLYIGNNRF |
| zo17_225 | 152 | MQHIFKRAMGINLPRTSAEQARMGTPVARSELQPGDMVFFRTLGGSRISHVGLYIGNNRF |
| zo18_225 | 152 | MQHIFKRAMGINLPRTSAEQARMGTPVARSELQPGDMVFFRTLGGSRISHVGLYIGNNRF |
| zo19_225 | 152 | MQHIFKRAMGINLPRTSAEQARMGTPVARSELQPGDMVFFRTLGGSRISHVGLYIGNNRF |
| zo21_225 | 152 | MQHIFKRAMGINLPRTSAEQARMGTPVARSELQPGDMVFFRTLGGSRISHVGLYIGNNRF |
| zo27_225 | 152 | MQHIFKRAMGINLPRTSAEQARMGTPVARSELQPGDMVFFRTLGGSRISHVGLYIGNNRF |
| zo28_225 | 152 | MQHIFKRAMGINLPRTSAEQARMGTPVARSELQPGDMVFFRTLGGSRISHVGLYIGNNRF |
| zo29_225 | 152 | MQHIFKRAMGINLPRTSAEQARMGTPVARSELQPGDMVFFRTLGGSRISHVGLYIGNNRF |
| zo13_225 | 152 | IQHIFKRAMGINLPRTSAEQARMGTPVARSELQPGDMVFFRTLGGSRISHVGLYIGNNRF |
| zo03_225 | 152 | MQHIFKRAMGINLPRTSAEQARMGTPVARSELQPGDMVFFRTLGGSRISHVGLYIGNNRF |
| zo15_225 | 123 | MQHIFKRAMGINLPRTSAEQARMGTPVARSELQPGDMVFFRTLGGSRISHVGLYIGNNRF |
| fa1090 | 123 | MQHIFKRAMGINLPRTSAEQARMGAPVARSELQPGDMVFFRTLGGSRISHVGLYIGNNRF |
| zo32_225 | 123 | MQHIFKRAMGINLPRTSAEQARMGAPVARSELQPGDMVFFRTLGGSRISHVGLYIGNNRF |
| zo33_225 | 123 | MQHIFKRAMGINLPRTSAEQARMGAPVARSELQPGDMVFFRTLGGSRISHVGLYIGNNRF |

FIG. 19B

| | | |
|---|---|---|
| zo05_225 | 212 | IHAPRTGKNIEITSLSHKYWSGKYAFARRVKKNDPSRFLN* |
| zo08_225 | 212 | IHAPRTGKNIEITSLSHKYWSGKYAFARRVKKNDPSRFLN* |
| z2491 | 241 | IHAPRTGKNIEITSLSHKYWSGKYAFARRVKKNDPSRFLN* |
| zo11_225 | 241 | IHAPRTGKNIEITSLSHKYWSGKYAFARRVKKNDPSRFLN* |
| zo20_225 | 241 | IHAPRTGKNIEITSLSHKYWSGKYAFARRVKKNDPSRFLN* |
| zo01_225 | 212 | IHAPRTGKNIEITSLSHKYWSGKYAFARRVKKNDPSRFLN* |
| zo09_225 | 212 | IHAPRTGKNIEITSLSHKYWSGKYAFARRVKKNDPSRFLN* |
| zo12_225 | 212 | IHAPRTGKNIEITSLSHKYWSGKYAFARRVKKNDPSRFLN* |
| zo22_225 | 212 | IHAPRTGKNIEITSLSHKYWSGKYAFARRVKKNDPSRFLN* |
| zo23_225 | 212 | IHAPRTGKNIEITSLSHKYWSGKYAFARRVKKNDPSRFLN* |
| zo24_225 | 212 | IHAPRTGKNIEITSLSHKYWSGKYAFARRVKKNDPSRFLN* |
| zo25_225 | 212 | IHAPRTGKNIEITSLSHKYWSGKYAFARRVKKNDPSRFLN* |
| zo26_225 | 212 | IHAPRTGKNIEITSLSHKYWSGKYAFARRVKKNDPSRFLN* |
| zo96_225 | 212 | IHAPRTGKNIEITSLSHKYWSGKYAFARRVKKNDPSRFLN* |
| zo02_225 | 212 | IHAPRTGKNIEITSLSHKYWSGKYAFARRVKKNDPSRFLN* |
| zo04_225 | 212 | IHAPRTGKNIEITSLSHKYWSGKYAFARRVKKNDPSRFLN* |
| zo06_225 | 212 | IHAPRTGKNIEITSLSHKYWSGKYAFARRVKKNDPSRFLN* |
| zo07_225 | 212 | IHAPRTGKNIEITSLSHKYWSGKYAFARRVKKNDPSRFLN* |
| zo10_225 | 212 | IHAPRTGKNIEITSLSHKYWSGKYAFARRVKKNDPSRFLN* |
| zo14_225 | 212 | IHAPRTGKNIEITSLSHKYWSGKYAFARRVKKNDPSRFLN* |
| zo16_225 | 212 | IHAPRTGKNIEITSLSHKYWSGKYAFARRVKKNDPSRFLN* |
| zo17_225 | 212 | IHAPRTGKNIEITSLSHKYWSGKYAFARRVKKNDPSRFLN* |
| zo18_225 | 212 | IHAPRTGKNIEITSLSHKYWSGKYAFARRVKKNDPSRFLN* |
| zo19_225 | 212 | IHAPRTGKNIEITSLSHKYWSGKYAFARRVKKNDPSRFLN* |
| zo21_225 | 212 | IHAPRTGKNIEITSLSHKYWSGKYAFARRVKKNDPSRFLN* |
| zo27_225 | 212 | IHAPRTGKNIEITSLSHKYWSGKYAFARRVKKNDPSRFLN* |
| zo28_225 | 212 | IHAPRTGKNIEITSLSHKYWSGKYAFARRVKKNDPSRFLN* |
| zo29_225 | 212 | IHAPRTGKNIEITSLSHKYWSGKYAFARRVKKNDPSRFLN* |
| zo13_225 | 212 | IHAPRTGKNIEITSLSHKYWSGKYAFARRVKKNDPSRFLN* |
| zo03_225 | 212 | IHAPRTGKNIEITSLSHKYWSGKYAFARRVKKNDPSRFLN* |
| zo15_225 | 183 | IHAPRTGKNIEITSLSHKYWSGKYAFARRVKKNDPSRFLN* |
| fa1090 | 183 | IHAPRTGKNIEITSLSHKYWSGKYAFARRVKKNDPSRFLN* |
| zo32_225 | 183 | IHAPRTGKNIEITSLSHKYWSGKYAFARRVKKNDPSRFLN* |
| zo33_225 | 183 | IHAPRTGKNIEITSLSHKYWSGKYAFARRIKKNDPSRFLN* |

Fig. 19C

```
gnmzq09  1  MKPLILGLAAALVLSACQVQKAPDFDYTSFKESKPASILVVPPLNESPDVNGTWGMLAST
gnmzq31  1  MKPLILGLAAVLALSACQVQKAPDFDYTAFKESKPASILVVPPLNESPDVNGTWGMLAST
fa1090   1  MKPLILGLAAVLALSACQVRKAPDLDYTSFKESKPASILVVPPLNESPDVNGTWGMLAST
gnmzq32  1  MKPLILGLAAVLALSACQVRKAPDLDYTSFKESKPASILVVPPLNESPDVNGTWGMLAST
gnmzq33  1  MKPLILGLAAVLALSACQVRKAPDLDYTSFKESKPASILVVPPLNESPDVNGTWGMLAST
gnmzq01  1  MKPLILGLAAVLALSACQVQKAPDFDYTSFKESKPASILVVPPLNESPDVNGTWGVLAST
gnmzq05  1  MKPLILGLAAVLALSACQVQKAPDFDYTSFKESKPASILVVPPLNESPDVNGTWGVLAST
gnmzq08  1  MKPLILGLAAVLALSACQVQKAPDFDYTSFKESKPASILVVPPLNESPDVNGTWGVLAST
gnmzq02  1  MKPLILGLAAVLALSACQVQKAPDFDYTSFKESKPASILVVPPLNESPDVNGTWGVLAST
gnmzq03  1  MKPLILGLAAVLALSACQVQKAPDFDYTSFKESKPASILVVPPLNESPDVNGTWGVLAST
gnmzq04  1  MKPLILGLAAVLALSACQVQKAPDFDYTSFKESKPASILVVPPLNESPDVNGTWGVLAST
gnmzq07  1  MKPLILGLAAVLALSACQVQKAPDFDYTSFKESKPASILVVPPLNESPDVNGTWGVLAST
gnmzq10  1  MKPLILGLAAVLALSACQVQKAPDFDYTSFKESKPASILVVPPLNESPDVNGTWGVLAST
gnmzq11  1  MKPLILGLAAVLALSACQVQKAPDFDYTSFKESKPASILVVPPLNESPDVNGTWGVLAST
gnmzq13  1  MKPLILGLAAVLALSACQVQKAPDFDYTSFKESKPASILVVPPLNESPDVNGTWGVLAST
gnmzq15  1  MKPLILGLAAVLALSACQVQKAPDFDYTSFKESKPASILVVPPLNESPDVNGTWGVLAST
gnmzq16  1  MKPLILGLAAVLALSACQVQKAPDFDYTSFKESKPASILVVPPLNESPDVNGTWGVLAST
gnmzq17  1  MKPLILGLAAVLALSACQVQKAPDFDYTSFKESKPASILVVPPLNESPDVNGTWGVLAST
gnmzq19  1  MKPLILGLAAVLALSACQVQKAPDFDYTSFKESKPASILVVPPLNESPDVNGTWGVLAST
gnmzq21  1  MKPLILGLAAVLALSACQVQKAPDFDYTSFKESKPASILVVPPLNESPDVNGTWGVLAST
gnmzq22  1  MKPLILGLAAVLALSACQVQKAPDFDYTSFKESKPASILVVPPLNESPDVNGTWGVLAST
gnmzq23  1  MKPLILGLAAVLALSACQVQKAPDFDYTSFKESKPASILVVPPLNESPDVNGTWGVLAST
gnmzq24  1  MKPLILGLAAVLALSACQVQKAPDFDYTSFKESKPASILVVPPLNESPDVNGTWGVLAST
gnmzq25  1  MKPLILGLAAVLALSACQVQKAPDFDYTSFKESKPASILVVPPLNESPDVNGTWGVLAST
gnmzq27  1  MKPLILGLAAVLALSACQVQKAPDFDYTSFKESKPASILVVPPLNESPDVNGTWGVLAST
gnmzq28  1  MKPLILGLAAVLALSACQVQKAPDFDYTSFKESKPASILVVPPLNESPDVNGTWGVLAST
gnmzq29  1  MKPLILGLAAVLALSACQVQKAPDFDYTSFKESKPASILVVPPLNESPDVNGTWGVLAST
z2491    1  MKPLILGLAAVLALSACQVQKAPDFDYTSFKESKPASILVVPPLNESPDVNGTWGVLAST
gnmzq14  1  MKPLILGLAAVLALSACQVQKAPDFDYTSFKESKPASILVVPPLNESPDVNGTWGVLAST
gnmzq18  1  MKPLILGLAAVLALSACQVQKAPDFDYTSFKESKPASILVVPPLNESPDVNGTWGVLAST
gnmzq26  1  MKPLILGLAAVLALSACQVQKAPDFDYTSFKESKPASILVVPPLNESPDVNGTWGMLAST

gnmzq09  61  AEPLSEAGYYVFPAAVVEETFKQNGLTNAADIHAVQPEKLHQIFGNDAVLYITITEYGTS
gnmzq31  61  AEPLSEAGYYVFPAAVVEETFKQNGLTNAADIHAVRPEKLHQIFGNDAVLYITITEYGTS
fa1090   61  AAPISEAGYYVFPAAVVEETFKENGLTNAADIHAVRPEKLHQIFGNDAVLYITVTEYGTS
gnmzq32  61  AAPISEAGYYVFPAAVVEETFKENGLTNAADIHAVRPEKLHQIFGNDAVLYITVTEYGTS
gnmzq33  61  AAPISEAGYYVFPAAVVEETFKENGLTNAADIHAVRPEKLHQIFGNDAVLYITVTEYGTS
gnmzq01  61  AAPLSEAGYYVFPAAVVEETFKENGLTNAADIHAVRPEKLHQIFGNDAVLYITVTEYGTS
gnmzq05  61  AAPLSEAGYYVFPAAVVEETFKENGLTNAADIHAVRPEKLHQIFGNDAVLYITVTEYGTS
gnmzq08  61  AAPLSEAGYYVFPAAVVEETFKENGLTNAADIHAVRPEKLHQIFGNDAVLYITVTEYGTS
gnmzq02  61  AAPLSEAGYYVFPAAVVEETFKQNGLTNAADIHAVRPEKLHQIFGNDAVLYITVTEYGTS
gnmzq03  61  AAPLSEAGYYVFPAAVVEETFKQNGLTNAADIHAVRPEKLHQIFGNDAVLYITVTEYGTS
gnmzq04  61  AAPLSEAGYYVFPAAVVEETFKQNGLTNAADIHAVRPEKLHQIFGNDAVLYITVTEYGTS
gnmzq07  61  AAPLSEAGYYVFPAAVVEETFKQNGLTNAADIHAVRPEKLHQIFGNDAVLYITVTEYGTS
gnmzq10  61  AAPLSEAGYYVFPAAVVEETFKQNGLTNAADIHAVRPEKLHQIFGNDAVLYITVTEYGTS
gnmzq11  61  AAPLSEAGYYVFPAAVVEETFKQNGLTNAADIHAVRPEKLHQIFGNDAVLYITVTEYGTS
gnmzq13  61  AAPLSEAGYYVFPAAVVEETFKQNGLTNAADIHAVRPEKLHQIFGNDAVLYITVTEYGTS
gnmzq15  61  AAPLSEAGYYVFPAAVVEETFKQNGLTNAADIHAVRPEKLHQIFGNDAVLYITVTEYGTS
gnmzq16  61  AAPLSEAGYYVFPAAVVEETFKQNGLTNAADIHAVRPEKLHQIFGNDAVLYITVTEYGTS
gnmzq17  61  AAPLSEAGYYVFPAAVVEETFKQNGLTNAADIHAVRPEKLHQIFGNDAVLYITVTEYGTS
gnmzq19  61  AAPLSEAGYYVFPAAVVEETFKQNGLTNAADIHAVRPEKLHQIFGNDAVLYITVTEYGTS
gnmzq21  61  AAPLSEAGYYVFPAAVVEETFKQNGLTNAADIHAVRPEKLHQIFGNDAVLYITVTEYGTS
gnmzq22  61  AAPLSEAGYYVFPAAVVEETFKQNGLTNAADIHAVRPEKLHQIFGNDAVLYITVTEYGTS
gnmzq23  61  AAPLSEAGYYVFPAAVVEETFKQNGLTNAADIHAVRPEKLHQIFGNDAVLYITVTEYGTS
gnmzq24  61  AAPLSEAGYYVFPAAVVEETFKQNGLTNAADIHAVRPEKLHQIFGNDAVLYITVTEYGTS
gnmzq25  61  AAPLSEAGYYVFPAAVVEETFKQNGLTNAADIHAVRPEKLHQIFGNDAVLYITVTEYGTS
gnmzq27  61  AAPLSEAGYYVFPAAVVEETFKQNGLTNAADIHAVRPEKLHQIFGNDAVLYITVTEYGTS
gnmzq28  61  AAPLSEAGYYVFPAAVVEETFKQNGLTNAADIHAVRPEKLHQIFGNDAVLYITVTEYGTS
gnmzq29  61  AAPLSEAGYYVFPAAVVEETFKQNGLTNAADIHAVRPEKLHQIFGNDAVLYITVTEYGTS
z2491    61  AAPLSEAGYYVFPAAVVEETFKQNGLTNAADIHAVRPEKLHQIFGNDAVLYITVTEYGTS
gnmzq14  61  AAPLSEAGYYVFPAAVVEETFKQNGLTNAADIHAVRPEKLHQIFGNDAVLYITVTEYGTS
gnmzq18  61  AAPLSEAGYYVFPAAVVEETFKQNGLTNAADIHAVRPEKLHQIFGNDAVLYITVTEYGTS
gnmzq26  61  AAPLSEAGYYVFPAAVVEETFKQNGLTNAADIHAVRPEKLHQIFGNDAVLYITVTEYGTS
```

FIG. 20A

```
gnmzq09  121 YQILDSVTTVSARARLVDSRNGKVLWSGSASIREGSNNSNSGLLGALVSAVVNQIANSLT
gnmzq31  121 YQILDSVTTVSARARLVDSRNGKVLWSGSASIREGSNNSNSGLLGALVGAVVNQIANSLT
fa1090   121 YQILDSVTTVSAKARLVDSRNGKELWSGSASIREGSNNSNSGLLGALVGAVVNQIANSLT
gnmzq32  121 YQILDSVTTVSAKARLVDSRNGKELWSGSASIREGSNNSNSGLLGALVGAVVNQIANSLT
gnmzq33  121 YQILDSVTTVSAKARLVDSRNGKELWSGSASIREGSNNSNSGLLGALVGAVVNQIANSLT
gnmzq01  121 YQILDSVTTVSAKARLVDSRNGKELWSGSASIREGSNNSNSGLLGALVSAVVNQIANNLT
gnmzq05  121 YQILDSVTTVSAKARLVDSRNGKELWSGSASIREGSNNSNSGLLGALVSAVVNQIANNLT
gnmzq08  121 YQILDSVTTVSAKARLVDSRNGKELWSGSASIREGSNNSNSGLLGALVSAVVNQIANNLT
gnmzq02  121 YQILDSVTTVSAKARLVDSRNGKELWSGSASIREGSNNSNSGLLGALVSAVVNQIANSLT
gnmzq03  121 YQILDSVTTVSAKARLVDSRNGKELWSGSASIREGSNNSNSGLLGALVSAVVNQIANSLT
gnmzq04  121 YQILDSVTTVSAKARLVDSRNGKELWSGSASIREGSNNSNSGLLGALVSAVVNQIANSLT
gnmzq07  121 YQILDSVTTVSAKARLVDSRNGKELWSGSASIREGSNNSNSGLLGALVSAVVNQIANSLT
gnmzq10  121 YQILDSVTTVSAKARLVDSRNGKELWSGSASIREGSNNSNSGLLGALVSAVVNQIANSLT
gnmzq11  121 YQILDSVTTVSAKARLVDSRNGKELWSGSASIREGSNNSNSGLLGALVSAVVNQIANSLT
gnmzq13  121 YQILDSVTTVSAKARLVDSRNGKELWSGSASIREGSNNSNSGLLGALVSAVVNQIANSLT
gnmzq15  121 YQILDSVTTVSAKARLVDSRNGKELWSGSASIREGSNNSNSGLLGALVSAVVNQIANSLT
gnmzq16  121 YQILDSVTTVSAKARLVDSRNGKELWSGSASIREGSNNSNSGLLGALVSAVVNQIANSLT
gnmzq17  121 YQILDSVTTVSAKARLVDSRNGKELWSGSASIREGSNNSNSGLLGALVSAVVNQIANSLT
gnmzq19  121 YQILDSVTTVSAKARLVDSRNGKELWSGSASIREGSNNSNSGLLGALVSAVVNQIANSLT
gnmzq21  121 YQILDSVTTVSAKARLVDSRNGKELWSGSASIREGSNNSNSGLLGALVSAVVNQIANSLT
gnmzq22  121 YQILDSVTTVSAKARLVDSRNGKELWSGSASIREGSNNSNSGLLGALVSAVVNQIANSLT
gnmzq23  121 YQILDSVTTVSAKARLVDSRNGKELWSGSASIREGSNNSNSGLLGALVSAVVNQIANSLT
gnmzq24  121 YQILDSVTTVSAKARLVDSRNGKELWSGSASIREGSNNSNSGLLGALVSAVVNQIANSLT
gnmzq25  121 YQILDSVTTVSAKARLVDSRNGKELWSGSASIREGSNNSNSGLLGALVSAVVNQIANSLT
gnmzq27  121 YQILDSVTTVSAKARLVDSRNGKELWSGSASIREGSNNSNSGLLGALVSAVVNQIANSLT
gnmzq28  121 YQILDSVTTVSAKARLVDSRNGKELWSGSASIREGSNNSNSGLLGALVSAVVNQIANSLT
gnmzq29  121 YQILDSVTTVSAKARLVDSRNGKELWSGSASIREGSNNSNSGLLGALVSAVVNQIANSLT
z2491    121 YQILDSVTTVSAKARLVDSRNGKELWSGSASIREGSNNSNSGLLGALVSAVVNQIANSLT
gnmzq14  121 YQILDSVTTVSAKARLVDSRNGKELWSGSASIREGSNNSNSGLLGALVGAVVNQIANSLT
gnmzq18  121 YQILDSVTTVSAKARLVDSRNGKELWSGSASIREGSNNSNSGLLGALVGAVVNQIANSLT
gnmzq26  121 YQILDSVTTVSAKARLVDSRNGKELWSGSASIREGSNNSNSGLLGALVGAVVNQIANSLT

gnmzq09  181 DRGYQVSKTAAYNLLSPYSHNGILKGPRFVEEQPK*
gnmzq31  181 DRGYQVSKAAAYDLLSPYSHNGILKGPRFVEEQPK*
fa1090   181 DRGYQVSKTAAYNLLSPYSRNGILKGPRFVEEQPK*
gnmzq32  181 DRGYQVSKTAAYNLLSPYSRNGILKGPRFVEEQPK*
gnmzq33  181 DRGYQVSKTAAYNLLSPYSRNGILKGPRFVEEQPK*
gnmzq01  181 DRGYQVSKTAAYNLLSPYSHNGILKGPRFVEEQPK*
gnmzq05  181 DRGYQVSKTAAYNLLSPYSHNGILKGPRFVEEQPK*
gnmzq08  181 DRGYQVSKTAAYNLLSPYSHNGILKGPRFVEEQPK*
gnmzq02  181 DRGYQVSKTAAYNLLSPYSHNGILKGPRFVEEQPK*
gnmzq03  181 DRGYQVSKTAAYNLLSPYSHNGILKGPRFVEEQPK*
gnmzq04  181 DRGYQVSKTAAYNLLSPYSHNGILKGPRFVEEQPK*
gnmzq07  181 DRGYQVSKTAAYNLLSPYSHNGILKGPRFVEEQPK*
gnmzq10  181 DRGYQVSKTAAYNLLSPYSHNGILKGPRFVEEQPK*
gnmzq11  181 DRGYQVSKTAAYNLLSPYSHNGILKGPRFVEEQPK*
gnmzq13  181 DRGYQVSKTAAYNLLSPYSHNGILKGPRFVEEQPK*
gnmzq15  181 DRGYQVSKTAAYNLLSPYSHNGILKGPRFVEEQPK*
gnmzq16  181 DRGYQVSKTAAYNLLSPYSHNGILKGPRFVEEQPK*
gnmzq17  181 DRGYQVSKTAAYNLLSPYSHNGILKGPRFVEEQPK*
gnmzq19  181 DRGYQVSKTAAYNLLSPYSHNGILKGPRFVEEQPK*
gnmzq21  181 DRGYQVSKTAAYNLLSPYSHNGILKGPRFVEEQPK*
gnmzq22  181 DRGYQVSKTAAYNLLSPYSHNGILKGPRFVEEQPK*
gnmzq23  181 DRGYQVSKTAAYNLLSPYSHNGILKGPRFVEEQPK*
gnmzq24  181 DRGYQVSKTAAYNLLSPYSHNGILKGPRFVEEQPK*
gnmzq25  181 DRGYQVSKTAAYNLLSPYSHNGILKGPRFVEEQPK*
gnmzq27  181 DRGYQVSKTAAYNLLSPYSHNGILKGPRFVEEQPK*
gnmzq28  181 DRGYQVSKTAAYNLLSPYSHNGILKGPRFVEEQPK*
gnmzq29  181 DRGYQVSKTAAYNLLSPYSHNGILKGPRFVEEQPK*
z2491    181 DRGYQVSKTAAYNLLSPYSHNGILKGPRFVEEQPK*
gnmzq14  181 DRGYQVSKTAAYNLLSPYSHNGILKGPRFVEEQPK*
gnmzq18  181 DRGYQVSKTAAYNLLSPYSHNGILKGPRFVEEQPK*
gnmzq26  181 DRGYQVSKTAAYNLLSPYSHNGILKGPRFVEEQPK*
```

FIG. 20B

```
287_14    1  MFKRSVIAMACIFALSACGGGGGGSPDVKSADTLSKPAAPVVSE...........KETEA
287_2     1  MFKRSVIAMACIFALSACGGGGGGSPDVKSADTLSKPAAPVVSE...........KETEA
287_21    1  MFKRSVIAMACIFALSACGGGGGGSPDVKSADTLSKPAAPVVSE...........KETEA
z2491     1  MFKRSVIAMACIFALSACGGGGGGSPDVKSADTLSKPAAPVVSE...........KETEA
287_9     1  MFKRSVIAMACIVALSACGGGGGGSPDVKSADTLSKPAAPVVTEDVGEEVLPKEKKDEEA
fa1090    1  MFKRSVIAMACIFPLSACGGGGGGSPDVKSADTPSKPAAPVVAENAGEGVLPKEKKDEEA

287_14   50  KEDAPQAGSQGQGAPSAQGGQDMAAVSEENTGNGGAAATDKPKNEDEGAQNDMPQNAADT
287_2    50  KEDAPQAGSQGQGAPSAQGGQDMAAVSEENTGNGGAAATDKPKNEDEGAQNDMPQNAADT
287_21   50  KEDAPQAGSQGQGAPSAQGSQDMAAVSEENTGNGGAVTADNPKNEDEVAQNDMPQNAAGT
z2491    50  KEDAPQAGSQGQGAPSAQGSQDMAAVSEENTGNGGAVTADNPKNEDEVAQNDMPQNAAGT
287_9    61  VSGAPQADT..QDATAGKGGQDMAAVSAENTGNGGAATTDNPENKDEGPQNDMPQNAADT
fa1090   61  AGGAPQADT..QDATAGEGSQDMAAVSAENTGNGGAATTDNPKNEDAGAQNDMPQNAA..

287_14  110  DSLTPNHTPASNMPAGNMENQAPDAGESEQPANQPDMANTADGMQGDDPSAGGENAGNTA
287_2   110  DSLTPNHTPASNMPAGNMENQAPDAGESEQPANQPDMANTADGMQGDDPSAGGENAGNTA
287_21  110  DSSTPNHTPDPNMLAGNMENQATDAGESSQPANQPDMANAADGMQGDDPSAGGQNAGNTA
z2491   110  DSSTPNHTPDPNMLAGNMENQATDAGESSQPANQPDMANAADGMQGDDPSAGGQNAGNTA
287_9   119  DSSTPNHTPAPNMPTRDMGNQAPDAGESAQPANQPDMANAADGMQGDDPSA.GENAGNTA
fa1090  117  ............................................................

287_14  170  AQGTNQAENNQTAGSQNPASSTNPSATNSGGDFGRTNVGNSVVIDGPSQNITLTHCKGDS
287_2   170  AQGTNQAENNQTAGSQNPASSTNPSATNSGGDFGRTNVGNSVVIDGPSQNITLTHCKGDS
287_21  170  AQGANQAGNNQAAGSSDPIPASNPAPANGGSNFGRVDLANGVLIDGPSQNITLTHCKGDS
z2491   170  AQGANQAGNNQAAGSSDPIPASNPAPANGGSNFGRVDLANGVLIDGPSQNITLTHCKGDS
287_9   178  DQAANQAENNQVGGSQNPASSTNPNATNGGSDFGRINVANGEKLDSGSENVTLTHCKDKV
fa1090  117   ESANQTGNNQPAGSSDSAPASNPAPANGGSDFGRTNVGNSVVIDGPSQNITLTHCKGDS

287_14  230  CSGNNFLDEEVQLKSEFEKLSDADKISNYKKDGKNDGKNDKFVGLVADSVQMKGINQYII
287_2   230  CSGNNFLDEEVQLKSEFEKLSDADKISNYKKDGKNDGKNDKFVGLVADSVQMKGINQYII
287_21  230  CSGNNFLDEEVQLKSEFEKLSDADKISNYKK....DGKNDKFVGLVADSVQMKGINQYII
z2491   230  CSGNNFLDEEVQLKSEFEKLSDADKISNYKK....DGKNDKFVGLVADSVQMKGINQYII
287_9   238  CDRD.FLDEEAPPKSEFEKLSDEEKINKYKK....DEQRENFVGLVADRVEKNGTNKYVI
fa1090  176  CNGDNLLDEEAPSKSEFEKLSDEEKIKRYKK....DEQRENFVGLVADRVKKDGTNKYII

287_14  290  FYKPKP..TSFARFRRSARSRRSLPAEMPLIPVNQADTLIVDGEAVSLTGHSGNIFAPEG
287_2   290  FYKPKP..TSFARFRRSARSRRSLPAEMPLIPVNQADTLIVDGEAVSLTGHSGNIFAPEG
287_21  286  FYKPKP..TSFARFRRSARSRRSLPAEMPLIPVNQADTLIVDGEAVSLTGHSGNIFAPEG
z2491   286  FYKPKP..TSFARFRRSARSRRSLPAEMPLIPVNQADTLIVDGEAVSLTGHSGNIFAPEG
287_9   293  IYKDKSASSSSARFRRSARSRRSLPAEMPLIPVNQADTLIVDGEAVSLTGHSGNIFAPEG
fa1090  232  FYTDKPPT.......RSARSRRSLPAEIPLIPVNQADTLIVDGEAVSLTGHSGNIFAPEG

287_14  348  NYRYLTYGAEKLPGGSYALRVQGEPSKGEMLAGTAVYNGEVLHFHTENGRPSPSRGRFAA
287_2   348  NYRYLTYGAEKLPGGSYALRVQGEPSKGEMLAGTAVYNGEVLHFHTENGRPSPSRGRFAA
287_21  344  NYRYLTYGAEKLPGGSYALRVQGEPAKGEMLAGAAVYNGEVLHFHTENGRPYPTRGRFAA
z2491   344  NYRYLTYGAEKLPGGSYALRVQGEPAKGEMLAGAAVYNGEVLHFHTENGRPYPTRGRFAA
287_9   353  NYRYLTYGAEKLSGGSYALSVQGEPAKGEMLAGTAVYNGEVLHFHMENGRPSPSGGRFAA
fa1090  285  NYRYLTYGAEKLPGGSYALRVQGEPAKGEMLVGTAVYNGEVLHFHMENGRPYPSGGRFAA

287_14  408  KVDFGSKSVDGIIDSGDGLHMGTQKFKAAIDGNGFKGTWTENGGGDVSGKFYGPAGEEVA
287_2   408  KVDFGSKSVDGIIDSGDGLHMGTQKFKAAIDGNGFKGTWTENGGGDVSGKFYGPAGEEVA
287_21  404  KVDFGSKSVDGIIDSGDDLHMGTQKFKAAIDGNGFKGTWTENGSGDVSGKFYGPAGEEVA
z2491   404  KVDFGSKSVDGIIDSGDDLHMGTQKFKAAIDGNGFKGTWTENGSGDVSGKFYGPAGEEVA
287_9   413  KVDFGSKSVDGIIDSGDDLHMGTQKFKAVIDGNGFKGTWTENGGGDVSGRFYGPAGEEVA
fa1090  345  KVDFGSKSVDGIIDSGDDLHMGTQKFKAAIDGNGFKGTWTENGGGDVSGRFYGPAGEEVA
```

FIG. 21A

| | | |
|---|---|---|
| 287_14 | 468 | GKYSYRPTDAEKGGFGVFAGKKEQD* |
| 287_2 | 468 | GKYSYRPTDAEKGGFGVFAGKKEQD* |
| 287_21 | 464 | GKYSYRPTDAEKGGFGVFAGKKEQD* |
| z2491 | 464 | GKYSYRPTDAEKGGFGVFAGKKEQD* |
| 287_9 | 473 | GKYSYRPTDAEKGGFGVFAGKKEQD* |
| fa1090 | 405 | GKYSYRPTDAEKGGFGVFAGKKDRD* |

FIG. 21B

```
z2491_519      1  MEFFIILLAAVVVFGFKSFVVIPQQEVHVVERLGRFHRALTAGLNILIPFIDRVAYRHSL
zv26_519       1  MEFFIILLAAVVVFGFKSFVVIPQQEVHVVERLGRFHRALTAGLNILIPFIDRVAYRHSL
zv22_519ass    1  MEFFIILLAAVVVFGFKSFVVIPQQEVHVVERLGRFHRALTAGLNILIPFIDRVAYRHSL
fa1090_519     1  MEFFIILLAAVAVFGFKSFVVIPQQEVHVVERLGRFHRALTAGLNILIPFIDRVAYRHSL
zv32_519       1  MEFFIILLAAVAVFGFKSFVVIPQQEVHVVERLGRFHRALTAGLNILIPFIDRVAYRHSL
zv11_519       1  MEFFIILLAAVAVFGFKSFVVIPQQEVHVVERLGRFHRALTAGLNILIPFIDRVAYRHSL
zv28_519       1  MEFFIILLAAVAVFGFKSFVVIPQQEVHVVERLGRFHRALTAGLNILIPFIDRVAYRHSL
zv96_519       1  MEFFIILLAAVAVFGFKSFVVIPQQEVHVVERLGRFHRALTAGLNILIPFIDRVAYRHSL
zv02_519       1  MEFFIILLVAVAVFGFKSFVVIPQQEVHVVERLGRFHRALTAGLNILIPFIDRVAYRHSL
zv03_519       1  MEFFIILLVAVAVFGFKSFVVIPQQEVHVVERLGRFHRALTAGLNILIPFIDRVAYRHSL
zv04_519       1  MEFFIILLVAVAVFGFKSFVVIPQQEVHVVERLGRFHRALTAGLNILIPFIDRVAYRHSL
zv05_519       1  MEFFIILLVAVAVFGFKSFVVIPQQEVHVVERLGRFHRALTAGLNILIPFIDRVAYRHSL
zv01_519       1  MEFFIILLVAVAVFGFKSFVVIPQQEVHVVERLGRFHRALTAGLNILIPFIDRVAYRHSL
zv07_519       1  MEFFIILLVAVAVFGFKSFVVIPQQEVHVVERLGRFHRALTAGLNILIPFIDRVAYRHSL
zv12_519       1  MEFFIILLVAVAVFGFKSFVVIPQQEVHVVERLGRFHRALTAGLNILIPFIDRVAYRHSL
zv18_519       1  MEFFIILLVAVAVFGFKSFVVIPQQEVHVVERLGRFHRALTAGLNILIPFIDRVAYRHSL
zv19_519       1  MEFFIILLVAVAVFGFKSFVVIPQQEVHVVERLGRFHRALTAGLNILIPFIDRVAYRHSL
zv21_519ass    1  MEFFIILLVAVAVFGFKSFVVIPQQEVHVVERLGRFHRALTAGLNILIPFIDRVAYRHSL
zv27_519       1  MEFFIILLVAVAVFGFKSFVVIPQQEVHVVERLGRFHRALTAGLNILIPFIDRVAYRHSL
zv20_519ass    1  MEFFIILLVAVAVFGFKSFVVIPQQEVHVVERLGRFHRALTAGLNILIPFIDRVAYRHSL
zv06_519ass    1  MEFFIILLVAVAVFGFKSFVVIPQQEVHVVERLGRFHRALTAGLNILIPFIDRVAYRHSL
zv29_519ass    1  MEFFIILLAAVAVFGFKSFVVIPQQEVHVVERLGRFHRALTAGLNILIPFIDRVAYRHSL

z2491_519     61  KEIPLDVPSQVCITRDNTQLTVDGIIYFQVTDPKLASYGSSNYIMAITQLAQTTLRSVIG
zv26_519      61  KEIPLDVPSQVCITRDNTQLTVDGIIYFQVTDPKLASYGSSNYIMAITQLAQTTLRSVIG
zv22_519ass   61  KEIPLDVPSQVCITRDNTQLTVDGIIYFQVTDPKLASYGSSNYIMAITQLAQTTLRSVIG
fa1090_519    61  KEIPLDVPSQVCITRDNTQLTVDGIIYFQVTDPKLASYGSSNYIMAITQLAQTTLRSVIG
zv32_519      61  KEIPLDVPSQVCITRDNTQLTVDGIIYFQVTDPKLASYGSSNYIMAITQLAQTTLRSVIG
zv11_519      61  KEIPLDVPSQVCITRDNTQLTVDGIIYFQVTDPKLASYGSSNYIMAITQLAQTTLRSVIG
zv28_519      61  KEIPLDVPSQVCITRDNTQLTVDGIIYFQVTDPKLASYGSSNYIMAITQLAQTTLRSVIG
zv96_519      61  KEIPLDVPSQVCITRDNTQLTVDGIIYFQVTDPKLASYGSSNYIMAITQLAQTTLRSVIG
zv02_519      61  KEIPLDVPSQVCITRDNTQLTVDGIIYFQVTDPKLASYGSSNYIMAITQLAQTTLRSVIG
zv03_519      61  KEIPLDVPSQVCITRDNTQLTVDGIIYFQVTDPKLASYGSSNYIMAITQLAQTTLRSVIG
zv04_519      61  KEIPLDVPSQVCITRDNTQLTVDGIIYFQVTDPKLASYGSSNYIMAITQLAQTTLRSVIG
zv05_519      61  KEIPLDVPSQVCITRDNTQLTVDGIIYFQVTDPKLASYGSSNYIMAITQLAQTTLRSVIG
zv01_519      61  KEIPLDVPSQVCITRDNTQLTVDGIIYFQVTDPKLASYGSSNYIMAITQLAQTTLRSVIG
zv07_519      61  KEIPLDVPSQVCITRDNTQLTVDGIIYFQVTDPKLASYGSSNYIMAITQLAQTTLRSVIG
zv12_519      61  KEIPLDVPSQVCITRDNTQLTVDGIIYFQVTDPKLASYGSSNYIMAITQLAQTTLRSVIG
zv18_519      61  KEIPLDVPSQVCITRDNTQLTVDGIIYFQVTDPKLASYGSSNYIMAITQLAQTTLRSVIG
zv19_519      61  KEIPLDVPSQVCITRDNTQLTVDGIIYFQVTDPKLASYGSSNYIMAITQLAQTTLRSVIG
zv21_519ass   61  KEIPLDVPSQVCITRDNTQLTVDGIIYFQVTDPKLASYGSSNYIMAITQLAQTTLRSVIG
zv27_519      61  KEIPLDVPSQVCITRDNTQLTVDGIIYFQVTDPKLASYGSSNYIMAITQLAQTTLRSVIG
zv20_519ass   61  KEIPLDVPSQVCITRDNTQLTVDGIIYFQVTDPKLASYGSSNYIMAITQLAQTTLRSVIG
zv06_519ass   61  KEIPLDVPSQVCITRDNTQLTVDGIIYFQVTDPKLASYGSSNYIMAITQLAQTTLRSVIG
zv29_519ass   61  KEIPLDVPSQVCITRDNTQLTVDGIIYFQVTDPKLASYGSSNYIMAITQLAQTTLRSVIG

z2491_519    121  RMELDKTFEERDEINSTVVSALDEAAGAWGVKVLRYEIKDLVPPQEILRSMQAQITAERE
zv26_519     121  RMELDKTFEERDEINSTVVAALDEAAGAWGVKVLRYEIKDLVPPQEILRSMQAQITAERE
zv22_519ass  121  RMELDKTFEERDEINSTVVSALDEAAGAWGVKVLRYEIKDLVPPQEILRSMQAQITAERE
fa1090_519   121  RMELDKTFEERDEINSTVVSALDEAAGAWGVKVLRYEIKDLVPPQEILRAMQAQITAERE
zv32_519     121  RMELDKTFEERDEINSTVVSALDEAAGAWGVKVLRYEIKDLVPPQEILRAMQAQITAERE
zv11_519     121  RMELDKTFEERDEINSTVVAALDEAAGAWGVKVLRYEIKDLVPPQEILRSMQAQITAERE
zv28_519     121  RMELDKTFEERDEINSTVVAALDEAAGAWGVKVLRYEIKDLVPPQEILRSMQAQITAERE
zv96_519     121  RMELDKTFEERDEINSTVVAALDEAAGAWGVKVLRYEIKDLVPPQEILRSMQAQITAERE
zv02_519     121  RMELDKTFEERDEINSTVVSALDEAAGAWGVKVLRYEIKDLVPPQEILRSMQAQITAERE
zv03_519     121  RMELDKTFEERDEINSTVVSALDEAAGAWGVKVLRYEIKDLVPPQEILRSMQAQITAERE
zv04_519     121  RMELDKTFEERDEINSTVVSALDEAAGAWGVKVLRYEIKDLVPPQEILRSMQAQITAERE
zv05_519     121  RMELDKTFEERDEINSTVVSALDEAAGAWGVKVLRYEIKDLVPPQEILRSMQAQITAERE
zv01_519     121  RMELDKTFEERDEINSTVVAALDEAAGAWGVKVLRYEIKDLVPPQEILRSMQAQITAERE
zv07_519     121  RMELDKTFEERDEINSTVVAALDEAAGAWGVKVLRYEIKDLVPPQEILRSMQAQITAERE
zv12_519     121  RMELDKTFEERDEINSTVVAALDEAAGAWGVKVLRYEIKDLVPPQEILRSMQAQITAERE
zv18_519     121  RMELDKTFEERDEINSTVVAALDEAAGAWGVKVLRYEIKDLVPPQEILRSMQAQITAERE
zv19_519     121  RMELDKTFEERDEINSTVVAALDEAAGAWGVKVLRYEIKDLVPPQEILRSMQAQITAERE
zv21_519ass  121  RMELDKTFEERDEINSTVVAALDEAAGAWGVKVLRYEIKDLVPPQEILRSMQAQITAERE
zv27_519     121  RMELDKTFEERDEINSTVVAALDEAAGAWGVKVLRYEIKDLVPPQEILRSMQAQITAERE
zv20_519ass  121  RMELDKTFEERDEINSTVVAALDEAAGAWGVKVLRYEIKDLVPPQEILRSMQAQITAERE
zv06_519ass  121  RMELDKTFEERDEINSTVFSALDEAAGAWGVKVLRYEIKDLVPPQEILRSMQAQITAERK
zv29_519ass  121  RMELDKTFEERDEINSIVVSALDEAAGAWGVKVLRYEIKDLVPPQEILRSMQAQITAERE
```

FIG. 22A

```
z2491_519     181  KRARIAESEGRKIEQINLASGQREAEIQQSEGEAQAAVNASNAEKIARINRAKGEAESLR
zv26_519      181  KRARIAESEGRKIEQINLASGQREAEIQQSEGEAQAAVNASNAEKIARINRAKGEAESLR
zv22_519ass   181  KRARIAESEGRKIEQINLASGQREAKIQQSEGEAQAAVNASNAEKIARINRAKGEAESLR
fa1090_519    181  KRARIAESEGRKIEQINLASGQREAEIQQSEGEAQAAVNASNAEKIARINRAKGEAESLR
zv32_519      181  KRARIAESEGRKIEQINLASGQREAEIQQSEGEAQAAVNASNAEKIARINRAKGEAESLR
zv11_519      181  KRARIAESEGRKIEQINLASGQREAEIQQSEGEAQAAVNASNAEKIARINRAKGEAESLR
zv28_519      181  KRARIAESEGRKIEQINLASGQREAEIQQSEGEAQAAVNASNAEKIARINRAKGEAESLR
zv96_519      181  KRARIAESEGRKIEQINLASGQREAEIQQSEGEAQAAVNASNAEKIARINRAKGEAESLR
zv02_519      181  KRARIAESEGRKIEQINLASGQREAEIQQSEGEAQAAVNASNAEKIARINRAKGEAESLR
zv03_519      181  KRARIAESEGRKIEQINLASGQREAEIQQSEGEAQAAVNASNAEKIARINRAKGEAESLR
zv04_519      181  KRARIAESEGRKIEQINLASGQREAEIQQSEGEAQAAVNASNAEKIARINRAKGEAESLR
zv05_519      181  KRARIAESEGRKIEQINLASGQREAEIQQSEGEAQAAVNASNAEKIARINRAKGEAESLR
zv01_519      181  KRARIAESEGRKIEQINLASGQREAEIQQSEGEAQAAVNASNAEKIARINRAKGEAESLR
zv07_519      181  KRARIAESEGRKIEQINLASGQREAEIQQSEGEAQAAVNASNAEKIARINRAKGEAESLR
zv12_519      181  KRARIAESEGRKIEQINLASGQREAEIQQSEGEAQAAVNASNAEKIARINRAKGEAESLR
zv18_519      181  KRARIAESEGRKIEQINLASGQREAEIQQSEGEAQAAVNASNAEKIARINRAKGEAESLR
zv19_519      181  KRARIAESEGRKIEQINLASGQREAEIQQSEGEAQAAVNASNAEKIARINRAKGEAESLR
zv21_519ass   181  KRARIAESEGRKIEQINLASGQREAEIQQSEGEAQAAVNASNAEKIARINRAKGEAESLR
zv27_519      181  KRARIAESEGRKIEQINLASGQREAEIQQSEGEAQAAVNASNAEKIARINRAKGEAESLR
zv20_519ass   181  KRARIAESEGRKIEQINLASGQREAEIQQSEGEAQAAVNASNAEKIARINRAKGEAESLR
zv06_519ass   181  KRARIAESEGRKIEQINLASGQREAEIQQSEGEAQAAVNASNAEKIARINRAKGEAESLR
zv29_519ass   181  KRARIAESEGRKIEQINLASGQREPEIQQSEGEAQAAVNASNAEKIARINRAKGEAESLR

z2491_519     241  LVAEANAEAIRQIAAALQTQGGADAVNLKIAEQYVAAFNNLAKESNTLIMPANVADIGSL
zv26_519      241  LVAEANAEAIRQIAAALQTQGGADAVNLKIAEQYVAAFNNLAKESNTLIMPANVADIGSL
zv22_519ass   241  LVAEANAEAIRQIAAALQTQGGADAVNLKIAEQYVAAFNNLAKESNTLIMPANVADIGSL
fa1090_519    241  LVAEANAEAIRQIAAALQTQGGADAVNLKIAEQYVAAFNNLAKESNTLIMPANVADIGSL
zv32_519      241  LVAEANAEAIRQIAAALQTQGGADAVNLKIAEQYVAAFNNLAKESNTLIMPANVADIGSL
zv11_519      241  LVAEANAEAIRQIAAALQTQGGADAVNLKIAEQYVAAFNNLAKESNTLIMPANVADIGSL
zv28_519      241  LVAEANAEAIRQIAAALQTQGGADAVNLKIAEQYVAAFNNLAKESNTLIMPANVADIGSL
zv96_519      241  LVAEANAEAIRQIAAALQTQGGADAVNLKIAEQYVAAFNNLAKESNTLIMPANVADIGSL
zv02_519      241  LVAEANAEAIRQIAAALQTQGGADAVNLKIAEQYVAAFNNLAKESNTLIMPANVADIGSL
zv03_519      241  LVAEANAEAIRQIAAALQTQGGADAVNLKIAEQYVAAFNNLAKESNTLIMPANVADIGSL
zv04_519      241  LVAEANAEAIRQIAAALQTQGGADAVNLKIAEQYVAAFNNLAKESNTLIMPANVADIGSL
zv05_519      241  LVAEANAEAIRQIAAALQTQGGADAVNLKIAEQYVAAFNNLAKESNTLIMPANVADIGSL
zv01_519      241  LVAEANAEAIRQIAAALQTQGGADAVNLKIAEQYVAAFNNLAKESNTLIMPANVADIGSL
zv07_519      241  LVAEANAEAIRQIAAALQTQGGADAVNLKIAEQYVAAFNNLAKESNTLIMPANVADIGSL
zv12_519      241  LVAEANAEAIRQIAAALQTQGGADAVNLKIAEQYVAAFNNLAKESNTLIMPANVADIGSL
zv18_519      241  LVAEANAEAIRQIAAALQTQGGADAVNLKIAEQYVAAFNNLAKESNTLIMPANVADIGSL
zv19_519      241  LVAEANAEAIRQIAAALQTQGGADAVNLKIAEQYVAAFNNLAKESNTLIMPANVADIGSL
zv21_519ass   241  LVAEANAEAIRQIAAALQTQGGADAVNLKIAEQYVAAFNNLAKESNTLIMPANVADIGSL
zv27_519      241  LVAEANAEAIRQIAAALQTQGGADAVNLKIAEQYVAAFNNLAKESNTLIMPANVADIGSL
zv20_519ass   241  LVAEANAEAIRQIAAALQTQGGADAVNLKIAEQYVAAFNNLAKESNTLIMPANVADIGSM
zv06_519ass   241  LVAEANAEAIRQIAAALQTQGGADAVNLKIAEQYVAAFNNLAKESNTLIMPANVADIGSL
zv29_519ass   241  LVAEANAEAIRQIAAALQTQGGADAVNLKIAEQYVAAFNNLAKESNTLIMPANVADIGSL

z2491_519     301  ISAGMKIIDSSKTAK*
zv26_519      301  ISAGMKIIDSSKTAK*
zv22_519ass   301  ISAGMKIIDSSKTAK*
fa1090_519    301  ISAGMKIIDSSKTAK*
zv32_519      301  ISAGMKIIDSSKTAK*
zv11_519      301  ISAGMKIIDSSKTAK*
zv28_519      301  ISAGMKIIDSSKTAK*
zv96_519      301  ISAGMKIIDSSKTAK*
zv02_519      301  ISAGMKIIDSSKTAK*
zv03_519      301  ISAGMKIIDSSKTAK*
zv04_519      301  ISAGMKIIDSSKTAK*
zv05_519      301  ISAGMKIIDSSKTAK*
zv01_519      301  ISAGMKIIDSSKTAK*
zv07_519      301  ISAGMKIIDSSKTAK*
zv12_519      301  ISAGMKIIDSSKTAK*
zv18_519      301  ISAGMKIIDSSKTAK*
zv19_519      301  ISAGMKIIDSSKTAK*
zv21_519ass   301  ISAGMKIIDSSKTAK*
zv27_519      301  ISAGMKIIDSSKTAK*
zv20_519ass   301  ISAGMKIIDSSKTAK*
zv06_519ass   301  ISAGMKIIDSSKTAK*
zv29_519ass   301  ISAGMKIIDSNKTAK*
```

FIG. 22B

```
fa1090      1  MKKHLLRSALYGIAAAILAACQSRSIQTFPQPDTSVINGPDRPAGIPDPAGTTVAGGGAV
zm33asbc    1  MKKHLLRSALYGIAAAILAACQSRSIQTFPQPDTSVINGPDRPAGIPDPAGTTVAGGGAV
zm32asbc    1  MKKHLLRSALYGIAAAILAACQSRSIQTFPQPDTSVINGPDRPAGIPDPAGTTVAGGGAV
zm23asbc    1  MKKYLFRAALYGIAAAILAACQSKSIQTFPQPDTSVINGPDRPVGIPDPAGTTVGGGGAV
zm27bc      1  MKKYLFRAALYGISAAILAACQSKSIQTFPQPDTSVINGPDRPAGIPDPAGTTVAGGGAV
zm09        1  MKKYLFRAALCGIAAAILAACQSKSIQTFPQPDTSVINGPDRPVGIPAPAGTTVAGGGAV
zm10        1  MKKYLFRAALCGIAAAILAACQSKSIQTFPQPDTSVINGPDRPVGIPAPAGTTVAGGGAV
zm24        1  MKKYLFRAALCGIAAAILAACQSKSIQTFPQPDTSVINGPDRPVGIPAPAGTTVAGGGAV
zm25        1  MKKYLFRAALCGIAAAILAACQSKSIQTFPQPDTSVINGPDRPVGIPAPAGTTVAGGGAV
zm14        1  MKKYLFRAALCGIAAAILAACQSKSIQTFPQPDTSVINGPDRPVGIPAPAGTTVAGGGAV
zm04        1  MKKYLFRAALCGIAAAILAACQSKSIQTFPQPDTSVINGPDRPVGIPAPAGTTVAGGGAV
zm11asbc    1  MKKYLFRAALCGIAAAILAACQSKSIQTFPQPDTSVINGPDRPVGIPAPAGTTVGGGGAV
zm08n       1  MKKYLFRAALYGIAAAILAACQSKSIQTFPQPDTSVINGPDRPVGIPDPAGTTVGGGGAV
zm96        1  MKKYLFRAALYGIAAAILAACQSKSIQTFPQPDTSVINGPDRPVGIPDPAGTTVGGGGAV
zm01        1  MKKYLFRAALYGIAAAILAACQSKSIQTFPQPDTSVINGPDRPVGIPDPAGTTVGGGGAV
zm02        1  MKKYLFRAALYGIAAAILAACQSKSIQTFPQPDTSVINGPDRPVGIPDPAGTTVGGGGAV
zm03        1  MKKYLFRAALYGIAAAILAACQSKSIQTFPQPDTSVINGPDRPVGIPDPAGTTVGGGGAV
zm07        1  MKKYLFRAALYGIAAAILAACQSKSIQTFPQPDTSVINGPDRPVGIPDPAGTTVGGGGAV
zm12        1  MKKYLFRAALYGIAAAILAACQSKSIQTFPQPDTSVINGPDRPVGIPDPAGTTVGGGGAV
zm18        1  MKKYLFRAALYGIAAAILAACQSKSIQTFPQPDTSVINGPDRPVGIPDPAGTTVGGGGAV
zm19        1  MKKYLFRAALYGIAAAILAACQSKSIQTFPQPDTSVINGPDRPVGIPDPAGTTVGGGGAV
zm20        1  MKKYLFRAALYGIAAAILAACQSKSIQTFPQPDTSVINGPDRPVGIPDPAGTTVGGGGAV
zm21        1  MKKYLFRAALYGIAAAILAACQSKSIQTFPQPDTSVINGPDRPVGIPDPAGTTVGGGGAV
zm06        1  MKKYLFRAALYGIAAAILAACQSKSIQTFPQPDTSVINGPDRPVGIPDPAGTTVGGGGAV
zm17        1  MKKYLFRAALYGIAAAILAACQSKSIQTFPQPDTSVINGPDRPVGIPDPAGTTVGGGGAV
zm13        1  MKKYLFRAALYGIAAAILAACQSKSIQTFPQPDTSVINGPDRPVGIPDPAGTTVGGGGAV
zm05        1  MKKYLFRAALYGIAAAILAACQSKSIQTFPQPDTSVINGPDRPVGIPDPAGTTVGGGGAV
z2491       1  MKKYLFRAALCGIAAAILAACQSKSIQTFPQPDTSVINGPDRPVGIPDPAGTTVGGGGAV
zm22        1  MKKYLFRAALCGIAAAILAACQSKSIQTFPQPDTSVINGPDRPVGIPDPAGTTVGGGGAV
zm26        1  MKKYLFRAALYGIAAAILAACQSKSIQTFPQPDTSVINGPDRPVGIPDPAGTTVGGGGAV
zm28        1  MKKYLFRAALCGIAAAILAACQSKSIQTFPQPDTSVINGPDRPVGIPDPAGTTVGGGGAV
zm29asbc    1  MKKYLFRAALCGIAAAILAACQSKSIQTFPQPDTSVINGPDRPVGIPDPAGTTVGGGGAV
zm16        1  MKKYLFRAALCGIAAAILAACQSKSIQTFPQPDTSVINGPGRPVGIPDPAGTTVGGGGAV
zm15        1  MKKYLFRAALYGIAAAILAACQSKSIQTFPQPDTSVINGPDRPVGIPDLAGTTVGGGGAV
zm31asbc    1  MKKHLFRAALYGIAAAILAACQSKSIQTFPQPDTSTIKGPDRPAGIPDPAGTTVGGGGAV

fa1090     61  YTVVPHLSMPHWAAQDFAKSLQSFRLGCANLKNRQGWQDVCAQAFQTPVHSFQAKRFFER
zm33asbc   61  YTVVPHLSMPHWAAQDFAKSLQSFRLGCANLKNRQGWQDVCAQAFQTPIHSFQAKRFFER
zm32asbc   61  YTVVPHLSMPHWAAQDFAKSLQSFRLGCANLKNRQGWQDVCAQAFQTPVHSFQAKRFFER
zm23asbc   61  YTVVPHLSLPHWAAQDFAKSLQSFRLGCANLKNRQGWQDVCAQAFQTPVHSFQAKQFFER
zm27bc     61  YTVVPHLSLPHWAAQDFAKSLQSFRLGCANLKNRQGWQDVCAQAFQTPVHSFQAKQFFER
zm09       61  YTVVPHLSLPHWAAQDFAKSLQSFRLGCANLKNRQGWQDVCAQAFQTPVHSFQAKQFFER
zm10       61  YTVVPHLSLPHWAAQDFAKSLQSFRLGCANLKNRQGWQDVCAQAFQTPVHSFQAKQFFER
zm24       61  YTVVPHLSLPHWAAQDFAKSLQSFRLGCANLKNRQGWQDVCAQAFQTPVHSFQAKQFFER
zm25       61  YTVVPHLSLPHWAAQDFAKSLQSFRLGCANLKNRQGWQDVCAQAFQTPVHSFQAKQFFER
zm14       61  YTVVPHLSLPHWAAQDFAKSLQSFRLGCANLKNRQGWQDVCAQAFQTPVHSFQAKQFFER
zm04       61  YTVVPHLSLPHWAAQDFAKSLQSFRLGCANLKNRQGWQDVCAQAFQTPVHSFQAKQFFER
zm11asbc   61  YTVVPHLSLPHWAAQDFAKSLQSFRLGCANLKNRQGWQDVCAQAFQTPVHSVQAKQFFER
zm08n      61  YTVVPHLSLPHWAAQDFAKSLQSFRLGCANLKNRQGWQDVCAQAFQTPVHSFQAKQFFER
zm96       61  YTVVPHLSLPHWAAQDFAKSLQSFRLGCANLKNRQGWQDVCAQAFQTPVHSFQAKQFFER
zm01       61  YTVVPHLSLPHWAAQDFAKSLQSFRLGCANLKNRQGWQDVCAQAFQTPVHSFQAKQFFER
zm02       61  YTVVPHLSLPHWAAQDFAKSLQSFRLGCANLKNRQGWQDVCAQAFQTPVHSFQAKQFFER
zm03       61  YTVVPHLSLPHWAAQDFAKSLQSFRLGCANLKNRQGWQDVCAQAFQTPVHSFQAKQFFER
zm07       61  YTVVPHLSLPHWAAQDFAKSLQSFRLGCANLKNRQGWQDVCAQAFQTPVHSFQAKQFFER
zm12       61  YTVVPHLSLPHWAAQDFAKSLQSFRLGCANLKNRQGWQDVCAQAFQTPVHSFQAKQFFER
zm18       61  YTVVPHLSLPHWAAQDFAKSLQSFRLGCANLKNRQGWQDVCAQAFQTPVHSFQAKQFFER
zm19       61  YTVVPHLSLPHWAAQDFAKSLQSFRLGCANLKNRQGWQDVCAQAFQTPVHSFQAKQFFER
zm20       61  YTVVPHLSLPHWAAQDFAKSLQSFRLGCANLKNRQGWQDVCAQAFQTPVHSFQAKQFFER
zm21       61  YTVVPHLSLPHWAAQDFAKSLQSFRLGCANLKNRQGWQDVCAQAFQTPVHSFQAKQFFER
zm06       61  YTVVPHLSLPHWAAQDFAKSLQSFRLGCANLKNRQGWQDVCAQAFQTPVHSFQAKQFFER
zm17       61  YTVVPHLSLPHWAAQDFAKSLQSFRLGCANLKNRQGWQDVCAQAFQTPVHSFQAKQFFER
zm13       61  YTVVPHLSLPHWAEQDFAKSLQSFRLGCANLKNRQGWQDVCAQAFQTPVHSFQAKQFFER
zm05       61  YTVVPHLSLPHWAAQDFAKSLQSFRLSCANLKNRQGWQDVCAQAFQTPVHSFQAKQFFER
z2491      61  YTVVPHLSLPHWAAQDFAKSLQSFRLGCANLKNRQGWQDVCAQAFQTPVHSVQAKQFFER
zm22       61  YTVVPHLSLPHWAAQDFAKSLQSFRLGCANLKNRQGWQDVCAQAFQTPVHSVQAKQFFER
zm26       61  YTVVPHLSLPHWAAQDFAKSLQSFRLGCANLKNRQGWQDVCAQAFQTPVHSVQAKQFFER
zm28       61  YTVVPHLSLPHWAAQDFAKSLQSFRLGCANLKNRQGWQDVCAQAFQTPVHSFQAKQFFER
zm29asbc   61  YTVVPHLSLPHWAAQDFAKSLQSFRLGCANLKNRQGWQDVCAQAFQTPVHSFQAKQFFER
zm16       61  YTVVPHLSLPHWAAQDFAKSLQSFRLGCANLKNRQGWQDVCAQAFQTPVHSFQAKQFFER
zm15       61  YTVVPHLSLPHWAAQDFAKSLQSFRLGCANLKNHQGWQDVCAQAFQTPVHSFQAKQFFER
zm31asbc   61  YTVVPHLSLPHWAAQDFAKSLQSFRLGCANLKNRQGWQDVCAQAFQTPVHSFQAKQFFER
```

FIG. 23A

```
fa1090     121 YFTPWQVAGNGSLAGTVTGYYEPVLKGDGRRTERARFPIYGIPDDFISVPLPAGLRGGKN
zm33asbc   121 YFTPWQVAGNGSLAGTVTGYYEPVLKGDGRRTERARFPIYGIPDDFISVPLPAGLRGGKN
zm32asbc   121 YFTPWQVAGNGSLAGTVTGYYEPVLKGDGRRTERARFPIYGIPDDFISVPLPAGLRGGKA
zm23asbc   121 YFTPWQVAGNGSLAGTVTGYYEPVLKGDDRRTAQARFPIYGIPDDFISVPLPAGLRSGKA
zm27bc     121 YFTPWQVAGNGSLAGTVTGYYEPVLKGDDRRTAQARFPIYGIPDDFISVPLPAGLRSGKA
zm09       121 YFTPWQVAGNGSLAGTVTGYYEPVLKGDDRRTAQARFPIYGIPDDFISVPLPAGLRSGKA
zm10       121 YFTPWQVAGNGSLAGTVTGYYEPVLKGDDRRTAQARFPIYGIPDDFISVPLPAGLRSGKA
zm24       121 YFTPWQVAGNGSLAGTVTGYYEPVLKGDDRRTAQARFPIYGIPDDFISVPLPAGLRSGKA
zm25       121 YFTPWQVAGNGSLAGTVTGYYEPVLKGDDRRTAQARFPIYGIPDDFISVPLPAGLRSGKA
zm14       121 YFTPWQVAGNGSLAGTVTGYYEPVLKGDDRRTAQARFPIYGIPDDFISVPLPAGLRSGKA
zm04       121 YFTPWQVAGNGSLAGTVTGYYEPVLKGDDRRTAQARFPIYGIPDDFISVPLPAGLRSGKA
zm11asbc   121 YFTPWQVAGNGSLAGTVTGYYEPVLKGDDRRTAQARFPIYGIPDDFISVPLPAGLRSGKA
zm08n      121 YFTPWQVAGNGSLAGTVTGYYEPVLKGDDRRTAQARFPIYGIPDDFISVPLPAGLRSGKA
zm96       121 YFTPWQVAGNGSLAGTVTGYYEPVLKGDDRRTAQARFPIYGIPDDFISVPLPAGLRSGKA
zm01       121 YFTPWQVAGNGSLAGTVTGYYEPVLKGDDRRTAQARFPIYGIPDDFISVPLPAGLRSGKA
zm02       121 YFTPWQVAGNGSLAGTVTGYYEPVLKGDDRRTAQARFPIYGIPDDFISVPLPAGLRSGKA
zm03       121 YFTPWQVAGNGSLAGTVTGYYEPVLKGDDRRTAQARFPIYGIPDDFISVPLPAGLRSGKA
zm07       121 YFTPWQVAGNGSLAGTVTGYYEPVLKGDDRRTAQARFPIYGIPDDFISVPLPAGLRSGKA
zm12       121 YFTPWQVAGNGSLAGTVTGYYEPVLKGDDRRTAQARFPIYGIPDDFISVPLPAGLRSGKA
zm18       121 YFTPWQVAGNGSLAGTVTGYYEPVLKGDDRRTAQARFPIYGIPDDFISVPLPAGLRSGKA
zm19       121 YFTPWQVAGNGSLAGTVTGYYEPVLKGDDRRTAQARFPIYGIPDDFISVPLPAGLRSGKA
zm20       121 YFTPWQVAGNGSLAGTVTGYYEPVLKGDDRRTAQARFPIYGIPDDFISVPLPAGLRSGKA
zm21       121 YFTPWQVAGNGSLAGTVTGYYEPVLKGDDRRTAQARFPIYGIPDDFISVPLPAGLRSGKA
zm06       121 YFTPWQVAGNGSLAGTVTGYYEPVLKGDDRRTAQARFPIYGIPDDFISVPLPAGLRSGKA
zm17       121 YFTPWQVAGNGSLAGTVTGYYEPVLKGDDRRTAQARFPIYGIPDDFISVPLPAGLRSGKA
zm13       121 YFTPWQVAGNGSLAGTVTGYYEPVLKGDDRRTAQARFPIYGIPDDFISVPLPAGLRSGKA
zm05       121 YFTPWQVAGNGSLAGTVTGYYEPVLKGDDRRTAQARFPIYGIPDDFISVPLPAGLRSGKA
z2491      121 YFTPWQVAGNGSLAGTVTGYYEPVLKGDDRRTAQARFPIYGIPDDFISVPLPAGLRSGKA
zm22       121 YFTPWQVAGNGSLAGTVTGYYEPVLKGDDRRTAQARFPIYGIPDDFISVPLPAGLRSGKA
zm26       121 YFTPWQVAGNGSLAGTVTGYYEPVLKGDDRRTAQARFPIYGIPDDFISVPLPAGLRSGKA
zm28       121 YFTPWQVAGNGSLAGTVTGYYEPVLKGDDRRTAQARFPIYGIPDDFISVPLPAGLRSGKA
zm29asbc   121 YFTPWQVAGNGSLAGTVTGYYEPVLKGDDRRTAQARFPIYGIPDDFISVPLPAGLRSGKA
zm16       121 YFTPWQVAGNGSLAGTVTGYYEPVLKGDDRRTAQARFPIYGIPDDFISVPLPAGLRSGKA
zm15       121 YFTPWQVAGNGSLAGTVTGYYEPVLKGDDRRTAQARFPIYGIPDDFISVPLPAGLRSGKA
zm31asbc   121 YFTPWQVAGNGSLAGTVTGYYEPVLKGDDRRTAQARFPIYGIPDDFISVPLPAGLRSGKA

fa1090     181 LVRIRQTGKNSGTIDNAGGTHTADLSRFPITARTTAIKGRFEGSRFLPYHTRNQINGGAL
zm33asbc   181 LVRIRQTGKNSGTIDNAGGTHTADLSRFPITARTTAIKGRFEGSRFLPYHTRNQINGGAL
zm32asbc   181 LVRIRQTGKNSGTIDNAGGTHTADLSRFPITARTTAIKGRFEGSRFLPYHTRNQINGGAL
zm23asbc   181 LVRIRQTGKNSGTIDNAGGTHTADLSRFPITARTTAIKGRFEGSRFLPYHTRNQINGGAL
zm27bc     181 LVRIRQTGKNSGTIDNAGGTHTADLSRFPITARTTAIKGRFEGSRFLPYHTRNQINGGAL
zm09       181 LVRIRQTGKNSGTIDNTGGTHTADLSQFPITARTTAIKGRFEGSRFLPYHTRNQINGGAL
zm10       181 LVRIRQTGKNSGTIDNTGGTHTADLSQFPITARTTAIKGRFEGSRFLPYHTRNQINGGAL
zm24       181 LVRIRQTGKNSGTIDNTGGTHTADLSQFPITARTTAIKGRFEGSRFLPYHTRNQINGGAL
zm25       181 LVRIRQTGKNSGTIDNTGGTHTADLSQFPITARTTAIKGRFEGSRFLPYHTRNQINGGAL
zm14       181 LVRIRQTGKNSGTIDNAGGTHTADLSRFPITARTTAIKGRFEGSRFLPYHTRNQINGGAL
zm04       181 LVRIRQTGKNSGTIDNAGGTHTADLSRFPITARTTAIKGRFEGSRFLPYHTRNQINGGAL
zm11asbc   181 LVRIRQTGKNSGTIDNAGGTHTADLSRFPITARTTAIKGRFEGSRFLPYHTRNQINGGAL
zm08n      181 LVRIRQTGKNSGTIDNTGGTHTADLSRFPITARTTAIKGRFEGSRFLPYHTRNQINGGAL
zm96       181 LVRIRQTGKNSGTIDNTGGTHTADLSRFPITARTTAIKGRFEGSRFLPYHTRNQINGGAL
zm01       181 LVRIRQTGKNSGTIDNTGGTHTADLSRFPITARTTAIKGRFEGSRFLPYHTRNQINGGAL
zm02       181 LVRIRQTGKNSGTIDNTGGTHTADLSRFPITARTTAIKGRFEGSRFLPYHTRNQINGGAL
zm03       181 LVRIRQTGKNSGTIDNTGGTHTADLSRFPITARTTAIKGRFEGSRFLPYHTRNQINGGAL
zm07       181 LVRIRQTGKNSGTIDNTGGTHTADLSRFPITARTTAIKGRFEGSRFLPYHTRNQINGGAL
zm12       181 LVRIRQTGKNSGTIDNTGGTHTADLSRFPITARTTAIKGRFEGSRFLPYHTRNQINGGAL
zm18       181 LVRIRQTGKNSGTIDNTGGTHTADLSRFPITARTTAIKGRFEGSRFLPYHTRNQINGGAL
zm19       181 LVRIRQTGKNSGTIDNTGGTHTADLSRFPITARTTAIKGRFEGSRFLPYHTRNQINGGAL
zm20       181 LVRIRQTGKNSGTIDNTGGTHTADLSRFPITARTTAIKGRFEGSRFLPYHTRNQINGGAL
zm21       181 LVRIRQTGKNSGTIDNTGGTHTADLSRFPITARTTAIKGRFEGSRFLPYHTRNQINGGAL
zm06       181 LVRIRQTGKNSGTIDNTGGTHTADLSRFPITARTTAIKGRFEGSRFLPYHTRNQINGGAL
zm17       181 LVRIRQTGKNSGTIDNTGGTHTADLSRFPITARTTAIKGRFEGSRFLPYHTRNQINGGAL
zm13       181 LVRIRQTGKNSGTIDNTGGTHTADLSRFPITARTTAIKGRFEGSRFLPYHTRNQINGGAL
zm05       181 LVRIRQTGKNSGTIDNTGGTHTADLSRFPITARTTAIKGRFEGSRFLPYHTRNQINGGAL
z2491      181 LVRIRQTGKNSGTIDNTGGTHTADLSQFPITARTTAIKGRFEGSRFLPYHTRNQINGGAL
zm22       181 LVRIRQTGKNSGTIDNTGGTHTADLSQFPITARTTAIKGRFEGSRFLPYHTRNQINGGAL
zm26       181 LVRIRQTGKNSGTIDNTGGTHTADLSQFPITARTTAIKGRFEGSRFLPYHTRNQINGGAL
zm28       181 LVRIRQTGKNSGTIDNTGGTHTADLSQFPITARTTAIKGRFEGSRFLPYHTRNQINGGAL
zm29asbc   181 LVRIRQTGKNSGTIDNTGGTHTADLSQFPITARTTAIKGRFEGSRFLPYHTRNQINGGAL
zm16       181 LVRIRQTGKNSGTIDNTGGTHTADLSQFPITARTTAIKGRFEGSRFLPYHTRNQINGGAL
zm15       181 LVRIRQTGKNSGTIDNTGGTHTADLSRFPITARTTAIKGRFEGSRFLPYHTRNQINGGAL
zm31asbc   181 LVRIRQTGKNSGTIDNAGGTHTADLSRFPITARTTAIKGRFEGSRFLPYHTRNQINGGAL
```

FIG. 23B

| | | |
|---|---|---|
| fa1090 | 241 | DGKAPILGYAEDPVELFFMHIQGSGRLKTPSGKYIRIGYADKNEHPYVSIGRYMADKGYL |
| zm33asbc | 241 | DGKAPILGYAEDPVELFFMHIQGSGRLKTPSGKYIRIGYADKNEHPYVSIGRYMADKGYL |
| zm32asbc | 241 | DGKAPILGYAEDPVELFFMHIQGSGRLKTPSGKYIRIGYADKNEHPYVSIGRYMADKGYL |
| zm23asbc | 241 | DGKAPILGYAEDPVELFFMHIQGSGRLKTPSGKYIRIGYADKNEHPYVSIGKYMADKGYL |
| zm27bc | 241 | DGKAPILGYAEDPVELFFMHIQGSGRLKTPSGKYIRIGYADKNEHPYVSIGRYMADKGYL |
| zm09 | 241 | DGKAPILGYAEDPVELFFMHIQGSGRLKTPSGKYIRIGYADKNEHPYVSIGKYMADKGYL |
| zm10 | 241 | DGKAPILGYAEDPVELFFMHIQGSGRLKTPSGKYIRIGYADKNEHPYVSIGKYMADKGYL |
| zm24 | 241 | DGKAPILGYAEDPVELFFMHIQGSGRLKTPSGKYIRIGYADKNEHPYVSIGKYMADKGYL |
| zm25 | 241 | DGKAPILGYAEDPVELFFMHIQGSGRLKTPSGKYIRIGYADKNEHPYVSIGKYMADKGYL |
| zm14 | 241 | DGKAPILGYAEDPVELFFMHIQGSGRLKTPSGKYIRIGYADKNEHPYVSIGKYMADKGYL |
| zm04 | 241 | DGKAPILGYAEDPVELFFMHIQGSGRLKTPSGKYIRIGYADKNEHPYVSIGRYMADKGYL |
| zm11asbc | 241 | DGKAPILGYAEDPVELFFMHIQGSGRLKTPSGKYIRIGYADKNEHPYVSIGKYMADKGYL |
| zm08n | 241 | DGKAPILGYAEDPVELFFMHIQGSGRLKTPSGKYIRIGYADKNEHPYVSIGRYMADKGYL |
| zm96 | 241 | DGKAPILGYAEDPVELFFMHIQGSGRLKTPSGKYIRIGYADKNEHPYVSIGRYMADKGYL |
| zm01 | 241 | DGKAPILGYAEDPVELFFMHIQGSGRLKTPSGKYIRIGYADKNEHPYVSIGRYMADKGYL |
| zm02 | 241 | DGKAPILGYAEDPVELFFMHIQGSGRLKTPSGKYIRIGYADKNEHPYVSIGRYMADKGYL |
| zm03 | 241 | DGKAPILGYAEDPVELFFMHIQGSGRLKTPSGKYIRIGYADKNEHPYVSIGRYMADKGYL |
| zm07 | 241 | DGKAPILGYAEDPVELFFMHIQGSGRLKTPSGKYIRIGYADKNEHPYVSIGRYMADKGYL |
| zm12 | 241 | DGKAPILGYAEDPVELFFMHIQGSGRLKTPSGKYIRIGYADKNEHPYVSIGRYMADKGYL |
| zm18 | 241 | DGKAPILGYAEDPVELFFMHIQGSGRLKTPSGKYIRIGYADKNEHPYVSIGRYMADKGYL |
| zm19 | 241 | DGKAPILGYAEDPVELFFMHIQGSGRLKTPSGKYIRIGYADKNEHPYVSIGRYMADKGYL |
| zm20 | 241 | DGKAPILGYAEDPVELFFMHIQGSGRLKTPSGKYIRIGYADKNEHPYVSIGRYMADKGYL |
| zm21 | 241 | DGKAPILGYAEDPVELFFMHIQGSGRLKTPSGKYIRIGYADKNEHPYVSIGRYMADKGYL |
| zm06 | 241 | DGKAPILGYAEDPVELFFMHIQGSGRLKTPSGKYIRIGYADKNEHPYVSIGKYMADKGYL |
| zm17 | 241 | DGKAPILGYAEDPVELFFMHIQGSGRLKTPSGKYIRIGYADKNEHPYVSIGKYMADKGYL |
| zm13 | 241 | DGKAPILGYAEDPVELFFMHIQGSGRLKTPSGKYIRIGYADKNEHPYVSIGRYMADKGYL |
| zm05 | 241 | DGKAPILGYAEDPVELFFMHIQGSGRLKTPSGKYIRIGYADKNEHPYVSIGRYMADKGYL |
| z2491 | 241 | DGKAPILGYAEDPVELFFMHIQGSGRLKTPSGKYIRIGYADKNEHPYVSIGRYMADKGYL |
| zm22 | 241 | DGKAPILGYAEDPVELFFMHIQGSGRLKTPSGKYIRIGYADKNEHPYVSIGRYMADKGYL |
| zm26 | 241 | DGKAPILGYAEDPVELFFMHIQGSGRLKTPSGKYIRIGYADKNEHPYVSIGRYMADKGYL |
| zm28 | 241 | DGKAPILGYAEDPVELFFMHIQGSGRLKTPSGKYIRIGYADKNEHPYVSIGRYMADKGYL |
| zm29asbc | 241 | DGKAPILGYAEDPVELFFMHIQGSGRLKTPSGKYIRIGYADKNEHPYVSIGRYMADKGYL |
| zm16 | 241 | DGKAPILGYAEDPVELFFMHIQGSGRLKTPSGKYIRIGYADKNEHPYVSIGKYMADKGYL |
| zm15 | 241 | DGKAPILGYAEDPVELFFMHIQGSGRLKTPSGKYIRIGYADKNEHPYVSIGKYMADKGYL |
| zm31asbc | 241 | DGKAPILGYAEDPVELFFMHIQGSGRLKTPSGKYIRIGYADKNEHPYVSIGRYMADKGYL |

| | | |
|---|---|---|
| fa1090 | 301 | KLGQTSMQGIKAYMRQNPQRLAEVLGQNPSYIFFRELAGSGNEGPVGALGTPLMGEYAGA |
| zm33asbc | 301 | KLGQTSMQGIKSYMRQNPHKLAEVLGQNPSYIFFRELAGSGNEGPVGALGTPLMGEYAGA |
| zm32asbc | 301 | KLGQTSMQGIKAYMRQNPQRLAEVLGQNPSYIFFRELAGSGGDGPVGALGTPLMGGYAGA |
| zm23asbc | 301 | KLGQTSMQGIKSYMRQNPQRLAEVLGQNPSYIFFRELAGSSNDGPVGALGTPLMGEYAGA |
| zm27bc | 301 | KLGQTSMQGIKSYMRQNPQRLAEVLGQNPSYIFFRELTGSSNDGPVGALGTPLMGEYAGA |
| zm09 | 301 | KLGQTSMQGIKSYMRQNPQRLAEVLGQNPSYIFFRELTGSGNDGPVGALGTPLMGEYAGA |
| zm10 | 301 | KLGQTSMQGIKSYMRQNPQRLAEVLGQNPSYIFFRELTGSGNDGPVGALGTPLMGEYAGA |
| zm24 | 301 | KLGQTSMQGIKSYMRQNPQRLAEVLGQNPSYIFFRELTGSGNDGPVGALGTPLMGEYAGA |
| zm25 | 301 | KLGQTSMQGIKSYMRQNPQRLAEVLGQNPSYIFFRELTGSGNDGPVGALGTPLMGEYAGA |
| zm14 | 301 | KLGQTSMQGIKSYMRQNPQRLAEVLGQNPSYIFFRELTGSRNDGPVGALGTPLMGEYAGA |
| zm04 | 301 | KLGQTSMQGIKAYMQQNPQRLAEVLGQNPSYIFFRELTGSSNDGPVGALGTPLMGEYAGA |
| zm11asbc | 301 | KLGQTSMQGIKSYMRQNPQRLAEVLGQNPSYIFFRELTGSSNDGPVGALGTPLMGEYAGA |
| zm08n | 301 | KLGQTSMQGIKAYMRQNPQRLAEVLGQNPSYIFFRELAGSSNDGPVGALGTPLMGEYAGA |
| zm96 | 301 | KLGQTSMQGIKAYMRQNPQRLAEVLGQNPSYIFFRELAGSSNDGPVGALGTPLMGEYAGA |
| zm01 | 301 | KLGQTSMQGIKSYMRQNPQRLAEVLGQNPSYIFFRELAGSSNDGPVGALGTPLMGEYAGA |
| zm02 | 301 | KLGQTSMQGIKSYMRQNPQRLAEVLGQNPSYIFFRELAGSSNDGPVGALGTPLMGEYAGA |
| zm03 | 301 | KLGQTSMQGIKSYMRQNPQRLAEVLGQNPSYIFFRELAGSSNDGPVGALGTPLMGEYAGA |
| zm07 | 301 | KLGQTSMQGIKSYMRQNPQRLAEVLGQNPSYIFFRELAGSSNDGPVGALGTPLMGEYAGA |
| zm12 | 301 | KLGQTSMQGIKSYMRQNPQRLAEVLGQNPSYIFFRELAGSSNDGPVGALGTPLMGEYAGA |
| zm18 | 301 | KLGQTSMQGIKSYMRQNPQRLAEVLGQNPSYIFFRELAGSSNDGPVGALGTPLMGEYAGA |
| zm19 | 301 | KLGQTSMQGIKSYMRQNPQRLAEVLGQNPSYIFFRELAGSSNDGPVGALGTPLMGEYAGA |
| zm20 | 301 | KLGQTSMQGIKSYMRQNPQRLAEVLGQNPSYIFFRELAGSSNDGPVGALGTPLMGEYAGA |
| zm21 | 301 | KLGQTSMQGIKSYMRQNPQRLAEVLGQNPSYIFFRELAGSSNDGPVGALGTPLMGEYAGA |
| zm06 | 301 | KLGQTSMQGIKSYMRQNPQRLAEVLGQNPSYIFFRELAGSSNDGPVGALGTPLMGEYAGA |
| zm17 | 301 | KLGQTSMQGIKSYMRQNPQRLAEVLGQNPSYIFFRELTGSSNDGPVGALGTPLMGEYAGA |
| zm13 | 301 | KLGQTSMQGIKAYMRQNPQRLAEVLGQNPSYIFFRELAGSSNDGPVGALGTPLMGEYAGA |
| zm05 | 301 | KLGQTSMQGIKAYMRQNPQRLAEVLGQNPSYIFFRELAGSSNDGPVGALGTPLMGEYAGA |
| z2491 | 301 | KLGQTSMQGIKAYMQQNPQRLAEVLGQNPSYIFFRELTGSSNDGPVGALGTPLMGEYAGA |
| zm22 | 301 | KLGQTSMQGIKAYMQQNPQRLAEVLGQNPSYIFFRELTGSSNDGPVGALGTPLMGEYAGA |
| zm26 | 301 | KLGQTSMQGIKAYMQQNPQRLAEVLGQNPSYIFFRELTGSSNDGPVGALGTPLMGEYAGA |
| zm28 | 301 | KLGQTSMQGIKAYMRQNPQRLAEVLGQNPSYIFFRELAGSSNDGPVGALGTPLMGEYAGA |
| zm29asbc | 301 | KLGQTSMQGIKSYMRQNPQRLAEVLGQNPSYIFFRELTGSGNDGPVGALGTPLMGEYAGA |
| zm16 | 301 | KLGQTSMQGIKSYMRQNPQRLAEVLGQNPSYIFFRELTGSSNDGPVGALGTPLMGEYAGA |
| zm15 | 301 | KLGQTSMQGIKSYMRQNPQRLAEVLGQNPSYIFFRELTGSGNDGPVGALGTPLMGEYAGA |
| zm31asbc | 301 | KLGQTSMQGIKAYMRQNPQRLAEVLGQNPSYVFFRELAGSGNDGPVGALGTPLMGEYAGA |

FIG. 23C

```
fa1090     361 IDRHYITLGAPLFVATAHPVTRKALNRLIMAQDTGSAIKGAVRVDYFWGYGDEAGELAGK
zm33asbc   361 IDRHYITLGAPLFVATAHPVTRKALNRLIMAQDTGSAIKGAVRVDYFWGYGDEAGELAGK
zm32asbc   361 IDRHYITLGAPLFVATAHPVTRKALNRLIMAQDTGSAIKGAVRVDYFWGYGDEAGELAGK
zm23asbc   361 VDRHYITLGAPLFVATAHPVTSKALNRLIMAQDTGSAIKGAVRVDYFWGYGDEAGETAGK
zm27bc     361 VDRHYITLGAPLFVATAHPVTRKALNRLIMAQDTGSAIKGAVRVDYFWGYGDEAGETAGK
zm09       361 VDRHYITLGAPLFVATAHPVTRKALNRLIMAQDTGSAIKGAVRVDYFWGYGDEAGELAGK
zm10       361 VDRHYITLGAPLFVATAHPVTRKALNRLIMAQDTGSAIKGAVRVDYFWGYGDEAGELAGK
zm24       361 VDRHYITLGAPLFVATAHPVTRKALNRLIMAQDTGSAIKGAVRVDYFWGYGDEAGELAGK
zm25       361 VDRHYITLGAPLFVATAHPVTRKALNRLIMAQDTGSAIKGAVRVDYFWGYGDEAGELAGK
zm14       361 VDRHYITLGAPLFVATAHPVTRKALNRLIMAQDTGSAIKGAVRVDYFWGYGDEAGELAGK
zm04       361 VDRHYITLGAPLFVATAHPVTRKALNRLIMAQDTGSAIKGAVRVDYFWGYGDEAGELAGK
zm11asbc   361 VDRHYITLGAPLFVATAHPVTRKALNRLIMAQDTGSAIKGAVRVDYFWGYGDEAGELAGK
zm08n      361 VDRHYITLGAPLFVATAHPVTRKALNRLIMAQDTGSAIKGAVRVDYFWGYGDEAGELAGK
zm96       361 VDRHYITLGAPLFVATAHPVTRKALNRLIMAQDTGSAIKGAVRVDYFWGYGDEAGELAGK
zm01       361 VDRHYITLGAPLFVATAHPVTRKALNRLIMAQDTGSAIKGAVRVDYFWGYGDEAGELAGK
zm02       361 VDRHYITLGAPLFVATAHPVTRKALNRLIMAQDTGSAIKGAVRVDYFWGYGDEAGELAGK
zm03       361 VDRHYITLGAPLFVATAHPVTRKALNRLIMAQDTGSAIKGAVRVDYFWGYGDEAGELAGK
zm07       361 VDRHYITLGAPLFVATAHPVTRKALNRLIMAQDTGSAIKGAVRVDYFWGYGDEAGELAGK
zm12       361 VDRHYITLGAPLFVATAHPVTRKALNRLIMAQDTGSAIKGAVRVDYFWGYGDEAGELAGK
zm18       361 VDRHYITLGAPLFVATAHPVTRKALNRLIMAQDTGSAIKGAVRVDYFWGYGDEAGELAGK
zm19       361 VDRHYITLGAPLFVATAHPVTRKALNRLIMAQDTGSAIKGAVRVDYFWGYGDEAGELAGK
zm20       361 VDRHYITLGAPLFVATAHPVTRKALNRLIMAQDTGSAIKGAVRVDYFWGYGDEAGELAGK
zm21       361 VDRHYITLGAPLFVATAHPVTRKALNRLIMAQDTGSAIKGAVRVDYFWGYGDEAGELAGK
zm06       361 VDRHYITLGAPLFVATAHPVTRKALNRLIMAQDTGSAIKGAVRVDYFWGYGDEAGELAGK
zm17       361 VDRHYITLGAPLFVATAHPVTRKALNRLIMAQDTGSAIKGAVRVDYFWGYGDEAGELAGK
zm13       361 VDRHYITLGAPLFVATAHPVTRKALNRLIMAQDTGSAIKGAVRVDYFWGYGDEAGELAGK
zm05       361 VDRHYITLGAPLFVATAHPVTRKALNRLIMAQDTGSAIKGAVRVDYFWGYGDEAGELAGK
z2491      361 VDRHYITLGAPLFVATAHPVTRKALNRLIMAQDTGSAIKGAVRVDYFWGYGDEAGELAGK
zm22       361 VDRHYITLGAPLFVATAHPVTRKALNRLIMAQDTGSAIKGAVRVDYFWGYGDEAGELAGK
zm26       361 VDRHYITLGAPLFVATAHPVTRKALNRLIMAQDTGSAIKGAVRVDYFWGYGDEAGELAGK
zm28       361 VDRHYITLGAPLFVATAHPVTRKALNRLIMAQDTGSAIKGAVRVDYFWGYGDEAGELAGK
zm29asbc   361 VDRHYITLGAPLFVATTHPITRKALNRLIMAQDTGSAIKGAVRVDYFWGYGDEAGELAGK
zm16       361 VDRHYITLGAPLFVATAHPVTRKALNRLIMAQDTGSAIKGAVRVDYFWGYGDEAGELAGK
zm15       361 VDRHYITLGAPLFVATAHPVTRKALNRLIMAQDTGSAIKGAVRVDYFWGYGDEAGELAGK
zm31asbc   361 VDRHYITLGAPLFVATAHPVTRKALNRLIMAQDTGSAIKGAVRVDYFWGYGDEAGELAGK

fa1090     421 QKTTGYVWQLLPNGMKPEYRP*
zm33asbc   421 QKTTGYVWQLLPNGMKPEYRP*
zm32asbc   421 QKTTGYVWQLLPNGMKPEYRP*
zm23asbc   421 MKEPGYVWQLLPNGMKPEYRP*
zm27bc     421 MKEPGYVWQLLPNGMKPEYRP*
zm09       421 QKTTGYVWQLLPNGMKPEYRP*
zm10       421 QKTTGYVWQLLPNGMKPEYRP*
zm24       421 QKTTGYVWQLLPNGMKPEYRP*
zm25       421 QKTTGYVWQLLPNGMKPEYRP*
zm14       421 QKTTGYVWQLLPNGMKPEYRP*
zm04       421 QKTTGYVWQLLPNGMKPEYRP*
zm11asbc   421 QKTTGYVWQLLPNGMKPEYRP*
zm08n      421 QKTTGYVWQLLPNGMKPEYRP*
zm96       421 QKTTGYVWQLLPNGMKPEYRP*
zm01       421 QKTTGYVWQLLPNGMKPEYRP*
zm02       421 QKTTGYVWQLLPNGMKPEYRP*
zm03       421 QKTTGYVWQLLPNGMKPEYRP*
zm07       421 QKTTGYVWQLLPNGMKPEYRP*
zm12       421 QKTTGYVWQLLPNGMKPEYRP*
zm18       421 QKTTGYVWQLLPNGMKPEYRP*
zm19       421 QKTTGYVWQLLPNGMKPEYRP*
zm20       421 QKTTGYVWQLLPNGMKPEYRP*
zm21       421 QKTTGYVWQLLPNGMKPEYRP*
zm06       421 QKTTGYVWQLLPNGMKPEYRP*
zm17       421 QKTTGYVWQLLPNGMKPEYRP*
zm13       421 QKTTGYVWQLLPNGMKPEYRP*
zm05       421 QKTTGYVWQLLPNGMKPEYRP*
z2491      421 QKTTGYVWQLLPNGMKPEYRP*
zm22       421 QKTTGYVWQLLPNGMKPEYRP*
zm26       421 QKTTGYVWQLLPNGMKPEYRP*
zm28       421 QKTTGYVWQLLPNGMKPEYRP*
zm29asbc   421 QKTTGYVWQLLPNGMKPEYRP*
zm16       421 QKTTGYVWQLLPNGMKPEYRP*
zm15       421 QKTTGYVWQLLPNGMKPEYRP*
zm31asbc   421 QKTTGYVWQLLPNGMKPEYRP*
```

FIG. 23D

*NEISSERIA MENINGITIDIS* ANTIGENS AND COMPOSITIONS

This application is a continuation-in-part of the following U.S. Provisional patent applications, from each of which priority is claimed, and each of which is incorporated by reference in its entirety: 60/083,758 (filed May 1, 1998); 60/094,869 (filed Jul. 31, 1998); 60/098,994 (filed Sep. 2, 1998); 60/099,062 (filed Sep. 2, 1998); 60/103,749 (filed Oct. 9, 1998); 60/103,794 (filed Oct. 9, 1998); 60/103,796 (filed Oct. 9, 1998); and 60/121,528 (filed Feb. 25, 1999).

This invention relates to antigens from the bacterial species: *Neisseria meningitidis* and *Neisseria gonorrhoeae.*

The Sequence Listing for this application, incorporated herewith by reference, has been submitted on two duplicate compact discs, under the file name SEQLIST223002101200. This file was created on May 2, 2006, and its size is 6.08 MB.

BACKGROUND

*Neisseria meningitidis* is a non-motile, gram negative *diplococcus* human pathogen. It colonizes the pharynx, causing meningitis and, occasionally, septicaemia in the absence of meningitis. It is closely related to *N. gonorrhoea*, although one feature that clearly differentiates meningococcus from gonococcus is the presence of a polysaccharide capsule that is present in all pathogenic meningococci.

*N. meningitidis* causes both endemic and epidemic disease. In the United States the attack rate is 0.6-1 per 100,000 persons per year, and it can be much greater during outbreaks. (see Lieberman et al. (1996) Safety and Immunogenicity of a Serogroups A/C *Neisseria meningitidis* Oligosaccharide-Protein Conjugate Vaccine in Young Children. *JAMA* 275 (19):1499-1503; Schuchat et al (1997) Bacterial Meningitis in the United States in 1995. *N Engl J Med* 337(14):970-976). In developing countries, endemic disease rates are much higher and during epidemics incidence rates can reach 500 cases per 100,000 persons per year. Mortality is extremely high, at 10-20% in the United States, and much higher in developing countries. Following the introduction of the conjugate vaccine against *Haemophilus influenzae, N. meningitidis* is the major cause of bacterial meningitis at all ages in the United States (Schuchat et al (1997) supra).

Based on the organism's capsular polysaccharide, 12 serogroups of *N. meningitidis* have been identified. Group A is the pathogen most often implicated in epidemic disease in sub-Saharan Africa. Serogroups B and C are responsible for the vast majority of cases in the United States and in most developed countries. Serogroups W135 and Y are responsible for the rest of the cases in the United States and developed countries. The meningococcal vaccine currently in use is a tetravalent polysaccharide vaccine composed of serogroups A, C, Y and W135. Although efficacious in adolescents and adults, it induces a poor immune response and short duration of protection, and cannot be used in infants [eg. Morbidity and Mortality weekly report, Vol. 46, No. RR-5 (1997)]. This is because polysaccharides are T-cell independent antigens that induce a weak immune response that cannot be boosted by repeated immunization. Following the success of the vaccination against *H. influenzae*, conjugate vaccines against serogroups A and C have been developed and are at the final stage of clinical testing (Zollinger WD "New and Improved Vaccines Against Meningococcal Disease". In: *New Generation Vaccines*, supra, pp. 469-488; Lieberman et al (1996) supra; Costantino et al (1992) Development and phase I clinical testing of a conjugate vaccine against meningococcus A and C. *Vaccine* 10:691-698).

Meningococcus B (menB) remains a problem, however. This serotype currently is responsible for approximately 50% of total meningitis in the United States, Europe, and South America. The polysaccharide approach cannot be used because the menB capsular polysaccharide is a polymer of $\alpha$(2-8)-linked N-acetyl neuraminic acid that is also present in mammalian tissue. This results in tolerance to the antigen; indeed, if an immune response were elicited, it would be anti-self, and therefore undesirable. In order to avoid induction of autoimmunity and to induce a protective immune response, the capsular polysaccharide has, for instance, been chemically modified substituting the N-acetyl groups with N-propionyl groups, leaving the specific antigenicity unaltered (Romero & Outschoorn (1994) Current status of Meningococcal group B vaccine candidates: capsular or non-capsular? *Clin Microbiol Rev* 7(4):559-575).

Alternative approaches to menB vaccines have used complex mixtures of outer membrane proteins (OMPs), containing either the OMPs alone, or OMPs enriched in porins, or deleted of the class 4 OMPs that are believed to induce antibodies that block bactericidal activity. This approach produces vaccines that are not well characterized. They are able to protect against the homologous strain, but are not effective at large where there are many antigenic variants of the outer membrane proteins. To overcome the antigenic variability, multivalent vaccines containing up to nine different porins have been constructed (eg. Poolman J T (1992) Development of a meningococcal vaccine. *Infect. Agents Dis.* 4:13-28). Additional proteins to be used in outer membrane vaccines have been the opa and opc proteins, but none of these approaches have been able to overcome the antigenic variability (eg. Ala'Aldeen & Borriello (1996) The meningococcal transferrin-binding proteins 1 and 2 are both surface exposed and generate bactericidal antibodies capable of killing homologous and heterologous strains. *Vaccine* 14(1):49-53).

A certain amount of sequence data is available for meningococcal and gonoccocal genes and proteins (e.g. EP-A-0467714, WO96/29412), but this is by no means complete. Other men B proteins may include those listed in WO 97/28273, WO 96/29412, WO 95/03413, U.S. Pat. No. 5,439,808, and U.S. Pat. No. 5,879,686.

The provision of further sequences could provide an opportunity to identify secreted or surface-exposed proteins that are presumed targets for the immune system and which are not antigenically variable. For instance, some of the identified proteins could be components of efficacious vaccines against meningococcus B, some could be components of vaccines against all meningococcal serotypes, and others could be components of vaccines against all pathogenic Neisseriae including *Neisseria meningitidis* or *Neisseria gonorrhoeae*. Those sequences specific to *N. meningitidis* or *N. gonorrhoeae* that are more highly conserved are further preferred sequences.

It is thus an object of the invention is to provide Neisserial DNA sequences which encode proteins that are antigenic or immunogenic.

BRIEF DESCRIPTION OF THE DRAWINGS

FIG. 1 illustrates the products of (B) protein expression and (A) purification, (C) FACs analysis, (D) bactericidal assay, (E) western blot, and (F) ELISA assay of the predicted ORF 919 as cloned and expressed in *E. coli.*

FIG. 2 illustrates the products of protein expression and purification, (B) western blot, (C) FACs analysis (D) bactericidal assay, and (E) ELISA assay of the predicted ORF 279 as cloned and expressed in *E. coli.*

FIG. 3 illustrates the products of (A) protein expression and purification, (B) western blot, (C) FACs analysis, (D) bactericidal assay, and (E) ELISA assay of the predicted ORF 576-1 as cloned and expressed in *E. coli.*

FIG. 4 illustrates the products of (A) protein expression and purification, (B) western blot, (C) FACs analysis, (D) bactericidal assay and (E) ELISA assay of the predicted ORF 519-1 as cloned and expressed in *E. coli.*

FIG. 5 illustrates the products of (A) protein expression and purification, (B) western blot, (C) FACs analysis, (D) bactericidal assay, and (E) ELISA assay of the predicted ORF 121-1 as cloned and expressed in *E. coli.*

FIG. 6 illustrates the products of (A) protein expression and purification, (B) western blot, (C) FACs analysis, (D) bactericidal assay, and (E) ELISA assay of the predicted ORF 128-1 as cloned and expressed in *E. coli.*

FIG. 7 illustrates the products of protein expression and purification, (B) western blot, (C) FACs analysis, (D) bactericidal assay, and (E) ELISA assay of the predicted ORF 206 as cloned and expressed in *E. coli.*

FIG. 8 illustrates the products of (A) protein expression and purification, (B) FACs analysis, (C) bactericidal assay, and (D) ELISA assay of the predicted ORF 287 as cloned and expressed in *E. coli.*

FIG. 9 illustrates the products of (A) protein expression and purification, (B) western blot, (C) FACs analysis, (D) bactericidal assay, and (E) ELISA assay of the predicted ORF 406 as cloned and expressed in *E. coli.*

FIG. 19A-C shows an alignment comparison of amino acid sequences for ORF 225 for several strains of *Neisseria*. Dark shading indicates regions of homology, and gray shading indicates the conservation of amino acids with similar characteristics. The Figure demonstrates a high degree of conservation among the various strains, further confirming its utility as an antigen for both vaccines and diagnostics. The sequences in the Figure have the following SEQ ID NOs: FA1090 SEQ ID 3115; Z2491 SEQ ID 3116; ZO01 225 SEQ ID 3117; ZO02 225 SEQ ID 3118; ZO03 225 SEQ ID 3119; ZO04 225 SEQ ID 3120; ZO05 225 SEQ ID 3121; ZO06 225 SEQ ID 3122; ZO07 225 SEQ ID 3123; ZO08 225 SEQ ID 3124; ZO09 225 SEQ ID 3125; ZO10 225 SEQ ID 3126; ZO11 225 SEQ ID 3127; ZO12 225 SEQ ID 3128; ZO13 225 SEQ ID 3129; ZO14 225 SEQ ID 3130; ZO15 225<SEQ ID 3131; ZO16 225 SEQ ID 3132; ZO17 225 SEQ ID 3133; ZO18 225 SEQ ID 3134; ZO19 225 SEQ ID 3135; ZO20 225 SEQ ID 3136; ZO21 225 SEQ ID 3137; ZO22 225 SEQ ID 3138; ZO23 225 SEQ ID 3139; ZO24 225 SEQ ID 3140; ZO25 225 SEQ ID 3141; ZO26 225 SEQ ID 3142; ZO27 225 SEQ ID 3143; ZO28 225 SEQ ID 3144; ZO29 225 SEQ ID 3145; ZO32 225 SEQ ID 3146; ZO33 225 SEQ ID 3147; and ZO96 225 SEQ ID 3148.

FIG. 20A-B shows an alignment comparison of amino acid sequences for ORF 235 for several strains of *Neisseria*. Dark shading indicates regions of homology, and gray shading indicates the conservation of amino acids with similar characteristics. The Figure demonstrates a high degree of conservation among the various strains, further confirming its utility as an antigen for both vaccines and diagnostics. The sequences in the Figure have the following SEQ ID NOs: FA1090 SEQ ID 3149; GNMZQ01 SEQ ID 3150; GNMZQ02 SEQ ID 3151; GNMZQ03 SEQ ID 31521; GNMZQ04 SEQ ID 3153; GNMZQ05 SEQ ID 3154; GNMZQ07 SEQ ID 3155; GNMZQ08 SEQ ID 3156; GNMZQ09 SEQ ID 3157; GNMZQ10 SEQ ID 3158; GNMZQ11 SEQ ID 3159; GNMZQ13 SEQ ID 3160: GNMZQ14 SEQ ID 3161: GNMZQ15 SEQ ID 3162; GNMZQ16 SEQ ID 3163; GNMZQ17 SEQ ID 3164; GNMZQ18 SEQ ID 3165; GNMZQ19 SEQ ID 3166; GNMZQ21 SEQ ID 3166; GNMZQ22 SEQ ID 3167; GNMZQ23 SEQ ID 3168; GNMZQ24 SEQ ID 3169: GNMZQ25 SEQ ID 3170; GNMZQ26 SEQ ID 3171: GNMZQ27 SEQ ID 3172: GNMZQ28 SEQ ID 3173: GNMZQ29 SEQ ID 3174; GNMZQ31 SEQ ID 3175; GNMZQ32 SEQ ID 3176; GNMZQ33 SEQ ID 3177; and Z2491 SEQ ID 3178.

FIG. 21A-B shows an alignment comparison of amino acid sequences for ORF 287 for several strains of *Neisseria*. Dark shading indicates regions of homology, and gray shading indicates the conservation of amino acids with similar characteristics. The Figure demonstrates a high degree of conservation among the various strains, further confirming its utility as an antigen for both vaccines and diagnostics. The sequences in the Figure have the following SEQ ID NOs: 287 14 SEQ ID 3179; 287 2 SEQ ID 3180; 287 21. SEQ ID 3181; 287 9 SEQ ID 3182; FA1090 SEQ ID 3183; and Z2491 SEQ ID 3184.

FIG. 22A-B shows an alignment comparison of amino acid sequences for ORF 519 for several strains of *Neisseria*. Dark shading indicates regions of homology, and gray shading indicates the conservation of amino acids with similar characteristics. The Figure demonstrates a high degree of conservation among the various strains, further confirming its utility as an antigen for both vaccines and diagnostics. The sequences in the Figure have the following SEQ ID NOs: FA1090 519 SEQ ID 3185; Z2491 519 SEQ ID 3186; ZV01 519 SEQ ID 3187; ZV02 519 SEQ ID 3188; ZV03 519 SEQ ID 3189; ZV04 519 SEQ ID 3190; ZV05 519 SEQ ID 3191; ZV06 519ASS SEQ ID 3192; ZV07 519 SEQ ID 3193; ZV11 519 SEQ ID 3194; ZV12 519 SEQ ID 3195; ZV18 519 SEQ ID 3196; ZV19 519 SEQ ID 3197; ZV20 519ASS SEQ ID 3198; ZV21 519ASS SEQ ID 3199; ZV22 519ASS SEQ ID 3200; ZV26 519 SEQ ID 3201; ZV27 519 SEQ ID 3202: ZV28 519 SEQ ID 3203; ZV29 519ASS SEQ ID 3204; ZV32 519 SEQ ID 3205; and ZV96 519 SEQ ID 3206.

FIG. 23A-D shows an alignment comparison of amino acid sequences for ORF 919 for several strains of *Neisseria*. Dark shading indicates regions of homology, and gray shading indicates the conservation of amino acids with similar characteristics. The Figure demonstrates a high degree of conservation among the various strains, further confirming its utility as an antigen for both vaccines and diagnostics. The sequences in the Figure have the following SEQ ID NOs: FA1090 SEQ ID 3207; Z2491<SEQ ID 3208; ZM01 SEQ ID 3209; ZM02 SEQ ID 3210; ZM03 SEQ ID 3211; ZM04 SEQ ID 3212; ZM05 SEQ ID 3213; ZM06 SEQ ID 3214; ZM07 SEQ ID 3215; ZM08N SEQ ID 3216; ZM09 SEQ ID 3217; ZM10 SEQ ID 3218; ZM11ASBC SEQ ID 3219; ZM12 SEQ ID 3220; ZM13 SEQ ID 3221; ZM14 SEQ ID 3222; ZM15 SEQ ID 3223; ZM16 SEQ ID 3224; ZM17 SEQ ID 3225; ZM18 SEQ ID 3226; ZM19 SEQ ID 3227; ZM20 SEQ ID 3228; ZM21 SEQ ID 3229; ZM22 SEQ ID 3230; ZM23ASBC SEQ ID 3231; ZM24 SEQ ID 3232; ZM25 SEQ ID 3233; ZM26 SEQ ID 3234; ZM27BC SEQ ID 3235; ZM28 SEQ ID 3236; ZM29ASBC SEQ ID 3237; ZM31ASBC SEQ ID 3238; ZM32ASBC SEQ ID 3239; ZM33ASBC SEQ ID 3240; ZM96 SEQ ID 3241.

THE INVENTION

Figure 10:
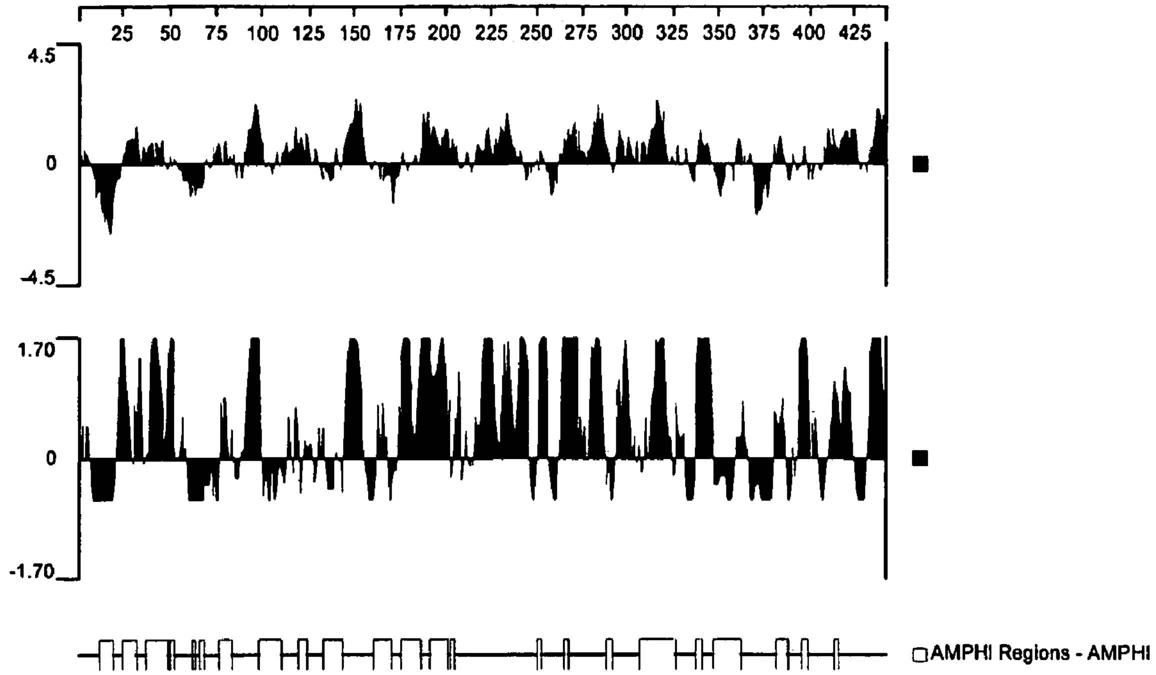
FIG. 10 illustrates the hydrophilicity plot, antigenic index and AMPHI regions of the products of protein expression the predicted ORF 919 as cloned and expressed in *E. coli.*

The invention provides proteins comprising the *N. meningitidis* amino acid sequences and *N. gonorrhoeae* amino acid sequences disclosed in the examples.

It also provides proteins comprising sequences homologous (i.e., those having sequence identity) to the *N. meningitidis* amino acid sequences disclosed in the examples. Depending on the particular sequence, the degree of homology (sequence identity) is preferably greater than 50% (eg. 60%, 70%, 80%, 90%, 95%, 99% or more). These proteins include mutants and allelic variants of the sequences disclosed in the examples. Typically, 50% identity or more between two proteins is considered to be an indication of functional equivalence. Identity between proteins is preferably determined by the Smith-Waterman homology search algorithm as implemented in MPSRCH program (Oxford Molecular) using an affine gap search with parameters:gap penalty 12, gap extension penalty 1.

The invention further provides proteins comprising fragments of the *N. meningitidis* amino acid sequences and *N. gonorrhoeae* amino acid sequences disclosed in the examples. The fragments should comprise at least n consecutive amino acids from the sequences and, depending on the particular sequence, n is 7 or more (eg. 8, 10, 12, 14, 16, 18, 20 or more). Preferably the fragments comprise an epitope from the sequence.

The proteins of the invention can, of course, be prepared by various means (eg. recombinant expression, purification from cell culture, chemical synthesis etc.) and in various forms (eg. native, fusions etc.). They are preferably prepared in substantially pure or isolated form (ie. substantially free from other *N. meningitidis* or *N. gonorrhoeae* host cell proteins)

According to a further aspect, the invention provides antibodies which bind to these proteins. These may be polyclonal or monoclonal and may be produced by any suitable means.

According to a further aspect, the invention provides nucleic acid comprising the *N. meningitidis* nucleotide sequences and *N. gonorrhoeae* nucleotide sequences disclosed in the examples.

According to a further aspect, the invention comprises nucleic acids having sequence identity of greater than 50% (e.g., 60%, 70%, 80%, 90%, 95%, 99% or more) to the nucleic acid sequences herein. Sequence identity is determined as above-discussed.

According to a further aspect, the invention comprises nucleic acid that hybridizes to the sequences provided herein. Conditions for hybridization are set forth herein.

Nucleic acid comprising fragments of these sequences are also provided. These should comprise at least n consecutive nucleotides from the *N. meningitidis* sequences or *N. gonorrhoeae* sequences and depending on the particular sequence, n is 10 or more (eg 12, 14, 15, 18, 20, 25, 30, 35, 40 or more).

According to a further aspect, the invention provides nucleic acid encoding the proteins and protein fragments of the invention.

It should also be appreciated that the invention provides nucleic acid comprising sequences complementary to those described above (eg. for antisense or probing purposes).

Nucleic acid according to the invention can, of course, be prepared in many ways (eg. by chemical synthesis, in part or in whole, from genomic or cDNA libraries, from the organism itself etc.) and can take various forms (eg. single stranded, double stranded, vectors, probes etc.).

In addition, the term "nucleic acid" includes DNA and RNA, and also their analogues, such as those containing modified backbones, and also protein nucleic acids (PNA) etc.

According to a further aspect, the invention provides vectors comprising nucleotide sequences of the invention (eg. expression vectors) and host cells transformed with such vectors.

According to a further aspect, the invention provides compositions comprising protein, antibody, and/or nucleic acid according to the invention. These compositions may be suitable as vaccines, for instance, or as diagnostic reagents or as immunogenic compositions.

The invention also provides nucleic acid, protein, or antibody according to the invention for use as medicaments (eg. as vaccines) or as diagnostic reagents. It also provides the use of nucleic acid, protein, or antibody according to the invention in the manufacture of (I) a medicament for treating or preventing infection due to Neisserial bacteria (ii) a diagnostic reagent for detecting the presence of Neisserial bacteria or of antibodies raised against Neisserial bacteria or (iii) for raising antibodies. Said Neisserial bacteria may be any species or strain (such as *N. gonorrhoeae*) but are preferably *N. meningitidis*, especially strain B or strain C.

The invention also provides a method of treating a patient, comprising administering to the patient a therapeutically effective amount of nucleic acid, protein, and/or antibody according to the invention.

According to further aspects, the invention provides various processes.

A process for producing proteins of the invention is provided, comprising the step of culturing a host cell according to the invention under conditions which induce protein expression.

A process for detecting polynucleotides of the invention is provided, comprising the steps of: (a) contacting a nucleic probe according to the invention with a biological sample under hybridizing conditions to form duplexes; and (b) detecting said duplexes.

A process for detecting proteins of the invention is provided, comprising the steps of: (a) contacting an antibody according to the invention with a biological sample under conditions suitable for the formation of an antibody-antigen complexes; and (b) detecting said complexes.

Having now generally described the invention, the same will be more readily understood through reference to the following examples which are provided by way of illustration, and are not intended to be limiting of the present invention, unless specified.

Methodology—Summary of Standard Procedures and Techniques.

General

This invention provides *Neisseria meningitidis* menB nucleotide sequences, amino acid sequences encoded therein. With these disclosed sequences, nucleic acid probe assays and expression cassettes and vectors can be produced. The expression vectors can be transformed into host cells to produce proteins. The purified or isolated polypeptides (which may also be chemically synthesized) can be used to produce antibodies to detect menB proteins. Also, the host cells or extracts can be utilized for biological assays to isolate agonists or antagonists. In addition, with these sequences one can search to identify open reading frames and identify amino acid sequences. The proteins may also be used in immunogenic compositions, antigenic compositions and as vaccine components.

The practice of the present invention will employ, unless otherwise indicated, conventional techniques of molecular biology, microbiology, recombinant DNA, and immunology, which are within the skill of the art. Such techniques are explained fully in the literature e.g., Sambrook *Molecular Cloning, A Laboratory Manual, Second Edition* (1989); *DNA Cloning, Volumes I and ii* (D. N Glover ed. 1985); *Oligonucleotide Synthesis* (M. J. Gait ed, 1984); *Nucleic Acid Hybridization* (B. D. Hames & S. J. Higgins eds. 1984); *Transcription and Translation* (B. D. Hames & S. J. Higgins eds. 1984); *Animal Cell Culture* (R. I. Freshney ed. 1986); *Immobilized Cells and Enzymes* (IRL Press, 1986); B. Perbal, *A Practical Guide to Molecular Cloning* (1984); the *Methods in Enzymology* series (Academic Press, Inc.), especially volumes 154 & 155; *Gene Transfer Vectors for Mammalian Cells* (J. H. Miller and M. P. Calos eds. 1987, Cold Spring Harbor Laboratory); Mayer and Walker, eds. (1987), *Immunochemical Methods in Cell and Molecular Biology* (Academic Press, London); Scopes, (1987) *Protein Purification: Principles and Practice*, Second Edition (Springer-Verlag, N.Y.), and *Handbook of Experimental Immunology, Volumes I-IV* (D. M. Weir and C. C. Blackwell eds 1986).

Standard abbreviations for nucleotides and amino acids are used in this specification.

All publications, patents, and patent applications cited herein are incorporated in full by reference.

Expression Systems

The *Neisseria* menB nucleotide sequences can be expressed in a variety of different expression systems; for example those used with mammalian cells, plant cells, baculoviruses, bacteria, and yeast.

i. Mammalian Systems

Mammalian expression systems are known in the art. A mammalian promoter is any DNA sequence capable of binding mammalian RNA polymerase and initiating the downstream (3') transcription of a coding sequence (e.g., structural gene) into mRNA. A promoter will have a transcription initiating region, which is usually placed proximal to the 5' end of the coding sequence, and a TATA box, usually located 25-30 base pairs (bp) upstream of the transcription initiation site. The TATA box is thought to direct RNA polymerase II to begin RNA synthesis at the correct site. A mammalian promoter will also contain an upstream promoter element, usually located within 100 to 200 bp upstream of the TATA box. An upstream promoter element determines the rate at which transcription is initiated and can act in either orientation (Sambrook et al. (1989) "Expression of Cloned Genes in Mammalian Cells." In *Molecular Cloning: A Laboratory Manual, 2nd ed.*).

Mammalian viral genes are often highly expressed and have a broad host range; therefore sequences encoding mammalian viral genes provide particularly useful promoter sequences. Examples include the SV40 early promoter, mouse mammary tumor virus LTR promoter, adenovirus major late promoter (Ad MLP), and herpes simplex virus promoter. In addition, sequences derived from non-viral genes, such as the murine metallothionein gene, also provide useful promoter sequences. Expression may be either constitutive or regulated (inducible). Depending on the promoter selected, many promotes may be inducible using known substrates, such as the use of the mouse mammary tumor virus (MMTV) promoter with the glucocorticoid responsive element (GRE) that is induced by glucocorticoid in hormone-responsive transformed cells (see for example, U.S. Pat. No. 5,783,681).

The presence of an enhancer element (enhancer), combined with the promoter elements described above, will usually increase expression levels. An enhancer is a regulatory DNA sequence that can stimulate transcription up to 1000-fold when linked to homologous or heterologous promoters, with synthesis beginning at the normal RNA start site. Enhancers are also active when they are placed upstream or downstream from the transcription initiation site, in either normal or flipped orientation, or at a distance of more than 1000 nucleotides from the promoter (Maniatis et al. (1987) *Science* 236:1237; Alberts et al. (1989) *Molecular Biology of the Cell,* 2nd ed.). Enhancer elements derived from viruses may be particularly useful, because they usually have a broader host range. Examples include the SV40 early gene enhancer (Dijkema et al (1985) *EMBO J.* 4:761) and the enhancer/promoters derived from the long terminal repeat (LTR) of the Rous Sarcoma Virus (Gorman et al. (1982b) *Proc. Natl. Acad. Sci.* 79:6777) and from human cytomegalovirus (Boshart et al. (1985) *Cell* 41:521). Additionally, some enhancers are regulatable and become active only in the presence of an inducer, such as a hormone or metal ion (Sassone-Corsi and Borelli (1986) *Trends Genet.* 2:215; Maniatis et al. (1987) *Science* 236:1237).

A DNA molecule may be expressed intracellularly in mammalian cells. A promoter sequence may be directly linked with the DNA molecule, in which case the first amino acid at the N-terminus of the recombinant protein will always be a methionine, which is encoded by the ATG start codon. If desired, the N-terminus may be cleaved from the protein by in vitro incubation with cyanogen bromide.

Alternatively, foreign proteins can also be secreted from the cell into the growth media by creating chimeric DNA molecules that encode a fusion protein comprised of a leader sequence fragment that provides for secretion of the foreign protein in mammalian cells. Preferably, there are processing sites encoded between the leader fragment and the foreign gene that can be cleaved either in vivo or in vitro. The leader sequence fragment usually encodes a signal peptide comprised of hydrophobic amino acids which direct the secretion of the protein from the cell. The adenovirus tripartite leader is an example of a leader sequence that provides for secretion of a foreign protein in mammalian cells.

Usually, transcription termination and polyadenylation sequences recognized by mammalian cells are regulatory regions located 3' to the translation stop codon and thus, together with the promoter elements, flank the coding sequence. The 3' terminus of the mature mRNA is formed by site-specific post-transcriptional cleavage and polyadenylation (Birnstiel et al. (1985) *Cell* 41:349; Proudfoot and Whitelaw (1988) "Termination and 3' end processing of eukaryotic RNA. In *Transcription and splicing* (ed. B. D. Hames and D. M. Glover); Proudfoot (1989) *Trends Biochem. Sci.* 14:105). These sequences direct the transcription of an mRNA which can be translated into the polypeptide encoded by the DNA. Examples of transcription terminator/polyadenylation signals include those derived from SV40 (Sambrook et al (1989) "Expression of cloned genes in cultured mammalian cells." In *Molecular Cloning: A Laboratory Manual*).

Usually, the above described components, comprising a promoter, polyadenylation signal, and transcription termination sequence are put together into expression constructs. Enhancers, introns with functional splice donor and acceptor sites, and leader sequences may also be included in an expression construct, if desired. Expression constructs are often maintained in a replicon, such as an extrachromosomal element (e.g., plasmids) capable of stable maintenance in a host, such as mammalian cells or bacteria. Mammalian replication systems include those derived from animal viruses, which require trans-acting factors to replicate. For example, plasmids containing the replication systems of papovaviruses, such as SV40 (Gluzman (1981) *Cell* 23:175) or polyomavirus, replicate to extremely high copy number in the presence of the appropriate viral T antigen. Additional examples of mammalian replicons include those derived from bovine papillomavirus and Epstein-Barr virus. Additionally, the replicon may have two replication systems, thus allowing it to be maintained, for example, in mammalian cells for expression and in a prokaryotic host for cloning and amplification. Examples of such mammalian-bacteria shuttle vectors include pMT2 (Kaufman et al. (1989) *Mol. Cell. Biol.* 9:946) and pHEBO (Shimizu et al. (1986) *Mol. Cell. Biol.* 6:1074).

The transformation procedure used depends upon the host to be transformed. Methods for introduction of heterologous polynucleotides into mammalian cells are known in the art and include dextran-mediated transfection, calcium phosphate precipitation, polybrene mediated transfection, protoplast fusion, electroporation, encapsulation of the polynucleotide(s) in liposomes, and direct microinjection of the DNA into nuclei.

Mammalian cell lines available as hosts for expression are known in the art and include many immortalized cell lines available from the American Type Culture Collection (ATCC), including but not limited to, Chinese hamster ovary (CHO) cells, HeLa cells, baby hamster kidney (BHK) cells, monkey kidney cells (COS), human hepatocellular carcinoma cells (e.g., Hep G2), and a number of other cell lines.

ii. Plant Cellular Expression Systems

There are many plant cell culture and whole plant genetic expression systems known in the art. Exemplary plant cellular genetic expression systems include those described in patents, such as: U.S. Pat. No. 5,693,506; U.S. Pat. No. 5,659,122; and U.S. Pat. No. 5,608,143. Additional examples of genetic expression in plant cell culture has been described by Zenk, *Phytochemistry* 30:3861-3863 (1991). Descriptions of plant protein signal peptides may be found in addition to the references described above in Vaulcombe et al., *Mol. Gen. Genet.* 209:33-40 (1987); Chandler et al., *Plant Molecular Biology* 3:407-418 (1984); Rogers, *J. Biol. Chem.* 260:3731-3738 (1985); Rothstein et al., *Gene* 55:353-356 (1987); Whittier et al., Nucleic Acids Research 15:2515-2535 (1987); Wirsel et al., *Molecular Microbiology* 3:3-14 (1989); Yu et al., *Gene* 122:247-253 (1992). A description of the regulation of plant gene expression by the phytohormone, gibberellic acid and secreted enzymes induced by gibberellic acid can be found in R. L. Jones and J. MacMillin, Gibberellins: in: *Advanced Plant Physiology*. Malcolm B. Wilkins, ed., 1984 Pitman Publishing Limited, London, pp. 21-52. References that describe other metabolically-regulated genes: Sheen, *Plant Cell,* 2:1027-1038 (1990); Maas et al., *EMBO J.* 9:3447-3452 (1990); Benkel and Hickey, *Proc. Natl. Acad. Sci.* 84:1337-1339 (1987)

Typically, using techniques known in the art, a desired polynucleotide sequence is inserted into an expression cassette comprising genetic regulatory elements designed for operation in plants. The expression cassette is inserted into a desired expression vector with companion sequences upstream and downstream from the expression cassette suitable for expression in a plant host. The companion sequences will be of plasmid or viral origin and provide necessary characteristics to the vector to permit the vectors to move DNA from an original cloning host, such as bacteria, to the desired plant host. The basic bacterial/plant vector construct will preferably provide a broad host range prokaryote replication origin; a prokaryote selectable marker; and, for *Agrobacterium* transformations, T DNA sequences for *Agrobacterium*-mediated transfer to plant chromosomes. Where the heterologous gene is not readily amenable to detection, the construct will preferably also have a selectable marker gene suitable for determining if a plant cell has been transformed. A general review of suitable markers, for example for the members of the grass family, is found in Wilmink and Dons, 1993, *Plant Mol. Biol. Reptr,* 11(2):165-185.

Sequences suitable for permitting integration of the heterologous sequence into the plant genome are also recommended. These might include transposon sequences and the like for homologous recombination as well as Ti sequences which permit random insertion of a heterologous expression cassette into a plant genome. Suitable prokaryote selectable markers include resistance toward antibiotics such as ampicillin or tetracycline. Other DNA sequences encoding additional functions may also be present in the vector, as is known in the art.

The nucleic acid molecules of the subject invention may be included into an expression cassette for expression of the protein(s) of interest. Usually, there will be only one expression cassette, although two or more are feasible. The recombinant expression cassette will contain in addition to the heterologous protein encoding sequence the following elements, a promoter region, plant 5' untranslated sequences, initiation codon depending upon whether or not the structural gene comes equipped with one, and a transcription and translation termination sequence. Unique restriction enzyme sites at the 5' and 3' ends of the cassette allow for easy insertion into a pre-existing vector.

A heterologous coding sequence may be for any protein relating to the present invention. The sequence encoding the protein of interest will encode a signal peptide which allows processing and translocation of the protein, as appropriate, and will usually lack any sequence which might result in the binding of the desired protein of the invention to a membrane. Since, for the most part, the transcriptional initiation region will be for a gene which is expressed and translocated during germination, by employing the signal peptide which provides for translocation, one may also provide for translocation of the protein of interest. In this way, the protein(s) of interest will be translocated from the cells in which they are expressed and may be efficiently harvested. Typically secretion in seeds are across the aleurone or scutellar epithelium layer into the endosperm of the seed. While it is not required that the protein be secreted from the cells in which the protein is produced, this facilitates the isolation and purification of the recombinant protein.

Since the ultimate expression of the desired gene product will be in a eucaryotic cell it is desirable to determine whether any portion of the cloned gene contains sequences which will be processed out as introns by the host's splicosome machinery. If so, site-directed mutagenesis of the "intron" region may be conducted to prevent losing a portion of the genetic message as a false intron code, Reed and Maniatis, *Cell* 41:95-105, 1985.

The vector can be microinjected directly into plant cells by use of micropipettes to mechanically transfer the recombinant DNA. Crossway, *Mol. Gen. Genet,* 202:179-185, 1985. The genetic material may also be transferred into the plant cell by using polyethylene glycol, Krens, et al., *Nature,* 296, 72-74, 1982. Another method of introduction of nucleic acid segments is high velocity ballistic penetration by small particles with the nucleic acid either within the matrix of small beads or particles, or on the surface, Klein, et al., *Nature,* 327, 70-73, 1987 and Knudsen and Muller, 1991, *Planta,* 185:330-336 teaching particle bombardment of barley endosperm to create transgenic barley. Yet another method of introduction would be fusion of protoplasts with other entities, either minicells, cells, lysosomes or other fusible lipid-surfaced bodies, Fraley, et al., *Proc. Natl. Acad. Sci. USA,* 79, 1859-1863, 1982.

The vector may also be introduced into the plant cells by electroporation. (Fromm et al., *Proc. Natl. Acad. Sci. USA* 82:5824, 1985). In this technique, plant protoplasts are electroporated in the presence of plasmids containing the gene construct. Electrical impulses of high field strength reversibly permeabilize biomembranes allowing the introduction of the plasmids. Electroporated plant protoplasts reform the cell wall, divide, and form plant callus.

All plants from which protoplasts can be isolated and cultured to give whole regenerated plants can be transformed by the present invention so that whole plants are recovered which contain the transferred gene. It is known that practically all plants can be regenerated from cultured cells or tissues, including but not limited to all major species of sugarcane, sugar beet, cotton, fruit and other trees, legumes and vegetables. Some suitable plants include, for example, species from the genera *Fragaria, Lotus, Medicago, Onobrychis, Trifolium, Trigonella, Vigna, Citrus, Linum, Geranium, Manihot, Daucus, Arabidopsis, Brassica, Raphanus, Sinapis, Atropa, Capsicum, Datura, Hyoscyamus, Lycopersion, Nicotiana, Solanum, Petunia, Digitalis, Majorana, Cichorium, Helianthus, Lactuca, Bromus, Asparagus, Antirrhinum, Hererocallis, Nemesia, Pelargonium, Panicum, Pennisetum, Ranunculus, Senecio, Salpiglossis, Cucumis, Browaalia, Glycine, Lolium, Zea, Triticum, Sorghum,* and *Datura.*

Means for regeneration vary from species to species of plants, but generally a suspension of transformed protoplasts containing copies of the heterologous gene is first provided. Callus tissue is formed and shoots may be induced from callus and subsequently rooted. Alternatively, embryo formation can be induced from the protoplast suspension. These embryos germinate as natural embryos to form plants. The culture media will generally contain various amino acids and hormones, such as auxin and cytokinins. It is also advantageous to add glutamic acid and proline to the medium, especially for such species as corn and alfalfa. Shoots and roots normally develop simultaneously. Efficient regeneration will depend on the medium, on the genotype, and on the history of the culture. If these three variables are controlled, then regeneration is fully reproducible and repeatable.

In some plant cell culture systems, the desired protein of the invention may be excreted or alternatively, the protein may be extracted from the whole plant. Where the desired protein of the invention is secreted into the medium, it may be collected. Alternatively, the embryos and embryoless-half seeds or other plant tissue may be mechanically disrupted to release any secreted protein between cells and tissues. The mixture may be suspended in a buffer solution to retrieve soluble proteins. Conventional protein isolation and purification methods will be then used to purify the recombinant protein. Parameters of time, temperature pH, oxygen, and volumes will be adjusted through routine methods to optimize expression and recovery of heterologous protein.

iii. Baculovirus Systems

The polynucleotide encoding the protein can also be inserted into a suitable insect expression vector, and is operably linked to the control elements within that vector. Vector construction employs techniques which are known in the art. Generally, the components of the expression system include a transfer vector, usually a bacterial plasmid, which contains both a fragment of the baculovirus genome, and a convenient restriction site for insertion of the heterologous gene or genes to be expressed; a wild type baculovirus with a sequence homologous to the baculovirus-specific fragment in the transfer vector (this allows for the homologous recombination of the heterologous gene in to the baculovirus genome); and appropriate insect host cells and growth media.

After inserting the DNA sequence encoding the protein into the transfer vector, the vector and the wild type viral genome are transfected into an insect host cell where the vector and viral genome are allowed to recombine. The packaged recombinant virus is expressed and recombinant plaques are identified and purified. Materials and methods for baculovirus/insect cell expression systems are commercially available in kit form from, inter alia, Invitrogen, San Diego Calif. ("MAXBAC™" kit). These techniques are generally known to those skilled in the art and fully described in Summers and Smith, *Texas Agricultural Experiment Station Bulletin No.* 1555 (1987) (hereinafter "Summers and Smith").

Prior to inserting the DNA sequence encoding the protein into the baculovirus genome, the above described components, comprising a promoter, leader (if desired), coding sequence of interest, and transcription termination sequence, are usually assembled into an intermediate transplacement construct (transfer vector). This construct may contain a single gene and operably linked regulatory elements; multiple genes, each with its owned set of operably linked regulatory elements; or multiple genes, regulated by the same set of regulatory elements. Intermediate transplacement constructs are often maintained in a replicon, such as an extrachromosomal element (e.g., plasmids) capable of stable maintenance in a host, such as a bacterium. The replicon will have a replication system, thus allowing it to be maintained in a suitable host for cloning and amplification.

Currently, the most commonly used transfer vector for introducing foreign genes into AcNPV is pAc373. Many other vectors, known to those of skill in the art, have also been designed. These include, for example, pVL985 (which alters the polyhedrin start codon from ATG to ATT, and which introduces a BamHI cloning site 32 basepairs downstream from the ATT; see Luckow and Summers, *Virology* (1989) 17:31.

The plasmid usually also contains the polyhedrin polyadenylation signal (Miller et al. (1988) *Ann. Rev. Microbiol.,* 42:177) and a prokaryotic ampicillin-resistance (amp) gene and origin of replication for selection and propagation in *E. coli.*

Baculovirus transfer vectors usually contain a baculovirus promoter. A baculovirus promoter is any DNA sequence capable of binding a baculovirus RNA polymerase and initiating the downstream (5' to 3') transcription of a coding sequence (e.g., structural gene) into mRNA. A promoter will have a transcription initiation region which is usually placed proximal to the 5' end of the coding sequence. This transcription initiation region usually includes an RNA polymerase binding site and a transcription initiation site. A baculovirus transfer vector may also have a second domain called an enhancer, which, if present, is usually distal to the structural gene. Expression may be either regulated or constitutive.

Structural genes, abundantly transcribed at late times in a viral infection cycle, provide particularly useful promoter sequences. Examples include sequences derived from the gene encoding the viral polyhedron protein, Friesen et al., (1986) "The Regulation of Baculovirus Gene Expression," in: *The Molecular Biology of Baculoviruses* (ed. Walter Doerfler); EPO Publ. Nos. 127 839 and 155 476; and the gene encoding the p10 protein, Vlak et al., (1988), *J. Gen. Virol.* 69:765.

DNA encoding suitable signal sequences can be derived from genes for secreted insect or baculovirus proteins, such as the baculovirus polyhedrin gene (Carbonell et al. (1988) *Gene,* 73:409). Alternatively, since the signals for mammalian cell posttranslational modifications (such as signal peptide cleavage, proteolytic cleavage, and phosphorylation) appear to be recognized by insect cells, and the signals required for secretion and nuclear accumulation also appear to be conserved between the invertebrate cells and vertebrate cells, leaders of non-insect origin, such as those derived from genes encoding human (alpha) α-interferon, Maeda et al., (1985), *Nature* 315:592; human gastrin-releasing peptide, Lebacq-Verheyden et al., (1988), *Molec. Cell. Biol.* 8:3129; human IL-2, Smith et al., (1985) *Proc. Nat'l Acad. Sci. USA,* 82:8404; mouse IL-3, (Miyajima et al., (1987) *Gene* 58:273; and human glucocerebrosidase, Martin et al. (1988) *DNA,* 7:99, can also be used to provide for secretion in insects.

A recombinant polypeptide or polyprotein may be expressed intracellularly or, if it is expressed with the proper regulatory sequences, it can be secreted. Good intracellular expression of nonfused foreign proteins usually requires heterologous genes that ideally have a short leader sequence containing suitable translation initiation signals preceding an ATG start signal. If desired, methionine at the N-terminus may be cleaved from the mature protein by in vitro incubation with cyanogen bromide.

Alternatively, recombinant polyproteins or proteins which are not naturally secreted can be secreted from the insect cell by creating chimeric DNA molecules that encode a fusion protein comprised of a leader sequence fragment that provides for secretion of the foreign protein in insects. The leader sequence fragment usually encodes a signal peptide comprised of hydrophobic amino acids which direct the translocation of the protein into the endoplasmic reticulum.

After insertion of the DNA sequence and/or the gene encoding the expression product precursor of the protein, an insect cell host is co-transformed with the heterologous DNA of the transfer vector and the genomic DNA of wild type baculovirus—usually by co-transfection. The promoter and transcription termination sequence of the construct will usually comprise a 2-5 kb section of the baculovirus genome. Methods for introducing heterologous DNA into the desired site in the baculovirus virus are known in the art. (See Summers and Smith supra; Ju et al. (1987); Smith et al., *Mol. Cell. Biol.* (1983) 3:2156; and Luckow and Summers (1989)). For example, the insertion can be into a gene such as the polyhedrin gene, by homologous double crossover recombination; insertion can also be into a restriction enzyme site engineered into the desired baculovirus gene. Miller et al., (1989), *Bioessays* 4:91. The DNA sequence, when cloned in place of the polyhedrin gene in the expression vector, is flanked both 5' and 3' by polyhedrin-specific sequences and is positioned downstream of the polyhedrin promoter.

The newly formed baculovirus expression vector is subsequently packaged into an infectious recombinant baculovirus. Homologous recombination occurs at low frequency (between about 1% and about 5%); thus, the majority of the virus produced after cotransfection is still wild-type virus. Therefore, a method is necessary to identify recombinant viruses. An advantage of the expression system is a visual screen allowing recombinant viruses to be distinguished. The polyhedrin protein, which is produced by the native virus, is produced at very high levels in the nuclei of infected cells at late times after viral infection. Accumulated polyhedrin protein forms occlusion bodies that also contain embedded particles. These occlusion bodies, up to 15 μm in size, are highly refractile, giving them a bright shiny appearance that is readily visualized under the light microscope. Cells infected with recombinant viruses lack occlusion bodies. To distinguish recombinant virus from wild-type virus, the transfection supernatant is plaqued onto a monolayer of insect cells by techniques known to those skilled in the art. Namely, the plaques are screened under the light microscope for the presence (indicative of wild-type virus) or absence (indicative of recombinant virus) of occlusion bodies. *Current Protocols in Microbiology* Vol. 2 (Ausubel et al. eds) at 16.8 (Supp. 10, 1990); Summers and Smith, supra; Miller et al. (1989).

Recombinant baculovirus expression vectors have been developed for infection into several insect cells. For example, recombinant baculoviruses have been developed for, inter alia: *Aedes aegypti, Autographa californica, Bombyx mori, Drosophila melanogaster, Spodoptera frugiperda*, and *Trichoplusia ni* (PCT Pub. No. WO 89/046699; Carbonell et al., (1985) *J. Virol.* 56:153; Wright (1986) *Nature* 321:718; Smith et al., (1983) *Mol. Cell. Biol.* 3:2156; and see generally, Fraser, et al. (1989) *In Vitro Cell. Dev. Biol.* 25:225).

Cells and cell culture media are commercially available for both direct and fusion expression of heterologous polypeptides in a baculovirus/expression system; cell culture technology is generally known to those skilled in the art. See, e.g., Summers and Smith supra.

The modified insect cells may then be grown in an appropriate nutrient medium, which allows for stable maintenance of the plasmid(s) present in the modified insect host. Where the expression product gene is under inducible control, the host may be grown to high density, and expression induced. Alternatively, where expression is constitutive, the product will be continuously expressed into the medium and the nutrient medium must be continuously circulated, while removing the product of interest and augmenting depleted nutrients. The product may be purified by such techniques as chromatography, e.g., HPLC, affinity chromatography, ion exchange chromatography, etc.; electrophoresis; density gradient centrifugation; solvent extraction, or the like. As appropriate, the product may be further purified, as required, so as to remove substantially any insect proteins which are also secreted in the medium or result from lysis of insect cells, so as to provide a product which is at least substantially free of host debris, e.g., proteins, lipids and polysaccharides.

In order to obtain protein expression, recombinant host cells derived from the transformants are incubated under conditions which allow expression of the recombinant protein encoding sequence. These conditions will vary, dependent upon the host cell selected. However, the conditions are readily ascertainable to those of ordinary skill in the art, based upon what is known in the art.

iv. Bacterial Systems

Bacterial expression techniques are known in the art. A bacterial promoter is any DNA sequence capable of binding bacterial RNA polymerase and initiating the downstream (3') transcription of a coding sequence (e.g. structural gene) into mRNA. A promoter will have a transcription initiation region which is usually placed proximal to the 5' end of the coding sequence. This transcription initiation region usually includes an RNA polymerase binding site and a transcription initiation site. A bacterial promoter may also have a second domain called an operator, that may overlap an adjacent RNA polymerase binding site at which RNA synthesis begins. The operator permits negative regulated (inducible) transcription, as a gene repressor protein may bind the operator and thereby inhibit transcription of a specific gene. Constitutive expression may occur in the absence of negative regulatory elements, such as the operator. In addition, positive regulation may be achieved by a gene activator protein binding sequence, which, if present is usually proximal (5') to the RNA polymerase binding sequence. An example of a gene activator protein is the catabolite activator protein (CAP), which helps initiate transcription of the lac operon in *Escherichia coli* (*E. coli*) (Raibaud et al. (1984) *Annu. Rev. Genet.* 18:173). Regulated expression may therefore be either positive or negative, thereby either enhancing or reducing transcription.

Sequences encoding metabolic pathway enzymes provide particularly useful promoter sequences. Examples include promoter sequences derived from sugar metabolizing enzymes, such as galactose, lactose (lac) (Chang et al. (1977) *Nature* 198:1056), and maltose. Additional examples include promoter sequences derived from biosynthetic enzymes such as tryptophan (trp) (Goeddel et al. (1980) *Nuc. Acids Res.* 8:4057; Yelverton et al. (1981) *Nucl. Acids Res.* 9:731; U.S. Pat. No. 4,738,921; EPO Publ. Nos. 036 776 and 121 775). The beta-lactamase (bla) promoter system (Weissmann (1981) "The cloning of interferon and other mistakes." In *Interferon* 3 (ed. I. Gresser)), bacteriophage lambda PL (Shimatake et al. (1981) *Nature* 292:128) and T5 (U.S. Pat. No. 4,689,406) promoter systems also provide useful promoter sequences.

In addition, synthetic promoters which do not occur in nature also function as bacterial promoters. For example, transcription activation sequences of one bacterial or bacteriophage promoter may be joined with the operon sequences of another bacterial or bacteriophage promoter, creating a synthetic hybrid promoter (U.S. Pat. No. 4,551,433). For example, the tac promoter is a hybrid trp-lac promoter comprised of both trp promoter and lac operon sequences that is regulated by the lac repressor (Amann et al. (1983) *Gene* 25:167; de Boer et al. (1983) *Proc. Natl. Acad. Sci.* 80:21). Furthermore, a bacterial promoter can include naturally occurring promoters of non-bacterial origin that have the ability to bind bacterial RNA polymerase and initiate transcription. A naturally occurring promoter of non-bacterial origin can also be coupled with a compatible RNA polymerase to produce high levels of expression of some genes in prokaryotes. The bacteriophage T7 RNA polymerase/promoter system is an example of a coupled promoter system (Studier et al. (1986) *J. Mol. Biol.* 189:113; Tabor et al. (1985) *Proc Natl. Acad. Sci.* 82:1074). In addition, a hybrid promoter can also be comprised of a bacteriophage promoter and an *E. coli* operator region (EPO Publ. No. 267 851).

In addition to a functioning promoter sequence, an efficient ribosome binding site is also useful for the expression of foreign genes in prokaryotes. In *E. coli*, the ribosome binding site is called the Shine-Dalgarno (SD) sequence and includes an initiation codon (ATG) and a sequence 3-9 nucleotides in length located 3-11 nucleotides upstream of the initiation codon (Shine et al. (1975) *Nature* 254:34). The SD sequence is thought to promote binding of mRNA to the ribosome by the pairing of bases between the SD sequence and the 3' end of *E. coli* 16S rRNA (Steitz et al. (1979) "Genetic signals and nucleotide sequences in messenger RNA." In *Biological Regulation and Development: Gene Expression* (ed. R. F. Goldberger)). To express eukaryotic genes and prokaryotic genes with weak ribosome-binding site, it is often necessary to optimize the distance between the SD sequence and the ATG of the eukaryotic gene (Sambrook et al. (1989) "Expression of cloned genes in *Escherichia coli*." In *Molecular Cloning: A Laboratory Manual*).

A DNA molecule may be expressed intracellularly. A promoter sequence may be directly linked with the DNA molecule, in which case the first amino acid at the N-terminus will always be a methionine, which is encoded by the ATG start codon. If desired, methionine at the N-terminus may be cleaved from the protein by in vitro incubation with cyanogen bromide or by either in vivo or in vitro incubation with a bacterial methionine N-terminal peptidase (EPO Publ. No. 219 237).

Fusion proteins provide an alternative to direct expression. Usually, a DNA sequence encoding the N-terminal portion of an endogenous bacterial protein, or other stable protein, is fused to the 5' end of heterologous coding sequences. Upon expression, this construct will provide a fusion of the two amino acid sequences. For example, the bacteriophage lambda cell gene can be linked at the 5' terminus of a foreign gene and expressed in bacteria. The resulting fusion protein preferably retains a site for a processing enzyme (factor Xa) to cleave the bacteriophage protein from the foreign gene (Nagai et al. (1984) *Nature* 309:810). Fusion proteins can also be made with sequences from the lacZ (Jia et al. (1987) *Gene* 60:197), trpE (Allen et al. (1987) *J. Biotechnol.* 5:93; Makoff et al. (1989) *J. Gen. Microbiol.* 135:11), and *Chey* (EPO Publ. No. 324 647) genes. The DNA sequence at the junction of the two amino acid sequences may or may not encode a cleavable site. Another example is a ubiquitin fusion protein. Such a fusion protein is made with the ubiquitin region that preferably retains a site for a processing enzyme (e.g. ubiquitin specific processing-protease) to cleave the ubiquitin from the foreign protein. Through this method, native foreign protein can be isolated (Miller et al. (1989) *Bio/Technology* 7:698).

Alternatively, foreign proteins can also be secreted from the cell by creating chimeric DNA molecules that encode a fusion protein comprised of a signal peptide sequence fragment that provides for secretion of the foreign protein in bacteria (U.S. Pat. No. 4,336,336). The signal sequence fragment usually encodes a signal peptide comprised of hydrophobic amino acids which direct the secretion of the protein from the cell. The protein is either secreted into the growth media (gram-positive bacteria) or into the periplasmic space, located between the inner and outer membrane of the cell (gram-negative bacteria). Preferably there are processing sites, which can be cleaved either in vivo or in vitro encoded between the signal peptide fragment and the foreign gene.

DNA encoding suitable signal sequences can be derived from genes for secreted bacterial proteins, such as the *E. coli* outer membrane protein gene (ompA) (Masui et al. (1983), in: *Experimental Manipulation of Gene Expression*; Ghrayeb et al. (1984) *EMBO J.* 3:2437) and the *E. coli* alkaline phosphatase signal sequence (phoA) (Oka et al. (1985) *Proc. Natl. Acad. Sci.* 82:7212). As an additional example, the signal sequence of the alpha-amylase gene from various *Bacillus* strains can be used to secrete heterologous proteins from *B. subtilis* (Palva et al. (1982) *Proc. Natl. Acad. Sci. USA* 79:5582; EPO Publ. No. 244 042).

Usually, transcription termination sequences recognized by bacteria are regulatory regions located 3' to the translation stop codon, and thus together with the promoter flank the coding sequence. These sequences direct the transcription of an mRNA which can be translated into the polypeptide encoded by the DNA. Transcription termination sequences frequently include DNA sequences of about 50 nucleotides capable of forming stem loop structures that aid in terminating transcription. Examples include transcription termination sequences derived from genes with strong promoters, such as the trp gene in *E. coli* as well as other biosynthetic genes.

Usually, the above described components, comprising a promoter, signal sequence (if desired), coding sequence of interest, and transcription termination sequence, are put together into expression constructs. Expression constructs are often maintained in a replicon, such as an extrachromosomal element (e.g., plasmids) capable of stable maintenance in a host, such as bacteria. The replicon will have a replication system, thus allowing it to be maintained in a prokaryotic host either for expression or for cloning and amplification. In addition, a replicon may be either a high or low copy number plasmid. A high copy number plasmid will generally have a copy number ranging from about 5 to about 200, and usually about 10 to about 150. A host containing a high copy number plasmid will preferably contain at least about 10, and more preferably at least about 20 plasmids. Either a high or low copy number vector may be selected, depending upon the effect of the vector and the foreign protein on the host.

Alternatively, the expression constructs can be integrated into the bacterial genome with an integrating vector. Integrating vectors usually contain at least one sequence homologous to the bacterial chromosome that allows the vector to integrate. Integrations appear to result from recombinations between homologous DNA in the vector and the bacterial chromosome. For example, integrating vectors constructed with DNA from various *Bacillus* strains integrate into the *Bacillus* chromosome (EPO Publ. No. 127 328). Integrating vectors may also be comprised of bacteriophage or transposon sequences.

Usually, extrachromosomal and integrating expression constructs may contain selectable markers to allow for the selection of bacterial strains that have been transformed. Selectable markers can be expressed in the bacterial host and may include genes which render bacteria resistant to drugs such as ampicillin, chloramphenicol, erythromycin, kanamycin (neomycin), and tetracycline (Davies et al. (1978) *Annu. Rev. Microbiol.* 32:469). Selectable markers may also include biosynthetic genes, such as those in the histidine, tryptophan, and leucine biosynthetic pathways.

Alternatively, some of the above described components can be put together in transformation vectors. Transformation vectors are usually comprised of a selectable market that is either maintained in a replicon or developed into an integrating vector, as described above.

Expression and transformation vectors, either extra-chromosomal replicons or integrating vectors, have been developed for transformation into many bacteria. For example, expression vectors have been developed for, inter alia, the following bacteria: *Bacillus subtilis* (Palva et al. (1982) *Proc. Natl. Acad. Sci. USA* 79:5582; EPO Publ. Nos. 036 259 and 063 953; PCT Publ. No. WO 84/04541), *Escherichia coli* (Shimatake et al. (1981) *Nature* 292:128; Amann et al. (1985) *Gene* 40:183; Studier et al. (1986) *J. Mol. Biol.* 189:113; EPO Publ. Nos. 036 776, 136 829 and 136 907), *Streptococcus cremoris* (Powell et al. (1988) *Appl. Environ. Microbiol.* 54:655); *Streptococcus lividans* (Powell et al. (1988) *Appl. Environ. Microbiol.* 54:655), *Streptomyces lividans* (U.S. Pat. No. 4,745,056).

Methods of introducing exogenous DNA into bacterial hosts are well-known in the art, and usually include either the transformation of bacteria treated with $CaCl_2$ or other agents, such as divalent cations and DMSO. DNA can also be introduced into bacterial cells by electroporation. Transformation procedures usually vary with the bacterial species to be transformed. (See e.g., use of *Bacillus*: Masson et al. (1989) *FEMS Microbiol. Lett.* 60:273; Palva et al. (1982) *Proc. Natl. Acad. Sci. USA* 79:5582; EPO Publ. Nos. 036 259 and 063 953; PCT Publ. No. WO 84/04541; use of *Campylobacter*: Miller et al. (1988) *Proc. Natl. Acad. Sci.* 85:856; and Wang et al. (1990) *J. Bacteriol.* 172:949; use of *Escherichia coli*: Cohen et al. (1973) *Proc. Natl. Acad. Sci.* 69:2110; Dower et al. (1988) *Nucleic Acids Res.* 16:6127; Kushner (1978) "An improved method for transformation of *Escherichia coli* with ColE1-derived plasmids. In *Genetic Engineering: Proceedings of the International Symposium on Genetic Engineering* (eds. H. W. Boyer and S. Nicosia); Mandel et al. (1970) *J. Mol. Biol.* 53:159; Taketo (1988) *Biochim. Biophys. Acta* 949:318; use of *Lactobacillus*: Chassy et al. (1987) *FEMS Microbiol. Lett.* 44:173; use of *Pseudomonas*: Fiedler et al. (1988) *Anal. Biochem* 170:38; use of *Staphylococcus*: Augustin et al. (1990) *FEMS Microbiol. Lett.* 66:203; use of *Streptococcus*: Barany et al. (1980) *J. Bacteriol.* 144:698; Harlander (1987) "Transformation of *Streptococcus lactis* by electroporation, in: *Streptococcal Genetics* (ed. J. Ferretti and R. Curtiss III); Perry et al. (1981) *Infect. Immun.* 32:1295; Powell et al. (1988) *Appl. Environ. Microbiol.* 54:655; Somkuti et al. (1987) *Proc. 4th Evr. Cong. Biotechnology* 1:412.

v. Yeast Expression

Yeast expression systems are also known to one of ordinary skill in the art. A yeast promoter is any DNA sequence capable of binding yeast RNA polymerase and initiating the downstream (3') transcription of a coding sequence (e.g. structural gene) into mRNA. A promoter will have a transcription initiation region which is usually placed proximal to the 5' end of the coding sequence. This transcription initiation region usually includes an RNA polymerase binding site (the "TATA Box") and a transcription initiation site. A yeast promoter may also have a second domain called an upstream activator sequence (UAS), which, if present, is usually distal to the structural gene. The UAS permits regulated (inducible) expression. Constitutive expression occurs in the absence of a UAS. Regulated expression may be either positive or negative, thereby either enhancing or reducing transcription.

Yeast is a fermenting organism with an active metabolic pathway, therefore sequences encoding enzymes in the metabolic pathway provide particularly useful promoter sequences. Examples include alcohol dehydrogenase (ADH) (EPO Publ. No. 284 044), enolase, glucokinase, glucose-6-phosphate isomerase, glyceraldehyde-3-phosphate-dehydrogenase (GAP or GAPDH), hexokinase, phosphofructokinase, 3-phosphoglycerate mutase, and pyruvate kinase (PyK) (EPO Publ. No. 329 203). The yeast PHO5 gene, encoding acid phosphatase, also provides useful promoter sequences (Myanohara et al. (1983) *Proc. Natl. Acad. Sci. USA* 80:1).

In addition, synthetic promoters which do not occur in nature also function as yeast promoters. For example, UAS sequences of one yeast promoter may be joined with the transcription activation region of another yeast promoter, creating a synthetic hybrid promoter. Examples of such hybrid promoters include the ADH regulatory sequence linked to the GAP transcription activation region (U.S. Pat. Nos. 4,876,197 and 4,880,734). Other examples of hybrid promoters include promoters which consist of the regulatory sequences of either the ADH2, GAL4, GAL10, OR PHO5 genes, combined with the transcriptional activation region of a glycolytic enzyme gene such as GAP or PyK (EPO Publ. No. 164 556). Furthermore, a yeast promoter can include naturally occurring promoters of non-yeast origin that have the ability to bind yeast RNA polymerase and initiate transcription. Examples of such promoters include, inter alia, (Cohen et al. (1980) *Proc. Natl. Acad. Sci. USA* 77:1078; Henikoff et al. (1981) *Nature* 283:835; Hollenberg et al. (1981) *Curr. Topics Microbiol. Immunol.* 96:119; Hollenberg et al. (1979) "The Expression of Bacterial Antibiotic Resistance Genes in the Yeast *Saccharomyces cerevisiae*," in: *Plasmids of Medical, Environmental and Commercial Importance* (eds. K. N. Timmis and A. Puhler); Mercerau-Puigalon et al. (1980) *Gene* 11:163; Panthier et al. (1980) *Curr. Genet.* 2:109).

A DNA molecule may be expressed intracellularly in yeast. A promoter sequence may be directly linked with the DNA molecule, in which case the first amino acid at the N-terminus of the recombinant protein will always be a methionine, which is encoded by the ATG start codon. If desired, methionine at the N-terminus may be cleaved from the protein by in vitro incubation with cyanogen bromide.

Fusion proteins provide an alternative for yeast expression systems, as well as in mammalian, plant, baculovirus, and bacterial expression systems. Usually, a DNA sequence encoding the N-terminal portion of an endogenous yeast protein, or other stable protein, is fused to the 5' end of heterologous coding sequences. Upon expression, this construct will provide a fusion of the two amino acid sequences. For example, the yeast or human superoxide dismutase (SOD) gene, can be linked at the 5' terminus of a foreign gene and expressed in yeast. The DNA sequence at the junction of the two amino acid sequences may or may not encode a cleavable site. See e.g., EPO Publ. No. 196056. Another example is a ubiquitin fusion protein. Such a fusion protein is made with the ubiquitin region that preferably retains a site for a processing enzyme (e.g. ubiquitin-specific processing protease) to cleave the ubiquitin from the foreign protein. Through this method, therefore, native foreign protein can be isolated (e.g., WO88/024066).

Alternatively, foreign proteins can also be secreted from the cell into the growth media by creating chimeric DNA molecules that encode a fusion protein comprised of a leader sequence fragment that provide for secretion in yeast of the foreign protein. Preferably, there are processing sites encoded between the leader fragment and the foreign gene that can be cleaved either in vivo or in vitro. The leader sequence fragment usually encodes a signal peptide comprised of hydrophobic amino acids which direct the secretion of the protein from the cell.

DNA encoding suitable signal sequences can be derived from genes for secreted yeast proteins, such as the yeast invertase gene (EPO Publ. No. 012 873; JPO Publ. No. 62:096,086) and the A-factor gene (U.S. Pat. No. 4,588,684). Alternatively, leaders of non-yeast origin, such as an interferon leader, exist that also provide for secretion in yeast (EPO Publ. No. 060 057).

A preferred class of secretion leaders are those that employ a fragment of the yeast alpha-factor gene, which contains both a "pre" signal sequence, and a "pro" region. The types of alpha-factor fragments that can be employed include the full-length pre-pro alpha factor leader (about 83 amino acid residues) as well as truncated alpha-factor leaders (usually about 25 to about 50 amino acid residues) (U.S. Pat. Nos. 4,546,083 and 4,870,008; EPO Publ. No. 324 274). Additional leaders employing an alpha-factor leader fragment that provides for secretion include hybrid alpha-factor leaders made with a presequence of a first yeast, but a pro-region from a second yeast alphafactor. (See e.g., PCT Publ. No. WO 89/02463.)

Usually, transcription termination sequences recognized by yeast are regulatory regions located 3' to the translation stop codon, and thus together with the promoter flank the coding sequence. These sequences direct the transcription of an mRNA which can be translated into the polypeptide encoded by the DNA. Examples of transcription terminator sequence and other yeast-recognized termination sequences, such as those coding for glycolytic enzymes.

Usually, the above described components, comprising a promoter, leader (if desired), coding sequence of interest, and transcription termination sequence, are put together into expression constructs. Expression constructs are often maintained in a replicon, such as an extrachromosomal element (e.g., plasmids) capable of stable maintenance in a host, such as yeast or bacteria. The replicon may have two replication systems, thus allowing it to be maintained, for example, in yeast for expression and in a prokaryotic host for cloning and amplification. Examples of such yeast-bacteria shuttle vectors include YEp24 (Botstein et al. (1979) *Gene* 8:17-24), pCl/l (Brake et al. (1984) *Proc. Natl. Acad. Sci. USA* 81:4642-4646), and YRp17 (Stinchcomb et al. (1982) *J. Mol. Biol.* 158:157). In addition, a replicon may be either a high or low copy number plasmid. A high copy number plasmid will generally have a copy number ranging from about 5 to about 200, and usually about 10 to about 150. A host containing a high copy number plasmid will preferably have at least about 10, and more preferably at least about 20. Enter a high or low copy number vector may be selected, depending upon the effect of the vector and the foreign protein on the host. See e.g., Brake et al., supra.

Alternatively, the expression constructs can be integrated into the yeast genome with an integrating vector. Integrating vectors usually contain at least one sequence homologous to a yeast chromosome that allows the vector to integrate, and preferably contain two homologous sequences flanking the expression construct. Integrations appear to result from recombinations between homologous DNA in the vector and the yeast chromosome (Orr-Weaver et al. (1983) *Methods in Enzymol.* 101:228-245). An integrating vector may be directed to a specific locus in yeast by selecting the appropriate homologous sequence for inclusion in the vector. See Orr-Weaver et al., supra. One or more expression construct may integrate, possibly affecting levels of recombinant protein produced (Rine et al. (1983) *Proc. Natl. Acad. Sci. USA* 80:6750). The chromosomal sequences included in the vector can occur either as a single segment in the vector, which results in the integration of the entire vector, or two segments homologous to adjacent segments in the chromosome and flanking the expression construct in the vector, which can result in the stable integration of only the expression construct.

Usually, extrachromosomal and integrating expression constructs may contain selectable markers to allow for the selection of yeast strains that have been transformed. Selectable markers may include biosynthetic genes that can be expressed in the yeast host, such as ADE2, HIS4, LEU2, TRP1, and ALG7, and the G418 resistance gene, which confer resistance in yeast cells to tunicamycin and G418, respectively. In addition, a suitable selectable marker may also provide yeast with the ability to grow in the presence of toxic compounds, such as metal. For example, the presence of CUP1 allows yeast to grow in the presence of copper ions (Butt et al. (1987) *Microbiol, Rev.* 51:351).

Alternatively, some of the above described components can be put together into transformation vectors. Transformation vectors are usually comprised of a selectable marker that is either maintained in a replicon or developed into an integrating vector, as described above.

Expression and transformation vectors, either extrachromosomal replicons or integrating vectors, have been developed for transformation into many yeasts. For example, expression vectors and methods of introducing exogenous DNA into yeast hosts have been developed for, inter alia, the following yeasts: *Candida albicans* (Kurtz, et al. (1986) *Mol. Cell. Biol.* 6:142); *Candida maltosa* (Kunze, et al. (1985) *J. Basic Microbiol* 25:141); *Hansenula polymorpha* (Gleeson, et al. (1986) *J. Gen. Microbiol.* 132:3459; Roggenkamp et al. (1986) *Mol. Gen. Genet.* 202:302); *Kluyveromyces fragilis* (Das, et al. (1984) *J. Bacteriol.* 158:1165); *Kluyveromyces lactis* (De Louvencourt et al. (1983) *J. Bacteriol.* 154:737; Van den Berg et al. (1990) *Bio/Technology* 8:135); *Pichia guillerimondii* (Kunze et al. (1985) *J. Basic Microbiol.* 25:141); *Pichia pastoris* (Cregg, et al. (1985) *Mol. Cell. Biol.* 5:3376; U.S. Pat. Nos. 4,837,148 and 4,929,555); *Saccharomyces cerevisiae* (Hinnen et al. (1978) *Proc. Natl. Acad. Sci. USA* 75:1929; Ito et al. (1983) *J. Bacteriol.* 153:163); *Schizosaccharomyces pombe* (Beach and Nurse (1981) *Nature* 300:706); and *Yarrowia lipolylica* (Davidow, et al. (1985) *Curr. Genet.* 10:380471 Gaillardin, et al. (1985) *Curr. Genet.* 10:49).

Methods of introducing exogenous DNA into yeast hosts are well-known in the art, and usually include either the transformation of spheroplasts or of intact yeast cells treated with alkali cations. Transformation procedures usually vary with the yeast species to be transformed. See e.g., [Kurtz et al. (1986) *Mol. Cell. Biol.* 6:142; Kunze et al. (1985) *J. Basic Microbiol* 25:141; *Candida*]; [Gleeson et al. (1986) *J. Gen. Microbiol.* 132:3459; Roggenkamp et al. (1986) *Mol. Gen. Genet.* 202:302; *Hansenula*]; [Das et al. (1984) *J. Bacteriol.* 158:1165; De Louvencourt et al. (1983) *J. Bacteriol.* 154: 1165; Van den Berg et al. (1990) *Bio/Technology* 8:135; *Kluyveromyces*]; [Cregg et al. (1985) *Mol. Cell. Biol.* 5:3376; Kunze et al. (1985) *J. Basic Microbiol.* 25:141; U.S. Pat. Nos. 4,837,148 and 4,929,555; *Pichia*]; [Hinnen et al. (1978) *Proc. Natl. Acad. Sci. USA* 75; 1929; Ito et al. (1983) *J. Bacteriol* 153:163 *Saccharomyces*]; [Beach and Nurse (1981) *Nature* 300:706; *Schizosaccharomyces*]; [Davidow et al. (1985) *Curr. Genet.* 10:39; Gaillardin et al. (1985) *Curr. Genet.* 10:49; *Yarrowia]*.

Definitions

A composition containing X is "substantially free of" Y when at least 85% by weight of the total X+Y in the composition is X. Preferably, X comprises at least about 90% by weight of the total of X+Y in the composition, more preferably at least about 95% or even 99% by weight.

A "conserved" *Neisseria* amino acid fragment or protein is one that is present in a particular Neisserial protein in at least x % of *Neisseria*. The value of x may be 50% or more, e.g., 66%, 75%, 80%, 90%, 95% or even 100% (i.e. the amino acid is found in the protein in question in all *Neisseria*). In order to determine whether an amino acid is "conserved" in a particular Neisserial protein, it is necessary to compare that amino acid residue in the sequences of the protein in question from a plurality of different *Neisseria* (a reference population). The reference population may include a number of different *Neisseria* species or may include a single species. The reference population may include a number of different serogroups of a particular species or a single serogroup. A preferred reference population consists of the 5 most common *Neisseria* strains.

The term "heterologous" refers to two biological components that are not found together in nature. The components may be host cells, genes, or regulatory regions, such as promoters. Although the heterologous components are not found together in nature, they can function together, as when a promoter heterologous to a gene is operably linked to the gene. Another example is where a Neisserial sequence is heterologous to a mouse host cell.

"Epitope" means antigenic determinant, and may elicit a cellular and/or humoral response.

Conditions for "high stringency" are 65 degrees C. in 0.1× SSC 0.5% SDS solution.

An "origin of replication" is a polynucleotide sequence that initiates and regulates replication of polynucleotides, such as an expression vector. The origin of replication behaves as an autonomous unit of polynucleotide replication within a cell, capable of replication under its own control. An origin of replication may be needed for a vector to replicate in a particular host cell. With certain origins of replication, an expression vector can be reproduced at a high copy number in the presence of the appropriate proteins within the cell. Examples of origins are the autonomously replicating sequences, which are effective in yeast; and the viral T-antigen, effective in COS-7 cells.

A "mutant" sequence is defined as a DNA, RNA or amino acid sequence differing from but having homology with the native or disclosed sequence. Depending on the particular sequence, the degree of homology (sequence identity) between the native or disclosed sequence and the mutant sequence is preferably greater than 50% (e.g., 60%, 70%, 80%, 90%, 95%, 99% or more) which is calculated as described above. As used herein, an "allelic variant" of a nucleic acid molecule, or region, for which nucleic acid sequence is provided herein is a nucleic acid molecule, or region, that occurs at essentially the same locus in the genome of another or second isolate, and that, due to natural variation caused by, for example, mutation or recombination, has a similar but not identical nucleic acid sequence. A coding region allelic variant typically encodes a protein having similar activity to that of the protein encoded by the gene to which it is being compared. An allelic variant can also comprise an alteration in the 5' or 3' untranslated regions of the gene, such as in regulatory control regions. (see, for example, U.S. Pat. No. 5,753,235).

Antibodies

As used herein, the term "antibody" refers to a polypeptide or group of polypeptides composed of at least one antibody combining site. An "antibody combining site" is the three-dimensional binding space with an internal surface shape and charge distribution complementary to the features of an epitope of an antigen, which allows a binding of the antibody with the antigen. "Antibody" includes, for example, vertebrate antibodies, hybrid antibodies, chimeric antibodies, humanized antibodies, altered antibodies, univalent antibodies, Fab proteins, and single domain antibodies.

Antibodies against the proteins of the invention are useful for affinity chromatography, immunoassays, and distinguishing/identifying *Neisseria* menB proteins. Antibodies elicited against the proteins of the present invention bind to antigenic polypeptides or proteins or protein fragments that are present and specifically associated with strains of *Neisseria meningitidis* menB. In some instances, these antigens may be associated with specific strains, such as those antigens specific for the menB strains. The antibodies of the invention may be immobilized to a matrix and utilized in an immunoassay or on an affinity chromatography column, to enable the detection and/or separation of polypeptides, proteins or protein fragments or cells comprising such polypeptides, proteins or protein fragments. Alternatively, such polypeptides, proteins or protein fragments may be immobilized so as to detect antibodies bindably specific thereto.

Antibodies to the proteins of the invention, both polyclonal and monoclonal, may be prepared by conventional methods. In general, the protein is first used to immunize a suitable animal, preferably a mouse, rat, rabbit or goat. Rabbits and goats are preferred for the preparation of polyclonal sera due to the volume of serum obtainable, and the availability of labeled anti-rabbit and anti-goat antibodies. Immunization is generally performed by mixing or emulsifying the protein in saline, preferably in an adjuvant such as Freund's complete adjuvant, and injecting the mixture or emulsion parenterally (generally subcutaneously or intramuscularly). A dose of 50-200 μg/injection is typically sufficient. Immunization is generally boosted 2-6 weeks later with one or more injections of the protein in saline, preferably using Freund's incomplete adjuvant. One may alternatively generate antibodies by in vitro immunization using methods known in the art, which for the purposes of this invention is considered equivalent to in vivo immunization. Polyclonal antisera is obtained by bleeding the immunized animal into a glass or plastic container, incubating the blood at 25° C. for one hour, followed by incubating at 4° C. for 2-18 hours. The serum is recovered by centrifugation (e.g., 1,000 g for 10 minutes). About 20-50 ml per bleed may be obtained from rabbits.

Monoclonal antibodies are prepared using the standard method of Kohler & Milstein (*Nature* (1975) 256:495-96), or a modification thereof. Typically, a mouse or rat is immunized as described above. However, rather than bleeding the animal to extract serum, the spleen (and optionally several large lymph nodes) is removed and dissociated into single cells. If desired, the spleen cells may be screened (after removal of nonspecifically adherent cells) by applying a cell suspension to a plate or well coated with the protein antigen. B-cells that express membrane-bound immunoglobulin specific for the antigen bind to the plate, and are not rinsed away with the rest of the suspension. Resulting B-cells, or all dissociated spleen cells, are then induced to fuse with myeloma cells to form hybridomas, and are cultured in a selective medium (e.g., hypoxanthine, aminopterin, thymidine medium, "HAT"). The resulting hybridomas are plated by limiting dilution, and are assayed for the production of antibodies which bind specifically to the immunizing antigen (and which do not bind to unrelated antigens). The selected MAb-secreting hybridomas are then cultured either in vitro (e.g., in tissue culture bottles or hollow fiber reactors), or in vivo (as ascites in mice).

If desired, the antibodies (whether polyclonal or monoclonal) may be labeled using conventional techniques. Suitable labels include fluorophores, chromophores, radioactive atoms (particularly $^{32}P$ and $^{125}I$), electron-dense reagents, enzymes, and ligands having specific binding partners. Enzymes are typically detected by their activity. For example, horseradish peroxidase is usually detected by its ability to convert 3,3',5,5'-tetramethylbenzidine (TMB) to a blue pigment, quantifiable with a spectrophotometer. "Specific binding partner" refers to a protein capable of binding a ligand molecule with high specificity, as for example in the case of an antigen and a monoclonal antibody specific therefor. Other specific binding partners include biotin and avidin or streptavidin, IgG and protein A, and the numerous receptor-ligand couples known in the art. It should be understood that the above description is not meant to categorize the various labels into distinct classes, as the same label may serve in several different modes. For example, $^{125}I$ may serve as a radioactive label or as an electron-dense reagent. HRP may serve as enzyme or as antigen for a MAb. Further, one may combine various labels for desired effect. For example, MAbs and avidin also require labels in the practice of this invention: thus, one might label a MAb with biotin, and detect its presence with avidin labeled with $^{125}I$, or with an anti-biotin MAb labeled with HRP. Other permutations and possibilities will be readily apparent to those of ordinary skill in the art, and are considered as equivalents within the scope of the instant invention.

Antigens, immunogens, polypeptides, proteins or protein fragments of the present invention elicit formation of specific binding partner antibodies. These antigens, immunogens, polypeptides, proteins or protein fragments of the present invention comprise immunogenic compositions of the present invention. Such immunogenic compositions may further comprise or include adjuvants, carriers, or other compositions that promote or enhance or stabilize the antigens, polypeptides, proteins or protein fragments of the present invention. Such adjuvants and carriers will be readily apparent to those of ordinary skill in the art.

Pharmaceutical Compositions

Pharmaceutical compositions can comprise (include) either polypeptides, antibodies, or nucleic acid of the invention. The pharmaceutical compositions will comprise a therapeutically effective amount of either polypeptides, antibodies, or polynucleotides of the claimed invention.

The term "therapeutically effective amount" as used herein refers to an amount of a therapeutic agent to treat, ameliorate, or prevent a desired disease or condition, or to exhibit a detectable therapeutic or preventative effect. The effect can be detected by, for example, chemical markers or antigen levels. Therapeutic effects also include reduction in physical symptoms, such as decreased body temperature, when given to a patient that is febrile. The precise effective amount for a subject will depend upon the subject's size and health, the nature and extent of the condition, and the therapeutics or combination of therapeutics selected for administration. Thus, it is not useful to specify an exact effective amount in advance. However, the effective amount for a given situation can be determined by routine experimentation and is within the judgment of the clinician.

For purposes of the present invention, an effective dose will be from about 0.01 mg/kg to 50 mg/kg or 0.05 mg/kg to about 10 mg/kg of the DNA constructs in the individual to which it is administered.

A pharmaceutical composition can also contain a pharmaceutically acceptable carrier. The term "pharmaceutically acceptable carrier" refers to a carrier for administration of a therapeutic agent, such as antibodies or a polypeptide, genes, and other therapeutic agents. The term refers to any pharmaceutical carrier that does not itself induce the production of antibodies harmful to the individual receiving the composition, and which may be administered without undue toxicity. Suitable carriers may be large, slowly metabolized macromolecules such as proteins, polysaccharides, polylactic acids, polyglycolic acids, polymeric amino acids, amino acid copolymers, and inactive virus particles. Such carriers are well known to those of ordinary skill in the art.

Pharmaceutically acceptable salts can be used therein, for example, mineral acid salts such as hydrochlorides, hydrobromides, phosphates, sulfates, and the like; and the salts of organic acids such as acetates, propionates, malonates, benzoates, and the like. A thorough discussion of pharmaceutically acceptable excipients is available in Remington's Pharmaceutical Sciences (Mack Pub. Co., N.J. 1991).

Pharmaceutically acceptable carriers in therapeutic compositions may contain liquids such as water, saline, glycerol and ethanol. Additionally, auxiliary substances, such as wetting or emulsifying agents, pH buffering substances, and the like, may be present in such vehicles. Typically, the therapeutic compositions are prepared as injectables, either as liquid solutions or suspensions; solid forms suitable for solution in, or suspension in, liquid vehicles prior to injection may also be prepared. Liposomes are included within the definition of a pharmaceutically acceptable carrier.

Delivery Methods

Once formulated, the compositions of the invention can be administered directly to the subject. The subjects to be treated can be animals; in particular, human subjects can be treated.

Direct delivery of the compositions will generally be accomplished by injection, either subcutaneously, intraperitoneally, intravenously or intramuscularly or delivered to the interstitial space of a tissue. The compositions can also be administered into a lesion. Other modes of administration include oral and pulmonary administration, suppositories, and transdermal and transcutaneous applications, needles, and gene guns or hyposprays. Dosage treatment may be a single dose schedule or a multiple dose schedule.

Vaccines

Vaccines according to the invention may either be prophylactic (i.e., to prevent infection) or therapeutic (i.e., to treat disease after infection).

Such vaccines comprise immunizing antigen(s) or immunogen(s), immunogenic polypeptide, protein(s) or protein fragments, or nucleic acids (e.g., ribonucleic acid or deoxyribonucleic acid), usually in combination with "pharmaceutically acceptable carriers," which include any carrier that does not itself induce the production of antibodies harmful to the individual receiving the composition. Suitable carriers are typically large, slowly metabolized macromolecules such as proteins, polysaccharides, polylactic acids, polyglycolic acids, polymeric amino acids, amino acid copolymers, lipid aggregates (such as oil droplets or liposomes), and inactive virus particles. Such carriers are well known to those of ordinary skill in the art. Additionally, these carriers may function as immunostimulating agents ("adjuvants"). Furthermore, the immunogen or antigen may be conjugated to a bacterial toxoid, such as a toxoid from diphtheria, tetanus, cholera, *H. pylori*, etc. pathogens.

Preferred adjuvants to enhance effectiveness of the composition include, but are not limited to: (1) aluminum salts (alum), such as aluminum hydroxide, aluminum phosphate, aluminum sulfate, etc; (2) oil-in-water emulsion formulations (with or without other specific immunostimulating agents such as muramyl peptides (see below) or bacterial cell wall components), such as for example (a) MF59 (PCT Publ. No. WO 90/14837), containing 5% Squalene, 0.5% TWEEN 80™, and 0.5% SPAN 85™ (optionally containing various amounts of MTP-PE (see below), although not required) formulated into submicron particles using a microfluidizer such as Model 110Y microfluidizer (Microfluidics, Newton, Mass.), (b) SAF, containing 10% Squalane, 0.4% Tween 80, 5% PLURONIC™-blocked polymer L121, and thr-MDP (see below) either microfluidized into a submicron emulsion or vortexed to generate a larger particle size emulsion, and (c) RIBI™ adjuvant system (RAS), (Ribi Immunochem, Hamilton, Mont.) containing 2% Squalene, 0.2% TWEEN 80™, and one or more bacterial cell wall components from the group consisting of monophosphorylipid A (MPL), trehalose dimycolate (TDM), and cell wall skeleton (CWS), preferably MPL+CWS (DEXTOX™); (3) saponin adjuvants, such as STIMULON™ (Cambridge Bioscience, Worcester, Mass.) may be used or particles generated therefrom such as ISCOMs (immunostimulating complexes); (4) Complete Freund's Adjuvant (CFA) and Incomplete Freund's Adjuvant (IFA); (5) cytokines, such as interleukins (e.g., IL-1, IL-2, IL-4, IL-5, IL-6, IL-7, IL-12, etc.), interferons (e.g., gamma interferon), macrophage colony stimulating factor (M-CSF), tumor necrosis factor (TNF), etc; and (6) other substances that act as immunostimulating agents to enhance the effectiveness of the composition. Alum and MF59 are preferred.

As mentioned above, muramyl peptides include, but are not limited to, N-acetyl-muramyl-L-threonyl-D-isoglutamine (thr-MDP), N-acetyl-normuramyl-L-alanyl-D-isoglutamine (nor-MDP), N-acetylmuramyl-L-alanyl-D-isoglutaminyl-L-alanine-2-(1'-2'-dipalmitoyl-sn-glycero-3-huydroxyphosphoryloxy)-ethylamine (MTP-PE), etc.

The vaccine compositions comprising immunogenic compositions (e.g., which may include the antigen, pharmaceutically acceptable carrier, and adjuvant) typically will contain diluents, such as water, saline, glycerol, ethanol, etc. Additionally, auxiliary substances, such as wetting or emulsifying agents, pH buffering substances, and the like, may be present in such vehicles. Alternatively, vaccine compositions comprising immunogenic compositions may comprise an antigen, polypeptide, protein, protein fragment or nucleic acid in a pharmaceutically acceptable carrier.

More specifically, vaccines comprising immunogenic compositions comprise an immunologically effective amount of the immunogenic polypeptides, as well as any other of the above-mentioned components, as needed. By "immunologically effective amount", it is meant that the administration of that amount to an individual, either in a single dose or as part of a series, is effective for treatment or prevention. This amount varies depending upon the health and physical condition of the individual to be treated, the taxonomic group of individual to be treated (e.g., nonhuman primate, primate, etc.), the capacity of the individual's immune system to synthesize antibodies, the degree of protection desired, the formulation of the vaccine, the treating doctor's assessment of the medical situation, and other relevant factors. It is expected that the amount will fall in a relatively broad range that can be determined through routine trials.

Typically, the vaccine compositions or immunogenic compositions are prepared as injectables, either as liquid solutions or suspensions; solid forms suitable for solution in, or suspension in, liquid vehicles prior to injection may also be prepared. The preparation also may be emulsified or encapsulated in liposomes for enhanced adjuvant effect, as discussed above under pharmaceutically acceptable carriers.

The immunogenic compositions are conventionally administered parenterally, e.g., by injection, either subcutaneously or intramuscularly. Additional formulations suitable for other modes of administration include oral and pulmonary formulations, suppositories, and transdermal and transcutaneous applications. Dosage treatment may be a single dose schedule or a multiple dose schedule. The vaccine may be administered in conjunction with other immunoregulatory agents.

As an alternative to protein-based vaccines, DNA vaccination may be employed (e.g., Robinson & Torres (1997) *Seminars in Immunology* 9:271-283; Donnelly et al. (1997) *Annu Rev Immunol* 15:617-648).

Gene Delivery Vehicles

Gene therapy vehicles for delivery of constructs, including a coding sequence of a therapeutic of the invention, to be delivered to the mammal for expression in the mammal, can be administered either locally or systemically. These constructs can utilize viral or non-viral vector approaches in in vivo or ex vivo modality. Expression of such coding sequence can be induced using endogenous mammalian or heterologous promoters. Expression of the coding sequence in vivo can be either constitutive or regulated.

The invention includes gene delivery vehicles capable of expressing the contemplated nucleic acid sequences. The gene delivery vehicle is preferably a viral vector and, more preferably, a retroviral, adenoviral, adeno-associated viral (AAV), herpes viral, or alphavirus vector. The viral vector can also be an astrovirus, coronavirus, orthomyxovirus, papovavirus, paramyxovirus, parvovirus, picornavirus, poxvirus, or togavirus viral vector. See generally, Jolly (1994) *Cancer Gene Therapy* 1:51-64; Kimura (1994) *Human Gene Therapy* 5:845-852; Connelly (1995) *Human Gene Therapy* 6:185-193; and Kaplitt (1994) *Nature Genetics* 6:148-153.

Retroviral vectors are well known in the art, including B, C and D type retroviruses, xenotropic retroviruses (for example, NZB-X1, NZB-X2 and NZB9-1 (see O'Neill (1985) *J. Virol.* 53:160) polytropic retroviruses e.g., MCF and MCF-MLV (see Kelly (1983) *J. Virol.* 45:291), spumaviruses and lentiviruses. See RNA Tumor Viruses, Second Edition, Cold Spring Harbor Laboratory, 1985.

Portions of the retroviral gene therapy vector may be derived from different retroviruses. For example, retrovector LTRs may be derived from a Murine Sarcoma Virus, a tRNA binding site from a Rous Sarcoma Virus, a packaging signal from a Murine Leukemia Virus, and an origin of second strand synthesis from an Avian Leukosis Virus.

These recombinant retroviral vectors may be used to generate transduction competent retroviral vector particles by introducing them into appropriate packaging cell lines (see U.S. Pat. No. 5,591,624). Retrovirus vectors can be constructed for site-specific integration into host cell DNA by incorporation of a chimeric integrase enzyme into the retroviral particle (see WO96/37626). It is preferable that the recombinant viral vector is a replication defective recombinant virus.

Packaging cell lines suitable for use with the above-described retrovirus vectors are well known in the art, are readily prepared (see WO95/30763 and WO92/05266), and can be used to create producer cell lines (also termed vector cell lines or "VCLs") for the production of recombinant vector particles. Preferably, the packaging cell lines are made from human parent cells (e.g., HT1080 cells) or mink parent cell lines, which eliminates inactivation in human serum.

Preferred retroviruses for the construction of retroviral gene therapy vectors include Avian Leukosis Virus, Bovine Leukemia Virus, Murine Leukemia Virus, Mink-Cell Focus-Inducing Virus, Murine Sarcoma Virus, Reticuloendotheliosis Virus and Rous Sarcoma Virus. Particularly preferred Murine Leukemia Viruses include 4070A and 1504A (Hartley and Rowe (1976) *J Virol* 19:19-25), Abelson (ATCC No. VR-999), Friend (ATCC No. VR-245), Graffi, Gross (ATCC Nol VR-590), Kirsten, Harvey Sarcoma Virus and Rauscher (ATCC No. VR-998) and Moloney Murine Leukemia Virus (ATCC No. VR-190). Such retroviruses may be obtained from depositories or collections such as the American Type Culture Collection ("ATCC") or isolated from known sources using commonly available techniques.

Exemplary known retroviral gene therapy vectors employable in this invention include those described in patent applications GB2200651, EP0415731, EP0345242, EP0334301, WO89/02468; WO89/05349, WO89/09271, WO90/02806, WO90/07936, WO94/03622, WO93/25698, WO93/25234, WO93/11230, WO93/10218, WO91/02805, WO91/02825, WO95/07994, U.S. Pat. No. 5,219,740, U.S. Pat. No. 4,405,712, U.S. Pat. No. 4,861,719, U.S. Pat. No. 4,980,289, U.S. Pat. No. 4,777,127, U.S. Pat. No. 5,591,624. See also Vile (1993) *Cancer Res* 53:3860-3864; Vile (1993) *Cancer Res* 53:962-967; Ram (1993) *Cancer Res* 53 (1993) 83-88; Takamiya (1992) *J Neurosci Res* 33:493-503; Baba (1993) *J Neurosurg* 79:729-735; Mann (1983) *Cell* 33:153; Cane (1984) *Proc Natl Acad Sci* 81:6349; and Miller (1990) *Human Gene Therapy* 1.

Human adenoviral gene therapy vectors are also known in the art and employable in this invention. See, for example, Berkner (1988) *Biotechniques* 6:616 and Rosenfeld (1991) *Science* 252:431, and WO93/07283, WO93/06223, and WO93/07282. Exemplary known adenoviral gene therapy vectors employable in this invention include those described in the above referenced documents and in WO94/12649, WO93/03769, WO93/19191, WO94/28938, WO95/11984, WO95/00655, WO95/27071, WO95/29993, WO95/34671, WO96/05320, WO94/08026, WO94/11506, WO93/06223, WO94/24299, WO95/14102, WO95/24297, WO95/02697, WO94/28152, WO94/24299, WO95/09241, WO95/25807, WO95/05835, WO94/18922 and WO95/09654. Alternatively, administration of DNA linked to killed adenovirus as described in Curiel (1992) *Hum. Gene Ther.* 3:147-154 may be employed. The gene delivery vehicles of the invention also include adenovirus associated virus (AAV) vectors. Leading and preferred examples of such vectors for use in this invention are the AAV-2 based vectors disclosed in Srivastava, WO93/09239. Most preferred AAV vectors comprise the two AAV inverted terminal repeats in which the native D-sequences are modified by substitution of nucleotides, such that at least 5 native nucleotides and up to 18 native nucleotides, preferably at least 10 native nucleotides up to 18 native nucleotides, most preferably 10 native nucleotides are retained and the remaining nucleotides of the D-sequence are deleted or replaced with non-native nucleotides. The native D-sequences of the AAV inverted terminal repeats are sequences of 20 consecutive nucleotides in each AAV inverted terminal repeat (i.e., there is one sequence at each end) which are not involved in HP formation. The non-native replacement nucleotide may be any nucleotide other than the nucleotide found in the native D-sequence in the same position. Other employable exemplary AAV vectors are pWP-19, pWN-1, both of which are disclosed in Nahreini (1993) *Gene* 124:257-262. Another example of such an AAV vector is psub201 (see Samulski (1987) *J. Virol.* 61:3096). Another exemplary AAV vector is the Double-D ITR vector. Construction of the Double-D ITR vector is disclosed in U.S. Pat. No. 5,478,745. Still other vectors are those disclosed in Carter U.S. Pat. No. 4,797,368 and Muzyczka U.S. Pat. No. 5,139,941, Chartejee U.S. Pat. No. 5,474,935, and Kotin WO94/288157. Yet a further example of an AAV vector employable in this invention is SSV9AFABTKneo, which contains the AFP enhancer and albumin promoter and directs expression predominantly in the liver. Its structure and construction are disclosed in Su (1996) *Human Gene Therapy* 7:463-470. Additional AAV gene therapy vectors are described in U.S. Pat. No. 5,354,678, U.S. Pat. No. 5,173,414, U.S. Pat. No. 5,139,941, and U.S. Pat. No. 5,252,479.

The gene therapy vectors comprising sequences of the invention also include herpes vectors. Leading and preferred examples are herpes simplex virus vectors containing a sequence encoding a thymidine kinase polypeptide such as those disclosed in U.S. Pat. No. 5,288,641 and EP0176170 (Roizman). Additional exemplary herpes simplex virus vectors include HFEM/ICP6-LacZ disclosed in WO95/04139 (Wistar Institute), pHSVlac described in Geller (1988) *Science* 241:1667-1669 and in WO90/09441 and WO92/07945, HSV Us3::pgC-lacZ described in Fink (1992) *Human Gene*

*Therapy* 3:11-19 and HSV 7134, 2 RH 105 and GAL4 described in EP 0453242 (Breakefield), and those deposited with the ATCC as accession numbers ATCC VR-977 and ATCC VR-260.

Also contemplated are alpha virus gene therapy vectors that can be employed in this invention. Preferred alpha virus vectors are Sindbis viruses vectors. Togaviruses, Semliki Forest virus (ATCC VR-67; ATCC VR-1247), Middleberg virus (ATCC VR-370), Ross River virus (ATCC VR-373; ATCC VR-1246), Venezuelan equine encephalitis virus (ATCC VR923; ATCC VR-1250; ATCC VR-1249; ATCC VR-532), and those described in U.S. Pat. Nos. 5,091,309, 5,217,879, and WO92/10578. More particularly, those alpha virus vectors described in U.S. Ser. No. 08/405,627, filed Mar. 15, 1995, WO94/21792, WO92/10578, WO95/07994, U.S. Pat. No. 5,091,309 and U.S. Pat. No. 5,217,879 are employable. Such alpha viruses may be obtained from depositories or collections such as the ATCC or isolated from known sources using commonly available techniques. Preferably, alphavirus vectors with reduced cytotoxicity are used (see U.S. Ser. No. 08/679,640)

DNA vector systems such as eukarytic layered expression systems are also useful for expressing the nucleic acids of the invention. See WO95/07994 for a detailed description of eukaryotic layered expression systems. Preferably, the eukaryotic layered expression systems of the invention are derived from alphavirus vectors and most preferably from Sindbis viral vectors.

Other viral vectors suitable for use in the present invention include those derived from poliovirus, for example ATCC VR-58 and those described in Evans, Nature 339 (1989) 385 and Sabin (1973) *J. Biol. Standardization* 1:115; rhinovirus, for example ATCC VR-1110 and those described in Arnold (1990) *J Cell Biochem L*401; pox viruses such as canary pox virus or vaccinia virus, for example ATCC VR-111 and ATCC VR-2010 and those described in Fisher-Hoch (1989) *Proc Natl Acad Sci* 86:317; Flexner (1989) *Ann NY Acad Sci* 569: 86, Flexner (1990) *Vaccine* 8:17; in U.S. Pat. No. 4,603,112 and U.S. Pat. No. 4,769,330 and WO89/01973; SV40 virus, for example ATCC VR-305 and those described in Mulligan (1979) *Nature* 277:108 and Madzak (1992) *J Gen Virol* 73:1533; influenza virus, for example ATCC VR-797 and recombinant influenza viruses made employing reverse genetics techniques as described in U.S. Pat. No. 5,166,057 and in Enami (1990) *Proc Natl Acad Sci* 87:3802-3805; Enami & Palese (1991) *Virol* 65:2711-2713 and Luytjes (1989) *Cell* 59:110, (see also McMichael (1983) *NEJ Med* 309:13, and Yap (1978) *Nature* 273:238 and Nature (1979) 277:108); human immunodeficiency virus as described in EP-0386882 and in Buchschacher (1992) *J. Virol.* 66:2731; measles virus, for example ATCC VR-67 and VR-1247 and those described in EP-0440219; Aura virus, for example ATCC VR-368; Bebaru virus, for example ATCC VR-600 and ATCC VR-1240; Cabassou virus, for example ATCC VR-922; Chikungunya virus, for example ATCC VR-64 and ATCC VR-1241; Fort Morgan Virus, for example ATCC VR-924; Getah virus, for example ATCC VR-369 and ATCC VR-1243; Kyzylagach virus, for example ATCC VR-927; Mayaro virus, for example ATCC VR-66; Mucambo virus, for example ATCC VR-580 and ATCC VR-1244; Ndumu virus, for example ATCC VR-371; Pixuna virus, for example ATCC VR-372 and ATCC VR-1245; Tonate virus, for example ATCC VR-925; Triniti virus, for example ATCC VR-469; Una virus, for example ATCC VR-374; Whataroa virus, for example ATCC VR-926; Y-62-33 virus, for example ATCC VR-375; O'Nyong virus, Eastern encephalitis virus, for example ATCC VR-65 and ATCC VR-1242; Western encephalitis virus, for example ATCC VR-70, ATCC VR-1251, ATCC VR-622 and ATCC VR-1252; and coronavirus, for example ATCC VR-740 and those described in Hamre (1966) *Proc Soc Exp Biol Med* 121:190.

Delivery of the compositions of this invention into cells is not limited to the above mentioned viral vectors. Other delivery methods and media may be employed such as, for example, nucleic acid expression vectors, polycationic condensed DNA linked or unlinked to killed adenovirus alone, for example see U.S. Ser. No. 08/366,787, filed Dec. 30, 1994 and Curiel (1992) *Hum Gene Ther* 3:147-154 ligand linked DNA, for example see Wu (1989) *J Biol Chem* 264:16985-16987, eucaryotic cell delivery vehicles cells, for example see U.S. Ser. No. 08/240,030, filed May 9, 1994, and U.S. Ser. No. 08/404,796, deposition of photopolymerized hydrogel materials, hand-held gene transfer particle gun, as described in U.S. Pat. No. 5,149,655, ionizing radiation as described in U.S. Pat. No. 5,206,152 and in WO92/11033, nucleic charge neutralization or fusion with cell membranes. Additional approaches are described in Philip (1994) *Mol Cell Biol* 14:2411-2418 and in Woffendin (1994) *Proc Natl Acad Sci* 91:1581-1585.

Particle mediated gene transfer may be employed, for example see U.S. Ser. No. 60/023,867. Briefly, the sequence can be inserted into conventional vectors that contain conventional control sequences for high level expression, and then incubated with synthetic gene transfer molecules such as polymeric DNA-binding cations like polylysine, protamine, and albumin, linked to cell targeting ligands such as asialoorosomucoid, as described in Wu & Wu (1987) *J. Biol. Chem.* 262:4429-4432, insulin as described in Hucked (1990) *Biochem Pharmacol* 40:253-263, galactose as described in Plank (1992) *Bioconjugate Chem* 3:533-539, lactose or transferrin.

Naked DNA may also be employed to transform a host cell. Exemplary naked DNA introduction methods are described in WO 90/11092 and U.S. Pat. No. 5,580,859. Uptake efficiency may be improved using biodegradable latex beads. DNA coated latex beads are efficiently transported into cells after endocytosis initiation by the beads. The method may be improved further by treatment of the beads to increase hydrophobicity and thereby facilitate disruption of the endosome and release of the DNA into the cytoplasm.

Liposomes that can act as gene delivery vehicles are described in U.S. Pat. No. 5,422,120, WO95/13796, WO94/23697, WO91/14445 and EP-524,968. As described in U.S. Ser. No. 60/023,867, on non-viral delivery, the nucleic acid sequences encoding a polypeptide can be inserted into conventional vectors that contain conventional control sequences for high level expression, and then be incubated with synthetic gene transfer molecules such as polymeric DNA-binding cations like polylysine, protamine, and albumin, linked to cell targeting ligands such as asialoorosomucoid, insulin, galactose, lactose, or transferrin. Other delivery systems include the use of liposomes to encapsulate DNA comprising the gene under the control of a variety of tissue-specific or ubiquitously-active promoters. Further non-viral delivery suitable for use includes mechanical delivery systems such as the approach described in Woffendin et al (1994) *Proc. Natl. Acad. Sci. USA* 91(24):11581-11585. Moreover, the coding sequence and the product of expression of such can be delivered through deposition of photopolymerized hydrogel materials. Other conventional methods for gene delivery that can be used for delivery of the coding sequence include, for example, use of hand-held gene transfer particle gun, as described in U.S. Pat. No. 5,149,655; use of ionizing radiation for activating transferred gene, as described in U.S. Pat. No. 5,206,152 and WO92/11033.

Exemplary liposome and polycationic gene delivery vehicles are those described in U.S. Pat. Nos. 5,422,120 and 4,762,915; in WO 95/13796; WO94/23697; and WO91/14445; in EP-0524968; and in Stryer, Biochemistry, pages 236-240 (1975) W.H. Freeman, San Francisco; Szoka (1980) *Biochem Biophys Acta* 600:1; Bayer (1979) *Biochem Biophys Acta* 550:464; Rivnay (1987) *Meth Enzymol* 149:119; Wang (1987) *Proc Natl Acad Sci* 84:7851; Plant (1989) *Anal Biochem* 176:420.

A polynucleotide composition can comprises therapeutically effective amount of a gene therapy vehicle, as the term is defined above. For purposes of the present invention, an effective dose will be from about 0.01 mg/kg to 50 mg/kg or 0.05 mg/kg to about 10 mg/kg of the DNA constructs in the individual to which it is administered.

Delivery Methods

Once formulated, the polynucleotide compositions of the invention can be administered (1) directly to the subject; (2) delivered ex vivo, to cells derived from the subject; or (3) in vitro for expression of recombinant proteins. The subjects to be treated can be mammals or birds. Also, human subjects can be treated.

Direct delivery of the compositions will generally be accomplished by injection, either subcutaneously, intraperitoneally, intravenously or intramuscularly or delivered to the interstitial space of a tissue. The compositions can also be administered into a tumor or lesion. Other modes of administration include oral and pulmonary administration, suppositories, and transdermal applications, needles, and gene guns or hyposprays. Dosage treatment may be a single dose schedule or a multiple dose schedule.

Methods for the ex vivo delivery and reimplantation of transformed cells into a subject are known in the art and described in eg. WO93/14778. Examples of cells useful in ex vivo applications include, for example, stem cells, particularly hematopoetic, lymph cells, macrophages, dendritic cells, or tumor cells.

Generally, delivery of nucleic acids for both ex vivo and in vitro applications can be accomplished by the following procedures, for example, dextran-mediated transfection, calcium phosphate precipitation, polybrene mediated transfection, protoplast fusion, electroporation, encapsulation of the polynucleotide(s) in liposomes, and direct microinjection of the DNA into nuclei, all well known in the art.

Polynucleotide and Polypeptide Pharmaceutical Compositions

In addition to the pharmaceutically acceptable carriers and salts described above, the following additional agents can be used with polynucleotide and/or polypeptide compositions.

A. Polypeptides

One example are polypeptides which include, without limitation: asioloorosomucoid (ASOR); transferrin; asialoglycoproteins; antibodies; antibody fragments; ferritin; interleukins; interferons, granulocyte, macrophage colony stimulating factor (GM-CSF), granulocyte colony stimulating factor (G-CSF), macrophage colony stimulating factor (M-CSF), stem cell factor and erythropoietin. Viral antigens, such as envelope proteins, can also be used. Also, proteins from other invasive organisms, such as the 17 amino acid peptide from the circumsporozoite protein of *plasmodium falciparum* known as RII.

B. Hormones, Vitamins, Etc.

Other groups that can be included are, for example: hormones, steroids, androgens, estrogens, thyroid hormone, or vitamins, folic acid.

C. Polyalkylenes, Polysaccharides, Etc.

Also, polyalkylene glycol can be included with the desired polynucleotides or polypeptides. In a preferred embodiment, the polyalkylene glycol is polyethlylene glycol. In addition, mono-, di-, or polysaccarides can be included. In a preferred embodiment of this aspect, the polysaccharide is dextran or DEAE-dextran. Also, chitosan and poly(lactide-co-glycolide)

D. Lipids, and Liposomes

The desired polynucleotide or polypeptide can also be encapsulated in lipids or packaged in liposomes prior to delivery to the subject or to cells derived therefrom.

Lipid encapsulation is generally accomplished using liposomes which are able to stably bind or entrap and retain nucleic acid. The ratio of condensed polynucleotide or polypeptide to lipid preparation can vary but will generally be around 1:1 (mg DNA:micromoles lipid), or more of lipid. For a review of the use of liposomes as carriers for delivery of nucleic acids, see, Hug and Sleight (1991) *Biochim. Biophys. Acta.* 1097:1-17; Straubinger (1983) *Meth. Enzymol.* 101: 512-527.

Liposomal preparations for use in the present invention include cationic (positively charged), anionic (negatively charged) and neutral preparations. Cationic liposomes have been shown to mediate intracellular delivery of plasmid DNA (Felgner (1987) *Proc. Natl. Acad. Sci. USA* 84:7413-7416); mRNA (Malone (1989) *Proc. Natl. Acad. Sci. USA* 86:6077-6081); and purified transcription factors (Debs (1990) *J. Biol. Chem.* 265:10189-10192), in functional form.

Cationic liposomes are readily available. For example, N[1-2,3-dioleyloxy)propyl]-N,N,N-triethylammonium (DOTMA) liposomes are available under the trademark Lipofectin, from GIBCO BRL, Grand Island, N.Y. (See, also, Felgner supra). Other commercially available liposomes include transfectace (DDAB/DOPE) and DOTAP/DOPE (Boerhinger). Other cationic liposomes can be prepared from readily available materials using techniques well known in the art. See, eg. Szoka (1978) *Proc. Natl. Acad. Sci. USA* 75:4194-4198; WO90/11092 for a description of the synthesis of DOTAP (1,2-bis(oleoyloxy)-3-(trimethylammonio) propane) liposomes.

Similarly, anionic and neutral liposomes are readily available, such as from Avanti Polar Lipids (Birmingham, Ala.), or can be easily prepared using readily available materials. Such materials include phosphatidyl choline, cholesterol, phosphatidyl ethanolamine, dioleoylphosphatidyl choline (DOPC), dioleoylphosphatidyl glycerol (DOPG), dioleoylphoshatidyl ethanolamine (DOPE), among others. These materials can also be mixed with the DOTMA and DOTAP starting materials in appropriate ratios. Methods for making liposomes using these materials are well known in the art.

The liposomes can comprise multilammelar vesicles (MLVs), small unilamellar vesicles (SUVs), or large unilamellar vesicles (LUVs). The various liposome-nucleic acid complexes are prepared using methods known in the art. See eg. Straubinger (1983) *Meth. Immunol.* 101:512-527; Szoka (1978) *Proc. Natl. Acad. Sci. USA* 75:4194-4198; Papahadjopoulos (1975) *Biochim. Biophys. Acta* 394:483; Wilson (1979) *Cell* 17:77); Deamer & Bangham (1976) *Biochim. Biophys. Acta* 443:629; Ostro (1977) *Biochem. Biophys. Res. Commun.* 76:836; Fraley (1979) *Proc. Natl. Acad. Sci. USA*

76:3348); Enoch & Strittmatter (1979) *Proc. Natl. Acad. Sci. USA* 76:145; Fraley (1980) *J. Biol. Chem.* (1980) 255:10431; Szoka & Papahadjopoulos (1978) *Proc. Natl. Acad. Sci. USA* 75:145; and Schaefer-Ridder (1982) *Science* 215:166.

E. Lipoproteins

In addition, lipoproteins can be included with the polynucleotide or polypeptide to be delivered. Examples of lipoproteins to be utilized include: chylomicrons, HDL, IDL, LDL, and VLDL. Mutants, fragments, or fusions of these proteins can also be used. Also, modifications of naturally occurring lipoproteins can be used, such as acetylated LDL. These lipoproteins can target the delivery of polynucleotides to cells expressing lipoprotein receptors. Preferably, if lipoproteins are including with the polynucleotide to be delivered, no other targeting ligand is included in the composition.

Naturally occurring lipoproteins comprise a lipid and a protein portion. The protein portion are known as apoproteins. At the present, apoproteins A, B, C, D, and E have been isolated and identified. At least two of these contain several proteins, designated by Roman numerals, AI, AII, AIV; CI, CII, CIII.

A lipoprotein can comprise more than one apoprotein. For example, naturally occurring chylomicrons comprises of A, B, C, and E, over time these lipoproteins lose A and acquire C and E apoproteins. VLDL comprises A, B, C, and E apoproteins, LDL comprises apoprotein B; and HDL comprises apoproteins A, C, and E.

The amino acid of these apoproteins are known and are described in, for example, Breslow (1985) *Annu Rev. Biochem* 54:699; Law (1986) *Adv. Exp Med. Biol.* 151:162; Chen (1986) *J Biol Chem* 261:12918; Kane (1980) *Proc Natl Acad Sci USA* 77:2465; and Utermann (1984) *Hum Genet.* 65:232.

Lipoproteins contain a variety of lipids including, triglycerides, cholesterol (free and esters), and phopholipids. The composition of the lipids varies in naturally occurring lipoproteins. For example, chylomicrons comprise mainly triglycerides. A more detailed description of the lipid content of naturally occurring lipoproteins can be found, for example, in *Meth. Enzymol.* 128 (1986). The composition of the lipids are chosen to aid in conformation of the apoprotein for receptor binding activity. The composition of lipids can also be chosen to facilitate hydrophobic interaction and association with the polynucleotide binding molecule.

Naturally occurring lipoproteins can be isolated from serum by ultracentrifugation, for instance. Such methods are described in *Meth. Enzymol.* (supra); Pitas (1980) *J. Biochem.* 255:5454-5460 and Mahey (1979) *J Clin. Invest* 64:743-750.

Lipoproteins can also be produced by in vitro or recombinant methods by expression of the apoprotein genes in a desired host cell. See, for example, Atkinson (1986) *Annu Rev Biophys Chem* 15:403 and Radding (1958) *Biochim Biophys Acta* 30: 443.

Lipoproteins can also be purchased from commercial suppliers, such as Biomedical Technologies, Inc., Stoughton, Mass., USA.

Further description of lipoproteins can be found in Zuckermann et al., PCT. Appln. No. US97/14465.

F. Polycationic Agents

Polycationic agents can be included, with or without lipoprotein, in a composition with the desired polynucleotide or polypeptide to be delivered.

Polycationic agents, typically, exhibit a net positive charge at physiological relevant pH and are capable of neutralizing the electrical charge of nucleic acids to facilitate delivery to a desired location. These agents have both in vitro, ex vivo, and in vivo applications. Polycationic agents can be used to deliver nucleic acids to a living subject either intramuscularly, subcutaneously, etc.

The following are examples of useful polypeptides as polycationic agents: polylysine, polyarginine, polyornithine, and protamine. Other examples include histones, protamines, human serum albumin, DNA binding proteins, non-histone chromosomal proteins, coat proteins from DNA viruses, such as (X174, transcriptional factors also contain domains that bind DNA and therefore may be useful as nucleic aid condensing agents. Briefly, transcriptional factors such as C/CEBP, c-jun, c-fos, AP-1, AP-2, AP-3, CPF, Prot-1, Sp-1, Oct-1, Oct-2, CREP, and TFIID contain basic domains that bind DNA sequences.

Organic polycationic agents include: spermine, spermidine, and purtrescine.

The dimensions and of the physical properties of a polycationic agent can be extrapolated from the list above, to construct other polypeptide polycationic agents or to produce synthetic polycationic agents.

Synthetic Polycationic Agents

Synthetic polycationic agents which are useful include, for example, DEAE-dextran, polybrene. LIPOFECTIN™, and LIPOFECTAMINE™ are monomers that form polycationic complexes when combined with polynucleotides or polypeptides.

Immunodiagnostic Assays

Neisserial antigens of the invention can be used in immunoassays to detect antibody levels (or, conversely, anti-Neisserial antibodies can be used to detect antigen levels). Immunoassays based on well defined, recombinant antigens can be developed to replace invasive diagnostics methods. Antibodies to Neisserial proteins within biological samples, including for example, blood or serum samples, can be detected. Design of the immunoassays is subject to a great deal of variation, and a variety of these are known in the art. Protocols for the immunoassay may be based, for example, upon competition, or direct reaction, or sandwich type assays. Protocols may also, for example, use solid supports, or may be by immunoprecipitation. Most assays involve the use of labeled antibody or polypeptide; the labels may be, for example, fluorescent, chemiluminescent, radioactive, or dye molecules. Assays which amplify the signals from the probe are also known; examples of which are assays which utilize biotin and avidin, and enzyme-labeled and mediated immunoassays, such as ELISA assays.

Kits suitable for immunodiagnosis and containing the appropriate labeled reagents are constructed by packaging the appropriate materials, including the compositions of the invention, in suitable containers, along with the remaining reagents and materials (for example, suitable buffers, salt solutions, etc.) required for the conduct of the assay, as well as suitable set of assay instructions.

Nucleic Acid Hybridisation

"Hybridization" refers to the association of two nucleic acid sequences to one another by hydrogen bonding. Typically, one sequence will be fixed to a solid support and the other will be free in solution. Then, the two sequences will be placed in contact with one another under conditions that favor hydrogen bonding. Factors that affect this bonding include: the type and volume of solvent; reaction temperature; time of hybridization; agitation; agents to block the non-specific attachment of the liquid phase sequence to the solid support (Denhardt's reagent or BLOTTO); concentration of the sequences; use of compounds to increase the rate of association of sequences (dextran sulfate or polyethylene glycol);

and the stringency of the washing conditions following hybridization. See Sambrook et al. [supra] Volume 2, chapter 9, pages 9.47 to 9.57.

"Stringency" refers to conditions in a hybridization reaction that favor association of very similar sequences over sequences that differ. For example, the combination of temperature and salt concentration should be chosen that is approximately 120 to 200□C below the calculated Tm of the hybrid under study. The temperature and salt conditions can often be determined empirically in preliminary experiments in which samples of genomic DNA immobilized on filters are hybridized to the sequence of interest and then washed under conditions of different stringencies. See Sambrook et al. at page 9.50.

Variables to consider when performing, for example, a Southern blot are (1) the complexity of the DNA being blotted and (2) the homology between the probe and the sequences being detected. The total amount of the fragment(s) to be studied can vary a magnitude of 10, from 0.1 to 1 μg for a plasmid or phage digest to $10^{-9}$ to $10^{-8}$ g for a single copy gene in a highly complex eukaryotic genome. For lower complexity polynucleotides, substantially shorter blotting, hybridization, and exposure times, a smaller amount of starting polynucleotides, and lower specific activity of probes can be used. For example, a single-copy yeast gene can be detected with an exposure time of only 1 hour starting with 1 μg of yeast DNA, blotting for two hours, and hybridizing for 4-8 hours with a probe of $10^8$ cpm/μg. For a single-copy mammalian gene a conservative approach would start with 10 μg of DNA, blot overnight, and hybridize overnight in the presence of 10% dextran sulfate using a probe of greater than $10^8$ cpm/μg, resulting in an exposure time of ~24 hours.

Several factors can affect the melting temperature (Tm) of a DNA-DNA hybrid between the probe and the fragment of interest, and consequently, the appropriate conditions for hybridization and washing. In many cases the probe is not 100% homologous to the fragment. Other commonly encountered variables include the length and total G+C content of the hybridizing sequences and the ionic strength and formamide content of the hybridization buffer. The effects of all of these factors can be approximated by a single equation:

$$Tm=81+16.6(\log_{10} Ci)+0.4[\%(G+C)]-0.6(\%\ \text{formamide})-600/n-1.5(\%\ \text{mismatch}).$$

where Ci is the salt concentration (monovalent ions) and n is the length of the hybrid in base pairs (slightly modified from Meinkoth & Wahl (1984) *Anal. Biochem.* 138: 267-284).

In designing a hybridization experiment, some factors affecting nucleic acid hybridization can be conveniently altered. The temperature of the hybridization and washes and the salt concentration during the washes are the simplest to adjust. As the temperature of the hybridization increases (ie. stringency), it becomes less likely for hybridization to occur between strands that are nonhomologous, and as a result, background decreases. If the radiolabeled probe is not completely homologous with the immobilized fragment (as is frequently the case in gene family and interspecies hybridization experiments), the hybridization temperature must be reduced, and background will increase. The temperature of the washes affects the intensity of the hybridizing band and the degree of background in a similar manner. The stringency of the washes is also increased with decreasing salt concentrations.

In general, convenient hybridization temperatures in the presence of 50% formamide are 42 □C for a probe with is 95% to 100% homologous to the target fragment, 37 □C for 90% to 95% homology, and 32□C for 85% to 90% homology. For lower homologies, formamide content should be lowered and temperature adjusted accordingly, using the equation above. If the homology between the probe and the target fragment are not known, the simplest approach is to start with both hybridization and wash conditions which are nonstringent. If non-specific bands or high background are observed after autoradiography, the filter can be washed at high stringency and reexposed. If the time required for exposure makes this approach impractical, several hybridization and/or washing stringencies should be tested in parallel.

Nucleic Acid Probe Assays

Methods such as PCR, branched DNA probe assays, or blotting techniques utilizing nucleic acid probes according to the invention can determine the presence of cDNA or mRNA. A probe is said to "hybridize" with a sequence of the invention if it can form a duplex or double stranded complex, which is stable enough to be detected.

The nucleic acid probes will hybridize to the Neisserial nucleotide sequences of the invention (including both sense and antisense strands). Though many different nucleotide sequences will encode the amino acid sequence, the native Neisserial sequence is preferred because it is the actual sequence present in cells. mRNA represents a coding sequence and so a probe should be complementary to the coding sequence; single-stranded cDNA is complementary to mRNA, and so a cDNA probe should be complementary to the non-coding sequence.

The probe sequence need not be identical to the Neisserial sequence (or its complement)—some variation in the sequence and length can lead to increased assay sensitivity if the nucleic acid probe can form a duplex with target nucleotides, which can be detected. Also, the nucleic acid probe can include additional nucleotides to stabilize the formed duplex. Additional Neisserial sequence may also be helpful as a label to detect the formed duplex. For example, a non-complementary nucleotide sequence may be attached to the 5' end of the probe, with the remainder of the probe sequence being complementary to a Neisserial sequence. Alternatively, non-complementary bases or longer sequences can be interspersed into the probe, provided that the probe sequence has sufficient complementarity with the a Neisserial sequence in order to hybridize therewith and thereby form a duplex which can be detected.

The exact length and sequence of the probe will depend on the hybridization conditions, such as temperature, salt condition and the like. For example, for diagnostic applications, depending on the complexity of the analyte sequence, the nucleic acid probe typically contains at least 10-20 nucleotides, preferably 15-25, and more preferably at least 30 nucleotides, although it may be shorter than this. Short primers generally require cooler temperatures to form sufficiently stable hybrid complexes with the template.

Probes may be produced by synthetic procedures, such as the triester method of Matteucci et al. [*J. Am. Chem. Soc.* (1981) 103:3185], or according to Urdea et al. [*Proc. Natl. Acad. Sci. USA* (1983) 80: 7461], or using commercially available automated oligonucleotide synthesizers.

The chemical nature of the probe can be selected according to preference. For certain applications, DNA or RNA are appropriate. For other applications, modifications may be incorporated eg. backbone modifications, such as phosphorothioates or methylphosphonates, can be used to increase in vivo half-life, alter RNA affinity, increase nuclease resistance etc. [eg. see Agrawal & Iyer (1995) *Curr Opin Biotechnol* 6:12-19; Agrawal (1996) *TIBTECH* 14:376-387]; analogues such as peptide nucleic acids may also be used [eg. see Corey (1997) *TIBTECH* 15:224-229; Buchardt et al. (1993) *TIBTECH* 11:384-386].

One example of a nucleotide hybridization assay is described by Urdea et al. in international patent application WO92/02526 [see also U.S. Pat. No. 5,124,246].

Alternatively, the polymerase chain reaction (PCR) is another well-known means for detecting small amounts of target nucleic acids. The assay is described in: Mullis et al. [*Meth. Enzymol.* (1987) 155: 335-350]; U.S. Pat. No. 4,683,195; and U.S. Pat. No. 4,683,202. Two "primer" nucleotides hybridize with the target nucleic acids and are used to prime the reaction. The primers can comprise sequence that does not hybridize to the sequence of the amplification target (or its complement) to aid with duplex stability or, for example, to incorporate a convenient restriction site. Typically, such sequence will flank the desired Neisserial sequence.

A thermostable polymerase creates copies of target nucleic acids from the primers using the original target nucleic acids as a template. After a threshold amount of target nucleic acids are generated by the polymerase, they can be detected by more traditional methods, such as Southern blots. When using the Southern blot method, the labelled probe will hybridize to the Neisserial sequence (or its complement).

Also, mRNA or cDNA can be detected by traditional blotting techniques described in Sambrook et al [supra]. mRNA, or cDNA generated from mRNA using a polymerase enzyme, can be purified and separated using gel electrophoresis. The nucleic acids on the gel are then blotted onto a solid support, such as nitrocellulose. The solid support is exposed to a labelled probe and then washed to remove any unhybridized probe. Next, the duplexes containing the labeled probe are detected. Typically, the probe is labelled with a radioactive moiety.

EXAMPLES

The examples describe nucleic acid sequences which have been identified in *N. meningitidis*, and *N. gonorrhoeae* along with their respective and putative translation products. Not all of the nucleic acid sequences are complete ie. they encode less than the full-length wild-type protein.

The examples are generally in the following format:

- a nucleotide sequence which has been identified in *N. meningitidis*
- the putative translation product of said *N. meningitidis* sequence
- a computer analysis of said translation product based on database comparisons
- a corresponding nucleotide sequence identified from *N. gonorrhoeae*
- the putative translation product of said *N. gonorrhoeae* sequence
- a comparison of the percentage of identity between the translation product of the *N. meningitidis* sequence and the *N. gonorrhoeae* sequence.
- a corresponding nucleotide sequence identified from strain A of *N. meningitidis*
- the putative translation product of said *N. meningitidis* strain A sequence
- a comparison of the percentage of identity between the translation product of the *N. meningitidis* sequence and the *N. gonorrhoeae* sequence.
- a description of the characteristics of the protein which indicates that it might be suitably antigenic or immunogenic.

Sequence comparisons were performed at NCBI (ncbi.nlm.nih.gov) using the algorithms BLAST, BLAST2, BLASTn, BLASTp, tBLASTn, BLASTx, & tBLASTx [eg. see also Altschul et al. (1997) Gapped BLAST and PSI-BLAST: a new generation of protein database search programs. *Nucleic Acids Research* 25:2289-3402]. Searches were performed against the following databases: non-redundant GenBank+EMBL+DDBJ+PDB sequences and non-redundant GenBank CDS translations+PDB+SwissProt+SP-update+PIR sequences.

Dots within nucleotide sequences represent nucleotides which have been arbitrarily introduced in order to maintain a reading frame. In the same way, double-underlined nucleotides were removed. Lower case letters represent ambiguities which arose during alignment of independent sequencing reactions (some of the nucleotide sequences in the examples are derived from combining the results of two or more experiments).

Nucleotide sequences were scanned in all six reading frames to predict the presence of hydrophobic domains using an algorithm based on the statistical studies of Esposti et al. [Critical evaluation of the hydropathy of membrane proteins (1990) *Eur J Biochem* 190:207-219]. These domains represent potential transmembrane regions or hydrophobic leader sequences.

Open reading frames were predicted from fragmented nucleotide sequences using the program ORFFINDER (NCBI).

Underlined amino acid sequences indicate possible transmembrane domains or leader sequences in the ORFs, as predicted by the PSORT algorithm (psort.nibb.ac.jp). Functional domains were also predicted using the MOTIFS program (GCG Wisconsin & PROSITE).

For each of the following examples: based on the presence of a putative leader sequence and/or several putative transmembrane domains (single-underlined) in the gonococcal protein, it is predicted that the proteins from *N. meningitidis* and *N. gonorrhoeae*, and their respective epitopes, could be useful antigens or immunogenic compositions for vaccines or diagnostics.

The standard techniques and procedures which may be employed in order to perform the invention (e.g. to utilize the disclosed sequences for vaccination or diagnostic purposes) were summarized above. This summary is not a limitation on the invention but, rather, gives examples that may be used, but are not required.

In particular, the following methods were used to express, purify and biochemically characterize the proteins of the invention.

Chromosomal DNA Preparation

*N. meningitidis* strain 2996 was grown to exponential phase in 100 ml of GC medium, harvested by centrifugation, and resuspended in 5 ml buffer (20% Sucrose, 50 mM Tris-HCl, 50 mM EDTA, pH 8). After 10 minutes incubation on ice, the bacteria were lysed by adding 10 ml lysis solution (50 mM NaCl, 1% Na-SARKOSYL™, 50 μg/ml Proteinase K), and the suspension was incubated at 37° C. for 2 hours. Two phenol extractions (equilibrated to pH 8) and one $ChCl_3$/isoamylalcohol (24:1) extraction were performed. DNA was precipitated by addition of 0.3M sodium acetate and 2 volumes ethanol, and was collected by centrifugation. The pellet was washed once with 70% (v/v) ethanol and redissolved in 4.0 ml TE buffer (10 mM Tris-HCl, 1 mM EDTA, pH 8.0). The DNA concentration was measured by reading the OD at 260 nm.

Oligonucleotide Design

Synthetic oligonucleotide primers were designed on the basis of the coding sequence of each ORF, using (a) the meningococcus B sequence when available, or (b) the gonococcus/meningococcus A sequence, adapted to the codon preference usage of meningococcus as necessary. Any predicted signal peptides were omitted, by designing the 5' primers to sequence immediately downstream from the predicted leader sequence.

For most ORFs, the 5' primers included two restriction enzyme recognition sites (BamHI-NdeI, BamHI-NheI, EcoRI-NdeI or EcoRI-NheI), depending on the restriction pattern of the gene of interest. The 3' primers included a XhoI or a HindIII restriction site (table 1). This procedure was established in order to direct the cloning of each amplification product (corresponding to each ORF) into two different expression systems: pGEX-KG (using BamHI-XhoI, BamHI-HindIII, EcoRI-XhoI or EcoRI-HindIII), and pET21b+ (using NdeI-XhoI, NheI-XhoI, NdeI-HindIII or NheI-HindIII).

```
5'-end primer tail:   CGCGGATCCCATATG  (BamHI-NdeI)
                      CGCGGATCCGCTAGC  (BamHI-NheI)
                      CCGGAATTCTA      (EcoRI-NdeI)
                      CATATG
                      CCGGAATTCTA      (EcoRI-NheI)
                      GCTAGC
3'-end primer tail    CCCGCTCGAG       (XhoI)
                      CCCGCTCGAG       (HindIII)
```

For cloning ORFs into the pGEX-His vector, the 5' and 3' primers contained only one restriction enzyme site (EcoRI, KpnI or SalI for the 5' primers and PstI, XbaI, SphI or SalI for the 3' primers). Again restriction sites were chosen according to the particular restriction pattern of the gene (table 1).

```
5'-end primer tail:         (AAA)AAAGAATTC (EcoRI)
                            (AAA)AAAGGTACC (KpnI)
3'-end primer tail:         (AAA)AAACTGCAG (PstI)
                            (AAA)AAATCTAGA (XbaI)
                            AAAGCATGC      (SphI)
5' or 3'-end primer tail:   AAAkAAGTCGAC   (SalI)
```

As well as containing the restriction enzyme recognition sequences, the primers included nucleotides which hybridized to the sequence to be amplified. The melting temperature depended on the number and type of hybridising nucleotides in the whole primer, and was determined for each primer using the formulae:

$$T_m=4(G+C)+2(A+T) \text{ (tail excluded)}$$

$$T_m=64.9+0.41(\%GC)-600/N \text{ (whole primer)}$$

The melting temperatures of the selected oligonucleotides were usually 65-70° C. for the whole oligo and 50-55° C. for the hybridising region alone.

Table 1 shows the forward and reverse primers used for each amplification. In certain cases, the sequence of the primer does not exactly match the sequence of the predicted ORF. This is because when initial amplifications were performed, the complete 5' and/or 3' sequences for some meningococcal B ORFs were not known. However the corresponding sequences had been identified in Gonococcus or in Meningoccus A. Hence, when the Meningoccus B sequence was incomplete or uncertain, Gonococcal or Meningococcal A sequences were used as the basis for primer design. These sequences were altered to take account of codon preference. It can be appreciated that, once the complete sequence is identified, this approach will no longer be necessary.

Oligos were synthesized using a Perkin Elmer 394 DNA/RNA SYNTHESIZER™, eluted from the columns in 2.0 ml $NH_4OH$, and deprotected by 5 hours incubation at 56° C. The oligos were precipitated by addition of 0.3M Na-Acetate and 2 volumes ethanol. The samples were centrifuged and the pellets resuspended in either 100 μl or 1.0 ml of water. The $OD_{260}$ was determined using a Perkin Elmer LAMBDA BIO™ spectophotometer and the concentration adjusted to 2-10 pmol/μl.

Amplification

The standard PCR protocol was as follows: 50-200 ng of genomic DNA was used as a template in the presence of 20-40 μM of each oligonucleotide primer, 400-800 μM dNTPs solution, 1×PCR buffer (including 1.5 mM $MgCl_2$), 2.5 units TaqI DNA polymerase (using Perkin-Elmer AMPLITAQ™, GIBCO Platinum, Pwo DNA polymerase, or Tahara Shuzo Taq polymerase). In some cases, PCR was optimised by the addition of 10 μl of DMSO or 50 μl of 2M Betaine.

After a hot start (adding the polymerase during a preliminary 3 minute incubation of the whole mix at 95° C.), each sample underwent a two-step amplification. The first 5 cycles were performed using the hybridization temperature that excluded the restriction enzyme tail of the primer (see above). This was followed by 30 cycles using the hybridization temperature calculated for the whole length oligos. The cycles were completed with a 10 minute extension step at 72° C. The standard cycles were as follows:

| | Denaturation | Hybridisation | Elongation |
|---|---|---|---|
| First 5 cycles | 30 seconds<br>95° C. | 30 seconds<br>50-55° C. | 30-60 seconds<br>72° C. |
| Last 30 cycles | 30 seconds<br>95° C. | 30 seconds<br>65-70° C. | 30-60 seconds<br>72° C. |

Elongation times varied according to the length of the ORF to be amplified. Amplifications were performed using either a 9600 or a 2400 Perkin Elmer GeneAmp PCR System. To check the results, 1/10 of the amplification volume was loaded onto a 1-1.5% (w/v) agarose gel and the size of each amplified fragment compared with a DNA molecular weight marker.

The amplified DNA was either loaded directly on a 1% agarose gel or first precipitated with ethanol and resuspended in a volume suitable to be loaded on a 1.0% agarose gel. The DNA fragment corresponding to the band of correct size was purified using the Qiagen Gel Extraction Kit, following the manufacturer's protocol. DNA fragments were eluted in a volume of 30 μl or 50 μl with either H2O or 10 mM Tris, pH 8.5.

Digestion of PCR Fragments

The purified DNA corresponding to the amplified fragment was doubly-digested with the appropriate restriction enzymes for; cloning into pET-21b+ and expressing the protein as a C-terminus His-tagged fusion, for cloning into pGEX-KG and expressing the protein as a N-terminus GST-fusion, and for cloning into pGEX-His and expressing the protein as a N-terminus GST-His tagged fusion.

Each purified DNA fragment was incubated at 37° C. for 3 hours to overnight with 20 units of appropriate restriction enzyme (New England Biolabs) in a volume of either 30 or 40 μl in the presence of suitable digestion buffer. Digested fragments were purified using the QIAquick PCR purification kit (following the manufacturer's instructions) and eluted in a volume of 30 μl or 50 μl with either H2O or 10 mM Tris, pH 8.5. The DNA concentration was determined by quantitative agarose gel electrophoresis (1.0% gel) in the presence of a titrated molecular weight marker.

Digestion of the Cloning Vectors (pET22B, pGEX-KG, pTRC-His A, pET21b+, pGEX-KG, and pGEX-His)

The vector pGEX-His is a modified pGEX-2T vector carrying a region encoding six histidine residues upstream of the thrombin cleavage site and containing the multiple cloning site of the vector pTRC99 (Pharmacia). 10 μg plasmid was double-digested with 50 units of each restriction enzyme in 200 μl reaction volume in the presence of appropriate buffer by overnight incubation at 37° C. After loading the whole digestion on a 1% agarose gel, the band corresponding to the digested vector was purified from the gel using the Qiagen QIAquick Gel Extraction Kit and the DNA was eluted in 50 μl of 10 mM Tris-HCl, pH 8.5. The DNA concentration was evaluated by measuring $OD_{260}$ of the sample, and adjusted to 50 μg/μl. 1 μl of plasmid was used for each cloning procedure.

10 μg of plasmid vector was doubly-digested with 50 units of each restriction enzyme in a volume of 200 μl with the appropriate buffer overnight at 37° C. The digest was loaded onto a 1.0% agarose gel and the band corresponding to the digested vector purified using the Qiagen QIAquick Gel Extraction Kit. DNA was eluted in 50 μl of 10 mM Tris-HCl, pH 8.5. The DNA concentration was evaluated by measuring $OD_{260nm}$ on and the concentration adjusted to 50 μg/μl. 1 μl of plasmid was used for each cloning procedure.

Cloning

For some ORFs, the fragments corresponding to each ORF, previously digested and purified, were ligated in both pET22b and pGEX-KG. In a final volume of 20 μl, a molar ratio of 3:1 fragment/vector was ligated using 0.5 μl of NEB T4 DNA ligase (400 units/μl), in the presence of the buffer supplied by the manufacturer. The reaction was incubated at room temperature for 3 hours. In some experiments, ligation was performed using the Boheringer "Rapid Ligation Kit", following the manufacturer's instructions.

In order to introduce the recombinant plasmid in a suitable strain, 100 μl *E. coli* DH5 competent cells were incubated with the ligase reaction solution for 40 minutes on ice, then at 37° C. for 3 minutes, then, after adding 800 μl LB broth, again at 37° C. for 20 minutes. The cells were then centrifuged at maximum speed in an Eppendorf microfuge and resuspended in approximately 200 μl of the supernatant. The suspension was then plated on LB ampicillin (100 mg/ml).

The screening of the recombinant clones was performed by growing 5 randomly-chosen colonies overnight at 37° C. in either 2 ml (pGEX or pTC clones) or 5 ml (pET clones) LB broth+100 μg/ml ampicillin. The cells were then pelletted and the DNA extracted using the Qiagen QIAprep Spin Miniprep Kit, following the manufacturer's instructions, to a final volume of 30 μl. 5 μl of each individual miniprep (approximately 1 g) were digested with either NdeI/XhoI or BamHI/XhoI and the whole digestion loaded onto a 1-1.5% agarose gel (depending on the expected insert size), in parallel with the molecular weight marker (1 Kb DNA Ladder, GIBCO). The screening of the positive clones was made on the base of the correct insert size.

For other ORFs, the fragments corresponding to each ORF, previously digested and purified, were ligated into both pET21b+ and pGEX-KG. A molar ratio of 3:1 fragment/vector was used in a final volume of 20 μl, that included 0.5 μl T4 DNA ligase (400 units/μl, NEB) and ligation buffer supplied by the manufacturer. The reaction was performed at room temperature for 3 hours. In some experiments, ligation was performed using the Boheringer "Rapid Ligation Kit" and the manufacturer's protocol.

Recombinant plasmid was transformed into 100 of competent *E. coli* DH5 or HB101 by incubating the ligase reaction solution and bacteria for 40 minutes on ice then at 37° C. for 3 minutes. This was followed by the addition of 800 μl LB broth and incubation at 37° C. for 20 minutes. The cells were centrifuged at maximum speed in an Eppendorf microfuge, resuspended in approximately 200 μl of the supernatant and plated onto LB ampicillin (100 mg/ml) agar.

Screening for recombinant clones was performed by growing 5 randomly selected colonies overnight at 37° C. in either 2.0 ml (pGEX-KG clones) or 5.0 ml (pET clones) LB broth+100 μg/ml ampicillin. Cells were pelleted and plasmid DNA extracted using the Qiagen QIAprep Spin Miniprep Kit, following the manufacturer's instructions. Approximately 1 μg of each individual miniprep was digested with the appropriate restriction enzymes and the digest loaded onto a 1-1.5% agarose gel (depending on the expected insert size), in parallel with the molecular weight marker (1 kb DNA Ladder, GIBCO). Positive clones were selected on the basis of the size of insert.

ORFs were cloned into PGEX-His, by doubly-digesting the PCR product and ligating into similarly digested vector. After cloning, recombinant plasmids were transformed into the *E. coli* host W3110. Individual clones were grown overnight at 37° C. in LB broth with 50 μg/ml ampicillin.

Certain ORFs may be cloned into the pGEX-HIS vector using EcoRI-PstI cloning sites, or EcoRI-SalI, or SalI-PstI. After cloning, the recombinant plasmids may be introduced in the *E. coli* host W3110.

Expression

Each ORF cloned into the expression vector may then be transformed into the strain suitable for expression of the recombinant protein product. 1 μl of each construct was used to transform 301 of *E. coli* BL21 (pGEX vector), *E. coli* TOP 10 (pTRC vector) or *E. coli* BL21-DE3 (pET vector), as described above. In the case of the pGEX-His vector, the same *E. coli* strain (W3110) was used for initial cloning and expression. Single recombinant colonies were inoculated into 2 ml LB+Amp (100 μg/ml), incubated at 37° C. overnight, then diluted 1:30 in 20 ml of LB+Amp (100 μg/ml) in 100 ml flasks, making sure that the $OD_{600}$ ranged between 0.1 and 0.15. The flasks were incubated at 30° C. into gyratory water bath shakers until OD indicated exponential growth suitable for induction of expression (0.4-0.8 OD for pET and pTRC vectors; 0.8-1 OD for pGEX and pGEX-His vectors). For the pET, pTRC and pGEX-His vectors, the protein expression was induced by addiction of 1 mM IPTG, whereas in the case of pGEX system the final concentration of IPTG was 0.2 mM. After 3 hours incubation at 30° C., the final concentration of the sample was checked by OD. In order to check expression, 1 ml of each sample was removed, centrifuged in a microfuge, the pellet resuspended in PBS, and analysed by 12% SDS-PAGE with Coomassie Blue staining. The whole sample was centrifuged at 6000 g and the pellet resuspended in PBS for further use.

GST-Fusion Proteins Large-Scale Purification.

For some ORFs, a single colony was grown overnight at 37° C. on LB+Amp agar plate. The bacteria were inoculated into 20 ml of LB+Amp liquid culture in a water bath shaker and grown overnight. Bacteria were diluted 1:30 into 600 ml of fresh medium and allowed to grow at the optimal temperature (20-37° C.) to $OD_{550}$ 0.8-1. Protein expression was induced with 0.2 mM IPTG followed by three hours incubation. The culture was centrifuged at 8000 rpm at 4° C. The supernatant was discarded and the bacterial pellet was resuspended in 7.5 ml cold PBS. The cells were disrupted by sonication on ice for 30 sec at 40 W using a Branson sonifier B-15, frozen and thawed two times and centrifuged again. The supernatant was collected and mixed with 150 μl GLUTATHIONE-SEPHAROSE 4B™ resin (Pharmacia) (previously washed with PBS) and incubated at room temperature for 30 minutes. The sample was centrifuged at 700 g for 5 minutes at 4 C. The resin was washed twice with 10 ml cold PBS for 10 minutes, resuspended in 1 ml cold PBS, and loaded on a disposable column. The resin was washed twice with 2 ml cold PBS until the flow-through reached $OD_{280}$ of 0.02-0.06. The GST-fusion protein was eluted by addition of 700 μl cold Glutathione elution buffer (10 mM reduced glutathione, 50 mM Tris-HCl) and fractions collected until the $OD_{280}$ was 0.1. 21 μl of each fraction were loaded on a 12% SDS gel using either Biorad SDS-PAGE Molecular weight standard broad range (M1) (200, 116.25, 97.4, 66.2, 45, 31, 21.5, 14.4, 6.5 kDa) or Amersham Rainbow Marker (M") (220, 66, 46, 30, 21.5, 14.3 kDa) as standards. As the MW of GST is 26 kDa, this value must be added to the MW of each GST-fusion protein.

For other ORFs, for each clone to be purified as a GST-fusion, a single colony was streaked out and grown overnight at 37° C. on a LB/Amp. (100 μg/ml) agar plate. An isolated colony from this plate was inoculated into 20 ml of LB/Amp (100 μg/ml) liquid medium and grown overnight at 37° C. with shaking. The overnight culture was diluted 1:30 into 600 ml LB/Amp (100 μg/ml) liquid medium and allowed to grow at the optimal temperature (20-37° C.) until the $OD_{550nm}$ reached 0.6-0.8. Recombinant protein expression was induced by addition of IPTG (final concentration 0.2 mM) and the culture incubated for a further 3 hours. Bacteria were harvested by centrifugation at 8000×g for 15 min at 4° C.

The bacterial pellet was resuspended in 7.5 ml cold PBS. Cells were disrupted by sonication on ice for 30 sec at 40 W using a Branson sonifier 450 and centrifuged at 13 000×g for 30 min at 4° C. The supernatant was collected and mixed with 150 μl GLUTATHIONE-SEPHAROSE 4B™ resin (Pharmacia), previously equilibrated with PBS, and incubated at room temperature with gentle agitation for 30 min. The batch-wise preparation was centrifuged at 700×g for 5 min at 4° C. and the supernatant discarded. The resin was washed twice (batchwise) with 10 ml cold PBS for 10 min, resuspended in 1 ml cold PBS, and loaded onto a disposable column. The resin continued to be washed twice with cold PBS, until the $OD_{280}$ nm of the flow-through reached 0.02-0.01. The GST-fusion protein was eluted by addition of 700 μl cold glutathione elution buffer (10 mM reduced glutathione, 50 mM Tris-HCl pH 8.0) and fractions collected, until the $OD_{280}$ nm of the eluate indicated all the recombinant protein was obtained. 20 μl aliquots of each elution fraction were analyzed by SDS-PAGE using a 12% gel. The molecular mass of the purified proteins was determined using either the Bio-Rad broad range molecular weight standard (M1) (200, 116, 97.4, 66.2, 45.0, 31.0, 21.5, 14.4, 6.5 kDa) or the Amersham Rainbow Marker (M2) (220, 66.2, 46.0, 30.0, 21.5, 14.3 kDa). The molecular weights of GST-fusion proteins are a combination of the 26 kDa GST protein and its fusion partner. Protein concentrations were estimated using the Bradford assay.

His-Fusion Soluble Proteins Large-Scale Purification.

For some ORFs, a single colony was grown overnight at 37° C. on a LB+Amp agar plate. The bacteria were inoculated into 20 ml of LB+Amp liquid culture and incubated overnight in a water bath shaker. Bacteria were diluted 1:30 into 600 ml fresh medium and allowed to grow at the optimal temperature (20-37° C.) to $OD_{550}$ 0.6-0.8. Protein expression was induced by addition of 1 mM IPTG and the culture further incubated for three hours. The culture was centrifuged at 8000 rpm at 4° C., the supernatant was discarded and the bacterial pellet was resuspended in 7.5 ml cold 10 mM imidazole buffer (300 mM NaCl, 50 mM phosphate buffer, 10 mM imidazole, pH 8). The cells were disrupted by sonication on ice for 30 sec at 40 W using a Branson sonifier B-15, frozen and thawed two times and centrifuged again. The supernatant was collected and mixed with 150 μl $Ni^{2+}$-resin (Pharmacia) (previously washed with 10 mM imidazole buffer) and incubated at room temperature with gentle agitation for 30 minutes. The sample was centrifuged at 700 g for 5 minutes at 4° C. The resin was washed twice with 10 ml cold 10 mM imidazole buffer for 10 minutes, resuspended in 1 ml cold 10 mM imidazole buffer and loaded on a disposable column. The resin was washed at 4° C. with 2 ml cold 10 mM imidazole buffer until the flow-through reached the $O.D_{280}$ of 0.02-0.06. The resin was washed with 2 ml cold 20 mM imidazole buffer (300 mM NaCl, 50 mM phosphate buffer, 20 mM imidazole, pH 8) until the flow-through reached the $O.D_{280}$ of 0.02-0.06. The His-fusion protein was eluted by addition of 700 μl cold 250 mM imidazole buffer (300 mM NaCl, 50 mM phosphate buffer, 250 mM imidazole, pH 8) and fractions collected until the $O.D_{280}$ was 0.1. 21 μl of each fraction were loaded on a 12% SDS gel.

His-Fusion Insoluble Proteins Large-Scale Purification.

A single colony was grown overnight at 37° C. on a LB+Amp agar plate. The bacteria were inoculated into 20 ml of LB+Amp liquid culture in a water bath shaker and grown overnight. Bacteria were diluted 1:30 into 600 ml fresh medium and let to grow at the optimal temperature (37° C.) to $O.D_{550}$ 0.6-0.8. Protein expression was induced by addition of 1 mM IPTG and the culture further incubated for three hours. The culture was centrifuged at 8000 rpm at 4° C. The supernatant was discarded and the bacterial pellet was resuspended in 7.5 ml buffer B (urea 8M, 10 mM Tris-HCl, 100 mM phosphate buffer, pH 8.8). The cells were disrupted by sonication on ice for 30 sec at 40 W using a Branson sonifier B-15, frozen and thawed twice and centrifuged again. The supernatant was stored at −20° C., while the pellets were resuspended in 2 ml guanidine buffer (6M guanidine hydrochloride, 100 mM phosphate buffer, 10 mM Tris-HCl, pH 7.5) and treated in a homogenizer for 10 cycles. The product was centrifuged at 13000 rpm for 40 minutes. The supernatant was mixed with 150 μl $Ni^{2+}$-resin (Pharmacia) (previously washed with buffer B) and incubated at room temperature with gentle agitation for 30 minutes. The sample was centrifuged at 700 g for 5 minutes at 4° C. The resin was washed twice with 10 ml buffer B for 10 minutes, resuspended in 1 ml buffer B, and loaded on a disposable column. The resin was washed at room temperature with 2 ml buffer B until the flow-through reached the $OD_{280}$ of 0.02-0.06. The resin was washed with 2 ml buffer C (urea 8M, 10 mM Tris-HCl, 100 mM phosphate buffer, pH 6.3) until the flow-through reached the $O.D_{280}$ of 0.02-0.06. The His-fusion protein was eluted by addition of 700 μl elution buffer (urea 8M, 10 mM Tris-HCl, 100 mM phosphate buffer, pH 4.5) and fractions collected until the $OD_{280}$ was 0.1. 21 μl of each fraction were loaded on a 12% SDS gel.

Purification of His-Fusion Proteins.

For each clone to be purified as a His-fusion, a single colony was streaked out and grown overnight at 37° C. on a LB/Amp (100 μg/ml) agar plate. An isolated colony from this plate was inoculated into 20 ml of LB/Amp (100 μg/ml) liquid medium and grown overnight at 37° C. with shaking. The overnight culture was diluted 1:30 into 600 ml LB/Amp (100 μg/ml) liquid medium and allowed to grow at the optimal temperature (20-37° C.) until the $OD_{550}$ nm reached 0.6-0.8. Expression of recombinant protein was induced by addition of IPTG (final concentration 1.0 mM) and the culture incubated for a further 3 hours. Bacteria were harvested by centrifugation at 8000×g for 15 min at 4° C.

The bacterial pellet was resuspended in 7.5 ml of either (i) cold buffer A (300 mM NaCl, 50 mM phosphate buffer, 10 mM imidazole, pH 8.0) for soluble proteins or (ii) buffer B (8M urea, 10 mM Tris-HCl, 100 mM phosphate buffer, pH 8.8) for insoluble proteins. Cells were disrupted by sonication on ice four times for 30 sec at 40 W using a Branson sonifier 450 and centrifuged at 13 000×g for 30 min at 4° C. For insoluble proteins, pellets were resuspended in 2.0 ml buffer C (6M guanidine hydrochloride, 100 mM phosphate buffer, 10 mM Tris-HCl, pH 7.5) and treated with a Dounce homogenizer for 10 cycles. The homogenate was centrifuged at 13 000×g for 40 min and the supernatant retained.

Supernatants for both soluble and insoluble preparations were mixed with 150 μl $Ni^{2+}$-resin (previously equilibrated with either buffer A or buffer B, as appropriate) and incubated at room temperature with gentle agitation for 30 min. The resin was CHELATING SEPHAROSE FAST FLOW™ (Pharmacia), prepared according to the manufacturers protocol. The batch-wise preparation was centrifuged at 700×g for 5 min at 4° C. and the supernatant discarded. The resin was washed twice (batch-wise) with 10 ml buffer A or B for 10 min, resuspended in 1.0 ml buffer A or B and loaded onto a disposable column. The resin continued to be washed with either (i) buffer A at 4° C. or (ii) buffer B at room temperature, the $OD_{280nm}$ of the flow-through reached 0.02-0.01. The resin was further washed with either (i) cold buffer C (300 mM NaCl, 50 mM phosphate buffer, 20 mM imidazole, pH 8.0) or (ii) buffer D (8M urea, 10 mM Tris-HCl, 100 mM phosphate buffer, pH 6.3) until the $OD_{280}$ nm of the flow-through reached 0.02-0.01. The His-fusion protein was eluted by addition of 700 μl of either (1) cold elution buffer A (300 mM NaCl, 50 mM phosphate buffer, 250 mM imidazole, pH 8.0) or (ii) elution buffer B (8 M urea, 10 mM Tris-HCl, 100 mM phosphate buffer, pH 4.5) and fractions collected until the $O.D_{280}$ nm indicated all the recombinant protein was obtained. 20 μl aliquots of each elution fraction were analyzed by SDS-PAGE using a 12% gel. Protein concentrations were estimated using the Bradford assay.

His-Fusion Proteins Renaturation

In the cases where denaturation was required to solubilize proteins, a renaturation step was employed prior to immunization. Glycerol was added to the denatured fractions obtained above to give a final concentration of 10% (v/v). The proteins were diluted to 200 μg/ml using dialysis buffer I (10% (v/v) glycerol, 0.5M arginine, 50 mM phosphate buffer, 5.0 mM reduced glutathione, 0.5 mM oxidised glutathione, 2.0M urea, pH 8.8) and dialysed against the same buffer for 12-14 hours at 4° C. Further dialysis was performed with buffer II (10% (v/v) glycerol, 0.5M arginine, 50 mM phosphate buffer, 5.0 mM reduced glutathione, 0.5 mM oxidised glutathione, pH 8.8) for 12-14 hours at 4° C.

Alternatively, 10% glycerol was added to the denatured proteins. The proteins were then diluted to 20 μg/ml using dialysis buffer I (10% glycerol, 0.5M arginine, 50 mM phosphate buffer, 5 mM reduced glutathione, 0.5 mM oxidised glutathione, 2M urea, pH 8.8) and dialysed against the same buffer at 4° C. for 12-14 hours. The protein was further dialysed against dialysis buffer II (10% glycerol, 0.5M arginine, 50 mM phosphate buffer, 5 mM reduced glutathione, 0.5 mM oxidised glutathione, pH 8.8) for 12-14 hours at 4° C.

Protein concentration was evaluated using the formula:

$$\text{Protein(mg/ml)}=(1.55\times OD_{280})-(0.76\times OD_{260})$$

Purification of Proteins

To analyse the solubility, pellets obtained from 3.0 ml cultures were resuspended in 500 μl buffer M1 (PBS pH 7.2). 25 μl of lysozyme (10 mg/ml) was added and the bacteria incubated for 15 min at 4° C. Cells were disrupted by sonication on ice four times for 30 sec at 40 W using a Branson sonifier 450 and centrifuged at 13 000×g for 30 min at 4° C. The supernatant was collected and the pellet resuspended in buffer M2 [8M urea, 0.5M NaCl, 20 mM imidazole and 0.1M $NaH_2$ $PO_4$] and incubated for 3 to 4 hours at 4° C. After centrifugation, the supernatant was collected and the pellet resuspended in buffer M3 [6M guanidinium-HCl, 0.5M NaCl, 20 mM imidazole and 0.1M $NaH_2PO_4$] overnight at 4° C. The supernatants from all steps were analysed by SDS-PAGE. Some proteins were found to be soluble in PBS, others need urea or guanidium-HCl for solubilization.

For preparative scale purifications, 500 ml cultures were induced and fusion proteins solubilized in either buffer M1, M2 or M3 using the procedure described above. Crude extracts were loaded onto a Ni-NTA superflow column (Quiagen) equilibrated with buffer M1, M2 or M3 depending on the solubilization buffer employed. Unbound material was eluted by washing the column with the same buffer. The recombinant fusion protein was eluted with the corresponding buffer containing 500 mM imidazole then dialysed against the same buffer in the absence of imidazole.

Mice Immunisations

20 μg of each purified protein are used to immunise mice intraperitoneally. In the case of some ORFs, Balb-C mice were immunised with $Al(OH)_3$ as adjuvant on days 1, 21 and 42, and immune response was monitored in samples taken on day 56. For other ORFs, CD1 mice could be immunised using the same protocol. For ORFs 25 and 40, CD1 mice were immunised using Freund's adjuvant, and the same immunisation protocol was used, except that the immune response was measured on day 42, rather than 56. Similarly, for still other ORFs, CD1 mice were immunised with Freund's adjuvant, but the immune response was measured on day 49. Alternatively, 20 μg of each purified protein was mixed with Freund's adjuvant and used to immunise CD1 mice intraperitoneally. For many of the proteins, the immunization was performed on days 1, 21 and 35, and immune response was monitored in samples taken on days 34 and 49. For some proteins, the third immunization was performed on day 28, rather than 35, and the immune response was measured on days 20 and 42, rather than 34 and 49.

ELISA Assay (Sera Analysis)

The acapsulated MenB M7 strain was plated on chocolate agar plates and incubated overnight at 37° C. Bacterial colonies were collected from the agar plates using a sterile dracon swab and inoculated into 7 ml of Mueller-Hinton Broth (Difco) containing 0.25% Glucose. Bacterial growth was monitored every 30 minutes by following $OD_{620}$. The bacteria were let to grow until the OD reached the value of 0.3-0.4. The culture was centrifuged for 10 minutes at 10000 rpm. The supernatant was discarded and bacteria were washed once with PBS, resuspended in PBS containing 0.025% formaldehyde, and incubated for 2 hours at room temperature and then overnight at 4° C. with stirring. 100 μl bacterial cells were added to each well of a 96 well Greiner plate and incubated overnight at 4° C. The wells were then washed three times with PBT washing buffer (0.1% TWEEN-20™ in PBS). 200

μl of saturation buffer (2.7% Polyvinylpyrrolidone 10 in water) was added to each well and the plates incubated for 2 hours at 37° C. Wells were washed three times with PBT. 200 μl of diluted sera (Dilution buffer: 1% BSA, 0.1% TWEEN-20™, 0.1% $NaN_3$ in PBS) were added to each well and the plates incubated for 90 minutes at 37° C. Wells were washed three times with PBT. 100 μl of HRP-conjugated rabbit anti-mouse (Dako) serum diluted 1:2000 in dilution buffer were added to each well and the plates were incubated for 90 minutes at 37° C. Wells were washed three times with PBT buffer. 100 μl of substrate buffer for HRP (25 ml of citrate buffer pH5, 10 mg of O-phenildiamine and 10 μl of H2O) were added to each well and the plates were left at room temperature for 20 minutes. 100 μl $H_2SO_4$ was added to each well and $OD_{490}$ was followed. The ELISA was considered positive when OD490 was 2.5 times the respective pre-immune sera.

Alternatively, The acapsulated MenB M7 strain was plated on chocolate agar plates and incubated overnight at 37° C. Bacterial colonies were collected from the agar plates using a sterile dracon swab and inoculated into Mueller-Hinton Broth (Difco) containing 0.25% Glucose. Bacterial growth was monitored every 30 minutes by following $OD_{620}$. The bacteria were let to grow until the OD reached the value of 0.3-0.4. The culture was centrifuged for 10 minutes at 10 000 rpm. The supernatant was discarded and bacteria were washed once with PBS, resuspended in PBS containing 0.025% formaldehyde, and incubated for 1 hour at 37° C. and then overnight at 4° C. with stirring. 100 μl bacterial cells were added to each well of a 96 well Greiner plate and incubated overnight at 4° C. The wells were then washed three times with PBT washing buffer (0.1% TWEEN-20™ in PBS). 200 μl of saturation buffer (2.7% Polyvinylpyrrolidone 10 in water) was added to each well and the plates incubated for 2 hours at 37° C. Wells were washed three times with PBT. 200 μl of diluted sera (Dilution buffer: 1% BSA, 0.1% TWEEN-20™, 0.1% $NaN_3$ in PBS) were added to each well and the plates incubated for 2 hours at 37° C. Wells were washed three times with PBT. 100 μl of HRP-conjugated rabbit anti-mouse (Dako) serum diluted 1:2000 in dilution buffer were added to each well and the plates were incubated for 90 minutes at 37° C. Wells were washed three times with PBT buffer. 100 μl of substrate buffer for HRP (25 ml of citrate buffer pH5, 10 mg of O-phenildiamine and 10 μl of $H_2O_2$) were added to each well and the plates were left at room temperature for 20 minutes. 100 μl $H_2SO_4$ was added to each well and $OD_{490}$ was followed. The ELISA titers were calculated arbitrarily as the dilution of sera which gave an $OD_{490}$ value of 0.4 above the level of preimmune sera. The ELISA was considered positive when the dilution of sera with $OD_{490}$ of 0.4 was higher than 1:400.

FACScan Bacteria Binding Assay Procedure.

The acapsulated MenB M7 strain was plated on chocolate agar plates and incubated overnight at 37° C. Bacterial colonies were collected from the agar plates using a sterile dracon swab and inoculated into 4 tubes containing 8 ml each Mueller-Hinton Broth (Difco) containing 0.25% glucose. Bacterial growth was monitored every 30 minutes by following $OD_{620}$. The bacteria were let to grow until the OD reached the value of 0.35-0.5. The culture was centrifuged for 10 minutes at 4000 rpm. The supernatant was discarded and the pellet was resuspended in blocking buffer (1% BSA in PBS, 0.4% $NaN_3$) and centrifuged for 5 minutes at 4000 rpm. Cells were resuspended in blocking buffer to reach $OD_{620}$ of 0.07. 100 μl bacterial cells were added to each well of a Costar 96 well plate. 100 μl of diluted (1:100, 1:200, 1:400) sera (in blocking buffer) were added to each well and plates incubated for 2 hours at 4° C. Cells were centrifuged for 5 minutes at 400 rpm, the supernatant aspirated and cells washed by addition of 200 μl/well of blocking buffer in each well. 100 μl of R-Phicoerytrin conjugated $F(ab)_2$ goat anti-mouse, diluted 1:100, was added to each well and plates incubated for 1 hour at 4° C. Cells were spun down by centrifugation at 400 rpm for 5 minutes and washed by addition of 200 μl/well of blocking buffer. The supernatant was aspirated and cells resuspended in 200 μl/well of PBS, 0.25% formaldehyde. Samples were transferred to FACScan tubes and read. The condition for FACScan (Laser Power 15 mW) setting were: FL2 on; FSC-H threshold: 92; FSC PMT Voltage: E 01; SSC PMT: 474; Amp. Gains 6.1; FL-2 PMT: 586; compensation values: 0.

OMV Preparations

Bacteria were grown overnight on 5 GC plates, harvested with a loop and resuspended in 10 ml 20 mM Tris-HCl. Heat inactivation was performed at 56° C. for 30 minutes and the bacteria disrupted by sonication for 10' on ice (50% duty cycle, 50% output). Unbroken cells were removed by centrifugation at 5000 g for 10 minutes and the total cell envelope fraction recovered by centrifugation at 50000 g at 4° C. for 75 minutes. To extract cytoplasmic membrane proteins from the crude outer membranes, the whole fraction was resuspended in 2% sarkosyl (Sigma) and incubated at room temperature for 20 minutes. The suspension was centrifuged at 10000 g for 10 minutes to remove aggregates, and the supernatant further ultracentrifuged at 50000 g for 75 minutes to pellet the outer membranes. The outer membranes were resuspended in 10 mM Tris-HCl, pH8 and the protein concentration measured by the Bio-Rad Protein assay, using BSA as a standard.

Whole Extracts Preparation

Bacteria were grown overnight on a GC plate, harvested with a loop and resuspended in 1 ml of 20 mM Tris-HCl. Heat inactivation was performed at 56° C. for 30' minutes.

Western Blotting

Purified proteins (500 ng/lane), outer membrane vesicles (5 μg) and total cell extracts (25 μg) derived from MenB strain 2996 were loaded onto a 12% SDS-polyacrylamide gel and transferred to a nitrocellulose membrane. The transfer was performed for 2 hours at 150 mA at 4° C., using transfer buffer (0.3% Tris base, 1.44% glycine, 20% (v/v) methanol). The membrane was saturated by overnight incubation at 4° C. in saturation buffer (10% skimmed milk, 0.1% TRITON X100™ in PBS). The membrane was washed twice with washing buffer (3% skimmed milk, 0.1% TRITON X100™ in PBS) and incubated for 2 hours at 37° C. with mice sera diluted 1:200 in washing buffer. The membrane was washed twice and incubated for 90 minutes with a 1:2000 dilution of horseradish peroxidase labeled anti-mouse Ig. The membrane was washed twice with 0.1% TRITON X100™ in PBS and developed with the OPTI-4CN SUBSTRATE KIT™ (Bio-Rad). The reaction was stopped by adding water.

Bactericidal Assay

MC58 and 2996 strains were grown overnight at 37° C. on chocolate agar plates. 5-7 colonies were collected and used to inoculate 7 ml Mueller-Hinton broth. The suspension was incubated at 37° C. on a nutator and let to grow until $OD_{620}$ was in between 0.5-0.8. The culture was aliquoted into sterile 1.5 ml Eppendorf tubes and centrifuged for 20 minutes at maximum speed in a microfuge. The pellet was washed once in Gey's buffer (Gibco) and resuspended in the same buffer to an $OD_{620}$ of 0.5, diluted 1:20000 in Gey's buffer and stored at 25° C.

50 μl of Gey's buffer/1% BSA was added to each well of a 96-well tissue culture plate. 25 μl of diluted (1:100) mice sera (dilution buffer: Gey's buffer/0.2% BSA) were added to each well and the plate incubated at 4° C. 25 μl of the previously described bacterial suspension were added to each well. 25 μl of either heat-inactivated (56° C. waterbath for 30 minutes) or normal baby rabbit complement were added to each well. Immediately after the addition of the baby rabbit complement, 22 μl of each sample/well were plated on Mueller-Hinton agar plates (time 0). The 96-well plate was incubated for 1 hour at 37° C. with rotation and then 22 μl of each sample/well were plated on Mueller-Hinton agar plates (time 1). After overnight incubation the colonies corresponding to time 0 and time 1 h were counted.

Gene Variability

The ORF4 and 919 genes were amplified by PCR on chromosomal DNA extracted from various *Neisseria* strains (see list of strains). The following oligonucleotides used as PCR primers were designed in the upstream and downstream regions of the genes:

```
orf 4.1 (forward)
CGAATCCGGACGGCAGGACTC              (SEQ ID NO: 3266)

orf 4.3 (reverse)
GGCAGGGAATGGCGGATTAAAG             (SEQ ID NO: 3267)

919.1 (forward)

AAAATGCCTCTCCACGGCTG or            (SEQ ID NO: 3268)

CTGCGCCCTGTGTTAAAATCCCCT           (SEQ ID NO: 3269)

919.6 (reverse)

CAAATAAGAAAGGAATTTTG or            (SEQ ID NO: 3270)

GGTATCGCAAAACTTCGCCTTAATGCG        (SEQ ID NO: 3271)
```

The PCR cycling conditions were:

| | |
|---|---|
| 1 cycle | 2 min. at 94° |
| 30 cycles | 30 sec. at 94° |
| | 30 sec. at ~54° or ~60° (in according to Tm of the primers) |
| | 40 sec. at 72° |
| 1 cycle | 7 min. at 72° |

The PCR products were purified from 1% agarose gel and sequenced using the following primers:

```
orf 4.1 (forward)
CGAATCCGGACGGCAGGACTC              (SEQ ID NO: 3272)
```

-continued

```
orf 4.2 (forward)
CGACCGCGCCTTTGGGACTG               (SEQ ID NO: 3273)

orf 4.3 (reverse)
GGCAGGGAATGGCGGATTAAAG             (SEQ ID NO: 3274)

orf 4.4 (reverse)
TCTTTGAGTTTGATCCAACC               (SEQ ID NO: 3275)

919.1 (forward)

AAAATGCCTCTCCACGGCTG or            (SEQ ID NO: 3276)

CTGCGCCCTGTGTTAAAATCCCCT           (SEQ ID NO: 3277)

919.2 (forward)
ATCCTTCCGCCTCGGCTGCG               (SEQ ID NO: 3278)

919.3 (forward)
AAAACAGCGGCACAATCGAC               (SEQ ID NO: 3279)

919.4 (forward)
ATAAGGGCTACCTCAAACTC               (SEQ ID NO: 3280)

919.5 (forward)
GCGCGTGGATTATTTTTGGG               (SEQ ID NO: 3281)

919.6 (reverse)

CAAATAAGAAAGGAATTTTG or            (SEQ ID NO: 3282)

GGTATCGCAAAACTTCGCCTTAATGCG        (SEQ ID NO: 3283)

919.7 (reverse)
CCCAAGGTAATGTAGTGCCG               (SEQ ID NO: 3284)

919.8 (reverse)
TAAAAAAAAGTTCGACAGGG               (SEQ ID NO: 3285)

919.9 (reverse)
CCGTCCGCCTGTCGTCGCCC               (SEQ ID NO: 3286)

919.10 (reverse)
TCGTTCCGGCGGGGTCGGGG               (SEQ ID NO: 3287)
```

All documents cited herein are incorporated by reference in their entireties.

The following Examples are presented to illustrate, not limit, the invention

Example 1

Using the above-described procedures, the following oligonucleotide primers were employed in the polymerase chain reaction (PCR) assay in order to clone the ORFs as indicated:

TABLE 1

Oligonucleotides used for PCR for Examples 2-10

| ORF | Primer | Sequence | Restriction sites |
|---|---|---|---|
| 279 | Forward | CGCGGATCCCATATG-TTGCCTGCAATCACGATT <SEQ ID 3021> | BamHI-Ndel |
| | Reverse | CCCGCTCGAG-TTTAGAAGCGGGCGGCAA <SEQ ID 3022> | XhoI |
| 519 | Forward | CGCGGATCCCATATG-TTCAAATCCTTTGTCGTCA <SEQ ID 3023> | BamHI-Ndel |
| | Reverse | CCCGCTCGAG-TTTGGCGGTTTTGCTGC <SEQ ID 3024> | XhoI |
| 576 | Forward | CGCGGATCCCATATG-GCCGCCCCCGCATCT <SEQ ID 3025> | BamHI-Ndel |

TABLE 1-continued

Oligonucleotides used for PCR for Examples 2-10

| ORF | Primer | Sequence | Restriction sites |
|---|---|---|---|
|  | Reverse | CCCG<u>CTCGAG</u>-ATTTACTTTTTTGATGTCGAC <SEQ ID 3026> | XhoI |
| 919 | Forward | CGC<u>GGATCCCATATG</u>-TGCCAAAGCAAGAGCATC <SEQ ID 3027> | BamHI-NdeI |
|  | Reverse | CCCG<u>CTCGAG</u>-CGGGCGGTATTCGGG <SEQ ID 3028> | XhoI |
| 121 | Forward | CGC<u>GGATCCCATATG</u>-GAAACACAGCTTTACAT <SEQ ID 3029> | BamHI-NdeI |
|  | Reverse | CCCG<u>CTCGAG</u>-ATAATAATATCCCGCGCCC <SEQ ID 3030> | XhoI |
| 128 | Forward | CGC<u>GGATCCCATATG</u>-ACTGACAACGCACT <SEQ ID 3031> | BamHI-NdeI |
|  | Reverse | CCCG<u>CTCGAG</u>-GACCGCGTTGTCGAAA <SEQ ID 3032> | XhoI |
| 206 | Forward | CGC<u>GGATCCCATATG</u>-AAACACCGCCAACCGA <SEQ ID 3033> | BamHI-NdeI |
|  | Reverse | CCCG<u>CTCGAG</u>-TTCTGTAAAAAAAGTATGTGC <SEQ ID 3034> | XhoI |
| 287 | Forward | CCG<u>GAATTCTAGCTAGC</u>-CTTTCAGCCTGCGGG <SEQ ID 3035> | EcoRI-NheI |
|  | Reverse | CCCG<u>CTCGAG</u>-ATCCTGCTCTTTTTTGCC <SEQ ID 3036> | XhoI |
| 406 | Forward | CGC<u>GGATCCCATATG</u>-TGCGGGACACTGACAG <SEQ ID 3037> | BamHI-NdeI |
|  | Reverse | CCCG<u>CTCGAG</u>-AGGTTGTCCTTGTCTATG <SEQ ID 3038> | XhoI |

Localization of the ORFs

The following DNA and amino acid sequences are identified by titles of the following form: [g, m, or a] [#].[seq or pep], where "g" means a sequence from N. gonorrhoeae, "m" means a sequence from N. meningitidis B, and "a" means a sequence from N. meningitidis A; "#" means the number of the sequence; "seq" means a DNA sequence, and "pep" means an amino acid sequence. For example, "g001.seq" refers to an N. gonorrhoeae DNA sequence, number 1. The presence of the suffix "-1" to these sequences indicates an additional sequence found for the same ORF, thus, data for an ORF having both an unsuffixed and a suffixed sequence designation applies to both such designated sequences. Further, open reading frames are identified as ORF #, where "#" means the number of the ORF, corresponding to the number of the sequence which encodes the ORF, and the ORF designations may be suffixed with ".ng" or ".a", indicating that the ORF corresponds to a N. gonorrhoeae sequence or a N. meningitidis A sequence, respectively. The word "partial" before a sequence indicates that the sequence may be a partial or a complete ORF. Computer analysis was performed for the comparisons that follow between "g", "m", and "a" peptide sequences; and therein the "pep" suffix is implied where not expressly stated. Further, in the event of a conflict between the text immediately preceding and describing which sequences are being compared, and the designated sequences being compared, the designated sequence controls and is the actual sequence being compared.

ORF: contig:

279 gnm4.seq

The following partial DNA sequence was identified in N. meningitidis <SEQ ID 3039>:

```
m279.seq

  1 ATAACGCGGA TTTGCGGCTG CTTGATTTCA ACGGTTTTCA GGGCTTCGGC

 51 AAGTTTGTCG GCGGCGGGTT TCATCAGGCT GCAATGGGAA GGTACGGACA

101 CGGGCAGCGG CAGGGCGCGT TTGGCACCGG CTTCTTTGGC GGCAGCCATG

151 GCGCGTCCGA CGGCGGCGGC GTTGCCTGCA ATCACGATTT GTCCGGGTGA

201 GTTGAAGTTG ACGGCTTCGA CCACTTCGCT TTGGGCGGCT TCGGCACAAA

251 TGGCTTTAAC CTGCTCATCT TCCAAGCCGA GAATCGCCGC CATTGCGCCC

301 ACGCCTTGCG GTACGGCGGA CTGCATCAGT TCGGCGCGCA GGCGCACGAG

351 TTTGACCGCG TCGGCAAAAT TCAATGCGCC GGCGGCAACG AGTGCGGTGT

401 ATTCGCCGAG GCTGTGTCCC GCAACGGCGG CAGGCGTTTT GCCGCCCGCT

451 TCTAAATAG
```

This corresponds to the amino acid sequence <SEQ ID 3040; ORF 279>:

m279.pep

```
  1 ITRICGCLIS TVFRASASLS AAGFIRLQWE GTDTGSGRAR LAPASLAAAM
 51 ARPTAAALPA ITICPGELKL TASTTSLWAA SAQMALTCSS SKPRIAAIAP
101 TPCGTADCIS SARRRTSLTA SAKFNAPAAT SAVYSPRLCP ATAAGVLPPA
151 SK*
```

The following partial DNA sequence was identified in *N. gonorrhoeae* <SEQ ID 3041>:

g279.seq

```
  1 atgacgcgga tttgcggctg cttgatttca acggttttga gtgtttcggc
 51 aagtttgtcg gcggcgggtt tcatcaggct gcaatgggaa ggaacggata
101 ccggcagcgg cagggcgcgt ttggctccgg cttctttggc ggcagccatg
151 gtgcgtccga cggcggcggc gttgcctgca atcacgactt gtccgggcga
201 gttgaagttg acggcttcga ccacttcgcc ctgtgcggat tcggcacaaa
251 tctgcctgac ctgttcatct tccaaaccca aaatggccgc cattgcgcct
301 acgccttgcg gtacggcgga ctgcatcagt tcggcgcgca ggcggacgag
351 tttgacggca tcggcaaaat ccaatgcttc ggcggcgaca agcgcggtgt
401 attcgccgag gctgtgtccg gcaacggcgg caggcgtttt gccgcccact
451 tccaaatag
```

This corresponds to the amino acid sequence <SEQ ID 3042; ORF 279.ng>:

g279.pep

```
  1 MTRICGCLIS TVLSVSASLS AAGFIRLQWE GTDTGSGRAR LAPASLAAAM
 51 VRPTAAALPA ITTCPGELKL TASTTSPCAD SAQICLTCSS SKPKMAAIAP
101 TPCGTADCIS SARRRTSLTA SAKSNASAAT SAVYSPRLCP ATAAGVLPPT
151 SK*
```

ORF 279 shows 89.5% identity over a 152 aa overlap with a predicted ORF (ORF 279.ng) from *N. gonorrhoeae*:

```
                    10        20        30        40        50        60
m279.pep    ITRICGCLISTVFRASASLSAAGFIRLQWEGTDTGSGRARLAPASLAAAMARPTAAALPA
            :||||||||||||: :|||||||||||||||||||||||||||||||||||:|||||||||
g279        MTRICGCLISTVLSVSASLSAAGFIRLQWEGTDTGSGRARLAPASLAAAMVRPTAAALPA
                    10        20        30        40        50        60

                    70        80        90       100       110       120
m279.pep    ITICPGELKLTASTTSLWAASAQMALTCSSSKPRIAAIAPTPCGTADCISSARRRTSLTA
            || |||||||||||||  | |||: ||||||||::|||||||||||||||||||||||||
g279        ITTCPGELKLTASTTSPCADSDQICLTCSSSKPKMAAIAPTPCGTADCISSARRRTSLTA
                    70        80        90       100       110       120

                   130       140       150
m279.pep    SAKFNAPAATSAVYSPRLCPATAAGVLPPASKX
            ||| || ||||||||||||||||||||||:|||
g279        SAKSNASAATSAVYSPRLCPATAAGVLPPTSKX
                   130       140       150
```

The following partial DNA sequence was identified in *N. meningitidis* <SEQ ID 3043>:

a279.seq

```
  1 ATGACNCNGA TTTGCGGCTC CTTGATTTCA ACGGTTTNNA GGGCTTCGGC
 51 GAGTTTGTCG GCGGCGGGTT TCATGAGGCT GCAATGGGAA GGTACNGACA
101 CNGGCAGCGG CAGGGCGCGT TTGGCGCCGG CTTCTTTGGC GGCAAGCATA
151 GCGCGCTCGA CGGCGGCGGC ATTGCCTGCA ATCACGACTT GTCCGGGCGA
201 GTTGAAGTTG ACGGCTTCAA CCACTTCATC CTGTGCGGAT TCGGCGCAAA
251 TTTGTTTTAC CTGTTCATCT TCCAAGCCGA GAATCGCCGC CATTGCGCCC
301 ACGCCTTGCG GTACGGCGGA CTGCATCAGT TCGGCGCGCA NGCGCACGAG
351 TTTGACCGCG TCGGCAAAAT CCAATGCGCC GGCGGCAACN AGTGCGGTGT
401 ATTCGCCGAN GCTGTGTCCG GCAACGGCGG CAGGCGTTTT GCCGCCCGCT
451 TCCGAATAG
```

This corresponds to the amino acid sequence <SEQ ID 3044; ORF 279.a>:

a279.pep

```
  1 MTXICGCLIS TVXRASASLS AAGFMRLQWE GTDTGSGRAR LAPASLAASI
 51 ARSTAAALPA ITTCPGELKL TASTTSSCAD SAQICFTCSS SKPRIAAIAP
101 TPCGTADCIS SARXRTSLTA SAKSNAPAAT SAVYSPXLCP ATAAGVLPPA
151 SE*
```

m279/a279 ORFs 279 and 279.a showed a 88.2% identity in 152 aa overlap

```
                   10        20        30        40        50        60
m279.pep  ITRICGCLISTVFRASASLSAAGFIRLQWEGTDTGSGRARLAPASLAAAMARPTAAALPA
          :| ||||||||| |||||||||||:|||||||||||||||||||||||::|| |||||||
a279      MTXICGCLISTVXRASASLSAAGFMRLQWEGTDTGSGRARLAPASLAASIARSTAAALPA
                   10        20        30        40        50        60

                   70        80        90       100       110       120
m279.pep  ITICPGELKLTASTTSLWAASAQMALTCSSSKPRIAAIAPTPCGTADCISSARRRTSLTA
          || |||||||||||||   | |||: :||||||||||||||||||||||||||| ||||||
a279      ITTCPGELKLTASTTSSCADSAQICFTCSSSKPRIAAIAPTPCGTADCISSARXRTSLTA
                   70        80        90       100       110       120

                  130       140       150
m279.pep  SAKFNAPAATSAVYSPRLCPATAAGVLPPASKX
          ||| |||||||||||| ||||||||||||||:|
a279      SAKSNAPAATSAVYSPXLCPATAAGVLPPASEX
                  130       140       150
```

519 and 519-1 gnm7.seq

The following partial DNA sequence was identified in *N. meningitidis* <SEQ ID 3045>:

m519.seq (partial)

```
  1 ..TCCGTTATCG GGCGTATGGA GTTGGACAAA ACGTTTGAAG AACGCGACGA
 51 AATCAACAGT ACTGTTGTTG CGGCTTTGGA CGAGGCGGCC GGGgCTTgGG
101 GTGTGAAGGT TTTGCGTTAT GAGATTAAAG ACTTGGTTCC GCCGCAAGAA
```

-continued

```
151 ATCCTTCGCT CAATGCAGGC GCAAATTACT GCCGAACGCG AAAAACGCGC
201 CCGTATCGCC GAATCCGAAG GTCGTAAAAT CGAACAAATC AACCTTGCCA
251 GTGGTCAGCG CGAAGCCGAA ATCCAACAAT CCGAAGGCGA GGCTCAGGCT
301 GCGGTCAATG CGTCAAATGC CGAGAAAATC GCCCGCATCA ACCGCGCCAA
351 AGGTGAAGCG GAATCCTTGC GCCTTGTTGC CGAAGCCAAT GCCGAAGCCA
401 TCCGTCAAAT TGCCGCCGCC CTTCAAACCC AAGGCGGTGC GGATGCGGTC
451 AATCTGAAGA TTGCGGAACA ATACGTCGCT GCGTTCAACA ATCTTGCCAA
501 AGAAAGCAAT ACGCTGATTA TGCCCGCCAA TGTTGCCGAC ATCGGCAGCC
551 TGATTTCTGC CGGTATGAAA ATTATCGACA GCAGCAAAAC CGCCAAaTAA
```

This corresponds to the amino acid sequence <SEQ ID 3046; ORF 519>:

m519.pep (partial)

```
  1 ..SVIGRMELDK TFEERDEINS TVVAALDEAA GAWGVKVLRY EIKDLVPPQE
 51 ILRSMQAQIT AEREKRARIA ESEGRKIEQI NLASGQREAE IQQSEGEAQA
101 AVNASNAEKI ARINRAKGEA ESLRLVAEAN AEAIRQIAAA LQTQGGADAV
151 NLKIAEQYVA AFNNLAKESN TLIMPANVAD IGSLISAGMK IIDSSKTAK*
```

The following partial DNA sequence was identified in *N. gonorrhoeae* <SEQ ID 3047>:

g519.seq

```
  1 atggaatttt tcattatctt gttggcagcc gtcgccgttt tcggcttcaa
 51 atcctttgtc gtcatccccc agcaggaagt ccacgttgtc gaaaggctcg
101 ggcgtttcca tcgcgccctg acggccggtt tgaatatttt gattcccttt
151 atcgaccgcg tcgcctaccg ccattcgctg aaagaaatcc ctttagacgt
201 acccagccag gtctgcatca cgcgcgataa tacgcaattg actgttgacg
251 gcatcatcta tttccaagta accgatccca aactcgcctc atacggttcg
301 agcaactaca ttatggcaat tacccagctt gcccaaacga cgctgcgttc
351 cgttatcggg cgtatggagt tggacaaaac gtttgaagaa cgcgacgaaa
401 tcaacagtac cgtcgtctcc gccctcgatg aagccgccgg ggcttggggt
451 gtgaaagtcc tccgttacga aatcaaggat ttggttccgc cgcaagaaat
501 ccttcgcgca atgcaggcac aaattaccgc cgaacgcgaa aaacgcgccc
551 gtattgccga atccgaaggc cgtaaaatcg aacaaatcaa ccttgccagt
601 ggtcagcgtg aagccgaaat ccaacaatcc gaaggcgagg ctcaggctgc
651 ggtcaatgcg tccaatgccg agaaaatcgc ccgcatcaac cgcgccaaag
701 gcgaagcgga atccctgcgc cttgttgccg aagccaatgc cgaagccaac
751 cgtcaaattg ccgccgccct tcaaacccaa agcggggcgg atgcggtcaa
801 tctgaagatt gcgggacaat acgttaccgc gttcaaaaat cttgccaaag
851 aagacaatac gcggattaag cccgccaagg ttgccgaaat cgggaaccct
```

-continued

```
901 aattttcggc ggcatgaaaa attttcgcca gaagcaaaaa cggccaaata

951 a
```

This corresponds to the amino acid sequence <SEQ ID 3048; ORF 519.ng>:

g519.pep

```
  1 MEFFIILLAA VAVFGFKSFV VIPQQEVHVV ERLGRFHRAL TAGLNILIPF

 51 IDRVAYRHSL KEIPLDVPSQ VCITRDNTQL TVDGIIYFQV TDPKLASYGS

101 SNYIMAITQL AQTTLRSVIG RMELDKTFEE RDEINSTVVS ALDEAAGAWG

151 VKVLRYEIKD LVPPQEILRA MQAQITAERE KRARIAESEG RKIEQINLAS

201 GQREAEIQQS EGEAQAAVNA SNAEKIARIN RAKGEAESLR LVAEANAEAN

251 RQIAAALQTQ SGADAVNLKI AGQYVTAFKN LAKEDNTRIK PAKVAEIGNP

301 NFRRHEKFSP EAKTAK*
```

ORF 519 shows 87.5% identity over a 200 aa overlap with a predicted ORF (ORF 519.ng) from *N. gonorrhoeae*:

m519/g519

```
                                                 10        20        30
m519.pep                                 SVIGRMELDKTFEERDEINSTVVAALDEAA
                                         |||||||||||||||||||||||:||||||
g519       YFQVTDPKLASYGSSNYIMAITQLAQTTLRSVIGRMELDKTFEERDEINSTVVSALDEAA
             90       100       110       120       130       140

                   40        50        60        70        80        90
m519.pep   GAWGVKVLRYEIKDLVPPQEILRSMQAQITAEREKRARIAESEGRKIEQINLASGQREAE
           |||||||||||||||||||||||:||||||||||||||||||||||||||||||||||||
g519       GAWGVKVLRYEIKDLVPPQEILRAMQAQITAEREKRARIAESEGRKIEQINLASGQREAE
            150       160       170       180       190       200

                  100       110       120       130       140       150
m519.pep   IQQSEGEAQAAVNASNAEKIARINRAKGEAESLRLVAEANAEAIRQIAAALQTQGGADAV
           ||||||||||||||||||||||||||||||||||||||||||| ||||||||||:|||||
g519       IQQSEGEAQAAVNASNAEKIARINRAKGEAESLRLVAEANAEANRQIAAALQTQSGADAV
            210       220       230       240       250       260

                  160       170       180       190       200
m519.pep   NLKIAEQYVAAFNNLAKESNTLIMPANVADIGSL-ISAGMKIIDSSKTAK
           ||||| |||:||:|||||:|| | ||:||:||:  :    |:   :||||
g519       NLKIAGQYVTAFKNLAKEDNTRIKPAKVAEIGNPNFRRHEKFSPEAKTAK
            270       280       290       300       310
```

The following partial DNA sequence was identified in *N. meningitidis* <SEQ ID 3049>:

a519.seq

```
  1 ATGGAATTTT TCATTATCTT GCTGGCAGCC GTCGTTGTTT TCGGCTTCAA

 51 ATCCTTTGTT GTCATCCCAC AGCAGGAAGT CCACGTTGTC GAAAGGCTCG

101 GGCGTTTCCA TCGCGCCCTG ACGGCCGGTT TGAATATTTT GATTCCCTTT

151 ATCGACCGCG TCGCCTACCG CCATTCGCTG AAAGAAATCC CTTTAGACGT

201 ACCCAGCCAG GTCTGCATCA CGCGCGACAA TACGCAGCTG ACTGTTGACG

251 GTATCATCTA TTTCCAAGTA ACCGACCCCA AACTCGCCTC ATACGGTTCG

301 AGCAACTACA TTATGGCGAT TACCCAGCTT GCCCAAACGA CGCTGCGTTC

351 CGTTATCGGG CGTATGGAAT TGGACAAAAC GTTTGAAGAA CGCGACGAAA
```

-continued

```
401 TCAACAGCAC CGTCGTCTCC GCCCTCGATG AAGCCGCCGG AGCTTGGGGT
451 GTGAAGGTTT TGCGTTATGA GATTAAAGAC TTGGTTCCGC CGCAAGAAAT
501 CCTTCGCTCA ATGCAGGCGC AAATTACTGC TGAACGCGAA AAACGCGCCC
551 GTATCGCCGA ATCCGAAGGT CGTAAAATCG AACAAATCAA CCTTGCCAGT
601 GGTCAGCGCG AAGCCGAAAT CCAACAATCC GAAGGCGAGG CTCAGGCTGC
651 GGTCAATGCG TCAAATGCCG AGAAAATCGC CCGCATCAAC CGCGCCAAAG
701 GTGAAGCGGA ATCCTTGCGC CTTGTTGCCG AAGCCAATGC CGAAGCCATC
751 CGTCAAATTG CCGCCGCCCT TCAAACCCAA GGCGGTGCGG ATGCGGTCAA
801 TCTGAAGATT GCGGAACAAT ACGTCGCCGC GTTCAACAAT CTTGCCAAAG
851 AAAGCAATAC GCTGATTATG CCCGCCAATG TTGCCGACAT CGGCAGCCTG
901 ATTTCTGCCG GTATGAAAAT TATCGACAGC AGCAAAACCG CCAAATAA
```

This corresponds to the amino acid sequence <SEQ ID 3050; ORF 519.a>:

```
a519.pep

  1 MEFFIILLAA VVVFGFKSFV VIPQQEVHVV ERLGRFHRAL TAGLNILIPF
 51 IDRVAYRHSL KEIPLDVPSQ VCITRDNTQL TVDGIIYFQV TDPKLASYGS
101 SNYIMAITQL AQTTLRSVIG RMELDKTFEE RDEINSTVVS ALDEAAGAWG
151 VKVLRYEIKD LVPPQEILRS MQAQITAERE KRARIAESEG RKIEQINLAS
201 GQREAEIQQS EGEAQAAVNA SNAEKIARIN RAKGEAESLR LVAEANAEAI
251 RQIAAALQTQ GGADAVNLKI AEQYVAAFNN LAKESNTLIM PANVADIGSL
301 ISAGMKIIDS SKTAK*
```

m519/a519 ORFs 519 and 519.a showed a 99.5% identity in 199 aa overlap

```
                                                10        20        30
m519.pep                                SVIGRMELDKTFEERDEINSTVVAALDEAA
                                        ||||||||||||||||||||||||:|||||
a519      YFQVTDPKLASYGSSNYIMAITQLAQTTLRSVIGRMELDKTFEERDEINSTVVSALDEAA
            90       100       110       120       130       140

                  40        50        60        70        80        90
m519.pep  GAWGVKVLRYEIKDLVPPQEILRSMQAQITAEREKRARIAESEGRKIEQINLASGQREAE
          ||||||||||||||||||||||||||||||||||||||||||||||||||||||||||||
a519      GAWGVKVLRYEIKDLVPPQEILRSMQAQITAEREKRARIAESEGRKIEQINLASGQREAE
           150       160       170       180       190       200

                 100       110       120       130       140       150
m519.pep  IQQSEGEAQAAVNASNAEKIARINRAKGEAESLRLVAEANAEAIRQIAAALQTQGGADAV
          ||||||||||||||||||||||||||||||||||||||||||||||||||||||||||||
a519      IQQSEGEAQAAVNASNAEKIARINRAKGEAESLRLVAEANAEAIRQIAAALQTQGGADAV
           210       220       230       240       250       260

                 160       170       180       190       200
m519.pep  NLKIAEQYVAAFNNLAKESNTLIMPANVADIGSLISAGMKIIDSSKTAKX
          |||||||||||||||||||||||||||||||||||||||||||||||||
a519      NLKIAEQYVAAFNNLAKESNTLIMPANVADIGSLISAGMKIIDSSKTAKX
           270       280       290       300       310
```

Further work revealed the DNA sequence identified in *N. meningitidis* <SEQ ID 3051>:

m519-1.seq

1 ATGGAATTTT TCATTATCTT GTTGGTAGCC GTCGCCGTTT TCGGTTTCAA

51 ATCCTTTGTT GTCATCCCAC AACAGGAAGT CCACGTTGTC GAAAGGCTGG

101 GGCGTTTCCA TCGCGCCCTG ACGGcCGGTT TGAATATTTT GATTCCCTTT

151 ATCGACCGCG TCGCCTACCG CCATTCGCTG AAAGAAATCC CTTTAGACGT

201 ACCCAGCCAG GTCTGCATCA CGCGCGACAA TACGCAGCTG ACTGTTGACG

251 GCATCATCTA TTTCCAAGTA ACCGACCCCA AACTCGCCTC ATACGGTTCG

301 AGCAACTACA TTATGGCGAT TACCCAGCTT GCCCAAACGA CGCTGCGTTC

351 CGTTATCGGG CGTATGGAGT TGGACAAAAC GTTTGAAGAA CGCGACGAAA

401 TCAACAGTAC TGTTGTTGCG GCTTTGGACG AGGCGGCCGG GGCTTGGGGT

451 GTGAAGGTTT TGCGTTATGA GATTAAAGAC TTGGTTCCGC CGCAAGAAAT

501 CCTTCGCTCA ATGCAGGCGC AAATTACTGC CGAACGCGAA AAACGCGCCC

551 GTATCGCCGA ATCCGAAGGT CGTAAAATCG AACAAATCAA CCTTGCCAGT

601 GGTCAGCGCG AAGCCGAAAT CCAACAATCC GAAGGCGAGG CTCAGGCTGC

651 GGTCAATGCG TCAAATGCCG AGAAAATCGC CCGCATCAAC CGCGCCAAAG

701 GTGAAGCGGA ATCCTTGCGC CTTGTTGCCG AAGCCAATGC CGAAGCCATC

751 CGTCAAATTG CCGCCGCCCT TCAAACCCAA GGCGGTGCGG ATGCGGTCAA

801 TCTGAAGATT GCGGAACAAT ACGTCGCTGC GTTCAACAAT CTTGCCAAAG

851 AAAGCAATAC GCTGATTATG CCCGCCAATG TTGCCGACAT CGGCAGCCTG

901 ATTTCTGCCG GTATGAAAAT TATCGACAGC AGCAAAACCG CCAAATAA

This corresponds to the amino acid sequence <SEQ ID 3052; ORF 519-1>:

m519-1.

1 MEFFIILLVA VAVFGFKSFV VIPQQEVHVV ERLGRFHRAL TAGLNILIPF

51 IDRVAYRHSL KEIPLDVPSQ VCITRDNTQL TVDGIIYFQV TDPKLASYGS

101 SNYIMAITQL AQTTLRSVIG RMELDKTFEE RDEINSTVVA ALDEAAGAWG

151 VKVLRYEIKD LVPPQEILRS MQAQITAERE KRARIAESEG RKIEQINLAS

201 GQREAEIQQS EGEAQAAVNA SNAEKIARIN RAKGEAESLR LVAEANAEAI

251 RQIAAALQTQ GGADAVNLKI AEQYVAAFNN LAKESNTLIM PANVADIGSL

301 ISAGMKIIDS SKTAK*

The following DNA sequence was identified in *N. gonorrhoeae* <SEQ ID 3053>:

g519-1.seq

1 ATGGAATTTT TCATTATCTT GTTGGCAGCC GTCGCCGTTT TCGGCTTCAA

51 ATCCTTTGTC GTCATCCCCC AGCAGGAAGT CCACGTTGTC GAAAGGCTCG

101 GGCGTTTCCA TCGCGCCCTG ACGGCCGGTT TGAATATTTT GATTCCCTTT

151 ATCGACCGCG TCGCCTACCG CCATTCGCTG AAAGAAATCC CTTTAGACGT

201 ACCCAGCCAG GTCTGCATCA CGCGCGATAA TACGCAATTG ACTGTTGACG

-continued

```
251 GCATCATCTA TTTCCAAGTA ACCGATCCCA AACTCGCCTC ATACGGTTCG

301 AGCAACTACA TTATGGCAAT TACCCAGCTT GCCCAAACGA CGCTGCGTTC

351 CGTTATCGGG CGTATGGAGT TGGACAAAAC GTTTGAAGAA CGCGACGAAA

401 TCAACAGTAC CGTCGTCTCC GCCCTCGATG AAGCCGCCGG GGCTTGGGGT

451 GTGAAAGTCC TCCGTTACGA AATCAAGGAT TTGGTTCCGC CGCAAGAAAT

501 CCTTCGCGCA ATGCAGGCAC AAATTACCGC CGAACGCGAA AAACGCGCCC

551 GTATTGCCGA ATCCGAAGGC CGTAAAATCG AACAAATCAA CCTTGCCAGT

601 GGTCAGCGTG AAGCCGAAAT CCAACAATCC GAAGGCGAGG CTCAGGCTGC

651 GGTCAATGCG TCCAATGCCG AGAAAATCGC CCGCATCAAC CGCGCCAAAG

701 GCGAAGCGGA ATCCCTGCGC CTTGTTGCCG AAGCCAATGC CGAAGCCATC

751 CGTCAAATTG CCGCCGCCCT TCAAACCCAA GGCGGGGCGG ATGCGGTCAA

801 TCTGAAGATT GCGGAACAAT ACGTAGCCGC GTTCAACAAT CTTGCCAAAG

851 AAAGCAATAC GCTGATTATG CCCGCCAATG TTGCCGACAT CGGCAGCCTG

901 ATTTCTGCCG GCATGAAAAT TATCGACAGC AGCAAAACCG CCAAATAA
```

This corresponds to the amino acid sequence <SEQ ID 3054; ORF 519-1.ng>:

g519-1.pep

```
  1 MEFFIILLAA VAVFGFKSFV VIPQQEVHVV ERLGRFHRAL TAGLNILIPF

 51 IDRVAYRHSL KEIPLDVPSQ VCITRDNTQL TVDGIIYFQV TDPKLASYGS

101 SNYIMAITQL AQTTLRSVIG RMELDKTFEE RDEINSTVVS ALDEAAGAWG

151 VKVLRYEIKD LVPPQEILRA MQAQITAERE KRARIAESEG RKIEQINLAS

201 GQREAEIQQS EGEAQAAVNA SNAEKIARIN RAKGEAESLR LVAEANAEAI

251 RQIAAALQTQ GGADAVNLKI AEQYVAAFNN LAKESNTLIM PANVADIGSL

301 ISAGMKIIDS SKTAK*
```

m519-1/g519-1 ORFs 519-1 and 519-1.ng showed a 99.0% identity in 315 aa overlap

```
                    10        20        30        40        50        60
g519-1.pep  MEFFIILLAAVAVFGFKSFVVIPQQEVHVVERLGRFHRALTAGLNILIPFIDRVAYRHSL
            ||||||||:|||||||||||||||||||||||||||||||||||||||||||||||||||
m519-1      MEFFIILLVAVAVFGFKSFVVIPQQEVHVVERLGRFHRALTAGLNILIPFIDRVAYRHSL
                    10        20        30        40        50        60

                    70        80        90       100       110       120
g519-1.pep  KEIPLDVPSQVCITRDNTQLTVDGIIYFQVTDPKLASYGSSNYIMAITQLAQTTLRSVIG
            ||||||||||||||||||||||||||||||||||||||||||||||||||||||||||||
m519-1      KEIPLDVPSQVCITRDNTQLTVDGIIYFQVTDPKLASYGSSNYIMAITQLAQTTLRSVIG
                    70        80        90       100       110       120

                   130       140       150       160       170       180
g519-1.pep  RMELDKTFEERDEINSTVVSALDEAAGAWGVKVLRYEIKDLVPPQEILRAMQAQITAERE
            |||||||||||||||||||:|||||||||||||||||||||||||||||:||||||||||
m519-1      RMELDKTFEERDEINSTVVAALDEAAGAWGVKVLRYEIKDLVPPQEILRSMQAQITAERE
                   130       140       150       160       170       180

                   190       200       210       220       230       240
g519-1.pep  KRARIAESEGRKIEQINLASGQREAEIQQSEGEAQAAVNASNAEKIARINRAKGEAESLR
            ||||||||||||||||||||||||||||||||||||||||||||||||||||||||||||
m519-1      KRARIAESEGRKIEQINLASGQREAEIQQSEGEAQAAVNASNAEKIARINRAKGEAESLR
                   190       200       210       220       230       240
```

-continued

```
                   250       260       270       280       290       300
g519-1.pep  LVAEANAEAIRQIAAALQTQGGADAVNLKIAEQYVAAFNNLAKESNTLIMPANVADIGSL
            ||||||||||||||||||||||||||||||||||||||||||||||||||||||||||||
m519-1      LVAEANAEAIRQIAAALQTQGGADAVNLKIAEQYVAAFNNLAKESNTLIMPANVADIGSL
                   250       260       270       280       290       300

                   310
g519-1.pep  ISAGMKIIDSSKTAKX
            ||||||||||||||||
m519-1      ISAGMKIIDSSKTAKX
                   310
```

The following DNA sequence was identified in *N. meningitidis* <SEQ ID 3055>:

a519-1.seq

```
  1 ATGGAATTTT TCATTATCTT GCTGGCAGCC GTCGTTGTTT TCGGCTTCAA
 51 ATCCTTTGTT GTCATCCCAC AGCAGGAAGT CCACGTTGTC GAAAGGCTCG
101 GGCGTTTCCA TCGCGCCCTG ACGGCCGGTT TGAATATTTT GATTCCCTTT
151 ATCGACCGCG TCGCCTACCG CCATTCGCTG AAAGAAATCC CTTTAGACGT
201 ACCCAGCCAG GTCTGCATCA CGCGCGACAA TACGCAGCTG ACTGTTGACG
251 GTATCATCTA TTTCCAAGTA ACCGACCCCA AACTCGCCTC ATACGGTTCG
301 AGCAACTACA TTATGGCGAT TACCCAGCTT GCCCAAACGA CGCTGCGTTC
351 CGTTATCGGG CGTATGGAAT TGGACAAAAC GTTTGAAGAA CGCGACGAAA
401 TCAACAGCAC CGTCGTCTCC GCCCTCGATG AAGCCGCCGG AGCTTGGGGT
451 GTGAAGGTTT TGCGTTATGA GATTAAAGAC TTGGTTCCGC CGCAAGAAAT
501 CCTTCGCTCA ATGCAGGCGC AAATTACTGC TGAACGCGAA AAACGCGCCC
551 GTATCGCCGA ATCCGAAGGT CGTAAAATCG AACAAATCAA CCTTGCCAGT
601 GGTCAGCGCG AAGCCGAAAT CCAACAATCC GAAGGCGAGG CTCAGGCTGC
651 GGTCAATGCG TCAAATGCCG AGAAAATCGC CCGCATCAAC CGCGCCAAAG
701 GTGAAGCGGA ATCCTTGCGC CTTGTTGCCG AAGCCAATGC CGAAGCCATC
751 CGTCAAATTG CCGCCGCCCT TCAAACCCAA GGCGGTGCGG ATGCGGTCAA
801 TCTGAAGATT GCGGAACAAT ACGTCGCCGC GTTCAACAAT CTTGCCAAAG
851 AAAGCAATAC GCTGATTATG CCCGCCAATG TTGCCGACAT CGGCAGCCTG
901 ATTTCTGCCG GTATGAAAAT TATCGACAGC AGCAAAACCG CCAAATAA
```

This corresponds to the amino acid sequence <SEQ ID 3056; ORF 519-1.a>:

a519-1.pep.

```
  1 MEFFIILLAA VVVFGFKSFV VIPQQEVHVV ERLGRFHRAL TAGLNILIPF
 51 IDRVAYRHSL KEIPLDVPSQ VCITRDNTQL TVDGIIYFQV TDPKLASYGS
101 SNYIMAITQL AQTTLRSVIG RMELDKTFEE RDEINSTVVS ALDEAAGAWG
151 VKVLRYEIKD LVPPQEILRS MQAQITAERE KRARIAESEG RKIEQINLAS
201 GQREAEIQQS EGEAQAAVNA SNAEKIARIN RAKGEAESLR LVAEANAEAI
251 RQIAAALQTQ GGADAVNLKI AEQYVAAFNN LAKESNTLIM PANVADIGSL
301 ISAGMKIIDS SKTAK*
```

m519-1/a519-1 ORFs 519-1 and 519-1.a showed a 99.0% identity in 315 aa overlap

```
                    10        20        30        40        50        60
a519-1.pep  MEFFIILLAAVVVFGFKSFVVIPQQEVHVVERLGRFHRALTAGLNILIPFIDRVAYRHSL
            ||||||||:||:||||||||||||||||||||||||||||||||||||||||||||||||
m519-1      MEFFIILLVAVAVFGFKSFVVIPQQEVHVVERLGRFHRALTAGLNILIPFIDRVAYRHSL
                    10        20        30        40        50        60

                    70        80        90       100       110       120
a519-1.pep  KEIPLDVPSQVCITRDNTQLTVDGIIYFQVTDPKLASYGSSNYIMAITQLAQTTLRSVIG
            ||||||||||||||||||||||||||||||||||||||||||||||||||||||||||||
m519-1      KEIPLDVPSQVCITRDNTQLTVDGIIYFQVTDPKLASYGSSNYIMAITQLAQTTLRSVIG
                    70        80        90       100       110       120

                   130       140       150       160       170       180
a519-1.pep  RMELDKTFEERDEINSTVVSALDEAAGAWGVKVLRYEIKDLVPPQEILRSMQAQITAERE
            |||||||||||||||||||:||||||||||||||||||||||||||||||||||||||||
m519-1      RMELDKTFEERDEINSTVVAALDEAAGAWGVKVLRYEIKDLVPPQEILRSMQAQITAERE
                   130       140       150       160       170       180

                   190       200       210       220       230       240
a519-1.pep  KRARIAESEGRKIEQINLASGQREAEIQQSEGEAQAAVNASNAEKIARINRAKGEAESLR
            ||||||||||||||||||||||||||||||||||||||||||||||||||||||||||||
m519-1      KRARIAESEGRKIEQINLASGQREAEIQQSEGEAQAAVNASNAEKIARINRAKGEAESLR
                   190       200       210       220       230       240

                   250       260       270       280       290       300
a519-1.pep  LVAEANAEAIRQIAAALQTQGGADAVNLKIAEQYVAAFNNLAKESNTLIMPANVADIGSL
            ||||||||||||||||||||||||||||||||||||||||||||||||||||||||||||
m519-1      LVAEANAEAIRQIAAALQTQGGADAVNLKIAEQYVAAFNNLAKESNTLIMPANVADIGSL
                   250       260       270       280       290       300

                   310
a519-1.pep  ISAGMKIIDSSKTAKX
            ||||||||||||||||
m519-1      ISAGMKIIDSSKTAKX
                   310
```

576 and 576-1 gnm22.seq

The following partial DNA sequence was identified in *N. meningitidis* <SEQ ID 3057>:

```
m576.seq.. (partial)

  1 ..ATGCAGCAGG CAAGCTATGC GATGGGCGTG GACATCGGAC GCTCCCTGAA
 51   GCAAATGAAG GAACAGGGCG CGGAAATCGA TTTGAAAGTC TTTACCGAAG
101   CCATGCAGGC AGTGTATGAC GGCAAAGAAA TCAAAATGAC CGAAGAGCAG
151   GCTCAGGAAG TCATGATGAA ATTCCTTCAG GAACAACAGG CTAAAGCCGT
201   AGAAAAACAC AAGGCGGACG CGAAGGCCAA TAAAGAAAAA GGCGAAGCCT
251   TTCTGAAAGA AAATGCCGCC AAAGACGGCG TGAAGACCAC TGCTTCCGGC
301   CTGCAATACA AAATCACCAA ACAGGGCGAA GGCAAACAGC CGACCAAAGA
351   CGACATCGTT ACCGTGGAAT ACGAAGGCCG CCTGATTGAC GGTACGGTAT
401   TCGACAGCAG CAAAGCCAAC GGCGGCCCGG TCACCTTCCC TTTGAGCCAA
451   GTGATTCCGG GTTGGACCGA AGgCGTACAG CTTCTGAAAG AAGGCGGCGA
501   AGCCACGTTC TACATCCCGT CCAACCTTGC CTACCGCGAA CAGGGTGCGG
551   GCGACAAAAT CGGTCCGAAC GCCACTTTGG TATTTGATGT GAAACTGGTC
601   AAAATCGGCG CACCCGAAAA CGCGCCCGCC AAGCAGCCGG CTCAAGTCGA
651   CATCAAAAAA GTAAATTAA
```

This corresponds to the amino acid sequence <SEQ ID 3058; ORF 576>:

m576.pep.. (partial)

```
  1 ..MQQASYAMGV DIGRSLKQMK EQGAEIDLKV FTEAMQAVYD GKEIKMTEEQ
 51   AQEVMMKFLQ EQQAKAVEKH KADAKANKEK GEAFLKENAA KDGVKTTASG
101   LQYKITKQGE GKQPTKDDIV TVEYEGRLID GTVFDSSKAN GGPVTFPLSQ
151   VIPGWTEGVQ LLKEGGEATF YIPSNLAYRE QGAGDKIGPN ATLVFDVKLV
201   KIGAPENAPA KQPAQVDIKK VN*
```

The following partial DNA sequence was identified in *N. gonorrhoeae* <SEQ ID 3059>:

g576.seq.. (partial)

```
  1 ..atgggcgtgg acatcggacg ctccctgaaa caaatgaagg aacagggcgc
 51   ggaaatcgat ttgaaagtct ttaccgatgc catgcaggca gtgtatgacg
101   gcaaagaaat caaaatgacc gaagagcagg cccaggaagt gatgatgaaa
151   ttcctgcagg agcagcaggc taaagccgta gaaaaacaca aggcggatgc
201   gaaggccaac aaagaaaaag gcgaagcctt cctgaaggaa aatgccgccg
251   aagacggcgt gaagaccact gcttccggtc tgcagtacaa aatcaccaaa
301   cagggtgaag gcaaacagcc gacaaaagac gacatcgtta ccgtggaata
351   cgaaggccgc ctgattgacg gtaccgtatt cgacagcagc aaagccaacg
401   gcggcccggc caccttccct ttgagccaag tgattccggg ttggaccgaa
451   ggcgtacggc ttctgaaaga aggcggcgaa gccacgttct acatcccgtc
501   caaccttgcc taccgcgaac agggtgcggg cgaaaaaatc ggtccgaacg
551   ccactttggt atttgacgtg aaactggtca aaatcggcgc acccgaaaac
601   gcgcccgcca agcagccgga tcaagtcgac atcaaaaaag taaattaa
```

This corresponds to the amino acid sequence <SEQ ID 3060; ORF 576.ng>:

g576.pep.. (partial)

```
  1 ..MGVDIGRSLK QMKEQGAEID LKVFTDAMQA VYDGKEIKMT EEQAQEVMMK
 51   FLQEQQAKAV EKHKADAKAN KEKGEAFLKE NAAEDGVKTT ASGLQYKITK
101   QGEGKQPTKD DIVTVEYEGR LIDGTVFDSS KANGGPATFP LSQVIPGWTE
151   GVRLLKEGGE ATFYIPSNLA YREQGAGEKI GPNATLVFDV KLVKIGAPEN
201   APAKQPDQVD IKKVN*
```

Computer analysis of this amino acid sequence gave the following results:

Homology with a predicted ORF from *N. gonorrhoeae* m576/g576 ORFs 576 and 576.ng showed a 97.2% identity in 215 aa overlap

```
                      10        20        30        40        50        60
m576.pep   MQQASYAMGVDIGRSLKQMKEQGAEIDLKVFTEAMQAVYDGKEIKMTEEQAQEVMMKFLQ
                  ||||||||||||||||||||||||:||||||||||||||||||||||||||
g576              MGVDIGRSLKQMKEQGAEIDLKVFTDAMQAVYDGKEIKMTEEQAQEVMMKFLQ
                         10        20        30        40        50
```

```
                     70        80        90       100       110       120
m576.pep  EQQAKAVEKHKADAKANKEKGEAFLKENAAKDGVKTTASGLQYKITKQGEGKQPTKDDIV
          |||||||||||||||||||||||||||||||:||||||||||||||||||||||||||||
g576      EQQAKAVEKHKADAKANKEKGEAFLKENAAEDGVKTTASGLQYKITKQGEGKQPTKDDIV
                     60        70        80        90       100       110

                    130       140       150       160       170       180
m576.pep  TVEYEGRLIDGTVFDSSKANGGPVTFPLSQVIPGWTEGVQLLKEGGEATFYIPSNLAYRE
          ||||||||||||||||||||||:||||||||||||||||:||||||||||||||||||||
g576      TVEYEGRLIDGTVFDSSKANGGPATFPLSQVIPGWTEGVRLLKEGGEATFYIPSNLAYRE
                    120       130       140       150       160       170

                    190       200       210       220
m576.pep  QGAGDKIGPNATLVFDVKLVKIGAPENAPAKQPAQVDIKKVNX
          ||||:|||||||||||||||||||||||||||||| ||||||
g576      QGAGEKIGPNATLVFDVKLVKIGAPENAPAKQPDQVDIKKVNX
                    180       190       200       210
```

The following partial DNA sequence was identified in *N. meningitidis* <SEQ ID 3061>:

```
a576.seq

  1 ATGAACACCA TTTTCAAAAT CAGCGCACTG ACCCTTTCCG CCGCTTTGGC

 51 ACTTTCCGCC TGCGGCAAAA AGAAGCCGCC CCCGCATCT  GCATCCGAAC

101 CTGCCGCCGC TTCTTCCGCG CAGGGCGACA CCTCTTCGAT CGGCAGCACG

151 ATGCAGCAGG CAAGCTATGC GATGGGCGTG ACATCGGAC  GCTCCCTGAA

201 GCAAATGAAG GAACAGGGCG CGGAAATCGA TTTGAAAGTC TTTACCGAAG

251 CCATGCAGGC AGTGTATGAC GGCAAAGAAA TCAAAATGAC CGAAGAGCAG

301 GCTCAGGAAG TCATGATGAA ATTCCTTCAG GAACAACAGG CTAAAGCCGT

351 AGAAAAACAC AAGGCGGACG CGAAGGCCAA TAAGAAAAA  GGCGAAGCCT

401 TTCTGAAAGA AAATGCCGCC AAAGACGGCG TGAAGACCAC TGCTTCCGGC

451 CTGCAATACA AAATCACCAA ACAGGGCGAA GGCAAACAGC CGACCAAAGA

501 CGACATCGTT ACCGTGGAAT ACGAAGGCCG CCTGATTGAC GGTACGGTAT

551 TCGACAGCAG CAAAGCCAAC GGCGGCCCGG TCACCTTCCC TTTGAGCCAA

601 GTGATTCTGG GTTGGACCGA AGGCGTACAG CTTCTGAAAG AAGGCGGCGA

651 AGCCACGTTC TACATCCCGT CCAACCTTGC CTACCGCGAA CAGGGTGCGG

701 GCGACAAAAT CGGCCCGAAC GCCACTTTGG TATTTGATGT GAAACTGGTC

751 AAAATCGGCG CACCCGAAAA CGCGCCCGCC AAGCAGCCGG CTCAAGTCGA

801 CATCAAAAAA GTAAATTAA
```

This corresponds to the amino acid sequence <SEQ ID 3062; ORF 576.a>:

```
a576.pep

  1 MNTIFKISAL TLSAALALSA CGKKEAAPAS ASEPAAASSA QGDTSSIGST

 51 MQQASYAMGV DIGRSLKQMK EQGAEIDLKV FTEAMQAVYD GKEIKMTEEQ

101 AQEVMMKFLQ EQQAKAVEKH KADAKANKEK GEAFLKENAA KDGVKTTASG

151 LQYKITKQGE GKQPTKDDIV TVEYEGRLID GTVFDSSKAN GGPVTFPLSQ

201 VILGWTEGVQ LLKEGGEATF YIPSNLAYRE QGAGDKIGPN ATLVFDVKLV

251 KIGAPENAPA KQPAQVDIKK VN*
```

m576/a576 ORFs 576 and 576.a showed a 99.5% identity in 222 aa overlap

```
                                                     10        20        30
m576.pep                                     MQQASYAMGVDIGRSLKQMKEQGAEIDLKV
                                             ||||||||||||||||||||||||||||||
a576      CGKKEAAPASASEPAAASSAQGDTSSIGSTMQQASYAMGVDIGRSLKQMKEQGAEIDLKV
                 30        40        50        60        70        80

                 40        50        60        70        80        90
m576.pep  FTEAMQAVYDGKEIKMTEEQAQEVMMKFLQEQQAKAVEKHKADAKANKEKGEAFLKENAA
          ||||||||||||||||||||||||||||||||||||||||||||||||||||||||||||
a576      FTEAMQAVYDGKEIKMTEEQAQEVMMKFLQEQQAKAVEKHKADAKANKEKGEAFLKENAA
                 90       100       110       120       130       140

                100       110       120       130       140       150
m576.pep  KDGVKTTASGLQYKITKQGEGKQPTKDDIVTVEYEGRLIDGTVFDSSKANGGPVTFPLSQ
          ||||||||||||||||||||||||||||||||||||||||||||||||||||||||||||
a576      KDGVKTTASGLQYKITKQGEGKQPTKDDIVTVEYEGRLIDGTVFDSSKANGGPVTFPLSQ
                150       160       170       180       190       200

                160       170       180       190       200       210
m576.pep  VIPGWTEGVQLLKEGGEATFYIPSNLAYREQGAGDKIGPNATLVFDVKLVKIGAPENAPA
          || |||||||||||||||||||||||||||||||||||||||||||||||||||||||||
a576      VILGWTEGVQLLKEGGEATFYIPSNLAYREQGAGDKIGPNATLVFDVKLVKIGAPENAPA
                210       220       230       240       250       260

                220
m576.pep  KQPAQVDIKKVNX
          |||||||||||||
a576      KQPAQVDIKKVNX
                270
```

Further work revealed the DNA sequence identified in *N. meningitidis* <SEQ ID 3063>:

m576-1.seq

```
  1 ATGAACACCA TTTTCAAAAT CAGCGCACTG ACCCTTTCCG CCGCTTTGGC
 51 ACTTTCCGCC TGCGGCAAAA AAGAAGCCGC CCCCGCATCT GCATCCGAAC
101 CTGCCGCCGC TTCTTCCGCG CAGGGCGACA CCTCTTCGAT CGGCAGCACG
151 ATGCAGCAGG CAAGCTATGC GATGGGCGTG GACATCGGAC GCTCCCTGAA
201 GCAAATGAAG GAACAGGGCG CGGAAATCGA TTTGAAAGTC TTTACCGAAG
251 CCATGCAGGC AGTGTATGAC GGCAAAGAAA TCAAAATGAC CGAAGAGCAG
301 GCTCAGGAAG TCATGATGAA ATTCCTTCAG GAACAACAGG CTAAAGCCGT
351 AGAAAAACAC AAGGCGGACG CGAAGGCCAA TAAAGAAAAA GGCGAAGCCT
401 TTCTGAAAGA AAATGCCGCC AAAGACGGCG TGAAGACCAC TGCTTCCGGC
451 CTGCAATACA AAATCACCAA ACAGGGCGAA GGCAAACAGC CGACCAAAGA
501 CGACATCGTT ACCGTGGAAT ACGAAGGCCG CCTGATTGAC GGTACGGTAT
551 TCGACAGCAG CAAAGCCAAC GGCGGCCCGG TCACCTTCCC TTTGAGCCAA
601 GTGATTCCGG GTTGGACCGA AGGCGTACAG CTTCTGAAAG AAGGCGGCGA
651 AGCCACGTTC TACATCCCGT CCAACCTTGC CTACCGCGAA CAGGGTGCGG
701 GCGACAAAAT CGGTCCGAAC GCCACTTTGG TATTTGATGT GAAACTGGTC
751 AAAATCGGCG CACCCGAAAA CGCGCCCGCC AAGCAGCCGG CTCAAGTCGA
801 CATCAAAAAA GTAAATTAA
```

This corresponds to the amino acid sequence <SEQ ID 3064; ORF 576-1>:

m576-1.pep

```
  1 MNTIFKISAL TLSAALALSA CGKKEAAPAS ASEPAAASSA QGDTSSIGST
 51 MQQASYAMGV DIGRSLKQMK EQGAEIDLKV FTEAMQAVYD GKEIKMTEEQ
101 AQEVMMKFLQ EQQAKAVEKH KADAKANKEK GEAFLKENAA KDGVKTTASG
151 LQYKITKQGE GKQPTKDDIV TVEYEGRLID GTVFDSSKAN GGPVTFPLSQ
201 VIPGWTEGVQ LLKEGGEATF YIPSNLAYRE QGAGDKIGPN ATLVFDVKLV
251 KIGAPENAPA KQPAQVDIKK VN*
```

The following DNA sequence was identified in *N. gonorrhoeae* <SEQ ID 3065>:

g576-1.seq

```
  1 ATGAACACCA TTTTCAAAAT CAGCGCACTG ACCCTTTCCG CCGCTTTGGC
 51 ACTTTCCGCC TGCGGCAAAA AAGAAGCCGC CCCCGCATCT GCATCCGAAC
101 CTGCCGCCGC TTCTGCCGCG CAGGGCGACA CCTCTTCAAT CGGCAGCACG
151 ATGCAGCAGG CAAGCTATGC AATGGGCGTG GACATCGGAC GCTCCCTGAA
201 ACAAATGAAG GAACAGGGCG CGGAAATCGA TTTGAAAGTC TTTACCGATG
251 CCATGCAGGC AGTGTATGAC GGCAAAGAAA TCAAAATGAC CGAAGAGCAG
301 GCCCAGGAAG TGATGATGAA ATTCCTGCAG GAGCAGCAGG CTAAAGCCGT
351 AGAAAAACAC AAGGCGGATG CGAAGGCCAA CAAAGAAAAA GGCGAAGCCT
401 TCCTGAAGGA AAATGCCGCC AAAGACGGCG TGAAGACCAC TGCTTCCGGT
451 CTGCAGTACA AAATCACCAA ACAGGGTGAA GGCAAACAGC CGACAAAAGA
501 CGACATCGTT ACCGTGGAAT ACGAAGGCCG CCTGATTGAC GGTACCGTAT
551 TCGACAGCAG CAAAGCCAAC GGCGGCCCGG CCACCTTCCC TTTGAGCCAA
601 GTGATTCCGG GTTGGACCGA AGGCGTACGG CTTCTGAAAG AAGGCGGCGA
651 AGCCACGTTC TACATCCCGT CCAACCTTGC CTACCGCGAA CAGGGTGCGG
701 GCGAAAAAAT CGGTCCGAAC GCCACTTTGG TATTTGACGT GAAACTGGTC
751 AAAATCGGCG CACCGGAAAA CGCGCCCGCC AAGCAGCCGG ATCAAGTCGA
801 CATCAAAAAA GTAAATTAA
```

This corresponds to the amino acid sequence <SEQ ID 3066; ORF 576-1.ng>:

g576-1.pep

```
1   1 MNTIFKISAL TLSAALALSA CGKKEAAPAS ASEPAAASAA QGDTSSIGST
 51 MQQASYAMGV DIGRSLKQMK EQGAEIDLKV FTDAMQAVYD GKEIKMTEEQ
101 AQEVMMKFLQ EQQAKAVEKH KADAKANKEK GEAFLKENAA KDGVKTTASG
151 LQYKITKQGE GKQPTKDDIV TVEYEGRLID GTVFDSSKAN GGPATFPLSQ
201 VIPGWTEGVR LLKEGGEATF YIPSNLAYRE QGAGEKIGPN ATLVFDVKLV
251 KIGAPENAPA KQPDQVDIKK VN*
```

g576-1/m576-1 ORFs 576-1 and 576-1.ng showed a 97.8% identity in 272 aa overlap

```
                       10        20        30        40        50        60
g576-1.pep    MNTIFKISALTLSAALALSACGKKEAAPASASEPAAASAAQGDTSSIGSTMQQASYAMGV
              |||||||||||||||||||||||||||||||||||||||:||||||||||||||||||||
m576-1        MNTIFKISALTLSAALALSACGKKEAAPASASEPAAASSAQGDTSSIGSTMQQASYAMGV
                       10        20        30        40        50        60

                       70        80        90       100       110       120
g576-1.pep    DIGRSLKQMKEQGAEIDLKVFTDAMQAVYDGKEIKMTEEQAQEVMMKFLQEQQAKAVEKH
              ||||||||||||||||||||:|||||||||||||||||||||||||||||||||||||||
m576-1        DIGRSLKQMKEQGAEIDLKVFTEAMQAVYDGKEIKMTEEQAQEVMMKFLQEQQAKAVEKH
                       70        80        90       100       110       120

                      130       140       150       160       170       180
g576-1.pep    KADAKANKEKGEAFLKENAAKDGVKTTASGLQYKITKQGEGKQPTKDDIVTVEYEGRLID
              ||||||||||||||||||||||||||||||||||||||||||||||||||||||||||||
m576-1        KADAKANKEKGEAFLKENAAKDGVKTTASGLQYKITKQGEGKQPTKDDIVTVEYEGRLID
                      130       140       150       160       170       180

                      190       200       210       220       230       240
g576-1.pep    GTVFDSSKANGGPATFPLSQVIPGWTEGVRLLKEGGEATFYIPSNLAYREQGAGEKIGPN
              ||||||||||||:||||||||||||||||:|||||||||||||||||||||||||:||||
m576-1        GTVFDSSKANGGPVTFPLSQVIPGWTEGVQLLKEGGEATFYIPSNLAYREQGAGDKIGPN
                      190       200       210       220       230       240

                      250       260       270
g576-1.pep    ATLVFDVKLVKIGAPENAPAKQPDQVDIKKVNX
              ||||||||||||||||||||||| |||||||||
m576-1        ATLVFDVKLVKIGAPENAPAKQPAQVDIKKVNX
                      250       260       270
```

The following DNA sequence was identified in *N. meningitidis* <SEQ ID 3067>:

a576-1.seq

```
  1 ATGAACACCA TTTTCAAAAT CAGCGCACTG ACCCTTTCCG CCGCTTTGGC
 51 ACTTTCCGCC TGCGGCAAAA AAGAAGCCGC CCCCGCATCT GCATCCGAAC
101 CTGCCGCCGC TTCTTCCGCG CAGGGCGACA CCTCTTCGAT CGGCAGCACG
151 ATGCAGCAGG CAAGCTATGC GATGGGCGTG GACATCGGAC GCTCCCTGAA
201 GCAAATGAAG GAACAGGGCG CGGAAATCGA TTTGAAAGTC TTTACCGAAG
251 CCATGCAGGC AGTGTATGAC GGCAAAGAAA TCAAAATGAC CGAAGAGCAG
301 GCTCAGGAAG TCATGATGAA ATTCCTTCAG GAACAACAGG CTAAAGCCGT
351 AGAAAAACAC AAGGCGGACG CGAAGGCCAA TAAAGAAAAA GGCGAAGCCT
401 TTCTGAAAGA AAATGCCGCC AAAGACGGCG TGAAGACCAC TGCTTCCGGC
451 CTGCAATACA AAATCACCAA ACAGGGCGAA GGCAAACAGC CGACCAAAGA
501 CGACATCGTT ACCGTGGAAT ACGAAGGCCG CCTGATTGAC GGTACGGTAT
551 TCGACAGCAG CAAAGCCAAC GGCGGCCCGG TCACCTTCCC TTTGAGCCAA
601 GTGATTCTGG GTTGGACCGA AGGCGTACAG CTTCTGAAAG AAGGCGGCGA
651 AGCCACGTTC TACATCCCGT CCAACCTTGC CTACCGCGAA CAGGGTGCGG
701 GCGACAAAAT CGGCCCGAAC GCCACTTTGG TATTTGATGT GAAACTGGTC
751 AAAATCGGCG CACCCGAAAA CGCGCCCGCC AAGCAGCCGG CTCAAGTCGA
801 CATCAAAAAA GTAAATTAA
```

This corresponds to the amino acid sequence <SEQ ID 3068; ORF 576-1.a>:

a576-1.pep

```
  1 MNTIFKISAL TLSAALALSA CGKKEAAPAS ASEPAAASSA QGDTSSIGST
 51 MQQASYAMGV DIGRSLKQMK EQGAEIDLKV FTEAMQAVYD GKEIKMTEEQ
```

-continued

```
101 AQEVMMKFLQ EQQAKAVEKH KADAKANKEK GEAFLKENAA KDGVKTTASG

151 LQYKITKQGE GKQPTKDDIV TVEYEGRLID GTVFDSSKAN GGPVTFPLSQ

201 VILGWTEGVQ LLKEGGEATF YIPSNLAYRE QGAGDKIGPN ATLVFDVKLV

251 KIGAPENAPA KQPAQVDIKK VN*
```

a576-1/m576-1 ORFs 576-1 and 576-1.a showed a 99.6% identity in 272 aa overlap

```
                    10        20        30        40        50        60
a576-1.pep  MNTIFKISALTLSAALALSACGKKEAAPASASEPAAASSAQGDTSSIGSTMQQASYAMGV
            ||||||||||||||||||||||||||||||||||||||||||||||||||||||||||||
m576-1      MNTIFKISALTLSAALALSACGKKEAAPASASEPAAASSAQGDTSSIGSTMQQASYAMGV
                    10        20        30        40        50        60

                    70        80        90       100       110       120
a576-1.pep  DIGRSLKQMKEQGAEIDLKVFTEAMQAVYDGKEIKMTEEQAQEVMMKFLQEQQAKAVEKH
            ||||||||||||||||||||||||||||||||||||||||||||||||||||||||||||
m576-1      DIGRSLKQMKEQGAEIDLKVFTEAMQAVYDGKEIKMTEEQAQEVMMKFLQEQQAKAVEKH
                    70        80        90       100       110       120

                   130       140       150       160       170       180
a576-1.pep  KADAKANKEKGEAFLKENAAKDGVKTTASGLQYKITKQGEGKQPTKDDIVTVEYEGRLID
            ||||||||||||||||||||||||||||||||||||||||||||||||||||||||||||
m576-1      KADAKANKEKGEAFLKENAAKDGVKTTASGLQYKITKQGEGKQPTKDDIVTVEYEGRLID
                   130       140       150       160       170       180

                   190       200       210       220       230       240
a576-1.pep  GTVFDSSKANGGPVTFPLSQVILGWTEGVQLLKEGGEATFYIPSNLAYREQGAGDKIGPN
            |||||||||||||||||||||| |||||||||||||||||||||||||||||||||||||
m576-1      GTVFDSSKANGGPVTFPLSQVIPGWTEGVQLLKEGGEATFYIPSNLAYREQGAGDKIGPN
                   190       200       210       220       230       240

                   250       260       270
a576-1.pep  ATLVFDVKLVKIGAPENAPAKQPAQVDIKKVNX
            |||||||||||||||||||||||||||||||||
m576-1      ATLVFDVKLVKIGAPENAPAKQPAQVDIKKVNX
                   250       260       270
```

919 gnm43.seq

The following partial DNA sequence was identified in *N. meningitidis* <SEQ ID 3069>:

m919.seq

```
  1 ATGAAAAAAT ACCTATTCCG CGCCGCCCTG TACGGCATCG CCGCCGCCAT

 51 CCTCGCCGCC TGCCAAAGCA AGAGCATCCA AACCTTTCCG CAACCCGACA

101 CATCCGTCAT CAACGGCCCG GACCGGCCGG TCGGCATCCC CGACCCCGCC

151 GGAACGACGG TCGGCGGCGG CGGGGCCGTC TATACCGTTG TACCGCACCT

201 GTCCCTGCCC CACTGGGCGG CGCAGGATTT CGCCAAAAGC CTGCAATCCT

251 TCCGCCTCGG CTGCGCCAAT TTGAAAAACC GCCAAGGCTG GCAGGATGTG

301 TGCGCCCAAG CCTTTCAAAC CCCCGTCCAT TCCTTTCAGG CAAAACAGTT

351 TTTTGAACGC TATTTCACGC CGTGGCAGGT TGCAGGCAAC GGAAGCCTTG

401 CCGGTACGGT TACCGGCTAT TACGAACCGG TGCTGAAGGG CGACGACAGG

451 CGGACGGCAC AAGCCCGCTT CCCGATTTAC GGTATTCCCG ACGATTTTAT

501 CTCCGTCCCC CTGCCTGCCG GTTTGCGGAG CGGAAAAGCC CTTGTCCGCA

551 TCAGGCAGAC GGGAAAAAAC AGCGGCACAA TCGACAATAC CGGCGGCACA

601 CATACCGCCG ACCTCTCCcG ATTCCCCATC ACCGCGCGCA CAACAGCAAT

651 CAAAGGCAGG TTTGAAGGAA GCCGCTTCCT CCCCTACCAC ACGCGCAACC
```

-continued

```
 701 AAATCAACGG CGGCGCGCTT GACGGCAAAG CCCCGATACT CGGTTACGCC
 751 GAAGACCCTG TCGAACTTTT TTTTATGCAC ATCCAAGGCT CGGGCCGTCT
 801 GAAAACCCCG TCCGGCAAAT ACATCCGCAT CGGCTATGCC GACAAAAACG
 851 AACATCCyTA CGTTTCCATC GGACGCTATA TGGCGGATAA GGGCTACCTC
 901 AAACTCGGAC AAACCTCCAT GCAGGGCATT AAGTCTTATA TGCGGCAAAA
 951 TCCGCAACGC CTCGCCGAAG TTTTGGGTCA AAACCCCAGC TATATCTTTT
1001 TCCGCGAGCT TGCCGGAAGC AGCAATGACG GCCCTGTCGG CGCACTGGGC
1051 ACGCCGCTGA TGGGGGAATA TGCCGGCGCA GTCGACCGGC ACTACATTAC
1101 CTTGGGTGCG CCCTTATTTG TCGCCACCGC CCATCCGGTT ACCCGCAAAG
1151 CCCTCAACCG CCTGATTATG GCGCAGGATA CCGGCAGCGC GATTAAAGGC
1201 GCGGTGCGCG TGGATTATTT TTGGGGATAC GGCGACGAAG CCGGCGAACT
1251 TGCCGGCAAA CAGAAAACCA CGGGATATGT CTGGCAGCTC CTACCCAACG
1301 GTATGAAGCC CGAATACCGc CCGTAA
```

This corresponds to the amino acid sequence <SEQ ID 3070; ORF 919>:

m919.pep

```
  1 MKKYLFRAAL YGIAAAILAA CQSKSIQTFP QPDTSVINGP DRPVGIPDPA
 51 GTTVGGGGAV YTVVPHLSLP HWAAQDFAKS LQSFRLGCAN LKNRQGWQDV
101 CAQAFQTPVH SFQAKQFFER YFTPWQVAGN GSLAGTVTGY YEPVLKGDDR
151 RTAQARFPIY GIPDDFISVP LPAGLRSGKA LVRIRQTGKN SGTIDNTGGT
201 HTADLSRFPI TARTTAIKGR FEGSRFLPYH TRNQINGGAL DGKAPILGYA
251 EDPVELFFMH IQGSGRLKTP SGKYIRIGYA DKNEHPYVSI GRYMADKGYL
301 KLGQTSMQGI KSYMRQNPQR LAEVLGQNPS YIFFRELAGS SNDGPVGALG
351 TPLMGEYAGA VDRHYITLGA PLFVATAHPV TRKALNRLIM AQDTGSAIKG
401 AVRVDYFWGY GDEAGELAGK QKTTGYVWQL LPNGMKPEYR P*
```

The following partial DNA sequence was identified in *N. gonorrhoeae* <SEQ ID 3071>:

g919.seq

```
  1 ATGAAAAAAC ACCTGCTCCG CTCCGCCCTG TACGGcatCG CCGCCgccAT
 51 CctcgCCGCC TGCCAAAgca gGAGCATCCA AACCTTTCCG CAACCCGACA
101 CATCCGTCAT CAACGGCCCG GACCGGCCGG CCGGCATCCC CGACCCCGCC
151 GGAACGACGG TTGCCGGCGG CGGGGCCGTC TATACCGTTG TGCCGCACCT
201 GTCCATGCCC CACTGGGCGG CGCaggATTT TGCCAAAAGC CTGCAATCCT
251 TCCGCCTCGG CTGCGCCAAT TTGAAAAACC GCCAAGGCTG GCAGGATGTG
301 TGCGCCCAAG CCTTTCAAAC CCCCGTGCAT TCCTTTCAGG CAAAGcGgTT
351 TTTTGAACGC TATTTCACGC cgtGGCaggt tgcaggcaAC GGAAGcCTTG
401 Caggtacggt TACCGGCTAT TACGAACCGG TGCTGAAGGG CGACGGCAGG
451 CGGACGGAAC GGGCCCGCTT CCCGATTTAC GGTATTCCCG ACGATTTTAT
```

-continued

```
 501 CTCCGTCCCG CTGCCTGCCG GTTTGCGGGG CGGAAAAAAC CTTGTCCGCA
 551 TCAGGCAGac ggGGAAAAAC AGCGGCACGA TCGACAATGC CGGCGGCACG
 601 CATACCGCCG ACCTCTCCCG ATTCCCCATC ACCGCGCGCA CAACGGcaat
 651 caaaGGCAGG TTTGAaggAA GCCGCTTCCT CCCTTACCAC ACGCGCAACC
 701 AAAtcaacGG CGGCgcgcTT GACGGCAAag cccCCATCCT CggttacgcC
 751 GAagaccCcG tcgaactTTT TTTCATGCAC AtccaaggCT CGGGCCGCCT
 801 GAAAACCCcg tccggcaaat acatCCGCAt cggaTacgcc gacAAAAACG
 851 AACAtccgTa tgtttccatc ggACGctaTA TGGCGGACAA AGGCTACCTC
 901 AAGctcgggc agACCTCGAT GCAGGgcatc aaagcCTATA TGCGGCAAAA
 951 TCCGCAACGC CTCGCCGAAG TTTTGGGTCA AACCCCAGC TATATCTTTT
1001 TCCGCGAGCT TGCCGGAAGC GGCAATGAGG GCCCCGTCGG CGCACTGGGC
1051 ACGCCACTGA TGGGGGAATA CGCCGGCGCA ATCGACCGGC ACTACATTAC
1101 CTTGGGCGCG CCCTTATTTG TCGCCACCGC CCATCCGGTT ACCCGCAAAG
1151 CCCTCAACCG CCTGATTATG GCGCAGGATA CAGGCAGCGC GATCAAAGGC
1201 GCGGTGCGCG TGGATTATTT TTGGGGTTAC GGCGACGAAG CCGGCGAACT
1251 TGCCGGCAAA CAGAAAACCA CGGGATACGT CTGGCAGCTC CTGCCCAACG
1301 GCATGAAGCC CGAATACCGC CCGTGA
```

This corresponds to the amino acid sequence <SEQ ID 3072; ORF 919.ng>:

g919.pep

```
  1 MKKHLLRSAL YGIAAAILAA CQSRSIQTFP QPDTSVINGP DRPAGIPDPA
 51 GTTVAGGGAV YTVVPHLSMP HWAAQDFAKS LQSFRLGCAN LKNRQGWQDV
101 CAQAFQTPVH SFQAKRFFER YFTPWQVAGN GSLAGTVTGY YEPVLKGDGR
151 RTERARFPIY GIPDDFISVP LPAGLRGGKN LVRIRQTGKN SGTIDNAGGT
201 HTADLSRFPI TARTTAIKGR FEGSRFLPYH TRNQINGGAL DGKAPILGYA
251 EDPVELFFMH IQGSGRLKTP SGKYIRIGYA DKNEHPYVSI GRYMADKGYL
301 KLGQTSMQGI KAYMRQNPQR LAEVLGQNPS YIFFRELAGS GNEGPVGALG
351 TPLMGEYAGA IDRHYITLGA PLFVATAHPV TRKALNRLIM AQDTGSAIKG
401 AVRVDYFWGY GDEAGELAGK QKTTGYVWQL LPNGMKPEYR P*
```

ORF 919 shows 95.9% identity over a 441 aa overlap with a predicted ORF (ORF 919.ng) from *N. gonorrhoeae*:

m919/g919

```
                  10         20         30         40         50         60
m919.pep  MKKYLFRAALYGIAAAILAACQSKSIQTFPQPDTSVINGPDRPVGIPDPAGTTVGGGGAV
          |||:|:|:||||||||||||||:|||||||||||||||||:|||||||||||:||||
g919      MKKHLLRSALYGIAAAILAACQSRSIQTFPQPDTSVINGPDRPAGIPDPAGTTVAGGGAV
                  10         20         30         40         50         60

                  70         80         90        100        110        120
m919.pep  YTVVPHLSLPHWAAQDFAKSLQSFRLGCANLKNRQGWQDVCAQAFQTPVHSFQAKQFFER
          ||||||||:|||||||||||||||||||||||||||||||||||||||||||||:||||
g919      YTVVPHLSMPHWAAQDFAKSLQSFRLGCANLKNRQGWQDVCAQAFQTPVHSFQAKRFFER
                  70         80         90        100        110        120
```

-continued

```
                130       140       150       160       170       180
m919.pep  YFTPWQVAGNGSLAGTVTGYYEPVLKGDDRRTAQARFPIYGIPDDFISVPLPAGLRSGKA
          |||||||||||||||||||||||||||| ||| :||||||||||||||||||||||:|| 
g919      YFTPWQVAGNGSLAGTVTGYYEPVLKGDGRRTERARFPIYGIPDDFISVPLPAGLRGGKN
                130       140       150       160       170       180

                190       200       210       220       230       240
m919.pep  LVRIRQTGKNSGTIDNTGGTHTADLSRFPITARTTAIKGRFEGSRFLPYHTRNQINGGAL
          ||||||||||||||||:|||||||||||||||||||||||||||||||||||||||||||
g919      LVRIRQTGKNSGTIDNAGGTHTADLSRFPITARTTAIKGRFEGSRFLPYHTRNQINGGAL
                190       200       210       220       230       240

                250       260       270       280       290       300
m919.pep  DGKAPILGYAEDPVELFFMHIQGSGRLKTPSGKYIRIGYADKNEHPYVSIGRYMADKGYL
          ||||||||||||||||||||||||||||||||||||||||||||||||||||||||||||
g919      DGKAPILGYAEDPVELFFMHIQGSGRLKTPSGKYIRIGYADKNEHPYVSIGRYMADKGYL
                250       260       270       280       290       300

                310       320       330       340       350       360
m919.pep  KLGQTSMQGIKSYMRQNPQRLAEVLGQNPSYIFFRELAGSSNDGPVGALGTPLMGEYAGA
          |||||||||||:||||||||||||||||||||||||||||:|:|||||||||||||||||
g919      KLGQTSMQGIKAYMRQNPQRLAEVLGQNPSYIFFRELAGSGNEGPVGALGTPLMGEYAGA
                310       320       330       340       350       360

                370       380       390       400       410       420
m919.pep  VDRHYITLGAPLFVATAHPVTRKALNRLIMAQDTGSAIKGAVRVDYFWGYGDEAGELAGK
          :|||||||||||||||||||||||||||||||||||||||||||||||||||||||||||
g919      IDRHYITLGAPLFVATAHPVTRKALNRLIMAQDTGSAIKGAVRVDYFWGYGDEAGELAGK
                370       380       390       400       410       420

                430       440
m919.pep  QKTTGYVWQLLPNGMKPEYRPX
          ||||||||||||||||||||||
g919      QKTTGYVWQLLPNGMKPEYRPX
                430       440
```

The following partial DNA sequence was identified in *N. meningitidis* <SEQ ID 3073>:

a919.seq

```
   1 ATGAAAAAAT ACCTATTCCG CGCCGCCCTG TGCGGCATCG CCGCCGCCAT
  51 CCTCGCCGCC TGCCAAAGCA AGAGCATCCA AACCTTTCCG CAACCCGACA
 101 CATCCGTCAT CAACGGCCCG GACCGGCCGG TCGGCATCCC CGACCCCGCC
 151 GGAACGACGG TCGGCGGCGG CGGGGCCGTT TATACCGTTG TGCCGCACCT
 201 GTCCCTGCCC CACTGGGCGG CGCAGGATTT CGCCAAAAGC CTGCAATCCT
 251 TCCGCCTCGG CTGCGCCAAT TTGAAAAACC GCCAAGGCTG GCAGGATGTG
 301 TGCGCCCAAG CCTTTCAAAC CCCCGTCCAT TCCGTTCAGG CAAAACAGTT
 351 TTTTGAACGC TATTTCACGC CGTGGCAGGT TGCAGGCAAC GGAAGCCTTG
 401 CCGGTACGGT TACCGGCTAT TACGAGCCGG TGCTGAAGGG CGACGACAGG
 451 CGGACGGCAC AAGCCCGCTT CCCGATTTAC GGTATTCCCG ACGATTTTAT
 501 CTCCGTCCCC CTGCCTGCCG GTTTGCGGAG CGGAAAAGCC CTTGTCCGCA
 551 TCAGGCAGAC GGGAAAAAAC AGCGGCACAA TCGACAATAC CGGCGGCACA
 601 CATACCGCCG ACCTCTCCCA ATTCCCCATC ACTGCGCGCA CAACGGCAAT
 651 CAAAGGCAGG TTTGAAGGAA GCCGCTTCCT CCCCTACCAC ACGCGCAACC
 701 AAATCAACGG CGGCGCGCTT GACGGCAAAG CCCCGATACT CGGTTACGCC
 751 GAAGACCCCG TCGAACTTTT TTTTATGCAC ATCCAAGGCT CGGGCCGTCT
 801 GAAAACCCCG TCCGGCAAAT ACATCCGCAT CGGCTATGCC GACAAAAACG
 851 AACATCCCTA CGTTTCCATC GGACGCTATA TGGCGGACAA AGGCTACCTC
 901 AAGCTCGGGC AGACCTCGAT GCAGGGCATC AAAGCCTATA TGCAGCAAAA
 951 CCCGCAACGC CTCGCCGAAG TTTTGGGGCA AAACCCCAGC TATATCTTTT
```

-continued

```
1001 TCCGAGAGCT TACCGGAAGC AGCAATGACG GCCCTGTCGG CGCACTGGGC

1051 ACGCCGCTGA TGGGCGAGTA CGCCGGCGCA GTCGACCGGC ACTACATTAC

1101 CTTGGGCGCG CCCTTATTTG TCGCCACCGC CCATCCGGTT ACCCGCAAAG

1151 CCCTCAACCG CCTGATTATG GCGCAGGATA CCGGCAGCGC GATTAAAGGC

1201 GCGGTGCGCG TGGATTATTT TTGGGGATAC GGCGACGAAG CCGGCGAACT

1251 TGCCGGCAAA CAGAAAACCA CGGGATATGT CTGGCAGCTT CTGCCCAACG

1301 GTATGAAGCC CGAATACCGC CCGTAA
```

This corresponds to the amino acid sequence <SEQ ID 3074; ORF 919.a>:

```
a919.pep

  1 MKKYLFRAAL CGIAAAILAA CQSKSIQTFP QPDTSVINGP DRPVGIPDPA

 51 GTTVGGGGAV YTVVPHLSLP HWAAQDFAKS LQSFRLGCAN LKNRQGWQDV

101 CAQAFQTPVH SVQAKQFFER YFTPWQVAGN GSLAGTVTGY YEPVLKGDDR

151 RTAQARFPIY GIPDDFISVP LPAGLRSGKA LVRIRQTGKN SGTIDNTGGT

201 HTADLSQFPI TARTTAIKGR FEGSRFLPYH TRNQINGGAL DGKAPILGYA

251 EDPVELFFMH IQGSGRLKTP SGKYIRIGYA DKNEHPYVSI GRYMADKGYL

301 KLGQTSMQGI KAYMQQNPQR LAEVLGQNPS YIFFRELTGS SNDGPVGALG

351 TPLMGEYAGA VDRHYITLGA PLFVATAHPV TRKALNRLIM AQDTGSAIKG

401 AVRVDYFWGY GDEAGELAGK QKTTGYVWQL LPNGMKPEYR P*
```

m919/a919 ORFs 919 and 919.a showed a 98.6% identity in 441 aa overlap

```
                   10        20        30        40        50        60
m919.pep   MKKYLFRAALYGIAAAILAACQSKSIQTFPQPDTSVINGPDRPVGIPDPAGTTVGGGGAV
           |||||||||| |||||||||||||||||||||||||||||||||||||||||||||||||
a919       MKKYLFRAALCGIAAAILAACQSKSIQTFPQPDTSVINGPDRPVGIPDPAGTTVGGGGAV
                   10        20        30        40        50        60

                   70        80        90       100       110       120
m919.pep   YTVVPHLSLPHWAAQDFAKSLQSFRLGCANLKNRQGWQDVCAQAFQTPVHSFQAKQFFER
           ||||||||||||||||||||||||||||||||||||||||||||||||||||| ||||||
a919       YTVVPHLSLPHWAAQDFAKSLQSFRLGCANLKNRQGWQDVCAQAFQTPVHSVQAKQFFER
                   70        80        90       100       110       120

                  130       140       150       160       170       180
m919.pep   YFTPWQVAGNGSLAGTVTGYYEPVLKGDDRRTAQARFPIYGIPDDFISVPLPAGLRSGKA
           ||||||||||||||||||||||||||||||||||||||||||||||||||||||||||||
a919       YFTPWQVAGNGSLAGTVTGYYEPVLKGDDRRTAQARFPIYGIPDDFISVPLPAGLRSGKA
                  130       140       150       160       170       180

                  190       200       210       220       230       240
m919.pep   LVRIRQTGKNSGTIDNTGGTHTADLSRFPITARTTAIKGRFEGSRFLPYHTRNQINGGAL
           ||||||||||||||||||||||||:|||||||||||||||||||||||||||||||||||
a919       LVRIRQTGKNSGTIDNTGGTHTADLSQFPITARTTAIKGRFEGSRFLPYHTRNQINGGAL
                  190       200       210       220       230       240

                  250       260       270       280       290       300
m919.pep   DGKAPILGYAEDPVELFFMHIQGSGRLKTPSGKYIRIGYADKNEHPYVSIGRYMADKGYL
           ||||||||||||||||||||||||||||||||||||||||||||||||||||||||||||
a919       DGKAPILGYAEDPVELFFMHIQGSGRLKTPSGKYIRIGYADKNEHPYVSIGRYMADKGYL
                  250       260       270       280       290       300

                  310       320       330       340       350       360
m919.pep   KLGQTSMQGIKSYMRQNPQRLAEVLGQNPSYIFFRELAGSSNDGPVGALGTPLMGEYAGA
           |||||||||||:||:||||||||||||||||||||||||||||:||||||||||||||||
a919       KLGQTSMQGIKAYMQQNPQRLAEVLGQNPSYIFFRELTGSSNDGPVGALGTPLMGEYAGA
                  310       320       330       340       350       360
```

-continued

```
                370       380       390       400       410       420
m919.pep   VDRHYITLGAPLFVATAHPVTRKALNRLIMAQDTGSAIKGAVRVDYFWGYGDEAGELAGK
           ||||||||||||||||||||||||||||||||||||||||||||||||||||||||||||
a919       VDRHYITLGAPLFVATAHPVTRKALNRLIMAQDTGSAIKGAVRVDYFWGYGDEAGELAGK
                370       380       390       400       410       420

                430       440
m919.pep   QKTTGYVWQLLPNGMKPEYRPX
           ||||||||||||||||||||||
a919       QKTTGYVWQLLPNGMKPEYRPX
          430       440
```

121 and 121-1

The following partial DNA sequence was identified in *N. meningitidis* <SEQ ID 3075>:

m121.seq

```
   1 ATGGAAACAC AGCTTTACAT CGGCATCATG TCGGGAACCA GCATGGACGG
  51 GGCGGATGCC GTACTGATAC GGATGGACGG CGGCAAATGG CTGGGCGCGG
 101 AAGGGCACGC CTTTACCCCC TACCCCGGCA GGTTACGCCG CCAATTGCTG
 151 GATTTGCAGG ACACAGGCGC AGACGAACTG CACCGCAGCA GGATTTTGTC
 201 GCAAGAACTC AGCCGCCTAT ATGCGCAAAC CGCCGCCGAA CTGCTGTGCA
 251 GTCAAAACCT CGCACCGTCC GACATTACCG CCCTCGGCTG CCACGGGCAA
 301 ACCGTCCGAC ACGCGCCGGA ACACGGTTAC AGCATACAGC TTGCCGATTT
 351 GCCGCTGCTG GCGxxxxxxx xxxxxxxxxx xxxxxxxxxx xxxxxxxxxx
 401 xxxxxxxxxx xxxxxxxxxx xxxxxxxxxx xxxxxxxxxx xxxxxxxxxx
 451 xxxxxxxxxx xxxxxxxxxx xxxxxxxxxx xxxxxxxxxx xxxxxxxxxx
 501 xxxxxxxxxx xxxxxxxxxx xxxxxxxxxx xxxxxxxxxx xxxxxxxxxx
 551 xxxxxxxxxx xxxxxxxxxx xxxxxxxxxx xxxxxxxxxx xxxxxxxxxx
 601 xxxxxxCAGC TTCCTTACGA CAAAAACGGT GCAAAGTCGG CACAAGGCAA
 651 CATATTGCCG CAACTGCTCG ACAGGCTGCT CGCCCACCCG TATTTCGCAC
 701 AACGCCACCC TAAAAGCACG GGGCGCGAAC TGTTTGCCAT AAATTGGCTC
 751 GAAACCTACC TTGACGGCGG CGAAAACCGA TACGACGTAT TGCGGACGCT
 801 TTCCCGTTTT ACCGCGCAAA CCGTTTGCGA CGCCGTCTCA CACGCAGCGG
 851 CAGATGCCCG TCAAATGTAC ATTTGCGACG GCGGCATCCG CAATCCTGTT
 901 TTAATGGCGG ATTTGGCAGA ATGTTTCGGC ACACGCGTTT CCCTGCACAG
 951 CACCGCCGAC CTGAACCTCG ATCCGCAATG GGTGGAAGCC GCCGnATTTG
1001 CGTGGTTGGC GGCGTGTTGG ATTAATCGCA TTCCCGGTAG TCCGCACAAA
1051 GCAACCGGCG CATCCAAACC GTGTATTCTG AnCGCGGGAT ATTATTATTG
1101 A
```

This corresponds to the amino acid sequence <SEQ ID 3076; ORF 121>:

m121.pep

```
  1 METQLYIGIM SGTSMDGADA VLIRMDGGKW LGAEGHAFTP YPGRLRRQLL
 51 DLQDTGADEL HRSRILSQEL SRLYAQTAAE LLCSQNLAPS DITALGCHGQ
```

-continued

```
101 TVRHAPEHGY SIQLADLPLL Axxxxxxxxx xxxxxxxxxx xxxxxxxxxx

151 xxxxxxxxxx xxxxxxxxxx xxxxxxxxxx xxxxxxxxxx xxxxxxxxxx

201 xxQLPYDKNG AKSAQGNILP QLLDRLLAHP YFAQRHPKST GRELFAINWL

251 ETYLDGGENR YDVLRTLSRF TAQTVCDAVS HAAADARQMY ICDGGIRNPV

301 LMADLAECFG TRVSLHSTAD LNLDPQWVEA AXFAWLAACW INRIPGSPHK

351 ATGASKPCIL XAGYYY*
```

The following partial DNA sequence was identified in *N. gonorrhoeae* <SEQ ID 3077>:

g121.seq

```
   1 ATGGAAACAC AGCTTTACAT CGGCATTATG TCGGGAACCA GTATGGACGG

  51 GGCGGATGCC GTGCTGGTAC GGATGGACGG CGGCAAATGG CTGGGCGCGG

 101 AAGGGCACGC CTTTACCCCC TACCCTGACC GGTTGCGCCG CAAATTGCTG

 151 GATTTGCAGG ACACAGGCAC AGACGAACTG CACCGCAGCA GGATGTTGTC

 201 GCAAGAACTC AGCCGCCTGT ACGCGCAAAC CGCCGCCGAA CTGCTGTGCA

 251 GTCAAAACCT CGCTCCGTGC GACATTACCG CCCTCGGCTG CCACGGGCAA

 301 ACCGTCCGAC ACGCGCCGGA ACACGGTtac AGCATACAGC TTGCCGATTT

 351 GCCGCTGCTG GCGGAACTGa cgcggatttT TACCGTCggc gacttcCGCA

 401 GCCGCGACCT TGCTGCCGGC GGacaAGGTG CGCCGCTCGT CCCCGCCTTT

 451 CACGAAGCCC TGTTCCGCGA TGACAGGGAA ACACGCGTGG TACTGAACAT

 501 CGGCGGGATT GCCAACATCA GCGTACTCCC CCCCGGCGCA CCCGCCTTCG

 551 GCTTCGACAC AGGGCCGGGC AATATGCTGA TGGAcgcgtg gacgcaggca

 601 cacTGGcagc TGCCTTACGA CAAAAacggt gcAAAGgcgg cacAAGGCAA

 651 catatTGCcg cAACTGCTCG gcaggctGCT CGCCcaccCG TATTTCTCAC

 701 AACCCCaccc aaAAAGCACG GGgcGCGaac TgtttgcccT AAattggctc

 751 gaaacctAcc ttgacggcgg cgaaaaccga tacgacgtat tgcggacgct

 801 ttcccgattc accgcgcaaA ccgTttggga cgccgtctca CACGCAGCGG

 851 CAGATGCCCG TCAAATGTAC ATTTGCGGCG GCGGCATCCG CAATCCTGTT

 901 TTAATGGCGG ATTTGGCAGA ATGTTTCGGC ACACGCGTTT CCCTGCACAG

 951 CACCGCCGAA CTGAACCTCG ATCCTCAATG GGTGGAGGCG gccgCATTtg

1001 cgtggttggC GGCGTGTTGG ATTAACCGCA TTCCCGGTAG TCCGCACAAA

1051 GCGACCGGCG CATCCAAACC GTGTATTCTG GGCGCGGGAT ATTATTATTG

1101 A
```

This corresponds to the amino acid sequence <SEQ ID 3078; ORF 121.ng>:

g121.pep

```
  1 METQLYIGIM SGTSMDGADA VLVRMDGGKW LGAEGHAFTP YPDRLRRKLL

 51 DLQDTGTDEL HRSRMLSQEL SRLYAQTAAE LLCSQNLAPC DITALGCHGQ
```

-continued

```
101 TVRHAPEHGY SIQLADLPLL AELTRIFTVG DFRSRDLAAG GQGAPLVPAF

151 HEALFRDDRE TRVVLNIGGI ANISVLPPGA PAFGFDTGPG NMLMDAWTQA

201 HWQLPYDKNG AKAAQGNILP QLLGRLLAHP YFSQPHPKST GRELFALNWL

251 ETYLDGGENR YDVLRTLSRF TAQTVWDAVS HAAADARQMY ICGGGIRNPV

301 LMADLAECFG TRVSLHSTAE LNLDPQWVEA AAFAWLAACW INRIPGSPHK

351 ATGASKPCIL GAGYYY*
```

ORF 121 shows 73.5% identity over a 366 aa overlap with a predicted ORF (ORF121.ng) from *N. gonorrhoeae*:

```
                      10        20        30        40        50        60
m121.pep      METQLYIGIMSGTSMDGADAVLIRMDGGKWLGAEGHAFTPYPGRLRRQLLDLQDTGADEL
              ||||||||||||||||||||||:||||||||||||||||||| ||||:||||||||:|||
g121          METQLYIGIMSGTSMDGADAVLVRMDGGKWLGAEGHAFTPYPDRLRRKLLDLQDTGTDEL
                      10        20        30        40        50        60

                      70        80        90       100       110       120
m121.pep      HRSRILSQELSRLYAQTAAELLCSQNLAPSDITALGCHGQTVRHAPEHGYSIQLADLPLL
              ||||:|||||||||||||||||||||||| ||||||||||||||||||||||||||||||
g121          HRSRMLSQELSRLYAQTAAELLCSQNLAPCDITALGCHGQTVRHAPEHGYSIQLADLPLL
                      70        80        90       100       110       120

                     130       140       150       160       170       180
m121.pep      AXXXXXXXXXXXXXXXXXXXXXXXXXXXXXXXXXXXXXXXXXXXXXXXXXXXXXXXXXXX
              |  :   :                                :
g121          AELTRIFTVGDFRSRDLAAGGQGAPLVPAFHEALFRDDRETRVVLNIGGIANISVLPPDA
                     130       140       150       160       170       180

                     190       200       210       220       230       240
m121.pep      XXXXXXXXXXXXXXXXXXXXXXQLPYDKNGAKSAQGNILPQLLDRLLAHPYFAQRHPKST
                    :          :    ||||||||||:|||||||||| ||||||||:| |||||
g121          PAFGFDTGPGNMLMDAWTQAHWQLPYDKNGAKAAQGNILPQLLGRLLAHPYFSQPHPKST
                     190       200       210       220       230       240

                     250       260       270       280       290       300
m121.pep      GRELFAINWLETYLDGGENRYDVLRTLSRFTAQTVCDAVSHAAADARQMYICDGGIRNPV
              ||||||:|||||||||||||||||||||||||||| |||||||||||||||| |||||||
g121          GRELFALNWLETYLDGGENRYDVLRTLSRFTAQTVWDAVSHAAADARQMYICGGGIRNPV
                     250       260       270       280       290       300

                     310       320       330       340       350       360
m121.pep      LMADLAECFGTRVSLHSTADLNLDPQWVEAAXFAWLAACWINRIPGSPHKATGASKPCIL
              |||||||||||||||||||:||||||||||| ||||||||||||||||||||||||||||
g121          LMADLAECFGTRVSLHSTAELNLDPQWVEAAAFAWLAACWINRIPGSPHKATGASKPCIL
                     310       320       330       340       350       360

m121.pep      XAGYYYX
               ||||||
g121          GAGYYYX
```

The following partial DNA sequence was identified in *N. meningitidis* <SEQ ID 3079>:

a121.seq

```
  1 ATGGAAACAC AGCTTTACAT CGGCATCATG TCGGGAACCA GCATGGACGG

 51 GGCGGATGCC GTACTGATAC GGATGGACGG CGGCAAATGG CTGGGCGCGG

101 AAGGGCACGC CTTTACCCCC TACCCCGGCA GGTTACGCCG CAAATTGCTG

151 GATTTGCAGG ACACAGGCGC GGACGAACTG CACCGCAGCA GGATGTTGTC

201 GCAAGAACTC AGCCGCCTGT ACGCGCAAAC CGCCGCCGAA CTGCTGTGCA

251 GTCAAAACCT CGCGCCGTCC GACATTACCG CCCTCGGCTG CCACGGGCAA

301 ACCGTCAGAC ACGCGCCGGA ACACAGTTAC AGCGTACAGC TTGCCGATTT

351 GCCGCTGCTG GCGGAACGGA CTCAGATTTT TACCGTCGGC GACTTCCGCA

401 GCCGCGACCT TGCGGCCGGC GGACAAGGCG CGCCGCTCGT CCCCGCCTTT
```

-continued

```
 451 CACGAAGCCC TGTTCCGCGA CGACAGGGAA ACACGCGCGG TACTGAACAT

 501 CGGCGGGATT GCCAACATCA GCGTACTCCC CCCCGACGCA CCCGCCTTCG

 551 GCTTCGACAC AGGACCGGGC AATATGCTGA TGGACGCGTG GATGCAGGCA

 601 CACTGGCAGC TTCCTTACGA CAAAAACGGT GCAAAGGCGG CACAAGGCAA

 651 CATATTGCCG CAACTGCTCG ACAGGCTGCT CGCCCACCCG TATTTCGCAC

 701 AACCCCACCC TAAAAGCACG GGGCGCGAAC TGTTTGCCCT AAATTGGCTC

 751 GAAACCTACC TTGACGGCGG CGAAAACCGA TACGACGTAT TGCGGACGCT

 801 TTCCCGATTC ACCGCGCAAA CCGTTTTCGA CGCCGTCTCA CACGCAGCGG

 851 CAGATGCCCG TCAAATGTAC ATTTGCGGCG GCGGCATCCG CAATCCTGTT

 901 TTAATGGCGG ATTTGGCAGA ATGTTTCGGC ACACGCGTTT CCCTGCACAG

 951 CACCGCCGAA CTGAACCTCG ATCCGCAATG GGTAGAAGCC GCCGCGTTCG

1001 CATGGATGGC GGCGTGTTGG GTCAACCGCA TTCCCGGTAG TCCGCACAAA

1051 GCAACCGGCG CATCCAAACC GTGTATTCTG GGCGCGGGAT ATTATTATTG

1101 A
```

This corresponds to the amino acid sequence <SEQ ID 3080; ORF 121.a>:

```
a121.pep

  1 METQLYIGIM SGTSMDGADA VLIRMDGGKW LGAEGHAFTP YPGRLRRKLL

 51 DLQDTGADEL HRSRMLSQEL SRLYAQTAAE LLCSQNLAPS DITALGCHGQ

101 TVRHAPEHSY SVQLADLPLL AERTQIFTVG DFRSRDLAAG GQGAPLVPAF

151 HEALFRDDRE TRAVLNIGGI ANISVLPPDA PAFGFDTGPG NMLMDAWMQA

201 HWQLPYDKNG AKAAQGNILP QLLDRLLAHP YFAQPHPKST GRELFALNWL

251 ETYLDGGENR YDVLRTLSRF TAQTVFDAVS HAAADARQMY ICGGGIRNPV

301 LMADLAECFG TRVSLHSTAE LNLDPQWVEA AAFAWMAACW VNRIPGSPHK

351 ATGASKPCIL GAGYYY*
```

m121/a121 ORFs 121 and 121.a showed a 74.0% identity in 366 aa overlap

```
                   10        20        30        40        50        60
m121.pep   METQLYIGIMSGTSMDGADAVLIRMDGGKWLGAEGHAFTPYPGRLRRQLLDLQDTGADEL
           |||||||||||||||||||||||||||||||||||||||||||||||:||||||||||||
a121       METQLYIGIMSGTSMDGADAVLIRMDGGKWLGAEGHAFTPYPGRLRRKLLDLQDTGADEL
                   10        20        30        40        50        60

                   70        80        90       100       110       120
m121.pep   HRSRILSQELSRLYAQTAAELLCSQNLAPSDITALGCHGQTVRHAPEHGYSIQLADLPLL
           ||||:||||||||||||||||||||||||||||||||||||||||||||:||:|||||||
a121       HRSRMLSQELSRLYAQTAAELLCSQNLAPSDITALGCHGQTVRHAPEHSYSVQLADLPLL
                   70        80        90       100       110       120

                  130       140       150       160       170       180
m121.pep   AXXXXXXXXXXXXXXXXXXXXXXXXXXXXXXXXXXXXXXXXXXXXXXXXXXXXXXXXXXX
           |  :   :                                :                   
a121       AERTQIFTVGDFRSRDLAAGGQGAPLVPAFHEALFRDDRETRAVLNIGGIANISVLPPDA
                  130       140       150       160       170       180

                  190       200       210       220       230       240
m121.pep   XXXXXXXXXXXXXXXXXXXXXXQLPYDKNGAKSAQGNILPQLLDRLLAHPYFAQRHPKST
                 :               ||||||||||:|||||||||||||||||||||| |||||
a121       PAFGFDTGPGNMLMDAWMQAHWQLPYDKNGAKAAQGNILPQLLDRLLAHPYFAQPHPKST
                  190       200       210       220       230       240
```

-continued

```
                  250       260       270       280       290       300
m121.pep   GRELFAINWLETYLDGGENRYDVLRTLSRFTAQTVCDAVSHAAADARQMYICDGGIRNPV
           ||||||:|||||||||||||||||||||||||||| |||||||||||||||| |||||||
a121       GRELFALNWLETYLDGGENRYDVLRTLSRFTAQTVFDAVSHAAADARQMYICGGGIRNPV
                  250       260       270       280       290       300


                  310       320       330       340       350       360
m121.pep   LMADLAECFGTRVSLHSTADLNLDPQWVEAAXFAWLAACWINRIPGSPHKATGASKPCIL
           |||||||||||||||||||:||||||||||| |||:||||:|||||||||||||||||||
a121       LMADLAECFGTRVSLHSTAELNLDPQWVEAAAFAWMAACWVNRIPGSPHKATGASKPCIL
                  310       320       330       340       350       360


m121.pep   XAGYYYX
            ||||||
a121       GAGYYYX
```

Further work revealed the DNA sequence identified in *N. meningitidis* <SEQ ID 3081>:

```
m121-1.seq
   1 ATGGAAACAC AGCTTTACAT CGGCATCATG TCGGGAACCA GCATGGACGG
  51 GGCGGATGCC GTACTGATAC GGATGGACGG CGGCAAATGG CTGGGCGCGG
 101 AAGGGCACGC CTTTACCCCC TACCCCGGCA GGTTACGCCG CCAATTGCTG
 151 GATTTGCAGG ACACAGGCGC AGACGAACTG CACCGCAGCA GGATTTTGTC
 201 GCAAGAACTC AGCCGCCTAT ATGCGCAAAC CGCCGCCGAA CTGCTGTGCA
 251 GTCAAAACCT CGCACCGTCC GACATTACCG CCCTCGGCTG CCACGGGCAA
 301 ACCGTCCGAC ACGCGCCGGA ACACGGTTAC AGCATACAGC TTGCCGATTT
 351 GCCGCTGCTG GCGGAACGGA CGCGGATTTT TACCGTCGGC GACTTCCGCA
 401 GCCGCGACCT TGCGGCCGGC GGACAAGGCG CGCCACTCGT CCCCGCCTTT
 451 CACGAAGCCC TGTTCCGCGA CAACAGGGAA ACACGCGCGG TACTGAACAT
 501 CGGCGGGATT GCCAACATCA GCGTACTCCC CCCCGACGCA CCCGCCTTCG
 551 GCTTCGACAC AGGGCCGGGC AATATGCTGA TGGACGCGTG GACGCAGGCA
 601 CACTGGCAGC TTCCTTACGA CAAAAACGGT GCAAAGGCGG CACAAGGCAA
 651 CATATTGCCG CAACTGCTCG ACAGGCTGCT CGCCCACCCG TATTTCGCAC
 701 AACCCCACCC TAAAAGCACG GGGCGCGAAC TGTTTGCCCT AAATTGGCTC
 751 GAAACCTACC TTGACGGCGG CGAAAACCGA TACGACGTAT TGCGGACGCT
 801 TTCCCGTTTT ACCGCGCAAA CCGTTTGCGA CGCCGTCTCA CACGCAGCGG
 851 CAGATGCCCG TCAAATGTAC ATTTGCGGCG GCGGCATCCG CAATCCTCTT
 901 TTAATGGCGG ATTTGGCAGA ATGTTTCGGC ACACGCGTTT CCCTGCACAG
 951 CACCGCCGAC CTGAACCTCG ATCCGCAATG GGTGGAAGCC GCCGNATTTG
1001 CGTGGTTGGC GGCGTGTTGG ATTAATCGCA TTCCCGGTAG TCCGCACAAA
1051 GCAACCGGCG CATCCAAACC GTGTATTCTG ANCGCGGGAT ATTATTATTG
1101 A
```

This corresponds to the amino acid sequence <SEQ ID 3082; ORF 121-1>:

m121-1.pep

```
  1 METQLYIGIM SGTSMDGADA VLIRMDGGKW LGAEGHAFTP YPGRLRRQLL

 51 DLQDTGADEL HRSRILSQEL SRLYAQTAAE LLCSQNLAPS DITALGCHGQ

101 TVRHAPEHGY SIQLADLPLL AERTRIFTVG DFRSRDLAAG GQGAPLVPAF

151 HEALFRDNRE TRAVLNIGGI ANISVLPPDA PAFGFDTGPG NMLMDAWTQA

201 HWQLPYDKNG AKAAQGNILP QLLDRLLAHP YFAQPHPKST GRELFALNWL

251 ETYLDGGENR YDVLRTLSRF TAQTVCDAVS HAAADARQMY ICGGGIRNPV

301 LMADLAECFG TRVSLHSTAD LNLDPQWVEA AXFAWLAACW INRIPGSPHK

351 ATGASKPCIL XAGYYY*
```

m121-1/g121 ORFs 121-1 and 121.ng showed a 95.6% identity in 366 aa overlap

```
                      10        20        30        40        50        60
m121-1.pep    METQLYIGIMSGTSMDGADAVLIRMDGGKWLGAEGHAFTPYPGRLRRQLLDLQDTGADEL
              ||||||||||||||||||||||||:||||||||||||||||| ||||:||||||||:|||
g121          METQLYIGIMSGTSMDGADAVLVRMDGGKWLGAEGHAFTPYPDRLRRKLLDLQDTGTDEL
                      10        20        30        40        50        60

                      70        80        90       100       110       120
m121-1.pep    HRSRILSQELSRLYAQTAAELLCSQNLAPSDITALGCHGQTVRHAPEHGYSIQLADLPLL
              ||||:||||||||||||||||||| |||||||||||||||||||||||||||||||||||
g121          HRSRMLSQELSRLYAQTAAELLCSQNLAPCDITALGCHGQTVRHAPEHGYSIQLADLPLL
                      70        80        90       100       110       120

                     130       140       150       160       170       180
m121-1.pep    AERTQIFTVGDFRSRDLAAGGQGAPLVPAFHEALFRDNRETRAVLNIGGIANISVLPPDA
              || |||||||||||||||||||||||||||||||:||||:|||||||||||||||||| |
g121          AELTQIFTVGDFRSRDLAAGGQGAPLVPAFHEALFRDDRETRVVLNIGGIANISVLPPGA
                     130       140       150       160       170       180

                     190       200       210       220       230       240
m121-1.pep    PAFGFDTGPGNMLMDAWMQAHWQLPYDKNGAKAAQGNILPQLLDRLLAHPYFAQPHPKST
              |||||||||||||||||||||||||||||||||||||||||||| |||||||:|||||||
g121          PAFGFDTGPGNMLMDAWMQAHWQLPYDKNGAKAAQGNILPQLLGRLLAHPYFSQPHPKST
                     190       200       210       220       230       240

                     250       260       270       280       290       300
m121-1.pep    GRELFAINWLETYLDGGENRYDVLRTLSRFTAQTVCDAVSHAAADARQMYICDGGIRNPV
              |||||||||||||||||||||||||||||||||| |||||||||||||||||||||||||
g121          GRELFAINWLETYLDGGENRYDVLRTLSRFTAQTVWDAVSHAAADARQMYICDGGIRNPV
                     250       260       270       280       290       300

                     310       320       330       340       350       360
m121-1.pep    LMADLAECFGTRVSLHSTADLNLDPQWVEAAXFAWLAACWINRIPGSPHKATGASKPCIL
              ||||||||||||||||||:||||||||||| |||||||||||||||||||||||||||||
g121          LMADLAECFGTRVSLHSTAELNLDPQWVEAAAFAWLAACWINRIPGSPHKATGASKPCIL
                     310       320       330       340       350       360

m121-1.pep    XAGYYYX
               ||||||
g121          GAGYYYX
```

The following DNA sequence was identified in *N. meningitidis* <SEQ ID 3083>:

a121-1.seq

```
  1 ATGGAAACAC AGCTTTACAT CGGCATCATG TCGGGAACCA GCATGGACGG

 51 GGCGGATGCC GTACTGATAC GGATGGACGG CGGCAAATGG CTGGGCGCGG

101 AAGGGCACGC CTTTACCCCC TACCCCGGCA GGTTACGCCG CAAATTGCTG

151 GATTTGCAGG ACACAGGCGC GGACGAACTG CACCGCAGCA GGATGTTGTC

201 GCAAGAACTC AGCCGCCTGT ACGCGCAAAC CGCCGCCGAA CTGCTGTGCA

251 GTCAAAACCT CGCGCCGTCC GACATTACCG CCCTCGGCTG CCACGGGCAA
```

-continued

```
 301 ACCGTCAGAC ACGCGCCGGA ACACAGTTAC AGCGTACAGC TTGCCGATTT

 351 GCCGCTGCTG GCGGAACGGA CTCAGATTTT TACCGTCGGC GACTTCCGCA

 401 GCCGCGACCT TGCGGCCGGC GGACAAGGCG CGCCGCTCGT CCCCGCCTTT

 451 CACGAAGCCC TGTTCCGCGA CGACAGGGAA ACACGCGCGG TACTGAACAT

 501 CGGCGGGATT GCCAACATCA GCGTACTCCC CCCCGACGCA CCCGCCTTCG

 551 GCTTCGACAC AGGACCGGGC AATATGCTGA TGGACGCGTG GATGCAGGCA

 601 CACTGGCAGC TTCCTTACGA CAAAAACGGT GCAAAGGCGG CACAAGGCAA

 651 CATATTGCCG CAACTGCTCG AGAGGCTGCT CGCCCACCCG TATTTCGCAC

 701 AACCCCACCC TAAAAGCACG GGGCGCGAAC TGTTTGCCCT AAATTGGCTC

 751 GAAACCTACC TTGACGGCGG CGAAAACCGA TACGACGTAT TGCGGACGCT

 801 TTCCCGATTC ACCGCGCAAA CCGTTTTCGA CGCCGTCTCA CACGCAGCGG

 851 CAGATGCCCG TCAAATGTAC ATTTGCGGCG GCGGCATCCG CAATCCTGTT

 901 TTAATGGCGG ATTTGGCAGA ATGTTTCGGC ACACGCGTTT CCCTGCACAG

 951 CACCGCCGAA CTGAACCTCG ATCCGCAATG GGTAGAAGCC GCCGCGTTCG

1001 CATGGATGGC GGCGTGTTGG GTCAACCGCA TTCCCGGTAG TCCGCACAAA

1051 GCAACCGGCG CATCCAAACC GTGTATTCTG GGCGCGGGAT ATTATTATTG

1101 A
```

This corresponds to the amino acid sequence <SEQ ID 3084; ORF 121-1.a>:

a121-1.pep

```
  1 METQLYIGIM SGTSMDGADA VLIRMDGGKW LGAEGHAFTP YPGRLRRKLL

 51 DLQDTGADEL HRSRMLSQEL SRLYAQTAAE LLCSQNLAPS DITALGCHGQ

101 TVRHAPEHSY SVQLADLPLL AERTQIFTVG DFRSRDLAAG GQGAPLVPAF

151 HEALFRDDRE TRAVLNIGGI ANISVLPPDA PAFGFDTGPG NMLMDAWMQA

201 HWQLPYDKNG AKAAQGNILP QLLDRLLAHP YFAQPHPKST GRELFALNWL

251 ETYLDGGENR YDVLRTLSRF TAQTVFDAVS HAAADARQMY ICGGGIRNPV

301 LMADLAECFG TRVSLHSTAE LNLDPQWVEA AAFAWMAACW VNRIPGSPHK

351 ATGASKPCIL GAGYYY*
```

m121-1/a121-1 ORFs 121-1 and 121-1.a showed a 96.4% identity in 366 aa overlap

```
                    10        20        30        40        50        60
m121-1.pep  METQLYIGIMSGTSMDGADAVLIRMDGGKWLGAEGHAFTPYPGRLRRQLLDLQDTGADEL
            |||||||||||||||||||||||||||||||||||||||||||||||||:||||||||||
a121-1      METQLYIGIMSGTSMDGADAVLIRMDGGKWLGAEGHAFTPYPGRLRRKLLDLQDTGADEL
                    10        20        30        40        50        60

                    70        80        90       100       110       120
m121-1.pep  HRSRILSQELSRLYAQTAAELLCSQNLAPSDITALGCHGQTVRHAPEHGYSIQLADLPLL
            ||||:|||||||||||||||||||||||||||||||||||||||||||:||:||||||||
a121-1      HRSRMLSQELSRLYAQTAAELLCSQNLAPSDITALGCHGQTVRHAPEHSYSVQLADLPLL
                    70        80        90       100       110       120

                   130       140       150       160       170       180
m121-1.pep  AERTRIFTVGDFRSRDLAAGGQGAPLVPAFHEALFRDNRETRAVLNIGGIANISVLPPDA
            ||||:||||||||||||||||||||||||||||||||:||||||||||||||||||||||
a121-1      AERTQIFTVGDFRSRDLAAGGQGAPLVPAFHEALFRDDRETRAVLNIGGIANISVLPPDA
                   130       140       150       160       170       180
```

-continued

```
                       190       200       210       220       230       240
m121-1.pep    PAFGFDTGPGNMLMDAWTQAHWQLPYDKNGAKAAQGNILPQLLDRLLAHPYFAQPHPKST
              ||||||||||||||||| ||||||||||||||||||||||||||||||||||||||||||
a121-1        PAFGFDTGPGNMLMDAWMQAHWQLPYDKNGAKAAQGNILPQLLDRLLAHPYFAQPHPKST
                       190       200       210       220       230       240

                       250       260       270       280       290       300
m121-1.pep    GRELFAINWLETYLDGGENRYDVLRTLSRFTAQTVCDAVSHAAADARQMYICDGGIRNPV
              ||||||||||||||||||||||||||||||||||| ||||||||||||||||||||||||
a121-1        GRELFAINWLETYLDGGENRYDVLRTLSRFTAQTVFDAVSHAAADARQMYICDGGIRNPV
                       250       260       270       280       290       300

                       310       320       330       340       350       360
m121-1.pep    LMADLAECFGTRVSLHSTADLNLDPQWVEAAXFAWLAACWINRIPGSPHKATGASKPCIL
              |||||||||||||||||||:|||||||||| |||:||||:||||||||||||||||||||
a121         LMADLAECFGTRVSLHSTAELNLDPQWVEAAAFAWMAACWVNRIPGSPHKATGASKPCIL
                       310       320       330       340       350       360

m121-1.pep    XAGYYYX
               ||||||
a121          GAGYYYX
```

128 and 128-1

The following partial DNA sequence was identified in *N. meningitidis* <SEQ ID 3085>:

m128.seq (partial)

```
  1 ATGACTGACA ACGCACTGCT CCATTTGGGC GAAGAACCCC GTTTTGATCA
 51 AATCAAAACC GAAGACATCA AACCCGCCCT GCAAACCGCC ATCGCCGAAG
101 CGCGCGAACA AATCGCCGCC ATCAAAGCCC AAACGCACAC CGGCTGGGCA
151 AACACTGTCG AACCCCTGAC CGGCATCACC GAACGCGTCG GCAGGATTTG
201 GGGCGTGGTG TCGCACCTCA ACTGCGTCGC CGACACGCCC GAACTGCGCG
251 CCGTCTATAA CGAACTGATG CCCGAAATCA CCGTCTTCTT CACCGAAATC
301 GGACAAGACA TCGAGCTGTA CAACCGCTTC AAAACCATCA AAAATTCCCC
351 CGAATTCGAC ACCCTCTCCC CCGCACAAAA AACCAAACTC AACCAC
  1 TACGCCAGCG AAAAACTGCG CGAAGCCAAA TACGCGTTCA GCGAAACCGA
 51 wGTCAAAAAA TAyTTCCCyG TCGGCAAwGT ATTAAACGGA CTGTTCGCCC
101 AAmTCAAAAA ACTmTACGGC ATCGGATTTA CCGAAAAAAC yGTCCCCGTC
151 TGGCACAAAG ACGTGCGCTA TTkTGAATTG CAACAAAACG GCGAAmCCAT
201 AGGCGGCGTT TATATGGATT TGTACGCACG CGAAGGCAAA CGCGGCGGCG
251 CGTGGATGAA CGACTACAAA GGCCGCCGCC GTTTTTCAGA CGGCACGCTG
301 CAAyTGCCCA CCGCCTACCT CGTCTGCAAC TTCGCCCCAC CCGTCGGCGG
351 CAGGGAAGCC CGCyTGAGCC ACGACGAAAT CCTCATCCTC TTCCACGAAA
401 CCGGACACGG GCTGCACCAC CTGCTTACCC AAGTGGACGA ACTGGGCGTA
451 TCCGGCATCA ACGGCGTAkA ATGGGACGCG GTCGAACTGC CCAGCCAGTT
501 TATGGAAAAT TTCGTTTGGG AATACAATGT CTTGGCACAA mTGTCAGCCC
551 ACGAAGAAAC CGGcgTTCCC yTGCCGAAAG AACTCTTsGA CAAAwTGCTC
601 GCCGCCAAAA ACTTCCAAsG CGGCATGTTC yTsGTCCGGC AAwTGGAGTT
651 CGCCCTCTTT GATATGATGA TTTACAGCGA AGACGACGAA GGCCGTCTGA
701 AAAACTGGCA ACAGGTTTTA GACAGCGTGC GCAAAAAAGT CGCCGTCATC
751 CAGCCGCCCG AATACAACCG CTTCGCCTTG AGCTTCGGCC ACATCTTCGC
801 AGGCGGCTAT TCCGCAGCTn ATTACAGCTA CGCGTGGGCG GAAGTATTGA
```

-continued

```
 851 GCGCGGACGC ATACGCCGCC TTTGAAGAAA GCGACGATGT CGCCGCCACA
 901 GGCAAACGCT TTTGGCAGGA AATCCTCGCC GTCGGGGnAT CGCGCAGCGG
 951 nGCAGAATCC TTCAAAGCCT TCCGCGGCCG CGAACCGAGC ATAGACGCAC
1001 TCTTGCGCCA CAGCGGTTTC GACAACGCGG TCTGA
```

This corresponds to the amino acid sequence <SEQ ID 3086; ORF 128>:

m128.pep (partial)

```
  1 MTDNALLHLG EEPRFDQIKT EDIKPALQTA IAEAREQIAA IKAQTHTGWA
 51 NTVEPLTGIT ERVGRIWGVV SHLNCVADTP ELRAVYNELM PEITVFFTEI
101 GQDIELYNRF KTIKNSPEFD TLSPAQKTKL NH
//
  1 YASEKLREAK YAFSETXVKK YFPVGXVLNG LFAQXKKLYG IGFTEKTVPV
 51 WHKDVRYXEL QQNGEXIGGV YMDLYAREGK RGGAWMNDYK GRRRFSDGTL
101 QLPTAYLVCN FAPPVGGREA RLSHDEILIL FHETGHGLHH LLTQVDELGV
151 SGINGVXWDA VELPSQFMEN FVWEYNVLAQ XSAHEETGVP LPKELXDKXL
201 AAKNFQXGMF XVRQXEFALF DMMIYSEDDE GRLKNWQQVL DSVRKKVAVI
251 QPPEYNRFAL SFGHIFAGGY SAAXYSYAWA EVLSADAYAA FEESDDVAAT
301 GKRFWQEILA VGXSRSGAES FKAFRGREPS IDALLRHSGF DNAV*
```

The following partial DNA sequence was identified in *N. gonorrhoeae* <SEQ ID 3087>:

g128.seq

```
  1 atgattgaca acgCActgct ccacttgggc gaagaacccC GTTTTaatca
 51 aatccaaacc gaagACAtca AACCCGCCGT CCAAACCGCC ATCGCCGAAG
101 CGCGCGGACA AATCGCCGCC GTCAAAGCGC AAACGCACAC CGGCTGGGCG
151 AACACCGTCG AGCGTCTGAC CGGCATCACC GAACGCGTCG GCAGGATTTG
201 GGGCGTCGTG TCCCATCTCA ACTCCGTCGT CGACACGCCC GAACTGCGCG
251 CCGTCTATAA CGAACTGATG CCTGAAATCA CCGTCTTCTT CACCGAAATC
301 GGACAAGACA TCGAACTGTA CAACCGCTTC AAAACCATCA AAAATTCCCC
351 CGAATTTGCA ACGCTTTCCC CCGCACAAAA AACCAAGCTC GATCACGACC
401 TGCGCGATTT CGTATTGAGC GGCGCGGAAC TGCCGCCCGA ACGGCAGGCA
451 GAACTGGCAA AACTGCAAAC CGAAGGCGCG CAACTTTCCG CCAAATTCTC
501 CCAAAACGTC CTAGACGCGA CCGACGCGTT CGGCATTTAC TTTGACGATG
551 CCGCACCGCT TGCCGGCATT CCCGAAGACG CGCTCGCCAT GTTTGCCGCC
601 GCCGCGCAAA GCGAAGGCAA AACAGGTTAC AAAATCGGCT TGCAGATTCC
651 GCACTACCTT GCCGTTATCC AATACGCCGG CAACCGCGAA CTGCGCGAAC
701 AAATCTACCG CGCCTACGTT ACCCGTGCCA GCGAACTTTC AAACGACGGC
751 AAATTCGACA ACACCGCCAA CATCGACCGC ACGCTCGAAA ACGCATTGAA
```

-continued

```
 801 AACCGccaaa cTGCTCGGCT TTAAAAATTA CGCCGAATTG TCGCTGGCAA
 851 CCAAAATGGC GGACACGCCC GAACAGGTTT TAAACTTCCT GCACGACCTC
 901 GCCCGCCGCG CCAAACCCTA CGCCGAAAAA GACCTCGCCG AAGTCAAAGC
 951 CTTCGCCCGC GAACACCTCG GTCTCGCCGA CCCGCAGCCG TGGGACTTGA
1001 GCTACGCCGG CGAAAAACTG CGCGAAGCCA AATACGCATT CAGCGAAACC
1051 GAAGTCAAAA AATACTTCCC CGTCGGCAAA GTTCTGGCAG GCCTGTTCGC
1101 CCAAATCAAA AAACTCTACG GCATCGGATT CGCCGAAAAA ACCGTTCCCG
1151 TCTGGCACAA AGACGTGCGC TATTTTGAAT TGCAACAAAA CGGCAAAACC
1201 ATCGGCGGCG TTTATATGGA TTTGTACGCA CGCGAAGGCA AACGCGGCGG
1251 CGCGTGGATG AACGACtaca AAGGCCGCCG CCGCTTTGCC GACGgcacGC
1301 TGCAACTGCC CACCGCCTAC CTCGTCTGCA ACTTCGCCCC GCCCGTCGGC
1351 GGCAAAGAAG CGCGTTTAAG CCACGACGAA ATCCTCACCC TCTTCCACGA
1401 AacCGGCCAC GGACTGCACC ACCTGCTTAC CCAAGTGGAC GAACTGGGCG
1451 TGTCCGGCAT CAAcggcgtA GAATGGGACG CGGTCGAACT GCCCAGCCAG
1501 TTTATGGAAA ACTTCGTTTG GGAATACAAT GTATTGGCAC AAATGTCCGC
1551 CCACGAAGAA AccgGCGAGC CCCTGCCGAA AGAACTCTTC GACAAAATGC
1601 TcgcCGCCAA AAACTTCCAG CGCGGTATGT TCCTCGTCCG GCAAATGGAG
1651 TTCGCCCTCT TCGATATGAT GATTTACAGT GAAAGCGACG AATGCCGTCT
1701 GAAAAACTGG CAGCAGGTTT TAGACAGCGT GCGCAAAGAA GTcGCCGTCA
1751 TCCAACCGCC CGAATACAAC CGCTTCGCCA ACAGCTTCGG CCacatctTC
1801 GCcggcGGCT ATTCCGCAGG CTATTACAGC TACGCATGGG CCGAAGTCCt
1851 cAGCACCGAT GCCTACGCCG CCTTTGAAGA AAGcGACGac gtcGCCGCCA
1901 CAGGCAAACG CTTCTGGCAA GAAAtccttg ccgtcggcgg ctCCCGCAGC
1951 gcgGCGGAAT CCTTCAAAGC CTTCCGCGGA CGCGAACCGA GCATAGACGC
2001 ACTGCTGCGC CAaagcggtT TCGACAACGC gGCttgA
```

This corresponds to the amino acid sequence <SEQ ID 3088; ORF 128.ng>:

g128.pep

```
  1 MIDNALLHLG EEPRFNQIQT EDIKPAVQTA IAEARGQIAA VKAQTHTGWA
 51 NTVERLTGIT ERVGRIWGVV SHLNSVVDTP ELRAVYNELM PEITVFFTEI
101 GQDIELYNRF KTIKNSPEFA TLSPAQKTKL DHDLRDFVLS GAELPPERQA
151 ELAKLQTEGA QLSAKFSQNV LDATDAFGIY FDDAAPLAGI PEDALAMFAA
201 AAQSEGKTGY KIGLQIPHYL AVIQYAGNRE LREQIYRAYV TRASELSNDG
251 KFDNTANIDR TLENALKTAK LLGFKNYAEL SLATKMADTP EQVLNFLHDL
301 ARRAKPYAEK DLAEVKAFAR EHLGLADPQP WDLSYAGEKL REAKYAFSET
351 EVKKYFPVGK VLAGLFAQIK KLYGIGFAEK TVPVWHKDVR YFELQQNGKT
401 IGGVYMDLYA REGKRGGAWM NDYKGRRRFA DGTLQLPTAY LVCNFAPPVG
451 GKEARLSHDE ILTLFHETGH GLHHLLTQVD ELGVSGINGV EWDAVELPSQ
501 FMENFVWEYN VLAQMSAHEE TGEPLPKELF DKMLAAKNFQ RGMFLVRQME
```

-continued

```
551 FALFDMMIYS ESDECRLKNW QQVLDSVRKE VAVIQPPEYN RFANSFGHIF

601 AGGYSAGYYS YAWAEVLSTD AYAAFEESDD VAATGKRFWQ EILAVGGSRS

651 AAESFKAFRG REPSIDALLR QSGFDNAA*
```

ORF 128 shows 91.7% identity over a 475 aa overlap with a predicted ORF (ORF 128.ng) from *N. gonorrhoeae*:

m128/g128

```
                    10        20        30        40        50        60
g128.pep    MIDNALLHLGEEPRFNQIQTEDIKPAVQTAIAEARGQIAAVKAQTHTGWANTVERLTGIT
            | |||||||||||||:||:|||||||:|||||||| ||||:||||||||||||| |||||
m128        MTDNALLHLGEEPRFDQIKTEDIKPALQTAIAEAREQIAAIKAQTHTGWANTVEPLTGIT
                    10        20        30        40        50        60

                    70        80        90       100       110       120
g128.pep    ERVGRIWGVVSHLNSVVDTPELRAAYNELMPEITVFFTEIGQDIELYNRFKTIKNSPEFA
            |||||||||||||| |:|||||||||||||||||||||||||||||||||||||||||| 
m128        ERVGRIWGVVSHLNCVADTPELRAAYNELMPEITVFFTEIGQDIELYNRFKTIKNSPEFD
                    70        80        90       100       110       120

                   130       140       150       160       170       180
g128.pep    TLSPAQKTKLDHDLRDFVLSGAELPPEQQAELAKLQTEGAQLSAKFSQNVLDATDAFGIY
            ||||||||||:|
m128        TLSPAQKTKLNH
                   130
              //
                                     340       350       360
g128.pep                                      YAGEKLREAKYAFSETEVKKYFPVGKVLAG
                                              ||:||||||||||||| |||||||| || |
m128                                          YASEKLREAKYAFSETXVKKYFPVGXVLNG
                                                      10        20        30

               370       380       390       400       410       420
g128.pep    LFAQIKKLYGIGFAEKTVPVWHKDVRYFELQQNGKTIGGVYMDLYAREGKRGGAWMNDYK
            |||| ||||||||:||||||||||||| ||||||::||||||||||||||||||||||||
m128        LFAQXKKLYGIGFTEKTVPVWHKDVRYXELQQNGEXIGGVYMDLYAREGKRGGAWMNDYK
                    40        50        60        70        80        90

               430       440       450       460       470       480
g128.pep    GRRRFADGTLQLPTAYLVCNFTPPVGGKEARLSHDEILTLEHETGHGLHHLLTQVDELGV
            |||||:|||||||||||||||||||||:|||||||||| |||||||||||||||||||||
m128        GRRRFSDGTLQLPTAYLVCNFTPPVGGREARLSHDEILILFHETGHGLHHLLTQVDELGV
                   100       100       120       130       140       150

               490       500       510       520       530       540
g128.pep    SGINGVEWDAVELPSQFMENFVWEYNVLAQMSAHEETGEPLPKELFDKMLAAKNFQRGMF
            |||||| ||||||||||||||||||||||| ||||||| |||||| || ||||||| |||
m128        SGINGVXWDAVELPSQFMENFVWEYNVLAQXSAHEETGVPLPKELXDKXLAAKNFQXGMF
                   160       170       180       190       200       210

               550       560       570       580       590       600
g128.pep    LVRQMEFALFDMMIYSESDECRLKNWQQVLDSVRKEVAVVRPPEYNRFANSFGHIFAGGY
             ||| ||||||||||||:|| ||||||||||||||:||||||||||||| ||||||||||
m128        XVRQXEFALFDMMIYSEDDEGRLKNWQQVLDSVRKKVAVVRPPEYNRFALSFGHIFAGGY
                   220       230       240       250       260       270

               610       620       630       640       650       660
g128.pep    SAGYYSYAWAEVLSTDAYAAFEESDDVAATGKRFWQEILAVGGSRSAAESFKAFRGREPS
            ||: ||||||||||:|||||||||||||||||||||||||||| |||:||||||||||||
m128        SAAXYSYAWAEVLSADAYAAFEESDDVAATGKRFWQEILAVGXSRSGAESFKAFRGREPS
                   280       290       300       310       320       330

               670      679
g128.pep    IDALLRQSGFDNAAX
            ||||||:||||||: 
m128        IDALLRHSGFDNAVX
                   240
```

The following partial DNA sequence was identified in *N. meningitidis* <SEQ ID 3089>:

a128.seq

```
  1 ATGACTGACA ACGCACTGCT CCATTTGGGC GAAGAACCCC GTTTTGATCA

 51 AATCAAAACC GAAGACATCA AACCCGCCCT GCAAACCGCC ATTGCCGAAG

101 CGCGCGAACA AATCGCCGCC ATCAAAGCCC AAACGCACAC CGGCTGGGCA
```

-continued

151 AACACTGTCG AACCCCTGAC CGGCATCACC GAACGCGTCG GCAGGATTTG

201 GGGCGTGGTG TCGCACCTCA ACTCCGTCAC CGACACGCCC GAACTGCGCG

251 CCGCCTACAA TGAATTAATG CCCGAAATTA CCGTCTTCTT CACCGAAATC

301 GGACAAGACA TCGAGCTGTA CAACCGCTTC AAAACCATCA AAAACTCCCC

351 CCAGTTCGAC ACCCTCTCCC ACGCGCAAAA AACCAAACTC AACCACGATC

401 TGCGCGATTT CGTCCTCAGC GGCGCGGAAC TGCCGCCCGA ACAGCAGGCA

451 GAATTGGCAA AACTGCAAAC CGAAGGCGCG CAACTTTCCG CCAAATTCTC

501 CCAAAACGTC CTAGACGCGA CCGACGCGTT CGGCATTTAC TTTGACGATG

551 CCGCACCGCT TGCCGGCATT CCCGAAGACG CGCTCGCCAT GTTTGCCGCT

601 GCCGCGCAAA GCGAAGGCAA AACAGGCTAC AAAATCGGTT TGCAGATTCC

651 GCACTACCTC GCCGTCATCC AATACGCCGA CAACCGCAAA CTGCGCGAAC

701 AAATCTACCG CGCCTACGTT ACCCGCGCCA GCGAGCTTTC AGACGACGGC

751 AAATTCGACA ACACCGCCAA CATCGACCGC ACGCTCGAAA ACGCCCTGCA

801 AACCGCCAAA CTGCTCGGCT TCAAAAACTA CGCCGAATTG TCGCTGGCAA

851 CCAAAATGGC GGACACCCCC GAACAAGTTT TAAACTTCCT GCACGACCTC

901 GCCCGCCGCG CCAAACCCTA CGCCGAAAAA GACCTCGCCG AAGTCAAAGC

951 CTTCGCCCGC GAAAGCCTCG GCCTCGCCGA TTTGCAACCG TGGGACTTGG

1001 GCTACGCGGG CGAAAAACTG CGCGAAGCCA AATACGCATT CAGCGAAACC

1051 GAAGTCAAAA AATACTTCCC CGTCGGCAAA GTATTAAACG GACTGTTCGC

1101 CCAAATCAAA AAACTCTACG GCATCGGATT TACCGAAAAA ACCGTCCCCG

1151 TCTGGCACAA AGACGTGCGC TATTTTGAAT TGCAACAAAA CGGCGAAACC

1201 ATAGGCGGCG TTTATATGGA TTTGTACGCA CGCGAAGGCA AACGCGGCGG

1251 CGCGTGGATG AACGACTACA AAGGCCGCCG CCGTTTTTCA GACGGCACGC

1301 TGCAACTGCC CACCGCCTAC CTCGTCTGCA ACTTCACCCC GCCCGTCGGC

1351 GGCAAAGAAG CCCGCTTGAG CCATGACGAA ATCCTCACCC TCTTCCACGA

1401 AACCGGACAC GGCCTGCACC ACCTGCTTAC CCAAGTCGAC GAACTGGGCG

1451 TATCCGGCAT CAACGGCGTA GAATGGGACG CAGTCGAACT GCCCAGTCAG

1501 TTTATGGAAA ATTTCGTTTG GGAATACAAT GTCTTGGCGC AAATGTCCGC

1551 CCACGAAGAA ACCGGCGTTC CCCTGCCGAA AGAACTCTTC GACAAAATGC

1601 TCGCCGCCAA AAACTTCCAA CGCGGAATGT TCCTCGTCCG CCAAATGGAG

1651 TTCGCCCTCT TTGATATGAT GATTTACAGC GAAGACGACG AAGGCCGTCT

1701 GAAAAACTGG CAACAGGTTT TAGACAGCGT GCGCAAAGAA GTCGCCGTCG

1751 TCCGACCGCC CGAATACAAC CGCTTCGCCA ACAGCTTCGG CCACATCTTC

1801 GCAGGCGGCT ATTCCGCAGG CTATTACAGC TACGCGTGGG CGGAAGTATT

1851 GAGCGCGGAC GCATACGCCG CCTTTGAAGA AAGCGACGAT GTCGCCGCCA

1901 CAGGCAAACG CTTTTGGCAG GAAATCCTCG CCGTCGGCGG ATCGCGCAGC

1951 GCGGCAGAAT CCTTCAAAGC CTTCCGCGGA CGCGAACCGA GCATAGACGC

2001 ACTCTTGCGC CACAGCGGCT TCGACAACGC GGCTTGA

This corresponds to the amino acid sequence <SEQ ID 3090; ORF 128.a>:

a128.pep

```
  1 MTDNALLHLG EEPRFDQIKT EDIKPALQTA IAEAREQIAA IKAQTHTGWA
 51 NTVEPLTGIT ERVGRIWGVV SHLNSVTDTP ELRAAYNELM PEITVFFTEI
101 GQDIELYNRF KTIKNSPEFD TLSHAQKTKL NHDLRDFVLS GAELPPEQQA
151 ELAKLQTEGA QLSAKFSQNV LDATDAFGIY FDDAAPLAGI PEDALAMFAA
201 AAQSEGKTGY KIGLQIPHYL AVIQYADNRK LREQIYRAYV TRASELSDDG
251 KFDNTANIDR TLENALQTAK LLGFKNYAEL SLATKMADTP EQVLNFLHDL
301 ARRAKPYAEK DLAEVKAFAR ESLGLADLQP WDLGYAGEKL REAKYAFSET
351 EVKKYFPVGK VLNGLFAQIK KLYGIGFTEK TVPVWHKDVR YFELQQNGET
401 IGGVYMDLYA REGKRGGAWM NDYKGRRRFS DGTLQLPTAY LVCNFTPPVG
451 GKEARLSHDE ILTLFHETGH GLHHLLTQVD ELGVSGINGV EWDAVELPSQ
501 FMENFVWEYN VLAQMSAHEE TGVPLPKELF DKMLAAKNFQ RGMFLVRQME
551 FALFDMMIYS EDDEGRLKNW QQVLDSVRKE VAVVRPPEYN RFANSFGHIF
601 AGGYSAGYYS YAWAEVLSAD AYAAFEESDD VAATGKRFWQ EILAVGGSRS
651 AAESFKAFRG REPSIDALLR HSGFDNAA*
```

m128/a128 ORFs 128 and 128.a showed a 66.0% identity in 677 aa overlap

```
                    10        20        30        40        50        60
m128.pep    MTDNALLHLGEEPRFDQIKTEDIKPALQTAIAEAREQIAAIKAQTHTGWANTVEPLTGIT
            ||||||||||||||||||||||||||||||||||||||||||||||||||||||||||||
a128        MTDNALLHLGEEPRFDQIKTEDIKPALQTAIAEAREQIAAIKAQTHTGWANTVEPLTGIT
                    10        20        30        40        50        60

                    70        80        90       100       110       120
m128.pep    ERVGRIWGVVSHLNCVADTPELRAVYNELMPEITVFFTEIGQDIELYNRFKTIKNSPEFD
            |||||||||||||| |:|||||||:|||||||||||||||||||||||||||||||||||
a128        ERVGRIWGVVSHLNSVTDTPELRAAYNELMPEITVFFTEIGQDIELYNRFKTIKNSPEFD
                    70        80        90       100       110       120

                   130
m128.pep    TLSPAQKTKLNH------------------------------------------------
            ||| ||||||||
a128        TLSHAQKTKLNHDLRDFVLSGAELPPEQQAELAKLQTEGAQLSAKFSQNVLDATDAFGIY
                   130       140       150       160       170       180

m128.pep    ------------------------------------------------------------

a128        FDDAAPLAGIPEDALAMFAAAAQSEGKTGYKIGLQIPHYLAVIQYADNRKLREQIYRAYV
                   190       200       210       220       230       240

m128.pep    ------------------------------------------------------------

a128        TRASELSDDGKFDNTANIDRTLENALQTAKLLGFKNYAELSLATKMADTPEQVLNFLHDL
                   250       260       270       280       290       300

                                                   140       150
m128.pep    ----------------------------------YASEKLREAKYAFSETXVKKYFPVGX
                                              ||:||||||||||||| ||||||||
a128        ARRAKPYAEKDLAEVKAFARESLGLADLQPWDLGYAGEKLREAKYAFSETEVKKYFPVGK
                   310       320       330       340       350       360

           160       170       180       190       200       210
m128.pep    VLNGLFAQXKKLYGIGFTEKTVPVWHKDVRYXELQQNGEXIGGVYMDLYAREGKRGGAWM
            |||||||| |||||||||||||||||||||| |||||||:||||||||||||||||||||
a128        VLNGLFAQIKKLYGIGFTEKTVPVWHKDVRYFELQQNGETIGGVYMDLYAREGKRGGAWM
                   370       380       390       400       410       420

           220       230       240       250       260       270
m128.pep    NDYKGRRRFSDGTLQLPTAYLVCNFAPPVGGREARLSHDEILILEHETGHGLHHLLTQVD
            |||||||||||||||||||||||||:|||||:|||||||||| |||||||||||||||||
a128        NDYKGRRRFSDGTLQLPTAYLVCNFTPPVGGKEARLSHDEILTLFHETGHGLHHLLTQVD
                   430       440       450       460       470       480

           280       290       300       310       320       330
m128.pep    ELGVSGINGVXWDAVELPSQFMENFVWEYNVLAQXSAHEETGVPLPKELXDKXLAAKNFQ
            |||||||||| ||||||||||||||||||||||| |||||||||||||| || |||||||
a128        ELGVSGINGVEWDAVELPSQFMENFVWEYNVLAQMSAHEETGVPLPKELFDKMLAAKNFQ
                   490       500       510       520       530       540
```

-continued

```
             340       350       360       370       380       390
m128.pep   XGMFXVRQXEFALFDMMIYSEDDEGRLKNWQQVLDSVRKKVAVIQPPEYNRFALSFGHIF
           ||| ||| |||||||||||||||||||||||||||||:|||::|||||||| ||||||
a128       RGMFLVRQMEFALFDMMIYSEDDEGRLKNWQQVLDSVRKEVAVVRPPEYNRFANSFGHIF
                   550       560       570       580       590       600

             400       410       420       430       440       450
m128.pep   AGGYSAAXYSYAWAEVLSADAYAAFEESDDVAATGKRFWQEILAVGXSRSGAESFKAFRG
           ||||||: |||||||||||||||||||||||||||||||||||||| |||:|||||||||
a128       AGGYSAGYYSYAWAEVLSADAYAAFEESDDVAATGKRFWQEILAVGGSRSAAESFKAFRG
                   610       620       630       640       650       660

             460       470
m128.pep   REPSIDALLRHSGFDNAVX
           ||||||||||||||||:
a128       REPSIDALLRHSGFDNAAX
                   670
```

Further work revealed the DNA sequence identified in *N. meningitidis* <SEQ ID 3091>:

m128-1.seq

```
   1 ATGACTGACA ACGCACTGCT CCATTTGGGC GAAGAACCCC GTTTTGATCA
  51 AATCAAAACC GAAGACATCA AACCCGCCCT GCAAACCGCC ATCGCCGAAG
 101 CGCGCGAACA AATCGCCGCC ATCAAAGCCC AAACGCACAC CGGCTGGGCA
 151 AACACTGTCG AACCCCTGAC CGGCATCACC GAACGCGTCG GCAGGATTTG
 201 GGGCGTGGTG TCGCACCTCA ACTCCGTCGC CGACACGCCC GAACTGCGCG
 251 CCGTCTATAA CGAACTGATG CCCGAAATCA CCGTCTTCTT CACCGAAATC
 301 GGACAAGACA TCGAGCTGTA CAACCGCTTC AAAACCATCA AAAATTCCCC
 351 CGAATTCGAC ACCCTCTCCC CCGCACAAAA AACCAAACTC AACCACGATC
 401 TGCGCGATTT CGTCCTCAGC GGCGCGGAAC TGCCGCCCGA ACAGCAGGCA
 451 GAACTGGCAA AACTGCAAAC CGAAGGCGCG CAACTTTCCG CCAAATTCTC
 501 CCAAAACGTC CTAGACGCGA CCGACGCGTT CGGCATTTAC TTTGACGATG
 551 CCGCACCGGT TGCCGGCATT CCCGAAGACG CGCTCGCCAT GTTTGCCGCC
 601 GCCGCGCAAA GCGAAAGCAA AACAGGCTAC AAAATCGGCT TGCAGATTCC
 651 ACACTACCTC GCCGTCATCC AATACGCCGA CAACCGCGAA CTGCGCGAAC
 701 AAATCTACCG CGCCTACGTT ACCCGCGCCA GCGAACTTTC AGACGACGGC
 751 AAATTCGACA ACACCGCCAA CATCGACCGC ACGCTCGCAA ACGCCCTGCA
 801 AACCGCCAAA CTGCTCGGCT TCAAAAACTA CGCCGAATTG TCGCTGGCAA
 851 CCAAAATGGC GGACACGCCC GAACAAGTTT TAAACTTCCT GCACGACCTC
 901 GCCCGCCGCG CCAAACCCTA CGCCGAAAAA GACCTCGCCG AAGTCAAAGC
 951 CTTCGCCCGC GAAAGCCTGA ACCTCGCCGA TTTGCAACCG TGGGACTTGG
1001 GCTACGCCAG CGAAAAACTG CGCGAAGCCA AATACGCGTT CAGCGAAACC
1051 GAAGTCAAAA AATACTTCCC CGTCGGCAAA GTATTAAACG GACTGTTCGC
1101 CCAAATCAAA AAACTCTACG GCATCGGATT TACCGAAAAA ACCGTCCCCG
1151 TCTGGCACAA AGACGTGCGC TATTTTGAAT TGCAACAAAA CGGCGAAACC
1201 ATAGGCGGCG TTTATATGGA TTTGTACGCA CGCGAAGGCA AACGCGGCGG
1251 CGCGTGGATG AACGACTACA AAGGCCGCCG CCGTTTTTCA GACGGCACGC
1301 TGCAACTGCC CACCGCCTAC CTCGTCTGCA ACTTCGCCCC ACCCGTCGGC
1351 GGCAGGGAAG CCCGCCTGAG CCACGACGAA ATCCTCATCC TCTTCCACGA
```

-continued

```
1401 AACCGGACAC GGGCTGCACC ACCTGCTTAC CCAAGTGGAC GAACTGGGCG

1451 TATCCGGCAT CAACGGCGTA GAATGGGACG CGGTCGAACT GCCCAGCCAG

1501 TTTATGGAAA ATTTCGTTTG GGAATACAAT GTCTTGGCAC AAATGTCAGC

1551 CCACGAAGAA ACCGGCGTTC CCCTGCCGAA AGAACTCTTC GACAAAATGC

1601 TCGCCGCCAA AAACTTCCAA CGCGGCATGT TCCTCGTCCG GCAAATGGAG

1651 TTCGCCCTCT TTGATATGAT GATTTACAGC GAAGACGACG AAGGCCGTCT

1701 GAAAAACTGG CAACAGGTTT TAGACAGCGT GCGCAAAAAA GTCGCCGTCA

1751 TCCAGCCGCC CGAATACAAC CGCTTCGCCT TGAGCTTCGG CCACATCTTC

1801 GCAGGCGGCT ATTCCGCAGG CTATTACAGC TACGCGTGGG CGGAAGTATT

1851 GAGCGCGGAC GCATACGCCG CCTTTGAAGA AAGCGACGAT GTCGCCGCCA

1901 CAGGCAAACG CTTTTGGCAG GAAATCCTCG CCGTCGGCGG ATCGCGCAGC

1951 GCGGCAGAAT CCTTCAAAGC CTTCCGCGGC CGCGAACCGA GCATAGACGC

2001 ACTCTTGCGC CACAGCGGTT TCGACAACGC GGTCTGA
```

This corresponds to the amino acid sequence <SEQ ID 3092; ORF 128-1>:

m128-1.pep.

```
  1 MTDNALLHLG EEPRFDQIKT EDIKPALQTA IAEAREQIAA IKAQTHTGWA

 51 NTVEPLTGIT ERVGRIWGVV SHLNSVADTP ELRAVYNELM PEITVFFTEI

101 GQDIELYNRF KTIKNSPEFD TLSPAQKTKL NHDLRDFVLS GAELPPEQQA

151 ELAKLQTEGA QLSAKFSQNV LDATDAFGIY FDDAAPLAGI PEDALAMFAA

201 AAQSESKTGY KIGLQIPHYL AVIQYADNRE LREQIYRAYV TRASELSDDG

251 KFDNTANIDR TLANALQTAK LLGFKNYAEL SLATKMADTP EQVLNFLHDL

301 ARRAKPYAEK DLAEVKAFAR ESLNLADLQP WDLGYASEKL REAKYAFSET

351 EVKKYFPVGK VLNGLFAQIK KLYGIGFTEK TVPVWHKDVR YFELQQNGET

401 IGGVYMDLYA REGKRGGAWM NDYKGRRRFS DGTLQLPTAY LVCNFAPPVG

451 GREARLSHDE ILILFHETGH GLHHLLTQVD ELGVSGINGV EWDAVELPSQ

501 FMENFVWEYN VLAQMSAHEE TGVPLPKELF DKMLAAKNFQ RGMFLVRQME

551 FALFDMMIYS EDDEGRLKNW QQVLDSVRKK VAVIQPPEYN RFALSFGHIF

601 AGGYSAGYYS YAWAEVLSAD AYAAFEESDD VAATGKRFWQ EILAVGGSRS

651 AAESFKAFRG REPSIDALLR HSGFDNAV*
```

The following DNA sequence was identified in *N. gonorrhoeae* <SEQ ID 3093>:

g128-1.seq (partial)

```
  1 ATGATTGACA ACGCACTGCT CCACTTGGGC GAAGAACCCC GTTTTAATCA

 51 AATCAAAACC GAAGACATCA AACCCGCCGT CCAAACCGCC ATCGCCGAAG

101 CGCGCGGACA AATCGCCGCC GTCAAAGCGC AAACGCACAC CGGCTGGGCG

151 AACACCGTCG AGCGTCTGAC CGGCATCACC GAACGCGTCG GCAGGATTTG
```

-continued

```
 201 GGGCGTCGTG TCCCATCTCA ACTCCGTCGT CGACACGCCC GAACTGCGCG
 251 CCGTCTATAA CGAACTGATG CCTGAAATCA CCGTCTTCTT CACCGAAATC
 301 GGACAAGACA TCGAACTGTA CAACCGCTTC AAAACCATCA AAAATTCCCC
 351 CGAATTTGCA ACGCTTTCCC CCGCACAAAA AACCAAGCTC GATCACGACC
 401 TGCGCGATTT CGTATTGAGC GGCGCGGAAC TGCCGCCCGA ACGGCAGGCA
 451 GAACTGGCAA AACTGCAAAC CGAAGGCGCG CAACTTTCCG CCAAATTCTC
 501 CCAAAACGTC CTAGACGCGA CCGACGCGTT CGGCATTTAC TTTGACGATG
 551 CCGCACCGCT TGCCGGCATT CCCGAAGACG CGCTCGCCAT GTTTGCCGCC
 601 GCCGCGCAAA GCGAAGGCAA AACAGGTTAC AAAATCGGCT TGCAGATTCC
 651 GCACTACCTT GCCGTTATCC AATACGCCGG CAACCGCGAA CTGCGCGAAC
 701 AAATCTACCG CGCCTACGTT ACCCGTGCCA GCGAACTTTC AAACGACGGC
 751 AAATTCGACA ACACCGCCAA CATCGACCGC ACGCTCGAAA ACGCATTGAA
 801 AACCGCCAAA CTGCTCGGCT TTAAAAATTA CGCCGAATTG TCGCTGGCAA
 851 CCAAAATGGC GGACACGCCC GAACAGGTTT TAAACTTCCT GCACGACCTC
 901 GCCCGCCGCG CCAAACCCTA CGCCGAAAAA GACCTCGCCG AAGTCAAAGC
 951 CTTCGCCCGC GAACACCTCG GTCTCGCCGA CCCGCAGCCG TGGGACTTGA
1001 GCTACGCCGG CGAAAAACTG CGCGAAGCCA AATACGCATT CAGCGAAACC
1051 GAAGTCAAAA AATACTTCCC CGTCGGCAAA GTTCTGGCAG GCCTGTTCGC
1101 CCAAATCAAA AAACTCTACG GCATCGGATT CGCCGAAAAA ACCGTTCCCG
1151 TCTGGCACAA AGACGTGCGC TATTTTGAAT TGCAACAAAA CGGCAAAACC
1201 ATCGGCGGCG TTTATATGGA TTTGTACGCA CGCGAAGGCA AACGCGGCGG
1251 CGCGTGGATG AACGACTACA AAGGCCGCCG CCGCTTTGCC GACGGCACGC
1301 TGCAACTGCC CACCGCCTAC CTCGTCTGCA ACTTCGCCCC GCCCGTCGGC
1351 GGCAAAGAAG CGCGTTTAAG CCACGACGAA ATCCTCACCC TCTTCCACGA
1401 AACCGGCCAC GGACTGCACC ACCTGCTTAC CCAAGTGGAC GAACTGGGCG
1451 TGTCCGGCAT CAACGGCGTA AAA
```

This corresponds to the amino acid sequence <SEQ ID 3094; ORF 128-1.ng>:

g128-1.pep (partial)

```
  1 MIDNALLHLG EEPRFNQIKT EDIKPAVQTA IAEARGQIAA VKAQTHTGWA
 51 NTVERLTGIT ERVGRIWGVV SHLNSVVDTP ELRAVYNELM PEITVFFTEI
101 GQDIELYNRF KTIKNSPEFA TLSPAQKTKL DHDLRDFVLS GAELPPERQA
151 ELAKLQTEGA QLSAKFSQNV LDATDAFGIY FDDAAPLAGI PEDALAMFAA
201 AAQSEGKTGY KIGLQIPHYL AVIQYAGNRE LREQIYRAYV TRASELSNDG
251 KFDNTANIDR TLENALKTAK LLGFKNYAEL SLATKMADTP EQVLNFLHDL
301 ARRAKPYAEK DLAEVKAFAR EHLGLADPQP WDLSYAGEKL REAKYAFSET
351 EVKKYFPVGK VLAGLFAQIK KLYGIGFAEK TVPVWHKDVR YFELQQNGKT
401 IGGVYMDLYA REGKRGGAWM NDYKGRRRFA DGTLQLPTAY LVCNFAPPVG
451 GKEARLSHDE ILTLFHETGH GLHHLLTQVD ELGVSGINGV K
```

m128-1/g128-1 ORFs 128-1 and 128-1.ng showed a 94.5% identity in 491 aa overlap

```
                    10        20        30        40        50        60
g128-1.pep  MIDNALLHLGEEPRFNQIKTEDIKPAVQTAIAEARGQIAAVKAQTHTGWANTVERLTGIT
            | |||||||||||||:||||||||||:||||||| ||||:|||||||||||| |||||
m128-1      MTDNALLHLGEEPRFDQIKTEDIKPALQTAIAEAREQIAAIKAQTHTGWANTVEPLTGIT
                    10        20        30        40        50        60

                    70        80        90       100       110       120
g128-1.pep  ERVGRIWGVVSHLNSVVDTPELRAAYNELMPEITVFFTEIGQDIELYNRFKTIKNSPEFA
            |||||||||||||||:||||||||||||||||||||||||||||||||||||||||||||
m128-1      ERVGRIWGVVSHLNSVADTPELRAAYNELMPEITVFFTEIGQDIELYNRFKTIKNSPEFD
                    70        80        90       100       110       120

                   130       140       150       160       170       180
g128-1.pep  TLSHAQKTKLDHDLRDFVLSGAELPPERQAELAKLQTEGAQLSAKFSQNVLDATDAFGIY
            ||||||||||:|||||||||||||||||:|||||||||||||||||||||||||||||||
m128-1      TLSHAQKTKLNHDLRDFVLSGAELPPEQQAELAKLQTEGAQLSAKFSQNVLDATDAFGIY
                   130       140       150       160       170       180

                   190       200       210       220       230       240
g128-1.pep  FDDAAPLAGIPEDALAMFAAAAQSEGKTGYKIGLQIPHYLAVIQYAGNRKLREQIYRAYV
            ||||||||||||||||||||||||:|||||||||||||||||||||| |||||||||||||
m128-1      FDDAAPLAGIPEDALAMGAAAAQSESKTGYKIGLQIPHYLAVIQYADNRKLREQIYRAYV
                   190       200       210       220       230       240

                   250       260       270       280       290       300
g128-1.pep  TRASELSNDGKFDNTANIDRTLENALKTAKLLGFKNYAELSLATKMADTPEQVLNFLHDL
            |||||||:|||||||||||||| |||:|||||||||||||||||||||||||||||||||
m128-1      TRASELSDDGKFDNTANIDRTLANALQTAKLLGFKNYAELSLATKMADTPEQVLNFLHDL
                   250       260       270       280       290       300

                   310       320       330       340       350       360
g128-1.pep  ARRAKPYAEKDLAEVKAFAREHLGLADPQPWDLSYAGEKLREAKYAFSETEVKKYFPVGK
            |||||||||||||||||||||| |:||| |||||:||:||||||||||||||||||||||
m128-1      ARRAKPYAEKDLAEVKAFARESLNLADLQPWDLGYASEKLREAKYAFSETEVKKYFPVGK
                   310       320       330       340       350       360

                   370       380       390       400       410       420
g128-1.pep  VLAGLFAQIKKLYGIGFAEKTVPVWHKDVRYFELQQNGKTIGGVYMDLYAREGKRGGAWM
            || |||||||||||||:|||||||||||||||||||||:|||||||||||||||||||||
m128-1      VLNGLFAQIKKLYGIGFTEKTVPVWHKDVRYFELQQNGETIGGVYMDLYAREGKRGGAWM
                   370       380       390       400       410       420

                   430       440       450       460       470       480
g128-1.pep  NDYKGRRRFADGTLQLPTAYLVCNFTPPVGGKEARLSHDEILTLEHETGHGLHHLLTQVD
            ||||||||:||||||||||||||||||||||:|||||||||| ||||||||||||||||||
m128-1      NDYKGRRRFSDGTLQLPTAYLVCNFTPPVGGREARLSHDEILILFHETGHGLHHLLTQVD
                   430       440       450       460       470       480

                   490
g128-1.pep  ELGVSGINGVK
            ||||||||||:
m128-1      ELGVSGINGVEWDAVELPSQFMENFVWEYNVLAQMSAHEETGVPLPKELFDKMLAAKNFQ
                   490       500       510       520       530       540
```

The following DNA sequence was identified in *N. meningitidis* <SEQ ID 3095>:

a128-1.seq

```
  1 ATGACTGACA ACGCACTGCT CCATTTGGGC GAAGAACCCC GTTTTGATCA
 51 AATCAAAACC GAAGACATCA AACCCGCCCT GCAAACCGCC ATTGCCGAAG
101 CGCGCGAACA AATCGCCGCC ATCAAAGCCC AAACGCACAC CGGCTGGGCA
151 AACACTGTCG AACCCCTGAC CGGCATCACC GAACGCGTCG GCAGGATTTG
201 GGGCGTGGTG TCGCACCTCA ACTCCGTCAC CGACACGCCC GAACTGCGCG
251 CCGCCTACAA TGAATTAATG CCCGAAATTA CCGTCTTCTT CACCGAAATC
301 GGACAAGACA TCGAGCTGTA CAACCGCTTC AAAACCATCA AAAACTCCCC
351 CGAGTTCGAC ACCCTCTCCC ACGCGCAAAA AACCAAACTC AACCACGATC
401 TGCGCGATTT CGTCCTCAGC GGCGCGGAAC TGCCGCCCGA ACAGCAGGCA
451 GAATTGGCAA AACTGCAAAC CGAAGGCGCG CAACTTTCCG CCAAATTCTC
501 CCAAAACGTC CTAGACGCGA CCGACGCGTT CGGCATTTAC TTTGACGATG
551 CCGCACCGCT TGCCGGCATT CCCGAAGACG CGCTCGCCAT GTTTGCCGCT
```

-continued

```
 601 GCCGCGCAAA GCGAAGGCAA AACAGGCTAC AAAATCGGTT TGCAGATTCC
 651 GCACTACCTC GCCGTCATCC AATACGCCGA CAACCGCAAA CTGCGCGAAC
 701 AAATCTACCG CGCCTACGTT ACCCGCGCCA GCGAGCTTTC AGACGACGGC
 751 AAATTCGACA ACACCGCCAA CATCGACCGC ACGCTCGAAA ACGCCCTGCA
 801 AACCGCCAAA CTGCTCGGCT TCAAAAACTA CGCCGAATTG TCGCTGGCAA
 851 CCAAAATGGC GGACACCCCC GAACAAGTTT TAAACTTCCT GCACGACCTC
 901 GCCCGCCGCG CCAAACCCTA CGCCGAAAAA GACCTCGCCG AAGTCAAAGC
 951 CTTCGCCCGC GAAAGCCTCG GCCTCGCCGA TTTGCAACCG TGGGACTTGG
1001 GCTACGCCGG CGAAAAACTG CGCGAAGCCA AATACGCATT CAGCGAAACC
1051 GAAGTCAAAA AATACTTCCC CGTCGGCAAA GTATTAAACG GACTGTTCGC
1101 CCAAATCAAA AAACTCTACG GCATCGGATT TACCGAAAAA ACCGTCCCCG
1151 TCTGGCACAA AGACGTGCGC TATTTTGAAT TGCAACAAAA CGGCGAAACC
1201 ATAGGCGGCG TTTATATGGA TTTGTACGCA CGCGAAGGCA AACGCGGCGG
1251 CGCGTGGATG AACGACTACA AAGGCCGCCG CCGTTTTTCA GACGGCACGC
1301 TGCAACTGCC CACCGCCTAC CTCGTCTGCA ACTTCACCCC GCCCGTCGGC
1351 GGCAAAGAAG CCCGCTTGAG CCATGACGAA ATCCTCACCC TCTTCCACGA
1401 AACCGGACAC GGCCTGCACC ACCTGCTTAC CCAAGTCGAC GAACTGGGCG
1451 TATCCGGCAT CAACGGCGTA GAATGGGACG CAGTCGAACT GCCCAGTCAG
1501 TTTATGGAAA ATTTCGTTTG GGAATACAAT GTCTTGGCGC AAATGTCCGC
1551 CCACGAAGAA ACCGGCGTTC CCCTGCCGAA AGAACTCTTC GACAAAATGC
1601 TCGCCGCCAA AAACTTCCAA CGCGGAATGT TCCTCGTCCG CCAAATGGAG
1651 TTCGCCCTCT TTGATATGAT GATTTACAGC GAAGACGACG AAGGCCGTCT
1701 GAAAAACTGG CAACAGGTTT TAGACAGCGT GCGCAAAGAA GTCGCCGTCG
1751 TCCGACCGCC CGAATACAAC CGCTTCGCCA ACAGCTTCGG CCACATCTTC
1801 GCAGGCGGCT ATTCCGCAGG CTATTACAGC TACGCGTGGG CGGAAGTATT
1851 GAGCGCGGAC GCATACGCCG CCTTTGAAGA AAGCGACGAT GTCGCCGCCA
1901 CAGGCAAACG CTTTTGGCAG GAAATCCTCG CCGTCGGCGG ATCGCGCAGC
1951 GCGGCAGAAT CCTTCAAAGC CTTCCGCGGA CGCGAACCGA GCATAGACGC
2001 ACTCTTGCGC CACAGCGGCT TCGACAACGC GGCTTGA
```

This corresponds to the amino acid sequence <SEQ ID 3096; ORF 128-1.a>:

a128-1.pep

```
  1 MTDNALLHLG EEPRFDQIKT EDIKPALQTA IAEAREQIAA IKAQTHTGWA
 51 NTVEPLTGIT ERVGRIWGVV SHLNSVTDTP ELRAAYNELM PEITVFFTEI
101 GQDIELYNRF KTIKNSPEFD TLSHAQKTKL NHDLRDFVLS GAELPPEQQA
151 ELAKLQTEGA QLSAKFSQNV LDATDAFGIY FDDAAPLAGI PEDALAMFAA
201 AAQSEGKTGY KIGLQIPHYL AVIQYADNRK LREQIYRAYV TRASELSDDG
251 KFDNTANIDR TLENALQTAK LLGFKNYAEL SLATKMADTP EQVLNFLHDL
```

-continued

```
301 ARRAKPYAEK DLAEVKAFAR ESLGLADLQP WDLGYAGEKL REAKYAFSET

351 EVKKYFPVGK VLNGLFAQIK KLYGIGFTEK TVPVWHKDVR YFELQQNGET

401 IGGVYMDLYA REGKRGGAWM NDYKGRRRFS DGTLQLPTAY LVCNFTPPVG

451 GKEARLSHDE ILTLFHETGH GLHHLLTQVD ELGVSGINGV EWDAVELPSQ

501 FMENFVWEYN VLAQMSAHEE TGVPLPKELF DKMLAAKNFQ RGMFLVRQME

551 FALFDMMIYS EDDEGRLKNW QQVLDSVRKE VAVVRPPEYN RFANSFGHIF

601 AGGYSAGYYS YAWAEVLSAD AYAAFEESDD VAATGKRFWQ EILAVGGSRS

651 AAESFKAFRG REPSIDALLR HSGFDNAA*
```

m128-1/a128-1 ORFs 128-1 and 128-1.a showed a 97.8% identity in 677 aa overlap

```
                    10        20        30        40        50        60
a128-1.pep  MTDNALLHLGEEPRFDQIKTEDIKPALQTAIAEAREQIAAIKAQTHTGWANTVEPLTGIT
            ||||||||||||||||||||||||||||||||||||||||||||||||||||||||||||
m128-1      MTDNALLHLGEEPRFDQIKTEDIKPALQTAIAEAREQIAAIKAQTHTGWANTVEPLTGIT
                    10        20        30        40        50        60

                    70        80        90       100       110       120
a128-1.pep  ERVGRIWGVVSHLNSVTDTPELRAAYNELMPEITVFFTEIGQDIELYNRFKTIKNSPEFD
            ||||||||||||||:|||||||:|||||||||||||||||||||||||||||||||||||
m128-1      ERVGRIWGVVSHLNSVADTPELRAVYNELMPEITVFFTEIGQDIELYNRFKTIKNSPEFD
                    70        80        90       100       110       120

                   130       140       150       160       170       180
a128-1.pep  TLSHAQKTKLNHDLRDFVLSGAELPPEQQAELAKLQTEGAQLSAKFSQNVLDATDAFGIY
            ||| ||||||||||||||||||||||||||||||||||||||||||||||||||||||||
m128-1      TLSPAQKTKLNHDLRDFVLSGAELPPEQQAELAKLQTEGAQLSAKFSQNVLDATDAFGIY
                   130       140       150       160       170       180

                   190       200       210       220       230       240
a128-1.pep  FDDAAPLAGIPEDALAMFAAAAQSEGKTGYKIGLQIPHYLAVIQYADNRKLREQIYRAYV
            ||||||||||||||||| ||||||:||||||||||||||||||||||||:||||||||||
m128-1      FDDAAPLAGIPEDALAMGAAAAQSESKTGYKIGLQIPHYLAVIQYADNRELREQIYRAYV
                   190       200       210       220       230       240

                   250       260       270       280       290       300
a128-1.pep  TRASELSDDGKFDNTANIDRTLENALQTAKLLGFKNYAELSLATKMADTPEQVLNFLHDL
            |||||||||||||||||||||| |||||||||||||||||||||||||||||||||||||
m128-1      TRASELSDDGKFDNTANIDRTLANALQTAKLLGFKNYAELSLATKMADTPEQVLNFLHDL
                   250       260       270       280       290       300

                   310       320       330       340       350       360
a128-1.pep  ARRAKPYAEKDLAEVKAFARESLGLADLQPWDLGYAGEKLREAKYAFSETEVKKYFPVGK
            ||||||||||||||||||||||:||||||||||||:||||||||||||||||||||||||
m128-1      ARRAKPYAEKDLAEVKAFARESLNLADLQPWDLGYASEKLREAKYAFSETEVKKYFPVGK
                   310       320       330       340       350       360

                   370       380       390       400       410       420
a128-1.pep  VLNGLFAQIKKLYGIGFTEKTVPVWHKDVRYFELQQNGETIGGVYMDLYAREGKRGGAWM
            ||||||||||||||||||||||||||||||||||||||||||||||||||||||||||||
m128-1      VLNGLFAQIKKLYGIGFTEKTVPVWHKDVRYFELQQNGETIGGVYMDLYAREGKRGGAWM
                   370       380       390       400       410       420

                   430       440       450       460       470       480
a128-1.pep  NDYKGRRRFSDGTLQLPTAYLVCNFTPPVGGKEARLSHDEILTLEHETGHGLHHLLTQVD
            |||||||||||||||||||||||||:|||||:|||||||||| ||||||||||||||||
m128-1      NDYKGRRRFSDGTLQLPTAYLVCNFAPPVGGREARLSHDEILILFHETGHGLHHLLTQVD
                   430       440       450       460       470       480

                   490       500       510       520       530       540
a128-1.pep  ELGVSGINGVEWDAVELPSQFMENFVWEYNVLAQMSAHEETGVPLPKELFDKMLAAKNFQ
            ||||||||||||||||||||||||||||||||||||||||||||||||||||||||||||
m128-1      ELGVSGINGVEWDAVELPSQFMENFVWEYNVLAQMSAHEETGVPLPKELFDKMLAAKNFQ
                   490       500       510       520       530       540

                   550       560       570       580       590       600
a128-1.pep  RGMFLVRQMEFALFDMMIYSEDDEGRLKNWQQVLDSVRKEVAVVRPPEYNRFANSFGHIF
            |||||||||||||||||||||||||||||||||||||:|||::|||||||| ||||||
m128-1      RGMFLVRQMEFALFDMMIYSEDDEGRLKNWQQVLDSVRKKVAVIQPPEYNRFALSFGHIF
                   550       560       570       580       590       600

                   610       620       630       640       650       660
a128-1.pep  AGGYSAGYYSYAWAEVLSADAYAAFEESDDVAATGKRFWQEILAVGGSRSAAESFKAFRG
            ||||||||||||||||||||||||||||||||||||||||||||||||||||||||||||
m128-1      AGGYSAGYYSYAWAEVLSADAYAAFEESDDVAATGKRFWQEILAVGGSRSAAESFKAFRG
                   610       620       630       640       650       660
```

-continued

```
                     670       679
a128-1.pep  REPSIDALLRHSGFDNAAX
            ||||||||||||||||:
m128-1      REPSIDALLRHSGFDNAVX
                     670
```

The following partial DNA sequence was identified in *N. meningitidis* <SEQ ID 3097>:

```
m206.seq

  1 ATGTTTCCCC CCGACAAAAC CCTTTTCCTC TGTCTCAGCG CACTGCTCCT

 51 CGCCTCATGC GGCACGACCT CCGGCAAACA CCGCCAACCG AAACCCAAAC

101 AGACAGTCCG GCAAATCCAA GCCGTCCGCA TCAGCCACAT CGACCGCACA

151 CAAGGCTCGC AGGAACTCAT GCTCCACAGC CTCGGACTCA TCGGCACGCC

201 CTACAAATGG GGCGGCAGCA GCACCGCAAC CGGCTTCGAT TGCAGCGGCA

251 TGATTCAATT CGTTTACAAr AACGCCCTCA ACGTCAAGCT GCCGCGCACC

301 GCCCGCGACA TGGCGGCGGC AAGCCGsAAA ATCCCCGAcA GCCGCyTCAA

351 GGCCGGCGAC CTCGTATTCT TCAACACCGG CGGCGCACAC CGCTACTCAC

401 ACGTCGGACT CTACATCGGC AACGGCGAAT TCATCCATGC CCCCAGCAGC

451 GGCAAAACCA TCAAAACCGA AAAACTCTCC ACACCGTTTT ACGCCAAAAA

501 CTACCTCGGC GCACATACTT TTTTTACAGA ATGA
```

This corresponds to the amino acid sequence <SEQ ID 3098; ORF 206>:

```
m206.pep..

  1 MFPPDKTLFL CLSALLLASC GTTSGKHRQP KPKQTVRQIQ AVRISHIDRT

 51 QGSQELMLHS LGLIGTPYKW GGSSTATGFD CSGMIQFVYK NALNVKLPRT

101 ARDMAAASRK IPDSRXKAGD LVFFNTGGAH RYSHVGLYIG NGEFIHAPSS

151 GKTIKTEKLS TPFYAKNYLG AHTFFTE*
```

The following partial DNA sequence was identified in *N. gonorrhoeae* <SEQ ID 3099>:

```
g206.seq

  1 atgttttccc ccgacaaaac ccttttcctc tgtctcggcg cactgctcct

 51 cgcctcatgc ggcacgacct ccggcaaaca ccgccaaccg aaacccaaac

101 agacagtccg gcaaatccaa gccgtccgca tcagccacat cggccgcaca

151 caaggctcgc aggaactcat gctccacagc ctcggactca tcggcacgcc

201 ctacaaatgg ggcggcagca gcaccgcaac cggcttcgac tgcagcggca

251 tgattcaatt ggtttacaaa aacgccctca acgtcaagct gccgcgcacc

301 gcccgcgaca tggcggcggc aagccgcaaa atccccgaca gccgcctcaa

351 ggccggcgac atcgtattct tcaacaccgg cggcgcacac cgctactcac

401 acgtcggact ctacatcggc aacggcgaat tcatccatgc ccccggcagc
```

-continued

```
451 ggcaaaacca tcaaaaccga aaaactctcc acaccgtttt acgccaaaaa

501 ctaccttgga gcgcatacgt tttttacaga atga
```

This corresponds to the amino acid sequence <SEQ ID 3100; ORF 206.ng>:

g206.pep

```
  1 MFSPDKTLFL CLGALLLASC GTTSGKHRQP KPKQTVRQIQ AVRISHIGRT

 51 QGSQELMLHS LGLIGTPYKW GGSSTATGFD CSGMIQLVYK NALNVKLPRT

101 ARDMAAASRK IPDSRLKAGD IVFFNTGGAH RYSHVGLYIG NGEFIHAPGS

151 GKTIKTEKLS TPFYAKNYLG AHTFFTE*
```

ORF 206 shows 96.0% identity over a 177 aa overlap with a predicted ORF (ORF 206.ng) from *N. gonorrhoeae*:

m206/g206

```
                   10        20        30        40        50        60
m206.pep   MFPPDKTLFLCLSALLLASCGTTSGKHRQPKPKQTVRQIQAVRISHIDRTQGSQELMLHS
           || |||||||||:||||||||||||||||||||||||||||||||| |||||||||||||
g206       MFSPDKTLFLCLGALLLASCGTTSGKHRQPKPKQTVRQIQAVRISHIGRTQGSQELMLHS
                   10        20        30        40        50        60

                   70        80        90       100       110       120
m206.pep   LGLIGTPYKWGGSSTATGFDCSGMIQFVYKNALNVKLPRTARDMAAASRKIPDSRXKAGD
           ||||||||||||||||||||||||||:|||||||||||||||||||||||||||| ||||
g206       LGLIGTPYKWGGSSTATGFDCSGMIQLVYKNALNVKLPRTARDMAAASRKIPDSRLKAGD
                   70        80        90       100       110       120

                  130       140       150       160       170
m206.pep   LVFFNTGGAHRYSHVGLYIGNGEFIHAPSSGKTIKTEKLSTPFYAKNYLGAHTFFTEX
           :|||||||||||||||||||||||||||:||||||||||||||||||||||||||||
g206       IVFFNTGGAHRYSHVGLYIGNGEFIHAPGSGKTIKTEKLSTPFYAKNYLGAHTFFTE
                  130       140       150       160       170
```

The following partial DNA sequence was identified in *N. meningitidis* <SEQ ID 3101>:

a206.seq

```
  1 ATGTTTCCCC CCGACAAAAC CCTTTTCCTC TGTCTCAGCG CACTGCTCCT

 51 CGCCTCATGC GGCACGACCT CCGGCAAACA CCGCCAACCG AAACCCAAAC

101 AGACAGTCCG GCAAATCCAA GCCGTCCGCA TCAGCCACAT CGACCGCACA

151 CAAGGCTCGC AGGAACTCAT GCTCCACAGC CTCGGACTCA TCGGCACGCC

201 CTACAAATGG GGCGGCAGCA GCACCGCAAC CGGCTTCGAT TGCAGCGGCA

251 TGATTCAATT CGTTTACAAA AACGCCCTCA ACGTCAAGCT GCCGCGCACC

301 GCCCGCGACA TGGCGGCGGC AAGCCGCAAA ATCCCCGACA GCCGCCTTAA

351 GGCCGGCGAC CTCGTATTCT TCAACACCGG CGGCGCACAC CGCTACTCAC

401 ACGTCGGACT CTATATCGGC AACGGCGAAT TCATCCATGC CCCCAGCAGC

451 GGCAAAACCA TCAAAACCGA AAAACTCTCC ACACCGTTTT ACGCCAAAAA

501 CTACCTCGGC GCACATACTT TCTTTACAGA ATGA
```

This corresponds to the amino acid sequence <SEQ ID 3102; ORF 206.a>:

a206.pep

```
  1 MFPPDKTLFL CLSALLLASC GTTSGKHRQP KPKQTVRQIQ AVRISHIDRT
 51 QGSQELMLHS LGLIGTPYKW GGSSTATGFD CSGMIQFVYK NALNVKLPRT
101 ARDMAAASRK IPDSRLKAGD LVFFNTGGAH RYSHVGLYIG NGEFIHAPSS
151 GKTIKTEKLS TPFYAKNYLG AHTFFTE*
```

m206/a206 ORFs 206 and 206.a showed a 99.4% identity in 177 aa overlap

```
                   10        20        30        40        50        60
m206.pep   MFPPDKTLFLCLSALLLASCGTTSGKHRQPKPKQTVRQIQAVRISHIDRTQGSQELMLHS
           ||||||||||||||||||||||||||||||||||||||||||||||||||||||||||||
a206       MFPPDKTLFLCLSALLLASCGTTSGKHRQPKPKQTVRQIQAVRISHIDRTQGSQELMLHS
                   10        20        30        40        50        60
                   70        80        90       100       110       120
m206.pep   LGLIGTPYKWGGSSTATGFDCSGMIQFVYKNALNVKLPRTARDMAAASRKIPDSRXKAGD
           ||||||||||||||||||||||||||||||||||||||||||||||||||||||| ||||
a206       LGLIGTPYKWGGSSTATGFDCSGMIQFVYKNALNVKLPRTARDMAAASRKIPDSRLKAGD
                   70        80        90       100       110       120
                  130       140       150       160       170
m206.pep   LVFFNTGGAHRYSHVGLYIGNGEFIHAPSSGKTIKTEKLSTPFYAKNYLGAHTFFTEX
           ||||||||||||||||||||||||||||||||||||||||||||||||||||||||||
a206       LVFFNTGGAHRYSHVGLYIGNGEFIHAPSSGKTIKTEKLSTPFYAKNYLGAHTFFTEX
                  130       140       150       160       170
```

The following partial DNA sequence was identified in *N. meningitidis* <SEQ ID 3103>:

m287.seq

```
  1 ATGTTTAAAC GCAGCGTAAT CGCAATGGCT TGTATTTTTG CCCTTTCAGC
 51 CTGCGGGGGC GGCGGTGGCG GATCGCCCGA TGTCAAGTCG GCGGACACGC
101 TGTCAAAACC TGCCGCCCCT GTTGTTTCTG AAAAAGAGAC AGAGGCAAAG
151 GAAGATGCGC CACAGGCAGG TTCTCAAGGA CAGGGCGCGC CATCCGCACA
201 AGGCAGTCAA GATATGGCGG CGGTTTCGGA AGAAAATACA GGCAATGGCG
251 GTGCGGTAAC AGCGGATAAT CCCAAAAATG AAGACGAGGT GGCACAAAAT
301 GATATGCCGC AAAATGCCGC CGGTACAGAT AGTTCGACAC CGAATCACAC
351 CCCGGATCCG AATATGCTTG CCGGAAATAT GGAAAATCAA GCAACGGATG
401 CCGGGGAATC GTCTCAGCCG GCAAACCAAC CGGATATGGC AAATGCGGCG
451 GACGGAATGC AGGGGGACGA TCCGTCGGCA GGCGGGCAAA ATGCCGGCAA
501 TACGGCTGCC CAAGGTGCAA ATCAAGCCGG AAACAATCAA GCCGCCGGTT
551 CTTCAGATCC CATCCCCGCG TCAAACCCTG CACCTGCGAA TGGCGGTAGC
601 AATTTTGGAA GGGTTGATTT GGCTAATGGC GTTTTGATTG ACGGGCCGTC
651 GCAAAATATA ACGTTGACCC ACTGTAAAGG CGATTCTTGT AGTGGCAATA
701 ATTTCTTGGA TGAAGAAGTA CAGCTAAAAT CAGAATTTGA AAAATTAAGT
751 GATGCAGACA AAATAAGTAA TTACAAGAAA GATGGGAAGA ATGATAAATT
801 TGTCGGTTTG GTTGCCGATA GTGTGCAGAT GAAGGGAATC AATCAATATA
851 TTATCTTTTA TAAACCTAAA CCCACTTCAT TTGCGCGATT TAGGCGTTCT
901 GCACGGTCGA GGCGGTCGCT TCCGGCCGAG ATGCCGCTGA TTCCCGTCAA
```

-continued

```
 951 TCAGGCGGAT ACGCTGATTG TCGATGGGGA AGCGGTCAGC CTGACGGGGC
1001 ATTCCGGCAA TATCTTCGCG CCCGAAGGGA ATTACCGGTA TCTGACTTAC
1051 GGGGCGGAAA AATTGCCCGG CGGATCGTAT GCCCTTCGTG TTCAAGGCGA
1101 ACCGGCAAAA GGCGAAATGC TTGCGGGCGC GGCCGTGTAC AACGGCGAAG
1151 TACTGCATTT CCATACGGAA AACGCCCGTC CGTACCCGAC CAGGGGCAGG
1201 TTTGCCGCAA AAGTCGATTT CGGCAGCAAA TCTGTGGACG GCATTATCGA
1251 CAGCGGCGAT GATTTGCATA TGGGTACGCA AAAATTCAAA GCCGCCATCG
1301 ATGGAAACGG CTTTAAGGGG ACTTGGACGG AAAATGGCAG CGGGGATGTT
1351 TCCGGAAAGT TTTACGGCCC GGCCGGCGAG GAAGTGGCGG GAAAATACAG
1401 CTATCGCCCG ACAGATGCGG AAAAGGGCGG ATTCGGCGTG TTTGCCGGCA
1451 AAAAAGAGCA GGATTGA
```

This corresponds to the amino acid sequence <SEQ ID 3104; ORF 287>:

m287.pep

```
  1 MFKRSVIAMA CIFALSACGG GGGGSPDVKS ADTLSKPAAP VVSEKETEAK
 51 EDAPQAGSQG QGAPSAQGSQ DMAAVSEENT GNGGAVTADN PKNEDEVAQN
101 DMPQNAAGTD SSTPNHTPDP NMLAGNMENQ ATDAGESSQP ANQPDMANAA
151 DGMQGDDPSA GGQNAGNTAA QGANQAGNNQ AAGSSDPIPA SNPAPANGGS
201 NFGRVDLANG VLIDGPSQNI TLTHCKGDSC SGNNFLDEEV QLKSEFEKLS
251 DADKISNYKK DGKNDKFVGL VADSVQMKGI NQYIIFYKPK PTSFARFRRS
301 ARSRRSLPAE MPLIPVNQAD TLIVDGEAVS LTGHSGNIFA PEGNYRYLTY
351 GAEKLPGGSY ALRVQGEPAK GEMLAGAAVY NGEVLHFHTE NGRPYPTRGR
401 FAAKVDFGSK SVDGIIDSGD DLHMGTQKFK AAIDGNGFKG TWTENGSGDV
451 SGKFYGPAGE EVAGKYSYRP TDAEKGGFGV FAGKKEQD*
```

The following partial DNA sequence was identified in *N. gonorrhoeae* <SEQ ID 3105>:

g287.seq

```
  1 atgtttaaac gcagtgtgat tgcaatggct tgtatttttc cccttttcagc
 51 ctgtgggggc ggcggtggcg gatcgcccga tgtcaagtcg gcggacacgc
101 cgtcaaaacc ggccgccccc gttgttgctg aaaatgccgg ggaaggggtg
151 ctgccgaaag aaaagaaaga tgaggaggca gcgggcggtg cgccgcaagc
201 cgatacgcag gacgcaaccg ccggagaagg cagccaagat atggcggcag
251 tttcggcaga aaatacaggc aatggcggtg cggcaacaac ggacaacccc
301 aaaaatgaag acgcgggggc gcaaaatgat atgccgcaaa atgccgccga
351 atccgcaaat caaacaggga acaaccaacc cgccggttct tcagattccg
401 cccccgcgtc aaaccctgcc cctgcgaatg gcggtagcga ttttggaagg
451 acgaacgtgg gcaattctgt tgtgattgac ggaccgtcgc aaaatataac
501 gttgacccac tgtaaaggcg attcttgtaa tggtgataat ttattggatg
```

```
-continued

 551 aagaagcacc gtcaaaatca gaatttgaaa aattaagtga tgaagaaaaa

 601 attaagcgat ataaaaaaga cgagcaacgg gagaattttg tcggtttggt

 651 tgctgacagg gtaaaaaagg atggaactaa caaatatatc atcttctata

 701 cggacaaacc acctactcgt tctgcacggt cgaggaggtc gcttccggcc

 751 gagattccgc tgattcccgt caatcaggcc gatacgctga ttgtggatgg

 801 ggaagcggtc agcctgacgg ggcattccgg caatatcttc gcgcccgaag

 851 ggaattaccg gtatctgact tacggggcgg aaaaattgcc cggcggatcg

 901 tatgccctcc gtgtgcaagg cgaaccggca aaaggcgaaa tgcttgttgg

 951 cacggccgtg tacaacggcg aagtgctgca tttccatatg gaaaacggcc

1001 gtccgtaccc gtccggaggc aggtttgccg caaaagtcga tttcggcagc

1051 aaatctgtgg acggcattat cgacagcggc gatgatttgc atatgggtac

1101 gcaaaaattc aaagccgcca tcgatggaaa cggctttaag gggacttgga

1151 cggaaaatgg cggcggggat gtttccggaa ggttttacgg cccggccggc

1201 gaggaagtgg cgggaaaata cagctatcgc ccgacagatg ctgaaaaggg

1251 cggattcggc gtgtttgccg gcaaaaaaga tcgggattga
```

This corresponds to the amino acid sequence <SEQ ID 3106; ORF 287.ng>:

g287.pep

```
  1 MFKRSVIAMA CIFPLSACGG GGGGSPDVKS ADTPSKPAAP VVAENAGEGV

 51 LPKEKKDEEA AGGAPQADTQ DATAGEGSQD MAAVSAENTG NGGAATTDNP

101 KNEDAGAQND MPQNAAESAN QTGNNQPAGS SDSAPASNFA PANGGSDFGR

151 TNVGNSVVID GPSQNITLTH CKGDSCNGDN LLDEEAPSKS EFEKLSDEEK

201 IKRYKKDEQR ENFVGLVADR VKKDGTNKYI IFYTDKPPTR SARSRRSLPA

251 EIPLIPVNQA DTLIVDGEAV SLTGHSGNIF APEGNYRYLT YGAEKLPGGS

301 YALRVQGEPA KGEMLVGTAV YNGEVLHFHM ENGRPYPSGG RFAAKVDFGS

351 KSVDGIIDSG DDLHMGTQKF KAAIDGNGFK GTWTENGGGD VSGRFYGPAG

401 EEVAGKYSYR PTDAEKGGFG VFAGKKDRD*
```

m287/g287 ORFs 287 and 287.ng showed a 70.1% identity in 499 aa overlap

```
                10         20         30         40         49
m287.pep   MFKRSVIAMACIFALSACGGGGGGSPDVKSADTLSKPAAPVVSE-----------KETEA
           ||||||||||||| |||||||||||||||||||| |||||||| :|          |: ||
g287       MFKRSVIAMACIFPLSACGGGGGGSPDVKSADTPSKPAAPVVAEDVGEEVLPKEKKDEEA
                10         20         30         40         50         60

                50         60         70         80         90        100        109
m287.pep   KEDAPQAGSQGQGAPSAQGSQDMAAVSEENTGNGGAVTADNPKNEDEVAQNDMPQNAAGT
           ||||  :|     |  :::|||||||||| |:|||||||  ||||||  ||||||||
g287       AGGAPQADTQD--ATAGEGSQDMAAVSAENTGNGGAATTDNPKNEDAGAQNDMPQNAA--
                70         80         90        100        110

                110        120        140        140        150        160        169
m287.pep   DSSTPNHTPDPNMLAGNMENQATDAGESSQPANQPDMANAADGMQGDDPSAGGQNAGNTA

g287       ------------------------------------------------------------
```

-continued

```
          170       180       190       200       210       220      229
m287.pep    AQGANQAGNNQAAGSSDPIPASNPAPANGGSNFGRVDLANGVLIDGPSQNITLTHCKGDS
             ::|||:|||| |||||  ||||||||||||:|||::::|:|:|||||||||||||||||
g287        -ESANQTGNNQPAGSSDSAPASNPAPANGGSDFGRTNVGNSVVIDGPSQNITLTHCKGDS
              120       130       140       150       160       170

          230       240       250       260       270       280      289
m287.pep    CSGNNFLDEEVQLKSEFEKLSDADKISNYKKDGKNDKFVGLVADSVQMKGINQYIIFYKP
            |:|:|:||||:  ||||||||| :||: |||| : ::||||||| |:  | |:|||||
g287        CNGDNLLDEEAPSKSEFEKLSDEEKIKRYKKDEQRENFVGLVADRVKKDGTNKYIIFYTD
             180       190       200       210       220       230

          290       300       310       320       330       340      349
m287.pep    KPTSFARFRRSARSRRSLPAEMPLIPVNQADTLIVDGEAVSLTGHSGNIFAPEGNYRYLT
            || :     ||||||||||||:||||||||||||||||||||||||||||||||||||||
g287        KPPT-----RSARSRRSLPAEIPLIPVNQADTLIVDGEAVSLTGHSGNIFAPEGNYRYLT
                   240       250       260       270       280       290

          350       360       370       380       390       400      409
m287.pep    YGAEKLPGGSYALRVQGEPAKGEMLAGAAVYNGEVLHFHTENGRPYPTRGRFAAKVDFGS
            |||||||||||||||||||||||||:|:||||||||||| |||||||: |||||||||||
g287        YGAEKLPGGSYALRVQGEPAKGEMLVGTAVYNGEVLHFHMENGRPYPSGGRFAAKVDFGS
                   300       310       320       330       340       350

          410       420       430       440       450       460      469
m287.pep    KSVDGIIDSGDDLHMGTQKFKAAIDGNGFKGTWTENGSGDVSGKFYGPAGEEVAGKYSYR
            |||||||||||||||||||||||||||||||||||||:|||||:||||||||||||||||
g287        KSVDGIIDSGDDLHMGTQKFKAAIDGNGFKGTWTENGGGDVSGRFYGPAGEEVAGKYSYR
                   360       370       380       390       400       410

          470       480      489
m287.pep    PTDAEKGGFGVFAGKKEQDX
            ||||||||||||||||::||
g287        PTDAEKGGFGVFAGKKDRDX
                   420       430
```

The following partial DNA sequence was identified in *N. meningitidis* <SEQ ID 3107>:

a287.seq

```
  1 ATGTTTAAAC GCAGTGTGAT TGCAATGGCT TGTATTGTTG CCCTTTCAGC
 51 CTGTGGGGGC GGCGGTGGCG GATCGCCCGA TGTTAAGTCG GCGGACACGC
101 TGTCAAAACC TGCCGCCCCT GTTGTTACTG AAGATGTCGG GGAAGAGGTG
151 CTGCCGAAAG AAAAGAAAGA TGAGGAGGCG GTGAGTGGTG CGCCGCAAGC
201 CGATACGCAG GACGCAACCG CCGGAAAAGG CGGTCAAGAT ATGGCGGCAG
251 TTTCGGCAGA AAATACAGGC AATGGCGGTG CGGCAACAAC GGATAATCCC
301 GAAAATAAAG ACGAGGGACC GCAAAATGAT ATGCCGCAAA ATGCCGCCGA
351 TACAGATAGT TCGACACCGA ATCACACCCC TGCACCGAAT ATGCCAACCA
401 GAGATATGGG AAACCAAGCA CCGGATGCCG GGGAATCGGC ACAACCGGCA
451 AACCAACCGG ATATGGCAAA TGCGGCGGAC GGAATGCAGG GGGACGATCC
501 GTCGGCAGGG GAAAATGCCG GCAATACGGC AGATCAAGCT GCAAATCAAG
551 CTGAAAACAA TCAAGTCGGC GGCTCTCAAA ATCCTGCCTC TTCAACCAAT
601 CCTAACGCCA CGAATGGCGG CAGCGATTTT GGAAGGATAA ATGTAGCTAA
651 TGGCATCAAG CTTGACAGCG GTTCGGAAAA TGTAACGTTG ACACATTGTA
701 AAGACAAAGT ATGCGATAGA GATTTCTTAG ATGAAGAAGC ACCACCAAAA
751 TCAGAATTTG AAAAATTAAG TGATGAAGAA AAAATTAATA AATATAAAAA
801 AGACGAGCAA CGAGAGAATT TTGTCGGTTT GGTTGCTGAC AGGGTAGAAA
851 AGAATGGAAC TAACAAATAT GTCATCATTT ATAAAGACAA GTCCGCTTCA
901 TCTTCATCTG CGCGATTCAG GCGTTCTGCA CGGTCGAGGC GGTCGCTTCC
951 GGCCGAGATG CCGCTGATTC CCGTCAATCA GGCGGATACG CTGATTGTCG
```

-continued

```
1001 ATGGGGAAGC GGTCAGCCTG ACGGGGCATT CCGGCAATAT CTTCGCGCCC

1051 GAAGGGAATT ACCGGTATCT GACTTACGGG GCGGAAAAAT TGTCCGGCGG

1101 ATCGTATGCC CTCAGTGTGC AAGGCGAACC GGCAAAAGGC GAAATGCTTG

1151 CGGGCACGGC CGTGTACAAC GGCGAAGTGC TGCATTTCCA TATGGAAAAC

1201 GGCCGTCCGT CCCCGTCCGG AGGCAGGTTT GCCGCAAAAG TCGATTTCGG

1251 CAGCAAATCT GTGGACGGCA TTATCGACAG CGGCGATGAT TTGCATATGG

1301 GTACGCAAAA ATTCAAAGCC GTTATCGATG GAAACGGCTT TAAGGGGACT

1351 TGGACGGAAA ATGGCGGCGG GGATGTTTCC GGAAGGTTTT ACGGCCCGGC

1401 CGGCGAAGAA GTGGCGGGAA AATACAGCTA TCGCCCGACA GATGCGGAAA

1451 AGGGCGGATT CGGCGTGTTT GCCGGCAAAA AAGAGCAGGA TTGA
```

This corresponds to the amino acid sequence <SEQ ID 3108; ORF 287.a>:

a287.pep

```
  1 MFKRSVIAMA CIVALSACGG GGGGSPDVKS ADTLSKPAAP VVTEDVGEEV

 51 LPKEKKDEEA VSGAPQADTQ DATAGKGGQD MAAVSAENTG NGGAATTDNP

101 ENKDEGPQND MPQNAADTDS STPNHTPAPN MPTRDMGNQA PDAGESAQPA

151 NQPDMANAAD GMQGDDPSAG ENAGNTADQA ANQAENNQVG GSQNPASSTN

201 PNATNGGSDF GRINVANGIK LDSGSENVTL THCKDKVCDR DFLDEEAPPK

251 SEFEKLSDEE KINKYKKDEQ RENFVGLVAD RVEKNGTNKY VIIYKDKSAS

301 SSSARFRRSA RSRRSLPAEM PLIPVNQADT LIVDGEAVSL TGHSGNIFAP

351 EGNYRYLTYG AEKLSGGSYA LSVQGEPAKG EMLAGTAVYN GEVLHFHMEN

401 GRPSPSGGRF AAKVDFGSKS VDGIIDSGDD LHMGTQKFKA VIDGNGFKGT

451 WTENGGGDVS GRFYGPAGEE VAGKYSYRPT DAEKGGFGVF AGKKEQD*
```

m287/a287 ORFs 287 and 287.a showed a 77.2% identity in 501 aa overlap

```
                      10        20        30        40                  49
m287.pep      MFKRSVIAMACIFALSACGGGGGGSPDVKSADTLSKPAAPVVSE-----------KETEA
              |||||||||||| |||||||||||||||||||||||||||||:|           |: ||
a287          MFKRSVIAMACIVALSACGGGGGGSPDVKSADTLSKPAAPVVTEDVGEEVLPKEKKDEEA
                      10        20        30        40        50        60

             50        60        70        80        90       100      109
m287.pep      KEDAPQAGSQGQGAPSAQGSQDMAAVSEENTGNGGAVTADNPKNEDEVAQNDMPQNAAGT
                 |||| :|   | :::|:||||||| ||||||||:|:|||:|:||  ||||||||| |
a287          VSGAPQADTQ--DATAGKGGQDMAAVSAENTGNGGAATTDNPENKDEGPQNDMPQNAADT
                      70          80        90       100       110

            110       120       140       140       150       160      169
m287.pep      DSSTPNHTPDPNMLAGNMENQATDAGESSQPANQPDMANAADGMQGDDPSAGGQNAGNTA
              ||||||||| ||| : :| ||| |||||:||||||||||||||||||||||| :||||||
a287          DSSTPNHTPAPNMPTRDMGNQAPDAGESAQPANQPDMANAADGMQGDDPSAG-ENAGNTA
             120       130       140       150       160       170

            170       180       190       200       210       220      229
m287.pep      AQGANQAGNNQAAGSSDPIPASNPAPANGGSNFGRVDLANGVLIDGPSQNITLTHCKGDS
               |:|||| |||::||::|  ::||  :||||:|||:::|||: :|: |:|:||||||
a287          DQAANQAENNQVGGSQNPASSTNPNATNGGSDFGRINVANGIKLDSGSENVTLTHCKDKV
              180       190       200       210       220       230

            230       240       250       260       270       280      289
m287.pep      CSGNNFLDEEVQLKSEFEKLSDADKISNYKKDGKNDKFVGLVADSVQMKGINQYIIFYKP
              |:  :|||||:  ||||||||| :||::|||| : ::||||||| |: :| |:|:|:||
a287          CD-RDFLDEEAPPKSEFEKLSDEEKINKYKKDEQRENFVGLVADRVEKNGTNKYVIIYKD
               240       250       260       270       280       290
```

-continued

```
           290       300       310       320       330       340
m287.pep   KP--TSFARFRRSARSRRSLPAEMPLIPVNQADTLIVDGEAVSLTGHSGNIFAPEGNYRY
           |   :|||||||||||||||||||||||||||||||||||||||||||||||||||||||
a287       KSASSSFARFRRSARSRRSLPAEMPLIPVNQADTLIVDGEAVSLTGHSGNIFAPEGNYRY
             300       310       320       330       340       350

           350       360       370       380       390       400
m287.pep   LTYGAEKLPGGSYALRVQGEPAKGEMLAGAAVYNGEVLHFHTENGRPYPTRGRFAAKVDF
           |||||||| |||||| |||||||||||||:||||||||||| ||||| |: |||||||||
a287       LTYGAEKLSGGSYALSVQGEPAKGEMLAGTAVYNGEVLHFHMENGRPSPSGGRFAAKVDF
             360       370       380       390       400       410

           410       420       430       440       450       460
m287.pep   GSKSVDGIIDSGDDLHMGTQKFKAAIDGNGFKGTWTENGSGDVSGKFYGPAGEEVAGKYS
           ||||||||||||||||||||||||:||||||||||||||:|||||:||||||||||||||
a287       GSKSVDGIIDSGDDLHMGTQKFKAVIDGNGFKGTWTENGGGDVSGRFYGPAGEEVAGKYS
             420       430       440       450       460       470

           470       480      489
m287.pep   YRPTDAEKGGFGVFAGKKEQDX
           ||||||||||||||||||||||
a287       YRPTDAEKGGFGVFAGKKEQDX
             480       490
```

The following partial DNA sequence was identified in *N. meningitidis* <SEQ ID 3109>:

m406.seq

```
  1 ATGCAAGCAC GGCTGCTGAT ACCTATTCTT TTTTCAGTTT TTATTTTATC
 51 CGCCTGCGGG ACACTGACAG GTATTCCATC GCATGGCGGA GGTAAACGCT
101 TTGCGGTCGA ACAAGAACTT GTGGCCGCTT CTGCCAGAGC TGCCGTTAAA
151 GACATGGATT TACAGGCATT ACACGGACGA AAAGTTGCAT TGTACATTGC
201 CACTATGGGC GACCAAGGTT CAGGCAGTTT GACAGGGGGT CGCTACTCCA
251 TTGATGCACT GATTCGTGGC GAATACATAA ACAGCCCTGC CGTCCGTACC
301 GATTACACCT ATCCACGTTA CGAAACCACC GCTGAAACAA CATCAGGCGG
351 TTTGACAGGT TTAACCACTT CTTTATCTAC ACTTAATGCC CCTGCACTCT
401 CTCGCACCCA ATCAGACGGT AGCGGAAGTA AAAGCAGTCT GGGCTTAAAT
451 ATTGGCGGGA TGGGGGATTA TCGAAATGAA ACCTTGACGA CTAACCCGCG
501 CGACACTGCC TTTCTTTCCC ACTTGGTACA GACCGTATTT TTCCTGCGCG
551 GCATAGACGT TGTTTCTCCT GCCAATGCCG ATACAGATGT GTTTATTAAC
601 ATCGACGTAT TCGGAACGAT ACGCAACAGA ACCGAAATGC ACCTATACAA
651 TGCCGAAACA CTGAAAGCCC AAACAAAACT GGAATATTTC GCAGTAGACA
701 GAACCAATAA AAAATTGCTC ATCAAACCAA AAACCAATGC GTTTGAAGCT
751 GCCTATAAAG AAAATTACGC ATTGTGGATG GGGCCGTATA AAGTAAGCAA
801 AGGAATTAAA CCGACGGAAG GATTAATGGT CGATTTCTCC GATATCCGAC
851 CATACGGCAA TCATACGGGT AACTCCGCCC CATCCGTAGA GGCTGATAAC
901 AGTCATGAGG GGTATGGATA CAGCGATGAA GTAGTGCGAC AACATAGACA
951 AGGACAACCT TGA
```

This corresponds to the amino acid sequence <SEQ ID 3110; ORF 406>:

m406.pep

```
  1 MQARLLIPIL FSVFILSACG TLTGIPSHGG GKRFAVEQEL VAASARAAVK
 51 DMDLQALHGR KVALYIATMG DQGSGSLTGG RYSIDALIRG EYINSPAVRT
```

-continued

```
101 DYTYPRYETT AETTSGGLTG LTTSLSTLNA PALSRTQSDG SGSKSSLGLN

151 IGGMGDYRNE TLTTNPRDTA FLSHLVQTVF FLRGIDVVSP ANADTDVFIN

201 IDVFGTIRNR TEMHLYNAET LKAQTKLEYF AVDRTNKKLL IKPKTNAFEA

251 AYKENYALWM GPYKVSKGIK PTEGLMVDFS DIRPYGNHTG NSAPSVEADN

301 SHEGYGYSDE VVRQHRQGQP *
```

The following partial DNA sequence was identified in *N. gonorrhoeae* <SEQ ID 3111>:

g406.seq

```
  1 ATGCGGGCAC GGCTGCTGAT ACCTATTCTT TTTTCAGTTT TTATTTTATC

 51 CGCCTGCGGG ACACTGACAG GTATTCCATC GCATGGCGGA GGCAAACGCT

101 TCGCGGTCGA ACAAGAACTT GTGGCCGCTT CTGCCAGAGC TGCCGTTAAA

151 GACATGGATT TACAGGCATT ACACGGACGA AAAGTTGCAT TGTACATTGC

201 AACTATGGGC GACCAAGGTT CAGGCAGTTT GACAGGGGGT CGCTACTCCA

251 TTGATGCACT GATTCGCGGC GAATACATAA ACAGCCCTGC CGTCCGCACC

301 GATTACACCT ATCCGCGTTA CGAAACCACC GCTGAAACAA CATCAGGCGG

351 TTTGACGGGT TTAACCACTT CTTTATCTAC ACTTAATGCC CCTGCACTCT

401 CGCGCACCCA ATCAGACGGT AGCGGAAGTA GGAGCAGTCT GGGCTTAAAT

451 ATTGGCGGGA TGGGGGATTA TCGAAATGAA ACCTTGACGA CCAACCCGCG

501 CGACACTGCC TTTCTTTCCC ACTTGGTGCA GACCGTATTT TTCCTGCGCG

551 GCATAGACGT TGTTTCTCCT GCCAATGCCG ATACAGATGT GTTTATTAAC

601 ATCGACGTAT TCGGAACGAT ACGCAACAGA ACCGAAATGC ACCTATACAA

651 TGCCGAAACA CTGAAAGCCC AAACAAAACT GGAATATTTC GCAGTAGACA

701 GAACCAATAA AAAATTGCTC ATCAAACCCA AAACCAATGC GTTTGAAGCT

751 GCCTATAAAG AAAATTACGC ATTGTGGATG GGGCCGTATA AAGTAAGCAA

801 AGGAATCAAA CCGACGGAAG GATTGATGGT CGATTTCTCC GATATCCAAC

851 CATACGGCAA TCATACGGGT AACTCCGCCC CATCCGTAGA GGCTGATAAC

901 AGTCATGAGG GGTATGGATA CAGCGATGAA GCAGTGCGAC AACATAGACA

951 AGGGCAACCT TGA
```

This corresponds to the amino acid sequence <SEQ ID 3112; ORF 406>:

g406.pep

```
  1 MRARLLIPIL FSVFILSACG TLTGIPSHGG GKRFAVEQEL VAASARAAVK

 51 DMDLQALHGR KVALYIATMG DQGSGSLTGG RYSIDALIRG EYINSPAVRT

101 DYTYPRYETT AETTSGGLTG LTTSLSTLNA PALSRTQSDG SGSRSSLGLN

151 IGGMGDYRNE TLTTNPRDTA FLSHLVQTVF FLRGIDVVSP ANADTDVFIN

201 IDVFGTIRNR TEMHLYNAET LKAQTKLEYF AVDRTNKKLL IKPKTNAFEA
```

-continued

```
251 AYKENYALWM GPYKVSKGIK PTEGLMVDFS DIQPYGNHTG NSAPSVEADN

301 SHEGYGYSDE AVRQHRQGQP *
```

ORF 406 shows 98.8% identity over a 320 aa overlap with a predicted ORF (ORF406.a) from *N. gonorrhoeae*:

g406/m406

```
                    10        20        30        40        50        60
g406.pep    MRARLLIPILFSVFILSACGTLTGIPSHGGGKRFAVEQELVAASARAAVKDMDLQALHGR
            |:||||||||||||||||||||||||||||||||||||||||||||||||||||||||||
m406        MQARLLIPILFSVFILSACGTLTGIPSHGGGKRFAVEQELVAASARAAVKDMDLQALHGR
                    10        20        30        40        50        60
                    70        80        90       100       110       120
g406.pep    KVALYIATMGDQGSGSLTGGRYSIDALIRGEYINSPAVRTDYTYPRYETTAETTSGGLTG
            ||||||||||||||||||||||||||||||||||||||||||||||||||||||||||||
m406        KVALYIATMGDQGSGSLTGGRYSIDALIRGEYINSPAVRTDYTYPRYETTAETTSGGLTG
                    70        80        90       100       110       120
                   130       140       150       160       170       180
g406.pep    LTTSLSTLNAPALSRTQSDGSGSRSSLGLNIGGMGDYRNETLTTNPRDTAFLSHLVQTVF
            |||||||||||||||||||||||:||||||||||||||||||||||||||||||||||||
m406        LTTSLSTLNAPALSRTQSDGSGSKSSLGLNIGGMGDYRNETLTTNPRDTAFLSHLVQTVF
                   130       140       150       160       170       180
                   190       200       210       220       230       240
g406.pep    FLRGIDVVSPANADTDVFINIDVFGTIRNRTEMHLYNAETLKAQTKLEYFAVDRTNKKLL
            ||||||||||||||||||||||||||||||||||||||||||||||||||||||||||||
m406        FLRGIDVVSPANADTDVFINIDVFGTIRNRTEMHLYNAETLKAQTKLEYFAVDRTNKKLL
                   190       200       210       220       230       240
                   250       260       270       280       290       300
g406.pep    IKPKTNAFEAAYKENYALWMGPYKVSKGIKPTEGLMVDFSDIQPYGNHTGNSAPSVEADN
            ||||||||||||||||||||||||||||||||||||||||||:|||||||||||||||||
m406        IKPKTNAFEAAYKENYALWMGPYKVSKGIKPTEGLMVDFSDIRPYGNHTGNSAPSVEADN
                   250       260       270       280       290       300
                   310       320
g406.pep    SHEGYGYSDEAVRQHRQGQPX
            ||||||||||:||||||||||
m406        SHEGYGYSDEVVRQHRQGQPX
                   310       320
```

The following partial DNA sequence was identified in *N. meningitidis* <SEQ ID 3113>:

a406.seq

```
  1 ATGCAAGCAC GGCTGCTGAT ACCTATTCTT TTTTCAGTTT TTATTTTATC

 51 CGCCTGCGGG ACACTGACAG GTATTCCATC GCATGGCGGA GGTAAACGCT

101 TCGCGGTCGA ACAAGAACTT GTGGCCGCTT CTGCCAGAGC TGCCGTTAAA

151 GACATGGATT TACAGGCATT ACACGGACGA AAAGTTGCAT TGTACATTGC

201 AACTATGGGC GACCAAGGTT CAGGCAGTTT GACAGGGGGT CGCTACTCCA

251 TTGATGCACT GATTCGTGGC GAATACATAA ACAGCCCTGC CGTCCGTACC

301 GATTACACCT ATCCACGTTA CGAAACCACC GCTGAAACAA CATCAGGCGG

351 TTTGACAGGT TTAACCACTT CTTTATCTAC ACTTAATGCC CCTGCACTCT

401 CGCGCACCCA ATCAGACGGT AGCGGAAGTA AAAGCAGTCT GGGCTTAAAT

451 ATTGGCGGGA TGGGGGATTA TCGAAATGAA ACCTTGACGA CTAACCCGCG

501 CGACACTGCC TTTCTTTCCC ACTTGGTACA GACCGTATTT TTCCTGCGCG

551 GCATAGACGT TGTTTCTCCT GCCAATGCCG ATACGGATGT GTTTATTAAC

601 ATCGACGTAT TCGGAACGAT ACGCAACAGA ACCGAAATGC ACCTATACAA

651 TGCCGAAACA CTGAAAGCCC AAACAAAACT GGAATATTTC GCAGTAGACA
```

-continued

```
701 GAACCAATAA AAAATTGCTC ATCAAACCAA AAACCAATGC GTTTGAAGCT

751 GCCTATAAAG AAAATTACGC ATTGTGGATG GGACCGTATA AAGTAAGCAA

801 AGGAATTAAA CCGACAGAAG GATTAATGGT CGATTTCTCC GATATCCAAC

851 CATACGGCAA TCATATGGGT AACTCTGCCC CATCCGTAGA GGCTGATAAC

901 AGTCATGAGG GGTATGGATA CAGCGATGAA GCAGTGCGAC GACATAGACA

951 AGGGCAACCT TGA
```

This corresponds to the amino acid sequence <SEQ ID 3114; ORF 406.a>:

```
a406.pep

  1 MQARLLIPIL FSVFILSACG TLTGIPSHGG GKRFAVEQEL VAASARAAVK

 51 DMDLQALHGR KVALYIATMG DQGSGSLTGG RYSIDALIRG EYINSPAVRT

101 DYTYPRYETT AETTSGGLTG LTTSLSTLNA PALSRTQSDG SGSKSSLGLN

151 IGGMGDYRNE TLTTNPRDTA FLSHLVQTVF FLRGIDVVSP ANADTDVFIN

201 IDVFGTIRNR TEMHLYNAET LKAQTKLEYF AVDRTNKKLL IKPKTNAFEA

251 AYKENYALWM GPYKVSKGIK PTEGLMVDFS DIQPYGNHMG NSAPSVEADN

301 SHEGYGYSDE AVRRHRQGQP *
```

m406/a406 ORFS 406 and 406.a showed a 98.8% identity in 320 aa overlap

```
                  10        20        30        40        50        60
m406.pep   MQARLLIPILFSVFILSACGTLTGIPSHGGGKRFAVEQELVAASARAAVKDMDLQALHGR
           ||||||||||||||||||||||||||||||||||||||||||||||||||||||||||||
a406       MQARLLIPILFSVFILSACGTLTGIPSHGGGKRFAVEQELVAASARAAVKDMDLQALHGR
                  10        20        30        40        50        60

                  70        80        90       100       110       120
m406.pep   KVALYIATMGDQGSGSLTGGRYSIDALIRGEYINSPAVRTDYTYPRYETTAETTSGGLTG
           ||||||||||||||||||||||||||||||||||||||||||||||||||||||||||||
a406       KVALYIATMGDQGSGSLTGGRYSIDALIRGEYINSPAVRTDYTYPRYETTAETTSGGLTG
                  70        80        90       100       110       120

                 130       140       150       160       170       180
m406.pep   LTTSLSTLNAPALSRTQSDGSGSKSSLGLNIGGMGDYRNETLTTNPRDTAFLSHLVQTVF
           ||||||||||||||||||||||||||||||||||||||||||||||||||||||||||||
a406       LTTSLSTLNAPALSRTQSDGSGSKSSLGLNIGGMGDYRNETLTTNPRDTAFLSHLVQTVF
                 130       140       150       160       170       180

                 190       200       210       220       230       240
m406.pep   FLRGIDVVSPANADTDVFINIDVFGTIRNRTEMHLYNAETLKAQTKLEYFAVDRTNKKLL
           ||||||||||||||||||||||||||||||||||||||||||||||||||||||||||||
a406       FLRGIDVVSPANADTDVFINIDVFGTIRNRTEMHLYNAETLKAQTKLEYFAVDRTNKKLL
                 190       200       210       220       230       240

                 250       260       270       280       290       300
m406.pep   IKPKTNAFEAAYKENYALWMGPYKVSKGIKPTEGLMVDFSDIRPYGNHTGNSAPSVEADN
           ||||||||||||||||||||||||||||||||||||||||||:||||| |||||||||||
a406       IKPKTNAFEAAYKENYALWMGPYKVSKGIKPTEGLMVDFSDIQPYGNHMGNSAPSVEADN
                 250       260       270       280       290       300

                 310       320
m406.pep   SHEGYGYSDEVVRQHRQGQPX
           ||||||||||:||:|||||||
a406       SHEGYGYSDEAVRRHRQGQPX
                 310       320
```

Example 2

Expression of ORF 919

The primer described in Table 1 for ORF 919 was used to locate and clone ORF 919. The predicted gene 919 was cloned in pET vector and expressed in *E. coli*. The product of protein expression and purification was analyzed by SDS-PAGE. In panel A) is shown the analysis of 919-His fusion protein purification. Mice were immunized with the purified 919-His and sera were used for Western blot (panel B), FACS analysis (panel C), bactericidal assay (panel D), and ELISA assay (panel E). Symbols: M1, molecular weight marker; PP, purified protein, TP, *N. meningitidis* total protein extract; OMV, *N. meningitidis* outer membrane vesicle preparation. Arrows indicate the position of the main recombinant protein product (A) and the *N. meningitidis* immunoreactive band (B). These experiments confirm that 919 is a surface-exposed protein and that it is a useful immunogen. The hydrophilicity plots, antigenic index, and amphipatic regions of ORF 919 are provided in FIG. 10. The AMPHI program is used to predict putative T-cell epitopes (Gao et al 1989, *J. Immunol* 143: 3007; Roberts et al. 1996, *AIDS Res Human Retroviruses* 12:593; Quakyi et al. 1992, *Scand J Immunol Suppl* 11:9). The nucleic acid sequence of ORF 919 and the amino acid sequence encoded thereby is provided in Example 1.

Example 3

Expression of ORF 279

Figure 11:
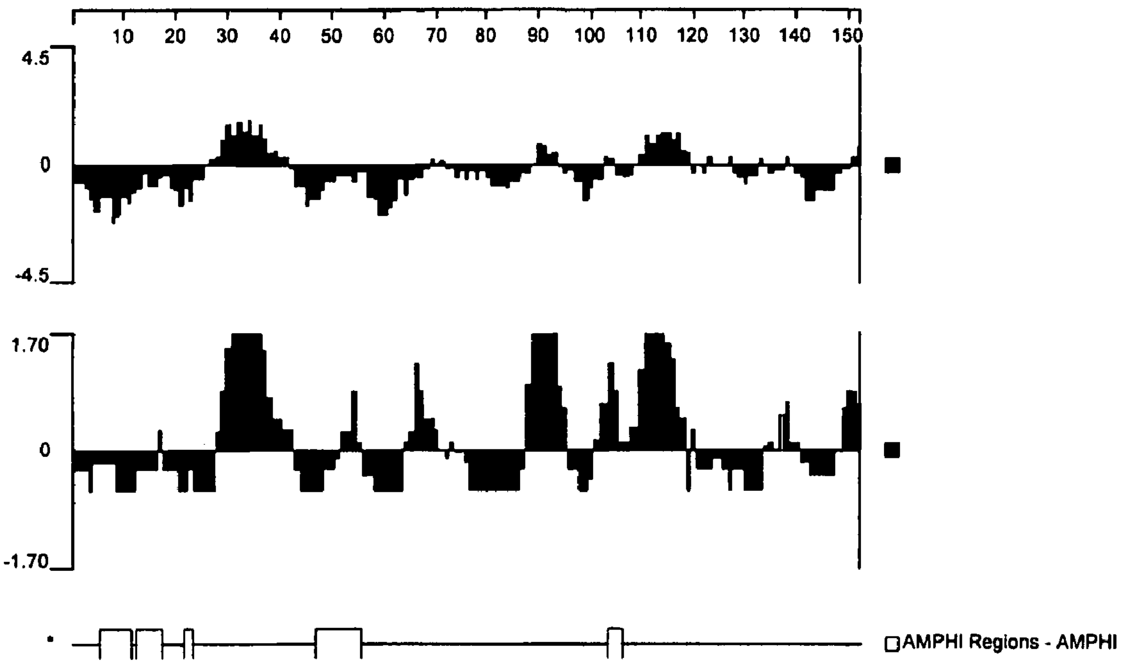
FIG. 11 illustrates the hydrophilicity plot, antigenic index and AMPHI regions of the products of protein expression the predicted ORF 279 as cloned and expressed in *E. coli.*

The primer described in Table 1 for ORF 279 was used to locate and clone ORF 279. The predicted gene 279 was cloned in pGex vector and expressed in *E. coli*. The product of protein expression and purification was analyzed by SDS-PAGE. In panel A) is shown the analysis of 279-GST purification. Mice were immunized with the purified 279-GST and sera were used for Western blot analysis (panel B), FACS analysis (panel C), bactericidal assay (panel D), and ELISA assay (panel E). Symbols: M1, molecular weight marker; TP, *N. meningitidis* total protein extract; OMV, *N. meningitidis* outer membrane vescicle preparation. Arrows indicate the position of the main recombinant protein product (A) and the *N. meningitidis* immunoreactive band (B). These experiments confirm that 279 is a surface-exposed protein and that it is a useful immunogen. The hydrophilicity plots, antigenic index, and amphipatic regions of ORF 279 are provided in FIG. 11. The AMPHI program is used to predict putative T-cell epitopes (Gao et al 1989, *J. Immunol.* 143:3007; Roberts et al. 1996, *AIDS Res Human Retroviruses* 12:593; Quakyi et al. 1992, *Scand J Immunol Suppl* 11:9). The nucleic acid sequence of ORF 279 and the amino acid sequence encoded thereby is provided in Example 1.

Example 4

Expression of ORF 576 and 576-1

Figure 12:
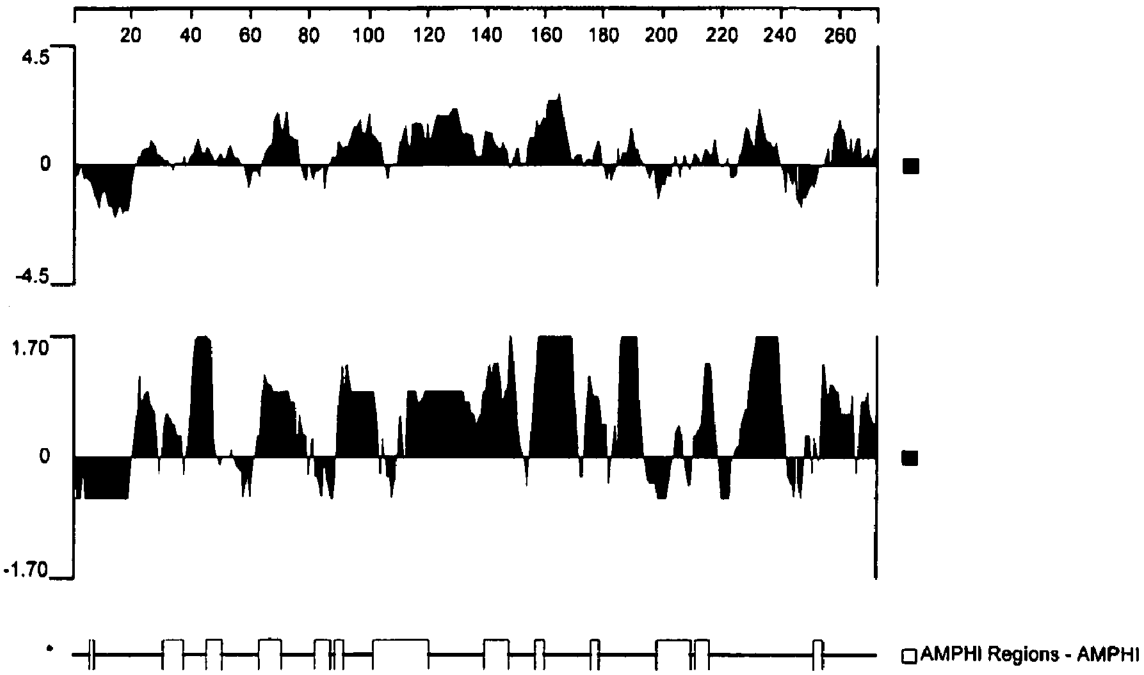
FIG. 12 illustrates the hydrophilicity plot, antigenic index and AMPHI regions of the products of protein expression the predicted ORF 576-1 as cloned and expressed in *E. coli.*

The primer described in Table 1 for ORF 576 was used to locate and clone ORF 576. The predicted gene 576 was cloned in pGex vector and expressed in *E. coli*. The product of protein purification was analyzed by SDS-PAGE. In panel A) is shown the analysis of 576-GST fusion protein purification. Mice were immunized with the purified 576-GST and sera were used for Western blot (panel B), FACS analysis (panel C), bactericidal assay (panel D), and ELISA assay (panel E). Symbols: M1, molecular weight marker; TP, *N. meningitidis* total protein extract; OMV, *N. meningitidis* outer membrane vescicle preparation. Arrows indicate the position of the main recombinant protein product (A) and the *N. meningitidis* immunoreactive band (B). These experiments confirm that ORF 576 is a surface-exposed protein and that it is a useful immunogen. The hydrophilicity plots, antigenic index, and amphipatic regions of ORF 576 are provided in FIG. 12. The AMPHI program is used to predict putative T-cell epitopes (Gao et al 1989, *J. Immunol.* 143:3007; Roberts et al. 1996, *AIDS Res Human Retroviruses* 12:593; Quakyi et al. 1992, *Scand J Immunol Suppl* 11:9). The nucleic acid sequence of ORF 576 and the amino acid sequence encoded thereby is provided in Example 1.

Example 5

Expression of ORF 519 and 519-1

Figure 13:
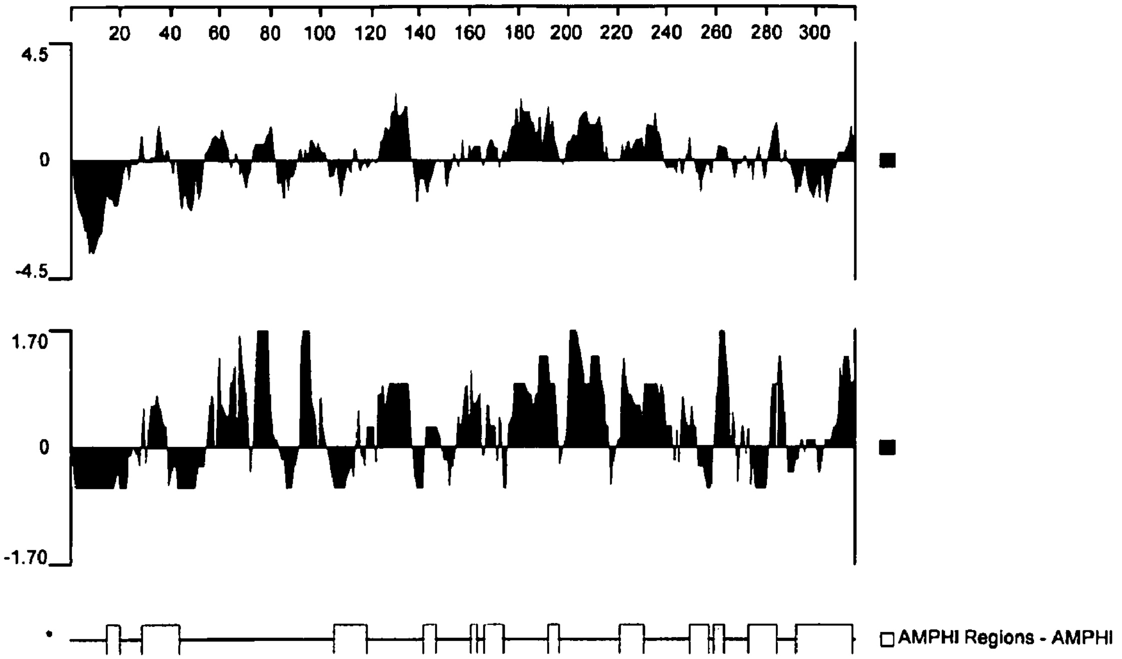
FIG. 13 illustrates the hydrophilicity plot, antigenic index and AMPHI regions of the products of protein expression the predicted ORF 519-1 as cloned and expressed in *E. coli.*

The primer described in Table 1 for ORF 519 was used to locate and clone ORF 519. The predicted gene 519 was cloned in pET vector and expressed in *E. coli*. The product of protein purification was analyzed by SDS-PAGE. In panel A) is shown the analysis of 519-His fusion protein purification. Mice were immunized with the purified 519-His and sera were used for Western blot (panel B), FACS analysis (panel C), bactericidal assay (panel D), and ELISA assay (panel E). Symbols: M1, molecular weight marker; TP, *N. meningitidis* total protein extract; OMV, *N. meningitidis* outer membrane vesicle preparation. Arrows indicate the position of the main recombinant protein product (A) and the *N. meningitidis* immunoreactive band (B). These experiments confirm that 519 is a surface-exposed protein and that it is a useful immunogen. The hydrophilicity plots, antigenic index, and amphipatic regions of ORF 519 are provided in FIG. 13. The AMPHI program is used to predict putative T-cell epitopes (Gao et al 1989, *J. Immunol* 143:3007; Roberts et al. 1996, *AIDS Res Human Retroviruses* 12:593; Quakyi et al. 1992, *Scand J Immunol Suppl* 11:9). The nucleic acid sequence of ORF 519 and the amino acid sequence encoded thereby is provided in Example 1.

Example 6

Expression of ORF 121 and 121-1

Figure 14:
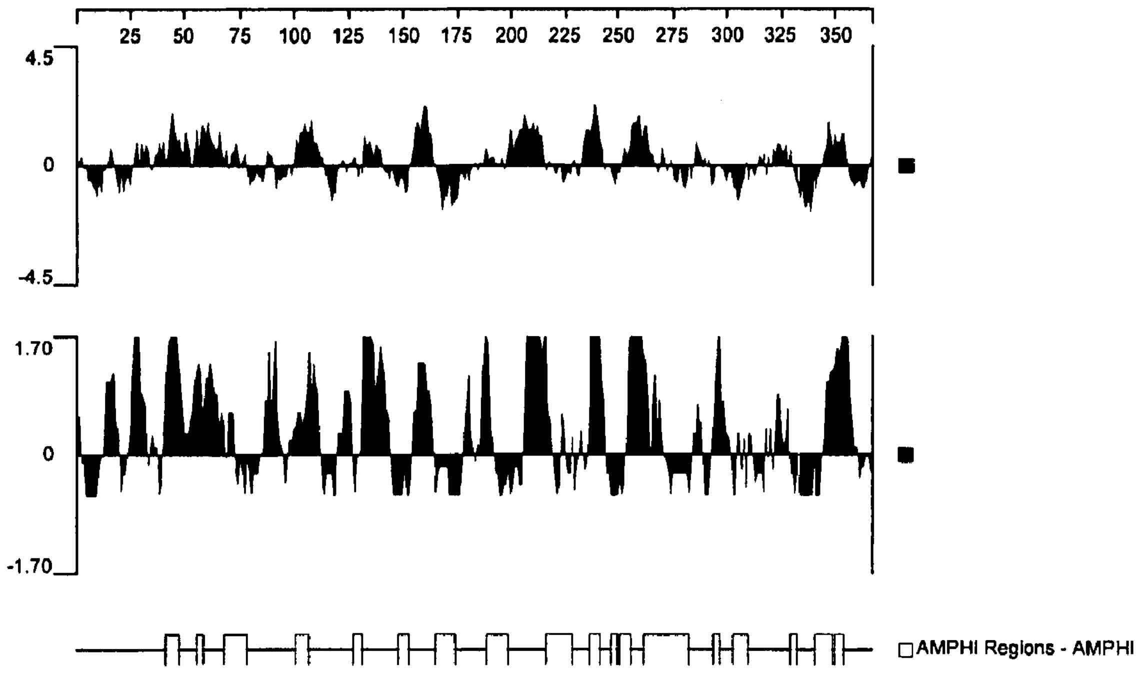
FIG. 14 illustrates the hydrophilicity plot, antigenic index and AMPHI regions of the products of protein expression the predicted ORF 121-1 as cloned and expressed in *E. coli.*

The primer described in Table 1 for ORF 121 was used to locate and clone ORF 121. The predicted gene 121 was cloned in pET vector and expressed in *E. coli*. The product of protein purification was analyzed by SDS-PAGE. In panel A) is shown the analysis of 121-His fusion protein purification. Mice were immunized with the purified 121-His and sera were used for Western blot analysis (panel B), FACS analysis (panel C), bactericidal assay (panel D), and ELISA assay (panel E). Results show that 121 is a surface-exposed protein. Symbols: M1, molecular weight marker; TP, *N. meningitidis* total protein extract; OMV, *N. meningitidis* outer membrane vescicle preparation. Arrows indicate the position of the main recombinant protein product (A) and the *N. meningitidis* immunoreactive band (B). These experiments confirm that 121 is a surface-exposed protein and that it is a useful immunogen. The hydrophilicity plots, antigenic index, and amphipatic regions of ORF 121 are provided in FIG. 14. The AMPHI program is used to predict putative T-cell epitopes (Gao et al 1989, *J. Immunol* 143:3007; Roberts et al. 1996, *AIDS Res Human Retroviruses* 12:593; Quakyi et al. 1992, *Scand J Immunol Suppl* 11:9). The nucleic acid sequence of ORF 121 and the amino acid sequence encoded thereby is provided in Example 1.

Example 7

Expression of ORF 128 and 128-1

The primer described in Table 1 for ORF 128 was used to locate and clone ORF 128. The predicted gene 128 was cloned in pET vector and expressed in *E. coli*. The product of protein purification was analyzed by SDS-PAGE. In panel A) is shown the analysis of 128-His purification. Mice were immunized with the purified 128-His and sera were used for Western blot analysis (panel B), FACS analysis (panel C), bactericidal assay (panel D) and ELISA assay (panel E).

Figure 15:
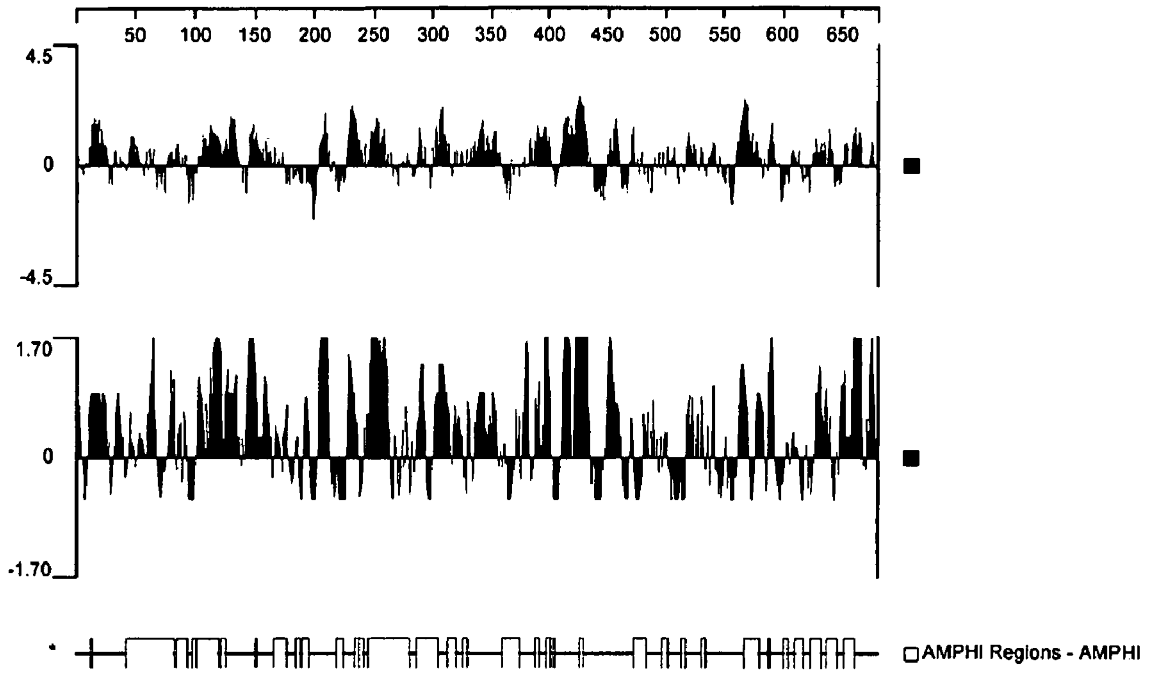
FIG. 15 illustrates the hydrophilicity plot, antigenic index and AMPHI regions of the products of protein expression the predicted ORF 128-1 as cloned and expressed in *E. coli.*

Results show that 128 is a surface-exposed protein. Symbols: M1, molecular weight marker; TP, *N. meningitidis* total protein extract; OMV, *N. meningitidis* outer membrane vesicle preparation. Arrows indicate the position of the main recombinant protein product (A) and the *N. meningitidis* immunoreactive band (B). These experiments confirm that 128 is a surface-exposed protein and that it is a useful immunogen. The hydrophilicity plots, antigenic index, and amphipatic regions of ORF 128 are provided in FIG. 15. The AMPHI program is used to predict putative T-cell epitopes (Gao et al 1989, *J. Immunol* 143:3007; Roberts et al. 1996, *AIDS Res Human Retroviruses* 12:593; Quakyi et al. 1992, *Scand J Immunol Suppl* 11:9). The nucleic acid sequence of ORF 128 and the amino acid sequence encoded thereby is provided in Example 1.

Example 8

Expression of ORF 206

Figure 16:
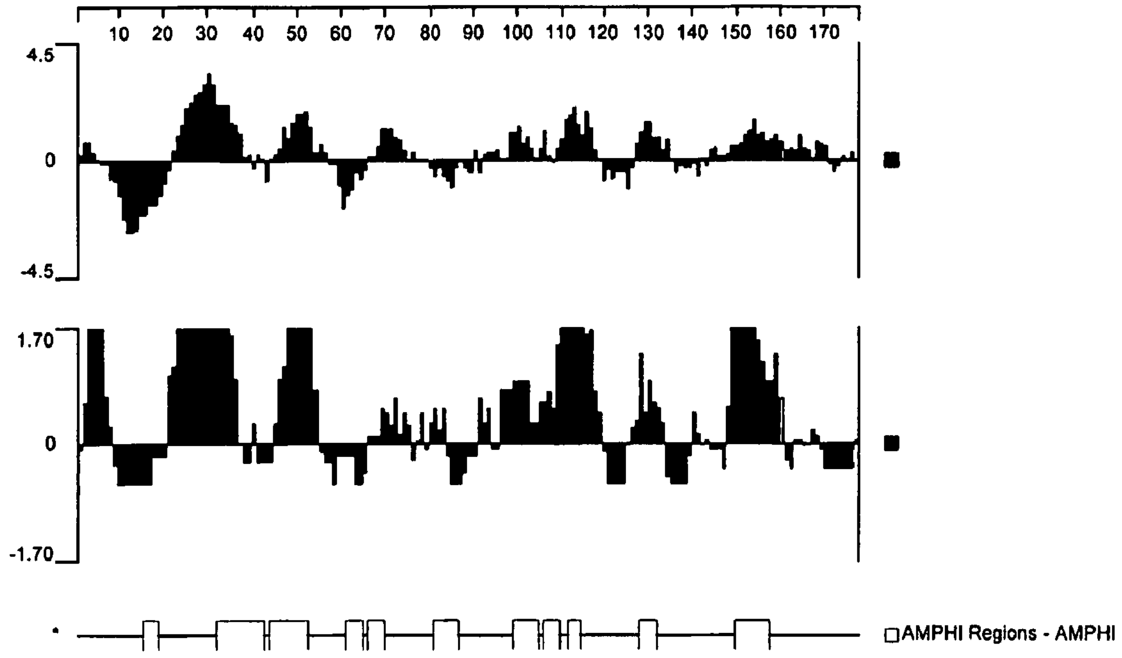
FIG. 16 illustrates the hydrophilicity plot, antigenic index and AMPHI regions of the products of protein expression the predicted ORF 206 as cloned and expressed in *E. coli.*

The primer described in Table 1 for ORF 206 was used to locate and clone ORF 206. The predicted gene 206 was cloned in pET vector and expressed in *E. coli*. The product of protein purification was analyzed by SDS-PAGE. In panel A) is shown the analysis of 206-His purification. Mice were immunized with the purified 206-His and sera were used for Western blot analysis (panel B). It is worthnoting that the immunoreactive band in protein extracts from meningococcus is 38 kDa instead of 17 kDa (panel A). To gain information on the nature of this antibody staining we expressed ORF 206 in *E. coli* without the His-tag and including the predicted leader peptide. Western blot analysis on total protein extracts from *E. coli* expressing this native form of the 206 protein showed a recative band at a position of 38 kDa, as observed in meningococcus. We conclude that the 38 kDa band in panel B) is specific and that anti-206 antibodies, likely recognize a multimeric protein complex. In panel C is shown the FACS analysis, in panel D the bactericidal assay, and in panel E) the ELISA assay. Results show that 206 is a surface-exposed protein. Symbols: M1, molecular weight marker; TP, *N. meningitidis* total protein extract; OMV, *N. meningitidis* outer membrane vesicle preparation. Arrows indicate the position of the main recombinant protein product (A) and the *N. meningitidis* immunoreactive band (B). These experiments confirm that 206 is a surface-exposed protein and that it is a useful immunogen. The hydrophilicity plots, antigenic index, and amphipatic regions of ORF 519 are provided in FIG. 16. The AMPHI program is used to predict putative T-cell epitopes (Gao et al 1989, *J. Immunol* 143:3007; Roberts et al. 1996, *AIDS Res Human Retroviruses* 12:593; Quakyi et al. 1992, *Scand J Immunol Suppl* 11:9). The nucleic acid sequence of ORF 206 and the amino acid sequence encoded thereby is provided in Example 1.

Example 9

Expression of ORF 287

Figure 17:
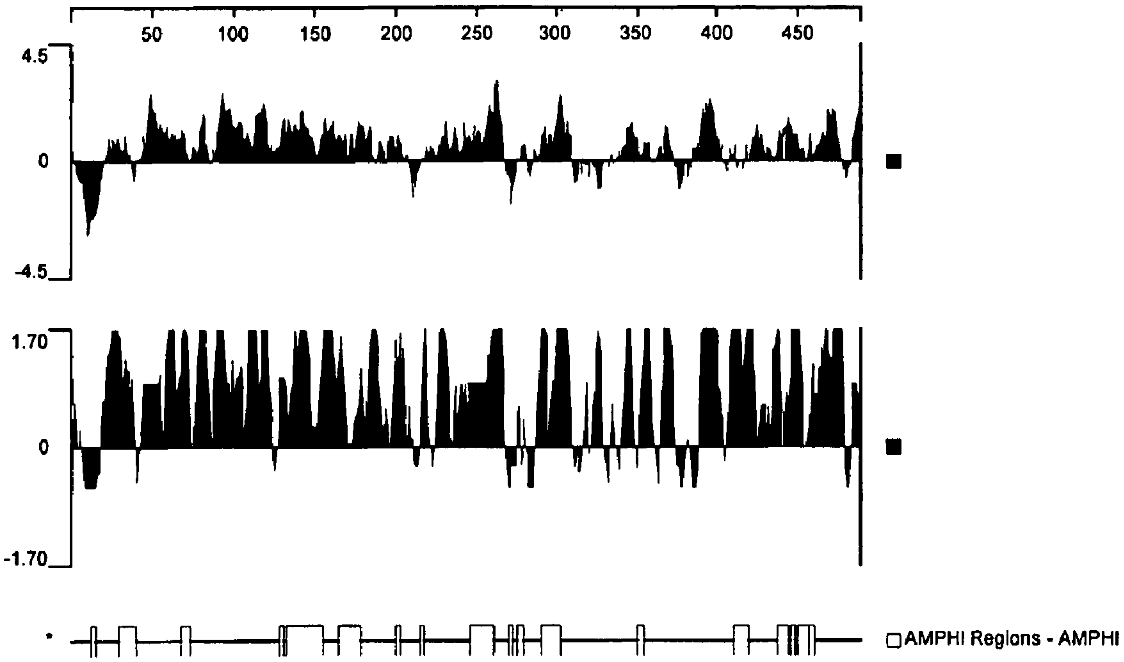
FIG. 17 illustrates the hydrophilicity plot, antigenic index and AMPHI regions of the products of protein expression the predicted ORF 287 as cloned and expressed in *E. coli.*

The primer described in Table 1 for ORF 287 was used to locate and clone ORF 287. The predicted gene 287 was cloned in pGex vector and expressed in *E. coli*. The product of protein purification was analyzed by SDS-PAGE. In panel A) is shown the analysis of 287-GST fusion protein purification. Mice were immunized with the purified 287-GST and sera were used for FACS analysis (panel B), bactericidal assay (panel C), and ELISA assay (panel D). Results show that 287 is a surface-exposed protein. Symbols: M1, molecular weight marker. Arrow indicates the position of the main recombinant protein product (A). These experiments confirm that 287 is a surface-exposed protein and that it is a useful immunogen. The hydrophilicity plots, antigenic index, and amphipatic regions of ORF 287 are provided in FIG. 17. The AMPHI program is used to predict putative T-cell epitopes (Gao et al 1989, *J. Immunol* 143:3007; Roberts et al. 1996, *AIDS Res Human Retroviruses* 12:593; Quakyi et al. 1992, *Scand J Immunol Suppl* 11:9). The nucleic acid sequence of ORF 287 and the amino acid sequence encoded thereby is provided in Example 1.

Example 10

Expression of ORF 406

Figure 18:
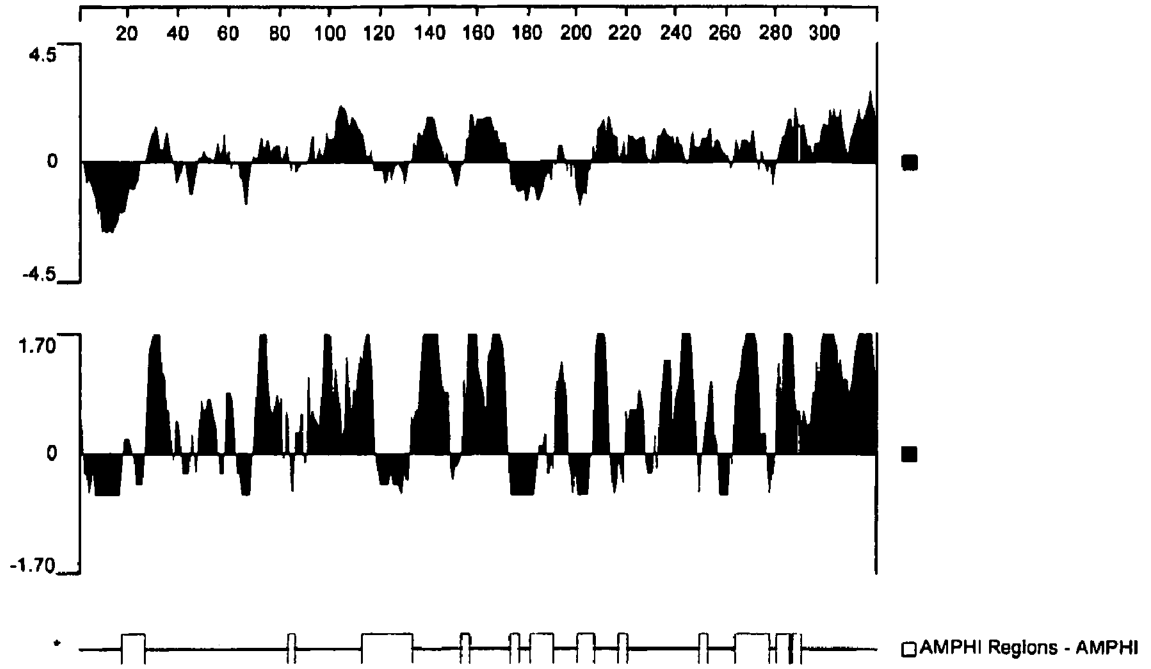
FIG. 18 illustrates the hydrophilicity plot, antigenic index and AMPHI regions of the products of protein expression the predicted ORF 406 as cloned and expressed in *E. coli.*

The primer described in Table 1 for ORF 406 was used to locate and clone ORF 406. The predicted gene 406 was cloned in pET vector and expressed in *E. coli*. The product of protein purification was analyzed by SDS-PAGE. In panel A) is shown the analysis of 406-His fusion protein purification. Mice were immunized with the purified 406-His and sera were used for Western blot analysis (panel B), FACS analysis (panel C), bactericidal assay (panel D), and ELISA assay (panel E). Results show that 406 is a surface-exposed protein. Symbols: MI, molecular weight marker; TP, *N. meningitidis* total protein extract; OMV, *N. meningitidis* outer membrane vescicle preparation. Arrows indicate the position of the main recombinant protein product (A) and the *N. meningitidis* immunoreactive band (B). These experiments confirm that 406 is a surface-exposed protein and that it is a useful immunogen. The hydrophilicity plots, antigenic index, and amphipatic regions of ORF 406 are provided in FIG. 18. The AMPHI program is used to predict putative T-cell epitopes (Gao et al 1989, *J. Immunol* 143:3007; Roberts et al. 1996, *AIDS Res Human Retroviruses* 12:593; Quakyi et al. 1992, *Scand J Immunol Suppl* 11:9). The nucleic acid sequence of ORF 406 and the amino acid sequence encoded thereby is provided in Example 1.

Example 11

Table 2 lists several *Neisseria* strains which were used to assess the conservation of the sequence of ORF 225 among different strains.

TABLE 2

225 gene variability: List of used *Neisseria* strains

| Identification number | Strains | Source/reference |
|---|---|---|
| Group B | | |
| zo01_225 | NG6/88 | R. Moxon/Seiler et al., 1996 |
| zo02_225 | BZ198 | R. Moxon/Seiler et al., 1996 |
| zo03_225 | NG3/88 | R. Moxon/Seiler et al., 1996 |
| zo04_225 | 297-0 | R. Moxon/Seiler et al., 1996 |
| zo05_225 | 1000 | R. Moxon/Seiler et al., 1996 |
| zo06_225 | BZ147 | R. Moxon/Seiler et al., 1996 |
| zo07_225 | BZ169 | R. Moxon/Seiler et al., 1996 |
| zo08_225 | 528 | R. Moxon/Seiler et al., 1996 |
| zo09_225 | NGP165 | R. Moxon/Seiler et al., 1996 |
| zo10_225 | BZ133 | R. Moxon/Seiler et al., 1996 |
| zo11_225 | NGE31 | R. Moxon/Seiler et al., 1996 |
| zo12_225 | NGF26 | R. Moxon/Seiler et al., 1996 |
| zo13_225 | NGE28 | R. Moxon/Seiler et al., 1996 |
| zo14_225 | NGH38 | R. Moxon/Seiler et al., 1996 |
| zo15_225 | SWZ107 | R. Moxon/Seiler et al., 1996 |
| zo16_225 | NGH15 | R. Moxon/Seiler et al., 1996 |

TABLE 2-continued 225 gene variability: List of used *Neisseria* strains

| Identification number | Strains | Source/reference |
|---|---|---|
| zo17__225 | NGH36 | R. Moxon/Seiler et al., 1996 |
| zo18__225 | BZ232 | R. Moxon/Seiler et al., 1996 |
| zo19__225 | BZ83 | R. Moxon/Seiler et al., 1996 |
| zo20__225 | 44/76 | R. Moxon/Seiler et al., 1996 |
| zo21__225 | MC58 | R. Moxon |
| zo96__225 | 2996 | Our collection |
| Group A | | |
| zo22__225 | 205900 | R. Moxon |
| zo23__225 | F6124 | R. Moxon |
| z2491 | Z2491 | R. Moxon/Maiden et al., 1998 |
| Group C | | |
| zo24__225 | 90/18311 | R. Moxon |
| zo25__225 | 93/4286 | R. Moxon |
| Others | | |
| zo26__225 | A22 (group W) | R. Moxon/Maiden et al., 1998 |
| zo27__225 | E26 (group X) | R. Moxon/Maiden et al., 1998 |
| zo28__225 | 860800 (group Y) | R. Moxon/Maiden et al., 1998 |
| zo29__225 | E32 (group Z) | R. Moxon/Maiden et al., 1998 |
| *Gonococcus* | | |
| zo32__225 | Ng F62 | R. Moxon/Maiden et al., 1998 |
| zo33__225 | Ng SN4 | R. Moxon |
| fa1090 | FA1090 | R. Moxon |

References:
Seiler A. et al., Mol. Microbiol., 1996, 19(4):841-856.
Maiden et al., Proc. Natl. Acad. Sci. USA, 1998, 95:3140-3145.

The amino acid sequences for each listed strain are as follows:

>FA1090 <SEQ ID 3115>

MDSFFKPAVWAVLWLMFAVRPALADELTNLLSSREQILRQFAEDEQPVLPVNRAPARRAG
NADELIGSAMGLNEQPVLPVNRAPARRAGNADELIGSAMGLLGIAYRYGGTSVSTGFDCS
GFMQHIFKRAMGINLPRTSAEQARMGAPVARSELQPGDMVFFRTLGGSRISHVGLYIGNN
RFIHAPRTGKNIEITSLSHKYWSGKYAFARRVKKNDPSRFLN*

Z2491 <SEQ ID 3116>

MDSFFKPAVWAVLWLMFAVRPALADELTNLLSSREQILRQFAEDEQPVLPINRAPARRAG
NADELIGSAMGLNEQPVLPVNRVPARRAGNADELIGNAMGLNEQPVLPVNRVPARRAGNA
DELIGNAMGLNEQPVLPVNRAPARRAGNADELIGNAMGLLGIAYRYGGTSISTGFDCSGF
MQHIFKRAMGINLPRTSAEQARMGTPVARSELQPGDMVFFRTLGGSRISHVGLYIGNNRF
IHAPRTGKNIEITSLSHKYWSGKYAFARRVKKNDPSRFLN*

ZO01_225 <SEQ ID 3117>

MDSFFKPAVWAVLWLMFAVRPALADELTNLLSSREQILRQFAEDEQPVLPINRAPARRAG
NADELIGSAMGLNEQPVLPVNRVPARRAGNADELIGNAMGLNEQPVLPVNRAPARRAGNA
DELIGNAMGLLGIAYRYGGTSISTGFDCSGFMQHIFKRAMGINLPRTSAEQARMGTPVAR
SELQPGDMVFFRTLGGSRISHVGLYIGNNRFIHAPRTGKNIEITSLSHKYWSGKYAFARR
VKKNDPSRFLN*

ZO02_225 <SEQ ID 3118>

MDSFFKPAVWAVLWLMFAVRPALADELTNLLSSREQILRQFAEDEQPVLPINRAPARRAG
NADELIGSAMGLNEQPVLPVNRVPARRAGNADELIGNAMGLNEQPVLPVNRAPARRAGNA
DELIGNAMGLLGIAYRYGGTSVSTGFDCSGFMQHIFKRAMGINLPRTSAEQARMGTPVAR
SELQPGDMVFFRTLGGSRISHVGLYIGNNRFIHAPRTGKNIEITSLSHKYWSGKYAFARR
VKKNDPSRFLN*

ZO03_225 <SEQ ID 3119>

MDSFFKPAVWAVLWLMFAVRLALADELTNLLSSREQILRQFAEDEQPVLPINRAPARRAG
NADELIGSAMGLNEQPVLPVNRVPARRAGNADELIGNAMGLNEQPVLPVNRAPARRAGNA

-continued

DELIGNAMGLLGIAYRYGGTSVSTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO04_225 <SEQ ID 3120>

MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSVSTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO05_225 <SEQ ID 3121>

MDSFFKPAVWAVLWLMFAVRPALADELTNLLSSREQILRQFAEDEQPVLPINRAPARRAG

NADELIGSAMGLNEQPVLPVNRVPARRAGNADELIGSAMGLNEQPVLPVNRAPARRAGNA

DELIGNAMGLLGIAYRYGGTSISTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO06_225 <SEQ ID 3122>

MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSVSTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO07_225 <SEQ ID 3123>

MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSVSTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO08_225 <SEQ ID 3124>

MDSFFKPAVWAVLWLMFAVRPALADELTNLLSSREQILRQFAEDEQPVLPINRAPARRAG

NADELIGSAMGLNEQPVLPVNRVPARRAGNADELIGSAMGLNEQPVLPVNRAPARRAGNA

DELIGNAMGLLGIAYRYGGTSISTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO09_225 <SEQ ID 3125>

MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSISTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

-continued

ZO10_225 <SEQ ID 3126>

MDSFFKPAVWAVLWLMFAVRPALADELTNLLSSREQILRQFAEDEQPVLPINRAPARRAG
NADELIGSAMGLNEQPVLPVNRVPARRAGNADELIGNAMGLNEQPVLPVNRAPARRAGNA
DELIGNAMGLLGIAYRYGGTSVSTGFDCSGFMQHIFKRAMGINLPRTSAEQARMGTPVAR
SELQPGDMVFFRTLGGSRISHVGLYIGNNRFIHAPRTGKNIEITSLSHKYWSGKYAFARR
VKKNDPSRFLN*

ZO11_225 <SEQ ID 3127>

MDSFFKPAVWAVLWLMFAVRPALADELTNLLSSREQILRQFAEDEQPVLPINRAPARRAG
NADELIGSAMGLNEQPVLPVNRVPARRAGNADELIGNAMGLNEQPVLPVNRAPARRAGNA
DELIGNAMGLNEQPVLPVNRAPARRAGNADELIGNAMGLLGIAYRYGGTSVSTGFDCSGF
MQHIFKRAMGINLPRTSAEQARMGTPVARSELQPGDMVFFRTLGGSRISHVGLYIGNNRF
IHAPRTGKNIEITSLSHKYWSGKYAFARRVKKNDPSRFLN*

ZO12_225 <SEQ ID 3128>

MDSFFKPAVWAVLWLMFAVRPALADELTNLLSSREQILRQFAEDEQPVLPINRAPARRAG
NADELIGSAMGLNEQPVLPVNRVPARRAGNADELIGNAMGLNEQPVLPVNRAPARRAGNA
DELIGNAMGLLGIAYRYGGTSISTGFDCSGFMQHIFKRAMGINLPRTSAEQARMGTPVAR
SELQPGDMVFFRTLGGSRISHVGLYIGNNRFIHAPRTGKNIEITSLSHKYWSGKYAFARR
VKKNDPSRFLN*

ZO13_225 <SEQ ID 3129>

MDSFFKPAVWAVLWLMFAVRPALADELTNLLSSREQILRQFAEDEQPVLPVNRAPARRAG
NADELIGSAMGLNEQPVLPVNRVPARRAGNADELIGNAMGLNEQPVLPVNRAPARRAGNA
DELIGNAMGLLGIAYRYGGTSVSTGFDCSGFIQHIFKRAMGINLPRTSAEQARMGTPVAR
SELQPGDMVFFRTLGGSRISHVGLYIGNNRFIHAPRTGKNIEITSLSHKYWSGKYAFARR
VKKNDPSRFLN*

ZO14_225 <SEQ ID 3130>

MDSFFKPAVWAVLWLMFAVRPALADELTNLLSSREQILRQFAEDEQPVLPINRAPARRAG
NADELIGSAMGLNEQPVLPVNRVPARRAGNADELIGNAMGLNEQPVLPVNRAPARRAGNA
DELIGNAMGLLGIAYRYGGTSVSTGFDCSGFMQHIFKRAMGINLPRTSAEQARMGTPVAR
SELQPGDMVFFRTLGGSRISHVGLYIGNNRFIHAPRTGKNIEITSLSHKYWSGKYAFARR
VKKNDPSRFLN*

ZO15_225 <SEQ ID 3131>

MDSFFKPAVWAVLWLMFAVRPALADELTNLLSSREQILRQFAEDEQPVLPINRAPARRAG
NADELIGSAMGLNEQPVLPVNRVPARRAGNADELIGNAMGLLGIAYRYGGTSVSTGFDCS
GFMQHIFKRAMGINLPRTSAEQARMGTPVARSELQPGDMVFFRTLGGSRISHVGLYIGNN
RFIHAPRTGKNIEITSLSHKYWSGKYAFARRVKKNDPSRFLN*

ZO16_225 <SEQ ID 3132>

MDSFFKPAVWAVLWLMFAVRPALADELTNLLSSREQILRQFAEDEQPVLPINRAPARRAG
NADELIGSAMGLNEQPVLPVNRVPARRAGNADELIGNAMGLNEQPVLPVNRAPARRAGNA
DELIGNAMGLLGIAYRYGGTSVSTGFDCSGFMQHIFKRAMGINLPRTSAEQARMGTPVAR

-continued

SELQPGDMVFFRTLGGSRISHVGLYIGNNRFIHAPRTGKNIEITSLSHKYWSGKYAFARR

VKKNDPSRFLN*

ZO17_225 <SEQ ID 3133>

MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSVSTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO18_225 <SEQ ID 3134>

MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSVSTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO19_225 <SEQ ID 3135>

MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSVSTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO20_225 <SEQ ID 3136>

MDSFFKPAVWAVLWLMFAVRPALADELTNLLSSREQILRQFAEDEQPVLPINRAPARRAG

NADELIGSAMGLNEQPVLPINRAPARRAGNADELIGSAMGLNEQPVLPVNRVPARRAGNA

DELIGNAMGLNEQPVLPVNRAPARRAGNADELIGNAMGLLGIAYRYGGTSVSTGFDCSGF

MQHIFKRAMGINLPRTSAEQARMGTPVARSELQPGDMVFFRTLGGSRISHVGLYIGNNRF

IHAPRTGKNIEITSLSHKYWSGKYAFARRVKKNDPSRFLN*

ZO21_225 <SEQ ID 3137>

MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSVSTGFDCSGFNQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO22_225 <SEQ ID 3138>

MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSISTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

-continued

ZO23_225 <SEQ ID 3139>

MDSFFKPAVWAVLWLMFAVRPALADELTNLLSSREQILRQFAEDEQPVLPINRAPARRAG
NADELIGSAMGLNEQPVLPVNRVPARRAGNADELIGNAMGLNEQPVLPVNRAPARRAGNA
DELIGNAMGLLGIAYRYGGTSISTGFDCSGFMQHIFKRAMGINLPRTSAEQARMGTPVAR
SELQPGDMVFFRTLGGSRISHVGLYIGNNRFIHAPRTGKNIEITSLSHKYWSGKYAFARR
VKKNDPSRFLN*

ZO24_225 <SEQ ID 3140>

MDSFFKPAVWAVLWLMFAVRPALADELTNLLSSREQILRQFAEDEQPVLPINRAPARRAG
NADELIGSAMGLNEQPVLPVNRVPARRAGNADELIGNAMGLNEQPVLPVNRAPARRAGNA
DELIGNAMGLLGIAYRYGGTSISTGFDCSGFMQHIFKRAMGINLPRTSAEQARMGTPVAR
SELQPGDMVFFRTLGGSRISHVGLYIGNNRFIHAPRTGKNIEITSLSHKYWSGKYAFARR
VKKNDPSRFLN*

ZO25_225 <SEQ ID 3141>

MDSFFKPAVWAVLWLMFAVRPALADELTNLLSSREQILRQFAEDEQPVLPINRAPARRAG
NADELIGSAMGLNEQPVLPVNRVPARRAGNADELIGNAMGLNEQPVLPVNRAPARRAGNA
DELIGNAMGLLGIAYRYGGTSISTGFDCSGFMQHIFKRAMGINLPRTSAEQARMGTPVAR
SELQPGDMVFFRTLGGSRISHVGLYIGNNRFIHAPRTGKNIEITSLSHKYWSGKYAFARR
VKKNDPSRFLN*

ZO26_225 <SEQ ID 3142>

MDSFFKPAVWAVLWLMFAVRPALADELTNLLSSREQILRQFAEDEQPVLPINRAPARRAG
NADELIGSAMGLNEQPVLPVNRVPARRAGNADELIGNAMGLNEQPVLPVNRAPARRAGNA
DELIGNAMGLLGIAYRYGGTSISTGFDCSGFMQHIFKRAMGINLPRTSAEQARMGTPVAR
SELQPGDMVFFRTLGGSRISHVGLYIGNNRFIHAPRTGKNIEITSLSHKYWSGKYAFARR
VKKNDPSRFLN*

ZO27_225 <SEQ ID 3143>

MDSFFKPAVWAVLWLMFAVRPALADELTNLLSSREQILRQFAEDEQPVLPINRAPARRAG
NADELIGSAMGLNEQPVLPVNRVPARRAGNADELIGNAMGLNEQPVLPVNRAPARRAGNA
DELIGNAMGLLGIAYRYGGTSVSTGFDCSGFMQHIFKRAMGINLPRTSAEQARMGTPVAR
SELQPGDMVFFRTLGGSRISHVGLYIGNNRFIHAPRTGKNIEITSLSHKYWSGKYAFARR
VKKNDPSRFLN*

ZO28_225 <SEQ ID 3144>

MDSFFKPAVWAVLWLMFAVRPALADELTNLLSSREQILRQFAEDEQPVLPINRAPARRAG
NADELIGSAMGLNEQPVLPVNRVPARRAGNADELIGNAMGLNEQPVLPVNRAPARRAGNA
DELIGNAMGLLGIAYRYGGTSVSTGFDCSGFMQHIFKRAMGINLPRTSAEQARMGTPVAR
SELQPGDMVFFRTLGGSRISHVGLYIGNNRFIHAPRTGKNIEITSLSHKYWSGKYAFARR
VKKNDPSRFLN*

ZO29_225 <SEQ ID 3145>

MDSFFKPAVWAVLWLMFAVRPALADELTNLLSSREQILRQFAEDEQPVLPINRAPARRAG
NADELIGSAMGLNEQPVLPVNRVPARRAGNADELIGNAMGLNEQPVLPVNRAPARRAGNA
DELIGNAMGLLGIAYRYGGTSVSTGFDCSGFMQHIFKRAMGINLPRTSAEQARMGTPVAR

```
                        -continued
SELQPGDMVFFRTLGGSRISHVGLYIGNNRFIHAPRTGKNIEITSLSHKYWSGKYAFARR

VKKNDPSRFLN*

ZO32_225 <SEQ ID 3146>

MDSEFKPAVWAVLWLMFAVRPALADELTNLLSSREQILRQFAEDEQPVLPVNRAPARRAG

NADELIGSAMGLNEQPVLPVNRAPARRAGNADELIGSAMGLLGIAYRYGGTSVSTGFDCS

GFMQHIFKRAMGINLPRTSAEQARMGAPVARSELQPGDMVFFRTLGGSRISHVGLYIGNN

RFIHAPRTGKNIEITSLSHKYWSGKYAFARRVKKNDPSRFLN*

ZO33_225 <SEQ ID 3147>

MDSFFKPAVWAVLWLMFAVRSALADELTNLLSSREQILRQFAEDEQPVLPVNRAPARRAG

NADELIGSAMGLNEQPVLPVNRAPARPAGNADELIGSAMGLLGIAYRYGGTSVSTGFDCS

GFMQHIFKRAMGINLPRTSAEQARMGAPVARSELQPGDMVFFRTLGGSRISHVGLYIGNN

RFIHAPRTGKNIEITSLSHKYWSGKYAFARRIKKNDPSRFLN*

ZO96_225 <SEQ ID 3148>

MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSISTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*
```

FIG. 19 shows the results of aligning the sequences of each of these strains. Dark shading indicates regions of homology, and gray shading indicates the conservation of amino acids with similar characteristics. As is readily discernible, there is significant conservation among the various strains of ORF 225, further confirming its utility as an antigen for both vaccines and diagnostics.

Example 12

Table 3 lists several *Neisseria* strains which were used to assess the conservation of the sequence of ORF 235 among different strains.

TABLE 3

**235 gene variability: List of used *Neisseria* strains**

| Identification number | Strains | Reference |
|---|---|---|
| **Group B** | | |
| gnmzq01 | NG6/88 | Seiler et al., 1996 |
| gnmzq02 | BZ198 | Seiler et al., 1996 |
| gnmzq03 | NG3/88 | Seiler et al., 1996 |
| gnmzq04 | 1000 | Seiler et al., 1996 |
| gnmzq05 | 1000 | Seiler et al., 1996 |
| gnmzq07 | BZ169 | Seiler et al., 1996 |
| gnmzq08 | 528 | Seiler et al., 1996 |
| gnmzq09 | NGP165 | Seiler et al., 1996 |
| gnmzq10 | BZ133 | Seiler et al., 1996 |
| gnmzq11 | NGE31 | Seiler et al., 1996 |
| gnnzq13 | NGE28 | Seiler et al., 1996 |
| gnmzq14 | NGH38 | Seiler et al., 1996 |
| gnmzq15 | SWZ107 | Seiler et al., 1996 |
| gnmzq16 | NGH15 | Seiler et al., 1996 |
| gnmzq17 | NGH36 | Seiler et al., 1996 |

TABLE 3-continued

**235 gene variability: List of used *Neisseria* strains**

| Identification number | Strains | Reference |
|---|---|---|
| gnmzq18 | BZ232 | Seiler et al., 1996 |
| gnmzq19 | BZ83 | Seiler et al., 1996 |
| gnmzq21 | MC58 | Virji et al., 1992 |
| **Group A** | | |
| gnmzq22 | 205900 | Our collection |
| gnmzq23 | F6124 | Our collection |
| z2491 | Z2491 | Maiden et al., 1998 |
| **Group C** | | |
| gnmzq24 | 90/18311 | Our collection |
| gnmzq25 | 93/4286 | Our collection |
| **Others** | | |
| gnmzq26 | A22 (group W) | Maiden et al., 1998 |
| gnmzq27 | E26 (group X) | Maiden et al., 1998 |
| gnmzq28 | 860800 (group Y) | Maiden et al., 1998 |
| gnmzq29 | E32 (group Z) | Maiden et al., 1998 |
| gnmzq31 | *N. lactamica* | Our collection |
| **Gonococcus** | | |
| gnmzq32 | Ng F62 | Maiden et al., 1998 |
| gnmzq33 | Ng SN4 | Our collection |
| fa1090 | FA1090 | Dempsey et al. 1991 |

References:
Seiler A. et al., Mol. Microbiol., 1996, 19(4):841-856.
Maiden R. et al., Proc. Natl. Acad. Sci. USA, 1998, 95:3140-3145.
Virji M. et al., Mol. Microbiol., 1992, 6:1271-1279
Dempsey J. F. et al., J. Bacteriol., 1991, 173:5476-5486

The amino acid sequences for each listed strain are as follows:

FA1090 <SEQ ID 3149>

MKPLILGLAAVLALSACQVRKAPDLDYTSFKESKPASILVVPPLNESPDVNGTWGMLAST

AAPISEAGYYVFPAAVVEETFKENGLTNAADIHAVRPEKLHQIFGNDAVLYITVTEYGTS

YQILDSVTTVSAKARLVDSRNGKELWSGSASIREGSNNSNSGLLGALVGAVVNQIANSLT

DRGYQVSKTAAYNLLSPYSRNGILKGPRFVEEQPK*

GNMZQ01 <SEQ ID 3150>

MKPLILGLAAVLALSACQVQKAPDFDYTSFKESKPASILVVPPLNESPDVNGTWGVLAST

AAPLSEAGYYVFPAAVVEETFKENGLTNAADIHAVRPEKLHQIFGNDAVLYITVTEYGTS

YQILDSVTTVSAKARLVDSRNGKELWSGSASIREGSNNSNSGLLGALVSAVVNQIANNLT

DRGYQVSKTAAYNLLSPYSHNGILKGPRFVEEQPK*

GNMZQ02 <SEQ ID 3151>

MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ03 <SEQ ID 3152>

MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ04 <SEQ ID 3153>

MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ05 <SEQ ID 3154>

MKPLILGLAAVLALSACQVQKAPDFDYTSFKESKPASILVVPPLNESPDVNGTWGVLAST

AAPLSEAGYYVFPAAVVEETFKENGLTNAADIHAVRPEKLHQIFGNDAVLYITVTEYGTS

YQILDSVTTVSAKARLVDSRNGKELWSGSASIREGSNNSNSGLLGALVSAVVNQIANNLT

DRGYQVSKTAAYNLLSPYSHNGILKGPRFVEEQPK*

GNMZQ07 <SEQ ID 3155>

MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ08 <SEQ ID 3156>

MKPLILGLAAVLALSACQVQKAPDFDYTSFKESKPASILVVPPLNESPDVNGTWGVLAST

AAPLSEAGYYVFPAAVVEETFKENGLTNAADIHAVRPEKLHQIFGNDAVLYITVTEYGTS

YQILDSVTTVSAKARLVDSRNGKELWSGSASIREGSNNSNSGLLGALVSAVVNQIANNLT

DRGYQVSKTAAYNLLSPYSHNGILKGPRFVEEQPK*

-continued

GNMZQ09 <SEQ ID 3157>

MKPLILGLAAALVLSACQVQKAPDFDYTSFKESKPASILVVPPLNESPDVNGTWGMLAST
AEPLSEAGYYVFPAAVVEETFKQNGLTNAADIHAVQPEKLHQIFGNDAVLYITITEYGTS
YQILDSVTTVSARARLVDSRNGKVLWSGSASIREGSNNSNSGLLGALVSAVVNQIANSLT
DRGYQVSKTAAYNLLSPYSHNGILKGPRFVEEQPK*

GNMZQ10 <SEQ ID 3158>

MKPLILGLAAVLALSACQVQKAPDFDYTSFKESKPASILVVPPLNESPDVNGTWGVLAST
AAPLSEAGYYVFPAAVVEETFKQNGLTNAADIHAVRPEKLHQIFGNDAVLYITVTEYGTS
YQILDSVTTVSAKARLVDSRNGKELWSGSASIREGSNNSNSGLLGALVSAVVNQIANSLT
DRGYQVSKTAAYNLLSPYSHNGILKGPRFVEEQPK*

GNMZQ11 <SEQ ID 3159>

MKPLILGLAAVLALSACQVQKAPDFDYTSFKESKPASILVVPPLNESPDVNGTWGVLAST
AAPLSEAGYYVFPAAVVEETFKQNGLTNAADIHAVRPEKLHQIFGNDAVLYITVTEYGTS
YQILDSVTTVSAKARLVDSRNGKELWSGSASIREGSNNSNSGLLGALVSAVVNQIANSLT
DRGYQVSKTAAYNLLSPYSHNGILKGPRFVEEQPK*

GNMZQ13 <SEQ ID 3160>

MKPLILGLAAVLALSACQVQKAPDFDYTSFKESKPASILVVPPLNESPDVNGTWGVLAST
AAPLSEAGYYVFPAAVVEETFKQNGLTNAADIHAVRPEKLHQIFGNDAVLYITVTEYGTS
YQILDSVTTVSAKARLVDSRNGKELWSGSASIREGSNNSNSGLLGALVSAVVNQIANSLT
DRGYQVSKTAAYNLLSPYSHNGILKGPRFVEEQPK*

GNMZQ14 <SEQ ID 3161>

MKPLILGLAAVLALSACQVQKAPDFDYTSFKESKPASILVVPPLNESPDVNGTWGVLAST
AAPLSEAGYYVFPAAVVEETFKQNGLTNAADIHAVRPEKLHQIFGNDAVLYITVTEYGTS
YQILDSVTTVSAKARLVDSRNGKELWSGSASIREGSNNSNSGLLGALVGAVVNQIANSLT
DRGYQVSKTAAYNLLSPYSHNGILKGPRFVEEQPK*

GNMZQ15 <SEQ ID 3162>

MKPLILGLAAVLALSACQVQKAPDFDYTSFKESKPASILVVPPLNESPDVNGTWGVLAST
AAPLSEAGYYVFPAAVVEETFKQNGLTNAADIHAVRPEKLHQIFGNDAVLYITVTEYGTS
YQILDSVTTVSAKARLVDSRNGKELWSGSASIREGSNNSNSGLLGALVSAVVNQIANSLT
DRGYQVSKTAAYNLLSPYSHNGILKGPRFVEEQPK*

GNMZQ16 <SEQ ID 3163>

MKPLILGLAAVLALSACQVQKAPDFDYTSFKESKPASILVVPPLNESPDVNGTWGVLAST
AAPLSEAGYYVFPAAVVEETFKQNGLTNAADIHAVRPEKLHQIFGNDAVLYITVTEYGTS
YQILDSVTTVSAKARLVDSRNGKELWSGSASIREGSNNSNSGLLGALVSAVVNQIANSLT
DRGYQVSKTAAYNLLSPYSHNGILKGPRFVEEQPK*

GNMZQ17 <SEQ ID 3164>

MKPLILGLAAVLALSACQVQKAPDFDYTSFKESKPASILVVPPLNESPDVNGTWGVLAST
AAPLSEAGYYVFPAAVVEETFKQNGLTNAADIHAVRPEKLHQIFGNDAVLYITVTEYGTS
YQILDSVTTVSAKARLVDSRNGKELWSGSASIREGSNNSNSGLLGALVSAVVNQIANSLT
DRGYQVSKTAAYNLLSPYSHNGILKGPRFVEEQPK*

-continued

GNMZQ18 <SEQ ID 3165>

MKPLILGLAAVLALSACQVQKAPDFDYTSFKESKPASILVVPPLNESPDVNGTWGVLAST
AAPLSEAGYYVFPAAVVEETFKQNGLTNAADIHAVRPEKLHQIFGNDAVLYITVTEYGTS
YQILDSVTTVSAKARLVDSRNGKELWSGSASIREGSNNSNSGLLGALVGAVVNQIANSLT
DRGYQVSKTAAYNLLSPYSHNGILKGPRFVEEQPK*

GNMZQ19 <SEQ ID 3166>

MKPLILGLAAVLALSACQVQKAPDFDYTSFKESKPASILVVPPLNESPDVNGTWGVLAST
AAPLSEAGYYVFPAAVVEETFKQNGLTNAADIHAVRPEKLHQIFGNDAVLYITVTEYGTS
YQILDSVTTVSAKARLVDSRNGKELWSGSASIREGSNNSNSGLLGALVSAVVNQIANSLT
DRGYQVSKTAAYNLLSPYSHNGILKGPRFVEEQPK*

GNMZQ21 <SEQ ID 3166>

MKPLILGLAAVLALSACQVQKAPDFDYTSFKESKPASILVVPPLNESPDVNGTWGVLAST
AAPLSEAGYYVFPAAVVEETFKQNGLTNAADIHAVRPEKLHQIFGNDAVLYITVTEYGTS
YQILDSVTTVSAKARLVDSRNGKELWSGSASIREGSNNSNSGLLGALVSAVVNQIANSLT
DRGYQVSKTAAYNLLSPYSHNGILKGPRFVEEQPK*

GNMZQ22 <SEQ ID 3167>

MKPLILGLAAVLALSACQVQKAPDFDYTSFKESKPASILVVPPLNESPDVNGTWGVLAST
AAPLSEAGYYVFPAAVVEETFKQNGLTNAADIHAVRPEKLHQIFGNDAVLYITVTEYGTS
YQILDSVTTVSAKARLVDSRNGKELWSGSASIREGSNNSNSGLLGALVSAVVNQIANSLT
DRGYQVSKTAAYNLLSPYSHNGILKGPRFVEEQPK*

GNMZQ23 <SEQ ID 3168>

MKPLILGLAAVLALSACQVQKAPDFDYTSFKESKPASILVVPPLNESPDVNGTWGVLAST
AAPLSEAGYYVFPAAVVEETFKQNGLTNAADIHAVRPEKLHQIFGNDAVLYITVTEYGTS
YQILDSVTTVSAKARLVDSRNGKELWSGSASIREGSNNSNSGLLGALVSAVVNQIANSLT
DRGYQVSKTAAYNLLSPYSHNGILKGPRFVEEQPK*

GNMZQ24 <SEQ ID 3169>

MKPLILGLAAVLALSACQVQKAPDFDYTSFKESKPASILVVPPLNESPDVNGTWGVLAST
AAPLSEAGYYVFPAAVVEETFKQNGLTNAADIHAVRPEKLHQIFGNDAVLYITVTEYGTS
YQILDSVTTVSAKARLVDSRNGKELWSGSASIREGSNNSNSGLLGALVSAVVNQIANSLT
DRGYQVSKTAAYNLLSPYSHNGILKGPRFVEEQPK*

GNMZQ25 <SEQ ID 3170>

MKPLILGLAAVLALSACQVQKAPDFDYTSFKESKPASILVVPPLNESPDVNGTWGVLAST
AAPLSEAGYYVFPAAVVEETFKQNGLTNAADIHAVRPEKLHQIFGNDAVLYITVTEYGTS
YQILDSVTTVSAKARLVDSRNGKELWSGSASIREGSNNSNSGLLGALVSAVVNQIANSLT
DRGYQVSKTAAYNLLSPYSNNGILKGPRFVEEQPK*

GNMZQ26 <SEQ ID 3171>

MKPLILGLAAVLALSACQVQKAPDFDYTSFKESKPASILVVPPLNESPDVNGTWGMLAST
AAPLSEAGYYVFPAAVVEETFKQNGLTNAADIHAVRPEKLHQIFGNDAVLYITVTEYGTS
YQILDSVTTVSAKARLVDSRNGKELWSGSASIREGSNNSNSGLLGALVGAVVNQIANSLT
DRGYQVSKTAAYNLLSPYSHNGILKGPRFVEEQPK*

-continued

GNMZQ27 <SEQ ID 3172>

MKPLILGLAAVLALSACQVQKAPDFDYTSFKESKPASILVVPPLNESPDVNGTWGVLAST
AAPLSEAGYYVFPAAVVEETFKQNGLTNAADIHAVRPEKLHQIFGNDAVLYITVTEYGTS
YQILDSVTTVSAKARLVDSRNGKELWSGSASIREGSNNSNSGLLGALVSAVVNQIANSLT
DRGYQVSKTAAYNLLSPYSHNGILKGPRFVEEQPK*

GNMZQ28 <SEQ ID 3173>

MKPLILGLAAVLALSACQVQKAPDFDYTSFKESKPASILVVPPLNESPDVNGTWGVLAST
AAPLSEAGYYVFPAAVVEETFKQNGLTNAADIHAVRPEKLHQIFGNDAVLYITVTEYGTS
YQILDSVTTVSAKARLVDSRNGKELWSGSASIREGSNNSNSGLLGALVSAVVNQIANSLT
DRGYQVSKTAAYNLLSPYSHNGILKGPRFVEEQPK*

GNMZQ29 <SEQ ID 3174>

MKPLILGLAAVLALSACQVQKAPDFDYTSFKESKPASILVVPPLNESPDVNGTWGVLAST
AAPLSEAGYYVFPAAVVEETFKQNGLTNAADIHAVRPEKLHQIFGNDAVLYITVTEYGTS
YQILDSVTTVSAKARLVDSRNGKELWSGSASIREGSNNSNSGLLGALVSAVVNQIANSLT
DRGYQVSKTAAYNLLSPYSHNGILKGPRFVEEQPK*

GNMZQ31 <SEQ ID 3175>

MKPLILGLAAVLALSACQVQKAPDFDYTAFKESKPASILVVPPLNESPDVNGTWGMLAST
AEPLSEAGYYVFPAAVVEETFKQNGLTNAADIHAVRPEKLHQIFGNDAVLYITITEYGTS
YQILDSVTTVSARARLVDSRNGKVLWSGSASIREGSNNSNSGLLGALVGAVVNQIANSLT
DRGYQVSKAAAYDLLSPYSHNGILKGPRFVEEQPK*

GNMZQ32 <SEQ ID 3176>

MKPLILGLAAVLALSACQVRKAPDLDYTSFKESKPASILVVPPLNESPDVNGTWGMLAST
AAPISEAGYYVFPAAVVEETFKENGLTNAADIHAVRPEKLHQIFGNDAVLYITVTEYGTS
YQILDSVTTVSAKARLVDSRNGKELWSGSASIREGSNNSNSGLLGALVGAVVNQIANSLT
DRGYQVSKTAAYNLLSPYSRNGILKGPRFVEEQPK*

GNMZQ33 <SEQ ID 3177>

MKPLILGLAAVLALSACQVRKAPDLDYTSFKESKPASILVVPPLNESPDVNGTWGMLAST
AAPISEAGYYVFPAAVVEETFKENGLTNAADIHAVRPEKLHQIFGNDAVLYITVTEYGTS
YQILDSVTTVSAKARLVDSRNGKELWSGSASIREGSNNSNSGLLGALVGAVVNQIANSLT
DRGYQVSKTAAYNLLSPYSRNGILKGPRFVEEQPK*

Z2491 <SEQ ID 3178>

MKPLILGLAAVLALSACQVQKAPDFDYTSFKESKPASILVVPPLNESPDVNGTWGVLAST
AAPLSEAGYYVFPAAVVEETFKQNGLTNAADIHAVRPEKLHQIFGNDAVLYITVTEYGTS
YQILDSVTTVSAKARLVDSRNGKELWSGSASIREGSNNSNSGLLGALVSAVVNQIANSLT
DRGYQVSKTAAYNLLSPYSHNGILKGPRFVEEQPK*

FIG. 20 shows the results of aligning the sequences of each of these strains. Dark shading indicates regions of homology, and gray shading indicates the conservation of amino acids with similar characteristics. As is readily discernible, there is significant conservation among the various strains of ORF 235, further confirming its utility as an antigen for both vaccines and diagnostics.

Example 13

Table 4 lists several *Neisseria* strains which were used to assess the conservation of the sequence of ORF 287 among different strains.

TABLE 4

287 gene variability: List of used *Neisseria* strains

| Identification number | Strains | Reference |
|---|---|---|
| Group B | | |
| 287_2 | BZ198 | Seiler et al., 1996 |
| 287_9 | NGP165 | Seiler et al., 1996 |
| 287_14 | NGH38 | Seiler et al., 1996 |
| 287_21 | MC58 | Virji et al., 1992 |
| Group A | | |
| z2491 | Z2491 | Maiden et al., 1998 |
| *Gonococcus* | | |
| fa1090 | FA1090 | Dempsey et al. 1991 |

References:
Seiler A. et al., Mol. Microbiol., 1996, 19(4):841-856.
Maiden R. et al., Proc. Natl. Acad. Sci. USA, 1998, 95:3140-3145.
Virji M. et al., Mol. Microbiol., 1992, 6:1271-1279
Dempsey J. F. et al., J. Bacteriol., 1991, 173:5476-5486

The amino acid sequences for each listed strain are as follows:

287_14 <SEQ ID 3179>

MFKRSVIAMACIFALSACGGGGGGSPDVKSADTLSKPAAPVVSEKETEAKEDAPQAGSQG
QGAPSAQGGQDMAAVSEENTGNGGAAATDKPKNEDEGAQNDMPQNAADTDSLTPNHTPAS
NMFAGNMENQAPDAGESEQPANQPDMANTADGMQGDDPSAGGENAGNTAAQGTNQAENNQ
TAGSQNPASSTNPSATNSGGDFGRTNVGNSVVIDGPSQNITLTHCKGDSCSGNNFLDEEV
QLKSEFEKLSDADKISNYKKDGKNDGKNDKFVGLVADSVQMKGINQYIIFYKPKPTSFAR
FRRSARSRRSLPAEMPLIPVNQADTLIVDGEAVSLTGHSGNIFAPEGNYRYLTYGAEKLP
GGSYALRVQGEPSKGEMLAGTAVYNGEVLHFHTENGRPSPSRGRFAAKVDFGSKSVDGII
DSGDGLHMGTQKFKAAIDGNGFKGTWTENGGGDVSGKFYGPAGEEVAGKYSYRPTDAEKG
GFGVFAGKKEQD*

287_2 <SEQ ID 3180>

MFKRSVIAMACIFALSACGGGGGGSPDVKSADTLSKPAAPVVSEKETEAKEDAPQAGSQG
QGAPSAQGGQDMAAVSEENTGNGGAAATDKPKNEDEGAQNDMPQNAADTDSLTPNHTPAS
NMPAGNMENQAPDAGESEQPANQPDMANTADGMQGDDPSAGGENAGNTAAQGTNQAENNQ
TAGSQNPASSTNPSATNSGGDFGRTNVGNSVVIDGPSQNITLTHCKGDSCSGNNFLDEEV
QLKSEFEKLSDADKISNYKKDGKNDGKNDKFVGLVADSVQMKGINQYIIFYKPKPTSFAR
FRRSARSRRSLPAEMPLIPVNQADTLIVDGEAVSLTGHSGNIFAPEGNYRYLTYGAEKLP
GGSYALRVQGEPSKGEMLAGTAVYNGEVLHFHTENGRPSPSRGRFAAKVDFGSKSVDGII
DSGDGLHMGTQKFKAAIDGNGFKGTWTENGGGDVSGKFYGPAGEEVAGKYSYRPTDAEKG
GFGVFAGKKEQD*

287_21. <SEQ ID 3181>

MFKRSVIAMACIFALSACGGGGGGSPDVKSADTLSKPAAPVVSEKETEAKEDAPQAGSQG
QGAPSAQGSQDMAAVSEENTGNGGAVTADNPKNEDEVAQNDMPQNAAGTDSSTPNHTPDP
NMLAGNMENQATDAGESSQPANQPDMANAADGMQGDDPSAGGQNAGNTAAQGANQAGNNQ
AAGSSDPIPASNPAPANGGSNFGRVDLANGVLIDGPSQNITLTHCKGDSCSGNNFLDEEV

-continued

QLKSEFEKLSDADKISNYKKDGKNDKFVGLVADSVQMKGINQYIIFYKPKPTSFARFRRS

ARSRRSLPAEMPLIPVNQADTLIVDGEAVSLTGHSGNIFAPEGNYRYLTYGAEKLPGGSY

ALRVQGEPAKGEMLAGAAVYNGEVLHFHTENGRPYPTRGRFAAKVDFGSKSVDGIIDSGD

DLHMGTQKFKAAIDGNGFKGTWTENGSGDVSGKFYGPAGEEVAGKYSYRPTDAEKGGFGV

FAGKKEQD*

287_9 <SEQ ID 3182>

MFKRSVIAMACIVALSACGGGGGGSPDVKSADTLSKPAAPVVTEDVGEEVLPKEKKDEEA

VSGAPQADTQDATAGKGGQDMAAVSAENTGNGGAATTDNPENKDEGPQNDMPQNAADTDS

STPNHTPAPNMPTRDMGNQAPDAGESAQPANQPDMANAADGMQGDDPSAGENAGNTADQA

ANQAENNQVGGSQNPASSTNPNATNGGSDFGRINVANGIKLDSGSENVTLTHCKDKVCDR

DFLDEEAPPKSEFEKLSDEEKINKYKKDEQRENFVGLVADRVEKNGTNKYVIIYKDKSAS

SSSARFRRSARSRRSLPAEMPLIPVNQADTLIVDGEAVSLTGHSGNIFAPEGNYRYLTYG

AEKLSGGSYALSVQGEPAKGEMLAGTAVYNGEVLHFHMENGRPSPSGGRFAAKVDFGSKS

VDGIIDSGDDLHMGTQKFKAVIDGNGFKGTWTENGGGDVSGRFYGPAGEEVAGKYSYRPT

DAEKGGFGVFAGKKEQD*

FA1090 <SEQ ID 3183>

MFKRSVIAMACIFPLSACGGGGGGSPDVKSADTPSKPAAPVVAENAGEGVLPKEKKDEEA

AGGAPQADTQDATAGEGSQDMAAVSAENTGNGGAATTDNPKNEDAGAQNDMPQNAAESAN

QTGNNQPAGSSDSAPASNPAPANGGSDFGRTNVGNSVVIDGPSQNITLTHCKGDSCNGDN

LLDEEAPSKSEFEKLSDEEKIKRYKKDEQRENFVGLVADRVKKDGTNKYIIFYTDKPPTR

SARSRRSLPAEIPLIPVNQADTLIVDGEAVSLTGHSGNIFAPEGNYRYLTYGAEKLPGGS

YALRVQGEPAKGEMLVGTAVYNGEVLHFHMENGRPYPSGGRFAAKVDFGSKSVDGIIDSG

DDLHMGTQKFKAAIDGNGFKGTWTENGGGDVSGRFYGPAGEEVAGKYSYRPTDAEKGGFG

VFAGKKDRD*

Z2491 <SEQ ID 3184>

MFKRSVIAMACIFALSACGGGGGGSPDVKSADTLSKPAAPVVSEKETEAKEDAPQAGSQG

QGAPSAQGSQDMAAVSEENTGNGGAVTADNPKNEDEVAQNDMPQNAAGTDSSTPNHTPDP

NMLAGNMENQATDAGESSQPANQPDMANAADGMQGDDPSAGGQNAGNTAAQGANQAGNNQ

AAGSSDPIPASNPAPANGGSNFGRVDLANGVLIDGPSQNITLTHCKGDSCSGNNFLDEEV

QLKSEFEKLSDADKISNYKKDGKNDKFVGLVADSVQMKGINQYIIFYKPKPTSFARFRRS

ARSRRSLPAEMPLIPVNQADTLIVDGEAVSLTGHSGNIFAPEGNYRYLTYGAEKLPGGSY

ALRVQGEPAKGEMLAGAAVYNGEVLHFHTENGRPYPTRGRFAAKVDFGSKSVDGIIDSGD

DLHMGTQKFKAAIDGNGFKGTWTENGSGDVSGKFYGPAGEEVAGKYSYRPTDAEKGGFGV

FAGKKEQD*

FIG. 21 shows the results of aligning the sequences of each of these strains. Dark shading indicates regions of homology, and gray shading indicates the conservation of amino acids with similar characteristics. As is readily discernible, there is significant conservation among the various strains of ORF 287, further confirming its utility as an antigen for both vaccines and diagnostics.

Example 14

Table 5 lists several *Neisseria* strains which were used to assess the conservation of the sequence of ORF 519 among different strains.

TABLE 5

519 gene variability: List of used *Neisseria* strains

| Identification Strains number | | Source/reference |
|---|---|---|
| Group B | | |
| zv01_519 | NG6/88 | R. Moxon/Seiler et al., 1996 |
| zv02_519 | BZ198 | R. Moxon/Seiler et al., 1996 |
| zv03_519ass | NG3/88 | R. Moxon/Seiler et al., 1996 |
| zv04_519 | 297-0 | R. Moxon/Seiler et al., 1996 |
| zv05_519 | 1000 | R. Moxon/Seiler et al., 1996 |
| zv06_519ass | BZ147 | R. Moxon/Seiler et al., 1996 |
| zv07_519 | BZ169 | R. Moxon/Seiler et al., 1996 |
| zv11_519 | NGE31 | R. Moxon/Seiler et al., 1996 |
| zv12_519 | NGF26 | R. Moxon/Seiler et al., 1996 |
| zv18_519 | BZ232 | R. Moxon/Seiler et al., 1996 |
| zv19_519 | BZ83 | R. Moxon/Seiler et al., 1996 |

TABLE 5-continued 519 gene variability: List of used *Neisseria* strains

| Identification Strains number | | Source/reference |
|---|---|---|
| zv20_519ass | 44/76 | R. Moxon/Seiler et al., 1996 |
| zv21_519ass | MC58 | R. Moxon |
| zv96_519 | 2996 | Our collection |
| Group A | | |
| zv22_519ass | 205900 | R. Moxon |
| z2491_519 | Z2491 | R. Moxon/Maiden et al., 1998 |
| Others | | |
| zv26_519 | A22 (group W) | R. Moxon/Maiden et al., 1998 |
| zv27_519 | E26 (group X) | R. Moxon/Maiden et al., 1998 |
| zv28_519 | 860800 (group Y) | R. Moxon/Maiden et al., 1998 |
| zv29_519ass | E32 (group Z) | R. Moxon/Maiden et al., 1998 |
| Gonococcus | | |
| zv32_519 | Ng F62 | R. Moxon/Maiden et al., 1998 |
| fa1090_519 | FA1090 | R. Moxon |

References:
Seiler A. et al., Mol. Microbiol., 1996, 19(4):841-856.
Maiden et al., Proc. Natl. Acad. Sci. USA, 1998, 95:3140-3145.

The amino acid sequences for each listed strain are as follows:

```
FA1090_519 <SEQ ID 3185>

MEFFIILLAAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVSALDEAAGAWGVKVLRYEIKDLVPPQEILRAMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

Z2491_519 <SEQ ID 3186>

MEFFIILLAAVVVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVSALDEAAGAWGVKVLRYEIKDLVPPQEILRSMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

ZV01_519 <SEQ ID 3187>

MEFFIILLVAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVAALDEAAGAWGVKVLRYEIKDLVPPQEILRSMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

ZV02_519 <SEQ ID 3188>

MEFFIILLVAVAVFGFKSFVVIPQQEVHVVERLGRFHRALTAGLNILIPFIDRVAYRHSL
```

-continued

KEIPLDVPSQVCITRDNTQLTVDGIIYFQVTDPKLASYGSSNYIMAITQLAQTTLRSVIG
RMELDKTFEERDEINSTVVSALDEAAGAWGVKVLRYEIKDLVPPQEILRSMQAQITAERE
KRARIAESEGRKIEQINLASGQREAEIQQSEGEAQAAVNASNAEKIARINRAKGEAESLR
LVAEANAEAIRQIAAALQTQGGADAVNLKIAEQYVAAFNNLAKESNTLIMPANVADIGSL
ISAGMKIIDSSKTAK*

ZV03_519 <SEQ ID 3189>

MEFFIILLVAVAVFGFKSFVVIPQQEVHVVERLGRFHRALTAGLNILIPFIDRVAYRHSL
KEIPLDVPSQVCITRDNTQLTVDGIIYFQVTDPKLASYGSSNYIMAITQLAQTTLRSVIG
RMELDKTFEERDEINSTVVSALDEAAGAWGVKVLRYEIKDLVPPQEILRSMQAQITAERE
KRARIAESEGRKIEQINLASGQREAEIQQSEGEAQAAVNASNAEKIARINRAKGEAESLR
LVAEANAEAIRQIAAALQTQGGADAVNLKIAEQYVAAFNNLAKESNTLIMPANVADIGSL
ISAGMKIIDSSKTAK*

ZV04_519 <SEQ ID 3190>

MEFFIILLVAVAVFGFKSFVVIPQQEVHVVERLGRFHRALTAGLNILIPFIDRVAYRHSL
KEIPLDVPSQVCITRDNTQLTVDGIIYFQVTDPKLASYGSSNYIMAITQLAQTTLRSVIG
RMELDKTFEERDEINSTVVSALDEAAGAWGVKVLRYEIEDLVPPQEILRSMQAQITAERE
KRARIAESEGRKIEQINLASGQREAEIQQSEGEAQAAVNASNAEKIARINRAKGEAESLR
LVAEANAEAIRQIAAALQTQGGADAVNLKIAEQYVAAFNNLAKESNTLIMPANVADIGSL
ISAGMKIIDSSKTAK*

ZV05_519 <SEQ ID 3191>

MEFFIILLVAVAVFGFKSFVVIPQQEVHVVERLGRFHRALTAGLNILIPFIDRVAYRHSL
KEIPLDVPSQVCITRDNTQLTVDGIIYFQVTDPKLASYGSSNYIMAITQLAQTTLRSVIG
RMELDKTFEERDEINSTVVSALDEAAGAWGVKVLRYEIKDLVPPQEILRSMQAQITAERE
KRARIAESEGRKIEQINLASGQREAEIQQSEGEAQAAVNASNAEKIARINRAKGEAESLR
LVAEANAEAIRQIAAALQTQGGADAVNLKIAEQYVAAFNNLAKESNTLIMPANVADIGSL
ISAGMKIIDSSKTAK*

ZV06_519ASS <SEQ ID 3192>

MEFFIILLVAVAVFGFKSFVVIPQQEVHVVERLGRFHRALTAGLNILIPFIDRVAYRHSL
KEIPLDVPSQVCITRDNTQLTVDGIIYFQVTDPKLASYGSSNYIMAITQLAQTTLRSVIG
RMELDKTFEERDEINSTVFSALDEAAGAWGVKVLRYEIKDLVPPQEILRSMQAQITAERK
KRARIAESEGRKIEQINLASGQREAEIQQSEGEAQAAVNASNAEKIARINRAKGEAESLR
LVAEANAEAIRQIAAALQTQGGADAVNLKIAEQYVAAFNNLAKESNTLIMPANVADIGSL
ISAGMKIIDSSKTAK*

ZV07_519 <SEQ ID 3193>

MEFFIILLVAVAVFGFKSFVVIPQQEVHVVERLGRFHRALTAGLNILIPFIDRVAYRHSL
KEIPLDVPSQVCITRDNTQLTVDGIIYFQVTDPKLASYGSSNYIMAITQLAQTTLRSVIG
RMELDKTFEERDEINSTVVAALDEAAGAWGVKVLRYEIKDLVPPQEILRSMQAQITAERE
KRARIAESEGRKIEQINLASGQREAEIQQSEGEAQAAVNASNAEKIARINRAKGEAESLR
LVAEANAEAIRQIAAALQTQGGADAVNLKIAEQYVAAFNNLAKESNTLIMPANVADIGSL
ISAGMKIIDSSKTAK*

-continued

ZV11_519 <SEQ ID 3194>

MEFFIILLAAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVAALDEAAGAWGVKVLRYEIKDLVPPQEILRSMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

ZV12_519 <SEQ ID 3195>

MEFFIILLVAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVAALDEAAGAWGVKVLRYEIKDLVPPQEILRSMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

ZV18_519 <SEQ ID 3196>

MEFFIILLVAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVAALDEAAGAWGVKVLRYEIKDLVPPQEILRSMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

ZV19_519 <SEQ ID 3197>

MEFFIILLVAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVAALDEAAGAWGVKVLRYEIKDLVPPQEILRSMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

ZV20_519ASS <SEQ ID 3198>

MEFFIILLVAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVAALDEAAGAWGVKVLRYEIKDLVPPQEILRSMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSM

ISAGMKIIDSSKTAK*

ZV21_519ASS <SEQ ID 3199>

MEFFIILLVAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVAALDEAAGAWGVKVLRYEIKDLVPPQEILRSMQAQITAERE

KRARIAESEGRKIEQINLASGQREAEIQQSEGEAQAAVNASNAEKIARINRAKGEAESLR

-continued

LVAEANAEAIRQIAAALQTQGGADAVNLKIAEQYVAAFNNLAKESNTLIMPANVADIGSL

ISAGMKIIDSSKTAK*

ZV22_519ASS <SEQ ID 3200>

MEFFIILLAAVVVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVSALDEAAGAWGVKVLRYEIKDLVPPQEILRSMQAQITAERE

KRARIAESEGRKIEQINLASGQREAKIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

ZV26_519 <SEQ ID 3201>

MEFFIILLAAVVVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVAALDEAAGAWGVKVLRYEIKDLVPPQEILRSMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

ZV27_519 <SEQ ID 3202>

MEFFIILLVAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVAALDEAAGAWGVKVLRYEIKDLVPPQEILRSMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

ZV28_519 <SEQ ID 3203>

MEFFIILLAAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVAALDEAAGAWGVKVLRYEIKDLVPPQEILRSMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

ZV29_519ASS <SEQ ID 3204>

MEFFIILLAAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSIVVSALDEAAGAWGVKVLRYEIKDLVPPQEILRSMQAQITAERE

KRARIAESEGRKIEQINLASGQREPEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSNKTAK*

ZV32_519 <SEQ ID 3205>

MEFFIILLAAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

-continued

RMELDKTFEERDEINSTVVSALDEAAGAWGVKVLRYEIKDLVPPQEILRAMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

ZV96_519 <SEQ ID 3206>

MEFFIILLAAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVAALDEAAGAWGVKVLRYEIKDLVPPQEILRSMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

FIG. 22 shows the results of aligning the sequences of each of these strains. Dark shading indicates regions of homology, and gray shading indicates the conservation of amino acids with similar characteristics. As is readily discernible, there is significant conservation among the various strains of ORF 519, further confirming its utility as an antigen for both vaccines and diagnostics.

Example 15

Table 6 lists several *Neisseria* strains which were used to assess the conservation of the sequence of ORF 919 among different strains.

TABLE 6

919 gene variability: List of used *Neisseria* strains

| Identification number | Strains | Source/reference |
|---|---|---|
| Group B | | |
| zm01 | NG6/88 | R. Moxon/Seiler et al., 1996 |
| zm02 | BZ198 | R. Moxon/Seiler et al., 1996 |
| zm03 | NG3/88 | R. Moxon/Seiler et al., 1996 |
| zm04 | 297-0 | R. Moxon/Seiler et al., 1996 |
| zm05 | 1000 | R. Moxon/Seiler et al., 1996 |
| zm06 | BZ147 | R. Moxon/Seiler et al., 1996 |
| zm07 | BZ169 | R. Moxon/Seiler et al., 1996 |
| zm08n | 528 | R. Moxon/Seiler et al., 1996 |
| zm09 | NGP165 | R. Moxon/Seiler et al., 1996 |
| zm10 | BZ133 | R. Moxon/Seiler et al., 1996 |
| zm11asbc | NGE31 | R. Moxon/Seiler et al., 1996 |
| zm12 | NGF26 | R. Moxon/Seiler et al., 1996 |
| zm13 | NGE28 | R. Moxon/Seiler et al., 1996 |
| zm14 | NGH38 | R. Moxon/Seiler et al., 1996 |
| zm15 | SWZ107 | R. Moxon/Seiler et al., 1996 |
| zm16 | NGH15 | R. Moxon/Seiler et al., 1996 |
| zm17 | NGH36 | R. Moxon/Seiler et al., 1996 |
| zm18 | BZ232 | R. Moxon/Seiler et al., 1996 |
| zm19 | BZ83 | R. Moxon/Seiler et al., 1996 |
| zm20 | 44/76 | R. Moxon/Seiler et al., 1996 |
| zm21 | MC58 | R. Moxon |
| zm96 | 2996 | Our collection |
| Group A | | |
| zm22 | 205900 | R. Moxon |
| zm23asbc | F6124 | R. Moxon |
| z2491 | Z2491 | R. Moxon/Maiden et al., 1998 |
| Group C | | |
| zm24 | 90/18311 | R. Moxon |
| zm25 | 93/4286 | R. Moxon |
| Others | | |
| zm26 | A22 (group W) | R. Moxon/Maiden et al., 1998 |
| zm27bc | E26 (group X) | R. Moxon/Maiden et al., 1998 |
| zm28 | 860800 (group Y) | R. Moxon/Maiden et al., 1998 |
| zm29asbc | E32 (group Z) | R. Moxon/Maiden et al., 1998 |
| zm31asbc | *N. lactamica* | R. Moxon |
| *Gonococcus* | | |
| zm32asbc | Ng F62 | R. Moxon/Maiden et al., 1998 |
| zm33asbc | Ng SN4 | R. Moxon |
| fa1090 | FA1090 | R. Moxon |

References:
Seiler A. et al., Mol. Microbiol., 1996, 19(4):841-856.
Maiden et al., Proc. Natl. Acad. Sci. USA, 1998, 95:3140-3145.

The amino acid sequences for each listed strain are as follows:

FA1090 <SEQ ID 3207>

MKKHLLRSALYGIAAAILAACQSRSIQTFPQPDTSVINGPDRPAGIPDPAGTTVAGGGAV

YTVVPHLSMPHWAAQDFAKSLQSFRLGCANLKNRQGWQDVCAQAFQTPVHSFQAKRFFER

YFTPWQVAGNGSLAGTVTGYYEPVLKGDGRRTERARFPIYGIPDDFISVPLPAGLRGGKN

LVRIRQTGKNSGTIDNAGGTHTADLSRFPITARTTAIKGRFEGSRFLPYHTRNQINGGAL

-continued

DGKAPILGYAEDPVELFFMHIQGSGRLKTPSGKYIRIGYADKNEHPYVSIGRYMADKGYL

KLGQTSMQGIKAYMRQNPQRLAEVLGQNPSYIFFRELAGSGNEGPVGALGTPLMGEYAGA

IDRHYITLGAPLFVATAHPVTRKALNRLIMAQDTGSAIKGAVRVDYFWGYGDEAGELAGK

QKTTGYVWQLLPNGMKPEYRP*

Z2491 <SEQ ID 3208>

MKKYLFRAALCGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSVQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSQFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKAYMQQNPQRLAEVLGQNPSYIFFRELTGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM01 <SEQ ID 3209>

MKKYLFRAALYGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKSYMRQNPQRLAEVLGQNPSYIFFRELAGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM02 <SEQ ID 3210>

MKKYLFRAALYGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKSYMRQNPQRLAEVLGQNPSYIFFRELAGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM03 <SEQ ID 3211>

MKKYLFRAALYGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADEGYL

KLGQTSMQGIKSYMRQNPQRLAEVLGQNPSYIFFRELAGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

-continued

ZM04 <SEQ ID 3212>

MKKYLFRAALCGIAAAILAACQSKSIQTFPQPDTSVINGPDRPVGIPAPAGTTVAGGGAV
YTVVPHLSLPHWAAQDFAKSLQSFRLGCANLKNRQGWQDVCAQAFQTPVHSFQAKQFFER
YFTPWQVAGNGSLAGTVTGYYEPVLKGDDRRTAQARFPIYGIPDDFISVPLPAGLRSGKA
LVRIRQTGKNSGTIDNAGGTHTADLSRFPITARTTAIKGRFEGSRFLPYHTRNQINGGAL
DGKAPILGYAEDPVELFFMHIQGSGRLKTPSGKYIRIGYADKNEHPYVSIGRYMADKGYL
KLGQTSMQGIKAYMQQNPQRLAEVLGQNPSYIFFRELTGSSNDGPVGALGTPLMGEYAGA
VDRHYITLGAPLFVATAHPVTRKALNRLIMAQDTGSAIKGAVRVDYFWGYGDEAGELAGK
QKTTGYVWQLLPNGMKPEYRP*

ZM05 <SEQ ID 3213>

MKKYLFRAALYGIAAAILAACQSKSIQTFPQPDTSVINGPDRPVGIPDPAGTTVGGGGAV
YTVVPHLSLPHWAAQDFAKSLQSFRLSCANLKNRQGWQDVCAQAFQTPVHSFQAKQFFER
YFTPWQVAGNGSLAGTVTGYYEPVLKGDDRRTAQARFPIYGIPDDFISVPLPAGLRSGKA
LVRIRQTGKNSGTIDNTGGTHTADLSRFPITARTTAIKGRFEGSRFLPYHTRNQINGGAL
DGKAPILGYAEDPVELFFMHIQGSGRLKTPSGKYIRIGYADKNEHPYVSIGRYMADKGYL
KLGQTSMQGIKAYMRQNPQRLAEVLGQNPSYIFFRELAGSSNDGPVGALGTPLMGEYAGA
VDRHYITLGAPLFVATAHPVTRKALNRLIMAQDTGSAIKGAVRVDYFWGYGDEAGELAGK
QKTTGYVWQLLPNGMKPEYRP*

ZM06 <SEQ ID 3214>

MKKYLFRAALYGIAAAILAACQSKSIQTFPQPDTSVINGPDRPVGIPDPAGTTVGGGGAV
YTVVPHLSLPHWAAQDFAKSLQSFRLGCANLKNRQGWQDVCAQAFQTPVHSFQAKQFFER
YFTPWQVAGNGSLAGTVTGYYEPVLKGDDRRTAQARFPIYGIPDDFISVPLPAGLRSGKA
LVRIRQTGKNSGTIDNTGGTHTADLSRFPITARTTAIKGRFEGSRFLPYHTRNQINGGAL
DGKAPILGYAEDPVELFFMHIQGSGRLKTPSGKYIRIGYADKNEHPYVSIGKYMADKGYL
KLGQTSMQGIKSYMRQNPQRLAEVLGQNPSYIFFRELAGSSNDGPVGALGTPLMGEYAGA
VDRHYITLGAPLFVATAHPVTRKALNRLIMAQDTGSAIKGAVRVDYFWGYGDEAGELAGK
QKTTGYVWQLLPNGMKPEYRP*

ZM07 <SEQ ID 3215>

MKKYLFRAALYGIAAAILAACQSKSIQTFPQPDTSVINGPDRPVGIPDPAGTTVGGGGAV
YTVVPHLSLPHWAAQDFAKSLQSFRLGCANLKNRQGWQDVCAQAFQTPVHSFQAKQFFER
YFTPWQVAGNGSLAGTVTGYYEPVLKGDDRRTAQARFPIYGIPDDFISVPLPAGLRSGKA
LVRIRQTGKNSGTIDNTGGTHTADLSRFPITARTTAIKGRFEGSRFLPYHTRNQINGGAL
DGKAPILGYAEDPVELFFMHIQGSGRLKTPSGKYIRIGYADKNEHPYVSIGRYMADKGYL
KLGQTSMQGIKSYMRQNPQRLAEVLGQNPSYIFFRELAGSSNDGPVGALGTPLMGEYAGA
VDRHYITLGAPLFVATAHPVTRKALNRLIMAQDTGSAIKGAVRVDYFWGYGDEAGELAGK
QKTTGYVWQLLPNGMKPEYRP*

ZM08N <SEQ ID 3216>

MKKYLFRAALYGIAAAILAACQSKSIQTFPQPDTSVINGPDRPVGIPDPAGTTVGGGGAV
YTVVPHLSLPHWAAQDFAKSLQSFRLGCANLKNRQGWQDVCAQAFQTPVHSFQAKQFFER
YFTPWQVAGNGSLAGTVTGYYEPVLKGDDRRTAQARFPIYGIPDDFISVPLPAGLRSGKA

-continued

LVRIRQTGKNSGTIDNTGGTHTADLSRFPITARTTAIKGRFEGSRFLPYHTRNQINGGAL
DGKAPILGYAEDPVELFFMHIQGSGRLKTPSGKYIRIGYADKNEHPYVSIGRYMADEGYL
KLGQTSMQGIKAYMRQNPQRLAEVLGQNPSYIFFRELAGSSNDGPVGALGTPLMGEYAGA
VDRHYITLGAPLFVATAHPVTRKALNRLIMAQDTGSAIKGAVRVDYFWGYGDEAGELAGK
QKTTGYVWQLLPNGMKPEYRP*

ZM09 <SEQ ID 3217>

MKKYLFRAALCGIAAAILAACQSKSIQTFPQPDTSVINGPDRPVGIPAPAGTTVAGGGAV
YTVVPHLSLPHWAAQDFAKSLQSFRLGCANLKNRQGWQDVCAQAFQTPVHSFQAKQFFER
YFTPWQVAGNGSLAGTVTGYYEPVLKGDDRRTAQARFPIYGIPDDFISVPLPAGLRSGKA
LVRIRQTGKNSGTIDNTGGTHTADLSQFPITARTTAIKGRFEGSRFLPYHTRNQINGGAL
DGKAPILGYAEDPVELFFMHIQGSGRLKTPSGKYIRIGYADKNEHPYVSIGKYMADKGYL
KLGQTSMQGIKSYMRQNPQRLAEVLGQNPSYIFFRELTGSGNDGPVGALGTPLMGEYAGA
VDRHYITLGAPLFVATAHPVTRKALNRLIMAQDTGSAIKGAVRVDYFWGYGDEAGELAGK
QKTTGYVWQLLPNGMKPEYRP*

ZM10 <SEQ ID 3218>

MKKYLFRAALCGIAAAILAACQSKSIQTFPQPDTSVINGPDRFVGIPAPAGTTVAGGGAV
YTVVPHLSLPHWAAQDFAKSLQSFRLGCANLKNRQGWQDVCAQAFQTPVHSFQAKQFFER
YFTPWQVAGNGSLAGTVTGYYEPVLKGDDRRTAQARFPIYGIPDDFISVPLPAGLRSGKA
LVRIRQTGKNSGTIDNTGGTHTADLSQFPITARTTAIKGRFEGSRFLPYHTRNQINGGAL
DGKAPILGYAEDPVELFFMHIQGSGRLKTPSGKYIRIGYADKNEHPYVSIGKYMADKGYL
KLGQTSMQGIKSYMRQNPQRLAEVLGQNPSYIFFRELTGSGNDGPVGALGTPLMGEYAGA
VDRHYITLGAPLFVATAHPVTRKALNRLIMAQDTGSAIKGAVRVDYFWGYGDEAGELAGK
QKTTGYVWQLLPNGMKPEYRP*

ZM11ASBC <SEQ ID 3219>

MKKYLFRAALCGIAAAILAACQSKSIQTFPQPDTSVINGPDRPVGIPAPAGTTVGGGGAV
YTVVPHLSLPHWAAQDFAKSLQSFRLGCANLKNRQGWQDVCAQAFQTPVHSVQAKQFFER
YFTPWQVAGNGSLAGTVTGYYEPVLKGDDRRTAQARFPIYGIPDDFISVPLPAGLRSGKA
LVRIRQTGKNSGTIDNAGGTHTADLSRFPITARTTAIKGRFEGSRFLPYHTRNQINGGAL
DGKAPILGYAEDPVELFFMHIQGSGRLKTPSGKYIRIGYADKNEHFYVSIGKYMADKGYL
KLGQTSMQGIKSYMRQNPQRLAEVLGQNPSYIFFRELTGSSNDGPVGALGTPLMGEYAGA
VDRHYITLGAPLFVATAHPVTRKALNRLIMAQDTGSAIKGAVRVDYFWGYGDEAGELAGK
QKTTGYVWQLLPNGMKPEYRP*

ZM12 <SEQ ID 3220>

MKKYLFRAALYGIAAAILAACQSKSIQTFPQPDTSVINGPDRPVGIPDPAGTTVGGGGAV
YTVVPHLSLPHWAAQDFAKSLQSFRLGCANLKNRQGWQDVCAQAFQTPVHSFQAKQFFER
YFTPWQVAGNGSLAGTVTGYYEPVLKGDDRRTAQARFPIYGIPDDFISVPLPAGLRSGKA
LVRIRQTGKNSGTIDNTGGTHTADLSRFPITARTTAIKGRFEGSRFLPYHTRNQINGGAL
DGKAPILGYAEDPVELFFMHIQGSGRLKTPSGKYIRIGYADKNEHPYVSIGRYMADKGYL
KLGQTSMQGIKSYMRQNPQRLAEVLGQNPSYIFFRELAGSSNDGPVGALGTPLMGEYAGA

-continued

VDRHYITLGAPLFVATAHPVTRKALNRLIMAQDTGSAIKGAVRVDYFWGYGDEAGELAGK

QKTTGYVWQLLPNGMKPEYRP*

ZM13 <SEQ ID 3221>

MKKYLFRAALYGIAAAILAACQSKSIQTFPQPDTSVINGPDRPVGIPDPAGTTVGGGGAV

YTVVPHLSLPHWAEQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSRFPITARTTAIKGRFEGSRFLPYHTRNQINGGAL

DGKAFILGYAEDPVELFFMHIQGSGRLKTPSGKYIRIGYADKNEHPYVSIGRYMADKGYL

KLGQTSMQGIKAYMRQNPQRLAEVLGQNPSYIFFRELAGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM14 <SEQ ID 3222>

MKKYLFRAALCGIAAAILAACQSKSIQTFPQPDTSVINGPDRPVGIPAPAGTTVAGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPACLRSGKA

LVRIRQTGKNSGTIDNAGGTHTADLSRFPITARTTAIKGRFEGSRFLPYHTRNQINGGAL

DGKAPILGYAEDPVELFFMHIQGSGRLKTPSGKYIRIGYADKNEHPYVSIGKYMADKGYL

KLGQTSMQGIKSYMRQNPQRLAEVLGQNPSYIFFRELTGSRNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM15 <SEQ ID 3223>

MKKYLFRAALYGIAAAILAACQSKSIQTFPQPDTSVINGPDRPVGIPDLAGTTVGGGGAV

YTVVPHLSLPHWAAQDFAKSLQSFRLGCANLKNHQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSRFPITARTTAIKGRFEGSRFLPYHTRNQINGGAL

DGKAPILGYAEDPVELFFMHIQGSGRLKTPSGKYIRIGYADKNEHPYVSIGKYMADKGYL

KLGQTSMQGIKSYMRQNPQRLAEVLGQNPSYIFFRELTGSGNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM16 <SEQ ID 3224>

MKKYLFRAALCGIAAAILAACQSKSIQTFPQPDTSVINGPGRPVGIPDPAGTTVGGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSQFPITARTTAIKGRFEGSRFLPYHTRNQINGGAL

DGKAPILGYAEDPVELFFMHIQGSGRLKTPSGKYIRIGYADKNEHPYVSIGKYMADKGYL

KLGQTSMQGIKSYMRQNPQRLAEVLGQNPSYIFFRELTGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

-continued

ZM17 <SEQ ID 3225>

MKKYLFRAALYGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSRFPITARTTAIKGRFEGSRFLPYHTRNQINGGAL

DGKAPILGYAEDPVELFFMHIQGSGRLKTPSGKYIRIGYADKNEHPYVSIGKYMADKGYL

KLGQTSMQGIKSYMRQNPQRLAEVLGQNPSYIFFRELTGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM18 <SEQ ID 3226>

MKKYLFRAALYGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSFQAKQFFER

YFTFWQVAGNGSLAGTVTGYYEPVLKGDDRRTAQARFPIYGIPDDFISVPLPAGLRSGKA

LVRIRQTGKNSGTIDNTGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKSYMRQNPQRLAEVLGQNPSYIFFRELAGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM19 <SEQ ID 3227>

MKKYLFRAALYGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKSYMRQNPQRLAEVLGQNPSYIFFRELAGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM20 <SEQ ID 3228>

MKKYLFRAALYGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKSYMRQNPQRLAEVLGQNPSYIFFRELAGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM21 <SEQ ID 3229>

MKKYLFRAALYGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

-continued

LVRIRQTGKNSGTIDNTGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKSYMRQNPQRLAEVLGQNPSYIFFRELAGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM22 <SEQ ID 3230>

MKKYLFRAALCGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSVQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSQFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKAYMQQNPQRLAEVLGQNPSYIFFRELTGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM23ASBC <SEQ ID 3231>

MKKYLFRAALYGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNAGGTHTADLSRFPITARTTAIKGRFEGSRFLPYHTRNQINGGAL

DGKAPILGYAEDPVELFFMHIQGSGRLKTPSGKYIRIGYADKNEHPYVSIGKYMADKGYL

KLGQTSMQGIKSYMRQNPQRLAEVLGQNPSYIFFRELAGSSNDGPVGALGTPLMGEYAGA

VDRHYITLGAPLFVATAHPVTSKALNRLIMAQDTGSAIKGAVRVDYFWGYGDEAGETAGK

MKEPGYVWQLLPNGMKPEYRP*

ZM24 <SEQ ID 3232>

MKKYLFRAALCGIAAAILAACQSKSIQTFPQPDTSVINGPDRPVGIPAPAGTTVAGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSQFPITARTTAIKGRFEGSRFLPYHTRNQINGGAL

DGKAPILGYAEDPVELFFMHIQGSGRLKTPSGKYIRIGYADKNEHPYVSIGKYMADKGYL

KLGQTSMQGIKSYMRQNPQRLAEVLGQNPSYIFFRELTGSGNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM25 <SEQ ID 3233>

MKKYLFRAALCGIAAAILAACQSKSIQTFPQPDTSVINGPDRPVGIPAPAGTTVAGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSQFPITARTTAIKGRFEGSRFLPYHTRNQINGGAL

DGKAPILGYAEDPVELFFMHIQGSGRLKTPSGKYIRIGYADKNEHPYVSIGKYMADKGYL

KLGQTSMQGIKSYMRQNPQRLAEVLGQNPSYIFFRELTGSGNDGPVGALGTPLMGEYAGA

-continued

VDRHYITLGAPLFVATAHPVTRKALNRLIMAQDTGSAIKGAVRVDYFWGYGDEAGELAGK

QKTTGYVWQLLPNGMKPEYRP*

ZM26 <SEQ ID 3234>

MKKYLFRAALYGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSVQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSQFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKAYMQQNPQRLAEVLGQNPSYIFFRELTGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM27BC <SEQ ID 3235>

MKKYLFRAALYGISAAILAACQSKSIQTFPQPDTSVINGPDRPAGIPDPAGTTVAGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNAGGTHTADLSRFPITARTTAIKGRFEGSRFLPYHTRNQINGGAL

DGKAPILGYAEDPVELFFMHIQGSGRLKTPSGKYIRIGYADKNEHFYVSIGRYMADKGYL

KLGQTSMQGIKSYMRQNPQRLAEVLGQNPSYIFFRELTGSSNDGPVGALGTPLMGEYAGA

VDRHYITLGAPLFVATAHPVTRKALNRLIMAQDTGSAIKGAVRVDYFWGYGDEAGETAGK

MKEPGYVWQLLPNGMKPEYRP*

ZM28 <SEQ ID 3236>

MKKYLFRAALCGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSQFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKAYMRQNPQRLAEVLGQNPSYIFFRELAGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM29ASBC <SEQ ID 3237>

MKKYLFRAALCGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSQFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKSYMRQNPQRLAEVLGQNPSYIFFRELTGSGNDGPVGALGTPLMGEYAGA

VDRHYITLGAPLFVATTHPITRKALNRLIMAQDTGSAIKGAVRVDYFWGYGDEAGELAGK

QKTTGYVWQLLPNGMKPEYRP*

-continued

ZM31ASBC <SEQ ID 3238>

MKKHLFRAALYGIAAAILAACQSKSIQTFPQPDTSIIKGPDRPAGIPDFAGTTVGGGGAV
YTVVPHLSLPHWAAQDFAKSLQSFRLGCANLKNRQGWQDVCAQAFQTPVHSFQAKQFFER
YFTPNQVAGNGSLAGTVTGYYEPVLKGDDRRTAQARFPIYGIPDDFISVPLPAGLRSGKA
LVRIRQTGKNSGTIDNAGGTHTADLSRFPITARTTAIKGRFEGSRFLPYHTRNQINGGAL
DGKAPILGYAEDPVELFFMHIQGSGRLKTPSGKYIRIGYADKNEHPYVSIGRYMADKGYL
KLGQTSMQGIKAYMRQNPQRLAEVLGQNPSYVFFRELAGSGNDGPVGALGTPLMGEYAGA
VDRHYITLGAPLFVATAHPVTRKALNRLIMAQDTGSAIKGAVRVDYFWGYGDEAGELAGK
QKTTGYVWQLLPNGMKPEYRP*

ZM32ASBC <SEQ ID 3239>

MKKHLLRSALYGIAAAILAACQSRSIQTFPQPDTSVINGPDRPAGIPDPAGTTVAGGGAV
YTVVPHLSMPHWAAQDFAKSLQSFRLGCANLKNRQGWQDVCAQAFQTPVHSFQAKRFFER
YFTPWQVAGNGSLAGTVTGYYEPVLKGDGRRTERARFPIYGIPDDFISVFLPAGLRGGKA
LVRIRQTGKNSGTIDNAGGTHTADLSRFPITARTTAIKGRFEGSRFLPYHTRNQINGGAL
DGKAPILGYAEDPVELFFMHIQGSGRLKTPSGKYIRIGYADKNEHPYVSIGRYMADKGYL
KLGQTSMQGIKAYMRQNPQRLAEVLGQNPSYIFFRELAGSGGDGPVGALGTPLMGGYAGA
IDRHYITLGAPLFVATAHPVTRKALNRLIMAQDTGSAIKGAVRVDYFWGYGDEAGELAGK
QKTTGYVWQLLPNGMKPEYRP*

ZM33ASBC <SEQ ID 3240>

MKKHLLRSALYGIAAAILAACQSRSIQTFPQPDTSVINGPDRPAGIPDPAGTTVAGGGAV
YTVVPHLSMPHWAAQDFAKSLQSFRLGCANLKNRQGWQDVCAQAFQTPIHSFQAKRFFER
YFTPWQVAGNGSLAGTVTGYYEPVLKGDGRRTERARFPIYGIPDDFISVPLPAGLRGGKN
LVRIRQTGKNSGTIDNAGGTHTADLSRFPITARTTAIKGRFEGSRFLPYHTRNQINGGAL
DGKAPILGYAEDPVELFFMHIQGSGRLKTPSGKYIRIGYADKNEHPYVSIGRYMADKGYL
KLGQTSMQGIKSYMRQNPHKLAEVLGQNPSYIFFRELAGSGNEGPVGALGTPLMGEYAGA
IDRHYITLGAPLFVATAHPVTRKALNRLIMAQDTGSAIKGAVRVDYFWGYGDEAGELAGK
QKTTGYVWQLLPNGMKPEYRP*

ZM96 <SEQ ID 3241>

MKKYLFRAALYGIAAAILAACQSKSIQTFPQPDTSVINGPDRPVGIPDPAGTTVGGGGAV
YTVVPHLSLPHWAAQDFAKSLQSFRLGCANLKNRQGWQDVCAQAFQTPVHSFQAKQFFER
YFTPWQVAGNGSLAGTVTGYYEPVLKGDDRRTAQARFPIYGIPDDFISVPLPAGLRSGKA
LVRIRQTGKNSGTIDNTGGTHTADLSRFPITARTTAIKGRFEGSRFLPYHTRNQINGGAL
DGKAPILGYAEDPVELFFMHIQGSGRLKTPSGKYIRIGYADKNEHPYVSIGRYMADKGYL
KLGQTSMQGIKAYMRQNPQRLAEVLGQNFSYIFFRELAGSSNDGPVGALGTPLMGEYAGA
VDRHYITLGAPLFVATAHPVTRKALNRLIMAQDTGSAIKGAVRVDYFWGYGDEAGELAGK
QKTTGYVWQLLPNGMKPEYRP*

FIG. 23 shows the results of aligning the sequences of each of these strains. Dark shading indicates regions of homology, and gray shading indicates the conservation of amino acids with similar characteristics. As is readily discernible, there is significant conservation among the various strains of ORF 919, further confirming its utility as an antigen for both vaccines and diagnostics.

Example 16

Using the above-described procedures, the following oligonucleotide primers were employed in the polymerase chain reaction (PCR) assay in order to clone the ORFs as indicated:

TABLE 7

Oligonucleotides used for PCR to amplify complete or partial ORFs

| ORF | primer | Sequence | Restriction sites |
|---|---|---|---|
| 001 | Forward | CGCGGATCCCATATG-TGGATGGTGCTGGTCAT | BamHI-NdeI |
| | Reverse | CCCGCTCGAG-TGCCGTCTTGTCCCAC | XhoI |
| 003 | Forward | CGCGGATCCCATATG-GTCGTATTCGTGGC | BamHI-NdeI |
| | Reverse | CCCGCTCGAG-AAAATCATGAACACGCGC | XhoI |
| 005 | Forward | CGCGGATCCCATATG-GACAATATTGACATGT | BamHI-NdeI |
| | Reverse | CCCGCTCGAG-CATCACATCCGCCCG | XhoI |
| 006 | Forward | CGCGGATCCCATATG-CTGCTGGTGCTGG | BamHI-NdeI |
| | Reverse | CCCGCTCGAG-AGTTCCGGCTTTGATGT | XhoI |
| 007 | Forward | CGCGGATCCCATATG-GCCGACAACAGCATCAT | BamHI-NdeI |
| | Reverse | CCCGCTCGAG-AAGGCGTTCATGATATAAG | XhoI |
| 008 | Forward | CGCGGATCCCATATG-AACAACAGACATTTTG | BamHI-NdeI |
| | Reverse | CCCGCTCGAG-CCTGTCCGGTAAAAGAC | XhoI |
| 009 | Forward | CGCGGATCCCATATG-CCCCGCGCTGCT | BamHI-NdeI |
| | Reverse | CCCGCTCGAG-TGGCTTTTGCCACGTTTT | XhoI |
| 011 | Forward | CGCGGATCCCATATG-AAGACACACCGCAAG | BamHI-NdeI |
| | Reverse | CCCGCTCGAG-GGCGGTCAGTACGGT | XhoI |
| 012 | Forward | CGCGGATCCCATATG-CTCGCCCGTTGCC | BamHI-NdeI |
| | Reverse | CCCGCTCGAG-AGCGGGGAAGAGGCAC | XhoI |
| 013 | Forward | CGCGGATCCCATATG-CCTTTGACCATGCT | BamHI-NdeI |
| | Reverse | CCCGCTCGAG-CTGATTCGGCAAAAAAATCT | XhoI |
| 018 | Forward | CGCGGATCCCATATG-CAGCAGAGGCAGTT | BamHI-NdeI |
| | Reverse | CCCGCTCGAG-GACGAGGCGAACGCC | XhoI |
| 019 | Forward | AAAGAATTC-CTGCCAGCCGGCAAGACCCCGGC | Eco RI |
| | Reverse | AAACTGCAG-TCAGCGGGCGGGGACAATGCCCAT | Pst I |
| 023 | Forward | AAAGAATTC-AAAGAATATTCGGCATGGCAGGC | Eco RI |
| | Reverse | AAACTGCAG-TTACCCCCAAATCACTTTAACTGA | Pst I |
| 025 | Forward | AAAGAATTC-TGCGCCACCCAACAGCCTGCTCC | Eco RI |
| | Reverse | AAACTGCAG-TCAGAACGCGATATAGCTGTTCGG | Pst I |
| 031 | Forward | CGCGGATCCCATATG-GTCTCCCTTCGCTT | BamHI-NdeI |
| | Reverse | CCCGCTCGAG-ATGTAAGACGGGGACAAC | XhoI |
| 032 | Forward | CGCGGATCCCATATG-CGGCGAAACGTGC | BamHI-NdeI |
| | Reverse | CCCGCTCGAG-CTGGTTTTTTGATATTTGTG | XhoI |
| 033 | Forward | CGCGGATCCCATATG-GCGGCGGCAGACA | BamHI-NdeI |
| | Reverse | CCCGCTCGAG-ATTTGCCGCATCCCGAT | XhoI |
| 034 | Forward | CGCGGATCCCATATG-GCCGAAAACAGCTACGG | BamHI-NdeI |
| | Reverse | CCCGCTCGAG-TTTGACGATTTGGTTCAATT | XhoI |
| 036 | Forward | CGCGGATCCCATATG-CTGAAGCCGTGCG | BamHI-NdeI |
| | Reverse | CCCGCTCGAG-CCGGACTGCGTATCGG | XhoI |
| 038 | Forward | CGCGGATCCCATATG-ACCGATTTCCGCCA | BamHI-NdeI |
| | Reverse | CCCGCTCGAG-TTCTACGCCGTACTGCC | XhoI |
| 039 | Forward | CGCGGATCCCATATG-CCGTCCGAACCGC | BamHI-NdeI |
| | Reverse | CCCGCTCGAG-TAGGATGACGAGGTAGG | XhoI |
| 041 | Forward | CGCGGATCCCATATG-TTCGTGCGCGAACCGC | BamHI-NdeI |
| | Reverse | CCCGCTCGAG-GCCCAAAAACTCTTTCAAA | XhoI |

TABLE 7-continued

Oligonucleotides used for PCR to amplify complete or partial ORFs

| ORF | primer | Sequence | Restriction sites |
|---|---|---|---|
| 042 | Forward | CGCGGATCCCATATG-ACGATGATTTGCTTGC | BamHI-NdeI |
| | Reverse | CCCGCTCGAG-TTTGCAGCCTGCATTTGAC | XhoI |
| 043 | Forward | AAAAAAGGTACC-ATGGTTGTTTCAAATCAAAATATC | Kpn I |
| | Reverse | AAACTGCAG-TTATTGCGCTTCACCTTCCGCCGC | Pst I |
| 043a | Forward | AAAAAAGGTACC-GCAAAAGTGCATGGCGGCTTGGACGGTGC | Kpn I |
| | Reverse | AAAAAACTGCAG-TTAATCCTGCAACACGAATTCGCCCGTCCG | Pst I |
| 044 | Forward | CGCGGATCCCATATG-CCGTCCGACTAGAG | BamHI-NdeI |
| | Reverse | CCCGCTCGAG-ATGCGCTACGGTAGCCA | XhoI |
| 046 | Forward | AAAGAATTC-ATGTCGGCAATGCTCCCGACAAG | Eco RI |
| | Reverse | AAACTGCAG-TCACTCGGCGACCCACACCGTGAA | Pst I |
| 047 | Forward | CGCGGATCCCATATG-GTCATCATACAGGCG | BamHI-NdeI |
| | Reverse | CCCGCTCGAG-TCCGAAAAAGCCCATTTTG | XhoI |
| 048 | Forward | AAAGAATTC-ATGCTCAACAAAGGCGAAGAATTGCC | Eco RI |
| | Reverse | AAACTGCAG-TCAAGATTCGACGGGGATGATGCC | Pst I |
| 049 | Forward | AAAGAATTC-ATGCGGGCGCAGGCGTTTGATCAGCC | Eco RI |
| | Reverse | AAACTGCAG-AAGGCGTATCTGAAAAAATGGCAG | Pst I |
| 050 | Forward | CGCGGATCCCATATG-GGCGCGGGCTGG | BamHI-NdeI |
| | Reverse | CCCGCTCGAG-AATCGGGCCATCTTCGA | XhoI |
| 052 | Forward | AAAAAAGAATTC-ATGGCTTTGGTGGCGGAGGAAAC | Eco RI |
| | Reverse | AAAAAAGTCGAC-TCAGGCGGCGTTTTTCACCTTCCT | Sal I |
| 052a | Forward | AAAAAAGAATTC-GTGGCGGAGGAAACGGAAATATCCGC | Eco RI |
| | Reverse | AAAAAACTGCAG-TTAGCTGTTTTTGGAAACGCCGTCCAACCC | Pst I |
| 073 | Forward | CGCGGATCCCATATG-TGTATGCCATATAAGAT | BamHI-NdeI |
| | Reverse | CCCGCTCGAG-CACCGGATTGTCCGAC | XhoI |
| 075 | Forward | CGCGGATCCCATATG-CCGTCTTACTTCATC | BamHI-NdeI |
| | Reverse | CCCGCTCGAG-ATCACCAATGCCGATTATTT | XhoI |
| 077a | Forward | AAAAAAGAATTC-GGCGGCATTTTCATCGACACCTTCCT | Eco RI |
| | Reverse | AAAAAACTGCAG-TCAGACGAACATCTGCACAAACGCAAT | Pst I |
| 080 | Forward | AAAGAATTC-GCGTCCGGGCTGGTTTGGTTTTACAATTC | Eco RI |
| | Reverse | AAACTGCAG-CTATTCTTCGGATTCTTTTTCGGG | Pst I |
| 081 | Forward | AAAGAATTC-ATGAAACCACTGGACCTAAATTTCATCTG | Eco RI |
| | Reverse | AAACTGCAG-TCACTTATCCTCCAATGCCTC | Pst I |
| 082 | Forward | AAAGAATTC-ATGTGGTTGTTGAAGTTGCCTGC | Eco RI |
| | Reverse | AAACTGCAG-TTACGCGGATTCGGCAGTTGG | Pst I |
| 084 | Forward | AAAGAATTC-TATCACCCAGAATATGAATACGGCTACCG | Eco RI |
| | Reverse | AAACTGCAG-TTATACTTGGGCGCAACATGA | Pst I |
| 085 | Forward | CGCGGATCCCATATG-GGTAAAGGGCAGGACT | BamHI-NdeI |
| | Reverse | CCCGCTCGAG-CAAAGCCTTAAACGCTTCG | XhoI |
| 086 | Forward | AAAAAAGGTACC-TATTTGGCATCAAAAGAAGGCGG | Kpn I |
| | Reverse | AAACTGCAG-TTACTCCACCCGATAACCGCG | Pst I |
| 087 | Forward | AAAGAATTC-ATGGGCGGTAAAACCTTTATGC | Eco RI |
| | Reverse | AAACTGCAG-TTACGCCGCACACGCAATCGC | Pst I |
| 087a | Forward | AAAAAAGAATTC-AAGCTATTAGGCGTGCCGATTGTGATTCA | Eco RI |
| | Reverse | AAAAAACTGCAG-TTACGCCTGCAAGATGCCCAGCTTGCC | Pst I |
| 088 | Forward | AAAAAAGAATTC-ATGTTTTTATGGCTCGCACATTTCAG | Eco RI |
| | Reverse | AAAAAACTGCAG-TCAGCGGATTTTGAGGGTACTCAAACC | Pst I |
| 089 | Forward | CGCGGATCCCATATG-CCGCCCAAAATCAC | BamHI-NdeI |
| | Reverse | CCCGCTCGAG-TGCGCATACCAAAGCCA | XhoI |
| 090 | Forward | CGCGGATCCCATATG-CGCATAGTCGAGCA | BamHI-NdeI |
| | Reverse | CCCGCTCGAG-AGCAAAACGGCGGTACG | XhoI |
| 091 | Forward | AAAGAATTC-ATGGAAATACCCGTACCGCCGAGTCC | Eco RI |
| | Reverse | AAACTGCAG-TCAGCGCAGGGGGTAGCCCAAGCC | Pst I |
| 092 | Forward | AAAGAATTC-ATGTTTTTTATTTCAATCCG | Eco RI |
| | Reverse | AAACTGCAG-TCAAATCTGTTTCGACAATGC | Pst I |
| 093 | Forward | AAAGAATTC-ATGCAGAATTTTGGCAAAGTGGC | Eco RI |
| | Reverse | AAACTGCAG-CTATGGCTCGTCATACCGGGC | Pst I |
| 094 | Forward | AAAGAATTC-ATGCCGTCACGGAAGCGCATCAACTC | Eco RI |
| | Reverse | AAACTGCAG-TTATCCCGGCCATACCGCCGAACA | Pst I |
| 095 | Forward | AAAGAATTC-ATGTCCTTTCATTTGAACATGGACGG | Eco RI |
| | Reverse | AAACTGCAG-TCAACGCCGCAGGCACTAACGCCC | Pst I |
| 096 | Forward | AAAGAATTC-ATGGCTCGTCATACCGGGCAGGG | Eco RI |
| | Reverse | AAACTGCAG-TCAAAGGAAAAGGCCGTCTGAAAAGCG | Pst I |
| 097 | Forward | AAAGAATTC-ATGGACACTTCAAAACAAACACTGTTG | Eco RI |
| | Reverse | AAACTGCAG-TCAGCCCAAATACCAGAATTTCAG | Pst I |

TABLE 7-continued

Oligonucleotides used for PCR to amplify complete or partial ORFs

| ORF | primer | Sequence | Restriction sites |
|---|---|---|---|
| 098 | Forward | AAAGAATTC-GATGAACGCAGCCCAGCATGGATACG | Eco RI |
| | Reverse | AAACTGCAG-TTACGACATTCTGATTTGGCA | Pst I |
| 102 | Forward | AAAAAAGAATTC-GGCCTGATGATTTTGGAAGTCAACAC | Eco RI |
| | Reverse | AAAAAACTGCAG-TTATCCTTTAAATACGGGGACGAGTTC | Pst I |
| 105 | Forward | CGCGGATCCCATATG-TCCGCAAACGAATACG | BamHI-NdeI |
| | Reverse | CCCGCTCGAG-GTGTTCTGCCAGTTTCAG | XhoI |
| 107 | Forward | AAAAAAGAATTC-CTGATGATTTTGGAAGTCAACACCCATTATCC | Eco RI |
| | Reverse | AAAAAACTGCAG-TTATCCTTTAAATACGGGGACGAGTTC | Pst I |
| 107b | Forward | AAAAAAGAATTC-GATACCCAAGCCCCCGCCGGCACAAACTACTG | Eco RI |
| | Reverse | AAAAAACTGCAG-TTACGCGTCGCCTTTAAAGTATTTGAGCAGGCTGGAGAC | Pst I |
| 108 | Forward | AAAGAATTC-ATGTTGCCGGGCTTCAACCG | Eco RI |
| | Reverse | AAACTGCAG-TTAGCGGTACAGGTGTTTGAAGCA | Pst I |
| 108a | Forward | AAAAAAGAATTC-GGTAACACATTCGGCAGCTTAGACGGTGG | Eco RI |
| | Reverse | AAACTGCAG-TTAGCGGTACAGGTGTTTGAAGCA | Pst I |
| 109 | Forward | AAAGAATTC-ATGTATTATCGCCGGGTTATGGG | Eco RI |
| | Reverse | AAACTGCAG-CTAGCCCAAAGATTTGAAGTGTTC | Pst I |
| 111 | Forward | CGCGGATCCCATATG-TGTTCGGAACAAACCGC | BamHI-NdeI |
| | Reverse | CCCGCTCGAG-GCGGAGCAGTTTTTCAAA | XhoI |
| 114 | Forward | CGCGGATCCCATATG-GCTTCCATCACTTCGC | BamHI-NdeI |
| | Reverse | CCCGCTCGAG-CATCCGCGAAATCGTC | XhoI |
| 117 | Forward | AAAAAAGGTACC-ATGGTCGAAGAACTGGAACTGCTG | Kpn I |
| | Reverse | AAACTGCAG-TTAAAGCCGGGTAACGCTCAATAC | Pst I |
| 118 | Forward | AAAGTCGAC-ATGTGTGAGTTCAAGGATATTATAAG | Sal I |
| | Reverse | AAAGCATGC-CTATTTTTTGTTGTAATAATCAAATC | Sph I |
| 121 | Forward | CGCGGATCCCATATG-GAAACACAGCTTTACAT | BamHI-NdeI |
| | Reverse | CCCGCTCGAG-ATAATAATATCCCGCGCCC | XhoI |
| 122 | Forward | CGCGGATCCCATATG-GTCATGATTAAAATCCGCA | BamHI-NdeI |
| | Reverse | CCCGCTCGAG-AATCTTGGTAGATTGGATTT | XhoI |
| 125 | Forward | AAAGAATTC-ATGTCGGGCAATGCCTCCTCTCC | Eco RI |
| | Reverse | AAACTGCAG-TCACGCCGTTTCAAGACG | Pst I |
| 125a | Forward | AAAAAAGAATTC-ACGGCAGGCAGCACCGCCGCACAGGTTTC | Eco RI |
| | Reverse | AAAAAACTGCAG-TTATTTTGCCACGTCGGTTTCTCCGGTGAACAACGC | Pst I |
| 126 | Forward | CGCGGATCCCATATG-CCGTCTGAAACCC | BamHI-NdeI |
| | Reverse | CCCGCTCGAG-ATATTCCGCCGAATGCC | XhoI |
| 127 | Forward | AAAGAATTC-ATGGAAATATGGAATATGTTGGACACTTG | Eco RI |
| | Reverse | AAACTGCAG-TTAAAGTGTTTCGGAGCCGGC | Pst I |
| 127a | Forward | AAAAAAGAATTC-AAGGAACTGATTATGTGTCTGTCGGG | Eco RI |
| | Reverse | AAACTGCAG-TTAAAGTGTTTCGGAGCCGGC | Pst I |
| 128 | Forward | CGCGGATCCCATATG-ACTGACAACGCACT | BamHI-NdeI |
| | Reverse | CCCGCTCGAG-GACCGCGTTGTCGAAA | XhoI |
| 130 | Forward | CGCGGATCCCATATG-AAACAACTCCGCGA | BamHI-NdeI |
| | Reverse | CCCGCTCGAG-GAATTTTGCACCGGATTG | XhoI |
| 132 | Forward | AAAGAATTC-ATGGAACCCTTCAAAACCTTAATTTG | Eco RI |
| | Reverse | AAAAAACTGCAG-TCACCATGTCGGCATTTGAAAAAC | Pst I |
| 134 | Forward | CGCGGATCCCATATG-TCCCAAGAAATCCTC | BamHI-NdeI |
| | Reverse | CCCGCTCGAG-CAGTTTGACCGAATGTTC | XhoI |
| 135 | Forward | CGCGGATCCCATATG-AAATACAAAAGAATCGTATT | BamHI-NdeI |
| | Reverse | CCCGCTCGAG-AAATTCGGTCAGAAGCAGG | XhoI |
| 137 | Forward | AAAAAAGGTACC-ATGATTACCCATCCCCAATTCGATCC | Kpn I |
| | Reverse | AAAAAACTGCAG-TCAGTGCTGTTTTTTCATGCCGAA | Pst I |
| 137a | Forward | AAAAAAGAATTC-GGCCGCAAACACGGCATCGGCTTCCT | Eco RI |
| | Reverse | AAAAAACTGCAG-TTAAGCGGGATGACGCGGCAGCATACC | Pst I |
| 138 | Forward | AAAAAAGAATTC-AACTCAGGCGAAGGAGTGCTTGTGGC | Eco RI |
| | Reverse | AAAAAATCTAGA-TCAGTTTAGGGATAGCAGGCGTAC | Xba I |
| 141 | Forward | AAAGAATTC-ATGAGCTTCAAAACCGATGCCGAAATCGC | Eco RI |
| | Reverse | AAACTGCAG-TCAGAACAAGCCGTGAATCACGCC | Pst I |
| 142 | Forward | CGCGGATCCCATATG-CGTGCCGATTTCATG | BamHI-NdeI |
| | Reverse | CCCGCTCGAG-AAACTGCTGCACATGGG | XhoI |

TABLE 7-continued

Oligonucleotides used for PCR to amplify complete or partial ORFs

| ORF | primer | Sequence | Restriction sites |
|---|---|---|---|
| 143 | Forward | AAAAAAGAATTC-ATGCTCAGTTTCGGCTTTCTCGGCGTTCAGAC | Eco RI |
| | Reverse | AAAAAACTGCAG-TCAAACCCCGCCGTGTGTTTCTTTAAT | Pst I |
| 144 | Forward | AAAAAAGAATTC-GGTCTGATCGACGGGCGTGCCGTAAC | Eco RI |
| | Reverse | AAAAAATCTAGA-TCGGCATCGGCCGGCATATGTCCG | Xba I |
| 146 | Forward | AAAAAAGAATTC-CGCCAAGTCGTCATTGACCACGACAAAGTC | Eco RI |
| | Reverse | AAAAAACTGCAG-TTAGGCATCGGCAAATAGGAAACTGGG | Pst I |
| 147 | Forward | AAAAAAGAATTC-ACTGAGCAATCGGTGGATTTGGAAAC | Eco RI |
| | Reverse | AAAAAATCTAGA-TTAGGTAAAGCTGCGGCCCATTTGCGG | Xba I |
| 148 | Forward | AAAAAAGAATTC-ATGGCGTTAAAAACATCAAACTTGGAACACGC | Eco RI |
| | Reverse | AAAAAATCTAGA-TCAGCCCTTCATACAGCCTTCGTTTTG | Xba I |
| 149 | Forward | CGCGGATCCCATATG-CTGCTTGACAACAAAGT | BamHI-NdeI |
| | Reverse | CCCGCTCGAG-AAACTTCACGTTCACGCC | XhoI |
| 150 | Forward | CGCGGATCCCATATG-CAGAACACAAATCCG | BamHI-NdeI |
| | Reverse | CCCGCTCGAG-ATAAACATCACGCTGATAGC | XhoI |
| 151 | Forward | AAAAAAGAATTC-ATGAAACAAATCCGCAACATCGCCATCATCGC | Eco RI |
| | Reverse | AAAAAACTGCAG-TCAATCCAGCTTTTTAAAGTGGCGGCG | Pst I |
| 152 | Forward | AAAAAAGAATTC-ATGAAAAACAAAACCAAAGTCTGGGACCTCCC | EcoRI |
| | Reverse | AAAAAACTGCAG-TCAGGACAGGAGCAGGATGGCGGC | Pst I |
| 153 | Forward | AAAAAAGAATTC-ATGGCGTTTGCTTACGGTATGAC | Eco RI |
| | Reverse | AAAAAACTGCAG-TCAGTCATGTTTTTCCGTTTCATT | Pst I |
| 153a | Forward | AAAAAAGAATTC-CGGACTTCGGTATCGGTTCCCCAGCATTG | Eco RI |
| | Reverse | AAAAAACTGCAG-TTACGCCGACGAAATACTCAGACTTTTCGG | Pst I |
| 154 | Forward | CGCGGATCCCATATG-ACTGACAACAGCCC | BamHI-NdeI |
| | Reverse | CCCGCTCGAG-TCGGCTTCCTTTCGGG | XhoI |
| 155 | Forward | AAAAAAGAATTC-ATGAAAATCGGTATCCCACGCGAGTC | Eco RI |
| | Reverse | AAAAAACTGCAG-TTACCCTTTCTTAAACATATTCAGCAT | Pst I |
| 156 | Forward | AAAAAAGAATTC-GCACAGCAAAACGGTTTTGAAGC | Eco RI |
| | Reverse | AAAAAACTGCAG-TCAAGCAGCCGCGACAAACAGCCC | Pst I |
| 157 | Forward | CGCGGATCCCATATG-AGGAACGAGGAAAAAC | BamHI-NdeI |
| | Reverse | CCCGCTCGAG-AAAACACAATATCCCCGC | XhoI |
| 158 | Forward | AAAAAAGAATTC-GCGGAGCAGTTGGCGATGGCAAATTCTGC | Eco RI |
| | Reverse | AAAAAATCTAGA-TTATCCACAGAGATTGTTTCCCAGTTC | Xba I |
| 160 | Forward | CGCGGATCCCATATG-GACATTCTGGACAAAC | BamHI-NdeI |
| | Reverse | CCCGCTCGAG-TTTTTGCCCGCCTTCTTT | XhoI |
| 163 | Forward | AAAAAAGGTACC-ACCGTGCCGGATCAGGTGCAGATGTG | Kpn I |
| | Reverse | AAAAAATCTAGA-TTACTCTGCCAATTCCACCTGCTCGTG | Xba I |
| 163a | Forward | AAAAAAGAATTC-CGGCTGGTGCAGATAATGAGCCAGAC | Eco RI |
| | Reverse | AAAAAATCTAGA-TTACTCTGCCAATTCCACCTGCTCGTG | Xba I |
| 164 | Forward | CGCGGATCCCATATG-AACCGGACTTATGCC | BamHI-NdeI |
| | Reverse | CCCGCTCGAG-TTTGTTTCCGTCAAACTGC | XhoI |
| 165 | Forward | CGCGGATCCGCTAGC-GCTGAAGCGACAGACG | BamHI-NdeI |
| | Reverse | CCCGCTCGAG-AATATCCAATACTTTCGCG | XhoI |
| 206 | Forward | CGCGGATCCCATATG-AAACACCGCCAACCGA | BamHI-NdeI |
| | Reverse | CCCGCTCGAG-TTCTGTAAAAAAAGTATGTGC | XhoI |
| 209 | Forward | CGCGGATCCCATATG-CTGCGGCATTTAGGA | BamHI-NdeI |
| | Reverse | CCCGCTCGAG-TACCCCTGAAGGCAAC | XhoI |
| 211 | Forward | AAAAAAGAATTC-ATGTTGCGGGTTGCTGCTGC | Eco RI |
| | Reverse | AAAAAACTGCAG-CTATCCTGCGGATTGGCATTGAAA | Pst I |
| 212 | Forward | CGCGGATCCCATATG-GACAATCTCGTATGG | BamHI-NdeI |
| | Reverse | CCCGCTCGAG-AGGGGTTAGATCCTTCC | XhoI |
| 215 | Forward | CGCGGATCCCATATG-GCATGGTTGGGTCGT | BamHI-NdeI |
| | Reverse | CCCGCTCGAG-CATATCTTTTGTATCATAAATC | XhoI |
| 216 | Forward | CGCGGATCCCATATG-GCAATGGCAGAAAACG | BamHI-NdeI |
| | Reverse | CCCGCTCGAG-TACAATCCGTGCCGCC | XhoI |

TABLE 7-continued

Oligonucleotides used for PCR to amplify complete or partial ORFs

| ORF | primer | Sequence | Restriction sites |
|---|---|---|---|
| 217 | Forward | CGCGGATCCCATATG-GCGGATGACGGTGTG | BamHI-NdeI |
| | Reverse | CCCGCTCGAG-ACCCCGAATATCGAATCC | XhoI |
| 218 | Forward | CGCGGATCCCATATG-GTCGCGGTCGATC | BamHI-NdeI |
| | Reverse | CCCGCTCGAG-TAACTCATAGAATCCTGC | XhoI |
| 219 | Forward | CGCGGATCCGCTAGC-ACGGCAAGGTTAAG | BamHI-NheI |
| | Reverse | CCCGCTCGAG-TTTAAACCATCTCCTCAAAAC | XhoI |
| 223 | Forward | CGCGGATCCCATATG-GAATTCAGGCACCAAGTA | BamHI-NdeI |
| | Reverse | CCCGCTCGAG-GGCTTCCCGCGTGTC | XhoI |
| 225 | Forward | CGCGGATCCCATATG-GACGAGTTGACCAACC | BamHI-NdeI |
| | Reverse | CCCGCTCGAG-GTTCAGAAAGCGGGAC | XhoI |
| 226 | Forward | AAAGAATTC-CTTGCGATTATCGTGCGCACGCG | Eco RI |
| | Reverse | AAACTGCAG-TCAAAATCCCAAAACGGGGAT | Pst I |
| 228 | Forward | CGCGGATCCCATATG-TCGCAAGAAGCCAAACAG | BamHI-NdeI |
| | Reverse | CCCGCTCGAG-TTTGGCGGCATCTTTCAT | XhoI |
| 229 | Forward | CGCGGATCCCATATG-CAAGAGGTTTTGCCC | BamHI-NdeI |
| | Reverse | CCCGCTCGAG-ACACAATATAGCGGATGAAC | XhoI |
| 230 | Forward | CGCGGATCCCATATG-CATCCGGGTGCCGAC | BamHI-NdeI |
| | Reverse | CCCGCTCGAG-AAGTTTGGCGGCTTCGG | XhoI |
| 232 | Forward | AAAAAAGAATTC-ATGTACGCTAAAAAAGGCGGTTTGGG | Eco RI |
| | Reverse | AAAAAACTGCAG-TCAAGGTTTTTTCCTGATTGCCGCCGC | Pst I |
| 232a | Forward | AAAAAAGAATTC-GCCAAGGCTGCCGATACACAAATTGA | Eco RI |
| | Reverse | AAAAAACTGCAG-TTAAACATTGTCGTTGCCGCCCAGATG | Pst I |
| 233 | Forward | CGCGGATCCCATATG-GCGGACAAACCCAAG | BamHI-NdeI |
| | Reverse | CCCGCTCGAG-GACGGCATTGAGCAG | XhoI |
| 234 | Forward | CGCGGATCCCATATG-GCCGTTTCACTGACCG | BamHI-NdeI |
| | Reverse | GCCCAAGCTT-ACGGTTGGATTGCCATG | Hind III |
| 235 | Forward | CGCGGATCCCATATG-GCCTGCCAAGTTCAAA | BamHI-NdeI |
| | Reverse | CCCGCTCGAG-TTTGGGCTGCTCTTC | XhoI |
| 236 | Forward | CGCGGATCCCATATG-GCGCGTTTCGCCTT | BamHI-NdeI |
| | Reverse | CCCGCTCGAG-ATGGGTCGCGCGCCGT | XhoI |
| 238 | Forward | CGCGGATCCGCTAGC-AACGGTTTGGATGCCCG | BamHI-NheI |
| | Reverse | CCCGCTCGAG-TTTGTCTAAGTTCCTGATATG | XhoI |
| 239 | Forward | CCGGAATTCTACATATG-CTCCACCATAAAGGTATTG | EcoRI-NdeI |
| | Reverse | CCCGCTCGAG-TGGTGAAGAGCGGTTTAG | XhoI |
| 240 | Forward | CGCGGATCCCATATG-GACGTTGGACGATTTC | BamHI-NdeI |
| | Reverse | CCCGCTCGAG-AAACGCCATTACCCGATG | XhoI |
| 241 | Forward | CCGGAATTCTACATATG-CCAACACGTCCAACT | EcoRI-NdeI |
| | Reverse | CCCGCTCGAG-GAATGCGCCTGTAATTAATC | XhoI |
| 242 | Forward | CGCGGATCCCATATG-ATCGGCAAACTTGTTG | BamHI-NdeI |
| | Reverse | GCCCAAGCTT-ACCGATACGGTCGCAG | HindIII |
| 243 | Forward | CGCGGATCCCATATG-ACGATTTTTTCGATGCTGC | BamHI-NdeI |
| | Reverse | CCCGCTCGAG-CGACTTGGTTACCGCG | XhoI |
| 244 | Forward | CGCGGATCCCATATG-CCGTCTGAAGCCC | BamHI-NdeI |
| | Reverse | CCCGCTCGAG-TTTTTTCGGTAGGGGATTT | XhoI |
| 246 | Forward | CGCGGATCCCATATG-GACATCGGCAGTGC | BamHI-NdeI |
| | Reverse | CCCGCTCGAG-CCCGCGCTGCTGGAG | XhoI |
| 247 | Forward | CGCGGATCCCATATG-GTCGGATCGAGTTAC | BamHI-NdeI |
| | Reverse | CCCGCTCGAG-AAGTGTTCTGTTTGCGCA | XhoI |
| 248 | Forward | CGCGGATCCCATATG-CGCAAACAGAACACT | BamHI-NdeI |
| | Reverse | CCCGCTCGAG-CTCATCATTATTGCTAACA | XhoI |

TABLE 7-continued

Oligonucleotides used for PCR to amplify complete or partial ORFs

| ORF | primer | Sequence | Restriction sites |
|---|---|---|---|
| 249 | Forward | CGCGGATCCCATATG-AAGAATAATGATTGCTTC | BamHI-NdeI |
| | Reverse | CCCGCTCGAG-TTCCCGACCTCCGAC | XhoI |
| 251 | Forward | CGCGGATCCCATATG-CGTGCTGCGGTAGT | BamHI-NdeI |
| | Reverse | CCCGCTCGAG-TACGAAAGCCGGTCGTG | XhoI |
| 253 | Forward | AAAAAAGAATTC-ATGATTGACAGGAACCGTATGCTGCG | Eco RI |
| | Reverse | AAAAAACTGCAG-TTATTGGTCTTTCAAACGCCCTTCCTG | Pst I |
| 253a | Forward | AAAAAAGAATTC-AAAATCCTTTTGAAAACAAGCGAAAACGG | Eco RI |
| | Reverse | AAAAAACTGCAG-TTATTGGTCTTTCAAACGCCCTTCCTG | Pst I |
| 254 | Forward | AAAAAAGAATTC-ATGTATACAGGCGAACGCTTCAATAC | Eco RI |
| | Reverse | AAAAAATCTAGA-TCAGATTACGTAACCGTACACGCTGAC | Xba I |
| 255 | Forward | CGCGGATCCCATATG-GCCGCGTTGCGTTAC | BamHI-NdeI |
| | Reverse | CCCGCTCGAG-ATCCGCAATACCGACCAG | XhoI |
| 256 | Forward | CGCGGATCCGCTAGC-TTTTAACACCGCCGGAC | BamHI-NdeI |
| | Reverse | CCCGCTCGAG-ACGCCTGTTTGTGCGG | XhoI |
| 257 | Forward | CGCGGATCCCATATG-GCGGTTTCTTTCCTG | BamHI-NdeI |
| | Reverse | CCCGCTCGAG-GCGCGTGAATATCGCG | XhoI |
| 258 | Forward | AAAAAAGAATTC-GATTATTTCTGGTGGATTGTTGCGTTCAG | Eco RI |
| | Reverse | AAAAAACTGCAG-CTACGCATAAGTTTTTACCGTTTTTGG | Pst I |
| 258a | Forward | AAAAAAGAATTC-GCGAAGGCGGTGGCGCAAGGCGA | Eco RI |
| | Reverse | AAAAAACTGCAG-CTACGCATAAGTTTTTACCGTTTTTGG | Pst I |
| 259 | Forward | CGCGGATCCCATATG-GAAGAGCTGCCTCCG | BamHI-NdeI |
| | Reverse | CCCGCTCGAG-GGCTTTTCCGGCGTTT | XhoI |
| 260 | Forward | CGCGGATCCCATATG-GGTGCGGGTATGGT | BamHI-NdeI |
| | Reverse | CCCGCTCGAG-AACAGGGCGACACCCT | XhoI |
| 261 | Forward | AAAAAAGAATTC-CAAGATACAGCTCGGGCATTCGC | Eco RI |
| | Reverse | AAAAAACTGCAG-TCAAACCAACAAGCCTTGGTCACT | Pst I |
| 263 | Forward | CGCGGATCCCATATG-GCACGTTTAACCGTA | BamHI-NdeI |
| | Reverse | CCCGCTCGAG-GGCGTAAGCCTGCAATT | XhoI |
| 264 | Forward | AAAAAAGGTACC-GCCGACGCAGTGGTCAAGGCAGAA | Kpn I |
| | Reverse | AAACTGCAG-TCAGCCGGCGGTCAATACCGCCCG | Pst I |
| 265 | Forward | AAAAAAGAATTC-GCGGAGGTCAAGAGAAGGTGTTTG | Eco RI |
| | Reverse | AAAAAACTGCAG-TTACGAATACGTCGTCAAAATGGG | Pst I |
| 266 | Forward | AAAGAATTC-CTCATCTTTGCCAACGCCCCCTTC | Eco RI |
| | Reverse | AAACTGCAG-CTATTCCCTGTTGCGCGTGTGCCA | Pst I |
| 267 | Forward | AAAGAATTC-TTCTTCCGATTCGATGTTAATCG | Eco RI |
| | Reverse | AAACTGCAG-TTAGTAAAAACCTTTCTGCTTGGC | Pst I |
| 269 | Forward | AAAGAATTC-TGCAAACCTTGCGCCACGTGCCC | Eco RI |
| | Reverse | AAACTGCAG-TTACGAAGACCGCAACGAAAGGCAGAG | Pst I |
| 269a | Forward | AAAAAAGAATTC-GACTTTATCCAAAACACGGCTTCGCC | Eco RI |
| | Reverse | AAACTGCAG-TTACGAAGACCGCAACGAAAGGCAGAG | Pst I |
| 270 | Forward | AAAGAATTC-GCCGTCAAGCTCGTTTTGTTGCAATG | Eco RI |
| | Reverse | AAACTGCAG-TTATTCGGCGGTAAATGCCGTCTG | Pst I |
| 271 | Forward | CGCGGATCCCATATG-CCTGTGTGCAGCTCGAC | BamHI-NdeI |
| | Reverse | CCCGCTCGAG-TCCCAGCCCCGTGGAG | XhoI |
| 272 | Forward | AAAGAATTC-ATGACCGCAAAGGAAGAACTGTTCGC | Eco RI |
| | Reverse | AAACTGCAG-TCAGAGCAGTTCCAAATCGGGGCT | Pst I |
| 273 | Forward | AAAGAATTC-ATGAGTCTTCAGGCGGTATTTATATACCC | Eco RI |
| | Reverse | AAACTGCAG-TTACGCGTAAGAAAAAACTGC | Pst I |
| 274 | Forward | CGCGGATCCCATATG-ACAGATTTGGTTACGGAC | BamHI-NdeI |
| | Reverse | CCCGCTCGAG-TTTGCTTTCAGTATTATTGAA | XhoI |
| 276 | Forward | AAAAAAGAATTC-ATGATTTTGCCGTCGTCCATCACGATGATGCG | Eco RI |
| | Reverse | AAAAAACTGCAG-CTACACCACCATCGGCGAATTTATGGC | Pst I |
| 277 | Forward | AAAAAAGAATTC-ATGCCCCGCTTTGAGGACAAGCTCGTAGG | Eco RI |
| | Reverse | AAAAAACTGCAG-TCATAAGCCATGCTTACCTTCCAACAA | Pst I |
| 277a | Forward | AAAAAAGAATTC-GGGGCGGCGGCTGGGTTGGACGTAGG | Eco RI |
| | Reverse | AAAAAACTGCAG-TCATAAGCCATGCTTACCTTCCAACAA | Pst I |
| 278 | Forward | AAAAAAGGTACC-GTCAAAGTTGTATTAATCGGGCCTTTGCC | Kpn I |
| | Reverse | AAAAAACTGCAG-TCATTCAACCATATCAAATCTGCC | Pst I |
| 278a | Forward | AAAAAAGAATTC-AAAACTCTCCTAATTCGTCATAGTCG | Eco RI |
| | Reverse | AAAAAACTGCAG-TCATTCAACCATATCAAATCTGCC | Pst I |
| 279 | Forward | CGCGGATCCCATATG-TTGCCTGCAATCACGATT | BamHI-NdeI |
| | Reverse | CCCGCTCGAG-TTTAGAAGCGGGCGGCAA | XhoI |

TABLE 7-continued

Oligonucleotides used for PCR to amplify complete or partial ORFs

| ORF | primer | Sequence | Restriction sites |
|---|---|---|---|
| 280 | Forward | AAAAAAGGTACC-GCCCCCCTGCCGGTTGTAACCAG | Kpn I |
| | Reverse | AAAAAACTGCAG-TTATTGCTTCATCGCGTTGGTCAAGGC | Pst I |
| 281 | Forward | AAAAAAGAATTC-GCACCCGTCGGCGTATTCCTCGTCATGCG | Eco RI |
| | Reverse | AAAAAATCTAGA-GGTCAGAATGCCGCCTTCTTTGCCGAG | Xba I |
| 281a | Forward | AAAAAAGAATTC-TCCTACCACATCGAAATTCCTTCCGG | Eco RI |
| | Reverse | AAAAAATCTAGA-GGTCAGAATGCCGCCTTCTTTGCCGAG | Xba I |
| 282 | Forward | AAAAAAGAATTC-CTTTACCTTGACCTGACCAACGGGCACAG | Eco RI |
| | Reverse | AAAAAACTGCAG-TCAACCTGCCAGTTGCGGGAATATCGT | Pst I |
| 283 | Forward | CGCGGATCCCATATG-GCCGTCTTTACTTGGAAG | BamHI-NdeI |
| | Reverse | CCCGCTCGAG-ACGGCAGTATTTGTTTACG | XhoI |
| 284 | Forward | CGCGGATCCCATATG-TTTGCCTGCAAAAGAATCG | BamHI-NdeI |
| | Reverse | CCCGCTCGAG-CCGACTTTGCAAAAAACTG | XhoI |
| 286 | Forward | CGCGGATCCCATATG-GCCGACCTTTCCGAAAA | BamHI-NdeI |
| | Reverse | CCCGCTCGAG-GAAGCGCGTTCCCAAG | XhoI |
| 287 | Forward | CCGGAATTCTAGCTAGC-CTTTCAGCCTGCGGG | EcoRI-NheI |
| | Reverse | CCCGCTCGAG-ATCCTGCTCTTTTTTGCC | XhoI |
| 288 | Forward | CGCGGATCCCATATG-CACACCGGACAGG | BamHI-NdeI |
| | Reverse | CCCGCTCGAG-CGTATCAAAGACTTGCGT | XhoI |
| 290 | Forward | CGCGGATCCCATATG-GCGGTTTGGGGCGGA | BamHI-NdeI |
| | Reverse | CCCGCTCGAG-TCGGCGCGGCGGGC | XhoI |
| 292 | Forward | CGCGGATCCCATATG-TGCGGGCAAACGCCC | BamHI-NdeI |
| | Reverse | CCCGCTCGAG-TTGATTTTTGCGGATGATTT | XhoI |
| 294 | Forward | AAAAAAGAATTC-GTCTGGTCGATTCGGGTTGTCAGAAC | Eco RI |
| | Reverse | AAAAAACTGCAG-TTACCAGCTGATATAAAACATCGCTTT | Pst I |
| 295 | Forward | CGCGGATCCCATATG-AACCGGCCGGCCTCC | BamHI-NdeI |
| | Reverse | CCCGCTCGAG-CGATATTTGATTCCGTTGC | XhoI |
| 297 | Forward | AAAAAAGAATTC-GCATACATTGCTTCGACAGAGAG | Eco RI |
| | Reverse | AAAAAACTGCAG-TCAATCCGATTGCGACACGGT | Pst I |
| 298 | Forward | AAAAAAGAATTC-CTGATTGCCGTGTGGTTCAGCCAAAACCC | Eco RI |
| | Reverse | AAAAAACTGCAG-TCATGGCTGTGTACTTGATGGTTGCGT | Pst I |
| 299 | Forward | CGCGGATCCGCTAGC-CTACCTGTCGCCTCCG | BamHI-NheI |
| | Reverse | CCCGCTCGAG-TTGCCTGATTGCAGCGG | XhoI |
| 302 | Forward | AAAAAAGAATTC-ATGAGTCAAACCGATACGCAACG | Eco RI |
| | Reverse | AAAAAACTGCAG-TTAAGGTGCGGGATAGAATGTGGGCGC | Pst I |
| 305 | Forward | AAAAAAGGTACC-GAATTTTTACCGATTTCCAGCACCGGA | Kpn I |
| | Reverse | AAAAAACTGCAG-TCATTCCCAACTTATCCAGCCTGACAG | Pst I |
| 305a | Forward | AAAAAAGGTACC-TCCCGTTCGGGCAGTACGATTATGGG | Kpn I |
| | Reverse | AAAAAACTGCAG-TTACAAACCGACATCATGCAGGGTGAA | Pst I |
| 306 | Forward | CGCGGATCCCATATG-TTTATGAACAAATTTTCCC | BamHI-NdeI |
| | Reverse | CCCGCTCGAG-CCGCATCGGCAGAC | XhoI |
| 308 | Forward | CGCGGATCCCATATG-TTAAATCGGGTATTTTATC | BamHI-NdeI |
| | Reverse | CCCGCTCGAG-ATCCGCCATTCCCTGC | XhoI |
| 311 | Forward | AAAAAAGGTACC-ATGTTCAGTTTTGGCTGGGTGTTT | Kpn I |
| | Reverse | AAACTGCAG-ATGTTCATATTCCCTGCCTTCGGC | Pst I |
| 312 | Forward | AAAAAAGGTACC-ATGAGTATCCCATCCGGCGAAATT | Kpn I |
| | Reverse | AAACTGCAG-TCAGTTTTTCATCGATTGAACCGG | Pst I |
| 313 | Forward | AAAAAAGAATTC-ATGGACGACCCGCGCACCTACGGATC | Eco RI |
| | Reverse | AAAAAACTGCAG-TCAGCGGCTGCCGCCGATTTTGCT | Pst I |
| 401 | Forward | CGCGGATCCCATATG-AAGGCGGCAACACAGC | BamHI-NdeI |
| | Reverse | CCCGCTCGAG-CCTTACGTTTTTCAAAGCC | XhoI |
| 402 | Forward | AAAAAAGAATTC-GTGCCTCAGGCATTTTCATTTACCCTTGC | Eco RI |
| | Reverse | AAAAAATCTAGA-TTAAATCCCTCTGCCGTATTTGTATTC | Xba I |
| 402a | Forward | AAAAAAGAATTC-AGGCTGATTGAAAACAAACACGG | Eco RI |
| | Reverse | AAAAAATCTAGA-TTAAATCCCTCTGCCGTATTTGTATTC | Xba I |
| 406 | Forward | CGCGGATCCCATATG-TGCGGGACACTGACAG | BamHI-NdeI |
| | Reverse | CCCGCTCGAG-AGGTTGTCCTTGTCTATG | XhoI |
| 501 | Forward | CGCGGATCCCATATG-GCAGGCGGAGATGGC | BamHI-NdeI |
| | Reverse | CCCGCTCGAG-GGTGTGATGTTCACCC | XhoI |

TABLE 7-continued

Oligonucleotides used for PCR to amplify complete or partial ORFs

| ORF | primer | Sequence | Restriction sites |
|---|---|---|---|
| 502 | Forward | CGCGGATCCCATATG-GTAGACGCGCTTAAGCA | BamHI-NdeI |
| | Reverse | CCCGCTCGAG-AGCTGCATGGCGGCG | XhoI |
| 503 | Forward | CGCGGATCCCATATG-TGTTCGGGGAAAGGCG | BamHI-NdeI |
| | Reverse | CCCGCTCGAG-CCGCGCATTCCTCGCA | XhoI |
| 504 | Forward | CGCGGATCCCATATG-AGCGATATTGAAGTGACG | BamHI-NdeI |
| | Reverse | GCCCAAGCTT-TGATTCAAGTCCTTGCCG | HindIII |
| 505 | Forward | CGCGGATCCCATATG-TTTCGTTTACAATTCAGG | BamHI-NdeI |
| | Reverse | CCCGCTCGAG-CGGCGTTTTATAGCGG | XhoI |
| 510 | Forward | CGCGGATCCCATATG-CCTTCGCGGACAC | BamHI-NdeI |
| | Reverse | CCCGCTCGAG-GCGCACTGGCAGCG | XhoI |
| 512 | Forward | CGCGGATCCCATATG-GGACATGAAGTAACGGT | BamHI-NdeI |
| | Reverse | CCCGCTCGAG-AGGAATAGCCTTTGACG | XhoI |
| 515 | Forward | CGCGGATCCCATATG-GAGGAAATAGCCTTCGA | BamHI-NdeI |
| | Reverse | CCCGCTCGAG-AAATGCCGCAAAGCATC | XhoI |
| 516 | Forward | CGCGGATCCCATATG-TGTACGTTGATGTTGTGG | BamHI-NdeI |
| | Reverse | CCCGCTCGAG-TTTGCGGGCGGCATC | XhoI |
| 517 | Forward | CGCGGATCCCATATG-GGTAAAGGTGTGGAAATA | BamHI-NdeI |
| | Reverse | CCCGCTCGAG-GTGCGCCCAGCCGT | XhoI |
| 518 | Forward | AAAGAATTC-GCTTTTTTACTGCTCCGACCGGAAGG | Eco RI |
| | Reverse | AAACTGCAG-TCAAATTTCAGACTCTGCCAC | Pst I |
| 519 | Forward | CGCGGATCCCATATG-TTCAAATCCTTTGTCGTCA | BamHI-NdeI |
| | Reverse | CCCGCTCGAG-TTTGGCGGTTTTGCTGC | XhoI |
| 520 | Forward | CGCGGATCCCATATG-CCTGCGCTTCTTTCA | BamHI-NdeI |
| | Reverse | CCCGCTCGAG-ATATTTACATTTCAGTCGGC | XhoI |
| 521 | Forward | CGCGGATCCCATATG-GCCAAAATCTATACCTGC | BamHI-NdeI |
| | Reverse | CCCGCTCGAG-CATACGCCCCAGTTCC | XhoI |
| 522 | Forward | CGCGGATCCCATATG-ACTGAGCCGAAACAC | BamHI-NdeI |
| | Reverse | GCCCAAGCTT-TTCTGATTTCAAATCGGCA | HindIII |
| 523 | Forward | CGCGGATCCCATATG-GCTCTGCTTTCCGCG | BamHI-NdeI |
| | Reverse | CCCGCTCGAG-AGGGTGTGTGATAATAAGAAG | XhoI |
| 525 | Forward | CGCGGATCCCATATG-GCCGAAATGGTTCAAATC | BamHI-NdeI |
| | Reverse | CCCGCTCGAG-GCCCGTGCATATCATAAA | XhoI |
| 527 | Forward | AAAGAATTC-TTCCCTCAATGTTGCCGTTTTCG | Eco RI |
| | Reverse | AAACTGCAG-TTATGCTAAACTCGAAACAAATTC | Pst I |
| 529 | Forward | CGCGGATCCGCTAGC-TGCTCCGGCAGCAAAAC | BamHI-NheI |
| | Reverse | GCCCAAGCTT-ACGCAGTTCGGAATGGAG | HindIII |
| 530 | Forward | CGCGGATCCCATATG-AGTGCGAGCGCGG | BamHI-NdeI |
| | Reverse | CCCGCTCGAG-ACGACCGACTGATTCCG | XhoI |
| 531 | Forward | AAAAAAGAATTC-TATGCCGCCGCCTACCAAATCTACGG | Eco RI |
| | Reverse | AAAAAACTGCAG-TTAAAACAGCGCCGTGCCGACGACAAG | Pst I |
| 532 | Forward | AAAAAAGAATTC-ATGAGCGGTCAGTTGGGCAAAGGTGC | Eco RI |
| | Reverse | AAAAAACTGCAG-TCAGTGTTCCAAGTGGTCGGTATCAAA | Pst I |
| 532a | Forward | AAAAAAGAATTC-TTGGGTGTCGCGTTTGAGCCGGAAGT | Eco RI |
| | Reverse | AAAAAACTGCAG-TCAGTGTTCCAAGTGGTCGGTATCAAA | Pst I |
| 535 | Forward | AAAGAATTC-ATGCCCTTTCCCGTTTTCAGAC | Eco RI |
| | Reverse | AAACTGCAG-TCAGACGACCCCGCCTTCCCC | Pst I |
| 537 | Forward | CGCGGATCCCATATG-CATACCCAAAACCAATCC | BamHI-NdeI |
| | Reverse | CCCGCTCGAG-ATCCTGCAAATAAAGGGTT | XhoI |
| 538 | Forward | CGCGGATCCCATATG-GTCGAGCTGGTCAAAGC | BamHI-NdeI |
| | Reverse | CCCGCTCGAG-TGGCATTTCGGTTTCGTC | XhoI |
| 539 | Forward | CGCGGATCCGCTAGC-GAGGATTTGCAGGAAA | BamHI-NheI |
| | Reverse | CCCGCTCGAG-TACCAATGTCGGCAAATC | XhoI |
| 542 | Forward | AAAGAATTC-ATGCCGTCTGAAACCGTGTC | Eco RI |
| | Reverse | AAACTGCAG-TTACCGCGAACCGGTCAGGAT | Pst I |

TABLE 7-continued

Oligonucleotides used for PCR to amplify complete or partial ORFs

| ORF | primer | Sequence | Restriction sites |
|---|---|---|---|
| 543 | Forward | AAAAAAGAATTC-GCCTTCGATGGCGACGTTGTAGGTAC | Eco RI |
| | Reverse | AAAAAATCTAGA-TTAATGAAGAAGAACATATTGGAATTTTGG | Xba I |
| 543a | Forward | AAAAAAGAATTC-GGCAAAACTCGTCATGAATTTGC | Eco RI |
| | Reverse | AAAAAATCTAGA-TTAATGAAGAAGAACATATTGGAATTTTGG | Xba I |
| 544 | Forward | AAAGAATTC-GCGCCCGCCTTCTCCCTGCCCGACCTGCACGG | Eco RI |
| | Reverse | AAACTGCAG-CTATTGCGCCACGCGCGTATCGAT | Pst I |
| 544a | Forward | AAAAAAGAATTC-GCAAATGACTATAAAAACAAAAACTTCCAAGTACTTGC | Eco RI |
| | Reverse | AAACTGCAG-CTATTGCGCCACGCGCGTATCGAT | Pst I |
| 547 | Forward | AAAGAATTC-ATGTTCGTAGATAACGGATTTAATAAAAC | Eco RI |
| | Reverse | AAACTGCAG-TTAACAACAAAAAACAAACCGCTT | Pst I |
| 548 | Forward | AAAGAATTC-GCCTGCAAACCTCAAGACAACAGTGCGGC | Eco RI |
| | Reverse | AAACTGCAG-TCAGAGCAGGGTCCTTACATCGGC | Pst I |
| 550 | Forward | AAAAAAGTCGAC-ATGATAACGGACAGGTTTCATCTCTTTCATTTTCC | Sal I |
| | Reverse | AAACTGCAG-TTACGCAAACGCTGCAAAATCCCC | Pst I |
| 550a | Forward | AAAAAAGAATTC-GTAAATCACGCCTTTGGAGTCGCAAACGG | Eco RI |
| | Reverse | AAACTGCAG-TTACGCAAACGCTGCAAAATCCCC | Pst I |
| 552 | Forward | AAAAAAGAATTC-TTGGCGCGTTGGCTGGATAC | Eco RI |
| | Reverse | AAACTGCAG-TTATTTCTGATGCCTTTTCCCAAC | Pst I |
| 554 | Forward | CGCGGATCCCATATG-TCGCCCGCGCCCAAC | BamHI-NdeI |
| | Reverse | CCCGCTCGAG-CTGCCCTGTCAGACAC | XhoI |
| 556 | Forward | AAAGAATTC-GCGGGCGGTTTTGTTTGGACATCCCG | Eco RI |
| | Reverse | AAACTGCAG-TTAACGGTGCGGACGTTTCTGACC | Pst I |
| 557 | Forward | CGCGGATCCCATATG-TGCGGTTTCCACCTGAA | BamHI-NdeI |
| | Reverse | CCCGCTCGAG-TTCCGCCTTCAGAAAGG | XhoI |
| 558 | Forward | AAAGAATTC-GAGCTTTATATGTTTCAACAGGGGACGGC | Eco RI |
| | Reverse | AAACTGCAG-CTAAACAATGCCGTCTGAAAGTGGAGA | Pst I |
| 558a | Forward | AAAAAAGAATTC-ATTAGATTCTATCGCCATAAACAGACGGG | Eco RI |
| | Reverse | AAAAAACTGCAG-CTAAACAATGCCGTCTGAAAGTGGAGA | Pst I |
| 560 | Forward | AAAAAAGAATTC-TCGCCTTTCCGGGACGGGGCGCACAAGATGGC | Eco RI |
| | Reverse | AAAAAACTGCAG-TCATGCGGTTTCAGACGGCATTTTGGC | Pst I |
| 561 | Forward | CCGGAATTCTACATATG-ATACTGCCAGCCCGT | EcoRI-NdeI |
| | Reverse | CCCGCTCGAG-TTTCAAGCTTTCTTCAGATG | XhoI |
| 562 | Forward | CGCGGATCCCATATG-GCAAGCCCGTCGAG | BamHI-NdeI |
| | Reverse | CCCGCTCGAG-AGACCAACTCCAACTCGT | XhoI |
| 565 | Forward | CGCGGATCCCATATG-AAGTCGAGCGCGAAATAC | BamHI-NdeI |
| | Reverse | CCCGCTCGAG-GGCATTGATCGGCGGC | XhoI |
| 566 | Forward | CGCGGATCCCATATG-GTCGGTGGCGAAGAGG | BamHI-NdeI |
| | Reverse | CCCGCTCGAG-CGCATGGGCGAAGTCA | XhoI |
| 567 | Forward | CCGGAATTCTACATATG-AGTGCGAACATCCTTG | EcoRI-NdeI |
| | Reverse | CCCGCTCGAG-TTTCCCCGACACCCTCG | XhoI |
| 568 | Forward | CGCGGATCCCATATG-CTCAGGGTCAGACC | BamHI-NdeI |
| | Reverse | CCCGCTCGAG-CGGCGCGGCGTTCAG | XhoI |
| 569 | Forward | AAAAAAGAATTC-CTGATTGCCTTGTGGGAATATGCCCG | Eco RI |
| | Reverse | AAAAAACTGCAG-TTATGCATAGACGCTGATAACGGCAAT | Pst I |
| 570 | Forward | CGCGGATCCCATATG-GACACCTTCCAAAAAATCG | BamHI-NdeI |
| | Reverse | CCCGCTCGAG-GCGGGCGTTCATTTCTTT | XhoI |
| 571 | Forward | AAAAAAGAATTC-ATGGGTATTGCCGGCGCCGTAAATGTTTTGAACCC | Eco RI |
| | Reverse | AAAAAACTGCAG-TTATGGCCGACGCGCGGCTACCTGACG | Pst I |
| 572 | Forward | CGCGGATCCCATATG-GCGCAAAAAGGCAAAACC | BamHI-NdeI |
| | Reverse | CCCGCTCGAG-GCGCAGTGTGCCGATA | XhoI |
| 573 | Forward | CGCGGATCCCATATG-CCCTGTTTGTGCCG | BamHI-NdeI |
| | Reverse | CCCGCTCGAG-GACGGTGTCATTTCGCC | XhoI |
| 574 | Forward | CGCGGATCCCATATG-TGGTTTGCCGCCCGC | BamHI-NdeI |
| | Reverse | CCCGCTCGAG-AACTTCGATTTTATTCGGG | XhoI |

TABLE 7-continued

Oligonucleotides used for PCR to amplify complete or partial ORFs

| ORF | primer | Sequence | Restriction sites |
|---|---|---|---|
| 575 | Forward | CGCGGATCCCATATG-GTTTCGGGCGAGG | BamHI-NdeI |
| | Reverse | CCCGCTCGAG-CATTCCGAATCTGAACAG | XhoI |
| 576 | Forward | CGCGGATCCCATATG-GCCGCCCCCGCATCT | BamHI-NdeI |
| | Reverse | CCCGCTCGAG-ATTTACTTTTTTGATGTCGAC | XhoI |
| 577 | Forward | CGCGGATCCCATATG-GAAAGGAACGGTGTATTT | BamHI-NdeI |
| | Reverse | CCCGCTCGAG-AGGCTGTTTGGTAGATTCG | XhoI |
| 578 | Forward | CGCGGATCCCATATG-AGAAGGTTCGTACAG | BamHI-NdeI |
| | Reverse | CCCGCTCGAG-GCCAACGCCTCCACG | XhoI |
| 579 | Forward | CGCGGATCCCATATG-AGATTGGGCGTTTCCAC | BamHI-NdeI |
| | Reverse | CCCGCTCGAG-AGAATTGATGATGTGTATGT | XhoI |
| 580 | Forward | CGCGGATCCCATATG-AGGCAGACTTCGCCGA | BamHI-NdeI |
| | Reverse | CCCGCTCGAG-CACTTCCCCCGAAGTG | XhoI |
| 581 | Forward | CGCGGATCCCATATG-CACTTCGCCCAGC | BamHI-NdeI |
| | Reverse | CCCGCTCGAG-CGCCGTTTGGCTTTGG | XhoI |
| 582 | Forward | AAAAAAGAATTC-TTTGGAGAGACCGCGCTGCAATGCGC | Eco RI |
| | Reverse | AAAAAATCTAGA-TCAGATGCCGTCCCAGTCGTTGAA | Xba I |
| 583 | Forward | AAAAAAGAATTC-ACTGCCGGCAATCGACTGCATAATCG | Eco RI |
| | Reverse | AAAAAACTGCAG-TTAACGGAGGTCAATATGATGAAATTG | Pst I |
| 584 | Forward | AAAAAAGAATTC-GCGGCTGAAGCATTGAATTACAATATTGTC | Eco RI |
| | Reverse | AAAAAACTGCAG-TCAGAACTGAACCGTCCCATTGACGCT | Pst I |
| 585 | Forward | AAAAAAGGTACC-TCTTTCTGGCTGGTGCAGAACACCCTTGC | Eco RI |
| | Reverse | AAAAAACTGCAG-TCAGTTCGCACTTTTTTCTGTTTTGGA | Pst I |
| 586 | Forward | CGCGGATCCCATATG-GCAGCCCATCTCG | BamHI-NdeI |
| | Reverse | CCCGCTCGAG-TTTCAGCGAATCAAGTTTC | XhoI |
| 587 | Forward | CGCGGATCCCATATG-GACCTGCCCTTGACGA | BamHI-NdeI |
| | Reverse | CCCGCTCGAG-AAATGTATGCTGTACGCC | XhoI |
| 588 | Forward | AAAAAAGAATTC-GCCGTCCTGACTTCCTATCAAGAACCAGG | Eco RI |
| | Reverse | AAAAAACTGCAG-TTATTTGTTTTTGGGCAGTTTCACTTC | Pst I |
| 589 | Forward | AAAAAAGAATTC-ATGCAACAAAAAATCCGTTTCCAAATCGAAGG | Eco RI |
| | Reverse | AAAAAACTGCAG-CTAATCGATTTTTACCCGTTTCAGGCG | Pst I |
| 590 | Forward | AAAAAAGAATTC-ATGAAAAAACCTTTGATTTCAGTTGCGGC | Eco RI |
| | Reverse | AAAAAACTGCAG-TTACTGCTGCGGCTCTGAAACCAT | Pst I |
| 591 | Forward | AAAAAAGAATTC-CACTACATCGTTGCCAGATTGTGCGG | Eco RI |
| | Reverse | AAAAAACTGCAG-CTAACCGAGCAGCCGGGTAACGTCGTT | Pst I |
| 592a | Forward | AAAAAAGAATTC-CGCGATTACACCGCCAAGCTGAAAATGGG | Eco RI |
| | Reverse | AAAAAACTGCAG-TTACCAAACGTCGGATTTGATACG | Pst I |
| 593 | Forward | CGCGGATCCGCTAGC-CTTGAACTGAACGGACTC | BamHI-NheI |
| | Reverse | CCCGCTCGAG-GCGGAAGCGGACGATT | XhoI |
| 594a | Forward | AAAAAAGAATTC-GGTAAGTTCGCCGTTCAGGCCTTTCA | Eco RI |
| | Reverse | AAAAAACTGCAG-TTACGCCGCCGTTTCCTGACACTCGCG | Pst I |
| 595 | Forward | AAAAAAGAATTC-TGCCAGCCGCCGGAGGCGGAGAAAGC | Eco RI |
| | Reverse | AAAAAACTGCAG-TTATTTCAAGCCGAGTATGCCGCG | Pst I |
| 596 | Forward | CGCGGATCCCATATG-TCCCAACAATACGTC | BamHI-NdeI |
| | Reverse | CCCGCTCGAG-ACGCGTTACCGGTTTGT | XhoI |
| 597 | Forward | CGCGGATCCCATATG-CTGCTTCATGTCAGC | BamHI-NdeI |
| | Reverse | GCCCAAGCTT-ACGTATCCAGCTCGAAG | HindIII |
| 601 | Forward | CGCGGATCCCATATG-ATATGTTCCCAACCGGCAAT | BamHI-NdeI |
| | Reverse | CCCGCTCGAG-AAAACAATCCTCAGGCAC | XhoI |
| 602 | Forward | CGCGGATCCGCTAGC-TTGCTCCATCAATGC | BamHI-NheI |
| | Reverse | CCCGCTCGAG-ATGCAGCTGCTAAAAGCG | XhoI |
| 603 | Forward | AAAAAAGAATTC-CTGTCCTCGCGTAGGCGGGGACGGGG | Eco RI |
| | Reverse | AAAAAACTGCAG-CTACAAGATGCCGGCAAGTTCGGC | Pst I |
| 604 | Forward | CGCGGATCCGCTAGC-CCCGAAGCGCACTT | BamHI-NheI |
| | Reverse | CCCGCTCGAG-GACGGCATCTGCACGG | XhoI |
| 606a | Forward | AAAAAAGAATTC-CGCGAATACCGCGCCGATGCGGGCGC | Eco RI |
| | Reverse | AAAAAACTGCAG-TTAAAGCGATTTGAGGCGGGCGATACG | Pst I |

TABLE 7-continued

Oligonucleotides used for PCR to amplify complete or partial ORFs

| ORF | primer | Sequence | Restriction sites |
|---|---|---|---|
| 607 | Forward | AAAAAAGAATTC-ATGCTGCTCGACCTCAACCGCTTTTC | Eco RI |
| | Reverse | AAAAAACTGCAG-TCAGACGGCCTTATGCGATCTGAC | Pst I |
| 608 | Forward | AAAAAAGAATTC-ATGTCCGCCCTCCTCCCCATCATCAACCG | Eco RI |
| | Reverse | AAAAAACTGCAG-TTAGTCTATCCAAATGTCGCGTTC | Pst I |
| 609 | Forward | CGCGGATCCCATATG-GTTGTGGATAGACTCG | BamHI-NdeI |
| | Reverse | CCCGCTCGAG-CTGGATTATGATGTCTGTC | XhoI |
| 610 | Forward | CGCGGATCCCATATG-ATTGGAGGGCTTATGCA | BamHI-NdeI |
| | Reverse | CCCGCTCGAG-ACGCTTCAACATCTTTGCC | XhoI |
| 611 | Forward | CGCGGATCCCATATG-CCGTCTCAAAACGGG | BamHI-NdeI |
| | Reverse | CCCGCTCGAG-AACGACTTTGAACGCGCAA | XhoI |
| 613 | Forward | CGCGGATCCCATATG-TCGCGTTCGAGCCG3 | BamHI-NdeI |
| | Reverse | CCCGCTCGAG-AGCCTGTAAAATAAGCGGC | XhoI |
| 614 | Forward | CGCGGATCCCATATG-TCCGTCGTGAGCGGC | BamHI-NdeI |
| | Reverse | CCCGCTCGAG-CCATACTGCGGCGTTC | XhoI |
| 616 | Forward | AAAAAAGAATTC-ATGTCAAACACAATCAAAATGGTTGTCGG | Eco RI |
| | Reverse | AAAAAATCTAGA-TTAGTCCGGGCGGCAGGCAGCTCG | Xba I |
| 619a | Forward | AAAAAAGAATTC-GGGCTTCTCGCCGCCTCGCTTGC | Eco RI |
| | Reverse | AAAAAACTGCAG-TCATTTTTTGTGTTTTAAAACGAGATA | Pst I |
| 622 | Forward | CGCGGATCCCATATG-GCCGCCCTGCCTAAAG | BamHI-NdeI |
| | Reverse | CCCGCTCGAG-TTTGTCCAAATGATAAATCTG | XhoI |
| 624 | Forward | CGCGGATCCCATATG-TCCCCGCGCTTTTACCG | BamHI-NdeI |
| | Reverse | CCCGCTCGAG-AGATTCGGGCCTGCGC | XhoI |
| 625 | Forward | CGCGGATCCCATATG-TTTGCAACCAGGAAAATG | BamHI-NdeI |
| | Reverse | CCCGCTCGAG-CGGCAAAATTACCGCCTT | XhoI |
| 627a | Forward | AAAAAAGAATTC-AAAGCAGGCGAGGCAGGCGCGCTGGG | Eco RI |
| | Reverse | AAAAAACTGCAG-TTACGAATGAAACAGGGTACCCGTCATCAAGGC | Pst I |
| 628 | Forward | AAAAAAGGTACC-GCCTTACAAACATGGATTTTGCGTTC | Kpn I |
| | Reverse | AAAAAACTGCAG-CTACGCACCTGAAGCGCTGGCAAA | Pst I |
| 629a | Forward | AAAAAAGAATTC-GCCACCTTTATCGCGTATGAAAACGA | Eco RI |
| | Reverse | AAAAAACTGCAG-TTACAACACCGCCGTCCGGTTCAAACC | Pst I |
| 630a | Forward | AAAAAAGAATTC-GCGGCTTTGGGTATTTCTTTCGG | Eco RI |
| | Reverse | AAAAAACTGCAG-TTAGGAGACTTCGCCAATGGAGCCGGG | Pst I |
| 635 | Forward | AAAAAAGAATTC-ATGACCCAGCGACGGGTCGGCAAGCAAAACCG | Eco RI |
| | Reverse | AAAAAACTGCAG-TTAATCCACTATAATCCTGTTGCT | Pst I |
| 638 | Forward | AAAAAAGAATTC-ATGATTGGCGAAAAGTTTATCGTAGTTGG | Eco RI |
| | Reverse | AAAAAACTGCAG-TCACGAACCGATTATGCTGATCGG | Pst I |
| 639 | Forward | CGCGGATCCCATATG-ATGCTTTATTTTGTTCG | BamHI-NdeI |
| | Reverse | CCCGCTCGAG-ATCGCGGCTGCCGAC | XhoI |
| 642 | Forward | CGCGGATCCCATATG-CGGTATCCGCCGCAAT | BamHI-NdeI |
| | Reverse | CCCGCTCGAG-AGGATTGCGGGGCATTA | XhoI |
| 643 | Forward | CGCGGATCCCATATG-GCTTCGCCGTCGGCAG | BamHI-NdeI |
| | Reverse | CCCGCTCGAG-AACCGAAAAACAGACCGC | XhoI |
| 644 | Forward | AAAAAAGAATTC-ATGCCGTCTGAAAGGTCGGCGGATTGTTGCCC | Eco RI |
| | Reverse | AAAAAATCTAGA-CTACCCGCAATATCGGCAGTCCAATAT | Pst I |
| 645 | Forward | AAAAAAGAATTC-GTGGAACAGAGCAACACGTTAAATCG | Eco RI |
| | Reverse | AAAAAACTGCAG-CTACGAGGAAACCGAAGACCAGGCCGC | Pst I |
| 647 | Forward | AAAAAAGAATTC-ATGCAAAGGCTCGCCGCAGACGG | Eco RI |
| | Reverse | AAAAAACTGCAG-TTAGATTATCAGGGATATCCGGTAGAA | Pst I |
| 648 | Forward | AAAAAAGAATTC-ATGAACAGGCGCGACGCGCGGATCGAACG | Eco RI |
| | Reverse | AAAAAACTGCAG-TCAAGCTGTGTGCTGATTGAATGCGAC | Pst I |
| 649 | Forward | AAAAAAGAATTC-GGTACGTCAGAACCCGCCCACCG | Eco RI |
| | Reverse | AAAAAACTGCAG-TTAACGGCGGAAACTGCCGCCGTC | Pst I |
| 650 | Forward | AAAAAAGAATTC-ATGTCCAAACTCAAAACCATCGC | Eco RI |
| | Reverse | AAAAAACTGCAG-TCAGACGGCATGGCGGTCTGTTTT | Pst I |
| 652 | Forward | AAAAAAGGTACC-GCTGCCGAAGACTCAGGCCTGCCGCTTTACCG | Kpn I |
| | Reverse | AAAAAACTGCAG-TTATTTGCCCAGTTGGTAGAATGCGGC | Pst I |
| 653 | Forward | AAAAAAGAATTC-GCGGCTTTGCCGGTAATTTTCATCGG | Eco RI |
| | Reverse | AAAAAACTGCAG-CTATGCCGGTCTGGTTGCCGGCGGCGA | Pst I |

TABLE 7-continued

Oligonucleotides used for PCR to amplify complete or partial ORFs

| ORF | primer | Sequence | Restriction sites |
|---|---|---|---|
| 656a | Forward | AAAAAAGAATTC-CGGCCGACGTCGTTGCGTCCTAAGTC | Eco RI |
| | Reverse | AAAAAACTGCAG-CTACGATTTCGGCGATTTCCACATCGT | Pst I |
| 657 | Forward | AAAAAAGAATTC-GCAGAATTTGCCGACCGCCATTTGTGCGC | Eco RI |
| | Reverse | AAAAAACTGCAG-TTATAGGGACTGATGCAGTTTTTTTGC | Pst I |
| 658 | Forward | CGCGGATCCCATATG-GTGTCCGGAATTGTG | BamHI-NdeI |
| | Reverse | CCCGCTCGAG-GGCAGAATGTTTACCGTT | XhoI |
| 661 | Forward | AAAAAAGAATTC-ATGCACATCGGCGGCTATTTTATCGACAACCC | Eco RI |
| | Reverse | AAAAAACTGCAG-TCACGACGTGTCTGTTCGCCGTCGGGC | Pst I |
| 663 | Forward | CGCGGATCCCATATG-TGTATCGAGATGAAATT | BamHI-NdeI |
| | Reverse | CCCGCTCGAG-GTAAAAATCGGGGCTGC | XhoI |
| 664 | Forward | CGCGGATCCCATATG-GCGGCTGGCGCGGT | BamHI-NdeI |
| | Reverse | CCCGCTCGAG-AAATCGAGTTTTACACCAC | XhoI |
| 665 | Forward | AAAAAAGAATTC-ATGAAATGGGACGAAACGCGCTTCGG | Eco RI |
| | Reverse | AAAAAACTGCAG-TCAATCCAAAATTTTGCCGACGATTTC | Pst I |
| 666 | Forward | AAAAAAGAATTC-AACTCAGGCGAAGGAGTGCTTGTGGC | Eco RI |
| | Reverse | AAAAAATCTAGA-TCAGTTTAGGGATAGCAGGCGTAC | Xba I |
| 667 | Forward | AAANAAGAATTC-CCGCATCCGTTTGATTTCCATTTCGTATTCGTCCG | Eco RI |
| | Reverse | AAAAAACTGCAG-TTAATGACACAATAGGCGCAAGTC | Pst I |
| 669 | Forward | AAAAAAGAATTC-ATGCGCCGCATCATTAAAAAACACCAGCC | Eco RI |
| | Reverse | AAAAAACTGCAG-TTACAGTATCCGTTTGATGTCGGC | Pst I |
| 670a | Forward | AAAAAAGAATTC-AAAAACGCTTCGGGCGTTTCGTCTTC | Eco RI |
| | Reverse | AAAAAACTGCAG-TTAGGAGCTTTTGGAACGCGTCGGACTGGC | Pst I |
| 671 | Forward | CGCGGATCCCATATG-ACCAGCAGGGTAAC | BamHI-NdeI |
| | Reverse | CCCGCTCGAG-AGCAACTATAAAAACGCAAG | XhoI |
| 672 | Forward | CGCGGATCCCATATG-AGGAAAATCCGCACC | BamHI-NdeI |
| | Reverse | CCCGCTCGAG-ACGGGATAGGCGGTTG | XhoI |
| 673 | Forward | AAAAAAGAATTC-ATGGATATTGAAACCTTCCTTGCAGG | Eco RI |
| | Reverse | AAAAAACTGCAG-CTACAAACCCAGCTCGCGCAGGAA | Pst I |
| 674 | Forward | AAAAAAGAATTC-ATGAAAACAGCCCGCCGCCGTTCCCG | Eco RI |
| | Reverse | AAAAAACTGCAG-TCAACGGCGTTTGGGCTCGTCGGG | Pst I |
| 675 | Forward | CGCGGATCCCATATG-AACACCATCGCCCC | BamHI-NdeI |
| | Reverse | CCCGCTCGAG-TTCTTCGTCTTCAAACTGT | XhoI |
| 677a | Forward | AAAAAAGAATTC-AGACGGCATTCCCGATCAGTCGATTTTGA | Eco RI |
| | Reverse | AAAAAACTGCAG-TTACGTATGCGCGAAATCGACCGCCGC | Pst I |
| 680 | Forward | CGCGGATCCGCTAGC-ACGAAGGGCAGTTCGG | BamHI-NheI |
| | Reverse | CCCGCTCGAG-CATCAAAAACCTGCCGC | XhoI |
| 681 | Forward | AAAAAAGAATTC-ATGACGACGCCGATGGCAATCAGTGC | Eco RI |
| | Reverse | AAAAAACTGCAG-TTACCGTCTTCCGCAAAAAACAGC | Pst I |
| 683 | Forward | CGCGGATCCCATATG-TGCAGCACACCGGACAA | BamHI-NdeI |
| | Reverse | CCCGCTCGAG-GAGTTTTTTTCCGCATACG | XhoI |
| 684 | Forward | CGCGGATCCCATATG-TGCGGTACTGTGCAAAG | BamHI-NdeI |
| | Reverse | CCCGCTCGAG-CTCGACCATCTGTTGCG | XhoI |
| 685 | Forward | CGCGGATCCCATATG-TGTTTGCTTAATAATAAACATT | BamHI-NdeI |
| | Reverse | CCCGCTCGAG-CTTTTTCCCCGCCGCA | XhoI |
| 686 | Forward | CGCGGATCCCATATG-TGCGGCGGTTCGGAAG | BamHI-NdeI |
| | Reverse | CCCGCTCGAG-CATTCCGATTCTGATGAAG | XhoI |
| 687 | Forward | CGCGGATCCCATATG-TGCGACAGCAAAGTCCA | BamHI-NdeI |
| | Reverse | CCCGCTCGAG-CTGCGCGGCTTTTTGTT | XhoI |
| 690 | Forward | CGCGGATCCCATATG-TGTTCTCCGAGCAAAGAC | BamHI-NdeI |
| | Reverse | CCCGCTCGAG-TATTCGCCCCGTGTTTGG | XhoI |
| 691 | Forward | CGCGGATCCCATATG-GCCACGGCTTATATCCC | BamHI-NdeI |
| | Reverse | CCCGCTCGAG-TTTGAGGCAGGAAGAAAG | XhoI |
| 694 | Forward | CGCGGATCCCATATG-TTGGTTTCCGCATCCGG | BamHI-NdeI |
| | Reverse | CCCGCTCGAG-TCTGCGTCGGTGCGGT | XhoI |

TABLE 7-continued

Oligonucleotides used for PCR to amplify complete or partial ORFs

| ORF | primer | Sequence | Restriction sites |
|---|---|---|---|
| 695 | Forward | CGCGGATCCCATATG-TTGCCTCAAACTCGTCCG | BamHI-NdeI |
| | Reverse | CCCGCTCGAG-TCGTTTGCGCACGGCT | XhoI |
| 696 | Forward | CGCGGATCCCATATG-TTGGGTTGCCGGCAGG | BamHI-NdeI |
| | Reverse | CCCGCTCGAG-TTGATTGCCGCAATGATG | XhoI |
| 700a | Forward | AAAAAAGAATTC-GCATCGACAGACGGTGTGTCGTGGAC | Eco RI |
| | Reverse | AAAAAACTGCAG-TTACGCTACCGGCACGACTTCCAAACC | Pst I |
| 701 | Forward | CGCGGATCCCATATG-AAGACTTGTTTGGATACTTC | BamHI-NdeI |
| | Reverse | CCCGCTCGAG-TGCCGACAACAGCCTC | XhoI |
| 702 | Forward | AAAAAAGAATTC-ATGCCGTGTTCCAAAGCCAGTTGGATTTC | Eco RI |
| | Reverse | AAAAAACTGCAG-TTAACCCCATTCCACCCGGAGAACCGA | Pst I |
| 703 | Forward | CGCGGATCCGCTAGC-CAAACGCTGGCAACCG | BamHI-NheI |
| | Reverse | CCCGCTCGAG-TTTTGCAGGTTTGATGTTTG | XhoI |
| 704a | Forward | AAAAAAGAATTC-GCTTCTACCGGTACGCTGGCGCG | Eco RI |
| | Reverse | AAAAAACTGCAG-TTAGTTTTGCCGGATAATATGGCGGGTGCG | Pst I |
| 707 | Forward | CGCGGATCCGCTAGC-GAAATTATTAACGATGCAGA | BamHI-NheI |
| | Reverse | CCCGCTCGAG-GAAACTGTAATTCAAGTTGA | XhoI |
| 708 | Forward | CGCGGATCCGCTAGC-CCTTTTAAGCCATCCAAAA | BamHI-NheI |
| | Reverse | CCCGCTCGAG-TTGACCGGTGAGGACG | XhoI |
| 710 | Forward | CGCGGATCCCATATG-GAAACCCACGAAAAAATC | BamHI-NdeI |
| | Reverse | CCCGCTCGAG-AACGGTTTCGGTCAG | XhoI |
| 714 | Forward | CGCGGATCCCATATG-AGCTATCAAGACATCTT | BamHI-NdeI |
| | Reverse | CCCGCTCGAG-GCGGTAGGTAAATCGGAT | XhoI |
| 716 | Forward | CGCGGATCCCATATG-GCCAACAAACCGGCAAG | BamHI-NdeI |
| | Reverse | CCCGCTCGAG-TTTAGAACCGCATTTGCC | XhoI |
| 718 | Forward | CGCGGATCCCATATG-GAGCCGATAATGGCAAA | BamHI-NdeI |
| | Reverse | CCCGCTCGAG-GGCGCGGGCATGGTCTTGTCC | XhoI |
| 720 | Forward | CGCGGATCCCATATG-AGCGGATGGCATACC | BamHI-NdeI |
| | Reverse | CCCGCTCGAG-TTTTGCATAGCTGTTGACCA | XhoI |
| 723 | Forward | CGCGGATCCCATATG-CGACCCAAGCCCC | BamHI-NdeI |
| | Reverse | CCCGCTCGAG-AATGCGAATCCGCCGCC | XhoI |
| 725 | Forward | CGCGGATCCCATATG-GTGCGCACGGTTAAA | BamHI-NdeI |
| | Reverse | CCCGCTCGAG-TTGCTTATCCTTAAGGGTTA | XhoI |
| 726 | Forward | CGCGGATCCCATATG-ACCATCTATTTCAAAAAC | BamHI-NdeI |
| | Reverse | CCCGCTCGAG-GCCGATGTTTAGCGTCC | XhoI |
| 728 | Forward | CGCGGATCCCATATG-TTTTGGCTGGGAACGGG | BamHI-NdeI |
| | Reverse | CCCGCTCGAG-GTGAGAAAGGTCGCGC | XhoI |
| 729 | Forward | CGCGGATCCCATATG-TGCACCATGATTCCCCA | BamHI-NdeI |
| | Reverse | GCCCAAGCTT-TTTGTCGGTTTGGGTATC | HindIII |
| 731 | Forward | CGCGGATCCGCTAGC-GCCGTGCCGGAGG | BamHI-NheI |
| | Reverse | CCCGCTCGAG-ACGGGCGCGGCAG | XhoI |
| 732 | Forward | CCGGAATTCTACATATG-TCGAAACCTGTTTTTAAGAA | EcoRI-NdeI |
| | Reverse | CCCGCTCGAG-CTTCTTATCTTTTTTATCTTTC | XhoI |
| 733 | Forward | CGCGGATCCCATATG-GCCTGCGGCGGCAA | BamHI-NdeI |
| | Reverse | CCCGCTCGAG-TCGCTTGCCTCCTTTAC | XhoI |
| 734 | Forward | CGCGGATCCCATATG-GCCGATACTTACGGCTAT | BamHI-NdeI |
| | Reverse | CCCGCTCGAG-TTTGAGATTTTGAATCAAAGAG | XhoI |
| 735 | Forward | CGCGGATCCCATATG-AAGCAGCAGGCGGTCA | BamHI-NdeI |
| | Reverse | CCCGCTCGAG-ATTTCCGTAGCCGAGGG | XhoI |
| 737 | Forward | CGCGGATCCCATATG-CACCACGACGGACACG | BamHI-NdeI |
| | Reverse | CCCGCTCGAG-GTCGTCGCGGCGGGA | XhoI |

TABLE 7-continued

Oligonucleotides used for PCR to amplify complete or partial ORFs

| ORF | primer | Sequence | Restriction sites |
|---|---|---|---|
| 739 | Forward | CGCGGATCCCATATG-GCAAAAAAACCGAACA | BamHI-NdeI |
| | Reverse | CCCGCTCGAG-GAAGAGTTTGTCGAGAATT | XhoI |
| 740 | Forward | CGCGGATCCCATATG-GCCAATCCGCCCGAAG | BamHI-NdeI |
| | Reverse | CCCGCTCGAG-AAACGCGCCAAAATAGTG | XhoI |
| 741 | Forward | CGCGGATCCCATATG-TGCAGCAGCGGAGGG | BamHI-NdeI |
| | Reverse | CCCGCTCGAG-TTGCTTGGCGGCAAGGC | XhoI |
| 743 | Forward | CGCGGATCCCATATG-GACGGTGTTGTGCCTGTT | BamHI-NdeI |
| | Reverse | CCCGCTCGAG-CTTACGGATCAAATTGACG | XhoI |
| 745 | Forward | CGCGGATCCCATATG-TTTTGGCAACTGACCG | BamHI-NdeI |
| | Reverse | CCCGCTCGAG-CAAATCAGATGCCTTTAGG | XhoI |
| 746 | Forward | CGCGGATCCCATATG-TCCGAAAACAAACAAAAC | BamHI-NdeI |
| | Reverse | CCCGCTCGAG-TTCATTCGTTACCTGACC | XhoI |
| 747 | Forward | CCGGAATTCTAGCTAGC-CTGACCCCTTGGG | EcoRI-NheI |
| | Reverse | GCCCAAGCTT-TTTTGATTTTAATTGACTATAGAAC | HindIII |
| 749 | Forward | CGCGGATCCCATATG-TGCCAGCCGCCG | BamHI-NdeI |
| | Reverse | CCCGCTCGAG-TTTCAAGCCGAGTATGC | XhoI |
| 750 | Forward | CGCGGATCCCATATG-TGTTCGCCCGAACCTG | BamHI-NdeI |
| | Reverse | CCCGCTCGAG-CTTTTTCCCCGCCGCAA | XhoI |
| 758 | Forward | CGCGGATCCCATATG-AACAATCTGACCGTGTT | BamHI-NdeI |
| | Reverse | CCCGCTCGAG-TGGCTCAATCCTTTCTGC | XhoI |
| 759 | Forward | CGCGGATCCGCTAGC-CGCTTCACACACACCAC | BamHI-NheI |
| | Reverse | CCCGCTCGAG-CCAGTTGTAGCCTATTTTG | XhoI |
| 763 | Forward | CGCGGATCCCATATG-CTGCCTGAAGCATGGCG | BamHI-NdeI |
| | Reverse | CCCGCTCGAG-TTCCGCAAATACCGTTTCC | XhoI |
| 764 | Forward | CGCGGATCCCATATG-TTTTTCTCCGCCCTGA | BamHI-NdeI |
| | Reverse | CCCGCTCGAG-TCGCTCCCTAAAGCTTTC | XhoI |
| 765 | Forward | CGCGGATCCCATATG-TTAAGATGCCGTCCG | BamHI-NdeI |
| | Reverse | CCCGCTCGAG-ACGCCGACGTTTTTTATTAA | XhoI |
| 767 | Forward | CGCGGATCCCATATG-CTGACGGAAGGGGAAG | BamHI-NdeI |
| | Reverse | CCCGCTCGAG-TTTCTGTACAGCAGGGG | XhoI |
| 768 | Forward | CGCGGATCCCATATG-GCCCCGCAAAAACCCG | BamHI-NdeI |
| | Reverse | CCCGCTCGAG-TTTCATCCCTTTTTTGAGC | XhoI |
| 770 | Forward | CGCGGATCCCATATG-TGCGGCAGCGGCGAA | BamHI-NdeI |
| | Reverse | CCCGCTCGAG-GCGTTTGTCGAGATTTTC | XhoI |
| 771 | Forward | CGCGGATCCCATATG-TCCGTATATCGCACCTTC | BamHI-NdeI |
| | Reverse | CCCGCTCGAG-CGGTTCTTTAGGTTTGAG | XhoI |
| 772 | Forward | CGCGGATCCCATATG-TTTGCGGCGTTGGTGG | BamHI-NdeI |
| | Reverse | CCCGCTCGAG-CAATGCCGACATCAAACG | XhoI |
| 774 | Forward | CGCGGATCCCATATG-TCCGTTTCACCCGTTCC | BamHI-NdeI |
| | Reverse | CCCGCTCGAG-TCGTTTGCGCACGGCT | XhoI |
| 790 | Forward | CGCGGATCCCATATG-GCAAGAAGGTCAAAAAC | BamHI-NdeI |
| | Reverse | CCCGCTCGAG-GGCGTTGTTCGGATTTCG | XhoI |
| 900 | Forward | CGCGGATCCCATATG-CCGTCTGAAATGCCG | BamHI-NdeI |
| | Reverse | CCCGCTCGAG-ATATGGAAAAGTCTGTTGTC | XhoI |
| 901 | Forward | CGCGGATCCCATATG-CCCGATTTTTCGATG | BamHI-NdeI |
| | Reverse | CCCGCTCGAG-AAAATGGAACAATACCAGG | XhoI |
| 902 | Forward.2 | CCGGAATTCTACATATG-TTGCACTTTCAAAGGATAATC | EcoRI-NdeI |
| | Reverse | CCCGCTCGAG-AAAAATGTACAATGGCGTAC | XhoI |

TABLE 7-continued

Oligonucleotides used for PCR to amplify complete or partial ORFs

| ORF | primer | Sequence | Restriction sites |
|---|---|---|---|
| 903 | Forward | CCGGAATTCTAGCTAGC-CAGCGTCAGCAGCACAT | EcoRI-NheI |
|  | Reverse | CCCGCTCGAG-GAAACTGTAATTCAAGTTGAA | XhoI |
| 904 | Forward | AAAAAAGGTACC-ATGATGCAGCACAATCGTTTC | Kpn I |
|  | Reverse | AAACTGCAG-TTAATATCGATAGGTTATATG | Pst I |
| 904a | Forward | AAAAAAGAATTC-CGGCTCGGCATTGTGCAGATGTTGCA | Eco RI |
|  | Reverse | AAACTGCAG-TTAATATCGATAGGTTATATG | Pst I |
| 905 | Forward | CGCGGATCCCATATG-AACAAAATATACCGCATC | BamHI-NdeI |
|  | Reverse | CCCGCTCGAG-CCACTGATAACCGACAGAT | XhoI |
| 907 | Forward | CGCGGATCCCATATG-GGCGCGCAACGTGAG | BamHI-NdeI |
|  | Reverse | CCCGCTCGAG-ACGCCACTGCCAGCG | XhoI |
| 908 | Forward | AAAGAATTC-GCAGAGTTAGTAGGCGTTAATAAAAATAC | Eco RI |
|  | Reverse | AAACTGCAG-TTAATATGGTTTTGTCGTTCG | Pst I |
| 909 | Forward | CGCGGATCCCATATG-TGCGCGTGGGAAACTTAT | BamHI-NdeI |
|  | Reverse | CCCGCTCGAG-TCGGTTTTGAAACTTTGGTTTT | XhoI |
| 910 | Forward | AAAGAATTC-GCATTTGCCGGCGACTCTGCCGAGCG | Eco RI |
|  | Reverse | AAACTGCAG-TCAGCGATCGAGCTGCTCTTT | Pst I |
| 911 | Forward | AAAGAATTC-GCTTTCCGCGTGGCCGGCGGTGC | Eco RI |
|  | Reverse | AAAAAACTGCAG-GTCGACTTATTCGGCGGCTTTTTCCGC | Pst I |
| 912 | Forward | AAAAAAGAATTC-CAAATCCGTCAAAACGCCACTCAAGTATTGAG | Eco RI |
|  | Reverse | AAAAAACTGCAG-TTACAGTCCGTCCACGCCTTTCGC | Pst I |
| 913 | Forward | CGCGGATCCCATATG-GAAACCCGCCCCGC | BamHI-NdeI |
|  | Reverse | CCCGCTCGAG-AGGTTGTGTTCCAGGTTG | XhoI |
| 915 | Forward | CGCGGATCCCATATG-TGCCGGCAGGCGGAA | BamHI-NdeI |
|  | Reverse | CCCGCTCGAG-TTTGAAAATATAGGTATCAGG | XhoI |
| 914 | Forward | AAAGAATTC-GACAGAATCGGCGATTTGGAAGCACG | Eco RI |
|  | Reverse | AAACTGCAG-CTATATGCGCGGCAGGACGCTCAACGG | Pst I |
| 916 | Forward | CGCGGATCCCATATG-GCAATGATGGCGGCTG | BamHI-NdeI |
|  | Reverse | CCCGCTCGAG-TTTGGCGGCATCTTTCAT | XhoI |
| 917 | Forward | AAAAAAGAATTC-CCTGCCGAAAAACCGGCACCGGC | Eco RI |
|  | Reverse | AAAAAACTGCAG-TTATTTCCCCGCCTTCACATCCTG | Pst I |
| 919 | Forward | CGCGGATCCCATATG-TGCCAAAGCAAGAGCATC | BamHI-NdeI |
|  | Reverse | CCCGCTCGAG-CGGGCGGTATTCGGG | XhoI |
| 920 | Forward | CGCGGATCCCATATG-CACCGCGTCTGGGTC | BamHI-NdeI |
|  | Reverse | CCCGCTCGAG-ATGGTGCGAATGACCGA | XhoI |
| 921 | Forward | AAAAAAGAATTC-TTGACGGAAATCCCCGTGAATCC | Eco RI |
|  | Reverse | AAAAAACTGCAG-TCATTTCAAGGGCTGCATCTTCAT | Pst I |
| 922 | Forward.2 | CGCGGATCCGCTAGC-TGTACGGCGATGGAGGC | BamHI-NdeI |
|  | Reverse | CCCGCTCGAG-CAATCCCGGGCCGCC | XhoI |
| 923 | Forward | CGCGGATCCCATATG-TGTTACGCAATATTGTCCC | BamHI-NheI |
|  | Reverse | CCCGCTCGAG-GGACAAGGCGACGAAG | XhoI |
| 925 | Forward | CGCGGATCCCATATG-AAACAAATGCTTTTAGCCG | BamHI-NdeI |
|  | Reverse | CCCGCTCGAG-GCCGTTGCATTTGATTTC | XhoI |
| 926 | Forward | CGCGGATCCCATATG-TGCGCGCAATTACCTC | BamHI-NdeI |
|  | Reverse | CCCGCTCGAG-TCTCGTGCGCGCCG | XhoI |
| 927 | Forward | CGCGGATCCCATATG-TGCAGCCCCGCAGC | BamHI-NdeI |
|  | Reverse | CCCGCTCGAG-GTTTTTTGCTGACGTAGT | XhoI |
| 929a | Forward | AAAAAAGAATTC-CGCGGTTTGCTCAAAACAGGGCTGGG | Eco RI |
|  | Reverse | AAAAAATCTAGA-TTAAGAAAGACGGAAACTACTGCC | Xba I |
| 931 | Forward | AAAAAAGAATTC-GCAACCCATGTTTTGATGGAAAC | Eco RI |
|  | Reverse | AAAAAACTGCAG-TTACTGCCCGACAACAACGCGACG | Pst I |
| 935 | Forward | AAAAAAGAATTC-GCGGATGCGCCCGCGATTTTGGATGACAAGGC | Eco RI |
|  | Reverse | AAAAAACTGCAG-TCAAAACCGCCAATCCGCCGACAC | Pst I |
| 936 | Forward | CGCGGATCCCATATG-GCCGCCGTCGGCGC | BamHI-NdeI |
|  | Reverse | CCCGCTCGAG-GCGTTGGACGTAGTTTTG | XhoI |
| 937 | Forward | AAAAAAGAATTC-CCGGTTTACATTCAAACCGGCGCAAC | Eco RI |
|  | Reverse | AAAAAACTGCAG-TTAAAATGTATGCTGTACGCCK&A | Pst I |

TABLE 7-continued

Oligonucleotides used for PCR to amplify complete or partial ORFs

| ORF | primer | Sequence | Restriction sites |
|---|---|---|---|
| 939a | Forward | AAAAAAGAATTC-GGTTCGGCAGCTGTGATGAAACC | Eco RI |
| | Reverse | AAAAAACTGCAG-TTAACGCAAACCTTGGATAAAGTTGGC | Pst I |
| 950 | Forward | CGCGGATCCCATATG-GCCAACAAACCGGCAAG | BamHI-NdeI |
| | Reverse | CCCGCTCGAG-TTTAGAACCGCATTTGCC | XhoI |
| 953 | Forward | CGCGGATCCCATATG-GCCACCTACAAAGTGGAC | BamHI-NdeI |
| | Reverse | CCCGCTCGAG-TTGTTTGGCTGCCTCGAT | XhoI |
| 957 | Forward | CGCGGATCCCATATG-TTTTGGCTGGGAACGGG | BamHI-NdeI |
| | Reverse | CCCGCTCGAG-GTGAGAAAGGTCGCGC | XhoI |
| 958 | Forward | CGCGGATCCCATATG-GCCGATGCCGTTGCG | BamHI-NdeI |
| | Reverse | GCCCAAGCTT-GGGTCGTTTGTTGCGTC | HindIII |
| 959 | Forward | CGCGGATCCCATATG-CACCACGACGGACACG | BamHI-NdeI |
| | Reverse | CCCGCTCGAG-GTCGTCGCGGCGGGA | XhoI |
| 961 | Forward | CGCGGATCCCATATG-GCCACAAGCGACGACG | BamHI-NdeI |
| | Reverse | CCCGCTCGAG-CCACTCGTAATTGACGC | XhoI |
| 972 | Forward | AAAAAAGAATTC-TTGACTAACAGGGGGGGAGCGAAATTAAAAAC | Eco RI |
| | Reverse | AAAAAATCTAGA-TTAAAAATAATCATAATCTACATTTTG | Xba I |
| 973 | Forward | AAAAAAGAATTC-ATGGACGGCGCACAACCGAAAAC | Eco RI |
| | Reverse | AAAAAACTGCAG-TTACTTCACGCGGGTCGCCATCAGCGT | Pst I |
| 982 | Forward | CGCGGATCCCATATG-GCAGCAAAAGACGTAC | BamHI-NdeI |
| | Reverse | CCCGCTCGAG-CATCATGCCGCCCATCC | XhoI |
| 983 | Forward | CGCGGATCCCATATG-TTAGCTGTTGCAACAACAC | BamHI-NdeI |
| | Reverse | CCCGCTCGAG-GAACCGGTAGCCTACG | XhoI |
| 987 | Forward | CGCGGATCCCATATG-CCCCCACTGGAAGAAC | BamHI-NdeI |
| | Reverse | CCCGCTCGAG-TAATAAACCTTCTATGGGC | XhoI |
| 988 | Forward | CGCGGATCCCATATG-TCTTTAAATTTACGGGAAAAAG | BamHI-NdeI |
| | Reverse | GCCCAAGCTT-TGATTTGCCTTTCCGTTTT | HindIII |
| 989 | Forward | CCGGAATTCTACATATG-GTCCACGCATCCGGCTA | EcoRI-NdeI |
| | Reverse | CCCGCTCGAG-TTTGAATTTGTAGGTGTATTGC | XhoI |
| 990 | Forward.2 | CGCGGATCCGCTAGC-TTCAGAGCTCAGCTT | BamHI-NheI |
| | Reverse | CCCGCTCGAG-AAACAGCCATTTGAGCGA | XhoI |
| 992 | Forward | CGCGGATCCCATATG-GACGCGCCCGCCCG | BamHI-NdeI |
| | Reverse | CCCGCTCGAG-CCAAATGCCCAACCATTC | XhoI |
| 993 | Forward | CGCGGATCCCATATG-GCAATGCTGATTGAAATCA | BamHI-NdeI |
| | Reverse | CCCGCTCGAG-GAACACATCGCGCCCG | XhoI |
| 996 | Forward | CGCGGATCCCATATG-TGCGGCAGAAAATCCGC | BamHI-NdeI |
| | Reverse | CCCGCTCGAG-TGTAAACCCCTGTTTTCTC | XhoI |
| 997 | Forward | CCGGAATTCTAGCTAGC-CGGCACGCCGACGTT | EcoRI-NdeI |
| | Reverse | CCCGCTCGAG-GACGGCATCGCTCAGG | XhoI |

Underlined sequences indicate restriction recognition sites.

The following partial DNA sequence was identified in *N. gonorrhoeae* <SEQ ID 1>:

g001.seq

```
  1 ATGCTGCCGC AGGGGAAGGC GGCGCGGAGG GTGTCGGCGA ACGAGGTGTC

 51 CGGCAGGGCT TGCGCCCGGA TGGTGCTGGT CATCTGCCAG ACGCTGCCGA

101 AACGCGATAC TTTAAACGGC TCGGGTACGC ATACTTTACC GGTTTGGGCG
```

-continued

```
151 ATTTTGCCGA GGTCGTTGCG CAGCAAATCG ACAATCATCA CGTTTTCGGC

201 GCGGTTTTTC GGGTCGGTTT GTAACTCGGC GGCGCGGCGT TCGTCTTGTC

251 CGTCGCCCAA AATCGGCGCG GTGCCTTTCA TCGGTTCGGT GCTGATGGTG

301 CCGTCTGAAG CGATGTTGAG GAAGAGTTCG GGCGAGAAAC ACAGCGTCCA

351 CGCGGATTGC CCGGCTTCAT CGGGCAGGTG GGACAATACG GCATAG
```

This corresponds to the amino acid sequence <SEQ ID 2; ORF 001.ng>:

g001.pep

```
  1 MLPQGKAARR VSANEVSGRA CARMVLVICQ TLPKRDTLNG SGTHTLPVWA

 51 ILPRSLRSKS TIITFSARFF GSVCNSAARR SSCPSPKIGA VPFIGSVLMV

101 PSEAMLRKSS GEKHSVHADC PASSGRWDNT A*
```

The following partial DNA sequence was identified in *N. meningitidis* <SEQ ID 3>:

m001.seq

```
  1 ATGCTGCCGC AGGGGAAGGC GGCGCGGAGG ATGTCGGCGA ACGAGGTGTC

 51 CGGcAssCTT ss.GCTTGGA yGGTGCTGGT CATCTGCCAA ACGCTGCCGA

101 AACGCGATAC TTTAAACGGT TCGGGTACGC ATACTGTGCC GGTTTGGGCG

151 ATTTTGCCGA GATCGTTACG CAGCAAATCG ACAATCATCA CGTTTTCGGC

201 GCGGTTTTTC GGGTCTGCTT GCAACTCGGC GGCGCGGCGT TCGTCTTGTC

251 CGTCGCCCAA AATCGGCGCG GTGCCTTTCA TCGGTTCGGT GCTGATGGTG

301 CCGTCCGAAC CGATTTTGAG GAAGAGTTCG GGCGAGAAAC ACAGCGTCCA

351 CGCGGATTGC CCCTCCGCAT CGGGCAGGTG GGACAAGACG GCATAG
```

This corresponds to the amino acid sequence <SEQ ID 4; ORF 001>:

m001.pep

```
  1 MLPQGKAARR MSANEVCGXL XAWXVLVICQ TLPKRDTLNG SGTHTVPVWA

 51 ILPRSLRSKS TIITFSARFF GSACNSAARR SSCPSPKIGA VPFIGSVLMV

101 PSEPILRKSS GEKHSVHADC PSASGRWDKT A*
```

The following partial DNA sequence was identified in *N. meningitidis* <SEQ ID 5>:

a001.seq

```
  1 ATGCTGCCGC AGGGGAAGGC GGCGCGGAGG ATGTCGGCGA ACGAGGTGTG

 51 CGGCAAGGCT TGGGCTTGGA TGGTGCTGGT CATCTGCCAA ACGCTGCCGA

101 AACGCGATAC TTTAAACGGT TCGGGTACGC ATACTGTGCC GGTTTGGGCG

151 ATTTTGCCGA GGTCGTTACG CAGCAAATCG ACAATCATCA CGTTTTCGGC
```

-continued

```
201 GCGGTTTTTC GGGTCTGCTT GCAACTCGGC GGCGCGGCGT TCGTCTTGTC

251 CGTCGCCCAA AATCGGCGCG GTGCCTTTCA TCGGTTCGGT GCTGATGGTG

301 CCGTCCGAAC CGATTTTGAG GAAGAGTTCG GGCGAGAAAC ACAGCGTCCA

351 CGCGGATTGC CCTTGTGCAT CGGGCAGGTG GGACAAAACG GCATAG
```

This corresponds to the amino acid sequence <SEQ ID 6; ORF 001.a>:

```
a001.pep

  1 MLPQGKAARR MSANEVCGKA WAWMVLVICQ TLPKRDTLNG SGTHTVPVWA

 51 ILPRSLRSKS TIITFSARFF GSACNSAARR SSCPSPKIGA VPFIGSVLMV

101 PSEPILRKSS GEKHSVHADC PCASGRWDKT A*
```

m001/a001 96.2% identity over a 131 aa overlap

```
                   10        20        30        40        50        60
m001.pep    MLPQGKAARRMSANEVCGXLXAWXVLVICQTLPKRDTLNGSGTHTVPVWAILPRSLRSKS
            ||||||||||||||||||   || ||||||||||||||||||||||||||||||||||||
a001-pep    MLPQGKAARRMSANEVCGKAWAWMVLVICQTLPKRDTLNGSGTHTVPVWAILPRSLRSKS
                   10        20        30        40        50        60
                   70        80        90       100       110       120
m001.pep    TIITFSARFFGSACNSAARRSSCPSPKIGAVPFIGSVLMVPSEPILRKSSGEKHSVHADC
            ||||||||||||||||||||||||||||||||||||||||||||||||||||||||||||
a001-pep    TIITFSARFFGSACNSAARRSSCPSPKIGAVPFIGSVLMVPSEPILRKSSGEKHSVHADC
                   70        80        90       100       110       120

                  130
m001.pep    PSASGRWDKTAX
            | ||||||||||
a001-pep    PCASGRWDKTAX
                  130
```

Computer analysis of this amino acid sequence gave the following results:

Homology with a predicted ORF from *N. gonorrhoeae*

ORF 001 shows 89.3% identity over a 131 aa overlap with a predicted ORF (ORF 001.ng) from *N. gonorrhoeae*:

```
m001/g001

                   10        20        30        40        50        60
m001.pep    MLPQGKAARRMSANEVCGXLXAWXVLVICQTLPKRDTLNGSGTHTVPVWAILPRSLRSKS
            ||||||||||:||||| |   |  |||||||||||||||||||||:||||||||||||||
g001        MLPQGKAARRVSANEVSGRACARMVLVICQTLPKRDTLNGSGTHTLPVWAILPRSLRSKS
                   10        20        30        40        50        60

                   70        80        90       100       110       120
m001.pep    TIITFSARFFGSACNSAARRSSCPSPKIGAVPFIGSVLMVPSEPILRKSSGEKHSVHADC
            ||||||||||||:|||||||||||||||||||||||||||||| :|||||||||||||||
g001        TIITFSARFFGSVCNSAARRSSCPSPKIGAVPFIGSVLMVPSEAMLRKSSGEKHSVHADC
                   70        80        90       100       110       120
                  130
m001.pep    PSASGRWDKTAX
            |::|||||:|||
g001        PASSGRWDNTAX
                  130
```

The following partial DNA sequence was identified in *N. gonorrhoeae* <SEQ ID 7>:

g003.seq

```
  1 ATGGTCGTAT TCGTGGCTGA AGGCGTATTC GGTCGCGCTG TTTTGGGTCA
 51 CTTGGTATTG CTCTTCGGTC AGGGTGCGTT TGAGTTCGGC GTCACTCGGT
101 TTTTTATACG TTGCCGCGTC GAAGCCTTTG CCTTGCGGTG CGGCTTTGGT
151 TTTGCCCGGC AGCGGTTCGT CGGCTTTGCG GATGTCGATG TGGCAGTAGC
201 CGTTGGGGTT TTTAATCAGG TAGTCCTGAT GGTATTCCTC GGCGTCGTAG
251 AAGTTTTTCA GCGGTTCGTT TTCAACAACG AGGGGCAGTT GGTATTTTTG
301 CTGCTCGCGT TTGAGGGCGG CGGCGATGAC GGCTTTTTCG GCGGGGTCGG
351 TGTAGTACAC GCCGCTGCGG TATTGCGTGC CGGTGTCGTT ACCCTGTTTG
401 TTGAGGCTGG TCGGATCAAC GACGCGGAAA TAATATTGCA GGATGTCGTC
451 CAGgCTGagt TTGTCGGCAT CGTaggtcac tTTGACGGTC TCGGCATGAC
501 CCGTATGGCG GTaggacact tctTCgtanc TcGGGtTTTC CGTGttGCCG
551 TTGGCgttac cGGATACCGC gtcaACCACG CCGTcgatgc gttggaAATa
601 ggCTTCCAAg ccccaaaagc agccgccggc gaagtaaatg gtgcccgtgt
651 tcatgattGC TGa
```

This corresponds to the amino acid sequence <SEQ ID 8; ORF 003.ng>:

g003.pep

```
  1 MVVFVAEGVF GRAVLGHLVL LFGQGAFEFG VTRFFIRCRV EAFALRCGFG
 51 FARQRFVGFA DVDVAVAVGV FNQVVLMVFL GVVEVFQRFV FNNEGQLVFL
101 LLAFEGGGDD GFFGGVGVVH AAAVLRAGVV TLFVEAGRIN DAEIILQDVV
151 QAEFVGIVGH FDGLGMTRMA VGHFFVRVFR VAVGVTGYRV NHAVDALEIG
201 FQAPKAAAGE VNGARVHDC
```

The following partial DNA sequence was identified in *N. meningitidis* <SEQ ID 9>:

m003.seq

```
  1 ATGGTCGTAT TCGTGGCTGA AGGCATATTC GGTCGCGCTG TTTTGGGTAA
 51 CTTGGsTATTG CTCTTCGGTC AGGGTGCGTT TGAGTTCGGC GTCACTCGGT
101 TTTTTATACG TTGCCGCGTC GAAGCCTTTG CCTTGCGGGG CGGTCTTGGT
151 TTTGCCCGGC AGCGGTTCGT CAGCkTTGCG GATGTCGATG TGGCAGTAGC
201 CGTTGGGGTT TTTAATCAAG TAGTCCTGAT GGTATTCCTC GGCATCGTAG
251 AAGTTTTtCA GCGGCTCGTT TTCAACAACG AGGGGCAGTT GGTATTTTTG
301 CTGCTCGCGT TTGAGGGCGk CGGCGATGAC GGCTTTTTCG kCGGGGTCGG
351 TGTAGTACAC GCCGCTGCGG TATTGCGTAC CGGTGTCGTT GCCCTGTTTG
401 TTGAGGCTGG TCGGATCAAC GACGCGGAAG AAATATTGCA GGATGTCGTC
451 TAGGCTGAGT TTGTCGGCAT CGTAGGTCAC TTTGACGGTT TCGGCGTGGC
501 CCGTATGGCG GTAGGACACG TCTTCATAGC TCGGATTTTT CGTGTTGCCG
551 TTGGCGTAGC CGGATACCGC GTCAACCACG CCGTCGATGC GTTGGAAATA
```

-continued

```
601 GGCTTCCAAG CCCCAGAAGC AGCg.CCGGC GAGGTAAATG GTGCGCGTGT
651 TCATGATTTT TGA
```

This corresponds to the amino acid sequence <SEQ ID 10; ORF 003>:

m003.pep Length: 221

```
  1 MVVFVAEGIF GRAVLGNLXL LFGQGAFEFG VTRFFIRCRV EAFALRGGLG
 51 FARQRFVSXA DVDVAVAVGV FNQVVLMVFL GIVEVFQRLV FNNEGQLVFL
101 LLAFEGXGDD GFFXGVGVVH AAAVLRTGVV ALFVEAGRIN DAEEILQDVV
151 *AEFVGIVGH FDGFGVARMA VGHVFIARIF RVAVGVAGYR VNHAVDALEI
201 GFQAPEAAXG EVNGARVHDF *
```

The following partial DNA sequence was identified in *N. meningitidis* <SEQ ID 11>:

a003.seq

```
  1 ATGGTCGTAT TCGTGGCTGA AGGCATATTC GGTCGCGCTG TTTTGGGTAA
 51 CTTGGTATTG CTCTTCGGTC AGGGTGCGTT TGAGTTCGGC GTCACTCGGT
101 TTTTTATACG TTGCCGCGTC GAAGCCTTTG CCTTGCGGTG CGGTCTTGGT
151 TTTGCCCGGC AGCGGTTCGT CGGCTTTGCG GATATCGATG TGGCAGTAGC
201 CGTTGGGGTT TTTAATCAAG TAGTCCTGAT GGTATTCCTC GGCATCGTAG
251 AAGTTTTTCA GCGGCTCGTT TTCAACAACG AGGGGCAGTT GGTATTTTTG
301 CTGCTCGCGT TTGAGGGCGG CGGCGATGAC GGCTTTTTCG GCGGGGTCGG
351 TGTAGTACAC GCCGCTGCGG TATTGCGTAC CGGTGTCGTT GCCCTGTTTG
401 TTGAGGCTGG TCGGATCAAC GACGCGGAAG AAATATTGCA GGATGTCGTC
451 TAGGCTGAGT TTGTCGGCAT CGTAGGTCAC TTTGACGGTT TCGGCGTGGC
501 CCGTATGGCG GTAGGACACG TCTTCATAGC TCGGATTTTT CGTGTTGCCG
551 TTGGCGTAGC CGGATACCGC GTCAACCACG CCGTCGATGC GTTGGAAATA
601 GGCTTCCAAG CCCCAGAAGC AGCCGCCGGC GAGGTAGATG GTGCGCGTGT
651 TCATGATTTT TGA
```

This corresponds to the amino acid sequence <SEQ ID 12; ORF 003.a>:

a003.pep

```
  1 MVVFVAEGIF GRAVLGNLVL LFGQGAFEFG VTRFFIRCRV EAFALRCGLG
 51 FARQRFVGFA DIDVAVAVGV FNQVVLMVFL GIVEVFQRLV FNNEGQLVFL
101 LLAFEGGGDD GFFGGVGVVH AAAVLRTGVV ALFVEAGRIN DAEEILQDVV
151 *AEFVGIVGH FDGFGVARMA VGHVFIARIF RVAVCVAGYR VNHAVDALEI
201 GFQAPEAAAG EVDGARVHDF *
```

m003/a003 95.9% identity over a 220 aa overlap

```
                      10        20        30        40        50        60
m003.pep      MVVFVAEGIFGRAVLGNLXLLFGQGAFEFGVTRFFIRCRVEAFALRGGLGFARQRFVSXA
              |||||||||||||||||| ||||||||||||||||||||||||||| ||||||||||: |
a003          MVVFVAEGIFGRAVLGNLVLLFGQGAFEFGVTRFFIRCRVEAFALRCGLGFARQRFVGFA
                      10        20        30        40        50        60

                      70        80        90       100       110       120
m003.pep      DVDVAVAVGVFNQVVLMVFLGIVEVFQRLVFNNEGQLVFLLLAFEGXGDDGFFXGVGVVH
              |:|||||||||||||||||||||||||||||||||||||||||||| |||||| ||||||
a003          DIDVAVAVGVFNQVVLMVFLGIVEVFQRLVFNNEGQLVFLLLAFEGGGDDGFFGGVGVVH
                      70        80        90       100       110       120

                     130       140       150       160       170       180
m003.pep      AAAVLRTGVVALFVEAGRINDAEEILQDVVXAEFVGIVGHFDGFGVARMAVGHVFIARIF
              ||||||||||||||||||||||||||||||||||||||||||||||||||||||||||||
a003          AAAVLRTGVVALFVEAGRINDAEEILQDVVXAEFVGIVGHFDGFGVARMAVGHVFIARIF
                     130       140       150       160       170       180

                     190       200       210       220
m003.pep      RVAVGVAGYRVNHAVDALEIGFQAPEAAXGEVNGARVHDFX
              |||||||||||||||||||||||||||| |||:||||||||
a003          RVAVGVAGYRVNHAVDALEIGFQAPEAAAGEVDGARVHDFX
                     190       200       210       220
```

Computer analysis of this amino acid sequence gave the following results:

Homology with a predicted ORF from *N. gonorrhoeae*

ORF 003 shows 88.6% identity over a 219 aa overlap with a predicted ORF (ORF 003.ng) from *N. gonorrhoeae*:

```
m003/g003

                      10        20        30        40        50        60
m003.pep      MVVFVAEGIFGRAVLGNLXLLFGQGAFEFGVTRFFIRCRVEAFALRGGLGFARQRFVSXA
              ||||||||:|||||||:| ||||||||||||||||||||||||||| |:||||||||: |
g003          MVVFVAEGVFGRAVLGHLVLLFGQGAFEFGVTRFFIRCRVEAFALRCGFGFARQRFVGFA
                      10        20        30        40        50        60

                      70        80        90       100       110       120
m003.pep      DVDVAVAVGVFNQVVLMVFLGIVEVFQRLVFNNEGQLVFLLLAFEGXGDDGFFXGVGVVH
              |||||||||||||||||||||:||||||:||||||||||||||||| |||||| ||||||
g003          DVDVAVAVGVFNQVVLMVFLGVVEVFQRFVFNNEGQLVFLLLAFEGGGDDGFFGGVGVVH
                      70        80        90       100       110       120

                     130       140       150       160       170       180
m003.pep      AAAVLRTGVVALFVEAGRINDAEEILQDVVXAEFVGIVGHFDGFGVARMAVGHVFIARIF
              ||||||:|||:|||||||||||| |||||| ||||||||||||:|::|||||| |: |:|
g003          AAAVLRAGVVTLFVEAGRINDAEIILQDVVQAEFVGIVGHFDGLGMTRMAVGHFFV-RVF
                     130       140       150       160       170       180

                     190       200       210       220
m003.pep      RVAVGVAGYRVNHAVDALEIGFQAPEAAXGEVNGARVHDFX
              ||||||:||||||||||||||||||:|| ||||||||||
g003          RVAVGVTGYRVNHAVDALEIGFQAPKAAAGEVNGARVHDC
                     190       200       210
```

The following partial DNA sequence was identified in *N. gonorrhoeae* <SEQ ID 13>:

```
g004.seq

  1 ATGgtagAAC GGCATATCCA GCATTTGCGG AACGGTCATC TTCATTTGAT

 51 GCGCCCATGC CAACAagtga gccaAAtgtT CGGCGGCAGG GCCTacgatT

101 TCCGCGCCGA TAAagcggcc gGTGgctTTT tcgGCataca ggcgcaTatg

151 gCCTTTGTTT ACCAgcatca cgcggctgcg accttgaTTT TTGAACGATA

201 CTTCGCCgaT GACAAATTCG TCGGCTTGGT ATTGCGCGGC AACCTGCGCG

251 TATTTCAAAC CGACAAAGCC GATTTGCgga ctggtaaACA CCACGCCAAT

301 GGTgctgcgg cGCAAACCGC TGCCGATATt cgGgtagcgg ccccgcgtta

351 ttgcccggca atcttacctt ggtcggcggc ttcatGCAGC AGGGGCagtt
```

-continued

```
401 ggttggacgc gtcgcccgca ataAAGATAT GCGGAATgct ggtCTGCATg
451 gtCAGCGGAT CGGCAACGGG tacgccgcgc gcgtctttgT CGATATTGAT
501 GTTTTCCAAA CCGATATtgT CAACGTTCGG ACGGCgACCT ACGGCTGCCA
551 ACATATATTC GGCAACAAAT ACGCCTTTTT CGCCATCCTG CTCCCAATGG
601 ACTtctACAT TGCCGTCTGC GTCGAGTTTG ACCTCGGTTT TAGCATCCAG
651 ATGCAGTTTC AATtctTCTC CGAACACGGC TTTCGCCTCG TCTGAAACAA
701 CGGGGTCGGA AATGCCGCCG ATGATTCCGC CCAAACCGAA AATTTCAACT
751 TTCACACCCA AACGGTGCAA TGCCTGA
```

This corresponds to the amino acid sequence <SEQ ID 14; ORF 004.ng>:

g004.pep

```
  1 MVERHIQHLR NGHLHLMRPC QQVSQMFGGR AYDFRADKAA GGFFGIQAHM
 51 AFVYQHHAAA TLIFERYFAD DKFVGLVLRG NLRVFQTDKA DLRTGKHHAN
101 GAAAQTAADI RVAAPRYCPA ILPWSAASCS RGSWLDASPA IKICGMLVCM
151 VSGSATGTPR ASLSILMFSK PILSTFGRRP TAANIYSATN TPFSPSCSQW
201 TSTLPSASSL TSVLASRCSF NSSPNTAFAS SETTGSEMPP MIPPKPKIST
251 FTPKRCNA*
```

The following partial DNA sequence was identified in *N. meningitidis* <SEQ ID 15>:

m004.seq

```
  1 ATGGTAGAAC GGCATATCCA GCATTTGCGG AACGGTCATC TTCATTTGAT
 51 GTGCCCAAGC CAACAGGTGC GCCAAATGTT CGGCGGCAGG GCCTACGATT
101 TCCGCGCCGA TAAAGCGGCC GGTGGCTTTT TCGGCATACA GGCGCATATG
151 GCCTTTGTTC ACCAGCATCA CGCGGCTGCG GCCTTGGTTT TTGAACGATA
201 CTTCGCCGAT GACAAATTCG TCGGCTTGGT ATTGCGCGGC AACCTGCGCG
251 TATTTCAGAC CGACAAAGCC GATTTGCGGA CTGGTAAACA CCACGCCGAT
301 GGTGCTGCGC CGCAAACCGC CGCCGATATT CGGGTAGCGG CCGCGTTATC
351 GCCGGCAATC TTGCCTTGGT CGGCAGCTTC ATGCAGCAGA GGCAGTTGGT
401 TGGACGCATC GCCTGCGATG AAGATATGCG GAATACTGGT CTGCATGGTC
451 AGCGGGTCGG CAACAGGTAC GCCGCGCGCA TCTTTTTCGA TATTGATATT
501 TTCCAAACCG ATATTGTCAA CGTTCGGACG GCGGCCCACG GCTGCCAGCA
551 TATATTCGGC AACAAATACG CCTTTTTCGC CATCCTGCTC CCAATGGACT
601 TCTACATTGC CGTCTGCATC GAGTTTGACC TCGGTTTTAG CATCCAGATG
651 CAGTTTCAAT TCTTCGCCGA ACACGGCGTT CGCCTCGTCT GAAACGACGG
701 GGTCGGAAAT GCCGCCGATG ATTCCGCCCA AACCGAAAAT TTCAACTTTC
751 ACGCCCAAAC GGTGCAATGC CTGA
```

This corresponds to the amino acid sequence <SEQ ID 16; ORF 004>:

m004.pep

```
  1 MVERHIQHLR NGHLHLMCPS QQVRQMFGGR AYDFRADKAA GGFFGIQAHM
 51 AFVHQHHAAA ALVFERYFAD DKFVGLVLRG NLRVFQTDKA DLRTGKHHAD
101 GAAPQTAADI RVAAALSPAI LPWSAASCSR GSWLDASPAM KICGILVCMV
151 SGSATGTPRA SFSILIFSKP ILSTFGRRPT AASIYSATNT PFSPSCSQWT
201 STLPSASSLT SVLASRCSFN SSPNTAFASS ETTGSEMPPM IPPKPKISTF
251 TPKRCNA*
```

The following partial DNA sequence was identified in *N. meningitidis* <SEQ ID 17>:

a004.seq

```
  1 ATGGTAGAAC GGCATATCCA GCATTTGCGG AACGGTCATC TTCATTTGAT
 51 GTGCCCAAGC CAACAGGTGC GCCAAATGTT CGGCGGCCGG ACCTACGATT
101 TCTGCGCCGA TGAAGCGGCC GGTGGCTTTT TCGGCATACA GGCGCATATG
151 GCCTTTGTTT ACCAGCATCA CGCGGCTGCG GCCTTGGTTT TTGAACGATA
201 CTTCGCCGAT GACAAATTCG TCGGCTTGGT ATTGCGCGGC AACCTGCGCG
251 TATTTCAAAC CGACAAAGCC GATTTGCGGA CTGGTGAACA CTACGCCGAT
301 GGTGCTGCGG CGCAAACCGC CGCCGATATT CGGGTAGCGG CCGCGTTATC
351 GCCGGCAATC TTGCCTTGGT CGGCGGCTTC ATGCAGCAGG GGCAGTTGGT
401 TGGACGCGTC GCCCGCAATA AAGATATGCG GAATACTGGT CTGCATAGTC
451 AGCGGATCGG CAACGGGTAC GCCGCGCGCA TCTTTTTCGA TATTGATGTT
501 TTCCAAACCG ATATTGTCAA CGTTCGGACG GCGGCCTACG GCTGCCAGCA
551 TATATTCGGC AACAAATACG CCTTTTTCGC CATCCTGCTC CCAATGGACT
601 TCTACATTGC CGTCTGCGTC GAGTTTGGCC TCGGTTTTAG CATCCAAATG
651 CAGTTTCAAT TCTTCACCGA ACACGGCTTT CGCCTCGTCT GAAACGACGG
701 GGTCGGAAAT GCCGCCGATG ATGCCACCCA AACCGAAAAT TTCAACTTTC
751 ACGCCCAAAC GGTGCAATGC CTGA
```

This corresponds to the amino acid sequence <SEQ ID 18; ORF 004.a>:

a004.pep

```
  1 MVERHIQHLR NGHLHLMCPS QQVRQMFGGR TYDFCADEAA GGFFGIQAHM
 51 AFVYQHHAAA ALVFERYFAD DKFVGLVLRG NLRVFQTDKA DLRTGEHYAD
101 GAAAQTAADI RVAAALSPAI LPWSAASCSR GSWLDASPAI KICGILVCIV
151 SGSATGTPRA SFSILMFSKP ILSTFGRRPT AASIYSATNT PFSPSCSQWT
201 STLPSASSLA SVLASKCSFN SSPNTAFASS ETTGSEMPPM MPPKPKISTF
251 TPKRCNA*
```

m004/a004 94.9% identity over a 257 aa overlap

```
                   10        20        30        40        50        60
m004.pep   MVERHIQHLRNGHLHLMCPSQQVRQMFGGRAYDFRADKAAGGFFGIQAHMAFVHQHHAAA
           ||||||||||||||||||||||||||||||:||| ||:||||||||||||||||:|||||
a004       MVERHIQHLRNGHLHLMCPSQQVRQMFGGRTYDFCADEAAGGFFGIQAHMAFVYQHHAAA
                   10        20        30        40        50        60

                   70        80        90       100       110       120
m004.pep   ALCFERYFADDKFVGLVLRGNLRVFQTDKADLRTGKHHADGAAPQTAADIRVAAALSPAI
           |||||||||||||||||||||||||||||||||||:|:||||| ||||||||||||||||
a004       ALCFERYFADDKFVGLVLRGNLRVFQTDKADLRTGEHYADGAAAQTAADIRVAAALSPAI
                   70        80        90       100       110       120

                  130       140       150       160       170       180
m004.pep   LPWSAASCSRGSWLDASPAMKICGILVCMVSGSATGTPRASFSILIFSKPILSTFGRRPT
           |||||||||||||||||||:||||||||:||||||||||||||||:||||||||||||||
a004       LPWSAASCSRGSWLDASPAIKICGILVCIVSGSATGTPRASFSILMFSKPILSTFGRRPT
                  130       140       150       160       170       180

                  190       200       210       220       230       240
m004.pep   AASIYSATNTPFSPSCSQWTSTLPSASSLTSVLASRCSFNSSPNTAFASSETTGSEMPPM
           |||||||||||||||||||||||||||||:|||||:||||||||||||||||||||||||
a004       AASIYSATNTPFSPSCSQWTSTLPSASSLASVLASKCSFNSSPNTAFASSETTGSEMPPM
                  190       200       210       220       230       240

                  250
m004.pep   IPPKPKISTFTPKRCNAX
           :|||||||||||||||||
a004       MPPKPKISTFTPKRCNAX
                  250
```

Computer analysis of this amino acid sequence gave the following results:

Homology with a predicted ORF from *N. gonorrhoeae*

ORF 004 shows 93.4% identity over a 258 aa overlap with a predicted ORF (ORF 004.ng) from *N. gonorrhoeae*:

```
m004/g004

                   10        20        30        40        50        60
m004.pep   MVERHIQHLRNGHLHLMCPSQQVRQMFGGRAYDFRADKAAGGFFGIQAHMAFVHQHHAAA
           ||||||||||||||||| | ||| ||||||||||||||||||||||||||||||:|||||
g004       MVERHIQHLRNGHLHLMRPCQQVSQMFGGRAYDFRADKAAGGFFGIQAHMAFVYQHHAAA
                   10        20        30        40        50        60

                   70        80        90       100       110       119
m004.pep   ALVFERYFADDKFVGLVLRGNLRVFQTDKADLRTGKHHADGAAPQTAADIRVAAA-LSPA
           :|:||||||||||||||||||||||||||||||||||||:||| ||||||||||    ||
g004       TLIFERYFADDKFVGLVLRGNLRVFQTDKADLRTGKHHANGAAAQTAADIRVAAPRYCPA
                   70        80        90       100       110       120

         120       130       140       150       160       170       179
m004.pep   ILPWSAASCSRGSWLDASPAMKICGILVCMVSGSATGTPRASFSILIFSKPILSTFGRRP
           ||||||||||||||||||||:||||:||||||||||||||||:|||:|||||||||||||
g004       ILPWSAASCSRGSWLDASPAIKICGMLVCMVSGSATGTPRASLSILMFSKPILSTFGRRP
                  130       140       150       160       170       180

         180       190       200       210       220       230       239
m004.pep   TAASIYSATNTPFSPSCSQWTSTLPSASSLTSVLASRCSFNSSPNTAFASSETTGSEMPP
           |||:||||||||||||||||||||||||||||||||||||||||||||||||||||||||
g004       TAANIYSATNTPFSPSCSQWTSTLPSASSLTSVLASRCSFNSSPNTAFASSETTGSEMPP
                  190       200       210       220       230       240

         240       250
m004.pep   MIPPKPKISTFTPKRCNAX
           ||||||||||||||||||
g004       MIPPKPKISTFTPKRCNA
                  250
```

The following partial DNA sequence was identified in *N. gonorrhoeae* <SEQ ID 19>:

g005.seq

```
  1 ATGGGGATGG ACAATATTGA TATGTTCATG CCTGAACAAG AGGAAATCCA

 51 ATCAATGTGG AAAGAAATTT TACTGAATTA CGGTATTTTC CTGCTCGAAC
```

-continued

```
 101 TGCTTACCGT GTTCGGCGCA ATTGCGCTGA TTGTGTTGGC TATCGTACAG

 151 AGTAAGAAAC AGTCGGAAAG CGGCAGTGTC GTACTGACAG ATTTTTCGGA

 201 AAATTATAAA AAACAGCGGC AATCGTTTGA AACATTCTTT TTAAGCGAGG

 251 AAGAGACAAA ACATCAGGAA AAAAAAGAAA AGAAAAAGGA AAAGGCGGAA

 301 GCCAAAGCAG AGAAAAAGCG TTTGAAGGAG GGCGGGGAGA AATCTGCCGA

 351 AACGCAAAAA TCCCGCCTTT TTGTGTTGGA TTTTGACGGC GATTTGTATG

 401 CACACGCCGT AGAATCCTTG CGTCATGAGA TTACGGCGGT GCTTTTGATT

 451 GCCAAGCCTG AAGATGAGGT TCTGCTCAGA TTGGAAAGTC CGGGCGGCGT

 501 GGTTCACGGT TACGGTTTGG CGGCTTCGCA GCTTAGGCGT TTGCGCGAAC

 551 GCAATATTCC GCTGAccgtc gccgTCGATA AGGTCGCGGC AAGCGgcggc

 601 tatatgatgg cgtgtgtgGC GGATAAAATT GTTTCCGCtc cgtttgcggt

 651 catcggttcg gtgggtgtgg tgGcggaagt gcCGAATATC CAccgCctGT

 701 TGAAAAAACA TGATATTGAT GTGGATGTGA TGACGGCGGG CGAATTTAAG

 751 CGCACGGTTA CTTTTATGGG TGAAAATACG GAAAAGGGCA AACAGAAATT

 801 CCGGCAGGAA CTGGAGGAAA CGCATCAGTT GTTCAAGCAG TTTGTCAGTG

 851 AAAACCGCCC CGGGTTGGAT ATTGAAAAAA TAGCGACGGG CGAGCATTGG

 901 TTCGGCCGGC AGGCGTTGGC GTTGAACTTG ATTGACGAGA TTTCGACCAG

 951 TGATGATTTG TTGTTGAAAG CGTTTGAAAA CAAACAGGtt aTCGAAGTGA

1001 AATATCAGGA GAAGCGAAGC CTGATCCAGC GCATTGGTTT GCAGGCGGAA

1051 GCTTCCGTTG AAAAGTTGTT TGCCAAACTT GTCAACCGGC GAGCGGATGT

1101 GATGTAG
```

This corresponds to the amino acid sequence <SEQ ID 20; ORF 005.ng>:

g005.pep

```
  1 MGMDNIDMFM PEQEEIQSMW KEILLNYGIF LLELLTVFGA IALIVLAIVQ

 51 SKKQSESGSV VLTDFSENYK KQRQSFETFF LSEEETKHQE KKEKKKEKAE

101 AKAEKKRLKE GGEKSAETQK SRLFVLDFDG DLYAHAVESL RHEITAVLLI

151 AKPEDEVLLR LESPGGVVHG YGLAASQLRR LRERNIPLTV AVDKVAASGG

201 YMMACVADKI VSAPFAVIGS VGVVAEVPNI HRLLKKHDID VDVMTAGEFK

251 RTVTFMGENT EKGKQKFRQE LEETHQLFKQ FVSENRPGLD IEKIATGEHW

301 FGRQALALNL IDEISTSDDL LLKAFENKQV IEVKYQEKRS LIQRIGLQAE

351 ASVEKLFAKL VNRRADVM*
```

The following partial DNA sequence was identified in *N. meningitidis* <SEQ ID 21>:

m005.seq

```
  1 ATGGACAATA TTGACATGTT CATGCCTGAA CAAGAGGAAA TCCAATCAAT

 51 GTGGAAAGAA ATTTTACTGA ATTACGGTAT TTTCCTGCTC GAACTGCTTA

101 CCGTGTTCGG CGCAATTGCG CTGATTGTGT TGGCTATCGT ACAGAGTAAG
```

-continued

```
 151 AAACAGTCGG AwAGCGGCAG TGTCGTACTG ACGGATTTTT CGGAAAATTA
 201 TAAAAAACAG CGGCAATCGT TTGAAGCATT CTTTTTAAGC GGGGAAGAGG
 251 CACAACATCA GGAAAAAGAG GAAAAGAAAA AGGAAAAGGC GGAAGCCAAA
 301 GCAGAGAAAA A.CGTTTGAA GGAGGGTGGG GAGAAATCTG CCGAAACGCA
 351 nAAATCACGC CTTTTTGTGT TGGANNNNNN NNNNNNNNNN NNNNNNNNNN
 401 NNNNNNNNNN NNNNNNNNNN NNNNNNNNNN NNNNNNNNNN NNNNNNNNNN
 451 NNNNNNNNNN NNNNNNNNNN NNNNNNNNNN NNNNNNNNNN NNNNNNNNNN
 501 NNNNNNNNNN NNNNNNNNNN NNNNNNNNNN NNNNNNNNNN NNNNNNNNNN
 551 NNNNNNNNNN NNNNNNNNNN NNNNNNNNNN NNGCGAGCGG CGGTTATATG
 601 ATGGCGTGTG TGGCGGATAA AATTGCTTCC GCTCCGTTTG CGATTGTCGG
 651 TTCGGTGGGT GTGGTGGCGG AAGTACCGAA TATCCACCGC CTGTTGAAAA
 701 AACATGATAT TGATGTGGAT GTGATGACGG CGGGCGAATT TAAGCGCACG
 751 GTTACTTTTA TGGGTGAAAA TACGGAAAAG GGCAAACAGA AATTCCGACA
 801 GGAACTGGAG GAAACGCATC AGTTGTTCAA GCAGTTTGTC AGCGAGAACC
 851 GCCCTCAATT GGATATTGAG GAAGTGGCAA CGGGCGAGCA TTGGTTCGGT
 901 CGGCAGGCGT TGGCGTTGAA CTTGATTGAC GAGATTTCGA CCAGTGATGA
 951 TTTGTTGTTG AAAGCGTTTG AAAACAAACA GGTTATCGAA GTGAAATATC
1001 AGGAGAAGCA AAGCCTGATC CAGCGCATTG GTTTGCAGGC GGAAGCTTCT
1051 GTTGAAAAGT TGTTTGCCAA ACTTGTCAAC CGGCGGGCGG ATGTGATGTA
1101 G
```

This corresponds to the amino acid sequence <SEQ ID 22; ORF 005>:

m005.pep

```
  1 MDNIDMFMPE QEEIQSMWKE ILLNYGIFLL ELLTVFGAIA LIVLAIVQSK
 51 KQSXSGSVVL TDFSENYKKQ RQSFEAFFLS GEEAQHQEKE EKKKEKAEAK
101 AEKXRLKEGG EKSAETXKSR LFVLXXXXXX XXXXXXXXXX XXXXXXXXXX
151 XXXXXXXXXX XXXXXXXXXX XXXXXXXXXX XXXXXXXXXX XXXXASGGYM
201 MACVADKIAS APFAIVGSVG VVAEVPNIHR LLKKHDIDVD VMTAGEFKRT
251 VTFMGENTEK GKQKFRQELE ETHQLFKQFV SENRPQLDIE EVATGEHWFG
301 RQALALNLID EISTSDDLLL KAFENKQVIE VKYQEKQSLI QRIGLQAEAS
351 VEKLFAKLVN RRADVM*
```

The following partial DNA sequence was identified in *N. meningitidis* <SEQ ID 23>:

a005.seq

```
  1 ATGGACAATA TTGACATGTT CATGCCTGAA CAAGAGGAAA TCCAATCAAT
 51 GTGGAAAGAA ATTTTACTGA ATTACGGTAT TTTCCTGCTC GAACTGCTTA
101 CCGTGTTCGG CGCAATTGCG CTGATTGTGT TGGCTATCGT ACAGAGTAAG
```

-continued

```
 151 AAACAGTCGG AAAGCGGCAG TGTCGTACTG ACGGATTTTT CGGAAAATTA
 201 TAAAAAACAG CGGCAATCGT TTGAAGCATT CTTTTTAAGC GGGGAAGAGG
 251 CAAAACATCA GGAAAAAGAG GAAAAGAAAA AGGAAAAGGC GGAAGCCAAA
 301 GCAGAGAAAA AGCGTTTGAA GGAGGGTGGG GAGAAATCTT CCGAAACGCA
 351 AAAATCCCGC CTTTTTGTGT TGGATTTTGA CGGCGATTTG TATGCACACG
 401 CCGTAGAATC CTTGCGTCAT GAGATTACGG CGGTGCTTTT GATTGCCAAG
 451 CCTGAAGATG AGGTTCTGCT TAGATTGGAA AGTCCGGGCG GCGTGGTTCA
 501 CGGTTACGGT TTGGCGGCTT CGCAGCTTAG GCGTTTGCGC GAACGCAATA
 551 TTCCGCTGAC CGTCGCCGTC GATAAGGTGG CGGCGAGCGG TGGTTATATG
 601 ATGGCGTGTG TGGCGGATAA AATTGTTTCC GCTCCGTTTG CGATTGTCGG
 651 TTCGGTGGGT GTTGTAGCGG AAGTACCGAA TATCCACCGC CTGTTGAAAA
 701 AACATGATAT TGATGTGGAT GTGATGACGG CGGGCGAATT TAAGCGCACG
 751 GTTACTTTTA TGGGTGAAAA TACGGAAAAG GGCAAACAGA AATTCCGACA
 801 GGAACTGGAG GAAACGCATC AGTTGTTCAA GCAGTTTGTC AGCGAGAACC
 851 GCCCTCAATT GGATATTGAG GAAGTGGCAA CGGGCGAGCA TTGGTTCGGT
 901 CGGCAGGCGT TGGCGTTGAA CTTGATTGAC GAGATTTCGA CCAGTGATGA
 951 TTTGTTGTTG AAAGCGTTTG AAAACAAACA GGTTATCGAA GTGAAATATC
1001 AGGAGAAGCA AAGCCTGATC CAGCGCATTG GTTTGCAGGC GGAAGCTTCT
1051 GTTGAAAAGT TGTTTGCCAA ACTTGTCAAC CGGCGGGCGG ATGTGATGTA
1101 G
```

This corresponds to the amino acid sequence <SEQ ID 24; ORF 005.a>:

a005.pep

```
  1 MDNIDMFMPE QEEIQSMWKE ILLNYGIFLL ELLTVFGAIA LIVLAIVQSK
 51 KQSESGSVVL TDFSENYKKQ RQSFEAFFLS GEEAKHQEKE EKKKEKAEAK
101 AEKKRLKEGG EKSSETQKSR LFVLDFDGDL YAHAVESLRH EITAVLLIAK
151 PEDEVLLRLE SPGGVVHGYG LAASQLRRLR ERNIPLTVAV DKVAASGGYM
201 MACVADKIVS APFAIVGSVG VVAEVPNIHR LLKKHDIDVD VMTAGEFKRT
251 VTFMGENTEK GKQKFRQELE ETHQLFKQFV SENRPQLDIE EVATGEHWFG
301 RQALALNLID EISTSDDLLL KAFENKQVIE VKYQEKQSLI QRIGLQAEAS
351 VEKLFAKLVN RRADVM*
```

m005/a005 79.2% identity over a 366 aa overlap

```
                10         20         30         40         50         60
m005.pep  MDNIDMFMPEQEEIQSMWKEILLNYGIFLLELLTVFGAIALIVLAIVQSKKQSXSGSVVL
          ||||||||||||||||||||||||||||||||||||||||||||||||||| ||||||
a005      MDNIDMFMPEQEEIQSMWKEILLNYGIFLLELLTVFGAIALIVLAIVQSKKQSESGSVVL
                10         20         30         40         50         60

                70         80         90        100        110        120
m005.pep  TDFSENYKKQRQSFEAFFLSGEEAQHQEKEEKKKEKAEAKAEKXRLKEGGEKSAETXKSR
          ||||||||||||||||||||||||:||||||||||||||||||| ||||||||| | ||
a005      TDFSENYKKQRQSFEAFFLSGEEAKHQEKEEKKKEKAEAKAEKKRLKEGGEKSSETQKSR
                70         80         90        100        110        120
```

-continued

```
                 130       140       150       160       170       180
m005.pep    LFVLXXXXXXXXXXXXXXXXXXXXXXXXXXXXXXXXXXXXXXXXXXXXXXXXXXXXXXXX
            ||||                      :
a005        LFVLDFDGDLYAHAVESLRHEITAVLLIAKPEDEVLLRLESPGGVVHGYGLAASQLRRLR
                 130       140       150       160       170       180

                 190       200       210       220       230       240
m005.pep    XXXXXXXXXXXXXXASGGYMMACVADKIASAPFAIVGSVGVVAEVPNIHRLLKKHDIDVD
                 :       |||||||||||||:||||||||||||||||||||||||||||||
a005        ERNIOLTVAVDKVAASGGYMMACVADKIVSAPFAIVGSVGVVAEVPNIHRLLKKHDIDVD
                 190       200       210       220       230       240

                 250       260       270       280       290       300
m005.pep    VMTAGEFKRTVTFMGENTEKGKQKFRQELEETHQLFKQFVSENRPQLDIEEVATGEHWFG
            ||||||||||||||||||||||||||||||||||||||||||||||||||||||||||||
a005        VMTAGEFKRTVTFMGENTEKGKQKFRQELEETHQLFKQFVSENRPQLDIEEVATGEHWFG
                 250       260       270       280       290       300

                 310       320       330       340       350       360
m005.pep    RQALALNLIDEISTSDDLLLKAFENKQVIEVKYQEKQSLIQRIGLQAEASVEKLFAKLVN
            ||||||||||||||||||||||||||||||||||||||||||||||||||||||||||||
a005        RQALALNLIDEISTSDDLLLKAFENKQVIEVKYQEKQSLIQRIGLQAEASVEKLFAKLVN
                 310       320       330       340       350       360

m005.pep    RRADVMX
            |||||||
a005        RRADVMX
```

Computer analysis of this amino acid sequence gave the following results:

Homology with a predicted ORF from *N. gonorrhoeae*

ORF 005 shows 77.0% identity over a 366 aa overlap with a predicted ORF (ORF 005.ng) from *N. gonorrhoeae*:

```
m005/g005

                    10        20        30        40        50
m005.pep      MDNIDMFMPEQEEIQSMWKEILLNYGIFLLELLTVFGAIALIVLAIVQSKKQSXSGSV
              |||||||||||||||||||||||||||||||||||||||||||||||||||| ||||
g005        MGMDNIDMFMPEQEEIQSMWKEILLNYGIFLLELLTVFGAIALIVLAIVQSKKQSESGSV
                    10        20        30        40        50        60

             60        70        80        90       100       110
m005.pep    VLTDFSENYKKQRQSFEAFFLSGEEAQHQEKEEKKKEKAEAKAEKKRLKEGGEKSAETXK
            ||||||||||||||||:||||  ||::||||:||||||||||||||||||||||||| |
g005        VLTDFSENYKKQRQSFETFFLSEEETKHQEKKEKKKEKAEAKAEKKRLKEGGEKSAETQK
                    70        80        90       100       110       120

            120       130       140       150       160       170
m005.pep    SRFVLXXXXXXXXXXXXXXXXXXXXXXXXXXXXXXXXXXXXXXXXXXXXXXXXXXXXXXX
            ||||                          :
g005        SRLFVLDFDGDLYAHAVESLRHEITAVLLIAKPEDEVLLRLESPGGVVHGYGLAASQLRR
                   130       140       150       160       170       180

            180       190       200       210       220       230
m005.pep    XXXXXXXXXXXXXXXXASGGYMMACVADKIASAPFAIVGSVGVVAEVPNIHRLLKKHDID
                   :        |||||||||||||:|||||::|||||||||||||||||||||
g005        LRERNIPLTVAVDKVAASGGYMMACVADKIVSAPFAVIGSVGVVAEVPNIHRLLKKHDID
                   190       200       210       220       230       240

            240       250       260       270       280       290
m005.pep    VDVMTAGEFKRTVTFMGENTEKGKQKFRQELEETHQLFKQFVSENRPQLDIEEVATGEHW
            ||||||||||||||||||||||||||||||||||||||||||||||||| ||||::||||||
g005        VDVMTAGEFKRTVTFMGENTEKGKQKFRQELEETHQLFKQFVSENRPGLDIEKIATGEHW
                   250       260       270       280       290       300

            300       310       320       330       340       350
m005.pep    FGRQALALNLIDEISTSDDLLLKAFENKQVIEVKYQEKQSLIQRIGLQAEASVEKLFAKL
            ||||||||||||||||||||||||||||||||||||:|||||||||||||||||||||||
g005        FGRQALALNLIDEISTSDDLLLKAFENKQVIEVKYQEKRSLIQRIGLQAEASVEKLFAKL
                   310       320       330       340       350       360

            360
m005.pep    VNRRADVMX
            |||||||||
g005        VNRRADVMX
```

The following partial DNA sequence was identified in *N. gonorrhoeae* <SEQ ID 25>:

g006.seq

1 ATGCTGCTGG TGCTggaatt ttggttcGGc gtGtCGGCGG TGGGCatact 51 tgCGTTGTTT TTATGGCttt TGCCACGTTT TGCCGCCATC AGCGAAAACC 101 TGTATTTCCG CCTGAACAAC AGCTTGGAAC gcgACAACCA CTTTATCCGA

151 AAAGGCGACG AGCGGCAGCT GTACCGCCAT TACGGACTGG TTTCGCGCCT

201 GCGTGTGCTG ATTTCCAACC GCGAAGCCTT CGGCTATCTC TGCGTCGGCG

251 CGGCGATGGG TATTTTGTTC GGCTTTGCTT TTGTGATGAT GACGCTCAAA

301 GGCTACGGCA GCGCGGGGCA TATTTATTCG GTCGGCACTT ATCTGTGGAT

351 GTTTGCCATG AGTTTGGACG ATGTGCCGCG ATTGGTCGAA CAATATTCCA

401 ATTTGAAAGA CATCGGACAA CGGATAGAGT GGTCGGAACG GAACATCAAA

451 GCCGGAACTT GA

This corresponds to the amino acid sequence <SEQ ID 26; ORF 006.ng>:

g006.pep

1 MLLVLEFWFG VSAVGILALF LWLLPRFAAI SENLYFRLNN SLERDNHFIR

51 KGDERQLYRH YGLVSRLRVL ISNREAFGYL CVGAAMGILF GFAFVMMTLK

101 GYGSAGHIYS VGTYLWMFAM SLDDVPRLVE QYSNLKDIGQ RIEWSERNIK

151 AGT*

The following partial DNA sequence was identified in *N. meningitidis* <SEQ ID 27>:

m006.seq

1 ATGCTGCTGG TGCTGGAATT TTGGGTCGGC GTGTCGGCGG TGGGCATACT

51 TGCGTTGTTT TTATGGCTTT TGCCACGTTT TGCCGCCATC AGCGAAAACC

101 TGTATTTCCG CCTGAACAAC AGCTTGGAAC GCGACAACCA CTTTATCCGA

151 AAAGGCGACC GGCGGCAGCT GTACCGCCAT TACGGACTGC TTGCGCGCCT

201 GCGTGTGCTG ATTTCCAACC GCGAAGCCTT CGGCTATCTC TGCGTCGGCA

251 CGGCGATGGG TATTTTGTTC GGCTTTGCTT TTGTGATGAT GACGCTCAAA

301 GGCTACAGCA GCGCGGGGCA TGTCTATTCG GTCGGCACTT ATCTGTGGAT

351 GTTTGCCATG AGTTTGGACG ACGTGCCGCG ATTGGTCGAA CAATATTCCA

401 ATTTGAAAGA CATCGGACAA CGGATAGAGT GGTCGGAACG GAACATCAAA

451 GCCGGAACTTGA

This corresponds to the amino acid sequence <SEQ ID 28; ORF 006>:

m006.pep

1 MLLVLEFWVG VSAVGILALF LWLLPRFAAI SENLYFRLNN SLERDNHFIR

51 KGDRRQLYRH YGLLARLRVL ISNREAFGYL CVGTAMGILF GFAFVMMTLK

-continued

```
101 GYSSAGHVYS VGTYLWMFAM SLDDVPRLVE QYSNLKDIGQ RIEWSERNIK

151 AGT*
```

The following partial DNA sequence was identified in *N. meningitidis* <SEQ ID 29>:

a006.seq

```
  1 ATGCTGCTGG TGCTGGAATT TTGGGTCGGC GTGTCGGCGG TGGGCATACT
 51 TGCGTTGTTT TTATGGCTTT TGCCACGTTT TGCCGCCATC AGCGAAAACC
101 TGTATTTCCG CCTGAAGAAC AGCTTGGAAC GCGACAACCA CTTTATCCGA
151 AAAGGCGACG AGCGGCAGCT GGACCGCCAT TACGGACTGC TTGCGCGCCT
201 GCGTGTGCTG ATTTCCAACC GCGAAGCCTT CGGCTATCTC TGCGTCGGCA
251 CGGCGATGGG TATTTTGTTC GGCTTTGCTT TTGTGATGAT GACGCTCAAA
301 GGCTACAGCA GCGCGGGGCA TGTCTATTCG GTCGGCACTT ATCTGTGGAT
351 GTTTGCCATA AGTTTGGACG ACGTGCCGCG ATTGGTCGAA CAATATTCCA
401 ATTTGAAAGA CATCGGACAA CGGATAGAGT GGTCGAAACG GAACATCAAA
451 GCCGGAACTT GA
```

This corresponds to the amino acid sequence <SEQ ID 30; ORF 006.a>:

a006.pep

```
  1 MLLVLEFWVG VSAVGILALF LWLLPRFAAI SENLYFRLKN SLERDNHFIR
 51 KGDERQLDRH YGLLARLRVL ISNREAFGYL CVGTAMGILF GFAFVMMTLK
101 GYSSAGHVYS VGTYLWMFAI SLDDVPRLVE QYSNLKDIGQ RIEWSKRNIK
151 AGT*
```

m006/a006 96.7% identity over a 153 aa overlap

```
                   10        20        30        40        50        60
m006.pep    MLLVLEFWVGVSAVGILALFLWLLPRFAAISENLYFRLNNSLERDNHFIRKGDRRQLYRH
            ||||||||||||||||||||||||||||||||||||||:|||||||||||||:||| ||
a006        MLLVLEFWVGVSAVGILALFLWLLPRFAAISENLYFRLkNSLERDNHFIRKGDERQLDRH
                   10        20        30        40        50        60

                   70        80        90       100       110       120
m006.pep    YGLLARLRVLISNREAFGYLCVGTAMGILFGFAFVMMTLKGYSSAGHVYSVGTYLWMFAM
            |||||||||||||||||||||||||||||||||||||||||||||||||||||||||||:
a006        YGLLARLRVLISNREAFGYLCVGTAMGILFGFAFVMMTLKGYSSAGHVYSVGTYLWMFAI
                   70        80        90       100       110       120
                  130       140       150
m006.pep    SLDDVPRLVEQYSNLKDIGQRIEWSERNIKAGTX
            |||||||||||||||||||||||||:||||||||
a006        SLDDVPRLVEQYSNLKDIGQRIEWSKRNIKAGTX
                  130       140       150
```

Computer analysis of this amino acid sequence gave the following results:

Homology with a predicted ORF from *N. gonorrhoeae*

ORF 006 shows 95.4% identity over a 153 aa overlap with a predicted ORF (ORF 006.ng) from *N. gonorrhoeae*:

```
m006/g006

                   10        20        30        40        50        60
m006.pep   MLLVLEFWVGVSAVGILALFLWLLPRFAAISENLYFRLNNSLERDNHFIRKGDRRQLYRH
           |||||||| |||||||||||||||||||||||||||||||||||||||||||||:||||||
g006       MLLVLEFWFGVSAVGILALFLWLLPRFAAISENLYFRLkNSLERDNHFIRKGDERQLDRH
                   10        20        30        40        50        60

                   70        80        90       100       110       120
m006.pep   YGLLARLRVLISNREAFGYLCVGTAMGILFGFAFVMMTLKGYSSAGHVYSVGTYLWMFAM
           |||::||||||||||||||||||||||||||||||||||||||||||||||||||||||||||||||||||||||||||||||||:||||||||||||||||||:||||:||||||||||||
g006       YGLVSRLRVLISNREAFGYLCVGAAMGILFGFAFVMMTLKGYGSAGHIYSVGTYLWMFAM
                   70        80        90       100       110       120

                  130       140       150
m006.pep   SLDDVPRLVEQYSNLKDIGQRIEWSERNIKAGTX
           |||||||||||||||||||||||||||||||||
g118       SLDDVPRLVEQYSNLKDIGQRIEWSERNIKAGT
                  130       140       150
```

The following partial DNA sequence was identified in *N. gonorrhoeae* <SEQ ID 31>:

g006-1.seq

```
  1 ATGTGGAAAA TGTTGAAACA CATAGCCAAA ACCCACCGCA AGCGATTGAT
 51 TGGCACATTT TCCCCGGTCG GACTGGAAAA CCTTTTGATG CTGGGGTATC
101 CGGTGTTTGG CGGCTGGGCG ATTAATGCCG TGATTGCGGG GAGGGTGTGG
151 CAGGCGTTGC TGTACGCTTT GGTTGTATTT TTGATGTGGC TGGTCGGTGC
201 GGCACGGCGG ATTGCCGATA CGCGCACGTT TACGCGGATT TATACCGAAA
251 TCGCCGTGCC GGTTGTGTTG GAACAACGGC AGCGGCAAGT CCCGCATTCA
301 GCGGTAACTG CACGGGTTGC CCTGTCGCGT GAATTTGTCA GCTTTTTTGA
351 AGAACACCTG CCGATTGCCG CGACATCCGT CGTATCCATA TTCGGCGCGT
401 GCATCATGCT GCTGGTGCTG GAATTTTGGG TCGGCGTGTC GGCGGTGGGC
451 ATACTTGCGT TGTTTTTATG GCTTTTGCCA CGTTTTGCCG CCATCAGCGA
501 AAACCTGTAT TTCCGCCTGA ACAACAGCTT GGAACGCGAC AACCACTTTA
551 TCCGAAAAGG CGACGAGCGG CAGCTGTACC GCCATTACGG ACTGGTTTCG
601 CGCCTGCGTG TGCTGATTTC CAACCGCGAA GCCTTCGGCT ATCTCTGCGT
651 CGGCGCGGCG ATGGGTATTT TGTTCGGCTT TGCTTTTGTG ATGATGACGC
701 TCAAAGGCTA CGGCAGCGCG GGGCATATTT ATTCGGTCGG CACTTATCTG
751 TGGATGTTTG CCATGAGTTT GGACGATGTG CCGCGATTGG TCGAACAATA
801 TTCCAATTTG AAAGACATCG GACAACGGAT AGAGTGGTCG GAACGGAACA
851 TCAAAGCCGG AACTTGA
```

This corresponds to the amino acid sequence <SEQ ID 32; ORF 006-1.ng>:

g006-1.pep

```
  1 MWKMLKHIAK THRKRLIGTF SPVGLENLLM LGYPVFGGWA INAVIAGRVW
 51 QALLYALVVF LMWLVGAARR IADTRTFTRI YTEIAVPVVL EQRQRQVPHS
101 AVTARVALSR EFVSFFEEHL PIAATSVVSI FGACIMLLVL EFWVGVSAVG
151 ILALFLWLLP RFAAISENLY FRLNNSLERD NHFIRKGDER QLYRHYGLVS
```

-continued

```
201 RLRVLISNRE AFGYLCVGAA MGILFGFAFV MMTLKGYGSA GHIYSVGTYL

251 WMFAMSLDDV PRLVEQYSNL KDIGQRIEWS ERNIKAGT*
```

The following partial DNA sequence was identified in *N. meningitidis* <SEQ ID 33>:

m006-1.seq

```
  1 ATGTGGAAAA TGTTGAAACA CATAGCCCAA ACCCACCGCA AGCGATTGAT

 51 TGGCACATTT TCCCTGGTCG GACTGGAAAA CCTTTTGATG CTGGTGTATC

101 CGGTGTTTGG CGGCCGGGCG ATCAATGCCG TGATTGCGGG GGAGGTGTGG

151 CAGGCGTTGC TGTACGCTTT GGTTGTGCTT TTGATGTGGC TGGTCGGTGC

201 GGTGCGGCGG ATTGCCGATA CGCGCACGTT TACGCGGATT TATACCGAAA

251 TCGCCGTGCC GGTCGTGTTG GAACAGCGGC AGCGACAAGT CCCGCATTCG

301 GCGGTAACTG CGCGGGTTGC CCTGTCGCGT GAGTTTGTCA GCTTTTTTGA

351 AGAACACCTG CCGATTGCCG CGACATCCGT CGTATCCATA TTCGGCGCGT

401 GCATCATGCT GCTGGTGCTG GAATTTTGGG TCGGCGTGTC GGCGGTGGGC

451 ATACTTGCGT TGTTTTTATG GCTTTTGCCA CGTTTTGCCG CCATCAGCGA

501 AAACCTGTAT TTCCGCCTGA ACAACAGCTT GGAACGCGAC AACCACTTTA

551 TCCGAAAAGG CGACCGGCGG CAGCTGTACC GCCATTACGG ACTGCTTGCG

601 CGCCTGCGTG TGCTGATTTC CAACCGCGAA GCCTTCGGCT ATCTCTGCGT

651 CGGCACGGCG ATGGGTATTT TGTTCGGCTT TGCTTTTGTG ATGATGACGC

701 TCAAAGGCTA CAGCAGCGCG GGGCATGTCT ATTCGGTCGG CACTTATCTG

751 TGGATGTTTG CCATGAGTTT GGACGACGTG CCGCGATTGG TCGAACAATA

801 TTCCAATTTG AAAGACATCG GACAACGGAT AGAGTGGTCG GAACGGAACA

851 TCAAAGCCGG AACTTGA
```

This corresponds to the amino acid sequence <SEQ ID 34; ORF 006-1>:

m006-1.pep

```
  1 MWKMLKHIAQ THRKRLIGTF SLVGLENLLM LVYPVFGGRA INAVIAGEVW

 51 QALLYALVVL LMWLVGAVRR IADTRTFTRI YTEIAVPVVL EQRQRQVPHS

101 AVTARVALSR EFVSFFEEHL PIAATSVVSI FGACIMLLVL EFWVGVSAVG

151 ILALFLWLLP RFAAISENLY FRLNNSLERD NHFIRKGDRR QLYRHYGLLA

201 RLRVLISNRE AFGYLCVGTA MGILFGFAFV MMTLKGYSSA GHVYSVGTYL

251 WMFAMSLDDV PRLVEQYSNL KDIGQRIEWS ERNIKAGT*
```

m006-1/g006-1 95.5% identity in 288 aa overlap

```
                         10        20        30        40        50        60
m006-1.pep      MWKMLKHIAQTHRKRLIGTFSLVGLENLLMLVYPVFGGRAINAVIAGEVWQALLYALVVL
                |||||||||:||||||||||| |||||||||| |||||| ||||||||:||||||||||:
g006-1          MWKMLKHIAKTHRKRLIGTFSPVGLENLLMLGYPVFGGWAINAVIAGRVWQALLYALVVF
                         10        20        30        40        50        60
```

-continued

```
                        70        80        90       100       110       120
m006-1.pep      LMWLVGAVRRIADTRTFTRIYTEIAVPVVLEQRQRQVPHSAVTARVALSREFVSFFEEHL
                |||||||:||||||||||||||||||||||||||||||||||||||||||||||||||||
g006-1          LMWLVGAARRIADTRTFTRIYTEIAVPVVLEQRQRQVPHSAVTARVALSREFVSFFEEHL
                        70        80        90       100       110       120

                       130       140       150       160       170       180
m006-1.pep      PIAATSVVSIFGACIMLLVLEFWVGVSAVGILALFLWLLPRFAAISENLYFRLNNSLERD
                ||||||||||||||||||||||||||||||||||||||||||||||||||||||||||||
g006-1          PIAATSVVSIFGACIMLLVLEFWVGVSAVGILALFLWLLPRFAAISENLYFRLNNSLERD
                       130       140       150       160       170       180

                       190       200       210       220       230       240
m006-1.pep      NHFIRKGDRRQLYRHYGLLARLRVLISNREAFGYLCVGTAMGILFGFAFVMMTLKGYSSA
                ||||||||:|||||||||::||||||||||||||||||:||||||||||||||||||:||
g006-1          NHFIRKGDERQLYRHYGLVSRLRVLISNREAFGYLCVGAAMGILFGFAFVMMTLKGYGSA
                       190       200       210       220       230       240

                       250       260       270       280      289
m006-1.pep      GHVYSVGTYLWMFAMSLDDVPRLVEQYSNLKDIGQRIEWSERNIKAGTX
                ||:||||||||||||||||||||||||||||||||||||||||||||||
g006-1          GHIYSVGTYLWMFAMSLDDVPRLVEQYSNLKDIGQRIEWSERNIKAGTX
                       250       260       270       280
```

The following partial DNA sequence was identified in *N. meningitidis* <SEQ ID 35>:

a006-1.seq (partial)

```
  1 ..AGCCAAAACC ACCGCAAGCG ATTGATTGGC ACATTTTTTC TGGTCGGACT
 51   GGAAAACCTT TTGATGCTGG TGTATCCGGT GTTTGGCGGC TGGGCGATTA
101   ATGCCGTGAT TGCGGGGCAG GCGTGGCAGG CGTTGCTGTA CGCTTTGGTT
151   GTGCTTTTGA TGTGGCTGGT CGGTGCGGCG CGGCGGATTG CCGATACGCG
201   CACGTTTACG CGGATTTATA CCGAAATCGC CGTGCCGGTT GTGTTGGAAC
251   AGCGGCAGCG GCAAGTCCCG CATTCGGCGG TAACTGCGCG GGTTGCCCTG
301   TCGCGTGAGT TTGTCAGCTT TTTTGAAGAA CACCTGCCGA TTGCCGCGAC
351   ATCCGTCGTA TCCATATTCG GCGCGTGCAT CATGCTGCTG GTGCTGGAAT
401   TTTGGGTCGG CGTGTCGGCG GTGGGCATAC TTGCGTTGTT TTTATGGCTT
451   TTGCCACGTT TTGCCGCCAT CAGCGAAAAC CTGTATTTCC GCCTGAAGAA
501   CAGCTTGGAA CGCGACAACC ACTTTATCCG AAAAGGCGAC GAGCGGCAGC
551   TGGACCGCCA TTACGGACTG CTTGCGCGCC TGCGTGTGCT GATTTCCAAC
601   CGCGAAGCCT TCGGCTATCT CTGCGTCGGC ACGGCGATGG GTATTTTGTT
651   CGGCTTTGCT TTTGTGATGA TGACGCTCAA AGGCTACAGC AGCGCGGGGC
701   ATGTCTATTC GGTCGGCACT TATCTGTGGA TGTTTGCCAT AAGTTTGGAC
751   GACGTGCCGC GATTGGTCGA ACAATATTCC AATTTGAAAG ACATCGGACA
801   ACGGATAGAG TGGTCGAAAC GGAACATCAA AGCCGGAACT TGA
```

This corresponds to the amino acid sequence <SEQ ID 36; ORF 006-1.a>:

a006-1.pep (partial)

```
  1 ..SQNHRKRLIG TFFLVGLENL LMLVYPVFGG WAINAVIAGQ AWQALLYALV
 51   VLLMWLVGAA RRIADTRTFT RIYTEIAVPV VLEQRQRQVP HSAVTARVAL
101   SREFVSFFEE HLPIAATSVV SIFGACIMLL VLEFWVGVSA VGILALFLWL
151   LPRFAAISEN LYFRLKNSLE RDNHFIRKGD ERQLDRHYGL LARLRVLISN
```

-continued

```
201  REAFGYLCVG TAMGILFGFA FVMMTLKGYS SAGHVYSVGT YLWMFAISLD

251  DVPRLVEQYS NLKDIGQRIE WSKRNIKAGT *
```

a006-1/m006-1 95.7% identity in 280 aa overlap

```
                              10        20        30        40        50
a006-1.pep            SQNHRKRLIGTFFLVGLENLLMLVYPVFGGWAINAVIAGQAWQALLYALVVL
                      :|:||||||||| ||||||||||||||||| |||||||||::|||||||||||
m006-1        MWKMLKHIAQTHRKRLIGTFSLVGLENLLMLVYPVFGGRAINAVIAGEVWQALLYALVVL
                      10        20        30        40        50        60

                      60        70        80        90       100       110
a006-1.pep    LMWLVGAARRIADTRTFTRIYTEIAVPVVLEQRQRQVPHSAVTARVALSREFVSFFEEHL
              |||||||:||||||||||||||||||||||||||||||||||||||||||||||||||||
m006-1        LMWLVGAVRRIADTRTFTRIYTEIAVPVVLEQRQRQVPHSAVTARVALSREFVSFFEEHL
                      70        80        90       100       110       120

                     120       130       140       150       160       170
a006-1.pep    PIAATSVVSIFGACIMLLVLEFWVGVSAVGILSLFLWLLPRFAAISENLYFRLKNSLERD
              |||||||||||||||||||||||||||||||||||||||||||||||||||||:||||||
m006-1        PIAATSVVSIFGACIMLLVLEFWVGVSAVGILSLFLWLLPRFAAISENLYFRLNNSLERD
                     130       140       150       160       170       180

                     180       190       200       210       220       230
a006-1.pep    NHFIRKGDERQLDRHYGLLARLRVLISNREAFGYLCVGTAMGILFGFAFVMMTLKGYSSA
              ||||||||:||| |||||||||||||||||||||||||||||||||||||||||||||||
m006-1        NHFIRKGDRRQLYRHYGLLARLRVLISNREAFGYLCVGTAMGILFGFAFVMMTLKGYSSA
                     190       200       210       220       230       240
                     240       250       260       270       280
a006-1.pep    GHVYSVGTYLWMFAISLDDVPRLVEQYSNLKDIGQRIEWSKRNIKAGTX
              ||||||||||||||:|||||||||||||||||||||||||:||||||||
m006-1        GHVYSVGTYLWMFAMSLDDVPRLVEQYSNLKDIGQRIEWSERNIKAGTX
                     250       260       270       280
```

The following partial DNA sequence was identified in *N. gonorrhoeae* <SEQ ID 37>:

g007.seq

```
  1 atgaACACAA CCCGACTGCC GACCGCCTTC ATCTTGTGCT GCCTCTGcgC

 51 CGCcGCTTCT GCCGccgaca acAGCatcat gaCaAAAGGG CAAAAAGTGT

101 ACGAATCcAa ctGCATCGCC TGCCACGGCA AGAAAGGGGA AGGGCGCGGC

151 ACTGCGtTTC CTccgctTTT CCggtcgGac tgtattatga acaAACCGCa

201 cgTCCtgctg cacagcatgg tcaaaggcAt cgacgggaca ttcaaagtgg

251 agcggcaaaa cctacgacgg atttatgCcc gcaaccgcca tcagcgATGC

301 GGACATTGCC GCCGTCGCCA CTTATATCAT GAACGCCTTT GA
```

This corresponds to the amino acid sequence <SEQ ID 38; ORF 007.ng>:

g007.pep

```
  1 MNTTRLPTAF ILCCLCAAAS AADNSIMTKG QKVYESNCIA CHGKKGEGRG

 51 TAFPPLFRSD CIMNKPHVLL HSMVKGIDGT FKVERQNLRR IYARNRHQRC

101 GHCRRRHLYH ERL*
```

The following partial DNA sequence was identified in *N. meningitidis* <SEQ ID 39>:

m007.seq

```
  1 ATGAACACAA CCCGACTGCC GACCGCCCTC GTCTTGGGCT GCTTCTGCGC
 51 CGCCGCTTCT GCCGCCGACA ACAGCATCAT GACAAAAGGG CAAAAAGTGT
101 ACGAATCCAA CTGCGTCGCC TGCCACGGCA AAAAGGGCGA AGGCCGCGGA
151 ACCATGTTTC CGCCGCTCTA CCGCTCCGAC TTCATCATGA AAAAACCGCA
201 GGTGCTGCTG CACAGCATGG TCAAAGGCAT CAACGGTACA ATCAAAGTC.
251 AACGGCAAAA CCTACAACGG ATTCATGCCC GCAACCGCCA TCAGCGATGC
301 GGACATTGCC GCCGTCGCCA CTTATATCAT GAACGCCTTT GA
```

This corresponds to the amino acid sequence <SEQ ID 40; ORF 007>:

m007.pep

```
  1 MNTTRLPTAL VLGCFCAAAS AADNSIMTKG QKVYESNCVA CHGKKGEGRG
 51 TMFPPLYRSD FIMKKPQVLL HSMVKGINGT IKVXRQNLQR IHARNRHQRC
101 GHCRRRHLYH ERL*
```

The following partial DNA sequence was identified in *N. meningitidis* <SEQ ID 41>:

a007.seq

```
  1 ATGAACACAA CCCGACTGCC GACCGCCCTC GTCTTGGGCT GCCTCTGCGC
 51 CGCCGCTTCT GCCGCCGACA ACAGCATCAT GACAAAAGGG CAAAAAGTGT
101 ACGAATCCAA CTGCGTCGCC TGCCACGGCA AAAAGGGCGA AGGCCGCGGA
151 ACCATGTTTC CGCCGCTCTA CCGCTCCGAC TTCATCATGA AAAAACCGCA
201 GGTGCTGCTG CACAGCATGG TCAAAGGCAT CAACGGTACA ATCAAAGTC.
251 AACGGCAAAA CCTACAACGG ATTCATGCCC GCCACTGCCA TCAGCGATGC
301 GGACATTGCC GCCGTCGCCA CTTATATCAT GAACGCCTTT GA
```

This corresponds to the amino acid sequence <SEQ ID 42; ORF 007.a>:

a007.pep

```
  1 MNTTRLPTAL VLGCLCAAAS AADNSIMTKG QKVYESNCVA CHGKKGEGRG
 51 TMFPPLYRSD FIMKKPQVLL HSMVKGINGT IKVXRQNLQR IHARHCHQRC
101 GHCRRRHLYH ERL*
```

m007/a007 97.3% identity over a 113 aa overlap

```
                  10        20        30        40        50        60
m007.pep   MNTTRLPTALVLGCFCAAASAADNSIMTKGQKVYESNCVACHGKKGEGRGTMFPPLYRSD
           ||||||||||||||:|||||||||||||||||||||||||||||||||||||||||||||
a007       MNTTRLPTALVLGCLCAAASAADNSIMTKGQKVYESNCVACHGKKGEGRGTMFPPLYRSD
                  10        20        30        40        50        60
```

-continued

```
                 70         80         90        100        110
m007.pep   FIMKKPQVLLHSMVKGINGTIKVXRQNLQRIHARNRHQRCGHCRRRHLYHERLX
           ||||||||||||||||||||||||||||||||||: ||||||||||||||||||
g007       FIMKKPQVLLHSMVKGINGTIKVXRQNLQRIHARHCHQRCGHCRRRHLYHERLX
                 70         80         90        100        110
```

Computer analysis of this amino acid sequence gave the following results:

Homology with a predicted ORF from *N. gonorrhoeae*

ORF 007 shows 86.7% identity over a 113 aa overlap with a predicted ORF (ORF 007.ng) from *N. gonorrhoeae*:

```
m007/g007

                 10         20         30         40         50         60
m007.pep   MNTTRLPTALVLGCFCAAASAADNSIMTKGQKVYESNCVACHGKKGEGRGTMFPPLYRSD
           ||||||||::|  |:|||||||||||||||||||||||:||||||||||||| ||||:|||
g007       MNTTRLPTAFILCCLCAAASAADNSIMTKGQKVYESNCIACHGKKGEGRGTAFPPLFRSD
                 10         20         30         40         50         60

                 70         80         90        100        110
m007.pep   FIMKKPQVLLHSMVKGINGTIKVXRQNLQRIHARNRHQRCGHCRRRHLYHERLX
            ||:||:||||||||||:||:|| ||||:||:|||||||||||||||||||||
g007       CIMNKPHVLLHSMVKGIDGTFKVERQNLRRIYARNRHQRCGHCRRRHLYHERL
                 70         80         90        100        110
```

The following partial DNA sequence was identified in *N. gonorrhoeae* <SEQ ID 43>:

```
g007-1.seq (partial)

  1 ATGAACACAA CCCGACTGCC GACCGCCTTC ATCTTGTGCT GCCTCTGCGC

 51 CGCCGCTTCT GCCGCCGACA ACAGCATCAT GACAAAAGGG CAAAAAGTGT

101 ACGAATCCAA CTGCATCGCC TGCCACGGCA AGAAAGGGGA AGGGCGCGGC

151 ACTGCGTTTC CTCCGCTTTT CCGGTCGGAC TATATTATGA ACAAACCGCA

201 CGTCCTGCTG CACAGCATGG TCAAAGGCAT CAACGGTACA ATCAAAGTCA

251 ACGGCAAAAC CTACAACGGA TTCATGCCCG CAACCGCCAT CAGCGATGCG

301 GACATTGCCG CCGTCGCCAC TTATATCATG AACGCCTTTG ACAACGGCGG

351 CGGAAGCGTT ACCGAAAAAG ACGTAAAACA GGCAAAAGGC AAAAAAAAC.
```

This corresponds to the amino acid sequence <SEQ ID 44; ORF 007-1.ng>:

```
g007-1.pep (partial)

  1 MNTTRLPTAF ILCCLCAAAS AADNSIMTKG QKVYESNCIA CHGKKGEGRG

 51 TAFPPLFRSD YIMNKPHVLL HSMVKGINGT IKVNGKTYNG FMPATAISDA

101 DIAAVATYIM NAFDNGGGSV TEKDVKQAKG KKN...
```

The following partial DNA sequence was identified in *N. meningitidis* <SEQ ID 45>:

m007-1.seq

```
  1 ATGAACACAA CCCGACTGCC GACCGCCCTC GTCTTGGGCT GCTTCTGCGC
 51 CGCCGCTTCT GCCGCCGACA ACAGCATCAT GACAAAAGGG CAAAAAGTGT
101 ACGAATCCAA CTGCGTCGCC TGCCACGGCA AAAAGGGCGA AGGCCGCGGA
151 ACCATGTTTC CGCCGCTCTA CCGCTCCGAC TTCATCATGA AAAAACCGCA
201 GGTGCTGCTG CACAGCATGG TCAAAGGCAT CAACGGTACA ATCAAAGTCA
251 ACGGCAAAAC CTACAACGGA TTCATGCCCG CAACCGCCAT CAGCGATGCG
301 GACATTGCCG CCGTCGCCAC TTATATCATG AACGCCTTTG ACAACGGCGG
351 CGGAAGCGTT ACCGAAAAAG ACGTAAAACA GGCAAAAAGC AAAAAAAACT
401 AA
```

This corresponds to the amino acid sequence <SEQ ID 46; ORF 007-1> m007-1.pep

```
  1 MNTTRLPTAL VLGCFCAAAS AADNSIMTKG QKVYESNCVA CHGKKGEGRG
 51 TMFPPLYRSD FIMKKPQVLL HSMVKGINGT IKVNGKTYNG FMPATAISDA
101 DIAAVATYIM NAFDNGGGSV TEKDVKQAKS KKN*
```

m007-1/g007-1 91.7% identity in 133 aa overlap

```
                       10        20        30        40        50        60
m007-1.pep    MNTTRLPTALVLGCFCAAASAADNSIMTKGQKVYESNCVACHGKKGEGRGTMFPPLYRSD
              |||||||||::| |:|||||||||||||||||||||||:|||||||||||| ||||:|||
g007-1        MNTTRLPTAFILCCLCAAASAADNSIMTKGQKVYESNCIACHGKKGEGRGTAFPPLFRSD
                       10        20        30        40        50        60

                       70        80        90       100       110       120
m007-1.pep    FIMKKPQVLLHSMVKGINGTIKVNGKTYNGFMPATAISDADIAAVATYIMNAFDNGGGSV
              :||:||:|||||||||||||||||||||||||||||||||||||||||||||||||||||
g007-1        YIMNKPHVLLHSMVKGINGTIKVNGKTYNGFMPATAISDADIAAVATYIMNAFDNGGGSV
                       70        80        90       100       110       120

                      130
m007-1.pep    TEKDVKQAKSKKNX
              |||||||||:|||
g007-1        TEKDVKQAKGKKN
                      130
```

The following partial DNA sequence was identified in *N. meningitidis* <SEQ ID 47>:

a007-1.seq (partial)

```
  1 ATGAACACAA CCCGACTGCC GACCGCCCTC GTCTTGGGCT GCCTCTGCGC
 51 CGCCGCTTCT GCCGCCGACA ACAGCATCAT GACAAAAGGG CAAAAAGTGT
101 ACGAATCCAA CTGCGTCGCC TGCCACGGCA AAAAGGGCGA AGGCCGCGGA
151 ACCATGTTTC CGCCGCTCTA CCGCTCCGAC TTCATCATGA AAAAACCGCA
201 GGTGCTGCTG CACAGCATGG TCAAAGGCAT CAACGGTACA ATCAAAGTCA
251 ACGGCAAAAC CTACAACGGA TTCATGCCCG CCACTGCCAT CAGCGATGCG
301 GACATTGCCG CCGTCGCCAC TTATATCATG AACGCCTTTG ACAACGGCGG
351 CGGAAGCGTT ACCGAAAAAG ACGTAAAACA GGCAAAAAAC AAAAAA..
```

This corresponds to the amino acid sequence <SEQ ID 48; ORF 007-1.a>:

a007-1.pep (partial)

```
  1 MNTTRLPTAL VLGCLCAAAS AADNSIMTKG QKVYESNCVA CHGKKGEGRG
 51 TMFPPLYRSD FIMKKPQVLL HSMVKGINGT IKVNGKTYNG FMPATAISDA
101 DIAAVATYIM NAFDNGGGSV TEKDVKQAIN KK..
```

m007-1/a007-1 98.5% identity in 132 aa overlap

```
                     10        20        30        40        50        60
m007-1.pep  MNTTRLPTALVLGCFCAAASAADNSIMTKGQKVYESNCVACHGKKGEGRGTMFPPLYRSD
            ||||||||||||||:|||||||||||||||||||||||||||||||||||||||||||||
a007-1      MNTTRLPTALVLGCLCAAASAADNSIMTKGQKVYESNCVACHGKKGEGRGTMFPPLYRSD
                     10        20        30        40        50        60

                     70        80        90       100       110       120
m007-1.pep  FIMKKPQVLLHSMVKGINGTIKVNGKTYNGFMPATAISDADIAAVATYIMNAFDNGGGSV
            ||||||||||||||||||||||||||||||||||||||||||||||||||||||||||||
a007-1      FIMKKPQVLLHSMVKGINGTIKVNGKTYNGFMPATAISDADIAAVATYIMNAFDNGGGSV
                     70        80        90       100       110       120

                    130
m007-1.pep  TEKDVKQAKSKKNX
            |||||||||:||
a007-1      TEKDVKQAKNKK
                    130
```

The following partial DNA sequence was identified in *N. gonorrhoeae* <SEQ ID 49>:

g008.seq

```
  1 ATGAACAACA GACATTTTGC CGTCAtcgCC TTGGGCAGCA ACCTTGACAA
 51 CCCCGCACAA CAAATacgcg gcgcattaga cgcgctctcg tcccatcctg
101 acatccggct tgaaCaggtt tcctcactgt aTatgaccgc acctgtcggt
151 tacgAcaaTC agcccgATTT CATCaatgcc gTCTgcaccg TTTCCACCAC
201 CtTGGACGGC ATTGcccTGC TTGCCgaACT CAAccgTATC GAAGCCGATT
251 TCGGACGCGA aCGCAGTTTC CGCAATGCAC CGCGCACATT GGATTTGGAC
301 ATTATCGACT TTGACGGCAT CTCCAGCGAC GACCCCCGCC TTACCCTGCC
351 GCATCCGCGC GCGCACGAAC GCAGTTTCGT CATACGCCCT TTGGCAGAAA
401 TCCTCCCTGA TTTTATTTTG GGAAAATACG GAAAGGTTGT CGAATTGTCA
451 AAACGGCTGG GCAATCAAGG CATCCGTCTT TTACCGGACA GGTAA
```

This corresponds to the amino acid sequence <SEQ ID 50; ORF 008.ng>:

g008.pep

```
  1 MNNRHFAVIA LGSNLDNPAQ QIRGALDALS SHPDIRLEQV SSLYMTAPVG
 51 YDNQPDFINA VCTVSTTLDG IALLAELNRI EADFGRERSF RNAPRTLDLD
101 IIDFDGISSD DPRLTLPHPR AHERSFVIRP LAEILPDFIL GKYGKVVELS
151 KRLGNQGIRL LPDR*
```

The following partial DNA sequence was identified in *N. meningitidis* <SEQ ID 51>:

m008.seq

```
  1 ATGAACAACA GACATTTTGC CGTCATCGCC CTGGGCAGTA ATCTTGAAAA
 51 CCCTGCTCAA CAGGTACGCG CCGCATTGGA CACGCTGTCG TCCCATCCTG
101 ACATCCGTCT TAAACAGGCT TCCTCACTGT ATATGACCGC GCCCGTCGGT
151 TACGACAATC AGCCCGATTT TGTCAATGCC GTCTGCACCG TTTCCACCAC
201 TCTGGACGGC ATTGCCyTGC TTGCCGAACT CAACCGTATC GAGGCTGATT
251 TCGGACGCGA ACGCAGCTTC CGCAACGCGC CGCGCACATT GkATTTGGAC
301 ATTATCGACT TTGACGGCAT CTCCAGCGAC GACACsCGAC TcACCtTGCC
351 GCATCCGCGC GCGCACGAAC GCAGTTTCGT CATCCGCCCT TTGGCAGAAA
401 TCCTCCCTGA TTTTGTTTTA GGAAAACACG GAAAGGTTGC CGAATTGTCA
451 AAACGGyTGG GCAATCAAGG TATCCGTCTT TTACCGGACA GGTAATT
```

This corresponds to the amino acid sequence <SEQ ID 52; ORF 008>:

m008.pep

```
  1 MNNRHFAVIA LGSNLENPAQ QVRAALDTLS SHPDIRLKQA SSLYMTAPVG
 51 YDNQPDFVNA VCTVSTTLDG IALLAELNRI EADFGRERSF RNAPRTLXLD
101 IIDFDGISSD DTRLTLPHPR AHERSFVIRP LAEILPDFIL GKHGKVAELS
151 KRLGNQGIRL LPDR*
```

The following partial DNA sequence was identified in *N. meningitidis*<SEQ ID 53>:

a008.seq

```
  1 ATGAACAACA GACATTTTGC CGTCATCGCC CTGGGCAGTA ATCTTGAAAA
 51 CCCTGCCCAA CAGGTACGCG CCGCATTGGA CACGCTGTCG TCCCATCCTG
101 ACATCCGTCT TAAACAGGCT TCCTCACTGT ATATGACCGC GCCCGTCGGT
151 TACGACAATC AGCCCGATTT CGTCAATGCC GTCTGCACCG TTTCCACCAC
201 CTTGGACGGC ATTGCCCTGC TTGCCGAACT CAACCGTATC GAAGCCGATT
251 TCGGACGCGA ACGCAGCTTC CGCAACGCGC CGCGCACATT GGATTTGGAC
301 ATTATCGACT TTGACGGCAT CTCCAGCGAC GACCCCCGAC TCACCCTGCC
351 GCATCCGCGC GCGCACGAAC GCAGTTTCGT CATACGCCCT TTGGCAGAAA
401 TCCTCCCTGA TTTTATTTTG GGAAAACACG GAAAGGTTGC CGAATTGTCA
451 AAACGGCTGG GCAATCAAGG CATCCGTCTT TTACCGGATA AGTAA
```

This corresponds to the amino acid sequence <SEQ ID 54; ORF 008.a>:

a008.pep

```
  1 MNNRHFAVIA LGSNLENPAQ QVRAALDTLS SHPDIRLKQA SSLYMTAPVG
 51 YDNQPDFVNA VCTVSTTLDG IALLAELNRI EADFGRERSF RNAPRTLDLD
```

-continued

```
101 IIDFDGISSD DPRLTLPHPR AHERSFVIRP LAEILPDFIL GKHGKVAELS

151 KRLGNQGIRL LPDK*
```

m008/a008 97.6% identity over a 164 aa overlap

```
                    10        20        30        40        50        60
m008.pep  MNNRHFAVIALGSNLENPAQQVRAALDTLSSHPDIRLKQASSLYMTAPVGYDNQPDFVNA
          ||||||||||||||||||||||||||||||||||||||||||||||||||||||||||||
a008      MNNRHFAVIALGSNLENPAQQVRAALDTLSSHPDIRLKQASSLYMTAPVGYDNQPDFVNA
                    10        20        30        40        50        60
                    70        80        90       100       110       120
m008.pep  VCTVSTTLDGIALLAELNRIEADFGRERSFRNAPRTLXLDIIDFDGISSDDTRLTLPHPR
          |||||||||||||||||||||||||||||||||||| |||||||||||||| ||||||||
a008      VCTVSTTLDGIALLAELNRIEADFGRERSFRNAPRTLDLDIIDFDGISSDDPRLTLPHPR
                    70        80        90       100       110       120

                   130       140       150       160
m008.pep  AHERSFVIRPLAEILPDFVLGKHGKVAELSKRLGNQGIRLLPDRX
          ||||||||||||||||||:|||||||||||||||||||||||:|
a008      AHERSFVIRPLAEILPDFILGKHGKVAELSKRLGNQGIRLLPDKX
                   130       140       150       160
```

Computer analysis of this amino acid sequence gave the following results:

Homology with a predicted ORF from *N. gonorrhoeae*

ORF 008 shows 92.7% identity over a 164 aa overlap with a predicted ORF (ORF008.ng) from *N. gonorrhoeae*:

```
m008/g008

                    10        20        30        40        50        60
m008.pep  MNNRHFAVIALGSNLENPAQQVRAALDTLSSHPDIRLKQASSLYMTAPVGYDNQPDFVNA
          |||||||||||||||:|||||:|:|||:|||||||||:|:||||||||||||||||:|||
g008      MNNRHFAVIALGSNLDNPAQQIRGALDALSSHPDIRLEQVSSLYMTAPVGYDNQPDFINA
                    10        20        30        40        50        60
                    70        80        90       100       110       120
m008.pep  VCTVSTTLDGIALLAELNRIEADFGRERSFRNAPRTLXLDIIDFDGISSDDTRLTLPHPR
          |||||||||||||||||||||||||||||||||||| |||||||||||||| ||||||||
g008      VCTVSTTLDGIALLAELNRIEADFGRERSFRNAPRTLDLDIIDFDGISSDDPRLTLPHPR
                    70        80        90       100       110       120
                   130       140       150       160
m008.pep  AHERSFVIRPLAEILPDFVLGKHGKVAELSKRLGNQGIRLLPDRX
          ||||||||||||||||||:|||:|||:||||||||||||||||
g008      AHERSFVIRPLAEILPDFILGKYGKVVELSKRLGNQGIRLLPDRX
                   130       140       150       160
```

The following partial DNA sequence was identified in *N. gonorrhoeae* <SEQ ID 55>:

```
g009.seq

  1 ATGCCCCGCG CTGCCGTAGC CTTTGAGCGT CATCATCACA AAAGCAAAGC

 51 CGAACAAAAT ACCCATCGCC GCGCCGACGC AGAGATAGCC GAAGGCTTCG

101 CGGTTGGAAA TCAGCACACG CAGGCGCGAA ACCAGTCCGT AATGGCGGTA

151 CAGCTGCCGC TCGTCGCCTT TTCGGATAAA GTGGTTGTcg cGTTCCAAGC

201 TGTTGTTCAG GCGGAAATAC AGGTTTTCGC TGATGGCGGC AAAACGTGGC

251 AaaaGCCATA A
```

This corresponds to the amino acid sequence <SEQ ID 56; ORF 009.ng>:

g009.pep

```
  1 MPRAAVAFER HHHKSKAEQN THRRADAEIA EGFAVGNQHT QARNQSVMAV

 51 QLPLVAFSDK VVVAFQAVVQ AEIQVFADGG KTWQKP*
```

The following partial DNA sequence was identified in *N. meningitidis* <SEQ ID 57>:

m009.seq

```
  1 ATGCCCCGCG CTGCTGTAGC CTTTGAGCGT CATCATCACA AAAGCAAAGC

 51 CGAACAAAAT ACCCATCGCC GTGCCGACGC AGAGATAGCC GAAGGCTTCG

101 CGGTTGGAAA TCAGCACACG CAGGCGCGCA AGCAGTCCGT AATGGCGGTA

151 CAGCTGCCGC CGGTCGCCTT TTCGGATAAA GTGGTTGTCG CGTTCCAAGC

201 TGTTGTTCAG GCGGAAATAC AGGTTTTCGC TGATGGCGGC AAAACGTGGC

251 AAAAGCCATA A
```

This corresponds to the amino acid sequence <SEQ ID 58; ORF 009>:

m009.pep

```
  1 MPRAAVAFER HHHKSKAEQN THRRADAEIA EGFAVGNQHT QARKQSVMAV

51 QLPPVAFSDK VVVAFQAVVQ AEIQVFADGG KTWQKP*
```

Computer analysis of this amino acid sequence gave the following results:

Homology with a predicted ORF from *N. gonorrhoeae*

ORF 009 shows 97.7% identity over a 86 aa overlap with a predicted ORF (ORF 009.ng) from *N. gonorrhoeae*:

m009/g009

```
                  10        20        30        40        50        60
m009.pep  MPRAAVAFERHHHKSKAEQNTHRRADAEIAEGFAVGNQHTQARKQSVMAVQLPPVAFSDK
          |||||||||||||||||||||||||||||||||||||||||||:|||||||| ||||||
g009      MPRAAVAFERHHHKSKAEQNTHRRADAEIAEGFAVGNQHTQARNQSVMAVQLPLVAFSDK
                  10        20        30        40        50        60

                  70        80
m009.pep  VVVAFQAVVQAEIQVFADGGKTWQKPX
          |||||||||||||||||||||||||||
g009      VVVAFQAVVQAEIQVFADGGKTWQKPX
                  70        80
```

The following partial DNA sequence was identified in *N. meningitidis* <SEQ ID 59>:

a009.seq

```
  1 ATGCCCCGCG CTGCTGTAGC CTTTGAGCGT CATCATCACA AAAGCAAAGC

 51 CGAACAAAAT ACCCATCGCC GTGCCGACGC AGAGATAGCC GAAGGCTTCG

101 CGGTTGGAAA TCAGCACACG CAGGCGCGCA AGCAGTCCGT AATGGCGGTC

151 CAGCTGCCGC TCGTCGCCTT TTCGGATAAA GTGGTTGTCG CGTTCCAAGC
```

-continued

```
201 TGTTCTTCAG GCGGAAATAC AGGTTTTCGC TGATGGCGGC AAAACGTGGC

251 AAAAGCCATA A
```

This corresponds to the amino acid sequence <SEQ ID 60; ORF 009.a>:

a009.pep

```
  1 MPRAAVAFER HHHKSKAEQN THRRADAEIA EGFAVGNQHT QARKQSVMAV

 51 QLPLVAFSDK VVVAFQAVLQ AEIQVFADGG KTWQKP*
```

m009/a009 97.7% identity over a 86 aa overlap

```
                   10        20        30        40        50        60
m009.pep   MPRAAVAFERHHHKSKAEQNTHRRADAEIAEGFAVGNQHTQARKQSVMAVQLPPVAFSDK
           |||||||||||||||||||||||||||||||||||||||||||||||||||| ||||||
a009       MPRAAVAFERHHHKSKAEQNTHRRADAEIAEGFAVGNQHTQARKQSVMAVQLPLVAFSDK
                   10        20        30        40        50        60

                   70        80
m009.pep   VVVAFQAVVQAEIQVFADGGKTWQKPX
           ||||||||:||||||||||||||||||
a009       VVVAFQAVLQAEIQVFADGGKTWQKPX
                   70        80
```

The following partial DNA sequence was identified in *N. gonorrhoeae* <SEQ ID 61>:

g010.seq

```
  1 ATGGGTTTTC CTGTTCGCAA GTTTGATGCC GTGATTGTCG GCGGTGGCGG

 51 TGCAGGTTTA CGTGCAGCCC TCCAATTATC CAAATCCGGT TTGAATTGTG

101 CCGTTTTGTC TAAAGTGTTC CCGACCCGCT CGCATACCGT AGCGGCGCAG

151 GGCGGTATTT CCGCCTCTCT GGGTAATGTG CAGGAGGACC GTTGGGACTG

201 GCACATGTAC GATACCGTGA AAGGTTCCGA CTGGCTGGGC GACCAAGATG

251 CGATTGAGTT TATGTGTCGC GCTGCGCCTG AAGCGGTGAT TGAGTTGGAA

301 CACATGGGTA TGCCTTTTGA CCGCGTTGAA AGCGGCAAAA TTTATCAGCG

351 TCCTTTCGGC GGACATACTG CCGAACATGG TAAACGTGCG GTAGAACGTG

401 CATGTGCGGT TGCCGACCGT ACCGGTCATG CGATGTTGCA TACTTTGTAC

451 CAACAAAACG TCCGTGCCAA TACACAATTC TTTGTGGAAT GGACGGCGCA

501 AGATTTGATT CGTGATGAAA ACGGCGATGT CGTCGGCGTA ACCGCCATGG

551 AAATGGAAAC GGGCGAAGTT TATATTTTCC ACGCCAAGGC CGTGATGTTT

601 GCTACCGGTG GCGGCGGTCG TATTTATGCT TCTTCTACCA ATGCTTATAT

651 GAATACCGGT GACGGTTTGG GCATTTGCGC CCGTGCGGGC ATTCCGTTGG

701 AAGATATGGA ATTCTGGCAA TTCCACCCGA CCGGCGTGGC GGGTGCGGGC

751 GTGTTGATTA CCGAAGGCGT ACGCGGCGAG GGCGGTATTC TGTTGAacgc

801 cgacggcgaA cgcTTTATGG AAcgctatgc GCcgACCGta aAagaCTTGG

851 CTTCTCGCga cgtGGTTTCA CgcgcGatgG CGatggaAAt ctatgaaggt

901 cgcggctgTG GtaaAAAcaA agaCCacgtC TTACTGAAAA TCGACcAtAt
```

-continued

```
 951 cggtGCAGAA AAAATTATGG AAAAACTGCC GGGCATCCGC GAGATTTCCA

1001 TTCagtttgc cGGTATCGAT CCGATTAAAG ACCCGATTcc ggttgTGCCG

1051 ACTACCCACT ATATGATGGG CGGCATTCcg aCCAATTATC ACGGTGAAGT

1101 TGTTGTTCCG CAAGGCGACG AGTACGAAGT ACCTGTAAAA GGCCTGTATG

1151 CCGCAGGTGA GTGCGCCTGT GCTTCCGTAC ACGGTGCGAA CCGTTTGGGT

1201 ACGAACTCCC TGCTGGACTT GGTGGTGTTC cgcccaaccc cccggtga
```

This corresponds to the amino acid sequence <SEQ ID 62; ORF 010.ng>:

g010.pep

```
  1 MGFPVRKFDA VIVGGGGAGL RAALQLSKSG LNCAVLSKVF PTRSHTVAAQ

 51 GGISASLGNV QEDRWDWHMY DTVKGSDWLG DQDAIEFMCR AAPEAVIELE

101 HMGMPFDRVE SGKIYQRPFG GHTAEHGKRA VERACAVADR TGHAMLHTLY

151 QQNVRANTQF FVEWTAQDLI RDENGDVVGV TAMEMETGEV YIFHAKAVMF

201 ATGGGGRIYA SSTNAYMNTG DGLGICARAG IPLEDMEFWQ FHPTGVAGAG

251 VLITEGVRGE GGILLNADGE RFMERYAPTV KDLASRDVVS RAMAMEIYEG

301 RGCGKNKDHV LLKIDHIGAE KIMEKLPGIR EISIQFAGID PIKDPIPVVP

351 TTHYMMGGIP TNYHGEVVVP QGDEYEVPVK GLYAAGECAC ASVHGANRLG

401 TNSLLDLVVF RPTPR*
```

The following partial DNA sequence was identified in *N. meningitidis* <SEQ ID 63>:

m010.seq (PARTIAL)

```
  1 ..nTCCAATTAT CCAAATCCGG TCTGAATTGT GCCGTTTTGT CTAAAGTGTT

 51   CCCGACCCGT TCGCATACCG TAGCGGCGCA GGGCGGTATT TCCGCCTCTn

101   TGGGTAATGT GCAGGAAGAC CGTTGGGACT GGCACATGTA CGATACCGTG

151   AAAGGTTCCG ACTGGTTGGG CGACCAAGAT GCGATTGAGT TTATGTGCCG

201   CGCCGCGCCT GAAGCCGTAA TTGAGTTGGA ACACATGGGT ATGCCTTTTG

251   ACCGTGTGGA AAGCGGTAAA ATTTATCAGC GTCCTTTCGG CGGCCATACT

301   GCCGAACACG GTAAACGCGC GGTAGAACGC GyCTGTGCGG TTGCCGACCG

351   TACAGGTCAT GCGATGCTGC ATACTTTGTA CCAACAAAAC GTCCGTGCCA

401   ATACGCAATT CTTTGTGGAA TGGACGGCAC AAGATTTGAT TCGTGATGAA

451   AACGGCGATG TCGTCGGCGT AACCGCCATG GAAATGGAAA CCGGCGAAgT

501   TTATATTTTC CACGCTAAAG CTGTGATGTT TGCTACCGGC GGCGGCGGTC

551   GTATTTATGC GTCTTCTACC AATGCCTATA TGAATACCGG CGATGGTTTG

601   GGTATTTGTG CGCGTGCAGG TATCCCGTTG GAAGACATGG AATTCTGGCA

651   ATTCCAGCCG ACCGGCGTGG CGGGTGCGGG CGTGTTGATT ACCGAA....
```

This corresponds to the amino acid sequence <SEQ ID 64; ORF 010>:

m010.pep (PARTIAL)

```
  1 ..XQLSKSGLNC AVLSKVFPTR SHTVAAQGGI SASXGNVQED RWDWHMYDTV
 51   KGSDWLGDQD AIEFMCRAAP EAVIELEHMG MPFDRVESGK IYQRPFGGHT
101   AEHGKRAVER XCAVADRTGH AMLHTLYQQN VRANTQFFVE WTAQDLIRDE
151   NGDVVGVTAM EMETGEVYIF HAKAVMFATG GGGRIYASST NAYMNTGDGL
201   GICARAGIPL EDMEFWQFQP TGVAGAGVLI TE...
```

The following partial DNA sequence was identified in *N. meningitidis* <SEQ ID 65>:

a010.seq

```
   1 ATGGGCTTTC CTGTTCGCAA GTTTGATGCC GTGATTGTCG GCGGTGGTGG
  51 TGCAGGTTTA CGCGCANCCC TCCAATTATC CAAATCCGGT CTGAATTGTG
 101 CCGTTTTGTC TAAAGTGTTC CCGACCCGTT CGCATACCGT AGCGGCGCAG
 151 GGCGGTATTT CCGCCTCTCT GGGTAATGTG CAGGAAGACC GTTGGGACTG
 201 GCACATGTAC GATACCGTGA AAGGTTCCGA CTGGTTGGGC GACCAAGATG
 251 CGATTGAGTT TATGTGCCGC GCCGCGCCTG AAGCCGTAAT TGAGTTGGAA
 301 CACATGGGTA TGCCTTTTGA CCGTGTGGAA AGCGGTAAAA TTTATCAGCG
 351 TCCTTTCGGC GGCCATACTG CCGAACACGG TAAACGCGCG GTAGAACGCG
 401 CCTGTGCNGT TGCCGACCGT ACAGGTCATG CGATGCTGCA TACTTTGTAC
 451 CAACAAAATG TCCGTGCCAA TACGCAATTC TTTGTGGAAT GGACGGCACA
 501 AGATTTGATT CGTGATGAAA ACGGCGATGT CGTCGGCGTA ACCGCCATGG
 551 AAATGGAAAC CGGCGAAGTT TATATTTTCC ACGCTAAAGC TGTGATGTTT
 601 GCTACCGGCG GCGGCGGCCG TATTTATGCG TCTTCTACCA ATGCCTATAT
 651 GAATACCGGC GATGGTTTGG GTATTTGTGC GCGTGCAGGT ATCCCGTTGG
 701 AAGACATGGA ATTCTGGCAA TTCCACCCGA CCGGCGTGGC AGGTGCGGGC
 751 GTGTTGATTA CCGAAGGCGT ACGCGGCGAG GGCGGTATTC TGTTGAATGC
 801 CGACGGCGAA CGCTTTATGG AACGCTATGC GCCGACCGTA AAAGACTTGG
 851 CTTCTCGCGA CGTTGTTTCC CGCGCGATGG CGATGGAAAT CTACGAAGGT
 901 CGCGGCTGCG GTAAAAACAA AGACCATGTC TTACTGAAAA TCGACCATAT
 951 CGGCGCAGAA AAAATTATGG AAAAACTGCC GGGCATCCGC GAGATTTCCA
1001 TTCAGTTCGC CGGTATCGAT CCGATTAAAG ACCCGATTCC CGTTGTGCCG
1051 ACTACCCACT ATATGATGGG CGGTATTCCG ACCAACTACC ATGGCGAAGT
1101 TGTCGTTCCT CAAGGCGACG AATACGAAGT GCCTGTAAAA GGTCTGTATG
1151 CGGCAGGTGA GTGCGCCTGT GCTTCCGTAC ACGGTGCGAA CCGCTTGGGT
1201 ACGAACTCCC TGCTGGACTT AGTGGTATTC GGTAAAGCTG CCGGCGACAG
1251 CATGATTAAA TTCATCAAAG AGCAAAGCGA CTGGAAACCT TTGCCTGCTA
1301 ATGCCGGCGA ACTGACCCGC CAACGTATCG AGCGTTTGGA CAATCAAACT
1351 GATGGTGAAA ACGTTGATGC ATTGCGCCGC GAACTGCAAC GCTCCGTACA
1401 ATTGCACGCC GGCGTGTTCC GTACTGATGA GATTCTGAGC AAAGGCGTTC
1451 GAGAAGTCAT GGCGATTGCC GAGCGTGTGA AACGTACCGA AATCAAAGAC
```

-continued

```
1501 AAGAGCAAAG TGTGGAATAC CGCGCGTATC GAGGCTTTGG AATTGGATAA

1551 CCTAATTGAA GTGGCGAAAG CGACTTTGGT GTCTGCCGAA GCACGTAAAG

1601 AATCACGCGG TGCGCACGCT TCAGACGACC ATCCTGAGCG CGATGATGAA

1651 AACTGGATGA AACATACGCT GTACCATTCA GATGCCAATA CCTTGTCCTA

1701 CAAACCGGTG CACACCAAGC CTTTGAGCGT GGAATACATC AAACCGGCCA

1751 AGCGCGTTTA TTGA
```

This corresponds to the amino acid sequence <SEQ ID 66; ORF 010.a>:

a010.pep

```
  1 MGFPVRKFDA VIVGGGGAGL RAXLQLSKSG LNCAVLSKVF PTRSHTVAAQ

 51 GGISASLGNV QEDRWDWHMY DTVKGSDWLG DQDAIEFMCR AAPEAVIELE

101 HMGMPFDRVE SGKIYQRPFG GHTAEHGKRA VERACAVADR TGHAMLHTLY

151 QQNVRANTQF FVEWTAQDLI RDENGDVVGV TAMEMETGEV YIFHAKAVMF

201 ATGGGGRIYA SSTNAYMNTG DGLGICARAG IPLEDMEFWQ FHPTGVAGAG

251 VLITEGVRGE GGILLNADGE RFMERYAPTV KDLASRDVVS RAMAMEIYEG

301 RGCGKNKDHV LLKIDHIGAE KIMEKLPGIR EISIQFAGID PIKDPIPVVP

351 TTHYMMGGIP TNYHGEVVVP QGDEYEVPVK GLYAAGECAC ASVHGANRLG

401 TNSLLDLVVF GKAAGDSMIK FIKEQSDWKP LPANAGELTR QRIERLDNQT

451 DGENVDALRR ELQRSVQLHA GVFRTDEILS KGVREVMAIA ERVKRTEIKD

501 KSKVWNTARI EALELDNLIE VAKATLVSAE ARKESRGAHA SDDHPERDDE

551 NWMKHTLYHS DANTLSYKPV HTKPLSVEYI KPAKRVY*
```

m010/a010 98.7% identity over a 231 aa overlap

```
                                          10        20        30
m010.pep                          XQLSKSGLNCAVLSKVFPTRSHTVAAQGGISASXGNV
                                   |||||||||||||||||||||||||||||||| |||
a010       MGFPVRKFDAVIVGGGGAGLRAXLQLSKSGLNCAVLSKVFPTRSHTVAAQGGISASLGNV
                   10        20        30        40        50        60

            40        50        60        70        80        90
m010.pep   QEDRWDWHMYDTVKGSDWLGDQDAIEFMCRAAPEAVIELEHMGMPFDRVESGKIYQRPEG
           ||||||||||||||||||||||||||||||||||||||||||||||||||||||||||||
a010       QEDRWDWHMYDTVKGSDWLGDQDAIEFMCRAAPEAVIELEHMGMPFDRVESGKIYQRPFG
                   70        80        90       100       110       120

           100       110       120       130       140       150
m010.pep   GHTAEHGKRAVERXCAVADRTGHAMLHTLYQQNVRANTQFFVEWTAQDLIRDENGDVVGV
           ||||||||||||| ||||||||||||||||||||||||||||||||||||||||||||||
a010       GHTAEHGKRAVERACAVADRTGHAMLHTLYQQNVRANTQFFVEWTAQDLIRDENGDVVGV
                  130       140       150       160       170       180

           160       170       180       190       200       210
m010.pep   TAMEMETGEVYIFHAKAVMFATGGGGRIYASSTNAYMNTGDGLGICARAGIPLEDMEFWQ
           ||||||||||||||||||||||||||||||||||||||||||||||||||||||||||||
a010       TAMEMETGEVYIFHAKAVMFATGGGGRIYASSTNAYMNTGDGLGICARAGIPLEDMEFWQ
                  190       200       210       220       230       240

           220       230
m010.pep   FQPTGVAGAGVLITE
           |:|||||||||||||
a010       FHPTGVAGAGVLITEGVRGEGGILLNADGERFMERYAPTVKDLASRDVVSRAMAMEIYEG
                  250       260       270       280       290       300
```

Computer analysis of this amino acid sequence gave the following results:

Homology with a predicted ORF from *N. gonorrhoeae*

ORF 010 shows 98.7% identity over a 231 aa overlap with a predicted ORF (ORF 010.ng) from *N. gonorrhoeae*:

m010.pep/g010.pep

```
                                   10        20        30
m010.pep                 XQLSKSGLNCAVLSKVFPTRSHTVAAQGGISASXGNV
                         |||||||||||||||||||||||||||||||||| |||
g010     MGFPVRKFDAVIVGGGGAGLRAALQLSKSGLNCAVLSKVFPTRSHTVAAQGGISASLGNV
                 10        20        30        40        50        60

          40        50        60        70        80        90
m010.pep QEDRWDWHMYDTVKGSDWLGDQDAIEFMCRAAPEAVIELEHMGMPFDRVESGKIYQRPEG
         ||||||||||||||||||||||||||||||||||||||||||||||||||||||||||||
g010     QEDRWDWHMYDTVKGSDWLGDQDAIEFMCRAAPEAVIELEHMGMPFDRVESGKIYQRPFG
                 70        80        90       100       110       120

         100       110       120       130       140       150
m010.pep GHTAEHGKRAVERXCAVADRTGHAMLHTLYQQNVRANTQFFVEWTAQDLIRDENGDVVGV
         ||||||||||||| ||||||||||||||||||||||||||||||||||||||||||||||
g010     GHTAEHGKRAVERACAVADRTGHAMLHTLYQQNVRANTQFFVEWTAQDLIRDENGDVVGV
                130       140       150       160       170       180

         160       170       180       190       200       210
m010.pep TAMEMETGEVYIFHAKAVMFATGGGGRIYASSTNAYMNTGDGLGICARAGIPLEDMEFWQ
         ||||||||||||||||||||||||||||||||||||||||||||||||||||||||||||
g010     TAMEMETGEVYIFHAKAVMFATGGGGRIYASSTNAYMNTGDGLGICARAGIPLEDMEFWQ
                190       200       210       220       230       240

         220       230
m010.pep FQPTGVAGAGVLITE
         |:|||||||||||||
g010     FHPTGVAGAGVLITEGVRGEGGILLNADGERFMERYAPTVKDLASRDVVSRAMAMEIYEG
                250       260       270       280       290       300
```

The following partial DNA sequence was identified in *N. gonorrhoeae* <SEQ ID 67>:

g010-1.seq..

```
  1 ATGGGTTTTC CTGTTCGCAA GTTTGATGCC GTGATTGTCG GCGGTGGCGG
 51 TGCAGGTTTA CGTGCAGCCC TCCAATTATC CAAATCCGGT TTGAATTGTG
101 CCGTTTTGTC TAAAGTGTTC CCGACCCGCT CGCATACCGT AGCGGCGCAG
151 GGCGGTATTT CCGCCTCTCT GGGTAATGTG CAGGAGGACC GTTGGGACTG
201 GCACATGTAC GATACCGTGA AAGGTTCCGA CTGGCTGGGC GACCAAGATG
251 CGATTGAGTT TATGTGTCGC GCTGCGCCTG AAGCGGTGAT TGAGTTGGAA
301 CACATGGGTA TGCCTTTTGA CCGCGTTGAA AGCGGCAAAA TTTATCAGCG
351 TCCTTTCGGC GGACATACTG CCGAACATGG TAAACGTGCG GTAGAACGTG
401 CATGTGCGGT TGCCGACCGT ACCGGTCATG CGATGTTGCA TACTTTGTAC
451 CAACAAAACG TCCGTGCCAA TACACAATTC TTTGTGGAAT GGACGGCGCA
501 AGATTTGATT CGTGATGAAA ACGGCGATGT CGTCGGCGTA ACCGCCATGG
551 AAATGGAAAC GGGCGAAGTT TATATTTTCC ACGCCAAGGC CGTGATGTTT
601 GCTACCGGTG GCGGCGGTCG TATTTATGCT TCTTCTACCA ATGCTTATAT
651 GAATACCGGT GACGGTTTGG GCATTTGCGC CCGTGCGGGC ATTCCGTTGG
701 AAGATATGGA ATTCTGGCAA TTCCACCCGA CCGGCGTGGC GGGTGCGGGC
751 GTGTTGATTA CCGAAGGCGT ACGCGGCGAG GGCGGTATTC TGTTGAACGC
801 CGACGGCGAA CGCTTTATGG AACGCTATGC GCCGACCGTA AAAGACTTGG
851 CTTCTCGCGA CGTGGTTTCA CGCGCGATGG CGATGGAAAT CTATGAAGGT
```

-continued

```
 901 CGCGGCTGTG GTAAAAACAA AGACCACGTC TTACTGAAAA TCGACCATAT
 951 CGGTGCAGAA AAAATTATGG AAAAACTGCC GGGCATCCGC GAGATTTCCA
1001 TTCAGTTTGC CGGTATCGAT CCGATTAAAG ACCCGATTCC GGTTGTGCCG
1051 ACTACCCACT ATATGATGGG CGGCATTCCG ACCAATTATC ACGGTGAAGT
1101 TGTTGTTCCG CAAGGCGACG AGTACGAAGT ACCTGTAAAA GGCCTGTATG
1151 CCGCAGGTGA GTGCGCCTGT GCTTCCGTAC ACGGTGCGAA CCGTTTGGGT
1201 ACGAACTCCC TGCTGGACTT GGTGGTGTTC cgcccaaccc cccggtga
```

This corresponds to the amino acid sequence <SEQ ID 68; ORF 010-1.ng>:

```
g010-1.pep

  1 MGFPVRKFDA VIVGGGGAGL RAALQLSKSG LNCAVLSKVF PTRSHTVAAQ
 51 GGISASLGNV QEDRWDWHMY DTVKGSDWLG DQDAIEFMCR AAPEAVIELE
101 HMGMPFDRVE SGKIYQRPFG GHTAEHGKRA VERACAVADR TGHAMLHTLY
151 QQNVRANTQF FVEWTAQDLI RDENGDVVGV TAMEMETGEV YIFHAKAVMF
201 ATGGGGRIYA SSTNAYMNTG DGLGICARAG IPLEDMEFWQ FHPTGVAGAG
251 VLITEGVRGE GGILLNADGE RFMERYAPTV KDLASRDVVS RAMAMEIYEG
301 RGCGKNKDHV LLKIDHIGAE KIMEKLPGIR EISIQFAGID PIKDPIPVVP
351 TTHYMMGGIP TNYHGEVVVP QGDEYEVPVK GLYAAGECAC ASVHGANRLG
401 TNSLLDLVVF RPTPR*
```

g010-1/P10444 sp|P10444|DHSA_ECOLI SUCCINATE DEHYDROGENASE FLAVOPROTEIN SUBUNIT gn1|PID|d1015210 (D90711) Succinate dehydrogenase, flavoprotein [*Escherichia coli*] gi|11786942 (AE000175) succinate dehydrogenase flavoprotein subunit [*Escherichia coli*] Length=588

Score=1073 (495.6 bits), Expect=6.7e−169, Sum P(2)=6.7e−169
Identities=191/303 (63%), Positives=238/303 (78%)

```
Query:   1 MGFPVRKFDAVIVXXXXXXXXXXXXXXSKSGLNCAVLSKVFPTRSHTVAAQGGISASLGNV  60
           M  PVR+FDAV++              S+SG  CA+LSKVFPTRSHTV+AQGGI+ +LGN
Sbjct:   1 MKLPVREFDAVVIGAGGAGMRAALQISQSGQTCALLSKVFPTRSHTVSAQGGITVALGNT  60

Query:  61 QEDRWDWHMYDTVKGSDWLGDQDAIEFMCRAAPEAVIELEHMGMPFDRVESGKIYQRPFG 120
           ED W+WHMYDTVKGSD++GDQDAIE+MC+  PEA++ELEHMG+PF R++ G+IYQRPFG
Sbjct:  61 HEDNWEWHMYDTVKGSDYIGDQDAIEYMCKTGPEAILELEHMGLPFSRLDDGRIYQRPFG 120

Query: 121 GHTAEHGKRAVERACAVADRTGHAMLHTLYQQNVRANTQFFVEWTAQDLIRDENGDVVGV 180
           G +   G     R  A ADRTGHA+LHTYLQQN++ +T   F EW A DL+++++G VVG
Sbjct: 121 GQSKNFGGEQAARTAAAADRTGHALLHTLYQQNLKNHTTIFSEWYALDLVKNQDGAVVGC 180

Query: 181 TAMEMETGEVYIFHAKAVMFATGGGGRIYASSTNAYMNTGDGLGICARAGIPLEDMEFWQ 240
           TA+ +ETGEV  F A+A + ATGG GRIY S+TNA++NTGDG+G+  RAG+P++DME WQ
Sbjct: 181 TALCIETGEVVYFKARATVLATGGAGRIYQSTTNAHINTGDGVGMAIRAGVPVQDMEMWQ 240

Query: 241 FHPTGVAGAGVLITEGVRGEGGILLNADGERFMERYAPTVKDLASRDVVSRAMAMEIYEG 300
           FHPTG+AGAGVL+TEG RGEGG LLN  GERFMERYAP  KDLA RDVV+R++ +EI EG
Sbjct: 241 FHPTGIAGAGVLVTEGCRGEGGYLLNKHGERFMERYAPNAKDLAGRDVVARSIMIEIREG 300

Query: 301 RGC                                                          303
           RGC
Sbjct: 301 RGC                                                          303
```

Score=249 (115.0 bits), Expect=6.7e−169, Sum P(2) 6.7e−169

Identities=53/102 (51%), Positives=62/102 (60%)

```
Query: 309 HVLLKIDHIGAEKIMEKLPGIREISIQFAGXXXXXXXXXXXXTTHYMMGGIPTNYHGEVV 368
           H  LK+DH+G E +  +LPGI E+S  FA             T HYMMGGIPT   G+ +
Sbjct: 310 HAKLKLDHLGKEVLESRLPGILELSRTFAHVDPVKEPIPVIPTCHYMMGGIPTKVTGQAL 369

Query: 369 VPQGDEYEVPVKGLYAAGECACASVHGANRLGTNSLLDLVVF                   410
                  +V V GL+A GE AC SVHGANRLG NSLLDLVVF
Sbjct: 370 TVNEKGEDVVVPGLFAVGEIACVSVHGANRLGGNSLLDLVVF                   411
```

The following partial DNA sequence was identified in *N. meningitidis* <SEQ ID 69>:

m010-1.seq..

```
   1 ATGGGTTTTC CTGTTCGCAA GTTTGATGCC GTGATTGTCG GCGGTGGTGG
  51 TGCAGGTTTA CGCGCAGCCC TCCAATTATC CAAATCCGGT CTGAATTGTG
 101 CCGTTTTGTC TAAAGTGTTC CCGACCCGTT CGCATACCGT AGCGGCGCAg
 151 GGCGGTATTT CCGCCTCTCT GGGTAATGTG CAGGAAGACC GTTGGGACTG
 201 GCACATGTAC GATACCGTGA AAGGTTCCGA CTGGTTGGGC GACCAAGATG
 251 CGATTGAGTT TATGTGCCGC GCCGCGCCTG AAGCCGTAAT TGAGTTGGAA
 301 CACATGGGTA TGCCTTTTGA CCGTGTGGAA AGCGGTAAAA TTTATCAGCG
 351 TCCTTTCGGC GGCCATACTG CCGAACACGG TAAACGCGCG GTAGAACGCG
 401 CCTGTGCGGT TGCCGACCGT ACAGGTCATG CGATGCTGCA TACTTTGTAC
 451 CAACAAAACG TCCGTGCCAA TACGCAATTC TTTGTGGAAT GGACGGCACA
 501 AGATTTGATT CGTGATGAAA ACGGCGATGT CGTCGGCGTA ACCGCCATGG
 551 AAATGGAAAC CGGCGAAGTT TATATTTTCC ACGCTAAAGC TGTGATGTTT
 601 GCTACCGGCG GCGGCGGTCG TATTTATGCG TCTTCTACCA ATGCCTATAT
 651 GAATACCGGC GATGGTTTGG GTATTTGTGC GCGTGCAGGT ATCCCGTTGG
 701 AAGACATGGA ATTCTGGCAA TTCCACCCGA CCGGCGTGGC GGGTGCGGGC
 751 GTGTTGATTA CCGAAGGCGT ACGCGGCGAG GGCGGTATTC TGTTGAATGC
 801 CGACGGCGAA CGCTTTATGG AACGCTATGC GCCGACCGTA AAAGACTTGG
 851 CTTCTCGCGA CGTTGTTTCC CGCGCGATGG CGATGGAAAT CTACGAAGGT
 901 CGCGGCTGCG GTAAAAACAA AGACCATGTC TTACTGAAAA TCGACCATAT
 951 CGGCGCAGAA AAAATTATGG AAAAACTGCC GGGCATCCGC GAGATTTCCA
1001 TTCAGTTCGC CGGTATCGAT CCGATTAAAG ACCCGATTCC CGTTGTGCCG
1051 ACTACCCACT ATATGATGGG CGGCATTCCG ACCAATTACC ACGGCGAAGT
1101 TGTCGTTCCG CAAGGTGAAG ATTACGAAGT GCCTGTAAAA GGTCTGTATG
1151 CGGCAGGTGA GTGCGCTTGT GCTTCCGTAC ACGCTGCGAA CCGCTTGGGT
1201 ACCAACTCCC TGTTGGACTT GGTGGTATTC GGTAAAGCTG CCGGCGACAG
1251 CATGATTAAA TTCATCAAAG AGCAAAGCGA CTGGAAACCT TTGCCTGCTA
1301 ATGCAGGTGA GTTGACCCGC CAACGTATCG AGCGTTTGGA CAACCAAACC
1351 GATGGTGAAA ACGTTGATGC ATTGCGTCGC GAACTGCAAC GCTCTGTACA
1401 ACTGCACGCC GGCGTGTTCC GTACTGATGA GATTCTGAGC AAAGGCGTTC
1451 GAGAAGTCAT GGCGATTGCC GAGCGTGTGA AACGTACCGA AATCAAAGAC
```

-continued

```
1501 AAGAGCAAAG TGTGGAATAC CGCGCGTATC GAGGCTTTGG AATTGGATAA

1551 CCTGATTGAA GTGGCGAAAG CGACTTTGGT GTCTGCCGAA GCACGTAAAG

1601 AATCACGCGG TGCGCACGCT TCAGACGACC ATCCTGAGCG CGATGATGAA

1651 AACTGGATGA AACATACGCT GTACCATTCA GATATCAATA CCTTGTCCTA

1701 CAAACCGGTG CACACCAAGC CTTTGAGCGT GGAATACATC AAACCGGCCA

1751 AGCGCGTTTA TTGATGA
```

This corresponds to the amino acid sequence <SEQ ID 70; ORF 010-1>:

```
m010-1.pep..

  1 MGFPVRKFDA VIVGGGGAGL RAALQLSKSG LNCAVLSKVF PTRSHTVAAQ

 51 GGISASLGNV QEDRWDWHMY DTVKGSDWLG DQDAIEFMCR AAPEAVIELE

101 HMGMPFDRVE SGKIYQRPFG GHTAEHGKRA VERACAVADR TGHAMLHTLY

151 QQNVRANTQF FVEWTAQDLI RDENGDVVGV TAMENETGEV YIFHAKAVMF

201 ATGGGGRIYA SSTNAYMNTG DGLGICARAG IPLEDMEFWQ FHPTGVAGAG

251 VLITEGVRGE GGILLNADGE RFMERYAPTV KDLASRDVVS RAMAMEIYEG

301 RGCGKNKDHV LLKIDHIGAE KIMEKLPGIR EISIQFAGID PIKDPIPVVP

351 TTHYMMGGIP TNYHGEVVVP QGEDYEVPVK GLYAAGECAC ASVHGANRLG

401 TNSLLDLVVF GKAAGDSMIK FIKEQSDWKP LPANAGELTR QRIERLDNQT

451 DGENVDALRR ELQRSVQLHA GVFRTDEILS KGVREVMAIA ERVKRTEIKD

501 KSKVWNTARI EALELDNLIE VAKATLVSAE ARKESRGAHA SDDHPERDDE

551 NWMKHTLYHS DINTLSYKPV HTKPLSVEYI KPAKRVY*
```

m010-1/g010-1 99.5% identity in 410 aa overlap

```
                      10        20        30        40        50        60
m010-1.pep    MGFPVRKFDAVIVGGGGAGLRAALQLSKSGLNCAVLSKVFPTRSHTVAAQGGISASLGNV
              ||||||||||||||||||||||||||||||||||||||||||||||||||||||||||||
g010-1        MGFPVRKFDAVIVGGGGAGLRAALQLSKSGLNCAVLSKVFPTRSHTVAAQGGISASLGNV
                      10        20        30        40        50        60

                      70        80        90       100       110       120
m010-1.pep    QEDRWDWHMYDTVKGSDWLGDQDAIEFMCRAAPEAVIELEHMGMPFDRVESGKIYQRPFG
              ||||||||||||||||||||||||||||||||||||||||||||||||||||||||||||
g010-1        QEDRWDWHMYDTVKGSDWLGDQDAIEFMCRAAPEAVIELEHMGMPFDRVESGKIYQRPFG
                      70        80        90       100       110       120

                     130       140       150       160       170       180
m010-1.pep    GHTAEHGKRAVERACAVADRTGHAMLHTLYQQNVRANTQFFVEWTAQDLIRDENGDVVGV
              ||||||||||||||||||||||||||||||||||||||||||||||||||||||||||||
g010-1        GHTAEHGKRAVERACAVADRTGHAMLHTLYQQNVRANTQFFVEWTAQDLIRDENGDVVGV
                     130       140       150       160       170       180

                     190       200       210       220       230       240
m010-1.pep    TAMEMETGEVYIFHAKAVMFATGGGGRIYASSTNAYMNTGDGLGICARAGIPLEDMEFWQ
              ||||||||||||||||||||||||||||||||||||||||||||||||||||||||||||
g010-1        TAMEMETGEVYIFHAKAVMFATGGGGRIYASSTNAYMNTGDGLGICARAGIPLEDMEFWQ
                     190       200       210       220       230       240

                     250       260       270       280       290       300
m010-1.pep    FHPTGVAGAGVLITEGVRGEGGILLNADGERFMERYAPTVKDLASRDVVSRAMAMEIYEG
              ||||||||||||||||||||||||||||||||||||||||||||||||||||||||||||
g010-1        FHPTGVAGAGVLITEGVRGEGGILLNADGERFMERYAPTVKDLASRDVVSRAMAMEIYEG
                     250       260       270       280       290       300

                     310       320       330       340       350       360
m010-1.pep    RGCGKNKDHVLLKIDHIGAEKIMEKLPGIREISIQFAGIDPIKDPIPVVPTTHYMMGGIP
              ||||||||||||||||||||||||||||||||||||||||||||||||||||||||||||
g010-1        RGCGKNKDHVLLKIDHIGAEKIMEKLPGIREISIQFAGIDPIKDPIPVVPTTHYMMGGIP
                     310       320       330       340       350       360
```

-continued

```
                370       380       390       400       410       420
m010-1.pep  TNYHGEVVVPQGEDYEVPVKGLYAAGECACASVHGANRLGTNSLLDLVVFGKAAGDSMIK
            ||||||||||::||||||||||||||||||||||||||||||||||||
g010-1      TNYHGEVVVPQGDEYEVPVKGLYAAGECACASVHGANRLGTNSLLDLVVFRPTPRX
                370       380       390       400       410

                430       440       450       460       470       480
m010-1.pep  FIKEQSDWKPLPANAGELTRQRIERLDNQTDGENVDALRRELQRSVQLHAGVFRTDEILS
```

The following partial DNA sequence was identified in *N. meningitidis* <SEQ ID 71>:

```
a010-1.seq..

   1 ATGGGCTTTC CTGTTCGCAA GTTTGATGCC GTGATTGTCG GCGCTGGTGG
  51 TGCAGGTTTA CGCGCANCCC TCCAATTATC CAAATCCGGT CTGAATTGTG
 101 CCGTTTTGTC TAAAGTGTTC CCGACCCGTT CGCATACCGT AGCGGCGCAG
 151 GGCGGTATTT CCGCCTCTCT GGGTAATGTG CAGGAAGACC GTTGGGACTG
 201 GCACATGTAC GATACCGTGA AAGGTTCCGA CTGGTTGGGC GACCAAGATG
 251 CGATTGAGTT TATGTGCCGC GCCGCGCCTG AAGCCGTAAT TGAGTTGGAA
 301 CACATGGGTA TGCCTTTTGA CCGTGTGGAA AGCGGTAAAA TTTATCAGCG
 351 TCCTTTCGGC GGCCATACTG CCGAACACGG TAAACGCGCG GTAGAACGCG
 401 CCTGTGCNGT TGCCGACCGT ACAGGTCATG CGATGCTGCA TACTTTGTAC
 451 CAACAAAATG TCCGTGCCAA TACGCAATTC TTTGTGGAAT GGACGGCACA
 501 AGATTTGATT CGTGATGAAA ACGGCGATGT CGTCGGCGTA ACCGCCATGG
 551 AAATGGAAAC CGGCGAAGTT TATATTTTCC ACGCTAAAGC TGTGATGTTT
 601 GCTACCGGCG GCGGCGGCCG TATTTATGCG TCTTCTACCA ATGCCTATAT
 651 GAATACCGGC GATGGTTTGG GTATTTGTGC GCGTGCAGGT ATCCCGTTGG
 701 AAGACATGGA ATTCTGGCAA TTCCACCCGA CCGGCGTGGC AGGTGCGGGC
 751 GTGTTGATTA CCGAAGGCGT ACGCGGCGAG GGCGGTATTC TGTTGAATGC
 801 CGACGGCGAA CGCTTTATGG AACGCTATGC GCCGACCGTA AAAGACTTGG
 851 CTTCTCGCGA CGTTGTTTCC CGCGCGATGG CGATGGAAAT CTACGAAGGT
 901 CGCGGCTGCG GTAAAAACAA AGACCATGTC TTACTGAAAA TCGACCATAT
 951 CGGCGCAGAA AAAATTATGG AAAAACTGCC GGGCATCCGC GAGATTTCCA
1001 TTCAGTTCGC CGGTATCGAT CCGATTAAAG ACCCGATTCC CGTTGTGCCG
1051 ACTACCCACT ATATGATGGG CGGTATTCCG ACCAACTACC ATGGCGAAGT
1101 TGTCGTTCCT CAAGCCGACG AATACGAAGT GCCTGTAAAA GGTCTGTATG
1151 CGGCAGGTGA GTGCGCCTGT GCTTCCGTAC ACGGTGCGAA CCGCTTGGGT
1201 ACGAACTCCC TGCTGGACTT AGTGGTATTC GGTAAAGCTG CCGGCGACAG
1251 CATGATTAAA TTCATCAAAG AGCAAAGCGA CTGGAAACCT TTGCCTGCTA
1301 ATGCCGGCGA ACTGACCCGC CAACGTATCG AGCGTTTGGA CAATCAAACT
1351 GATGGTGAAA ACGTTGATGC ATTGCGCCGC GAACTGCAAC GCTCCGTACA
1401 ATTGCACGCC GGCGTGTTCC GTACTGATGA GATTCTGAGC AAAGGCGTTC
1451 GAGAAGTCAT GGCGATTGCC GAGCGTGTGA AACGTACCGA AATCAAAGAC
1501 AAGAGCAAAG TGTGGAATAC CGCGCGTATC GAGGCTTTGG AATTGGATAA
```

-continued

```
1551 CCTAATTGAA GTGGCGAAAG CGACTTTGGT GTCTGCCGAA GCACGTAAAG

1601 AATCACGCGG TGCGCACGCT TCAGACGACC ATCCTGAGCG CGATGATGAA

1651 AACTGGATGA AACATACGCT GTACCATTCA GATGCCAATA CCTTGTCCTA

1701 CAAACCGGTG CACACCAAGC CTTTGAGCGT GGAATACATC AAACCGGCCA

1751 AGCGCGTTTA TTGA
```

This corresponds to the amino acid sequence <SEQ ID 72; ORF 010-1.a>:

```
a010-1.pep..

  1 MGFPVRKFDA VIVGGGGAGL RAXLQLSKSG LNCAVLSKVF PTRSHTVAAQ

 51 GGISASLGNV QEDRWDWHMY DTVKGSDWLG DQDAIEFMCR AAPEAVIELE

101 HMGMPFDRVE SGKIYQRPFG GHTAEHGKRA VERACAVADR TGHAMLHTLY

151 QQNVRANTQF FVEWTAQDLI RDENGDVVGV TAMEMETGEV YIFHAKAVMF

201 ATGGGGRIYA SSTNAYMNTG DGLGICARAG IPLEDMEFWQ FHPTGVAGAG

251 VLITEGVRGE GGILLNADGE RFMERYAPTV KDLASRDVVS RAMAMEIYEG

301 RGCGKNKDHV LLKIDHIGAE KIMEKLPGIR EISIQFAGID PIKDPIPVVP

351 TTHYMMGGIP TNYHGEVVVP QGDEYEVPVK GLYAAGECAC ASVHGANRLG

401 TNSLLDLVVF GKAAGDSMIK FIKEQSDWKP LPANAGELTR QRIERLDNQT

451 DGENVDALRR ELQRSVQLHA GVFRTDEILS KGVREVMAIA ERVKRTEIKD

501 KSKVWNTARI EALELDNLIE VAKATLVSAE ARKESRGAHA SDDHPERDDE

551 NWMKHTLYHS DANTLSYKPV HTKPLSVEYI KPAKRVY*
```

m010-1/a010-1 99.3% identity in 587 aa overlap

```
                     10        20        30        40        50        60
a010-1.pep  MGFPVRKFDAVIVGGGGAGLRAXLQLSKSGLNCAVLSKVFPTRSHTVAAQGGISASLGNV
            |||||||||||||||||||||| |||||||||||||||||||||||||||||||||||||
m010-1      MGFPVRKFDAVIVGGGGAGLRAALQLSKSGLNCAVLSKVFPTRSHTVAAQGGISASLGNV
                     10        20        30        40        50        60

                     70        80        90       100       110       120
a010-1.pep  QEDRWDWHMYDTVKGSDWLGDQDAIEFMCRAAPEAVIELEHMGMPFDRVESGKIYQRPFG
            ||||||||||||||||||||||||||||||||||||||||||||||||||||||||||||
m010-1      QEDRWDWHMYDTVKGSDWLGDQDAIEFMCRAAPEAVIELEHMGMPFDRVESGKIYQRPFG
                     70        80        90       100       110       120

                    130       140       150       160       170       180
a010-1.pep  GHTAEHGKRAVERACAVADRTGHAMLHTLYQQNVRANTQFFVEWTAQDLIRDENGDVVGV
            ||||||||||||||||||||||||||||||||||||||||||||||||||||||||||||
a010-1      GHTAEHGKRAVERACAVADRTGHAMLHTLYQQNVRANTQFFVEWTAQDLIRDENGDVVGV
                    130       140       150       160       170       180

                    190       200       210       220       230       240
a010-1.pep  TAMEMETGEVYIFHAKAVMFATGGGGRIYASSTNAYMNTGDGLGICARAGIPLEDMEFWQ
            ||||||||||||||||||||||||||||||||||||||||||||||||||||||||||||
m010-1      TAMEMETGEVYIFHAKAVMFATGGGGRIYASSTNAYMNTGDGLGICARAGIPLEDMEFWQ
                    190       200       210       220       230       240

                    250       260       270       280       290       300
a010-1.pep  FHPTGVAGAGVLITEGVRGEGGILLNADGERFMERYAPTVKDLASRDVVSRAMAMEIYEG
            ||||||||||||||||||||||||||||||||||||||||||||||||||||||||||||
m010-1      FHPTGVAGAGVLITEGVRGEGGILLNADGERFMERYAPTVKDLASRDVVSRAMAMEIYEG
                    250       260       270       280       290       300

                    310       320       330       340       350       360
a010-1.pep  RGCGKNKDHVLLKIDHIGAEKIMEKLPGIREISIQFAGIDPIKDPIPVVPTTHYMMGGIP
            ||||||||||||||||||||||||||||||||||||||||||||||||||||||||||||
m010-1      RGCGKNKDHVLLKIDHIGAEKIMEKLPGIREISIQFAGIDPIKDPIPVVPTTHYMMGGIP
                    310       320       330       340       350       360
```

-continued

```
                370       380       390       400       410       420
a010-1.pep  TNYHGEVVVPQGDEYEVPVKGLYAAGECACASVHGANRLGTNSLLDLVVFGKAAGDSMIK
            ||||||||||||::||||||||||||||||||||||||||||||||||||||||||||||
m010-1      TNYHGEVVVPQGEDYEVPVKGLYAAGECACASVHGANRLGTNSLLDLVVFGKAAGDSMIK
                370       380       390       400       410       420

                430       440       450       460       470       480
a010-1.pep  FIKEQSDWKPLPANAGELTRQRIERLDNQTDGENVDALRRELQRSVQLHAGVFRTDEILS
            ||||||||||||||||||||||||||||||||||||||||||||||||||||||||||||
m010-1      FIKEQSDWKPLPANAGELTRQRIERLDNQTDGENVDALRRELQRSVQLHAGVFRTDEILS
                430       440       450       460       470       480

                490       500       510       520       530       540
a010-1.pep  KGVREVMAIAERVKRTEIKDKSKVWNTARIEALELDNLIEVAKATLVSAEARKESRGAHA
            ||||||||||||||||||||||||||||||||||||||||||||||||||||||||||||
m010-1      KGVREVMAIAERVKRTEIKDKSKVWNTARIEALELDNLIEVAKATLVSAEARKESRGAHA
                490       500       510       520       530       540

                550       560       570       580
a010-1.pep  SDDHPERDDENWMKHTLYHSDANTLSYKPVHTKPLSVEYIKPAKRVYX
            ||||||||||||||||||||| ||||||||||||||||||||||||||
m010-1      SDDHPERDDENWMKHTLYHSDINTLSYKPVHTKPLSVEYIKPAKRVYX
                550       560       570       580
```

The following partial DNA sequence was identified in *N. gonorrhoeae* <SEQ ID 73>:

g011.seq

```
  1 ATGAAGACAC ACCGCAAGAC CTGCTCTGCG GTGTGTTTTG CTTTTCAGAC
 51 GGCATCGAAA CCCGCCGTTT CCATCCGACA TCCCAGCGAG GACATCATGA
101 GCCTGAAAAC CCGCCTTACC GAAGATATGA AAACCGCGAT GCGCGCCAAA
151 GATCAAGTTT CCCTCGGCAC CATCCGCCTC ATCAATGCCG CCGTCAAACA
201 GTTTGAAGTA GACGAACGCA CCGAAGCCGA CGATGCCAAA ATCACCGCCA
251 TCCTGACCAA AATGGTCAAA CAGCGCAAAG ACGGCGCGAA AATCTACACT
301 GAAGCCGGCC GTCAGGATTT GGCAGACAAA GAAAACGCCG AAATCGACGT
351 GCTGCACCGC TACCTGCCGC AAATGCTCTC CGCCGGCGAA ATCCGCACCG
401 CCGTCGAAGC AGCCGTTGCC GAAACCGGCG CGGCAGGTAT GGCGGATATG
451 GGCAAAGTGA TGGTCGTATT GAAAAcccGC CTCGCCGGCA AAGccgATAT
501 GGGCGAAGTC AACAAAATCT TGAAAAccGt aCTGACCGCC tga
```

This corresponds to the amino acid sequence <SEQ ID 74; ORF 011.ng>:

g011.pep

```
  1 MKTHRKTCSA VCFAFQTASK PAVSIRHPSE DIMSLKTRLT EDMKTAMRAK
 51 DQVSLGTIRL INAAVKQFEV DERTEADDAK ITAILTKMVK QRKDGAKIYT
101 EAGRQDLADK ENAEIDVLHR YLPQMLSAGE IRTAVEAAVA ETGAAGMADM
151 GKVMVVLKTR LAGKADMGEV NKILKTVLTA *
```

The following partial DNA sequence was identified in *N. meningitidis* <SEQ ID 75>:

m011.seq (partial)

```
  1 ATGAGGACAC ACCGCAAGAC CTGCTCTGCG GTGTGTTTTG CTTTTCAGAC
 51 GGCATCGAAA CCCGCCGTTT CCATCCGACA TCCCAGCGAG GACATCATGA
```

-continued

```
101 GCCTGAAAAT CCGCCTTACC GAAGACATGA AAACCGCGAT GCGCGCCAAA

151 GACCAAGTTT CCCTCGGCAC CATCCGCCTC ATCAACGCCG CCGTCAAACA

201 GTTTGAAGTG GACGAACGCA CCGAAGCCGA CGATGCCAAA ATCACCGCCA

251 TCCTGACCAA AATGGTCAAA CAGCGAAAAG ACAGCGCGAA AATCTACACT

301 GAAGCCGGCC GTCAGGATTT GGCAGACAAA GAAAACGCCG AAATCGAGGT

351 ACTGCACCGC TACCTTCCCC AAATGCTTTC CGCCGGCGAA ATCCGTACCG

401 AGGTCGAAGC TGCCGTTGCC GAAACCGGCG CGGCAGGTAT GGCGGATATG

451 GGTAAAGTCA TGGGGCTGCT GAAAACCCGC CTCGCAGGTA AAGCCGA...
```

This corresponds to the amino acid sequence <SEQ ID 76: ORF 011>:

m011.pep (partial)

```
  1 MRTHRKTCSA VCFAFQTASK PAVSIRHPSE DIMSLKIRLT EDMKTAMRAK

 51 DQVSLGTIRL INAAVKQFEV DERTEADDAK ITAILTKMVK QRKDSAKIYT

101 EAGRQDLADK ENAEIEVLHR YLPQMLSAGE IRTEVEAAVA ETGAAGMADM

151 GKVMGLLKTR LAGKA.....
```

Computer analysis of this amino acid sequence gave the following results:

Homology with a predicted ORF from *N. gonorrhoeae*

ORF 011 shows 95.8% identity over a 165 aa overlap with a predicted ORF (ORF 011.ng) from *N. gonorrhoeae*.

m011/g011

```
                 10        20        30        40        50        60
m011.pep  MRTHRKTCSAVCFAFQTASKPAVSIRHPSEDIMSLKIRLTEDMKTAMRAKDQVSLGTIRL
          |:|||||||||||||||||||||||||||||||||| |||||||||||||||||||||||
g011      MKTHRKTCSAVCFAFQTASKPAVSIRHPSEDIMSLKTRLTEDMKTAMRAKDQVSLGTIRL
                 10        20        30        40        50        60

                 70        80        90       100       110       120
m011.pep  INAAVKQFEVDERTEADDAKITAILTKMVKQRKDSAKIYTEAGRQDLADKENAEIEVLHR
          ||||||||||||||||||||||||||||||||||:||||||||||||||||||||:||||
g011      INAAVKQFEVDERTEADDAKITAILTKMVKQRKDGAKIYTEAGRQDLADKENAEIDVLHR
                 70        80        90       100       110       120

                130       140       150       160
m011.pep  YLPQMLSAGEIRTEVEAAVAETGAAGMADMGKVMGLLKTRLAGKA
          ||||||||||||| |||||||||||||||||||| :|||||||||
g011      YLPQMLSAGEIRTAVEAAVAETGAAGMADMGKVMVVLKTRLAGKADMGEVNKILKTVLTA
                130       140       150       160       170       180

g011      X
```

The following partial DNA sequence was identified in *N. gonorrhoeae* <SEQ ID 77>:

g012.seq

```
 1 ATGCTCGCCC GTCGCTATTT TTTCAATATC CAACCCGGGG CGGTTTTCAC

51 TGACAAACTG CTTGAACAAC TGATGCGTTT CCTCCAGTTC CTGCCGGAAT
```

-continued

```
101 TTCTGTTTGC CCTTTTCCGT ATTTTCACCC ATAAAAGTAA CCGTGCGCTT

151 AAATTCGCCC GCCGTCATCA CATCCACATC AATATCATGT TTTTTCAACa

201 gGcggTGGAT ATTCGgcact tccgCcacca cacccaccga accgatgacc

251 gcaaacggaG CGGAAACAAT TTTATCCGCc acacacgcca tcatatagcc

301 gcCGCTTGCC GCGACCTTAT CGAcggcgac ggTCAGCGGA ATATTGCGTT

351 CGCGCAAACG CCTAAGCTGC GAAGCCGCCA AACCGTAACC GTGAACCACG

401 CCGCCCGGAC TTTCCAATCT GAGCAGAACC TCATCTTCAG GCTTGGCAAT

451 CAAAAGCACC GCCGTAATCT CATGACGCAA GGATTCTACG GCGTGTGCAT

501 ACAAATCGCC GTCAAAATCC AACACAAAAA GGCGGGATTT TTGCGTTTCG

551 GCAGATTTCT CCCCGCCCTC CTTCAAACGC TTTTTCTCTG CTTTGGCTTC

601 CGCCTTTTCC TTTTTCTTTT CTTTTTTTTC CTGATGTTTT GTCTCTTCCT

651 CGCTTAA
```

This corresponds to the amino acid sequence <SEQ ID 78; ORF 012.ng>:

g012.pep

```
  1 MLARRYFFNI QPGAVFTDKL LEQLMRFLQF LPEFLFALFR IFTHKSNRAL

 51 KFARRHHIHI NIMFFQQAVD IRHFRHHTHR TDDRKRSGNN FIRHTRHHIA

101 AACRDLIDGD GQRNIAFAQT PKLRSRQTVT VNHAARTFQS EQNLIFRLGN

151 QKHRRNLMTQ GFYGVCIQIA VKIQHKKAGF LRFGRFLPAL LQTLFLCFGF

201 RLFLFLFFFF LMFCLFLA*
```

The following partial DNA sequence was identified in *N. meningitidis* <SEQ ID 79>:

m012.seq

```
  1 ATGCTCGCCC GTTGCCACTT CCTCAATATC CAATTGAGGG CGGTTCTCGC

 51 TGACAAACTG CTTGAACAAC TGATGCGTTT CCTCCAGTTC CTGTCGGAAT

101 TTCTGTTTGC CCTTTTCCGT ATTTTCACCC ATAAAAGTAA CCGTGCGCTT

151 AAATTCGCCC GCCGTCATCA CATCCACATC AATATCATGT TTTTTCAACA

201 GGCGGTGGAT ATTCGGTACT TCCGCCACCA CACCCACCGA ACCGACAATC

251 GCAAACGGAG CGGAAGCAAT TTTATCCGCC ACACACGCCA TCATATAACC

301 GCCGCTCGCn nnnnnnnnnn nnnnnnnnnn nnnnnnnnnn nnnnnnnnnn

351 nnnnnnnnnn nnnnnnnnnn nnnnnnnnnn nnnnnnnnnn nnnnnnnnnn

401 nnnnnnnnnn nnnnnnnnnn nnnnnnnnnn nnnnnnnnnn nnnnnnnnnn

451 nnnnnnnnnn nnnnnnnnnn nnnnnnnnnn nnnnnnnnnn nnnnnnnnnn

501 nnnnnnnnnn nnnnnnnnnC AACACAAAAA GGCGTGATTT nTGCGTTTCG

551 GCAGATTTCT CCCCACCCTC CTTCAAACGT TTTTCcTCTG CTTTGGCTTC

601 CGCCTTTTCC TTTTTCTTTT CCTCTTTTTC CTGATGTTGT GCCTCTTCCC

651 CGCTTAA
```

This corresponds to the amino acid sequence <SEQ ID 80; ORF 012>:

m012.pep

```
  1 MLARCHFLNI QLRAVLADKL LEQLMRFLQF LSEFLFALFR IFTHKSNRAL

 51 KFARRHHIHI NIMFFQQAVD IRYFRHHTHR TDNRKRSGSN FIRHTRHHIT

101 AARXXXXXXX XXXXXXXXXX XXXXXXXXXX XXXXXXXXXX XXXXXXXXXX

151 XXXXXXXXXX XXXXXXXXXX XXXQHKKA*F XRFGRFLPTL LQTFFLCFGF

201 RLFLFLFLFF LMLCLFPA*
```

The following partial DNA sequence was identified in *N. meningitidis* <SEQ ID 81>:

a012.seq

```
  1 ATGCTCGCCC GTTGCCACTT CCTCAATATC CAATTGAGGG CGGTTCTCGC
 51 TGACAAACTG CTTGAACAAC TGATGCGTTT CCTCCAGTTC CTGTCGGAAT
101 TTCTGTTTGC CCTTTTCCGT ATTTTCACCC ATAAAAGTAA CCGTGCGCTT
151 AAATTCGCCC GCCGTCATCA CATCCACATC AATATCATGT TTTTTCAACA
201 GGCGGTGGAT ATTCGGTACT TCCGCTACAA CACCCACCGA ACCGACAATC
251 GCAAACGGAG CGGAAACAAT TTTATCCGCC ACACACGCCA TCATATAACC
301 ACCGCTCGCC GCCACCTTAT CGACGGCGAC GGTCAGCGGA ATATTGCGTT
351 CGCGCAAACG CCTAAGCTGC GAAGCCGCCA AACCGTAACC GTGAACCACG
401 CCGCCCGGAC TTTCCAATCT AAGCAGAACC TCATCTTCAG GCTTGGCAAT
451 CAAAAGCACC GCCGTAATCT CATGACGCAA GGATTCTACG GCGTGTGCAT
501 ACAAATCGCC GTCAAAATCC AACACAAAAA GGCGGGATTT TTGCGTTTCG
551 GAAGATTTCT CCCCACCCTC CTTCAAACGC TTTTTCTCTG CTTTGGCTTC
601 CGCCTTTTCC TTTTTCTTTT CCTCTTTTTC CTGATGTTTT GCCTCTTCCC
651 CGCTTAA
```

This corresponds to the amino acid sequence <SEQ ID 82; ORF 012.a>:

a012.pep

```
  1 MLARCHFLNI QLRAVLADKL LEQLMRFLQF LSEFLFALFR IFTHKSNRAL
 51 KFARRHHIHI NIMFFQQAVD IRYFRYNTHR TDNRKRSGNN FIRHTRHHIT
101 TARRHLIDGD GQRNIAFAQT PKLRSRQTVT VNHAARTFQS KQNLIFRLGN
151 QKHRRNLMTQ GFYGVCIQIA VKIQHKKAGF LRFGRFLPTL LQTLFLCFGF
201 RLFLFLFLFF LMFCLFPA*
```

m012/a012 64.2% identity over a 218 aa overlap

```
                    10        20        30        40        50        60
m012.pep    MLARCHFLNIQLRAVLADKLLEQLMRFLQFLSEFLFALFRIFTHKSNRALKFARRHHIHI
            ||||||||||||||||||||||||||||||||||||||||||||||||||||||||||||
a012        MLARCHFLNIQLRAVLADKLLEQLMRFLQFLSEFLFALFRIFTHKSNRALKFARRHHIHI
                    10        20        30        40        50        60

                    70        80        90       100       110       120
m012.pep    NIMFFQQAVDIRYFRHHTHRTDNRKRSGSNFIRHTRHHITAARXXXXXXXXXXXXXXXXX
            |||||||||||||||::|||||||||||:|||||||||||:||                :
a012        NIMFFQQAVDIRYFRYNTHRTDNRKRSGNNFIRHTRHHITTARRHLIDGDGQRNIAFAQT
                    70        80        90       100       110       120

                   130       140       150       160       170       180
m012.pep    XXXXXXXXXXXXXXXXXXXXXXXXXXXXXXXXXXXXXXXXXXXXXXXXXXXXXQHKKAXF
                   : :      :                     :              ||||| |
a012        PKLRSRQTVTVNHAARTFQSKQNLIFRLGNQKHRRNLMTQGFYGVCIQIAVKIQHKKAGF
                   130       140       150       160       170       180

                   190       200       210      219
m012.pep    XRFGRFLPTLLQTFFLCFGFRLFLFLFLFFLMLCLFPAX
             ||||||||||||:||||||||||||||||||:||||||
a012        LRFGRFLPTLLQTLFLCFGFRLFLFLFLFFLMFCLFPAX
                   190       200       210
```

Computer analysis of this amino acid sequence gave the following results:

Homology with a predicted ORF from *N. gonorrhoeae*

ORF 012 shows 58.7% identity over a 218 aa overlap with a predicted ORF (ORF 012.ng) from *N. gonorrhoeae*:

```
m012/g012

                    10        20        30        40        50        60
m012.pep    MLARCHFLNIQLRAVLADKLLEQLMRFLQFLSEFLFALFRIFTHKSNRALKFARRHHIHI
            |||| :|:|||  ||::|||||||||||||| ||||||||||||||||||||||||||||
g012        MLARRYFFNIQPGAVFTDKLLEQLMRFLQFLPEFLFALFRIFTHKSNRALKFARRHHIHI
                    10        20        30        40        50        60

                    70        80        90       100       110       120
m012.pep    NIMFFQQAVDIRYFRHHTHRTDNRKRSGSNFIRHTRHHITAARXXXXXXXXXXXXXXXXX
            ||||||||||||:|||||||||:|||||:||||||||||:|||                :
g012        NIMFFQQAVDIRHFRHHTHRTDDRKRSGNNFIRHTRHHIAAACRDLIDGDGQRNIAFAQT
                    70        80        90       100       110       120

                   130       140       150       160       170       180
m012.pep    XXXXXXXXXXXXXXXXXXXXXXXXXXXXXXXXXXXXXXXXXXXXXXXXXXXXXXXQHKKAXF
                   : :      :                     :              ||||| |
g012        PKLRSRQTVTVNHAARTFQSEQNLIFRLGNQKHRRNLMTQGFYGVCIQIAVKIQHKKAGF
                   130       140       150       160       170       180

                   190       200       210      219
m012.pep    XRFGRFLPTLLQTFFLCFGFRLFLFLFLFFLMLCLFPAX
             |||||||:||||:|||||||||||||:||||:|||  ||
g012        LRFGRFLPALLQTLFLCFGFRLFLFLFFFFLMFCLFLAX
                   190       200       210
```

The following partial DNA sequence was identified in *N. meningitidis* <SEQ ID 83>:

```
m012-1.seq

  1 ATGCTCGCCC GTTGCCACTT CCTCAATATC CAATTGAGGG CGGTTCTCGC

 51 TGACAAACTG CTTGAACAAC TGATGCGTTT CCTCCAGTTC CTGTCGGAAT

101 TTCTGTTTGC CCTTTTCCGT ATTTTCACCC ATAAAAGTAA CCGTGCGCTT

151 AAATTCGCCC GCCGTCATCA CATCCACATC AATATCATGT TTTTTCAACA

201 GGCGGTGGAT ATTCGGTACT TCCGCCACCA CACCCACCGA ACCGACAATC

251 GCAAACGGAG CGGAAGCAAT TTTATCCGCC ACACACGCCA TCATATAACC

301 GCCGCTCGCC GCCACCTTAT CGACGGCGAC GGTCAGCGGA ATATTGCGTT

351 CGCGCAAACG CyTAAGCTGC GAAGCCGCCA AACCGTAACC GTGAACCACG
```

-continued

```
401 CCGCCCGGAC TTTCCAATCT GAGCAGAACC TCATCTTCAG GCTTGGCAAT

451 CAAAAGCACC GCCGTAATCT CATGACGCAA GGATTCTACG GCGTGTGCAT

501 ACAAATCGCC GTCAAAATCC AACACAAAAA GGCGGGATTT TTGCGTTTCG

551 GCAGATTTCT CCCCACCCTC CTTCAAACGC TTTTTCTCTG CTTTGGCTTC

601 CGCCTTTTCC TTTTTCTTTT CCTCTTTTTC CTGATGTTTT GCCTCTTCCC

651 CGCTTAA
```

This corresponds to the amino acid sequence <SEQ ID 84; ORF 012-1>:

m012-1.pep

```
  1 MLARCHFLNI QLRAVLADKL LEQLMRFLQF LSEFLFALFR IFTHKSNRAL

 51 KFARRHHIHI NIMFFQQAVD IRYFRHHTHR TDNRKRSGSN FIRHTRHHIT

101 AARRHLIDGD GQRNIAFAQT XKLRSRQTVT VNHAARTFQS EQNLIFRLGN

151 QKHRRNLMTQ GFYGVCIQIA VKIQHKKAGF LRFGRFLPTL LQTLFLCFGF

201 RLFLFLFLFF LMFCLFPA*
```

m012-1/g012 91.7% identity in 218 aa overlap

```
                    10        20        30        40        50        60
m012-1.pep  MLARCHFLNIQLRAVLADKLLEQLMRFLQFLSEFLFALFRIFTHKSNRALKFARRHHIHI
            |||| :|:|||  ||::|||||||||||||| ||||||||||||||||||||||||||||
g012        MLARRYFFNIQPGAVFTDKLLEQLMRFLQFLPEFLFALFRIFTHKSNRALKFARRHHIHI
                    10        20        30        40        50        60

                    70        80        90       100       110       120
m012-1.pep  NIMFFQQAVDIRYFRHHTHRTDNRKRSGSNFIRHTRHHITAARRHLIDGDGQRNIAFAQT
            ||||||||||||:|||||||||:|||||:|||||||||||:|| | ||||||||||||||
g012        NIMFFQQAVDIRHFRHHTHRTDDRKRSGNNFIRHTRHHIAAACRDLIDGDGQRNIAFAQT
                    70        80        90       100       110       120

                   130       140       150       160       170       180
m012-1.pep  XKLRSRQTVTVNHAARTFQSEQNLIFRLGNQKHRRNLMTQGFYGVCIQIAVKIQHKKAGF
             |||||||||||||||||||||||||||||||||||||||||||||||||||||||||||
g012        PKLRSRQTVTVNHAARTFQSEQNLIFRLGNQKHRRNLMTQGFYGVCIQIAVKIQHKKAGF
                   130       140       150       160       170       180

                   190       200       210      219
m012-1.pep  LRFGRFLPTLLQTLFLCFGFRLFLFLFLFFLMFCLFPAX
            ||||||||:||||||||||||||||||:|||||||| ||
g012        LRFGRFLPALLQTLFLCFGFRLFLFLFFFFLMFCLFLAX
                   190       200       210
```

The following partial DNA sequence was identified in *N. meningitidis* <SEQ ID 85>:

a012-1.seq

```
  1 ATGCTCGCCC GTTGCCACTT CCTCAATATC CAATTGAGGG CGGTTCTCGC

 51 TGACAAACTG CTTGAACAAC TGATGCGTTT CCTCCAGTTC CTGTCGGAAT

101 TTCTGTTTGC CCTTTTCCGT ATTTTCACCC ATAAAAGTAA CCGTGCGCTT

151 AAATTCGCCC GCCGTCATCA CATCCACATC AATATCATGT TTTTTCAACA

201 GGCGGTGGAT ATTCGGTACT TCCGCTACAA CACCCACCGA ACCGACAATC

251 GCAAACGGAG CGGAAACAAT TTTATCCGCC ACACACGCCA TCATATAACC

301 ACCGCTCGCC GCCACCTTAT CGACGGCGAC GGTCAGCGGA ATATTGCGTT
```

-continued

```
351 CGCGCAAACG CCTAAGCTGC GAAGCCGCCA AACCGTAACC GTGAACCACG

401 CCGCCCGGAC TTTCCAATCT AAGCAGAACC TCATCTTCAG GCTTGGCAAT

451 CAAAAGCACC GCCGTAATCT CATGACGCAA GGATTCTACG GCGTGTGCAT

501 ACAAATCGCC GTCAAAATCC AACACAAAAA GGCGGGATTT TTGCGTTTCG

551 GAAGATTTCT CCCCACCCTC CTTCAAACGC TTTTTCTCTG CTTTGGCTTC

601 CGCCTTTTCC TTTTTCTTTT CCTCTTTTTC CTGATGTTTT GCCTCTTCCC

651 CGCTTAA
```

This corresponds to the amino acid sequence <SEQ ID 86; ORF 012-1.a>:

a012-1.pep

```
  1 MLARCHFLNI QLRAVLADKL LEQLMRFLQF LSEFLFALFR IFTHKSNRAL

 51 KFARRHHIHI NIMFFQQAVD IRYFRYNTHR TDNRKRSGNN FIRHTRHHIT

101 TARRHLIDGD GQRNIAFAQT PKLRSRQTVT VNHAARTFQS KQNLIFRLGN

151 QKHRRNLMTQ GFYGVCIQIA VKIQHKKAGF LRFGRFLPTL LQTLFLCFGF

201 RLFLFLFLFF LMFCLFPA*
```

a012-1/m012-1 97.2% identity in 218 aa overlap

```
                   10        20        30        40        50        60
a012-1.pep  MLARCHFLNIQLRAVLADKLLEQLMRFLQFLSEFLFALFRIFTHKSNRALKFARRHHIHI
            ||||||||||||||||||||||||||||||||||||||||||||||||||||||||||||
m012-1      MLARCHFLNIQLRAVLADKLLEQLMRFLQFLSEFLFALFRIFTHKSNRALKFARRHHIHI
                   10        20        30        40        50        60

                   70        80        90       100       110       120
a012-1.pep  NIMFFQQAVDIRYFRYNTHRTDNRKRSGNNFIRHTRHHITTARRHLIDGDGQRNIAFAQT
            |||||||||||||||::|||||||||||:|||||||||||:|||||||||||||||||||
m012-1      NIMFFQQAVDIRYFRHHTHRTDNRKRSGSNFIRHTRHHITAARRHLIDGDGQRNIAFAQT
                   70        80        90       100       110       120

                  130       140       150       160       170       180
a012-1.pep  PKLRSRQTVTVNHAARTFQSKQNLIFRLGNQKHRRNLMTQGFYGVCIQIAVKIQHKKAGF
             ||||||||||||||||||:|||||||||||||||||||||||||||||||||||||||
m012-1      XKLRSRQTVTVNHAARTFQSEQNLIFRLGNQKHRRNLMTQGFYGVCIQIAVKIQHKKAGF
                  130       140       150       160       170       180

                  190       200       210      219
a012-1.pep  LRFGRFLPTLLQTLFLCFGFRLFLFLFLFFLMFCLFPAX
            ||||||||||||||||||||||||||||||||||||||
m012-1      LRFGRFLPTLLQTLFLCFGFRLFLFLFLFFLMFCLFPAX
                  190       200       210
```

The following partial DNA sequence was identified in *N. gonorrhoeae* <SEQ ID 87>:

g013.seq

```
  1 aTgcctttga ccatgctgtg cagcaGGAcg tGCGGTTtgt tcataataca

 51 gtCcgaccGG AAAagcggAG GAAaCGCAGT GCCGCGCCCT TCCCCTTTCT

101 TGCCGTGGCA GGCGATGCag tTgGATTCGT ACACTTTTTG CCCTTTtGtc

151 atgatGCTgt tgtcggCGGC AGAAGCgGCG GcgCAGAGGC AGCACAAGAT
```

-continued

```
201 GAAGGCGGTC GGCAGTCGGG TTGTGTtcat tGgcgTTTCC cctaatgttt

251 tgaaaccttg ttttttgatt Ttgcctttac ggggtgaaaa gtttttTtgg

301 cccaaatccg gaatttag
```

This corresponds to the amino acid sequence <SEQ ID 88; ORF 013.ng:

g013.pep

```
  1 MPLTMLCSRT CGLFIIQSDR KSGGNAVPRP SPFLPWQAMQ LDSYTFCPFV

 51 MMLLSAAEAA AQRQHKMKAV GSRVVFIGVS PNVLKPCFLI LPLRGEKFFW

101 PKSGI*
```

The following partial DNA sequence was identified in *N. meningitidis* <SEQ ID 89>:

m013.seq

```
  1 ATGCCTTTGA CCATGCTGTG CAGCAGCACC TGCGGTTTTT TCATGATGAA

 51 GTCGGAGCGG TAGAGCGGCG GAAACATGGT TCCGCGGCCT TCGCCCTTTT

101 TGCCGTGGCA GGCGACGCAG TTGGATTCGT ACACTTTTTG CCCTTTTGTC

151 ATGATGCTGT TGTCGGCGGC AGAAGCGGCG GCGCAGAAGC AGCCCAAGAC

201 GAGGGCGGTC GGCAGTCGGG TTGTGTTCAT TGGTGTTTCC TTCATGTTTG

251 AAACCTTGTT GTTGATTTTG CGTAGCGGGT GAAAGATTTT TTTGCCGAAT

301 CAGTAG
```

This corresponds to the amino acid sequence <SEQ ID 90; ORF 013>:

m013.pep

```
  1 MPLTMLCSST CGFFMMKSER XSGGNMVPRP SPFLPWQATQ LDSYTFCPFV

 51 MMLLSAAEAA AQKQPKTRAV GSRVVFIGVS FMFETLLLIL RSGXKIFLPN

101 Q*
```

The following partial DNA sequence was identified in *N. meningitidis* <SEQ ID 91>:

a013.seq

```
  1 ATGCCTTTGA CCATGCTGTG CAGCAGCACC TGCGGTTTTT TCATGATGAA

 51 GTCGGAGCGG TAGAGCGGCG GAAACATGGT TCCGCGGCCT TCGCCCTTTT

101 TGCCGTGGCA GGCGACGCAG TTGGATTCGT ACACTTTTTG CCCTTTTGTC

151 ATGATGCTGT TGTCGGCGGC AGAAGCGGCG GCGCAGAGGC AGCCCAAGAC

201 GAGGGCGGTC GGCAGTCGGG TTGTGTTCAT TGGTGTTTCC TTAATGTTTG

251 AAACCTTGTT GTTGATTTTG CGTAGCGGGT GAAAGATTTT CTTGCCGAAT

301 CGGTAG
```

This corresponds to the amino acid sequence <SEQ ID 92; ORF 013.a>:

a013.pep

```
  1 MPLTMLCSST CGFFMMKSER *SGGNMVPRP SPFLPWQATQ LDSYTFCPFV

 51 MMLLSAAEAA AQRQPKTRAV GSRVVFIGVS LMFETLLLIL RSG*KIFLPN

101 R*
```

m013/a013 97.0% identity over a 101 aa overlap

```
                   10        20        30        40        50        60
m013.pep   MPLTMLCSSTCGFFMMKSERXSGGNMVPRPSPFLPWQATQLDSYTFCPFVMMLLSAAEAA
           ||||||||||||||||||||||||||||||||||||||||||||||||||||||||||||
a013       MPLTMLCSSTCGFFMMKSERXSGGNMVPRPSPFLPWQATQLDSYTFCPFVMMLLSAAEAA
                   10        20        30        40        50        60
                   70        80        90       100
m013.pep   AQKQPKTRAVGSRVVFIGVSFMFETLLLILRSGXKIFLPNQX
           ||:|||||||||||||||||:|||||||||||||||||||:|
a013       AQRQPKTRAVGSRVVFIGVSLMFETLLLILRSGXKIFLPNRX
                   70        80        90       100
```

Computer analysis of this amino acid sequence gave the following results:

Homology with a predicted ORF from *N. gonorrhoeae*

ORF 013 shows 73.3% identity over a 101 aa overlap with a predicted ORF (ORF 013.ng) from *N. gonorrhoeae*:

m013/g013

```
                   10        20        30        40        50        60
m013.pep   MPLTMLCSSTCGFFMMKSERXSGGNMVPRPSPFLPWQATQLDSYTFCPFVMMLLSAAEAA
           |||||||| |||:|:::|:| |||| |||||||||||| |||||||||||||||||||||
g013       MPLTMLCSRTCGLFIIQSDRKSGGNAVPRPSPFLPWQAMQLDSYTFCPFVMMLLSAAEAA
                   10        20        30        40        50        60
                   70        80         90       100
m013.pep   AQKQPKTRAVGSRVVFIGVSF-MFETLLLILR-SGXKIFLPNQX
           ||:| | :||||||||||||  :::   :|||   | |:| |:
g013       AQRQHKMKAVGSRVVFIGVSPNVLKPCFLILPLRGEKFFWPKSGIX
                   70        80        90       100
```

The following partial DNA sequence was identified in *N. gonorrhoeae* <SEQ ID 93>:

g015.seq

```
  1 ATGCAGTATC TGATTGTCAA ATACAGCCAT CAAATCTTCG TTACCATCAC

 51 CATTTTGGTA TTCAACATCC GTTTTTTCCT ACTTTGGAAA AATCCAGAAA

101 AGCCCTTGGT CGGCTTTTGG AAAGCACTGC CCCACCTCAA CGACACGATG

151 CTGCTGTTTA CGGGATTGTG GCTGATGAAG ATTACCCATT TCTCCCCGTT

201 CAACGCGCCT TGGCTCGGCA CAAAAATCCT GCTCCTGTTC GCCTACATCG

251 CACTGGGCAT GGTAATGATG CGCGCCCGTC CGCGTTCGAC CAAGTTCTAC

301 ACCGTTTACC TGCTCGCTAT GTGTTGCATC GCCTGCATCG TTTACCTTGC

351 CAAAACCAAA GTCCTGCCAT TCTGA
```

This corresponds to the amino acid sequence <SEQ ID 94; ORF 015.ng>:

g015.pep

```
  1 MQYLIVKYSH QIFVTITILV FNIRFFLLWK NPEKPLVGFW KALPHLNDTM
 51 LLFTGLWLMK ITHFSPFNAP WLGTKILLLF AYIALGMVMM RARPRSTKFY
101 TVYLLAMCCI ACIVYLAKTK VLPF*
```

The following partial DNA sequence was identified in *N. meningitidis* <SEQ ID 95>:

m015.seq (partial)

```
  1 ..AAAATCAGAA AAGCCTTGGC GGGCTTTTGG AAGGCACTGC CCCACCTTAA
 51   CGACACCATG CTGCTGTTTA CGGGATTGTG GCTGATGAAA ATTACCCATT
101   TCTCCCCGTT CAACGCGCCT TGGCTCGGTA CAAAAATCCT GCTTCTGCTC
151   GCCTATATCG CATTGGGTAT GATGATGATG CGCGCCCGTC CGCGTTCGAC
201   CAAGTTCTAC ACCGTTTACC TGCTCGCCAT GTGTTGCGTC GCCTGCATCG
251   TTTACCTTGC CAAAACCAAA GTCCTGCCTT TCTGA
```

This corresponds to the amino acid sequence <SEQ ID 96; ORF 015:

m015.pep (partial)

```
  1 ..KIRKALAGFW KALPHLNDTM LLFTGLWLMK ITHFSPFNAP WLGTKILLLL
51    AYIALGMMMM RARPRSTKFY TVYLLAMCCV ACIVYLAKTK VLPF*
```

The following partial DNA sequence was identified in *N. meningitidis* <SEQ ID 97>:

a015.seq

```
  1 ATGCAGTATC TGATTGTCAA ATACAGCCAT CAAATCTTCG TTACCATCAC
 51 CATTTTGGTA TTCAACATCC GTGTTTTCNT ACTTTGGAAA AATCCAGAAA
101 AGCCCTTGGC GGGCTTTTGG AAGGCACTGC CCCACCTTAA CGACACCATG
151 CTGCTGTTTA CGGGATTGTG GCTGATGAAA ATTACCCATT TCTCCCCGTT
201 CAACGCGCCT TGGCTCGGTA CAAAAATCCT GCTTCTGCTC GCCTATATCG
251 CATTGGGTAT GATGATGATG CGCGCCCGTC CGCGTTCGAC CAAGTTCTAC
301 ACCGTTTACC TGCTCGCCAT GTGTTGCCTC ACCTGCATCG TTTACCTTGC
351 CAAAACCAAA GTCCTGCCTT TCTGA
```

This corresponds to the amino acid sequence <SEQ ID 98; ORF 015.a>:

a015.pep

```
  1 MQYLIVKYSH QIFVTITILV FNIRVFXLWK NPEKPLAGFW KALPHLNDTM
 51 LLFTGLWLMK ITHFSPFNAP WLGTKILLLL AYIALGMMMM RARPRSTKFY
101 TVYLLAMCCL TCIVYLAKTK VLPF*
```

m015/a015 96.7% identity over a 91 aa overlap

```
                                              10        20        30
m015.pep                                 KIRKALAGFWKALPHLNDTMLLFTGLWLMKITH
                                              | |||||||||||||||||||||||||||
a015      LIVKYSHQIFVTITILVFNIRVFXLWKNPEKPLAGFWKALPHLNDTMLLFTGLWLMKITH
                  10        20        30        40        50        60

                  40        50        60        70        80        90
m015.pep  FSPFNAPWLGTKILLLLAYIALGMMMMRARPRSTKFYTVYLLAMCCVACIVYLAKTKVLP
          ||||||||||||||||||||||||||||||||||||||||||||||::||||||||||||
a015      FSPFNAPWLGTKILLLLAYIALGMMMMRARPRSTKFYTVYLLAMCCLTCIVYLAKTKVLP
                  70        80        90       100       110       120

m015.pep  FX
          ||
a015      FX
```

Computer analysis of this amino acid sequence gave the following results:

Homology with a predicted ORF from *N. gonorrhoeae*

ORF 015 shows 94.5% identity over a 91 aa overlap with a predicted ORF (ORF 015.ng) from *N. gonorrhoeae*:

m015/g015

```
                                              10        20        30
m015.pep                                 KIRKALAGFWKALPHLNDTMLLFTGLWLMKITH
                                              | |:|||||||||||||||||||||||||
g015      LIVKYSHQIFVTITILVFNIRFFLLWKNPEKPLVGFWKALPHLNDTMLLFTGLWLMKITH
                  10        20        30        40        50        60

                  40        50        60        70        80        90
m015.pep  FSPFNAPWLGTKILLLLAYIALGMMMMRARPRSTKFYTVYLLAMCCVACIVYLAKTKVLP
          ||||||||||||||||:|||||||:|||||||||||||||||||||:|||||||||||||
g015      FSPFNAPWLGTKILLLFAYIALGMVMMRARPRSTKFYTVYLLAMCCIACIVYLAKTKVLP
                  70        80        90       100       110       120

m015.pep  FX
          ||
g015      FX
```

The following partial DNA sequence was identified in *N. gonorrhoeae* <SEQ ID 99>:

g018.seq

```
  1 atGCAGCAGG GGCagttggt tggacgcgtc gcccgcaata AAGATATGCG
 51 GAATgctggt CTGCATggtC AGCGGATCGG CAACGGGtac gccgcgcgcg
101 tctttgTCGA TATTGATGTT TTCCAAACCG ATATtgTCAA CGTTCGGACG
151 GCgACCTACG GCTGCCAACA TATATTCGGC AACAAATACG CCTTTTTCGC
201 CATCCTGCTC CCAATGGACT tctACATTGC CGTCTGCGTC GAGTTTGACC
251 TCGGTTTTAG CATCCAGATG CAGTTTCAAT tctTCTCCGA ACACGGCTTT
301 CGCCTCGTCT GA
```

This corresponds to the amino acid sequence <SEQ ID 100; ORF 018.ng>:

g018.pep

```
  1 MQQGQLVGRV ARNKDMRNAG LHGQRIGNGY AARVFVDIDV FQTDIVNVRT
 51 ATYGCQHIFG NKYAFFAILL PMDFYIAVCV EFDLGFSIQM QFQFFSEHGF
101 RLV*
```

The following partial DNA sequence was identified in *N. meningitidis* <SEQ ID 101>:

m018.seq

```
  1 ATGCAGCAGA GGCAGTTGGT TGGACGCATC GCCTGCGATG AAGATATGCG
 51 GAATACTGGT CTGCATGGTC AGCGGGTCGG CAACAGGTAC GCCGCGCGCA
101 TCTTTTTCGA TATTGATATT TTCCAAACCG ATATTGTCAA CGTTCGGACG
151 GCGGCCCACG GCTGCCAGCA TATATTCGGC AACAAATACG CCTTTTTCGC
201 CATCCTGCTC CCAATGGACT TCTACATTGC CGTCTGCATC GAGTTTGACC
251 TCGGTTTTAG CATCCAGATG CAGTTTCAAT TCTTCGCCGA ACACGGCGTT
301 CGCCTCGTCT GA
```

This corresponds to the amino acid sequence <SEQ ID 102; ORF 018>:

m018.pep

```
  1 MQQRQLVGRI ACDEDMRNTG LHGQRVGNRY AARIFFDIDI FQTDIVNVRT
 51 AAHGCQHIFG NKYAFFAILL PMDFYIAVCI EFDLGFSIQM QFQFFAEHGV
101 RLV*
```

The following partial DNA sequence was identified in *N. meningitidis* <SEQ ID 103>:

a018.seq

```
  1 ATGCAGCAGG GGCAGTTGGT TGGACGCGTC GCCCGCAATA AAGATATGCG
 51 GAATACTGGT CTGCATAGTC AGCGGATCGG CAACGGGTAC GCCGCGCGCA
101 TCTTTTTCGA TATTGATGTT TTCCAAACCG ATATTGTCAA CGTTCGGACG
151 GCGGCCTACG GCTGCCAGCA TATATTCGGC AACAAATACG CCTTTTTCGC
201 CATCCTGCTC CCAATGGACT TCTACATTGC CGTCTGCGTC GAGTTTGGCC
251 TCGGTTTTAG CATCCAAATG CAGTTTCAAT TCTTCACCGA ACACGGCTTT
301 CGCCTCGTCT GA
```

This corresponds to the amino acid sequence <SEQ ID 104; ORF 018.a>:

a018.pep

```
  1 MQQGQLVGRV ARNKDMRNTG LHSQRIGNGY AARIFFDIDV FQTDIVNVRT
 51 AAYGCQHIFG NKYAFFAILL PMDFYIAVCV EFGLGFSIQM QFQFFTEHGF
101 RLV*
```

m018/a018 86.4% identity over a 103 aa overlap

```
                    10        20        30        40        50        60
m018.pep    MQQRQLVGRIACDEDMRNTGLHGQRVGNRYAARIFFDIDIFQTDIVNVRTAAHGCQHIFG
            ||| |||||:| ::||||||||:||:|| ||||||||||:||||||||||||:|||||||
a018        MQQGQLVGRVARNKDMRNTGLHSQRIGNGYAARIFFDIDVFQTDIVNVRTAAYGCQHIFG
                    10        20        30        40        50        60

                    70        80        90       100
m018.pep    NKYAFFAILLPMDFYIAVCIEFDLGFSIQMQFQFFAEHGVRLVX
            |||||||||||||||||||:|| ||||||||||||:||| ||||
a018        NKYAFFAILLPMDFYIAVCVEFGLGFSIQMQFQFFTEHGFRLVX
                    70        80        90       100
```

Computer analysis of this amino acid sequence gave the following results:

Homology with a predicted ORF from *N. gonorrhoeae*

ORF 018 shows 84.5% identity over a 103 aa overlap with a predicted ORF (ORF 018.ng) from *N. gonorrhoeae*:

```
m018/g018

                    10        20        30        40        50        60
m018.pep    MQQRQLVGRIACDEDMRNTGLHGQRVGNRYAARIFFDIDIFQTDIVNVRTAAHGCQHIFG
            ||| |||||:| ::||||:||||||:|| ||||:| |||:|||||||||||::|||||||
g018        MQQGQLVGRVARNKDMRNAGLHGQRIGNGYAARVFVDIDVFQTDIVNVRTATYGCQHIFG
                    10        20        30        40        50        60

                    70        80        90       100
m018.pep    NKYAFFAILLPMDFYIAVCIEFDLGFSIQMQFQFFAEHGVRLVX
            |||||||||||||||||||:|||||||||||||||:||| ||||
g018        NKYAFFAILLPMDFYIAVCVEFDLGFSIQMQFQFFSEHGFRLVX
                    70        80        90       100
```

The following partial DNA sequence was identified in *N. gonorrhoeae* <SEQ ID 105>:

```
g019.seq (partial)

  1 . . . ctgctggcgg ccctggtgct tgccgcgtgt tcttcgACAA ACAcacTGCC
 51       AGCCGGCAAG ACCCCGGCAG ACAATATAGA AActgcCgAC CTTTCGGCAA
101       GCGTTCCCAC ccgcCCTGCC GAACCGGAAG GAAAAACGCT GGCAGATTAC
151       GGCGGCTACC CGTCCGCACT GGATGCAGTG AAACAGAACA ACGATGCGGC
201       AGCCGCCGCC TATTTGGAAA Acgcaggaga cagCGcgatg gcGGAAAatg
251       tccgcaagga gtgGCTGa
```

This corresponds to the amino acid sequence <SEQ ID 106; ORF 019.ng>:

```
g019.pep (partial)

 1 . . . LLAALVLAAC SSTNTLPAGK TPADNIETAD LSASVPTRPA EPEGKTLADY
51       GGYPSALDAV KQNNDAAAAA YLENAGDSAM AENVRKEWL*
```

The following partial DNA sequence was identified in *N. meningitidis* <SEQ ID 107>:

m019.seq (partial)

```
   1 ATGTACCTAC CCTCTATGAA GCATTCCCTG CCGCTGCTGG CGGCCCTGGT
  51 GCTTGCCGCG TGTTCTTCGA CAAACACACT GCCAGCCGGC AAGACCCCGG
 101 CAGACAATAT AGAAACTGCC GACCTTTCGG CAAGCGTTCC CACCCGCCCT
 151 GCCGAACCCG AAAGAAAAAC GCTGGCAGAT TACGGCGGCT ACCCGTCCGC
 201 ACTGGATGCA GTGAAACAGA AAAACGATGC CGCCGTCGCC GCCTATTTGG
 251 AAAACGCCGG CGACAGCGCG ATGGCGGAAA ATGTCCGCAA CGAGTGGCTG
 301 AAGTCTTTGG GCGCACGCAG ACAGTGGACG CTGTTTGCAC AGGAATACGC
 351 CAAACTCGAA CCGGCAGGGC GCGCCCAAGA AGTCGAATGC TACGCCGATT
 401 CGAGCCGCAA CGACTATACG CGTGCCGCTG AACTGGTCAA AAATACGGGC
 451 AAACTGCCTT CGGGCTGCAC CAAACTGTTG GAACAGGCAG CCGCATCCGG
 501 CTTGTTGGAC GGCAACGACG CCTGGAGGCG CGTGCGCGGA CTGCTGGCCG
 551 GCCGCCAAAC CACAGACGCA CGCAACCTTG CCGCCGCATT GGGCAGCCCG
 601 TTTGACGGCG GTACACAAGG TTCGCGCGAA TATGCCCTGT TGAACGTCAT
 651 CGGCAAAGAA GCACGCAAAT CGCCGAATGC CGCCGCCCTG CTGTCCGAAA
 701 TGGAAAGCGG TTTAAGCCTC GAACAACGCA GTTTCGCGTG GGGCGTATTG
 751 GGGCATTATC AGTCGCAAAA CCTCAATGTG CCTGCCGCCT TGGACTATTA
 801 CGGCAAGGTT GCCGACCGCC GCCAACTGAC CGACGACCAA ATCGAGTGGT
 851 ACGCCCGCGC CGCCTTGCGC GCCCGACGTT GGGACGAGCT GGCCTCCGTT
 901 ATCTCGCATA TGCCCGAAAA ACTGCAAAAA AGCCCGACCT GGCTCTACTG
 951 GCTGGCACGC AGCCGCGCCG CAACGGGCAA CACGCAAGAG GCGGAAAAAC
1001 TTTACAAACA GGCGGCAGCG ACGGGCAGGA ATTTTTATGC GGTGCTGGCA
1051 GGGGAAGAAT TGGGTCGGAA AATCGATACG CGCAACAATG TGCCCGATGC
1101 CGGCAAAAAC AGCGTCCGCC GCATGGCGGA AGACGGTGCA GTCAAACGCG
1151 CACTGGTACT GTTCCAAAAC AGCCAATCTG CCGGTGATGC AAAAATGCGC
1201 CGTCAGGCTC AGGCGGAATG GCGTTTTGCC ACACGCGGCT TTGACGAAGA
1251 CAAGCTGCTG ACCGCCGCGC AAACCGCGTT CGACCACGGT TTTTACGATA
1301 TGGCGGTCAA CAGCGCGGAA CGCACCGACC GCAAACTCAA CTACACCTTG
1351 CGCTATATTT CGCCGTTTAA AGACACGGTA ATCCGCCACG CGCAAAATGT
1401 TAATGTCGAT CCGGCTTGGG TTTATGGGCT GATTCGTCAG GAAAGCCGCT
1451 TCGTTATAGG CGCGCAATCC CGCGTAGGCG CGCAGGGGCT GATGCAGGTT
1501 ATGCCTGCCA CCGCGCGCGA AATCGCCGGC AAAATCGGTA TGGATGCCGC
1551 ACAACTTTAC ACCGCCGACG GG . . .
```

This corresponds to the amino acid sequence <SEQ ID 108; ORF 019>:

m019.pep (partial)

```
  1 MYLPSMKHSL PLLAALVLAA CSSTNTLPAG KTPADNIETA DLSASVPTRP
 51 AEPERKTLAD YGGYPSALDA VKQKNDAAVA AYLENAGDSA MAENVRNEWL
101 KSLGARRQWT LFAQEYAKLE PAGRAQEVEC YADSSRNDYT RAAELVKNTG
```

-continued

```
151 KLPSGCTKLL EQAAASGLLD GNDAWRRVRG LLAGRQTTDA RNLAAALGSP

201 FDGGTQGSRE YALLNVIGKE ARKSPNAAAL LSEMESGLSL EQRSFAWGVL

251 GHYQSQNLNV PAALDYYGKV ADRRQLTDDQ IEWYARAALR ARRWDELASV

301 ISHMPEKLQK SPTWLYWLAR SRAATGNTQE AEKLYKQAAA TGRNFYAVLA

351 GEELGRKIDT RNNVPDAGKN SVRRMAEDGA VKRALVLFQN SQSAGDAKMR

401 RQAQAEWRFA TRGFDEDKLL TAAQTAFDHG FYDMAVNSAE RTDRKLNYTL

451 RYISPFKDTV IRHAQNVNVD PAWVYGLIRQ ESRFVIGAQS RVGAQGLMQV

501 MPATAREIAG KIGMDAAQLY TADG . . .
```

The following partial DNA sequence was identified in *N. meningitidis* <SEQ ID 109>:

a019.seq

```
   1 ATGTACCCAC CCTCTCTGAA GCATTCCCTG CCGCTGCTGG TGGNCCTGGT

  51 GCTTGCCGCG TGTTCTTNGA CAAACACACT GTCAGCCGAC AAGACCCCGG

 101 CAGACAATAT AGAAACTGCC GACCTTTCGG CAAGCGTTCC CACCNGCCCT

 151 GCCGAACCCG AANGAAAAAC GTNGGCAGAT TACGGCGGCT ACCCGTCCGC

 201 ACTGGATGCA GTGAAACAGA AAAACGATGC CGCCGTCGCC GCCTATTTGG

 251 AAAACGCCGG CGACAGCGCG ATGGCGGAAA ATGTCCGCAA CGAGTGGCTG

 301 AAGTCTTTGG GCGCGCGCAG ACAGTGGACG CTGTNTGCAC ANGAATATGC

 351 NAAACTCGAA CCGGCANGGC GCGCCCAAGA AGTCGAATGC TACGCCGATT

 401 CGAGCCGCAA CGACTATACG CGTGCCGCCG AACTGGTCAA AAATACGGGC

 451 AAACTGCCTT CGGGCTGCAC CAAACTGTTG GAACAGGCAG CCGCATCCGG

 501 CTTGTTGGAC GGCAACGACG CCTGGAGGCG CGTGCGCGGA CTGCTGGCCG

 551 GCCGCCAAAC CACAGACGCA CGCAACCTTG CCGCCGCATT GGGCAGCCCG

 601 TTTGACGGCG GTACACAAGG TTCGCGCGAA TATGCCCTGT TGAACGTCAT

 651 CGGCAAAGAA GCACGCAAAT CGCCGAATGC CGCCGCCCTG CTGTCCGAAA

 701 TGGAAAGCGG TTTAAGCCTC GAACAACGCA GTTTCGCGTG GGGCGTATTG

 751 GGGCATTATC AGTCGCAAAA CCTCAATGTG CCTGCCGCCT TGGACTATTA

 801 NGGCAAGGTT GCCGACCGCC GCCAACTGAC CGACGACCAA ATCGAGTGGT

 851 ACGCCCGCGC CGCNNTNNGC NNNCGNNGTT NGNANGANNT GGCNNCCGNN

 901 ANCNCGNNNN TGCNNGANAA ACNNNNNNAN AGNCNNANNT NGNTNNANTG

 951 NNTGGCACGC AGCCGCGCCG CNACGGGCAA CACGCAANAN GCGGANAAAC

1001 TNTACAAACA GGCGGCAGCA NCGGGCANGA ATTTTTATGC NGTGCTGNCN

1051 GGGGAAGAGT TGGGGCGCAN AATCGATACG CGCAACAATG TGCCCGATGC

1101 CGGCAAAANC AGCGTCCTCC GTATGGCGGA AGACGGCGCG ATTAAGCGCG

1151 CGCTGGTGCT GTTCCGAAAC AGCCGAACCG CCGGCGATGC GAAAATGCGC

1201 CGTCNGGCTC AGGCGGAATG GCGTTTCGCC ACACGCGGCT TCGATGAAGA

1251 CAAGCTGCTG ACCGCCGCGC AAACCGCGTT CGACCACGGT TTTTACGATA

1301 TGGCGGTCAA CAGCGCGGAA CGCACCGACC GCAAACTCAA CTACACCTTG
```

-continued

```
1351 CGCTACATTT CGNNNNNTNA NGACACGGTA ATCCGCCACG CGCAAAATGT

1401 TAATGTCGAT CCGGCGTGGG TTTACGGGCT GATTCGTCAG GAAAGCCGCT

1451 TCGTTATGGG CGCGCAATCC CGCGTAGGCG CGCAGGGGCT GATGCAGGTT

1501 ATGCCTGCCA CCGCGCGCGA AATCGCCGGC AAAATCGGTA TGGATGCCGC

1551 ACAACTTTAC ACCGCCGACG GCAATATCCG TATGGGGACG TGGTATATGG

1601 CGGACACCAA ACGCCGCCTG CAAAACAACG AAGTCCTCGC CACCGCAGGC

1651 TATAACGCCG GTCCCGGCAG GGCGCGCCGA TGGCAGGCGG ACACGCCCCT

1701 CGAAGGCGCG GTATATGCCG AAACCATCCC GTTTTCCGAA ACGCGCGACT

1751 ATGTGAAAAA AGTGATGGCC AATGCCGCCT ACTACGCCTC CCTCTTCGGC

1801 GCGCCGCACA TCCCGCTCAA ACAGCGTATG GGCATTGTCC CCGCCCGCTG

1851 A
```

This corresponds to the amino acid sequence <SEQ ID 110; ORF 019.a>:

a019.pep

```
  1 MYPPSLKHSL PLLVXLVLAA CSXTNTLSAD KTPADNIETA DLSASVPTXP

 51 AEPEXKTXAD YGGYPSALDA VKQKNDAAVA AYLENAGDSA MAENVRNEWL

101 KSLGARRQWT LXAXEYAKLE PAXRAQEVEC YADSSRNDYT RAAELVKNTG

151 KLPSGCTKLL EQAAASGLLD GNDAWRRVRG LLAGRQTTDA RNLAAALGSP

201 FDGGTQGSRE YALLNVIGKE ARKSPNAAAL LSEMESGLSL EQRSFAWGVL

251 GHYQSQNLNV PAALDYXGKV ADRRQLTDDQ IEWYARAAXX XRXXXXXAXX

301 XXXXXXKXXX XXXXXXXXAR SRAATGNTQX AXKLYKQAAA XGXNFYAVLX

351 GEELGRXIDT RNNVPDAGKX SVLRMAEDGA IKRALVLFRN SRTAGDAKMR

401 RXAQAEWRFA TRGFDEDKLL TAAQTAFDHG FYDMAVNSAE RTDRKLNYTL

451 RYISXXXDTV IRHAQNVNVD PAWVYGLIRQ ESRFVMGAQS RVGAQGLMQV

501 MPATAREIAG KIGMDAAQLY TADGNIRMGT WYMADTKRRL QNNEVLATAG

551 YNAGPGRARR WQADTPLEGA VYAETIPFSE TRDYVKKVMA NAAYYASLFG

601 APHIPLKQRM GIVPAR*
```

m019/a019 88.9% identity over a 524 aa overlap

```
                    10        20        30        40        50        60
m019.pep    MYLPSMKHSLPLLAALVLAACSSTNTLPAGKTPADNIETADLSASVPTRPAEPERKTLAD
            || ||:|||||||: ||||||| |||| | |||||||||||||||||| ||||| || ||
a019        MYPPSLKHSLPLLVXLVLAACSXTNTLSADKTPADNIETADLSASVPTXPAEPEXKTXAD
                    10        20        30        40        50        60

                    70        80        90       100       110       120
m019.pep    YGGYPSALDAVKQKNDAAVAAYLENAGDSAMAENVRNEWLKSLGARRQWTLFAQEYAKLE
            ||||||||||||||||||||||||||||||||||||||||||||||||||| | ||||||
a019        YGGYPSALDAVKQKNDAAVAAYLENAGDSAMAENVRNEWLKSLGARRQWTLXAXEYAKLE
                    70        80        90       100       110       120

                   130       140       150       160       170       180
m019.pep    PAGRAQEVECYADSSRNDYTRAAELVKNTGKLPSGCTKLLEQAAASGLLDGNDAWRRVRG
            || |||||||||||||||||||||||||||||||||||||||||||||||||||||||||
a019        PAXRAQEVECYADSSRNDYTRAAELVKNTGKLPSGCTKLLEQAAASGLLDGNDAWRRVRG
                   130       140       150       160       170       180
```

-continued

```
                 190       200       210       220       230       240
m019.pep  LLAGRQTTDARNLAAALGSPFDGGTQGSREYALLNVIGKEARKSPNAAALLSEMESGLSL
          ||||||||||||||||||||||||||||||||||||||||||||||||||||||||||||
a019      LLAGRQTTDARNLAAALGSPFDGGTQGSREYALLNVIGKEARKSPNAAALLSEMESGLSL
                 190       200       210       220       230       240

                 250       260       270       280       290       300
m019.pep  EQRSFAWGVLGHYQSQNLNVPAALDYYGKVADRRQLTDDQIEWYARAALRARRWDELASV
          |||||||||||||||||||||||||| |||||||||||||||||||||   |     |
a019      EQRSFAWGVLGHYQSQNLNVPAALDYXGKVADRRQLTDDQIEWYARAAXXXRXXXXXAXX
                 250       260       270       280       290       300

                 310       320       330       340       350       360
m019.pep  ISHMPEKLQKSPTWLYWLARSRAATGNTQEAEKLYKQAAATGRNFYAVLAGEELGRKIDT
                |     :     ||||||||||| | ||||||||:| |||||| |||||| |||
a019      XXXXXXKXXXXXXXXXXXARSRAATGNTQXAXKLYKQAAAXGXNFYAVLXGEELGRXIDT
                 310       320       330       340       350       360

                 370       380       390       400       410       420
m019.pep  RNNVPDAGKNSVRRMAEDGAVKRALVLFQNSQSAGDAKMRRQAQAEWRFATRGFDEDKLL
          ||||||||| || |||||||:|||||||:||::|||||||| ||||||||||||||||||
a019      RNNVPDAGKXSVLRMAEDGAIKRALVLFRNSRTAGDAKMRRXAQAEWRFATRGFDEDKLL
                 370       380       390       400       410       420

                 430       440       450       460       470       480
m019.pep  TAAQTAFDHGFYDMAVNSAERTDRKLNYTLRYISPFKDTVIRHAQNVNVDPAWVYGLIRQ
          ||||||||||||||||||||||||||||||||||   |||||||||||||||||||||||
a019      TAAQTAFDHGFYDMAVNSAERTDRKLNYTLRYISXXXDTVIRHAQNVNVDPAWVYGLIRQ
                 430       440       450       460       470       480

                 490       500       510       520
m019.pep  ESRFVIGAQSRVGAQGLMQVMPATAREIAGKIGMDAAQLYTADG
          |||||:||||||||||||||||||||||||||||||||||||||
a019      ESRFVMGAQSRVGAQGLMQVMPATAREIAGKIGMDAAQLYTADGNIRMGTWYMADTKRRL
                 490       500       510       520       530       540


a019      QNNEVLATAGYNAGPGRARRWQADTPLEGAVYAETIPFSETRDYVKKVMANAAYYASLFG
                 550       560       570       580       590       600
```

Computer analysis of this amino acid sequence gave the following results:

Homology with a predicted ORF from *N. gonorrhoeae*

ORF 019 shows 95.5% identity over a 89 aa overlap with a predicted ORF (ORF 019.ng) from *N. gonorrhoeae*:

```
g019/m019

                             10        20        30        40       49
g019.pep             LLAALVLAACSSTNTLPAGKTPADNIETADLSASVPTRPAEPEGKTLAD
                     ||||||||||||||||||||||||||||||||||||||||||| |||||
m019      MYLPSMKHSLPLLAALVLAACSSTNTLPAGKTPADNIETADLSASVPTRPAEPERKTLAD
                  10        20        30        40        50        60

        50        60        70        80        89
g019.pep  YGGYPSALDAVKQNNDAAAAAYLENAGDSAMAENVRKEWL
          |||||||||||||:||||:|||||||||||||||||:|||
m019      YGGYPSALDAVKQKNDAAVAAYLENAGDSAMAENVRNEWLKSLGARRQWTLFAQEYAKLE
                  70        80        90       100       110       120
```

The following partial DNA sequence was identified in *N. gonorrhoeae* <SEQ ID 111>:

```
g023.seq

  1 ATGGTAGAAC GTAAATTGAC CGGTGCCCAT TACGGTTTGC GCGATTGGGT

 51 AATGCAGCGT GCGACTGCGG TTATTATGTT GATTTATACC GTTGCACTTT

101 TAGTGGTTCT ATTTGCCCTG CCTAAAGAAT ATCCGGCATG GCAGGCATTT

151 TTTAGTCAAG CTTGGGTAAA AGTATTTACC CAAGTGAGCT TTATCGCCGT

201 ATTCTTGCAC GCTTGGGTGG GTATCCGCGA TTTGTGGATG GACTATATCA
```

-continued

```
251 AACCCTTCGG CGTGCGTTTG TTTTTGCAGG TTGCCACCAT TGtctGGCTG

301 GTCGGCTGCC TCGTGTATTC AGTTAAAGTG ATTTGGGGGT AA
```

This corresponds to the amino acid sequence <SEQ ID 112; ORF 023.ng>:

g023.pep

```
  1 MVERKLTGAH YGLRDWVMQR ATAV
IMLIYT VALLVVLFAL PKEYPAWQAF

 51 FSQAWVKVFT QVSFIAVFLH AWVGIRDLWM DYIKPFGVR
L FLQVATIVWL

101 VGCLVYSVKV IWG*
```

The following partial DNA sequence was identified in *N. meningitidis* <SEQ ID 113>:

m023.seq

```
  1 ATGGTAGAAC GTAAATTGAC CGGTGCCCAT TACGGTTTGC GCGATTGGGT

 51 GATGCAACGT GCGACTGCGG TTATTATGTT GATTTATACC GTTGCACTTT

101 TAGTGGTTCT ATTTTCCCTG CCTAAAGAAT ATTCGGCATG GCAGGCATTT

151 TTTAGTCAAA CTTGGGTAAA AGTATTTACC CAAGTGAGCT TCATCGCCGT

201 ATTCTTGCAC GCTTGGGTGG GTATCCGCGA TTTGTGGATG GACTATATCA

251 AACCCTTCGG CGTGCGTTTG TTTTTGCAGG TTGCCACCAT CGTTTGGCTG

301 GTCGGCTGTC TCGTGTATTC AGTTAAAGTG ATTTGGGGGT AA
```

This corresponds to the amino acid sequence <SEQ ID 114; ORF 023>:

m023.pep

```
  1 MVERKLTGAH YGLRDWVMQR ATAVIMLIYT VALLVVLFSL PKEYSAWQAF

 51 FSQTWVKVFT QVSFIAVFLH AWVGIRDLWM DYIKPFGVRL FLQVATIVWL

101 VGCLVYSVKV IWG*
```

The following partial DNA sequence was identified in *N. meningitidis* <SEQ ID 115>:

a023.seq

```
  1 ATGGTAGAAC GTAAATTGAC CGGTGCCCAT TACGGTTTGC GGGATTGGGC

 51 GATGCAACGT GCGACCGCGG TTATTATGTT GATTTATACC GTTGCACTTT

101 TAGTGGTTCT ATTTGCTCTG CCTAAAGAAT ATTCGGCATG GCAGGCATTT

151 TTTAGTCAAA CTTGGGTAAA AGTATTTACC CAAGTGAGCT TCATCGCCGT

201 ATTCTTGCAC GCTTGGGTGG GTATCCGCGA TTTGTGGATG GACTATATNA

251 AACCCTTCGG CGTGCGTTTG TTTTTGCAGG TTGCCACCAT CGTCTGGCTG

301 GTCGGCTGCT TGGTGTATTC AATTAAAGTA ATTTGGGGGT AA
```

This corresponds to the amino acid sequence <SEQ ID 116; ORF 023.a>:

a023.pep

```
  1 MVERKLTGAH YGLRDWAMQR ATAVIMLIYT VALLVVLFAL PKEYSAWQAF
 51 FSQTWVKVFT QVSFIAVFLH AWVGIRDLWM DYXKPFGVRL FLQVATIVWL
101 VGCLVYSIKV IWG*
```

m023/a023 96.5% identity over a 113 aa overlap

```
                  10        20        30        40        50        60
m023.pep   MVERKLTGAHYGLRDWVMQRATAVIMLIYTVALLVVLFSLPKEYSAWQAFFSQTWVKVFT
           ||||||||||||||||:|||||||||||||||||||||:|||||||||||||||||||||
a023       MVERKLTGAHYGLRDWAMQRATAVIMLIYTVALLVVLFALPKEYSAWQAFFSQTWVKVFT
                  10        20        30        40        50        60
                  70        80        90       100       110
m023.pep   QVSFIAVFLHAWVGIRDLWMDYIKPFGVRLFLQVATIVWLVGCLVYSVKVIWGX
           |||||||||||||||||||||| ||||||||||||||||||||||||:|||||
a023       QVSFIAVFLHAWVGIRDLWMDYXKPFGVRLFLQVATIVWLVGCLVYSIKVIWGX
                  70        80        90       100       110
```

Computer analysis of this amino acid sequence gave the following results:

Homology with a predicted ORF from *N. gonorrhoeae*

ORF 023 shows 97.3% identity over a 113 aa overlap with a predicted ORF (ORF 023.ng) from *N. gonorrhoeae*:

g023/m023

```
                  10        20        30        40        50        60
g023.pep   MVERKLTGAHYGLRDWVMQRATAVIMLIYTVALLVVLFALPKEYPAWQAFFSQAWVKVFT
           ||||||||||||||||||||||||||||||||||||||:||||| ||||||||:||||||
m023       MVERKLTGAHYGLRDWVMQRATAVIMLIYTVALLVVLFSLPKEYSAWQAFFSQTWVKVFT
                  10        20        30        40        50        60
                  70        80        90       100       110
g023.pep   QVSFIAVFLHAWVGIRDLWMDYIKPFGVRLFLQVATIVWLVGCLVYSVKVIWGX
           |||||||||||||||||||||||||||||||||||||||||||||||||||||
m023       QVSFIAVFLHAWVGIRDLWMDYIKPFGVRLFLQVATIVWLVGCLVYSVKVIWGX
                  70        80        90       100       110
```

The following partial DNA sequence was identified in *N. gonorrhoeae* <SEQ ID 117>:

g025.seq

```
  1 ATGTTGAAAC AAAcgACACT TTTGGCAGCT TGTACCGCCG TTGCCGCTCT
 51 GTTGGGCGGT TGcgCCACCC AACAGCCTGC TccTGTCATT GCAGGCAATT
101 CAGGTATGCA GACCGTATCG TCTGCGCCGG TTTACAATCC TTATGGCGCA
151 ACGCCGTACA ATGCCGCTCC TGCCGCCAac gatgcGCCgT ATGTGCCGCC
201 CGTGCAAact gcgccggttT ATTCGCCTCC TGCTTATGTT CCGCcgtCTG
251 CACCTGCCGT TTCGGgtaca tatgtTCCTT CTTACGCACC CgtcgACATC
301 aacgCGGCGa cgCataCTAT TGTGCGTGGC GACACgGtgt acaACATTTc
351 caaAcgCtac CATATCTCTC AAGACGATTT CCGTGCGTGG AACGGCATGA
401 CCGACAATAC GTTGAGCATC GGTCAGATTG TTAAAGTCAA ACCGGCaggA
451 TATGCCGCAC CGAAAACCGC AGCCGTAGAA AGCAGGCCCG CCGTACCGGC
501 TGCCGCGCAA ACCCCTGTGA AACCCGCCGC gcaACCGCCC GTTCAGTCCG
```

-continued

```
 551 CGCCGCAACC TGCCGCGCCC GCTGCGGAAA ATAAAGCGGT TCCCGCCCCC
 601 GCGCCCGCCC CGCAATCTCC TGCCGCTTCG CCTTCCGGCA CGCGTTCGGT
 651 CGGCGGCATT GTTTGGCAGC GTCCGACCCA AGGTAAAGTG GTTGCCGATT
 701 TCGGCGGCGG CAACAAGGGT GTCGATATTG CCGGCAATGC CGGACAACCC
 751 GTTTTGGCGG CGGCTGACGG CAAAGTGGTT TATGCCGGTT CAGGTTTGAG
 801 GGGATACGGA AACTTGGTCA TCATCCAGCA CAATTCCTCT TTCCTGACCG
 851 CGTACGGGCA CAACCAAAAA TTGCTGGTCG GCGAAGGTCA GCAGGTCAAA
 901 CGCGGTCAGC AGGTTGCTTT GATGGGTAAT ACCGATGCTT CCAGAACGCA
 951 GCTTCATTTC GAGGTGCGTC AAAACGGCAA ACCGGTTAAC CCGAACAGCT
1001 ATATCGCGTT CTGA
```

This corresponds to the amino acid sequence <SEQ ID 118; ORF 025.ng>:

g025.pep

```
  1 MLKQTTLLAA CTAVAALLGG CATQQPAPVI AGNSGMQTVS SAPVYNPYGA
 51 TPYNAAPAAN DAPYVPPVQT APVYSPPAYV PPSAPAVSGT YVPSYAPVDI
101 NAATHTIVRG DTVYNISKRY HISQDDFRAW NGMTDNTLSI GQIVKVKPAG
151 YAAPKTAAVE SRPAVPAAAQ TPVKPAAQPP VQSAPQPAAP AAENKAVPAP
201 APAPQSPAAS PSGTRSVGGI VWQRPTQGKV VADFGGGNKG VDIAGNAGQP
251 VLAAADGKVV YAGSGLRGYG NLVIIQHNSS FLTAYGHNQK LLVGEGQQVK
301 RGQQVALMGN TDASRTQLHF EVRQNGKPVN PNSYIAF*
```

The following partial DNA sequence was identified in *N. meningitidis* <SEQ ID 119>:

m025.seq (partial)

```
  1 ..GTGCCGCCGG TGCAAAGCGC GCCGGTTTAT ACGCCTCCTG CTTATGTTCC
 51   GCCGTCTGCA CCTGCCGTTT CGGGTACATA CGTTCCTTCT TACGCACCCG
101   TCGACATCAA CGCGGCGACG CATACTATTG TGCGCGGCGA CACGGTGTAC
151   AACATTTCCA AACGCTACCA TATCTCTCAA GACGATTTCC GTGCGTGGAA
201   CGGCATGACC GACAATACGT TGAGCATCGG TCAGATTGTT AAAGTCAAAC
251   CGGCAGGATA TGCCGCACCG AAAGCCGCAG CCGTAAAAAG CAGGCCCGCC
301   GTACCGGCTG CCGCGCAACC GCCCGTACAG TCCGCACCCG TCGACATTAA
351   CGCGGCGACG CATACTATTG TGCGCGGCGA CACGGTGTAC AACATTTCCA
401   AACGCTACCA TATCTCTCAA GACGATTTCC GTGCGTGGAA CGGCATGACC
451   GACAATATGT TGAGCATCGG TCAGATTGTT AAAGTCAAAC CGGCAGGATA
501   TGCCGCACCG AAAACCGCAG CCGTAGAAAG CAGGCCCGCC GTACCGGCTG
551   CCGTGCAAAC CCCTGTGAAA CCCGCCGCGC AACCGCCTGT GCAGTCCGCG
601   CCGCAACCTG CCGCGCCCGC TGCGGAAAAT AAAGCGGTTC CCGCGCCCGC
651   CCCGCAATCT CCTGCCGCTT CGCCTTCCGG CACGCGTTCG GTCGGCGGCA
```

-continued

```
701   TTGTTTGGCA GCGTCCGACG CAAGGTAAAG TGGTTGCCGA TTTCGGCGGC

751   AACAACAAGG GTGTCGATAT TGCCGGTAAT GCGGGACAGC CCGTTTTGGC

801   GGCGGCTGAC GGCAAAGTGG TTTATGCCGG TTCAGGTTTG AGGGGATACG

851   GAAACTTGGT CATCATCCAG CATAATTCTT CTTTCCTGAC CGCATACGGG

901   CACAACCAAA AATTGCTGGT CGGCGAGGGG CAGCAGGTCA AACGCGGTCA

951   GCAGGTTGCT TTGATGGGCA ATACCGATGC TTCCAGAACG CAGCTTCATT

1001  TCGAGGTGCG TCAAAACGGC AAACCGGTTA ACCCGAACAG CTATATCGCG

1051  TTCTGA
```

This corresponds to the amino acid sequence <SEQ ID 110; ORF 025>:

m025.pep (partial)

```
  1 ..VPPVQSAPVY TPPAYVPPSA PAVSGTYVPS YAPVDINAAT HTIVRGDTVY

 51   NISKRYHISQ DDFRAWNGMT DNTLSIGQIV KVKPAGYAAP KAAAVKSRPA

101   VPAAAQPPVQ SAPVDINAAT HTIVRGDTVY NISKRYHISQ DDFRAWNGMT

151   DNMLSIGQIV KVKPAGYAAP KTAAVESRPA VPAAVQTPVK PAAQPPVQSA

201   PQPAAPAAEN KAVPAPAPQS PAASPSGTRS VGGIVWQRPT QGKVVADFGG

251   NNKGVDIAGN AGQPVLAAAD GKVVYAGSGL RGYGNLVIIQ HNSSFLTAYG

301   HNQKLLVGEG QQVKRGQQVA LMGNTDASRT QLHFEVRQNG KPVNPNSYIA

351   F*
```

The following partial DNA sequence was identified in *N. meningitidis* <SEQ ID 111>:

a025.seq

```
  1 ATGTTGACAC CAACAACACT TTAGGTAGCT TGTACCGCCC TTGCCGCTCA

 51 GTTGGGCGGA TGCCCCACCC AACACCCTTC TCCTGTCATT GCAGGCAATT

101 CAGGTATGCA GACCGTACCG TCTGCGCCGG TTTACAATCC TTATGGCGCA

151 ACGCCGTACA ATGCCGCTCC TGCCGCCAAC GATGCGCCGT ATGTGCCGCC

201 GGTGCAAAGC GCGCCGGTTT ATANGCCTCC TGCTTATGTT CCGCCGTCTG

251 CACCTGCCGT TTCGGGTACA TACGTTCCTT CTTACGCANC CGTCGACATC

301 AACGCGGCGA CCCATACTAT TGTGCGCGGC GACACCGTGT ACAAGATTTC

351 CAAATGCTAC CATATCTCTC AAGACGATTT CCGTGCGTGG AACGGCATGA

401 CCGACAATAC GTTGAGCATC GGTCAGATTG TTAAAGTCAA ACCGGCAGGA

451 TATGCCGCAC CGAAAGCCGC AGCCGTAAAA AGCAGGCCCG CCGTACCGGC

501 TGCCGCGCAA CCGCTCGTAC AGTCCGCACC CGTCGACATC AACGCGGCGA

551 CGCATACTAT TGTGCGCGGC GACACGGTGT ACAACATTTC CAAACGCTAC

601 CATATCTCTC AAGACGATTT CCGTGCGTGG AACGGCATGA CCGACAATAC

651 GTTGAGCATC GGTCAGATTG TTAAAGTCAA ACCGGCAGGA TATGCCGCAC

701 CGAAAGCCGC AGCCGTAAAA AGCAGGCCCG CCGTACCGGC TGCCGTGCAA

751 ACCCCTGTGA AACCCGCCGC GCAACCGCCT GTGCAGTCCG CGCCGCAACC
```

-continued

```
 801 TGCCGCGCCC GCTGCGGAAA ATAAAGCGGT TCCCGCGCCC GCCCCGCAAT

 851 CTCCTGCCGC TTCGCCTTCC GGCACGCGTT CGGTCGGCGG CATTGTTTGG

 901 CAGCGTCCGA CGCAAGGTAA AGTGGTTGCC GATTTCGGCG GCAACAACAA

 951 GGGTGTCGAT ATTGCAGGAA ATGCGGGACA GCCCGTTTTG GCGGCGGCTG

1001 ACGGCAAAGT GGTTTATGCA GGTTCCGGTT TGAGGGGATA CGGCAATTTG

1051 GTCATCATCC AGCATAATTC TTCCTTCCTG ACCGCATACG GGCACAACCA

1101 AAAATTGCTG GTCGGCGAAG GCCAGCAGGT CAAACGCGGG CAGCAGGTCG

1151 CTTTGATGGG CAATACCGAG GCTTCTAGAA CGCAGCTTCA TTTCGAGGTG

1201 CGGCAAAACG GCAAACCGGT TAATCCGAAC AGCTATATCG CGTTCTGA
```

This corresponds to the amino acid sequence <SEQ ID 112; ORF 025.a>:

a025.pep

```
  1 MLTPTTL*VA CTALAAQLGG CPTQHPSPVI AGNSGMQTVP SAPVYNPYGA

 51 TPYNAAPAAN DAPYVPPVQS APVYXPPAYV PPSAPAVSGT YVPSYAXVDI

101 NAATHTIVRG DTVYKISKCY HISQDDFRAW NGMTDNTLSI GQIVKVKPAG

151 YAAPKAAAVK SRPAVPAAAQ PLVQSAPVDI NAATHTIVRG DTVYNISKRY

201 HISQDDFRAW NGMTDNTLSI GQIVKVKPAG YAAPKAAAVK SRPAVPAAVQ

251 TPVKPAAQPP VQSAPQPAAP AAENKAVPAP APQSPAASPS GTRSVGGIVW

301 QRPTQGKVVA DFGGNNKGVD IAGNAGQPVL AAADGKVVYA GSGLRGYGNL

351 VIIQHNSSFL TAYGHNQKLL VGEGQQVKRG QQVALMGNTE ASRTQLHFEV

401 RQNGKPVNPN SYIAF*
```

m025/a025 97.4% identity over a 351 aa overlap

```
                                                      10        20        30
m025.pep                                      VPPVQSAPVYTPPAYVPPSAPAVSGTYVPS
                                              ||||||||||:|||||||||||||||||||
a025            GMQTVPSAPVYNPYGATPYNAAPAANDAPYVPPVQSAPVYXPPAYVPPSAPAVSGTYVPS
                    40        50        60        70        80        90

                        40        50        60        70        80        90
m025.pep        YAPVDINAATHTIVRGDTVYNISKRYHISQDDFRAWNGMTDNTLSIGQIVKVKPAGYAAP
                || |||||||||||||||||:||| |||||||||||||||||||||||||||||||||||
a025            YAXVDINAATHTIVRGDTVYKISKCYHISQDDFRAWNGMTDNTLSIGQIVKVKPAGYAAP
                  100       110       120       130       140       150

                       100       110       120       130       140       150
m025.pep        KAAAVKSRPAVPAAAQPPVQSAPVDINAATHTIVRGDTVYNISKRYHISQDDFRAWNGMT
                ||||||||||||||||| ||||||||||||||||||||||||||||||||||||||||||
a025            KAAAVKSRPAVPAAAQPLVQSAPVDINAATHTIVRGDTVYNISKRYHISQDDFRAWNGMT
                  160       170       180       190       200       210

                       160       170       180       190       200       210
m025.pep        DNMLSIGQIVKVKPAGYAAPKTAAVESRPAVPAAVQTPVKPAAQPPVQSAPQPAAPAAEN
                || ||||||||||||||||||:|||:||||||||||||||||||||||||||||||||||
a025            DNTLSIGQIVKVKPAGYAAPKAAAVKSRPAVPAAVQTPVKPAAQPPVQSAPQPAAPAAEN
                  220       230       240       250       260       270

                       220       230       240       250       260       270
m025.pep        KAVPAPAPQSPAASPSGTRSVGGIVWQRPTQGKVVADFGGNNKGVDIAGNAGQPVLAAAD
                ||||||||||||||||||||||||||||||||||||||||||||||||||||||||||||
a025            KAVPAPAPQSPAASPSGTRSVGGIVWQRPTQGKVVADFGGNNKGVDIAGNAGQPVLAAAD
                  280       290       300       310       320       330

                       280       290       300       310       320       330
m025.pep        GKVVYAGSGLRGYGNLVIIQHNSSFLTAYGHNQKLLVGEGQQVKRGQQVALMGNTDASRT
                |||||||||||||||||||||||||||||||||||||||||||||||||||||||:||||
a025            GKVVYAGSGLRGYGNLVIIQHNSSFLTAYGHNQKLLVGEGQQVKRGQQVALMGNTEASRT
                  340       350       360       370       380       390
```

-continued

```
             340         350
m025.pep   QLHFEVRQNGKPVNPNSYIAFX
           ||||||||||||||||||||||
a025       QLHFEVRQNGKPVNPNSYIAFX
               400        410
```

Computer analysis of this amino acid sequence gave the following results:

Homology with a predicted ORF from *N. gonorrhoeae*

ORF 025 shows 75.6% identity over a 353 aa overlap with a predicted ORF (ORF 025.ng) from *N. gonorrhoeae*:

m025/g025

```
                                                        10         20         30
m025.pep                                          VPPVQSAPVYTPPAYVPPSAPAVSGTYVPS
                                                  |||||:||||:||||||||||||||||||
g025       GMQTVSSAPVYNPYGATPYNAAPAANDAPYVPPVQTAPVYSPPAYVPPSAPAVSGTYVPS
               40        50        60        70        80        90

                40         50         60         70         80         90
m025.pep   YAPVDINAATHTIVRGDTVYNISKRYHISQDDFRAWNGMTDNTLSIGQIVKVKPAGYAAP
           ||||||||||||||||||||||||||||||||||||||||||||||||||||||||||||
g025       YAPVDINAATHTIVRGDTVYNISKRYHISQDDFRAWNGMTDNTLSIGQIVKVKPAGYAAP
              100       110       120       130       140       150

               100        110        120        130        140        150
m025.pep   KAAAVKSRPAVPAAAQPPVQSAPVDINAATHTIVRGDTVYNISKRYHISQDDFRAWNGMT
           |
g025       K-----------------------------------------------------------

               160        170        180        190        200        210
m025.pep   DNMLSIGQIVKVKPAGYAAPKTAAVESRPAVPAAVQTPVKPAAQPPVQSAPQPAAPAAEN
                                |||||||||||:||||||||||||||||||||||||
g025       ---------------------TAAVESRPAVPAAAQTPVKPAAQPPVQSAPQPAAPAAEN
                                  160       170       180       190

                  220        230        240        250        260
m025.pep   KAVPAPAP--QSPAASPSGTRSVGGIVWQRPTQGKVVADFGGNNKGVDIAGNAGQPVLAA
           ||||||||  ||||||||||||||||||||||||||||||||:||||||||||||||||
g025       KAVPAPAPAPQSPAASPSGTRSVGGIVWQRPTQGKVVADFGGGNKGVDIAGNAGQPVLAA
              200       210       220       230       240       250

          270        280        290        300        310        320
m025.pep   ADGKVVYAGSGLRGYGNLVIIQHNSSFLTAYGHNQKLLVGEGQQVKRGQQVALMGNTDAS
           ||||||||||||||||||||||||||||||||||||||||||||||||||||||||||||
g025       ADGKVVYAGSGLRGYGNLVIIQHNSSFLTAYGHNQKLLVGEGQQVKRGQQVALMGNTDAS
              260       270       280       290       300       310

          330        340        350
m025.pep   RTQLHFEVRQNGKPVNPNSYIAFX
           ||||||||||||||||||||||||
m025       RTQLHFEVRQNGKPVNPNSYIAFX
              320       330
```

The following partial DNA sequence was identified in *N. gonorrhoeae* <SEQ ID 113>:

g031.seq

```
  1 ATGGTGTCCC TCCGCTTCAG ATTCGGCAAC CACTTTAAAC GCCGACATTC
 51 TGACAATTTC CTTTTCCGCC AGCCAAATAT CATGCGTATC TTTCGGTTCG
101 GGCTTGTTGG GCATGGCAAC CTTCAACAGC CGCGCCATCA CAGGAATCGT
151 CGTTCCCTGA ATCAGCAGCG ACAGCACCAC CACGGCAAAC GCCACATCAA
201 ACAGCAGGTG CGAATTGGGA ACGCCCATCA CCAGCGGCAT CATCGCCAGC
251 GAAATCGGTA CGGCTCCTCG CAAGCCCAAC CAACTGATAT ACGCCTTTTC
301 ACGCAGGCTG TAATTGAATT TCCACAAACC GCCGAACACT GCCAGCGGAC
351 GCGCGACCAG CATCAGGAAC GCCGCAATCG CCAAGGCTTC CGCCGCCCTG
```

-continued

```
401 TCCAACACGC CGGCGGGAGA AACCAGCAGA CCGAGCATGA CGAACAAAGT
451 TGCCTGCGCC AGCCAAGCCA AACCGTCCAT CACACGCAAA ACGTGTTCCG
501 TcgcACGGTT GCGCTGGTTA CCGACAATGA TGCCGGCAAG GTAAACCGCC
551 AAAAAGCCGC TGCCGCCTAT GGTATTGGTA AACGCAAACA CAAGCAGCCC
601 GCCCGACACA ATCATCAGCG CGTACAGACC TTCCGtacac acctccaatt
651 cccaatcaac gtcatagctg tctcccgtgt taaaatgttc ttcacttcag
701 aatccccccc ttcttcccag cccgaaacct tcatgtgtta naccctgggg
751 tgccccaacg gatttagtaa cctcccaatg actctgcttg tcgcccccctt
801 cgcccgcttt ctccttccgg gaaaacttgt tgtccccgtc ttacattaa
```

This corresponds to the amino acid sequence <SEQ ID 114; ORF 031.ng>:

g031.pep

```
  1 MVSLRFRFGN HFKRRHSDNF LFRQPNIMRI FRFGLVGHGN LQQPRHHRNR
 51 RSLNQQRQHH HGKRHIKQQV RIGNAHHQRH HRQRNRYGSS QAQPTDIRLF
101 TQAVIEFPQT AEHCQRTRDQ HQERRNRQGF RRPVQHAGGR NQQTEHDEQS
151 CLRQPSQTVH HTQNVFRRTV ALVTDNDAGK VNRQKAAAAY GIGKRKHKQP
201 ARHNHQRVQT FRTHLQFPIN VIAVSRVKMF FTSESPPSSQ PETFMCXTLG
251 CPNGFSNLPM TLLVAPFARF LLPGKLVVPV LH*
```

The following partial DNA sequence was identified in *N. meningitidis* <SEQ ID 115>:

m031.seq (partial)

```
  1 ...CGCCTGAAGC ACGGTGTCGG ACTGCATTTC TATTCGGCTA TACGCCTTTT
 51    CACGCAGGCT GTAATTGAAT TTCCACAAAC CGCCGAACAC TGCCGACGGA
101    CGCGCGACCA GCATCAGGAA CGCCGCAATC GCCAAgGCTT CCGCCGCCCT
151    GTCCAACACG TTGGCAGGAG AAACCAGCAG CAAAGGCATT CCCAAACGTG
201    CGGACAAAGT GGTCGAAACC ACGCTCAGAA ACAACAGTGC GCCACCCGGC
251    AG....
```

This corresponds to the amino acid sequence <SEQ ID 116; ORF 031>:

m031.pep (partial)

```
 1 ...RLKHGVGLHF YSAIRLFTQA VIEFPQTAEH CRRTRDQHQE RRNRQGFRRP
51    VQHVGRRNQQ QRHSQTCGQS GRNHAQKQQC ATRQ....
```

The following partial DNA sequence was identified in *N. meningitidis* <SEQ ID 117>:

a031.seq

```
  1 ATACGCCTTT TCACGCAGGC TGTAATTGAA TTTCCACAAA CCGCCGAACA

 51 CTGCCGGCGG ACGCGCGACC AGCATCAGGA ACGCCGCAAT CGCCAAGGCT

101 TCCGCCGCCC CGTCCAACAC GTTGGCAGGA GAAACCAGCA GCAAAGGCAT

151 TCCCAAACGT GCGGACAAAG TGGTCGAAAC CACGCTCAGA AACAACAGTG

201 CGCCACCCGG CAG
```

This corresponds to the amino acid sequence <SEQ ID 118; ORF 031.a>:

a031.pep (partial)

```
 1 IRLFTQAVIE FPQTAEHCRR TRDQHQERRN RQGFRRPVQH VGRRNQQQRH

51 SQTCGQSGRN HAQKQQCATR Q
```

m031/a031 100.0% identity over a 71 aa overlap

```
                   10        20        30        40        50        60
m031.pep   RLKHGVGLHFYSAIRLFTQAVIEFPQTAEHCRRTRDQHQERRNRQGFRRPVQHVGRRNQQ
                        |||||||||||||||||||||||||||||||||||||||||||||||
a031                    IRLFTQAVIEFPQTAEHCRRTRDQHQERRNRQGFRRPVQHVGRRNQQ
                                10        20        30        40

                   70        80
m031.pep   QRHSQTCGQSGRNHAQKQQCATRQ
           ||||||||||||||||||||||||
a031       QRHSQTCGQSGRNHAQKQQCATRQ
            50        60        70
```

Computer analysis of this amino acid sequence gave the following results:

Homology with a predicted ORF from *N. gonorrhoeae*

ORF 031 shows 60.0% identity over a 85 aa overlap with a predicted ORF (ORF 031.ng) from *N. gonorrhoeae*:

m031/g031

```
                                                 10        20        30
m031.pep                                 RLKHGVGLHFYSAIRLFTQAVIEFPQTAEH
                                         | ::| :    : |||||||||||||||||
g031       NQQRQHHHGKRHIKQQVRIGNAHHQRHHRQRNRYGSSQAQPTDIRLFTQAVIEFPQTAEH
                60        70        80        90       100       110

                   40        50        60         70        80
m031.pep   CRRTRDQHQERRNRQGFRRPVQHVGRRNQQQRHS-QTCGQSGRNHAQKQQCATRQ
           |:|||||||||||||||||||||:| |||| :|: |:| ::  : ::: | : |:
g031       CQRTRDQHQERRNRQGFRRPVQHAGGRNQQTEHDEQSCLRQPSQTVHHTQNVFRRTVALV
                120       130       140       150       160       170


g031       TDNDAGKVNRQKAAAAYGIGKRKHKQPARHNHQRVQTFRTHLQFPINVIAVSRVKMFFTS
                180       190       200       210       220       230
```

The following partial DNA sequence was identified in *N. gonorrhoeae* <SEQ ID 119>:

g032.seq

```
  1 ATGCGGCGAA ACGTGCCTGC CGTCGCCGTA TTGCGCCGCC CACGATTCGA

 51 GGCGTTTTTG GATTTGGCGT TGGCTCAGGC GCGTGCCGTT CCTGCCGGTA
```

-continued

```
101 AACAGGGCTT TGCCGTCCGA TGCCGTCTGA CGCAGCGGCA GATAGTTTTT

151 CAAGGCTTCC ACGCTTTTGC CGGTCAGCGG AACCTGACGC TGCTTGCGCC

201 CTTTGCCGGT AACGTGTACC CACGCTTCGT CCAAATATAC ATCATCTGCA

251 TTCAAGCCGT GTATCTCGCT CACGCGCAAA CCGCTGCCGT ACATCAGCTC

301 GAACAGCGCG TGGTCGCGCA CCGCCAGCGG GTCGCCGCCG TCCACGGGCA

351 AATCCAACAT CCGGTTCAGC CATTCCTGCG GCAGGGCTTT GGGTACGCGC

401 TCGGGCTGCT TCGGCGGTTT GATGTCGGCG GTCGGGTCGG CGCGCATCAG

451 CCCGCGTTTG ACCAGCCAGG CGCAATACTG CCGCCACGCC GACAGCTTGC

501 GCGCCAGCGT CCGACCGTCC AAACCGCGCT GCGACAGCCG CCGCAACGCC

551 GccgTAAAAT CGCGCCGCGA CAAGTCCTGC GGCACGCcgc ctgcaTCTTC

601 AGACGGCATT TGTGCCAACA GTGCAAACAG TTCTTCCAAA TCGCGCCGGT

651 ATGCCGCAAC CGTGTGCTCC GACTTGCCCT CGCGCACGAT GTTTTCCAAA

701 TAAGCGTCAA AATacgccgC AAACccgTCC AAAACCATAA CCGTCCCACA

751 CAAATATCAA AAAACCAGTG A
```

This corresponds to the amino acid sequence <SEQ ID 110; ORF 032.ng>:

g032.pep

```
  1 MRRNVPAVAV LRRPRFEAFL DLALAQARAV PAGKQGFAVR CRLTQRQIVF

 51 QGFHAFAGQR NLTLLAPFAG NVYPRFVQIY IICIQAVYLA HAQTAAVHQL

101 EQRVVAHRQR VAAVHGQIQH PVQPFLRQGF GYALGLLRRF DVGGRVGAHQ

151 PAFDQPGAIL PPRRQLARQR PTVQTALRQP PQRRRKIAPR QVLRHAACIF

201 RRHLCQQCKQ FFQIAPVCRN RVLRLALAHD VFQISVKIRR KPVQNHNRPT

251 QISKNQ*
```

The following partial DNA sequence was identified in *N. meningitidis* <SEQ ID 111>:

m032.seq (partial)

```
  1 ATGCGGCGAA ACGTGCmTGC mGTCGCCGTT kTGCGCCGCC CATTGCGCCA

 51 AACGTTTTTG GATTTGGCGT TGGCTCAGGC GCGTGCCGTT CCTGCCGGTA

101 AACAGGGCTT TGCCGTCCGA TGCCGTCTGA CGCAGCGGCA GATAGTTTTT

151 CAGGGCTTCC ACGCTTTTGC CGACCAGCGG CACCTGCCGC TgTT.GCGCC

201 CTTTGCCGAT AAcGTGTACC CACGCyTCGT CCAAATAGAC ATCATCTGCA

251 TTCAAGCCGT GTATCTCGCT CACGCGCAAA CCGCTGCCGT ACATCAGTTC

301 GAACAGGGCG TGGTCGCGCA CCGCCAGCGG GTCGCCGCCG TCCACGGGCA

351 AATCCAGCAT CCGGTTCAGC CATTCCTGCG GCAGGGCTTT GGGTACGCGC

401 TCGGGCTGCT TCGGCGGTTT GATGTCGGCG GTCGGGTCGG CGTGCATCAG

451 GCCGCGCTTT ACCAGCCAAA CGCAATACTG CCGCCAAGAC GAAAGCTTGC

501 GAGCCAGCGT CCGTTCCCCC AAACCGCG...
```

This corresponds to the amino acid sequence <SEQ ID 112; ORF 032>:

m032.pep (partial)

```
  1 MRRNVXAVAV XRRPLRQTFL DLALAQARAV PAGKQGFAVR CRLTQRQIVF
 51 QGFHAFADQR HLPLXAPFAD NVYPRXVQID IICIQAVYLA HAQTAAVHQF
101 EQGVVAHRQR VAAVHGQIQH PVQPFLRQGF GYALGLLRRF DVGGRVGVHQ
151 AALYQPNAIL PPRRKLASQR PFPQTA...
```

The following partial DNA sequence was identified in *N. meningitidis* <SEQ ID 113>:

a032.seq

```
  1 ATGCGGCGAA ACGTGCCTGC CGTCGCCGTT TTGCGCCGCC CATTGCGCCA
 51 AACGTTTTTG GATTTGGCGT TGGCTCAGGC GCGTGCCGTT CCTGCCGGTA
101 AACAGGGCTT TGCCGTCCGA TGCCGTCTGA CGCAGCGGCA GATAGTTTTT
151 CAGGGCTTCC ACGCTTTTGC CGGTCAGCGG AACCTGCCGC TGCTTGCGTC
201 CTTTGCCGGT AACGTGTACC CACGCCTCGT CCAAATATAC ATCATCTGCA
251 TTCAAGCCGT GTATCTCGCT CACGCGCAAA CCGCTGCCGT ACATCAGTTC
301 GAACAGCGCG TGATCGCGCA CCGCCAGCGG GTCGCCGCCG TCCACGGGCA
351 AATCCAGCAT CCGGTTCAGC CATTCCTGCG GCAGGGCTTT GGGTACGCGC
401 TCGGGCTGCT TCGGCGGTTT GATGTCGGCG GTCGGGTCGG TATGCAGCAG
451 ACCGCGTTTG ACCAGCCAGG CGCAATACTG CCGCCAAGAC GACAGCTTGC
501 GCGCCAGCGT CCGCGCATTC AAACCGCGCT GCGACAGCCG CCGCAACGCC
551 GCCGTAAAAT CGCGCTGCGA CAAGCCCTGC GGCACGCCGC CTGCATCTTC
601 AGACGGCATT TGTGCCAACA GCGCAAACAG TTCTTCCAAA TCGCGCCGGT
651 ATGCCGCCAC CGTGTGCTCC GACTTGCCCT CGCGCACGAT GTTTTCCAAA
701 TAAGCGTCAA AATGCGCCGC AAACCCGTCC AAAACCATAA CCGCCCCACA
751 CAAATATCAA AAAAACAGTG A
```

This corresponds to the amino acid sequence <SEQ ID 114; ORF 032.a>:

a032.pep

```
  1 MRRNVPAVAV LRRPLRQTFL DLALAQARAV PAGKQGFAVR CRLTQRQIVF
 51 QGFHAFAGQR NLPLLASFAG NVYPRLVQIY IICIQAVYLA HAQTAAVHQF
101 EQRVIAHRQR VAAVHGQIQH PVQPFLRQGF GYALGLLRRF DVGGRVGMQQ
151 TAFDQPGAIL PPRRQLARQR PRIQTALRQP PQRRRKIALR QALRHAACIF
201 RRHLCQQRKQ FFQIAPVCRH RVLRLALAHD VFQISVKMRR KPVQNHNRPT
251 QISKKQ*
```

m032/a032 88.1% identity over a 176 aa overlap

```
                     10        20        30        40        50        60
m032.pep     MRRNVXAVAVXRRPLRQTFLDLALAQARAVPAGKQGFAVRCRLTQRQIVFQGFHAFADQR
             ||||| |||| |||||||||||||||||||||||||||||||||||||||||||||| ||
a032         MRRNVPAVAVLRRPLRQTFLDLALAQARAVPAGKQGFAVRCRLTQRQIVFQGFHAFAGQR
                     10        20        30        40        50        60

                     70        80        90       100       110       120
m032.pep     HLPLXAPFADNVYPRXVQIDIICIQAVYLAHAQTAAVHQFEQGVVAHRQRVAAVHGQIQH
             :||| | || ||||| ||| |||||||||||||||||||||| |:|||||||||||||||
a032         NLPLLASFAGNVYPRLVQIYIICIQAVYLAHAQTAAVHQFEQRVIAHRQRVAAVHGQIQH
                     70        80        90       100       110       120

                    130       140       150       160       170
m032.pep     PVQPFLRQGFGYALGLLRRFDVGGRVGVHQAALYQPNAILPPRRKLASQRPFPQTA
             |||||||||||||||||||||||||||::|:|: ||:|||||||:|| |||  |||
a032         PVQPFLRQGFGYALGLLRRFDVGGRVGMQQTAFDQPGAILPPRRQLARQRPRIQTALRQP
                    130       140       150       160       170       180


a032         PQRRRKIALRQALRHAACIFRRHLCQQRKQFFQIAPVCRHRVLRLALAHDVFQISVKMRR
                    190       200       210       220       230       240
```

Computer analysis of this amino acid sequence gave the following results:

Homology with a predicted ORF from *N. gonorrhoeae*

ORF 032 shows 86.4% identity over a 176 aa overlap with a predicted ORF (ORF 032.ng) from *N. gonorrhoeae*:

m032/g032

```
                     10        20        30        40        50        60
m032.pep     MRRNVXAVAVXRRPLRQTFLDLALAQARAVPAGKQGFAVRCRLTQRQIVFQGFHAFADQR
             ||||| |||| |||  ::||||||||||||||||||||||||||||||||||||||| ||
g032         MRRNVPAVAVLRRPRFEAFLDLALAQARAVPAGKQGFAVRCRLTQRQIVFQGFHAFAGQR
                     10        20        30        40        50        60

                     70        80        90       100       110       120
m032.pep     HLPLXAPFADNVYPRXVQIDIICIQAVYLAHAQTAAVHQFEQGVVAHRQRVAAVHGQIQH
             :| | |||| ||||| ||| |||||||||||||||||||:|| |||||||||||||||||
g032         NLTLLAPFAGNVYPRFVQIYIICIQAVYLAHAQTAAVHQLEQRVVAHRQRVAAVHGQIQH
                     70        80        90       100       110       120

                    130       140       150       160       170
m032.pep     PVQPFLRQGFGYALGLLRRFDVGGRVGVHQAALYQPNAILPPRRKLASQRPFPQTA
             |||||||||||||||||||||||||||:|| |: ||:|||||||:|| |||  |||
g032         PVQPFLRQGFGYALGLLRRFDVGGRVGAHQPAFDQPGAILPPRRQLARQRPTVQTALRQP
                    130       140       150       160       170       180


g032         PQRRRKIALRQALRHAACIFRRHLCQQCKQFFQIAPVCRNRVLRLALAHDVFQISVKIRR
                    190       200       210       220       230       240
```

The following partial DNA sequence was identified in *N. gonorrhoeae* <SEQ ID 115>:

g033.seq

```
  1 ATGGCGGCGG CGGACAAACT CTTGGGCGGC GACCGCCGCA GCGTCGCCAT

 51 CATCGGAGAC GGCGCGATGA CGGCGGGGCA GGCGTTTGAA GCCTTGAATT

101 GCGCGGGCGA TATGGATGTG GATTTGCTGG TCGTCCTCAA CGACAACGAA

151 ATGTCGATTT CCCCCAACGT CGGCGCGTTG CCCAAATATC TTGCCAGCAA

201 CGTCGTGCGC GATATGCACG GACTGTTGAG TACCGTCAAA GCGCAAAcgg

251 GCAAGGTATT AGACAAAATA CCCGGCGCGA TGGagtTTGC CCAAAAAGTC

301 GAACAcaaaA TCAAAACCCT TGCCGAAGAA GCCGAACACG CCAAACAGTC

351 GCTGTCGCTG TTTGAAAATT TCGGCTTCCG CTACACCGGC CCCGTGGACG
```

-continued

```
 401 GACACAACGT CGAGAATCTG GTGGACGTAT TGAAAGACTT GCGCAGCCGC
 451 AAAGGCCCTC AGTTGCTGCA CGTCATCACC AAAAAGGGCA ACGGCTACAA
 501 ACTCGCCGAA AACGACCCcg tcaAATACCA CGCCGTCGCc aACCTGCcta
 551 AAGAAGGCGG GGCGCAAATg ccGTCTGAAA AAGAACCCAA GCCCGCCgCc
 601 aaaccgACCT ATACCCAAGT ATTCGGCAAA TGGCTGTGCG ACCGGGCGGC
 651 GGCAGATTCC CGACTGGTTG CGATTACCCC CGCCATGCGC GAGGGCAGCG
 701 GACTGGTGGA GTTTGAACAA CGATTCCCCG ACCGCTATTT CGATGTCGGC
 751 ATCGCCGAGC AGCACGCCGT tacCTTTGCC GGCGGTTTGG CGTGCGAAGG
 801 CATGAAGCCC GTCGTGGCGA TTTATTCCAC CTTTTTACAA CGCGCCTACG
 851 ACCAACTGGT GCACGACATC GCCCTGCAAA ACCTGCCCGT TTTGTTTGCC
 901 GTCGACCGTG CGGGCATCGT CGGCGCGGAC GGTCCGACCC ATGCCGGCTT
 951 GTACGATTTG AGCTTCTTGC GCTGTGTGCC GAACATGATT GTTGCCGCGC
1001 CGAGCGATGA AAACGAATGC CGCCTGCTGC TTTCGACCTG CTATCAGGCG
1051 GATGCGCCCG CCGCCGTCCG CTATCCGCGC GGCACGGGTA CGGGCGCGCC
1101 GGTTTCAGAC GGCATGGAAA CCGTGGAAAT CGGCAAGGGC ATTATCCGCC
1151 GCGAAGGTGA GAAAACCGCC TTcatTGCCT TCGGCAGTAT GGTCGCCACC
1201 GCATTGGCGG TTGCCGAAAA ACTGAACGCC ACCGTCGCCG ATATGCGCTt
1251 cgtcaaacCG ATAGACGAAG AGTTGATTGT CCGCCTTGCC CGAAGCCAcg
1301 accGCATCGT TACCCTTGAA GAAAACGCCG AACAGGGCGG CGCAGGCGGC
1351 GCGGTCTTGG AAGTGTTGGC GAAACACGGC ATCTGCAAAC CCGTTTTGCT
1401 TTTGGGCGTT GCCGATACCG TAACCGAACA CGGCGATCCG AAAAAACTTT
1451 TGGACGATTT GGGTTTGAGT GCCGAAGCGG TGGAACGCCG GGTGCGCGAG
1501 TGGCTGCCGG ACCGTGATGC GGCAAATTAA
```

This corresponds to the amino acid sequence <SEQ ID 116; ORF 033.ng>:

g033.pep

```
  1 MAAADKLLGG DRRSVAIIGD GAMTAGQAFE ALNCAGDMDV DLLVVLNDNE
 51 MSISPNVGAL PKYLASNVVR DMHGLLSTVK AQTGKVLDKI PGAMEFAQKV
101 EHKIKTLAEE AEHAKQSLSL FENFGFRYTG PVDGHNVENL VDVLKDLRSR
151 KGPQLLHVIT KKGNGYKLAE NDPVKYHAVA NLPKEGGAQM PSEKEPKPAA
201 KPTYTQVFGK WLCDRAAADS RLVAITPAMR EGSGLVEFEQ RFPDRYFDVG
251 IAEQHAVTFA GGLACEGMKP VVAIYSTFLQ RAYDQLVHDI ALQNLPVLFA
301 VDRAGIVGAD GPTHAGLYDL SFLRCVPNMI VAAPSDENEC RLLLSTCYQA
351 DAPAAVRYPR GTGTGAPVSD GMETVEIGKG IIRREGEKTA FIAFGSMVAT
401 ALAVAEKLNA TVADMRFVKP IDEELIVRLA RSHDRIVTLE ENAEQGGAGG
451 AVLEVLAKHG ICKPVLLLGV ADTVTEHGDP KKLLDDLGLS AEAVERRVRE
501 WLPDRDAAN*
```

The following partial DNA sequence was identified in *N. meningitidis* <SEQ ID 117>:

m033.seq

```
   1 ATGGCGGCGG CAGACAAACT CTTGGGCAGC GACCGCCGCA GCGTCGCCAT
  51 CATCGGCGAC GGCGCGATGA CGGCGGGGCA GGCGTTTGAA GCCTTGAATT
 101 GCGCaG.CGA TATGGATGTr GATTTGCTrG TCGTCCTCAA CGACAACGAA
 151 ATGTCGATTT CCCCCAACGT CGGCGCGCTG CCGAAATACC TTGCCAGCAA
 201 CGTCGTGCGC GATATGCACG GCCTGTTGAG TACCGTCAAA GCGCAAACGG
 251 GCAAGGTATT AGACAAAATA CCCGGCGCGA TGGAGTTTGC CCAAAAAGTC
 301 GAACACAAAA TCAAAACCCT TGCCGAAGAA GCCGAACACG CCAAACAGTC
 351 GCTGTCTTTG TTTGAAAACT TCGGCTTCCG CTACACCGGC CCCGTGGACG
 401 GACACAACGT CGAAAATCTG GTGGACGTAT TGAAAGACTT GCGCAGCCGC
 451 AAAGGCCCTC AGTTGCTGCA CGTCATCACC AAAAAGGGCA ACGGCTACAA
 501 ACTCGCCGAA AACGACCCCG TCAAATACCA CGCCGTCGCC AACCTGCCTA
 551 AAGAAAGCGC GGCGCAAATG CCGTCTGAAA AAGAACCCAA GCCCGCCGCC
 601 AAACCGACCT ATACCCAAGT GTTCGGCAAA TGGCTGTGCG ACCGGGCGGC
 651 GGCAGATTCC CGACTGGTTG CGATTACCCC CGCCATGCGC GAGGGCAGCG
 701 GCTTGGTTGA GTTTGAACAA CGATTCCCCG ACCGCTATTT CGATGTCGGC
 751 ATCGCCGAGC AGCACGCCGT TACCTTTGCC GGCGGTTTGG CTTGCGAAGG
 801 GATGAAGCCC GTCGTGGCGA TTTATTCCAC CTTTTTACAA CGCGCCTACG
 851 ACCAACTGGT GCACGACATC GCCCTGCAAA ACCTACCCGT TTTGTTTGCC
 901 GTCGACCGCG CGGGCATCGT CGGCGCGGAC GGCCCGACCC ATGCCGGTCT
 951 GTACGATTTG AGCTTTTTGC GCTGCGTGCC GAACATGATT GTCGCCGCGC
1001 CGAGCGATGA AAACGAATGC CGCCTGTTGC TTTCGACCTG CTATCAGGCA
1051 GACGCGCCCG CCGCCGTCCG CTATCCGCGC GGCACGGGTA CGGGCGCGCC
1101 GGTTTCAGAC GGCATGGAAA CCGTGGAAAT CGGCAAGGGC ATTATCCGCC
1151 GCGAAGGTGA GAAAACCGCA TTCATTGCCT TCGGCAGTAT GGTCGCCCCC
1201 GCATTGGCGG TTGCCGAAAA ACTGAACGCC ACCGTCGCCG ATATGCGCTT
1251 CGTCAAACCG ATAGACGAAG AGTTGATTGT CCGCCTTGCC CGAAGCCACG
1301 ACCGCATCGT TACCCTTGAA GAAAACGCCG AACAGGGCGG CGCAGGCGGC
1351 GCGGTGCTGG AAGTATTGGC GAAACACGGC ATCTGCAAAC CCGTTTTGCT
1401 TTTGGGCGTT GCCGATACCG TAACCGGACA CGGCGATCCG AAAAAACTTT
1451 TAGACGATTT GGGCTTGAGT GCCGAAGCGG TGGAACGGCG TGTGCGCGCG
1501 TGGCTGTCGG ATCGGGATGC GGCAAATTAA
```

This corresponds to the amino acid sequence <SEQ ID 118; ORF 033>:

m033.pep

```
   1 MAAADKLLGS DRRSVAIIGD GAMTAGQAFE ALNCAXDMDV DLLVVLNDNE
  51 MSISPNVGAL PKYLASNVVR DMHGLLSTVK AQTGKVLDKI PGAMEFAQKV
 101 EHKIKTLAEE AEHAKQSLSL FENFGFRYTG PVDGHNVENL VDVLKDLRSR
 151 KGPQLLHVIT KKGNGYKLAE NDPVKYHAVA NLPKESAAQM PSEKEPKPAA
```

-continued

```
201 KPTYTQVFGK WLCDRAAADS RLVAITPAMR EGSGLVEFEQ RFPDRYFDVG
251 IAEQHAVTFA GGLACEGMKP VVAIYSTFLQ RAYDQLVHDI ALQNLPVLFA
301 VDRAGIVGAD GPTHAGLYDL SFLRCVPNMI VAAPSDENEC RLLLSTCYQA
351 DAPAAVRYPR GTGTGAPVSD GMETVEIGKG IIRREGEKTA FIAFGSMVAP
401 ALAVAEKLNA TVADMRFVKP IDEELIVRLA RSHDRIVTLE ENAEQGGAGG
451 AVLEVLAKHG ICKPVLLLGV ADTVTGHGDP KKLLDDLGLS AEAVERRVRA
501 WLSDRDAAN*
```

The following partial DNA sequence was identified in *N. meningitidis* <SEQ ID 119>:

a033.seq

```
   1 ATGGCGGCGG CGGACAAACA GTTGGGCAGC GACCGCCGCA GCGTCGCCAT
  51 CATCGGCGAC GGCGCGATGA CGGCGGGTCA GGCGTTTGAA GCCTTGAACT
 101 GCGCGGGCGA TATGGATGTG GATTTGCTGG TCGTCCTCAA CGACAACGAA
 151 ATGTCGATTT CCCCCAACGT CGGTGCGTTG CCCAAATACC TTGCCAGCAA
 201 CGTCGTGCGC GATATGCACG GACTGTTGAG TACCGTCAAA GCGCAAACGG
 251 GCAAGGTATT AGACAAAATA CCCGGCGCGA TGGAGTTTGC CCAAAAAGTC
 301 GAACATAAAA TCAAAACCCT TGCCGAAGAA GCCGAACACG CCAAACAGTC
 351 ACTGTCTTTG TTTGAAAACT TCGGCTTCCG CTATACCGGC CCCGTGGACG
 401 GACACAACGT CGAAAATCTG GTCGATGTAT TGGAAGACCT GCGCGGACGC
 451 AAAGGCCCGC AGCTTCTGCA CGTCATCACC AAAAAGGGCA ACGGCTACAA
 501 ACTCGCCGAA AACGATCCCG TCAAATACCA CGCCGTCGCC AACCTGCCTA
 551 AAGAAAGCGC GGCGCAAATG CCGTCTGAAA AAGAACCCAA GCCCGCCGCC
 601 AAACCGACCT ATACCCAAGT GTTCGGCAAA TGGCTGTGCG ACCGGGCGGC
 651 GGCAGATTCC CGACTGGTTG CGATTACCCC CGCCATGCGC GAGGGCAGCG
 701 GCTTGGTTGA GTTTGAACAA CGATTCCCCG ACCGCTATTT CGATGTCGGC
 751 ATCGCCGAGC AGCACGCCGT TACCTTTGCC GGCGGTTTGG CTTGCGAAGG
 801 GATGAAGCCC GTCGTGGCGA TTTATTCCAC CTTTTTACAA CGCGCCTACG
 851 ACCAACTGGT GCACGACATC GCCCTGCAAA ACCTGCCCGT TTTGTTTGCC
 901 GTCGACCGCG CGGGCATCGT CGGCGCGGAC GGCCCGACCC ATGCCGGTTT
 951 GTACGATTTA AGCTTTTTGC GCTGCATTCC GAATATGATT GTCGCCGCGC
1001 CGAGCGATGA AAATGAATGC CGCCTGCTGC TTTCGACCTG CTATCAGGCA
1051 GACGCGCCCG CCGCCGTCCG CTATCCGCGC GGCACGGGTA CGGGCGTGCC
1101 GGTTTCAGAC GGCATGGAAA CCGTGGAAAT CGGCAAGGGC ATTATCCGCC
1151 GCGAAGGTGA GAAAACCGCA TTCATTGCCT TCGGCAGTAT GGTCGCCCCT
1201 GCATTGGCGG TCGCCGGAAA ACTGAACGCC ACCGTCGCCG ATATGCGCTT
1251 CGTCAAACCG ATAGACGAAG AGTTGATTGT CCGCCTTGCC CGAAGCCACG
1301 ACCGCATCGT TACCCTTGAA GAAAACGCCG AACAGGGCGG CGCAGGCAGC
1351 GCGGTGCTGG AAGTGTTGGC GAAACACGGC ATCTGCAAAC CCGTCTTGCT
```

-continued

```
1401 TTTGGGCGTT GCCGATACCG TAACCGGACA CGGCGATCCG AAAAAACTTT

1451 TAGACGATTT GGGCTTGAGT GCCGAAGCGG TGGAACGGCG TGTGCGCGCG

1501 TGGCTGTCGG ATCGGGATGC GGCAAATTAA
```

This corresponds to the amino acid sequence <SEQ ID 120; ORF 033.a>:

a033.pep

```
  1 MAAADKQLGS DRRSVAIIGD GAMTAGQAFE ALNCAGDMDV DLLVVLNDNE

 51 MSISPNVGAL PKYLASNVVR DMHGLLSTVK AQTGKVLDKI PGAMEFAQKV

101 EHKIKTLAEE AEHAKQSLSL FENFGFRYTG PVDGHNVENL VDVLEDLRGR

151 KGPQLLHVIT KKGNGYKLAE NDPVKYHAVA NLPKESAAQM PSEKEPKPAA

201 KPTYTQVFGK WLCDRAAADS RLVAITPAMR EGSGLVEFEQ RFPDRYFDVG

251 IAEQHAVTFA GGLACEGMKP VVAIYSTFLQ RAYDQLVHDI ALQNLPVLFA

301 VDRAGIVGAD GPTHAGLYDL SFLRCIPNMI VAAPSDENEC RLLLSTCYQA

351 DAPAAVRYPR GTGTGVPVSD GMETVEIGKG IIRREGEKTA FIAFGSMVAP

401 ALAVAGKLNA TVADMRFVKP IDEELIVRLA RSHDRIVTLE ENAEQGGAGS

451 AVLEVLAKHG ICKPVLLLGV ADTVTGHGDP KKLLDDLGLS AEAVERRVRA

501 WLSDRDAAN*
```

m033/a033 98.4% identity over a 509 aa overlap

```
                   10        20        30        40        50        60
m033.pep    MAAADKLLGSDRRSVAIIGDGAMTAGQAFEALNCAXDMDVDLLVVLNDNEMSISPNVGAL
            |||||| |||||||||||||||||||||||||||| ||||||||||||||||||||||||
a033        MAAADKQLGSDRRSVAIIGDGAMTAGQAFEALNCAGDMDVDLLVVLNDNEMSISPNVGAL
                   10        20        30        40        50        60

                   70        80        90       100       110       120
m033.pep    PKYLASNVVRDMHGLLSTVKAQTGKVLDKIPGAMEFAQKVEHKIKTLAEEAEHAKQSLSL
            ||||||||||||||||||||||||||||||||||||||||||||||||||||||||||||
a033        PKYLASNVVRDMHGLLSTVKAQTGKVLDKIPGAMEFAQKVEHKIKTLAEEAEHAKQSLSL
                   70        80        90       100       110       120

                  130       140       150       160       170       180
m033.pep    FENFGFRYTGPVDGHNVENLVDVLKDLRSRKGPQLLHVITKKGNGYKLAENDPVKYHAVA
            ||||||||||||||||||||||||:|||:|||||||||||||||||||||||||||||||
a033        FENFGFRYTGPVDGHNVENLVDVLEDLRGRKGPQLLHVITKKGNGYKLAENDPVKYHAVA
                  130       140       150       160       170       180

                  190       200       210       220       230       240
m033.pep    NLPKESAAQMPSEKEPKPAAKPTYTQVFGKWLCDRAAADSRLVAITPAMREGSGLVEFEQ
            ||||||||||||||||||||||||||||||||||||||||||||||||||||||||||||
a033        NLPKESAAQMPSEKEPKPAAKPTYTQVFGKWLCDRAAADSRLVAITPAMREGSGLVEFEQ
                  190       200       210       220       230       240

                  250       260       270       280       290       300
m033.pep    RFPDRYFDVGIAEQHAVTFAGGLACEGMKPVVAIYSTFLQRAYDQLVHDIALQNLPVLFA
            ||||||||||||||||||||||||||||||||||||||||||||||||||||||||||||
a033        RFPDRYFDVGIAEQHAVTFAGGLACEGMKPVVAIYSTFLQRAYDQLVHDIALQNLPVLFA
                  250       260       270       280       290       300

                  310       320       330       340       350       360
m033.pep    VDRAGIVGADGPTHAGLYDLSFLRCVPNMIVAAPSDENECRLLLSTCYQADAPAAVRYPR
            |||||||||||||||||||||||||:||||||||||||||||||||||||||||||||||
a033        VDRAGIVGADGPTHAGLYDLSFLRCIPNMIVAAPSDENECRLLLSTCYQADAPAAVRYPR
                  310       320       330       340       350       360

                  370       380       390       400       410       420
m033.pep    GTGTGAPVSDGMETVEIGKGIIRREGEKTAFIAFGSMVAPALAVAEKLNATVADMRFVKP
            |||||:||||||||||||||||||||||||||||||||||||||| ||||||||||||||
a033        GTGTGVPVSDGMETVEIGKGIIRREGEKTAFIAFGSMVAPALAVAGKLNATVADMRFVKP
                  370       380       390       400       410       420

                  430       440       450       460       470       480
m033.pep    IDEELIVRLARSHDRIVTLEENAEQGGAGGAVLEVLAKHGICKPVLLLGVADTVTGHGDP
            |||||||||||||||||||||||||||||:||||||||||||||||||||||||||||||
a033        IDEELIVRLARSHDRIVTLEENAEQGGAGSAVLEVLAKHGICKPVLLLGVADTVTGHGDP
                  430       440       450       460       470       480
```

-continued

```
                  490        500        510
m033.pep   KKLLDDLGLSAEAVERRVRAWLSDRDAANX
           ||||||||||||||||||||||||||||||
a033       KKLLDDLGLSAEAVERRVRAWLSDRDAANX
                  490        500        510
```

Computer analysis of this amino acid sequence gave the following results:

Homology with a predicted ORF from *N. gonorrhoeae*

ORF 033 shows 98.4% identity over a 509 aa overlap with a predicted ORF (ORF 033.ng) from *N. gonorrhoeae*:

m033/g033

```
m033.pep   MAAADKLLGSDRRSVAIIGDGAMTAGQAFEALNCAXDMDVDLLVVLNDNEMSISPNVGAL   60
           |||||||||:||||||||||||||||||||||||||| |||||||||||||||||||||||||
g033       MAAADKLLGGDRRSVAIIGDGAMTAGQAFEALNCAGDMDVDLLVVLNDNEMSISPNVGAL   60
m033.pep   PKYLASNVVRDMHGLLSTVKAQTGKVLDKIPGAMEFAQKVEHKIKTLAEEAEHAKQSLSL  120
           ||||||||||||||||||||||||||||||||||||||||||||||||||||||||||||
g033       PKYLASNVVRDMHGLLSTVKAQTGKVLDKIPGAMEFAQKVEHKIKTLAEEAEHAKQSLSL  120
m033.pep   FENFGFRYTGPVDGHNVENLVDVLKDLRSRKGPQLLHVITKKGNGYKLAENDPVKYHAVA  180
           ||||||||||||||||||||||||||||||||||||||||||||||||||||||||||||
g033       FENFGFRYTGPVDGHNVENLVDVLKDLRSRKGPQLLHVITKKGNGYKLAENDPVKYHAVA  180
m033.pep   NLPKESAAQMPSEKEPKPAAKPTYTQVFGKWLCDRAAADSRLVAITPAMREGSGLVEFEQ  240
           |||||::|||||||||||||||||||||||||||||||||||||||||||||||||||||
g033       NLPKEGGAQMPSEKEPKPAAKPTYTQVFGKWLCDRAAADSRLVAITPAMREGSGLVEFEQ  240
m033.pep   RFPDRYFDVGIAEQHAVTFAGGLACEGMKPVVAIYSTFLQRAYDQLVHDIALQNLPVLFA  300
           ||||||||||||||||||||||||||||||||||||||||||||||||||||||||||||
g033       RFPDRYFDVGIAEQHAVTFAGGLACEGMKPVVAIYSTFLQRAYDQLVHDIALQNLPVLFA  300
m033.pep   VDRAGIVGADGPTHAGLYDLSFLRCVPNMIVAAPSDENECRLLLSTCYQADAPAAVRYPR  360
           ||||||||||||||||||||||||||||||||||||||||||||||||||||||||||||
g033       VDRAGIVGADGPTHAGLYDLSFLRCVPNMIVAAPSDENECRLLLSTCYQADAPAAVRYPR  360
m033.pep   GTGTGAPVSDGMETVEIGKGIIRREGEKTAFIAFGSMVAPALAVAEKLNATVADMRFVKP  420
           ||||||||||||||||||||||||||||||||||||||| ||||||||||||||||||||
g033       GTGTGAPVSDGMETVEIGKGIIRREGEKTAFIAFGSMVATALAVAEKLNATVADMRFVKP  420
m033.pep   IDEELIVRLARSHDRIVTLEENAEQGGAGGAVLEVLAKHGICKPVLLLGVADTVTGHGDP  480
           ||||||||||||||||||||||||||||||||||||||||||||||||||||||| ||||
g033       IDEELIVRLARSHDRIVTLEENAEQGGAGGAVLEVLAKHGICKPVLLLGVADTVTEHGDP  480
m033.pep   KKLLDDLGLSAEAVERRVRAWLSDRDAANX  510
           ||||||||||||||||||| || ||||||
g033       KKLLDDLGLSAEAVERRVREWLPDRDAANX  510
```

The following partial DNA sequence was identified in *N. gonorrhoeae* <SEQ ID 121>:

g034.seq

```
  1 ATGAGCCGTT TATGGTTTTT TGCCGTAAAA AACATTATAA TCCGCCTTAT
 51 TTACCTATTG CCCAAGGAGA CACAAATGGC ACTCGTATCC ATGCGCCAAC
101 TGCTTGACCA CGCCGCCGAA AACAGCTACG GCCTGCCCGC GTTCAACGTC
151 AACAACCTCG AACAAATGCG CGCCATTATG GAAGCCGCCG ACCAAGTCAA
201 CGCGCCCGTC ATCGTACAGG CGAGCGCAGG TGCGCGCAAA TACGcggGCG
251 CGCCGTTTTT GCGCCACCTG ATTCTGGCGG CAGTCGAAGA ATTTCCGCAC
301 ATCCCCGTCG TGATGCACCA AGACCACGGC GCATCGCCCG ACGTgtgCCA
351 ACGCTCCATC CAACTGGGCT TCTCCTCCGT GATGATGGAC GGCTCTTTGC
401 TCGAAGACGG CAAAACCCCT TCTTCTTACG AATACAACGT CAACGCCACC
451 CGTACCGTCG TCAACTTCTC CCACGCCTGC GGCGTGTCCG TCGAAGGCGA
501 AATCGGCGTA TTGGGCAACC TCGAAACCGG CGAAGCAGGC GAAGAAGACG
```

-continued

```
 551 GAGTGGGCGC GGCAGGCAAA CTCTCACACG ACCAAATGCT CACCAGCGTT
 601 GAAGATGCCG TGCGTTTCGT TAAAGATACC GGCGTTGACG CATTGGCGAT
 651 TGCCGTCGGC ACCAGCCACG GCGCATACAA ATTCACCCGT CCGCCCACAG
 701 GCGACGTATT GCGTATCGAC CGCATCAAGG AAATCCACCA AGCCCTGCCC
 751 AATACACACA TCGTGATGCA CGgctCCAGC TCCGTTCCGC AAGAatgGCT
 801 GAAAGTCATC AACGAATACG GCGGCAATAT CGGCGAAACC TACGGCGTGC
 851 CGGTTGAAGA AATCGTCGAA GGCATCAAAC ACGGCGTGCG CAAAGTCAAC
 901 ATCGATACCG ACCTGCGCCT CGCTTCCACC GGCGCGGTAC GCCGCTACCT
 951 TGCCGAAAAC CCGTCCGACT TTGATCCGCG CAAATACTTG GGCAAAACCA
1001 TTGAAGCGAT GAAGCAAATC TGCCTCGACC GTTATCTTGC GTTCGGTTGC
1051 GAAGGTCAGG CAGGCAAAAT CAAACCTGTT TCGTTGGAAA AAATGGCAAG
1101 CCGTTATGCC AAGGGCGAAT TGAACCAAAT CGTCAAATAA
```

This corresponds to the amino acid sequence <SEQ ID 122; ORF 034.ng>:

g034.pep

```
  1 MSRLWFFAVK NIIIRLIYLL PKETQMALVS MRQLLDHAAE NSYGLPAFNV
 51 NNLEQMRAIM EAADQVNAPV IVQASAGARK YAGAPFLRHL ILAAVEEFPH
101 IPVVMHQDHG ASPDVCQRSI QLGFSSVMMD GSLLEDGKTP SSYEYNVNAT
151 RTVVNFSHAC GVSVEGEIGV LGNLETGEAG EEDGVGAAGK LSHDQMLTSV
201 EDAVRPVKDT GVDALAIAVG TSHGAYKFTR PPTGDVLRID RIKEIHQALP
251 NTHIVMHGSS SVPQEWLKVI NEYGGNIGET YGVPVEEIVE GIKHGVRKVN
301 IDTDLRLAST GAVRRYLAEN PSDFDPRKYL GKTIEAMKQI CLDRYLAFGC
351 EGQAGKIKPV SLEKMASRYA KGELNQIVK*
```

The following partial DNA sequence was identified in *N. meningitidis* <SEQ ID 123>:

m034.seq (partial)

```
  1 ATGAGCTGTT TATGGTTTTT TGCTGTAAAA AACATTATAA TCCGCCTTAT
 51 TTACCTATTG CCCAAGGAGA CACAAATGGC ACTCGTATCC ATGCGCCAAC
101 TGCTTGATCA TGCTGCCGAA wACAGCTACG GCyTGCCGGC GTTCAACGTC
151 AACAACCTCG wACAGATGCG CGCCATCATG GAGGCTGCAG ACCAAGTCGA
201 CGCCCCCGTC ATCGTACAGG CGAGTGCCGG TGCGCGCAAA TATGCGGGTG
251 CGCCGTTTTT ACGCCACCTG ATTTTGGCGG CTGTCGAAGT ATTTCCACAC
301 ATCCCCGTCG TCATGCACCA AGACCACGGC GCATCACCCG ACGTGTGCCA
351 ACGCTCCATC CAACTGGGCT TCTCCTCTGT AATGATGGAC GGCTCGCTGA
401 TGGAAGACGG CAAAACCCCT TCTTCTTACG AATACAACGT CAACGCCACA
451 CGTACCGTGG TTAACTTCTC CCACGCTTGC GGCGTATCCG TTGAAGGCGA
501 AATCGGCGTA TTGGGCAACC TCGAAACCGG CGATGCAGGC GAAGAAGACG
551 GTGTAGGCGC AGTGGGCAAA CTTTCCCACG ACCAAATGCT GACCAGCGTC
```

-continued

```
601 GAAGATGCCG TATGTTTCGT TAAAGATACC GGCGTTGACG CATTGGCTAT
651 TGCCGTCGGC ACCAGCCACG GCGCATACAA ATTCACCCGT CCGCCCACAG
701 GCGATGTATT ACGTATCGAC CGCATCAAAG AAATCCACCA AGCCCTGCCC
751 AATACACACA TCGTGATGCA C...
```

This corresponds to the amino acid sequence <SEQ ID 124; ORF 034>:

m034.pep (partial)

```
  1 MSCLWFFAVK NIIIRLIYLL PKETQMALVS MRQLLDHAAE XSYGLPAFNV
 51 NNLXQMRAIM EAADQVDAPV IVQASAGARK YAGAPFLRHL ILAAVEVFPH
101 IPVVMHQDHG ASPDVCQRSI QLGFSSVMMD GSLMEDGKTP SSYEYNVNAT
151 RTVVNFSHAC GVSVEGEIGV LGNLETGDAG EEDGVGAVGK LSHDQMLTSV
201 EDAVCFVKDT GVDALAIAVG TSHGAYKFTR PPTGDVLRID RIKEIHQALP
251 NTHIVMH...
```

The following partial DNA sequence was identified in *N. meningitidis* <SEQ ID 125>:

a034.seq

```
   1 ATGAGCCGTT TATGGTTTTT TGCCGCAAAA AACATTATAA TCCGCCTTAT
  51 TTACCTATTG CCCAAGGAGA CACAAATGGC ACTCGTATCC ATGCGCCAAC
 101 TGCTTGATCA TGCTGCCGAA AACAGCTACG GCCTGCCCGC GTTCAACGTC
 151 AACAACCTCG AACAAATGCG CGCCATTATG GAAGCCGCCG ACCAAGTCAA
 201 CGCGCCCGTC ATCGTACAGG CGAGCGCAGG TGCGCGCAAA TACGCGGGCG
 251 CGCCGTTTTT GCGCCACCTG ATTTTGGCGG CTGTCGAAGA ATTTCCGCAC
 301 ATCCCCGTCG TGATGCACCA AGACCACGGC GCATCGCCCG ACGTGTGCCA
 351 ACGCTCCATC CAACTGGGCT TTTCCTCCGT GATGATGGAC GGCTCGCTGA
 401 TGGAAGACGG CAAAACCCCT TCTTCTTATG AATACAACGT CAACGCCACC
 451 CGTACCGTGG TTAATTTCTC CCACGCCTGC GGCGTATCCG TTGAAGGCGA
 501 AATCGGCGTA TTGGGCAACC TCGAAACTGG CGAAGCCGGC GAAGAAGACG
 551 GTGTAGGCGC AGTGGGCAAA CTTTCCCACG ACCAAATGCT CACCAGCGTC
 601 GAAGATGCCG TGCGTTTCGT TAAAGATACC GGCGTTGACG CATTGGCGAT
 651 TGCCGTCGGC ACCAGCCACG GCGCGTACAA ATTCACCCGT CCGCCCACAG
 701 GCGACGTGTT GCGTATCGAC CGCATCAAAG AAATCCACCA AGCCCTGCCC
 751 AATACACACA TCGTGATGCA CGGCTCCAGC TCCGTTCCGC AAGAATGGCT
 801 GAAAGTCATC AACGAATACG GCGGCAATAT CGGCGAAACC TACGGCGTGC
 851 CGGTTGAAGA AATCGTCGAA GGCATCAAAC ACGGCGTGCG TAAAGTCAAC
 901 ATCGATACCG ACTTGCGCCT TGCTTCCACC GGCGCGGTAC GCCGCTACCT
 951 TGCCGAAAAC CGGTCCGACT TCGATCCGCG CAAATATTTG AGCAAAACCA
1001 TTGAAGCGAT GAAGCAAATC TGCCTCGACC GCTACCTCGC GTTCGGTTGC
```

-continued

```
1051 GAAGGTCAGG CAGGCAAAAT CAAACCGGTT TCCTTGGAAA AAATGGCAAA

1101 CCGTTATGCC AAGGGCGAAT TGAACCAAAT CGTCAAATAA
```

This corresponds to the amino acid sequence <SEQ ID 126; ORF 034.a>:

a034.pep

```
  1 MSRLWFFAAK NIIIRLIYLL PKETQMALVS MRQLLDHAAE NSYGLPAFNV

 51 NNLEQMRAIM EAADQVNAPV IVQASAGARK YAGAPFLRHL ILAAVEEFPH

101 IPVVMHQDHG ASPDVCQRSI QLGFSSVMMD GSLMEDGKTP SSYEYNVNAT

151 RTVVNFSHAC GVSVEGEIGV LGNLETGEAG EEDGVGAVGK LSHDQMLTSV

201 EDAVRFVKDT GVDALAIAVG TSHGAYKFTR PPTGDVLRID RIKEIHQALP

251 NTHIVMHGSS SVPQEWLKVI NEYGGNIGET YGVPVEEIVE GIKHGVRKVN

301 IDTDLRLAST GAVRRYLAEN PSDFDPRKYL SKTIEANKQI CLDRYLAFGC

351 EGQAGKIKPV SLEKMANRYA KGELNQIVK*
```

m034/a034 96.9% identity over a 257 aa overlap

```
                    10        20        30        40        50        60
m034.pep    MSCLWFFAVKNIIIRLIYLLPKETQMALVSMRQLLDHAAEXSYGLPAFNVNNLXQMRAIM
            || |||||:||||||||||||||||||||||||||||||| |||||||||||| ||||||
a034        MSRLWFFAAKNIIIRLIYLLPKETQMALVSMRQLLDHAAENSYGLPAFNVNNLEQMRAIM
                    10        20        30        40        50        60

                    70        80        90       100       110       120
m034.pep    EAADQVDAPVIVQASAGARKYAGAPFLRHLILAAVEVFPHIPVVMHQDHGASPDVCQRSI
            ||||||:||||||||||||||||||||||||||||| |||||||||||||||||||||||
a034        EAADQVNAPVIVQASAGARKYAGAPFLRHLILAAVEEFPHIPVVMHQDHGASPDVCQRSI
                    70        80        90       100       110       120

                   130       140       150       160       170       180
m034.pep    QLGFSSVMMDGSLMEDGKTPSSYEYNVNATRTVVNFSHACGVSVEGEIGVLGNLETGDAG
            |||||||||||||||||||||||||||||||||||||||||||||||||||||||||:||
a034        QLGFSSVMMDGSLMEDGKTPSSYEYNVNATRTVVNFSHACGVSVEGEIGVLGNLETGEAG
                   130       140       150       160       170       180

                   190       200       210       220       230       240
m034.pep    EEDGVGAVGKLSHDQMLTSVEDAVCFVKDTGVDALAIAVGTSHGAYKFTRPPTGDVLRID
            |||||||||||||||||||||||| |||||||||||||||||||||||||||||||||||
a034        EEDGVGAVGKLSHDQMLTSVEDAVRFVKDTGVDALAIAVGTSHGAYKFTRPPTGDVLRID
                   190       200       210       220       230       240

                   250
m034.pep    RIKEIHQALPNTHIVMH
            |||||||||||||||||
a034        RIKEIHQALPNTHIVMHGSSSVPQEWLKVINEYGGNIGETYGVPVEEIVEGIKHGVRKVN
                   250       260       270       280       290       300
```

Computer analysis of this amino acid sequence gave the following results:

Homology with a predicted ORF from *N. gonorrhoeae*

ORF 034 shows 96.5% identity over a 257 aa overlap with a predicted ORF (ORF 034.ng) from *N. gonorrhoeae*:

m034/g034

```
m034.pep    MSCLWFFAVKNIIIRLIYLLPKETQMALVSMRQLLDHAAEXSYGLPAFNVNNLXQMRAIM   60
            || ||||||||||||||||||||||||||||||||||||| |||||||||||| ||||||
g034        MSRLWFFAVKNIIIRLIYLLPKETQMALVSMRQLLDHAAENSYGLPAFNVNNLEQMRAIM   60

m034.pep    EAADQVDAPVIVQASAGARKYAGAPFLRHLILAAVEVFPHIPVVMHQDHGASPDVCQRSI  120
            ||||||:||||||||||||||||||||||||||||| |||||||||||||||||||||||
g034        EAADQVNAPVIVQASAGARKYAGAPFLRHLILAAVEEFPHIPVVMHQDHGASPDVCQRSI  120
```

-continued

```
m034.pep   QLGFSSVMMDGSLMEDGKTPSSYEYNVNATRTVVNFSHACGVSVEGEIGVLGNLETGDAG  180
           ||||||||||||:|||||||||||||||||||||||||||||||||||||||||||||:||
g034       QLGFSSVMMDGSLLEDGKTPSSYEYNVNATRTVVNFSHACGVSVEGEIGVLGNLETGEAG  180

m034.pep   EEDGVGAVGKLSHDQMLTSVEDAVCFVKDTGVDALAIAVGTSHGAYKFTRPPTGDVLRID  240
           |||||||:|||||||||||||||| |||||||||||||||||||||||||||||||||||
g034       EEDGVGAAGKLSHDQMLTSVEDAVRFVKDTGVDALAIAVGTSHGAYKFTRPPTGDVLRID  240
m034.pep   RIKEIHQALPNTHIVMH                                             257
           |||||||||||||||||
g034       RIKEIHQALPNTHIVMHGSSSVPQEWLKVINEYGGNIGETYGVPVEEIVEGIKHGVRKVN  300
```

The following partial DNA sequence was identified in *N. gonorrhoeae* <SEQ ID 127>:

g036.seq

```
  1 ATGCTGAAGC CGTGTTTGGT ATACAGTGCC TGTGCGGCGG cgttgcCTGC
 51 GCGGACTTCG AGCAGCAGGC GTTGCGTGCC TTCGGGCAGA TGTGCGTACC
101 AATATTCGAG CAGGGCGGAC GCAACGCCCC GTCGGCGGCA TTCGGGCGCG
151 GTGGCAATCA GGTGCAGTTC GGATTCGTCG GGCAGGTTCT GCCAAACGAT
201 AAAGGCGGCA ATCCTGCCGT CTTTTTCCGC AAGGAAAACC TGTTCGGACG
251 GCGAAACAAG CGCGGACTCA AATTGGCGTT GCGTCCACGC GGACGGGTTG
301 CAGACGGTAT CGAGCGCGGC CAGTGCGGCG CAGTCGGACG GTGAGGCTGG
351 GCGGATGTTC ATGTTCGTGC CTTCCGTTCC GCCTGTTCTT TGGCAGTCAG
401 GGCGATTTTG TTGCGGACGT AGAGCAGTTC GGCGTGTGCC GCGCCAGTTG
451 CGGGATAGCC GCCGCCGAGG GCGAGCGCGA GAAAATCGGC GGCGGTCGGC
501 ATATCGGCTT TGCCTGAGAA GGGCGGACGG TTTTCCAGTG CGAACGCACT
551 GCCGATGCCG TCTGAAAAGA CGTACCCCTC GGGGAGGGCA ATGTCTGCCG
601 CCCTACCGAC TTGATAATCG CTCAAACGGC GGCGGTTCAG CGTGTCGAAC
651 CACGCATAAA ACACTTCGCC CATACGCGCG TCCGCAGCGG CGAGTATGCA
701 GCTTTGCGGC GGCGGCAGCG AGGCGGCGGC ATCGAGCGTG GGGATGCCGA
751 TTAAAGGCGT GTCGAACGGC GTTGCCAAAC CTTGCGCCAC GCCGATGCCG
801 ATACGCAGTC CGGTAA
```

This corresponds to the amino acid sequence <SEQ ID 128; ORF 036.ng>:

g036.pep

```
  1 MLKPCLVYSA CAAALPARTS SSRRCVPSGR CAYQYSSRAD ATPRRRHSGA
 51 VAIRCSSDSS GRFCQTIKAA ILPSFSARKT CSDGETSADS NWRCVHADGL
101 QTVSSAASAA QSDGEAGRMF MFVPSVPPVL WQSGRFCCGR RAVRRVPRQL
151 RDSRRRGRAR ENRRRSAYRV CLRRADGFPV RTHCRCRLKR RTPRGGQCLP
201 PYRLDNRSNG GGSACRTTHK TLRPYARPQR RVCSFAAAAA RRRHRAWGCR
251 LKACRTALPN LAPRRCRYAV R*
```

The following partial DNA sequence was identified in *N. meningitidis* <SEQ ID 129>:

m036.seq

```
  1 ATGCTGAAGC CGTGCGCCGT GTACAGTGCC TGTGCGGCGG TGTTGCCTGC
 51 ACGGACTTCG AGCAGCAGGC GTTGCGTGTC TTCGGGCAGA TGTGTGAACC
101 AATATTCGAG CAGGGCGGAC GCAATTCCTT GGCGGCGGCA TTCGGGCGCG
151 GTGGCAATCA GGTGCAGTTC GGATTCGTCG GGCAGGTTCT GCCAAACGAT
201 AAAGGCGGCA ATCCCg.CGT CTTTTTCCGC AAGGAAAACC TGTTCGGACG
251 GCGAAACCAG TGCGGACTCA AATTGGCGTT GCGTCCATGC GGACGGGTTG
301 CAGACGGCAT CGAGTGCGGC CAGCTCCTCA CAATCGGCAC AAACGGCACG
351 GCGGATGTTC ACGGGCGCGC TCTCCGTTCG GCCTGTTCTT TGGCAGTCAG
401 GGCGATTTTG TTGCGGACGT AGAGCAAACC GGCGTGTGCG GCATGGACGG
451 CAGGATAACC GCCCTTGGCT GCCAATGCGA GAAAGTCGGC GGCAGTCGGC
501 ATATCCGGTC TGCCTGAGAA CGGCGGAGCT TCTTCCAGCG CGAACGCGCT
551 GCCTATGCCG TCTGAAAAGG CGCATCCCTC CGGCAGCCGG ATGTCTGCCG
601 CCCGCCCGAC CTGATAATCG CTCAAACGGT GGCAGTTCAG CGTATCGAAC
651 CATGCATAAA ACACTTCGCC CATACGAGCG TCCGTAGCGG CAAGGATGCA
701 GCTTTGCGGC GGCGGCAGCG AGGCGGCGGC ATCGAGCGAG GGTACGCCGA
751 TTAAGGGGGT ATCAAACGGC GTTGCCAAAC CCTGAGCTAC ACCGATGCCG
801 ATACGCAGTC CGGTAA
```

This corresponds to the amino acid sequence <SEQ ID 130; ORF 036>:

m036.pep

```
  1 MLKPCAVYSA CAAVLPARTS SSRRCVSSGR CVNQYSSRAD AIPWRRHSGA
 51 VAIRCSSDSS GRFCQTIKAA IPXSFSARKT CSDGETSADS NWRCVHADGL
101 QTASSAASSS QSAQTARRMF TGALSVRPVL WQSGRFCCGR RANRRVRHGR
151 QDNRPWLPMR ESRRQSAYPV CLRTAELLPA RTRCLCRLKR RIPPAAGCLP
201 PARPDNRSNG GSSAYRTMHK TLRPYERP*R QGCSFAAAAA RRRHRARVRR
251 LRGYQTALPN PELHRCRYAV R*
```

The following partial DNA sequence was identified in *N. meningitidis* <SEQ ID 131>:

a036.seq

```
  1 ATGCTGAAGC CGTGCGCCGT GTACAGTGCC TGTGCGGCGG TCTTGCCTGC
 51 ACGGACTTCG AGCAGCAGGC GTTGCGTGTC TTCGGGCAGA TGTGTGAACC
101 AATATTCGAG CAGGCCGGAC GCAATTCCTT GGCGGCGGCA TTCGGGCGCG
151 GTGGCAATCA GGTGCAGTTC GGATTCGTCG GGCAGGTTCT GCCAAACGAT
201 AAAGGCGGCA ATCCCGCCGT CTTTTTCCGC AAGGAAAACC TGTTCGGACG
251 GCGAAACCAG TGCGGACTCA AATTGGCGTT GCGTCCACGC GGACGGGTTG
301 CAGACGGCAT CGAGCGCGGC GAGTGCGGCG CAATCGGCAT AAACGGCGCG
351 GCGGATGTTC ACAGGCGCGC CCTCCGTTCC GCCTGTTCTT TGGCAGTCAA
```

-continued

```
401 GGCGATTTTG TTGCGGACGT AGAGCAGCTC GGCGTGTGCC GCAGCGACGG

451 CGGGAAAACC GCCTTCAGCC GCCAGATTGA GGAAGTCGGC GGCGGTCGGC

501 ATATCGGGTT TGCCTGAGAA CGGCGGACGG TTTTCCACCG CGAACGCATT

551 GCCGATGCCG TCTGAAAAGG CGCATCCTTC CGGCAGCCGG ATGTCTGCCG

601 CCCGACCGAC CTGATAATCG CTCAAACGGC GGCGGTTCAG CGTGTCGAAC

651 CATGCATAAA ACACTTCGCC CATACGTGCG TCCGCAGCGG CAAGGATGCA

701 GCTTTGCGGC GGCGGCAGCG AGGCGGCGGC ATCGAGCCAG GGTACGCCGA

751 TTAAAGGAGT ATCAAACGGC GTTGCCAAAC CTTGCGCCAC GCCGATGCCG

801 ATACGCAGTC CCGTAA
```

This corresponds to the amino acid sequence <SEQ ID 132; ORF 036.a>:

a036.pep

```
  1 MLKPCAVYSA CAAVLPARTS SSRRCVSSGR CVNQYSSRAD AIPWRRHSGA

 51 VAIRCSSDSS GRFCQTIKAA IPPSFSARKT CSDGETSADS NWRCVHADGL

101 QTASSAASAA QSA*TARRMF TGAPSVPPVL WQSRRFCCGR RAARRVPQRR

151 RENRLQPPD* GSRRRSAYRV CLRRADGFPA RTHCRCRLKR RILPAAGCLP

201 PDRPDNRSNG GGSACRTMHK TLRPYVRPQR QGCSFAAAAA RRRHRARVRR

251 LKEYQTALPN LAPRRCRYAV P*
```

m036/a036 85.6% identity over a 270 aa overlap

```
                   10        20        30        40        50        60
m036.pep   MLKPCAVYSACAAVLPARTSSSRRCVSSGRCVNQYSSRADAIPWRRHSGAVAIRCSSDSS
           ||||||||||||||||||||||||||||||||||||||||||||||||||||||||||||
a036       MLKPCAVYSACAAVLPARTSSSRRCVSSGRCVNQYSSRADAIPWRRHSGAVAIRCSSDSS
                   10        20        30        40        50        60

                   70        80        90       100       110       120
m036.pep   GRFCQTIKAAIPXSFSARKTCSDGETSADSNWRCVHADGLQTASSAASSSQSAQTARRMF
           |||||||||||| |||||||||||||||||||||||||||||||||||::||| ||||||
a036       GRFCQTIKAAIPPSFSARKTCSDGETSADSNWRCVHADGLQTASSAASAAQSAXTARRMF
                   70        80        90       100       110       120
                  130       140       150       160       170       180
m036.pep   TGALSVRPVLWQSGRFCCGRRANRRVRHGRQDNRPWLPMRESRRQSAYPVCLRTAELLPA
           ||| || |||||| |||||||| ||| : |::||   |   |||:||| |||| |: :||
a036       TGAPSVPPVLWQSRRFCCGRRAARRVPQRRRENRLQPPDXGSRRRSAYRVCLRRADGFPA
                  130       140       150       160       170       180
                  190       200       210       220       230       240
m036.pep   RTRCLCRLKRRIPPAAGCLPPARPDNRSNGGSSAYRTMHKTLRPYERPXRQGCSFAAAAA
           ||:| ||||||| |||||||| |||||||||:|| |||||||||| || |||||||||||
a036       RTHCRCRLKRRILPAAGCLPPDRPDNRSNGGGSACRTMHKTLRPYVRPQRQGCSFAAAAA
                  190       200       210       220       230       240
                  250       260       270
m036.pep   RRRHRARVRRLRGYQTALPNPELHRCRYAVRX
           |||||||||||: |||||||   :||||||
a036       RRRHRARVRRLKEYQTALPNLAPRRCRYAVPX
                  250       260       270
```

Computer analysis of this amino acid sequence gave the following results:

Homology with a predicted ORF from *N. gonorrhoeae*

ORF 036 shows 74.9% identity over a 271 aa overlap with a predicted ORF (ORF 036.ng) from *N. gonorrhoeae*:

m036/g036

```
                  10        20        30        40        50        60
m036.pep   MLKPCAVYSACAAVLPARTSSSRRCVSSGRCVNQYSSRADAIPWRRHSGAVAIRCSSDSS
           ||||| |||||||:|||||||||||| ||||: |||||||| | ||||||||||||||||
g036       MLKPCLVYSACAAALPARTSSSRRCVPSGRCAYQYSSRADATPRRRHSGAVAIRCSSDSS
                  10        20        30        40        50        60

                  70        80        90       100       110       120
m036.pep   GRFCQTIKAAIPXSFSARKTCSDGETSADSNWRCVHADGLQTASSAASSSQSAQTARRMF
           |||||||||||  |||||||||||||||||||||||||||||:|||||::||   | |||
g036       GRFCQTIKAAILPSFSARKTCSDGETSADSNWRCVHADGLQTVSSAASAAQSDGEAGRMF
                  70        80        90       100       110       120

                 130       140       150       160       170       180
m036.pep   TGALSVRPVLWQSGRFCCGRRANRRVRHGRQDNRPWLPMRESRRQSAYPVCLRTAELLPA
             : || ||||||||||||||| ||| :  :|:|     ||:||:||| |||| |: :|:
g036       MFVPSVPPVLWQSGRFCCGRRAVRRVPRQLRDSRRRGRARENRRRSAYRVCLRRADGFPV
                 130       140       150       160       170       180

                 190       200       210       220       230       240
m036.pep   RTRCLCRLKRRIPPAAGCLPPARPDNRSNGGSSAYRTMHKTLRPYERPXRQGCSFAAAAA
           ||:| |||||| | :: |||| | |||||||:|| || ||||||| || |: ||||||||
g036       RTHCRCRLKRRTPRGGQCLPPYRLDNRSNGGGSACRTTHKTLRPYARPQRRVCSFAAAAA
                 190       200       210       220       230       240

                 250       260       270
m036.pep   RRRHRARVRRLRGYQTALPNPELHRCRYAVRX
           ||||||   ||:: :|||||   :||||||||
g036       RRRHRAWGCRLKACRTALPNLAPRRCRYAVRX
                 250       260       270
```

The following partial DNA sequence was identified in *N. meningitidis* <SEQ ID 133>:

m036-1.seq

```
  1 ATGCTGAAGC CGTGCGCCGT GTACAGTGCC TGTGCGGCGG TGTTGCCTGC

 51 ACGGACTTCG AGCAGCAGGC GTTGCGTGTC TTCGGGCAGA TGTGTGAACC

101 AATATTCGAG CAGGGCGGAC GCAATTCCTT GGCGGCGGCA TTCGGGCGCG

151 GTGGCAATCA GGTGCAGTTC GGATTCGTCG GGCAGGTTCT GCCAAACGAT

201 AAAGGCGGCA ATCCCGCCGT CTTTTTCCGC AAGGAAAACC TGTTCGGACG

251 GCGAAACCAG TGCGGACTCA AATTGGCGTT GCGTCCATGC GGACGGGTTG

301 CAGACGGCAT CGAGTGCGGC CAGCTCCTCA CAATCGGCAC AAACGGCACG

351 GCGGATGTTC ACGGGCGCGC TCTCCGTTCG GCCTGTTCTT TGGCAGTCAG

402 GGCGATTTTG TTGCGGACGT AGAGCAAACC GGCGTGTGCG GCATGGACGG

451 CAGGATAACC GCCCTTGGCT GCCAATGCGA GAAAGTCGGC GGCAGTCGGC

501 ATATCCGCTC TGCCTGAGAA CGGCGGAGCT TCTTCCAGCG CGAACGCGCT

551 GCCTATGCCG TCTGAAAAGG CGCATCCCTC CGGCAGCCGG ATGTCTGCCG

601 CCCGCCCGAC CTGATAATCG CTCAAACGGT GGCAGTTCAG CGTATCGAAC

651 CATGCATAAA ACACTTCGCC CATACGAGCG TCCGTAG
```

This corresponds to the amino acid sequence <SEQ ID 134; ORF 0036-1>:

m036-1.pep

```
  1 MLKPCAVYSA CAAVLPARTS SSRRCVSSGR CVNQYSSRAD AIPWRRHSGA

 51 VAIRCSSDSS GRFCQTIKAA IPPSFSARKT CSDGETSADS NWRCVHADGL

101 QTASSAASSS QSAQTARRMF TGALSVRPVL WQSGRFCCGR RANRRVRHGR

151 QDNRPWLPMR ESRRQSAYPV CLRTAELLPA RTRCLCRLKR RIPPAAGCLP

201 PARPDNRSNG GSSAYRTMHK TLRPYERP*
```

m036-1/g036 76.8% identity in 228 aa overlap

```
                     10        20        30        40        50        60
m036-1.pep   MLKPCAVYSACAAVLPARTSSSRRCVSSGRCVNQYSSRADAIPWRRHSGAVAIRCSSDSS
             ||||| |||||||:|||||||||||| ||||: |||||||| | ||||||||||||||||
g036         MLKPCLVYSACAAALPARTSSSRRCVPSGRCAYQYSSRADATPRRRHSGAVAIRCSSDSS
                     10        20        30        40        50        60

                     70        80        90       100       110       120
m036-1.pep   GRFCQTIKAAIPPSFSARKTCSDGETSADSNWRCVHADGLQTASSAASSSQSAQTARRMF
             ||||||||||| ||||||||||||||||||||||||||||||:|||||::||   | |||
g036         GRFCQTIKAAILPSFSARKTCSDGETSADSNWRCVHADGLQTVSSAASAAQSDGEAGRMF
                     70        80        90       100       110       120

                    130       140       150       160       170       180
m036-1.pep   TGALSVRPVLWQSGRFCCGRRANRRVRHGRQDNRPWLPMRESRRQSAYPVCLRTAELLPA
               : || ||||||||||||||| ||| :  :|:|     ||:||:||| |||| |: :|:
g036         MFVPSVPPVLWQSGRFCCGRRAVRRVPRQLRDSRRRGRARENRRRSAYRVCLRRADGFPV
                    130       140       150       160       170       180

                    190       200       210       220      229
m036-1.pep   RTRCLCRLKRRIPPAAGCLPPARPDNRSNGGSSAYRTMHKTLRPYERPX
             ||:| |||||| | :: |||| | |||||||:|| || ||||||| ||
g036         RTHCRCRLKRRTPRGGQCLPPYRLDNRSNGGGSACRTTHKTLRPYARPQRRVCSFAAAAA
                    190       200       210       220       230       240

g036         RRRHRAWGCRLKACRTALPNLAPRRCRYAVRX
                    250       260       270
```

The following partial DNA sequence was identified in *N. gonorrhoeae* <SEQ ID 135>:

g038.seq

```
  1 ATGACTGATT TCCGCCAAGA TTTCCTCAAA TTCTCCCTCG CCCAAAATGT
 51 TTTGAAATTC CGCGAATTTA CCACCAAAGC CGGACGGCGG TCGCCCTATT
101 TCTTCAATGC CGGCCTCTTC AACGACGGCG CGTCCACGCT GCAACTGGCA
151 AAATTCTATG CACAATCCAT CATTGAAAGC GGCATCCGAT TCGATATGCT
201 GTTCGGCCCC GCCTACAAAG GCATTATTTT GGCGGCGGCA ACCGCGATGA
251 TGCTGGCGGA AAAAGGCGTG AACGTCCCGT TTGCCTACAA CCGCAAAGAA
301 GCCAAAGACC GCGGCGAAGG CGGCGTGTTG GTCGGCGCGC CGCTTAAAGG
351 GCGCGTGCTG ATTATCGACG ACGTGATTTC CGCCGGCACA TCCGTACGCG
401 AATCAATCAA ACTGATTGAA GCGGAGGGTG CAACCCCCGC CGGTGTCGCC
451 ATCGCGCTCG ACCGCATGGA AAAAGGCACG GGTAAATTGT CCGCCGTTCA
501 GGAAGTGGAA AAACAATACG GCCTGCCCGT CGCCCCCATC GCCAGCCTGA
551 ACGATTTGTT TATCCTGTTG CAAAACAACC CCGAATTCGG ACAGTTCCTC
601 GAACCCGTCC GCACCTACCG CCGGCAGTAC GGCGTAGAAT AA
```

This corresponds to the amino acid sequence <SEQ ID 136; ORF 038.ng>:

g038.pep

```
  1 MTDFRQDFLK FSLAQNVLKF GEFTTKAGRR SPYFFNAGLF NDGASTLQLA
 51 KFYAQSIIES GIRFDMLFGP AYKGIILAAA TAMMLAEKGV NVPFAYNRKE
101 AKDRGEGGVL VGAPLKGRVL IIDDVISAGT SVRESIKLIE AEGATPAGVA
151 IALDRMEKGT GKLSAVQEVE KQYGLPVAPI ASLNDLFILL QNNPEFGQFL
201 EPVRTYRRQY GVE*
```

The following partial DNA sequence was identified in *N. meningitidis* <SEQ ID 137>:

m038.seq

```
  1 ATGACCGATT TCCGCCAAGA TTTCCTCAAA TTCTCCCTCG CCCAAAATGT
 51 TTTGAAATTC GGCGAATTTA CCACCAAGGC AGGACGGCCG TCGCCCTATT
101 TCTTCAATGC CGGCCTCTTT AACGACGGCT TGTCCACGCT GCAACTGGCA
151 AAATTTTACG CACAATCCAT CATTGAAAGC GGCATCCGAT TCGATATGCT
201 GTTCGGTCCC GCCTACAAAG GCATTATTTT GGCGGCGGCA ACCGCGATGA
251 TGCTGGCGGA AAAAGGCGTG AACGTCCCGT TTGCCTACAA CCGCAAAGAA
301 GCCAAAGACC ACGGCGAAGG CGGCGTGTTG GTCGGCGCGC CGCTTAAAGG
351 GCGCGTGCTG ATTATCGACG ACGTGATTTC CGCCGGCACA TCCGTACGCG
401 AATCGATCAA ACTGATTGAA GCGGAGGGTG CAACCCCcGC CGGTGTCGCC
451 ATCGCGCTCG ATCGCATGGA AAAAGGCACG GGTGAATTGA GCGCGGTTCA
501 GGAAGTGGAr AAACAATACG GkCTGCCCGT CGCCCCCATC GCCAGCCTGA
551 ACGATTTGTT TATTCTGTTG CAAAACAACC CCGAATTCCG ACAGTTCCTC
601 GAACCCGTCC GAGCCTACCG TCGGCAGTAC GGCGTAGAAT AA
```

This corresponds to the amino acid sequence <SEQ ID 138; ORF 038>:

m038.pep

```
  1 MTDFRQDFLK FSLAQNVLKF GEFTTKAGRR SPYFFNAGLF NDGLSTLQLA
 51 KFYAQSIIES GIRFDMLFGP AYKGIILAAA TAMMLAEKGV NVPFAYNRKE
101 AKDHGEGGVL VGAPLKGRVL IIDDVISAGT SVRESIKLIE AEGATPAGVA
151 IALDRMEKGT GELSAVQEVE KQYGLPVAPI ASLNDLFILL QNNPEFGQFL
201 EPVRAYRRQY GVE*
```

The following partial DNA sequence was identified in *N. meningitidis* <SEQ ID 139>:

a038.seq

```
  1 ATGACCGATT TCCGCCAAGA TTTCCTCAAA TTCTCCCTCG CCCAAAATGT
 51 TTTGAAATTC GGCGAATTCA CCACCAAAGC CGGACGGCGG TCGCCCTATT
101 TCTTCAATGC CGGCCTCTTT AACGACGGCT TGTCCACGCT GCAACTGGCA
151 AAATTTTACG CACAATCCAT CATTGAAAGC GGCATCCGAT TCGATATGCT
201 GTTCGGCCCC GCCTACAAAG GCATTATTTT GGCGGCGGCA ACCGCGATGA
251 TGCTGGCGGA AAAAGGCGTG AACGTCCCGT TTGCCTACAA CCGCAAAGAA
301 GCCAAAGACC ACGGCGAAGG CGGCGTGTTG GTCGGCGCGC CGCTTAAAGG
351 GCGCGTGCTG ATTATCGACG ACGTGATTTC CGCCGGCACA TCCGTACGCG
401 AATCGATCAA ACTGATTGAA GCGGAGGGTG CAACCCCCGC CGGTGTCGCC
451 ATCGCGCTCG ACCGCATGGA AAAAGGCACG GGTGAATTGA GCGCGGTTCA
501 GGAAGTGGAA AAACAATACG GCCTGCCCGT CGCCCCCATC GCCAGCCTGA
```

-continued

```
551 ACGATTTGTT TATTCTGTTG CAAAACAACC CCGAATTCGG ACAGTTCCTC

601 GAACCCGTCC GAGCCTACCG TCGGCAGTAC GGCGTAGAAT AA
```

This corresponds to the amino acid sequence <SEQ ID 140; ORF 038.a>:

a038.pep

```
  1 MTDFRQDFLK FSLAQNVLKF GEFTTKAGRR SPYFFNAGLF NDGLSTLQLA

 51 KFYAQSIIES GIRFDMLFGP AYKGIILAAA TAMMLAEKGV NVPFAYNRKE

101 AKDHGEGGVL VGAPLKGRVL IIDDVISAGT SVRESIKLIE AEGATPAGVA

151 IALDRMEKGT GELSAVQEVE KQYGLPVAPI ASLNDLFILL QNNPEFGQFL

201 EPVRAYRRQY GVE*
```

m038/a038 100.0% identity over a 213 aa overlap

```
                   10        20        30        40        50        60
m038.pep    MTDFRQDFLKFSLAQNVLKFGEFTTKAGRRSPYFFNAGLFNDGLSTLQLAKFYAQSIIES
            ||||||||||||||||||||||||||||||||||||||||||||||||||||||||||||
a038        MTDFRQDFLKFSLAQNVLKFGEFTTKAGRRSPYFFNAGLFNDGLSTLQLAKFYAQSIIES
                   10        20        30        40        50        60

                   70        80        90       100       110       120
m038.pep    GIRFDMLFGPAYKGIILAAATAMMLAEKGVNVPFAYNRKEAKDHGEGGVLVGAPLKGRVL
            ||||||||||||||||||||||||||||||||||||||||||||||||||||||||||||
a038        GIRFDMLFGPAYKGIILAAATAMMLAEKGVNVPFAYNRKEAKDHGEGGVLVGAPLKGRVL
                   70        80        90       100       110       120

                  130       140       150       160       170       180
m038.pep    IIDDVISAGTSVRESIKLIEAEGATPAGVAIALDRMEKGTGELSAVQEVEKQYGLPVAPI
            ||||||||||||||||||||||||||||||||||||||||||||||||||||||||||||
a038        IIDDVISAGTSVRESIKLIEAEGATPAGVAIALDRMEKGTGELSAVQEVEKQYGLPVAPI
                  130       140       150       160       170       180

                  190       200       210
m038.pep    ASLNDLFILLQNNPEFGQFLEPVRAYRRQYGVEX
            ||||||||||||||||||||||||||||||||||
a038        ASLNDLFILLQNNPEFGQFLEPVRAYRRQYGVEX
                  190       200       210
```

Computer analysis of this amino acid sequence gave the following results:

Homology with a predicted ORF from *N. gonorrhoeae*

ORF 038 shows 98.1% identity over a 213 aa overlap with a predicted ORF (ORF 038.ng) from *N. gonorrhoeae*:

m038/g038

```
                   10        20        30        40        50        60
m038.pep    MTDFRQDFLKFSLAQNVLKFGEFTTKAGRRSPYFFNAGLFNDGLSTLQLAKFYAQSIIES
            |||||||||||||||||||||||||||||||||||||||||||| |||||||||||||||
g038        MTDFRQDFLKFSLAQNVLKFGEFTTKAGRRSPYFFNAGLFNDGASTLQLAKFYAQSIIES
                   10        20        30        40        50        60

                   70        80        90       100       110       120
m038.pep    GIRFDMLFGPAYKGIILAAATAMMLAEKGVNVPFAYNRKEAKDHGEGGVLVGAPLKGRVL
            ||||||||||||||||||||||||||||||||||||||||||||:|||||||||||||||
g038        GIRFDMLFGPAYKGIILAAATAMMLAEKGVNVPFAYNRKEAKDRGEGGVLVGAPLKGRVL
                   70        80        90       100       110       120

                  130       140       150       160       170       180
m038.pep    IIDDVISAGTSVRESIKLIEAEGATPAGVAIALDRMEKGTGELSAVQEVEKQYGLPVAPI
            ||||||||||||||||||||||||||||||||||||||||||:|||||||||||||||||
g038        IIDDVISAGTSVRESIKLIEAEGATPAGVAIALDRMEKGTGKLSAVQEVEKQYGLPVAPI
                  130       140       150       160       170       180
```

-continued

```
                    190        200        210
m038.pep     ASLNDLFILLQNNPEFGQFLEPVRAYRRQYGVEX
             ||||||||||||||||||||||||:|||||||||
g038         ASLNDLFILLQNNPEFGQFLEPVRTYRRQYGVEX
                    190        200        210
```

The following partial DNA sequence was identified in *N. gonorrhoeae* <SEQ ID 141>:

g039.seq

```
  1 ATGCCGTCCG AACCACCTGC CGCTTCAGAC GGCATCAAAC CGACACACAC
 51 CGAGAAAACA TCATGCCCGC CTGTTTCTGT CCGCACTGCA AAACCCGCCT
101 CTGGGTCAAA GAAAcccagC TCAAcgtCgC ccaagGCTTC GTCGTCTgcc
151 aaAAAtgcga agGGCTgttt aaAgccaaaG accAtctggc aaGcacGAAA
201 gaacctatat tcaacgattg gcccgaagct gtttcgggat gTcaaaCTCG
251 TCcaccgcaT cggcacgcac gccattagca aGAaacagat gtcccgcgac
301 gaaatCgccg atatcctcaa cggcggtaca acCCTGCACG ATACGCCGCC
351 CGCAACCGCC GCTGCCGCac ctGCCGCCGC ACCGCaggTT TCCGTACCGC
401 CCGCCCGTCA GGAAGGGCTC AACTGGACTA TTGCAACCCT GTTCGCACTT
451 ATCGTCCTCA TTATGCAGCT TTCCTACCTC TTCATCCTAT GA
```

This corresponds to the amino acid sequence <SEQ ID 142; ORF 039.ng>:

g039.pep

```
  1 MPSEPPAASD GIKPTHTEKT SCPPVSVRTA KPASGSKKPS STSPKASSSA
 51 KNAKGCLKPK TIWQARKNLY STIGPKLFRD VKLVHRIGTH AISKKQMSRD
101 EIADILNGGT TLHDTPPATA AAAPAAAPQV SVPPARQEGL NWTIATLFAL
151 IVLIMQLSYL FIL*
```

The following partial DNA sequence was identified in *N. meningitidis* <SEQ ID 143>:

m039.seq

```
  1 ATGCCGTCCG AACCGCCTTA CGCCTCAGAC GGCATCAAAC CTGACACACA
 51 CGAGGAAATA CCATGCCCGC CTGTTTCTGC CCCCACTGCA AAACCCGTCT
101 CTGGGTCAAA GAAACCCAAC TCAATGTCGC CGnnnnnnnn nnnnnnnnnn
151 nnnnnnnnnn nnnnnnnnnn nnnnnnnnnn nnnnnnnnnn nnnnnnnnnn
201 nnnnnnnnnn nnnnnnnnnn nnnnnnnnnn nnnnnnnCCC GAGGCTGTTT
251 CGGATGTCAA ACTCGTTCAC CGTATCGGCA CGCGCGCCAT CGGCAAGAAA
301 CAGATTTCCC GTGACGAAAT CGCCGGCATC CTCAACGGCG GTACAACCCA
351 GCCCGATATT CCGCCCGCAA CCGCCGCCAC CCCTGCTGCC GCACCGCAGG
401 TTACCGTACC GCCCGCCGCG CCCGCCCGTC AGGATGGGTT CAACTGGACG
```

-continued

```
451 ATTGCAACCC TGTTTGCCCT TATCGTCCTC ATTATGCAGC TTTCCTACCT

501 CGTCATCCTA TGA
```

This corresponds to the amino acid sequence <SEQ ID 144; ORF 039>:

m039.pep

```
  1 MPSEPPYASD GIKPDTHEEI PCPPVSAPTA KPVSGSKKPN SMSPXXXXXX

 51 XXXXXXXXXX XXXXXXXXXX XXXXXXXXXP EAVSDVKLVH RIGTRAIGKK

101 QISRDEIAGI LNGGTTQPDI PPATAATPAA APQVTVPPAA PARQDGFNWT

151 IATLFALIVL IMQLSYLVIL *
```

The following partial DNA sequence was identified in *N. meningitidis* <SEQ ID 145>:

a039.seq

```
  1 ATGCCGTCTG AACCGCCTTA CGCCTCAGAC GGCATCAAAC CTGACACACA

 51 CGAGGAAATA CCATGCCCGC CTGTTTCTGC CCCCACTGCA AAACCCGTCT

101 CTGGGTCAAA GAAACCCAAC TCAATGTCGC CCAAGGCTTC GTCGTCTGCC

151 AAAAATGCGA AGGAATGTTT AAAGCCAAAG ACCATCTGGC AAGCACGAAA

201 GAACCCATAT TCAACGATT. TGCCCGAAGC TGTTTCGGAT GTCAAACTCG

251 TTCACCGCAT CGGCACGAGC GCCATCGGCA AGAAACAGAT TTCCCGTGAC

301 GAAATCGCCG GCATCCTCAA CGGCGGCACA ACCCAGCCCG ATATTCCGCC

351 CGCAACCGCC GCCACCCCTG CTGCCGCACC GCAGGTTACC GTACCGCCCG

401 CCGCGCCCGC CCGTCAGGAT GGGTTCAACT GGACGATTGC AACCCTGTTT

451 GCCCTTATCG TCCTCATTAT GCAGCTTTCC TACCTCGTCA TCCTATGA
```

This corresponds to the amino acid sequence <SEQ ID 146; ORF 039.a>:

a039.pep

```
  1 MPSEPPYASD GIKPDTHEEI PCPPVSAPTA KPVSGSKKPN SMSPKASSSA

 51 KNAKECLKPK TIWQARKNPY STIXPEAVSD VKLVHRIGTS AIGKKQISRD

101 EIAGILNGGT TQPDIPPATA ATPAAAPQVT VPPAAPARQD GFNWTIATLF

151 ALIVLIMQLS YLVIL*
```

m039/a039 79.4% identity over a 170 aa overlap

```
                    10        20        30        40        50        60
m039.pep    MPSEPPYASDGIKPDTHEEIPCPPVSAPTAKPVSGSKKPNSMSPXXXXXXXXXXXXXXXX
            ||||||||||||||||||||||||||||||||||||||||||||
a039        MPSEPPYASDGIKPDTHEEIPCPPVSAPTAKPVSGSKKPNSMSPKASSSAKNAKECLKPK
                    10        20        30        40        50        60

                    70        80        90       100       110       120
m039.pep    XXXXXXXXXXXXXXXXXXXPEAVSDVKLVHRIGTRAIGKKQISRDEIAGILNGGTTQPDI
            :           : |     |||||||||||||| ||||||||||||||||||||||||
a039        TIWQARKNPYSTIX-----PEAVSDVKLVHRIGTSAIGKKQISRDEIAGILNGGTTQPDI
                    70             80        90       100       110
```

-continued

```
                130         140         150         160         170
m039.pep     PPATAATPAAAPQVTVPPAAPARQDGFNWTIATLFALIVLIMQLSYLVILX
             |||||||||||||||||||||||||||||||||||||||||||||||||||
a039         PPATAATPAAAPQVTVPPAAPARQDGFNWTIATLFALIVLIMQLSYLVILX
               120         130         140         150         160
```

Computer analysis of this amino acid sequence gave the following results:

Homology with a predicted ORF from *N. gonorrhoeae*

ORF 039 shows 60.8% identity over a 171 aa overlap with a predicted ORF (ORF 039.ng) from *N. gonorrhoeae*:

m039/g039

```
                10          20          30          40          50          60
m039.pep     MPSEPPYASDGIKPDTHEEIPCPPVSAPTAKPVSGSKKPNSMSPXXXXXXXXXXXXXXXX
             |||||| |||||||    |:  |||||: ||||:||||||:| ||
a039         MPSEPPAASDGIKPTHTEKTSCPPVSVRTAKPASGSKKPSSTSPKASSSAKNAKGCLKPK
                10          20          30          40          50          60
                70          80          90         100         110         120
m039.pep     XXXXXXXXXXXXXXXXXXXPEAVSDVKLVHRIGTRAIGKKQISRDEIAGILNGGTTQPDI
             :         :          |:   |||||||||:||:|||:|||||| |||||||   |
a039         TIWQARKNLYSTIG-----PKLFRDVKLVHRIGTHAISKKQMSRDEIADILNGGTTLHDT
                70               80          90         100         110
                130         140         150         160         170
m039.pep     PPATAAT-PAAAPQVTVPPAAPARQDGFNWTIATLFALIVLIMQLSYLVILX
             ||||||: |||||||:||||    ||:|:|||||||||||||||||||| |||
a039         PPATAAAAPAAAPQVSVPPA---RQEGLNWTIATLFALIVLIMQLSYLFILX
               120         130            140         150         160
```

The following partial DNA sequence was identified in *N. gonorrhoeae* <SEQ ID 147>:

g040.seq

```
  1 ATGAACGCGC CCGACAGCTT TGTCGCCCAC TTCCGCGAAG CCGCCCCCTA
 51 CATCCGCCAA ATGCGCGGCA CGACACTGGT CGCCGGCATA GAcggCCGCC
101 TGCTCGAAGG CGGCACCTTA AATAAGCTCG CCGCCGACAT CGGGCTGTTG
151 TCGCAACTGG GCATCCGACT CGTCCTCATC CACGGCGCGT ACCACTTCCT
201 CGAccgCCTC GCCGCCGCGC AAGgccGCAC GCCGCATTAT TGCCGgggtt
251 tGCGCGTTAC CGACGaAACc tcGctcgGAC AGGCGCAGCA GtttGCCGGC
301 AccgTCCGCA GCCGTTTTGA agcCGCATTG tgcggcagCG tttcaggatt
351 cgcgCGCGCG CCTTCCGTCC CGCTCGTAtc gggcaacttc ctgacCGCCC
401 GTCcgatggg cgtgattgac ggaACCGata tggaatacgc gggggttatc
451 cgcaaaaccg ACACCGCCGC CCTCCGTTTC CAACTCGACG CGGGCAATAT
501 CGTCTGGATG CCGCCGCTCG CGCATTCCTA CGGCGGCAAA ACCTTCAATC
551 TCGATATGGT GCAGGCCGCC GCTTCCGTCG CCGTCTCGCT TCAGGCCGAA
601 AAACTCGTTT ACCTGACCCT TTCAGACGGC ATTTCCCGCC CCGACGGCAC
651 GCTCGCCGAA ACCCTCTCGG CACAGGAAGC GCAATCGCTG GCGGAACACG
701 CCGCCAGCGA AACCCGACGA CTGATTTCGT CCGCCGTTGC CGCGCTCGAA
751 GGCGGCGTGC ATCGCGTCCA AATCCTCAAC GGGGCCGCCG ACGGCAGCCT
801 GCTGCAAGAA CTCTTCACCC GCAACGGCAT CGGCACGTCC ATTGCCAAAG
851 AAGCCTTCGT CTCCATCCGG CAGGCGCACA GCGGCGACAT CCCGCACATC
```

-continued

```
 901 GCCGCCCTCA TCCGCCCGCT GGAAGAACAG GGCGTCCTAT TGCACCGCAG
 951 CCGCGAATAC CTCGAAAACC ACATTTCCGA ATTTTCCATC CTCGAACACG
1001 ACGGCGACCT GTACGGCTGT GCCGCACTCA AAACCTTTGC CGAAGCCGAT
1051 TGCGGCGAAA TCGCCTGCCT TGCCGTCTCG CCGCAGGCAC AGGACGGCGg
1101 ctACGGCGAA CGCCTGCTTG CCCACATTAT CGATAAGGCG CGCGGCATAG
1151 GCATAAGCAG GCTGTTCGCA CTGTCCACAA ATACCGGCGA ATGGTTTGCC
1201 GAACGCGGCT TTCAGACGGC ATCGGAAGAC GAGCTGCCCG AAACGCGGCG
1251 CAAAGACTAC CGCAGCAACG GACGAAACCC GCATATTCTG GTGCGTCGCC
1301 TGCACCGCTG A
```

This corresponds to the amino acid sequence <SEQ ID 148; ORF 040.ng>:

g040.pep

```
  1 MNAPDSFVAH FREAAPYIRQ MRGTTLVAGI DGRLLEGGTL NKLAADIGLL
 51 SQLGIRLVLIHGAYHFLDRL AAAQGRTPHY CRGLRVTDET SLGQAQQFAG
101 TVRSRFEAAL CGSVSGFARA PSVPLVSGNF LTARPMGVID GTDMEYAGVI
151 RKTDTAALRF QLDAGNIVWM PPLGHSYGGK TFNLDMVQAA ASVAVSLQAE
201 KLVYLTLSDG ISRPDGTLAE TLSAQEAQSL AEHAASETRR LISSAVAALE
251 GGVHRVQILN GAADGSLLQE LFTRNGIGTS IAKEAFVSIR QAHSGDIPHI
301 AALIRPLEEQ GVLLHRSREY LENHISEFSI LEHDGDLYGC AALKTFAEAD
351 CGEIACLAVS PQAQDGGYGE RLLAHIIDKA RGIGISRLFA LSTNTGEWFA
401 ERGFQTASED ELPETRRKDY RSNGRNPHIL VRRLHR*
```

The following partial DNA sequence was identified in *N. meningitidis* <SEQ ID 149>:

m040.seq

```
  1 ATGAGCGCGC CCGACCTCTT TGTCGCCCAC TTCCGCGAAG CCGTCCCCTA
 51 CATCCGCCAA ATGCGCGGCA AAACGCTGGT CGCCGGCATA GACGACCGCC
101 TGCTCGAAGG TGATACCTTA AACAAGCTCG CCGCCGACAT CGGGCTGTTG
151 TCGCAACTGG GCATCAGGCT CGTCCTCATC CACGGCGCGC GCCACTTCCT
201 CGACCGCCAC GCCGCCGCTC AAGGCCGCAC GCCGCATTAT TGCCGGGGCT
251 TGCGCGTTAC CGACGAAACC TCGCTCGAAC AGGCGCAgCA GTTTGCCGGC
301 ACCGTCCGCA GCCGTTTTGA AGCCGCATTG TGCGGCAGCG TTTCCGGGTT
351 CGCGCGCGCG CCTTCCGTCC CGCTCGTATC GGGCAACTTC CTGACCGCCC
401 GTCCGATAGG TGTGATTGAC GGAACCGATA TGGAATACGC GGGCGTTATC
451 CGCAAAACCG ACACCGCCGC CCTCCGTTTC CAACTCGACG CGGGCAATAT
501 CGTCTGGCTG CCGCCGCTCG GACATTCCTA CAGCGGCAAG ACCTTCTATC
551 TCGATATGCT TCAAACCGCC GCCTCCGCCG CCGTCTCGCT TCAGGCCGAA
601 AAACTCGTTT ACCTGACCCT TTCAGACGGC ATTTCCCGCC CCGACGGCAC
```

-continued

```
 651 GCTCGCCGAA ACCCTCTCGG CACAGGAAGC GCAATCGCTG GCGGAACACG
 701 CCGGCGGGCA AACGCGACGG CTGATTTCGT CCGCCGAACT CTTCACCCGC
 751 AACGGCATCG GCACGTCCAT TGCCAAAGAA GCCTTCGTCT CCATCCGGCA
 801 rGCGCAywgG G.CGACATCC CGCACATCGC CGCCCTCATC CGCCCGCTGG
 851 AAGAACAGGG CATCCTGCTG CACCGCAs.c GCGAATACCT CGAAAACCAC
 901 ATTTCCGAAT TTTCCATCCT CGAACACGAC GGCAACCTGT ACGGTTGCGC
 951 CGCCCTGAAA ACCTTTGCCG AAGCCGATTG CGGCGAAATC GCCTGCCTTG
1001 CCGTCTCGCC GCag.cACAG GACGGCGGCT ACGGCGAACG CnTGCTTGCC
1051 CACATTATCG ATAAGGCGCG CGGCATAGGC ATAAGCAGGC TGTTCGCACT
1101 GTCCACAAAT ACCGGCGAAT GGTTTGCCGA ACGCGGCTTT CAGACGGCAT
1151 CGGAAGACGA GTTGCCCGAA ACGCGGCGCA AAGACTACCG CAGCAACGGA
1201 CGGAACTCGC ATATTCTGGT ACGTCGCCTG CACCGCTGA
```

This corresponds to the amino acid sequence <SEQ ID 150; ORF 040>:

m040.pep

```
  1 MSAPDLFVAH FREAVPYIRQ MRGKTLVAGI DDRLLEGDTL NKLAADIGLL
 51 SQLGIRLVLI HGARHFLDRH AAAQGRTPHY CRGLRVTDET SLEQAQOFAG
101 TVRSRFEAAL CGSVSGFARA PSVPLVSGNF LTARPIGVID GTDMEYAGVI
151 RKTDTAALRF QLDAGNIVWL PPLGHSYSGK TFYLDMLQTA ASAAVSLQAE
201 KLVYLTLSDG ISRPDGTLAE TLSAQEAQSL AEHAGGQTRR LISSAELFTR
251 NGIGTSIAKE AFVSIRQAHX XDIPHIAALI RPLEEQGILL HRXREYLENH
301 ISEFSILEHD GNLYGCAALK TFAEADCGEI ACLAVSPQXQ DGGYGERXLA
351 HIIDKARGIG ISRLFALSTN TGEWFAERGF QTASEDELPE TRRKDYRSNG
401 RNSHILVRRL HR*
```

The following partial DNA sequence was identified in *N. meningitidis* <SEQ ID 151>:

a040.seq

```
  1 ATGATCGTGC CCGACCTCTT TGTCGCCCAC TTCCGCGAAG CCGCCCCCTA
 51 CATCCGCCAA ATGCGCGGCA AAACGCTGGT CGCCGGCATA GACGACCGCC
101 TGCTCGAAGG TGATACCTTA AACAAGTTCG CCGCCGACAT CGGGCTTTTG
151 TCGCAACTGG GCATCAGGCT CGTCCTCATC CACGGCGCGC GCCACTTCCT
201 CGACCGCCAC GCCGCCGCGC AAGGCCGCAC GCCGCATTAT TGCCGGGGCT
251 TGCGCGTTAC CGACGAAACC TCGCTCGAAC AGGCGCAGCA GTTTGCCGGC
301 ACCGTCCGCA GCCGTTTTGA AGCCGCATTG TGCGGCAGCG TTTCCGGGTT
351 CGCGCGCGCG CCTTCCGTCC CGCTCGTATC GGGCAACTTC CTGACCGCCC
401 GTCCGATAGG TGTGATTGAC GGAACCGATA TGGAATACGC GGGCGTTATC
451 CGCAAAACCG ACACCGCCGC CCTCCGTTTC CAACTCGACG CGGGCAATAT
501 CGTCTGGCTG CCGCCGCTCG GACATTCCTA CAGCGGCAAG ACCTTCCATC
```

-continued

```
 551 TCGATATGCT TCAAACCGCC GCCTCCGTCG CCGTCTCGCT TCAGGCCGAA
 601 AAACTCGTTT ACCTGACCCT TTCAGACGGC ATTTCCCGCC CCGACGGCAC
 651 GCTCGCCGTA ACCCTCTCGG CACAGGAAGC GCAATCGCTG GCGGAACACG
 701 CCGGCGGCGA AACGCGACGG CTGATTTCCT CCGCCGTTGC CGCGCTCGAA
 751 GGCGGCGTGC ATCGCGTCCA AATCCTCAAC GGAGCCGCCG ACGGCAGCCT
 801 GCTGCAAGAA CTCTTCACCC GCAACGGCAT CGGCACGTCC ATTGCCAAAG
 851 AAGCCTTCGT CTCCATCCGG CAGGCGCACA GCGGCGACAT CCCGCACATT
 901 GCCGCCCTCA TCCGCCCGCT GGAAGAACAG GGCATCCTGC TGCACCGCAG
 951 CCGCGAATAC CTCGAAAACC ACATTTCCGA ATTTTCCATC CTCGAACACG
1001 ACGGCAACCT GTACGGTTGC GCCGCCCTGA AAACCTTTGC CGAAGCCGAT
1051 TGCGGCGAAA TCGCCTGCCT TGCCGTCTCG CCGCAGGCAC AGGACGGCGG
1101 CTACGGCGAA CGCCTGCTTG CCCACATTAT CGATAAGGCG CGCGGCATAG
1151 GCATAAGCAG GCTGTTCGCA CTGTCCACAA ATACCGGCGA ATGGTTTGCC
1201 GAACGCGGCT TTCAGACGGC ATCGGAAGAC GAGTTGCCCG AAACGCGGCG
1251 CAAAGACTAC CGCAGCAACG GACGGAACTC GCATATTCTG GTGCGTCGCC
1301 TGCACCGCTG A
```

This corresponds to the amino acid sequence <SEQ ID 152; ORF 040.a>:

a040.pep

```
  1 MIVPDLFVAH FREAAPYIRQ MRGKTLVAGI DDRLLEGDTL NKFAADIGLL
 51 SQLGIRLVLI HGARHFLDRH AAAQGRTPHY CRGLRVTDET SLEQAQQFAG
101 TVRSRFEAAL CGSVSGFARA PSVPLVSGNF LTARPIGVID GTDMEYAGVI
151 RKTDTAALRF QLDAGNIVWL PPLGHSYSGK TFHLDMLQTA ASVAVSLQAE
201 KLVYLTLSDG ISRPDGTLAV TLSAQEAQSL AEHAGGETRR LISSAVAALE
251 GGVHRVQILN GAADGSLLQE LFTRNGIGTS IAKEAFVSIR QAHSGDIPHI
301 AALIRPLEEQ GILLHRSREY LENHISEFSI LEHDGNLYGC AALKTFAEAD
351 CGEIACLAVS PQAQDGGYGE RLLAHIIDKA RGIGISRLFA LSTNTGEWFA
401 ERGFQTASED ELPETRRKDY RSNGRNSHIL VRRLHR*
```

m040/a040 91.5% identity in 436 aa overlap

```
                    10        20        30        40        50        60
m040.pep    MSAPDLFVAHFREAVPYIRQMRGKTLVAGIDDRLLEGDTLNKLAADIGLLSQLGIRLVLI
            | :|||||||||||:|||||||||||||||||||||||||||:|||||||||||||||||
a040        MIVPDLFVAHFREAAPYIRQMRGKTLVAGIDDRLLEGDTLNKFAADIGLLSQLGIRLVLI
                    10        20        30        40        50        60

                    70        80        90       100       110       120
m040.pep    HGARHFLDRHAAAQGRTPHYCRGLRVTDETSLEQAQQFAGTVRSRFEAALCGSVSGFARA
            ||||||||||||||||||||||||||||||||||||||||||||||||||||||||||||
a040        HGARHFLDRHAAAQGRTPHYCRGLRVTDETSLEQAQQFAGTVRSRFEAALCGSVSGFARA
                    70        80        90       100       110       120

                   130       140       150       160       170       180
m040.pep    PSVPLVSGNFLTARPIGVIDGTDMEYAGVIRKTDTAALRFQLDAGNIVWLPPLGHSYSGK
            ||||||||||||||||||||||||||||||||||||||||||||||||||||||||||||
a040        PSVPLVSGNFLTARPIGVIDGTDMEYAGVIRKTDTAALRFQLDAGNIVWLPPLGHSYSGK
                   130       140       150       160       170       180
```

-continued

```
                190       200       210       220       230       240
m040.pep    TFYLDMLQTAASAAVSLQAEKLVYLTLSDGISRPDGTLAETLSAQEAQSLAEHAGGQTRR
            ||:|||||||||:|||||||||||||||||||||||||| ||||||||||||||||:|||
a040        TFHLDMLQTAASVAVSLQAEKLVYLTLSDGISRPDGTLAVTLSAQEAQSLAEHAGGETRR
                190       200       210       220       230       240

                                                250       260       270
m040.pep    LISSA------------------------ELFTRNGIGTSIAKEAFVSIRQAHXXDIPHI
            |||||||||||:||||||||||||||||||||||||| |||||||||||||  |||||
a040        LISSAVAALEGGVHRVQILNGAADGSLLQELFTRNGIGTSIAKEAFVSIRQAHSGDIPHI
                250       260       270       280       290       300

             280       290       300       310       320       330
m040.pep    AALIRPLEEQGILLHRXREYLENHISEFSILEHDGNLYGCAALKTFAEADCGEIACLAVS
            |||||||||||||||| |||||||||||||||||||||||||||||||||||||||||||
a040        AALIRPLEEQGILLHRSREYLENHISEFSILEHDGNLYGCAALKTFAEADCGEIACLAVS
                310       320       330       340       350       360

             340       350       360       370       380       390
m040.pep    PQXQDGGYGERXLAHIIDKARGIGISRLFALSTNTGEWFAERGFQTASEDELPETRRKDY
            || |||||||| ||||||||||||||||||||||||||||||||||||||||||||||||
a040        PQAQDGGYGERLLAHIIDKARGIGISRLFALSTNTGEWFAERGFQTASEDELPETRRKDY
                370       380       390       400       410       420

             400       410
m040.pep    RSNGRNSHILVRRLHRX
            ||||||||||||||||
a040        RSNGRNSHILVRRLHRX
                430
```

Computer analysis of this amino acid sequence gave the following results:

Homology with a predicted ORF from *N. gonorrhoeae*

ORF 040 shows 88.3% identity over a 436 aa overlap with a predicted ORF (ORF 040.ng) from *N. gonorrhoeae*:

m040/g040

```
m040.pep    MSAPDLFVAHFREAVPYIRQMRGKTLVAGIDDRLLEGDTLNKLAADIGLLSQLGIRLVLI    60
            |:||| ||||||||:|||||||| ||||||| ||||| ||||||||||||||||||||||
g040        MNAPDSFVAHFREAAPYIRQMRGTTLVAGIDGRLLEGGTLNKLAADIGLLSQLGIRLVLI    60

m040.pep    HGARHFLDRHAAAQGRTPHYCRGLRVTDETSLEQAQQFAGTVRSRFEAALCGSVSGFARA   120
            ||| ||||| |||||||||||||||||||||| |||||||||||||||||||||||||||
g040        HGAYHFLDRLAAAQGRTPHYCRGLRVTDETSLGQAQQFAGTVRSRFEAALCGSVSGFARA   120

m040.pep    PSVPLVSGNFLTARPIGVIDGTDMEYAGVIRKTDTAALRFQLDAGNIVWLPPLGHSYSGK   180
            |||||||||||||||:|||||||||||||||||||||||||||||||||:|||||||:||
g040        PSVPLVSGNFLTARPMGVIDGTDMEYAGVIRKTDTAALRFQLDAGNIVWMPPLGHSYGGK   180

m040.pep    TFYLDMLQTAASAAVSLQAEKLVYLTLSDGISRPDGTLAETLSAQEAQSLAEHAGGQTRR   240
            || |||:|:|||:|||||||||||||||||||||||||||||||||||||||||:::|||
g040        TFNLDMVQAAASVAVSLQAEKLVYLTLSDGISRPDGTLAETLSAQEAQSLAEHAASETRR   240

m040.pep    LISSA------------------------ELFTRNGIGTSIAKEAFVSIRQAHXXDIPHI   276
            |||||                        ||||||||||||||||||||||||  |||||
g040        LISSAVAALEGGVHRVQILNGAADGSLLQELFTRNGIGTSIAKEAFVSIRQAHSGDIPHI   300

m040.pep    AALIRPLEEQGILLHRXREYLENHISEFSILEHDGNLYGCAALKTFAEADCGEIACLAVS   336
            |||||||||||:|||| ||||||||||||||||||:||||||||||||||||||||||||
g040        AALIRPLEEQGVLLHRSREYLENHISEFSILEHDGDLYGCAALKTFAEADCGEIACLAVS   360

m040.pep    PQXQDGGYGERXLAHIIDKARGIGISRLFALSTNTGEWFAERGFQTASEDELPETRRKDY   396
            || |||||||| ||||||||||||||||||||||||||||||||||||||||||||||||
g040        PQAQDGGYGERLLAHIIDKARGIGISRLFALSTNTGEWFAERGFQTASEDELPETRRKDY   420

m040.pep    RSNGRNSHILVRRLHRX  413
            |||||| ||||||||||
g040        RSNGRNPHILVRRLHRX  437
```

The following partial DNA sequence was identified in *N. gonorrhoeae* <SEQ ID 153>:

g041.seq

```
  1 ATGAGTTCGC CCAAACACAT CGGCTTGCAG GGCGGCAGCA ACGGCGGCCT

 51 GATTACCGCC GCCGCCTTCG TGCGCGAACC GCAAAGCATC GGTGCGCTGG

101 TGTGCGAAGT ACCGCTGACC GATATGATCC GTTATCCGCT GCTGTCCGCC
```

-continued

```
151 GGTTCAAGTT GGACGGACGA ATACGGCAAT CCGCAGAAAT ACGAAGCCTG

201 CAAACGCCGG CTGGGCGAAT TGTCGCCGTA TCACAATCTT TCAGACGGCA

251 TCGATTATCC GCCCGCACTC ATTACCACCA GCCTCAGCGA CGACCGCGTC

301 CATCCCGCCC ACGCGCTCAA ATTCTACGCC AAACTGCGCG AAACCTCGCC

351 GCAATCTTGG CTCTACTCGC CTGACGGCGG CGGCCATACC GGCAACGGCA

401 CCCAACGCGA ATCCGCCGAC AAACTCGCCT GCGTGTTGCT GTTTTTGAAA

451 GAATTTTTGG GATAA
```

This corresponds to the amino acid sequence <SEQ ID 154; ORF 041.ng>:

g041.pep

```
  1 MSSPKHIGLQ GGSNGGLITA AAFVREPQSI GALVCEVPLT DMIRYPLLSA

 51 GSSWTDEYGN PQKYEACKRR LGELSPYHNL SDGIDYPPAL ITTSLSDDRV

101 HPAHALKFYA KLRETSPQSW LYSPDGGGHT GNGTQRESAD KLACVLLFLK

151 EFLG*
```

The following partial DNA sequence was identified in *N. meningitidis* <SEQ ID 155>:

m041.seq

```
  1 ATCAGTTCGC CCGAACACAT CGGCTTGCAG GGCGGCAGCA ACGGCGGACT

 51 GATTACTGCC GCCGCCTTCG TGCGCGAACC GCAAAGCATC GGCGCGCTGG

101 TGTGCGAAGT GCCGCTGACC GACATGATCC GTTATCCGCT GCTCTCCGCC

151 GGTTCAAGCT GGACAGACGA ATACGGCAAT CCGCAAAAAT ACGAAGTCTG

201 CAAACGCCGG TTGGGCGAAT TGTCGCCGTA TCACAATCTT TCAGACGGCA

251 TCGATTATCC GCCCGCGCTC ATTACCACCA GCCTCTCCGA CGATCGCGTC

301 CATCCCGCCC ACGCGCTCAA GTTCTACGCC AAACTCCGCG AAACCTCCGC

351 GCAATCTTGG CTCTACTCGC CTGACGGCGG CGGCCATACC GGCAACGGCA

401 CCCAACGCGA ATCCGCCGAC GAACTCGCCT GCGTCTTGCT GTTTTTGAAA

451 GAGTTTTTGG GCTAA
```

This corresponds to the amino acid sequence <SEQ ID 156; ORF 041>:

m041.pep

```
  1 ISSPEHIGLQ GGSNGGLITA AAFVREPQSI GALVCEVPLT DMIRYPLLSA

 51 GSSWTDEYGN PQKYEVCKRR LGELSPYHNL SDGIDYPPAL ITTSLSDDRV

101 HPAHALKFYA KLRETSAQSW LYSPDGGGHT GNGTQRESAD ELACVLLFLK

151 EFLG*
```

The following partial DNA sequence was identified in *N. meningitidis* <SEQ ID 157>:

a041.seq

```
  1 ATCAGTTCGC CCGAACACAT CGGCTTGCAG GGCGGCAGCA ACGGCGGACT
 51 GATTACTGCC GCCGCCTTCG TGCGCGAACC GCAAAGCATC GGCGCGCTGG
101 TGTGCGAAGT GCCGCTGACC GACATGATCC GTTATCCGCT GCTCTCCGCC
151 GGTTCAAGCT GGACAGACGA ATACGGCAAT CCGCAAAAAT ACGAAGTCTG
201 CAAACGCCGG TTGGGCGAAT TGTCGCCGTA TCACAATCTT TCAGACGGCA
251 TCGATTATCC GCCCGCGCTC ATTACCACCA GCCTGTCCGA CGATCGCGTC
301 CATCCCGCCC ACGCGCTCAA GTTCTACGCC AAACTGCGCG AAACCTCGCC
351 GCAATCTTGG CTCTACTCCC CTGACGGCGG CGGCCATACC GGCAACGGCA
401 CCCAACGCGA AGCCGCCGAC GAACTCGCCT GCGTCTTGCT GTTTTTGAAA
451 GAGTTTTTGG GCTAA
```

This corresponds to the amino acid sequence <SEQ ID 158; ORF 041.a>:

a041.pep

```
  1 ISSPEHIGLQ GGSNGGLITA AAFVREPQSI GALVCEVPLT DMIRYPLLSA
 51 GSSWTDEYGN PQKYEVCKRR LGELSPYHNL SDGIDYPPAL ITTSLSDDRV
101 HPAHALKFYA KLRETSPQSW LYSPDGGGHT GNGTQREAAD ELACVLLFLK
151 EFLG*
```

m041/a041 98.7% identity over a 154 aa overlap

```
                   10        20        30        40        50        60
m041.pep    ISSPEHIGLQGGSNGGLITAAAFVREPQSIGALVCEVPLTDMIRYPLLSAGSSWTDEYGN
            ||||||||||||||||||||||||||||||||||||||||||||||||||||||||||||
a041        ISSPEHIGLQGGSNGGLITAAAFVREPQSIGALVCEVPLTDMIRYPLLSAGSSWTDEYGN
                   10        20        30        40        50        60

                   70        80        90       100       110       120
m041.pep    PQKYEVCKRRLGELSPYHNLSDGIDYPPALITTSLSDDRVHPAHALKFYAKLRETSAQSW
            |||||||||||||||||||||||||||||||||||||||||||||||||||||||| |||
a041        PQKYEVCKRRLGELSPYHNLSDGIDYPPALITTSLSDDRVHPAHALKFYAKLRETSPQSW
                   70        80        90       100       110       120

                  130       140       150
m041.pep    LYSPDGGGHTGNGTQRESADELACVLLFLKEFLGX
            ||||||||||||||||:||||||||||||||||||
a041        LYSPDGGGHTGNGTQREAADELACVLLFLKEFLGX
                  130       140       150
```

Computer analysis of this amino acid sequence gave the following results:

Homology with a predicted ORF from *N. gonorrhoeae*

ORF 041 shows 96.8% identity over a 154 aa overlap with a predicted ORF (ORF 041.ng) from *N. gonorrhoeae*:

m041/g041

```
                   10        20        30        40        50        60
m041.pep    ISSPEHIGLQGGSNGGLITAAAFVREPQSIGALVCEVPLTDMIRYPLLSAGSSWTDEYGN
            :|||:|||||||||||||||||||||||||||||||||||||||||||||||||||||||
g041        MSSPKHIGLQGGSNGGLITAAAFVREPQSIGALVCEVPLTDMIRYPLLSAGSSWTDEYGN
                   10        20        30        40        50        60
```

-continued

```
                   70        80        90       100       110       120
m041.pep    PQKYEVCKRRLGELSPYHNLSDGIDYPPALITTSLSDDRVHPAHALKFYAKLRETSAQSW
            |||||:|||||||||||||||||||||||||||||||||||||||||||||||||| |||
g041        PQKYEACKRRLGELSPYHNLSDGIDYPPALITTSLSDDRVHPAHALKFYAKLRETSPQSW
                   70        80        90       100       110       120

                  130       140       150
m041.pep    LYSPDGGGHTGNGTQRESADELACVLLFLKEFLGX
            |||||||||||||||||||||:|||||||||||||
g041        LYSPDGGGHTGNGTQRESADKLACVLLFLKEFLGX
                  130       140       150
```

The following partial DNA sequence was identified in *N. gonorrhoeae* <SEQ ID 159>:

g041-1.seq

```
   1 ATGAAATCCT ACCCCGACCC CTACCGCCAT TTTGAAAACC TCGATTCCGC
  51 CGAAACGCAA AACTTCGCTG CTGAAGCGAA TGCCGAAACG CGCGCGCGTT
 101 TTTTAAACAA CGACAAGGCG CGCGCACTTT CAGACGGCAT TTTGAATCAA
 151 ATGCAGGACA CGCGGCAGAT TCCGTTTTGT CAGGAACACC GCGCGCGGAT
 201 GTACCATTTC CATCAGAATG CGGAATATCC GAAGGGCGTG TACCGCATGT
 251 GTACGGCGGC GACCTACCGT TCCGGCTATC CCGAGTGGAA AATCCTGTTT
 301 TCGGTGGCGG ATTTCGATGA GTTGCTCGGC GACGATGTGT ATTTGGGCGG
 351 CGTGTCGCAC TTGGTGGAGC AGCCCAACCG CGCGCTGCTG ACTTTGAACA
 401 AATCGGGCGG CGATACGGCG TATACGCTGG AAGTGGATTT GGAAGCAGGG
 451 GAATTGGTAG AGGGCGGTTT TCACTTTCCG GCAGGCAAAA ACCATGTGTC
 501 GTGGCGCGAT GAAAACAGCG TGTGGGTGTG TCCGGCTTGG GACGAACGCC
 551 AGTTGACCGA ATCGGGCTAT CCGCGCGAAG TGTGGCTGGT GGAACGCGGC
 601 AAGAGTTTCG AGGAAAGCCT GCCGGCGTAC CAAATCGATA AAGGCGCGAT
 651 GATGGTAAAC GCGTGGCGTT ACCTCGATCC GCAGGGTTCG CCGATTGATT
 701 TGATTGAAGC GTCGGACGGT TTTTACACCA AGACGTATTT GCAGGTGTCG
 751 TCCGAAGGCG GGGCGAAACC GTTGAACCTG CCTAATGATT GCGATGTGGT
 801 CGGCTATCTG GCGGGACATC TTTTGCTGAC GCTGCGCAAG GACTGGCACC
 851 GCGCGAACCA AAGCTATCCG AGTGGCGCGT TGGTGGCGGT GAAACTGAAT
 901 CGGGGCGAAC TCGGGGCGGC GCAGCTTTTG TTTGCGCCCG ATGAAACGCA
 951 GGCATTGGAA AGCGTGGAAA CGACCAAGCG TTTTGTGGTG GCAAGCCTGC
1001 TGGAGAATGT ACAAGGCCGT CTGAAAGCGT GGCGGTTTGC CGACAGCAAA
1051 TGGCAGGAAG CCGAGTTGCC GCACCTGCCC TCGGGCGCGT TGGAAATGAC
1101 CGACCAACCG TGGGGCGGCG ACGTGGTTTA TCTTGCCGCC ACCGATTTCA
1151 CCACGCCGCT GACGCTGTTT GCGCTGGATT TGAACGTGAT GGAACTGACC
1201 GTCATGCGCC TCCAGCCGCA GCAGTTTGTT TCAGACGGCA TCGAAGTGCG
1251 GCAGTTTTGG GCGGTGTCGT CCGACGGCGA ACGCATTCCT TATTTCCACG
1301 TCGGCAAAAA CGCCGCGCCC GACACGCCGA CCTTAGTCTA TGCTTACGGA
1351 GGTTTCGGCA TTCCTGAATT GCCGCATTAT CTGGGCAGCG TCGGCAAATA
1401 TTGGCTGGAA GAGGGCAATG CCTTTGTATT GGCAAACATC CGCGGCGGCG
1451 GAGAATTCGG CCCGCGCTGG CATCAGGCGG CGCAGGGAAT CAGCAAACAC
```

-continued

```
1501 AAAAGCGTTG ATGATTTGTT GGCAGTCGTG CGTGATTTGT CCGAACGCGG

1551 CATGAGTTCG CCCAAACACA TCGGCTTGCA GGGCGGCAGC AACGGCGGCC

1601 TGATTACCGC CGCCGCCTTC GTGCGCGAAC CGCAAAGCAT CGGTGCGCTG

1651 GTGTGCGAAG TACCGCTGAC CGATATGATC CGTTATCCGC TGCTGTCCGC

1701 CGGTTCAAGT TGGACGGACG AATACGGCAA TCCGCAGAAA TACGAAGCCT

1751 GCAAACGCCG GCTGGGCGAA TTGTCGCCGT ATCACAATCT TTCAGACGGC

1801 ATCGATTATC CGCCCGCACT CATTACCACC AGCCTCAGCG ACGACCGCGT

1851 CCATCCCGCC CACGCGCTCA AATTCTACGC CAAACTGCGC GAAACCTCGC

1901 CGCAATCTTG GCTCTACTCG CCTGACGGCG GCGGCCATAC CGGCAACGGC

1951 ACCCAACGCG AATCCGCCGA CAAACTCGCC TGCGTGTTGC TGTTTTTGAA

2001 AGAATTTTTG GGATAA
```

This corresponds to the amino acid sequence <SEQ ID 160; ORF 041-1.ng>:

g041-1.pep

```
  1 MKSYPDPYRH FENLDSAETQ NFAAEANAET RARFLNNDKA RALSDGILNQ

 51 MQDTRQIPFC QEHRARMYHF HQNAEYPKGV YRMCTAATYR SGYPEWKILF

101 SVADFDELLG DDVYLGGVSH LVEQPNRALL TLNKSGGDTA YTLEVDLEAG

151 ELVEGGFHFP AGKNHVSWRD ENSVWVCPAW DERQLTESGY PREVWLVERG

201 KSFEESLPAY QIDKGAMMVN AWRYLDPQGS PIDLIEASDG FYTKTYLQVS

251 SEGGAKPLNL PNDCDVVGYL AGHLLLTLRK DWHRANQSYP SGALVAVKLN

301 RGELGAAQLL FAPDETQALE SVETTKRFVV ASLLENVQGR LKAWRFADSK

351 WQEAELPHLP SGALEMTDQP WGGDVVYLAA SDFTTPLTLF ALDLNVMELT

401 VMRLQPQQFV SDGIEVRQFW AVSSDGERIP YFHVGKNAAP DTPTLVYAYG

451 GFGIPELPHY LGSVGKYWLE EGNAFVLANI RGGGEFGPRW HQAAQGISKH

501 KSVDDLLAVV RDLSERGMSS PKHIGLQGGS NGGLITAAAF VREPQSIGAL

551 VCEVPLTDMI RYPLLSAGSS WTDEYGNPQK YEACKRRLGE LSPYHNLSDG

601 IDYPPALITT SLSDDRVHPA HALKFYAKLR ETSPQSWLYS PDGGGHTGNG

651 TQRESADKLA CVLLFLKEFL G*
```

The following partial DNA sequence was identified in *N. meningitidis* <SEQ ID 161>:

m041-1.seq

```
  1 ATGAAATCCT ACCCCGACCC CTACCGCCAT TTTGAAAACC TCGATTCCGC

 51 CGAAACGCAA AACTTCGCTG CTGAAGCGAA TGCCGAAACG CGCGCGCGTT

101 TTTTAGAAAA CGACAAGGCG CGCGCGCTTT CAGACGGCAT TTTGGCGCAG

151 TTGCAGGACA CGCGGCAGAT TCCGTTTTGT CAGGAACACC GCGCGCGGAT

201 GTACCATTTC CATCAGGACG CGGAGTATCC GAAGGGCGTG TACCGCGTGT

251 GTACCGCGGC GACGTATCGT TCCGGCTATC CCGAGTGGAA AATCCTGTTT

301 TCGGTGGCGG ATTTCGACGA ATTGCTTGGC GACGATGTGT ATTTGGGCGG
```

-continued

```
 351 CGTGTCGCAC TTGGTGGAAC AGCCCAACCG CGCGTTGTTA ACACTGAGCA
 401 AATTGGGCAG CGATACGGCG TACACGCTGG AAGTGGATTT GGAAGCAGGG
 451 GAGTTGGTCG AAGGCGGTTT TCACTTTCCG GCAGGCAAAA ACCATGTGTC
 501 GTGGCGCGAT GAAAACAGCG TGTGGGTGTG TCCGGCTTGG AACGAACGCC
 551 AGTTGACCCA ATCGGGCTAT CCGCGCGAAG TATGGCTGGT GGAACGCGGC
 601 AAGAGTTTCG AGGAAAGCCT GCCTGTGTAT CAAATCGGCG AAGACGGCAT
 651 GATGGTGAAC GCGTGGCGTT ATCTCGATCC GCAGGGTTCG CCGATTGATT
 701 TGATTGAAGC GTCGGACGGT TTTTACACCA AAACCTATTT GCGGGTCTCA
 751 GCCGAAGGCG AGGCGAAACC GTTAAACCTG CCCAACGATT GCGACGTGGT
 801 CGGCTATCTG GCGGGGCATC TTTTGCTGAC GCTGCGCAAG GACTGGAACC
 851 GCGCGAACCA AAGCTATCCG AGCGGCGCGC TGGTGGCGGT GAAGCTGAAT
 901 CGGGGCGAAC TCGGGGCGGC GCAGCTTTTG TTTGCGCCCG ATGAAACGCA
 951 GGCATTGGAA AGCGTGGAAA CGACCAAGCG TTTTGTGGTG GCGAGCCTGT
1001 TGGAGAACGT ACAAGGCCGT CTGAAAGCAT GGCGGTTTGC CGACGGCAAA
1051 TGGCAGGAAG TCGAATTGCC GCGCCTGCCT TCGGGCGCGT TGGAAATGAC
1101 CGACCAACCT TGGGGCGGCG ACGTGGTTTA CCTTGCCGCC AGCGATTTCA
1151 CCACGCCGCT GACGCTGTTT GCGCTGGATT TGAACGTGAT GGAACTGACC
1201 GTCATGCGCC GCCAGCCGCA GCAGTTTGAT TCAGACGGCA TTAACGTGCA
1251 GCAGTTTTGG ACGACTTCGG CTGACGGCGA GCGCATTCCT TATTTCCACG
1301 TCGGCAAAAA CGCCGCGCCC GACATGCCGA CGCTGGTCTA TGCCTACGGC
1351 GGTTTCGGCA TTCCCGAATT GCCGCATTAT CTGGGCAGCA TTGGCAAATA
1401 TTGGCTGGAA GAGGGCAATG CCTTTGTATT GGCGAACATC CGCGGCGGCG
1451 GCGAGTTCGG CCCGCGCTGG CATCAGGCGG CGCAGGGAAT CAGCAAACAT
1501 AAAAGCGTTG ATGATTTATT GGCAGTCGTG CGCGATTTGT CCGAACGCGG
1551 TATCAGTTCG CCCGAACACA TCGGCTTGCA GGGCGGCAGC AACGGCGGAC
1601 TGATTACTGC CGCCGCCTTC GTGCGCGAAC CGCAAAGCAT CGGCGCGCTG
1651 GTGTGCGAAG TGCCGCTGAC CGACATGATC CGTTATCCGC TGCTCTCCGC
1701 CGGTTCAAGC TGGACAGACG AATACGGCAA TCCGCAAAAA TACGAAGTCT
1751 GCAAACGCCG GTTGGGCGAA TTGTCGCCGT ATCACAATCT TTCAGACGGC
1801 ATCGATTATC CGCCCGCGCT CATTACCACC AGCCTGTCCG ACGATCGCGT
1851 CCATCCCGCC CACGCGCTCA AGTTCTACGC CAAACTGCGC GAAACCTCCG
1901 CGCAATCTTG GCTCTACTCG CCTGACGGCG GCGGCCATAC CGGCAACGGC
1951 ACCCAACGCG AATCCGCCGA CGAACTCGCC TGCGTCTTGC TGTTTTTGAA
2001 AGAGTTTTTG GGCTAA
```

This corresponds to the amino acid sequence <SEQ ID 162; ORF 041-1>:

m041-1.pep

```
   1 MKSYPDPYRH FENLDSAETQ NFAAEANAET RARFLENDKA RALSDGILAQ
```

-continued

```
 51 LQDTRQIPFC QEHRARMYHF HQDAEYPKGV YRVCTAATYR SGYPEWKILF

101 SVADFDELLG DDVYLGGVSH LVEQPNRALL TLSKLGSDTA YTLEVDLEAG

151 ELVEGGFHFP AGKNHVSWRD ENSVWVCPAW NERQLTQSGY PREVWLVERG

201 KSFEESLPVY QIGEDGMMVN AWRYLDPQGS PIDLIEASDG FYTKTYLRVS

251 AEGEAKPLNL PNDCDVVGYL AGHLLLTLRK DWNRANQSYP SGALVAVKLN

301 RGELGAAQLL FAPDETQALE SVETTKRFVV ASLLENVQGR LKAWRFADGK

351 WQEVELPRLP SGALEMTDQP WGGDVVYLAA SDFTTPLTLF ALDLNVMELT

401 VMRRQPQQFD SDGINVQQFW TTSADGERIP YFHVGKNAAP DMPTLVYAYG

451 GFGIPELPHY LGSIGKYWLE EGNAFVLANI RGGGEFGPRW HQAAQGISKH

501 KSVDDLLAVV RDLSERGISS PEHIGLQGGS NGGLITAAAF VREPQSIGAL

551 VCEVPLTDMI RYPLLSAGSS WTDEYGNPQK YEVCKRRLGE LSPYHNLSDG

601 IDYPPALITT SLSDDRVHPA HALKFYAKLR ETSAQSWLYS PDGGGHTGNG

651 TQRESADELA CVLLFLKEFL G*
```

m041-1/g041-1 94.6% identity in 671 aa overlap

```
                    10        20        30        40        50        60
m041-1.pep  MKSYPDPYRHFENLDSAETQNFAAEANAETRARFLENDKARALSDGILAQLQDTRQIPFC
            |||||||||||||||||||||||||||||||||||:|||||||||||| |:||||||||
g041-1      MKSYPDPYRHFENLDSAETQNFAAEANAETRARFLNNDKARALSDGILNQMQDTRQIPFC
                    10        20        30        40        50        60

                    70        80        90       100       110       120
m041-1.pep  QEHRARMYHFHQDAEYPKGVYRVCTAATYRSGYPEWKILFSVADFDELLGDDVYLGGVSH
            ||||||||||||:|||||||||:|||||||||||||||||||||||||||||||||||||
g041-1      QEGRARMYHFHQNAEYPKGVYRMCTAATYRSGYPEWKILFSVADFDELLGDDVYLGGVSH
                    70        80        90       100       110       120

                   130       140       150       160       170       180
m041-1.pep  LVEQPNRALLTLSKLGSDTAYTLEVDLEAGELVEGGFHFPAGKNHVSWRDENSVWVCPAW
            ||||||||||||:| |:|||||||||||||||||||||||||||||||||||||||||||
g041-1      LVEQPNRALLTLNKSGGDTAYTLEVDLEAGELVEGGFHFPAGKNHVSWRDENSVWVCPAW
                   130       140       150       160       170       180

                   190       200       210       220       230       240
m041-1.pep  NERQLTQSGYPREVWLVERGKSFEESLPVYQIGEDGMMVNAWRYLDPQGSPIDLIEASDG
            :|||||:|||||||||||||||||||||:||| : :||||||||||||||||||||||||
g041-1      DERQLTESGYPREVWLVERGKSFEESLPAYQIDKGAMMVNAWRYLDPQGSPIDLIEASDG
                   190       200       210       220       230       240

                   250       260       270       280       290       300
m041-1.pep  FYTKTYLRVSAEGEAKPLNLPNDCDVVGYLAGHLLLTLRKDWNRANQSYPSGALVAVKLN
            |||||||:||:|| ||||||||||||||||||||||||||||:|||||||||||||||||
g041-1      FYTKTYLQVSSEGGAKPLNLPNDCDVVGYLAGHLLLTLRKDWHRANQSYPSGALVAVKLN
                   250       260       270       280       290       300

                   310       320       330       340       350       360
m041-1.pep  RGELGAAQLLFAPDETQALESVETTKRFVVASLLENVQGRLKAWRFADGKWQEVELPRLP
            ||||||||||||||||||||||||||||||||||||||||||||||||:||||:|||:||
g041-1      RGELGAAQLLFAPDETQALESVETTKRFVVASLLENVQGRLKAWRFADSKWQEAELPHLP
                   310       320       330       340       350       360

                   370       380       390       400       410       420
m041-1.pep  SGALEMTDQPWGGDVVYLAASDFTTPLTLFALDLNVMELTVMRRQPQQFDSDGINVQQFW
            |||||||||||||||||||||||||||||||||||||||||| |||||| ||||:|:|||
g041-1      SGALEMTDQPWGGDVVYLAASDFTTPLTLFALDLNVMELTVMRLQPQQFVSDGIEVRQFW
                   370       380       390       400       410       420

                   430       440       450       460       470       480
m041-1.pep  TTSADGERIPYFHVGKNAAPDMPTLVYAYGGFGIPELPHYLGSIGKYWLEEGNAFVLANI
            ::|:||||||||||||||||| |||||||||||||||||||||:||||||||||||||||
g041-1      AVSSDGERIPYFHVGKNAAPDTPTLVYAYGGFGIPELPHYLGSVGKYWLEEGNAFVLANI
                   430       440       450       460       470       480

                   490       500       510       520       530       540
m041-1.pep  RGGGEFGPRWHQAAQGISKHKSVDDLLAVVRDLSERGISSPEHIGLQGGSNGGLITAAAF
            |||||||||||||||||||||||||||||||||||||:|||:||||||||||||||||||
g041-1      RGGGEFGPRWHQAAQGISKHKSVDDLLAVVRDLSERGMSSPKHIGLQGGSNGGLITAAAF
                   490       500       510       520       530       540

                   550       560       570       580       590       600
m041-1.pep  VREPQSIGALVCEVPLTDMIRYPLLSAGSSWTDEYGNPQKYEVCKRRLGELSPYHNLSDG
            ||||||||||||||||||||||||||||||||||||||||||:|||||||||||||||||
g041-1      VREPQSIGALVCEVPLTDMIRYPLLSAGSSWTDEYGNPQKYEACKRRLGELSPYGNLSDG
                   550       560       570       580       590       600
```

-continued

```
                    610       620       630       640       650       660
m041-1.pep   IDYPPALITTSLSDDRVHPAHALKFYAKLRETSAQSWLYSPDGGGHTGNGTQRESADELA
             |||||||||||||||||||||||||||||||||| ||||||||||||||||||||||||:||
g041-1       IDYPPALITTSLSDDRVHPAHALKFYAKLRETSPQSWLYSPDGGGHTGNGTQRESADKLA
                    610       620       630       640       650       660

                    670
m041-1.pep   CVLLFLKEFLGX
             ||||||||||||
g041-1       CVLLFLKEFLGX
                    670
```

m041-1/P55577 sp|P55577|Y4NA_RHISN PROBABLE PEPTIDASE Y4NA >gi|2182536 (AE000086) Y4nA [*Rhizobium* sp. NGR234] Length=726

Score=370 bits (940), Expect=e-101

Identities=217/682 (31%), Positives=331/682 (47%), Gaps=22/682 (3%)

```
Query: 2    KSYPDPYRHFENLDSAETQNFAAEANAETRARFLENDKARALSDGILAQLQQTRQIPFCQ   61
             K   DP  +    +D  +    +     N  T  +   ++ +          L  LQ T +I
Sbjct: 42   KDASDPRAYLNEIDGDKAMTWVEAHNLSTVDKLSKDPRYSEYQADALTILQATDRIASPS   101

Query: 62   EHRARMY-HFHQDAEYPKGVYRVCTAATYRSGYPEWKILFSVADFDELLGDDVYLGGVSH   120
               R  M   +F QD  + +G++R  T   +YRSG P+W+ +  V     + G      G
Sbjct: 102  FARDGMIDNFWQDGTHVQGLWRRTTWESYRSGNPQWRTILDVDALSKAEGKTWVFEGGDC   161

Query: 121  LVEQPNRALLTLSKLGSDTAYTLEVDLEAGELVEGGFHFPAGKNHVSWRDENSVWVCPAW   180
             L     N  L+ LS  G D       E D+   GE V+ GF   P GK  V+W DEN+++V    W
Sbjct: 162  LPPTSNLCLIRLSDGGKDADVVREFDIAKGEFVKEGFVLPEGKQSVTWVDENTIYVTREW   221

Query: 181  NERQLTQSGYPREVWLVERGKSFEESLQVYQ------IGEDGMM--VNAWRYLDPQGSPI   232
               ++T SGY      +V+RG+S ++++ +++         E G++   ++     +D    +
Sbjct: 222  TPGEVTSSGYAYVTKVVKRGQSLDQAVEIFRGQKKDVSAERGVLRDIDGKYVMDTSYRGL   281

Query: 233  DLIEASDGFYTKTYLRVSAEGEAKPLNLPNDCDVVGYLAGHLLLTLRKDWNRANQS-YPS   291
             D          FY    +     +    L LP         GY  G   +  L+ DW   A  + + +
Sbjct: 282  DFFNTELAFYPNGH----PDTRKVVLPLPTTAVFSGYYKGQAIYWLKSDWTSAKGTVFHN   337

Query: 292  GALVAVKLNRGELGAAQL----LFAPDETQALESVETTKRFVVASLLENVQGRLKAWRFA   347
             GA++A   L         A++     LF P+E Q++       TK  +V S+L NV    ++++ F
Sbjct: 338  GAIIAFDLKAALADPARVEPLVLFMPNEHQSVAGTTQTKNRLVLSILSNVTSEVRSFDFG   397

Query: 348  DGKWQEVELPRLPSGALEMTDQPWGGDVVYLAASDFTTPLTLFALDLNVMELTVMRRQPQ   407
               G W   +L      +  L +T        D +++ +   F  P TLF  D     ++   +    P
Sbjct: 398  KGGWSSFKLALPENSTLSLTSSDDESDQLFVFSEGFLEPSTLFCADAATGQVEKITSTPA   457

Query: 408  QFDSDGINVQQFWTTSADGERIPYFHVGKNAAP---DMPTLVYAYGGFGIPELPHYLGSI   464
             +FD+ G+  QQFW TS DG ++PYF V +           PT++YAYGGF IP  P Y   +
Sbjct: 458  RFDAGGLQAQQFWATSKDGTKVPYFLVARKDVKLDGTNPTILYAYGGFQIPMQPSYSAVL   517

Query: 465  GKYWLEEGNAFVLANIRFFFEFGPRWHQAAQGISKHKSVDDLLAVVRDLSERGISSPEHI   524
             GK WLE+G A+ LANIRGGGEFGP+WH A     ++ +  DD  AV +DL  + ++S  H+
Sbjct: 518  GKLWLEKGGAYALANIRGGGEFGPKWHDAGLKTNRQRVYDDFQAVAQDLIAKKVTSTPHL   577

Query: 525  GLQGGSNGGLITAAAFVREPQSIGALVCEVPLTDMIRYPLLSAGSSWTDEYGNPQKYEVC   584
             G+ GGSNGGL+       ++ P     A+V +VPL DM+ +   +SAG+SW  EYG+P      V
Sbjct: 578  GIMGGSNGGLLMGVQMIQRPDLWNAVVIQVPLLDMVNFTRMSAGASWQAEYGSPDD-PVE   636

Query: 585  KRRLGELSPYHNLSDGIDYPPALITTSLSDDRVHPAHALKFYAKLRETSAQSWLYSPDGG   644
                L  +SPYHN+  G+ YP       TS  DDRV P HA K  A     +       + Y    G
Sbjct: 637  GAFLRSISPYGNVKAGVAYPEPFFETSTKDDRVGPVHARKMAALFEDMGLPFYYYENIEG   696

Query: 645  GHTGNGTQRESADELACVLLFL                                         666
             GH         +E A     A    +++
Sbjct: 697  GHAAAANLQEHARRYALEYIYM                                         718
```

The following partial DNA sequence was identified in *N. meningitidis* <SEQ ID 163>:

a041-1.seq

```
  1 ATGAAATCCT ACCCCGACCC CTACCGCCAT TTTGAAAACC TCGATTCCGC

 51 CGAAACGCAA AACTTCGCTG CTGAAGCGAA TGCCGAAACG CGCGCGCGTT

101 TTTTAAACAA CGACAAGGCA CGCGCATTGT CTGACGGCAT TTTGGCGCAG

151 TTGCAGGACA CGCGGCAAAT TCCGTTTTGT CAGGAACACC GCGCGCGGAT
```

-continued

```
 201 GTACCATTTC CATCAAGATG CGGAATATCC GAAAGGCGTG TACCGCGTGT
 251 GTACCGCGGC GACTTACCGT TCGGGCTATC CTGAGTGGAA AATCCTGTTT
 301 TCGGTGGCGG ATTTCGACGA ATTGCTCGGT GACGATGTAT ATCTAGGCGG
 351 CGTGTCGCAC CTGGTGGAAC AGCCCAACCG CGCGTTGTTA ACACTGAGCA
 401 AATCGGGCGG CGATACCGCG TACACGCTGG AAGTGGATTT GGAAGCAGGG
 451 GAGTTGGTAG AAGGCGGTTT TCACTTTCCG GCAGGCAAAA ACCATGTGTC
 501 GTGGCGCGAT GAAAACAGCG TGTGGGTGTG TCCGGCTTGG GACGAACGCC
 551 AGTTGACCGA ATCGGGCTAT CCGCGCGAGG TGTGGCTGGT GGAACGCGGC
 601 AAGAGTTTCG AGGAAAGCCT GCCGGTGTAC CAAATTGCTG AAGACGGCAT
 651 GATGGTGAAC GCGTGGCGTT ACCTCGATCC GCAGGGTTCG CCGATTGATT
 701 TGATTGAAGC GTCTGACGGT TTTTACACCA AAACCTATTT GCAGGTCTCA
 751 GCCGAAGGCG AAGCGAAACC GTTAAACCTG CCCAACGATT GCGACGTAGT
 801 CGGCTATCTG GCCGGACATC TTTTGCTGAC CTTGCGTAAA GACTGGCACC
 851 GCGCGAACCA AAGCTATCCG AGTGGCGCAT TGGTAGCAGT AAAATTAAAC
 901 CGCGGCGAAT TGGGCGCGGC GCAGCTTTTG TTTGCGCCCA ATGAAACGCA
 951 GGCATTGGAA AGCGTGGAAA CGACCAAGCG TTTTGTCGTG GCGAGCCTGC
1001 TGGAAAACGT ACAGGGTCGT CTGAAAGCGT GGCGTTTTAC TGATGGCAAA
1051 TGGCAGGAAA CCGAGTTGCC GCGCCTGCCT TCGGGCGCGT TGGAAATGAC
1101 CGACCAACCG TGGGGGGGCG ACGTAGTTTA CCTTGCCGCC AGCGATTTCA
1151 CCACGCCGCT GACGCTGTTT GCATTGGATT TGAACGTGAT GGAACTGACC
1201 GTCATGCGCC GCCAGCCGCA GCAGTTTGAT TCAGACGGCA TTAACGTGCA
1251 GCAGTTTTGG ACGACTTCGG CTGACGGCGA GCGCATTCCT TATTTCCACG
1301 TCGGCAAAAA CGCCGCGCCC GACATGCCGA CGCTGGTCTA TGCCTACGGC
1351 GGTTTCGGCA TTCCCGAATT GCCGCATTAT CTGGGCAGCA TTGGCAAATA
1401 TTGGCTGGAA GAGGGCAATG CCTTTGTATT GGCGAACATC CGCGGCGGCG
1451 GCGAGTTCGG CCCGCGCTGG CATCAGGCGG CGCAGGGAAT CAGCAAACAT
1501 AAAAGCGTTG ATGATTTATT GGCAGTCGTG AGCGATTTGT CCGAACGCGG
1551 TATCAGTTCG CCCGAACACA TCGGCTTGCA GGGCGGCAGC AACGGCGGAC
1601 TGATTACTGC CGCCGCCTTC GTGCGCGAAC CGCAAAGCAT AGGCGCGCTG
1651 GTGTGCGAAG TGCCGCTGAC CGACATGATC CGTTATCCGC TGCTCTCCGC
1701 CGGTTCAAGC TGGACAGACG AATACGGCAA TCCGCAAAAA TACGAAGTCT
1751 GCAAACGCCG GTTGGGCGAA TTGTCGCCGT ATCACAATCT TTCAGACGGC
1801 ATCGATTATC CGCCCGCGCT CATTACCACC AGCCTGTCCG ACGATCGCGT
1851 CCATCCCGCC CACGCGCTCA AGTTCTACGC CAAACTGCGC GAAACCTCGC
1901 CGCAATCTTG GCTCTACTCG CCTGACGGCG GCGGCCATAC CGGCAACGGC
1951 ACGCAGCGCG AAGCCGCCGA CGAACTCGCC TGCGTGTTGC TGTTTTTGAA
2001 AGAGTTTTTG GGCTAA
```

This corresponds to the amino acid sequence <SEQ ID 164; ORF 041-1.a>:

a041-1.pep

```
  1 MKSYPDPYRH FENLDSAETQ NFAAEANAET RARFLNNDKA RALSDGILAQ
 51 LQDTRQIPFC QEHRARMYHF HQDAEYPKGV YRVCTAATYR SGYPEWKILF
101 SVADFDELLG DDVYLGGVSH LVEQPNRALL TLSKSGGDTA YTLEVDLEAG
151 ELVEGGFHFP AGKNHVSWRD ENSVWVCPAW DERQLTESGY PREVWLVERG
201 KSFEESLPVY QIAEDGMMVN AWRYLDPQGS PIDLIEASDG FYTKTYLQVS
251 AEGEAKPLNL PNDCDVVGYL AGHLLLTLRK DWHRANQSYP SGALVAVKLN
301 RGELGAAQLL FAPNETQALE SVETTKRFVV ASLLENVQGR LKAWRFTDGK
351 WQETELPRLP SGALEMTDQP WGGDVVYLAA SDFTTPLTLF ALDLNVMELT
401 VMRRQPQQFD SDGINVQQFW TTSADGERIP YFHVGKNAAP DMPTLVYAYG
451 GFGIPELPHY LGSIGKYWLE EGNAFVLANI RGGGEFGPRW HQAAQGISKH
501 KSVDDLLAVV SDLSERGISS PEHIGLQGGS NGGLITAAAF VREPQSIGAL
551 VCEVPLTDMI RYPLLSAGSS WTDEYGNPQK YEVCKRRLGE LSPYHNLSDG
601 IDYPPALITT SLSDDRVHPA HALKFYAKLR ETSPQSWLYS PDGGGHTGNG
651 TQREAADELA CVLLFLKEFL G*
```

a041-1/m041-1 97.9% identity in 671 aa overlap

```
                      10        20        30        40        50        60
a041-1.PEP    MKSYPDPYRHFENLDSAETQNFAAEANAETRARFLNNDKARALSDGILAQLQDTRQIPFC
              |||||||||||||||||||||||||||||||||||:||||||||||||||||||||||||
a041-1        MKSYPDPYRHFENLDSAETQNFAAEANAETRARFLENDKARALSDGILAQLQDTRQIPFC
                      10        20        30        40        50        60

                      70        80        90       100       110       120
a041-1.pep    QEHRARMYHFHQDAEYPKGVYRVCTAATYRSGYPEWKILFSVADFDELLGDDVYLGGVSH
              ||||||||||||||||||||||||||||||||||||||||||||||||||||||||||||
m041-1        QEGRARMYHFHQNAEYPKGVYRMCTAATYRSGYPEWKILFSVADFDELLGDDVYLGGVSH
                      70        80        90       100       110       120

                     130       140       150       160       170       180
a041-1.pep    LVEQPNRALLTLSKSGGDTAYTLEVDLEAGELVEGGFHFPAGKNHVSWRDENSVWVCPAW
              |||||||||||||| |:|||||||||||||||||||||||||||||||||||||||||||
m041-1        LVEQPNRALLTLSKLGSDTAYTLEVDLEAGELVEGGFHFPAGKNHVSWRDENSVWVCPAW
                     130       140       150       160       170       180

                     190       200       210       220       230       240
a041-1.pep    DERQLTESGYPREVWLVERGKSFEESLPVYQIAEDGMMVNAWRYLDPQGSPIDLIEASDG
              :|||||:||||||||||||||||||||||||:||||||||||||||||||||||||||||
m041-1        NERQLTQSGYPREVWLVERGKSFEESLPVYQIGEDGMMVNAWRYLDPQGSPIDLIEASDG
                     190       200       210       220       230       240

                     250       260       270       280       290       300
a041-1.pep    FYTKTYLQVSAEGEAKPLNLPNDCDVVGYLAGHLLLTLRKDWHRANQSYPSGALVAVKLN
              |||||||:||||| ||||||||||||||||||||||||||||:|||||||||||||||||
m041-1        FYTKTYLRVSAEGEAKPLNLPNDCDVVGYLAGHLLLTLRKDWNRANQSYPSGALVAVKLN
                     250       260       270       280       290       300

                     310       320       330       340       350       360
a041-1.pep    RGELGAAQLLFAPNETQALESVETTKRFVVASLLENVQGRLKAWRFTDGKWQETELPRLP
              |||||||||||||:||||||||||||||||||||||||||||||||:||||||:||||||
m041-1        RGELGAAQLLFAPDETQALESVETTKRFVVASLLENVQGRLKAWRFADGKWQEVELPRLP
                     310       320       330       340       350       360

                     370       380       390       400       410       420
a041-1.pep    SGALEMTDQPWGGDVVYLAASDFTTPLTLFALDLNVMELTVMRRQPQQFDSDGINVQQFW
              ||||||||||||||||||||||||||||||||||||||||||||||||||||||||||||
m041-1        SGALEMTDQPWGGDVVYLAASDFTTPLTLFALDLNVMELTVMRRQPQQFDSDGINVQQFW
                     370       380       390       400       410       420

                     430       440       450       460       470       480
a041-1.pep    TTSADGERIPYFHVGKNAAPDMPTLVYAYGGFGIPELPHYLGSIGKYWLEEGNAFVLANI
              ||||||||||||||||||||||||||||||||||||||||||||||||||||||||||||
m041-1        TTSADGERIPYFHVGKNAAPDMPTLVYAYGGFGIPELPHYLGSIGKYWLEEGNAFVLANI
                     430       440       450       460       470       480

                     490       500       510       520       530       540
a041-1.pep    RGGGEFGPRWHQAAQGISKHKSVDDLLAVVSDLSERGISSPEHIGLQGGSNGGLITAAAF
              |||||||||||||||||||||||||||||||||||||:|||:||||||||||||||||||
m041-1        RGGGEFGPRWHQAAQGISKHKSVDDLLAVVRDLSERGISSPEHIGLQGGSNGGLITAAAF
                     490       500       510       520       530       540
```

-continued

```
                550        560        570        580        590        600
a041-1.pep  VREPQSIGALVCEVPLTDMIRYPLLSAGSSWTDEYGNPQKYEVCKRRLGELSPYHNLSDG
            ||||||||||||||||||||||||||||||||||||||||||||||||||||||||||||
m041-1      VREPQSIGALVCEVPLTDMIRYPLLSAGSSWTDEYGNPQKYEVCKRRLGELSPYHNLSDG
                550        560        570        580        590        600

                610        620        630        640        650        660
a041-1.pep  IDYPPALITTSLSDDRVHPAHALKFYAKLRETSPQSWLYSPDGGGHTGNGTQREAADELA
            |||||||||||||||||||||||||||||||| ||||||||||||||||||||| |||||
m041-1      IDYPPALITTSLSDDRVHPAHALKFYAKLRETSAQSWLYSPDGGGHTGNGTQRESADELA
                610        620        630        640        650        660

                670
a041-1.pep  CVLLFLKEFLGX
            ||||||||||||
m041-1      CVLLFLKEFLGX
                670
```

The following partial DNA sequence was identified in *N. gonorrhoeae* <SEQ ID 165>:

g042.seq

```
  1 ATGACGATGA TTTGCTTGCG CTTCCAagcG TTCGTGCCGC ATACCAGCGC

 51 GTTATCCAAC ACTTCCACGG CAGCCGGCCC TTCCTGCCCG ATGGCGGCGG

101 TGCGGTCGAT GATGAAAATC CAGCCGGGGT TTTTCTCTTT GATGTATTCG

151 AAGGAAACGG GCTGCCCGTG CCCTTCGTTG CGTAAAGATT CGTCCACGGG

201 CGGCAGGCCG ATGTCGCCGT GTATCCAACT TGCCAACCGC GATTGCGTGC

251 CGAAGGCGGA CACCTTGTTG CCTGTAACCG ACAGCACCAG CCCGCGTCCT

301 TTGCCTTTGG cggCTTCGCG CTTTTGGGCG AACAGCGCGT CAATCTGCGC

351 ATTCAATTCC GCCACGCGCG CTTCCTTACC GAAAATCCGC GACAGGGTCT

401 CCATCTGCTT CTCGCCGCTG GTGCGGATAT TGCCGTTGTC CACCGTCAAA

451 TCTATGgtgG TCGCGTTTTT CGCCAACTGT TCATACGCTT CCGCACCCGG

501 CCCGCCGGTA ATGACAAACT GCGGATTGTG GCGGTGCAGG GATTCGCAAT

551 CGGGCTCAAA CAGCGTCCCC ACCGTTGCCG CCTTGTCAAA TGCAGGCTGC

601 AAATAG
```

This corresponds to the amino acid sequence <SEQ ID 166; ORF 042.ng>:

g042.pep

```
  1 MTMICLRFQA FVPHTSALSN TSTAAGPSCP MAAVRSMMKI QPGFFSLMYS

 51 KETGCPCPSL RKDSSTGGRP MSPCIQLANR DCVPKADTLL PVTDSTSPRP

101 LPLAASRFWA NSASICAFNS ATRASLPKIR DRVSICFSPL VRILPLSTVK

151 SMVVAFFANC SYASAPGPPV MTNCGLWRCR DSQSGSNSVP TVAALSNAGC

201 K*
```

The following partial DNA sequence was identified in *N. meningitidis* <SEQ ID 167>:

m042.seq

```
  1 ATGACGATGA TTTGCTTGCG CTTCCAAGCG TTCGTGCCGC GTACCAGCGC
```

-continued

```
 51 GTTATCCAmT ACTTCGACAG CCGcCGGCCy TTCyTGCCCG ATGGCGGCGG
101 TACGGTCGAT GATGAAAATC CAATCGGGGT TTTTCTCTTT GATGTATTCG
151 AAGGAAACAG GCTGCCCGTG CCCCTCGTTG CGTAAAGATT CGTCTACAGG
201 CGGTAGGCCG ATGTCGCCGT GTATCCAACT TGCCAACCGC GACTGCGTGC
251 CGAAGGCGGA CACCTTGTTG CCCGTAACCG ACAGCACCAG CCCGCGTCCT
301 TTGCCTTTGG CGGCTTCGCG CGTTTGGGCG AACAGCGCGT CAATCTGCGC
351 CTTCAATTCC GCCGCGCGCG CTTCCTTGCC GAAAATCCGC GCCAAGGTCT
401 CCATCTGCTT TTCGCCGCTG GTGCGGATAT TGCCGTTGTC CACCGTCAGA
451 TCTATGGTGG TCGCGTTTTT CGCTAACTGT TCATACGCTT CCGCGCCCGG
501 CCCGCCGGTA ATGACAAGCT GAGGATTGTA GCGGTGCAGG GCTTCGTAAT
551 CGGGCTCGAA CAGCGTCCCC ACCGTTGCCG CCTTGTCAAA TGCAGGCTGC
601 AAATAA
```

This corresponds to the amino acid sequence <SEQ ID 168; ORF 042>:

m042.pep

```
  1 MTMICLRFQA FVPRTSALSX TSTAAGXSCP MAAVRSMMKI QSGFFSLMYS
 51 KETGCPCPSL RKDSSTGGRP MSPCIQLANR DCVPKADTLL PVTDSTSPRP
101 LPLAASRVWA NSASICAFNS AARASLPKIR AKVSICFSPL VRILPLSTVR
151 SMVVAFFANC SYASAPGPPV MTSXGLXRCR ASXSGSNSVP TVAALSNAGC
201 K*
```

The following partial DNA sequence was identified in *N. meningitidis* <SEQ ID 169>:

a042.seq

```
  1 ATGACGATGA TTTGCTTGCG CTTCCAAGCG TTCGTGCCGC GTACCAGCGC
 51 GTTATCCAAT ACTTCGACAG CCGCCGGCCC TTCCTGCCCG ATGGCGGCGG
101 TACGGTCGAT GATGAAAATC CAATCGGGGT TTTTCTCTTT GATGTATTCG
151 AAGGAAACAG GCTGCCCGTG CCCCTCGTTG CGTAAAGATT CGTCTACAGG
201 CGGTAGGCCG ATGTCGCCGT GTATCCAACT TGCCAACCGC GACTGCGTGC
251 CGAAGGCGGA CACCTTGTTG CCCGTAACCG ACAGCACCAG CCCGCGTCCT
301 TTGCCTTTGG CGGCTTCGCG CGTTTGGGCG AACAGCGCGT CAATCTGCGC
351 CTTCAATTCC GCCGCGCGCG CTTCCTTGCC GAAAATCCGC GCCAAGGTCT
401 CCATCTGCTT TTCGCCGCTG GTGCGGATAT TGCCGTTGTC CACCGTCAGA
451 TCTATGGTGG TCGCGTTTTT CGCCAACTGT TCATACGCTT CCGCGCCCGG
501 CCCGCCGGTA ATGACAAGCT GAGGATTGTA GCGGTGCAGG GCTTCGTAAT
551 CGGGCTCGAA CAGCGTCCCC ACCGTTGCCG CCTTGTCAAA TGCAGGCTGC
601 AAATAA
```

This corresponds to the amino acid sequence <SEQ ID 170; ORF 042.a>:

a042.pep

```
  1 MTMICLRFQA FVPRTSALSN TSTAAGPSCP MAAVRSMMKI QSGFFSLMYS

 51 KETGCPCPSL RKDSSTGGRP MSPCIQLANR DCVPKADTLL PVTDSTSPRP

101 LPLAASRVWA NSASICAFNS AARASLPKIR AKVSICFSPL VRILPLSTVR

151 SMVVAFFANC SYASAPGPPV MTS*GL*RCR AS*SGSNSVP TVAALSNAGC

201 K*
```

m042/a042 99.0% identity over a 201 aa overlap

```
                 10         20         30         40         50         60
m042.pep MTMICLRFQAFVPRTSALSXTXTAAGXSCPMAAVRSMMKIQSGFFSLMYSKETGCPCPSL
         |||||||||||||||||||| ||||| |||||||||||||||||||||||||||||||||
a042     MTMICLRFQAFVPRTSALSNTSTAAGPSCPMAAVRSMMKIQSGFFSLMYSKETGCPCPSL
                 10         20         30         40         50         60
                 70         80         90        100        110        120
m042.pep RKDSSTGGRPMSPCIQLANRDCVPKADTLLPVTDSTSPRPLPLAASRVWANSASICAFNS
         ||||||||||||||||||||||||||||||||||||||||||||||||||||||||||||
a042     RKDSSTGGRPMSPCIQLANRDCVPKADTLLPVTDSTSPRPLPLAASRVWANSASICAFNS
                 70         80         90        100        110        120
                130        140        150        160        170        180
m042.pep AARASLPKIRAKVSICFSPLVRILPLSTVRSMVVAFFANCSYASAPGPPVMTSXGLXRCR
         ||||||||||||||||||||||||||||||||||||||||||||||||||||||||||||
a042     AARASLPKIRAKVSICFSPLVRILPLSTVRSMVVAFFANCSYASAPGPPVMTSXGLXRCR
                130        140        150        160        170        180
                190        200
m042.pep ASXSGSNSVPTVAALSNAGCKX
         ||||||||||||||||||||||
a042     ASXSGSNSVPTVAALSNAGCKX
                190        200
```

Computer analysis of this amino acid sequence gave the following results:

Homology with a predicted ORF from *N. gonorrhoeae*

ORF 042 shows 93.0% identity over a 201 aa overlap with a predicted ORF (ORF 042.ng) from *N. gonorrhoeae*:

```
                 10         20         30         40         50         60
m042.pep MTMICLRFQAFVPRTSALSXTSTAAGXSCPMAAVRSMMKIQSGFFSLMYSKETGCPCPSL
         ||||||||||||:||||| |||||| ||||||||||||||| ||||||||||||||||||
g042     MTMICLRFQAFVPHTSALSNTSTAAGPSCPMAAVRSMMKIQPGFFSLMYSKETGCPCPSL
                 10         20         30         40         50         60
                 70         80         90        100        110        120
m042.pep RKDSSTGGRPMSPCIQLANRDCVPKADTLLPVTDSTSPRPLPLAASRVWANSASICAFNS
         |||||||||||||||||||||||||||||||||||||||||||||||| |||||||||||
g042     RKDSSTGGRPMSPCIQLANRDCVPKADTLLPVTDSTSPRPLPLAASRFWANSASICAFNS
                 70         80         90        100        110        120
                130        140        150        160        170        180
m042.pep AARASLPKIRAKVSICFSPLVRILPLSTVRSMVVAFFANCSYASAPGPPVMTSXGLXRCR
         |:|||||||| :|||||||||||||||||:|||||||||||||||||||||| || |||
g042     ATRASLPKIRDRVSICFSPLVRILPLSTVKSMVVAFFANCSYASAPGPPVMTNCGLWRCR
                130        140        150        160        170        180
                190        200
m042.pep ASXSGSNSVPTVAALSNAGCKX
         | ||||||||||||||||||||
g042     DSQSGSNSVPTVAALSNAGCKX
                190        200
```

The following partial DNA sequence was identified in *N. meningitidis* <SEQ ID 171>:

m042-1.seq

```
  1 ATGACGATGA TTTGCTTGCG CTTCCAAGCG TTCGTGCCGC GTACCAGCGC

 51 GTTATCCAAT ACTTCGACAG CCGCCGGCCC TTCCTGCCCG ATGGCGGCGG
```

-continued

```
101 TACGGTCGAT GATGAAAATC CAATCGGGGT TTTTCTCTTT GATGTATTCG

151 AAGGAAACAG GCTGCCCGTG CCCCTCGTTG CGTAAAGATT CGTCTACAGG

201 CGGTAGGCCG ATGTCGCCGT GTATCCAACT TGCCAACCGC GACTGCGTGC

251 CGAAGGCGGA CACCTTGTTG CCCGTAACCG ACAGCACCAG CCCGCGTCCT

301 TTGCCTTTGG CGGCTTCGCG CGTTTGGGCG AACAGCGCGT CAATCTGCGC

351 CTTCAATTCC GCCGCGCGCG CTTCCTTGCC GAAAATCCGC GCCAAGGTCT

401 CCATCTGCTT TTCGCCGCTG GTGCGGATAT TGCCGTTGTC CACCGTCAGA

451 TCTATGGTGG TCGCGTTTTT CGCTAACTGT TCATACGCTT CCGCGCCCGG

501 CCCGCCGGTA A
```

This corresponds to the amino acid sequence <SEQ ID 172; ORF 042-1>:

m042-1.pep

```
  1 MTMICLRFQA FVPRTSALSN TSTAAGPSCP MAAVRSMMKI QSGFFSLMYS

 51 KETGCPCPSL RKDSSTGGRP MSPCIQLANR DCVPKADTLL PVTDSTSPRP

101 LPLAASRVWA NSASICAFNS AARASLPKIR AKVSICFSPL VRILPLSTVR

151 SMVVAFFANC SYASAPGPPV MTS*
```

042-1/g042 95.4% identity in 173 aa overlap

```
                    10        20        30        40        50        60
m042-1.pep  MTMICLRFQAFVPRTSALSNTSTAAGPSCPMAAVRSMMKIQSGFFSLMYSKETGCPCPSL
            ||||||||||||:|||||||||||||||||||||||||||| ||||||||||||||||||
g042        MTMICLRFQAFVPHTSALSNTSTAAGPSCPMAAVRSMMKIQPGFFSLMYSKETGCPCPSL
                    10        20        30        40        50        60
                    70        80        90       100       110       120
m042-1.pep  RKDSSTGGRPMSPCIQLANRDCVPKADTLLPVTDSTSPRPLPLAASRVWANSASICAFNS
            ||||||||||||||||||||||||||||||||||||||||||||||| ||||||||||||
g042        RKDSSTGGRPMSPCIQLANRDCVPKADTLLPVTDSTSPRPLPLAASRFWANSASICAFNS
                    70        80        90       100       110       120
                   130       140       150       160       170
m042-1.pep  AARASLPKIRAKVSICFSPLVRILPLSTVRSMVVAFFANCSYASAPGPPVMTSX
            |:|||||||| :|||||||||||||||||:||||||||||||||||||||||:
g042        ATRASLPKIRDRVSICFSPLVRILPLSTVKSMVVAFFANCSYASAPGPPVMTNCGLWRCR
                   130       140       150       160       170       180
g042        DSQSGSNSVPTVAALSNAGCKX
                   190       200
```

The following partial DNA sequence was identified in *N. meningitidis* <SEQ ID 173>:

a042-1.seq

```
  1 ATGACGATGA TTTGCTTGCG CTTCCAAGCG TTCGTGCCGC GTACCAGCGC

 51 GTTATCCAAT ACTTCGACAG CCGCCGGCCC TTCCTGCCCG ATGGCGGCGG

101 TACGGTCGAT GATGAAAATC CAATCGGGGT TTTTCTCTTT GATGTATTCG

151 AAGGAAACAG GCTGCCCGTG CCCCTCGTTG CGTAAAGATT CGTCTACAGG

201 CGGTAGGCCG ATGTCGCCGT GTATCCAACT TGCCAACCGC GACTGCGTGC

251 CGAAGGCGGA CACCTTGTTG CCCGTAACCG ACAGCACCAG CCCGCGTCCT
```

-continued

```
301 TTGCCTTTGG CGGCTTCGCG CGTTTGGGCG AACAGCGCGT CAATCTGCGC

351 CTTCAATTCC GCCGCGCGCG CTTCCTTGCC GAAAATCCGC GCCAAGGTCT

401 CCATCTGCTT TTCGCCGCTG GTGCGGATAT TGCCGTTGTC CACCGTCAGA

451 TCTATGGTGG TCGCGTTTTT CGCCAACTGT TCATACGCTT CCGCGCCCGG

501 CCCGCCGGTA A
```

This corresponds to the amino acid sequence <SEQ ID 174; ORF 042-1.a>:

a042-1.pep

```
  1 MTMICLRFQA FVPRTSALSN TSTAAGPSCP MAAVRSMMKI QSGFFSLMYS

 51 KETGCPCPSL RKDSSTGGRP MSPCIQLANR DCVPKADTLL PVTDSTSPRP

101 LPLAASRVWA NSASICAFNS AARASLPKIR AKVSICFSPL VRILPLSTVR

151 SMVVAFFANC SYASAPGPPV MTS*
```

m042-1/a042-1 100.0% identity in 173 aa overlap

```
                    10        20        30        40        50        60
m042-1.pep  MTMICLRFQAFVPRTSALSNTSTAAGPSCPMAAVRSMMKIQSGFFSLMYSKETGCPCPSL
            ||||||||||||||||||||||||||||||||||||||||||||||||||||||||||||
a042-1      MTMICLRFQAFVPRTSALSNTSTAAGPSCPMAAVRSMMKIQSGFFSLMYSKETGCPCPSL
                    10        20        30        40        50        60

                    70        80        90       100       110       120
m042-1.pep  RKDSSTGGRPMSPCIQLANRDCVPKADTLLPVTDSTSPRPLPLAASRVWANSASICAFNS
            ||||||||||||||||||||||||||||||||||||||||||||||||||||||||||||
a042-1      RKDSSTGGRPMSPCIQLANRDCVPKADTLLPVTDSTSPRPLPLAASRVWANSASICAFNS
                    70        80        90       100       110       120

                   130       140       150       160       170
m042-1.pep  AARASLPKIRAKVSICFSPLVRILPLSTVRSMVVAFFANCSYASAPGPPVMTSX
            ||||||||||||||||||||||||||||||||||||||||||||||||||||||
a042-1      AARASLPKIRAKVSICFSPLVRILPLSTVRSMVVAFFANCSYASAPGPPVMTSX
                   130       140       150       160       170
```

The following partial DNA sequence was identified in *N. gonorrhoeae* <SEQ ID 175>:

g043.seq

```
  1 ATGGTTGTTT CAAATCAAAA TATCTATGCC GTCGGCCCAT CAGCACTTTT

 51 TCACATCCGA AGGCAAAAAT CCGTAATGCC GCCTGAACGC TTCgttgaAC

101 CGTCCCGCGT ggcggtagcc gcAAAAGTGC ATcGCGGCTT GGATGGTGCT

151 GCCCGATTCG ATGAGGGcga gcGCGTGTTC CAGCCGCAGG CGGCGCAGGC

201 GTCCGGCGAC GGTTTCGCCG GTTTGCGCTT TGAAATAGCG TTTCAGGTAG

251 CATTCGTTCA GCCCGACGCG GCGGGCGATT TCGGCGATGG TCAGCGGGCG

301 GGCGAATTCG CTGTTCAAAA TATCGGCGGC TTCGTCTATG CGCCGGCGGC

351 GGTAGCCGTT GTCGTGGCGG CGGAAGGTGA AGCGTAA
```

This corresponds to the amino acid sequence <SEQ ID 176; ORF 043.ng>:

g043.pep

```
  1 MVVSNQNIYA VGPSALFHIR RQKSVMPPER FVEPSRVAVA AKVHRGLDGA

 51 ARFDEGERVF QPQAAQASGD GFAGLRFEIA FQVAFVQPDA AGDFGDGQRA

101 GEFAVQNIGG FVYAPAAVAV VVAAEGEA*
```

The following partial DNA sequence was identified in *N. meningitidis* <SEQ ID 177>:

m043.seq

```
  1 ATGGTTGTTT CAAATCAAAA TATCTATGCC GCCGGCCCCT CAGCACTTCT

 51 TCACATCCGA AGGCAAAAAT CCGTAATGCC GTCTGAACGC TTCGTTGAAC

101 CGTCCCGCGT GGCGGTAGCC GCAAAAGTGC ATGGCGGCTT GGACGGTGCT

151 GCCGGATTCG ATGAGGGCGA GCGCGTGTTC CAGCCGCAGG CGGCGCAgGC

201 ATCCGGCGAC GGTTTCGCCG GTTTGCGCTT TGAAATAGCG TTTCAGGTAG

251 CATTCGTTCA GTCCGACGCG GCGGGCGATT TCGGCGATGG TCAGCGGACG

301 GGCGAATTCG TGTTGCAGGA TGTCGGCGGC TTCGTCTATG CGCCGACGGC

351 GGTAACCGTT GTCGTGGCGG CGGAAGGTGA AGCGCAATAA
```

This corresponds to the amino acid sequence <SEQ ID 178: ORF 043>:

m043.pep

```
  1 MVVSNQNIYA AGPSALLHIR RQKSVMPSER FVEPSRVAVA AKVHGGLDGA

 51 AGFDEGERVF QPQAAQASGD GFAGLRFEIA FQVAFVQSDA AGDFGDGQRT

101 GEFVLQDVGG FVYAPTAVTV VVAAEGEAQ*
```

Computer analysis of the amino acid sequences gave the following results:

Homology with a predicted ORF from *N. meningitidis* menA with menB

ORF 043 shows 89.8% identity over a 128 aa overlap with a predicted ORF (ORF043.a) from *N. gonorrhoeae*:

m043/g043

```
                    10        20        30        40        50        60
m043.pep    MVVSNQNIYAAGPSALLHIRRQKSVMPSERFVEPSRVAVAAKVHGGLDGAAGFDEGERVF
            ||||||||||:|||||:|||||||||| |||||||||||||||| |||||| ||||||||
g043        MVVSNQNIYAVGPSALFHIRRQKSVMPPERFVEPSRVAVAAKVHRGLDGAARFDEGERVF
                    10        20        30        40        50        60

                    70        80        90       100       110       120
m043.pep    QPQAAQASGDGFAGLRFEIAFQVAFVQSDAAGDFGDGQRTGEFVLQDVGGFVYAPTAVTV
            ||||||||||||||||||||||||||| |||||||||||:|||::|::|||||||:||:|
g043        QPQAAQASGDGFAGLRFEIAFQVAFVQPDAAGDFGDGQRAGEFAVQNIGGFVYAPAAVAV
                    70        80        90       100       110       120

                   130
m043.pep    VVAAEGEAQX
            ||||||||
g043        VVAAEGEAXX
                   130
```

The following partial DNA sequence was identified in *N. meningitidis* <SEQ ID 179>:

a043.seq

```
  1 ATGGTTGTTT CAAATCAAAA TATCTATGCC GCCGGCCCCT CAGCACTTCT
 51 TCACATCCGA AGGCAAAAAT CCGTAATGCC GTCTGAACGC TTCGTTGAAC
101 CGTCCCGCGT GGCGGTAGCC GCAAAAGTGC ATGGCGGCTT GGACGGTGCT
151 GCCGGATTCG ATGAGGGCGA GCGCGTGTTC CAGCCGCAGG CGGCGCAGGC
201 ATCCGGCGAC GGTTTCGCCG GTTTGCGCTT TGAAATAGCG TTTCAGGTAG
251 CATTCGTTCA GTCCGACGCG GCGGGCGATT TCGGCGATGG TCAGCGGACG
301 GGCGAATTCG TGTTGCAGGA TGTCGGCGGC TTCGTCTATG CGCCGACGGC
351 GGTAACCGTT GTCGTGGCGG CGGAAGGTGA AGCGCAATAA
```

This corresponds to the amino acid sequence <SEQ ID 180; ORF 043.a>:

a043.pep

```
  1 MVVSNQNIYA AGPSALLHIR RQKSVMPSER FVEPSRVAVA AKVHGGLDGA
 51 AGFDEGERVF QPQAAQASGD GFAGLRFEIA FQVAFVQSDA AGDFGDGQRT
101 GEFVLQDVGG FVYAPTAVTV VVAAEGEAQ*
```

m043/a043 100.0% identity in 129 aa overlap

```
                    10        20        30        40        50        60
m043.pep   MVVSNQNIYAAGPSALLHIRRQKSVMPSERFVEPSRVAVAAKVHGGLDGAAGFDEGERVF
           ||||||||||||||||||||||||||||||||||||||||||||||||||||||||||||
a043       MVVSNQNIYAAGPSALLHIRRQKSVMPSERFVEPSRVAVAAKVHGGLDGAAGFDEGERVF
                    10        20        30        40        50        60

                    70        80        90       100       110       120
m043.pep   QPQAAQASGDGFAGLRFEIAFQVAFVQSDAAGDFGDGQRTGEFVLQDVGGFVYAPTAVTV
           ||||||||||||||||||||||||||||||||||||||||||||||||||||||||||||
a043       QPQAAQASGDGFAGLRFEIAFQVAFVQSDAAGDFGDGQRTGEFVLQDVGGFVYAPTAVTV
                    70        80        90       100       110       120

                   130
m043.pep   VVAAEGEAQX
           ||||||||||
a043       VVAAEGEAQX
                   130
```

The following partial DNA sequence was identified in *N. gonorrhoeae* <SEQ ID 181>:

g044.seq

```
  1 ATGCTGCCCG ACCAGAGCGT CGAGTTCTTG CCACAAGTCG TCGTTTTTGA
 51 CGGGCTGTTT GGCGGCGGTT TTCCAGCCGT TGCGCTTCCA ACCGTGTATC
101 CAGTTTTCCA TGCCGTTTTT GACGTATTGC GAGTCGGTGC AGATGATGAC
151 GGTGCAGCGG CGTTTGAGCG ATTTCAGCCC TTCGATAACG GCGGTCAGCT
201 CCATGCGGTT GTTGGTGGTT TGCGCTTCGC CGCCGAAAAG TTCTTTTTCG
251 CGGCTGCCGT AGCGCATTAA
```

This corresponds to the amino acid sequence <SEQ ID 182; ORF 044.ng>:

g044.pep

```
 1 MLPDQSVEFL PQVVVFDGLF GGGFPAVALP TVYPVFHAVF DVLRVGADDD

51 GAAAFERFQP FDNGGQLHAV VGGLRFAAEK FFFAAAVAH*
```

The following partial DNA sequence was identified in *N. meningitidis* <SEQ ID 183>:

m044.seq

```
  1 ATGCCGTCCG ACTAGAGCGT CGAGTTCTTT CCAGAAGTCG TCGTTTTTGA
 51 CGGGCTGTTT GGAGGCGGTT TTCCAGCCGT TGCGCTTCCA ACCGTGTATC
101 CAGTTTTCCA TGCCATTTTT GACGTATTGC GAGTCGGTGC AGATGATGAC
151 GGTGCAGCGG CGTTTGAGCG ATTTCAGTCC TTCGATGACG GCAGTCAGTT
201 CCATGCGGTT GTTGGTGGTT TGCGCTTCGC CGCCGAAAAG TTCTTTTTCG
251 TGGCTACCGT AGCGCAyTAa
```

This corresponds to the amino acid sequence <SEQ ID 184; ORF 044>:

m044.pep

```
 1 MPSDXSVEFF PEVVVFDGLF GGGFPAVALP TVYPVFHAIF DVLRVGADDD

51 GAAAFERFQS FDDGSQFHAV VGGLRFAAEK FFFVATVAH*
```

The following partial DNA sequence was identified in *N. meningitidis* <SEQ ID 185>:

a044.seq

```
  1 GTGCCGTCCG ACCAGCGCGT CGAGTTCTTT CCACAAGTCG TCGTTTTTGA
 51 CGGGCTGTTT GGCGGCGGTT TTCCAGCCGT TGCGCTTCCA ACCGTGTATC
101 CAGTTTTCCA TGCCGTTTTT GACGTATTGC GAGTCGGTGC AGATGATGAC
151 GGTGCAGCGG CGTTTGAGCG ATTTCAGTCC TTCGATGACG GCGGTCAGTT
201 CCATACGGTT GTTGGTGGTT TGCGCTTCGC CGCCGAAAAG TTCTTTTTCG
251 TGGCTGCCGT AGCGCATTAA
```

This corresponds to the amino acid sequence <SEQ ID 186; ORF 044.a>:

a044.pep

```
 1 VPSDQRVEFF PQVVVFDGLF GGGFPAVALP TVYPVFHAVF DVLRVGADDD
51 GAAAFERFQS FDDGGQFHTV VGGLRFAAEK FFFVAAVAH*
```

m044/a044 91.0% identity over a 89 aa overlap

```
                  10        20        30        40        50        60
m044.pep   MPSDXSVEFFPEVVVFDGLFGGGFPAVALPTVYPVFHAIFDVLRVGADDDGAAAFERFQS
           :|||  |||||:||||||||||||||||||||||||||:|||||||||||||||||||||
a044       VPSDQRVEFFPQVVVFDGLFGGGFPAVALPTVYPVFHAVFDVLRVGADDDGAAAFERFQS
                  10        20        30        40        50        60

                  70        80        90
m044.pep   FDDGSQFHAVVGGLRFAAEKFFFVATVAHX
           ||||:|||:||||||||||||||||:||||
a044       FDDGGQFHTVVGGLRFAAEKFFFVAAVAHX
                  70        80        90
```

Computer analysis of this amino acid sequence gave the following results:

Homology with a predicted ORF from *N. gonorrhoeae*

ORF 044 shows 86.5% identity over a 89 aa overlap with a predicted ORF (ORF 044.ng) from *N. gonorrhoeae*:

m044/g044

```
                  10        20        30        40        50        60
m044.pep   MPSDXSVEFFPEVVVFDGLFGGGFPAVALPTVYPVFHAIFDVLRVGADDDGAAAFERFQS
           |  | ||||:|:||||||||||||||||||||||||||:|||||||||||||||||||||
g044       MLPDQSVEFLPQVVVFDGLFGGGFPAVALPTVYPVFHAVFDVLRVGADDDGAAAFERFQP
                  10        20        30        40        50        60

                  70        80        90
m044.pep   FDDGSQFHAVVGGLRFAAEKFFFVATVAHX
           ||:|:|:||||||||||||||||:|:||||
g044       FDNGGQLHAVVGGLRFAAEKFFFAAAVAHX
                  70        80        90
```

The following partial DNA sequence was identified in *N. gonorrhoeae* <SEQ ID 187>:

g046.seq

```
  1 ATGTCGGCAA TGCTGCGTCC GACAAGCAGC CCGCCGCgcc gCGCCTGTAT
 51 GATGACCATC CGCACGCGGT CGTCTGCAAA ACGTAAAACC TGCAATGCGC
101 CCGGGCAGTC TATCAGGCCG GCAAGCTGTT CGGTAACGAG CTGTTCGGGG
151 CTGATGGTTT CGGTTATGCC gaATATGGAA AGGCTGCCGt TTTcGTTGTT
201 TTCGAGCTTG GGGCTGAGGT ATTCGAGGTA TtcgctGGAA CGGACGCGCG
251 CGATGCGGCC GGGGATGTTG AACAGGTCGG CGGCAACTTT GCAGGCGACG
301 ATGTTGGTTT CGTCGCTGCG GGagaGCGCG AGcagcaagt cggcatcttC
351 CgcgccggcG Cgttataatg tgAAGGGGGA TGCGccgttg ccgaAAACGG
401 TTTGGacatc gaggcggctg CCTGTTTCCT GCAATGCTTT TTCGTCGATG
451 TCGATAAcgg TTACGTCGTT GTTGGTGATG GCGGCAAGGT TTTGCGCGAC
501 GGTAGAACCT ACCTGCCCGT TGCCTAAAAT GAGGATTTTC ACGGTATGGG
551 TCGCCGGGTG A
```

This corresponds to the amino acid sequence <SEQ ID 188; ORF 046.ng>:

g046.pep

```
  1 MSAMLRPTSS PPRRACMMTI RTRSSAKRKT CNAPGQSIRP ASCSVTSCSG
 51 LMVSVMPNME RLPFSLFSSL GLRYSRYSLE RTRAMRPGML NRSAATLQAT
```

-continued

```
101 MLVSSLRESA SSKSASSAPA RYNVKGDAPL PKTVWTSRRL PVSCNAFSSM

151 SITVTSLLVM AARFCATVEP TCPLPKMRIF TVWVAG*
```

The following partial DNA sequence was identified in *N. meningitidis* <SEQ ID 189>:

m046.seq

```
  1 ATGTCGGCAA TGCTGCGTCC GACAAGCAsT CCGC.r.sGC gCGcCTGTAT

 51 GATGACCATC CGCACGCGGT CGTCTGCAAA ACGTAAAACC TGCAATGCGC

101 CCGGGCAGTC TATCAGGCCG GCAAGCTGTT CGGTAACGAG CTGTTCGGGG

151 CTGATGGTTT CGGTTATGCC GAATATGGAA AGGCTGCCGT TTTCGTTGTT

201 TTCGAGCTTG GGGCTGAGGT ATTCGAGGTA TTCGCTGGAA CGGACGCGCG

251 CGATGCGGCC GGGGATGTTG AACAGGTCGG CGGCAACTTT GCAGGCGACG

301 ATGTTGGTTT CGTCGCTGCG GGAGAGCGCG AGCAGCAAGT CGGCATCTTC

351 CGCGCCGGCG CGTTCTAATG TGAAGGGGGA TGCGCCGTTG CCGAAAACGG

401 TTTGGACATC GAGGCGGCTG CCTGTTTCCT GCAATGCTTT TTCGTCGATG

451 TCGATAACGG TTACGTCGTT GTTGGGTATG GCGGCAAGGT TTTGTGCGAC

501 GGTAGAACCT ACCTGTCCGT TGCCTAAAAT GAGGATTTTC ACGGTGTGGG

551 TCGCCGAGTG A
```

This corresponds to the amino acid sequence <SEQ ID 190; ORF 046>:

m046.pep

```
  1 MSAMLRPTSX PXXRACMMTI RTRSSAKRKT CNAPGQSIRP ASCSVTSCSG

 51 LMVSVMPNME RLPFSLFSSL GLRYSRYSLE RTRAMRPGML NRSAATLQAT

101 MLVSSLRESA SSKSASSAPA RSNVKGDAPL PKTVWTSRRL PVSCNAFSSM

151 SITVTSLLGM AARFCATVEP TCPLPKMRIF TVWVAE*
```

The following partial DNA sequence was identified in *N. meningitidis* <SEQ ID 191>:

a046.seq

```
  1 ATGTCGGCAA TGCTGCGTCC GACAAGCAGT CCGCCGCGCC GCGCCTGTAT

 51 GATGACCATC CGCACGCGGT CGTCTGCAAA ACGTAAAACC TGCAATGCGC

101 CCGGGCAGTC TATCAGGCCG GCAAGCTGTT CGGTAACGAG CTGTTCGGGG

151 CTGATGGTTT CGGTTATGCC GAATATGGAA AGGCTGCCGT TTTCGTTGTT

201 TTCGAGCTTG GGGCTGAGGT ATTCGAGGTA TTCGCTGGAA CGGACGCGCG

251 CGATGCGGCC GGGGATGTTG AACAGGTCGG CGGCAACTTT GCAGGCGACG

301 ATGTTGGTTT CGTCGCTGCG GGAGAGCGCG AGCAGCAAGT CGGCATCTTC

351 CGCGCCGGCG CGTTCTAATG TGAAGGGGGA TGCGCCGTTG CCGAAAACGG

401 TTTGGACATC GAGGCGGCTG CCTGTTTCCT GCAATGCTTT TTCGTCGATG
```

-continued

```
451 TCGATAACGG TTACGTCGTT GTTGGGTATG GCGGCAAGGT TTTGTGCGAC

501 GGTAGAACCT ACCTGTCCGT TGCCTAAAAT GAGGATTTTC ACGGTGTGGG

551 TCGCCGAGTG A
```

This corresponds to the amino acid sequence <SEQ ID 192; ORF 046.a>:

a046.pep

```
  1 MSAMLRPTSS PPRRACMMTI RTRSSAKRKT CNAPGQSIRP ASCSVTSCSG

 51 LMVSVMPNME RLPFSLFSSL GLRYSRYSLE RTRAMRPGML NRSAATLQAT

101 MLVSSLRESA SSKSASSAPA RSNVKGDAPL PKTVWTSRRL PVSCNAFSSM

151 SITVTSLLGM AARFCATVEP TCFLPKMRIF TVWVAE*
```

m046/a046 98.4% identity over a 186 aa overlap

```
                   10        20        30        40        50        60
m046.pep   MSAMLRPTSXPXXRACMMTIRTRSSAKRKTCNAPGQSIRPASCSVTSCSGLMVSVMPNME
           ||||||||| |  |||||||||||||||||||||||||||||||||||||||||||||||
a046       MSAMLRPTSSPPRRACMMTIRTRSSAKRKTCNAPGQSIRPASCSVTSCSGLMVSVMPNME
                   10        20        30        40        50        60
                   70        80        90       100       110       120
m046.pep   RLPFSLFSSLGLRYSRYSLERTRAMRPGMLNRSAATLQATMLVSSLRESASSKSASSAPA
           ||||||||||||||||||||||||||||||||||||||||||||||||||||||||||||
a046       RLPFSLFSSLGLRYSRYSLERTRAMRPGMLNRSAATLQATMLVSSLRESASSKSASSAPA
                   70        80        90       100       110       120
                  130       140       150       160       170       180
m046.pep   RSNVKGDAPLPKTVWTSRRLPVSCNAFSSMSITVTSLLGMAARFCATVEPTCPLPKMRIF
           ||||||||||||||||||||||||||||||||||||||||||||||||||||||||||||
a046       RSNVKGDAPLPKTVWTSRRLPVSCNAFSSMSITVTSLLGMAARFCATVEPTCPLPKMRIF
                  130       140       150       160       170       180
m046.pep   TVWVAEX
           |||||||
a046       TVWVAEX
```

Computer analysis of this amino acid sequence gave the following results:

Homology with a predicted ORF from *N. gonorrhoeae*

ORF 046 shows 97.3% identity over a 185 aa overlap with a predicted ORF (ORF 046.ng) from *N. gonorrhoeae*:

m046/g046

```
                   10        20        30        40        50        60
m046.pep   MSAMLRPTSXPXXRACMMTIRTRSSAKRKTCNAPGQSIRPASCSVTSCSGLMVSVMPNME
           ||||||||| |  |||||||||||||||||||||||||||||||||||||||||||||||
g046       MSAMLRPTSSPPRRACMMTIRTRSSAKRKTCNAPGQSIRPASCSVTSCSGLMVSVMPNME
                   10        20        30        40        50        60
                   70        80        90       100       110       120
m046.pep   RLPFSLFSSLGLRYSRYSLERTRAMRPGMLNRSAATLQATMLVSSLRESASSKSASSAPA
           ||||||||||||||||||||||||||||||||||||||||||||||||||||||||||||
g046       RLPFSLFSSLGLRYSRYSLERTRAMRPGMLNRSAATLQATMLVSSLRESASSKSASSAPA
                   70        80        90       100       110       120
                  130       140       150       160       170       180
m046.pep   RSNVKGDAPLPKTVWTSRRLPVSCNAFSSMSITVTSLLGMAARFCATVEPTCPLPKMRIF
           | |||||||||||||||||||||||||||||||||||| |||||||||||||||||||||
g046       RYNVKGDAPLPKTVWTSRRLPVSCNAFSSMSITVTSLLVMAARFCATVEPTCPLPKMRIF
                  130       140       150       160       170       180
m046.pep   TVWVAEX
           |||||
g046       TVWVAGX
```

The following partial DNA sequence was identified in *N. gonorrhoeae* <SEQ ID 193>:

g047.seq

```
  1 ATGGTCATCA TACAGGCGcg gcGCGGCGGG CTGCTTGTCG GACGCAGCAT
 51 TGCCGACATC GCCCAAGATT TGCCCGACGG GGCCGACTGC CAAATCTGCG
101 CCGTTTACCG CAACAACCGC CTCATCGTCC CCGCGCCGCA AACCGTCATC
151 ATCGAAGGCG ACGAAATCCT GTTTGCCGCC GCCGCCGAAA ACATCGGGGC
201 GGTCATACCc gaATTGCGCC CCAAAGAAAC CAGCACCCGC CGCATCATGA
251 TTGCCGGCGG CGGCAACATc tgctACCGCC TCGCCAAGCA GCTCGAACAC
301 GCATAcaacG TCAAAATCAT CGAATGCCGG CCGCGCcgtg ccgaATGGAT
351 AGCCGAAAAC ctcgAcaaCA CCCTCGTCCT GCAAGGTTCG Gcaaccgacg
401 aAaccctgct cgAcaacgaa tacatcgacg aaatcgaCGT ATTCTGCGCC
451 CTGACCAACG ACGACGAAAG CAACATTAtg tCCGCCCTTT TGGCGAAAAA
501 CCTcggCgCG AAGCgcgtca tcggCATCGT CAACCGCTCA AGCTACGTCG
551 ATTTGCTCGA AGGCAACAAA ATCGACATCG TCGTCTCCCC CCACCTCATC
601 ACCATCGGCT CGATACTCGC CCACATCCGG CGCGGCGACA TCGTTGCCGT
651 CCACCCCATC CGGCGCGGCA CGGCGGAAGC CATCGAAGTC GTCGCGCACG
701 GCGACAAAAA AACTTCCGCC ATCATCGGCA GGCGCATCAG CGGCATCAAA
751 TGGCCCGAAG GCTGCCACAT TGCCGCCGTC GTCCGCGCCG GAACCGGCGA
801 AACCATTATG GGACACCATA CCGAAACCGT CATCCAAGAC GGTGACCACA
851 TCATCTTTTT CGTCTCGCGC CGGCGCATCC TGAACGAACT GGAGAAACTC
901 ATCCAAGTCA AAATGGGCTT TTTCGGATAA
```

This corresponds to the amino acid sequence <SEQ ID 194; ORF 047.ng>:

g047.pep

```
  1 MVIIQARRGG LLVGRSIADI AQDLPDGADC QICAVYRNNR LIVPAPQTVI
 51 IEGDEILFAA AAENIGAVIP ELRPKETSTR RIMIAGGGNI CYRLAKQLEH
101 AYNVKIIECR PRRAEWIAEN LDNTLVLQGS ATDETLLDNE YIDEIDVFCA
151 LTNDDESNIM SALLAKNLGA KRVIGIVNRS SYVDLLEGNK IDIVVSPHLI
201 TIGSILAHIR RGDIVAVEPI RRGTAEAIEV VAHGDKKTSA IIGRRISGIK
251 WPEGCHIAAV VRAGTGETIM GHHTETVIQD GDHIIFFVSR RRILNELEKL
301 IQVKMGFFG*
```

The following partial DNA sequence was identified in *N. meningitidis* <SEQ ID 195>:

m047.seq

```
  1 ATGGTCATCA TACAGgCGcG C..syGCGGA sTGCTTGTCG GACGCAGCAT
 51 TGCCGACATC GCCCAAGATT TGCCCGACGG GGCCGACTGC CAAATCTGCG
101 CCGTTTACCG CAACAACCGC CTCATCGTCC CCGCGCCGCA AACCGTCATC
151 ATCGAAGGCG ACGAAATCCT ATTTGCCGCC GCCGCCGAAA ACATCGGCGC
201 GGTCATACCC GAATTGCGCC CCAAAGAAAC CCAAAGAAAC CAGCcCmgmm
```

-continued

```
251 GcATCATGAT TkCCGGCGGC GGCAACATCG GCTACCGTCT CGCCAAGCAG
301 CTCGAACACG CATACAACGT yAAAATCATC GAATGCCGGC CGCGCCGTGC
351 CGAATGGATA GCCGAAAACC TCGACAACAC CCTCGTCyTG CAAGGTTCGG
401 CAACCGACGA AACCCTGCTC GACAACGAAT ACATCGACGA AATCGACGTA
451 TTCTGCGCCC TGACCAACGA CGACGAAAGC AACATTATGT CCGCCCTTTT
501 GGCGAaAAAC CTCGGCGCGA AGCGCGTCAT CGGCATCGTC AACCGCTCAA
551 GCTACGTCGA TTTGCTCGAA GGCAACAAAA TCGACATCGT CGTCTCCCCC
601 CACCTCATCA CCATCGGCTC GATACTCGCC CACATCCGGC GCGGCGACAT
651 CGTTGCCGTC CACCCCATCC GGCGCGGCAC GGCGGAAGCC ATCGAAGTCG
701 TCGCACACGG CGACAAAAAA ACTTCCGCCA TCATCGGCAG GCGCATCAGC
751 GGCATCAAAT GGCCCGAAGG CTGCCACATT GCCGCCGTCG TCCGCGCCGG
801 AACCGGCGAA ACCATTATGG GACACCATAC CGAAACCGTC ATCCAAGACG
851 GCGACCACAT CATCTTTTTC GTCTCGCGCC GGCGCATCCT GAACGAACTG
901 GAAAAACTCA TCCAGGTCAA AATGGGCTTT TTCGGATAA
```

This corresponds to the amino acid sequence <SEQ ID 196; ORF 047>:

m047.pep

```
  1 MVIIQARXXG XLVGRSIADI AQDLPDGADC QICAVYRNNR LIVPAPQTVI
 51 IEGDEILFAA AAENIGAVIP ELRPKETQRN QPXXIMIXGG GNIGYRLAKQ
101 LEHAYNVKII ECRPRRAEWI AENLDNTLVL QGSATDETLL DNEYIDEIDV
151 FCALTNDDES NIMSALLAKN LGAKRVIGIV NRSSYVDLLE GNKIDIVVSP
201 HLITIGSILA HIRRGDIVAV HPIRRGTAEA IEVVANGDKK TSAIIGRRIS
251 GIKWPEGCHI AAVVRAGTGE TIMGHHTETV IQDGDHIIFF VSRRRILNEL
301 EKLIQVKMGF FG*
```

The following partial DNA sequence was identified in *N. meningitidis* <SEQ ID 197>:

a047.seq

```
  1 ATGGTCATCA TACAGGCGCG GCGCGGCGGA CTGCTTGTCG GACGCAGCAT
 51 TGCCGACATC GCCCAAGATT TGCCCGACGG GGCCGACTGC CAAATCTGCG
101 CCGTTTACCG CAACAACCGC CTCATCGTCC CCGCGCCGCA AACCGTCATC
151 ATCGAAGGCG ACGAAATCCT ATTTGCCGCC GCCGCCGAAA ACATCGGCGC
201 GGTCATACCC GAATTGCGCC CCAAAGAAAC CAGCACCCGC CGCATCATGA
251 TTGCCGGCGC CGGCAACATC GGCTACCGTC TCGCCAAGCA GCTCGAACAC
301 GCATACAACG TCAAAATCAT CGAATGCCGG CCGCGCCGTG CCGAATGGAT
351 AGCCGAAAAC CTCGACAACA CCCTCGTCCT GCAAGGTTCG GCAACCGACG
401 AAACCCTGCT CGACAACGAA TACATCGACG AAATCGACGT ATTCTGCGCC
451 CTGACCAACG ACGACGAAAG CAACATTATG TCCGCCCTTT TGGCGAAAAA
```

-continued

```
501 CCTCGGCGCG AAGCGCGTCA TCGGCATCGT CAACCGCTCA AGCTACGTCG

551 ATTTGCTCGA AGGCAACAAA ATCGACATCG TCGTCTCCCC CCACCTCATC

601 ACCATCGGCT CGATACTCGC CCACATCCGG CGCGGCGACA TCGTTGCCGT

651 CCACCCCATC CGGCGCGGCA CGGCGGAAGC CATCGAAGTC GTCGCACACG

701 GCGACAAAAA AACTTCCGCC ATCATCGGCA GGCGCATCAG CGGCATCAAA

751 TGGCCCGAAG GCTGCCACAT TGCCGCCGTC GTCCGCGCCG GAACCGGCGA

801 AACCATTATG GGACACCATA CCGAAACCGT CATCCAAGAC GGCGACCACA

851 TCATCTTTTT CGTCTCGCGC CGGCGCATCC TGAACGAACT GGAAAAACTC

901 ATCCAAGTCA AAATGGGCTT TTTCGGATAA
```

This corresponds to the amino acid sequence <SEQ ID 198; ORF 047.a>:

a047.pep

```
  1 MVIIQARRGG LLVGRSIADI AQDLPDGADC QICAVYRNNR LIVPAPQTVI

 51 IEGDEILFAA AAENIGAVIP ELRPKETSTR RIMIAGGGNI GYRLAKQLEH

101 AYNVKIIECR PRRAEWIAEN LDNTLVLQGS ATDETLLDNE YIDEIDVFCA

151 LTNDDESNIM SALLAKNLGA KRVIGIVNRS SYVDLLECNK IDIVVSPHLI

201 TIGSILAHIR RGDIVAVHPI RRGTAEAIEV VAHGDKKTSA IIGRRISGIK

251 WPEGCHIAAV VRAGTGETIM GHHTETVIQD GDHIIFFVSR RRILNELEKL

301 IQVKMGFFG*
```

m047/a047 96.5% identity over a 312 aa overlap

```
                   10        20        30        40        50        60
m047.pep   MVIIQARXXGXLVGRSIADIAQDLPDGADCQICAVYRNNRLIVPAPQTVIIEGDEILFAA
           |||||||  |  |||||||||||||||||||||||||||||||||||||||||||||||||
a047       MVIIQARRGGLLVGRSIADIAQDLPDGADCQICAVYRNNRLIVPAPQTVIIEGDEILFAA
                   10        20        30        40        50        60

                   70        80        90       100       110       120
m047.pep   AAENIGAVIPELRPKETQRNQPXXIMIXGGGNIGYRLAKQLEHAYNVKIIECRPRRAEWI
           |||||||||||||||||:  :   ||| ||||||||||||||||||||||||||||||||
a047       AAENIGAVIPELRPKETSTRR---IMIAGGGNIGYRLAKQLEHAYNVKIIECRPRRAEWI
                   70        80           90       100       110

                  130       140       150       160       170       180
m047.pep   AENLDNTLVLQGSATDETLLDNEYIDEIDVFCALTNDDESNIMSALLAKNLGAKRVIGIV
           ||||||||||||||||||||||||||||||||||||||||||||||||||||||||||||
a047       AENLDNTLVLQGSATDETLLDNEYIDEIDVFCALTNDDESNIMSALLAKNLGAKRVIGIV
           120       130       140       150       160       170

                  190       200       210       220       230       240
m047.pep   NRSSYVDLLEGNKIDIVVSPHLITIGSILAHIRRGDIVAVHPIRRGTAEAIEVVAHGDKK
           ||||||||||||||||||||||||||||||||||||||||||||||||||||||||||||
a047       NRSSYVDLLEGNKIDIVVSPHLITIGSILAHIRRGDIVAVHPIRRGTAEAIEVVAHGDKK
           180       190       200       210       220       230

                  250       260       270       280       290       300
m047.pep   TSAIIGRRISGIKWPEGCHIAAVVRAGTGETIMGHHTETVIQDGDHIIFFVSRRRILNEL
           ||||||||||||||||||||||||||||||||||||||||||||||||||||||||||||
a047       TSAIIGRRISGIKWPEGCHIAAVVRAGTGETIMGHHTETVIQDGDHIIFFVSRRRILNEL
           240       250       260       270       280       290

                  310
m047.pep   EKLIQVKMGFFGX
           |||||||||||||
a047       EKLIQVKMGFFGX
           300       310
```

Computer analysis of this amino acid sequence gave the following results:

Homology with a predicted ORF from *N. gonorrhoeae*

ORF 047 shows 96.2% identity over a 312 aa overlap with a predicted ORF (ORF 047.ng) from *N. gonorrhoeae*:

```
m047/g045

m047.pep  MVIIQARXXGXLVGRSIADIAQDLPDGADCQICAVYRNNRLIVPAPQTVIIEGDEILFAA   60
          |||||||  | ||||||||||||||||||||||||||||||||||||||||||||||||||
g047      MVIIQARRGGLLVGRSIADIAQDLPDGADCQICAVYRNNRLIVPAPQTVIIEGDEILFAA   60

m047.pep  AAENIGAVIPELRPKETQRNQPXXIMIXGGGNIGYRLAKQLEHAYNVKIIECRPRRAEWI  120
          |||||||||||||||||:  :   ||| ||||| ||||||||||||||||||||||||||
g047      AAENIGAVIPELRPKETSTRR---IMIAGGGNICYRLAKQLEHAYNVKIIECRPRRAEWI  117
m047.pep  AENLDNTLVLQGSATDETLLDNEYIDEIDVFCALTNDDESNIMSALLAKNLGAKRVIGIV  180
          ||||||||||||||||||||||||||||||||||||||||||||||||||||||||||||
g047      AENLDNTLVLQGSATDETLLDNEYIDEIDVFCALTNDDESNIMSALLAKNLGAKRVIGIV  177
m047.pep  NRSSYVDLLEGNKIDIVVSPHLITIGSILAHIRRGDIVAVHPIRRGTAEAIEVVAHGDKK  240
          ||||||||||||||||||||||||||||||||||||||||||||||||||||||||||||
g047      NRSSYVDLLEGNKIDIVVSPHLITIGSILAHIRRGDIVAVHPIRRGTAEAIEVVAHGDKK  237
m047.pep  TSAIIGRRISGIKWPEGCHIAAVVRAGTGETIMGHHTETVIQDGDHIIFFVSRRRILNEL  300
          ||||||||||||||||||||||||||||||||||||||||||||||||||||||||||||
g047      TSAIIGRRISGIKWPEGCHIAAVVRAGTGETIMGHHTETVIQDGDHIIFFVSRRRILNEL  297
m047.pep  EKLIQVKMGFFGX  313
          ||||||||||||
g047      EKLIQVKMGFFGX  310
```

The following partial DNA sequence was identified in *N. gonorrhoeae* <SEQ ID 199>:

```
g048.seq

  1 ATGCTCGACA AAGGCGAGGA GTTGCCCGTC GATTTCACCA ACCGCCTGAT

 51 TTACTACGTc ggcCCcgTCG ATCCGGTCGG CGATGAAGTC GTCGGTCCCG

101 CAGGTCCGAC CACAGCCACC CGCATGGACA AATTTACCCG CCAAATGCTC

151 AAACAAACCG GCCTCTTGGG CATGATCGGC AAATCCGagc gcgGcgcggc

201 cacctGCGAA GCcatCGCCG ACAACAAGGC CGTGTACCTC ATGGCAGTCG

251 GCGGCGCGGC ATACCTCGTG GCAAAAGCCA TCAAATCTTC CAAAGTCTTG

301 GCGTTCCCCG AATTGGGTAT GGAAGCCGTT TACGAATTTG AAGTCAAAGA

352 TATGCCCGTA ACCGTCGCCG TGGACAGCAA AGGCGAATCC ATCCACGCCA

401 CCGCCCCGCG CAAATGGCAG GCGAAAATCG GCATCATCCC CGTCGAGTCT

451 TGA
```

This corresponds to the amino acid sequence <SEQ ID 200; ORF 048.ng>:

```
g048.pep

  1 MLDKGEELPV DFTNRLIYYV GPVDPVGDEV VGPAGPTTAT RMDKFTRQML

 51 KQTGLLGMIG KSERGAATCE AIADNKAVYL MAVGGAAYLV AKAIKSSKVL

101 AFPELGMEAV YEFEVKDMPV TVAVDSKGES IHATAPRKWQ AKIGIIPVES

151 *
```

The following partial DNA sequence was identified in *N. meningitidis* <SEQ ID 201>:

m048.seq

```
  1 ATGCTCAACA AAGGCGAAGA ATTGCCCGTC GATTTCACCA ACCGCCTGAT
 51 TTACTACGTC GGCCCCGTCG ATCCGGTCGG CGATGAAGTC GTCGGTCCGG
101 CAGGTCCGAC CACAGCCACC CGCATGGACA AATTCACCCG CCAAATGCTC
151 GAACAAACCG ACCTCTTGGG CATGATCGGC AAATCCGAGC GCGGCGTGGC
201 CACCTGCGAA GCCATCGCCG ACAACAAAGC CGTGTACCTC ATGGCAGTCG
251 GCGGCGCGGC GTATCTCGTG GCAAAAGCCA TCAAATCTTC CAAAGTCTTG
351 CATGCCCGTA ACCGTCGCCG TAGATAGCAA AGGCGAATCC ATCCACGCCA
401 CCGCCCCGCG CAAATGGCAG GCGAAAATCG GCATCATCCC CGTCGAATCT
451 TGA
```

This corresponds to the amino acid sequence <SEQ ID 202; ORF 048>:

m048.pep

```
  1 MLNKGEELPV DFTNRLIYYV GPVDPVGDEV VGPAGPTTAT RMDKFTRQML
 51 EQTDLLGMIG KSERGVATCE AIADNKAVYL MAVGGAAYLV AKAIKSSKVL
101 AFPELGMEAI YEFEVKDMPV TVAVDSKGES IHATAPRKWQ AKIGIIPVES
151 *
```

The following partial DNA sequence was identified in *N. meningitidis* <SEQ ID 203>:

a048.seq

```
  1 ATGCTCGACA AAGGCGAAGA ATTGCCCGTC GATTTCACCA ACCGCCTGAT
 51 TTACTACGTC GGCCCCGTCG ATCCGGTCGG CGACGAAATC GTCGGCCCAG
101 CAGGTCCGAC CACCGCCACC CGCATGGACA AATTCACCCC CCAAATGCTC
151 GAACAAACCG ACCTCTTGGG CATGATCGGC AAATCCGAGC GCGGCGCGGC
201 CACCTGCGAA GCCATCGCCG ACAACAAAGC CGTGTACCTC ATGGCAGTCG
251 GCGGCGCGGC GTATCTCGTG GCAAAAGCCA TCAAATCTTC CAAAGTCTTG
301 CCGTTCCCCG AATTGGGCAT GGAAGCCATT TACGAATTTG AAGTCAAAGA
351 CATGCCCGTA ACCGTCGCCG TAGACAGCAA AGGCGAATCC ATCCACGCCA
401 CCGCCCCGCC CCAATGGCAG GCGAAAATCG GCATCATCCC CGTCAAATCT
451 TGA
```

This corresponds to the amino acid sequence <SEQ ID 204; ORF 048.a>:

a048.pep

```
  1 MLDKGEELPV DFTNRLIYYV GFVDPVGDEI VGPAGPTTAT RMDKFTRQML
 51 EQTDLLGMIG KSERGAATCE AIADNKAVYL MAVGGAAYLV AKAIKSSKVL
101 AFPELGMEAI YEFEVKDMPV TVAVDSKGES IHATAPPQWQ AKIGIIPVKS
151 *
```

m048/a048 96.0% identity over a 150 aa overlap

```
                    10        20        30        40        50        60
m048.pep    MLNKGEELPVDFTNRLIYYVGPVDPVGDEVVGPAGPTTATRMDKFTRQMLEQTDLLGMIG
            ||:||||||||||||||||||||||||||:||||||||||||||||||||||||||||||
a048        MLDKGEELPVDFTNRLIYYVGPVDPVGDEIVGPAGPTTATRMDKFTRQMLEQTDLLGMIG
                    10        20        30        40        50        60
                    70        80        90       100       110       120
m048.pep    KSERGVATCEAIADNKAVYLMAVGGAAYLVAKAIKSSKVLAFPELGMEAIYEFEVKDMPV
            |||||:||||||||||||||||||||||||||||||||||||||||||||||||||||||
a048        KSERGAATCEAIADNKAVYLMAVGGAAYLVAKAIKSSKVLAFPELGMEAIYEFEVKDMPV
                    70        80        90       100       110       120
                   130       140       150
m048.pep    TVAVDSKGESIHATAPRKWQAKIGIIPVESX
            |||||||||||||||| :||||||||||:||
a048        TVAVDSKGESIHATAPPQWQAKIGIIPVKSX
                   130       140       150
```

Computer analysis of this amino acid sequence gave the following results:

Homology with a predicted ORF from *N. gonorrhoeae*

ORF 048 shows 96.4% identity over a 150 aa overlap with a predicted ORF (ORF 048.ng) from *N. gonorrhoeae*:

m048/g048

```
                    10        20        30        40        50        60
m048.pep    MLNKGEELPVDFTNRLIYYVGPVDPVGDEVVGPAGPTTATRMDKFTRQMLEQTDLLGMIG
            ||:||||||||||||||||||||||||||||||||||||||||||||||:|| ||||||
g048        MLDKGEELPVDFTNRLIYYVGPVDPVGDEVVGPAGPTTATRMDKFTRQMLKQTGLLGMIG
                    10        20        30        40        50        60

                    70        80        90       100       110       120
m048.pep    KSERGVATCEAIADNKAVYLMAVGGAAYLVAKAIKSSKVLAFPELGMEAIYEFEVKDMPV
            |||||:|||||||||||||||||||||||||||||||||||||||||||:||||||||||
g048        KSERGAATCEAIADNKAVYLMAVGGAAYLVAKAIKSSKVLAFPELGMEAVYEFEVKDMPV
                    70        80        90       100       110       120
                   130       140       150
m048.pep    TVAVDSKGESIHATAPRKWQAKIGIIPVESX
            |||||||||||||||||||||||||||||||
g048        TVAVDSKGESIHATAPRKWQAKIGIIPVESX
                   130       140       150
```

The following partial DNA sequence was identified in *N. gonorrhoeae* <SEQ ID 205>:

g049.seq

```
  1 ATGCGGGCGC AGGCGTTTGA TCAACCGTTC GGTCAGCTCC TGTTCGGACA
 51 GGCAGAACAC TTCGCGCCGG TTGACGGCTT TCGGGTTCAG GATATTGATT
101 TGGACGGGCA TCAACGCCTC TTCCGCACCG CCTTCGCCGT TTTCCGCAAC
151 CCCGTCTGCC GCCGTACCGG ATTCTGCCGC ATCGGCGTTT TCCCCGCCCT
201 CAATCTGTGC GGTTTCAAAT TCGGCACTGT CTTTTTTGGC ATCGAACCGG
251 ATTCTCCGCC GCGATTCGAT GTGTTTTTCC GAAAccggca tTTGCAGGGA
301 AGCCTgcgcg TTGAGCCAGT TTTCCTGAAG GACGATCATC GGGTCGGTTT
351 CGACTTCCTC GCCGCAATCG GCAACGGCgc tGTTGTGTTC TTCCTGCCAT
401 TTCTTCAGAT ACGCCTTTAA
```

This corresponds to the amino acid sequence <SEQ ID 206; ORF 049.ng>:

g049.pep

```
  1 MRAQAFDQPF GQLLFGQAEH FAPVDGFRVQ DIDLDGHQRL FRTAFAVFRN
 51 PVCRRTGFCR IGVFPALNLC GFKFGTVFFG IEPDSPPRFD VFFRNRHLQG
101 SLRVEPVFLK DDHRVGFDFL AAIGNGAVVF FLPFLQIRL*
```

The following partial DNA sequence was identified in *N. meningitidis* <SEQ ID 207>:

m049.seq (partial)

```
  1 ATGCGGGCGC AGGCGTTTGA TCAGCCGTTC GGTCAGCTCC TGTTCGGACA
 51 GGCAGAACAC TTCGCGCCGG TTGACGGCTT TCGGGTTCAG GATATTGATT
101 TGGACGGGCA TCAACGTTTC TTCCGCATCG TTTTCCCCGT TTTCCGAAAC
151 CGCCGGCTCA TTCGTGCCGG ATTCTGCCTC GTCGGCGTTT TCCCCGCTTT
201 CAATCTGTCC GGTTTCAAAT TCGACACTGT CTTTTTTGGT ATCAAACCGG
251 ATTCTCCGCC GCGATTCGAT GTGTTTTTCC GAAACCGACA TTTGCAGGGA
301 AGCCTGCGCG TTGAGCCAGT TTTCCTGAAG GACGATCATC GGGTCGGTTT
351 CGACTTCCTC GCCGCAATCG GCAACGGCGG CATTGTGTTC CTCCTGCCAT
401 TTTTTCAGAT ACGCCTT...
```

This corresponds to the amino acid sequence <SEQ ID 208; ORF 049>:

m049.pep (partial)

```
  1 MRAQAFDQPF GQLLFGQAEH FAPVDGFRVQ DIDLDGHQRF FRIVFPVFRN
 51 RRLIRAGFCL VGVFPAFNLS GFKFDTVFFG IKPDSPPRFD VFFRNRHLQG
101 SLRVEPVFLK DDHRVGFDFL AAIGNGGIVF LLPFFQIRL...
```

The following partial DNA sequence was identified in *N. meningitidis* <SEQ ID 209>:

a049.seq

```
  1 ATGCGGGCGC AGGCGTTTGA TCAGCCGTTC GGTCAGCTCC TGTTCGGACA
 51 GGCAGAACAC TTCGCGCCGG TTGACGGCTT TCGGGTTCAG AATATTGATT
101 TGGACGGGCA TCAACGCTTC TTCCGCACCG CCTTCGCCGT TTTCCGCAAC
151 CCCGTCTGCC GCCGTACCCG ATTCTGCCGC ATCGGCGTTT TCCCCGCCTT
201 CAATCTGTCC GGTTTCAAAT TCGGCACTGT CTTTTTTGGC ATCAAACCGG
251 ATTCTCCGCC GCGATTCGAT GTGTTTTTCC GAAACCGACA TTTGCAGGGA
301 AGCCTGCGCG TTGAGCCAGT TTTCCTGAAG GACGATCATC GGGTCGGTTT
351 CGACTTCCTC GCCGCAATCG GCAACGGCGG CATTGTGTTC CTCCTGCCAT
401 TTTTTCAGAT ACGCCTT
```

This corresponds to the amino acid sequence <SEQ ID 210; ORF 049.a>:

a049.pep

```
  1 MRAQAFDQPF GQLLFGQAEH FAPVDGFRVQ NIDLDGHQRF FRTAFAVFRN
 51 PVCRRTRFCR IGVFPAFNLS GFKFGTVFFG IKPDSPPRFD VFFRNRHLQG
101 SLRVEPVFLK DDHRVGFDFL AAIGNGGIVF LLPFFQIRL
```

m049/a049 90.6% identity over a 139 aa overlap

```
                   10        20        30        40        50        60
m049.pep   MRAQAFDQPFGQLLFGQAEHFAPVDGFRVQDIDLDGHQRFFRIVFPVFRNRRLIRAGFCL
           ||||||||||||||||||||||||||||||:||||||||||| :| ||||    |: ||
a049       MRAQAFDQPFGQLLFGQAEHFAPVDGFRVQNIDLDGHQRFFRTAFAVFRNPVCRRTRFCR
                   10        20        30        40        50        60
                   70        80        90       100       110       120
m049.pep   VGVFPAFNLSGFKFDTVFFGIKPDSPPRFDVFFRNRHLQGSLRVEPVFLKDDHRVGFDFL
           :||||||||||||| |||||||||||||||||||||||||||||||||||||||||||||
a049       IGVFPAFNLSGFKFGTVFFGIKPDSPPRFDVFFRNRHLQGSLRVEPVFLKDDHRVGFDFL
                   70        80        90       100       110       120
                  130       139
m049.pep   AAIGNGGIVFLLPFFQIRL
           |||||||||||||||||||
a049       AAIGNGGIVFLLPFFQIRL
                  130
```

Computer analysis of this amino acid sequence gave the following results:

Homology with a predicted ORF from *N. gonorrhoeae*

ORF 049 shows 86.3% identity over a 139 aa overlap with a predicted ORF (ORF 049.ng) from *N. gonorrhoeae*:

m049/g049

```
                   10        20        30        40        50        60
m049.pep   MRAQAFDQPFGQLLFGQAEHFAPVDGFRVQDIDLDGHQRFFRIVFPVFRNRRLIRAGFCL
           |||||||||||||||||||||||||||||||||||||||:|| :| ||||    |:|||
g049       MRAQAFDQPFGQLLFGQAEHFAPVDGFRVQDIDLDGHQRLFRTAFAVFRNPVCRRTGFCR
                   10        20        30        40        50        60
                   70        80        90       100       110       120
m049.pep   VGVFPAFNLSGFKFDTVFFGIKPDSPPRFDVFFRNRHLQGSLRVEPVFLKDDHRVGFDFL
           :|||||:|| |||| ||||||:||||||||||||||||||||||||||||||||||||||
g049       IGVFPALNLCGFKFGTVFFGIEPDSPPRFDVFFRNRHLQGSLRVEPVFLKDDHRVGFDFL
                   70        80        90       100       110       120
                  130       139
m049.pep   AAIGNGGIVFLLPFFQIRL
           ||||||::||:|||:||||
g049       AAIGNGAVVFFLPFLQIRLX
                  130       140
```

The following partial DNA sequence was identified in *N. gonorrhoeae* <SEQ ID 211>:

g050.seq

```
  1 atgggcgCGG GCTGGTGTCC TCCCGGCATC TTGGGCATCG GCATCGGCGg
 51 cacgcccGAA AAAGccgtgt TGATGGCaaA AGAATCCCTG ATGAGCCACA
101 TCGAcatCca aGaATTGCAG GAAAAAGCCG CGTccggggc ggaattgtcc
151 accaccgaAG ccCTGCGCCT cGAACTCTTT GAAAAGGTCA ACGCGCTGGG
201 CATCGGCGCG CAAGGCTTGG GCGGTCTGAC CACCGTGTTG GACGTGAAAA
251 TCCTCGATTA CCCGACCCAT GCCGCCTCCA AACCGATTGC CATGATTCCC
```

-continued

```
301 AACTGTGCcg ccacCCGcca cgtcgAATTT GAATTGgACG GCTCAGGtcc
351 TGTCGAactc acgccGCcgc gtgtCGAAGA CTGA
```

This corresponds to the amino acid sequence <SEQ ID 212; ORF 050.ng>:

g050.pep

```
  1 MGAGWCPPGI LGIGIGGTPE KAVLMAKESL MSHIDIQELQ EKAASGAELS
 51 TTEALRLELF EKVNALGIGA QGLGGLTTVL DVKILDYPTH AASKPIAMIP
101 NCAATRHVEF ELDGSGPVEL TPPRVED*
```

The following partial DNA sequence was identified in *N. meningitidis* <SEQ ID 213>:

m050.seq

```
  1 ATGGGCGCGG GCTGGTGTCC TCCCGGCATC TTGGGTATCG GCATCGGCGG
 51 C..agCCgAA AAAGCCGTGC TGATGGCAAA AGAGTCCCTG ATGAGCCACA
101 TCGACATTCA AGAATTGCAG GAAAAGGCCG CGTCCGGCGC GgAATTGTCC
151 ACCACCGAAG CCCTGCGCCT CGAACTCTTT GAAAAAGTCA ACGCGCTGGG
201 CATCGGCGCA CAAGGCTTGG GCGGACTGAC CACCGTGTTG GACGTGAAAA
251 TCCTCGATTA TCCGACCCAC GCCGCCTCCA AACCGATTGC CATGATTCCG
301 AACTGCGCCG CCACCCGCCA CGTCGAATTT GAATTGGACG GCTCAGGCCC
351 TGTCGAACTC ACGCCGCCGC GCGTCGAAGA TGGCCCGATT TGA
```

This corresponds to the amino acid sequence <SEQ ID 214; ORF 050>:

m050.pep

```
  1 MGAGWCPPGI LGIGIGGXAE KAVLMAKESL MSHIDIQELQ EKAASGAELS
 51 TTEALRLELF EKVNALGIGA QGLGGLTTVL DVKILDYPTH AASKPIAMIP
101 NCAATRHVEF ELDGSGPVEL TPPRVEDGPI *
```

The following partial DNA sequence was identified in *N. meningitidis* <SEQ ID 215>:

a050.seq

```
  1 ATGGGCGCGG GCTGGTGTCC TCCCGGCATC TTGGGCATCG GCATCGGCGG
 51 TACGCCCGAA AAAGCCGTGT TGATGGCGAA AGAATCCCTG ATGAGCCACA
101 TCGACATCCA AGAATTGCAG GAAAAAGCCG CGTCCGGCGC GGAATTGTCC
151 ACCACCGAAG CCCTGCGCCT CGAACTCTTT GAAAAAGTCA ACGCGCTAGG
201 CATCGGCGCG CAAGGCTTGG GCGGTCTGAC CACCGTGTTG GACGTGAAAA
251 TCCTCGATTA CCCGACCCAC GCCGCCTCCA AACCGATTGC CATGATTCCG
```

-continued

```
301 AACTGCGCCG CCACCCGCCA CGTCGAATTT GAATTGGACG GCTCAGGCCC

351 TGTCGAACTC ACGCCGCCGC GCGTCGAAGA CTGGCCC
```

This corresponds to the amino acid sequence <SEQ ID 216; ORF 050.a>:

a050.pep

```
  1 MGAGWCPPGI LGIGIGGTPE KAVLMAKESL MSHIDIQELQ EKAASGAELS

 51 TTEALRLELF EKVNALGIGA QGLGGLTTVL DVKILDYPTH AASKPIAMIP

101 NCAATRHVEF ELDGSGPVEL TPPRVEDWP
```

m050/a050 97.7% identity over a 129 aa overlap

```
                  10        20        30        40        50        60
m050.pep  MGAGWCPPGILGIGIGGXAEKAVLMAKESLMSHIDIQELQEKAASGAELSTTEALRLELF
          |||||||||||||||||: |||||||||||||||||||||||||||||||||||||||||
a050      MGAGWCPPGILGIGIGGTPEKAVLMAKESLMSHIDIQELQEKAASGAELSTTEALRLELF
                  10        20        30        40        50        60
                  70        80        90       100       110       120
m050.pep  EKVNALGIGAQGLGGLTTVLDVKILDYPTHAASKPIAMIPNCAATRHVEFELDGSGPVEL
          ||||||||||||||||||||||||||||||||||||||||||||||||||||||||||||
a050      EKVNALGIGAQGLGGLTTVLDVKILDYPTHAASKPIAMIPNCAATRHVEFELDGSGPVEL
                  70        80        90       100       110       120
                 130
m050.pep  TPPRVEDGPIX
          ||||||| |
a050      TPPRVEDWP
```

Computer analysis of this amino acid sequence gave the following results:

Homology with a predicted ORF from *N. gonorrhoeae*

ORF 050 shows 98.4% identity over a 127 aa overlap with a predicted ORF (ORF 050.ng) from *N. gonorrhoeae*:

m050/g050

```
                  10        20        30        40        50        60
m050.pep  MGAGWCPPGILGIGIGGXAEKAVLMAKESLMSHIDIQELQEKAASGAELSTTEALRLELF
          |||||||||||||||||: |||||||||||||||||||||||||||||||||||||||||
g050      MGAGWCPPGILGIGIGGTPEKAVLMAKESLMSHIDIQELQEKAASGAELSTTEALRLELF
                  10        20        30        40        50        60
                  70        80        90       100       110       120
m050.pep  EKVNALGIGAQGLGGLTTVLDVKILDYPTHAASKPIAMIPNCAATRHVEFELDGSGPVEL
          ||||||||||||||||||||||||||||||||||||||||||||||||||||||||||||
g050      EKVNALGIGAQGLGGLTTVLDVKILDYPTHAASKPIAMIPNCAATRHVEFELDGSGPVEL
                  70        80        90       100       110       120
                 130
m050.pep  TPPRVEDGPIX
          |||||||
g050      TPPRVEDX
```

The following partial DNA sequence was identified in *N. gonorrhoeae* <SEQ ID 217>:

g050-1.seq

```
  1 ATGACCGTTA TCAAGCAAGA AGACTTTATT CAAAGTATCT GCGATGCCTT

 51 CCAATTCATC AGCTACTACC ATCCAAAAGA CTACATCGAC GCGCTTTATA

101 AGGCGTGGCA GAAGGAAGAA AATCCCGCCG CCAAAGACGC GATGACGCAG
```

-continued

```
 151 ATTTTGGTCA ACAGCCGTAT GTGTGCCGAA AACAACCGCC CCATCTGCCA
 201 AGACACAGGT ATCGCAACCG TCTTCCTCAA AGTCGGTATG GATGTGCAAT
 251 GGGATGCGGA CATGAGCGTG GAAAAGATGG TTAACGAAGG CGTACGCCGC
 301 GCCTACACTT GGGAAGGCAA CACCCTGCGC GCTTCCGTCC TCGCCGATCC
 351 GGCCGGCAAA CGCCAAAACA CCAAAGACAA CACCCCCGCC GTCATCCACA
 401 TGAGCATCGT GCCGGGCGGT AAAGTCGAAG TAACCTGCGC GGCAAAAGGC
 451 GGCGGCTCTG AAAACAAATC CAAACTCGCT ATGCTCAACC CTTCCGACAA
 501 CATCGTCGAT TGGGTATTGA AAACCATCCC GACGATGGGC GCGGGCTGGT
 551 GTCCTCCCGG CATCTTGGGC ATCGGCATCG GCGGCAcgcC CGAAAAAGCC
 601 GTGTTGATGG cgaAAGAATC CCTGATGAGC CACATCGACA TCCAAGAATT
 651 GCAGGAAAAA GCCGCGTCCG GCGCGGAATT GTCCACCACC GAAGCCCTGC
 701 GCCTCGAACT CTTTGAAAAG GTCAACGCGC TGGGCATCGG CGCGCAAGGC
 751 TTGGGCGGTC TGACCACCGT GTTGGACGTG AAAATCCTCG ATTACCCGAC
 801 CCATGCCGCC TCCAAACCGA TTGCCATGAT TCCCAACTGT GCCGCCACCC
 851 GCCACGTCGA ATTTGAATTG GACGGCTCAG GTCCTGTCGA ACTCACGCCG
 901 CCGCGCGTCG AAGACTGACC CGATCTGACT TACAGCCCCG ACAACGGCAA
 951 ACGCGTCGAT GTCGATAAGC TGACCAAAGA AGAAGTGGCA AGCTGGAAAA
1001 CCGGCGACGT ATTGCTGTTG AACGGCAAAA TCCTCACCGG CCGCGATGCC
1051 GCGCACAAAC GCCTCGTCAA TATGCTCGAC AAAGGCGAGG AGTTGCCCGT
1101 CGATTTCACC AACCGCCTGA TTTACTACGT CGGCCCCGTC GATCCGGTCG
1151 GCGATGAAGT CGTCGGTCCC GCAGGTCCGA CCACAGCCAC CCGCATGGAC
1201 AAATTTACCC GCCAAATGCT CAAACAAACC GGCCTCTTGG GCATGATCGG
1251 CAAATCCGAG CGCGGCGCGG CCACCTGCGA AGCCATCGCC GACAACAAGG
1301 CCGTGTACCT CATGGCAGTC GGCGGCGCGG CATACCTCGT GGCAAAAGCC
1351 ATCAAATCTT CCAAAGTCTT GGCGTTCCCC GAATTGGGTA TGGAAGCCGT
1401 TTACGAATTT GAAGTCAAAG ATATGCCCGT AACCGTCGCC GTGGACAGCA
1451 AAGGCGAATC CATCCACGCC ACCGCCCCGC GCAAATGGCA GGCGAAAATC
1501 GGCATCATCC CCGTCGAGTC TTGA
```

This corresponds to the amino acid sequence <SEQ ID 218; ORF 050-1.ng>:

g050-1.pep

```
  1 MTVIKQEDFI QSICDAFQFI SYYHPKDYID ALYKAWQKEE NPAAKDAMTQ
 51 ILVNSRMCAE NNRPICQDTG IATVFLKVGM DVQWDADMSV EKMVNEGVRR
101 AYTWEGNTLR ASVLADPAGK RQNTKDNTPA VIHMSIVPGG KVEVTCAAKG
151 GGSENKSKLA MLNPSDNIVD WVLKTIPTMG AGWCPPGILG IGIGGTPEKA
201 VLMAKESLMS HIDIQELQEK AASGAELSTT EALRLELFEK VNALGIGAQG
251 LGGLTTVLDV KILDYPTHAA SKPIAMIPNC AATRHVEFEL DGSGPVELTP
301 PRVED*PDLT YSPDNGKRVD VDKLTKEEVA SWKTGDVLLL NGKILTGRDA
```

-continued

```
351 AHKRLVNMLD KGEELPVDFT NRLIYYVGPV DPVGDEVVGP AGPTTATRMD

401 KFTRQMLKQT GLLGMIGKSE RGAATCEAIA DNKAVYLMAV GGAAYLVAKA

451 IKSSKVLAFP ELGMEAVYEF EVKDMPVTVA VDSKGESIHA TAPRKWQAKI

501 GIIPVES*
```

g050-1/p14407 sp|P14407|FUMB_ECOLI FUMARATE HYDRATASE CLASS I, ANAEROBIC (FUMARASE) >gi|280063|pir||B44511 fumarate hydratase (EC 4.2.1.2) fumB, iron-dependent-*Escherichia coli* >gi|146048 (M27058) anaerobic class I fumarase (EC 4.2.1.2) [*Escherichia coli*] Length=548

Score=172 bits (432), Expect=4e−42

Identities=138/488 (28%), Positives=216/488 (43%), Gaps=22/488 (4%)

```
Query:  11 QSICDAFQFISYYHPKDYIDALYKAWQKEENPAAKDAMTQILVNSRMCAENNRPICQDTG  70
           Q+  DA   +   H K     L+     E +   K    Q L NS + A+   P CQDTG
Sbjct:  53 QAFHDASFMLRPAHQKQVAAILHDPEASEND---KYVALQFLRNSEIAAKGVLPTCQDTG  109

Query:  71 IATVFLKVGMDVQWDADMSVEKMVNEGVRRAYTWEGNTLRASVLADPAGKRQNTKDNTPA  130
            A+   K G  V W      E+ +++GV   Y  E N    +  A    K  NT  N PA
Sbjct: 110 TAIIVGKKGQRV-WTGGGD-EETLSKGVYNTYI-EDNLRYSQNAALDMYKEVNTGTNLPA  166

Query: 131 VIHMSIVPGGKVEVTCAAKGGGSENKSKL-----AMLNPSDNIVDWVLKTIPTMGAGWCP  185
            I +  V G + +  C AKGGGS NK+ L     A+L P   + +++++ + T+G   CP
Sbjct: 167 QIDLYAVDGDEYKFLCVAKGGGSANKTYLYQETKALLTPG-KLKNFLVEKMRTLGTAACP  225

Query: 186 PXXXXXXXXXTPEKAVLMAKESLMSHIDIQELQEKAASGAELSTTEALRLELFEKVNXXX  245
           P         T  +  L   +   +H    EL  +     +      L  EL E+
Sbjct: 226 PYHIAFVIGGTSAETNLKTVKLASAHY-YDELPTEGNEHGQAFRDVQLEQELLEEAQKLG  284

Query: 246 XXXXXXXXXTTVLDVKILDYPTHAASKPIAMIPNCAATRHVEFELDGSG----PVELTPP  301
                        D++++  P H AS P+ M  +C+A R+++ +++  G     +E  P
Sbjct: 285 LGAQFGGKYFAH-DIRVIRLPRHGASCPVGMGVSCSADRNIKAKINREGIWIEKLEHNPG  343

Query: 302 RVEDXPDLTYSPDNGKRVDVDKLTKE---EVASWKTGDVLLLNGKILTGRDAAHKRLVNM  358
           +               +VD+++  KE   +++ +     L L G I+ GRD AH +L  +
Sbjct: 344 QYIPQELRQAGEGEAVKVDLNRPMKEILAQLSQYPVSTRLSLTGTIIVGRDIAHAKLKEL  403

Query: 359 LDKGEELPVDFTNRLIYYXXXXXXXXXXXXXXXXXTTATRMDKFTRQMLKQTGLLGMIGK  418
           +D G+ELP    +  IYY                 TTA RMD +   +    G + M+ K
Sbjct: 404 IDAGKELPQYIKDHPIYYAGPAKTPAGYPSGSLGPTTAGRMDSYVDLLQSHGGSMIMLAK  463

Query: 419 SERGAATCEAIADNKAVYLMAVGG-AAYLVAKAIKSSKVLAFPELGMEAVYEFEVKDMPV  477
             R     +A   +   YL ++GG AA L  ++IK  + +A+PELGMEA+++ EV+D P
Sbjct: 464 GNRSQQVTDACHKHGGFYLGSIGGPAAVLAQQSIKHLECVAYPELGMEAIWKIEVEDFPA  523

Query: 478 TVAVDSKG  485
            + VD KG
Sbjct: 524 FILVDDKG  531
```

The following partial DNA sequence was identified in *N. meningitidis* <SEQ ID 219>:

m050-1.seq

```
  1 ATGACCGTCA TCAAACAGGA AGACTTTATC CAAAGCATTT GCGATGCCTT

 51 CCAATTCATC AGCTACTATC ATCCCAAAGA CTACATCGAC GCGCTTTATA

101 AGGCGTGGCA GAAGGAAGAA AATCCTGCCG CCAAAGACGC GATGACGCAG

151 ATTTTGGTCA ACAGCCGTAT GTGTGCGGAA AACAACCGCC CCATCTGCCA

201 AGACACAGGT ATCGCAACCG TCTTCCTCAA AGTCGGTATG AACGTCCAAT

251 GGGATGCGGA CATGAGCGTG GAAGAGATGG TTAACGAAGG CGTACGCCGC

301 GCCTACACTT GGGAAGGCAA TACGCTGCGC GCTTCCGTCC TCGCCGATCC
```

-continued

```
 351 GGCCGGCAAA CGCCAAAACA CCAAAGACAA CACCCCCGCC GTCATCCATA

 401 TGAGCATCGT GCCGGGCGGT AAAGTCGAAG TAACCTGCGC GGCAAAAGGC

 451 GGCGGCTCTG AAAACAAATC CAAACTCGCC ATGCTCAATC CTTCCGACAA

 501 CATCGTCGAT TGGGTATTGA AAACCATCCC GACCATGGGC GCGGGCTGGT

 551 GTCCTCCCGG CATCTTGGGT ATCGGCATCG GCGGCACGCC CGAAAAAGCC

 601 GTGCTGATGG CAAAAGAGTC CCTGATGAGC CACATCGACA TTCAAGAATT

 651 GCAGGAAAAG GCCGCGTCCG GCGCGGAATT GTCCACCACC GAAGCCCTGC

 701 GCCTCGAACT CTTTGAAAAA GTCAACGCGC TGGGCATCGG CGCACAAGGC

 751 TTGGGCGGAC TGACCACCGT GTTGGACGTG AAAATCCTCG ATTATCCGAC

 801 CCACGCCGCC TCCAAACCGA TTGCCATGAT TCCGAACTGC GCCGCCACCC

 851 GCCACGTCGA ATTTGAATTG GACGGCTCAG GCCCTGTCGA ACTCACGCCG

 901 CCGCGCGTCG AAGACTGGCC CGATTTGACT TACAGCCCCG ACAACGGCAA

 951 ACGCGTCGAT GTCGACAAGC TGACCAAAGA AGAAGTGGCA AGCTGGAAAA

1001 CCGGCGACGT ATTGCTGTTG AACGGCAAAA TCCTCACCGG CCGCGATGCC

1051 GCACACAAAC GCCTCGTCGA TATGCTCAAC AAAGGCGAAG AATTGCCCGT

1101 CGATTTCACC AACCGCCTGA TTTACTACGT CGGCCCCGTC GATCCGGTCG

1151 GCGATGAAGT CGTCGGTCCG GCAGGTCCGA CCACAGCCAC CCGCATGGAC

1201 AAATTCACCC GCCAAATGCT CGAACAAACC GACCTCTTGG GCATGATCGG

1251 CAAATCCGAG CGCGGCGTGG CCACCTGCGA AGCCATCGCC GACAACAAAG

1301 CCGTGTACCT CATGGCAGTC GGCGGCGCGG CGTATCTCGT GGCAAAAGCC

1351 ATCAAATCTT CCAAAGTCTT GGCGTTCCCC GAATTGGGCA TGGAAGCCAT

1401 TTACGAATTT GAAGTCAAAG ACATGCCCGT AACCGTCGCC GTAGATAGCA

1451 AAGGCGAATC CATCCACGCC ACCGCCCCGC GCAAATGGCA GGCGAAAATC

1501 GGCATCATCC CCGTCGAATC TTGA
```

This corresponds to the amino acid sequence <SEQ ID 220; ORF 050-1>:

m050-1.pep

```
  1 MTVIKQEDFI QSICDAFQFI SYYHPKDYID ALYKAWQKEE NPAAKDAMTQ

 51 ILVNSRMCAE NNRPICQDTG IATVFLKVGM NVQWDADMSV EEMVNEGVRR

101 AYTWEGNTLR ASVLADPAGK RQNTKDNTPA VIHMSIVPGG KVEVTCAAKG

151 GGSENKSKLA MLNPSDNIVD WVLKTIPTMG AGWCPPGILG IGIGGTPEKA

201 VLMAKESLMS HIDIQELQEK AASGAELSTT EALRLELFEK VNALGIGAQG

251 LGGLTTVLDV KILDYPTHAA SKPIAMIPNC AATRHVEFEL DGSGPVELTP

301 PRVEDWPDLT YSPDNGKRVD VDKLTKEEVA SWKTGDVLLL NGKILTGRDA

351 AHKRLVDMLN KGEELPVDFT NRLIYYVGPV DPVGDEVVGP AGPTTATRMD

401 KFTRQMLEQT DLLGMIGKSE RGVATCEAIA DNKAVYLMAV GGAAYLVAKA

451 IKSSKVLAFP ELGMEAIYEF EVKDMPVTVA VDSKGESIHA TAPRKWQAKI

501 GIIPVES*
```

m050-1/g050-1 98.2% identity in 507 aa overlap

```
                    10        20        30        40        50        60
m050-1.pep  MTVIKQEDFIQSICDAFQFISYYHPKDYIDALYKAWQKEENPAAKDAMTQILVNSRMCAE
            ||||||||||||||||||||||||||||||||||||||||||||||||||||||||||||
g050-1      MTVIKQEDFIQSICDAFQFISYYHPKDYIDALYKAWQKEENPAAKDAMTQILVNSRMCAE
                    10        20        30        40        50        60

                    70        80        90       100       110       120
m050-1.pep  NNRPICQDTGIATVFLKVGMNVQWDADMSVEEMVNEGVRRAYTWEGNTLRASVLADPAGK
            ||||||||||||||||||||:|||||||||||:|||||||||||||||||||||||||||
g050-1      NNRPICQDTGIATVFLKVGMDVQWDADMSVEKMVNEGVRRAYTWEGNTLRASVLADPAGK
                    70        80        90       100       110       120

                   130       140       150       160       170       180
m050-1.pep  RQNTKDNTPAVIHMSIVPGGKVEVTCAAKGGGSENKSKLAMLNPSDNIVDWVLKTIPTMG
            ||||||||||||||||||||||||||||||||||||||||||||||||||||||||||||
g050-1      RQNTKDNTPAVIHMSIVPGGKVEVTCAAKGGGSENKSKLAMLNPSDNIVDWVLKTIPTMG
                   130       140       150       160       170       180

                   190       200       210       220       230       240
m050-1.pep  AGWCPPGILGIGIGGTPEKAVLMAKESLMSHIDIQELQEKAASGAELSTTEALRLELFEK
            ||||||||||||||||||||||||||||||||||||||||||||||||||||||||||||
g050-1      AGWCPPGILGIGIGGTPEKAVLMAKESLMSHIDIQELQEKAASGAELSTTEALRLELFEK
                   190       200       210       220       230       240

                   250       260       270       280       290       300
m050-1.pep  VNALGIGAQGLGGLTTVLDVKILDYPTHAASKPIAMIPNCAATRHVEFELDGSGPVELTP
            ||||||||||||||||||||||||||||||||||||||||||||||||||||||||||||
g050-1      VNALGIGAQGLGGLTTVLDVKILDYPTHAASKPIAMIPNCAATRHVEFELDGSGPVELTP
                   250       260       270       280       290       300

                   310       320       330       340       350       360
m050-1.pep  PRVEDWPDLTYSPDNGKRVDVDKLTKEEVASWKTGDVLLLNGKILTGRDAAHKRLVDMLN
            ||||| ||||||||||||||||||||||||||||||||||||||||||||||||:||:
g050-1      PRVEDXPDLTYSPDNGKRVDVDKLTKEEVASWKTGDVLLLNGKILTGRDAAHKRLVNMLD
                   310       320       330       340       350       360

                   370       380       390       400       410       420
m050-1.pep  KGEELPVDFTNRLIYYVGPVDPVGDEVVGPAGPTTATRMDKFTRQMLEQTDLLGMIGKSE
            |||||||||||||||||||||||||||||||||||||||||||||||:|| |||||||||
g050-1      KGEELPVDFTNRLIYYVGPVDPVGDEVVGPAGPTTATRMDKFTRQMLKQTGLLGMIGKSE
                   370       380       390       400       410       420

                   430       440       450       460       470       480
m050-1.pep  RGVATCEAIADNKAVYLMAVGGAAYLVAKAIKSSKVLAFPELGMEAIYEFEVKDMPVTVA
            ||:|||||||||||||||||||||||||||||||||||||||||||:|||||||||||||
g050-1      RGAATCEAIADNKAVYLMAVGGAAYLVAKAIKSSKVLAFPELGMEAVYEFEVKDMPVTVA
                   430       440       450       460       470       480

                   490       500
m050-1.pep  VDSKGESIHATAPRKWQAKIGIIPVESX
            ||||||||||||||||||||||||||||
g050-1      VDSKGESIHATAPRKWQAKIGIIPVESX
                   490       500
```

The following partial DNA sequence was identified in *N. meningitidis* <SEQ ID 221>:

a050-1.seq

```
  1 ATGACCGTCA TCAAACAGGA AGACTTTATC CAAAGCATTT GCGATGCCTT
 51 CCAATTCATC AGCTACTACC ATCCCAAAGA CTACATCGAC GCGCTTTATA
101 AGGCGTGGCA GAAGGAAGAA AACCCCGCCG CCAAAGACGC GATGACGCAG
151 ATTTTGGTCA ACAGCCGCAT GTGTGCCGAA AACAACCGCC CCATCTGCCA
201 AGATACCGGT ATCGCGACCG TGTTTTTGAA AGTCGGTATG GATGTGCAAT
251 GGGATGCAGA CATGAGCGTC GAAGAGATGG TTAACGAAGG CGTGCGCCGC
301 GCCTACACTT GGGAAGGCAA TACGCTGCGC GCTTCCGTTC TCGCCGACCC
351 CGCCGGCAAA CGCCAAAATA CCAAAGACAA CACGCCCGCC GTCATCCATA
401 TGAGCATCGT GCCGGGCGAC AAAGTCGAAG TAACCTGCGC GGCAAAAGGC
451 GGCGGTTCTG AAAACAAATC CAAACTCGCC ATGCTCAACC CTTCCGACAA
501 CATCGTCGAT TGGGTATTGA AAACCATTCC GACCATGGGC GCGGGCTGGT
551 GTCCTCCCGG CATCTTGGGC ATCGGCATCG GCGGTACGCC CGAAAAAGCC
601 GTGTTGATGG CGAAAGAATC CCTGATGAGC CACATCGACA TCCAAGAATT
```

-continued

```
 651 GCAGGAAAAA GCCGCGTCCG GCGCGGAATT GTCCACCACC GAAGCCCTGC

 701 GCCTCGAACT CTTTGAAAAA GTCAACGCGC TAGGCATCGG CGCGCAAGGC

 751 TTGGGCGGTC TGACCACCGT GTTGGACGTG AAAATCCTCG ATTACCCGAC

 801 CCACGCCGCC TCCAAACCGA TTGCCATGAT TCCGAACTGC GCCGCCACCC

 851 GCCACGTCGA ATTTGAATTG GACGGCTCAG GCCCTGTCGA ACTCACGCCG

 901 CCGCGCGTCG AAGACTGGCC CGATTTGACT TACAGCCCCG ACAACGGCAA

 951 ACGCGTCGAT GTCGACAAGC TGACCAAAGA AGAAGTGGCA AGCTGGAAAA

1001 CCGGCGACGT ATTGCTGTTG AACGGCAAAA TCCTCACCGG CCGCGATGCC

1051 GCACACAAAC GCCTCGTCGA TATGCTCGAC AAAGGCGAAG AATTGCCCGT

1101 CGATTTCACC AACCGCCTGA TTTACTACGT CGGCCCCGTC GATCCGGTCG

1151 GCGACGAAAT CGTCGGCCCA GCAGGTCCGA CCACCGCCAC CCGCATGGAC

1201 AAATTCACCC GCCAAATGCT CGAACAAACC GACCTCTTGG GCATGATCGG

1251 CAAATCCGAG CGCGGCGCGG CCACCTGCGA AGCCATCGCC GACAACAAAG

1301 CCGTGTACCT CATGGCAGTC GGCGGCGCGG CGTATCTCGT GGCAAAAGCC

1351 ATCAAATCTT CCAAAGTCTT GGCGTTCCCC GAATTGGGCA TGGAAGCCAT

1401 TTACGAATTT GAAGTCAAAG ACATGCCCGT AACCGTCGCC GTAGACAGCA

1451 AAGGCGAATC CATCCACGCC ACCGCCCCGC CCCAATGGCA GGCGAAAATC

1501 GGCATCATCC CCGTCAAATC TTGA
```

This corresponds to the amino acid sequence <SEQ ID 222; ORF 050-1.a>:

```
a050-1.pep

  1 MTVIKQEDFI QSICDAFQFI SYYHPKDYID ALYKAWQKEE NPAAKDAMTQ

 51 ILVNSRMCAE NNRPICQDTG IATVFLKVGM DVQWDADMSV EEMVNEGVRR

101 AYTWEGNTLR ASVLADPAGK RQNTKDNTPA VIHMSIVPGD KVEVTCAAKG

151 GGSENKSKLA MLNPSDNIVD WVLKTIPTMG AGWCPPGILG IGIGGTPEKA

201 VLMAKESLMS HIDIQELQEK AASGAELSTT EALRLELFEK VNALGIGAQG

251 LGGLTTVLDV KILDYPTHAA SKPIAMIPNC AATRHVEFEL DGSGPVELTP

301 PRVEDWPDLT YSPDNGKRVD VDKLTKEEVA SWKTGDVLLL NGKILTGRDA

351 AHKRLVDMLD KGEELPVDFT NRLIYYVGPV DPVGDEIVGP AGPTTATRMD

401 KFTRQMLEQT DLLGMIGKSE RGAATCEAIA DNKAVYLMAV GGAAYLVAKA

451 IKSSKVLAFP ELGMEAIYEF EVKDMPVTVA VPSKGESIHA TAPPQWQAKI

501 GIIPVKS*
```

a050-1/m050-1 98.4% identity in 507 aa overlap

```
                      10        20        30        40        50        60
a050-1.pep    MTVIKQEDFIQSICDAFQFISYYHPKDYIDALYKAWQKEENPAAKDAMTQILVNSRMCAE
              ||||||||||||||||||||||||||||||||||||||||||||||||||||||||||||
m050-1        MTVIKQEDFIQSICDAFQFISYYHPKDYIDALYKAWQKEENPAAKDAMTQILVNSRMCAE
                      10        20        30        40        50        60
```

-continued

```
                      70        80        90       100       110       120
a050-1.pep    NNRPICQDTGIATVFLKVGMDVQWDADMSVEEMVNEGVRRAYTWEGNTLRASVLADPAGK
              ||||||||||||||||||||:|||||||||||||||||||||||||||||||||||||||
m050-1        NNRPICQDTGIATVFLKVGMNVQWDADMSVEEMVNEGVRRAYTWEGNTLRASVLADPAGK
                      70        80        90       100       110       120

                     130       140       150       160       170       180
a050-1.pep    RQNTKDNTPAVIHMSIVPGDKVEVTCAAKGGGSENKSKLAMLNPSDNIVDWVLKTIPTMG
              ||||||||||||||||||| ||||||||||||||||||||||||||||||||||||||||
m050-1        RQNTKDNTPAVIHMSIVPGGKVEVTCAAKGGGSENKSKLAMLNPSDNIVDWVLKTIPTMG
                     130       140       150       160       170       180

                     190       200       210       220       230       240
a050-1.pep    AGWCPPGILGIGIGGTPEKAVLMAKESLMSHIDIQELQEKAASGAELSTTEALRLELFEK
              ||||||||||||||||||||||||||||||||||||||||||||||||||||||||||||
m050-1        AGWCPPGILGIGIGGTPEKAVLMAKESLMSHIDIQELQEKAASGAELSTTEALRLELFEK
                     190       200       210       220       230       240

                     250       260       270       280       290       300
a050-1.pep    VNALGIGAQGLGGLTTVLDVKILDYPTHAASKPIAMIPNCAATRHVEFELDGSGPVELTP
              ||||||||||||||||||||||||||||||||||||||||||||||||||||||||||||
m050-1        VNALGIGAQGLGGLTTVLDVKILDYPTHAASKPIAMIPNCAATRHVEFELDGSGPVELTP
                     250       260       270       280       290       300

                     310       320       330       340       350       360
a050-1.pep    PRVEDWPDLTYSPDNGKRVDVDKLTKEEVASWKTGDVLLLNGKILTGRDAAHKRLVDMLD
              |||||||||||||||||||||||||||||||||||||||||||||||||||||||||||:
m050-1        PRVEDWPDLTYSPDNGKRVDVDKLTKEEVASWKTGDVLLLNGKILTGRDAAHKRLVDMLN
                     310       320       330       340       350       360

                     370       380       390       400       410       420
a050-1.pep    KGEELPVDFTNRLIYYVGPVDPVGDEIVGPAGPTTATRMDKFTRQMLEQTDLLGMIGKSE
              ||||||||||||||||||||||||||:|||||||||||||||||||||||||||||||||
m050-1        KGEELPVDFTNRLIYYVGPVDPVGDEVVGPAGPTTATRMDKFTRQMLEQTDLLGMIGKSE
                     370       380       390       400       410       420

                     430       440       450       460       470       480
a050-1.pep    RGAATCEAIADNKAVYLMAVGGAAYLVAKAIKSSKVLAFPELGMEAIYEFEVKDMPVTVA
              ||:|||||||||||||||||||||||||||||||||||||||||||||||||||||||||
m050-1        RGVATCEAIADNKAVYLMAVGGAAYLVAKAIKSSKVLAFPELGMEAIYEFEVKDMPVTVA
                     430       440       450       460       470       480

                     490       500
a050-1.pep    VDSKGESIHATAPPQWQAKIGIIPVKSX
              ||||||||||||| :||||||||||:||
m050-1        VDSKGESIHATAPRKWQAKIGIIPVESX
                     490       500
```

The following partial DNA sequence was identified in *N. gonorrhoeae* <SEQ ID 223>:

g052.seq

```
  1 ATGGCTTTGG TGGCGGAGGA AACGGAAATA TCCGCGCCGT GTTTCAAAGG
 51 CTGCGAGCCG ACGGGCGACA GCAGGCTGTT GTCCACCACC AAGAGCGCGC
101 CGATGCCGTG CGCCAATTCC GCCAAGGCTT CCAAGTCGGC CACTTCGCCC
151 AAGGGGTTGG ACGGCGTTTC CAAAAACAGC AGTTTGGTGT TGGCTTTGAC
201 GGCGGCTTTC CATTCATTTA TATCAGTCGG CGACACGCGG CTCACTCCGA
251 TGCCGAATTT GGTAACGATG TTATTGATAA AGCCGACGGT CGTGCCGAAC
301 AGGCTGCGGC TGGAAACCAC ATGGTCGCCC GCCTGCAGGA AGGTGAAAAA
351 CGCCGCCTGA
```

This corresponds to the amino acid sequence <SEQ ID 224; ORF 052.ng>:

g052.pep

```
  1 MALVAEETEI SAPCFKGCEP TGDSRLLSTT KSAPMPCANS AKASKSATSP
 51 KGLDGVSKNS SLVLALTAAF HSFISVGDTR LTPMPNLVTM LLIKPTVVPN
101 RLRLETTWSP ACRKVKNAA*
```

The following partial DNA sequence was identified in *N. meningitidis* <SEQ ID 225>:

m052.seq

```
  1 ATGGCTTTGG TGGCGGAGGA AACGGAAATA TCCGCGCCGT GTTTCAAAGG
 51 CTGCGAGCCG ACGGGCGACA GCAGGCTGTT GTCCACCACC AAGAGCGCGC
101 CGATGCCGTG CGCCAATTCC GCCAAGGCTT CCAAGTCGGC CACTTCGCCC
151 AAGGGGTTGG ACGGCGTTTC CAAAAACAGC AGTTTGGTGT TGGCTTTGAC
201 GGCGGCTTTC CATTCATTTA TATCAGTCGG CGACACGCGG CTCACTCCGA
251 TGCCGAATTT GGTAACGATG TTATTGATAA AGCCGACGGT CGTGCCGAAC
301 AGGCTGCGGC TGGAAACCAC ATGGTCGCCC GCCTGCAGGA AGGTGAAAAA
351 CGCCGCCTGA
```

This corresponds to the amino acid sequence <SEQ ID 226; ORF 052>:

m052.pep

```
  1 MALVAEETEI SAPCFKGCEP TGDSRLLSTT KSAPMPCANS AKASKSATSP
 51 KGLDGVSKNS SLVLALTAAF HSFISVGDTR LTPMPNLVTM LLIKPTVVPN
101 RLRLETTWSP ACRKVKNAA*
```

The following partial DNA sequence was identified in *N. meningitidis* <SEQ ID 227>:

a052.seq

```
  1 ATGGCTTTGG TCGCGGAGGA AACGGAAATA TCCGCGCCGT GTTTCAAAGG
 51 CTGAGAGCCG ACAGGCGACA GCAGGCTGTT GTCCACCACC AAGAGCGCGC
101 CGATGCCGTG CGCCAATTCC GCCAAGGCTT CCAAGTCGGC CACTTCTCCC
151 AAGGGATTGG ACGGCGTTTC CAAAAACAGC AGTTTGGTGT TGGCTTTGAC
201 GGCGGCTTTC CATTCGTTTA TATCAGTCGG CGACACGTGA CTCACTTCGA
251 TGCCGAATTT GGTAACGATG TTATTGATAA AGCCGACGGT CGTGCCGAAC
301 AGGCTGCGGC TGGAAATCAC ATGGTCGCCC GCCTGCAAAA AGGTGAAAAA
351 CGCCGCCTGA
```

This corresponds to the amino acid sequence <SEQ ID 228; ORF 052.a>:

a052.pep

```
  1 MALVAEETEI SAPCFKG*EP TGDSRLLSTT KSAPMPCANS AKASKSATSP
 51 KGLDGVSKNS SLVLALTAAF HSFISVGDT* LTSMPNLVTM LLIKPTVVPN
101 RLRLEITWSP ACKKVKNAA*
```

m052/a052 95.8% identity over a 119 aa overlap

```
                10         20         30         40         50         60
m052.pep  MALVAEETEISAPCFKGCEPTGDSRLLSTTKSAPMPCANSAKASKSATSPKGLDGVSKNS
          |||||||||||||||| ||||||||||||||||||||||||||||||||||||||||||||
a052      MALVAEETEISAPCFKGXEPTGDSRLLSTTKSAPMPCANSAKASKSATSPKGLDGVSKNS
                10         20         30         40         50         60
                70         80         90        100        110        120
m052.pep  SLVLALTAAFHSFISVGDTRLTPMPNLVTMLLIKPTVVPNRLRLETTWSPACRKVKNAAX
          |||||||||||||||||| || ||||||||||||||||||||| ||||||:|||||||
a052      SLVLALTAAFHSFISVGDTXLTSMPNLVTMLLIKPTVVPNRLRLEITWSPACKKVKNAAX
                70         80         90        100        110        120
```

Computer analysis of this amino acid sequence gave the following results:

Homology with a predicted ORF from *N. gonorrhoeae*

ORF 052 shows 95.8% identity over a 119 aa overlap with a predicted ORF (ORF 052.ng) from *N. gonorrhoeae*:

m052/g052

```
                10         20         30         40         50         60
m052.pep  MALVAEETEISAPCFKGCEPTGDSRLLSTTKSAPMPCANSAKASKSATSPKGLDGVSKNS
          ||||||||||||||||||||||||||||||||||||||||||||||||||||||||||||
g052      MALVAEETEISAPCFKGCEPTGDSRLLSTTKSAPMPCANSAKASKSATSPKGLDGVSKNS
                10         20         30         40         50         60

                70         80         90        100        110        120
m052.pep  SLVLALTAAFHSFISVGDTWLTSMPNLATMLLIKPTVVPNRLRLEITWSPACKKVKNAAX
          |||||||||||||||||| || ||||:|||||||||||||||| ||||||:|||||||
g052      SLVLALTAAFHSFISVGDTRLTPMPNLVTMLLIKPTVVPNRLRLETTWSPACRKVKNAAX
                70         80         90        100        110        120
```

The following partial DNA sequence was identified in *N. gonorrhoeae* <SEQ ID 229>:

g073.seq

```
  1 ATGTGTATGC CATACGCAAT AAGGGTTTCA GACGGCATCT GCCGCATTTT
 51 TCCGCCGATG CCGTCTGAAA CACGCAATCA GCGCGCGAGT GCCTGTTTCA
101 AATCGTCAAT CAAATCGCCA ACATATTCCA AACCGACCGA CAGGCGCACC
151 AGTCCGGGGC GGatacCGGC GGCGAGTTTT TCTTCGGGCT GCATCCTGCC
201 GTGCGTGGTT GTCCACGGAT TGGTGATGGT CGAGCGCACG TCGCCGAGGT
251 TGGCGGTACG GGAAAAGAGT TCCACGACTT TCCACGCGGC TGCTTGGTCG
301 GCGACTTCAA AACCGATGAC GATGCCGCCG CCGTTTTGCT GTTTGCGGAT
351 AAGCTCCGCC TGCGGATGGT CGGGCAATCC GGTGTAG
```

This corresponds to the amino acid sequence <SEQ ID 230; ORF 073.ng>:

g073.pep

```
  1 MCMPYAIRVS DGICRIFPPM PSETRNQRAS ACFKSSIKSP TYSKPTDRRT
 51 SPGRIPAASF SSGCILPCVV VHGLVMVERT SPRLAVREKS STTFHAAAWS
101 ATSKPMTMPP PFCCLRISSA CGWSGNPV*
```

The following partial DNA sequence was identified in *N. meningitidis* <SEQ ID 231>:

m073.seq

```
  1 ATGTGTATGC CATATAAGAT AAGGGTTTCA GACGGCATCT GCTGTCCAAT
 51 GCCGTCTGAA ACACGCAATC AGCGTGCGAG TGCCTGTTTC AAATCGTCAA
101 TCAAATCGCC AACATATTCC AAACCGACCG ACAGGCGCAC CAATCCGGGG
151 CGGATGTTGG CGGCGAGTTT TTCTTCGGGC TGCATCCTGC CGTGCGTGGT
201 TGTCCACGGG TGGGTAATGG TCGAGCGCAC GTCACCGAGG TTGGCGGTGC
251 GGGAAAAGAG TTCCACGCCG TCCACAACTT TCCACGCCGC TTCTTGATCG
301 GCAACTTCAA AGCCGATGAC GATGCCGCCG CCGTTTTGCT GTTTGCGGAT
351 AAGCGCCGCC TGAGGATGGT CGGACAATCC GGTGTAG
```

This corresponds to the amino acid sequence <SEQ ID 232; ORF 073>:

m073.pep

```
  1 MCMPYKIRVS DGICCPMPSE TRNQRASACF KSSIKSPTYS KPTDRRTNPG
 51 RMLAASFSSG CILPCVVVHG WVMVERTSPR LAVREKSSTP STTFHAASXS
101 ATSKPMTMPP PFCCLRISAA XGWSDNPV*
```

The following partial DNA sequence was identified in *N. meningitidis* <SEQ ID 233>:

a073.seq

```
  1 ACGTGTATGT CATATAAGAT AAGGGTTTCA GACGGCATTT GCGGTGTTTT
 51 TCCGCCGATG CCGTCTGAA. CACGCAATCA GCGCGCGAGT GCCTGTTTCA
101 AATCGTCAAT CAAATCGCCA ACATATTCCA AACCGACCGA CAGGCGCACC
151 AATCCGGGGC GGATGTTGGC GGCGAGTTTT TCTTCGGGCT GCATCCTGCC
201 GTGCGTGGTT GTCCACGGAT GGGTAATGGT CGAGCGCACG TCGCCGAGGT
251 TGGCGGTACG GGAGAAAAGT TCGACGCCGT CCACGACTTT CCACGCGGCT
301 GCTTGGTCGG CGACTTCAAA GCCGATGACG ATGCCGCCGC CGTTTTGCTG
351 TTTGCGGATA AGCTCCGCCT GAGGATGGTC GGGTAATCCG GTGTAA
```

This corresponds to the amino acid sequence <SEQ ID 234; ORF 073.a>:

a073.pep

```
  1 TCMSYKIRVS DGICGVFPPM PSEXRNQRAS ACFKSSIKSP TYSKPTDRRT
 51 NPGRMLAASF SSGCILPCVV VHGWVMVERT SPRLAVREKS STPSTTFHAA
101 AWSATSKPMT MPPPFCCLRI SSA*GWSGNP V*
```

m073/a073 92.3% identity over a 130 aa overlap

```
                10         20         30         40         50
m073.pep  MCMPYKIRVSDGICC---PMPSETRNQRASACFKSSIKSPTYSKPTDRRTNPGRMLAASF
           || |||||||||    |||||:|||||||||||||||||||||||||||||||||||||
a073      TCMSYKIRVSDGICGVFPPMPSEXRNQRASACFKSSIKSPTYSKPTDRRTNPGRMLAASF
                10         20         30         40         50         60

           60         70         80         90        100        110
m073.pep  SSGCILPCVVVHGWVMVERTSPRLAVREKSSTPSTTFHAASXSATSKPMTMPPPFCCLRI
          |||||||||||||||||||||||||||||||||||||||||: ||||||||||||||||||
a073      SSGCILPCVVVHGWVMVERTSPRLAVREKSSTPSTTFHAAAWSATSKPMTMPPPFCCLRI
                70         80         90        100        110        120

          120       129
m073.pep  SAAXGWSDNPVX
          |:||||| ||||
a073      SSAXGWSGNPVX
               130
```

Computer analysis of this amino acid sequence gave the following results:

Homology with a predicted ORF from *N. gonorrhoeae*

ORF 073 shows 87.0% identity over a 131 aa overlap with a predicted ORF (ORF 073.ng) from *N. gonorrhoeae*:

m073/g073

```
                10         20         30         40         50
m073.pep  MCMPYKIRVSDGICC---PMPSETRNQRASACFKSSIKSPTYSKPTDRRTNPGRMLAASF
          ||||| ||||||||    ||||||||||||||||||||||||||||||||:|||: ||||
g073      MCMPYAIRVSDGICRIFPPMPSETRNQRASACFKSSIKSPTYSKPTDRRTSPGRIPAASF
                10         20         30         40         50         60

           60         70         80         90        100        110
m073.pep  SSGCILPCVVVHGWVMVERTSPRLAVREKSSTPSTTFHAASXSATSKPMTMPPPFCCLRI
          ||||||||||||| ||||||||||||||||||   |||||: |||||||||||||||||
g073      SSGCILPCVVVHGLVMVERTSPRLAVREKSST---TFHAAAWSATSKPMTMPPPFCCLRI
                70         80         90           100        110
          120       129
m073.pep  SAAXGWSDNPVX
          |:| ||| ||||
g073      SSACGWSGNPVX
          120
```

The following partial DNA sequence was identified in *N. gonorrhoeae* <SEQ ID 235>:

g075.seq

```
  1 ATGCCGCCTT ACTTCATCAC CCTCTTAACG ATGGAAAATA CAAAAAGCGC
 51 GGCGAAAACG CCCACTACAA TCCAACCGGC TTCCATACCG TCCGCTTTTG
101 CGGCTTCCAA AGCGTTTTTT GCCGTTTCGG GCAACGCTGC GTTTGCCTGT
151 GCCGCCAAAG CCAGCGGGGC GGCTGTTACA ACAGCCAGTT TTGCGCCGTA
201 TTTACGGCAG GTGTTAATAA ATTTCATGAT ATTTTCCTTT ACGAAATTTT
251 TAAAAAAATG TGTTTGCGGG CTTTGTGAAG GTTTTAGAGA CCGCCTGCCG
301 GGCCTCTTAA ACTTAATCTT CTTTTTCGTA GAATCCGAAA ATTACAAATT
351 CCCCGCCTAT CTCTTCCAAT GCCGAGCTAA AAGCGTCTTC ATAGCTGTCA
401 TATTTACCGG CTGA
```

This corresponds to the amino acid sequence <SEQ ID 236; ORF 075.ng>:

g075.pep

```
  1 MPPYFITLLT MENTKSAAKT PTTIQPASIP SAFAASKAFF AVSGNAAFAC

 51 AAKASGAAVT TASFAPYLRQ VLINFMIFSF TKFLKKCVCG LCEGFRDRLP

101 GLLNLIFFFV ESENYKFPAY LFQCRAKSVF IAVIFTG*
```

The following partial DNA sequence was identified in *N. meningitidis* <SEQ ID 237>:

m075.seq

```
  1 ATGCCGTCTT ACTTCATCAC TCTCTTAACG ATGGAAAATA CAAAAAGCGC

 51 GGCGAAAATG CCCACTACAA TCCAACCGGC TTCCATACCG TCCGCTTTTG

101 CGGCTTCCAA AGCGTTTTTT GCCGTATCGG GCAACGTTGC ATTTGCATGT

151 GCGGCCAAAG CCAGGGGAGC AGCTGTTACA ACAGCCAGTT TTGCGCCGTA

201 TTTACGGCAG GTGTTAATAA ATTTCATGAT ATTTTCCTTC AAAAAGTGTT

251 TGGCGGTAAT GGATGGAGCG TTTTTCAGAC GACCGCCGAA CATCCGAAAA

301 TCAGTCTTTC AAAAATCCGA ATACGACAAA TTCGTATTGG TTGCCGATTT

351 CTTCCAAACC TGCGTTAATC GCTTCTTCGA AGTCGTAGAA ATAATCGGCA

401 TTGGTGATTA A
```

This corresponds to the amino acid sequence <SEQ ID 238; ORF 075>:

m075.pep

```
  1 MPSYFITLLT MENTKSAAKM PTTIQPASIP SAFAASKAFF AVSGNVAFAC

 51 AAKARGAAVT TASFAPYLRQ VLINFMIFSF KKCLAVMDGA FFRRPPNIRK

101 SVFQKSEYDK FVLVADFFQT CVNRFFEVVE IIGIGD*
```

Computer analysis of this amino acid sequence gave the following results:

Homology with a predicted ORF from *N. gonorrhoeae*

ORF 075 shows 65.7% identity over a 137 aa overlap with a predicted ORF (ORF 075.ng) from *N. gonorrhoeae*:

m075/g075

```
                    10        20        30        40        50        60
m075.pep   MPSYFITLLTMENTKSAAKMPTTIQPASIPSAFAASKAFFAVSGNVAFACAAKARGAAVT
           || |||||||||||||||| |||||||||||||||||||||||||:|||||||| |||||
g075       MPPYFITLLTMENTKSAAKTPTTIQPASIPSAFAASKAFFAVSGNAAFACAAKASGAAVT
                    10        20        30        40        50        60

                    70        80            90       100       110
m075.pep   TASFAPYLRQVLINFMIFSF----KKCLAVMDGAFFRRPPNIRKSVFQKSEYDKFVLVAD
           ||||||||||||||||||||    |||:  :  :|  | |:: : :|   | ::: : |
g075       TASFAPYLRQVLINFMIFSFTKFLKKCVCGLCEGFRDRLPGLLNLIFFFVESENYKFPAY
                    70        80        90       100       110       120

            120       130
m075.pep   FFQTCVNRFFEVVEIIGIGDX
           :||  ::  | :| : |
g075       LFQCRAKSVFIAVIFTGX
                  130
```

The following partial DNA sequence was identified in *N. meningitidis* <SEQ ID 239>:

a075.seq

```
  1 ATGCCGTCTT ACTTCATCAC TCTCTTAACG ATGGAAAAGA CAAAAAGCGC
 51 GGCGAAAACG CCCACTACAA TCCAACCGGC TTCCATACCG TCCGCTTTTG
101 CGGCTTCCAA AGCGTTTTTT GCTGTATCGG GCAACGTTGC ATTTGCATGT
151 GCGGCCAAAG CCAGGGGAGC AGCTGTTACA ACAGCCAGTT TTGCGCCGTA
201 TTTACGGCAG GTGTTAATAA ATTTCATGAT ATTTTCCTTC AAAAAGTGTT
251 TGGCGGTAAT GGATGGAGCG TTTTTCAGAC GACCGCCGAA CATCCGAAAA
301 TCAGTCTTTC AAAAATCCGA ATACGACAAA TTCGTATTGG TTGCCGATTT
351 CTTCCAAACC TGCGTTAATC GCTTCTTCGA AGTCGTAGAA ATAATCGGCA
401 TTGGTGATTA A
```

This corresponds to the amino acid sequence <SEQ ID 240; ORF 075.a>:

a075.pep

```
  1 MPSYFITLLT MEKTKSAAKT PTTIQPASIP SAFAASKAFF AVSGNVAFAC
 51 AAKARGAAVT TASFAPYLRQ VLINFMIFSF KKCLAVMDGA FFRRPPNIRK
101 SVFQKSEYDK FVLVADFFQT CVNRFFEVVE IIGIGD*
```

m075/a075 98.5% identity over a 136 aa overlap

```
                   10        20        30        40        50        60
m075.pep  MPSYFITLLTMENTKSAAKMPTTIQPASIPSAFAASKAFFAVSGNVAFACAAKARGAAVT
          ||||||||||||:|||||| ||||||||||||||||||||||||||||||||||||||||
a075      MPSYFITLLTMEKTKSAAKTPTTIQPASIPSAFAASKAFFAVSGNVAFACAAKARGAAVT
                   10        20        30        40        50        60

                   70        80        90       100       110       120
m075.pep  TASFAPYLRQVLINFMIFSFKKCLAVMDGAFFRRPPNIRKSVFQKSEYDKFVLVADFFQT
          ||||||||||||||||||||||||||||||||||||||||||||||||||||||||||||
a075      TASFAPYLRQVLINFMIFSFKKCLAVMDGAFFRRPPNIRKSVFQKSEYDKFVLVADFFQT
                   70        80        90       100       110       120

                  130
m075.pep  CVNRFFEVVEIIGIGDX
          ||||||||||||||||
a075      CVNRFFEVVEIIGIGDX
                  130
```

The following partial DNA sequence was identified in *N. gonorrhoeae* <SEQ ID 241>:

g080.seq

```
  1 ATGTGGGATA ATGCCGAAGC GATGGAACGG CTGACGCGCT GGCTGCTTGT
 51 CATGATGGCG ATGCTGCTTG CTGCGTCCGG GCTGGTTTGG TTTTACAATT
101 CGAATCATCT GCCCGTCAAG CAGGTGTCGC TGAAGGGCAA CCTGGTTTAT
151 TCCGATAAGA AGGCATTGGG CAGTTTGGCG AAAGAATACA TCCATGGGAA
201 TATTTTGAGG ACGGACATCA ATGGCGCACA GGAAGCCTAC CGCCGGTATC
251 CGTGGATTGC GTCGGTCATG GTGCGCCGCC GTTTTCCCGA TACGGTTGAG
301 GTCGTCCTGA CCGAGCGCAA GCCGGTTGCA CGTTGGGGCG ACCATGCCTT
351 GGTGGACGGC GAAGGCAATG TTTTTGAAGC CCGCTTGGAC AGACCCGGAA
```

-continued

```
401 TGCCGGTATT CAGAGGCGCG GAAGGAACGT CTGCCGAAAT GCTCCGCCGT
451 TATGACGAAT TTTCGACTGT TTTGGCAAAA CAGGGTTTGG GCATCAAAGA
501 GATGACCTAT ACGGCACGTT CGGCGTGGAA TGTCGTTTTG GACAACGGCA
551 TCACCGTCAG GCTCGGACGG GAAAAcgaGA TGAAACGCCT CCgGCTTTTT
601 ACcgAAGCGT GGCAGCATCT gttgcGTAAG AATAAAAATC GGTTATCCTA
651 TGTGGATATG Aggtataagg acggatttTC agtcccccat gctCCCGACG
701 GTTTACCCGA AAAAGAATcc gAAGAATatt gggaacaggt ttgggacata
751 ttacggcctg gcgtcggaaa cggttcgacg caaatttcaa tcagttatAA
801 GGGCAGacga acaatggaac AGcagtaa
```

This corresponds to the amino acid sequence <SEQ ID 242; ORF 080.ng>:

g080.pep

```
  1 MWDNAEAMER LTRWLLVMMA MLLAASGLVW FYNSNHLPVK QVSLKGNLVY
 51 SDKKALGSLA KEYIHGNILR TDINGAQEAY RRYPWIASVM VRRRFPDTVE
101 VVLTERKPVA RWGDHALVDG EGNVFEARLD RPGMPVFRGA EGTSAEMLRR
151 YDEFSTVLAK QGLGIKEMTY TARSAWNVVL DNGITVRLGR ENEMKRLRLF
201 TEAWQHLLRK NKNRLSYVDM RYKDGFSVPH APDGLPEKES EEYWEQVWDI
251 LRPGVGNGST QISISYKGRR TMEQQ*
```

The following partial DNA sequence was identified in *N. meningitidis* <SEQ ID 243>:

m080.seq

```
  1 ATGTGGGATA ATGCCGAAGC GATGGAACGG CTGACGCGCT GGCTGCTTGT
 51 CATGATGGCG ATGCTGCTTG CTGCGTCCGG GCTGGTTTGG TTTTACAATT
101 CGAATCATCT GCCCGTCAAG CAGGTGTCGC TGAAGGGCAA CCTGGTTTAT
151 TCCGATAAGA AGACATTGGG CAGTTTGGCG AAAGAATACA TCCATGGGAA
201 TATTTTGAGG ACGGACATCA ATGGCGCACA GGAGGCCTAC CGCCGGTATC
251 CGTGGATTGC GTCGGTCATG GTGCGCCGCC GTTTTCCCGA CACGGTTGAG
301 GTCGTCCTGA CCGAGCGCAA GCCGGTCGCG CGTTGGGGCG ACCATGCCTT
351 GGTGGACGGC GAAGGCAATG TTTTTGAAGC CCGCTTGGAC AGACCCGGAA
401 TGCCGGTATT CAGAGGCGCG GAAGGAACGT CTGCCGAAAT GCTCCGCCGT
451 TATGACGAAT TTTCGACTGT TTTGGCAAAA CAGGGTTTGG GCATCAAAGA
501 GATGACCTAT ACGGCACGTT CGGCGTGGAT TGTCGTTTTG GACAACGGCA
551 TCACCGTCAG GCTCGGACGG GAAAACGAGA TGAAACGCCT CCGGCTTTTT
601 ACCGAAGCGT GGCAGCATCT GTTGCGTAAA AATAAAAATC GGTTATCCTA
651 TGTGGATATG AGGTATAAGG ACGGATTTTC AGTCCGCTAT GCTTCCGACG
701 GTTTACCCGA AAAAGAATCC GAAGAATAG
```

This corresponds to the amino acid sequence <SEQ ID 2441; ORF 080>:

```
m080.pep

  1 MWDNAEAMER LTRWLLVMMA MLLAASGLVW FYNSNHLPVK QVSLKGNLVY

 51 SDKKTLGSLA KEYIHGNILR TDINGAQEAY RRYPWIASVM VRRRFPDTVE

101 VVLTERKPVA RWGDHALVDG EGNVFEARLD RPGMPVFRGA EGTSAEMLRR

151 YDEFSTVLAK QGLGIKEMTY TARSAWIVVL DNGITVRLGR ENEMKRLRLF

201 TEAWQHLLRK NKNRLSYVDM RYKDGFSVRY ASDGLPEKES EE*
```

Computer analysis of this amino acid sequence gave the following results:

Homology with a predicted ORF from *N. gonorrhoeae*

ORF 080 shows 97.9% identity over a 242 aa overlap with a predicted ORF (ORF 080.ng) from *N. gonorrhoeae*:

```
m080/g080

                   10        20        30        40        50        60
m080.pep   MWDNAEAMERLTRWLLVMMAMLLAASGLVWFYNSNHLPVKQVSLKGNLVYSDKKTLGSLA
           ||||||||||||||||||||||||||||||||||||||||||||||||||||||:|||||
080        MWDNAEAMERLTRWLLVMMAMLLAASGLVWFYNSNHLPVKQVSLKGNLVYSDKKALGSLA
                   10        20        30        40        50        60

                   70        80        90       100       110       120
m080.pep   KEYIHGNILRTDINGAQEAYRRYPWIASVMVRRRFPDTVEVVLTERKPVARWGDHALVDG
           ||||||||||||||||||||||||||||||||||||||||||||||||||||||||||||
080        KEYIHGNILRTDINGAQEAYRRYPWIASVMVRRRFPDTVEVVLTERKPVARWGDHALVDG
                   70        80        90       100       110       120

                  130       140       150       160       170       180
m080.pep   EGNVFEARLDRPGMPVFRGAEGTSAEMLRRYDEFSTVLAKQGLGIKEMTYTARSAWIVVL
           |||||||||||||||||||||||||||||||||||||||||||||||||||||||| |||
080        EGNVFEARLDRPGMPVFRGAEGTSAEMLRRYDEFSTVLAKQGLGIKEMTYTARSAWNVVL
                  130       140       150       160       170       180

                  190       200       210       220       230       240
m080.pep   DNGITVRLGRENEMKRLRLFTEAWQHLLRKNKNRLSYVDMRYKDGFSVRYASDGLPEKES
           |||||||||||||||||||||||||||||||||||||||||||||||| :| ||||||||
080        DNGITVRLGRENEMKRLRLFTEAWQHLLRKNKNRLSYVDMRYKDGFSVPHAPDGLPEKES
                  190       200       210       220       230       240

m080.pep   EEX
           ||
080        EEYWEQVWDILRPGVGNGSTQISISYKGRRTMEQQX
                  250       260       270
```

The following partial DNA sequence was identified in *N. meningitidis* <SEQ ID 245>:

```
a080.seq

  1 ATGTGGGATA ATGCCGAAGC GATGGAACGG CTGACGCGCT GGCTGCTTGT

 51 CATGATGGCG ATGCTGCTTG CTGCGTCCGG GCTGGTTTGG TTTTACAATT

101 CGAATCATCT GCCCGTCAAG CAGGTGTCGC TGAAGGGCAA CCTAGTTTAT

151 TCCGATAAGA AAGCATTGGG CAGTTTGGCG AAAGAATACA TCCATGGGAA

201 TATTTTGAGG ACGGACATCA ATGGCGCACA GGAGGCCTAC CGCCGGTATC

251 CGTGGATTGC GTCGGTCATG GTGCGCCGCC GTTTTCCCGA CACGGTTGAG

301 GTCGTCCTGA CCGAGCGCAA GCCGGTCGCG CGTTGGGGCG ACCATGCCTT

351 GGTGGACGGC GAAGGCAATG TTTTTGAAGC CCGTTTGGAC AGACCCGGAA

401 TGCCGGTATT CAGAGGCGCG GAAGGAACGT CTGCCGAAAT GCTCCGCCGT
```

-continued

```
451 TATGACGAAT TTTCGACTGT TTTGGCAAAA CAGGGTTTGG GCATCAAAGA

501 GATGACCTAT ACGGCACGTT CGGCGTGGAT TGTCGTTTTG GACAACGGCA

551 TCACCGTCAG GCTCGGACGG GAAAACGAGA TGAAACGCCT CCGGCTTTTT

601 ACCGAAGCGT GGCAACATCT GTTGCGTAAA AATAAAAATC GGTTATCCTA

651 TGTGGATATG AGGTATAAGG ACGGATTTTC AGTCCGCTAT GCTCCCGACG

701 GTTTACCCGA AAAAGAATCC GAAGAATAG
```

This corresponds to the amino acid sequence <SEQ ID 246; ORF 080.a>:

a080.pep

```
  1 MWDNAEAMER LTRWLLVMMA MLLAASGLVW FYNSNHLPVK QVSLKGNLVY

 51 SDKKALGSLA KEYIHGNILR TDINGAQEAY RRYPWIASVM VRRRFPDTVE

101 VVLTERKPVA RWGDHALVDG EGNVFEARLD RPGMPVFRGA EGTSAEMLRR

151 YDEFSTVLAK QGLGIKEMTY TARSAWIVVL DNGITVRLGR ENEMKRLRLF

201 TEAWQHLLRK NKNRLSYVDM RYKDGFSVRY APDGLPEKES EE*
```

m080/a080 99.2% identity over a 242 aa overlap

```
                   10        20        30        40        50        60
m080.pep    MWDNAEAMERLTRWLLVMMAMLLAASGLVWFYNSNHLPVKQVSLKGNLVYSDKKTLGSLA
            ||||||||||||||||||||||||||||||||||||||||||||||||||||||:|||||
a080        MWDNAEAMERLTRWLLVMMAMLLAASGLVWFYNSNHLPVKQVSLKGNLVYSDKKALGSLA
                   10        20        30        40        50        60
                   70        80        90       100       110       120
m080.pep    KEYIHGNILRTDINGAQEAYRRYPWIASVMVRRRFPDTVEVVLTERKPVARWGDHALVDG
            ||||||||||||||||||||||||||||||||||||||||||||||||||||||||||||
a080        KEYIHGNILRTDINGAQEAYRRYPWIASVMVRRRFPDTVEVVLTERKPVARWGDHALVDG
                   70        80        90       100       110       120
                  130       140       150       160       170       180
m080.pep    EGNVFEARLDRPGMPVFRGAEGTSAEMLRRYDEFSTVLAKQGLGIKEMTYTARSAWIVVL
            ||||||||||||||||||||||||||||||||||||||||||||||||||||||||||||
a080        EGNVFEARLDRPGMPVFRGAEGTSAEMLRRYDEFSTVLAKQGLGIKEMTYTARSAWIVVL
                  130       140       150       160       170       180
                  190       200       210       220       230       240
m080.pep    DNGITVRLGRENEMKRLRLFTEAWQHLLRKNKNRLSYVDMRYKDGFSVRYASDGLPEKES
            |||||||||||||||||||||||||||||||||||||||||||||||||||| |||||||
a080        DNGITVRLGRENEMKRLRLFTEAWQHLLRKNKNRLSYVDMRYKDGFSVRYAPDGLPEKES
                  190       200       210       220       230       240
m080.pep    EEX
            |||
a080        EEX
```

The following partial DNA sequence was identified in *N. gonorrhoeae* <SEQ ID 247>:

g081.seq

```
  1 ATGAAACCAC TGGACCTAAA TTTCATCTGC CAAGCCCTCA AGCTTCCGAT

 51 GCCGTCTGAA AACAAACCCG TGTCGCGCAT CGTAACCGAC AGCCGCGATA

101 TTCGGGAAGG CGATGTGTTT TTCGCATTGG CGGGCGGGCG GTTTGACGCG

151 CATGATTTTG TTGGAGGCGT ATTGTCTGCG GGCGCGGCGG CGGTTGTGGT

201 TTCGCGCGAA GATTGCGCGG CTTTGGGCGG CGCGTTGAAA GTCGATGACA
```

-continued

```
 251 CGCTTGCCGC GTTGCAAACG TTGGCGAAGG CGTGGCGCGA TAATGTGAAC
 301 CCGTTTGTGT TCGGCATTAC CGGTTCGGGC GGCAAGACGA CGGTGAAGGA
 351 GATGCTGGCT GCGGTATTGC GCCGCCGTTT CGGCGATGAT GCCGTTTCGG
 401 CGACGGCAGG CAACTTCAAC AACCACAtcg gaTTGCCGCT GACTTTATTG
 451 AAATtaaAcg aAAAACACCG CTATGCCGTG ATTGAAATGG GCATGAACCA
 501 TTTTGGcgaa ctggcggtTt taacgcaaaT CGCCAAACCC GATGCCGCTT
 551 TGGtcaACAA CGCCCTGCGC GCCCATGTCG GATGCGGTTt cgacggagtg
 601 GGCGATATTG CCAAAGcgaa aagcGAGATT TatgcagGct tATGTTCAGA
 651 CGGCATGGCA CTGATTCCTC AAGAAGATGC CAATATGGCT GTCTTCAAAA
 701 CGGCAACGTT TAATTTGAAT ACGTGCACTT TCGGCGTCGA TAGCGGCGAT
 751 GTCCGCGCGG AAAATATCGT GCTGAAACCT TTGTCGTGCG AATTTGATTT
 801 GGTGTGCGGC GACGAGCGCA CTGCCGTGGT GCTGCCTGTT CCCGGCCGCC
 851 ACAATGTCCA CAACGCCGCC GCTGCCGCCG CGCTGGCTTT GGCTGCCGGT
 901 TTGAGTTTGA ACGATGTGGC GGAAGGTTTG CAAGGCTTCA GCAACATCAA
 951 AGGCCGTCTG AACGTCAAAG CCGGCATCAA GGGCGCAACC CTGATTGACG
1001 ATACTTATAA TGCGAATCCC GACAGTATGA AAGCCGCGGT TGACGTGTTG
1051 GCGCGTATGC CTGCGCCGCG CATTTTCGTG ATGGGCGATA TGGGCGAACT
1101 GGGCGAGGAc gaAGCCGCCG CCATGCACGC CGAAagtcgGC GCGTACGCCC
1151 GCGACCAAGG CATCGAAGCG GCTTATTTTG TCGGCGACAA CAGCGTCGAA
1201 GCGGcggaAA AATTTGGCGC GGACGGTTTG TGGTTCGCCG CCAAAGACCC
1251 GTTGATTCAA GTGTTGAGCC ACGATTTGCC CGAACGCGCC ACCGTGTTGG
1301 TGAAAGGTTC GCGCTTTATG CAGAtggAAG AAGTGGTCGA GGCATTGGAG
1351 GATAAGTga
```

This corresponds to the amino acid sequence <SEQ ID 248; ORF 081.ng>:

g081.pep

```
  1 MKPLDLNFIC QALKLPMPSE NKPVSRIVTD SRDIREGDVF FALAGGRFDA
 51 HDFVGGVLSA GAAAVVVSRE DCAALGGALK VDDTLAALQT LAKAWRDNVN
101 PFVFGITGSG GKTTVKEMLA AVLRRRFGDD AVSATAGNFN NHIGLPLTLL
151 KLNEKHRYAV IEMGMNHFGE LAVLTQIAKP DAALVNNALR AHVGCGFDGV
201 GDIAKAKSEI YAGLCSDGMA LIPQEDANMA VFKTATFNLN TCTFGVDSGD
251 VRAENIVLKP LSCEFDLVCG DERTAVVLPV PGRHNVHNAA AAALALAAG
301 LSLNDVAEGL QGFSNIKGRL NVKAGIKGAT LIDDTYNANP DSMKAAVDVL
351 ARMPAPRIFV MGDMGELGED EAAAMHAEVG AYARDQGIEA AYFVGDNSVE
401 AAEKFGADGL WFAAKDPLIQ VLSHDLPERA TVLVKGSRFM QMEEVVEALE
451 DK*
```

The following partial DNA sequence was identified in *N. meningitidis* <SEQ ID 249>:

m081.seq

```
   1 ATGAAACCAC TGGACCTAAA TTTCATCTGC CAAGCCCTCA AGCTTCCGAT
  51 GCCGTCTGAA AGCAAACCCG TGTCGCGCAT CGTAACCGAC AGCCGCGACA
 101 TCCGCGCGGG CGATGTGTTT TTCGCATTGG CGGGCGAGCG GTTTGACGCG
 151 CATGATTTTG TTGAAGACGT ATTGGCTGCT GGTGCGGCGG CGGTTGTGGT
 201 TTCGCGCGAA GATTGTGCTG CAATGGATGG CGCGTTGAAA GTCGATGACA
 251 CGCTTGCCGC ATTGCAAACG CTGGCAAAGG CGTGGCGTGA AAATGTGAAT
 301 CCGTTTGTGT TCGGCATTAC CGGTTCGGGC GGCAAGACGA CGGTGAAGGA
 351 AATGCTGGCT GCGGTATTGC GCCgCCGTTT CGGCGATGAT GCCGTGTTGG
 401 CGACGGCAGG CAACTTCAAC AACCATATCG GATTGCCGCT GACTTTGTTG
 451 AAGTTAAACG AAAAACACCG CTATGCCGTG ATTGAAATGG GCATGAACCA
 501 TTTCGGCGAA CTGGCGGTTT TAACGCAmAT CGCCAAACCA AATGCCGCAT
 551 TGGTCAACAA CGCCATGCGC GCCCATGTCG GCTGCGGTTT CGACGGAGTG
 601 GGCGATATTG CCAAAGCGAA AAGCGAGATT TACCAAGGTT TATGTTCAGA
 651 CGGCATTGCA CTGATTCCTC AAGAAGATGC CAATATGGCT GTCTTCAAAA
 701 CGGCAACGCT TAATTTGAAT ACGCGCACTT TCGGCATCGA TAGCGGCGAT
 751 GTTCACGCGG AAAATATTGT GCTGAAACCG TTGTCGTGCG AATTTGATTT
 801 GGTGTGCGGC GATGAGCGCG CCGCCGTGGT GCTGCCTGTT CCCGGCCGCC
 851 ACAATGTCCA CAACGCCGCC GCTGCCGCCG CGCTGGCTTT GGCTGCGGGT
 901 TTGAGTTTGA ACGATGTGGC GGAAGGTTTG AAAGGCTTCA GCAATATCAA
 951 AGGCCGTCTG AACGTCAAAT CCGGAATCAA GGGCGCAACC CTGATTGACG
1001 ATACTTATAA TGCGAACCCT GACAGCATGA AAGCTGCGAT TGACGTGTTG
1051 GCGCGTATGC CTGCGCCGCG TATTTTCGTG ATGGGCGATA TGGGCGAACT
1101 GGGCGAACTG GGCGAGGACG AAGCCGCCGC TATGCACGCC GAAGTCGGCG
1151 CGTATGCCCG CGACCAAGGC ATCGAAGCGG CTTATTTTGT CGGCGACAAC
1201 AGCGTCGAAG CGGCGGAAAA ATTTGGCGCG GACGGTTTGT GGTTCGCCGC
1251 CAAAGACCCG TTGATTCAAG TGTTGCGCCA CGATTTGCCC GAACGCGCCA
1301 CCGTGTTGGT GAAAGGTTCG CGCTTTATGC AGATGGAAGA AGTGGTCGAG
1351 GCATTGGAGG ATAAGTGA
```

This corresponds to the amino acid sequence <SEQ ID 250; ORF 081>:

m081.pep

```
   1 MKPLDLNFIC QALKLPMPSE SKPVSRIVTD SRDIRAGDVF FALAGERFDA
  51 HDFVEDVLAA GAAAVVVSRE DCAAMDGALK VDDTLAALQT LAKAWRENVN
 101 PFVFGITGSG GKTTVKEMLA AVLRRRFGDD AVLATAGNFN NHIGLPLTLL
 151 KLNEKHRYAV IEMGMNHFGE LAVLTXIAKP NAALVNNAMR AHVGCGFDGV
 201 GDIAKAKSEI YQGLCSDGIA LIPQEDANMA VFKTATLNLN TRTFGIDSGD
 251 VHAENIVLKP LSCEFDLVCG DERAAVVLPV PGRHNVHNAA AAALALAAG
 301 LSLNDVAEGL KGFSNIKGRL NVKSGIKGAT LIDDTYNANP DSMKAAIDVL
```

-continued

```
351 ARMPAPRIFV MGDMGELGEL GEDEAAAMHA EVGAYARDQG IEAAYFVGDN

401 SVEAAEKFGA DGLWFAAKDP LIQVLRHDLP ERATVLVKGS RFMQMEEVVE

451 ALEDK*
```

Computer analysis of this amino acid sequence gave the following results:

Homology with a predicted ORF from *N. gonorrhoeae*

ORF 081 shows 94.1% identity over a 455 aa overlap with a predicted ORF (ORF 081.ng) from *N. gonorrhoeae*:

m081/g081

```
                  10        20        30        40        50        60
m081.pep  MKPLDLNFICQALKLPMPSESKPVSRIVTDSRDIRAGDVFFALAGERFDAHDFVEDVLAA
          ||||||||||||||||||||:|||||||||||||| ||||||||| ||||||||  ||:|
g081      MKPLDLNFICQALKLPMPSENKPVSRIVTDSRDIREGDVFFALAGGRFDAHDFVGGVLSA
                  10        20        30        40        50        60

                  70        80        90       100       110       120
m081.pep  GAAAVVVSREDCAAMDGALKVDDTLAALQTLAKAWRENVNPFVFGITGSGGKTTVKEMLA
          ||||||||||||||: ||||||||||||||||||||:|||||||||||||||||||||||
g081      GAAAVVVSREDCAALGGALKVDDTLAALQTLAKAWRDNVNPFVFGITGSGGKTTVKEMLA
                  70        80        90       100       110       120

                 130       140       150       160       170       180
m081.pep  AVLRRRFGDDAVLATAGNFNNHIGLPLTLLKLNEKHRYAVIEMGMNHFGELAVLTXIAKP
          |||||||||||| |||||||||||||||||||||||||||||||||||||||||| ||||
g081      AVLRRRFGDDAVSATAGNFNNHIGLPLTLLKLNEKHRYAVIEMGMNHFGELAVLTQIAKP
                 130       140       150       160       170       180

                 190       200       210       220       230       240
m081.pep  NAALVNNAMRAHVGCGFDGVGDIAKAKSEIYQGLCSDGIALIPQEDANMAVFKTATLNLN
          :|||||||:|||||||||||||||||||||| ||||||:|||||||||||||||||:|||
g081      DAALVNNALRAHVGCGFDGVGDIAKAKSEIYAGLCSDGMALIPQEDANMAVFKTATFNLN
                 190       200       210       220       230       240

                 250       260       270       280       290       300
m081.pep  TRTFGIDSGDVHAENIVLKPLSCEFDLVCGDERAAVVLPVPGRHNVHNAAAAAALALAAG
          | |||:|||||:|||||||||||||||||||||:||||||||||||||||||||||||||
g081      TCTFGVDSGDVRAENIVLKPLSCEFDLVCGDERTAVVLPVPGRHNVHNAAAAAALALAAG
                 250       260       270       280       290       300

                 310       320       330       340       350       360
m081.pep  LSLNDVAEGLKGFSNIKGRLNVKSGIKGATLIDDTYNANPDSMKAAIDVLARMPAPRIFV
          ||||||||||:||||||||||||:||||||||||||||||||||||:|||||||||||||
g081      LSLNDVAEGLQGFSNIKGRLNVKAGIKGATLIDDTYNANPDSMKAAVDVLARMPAPRIFV
                 310       320       330       340       350       360

              370          380       390       400       410       420
m081.pep  MGDMGELGELGEDEAAAMHAEVGAYARDQGIEAAYFVGDNSVEAAEKFGADGLWFAAKDP
          |||||||||   ||||||||||||||||||||||||||||||||||||||||||||||||
g081      MGDMGELGE---DEAAAMHAEVGAYARDQGIEAAYFVGDNSVEAAEKFGADGLWFAAKDP
                     370       380       390       400       410

                 430       440       450
m081.pep  LIQVLRHDLPERATVLVKGSRFMQMEEVVEALEDKX
          ||||| ||||||||||||||||||||||||||||||
g081      LIQVLSHDLPERATVLVKGSRFMQMEEVVEALEDKX
          420       430       440       450
```

The following partial DNA sequence was identified in *N. meningitidis* <SEQ ID 251>: a081.seq a081.seq

```
  1 ATGAAACCAC TGGACCTAAA TTTCATCTGC CAAGCCCTCA AGCTTCCGAT

 51 GCCGTCTGAA AGCAAACCCG TGTCGCGCAT CGTAACCGAC AGCCGCGACA

101 TCCGCGCGGG CGATGTGTTT TTCGCATTGG CGGGCGGGCG GTTTGATGCG

151 CATGATTTTG TTGAAGACGT ATTGGCTGCG GGTGCGGCGG CGGTTGTGGT

201 TTCGCGCGAA GATTGCGTTG CAATGGATGG CCCGTTGAAA GTCGATGACA
```

-continued

```
 251 CGCTTACCGC GTTGCAAATG TTGGCGAAGG CGTGGCGCGA GAATGTGAAC
 301 CCGTTTGTGT TCGGTATTAC CGGCTCGGGC GGCAAGACGA CGGTGAAGGA
 351 AATGTTGGCT GCGGTATTGC GCCGCCGTTT CGGCGATAAT GCCGTTTTGG
 401 CGACGGCAGG CAACTTCAAC AACCACATCG GATTGCCGTT GACTTTGTTG
 451 AAATTAAACG AAAAACACCG CTATGCCGTG ATTGAAATGG GTATGAACCA
 501 TTTTGGCGAA CTGGCGGTTT TGACACAAAT CGCCAAACCC GATGCCGCAT
 551 TGGTCAACAA CGCCATGCGC GCCCATGTCG GCTGCGGTTT CGACGGAGTG
 601 GGCGATATTG CCAAAGCGAA AAGCGAGATT TATCAAGGCT TATGTTCAGA
 651 CGGCATGGCG CTGATTCCTC AAGAAGATGC CAATATGGCT GTCTTCAAAA
 701 CGGCAACGCT TAATTTGAAT ACGCGCACTT TCGGCATCGA TAGCGGCGAT
 751 GTCCACGCGG AAAATATCGT GCTGAAACCG TTGTCGTGCG AATTTGATTT
 801 GGTGTGCGGC AACGAGTGCG CAGCCGTGGT TCTGCCCGTT CCCGGCCGCC
 851 ACAATGTCCA CAACGCCGCC GCCGCCGCCG CGCTGTCTTT GGCTGCAGGT
 901 TTGACTTTGA ACGATGTGGC GGAAGGTTTG AAAGGCTTCA GCAATATCAA
 951 AGGCCGTCTG AACGTCAAAT CCGGAATCAA GGGCGCAACC CTGATTGACG
1001 ATACTTATAA TGCGAACCCT GACAGCATGA AAGCTGCGGT TGACGTGTTG
1051 GCGCGTATGC CTGCGCCGCG TATTTTCGTG ATGGGCGATA TGGGCGAACT
1101 GGGTGAGGAC GAAGCCGCCG CCATGCACGC CGAAGTCGGC GCGTACGCCC
1151 GCGACCAAGG CATCGAAGCG GCTTATTTTG TCGGCGACAA CAGCGTCGAA
1201 GCGGCGGAAA AATTTGGCGC GGACGGTTTG TGGTTCGCCG CCAAAGACCC
1251 GTTGATTCAA GTGTTGCGCC ACGATTTGCC CGAACGCGCC ACCGTGTTGG
1301 TGAAAGGTTC GCGCTTTATG CAGATGGAAG AAGTGGTCGA GGCATTGGAG
1351 GATAAGTGA
```

This corresponds to the amino acid sequence <SEQ ID 252; ORF 081.a>:

<u>a081.pep</u>

```
  1 MKPLDLNFIC QALKLPMPSE SKPVSRIVTD SRDIRAGDVF FALAGGRFDA
 51 HDFVEDVLAA GAAAVVVSRE DCVAMDGALK VDDTLTALQM LAKAWRENVN
101 PFVFGITGSG GKTTVKEMLA AVLRRRFGDN AVLATAGNFN NHIGLPLTLL
151 KLNEKHRYAV IEMGMNHFGE LAVLTQIAKP DAALVNNAMR AHVGCGFDGV
201 GDIAKAKSEI YQGLCSDGMA LIPQEDANMA VFKTATLNLN TRTFGIDSGD
251 VHAENIVLKP LSCEFDLVCG NECAAVVLPV PGRHNVHNAA AAALSLAAG
301 LSLNDVAEGL KGFSNIKGRL NVKSGIKGAT LIDDTYNANP DSMKAAVDVL
351 ARMPAPRIFV MGDMGELGED EAAAMHAEVG AYARDQGIEA AYFVGDNSVE
401 AAEKFGADGL WFAAKDPLIQ VLRHDLPERA TVLVKGSRFM QMEEVVEALE
451 DK*
```

m081/a081 96.7% identity over a 455 aa overlap

```
                10         20         30         40         50         60
m081.pep  MKPLDLNFICQALKLPMPSESKPVSRIVTDSRDIRAGDVFFALAGERFDAHDFVEDVLAA
          ||||||||||||||||||||||||||||||||||||||||||||||| ||||||||||||
a081      MKPLDLNFICQALKLPMPSESKPVSRIVTDSRDIRAGDVFFALAGGRFDAHDFVEDVLAA
                10         20         30         40         50         60

                70         80         90        100        110        120
m081.pep  GAAAVVVSREDCAAMDGALKVDDTLAALQTLAKAWRENVNPFVFGITGSGGKTTVKEMLA
          ||||||||||||:||||||||||||:||| ||||||||||||||||||||||||||||||
a081      GAAAVVVSREDCVAMDGALKVDDTLTALQMLAKAWRENVNPFVFGITGSGGKTTVKEMLA
                70         80         90        100        110        120

               130        140        150        160        170        180
m081.pep  AVLRRRFGDDAVLATAGNFNNHIGLPLTLLKLNEKHRYAVIEMGMNHFGELAVLTXIAKP
          |||||||||:||||||||||||||||||||||||||||||||||||||||||||| ||||
a081      AVLRRRFGDNAVLATAGNFNNHIGLPLTLLKLNEKHRYAVIEMGMNHFGELAVLTQIAKP
               130        140        150        160        170        180

               190        200        210        220        230        240
m081.pep  NAALVNNAMRAHVGCGFDGVGDIAKAKSEIYQGLCSDGIALIPQEDANMAVFKTATLNLN
          :||||||||||||||||||||||||||||||||||||||:||||||||||||||||||||
a081      DAALVNNAMRAHVGCGFDGVGDIAKAKSEIYQGLCSDGMALIPQEDANMAVFKTATLNLN
               190        200        210        220        230        240

               250        260        270        280        290        300
m081.pep  TRTFGIDSGDVHAENIVLKPLSCEFDLVCGDERAAVVLPVPGRHNVHNAAAAAALALAAG
          ||||||||||||||||||||||||||||||:| ||||||||||||||||||||||:||||
a081      TRTFGIDSGDVHAENIVLKPLSCEFDLVCGNECAAVVLPVPGRHNVHNAAAAAALSLAAG
               250        260        270        280        290        300

               310        320        330        340        350        360
m081.pep  LSLNDVAEGLKGFSNIKGRLNVKSGIKGATLIDDTYNANPDSMKAAIDVLARMPAPRIFV
          ||||||||||||||||||||||||||||||||||||||||||||||:|||||||||||||
a081      LSLNDVAEGLKGFSNIKGRLNVKSGIKGATLIDDTYNANPDSMKAAVDVLARMPAPRIFV
               310        320        330        340        350        360

               370        380        390        400        410        420
m081.pep  MGDMGELGELGEDEAAAMHAEVGAYARDQGIEAAYFVGDNSVEAAEKFGADGLWFAAKDP
          |||||||||   ||||||||||||||||||||||||||||||||||||||||||||||||
a081      MGDMGELGE---DEAAAMHAEVGAYARDQGIEAAYFVGDNSVEAAEKFGADGLWFAAKDP
                   370        380        390        400        410

               430        440        450
m081.pep  LIQVLRHDLPERATVLVKGSRFMQMEEVVEALEDKX
          |||||||||||||||||||||||||||||||||||
a081      LIQVLRHDLPERATVLVKGSRFMQMEEVVEALEDKX
          420        430        440        450
```

The following partial DNA sequence was identified in *N. gonorrhoeae* <SEQ ID 253>:

<u>g082.seq</u>

```
  1 aTGTGGTTGT TGAAGTTGCC TGCCGTCGCC GAAACGGCAT CATCGCCGAA
 51 ACGGCGGCGC AATACCGCAG CCAGCATCTC CTTCACCGTC GTCTTGCCGC
101 CCGAACCGGT AATGCCGAAC ACAAACGGGT TCACATTATC GCGCCACGCC
151 TTCGCCAACG TTTGCAACGC GGCAAGCGTG TCATCGACTT TCAACGCGCC
201 GCCCAAAGCC GCGCAATCTT CGCGCGAAAC CACAACCGCC GCCGCGCCCG
251 CAGACAATAC GCCTCCAACA AAATCATGCG CGTCAAACCG CCCGCCCGCC
301 AATGCGAAAA ACACATCGCC TTCCCGAATA TCGCGGCTGT CGGTTACGAT
351 GCGCGACACG GGTTTGTTTT CAGACGGCAT CGGAAGCTTG AGGGCTTGGC
401 AGATGAAATT TAGGTCCAGT GGTTTCATAT TTGCTTTCGT TAATATTCGG
451 GCGGCGGACA CATCGGTAGC GGCTGATTTT TTTATCGCCT GTTTTGCTGT
501 GGTAAAACAC AGATTATTTT CCCATTCTCA TTCGGCATTT TTTCTGTACG
551 TATCATTTTT TAGACGTATT TTTAGCCGAT TTGCCTTTTC CCGCATACCA
601 CGGCGCGGGG TCGTCGGACT GTCTGTCGAT AAAGGCAAGG TTATTGCCTT
651 CGCCCGGCAC ATCGGGGACA TTCCCCCAAA AATCATAGCC GTCATCGGGC
701 AACTCGTCGG TTTCGATACC CGTCCAACTG CCGAATCCGC GTAA
```

This corresponds to the amino acid sequence <SEQ ID 254; ORF 082.ng>:

g082.pep

```
  1 MWLLKLPAVA ETASSPKRRR NTAASISFTV VLPPEPVMPN TNGFTLSRHA
 51 FANVCNAASV SSTFNAPPKA AQSSRETTTA AAPADNTPPT KSCASNRPPA
101 NAKNTSPSRI SRLSVTMRDT GLFSDGIGSL RAWQMKFRSS GFIFAFVNIR
151 AADTSVAADF FIACFAVVKH RLFSHSHSAF FLYVSFFRRI FSRFAFSRIP
201 RRGVVGLSVD KGKVIAFARH IGDIPPKIIA VIGQLVGFDT RPTAESA*
```

The following partial DNA sequence was identified in *N. meningitidis* <SEQ ID 255>:

m082.seq

```
  1 ATGnnGTTGT TGAAGTTGCC TGCCGTCGCC AACACGGCAT CATCGCCGAA
 51 ACGGcGGCGC AATACCGCAG CCAGCATTTC CTTCACCGTC GTCTTGCCGC
101 CCGAACCGGT AATGCCGAAC ACAAACGGAT TCACATTTTC ACGCCACGCC
151 TTTGCCAGCG TTTGCAATGC GGCAAGCGTG TCATCGACTT TCAACGCGCC
201 ATCCATTGCA GCACAATCTT CGCGCGAAAC CACAACCGCC GCCGCACCAG
251 CAGCCAATAC GTCTTCAACA AAATCATGCG CGTCAAACCG CTCGCCCGCC
301 AATGCGAAAA ACACATCGCC CGCGCGGATG TCGCGGCTGT CGGTTACGAT
351 GCGCGACACG GGTTTGCTTT CAGACGGCAT CGGAAGCTTG AGGGCTTGGC
401 AGATGAAATT TAGGTCCAGT GGTTTCATAT TTACTTTCGT TAATATTCGG
451 GCGGCGGACA CATCGGTAGC GGCTGATTTT TTTATCGCCT GTTTTGCTGT
501 GGTAAAACAC AGATTATTTT CCCATTCTCA TTCGGsATTT TTTCTGTACG
551 TATCATTTTT TAGACGTATT TTTAGTCGAT TTGCCTTTTC CCGCATACCA
601 CGGCGCGGGG TCGTCGGGCA GTCCGTCGAT AAAGGCAAGG TTATTGCCTT
651 CGCCCTGCAC ATCGGGAACA TTCCCCCAAA AATCATAGCC GTCATCGGGC
701 AACTCGTCGG TTTCGATACC CGTCCAACTG CCGAATCCGC GTAA
```

This corresponds to the amino acid sequence <SEQ ID 256; ORF 082>:

m082.pep

```
  1 MXLLKLPAVA NTASSPKRRR NTAASISFTV VLPPEPVMPN TNGFTFSRHA
 51 FASVCNAASV SSTFNAPSIA AQSSRETTTA AAPAANTSST KSCASNRSPA
101 NAKNTSPARM SRLSVTMRDT GLLSDGIGSL RAWQMKFRSS GFIFTFVNIR
151 AADTSVAADF FIACFAVVKH RLFSHSHSXF FLYVSFFRRI FSRFAFSRIP
201 RRGVVGQSVD KGKVIAFALH IGNIPPKIIA VIGQLVGFDT RPTAESA*
```

Computer analysis of this amino acid sequence gave the following results:

Homology with a predicted ORF from *N. gonorrhoeae*

ORF 082 shows 92.7% identity over a 247 aa overlap with a predicted ORF (ORF 082.ng) from *N. gonorrhoeae*:

m082/g082

```
                10        20        30        40        50        60
m082.pep  MXLLKLPAVANTASSPKRRRNTAASISFTVVLPPEPVMPNTNGFTFSRHAFASVCNAASV
          | ||||||||:||||||||||||||||||||||||||||||||||:||||||:|||||||
g082      MWLLKLPAVAETASSPKRRRNTAASISFTVVLPPEPVMPNTNGFTLSRHAFANVCNAASV
                10        20        30        40        50        60

                70        80        90       100       110       120
m082.pep  SSTFNAPSIAAQSSRETTTAAAPAANTSSTKSCASNRSPANAKNTSPARMSRLSVTMRDT
          |||||||  ||||||||||||||| ||  |||||||| |||||||||:|:||||||||||
g082      SSTFNAPPKAAQSSRETTTAAAPADNTPPTKSCASNRPPANAKNTSPSRISRLSVTMRDT
                70        80        90       100       110       120

               130       140       150       160       170       180
m082.pep  GLLSDGIGSLRAWQMKFRSSGFIFTFVNIRAADTSVAADFFIACFAVVKHRLFSHSHSXF
          ||:|||||||||||||||||||||:||||||||||||||||||||||||||||||||| |
g082      GLFSDGIGSLRAWQMKFRSSGFIFAFVNIRAADTSVAADFFIACFAVVKHRLFSHSHSAF
               130       140       150       160       170       180

               190       200       210       220       230       240
m082.pep  FLYVSFFRRIFSRFAFSRIPRRGVVGQSVDKGKVIAFALHIGNIPPKIIAVIGQLVGFDT
          |||||||||||||||||||||||||| ||||||||||| |||:|||||||||||||||||
g082      FLYVSFFRRIFSRFAFSRIPRRGVVGLSVDKGKVIAFARHIGDIPPKIIAVIGQLVGFDT
               190       200       210       220       230       240

m082.pep  RPTAESAX
          ||||||||
g082      RPTAESAX
```

The following partial DNA sequence was identified in *N. meningitidis* <SEQ ID 257>:

a082.seq

1 ATGTGGTTGT TGAAGTTGCC TGCCGTCGCC AAAACGGCAT TATCGCCGAA

51 ACGGCGGCGC AATACCGCAG CCAACATTTC CTTCACCGTC GTCTTGCCGC

101 CCGAGCCGGT AATACCGAAC ACAAACGGGT TCACATTCTC GCGCCACGCC

151 TTCGCCAACA TTTGCAACGC GGTAAGCGTG TCATCGACTT TCAACGCGCC

201 ATCCATTGCA ACGCAATCTT CGCGCGAAAC CACAACCGCC GCCGCACCCG

251 CAGCCAATAC GTCTTCAACA AAATCATGCG CATCAAACCG CCCGCCCGCC

301 AATGCGAAAA ACACATCGCC CGCGCGGATG TCGCGGCTGT CGGTTACGAT

351 GCGCGACACG GGTTTGCTTT CAGACGGCAT CGGAAGCTTG AGGGCTTGGC

401 AGATGAAATT TAGGTCCAGT GGTTTCATAT TTACTTTCGT TAATATTCGG

451 GCGGCGGACA CATCGGTAGC GGCTGATTTT TTTATCGCCT GTTTTGCTGT

501 GGTAAAACAC AGATTATTTT CCCATTCTCA TTCGGCATTT TTTCTGTACG

551 TATCATTTTT TAGACGTATT TTTAGTCGAT TTGCCTTTTC CCGCATACCA

601 CGGCGCGGGG TCGTCGGGCA GTCCGTCGAT AAAGGCAAGG TTATTGCCTT

651 CGCCCTGCAC ATCGGGAACA TTCCCCCAAA AATCATAGCC GTCATCGGGC

701 AACTCGTCGG TTTCGATACC CGTCCAACTG CCGAATCCGC GTAA

This corresponds to the amino acid sequence <SEQ ID 258; ORF 082.a>:

a082.pep

1 MWLLKLPAVA KTALSPKRRR NTAANISFTV VLPPEPVIPN TNGFTFSRHA

51 FANICNAVSV SSTFNAPSIA TQSSRETTTA AAPAANTSST KSCASNRPPA

101 NAKNTSPARM SRLSVTMRDT GLLSDGIGSL RAWQMKFRSS GFIFTFVNIR

-continued

```
151 AADTSVAADF FIACFAVVKH RLFSHSHSAF FLYVSFFRRI FSRFAFSRIP

201 RRGVVGQSVD KGKVIAFALH IGNIPPKIIA VIGQLVGFDT RPTAESA*
```

m082/a082 95.5% identity over a 247 aa overlap

```
                   10         20         30         40         50         60
m082.pep    MXLLKLPAVANTASSPKRRRNTAASISFTVVLPPEPVMPNTNGFTFSRHAFASVCNAASV
            | ||||||||:|| ||||||||||:||||||||||||:||||||||||||||::||||:||
a082        MWLLKLPAVAKTALSPKRRRNTAANISFTVVLPPEPVIPNTNGFTFSRHAFANICNAVSV
                   10         20         30         40         50         60

                   70         80         90        100        110        120
m082.pep    SSTFNAPSIAAQSSRETTTAAAPAANTSSTKSCASNRSPANAKNTSPARMSRLSVTMRDT
            ||||||||||:||||||||||||||||||||||||||| ||||||||||||||||||||||
a082        SSTFNAPSIATQSSRETTTAAAPAANTSSTKSCASNRPPANAKNTSPARMSRLSVTMRDT
                   70         80         90        100        110        120

                  130        140        150        160        170        180
m082.pep    GLLSDGIGSLRAWQMKFRSSGFIFTFVNIRAADTSVAADFFIACFAVVKHRLFSHSHSXF
            |||||||||||||||||||||||||||||||||||||||||||||||||||||||||| |
a082        GLLSDGIGSLRAWQMKFRSSGFIFTFVNIRAADTSVAADFFIACFAVVKHRLFSHSHSAF
                  130        140        150        160        170        180

                  190        200        210        220        230        240
m082.pep    FLYVSFFRRIFSRFAFSRIPRRGVVGQSVDKGKVIAFALHIGNIPPKIIAVIGQLVGFDT
            ||||||||||||||||||||||||||||||||||||||||||||||||||||||||||||
a082        FLYVSFFRRIFSRFAFSRIPRRGVVGQSVDKGKVIAFALHIGNIPPKIIAVIGQLVGFDT
                  190        200        210        220        230        240

m082.pep    RPTAESAX
            ||||||||
a082        RPTAESAX
```

The following partial DNA sequence was identified in *N. gonorrhoeae* <SEQ ID 259>:

g084.seq

```
  1 ATGAAacaAT CCGcccgaat aAAAAATATG GATCAGACAT TAAAAAATAc
 51 attgggcatt tGCGCGcttt tagcctTTTG TTTTggcgcG gccaTCGCAT
101 CAGGTTATCA CTTGGAATAT GAATACGGCT ACCGTTATTC TGCCGTGGGC
151 GCTTTGGCTT CGGTTGTATT TTTATTATTA TTGGCACGCG GCTTCCCGCG
201 CGTTTCTTCA GTTGTTTTAC TGATTTACGT CGGCACAACC GCCCTATATT
251 TGCCGGTCGG CTGGCTGTAT GGTGCGCCTT CTTATCAGAT AGTCGGTTCG
301 ATATTGGAAA GCAATCCTGC CGAGGCGCGT GAATTTGTCG GCAATCTTCC
351 CGGGTCGCTT TATTTTGTGC AGGCATTATT TTTCATTTTT GGCTTGACAG
401 TTTGGAAATA TTGTGTATCT GTGGGGGTAT TTGCTGACGT AAAAAACTAT
451 AAACGTCGCA GCAAAATATG GCTGACCATA TTATTGACTT TGATTTTGTC
501 CTGCGCGGTG ATGGAGAAAA TCGccggcga taaAGATTGG CGAGaacctg
551 atgccggcct gttgttgaat ATTTTcgacc tgtattaCga cttggctttc
601 cgcgccggca cAATATGCCG CCAAGCGCGC CCAcattttg gaagCagcaa
651 aaaaagcgtC AACATGGCAt atccgccaac ttgcgcccaa gTAtaa
```

This corresponds to the amino acid sequence <SEQ ID 260; ORF 084.ng>:

g084.pep

```
  1 MKQSARIKNM DQTLKNTLGI CALLAFCFGA AIASGYHLEY EYGYRYSAVG
```

-continued

51 ALASVVFLLL LARGFPRVSS VVLLIYVGTT ALYLPVGWLY GAPSYQIVGS

101 ILESNPAEAR EFVGNLPGSL YFVQALFFIF GLTVWKYCVS VGVFADVKNY

151 KRRSKIWLTI LLTLILSCAV MEKIAGDKDW REPDAGLLLN IFDLYYDLAF

201 RAGTICRQAR PHFGSSKKSV NMAYPPTCAQ V*

The following partial DNA sequence was identified in *N. meningitidis* <SEQ ID 261>:

m084.seq

1 ATGAAACAAT CCGCCcGAAT AAAa.ATATG AATCAGACAT TACTTTATAC

51 ATTGGGCATT TGCGCGCTTT TAACCTTTnn nnnnnnnnnn nnnnnnnnnn 101 nnnnnTATCA CCCnGAATAT GAATACGGCT ACCGTTATTC TGCCGTGGGT

151 GCTTTGGCTT CGGTTGTATT TTTATTATTA TTGGCACGCG GTTTCCCGCG

201 CGTTTCTTCA GTTGTTTTAC TGATTTACGT CGGCACAACC GCCCTATATT

251 TGCCGGTCGG CTGGCTGTAT GGTGCGCCGT CTTATCAGAT AGTCGGTTCG

301 ATATTGGAAA GCAATCCTGC CGAGGCGCGT GAATTTGTCG GCAATCTTCC

351 CGGGTCGCTT TATTTTGTGC AGGCATTATT TTTCATTTTT GGCTTGACAG

401 TTTGGAAATA TTGTGTATCG GGGGGGGTAT TTGCTGACGT AAAAAACTAT

451 AAACGCCGCA GCAAAATATG GCTGACTATA TTATTGACTT TGATTTTGTC

501 CTGCGCGGTG ATGGATAAAA TCGCCAGCGA TAAAGATTTG CGAGAACCTG

551 ATGCCGGCCT GTTGTTGAAT ATTTTCGACC TGTATTACGA TTTGGCT.TC

601 CGCGCCGGCA CAATATGCCG CCAAGCGCGC CCACATTTTG GAAGCAGCAA

651 AAAAAGCGTC AACATGGCAT ATCCGTCATG TTGCGCCCAA GTATAA

This corresponds to the amino acid sequence <SEQ ID 262; ORF 084>:

m084.pep

1 MKQSARIKXM NQTLKNTLGI CALLTFXXXX XXXXXYHPEY EYGYRYSAVG

51 ALASVVFLLL LARGFPRVSS VVLLIYVGTT ALYLPVGWLY GAPSYQIVGS

101 ILESNPAEAR EFVGNLPGSL YFVQALFFIF GLTVWKYCVS GGVFADVKNY

151 KRRSKIWLTI LLTLILSCAV MDKIASDKDL REPDAGLLLN IFDLYYDLAX

201 RAGTICRQAR PHFGSSKKSV NMAYPSCCAQ V*

Computer analysis of this amino acid sequence gave the following results:

Homology with a predicted ORF from *N. gonorrhoeae*

ORF 084 shows 90.5% identity over a 231 aa overlap with a predicted ORF (ORF 084.ng) from *N. gonorrhoeae*:

m084/g084

```
                   10        20                 30        40        50
m084.pep  MKQSARIKXMNQTLLYTLGICALLTF---------YHPEYEYGYRYSAVGALASVVFLLL
          |||||||| |:|||  ||||||||:|         || ||||||||||||||||||||||
g084      MKQSARIKNMDQTLKNTLGICALLAFCFGAAIASGYHLEYEYGYRYSAVGALASVVFLLL
                   10        20        30        40        50        60

                   60        70        80        90       100       110
m084.pep  LARGFPRVSSVVLLIYVGTTALYLPVGWLYGAPSYQIVGSILESNPAEAREFVGNLPGSL
          ||||||||||||||||||||||||||||||||||||||||||||||||||||||||||||
g084      LARGFPRVSSVVLLIYVGTTALYLPVGWLYGAPSYQIVGSILESNPAEAREFVGNLPGSL
                   70        80        90       100       110       120

                  120       130       140       150       160       170
m084.pep  YFVQALFFIFGLTVWKYCVSGGVFADVKNYKRRSKIWLTILLTLILSCAVMDKIASDKDL
          |||||||||||||||||||| ||||||||||||||||||||||||||||||:|||:||| 
g084      YFVQALFFIFGLTVWKYCVSVGVFADVKNYKRRSKIWLTILLTLILSCAVMEKIAGDKDW
                  130       140       150       160       170       180

                  180       190       200       210       220
m084.pep  REPDAGLLLNIFDLYYDLAXRAGTICRQARPHFGSSKKSVNMAYPSCCAQVX
          ||||||||||||||||||| |||||||||||||||||||||||||  |||||
g084      REPDAGLLLNIFDLYYDLAFRAGTICRQARPHFGSSKKSVNMAYPPTCAQVX
                  190       200       210       220       230
```

The following partial DNA sequence was identified in *N. meningitidis* <SEQ ID 263>:

a084.seq

```
  1 ATGAAACAAT CCGCCCGAAT AAAAAATATG GATCAGACAT TAAAAAATAC
 51 ATTGGGCATT TGCGCGCTTT TAGCCTTTTG TTTTGGCGCG GCCATCGCAT
101 CAGGTTATCA CTTGGAATAT GAATACGGCT ACCGTTATTC TGCCCTGGGT
151 GCTTTGGCTT CGGTTGTATT TTTATTATTA TTGGCACGCG GTTTCCCGCG
201 CGTTTCTTCA GTTGTTTTAC TGATTTACGT CGGCACAACC GCCCTATATT
251 TGCCGGTCGG CTGGCTCTAT GGTGCGCCGT CTTATCAGAT AGTCGGTTCG
301 ATATTGGAAA GCAATCCTGC CGAGGCGCGT GAATTTGTCG GCAATCTTCC
351 CGGGTCGCTT TATTTTCTGC AGGCATTATT TTTCATTTTT GGCTTGACAG
401 TTTGGAGATA TTGTGTATCG GGGGGGGTAT TTGCTGACGT AAAAAACTAT
451 AAACGCCGCA GCAAAAATATG GCTGACTATA TTATTGACTT TGATTTTGTC
501 CTGCGCGGTG ATGCATAAAA TCGCCAGCGA TAAAGATTTG CGAGAACCTG
551 ATGCCGGCCT CTTGTTGAAT ATTTTCGACC TGTATTACGA TTTGGCTTCC
601 .GCGCCGGCA CAATATGCCG CCAAGCGCGC CCACATTTTG GAAGCAGCAA
651 AAAAAGCGTC AACATGGCAT ATCCGTCATG TTGCGCCCAA GTATAA
```

This corresponds to the amino acid sequence <SEQ ID 264; ORF 084.a>:

a084.pep

```
  1 MKQSARIKNM DQTLKNTLGI CALLAFCFGA AIASGYHLEY EYGYRYSAVG
 51 ALASVVFLLL LARGFPRVSS VVLLIYVGTT ALYLPVGWLY GAPSYQIVGS
101 ILESNPAEAR EFVGNLPGSL YFVQALFFIF GLTVWRYCVS GGVFADVKNY
151 KRRSKIWLTI LLTLILSCAV MDKIASDKDL REPDAGLLLN IFDLYYDLAS
201 XAGTICRQAR PHFGSSKKSV NMAYPSCCAQ V*
```

m084/a084 92.2% identity over a 231 aa overlap

```
                10        20        30        40        50        60
m084.pep  MKQSARIKXMNQTLLYTLGICALLTFXXXXXXXXXYHPEYEYGYRYSAVGALASVVFLLL
          |||||||| |:|||  ||||||||:|         || ||||||||||||||||||||||
a084      MKQSARIKNMDQTLKNTLGICALLAFCFGAAIASGYHLEYEYGYRYSAVGALASVVFLLL
                10        20        30        40        50        60

                70        80        90       100       110       120
m084.pep  LARGFPRVSSVVLLIYVGTTALYLPVGWLYGAPSYQIVGSILESNPAEAREFVGNLPGSL
          ||||||||||||||||||||||||||||||||||||||||||||||||||||||||||||
a084      LARGFPRVSSVVLLIYVGTTALYLPVGWLYGAPSYQIVGSILESNPAEAREFVGNLPGSL
                70        80        90       100       110       120

               130       140       150       160       170       180
m084.pep  YFVQALFFIFGLTVWKYCVSGGVFADVKNYKRRSKIWLTILLTLILSCAVMDKIASDKDL
          |||||||||||||||:||||||||||||||||||||||||||||||||||||||||||||
a084      YFVQALFFIFGLTVWRYCVSGGVFADVKNYKRRSKIWLTILLTLILSCAVMDKIASDKDL
               130       140       150       160       170       180
               190       200       210       220       230
m084.pep  REPDAGLLLNIFDLYYDLAXRAGTICRQARPHFGSSKKSVNMAYPSCCAQVX
          |||||||||||||||||||  ||||||||||||||||||||||||||||||
a084      REPDAGLLLNIFDLYYDLASXAGTICRQARPHFGSSKKSVNMAYPSCCAQVX
               190       200       210       220       230
```

The following partial DNA sequence was identified in *N. gonorrhoeae* <SEQ ID 265>:

g085.seq

```
  1 ATGGGCAAAG GGCAGGACTT CACGCCCCTG CGCGACGCGT TGAAAGATAA
 51 GGCAAAAGGC GTGTTCCTGA TCGGCGTCGA TGCGCCGCAA ATCCGCCGCG
101 ATTTGGACGG CTGCGGCTTG AACCTGACCG ACTGCGTCAC TTTGGAAGAG
151 GCGGTTCAGA CGGCATACGC CCAAGCCGAA GCGGGCGATA TTGTCTTGCT
201 CAGCCCCGCC TGCGCGAGTT TCGATATGTT TAAAGGCTAC GCGCACCGTT
251 CGGAAGTGTT tatCGAAGCG TTTAAGGCTT TGTGA
```

This corresponds to the amino acid sequence <SEQ ID 266; ORF 085.ng>:

g085.pep

```
 1 MGKGQDFTPL RDALKDKAKG VFLIGVDAPQ IRRDLDGCGL NLTDCVTLEE
51 AVQTAYAQAE AGDIVLLSPA CASFDMFKGY AHRSEVFIEA FKAL*
```

The following partial DNA sequence was identified in *N. meningitidis* <SEQ ID 267>:

m085.seq

```
  1 ATGGGTAAAG GGCAGGACTT CACGCCCCTG CGCGATGCAC TGGTAGGCAA
 51 GGCAAAAGGC GTGTTCTTGA TTGGTGTCGA TGCGCCGCAA ATCCGCCGCG
101 ATTTGGACGG CTGCGGCTTG AATATGACCG ACTGCGCCAC TTTGGGAGAA
151 GCCGTTCAGA CGGCATATGC CCAAGCCGAA GCAGGCGATA TTGTGTTGCT
201 CAGCCCCGCC TGCGCGAGCT TTGATATGTT CAAAGGCTAC GCGCACCGTT
251 CGGAAGTGTT TATCGAAGCG TTTAAGGCTT TGTGA
```

This corresponds to the amino acid sequence <SEQ ID 268; ORF 085>:

m085.pep

```
 1 MGKGQDFTPL RDALVGKAKG VFLIGVDAPQ IRRDLDGCGL NMTDCATLGE

51 AVQTAYAQAE AGDIVLLSPA CASFDMFKGY AHRSEVFIEA FKAL*
```

Computer analysis of this amino acid sequence gave the following results:

Homology with a predicted ORF from *N. gonorrhoeae*

ORF 085 shows 94.7% identity over a 94 aa overlap with a predicted ORF (ORF 085.ng) from *N. gonorrhoeae*:

m085/g085

```
                   10        20        30        40        50        60
m085.pep   MGKGQDFTPLRDALVGKAKGVFLIGVDAPQIRRDLDGCGLNMTDCATLGEAVQTAYAQAE
           ||||||||||||||  ||||||||||||||||||||||||:|||:|| ||||||||||
g085       MGKGQDFTPLRDALKDKAKGVFLIGVDAPQIRRDLDGCGLNLTDCVTLEEAVQTAYAQAE
                   10        20        30        40        50        60
                   70        80        90
m085.pep   AGDIVLLSPACASFDMFKGYAHRSEVFIEAFKALX
           ||||||||||||||||||||||||||||||||||
g085       AGDIVLLSPACASFDMFKGYAHRSEVFIEAFKALX
                   70        80        90
```

The following partial DNA sequence was identified in *N. meningitidis* <SEQ ID 269>:

a085.seq

```
  1 ATGGGCAAAG GGCAGGACTT CACGCCCCTG CGCGACGCGC TTGCCGGCAA

 51 GGCAAAAGGC GTGTTCCTGA TCGGTGTGGA TGCGCCGCAA ATCCGCCGCG

101 ATTTGGACGG CTGCGATCTG AATATGACCG ACTGCGCCAC TTTGGAAGAA

151 GCGGTTCAGA AGGCATATGC CCAAGCCGAA GCGGGCGATA TCGTGCTGCT

201 CAGCCCCGCC TGCGCGAGTT TCGATATGTT TAAAGGCTAC GCGCACCGTT

251 CGGAAGTGTT TATCGGGGCG TTTAAGGCTT TGTGA
```

This corresponds to the amino acid sequence <SEQ ID 270; ORF 085.a>:

a085.pep

```
 1 MGKGQDFTPL RDALAGKAKG VFLIGVDAPQ IRRDLDGCDL NMTDCATLEE

51 AVQKAYAQAE AGDIVLLSPA CASFDMFKGY AHRSEVFIGA FKAL*
```

m085/a085 94.7% identity over a 94 aa overlap

```
                   10        20        30        40        50        60
m085.pep   MGKGQDFTPLRDALVGKAKGVFLIGVDAPQIRRDLDGCGLNMTDCATLGEAVQTAYAQAE
           ||||||||||||||:||||||||||||||||||||||| ||||||||| |||| ||||||
a085       MGKGQDFTPLRDALAGKAKGVFLIGVDAPQIRRDLDGCDLNMTDCATLEEAVQKAYAQAE
                   10        20        30        40        50        60
                   70        80        90
m085.pep   AGDIVLLSPACASFDMFKGYAHRSEVFIEAFKALX
           |||||||||||||||||||||||||||| ||||||
a085       AGDIVLLSPACASFDMFKGYAHRSEVFIGAFKALX
                   70        80        90
```

The following partial DNA sequence was identified in *N. gonorrhoeae* <SEQ ID 271>:

g086.seq

```
   1 ATGGTGGTGC TGATGACGGC GTTCGGCCTG CTGATGATTT ATTCGGCTTC
  51 TGTGTATTTG GCATCGAAGG AAGGCGGCGA TCAGTTTTTC TATTTGACCA
 101 GGCAGGCGGG GTTCGTCGTT GCCGGCCTTA TAGCGAGCGG TTTTTTATGG
 151 TTTCTTTGCA GGATGAGGAC ATGGCGGCGG CTTGTGCCGT GGATTTTTGC
 201 CTTATCCGGC CTGTTGCTGG TAGCCGTATT GATTGCCGGG CGCGAAATCA
 251 ATGGCGCGAC CCGTTGGATA CCTTTGGGTC CGTTGAATTT CCAGCCGACC
 301 GAGCTGTTCA AGCTGGCAGT CATCCTTTAT TTGGCAAGCC TGTTCACGCG
 351 CCGTGAAGAA GTGTTGCGCA GCATGGAAAG TTTGGGTTGG CAGTCGATTT
 401 GGCGGGGGAC GGCCAACCTG ATTATGTCCG CCACCAATCC GCAGGCACGT
 451 CGTGAAACAT TAGAAATGTA CGgcCGTTTC CGGGCGATCA TCCTGCCGAT
 501 TATGCTGGTG GCGTTCGGTT TGGTGCTGAT AATGGTACAG CCGGATTTCG
 551 GTTCGTTTGT CGTCATTACC GTCATTACCG TTGGAATGCT GTTTCTGGCA
 601 GGATTGCCGT GGAAATATTT TTTTGTCCTG GTAGGCAGCG TCTTGGGTGG
 651 GATGGTGCTG ATGATTACCG CCGCTCCCTA CCGTGTGCAG CGGGTAGTGG
 701 CATTTTTGGA CCCGTGGAAA GACCCGCAGG GTGCCGGCTA CCAGCTTACC
 751 CACTCTCTGA TGGCAATCGG GCGCGGAGAG TGGTTCGGTA TGGGTTTGGG
 801 TGCGAGTTTG AGCAAACGCG GCTTTCTGCC GGAAGCGCAT ACCGATTTTA
 851 TTTTTGCCAT CATCGCTGAA GAATTCGGCT TCTTCGGGAT GTGCGTGCTG
 901 ATATTCTGTT ACGGCTGGCT GGTGGTGCGG GCGTTTTCCA TCGGCAAGCA
 951 GTCGCGCGAT TTGGGtttgA CTTTCAACGC CTATATCGCT TCGGGTATCG
1001 GCATTTGGAT CGGTATCCAA AGTTTCTTCA ATATCGGTGT GAACATCGGT
1051 GCTTTGCCGA CCAAAGGTCT GACGctgCcg tTGATGTCCT ATGGcggTTC
1101 GTCAGTCTTT TTCATGCTGA TCAGCATGAT GCTGCTGTTG CGTATCGATT
1151 ATGAAAACCG CCAGAAAATG CGCGGTTACC GGGTGGAGTA AA
```

This corresponds to the amino acid sequence <SEQ ID 272; ORF 086.ng>:

g086.pep

```
   1 MVVLMTAFGL LMIYSASVYL ASKEGGDQFF YLTRQAGFVV AGLIASGFLW
  51 FLCRMRTWRR LVPWIFALSG LLLVAVLIAG REINGATRWI PLGPLNFQPT
 101 ELFKLAVILY LASLFTRREE VLRSMESLGW QSIWRGTANL IMSATNPQAR
 151 RETLEMYGRF RAIILPIMLV AFGLVLIMVQ PDFGSFVVIT VITVGMLFLA
 201 GLPWKYFFVL VGSVLGGMVL MITAAPYRVQ RVVAFLDPWK DPQGAGYQLT
 251 HSLMAIGRGE WFGMGLGASL SKRGFLPEAH TDFIFAIIAE EFGFFGMCVL
 301 IFCYGWLVVR AFSIGKQSRD LGLTFNAYIA SGIGIWIGIQ SFFNIGVNIG
 351 ALPTKGLTLP LMSYGGSSVF FMLISMMLLL RIDYENRQKM RGYRVE*
```

The following partial DNA sequence was identified in *N. meningitidis* <SEQ ID 273>:

m086.seq

```
   1 ATGGTGGTGC TGATGACGGC GTTCAGCCTG CTGATGATTT ATTCGGCTTC
  51 TGTGTATTTG GCATCAAAAG AAGGCGGCGA TCAGTTTTTC TATTTGACCA
 101 GACAGGCGGG GTTCGTCGTT GCCGGCTTGA TAGCGAGCGG TTTGTTATGG
 151 TTTCTTTGCA GGATGAGGAC ATGGCGGCGG CTTGTGCCGT GGATTTTTGC
 201 CCTATCCGGC CTGTTGCTGG TAGTCGTATT GATTGCCGGG CGCGAAATCA
 251 ATGGCGCGAC CCGTTGGATA CCTTTGGGTC CGTTGAATTT CCAGCCGACc
 301 GAGCTGTTCA AGCtGGCGGT CATCCTTTAT TTGGCAAGCC TGTTCACGCG
 351 CCGTGAAGAA GTGTTGcGCA GCATGGAAAG TTTGGGTTGG CAGTCGATTT
 401 GGCGGGGGAC GGCCAATCTG ATCATGTCCG CCACCAATCC GCAGrCACGT
 451 CGTGAaACAT TAGAAATGTA CGGCCGTwTC CGGGCGATCA TCCTGCCGAT
 501 TATGCTGGTG GCGTTCGGTT TGGTGCTGAT AATGGTACAG CCGGATTTCG
 551 GTTCGTTTGT CGTCATTACC GTCATTGCCG TTGGAATGCT GTTTTTGGCA
 601 GGATTGCCGT GGAAATATTT TTTCGTCCTG GTAGGCAGCG TCTTGGGCGG
 651 GATGGTGCTG ATGATTACCG CCGCTCCCTA CCGTGTGCAG CGGGTAGTGG
 701 CATTTTTGGA CCCGTGGAAA GACCCGCAGG GTGCCGGCTA CCAGCTTACC
 751 CACTCTCTGA TGGCAATCGG GCGCGGAGAG TGGTTCGGTA TGGGTTTGGG
 801 TGCGAGTTTG AGCAAACGCG GCTTTCTGCC GGAAGCGCAT ACCGATTTTA
 851 TTTTTGCCAT CATCGCCGAA GAATTCGGTT TCTTCGGTAT GTGCGTGCTG
 901 ATATTCTGTT ACGGCTGGCT GGTGGTGCGG GCGTTTTCCA TCGGCAAGCA
 951 GTCGCGCGAT TTGGGTTTGA CTTTCAACGC CTATATCGCT TCGGGTATCG
1001 GCATTTGGAT CGGkrTCCAA AGTTTCTTCA ATATCGGTGT GAACATCGGT
1051 GCTTTGCCGA mCAAAgGyCT GACGCyGCCG Tg.AtGTCCw ATGGCGGTTC
1101 GTCAGTCTTT TTCATGCTGA TCAGCATGAT GCTGCTGTkG CGTATAGATT
1151 ATGAAAACCG CCGGAAAATG CGCGGTTATC GGGTGGAGTA A
```

This corresponds to the amino acid sequence <SEQ ID 274; ORF 086>:

m086.pep

```
   1 MVVLMTAFSL LMIYSASVYL ASKEGGDQFF YLTRQAGFVV AGLIASGLLW
  51 FLCRMRTWRR LVPWIFALSG LLLVVVLIAG REINGATRWI PLGPLNFQPT
 101 ELFKLAVILY LASLFTRREE VLRSMESLGW QSIWRGTANL IMSATNPQXR
 151 RETLEMYGRX RAIILPIMLV AFGLVLIMVQ PDFGSFVVIT VIAVGMLFLA
 201 GLPWKYFFVL VGSVLGGMVL MITAAPYRVQ RVVAFLDPWK DPQGAGYQLT
 251 HSLMAIGRGE WFGMGLGASL SKRGFLPEAH TDFIFAIIAE EFGFFGMCVL
 301 IFCYGWLVVR AFSIGKQSRD LGLTFNAYIA SGIGIWIGXQ SFFNIGVNIG
 351 ALPXKGLTXP XMSXGGSSVF FMLISMMLLX RIDYENRRKM RGYRVE*
```

Computer analysis of this amino acid sequence gave the following results:

Homology with a predicted ORF from *N. gonorrhoeae*

ORF 086 shows 96.7% identity over a 396 aa overlap with a predicted ORF (ORF 086.ng) from *N. gonorrhoeae*:

m086/g086

```
                      10        20        30        40        50        60
m086.pep      MVVLMTAFSLLMIYSASVYLASKEGGDQFFYLTRQAGFVVAGLIASGLLWFLCRMRTWRR
              ||||||||:||||||||||||||||||||||||||||||||||||||||:||||||||||
g086          MVVLMTAFGLLMIYSASVYLASKEGGDQFFYLTRQAGFVVAGLIASGFLWRLCRMRTWRR
                      10        20        30        40        50        60

                      70        80        90       100       110       120
m086.pep      LVPWIFALSGLLLVVVLIAGREINGATRWIPLGPLNFQPTELFKLAVILYLASLFTRREE
              ||||||||||||||:|||||||||||||||||||||||||||||||||||||||||||||
g086          LVPWIFALSGLLLVAVLIAGREINGATRWIPLGPLNFQPTELFKLAVILYLASLFTRREE
                      70        80        90       100       110       120

                     130       140       150       160       170       180
m086.pep      VLRSMESLGWQSIWRGTANLIMSATNPQXRRETLEMYGRXRAIILPIMLVAFGLVLIMVQ
              |||||||||||||||||||||||||||| |||||||||| ||||||||||||||||||||
g086          VLRSMESLGWQSIWRGTANLIMSATNPQARRETLEMYGRFRAIILPIMLVAFGLVLIMVQ
                     130       140       150       160       170       180

                     190       200       210       220       230       240
m086.pep      PDFGSFVVITVIAVGMLFLAGLPWKYFFVLVGSVLGGMVLMITAAPYRVQRVVAFLDPWK
              ||||||||||||:|||||||||||||||||||||||||||||||||||||||||||||||
g086          PDFGSFVVITVITVGMLFLAGLPWKYFFVLVGSVLGGMVLMITAAPYRVQRVVAFLDPWK
                     190       200       210       220       230       240

                     250       260       270       280       290       300
m086.pep      DPQGAGYQLTHSLMAIGRGEWFGMGLGASLSKRGFLPEAHTDFIFAIIAEEFGFFGMCVL
              ||||||||||||||||||||||||||||||||||||||||||||||||||||||||||||
g086          DPQGAGYQLTHSLMAIGRGEWFGMGLGASLSKRGFLPEAHTDFIFAIIAEEFGFFGMCVL
                     250       260       270       280       290       300

                     310       320       330       340       350       360
m086.pep      IFCYGWLVVRAFSIGKQSRDLGLTFNAYIASGIGIWIGXQSFFNIGVNIGALPXKGLTXP
              |||||||||||||||||||||||||||||||||||||| ||||||||||||||:|||| |
g086          IFCYGWLVVRAFSIGKQSRDLGLTFNAYIASGIGIWIGIQSFFNIGVNIGALPTKGLTLP
                     310       320       330       340       350       360

                     370       380       390
m086.pep      XMSXGGSSVFFMLISMMLLXRIDYENRRKMRGYRVEX
               || ||||||||||||||| |||||||:|||||||||
g086          LMSYGGSSVFFMLISMMLLLRIDYENRQKMRGYRVEX
                     370       380       390
```

The following partial DNA sequence was identified in *N. meningitidis* <SEQ ID 275>:

a086.seq

```
  1 ATGGTGGTGC TGATGACGGC GTTCAGCCTG CTGATGATTT ATTCGGCTTC
 51 TGTGTATTTG GCATCAAAAG AAGGCGGCGA TCAGTTTTTC TATTTGACCA
101 GACAGGCGGG GTTCGTCGTT GCCGGCTTGA TAGCGAGCGG TTTGTTATGG
151 TTTCTTTGCA GGATGAGGAC ATGGCGGCGG CTTGTGCCGT GGATTTTTGC
201 CCTATCCGGC CTGTTGCTGG TAGTCGTATT GATTGCCGGG CGCGAAATCA
251 ATGGCGCGAC CCGTTGGATA CCTTTGGGTC CGTTGAATTT CCAGCCGACC
301 GAGCTGTTCA AGCTGGCGGT CATCCTTTAT TTGGCAAGCC TGTTCACGCG
351 CCGTGAAGAA GTGTTGCGCA GCATGGAAAG TTTGGGTTGG CAGTCGATTT
401 GGCGGGGGAC GGCCAATCTG ATCATGTCCG CCACCAATCC GCAGGCACGT
451 CGTGAAACAT TAGAAATGTA CGGCCGTTTC CGGGCGATCA TCCTGCCGAT
501 TATGCTGGTG GCGTTCGGTT TGGTGCTGAT AATGGTACAG CCGGATTTCG
551 GTTCGTTTGT CGTCATTACC GTCATTGCCG TTGGAATGCT GTTTTTGGCA
601 GGATTGCCGT GGAAATATTT TTTCGTCCTG GTAGGCAGCG TCTTGGGCGG
651 GATGGTGCTG ATGATTACCG CCGCTCCCTA CCGTGTGCAG CGGGTAGTGG
701 CATTTTTGGA CCCGTGGAAA GACCCGCAGG GTGCCGGCTA CCAGCTTACC
751 CACTCTCTGA TGGCAATCGG GCGCGGAGAG TGGTTCGGTA TGGGTTTGGG
801 TGCGAGTTTG AGCAAACGCG GCTTTCTGCC GGAAGCGCAT ACCGATTTTA
```

-continued

```
 851 TTTTTGCCAT CATCGCCGAA GAATTCGGTT TCTTCGGTAT GTGCGTGCTG

 901 ATATTCTGTT ACGGCTGGCT GGTGGTGCGG GCGTTTTCCA TCGGCAAGCA

 951 GTCGCGCGAT TTGGGTTTGA CTTTCAACGC CTATATCGCT TCGGGTATCG

1001 GCATTTGGAT CGGTATCCAA AGTTTCTTCA ATATCGGTGT GAACATCGGT

1051 GCTTTGCCGA CCAAAGGTCT GACGCTGCCG TTGATGTCCT ATGGCGGTTC

1101 GTCAGTCTTT TTCATGCTGA TCAGCATGAT GCTGCTGTTG CGTATAGATT

1151 ATGAAAACCG CCGGAAAATG CGCGGTTACC GGGTGGAGTA A
```

This corresponds to the amino acid sequence <SEQ ID 276; ORF 086.a>:

```
a086.pep

  1 MVVLMTAFSL LMIYSASVYL ASKEGGDQFF YLTRQAGFVV AGLIASGLLW

 51 FLCRMRTWRR LVPWIFALSG LLLVVVLIAG REINGATRWI PLGPLNFQPT

101 ELFKLAVILY LASLFTRREE VLRSMESLGW QSIWRGTANL IMSATNPQAR

151 RETLEMYGRF RAIILPIMLV AFGLVLIMVQ PDFGSFVVIT VIAVGMLFLA

201 GLPWKYFFVL VGSVLGGMVL MITAAPYRVQ RVVAFLDPWK DPQGAGYQLT

251 HSLMAIGRGE WFGMGLGASL SKRGFLPEAH TDFIFAIIAE EFGFFGMCVL

301 IFCYGWLVVR AFSIGKQSRD LGLTFNAYIA SGIGIWIGIQ SFFNIGVNIG

351 ALPTKGLTLP LMSYGGSSVF FMLISMMLLL RIDYENRRKM RGYRVE*
```

m086/a086 98.0% identity over a 396 aa overlap

```
                  10        20        30        40        50        60
m086.pep  MVVLMTAFSLLMIYSASVYLASKEGGDQFFYLTRQAGFVVAGLIASGLLWFLCRMRTWRR
          ||||||||||||||||||||||||||||||||||||||||||||||||||||||||||||
a086      MVVLMTAFSLLMIYSASVYLASKEGGDQFFYLTRQAGFVVAGLIASGLLWRLCRMRTWRR
                  10        20        30        40        50        60

                  70        80        90       100       110       120
m086.pep  LVPWIFALSGLLLVVVLIAGREINGATRWIPLGPLNFQPTELFKLAVILYLASLFTRREE
          ||||||||||||||||||||||||||||||||||||||||||||||||||||||||||||
a086      LVPWIFALSGLLLVVVLIAGREINGATRWIPLGPLNFQPTELFKLAVILYLASLFTRREE
                  70        80        90       100       110       120

                 130       140       150       160       170       180
m086.pep  VLRSMESLGWQSIWRGTANLIMSATNPQXRRETLEMYGRXRAIILPIMLVAFGLVLIMVQ
          |||||||||||||||||||||||||||| |||||||||| ||||||||||||||||||||
a086      VLRSMESLGWQSIWRGTANLIMSATNPQARRETLEMYGRFRAIILPIMLVAFGLVLIMVQ
                 130       140       150       160       170       180

                 190       200       210       220       230       240
m086.pep  PDFGSFVVITVIAVGMLFLAGLPWKYFFVLVGSVLGGMVLMITAAPYRVQRVVAFLDPWK
          ||||||||||||||||||||||||||||||||||||||||||||||||||||||||||||
a086      PDFGSFVVITVIAVGMLFLAGLPWKYFFVLVGSVLGGMVLMITAAPYRVQRVVAFLDPWK
                 190       200       210       220       230       240

                 250       260       270       280       290       300
m086.pep  DPQGAGYQLTHSLMAIGRGEWFGMGLGASLSKRGFLPEAHTDFIFAIIAEEFGFFGMCVL
          ||||||||||||||||||||||||||||||||||||||||||||||||||||||||||||
a086      DPQGAGYQLTHSLMAIGRGEWFGMGLGASLSKRGFLPEAHTDFIFAIIAEEFGFFGMCVL
                 250       260       270       280       290       300

                 310       320       330       340       350       360
m086.pep  IFCYGWLVVRAFSIGKQSRDLGLTFNAYIASGIGIWIGXQSFFNIGVNIGALPXKGLTXP
          ||||||||||||||||||||||||||||||||||||||| |||||||||||||:|||| |
a086      IFCYGWLVVRAFSIGKQSRDLGLTFNAYIASGIGIWIGIQSFFNIGVNIGALPTKGLTLP
                 310       320       330       340       350       360

                 370       380       390
m086.pep  XMSXGGSSVFFMLISMMLLXRIDYENRRKMRGYRVEX
           || ||||||||||||||| |||||||||||||||||
a086      LMSYGGSSVFFMLISMMLLLRIDYENRRKMRGYRVEX
                 370       380       390
```

The following partial DNA sequence was identified in *N. gonorrhoeae* <SEQ ID 277>:

g087.seq

```
   1 ATGGGCGGTA AAACCTTTAT GCTGATGGCG GGCGGAACGG GCGGACACAT
  51 TTTCCCAGCT CTGGCTGTGG CGGATTCATT GCGCGTGCGC GGTCATCATG
 101 TAATTTGGCT GGGCAGCAAG GATTCGATGG AAGAGCGCAT CGTGCCGCAA
 151 TACGGCATAC GCTTGGAAAC GCTGGCGATT AAAGGAATAC GCGGCAACGG
 201 CATCAAACGC AAGCTGATGC TTCCGTTTAC TCTGTACAAA ACCGTCCGCG
 251 AAGCGCAGCG GATTATCCGC AAACACCGTG TCGAGTGCGT CATCGGCTTC
 301 GGCGGTTTTG TTACCTTTCC CGGCGGTCTG GCGGCGAAAC TCTTGGGCGT
 351 GCCGATTGTG ATTCACGAGC AAAACGCCGT GGCAGGCTTG TCCAACCGCC
 401 AccTGTCGCg ctGGGCGAAA CGGGTGTTGT ACGCTTTTCC GAAAGCGTTC
 451 AGCCACGAAG GCGGTTTGGT CGGCAACCCC GTCCGCGCCG ATATTAGCAA
 501 CCTGCCCGTG CCTGCCGAAC GCTTCCAAGG GCGCGAAGGC CGTCTGAAAA
 551 TTTTGGTGGT CGGCGGCAGT TTGGGTGCGG ACGTTTTGAA CAAAACCGTA
 601 CCGCAGGCGT TGGCACTGCT GCCTGAAGAG GTGCGCCCGC AGATGTACCA
 651 CCAGTCGGGG CGTAACAAGC TGGGCAATCT TCAGGCGGAT TATGACGCGT
 701 TGGGCGTGAA AGCGGAATGC GTGGAATTTA TTACCGACAT GGTGTCCGCC
 751 TACCGTGATG CCGATTTGGT GATTTGCCGT GCCGGCGCGC TGACGATTGC
 801 CGAGTTGACG GCGGCGGGGC TGGGCGCGTT GTTAGTGCCG TATCCTCACG
 851 CCGTTGATGA CCATCAAACC GCCAACGCGC GTTTCATGGT GCAGGCAGAA
 901 GCGGGGCTGC TGTTGCCGCA AACCCAGTTG ACGGCGGAAA AACTCGCCGA
 951 AATCCTCGGC AGCCTCAACC GCGAAAAATG CCTCAAATGG GCGGAAAACG
1001 CCCGTACGTT GGCATTGCCG CACAGCGCGG ATGACGTTGC CGAAGCCGCG
1051 ATTGCGTGTG CGGCGTAAA
```

This corresponds to the amino acid sequence <SEQ ID 278; ORF 087.ng>:

g087.pep

```
  1 MGGKTFMLMA GGTGGHIFPA LAVADSLRVR GHHVIWLGSK DSMEERIVPQ
 51 YGIRLETLAI KGIRGNGIKR KLMLPFTLYK TVREAQRIIR KHRVECVIGF
101 GGFVTFPGGL AAKLLGVPIV IHEQNAVAGL SNRHLSRWAK RVLYAFPKAF
151 SHEGGLVGNP VRADISNLPV PAERFQGREG RLKILVVGGS LGADVLNKTV
201 PQALALLPEE VRPQMYHQSG RNKLGNLQAD YDALGVKAEC VEFITDMVSA
251 YRDADLVICR AGALTIAELT AAGLGALLVP YPHAVDDHQT ANARFMVQAE
301 AGLLLPQTQL TAEKLAEILG SLNREKCLKW AENARTLALP HSADDVAEAA
351 IACAA*
```

The following partial DNA sequence was identified in *N. meningitidis* <SEQ ID 279>:

m087.seq

```
   1 ATGGGCGGTA AAACCTTTAT GCTGAwkkCG GGCGGAACGG GCGGACATAT
  51 TTTCCCCGCG CTGGCGGTGG CGGATTCATT GCGCGCGCGC GGCCATCATG
 101 TGATTTGGCT GGGCAGCAAG GATTCGATGG AAGAGCGTAT CGTGCCGCAA
 151 TACGGCATAC GCTTGGAAAC GCTGGCGATT AAAGGCGTGC GCGGCAACGG
 201 CATCAAACGC AAACTGATGC TGCCGGTTAC TTTGTATCAA ACCGTCCGCG
 251 AAGCGCAGCG GATTATCCGC AAACACCGTG TCGAGTGCGT CATCGGCTTC
 301 GGCGGCTTCG TTACCTTCCC CGGCGGTTTG GCGGCGAAGC TATTArGCGT
 351 GCCGATTGTG ATTCACGAGC AAAACGCCGT GGCAGGTTTG TCCAACCGCC
 401 ACCTGTCGCG CTGGGCGAAG CGGGTGTTGT ACGCTTTTCC GAAAGCGTTC
 451 AGCCACGAAG GCGGCTTGGT CGGCAACCCC GTCCGCGCCG ATATTAGCAA
 501 CCTGCCCGTG CCTGCCGAAC GCTTCCAAGG GCGTGAAGGC CGTCTGAAAA
 551 TTTTGGTGGT CGGCGGCAGT TTGGGCGCGG ACGTTTTGAA CAAAACCGTA
 601 CCGCATGCAT TGGCTTTGCT GCCCGACAAT GCGCGTCCGC ATATGTACCA
 651 CCAATCGGGA CGGGGCAAGC TGGGCATCTT GCAGGCGnnn nnnnnnnnnn
 701 nnnnnnnnnn nnnnnnnnnn nnnnnnnnnn nnnnnnnnnn nnnnnnnnnn
 751 nnnGCGGGAT TGGGTGCGTT GTTAGTGCCG TATCCTCACG CGGTTGACGA
 801 TCACCAAACC GCCAACGCGC GTTTTATGGT GCAGGCGGAG GCGGGATTGC
 851 TGTTGCCGCA AACCCAGTTG ACGGCGGAAA AACTCGCCGA GATTCTCGGC
 901 GGCTTAAACC GCGAAAAATG CCTCAAATGG GCAGAAAACG CCCGTACGTT
 951 GGCACTGCCG CACAGTGCGG ACGACGTGGC GGAAGCCGCG ATTGCGTGTG
1001 CGGCGTAA
```

This corresponds to the amino acid sequence <SEQ ID 280; ORF 087>:

m087.pep

```
  1 MGGKTFMLXX GGTGGHIFPA LAVADSLRAR GHHVIWLGSK DSMEERIVPQ
 51 YGIRLETLAI KGVRGNGIKR KLMLPVTLYQ TVREAQRIIR KHRVECVIGF
101 GGFVTFPGGL AAKLLXVPIV IHEQNAVAGL SNRHLSRWAK RVLYAFPKAF
151 SHEGGLVGNP VRADISNLPV PAERFQGREG RLKILVVGGS LGADVLNKTV
201 PHALALLPDN ARPHMYHQSG RGKLGILQAX XXXXXXXXXX XXXXXXXXXX
251 XAGLGALLVP YPHAVDDHQT ANARFMVQAE AGLLLPQTQL TAEKLAEILG
301 GLNREKCLKW AENARTLALP HSADDVAEAA IACAA*
```

Computer analysis of this amino acid sequence gave the following results:

Homology with a predicted ORF from *N. gonorrhoeae*

ORF 087 shows 83.9% identity over a 355 aa overlap with a predicted ORF (ORF 087.ng) from *N. gonorrhoeae*:

m087/g087

```
                 10         20         30         40         50         60
m087.pep   MGGKTFMLXXGGTGGHIFPALAVADSLRARGHHVIWLGSKDSMEERIVPQYGIRLETLAI
           ||||||||  |||||||||||||||||||:||||||||||||||||||||||||||||||
g087       MGGKTFMLMAGGTGGHIFPALAVADSLRVRGHHVIWLGSKDSMEERIVPQYGIRLETLAI
                 10         20         30         40         50         60

                 70         80         90        100        110        120
m087.pep   KGVRGNGIKRKLMLPVTLYQTVREAQRIIRKHRVECVIGFGGFVTFPGGLAAKLLXVPIV
           ||:||||||||||| |||:||||||||||||||||||||||||||||||||||| ||||
g087       KGIRGNGIKRKLMLPFTLYKTVREAQRIIRKHRVECVIGFGGFVTFPGGLAAKLLGVPIV
                 70         80         90        100        110        120

                130        140        150        160        170        180
m087.pep   IHEQNAVAGLSNRHLSRWAKRVLYAFPKAFSHEGGLVGNPVRADISNLPVPAERFQGREG
           ||||||||||||||||||||||||||||||||||||||||||||||||||||||||||||
g087       IHEQNAVAGLSNRHLSRWAKRVLYAFPKAFSHEGGLVGNPVRADISNLPVPAERFQGREG
                130        140        150        160        170        180

                190        200        210        220        229
m087.pep    RLKILVVGGSLGADVLNKTVPHALALLPDNARPHMYHQSGRGKLGILQA-----------
            |||||||||||||||||||||:||||||:::||:|||||||:||| |||
g087        RLKILVVGGSLGADVLNKTVPQALALLPEEVRPQMYHQSGRNKLGNLQADYDALGVKAEC
                190        200        210        220        230        240

                                     230        240        250
m087.pep    -------------------------------AGLGALLVPYPHAVDDHQTANARFMVQAE
                                           ||||||||||||||||||||||||||||
g087        VEFITDMVSAYRDADLVICRAGALTIAELTAAGLGALLVPYPHAVDDHQTANARFMVQAE
                250        260        270        280        290        300

          260        270        280        290        300        310
m087.pep   AGLLLPQTQLTAEKLAEILGGLNREKCLKWAENARTLALPHSADDVAEAAIACAAX
           ||||||||||||||||||||:|||||||||||||||||||||||||||||||||||
g087       AGLLLPQTQLTAEKLAEILGSLNREKCLKWAENARTLALPHSADDVAEAAIACAAX
                310        320        330        340        350
```

The following partial DNA sequence was identified in *N. meningitidis* <SEQ ID 281>:

a087.seq

```
  1 ATGGGCGGTA AAACCTTTAT GCTGATGGCG GGCGGAACGG GCGGACATAT
 51 TTTCCCCGCG CTGGCGGTGG CGGATTCATT GCGCGCGCGC GGCCATCATG
101 TAATTTGGCT GGGCAGCAAG GATTCGATGG AAGAGCGCAT CGTGCCGCAA
151 TACGACATCC TGCTCGAAAC GCTGGCGATT AAAGGCGTGC GCGGCAACGG
201 CATCAAACGC AAGCTGATGC TGCCGTTTAC TTTGTATCAA ACTGTCCGCG
251 AAGCGCAGCA GATTATCCGC AAACACCGTG TCGAGTGCGT CATCGGCTTC
301 GGCGGCTTCG TTACCTTTCC CGGCGGTTTG GCGGCGAAGT TATTAGGCGT
351 GCCGATTGTG ATTCACGAGC AAAACGCCGT GGCAGGTTTG TCCAACCGCC
401 ACCTGTCGCG CTGGGCGAAG CGGGTGTTGT ACGCTTTTCC GAAAGCGTTC
451 AGCCACGAAG GCGGCTTGGT CGGCAACCCC GTCCGCGCCG ATATTAGCAA
501 CCTGCCCGTG CCTGCCGAAC GCTTCCAAGG GCGTGAAGGC CGTCTGAAAA
551 TTTTGGTGGT CGGCGGCAGT TTGGGCGCGG ACGTTTTGAA CAAAACCGTA
601 CCGCAGGCAT TGGCTTTGCT GCCCGACAAT GCGCGTCCGC AGATGTACCA
651 CCAATCGGGA CGGGGCAAGC TGGGCAGCTT GCAGGCGGAT TACGACGCGC
701 TGGGCGTGCA AGCGGAATGC GTGGAATTTA TTACCGATAT GGTGTCCGCC
751 TACCGCGATG CCGATTTGGT GATTTGCCGT GCCGGCGCGC TGACGATTGC
801 CGAGTTGACG GCGGCGGGAT TGGGTGCGTT GTTAGTGCCG TATCCTCACG
851 CCGTTGATGA CCATCAAACC GCCAACGCGC GTTTTATGGT GCAGGCGGAG
901 GCGGGATTGC TGTTGCCGCA AACCCAGTTG ACGGCGGAAA AACTCGCCGA
```

-continued

951 GATTCTCGGC GGCTTAAACC GCGAAAAATG CCTCAAATGG GCAGAAAACG

1001 CCCGTACGTT GGCACTGCCG CACAGTGCGG ACGACGTTGC CGAAGCCGCG

1051 ATTGCGTGTG CGGCGTAA

This corresponds to the amino acid sequence <SEQ ID 282; ORF 087.a>:

a087.pep

1 MGGKTFMLMA GGTGGHIFPA LAVADSLRAR GHHVIWLGSK DSMEERIVPQ

51 YDILLETLAI KGVRGNGIKR KLMLPFTLYQ TVREAQQIIR KHRVECVIGF

101 GGFVTFPGGL AAKLLGVPIV IHEQNAVAGL SNRHLSRWAK RVLYAFPKAF

151 SHEGGLVGNP VRADISNLPV PAERFQGREG RLKILVVGGS LGADVLNKTV

201 PQALALLPDN ARPQMYHQSG RGKLGSLQAD YDALGVQAEC VEFITDMVSA

251 YRDADLVICR AGALTIAELT AAGLGALLVP YPHAVDDHQT ANARFMVQAE

301 AGLLLPQTQL TAEKLAEILG GLNREKCLKW AENARTLALP HSADDVAEAA

351 IACAA* m087/a087 85.4% identity over a 355 aa overlap

```
                   10        20        30        40        50        60
m087.pep   MGGKTFMLXXGGTGGHIFPALAVADSLRARGHHVIWLGSKDSMEERIVPQYGIRLETLAI
           ||||||||  ||||||||||||||||||||||||||||||||||||||||| | ||||||
a087       MGGKTFMLMAGGTGGHIFPALAVADSLRARGHHVIWLGSKDSMEERIVPQYDILLETLAI
                   10        20        30        40        50        60

                   70        80        90       100       110       120
m087.pep   KGVRGNGIKRKLMLPVTLYQTVREAQRIIRKHRVECVIGFGGFVTFPGGLAAKLLXVPIV
           ||||||||||||||| |||||||||||:||||||||||||||||||||||||||| ||||
a087       KGVRGNGIKRKLMLPFTLYQTVREAQQIIRKHRVECVIGFGGFVTFPGGLAAKLLGVPIV
                   70        80        90       100       110       120

                  130       140       150       160       170       180
m087.pep   IHEQNAVAGLSNRHLSRWAKRVLYAFPKAFSHEGGLVGNPVRADISNLPVPAERFQGREG
           ||||||||||||||||||||||||||||||||||||||||||||||||||||||||||||
a087       IHEQNAVAGLSNRHLSRWAKRVLYAFPKAFSHEGGLVGNPVRADISNLPVPAERFQGREG
                  130       140       150       160       170       180

                   190       200       210       220       230       240
m087.pep    RLKILVVGGSLGADVLNKTVPHALALLPDNARPHMYHQSGRGKLGILQAXXXXXXXXXXX
            |||||||||||||||||||||:|||||||||||:||||||||||| |||
a087        RLKILVVGGSLGADVLNKTVPQALALLPDNARPQMYHQSGRGKLGSLQADYDALGVKQEC
                   190       200       210       220       230       240

                                       250       260       270       280
m087.pep    XX--------------------XXXXXXXXXAGLGALLVPYPHAVDDHQTANARFMVQAE
                                    :    : |||||||||||||||||||||||||||||
a087        VEFITDMVSAYRDADLVICRAGALTIAELTAAGLGALLVPYPHAVDDHQTANARFMVQAE
                   250       260       270       280       290       300

                  290       300       310       320       330
m087.pep   AGLLLPQTQLTAEKLAEILGGLNREKCLKWAENARTLALPHSADDVAEAAIACAAX
           ||||||||||||||||||||||||||||||||||||||||||||||||||||||||
a087       AGLLLPQTQLTAEKLAEILGGLNREKCLKWAENARTLALPHSADDVAEAAIACAAX
                  310       320       330       340       350
```

The following partial DNA sequence was identified in *N. gonorrhoeae* <SEQ ID 283>:

g088.seq

1 ATGTTTTTAT GGCTCGCACA TTTCAGCAAC TGGTTAACCG GTCTGAATAT

51 TTTTCAATAC ACCACATTCC GCGCCGTTAT GGCGGCGTTG ACCGCCTTGG

101 CGTTTTCCCT GATGTTCGGC CCGTGGACGA TACGCAGGCT GACCGCGCTC

-continued

151 AAATGCGGGC AGGCAGTGCG TACCGACGGC CCGCAAACCC ACCTCGTCAA

201 AAACGGCACG CCGACGATGG GCGGTTCGCT GATTCTGACC GCCATTACCG

251 TGTCCACCCT GTTGTGGGGC AACTGGGCGA ACCCGTATAT CTGGATTCTC

301 TTGGGCGTAC TGCTTGCCAC CGGTGCGCTC GGTTTTTACG ACGACTGGCG

351 CAAAGTCGTT TATAAAGACC CCAACGGCGT GTCCGCCAAA TTCAAAATGG

401 TGTGGCAGTC AAGCGTTGCC GTTatcgcCG GTttggcaTT GTTTTACctt 451 gCcgcCAATT CCGCCAACAA TATTTTGATT GTCCCGtttT TCAAACAAAT 501 CGCCCTGCCG CTGGGCGTGG TCGGCTTttt gGtgttgTCT TACCTGACCA 551 TCGTCGGCAC ATCCAACGCC GTCAACCTCA CcgaCGGCTT GGACGGCCTT 601 GCCGCcttcc cgttcgtcct cgttgccgcC GGGCTCGCCA ttttcgccTA

651 CGTCAGCGGA CACTACCAAT TTTCCCAATA CCTCCAGCTT CCCTATGTCG

701 CCGGCGCGAA CGAAGTCGCT ATATTCTGCA CCGCCATGTG CGGCGCGTGC

751 CTCGGATTTT TGTGGTTCAA CGCCTATCCC GCGCAAGTCT TTATGGGCGA

801 TGTCGGCGCG CTGGCATTGG GTGCCGCGCT CGGTaccGtt gCCGTcaTcg 851 tCCGCCAAGA ATTTGTcctc gtcattaTGG GCGGTCTGTT cgtcgtagaa 901 gccgtgTCCG TTATGCTTCa tgtcggCTGG TACAAGAAAA Ccaaaaaacg 951 CATCTTcCTg acgGcaccga ttcatcacca ttaCCaactt cgatgCTGGa 1001 aagaaacgca agtcgtcgtc CGTTtCTGGA TTAtTAccat cgtcgtggtt 1051 tTgataggtt tGagtacccT caAAattcgc ggaaactatg ccgTCCGAAC

1101 ACCTTTCAGA CGGCATTTGA ACGCGCAATA A

This corresponds to the amino acid sequence <SEQ ID 284; ORF 088.ng>:

g088.pep

1 MFLWLAHFSN WLTGLNIFQY TTFRAVMAAL TALAFSLMFG PWTIRRLTAL

51 KCGQAVRTDG PQTHLVKNGT PTMGGSLILT AITVSTLLWG NWANPYIWIL

101 LGVLLATGAL GFYDDWRKVV YKDPNGVSAK FKMVWQSSVA VIAGLALFYL

151 AANSANNILI VPFFKQIALP LGVVGFLVLS YLTIVGTSNA VNLTDGLDGL

201 AAFPFVLVAA GLAIFAYVSG HYQFSQYLQL PYVAGANEVA IFCTAMCGAC

251 LGFLWFNAYP AQVFMGDVGA LALGAALGTV AVIVRQEFVL VIMGGLFVVE

301 AVSVMLHVGW YKKTKKRIFL TAPIHHHYQL RCWKETQVVV RFWIITIVVV

351 LIGLSTLKIR GNYAVRTPFR RHLNAQ*

The following partial DNA sequence was identified in *N. meningitidis* <SEQ ID 285>:

m088.seq

1 ATGTTTTTAT GGCTCGCACA TTTCAGCAnC TGGTTAACCG GTCTGAATnn 51 nnnnnnnnnn nnnnnnnnnn nnnnnnnnnn nnnnnnnnnn nnnnnnnnnn 101 nnnnnnnnnn nnnnnnnnnn nnnnnnnnnn nnnnnnnnnn nnnnnnnnnn -continued

```
 151 nnnnnnnnnn nnnnnnnnnn nnnnnnnnnn nnnnnnnnnn nnnnnnnnnn

 201 nnnnnnnnnn nnnnnnnnnn nnnnnnnnnn nnnnnnnnnn nnnnnnnnnn

 251 nnnnnnnnnn nnnnnnnnnn nnnnnnnnnn nnnnnnnnnn nnnnnnnnnn

 301 nnnnnnnnnn nnnnnnnnnn nnnnnnnnnn nnnnnnnnnn nnnnnnnnnn

 351 nnnnnnnnnn nnnnnnnnnn nnnnnnnnnn nnnnnnnnnn nnnnnnnnnn

 401 nnnnnnnnnn nnnnnnnnnn nnnnnnnnnn nnnnnnnnnn nnnnnnnnnn

 451 nnnnnnnnnn nnnnnnnnnn nnnnnnnnnn nnnnnnnnnn nnnnnnnnnn

 501 nnnnnnnnnn nnnGGCGTGG TCGGCTTTTT GGTGTTGTCT TACCTGACCA

 551 TCGTCGGCAC ATCCAATGCC GTCAACCTCA CCGACGGCTT GGACGGCCTT

 601 GCGACCTTCC CCGTCGTCCT CGTTGCCGCC GGCCTCGCCA TCTTCGCCTA

 651 TGCCAGCGGC CACTCACAAT TTGCCCAATA CCTGCAATTA CCTTACGTTG

 701 CCGGCGCAAA CGAAGTGGTG ATTTTCTGTA CCGCCATGTG CGGCGCGTGC

 751 CTCGGTTTCT TGTGGTTTAA CGCCTATCCC GCGCAAGTCT TTATGGGCGA

 801 TGTCGGTGCA TTGGCATTGG GTGCCGCGCT CGGTACCGTC GCCGTTATCG

 851 TCCGCCAAGA GTTTGTCCTC GTCATTATGG GCGGATTATT TGTCGTAGAA

 901 GCCGTATCCG TTATGCTTCA GGTTGGCTGG TATAAGAAAA CCAAAAAACG

 951 CATCTTCCTG ATGGCGCCCA TCCATCACCA CTACGAACAA AAAGGCTGGA

1001 AAGAAACCCA AGTCGTCGTC CGCTTTTGGA TTATTACCAT CGTCTTGGTG

1051 TTGATCGGTT TGAGTACCCT CAAAATCCGC TGAACCTATG CCGTCTGAAC

1101 ATCTTTCAGA CGGCATTTGA ACGCGCAATA A

   1 MFLWLAHFSN WLTGLNIFQY TTFRAVMAAL TALAFSLMFG PWTIRRLTAL

  51 KCGQAVRTDG PQTHLVKNGT PTMGGSLILT AITVSTLLWG NWANPYIWIL

 101 LGVLLATGAL GFYDDWRKVV YKDPNGVSAK FKMVWQSSVA VIAGLALFYL

 151 AANSANNILI VPFFKQIALP LGVVGFLVLS YLTIVGTSNA VNLTDGLDGL

 201 AAFPFVLVAA GLAIFAYVSG HYQFSQYLQL PYVAGANEVA IFCTAMCGAC

 251 LGFLWFNAYP AQVFMGDVGA LALGAALGTV AVIVRQEFVL VIMGGLFVVE

 301 AVSVMLHVGW YKKTKKRIFL TAPIHHHYQL RCWKETQVVV RFWIITIVVV

 351 LIGLSTLKIR GNYAVRTPFR RHLNAQ*
```

This corresponds to the amino acid sequence <SEQ ID 286; ORF 088>:

m088.pep

```
  1 MFLWLAHFSX WLTGLNXXXX XXXXXXXXXX XXXXXXXXXX XXXXXXXXXX

 51 XXXXXXXXXX XXXXXXXXXX XXXXXXXXXX XXXXXXXXXX XXXXXXXXXX

101 XXXXXXXXXX XXXXXXXXXX XXXXXXXXXX XXXXXXXXXX XXXXXXXXXX

151 XXXXXXXXXX XXXXXXXXXX XGVVGFLVLS YLTIVGTSNA VNLTDGLDGL

201 ATFPVVLVAA GLAIFAYASG HSQFAQYLQL PYVAGANEVV IFCTAMCGAC

251 LGFLWFNAYP AQVFMGDVGA LALGAALGTV AVIVRQEFVL VIMGGLFVVE

301 AVSVMLQVGW YKKTKKRIFL MAPIHHHYEQ KGWKETQVVV RFWIITIVLV

351 LIGLSTLKIR XTYAVXTSFR RHLNAQ*
```

Computer analysis of this amino acid sequence gave the following results:

Homology with a predicted ORF from *N. gonorrhoeae*

ORF 088 shows 91.7% identity over a 205 aa overlap with a predicted ORF (ORF 088.ng) from *N. gonorrhoeae*:

m088/g088

```
                                                 10        20        30
m088.pep                               GVVGFLVLSYLTIVGTSNAVNLTDGLDGLA
                                       ||||||||||||||||||||||||||||||
g088       IAGLALFYLAANSANNILIVPFFKQIALPLGVVGFLVLSYLTIVGTSNAVNLTDGLDGLA
                  150       160       170       180       190       200

                   40        50        60        70        80        90
m088.pep   TFPVVLVAAGLAIFAYASGHSQFAQYLQLPYVAGANEVVIFCTAMCGACLGFLWFNAYPA
           :|| ||||||||||||:||| ||:||||||||||||||:|||||||||||||||||||||
g088       AFPFVLVAAGLAIFAYVSGHYQFSQYLQLPYVAGANEVAIFCTAMCGACLGFLWFNAYPA
                  210       220       230       240       250       260

                  100       100       120       130       140       150
m088.pep   QVFMGDVGALALGAALGTVAVIVRQEFVLVIMGGLFVVEAVSVMLQVGWYKKTKKRIFLM
           |||||||||||||||||||||||||||||||||||||||||||||:||||||||||||| 
g088       QVFMGDVGALALGAALGTVAVIVRQEFVLVIMGGLFVVEAVSVMLHVGWYKKTKKRIFLT
                  270       280       290       300       310       320

                  160       170       180       190       200
m088.pep   APIHHHYEQKGWKETQVVVRFWIITIVLVLIGLSTLKIRXTYAVXTSFRRHLNAOX
           |||||||: : ||||||||||||||||:||||||||||| :||| | |||||||||
g088       APIHHHYQLRCWKETQVVVRFWIITIVVVLIGLSTLKIRGNYAVRTPFRRHLNAQX
                  330       340       350       360       370
```

The following partial DNA sequence was identified in *N. meningitidis* <SEQ ID 287>:

a088.seq

```
  1 ATGTTTTTAT GGCTCGCACA TTTCAGCAAC TGGTTAACCG GTCTGAATAT
 51 TTTTCAATAC ACCACATTCC GCGCCGTCAT GGCGGCGTTG ACCGCCTTGG
101 CGTTTTCCCT GATGTTCGGC CCGTGGACGA TACGCAGGCT GACCGCGCTC
151 AAATGCGGGC AGGCAGTGCG TACCGACGGT CCGCAAACCC ACCTCGTCAA
201 AAACGGCACG CCGACGATGG GCGGTTCGCT GATTCTGACC GCCATTACCG
251 TGTCCACCCT GTTGTGGGGC AACTGGGCAA ACCCGTATAT CTGGATTCTC
301 TTGGGCGTAT TGCTCGCCAC GGGCGCACTC GGTTTTTACG ACGACTGGCG
351 CAAAGTCGTC TATAAAGACC CCAACGGCGT GTCCGCCAAA TTCAAAATGG
401 TGTGGCAGTC AAGCGTTGCC ATTATCGCCG GTTTGGCATT GTTTTACCTT
451 GCCGCCAATT CCGCCAACAA TATTTTGATT GTCCCGTTCT TCAAACAAAT
501 CGCCCTGCCG CTGGGCGTGG TCGGCTTTTT GGTGTTGTCT TACCTGACCA
551 TCGTCGGCAC ATCCAATGCC GTCAACCTCA CCGACGGCTT GGACGGCCTT
601 GCGACCTTCC CCGTCGTCCT CGTTGCCGCC GGCCTCGCCA TCTTCGCCTA
651 TGCCAGCGGC CACTCACAAT TTGCCCAATA CCTGCAATTA CCTTACGTTG
701 CCGGCGCAAA CGAAGTGGTG ATTTTCTGTA CCGCCATGTG CGGCGCGTGC
751 CTCGGTTTCT TGTGGTTTAA CGCCTATCCC GCGCAAGTCT TTATGGGCGA
801 TGTCGGTGCA TTGGCATTGG GTGCCGCGCT CGGTACCGTC GCCGTCATCG
851 TCCGCCAAGA GTTTGTCCTC GTCATTATGG GCGGATTATT TGTCGTAGAA
901 GCCGTATCCG TTATGCTTCA GGTCGGCTGG TATAAGAAAA CCAAAAAACG
951 CATCTTCCTG ATGGCGCCCA TCCATCACCA CTACGAACAA AAAGGCTGGA
```

-continued

```
1001 AAGAAACCCA AGTCGTCGTC CGCTTTTGGA TTATTACCAT CGTCTTGGTG

1051 TTGATCGGTT TGAGTACCCT CAAAATCCGC TGAACCTATG CCGTCTGAAC

1101 ACCTTTCAGA CGGCATTTGA ACGCGCAATA A
```

This corresponds to the amino acid sequence <SEQ ID 288; ORF 088.a>:

a088.pep

```
  1 MFLWLAHFSN WLTGLNIFQY TTFRAVMAAL TALAFSLMFG PWTIRRLTAL

 51 KCGQAVRTDG PQTHLVKNGT PTMGGSLILT AITVSTLLWG NWANPYIWIL

101 LGVLLATGAL GFYDDWRKVV YKDPNGVSAK FKMVWQSSVA IIAGLALFYL

151 AANSANNILI VPFFKQIALP LGVVGFLVLS YLTIVGTSNA VNLTDGLDGL

201 ATFPVVLVAA GLAIFAYASG HSQFAQYLQL PYVAGANEVV IFCTAMCGAC

251 LGFLWFNAYP AQVFMGDVGA LALGAALGTV AVIVRQEFVL VIMGGLFVVE

301 AVSVMLQVGW YKKTKKRIFL MAPIHHHYEQ KGWKETQVVV RFWIITIVLV

351 LIGLSTLKIR *TYAV*TPFR RHLNAQ*
```

m088/a088 99.5% identity over a 205 aa overlap

```
                 150       160       170       180       190       200
m088.pep  XXXXXXXXXXXXXXXXXXXXXXXXXXXXXXGVVGFLVLSYLTIVGTSNAVNLTDGLDGLA
                                          ||||||||||||||||||||||||||||||
a088      IAGLALFYLAANSANNILIVPFFKQIALPLGVVGFLVLSYLTIVGTSNAVNLTDGLDGLA
                 150       160       170       180       190       200

                 210       220       230       240       250       260
m088.pep  TFPVVLVAAGLAIFAYASGHSQFAQYLQLPYVAGANEVVIFCTAMCGACLGFLWFNAYPA
          ||||||||||||||||||||||||||||||||||||||||||||||||||||||||||||
a088      TFPVVLVAAGLAIFAYASGHSQFAQYLQLPYVAGANEVVIFCTAMCGACLGFLWFNAYPA
                 210       220       230       240       250       260

                 270       280       290       300       310       320
m088.pep  QVFMGDVGALALGAALGTVAVIVRQEFVLVIMGGLFVVEAVSVMLQVGWYKKTKKRIFLM
          ||||||||||||||||||||||||||||||||||||||||||||||||||||||||||||
a088      QVFMGDVGALALGAALGTVAVIVRQEFVLVIMGGLFVVEAVSVMLQVGWYKKTKKRIFLM
                 270       280       290       300       310       320

                 330       340       350       360       370
m088.pep  APIHHHYEQKGWKETQVVVRFWIITIVLVLIGLSTLKIRXTYAVXTSFRRHLNAQX
          |||||||||||||||||||||||||||||||||||||||||||||| |||||||||
a088      APIHHHYEQKGWKETQVVVRFWIITIVLVLIGLSTLKIRXTYAVXTPFRRHLNAQX
                 330       340       350       360       370
```

The following partial DNA sequence was identified in *N. gonorrhoeae* <SEQ ID 289>:

g089.seq

```
  1 ATGCCGCCCA AAATCACGAA GAGCGGGTTT TGCAAACCGG CAATCGCGGC

 51 GGCGGTCGCG CCGACATTCG TGCCTTTGCT GTCGTCGATG AATACCACGC

101 CGTTTTTCTC GCCGATTTTT TCCACACGGT GCGGCAAGCC TTGGAAGGTT

151 TTGACGTGTT CCAGCAATGC TTCGCGCGGC AAACCGACGG CCTCGCACAA

201 AGCCACGGCA GCCATAACGT TGGCGGCGTT GTGCAAACCT TGCAGCGGGA

251 TGTCTTGCGT AGAAATCAAA TCTTCATTGC CTTGTTTTAA ACAGCCCGTC

301 CCGCGTTCCA ACCAAAAATC GGCTTCGTGT TCCAAGGAAA ACCGTTTCAC
```

-continued

```
351 TTCACGCCCT GCCCGTTTCA TGGCGCGGCA GAACACGTCG TCCGCATTCA

401 AAACCTGCAC TCCATCGCCA CGGAAAATCT CGGCTTTGGT ATGCGCGTAG
```

This corresponds to the amino acid sequence <SEQ ID 290; ORF 089.ng>:

g089.pep

```
  1 MPPKITKSGF CKPAIAAAVA PTFVPLLSSM NTTPFFSPIF STRCGKPWKV

 51 LTCSSNASRG KPTASHKATA AITLAALCKP CSGMSCVEIK SSLPCFKQPV

101 PRSNQKSASC SKENRFTSRP ARFMARQNTS SAFKTCTPSP RKISALVCA*
```

The following partial DNA sequence was identified in N meningitidis <SEQ ID 291>:

m089.seq

```
  1 ATGCCGCCCA AAATCACkAw GAGCGGATTT TGCAAACCGG CAATCGCGGC

 51 GGCAGTCGCG CCGACATTCG TGCCTTTGCT GTCGTCGATA AACACCACGC

101 CGTTTTTCTC GCCGATTTTT TCCACGCGGT GCGGCAGGCC TTGGAAGGTT

151 TTGACGTGTT CGAGCAATGC TTCGCGCGAC AAACCGATGG CCTCACACAA

201 AGCCACkGCA GCCATGACGT TAGCGGCGTT GTGCAkACCT TGCAACGGwA

251 TGTCTTGCGT GACAATCAAA TCTTCATTGC CTTGTTTCAG GCGGCCTGTC

301 TCGCGTTCCA ACCAGAAATC AGCTTCGTGT TCCAACGAAA ACCATTTTAC

351 CTCGCGCCCG GCACGCTTCA TCGCGCGGCA GAACGCATCG TCCGCATTCA

401 AAACCTGCAC GCCGTCGCCA CGGAAAATCT TGGCTTTGGT ATGCGCATAG
```

This corresponds to the amino acid sequence <SEQ ID 292; ORF 089>:

m089.pep

```
  1 MPPKITXSGF CKPAIAAAVA PTFVPLLSSI NTTPFFSPIF STRCGRPWKV

 51 LTCSSNASRD KPMASHKATA AMTLAALCXP CNGMSCVTIK SSLPCFRRPV

101 SRSNQKSASC SNENHFTSRP ARFIARQNAS SAFKTCTPSP RKILALVCA*
```

Computer analysis of this amino acid sequence gave the following results:

Homology with a predicted ORF from *N. gonorrhoeae*

ORF 089 shows 88.6% identity over a 149 aa overlap with a predicted ORF (ORF 089.ng) from *N. gonorrhoeae*:

m089/g089

```
                    10        20        30        40        50        60
m089.pep   MPPKITXSGFCKPAIAAAVAPTFVPLLSSINTTPFFSPIFSTRCGRPWKVLTCSSNASRD
           |||||| |||||||||||||||||||||||:||||||||||||||:||||||||||||| 
g089       MPPKITKSGFCKPAIAAAVAPTFVPLLSSMNTTPFFSPIFSTRCGKPWKVLTCSSNASRG
                    10        20        30        40        50        60
```

-continued

```
                   70        80        90       100       110       120
m089.pep   KPMASHKATAAMTLAALCXPCNGMSCVTIKSSLPCFRRPVSRSNQKSASCSNENHFTSRP
           || ||||||||:|||||| ||:||||| ||||||||::|| ||||||||||:||:|||||
g089       KPTASHKATAAITLAALCKPCSGMSCVEIKSSLPCFKQPVPRSNQKSASCSKENRFTSRP
                   70        80        90       100       110       120

                  130       140       150
m089.pep   ARFIARQNASSAFKTCTPSPRKILALVCAX
           |||:||||:|||||||||||||| ||||||
g089       ARFMARQNTSSAFKTCTPSPRKISALVCAX
                  130       140       150
```

The following partial DNA sequence was identified in *N. meningitidis* <SEQ ID 293>:

a089.seq

```
  1 ATGCCGCCTA AAATCACGAA GAGCGGATTT TGCAAACCGG CAATCGCGGC
 51 GGCGGTCGCA CCGACGTTCG TGCCTTTGCT GTCGTCGATG AACACCACGC
101 CATTTTTCTC GCCGATTTTT TCCACGCGGT GCGGCAGGCC TTGAAAGGTT
151 TTGACGTGTT CGAGCAATGC TTCGCGCGGC AAACCGACGG CTTCGCACAA
201 GGCAACGGCA GCCATCACGT TAGTGGCGTT GTGCAAGCCT TGCAGCGGAA
251 TATCTTGCGT GGCAATCAAA TCTTCATTGC CTTGTTTCAG GCGACCTGTC
301 TCACGTTCCA ACCAAAAATC GGCTTCGTAT TCCAACGAAA ACCATTTCAC
351 CTCGCGCCCG GCGCGCTTCA TCGCACGACA GAACGCATCG TCCGCATTCA
401 AAACCTGCAC ACCGTCGCCA CGGAAAATCT TGGCTTTGGT ATGCGCGTAG
```

This corresponds to the amino acid sequence <SEQ ID 294; ORF 089.a>:

a089.pep

```
  1 MPPKITKSGF CKPAIAAAVA PTFVPLLSSM NTTPFFSPIF STRCGRP*KV
 51 LTCSSNASRG KPTASHKATA AITLVALCKP CSGISCVAIK SSLPCFRRPV
101 SRSNQKSASY SNENHFTSRP ARFIARQNAS SAFKTCTPSP RKILALVCA*
```

m089/a089 91.9% identity over a 149 aa overlap

```
                   10        20        30        40        50        60
m089.pep   MPPKITXSGFCKPAIAAAVAPTFVPLLSSINTTPFFSPIFSTRCGRPWKVLTCSSNASRD
           |||||| ||||||||||||||||||||||:|||||||||||||||||| ||||||||||
a089       MPPKITKSGFCKPAIAAAVAPTFVPLLSSMNTTPFFSPIFSTRCGRPXKVLTCSSNASRG
                   10        20        30        40        50        60

                   70        80        90       100       110       120
m089.pep   KPMASHKATAAMTLAALCXPCNGMSCVTIKSSLPCFRRPVSRSNQKSASCSNENHFTSRP
           || ||||||||:||:||| ||:|:|||:||||||||||||||||||||| ||||||||||
a089       KPTASHKATAAITLVALCKPCSGISCVAIKSSLPCFRRPVSRSNQKSASYSNENHFTSRP
                   70        80        90       100       110       120
                  130       140       150
m089.pep   ARFIARQNASSAFKTCTPSPRKILALVCAX
           ||||||||||||||||||||||||||||||
a089       ARFIARQNASSAFKTCTPSPRKILALVCAX
                  130       140       150
```

The following partial DNA sequence was identified in *N. gonorrhoeae* <SEQ ID 295>:

g090.seq

```
  1 ATGCGCGTAG TCGAGCAAAT CGTCGTAGCG GTCGAGATGG TCTTCGGAAA
 51 TGTTCATCAC CGTCGCCGCA GTCGGGCGCA GGCTTTCGGT GTTTTCCAGT
101 TGGAAGCTGG AAAGCTCcca CACCCACACG TCCGCCTTTT TGCCTTCgcg
151 ctgCAATtct gcctccaaga cgggcgtacc gatATTGCCC GCAATGAcgg
201 tatccagccc gcacttgatg CAGAGatagc ggaccaggct ggttaccgTG
251 GTTttgccgt tgctgCcggt aatcgCaatc accttgtcgC CGCGGCGGtt
301 cAcaaTGTCc gccaGCAATt ggATGTCGCC TAgCACGCGC .ccgccgTTT
351 TGCttga
```

This corresponds to the amino acid sequence <SEQ ID 296; ORF 090.ng>:

g090.pep

```
  1 MRVVEQIVVA VEMVFGNVHH RRRSRAQAFG VFQLEAGKLP HPHVRLFAFA
 51 LQFCLQDGRT DIARNDGIQP ALDAEIADQA GYRGFAVAAG NRNHLVAAAV
101 HNVRQQLDVA XHAXRRFA*
```

The following partial DNA sequence was identified in *N. meningitidis* <SEQ ID 297>:

m090.seq

```
  1 ATGCGCATAG TCGAGCAAGT CGTCGTAGCG GTCGAGATGG TCTTCGGAAA
 51 TGTTCAGCAC CGTCGCCGCA GTCGGACGCA GGCTTTCGGT GTTTTCCAGT
101 TGGAAGCTGG AAAGCTCCAA CACCCACACG TCCGCCTTTT TGCCTTCGCG
151 CTGCCATTCC GCCTCCAAAA CCGGCGTGCC GATATTGCCC GCGATAACGG
201 TATCCAGCCC GCACTTGATA CAGAGATAGC CGACCAGGCT CGTTACCGTG
251 GTTTTGCCGT TGCTGCCGGT AATCGCAATT ACCTTGTCGT CCCGGCGGTT
301 CACAATGTCC GCCAGCAATT CGATGTCGCC CAACACGCGT .CCGCCGTTT
351 TGCTTGA
```

This corresponds to the amino acid sequence <SEQ ID 298; ORF 090>:

m090.pep

```
  1 MRIVEQVVVA VEMVFGNVQH RRRSRTQAFG VFQLEAGKLQ HPHVRLFAFA
 51 LPFRLQNRRA DIARDNGIQP ALDTEIADQA RYRGFAVAAG NRNYLVVPAV
101 HNVRQQFDVA QHAXRRFA*
```

Computer analysis of this amino acid sequence gave the following results:

Homology with a predicted ORF from *N. gonorrhoeae*

ORF 090 shows 83.9% identity over a 118 aa overlap with a predicted ORF (ORF 090.ng) from *N. gonorrhoeae*:

m090/g090

```
                  10        20        30        40        50        60
m090.pep  MRIVEQVVVAVEMVFGNVQHRRRSRTQAFGVFQLEAGKLQHPHVRLFAFALPFRLQNRRA
          ||:|||:||||||||||:||||||:||||||||||||| |||||||||| | ||: |:
g090      MRVVEQIVVAVEMVFGNVHHRRRSRAQAFGVFQLEAGKLPHPHVRLFAFALQFCLQDGRT
                  10        20        30        40        50        60

                  70        80        90       100       110      119
m090.pep  DIARDNGIQPALDTEIADQARYRGFAVAAGNRNYLVVPAVHNVRQQFDVAQHAXRRFAX
          ||||::|||||||:|||||| ||||||||||||:||: |||||||:||| |||||||
g090      DIARNDGIQPALDAEIADQAGYRGFAVAAGNRNHLVAAAVHNVRQQLDVAXHAXRRFAX
                  70        80        90       100       110
```

The following partial DNA sequence was identified in *N. meningitidis* <SEQ ID 299>:

a090.seq

```
  1 ATGCGCGTAG TCGAGCAAGT CGTCGTAGCG GTCGAGATGG TCTTCGGAAA
 51 TGTTCAGCAC TGTCGCCGCA GTCGGGCGCA GGCTTTCGGT GTTTTCCAGT
101 TGGAAACTGG AAAGCTCCAA CACCCACACG TCCGCCTTTT TGCCTTCGCG
151 CTGCAATTCC GCCTCCAAAA CCGGCGCGCC GATATTGCCC GCGATAACGG
201 TATCCAGCCC ACACTTGATG CAGAGATAGC CGACCAGGCT CGTTACCGTG
251 GTTTTGCCGT TGCTGCCGGT AATCGCAATC ACCTTGTCGC CGCGGCGGTT
301 CACAATGTCC GCCAGCAATT CGATGTCGCC CAACACGCGT C.CGCCGTTT
351 CGCTTAA
```

This corresponds to the amino acid sequence <SEQ ID 300; ORF 090.a>:

a090.pep

```
  1 MRVVEQVVVA VEMVFGNVQH CRRSRAQAFG VFQLETGKLQ HPHVRLFAFA
 51 LQFRLQNRRA DIARDNGIQP TLDAEIADQA RYRGFAVAAG NRNHLVAAAV
101 HNVRQQFDVA QHAXRRFA*
```

m09/a090 91.5% identity over a 117 aa overlap

```
                  10        20        30        40        50        60
m090.pep  MRIVEQVVVAVEMVFGNVQHRRRSRTQAFGVFQLEAGKLQHPHVRLFAFALPFRLQNRRA
          ||:|||||||||||||||| ||||:||||||||:|||||||||||||| ||||||||
a090      MRVVEQVVVAVEMVFGNVQHCRRSRAQAFGVFQLETGKLQHPHVRLFAFALQFRLQNRRA
                  10        20        30        40        50        60

                  70        80        90       100       110      119
m090.pep  DIARDNGIQPALDTEIADQARYRGFAVAAGNRNYLVVPAVHNVRQQFDVAQHAXRRFAX
          ||||||||||:||:||||||||||||||||||:||: ||||||||||||||||||||
a090      DIARDNGIQPTLDAEIADQARYRGFAVAAGNRNHLVAAAVHNVRQQFDVAQHAXRRFAX
                  70        80        90       100       110
```

The following partial DNA sequence was identified in *N. gonorrhoeae* g090-1.seq This sequence contains multiple stop codons (not shown)

This corresponds to the amino acid sequence <ORF 090-1.ng>:

g090-1.pep (not shown)

The following partial DNA sequence was identified in *N. meningitidis* <SEQ ID 2>:

m090-1.seq

```
   1 ATGACGGCGT TTGCATTTCA GACGGCATCA CAAAGCCTTA AACGCTTCGA
  51 TAAACACTTC CGAACGGTGC GCGTAGCCTT TGAACATATC AAAGCTCGCG
 101 CAGGCGGGGC TGAGCAACAC AATATCGCCT GCTTCGGCTT GGGCATATGC
 151 CGTCTGAACG GCTTCTCCCA AAGTGGCGCA GTCGGTCATA TTCAAGCCGC
 201 AGCCGTCCAA ATCGCGGCGG ATTTGCGGCG CATCGACACC AATCAAGAAC
 251 ACGCCTTTTG CCTTGCCTAC CAGTGCATCG CGCAGGGGCG TGAAGTCCTG
 301 CCCTTTACCC ATGCCGCCCA AAATCACGAA GAGCGGATTT TGCAAACCGG
 351 CAATCGCGGC GGCAGTCGCG CCGACATTCG TGCCTTTGCT GTCGTCGATA
 401 AACACCACGC CGTTTTTCTC GCCGATTTTT TCCACGCGGT GCGGCAGGCC
 451 TTGGAAGGTT TTGACGTGTT CGAGCAATGC TTCGCGCGAC AAACCGATGG
 501 CCTCACACAA AGCCACGGCA GCCATGACGT TAGCGGCGTT GTGCAGACCT
 551 TGCAACGGAA TGTCTTGCGT GACAATCAAA TCTTCATTGC CTTGTTTCAG
 601 GCGGCCTGTC TCGCGTTCCA ACCAGAAATC AGCTTCGTGT TCCAACGAAA
 651 ACCATTTTAC CTCGCGCCCG GCACGCTTCA TCGCGCGGCA GAACGCATCG
 701 TCCGCATTCA AAACCTGCAC GCCGTCGCCA CGGAAAATCT TGGCTTTGGT
 751 ATGCGCATAG TCGAGCAAGT CGTCGTAGCG GTCGAGATGG TCTTCGGAAA
 801 TGTTCAGCAC CGTCGCCGCA GTCGGACGCA GGCTTTCGGT GTTTTCCAGT
 851 TGGAAGCTGG AAAGCTCCAA CACCCACACG TCCGCCTTTT TGCCTTCGCG
 901 CTGCCATTCC GCCTCCAAAA CCGGCGTGCC GATATTGCCC GCGATAACGG
 951 TATCCAGCCC GCACTTGATA CAGAGATAGC CGACCAGGCT CGTTACCGTG
1001 GTTTTGCCGT TGCTGCCGGT AATCGCAATT ACCTTGTCGT CCCGGCGGTT
1051 CACAATGTCC GCCAGCAATT CGATGTCGCC CAACACGCGT CCGCCGTTTT
1101 GCTTGAACGC CTCAATATCC GGCTGCCGCT CGCTGATGCC GGGACTGAGA
1151 GCCAGAATAT CGAAACCGTT GTCCAGCGCA TCTTTCAGAC GGCCCGTGTA
1201 AAACACCAAC CCGTCAAACA TCTTACCGAT TTGCGACACG CGTTCCGGCT
1251 TCAGCTCCGC ATCATACGCA GCAACCTCCG CGCCGTTTTT GCGCAGGTAG
1301 GCAATCATGG AAATACCCGT ACCGCCGAGT CCGGCGACGA GGATTTTTTT
1351 GTTTTGAAAA GTCATTTTGG TTTGTCCTAA
```

This corresponds to the amino acid sequence <SEQ ID 3; ORF 090-1>:

m090-1.pep

```
  1 MTAFAFQTAS QSLKRFDKHF RTVRVAFEHI KARAGGAEQH NIACFGLGIC
 51 RLNGFSQSGA VGHIQAAAVQ IAADLRRIDT NQEHAFCLAY QCIAQGREVL
101 PFTHAAQNHE ERILQTGNRG GSRADIRAFA VVDKHHAVFL ADFFHAVRQA
151 LEGFDVFEQC FARQTDGLTQ SHGSHDVSGV VQTLQRNVLR DNQIFIALFQ
201 AACLAFQPEI SFVFQRKPFY LAPGTLHRAA ERIVRIQNLH AVATENLGFG
251 MRIVEQVVVA VEMVFGNVQH RRRSRTQAFG VFQLEAGKLQ HPHVRLFAFA
301 LPFRLQNRRA DIARDNGIQP ALDTEIADQA RYRGFAVAAG NRNYLVVPAV
```

-continued

```
351 HNVRQQFDVA QHASAVLLER LNIRLPLADA GTESQNIETV VQRIFQTARV

401 KHQPVKHLTD LRHAFRLQLR IIRSNLRAVF AQVGNHGNTR TAESGDEDFF

451 VLKSHFGLS*
```

The following partial DNA sequence was identified in *N. gonorrhoeae* <SEQ ID 303>:

g091.seq

```
  1 ATGGAAATAC CCGTGCCGCC AAGTCCGGCG ACGAGGATTT TTTTGTTTGA

 51 AAGTCATTTT GGTTTTGTCC TAAAACAAAT CATATTGGGC AGGAGACGTC

101 CGCCCTTGCC CAAGCCGCTT TCAGACGGCA TCGCGAGCCG ATTAATAACC

151 CGCCTTCAGG CGTTGGTCAT TGTCGCAGCT GTTTTGGTCT CCGTTTTGAC

201 AAGCCTTGCC AAGCCATTGT TGAGCGAGCG CAAGGTCTTG GCGCACGCCG

251 CGTCCATCGT AATACATCAA GCCCAAATTG TATTGGGCTT GGGCATCCCC

301 TTGTTCTGA
```

This corresponds to the amino acid sequence <SEQ ID 304; ORF 091.ng>:

g091.pep

```
  1 MEIPVPPSPA TRIFLFESHF GFVLKQIILG RRRPPLPKPL SDGIASRLIT

 51 RLQALVIVAA VLVSVLTSLA KPLLSERKVL AHAASIVIHQ AQIVLGLGIP

101 LF*
```

The following partial DNA sequence was identified in *N. meningitidis* <SEQ ID 305>:

m091.seq

```
  1 ATGGAAATAC CCGTACCGCC GAGTCCGGCG ACGAGGATTT TTTTGTTTGA

 51 AAAGTCATTT TGGTTTGTCC TAAAACAAAT CATATTGAGC AGGAGATGTC

101 CGCCCCTGCC CAAGCCGCTT TCAGACGGCA TCGCGAGCTG TTCAATAACC

151 CGCCTTCAGG CGTTGGTCAT TGTCGCAGCC GTCTTGGTCT CCGTTTTGAC

201 AAGCCTTGCC AAACCATTCT TGTGCAAGGG CGCGGTCTTG GCGCACGCCG

251 CGTCTTTCGG CATACATCAC GCCCAAATTG TTTTGGGCTT GGGCTACCCC

301 CTGCGC . . .
```

This corresponds to the amino acid sequence <SEQ ID 306; ORF 091>:

m091.pep

```
  1 MEIPVPPSPA TRIFLFEKSF WFVLKQIILS RRCPPLPKPL SDGIASCSIT

 51 RLQALVIVAA VLVSVLTSLA KPFLCKGAVL AHAASFGIHH AQIVLGLGYP

101 LR.
```

Computer analysis of this amino acid sequence gave the following results:

Homology with a predicted ORF from *N. gonorrhoeae*

ORF 091 shows 84.2% identity over a 101 aa overlap with a predicted ORF (ORF 091.ng) from *N. gonorrhoeae*:

m091/g091

```
                   10        20        30        40        50        60
m091.pep   MEIPVPPSPATRIFLFEKSFWFVLKQIILSRRCPPLPKPLSDGIASCSITRLQALVIVAA
           |||||||||||||||||: | ||||||||:|| |||||||||||||  ||||||||||||
g091       MEIPVPPSPATRIFLFESHFGFVLKQIILGRRRPPLPKPLSDGIASRLITRLQALVIVAA
                   10        20        30        40        50        60

                   70        80        90       100
m091.pep   VLVSVLTSLAKPFLCKGAVLAHAASFGIHHAQIVLGLGYPLR
           ||||||||||||:| :  |||||||: ||:|||||||| ||
g091       VLVSVLTSLAKPLLSERKVLAHAASIVIHQAQIVLGLGIPLFX
                   70        80        90       100
```

The following partial DNA sequence was identified in *N. meningitidis* <SEQ ID 307>:

a091.seq

```
  1 ATGGAAATAC CCGTGCCGCC AAGTCCGGCG ACGAGGATTT TTTTGTTTTG
 51 GAAATCATTT TGGTTTGTCC TAAAACAAAT CATATTGAGC AGGGGATGTC
101 TGATCCTGCT CAAGCCGCTT TCAGACGGCA TCGCGAGCTG TTCAATAACC
151 CGCTTTCAGG CGTTGGTCAT TGTCGCAGCT GTCTTGGTAT CCGTTTTGAC
201 AAGCCTTGCC AAGCCATTCT TGTGCAAGGG CGCGGTCTTG GCGCACGCCG
251 CGTCTTTCGG CATACATCAC GCCCAAATTG TTTTGGGC
```

This corresponds to the amino acid sequence <SEQ ID 308; ORF 091.a>:

a091.pep

```
  1 MEIPVPPSPA TRIFLFWKSF WFVLKQIILS RGCLILLKPL SDCIASCSIT
 51 RFQALVIVAA VLVSVLTSLA KPFLCKGAVL AHAASFGIHH AQIVLG
```

m091/a091 93.8% identity over a 96 aa overlap

```
                   10        20        30        40        50        60
m091.pep   MEIPVPPSPATRIFLFEKSFWFVLKQIILSRRCPPLPKPLSDGIASCSITRLQALVIVAA
           |||||||||||||||| |||||||||||||| |   | ||||||||||||||:||||||||
a091       MEIPVPPSPATRIFLFWKSFWFVLKQIILSRGCLILIKPLSDGIASCSITRFQALVIVAA
                   10        20        30        40        50        60

                   70        80        90       100
m091.pep   VLVSVLTSLAKPFLCKGAVLAHAASFGIHHAQIVLGLGYPLR
           ||||||||||||||||||||||||||||||||||||
a091       VLVSVLTSLAKPFLCKGAVLAHAASFGIHHAQIVLG
                   70        80        90
```

The following partial DNA sequence was identified in *N. gonorrhoeae* <SEQ ID 309>:

g092.seq

```
  1 ATGTTTTTTA TTTCAATCCG CTATATATTT GTCAGAAAAC TATGGTGCGC
 51 AAACGGTCAG ACCTTTAAAA TAACGCCTTT ACGCACTAAA AACCAACCGG
```

-continued

```
 101 AACGCAACAT TATGATGAAA AATCGAGTAA GCAACATCCA TTTTGTCGGT
 151 ATCGGCGGCG TCGGCATGAG CGGTATCGCC GAAGTCTTGC ACAATTTGGG
 201 CTTTAAAGTT TCCGGTTCGG ATCAGGCGCG AAATGCCGCT ACCGAGCATT
 251 TGAGCAGCCT GGGCATTCAA GTTTATCCCG GCCATACCGC AGAACACGTT
 301 AACGGTgcgg ATGTCGTCGT TGCCTCTACC GCCGTCAAGA AAGAAaatcC
 351 CGAAGTtgtc gcTGCGTTGG AGCGGCAAAT TCCCGTTATT CCGCGCGCCT
 401 TGATGCTGGC AGAGCTGATG CGCTTCCGTG ACGgcatcgc cattgccggT
 451 ACGCACGGCA AAACCACGAC CACCAGCCTG ACCGCCTCCA TCCTCGGCGC
 501 GGCAGGACTC GACCCCACTT TCGTTATCGG CGGCAAACTC AACGCCGCAG
 551 GCACCAACGC CCGCTTGGGC AAAGGCGAAT ACATCGTTGC CGAAGCCGAC
 601 GAATCCGATG CCTCTTTCCT ACATCTGACC CCGATTATGT CCGTCGTTAC
 651 CAATATCGAC GAAGACCATA TGGATACCTA CGGGCACAGC GTCGAAAAAC
 701 TGCATCAGGC GTTTATCGAT TTCATCCACC GTATGCCCTT CTACGGCAAA
 751 GCCTTTTTGT GTGTTGACAG CGAACACGTC CGCGCGATTT TGCCCAAAGT
 801 GAGCAAACCT TATGCTACTT ACGGTTTGGA CGATACCGCC GACATCTACG
 851 CCACCGACAT CGAAAACGTC GGCGCGCAAA TGAAATTCAC CGTCCATGTT
 901 CAAATGAAAG GACATGAGCA GGGGTCGTTT GAAGTCGTGC TGAATATGCC
 951 CGGCAGACAC AACGTGCTGA ACGCATTGGC AGCCATCGGc gtggcGCTgg
1001 aagtcGgCGC ATcggttgAA GCGAtcCAAA AaggCTTGCT CGGCTTTGAA
1051 GGCGTCGGCC GCCGCTTCCA AAAATAcggc gacatCAagt tgccaaacgg
1101 cggGaccgCT TTgctGGTGG ACGATTAcgg ACACCACCCC GTCGAAATGG
1151 CGGcaaccct tgccgcTGCA CGCGGCGCGT ATCCGGAAAA acgtTTGGTG
1201 CtcgCCTTCC AGCCGCACCG CTATACCCGC ACGCGCGATT TGTTTGAAGA
1251 CTTTACCAAA GTACTCAATA CCGTTGatgC GCTGGTACTG ACCGAAGTTT
1301 Atgccgccgg CGAAGAGCCG GTTGCCGCCG CCGactcCCG CGCCTTGGCG
1351 CGTGCTATCC GCGTATTGGG CAAACTTGAG CCGATTTACT GCGAAAatgt
1401 cgccgACCTG CCGCAAATGC TGATGAATGT TTTACAGGAT Ggcgatgttg
1451 tgttgAATAT GggTgcggga agcatcaacc gcgttccttc cgcgctgttg
1501 gaattgtcga AACAGAtttg A
```

This corresponds to the amino acid sequence <SEQ ID 310; ORF 092.ng>:

g092.pep

```
  1 MFFISIRYIF VRKLWCANGQ TFKITPLRTK NQPERNIMMK NRVSNIHFVG
 51 IGGVGMSGIA EVLHNLGFKV SGSDQARNAA TEHLSSLGIQ VYPGHTAEHV
101 NGADVVVAST AVKKENPEVV AALERQIPVI PRALMLAELM RFRDGIAIAG
151 THGKTTTTSL TASILGAAGL DPTFVIGGKL NAAGTNARLG KGEYIVAEAD
201 ESDASFLHLT PIMSVVTNID EDHMDTYGHS VEKLHQAFID FIHRMPFYGK
251 AFLCVDSEHV RAILPKVSKP YATYGLDDTA DIYATDIENV GAQMKFTVHV
```

-continued

```
301 QMKGHEQGSF EVVLNMPGRH NVLNALAAIG VALEVGASVE AIQKGLLGFE

351 GVGRRFQKYG DIKLPNGGTA LLVDDYGHHP VEMAATLAAA RGAYPEKRLV

401 LAFQPHRYTR TRDLFEDFTK VLNTVDALVL TEVYAAGEEP VAAADSRALA

451 RAIRVLGKLE PIYCENVADL PQMLMNVLQD GDVVLNMGAG SINRVPSALL

501 ELSKQI*
```

The following partial DNA sequence was identified in *N. meningitidis* <SEQ ID 311>:

m092.seq

```
   1 ATGTTTTTTA TTTCAATCCG CTATATATTT GTCAGAAAAC TATGGCGCGC
  51 AAACGGTCAG CCCTTTAAAA TAACGCCTTT ACGCATCGAA AATCCACCGG
 101 AACGCAACAT TATGATGAAA AATCGAGTTA CCAACATCCA TTTTGTCGGT
 151 ATCGGCGGCG TCGGCATGAG CGGCATCGCC GAAGTCTTGC ACAATTTGGG
 201 CTTTAAAGTT TCCGGTTCGG ATCAgGCGCG AAATGCCGCT ACCGAGCATT
 251 TGGGCAGCCT GGGCATTCAA GTTTATCCCG GCCATACCGC CGAACACGTT
 301 AACGGTGCGG ATGTCGTCGT TACCTCTACC GCCGTCAAAA AAGAAAATCC
 351 CGAAGTTGTC GCTGCGTTGG AGCAGCAAAT TCCCGTTATT CCGCGCGCCC
 401 TGATGTTGGC GGAGTTGATG CGCTTCCGTG ACGGCATCGC CATTGCCGGC
 451 ACGCACGGCA AAACCACGAC CACCAGCCTG ACCGCCTCCA TCCTCGGCGC
 501 GGCAGGACTT GACCCGACTT TCGTTATCGG CGGCAAACTC AACGCCGCAG
 551 GCACTAACGC CCGCTTGGGC AAAGGCGAAT ACATCGTTGC CGAAGCCGAC
 601 GAGTCGGATG CATCCTTTCT GCACCTGACA CCGATTATGT CCGTCGTTAC
 651 CAATATCGAC GAAGACCATA TGGATACCTA CGGGCACAGC GTCGAAAAAC
 701 TGCATCAGGC GTTTATCGAT TTCATCCACC GTATGCCCTT CTACGGCAAA
 751 GCCTTTTTGT GTATTGACAG CGAACACGTC CGCGCGATTT TGCCCAAAGT
 801 GAGCAAACCT TATGCTACTT ACGGTTTGGA CGATACCGCC GACATCTACG
 851 CCACCGACAT CGAAAACGTC GGCGCGCAAA TGAAATTCAC CGTCCATGTT
 901 CAAATGAAAG GACATGAGCA GGGGTCGTTT GAAGTCGTGC TGAATATGCC
 951 CGGCAGACAC AACGTGCTGA ACGCATTGGC AGCCATCGGC GTGGCGCTGG
1001 AAGTCGGCGC ATCGGTTGAA GCGATCCAAA AAGGCTTGCT CGGCTTTGAA
1051 GGCGTCGGCC GCCGCTTCCA AAAATACGGC GACATCAAGT TGCCAAACGG
1101 CGGGACCGCG CTCTTGGTGG ACGACTACGG ACACCACCCC GTCGAAATGG
1151 CGGCGACCCT TGCCGCCGCA CGCGGCGCGT ATCTGGAAAA ACGTTTGGTA
1201 CTCGCCTTCC AGCCGCACCG CTATACCCGC ACGCGCGATT TGTTTGAAGA
1251 CTTTACCAAA GTCCTCAATA CCGTTGACGC GCTGGTGCTG ACCGAAGTTT
1301 ATGCCGCCGG TGAAGAGCCG ATTGCCGCCG CCGATTCCCG CGCTCTTGCC
1351 CGCGCCATCC GCGTGTTGGG CAAACTCGAG CCGATTTACT GCGAAAACGT
1401 TGCCGATCTG CCCGAAATGC TGTTGAACGT TTTGCAGGAC GGCGACATCG
1451 TGTTGAATAT GGGCGCGGGA AGCATCAACC GCGTCCCCGC CGCGCTGCTG
1501 GCATTGTCGA AACAGATTTG A
```

This corresponds to the amino acid sequence <SEQ ID 312; ORF 092>:

m092.pep

```
  1 MFFISIRYIF VRKLWRANGQ PFKITPLRIE NPPERNIMMK NRVTNIHFVG
 51 IGGVGMSGIA EVLHNLGFKV SGSDQARNAA TEHLGSLGIQ VYPGHTAEHV
101 NGADVVVTST AVKKENPEVV AALEQQIPVI PRALMLAELM RFRDGIAIAG
151 THGKTTTTSL TASILGAAGL DPTFVIGGKL NAAGTNARLG KGEYIVAEAD
201 ESDASFLNLT PIMSVVTNID EDHMDTYGHS VEKLHQAFID FIHRMPFYGK
251 AFLCIDSEHV RAILPKVSKP YATYGLDDTA DIYATDIENV GAQMKFTVHV
301 QMKGHEQGSF EVVLNMPGRH NVLNALAAIG VALEVGASVE AIQKGLLGFE
351 GVGRRFQKYG DIKLPNGGTA LLVDDYGHHP VEMAATLAAA RGAYLEKRLV
401 LAFQPHRYTR TRDLFEDFTK VLNTVDALVL TEVYAAGEEP IAAADSRALA
451 RAIRVLGKLE PIYCENVADL PEMLLNVLQD GDIVLNMGAG SINRVPAALL
501 ALSKQI*
```

Computer analysis of this amino acid sequence gave the following results:

Homology with a predicted ORF from *N. gonorrhoeae*

ORF 092 shows 96.6% identity over a 506 aa overlap with a predicted ORF (ORF 092.ng) from *N. gonorrhoeae*:

m092/g092

```
                   10        20        30        40        50        60
m092.pep  MFFISIRYIFVRKLWRANGQPFKITPLRIENPPERNIMMKNRVTNIHFVGIGGVGMSGIA
          ||||||||||||||| |||| ||||||| :|||||||||||||:||||||||||||||||
g092      MFFISIRYIFVRKLWCANGQTFKITPLRTKNPPERNIMMKNRVSNIHFVGIGGVGMSGIA
                   10        20        30        40        50        60

                   70        80        90       100       110       120
m092.pep  EVLHNLGFKVSGSDQARNAATEHLGSLGIQVYPGHTAEHVNGADVVVTSTAVKKENPEVV
          ||||||||||||||||||||||||:||||||||||||||||||||||:||||||||||||
g092      EVLHNLGFKVSGSDQARNAATEHLSSLGIQVYPGHTAEHVNGADVVVASTAVKKENPEVV
                   70        80        90       100       110       120

                  130       140       150       160       170       180
m092.pep  AALEQQIPVIPRALMLAELMRFRDGIAIAGTHGKTTTTSLTASILGAAGLDPTFVIGGKL
          ||||:|||||||||||||||||||||||||||||||||||||||||||||||||||||||
g092      AALERQIPVIPRALMLAELMRFRDGIAIAGTHGKTTTTSLTASILGAAGLDPTFVIGGKL
                  130       140       150       160       170       180

                  190       200       210       220       230       240
m092.pep  NAAGTNARLGKGEYIVAEADESDASFLHLTPIMSVVTNIDEDHMDTYGHSVEKLHQAFID
          ||||||||||||||||||||||||||||||||||||||||||||||||||||||||||||
g092      NAAGTNARLGKGEYIVAEADESDASFLHLTPIMSVVTNIDEDHMDTYGHSVEKLHQAFID
                  190       200       210       220       230       240

                  250       260       270       280       290       300
m092.pep  FIHRMPFYGKAFLCIDSEHVRAILPKVSKPYATYGLDDTADIYATDIENVGAQMKFTVHV
          ||||||||||||||:|||||||||||||||||||||||||||||||||||||||||||||
g092      FIHRMPFYGKAFLCVDSEHVRAILPKVSKPYATYGLDDTADIYATDIENVGAQMKFTVHV
                  250       260       270       280       290       300

                  310       320       330       340       350       360
m092.pep  QMKGHEQGSFEVVLNMPGRHNVLNALAAIGVALEVGASVEAIQKGLLGFEGVGRRFQKYG
          ||||||||||||||||||||||||||||||||||||||||||||||||||||||||||||
g092      QMKGHEQGSFEVVLNMPGRHNVLNALAAIGVALEVGASVEAIQKGLLGFEGVGRRFQKYG
                  310       320       330       340       350       360

                  370       380       390       400       410       420
m092.pep  DIKLPNGGTALLVDDYGHHPVEMAATLAAARGAYLEKRLVLAFQPHRYTRTRDLFEDFTK
          |||||||||||||||||||||||||||||||||| |||||||||||||||||||||||||
g092      DIKLPNGGTALLVDDYGHHPVEMAATLAAARGAYPEKRLVLAFQPHRYTRTRDLFEDFTK
                  370       380       390       400       410       420

                  430       440       450       460       470       480
m092.pep  VLNTVDALVLTEVYAAGEEPIAAADSRALARAIRVLGKLEPIYCENVADLPEMLLNVLQD
          ||||||||||||||||||||:|||||||||||||||||||||||||||||||:||:|||||
g092      VLNTVDALVLTEVYAAGEEPVAAADSRALARAIRVLGKLEPIYCENVADLPQMLMNVLQD
                  430       440       450       460       470       480
```

-continued

```
                490       500
m092.pep   GDIVLNMGAGSINRVPAALLALSKQIX
           ||:|||||||||||||:||| ||||||
g092       GDVVLNMGAGSINRVPSALLELSKQIX
                490       500
```

The following partial DNA sequence was identified in *N. meningitidis* <SEQ ID 313>:

a092.seq

```
   1 ATGTTTTTTA TTTCAATCCG CTATATATTT GTCAGAAAAC TATGGCGCGC
  51 AAACGGTCAG CCCTTTAAAA TAACGCCTTT ACGCATCGAA AATCCACCGG
 101 AACGCAACAT TATGATGAAA AATCGAGTGA CCAACATCCA TTTTGTCGGT
 151 ATCGGCGGCG TCGGCATGAG CGGTATCGCC GAAGTCTTGC ACAATTTGGG
 201 TTTTAAAGTT TCCGGTTCGG ATCAGGCGCG AAATGCCGCT ACCGAGCATT
 251 TGGGCAGCCT GGGCATTCAA GTTTATCCCG GCCATACCGC AGAACACGTT
 301 AACGGTGCGG ATGTCGTCGT TACCTCTACC GCCGTCAAAA AAGAAAATCC
 351 CGAAGTTGTC GCTGCGTTGG AGCAGCAAAT TCCCGTTATT CCGCGCGCCC
 401 TGATGTTGGC GGAGTTGATG CGCTTCCGTG ACGGCATCGC CATTGCCGGC
 451 ACGCACGGCA AAACCACGAC CACCAGCCTG ACCGCCTCCA TCCTCGGCGC
 501 GGCAGGACTT GACCCGACTT TCGTTATCGG CGGCAAACTC AACGCCGCAG
 551 GCACCAACGC CCGCTTGGGC AAAGGCGAAT ACATCGTTGC CGAAGCCGAC
 601 GAGTCCCATG CATCCTTTCT GCACCTGACA CCGATTATGT CCGTCGTTAC
 651 CAATATCGAC GAAGACCATA TGGATACCTA CGGGCACAGT GTTGAGAAGC
 701 TGCATCAGGC GTTTATCGAT TTCATCCACC GTATGCCCTT CTACGGCAAA
 751 GCCTTTTTGT GTATTGACAG CGAACACGTC CGCGCGATTT TGCCCAAAGT
 801 GAGCAAACCT TATGCTACTT ACGGTTTGGA CGATACCGCC GACATCTACG
 851 CCACCGACAT CGAAAACGTC GGCGCGCAAA TGAAATTCAC CGTCCATGTT
 901 CAAATGAAAG GACATGAGCA GGGGTCGTTT GAAGTCGTGC TGAATATGCC
 951 CGGCAGACAC AACGTGCTGA ACGCATTGGC AGCCATCGGC GTGGCGCTGG
1001 AAGTCGGCGC ATCGGTTGAA GCGATCCAAA AAGGCTTGCT CGGCTTTGAA
1051 GGTGTCGGCC GCCGCTTCCA AAAATACGGC GACATCAAGT TGCCAAACGG
1101 TGGAACCGCG CTCTTGGTGG ACGACTACGG ACACCACCCC GTCGAAATGG
1151 CGGCGACCCT TTCCGCCGCA CGCGGCGCGT ATCCGGAAAA ACGTTTGGTA
1201 CTCGCCTTCC AGCCGCACCG CTATACCCGC ACGCGCGATT TGTTTGAAGA
1251 CTTTACCAAA GTCCTCAATA CCGTTGACGC GCTGGTGCTG ACCGAAGTTT
1301 ATGCCGCCGG TGAAGAGCCG ATTGCCGCCG CTGATTCCCG CGCTCTTGCC
1351 CGCGCCATCC GCGTGTTGGG CAAACTCGAG CCGATTTACT GCGAAAACGT
1401 TGCCGATCTG CCCGAAATGC TGTTGAACGT TTTGCAGGAC GGCGACATCG
1451 TGTTGAATAT GGGTGCGGGA ACCATCAACC GCGTCCCCGC CGCGCTGCTG
1501 GAATTGTCGA AACAGATTTG A
```

This corresponds to the amino acid sequence <SEQ ID 314; ORF 092.a>:

a092.pep

```
  1 MFFISIRYIF VRKLWRANGQ PFKITPLRIE NPPERNIMMK NRVTNIHFVG

 51 IGGVGMSGIA EVLHNLGFKV SGSDQARNAA TEHLGSLGIQ VYPGHTAEHV

101 NGADVVVTST AVKKENPEVV AALEQQIPVI PRALMLAELM RFRDGIAIAG

151 THGKTTTTSL TASILGAAGL DPTFVIGGKL NAAGTNARLG KGEYIVAEAD

201 ESDASFLHLT PIMSVVTNID EDHMDTYGHS VEKLHQAFID FIHRMPFYGK

251 AFLCIDSEHV RAILPKVSKP YATYGLDDTA DIYATDIENV GAQMKFTVHV

301 QMKGHEQGSF EVVLNMPGRH NVLNALAAIG VALEVGASVE AIQKGLLGFE

351 GVGRRFQKYG DIKLPNGGTA LLVDDYGHHP VEMAATLSAA RGAYPEKRLV

401 LAFQPHRYTR TRDLFEDFTK VLNTVDALVL TEVYAAGEEP IAAADSRALA

451 RAIRVLGKLE PIYCENVADL PEMLLNVLQD GDIVLNMGAG SINRVPAALL

501 ELSKQI*
```

m092/a092 99.4% identity over a 506 aa overlap

```
                     10        20        30        40        50        60
m092.pep    MFFISIRYIFVRKLWRANGQPFKITPLRIENPPERNIMMKNRVTNIHFVGIGGVGMSGIA
            ||||||||||||||||||||||||||||||||||||||||||||||||||||||||||||
a092        MFFISIRYIFVRKLWRANGQPFKITPLRIENPPERNIMMKNRVTNIHFVGIGGVGMSGIA
                     10        20        30        40        50        60

                     70        80        90       100       110       120
m092.pep    EVLHNLGFKVSGSDQARNAATEHLGSLGIQVYPGHTAEHVNGADVVVTSTAVKKENPEVV
            ||||||||||||||||||||||||||||||||||||||||||||||||||||||||||||
a092        EVLHNLGFKVSGSDQARNAATEHLGSLGIQVYPGHTAEHVNGADVVVTSTAVKKENPEVV
                     70        80        90       100       110       120

                    130       140       150       160       170       180
m092.pep    AALEQQIPVIPRALMLAELMRFRDGIAIAGTHGKTTTTSLTASILGAAGLDPTFVIGGKL
            ||||||||||||||||||||||||||||||||||||||||||||||||||||||||||||
a092        AALEQQIPVIPRALMLAELMRFRDGIAIAGTHGKTTTTSLTASILGAAGLDPTFVIGGKL
                    130       140       150       160       170       180
                    190       200       210       220       230       240
m092.pep    NAAGTNARLGKGEYIVAEADESDASFLHLTPIMSVVTNIDEDHMDTYGHSVEKLHQAFID
            ||||||||||||||||||||||||||||||||||||||||||||||||||||||||||||
a092        NAAGTNARLGKGEYIVAEADESDASFLHLTPIMSVVTNIDEDHMDTYGHSVEKLHQAFID
                    190       200       210       220       230       240
                    250       260       270       280       290       300
m092.pep    FIHRMPFYGKAFLCIDSEHVRAILPKVSKPYATYGLDDTADIYATDIENVGAQMKFTVHV
            ||||||||||||||||||||||||||||||||||||||||||||||||||||||||||||
a092        FIHRMPFYGKAFLCIDSEHVRAILPKVSKPYATYGLDDTADIYATDIENVGAQMKFTVHV
                    250       260       270       280       290       300
                    310       320       330       340       350       360
m092.pep    QMKGHEQGSFEVVLNMPGRHNVLNALAAIGVALEVGASVEAIQKGLLGFEGVGRRFQKYG
            ||||||||||||||||||||||||||||||||||||||||||||||||||||||||||||
a092        QMKGHEQGSFEVVLNMPGRHNVLNALAAIGVALEVGASVEAIQKGLLGFEGVGRRFQKYG
                    310       320       330       340       350       360
                    370       380       390       400       410       420
m092.pep    DIKLPNGGTALLVDDYGHHPVEMAATLAAARGAYLEKRLVLAFQPHRYTRTRDLFEDFTK
            |||||||||||||||||||||||||||:|||||| |||||||||||||||||||||||||
a092        DIKLPNGGTALLVDDYGHHPVEMAATLSAARGAYPEKRLVLAFQPHRYTRTRDLFEDFTK
                    370       380       390       400       410       420
                    430       440       450       460       470       480
m092.pep    VLNTVDALVLTEVYAAGEEPIAAADSRALARAIRVLGKLEPIYCENVADLPEMLLNVLQD
            ||||||||||||||||||||||||||||||||||||||||||||||||||||||||||||
a092        VLNTVDALVLTEVYAAGEEPIAAADSRALARAIRVLGKLEPIYCENVADLPEMLLNVLQD
                    430       440       450       460       470       480
                    490       500
m092.pep    GDIVLNMGAGSINRVPAALLALSKQIX
            |||||||||||||||||||| ||||||
a092        GDIVLNMGAGSINRVPAALLELSKQIX
                    490       500
```

The following partial DNA sequence was identified in *N. gonorrhoeae* <SEQ ID 315>:

g093.seq

```
  1 aTGCAGAATt ttgGCAAAGT ggccgtATTG ATGGGtggtT TTTCCAGCGA
 51 ACGAGAaatc tcgcTGGACA GCgGTACCGC CATTTTGAAC GCCTTAAAAA
101 GCAAAGGCAT AGACGCATAC GCCTTCGACC CTAAGGAAAC GCCGTTATCC
151 GAACTGAAGG AGCGGGGCTT TCAGACGGCA TTCAACATCC TTCACGGTAC
201 TTACGGCGAA GACGGGGCTG TTCAGGGTGC ATTGGAACTG TTGGGCATTC
251 CCTATACCGG CAGCGGTGTC GCCGCCTCCG CCATCGGCAT GGACAAATAC
301 CGCTGCAAAC TGATTTGGCA GGCATTGGGA TTACCCGTTC CCGAGTTCGC
351 CGTACTGTAC GATGATACCG ATTTCGATGC CGTCGAAGAA AAATTGGGTC
401 TGCCGATGTT TGTGAAGCCG GCGGCCGAAG GCAGCAGCgt cggcgtggta
451 aAAGTCAAAG AAAaaggccg TCTGAAAAGC GTTtacgaag aatTGAaaCA
501 CCTTcagggg cgaAAtcatt gccgAacgTT TTATCGGCGG CGGCGAATAT
551 TCCTGCCCCG TCCTGAACGG CAAAGGGCTG CCCGGCATAC ACATCATCCC
601 CGCAACCGAG TTTTACGAct acgaagccaa GtacaaCCGA GACGAcacca
651 tttaTCAATG TCCTTCGGAA GATTTGACCG AAGCCGAAGA AAGCCTGATG
701 CGCGAACTGG CGGTTCGCGG CGCACAGGCA ATCGGTGCGG AAGGCTGCGT
751 GCGCGTCGAT TTCCTCAAAG ATACCGACGG CAAACTCTAT CTGTTGGAAA
801 TCAACACCCT GCCCGGTATG ACCGGCCATA G
```

This corresponds to the amino acid sequence <SEQ ID 316; ORF 093.ng>:

g093.pep

```
  1 MQNFGKVAVL MGGFSSEREI SLDSGTAILN ALKSKGIDAY AFDPKETPLS
 51 ELKERGFQTA FNILHGTYGE DGAVQGALEL LGIPYTGSGV AASAIGMDKY
101 RCKLIWQALG LPVPEFAVLY DDTDFDAVEE KLGLPMFVKP AAEGSSVGVV
151 KVKEKGRLKS VYEELKHLQG RNHCRTFYRR RRIFLPRPER QRAARHTHHP
201 RNRVLRLRSQ VQPRRHHLSM SFGRFDRSRR KPDARTGGSR RTGNRCGRLR
251 ARRFPQRYRR QTLSVGNQHP ARYDRP*
```

The following partial DNA sequence was identified in *N. meningitidis* <SEQ ID 317>:

m093.seq

```
  1 ATGCAGAATT TTGGCAAAGT GGCCGTATTG ATGGGCGGTT TTTCCAGCGA
 51 ACGAGAAATC TCGCTGGACA GCGGCACCGC CATTTTGAAT GCTTTAAAAA
101 GCAAAGGCAT AGACGCATAC GCCTTCGATC CTAAAGAAAC CCCATTGTCT
151 GAATTGAAGG CACAAGGTTT TCAGACGGCA TTCAACATCC TTCACGGTAC
201 TTACGGCrAA GACGGGGCGG TTCAGGGTGC ATTGGAACTG TTGGGCATTC
251 CCTATACCGG CAGCGGTGTC GCCGCATCCG CCATCGGCAT GGACAAATAC
301 CGCTGCAAAC TGATTTGGCA GGCATTGGGA TTGCCCGTTC CCGAGTTCGC
351 CGTCCTGCAC GACGACACTG ATTTCGATGC CGTCGAAGAA AAATTGGGCC
```

-continued

```
401 TGCCGATGTT TGTGAAACCG GCGGCCGAAG GCAGCAGCGT AGGCGTGGTA

451 AAAGTCAAAG GAAAAGGCCG TCTGAAAAGC GTTTACGAAG AATTGAAACA

501 CCTTCAGGG. CGAAATCATT GCCGAACGTT TTATCGGCGG CGGCGAATAT

551 TCCTGCCCCG TCCTGAACGG CAAAGGGCTG CCCGGCATAC ACATCATTCC

601 CGCAACCGAG TTTTACGACT ACGAAGCCAA GTACAACCGC GACGACACCA

651 TTTATCAATG TCCTTCGGAA GATTTGACCG AAGCCGAAGA AAGCCTGATG

701 CGCGAACTGG CGGTTCGCGG CGCGCAGGCA ATCGGTGCGG AAGGCTGCGT

751 GCGCGTCGAT TTCCTCAAAG ATACCGACGG CAAACTCTAT CTGTTGGAAA

801 TCAACACCCT GCCCGGTATG ACGAGCCATA G
```

This corresponds to the amino acid sequence <SEQ ID 318; ORF 093>:

m093.pep

```
  1 MQNFGKVAVL MGGFSSEREI SLDSGTAILN ALKSKGIDAY AFDPKETPLS

 51 ELKAQGFQTA FNILHGTYGX DGAVQGALEL LGIPYTGSGV AASAIGMDKY

101 RCKLIWQALG LPVPEFAVLH DDTDFDAVEE KLGLPMFVKP AAEGSSVGVV

151 KVKGKGRLKS VYEELKHLQX RNHCRTFYRR RRIFLPRPER QRAARHTHHS

201 RNRVLRLRSQ VQPRRHHLSM SFGRFDRSRR KPDARTGGSR RAGNRCGRLR

251 ARRFPQRYRR QTLSVGNQHP ARYDEP*
```

Computer analysis of this amino acid sequence gave the following results:

Homology with a predicted ORF from *N. gonorrhoeae*

ORF 093 shows 96.7% identity over a 276 aa overlap with a predicted ORF (ORF 093.ng) from *N. gonorrhoeae*:

m093/g093

```
                   10        20        30        40        50        60
m093.pep    MQNFGKVAVLMGGFSSEREISLDSGTAILNALKSKGIDAYAFDPKETPLSELKAQGFQTA
            ||||||||||||||||||||||||||||||||||||||||||||||||||||| :|||||
g093        MQNFGKVAVLMGGFSSEREISLDSGTAILNALKSKGIDAYAFDPKETPLSELKERGFQTA
                   10        20        30        40        50        60

                   70        80        90       100       110       120
m093.pep    FNILHGTYGXDGAVQGALELLGIPYTGSGVAASAIGMDKYRCKLIWQALGLPVPEFAVLH
            ||||||||| |||||||||||||||||||||||||||||||||||||||||||||||||:
g093        FNILHGTYGEDGAVQGALELLGIPYTGSGVAASAIGMDKYRCKLIWQALGLPVPEFAVLY
                   70        80        90       100       110       120

                  130       140       150       160       170       180
m093.pep    DDTDFDAVEEKLGLPMFVKPAAEGSSVGVVKVKGKGRLKSVYEELKHLQXRNHCRTFYRR
            ||||||||||||||||||||||||||||||||| ||||||||||||||| ||||||||||
g093        DDTDFDAVEEKLGLPMFVKPAAEGSSVGVVKVKEKGRLKSVYEELKHLQGRNHCRTFYRR
                  130       140       150       160       170       180

                  190       200       210       220       230       240
m093.pep    RRIFLPRPERQRAARHTHHSRNRVLRLRSQVQPRRHHLSMSFGRFDRSRRKPDARTGGSR
            ||||||||||||||||||| ||||||||||||||||||||||||||||||||||||||||
g093        RRIFLPRPERQRAARHTHHPRNRVLRLRSQVQPRRHHLSMSFGRFDRSRRKPDARTGGSR
                  190       200       210       220       230       240

                  250       260       270
m093.pep    RAGNRCGRLRARRFPQRYRRQTLSVGNQHPARYDEPX
            |:||||||||||||||||||||||||||||||||:||
g093        RTGNRCGRLRARRFPQRYRRQTLSVGNQHPARYDRPX
                  250       260       270
```

The following partial DNA sequence was identified in *N. meningitidis* <SEQ ID 319>:

a093.seq

```
  1 ATGCAGAATT TTGGCAAAGT GGCCGTATTG ATGGGCGGTT TTTCCAGCGA
 51 ACGAGAAATC TCGCTGGACA GCGGCACCGC CATTTTGAAT GCTTTAAAAA
101 GCAAAGGCAT AGACGCATAC GCCTTCGATC CCAAGGAAAC CCCATTGTCT
151 GAATTGAAGG CACAAGGTTT TCAGACGGCA TTCAACATCC TTCACGGTAC
201 TTACGGCGAA GACGGGGCTG TTCAGGGTGC ATTGGAACTG TTGGGCATTC
251 CCTATACCGG CAGCGGTGTC GCCGCATCCG CCATCGGCAT GGACAAATAC
301 CGCTGCAAAC TGATTTGGCA GGCATTGGGA TTGCCCGTTC CCGAGTTCGC
351 CGTCCTGCAC GACGACACTG ATTTCGATGC CGTCGAAGAA AAATTGGGCC
401 TGCCGATGTT TGTGAAACCG GCGGCCGAAG GCAGCAGCGT AGGCGTGGTA
451 AAAGTCAAAG GAAAAGGCCG TCTGAAAAGC GTTTACGAAG AATTGAAACA
501 CTTTCAGGG. CGAAATCATT GCCGAACGGT TTATCGGCGG CGGCGAATAT
551 TCCTGCCCTG TGTTGAACGG CAAAGGCCTG CCCGGCATAC ACATCATCCC
601 CGCGACCGAG TTTTATGACT ACGAAGCCAA GTACAACCGC AACGACACCA
651 TTTATCAATG TCCTTCGGAA GATCTGACCG AAGCCGAAGA AAGCCTGATG
701 CGCGAACTGG CGGTTCGCGG CGCGCAGGCA ATCGGTGCGG AAGGCTGCGT
751 GCGCGTCGAT TTCCTCAAAG ATACCGACGG CAAACTCTAT CTGTTGGAAA
801 TCAACACCCT GCCCGGTATG ACCGGCCATA G
```

This corresponds to the amino acid sequence <SEQ ID 320; ORF 093.a>:

a093.pep

```
  1 MQNFGKVAVL MGGFSSEREI SLDSGTAILN ALKSKGIDAY AFDPKETPLS
 51 ELKAQGFQTA FNILHGTYGE DGAVQGALEL LGIPYTGSGV AASAIGMDKY
101 RCKLIWQALG LPVPEFAVLH DDTDFDAVEE KLGLPMFVKP AAEGSSVGVV
151 KVKGKGRLKS VYEELKHFQX RNHCRTVYRR RRIFLPCVER QRPARHTHHP
201 RDRVL*LRSQ VQPQRHHLSM SFGRSDRSRR KFDARTGGSR RAGNRCGRLR
251 ARRFFQRYRR QTLSVGNQHP ARYDRP*
```

m093/a093 95.7% identity over a 276 aa overlap

```
                    10        20        30        40        50        60
m093.pep    MQNFGKVAVLMGGFSSEREISLDSGTAILNALKSKGIDAYAFDPKETPLSELKAQGFQTA
            ||||||||||||||||||||||||||||||||||||||||||||||||||||||||||||
a093        MQNFGKVAVLMGGFSSEREISLDSGTAILNALKSKGIDAYAFDPKETPLSELKAQGFQTA
                    10        20        30        40        50        60

                    70        80        90       100       110       120
m093.pep    FNILHGTYGXDGAVQGALELLGIPYTGSGVAASAIGMDKYRCKLIWQALGLPVPEFAVLH
            |||||||| |||||||||||||||||||||||||||||||||||||||||||||||||||
a093        FNILHGTYGEDGAVQGALELLGIPYTGSGVAASAIGMDKYRCKLIWQALGLPVPEFAVLH
                    70        80        90       100       110       120

                   130       140       150       160       170       180
m093.pep    DDTDFDAVEEKLGLPMFVKPAAEGSSVGVVKVKGKGRLKSVYEELKHLQXRNHCRTFYRR
            |||||||||||||||||||||||||||||||||||||||||||||||:|||||||| |||
a093        DDTDFDAVEEKLGLPMFVKPAAEGSSVGVVKVKGKGRLKSVYEELKHFQXRNHCRTVYRR
                   130       140       150       160       170       180
```

-continued

```
                190        200        210        220        230        240
m093.pep  RRIFLPRPERQRAARHTHHSRNRVLRLRSQVQPRRHHLSMSFGRFDRSRRKPDARTGGSR
          ||||||  |||| |||||| |:||| |||||||:|||||||||| |||||||||||||||
a093      RRIFLPCVERQRPARHTHHPRDRVLXLRSQVQPQRHHLSMSFGRSDRSRRKPDARTGGSR
                190        200        210        220        230        240

                250        260        270
m093.pep  RAGNRCGRLRARRFPQRYRRQTLSVGNQHPARYDEPX
          ||||||||||||||||||||||||||||||||||:||
a093      RAGNRCGRLRARRFPQRYRRQTLSVGNQHPARYDRPX
                250        260        270
```

The following partial DNA sequence was identified in *N. gonorrhoeae* <SEQ ID 321>:

g094.seq

```
  1 ATGTATTCGC CTTTGCCCAA GCGGGCGTTG GTGCCTGCGG CGTTGAGTTT
 51 GCCGCCGATA ACGAAAGTGG GGTCGAGTCC TGCCGCGCCG AGGATGGAGG
101 CGGTCAGGCT GGTGGTCGTG GTTTTGCCGT GCGTAccggc aatggcgatg
151 cCGTCACGGA AGCGCATCAG CTCTGCCAGC ATCAAGGCGC GCGGAATAAC
201 GGGAATTTGC CGCTCCAACG CAgcgacaAC TTCGGgattT TCTTTCTTGA
251 CGGCGGTAGA GGCAACGACG ACATccgcAC CGTTAACGTG TTCTGCGGTA
301 TGGCCGGGAT AA
```

This corresponds to the amino acid sequence <SEQ ID 322; ORF 094.ng>:

g094.pep

```
  1 MYSPLPKRAL VPAALSLPPI TKVGSSPAAP RMEAVRLVVV VLPCVPAMAM
 51 PSRKRISSAS IKARGITGIC RSNAATTSGF SFLTAVEATT TSAPLTCSAV
101 WPG*
```

The following partial DNA sequence was identified in *N. meningitidis* <SEQ ID 323>:

m094.seq

```
  1 ATGTATTCGC CTTTGCCCAA GCGGGCGTTA GTGCCTGCGG CGTTGAGTTT
 51 GCCGCCGATA ACGAAAGTCG GGTCAAGTCC TGCCGCGCCG AGGATGGAGG
101 CGGTCAGGCT GGTGGTCGTG GTTTTGCCGT GCGTGCCGGC AATGGCGATG
151 CCGTCACGGA AGCGCATCAA CTCCGCCAAC ATCAGGGCGC GCGGAATAAC
201 GGGAATTTGC TGCTCCAACG CAGCGACAAC TTCGGGATTT TCTTTTTTGA
251 CGGCGGTAGA GGTAACGACG ACATCCGCAC CGTTAACGTG TTCGGCGGTA
301 TGGCCGGGAT AA
```

This corresponds to the amino acid sequence <SEQ ID 324; ORF 094>:

m094.pep

```
  1 MYSPLPKRAL VPAALSLPPI TKVGSSPAAP RMEAVRLVVV VLPCVPAMAM
 51 PSRKRINSAN IRARGITGIC CSNAATTSGF SFLTAVEVTT TSAPLTCSAV
101 WPG*
```

Computer analysis of this amino acid sequence gave the following results:

Homology with a predicted ORF from *N. gonorrhoeae*

ORF 094 shows 95.1% identity over a 103 aa overlap with a predicted ORF (ORF 094.ng) from *N. gonorrhoeae*:

m094/g094

```
                   10        20        30        40        50        60
m094.pep   MYSPLPKRALVPAALSLPPITKVGSSPAAPRMEAVRLVVVVLPCVPAMAMPSRKRINSAN
           ||||||||||||||||||||||||||||||||||||||||||||||||||||||||:||:
g094       MYSPLPKRALVPAALSLPPITKVGSSPAAPRMEAVRLVVVVLPCVPAMAMPSRKRISSAS
                   10        20        30        40        50        60

                   70        80        90       100
m094.pep   IRARGITGICCSNAATTSGFSFLTAVEVTTTSAPLTCSAVWPGX
           |:||||||||| ||||||||||||||||:||||||||||||||||
g094       IKARGITGICRSNAATTSGFSFLTAVEATTTSAPLTCSAVWPGX
                   70        80        90       100
```

The following partial DNA sequence was identified in *N. meningitidis* <SEQ ID 325>:

a094.seq

```
  1 ATGTATTCGC CTTTGCCCAA GCGGGCCTTG GTGCCTGCGG CGTTGAGTTT
 51 GCCGCCGATA ACGAAAGTCG GGTCAAGTCC TGCCGCGCCG AGGATGGAGG
101 CGGTCAGGCT GGTGGTCGTG GTTTTGCCGT GCGTGCCGGC AATGGCGATG
151 CCGTCACGGA AGCGCATCAA CTCCGCCAAC ATCAGGGCGC GCGGAATAAC
201 GGGAATTTGC TGCTCCAACG CAGCGACAAC TTCGGGATTT TCTTTTTTGA
251 CGGCGGTAGA GGTAACGACG ACATCCGCAC CGTTAACGTG TTCTGCGGTA
301 TGGCCGGGAT AA
```

This corresponds to the amino acid sequence <SEQ ID 326; ORF 094.a>:

a094.pep

```
  1 MYSPLPKRAL VPAALSLPPI TKVGSSPAAP RMEAVRLVVV VLPCVPAMAM
 51 PSRKRINSAN IRARGITGIC CSNAATTSGF SFLTAVEVTT TSAPLTCSAV
101 WPG*
```

m094/a094 100.0% identity over a 103 aa overlap

```
                10         20         30         40         50         60
m094.pep  MYSPLPKRALVPAALSLPPITKVGSSPAAPRMEAVRLVVVVLPCVPAMAMPSRKRINSAN
          ||||||||||||||||||||||||||||||||||||||||||||||||||||||||||||
a094      MYSPLPKRALVPAALSLPPITKVGSSPAAPRMEAVRLVVVVLPCVPAMAMPSRKRINSAN
                10         20         30         40         50         60

                70         80         90        100
m094.pep  IRARGITGICCSNAATTSGFSFLTAVEVTTTSAPLTCSAVWPGX
          ||||||||||||||||||||||||||||||||||||||||||||
a094      IRARGITGICCSNAATTSGFSFLTAVEVTTTSAPLTCSAVWPGX
                70         80         90        100
```

The following partial DNA sequence was identified in *N. gonorrhoeae* <SEQ ID 327>:

g095.seq

```
  1 ATGTCCTTTC ATTTGAACAT GGACGGTGAA TTTCATTTGC GCGCCGACGT
 51 TTTCGATGTC GGTGGCGTAG ATGTCGGCGG TATCGTCCAA ACCGTAAGTA
101 GCATAAGGTT TGCTCACTTT GGGCAAAATC GCGCGGACGT GTTCGCTGTC
151 AACACACAAA AAGGCTTTGC CGTAGAAGGG CATACGGTGG ATGAAATCGA
201 TAAACGCCTG ATGCAGTTTT TCGACGCTGT GCCCGTAGGT ATCCATATGG
251 TCTTCGTCGA TATTGGTAAC GACGGACATA ATCGGGGTCA GTGTAGGAAA
301 GAGGCATCGG ATCGTCGGCT TCGGCAACGA TGTATTCGCC TTTGCCCAAG
351 CGGGCGTTGG TGCCTGCGGC GTTGA
```

This corresponds to the amino acid sequence <SEQ ID 328; ORF 095.ng>:

g095.pep

```
  1 MSFHLNMDGE FHLRADVFDV GGVDVGGIVQ TVSSIRFAHF GQNRADVFAV
 51 NTQKGFAVEG HTVDEIDKRL MQFFDAVPVG IHMVFVDIGN DGHNRGQCRK
101 EASDRRLRQR CIRLCPSGRW CLRR*
```

The following partial DNA sequence was identified in *N. meningitidis* <SEQ ID 329>:

m095.seq

```
  1 ATGTCCTTTC ATTTGAACAT GGACGGTGAA TTTCATTTGC GCGCCGACGT
 51 TTTCGATGTC GGTGGCGTAG ATGTCGGCGG TATCGTCCAA ACCGTAAGTA
101 GCATAAGGTT TGCTCACTTT GGGCAAAATC GCGCGGACGT GTTCGCTGTC
151 AATACACAAA AAGGCTTTGC CGTAGAAGGG CATACGGTGG ATGAAATCGA
201 TAAACGCCTG ATGCAGTTTT TCGACGCTGT GCCCGTAGGT ATCCATATGG
251 TCTTCGTCGA TATTGGTAAC GACGGACATA ATCGGTGTCA GTGCAGAAAG
301 GATGCATCCG ACCGTCGGCT TCGGCAACGA TGTATTCGCC TTTGCCCAAG
351 CGGGCGTTAG TGCCTGCGGC GTTGA
```

This corresponds to the amino acid sequence <SEQ ID 330; ORF 095>:

m095.pep

```
  1 MSFHLNMDGE FHLRADVFDV GGVDVGGIVQ TVSSIRFAHF GQNRADVFAV
 51 NTQKGFAVEG HTVDEIDKRL MQFFDAVPVG IHMVFVDIGN DGHNRCQCRK
101 DASDRRLRQR CIRLCPSGRX CLRR*
```

Computer analysis of this amino acid sequence gave the following results:

Homology with a predicted ORF from *N. gonorrhoeae*

ORF 095 shows 97.6% identity over a 124 aa overlap with a predicted ORF (ORF 095.ng) from *N. gonorrhoeae*:

m095/g095

```
                   10        20        30        40        50        60
m095.pep   MSFHLNMDGEFHLRADVFDVGGVDVGGIVQTVSSIRFAHFGQNRADVFAVNTQKGFAVEG
           ||||||||||||||||||||||||||||||||||||||||||||||||||||||||||||
g095       MSFHLNMDGEFHLRADVFDVGGVDVGGIVQTVSSIRFAHFGQNRADVFAVNTQKGFAVEG
                   10        20        30        40        50        60
                   70        80        90       100       110       120
m095.pep   HTVDEIDKRLMQFFDAVPVGIHMVFVDIGNDGHNRCQCRKDASDRRLRQRCIRLCPSGRX
           |||||||||||||||||||||||||||||||||| ||||:||||||||||||||||||
g095       HTVDEIDKRLMQFFDAVPVGIHMVFVDIGNDGHNRGQCRKEASDRRLRQRCIRLCPSGRW
                   70        80        90       100       110       120
m095.pep   CLRRX
           |||||
g095       CLRRX
```

The following partial DNA sequence was identified in *N. meningitidis* <SEQ ID 331>:

a095.seq

```
  1 ATGTCCTTTC ATTTGAACAT GGACGGTGAA TTTCATTTGC GCGCCGACGT
 51 TTTCGATGTC GGTGGCGTAG ATGTCGGCGG TATCGTCCAA ACCGTAAGTA
101 GCATAAGGTT TGCTCACTTT GGGCAAAATC GCGCGGACGT GTTCGCTGTC
151 AATACACAAA AAGGCTTTGC CGTAGAAGGG CATACGGTGG ATGAAATCGA
201 TAAACGCCTG ATGCAGCTTC TCAACACTGT GCCCGTAGGT ATCCATATGG
251 TCTTCGTCGA TATTGGTAAC GACGGACATA ATCGGTGTCA GTGCAGAAAG
301 GATGCATCCG ACCGTCGGCT TCGGCAACGA TGTATTCGCC TTTGCCCAAG
351 CGGGCGTTGG TGCCTGCGGC GTTGA
```

This corresponds to the amino acid sequence <SEQ ID 332; ORF 095.a>:

a095.pep

```
  1 MSFHLNMDGE FHLRADVFDV GGVDVGGIVQ TVSSIRFAHF GQNRADVFAV
 51 NTQKGFAVEG HTVDEIDKRL MQLLNTVPVG IHMVFVDIGN DGHNRCQCRK
101 DASDRRLRQR CIRLCPSGRW CLRR*
```

m095/a095 96.0% identity in 124 aa overlap

```
                10         20         30         40         50         60
m095.pep  MSFHLNMDGEFHLRADVFDVGGVDVGGIVQTVSSIRFAHFGQNRADVFAVNTQKGFAVEG
          ||||||||||||||||||||||||||||||||||||||||||||||||||||||||||||
a095      MSFHLNMDGEFHLRADVFDVGGVDVGGIVQTVSSIRFAHFGQNRADVFAVNTQKGFAVEG
                10         20         30         40         50         60

70         80         90        100        110        120
m095.pep  HTVDEIDKRLMQFFDAVPVGIHMVFVDIGNDGHNRCQCRKDASDRRLRQRCIRLCPSGRX
          |||||||||||::::|||||||||||||||||||||||||||||||||||||||||||| 
a095      HTVDEIDKRLMQLLNTVPVGIHMVFVDIGNDGHNRCQCRKDASDRRLRQRCIRLCPSGRW
                70         80         90        100        110        120 m095.pep  CLRRX
          |||||
a095      CLRRX
```

The following partial DNA sequence was identified in *N. gonorrhoeae* <SEQ ID 333>:

g096.seq

```
  1 ATGGCCGGTC ATACCGGGCA GGGTGTTGAT TTCCAACAGA TAGAGTTTGC
 51 CGTCGGTATC TTTGAGGAAA TCGACGCGCA CGCAGCCTTC CGCACCGATT
101 GCCTGTGCGC CGCGAACCGC CAGTTCGCGC ATCAGGCTTT CTTCGGCTTC
151 GGTCAAATCT TCCGAAGGAC ATTGAtaaat ggtgTCGTCT CGGttgtaCt
201 tggcttcgta gTCGTAAAAC TCGGTTGCGG GGATGATGTG TATGCCGGGC
251 AGCCCTTTGC CGTTCAGGAC GGGGCAGGAA TATTCGCCGC CGCCGATAAA
301 AcgtTcggca atgaTTtcgc ccctgAAGGT GttTCAattc ttcgtaAACG
351 CTTTTCAGAc ggcctttTTC TTTGA
```

This corresponds to the amino acid sequence <SEQ ID 334; ORF 096.ng>:

g096.pep

```
  1 MAGHTGQGVD FQQIEFAVGI FEEIDAHAAF RTDCLCAANR QFAHQAFFGF
 51 GQIFRRTLIN GVVSVVLGFV VVKLGCGDDV YAGQPFAVQD GAGIFAAADK
101 TFGNDFAPEG VSILRKRFSD GLFL*
```

The following partial DNA sequence was identified in *N. meningitidis* <SEQ ID 335>:

m096.seq

```
  1 ATGGCTCGTC ATACCGGGCA GGGTGTTGAT TTCCAACAGA TAGAGTTTGC
 51 CGTCGGTATC TTTGAGGAAA TCGACGCGCA CGCAGCCTTC CGCACCGATT
101 GCCTGCGCGC CGCGAACCGC CAGTTCGCGC ATCAGGCTTT CTTCGGCTTC
151 GGTCAAATCT TCCGAAGGAC ATTGATAAAT GGTGTCGTCG CGGTTGTACT
201 TGGCTTCGTA GTCGTAAAAC TCGGTTGCGG GAATGATGTG TATGCCGGGC
251 AGCCCTTTGC CGTTCAGGAC GGGGCAGGAA TATTCGCCGC CGCCGATAAA
301 ACGTTCGGCA ATGATTTCGC CC.TGAAGGT GTTTCAATTC TTCGTAAACG
351 CTTTTCAGAC GGCCTTTTCC TTTGA
```

This corresponds to the amino acid sequence <SEQ ID 336; ORF 096>:

m096.pep

```
  1 MARHTGQGVD FQQIEFAVGI FEEIDAHAAF RTDCLRAANR QFAHQAFFGF

 51 GQIFRRTLIN GVVAVVLGFV VVKLGCGNDV YAGQPFAVQD GAGIFAAADK

101 TFGNDFAXEG VSILRKRFSD GLFL*
```

m096/g096 96.0% identity in 124 aa overlap

```
                   10         20         30         40         50         60
m096.pep   MARHTGQGVDFQQIEFAVGIFEEIDAHAAFRTDCLRAANRQFAHQAFFGFGQIFRRTLIN
           || |||||||||||||||||||||||||||||||| ||||||||||||||||||||||||
g096       MAGHTGQGVDFQQIEFAVGIFEEIDAHAAFRTDCLCAANRQFAHQAFFGFGQIFRRTLIN
                   10         20         30         40         50         60

                   70         80         90        100        110        120
m096.pep   GVVAVVLGFVVVKLGCGNDVYAGQPFAVQDGAGIFAAADKTFGNDFAXEGVSILRKRFSD
           |||:|||||||||||||:|||||||||||||||||||||||||||||| |||||||||||
G096       GVVSVVLGFVVVKLGCGDDVYAGQPFAVQDGAGIFAAADKTFGNDFAPEGVSILRKRFSD
                   70         80         90        100        110        120

m096.pep   GLFLX
           |||||
g096       GLFLX
```

The following partial DNA sequence was identified in *N. meningitidis* <SEQ ID 337>:

a096.seq

```
  1 ATGGCCGGTC ATACCGGGCA GGGTGTTGAT TTCCAACAGA TAGAGTTTGC

 51 CGTCGGTATC TTTGAGGAAA TCGACGCGCA CGCAGCCTTC CGCACCGATT

101 GCCTGCGCGC CGCGAACCGC CAGTTCGCGC ATCAGGCTTT CTTCGGCTTC

151 GGTCAGATCT TCCGAAGGAC ATTGATAAAT GGTGTCGTTG CGGTTGTACT

201 TGGCTTCGTA GTCATAAAAC TCGGTCGCGG GGATGATGTG TATGCCGGGC

251 AGGCCTTTGC CGTTCAACAC AGGGCAGGAA TATTCGCCGC CGCCGATAAA

301 CCGTTCGGCA ATGATTTCGC CCT.GAAAGT GTTTCAATTC TTCGTAAACG

351 CTTTTCAGAC GGCCTTTTCC TTTGA
```

This corresponds to the amino acid sequence <SEQ ID 338; ORF 096.ng>:

a096.pep

```
  1 MAGHTGQGVD FQQIEFAVGI FEEIDAHAAF RTDCLRAANR QFAHQAFFGF

 51 GQIFRRTLIN GVVAVVLGFV VIKLGRGDDV YAGQAFAVQH RAGIFAAADK

101 PFGNDFAXES VSILRKRFSD GLFL*
```

m096/a096 92.7% identity in 124 aa overlap

```
                10         20         30         40         50         60
m096.pep  MARHTGQGVDFQQIEFAVGIFEEIDAHAAFRTDCLRAANRQFAHQAFFGFGQIFRRTLIN
          || |||||||||||||||||||||||||||||||||||||||||||||||||||||||||
a096      MAGHTGQGVDFQQIEFAVGIFEEIDAHAAFRTDCLRAANRQFAHQAFFGFGQIFRRTLIN
                10         20         30         40         50         60

                70         80         90        100        110        120
m096.pep  GVVAVVLGFVVVKLGCGNDVYAGQPFAVQDGAGIFAAADKTFGNDFAXEGVSILRKRFSD
          |||||||||||:||| |:|||||| ||||  ||||||||| ||||||||:||||||||||
a096      GVVAVVLGFVVIKLGRGDDVYAGQAFAVQHRAGIFAAADKPFGNDFAXESVSILRKRFSD
                70         80         90        100        110        120

m096.pep  GLFLX
          |||||
a096      GLFLX
```

The following partial DNA sequence was identified in *N. gonorrhoeae* <SEQ ID 339>:

g097.seq

```
   1 ATGGATATTT CAAAACAAAC ATTGCTGGAT AGGGTTTTTA ACCTGAAGGC
  51 AAACGGTACG ACGGTACGTA CCGAGTTGAT GGCGGGTTTG ACGACCTTTT
 101 TGACGATGTG CTACATCGTT ATCGTCAATC CCCTGATTTT GGGCGAGACC
 151 GGAATGGATA TGGGGGCGGT ATTCGTCGCT ACCTGTATCG CATCCGCCAT
 201 CGGCTGTTTT GTCATGGGTT TTATCGGCAA CTATCCGATT GCGCTTGCCC
 251 CGGGGATGGG GCTGAATGCC TATTTCACCT TTGCCGTCGT TAAGGGTATG
 301 GGCGTGCCTT GGCAGGTGGC GTTGGGTGCG GTGTTCATTT CCGGTCTGAT
 351 TTTCATCCTG TTCAGCTTTT TTAAAGTCAG GGAAATGCTG GTCAACGCAC
 401 TGCCTATGGG TTTGAAAATG TCGATTGCCG CCGGTATCGG TTTGTTTTTG
 451 GCACTGATTT CCCTGAAAGG CGCAGGCATT ATCGTTGCCA ATCCGGCAAC
 501 CTTGGTCGGC TTGGGCGATA TTCATCAGCC CAGCGCACTG TTGGCATTGT
 551 TCGGTTTTGT CATGGTGGTC GTATTGGGGT ATTTCCGCGT TCAAGGCGCA
 601 ATCATCATCA CCATTCTGAC GATTACCGTC ATTGCCAGCC TGATGGGTTT
 651 GAACGAGTTT CACGGCGTGG TCGGCGAAGT ACCGGGCATT GCGCCGACCT
 701 TTATGCAGAT GGATTTTAAA GGTCTGTTTA CCGTCAGCAT GGTCAGCGTG
 751 ATTTTCGTCT TCTTCTTGGT CGATTTGTTC GACAGTACCG GAACGCTGGT
 801 CGGCGTATCC CACCGTGCCG GACTGCTGGT GGACGGTAAG CTGCCCCGCC
 851 TGAAACGCGC ACTGCTTGCA GACTCTACCG CCATTGTGGC AGGTGCGGCT
 901 TTGGGTACTT CTTCAACCAC GCCTTATGTG GAAAGCGCGG CGGGCGTATC
 951 GGCAGGCGGA CGGACCGGCC TGACGGCGGT TACCGTCGGC GTATTGATGC
1001 TGGCGTGTCT GATGTTCTCC CCATTGGCGA AAAGTGTTCC GGTATTTGCC
1051 ACCGCGCCCG CACTGCTTTA TGTCGGCACG CAGATGCTCC GCAGTGCGAG
1101 GGACATTGAT TGGGACGATA TGACTGAAGC CGCGCCCGCG TTCCTGACCA
1151 TTGTCTTCAT GCCGTTTACC TATTCGATTG CAGACGGCAT CGCCTTCGGC
1201 TTCATCAGCT ATGCCGTGGT CAAACTTTTG TGTCGCCGGA CTGGGGACGT
1251 GCCGCCTATG GTATGGGTTG TTGCCGTATT GTGGGCATTG AAATTCTGGT
1301 ATTTGGGCTG A
```

This corresponds to the amino acid sequence <SEQ ID 340; ORF 097.ng>:

g097.pep

1 MDISKQTLLD RVFNLKANGT TVRTELMAGL TTFLTMCYIV IVNPLILGET
51 GMDMGAVFVA TCIASAIGCF VMGFIGNYPI ALAPGMGLNA YFTFAVVKGM
101 GVPWQVALGA VFISGLIFIL FSFFKVREML VNALPMGLKM SIAAGIGLFL
151 ALISLKGAGI IVANPATLVG LGDIHQPSAL LALFGFVMVV VLGYFRVQGA
201 IIITILTITV IASLMGLNEF HGVVGEVPGI APTFMQMDFK GLFTVSMVSV
251 IFVFFLVDLF DSTGTLVGVS HRAGLLVDGK LPRLKRALLA DSTAIVAGAA
301 LGTSSTTPYV ESAAGVSAGG RTGLTAVTVG VLMLACLMFS PLAKSVPVFA
351 TAPALLYVGT QMLRSARDID WDDMTEAAPA FLTIVFMPFT YSIADGIAFG
401 FISYAVVKLL CRRTGDVPPM VWVVAVLWAL KFWYLG*

The following partial DNA sequence was identified in *N. meningitidis* <SEQ ID 341>:

m097.seq

1 ATGGACACTT CAAAACAAAC ACTGTTGGAC GGGATTTTTA AGCTGAAGGC
51 AAACGGTACk ACGGTGCGTA CCGAGTTGAT GGCGGGTTTG ACAACTTTTT
101 TGACGATGTG CTACATCGTT ATCGTCAACC CTCyGATTTT GGGCGAGACC
151 GGCATGGATA TGGGGGCGGT ATTCGTCGCT ACCTGTATCG CGTCTGCCAT
201 CGGCTGTTTT GTTATGGGTT TTGTCGGCAA CTATCCGATT GCACTCGCAC
251 CGGGGATGGG GCTGAATGCC TATTTCACCT TTGCCGTCGT TAAGGGTATG
301 GGCGTGCCTT GGCAGGTTGC GTTGGGTGCG GTGTTCATCT CCGGTCTGAT
351 TTTTATCCTG TTCAGCTTTT TTAAAGTCAG GGAAATGCTG GTCAACGCAC
401 TGCCTATGGG TTTGAAAATG TCGATTGCTG CCGGTATCGG TTTGTTTTTG
451 GCACTGATTT CCCTGAAAGG CGCAGGCATT ATCGTTGCCA ATCCGGCAAC
501 CTTGGTCGGT TTGGGCGATA TTCATCAGCC GTCCGCGTTG TTGGCATTGT
551 TCGGTTTTGC TATGGTGGTC GTATTGGGAC ATTTCCGCGT TCAAGGCGCA
601 ATCATCATCA CCATCTTGAC CATTACCGTC ATTGCCAGCC TGATGGGTTT
651 GAATGAATTT CACGGCATCA TCGGCGAAGT ACCGAGCATT GCGCCGACTT
701 TTATGCAGAT GGATTTTGAA GGCCTGTTTA CCGTCAGCAT GGTCAGTGTG
751 ATTTTCGTCT TCTTCTTGGT CGATCTATTT GACAGTACCG GAACGCTGGT
801 CGGCATATCC CACCGTGCCG GGCTGCTGGT GGACGGTAAG CTGCCCCGCC
851 TGAAACGCGC ACTGCTTGCA GACTCTACCG CCATTGTGGC AGGTGCGGCT
901 TTGGGTACTT CTTCCACCAC GCCTTATGTG GAAAGCGCGG CGGGCGTATC
951 GGCAGGCGGA CGGACCGGCC TGACGGCGGT TACCGTCGGC GTATTGATGC
1001 TCGCCTGCCT GATGTTTTCA CCTTTGGCGA AAAGTGTTCC CGCTTTTGCC
1051 ACCGCGCCCG CCCTGCTTTA TGTCGGCACG CAGATGCTCC GCAGTGCGAG
1101 GGATATTGAT TGGGACGATA TGACGGAAGC CGCACCTGCG TTCCTGACCA
1151 TTGTTTTCAT GCCGTTTACT TATTCGATTG CAGACGGCAT CGCTTTCGGC
1201 TTCATCAGTT ATGCCGTGGT TAAACTTTTA TGCCGCCGCA CCAAAGACGT

-continued

```
1251 TCCGCCTATG GTATGGATTG TTGCCGTATT GTGGGCACTG AAATTCTGGT

1301 ATTTGGGCTG A
```

This corresponds to the amino acid sequence <SEQ ID 342; ORF 097>:

m097.pep

```
  1 MDTSKQTLLD GIFKLKANGT TVRTELMAGL TTFLTMCYIV IVNPXILGET
 51 GMDMGAVFVA TCIASAIGCF VMGFVGNYPI ALAPGMGLNA YFTFAVVKGM
101 GVPWQVALGA VFISGLIFIL FSFFKVREML VNALPMGLKM SIAAGIGLFL
151 ALISLKGAGI IVANPATLVG LGDIHQPSAL LALFGFAMVV VLGHFRVQGA
201 IIITILTITV IASLMGLNEF HGIIGEVPSI APTFMQMDFE GLFTVSMVSV
251 IFVFFLVDLF DSTGTLVGIS HRAGLLVDGK LPRLKRALLA DSTAIVAGAA
301 LGTSSTTPYV ESAAGVSAGG RTGLTAVTVG VLMLACLMFS PLAKSVPAFA
351 TAPALLYVGT QMLRSARDID WDDMTEAAPA FLTIVFMPFT YSIADGIAFG
401 FISYAVVKLL CRRTKDVPPM VWIVAVLWAL KFWYLG*
```

Computer analysis of this amino acid sequence gave the following results:

Homology with a predicted ORF from *N. gonorrhoeae*

ORF 097 shows 96.3% identity over a 436 aa overlap with a predicted ORF (ORF 097.ng) from *N. gonorrhoeae*:

m097/g097

```
                  10        20        30        40        50        60
m097.pep  MDTSKQTLLDGIFKLKANGTTVRTELMAGLTTFLTMCYIVIVNPXILGETGMDMGAVFVA
          || ||||||| :|:|||||||||||||||||||||||||||||| |||||||||||||||
g097      MDISKQTLLDRVFNLKANGTTVRTELMAGLTTFLTMCYIVIVNPLILGETGMDMGAVFVA
                  10        20        30        40        50        60

                  70        80        90       100       110       120
m097.pep  TCIASAIGCFVMGFVGNYPIALAPGMGLNAYFTFAVVKGMGVPWQVALGAVFISGLIFIL
          |||||||||||||||:||||||||||||||||||||||||||||||||||||||||||||
g097      TCIASAIGCFVMGFIGNYPIALAPGMGLNAYFTFAVVKGMGVPWQVALGAVFISGLIFIL
                  70        80        90       100       110       120

                 130       140       150       160       170       180
m097.pep  FSFFKVREMLVNALPMGLKMSIAAGIGLFLALISLKGAGIIVANPATLVGLGDIHQPSAL
          ||||||||||||||||||||||||||||||||||||||||||||||||||||||||||||
g097      FSFFKVREMLVNALPMGLKMSIAAGIGLFLALISLKGAGIIVANPATLVGLGDIHQPSAL
                 130       140       150       160       170       180

                 190       200       210       220       230       240
m097.pep  LALFGFAMVVVLGHFRVQGAIIITILTITVIASLMGLNEFHGIIGEVPSIAPTFMQMDFE
          ||||||:||||||:||||||||||||||||||||||||||||::||||:||||||||||:
g097      LALFGFVMVVVLGYFRVQGAIIITILTITVIASLMGLNEFHGVVGEVPGIAPTFMQMDFK
                 190       200       210       220       230       240

                 250       260       270       280       290       300
m097.pep  GLFTVSMVSVIFVFFLVDLFDSTGTLVGISHRAGLLVDGKLPRLKRALLADSTAIVAGAA
          ||||||||||||||||||||||||||||:|||||||||||||||||||||||||||||||
g097      GLFTVSMVSVIFVFFLVDLFDSTGTLVGVSHRAGLLVDGKLPRLKRALLADSTAIVAGAA
                 250       260       270       280       290       300

                 310       320       330       340       350       360
m097.pep  LGTSSTTPYVESAAGVSAGGRTGLTAVTVGVLMLACLMFSPLAKSVPAFATAPALLYVGT
          ||||||||||||||||||||||||||||||||||||||||||||||||:|||||||||||
g097      LGTSSTTPYVESAAGVSAGGRTGLTAVTVGVLMLACLMFSPLAKSVPVFATAPALLYVGT
                 310       320       330       340       350       360

                 370       380       390       400       410       420
m097.pep  QMLRSARDIDWDDMTEAAPAFLTIVFMPFTYSIADGIAFGFISYAVVKLLCRRTKDVPPM
          |||||||||||||||||||||||||||||||||||||||||||||||||||||| |||||
g097      QMLRSARDIDWDDMTEAAPAFLTIVFMPFTYSIADGIAFGFISYAVVKLLCRRTGDVPPM
                 370       380       390       400       410       420

                 430
m097.pep  VWIVAVLWALKFWYLGX
          ||:||||||||||||||
g097      VWVVAVLWALKFWYLGX
                 430
```

The following partial DNA sequence was identified in *N. meningitidis* <SEQ ID 343> a097.seq

```
   1 ATGGACACTT CAAAACAAAC ACTGTTGGAC GGGATTTTTA AGCTGAAGGC
  51 AAACGGTACG ACGGTGCGTA CCGAGTTGAT GGCGGGTTTG ACAACTTTTT
 101 TGACGATGTG CTACATCGTT ATCGTCAACC CTCTGATTTT GGGCGAGACC
 151 GGCATGGATA TGGGGGCGGT ATTCGTCGCT ACCTGTATCG CGTCTGCCAT
 201 CGGCTGTTTT GTTATGGGTT TTGTCGGCAA CTATCCGATT GCACTCGCAC
 251 CGGGGATGGG GCTGAATGCC TATTTCACCT TTGCCGTCGT TAAGGGTATG
 301 GGCGTGCCTT GGCAGGTTGC GTTGGGTGCG GTGTTCATCT CCGGTCTGAT
 351 TTTCATCCTG TTCAGCTTTT TTAAAGTCAG GGAAATGCTG GTCAACGCAC
 401 TGCCTATGGG TTTGAAAATG TCGATTGCTG CCGGTATCGG TTTGTTTTTG
 451 GCACTGATTT CCCTGAAAGG CGCAGGCATT ATCGTTGCCA ATCCGGCAAC
 501 CTTGGTCGGC TTGGGCGATA TTCATCAGCC GTCCGCGTTG TTGGCACTGT
 551 TCGGTTTTGC CATGGTGGTC GTATTGGGAC ATTTCCGCGT TCAAGGCGCA
 601 ATCATCATCA CCATTTTGAC GATTACCGTC ATTGCCAGCC TGATGGGTTT
 651 GAACGAATTT CACGGCATCA TCGGCGAAGT GCCGAGCATT GCGCCGACTT
 701 TTATGCAGAT GGATTTTAAA GGGTTGTTTA CCGTCAGCAT GGTCAGCGTG
 751 ATTTTCGTCT TTTTCCTAGT CGATCTGTTC GACAGTACCG GAACACTGGT
 801 CGGTGTATCG CATCGTGCCG GACTGCTGGT GGACGGTAAG CTGCCCCGCC
 851 TGAAACGCGC ACTGCTTGCA GACTCTACCG CTATTGTGGC AGGTGCGGCT
 901 TTGGGTACTT CTTCAACCAC GCCTTATGTG GAAAGTGCGG CGGGCGTATC
 951 GGCAGGCGGG CGGACAGGTC TGACGGCGGT TACCGTCGGC GTATTGATGC
1001 TCGCCTGCCT GATGTTTTCA CCTTTGGCGA AAAGTGTTCC CGCTTTTGCC
1051 ACCGCGCCCG CCCTGCTTTA TGTCGGCACG CAGATGCTCC GCAGTGCGAG
1101 GGACATCGAT TGGGACGATA TGACGGAAGC CGCACCCGCA TTCCTGACCA
1151 TTGTCTTCAT GCCGTTTACC TATTCGATTG CAGACGGCAT CGCTTTCGGC
1201 TTCATCAGTT ATGCCGTGGT TAAACTTTTA TGCCGCCGCA CCAAAGACGT
1251 TCCGCCTATG GTATGGATTG TTGCCGTATT GTGGGCACTG AAATTCTGGT
1301 ATTTGGGCTG A
```

This corresponds to the amino acid sequence <SEQ ID 344; ORF 097.a>:

a097.pep

```
   1 MDTSKQTLLD GIFKLKANGT TVRTELMAGL TTFLTMCYIV IVNPLILGET
  51 GMDMGAVFVA TCIASAIGCF VMGFVGNYPI ALAPGMGLNA YFTFAVVKGM
 101 GVPWQVALGA VFISGLIFIL FSFFKVREML VNALPMGLKM SIAAGIGLFL
 151 ALISLKGAGI IVANPATLVG LGDIHQPSAL LALFGFAMVV VLGHFRVQGA
 201 IIITILTITV IASLMGLNEF HGIIGEVPSI APTFMQMDFK GLFTVSMVSV
 251 IFVFFLVDLF DSTGTLVGVS HRAGLLVDGK LPRLKRALLA DSTAIVAGAA
```

-continued

```
301 LGTSSTTPYV ESAAGVSAGG RTGLTAVTVG VLMLACLMFS PLAKSVPAFA

351 TAPALLYVGT QMLRSARDID WDDMTEAAPA FLTIVFMPFT YSIADGIAFG

401 FISYAVVKLL CRRTKDVPPM VWIVAVLWAL KFWYLG*
```

m097/a097 99.3% identity in 436 aa overlap

```
                 10        20        30        40        50        60
m097.pep  MDTSKQTLLDGIFKLKANGTTVRTELMAGLTTFLTMCYIVIVNPXILGETGMDMGAVFVA
          |||||||||||||||||||||||||||||||||||||||||||| ||||||||||||||||
a097      MDTSKQTLLDGIFKLKANGTTVRTELMAGLTTFLTMCYIVIVNPLILGETGMDMGAVFVA
                 10        20        30        40        50        60

                 70        80        90       100       110       120
m097.pep  TCIASAIGCFVMGFVGNYPIALAPGMGLNAYFTFAVVKGMGVPWQVALGAVFISGLIFIL
          ||||||||||||||||||||||||||||||||||||||||||||||||||||||||||||
a097      TCIASAIGCFVMGFVGNYPIALAPGMGLNAYFTFAVVKGMGVPWQVALGAVFISGLIFIL
                 70        80        90       100       110       120

                130       140       150       160       170       180
m097.pep  FSFFKVREMLVNALPMGLKMSIAAGIGLFLALISLKGAGIIVANPATLVGLGDIHQPSAL
          ||||||||||||||||||||||||||||||||||||||||||||||||||||||||||||
a097      FSFFKVREMLVNALPMGLKMSIAAGIGLFLALISLKGAGIIVANPATLVGLGDIHQPSAL
                130       140       150       160       170       180

                190       200       210       220       230       240
m097.pep  LALFGFAMVVVLGHFRVQGAIIITILTITVIASLMGLNEFHGIIGEVPSIAPTFMQMDFE
          |||||||||||||||||||||||||||||||||||||||||||||||||||||||||||:
a097      LALFGFAMVVVLGHFRVQGAIIITILTITVIASLMGLNEFHGIIGEVPSIAPTFMQMDFK
                190       200       210       220       230       240

                250       260       270       280       290       300
m097.pep  GLFTVSMVSVIFVFFLVDLFDSTGTLVGISHRAGLLVDGKLPRLKRALLADSTAIVAGAA
          ||||||||||||||||||||||||||||:|||||||||||||||||||||||||||||||
a097      GLFTVSMVSVIFVFFLVDLFDSTGTLVGVSHRAGLLVDGKLPRLKRALLADSTAIVAGAA
                250       260       270       280       290       300

                310       320       330       340       350       360
m097.pep  LGTSSTTPYVESAAGVSAGGRTGLTAVTVGVLMLACLMFSPLAKSVPAFATAPALLYVGT
          ||||||||||||||||||||||||||||||||||||||||||||||||||||||||||||
a097      LGTSSTTPYVESAAGVSAGGRTGLTAVTVGVLMLACLMFSPLAKSVPAFATAPALLYVGT
                310       320       330       340       350       360

                370       380       390       400       410       420
m097.pep  QMLRSARDIDWDDMTEAAPAFLTIVFMPFTYSIADGIAFGFISYAVVKLLCRRTKDVPPM
          ||||||||||||||||||||||||||||||||||||||||||||||||||||||||||||
a097      QMLRSARDIDWDDMTEAAPAFLTIVFMPFTYSIADGIAFGFISYAVVKLLCRRTKDVPPM
                370       380       390       400       410       420

                430
m097.pep  VWIVAVLWALKFWYLGX
          ||||||||||||||||
a097      VWIVAVLWALKFWYLGX
                430
```

The following partial DNA sequence was identified in *N. gonorrhoeae* <SEQ ID 345>:

g098.seq

```
  1 ATGACCGCCG ACGGTCTCTT CGTCGCTTTC AACTTCAATA CGTTTGCCGT

 51 TGTGCGAATA TTGATACCAG TACAGCAGGA TGCTGCCCAG GCTGGCGATC

101 AGTTTGTCGG CGATGTCGCG CGCTTCGCTG TCGGGATGGC TTTCGCGTTC

151 GGGATGAACG CAGCCGAGCA TGGACACGCC GGTACGCATC ACGTCCATCG

201 GATGGGTATG TGCAGGCAGG CTTTCCAAAA CTTTAATCAC ACGGATAGGC

251 AGGCCGCGCA TGGATTTGAG CTTGGTTTTA TAAGCGGCCA GCTCGAATTT

301 GTTGGGCAGA TGGCCGTGAA TCAGCAAGTG TGCGACTTCT TCAAACTCGC

351 ATTTTTGTGC CAAATTAGAA TGTCGTAA
```

This corresponds to the amino acid sequence <SEQ ID 346; ORF 098.ng>:

g098.pep

```
  1 MTADGLFVAF NFNTFAVVRI LIPVQQDAAQ AGDQFVGDVA RFAVGMAFAF
 51 GMNAAEHGHA GTHHVHRMGM CRQAFQNFNH TDRQAAHGFE LGFISGQLEF
101 VGQMAVNQQV CDFFKLAFLC QIRMS*
```

The following partial DNA sequence was identified in *N. meningitidis* <SEQ ID 347>:

m098.seq

```
  1 ATGACCGCCG ATGGTCTCTT CGTCGCTTTC AACCTCAATG CGTTTGCCGT
 51 TGTGCGAATA TTGATACCAG TACAAGAGGA TGCTGCCGAG GCTGGCGATC
101 AGTTTGTCGG CGATGTCGCG CGCTTCACTT TCCGGATGGC TTTCACGTTC
151 AGGATGAACG CAGCCCAGCA TGGATACGCC GGTACGCATT ACGTCCATCG
201 GATGGGTATG TGCAGGCAGG CTTTCCAAAA CTTTAATCAC ACGGATAGGC
251 AGGCCGCGCA TGGATTTGAG CTTGGTTTTA TAAGCGGCCA GCTCGAATTT
301 GTTGGGCAGA TGGCCGTGAA TCAGCAGGTG GGCGACTTCT TCAAACTCGC
351 ATTTTTGTGC CAAATCAGAA TGTCGTAA
```

This corresponds to the amino acid sequence <SEQ ID 348; ORF 098>:

m098.pep

```
  1 MTADGLFVAF NLNAFAVVRI LIPVQEDAAE AGDQFVGDVA RFTFRMAFTF
 51 RMNAAQHGYA GTHYVHRMGM CRQAFQNFNH TDRQAAHGFE LGFISGQLEF
101 VGQMAVNQQV GDFFKLAFLC QIRMS*
```

Computer analysis of this amino acid sequence gave the following results:

Homology with a predicted ORF from *N. gonorrhoeae*

ORF 098 shows 89.6% identity over a 125 aa overlap with a predicted ORF (ORF 098.ng) from *N. gonorrhoeae*:

m098/g098

```
                   10        20        30        40        50        60
m098.pep   MTADGLFVAFNLNAFAVVRILIPVQEDAAEAGDQFVGDVARFTFRMAFTFRMNAAQHGYA
           ||||||||||:|:|||||||||||:|||:||||||||||||:  |||:| ||||:||:|
g098       MTADGLFVAFNFNTFAVVRILIPVQQDAAQAGDQFVGDVARFAVGMAFAFGMNAAEHGHA
                   10        20        30        40        50        60

                   70        80        90       100       110       120
m098.pep   GTHYVHRMGMCRQAFQNFNHTDRQAAHGFELGFISGQLEFVGQMAVNQQVGDFFKLAFLC
           |||:|||||||||||||||||||||||||||||||||||||||||||||| |||||||||
g098       GTHHVHRMGMCRQAFQNFNHTDRQAAHGFELGFISGQLEFVGQMAVNQQVCDFFKLAFLC
                   70        80        90       100       110       120

m098.pep   QIRMSX
           ||||||
g098       QIRMSX
```

The following partial DNA sequence was identified in *N. meningitidis* <SEQ ID 349>:

a098.seq

```
  1 ATGACCGCCG ATGGTCTCTT CGTCGCTTTC AACCTCAATG CGTTTGCCGT
 51 TGTGCGAATA TTGATACCAG TACAAGAGGA TGCTGCCGAG GCTGGCGATC
101 AGTTTGTCGG CGATGTCGCG CGCTTCACTT TCCGGATGGC TTTCACGTTC
151 AGGATGAACG CAGCCCAGCA TGGATACGCC GGTACGCATT ACGTCCATCG
201 GATGGGTATG TGCAGGCAGG CTTTCCAAAA CTTTAATCAC ACGGATAGGC
251 AGGCCGCGCA TGGATTTGAG CTTGGTTTTA TAAGCGGCCA GCTCGAATTT
301 GTTGGGCAGA TGGCCGTGAA TCAGCAGGTG GGCGACTTCT TCAAACTCGC
351 ATTTTTGTGC CAAATCAGAA TGTCGTAA
```

This corresponds to the amino acid sequence <SEQ ID 350; ORF 098.a>:

a098.pep

```
  1 MTADGLFVAF NLNAFAVVRI LIPVQEDAAE AGDQFVGDVA RFTFRMAFTF
 51 RMNAAQHGYA GTHYVHRMGM CRQAFQNFNH TDRQAAHGFE LGFISGQLEF
101 VGQMAVNQQV GDFFKLAFLC QIRMS*
```

m098/a098 100.0% identity in 125 aa overlap

```
                    10        20        30        40        50        60
m098.pep   MTADGLFVAFNLNAFAVVRILIPVQEDAAEAGDQFVGDVARFTFRMAFTFRMNAAQHGYA
           ||||||||||||||||||||||||||||||||||||||||||||||||||||||||||||
a098       MTADGLFVAFNLNAFAVVRILIPVQEDAAEAGDQFVGDVARFTFRMAFTFRMNAAQHGYA
                    10        20        30        40        50        60

                    70        80        90       100       110       120
m098.pep   GTHYVHRMGMCRQAFQNFNHTDRQAAHGFELGFISGQLEFVGQMAVNQQVGDFFKLAFLC
           ||||||||||||||||||||||||||||||||||||||||||||||||||||||||||||
a098       GTHYVHRMGMCRQAFQNFNHTDRQAAHGFELGFISGQLEFVGQMAVNQQVGDFFKLAFLC
                    70        80        90       100       110       120

m098.pep   QIRMSX
           ||||||
a098       QIRMSX
```

The following partial DNA sequence was identified in *N. gonorrhoeae* <SEQ ID 351>:

g099.seq

```
  1 ATGCTGGGAC GCGCGTCCAT GATGCGCCTG CCCGATATTG TCGGCGTGGA
 51 GCTGACGGGC AAACGGCAGG CGGGCATTAC TGCCACAGAC ATCGTGTTGG
101 CACTGACCGA ATTCTTGCGT AAAGAGCGCG TGGTCGGGGC GTTTGTCGAA
151 TTTTTCGGCG AGGGCGCGAG AAGCCTGTCT ATCGGCGACC GCGCGACCAT
201 TTCCAACATG ACGCCGGAGT TCGGCGCGAC TGCCGCCATG TTCGCCATCG
251 ACGCGCAAAC TATTGATTAT TTGAAACTGA CCGGACGTGA CGACGCGCAG
301 GTGAAATTGG TGGAAACCTA CGCCAAAACC GCAGGCTTAT GGGCAGGTGG
351 CTTGAAAACC GCCGTTTATC CGCGCGTTTT GAAATTTGAT TTGAGCAGCG
401 TAACGCGCAA TATGGCAGGC CCGAGCAACC CGCACGCGCG TTTTGCCACC
451 GCCGATTTGG CGGCGAAAGG GCTGGCGAAG CCTTACGAAG AGCCTTCAGA
```

-continued

```
 501 CGGCCAAATG CCTGACGGTG CAGTGATTAT TGCCGCGATT ACTTCGTGTA
 551 CCAATACTTC CAACCCGCGC AACGTTGTCG CCGCCGCACT GTTGGCACGC
 601 AATGCCAACC GCCTCGGCTT GAAACGCAAA CCTTGGGTGA AATCTTCGTT
 651 TGCCCCGGGT TCAAAAGTAG CCGGAATCTA TTTGAAAGAA GCAGGCTTGT
 701 TGCCCGAAAT GGAAAAACTC GGCTTCGGTA TCGTCGCCTT CGCATGTACC
 751 ACCTGTAACG GCATGAgcgG CGCGCTcgaC CCGAAAATCC AACAAGAAAT
 801 CATCGACCGC GAtttgtacg cCACCGCCGT ATTGTCAGGC AACCGCAACT
 851 TCGACGGCCG TATCCATCCG TATGCGAAAC AGGCTTTCCT CGCTTCGCCT
 901 CCTTTGGTCG TTGCCTACGC ATTGGCAGGT AGCATCCGTT TCGATATTGA
 951 AAACGACGTA CTCGGCGTTG CAGACGGCCG CGAAATCCGC CTGAAAGATA
1001 TCTGGCCGAC AGACGAAGAA ATCGATGCCA TCGTTGCCGA ATATGTGAAA
1051 CCGCAACAAT TCCGCGACAT TTATATCCCG ATGTCCGACA CCGGCACAGC
1101 GCAAAAAGCA CCAAGCCCGC TGTACGACTG GCGACCGATG TCCACCTACA
1151 TCCGCCGTCC GCCCTATTGG GAAGGCGCAC TGGCAGGGGA ACGTACATTA
1201 AGAGGTATGC GTCCGCCGGC GATTTTGCCC GACAACATCA CCACCGACCA
1251 CATCTCgcca tCCAATGCGA TTTTGGCCGG cagTGCcgca ggtgaATATT
1301 TGGCGAAAAT GGGTTTGCCT GAAGAagaCT TCAACTCTTA CGCAACCCAC
1351 CGCGGCGACC ACTTGACCGC CCAACGCGCA ACCTTCGCCA ATCCGAAACT
1401 GTTTAACGAA ATGGTGAGAA ACGAAGACGG CAGCGTACGC CAAGGTtcgt
1451 tggcacgcgT tgaacCAGAA GGCCAAACCA TGCGCATGTG GGAAGCCATC
1501 GAAACCTATA TGAACCGCAA ACAGCCGCTT ATCATCATTG CCGGTGCGGA
1551 CTATGGTCAA GGCTCAAGCC GCGACTGGGC GGCGAAGGGC GTGCGGCTGG
1601 CGGGTGTGGA AGCCATCGCC GCCGAAGGTT TCGAGCGCAT CCACCGCACC
1651 AACCTCATCG GCATGGGCGT CTTGCCGCTG CAATTCAAAC CCGGCACCAA
1701 CCGCCATACC CTGCAACTGG ACGGTACGGA AACCTACGAC GTTGTCGGCG
1751 AACGCACACC GCGCTGCGGC CTGACCCTCG TGATTCACCG TAAAAACGGA
1801 GAAACCGTCG AAGTTCCGGT TACCTGCCGC CCCGATACCG CAGAAGAAGC
1851 ATTGGTATAT GAAGCCGGCG GCGTATTGCA ACGGTTTGCA CAGGACTTTT
1901 TGGAAGGGAA CGCGGCTTAG
```

This corresponds to the amino acid sequence <SEQ ID 352; ORF 099.ng>:

g099.pep

```
  1 MLGRASMMRL PDIVGVELTG KRQAGITATD IVLALTEFLR KERVVGAFVE
 51 FFGEGARSLS IGDRATISNM TPEFGATAAM FAIDAQTIDY LKLTGRDDAQ
101 VKLVETYAKT AGLWAGGLKT AVYPRVLKFD LSSVTRNMAG PSNPHARFAT
151 ADLAAKGLAK PYEEPSDGQM PDGAVIIAAI TSCTNTSNPR NVVAAALLAR
201 NANRLGLKRK PWVKSSFAPG SKVAGIYLKE AGLLPEMEKL GFGIVAFACT
251 TCNGMSGALD PKIQQEIIDR DLYATAVLSG NRNFDGRIHP YAKQAFLASP
```

-continued

```
301 PLVVAYALAG SIRFDIENDV LGVADGREIR LKDIWPTDEE IDAIVAEYVK

351 PQQFRDIYIP MSDTGTAQKA PSPLYDWRPM STYIRRPPYW EGALAGERTL

401 RGMRPPAILP DNITTDHISP SNAILAGSAA GEYLAKMGLP EEDFNSYATH

451 RGDHLTAQRA TFANPKLFNE MVRNEDGSVR QGSLARVEPE GQTMRMWEAI

501 ETYMNRKQPL IIIAGADYGQ GSSRDWAAKG VRLAGVEAIA AEGFERIHRT

551 NLIGMGVLPL QFKPGTNRHT LQLDGTETYD VVGERTPRCG LTLVIHRKNG

601 ETVEVPVTCR PDTAEEALVY EAGGVLQRFA QDFLEGNAA*
```

The following partial DNA sequence was identified in *N. meningitidis* <SEQ ID 353>:

m099.seq

```
   1 ATGCTGGGAC GCGCGTCCAT GATGCGCCTG CCCGATATTG TCGGCGTTGA
  51 GCTGAACGGC AAACGGCAGG CGGGCATTAC GGCGACGGAT ATTGTGTTGG
 101 CACTGACCGA GTTTCTGCGC AAAGAACGCG TGGTCGGGGC GTTTGTCGAA
 151 TTCTTCGGCG AGGGCGCGAG AAGCCTGTCT ATCGGCGACC GCGCGACCAT
 201 TTCCAACATG ACGCCGGAGT TCGGCGCGAC TGCCGCGATG TTCGCTATTG
 251 ATGAGCAAAC CATTGATTAT TTGAAACTGA CCGGACGCGA CGACGCGCAG
 301 GTGAAATTGG TGGAAACCTA CGCCAAAACC GCAGGCTTGT GGGCAGATGC
 351 CTTGAAAACC GCCGTTTATC CTCGCGTTTT GAAATTTGAT TTGAGCAGCG
 401 TAACGCGCAA TATGGCAGGC CCAAGTAACC CGCATGCCCG TTTTGCGACC
 451 GCCGATTTGG CGGCGAAAGG GCTGGCGAAG CCTTACGAAG AGCCTTCGGA
 501 CGGCCAAATG CCCGACGGCT CGGTCATCAT CGCCGCGATT ACCAGTTGCA
 551 CCAACACTTC CAACCCGCGC AACGTTGTTG CCGCCGCGCT CTTGGCACGC
 601 AATGCCAACC GTCTCGGCTT GAAACGCAAA CCTTGGGTGA AATCTTCGTT
 651 TGCCCCGGGT TCAAAAGTAG CCGAAATCTA TTTGAAAGAA GCGGGCCTGT
 701 TGCCCGAAAT GGAAAAACTC GGCTTCGGTA TCGTCGCCTT CGCCTGCACC
 751 ACCTGCAACG GCATGAGTGG CGCGCTGGAT CCGAAAATCC AGAAAGAAAT
 801 CATCGACCGC GATTTGTACG CCACCGCCGT ATTATCAGGC AACCGCAACT
 851 TCGACGGCCG TATCCACCCG TATGCGAAAC AGGCTTTCCT CGCTTCGCCT
 901 CCGTTGGTCG TTGCCTACGC GCTGGCAGGC AGTATCCGTT TCGATATTGA
 951 AAACGACGTA CTCGGCGTTG CAGACGGCAA GGAAATCCGC CTGAAAGACA
1001 TTTGGCCTGC CGATGAAGAA ATCGATGCCG TCGTTGCCGA ATATGTGAAA
1051 CCGCAGCAGT TCCGCGATGT GTATGTACCG ATGTTCGACA CCGGCACAGC
1101 GCAAAAAGCA CCCAGTCCGC TGTACGATTG GCGTCCGATG TCCACCTACA
1151 TCCGCCGTCC GCCTTACTGG GAAGGCGCGC TGGCAGGGGA ACGCACATTA
1201 AGAGGTATGC GTCCGCTGGC GATTTTGCCC GACAACATCA CCACCGACCA
1251 CCTCTCGCCG TCCAATGCGA TTTTGGCCGT CAGTGCCGCA GGCGAGTATT
1301 TGGCGAAAAT GGGTTTGCCT GAAGAAGACT TCAACTCTTA CGCAACCCAC
1351 CGCGGCGACC ACTTGACCGC CCAACGCGCT ACCTTCGCCA ATCCGAAACT
1401 GTTTAACGAA ATGGTGAAAA ACGAAGACGG CAGCGTGCGC CAAGGCTCGT
```

-continued

```
1451 TCGCCCGCGT CGAACCCGAA GGCGAAACCA TGCGCATGTG GGAAGCCATC

1501 GAAACCTATA TGAACCGCAA ACAGCCGCTC ATCATCATTG CCGGTGCGGA

1551 CTATGGTCAA GGCTCAAGCC GCGACTGGGC TGCAAAAGGC GTACGCCTCG

1601 CCGGCGTAGA AGCGATTGTT GCCGAAGGCT TCGAGCGTAT CCACCGCACC

1651 AACCTTATCG GCATGGGCGT GTTGCCGCTG CAGTTCAAAC CCGACACCAA

1701 CCGCCATACC CTGCAACTGG ACGGTACGGA AACCTACGAC GTGGTCGGCG

1751 AACGCACACC GCGCTGCGAC CTGACCCTCG TGATTCACCG TAAAAACGGC

1801 GAAACCGTTG AAGTTCCCGT TACCTGCTGC CTCGATACTG CAGAAGAAGT

1851 ATTGGTATAT GAAGCCGGCG GCGTGTTGCA ACGGTTTGCA CAGGATTTTT

1901 TGGAAGGGAA CGCGGCTTAG
```

This corresponds to the amino acid sequence <SEQ ID 354; ORF 099>:

m099.pep

```
  1 MLGRASMMRL PDIVGVELNG KRQAGITATD IVLALTEFLR KERVVGAFVE

 51 FFGEGARSLS IGDRATISNM TPEFGATAAM FAIDEQTIDY LKLTGRDDAQ

101 VKLVETYAKT AGLWADALKT AVYPRVLKFD LSSVTRNMAG PSNPHARFAT

151 ADLAAKGLAK PYEEPSDGQM PDGSVIIAAI TSCTNTSNPR NVVAAALLAR

201 NANRLGLKRK PWVKSSFAPG SKVAEIYLKE AGLLPEMEKL GFGIVAFACT

251 TCNGMSGALD PKIQKEIIDR DLYATAVLSG NRNFDGRIHP YAKQAFLASP

301 PLVVAYALAG SIRFDIENDV LGVADGKEIR LKDIWPADEE IDAVVAEYVK

351 PQQFRDVYVP MFDTGTAQKA PSPLYDWRPM STYIRRPPYW EGALAGERTL

401 RGMRPLAILP DNITTDHLSP SNAILAVSAA GEYLAKMGLP EEDFNSYATH

451 RGDHLTAQRA TFANPKLFNE MVKNEDGSVR QGSFARVEPE GETMRMWEAI

501 ETYMNRKQPL IIIAGADYGQ GSSRDWAAKG VRLAGVEAIV AEGFERIHRT

551 NLIGMGVLPL QFKPDTNRHT LQLDGTETYD VVGERTPRCD LTLVIHRKNG

601 ETVEVPVTCC LDTAEEVLVY EAGGVLQRFA QDFLEGNAA*
```

Computer analysis of this amino acid sequence gave the following results:

Homology with a predicted ORF from *N. gonorrhoeae*

ORF 099 shows 96.2% identity over a 639 aa overlap with a predicted ORF (ORF 099.ng) from *N. gonorrhoeae*:

m099/g099

```
                    10        20        30        40        50        60
m099.pep    MLGRASMMRLPDIVGVELNGKRQAGITATDIVLALTEFLRKERVVGAFVEFFGEGARSLS
            ||||||||||||||||||:|||||||||||||||||||||||||||||||||||||||||
g099        MLGRASMMRLPDIVGVELTGKRQAGITATDIVLALTEFLRKERVVGAFVEFFGEGARSLS
                    10        20        30        40        50        60

                    70        80        90       100       110       120
m099.pep    IGDRATISNMTPEFGATAAMFAIDEQTIDYLKLTGRDDAQVKLVETYAKTAGLWADALKT
            |||||||||||||||||||||||| |||||||||||||||||||||||||||||| :|||
g099        IGDRATISNMTPEFGATAAMFAIDAQTIDYLKLTGRDDAQVKLVETYAKTAGLWAGGLKT
                    70        80        90       100       110       120
```

-continued

```
                 130       140       150       160       170       180
m099.pep  AVYPRVLKFDLSSVTRNMAGPSNPHARFATADLAAKGLAKPYEEPSDGQMPDGSVIIAAI
          |||||||||||||||||||||||||||||||||||||||||||||||||||||:||||||
g099      AVYPRVLKFDLSSVTRNMAGPSNPHARFATADLAAKGLAKPYEEPSDGQMPDGAVIIAAI
                 130       140       150       160       170       180

                 190       200       210       220       230       240
m099.pep  TSCTNTSNPRNVVAAALLARNANRLGLKRKPWVKSSFAPGSKVAEIYLKEAGLLPEMEKL
          ||||||||||||||||||||||||||||||||||||||||||| ||||||||||||||||
g099      TSCTNTSNPRNVVAAALLARNANRLGLKRKPWVKSSFAPGSKVAGIYLKEAGLLPEMEKL
                 190       200       210       220       230       240

                 250       260       270       280       290       300
m099.pep  GFGIVAFACTTCNGMSGALDPKIQKEIIDRDLYATAVLSGNRNFDGRIHPYAKQAFLASP
          ||||||||||||||||||||||||:|||||||||||||||||||||||||||||||||||
g099      GFGIVAFACTTCNGMSGALDPKIQQEIIDRDLYATAVLSGNRNFDGRIHPYAKQAFLASP
                 250       260       270       280       290       300

                 310       320       330       340       350       360
m099.pep  PLVVAYALAGSIRFDIENDVLGVADGKEIRLKDIWPADEEIDAVVAEYVKPQQFRDVYVP
          ||||||||||||||||||||||||||:|||||||||:||||||:||||||||||||:|:|
g099      PLVVAYALAGSIRFDIENDVLGVADGREIRLKDIWPTDEEIDAIVAEYVKPQQFRDIYIP
                 310       320       330       340       350       360

                 370       380       390       400       410       420
m099.pep  MFDTGTAQKAPSPLYDWRPMSTYIRRPPYWEGALAGERTLRGMRPLAILPDNITTDHLSP
          | ||||||||||||||||||||||||||||||||||||||||||| |||||||||||:||
g099      MSDTGTAQKAPSPLYDWRPMSTYIRRPPYWEGALAGERTLRGMRPPAILPDNITTDHISP
                 370       380       390       400       410       420

                 430       440       450       460       470       480
m099.pep  SNAILAVSAAGEYLAKMGLPEEDFNSYATHRGDHLTAQRATFANPKLFNEMVKNEDGSVR
          |||||| |||||||||||||||||||||||||||||||||||||||||||||:|||||||
g099      SNAILAGSAAGEYLAKMGLPEEDFNSYATHRGDHLTAQRATFANPKLFNEMVRNEDGSVR
                 430       440       450       460       470       480

                 490       500       510       520       530       540
m099.pep  QGSFARVEPEGETMRMWEAIETYMNRKQPLIIIAGADYGQGSSRDWAAKGVRLAGVEAIV
          |||:|||||||:|||||||||||||||||||||||||||||||||||||||||||||||:
g099      QGSLARVEPEGQTMRMWEAIETYMNRKQPLIIIAGADYGQGSSRDWAAKGVRLAGVEAIA
                 490       500       510       520       530       540

                 550       560       570       580       590       600
m099.pep  AEGFERIHRTNLIGMGVLPLQFKPDTNRHTLQLDGTETYDVVGERTPRCDLTLVIHRKNG
          |||||||||||||||||||||||| |||||||||||||||||||||||| ||||||||||
g099      AEGFERIHRTNLIGMGVLPLQFKPGTNRHTLQLDGTETYDVVGERTPRCGLTLVIHRKNG
                 550       560       570       580       590       600

                 610       620       630       640
m099.pep  ETVEVPVTCCLDTAEEVLVYEAGGVLQRFAQDFLEGNAAX
          |||||||||  |||||:|||||||||||||||||||||||
g099      ETVEVPVTCRPDTAEEALVYEAGGVLQRFAQDFLEGNAAX
                 610       620       630       640
```

The following partial DNA sequence was identified in *N. meningitidis* <SEQ ID 355>:

a099.seq

```
  1 ATGCTGGGAC GCGCGTCCAT GATGCGCCTG CCCGATATTG TCGGCGTTGA
 51 GCTGAACGGC AAACGGAAGG CGGGCATTAC GGCGACGGAT ATTGTGTTGG
101 CACTGACCGA GTTTCTGCGC AAAGAACGCG TGGTCGGGGC GTTTGTCGAA
151 TTCTTCGGCG AGGGCGCGAG AAGCCTGTCT ATCGGCGACC GCGCGACCAT
201 TTCCAACATG ACGCCGGAGT TCGGCGCGAC TGCCGCGATG TTCGCTATTG
251 ATGAGCAAAC CATTGATTAT TTGAAACTGA CCGGACGCGA CGACGCGCAG
301 GTGAAATTGG TGGAAACCTA CGCCAAAACC GCAGGCTTGT GGGCAGATGC
351 CTTGAAAACC GCCGTTTATC CGCGCGTTTT GAAATTTGAT TTGAGCAGCG
401 TAACGCGCAA TATGGCAGGC CCGAGCAACC CGCACGCGCG TTTTGCGACC
451 GCCGATTTGG CCGGCAAAGG CTTGGCTAAA CCTTACGAAG AGCCTTCAGA
501 CGGCCAAATG CCTGACGGTG CAGTGATTAT TGCCGCGATT ACTTCCTGTA
551 CCAATACTTC CAATCCGCGC AACGTTGTCG CCGCCGCGCT GTTGGCACGC
601 AATGCCAACC GCCTCGGCTT GCAACGCAAA CCTTGGGTGA AATCTTCGTT
```

-continued

```
 651 TGCCCCGGGT TCAAAAGTAG CCGAAATCTA TTTGAAAGAA GCAGATCTGC
 701 TGCCCGAAAT GGAAAAACTC GGCTTCGGTA TCGTTGCCTT CGCATGTACC
 751 ACCTGTAACG GCATGAGCGG CGCGCTGGAT CCGAAAATCC AGAAAGAAAT
 801 CATCGACCGC GATTTGTACG CCACCGCCGT ATTGTCAGGC AACCGCAACT
 851 TTGACGGCCG TATCCATCCG TATGCGAAAC AGGCTTTCCT CGCTTCGCCT
 901 CCGTTGGTCG TTGCCTACGC GCTGGCAGGC AGCATCCGTT TCGATATTGA
 951 AAACGACGTA CTCGGCGTTG CAGACGGCAA AGAAATCCGC CTGAAAGACA
1001 TTTGGCCTAC CGATGAAGAA ATCGATGCCA TCGTTGCCGA ATATGTGAAA
1051 CCGCAGCAAT TTCGCGACGT TTATATCCCG ATGTTCGACA CCGGCACAGC
1101 GCAAAAAGCA CCAAGCCCGC TGTACGACTG GCGTCCAATG TCTACCTATA
1151 TCCGCCGCCC ACCTTACTGG GAAGGCGCAC TGGCAGGGGA ACGCACATTA
1201 AGCGGTATGC GTCCGCTGGC GATTTTGCCC GACAACATCA CCACCGACCA
1251 TCTCTCGCCA TCCAATGCGA TTTTGGCAAG CAGTGCCGCA GGCGAATATT
1301 TGGCAAAAAT GGGTTTGCCT GAAGAAGACT TCAACTCTTA CGCAACCCAC
1351 CGTGGCGACC ACTTGACCGC CCAACGCGCA ACCTTCGCCA ATCCGAAACT
1401 GTTTAACGAA ATGGTGAGAA ACGAAGACGG CAGCGTACGC CAAGGTTCGC
1451 TGGCACGCGT TGAACCCGAA GGCCAAACCA TGCGCATGTG GGAAGCCATC
1501 GAAACCTATA TGAACCGCAA ACAGCCGCTC ATCATCATTG CCGGCGCGGA
1551 CTACGGTCAA GGCTCAAGCC GCGACTGGGC TGCAAAAGGC GTACGCCTCG
1601 CCGGCGTGGA AGCGATTGTT GCCGAAGGCT TCGAGCGTAT CCACCGCACC
1651 AACTTGATCG GTATGGGCGT GTTGCCGCTG CAGTTCAAAC CGGGTACCAA
1701 CCGCCACACC CTGCAACTGG ACGGTACGGA AACCTACGAC GTTGTCGGCG
1751 AACGCACACC GCGCTGCGAC CTGACCCTTG TGATTCACCG TAAAAACGGC
1801 GAGACCGTCG AAGTCCCCAT TACCTGCCGC CTCGATACCG CAGAAGAAGT
1851 GTTGGTATAT GAAGCCGGTG GCGTATTGCA ACGGTTTGCA CAGGATTTTT
1901 TGGAAGGGAA CGCGGCTTAG
```

This corresponds to the amino acid sequence <SEQ ID 356; ORF 099.a>:

a099.pep

```
  1 MLGRASMMRL PDIVGVELNG KRKAGITATD IVLALTEFLR KERVVGAFVE
 51 FFGEGARSLS IGDRATISNM TPEFGATAAM FAIDEQTIDY LKLTGRDDAQ
101 VKLVETYAKT AGLWADALKT AVYPRVLKFD LSSVTRNMAG PSNPHARFAT
151 ADLAGKGLAK PYEEPSDGQM PDGAVIIAAI TSCTNTSNPR NVVAAALLAR
201 NANRLGLQRK PWVKSSFAPG SKVAEIYLKE ADLLPEMEKL GFGIVAFACT
251 TCNGMSGALD PKIQKEIIDR DLYATAVLSG NRNFDGRIHP YAKQAFLASP
301 PLVVAYALAG SIRFDIENDV LGVADGKEIR LKDIWPTDEE IDAIVAEYVK
351 PQQFRDVYIP MFDTGTAQKA PSPLYDWRPM STYIRRPPYW EGALAGERTL
401 SGMRPLAILP DNITTDHLSP SNAILASSAA GEYLAKMGLP EEDFNSYATH
451 RGDHLTAQRA TFANPKLFNE MVRNEDGSVR QGSLARVEPE GQTMRMWEAI
```

-continued

```
501 ETYMNRKQPL IIIAGADYGQ GSSRDWAAKG VRLAGVEAIV AEGFERIHRT

551 NLIGMGVLPL QFKPGTNRHT LQLDGTETYD VVGERTPRCD LTLVIHRKNG

601 ETVEVPITCR LDTAEEVLVY EAGGVLQRFA QDFLEGNAA*
```

m099/a099 97.5% identity in 639 aa overlap

```
                  10        20        30        40        50        60
m099.pep  MLGRASMMRLPDIVGVELNGKRQAGITATDIVLALTEFLRKERVVGAFVEFFGEGARSLS
          ||||||||||||||||||||||:|||||||||||||||||||||||||||||||||||||
a099      MLGRASMMRLPDIVGVELNGKRKAGITATDIVLALTEFLRKERVVGAFVEFFGEGARSLS
                  10        20        30        40        50        60

                  70        80        90       100       110       120
m099.pep  IGDRATISNMTPEFGATAAMFAIDEQTIDYLKLTGRDDAQVKLVETYAKTAGLWADALKT
          ||||||||||||||||||||||||||||||||||||||||||||||||||||||||||||
a099      IGDRATISNMTPEFGATAAMFAIDEQTIDYLKLTGRDDAQVKLVETYAKTAGLWADALKT
                  70        80        90       100       110       120

                 130       140       150       160       170       180
m099.pep  AVYPRVLKFDLSSVTRNMAGPSNPHARFATADLAAKGLAKPYEEPSDGQMPDGSVIIAAI
          ||||||||||||||||||||||||||||||||||:||||||||||||||||||:||||||
a099      AVYPRVLKFDLSSVTRNMAGPSNPHARFATADLAGKGLAKPYEEPSDGQMPDGAVIIAAI
                 130       140       150       160       170       180

                 190       200       210       220       230       240
m099.pep  TSCTNTSNPRNVVAAALLARNANRLGLKRKPWVKSSFAPGSKVAEIYLKEAGLLPEMEKL
          |||||||||||||||||||||||||||:||||||||||||||||||||||| ||||||||
a099      TSCTNTSNPRNVVAAALLARNANRLGLQRKPWVKSSFAPGSKVAEIYLKEADLLPEMEKL
                 190       200       210       220       230       240

                 250       260       270       280       290       300
m099.pep  GFGIVAFACTTCNGMSGALDPKIQKEIIDRDLYATAVLSGNRNFDGRIHPYAKQAFLASP
          ||||||||||||||||||||||||||||||||||||||||||||||||||||||||||||
a099      GFGIVAFACTTCNGMSGALDPKIQKEIIDRDLYATAVLSGNRNFDGRIHPYAKQAFLASP
                 250       260       270       280       290       300

                 310       320       330       340       350       360
m099.pep  PLVVAYALAGSIRFDIENDVLGVADGKEIRLKDIWPADEEIDAVVAEYVKPQQFRDVYVP
          ||||||||||||||||||||||||||||||||||||:||||||:||||||||||||||:|
a099      PLVVAYALAGSIRFDIENDVLGVADGKEIRLKDIWPTDEEIDAIVAEYVKPQQFRDVYIP
                 310       320       330       340       350       360

                 370       380       390       400       410       420
m099.pep  MFDTGTAQKAPSPLYDWRPMSTYIRRPPYWEGALAGERTLRGMRPLAILPDNITTDHLSP
          |||||||||||||||||||||||||||||||||||||||| |||||||||||||||||||
a099      MFDTGTAQKAPSPLYDWRPMSTYIRRPPYWEGALAGERTLSGMRPLAILPDNITTDHLSP
                 370       380       390       400       410       420

                 430       440       450       460       470       480
m099.pep  SNAILAVSAAGEYLAKMGLPEEDFNSYATHRGDHLTAQRATFANPKLFNEMVKNEDGSVR
          |||||| |||||||||||||||||||||||||||||||||||||||||||||:|||||||
a099      SNAILASSAAGEYLAKMGLPEEDFNSYATHRGDHLTAQRATFANPKLFNEMVRNEDGSVR
                 430       440       450       460       470       480

                 490       500       510       520       530       540
m099.pep  QGSFARVEPEGETMRMWEAIETYMNRKQPLIIIAGADYGQGSSRDWAAKGVRLAGVEAIV
          |||:|||||||:||||||||||||||||||||||||||||||||||||||||||||||||
a099      QGSLARVEPEGQTMRMWEAIETYMNRKQPLIIIAGADYGQGSSRDWAAKGVRLAGVEAIV
                 490       500       510       520       530       540

                 550       560       570       580       590       600
m099.pep  AEGFERIHRTNLIGMGVLPLQFKPDTNRHTLQLDGTETYDVVGERTPRCDLTLVIHRKNG
          |||||||||||||||||||||||| |||||||||||||||||||||||||||||||||||
a099      AEGFERIHRTNLIGMGVLPLQFKPGTNRHTLQLDGTETYDVVGERTPRCDLTLVIHRKNG
                 550       560       570       580       590       600

                 610       620       630       640
m099.pep  ETVEVPVTCCLDTAEEVLVYEAGGVLQRFAQDFLEGNAAX
          ||||||:|| ||||||||||||||||||||||||||||||
A099      ETVEVPITCRLDTAEEVLVYEAGGVLQRFAQDFLEGNAAX
                 610       620       630       640
```

The following partial DNA sequence was identified in *N. gonorrhoeae* <SEQ ID 357>:

g102.seq

```
  1 AtgtCCGCCA AAactccgtc gctcttcggc ggcgcgatga Ttatcgccgg

 51 gaaggttatc ggcgcAGgta tgttccccaa ccccaccgcc aacttggggg
```

-continued 101 acgggttaat aggctcgctg attgtgctgc tgtacacctg gtttccattc 151 tcctccggcg ccctcatgat tttggaagtc aacacccata acCCccgagg 201 ggcaAGtttt gacaccATGg tcAAagacct gctcgGaCGc ggctggaaca 251 tcatcaacgg catcgccgtc gctttggTCc tatacggctc gacctacgcg 301 tacattttag tcggcggtga cctGACCGCC AAAGGCAtcg GCAgCGCAGT 351 AGGCGGCAAA ATTTCgctca CCGTCGGACA actcgtcttc tTCGGCATCC

401 TCGCCTTTTG CGTATGGGCA TCCGCACGCT TGGTCGACCG CTTTACCGGC

451 GTCCTCATCG GCGGCATGGT ATTAACCTTT ATTTGGGCAA CCGGCGGCCT

501 GGTTGCCGAT GCCAAACCGT CCGTCCTCTT CGACACCCAA GCCCCCGTCG

551 GCACCGGCTA CTGGATTTAC GCCGCCACCG CCCTGCCCGT CTGCCTCGCT

601 TCCTTCGGCT TCCACGGCAA CGTTTCCAGC CTGCTCAAAT ACTTTAAAGG

651 CGACGcgcCc aaagtGgCGA aATCcatctg gGcaggtaca ttggTTGCCt 701 tggtaattta cgtccTCTgg caaaccgcca tCcaaagcaa ccTGCcgcgc 751 aacgagttcg cCCCcgtgat tgccgccgag aggcaactCT CCGTCCTgaa 801 tgaaacccTG tccaaattcg cccaaaccgg cgatatggat aAaatattgt 851 ccctatttcc ctacatggca atcgccacct cctttttagg cgTAACctta 901 ggcctgtttg acaacatcgc cgacatcttc aaatggaacg acagtatgtc 951 cgggcggggc accaaaaccg tcgcgctgaa cttcctgccg CCCCtgattt 1001 cctggctgct cctccccacc ggcttcttta ccgccattgg tgcgtccggc 1051 ctggcggcaa ccgtctggga ccaagGcatc atccccgcca tgctgctcta 1101 cgtttccccc caaaaaattG gcGcaggcaa gacttataAa gtttaCGGCG 1151 gcttgtggct gatgttagtc ttccttttcg gcatcgccaa catcgccgca 1201 CAGGTATTGA GccaAatgGa ACtcgtCccc GTATTTAAAG GATAA This corresponds to the amino acid sequence <SEQ ID 358; ORF 102.ng>:

g102.pep

1 MSAKTPSLFG GAMIIAGKVI GAGMFPNPTA NLGDGLIGSL IVLLYTWFPF

51 SSGALMILEV NTHNPRGASF DTMVKDLLGR GWNIINGIAV ALVLYGSTYA

101 YILVGGDLTA KGIGSAVGGK ISLTVGQLVF FGILAFCVWA SARLVDRFTG

151 VLIGGMVLTF IWATGGLVAD AKPSVLFDTQ APVGTGYWIY AATALPVCLA

201 SFGFHGNVSS LLKYFKGDAP KVAKSIWAGT LVALVIYVLW QTAIQSNLPR

251 NEFAPVIAAE RQLSVLNETL SKFAQTGDMD KILSLFPYMA IATSFLGVTL

301 GLFDNIADIF KWNDSMSGRG TKTVALNFLP PLISWLLLPT GFFTAIGASG

351 LAATVWDQGI IPAMLLYVSP QKIGAGKTYK VYGGLWLMLV FLFGIANIAA

401 QVLSQMELVP VFKG*

The following partial DNA sequence was identified in *N. meningitidis* <SEQ ID 359>:

m102.seq

```
   1 ATGCCCAACA AAACCCCTTC ACTGTTCGGC GGCGCGATGA TTATCGCCGG
  51 CACGGTCATC GGCGCAGGCA TGCTCGCCAA CCCGACCGCC ACATCCGGCG
 101 TATGGTTTAC CGGCTCGCTG GCCGTGTTGC TGTACACCTG GTTTTCTATG
 151 CTTTCCAGCG GCCTGATGAT TTTGGAAGTC AACACCCATT ATCCGCACGG
 201 CGCAAGTTTC GACACGATGG TCAAAGACCT GCTCGGACGC GGCTGGAACA
 251 TCATCAACGG CATCGCCGTC GCCTTCGTTT TATACCTGCT TACTTACGCT
 301 TATATCTTCG TCGGCGGCGA CCTGACCGCC AAAGGCTTAG GCAGCGCGGC
 351 AGGCGGCGAC GTTTCACTCA CCGTCGGACA ACTCGTCTTC TTCGGCATCC
 401 TCGCCTTTTG CGTATGGGCA TCCGCACGCT TGGTCGACCG CTTCACCGGC
 451 GTCCTTATCG GCGGCATGGT ATTGACCTTT ATTTGGGCGG CCGGCGGGCT
 501 GATTGCCGAT GCCAAGCCGT CCGTCCTCTT CGATACCCAA GCCCCCGCCG
 551 GCACAAACTA CTGGATTTAC GCCGCCACCG CCCTGCCCGT CTGCCTCGCT
 601 TCCTTCGGCT TCCACGGCAA CGTCTCCAGC CTGCTCAAAT ACTTTAAAGG
 651 CGACGCGCCC AAAGTGGCTA AATCCATCTG GACGGGCACA CTGATTGCGC
 701 TGGTAATTTA CGTCCTCTGG CAAACCGCCA TCCAAGGCAA CCTGCCGCGC
 751 AACGAGTTCG CCCCCGTCAT CGCCGCCGAA GGGCAAGTCT CCGTCCTCAT
 801 CGAAACCCTG TCCAAATTCG CCCAAACCGG CAATATGGAC AAAATATTGT
 851 CCCTGTTTTC CTATATGGCG ATCGCCACCT CGTTTTTAGG CGTAACGCTC
 901 GGACTCTTCG ACTACATCGC CGACATCTTC AAATGGAACG ACAGCATCTC
 951 CGGCCGCACC AAAACCGCCG CGCTGACCTT CCTGCCGCCC CTGATTTCCT
1001 GCCTGCTCTT CCCCACCGGC TTCGTTACCG CCATCGGCTA CGTCGGCCTG
1051 GCGGCAACCG TCTGGACAGG CATCATCCCC GCCATGCTGC TCTACCGTTC
1101 GCGCAAAAAA TTCGGCGCAG GCAAAACCTA TAAAGTTTAC GGCGGCTTGT
1151 GGCTGATGGT TTGGGTCTTC CTTTTCGGCA TCGTCAACAT CGCCGCACAG
1201 GTATTGAGCC AAATGGAACT CGTCCCCGTA TTTAAAGGAT AA
```

This corresponds to the amino acid sequence <SEQ ID 360; ORF 102>:

m102.pep..

```
   1 MPNKTPSLFG GAMIIAGTVI GAGMLANPTA TSGVWFTGSL AVLLYTWFSM
  51 LSSGLMILEV NTHYPHGASF DTMVKDLLGR GWNIINGIAV AFVLYLLTYA
 101 YIFVGGDLTA KGLGSAAGGD VSLTVGQLVF FGILAFCVWA SARLVDRFTG
 151 VLIGGMVLTF IWAAGGLIAD AKPSVLFDTQ APAGTNYWIY AATALPVCLA
 201 SFGFHGNVSS LLKYFKGDAP KVAKSIWTGT LIALVIYVLW QTAIQGNLPR
 251 NEFAPVIAAE GQVSVLIETL SKFAQTGNMD KILSLFSYMA IATSFLGVTL
 301 GLFDYIADIF KWNDSISGRT KTAALTFLPP LISCLLFPTG FVTAIGYVGL
 351 AATVWTGIIP AMLLYRSRKK FGAGKTYKVY GGLWLMVWVF LFGIVNIAAQ
 401 VLSQMELVPV FKG*
```

m102/g102 86.0% identity in 415 aa overlap

```
                      10        20        30        40        50        60
m102.pep      MPNKTPSLFGGAMIIAGTVIGAGMLANPTATSGVWFTGSLAVLLYTWFSMLSSGLMILEV
              |  |||||||||||||| ||||||: ||||: |  : ||| ||||||| : |::||||||
g102          MSAKTPSLFGGAMIIAGKVIGAGMFPNPTANLGDGLIGSLIVLLYTWFPFSSGALMILEV
                      10        20        30        40        50        60

                      70        80        90       100       110       120
m102.pep      NTHYPHGASFDTMVKDLLGRGWNIINGIAVAFVLYLLTYAYIFVGGDLTAKGLGSAAGGD
              ||| |:|||||||||||||||||||||||||:|||  |||||:|||||||||:|||:||
g102          NTHNPRGASFDTMVKDLLGRGWNIINGIAVALVLYGSTYAYILVGGDLTAKGIGSAVGGK
                      70        80        90       100       110       120

                     130       140       150       160       170       180
m102.pep      VSLTVGQLVFFGILAFCVWASARLVDRFTGVLIGGMVLTFIWAAGGLIADAKPSVLFDTQ
              :||||||||||||||||||||||||||||||||||||||||||:|||:||||||||||||
g102          ISLTVGQLVFFGILAFCVWASARLVDRFTGVLIGGMVLTFIWATGGLVADAKPSVLFDTQ
                     130       140       150       160       170       180

                     190       200       210       220       230       240
m102.pep      APAGTNYWIYAATALPVCLASFGFHGNVSSLLKYFKGDAPKVAKSIWTGTLIALVIYVLW
              ||:||:|||||||||||||||||||||||||||||||||||||||||:|||:||||||||
g102          APVGTGYWIYAATALPVCLASFGFHGNVSSLLKYFKGDAPKVAKSIWAGTLVALVIYVLW
                     190       200       210       220       230       240

                     250       260       270       280       290       300
m102.pep      QTAIQGNLPRNEFAPVIAAEGQVSVLIETLSKFAQTGNMDKILSLFSYMAIATSFLGVTL
              |||||:|||||||||||||| |:||| ||||||||||:|||||||| |||||||||||||
g102          QTAIQSNLPRNEFAPVIAAERQLSVLNETLSKFAQTGDMDKILSLFPYMAIATSFLGVTL
                     250       260       270       280       290       300

                     310        320       330       340       350
m102.pep      GLFDYIADIFKWNDSISGR-TKTAALTFLPPLISCLLFPTGFVTAIGYVGLAATVWT-GI
              |||| ||||||||||:||| |||:||:||||||| ||:|||| ||||  |||||||  ||
g102          GLFDNIADIFKWNDSMSGRGTKTVALNFLPPLISWLLLPTGFFTAIGASGLAATVWDQGI
                     310       320       330       340       350       360

           360       370       380       390       400       410
m102.pep      IPAMLLYRSRKKFGAGKTYKVYGGLWLMVWVFLFGIVNIAAQVLSQMELVPVFKGX
              ||||||| | :|:|||||||||||||||: ||||||:||||||||||||||||||||
g102          IPAMLLYVSPQKIGAGKTYKVYGGLWLML-VFLFGIANIAAQVLSQMELVPVFKGX
                     370       380       390        400       410
```

The following partial DNA sequence was identified in *N. meningitidis* <SEQ ID 361>:

a102.seq

```
  1 ATGCCCACCA AAACCCCTTC ACTGTTCGGC GGCGCGATGA TTATCGCCGG
 51 CACGNTCATC GGCGCAGGTA TGCTCGCCAA CCCGACCGCC ACATCCGGCG
101 TATGGTTTAC CGGCTCGCTG GCCGTGTTGC TGTACACCTG GTTTTCCATG
151 CTCTCCAGCG GCCTGATGAT TTTGGAAGTC AACACCCACT ACCCCCACGG
201 CGCGANCTTC GACACCATGG TTAAAGACCT GCTCGGACGG AGCTGGAACA
251 TCATCAACGG CATCGCCGTC GCCTTCGTTT TATACCTGCT TACTTACGCT
301 TATATCTTCG TCGGCGGCGA CCTGACCGCC AAAGGCTTAG GCAGCGCGGC
351 AGGCGGCAAT GTTTCACTCA CCGTCGGACA ACTCGTCTTC TTCGGCATTC
401 TCGCCTTTTG CGTATGGGCA TCCGCACGCT TGGTCGACCG ATTCACCAGC
451 GTCCTCATCG GCGGCATGGT ATTAACCTTT ATTTGGGCAA CCGGCGGCCT
501 GATTGCCGAT GCCAAACTGC CCGTCCTCTT CGACACCCAA GCCCCTACCG
551 GCACCAACTA CTGGATTTAT GTCGCCACCG CCCTGCCCGT CTGCCTTGCG
601 TCATTCGGTT TCCACGGCAA CGTCTCCAGC CTGCTCAAAT ACTTTAAAGG
651 CGACGCGCCC AAAGTGGCTA AATCCATCTG GACGGGCACA CTGATTGCGC
701 TGGTAATTTA CGTCCTCTGG CAAACCGCCA TCCAANGCAA CCTGCCGCGC
751 AACGAGTTCG CCCCCGTGAT TGCCGCCGAA GGGCAAGTCT CCGTCNTGAT
801 TGAAACCCTG TCCAAATTCG CCCAAACCGG CAATATGGAC AAAATATTGT
851 CCCTGTTTTC CTATATGGCG ATCGCCACCT CGTTTTTAGG CGTAACGCTC
```

-continued

```
 901 GGACTCTTCG ACTACATCGC CGACATCTTC AAATGGAACG ACAGCGTGTC

 951 CGGCCGCACC AAAACCGCCG CGCTGACCTT CCTGCCGCCT NTAATTTCCT

1001 GCCTGCTCTT CCCCACCGGC TTTGTTACCG CCATCGGNTA CGTCGGCCTG

1051 GCGGCAACCG TCTGGACAGG CATCATCCCC GCCATGCTGC TNTACCGTTC

1101 GCGCAAAAAA TTCGGCGCAG GCAAAACCTA TAAAGTTTAC GGCGGCTTGT

1151 GGCTGATGGT TTGGGTCTTC CTTTTCGGCA TCNTCAACAT CGCCGCACAN

1201 GTATTGAGCC AAATGGAACT CGTCCCCGTA TTTAAAGGAT AA

1202
```

This corresponds to the amino acid sequence <SEQ ID 362; ORF 102.a>:

a102.pep

```
  1 MPTKTPSLFG GAMIIAGTXI GAGMLANPTA TSGVWFTGSL AVLLYTWFSM

 51 LSSGLMILEV NTHYPHGAXF DTMVKDLLGR SWNIINGIAV AFVLYLLTYA

101 YIFVGGDLTA KGLGSAAGGN VSLTVGQLVF FGILAFCVWA SARLVDRFTS

151 VLIGGMVLTF IWATGGLIAD AKLPVLFDTQ APTGTNYWIY VATALPVCLA

201 SFGFHGNVSS LLKYFKGDAP KVAKSIWTGT LIALVIYVLW QTAIQXNLPR

251 NEFAPVIAAE GQVSVXIETL SKFAQTGNMD KILSLFSYMA IATSFLGVTL

301 GLFDYIADIF KWNDSVSGRT KTAALTFLPP XISCLLFPTG FVTAIGYVGL

351 AATVWTGIIP AMLLYRSRKK FGAGKTYKVY GGLWLMVWVF LFGIXNIAAX

401 VLSQMELVPV FKG*
```

m102/a102 95.9% identity in 413 aa overlap

```
                  10        20        30        40        50        60
m102.pep  MPNKTPSLFGGAMIIAGTVIGAGMLANPTATSGVWFTGSLAVLLYTWFSMLSSGLMILEV
          ||:||||||||||||||| |||||||||||||||||||||||||||||||||||||||||
a102      MPTKTPSLFGGAMIIAGTXIGAGMLANPTATSGVWFTGSLAVLLYTWFSMLSSGLMILEV
                  10        20        30        40        50        60

                  70        80        90       100       110       120
m102.pep  NTHYPHGASFDTMVKDLLGRGWNIINGIAVAFVLYLLTYAYIFVGGDLTAKGLGSAAGGD
          |||||||| |||||||||||:||||||||||||||||||||||||||||||||||||||:
a102      NTHYPHGAXFDTMVKDLLGRSWNIINGIAVAFVLYLLTYAYIFVGGDLTAKGLGSAAGGN
                  70        80        90       100       110       120

                 130       140       150       160       170       180
m102.pep  VSLTVGQLVFFGILAFCVWASARLVDRFTGVLIGGMVLTFIWAAGGLIADAKPSVLFDTQ
          |||||||||||||||||||||||||||||:|||||||||||||:||||||||  ||||||
a102      VSLTVGQLVFFGILAFCVWASARLVDRFTSVLIGGMVLTFIWATGGLIADAKLPVLFDTQ
                 130       140       150       160       170       180

                 190       200       210       220       230       240
m102.pep  APAGTNYWIYAATALPVCLASFGFHGNVSSLLKYFKGDAPKVAKSIWTGTLIALVIYVLW
          ||:|||||||:|||||||||||||||||||||||||||||||||||||||||||||||||
a102      APTGTNYWIYVATALPVCLASFGFHGNVSSLLKYFKGDAPKVAKSIWTGTLIALVIYVLW
                 190       200       210       220       230       240

                 250       260       270       280       290       300
m102.pep  QTAIQGNLPRNEFAPVIAAEGQVSVLIETLSKFAQTGNMDKILSLFSYMAIATSFLGVTL
          ||||| ||||||||||||||||||| ||||||||||||||||||||||||||||||||||
a102      QTAIQXNLPRNEFAPVIAAEGQVSVXIETLSKFAQTGNMDKILSLFSYMAIATSFLGVTL
                 250       260       270       280       290       300

                 310       320       330       340       350       360
m102.pep  GLFDYIADIFKWNDSISGRTKTAALTFLPPLISCLLFPTGFVTAIGYVGLAATVWTGIIP
          |||||||||||||||:|||||||||||||| |||||||||||||||||||||||||||||
a102      GLFDYIADIFKWNDSVSGRTKTAALTFLPPXISCLLFPTGFVTAIGYVGLAATVWTGIIP
                 310       320       330       340       350       360
```

-continued

```
                 370       380       390       400       410
m102.pep   AMLLYRSRKKFGAGKTYKVYGGLWLMVWVFLFGIVNIAAQVLSQMELVPVFKGX
           |||||||||||||||||||||||||||||||||||| |||| |||||||||||||
a102       AMLLYRSRKKFGAGKTYKVYGGLWLMVWVFLFGIXNIAAXVLSQMELVPVFKGX
                 370       380       390       400       410
```

The following partial DNA sequence was identified in *N. gonorrhoeae* <SEQ ID 363>:

g105.seq

```
  1 Atgtccgcag aaaCATACAc acAAAtcggc tGGgtaggct taggGcaaat
 51 gGgtctgcct atgGTAACGC GGCTCTTGGA CGGCGGCATC GAAGTCGGCG
101 TATACAACCG CTCGCCCGAC AAAACTGCCC CCATCTCcgc CAAAGGAGCA
151 AAAGTTTACG GCagcACCGC CGAACTCGTC CGCGCCTGCC CCGTCATTTT
201 CCTGATGGTT TCCGACTATG CCGCCGTGTG CGACATCCTG AACGGAGTCC
251 GCGACGGATT GGCCGGCAAA ATCATCGTCA ACATGAGCAC CATCTCCCCG
301 ACCGAAAACC TCGCCGTCAA AGCACTTGTC GAAGCCGCAG GCGGACAGTT
351 TGCCGAAGCA CCCGTTTCCG GATCGGTCGG ACCCGCCACC AACGGCACAC
401 TGCTGATTCT GTTCGGCGGC AGCGAAGCCG TTTTAAACCC GCTGCAAAAA
451 ATATTTTCCC TTGTCGGCAA AAAAACCTTC CATTTCGGCG ATGTCGGCAA
501 AGGCTCGGGC GCGAAACTCG TCTTGAACTC GCTCTTAGGC ATTTTCGGCG
551 AAGCGTACAG CGAAGCGATG CTGATGGCGC GGCAGTTCGG CATCGATACC
601 GACACCATCG TCGAAGCCAT CGGCGGCTCG GCAATGGACT CGCCTATGTT
651 TCAAACAAAA AAATCACTAT GGGCAAACCG TGAGTTCCCC CCTGCCTTTG
701 CACTCAAACA CGCTTCCAAA GAcctTAACC TCGccgtcAA AGAGCTTGAA
751 CAGGCAGGCA ACACCCTGCC CGCCGTCGAA ACCGTTGCTG CCAGCTACCG
801 CAAAGCAGTT GAAGCCGGCT ACGGCGAACA GGACGTTTCC GGCGTTTACC
851 TGAAATTGGC AGAACACTGA
```

This corresponds to the amino acid sequence <SEQ ID 364; ORF 105.ng>:

g105.pep

```
  1 MSAETYTQIG WVGLGQMGLP MVTRLLDGGI EVGVYNRSPD KTAPISAKGA
 51 KVYGSTAELV RACPVIFLMV SDYAAVCDIL NGVRDGLAGK IIVNMSTISP
101 TENLAVKALV EAAGGQFAEA PVSGSVGPAT NGTLLILFGG SEAVLNPLQK
151 IFSLVGKKTF HFGDVGKGSG AKLVLNSLLG IFGEAYSEAM LMARQFGIDT
201 DTIVEAIGGS AMDSPMFQTK KSLWANREFP PAFALKHASK DLNLAVKELE
251 QAGNTLPAVE TVAASYRKAV EAGYGEQDVS GVYLKLAEH
```

The following partial DNA sequence was identified in *N. meningitidis* <SEQ ID 365>:

m105.seq

```
  1 ATGTCCGCAA ACGAATACGC ACAAATCGGC TGGaTAGGCT TAGGGCAAAT
 51 GGGTCTGCCT ATGGTAACGC GGCTCTTGGA CGGCGGCATC GAAGTCGGCG
101 TATACAACCG CTCGCCCGAC AAAACTGCCC CCATCTCCGC CAAAGGCGCA
151 AAAGTTTACG GCAACACCGC CGAACTCGTC CGCGACTATC CCGTCATTTT
201 CCTGATGGTT TCCGACTATG CCGCCGTGTG CGACATCCTG AACGGAGTCC
251 GCGACGGATT GGCCGGCAAm ATCATCGTCA ACATGAGCAC CATCTCCCCG
301 ACCGAAAaGC TCGCCGTCAA AGCACTTGTC GAAGCGCAGm GaCAGTTTGC
351 CGAAGCACCC GTTTCCGGAT CGGTCGGGCC CGCCACCAAC GGCACGCTGC
401 TGATTCTGTT CGGCGGCAGC GAAcCGtTTT AAACCCGCTG CAAAAAATAT
451 TTTCCCTCGT CGGCAAAAAA ACCTTCCATT TCGGCGATGT CGGCAAAGGT
501 TCGGGCGCGA AACTCGTCTT GAACTCGCTC TTGGGCATTT TCGGCGAaCG
551 TAcAGCGAAs GmTgCTGATG GCGCGGCAGT TCGGCATCGA TACCGACACC
601 ATCGTCGAAG CCATCGGsGA CTCGGCAATG GACTCGCCCA TGTTCGAAAC
651 CAAAAAATCC CTGTGGGCAA ACCGCGAATT CCCGmCCGmC TTCGCCCTCA
701 AACACGCCTC CAAAGACCTC AACCTCGCCG TCAAAGAGCT TGAACAGGCA
751 GGCAACACCC TGCCCGCCGT CGAAACCGTT GCTGCCAGCT ACCGCAAAGC
801 AGTCGAAGCC GGCTACGGGA CACAGGACGT TTCCGGCGTT TACCTGAAAC
851 TGGCAGAACA CTGA
```

This corresponds to the amino acid sequence <SEQ ID 366; ORF 105>:

m105.pep

```
  1 MSANEYAQIG WIGLGQMGLP MVTRLLDGGI EVGVYNRSPD KTAPISAKGA
 51 KVYGNTAELV RDYPVIFLMV SDYAAVCDIL NGVRDGLAGX IIVNMSTISP
101 TEKLAVKALV EAQRQFAEAP VSGSVGPATN GTLLILFGGS EPFXTRCKKY
151 FPSSAKKPSI SAMSAKVRAR NSSXTRSWAF SANVQRXXLM ARQFGIDTDT
201 IVEAIGDSAM DSPMFQTKKS LWANREFPXX FALKHASKDL NLAVKELEQA
251 GNTLPAVETV AASYRKAVEA GYGTQDVSGV YLKLAEH
```

Computer analysis of this amino acid sequence gave the following results:

Homology with a predicted ORF from *N. gonorrhoeae*

ORF 105 shows 79.9% identity over a 289 aa overlap with a predicted ORF (ORF 105.ng) from *N. gonorrhoeae*:

m105/g105

```
                   10        20        30        40        50        60
g105.pep    MSAETYTQIGWVGLGQMGLPMVTRLLDGGIEVGVYNRSPDKTAPISAKGAKVYGSTAELV
            |||:  |:||||:||||||||||||||||||||||||||||||||||||||||||:|||||
m105        MSANEYAQIGWIGLGQMGLPMVTRLLDGGIEVGVYNRSPDKTAPISAKGAKVYGNTAELV
                   10        20        30        40        50        60
```

-continued

```
                      70        80        90       100       110       120
g105.pep      RACPVIFLMVSDYAAVCDILNGVRDGLAGKIIVNMSTISPTENLAVKALVEAAGGQFAEA
              |  |||||||||||||||||||||||||| ||||||||||||:|||||||||   |||||
m105          RDYPVIFLMVSDYAAVCDILNGVRDGLAGXIIVNMSTISPTEKLAVKALVEAQR-QFAEA
                      70        80        90       100       110

                     130       140       150       160       170       180
g105.pep      PVSGSVGPATNGTLLILFGGSEAVLNPLQKIFSLVGKKTFHFGDVGKGSGAKLVLNSLLG
              ||||||||||||||||||||||   :  :| |   :||   :: ::    |:    :
m105          PVSGSVGPATNGTLLILFGGSEPFXTRCKKYFPSSAKKP-SISAMSAKVRARNSSXTRSW
            120       130       140       150        160       170

                     190       200       210       220       230       240
g105.pep      IFGEAYSEAMLMARQFGIDTDTIVEAIGGSAMDSPMFQTKKSLWANREFPPAFALKHASK
               |:   ::  |||||||||||||||||| |||||||||||||||||||||  ||||||||
m105          AFSANVQRXXLMARQFGIDTDTIVEAIGDSAMDSPMFQTKKSLWANREFPXXFALKHASK
             180       190       200       210       220       230

                     250       260       270       280      289
g105.pep      DLNLAVKELEQAGNTLPAVETVAASYRKAVEAGYGEQDVSGVYLKLAEH
              ||||||||||||||||||||||||||||||||||| |||||||||||||
m105          DLNLAVKELEQAGNTLPAVETVAASYRKAVEAGYGTQDVSGVYLKLAEH
             240       250       260       270       280
```

The following partial DNA sequence was identified in *N. meningitidis* <SEQ ID 367>:

a105.seq

```
  1 ATGTCCGCAA ACGAATACAC ACAAATCGGC TGGATAGGCT TAGGGCAAAT
 51 GGGTCTGCCT ATGGTAACGC GGCTCTTGGA CGGCGGCATC GAAGTCGGCG
101 TATACAACCG CTCGCCCGAC AAAACTGCCC CCATCTCCGC CAAAGGCGCA
151 AAAGTTTACG GCAACACCGC CGAACTCGTC CGCGACTATC CCGTCATTTT
201 CCTGATGGTT TCCGACTATG CCGCCGTGTG CGACATCCTG AACGGAGTCC
251 GCGACGGATT GGCCGGCAAA ATCATCGTCA ACATGAGCAC CATCTCCCCG
301 ACCGAAAACC TCCCCCTCAA AGCACTTGTC GAAGCCGCAG GCGGACAGTT
351 TGCCGAAGCA CCCGTTTCCG GATCGGTCGG GCCCGCCACC AACGGCACGC
401 TGCTGATTCT GTTCGGCGGC AGCGAAGCCG TTTTAAACCC GCTGCAAAAA
451 ATATTTTCCC TCGTCGGCAA AAAAACCTTC CATTTCGGCG ATGTCGGCAA
501 AGGTTCGGGC GCGAAACTCG TCTTGAACTC GCTCTTGGGC ATTTTCGGCG
551 AAGCGTACAG CGAAGCGATG CTGATGGCGC GGCAGTTCGG CATCGATACC
601 GACACCATCG TCGAAGCCAT CGCCGGCTCG GCAATGGACT CGCCCATGTT
651 CCAAACCAAA AAATCCCTGT GGGCAAACCG CGAATTCCCA CCCGCCTTCG
701 CCCTCAAACA CGCCTCCAAA GACCTCAACC TCGCCGTCAA AGAGCTTGAA
751 CAGGCAGGCA ACACCCTGCC CGCCGTCGAA ACCGTTGCTG CCAGCTACCG
801 CAAAGCAGTC GAAGCCGGCT ACGGCGAACA GGACGTTTCC GGCGTTTACC
851 TGAAATTGGC AGAACACTGA
```

This corresponds to the amino acid sequence <SEQ ID 368; ORF 105.a>:

a105.pep

```
  1 MSANEYTQIG WIGLGQMGLP MVTRLLDGGI EVGVYNRSPD KTAPISAKGA
 51 KVYGNTAELV RDYPVIFLMV SDYAAVCDIL NGVRDGLAGK IIVNMSTISP
101 TENLAVKALV EAAGGQFAEA PVSGSVGPAT NGTLLILFGG SEAVLNPLQK
```

-continued

```
151 IFSLVGKKTF HFGDVGKGSG AKLVLNSLLG IFGEAYSEAN LMARQFGIDT

201 DTIVEAIGGS AMDSPMFQTK KSLWANREFP PAFALKHASK DLNLAVKELE

251 QAGNTLPAVE TVAASYRKAV EAGYGEQDVS GVYLKLAEH*
```

m105/a105 96.5% identity in 289 aa overlap

```
                10         20         30         40         50         60
m105.pep   MSANEYAQIGWIGLGQMGLPMVTRLLDGGIEVGVYNRSPDKTAPISAKGAKVYGNTAELV
           ||||||:|||||||||||||||||||||||||||||||||||||||||||||||||||||
a105       MSANEYTQIGWIGLGQMGLPMVTRLLDGGIEVGVYNRSPDKTAPISAKGAKVYGNTAELV
                10         20         30         40         50         60

                70         80         90        100        110       119
m105.pep   RDYPVIFLMVSDYAAVCDILNGVRDGLAGKIIVNMSTISPTENLAVKALVEAAG-QFAEA
           |||||||||||||||||||||||||||||||||||||||||||||||||||||| |||||
a105       RDYPVIFLMVSDYAAVCDILNGVRDGLAGKIIVNMSTISPTENLAVKALVEAQGGQFAEA
                70         80         90        100        110        120

               120        130        140        150        160       170       179
m105.pep   PVSGSVGPATNGTLLILFGGSEAVLNPLQKIFSLVGKKTFHFGDVGKGSGAKLVLNSLLG
           ||||||||||||||||||||||||||||||||||||||||||||||||||||||||||||
a105       PVSGSVGPATNGTLLILFGGSEAVLNPLQKIFSLVGKKTFHFGDVGKGSGAKLVLNSLLG
               130        140        150        160        170        180

               180       190        200        210        220        230
m105.pep   IFGDV-QRXMLMARQFGIDTDTIVEAIGDSAMDSPMFQTKKSLWANREFPXAFALKHASK
           |||::  :: |||||||||||||||||||| |||||||||||||||||||| ||||||||
a105       IFGEAYSEAMLMARQFGIDTDTIVEAIGGSAMDSPMFQTKKSLWANREFPPAFALKHASK
               190        200        210        220        230        240

               240        250        260        270        280
m105.pep   DLNLAVKELEQAGNTLPAVETVAASYRKAVEAGYGEQDVSGVYLKLAEHX
           |||||||||||||||||||||||||||||||||||||||||||||||||
a105       DLNLAVKELEQAGNTLPAVETVAASYRKAVEAGYGEQDVSGVYLKLAEHX
               250        260        270        280        290
```

The following partial DNA sequence was identified in *N. gonorrhoeae* <SEQ ID 369>:

```
g105-1.seq

  1 ATGTCCGCAG AAACATACAC ACAAATCGGC TGGGTAGGCT TAGGGCAAAT

 51 GGGTCTGCCT ATGGTAACGC GGCTCTTGGA CGGCGGCATC GAAGTCGGCG

101 TATACAACCG CTCGCCCGAC AAAACTGCCC CCATCTCCGC CAAAGGAGCA

151 AAAGTTTACG GCAGCACCGC CGAACTCGTC CGCGCCTGCC CCGTCATTTT

201 CCTGATGGTT TCCGACTATG CCGCCGTGTG CGACATCCTG AACGGAGTCC

251 GCGACGGATT GGCCGGCAAA ATCATCGTCA ACATGAGCAC CATCTCCCCG

301 ACCGAAAACC TCGCCGTCAA AGCACTTGTC GAAGCCGCAG GCGGACAGTT

351 TGCCGAAGCA CCCGTTTCCG GATCGGTCGG ACCCGCCACC AACGGCACAC

401 TGCTGATTCT GTTCGGCGGC AGCGAAGCCG TTTTAAACCC GCTGCAAAAA

451 ATATTTTCCC TTGTCGGCAA AAAAACCTTC CATTTCGGCG ATGTCGGCAA

501 AGGCTCGGGC GCGAAACTCG TCTTGAACTC GCTCTTAGGC ATTTTCGGCG

551 AAGCGTACAG CGAAGCGATG CTGATGGCGC GGCAGTTCGG CATCGATACC

601 GACACCATCG TCGAAGCCAT CGGCGGCTCG GCAATGGACT CGCCTATGTT

651 TCAAACAAAA AAATCACTAT GGGCAAACCG TGAGTTCCCC CCTGCCTTTG

701 CACTCAAACA CGCTTCCAAA GACCTTAACC TCGCCGTCAA AGAGCTTGAA

751 CAGGCAGGCA ACACCCTGCC CGCCGTCGAA ACCGTTGCTG CCAGCTACCG

801 CAAAGCAGTT GAAGCCGGCT ACGGCGAACA GGACGTTTCC GGCGTTTACC

851 TGAAATTGGC AGAACACTGA
```

This corresponds to the amino acid sequence <SEQ ID 370; ORF 105-1.ng>:

g105-1.pep

```
  1 MSAETYTQIG WVGLGQMGLP MVTRLLDGGT EVGVYNRSPD KTAPISAKGA
 51 KVYGSTAELV RACPVIFLMV SDYAAVCDIL NGVRDGLAGK IIVNMSTISP
101 TENLAVKALV EAAGGQFAEA PVSGSVGPAT NGTLLILFGG SEAVLNPLQK
151 IFSLVGKKTF HFGDVGKGSG AKLVLNSLLG IFGEAYSEAM LMARQFGIDT
201 DTIVEAIGGS AMDSPNFQTK KSLWANREFP PAFALKHASK DLNLAVKELE
251 QAGNTLPAVE TVAASYRKAV EAGYGEQDVS GVYLKLAEH*
```

The following partial DNA sequence was identified in *N. meningitidis* <SEQ ID 371>:

m105-1.seq

```
  1 ATGTCCGCAA ACGAATACGC ACAAATCGGC TGGATAGGCT TAGGGCAAAT
 51 GGGTCTGCCT ATGGTAACGC GGCTCTTGGA CGGCGGCATC GAAGTCGGCG
101 TATACAACCG CTCGCCCGAC AAAACTGCCC CCATCTCCGC CAAAGGCGCA
151 AAAGTTTACG GCAACACCGC CGAACTCGTC CGCGACTATC CCGTCATTTT
201 CCTGATGGTT TCCGACTATG CCGCCGTGTG CGACATCCTG AACGGAGTCC
251 GCGACGGATT GGCCGGCAAA ATCATCGTCA ACATGAGCAC CATCTCCCCG
301 ACCGAAAACC TCGCCGTCAA AGCACTTGTC GAAGCCGCAG GCGGACAGTT
351 TGCCGAAGCA CCCGTTTCCG GATCGGTCGG GCCCGCCACC AACGCCACGC
401 TGCTGATTCT GTTCGGCGGC AGCGAAGCCG TTTTAAACCC GCTGCAAAAA
451 ATATTTTCCC TCGTCGGCAA AAAAACCTTC CATTTCGGCG ATGTCGGCAA
501 AGGTTCGGGC GCGAAACTCG TCTTGAACTC GCTCTTGGGC ATTTTCGGCG
551 AAGCGTACAG CGAAnCGATG CTGATGGCGC GGCAGTTCGG CATCGATACC
601 GACACCATCG TCGAAGCCAT CGGsGACTCG GCAATGGACT CGCCCATGTT
651 CCAAACCAAA AAATCCCTGT GGGCAAACCG CGAATTCCCG CCCGCCTTCG
701 CCCTCAAACA CGCCTCCAAA GACCTCAACC TCGCCGTCAA AGAGCTTGAA
751 CAGGCAGGCA ACACCCTGCC CGCCGTCGAA ACCGTTGCTG CCAGCTACCG
801 CAAAGCAGTC GAAGCCGGCT ACGGCGAACA GGACGTTTCC GGCGTTTACC
851 TGAAACTGGC AGAACACTGA
```

This corresponds to the amino acid sequence <SEQ ID 372; ORF 105-1>:

m105-1.pep

```
  1 MSANEYAQIG WIGLGQNGLP MVTRLLDGGI EVGVYNRSPD KTAPISAKGA
 51 KVYGNTAELV RDYPVIFLMV SDYAAVCDIL NGVRDGLAGK IIVWNSTISP
101 TENLAVKALV EAAGGQFAEA PVSGSVGPAT NGTLLILFGG SEAVLNPLQK
151 IFSLVGKKTF HFGDVGKGSG AKLVLNSLLG IFGEAYSEXM LMARQFGIDT
201 DTIVEAIGDS AMDSPMFQTK KSLWANREFP PAFALKHASK DLNLAVKELE
251 QAGNTLPAVE TVAASYRKAV EAGYGEQDVS GVYLKLAEH*
```

m105-1/g105-1 96.9% identity in 289 aa overlap

```
                        10        20        30        40        50        60
m105-1.pep    MSANEYAQIGWIGLGQMGLPMVTRLLDGGIEVGVYNRSPDKTAPISAKGAKVYGNTAELV
              |||: |:||||:||||||||||||||||||||||||||||||||||||||||||:|||||
g105-1        MSAETYTQIGWVGLGQMGLPMVTRLLDGGIEVGVYNRSPDKTAPISAKGAKVYGSTAELV
                        10        20        30        40        50        60

                        70        80        90       100       110       120
m105-1.pep    RDYPVIFLMVSDYAAVCDILNGVRDGLAGKIIVNMSTISPTENLAVKALVEAAGGQFAEA
              |  |||||||||||||||||||||||||||||||||||||||||||||||||||||||||
g105-1        RACPVIFLMVSDYAAVCDILNGVRDGLAGKIIVNMSTISPTENLAVKALVEAAGGQFAEA
                        70        80        90       100       110       120

                       130       140       150       160       170       180
m105-1.pep    PVSGSVGPATNGTLLILFGGSEAVLNPLQKIFSLVGKKTFHFGDVGKGSGAKLVLNSLLG
              ||||||||||||||||||||||||||||||||||||||||||||||||||||||||||||
g105-1        PVSGSVGPATNGTLLILFGGSEAVLNPLQKIFSLVGKKTFHFGDVGKGSGAKLVLNSLLG
                       130       140       150       160       170       180

                       190       200       210       220       230       240
m105-1.pep    IFGEAYSEXMLMARQFGIDTDTIVEAIGDSAMDSPMFQTKKSLWANREFPPAFALKHASK
              |||||||| ||||||||||||||||||| |||||||||||||||||||||||||||||||
g105-1        IFGEAYSEAMLMARQFGIDTDTIVEAIGGSAMDSPMFQTKKSLWANREFPPAFALKHASK
                       190       200       210       220       230       240

                       250       260       270       280       290
m105-1.pep    DLNLAVKELEQAGNTLPAVETVAASYRKAVEAGYGEQDVSGVYLKLAEHX
              |||||||||||||||||||||||||||||||||||||||||||||||||
g105-1        DLNLAVKELEQAGNTLPAVETVAASYRKAVEAGYGEQDVSGVYLKLAEHX
                       250       260       270       280       290
```

The following partial DNA sequence was identified in *N. meningitidis* <SEQ ID 373>:

a105-1.seq

```
  1 ATGTCCGCAA ACGAATACAC ACAAATCGGC TGGATAGGCT TAGGGCAAAT
 51 GGGTCTGCCT ATGGTAACGC GGCTCTTGGA CGGCGGCATC GAAGTCGGCG
101 TATACAACCG CTCGCCCGAC AAAACTGCCC CCATCTCCGC CAAAGGCGCA
151 AAAGTTTACG GCAACACCGC CGAACTCGTC CGCGACTATC CCGTCATTTT
201 CCTGATGGTT TCCGACTATG CCGCCGTGTG CGACATCCTG AACGGAGTCC
251 GCGACGGATT GGCCGGCAAA ATCATCGTCA ACATGAGCAC CATCTCCCCG
301 ACCGAAAACC TCGCCGTCAA AGCACTTGTC GAAGCCGCAG GCGGACAGTT
351 TGCCGAAGCA CCCGTTTCCG GATCGGTCGG GCCCGCCACC AACGGCACGC
401 TGCTGATTCT GTTCGGCGGC AGCGAAGCCG TTTTAAACCC GCTGCAAAAA
451 ATATTTTCCC TCGTCGGCAA AAAAACCTTC CATTTCGGCG ATGTCGGCAA
501 AGGTTCGGGC GCGAAACTCG TCTTGAACTC GCTCTTGGGC ATTTTCGGCG
551 AAGCGTACAG CGAAGCGATG CTGATGGCGC GGCAGTTCGG CATCGATACC
601 GACACCATCG TCGAAGCCAT CGGCGGCTCG GCAATGGACT CGCCCATGTT
651 CCAAACCAAA AAATCCCTGT GGGCAAACCG CGAATTCCCA CCCGCCTTCG
701 CCCTCAAACA CGCCTCCAAA GACCTCAACC TCGCCGTCAA AGAGCTTGAA
751 CAGGCAGGCA ACACCCTGCC CGCCGTCGAA ACCGTTGCTG CCAGCTACCG
801 CAAAGCAGTC GAAGCCGGCT ACGGCGAACA GGACGTTTCC GGCGTTTACC
851 TGAAATTGGC AGAACACTGA
```

This corresponds to the amino acid sequence <SEQ ID 374; ORF 105-1.a>:

a105-1.pep

```
  1 MSANEYTQIG WIGLGQMGLP MVTRLLDGGI EVGVYNRSPD KTAPISAKGA
 51 KVYGNTAELV RDYPVIFLMV SDYAAVCDIL NGVRDGLAGK IIVNMSTISP
101 TENLAVKALV EAAGGQFAEA PVSGSVGPAT NGTLLILFGG SEAVLNPLQK
151 IFSLVGKKTF HFGDVGKGSG AKLVLNSLLG IFGEAYSEAM LMARQFGIDT
201 DTIVEAIGGS AMDSPMFQTK KSLWANREFP PAFALKHASK DLNLAVKELE
251 QAGNTLPAVE TVAASYRKAV EAGYGEQDVS GVYLKLAEH*
```

a105-1/m105-1 99.0% identity in 289 aa overlap

```
                    10        20        30        40        50        60
a105-1.pep  MSANEYTQIGWIGLGQMGLPMVTRLLDGGIEVGVYNRSPDKTAPISAKGAKVYGNTAELV
            ||||||:|||||||||||||||||||||||||||||||||||||||||||||||||||||
m105-1      MSANEYAQIGWIGLGQMGLPMVTRLLDGGIEVGVYNRSPDKTAPISAKGAKVYGNTAELV
                    10        20        30        40        50        60

                    70        80        90       100       110       120
a105-1.pep  RDYPVIFLMVSDYAAVCDILNGVRDGLAGKIIVNMSTISPTENLAVKALVEAAGGQFAEA
            ||||||||||||||||||||||||||||||||||||||||||||||||||||||||||||
m105-1      RDYPVIFLMVSDYAAVCDILNGVRDGLAGKIIVNMSTISPTENLAVKALVEAAGGQFAEA
                    70        80        90       100       110       120
                   130       140       150       160       170       180
a105-1.pep  PVSGSVGPATNGTLLILFGGSEAVLNPLQKIFSLVGKKTFHFGDVGKGSGAKLVLNSLLG
            ||||||||||||||||||||||||||||||||||||||||||||||||||||||||||||
m105-1      PVSGSVGPATNGTLLILFGGSEAVLNPLQKIFSLVGKKTFHFGDVGKGSGAKLVLNSLLG
                   130       140       150       160       170       180
                   190       200       210       220       230       240
a105-1.pep  IFGEAYSEAMLMARQFGIDTDTIVEAIGGSAMDSPMFQTKKSLWANREFPPAFALKHASK
            |||||||| |||||||||||||||||||||||| ||||||||||||||||||||||||||
m105-1      IFGEAYSEXMLMARQFGIDTDTIVEAIGDSAMDSPMFQTKKSLWANREFPPAFALKHASK
                   190       200       210       220       230       240
                   250       260       270       280       290
a105-1.pep  DLNLAVKELEQAGNTLPAVETVAASYRKAVEAGYGEQDVSGVYLKLAEHX
            ||||||||||||||||||||||||||||||||||||||||||||||||||
m105-1      DLNLAVKELEQAGNTLPAVETVAASYRKAVEAGYGEQDVSGVYLKLAEHX
                   250       260       270       280       290
```

The following partial DNA sequence was identified in *N. gonorrhoeae* <SEQ ID 375>:

g107.seq

```
  1 ATGGTATTAA CCTTTATTTG GGCAACCGGC GGCCTGGTTG CCGATGCCAA
 51 ACCGTCCGTC CTCTTCGACA CCCAAGCCCC CGTCGGCACC GGCTACTGGA
101 TTTACGCCGC CACCGCCCTG CCCGTCTGCC TCGCTTCCTT CGGCTTCCAC
151 GGCAACGTTT CCAGCCTGCT CAAATACTTT AAAGGCGACG cgcCcaaagt
201 GgCGAaATCc atctggGcag gtacattggT TGCCttggta atttacgtcc
251 TCTggcaaac cgccatCcaa agcaaccTGC cgcgcaacga gttcgcCCCc
301 gtgattgccg ccgagaggca actCTCCGTC CTgaatgaaa cccTGtccaa
351 attcgcccaa accggcgata tggataAaat attgtcccta tttccctaca
401 tggcaatcgc cacctccttt ttaggcgTAA Ccttaggcct gtttgacaac
451 atcgccggac atcttcaaat ggaacgacag tatgtccggg cggcaccaaa
501 accgtcgcgc tga
```

This corresponds to the amino acid sequence <SEQ ID 376; ORF 107.ng>:

g107.pep

```
  1 MVLTFIWATG GLVADAKPSV LFDTQAPVGT GYWIYAATAL PVCLASFGFH
 51 GNVSSLLKYF KGDAPKVAKS IWAGTLVALV IYVLWQTAIQ SNLPRNEFAP
101 VIAAERQLSV LNETLSKFAQ TGDMDKILSL FPYMAIATSF LGVTLGLFDN
151 IAGHLQMERQ YVRAAPKPSR *
```

The following partial DNA sequence was identified in *N. meningitidis* <SEQ ID 377>:

m107.seq

```
  1 ATGGTATTGA CCTTTATTTG GGCGGCCGGC GGGCTGATTG CCGATGCCAA
 51 GCCGTCCGTC CTCTTCGATA CCCAAGCCCC CGCCGGCACA AACTACTGGA
101 TTTACGCCGS CACCGCCCTG CCCGTCTGCC TCGCTTCCTT CGGCTTCCAC
151 GGCAACGTCT CCAGCCTGCT CAAATACTTT AAAGGCGACG CGCCCAAAGT
201 GGCTAAATCC ATCTGGACGG GCACACTGAT TGCGCTGGTA ATTTACGTCC
251 TCTGGCAAAC CGCCATCCAA GGCAACCTGC CGCGCAACGA GTTCGCCCCC
301 GTCATCGCCG CCGAAGGGCA AGTCTCCGTC CTCATCGAAA CCCTGTCCAA
351 ATTCGCCCAA ACCGGCAATA TGGACAAAAT ATTGTCCCTG TTTTCCTATA
401 TGGCGATCGC CACCTCGTTT TTAGGCGTAA CGCTCGGACT CTTCGACTAC
451 ATCGCCCATC TTCAAATGGA ACGACAGCAT CTCCGGgCCG CACCAAAACC
501 GCCGCGCTGA
```

This corresponds to the amino acid sequence <SEQ ID 378; ORF 107>:

m107.pep..

```
  1 MVLTFIWAAG GLIADAKPSV LFDTQAPAGT NYWIYAXTAL PVCLASFGFH
 51 GNVSSLLKYF KGDAPKVAKS IWTGTLIALV IYVLWQTAIQ GNLPRNEFAP
101 VIAAEGQVSV LIETLSKFAQ TGNMDKILSL FSYMAIATSF LGVTLGLFDY
151 IAHLQMERQH LRAAPKPPR*
```

Computer analysis of this amino acid sequence gave the following results:

Homology with a predicted ORF from *N. gonorrhoeae*

ORF 107 shows 89.4% identity over a 170 aa overlap with a predicted ORF (ORF 107.ng) from *N. gonorrhoeae*:

m107/g107

```
                   10        20        30        40        50        60
m107.pep  MVLTFIWAAGGLIADAKPSVLFDTQAPAGTNYWIYAXTALPVCLASFGFHGNVSSLLKYF
          ||||||||:|||:||||||||||||||:||:||||| |||||||||||||||||||||||
g107      MVLTFIWATGGLVADAKPSVLFDTQAPVGTGYWIYAATALPVCLASFGFHGNVSSLLKYF
                   10        20        30        40        50        60

                   70        80        90       100       110       120
m107.pep  KGDAPKVAKSIWTGTLIALVIYVLWQTAIQGNLPRNEFAPVIAAEGQVSVLIETLSKFAQ
          ||||||||||||:|||:|||||||||||||:|||||||||||||| |:||| ||||||||
g107      KGDAPKVAKSIWAGTLVALVIYVLWQTAIQSNLPRNEFAPVIAAERQLSVLNETLSKFAQ
                   70        80        90       100       110       120
```

-continued

```
                 130       140       150       160       170
m107.pep  TGNMDKILSLFSYMAIATSFLGVTLGLFDYIA-HLQMERQHLRAAPKPPR
          ||:|||||||| ||||||||||||||||| || |||||||::|||||| |
g107      TGDMDKILSLFPYMAIATSFLGVTLGLFDNIAGHLQMERQYVRAAPKPSR
                 130       140       150       160       170
```

The following partial DNA sequence was identified in *N. meningitidis* <SEQ ID 379>:

a107.seq

```
  1 ATGGTATTAA CCTTTATTTG GGCAACCGGC GGCCTGATTG CCGATGCCAA
 51 ACTGCCCGTC CTCTTCGACA CCCAAGCCCC TACCGGCACC AACTACTGGA
101 TTTATGTCGC CACCGCCCTG CCCGTCTGCC TTGCGTCATT CGGTTTCCAC
151 GGCAACGTCT CCAGCCTGCT CAAATACTTT AAAGGCGACG CGCCCAAAGT
201 GGCTAAATCC ATCTGGACGG GCACACTGAT TGCGCTGGTA ATTTACGTCC
251 TCTGGCAAAC CGCCATCCAA GGCAACCTGC CGCGCAACGA GTTCGCCCCC
301 GTGATTGCCG CCGAAGGGCA AGTCTCCGTC CTGATTGAAA CCCTGTCCAA
351 ATTCGCCCAA ACCGGCAATA TGGACAAAAT ATTGTCCCTG TTTTCCTATA
401 TGGCGATCGC CACCTCGTTT TTAGGCGTAA CGCTCGGACT CTTCGACTAC
451 ATCGCCGACA TCTTCAAATG GAACGACAGC GTGTCCGGCC GCACCAAAAC
501 CGCCGCGCTG ACCTTCCTGC CGCCTCTAAT TTCCTGCCTG CTCTTCCCCA
551 CCGGCTTTGT TACCGCCATC GGCTACGTCG GCCTGGCGGC AACCGTCTGG
601 ACAGGCATCA TCCCCGCCAT GCTGCTCTAC CGTTCGCGCA AAAAATTCGG
651 CGCAGGCAAA ACCTATAAAG TTTACGGCGG CTTGTGGCTG ATGGTTTGGG
701 TCTTCCTTTT CGGCATCGTC AACATCGCCG CACAGGTATT GAGCCAAATG
751 GAACTCGTCC CCGTATTTAA AGGATAA
```

This corresponds to the amino acid sequence <SEQ ID 380; ORF 107.a>:

a107.pep

```
  1 MVLTFIWATG GLIADAKLPV LFDTQAPTGT NYWIYVATAL PVCLASFGFH
 51 GNVSSLLKYF KGDAPKVAKS IWTGTLIALV IYVLWQTAIQ GNLPRNEFAP
101 VIAAEGQVSV LIETLSKFAQ TGNMDKILSL FSYMAIATSF LGVTLGLFDY
151 IADIFKWNDS VSGRTKTAAL TFLPPLISCL LFPTGFVTAI GYVGLAATVW
201 TGIIPAMLLY RSRKKFGAGK TYKVYGGLWL MVWVFLFGIV NIAAQVLSQM
251 ELVPVFKG*
```

m107/a107 94.8% identity in 154 aa overlap

```
                  10        20        30        40        50        60
m107.pep  MVLTFIWAAGGLIADAKPSVLFDTQAPAGTNYWIYAXTALPVCLASFGFHGNVSSLLKYF
          ||||||||:||||||||  ||||||||:|||||||: |||||||||||||||||||||||
a107      MVLTFIWATGGLIADAKLPVLFDTQAPTGTNYWIYVATALPVCLASFGFHGNVSSLLKYF
                  10        20        30        40        50        60
```

-continued

```
                   70        80        90       100       110       120
m107.pep  KGDAPKVAKSIWTGTLIALVIYVLWQTAIQGNLPRNEFAPVIAAEGQVSVLIETLSKFAQ
          ||||||||||||||||||||||||||||||||||||||||||||||||||||||||||||
a107      KGDAPKVAKSIWTGTLIALVIYVLWQTAIQGNLPRNEFAPVIAAEGQVSVLIETLSKFAQ
                   70        80        90       100       110       120

                  130       140       150       160       170
m107.pep  TGNMDKILSLFSYMAIATSFLGVTLGLFDYIAHLQMERQHLRAAPKPPRX
          ||||||||||||||||||||||||||||||||| :
a107      TGNMDKILSLFSYMAIATSFLGVTLGLFDYIADIFKWNDSVSGRTKTAALTFLPPLISCL
                  130       140       150       160       170       180

a107      LFPTGFVTAIGYVGLAATVWTGIIPAMLLYRSRKKFGAGKTYKVYGGLWLMVWVFLFGIV
                  190       200       210       220       230       240
```

The following partial DNA sequence was identified in *N. gonorrhoeae* <SEQ ID 381>:

```
g108.seq

  1 ATGttgccgg gCTTCAACCG GATATTCAaa cggTTTGCTC CAACACTCGG
 51 AACggCGCAT AAAACGCCgc ccTTCGCGTT ATCCCGAACG GGGCGGCTAA
101 TCAGATCCTA TCGCCATAAA AGGCGGGGTT TCAACCGAAA AGGAATTGAG
151 ATGAATAAAA CCTTGTCTAT TTTGCCGGCG GCAATCTTAC TCGGCGGGTG
201 CGCCGCCGGC GGCAACACAT TCGGCAGCTT AGACGGCGGC ACGGGTATGG
251 GTGGCAGCAT CGTCAAAATG ACGGTAGAAA gccAATGCCG TGCGGAATTG
301 GACAGGCGCA GCGAATGGCG TTTGACCGCG CTGGCGATGA GTGCCGAAAA
351 ACAGGCGGAA TGGGAAAACA AGATTTGCGG CTGCGCTACC GAAGAAGCAC
401 CTAACCAGCT GACCGGCAAC GATGTGATGC AGATGCTGAa ccagtccacG
451 CGCaatcagg cacTtgccgc CCtgaccgTC AAAacggtTT CcgcctgcTT
501 CAaacgcctg tACCGCTAa
```

This corresponds to the amino acid sequence <SEQ ID 382; ORF 108.ng>:

```
g108.pep

  1 MLPGFNRIFK RFAPTLGTAH KTPPFALSRT GRLIRSYRHK RRGFNRKGIE
 51 MNKTLSILPA AILLGGCAAG GNTFGSLDGG TGMGGSIVKM TVESQCRAEL
101 DRRSEWRLTA LAMSAEKQAE WENKICGCAT EEAPNQLTGN DVMQMLNQST
151 RNQALAALTV KTVSACFKRL YR*
```

The following partial DNA sequence was identified in *N. meningitidis* <SEQ ID 383>:

```
m108.seq

  1 ATGTTGCCGG GCTTCAACCG GATATTCAAA CGGTTTGTTC CAACACTCGG
 51 AACGGCGCAT AAAACGCCGC CCTTCGCGTT ATCCCGAACG GGGCGGCTAA
101 TCAGATTCTA TCGCCATAAA AGGCGGGGTT TCAACCGAAA AGGAATTGAG
151 ATGAATAAAA CCTTGTCTAT TTTGCCGGTG GCAATCTTAC TCGGCGGCTG
201 CGCCGCCGGA GGCGGTAACA CATTCGGCAG CTTAGACGGT GGCACAGGCA
```

-continued

```
251 TGGGCGGCAG CATCGTCAAA ATGGCGGTTG GGAGCCAATG CCGTGCGGAA

301 TTGGACAAAC GCAGCGAATG GCGTTTGACC GCGCTGGCGA TGAGTGCCGA

351 AAAACAGGCG GAGTGGGAAA ACAAGATTTG CGCTTGCGTC GCCCAAGAAG

401 CACCCGAACG GATGACCGGC AACGATGTGA TGCAGATGCT GGCTCCGTCC

451 ACGCGCAATC AGGCACTTGC CGCCCTGACC GCCAAAACGG TTTCCGCCTG

501 CTTCAAACAC CTGTACCGCT AA
```

This corresponds to the amino acid sequence <SEQ ID 384; ORF 108>:

m108.pep

```
  1 MLPGFNRIFK RFVPTLGTAH KTPPFALSRT GRLIRFYRHK RRGFNRKGIE

 51 MNKTLSILPV AILLGGCAAG GGNTFGSLDG GTGMGGSIVK MAVGSQCRAE

101 LDKRSEWRLT ALAMSAEKQA EWENKICACV AQEAPERMTG NDVMQMLAPS

151 TRNQALAALT AKTVSACFKH LYR*
```

Computer analysis of this amino acid sequence gave the following results:

Homology with a predicted ORF from *N. gonorrhoeae*

ORF 108 shows 89.6% identity over a 173 aa overlap with a predicted ORF (ORF 108.ng) from *N. gonorrhoeae*:

```
                    10        20        30        40        50        60
m108.pep    MLPGFNRIFKRFVPTLGTAHKTPPFALSRTGRLIRFYRHKRRGFNRKGIEMNKTLSILPV
            ||||||||||||:|||||||||||||||||||||| |||||||||||||||||||||||:
g108        MLPGFNRIFKRFAPTLGTAHKTPPFALSRTGRLIRSYRHKRRGFNRKGIEMNKTLSILPA
                    10        20        30        40        50        60

                    70        80        90       100       110       120
m108.pep    AILLGGCAAGGGNTFGSLDGGTGMGGSIVKMAVGSQCRAELDKRSEWRLTALAMSAEKQA
            ||||||||||| |||||||||||||||||||:| ||||||||:|||||||||||||||||
g108        AILLGGCAAGG-NTFGSLDGGTGMGGSIVKMTVESQCRAELDRRSEWRLTALAMSAEKQA
                    70         80        90       100       110

                   130       140       150       160       170
m108.pep    EWENKICACVAQEAPERMTGNDVMQMLAPSTRNQALAALTAKTVSACFKHLYRX
            |||||||:|:::|||:::|||||||||  ||||||||||:|||||||||:||||
g108        EWENKICGCATEEAPNQLTGNDVMQMLNQSTRNQALAALTVKTVSACFKRLYRX
          120       130       140       150       160       170
```

The following partial DNA sequence was identified in *N. meningitidis* <SEQ ID 385>:

a108.seq

```
  1 ATGTTGCCGG GCTTCAACCG GATATTCAAA CGGTTTGTTC CAACACTCGG

 51 AACGGCGCAT AAAACGCCGC CCTTCGCGTT ATCCCGAACG GGGCGGCTAA

101 TCAGATTCTA TCGCCATAAA AGGCGGGGTT TCAACCGAAA AGGAATTGAG

151 ATGAATAAAA CCTTGTCTAT TTTGCCGGTG GCAATCTTAC TCGGCGGCTG

201 CGCCGCCGGG GGCGGTAACA CATTCGGCAG CTTAGACGGC GGCACAGGTA

251 TGGGCGGCAG CATCGTCAAA ATGGCGGTAG AAAGCCAATG CCGTGCGGAA

301 TTGAACAAAC GCAGCGAATG GCGTTTGACC GCGCTGGCGA TGAGTGCCGA

351 AAAACAGGCG GAATGGGAAA ACAAGATTTG CGCTTGCGTC GCCCAAGAAG
```

-continued

```
401 CACCCAACCA GCTGACCGGC AACGATGTGA TGCAGATGCT GGATCCGTCC

451 ACGCGCAATC AGGCACTTGC CGCCCTGACC GCCAAAACGG TTTCCGCCTG

501 CTTCAAACAC CTGTACCGCT AA
```

This corresponds to the amino acid sequence <SEQ ID 386; ORF 108.a>:

a108.pep

```
  1 MLPGFNRIFK RFVPTLGTAH KTPPFALSRT GRLIRFYRHK RRGFNRKGIE

 51 MNKTLSILPV AILLGGCAAG GGNTFGSLDG GTGMGGSIVK MAVESQCRAE

101 LNKRSEWRLT ALAMSAEKQA EWENKICACV AQEAPNQLTG NDVMQMLDPS

151 TRNQALAALT AKTVSACFKH LYR*
```

m108/a108 96.5% identity in 173 aa overlap

```
                  10        20        30        40        50        60
m108.pep  MLPGFNRIFKRFVPTLGTAHKTPPFALSRTGRLIRFYRHKRRGFNRKGIEMNKTLSILPV
          ||||||||||||||||||||||||||||||||||||||||||||||||||||||||||||
a108      MLPGFNRIFKRFVPTLGTAHKTPPFALSRTGRLIRFYRHKRRGFNRKGIEMNKTLSILPV
                  10        20        30        40        50        60

                  70        80        90       100       110       120
m108.pep  AILLGGCAAGGGNTFGSLDGGTGMGGSIVKMAVGSQCRAELDKRSEWRLTALAMSAEKQA
          |||||||||||||||||||||||||||||||| ||||||:|||||||||||||||||||||
a108      AILLGGCAAGGGNTFGSLDGGTGMGGSIVKMAVESQCRAELNKRSEWRLTALAMSAEKQA
                  70        80        90       100       110       120

                 130       140       150       160       170
m108.pep  EWENKICACVAQEAPERMTGNDVMQMLAPSTRNQALAALTAKTVSACFKHLYRX
          |||||||||||||||:::||||||||| |||||||||||||||||||||||||
a108      EWENKICACVAQEAPNQLTGNDVMQMLDPSTRNQALAALTAKTVSACFKHLYRX
                 130       140       150       160       170
```

The following partial DNA sequence was identified in *N. gonorrhoeae* <SEQ ID 387>:

g109.seq

```
  1 ATGTATTATC GCCGGGTTGT GGGGCTATCC GATGGACTTG GCGATTTGGC

 51 AGCCGGTATT GATCGTAGGC GTATGCTTAC CGCTTTTGGA AGCGGGCATG

101 GAAATGACGC GCAAAGGCAA AACCACCCAA TCCGCCGCCA TCGTGGTGTT

151 CTCTTCCGTC TGGTCAATCC GGTTTTCGGC TGGGCGTTGA CGATGCTGTT

201 GGATAATTTG GGCTTAATCG GCTGCAAAGA ACGCAGCGCG CAATTAGGTT

251 TTGTCGGACG AGTATTGATA CCCGCAGTAG GTTTCTTAAT CTTGTGTGTG

301 GCGATGGGTG CGGTCGGGAT GCTGCCCGGT ATCCCTCCGT TTTTGGAGCA

351 GTTCAAATCT TTGGGCTAG
```

This corresponds to the amino acid sequence <SEQ ID 388; ORF 109.ng>:

g109.pep

```
  1 MYYRRVVGLS DGLGDLAAGI DRRRMLTAFG SGHGNDAQRQ NHPIRRHRGV

 51 LFRLVNPVFG WALTMLLDNL GLIGCKERSA QLGFVGRVLI PAVGFLILCV

101 AMGAVGMLPG IPPFLEQFKS LG
```

The following partial DNA sequence was identified in *N. meningitidis* <SEQ ID 389>:

m109.seq

```
  1 ATGTATTATC GCCGGGTTAT GGGGCTATCC GATGGACTTG GCGATTTGGC
 51 AGCCGGTATT GAGCGTAGCC TTGGTCGTAG GCGTATACTT ACCGCTTTTG
101 GAAGCGGGCA TGGAAATGAC GCGCAAAGGC AAAACCACCC AATCCGCCGC
151 CATCGTGGTG TTCTCTTCCG CCTTGTCAAT CCGGTTTTCG GCTGGGCGTT
201 GACGATGCTG TTGGATAATT TGGGCTTAAT CGGCTGCAAA GAGCGCAGTG
251 CGCAATTAGG TTTCGCCGGA CGCGTGTTGA TACCCGCAGT AGGTTTCTTG
301 ATCTTGTGTG TGGCGATGGG TGCGGTCGGG ATGCTGCCCG GTATCCCGCC
351 GTTTTTGGAA CACTTCAAAT CTTTGGGCTA G
```

This corresponds to the amino acid sequence <SEQ ID 4; ORF 109>:

m109.pep

```
  1 MYYRRVMGLS DGLGDLAAGI ERSLGRRRIL TAFGSGHGND AQRQNHPIRR
 51 HRGVLFRLVN PVFGWALTML LDNLGLIGCK ERSAQLGFAG RVLIPAVGFL
101 ILCVAMGAVG MLPGIPPFLE HFKSLG*
```

Computer analysis of this amino acid sequence gave the following results:

Homology with a predicted ORF from *N. gonorrhoeae*

ORF 109 shows 92.9% identity over a 126 aa overlap with a predicted ORF (ORF 109.ng) from *N. gonorrhoeae*:

m109/g109

```
                   10        20        30        40        50        60
m109.pep   MYYRRVMGLSDGLGDLAAGIERSLGRRRILTAFGSGHGNDAQRQNHPIRRHRGVLFRLVN
           ||||||:|||||||||||||:|    ||:|||||||||||||||||||||||||||||||
g109       MYYRRVVGLSDGLGDLAAGIDR----RRMLTAFGSGHGNDAQRQNHPIRRHRGVLFRLVN
                   10        20            30        40        50

                   70        80        90       100       110       120
m109.pep   PVFGWALTMLLDNLGLIGCKERSAQLGFAGRVLIPAVGFLILCVAMGAVGMLPGIPPFLE
           ||||||||||||||||||||||||||||:|||||||||||||||||||||||||||||||
g109       PVFGWALTMLLDNLGLIGCKERSAQLGFVGRVLIPAVGFLILCVAMGAVGMLPGIPPFLE
             60        70        80        90       100       110

m109.pep   HFKSLGX
           :|||||
g109       QFKSLGX
            120
```

The following partial DNA sequence was identified in *N. meningitidis* <SEQ ID 391>:

a109.seq

```
  1 ATGTATTATC GCCGGGTTGT GGGGCTATCC GATGGACTTG GCGATTTGGC
 51 AGCCGGTATT GAGCGTAGCC TTGGTCGTAG GCGTATACTT ACCGCTTTTG
101 GAAGCGGGCA TGGAAATGAC GCGCAAAGGC AAAACCACCC AATCCGCCGC
```

-continued

```
151 CACCGTGGTG TTCTCTTCCG CTTGGTCAAT CCGGTTTTCG GCTGGGCGTT

201 GACGATGCTG TTGGATAATT TGGGCTTAAT CGGCTGCAAA GAGCGCAGCG

251 CGCAATTAGG TTTCACCGGA CGCGTATTGA TACCCGTAGT AGGTTTCTTG

301 ATCTTGTGTG TGGCGATGGG TGCGGTCGGG ATGCTGCCCG GTATCCCGCC

351 GTTTTTGGAG CACTTCAAAT CTTTGGGCTA G
```

This corresponds to the amino acid sequence <SEQ ID 392; ORF 109>:

a109.pep

```
  1 MYYRRVVGLS DGLGDLAAGI ERSLGRRRIL TAFGSGHGND AQRQNHPIRR

 51 HRGVLFRLVN PVFGWALTML LDNLGLIGCK ERSAQLGFTG RVLIPVVGFL

101 ILCVAMGAVG MLPGIPPFLE HFKSLG*
```

m109/a109 97.6% identity in 126 aa overlap

```
                  10        20        30        40        50        60
m109.pep   MYYRRVMGLSDGLGDLAAGIERSLGRRRILTAFGSGHGNDAQRQNHPIRRHRGVLFRLVN
           ||||||:|||||||||||||||||||||||||||||||||||||||||||||||||||||
a109       MYYRRVVGLSDGLGDLAAGIERSLGRRRILTAFGSGHGNDAQRQNHPIRRHRGVLFRLVN
                  10        20        30        40        50        60

                  70        80        90       100       110       120
m109.pep   PVFGWALTMLLDNLGLIGCKERSAQLGFAGRVLIPAVGFLILCVAMGAVGMLPGIPPFLE
           ||||||||||||||||||||||||||||:||||||:||||||||||||||||||||||||
a109       PVFGWALTMLLDNLGLIGCKERSAQLGFTGRVLIPVVGFLILCVAMGAVGMLPGIPPFLE
                  70        80        90       100       110       120

m109.pep   HFKSLGX
           |||||||
a109       HFKSLGX
```

The following partial DNA sequence was identified in *N. gonorrhoeae* <SEQ ID 393>:

g111.seq

```
  1 ATGCCGTCTG AAACACGCCT GCCGAACCTT ATCCGCGCCT TGATATTTGC

 51 CCTGGGTTTC ATCTTCCTGA ACGCCTGTTC GGaacaaacC GCGCAaaccg

101 TTACCCTGCA AGGCGAAACG ATGGGTACGA CCtATACCGT CAAATACCTT

151 TCAAATAATC GGGACAAACT CCCCTCCCCT GCCAAAATAC AAAAGCGCAT

201 TGATGATGCG CTTAAAGAAG TCAACCGGCA GATGtccaCC TACCAGACCG

251 ATTCCGAAAT CAGCCGGTTt atacagacan atgctggaga gctcttcgcg

301 tntcatgcag nttctataac tgattccgcc gaagactgtc tgcctaatac

351 gcctatctca tcggcgctct ga
```

This corresponds to the amino acid sequence <SEQ ID 394; ORF 111.ng>:

g111.pep

```
  1 MPSETRLPNL IRALIFALGF IFLNACSEQT AQTVTLQGET MGTTYTVKYL
 51 SNNRDKLPSP AKIQKRIDDA LKEVNRQMST YQTDSEISRF IQTAGELFAH
101 ASITDSAEDC LPNTPISSAL *
```

The following partial DNA sequence was identified in *N. meningitidis* <SEQ ID 395>:

m111.seq

```
   1 ATGCCGTCTG AAACACGCCT GCCGAACTTT ATCCGCGTCT TGATATTTGC
  51 CCTGGGTTTC ATCTTCCTGA ACGCCTGTTC GGAACAAACC GCGCAAACCG
 101 TTACCCTGCA AGGCGAAACG ATGGGCACGA CCTATAyCGT CAAATACCTT
 151 TCAAATAATC GGGACAAACT CCCCTCACCT GCCGAAATAC AwAAACGCAT
 201 CGATGACGCG CTTAAAGAAk TCAACCGGyA GATGTCCACC TATCAGCCCG
 251 ACTCCGAAAT CAGCCGGTTC AACCAACACA CAGCCGGCAA GCCCCTCCGC
 301 ATTTCAAGCG ACTTCGCACA CGTTACTGCC GAAGCCGTCC GCCTGAACCG
 351 CCTGACACAC GGCGCGCTGG ACGTAACCGT CGGCCCCTTG GTCAACCTTT
 401 GGGGATTCGG CCCCGACAAA TCCGTTACCC GTGAACCGTC GCCGGAACAA
 451 ATCAAACAGG CGGCATCTTA TACGGGCATA GACAAAATCA TTTTGAAACA
 501 AGGCAAAGAT TACGCTTCCT TGAGCAAAAC CCACCCCAAG GCCTATTTGG
 551 ATTTATCTTC GATTGCCAAA GGCTTCGGCG TTGATAAAGT TGCGGGCGAA
 601 CTGGAAAAAT ACGGCATTCA AAATTATCTG GTCGAAATCG GCGGCGAGTT
 651 GCACGGCAAA GGCAAAAACG CGCGCGGCGA ACCGTGGCGC ATCGGTATCG
 701 AGCAGCCCAA TATCGTCCAA GGCGGCAATA CGCAGATTAT CGTCCCGCTG
 751 AACAACCGTT CGCTTGCCAC TTCCGGCGAT TACCGTATTT TCCACGTCGA
 801 TAAAAACGGC AAACGCCTCT CCCATATCAT CAACCCGAAC AACAAACGAC
 851 CCATCAGCCA CAACCTCGCC TCCATCAGCG TGGTCGCAGA CAGTGCGATG
 901 ACGGCGGACG GCTTGTCCAC AGGATTATTC GTATTGGGCG AAACCGAAGC
 951 CTTAAAGCTG GCAGAGCGCG AAAAACTCGC TGTTTTCCTG ATTGTCAGGG
1001 ATAAAGGCGG cTACCGCACC GCCATGTCTT CCGAATTTGA AAAACTGcTC
1051 CGCTAA
```

This corresponds to the amino acid sequence <SEQ ID 396; ORF 111>:

m111.pep

```
  1 MPSETRLPNF IRVLIFALGF IFLNACSEQT AQTVTLQGET MGTTYXVKYL
 51 SNNRDKLPSP AEIXKRIDDA LKEXNRXMST YQPDSEISRF NQHTAGKPLR
101 ISSDFAHVTA EAVRLNRLTH GALDVTVGPL VNLWGFGPDK SVTREPSPEQ
151 IKQAASYTGI DKIILKQGKD YASLSKTHPK AYLDLSSIAK GFGVDKVAGE
201 LEKYGIQNYL VEIGGELHGK GKNARGEPWR IGIEQPNIVQ GGNTQIIVPL
251 NNRSLATSGD YRIFHVDKNG KRLSHIINPN NKRPISHNLA SISVVADSAM
```

-continued

301 TADGLSTGLF VLGETEALKL AEREKLAVFL IVRDKGGYRT AMSSEFEKLL

351 R*

ORF 111 shows 88.7% identity over a 97 aa overlap with a predicted ORF (ORF 111.ng) from *N. gonorrhoeae*:

m111.pep/g111.pep

```
                  10        20        30        40        50        60
m111.pep  MPSETRLPNFIRVLIFALGFIFLNACSEQTAQTVTLQGETMGTTYXVKYLSNNRDKLPSP
          |||||||||:||:||||||||||||||||||||||||||||||||:||||||||||||||
g111      MPSETRLPNLIRALIFALGFIFLNACSEQTAQTVTLQGETMGTTYTVKYLSNNRDKLPSP
                  10        20        30        40        50        60

                  70        80        90       100       110       120
m111.pep  AEIXKRIDDALKEXNRXMSTYQPDSEISRFNQHTAGKPLRISSDFAHVTAEAVRLNRLTH
          |:| ||||||||| || ||||| ||||||| | :||:
g111      AKIQKRIDDALKEVNRQMSTYQTDSEISRFIQTXAGELFAXHAXSITDSAEDCLPNTPIS
                  70        80        90       100       110       120

                 130       140       150       160       170       180
m111.pep  GALDVTVGPLVNLWGFGPDKSVTREPSPEQIKQAASYTGIDKIILKQGKDYASLSKTHPK

g111      SALX
```

The following partial DNA sequence was identified in *N. meningitidis* <SEQ ID 397>:

a111.seq

1 ATGCCGTCTG AAACACGCCT GCCGAACTTT ATCCGCACCT TGATATTTGC

51 CCTGAGTTTT ATCTTCCTGA ACGCCTGTTC GGAACAAACC GCGCAAACCG

101 TTACCCTGCA AGGTGAAACG ATGGGCACGA CCTATACCGT CAAATACCTT

151 TCAAATAATC GGGACAAACT CCCCTCACCT GCCGAAATAC AAAAGCGCAT

201 CGATGACGCG CTTAAAGAAG TCAACCGGCA GATGTCCACC TATCAGCCCG

251 ACTCCGAAAT CAGCCGGTTC AACCAACACA CAGCCGGCAA GCCCCTCCGC

301 ATTTCAAGCG ACTTCGCACA CGTTACTGCC GAAGCCGTCC ACCTGAACCG

351 CCTGACACAC GGCGCGCTGG ACGTAACCGT CGGCCCCTTG GTCAACCTTT

401 GGGGATTCGG CCCCGACAAA TCCGTTACCC GTGAACCGTC GCCGGAACAA

451 ATCAAACAAG CAGCATCTTA TACGGGCATA GACAAAATCA TTTTGAAACA

501 AGGCAAAGAT TACGCTTCCT TGAGCAAAAC CCACCCCAAG GCCTATTTGG

551 ATTTATCTTC GATTGCCAAA GGCTTCGGCG TTGATAAAGT TGCGGGCGAA

601 CTGGAAAAAT ACGGCATTCA AAATTATCTG GTCGAAATCG GCGGCGAGTT

651 GCACGGCAAA GGCAAAAACG CGCGCGGCGA ACCTTGGCGC ATCGGCATCG

701 AACAGCCCAA CATCGTCCAA GGCGGCAATA CGCAGATTAT CGTCCCGCTG

751 AACAACCGTT CGCTTGCCAC TTCCGGCGAT TACCGTATTT TCCACGTCGA

801 TAAAAGCGGC AAACGCCTCT CCCATATCAT TAATCCGAAC AACAAACGAC

851 CCATCAGCCA CAACCTCGCC TCCATCAGCG TGGTCGCAGA CAGTGCGATG

901 ACGGCGGACG GCTTGTCCAC AGGATTATTC GTATTGGGCG AAACCGAAGC

951 CTTAAAGCTG GCAGAGCGCG AAAAACTCGC TGTTTTCCTG ATTGTCAGGG

1001 ATAAAGGCGG CTACCGCACC GCCATGTCTT CCGAATTTGA AAAACTGCTC

1051 CGCTAA

This corresponds to the amino acid sequence <SEQ ID 398; ORF 111.a>:

a111.pep

```
  1 MPSETRLPNF IRTLIFALSF IFLNACSEQT AQTVTLQGET MGTTYTVKYL
 51 SNNRDKLPSP AEIQKRIDDA LKEVNRQMST YQPDSEISRF NQHTAGKPLR
101 ISSDFAHVTA EAVHLNRLTH GALDVTVGPL VNLWGFGPDK SVTREPSPEQ
151 IKQAASYTGI DKIILKQGKD YASLSKTHPK AYLDLSSIAK GFGVDKVAGE
201 LEKYGIQNYL VEIGGELHGK GKNARGEPWR IGIEQPNIVQ GGNTQIIVPL
251 NNRSLATSGD YRIFHVDKSG KRLSHIINPN NKRPISHNLA SISVVADSAM
301 TADGLSTGLF VLGETEALKL AEREKLAVFL IVRDKGGYRT AMSSEFEKLL
351 R*
```

m111/a111 97.7% identity in 351 aa overlap

```
                  10        20        30        40        50        60
m111.pep  MPSETRLPNFIRVLIFALGFIFLNACSEQTAQTVTLQGETMGTTYXVKYLSNNRDKLPSP
          ||||||||||||:|||||:||||||||||||||||||||||||||:||||||||||||||
a111      MPSETRLPNFIRTLIFALSFIFLNACSEQTAQTVTLQGETMGTTYTVKYLSNNRDKLPSP
                  10        20        30        40        50        60

                  70        80        90       100       110       120
m111.pep  AEIXKRIDDALKEXNRXMSTYQPDSEISRFNQHTAGKPLRISSDFAHVTAEAVRLNRLTH
          ||| ||||||||| || ||||||||||||||||||||||||||||||||||||:||||||
a111      AEIQKRIDDALKEVNRQMSTYQPDSEISRFNQHTAGKPLRISSDFAHVTAEAVHLNRLTH
                  70        80        90       100       110       120

                 130       140       150       160       170       180
m111.pep  GALDVTVGPLVNLWGFGPDKSVTREPSPEQIKQAASYTGIDKIILKQGKDYASLSKTHPK
          ||||||||||||||||||||||||||||||||||||||||||||||||||||||||||||
a111      GALDVTVGPLVNLWGFGPDKSVTREPSPEQIKQAASYTGIDKIILKQGKDYASLSKTHPK
                 130       140       150       160       170       180

                 190       200       210       220       230       240
m111.pep  AYLDLSSIAKGFGVDKVAGELEKYGIQNYLVEIGGELHGKGKNARGEPWRIGIEQPNIVQ
          ||||||||||||||||||||||||||||||||||||||||||||||||||||||||||||
a111      AYLDLSSIAKGFGVDKVAGELEKYGIQNYLVEIGGELHGKGKNARGEPWRIGIEQPNIVQ
                 190       200       210       220       230       240

                 250       260       270       280       290       300
m111.pep  GGNTQIIVPLNNRSLATSGDYRIFHVDKNGKRLSHIINPNNKRPISHNLASISVVADSAM
          ||||||||||||||||||||||||||||:|||||||||||||||||||||||||||||||
a111      GGNTQIIVPLNNRSLATSGDYRIFHVDKSGKRLSHIINPNNKRPISHNLASISVVADSAM
                 250       260       270       280       290       300

                 310       320       330       340       350
m111.pep  TADGLSTGLFVLGETEALKLAEREKLAVFLIVRDKGGYRTAMSSEFEKLLRX
          ||||||||||||||||||||||||||||||||||||||||||||||||||||
a111      TADGLSTGLFVLGETEALKLAEREKLAVFLIVRDKGGYRTAMSSEFEKLLRX
                 310       320       330       340       350
```

The following partial DNA sequence was identified in *N. gonorrhoeae* <SEQ ID 399>:

g111-1.seq

```
  1 ATGCCGTCTG AAACACGCCT GCCGAACCTT ATCCGCGCCT TGATATTTGC
 51 CCTGGGTTTC ATCTTCCTGA ACGCCTGTTC GGAACAAACC GCGCAAacCG
101 TTACCCTGCA AGGCGAAACG ATGGGTACGA CCTATACCGT CAAATACCTT
151 TCAAATAATC GGGACAAACT CCCCTCCCCT GCCAAAATAC AAAAGCGCAT
201 TGATGATGCG CTTAAAGAAG TCAACCGGCA GATGTCCACC TACCAGACCG
251 ATTCCGAAAT CAGCCGGTTC AACCAACACA CAGCCGGCAA GCCCCTCCGC
301 ATTTCAAGCG ATTTCGCACA CGTTACCGCC GAAGCCGTCC GCCTGAACCG
```

-continued

```
 351 CCTGACTCAC GGCGCACTGG ACGTAACCGT CGGCCCTTTG GTCAACCTTT
 401 GGGGGTTCGG CCCCGACAAA TCCGTTACCC GTGAACCGTC GCCGGAACAA
 451 ATCAAACAGG CGGCATCTTA TACGGGCATA GACAAAATCA TTTTGCAACA
 501 AGGCAAAGAT TACGCTTCCT TGAGCAAAAC CCACCCCAAA GCCTATTTGG
 551 ATTTATCTTC GATTGCCAAA GGCTTCGGCG TTGATAAAGT TGCGGGCGAA
 601 CTGGAAAAAT ACGGCATTCA AAATTATCTG GTCGAAATCG GCggcGAGTT
 651 GCACGGCAAA GGCAAAAATG CGCACGGCGA ACCGTGGCGC ATCGGTATAG
 701 AGCAACCCAA TATcatccaa ggcggcaata cgcAGattat cgtcccgctg
 751 aaCaaccgtt cgcttgccac ttccggcgAT taccgtaTTT tccacgtcgA
 801 TAAAAACGGC Aaacgccttt cccacATCAT CAATCCCAAC AACAAACGAC
 851 CCATCAGcCA CAAcctcgcc tcCATCAgCg TGGTCTCAGA CAGTGCAATG
 901 ACGGCGGACG GTTTATCCAC AGGATTATTT GTTTTAGGCG AAACCGAAGC
 951 CTTAAGGCTG GCAGAACAAG AAAAACTCGC TGTTTTCCTA ATTGTCCGGG
1001 ATAAGGACGG CTACCGCACC GCCATGTCTT CCGAATTTGC CAAGCTGCTC
1051 CGCTAA
```

This corresponds to the amino acid sequence <SEQ ID 400, ORF 111-1.ng>:

g111-1.pep

```
  1 MPSETRLPNL IRALIFALGF IFLNACSEQT AQTVTLQGET MGTTYTVKYL
 51 SNNRDKLPSP AKIQKRIDDA LKEVNRQMST YQTDSEISRF NQHTAGKPLR
101 ISSDFAHVTA EAVRLNRLTH GALDVTVGPL VNLWGFGPDK SVTREPSPEQ
151 IKQAASYTGI DKIILQQGKD YASLSKTHPK AYLDLSSIAK GFGVDKVAGE
201 LEKYGIQNYL VEIGGELHGK GKNAHGEPWR IGIEQPNIIQ GGNTQIIVPL
251 NNRSLATSGD YRIFHVDKNG KRLSHIINPN NKRPISHNLA SISVVSDSAM
301 TADGLSTGLF VLGETEALRL AEQEKLAVFL IVRDKDGYRT AMSSEFAKLL
351 R*
```

The following partial DNA sequence was identified in *N. meningitidis* <SEQ ID 401>:

m111-1.seq

```
  1 ATGCCGTCTG AAACACGCCT GCCGAACTTT ATCCGCGTCT TGATATTTGC
 51 CCTGGGTTTC ATCTTCCTGA ACGCCTGTTC GGAACAAACC GCGCAAACCG
101 TTACCCTGCA AGGCGAAACG ATGGGCACGA CCTATACCGT CAAATACCTT
151 TCAAATAATC GGGACAAACT CCCCTCACCT GCCGAAATAC AAAAACGCAT
201 CGATGACGCG CTTAAAGAAG TCAACCGGCA GATGTCCACC TATCAGCCCG
251 ACTCCGAAAT CAGCCGGTTC AACCAACACA CAGCCGGCAA GCCCCTCCGC
301 ATTTCAAGCG ACTTCGCACA CGTTACTGCC GAAGCCGTCC GCCTGAACCG
351 CCTGACACAC GGCGCGCTGG ACGTAACCGT CGGCCCCTTG GTCAACCTTT
401 GGGGATTCGG CCCCGACAAA TCCGTTACCC GTGAACCGTC GCCGGAACAA
```

-continued

```
 451 ATCAAACAGG CGGCATCTTA TACGGGCATA GACAAAATCA TTTTGAAACA

 501 AGGCAAAGAT TACGCTTCCT TGAGCAAAAC CCACCCCAAG GCCTATTTGG

 551 ATTTATCTTC GATTGCCAAA GGCTTCGGCG TTGATAAAGT TGCGGGCGAA

 601 CTGGAAAAAT ACGGCATTCA AAATTATCTG GTCGAAATCG GCGGCGAGTT

 651 GCACGGCAAA GGCAAAAACG CGCGCGGCGA ACCGTGGCGC ATCGGTATCG

 701 AGCAGCCCAA TATCGTCCAA GGCGGCAATA CGCAGATTAT CGTCCCGCTG

 751 AACAACCGTT CGCTTGCCAC TTCCGGCGAT TACCGTATTT TCCACGTCGA

 801 TAAAAACGGC AAACGCCTCT CCCATATCAT CAACCCGAAC AACAAACGAC

 851 CCATCAGCCA CAACCTCGCC TCCATCAGCG TGGTCGCAGA CAGTGCGATG

 901 ACGGCGGACG GCTTGTCCAC AGGATTATTC GTATTGGGCG AAACCGAAGC

 951 CTTAAAGCTG GCAGAGCGCG AAAAACTCGC TGTTTTCCTG ATTGTCAGGG

1001 ATAAAGGCGG CTACCGCACC GCCATGTCTT CCGAATTTGA AAAACTGCTC

1051 CGCTAA
```

This corresponds to the amino acid sequence <SEQ ID 402; ORF 111-1>:

```
m111-1.pep

  1 MPSETRLPNF IRVLIFALGF IFLNACSEQT AQTVTLQGET MGTTYTVKYL

 51 SNNRDKLPSP AEIQKRIDDA LKEVNRQMST YQPDSEISRF NQHTAGKPLR

101 ISSDFAHVTA EAVRLNRLTH GALDVTVGPL VNLWGFGPDK SVTREPSPEQ

151 IKQAASYTGI DKIILKQGKD YASLSKTHPK AYLDLSSIAK GFGVDKVAGE

201 LEKYGIQNYL VEIGGELHGK GKNARGEPWR IGIEQPNIVQ GGNTQIIVPL

251 NNRSLATSGD YRIFHVDKNG KRLSHIINPN NKRPISHNLA SISVVADSAM

301 TADGLSTGLF VLGETEALKL AEREKLAVFL IVRDKGGYRT AMSSEFEKLL

351 R*
```

m111-1/g111-1 96.6% identity in 351 aa overlap

```
                    10        20        30        40        50        60
m111-1.pep  MPSETRLPNFIRVLIFALGFIFLNACSEQTAQTVTLQGETMGTTYTVKYLSNNRDKLPSP
            |||||||||:||:|||||||||||||||||||||||||||||||||||||||||||||||
g111-1      MPSETRLPNLIRALIFALSFIFLNACSEQTAQTVTLQGETMGTTYTVKYLSNNRDKLPSP
                    10        20        30        40        50        60

                    70        80        90       100       110       120
m111-1.pep  AEIQKRIDDALKEVNRQMSTYQPDSEISRFNQHTAGKPLRISSDFAHVTAEAVRLNRLTH
            |:|||||||||||||||||||| |||||||||||||||||||||||||||||||||||||
g111-1      AKIQKRIDDALKEVNRQMSTYQTDSEISRFNQHTAGKPLRISSDFAHVTAEAVRLNRLTH
                    70        80        90       100       110       120

                   130       140       150       160       170       180
m111-1.pep  GALDVTVGPLVNLWGFGPDKSVTREPSPEQIKQAASYTGIDKIILKQGKDYASLSKTHPK
            |||||||||||||||||||||||||||||||||||||||||||||:||||||||||||||
g111-1      GALDVTVGPLVNLWGFGPDKSVTREPSPEQIKQAASYTGIDKIILQQGKDYASLSKTHPK
                   130       140       150       160       170       180

                   190       200       210       220       230       240
m111-1.pep  AYLDLSSIAKGFGVDKVAGELEKYGIQNYLVEIGGELHGKGKNARGEPWRIGIEQPNIVQ
            |||||||||||||||||||||||||||||||||||||||||||:||||||||||||||:|
g111-1      AYLDLSSIAKGFGVDKVAGELEKYGIQNYLVEIGGELHGKGKNAHGEPWRIGIEQPNIIQ
                   190       200       210       220       230       240
```

-continued

```
                 250        260        270        280        290        300
m111-1.pep  GGNTQIIVPLNNRSLATSGDYRIFHVDKNGKRLSHIINPNNKRPISHNLASISVVADSAM
            ||||||||||||||||||||||||||||||||||||||||||||||||||||||||:||||
g111-1      GGNTQIIVPLNNRSLATSGDYRIFHVDKNGKRLSHIINPNNKRPISHNLASISVVSDSAM
                 250        260        270        280        290        300

                 310        320        330        340        350
m111-1.pep  TADGLSTGLFVLGETEALKLAERELKAVFLIVRDKGGYRTAMSSEFEKLLRX
            |||||||||||||||||:|||:|||||||||||| |||||||||||||||
g111-1      TADGLSTGLFVLGETEALRLAEQEKLAVFLIVRDKDGYRTAMSSEFEKLLRX
                 310        320        330        340        350
```

g111-1/p44550 sp|P44550|YOJL_HAEIN HYPOTHETICAL LIPOPROTEIN HI0172 PRECURSOR >gi|1074292|pir||C64144 hypothetical protein HI0172-*Haemophilus influenzae* (strain Rd KW20) >gi|1573128 (U32702) lipoprotein, putative [*Haemophilus influenzae* Rd] Length=346

Score=349 bits (885), Expect=2e−95

Identities=177/328 (53%), Positives=240/328 (72%), Gaps=4/328 (1%)

```
Query:   23  LNACSEQTAQTVTLQGETMGTTYXVKYLSNNRDKLPSPAEIXKRIDDALKEXNRXMSTYQ   82
             L AC ++T + ++L G+TMGTTY VKYL +      S  +  + I+  LK+ N  MSTY+
Sbjct:   17  LAACQKET-KVISLSGKTMGTTYHVKYLDDGSITATS-EKTHEEIEAILKDVNAKMSTYK   74
Query:   83  PDSEISRFNQHT-AGKPLRISSDFAHVTAEAVRLNRLTHGALDVTVGPLVNLWGFGPDKS  141
              DSE+SRFNQ+T    P+ IS+DFA v AEA+RLN++T GALDVTVGP+VNLWGFGP+K
Sbjct:   75  KDSELSRFNQNTQVNTPIEISADFAKVLAEAIRLNKVTEGALDVTVGPVVNLWGFGPEKR  134
Query:  142  VTREPSPEQIKQAASYTGIDKIILKQGKDYASLSKTHPKAYLDLSSIAKGFGVDKVAGEL  201
               ++P+PEQ+ +   ++ GIDKI L   K+ A+LSK  P+ Y+DLSSIAKGFGVD+VA +L
Sbjct:  135  PEKQPTPEQLAERQAWVGIDKITLDTNKEKATLSKALQVVYVDLSSIAKGFGVDQVAEKL  194
Query:  202  EKYGIQNYLVEIGGELHGKGKNARGEPWRIGIEQPNIVQGGNTQIIVPLNNRSLATSGDY  261
             E+   QNY+VEIGGE+  KGKN  G+PW+I IE+P         + ++ LNN  +A++SGDY
Sbjct:  195  EQLNAQNYMVEIGGEIRAKGKNIEGKPWQIAIEKPTTTGERAVEAVIGLNNMGMASSGDY  254
Query:  262  RIFHVDKNGKRLSHIINPNNKRPISHNLASISVVADSAMTADGLSTGLFVLGETEALKLA  321
             RI+  ++NGKR +H I+P    PI H+LASI+V+A ++MTADGLSTGLFVLGE +AL++A
Sbjct:  255  RIY-FEENGKRFAHEIDPKTGYPIQHHLASITVLAPTSMTADGLSTGLFVLGEDKALEVA  313
Query:  322  EREKLAVFLIVRDKGGYRTAMSSEFEKL                                349
             E+  LAV+LI+R   G+ T  SS F+KL
Sbjct:  314  EKNNLAVYLIIRTDNGFVTKSSSAFKKL                                341
```

The following partial DNA sequence was identified in *N. meningitidis* <SEQ ID 403>:

a111-1.seq

```
  1 ATGCCGTCTG AAACACGCCT GCCGAACTTT ATCCGCACCT TGATATTTGC
 51 CCTGAGTTTT ATCTTCCTGA ACGCCTGTTC GGAACAAACC GCGCAAACCG
101 TTACCCTGCA AGGTGAAACG ATGGGCACGA CCTATACCGT CAAATACCTT
151 TCAAATAATC GGGACAAACT CCCCTCACCT GCCGAAATAC AAAAGCGCAT
201 CGATGACGCG CTTAAAGAAG TCAACCGGCA GATGTCCACC TATCAGCCCG
251 ACTCCGAAAT CAGCCGGTTC AACCAACACA CAGCCGGCAA GCCCCTCCGC
301 ATTTCAAGCG ACTTCGCACA CGTTACTGCC GAAGCCGTCC ACCTGAACCG
351 CCTGACACAC GGCGCGCTGG ACGTAACCGT CGGCCCCTTG GTCAACCTTT
401 GGGGATTCGG CCCCGACAAA TCCGTTACCC GTGAACCGTC GCCGGAACAA
451 ATCAAACAAG CAGCATCTTA TACGGGCATA GACAAAATCA TTTTGAAACA
501 AGGCAAAGAT TACGCTTCCT TGAGCAAAAC CCACCCCAAG GCCTATTTGG
551 ATTTATCTTC GATTGCCAAA GGCTTCGGCG TTGATAAAGT TGCGGGCGAA
601 CTGGAAAAAT ACGGCATTCA AAATTATCTG GTCGAAATCG GCGGCGAGTT
651 GCACGGCAAA GGCAAAAACG CGCGCGGCGA ACCTTGGCGC ATCGGCATCG
```

-continued

```
 701 AACAGCCCAA CATCGTCCAA GGCGGCAATA CGCAGATTAT CGTCCCGCTG

 751 AACAACCGTT CGCTTGCCAC TTCCGGCGAT TACCGTATTT TCCACGTCGA

 801 TAAAAGCGGC AAACGCCTCT CCCATATCAT TAATCCGAAC AACAAACGAC

 851 CCATCAGCCA CAACCTCGCC TCCATCAGCG TGGTCGCAGA CAGTGCGATG

 901 ACGGCGGACG GCTTGTCCAC AGGATTATTC GTATTGGGCG AAACCGAAGC

 951 CTTAAAGCTG GCAGAGCGCG AAAAACTCGC TGTTTTCCTG ATTGTCAGGG

1001 ATAAAGGCGG CTACCGCACC GCCATGTCTT CCGAATTTGA AAAACTGCTC

1051 CGCTAA
```

This corresponds to the amino acid sequence <SEQ ID 404; ORF 111-1.a>:

a111-1.pep

```
  1 MPSETRLPNF IRTLIFALSF IFLNACSEQT AQTVTLQGET MGTTYTVKYL

 51 SNNRDKLPSP AEIQKRIDDA LKEVNRQMST YQPDSEISRF NQHTAGKPLR

101 ISSDFAHVTA EAVHLNRLTH GALDVTVGPL VNLWGFGPDK SVTREPSPEQ

151 IKQAASYTGI DKIILKQGKD YASLSKTHPK AYLDLSSIAK GFGVDKVAGE

201 LEKYGIQNYL VEIGGELHGK GKNARGEPWR IGIEQPNIVQ GGNTQIIVPL

251 NNRSLATSGD YRIFHVDKSG KRLSHIINPN NKRPISHNLA SISVVADSAM

301 TADGLSTGLF VLGETEALKL AEREKLAVFL IVRDKGGYRT AMSSEFEKLL

351 R*
```

a111-1/m111-1 98.9% identity in 351 aa overlap

```
                    10        20        30        40        50        60
a111-1.pep  MPSETRLPNFIRTLIFALSFIFLNACSEQTAQTVTLQGETMGTTYTVKYLSNNRDKLPSP
            ||||||||||||:|||||:|||||||||||||||||||||||||||||||||||||||||
m111-1      MPSETRLPNFIRVLIFALGFIFLNACSEQTAQTVTLQGETMGTTYTVKYLSNNRDKLPSP
                    10        20        30        40        50        60

                    70        80        90       100       110       120
a111-1.pep  AEIQKRIDDALKEVNRQMSTYQPDSEISRFNQHTAGKPLRISSDFAHVTAEAVHLNRLTH
            |||||||||||||||||||||||||||||||||||||||||||||||||||||:||||||
m111-1      AEIQKRIDDALKEVNRQMSTYQPDSEISRFNQHTAGKPLRISSDFAHVTAEAVRLNRLTH
                    70        80        90       100       110       120

                   130       140       150       160       170       180
a111-1.pep  GALDVTVGPLVNLWGFGPDKSVTREPSPEQIKQAASYTGIDKIILKQGKDYASLSKTHPK
            ||||||||||||||||||||||||||||||||||||||||||||||||||||||||||||
m111-1      GALDVTVGPLVNLWGFGPDKSVTREPSPEQIKQAASYTGIDKIILKQGKDYASLSKTHPK
                   130       140       150       160       170       180

                   190       200       210       220       230       240
a111-1.pep  AYLDLSSIAKGFGVDKVAGELEKYGIQNYLVEIGGELHGKGKNARGEPWRIGIEQPNIVQ
            ||||||||||||||||||||||||||||||||||||||||||||||||||||||||||||
m111-1      AYLDLSSIAKGFGVDKVAGELEKYGIQNYLVEIGGELHGKGKNARGEPWRIGIEQPNIVQ
                   190       200       210       220       230       240

                   250       260       270       280       290       300
a111-1.pep  GGNTQIIVPLNNRSLATSGDYRIFHVDKSGKRLSHIINPNNKRPISHNLASISVVADSAM
            |||||||||||||||||||||||||||:||||||||||||||||||||||||||||||||
m111-1      GGNTQIIVPLNNRSLATSGDYRIFHVDKNGKRLSHIINPNNKRPISHNLASISVVADSAM
                   250       260       270       280       290       300

                   310       320       330       340       350
a111-1.pep  TADGLSTGLFVLGETEALKLAEREKLAVFLIVRDKGGYRTAMSSEFEKLLRX
            |||||||||||||||||||||||||||||||||||||||||||||||||||
m111-1      TADGLSTGLFVLGETEALKLAEREKLAVFLIVRDKGGYRTAMSSEFEKLLRX
                   310       320       330       340       350
```

The following partial DNA sequence was identified in *N. gonorrhoeae* <SEQ ID 405>:

g114.seq

```
  1 ATGGCTTCCA TCACTTCGCC GCTGCACGGG GCGCAGCAGG AATGCAGCAA
 51 GACTTTTTTA TGTCCGCCGG GCGGGACGAG TATGGGGCGG TCAATGTCGG
101 TAACGGTAGG TTTGTTTTGT GTTTCCATTA ACTTAACAAT ATCTGTCGAA
151 TACGGTCAAA GCGGCTATTT TACCAGAGCC GCCGAATGTA AAACAGGGTG
201 TCAGGGCATC AGCCCGAGCT GCCTGAACGA ACGGACGGTT TGCGAGGTAA
251 CGATAAAATG GTCGAGCAGC GAAACATCAA CCAGCGACAT GGCCTGTGCC
301 AGCCGCCTTG TGAACATGAT GTCTTCCTGC GAAGGTTCAG GCGAGCCGCC
351 CGGATGGTTG TGCGCGATAA TCAGGCTGTC GGCATATTCG TCCAATGCCA
401 GTTTGACGAT TTCGCGGATG TAA
```

This corresponds to the amino acid sequence <SEQ ID 406; ORF 114.ng>:

g114.pep

```
  1 MASITSPLHG AQQECSKTFL CPPGGTSMGR SMSVTVGLFC VSINLTISVE
 51 YGQSGYFTRA AECKTGCQGI SPSCLNERTV CEVTIKWSSS ETSTSDMACA
101 SRLVNMMSSC EGSGEPPGWL CAIIRLSAYS SNASLTISRM *
```

The following partial DNA sequence was identified in *N. meningitidis* <SEQ ID 407>:

m114.seq

```
  1 ATGGCTTCCA TCACTTCGCC GCTGCACGGG GCGCACAGAG AATGCAGCAA
 51 GACTTTTTTA TGTCCACCGG GCGGGACGAG TATAGGGCGG TCAATGTCGG
101 TAACGGTAGG TTTGTTTTGT GTTTCCATTA ACTTAACAAT ATCTGTTGAA
151 TACGGTTGAA GCGGCTATTT TATCAGAGCC GCCGCATGTA AAACAGAGTG
201 TCAGGGCATC AACCCGAGCT GTCTGAACGA ACAGACGCTT TGCGAkGTAA
251 CGATAAAATG GTCGAGCAGC GACACATCGA CCAGCGACAT TGCCTGTGCC
301 AGCCGCCTTG TGAACATGAT GTCTTCCTGC GAArGTTCsG GCGAGCCGcC
351 CGgATGGTTG TGCGCAATAA TCAGGCTGTC GGCATATTCG TCCAATGCCA
401 GTTTGACGAT TTCGCGGATG TAA
```

This corresponds to the amino acid sequence <SEQ ID 408; ORF 114>:

m114.pep

```
  1 MASITSPLHG AHRECSKTFL CPPGGTSIGR SMSVTVGLFC VSINLTISVE
 51 YGXSGYFIRA AACKTECQGI NPSCLNEQTL CXVTIKWSSS DTSTSDIACA
101 SRLVNMMSSC EXSGEPPGWL CAIIRLSAYS SNASLTISRM *
```

m114/g114 90.0% identity over a 140 aa overlap

```
                       10        20        30        40        50        60
m114.pep       MASITSPLHGAHRECSKTFLCPPGGTSIGRSMSVTVGLFCVSINLTISVEYGXSGYFIRA
               ||||||||||::|||||||||||||||:|||||||||||||||||||||||| |||| ||
g114           MASITSPLHGQQRECSKTFLCPPGGTSMGRSMSVTVGLFCVSINLTISVEYGQSGYFTRA
                       10        20        30        40        50        60

                       70        80        90       100       110       120
m114.pep       AACKTECQGINPSCLNEQTLCXVTIKWSSSDTSTSDIACASRLVNMMSSCEXSGEPPGWL
               | ||| ||||:||||||:|:| ||||||||:|||||:|||||||||||||| ||||||||
g114           AECKTGCQGISPSCLNERTVCEVTIKWSSSETSTSDMACASRLVNMMSSCEGSGEPPGWL
                       70        80        90       100       110       120

                      130       140
m114.pep       CAIIRLSAYSSNASLTISRMX
               |||||||||||||||||||||
g114           CAIIRLSAYSSNASLTISRMX
                      130       140
```

The following partial DNA sequence was identified in *N. gonorrhoeae* <SEQ ID 409>:

a114.seq

```
  1 ATGCCGGAGG CAAGCATCGC CTCCATCACT TCGCCGCTGC ACGGGGCGCA
 51 ACAGGAATGC AGCAAGACTT TTTTATGTCC GCCGGGCGGG ACGAGTATGG
101 GGCGGTCAAT GTCGGTAACG GTAGGTTTGT TTTGTGTTTC CATTAACTTA
151 ACGATATCTG TCGAATACGG TTGAAGCGGC TATTTTATCA GAGCCGCCGC
201 ATGTAAAACA GGGTGTCAGG GCATCAGCCC GAGCTGCCTG AACGAACGGA
251 CGGTTTGCGC CGTTACGATA AAATGGTCGA GCAGCGACAC ATCGACCAGC
301 GACATTGCCT GTGCCAGCCG CCTTGTGAAC ATGATGTCTT CCTGCGAAGG
351 TTCGGGCGAG CCGCCCGGAT GGTTGTGCGC GATAATCAGG CTGTCGGCAT
401 ATTCGTCCAA TGCCAGTTTG ACAATTTCAC GGATGTAA
```

This corresponds to the amino acid sequence <SEQ ID 410; ORF 114.a>:

a114.pep

```
  1 MPEASIASIT SPLHGAQQEC SKTFLCPPGG TSMGRSMSVT VGLFCVSINL
 51 TISVEYG*SG YFIRAAACKT GCQGISPSCL NERTVCAVTI KWSSSDTSTS
101 DIACASRLVN MMSSCEGSGE PPGWLCAIIR LSAYSSNASL TISRM*
```

m114/a114 92.9% identity in 140 aa overlap

```
                            10        20        30        40        50
m114.pep            MASITSPLHGAHRECSKTFLCPPGGTSIGRSMSVTVGLFCVSINLTISVEYGXSG
                    :||||||||||::||||||||||||||:|||||||||||||||||||||||||||
a114           MPEASIASITSPLHGAQQECSKTFLCPPGGTSMGRSMSVTVGLFCVSINLTISVEYGXSG
                       10        20        30        40        50        60

                   60        70        80        90       100       110
m114.pep       YFIRAAACKTECQGINPSCLNEQTLCXVTIKWSSSDTSTSDIACASRLVNMMSSCEXSGE
               |||||||||| ||||:||||||:|:| ||||||||||||||||||||||||||||| |||
a114           YFIRAAACKTGCQGISPSCLNERTVCAVTIKWSSSDTSTSDIACASRLVNMMSSCEGSGE
                       70        80        90       100       110       120

                 120       130       140
m114.pep       PPGWLCAIIRLSAYSSNASLTISRMX
               ||||||||||||||||||||||||||
a114           PPGWLCAIIRLSAYSSNASLTISRMX
                      130       140
```

The following partial DNA sequence was identified in *N. gonorrhoeae* <SEQ ID 411>:

g117.seq

```
   1 atggtcgacg aactcgacCT GCTGCCCGAT GCCGTCGCCG CCACCCTGCT
  51 TGCCGACATC GGACGCTACG TCCCCGATTG GAACCTATTG GTTTCCGAGC
 101 GCTGCAACAG CACCGTCGCC GAGCTGGTCA AAGGTGtgga CGAAGTGCAG
 151 AAACTTACCC ACTTCGCCCG GGTGGACAGC CTCGCCACGC CGGAAGAACG
 201 CGCACAGCAA GCGGAAACCA TGCGGAAAAT GCTGCTGGCg atggttaccg
 251 Acatccgcgt cgtaTTAATC AAACTGGCGA TGCGTacgcg caccCTGcta
 301 ttTTtaaGCA ACGCCCCCGA CAGCCCTGAA AAACgcgccG TCgccaaAga
 351 aacccTCGAC ATCTTCGCCC CGCTCGCCAA CCGCTTGGGC GTGTGGCAGC
 401 TCAAATGGCA GCTCGAAGAT TTGGGCTTCC GCCATCAAGA ACCCGAAAAA
 451 TACCGCGAAA TCGCCCTGCT TTTGGACGAA AAACGCACCG AACGCCTCGA
 501 ATACATCGAA AACTTCCTCG ATATCCTGCG TACGGAACTC AAAAAATACA
 551 ATATCCACTT TGAAGTCGCC GGCCGTCCGA AACACATCTA CTCCATTTAC
 601 AAAAAAATGG TGAAGAAAAA ACTCAGCTTC GACGgccTGT TCGACATCCG
 651 CGCCGTGCGG ATTCTGGTCG ATACCGTCCC CGaGTGTTAC ACCACGCTGG
 701 gcaTCGTCCA CAGCCTCTGG CAGCCCATTC CCGGCGagtt CGAcgactAC
 751 ATCGCCAACC CCAAAGgcaA CGgttATAAA AGtTTGCACA CCGTCATCGT
 801 cggcccGGAa gacaaaggtg tggaaGtgCA AATCCGCACC TTCGAtatGC
 851 accAATTCaa CgaatTcggT gtcgccgCCC ACTGGCGtta caaagaaggc
 901 ggcaaaggcg attccGCCtA cgaacaaAAA ATcgccTggt TGCgccaACT
 951 CTTGGACTGG CGCGAAAATA TGGCGGAAAG CGGCAAGGAA GACCTCGCCG
1001 CCGCCTTCAA AACCGAGCTT TTCAACGACA CGATTTATGT TTTGACCCCG
1051 CACGGCAAAG TCCTCTCTCT GCCAACGGGC GCAACCCCCA TCGACTTCGC
1101 CTACGCCCTG CACAGCAGCA TcggCGACCG CTGCCGGGGC GCGAAAGTCG
1151 AaggGCAGAT TGTGCCGCTG TCCACCCCGC TCGAAAACGG ACAGCGCGTC
1201 GAAATcatta cCGCcaaAGA AGGGCATCCT TCCGTCAACT GGCTTTACGA
1251 AGGctgGGtc aAATCCGGCA AGGCCATCGG caaAATCCGC GCCTAcatCC
1301 GCCAGcaaAa cgCcgaCACC GTGCGCGAAG AAGGCCGTGT CCAACTCGAC
1351 AAGCAGCTTG CCAAACTCAC GCCCAAACCC AACCTGCAAG AGCTTgccga
1401 aaATCTCGGC tacaaAAAGC cagaagacct ctacacCGCc gtcggacaag
1451 gcgaaatttc caaccgcgcc atCcaaaaag cctgcggcac GCTgaacgaa
1501 ccgccccCCG TGCCCGTCAG CGCAACCACC ATCGTCAAAC AGTCCAAAAT
1551 CAAAAAAGGT GGCAAAACCG GCGTGCTCAT CGACGGCGAA GACGGCTTGA
1601 TGACCACGCT TGCCAAATGC TGCAAACCCG CGCCGCCCGA CGATATTGCC
1651 GGCTTCGTTA CCCGCGAGCG CGGCATTTCC GTCCACCGCA AAACCTGCCC
1701 CTCTTTCCGA CACCTTGCCG AACACGCGCC CGAAAAAGTA CTGGACGCAA
1751 GTTGGGCGGC GTTGCAGGAA GGGCAAGTGT TCGCCGTCGA TATCGAAATC
1801 CGCGCCCAAG ACCGCTCCGG GCTTTTGCGC GACGTATCCG ACGCGCTCGC
```

-continued

```
1851 CCGCCACAAA CTCAACGTTA CCGCCGTGCA AACCCAGTCC CGCGACTTGG

1901 AAGCCAGCAT GAGGTTCACG CTCGAAGTCA AACAAGtCAA CGacCTCCCG

1951 CGCGTCCTCG CCGGCCTCGG CGATGTCAAA GGCGTATTGA GCGTTACCCG

2001 GCTTTAA
```

This corresponds to the amino acid sequence <SEQ ID 412; ORF 117.ng>:

g117.pep

```
  1 MVDELDLLPD AVAATLLADI GRYVPDWNLL VSERCNSTVA ELVKGVDEVQ

 51 KLTHFARVDS LATPEERAQQ AETMRKMLLA MVTDIRVVLI KLAMRTRTLL

101 FLSNAPDSPE KRAVAKETLD IFAPLANRLG VWQLKWQLED LGFRHQEPEK

151 YREIALLLDE KRTERLEYIE NFLDILRTEL KKYNIHFEVA GRPKHIYSIY

201 KKMVKKKLSF DGLFDIRAVR ILVDTVPECY TTLGIVHSLW QPIPGEFDDY

251 IANPKGNGYK SLHTVIVGPE DKGVEVQIRT FDMHQFNEFG VAAMWRYKEG

301 GKGDSAYEQK IAWLRQLLDW RENMAESGKE DLAAAFKTEL FNDTIYVLTP

351 HGKVLSLPTG ATPIDFAYAL HSSIGDRCRG AKVEGQIVPL STPLENGQRV

401 EIITAKEGHP SVNWLYEGWV KSGKAIGKIR AYIRQQNADT VREEGRVQLD

451 KQLAKLTPKP NLQELAENLG YKKPEDLYTA VGQGEISNRA IQKACGTLNE

501 PPPVPVSATT IVKQSKIKKG GKTGVLIDGE DGLMTTLAKC CKPAPPDDIA

551 GFVTRERGIS VHRKTCPSFR HLAEHAPEKV LDASWAALQE GQVFAVDIEI

601 RAQDRSGLLR DVSDALARHK LNVTAVQTQS RDLEASMRFT LEVKQVNDLP

651 RVLAGLGDVK GVLSVTRL*
```

The following partial DNA sequence was identified in *N. meningitidis* <SEQ ID 413>:

m117.seq (partial)

```
  1 ..GTGAAACTCA AGAAATACAA TGTCCATTTC GAAGTCGCCG GCCGCCCGAA

 51   ACACATCTAC TCCATTTACA AAAAAATGGT GAAGAAAAAA CTCAGCTTCG

101   ACGGCCTCTT TGACATCCGC GCCGTGCGAA TTCTGGTTGA TACCGTCCCC

151   GAGTGTTACA CCACGCTGGG TATCGTCCAC AGCCTCTGGC AGCCCATTCC

201   CGGCGAGTTC GACGACTACA TCGCCAATCC CAAAGGCAAC GGCTATAAAA

251   GTTTGCACAC CGTCATCGTC GGCCCGGAAG ACAAAGGCGT GGAAGTACAA

301   ATCCGCACCT TCGATATGCA CCAATTCAAC GAATTCGGTG TCGCCGCCCA

351   CTGgCGTTAC AAAGAGGGCG GCAAGGGCGA TTCCGCCTAC GAACAGAAAA

401   TCGCCTGGTT GCGCCAACTC TTGGACTGGC GCGAAAACAT GGCGGAAAGC

451   GGCAAGGAAG ACCTCGCCGC CGCCTTCAAA ACCGAGCTTT TCAACGACAC

501   GATTTATGTT TTGACCCCGC ACGGCAAAGT CCTCTCCCTG CCCACGGGCG

551   CGACCCCCAT CGACTTCGCC TACGCCCTGC ACAGCAGCAT CGGCGACCGT

601   TGCCGCGGTG CGAAAGTCGA AGGGCAGATT GTGCCGCTGT CCACCCCGCT

651   CGAAAACGGA CAGCGCGTCG AAATCATTAC CGCCAAAGAA GGGCATCCTT
```

-continued

```
701   CCGTCAACTG GCTTTACGAA GGCTGGGTCA AATCCAACAA GGCAATCGGC
751   AAAATCCGCG CCTACATCCG CCAGCAAAAC GCCGACACCG TGCGCGAAGA
801   AGGCCGCGTC CAACTCGACA AACAGCTTGC CAAACTCACG CCCAAACCCA
851   ACCTGCAAGA GCTTGCCGAA AATCTCGGCT ACAAAAAGCC AGAAGACCTC
901   TACACCGCCG TCGGACAAGG CGAAATTTCC AACCGCGCCA TCCAAAAAGC
951   CTGCGGCACg CTGAACGAAC CGCCGCCCGT ACCCGTCAGC GAAACCACCA
1001  TCGTCAAACA GTCCAAAATC AAAAAAGGCG GCAAAAACGG CGTGCTCATC
1051  GACGGCGAAG ACGGTCTGAT GACCACGCTT GCCAAATGCT GCAAACCCGC
1101  GCCGCCCGAC GATATTATCG GCTTCGTTAC CCGCGAGCGC GgCATTTCAG
1151  TGCACCGCAA AwyyTkCyCG TCTTTCCAAC ACCTCGCCGA ACACGCGCCC
1201  GAwAAAGTGC TGGACGCAAG CTGGGCGGCA TTGCAGGAAG GACAAGTATT
1251  CGCCGTCGAT ATCGAAATCC GCGCCCAAGA CCGCTCCGGG CTTTTGCGCG
1301  ACGTATCCGA CGCGCTCGCC CGCCACAAAC TCAACGTTAC CGCCGTGCAA
1351  ACCCAGTCCC GCGACTTGGA AGCCAGCATG AGGTTCACGC TCGAAGTCAA
1401  ACAAGTCAAC GACCTCCCGC GCGTCCTCGC CAGCCTCGGC GACGTCAAAG
1451  GCGTATTGAG CGTTACCCGG CTTTAA
```

This corresponds to the amino acid sequence <SEQ ID 414; ORF 117>:

m117.pep (partial)

```
  1 ....VKLKKYNVHF EVAGRPKHIY SIYKKMVKKK LSFDGLFDIR AVRILVDTVP
 51     ECYTTLGIVH SLWQPIPGEF DDYIANPKGN GYKSLHTVIV GPEDKGVEVQ
101     IRTFDMHQFN EFGVAAHWRY KEGGKGDSAY EQKIAWLRQL LDWRENMAES
151     GKEDLAAAFK TELFNDTIYV LTPHGKVLSL PTGATPIDFA YALHSSIGDR
201     CRGAKVEGQI VPLSTPLENG QRVEIITAKE GHPSVNWLYE GWVKSNKAIG
251     KIRAYIRQQN ADTVREEGRV QLDKQLAKLT PKPNLQELAE NLGYKKPEDL
301     YTAVGQGEIS NRAIQKACGT LNEPPPVPVS ETTIVKQSKI KKGGKNGVLI
351     DGEDGLMTTL AKCCKPAPPD DIIGFVTRER GISVHRKXXX SFQHLAEHAP
401     XKVLDASWAA LQEGQVFAVD IEIRAQDRSG LLRDVSDALA RHKLNVTAVQ
451     TQSRDLEASM RFTLEVKQVN DLPRVLASLG DVKGVLSVTR L*
```

Computer analysis of this amino acid sequence gave the following results:

Homology with a predicted ORF from *N. gonorrhoeae*

ORF 117 shows 97.6% identity over a 490 aa overlap with a predicted ORF (ORF 117.ng) from *N. gonorrhoeae*:

m117/g117

```
                                                      10        20        30
m117.pep                                    VKLKKYNVHFEVAGRPKHIYSIYKKMVKKKL
                                            :|||||:||||||||||||||||||||||||
g117       EKYREIALLLDEKRTERLEYIENFLDILRTELKKYNIHFEVAGRPKHIYSIYKKMVKKKL
          150       160       170       180       190       200
```

-continued

```
                  40        50        60        70        80        90
m117.pep   SFDGLFDIRAVRILVDTVPECYTTLGIVHSLWQPIPGEFDDYIANPKGNGYKSLHTVIVG
           ||||||||||||||||||||||||||||||||||||||||||||||||||||||||||||
g117       SFDGLFDIRAVRILVDTVPECYTTLGIVHSLWQPIPGEFDDYIANPKGNGYKSLHTVIVG
          210       220       230       240       250       260

                 100       110       120       130       140       150
m117.pep   PEDKGVEVQIRTFDMHQFNEFGVAAHWRYKEGGKGDSAYEQKIAWLRQLLDWRENMAESG
           ||||||||||||||||||||||||||||||||||||||||||||||||||||||||||||
g117       PEDKGVEVQIRTFDMHQFNEFGVAAHWRYKEGGKGDSAYEQKIAWLRQLLDWRENMAESG
          270       280       290       300       310       320

                 160       170       180       190       200       210
m117.pep   KEDLAAAFKTELFNDTIYVLTPHGKVLSLPTGATPIDFAYALHSSIGDRCRGAKVEGQIV
           ||||||||||||||||||||||||||||||||||||||||||||||||||||||||||||
g117       KEDLAAAFKTELFNDTIYVLTPHGKVLSLPTGATPIDFAYALHSSIGDRCRGAKVEGQIV
          330       340       350       360       370       380

                 220       230       240       250       260       270
m117.pep   PLSTPLENGQRVEIITAKEGHPSVNWLYEGWVKSNKAIGKIRAYIRQQNADTVREEGRVQ
           ||||||||||||||||||||||||||||||||||:|||||||||||||||||||||||||
g117       PLSTPLENGQRVEIITAKEGHPSVNWLYEGWVKSGKAIGKIRAYIRQQNADTVREEGRVQ
          390       400       410       420       430       440

                 280       290       300       310       320       330
m117.pep   LDKQLAKLTPKPNLQELAENLGYKKPEDLYTAVGQGEISNRAIQKACGTLNEPPPVPVSE
           ||||||||||||||||||||||||||||||||||||||||||||||||||||||||||| 
g117       LDKQLAKLTPKPNLQELAENLGYKKPEDLYTAVGQGEISNRAIQKACGTLNEPPPVPVSA
          450       460       470       480       490       500

                 340       350       360       370       380       390
m117.pep   TTIVKQSKIKKGGKNGVLIDGEDGLMTTLAKCCKPAPPDDIIGFVTRERGISVHRKXXXS
           ||||||||||||||:|||||||||||||||||||||||||| ||||||||||||||:  |
g117       TTIVKQSKIKKGGKTGVLIDGEDGLMTTLAKCCKPAPPDDIAGFVTRERGISVHRKTCPS
          510       520       530       540       550       560

                 400       410       420       430       440       450
m117.pep   FQHLAEHAPXKVLDASWAALQEGQVFAVDIEIRAQDRSGLLRDVSDALARHKLNVTAVQT
           |:||||||| ||||||||||||||||||||||||||||||||||||||||||||||||||
g117       FRHLAEHAPEKVLDASWAALQEGQVFAVDIEIRAQDRSGLLRDVSDALARHKLNVTAVQT
          570       580       590       600       610       620

                 460       470       480       490
m117.pep   QSRDLEASMRFTLEVKQVNDLPRVLASLGDVKGVLSVTRLX
           ||||||||||||||||||||||||||:|||||||||||||| 
g117       QSRDLEASMRFTLEVKQVNDLPRVLAGLGDVKGVLSVTRLX
          630       640       650       660
```

The following partial DNA sequence was identified in *N. meningitidis* <SEQ ID 415>:

a117.seq

```
  1 ATGGTTCATG AACTCGACCT GCTCCCCGAT GCCGTCGCCG CCACCCTGCT
 51 TGCCGACATC GGACGCTACG TCCCCGACTG GAACCTATTG GTTTCCGAAC
101 GCTGCAACAG TACCGTCGCC GAGCTGGTCA AAGGTGTGGA CGAAGTGCAG
151 AAACTCACCC ACTTCGCCCG GGTGGACAGC CTCGCCACGC CGGAAGAACG
201 CGCCCAGCAG GCAGAAACTA TGCGGAAAAT GCTGCTGGCG ATGGTTACCG
251 ACATCCGCGT CGTGTTAATC AAACTGGCGA TGCGTACGCG CACCCTGCAA
301 TTTTTAAGCA ACGCCCCCGA CAGCCCCGAA AAACGCGCCG TCGCCAAAGA
351 AACCCTCGAC ATCTTCGCCC CGCTCGCCAA CCGTTTGGGC GTGTGGCAGC
401 TCAAATCGCA GCTCGAAGAT TTGGGCTTCC GCCATCAAGA ACCCGAAAAA
451 TACCGCGAAA TCGCCCTGCT TTTGGACGAA AAACGCACCG AACGCCTCGA
501 ATACATCGAA AACTTCCTTA ATATCCTGCG TACGGAACTC AAAAAATACA
551 ATATCCACTT TGAAGTCGCC GGCCGTCCGA AACACATCTA CTCCATTTAC
601 AAAAAAATGG TGAAGAAAAA ACTCAGCTTC GACGGGTTGT TCGACATCCG
651 CGCCGTGCGG ATTCTGGTTG ATACCGTCCC CGAGTGTTAC ACCACACTGG
701 GCATTGTCCA CAGCCTCTGG CAGCCCATTC CCGGCGAGTT CGACGACTAC
```

-continued

```
 751 ATCGCCAACC CGAAAGGCAA CGGCTATAAA AGTTTGCACA CCGTCATCGT
 801 CGGCCCGGAA GACAAAGGCG TGGAAGTGCA AATCCGCACC TTCGATATGC
 851 ACCAATTCAA CGAATTCGGT GTCGCCGCGC ACTGGCGTTA CAAAGAGGGC
 901 GGCAAAGGCG ATTCCGCCTA CGAACAAAAA ATCGCCTGGT TACGCCAACT
 951 TTTGGACTGG CGCGAAAACA TGGCGGAAAG CGGCAAGGAA GACCTCGCCG
1001 CCGCCTTCAA AACCGAGCTT TTCAACGACA CGATTTATGT TTTGACCCCG
1051 CACGGCAAAG TCCTCTCCCT GCCCACAGGC GCGACCCCCA TCGACTTCGC
1101 CTACGCCCTG CACAGCAGCA TCGGCGACCG TTGCCGCGGT GCGAAAGTCG
1151 AAGGGCAGAT TGTGCCGCTG TCCACCCCGC TCGAAAACGG ACAGCGTGTC
1201 GAAATCATTA CCGCCAAAGA AGGGCATCCT TCCGTCAACT GGCTTTACGA
1251 AGGCTGGGTC AAATCCAACA AGGCAATCGG CAAAATCCGC GCCTACATCC
1301 GCCAGCAAAA CGCCGACACC GTGCGCGAAG AAGGCCGCGT CCAACTCGAC
1351 AAACAGCTTG CCAAACTCAC GCCCAAACCC AACCTGCAAG AGCTTGCCGA
1401 AAATCTCGGC TACAAAAAGC CAGAAGACCT CTACACCGCC GTCGGACAAG
1451 GCGAAATTTC CAACCGCGCC ATCCAAAAAG CCTGCGGCAC GCTGAACGAA
1501 CCGCCGCCCG TACCCGTCAG CGAAACCACC ATCGTCAAAC AGTCCAAAAT
1551 CAAAAAAGGC GGCAAAAACG GCGTGCTCAT CGACGGCGAA GACGGTCTGA
1601 TGACCACGCT TGCCAAATGC TGCAAACCCG CGCCGCCCGA CGACATTGTC
1651 GGCTTCGTTA CCCGCGATCG CGGCATTTCG GTACACCGCA AAACCTGCCC
1701 CTCTTTCCGA CACCTCGCCG AACACGCGCC CGAAAAAGTA CTGGACGCAA
1751 GTTGGGCGGC GTTGCAGGAA GGACAAGTGT TCGCCGTCGA TATCGAAATC
1801 CGCGCCCAAG ACCGCTCCGG GCTTTTGCGC GACGTATCCG ACGCGCTCGC
1851 CCGCCACAAA CTCAACGTTA CCGCCGTGCA AACCCAGTCC CGCGACTTGG
1901 AAGCCAGCAT GAGGTTCACG CTCGAAGTCA AACAAGTTAC CGACCTCCCA
1951 CGCGTCCTCG CCAGCCTCGG CGACGTCAAA GGCGTATTGA GCGTTACCCG
2001 GCTTTAA
```

This corresponds to the amino acid sequence <SEQ ID 416; ORF 117.a>:

a117.pep

```
  1 MVHELDLLPD AVAATLLADI GRYVPDWNLL VSERCNSTVA ELVKGVDEVQ
 51 KLTHFARVDS LATPEERAQQ AETMRKMLLA MVTDIRVVLI KLAMRTRTLQ
101 FLSNAPDSPE KRAVAKETLD IFAPLANRLG VWQLKWQLED LGFRHQEPEK
151 YREIALLLDE KRTERLEYIE NFLNILRTEL KKYNIHFEVA GRPKHIYSIY
201 KKMVKKKLSF DGLFDIRAVR ILVDTVPECY TTLGIVHSLW QPIPGEFDDY
251 IANPKGNGYK SLHTVIVGPE DKGVEVQIRT FDMHQFNEFG VAAHWRYKEG
301 GKGDSAYEQK IAWLRQLLDW RENMAESGKE DLAAAFKTEL FNDTIYVLTP
351 HGKVLSLPTG ATPIDFAYAL HSSIGDRCRG AKVEGQIVPL STPLENGQRV
401 EIITAKEGHP SVNWLYEGWV KSNKAIGKIR AYIRQQNADT VREEGRVQLD
451 KQLAKLTPKP NLQELAENLG YKKPEDLYTA VGQGEISNRA IQKACGTLNE
```

-continued

```
501 PPPVPVSETT IVKQSKIKKG GKNGVLIDGE DGLMTTLAKC CKPAPPDDIV

551 GFVTRDRGIS VHRKTCPSFR HLAEHAPEKV LDASWAALQE GQVFAVDIEI

601 RAQDRSGLLR DVSDALARHK LNVTAVQTQS RDLEASMRFT LEVKQVTDLP

651 RVLASLGDVK GVLSVTRL*
```

m117/a117 98.0% identity in 490 aa overlap

```
                                                10        20        30
m117.pep                             VKLKKYNVHFEVAGRPKHIYSIYKKMVKKKL
                                         :|||||:|||||||||||||||||||||||
a117       EKYREIALLLDEKRTERLEYIENFLNILRTELKKYNIHFEVAGRPKHIYSIYKKMVKKKL
         150       160       170       180       190       200

                   40        50        60        70        80        90
m117.pep   SFDGLFDIRAVRILVDTVPECYTTLGIVHSLWQPIPGEFDDYIANPKGNGYKSLHTVIVG
           ||||||||||||||||||||||||||||||||||||||||||||||||||||||||||||
a117       SFDGLFDIRAVRILVDTVPECYTTLGIVHSLWQPIPGEFDDYIANPKGNGYKSLHTVIVG
         210       220       230       240       250       260

                  100       110       120       130       140       150
m117.pep   PEDKGVEVQIRTFDMHQFNEFGVAAHWRYKEGGKGDSAYEQKIAWLRQLLDWRENMAESG
           ||||||||||||||||||||||||||||||||||||||||||||||||||||||||||||
a117       PEDKGVEVQIRTFDMHQFNEFGVAAHWRYKEGGKGDSAYEQKIAWLRQLLDWRENMAESG
         270       280       290       300       310       320

                  160       170       180       190       200       210
m117.pep   KEDLAAAFKTELFNDTIYVLTPHGKVLSLPTGATPIDFAYALHSSIGDRCRGAKVEGQIV
           ||||||||||||||||||||||||||||||||||||||||||||||||||||||||||||
a117       KEDLAAAFKTELFNDTIYVLTPHGKVLSLPTGATPIDFAYALHSSIGDRCRGAKVEGQIV
         330       340       350       360       370       380

                  220       230       240       250       260       270
m117.pep   PLSTPLENGQRVEIITAKEGHPSVNWLYEGWVKSNKAIGKIRAYIRQQNADTVREEGRVQ
           ||||||||||||||||||||||||||||||||||||||||||||||||||||||||||||
a117       PLSTPLENGQRVEIITAKEGHPSVNWLYEGWVKSNKAIGKIRAYIRQQNADTVREEGRVQ
         390       400       410       420       430       440

                  280       290       300       310       320       330
m117.pep   LDKQLAKLTPKPNLQELAENLGYKKPEDLYTAVGQGEISNRAIQKACGTLNEPPPVPVSE
           ||||||||||||||||||||||||||||||||||||||||||||||||||||||||||||
a117       LDKQLAKLTPKPNLQELAENLGYKKPEDLYTAVGQGEISNRAIQKACGTLNEPPPVPVSE
         450       460       470       480       490       500

                  340       350       360       370       380       390
m117.pep   TTIVKQSKIKKGGKNGVLIDGEDGLMTTLAKCCKPAPPDDIIGFVTRERGISVHRKXXXS
           |||||||||||||||||||||||||||||||||||||||||:|||||:||||||||:  |
a117       TTIVKQSKIKKGGKNGVLIDGEDGLMTTLAKCCKPAPPDDIVGFVTRDRGISVHRKTCPS
         510       520       530       540       550       560

                  400       410       420       430       440       450
m117.pep   FQHLAEHAPXKVLDASWAALQEGQVFAVDIEIRAQDRSGLLRDVSDALARHKLNVTAVQT
           |:||||||| ||||||||||||||||||||||||||||||||||||||||||||||||||
a117       FRHLAEHAPEKVLDASWAALQEGQVFAVDIEIRAQDRSGLLRDVSDALARHKLNVTAVQT
         570       580       590       600       610       620

                  460       470       480       490
m117.pep   QSRDLEASMRFTLEVKQVNDLPRVLASLGDVKGVLSVTRLX
           ||||||||||||||||||:||||||||||||||||||||||
a117       QSRDLEASMRFTLEVKQVTDLPRVLASLGDVKGVLSVTRLX
         630       640       650       660
```

The following partial DNA sequence was identified in *N. gonorrhoeae* <SEQ ID 417>:

g117-1.seq

```
  1 ATGACCGCCA TCAGCCCGAT TCAAGACACG CAAAGCGCGA CCCTGCAAGA

 51 ATTGCGCGAA TGGTTCGACA GCTACTGCGC CGCTCTGCCG GACAACGATA

101 AAAACCTCAT CGGTACCGCA TGGTCGCTGG CGCAGGAACA TTATCCTGCC

151 GATGCCGCCA CGCCGTATGG CGAGCCGCTG CCCGACCACT TCCTCGGCGC

201 GGCGCAAATG GTCGACGAAC TCGACCTGCT GCCCGATGCC GTCGCCGCCA

251 CCCTGCTTGC CGACATCGGA CGCTACGTCC CCGATTGGAA CCTATTGGTT
```

-continued

```
 301 TCCGAGCGCT GCAACAGCAC CGTCGCCGAG CTGGTCAAAG GTGTGGACGA
 351 AGTGCAGAAA CTTACCCACT TCGCCCGGGT GGACAGCCTC GCCACGCCGG
 401 AAGAACGCGC ACAGCAAGCG GAAACCATGC GGAAAATGCT GCTGGCGATG
 451 GTTACCGACA TCCGCGTCGT ATTAATCAAA CTGGCGATGC GTACGCGCAC
 501 CCTGCAATTT TTAAGCAACG CCCCCGACAG CCCTGAAAAA CGCGCCGTCG
 551 CCAAAGAAAC CCTCGACATC TTCGCCCCGC TCGCCAACCG CTTGGGCGTG
 601 TGGCAGCTCA AATGGCAGCT CGAAGATTTG GGCTTCCGCC ATCAAGAACC
 651 CGAAAAATAC CGCGAAATCG CCCTGCTTTT GGACGAAAAA CGCACCGAAC
 701 GCCTCGAATA CATCGAAAAC TTCCTCGATA TCCTGCGTAC GGAACTCAAA
 751 AAATACAATA TCCACTTTGA AGTCGCCGGC CGTCCGAAAC ACATCTACTC
 801 CATTTACAAA AAAATGGTGA AGAAAAAACT CAGCTTCGAC GGCCTGTTCG
 851 ACATCCGCGC CGTGCGGATT CTGGTCGATA CCGTCCCCGA GTGTTACACC
 901 ACGCTGGGCA TCGTCCACAG CCTCTGGCAG CCCATTCCCG GCGagttCGA
 951 cgactACATC GCCAACCCCA AGGgcaACGg ttATAAAAGt TTGCACACCG
1001 TCATCGTcgg cccGGAagaa aaaggtgtgg aagtgcAAAT CCGCACCTTC
1051 GATATGCacc AATTCaaCga ATTCGGTGTC GCCGCCCACT GGCGTTACAA
1101 AGAAGGCGGC AAAGGCGATT CCGCCTACGA ACAAAAAATC GCCTGGTTGC
1151 GCCAACTCTT GGACTGGCGC GAAAATATGG CGGAAAGCGG CAAGGAAGAC
1201 CTCGCCGCCG CCTTCAAAAC CGAGCTTTTC AACGACACGA TTTATGTTTT
1251 GACCCCGCAC GGCAAAGTCC TCTCTCTGCC AACGGGCGCA ACCCCCATCG
1301 ACTTCGCCTA CGCCCTGCAC AGCAGCATCG GCGACCGCTG CCGGGGCGCG
1351 AAAGTCGAAG GGCAGATTGT GCCGCTGTCC ACCCCGCTCG AAAACGGACA
1401 GCGCGTCGAA ATCATTACCG CCAAAGAAGG GCATCCTTCC GTCAACTGGC
1451 TTTACGAAGG CTGGGTCAAA TCCGGCAAGG CCATCGGCAA AATCCGCGCC
1501 TACATCCGCC AGCAAAACGC CGACACCGTG CGCGAAGAAG GCCGTGTCCA
1551 ACTCGACAAG CAGCTTGCCA AACTCACGCC CAAACCCAAC CTGCAAGAGC
1601 TTGCCGAAAA TCTCGGCTAC AAAAAGCCAG AAGACCTCTA CACCGCCGTC
1651 GGACAAGGCG AAATTTCCAA CCGCGCCATC CAAAAAGCCT GCGGCACGCT
1701 GAACGAACCG CCGCCCGTGC CCGTCAGCGC AACCACCATC GTCAAACAGT
1751 CCAAAATCAA AAAAGGTGGC AAAACCGGCG TGCTCATCGA CGGCGAAGAC
1801 GGCTTGATGA CCACGCTTGC CAAATGCTGC AAACCCGCGC CGCCCGACGA
1851 TATTGCCGGC TTCGTTACCC GCGAGCGCGG CATTTCCGTC CACCGCAAAA
1901 CCTGCCCCTC TTTCCGACAC CTTGCCGAAC ACGCGCCCGA AAAAGTACTG
1951 GACGCAAGTT GGGCGGCGTT GCAGGAAGGG CAAGTGTTCG CCGTCGATAT
2001 CGAAATCCGC GCCCAAGACC GCTCCGGGCT TTTGCGCGAC GTATCCGACG
2051 CGCTCGCCCG CCACAAACTC AACGTTACCG CCGTGCAAAC CCAGTCCCGC
2101 GACTTGGAAG CCAGCATGAG GTTCACGCTC GAAGTCAAAC AAGTCAACGA
2151 CCTCCCGCGC GTCCTCGCCG GCCTCGGCGA TGTCAAAGGC GTATTGAGCG
2201 TTACCCGGCT TTAA
```

This corresponds to the amino acid sequence <SEQ ID 418; ORF 117-1.ng>:

g117-1.pep

```
  1 MTAISPIQDT QSATLQELRE WFDSYCAALP DNDKNLIGTA WSLAQEHYPA
 51 DAATPYGEPL PDHFLGAAQM VDELDLLPDA VAATLLADIG RYVPDWNLLV
101 SERCNSTVAE LVKGVDEVQK LTHFARVDSL ATPEEKAQQA ETMRKMLLAM
151 VTDIRVVLIK LAMRTRTLQF LSNAPDSPEK RAVAKETLDI FAPLANRLGV
201 WQLKWQLEDL GFRHQEPEKY REIALLLDEK RTERLEYIEN FLDILRTELK
251 KYNIHFEVAG RPKHIYSIYR KMVKKKLSFD GLFDIRAVRI LVDTVPECYT
301 TLGIVRSLWQ PIPGEFDDYI ANPKGNGYKS LHTVIVGPEE KGVEVQIRTF
351 DMHQFNEFGV AAHWRYKEGG KGDSAYEQKI AWLRQLLDWR ENMAESGKED
401 LAAAFKTELF NDTIYVLTPH GKVLSLPTGA TPIDFAYALH SSIGDRCRGA
451 KVEGQIVPLS TPLENGQRVE IITAKEGHPS VNWLYEGWVK SGKAIGKIRA
501 YIRQQNADTV REEGRVQLDK QLAKLTPKPN LQELAENLGY KKPEDLYTAV
551 GQGEISNRAI QKACGTLNEP PPVPVSATTI VKQSKIKKGG KTGVLIDGED
601 GLMTTLAKCC KPAPPDDIAG FVTRERGISV HRKTCPSFRH LAEHAPEKVL
651 DASWAALQEG QVFAVDIEIR AQDRSGLLRD VSDALARHKL NVTAVQTQSR
701 DLEASMRFTL EVKQVNDLPR VLAGLGDVKG VLSVTRL*
```

The following partial DNA sequence was identified in *N. meningitidis* <SEQ ID 419>:

m117-1.seq

```
  1 ATGACCGCCA TCAGCCCGAT TCAAGACACG CAAAGCGCGA CTCTGCAAGA
 51 ATTGCGCGAA TGGTTCGACA GCTACTGCGC CGCTCTGCCG GACAACGATA
101 AAAACCTCAT CGGTACCGCA TGGTTGCTGG CGCAGGAACA TTACCCCGCC
151 GATGCCGCCA CGCCGTATGG CGAGCCGCTG CCCGACCACT TCCTCGGCGC
201 GGCGCAAATG GTTCATGAAC TCGACCTGCT CCCCGATGCC GTCGCCGCCA
251 CCCTGCTTGC CGACATCGGA CGCTACGTCC CCGACTGGAA CCTATTGGTT
301 TCCGAACGCT GCAACAGTAC CGTCGCCGAG CTGGTCAAAG GTGTGGACGA
351 AGTGCAGAAA CTCACCCACT TCGCCCGGGT GGACAGCCTC GCCACGCCGG
401 AAGAACGCGC CCAGCAGGCA GAAACTATGC GGAAAATGCT GCTGGCGATG
451 GTTACCGACA TCCGCGTCGT GTTAATCAAA CTGGCGATGC GTACGCGCAC
501 CCTGCAATTT TTAAGCAACG CCCCCGACAG CCCCGAAAAA CGCGCCGTCG
551 CCAAAGAAAC CCTCGACATC TTCGCCCCGC TCGCCAACCG TTTGGGCGTG
601 TGGCAGCTCA AATGGCAGCT CGAAGATTTG GGCTTCCGCC ATCAAAAGCC
651 CGAAAAATAC CGCGAAATCG CGCTGCTTTT GGACGAAAAA CGCACCGAAC
701 GCCTCGAATA CATCGAAAAC TTCCTCAACA TCCTGCGCGG TGAACTCAAG
751 AAATACAATG TCCATTTCGA AGTCGCCGGC CGCCCGAAAC ACATCTACTC
801 CATTTACAAA AAAATGGTGA AGAAAAAACT CAGCTTCGAC GGCCTCTTTG
851 ACATCCGCGC CGTGCGAATT CTGGTTGATA CCGTCCCCGA GTGTTACACC
```

-continued

```
 901 ACGCTGGGTA TCGTCCACAG CCTCTGGCAG CCCATTCCCG GCGAGTTCGA
 951 CGACTACATC GCCAATCCCA AAGGCAACGG CTATAAAAGT TTGCACACCG
1001 TCATCGTCGG CCCGGAAGAC AAAGGCGTGG AAGTACAAAT CCGCACCTTC
1051 GATATGCACC AATTCAACGA ATTCGGTGTC GCCGCCCACT GGCGTTACAA
1101 AGAGGGCGGC AAGGGCGATT CCGCCTACGA ACAGAAAATC GCCTGGTTGC
1151 GCCAACTCTT GGACTGGCGC GAAAACATGG CGGAAAGCGG CAAGGAAGAC
1201 CTCGCCGCCG CCTTCAAAAC CGAGCTTTTC AACGACACGA TTTATGTTTT
1251 GACCCCGCAC GGCAAAGTCC TCTCCCTGCC CACGGGCGCG ACCCCCATCG
1301 ACTTCGCCTA CGCCCTGCAC AGCAGCATCG GCGACCGTTG CCGCGGTGCG
1351 AAAGTCGAAG GGCAGATTGT GCCGCTGTCC ACCCCGCTCG AAAACGGACA
1401 GCGCGTCGAA ATCATTACCG CCAAAGAAGG GCATCCTTCC GTCAACTGGC
1451 TTTACGAAGG CTGGGTCAAA TCCAACAAGG CAATCGGCAA AATCCGCGCC
1501 TACATCCGCC AGCAAAACGC CGACACCGTG CGCGAAGAAG GCCGCGTCCA
1551 ACTCGACAAA CAGCTTGCCA AACTCACGCC CAAACCCAAC CTGCAAGAGC
1601 TTGCCGAAAA TCTCGGCTAC AAAAAGCCAG AAGACCTCTA CACCGCCGTC
1651 GGACAAGGCG AAATTTCCAA CCGCGCCATC CAAAAAGCCT GCGGCACGCT
1701 GAACGAACCG CCGCCCGTAC CCGTCAGCGA AACCACCATC GTCAAACAGT
1751 CCAAAATCAA AAAAGGCGGC AAAAACGGCG TGCTCATCGA CGGCGAAGAC
1801 GGTCTGATGA CCACGCTTGC CAAATGCTGC AAACCCGCGC CGCCCGACGA
1851 TATTATCGGC TTCGTTACCC GCGAGCGCGG CATTTCAGTG CACCGCAAAA
1901 CCTGCCCGTC TTTCCAACAC CTCGCCGAAC ACGCGCCCGA AAAAGTGCTG
1951 GACGCAAGCT GGGCGGCATT GCAGGAAGGA CAAGTATTCG CCGTCGATAT
2001 CGAAATCCGC GCCCAAGACC GCTCCGGGCT TTTGCGCGAC GTATCCGACG
2051 CGCTCGCCCG CCACAAACTC AACGTTACCG CCGTGCAAAC CCAGTCCCGC
2101 GACTTGGAAG CCAGCATGAG GTTCACGCTC GAAGTCAAAC AAGTCAACGA
2151 CCTCCCGCGC GTCCTCGCCA GCCTCGGCGA CGTCAAAGGC GTATTGAGCG
2201 TTACCCGGCT TTAA
```

This corresponds to the amino acid sequence <SEQ ID 420; ORF 117-1>:

m117-1.pep

```
  1 MTAISPIQDT QSATLQELRE WFDSYCAALP DNDKNLIGTA WLLAQEHYPA
 51 DAATPYGEPL PDHFLGAAQM VHELDLLPDA VAATLLADIG RYVPDWNLLV
101 SERCNSTVAE LVKGVDEVQK LTHFARVDSL ATPEERAQQA ETMRKMLLAM
151 VTDIRVVLIK LAMRTRTLQF LSNAPDSPEK RAVAKETLDI FAPLANRLGV
201 WQLKWQLEDL GFRHQKPEKY REIALLLDEK RTERLEYIEN FLNILRGELK
251 KYNVHFEVAG RPKHIYSIYK KMVKKKLSFD GLFDIRAVRI LVDTVPECYT
301 TLGIVHSLWQ PIPGEFDDYI ANPKGNGYKS LHTVIVGPED KGVEVQIRTF
351 DMHQFNEFGV AAHWRYKEGG KGDSAYEQKI AWLRQLLDWR ENMAESGKED
401 LAAAFKTELF NDTIYVLTPH GKVLSLPTGA TPIDFAYALH SSIGDRCRGA
```

-continued

```
451 KVEGQIVPLS TPLENGQRVE IITAKEGHPS VNWLYEGWVK SNKAIGKIRA

501 YIRQQNADTV REEGRVQLDK QLAKLTPKPN LQELAENLGY KKPEDLYTAV

551 GQGEISNRAI QKACGTLNEP PPVPVSETTI VKQSKIKKGG KNGVLIDGED

601 GLMTTLAKCC KPAPPDDIIG FVTRERGISV HRKTCPSFQH LAEHAPEKVL

651 DASWAALQEG QVFAVDIEIR AQDRSGLLRD VSDALARHKL NVTAVQTQSR

701 DLEASMRFTL EVKQVNDLPR VLASLGDVKG VLSVTRL*
```

m117-1/g117-1 98.2% identity in 737 aa overlap

```
                    10        20        30        40        50        60
m117-1.pep  MTAISPIQDTQSATLQELREWFDSYCAALPDNDKNLIGTAWLLAQEHYPADAATPYGEPL
            |||||||||||||||||||||||||||||||||||||||| |||||||||||||||||||
g117-1      MTAISPIQDTQSATLQELREWFDSYCAALPDNDKNLIGTAWSLAQEHYPADAATPYGEPL
                    10        20        30        40        50        60

                    70        80        90       100       110       120
m117-1.pep  PDHFLGAAQMVHELDLLPDAVAATLLADIGRYVPDWNLLVSERCNSTVAELVKGVDEVQK
            |||||||||| |||||||||||||||||||||||||||||||||||||||||||||||||
g117-1      PDHFLGAAQMVDELDLLPDAVAATLLADIGRYVPDWNLLVSERCNSTVAELVKGVDEVQK
                    70        80        90       100       110       120

                   130       140       150       160       170       180
m117-1.pep  LTHFARVDSLATPEERAQQAETMRKMLLAMVTDIRVVLIKLAMRTRTLQFLSNAPDSPEK
            ||||||||||||||||||||||||||||||||||||||||||||||||||||||||||||
g117-1      LTHFARVDSLATPEERAQQAETMRKMLLAMVTDIRVVLIKLAMRTRTLQFLSNAPDSPEK
                   130       140       150       160       170       180

                   190       200       210       220       230       240
m117-1.pep  RAVAKETLDIFAPLANRLGVWQLKWQLEDLGFRHQKPEKYREIALLLDEKRTERLEYIEN
            ||||||||||||||||||||||||||||||||||||:|||||||||||||||||||||||
g117-1      RAVAKETLDIFAPLANRLGVWQLKWQLEDLGFRHQEPEKYREIALLLDEKRTERLEYIEN
                   190       200       210       220       230       240

                   250       260       270       280       290       300
m117-1.pep  FLNILRGELKKYNVHFEVAGRPKHIYSIYKKMVKKKLSFDGLFDIRAVRILVDTVPECYT
            ||:||| ||||||:||||||||||||||||||||||||||||||||||||||||||||||
g117-1      FLDILRTELKKYNIHFEVAGRPKHIYSIYKKMVKKKLSFDGLFDIRAVRILVDTVPECYT
                   250       260       270       280       290       300

                   310       320       330       340       350       360
m117-1.pep  TLGIVHSLWQPIPGEFDDYIANPKGNGYKSLHTVIVGPEDKGVEVQIRTFDMHQFNEFGV
            |||||||||||||||||||||||||||||||||||||||:||||||||||||||||||||
g117-1      TLGIVHSLWQPIPGEFDDYIANPKGNGYKSLHTVIVGPEEKGVEVQIRTFDMHQFNEFGV
                   310       320       330       340       350       360

                   370       380       390       400       410       420
m117-1.pep  AAHWRYKEGGKGDSAYEQKIAWLRQLLDWRENMAESGKEDLAAAFKTELFNDTIYVLTPH
            ||||||||||||||||||||||||||||||||||||||||||||||||||||||||||||
g117-1      AAHWRYKEGGKGDSAYEQKIAWLRQLLDWRENMAESGKEDLAAAFKTELFNDTIYVLTPH
                   370       380       390       400       410       420

                   430       440       450       460       470       480
m117-1.pep  GKVLSLPTGATPIDFAYALHSSIGDRCRGAKVEGQIVPLSTPLENGQRVEIITAKEGHPS
            ||||||||||||||||||||||||||||||||||||||||||||||||||||||||||||
g117-1      GKVLSLPTGATPIDFAYALHSSIGDRCRGAKVEGQIVPLSTPLENGQRVEIITAKEGHPS
                   430       440       450       460       470       480

                   490       500       510       520       530       540
m117-1.pep  VNWLYEGWVKSNKAIGKIRAYIRQQNADTVREEGRVQLDKQLAKLTPKPNLQELAENLGY
            |||||||||||:||||||||||||||||||||||||||||||||||||||||||||||||
g117-1      VNWLYEGWVKSGKAIGKIRAYIRQQNADTVREEGRVQLDKQLAKLTPKPNLQELAENLGY
                   490       500       510       520       530       540

                   550       560       570       580       590       600
m117-1.pep  KKPEDLYTAVGQGEISNRAIQKACGTLNEPPPVPVSETTIVKQSKIKKGGKNGVLIDGED
            |||||||||||||||||||||||||||||||||||| ||||||||||||||:||||||||
g117-1      KKPEDLYTAVGQGEISNRAIQKACGTLNEPPPVPVSATTIVKQSKIKKGGKTGVLIDGED
                   550       560       570       580       590       600

                   610       620       630       640       650       660
m117-1.pep  GLMTTLAKCCKPAPPDDIIGFVTRERGISVHRKTCPSFQHLAEHAPEKVLDASWAALQEG
            ||||||||||||||||| ||||||||||||||||||||:|||||||||||||||||||||
g117-1      GLMTTLAKCCKPAPPDDIAGFVTRERGISVHRKTCPSFRHLAEHAPEKVLDASWAALQEG
                   610       620       630       640       650       660

                   670       680       690       700       710       720
m117-1.pep  QVFAVDIEIRAQDRSGLLRDVSDALARHKLNVTAVQTQSRDLEASMRFTLEVKQVNDLPR
            ||||||||||||||||||||||||||||||||||||||||||||||||||||||||||||
g117-1      QVFAVDIEIRAQDRSGLLRDVSDALARHKLNVTAVQTQSRDLEASMRFTLEVKQVNDLPR
                   670       680       690       700       710       720
```

-continued

```
                730
m117-1.pep  VLASLGDVKGVLSVTRLX
            |||:||||||||||||||
g117-1      VLAGLGDVKGVLSVTRLX
                730
```

m117-1/RelA sp|P55133|RELA_VIBSS GTP PYROPHOSPHOKINASE (ATP:GTP 3'-PYROPHOSPHOTRANSFERASE) (PPGPP SYNTHETASE I) >gi|537617 (U13769) ppGpp synthetase I [*Vibrio* sp.] Length=744

Score=536 bits (1366), Expect=e−151

Identities=288/685 (42%), Positives=432/685 (63%), Gaps=31/685 (4%)

```
Query:  74 LDLLPDAVAATLLADI---GRYVPDWNLLVSERCNSTVAELVKGVDEVQKLTHFARVDSL 130
           L +  D + A LL  +   G Y  D    + E  + T+  LV+GV+++  ++   ++ S
Sbjct:  68 LSMDADTLIAALLYPLVEGGCYSTD---ALKEEYSGTILHLVQGVEQMCAIS---QLKST 121

Query: 131 ATPEERAQQAETMRKMLLAMVTDIRVVLIKLAMRTRTLQFLSNAPDSPEKRAVAKETLDI 190
           A     +A Q + +R+MLL+MV D R V+ILKA R    L+ + + PD    +RA A+E  +I
Sbjct: 122 AEETAQAAQVDNIRRMLLSMVDDFRCVVIKLAERICNLREVKDQPDEV-RRAAAQECANI 180

Query: 191 FAPLANRLGVWQLKWQLEDLGFRHQKPEKYREIALLLDEKRTERLEYIENFLNILRGELK 250
           +APLANRLG+ QLKW++ED  FR+Q P+ Y++IA  L E+R +R +YI +F++ L   +K
Sbjct: 181 YAPLANRLGIGQLKWEIEDYAFRYQHPDTYKQIAKQLSERRIDREDYITHFVDDLSDAMK 240

Query: 251 KYNVHFEVAGRPKHIYSIYKKMVKKKLSFDGLFDIRAVRILVDTVPECYTTLGIVHSLWQ 310
              N+  EV GRPKHIYSI++KM KK L FD LFD+RAVRI+ + + +CY  LG+VH+ ++
Sbjct: 241 ASNIRAEVQGRPKHIYSIWRKMQKKSLEFDELFDVRAVRIVAEELQDCYAALGVVHTKYR 300

Query: 311 PIPGEFDDYIANPKGNGYKSLHTVIVGPEDKGVEVQIRTFDMHQFNEFGVAAHWRYKEG- 369
             +P EFDDY+ANPK NGY+S+HTV++GPE K +E+QIRT  MH+ +E GVAAHW+YKEG
Sbjct: 301 HLPKEFDDYVANPKPNGYQSIHTVVLGPEGKTIEIQIRTKQMHEESELGVAAHWKYKEGT 360

Query: 370 --GKGDSAYEQKIAWLRQLLDWRENMAESGKEDLAAAFKTELFNDTIYVLTPHGKVLSLP 427
             G    SAY++KI WLR+LL W+E M++SG  ++    ++++F+D +Y  TP G V+ LP
Sbjct: 361 ASGGAQSAYDEKINWLRKLLAWQEEMSDSG--EMLDELRSQVFDDRVYAFTPKGDVVDLP 418

Query: 428 TGATPIDFAYALHSSIGDRCRGAKVEGQIVPLSTPLENGQRVEIITAKEGHPSVNWLYE- 486
           + ATP+DFAY +HS +G RC GAKVEG+IVP +  L+ G +VEIIT KE +PS +WL
Sbjct: 419 SNATPLDFAYHIHSEVGHRCIGAKVEGRIVPFTYHLQMGDQVEIITQKEPNPSRDWLNPN 478

Query: 487 -GWVKSNKAIGKIRAYIRQQNADTVREEGRVQLDKQLAKL--TPKPNLQELAENLGYKKP 543
            G+V S++A  K+ A+ R+Q+ D      G+  L+ +L K+  T K       A+     K P
Sbjct: 479 LGFVTSSRARAKVHAWFRKQDRDKNIIAGKEILEAELVKIHATLKDAQYYAAKRFNVKSP 538

Query: 544 EDLYTAVGQGEIS-NRAIQKACGTLNEPPPVPVSETTIVKQSKI--------KKGGKNGV 594
           E+LY  +G G++  N+ I       +N+P       +  + K S++         KK  ++ V
Sbjct: 539 EELYAGIGSGDLRINQVINHINALVNKPTAEEEDQQLLEKLSEASNKQATSHKKPQRDAV 598

Query: 595 LIDGEDGLMTTLAKCCKPAPPDDIIGFVTRERGISVHRKTCPSFQHLAEHAPEKVLDASW 654
           +++G D LMT LA+CC+P P DDI GFVT+ RGISVHR  C   + L  HAPE+++D  W
Sbjct: 599 VVEGVDNLMTHLARCCQPIPGDDIQGFVTQGRGISVHRMDCEQLEELRHHAPERIIDTVW 658

Query: 655 AALQEGQVFAVDIEIRAQDRSGLLRDVSDALARHKLNVTAVQTQ--SRDLEASMRFTLEV 712
                G  + + + + A +R+GLL+++++ L    K+ V  ++++   +  + M F LE+
Sbjct: 659 GGGFVGN-YTITVRVTASERNGLLKELTNTLMNEKVKVAGMKSRVDYKKQMSIMDFELEL 717

Query: 713 KQVNDLPRVLASLGDVKGVLSVTRL                                    737
             +  L RVL  +  VK V    RL
Sbjct: 718 TDLEVLGRVLKRIEQVKDVAEAKRL                                    742
```

The following partial DNA sequence was identified in *N. meningitidis* <SEQ ID 421>:

a117-1.seq

```
  1 ATGACCGCCA TCAGCCCGAT TCAAGACACG CAAAGCGCGA CTCTGCAAGA

 51 ATTGCGCGAA TGGTTCGACA GCTACTGCAC CGCGCTGCCG AACAACGATA

101 AAAAACTTGT CTTAGCCGCC CGTTCGCTGG CGGAAGCACA TTACCCCGCC
```

-continued

```
 151 GATGCCGCCA CGCCGTATGG CGAACCGCTG CCCGACCACT TCCTCGGCGC
 201 GGCGCAAATG GTTCATGAAC TCGACCTGCT CCCCGATGCC GTCGCCGCCA
 251 CCCTGCTTGC CGACATCGGA CGCTACGTCC CCGACTGGAA CCTATTGGTT
 301 TCCGAACGCT GCAACAGTAC CGTCGCCGAG CTGGTCAAAG GTGTGGACGA
 351 AGTGCAGAAA CTCACCCACT TCGCCCGGGT GGACAGCCTC GCCACGCCGG
 401 AAGAACGCGC CCAGCAGGCA GAAACTATGC GGAAAATGCT GCTGGCGATG
 451 GTTACCGACA TCCGCGTCGT GTTAATCAAA CTGGCGATGC GTACGCGCAC
 501 CCTGCAATTT TTAAGCAACG CCCCCGACAG CCCCGAAAAA CGCGCCGTCG
 551 CCAAAGAAAC CCTCGACATC TTCGCCCCGC TCGCCAACCG TTTGGGCGTG
 601 TGGCAGCTCA AATGGCAGCT CGAAGATTTG GGCTTCCGCC ATCAAGAACC
 651 CGAAAAATAC CGCGAAATCG CCCTGCTTTT GGACGAAAAA CGCACCGAAC
 701 GCCTCGAATA CATCGAAAAC TTCCTTAATA TCCTGCGTAC GGAACTCAAA
 751 AAATACAATA TCCACTTTGA AGTCGCCGGC CGTCCGAAAC ACATCTACTC
 801 CATTTACAAA AAAATGGTGA AGAAAAAACT CAGCTTCGAC GGGTTGTTCG
 851 ACATCCGCGC CGTGCGGATT CTGGTTGATA CCGTCCCCGA GTGTTACACC
 901 ACACTGGGCA TTGTCCACAG CCTCTGGCAG CCCATTCCCG GCGAGTTCGA
 951 CGACTACATC GCCAACCCGA AAGGCAACGG CTATAAAAGT TTGCACACCG
1001 TCATCGTCGG CCCGGAAGAC AAAGGCGTGG AAGTGCAAAT CCGCACCTTC
1051 GATATGCACC AATTCAACGA ATTCGGTGTC GCCGCGCACT GGCGTTACAA
1101 AGAGGGCGGC AAAGGCGATT CCGCCTACGA ACAAAAAATC GCCTGGTTAC
1151 GCCAACTTTT GGACTGGCGC GAAAACATGG CGGAAAGCGG CAAGGAAGAC
1201 CTCGCCGCCG CCTTCAAAAC CGAGCTTTTC AACGACACGA TTTATGTTTT
1251 GACCCCGCAC GGCAAAGTCC TCTCCCTGCC CACAGGCGCG ACCCCCATCG
1301 ACTTCGCCTA CGCCCTGCAC AGCAGCATCG GCGACCGTTG CCGCGGTGCG
1351 AAAGTCGAAG GGCAGATTGT GCCGCTGTCC ACCCCGCTCG AAAACGGACA
1401 GCGTGTCGAA ATCATTACCG CCAAAGAAGG GCATCCTTCC GTCAACTGGC
1451 TTTACGAAGG CTGGGTCAAA TCCAACAAGG CAATCGGCAA AATCCGCGCC
1501 TACATCCGCC AGCAAAACGC CGACACCGTG CGCGAAGAAG GCCGCGTCCA
1551 ACTCGACAAA CAGCTTGCCA AACTCACGCC CAAACCCAAC CTGCAAGAGC
1601 TTGCCGAAAA TCTCGGCTAC AAAAAGCCAG AAGACCTCTA CACCGCCGTC
1651 GGACAAGGCG AAATTTCCAA CCGCGCCATC CAAAAAGCCT GCGGCACGCT
1701 GAACGAACCG CCGCCCGTAC CCGTCAGCGA AACCACCATC GTCAAACAGT
1751 CCAAAATCAA AAAAGGCGGC AAAAACGGCG TGCTCATCGA CGGCGAAGAC
1801 GGTCTGATGA CCACGCTTGC CAAATGCTGC AAACCCGCGC CGCCCGACGA
1851 CATTGTCGGC TTCGTTACCC GCGATCGCGG CATTTCGGTA CACCGCAAAA
1901 CCTGCCCCTC TTTCCGACAC CTCGCCGAAC ACGCGCCCGA AAAAGTACTG
1951 GACGCAAGTT GGGCGGCGTT GCAGGAAGGA CAAGTGTTCG CCGTCGATAT
2001 CGAAATCCGC GCCCAAGACC GCTCCGGGCT TTTGCGCGAC GTATCCGACG
2051 CGCTCGCCCG CCACAAACTC AACGTTACCG CCGTGCAAAC CCAGTCCCGC
2101 GACTTGGAAG CCAGCATGAG GTTCACGCTC GAAGTCAAAC AAGTTACCGA
```

-continued

```
2151 CCTCCCACGC GTCCTCGCCA GCCTCGGCGA CGTCAAAGGC GTATTGAGCG

2201 TTACCCGGCT TTAA
```

This corresponds to the amino acid sequence <SEQ ID 422; ORF 117-1.a>:

a117-1.pep

```
  1 MTAISPIQDT QSATLQELRE WFDSYCTALP NNDKKLVLAA RSLAEAHYPA

 51 DAATPYGEPL PDHFLGAAQM VHELDLLPDA VAATLLADIG RYVPDWNLLV

101 SERCNSTVAE LVKGVDEVQK LTHFARVDSL ATPEERAQQA ETMRKMLLAM

151 VTDIRVVLIK LAMRTRTLQF LSNAPDSPEK RAVAKETLDI FAPLANRLGV

201 WQLKWQLEDL GFRHQEPEKY REIALLLDEK RTERLEYIEN FLNILRTELK

251 KYNIHFEVAG RPKHIYSIYK KMVKKKLSFD GLFDIRAVRI LVDTVPECYT

301 TLGIVHSLWQ PIPGEFDDYI ANPKGNGYKS LHTVIVGPED KGVEVQIRTF

351 DMHQFNEFGV AAHWRYKEGG KGDSAYEQKI AWLRQLLDWR ENMAESGKED

401 LAAAFKTELF NDTIYVLTPH GKVLSLPTGA TPIDFAYALH SSIGDRCRGA

451 KVEGQIVPLS TPLENGQRVE IITAKEGHPS VNWLYEGWVK SNKAIGKIRA

501 YIRQQNADTV REEGRVQLDK QLAKLTPKPN LQELAENLGY KKPEDLYTAV

551 GQGEISNRAI QKACGTLNEP PPVPVSETTI VKQSKIKKGG KNGVLIDGED

601 GLMTTLAKCC KPAPPDDIVG FVTRDRGISV HRKTCPSFRH LAEHAPEKVL

651 DASWAALQEG QVFAVDIEIR AQDRSGLLRD VSDALARHKL NVTAVQTQSR

701 DLEASMRFTL EVKQVTDLPR VLASLGDVKG VLSVTRL*
```

a117-1/m117-1 97.7% identity in 737 aa overlap

```
                    10        20        30        40        50        60
m117-1.pep  MTAISPIQDTQSATLQELREWFDSYCAALPDNDKNLIGTAWLLAQEHYPADAATPYGEPL
            ||||||||||||||||||||||||||:||:|||:|: :|  ||: |||||||||||||||
a117-1      MTAISPIQDTQSATLQELREWFDSYCTALPNNDKKLVLAARSLAEAHYPADAATPYGEPL
                    10        20        30        40        50        60

                    70        80        90       100       110       120
m117-1.pep  PDHFLGAAQMVHELDLLPDAVAATLLADIGRYVPDWNLLVSERCNSTVAELVKGVDEVQK
            ||||||||||||||||||||||||||||||||||||||||||||||||||||||||||||
a117-1      PDHFLGAAQMVHELDLLPDAVAATLLADIGRYVPDWNLLVSERCNSTVAELVKGVDEVQK
                    70        80        90       100       110       120

                   130       140       150       160       170       180
m117-1.pep  LTHFARVDSLATPEERAQQAETMRKMLLAMVTDIRVVLIKLAMRTRTLQFLSNAPDSPEK
            ||||||||||||||||||||||||||||||||||||||||||||||||||||||||||||
a117-1      LTHFARVDSLATPEERAQQAETMRKMLLAMVTDIRVVLIKLAMRTRTLQFLSNAPDSPEK
                   130       140       150       160       170       180

                   190       200       210       220       230       240
m117-1.pep  RAVAKETLDIFAPLANRLGVWQLKWQLEDLGFRHQKPEKYREIALLLDEKRTERLEYIEN
            ||||||||||||||||||||||||||||||||||:|||||||||||||||||||||||||
a117-1      RAVAKETLDIFAPLANRLGVWQLKWQLEDLGFRHQEPEKYREIALLLDEKRTERLEYIEN
                   190       200       210       220       230       240

                   250       260       270       280       290       300
m117-1.pep  FLNILRGELKKYNVHFEVAGRPKHIYSIYKKMVKKKLSFDGLFDIRAVRILVDTVPECYT
            |||||| ||||||:||||||||||||||||||||||||||||||||||||||||||||||
a117-1      FLNILRTELKKYNIHFEVAGRPKHIYSIYKKMVKKKLSFDGLFDIRAVRILVDTVPECYT
                   250       260       270       280       290       300

                   310       320       330       340       350       360
m117-1.pep  TLGIVHSLWQPIPGEFDDYIANPKGNGYKSLHTVIVGPEDKGVEVQIRTFDMHQFNEFGV
            ||||||||||||||||||||||||||||||||||||||||||||||||||||||||||||
a117-1      TLGIVHSLWQPIPGEFDDYIANPKGNGYKSLHTVIVGPEDKGVEVQIRTFDMHQFNEFGV
                   310       320       330       340       350       360
```

-continued

```
                370       380       390       400       410       420
m117-1.pep  AAHWRYKEGGKGDSAYEQKIAWLRQLLDWRENMAESGKEDLAAAFKTELFNDTIYVLTPH
            ||||||||||||||||||||||||||||||||||||||||||||||||||||||||||||
a117-1      AAHWRYKEGGKGDSAYEQKIAWLRQLLDWRENMAESGKEDLAAAFKTELFNDTIYVLTPH
                370       380       390       400       410       420

                430       440       450       460       470       480
m117-1.pep  GKVLSLPTGATPIDFAYALHSSIGDRCRGAKVEGQIVPLSTPLENGQRVEIITAKEGHPS
            ||||||||||||||||||||||||||||||||||||||||||||||||||||||||||||
a117-1      GKVLSLPTGATPIDFAYALHSSIGDRCRGAKVEGQIVPLSTPLENGQRVEIITAKEGHPS
                430       440       450       460       470       480
                490       500       510       520       530       540
m117-1.pep  VNWLYEGWVKSNKAIGKIRAYIRQQNADTVREEGRVQLDKQLAKLTPKPNLQELAENLGY
            ||||||||||||||||||||||||||||||||||||||||||||||||||||||||||||
a117-1      VNWLYEGWVKSNKAIGKIRAYIRQQNADTVREEGRVQLDKQLAKLTPKPNLQELAENLGY
                490       500       510       520       530       540
                550       560       570       580       590       600
m117-1.pep  KKPEDLYTAVGQGEISNRAIQKACGTLNEPPPVPVSETTIVKQSKIKKGGKNGVLIDGED
            ||||||||||||||||||||||||||||||||||||||||||||||||||||||||||||
a117-1      KKPEDLYTAVGQGEISNRAIQKACGTLNEPPPVPVSETTIVKQSKIKKGGKNGVLIDGED
                550       560       570       580       590       600
                610       620       630       640       650       660
m117-1.pep  GLMTTLAKCCKPAPPDDIIGFVTRERGISVHRKTCPSFQHLAEHAPEKVLDASWAALQEG
            |||||||||||||||||||:|||||:|||||||||||||:||||||||||||||||||||
a117-1      GLMTTLAKCCKPAPPDDIVGFVTRDRGISVHRKTCPSFRHLAEHAPEKVLDASWAALQEG
                610       620       630       640       650       660
                670       680       690       700       710       720
m117-1.pep  QVFAVDIEIRAQDRSGLLRDVSDALARHKLNVTAVQTQSRDLEASMRFTLEVKQVNDLPR
            |||||||||||||||||||||||||||||||||||||||||||||||||||||||:||||
a117-1      QVFAVDIEIRAQDRSGLLRDVSDALARHKLNVTAVQTQSRDLEASMRFTLEVKQVTDLPR
                670       680       690       700       710       720
                730
m117-1.pep  VLASLGDVKGVLSVTRLX
            ||||||||||||||||||
a117-1      VLASLGDVKGVLSVTRLX
                730
```

The following partial DNA sequence was identified in *N. gonorrhoeae* <SEQ ID 423>:

```
g118.seq

  1 ATGTGCGAGT TCAAGGATTT TAGAAGAAAC ATCCCTTGTT TTGAAGAGTA

 51 TGACGAAAAT TCATTTATTG GCAAATGGTA TGATGACGGG GTGTGGGATG

101 ATGAAGAATA TTGGAAGCTG GAGAATGATT TAATcgaGGT TAGGAGAAAA

151 TATCCTTATC CGATGGATAT ACCAAGGGAT ATTGTGATTG GAATCGGTAC

201 CATTATTGAT TTTTTAATGG TTCCAAATTG GGAGCTTTTT GAAATTAAAG

251 CTTCCCCTTG GTTGCCTGAT AGCGTGGGAA TTCATGAACG TTATGAAAGA

301 TTCACAACGA TGCTCCGTTA TATTTTTACC GAGAAAGACA TAGTCAACGT

351 GCGATTTGAT TATTACAaCA AAAAATAG
```

This corresponds to the amino acid sequence <SEQ ID 424; ORF 118.ng>:

```
g118.pep

  1 MCEFKDFRRN IPCFEEYDEN SFIGKWYDDG VWDDEEYWKL ENDLIEVRRK

 51 YPYPMDIPRD IVIGIGTIID FLMVPNWELF EIKASPWLPD SVGIHERYER

101 FTTMLRYIFT EKDIVNVRFD YYNKK*
```

The following partial DNA sequence was identified in *N. meningitidis* <SEQ ID 425>:

m118.seq

```
  1 ATGTGTGAGT TCAAGGATAT TATAAGAAAC GTTCCTTATT TTGAGGGGTA
 51 TGACGAAAAT TCATTTATTG GCAAATGGTA TGATGACGGG GTGTGGGATG
101 ATGAAGAATA TTGGAAGTTG GAGAATGATT TAATCGAGGT TAGAAAAAAA
151 TATCCTTATC CGATGGACAT ACCAAGATAT GTTGTCATTG GAATCGGTAC
201 CATTATTGAT TTCTTAATGG TTCCAAATTG GAAACTTTTT GAAATTAAAG
251 CTTCCCCTTG GTTGCCTGAT AGTGTGGGAA TTCATGAACG TTATGAAAGA
301 TTCACAACGA TGCTCCGTTA TATTTTTACC GAGAAAGACA TAGTCAACGT
351 GCGATTTGAT TATTACAACA AAAAATAG
```

This corresponds to the amino acid sequence <SEQ ID 426; ORF 118>:

m118.pep

```
  1 MCEFKDIIRN VPYFEGYDEN SFIGKWYDDG VWDDEEYWKL ENDLIEVRKK
 51 YPYPMDIPRY VVIGIGTIID FLMVPNWKLF EIKASPWLPD SVGIHERYER
101 FTTMLRYIFT EKDIVNVRFD YYNKK*
```

Computer analysis of this amino acid sequence gave the following results:

Homology with a predicted ORF from *N. gonorrhoeae*

ORF 118 shows 92.8% identity over a 125 aa overlap with a predicted ORF (ORF 118.ng) from *N. gonorrhoeae*:

m118/g118

```
                   10        20        30        40        50        60
m118.pep  MCEFKDIIRNVPYFEGYDENSFIGKWYDDGVWDDEEYWKLENDLIEVRKKYPYPMDIPRY
          ||||||: ||:| || |||||||||||||||||||||||||||||||:||||||||||
g118      MCEFKDFRRNIPCFEEYDENSFIGKWYDDGVWDDEEYWKLENDLIEVRRKYPYPMDIPRD
                   10        20        30        40        50        60

                   70        80        90       100       110       120
m118.pep  VVIGIGTIIDFLMVPNWKLFEIKASPWLPDSVGIHERYERFTTMLRYIFTEKDIVNVRFD
          :||||||||||||||||:||||||||||||||||||||||||||||||||||||||||||
g118      IVIGIGTIIDFLMVPNWELFEIKASPWLPDSVGIHERYERFTTMLRYIFTEKDIVNVRFD
                   70        80        90       100       110       120

m118.pep  YYNKKX
          ||||||
g118      YYNKKX
```

The following partial DNA sequence was identified in *N. meningitidis* <SEQ ID 427>:

a118.seq

```
  1 ATGTGTGAGT TCAAGGATTT TAGAAGAAAC ATCCCTTGTT TTGAAGAGTA
 51 TGACGAAAAT TCATTTATTG GCAAATGGTA TGATGACGGG GTGTGGGATG
101 ATGAAGAATA TTGGAAATTG GAGAATGATT TAATCGAGGT TAGAAAAAAA
151 TATCCTTATC CGATGGATAT ACCAAGGGAT ATTGTGATTG GAATCGGTAC
201 CATTATTGAT TTTTTAATGG TTCCAAATTG GGAGCTTTTT GAAATTAAAG
```

-continued

```
251 CTTCCCCTTG GTTGCCTGAT AGTGTGGGAA TTCATGAACG TTATGAAAGA

301 TTCACAACGA TGCTCCGTTA TATTTTTACC GAGAAAGACA TAGTCAACGT

351 GCGATTTGAT TATTACAACA AAAAATAG
```

This corresponds to the amino acid sequence <SEQ ID 428; ORF 118.a>:

a118.pep

```
  1 MCEFKDFRRN IPCFEEYDEN SFIGKWYDDG VWDDEEYWKL ENDLIEVRKK

 51 YPYPMDIPRD IVIGIGTIID FLMVPNWELF EIKASPWLPD SVGIHERYER

101 FTTMLRYIFT EKDIVNVRFD YYNKK*
```

m118/a118 93.6% identity in 125 aa overlap

```
                    10        20        30        40        50        60
m118.pep   MCEFKDIIRNVPYFEGYDENSFIGKWYDDGVWDDEEYWKLENDLIEVRKKYPYPMDIPRY
           ||||||: ||:| || ||||||||||||||||||||||||||||||||||||||||||| 
a118       MCEFKDFRRNIPCFEEYDENSFIGKWYDDGVWDDEEYWKLENDLIEVRKKYPYPMDIPRD
                    10        20        30        40        50        60

                    70        80        90       100       110       120
m118.pep   VVIGIGTIIDFLMVPNWKLFEIKASPWLPDSVGIHERYERFTTMLRYIFTEKDIVNVRFD
           :|||||||||||||||:|||||||||||||||||||||||||||||||||||||||||||
a118       IVIGIGTIIDFLMVPNWELFEIKASPWLPDSVGIHERYERFTTMLRYIFTEKDIVNVRFD
                    70        80        90       100       110       120

m118.pep   YYNKKX
           ||||||
a118       YYNKKX
```

The following partial DNA sequence was identified in *N. gonorrhoeae* <SEQ ID 429>:

g120.seq

```
  1 ATGATGAAGA CTTTTAAAAA TATATTTTCC GCCGCCATTT TGTCCGCCGC

 51 CCTGCCGTGC GCGTATGCGG CAAGGCTACC CCAATCCGCC GTGCTGCACT

101 ATTCCGGCAG CTACGGCATT CCCGCCACGA TGACATTTGA ACGCAGCGGC

151 AATGCTTACA AAATCGTTTC GACGATTAAA GTGCCGCTAT ACAATATCCG

201 TTTCGAATCC GGCGGTACGG TTGTCGGCAA TACCCTGCAC CCTGCCTACT

251 ATAAAGACAT ACGCAGGGGC AAACTGTATG CGGAAGCCAA ATTCGCCGAC

301 GGCAGCGTAA CCTACGGCAA AGCGGGCGAG AGCAAAACCG AGCAAAGCCC

351 CAAGGCTATG GATTTGTTCA CGCTTGCCTG GCAGTTGGCG GCAAATGACG

401 CGAAACTCCC CCCGGGTCTG AAAATCACCA ACGGCAAAAA ACTTTATTCC

451 GTCGGCGGCC TGAATAAGGC GGGTACGGGA AAATACAGCA Taggcggcgt

501 gGAAACCGAA GTCGTCAAAT ATCGGGTGCG GCGCGGCGAC GATACGGTAA

551 CGTATTTCTT CGCACCGTCC CTGAACAATA TTCCGGCACA AATCGGCTAT

601 ACCGAcgaCG GCAAAACCTA TACGCTGAAG CTCAAATCGG TGCAGATCAA

651 CGGACAGGCC GCCAAACCGT AA
```

This corresponds to the amino acid sequence <SEQ ID 430; ORF 120.ng>:

g120.pep

```
  1 MMKTFKNIFS AAILSAALPC AYAARLPQSA VLHYSGSYGI PATMTFERSG
 51 NAYKIVSTIK VPLYNIRFES GGTVVGNTLH PAYYKDIRRG KLYAEAKFAD
101 GSVTYGKAGE SKTEQSPKAM DLFTLAWQLA ANDAKLPPGL KITNGKKLYS
151 VGGLNKAGTG KYSIGGVETE VVKYRVRRGD DTVTYFFAPS LNNIPAQIGY
201 TDDGKTYTLK LKSVQINGQA AKP*
```

The following partial DNA sequence was identified in *N. meningitidis* <SEQ ID 431>:

m120.seq

```
  1 ATGATGAAGA CTTTTAAAAA TATATTTTCC GCCGCCATTT TGTCCGCCGC
 51 CCTGCCGTGC GCGTATGCGG CAGGGCTGCC CCAATCCGCC GTGCTGmACT
101 ATTCCGGCAG CTACGGCATT CCCGCCACGA TGACATTTGA ACGCAGCGGC
151 AATGCTTACA AAATCGTTTC GACGATTAAA GTGCCGCTAT ACAATATCCG
201 TTTCGAGTCC GGCGGTACGG TTGTCGGCAA TACCCTGCAC CCTACCTACT
251 ATAGAGACAT ACGCAGGGGC AAACTGTATG CGGAAGCcAA ATTCGCCGAC
301 GGCAGCGTAA CTTACGGCAA AGCGGGCGAG AGCAAAACCG AGCAAAGCCC
351 CAAGGCTATG GATTTGTTCA CGCTTGCCTG GCAGTTGGCG GCAAATGACG
401 CGAAACTCCC CCCGGGGCTG AAAATCACCA ACGGCAAAAA ACTTTATTCC
451 GTCGGCGGTT TGAATAAGGC GGGTACAGGA AAATACAGCA TAGGCGGCGT
501 GGAAACCGAA GTCGTCAAAT ATCGGGTGCG GCGCGGCGAC GATGCGGTAA
551 TGTATTTCTT CGCACCGTCC CTGAACAATA TTCCGGCACA AATCGGCTAT
601 ACCGACGACG GCAAAACCTA TACGCTGAAA CTCAAATCGG TGCAGATCAA
651 CGGCCAGGCA GCCAAACCG
```

This corresponds to the amino acid sequence <SEQ ID 432: ORF 120>:

m120.pep

```
  1 MMKTFKNIFS AAILSAALPC AYAAGLPQSA VLXYSGSYGI PATMTFERSG
 51 NAYKIVSTIK VPLYNIRFES GGTVVGNTLH PTYYRDIRRG KLYAEAKFAD
101 GSVTYGKAGE SKTEQSPKAM DLFTLAWQLA ANDAKLPPGL KITNGKKLYS
151 VGGLNKAGTG KYSIGGVETE VVKYRVRRGD DAVMYFFAPS LNNIPAQIGY
201 TDDGKTYTLK LKSVQINGQA AKP
```

Computer analysis of this amino acid sequence gave the following results:

Homology with a predicted ORF from *N. gonorrhoeae*

ORF 120 shows 97.3% identity over a 223 aa overlap with a predicted ORF (ORF 120.ng) from *N. gonorrhoeae*:

m120/g120

```
                  10        20        30        40        50        60
m120.pep  MMKTFKNIFSAAILSAALPCAYAAGLPQSAVLXYSGSYGIPATMTFERSGNAYKIVSTIK
          ||||||||||||||||||||||| ||||||| ||||||||||||||||||||||||||||
g120      MMKTFKNIFSAAILSAALPCAYAARLPQSAVLHYSGSYGIPATMTFERSGNAYKIVSTIK
                  10        20        30        40        50        60

                  70        80        90       100       110       120
m120.pep  VPLYNIRFESGGTVVGNTLHPTYYRDIRRGKLYAEAKFADGSVTYGKAGESKTEQSPKAM
          |||||||||||||||||||||||:||:|||||||||||||||||||||||||||||||||
g120      VPLYNIRFESGGTVVGNTLHPAYYKDIRRGKLYAEAKFADGSVTYGKAGESKTEQSPKAM
                  70        80        90       100       110       120

                 130       140       150       160       170       180
m120.pep  DLFTLAWQLAANDAKLPPGLKITNGKKLYSVGGLNKAGTGKYSIGGVETEVVKYRVRRGD
          ||||||||||||||||||||||||||||||||||||||||||||||||||||||||||||
g120      DLFTLAWQLAANDAKLPPGLKITNGKKLYSVGGLNKAGTGKYSIGGVETEVVKYRVRRGD
                 130       140       150       160       170       180

                 190       200       210       220
m120.pep  DAVMYFFAPSLNNIPAQIGYTDDGKTYTLKLKSVQINGQAAKP
          |:| |||||||||||||||||||||||||||||||||||||||
g120      DTVTYFFAPSLNNIPAQIGYTDDGKTYTLKLKSVQINGQAAKPX
                 190       200       210       220
```

The following partial DNA sequence was identified in *N. meningitidis* <SEQ ID 433>:

a120.seq

```
  1 ATGATGAAGA CTTTTAAAAA TATATTTTCC GCCGCCATTT TGTCCGCCGC
 51 CCTGCCGTGC GCGTATGCGG CAGGGCTGCC CCAATCCGCC GTGCTGCACT
101 ATTCCGGCAG CTACGGCATT CCCGCCACGA TGACATTTGA ACGCAGCGGC
151 AATGCTTACA AAATCGTTTC GACGATTAAA GTGCCGCTAT ACAATATCCG
201 TTTCGAGTCC GGCGGTACGG TTGTCGGCAA TACCCTGCAC CCTACCTACT
251 ATAGAGACAT ACGCAGGGGC AAACTGTATG CGGAAGCCAA ATTCGCCGAC
301 GGCAGCGTAA CCTACGGCAA AGCGGGCGAG AGCAAAACCG AGCAAAGCCC
351 CAAGGCTATG GATTTGTTCA CGCTTGCCTG GCAGTTGGCG GCAAATGACG
401 CGAAACTCCC CCCGGGGCTG AAAATCACCA ACGGCAAAAA ACTTTATTCC
451 GTCGGCGGTT TGAATAAGGC GGGTACAGGA AAATACAGCA TAGGCGGCGT
501 GGAAACCGAA GTCGTCAAAT ATCGGGTGCG GCGCGGCGAC GATGCGGTAA
551 TGTATTTCTT CGCACCGTCC CTGAACAATA TTCCGGCACA AATCGGCTAT
601 ACCGACGACG GCAAAACCTA TACGCTGAAA CTCAAATCGG TGCAGATCAA
651 CGGCCAGGCA GCCAAACCGT AA
```

This corresponds to the amino acid sequence <SEQ ID 434; ORF 120.a>:

a120.pep

```
  1 MMKTFKNIFS AAILSAALPC AYAAGLPQSA VLHYSGSYGI PATMTFERSG
 51 NAYKIVSTIK VPLYNIRFES GGTVVGNTLH PTYYRDIRRG KLYAEAKFAD
102 GSVTYGKAGE SKTEQSPKAM DLFTLAWQLA ANDAKLPPGL KITNGKKLYS
151 VGGLNKAGTG KYSIGGVETE VVKYRVRRGD DAVMYFFAPS LNNIPAQIGY
201 TDDGKTYTLK LKSVQINGQA AKP*
```

m120/a120 99.6% identity in 223 aa overlap

```
                    10         20         30         40         50         60
m120.pep   MMKTFKNIFSAAILSAALPCAYAAGLPQSAVLXYSGSYGIPATMTFERSGNAYKIVSTIK
           ||||||||||||||||||||||||||||||||| ||||||||||||||||||||||||||
a120       MMKTFKNIFSAAILSAALPCAYAAGLPQSAVLHYSGSYGIPATMTFERSGNAYKIVSTIK
                    10         20         30         40         50         60

                    70         80         90        100        110        120
m120.pep   VPLYNIRFESGGTVVGNTLHPTYYRDIRRGKLYAEAKFADGSVTYGKAGESKTEQSPKAM
           ||||||||||||||||||||||||||||||||||||||||||||||||||||||||||||
a120       VPLYNIRFESGGTVVGNTLHPTYYRDIRRGKLYAEAKFADGSVTYGKAGESKTEQSPKAM
                    70         80         90        100        110        120

                   130        140        150        160        170        180
m120.pep   DLFTLAWQLAANDAKLPPGLKITNGKKLYSVGGLNKAGTGKYSIGGVETEVVKYRVRRGD
           ||||||||||||||||||||||||||||||||||||||||||||||||||||||||||||
a120       DLFTLAWQLAANDAKLPPGLKITNGKKLYSVGGLNKAGTGKYSIGGVETEVVKYRVRRGD
                   130        140        150        160        170        180

                   190        200        210        220
m120.pep   DAVMYFFAPSLNNIPAQIGYTDDGKTYTLKLKSVQINGQAAKPX
           ||||||||||||||||||||||||||||||||||||||||||||
a120       DAVMYFFAPSLNNIPAQIGYTDDGKTYTLKLKSVQINGQAAKPX
                   190        200        210        220
```

The following partial DNA sequence was identified in *N. gonorrhoeae* <SEQ ID 435>:

<u>g121.seq</u>

```
   1 ATGGAAACAC AGCTTTACAT CGGCATTATG TCGGGAACCA GTATGGACGG
  51 GGCGGATGCC GTGCTGGTAC GGATGGACGG CGGCAAATGG CTGGGCGCGG
 101 AAGGGCACGC CTTTACCCCC TACCCTGACC GGTTGCGCCG CAAATTGCTG
 151 GATTTGCAGG ACACAGGCAC AGACGAACTG CACCGCAGCA GGATGTTGTC
 201 GCAAGAACTC AGCCGCCTGT ACGCGCAAAC CGCCGCCGAA CTGCTGTGCA
 251 GTCAAAACCT CGCTCCGTGC GACATTACCG CCCTCGGCTG CCACGGGCAA
 301 ACCGTCCGAC ACGCGCCGGA ACACGGTtac AGCATACAGC TTGCCGATTT
 351 GCCGCTGCTG GCGGAACTGa cgcggatttT TACCGTCggc gacttcCGCA
 401 GCCGCGACCT TGCTGCCGGC GGacaAGGTG CGCCGCTCGT CCCCGCCTTT
 451 CACGAAGCCC TGTTCCGCGA TGACAGGGAA ACACGCGTGG TACTGAACAT
 501 CGGCGGGATT GCCAACATCA GCGTACTCCC CCCCGGCGCA CCCGCCTTCG
 551 GCTTCGACAC AGGGCCGGGC AATATGCTGA TGGAcgcgtg gacgcaggca
 601 cacTGGcagc TGCCTTACGA CAAAAacggt gcAAAGgcgg cacAAGGCAA
 651 catatTGCcg cAACTGCTCG gcaggctGCT CGCCcaccCG TATTTCTCAC
 701 AACCCcaccc aaAAAGCACG GGgcGCGaac TgtttgcccT AAattggctc
 751 gaaacctAcc ttgacggcgg cgaaaaaccga tacgacgtat tgcggacgct
 801 ttcccgattc accgcgcaaA ccgTttggga cgccgtctca CACGCAGCGG
 851 CAGATGCCCG TCAAATGTAC ATTTGCGGCG GCGGCATCCG CAATCCTGTT
 901 TTAATGGCGG ATTTGGCAGA ATGTTTCGGC ACACGCGTTT CCCTGCACAG
 951 CACCGCCGAA CTGAACCTCG ATCCTCAATG GGTGGAGGCG gccgCATTtg
1001 cgtggttggC GGCGTGTTGG ATTAACCGCA TTCCCGGTAG TCCGCACAAA
1051 GCGACCGGCG CATCCAAACC GTGTATTCTG GGCGCGGGAT ATTATTATTG
1101 A
```

This corresponds to the amino acid sequence <SEQ ID 436; ORF 121.ng>:

g121.pep

```
  1 METQLYIGIM SGTSMDGADA VLVRMDGGKW LGAEGHAFTP YPDRLRRKLL
 51 DLQDTGTDEL HRSRMLSQEL SRLYAQTAAE LLCSQNLAPC DITALGCHGQ
101 TVRHAPEHGY SIQLADLPLL AELTRIFTVG DFRSRDLAAG GQGAPLVPAF
151 HEALFRDDRE TRVVLNIGGI ANISVLPPGA PAFGFDTGPG NMLMDAWTQA
201 HWQLPYDKNG AKAAQGNILP QLLGRLLAHP YFSQPHPKST GRELFALNWL
251 ETYLDGGENR YDVLRTLSRF TAQTVWDAVS HAAADARQMY ICGGGIRNPV
301 LMADLAECFG TRVSLHSTAE LNLDPQWVEA AAFAWLAACW INRIPGSPHK
351 ATGASKPCIL GAGYYY*
```

The following partial DNA sequence was identified in *N. meningitidis* <SEQ ID 437>:

m121.seq

```
   1 ATGGAAACAC AGCTTTACAT CGGCATCATG TCGGGAACCA GCATGGACGG
  51 GGCGGATGCC GTACTGATAC GGATGGACGG CGGCAAATGG CTGGGCGCGG
 101 AAGGGCACGC CTTTACCCCC TACCCCGGCA GGTTACGCCG CCAATTGCTG
 151 GATTTGCAGG ACACAGGCGC AGACGAACTG CACCGCAGCA GGATTTTGTC
 201 GCAAGAACTC AGCCGCCTAT ATGCGCAAAC CGCCGCCGAA CTGCTGTGCA
 251 GTCAAAACCT CGCACCGTCC GACATTACCG CCCTCGGCTG CCACGGGCAA
 301 ACCGTCCGAC ACGCGCCGGA ACACGGTTAC AGCATACAGC TTGCCGATTT
 351 GCCGCTGCTG GCGxxxxxxx xxxxxxxxxx xxxxxxxxxx xxxxxxxxxx
 401 xxxxxxxxxx xxxxxxxxxx xxxxxxxxxx xxxxxxxxxx xxxxxxxxxx
 451 xxxxxxxxxx xxxxxxxxxx xxxxxxxxxx xxxxxxxxxx xxxxxxxxxx
 501 xxxxxxxxxx xxxxxxxxxx xxxxxxxxxx xxxxxxxxxx xxxxxxxxxx
 551 xxxxxxxxxx xxxxxxxxxx xxxxxxxxxx xxxxxxxxxx xxxxxxxxxx
 601 xxxxxxCAGC TTCCTTACGA CAAAAACGGT GCAAAGTCGG CACAAGGCAA
 651 CATATTGCCG CAACTGCTCG ACAGGCTGCT CGCCCACCCG TATTTCGCAC
 701 AACGCCACCC TAAAAGCACG GGGCGCGAAC TGTTTGCCAT AAATTGGCTC
 751 GAAACCTACC TTGACGGCGG CGAAAACCGA TACGACGTAT TGCGGACGCT
 801 TTCCCGTTTT ACCGCGCAAA CCGTTTGCGA CGCCGTCTCA CACGCAGCGG
 851 CAGATGCCCG TCAAATGTAC ATTTGCGACG GCGGCATCCG CAATCCTGTT
 901 TTAATGGCGG ATTTGGCAGA ATGTTTCGGC ACACGCGTTT CCCTGCACAG
 951 CACCGCCGAC CTGAACCTCG ATCCGCAATG GGTGGAAGCC GCCGnATTTG
1001 CGTGGTTGGC GGCGTGTTGG ATTAATCGCA TTCCCGGTAG TCCGCACAAA
1051 GCAACCGGCG CATCCAAACC GTGTATTCTG AnCGCGGGAT ATTATTATTG
1101 A
```

This corresponds to the amino acid sequence <SEQ ID 438; ORF 121>:

m121.pep

```
  1 METQLYIGIM SGTSMDGADA VLIRMDGGKW LGAEGHAFTP YPGRLRRQLL

 51 DLQDTGADEL HRSRILSQEL SRLYAQTAAE LLCSQNLAPS DITALGCHCQ

101 TVRHAPEHGY SIQLADLPLL Axxxxxxxxx xxxxxxxxxx xxxxxxxxxx

151 xxxxxxxxxx xxxxxxxxxx xxxxxxxxxx xxxxxxxxxx xxxxxxxxxx

201 xxQLPYDKNG AKSAQGNILP QLLDRLLAHP YFAQRHPKST GRELFAINWL

251 ETYLDGGENR YDVLRTLSRF TAQTVCDAVS HAAADARQMY ICDGGIRNPV

301 LMADLAECFG TRVSLHSTAD LNLDPQWVEA AXFAWLAACW INRIPGSPHK

351 ATGASKPCIL XAGYYY*
```

Computer analysis of the amino acid sequences gave the following results:

Homology with a predicted ORF from *N. meningitidis* menA with menB

ORF 121 shows 73.5% identity over a 366 aa overlap with a predicted ORF (ORF121.ng) from *N. gonorrhoeae*:

m121/g121

```
                     10        20        30        40        50        60
m121.pep    METQLYIGIMSGTSMDGADAVLIRMDGGKWLGAEGHAFTPYPGRLRRQLLDLQDTGADEL
            ||||||||||||||||||||||:||||||||||||||||||| ||||:||||||||:|||
g121        METQLYIGIMSGTSMDGADAVLVRMDGGKWLGAEGHAFTPYPDRLRRKLLDLQDTGTDEL
                     10        20        30        40        50        60

                     70        80        90       100       110       120
m121.pep    HRSRILSQELSRLYAQTAAELLCSQNLAPSDITALGCHGQTVRHAPEHGYSIQLADLPLL
            ||||:|||||||||||||||||||||||| ||||||||||||||||||||||||||||||
g121        HRSRMLSQELSRLYAQTAAELLCSQNLAPCDITALGCHGQTVRHAPEHGYSIQLADLPLL
                     70        80        90       100       110       120

                    130       140       150       160       170       180
m121.pep    AXXXXXXXXXXXXXXXXXXXXXXXXXXXXXXXXXXXXXXXXXXXXXXXXXXXXXXXXXXX
            |  :   :                                :
g121        AELTRIFTVGDFRSRDLAAGGQGAPLVPAFHEALFRDDRETRVVLNIGGIANISVLPPGA
                    130       140       150       160       170       180

                    190       200       210       220       230       240
m121.pep    XXXXXXXXXXXXXXXXXXXXXXQLPYDKNGAKSAQGNILPQLLDRLLAHPYFAQRHPKST
                  :          :    ||||||||||:|||||||||| ||||||||:| |||||
g121        PAFGFDTGPGNMLMDAWTQAHWQLPYDKNGAKAAQGNILPQLLGRLLAHPYFSQPHPKST
                    190       200       210       220       230       240

                    250       260       270       280       290       300
m121.pep    GRELFAINWLETYLDGGENRYDVLRTLSRFTAQTVCDAVSHAAADARQMYICDGGIRNPV
            ||||||:|||||||||||||||||||||||||||| |||||||||||||||| |||||||
g121        GRELFALNWLETYLDGGENRYDVLRTLSRFTAQTVWDAVSHAAADARQMYICGGGIRNPV
                    250       260       270       280       290       300

                    310       320       330       340       350       360
m121.pep    LMADLAECFGTRVSLHSTADLNLDPQWVEAAXFAWLAACWINRIPGSPHKATGASKPCIL
            |||||||||||||||||||:||||||||||| ||||||||||||||||||||||||||||
g121        LMADLAECFGTRVSLHSTAELNLDPQWVEAAAFAWLAACWINRIPGSPHKATGASKPCIL
                    310       320       330       340       350       360

m121.pep    XAGYYYX
             ||||||
g121        GAGYYYX
```

The following partial DNA sequence was identified in *N. meningitidis* <SEQ ID 439>:

a121.seq

```
  1 ATGGAAACAC AGCTTTACAT CGGCATCATG TCGGGAACCA GCATGGACGG

 51 GGCGGATGCC GTACTGATAC GGATGGACGG CGGCAAATGG CTGGGCGCGG
```

-continued

```
 101 AAGGGCACGC CTTTACCCCC TACCCCGGCA GGTTACGCCG CAAATTGCTG

 151 GATTTGCAGG ACACAGGCGC GGACGAACTG CACCGCAGCA GGATGTTGTC

 201 GCAAGAACTC AGCCGCCTGT ACGCGCAAAC CGCCGCCGAA CTGCTGTGCA

 251 GTCAAAACCT CGCGCCGTCC GACATTACCG CCCTCGGCTG CCACGGGCAA

 301 ACCGTCAGAC ACGCGCCGGA ACACAGTTAC AGCGTACAGC TTGCCGATTT

 351 GCCGCTGCTG GCGGAACGGA CTCAGATTTT TACCGTCGGC GACTTCCGCA

 401 GCCGCGACCT TGCGGCCGGC GGACAAGGCG CGCCGCTCGT CCCCGCCTTT

 451 CACGAAGCCC TGTTCCGCGA CGACAGGGAA ACACGCGCGG TACTGAACAT

 501 CGGCGGGATT GCCAACATCA GCGTACTCCC CCCCGACGCA CCCGCCTTCG

 551 GCTTCGACAC AGGACCGGGC AATATGCTGA TGGACGCGTG GATGCAGGCA

 601 CACTGGCAGC TTCCTTACGA CAAAAACGGT GCAAAGGCGG CACAAGGCAA

 651 CATATTGCCG CAACTGCTCG ACAGGCTGCT CGCCCACCCG TATTTCGCAC

 701 AACCCCACCC TAAAAGCACG GGGCGCGAAC TGTTTGCCCT AAATTGGCTC

 751 GAAACCTACC TTGACGGCGG CGAAAACCGA TACGACGTAT TGCGGACGCT

 801 TTCCCGATTC ACCGCGCAAA CCGTTTTCGA CGCCGTCTCA CACGCAGCGG

 851 CAGATGCCCG TCAAATGTAC ATTTGCGGCG GCGGCATCCG CAATCCTGTT

 901 TTAATGGCGG ATTTGGCAGA ATGTTTCGGC ACACGCGTTT CCCTGCACAG

 951 CACCGCCGAA CTGAACCTCG ATCCGCAATG GGTAGAAGCC GCCGCGTTCG

1001 CATGGATGGC GGCGTGTTGG GTCAACCGCA TTCCCGGTAG TCCGCACAAA

1051 GCAACCGGCG CATCCAAACC GTGTATTCTG GGCGCGGGAT ATTATTATTG

1101 A
```

This corresponds to the amino acid sequence <SEQ ID 440; ORF 121.a>:

a121.pep

```
  1 METQLYIGIM SGTSMDGADA VLIRMDGGKW LGAEGHAFTP YPGRLRRKLL

 51 DLQDTGADEL HRSRMLSQEL SRLYAQTAAE LLCSQNLAPS DITALGCHGQ

101 TVRHAPEHSY SVQLADLPLL AERTQIFTVG DFRSRDLAAG GQGAPLVPAF

151 HEALFRDDRE TRAVLNIGGI ANISVLPPDA PAFGFDTGPG NMLMDAWMQA

201 HWQLPYDKNG AKAAQGNILP QLLDRLLAHP YFAQPHPKST GRELFALNWL

251 ETYLDGGENR YDVLRTLSRF TAQTVFDAVS HAAADARQMY ICGGGIRNPV

301 LMADLAECFG TRVSLHSTAE LNLDPQWVEA AAFAWMAACW VNRIPGSPHK

351 ATGASKPCIL GAGYYY*
```

m121/a121 74.0% identity in 366 aa overlap

```
                  10         20         30         40         50         60
m121.pep  METQLYIGIMSGTSMDGADAVLIRMDGGKWLGAEGHAFTPYPGRLRRQLLDLQDTGADEL
          ||||||||||||||||||||||||||||||||||||||||||||||| :||||||||||
a121      METQLYIGIMSGTSMDGADAVLIRMDGGKWLGAEGHAFTPYPGRLRRKLLDLQDTGADEL
                  10         20         30         40         50
```

-continued

```
             70        80        90       100       110       120
m121.pep  HRSRILSQELSRLYAQTAAELLCSQNLAPSDITALGCHGQTVRHAPEHGYSIQLADLPLL
          ||||:|||||||||||||||||||||||||||||||||||||||||||:||:||||||||
a121      HRSRMLSQELSRLYAQTAAELLCSQNLAPSDITALGCHGQTVRHAPEHSYSVQLADLPLL
             70        80        90       100       110       120

            130       140       150       160       170       180
m121.pep  AXXXXXXXXXXXXXXXXXXXXXXXXXXXXXXXXXXXXXXXXXXXXXXXXXXXXXXXXXXX
          |  :     :                              :
a121      AERTQIFTVGDFRSRDLAAGGQGAPLVPAFHEALFRDDRETRAVLNIGGIANISVLPPDA
            130       140       150       160       170       180

            190       200       210       220       230       240
m121.pep  XXXXXXXXXXXXXXXXXXXXXXQLPYDKNGAKSAQGNILPQLLDRLLAHPYFAQRHPKST
                :               ||||||||||:||||||||||||||||||||| |||||
a121      PAFGFDTGPGNMLMDAWMQAHWQLPYDKNGAKAAQGNILPQLLDRLLAHPYFAQPHPKST
            190       200       210       220       230       240

            250       260       270       280       290       300
m121.pep  GRELFAINWLETYLDGGENRYDVLRTLSRFTAQTVCDAVSHAAADARQMYICDGGIRNPV
          ||||||:|||||||||||||||||||||||||||| |||||||||||||||| |||||||
a121      GRELFALNWLETYLDGGENRYDVLRTLSRFTAQTVFDAVSHAAADARQMYICGGGIRNPV
            250       260       270       280       290       300

            310       320       330       340       350       360
m121.pep  LMADLAECFGTRVSLHSTADLNLDPQWVEAAXFAWLAACWINRIPGSPHKATGASKPCIL
          |||||||||||||||||||:||||||||||| |||:||||:|||||||||||||||||||
a121      LMADLAECFGTRVSLHSTAELNLDPQWVEAAAFAWMAACWVNRIPGSPHKATGASKPCIL
            310       320       330       340       350       360

m121.pep  XAGYYYX
           ||||||
a121      GAGYYYX
```

The following partial DNA sequence was identified in *N. meningitidis* <SEQ ID 441>:

m121-1.seq

```
   1 ATGGAAACAC AGCTTTACAT CGGCATCATG TCGGGAACCA GCATGGACGG
  51 GGCGGATGCC GTACTGATAC GGATGGACGG CGGCAAATGG CTGGGCGCGG
 101 AAGGGCACGC CTTTACCCCC TACCCCGGCA GGTTACGCCG CCAATTGCTG
 151 GATTTGCAGG ACACAGGCGC AGACGAACTG CACCGCAGCA GGATTTTGTC
 201 GCAAGAACTC AGCCGCCTAT ATGCGCAAAC CGCCGCCGAA CTGCTGTGCA
 251 GTCAAAACCT CGCACCGTCC GACATTACCG CCCTCGGCTG CCACGGGCAA
 301 ACCGTCCGAC ACGCGCCGGA ACACGGTTAC AGCATACAGC TTGCCGATTT
 351 GCCGCTGCTG GCGGAACGGA CGCGGATTTT TACCGTCGGC GACTTCCGCA
 401 GCCGCGACCT TGCGGCCGGC GGACAAGGCG CGCCACTCGT CCCCGCCTTT
 451 CACGAAGCCC TGTTCCGCGA CAACAGGGAA ACACGCGCGG TACTGAACAT
 501 CGGCGGGATT GCCAACATCA GCGTACTCCC CCCCGACGCA CCCGCCTTCG
 551 GCTTCGACAC AGGGCCGGGC AATATGCTGA TGGACGCGTG GACGCAGGCA
 601 CACTGGCAGC TTCCTTACGA CAAAAACGGT GCAAAGGCGG CACAAGGCAA
 651 CATATTGCCG CAACTGCTCG ACAGGCTGCT CGCCCACCCG TATTTCGCAC
 701 AACCCCACCC TAAAAGCACG GGGCGCGAAC TGTTTGCCCT AAATTGGCTC
 751 GAAACCTACC TTGACGGCGG CGAAAACCGA TACGACGTAT TGCGGACGCT
 801 TTCCCGTTTT ACCGCGCAAA CCGTTTGCGA CGCCGTCTCA CACGCAGCGG
 851 CAGATGCCCG TCAAATGTAC ATTTGCGGCG GCGGCATCCG CAATCCTGTT
 901 TTAATGGCGG ATTTGGCAGA ATGTTTCGGC ACACGCGTTT CCCTGCACAG
 951 CACCGCCGAC CTGAACCTCG ATCCGCAATG GGTGGAAGCC GCCGNATTTG
1001 CGTGGTTGGC GGCGTGTTGG ATTAATCGCA TTCCCGGTAG TCCGCACAAA
```

-continued

```
1051 GCAACCGGCG CATCCAAACC GTGTATTCTG ANCGCGGGAT ATTATTATTG

1101 A
```

This corresponds to the amino acid sequence <SEQ ID 442; ORF 121-1>:

m121-1.pep

```
  1 METQLYIGIM SGTSMDGADA VLIRMDGGKW LGAEGHAFTP YPGRLRRQLL

 51 DLQDTGADEL HRSRILSQEL SRLYAQTAAE LLCSQNLAPS DITALGCHGQ

101 TVRHAPEHGY SIQLADLPLL AERTRIFTVG DFRSRDLAAG GQGAPLVPAF

151 HEALFRDNRE TRAVLNIGGI ANISVLPPDA PAFGFDTGPG NMLMDAWTQA

201 HWQLPYDKNG AKAAQGNILP QLLDRLLAHP YFAQPHPKST GRELFALNWL

251 ETYLDGGENR YDVLRTLSRF TAQTVCDAVS HAAADARQMY ICGGGIRNPV

301 LMADLAECFG TRVSLHSTAD LNLDPQWVEA AXFAWLAACW INRIPGSPHK

351 ATGASKPCIL XAGYYY*
```

m121-1/g121 95.6% identity in 366 aa overlap

```
                    10        20        30        40        50        60
m121-1.pep  METQLYIGIMSGTSMDGADAVLIRMDGGKWLGAEGHAFTPYPGRLRRQLLDLQDTGADEL
            ||||||||||||||||||||||:||||||||||||||||||| |||||:|||||||:|||
g121        METQLYIGIMSGTSMDGADAVLVRMDGGKWLGAEGHAFTPYPDRLRRKLLDLQDTGTDEL
                    10        20        30        40        50        60

                    70        80        90       100       110       120
m121-1.pep  HRSRILSQELSRLYAQTAAELLCSQNLAPSDITALGCHGQTVRHAPEHGYSIQLADLPLL
            ||||:||||||||||||||||||||||||| |||||||||||||||||||||||||||||||||||
g121        HRSRMLSQELSRLYAQTAAELLCSQNLAPCDITALGCHGQTVRHAPEHGYSIQLADLPLL
                    70        80        90       100       110       120

                   130       140       150       160       170       180
m121-1.pep  AERTRIFTVGDFRSRDLAAGGQGAPLVPAFHEALFRDNRETRAVLNIGGIANISVLPPDA
            || ||||||||||||||||||||||||||||||||||:||||:||||||||||||||| |
g121        AELTRIFTVGDFRSRDLAAGGQGAPLVPAFHEALFRDDRETRVVLNIGGIANISVLPPGA
                   130       140       150       160       170       180

                   190       200       210       220       230       240
m121-1.pep  PAFGFDTGPGNMLMDAWTQAHWQLPYDKNGAKAAQGNILPQLLDRLLAHPYFAQPHPKST
            ||||||||||||||||||||||||||||||||||||||||||| ||||||||:|||||||
g121        PAFGFDTGPGNMLMDAWTQAHWQLPYDKNGAKAAQGNILPQLLGRLLAHPYFSQPHPKST
                   190       200       210       220       230       240

                   250       260       270       280       290       300
m121-1.pep  GRELFALNWLETYLDGGENRYDVLRTLSRFTAQTVCDAVSHAAADARQMYICGGGIRNPV
            ||||||||||||||||||||||||||||||||||| ||||||||||||||||||||||||
g121        GRELFALNWLETYLDGGENRYDVLRTLSRFTAQTVWDAVSHAAADARQMYICGGGIRNPV
                   250       260       270       280       290       300

                   310       320       330       340       350       360
m121-1.pep  LMADLAECFGTRVSLHSTADLNLDPQWVEAAXFAWLAACWINRIPGSPHKATGASKPCIL
            ||||||||||||||||||:|||||||||||| ||||||||||||||||||||||||||||
g121        LMADLAECFGTRVSLHSTAELNLDPQWVEAAAFAWLAACWINRIPGSPHKATGASKPCIL
                   310       320       330       340       350       360

m121-1.pep  XAGYYYX
             ||||||
g121        GAGYYYX
```

The following partial DNA sequence was identified in *N. meningitidis* <SEQ ID 443>:

a121-1.seq

```
   1 ATGGAAACAC AGCTTTACAT CGGCATCATG TCGGGAACCA GCATGGACGG
```

-continued

```
  51 GGCGGATGCC GTACTGATAC GGATGGACGG CGGCAAATGG CTGGGCGCGG

 101 AAGGGCACGC CTTTACCCCC TACCCCGGCA GGTTACGCCG CAAATTGCTG

 151 GATTTGCAGG ACACAGGCGC GGACGAACTG CACCGCAGCA GGATGTTGTC

 201 GCAAGAACTC AGCCGCCTGT ACGCGCAAAC CGCCGCCGAA CTGCTGTGCA

 251 GTCAAAACCT CGCGCCGTCC GACATTACCG CCCTCGGCTG CCACGGGCAA

 301 ACCGTCAGAC ACGCGCCGGA ACACAGTTAC AGCGTACAGC TTGCCGATTT

 351 GCCGCTGCTG GCGGAACGGA CTCAGATTTT TACCGTCGGC GACTTCCGCA

 401 GCCGCGACCT TGCGGCCGGC GGACAAGGCG CGCCGCTCGT CCCCGCCTTT

 451 CACGAAGCCC TGTTCCGCGA CGACAGGGAA ACACGCGCGG TACTGAACAT

 501 CGGCGGGATT GCCAACATCA GCGTACTCCC CCCCGACGCA CCCGCCTTCG

 551 GCTTCGACAC AGGACCGGGC AATATGCTGA TGGACGCGTG GATGCAGGCA

 601 CACTGGCAGC TTCCTTACGA CAAAAACGGT GCAAAGGCGG CACAAGGCAA

 651 CATATTGCCG CAACTGCTCG ACAGGCTGCT CGCCCACCCG TATTTCGCAC

 701 AACCCCACCC TAAAAGCACG GGGCGCGAAC TGTTTGCCCT AAATTGGCTC

 751 GAAACCTACC TTGACGGCGG CGAAAACCGA TACGACGTAT TGCGGACGCT

 801 TTCCCGATTC ACCGCGCAAA CCGTTTTCGA CGCCGTCTCA CACGCAGCGG

 851 CAGATGCCCG TCAAATGTAC ATTTGCGGCG GCGGCATCCG CAATCCTGTT

 901 TTAATGGCGG ATTTGGCAGA ATGTTTCGGC ACACGCGTTT CCCTGCACAG

 951 CACCGCCGAA CTGAACCTCG ATCCGCAATG GGTAGAAGCC GCCGCGTTCG

1001 CATGGATGGC GGCGTGTTGG GTCAACCGCA TTCCCGGTAG TCCGCACAAA

1051 GCAACCGGCG CATCCAAACC GTGTATTCTG GGCGCGGGAT ATTATTATTG

1101 A
```

This corresponds to the amino acid sequence <SEQ ID 444; ORF 121-1.a>:

```
a121-1.pep

  1 METQLYIGIM SGTSMDGADA VLIRMDGGKW LGAEGHAFTP YPGRLRRKLL

 51 DLQDTGADEL HRSRMLSQEL SRLYAQTAAE LLCSQNLAPS DITALGCHGQ

101 TVRHAPEHSY SVQLADLPLL AERTQIFTVG DFRSRDLAAG GQGAPLVPAF

151 HEALFRDDRE TRAVLNIGGI ANISVLPPDA PAFGFDTGPG NMLMDAWMQA

201 HWQLPYDKNG AKAAQGNILP QLLDRLLAHP YFAQPHPKST GRELFALNWL

251 ETYLDGGENR YDVLRTLSRF TAQTVFDAVS HAAADARQMY ICGGGIRNPV

301 LMADLAECFG TRVSLHSTAE LNLDPQWVEA AAFAWMAACW VNRIPGSPHK

351 ATGASKPCIL GAGYYY*
```

m121-1/a121-1 96.4% identity in 366 aa overlap

```
                    10        20        30        40        50        60
m121-1.pep  METQLYIGIMSGTSMDGADAVLIRMDGGKWLGAEGHAFTPYPGRLRRQLLDLQDTGADEL
            |||||||||||||||||||||||||||||||||||||||||||||||:||||||||||||
a121-1      METQLYIGIMSGTSMDGADAVLIRMDGGKWLGAEGHAFTPYPGRLRRKLLDLQDTGADEL
                    10        20        30        40        50        60
```

-continued

```
                      70        80        90       100       110       120
m121-1.pep    HRSRILSQELSRLYAQTAAELLCSQNLAPSDITALGCHGQTVRHAPEHGYSIQLADLPLL
              ||||:|||||||||||||||||||||||||||||||||||||||||||:||:||||||||
a121-1        HRSRMLSQELSRLYAQTAAELLCSQNLAPSDITALGCHGQTVRHAPEHSYSVQLADLPLL
                      70        80        90       100       110       120

                     130       140       150       160       170       180
m121-1.pep    AERTRIFTVGDFRSRDLAAGGQGAPLVPAFHEALFRDNRETRAVLNIGGIANISVLPPDA
              ||||:||||||||||||||||||||||||||||||||:||||||||||||||||||||||
a121-1        AERTQIFTVGDFRSRDLAAGGQGAPLVPAFHEALFRDDRETRAVLNIGGIANISVLPPDA
                     130       140       150       160       170       180

                     190       200       210       220       230       240
m121-1.pep    PAFGFDTGPGNMLMDAWTQAHWQLPYDKNGAKAAQGNILPQLLDRLLAHPYFAQPHPKST
              ||||||||||||||||| ||||||||||||||||||||||||||||||||||||||||||
a121-1        PAFGFDTGPGNMLMDAWMQAHWQLPYDKNGAKAAQGNILPQLLDRLLAHPYFAQPHPKST
                     190       200       210       220       230       240

                     250       260       270       280       290       300
m121-1.pep    GRELFALNWLETYLDGGENRYDVLRTLSRFTAQTVCDAVSHAAADARQMYICGGGIRNPV
              ||||||||||||||||||||||||||||||||||| ||||||||||||||||||||||||
a121-1        GRELFALNWLETYLDGGENRYDVLRTLSRFTAQTVFDAVSHAAADARQMYICGGGIRNPV
                     250       260       270       280       290       300

                     310       320       330       340       350       360
m121-1.pep    LMADLAECFGTRVSLHSTADLNLDPQWVEAAXFAWLAACWINRIPGSPHKATGASKPCIL
              |||||||||||||||||||:||||||||||| |||:||||:|||||||||||||||||||
a121          LMADLAECFGTRVSLHSTAELNLDPQWVEAAAFAWMAACWVNRIPGSPHKATGASKPCIL
                     310       320       330       340       350       360

m121-1.pep    XAGYYYX
               ||||||
a121          GAGYYYX
```

The following partial DNA sequence was identified in *N. gonorrhoeae* <SEQ ID 445>:

g122.seq

```
  1 ATGGCTTTAC TGAGCATCCG CAAGCTGCAC AAACAATACG GCAGCGTAAC
 51 CGCCATCCAA TCCTTAGACT TGGACTTGGA AAAAGGCGAA GtcatCGTAC
101 TGCTGGGCCC gTccggctgc ggCAAATCCA CCCTcctgcg ctgcgtcaaC
151 GGTTTGGAGC CGCACCAagg cgGCAGCATC GTGATGGACG GTgtcgGCGA
201 ATTCggcAAA GACGTTTCCT GGCAAACCGC CCGGCAAAAa gtcggtatgg
251 tctttcaaag taacgAactg Tttgcccaca tgaccgtcat cgAaaacatc
301 ttcttAggcC CGGTAAagga aCAAAAcCgc gaccgtgccg aagcaGAGGC
351 gCAAGCCGGC AAactGttgg aacgcgTCGG actgctAGAC CGCAAAAACG
401 CCTATCCGCG CGAACTTTCC GGCGGTCAGA AACAGCGCAT CGCCATTGTC
451 CGCGCCCTGT GCCTGAATCC GGAAGTCATC CTGCTGGACG AAATCACCGC
501 CGCACTTGAC CCCGAAATGG TGCGCGAAGT CTTGGAAGTG GTTTTGGAAC
551 TCGCCCGCGA AGGGATGAGT ATGCTCATCG TAACCCACGA AATGGGGTTC
601 GCACGCAAAG TTGCCGACCG CATCGTCTTT ATGGACAAAG GCGGCATCGT
651 CGAATCGTCC GACCCCGAAA CCTTTTTTTC CGCACCAAAA AGCGAACGCG
701 CCCGCCAATT TCTGGCAGGT ATGGACTACT GA
```

This corresponds to the amino acid sequence <SEQ ID 446; ORF 122.ng>:

g122.pep

```
  1 MALLSIRKLH KQYGSVTAIQ SLDLDLEKGE VIVLLGPSGC GKSTLLRCVN
 51 GLEPHQGGSI VMDGVGEFGK DVSWQTARQK VGMVFQSNEL FAHMTVIENI
```

-continued

```
101 FLGPVKEQNR DRAEAEAQAG KLLERVGLLD RKNAYPRELS GGQKQRIAIV
151 RALCLNPEVI LLDEITAALD PEMVREVLEV VLELAREGMS MLIVTHEMGF
201 ARKVADRIVF MDKGGIVESS DPETFFSAPK SERARQFLAG MDY*
```

The following partial DNA sequence was identified in *N. meningitidis* <SEQ ID 447>:

m122.seq

```
  1 GTTGTCATGA TTAAAATCCG CAATATCCAT AAGACCTTTG GCGAAAACAC
 51 TATTTTGCGC GGCATCGATT TGGATGTGTG CAAAGGGCAG GTGGTCGTCA
101 TCCTCGGGcC TTCCGGCTCA GGCAAAACGA CGTTTCTGCG ATGCCTAAAC
151 GCGTTGGAAA TGCCCGAAGA CGGACAAATC GAGTTCGACA ACGAGCGACC
201 GCTGAAAATC GATTTTTCTA AAAAACCAAG CAAACACGAT ATTTTGGCAC
251 TGCGCCGCAA ATCAkGCATG GTGTTTCAAC AATACAAyCT CTTTCCGCAC
301 AAAACCGCCT TGGAAAACGT AATGGAAGGA CCGGTTGCCG TACAgGGCAA
351 GCCTGCCGCC CAAGCGCGCG AAGAGGCTCT GAAACTGCTG GAAAAAGTCG
401 GCTTGGGCGA CAAAGTGGAT TTGTATCCCT ACCAGCTTTC CGGCGGTCAG
451 CAGCAGCGCG TCGGCATTGC CCGCGCATTG GCGATTCAGC CTGAACTGAT
501 GCTGTTTGAC GAACCGACTT CCGCGCTCGA TCCTGAATTG GTGCAAGATG
551 TTTTGGATmC CATGAAGGAA TTGGCGCAAG AAGGCTGGAC CATGGTTGTC
601 GTTACGCATG AAATCAAGTT CGCCTTAGAA GTGGCAACCA CCGwCGTCGT
651 GATGGACrGC GGCGTTATTG TCGAACAAGG CAGCCCGCAA GATTTGTTCG
701 ACCACCCCAA ACACGAACGG ACGCGGAGAT TTTTAAGCCA AATCCAATCT
751 ACCAAGATTT GA
```

This corresponds to the amino acid sequence <SEQ ID 448; ORF 122>:

m122.pep

```
  1 VVMIKIRNIH KTFGENTILR GIDLDVCKGQ VVVILGPSGS GKTTFLRCLN
 51 ALEMPEDGQI EFDNERPLKI DFSKKPSKHD ILALRRKSXM VFQQYNLFPH
101 KTALENVMEG PVAVQGKPAA QAREEALKLL EKVGLGDKVD LYPYQLSGGQ
151 QQRVGIARAL AIQPELMLFD EPTSALDPEL VQDVLDXMKE LAQEGWTMVV
201 VTHEIKFALE VATTXVVMDX GVIVEQGSPQ DLFDHPKHER TRRFLSQIQS
251 TKI*
```

Computer analysis of this amino acid sequence gave the following results:

Homology with a predicted ORF from *N. gonorrhoeae*

ORF 122 shows 47.2% identity over a 246 aa overlap with a predicted ORF (ORF 122.ng) from *N. gonorrhoeae*:

m122/g122

```
                    10        20        30        40        50        60
m122.pep    VVMIKIRNIHKTFGENTILRGIDLDVCKGQVVVILGPSGSGKTTFLRCLNALEMPEDGQI
            :::::||::|| :|  | ::::|||: ||:|:|:||||| ||:|:|||:|:||  : |:|
g122        MALLSIRKLHKQYGSVTAIQSLDLDLEKGEVIVLLGPSGCGKSTLLRCVNGLEPHQGGSI
                    10        20        30        40        50        60

                    70        80        90       100       110       120
m122.pep    EFDNERPLKIDFSKKPSKHDILALRRKSXMVFQQYNLFPHKTALENVMEGPVAVQGKPAA
             :|:   :  | | : :       |:|  ||||: :|| | |::||:: |||  |::  |
g122        VMDGVGEFGKDVSWQTA-------RQKVGMVFQSNELFAHMTVIENIFLGPVKEQNRDRA
                    70               80        90       100       110

                   130       140       150       160       170       180
m122.pep    QAREEALKLLEKVGLGDKVDLYPYQLSGGQQQRVGIARALAIQPELMLFDEPTSALDPEL
            :|: :| ||||:||| |: : || :|||||:||::|:||| ::||::|:|| |:|||||:
g122        EAEAQAGKLLERVGLLDRKNAYPRELSGGQKQRIAIVRALCLNPEVILLDEITAALDPEM
                120       130       140       150       160       170

                   190       200       210       220       230       240
m122.pep    VQDVLDXMKELAQEGWTMVVVTHEIKFALEVATTXVVMDXGVIVEQGSPQDLFDHPKHER
            |::||: : |||:|| :|::||||: || :||   | || | |||:::|: :|: || ||
g122        VREVLEVVLELAREGMSMLIVTHEMGFARKVADRIVFMDKGGIVESSDPETFFSAPKSER
                180       190       200       210       220       230

                   250
m122.pep    TRRFLSQIQSTKIX
            :|:||:
g122        ARQFLAGMDYX
                240
```

The following partial DNA sequence was identified in *N. meningitidis* <SEQ ID 449>:

a122.seq

```
  1 GTTGTCATGA TTAAAATCCG CAATATCCAT AAGACCTTCG GCAAAAATAC
 51 CATTTTGCGC GGCATCAATT TGGATGTGTG CAAAGGGCAG GTGGTCGTCA
101 TCCTCGGGCC TTCCGGCTCA GGCAAAACGA CGTTTCTGCG ATGCCTAAAC
151 GCGTTGGAAA TGCCCGAAGA CGGACAAATC GAGTTCGACA ACGAGCGACC
201 GCTGAAAATC GATTTTTCTA AAAAACCAAG CAAACACGAT ATTTTGGCAC
251 TGCGCCGCAA ATCAGGCATG GTGTTTCAAC AATACAACCT CTTTCCGCAC
301 AAAACCGCCT TGGAAAACGT GATGGAAGGA CCGGTTGCCG TACAGGGCAA
351 GCCTGCCGCC CAAGCGCGCG AAGAGGCTCT GAAACTGCTG GAAAAAGTCG
401 GCTTGGGCGA CAAAGTGGAT TTGTATCCCT ACCAGCTTTC CGGCGGTCAG
451 CAGCAGCGCG TCGGCATTGC CCGAGCATTG GCGATTCAGC CCGAGCTGAT
501 GTTGTTTGAC GAACCCACTT CCGCGCTTGA CCCCGAGTTG GTGCAAGACG
551 TGTTGAACGC CATGAAGGAA TTGGCGCGGG AAGGTTGGAC GATGGTCGTC
601 GTTACCCACG AAATCAAGTT CGCGCTGGAA GTTGCCACGA CCGTTGTCGT
651 GATGGACGGC GGCGTTATCG TAGAGCAGGG CAGCCCGAAA GAGTTGTTCG
701 ACCACCCCAA ACACGAACGG ACGCGGAGAT TTTTAAGCCA AATCCAATCT
751 ACCAAGATTT GA
```

This corresponds to the amino acid sequence <SEQ ID 450; ORF 122.a>:

a122.pep

```
  1 VVMIKIRNIH KTFGKNTILR GINLDVCKGQ VVVILGPSGS GKTTFLRCLN
 51 ALEMPEDGQI EFDNERPLKI DFSKKPSKHD ILALRRKSGM VFQQYNLFPH
```

-continued

```
101 KTALENVMEG PVAVQGKPAA QAREEALKLL EKVGLGDKVD LYPYQLSGGQ

151 QQRVGIARAL AIQPELMLFD EPTSALDPEL VQDVLNAMKE LAREGWTMVV

201 VTHEIKFALE VATTVVVMDG GVIVEQGSPK ELFDHPKHER TRRFLSQIQS

251 TKI*
```

m122/a122 96.0% identity in 253 aa overlap

```
                    10        20        30        40        50        60
m122.pep    VVMIKIRNIHKTFGENTILRGIDLDVCKGQVVVILGPSGSGKTTFLRCLNALEMPEDGQI
            |||||||||||||:||||||||:|||||||||||||||||||||||||||||||||||||
a122        VVMIKIRNIHKTFKENTILRGINLDVGKGQVVVILGPSGSGKTTFLRCLNALEMPEDGQI
                    10        20        30        40        50        60

                    70        80        90       100       110       120
m122.pep    EFDNERPLKIDFSKKPSKHDILALRRKSXMVFQQYNLFPHKTALENVMEGPVAVQGKPAA
            |||||||||||||||||||||||||||| |||||||||||||||||||||||||||||||
a122        EFDNARPLKIDFSKKTSKHDILALRRKSGMVFQQYNLFPHKTVLENVMEGPVAVQGKPAA
                    70        80        90       100       110       120

                   130       140       150       160       170       180
m122.pep    QAREEALKLLEKVGLGDKVDLYPYQLSGGQQQRVGIARALAIQPELMLFDEPTSALDPEL
            ||||||||||||||||||||||||||||||||||||||||||||||||||||||||||||
a122        QAREEALKLLEKVGLGDKVDLYPYQLSGGQQQRVGIARALAIQPELMLFDEPTSALDPEL
                   130       140       150       160       170       180

                   190       200       210       220       230       240
m122.pep    VQDVLDXMKELAQEGWTMVVVTHEIKFALEVATTXVVMDXGVIVEQGSPQDLFDHPKHER
            |||||: |||||:|||||||||||||||||||| |||| ||||||||::|||||||||||
a122        VQDVLNAMKELAREGWTMVVVTHEIKFTLEVATNVVVMDGGVIVEQGSPKELFDHLKHER
                   190       200       210       220       230       240

                   250
m122.pep    TRRFLSQIQSTKIX
            ||||||||||||||
a122        TRRFLSQIQSTKIX
                   250
```

The following partial DNA sequence was identified in *N. gonorrhoeae* <SEQ ID 451>:

<u>g122-1.seq</u>

```
  1 ATGATTAAAA TCCGCAATAT CCATAAGACC TTTGGCGAAA ACACCATTTT

 51 GCGCGGCATC GATTTGGATG TGGGCAAAGG GCAGGTGGTC GTCATCCTCG

101 GGCCTTCCGG CTCGGGTAAA ACAACATTTC TGCGCTGCCT AAACGCGTTG

151 GAAATGCCCG AAGACGGACA AATCGAGTTC GACAACGCGC GGCCGTTACG

201 CATTGATTTT TCCAAAAAAA CAAGCAAACA CGATATTTTG GCACTGCGCC

251 GCAAGTCCGG AATGGTATTC CAACAATACA ACCTCTTCCC GCATAAAACC

301 GTGTTGGAAA ACGTGATGGA AGGGCCGGTT GCCGTACAGG GCAAGCCTGC

351 CGCCCAAGCG CGCGAAGAGG CTTTGAAACT GCTGGAAAAA GTCGGCTTGG

401 GCGATAAAGT GGATTTGTAT CCCTACCAGC TTTCCGGCGG TCAGCAGCAG

451 CGTGTCGGTA TCGCCCGCGC ACTGGCGATT CAGCCTGAAT TGATGCTGTT

501 TGACGAACCC ACTTCCGCGC TGGACCCCGA GTTGGTGCAA GACGTGTTGG

551 ACGCCATGAA GGAATTGGCG CGGGAAGGTT GGACGATGGT CGTCGTTACC

601 CACGAAATCA AGTTCACGCT GGAAGTTGCC ACGAACGTCG TCGTGATGGA

651 CGGCGGCGTT ATCGTAGAGC AGGGCAGCCC GAAAGAGTTG TTCGACCACC

701 TCAAACACGA ACGGACGCGG AGATTTTTAA GCCAAATCCA ATCTGCCAAG

751 ATTTGA
```

This corresponds to the amino acid sequence <SEQ ID 452; ORF 122-1.ng>:

g122-1.pep

```
  1 MIKIRNIHKT FGENTILRGI DLDVGKGQVV VILGPSGSGK TTFLRCLNAL
 51 EMPEDGQIEF DNARPLRIDF SKKTSKHDIL ALRRKSGMVF QQYNLFPHKT
101 VLENVMEGPV AVQGKPAAQA REEALKLLEK VGLGDKVDLY PYQLSGGQQQ
151 RVGIARALAI QPELMLFDEP TSALDPELVQ DVLDAMKELA REGWTMVVVT
201 HEIKFTLEVA TNVVVMDGGV IVEQGSPKEL FDHLKHERTR RFLSQIQSAK
251 I*
```

The following partial DNA sequence was identified in *N. meningitidis* <SEQ ID 453>:

m122-1.seq

```
  1 ATGATTAAAA TCCGCAATAT CCATAAGACC TTTGGCGAAA ACACTATTTT
 51 GCGCGGCATC GATTTGGATG TGTGCAAAGG GCAGGTGGTC GTCATCCTCG
101 GGCCTTCCGG CTCAGGCAAA ACGACGTTTC TGCGATGCCT AAACGCGTTG
151 GAAATGCCCG AAGACGGACA AATCGAGTTC GACAACGAGC GACCGCTGAA
201 AATCGATTTT TCTAAAAAAC CAAGCAAACA CGATATTTTG GCACTGCGCC
251 GCAAATCAGG CATGGTGTTT CAACAATACA ACCTCTTTCC GCACAAAACC
301 GCCTTGGAAA ACGTAATGGA AGGACCGGTT GCCGTACAGG GCAAGCCTGC
351 CGCCCAAGCG CGCGAAGAGG CTCTGAAACT GCTGGAAAAA GTCGGCTTGG
401 GCGACAAAGT GGATTTGTAT CCCTACCAGC TTTCCGGCGG TCAGCAGCAG
451 CGCGTCGGCA TTGCCCGCGC ATTGGCGATT CAGCCTGAAC TGATGCTGTT
501 TGACGAACCG ACTTCCGCGC TCGATCCTGA ATTGGTGCAA GATGTTTTGG
551 ATACCATGAA GGAATTGGCG CAAGAAGGCT GGACCATGGT TGTCGTTACG
601 CATGAAATCA AGTTCGCCTT AGAAGTGGCA ACCACCGTCG TCGTGATGGA
651 CGGCGGCGTT ATTGTCGAAC AAGGCAGCCC GCAAGATTTG TTCGACCACC
701 CCAAACACGA ACGGACGCGG AGATTTTTAA GCCAAATCCA ATCTACCAAG
751 ATTTGA
```

This corresponds to the amino acid sequence <SEQ ID 454; ORF 122-1>:

m122-1.pep

```
  1 MIKIRNIHKT FGENTILRGI DLDVCKGQVV VILGPSGSGK TTFLRCLNAL
 51 EMPEDGQIEF DNERPLKIDF SKKPSKHDIL ALRRKSGMVF QQYNLFPHKT
101 ALENVMEGPV AVQGKPAAQA REEALKLLEK VGLGDKVDLY PYQLSGGQQQ
151 RVGIARALAI QPELMLFDEP TSALDPELVQ DVLDTMKELA QEGWTMVVVT
201 HEIKFALEVA TTVVVMDGGV IVEQGSPQDL FDHPKHERTR RFLSQIQSTK
251 I*
```

m122-1/g122-1 94.8% identity in 251 aa overlap

```
                      10        20        30        40        50        60
m122-1.pep  MIKIRNIHKTFGENTILRGIDLDVCKGQVVVILGPSGSGKTTFLRCLNALEMPEDGQIEF
            |||||||||||||||||||||||| |||||||||||||||||||||||||||||||||||
g122-1      MIKIRNIHKTFGENTILRGIDLDVGKGQVVVILGPSGSGKTTFLRCLNALEMPEDGQIEF
                      10        20        30        40        50        60

                      70        80        90       100       110       120
m122-1.pep  DNERPLKIDFSKKPSKHDILALRRKSGMVFQQYNLFPHKTALENVMEGPVAVQGKPAAQA
            || |||:|||||| |||||||||||||||||||||||||||:||||||||||||||||||
g122-1      DNARPLKIDFSKKTSKHDILALRRKSGMVFQQYNLFPHKTVLENVMEGPVAVQGKPAAQA
                      70        80        90       100       110       120

                     130       140       150       160       170       180
m122-1.pep  REEALKLLEKVGLGDKVDLYPYQLSGGQQQRVGIARALAIQPELMLFDEPTSALDPELVQ
            ||||||||||||||||||||||||||||||||||||||||||||||||||||||||||||
g122-1      REEALKLLEKVGLGDKVDLYPYQLSGGQQQRVGIARALAIQPELMLFDEPTSALDPELVQ
                     130       140       150       160       170       180

                     190       200       210       220       230       240
m122-1.pep  DVLDTMKELAQEGWTMVVVTHEIKFALEVATTVVVMDGGVIVEQGSPQDLFDHPKHERTR
            ||||:|||||:||||||||||||||:|||||:||||||||||||||||::||||| |||||
g122-1      DVLDAMKELAREGWTMVVVTHEIKFTLEVATNVVVMDGGVIVEQGSPKELFDHLKHERTR
                     190       200       210       220       230       240

                     250
m122-1.pep  RFLSQIQSTKIX
            ||||||||:|||
g122-1      RFLSQIQSAKIX
                     250
```

The following partial DNA sequence was identified in *N. meningitidis* <SEQ ID 455>:

a122-1.seq

```
  1 ATGATTAAAA TCCGCAATAT CCATAAGACC TTCGGCAAAA ATACCATTTT
 51 GCGCGGCATC AATTTGGATG TGTGCAAAGG GCAGGTGGTC GTCATCCTCG
101 GGCCTTCCGG CTCAGGCAAA ACGACGTTTC TGCGATGCCT AAACGCGTTG
151 GAAATGCCCG AAGACGGACA AATCGAGTTC GACAACGAGC GACCGCTGAA
201 AATCGATTTT TCTAAAAAAC CAAGCAAACA CGATATTTTG GCACTGCGCC
251 GCAAATCAGG CATGGTGTTT CAACAATACA ACCTCTTTCC GCACAAAACC
301 GCCTTGGAAA ACGTGATGGA AGGACCGGTT GCCGTACAGG GCAAGCCTGC
351 CGCCCAAGCG CGCGAAGAGG CTCTGAAACT GCTGGAAAAA GTCGGCTTGG
401 GCGACAAAGT GGATTTGTAT CCCTACCAGC TTTCCGGCGG TCAGCAGCAG
451 CGCGTCGGCA TTGCCCGAGC ATTGGCGATT CAGCCCGAGC TGATGTTGTT
501 TGACGAACCC ACTTCCGCGC TTGACCCCGA GTTGGTGCAA GACGTGTTGA
551 ACGCCATGAA GGAATTGGCG CGGGAAGGTT GGACGATGGT CGTCGTTACC
601 CACGAAATCA AGTTCGCGCT GGAAGTTGCC ACGACCGTTG TCGTGATGGA
651 CGGCGGCGTT ATCGTAGAGC AGGGCAGCCC GAAAGAGTTG TTCGACCACC
701 CCAAACACGA ACGGACGCGG AGATTTTTAA GCCAAATCCA ATCTACCAAG
751 ATTTGA
```

This corresponds to the amino acid sequence <SEQ ID 456; ORF 122-1.a>:

a122-1.pep

```
  1 MIKIRNIHKT FGKNTILRGI NLDVCKGQVV VILGPSGSGK TTFLRCLNAL
 51 EMPEDGQIEF DNERPLKIDF SKKPSKHDIL ALRRKSGMVF QQYNLFPHKT
101 ALENVMEGPV AVQGKPAAQA REEALKLLEK VGLGDKVDLY PYQLSGGQQQ
```

-continued

```
151 RVGIARALAI QPELMLEDEP TSALDPELVQ DVLNAMKELA REGWTMVVVT

201 HEIKFALEVA TTVVVMDGGV IVEQGSPKEL FDHPKHERTR RFLSQIQSTK

251 I*
```

a122-1/m122-1 97.2% identity in 251 aa overlap

```
                    10        20        30        40        50        60
a122-1.pep  MIKIRNIHKTFGKNTILRGINLDVCKGQVVVILGPSGSGKTTFLRCLNALEMPEDGQIEF
            ||||||||||||:|||||||:|||||||||||||||||||||||||||||||||||||||
m122-1      MIKIRNIHKTFGENTILRGIDLDVCKGQVVVILGPSGSGKTTFLRCLNALEMPEDGQIEF
                    10        20        30        40        50        60

                    70        80        90       100       110       120
a122-1.pep  DNERPLKIDFSKKPSKHDILALRRKSGMVFQQYNLFPHKTALENVMEGPVAVQGKPAAQA
            ||||||||||||||||||||||||||||||||||||||||||||||||||||||||||||
m122-1      DNERPLKIDFSKKPSKHDILALRRKSGMVFQQYNLFPHKTALENVMEGPVAVQGKPAAQA
                    70        80        90       100       110       120

                   130       140       150       160       170       180
a122-1.pep  REEALKLLEKVGLGDKVDLYPYQLSGGQQQRVGIARALAIQPELMLFDEPTSALDPELVQ
            ||||||||||||||||||||||||||||||||||||||||||||||||||||||||||||
m122-1      REEALKLLEKVGLGDKVDLYPYQLSGGQQQRVGIARALAIQPELMLFDEPTSALDPELVQ
                   130       140       150       160       170       180

                   190       200       210       220       230       240
a122-1.pep  DVLNAMKELAREGWTMVVVTHEIKFALEVATTVVVMDGGVIVEQGSPKELFDHPKHERTR
            |||::|||||:||||||||||||||||||||||||||||||||||||::|||||||||||
m122-1      DVLDTMKELAQEGWTMVVVTHEIKFALEVATTVVVMDGGVIVEQGSPQDLFDHPKHERTR
                   190       200       210       220       230       240

                   250
a122-1.pep  RFLSQIQSTKIX
            ||||||||||||
m122-1      RFLSQIQSTKIX
                   250
```

The following partial DNA sequence was identified in *N. gonorrhoeae* <SEQ ID 457>:

g125.seq

```
  1 ATGTCGGGCA ATGCCTCCTC TCCTTCATCT TCCGCCGCCA TCGGGCTGGT

 51 TTGGTTCGGC GCGGCGGTAT CGATTGCCGA AATCAGCACG GGTACGCTGC

101 TCGCCCCCTT GGGCTGGCAG CGCGGTCTGG CGGCCCTGCT TTTGGGTCAT

151 GCCGTCGGCG GCGCGCTGTT TTTTGCGGCG GCGTATATCG GCGCACTGAC

201 CGGACGCAGC TCGATGGAAA GTGTGCGCCT GTCGTTCGGC AAATGCGGTT

251 CAGTGCTGTT TTCCGTGGCG AATATGCTGC AACTGGCCGG CTGGACGGCG

301 GTGATGATTT ACGTCGGCGC AacggTCAGC TCCGCTTTGG GCAAAGTGTT

351 GTGGGACggc gaATCCTTTG TCTGGTGGGC ATTGGCAAAC GGCGCACTGA

401 TCGTGCTGTG GCTGGTTTTC GGCGCACGCA GAACGGGCGG GCTGAAAACC

451 GTTTCGATGC TGCTGATGCT GCTTGCCGTG TTGTGGTTGA GCGTCGAAGT

501 GTTCGCTTCG TCCGGCACAA ACGCCGCGCC CGCCGTTTCA GACGGCATGA

551 CCTTCGGAAC GGCAGTCGAA CTGTCCGCCG TCATGCCGCT TTCCTGGCTG

601 CCGCTGGCCG CCGACTACAC GCGCCAAGCA CGCCGCCCGT TTGCGGCAAC

651 CCTGACGGCA ACGCTCGCCT ATACGCTGAC GGGCTGCTGG ATGTATGCCT

701 TGGGTTTGGC GGCGGCTCTG TTTACCGGAG AAACCGACGT GGCGAAAATC

751 CTGTTGGGCG CGGGCTTGGG CATAACGGGC ATTCTGGCAG TCGTCCTCTC

801 CACCGTTACC ACAACGTTTC TCGATACCTA TTCCGCCGGC GCGAGTGCGA
```

-continued

```
 851 ACAACATTTC CGCGCGTTTT GCGGAAATAC CCGTCGCTGT CGGCGTTACC

 901 CTGatccgca ccgtgcttgc cgtcatgctg cccgttaccg aatataaaaa

 951 cttcctgctg cttatccgct cggtatttgg gccgatggcg ggtggttttg

1001 attgccgaCT TTTttgtctt AAAACGGCGT GA
```

This corresponds to the amino acid sequence <SEQ ID 458; ORF 125.ng>:

The following partial DNA sequence was identified in *N. meningitidis* <SEQ ID 459>:

m125.seq

```
   1 ATGTCGGGCA ATGCCTCCTC TCCTTCATCT TCCTCCGCCA TCGGGCTGAT

  51 TTGGTTCGGC GCGGCGGTAT CGATTGCCGA AATCAGCACG GGTACGCTGC

 101 TTGCGCCTTT GGGCTGGCAG CGCGGTCTGG CGGCTCTACT TTTGGGTCAT

 151 GCCGTCGGCG GCGCGCTGTT TTTTGCGGCG GCGTATATCG GCGCACTGAC

 201 CGGACGCAGC TCGATGGAAA GCGTGCGCCT GTCGTTCGGC AAACGCGGTT

 251 CAGTGCTGTT TTCCGTGGCG AATATGCTGC AACTGGCCGG CTGGACGGCG

 301 GTGATGATTT ACGCCGGCGC AACGGTCAGC TCCGCTTTGG GCAAAGTGTT

 351 GTGGGACGGC GAATCTTTTG TCTGGTGGGC ATTGGCAAAC GGCGCGCTGA

 401 TTGTGCTGTG GCTGGTTTTC GGCGCACGCA AAACAGGCGG GCTGAAAACC

 451 GTTTCGATGC TGCTGATGCT GTTGGCGGTT CTGTGGCTGA GTGCCGAAGT

 501 CTTTTCCACG GCAGGCAGCA CCGCCGCACA GGTTTCAGAC GGCATGAGTT

 551 TCGGAACGGC AGTCGAGCTG TCCGCCGTGA TGCCGCTTTC CTGGCTGCCG

 601 CTTGCCGCCG ACTACACGCG CCACGCGCGC CGCCCGTTTG CGGCAACCCT

 651 GACGGCAACG CTCGCCTACA CGCTGACCGG CTGCTGGATG TATGCCTTGG

 701 GTTTGGCAGC GGCGTTGTTC ACCGGAGAAA CCGACGTGGC AAAAATCCTG

 751 CTGGCCGCAr GTTTGgGTGC GGCAGGCATT TTGGCGGTCG TCCTCTCCAC

 801 CGTTACCACA ACGTTTCTCG ATGCCTATTC CGCCGGCGCG AGTGCGAACA

 851 ACATTTCCGC GCGTTTTGCG GAAACACCCG TCGCTGTCrG CGTTACCCTG

 901 ATCGGCACGG TACTTGCCGT CATGCTGCCC GTTACCGAAT ATGAAAACTT

 951 CCTGCTGCTT ATCGGCTCGG TATTTGCGCC GATGGCGGgC GGTTTTGATT

1001 GCCGACTTTT TCGTCTTGAA ACGGCGTGA
```

This corresponds to the amino acid sequence <SEQ ID 460; ORF 125>:

m125.pep

```
  1 MSGNASSPSS SSAIGLIWFG AAVSIAEIST GTLLAPLGWQ RGLAALLLGH

 51 AVGGALFFAA AYIGALTGRS SMESVRLSFG KRGSVLFSVA NMLQLAGWTA

101 VMIYAGATVS SALGKVLWDG ESFVWWALAN GALIVLWLVF GARKTGGLKT

151 VSMLLMLLAV LWLSAEVFST AGSTAAQVSD GMSFGTAVEL SAVMPLSWLP
```

-continued

```
201 LAADYTRHAR RPFAATLTAT LAYTLTGCWM YALGLAAALF TGETDVAKIL

251 LGAXLGAAGI LAVVLSTVTT TFLDAYSAGA SANNISARFA ETPVAVXVTL

301 IGTVLAVMLP VTEYENFLLL IGSVFAPMAG GFDCRLFRLE TA*
```

Computer analysis of this amino acid sequence gave the following results:

Homology with a predicted ORF from *N. gonorrhoeae*

ORF 125 shows 92.1% identity over a 343 aa overlap with a predicted ORF (ORF 125.ng) from *N. gonorrhoeae*:

```
m125/g125

                        10        20        30        40        50        60
m125.pep        MSGNASSPSSSSAIGLIWFGAAVSIAEISTGTLLAPLGWQRGLAALLLGHAVGGALFFAA
                |||||||||||:||||:|||||||||||||||||||||||||||||||||||||||||||
g125            MSGNASSPSSSAAIGLVWFGAAVSIAEISTGTLLAPLGWQRGLAALLLGHAVGGALFFAA
                        10        20        30        40        50        60

                        70        80        90       100       110       120
m125.pep        AYIGALTGRSSMESVRLSFGKRGSVLFSVANMLQLAGWTAVMIYAGATVSSALGKVLWDG
                ||||||||||||||||||||| ||||||||||||||||||||||:|||||||||||||||
g125            AYIGALTGRSSMESVRLSFGKCGSVLFSVANMLQLAGWTAVMIYVGATVSSALGKVLWDG
                        70        80        90       100       110       120

                       130       140       150       160       170       179
m125.pep        ESFVWWALANGALIVLWLVFGARKTGGLKTVSMLLMLLAVLWLSAEVFSTAGSTAAQ-VS
                |||||||||||||||||||||||:|||||||||||||||||||||:|||:::|::||  ||
g125            ESFVWWALANGALIVLWLVFGARRTGGLKTVSMLLMLLAVLWLSVEVFASSGTNAAPAVS
                       130       140       150       160       170       180

             180       190       200       210       220       230       239
m125.pep        DGMSFGTAVELSAVMPLSWLPLAADYTRHARRPFAATLTATLAYTLTGCWMYALGLAAAL
                |||:||||||||||||||||||||||||:|||||||||||||||||||||||||||||||
g125            DGMTFGTAVELSAVMPLSWLPLAADYTRQARRPFAATLTATLAYTLTGCWMYALGLAAAL
                       190       200       210       220       230       240

             240       250       260       270       280       290       299
m125.pep        FTGETDVAKILLGAXLGAAGILAVVLSTVTTTFLDAYSAGASANNISARFAETPVAVXVT
                ||||||||||||||||| :||||||||||||||||:|||||||||||||||| |||| ||
g125            FTGETDVAKILLGAXLGITGILAVVLSTVTTTFLDTYSAGASANNISARFAEIPVAVGVT
                       250       260       270       280       290       300

             300       310       320       330       340
m125.pep        LIGTVLAVMLPVTEYENFLLLIGSVFAPMAGGFDCRLFRLETAX
                || ||||||||||||:|||||| |||:||||||||||| |:|||
g125            LIRTVLAVMLPVTEYKNFLLLIRSVFGPMAGGFDCRLFCLKTAX
                       310       320       330       340
```

The following partial DNA sequence was identified in *N. meningitidis* <SEQ ID 461>:

a125.seq

```
  1 ATGTCGGGCA ATGCCTCCTC TCCTTCATCT TCCGCCGCCA TCGGGCTGAT

 51 TTGGTTCGGC GCGGCGGTAT CGATTGCCGA AATCAGCACG GGTACACTGC

101 TTGCGCCTTT GGGCTGGCAG CGCGGTCTGG CGGCTCTGCT TTTGGGTCAT

151 GCCGTCGGCG GCGCGCTGTT TTTTGCGGCG GCGTATATCG GCGCACTGAC

201 CGGACGCAGC TCGATGGAAA GCGTGCGCCT GTCGTTCGGC AAACGCGGTT

251 CAGTGCTGTT TTCCGTGGCG AATATGCTGC AACTGGCCGG CTGGACGGCG

301 GTGATGATTT ACGCCGGCGC AACGGTCAGC TCCGCTTTGG GCAAAGTGTT

351 GTGGGACGGC GAATCTTTTG TCTGGTGGGC ATTGGCAAAC GGCGCGCTGA

401 TTGTGCTGTG GCTGGTTTTC GGCGCACGCA AAACAGGCGG GCTGAAAACC

451 GTTTCGATGC TGCTGATGCT GTTGGCGGTT CTGTGGCTGA GTGCCGAAGT

501 CTTTTCCACG GCAGGCAGCA CCGCCGCACA GGTTTCAGAC GGCATGAGTT
```

-continued

```
 551 TCGGAACGGC AGTCGAGCTG TCCGCCGTGA TGGCGCTTTC TTGGCTGCCG

 601 CTGGCCGCCG ACTACACGCG CCACGCGCGC CGCCCGTTTG CGGCAACCCT

 651 GACGGCAACG CTCGCCTACA CGCTGACCGG CTGCTGGATG TATGCCTTGG

 701 GTTTGGCAGC GGCGTTGTTC ACCGGAGAAA CCGACGTGGC AAAAATCCTG

 751 CTGGGCGCAG GTTTGGGTGC GGCAGGCATT TTGGCGGTCG TCCTGTCGAC

 801 CGTTACCACC ACTTTTCTCG ATGCCTACTC CGCCGGCGTA AGTGCCAACA

 851 ATATTTCCGC CAAACTTTCG GAAATACCCA TCGCCGTTGC CGTCGCCGTT

 901 GTCGGCACAC TGCTTGCCGT CCTCCTGCCC GTTACCGAAT ATGAAAACTT

 951 CGTGCTGCTT ATCGGCTCGG TATTTGCGCC GATGGCG.GC GGTTTTGATT

1001 GCCGACTTTT TCGTCTTGAA ACGGCGTGA
```

This corresponds to the amino acid sequence <SEQ ID 462; ORF 125.a>:

```
a125.pep

  1 MSGNASSPSS SAAIGLIWFG AAVSIAEIST GTLLAPLGWQ RGLAALLLGH

 51 AVGGALFFAA AYIGALTGRS SMESVRLSFG KRGSVLFSVA NMLQLAGWTA

101 VMIYAGATVS SALGKVLWDG ESFVWWALAN GALIVLWLVF GARKTGGLKT

151 VSMLLMLLAV LWLSAEVFST AGSTAAQVSD GMSFGTAVEL SAVMPLSWLP

201 LAADYTRHAR RPFAATLTAT LAYTLTGCWM YALGLAAALF TGETDVAKIL

251 LGAGLGAAGI LAVVLSTVTT TFLDAYSAGV SANNISAKLS EIPIAVAVAV

301 VGTLLAVLLP VTEYENFLLL IGSVFAPMAX GFDCRLFRLE TA*
```

m125/a125 95.6% identity in 342 aa overlap

```
                   10        20        30        40        50        60
m125.pep   MSGNASSPSSSSAIGLIWFGAAVSIAEISTGTLLAPLGWQRGLAALLLGHAVGGALFFAA
           |||||||||||:||||||||||||||||||||||||||||||||||||||||||||||||
a125       MSGNASSPSSSAAIGLIWFGAAVSIAEISTGTLLAPLGWQRGLAALLLGHAVGGALFFAA
                   10        20        30        40        50        60

                   70        80        90       100       110       120
m125.pep   AYIGALTGRSSMESVRLSFGKRGSVLFSVANMLQLAGWTAVMIYAGATVSSALGKVLWDG
           ||||||||||||||||||||||||||||||||||||||||||||||||||||||||||||
a125       AYIGALTGRSSMESVRLSFGKRGSVLFSVANMLQLAGWTAVMIYAGATVSSALGKVLWDG
                   70        80        90       100       110       120

                  130       140       150       160       170       180
m125.pep   ESFVWWALANGALIVLWLVFGARKTGGLKTVSMLLMLLAVLWLSAEVFSTAGSTAAQVSD
           ||||||||||||||||||||||||||||||||||||||||||||||||||||||||||||
a125       ESFVWWALANGALIVLWLVFGARKTGGLKTVSMLLMLLAVLWLSAEVFSTAGSTAAQVSD
                  130       140       150       160       170       180

                190       200       210       220       230       240
m125.pep   GMSFGTAVELSAVMPLSWLPLAADYTRHARRPFAATLTATLAYTLTGCWMYALGLAAALF
           ||||||||||||||||||||||||||||||||||||||||||||||||||||||||||||
a125       GMSFGTAVELSAVMPLSWLPLAADYTRHARRPFAATLTATLAYTLTGCWMYALGLAAALF
                190       200       210       220       230       240

                  250       260       270       280       290       300
m125.pep   TGETDVAKILLGAXLGAAGILAVVLSTVTTTFLDAYSAGASANNISARFAETPVAVXVTL
           ||||||||||||| |||||||||||||||||||||||||||||||||:::| |:|| |::
a125       TGETDVAKILLGAGLGAAGILAVVLSTVTTTFLDAYSAGVSANNISAKLSEIPIAVAVAV
                  250       260       270       280       290       300

                  310       320       330       340
m125.pep   IGTVLAVMLPVTEYENFLLLIGSVFAPMAGGFDCRLFRLETAX
           :||:|||:||||||||||||||||||||| |||||||||||||
a125       VGTLLAVLLPVTEYENFLLLIGSVFAPMAXGFDCRLFRLETAX
```

The following partial DNA sequence was identified in *N. gonorrhoeae* <SEQ ID 463>:

g126.seq

```
  1 AtgccgtcTG AAaccCcaaa ggcACGCCGC CGGCTTTCAG ACGGCATCGC
 51 GTCCGACAAC CATACCAAAG AATCCATCAT GCTCACCctg tacggcGAAA
101 CTTTCCCTTC GCGGCTGCTg ctcggcacgG cggcctacCC GACCCCTGAA
151 ATCCTCAAAC AATCCGTCCG AACCGCCCGG CCCGCGATGA ttaccGTCTC
201 GCTGCGCCGC ACGGGATGCG GCGGCGAGGC GCACGGTCAG GGGTTTTGGT
251 CGCTGCTTCA AGAAACCGGC GTTCCCGTCC TGCCGAACAC GGCAGGCTGC
301 CAAAGCGTGC AGGAAGCGGT AACGACGGCG CAAATGGCGC GCGAAGTGTT
351 TGAAACCGAT TGGATAAAAT TGGAACTCAT CGGCGACGAC GACACCTTGC
401 AGCCGGACGT GTTCCAACTC GTCGAAGCGG CGGAAATCCT GATTAAAGAC
451 GGCTTCAAAG TGCTGCCTTA TTGCACCGAA GACCTGATTG CCTGCCGCCG
501 CCTGCTCGAT GCGGGCTGTC AGGCGTTGAT GCCGTGGGCG GCTCCCATCG
551 GCACGGGTTT GGGGGCGGTT CACGCCTATG CGCTCAAAAT CCTGCGCGAA
601 CGCCTGCCCG ACACGCCGCT GATTATCGAC GCGGGCTTGG GTTTGCCTTC
651 CCAAGCGGCA CAAGTGATGG AATGGGGTTT TGACGGCGTA TTGTTAAACA
701 CCGCCGTTTC CCGCAGCGGC GACCCCGTCA ACATGGCGCG CGCCTTCGCA
751 CTCGCCGTCG AATCCGGACG GCTGGCATTT GAAGCCGGGC CGGTCGAAGC
801 GCGAACCAAA GCCCAAGCCA GCACGCCGAC AGTCGGACAA CCGTTTTGGC
851 ATTCGGCGGA ATATTGA
```

This corresponds to the amino acid sequence <SEQ ID 464; ORF 126.ng>:

g126.pep

```
  1 MPSETPKARR RLSDGIASDN HTKESIMLTL YGETFPSRLL LGTAAYPTPE
 51 ILKQSVRTAR PAMITVSLRR TGCGGEAHGQ GFWSLLQETG VPVLPNTAGC
101 QSVQEAVTTA QMAREVFETD WIKLELIGDD DTLQPDVFQL VEAAEILIKD
151 GFKVLPYCTE DLIACRRLLD AGCQALMPWA APIGTGLGAV HAYALKILRE
201 RLPDTPLIID AGLGLPSQAA QVMEWGFDGV LLNTAVSRSG DPVNMARAFA
251 LAVESGRLAF EAGPVEARTK AQASTPTVGQ PFWHSAEY*
```

The following partial DNA sequence was identified in *N. meningitidis* <SEQ ID 465>:

m126.seq (partial)

```
  1 ..CACTATACAA AGGAACCCAT TATGCTCACC CTATACGGCG AAACTTTCCC
 51   CTCGCGGCTG CTGCTCGGCA CGGCTGCCTA CCCGACCCCC GAAATCCTCA
101   AACAATCCAT CCAAACCGCC CAGCCTGCGA TGATTACCGT CTCGCTGCGC
151   CGCGCGGGAA GCGGCGGCGA GGCGCACGGT CAGGGGTTTT GGTCGCTGCT
201   TCAAGAAACC GGCGTTCCCG TCCTGCCGAA CACGGCAGGC TGCCAAAGCG
```

-continued

```
251   TGCAGGAAGC GGTAACGACG GCGCAAATGG CGCGCGAAGT GTTTGAAACC

301   GATTGGATAA AATTGGAACT CATCGGAGAT GACGACACCT TGCAGCCGGA

351   TGTGTTCCAG CTTGTCGAAG CGGCGGAAAT CCTGATTAAA GACGGCTTCA

401   AAGTGCTGCC TTATTGCACC GAAGACCTGA TTGCCTGCCG CCGCCTGCTC

451   GACGCGGGCT GTCAGGCGTT GATGCCGTGG GCGGCCCCGA TCGGCACGGG

501   TTTGGGCGCG GTTCACGCCT ACGCGTTGAA CGTCCTGCGC GAACGCCTGC

551   CCGACACGCC GCTGATTATC GACGCGGGCT TGGGTTTGCC CTCACAGGCG

601   GCACAAGTGA TGGAATGGGG CTTTGACGGC GTGCTTTTGA ATACTGCCGT

651   TTCCCGCAGC GGCGATCCGG TCAATATGGC ACGCGCCTTC GCACTCGCCG

701   TCGAATCCGG ACGGCTGGCA TTTGAAGCCG GACCGGTCGA AGCACGCGAC

751   AAAGCGCAAG CCAGCACGCC GACAGTCGGA CAACCGTTTT GGCATTCGGC

801   GGAATATTGA
```

This corresponds to the amino acid sequence <SEQ ID 466: ORF 126>:

m126.pep (partial)

```
  1 ..HYTKEPIMLT LYGETFPSRL LLGTAAYPTP EILKQSIQTA QPAMITVSLR

 51   RAGSGGEAHG QGFWSLLQET GVPVLPNTAG CQSVQEAVTT AQMAREVFET

101   DWIKLELIGD DDTLQPDVFQ LVEAAEILIK DGFKVLPYCT EDLIACRRLL

151   DAGCQALMPW AAPIGTGLGA VHAYALNVLR ERLPDTPLII DAGLGLPSQA

201   AQVMEWGFDG VLLNTAVSRS GDPVNMARAF ALAVESGRLA FEAGPVEARD

251   KAQASTPTVG QPFWHSAEY*
```

Computer analysis of this amino acid sequence gave the following results:

Homology with a predicted ORF from *N. gonorrhoeae*

ORF 126 shows 95.9% identity over a 269 aa overlap with a predicted ORF (ORF 126.ng) from *N. gonorrhoeae*:

```
m126/g126

                                      10        20        30        40
m126.pep                      HYTKEPIMLTLYSETFPSRLLLGTAAYPTPEILKQSIQTAQ
                              ::||| ||||||||||||||||||||||||||||||::||:
g126       MPSETPKARRRLSDGIASDNHTKESIMLTLYGETFPSRLLLGTAAYPTPEILKQSVRTAR
                   10        20        30        40        50        60

                  50        60        70        80        90       100
m126.pep   PAMITVSLRRAGSGGEAHGQGFWSLLQETGVPVLPNTAGCQSVQEAVTTAQMAREVFETD
           ||||||||||:| |||||||||||||||||||||||||||||||||||||||||||||||
g126       PAMITVSLRRTGCGGEAHGQGFWSLLQETGVPVLPNTAGCQSVQEAVTTAQMAREVFETD
                   70        80        90       100       110       120

                  110       120       130       140       150       160
m126.pep   WIKLELIGDDDTLQPDVFQLVEAAEILIKDGFKVLPYCTEDLIACRRLLDAGCQALMPWA
           ||||||||||||||||||||||||||||||||||||||||||||||||||||||||||||
g126       WIKLELIGDDDTLQPDVFQLVEAAEILIKDGFKVLPYCTEDLIACRRLLDAGCQALMPWA
                  130       140       150       160       170       180

                  170       180       190       200       210       220
m126.pep   APIGTGLGAVHAYALNVLRERLPDTPLIIDAGLGLPSQAAQVMEWGFDGVLLNTAVSRSG
           |||||||||||||||::|||||||||||||||||||||||||||||||||||||||||||
g126       APIGTGLGAVHAYALKILRERLPDTPLIIDAGLGLPSQAAQVMEWGFDGVLLNTAVSRSG
                  190       200       210       220       230       240
```

-continued

```
                 230        240        250        260        270
m126.pep  DPVNMARAFALAVESGRLAFEAGPVEARDKAQASTPTVGQPEWHSAEYX
          |||||||||||||||||||||||||||| ||||||||||||||||||||
g126      DPVNMARAFALAVESGRLAFEAGPVEARTKAQASTPTVGQPEWHSAEYX
                  250        260        270        280
```

The following partial DNA sequence was identified in *N. meningitidis* <SEQ ID 467>:

```
a126.seq
  1 TTGTTAATCC ACTATACAAA GGAACCCATT ATGCTCACCC TGTACAGCGA
 51 AACTTTCCCT TCGCGGCTGC TGCTCGGCAC AGCCGCCTAC CCGACCCCTG
101 AAATCCTCAA ACAATCCGTC CGAACCGCCC GGCCCGCGAT GATTACCGTC
151 TCGCTGCGCC GCGCGGGATG CGGCGGCGAG GCGCACGGTC AGGGGTTTTG
201 GTCGCTGCTT CAAGAAACCG GCGTTCCCGT CCTGCCGAAC ACGGCAGGCT
251 GCCAAAGCGT GCAGGAAGCG GTAACGACGG CGCAAATGGC GCGCGAAGTG
301 TTTGAAACCG ATTGGATTAA ACTCGAACTC ATCGGCGACG ACGACACCTT
351 GCAGCCGGAT GTGTTCCAAC TTGTCGAAGC GGCGGAAATC CTGATTAAAG
401 ACGGCTTCAA AGTGCTGCCT TATTGCACCG AAGACCTGAT TGCCTGCCGC
451 CGCCTGCTCG ACGCGGGCTG TCAGGCGTTG ATGCCGTGGG CGGCCCCGAT
501 CGGCACGGGT TTGGGCGCGG TTCACGCCTA CGCGTTGAAC GTCCTGCGCG
551 AACGCCTGCC CGACACGCCG CTGATTATCG ACGCGGGCTT GGGTTTGCCC
601 TCACAGGCGG CACAAGTGAT GGAATGGGGC TTTGACGGCG TGCTTTTGAA
651 TACTGCCGTT TCCCGCAGCG GCGATCCGGT CAATATGGCA CGCGCCTTCG
701 CACTCGCCGT CGAATCCGGA CGGCTGGCAT TTGAAGCCGG ACCGGTCGAA
751 GCACGCGACA AAGCGCAAGC CAGCACGCCG ACAGTCGGAC AACCGTTTTG
801 GCATTCGGCG GAATATTGA
```

This corresponds to the amino acid sequence <SEQ ID 468; ORF 126.a>:

```
a126.pep
  1 LLIHYTKEPI MLTLYSETFP SRLLLGTAAY PTPEILKQSV RTARPAMITV
 51 SLRRAGCGGE AHGQGFWSLL QETGVPVLPN TAGCQSVQEA VTTAQMAREV
101 FETDWIKLEL IGDDDTLQPD VFQLVEAAEI LIKDGFKVLP YCTEDLIACR
151 RLLDAGCQAL MPWAAPIGTG LGAVHAYALN VLRERLPDTP LIIDAGLGLP
201 SQAAQVMEWG FDGVLLNTAV SRSGDPVNMA RAFALAVESG RLAFEAGPVE
251 ARDKAQASTP TVGQPFWHSA EY*
```

m126/a126 98.1% identity in 269 aa overlap

```
                    10         20         30         40         50
m126.pep    HYTKEPIMLTLYGETFPSRLLLGTAAYPTPEILKQSIQTAQPAMITVSLRRAGSGGE
            ||||||||||||:|||||||||||||||||||||||::||:|||||||||||| |||
a126      LLIHYTKEPIMLTLYSETFPSRLLLGTAAYPTPEILKQSVRTARPAMITVSLRRAGCGGE
                  10        20        30        40        50        60
```

-continued

```
             60        70        80        90       100       110
m126.pep   AHGQGFWSLLQETGVPVLPNTAGCQSVQEAVTTAQMAREVFETDWIKLELIGDDDTLQPD
           ||||||||||||||||||||||||||||||||||||||||||||||||||||||||||||
a126       AHGQGFWSLLQETGVPVLPNTAGCQSVQEAVTTAQMAREVFETDWIKLELIGDDDTLQPD
                   70        80        90       100       110       120

           120       130       140       150       160       170
m126.pep   VFQLVEAAEILIKDGFKVLPYCTEDLIACRRLLDAGCQALMPWAAPIGTGLGAVHAYALN
           ||||||||||||||||||||||||||||||||||||||||||||||||||||||||||||
a126       VFQLVEAAEILIKDGFKVLPYCTEDLIACRRLLDAGCQALMPWAAPIGTGLGAVHAYALN
                  130       140       150       160       170       180

           180       190       200       210       220       230
m126.pep   VLRERLPDTPLIIDAGLGLPSQAAQVMEWGFDGVLLNTAVSRSGDPVNMARAFALAVESG
           ||||||||||||||||||||||||||||||||||||||||||||||||||||||||||||
a126       VLRERLPDTPLIIDAGLGLPSQAAQVMEWGFDGVLLNTAVSRSGDPVNMARAFALAVESG
                  190       200       210       220       230       240

           240       250       260       270
m126.pep   RLAFEAGPVEARDKAQASTPTVGQPEWHSAEYX
           |||||||||||||||||||||||||||||||||
a126       RLAFEAGPVEARDKAQASTPTVGQPEWHSAEYX
                  250       260       270
```

The following partial DNA sequence was identified in *N. gonorrhoeae* <SEQ ID 469>:

g126-1.seq

```
  1 ATGCTCACCC TGTACGGCGA AACTTTCCCT TCGCGGCTGC TGCTCGGCAC
 51 GGCCGCCTAC CCGACCCCTG AAATCCTCAA ACAATCCGTC CGAACCGCCC
101 GGCCCGCGAT GATTACCGTC TCGCTGCGCC GCACGGGATG CGGCGGCGAG
151 GCGCACGGTC AGGGGTTTTG GTCGCTGCTT CAAGAAACCG GCGTTCCCGT
201 CCTGCCGAAC ACGGCAGGCT GCCAAAGCGT GCAGGAAGCG GTAACGACGG
251 CGCAAATGGC GCGCGAAGTG TTTGAAACCG ATTGGATAAA ATTGGAACTC
301 ATCGGCGACG ACGACACCTT GCAGCCGGAC GTGTTCCAAC TCGTCGAAGC
351 GGCGGAAATC CTGATTAAAG ACGGCTTCAA AGTGCTGCCT TATTGCACCG
401 AAGACCTGAT TGCCTGCCGC CGCCTGCTCG ATGCGGGCTG TCAGGCGTTG
451 ATGCCGTGGG CGGCTCCCAT CGGCACGGGT TTGGGGGCGG TTCACGCCTA
501 TGCGCTCAAA ATCCTGCGCG AACGCCTGCC CGACACGCCG CTGATTATCG
551 ACGCGGGCTT GGGTTTGCCT TCCCAAGCGG CACAAGTGAT GGAATGGGGT
601 TTTGACGGCG TATTGTTAAA CACCGCCGTT TCCCGCAGCG GCGACCCCGT
651 CAACATGGCG CGCGCCTTCG CACTCGCCGT CGAATCCGGA CGGCTGGCAT
701 TTGAAGCCGG GCCGGTCGAA GCGCGAACCA AAGCCCAAGC CAGCACGCCG
751 ACAGTCGGAC AACCGTTTTG GCATTCGGCG GAATATTGA
```

This corresponds to the amino acid sequence <SEQ ID 470; ORF 126-1.ng>:

g126-1.pep

```
  1 MLTLYGETFP SRLLLGTAAY PTPEILKQSV RTARPAMITV SLRRTGCGGE
 51 AHGQGFWSLL QETGVPVLPN TAGCQSVQEA VTTAQMAREV FETDWIKLEL
101 IGDDDTLQPD VFQLVEAAEI LIKDGFKVLP YCTEDLIACR RLLDAGCQAL
151 MPWAAPIGTG LGAVHAYALK ILRERLPDTP LIIDAGLGLP SQAAQVMEWG
201 FDGVLLNTAV SRSGDPVNMA RAFALAVESG RLAFEAGPVE ARTKAQASTP
251 TVGQPFWHSA EY*
```

The following partial DNA sequence was identified in *N. meningitidis* <SEQ ID 471>:

m126-1.seq

```
  1 ATGCTCACCC TATACGGCGA AACTTTCCCC TCGCGGCTGC TGCTCGGCAC

 51 GGCTGCCTAC CCGACCCCCG AAATCCTCAA ACAATCCATC CAAACCGCCC

101 AGCCTGCGAT GATTACCGTC TCGCTGCGCC GCGCGGGAAG CGGCGGCGAG

151 GCGCACGGTC AGGGGTTTTG GTCGCTGCTT CAAGAAACCG GCGTTCCCGT

201 CCTGCCGAAC ACGGCAGGCT GCCAAAGCGT GCAGGAAGCG GTAACGACGG

251 CGCAAATGGC GCGCGAAGTG TTTGAAACCG ATTGGATAAA ATTGGAACTC

301 ATCGGAGATG ACGACACCTT GCAGCCGGAT GTGTTCCAGC TTGTCGAAGC

351 GGCGGAAATC CTGATTAAAG ACGGCTTCAA AGTGCTGCCT TATTGCACCG

401 AAGACCTGAT TGCCTGCCGC CGCCTGCTCG ACGCGGGCTG TCAGGCGTTG

451 ATGCCGTGGG CGGCCCCGAT CGGCACGGGT TTGGGCGCGG TTCACGCCTA

501 CGCGTTGAAC GTCCTGCGCG AACGCCTGCC CGACACGCCG CTGATTATCG

551 ACGCGGGCTT GGGTTTGCCC TCACAGGCGG CACAAGTGAT GGAATGGGGC

601 TTTGACGGCG TGCTTTTGAA TACTGCCGTT TCCCGCAGCG GCGATCCGGT

651 CAATATGGCA CGCGCCTTCG CACTCGCCGT CGAATCCGGA CGGCTGGCAT

701 TTGAAGCCGG ACCGGTCGAA GCACGCGACA AAGCGCAAGC CAGCACGCCG

751 ACAGTCGGAC AACCGTTTTG GCATTCGGCG GAATATTGA
```

This corresponds to the amino acid sequence <SEQ ID 5; ORF 126-1>:

m126-1.pep

```
  1 MLTLYGETFP SRLLLGTAAY PTPEILKQSI QTAQPAMITV SLRRAGSGGE

 51 AHGQGFWSLL QETGVPVLPN TAGCQSVQEA VTTAQMAREV FETDWIKLEL

101 IGDDDTLQPD VFQLVEAAEI LIKDGFKVLP YCTEDLIACR RLLDAGCQAL

151 MPWAAPIGTG LGAVHAYALN VLRERLPDTP LIIDAGLGLP SQAAQVMEWG

201 FDGVLLNTAV SRSGDPVNMA RAFALAVESG RLAFEAGPVE ARDKAQASTP

251 TVGQPFWHSA EY*
```

m126-1/a126-1 96.9% identity in 262 aa overlap

```
                      10        20        30        40        50        60
m126-1.pep    MLTLYGETFPSRLLLGTAAYPTPEILKQSIQTAQPAMITVSLRRAGSGGEAHGQGFWSLL
              |||||||||||||||||||||||||||||::||:||||||||||:| |||||||||||||
g126-1        MLTLYGETFPSRLLLGTAAYPTPEILKQSVRTARPAMITVSLRRTGCGGEAHGQGFWSLL
                      10        20        30        40        50        60

                      70        80        90       100       110       120
m126-1.pep    QETGVPVLPNTAGCQSVQEAVTTAQMAREVFETDWIKLELIGDDDTLQPDVFQLVEAAEI
              ||||||||||||||||||||||||||||||||||||||||||||||||||||||||||||
g126-1        QETGVPVLPNTAGCQSVQEAVTTAQMAREVFETDWIKLELIGDDDTLQPDVFQLVEAAEI
                      70        80        90       100       110       120

                     130       140       150       160       170       180
m126-1.pep    LIKDGFKVLPYCTEDLIACRRLLDAGCQALMPWAAPIGTGLGAVHAYALNVLRERLPDTP
              |||||||||||||||||||||||||||||||||||||||||||||||||::|||||||||
g126-1        LIKDGFKVLPYCTEDLIACRRLLDAGCQALMPWAAPIGTGLGAVHAYALKILRERLPDTP
                     130       140       150       160       170       180
```

-continued

```
                190       200       210       220       230       240
m126-1.pep  LIIDAGLGLPSQAAQVMEWGFDGVLLNTAVSRSGDPVNMARAFALAVESGRLAFEAGPVE
            ||||||||||||||||||||||||||||||||||||||||||||||||||||||||||||
g126-1      LIIDAGLGLPSQAAQVMEWGFDGVLLNTAVSRSGDPVNMARAFALAVESGRLAFEAGPVE
                190       200       210       220       230       240

                250       260
m126-1.pep  ARDKAQASTPTVGQPEWHSAEYX
            || ||||||||||||||||||||
g126-1      ARTKAQASTPTVGQPEWHSAEYX
                250       260
```

The following partial DNA sequence was identified in *N. meningitidis* <SEQ ID 473>:

a126-1.seq

```
  1 ATGCTCACCC TGTACAGCGA AACTTTCCCT TCGCGGCTGC TGCTCGGCAC
 51 AGCCGCCTAC CCGACCCCTG AAATCCTCAA ACAATCCGTC CGAACCGCCC
101 GGCCCGCGAT GATTACCGTC TCGCTGCGCC GCGCGGGATG CGGCGGCGAG
151 GCGCACGGTC AGGGGTTTTG GTCGCTGCTT CAAGAAACCG GCGTTCCCGT
201 CCTGCCGAAC ACGGCAGGCT GCCAAAGCGT GCAGGAAGCG GTAACGACGG
251 CGCAAATGGC GCGCGAAGTG TTTGAAACCG ATTGGATTAA ACTCGAACTC
301 ATCGGCGACG ACGACACCTT GCAGCCGGAT GTGTTCCAAC TTGTCGAAGC
351 GGCGGAAATC CTGATTAAAG ACGGCTTCAA AGTGCTGCCT TATTGCACCG
401 AAGACCTGAT TGCCTGCCGC CGCCTGCTCG ACGCGGGCTG TCAGGCGTTG
451 ATGCCGTGGG CGGCCCCGAT CGGCACGGGT TTGGGCGCGG TTCACGCCTA
501 CGCGTTGAAC GTCCTGCGCG AACGCCTGCC CGACACGCCG CTGATTATCG
551 ACGCGGGCTT GGGTTTGCCC TCACAGGCGG CACAAGTGAT GGAATGGGGC
601 TTTGACGGCG TGCTTTTGAA TACTGCCGTT TCCCGCAGCG GCGATCCGGT
651 CAATATGGCA CGCGCCTTCG CACTCGCCGT CGAATCCGGA CGGCTGGCAT
701 TTGAAGCCGG ACCGGTCGAA GCACGCGACA AAGCGCAAGC CAGCACGCCG
751 ACAGTCGGAC AACCGTTTTG GCATTCGGCG GAATATTGA
```

This corresponds to the amino acid sequence <SEQ ID 474; ORF 126-1.a>:

a126-1.pep

```
  1 MLTLYSETFP SRLLLGTAAY PTPEILKQSV RTARPAMITV SLRRAGCGGE
 51 AHGQGFWSLL QETGVPVLPN TAGCQSVQEA VTTAQMAREV FETDWIKLEL
101 IGDDDTLQPD VFQLVEAAEI LIKDGFKVLP YCTEDLIACR RLLDAGCQAL
151 MPWAAPIGTG LGAVHAYALN VLRERLPDTP LIIDAGLGLP SQAAQVMEWG
201 FDGVLLNTAV SRSGDPVNMA RAFALAVESG RLAFEAGPVE ARDKAQASTP
251 TVGQPFWHSA EY*
```

a126-1/m126-1 98.1% identity in 262 aa overlap

```
                   10         20         30         40         50         60
a126-1.pep  MLTLYSETFPSRLLLGTAAYPTPEILKQSVRTARPAMITVSLRRAGCGGEAHGQGFWSLL
            |||||:|||||||||||||||||||||||::||:|||||||||||| |||||||||||||
m126-1      MLTLYGETFPSRLLLGTAAYPTPEILKQSIQTAQPAMITVSLRRAGSGGEAHGQGFWSLL
                   10         20         30         40         50         60

                   70         80         90        100        110        120
a126-1.pep  QETGVPVLPNTAGCQSVQEAVTTAQMAREVFETDWIKLELIGDDDTLQPDVFQLVEAAEI
            ||||||||||||||||||||||||||||||||||||||||||||||||||||||||||||
m126-1      QETGVPVLPNTAGCQSVQEAVTTAQMAREVFETDWIKLELIGDDDTLQPDVFQLVEAAEI
                   70         80         90        100        110        120

                  130        140        150        160        170        180
a126-1.pep  LIKDGFKVLPYCTEDLIACRRLLDAGCQALMPWAAPIGTGLGAVHAYALNVLRERLPDTP
            ||||||||||||||||||||||||||||||||||||||||||||||||||||||||||||
m126-1      LIKDGFKVLPYCTEDLIACRRLLDAGCQALMPWAAPIGTGLGAVHAYALNVLRERLPDTP
                  130        140        150        160        170        180

                  190        200        210        220        230        240
a126-1.pep  LIIDAGLGLPSQAAQVMEWGFDGVLLNTAVSRSGDPVNMARAFALAVESGRLAFEAGPVE
            ||||||||||||||||||||||||||||||||||||||||||||||||||||||||||||
m126-1      LIIDAGLGLPSQAAQVMEWGFDGVLLNTAVSRSGDPVNMARAFALAVESGRLAFEAGPVE
                  190        200        210        220        230        240

                  250        260
a126-1.pep  ARDKAQASTPTVGQPEWHSAEYX
            ||||||||||||||||||||||
m126-1      ARDKAQASTPTVGQPEWHSAEYX
                  250        260
```

The following partial DNA sequence was identified in *N. gonorrhoeae* <SEQ ID 475>:

g127.seq

```
  1 ATGGAAATAT GGAATATGTT GAACACTTGG CCCGATGCCG TCCCGATACG
 51 CGCGGAGGCG GCCGAATCCG TGGCGGCGGT CGCGGCTTTG CTGCTGGCGC
101 GCGCCCTTCT GTTGAATATC CACTTCAGAC GGCATCCGGA TTTCGGCATC
151 GAAAGCAAGC GGCGGTTTTT GGTTGCCAGC CGCAATATAA CGCTGCTTTT
201 GGTGCTGTTT TCGCTGGCAT TTATCTGGTC GGCGCAAATT CAAACGCTGG
251 CTTTGTCGAT GTTTGCGGTG GCGGCGGCGG TCGTCGTGGC GACAAAAGAA
301 CTGATTATGT GTCTGTCGGG CAGTATTTTA aggtctGCCA CCCAGCAATA
351 CTCGGTCGGC GACTATATCG AAATCAACGG CCTGCGCGGG CGCGTGGTCG
401 ACATCAATCT GTTGAACACG CTGATGATGC AGGTCGGTCC GAACCCCTTG
451 GTCGGACAGC TTGCGGGAAC CACCGTTTCT TTCCCCAACA GCCTGTTGTT
501 GAGCCACCCC GTGCGCCGCG ACAATATTTT GGGCGACTAT GTCATCCATA
551 CGGTCGAAAT CCCCGTTCCC ATCCATTTGG ATTCGGATGA AGCCGTATGC
601 CGTCTGAAAG CCGTACTCGA GCCCTTGTGC GCGCCCTACA TCCCCGCCAT
651 TCAGCGGTAT TTGGAAAACG TGCAGGCGGA AAAACTGTTT ATCACGCCCG
701 CCGCCAGGCC GCGCGTTACC CGCGTACCGT ACGACGACAA GGCATACCGC
751 ATCATCGTCC GCTTCGCCTC CCCCGTTTCA AAGCGGCTGG AAATCCAACA
801 GGCGGTTATG GACGAATTTT TGCGCGTACA ATACCGCCTG TTAAATCATC
851 CCGCCGgctc cgAAACACTT TAA
```

This corresponds to the amino acid sequence <SEQ ID 476; ORF 127.ng>:

g127.pep

```
  1 MEIWNMLNTW PDAVPIRAEA AESVAAVAAL LLARALLLNI HFRRHPDFGI
 51 ESKRRFLVAS RNITLLLVLF SLAFIWSAQI QTLALSMFAV AAAVVVATKE
```

-continued

```
101 LIMCLSGSIL RSATQQYSVG DYIEINGLRG RVVDINLLNT LMMQVGPNPL
151 VGQLAGTTVS FPNSLLLSHP VRRDNILGDY VIHTVEIPVP IHLDSDEAVC
201 RLKAVLEPLC APYIPAIQRY LENVQAEKLF ITPAARPRVT RVPYDDKAYR
251 IIVRFASPVS KRLEIQQAVM DEFLRVQYRL LNHPAGSETL *
```

The following partial DNA sequence was identified in *N. meningitidis* <SEQ ID 477>:

m127.seq

```
  1 ATGGAAATAT GGAATATGTT GGACACTTGG CTCGGTGCCG TCCCGATACG
 51 TGCGGAGGCG GTCGAATCCG TGGCGGCGGT TGCGGCTTTG CTGCTGGCGC
101 GCGCCCTTCT GTTGAATATC CACTTCAAAC GGCATCCGGA TTTCGGCATC
151 GAAAGCAAGC GGCGGTTTTT GGTTGCCAGC CGCAATATAA CGCTGCTTTT
201 GGTGCTGTTT TCGCTGGCAT TTATCTGGTC GGCGCAAATC CAAACGCTGG
251 CTTTGTCGAT GTTTGCGGTG GCGGCGGCGG TCGTCGTGGC GACGAAGGAA
301 CTGATTATGT GTCTGTCGGG CAGTATTTTA AGGTCTGCCA CCCAGCAATA
351 CTCGGTCGGC GACTATATCG AAATCAACGG CCTGCGCGGG CGCGTGGTCG
401 ACATCAACCT GTTGAACACG CTGATGATGC AGGTCGGTCC GAACCCCTTG
451 GTCGGACAGC TTGCGGGAAC CACCGTTTCT TTCCCCAACA GCCTGTTGTT
501 GAGCCACCCC GTGCGCCGCG ACAATATTTT GGGCGACTAT GTCATCCATA
551 CGGTCGAAAT CCCCGTTCCC ATCCATTTGG ATTCGGATGA AGCCGTATGC
601 CGTCTGAAAG CCGTACTCGA GCCCTTGTGC GCGCCCTACA TCCCCGCCAT
651 CCAACGGsAT TTGGAAAACG TGCAGGCGGA AAAACTGTTT ATCACGCCCG
701 CCGCCAGACC GCGCGTTACC CGCGTGCCGT ACGATGACAA GGCATACCGC
751 ATCATCGTCC GCTTCGCTTC CCCCGTTTCA AAGCGGCTGG AAATCCAACA
801 GGCGGTTATG GACGAATTTT TGCGCGTACA ATACCGCCTG TTAAATCACC
851 CCGCCGGCTC CGAAACACTT TAA
```

This corresponds to the amino acid sequence <SEQ ID 478; ORF 127>:

m127.pep

```
  1 MEIWNMLDTW LGAVPIRAEA VESVAAVAAL LLARALLLNI HFKRHPDFGI
 51 ESKRRFLVAS RNITLLLVLF SLAFIWSAQI QTLALSMFAV AAAVVVATKE
101 LIMCLSGSIL RSATQQYSVG DYIEINGLRG RVVDINLLNT LMMQVGPNPL
151 VGQLAGTTVS FPNSLLLSHP VRRDNILGDY VIHTVEIPVP IHLDSDEAVC
201 RLKAVLEPLC APYIPAIQRX LENVQAEKLF ITPAARPRVT RVPYDDKAYR
251 IIVRFASPVS KRLEIQQAVM DEFLRVQYRL LNHPAGSETL *
```

Computer analysis of this amino acid sequence gave the following results:

Homology with a predicted ORF from *N. gonorrhoeae*

ORF 127 shows 97.9% identity over a 290 aa overlap with a predicted ORF (ORF 127.ng) from *N. gonorrhoeae*:

m127/g127

```
                10        20        30        40        50        60
m127.pep  MEIWNMLDTWLGAVPIRAEAVESVAAVAALLLARALLLNIHFKRHPDFGIESKRRFLVAS
          |||||||:||  ||||||||:|||||||||||||||||||||:|||||||||||||||||
g127      MEIWNMLNTWPDAVPIRAEAAESVAAVAALLLARALLLNIHFRRHPDFGIESKRRFLVAS
                10        20        30        40        50        60

                70        80        90       100       110       120
m127.pep  RNITLLLVLFSLAFIWSAQIQTLALSMFAVAAAVVVATKELIMCLSGSILRSATQQYSVG
          ||||||||||||||||||||||||||||||||||||||||||||||||||||||||||||
g127      RNITLLLVLFSLAFIWSAQIQTLALSMFAVAAAVVVATKELIMCLSGSILRSATQQYSVG
                70        80        90       100       110       120

               130       140       150       160       170       180
m127.pep  DYIEINGLRGRVVDINLLNTLMMQVGPNPLVGQLAGTTVSFPNSLLLSHPVRRDNILGDY
          ||||||||||||||||||||||||||||||||||||||||||||||||||||||||||||
g127      DYIEINGLRGRVVDINLLNTLMMQVGPNPLVGQLAGTTVSFPNSLLLSHPVRRDNILGDY
               130       140       150       160       170       180
               190       200       210       220       230       240
m127.pep  VIHTVEIPVPIHLDSDEAVCRLKAVLEPLCAPYIPAIQRXLENVQAEKLFITPAARPRVT
          ||||||||||||||||||||||||||||||||||||||| ||||||||||||||||||||
g127      VIHTVEIPVPIHLDSDEAVCRLKAVLEPLCAPYIPAIQRYLENVQAEKLFITPAARPRVT
               190       200       210       220       230       240

               250       260       270       280       290
m127.pep  RVPYDDKAYRIIVRFASPVSKRLEIQQAVMDEFLRVQYRLLNHPAGSETLX
          |||||||||||||||||||||||||||||||||||||||||||||||||||
g127      RVPYDDKAYRIIVRFASPVSKRLEIQQAVMDEFLRVQYRLLNHPAGSETLX
               250       260       270       280       290
```

The following partial DNA sequence was identified in *N. meningitidis* <SEQ ID 479>:

a127.seq

```
  1 ATGGAAATAT GGAATATGTT GGACACTTGG CTCGGTGCCG TCCCGATACG
 51 TGCGGAGGCG GTCGAATCCG TGGCGGTGGT CGCGGCTTTG CTGCTGGCGC
101 GCGCCCTTCT GTTGAATATC CACTTCAAAC GGCATCCGGA TTTCGGCATC
151 GAAAGCAAGC GGCGGTTTTT GGTTGCCAGC CGCAATATAA CGCTGCTTTT
201 GGTGCTGTTT TCGCTGGCAT TTATCTGGTC GGCGCAAATC CAAACGCTGG
251 CTTTGTCGAT GTTTGCGGTG GCGGCGGCGG TCGTCGTGGC GACGAAGGAA
301 CTGATTATGT GTCTGTCGGG CAGCATTTTA AGGTCTGCCA CCCAGCAATA
351 CTCGGTCGGC GACTATATCG AAATCAACGG CCTGCGCGGG CGCGTGGTCG
401 ACATCAACCT GTTGAACACG CTGATGATGC AGGTCGGTCC GAACCCCTTG
451 GTCGGACAGC TTGCGGGAAC CACCGTTTCT TTCCCCAACA GCCTGTTGTT
501 GAGCCACCCC GTGCGCCGCG ACAATATTTT GGGCGACTAC GTCATCCATA
551 CGGTCGAAAT CCCGGTTCCC ATCCATTTGG ATTCGGATGA AGCCGTATGC
601 CGTCTGAAAG CCGTACTCGA GCCCTTGTGC GCGCCCTACA TCCCCGCCAT
651 CCAACGGCAT TTGGAAAACG TGCAGGCGGA AAAACTGTTT ATCACGCCCG
701 CCGCCAAACC GCGCGTTACC CGCGTGCCGT ACGATGACAA GGCATACCGC
751 ATCATCGTCC GCTTCGCCTC CCCCGTTTCA AAGCGGCTGG AAATCCAACA
801 GCCGGTTATG GACGAATTTT TGCGCGTACA ATACCGCCTG TTAAATTACC
851 CCGCCGGCTC CGAAACACTT TAA
```

This corresponds to the amino acid sequence <SEQ ID 480; ORF 127.a>:

a127.pep

```
  1 MEIWNMLDTW LGAVPIRAEA VESVAVVAAL LLARALLLNI HFKRHPDFGI
 51 ESKRRFLVAS RNITLLLVLF SLAFIWSAQI QTLALSMFAV AAAVVVATKE
101 LIMCLSGSIL RSATQQYSVG DYIEINGLRG RVVDINLLNT LMMQVGPNPL
151 VGQLAGTTVS FPNSLLLSHP VRRDNILGDY VIHTVEIPVP IHLDSDEAVC
201 RLKAVLEPLC APYIPAIQRH LENVQAEKLF ITPAAKPRVT RVPYDDKAYR
251 IIVRFASPVS KRLEIQQAVM DEFLRVQYRL LNYPAGSETL *
```

m127/a127 98.6% identity in 290 aa overlap

```
                  10        20        30        40        50        60
m127.pep   MEIWNMLDTWLGAVPIRAEAVESVAAVAALLLARALLLNIHFKRHPDFGIESKRRFLVAS
           ||||||||||||||||||||||||||:|||||||||||||||||||||||||||||||||
a127       MEIWNMLDTWLGAVPIRAEAVESVAAVVALLLARALLLNIHFKRHPDFGIESKRRFLVAS
                  10        20        30        40        50        60

                  70        80        90       100       110       120
m127.pep   RNITLLLVLFSLAFIWSAQIQTLALSMFAVAAAVVVATKELIMCLSGSILRSATQQYSVG
           ||||||||||||||||||||||||||||||||||||||||||||||||||||||||||||
a127       RNITLLLVLFSLAFIWSAQIQTLALSMFAVAAAVVVATKELIMCLSGSILRSATQQYSVG
                  70        80        90       100       110       120

                 130       140       150       160       170       180
m127.pep   DYIEINGLRGRVVDINLLNTLMMQVGPNPLVGQLAGTTVSFPNSLLLSHPVRRDNILGDY
           ||||||||||||||||||||||||||||||||||||||||||||||||||||||||||||
a127       DYIEINGLRGRVVDINLLNTLMMQVGPNPLVGQLAGTTVSFPNSLLLSHPVRRDNILGDY
                 130       140       150       160       170       180

                 190       200       210       220       230       240
m127.pep   VIHTVEIPVPIHLDSDEAVCRLKAVLEPLCAPYIPAIQRXLENVQAEKLFITPAARPRVT
           ||||||||||||||||||||||||||||||||||||||| |||||||||||||||:||||
a127       VIHTVEIPVPIHLDSDEAVCRLKAVLEPLCAPYIPAIQRHLENVQAEKLFITPAAKPRVT
                 190       200       210       220       230       240

                 250       260       270       280       290
m127.pep   RVPYDDKAYRIIVRFASPVSKRLEIQQAVMDEFLRVQYRLLNHPAGSETLX
           ||||||||||||||||||||||||||||||||||||||||||:||||||||
a127       RVPYDDKAYRIIVRFASPVSKRLEIQQAVMDEFLRVQYRLLNYPAGSETLX
                 250       260       270       280       290
```

The following partial DNA sequence was identified in *N. gonorrhoeae* <SEQ ID 481>:

g128.seq

```
  1 atgattgaca acgCActgct ccacttgggc gaagaacccC GTTTTaatca
 51 aatccaaacc gaagACAtca AACCCGCCGT CCAAACCGCC ATCGCCGAAG
101 CGCGCGGACA AATCGCCGCC GTCAAAGCGC AAACGCACAC CGGCTGGGCG
151 AACACCGTCG AGCGTCTGAC CGGCATCACC GAACGCGTCG GCAGGATTTG
201 GGGCGTCGTG TCCCATCTCA ACTCCGTCGT CGACACGCCC GAACTGCGCG
251 CCGTCTATAA CGAACTGATG CCTGAAATCA CCGTCTTCTT CACCGAAATC
301 GGACAAGACA TCGAACTGTA CAACCGCTTC AAAACCATCA AAAATTCCCC
351 CGAATTTGCA ACGCTTTCCC CCGCACAAAA AACCAAGCTC GATCACGACC
401 TGCGCGATTT CGTATTGAGC GGCGCGGAAC TGCCGCCCGA ACGGCAGGCA
451 GAACTGGCAA AACTGCAAAC CGAAGGCGCG CAACTTTCCG CCAAATTCTC
501 CCAAAACGTC CTAGACGCGA CCGACGCGTT CGGCATTTAC TTTGACGATG
551 CCGCACCGCT TGCCGGCATT CCCGAAGACG CGCTCGCCAT GTTTGCCGCC
601 GCCGCGCAAA GCGAAGGCAA AACAGGTTAC AAAATCGGCT TGCAGATTCC
```

-continued

```
 651 GCACTACCTT GCCGTTATCC AATACGCCGG CAACCGCGAA CTGCGCGAAC
 701 AAATCTACCG CGCCTACGTT ACCCGTGCCA GCGAACTTTC AAACGACGGC
 751 AAATTCGACA ACACCGCCAA CATCGACCGC ACGCTCGAAA ACGCATTGAA
 801 AACCGccaaa cTGCTCGGCT TTAAAAATTA CGCCGAATTG TCGCTGGCAA
 851 CCAAAATGGC GGACACGCCC GAACAGGTTT TAAACTTCCT GCACGACCTC
 901 GCCCGCCGCG CCAAACCCTA CGCCGAAAAA GACCTCGCCG AAGTCAAAGC
 951 CTTCGCCCGC GAACACCTCG GTCTCGCCGA CCCGCAGCCG TGGGACTTGA
1001 GCTACGCCGG CGAAAAACTG CGCGAAGCCA AATACGCATT CAGCGAAACC
1051 GAAGTCAAAA AATACTTCCC CGTCGGCAAA GTTCTGGCAG GCCTGTTCGC
1101 CCAAATCAAA AAACTCTACG GCATCGGATT CGCCGAAAAA ACCGTTCCCG
1151 TCTGGCACAA AGACGTGCGC TATTTTGAAT TGCAACAAAA CGGCAAAACC
1201 ATCGGCGGCG TTTATATGGA TTTGTACGCA CGCGAAGGCA AACGCGGCGG
1251 CGCGTGGATG AACGACtaca AAGGCCGCCG CCGCTTTGCC GACGgcacGC
1301 TGCAACTGCC CACCGCCTAC CTCGTCTGCA ACTTCGCCCC GCCCGTCGGC
1351 GGCAAAGAAG CGCGTTTAAG CCACGACGAA ATCCTCACCC TCTTCCACGA
1401 AacCGGCCAC GGACTGCACC ACCTGCTTAC CCAAGTGGAC GAACTGGGCG
1451 TGTCCGGCAT CAAcggcgtA GAATGGGACG CGGTCGAACT GCCCAGCCAG
1501 TTTATGGAAA ACTTCGTTTG GGAATACAAT GTATTGGCAC AAATGTCCGC
1551 CCACGAAGAA AccgGCGAGC CCCTGCCGAA AGAACTCTTC GACAAAATGC
1601 TcgCCGCCAA AAACTTCCAG CGCGGTATGT TCCTCGTCCG GCAAATGGAG
1651 TTCGCCCTCT TCGATATGAT GATTTACAGT GAAAGCGACG AATGCCGTCT
1701 GAAAAACTGG CAGCAGGTTT TAGACAGCGT GCGCAAAGAA GTcGCCGTCA
1751 TCCAACCGCC CGAATACAAC CGCTTCGCCA ACAGCTTCGG CCacatctTC
1801 GCcggcGGCT ATTCCGCAGG CTATTACAGC TACGCATGGG CCGAAGTCCt
1851 cAGCACCGAT GCCTACGCCG CCTTTGAAGA AAGcGACGac gtcGCCGCCA
1901 CAGGCAAACG CTTCTGGCAA GAAAtccttg ccgtcggcgg ctCCCGCAGC
1951 gcgGCGGAAT CCTTCAAAGC CTTCCGCGGA CGCGAACCGA GCATAGACGC
2001 ACTGCTGCGC CAaagcggtT TCGACAACGC gGCttgA
```

This corresponds to the amino acid sequence <SEQ ID 482; ORF 128.ng>:

<u>g128.pep</u>

```
  1 MIDNALLHLG EEPRFNQIQT EDIKPAVQTA IAEARGQIAA VKAQTHTGWA
 51 NTVERLTGIT ERVGRIWGVV SHLNSVVDTP ELRAVYNELM PEITVFFTEI
101 GQDIELYNRF KTIKNSPEFA TLSPAQKTKL DHDLRDFVLS GAELPPERQA
151 ELAKLQTEGA QLSAKFSQNV LDATDAFGIY FDDAAPLAGI PEDALAMFAA
201 AAQSEGKTGY KIGLQIPHYL AVIQYAGNRE LREQIYRAYV TRASELSNDG
251 KFDNTANIDR TLENALKTAK LLGFKNYAEL SLATKMADTP EQVLNFLHDL
301 ARRAKPYAEK DLAEVKAFAR EHLGLADPQP WDLSYAGEKL REAKYAFSET
351 EVKKYFPVGK VLAGLFAQIK KLYGIGFAEK TVPVWHKDVR YFELQQNGKT
```

-continued

```
401 IGGVYMDLYA REGKRGGAWM NDYKGRRRFA DGTLQLPTAY LVCNFAPPVG
451 GKEARLSHDE ILTLFHETGH GLHHLLTQVD ELGVSGINGV EWDAVELPSQ
501 FMENFVWEYN VLAQMSAHEE TGEPLPKELF DKMLAAKNFQ RGMFLVRQME
551 FALFDMMIYS ESDECRLKNW QQVLDSVRKE VAVIQPPEYN RFANSFGHIF
601 AGGYSAGYYS YAWAEVLSTD AYAAFEESDD VAATGKRFWQ EILAVGGSRS
651 AAESFKAFRG REPSIDALLR QSGFDNAA*
```

The following partial DNA sequence was identified in *N. meningitidis* <SEQ ID 483>:

m128.seq (partial)

```
   1 ATGACTGACA ACGCACTGCT CCATTTGGGC GAAGAACCCC GTTTTGATCA
  51 AATCAAAACC GAAGACATCA AACCCGCCCT GCAAACCGCC ATCGCCGAAG
 101 CGCGCGAACA AATCGCCGCC ATCAAAGCCC AAACGCACAC CGGCTGGGCA
 151 AACACTGTCG AACCCCTGAC CGGCATCACC GAACGCGTCG GCAGGATTTG
 201 GGGCGTGGTG TCGCACCTCA ACTGCGTCGC CGACACGCCC GAACTGCGCG
 251 CCGTCTATAA CGAACTGATG CCCGAAATCA CCGTCTTCTT CACCGAAATC
 301 GGACAAGACA TCGAGCTGTA CAACCGCTTC AAAACCATCA AAAATTCCCC
 351 CGAATTCGAC ACCCTCTCCC CCGCACAAAA AACCAAACTC AACCAC
   1 TACGCCAGCG AAAAACTGCG CGAAGCCAAA TACGCGTTCA GCGAAACCGA
  51 wGTCAAAAAA TAyTTCCCyG TCGGCAAwGT ATTAAACGGA CTGTTCGCCC
 101 AAmTCAAAAA ACTmTACGGC ATCGGATTTA CCGAAAAAAC yGTCCCCGTC
 151 TGGCACAAAG ACGTGCGCTA TTkTGAATTG CAACAAAACG GCGAAmCCAT
 201 AGGCGGCGTT TATATGGATT TGTACGCACG CGAAGGCAAA CGCGGCGGCG
 251 CGTGGATGAA CGACTACAAA GGCCGCCGCC GTTTTTCAGA CGGCACGCTG
 301 CAAyTGCCCA CCGCCTACCT CGTCTGCAAC TTCGCCCCAC CCGTCGGCGG
 351 CAGGGAAGCC CGCyTGAGCC ACGACGAAAT CCTCATCCTC TTCCACGAAA
 401 CCGGACACGG GCTGCACCAC CTGCTTACCC AAGTGGACGA ACTGGGCGTA
 451 TCCGGCATCA ACGGCGTAkA ATGGGACGCG GTCGAACTGC CCAGCCAGTT
 501 TATGGAAAAT TTCGTTTGGG AATACAATGT CTTGGCACAA mTGTCAGCCC
 551 ACGAAGAAAC CGGcgTTCCC yTGCCGAAAG AACTCTTsGA CAAAwTGCTC
 601 GCCGCCAAAA ACTTCCAAsG CGGCATGTTC yTsGTCCGGC AAwTGGAGTT
 651 CGCCCTCTTT GATATGATGA TTTACAGCGA AGACGACGAA GGCCGTCTGA
 701 AAAACTGGCA ACAGGTTTTA GACAGCGTGC GCAAAAAAGT CGCCGTCATC
 751 CAGCCGCCCG AATACAACCG CTTCGCCTTG AGCTTCGGCC ACATCTTCGC
 801 AGGCGGCTAT TCCGCAGCTn ATTACAGCTA CGCGTGGGCG GAAGTATTGA
 851 GCGCGGACGC ATACGCCGCC TTTGAAGAAA GCGACGATGT CGCCGCCACA
 901 GGCAAACGCT TTTGGCAGGA AATCCTCGCC GTCGGGGnAT CGCGCAGCGG
 951 nGCAGAATCC TTCAAAGCCT TCCGCGGCCG CGAACCGAGC ATAGACGCAC
1001 TCTTGCGCCA CAGCGGTTTC GACAACGCGG TCTGA
```

This corresponds to the amino acid sequence <SEQ ID 484; ORF 128>:

m128.pep (partial)

```
      1 MTDNALLHLG EEPRFDQIKT EDIKPALQTA IAEAREQIAA IKAQTHTGWA
     51 NTVEPLTGIT ERVGRIWGVV SHLNCVADTP ELRAVYNELM PEITVFFTEI
    101 GQDIELYNRF KTIKNSPEFD TLSPAQKTKL NH
//
      1 YASEKLREAK YAFSETXVKK YFPVGXVLNG LFAQXKKLYG IGFTEKTVPV
     51 WHKDVRYXEL QQNGEXIGGV YMDLYAREGK RGGAWMNDYK GRRRFSDGTL
    101 QLPTAYLVCN FAPPVGGREA RLSHDEILIL FHETGHGLHH LLTQVDELGV
    151 SGINGVXWDA VELPSQFMEN FVWEYNVLAQ XSAHEETGVP LPKELXDKXL
    201 AAKNFQXGMF XVRQXEFALF DMMIYSEDDE GRLKNWQQVL DSVRKKVAVI
    251 QPPEYNRFAL SFGHIFAGGY SAAXYSYAWA EVLSADAYAA FEESDDVAAT
    301 GKRFWQEILA VGXSRSGAES FKAFRGREPS IDALLRHSGF DNAV*
```

Computer analysis of this amino acid sequence gave the following results:

Homology with a predicted ORF from *N. gonorrhoeae*

ORF 128 shows 91.7% identity over a 475 aa overlap with a predicted ORF (ORF 128.ng) from *N. gonorrhoeae*:

```
                    10        20        30        40        50        60
g128.pep   MIDNALLHLGEEPRFNQIQTEDIKPAVQTAIAEARGQIAAVKAQTHTGWANTVERLTGIT
           | |||||||||||||:||:|||||||:|||||||| ||||:||||||||||||| |||||
m128       MTDNALLHLGEEPRFDQIKTEDIKPALQTAIAEAREQIAAIKAQTHTGWANTVEPLTGIT
                    10        20        30        40        50        60

                    70        80        90       100       110       120
g128.pep   ERVGRIWGVVSHLNSVTDTPELRAAYNELMPEITVFFTEIGQDIELYNRFKTIKNSPEFD
           |||||||||||||| |:|||||||||||||||||||||||||||||||||||||||||| 
m128       ERVGRIWGVVSHLNCVADTPELRAAYNELMPEITVFFTEIGQDIELYNRFKTIKNSPEFA
                    70        80        90       100       110       120

                   130       140       150       160       170       180
g128.pep   TLSPAQKTKLDHDLRDFVLSGAELPPERQAELAKLQTEGAQLSAKFSQNVLDATDAFGIY
           ||||||||||:|
m128       TLSPAQKTKLNH
                   130
             //

                                                 340       350       360
g128.pep                                 YAGEKLREAKYAFSETEVKKYFPVGKVLAG
                                         ||:||||||||||||| |||||||| || |
m128                                     YASEKLREAKYAFSETXVKKYFPVGXVLNG
                                                  10        20        30

                   370       380       390       400       410       420
g128.pep   LFAQIKKLYGIGFAEKTVPVWHKDVRYFELQQNGKTIGGVYMDLYAREGKRGGAWMNDYK
           |||| ||||||||:||||||||||||| ||||||::||||||||||||||||||||||||
m128       LFAQXKKLYGIGFTEKTVPVWHKDVRYXELQQNGEXIGGVYMDLYAREGKRGGAWMNDYK
                    40        50        60        70        80        90

                   430       440       450       460       470       480
g128.pep   GRRRFADGTLQLPTAYLVCNFTPPVGGKEARLSHDEILTLFHETGHGLHHLLTQVDELGV
           |||||:|||||||||||||||||||||:|||||||||| |||||||||||||||||||||
m128       GRRRFSDGTLQLPTAYLVCNFTPPVGGREARLSHDEILILFHETGHGLHHLLTQVDELGV
                   100       100       120       130       140       150

                   490       500       510       520       530       540
g128.pep   SGINGVEWDAVELPSQFMENFVWEYNVLAQMSAHEETGEPLPKELFDKMLAAKNFQRGMF
           |||||| ||||||||||||||||||||||| ||||||| |||||| || ||||||| |||
m128       SGINGVXWDAVELPSQFMENFVWEYNVLAQXSAHEETGVPLPKELXDKXLAAKNFQXGMF
                   160       170       180       190       200       210

                   550       560       570       580       590       600
g128.pep   LVRQMEFALFDMMIYSESDECRLKNWQQVLDSVRKEVAVVRPPEYNRFANSFGHIFAGGY
            ||| ||||||||||||:|| ||||||||||||||:||||||||||||| ||||||||||
m128       XVRQXEFALFDMMIYSEDDEGRLKNWQQVLDSVRKKVAVVRPPEYNRFALSFGHIFAGGY
                   220       230       240       250       260       270
```

-continued

```
                 610        620        630        640        650        660
g128.pep   SAGYYSYAWAEVLSTDAYAAFEESDDVAATGKRFWQEILAVGGSRSAAESFKAFRGREPS
           ||: ||||||||||:||||||||||||||||||||||||||||| |||:|||||||||||||
m12        SAAXYSYAWAEVLSADAYAAFEESDDVAATGKRFWQEILAVGXSRSGAESFKAFRGREPS
                   280        290        300        310        320        330

                 670        679
g128.pep   IDALLRQSGFDNAAX
           ||||||:||||||:
m128       IDALLRHSGFDNAVX
                   340
```

The following partial DNA sequence was identified in *N. meningitidis* <SEQ ID 485>:

a128.seq

```
   1 ATGACTGACA ACGCACTGCT CCATTTGGGC GAAGAACCCC GTTTTGATCA
  51 AATCAAAACC GAAGACATCA AACCCGCCCT GCAAACCGCC ATTGCCGAAG
 101 CGCGCGAACA AATCGCCGCC ATCAAAGCCC AAACGCACAC CGGCTGGGCA
 151 AACACTGTCG AACCCCTGAC CGGCATCACC GAACGCGTCG GCAGGATTTG
 201 GGGCGTGGTG TCGCACCTCA ACTCCGTCAC CGACACGCCC GAACTGCGCG
 251 CCGCCTACAA TGAATTAATG CCCGAAATTA CCGTCTTCTT CACCGAAATC
 301 GGACAAGACA TCGAGCTGTA CAACCGCTTC AAAACCATCA AAAACTCCCC
 351 CGAGTTCGAC ACCCTCTCCC ACGCGCAAAA AACCAAACTC AACCACGATC
 401 TGCGCGATTT CGTCCTCAGC GGCGCGGAAC TGCCGCCCGA ACAGCAGGCA
 451 GAATTGGCAA AACTGCAAAC CGAAGGCGCG CAACTTTCCG CCAAATTCTC
 501 CCAAAACGTC CTAGACGCGA CCGACGCGTT CGGCATTTAC TTTGACGATG
 551 CCGCACCGCT TGCCGGCATT CCCGAAGACG CGCTCGCCAT GTTTGCCGCT
 601 GCCGCGCAAA GCGAAGGCAA AACAGGCTAC AAAATCGGTT TGCAGATTCC
 651 GCACTACCTC GCCGTCATCC AATACGCCGA CAACCGCAAA CTGCGCGAAC
 701 AAATCTACCG CGCCTACGTT ACCCGCGCCA GCGAGCTTTC AGACGACGGC
 751 AAATTCGACA ACACCGCCAA CATCGACCGC ACGCTCGAAA ACGCCCTGCA
 801 AACCGCCAAA CTGCTCGGCT TCAAAAACTA CGCCGAATTG TCGCTGGCAA
 851 CCAAAATGGC GGACACCCCC GAACAAGTTT TAAACTTCCT GCACGACCTC
 901 GCCCGCCGCG CCAAACCCTA CGCCGAAAAA GACCTCGCCG AAGTCAAAGC
 951 CTTCGCCCGC GAAAGCCTCG GCCTCGCCGA TTTGCAACCG TGGGACTTGG
1001 GCTACGCCGG CGAAAAACTG CGCGAAGCCA AATACGCATT CAGCGAAACC
1051 GAAGTCAAAA AATACTTCCC CGTCGGCAAA GTATTAAACG GACTGTTCGC
1101 CCAAATCAAA AAACTCTACG GCATCGGATT TACCGAAAAA ACCGTCCCCG
1151 TCTGGCACAA AGACGTGCGC TATTTTGAAT TGCAACAAAA CGGCGAAACC
1201 ATAGGCGGCG TTTATATGGA TTTGTACGCA CGCGAAGGCA AACGCGGCGG
1251 CGCGTGGATG AACGACTACA AAGGCCGCCG CCGTTTTTCA GACGGCACGC
1301 TGCAACTGCC CACCGCCTAC CTCGTCTGCA ACTTCACCCC GCCCGTCGGC
1351 GGCAAAGAAG CCCGCTTGAG CCATGACGAA ATCCTCACCC TCTTCCACGA
1401 AACCGGACAC GGCCTGCACC ACCTGCTTAC CCAAGTCGAC GAACTGGGCG
1451 TATCCGGCAT CAACGGCGTA GAATGGGACG CAGTCGAACT GCCCAGTCAG
```

-continued

```
1501 TTTATGGAAA ATTTCGTTTG GGAATACAAT GTCTTGGCGC AAATGTCCGC

1551 CCACGAAGAA ACCGGCGTTC CCCTGCCGAA AGAACTCTTC GACAAAATGC

1601 TCGCCGCCAA AAACTTCCAA CGCGGAATGT TCCTCGTCCG CCAAATGGAG

1651 TTCGCCCTCT TTGATATGAT GATTTACAGC GAAGACGACG AAGGCCGTCT

1701 GAAAAACTGG CAACAGGTTT TAGACAGCGT GCGCAAAGAA GTCGCCGTCG

1751 TCCGACCGCC CGAATACAAC CGCTTCGCCA ACAGCTTCGG CCACATCTTC

1801 GCAGGCGGCT ATTCCGCAGG CTATTACAGC TACGCGTGGG CGGAAGTATT

1851 GAGCGCGGAC GCATACGCCG CCTTTGAAGA AAGCGACGAT GTCGCCGCCA

1901 CAGGCAAACG CTTTTGGCAG GAAATCCTCG CCGTCGGCGG ATCGCGCAGC

1951 GCGGCAGAAT CCTTCAAAGC CTTCCGCGGA CGCGAACCGA GCATAGACGC

2001 ACTCTTGCGC CACAGCGGCT TCGACAACGC GGCTTGA
```

This corresponds to the amino acid sequence <SEQ ID 486; ORF 128.a>:

a128.pep

```
  1 MTDNALLHLG EEPRFDQIKT EDIKPALQTA IAEAREQIAA IKAQTHTGWA

 51 NTVEPLTGIT ERVGRIWGVV SHLNSVTDTP ELRAAYNELM PEITVFFTEI

101 GQDIELYNRF KTIKNSPEFD TLSHAQKTKL NHDLRDFVLS GAELPPEQQA

151 ELAKLQTEGA QLSAKFSQNV LDATDAFGIY FDDAAPLAGI PEDALAMFAA

201 AAQSEGKTGY KIGLQIPHYL AVIQYADNRK LREQIYRAYV TRASELSDDG

251 KFDNTANIDR TLENALQTAK LLGFKNYAEL SLATKMADTP EQVLNFLHDL

301 ARRAKPYAEK DLAEVKAFAR ESLGLADLQP WDLGYAGEKL REAKYAFSET

351 EVKKYFPVGK VLNGLFAQIK KLYGIGFTEK TVPVWHKDVR YFELQQNGET

401 IGGVYMDLYA REGKRGGAWM NDYKGRRRFS DGTLQLPTAY LVCNFTPPVG

451 GKEARLSHDE ILTLFHETGH GLHHLLTQVD ELGVSGINGV EWDAVELPSQ

501 FMENFVWEYN VLAQMSAHEE TGVPLPKELF DKMLAAKNFQ RGMFLVRQME

551 FALFDMMIYS EDDEGRLKNW QQVLDSVRKE VAVVRPPEYN RFANSFGHIF

601 AGGYSAGYYS YAWAEVLSAD AYAAFEESDD VAATGKRFWQ EILAVGGSRS

651 AAESFKAFRG REPSIDALLR HSGFDNAA*
```

m128/a128 66.0% identity in 677 aa overlap

```
                   10        20        30        40        50        60
m128.pep   MTDNALLHLGEEPRFDQIKTEDIKPALQTAIAEAREQIAAIKAQTHTGWANTVEPLTGIT
           ||||||||||||||||||||||||||||||||||||||||||||||||||||||||||||
a128       MTDNALLHLGEEPRFDQIKTEDIKPALQTAIAEAREQIAAIKAQTHTGWANTVEPLTGIT
                   10        20        30        40        50        60

                   70        80        90       100       110       120
m128.pep   ERVGRIWGVVSHLNCVADTPELRAVYNELMPEITVFFTEIGQDIELYNRFKTIKNSPEFD
           |||||||||||||| |:||||||:||||||||||||||||||||||||||||||||||||
a128       ERVGRIWGVVSHLNSVTDTPELRAAYNELMPEITVFFTEIGQDIELYNRFKTIKNSPEFD
                   70        80        90       100       110       120

                  130
m128.pep   TLSPAQKTKLNH------------------------------------------------
           ||| ||||||||
a128       TLSHAQKTKLNHDLRDFVLSGAELPPEQQAELAKLQTEGAQLSAKFSQNVLDATDAFGIY
                  130       140       150       160       170       180
```

-continued

```
m128.pep  ------------------------------------------------------------

a128      FDDAAPLAGIPEDALAMFAAAAQSEGKTGYKIGLQIPHYLAVIQYADNRKLREQIYRAYV
                 190       200       210       220       230       240

m128.pep  ------------------------------------------------------------

a128      TRASELSDDGKFDNTANIDRTLENALQTAKLLGFKNYAELSLATKMADTPEQVLNFLHDL
                 250       260       270       280       290       300

                                                 140       150
m128.pep  ----------------------------------YASEKLREAKYAFSETXVKKYFPVGX
                                          ||:||||||||||||| |||||||| 
a128      ARRAKPYAEKDLAEVKAFARESLGLADLQPWDLGYAGEKLREAKYAFSETEVKKYFPVGK
                 310       320       330       340       350       360

         160       170       180       190       200       210
m128.pep  VLNGLFAQXKKLYGIGFTEKTVPVWHKDVRYXELQQNGEXIGGVYMDLYAREGKRGGAWM
          |||||||| |||||||||||||||||||||| |||||||:||||||||||||||||||||
a128      VLNGLFAQIKKLYGIGFTEKTVPVWHKDVRYFELQQNGETIGGVYMDLYAREGKRGGAWM
                 370       380       390       400       410       420

         220       230       240       250       260       270
m128.pep  NDYKGRRRFSDGTLQLPTAYLVCNFAPPVGGREARLSHDEILILFHETGHGLHHLLTQVD
          |||||||||||||||||||||||||:|||||:|||||||||| |||||||||||||||||
a128      NDYKGRRRFSDGTLQLPTAYLVCNFTPPVGGKEARLSHDEILTLFHETGHGLHHLLTQVD
                 430       440       450       460       470       480

         280       290       300       310       320       330
m128.pep  ELGVSGINGVXWDAVELPSQFMENFVWEYNVLAQXSAHEETGVPLPKELXDKXLAAKNFQ
          |||||||||| ||||||||||||||||||||||| |||||||||||||| || |||||||
a128      ELGVSGINGVEWDAVELPSQFMENFVWEYNVLAQMSAHEETGVPLPKELFDKMLAAKNFQ
                 490       500       510       520       530       540

         340       350       360       370       380       390
m128.pep  XGMFXVRQXEFALFDMMIYSEDDEGRLKNWQQVLDSVRKKVAVIQPPEYNRFALSFGHIF
           ||| ||| ||||||||||||||||||||||||||||||:|||::|||||||| ||||||
a128      RGMFLVRQMEFALFDMMIYSEDDEGRLKNWQQVLDSVRKEVAVVRPPEYNRFANSFGHIF
                 550       560       570       580       590       600

         400       410       420       430       440       450
m128.pep  AGGYSAAXYSYAWAEVLSADAYAAFEESDDVAATGKRFWQEILAVGXSRSGAESFKAFRG
          ||||||: |||||||||||||||||||||||||||||||||||||| |||:|||||||||
a128      AGGYSAGYYSYAWAEVLSADAYAAFEESDDVAATGKRFWQEILAVGGSRSAAESFKAFRG
                 610       620       630       640       650       660

         460       470
m128.pep  REPSIDALLRHSGFDNAVX
          |||||||||||||||||:
a128      REPSIDALLRHSGFDNAAX
                 670
```

The following partial DNA sequence was identified in *N. gonorrhoeae* <SEQ ID 487>:

<u>g128-1.seq (partial)</u>

```
  1 ATGATTGACA ACGCACTGCT CCACTTGGGC GAAGAACCCC GTTTTAATCA
 51 AATCAAAACC GAAGACATCA AACCCGCCGT CCAAACCGCC ATCGCCGAAG
101 CGCGCGGACA AATCGCCGCC GTCAAAGCGC AAACGCACAC CGGCTGGGCG
151 AACACCGTCG AGCGTCTGAC CGGCATCACC GAACGCGTCG GCAGGATTTG
201 GGGCGTCGTG TCCCATCTCA ACTCCGTCGT CGACACGCCC GAACTGCGCG
251 CCGTCTATAA CGAACTGATG CCTGAAATCA CCGTCTTCTT CACCGAAATC
301 GGACAAGACA TCGAACTGTA CAACCGCTTC AAAACCATCA AAAATTCCCC
351 CGAATTTGCA ACGCTTTCCC CCGCACAAAA AACCAAGCTC GATCACGACC
401 TGCGCGATTT CGTATTGAGC GGCGCGGAAC TGCCGCCCGA ACGGCAGGCA
451 GAACTGGCAA AACTGCAAAC CGAAGGCGCG CAACTTTCCG CCAAATTCTC
501 CCAAAACGTC CTAGACGCGA CCGACGCGTT CGGCATTTAC TTTGACGATG
551 CCGCACCGCT TGCCGGCATT CCCGAAGACG CGCTCGCCAT GTTTGCCGCC
601 GCCGCGCAAA GCGAAGGCAA AACAGGTTAC AAAATCGGCT TGCAGATTCC
```

-continued

```
 651 GCACTACCTT GCCGTTATCC AATACGCCGG CAACCGCGAA CTGCGCGAAC
 701 AAATCTACCG CGCCTACGTT ACCCGTGCCA GCGAACTTTC AAACGACGGC
 751 AAATTCGACA ACACCGCCAA CATCGACCGC ACGCTCGAAA ACGCATTGAA
 801 AACCGCCAAA CTGCTCGGCT TTAAAAATTA CGCCGAATTG TCGCTGGCAA
 851 CCAAAATGGC GGACACGCCC GAACAGGTTT TAAACTTCCT GCACGACCTC
 901 GCCCGCCGCG CCAAACCCTA CGCCGAAAAA GACCTCGCCG AAGTCAAAGC
 951 CTTCGCCCGC GAACACCTCG GTCTCGCCGA CCCGCAGCCG TGGGACTTGA
1001 GCTACGCCGG CGAAAAACTG CGCGAAGCCA AATACGCATT CAGCGAAACC
1051 GAAGTCAAAA AATACTTCCC CGTCGGCAAA GTTCTGGCAG GCCTGTTCGC
1101 CCAAATCAAA AAACTCTACG GCATCGGATT CGCCGAAAAA ACCGTTCCCG
1151 TCTGGCACAA AGACGTGCGC TATTTTGAAT TGCAACAAAA CGGCAAAACC
1201 ATCGGCGGCG TTTATATGGA TTTGTACGCA CGCGAAGGCA AACGCGGCGG
1251 CGCGTGGATG AACGACTACA AAGGCCGCCG CCGCTTTGCC GACGGCACGC
1301 TGCAACTGCC CACCGCCTAC CTCGTCTGCA ACTTCGCCCC GCCCGTCGGC
1351 GGCAAAGAAG CGCGTTTAAG CCACGACGAA ATCCTCACCC TCTTCCACGA
1401 AACCGGCCAC GGACTGCACC ACCTGCTTAC CCAAGTGGAC GAACTGGGCG
1451 TGTCCGGCAT CAACGGCGTA AAA
```

This corresponds to the amino acid sequence <SEQ ID a488; ORF 128-1.ng>:

g128-1.pep (partial)

```
  1 MIDNALLHLG EEPRFNQIKT EDIKPAVQTA IAEARGQIAA VKAQTHTGWA
 51 NTVERLTGIT ERVGRIWGVV SHLNSVVDTP ELRAVYNELM PEITVFFTEI
101 GQDIELYNRF KTIKNSPEFA TLSPAQKTKL DHDLRDFVLS GAELPPERQA
151 ELAKLQTEGA QLSAKFSQNV LDATDAFGIY FDDAAPLAGI PEDALAMFAA
201 AAQSEGKTGY KIGLQIPHYL AVIQYAGNRE LREQIYRAYV TRASELSNDG
251 KFDNTANIDR TLENALKTAK LLGFKNYAEL SLATKMADTP EQVLNFLHDL
301 ARRAKPYAEK DLAEVKAFAR EHLGLADPQP WDLSYAGEKL REAKYAFSET
351 EVKKYFPVGK VLAGLFAQIK KLYGIGFAEK TVPVWHKDVR YFELQQNGKT
401 IGGVYMDLYA REGKRGGAWM NDYKGRRRFA DGTLQLPTAY LVCNFAPPVG
451 GKEARLSHDE ILTLFHETGH GLHHLLTQVD ELGVSGINGV K
```

The following partial DNA sequence was identified in *N. meningitidis* <SEQ ID 489>:

m128-1.seq

```
  1 ATGACTGACA ACGCACTGCT CCATTTGGGC GAAGAACCCC GTTTTGATCA
 51 AATCAAAACC GAAGACATCA AACCCGCCCT GCAAACCGCC ATCGCCGAAG
101 CGCGCGAACA AATCGCCGCC ATCAAAGCCC AAACGCACAC CGGCTGGGCA
```

-continued

```
 151 AACACTGTCG AACCCCTGAC CGGCATCACC GAACGCGTCG GCAGGATTTG

 201 GGGCGTGGTG TCGCACCTCA ACTCCGTCGC CGACACGCCC GAACTGCGCG

 251 CCGTCTATAA CGAACTGATG CCCGAAATCA CCGTCTTCTT CACCGAAATC

 301 GGACAAGACA TCGAGCTGTA CAACCGCTTC AAAACCATCA AAAATTCCCC

 351 CGAATTCGAC ACCCTCTCCC CCGCACAAAA AACCAAACTC AACCACGATC

 401 TGCGCGATTT CGTCCTCAGC GGCGCGGAAC TGCCGCCCGA ACAGCAGGCA

 451 GAACTGGCAA AACTGCAAAC CGAAGGCGCG CAACTTTCCG CCAAATTCTC

 501 CCAAAACGTC CTAGACGCGA CCGACGCGTT CGGCATTTAC TTTGACGATG

 551 CCGCACCGCT TGCCGGCATT CCCGAAGACG CGCTCGCCAT GTTTGCCGCC

 601 GCCGCGCAAA GCGAAAGCAA AACAGGCTAC AAAATCGGCT TGCAGATTCC

 651 ACACTACCTC GCCGTCATCC AATACGCCGA CAACCGCGAA CTGCGCGAAC

 701 AAATCTACCG CGCCTACGTT ACCCGCGCCA GCGAACTTTC AGACGACGGC

 751 AAATTCGACA ACACCGCCAA CATCGACCGC ACGCTCGCAA ACGCCCTGCA

 801 AACCGCCAAA CTGCTCGGCT TCAAAAACTA CGCCGAATTG TCGCTGGCAA

 851 CCAAAATGGC GGACACGCCC GAACAAGTTT TAAACTTCCT GCACGACCTC

 901 GCCCGCCGCG CCAAACCCTA CGCCGAAAAA GACCTCGCCG AAGTCAAAGC

 951 CTTCGCCCGC GAAAGCCTGA ACCTCGCCGA TTTGCAACCG TGGGACTTGG

1001 GCTACGCCAG CGAAAAACTG CGCGAAGCCA AATACGCGTT CAGCGAAACC

1051 GAAGTCAAAA AATACTTCCC CGTCGGCAAA GTATTAAACG GACTGTTCGC

1101 CCAAATCAAA AAACTCTACG GCATCGGATT TACCGAAAAA ACCGTCCCCG

1151 TCTGGCACAA AGACGTGCGC TATTTTGAAT TGCAACAAAA CGGCGAAACC

1201 ATAGGCGGCG TTTATATGGA TTTGTACGCA CGCGAAGGCA AACGCGGCGG

1251 CGCGTGGATG AACGACTACA AAGGCCGCCG CCGTTTTTCA GACGGCACGC

1301 TGCAACTGCC CACCGCCTAC CTCGTCTGCA ACTTCGCCCC ACCCGTCGGC

1351 GGCAGGGAAG CCCGCCTGAG CCACGACGAA ATCCTCATCC TCTTCCACGA

1401 AACCGGACAC GGGCTGCACC ACCTGCTTAC CCAAGTGGAC GAACTGGGCG

1451 TATCCGGCAT CAACGGCGTA GAATGGGACG CGGTCGAACT GCCCAGCCAG

1501 TTTATGGAAA ATTTCGTTTG GGAATACAAT GTCTTGGCAC AAATGTCAGC

1551 CCACGAAGAA ACCGGCGTTC CCCTGCCGAA AGAACTCTTC GACAAAATGC

1601 TCGCCGCCAA AAACTTCCAA CGCGGCATGT TCCTCGTCCG GCAAATGGAG

1651 TTCGCCCTCT TTGATATGAT GATTTACAGC GAAGACGACG AAGGCCGTCT

1701 GAAAAACTGG CAACAGGTTT TAGACAGCGT GCGCAAAAAA GTCGCCGTCA

1751 TCCAGCCGCC CGAATACAAC CGCTTCGCCT TGAGCTTCGG CCACATCTTC

1801 GCAGGCGGCT ATTCCGCAGG CTATTACAGC TACGCGTGGG CGGAAGTATT

1851 GAGCGCGGAC GCATACGCCG CCTTTGAAGA AAGCGACGAT GTCGCCGCCA

1901 CAGGCAAACG CTTTTGGCAG GAAATCCTCG CCGTCGGCGG ATCGCGCAGC

1951 GCGGCAGAAT CCTTCAAAGC CTTCCGCGGC CGCGAACCGA GCATAGACGC

2001 ACTCTTGCGC CACAGCGGTT TCGACAACGC GGTCTGA
```

This corresponds to the amino acid sequence <SEQ ID 490; ORF 128-1>:

m128-1.pep.

```
  1 MTDNALLHLG EEPRFDQIKT EDIKPALQTA IAEAREQIAA IKAQTHTGWA
 51 NTVEPLTGIT ERVGRIWGVV SHLNSVADTP ELRAVYNELM PEITVFFTEI
101 GQDIELYNRF KTIKNSPEFD TLSPAQKTKL NHDLRDFVLS GAELPPEQQA
151 ELAKLQTEGA QLSAKFSQNV LDATDAFGIY FDDAAPLAGI PEDALAMFAA
201 AAQSESKTGY KIGLQIPHYL AVIQYADNRE LREQIYRAYV TRASELSDDG
251 KFDNTANIDR TLANALQTAK LLGFKNYAEL SLATKMADTP EQVLNFLHDL
301 ARRAKPYAEK DLAEVKAFAR ESLNLADLQP WDLGYASEKL REAKYAFSET
351 EVKKYFPVGK VLNGLFAQIK KLYGIGFTEK TVPVWHKDVR YFELQQNGET
401 IGGVYMDLYA REGKRGGAWN NDYKGRRRFS DGTLQLPTAY LVCNFAPPVG
451 GREARLSHDE ILILFHETGH GLHHLLTQVD ELGVSGINGV EWDAVELPSQ
501 FMENFVWEYN VLAQMSAHEE TGVPLPKELF DKMLAAKNFQ RGMFLVRQME
551 FALFDMMIYS EDDEGRLKNW QQVLDSVRKK VAVIQPPEYN RFALSFGHIF
601 AGGYSAGYYS YAWAEVLSAD AYAAFEESDD VAATGKRFWQ EILAVGGSRS
651 AAESFKAFRG REPSIDALLR HSGFDNAV*
```

m128-1/g128-1 94.5% identity in 491 aa overlap

```
                    10        20        30        40        50        60
g128-1.pep  MIDNALLHLGEEPRFNQIKTEDIKPAVQTAIAEARGQIAAVKAQTHTGWANTVERLTGIT
            | |||||||||||||:||||||||||:||||||| ||||:||||||||||||| |||||
m128-1      MTDNALLHLGEEPRFDQIKTEDIKPALQTAIAEAREQIAAIKAQTHTGWANTVEPLTGIT
                    10        20        30        40        50        60

                    70        80        90       100       110       120
g128-1.pep  ERVGRIWGVVSHLNSVVDTPELRAAYNELMPEITVFFTEIGQDIELYNRFKTIKNSPEFA
            |||||||||||||||:||||||||||||||||||||||||||||||||||||||||||||
m128-1      ERVGRIWGVVSHLNSVADTPELRAAYNELMPEITVFFTEIGQDIELYNRFKTIKNSPEFD
                    70        80        90       100       110       120

                   130       140       150       160       170       180
g128-1.pep  TLSPAQKTKLDHDLRDFVLSGAELPPERQAELAKLQTEGAQLSAKFSQNVLDATDAFGIY
            ||||||||||:||||||||||||||||:||||||||||||||||||||||||||||||||
m128-1      TLSPAQKTKLNHDLRDFVLSGAELPPEQQAELAKLQTEGAQLSAKFSQNVLDATDAFGIY
                   130       140       150       160       170       180

                   190       200       210       220       230       240
g128-1.pep  FDDAAPLAGIPEDALAMFAAAAQSEGKTGYKIGLQIPHYLAVIQYAGNRKLREQIYRAYV
            ||||||||||||||||||||||||||:||||||||||||||||||||| ||||||||||||
m128-1      FDDAAPLAGIPEDALAMFAAAAQSESKTGYKIGLQIPHYLAVIQYADNRKLREQIYRAYV
                   190       200       210       220       230       240

                   250       260       270       280       290       300
g128-1.pep  TRASELSNDGKFDNTANIDRTLENALKTAKLLGFKNYAELSLATKMADTPEQVLNFLHDL
            |||||||:|||||||||||||||| |||:|||||||||||||||||||||||||||||||
m128-1      TRASELSDDGKFDNTANIDRTLANALQTAKLLGFKNYAELSLATKMADTPEQVLNFLHDL
                   250       260       270       280       290       300

                   310       320       330       340       350       360
g128-1.pep  ARRAKPYAEKDLAEVKAFAREHLGLADPQPWDLSYAGEKLREAKYAFSETEVKKYFPVGK
            |||||||||||||||||||| |:||| |||||:||:||||||||||||||||||||||||
m128-1      ARRAKPYAEKDLAEVKAFARESLNLADLQPWDLGYASEKLREAKYAFSETEVKKYFPVGK
                   310       320       330       340       350       360

                   370       380       390       400       410       420
g128-1.pep  VLAGLFAQIKKLYGIGFAEKTVPVWHKDVRYFELQQNGKTIGGVYMDLYAREGKRGGAWM
            || ||||||||||||||:||||||||||||||||||||:|||||||||||||||||||||
m128-1      VLNGLFAQIKKLYGIGFTEKTVPVWHKDVRYFELQQNGETIGGVYMDLYAREGKRGGAWM
                   370       380       390       400       410       420
```

-continued

```
                430        440        450        460        470        480
g128-1.pep  NDYKGRRRFADGTLQLPTAYLVCNFTPPVGGKEARLSHDEILTLFHETGHGLHHLLTQVD
            ||||||||:||||||||||||||||||||:|||||||||| ||||||||||||||||
m128-1      NDYKGRRRFSDGTLQLPTAYLVCNFTPPVGGREARLSHDEILILFHETGHGLHHLLTQVD
                430        440        450        460        470        480

                490
g128-1.pep  ELGVSGINGVK
            ||||||||||:
m128-1      ELGVSGINGVEWDAVELPSQFMENFVWEYNVLAQMSAHEETGVPLPKELFDKMLAAKNFQ
                490        500        510        520        530        540
```

The following partial DNA sequence was identified in *N. meningitidis* <SEQ ID 491>:

a128-1.seq

```
   1 ATGACTGACA ACGCACTGCT CCATTTGGGC GAAGAACCCC GTTTTGATCA
  51 AATCAAAACC GAAGACATCA AACCCGCCCT GCAAACCGCC ATTGCCGAAG
 101 CGCGCGAACA AATCGCCGCC ATCAAAGCCC AAACGCACAC CGGCTGGGCA
 151 AACACTGTCG AACCCCTGAC CGGCATCACC GAACGCGTCG GCAGGATTTG
 201 GGGCGTGGTG TCGCACCTCA ACTCCGTCAC CGACACGCCC GAACTGCGCG
 251 CCGCCTACAA TGAATTAATG CCCGAAATTA CCGTCTTCTT CACCGAAATC
 301 GGACAAGACA TCGAGCTGTA CAACCGCTTC AAAACCATCA AAAACTCCCC
 351 CGAGTTCGAC ACCCTCTCCC ACGCGCAAAA AACCAAACTC AACCACGATC
 401 TGCGCGATTT CGTCCTCAGC GGCGCGGAAC TGCCGCCCGA ACAGCAGGCA
 451 GAATTGGCAA AACTGCAAAC CGAAGGCGCG CAACTTTCCG CCAAATTCTC
 501 CCAAAACGTC CTAGACGCGA CCGACGCGTT CGGCATTTAC TTTGACGATG
 551 CCGCACCGCT TGCCGGCATT CCCGAAGACG CGCTCGCCAT GTTTGCCGCT
 601 GCCGCGCAAA GCGAAGGCAA AACAGGCTAC AAAATCGGTT TGCAGATTCC
 651 GCACTACCTC GCCGTCATCC AATACGCCGA CAACCGCAAA CTGCGCGAAC
 701 AAATCTACCG CGCCTACGTT ACCCGCGCCA GCGAGCTTTC AGACGACGGC
 751 AAATTCGACA ACACCGCCAA CATCGACCGC ACGCTCGAAA ACGCCCTGCA
 801 AACCGCCAAA CTGCTCGGCT TCAAAAACTA CGCCGAATTG TCGCTGGCAA
 851 CCAAAATGGC GGACACCCCC GAACAAGTTT TAAACTTCCT GCACGACCTC
 901 GCCCGCCGCG CCAAACCCTA CGCCGAAAAA GACCTCGCCG AAGTCAAAGC
 951 CTTCGCCCGC GAAAGCCTCG GCCTCGCCGA TTTGCAACCG TGGGACTTGG
1001 GCTACGCCGG CGAAAAACTG CGCGAAGCCA AATACGCATT CAGCGAAACC
1051 GAAGTCAAAA AATACTTCCC CGTCGGCAAA GTATTAAACG GACTGTTCGC
1101 CCAAATCAAA AAACTCTACG GCATCGGATT TACCGAAAAA ACCGTCCCCG
1151 TCTGGCACAA AGACGTGCGC TATTTTGAAT TGCAACAAAA CGGCGAAACC
1201 ATAGGCGGCG TTTATATGGA TTTGTACGCA CGCGAAGGCA AACGCGGCGG
1251 CGCGTGGATG AACGACTACA AAGGCCGCCG CCGTTTTTCA GACGGCACGC
1301 TGCAACTGCC CACCGCCTAC CTCGTCTGCA ACTTCACCCC GCCCGTCGGC
1351 GGCAAAGAAG CCCGCTTGAG CCATGACGAA ATCCTCACCC TCTTCCACGA
1401 AACCGGACAC GGCCTGCACC ACCTGCTTAC CCAAGTCGAC GAACTGGGCG
```

-continued

```
1451 TATCCGGCAT CAACGGCCTA GAATGGGACG CAGTCGAACT GCCCAGTCAG

1501 TTTATGGAAA ATTTCGTTTG GGAATACAAT GTCTTGGCGC AAATGTCCGC

1551 CCACGAAGAA ACCGGCGTTC CCCTGCCGAA AGAACTCTTC GACAAAATGC

1601 TCGCCGCCAA AAACTTCCAA CGCGGAATGT TCCTCGTCCG CCAAATGGAG

1651 TTCGCCCTCT TTGATATGAT GATTTACAGC GAAGACGACG AAGGCCGTCT

1701 GAAAAACTGG CAACAGGTTT TAGACAGCGT GCGCAAAGAA GTCGCCGTCG

1751 TCCGACCGCC CGAATACAAC CGCTTCGCCA ACAGCTTCGG CCACATCTTC

1801 GCAGGCGGCT ATTCCGCAGG CTATTACAGC TACGCGTGGG CGGAAGTATT

1851 GAGCGCGGAC GCATACGCCG CCTTTGAAGA AAGCGACGAT GTCGCCGCCA

1901 CAGGCAAACG CTTTTGGCAG GAAATCCTCG CCGTCGGCGG ATCGCGCAGC

1951 GCGGCAGAAT CCTTCAAAGC CTTCCGCGGA CGCGAACCGA GCATAGACGC

2001 ACTCTTGCGC CACAGCGGCT TCGACAACGC GGCTTGA
```

This corresponds to the amino acid sequence <SEQ ID 492; ORF 128-1.a>:

```
a128-1.pep

  1 MTDNALLHLG EEPRFDQIKT EDIKPALQTA IAEAREQIAA IKAQTHTGWA

 51 NTVEPLTGIT ERVGRIWGVV SHLNSVTDTP ELRAAYNELM PEITVFFTEI

101 GQDIELYNRF KTIKNSPEFD TLSHAQKTKL NHDLRDFVLS GAELPPEQQA

151 ELAKLQTEGA QLSAKFSQNV LDATDAFGIY FDDAAPLAGI PEDALAMFAA

201 AAQSEGKTGY KIGLQIPHYL AVIQYADNRK LREQIYRAYV TRASELSDDG

251 KFDNTANIDR TLENALQTAK LLGFKNYAEL SLATKMADTP EQVLNFLHDL

301 ARRAKPYAEK DLAEVKAFAR ESLGLADLQP WDLGYAGEKL REAKYAFSET

351 EVKKYFPVGK VLNGLFAQIK KLYGIGFTEK TVPVWHKDVR YFELQQNGET

401 IGGVYMDLYA REGKRGGAWM NDYKGRRRFS DGTLQLPTAY LVCNFTPPVG

451 GKEARLSHDE ILTLFHETGH GLHHLLTQVD ELGVSGINGV EWDAVELPSQ

501 FMENFVWEYN VLAQMSAHEE TGVPLPKELF DKMLAAKNFQ RGMFLVRQME

551 FALFDMMIYS EDDEGRLKNW QQVLDSVRKE VAVVRPPEYN RFANSFGHIF

601 AGGYSAGYYS YAWAEVLSAD AYAAFEESDD VAATGKRFWQ EILAVGGSRS

651 AAESFKAFRG REPSIDALLR HSGFDNAA*
```

m128-1/a128-1 97.8% identity in 677 aa overlap

```
                    10        20        30        40        50        60
a128-1.pep  MTDNALLHLGEEPRFDQIKTEDIKPALQTAIAEAREQIAAIKAQTHTGWANTVEPLTGIT
            ||||||||||||||||||||||||||||||||||||||||||||||||||||||||||||
m128-1      MTDNALLHLGEEPRFDQIKTEDIKPALQTAIAEAREQIAAIKAQTHTGWANTVEPLTGIT
                    10        20        30        40        50        60

                    70        80        90       100       110       120
a128-1.pep  ERVGRIWGVVSHLNSVTDTPELRAAYNELMPEITVFFTEIGQDIELYNRFKTIKNSPEFD
            ||||||||||||||||:|||||||:|||||||||||||||||||||||||||||||||||
m128-1      ERVGRIWGVVSHLNSVADTPELRAVYNELMPEITVFFTEIGQDIELYNRFKTIKNSPEFD
                    70        80        90       100       110       120
```

-continued

```
               130       140       150       160       170       180
a128-1.pep  TLSHAQKTKLNHDLRDFVLSGAELPPEQQAELAKLQTEGAQLSAKFSQNVLDATDAFGIY
            ||| ||||||||||||||||||||||||||||||||||||||||||||||||||||||||
m128-1      TLSPAQKTKLNHDLRDFVLSGAELPPEQQAELAKLQTEGAQLSAKFSQNVLDATDAFGIY
               130       140       150       160       170       180

               190       200       210       220       230       240
a128-1.pep  FDDAAPLAGIPEDALAMFAAAAQSEGKTGYKIGLQIPHYLAVIQYADNRKLREQIYRAYV
            |||||||||||||||||||||||||:|||||||||||||||||||||||:||||||||||
m128-1      FDDAAPLAGIPEDALAMFAAAAQSESKTGYKIGLQIPHYLAVIQYADNRELREQIYRAYV
               190       200       210       220       230       240

               250       260       270       280       290       300
a128-1.pep  TRASELSDDGKFDNTANIDRTLENALQTAKLLGFKNYAELSLATKMADTPEQVLNFLHDL
            |||||||||||||||||||||| |||||||||||||||||||||||||||||||||||||
m128-1      TRASELSDDGKFDNTANIDRTLANALQTAKLLGFKNYAELSLATKMADTPEQVLNFLHDL
               250       260       270       280       290       300

               310       320       330       340       350       360
a128-1.pep  ARRAKPYAEKDLAEVKAFARESLGLADLQPWDLGYAGEKLREAKYAFSETEVKKYFPVGK
            |||||||||||||||||||||||:||||||||||||:|||||||||||||||||||||||
m128-1      ARRAKPYAEKDLAEVKAFARESLNLADLQPWDLGYASEKLREAKYAFSETEVKKYFPVGK
               310       320       330       340       350       360

               370       380       390       400       410       420
a128-1.pep  VLNGLFAQIKKLYGIGFTEKTVPVWHKDVRYFELQQNGETIGGVYMDLYAREGKRGGAWM
            ||||||||||||||||||||||||||||||||||||||||||||||||||||||||||||
m128-1      VLNGLFAQIKKLYGIGFTEKTVPVWHKDVRYFELQQNGETIGGVYMDLYAREGKRGGAWM
               370       380       390       400       410       420

               430       440       450       460       470       480
a128-1.pep  NDYKGRRRFSDGTLQLPTAYLVCNFTPPVGGKEARLSHDEILTLFHETGHGLHHLLTQVD
            |||||||||||||||||||||||||:|||||:|||||||||| |||||||||||||||||
m128-1      NDYKGRRRFSDGTLQLPTAYLVCNFAPPVGGREARLSHDEILILFHETGHGLHHLLTQVD
               430       440       450       460       470       480

               490       500       510       520       530       540
a128-1.pep  ELGVSGINGVEWDAVELPSQFMENFVWEYNVLAQMSAHEETGVPLPKELFDKMLAAKNFQ
            ||||||||||||||||||||||||||||||||||||||||||||||||||||||||||||
m128-1      ELGVSGINGVEWDAVELPSQFMENFVWEYNVLAQMSAHEETGVPLPKELFDKMLAAKNFQ
               490       500       510       520       530       540

               550       560       570       580       590       600
a128-1.pep  RGMFLVRQMEFALFDMMIYSEDDEGRLKNWQQVLDSVRKEVAVVRPPEYNRFANSFGHIF
            |||||||||||||||||||||||||||||||||||||||:|||::|||||||| ||||||
m128-1      RGMFLVRQMEFALFDMMIYSEDDEGRLKNWQQVLDSVRKKVAVIQPPEYNRFALSFGHIF
               550       560       570       580       590       600

               610       620       630       640       650       660
a128-1.pep  AGGYSAGYYSYAWAEVLSADAYAAFEESDDVAATGKRFWQEILAVGGSRSAAESFKAFRG
            ||||||||||||||||||||||||||||||||||||||||||||||||||||||||||||
m128-1      AGGYSAGYYSYAWAEVLSADAYAAFEESDDVAATGKRFWQEILAVGGSRSAAESFKAFRG
               610       620       630       640       650       660

               670      679
a128-1.pep  REPSIDALLRHSGFDNAAX
            |||||||||||||||||:
m128-1      REPSIDALLRHSGFDNAVX
               670
```

a128-1/P44573 sp|P44573|OPDA_HAEIN OLIGOPEPTIDASE A >gi|1075082|pir||C64055 oligopeptidase A (prlC) homolog-*Haemophilus influenzae* (strain Rd KW20) >gi|1573174 (U32706) oligopeptidase A (prlC) [*Haemophilus influenzae* Rd] Length=681

Score=591 bits (1507), Expect=e−168

Identities=309/677 (45%), Positives=415/677 (60%), Gaps=4/677 (0%)

```
Query:  4    NALLHLGEEPRFDQIKTEDIKPALQTXXXXXXXXXXXXXXXTHTGWANTVEPLTGITERV  63
             N LL++    P F QIK E I+PA++                 H  W N + PLT   +R+
Sbjct:  5    NPLLNIQGLPPFSQIKPEHIRPAVEKLIQDCRNTIEQVLKQPHFTWENFILPLTETNDRL  64

Query:  64   GRIWGVVSHLNSVTDTPELRAAYNELMPEITVFFTEIGQDIELYNRFKTIKNSPEFDTLS  123
              R W  VSHLNSV ++ ELR AY    +P ++ + T +GQ    LYN +   +KNS EF   S
Sbjct:  65   NRAWSPVSHLNSVKNSTELREAYQTCLPLLSEYSTWVGQHKGLYNAYLALKNSAEFADYS  124

Query:  124  HAQKTKLNHDLRDFVLSGAELPPEQQAELAKLQTEGAQLSAKFSQNVLDATDAFGIYFDD  183
              AQK   + + LRDF LSG   L   E+Q     ++     ++L+++FS NVLDAT   +     ++
Sbjct:  125  IAQKKAIENSLRDFELSGIGLSEEKQQRYGEIVARLSELNSQFSNNVLDATMGWEKLIEN  184

Query:  184  AAPLAGIPEDALAMFAAAAQSEGKTGYKIGLQIPHYLAVIQYADNRKLREQIYRAYVTRA  243
              A LAG+PE AL       +A+S+G   GY+   L+IP YL V+ Y +NR LRE++YRAY TRA
Sbjct:  185  EAELAGLPESALQAAQQSAESKGLKGYRFTLEIPSYLPVMTYCENRALREEMYRAYATRA  244

Query:  244  SELSDD-GKFDNTANIDRTLENALQTAKLLGFKNYAELSLATKMADTPEQVLNFLHDLAR  302
             SE    + GK+DN+   ++   L     ++ AKLLGF   Y ELSLATKMA+ P+QVL+FL  LA
Sbjct:  245  SEQGPNAGKWDNSKVMEEILTLRVELAKLLGFNTYTELSLATKMAENPQQVLDFLDHLAE  304

Query:  303  RAKPYAEKDLAEVKAFARESLGLADLQPWDLGYAGEKLREAKYAFSETEVKKYFPVGKVL  362
             RAKP   EK+L E+K +   +   G+ +L PWD+G+   EK ++    YA ++ E++ YFP   +V+
Sbjct:  305  RAKPQGEKELQELKGYCEKEFGVTELAPWDIGFYSEKQKQHLYAINDEELRPYFPENRVI  364
```

-continued

```
Query:  363  NGLFAQIKKLYGIGFTE-KTVPVWHKDVRYFEL-QQNGETIGGVYMDLYAREGKRGGAWM  420
             +GLF  IK+++ I    E K V  WHKDVR+F+L  +N +  G  Y+DLYARE KRGGAWM
Sbjct:  365  SGLFELIKRIFNIRAVERKGVDTWHKDVRFFDLIDENDQLRGSFYLDLYAREHKRGGAWM  424

Query:  421  NDYKGRRRFSDGTLQLPTAYLVCNFTPPVGGKEARLSHDEIXXXXXXXXXXXXXXXXQVD  480
             +D  GR+R  DG+++ P AYL CNF  P+G K A  +H+E+                Q+D
Sbjct:  425  DDCIGRKRKLDGSIETPVAYLTCNFNAPIGNKPALFTHNEVTTLFHEFGHGIHHMLTQID  484

Query:  481  ELGVSGINGVEWDAVELPSQFMENFVWEYNVLAQMSAHEETGVPLPKELFDKMLAAKNFQ  540
                V+GINGV WDAVELPSQFMEN+ WE   LA +S H ETG PLPKE   ++L AKNFQ
Sbjct:  485  VSDVAGINGVPWDAVELPSQFMENWCWEEEALAFISGHYETGEPLPKEKLTQLLKAKNFQ  544

Query:  541  RGMFLVRQMEFALFDMMIYSEDDEGRLKNWQQVLDSVRKEVAVVRPPEYNRFANSFGHIF  600
               MF++RQ+EF +FD  ++   D  +        L SV+ +VAV++  ++ R  +SF HIF
Sbjct:  545  AAMFILRQLEFGIFDFRLHHTFDAEKTNQILDTLKSVKSQVAVIKGVDWARAPHSFSHIF  604

Query:  601  XXXXXXXXXXXXWAEVLSADAYAAFEESDDV-AATGKRFWQEILAVGGSRSAAESFKAFR  659
                         WAEVLSADAY+ FEE        TGK F  EIL  GGS    E FK FR
Sbjct:  605  AGGYAAGYYSYLWAEVLSADAYSRFEEEGIFNPITGKSFLDEILTRGGSEEPMELFKRFR  664

Query:  660  GREPSIDALLRHSGFDN  676
             GREP +DALLRH G  N
Sbjct:  665  GREPQLDALLRHKGIMN  681
```

The following partial DNA sequence was identified in *N. gonorrhoeae* <SEQ ID 493>:

g129.seq

```
  1 ATGCTTTCAC CTCCTCGGCG TAAAACGGCG GCACATCAAT CAAGCCGTCT
 51 TTCATTTGCG TGCGGAAAAA ATGCGGCGTG TTGCCGTGAT CAAAATCAAT
101 ATCGTGCAGC ATCCAGCCCA AATCGCGGTT TGCCTCGCTT TCCGATAACG
151 CCGACGGCGG CAGCGGTTCA CCCTTATCCG CGCTTTCGCC ATTTGCCCTT
201 TCAGGCTGCG GGCATAGGGG CGGAACAGGC GGCGGTCGAA TCCTGTTTCA
251 TCCGGACAAA CGCGTTGGCA GTCGGAAAAT CCGGCCGGCC GTGTCAAATA
301 ATGCGTTACT TTGGCCGGGT CTTGTCCTTT GTAAGCGGCG GTCTTTTTTT
351 GCGCGCCATC CGCATCTGTT TGGGCGCATG GCAAACGGCG GCTGCCGTAC
401 AATCAAAATG TTTGGCGATT TCATGCAGAC AGGCATCCGG ATGCCGCCCG
451 ACATATCGAG CCGGTTTTTG CCTATCCGAT TTGGCGGCAT TTAGGCCGGT
501 AACTTGA
```

This corresponds to the amino acid sequence <SEQ ID 494; ORF 129.ng>:

g129.pep

```
  1 MLSPPRRKTA AHQSSRLSFA CGKNAACCRD QNQYRAASSP NRGLPRFPIT
 51 PTAAAVHPYP RFRHLPFQAA GIGAEQAAVE SCFIRTNALA VGKSGRPCQI
101 MRYFGRVLSF VSGGLFLRAI RICLGAWQTA AAVQSKCLAI SCRQASGCRP
151 TYRAGFCLSD LAAFRPVT*
```

The following partial DNA sequence was identified in *N. meningitidis* <SEQ ID 495>:

m129.seq (partial)

```
  1 TATCTGCGCT TTCACTATTT GCCCTTTCAG GCTGCGGGCA TAGGGACGGA
 51 ACAGGTAGCG GTCAAATCCT GTTTCATCCA AATAAACACG TTGGTAGTCG
```

-continued

```
101 GAAAATTCGG CCGGCTGTGT CAAATAATGC GTTACTTTGG CCGGGTCTTG

151 TTCTTTGTAA GTGGTGGTCT TTTTTTGCGC GTTATCCCCA TCTGTTTGAG

201 TGCATAGCAA ATGGTGGCTG CCGTACAATC AAAATGTTTG GCGATTTCAT

251 GCAGATAGGC ATCCGGGTGT TGCCCAACAT ATTGAGCCGG TTTTTGCCTA

301 TCCGATTTGA CGGCATTTAG ACCGGTAACT TGA
```

This corresponds to the amino acid sequence <SEQ ID 496; ORF 129>:

m129.pep (partial)

```
  1 YLRFHYLPFQ AAGIGTEQVA VKSCFIQINT LVVGKFGRLC QIMRYFGRVL

 51 FFVSGGLFLR VIPICLSAXQ MVAAVQSKCL AISCRXASGC CPTYXAGFCL

101 SDLTAFRPVT *
```

Computer analysis of this amino acid sequence gave the following results:

Homology with a predicted ORF from *N. gonorrhoeae*

ORF 129 shows 79.1% identity over a 110 aa overlap with a predicted ORF (ORF 129.ng) from *N. gonorrhoeae*:

```
m129/g129

                                                     10        20        30
m129.pep                                     YLRFHYLPFQAAGIGTEQVAVKSCFIQINT
                                             | ||::|||||||||:||:||:||||: |:
g129       RDQNQYRAASSPNRGLPRFPITPTAAAVHPYPRFRHLPFQAAGIGAEQAAVESCFIRTNA
           30        40        50        60        70        80
                  40        50        60        70        80        90
m129.pep   LVVGKFGRLCQIMRYFGRVLFFVSGGLFLRVIPICLSAXQMVAAVQSKCLAISCRXASGC
           |:||| || ||||||||||| |||||||||:| |||:| | :||||||||||||| ||||
g129       LAVGKSGRPCQIMRYFGRVLSFVSGGLFLRAIRICLGAWQTAAAVQSKCLAISCRQASGC
           90       100       110       120       130       140
                 100       110
m129.pep   CPTYXAGFCLSDLTAFRPVTX
            ||| ||||||||:|||||||
g129       RPTYRAGFCLSDLAAFRPVTX
          150       160
```

The following partial DNA sequence was identified in *N. meningitidis* <SEQ ID 497>:

a129.seq (partial)

```
  1 TATCTGCGCT TTCACTATTT GCCCTTTCAG GCTGCGGGCA TAGGGACGGA

 51 ACAGGTAGCG GTCAAATCCT GTTTCATCCA AATAAACACG TTGGTAGTCG

101 GAAAATTCGG CCAGCTGTGT CAAATAATGC GTTACTTTGG CCGGGTCTTG

151 TTCTTTGTAA GTGGTGGTCT TTTTTTGCGC GTTATCCCCA TCTGTTTGAG

201 TGCATAGCAA ATGGTGGCTG CCGTACAATC AAAATGTTTG GCGATTTCAT

251 GCAGATAGGC ATCCTGGTGT TGCCCAACAT ATTGAGCCGG TTTTTGCCTA

301 TCCGATTTGA CGGCATTTAG ACCGGTAACT TGA
```

This corresponds to the amino acid sequence <SEQ ID 498; ORF 129.a>:

a129.pep (partial)

```
  1 YLRFHYLPFQ AAGIGTEQVA VKSCFIQINT LVVGKFGQLC QIMRYFGRVL
 51 FFVSGGLFLR VIPICLSA*Q MVAAVQSKCL AISCR*ASWC CPTY*AGFCL
101 SDLTAFRPVT *
```

m129/a129 98.2% identity in 110 aa overlap

```
                    10        20        30        40        50        60
m129.pep    YLRFHYLPFQAAGIGTEQVAVKSCFIQINTLVVGKFGRLCQIMRYFGRVLFFVSGGLFLR
            |||||||||||||||||||||||||||||||||||||:||||||||||||||||||||||
a129        YLRFHYLPFQAAGIGTEQVAVKSCFIQINTLVVGKFGQLCQIMRYFGRVLFFVSGGLFLR
                    10        20        30        40        50        60

                    70        80        90       100       110
m129.pep    VIPICLSAXQMVAAVQSKCLAISCRXASGCCPTYXAGFCLSDLTAFRPVTX
            |||||||||||||||||||||||||||| ||||||||||||||||||||||
a129        VIPICLSAXQMVAAVQSKCLAISCRXASWCCPTYXAGFCLSDLTAFRPVTX
                    70        80        90       100       110
```

The following partial DNA sequence was identified in *N. gonorrhoeae* <SEQ ID 499>:

g130.seq

```
  1 ATGAAACAAC TCCGCGACAA CAAAGCCCAA GGCTCTGCAC TGTTTACCCT
 51 TGTGAGCGGT ATCGTTATTG TTATTGCAGT CCTTTATTTC CTGATTAAGC
101 TGGCGGGCAG TGGATCGTTC GGCGATGTCG ATGCCACTAC GGAAGCGGCA
151 ACGCAGACCC GCATCCAGCC TGTCGGACAA TTGACGATGG GTGACGGCAT
201 CCCCGTCGGC GAACGCCAAG GCGAACAGAT TTTCGGCAAA ATCTGTATCC
251 AATGCCACGC GGCGGACAGC AATGTGCCGA ACGCTCCGAA ACTGGAACAC
301 AACGGCGACT GGGCGCCGCG TATCGCGCAA GGCTTCGATA CCTTGTTCCA
351 ACACGCGCTG AACGGCTTTA ACGCCATGCC TGCCAAAGGC GGTGCGGCAG
401 ACCTGACCGA TCAGGAACTC AAACGGGCGA TTACCTACAT GGCGAATAAA
451 AGCGGCGGTT CTTTCCCGAA TCCTGATGAG GCTGCGCCTG CCGACAATGC
501 CGCTTCAGGA ACAGCTTCTG CTCCTGCCGA TAGTGCAGCT CCGGCAGAAG
551 CGAAGGCAGA AGACAAGGGT GCGGCAGCCC CTGCGGTCGG CGTTGACGGT
601 AAAAAAGTCT TCGAAGCAAC CTGTCAGGTG TGCCACGGCG GTTCGATTCC
651 CGGTATTCCC GGCATAGGCA AAAAAGACGA TTGGGCACCG CGTATCAAAA
701 AAGGCAAAGA AACCTTGCAC AAACATGCCC TTGAAGGCTT TAACGCGATG
751 CCGGCCAAAG GCGGCAATGC AGGTTTGAGC GATGACGAAG TCAAAGCGGC
801 TGTTGACTAT ATGGCAAACC AATCCGGTGC AAAATTCTAA
```

This corresponds to the amino acid sequence <SEQ ID 500; ORF 130.ng>:

g130.pep

```
  1 MKQLRDNKAQ GSALFTLVSG IVIVIAVLYF LIKLAGSGSF GDVDATTEAA
 51 TQTRIQPVGQ LTMGDGIPVG ERQGEQIFGK ICIQCHAADS NVPNAPKLEH
```

-continued

```
101 NGDWAPRIAQ GFDTLFQHAL NGFNAMPAKG GAADLTDQEL KRAITYMANK

151 SGGSFPNPDE AAPADNAASG TASAPADSAA PAEAKAEDKG AAAPAVGVDG

201 KKVFEATCQV CHGGSIPGIP GIGKKDDWAP RIKKGKETLH KHALEGFNAM

251 PAKGGNAGLS DDEVKAAVDY MANQSGAKF*
```

The following partial DNA sequence was identified in *N. meningitidis* <SEQ ID 501>:

m130.seq (partial)

```
  1 ..GGCGAACAGA TTTTCGGCAA AATCTGTATC CAATGCCACG CGGCGGACAG
 51   CAATGTGCCG AACGCTCCGA AACTGGAACA CAACGGCGAT TrGGCACCGC
101   GTATCGgCAA GGCTTCGATA CCTTGTTCCA ACACGCGCTG AACGGCTTTA
151   ACGCCATGCC TGCAAAAGGC GGTGCGGCAG ACCTGACCGA TCAGGAACTT
201   AAACGGGCGA TTACTTACAT GGCGAACAAA AGCGGCGGTT CTTTCCCGAA
251   TCCTGATGAG GCTGCGCCTG CCGACAATGC CGCTTCAGGA ACAGCTTCTG
301   CTCCTGCCGA TAGTGCAGCT CCGGCAGAAG CGAAGGCAGA AGACAAGGGT
351   GCGGCAcCCC TGCGGTCGGC GTTGACGGTA AAAAAGTCTT CGAAGCAACC
401   TGTCAGGTGT GCCACGGCGG TTCGATTCCC GGTATTCCCG GCATAGGCAA
451   AAAAGACGAT TGGGCACCGC GTATCAAAAA AGGCAAAGAA ACCTTGCACA
501   AACACGCCCT TGAAGGCTTT AACGCGATGC CTGCCAAArG CGgCAATGCA
551   GGTTTGAGCG ATGACGAAgT CAAAGCGGCT GTTGACTATA TGGCAAACCA
601   ATCCGGTGCA AAATTCTAA
```

This corresponds to the amino acid sequence <SEQ ID 502; ORF 130>:

m130.pep (partial)

```
  1 ..GEQIFGKICI QCHAADSNVP NAPKLEHNGD XAPRIQGFDT LFQHALNGFN
 51   AMPAKGGAAD LTDQELKRAI TYMANKSGGS FPNPDEAAPA DNAASGTASA
101   PADSAAPAEA KAEDKGAAPA VGVDGKKVFE ATCQVCHGGS IPGIPGIGKK
151   DDWAPRIKKG KETLHKHALE GFNAMPAKXG NAGLSDDEVK AAVDYMANQS
201   GAKF*
```

Computer analysis of this amino acid sequence gave the following results:

Homology with a predicted ORF from *N. gonorrhoeae*

ORF 130 shows 98.1% identity over a 206 aa overlap with a predicted ORF (ORF 130.ng) from *N. gonorrhoeae*:

m130/g130

```
                                                   10        20        30
m130.pep                                   GEQIFGKICIQCHAADSNVPNAPKLEHNGD
                                           ||||||||||||||||||||||||||||||
g130        DATTEAATQTRIQPVGQLTMGDGIPVGERQGEQIFGKICIQCHAADSNVPNAPKLEHNGD
                    50        60        70        80        90       100
```

-continued

```
               40         50         60         70         80        89
m130.pep    XAPRI-QGFDTLFQHALNGFNAMPAKGGAADLTDQELKRAITYMANKSGGSFPNPDEAAP
            |||| |||||||||||||||||||||||||||||||||||||||||||||||||||||||
g130        WAPRIAQGFDTLFQHALNGFNAMPAKGGAADLTDQELKRAITYMANKSGGSFPNPDEAAP
                 110        120        130        140        150        160

           90        100        100        120        130        140
m130.pep    ADNAASGTASAPADSAAPAEAKAEDKGAA-PAVGVDGKKVFEATCQVCHGGSIPGIPGIG
            ||||||||||||||||||||||||||||| ||||||||||||||||||||||||||||||
g130        ADNAASGTASAPADSAAPAEAKAEDKGAAAPAVGVDGKKVFEATCQVCHGGSIPGIPGIG
                 170        180        190        200        210        220

          150        160        170        180        190        200
m130.pep    KKDDWAPRIKKGKETLHKHALEGFNAMPAKXGNAGLSDDEVKAAVDYMANQSGAKFX
            |||||||||||||||||||||||||||||| ||||||||||||||||||||||||||
g130        KKDDWAPRIKKGKETLHKHALEGFNAMPAKGGNAGLSDDEVKAAVDYMANQSGAKFX
                 230        240        250        260        270        280
```

The following partial DNA sequence was identified in *N. meningitidis* <SEQ ID 503>:

a130.seq

```
  1 ATGAAACAAC TCCGCGACAA CAAAGCCCAA GGCTCTGCAC TGTTTACCCT
 51 TGTGAGCGGT ATCGTTATTG TTATTGCAGT CCTTTATTTC CTGATTAACC
101 TGGCGGGCAG CGGCTCGTTC GGCGATGTCG ATGCCACTAC GGAAGCAGCA
151 ACGCAGACCC GTATCCAGCC TGTCGGACAA TTGACGATGG GCGACGGCAT
201 CCCCGTCGGC GAACGCCAAG GCGAACAGAT TTTCGGCAAA ATCTGTATCC
251 AATGCCACGC GGCGGACAGC AATGTGCCGA ACGCTCCGAA ACTGGAACAC
301 AACGGCGATT GGGCGCCGCG TATCGCGCAA GGCTTCGATA CCTTGTTCCA
351 ACACGCGCTG AACGGCTTTA ACGCCATGCC TGCCAAAGGC GGTGCGGTAG
401 ACCTGACCGA TCAGGAACTC AAACGGGCGA TTACTTACAT GGCGAACAAA
451 AGCGGCGGTT CTTTCCCGAA TCCTGATGAG GCTGCGCCTG CCGACAATGC
501 CGCTTCAGGA ACAGCTTCTG CTCCTGCCGA TAGTGCAGCT CCGGCAGAAG
551 CGAAGGCAGA AGACAAGGGT GCGGCAGCCC CTGCGGTCGG CGTTGACGGT
601 AAAAAAGTCT TCGAAGCAAC CTGTCAGGTG TGCCACGGCG GTTCGATTCC
651 CGGTATTCCC GGCATAGGCA AAAAAGACGA TTGGGCACCG CGTATCAAAA
701 AAGGCAAAGA AACCTTGCAC AAACACGCCC TTGAAGGCTT TAACGCGATG
751 CCTGCCAAAG GCGGCAATGC AGGTTTGAGC GATGACGAAG TCAAAGCGGC
801 TGTTGACTAT ATGGCAAACC AATCCGGTGC AAAATTCTAA
```

This corresponds to the amino acid sequence <SEQ ID 504; ORF 130.a>:

a130.pep

```
  1 MKQLRDNKAQ GSALFTLVSG IVIVIAVLYF LIKLAGSGSF GDVDATTEAA
 51 TQTRIQPVGQ LTMGDGIPVG ERQGEQIFGK ICIQCHAADS NVPNAPKLEH
101 NGDWAPRIAQ GFDTLFQHAL NGFNAMPAKG GAVDLTDQEL KRAITYMANK
151 SGGSFPNPDE AAPADNAASG TASAPADSAA PAEAKAEDKG AAAPAVGVDG
201 KKVFEATCQV CHGGSIPGIP GIGKKDDWAP RIKKGKETLH KHALEGFNAM
251 PAKGGNAGLS DDEVKAAVDY MANQSGAKF*
```

m130/a130 97.6% identity in 206 aa overlap

```
                                  10         20         30
m130.pep                  GEQIFGKICIQCHAADSNVPNAPKLEHNGD
                          ||||||||||||||||||||||||||||||
a130     DATTEAATQTRIQPVGQLTMGDGIPVGERQGEQIFGKICIQCHAADSNVPNAPKLEHNGD
             50         60         70         80         90        100

                 40         50         60         70         80         89
m130.pep   XAPRI-QGFDTLFQHALNGFNAMPAKGGAADLTDQELKRAITYMANKSGGSFPNPDEAAP
           |||| |||||||||||||||||||||||||:||||||||||||||||||||||||||||
a130       WAPRIAQGFDTLFQHALNGFNAMPAKGGAVDLTDQELKRAITYMANKSGGSFPNPDEAAP
              110        120        130        140        150        160

              90        100        100        120        130        140
m130.pep   ADNAASGTASAPADSAAPAEAKAEDKGAA-PAVGVDGKKVFEATCQVCHGGSIPGIPGIG
           |||||||||||||||||||||||||||||||||||||||||||||||||||||||||||
a130       ADNAASGTASAPADSAAPAEAKAEDKGAAAPAVGVDGKKVFEATCQVCHGGSIPGIPGIG
              170        180        190        200        210        220

             150        160        170        180        190        200
m130.pep   KKDDWAPRIKKGKETLHKHALEGFNAMPAKXGNAGLSDDEVKAAVDYMANQSGAKFX
           |||||||||||||||||||||||||||||| ||||||||||||||||||||||||||
a130       KKDDWAPRIKKGKETLHKHALEGFNAMPAKGGNAGLSDDEVKAAVDYMANQSGAKFX
              230        240        250        260        270        280
```

The following partial DNA sequence was identified in *N. gonorrhoeae* <SEQ ID 505>:

g132.seq

```
  1 ATGGAAGCCT TCAAAACCCT AATTTGGATT ATTAATATTA TTTCCGCTTT
 51 GGCCGTCATC GTGTTAGTAT TGCTCCAACA CGGCAAAGGC GCGGATGCCG
101 GCGCGACCTT CGGATCGGGA AGCGGCAGCG CGCAAGGCGT ATTCGGCTCT
151 GCCGGCAACG CCAACTTcct CAgccGCTCG AccGccGTTG CAGCAACAtt
201 tttcttTGca acctgcAtgg gctatggTgt atattcacac CCACACGACA
251 AAACACGGTT TGGACTtcag caacataCGA CAGACTCAGC AagcACCCAA
301 ACCcgtAAGC AATACCGAAC CTTCTGCCCC TGTTCCTCAG CAGCAGAAAT
351 AACagtTTTT CAAATgccga caTGgtga
```

This corresponds to the amino acid sequence <SEQ ID 506; ORF 132.ng>:

g132.pep

```
  1 MEAFKTLIWI INIISALAVI VLVLLQHGKG ADAGATFGSG SGSAQGVFGS
 51 AGNANFLSRS TAVAATFFFA TCMGYGVYSH PHDKTRFGLQ QHTTDSASTQ
101 TRKQYRTFCP CSSAAEITVF QMPTW*
```

The following partial DNA sequence was identified in *N. meningitidis* <SEQ ID 507>:

m132.seq (partial)

```
  1 ATGGAACCCT TCAAAACCTT AATTTGGATT GTTAATTTAA TTTCCGCTTT
 51 GGCCGTCTTC GTGTTAGTAT TGCTCCAACA CGGCAAAGGC GCGGATGCCG
101 GCGCGACTTT CGGA...
```

This corresponds to the amino acid sequence <SEQ ID 508; ORF 132>:

m132.pep (partial)

```
1 MEPFKTLIWI VNLISALAVF VLVLLQHGKG ADAGATFG...
```

Computer analysis of this amino acid sequence gave the following results:

Homology with a predicted ORF from *N. gonorrhoeae*

ORF 132 shows 89.5% identity over a 38 aa overlap with a predicted ORF (ORF 132.ng) from *N. gonorrhoeae*:

m132/g132

```
                   10        20        30
m132.pep  MEPFKTLIWIVNLISALAVFVLVLLQHGKGADAGATFG
          || |||||||:|:||||||:|||||||||||||||||
g132      MEAFKTLIWIINIISALAVIVLVLLQHGKGADAGATFGSGSGSAQGVFGSAGNANFLSRS
                  10        20        30        40        50        60
```

The following partial DNA sequence was identified in *N. meningitidis* <SEQ ID 509>:

a132.seq

```
  1 ATGGAAGCCT TCAAAACCCT AATTTGGATT GTTAATATAA TTTCCGCTTT
 51 GGCCGTCATC GTGTTAGTAT TGCTCCAACA CGGCAAAGGC GCGGATGCCG
101 GCGCGACTTT CGGATCGGGA AGCGGCAGCG CGCAAGGCGT ATTCGGCTCT
151 GCCGGCAACG CTAACTTCCT CAGCCGCTCG ACCGCCGTTG CAGCAACATT
201 TTTCTTTGCA ACCTGCATGg GCTATGGTGT ATATTCACAC CCACACGACA
251 AAACACGGTT TGGACTTCAG CAACGTACAA CAAACTCAGC AAGCACCCAA
301 ACCCGTAAGC AATACCGAAC CTTCTGCCCC TGTTCCTCAG CAGCAGAAAT
351 AACAGTTTTT CAAATGCCGA CATGGTGA
```

This corresponds to the amino acid sequence <SEQ ID 510; ORF 132.a>:

a132.pep

```
  1 MEAFKTLIWI VNIISALAVI VLVLLQHGKG ADAGATFGSG SGSAQGVFGS
 51 AGNANFLSRS TAVAATFFFA TCMGYGVYSH PHDKTRFGLQ QRTTNSASTQ
101 TRKQYRTFCP CSSAAEITVF QMPTW*
```

m132/a132 92.1% identity in 38 aa overlap

```
                   10        20        30
m132.pep  MEPFKTLIWIVNLISALAVFVLVLLQHGKGADAGATFG
          || |||||||||:||||||:|||||||||||||||||
a132      MEAFKTLIWIVNIISALAVIVLVLLQHGKGADAGATFGSGSGSAQGVFGSAGNANFLSRS
                  10        20        30        40        50        60
```

The following partial DNA sequence was identified in *N. gonorrhoeae* <SEQ ID 511>:

g134.seq

```
 1 ATGTCCCAAG AAATCCTCGA CCAAGTGCGC CGCCGCCGCA CGTTTGCCAT
51 CATCTCCCAC CCCGATGCGG GTAAAACCAC GCTGACCGAA AAACTGCTGC
```

-continued

```
 101 TGTTTTCGGG CGCGATTCAA AGCGCAGGCA CGGTGAAAGG TAAGAAAACC

 151 GGCAAATTCG CCACCTCCGA CTGGATGGAC ATCGAGAAGC AGCGCGGCAT

 201 TTCCGTGGCA TCAAGCGTGA TGCAGTTCGA CTACAAAGAC CACACCGTCA

 251 ACCTCTTGGA CACGCCGGGA CACCAAGACT TCTCCGAAGA CACCTACCGC

 301 GTTTTAACCG CAGTGGACAG CGCCTTGATG GTCATCGACG CGGCAAAAGG

 351 CGTGGAAGCG CAAACCATCA AACTCTTGAA CGTCTGCCGC CTGCGCGATA

 401 CGCCGATTGT TACCTTCATG AACAAATACG ACCGCGAAGT GCGCGATTCT

 451 TTGGAACTCT TGGACGAAGT GGAAGACATC CTGCAAATCC GCTGCGCGCC

 501 CGTTACCTGG CCGATCGGTA TGGGCAAAAA CTTCAAGGGC GTGTACCACA

 551 TCCTGAACGA CGAAATCTAT CTCTTTGAAG CGGGCGGCGA ACGCCTGCCG

 601 CACGAGTTCG ACATCATCAA AGGCATAAAC AATCCCGAAT TGGAACAACG

 651 CTTTCCGTTG GAAATCCAGC AGTTGCGCGA CGAAATCGAA TTGGTGCAGG

 701 CGGCTTCCAA CGAATTTAAT CTCGacgaAT TTCTCGccgG CGAACTCACG

 751 CCAGTGTTCT TCGGCTCTGC GATTAACAAC TTCGGCATTC AGGAAATCCT

 801 CAATTCATTG ATTGACTGGG CACCCGCACC GAAACCGCGC GACGCGACCA

 851 TGCGCATGGT CGGGCCGGAC GAGCCGAAAT TTTCCGGATT TATCTTTAAA

 901 ATCCAAGCCA ATATGGACCC GAAACACCGC GACCGTATCG CCTTCTTGCG

 951 CGTCTGCTCC GGTAAATTCG AGCGCGGCAT GAAGATGAAA CACCTGCGTA

1001 TCAACCGCGA AATCGCCGCC TCCAGCGTAG TAACCTTCAT GTCGCACGAC

1051 CGCGAACTGG CGGAAGAAGC CTACGCCGGC GACATCATCG GCATCCCGAA

1101 CCACGGCAAC ATCCAAATCG GCGACAGCTT CTCCGAAGGC GAACAACTGG

1151 CGTTTACCGG CATCCCATTC TTCGCGCCCG AACTGTTCCG CAGCGTCCGC

1201 ATCAAAAACC CGCTGAAAAT CAAACAACTG CAAAAAGGTT TGCAACAACT

1251 CGGCGAAGAA GGTGCGGTTC AAGTATTCAA ACCGATGAGC GGCGCGGATT

1301 TGATTTTGGG TGCGGTCGGC GTGTTGCAGT TTGAAGTCGT AACCTCACGC

1351 CTCGCCAACG AATACGGCGT GGAAGCCGTG TTCGACAGCG CATCCATCTG

1401 GTCGGCGCGC TGGGTATCGT GCGACGACAA GAAAAAACTG GCGGAATTTG

1451 AAAAAGCCAA CGCAGGCAAC CTCGCCATCG ACGCAGGCGG CAACCTCGCC

1501 TACCTCGCCC CCAACCGCGT GAATTTGGGG TTGACGCAAG AACGCTGGCC

1551 GGACATCGTG TTCCACGAAA CGCGCGAACA TTCGGTCAAA CTCTAA
```

This corresponds to the amino acid sequence <SEQ ID 512; ORF 134.ng>:

g134.pep

```
  1 MSQEILDQVR RRRTFAIISH PDAGKTTLTE KLLLFSGAIQ SAGTVKGKKT

 51 GKFATSDWMD IEKQRGISVA SSVMQFDYKD HTVNLLDTPG HQDFSEDTYR

101 VLTAVDSALM VIDAAKGVEA QTIKLLNVCR LRDTPIVTFM NKYDREVRDS

151 LELLDEVEDI LQIRCAPVTW PIGMGKNFKG VYHILNDEIY LFEAGGERLP

201 HEFDIIKGIN NPELEQRFPL EIQQLRDEIE LVQAASNEFN LDEFLAGELT
```

-continued

```
251 PVFFGSAINN FGIQEILNSL IDWAPAPKPR DATMRMVGPD EPKFSGFIFK

301 IQANMDPKHR DRIAFLRVCS GKFERGMKMK HLRINREIAA SSVVTFMSHD

351 RELAEEAYAG DIIGIPNHGN IQIGDSFSEG EQLAFTGIPF FAPELFRSVR

401 IKNPLKIKQL QKGLQQLGEE GAVQVFKPMS GADLILGAVG VLQFEVVTSR

451 LANEYGVEAV FDSASIWSAR WVSCDDKKKL AEFEKANAGN LAIDAGGNLA

501 YLAPNRVNLG LTQERWPDIV FHETREHSVK L*
```

The following partial DNA sequence was identified in *N. meningitidis* <SEQ ID 513>:

m134.seq

```
   1 ATGTCCCAAG AAATCCTCGA CCAAGTGCGC CGCCGCCGCA CGTTTGCCAT
  51 CATCTCCCAC CCTGACGCAG GTAAAACCAC GTTGACTGAA AAACTCTTGC
 101 TGTTTTCGGG CGCGATTCAG AGCGCGGGTA CGGTAAAAGG CAAGAAAACC
 151 GGCAAATTCG CCACTTCCGA CTGGATGGAA ATCGAGAAGC AGCGCGGCAT
 201 TTCCGTGGCA TCAAGTGTGA TGCAGTTCGA TTACAAAGAC CACACCGTCA
 251 ACCTCTTGGA CACGCCGGGA CACCAAGACT TCTCCGAAGA CACCTACCGC
 301 GTTTTAACCG CCGTGGACAG CGCATTAATG GTCATCGACG CGGCAAAAGG
 351 CGTGGAAGCG CAAACCATCA AGCTCTTAAA CGTCTGCCGC CTGCGCGATA
 401 CACCGATTGT TACGTTTATG AACAAATACG ACCGCGAAGT GCGCGATTCC
 451 CTGGAACTTT TGGACGAAGT GGAAAACATT TTAAAAATCC GCTGCGCGCC
 501 CGTTACCTGG CCGATCGGTA TGGGCAAAAA CTTCAAGGGC GTGTACCACA
 551 TCCTGAACGA TGAAATTTAT CTCTTTGAAG CTGGCGGCGA ACGCCTGCCG
 601 CACGAGTTCG ACATCATCAA AGGCATCGAT AATCCTGAAT TGGAACAACG
 651 CTTTCCGTTG GAAATCCAGC AGTTGCGCGA CGAAATCGAA TTGGTGCAGG
 701 CGGCTTCCAA CGAGTTTAAT CTCGACGAAT TCCTCGCCGG CGAACTCACG
 751 CCCGTATTCT TCGGCTCTGC GATTAACAAC TTCGGTATTC AGGAAATCCT
 801 CAATTCATTG ATTGACTGGG CGCCCGCGCC GAAACCGCGC GACGCGACCG
 851 TACGTATGGT CGAGCCGGAC GAGCCGAAGT TTTCCGGATT TATCTTCAAA
 901 ATCCAAGCCA ATATGGACCC GAAACACCGC GACCGTATTG CCTTCTTGCG
 951 CGTCTGCTCC GGCAAATTCG AGCGCGGCAT GAAGATGAAA CACCTGCGTA
1001 TCAACCGCGA AATCGCCGCC TCCAGCGTGG TTACCTTCAT GTCGCACGAC
1051 CGCGAGCTGG TTGAAGAAGC CTACGCCGGC GACATTATCG GCATCCCGAA
1101 CCACGGCAAC ATCCAAATCG GCGACAGCTT CTCCGAAGGC GAACAACTGG
1151 CGTTCACCGG CATCCCATTC TTCGCACCCG AACTGTTCCG CAGCGTACGC
1201 ATCAAAAACC CGCTGAAAAT CAAACAACTG CAAAAAGGCT TGCAACAGCT
1251 CGGCGAAGAA GGCGCGGTGC AGGTGTTCAA ACCGATGAGC GGCGCGGATT
1301 TGATTTTGGG CGCGGTCGGC GTGTTGCAGT TTGAAGTCGT TACCTCGCGC
1351 CTCGCCAACG AATACGGCGT AGAAGCCGTG TTCGACAGCG CATCCATCTG
1401 GTCGGCGCGC TGGGTATCGT GCGACGACAA GAAAAAACTG GCTGAATTTG
1451 AAAAAGCCAA CGCGGGCAAC CTCGCCATCG ACGCAGGCGG CAACCTCGCC
```

-continued

```
1501 TACCTCGCCC CCAACCGCGT GAATTTGGGA CTCACGCAAG AACGTTGGCC

1551 GGACATCGTG TTCCACGAAA CACGCGAACA TTCGGTCAAA CTGTAA
```

This corresponds to the amino acid sequence <SEQ ID 514; ORF 134>:

m134.pep

```
  1 MSQEILDQVR RRRTFAIISH PDAGKTTLTE KLLLFSGAIQ SAGTVKGKKT

 51 GKFATSDWME IEKQRGISVA SSVMQFDYKD HTVNLLDTPG HQDFSEDTYR

101 VLTAVDSALM VIDAAKGVEA QTIKLLNVCR LRDTPIVTFM NKYDREVRDS

151 LELLDEVENI LKIRCAPVTW PIGMGKNFKG VYHILNDEIY LFEAGGERLP

201 HEFDIIKGID NPELEQRFPL EIQQLRDEIE LVQAASNEFN LDEFLAGELT

251 PVFFGSAINN FGIQEILNSL IDWAPAPKPR DATVRMVEPD EPKFSGFIFK

301 IQANMDPKHR DRIAFLRVCS GKFERGMKMK HLRINREIAA SSVVTFMSHD

351 RELVEEAYAG DIIGIPNHGN IQIGDSFSEG EQLAFTGIPF FAPELFRSVR

401 IKNPLKIKQL QKGLQQLGEE GAVQVFKPMS GADLILGAVG VLQFEVVTSR

451 LANEYGVEAV FDSASIWSAR WVSCDDKKKL AEFEKANAGN LAIDAGGNLA

501 YLAPNRVNLG LTQERWPDIV FHETREHSVK L*
```

Computer analysis of this amino acid sequence gave the following results:

Homology with a predicted ORF from *N. gonorrhoeae*

ORF 134 shows 98.7% identity over a 531 aa overlap with a predicted ORF (ORF 134.ng) from *N. gonorrhoeae*:

m134/g134

```
                  10        20        30        40        50        60
m134.pep  MSQEILDQVRRRRTFAIISHPDAGKTTLTEKLLLFSGAIQSAGTVKGKKTGKFATSDWME
          |||||||||||||||||||||||||||||||||||||||||||||||||||||||||||:
g134      MSQEILDQVRRRRTFAIISHPDAGKTTLTEKLLLFSGAIQSAGTVKGKKTGKFATSDWMD
                  10        20        30        40        50        60

                  70        80        90       100       110       120
m134.pep  IEKQRGISVASSVMQFDYKDHTVNLLDTPGHQDFSEDTYRVLTAVDSALMVIDAAKGVEA
          ||||||||||||||||||||||||||||||||||||||||||||||||||||||||||||
g134      IEKQRGISVASSVMQFDYKDHTVNLLDTPGHQDFSEDTYRVLTAVDSALMVIDAAKGVEA
                  70        80        90       100       110       120

                 130       140       150       160       170       180
m134.pep  QTIKLLNVCRLRDTPIVTFMNKYDREVRDSLELLDEVENILKIRCAPVTWPIGMGKNFKG
          ||||||||||||||||||||||||||||||||||||||:||:||||||||||||||||||
g134      QTIKLLNVCRLRDTPIVTFMNKYDREVRDSLELLDEVEDILQIRCAPVTWPIGMGKNFKG
                 130       140       150       160       170       180

                 190       200       210       220       230       240
m134.pep  VYHILNDEIYLFEAGGERLPHEFDIIKGIDNPELEQRFPLEIQQLRDEIELVQAASNEFN
          |||||||||||||||||||||||||||||:||||||||||||||||||||||||||||||
g134      VYHILNDEIYLFEAGGERLPHEFDIIKGINNPELEQRFPLEIQQLRDEIELVQAASNEFN
                 190       200       210       220       230       240

                 250       260       270       280       290       300
m134.pep  LDEFLAGELTPVFFGSAINNFGIQEILNSLIDWAPAPKPRDATVRMVEPDEPKFSGFIFK
          |||||||||||||||||||||||||||||||||||||||||||:||| ||||||||||||
g134      LDEFLAGELTPVFFGSAINNFGIQEILNSLIDWAPAPKPRDATMRMVGPDEPKFSGFIFK
                 250       260       270       280       290       300

                 310       320       330       340       350       360
m134.pep  IQANMDPKHRDRIAFLRVCSGKFERGMKMKHLRINREIAASSVVTFMSHDRELVEEAYAG
          |||||||||||||||||||||||||||||||||||||||||||||||||||||:||||||
g134      IQANMDPKHRDRIAFLRVCSGKFERGMKMKHLRINREIAASSVVTFMSHDRELAEEAYAG
                 310       320       330       340       350       360
```

-continued

```
                370        380        390        400        410        420
m134.pep  DIIGIPNHGNIQIGDSFSEGEQLAFTGIPFFAPELFRSVRIKNPLKIKQLQKGLQQLGEE
          ||||||||||||||||||||||||||||||||||||||||||||||||||||||||||||
g134      DIIGIPNHGNIQIGDSFSEGEQLAFTGIPFFAPELFRSVRIKNPLKIKQLQKGLQQLGEE
                370        380        390        400        410        420

                430        440        450        460        470        480
m134.pep  GAVQVFKPMSGADLILGAVGVLQFEVVTSRLANEYGVEAVFDSASIWSARWVSCDDKKKL
          ||||||||||||||||||||||||||||||||||||||||||||||||||||||||||||
g134      GAVQVFKPMSGADLILGAVGVLQFEVVTSRLANEYGVEAVFDSASIWSARWVSCDDKKKL
                430        440        450        460        470        480

                490        500        510        520        530
m134.pep  AEFEKANAGNLAIDAGGNLAYLAPNRVNLGLTQERWPDIVFHETREHSVKLX
          ||||||||||||||||||||||||||||||||||||||||||||||||||||
g134      AEFEKANAGNLAIDAGGNLAYLAPNRVNLGLTQERWPDIVFHETREHSVKLX
                490        500        510        520        530
```

The following partial DNA sequence was identified in *N. meningitidis* <SEQ ID 515>:

a134.seq

```
   1 ATGTCCCAAG AAATCCTCGA CCAAGTGCGC CGCCGCCGCA CGTTTGCCAT
  51 CATCTCCCAC CCTGACGCAG GTAAAACCAC GTTGACTGAA AAACTCTTGC
 101 TGTTTTCAGG TGCGATTCAA AGCGCGGGTA CGGTAAAAGG CAAGAAAACC
 151 GGCAAATTCG CCACCTCCGA CTGGATGGAC ATCGAGAAGC AGCGCGGCAT
 201 TTCCGTGGCA TCAAGCGTGA TGCAGTTCGA CTATAAAGAC CACACCGTCA
 251 ACCTTTTGGA CACGCCGGGA CACCAAGACT TCTCCGAAGA CACCTACCGC
 301 GTTTTGACCG CCGTCGATAG TGCCTTGATG GTCATCGACG CGGCAAAAGG
 351 CGTGGAAGCG CAAACCATCA AACTCTTGAA CGTCTGCCGC CTGCGCAATA
 401 CGCCGATTGT TACGTTCATG AACAAATACG ACCGCGAAGT GCGCGATTCC
 451 CTGGAATTGC TGGACGAAGT GGAAAACATC CTGCAAATCC GCTGCGCGCC
 501 CGTAACCTGG CCGATCGGCA TGGGCAAAAA CTTCAAAGGC GTGTACCACA
 551 TCCTGAACGA CGAAATCTAT CTCTTTGAAG CGGGCGGCGA ACGCTTGCCG
 601 CACGAGTTCG ACATCATCAA AGGCATCGAT AATCCCGAAT TGGAACAACG
 651 CTTTCCGTTA GAAATACAGC AGTTGCGCGA CGAAATCGAA TTGGTGCAGG
 701 CGGCTTCCAA CGAGTTCAAT CTCGACGAAT TCCTCGCCGG CGAACTCACG
 751 CCCGTATTCT TCGGCTCTGC GATTAACAAC TTCGGTATTC AGGAAATCCT
 801 CAATTCATTG ATTGAATGGG CGCCCGCGCC GAAACCACGC GATGCGACCG
 851 TGCGTATGGT CGAGCCGGAC GAGCCGAAGT TTTCCGGATT TATCTTCAAA
 901 ATCCAAGCCA ATATGGACCC GAAACACCGC GACCGTATTG CCTTCTTGCG
 951 CGTCTGCTCC GGCAAATTCG AGCGCGGCAT GAAAATGAAA CACCTGCGTA
1001 TCAACCGCGA AATCGCCGCC TCCAGCGTGG TAACCTTCAT GTCCCACGAC
1051 CGCGAGCTGG TTGAAGAAGC CTACGCCGGC GACATTATCG GTATCCCAAA
1101 CCACGGCAAC ATCCAAATCG GCGACAGCTT CTCCGAAGGC GAACAACTGA
1151 CGTTTACCGG CATCCCATTC TTCGCGCCCG AACTGTTCCG CAGCGTTCGC
1201 ATCAAAAACC CGCTGAAAAT CAAGCAACTG CAAAAAGGTT TGCAACAGCT
1251 TGGCGAAGAA GGTGCGGTGC AGGTGTTCAA ACCAATGAGC GGCGCGGATT
1301 TGATTTTGGG CGCGGTCGGC GTGTTGCAGT TTGAAGTCGT TACCTCGCGC
1351 CTTGCCAACG AATACGGCGT GGAAGCCGTG TTCGACAACG CATCCATCTG
```

-continued

```
1401 GTCGGCGCGC TGGGTATCGT GCGACGACAA GAAAAAACTG GCGGAATTTG

1451 AAAAAGCCAA CGCGGGCAAC CTCGCCATCG ACGCGGGCGG CAACCTCGCC

1501 TACCTCGCCC CTAACCGCGT GAATCTGGGA CTCACGCAAG AACGCTGGCC

1551 GGACATCGTG TTCCACGAAA CGCGCGAGCA TTCGGTCAAA CTTTAA
```

This corresponds to the amino acid sequence <SEQ ID 516; ORF 134.a>:

```
a134.pep

  1 MSQEILDQVR RRRTFAIISH PDAGKTTLTE KLLLFSGAIQ SAGTVKGKKT

 51 GKFATSDWMD IEKQRGISVA SSVMQFDYKD HTVNLLDTPG HQDFSEDTYR

101 VLTAVDSALM VIDAAKGVEA QTIKLLNVCR LRNTPIVTFM NKYDREVRDS

151 LELLDEVENI LQIRCAPVTW PIGMGKNFKG VYHILNDEIY LFEAGGERLP

201 HEFDIIKGID NPELEQRFPL EIQQLRDEIE LVQAASNEFN LDEFLAGELT

251 PVFFGSAINN FGIQEILNSL IEWAPAPKPR DATVRMVEPD EPKFSGFIFK

301 IQANMDPKHR DRIAFLRVCS GKFERGMKMK HLRINREIAA SSVVTFMSHD

351 RELVEEAYAG DIIGIPNHGN IQIGDSFSEG EQLTFTGIPF FAPELFRSVR

401 IKNPLKIKQL QKGLQQLGEE GAVQVFKPMS GADLILGAVG VLQFEVVTSR

451 LANEYGVEAV FDNASIWSAR WVSCDDKKKL AEFEKANAGN LAIDAGGNLA

501 YLAPNRVNLG LTQERWPDIV FHETREHSVK L*
```

m134/a134 98.9% identity in 531 aa overlap

```
                   10        20        30        40        50        60
m134.pep   MSQEILDQVRRRRTFAIISHPDAGKTTLTEKLLLFSGAIQSAGTVKGKKTGKFATSDWME
           |||||||||||||||||||||||||||||||||||||||||||||||||||||||||||:
a134       MSQEILDQVRRRRTFAIISHPDAGKTTLTEKLLLFSGAIQSAGTVKGKKTGKFATSDWMD
                   10        20        30        40        50        60

                   70        80        90       100       110       120
m134.pep   IEKQRGISVASSVMQFDYKDHTVNLLDTPGHQDFSEDTYRVLTAVDSALMVIDAAKGVEA
           ||||||||||||||||||||||||||||||||||||||||||||||||||||||||||||
a134       IEKQRGISVASSVMQFDYKDHTVNLLDTPGHQDFSEDTYRVLTAVDSALMVIDAAKGVEA
                   70        80        90       100       110       120

                  130       140       150       160       170       180
m134.pep   QTIKLLNVCRLRDTPIVTFMNKYDREVRDSLELLDEVENILKIRCAPVTWPIGMGKNFKG
           ||||||||||||:|||||||||||||||||||||||||||||:|||||||||||||||||
a134       QTIKLLNVCRLRNTPIVTFMNKYDREVRDSLELLDEVENILQIRCAPVTWPIGMGKNFKG
                  130       140       150       160       170       180

                  190       200       210       220       230       240
m134.pep   VYHILNDEIYLFEAGGERLPHEFDIIKGIDNPELEQRFPLEIQQLRDEIELVQAASNEFN
           ||||||||||||||||||||||||||||||||||||||||||||||||||||||||||||
a134       VYHILNDEIYLFEAGGERLPHEFDIIKGIDNPELEQRFPLEIQQLRDEIELVQAASNEFN
                  190       200       210       220       230       240

                  250       260       270       280       290       300
m134.pep   LDEFLAGELTPVFFGSAINNFGIQEILNSLIDWAPAPKPRDATVRMVEPDEPKFSGFIFK
           |||||||||||||||||||||||||||||||:||||||||||||||||||||||||||||
a134       LDEFLAGELTPVFFGSAINNFGIQEILNSLIEWAPAPKPRDATVRMVEPDEPKFSGFIFK
                  250       260       270       280       290       300

                  310       320       330       340       350       360
m134.pep   IQANMDPKHRDRIAFLRVCSGKFERGMKMKHLRINREIAASSVVTFMSHDRELVEEAYAG
           ||||||||||||||||||||||||||||||||||||||||||||||||||||||||||||
a134       IQANMDPKHRDRIAFLRVCSGKFERGMKMKHLRINREIAASSVVTFMSHDRELVEEAYAG
                  310       320       330       340       350       360

                  370       380       390       400       410       420
m134.pep   DIIGIPNHGNIQIGDSFSEGEQLAFTGIPFFAPELFRSVRIKNPLKIKQLQKGLQQLGEE
           |||||||||||||||||||||||:||||||||||||||||||||||||||||||||||||
a134       DIIGIPNHGNIQIGDSFSEGEQLTFTGIPFFAPELFRSVRIKNPLKIKQLQKGLQQLGEE
                  370       380       390       400       410       420
```

-continued

```
                430       440       450       460       470       480
m134.pep  GAVQVFKPMSGADLILGAVGVLQFEVVTSRLANEYGVEAVFDSASIWSARWVSCDDKKKL
          ||||||||||||||||||||||||||||||||||||||||||:|||||||||||||||||
a134      GAVQVFKPMSGADLILGAVGVLQFEVVTSRLANEYGVEAVFDNASIWSARWVSCDDKKKL
                430       440       450       460       470       480

                490       500       510       520       530
m134.pep  AEFEKANAGNLAIDAGGNLAYLAPNRVNLGLTQERWPDIVFHETREHSVKLX
          |||||||||||||||||||||||||||||||||||||||||||||||||||
a134      AEFEKANAGNLAIDAGGNLAYLAPNRVNLGLTQERWPDIVFHETREHSVKLX
                490       500       510       520       530
```

The following partial DNA sequence was identified in *N. gonorrhoeae* <SEQ ID 517>:

g135.seq

```
  1 ATGAAATACA AAAGAATCGT ATTTAAAGTC GGCACATCTT CGATTACCCG
 51 TTCGGAcgGC AGCCTCTCGC GCGGCAAAAT CCAAACCATC ACCCGCCAGC
101 TTGCCGCATT GCATCATGCG GGACACGAGC TGGTCTTGGT GTCTTCCGGC
151 GCGGTTGCTG CAGGGTTCGG CGCGCTGGGT TTCAAAAAAC GTCCGGTCAA
201 AATCGCCGAC AAACAGGCTT CCGCCGCCGT CGGGCAGGGG CTGCTGATGG
251 AAGAATATAC GGCAAACCTG TCTTCAGACG GCATCGTGTC CGCACAAATC
301 CTGCTCAGCC GTGCCGACTT TGCCGACAAA CGCCGCTACC AAAATGCCGG
351 CGGCGCACTT TCCGTGCTGC TGCAACGCCG CGCGATTCCC ATCATCAATG
401 AAAACGACAC GGTTTCGGTT GAGGAGTTGA AAATCGGCGA CAACGACACA
451 TTGAGTGCGC AAGTGGCGGC GATGATACAG GCAGACCTCT TGGTGCTGCT
501 GACCGACATA GACGGTCTTT ACACCGGCAA CCCGAACAGC AATCCCGATG
551 CCGTACGGCT GGACAAAATC GAACACATCA ACCATGAAAT CATCGAAATG
601 GCGGGCGGCT CGGGTTCGGC AAACGGCACG GGCGGTATGC TGACCAAAAT
651 CAAAGCGGCA ACCATCGCCG CCGAATCCGG CGTACCGGTG TATATCTGTT
701 CCTCACTCAA ACCCGATTCA TTGGCCGAAG CCGCCGAACA TCAGGCGGAC
751 GGCTCGTTTT TCGTcccCcg tgCCAAAGGT TTGCGGACAC AGAAGCAATG
801 GctggCGTTC TATTCcgaaa gcggGGgcag cgttTAtgtg gacgaaagtg
851 cggaacacgc tTtgtccgaa caagggaaag cctgCTGA
```

This corresponds to the amino acid sequence <SEQ ID 518; ORF 135.ng>:

g135.pep

```
  1 MKYKRIVFKV GTSSITRSDG SLSRGKIQTI TRQLAALHHA GHELVLVSSG
 51 AVAAGFGALG FKKRPVKIAD KQASAAVGQG LLMEEYTANL SSDGIVSAQI
101 LLSRADFADK RRYQNAGGAL SVLLQRRAIP IINENDTVSV EELKIGDNDT
151 LSAQVAAMIQ ADLLVLLTDI DGLYTGNPNS NPDAVRLDKI EHINHEIIEM
201 AGGSGSANGT GGMLTKIKAA TIAAESGVPV YICSSLKPDS LAEAAEHQAD
251 GSFFVPRAKG LRTQKQWLAF YSESGGSVYV DESAEHALSE QGKAC*
```

The following partial DNA sequence was identified in *N. meningitidis* <SEQ ID 519>:

m135.seq

```
   1 ATGAAATACA AAAGAATCGT ATTTAAAGTC GGCACATCTT CGATTACCCA
  51 TTCGGACGGC AGTCTCTCGC GCGGCAAAAT CCAAACCATC ACCTGCCAGC
 101 TTGCCGCATT GCATCATGCG GGACACGAGC TGGTCTTGGT GTCTTCCGGC
 151 GCGGTTGCGG CAGGGTTCGG TGCGCTGGGT TTCAAAAAAC GTCCGGTCAA
 201 AATCGCCGAC AAACAGGCTT CCGCCGCCGT CGGGCAGGGG CTGCTGATGG
 251 AAGAATATAC GGCAAACCTG TCTTCAGACG GCATCGTGTC CGCGCAAATC
 301 CTGCTCAGCC GCGCCGACTT TGCCGACAAA CGCCGCTACC AAAATGCCGG
 351 CGGCGCACTT TCCGTGCTGC TGCAACGCCG CGCCGTCCCC ATCATCAATG
 401 AAAACGATAC GGTTTCGGTT GAGGAATTGA AAATCGGCGA CAACGACACA
 451 TTGAGTGCGC AAGTGGCGGC GATGATACAG GCAGACCTCT TGGTGCTGCT
 501 GACCGACATA GACGGTCTTT ACACGGGCAA CCCGAACAGC AATCCCGATG
 551 CCGTACGGCT GGACAAAATC GAACACATCA ACCATGAAAT CATCGAAATG
 601 GCGGGCGGCT CGGGTTCGGC AAACGGCACG GGCGGTATGC TGACCAAAAT
 651 CAAAGCGGCA ACCATCGCCG CCGAATCCGG CGTACCGGTG TATATCTGTT
 701 CCTCGCTCAA ACCCGATGCA CTTGCCGAAG CTGCCGAACA TCAGGCGGAC
 751 GGCTCGTTTT TCGTCCCCCG TGCCAAAGGT TTGCGGACGC AGAAGCAATG
 801 GCTGGCGTTC TATTCCGAAA GCCGGGGCAG CGTTTATGTG GACGAAGGTG
 851 CGGAACACGC TTTGTCCGAA CAGGGGAAAA GCCTGCTGAT GTCGGGCATT
 901 GCCGGAATCG AAGGGCATTT TTCCCGTATG GACACCGTAA CCGTGTACAG
 951 CAAGGCAACC AAACAGCCCC TGGGCAAAGG GCGCGTCCTG TTCGGCTCTG
1001 CCGCCGCCGA AGACCTGCTC AAATCGCGTA AGGCGAAAGG CGTGTTCATC
1051 CATCGGGACG ACTGGATTTC CATCACGCCC GAAATACGCC TGCTTCTGAC
1101 CGAATTTTAG
```

This corresponds to the amino acid sequence <SEQ ID 520; ORF 135>:

m135.pep

```
  1 MKYKRIVFKV GTSSITHSDG SLSRGKIQTI TCQLAALHHA GHELVLVSSG
 51 AVAAGFGALG FKKRPVKIAD KQASAAVGQG LLMEEYTANL SSDGIVSAQI
101 LLSRADFADK RRYQNAGGAL SVLLQRRAVP IINENDTVSV EELKIGDNDT
151 LSAQVAAMIQ ADLLVLLTDI DGLYTGNPNS NPDAVRLDKI ENINHEIIEM
201 AGGSGSANGT GGMLTKIKAA TIAAESGVPV YICSSLKPDA LAEAAEEQAD
251 GSFFVPRAKG LRTQKQWLAF YSESRGSVYV DEGAEHALSE QGKSLLMSGI
301 AGIEGHFSRM DTVTVYSKAT KQPLGKGRVL FGSAAAEDLL KSRKAKGVFI
351 HRDDWISITP EIRLLLTEF*
```

Computer analysis of this amino acid sequence gave the following results:

Homology with a predicted ORF from *N. gonorrhoeae*

ORF 135 shows 97.6% identity over a 294 aa overlap with a predicted ORF (ORF 135.ng) from *N. gonorrhoeae*:

m135/g135

```
                    10         20         30         40         50         60
m135.pep    MKYKRIVFKVGTSSITHSDGSLSRGKIQTITCQLAALHHAGHELVLVSSGAVAAGFGALG
            ||||||||||||||||:|||||||||||||| ||||||||||||||||||||||||||||
g135        MKYKRIVFKVGTSSITRSDGSLSRGKIQTITRQLAALHHAGHELVLVSSGAVAAGFGALG
                    10         20         30         40         50         60

                    70         80         90        100        110        120
m135.pep    FKKRRVKIADKQASAAVGQGLLMEEYTANLSSDGIVSAQILLSRADFADKRRYQNAGGAL
            ||||||||||||||||||||||||||||||||||||||||||||||||||||||||||||
g135        FKKRPVKIADKQASAAVGQGLLMEEYTANLSSDGIVSAQILLSRADFADKRRYQNAGGAL
                    70         80         90        100        110        120

                   130        140        150        160        170        180
m135.pep    SVLLQRRAVPIINENDTVSVEELKIGDNDTLSAQVAAMIQADLLVLLTDIDGLYTGNPNS
            ||||||||:|||||||||||||||||||||||||||||||||||||||||||||||||||
g135        SVLLQRRAIPIINENDTVSVEELKIGDNDTLSAQVAAMIQADLLVLLTDIDGLYTGNPNS
                   130        140        150        160        170        180

                   190        200        210        220        230        240
m135.pep    NPDAVRLDKIEHINHEIIEMAGGSGSANGTGGMLTKIKAATIAAESGVPVYICSSLKPDA
            |||||||||||||||||||||||||||||||||||||||||||||||||||||||||||:
g135        NPDAVRLDKIEHINHEIIEMAGGSGSANGTGGMLTKIKAATIAAESGVPVYICSSLKPDS
                   190        200        210        220        230        240

                   250        260        270        280        290        300
m135.pep    LAEAAEHQADGSFFVPRAKGLRTQKQWLAFYSESRGSVYVDEGAEHALSEQGKSLIMSGI
            |||||||||||||||||||||||||||||||||| |||||||:||||||||||:
g135        LAEAAEHQADGSFFVPRAKGLRTQKQWLAFYSESGGSVYVDESAEHALSEQGKACX
                   250        260        270        280        290

                   310        320        330        340        350        360
m135.pep    AGIEGHFSRMDTVTVYSKATKQPLGKGRVLFGSAAAEDLLKSRKAKGVFIHRDDWISITP
```

The following partial DNA sequence was identified in *N. meningitidis* <SEQ ID 521>:

a135.seq

```
   1 ATGAAATACA AAAGAATCGT ATTTAAAGTC GGCACATCTT CGATTACCCA
  51 TTCGGACGGC AGTCTCTCGC GCGGCAAAAT CCAAACCATC ACCCGCCAGC
 101 TTGCCGCATT GCATCATGCG GGACACGAGC TGGTCTTGGT GTCTTCCGGC
 151 GCGGTTGCGG CAGGGTTCGG TGCGCTGGGT TTCAAAAAAC GTCCGGTCAA
 201 AATCGCCGAC AAACAGGCTT CCGCCGCCGT CGGGCAGGGG CTGCTGATGG
 251 AAGAATATAC GGCAAACCTG TCTTCAGACG GCATCGTGTC CGCACAAATC
 301 CTGCTCAGCC GCGCCGACTT TGCCGACAAA CGCCGCTACC AAAATGCCGG
 351 CGGCGCACTT TCCGTGCTGC TGCAACGCCG CGCCGTCCCC ATCATCAATG
 401 AAAACGATAC GGTTTCGGTT GAGGAATTGA AAATCGGCGA CAACGACACA
 451 TTGAGTGCGC AAGTGGCGGC GATGATACAG GCAGACCTCT TGGTGCTGCT
 501 GACCGACATA GACGGTCTTT ACACCGGCAA CCCGAACAGC AATCCCGATG
 551 CCGTACGGCT GGACAAAATC GAACACATCA ACCATGAAAT CATCGAAATG
 601 GCGGGCGGCT CGGGTTCGGC AAACGGCACA GGCGGTATGC TGACTAAAAT
 651 CAAAGCGGCG ACGATTGCGA CCGAGTCCGG CGTACCGGTC TATATCTGTT
 701 CCTCGCTCAA ACCCGATGCA CTTGCCGAAG CGGCAGATAA TCAGGCGGAC
 751 GGCTCGTTTT TCGTCCCCCG TGCCAAAGGT TTGCGGACGC AGAAGCAATG
 801 GCTGGCGTTC TATTCCGAAA GCAGGGGCGG CGTTTATGTG GACGAAGGTG
 851 CGGAACACGC TTTGTCCGAA CAGGGAAAAA GCCTGCTGAT GTCGGGCATT
 901 GCCGGAATCG AAGGGCATTT TTCCCGTATG GACACCGTAA CCGTGTACAG
 951 CAAGGCAACC AAACAGCCTT TGGGCAAAGG GCGAGTCCTG TTCGGCTCTG
1001 CCGCCGCCGA AGACCTGCTC AAATTGCGTA AGGCGAAAGG CGTGTTCATC
```

-continued

```
1051 CATCGGGACG ACTGGATTTC CATCACGCCC GAAATACGCC TGCTTCTGAC

1101 CGAATTTTAG
```

This corresponds to the amino acid sequence <SEQ ID 522; ORF 135.a>:

a135.pep

```
  1 MKYKRIVFKV GTSSITHSDG SLSRGKIQTI TRQLAALHHA GHELVLVSSG

 51 AVAAGFGALG FKKRPVKIAD KQASAAVGQG LLMEEYTANL SSDGIVSAQI

101 LLSRADFADK RRYQNAGGAL SVLLQRRAVP IINENDTVSV EELKIGDNDT

151 LSAQVAAMIQ ADLLVLLTDI DGLYTGNPNS NPDAVRLDKI EHINHEIIEM

201 AGGSGSANGT GGMLTKIKAA TIATESGVPV YICSSLKPDA LAEAADNQAD

251 GSFFVPRAKG LRTQKQWLAF YSESRGGVYV DEGAEHALSE QGKSLLMSGI

301 AGIEGHFSRM DTVTVYSKAT KQPLGKGRVL FGSAAAEDLL KLRKAKGVFI

351 HRDDWISITP EIRLLLTEF*
```

m135/a135 98.4% identity in 369 aa overlap

```
                   10        20        30        40        50        60
m135.pep   MKYKRIVFKVGTSSITHSDGSLSRGKIQTITCQLAALHHAGHELVLVSSGAVAAGFGALG
           |||||||||||||||||||||||||||||| |||||||||||||||||||||||||||||
a135       MKYKRIVFKVGTSSITHSDGSLSRGKIQTITRQLAALHHAGHELVLVSSGAVAAGFGALG
                   10        20        30        40        50        60

                   70        80        90       100       110       120
m135.pep   FKKRRVKIADKQASAAVGQGLLMEEYTANLSSDGIVSAQILLSRADFADKRRYQNAGGAL
           ||||||||||||||||||||||||||||||||||||||||||||||||||||||||||||
a135       FKKRPVKIADKQASAAVGQGLLMEEYTANLSSDGIVSAQILLSRADFADKRRYQNAGGAL
                   70        80        90       100       110       120

                  130       140       150       160       170       180
m135.pep   SVLLQRRAVPIINENDTVSVEELKIGDNDTLSAQVAAMIQADLLVLLTDIDGLYTGNPNS
           ||||||||||||||||||||||||||||||||||||||||||||||||||||||||||||
a135       SVLLQRRAVPIINENDTVSVEELKIGDNDTLSAQVAAMIQADLLVLLTDIDGLYTGNPNS
                  130       140       150       160       170       180

                  190       200       210       220       230       240
m135.pep   NPDAVRLDKIEHINHEIIEMAGGSGSANGTGGMLTKIKAATIAAESGVPVYICSSLKPDA
           |||||||||||||||||||||||||||||||||||||||||||:||||||||||||||||
a135       NPDAVRLDKIEHINHEIIEMAGGSGSANGTGGMLTKIKAATIATESGVPVYICSSLKPDA
                  190       200       210       220       230       240

                  250       260       270       280       290       300
m135.pep   LAEAAEHQADGSFFVPRAKGLRTQKQWLAFYSESRGSVYVDEGAEHALSEQGKSLLMSGI
           |||||::|||||||||||||||||||||||||||||:|||||||||||||||||||||||
a135       LAEAADNQADGSFFVPRAKGLRTQKQWLAFYSESRGGVYVDEGAEHALSEQGKSLLMSGI
                  250       260       270       280       290       300

                  310       320       330       340       350       360
m135.pep   AGIEGHFSRMDTVTVYSKATKQPLGKGRVLFGSAAAEDLLKSRKAKGVFIHRDDWISITP
           ||||||||||||||||||||||||||||||||||||||||| ||||||||||||||||||
a135       AGIEGHFSRMDTVTVYSKATKQPLGKGRVLFGSAAAEDLLKLRKAKGVFIHRDDWISITP
                  310       320       330       340       350       360

                  370
m135.pep   EIRLLLTEFX
           ||||||||||
a135       EIRLLLTEFX
                  370
```

The following partial DNA sequence was identified in *N. gonorrhoeae* <SEQ ID 523>:

g136.seq

```
  1 ATGGAAATCC GGTTTCAGAC AGCATTTTTA CGTTTGGTTC AGatgaAAAC
```

-continued

```
 51 AAACGCTtca aTTCTtaccg caACACGCCT TGTATTTCCT GccgCTGCCG
101 CACGGACAGG GATCGTTCCT GCCGgtTTTT TCCCCTTCCC TGCGGACGGT
151 TTGCGGTTTG TTGATGACCG CCTGCCAGTA GCGGTAGATG TCtgccagcg
201 cgTAAGGCag tTCGGAcgca agttccgcca gctcgccttc ggTGAATTGC
251 AGgcggataa cgccgtttTC CTCTTCGTCg taaatgccgc ccactgccat
301 cacgGGGTAA AACAGCTCTT CAAACGCTTC ATCATCGGCG GCTTCAAACC
351 AATCGGTCGG CACAATGTCC AAACCGTAAA GATAGGCGTT GCACCAAGTG
401 TAAAAATCGC TGCCGCCCTC GCCGTCGTCG TAGAGCCACA AATCGGGCAG
451 CTTTTTATCC GACATCGCGG CGGTTGTTTC CATCGCCATT GCCAAAACCA
501 GCCGTTCGAT TTCGGAACGT TCGGCGGCGG TAAATTGCGA TTCGTCGCCC
551 AACACTTCGG GCAGCCAGTC GAGCGGTGCC AATTTGTCCG GCCCGCTCAA
601 CAGCGCCGTC ATAAAACCTT GAACCTCGTC GCAACGCATC GTGTTGCCTT
651 GTTCGCTTTT GGCATCCAAT AA
```

This corresponds to the amino acid sequence <SEQ ID 524; ORF 136.ng>:

g136.pep

```
  1 MEIRFQTAFL RLVQMKTNAS ILTATRLVFP AAAARTGIVP AGFFPFPADG
 51 LRFVDDRLPV AVDVCQRVRQ FGRKFRQLAF GELQADNAVF LFVVNAAHCH
101 HGVKQLFKRF IIGGFKPIGR HNVQTVKIGV APSVKIAAAL AVVVEPQIGQ
151 LFIRHRGGCF HRHCQNQPFD FGTFGGGKLR FVAQHFGQPV ERCQFVRPAQ
201 QRRHKTLNLV ATHRVALFAF GIQ*
```

The following partial DNA sequence was identified in *N. meningitidis* <SEQ ID 525>:

m136.seq

```
  1 ATGGAAACAA ACGCTTCAAT TCTTACCGCA ACACGCCTTG TATTTTCTGC
 51 CGCTGCCGCA CGGACAGGGA TCGTTCCTGC CTGTTTTTTC GCCTTCCCTG
101 CGGACGGTTT GCGGTTTGTT GATGACTGCC TGCCAGTAGC GGTAGATATC
151 CGCCAATGCA TAAGGCAACT CGGATTCCAG TTCCGCCAGC TCGCCTTCTG
201 TGAATTGCAG ACGGATAGCG CCGTTTTCCT CTTCGTCGTA AATACCGCCC
251 AATGCCATGA TGGGATAAAA CAACTCTTCA AACGCTTCAT CATCGACGGC
301 TTCAAACCAA TCGGTCGGCA CAATATCCAA ACCGTAAAGA TAAGCATTGC
351 ACCATGTGTA AAAATCGCTG CCGCCGTCTT CGTTTTCATA CAGCCACAAA
401 TCGGGCAGTT TTTTATCCGA CATCGCGGCG GTTGTTTCCA TCGCCATTGC
451 CAAAACCAGC CGTTCGATTT CGGAACGTTC GGCGGCGGTA AATTGCGATT
501 CGTCGCCCAA CACTTCGGGC AGCCAGTCGA GCGGTGTCAA TTTGTCCGGC
551 CCGCTCAACA GCGCCGTCAT AAAACCTTGA ACCTCGTCGC AACGCATCGT
601 GTTGCCTTGT TCGCTTTTGG CATCCAACAA TTCGCTCAAC CGCCGTTTGG
```

-continued

```
651 ATGCTTCGGT AAATTTTCGG GAATCCATCA TTTTCCTTTT CAAATGGGTT

701 TTGCGCCCTA TTATCGCCGC AATGCCGTCT GA
```

This corresponds to the amino acid sequence <SEQ ID 526; ORF 136>:

m136.pep

```
  1 METNASILTA TRLVFSAAAA RTGIVPACFF AFPADGLRFV DDCLPVAVDI

 51 RQCIRQLGFQ FRQLAFCELQ TDSAVFLFVV NTAQCHDGIK QLFKRFIIDG

101 FKPIGRHNIQ TVKISIAPCV KIAAAVFVFI QPQIGQFFIR HRGGCFHRHC

151 QNQPFDFGTF GGGKLRFVAQ HFGQPVERCQ FVRPAQQRRH KTLNLVATHR

201 VALFAFGIQQ FAQPPFGCFG KFSGIHHFPF QMGFAPYYRR NAV*
```

Computer analysis of this amino acid sequence gave the following results:

Homology with a predicted ORF from *N. gonorrhoeae*

ORF 136 shows 85.6% identity over a 209 aa overlap with a predicted ORF (ORF 136.ng) from *N. gonorrhoeae*:

m136/g136

```
                                    10        20        30        40
m136.pep                 METNASILTATRLVFSAAAARTGIVPACFFAFPADGLRFVDDCLPV
                         |:||||||||||||| ||||||||||| || ||||||||||| |||
g136           MEIRFQTAFLRLVQMKTNASILTATRLVFPAAAARTGIVPAGFFPFPADGLRFVDDRLPV
                       10        20        30        40        50        60

                 50        60        70        80        90       100
m136.pep       AVDIRQCIRQLGFQFRQLAFCELQTDSAVFLFVVNTAQCHDGIKQLFKRFIIDGFKPIGR
               |||: | :||:| :|||||| |||:|:||||||||:|:|| |:||||||||| |||||||
g136           AVDVCQRVRQFGRKFRQLAFGELQADNAVFLFVVNAAHCHHGVKQLFKRFIIGGFKPIGR
                       70        80        90       100       110       120

                110       120       130       140       150       160
m136.pep       HNIQTVKISIAPCVKIAAAVFVFIQPQIGQFFIRHRGGCFHRHCQNQPFDFGTFGGGKLR
               ||:|||||::|| ||||||: | ::|||||:|||||||||||||||||||||||||||||
g136           HNVQTVKIGVAPSVKIAAALAVVVEPQIGQLFIRHRGGCFHRHCQNQPFDFGTFGGGKLR
                      130       140       150       160       170       180

                170       180       190       200       210       220
m136.pep       FVAQHFGQPVERCQFVRPAQQRRHKTLNLVATHRVALFAFGIQQFAQPPFGCFGKFSGIH
               |||||||||||||||||||||||||||||||||||||||||||
g136           FVAQHFGQPVERCQFVRPAQQRRHKTLNLVATHRVALFAFGIQX
                      190       200       210       220

                230       240
m136.pep       HFPFQMGFAPYYRRNAVX
```

The following partial DNA sequence was identified in *N. meningitidis* <SEQ ID 527>:

a136.seq

```
  1 ATGGAAACAA ACGCTTCAAT TCTTACCGCA ACACGCCTTG TATTTTCTGC

 51 CGCTGCCGCA CGGACAGGGA TCGTTCCTGC CTGTTTTTTC GCCTTCCCTG

101 CGGACGGTTT GCGGCTTGTT GATGACCGCC TGCCAGTAGC GGTAGATATC

151 CGCCAATGCA TAAGGCAACT CGGATTCCAG TTCCGCCAGC TCGCCTTCTG

201 TGAATTGCAG ACGGATAGTG CCGTTGTCCT CTTCGTCGTA AATACCGCCC

251 AATGCCATGA TGGGATAAAA CAACTCTTCA AACGCTTCAT CATCGACGGC
```

-continued

```
301 TTCAAACCAA TCGGTCGGCA CAATATCCAA ACCGTAAAGA TAAGCATTGC

351 ACCATGTGTA AAAATCGCTG CCGCCGTCTT CGTTTTCATA CAGCCACAAA

401 TCGGGCAGTT TTTTATCCGA CATCGCGGCG GTTGTTTCCA TCGCCATTGC

451 CAAAACCAGC CGTTCGATTT CGGAACGTTC GGCGGCGGTA AATTGCGATT

501 CGTCGCCCAA CACTTCGGGC AGCCAGTCGA GCGGTGTCAA TTTGTCCGGC

551 CCGCTCAACA GCGCCGTCAT AAAACCTTGA ACCTCGTCGC AACGCATCGT

601 GTTGCCTTGT TCGCTTTTGG CATCCAACAA TTCGCTCAAC CGCCGTTTGG

651 ATGCTTCGGT AAATTTTCGG GAATCCATCA TTTTCCTTTT CCAATGGGTT

701 TTGCGCCCTA TTATAGTGGA TTAAATTTAA ATCAGGACAA GGCGACGAAG

751 CCGCAGACAG TACAAATAGT ACGGCAAGGC GAGGCAACGC CGTACTGGTT

801 TAAATTTAAT CCACTATATC GCCGCAATGC CGTCTGA
```

This corresponds to the amino acid sequence <SEQ ID 528; ORF 136.a>:

a136.pep

```
  1 METNASILTA TRLVFSAAAA RTGIVPACFF AFPADGLRLV DDRLPVAVDI

 51 RQCIRQLGFQ FRQLAFCELQ TDSAVVLFVV NTAQCHDGIK QLFKRFIIDG

101 FKPIGRHNIQ TVKISIAPCV KIAAAVFVFI QPQIGQFFIR HRGGCFHRHC

151 QNQPFDFGTF GGGKLRFVAQ HFGQPVERCQ FVRPAQQRRH KTLNLVATHR

201 VALFAFGIQQ FAQPPFGCFG KFSGIHHFPF PMGFAPYYSG LNLNQDKATK

251 PQTVQIVRQG EATPYWFKFN PLYRRNAV*
```

m136/a136 98.3% identity in 238 aa overlap

```
                  10        20        30        40        50        60
m136.pep  METNASILTATRLVFSAAAARTGIVPACFFAFPADGLRFVDDCLPVAVDIRQCIRQLGFQ
          ||||||||||||||||||||||||||||||||||||||:||| |||||||||||||||||
a136      METNASILTATRLVFSAAAARTGIVPACFFAFPADGLRLVDDRLPVAVDIRQCIRQLGFQ
                  10        20        30        40        50        60

                  70        80        90       100       110       120
m136.pep  FRQLAFCELQTDSAVFLFVVNTAQCHDGIKQLFKRFIIDGFKPIGRHNIQTVKISIAPCV
          ||||||||||||||| ||||||||||||||||||||||||||||||||||||||||||||
a136      FRQLAFCELQTDSAVVLFVVNTAQCHDGIKQLFKRFIIDGFKPIGRHNIQTVKISIAPCV
                  70        80        90       100       110       120

                 130       140       150       160       170       180
m136.pep  KIAAAVFVFIQPQIGQFFIRHRGGCFHRHCQNQPFDFGTFGGGKLRFVAQHFGQPVERCQ
          ||||||||||||||||||||||||||||||||||||||||||||||||||||||||||||
a136      KIAAAVFVFIQPQIGQFFIRHRGGCFHRHCQNQPFDFGTFGGGKLRFVAQHFGQPVERCQ
                 130       140       150       160       170       180
                 190       200       210       220       230       240
m136.pep  FVRPAQQRRHKTLNLVATHRVALFAFGIQQFAQPPFGCFGKFSGIHHFPFQMGFAPYYRR
          |||||||||||||||||||||||||||||||||||||||||||||||||| |||||||
a136      FVRPAQQRRHKTLNLVATHRVALFAFGIQQFAQPPFGCFGKFSGIHHFPFPMGFAPYYSG
                 190       200       210       220       230       240

m136.pep  NAVX

a136      LNLNQDKATKPQTVQIVRQGEATPYWFKFNPLYRRNAVX
                 250       260       270
```

The following partial DNA sequence was identified in *N. gonorrhoeae* <SEQ ID 529>:

g137.seq

```
  1 ATGATTATCC ATCACcaaTT CGATCCCGTC CTCATCAGTA TCGGCCCGCT
 51 TGCCGTCCGC TGGTATGCCT TAAGCTACAT CCTCGGATTT ATTCTTTTTA
101 CCTTTCTCGG CAGAAGGCGC ATCGCGCAAG GCTTGTCCGT TTTTACCAAA
151 GAATCGCTCG ACGACTTCCT GACATGGGGC ATTTTGGGCG TGATTTTGGG
201 CGGACGCTTG GGCTATGTCC TGTTTTACAA ATTCTCCGAC TACCTCGCCC
251 ATCCGCTTGA TATTTTCAAG GTATGGGAAG GCGGAATGTC GTTCCACGGC
301 GGCTTTTTGG GTGTAGTTAT TGCCATATGG TTGTTCAGCC GCAAGCACGG
351 CATCGGCTTC CTCAAACTGA TGGACACGGT CGCGCCGCTC GTTCCGCTGG
401 GTCTCGCTTC GGGACGTATC GGCAACTTTA TCAACGGCGA ACTTTGGGGA
451 CGCATTACCG ACATTAACGC ATTTTGGGCA ATGGGCTTCC CGCAAGCGCA
501 TTACGAAGAT GCCGAAGCCG CCGCGCACAA TCCGCTTTGG GCAGAATGGC
551 TGCAACAATA CGGTATGCTG CCGCGTCATC CCTCGCAGCT TTATCAGTTT
601 GCCCTTGAAG GCATCTGCCT GTTCGCCGTC GTTTGGCTGT TTTCCAAAAA
651 ACCGCGCCCG ACCGGGCAGA CTGCCGCGCT TTTTCTCGGC GGCTACGGCG
701 TGTTCCGCTT TATTGCCGAA TTTGCGCGCC AACCCGACGA CTATCTCGGG
751 CTGCTGACCT TGGGGCTGTC GATGGGGCAA TGGTTGAGCG TCCCGATGAT
801 TGTTTTGGGT ATCGTCGGCT TTGTCCGGTT CGGCATGAAA AAACAGCACT
851 GA
```

This corresponds to the amino acid sequence <SEQ ID 530; ORF 137.ng>:

g137.pep

```
  1 MIIHHQFDPV LISIGPLAVR WYALSYILGF ILFTFLGRRR IAQGLSVFTK
 51 ESLDDFLTWG ILGVILGGRL GYVLFYKFSD YLAHPLDIFK VWEGGMSFHG
101 GFLGVVIAIW LFSRKHGIGF LKLMDTVAPL VPLGLASGRI GNFINGELWG
151 RITDINAFWA MGFPQAHYED AEAAAHNPLW AEWLQQYGML PRHPSQLYQF
201 ALEGICLFAV VWLFSKKPRP TGQTAALFLG GYGVFRFIAE FARQPDDYLG
251 LLTLGLSMGQ WLSVPMIVLG IVGFVRFGMK KQH*
```

The following partial DNA sequence was identified in *N. meningitidis* <SEQ IL) 531>:

m137.seq

```
  1 ATGATTACCC ATCCCCAATT CGATCCCGTC CTTATCAGTA TCGGCCCGCT
 51 TGCCGTCCGC TGGTATGCCC TAAGCTACAT CCTCGGATTT ATTCTTTTTA
101 CCTTTCTCGG CAGAAGGCGC ATCGCGCAAG GCTTGTCCGT TTTTACCAAA
151 GAATCGCTCG ACGACTTCCT GACATGGGGC ATTTTGGGCG TAATTTTGGG
201 CGGGCGTTTG GGTTACGTCC TGTTTTACAA GTTTTCCGAC TACCTCGCCC
251 ATCCGCTTGA TATTTTCAAG GTATGGGAAG GCGGAATGTC GTTCCACGGC
301 GGCTTTTTGG GTGTAGTTAT TGCCATACGG TTGTTCGGCC GCAAACACGG
```

-continued

```
351 CATCGGCTTC CTCAAACTGA TGGATACGGT CGCACCGCTC GTTCCGCTGG

401 GTCTCGCTTC GGGACGTATC GGCAACTTCA TCAACGGCGA ACTTTGGGGA

451 CGCGTTACCG ACATCAACGC ATTTTGGGCA ATGGGCTTCC CGCAGGCGCG

501 TTACGAAGAT GCCGAAGCCG CCGCGCACAA TCCGCTTTGG GCAGAATGGC

551 TGCAACAATA CGGTATGCTG CCGCGTCATC CCTCGCAGCT TTATCAGTTT

601 GCACTTGAAG GCATCTGCCT GTTCACCGTC ATTTGGCTGT TCTCTAAAAA

651 ACAGCGGTCG ACCGGACAAG TCGCCTCGCT CTTCCTCGGC GGCTACGGCA

701 TATTCCGCTT CATTGCCGAA TTCGCACGCC AACCCGACGA CTATCTCGGG

751 CTGCTGACCT TGGGGCTGTC GATGGGGCAA TGGTTGAGCG TCCCGATGAT

801 TGTTTTGGGT ATCGTCGGCT TTGTCCGGTT CGGCATGAAA AAACAGCACT

851 GA
```

This corresponds to the amino acid sequence <SEQ ID 532; ORF 137>:

m137.pep

```
  1 MITHPQFDPV LISIGPLAVR WYALSYILGF ILFTFLGRRR IAQGLSVFTK

 51 ESLDDFLTWG ILGVILGGRL GYVLFYKFSD YLAHPLDIFK VWEGGMSFHG

101 GFLGVVIAIR LFGRKHGIGF LKLMDTVAPL VPLGLASGRI GNFINGELWG

151 RVTDINAFWA MGFPQARYED AEAAAHNPLW AEWLQQYGML PRHPSQLYQF

201 ALEGICLFTV IWLFSKKQRS TGQVASLFLG GYGIFRFIAE FARQPDDYLG

251 LLTLGLSMGQ WLSVPMIVLG IVGFVRFGMK KQN*
```

Computer analysis of this amino acid sequence gave the following results:

Homology with a predicted ORF from *N. gonorrhoeae*

ORF 137 shows 95.4% identity over a 283 aa overlap with a predicted ORF (ORF 137.ng) from *N. gonorrhoeae*:

m137/g137

```
                   10        20        30        40        50        60
m137.pep  MITHPQFDPVLISIGPLAVRWYALSYILGFILFTFLGRRRIAQGLSVFTKESLDDFLTWG
          || | |||||||||||||||||||||||||||||||||||||||||||||||||||||||
g137      MIIHHQFDPVLISIGPLAVRWYALSYILGFILFTFLGRRRIAQGLSVFTKESLDDFLTWG
                   10        20        30        40        50        60

                   70        80        90       100       110       120
m137.pep  ILGVILGGRLGYVLFYKFSDYLAHPLDIFKVWEGGMSFHGGFLGVVIAIRLFGRKHGIGF
          ||||||||||||||||||||||||||||||||||||||||||||||||| ||:|||||||
g137      ILGVILGGRLGYVLFYKFSDYLAHPLDIFKVWEGGMSFHGGFLGVVIAIWLFSRKHGIGF
                   70        80        90       100       110       120

                  130       140       150       160       170       180
m137.pep  LKLMDTVAPLVPLGLASGRIGNFINGELWGRVTDINAFWAMGFPQARYEDAEAAAHNPLW
          |||||||||||||||||||||||||||||||:||||||||||||||:|||||||||||||
g137      LKLMDTVAPLVPLGLASGRIGNFINGELWGRITDINAFWAMGFPQAHYEDAEAAAHNPLW
                  130       140       150       160       170       180

                  190       200       210       220       230       240
m137.pep  AEWLQQYGMLPRHPSQLYQFALEGICLFTVIWLFSKKQRSTGQVASLFLGGYGIFRFIAE
          ||||||||||||||||||||||||||||:|:|||||| | |||:|:|||||||:||||||
g137      AEWLQQYGMLPRHPSQLYQFALEGICLFAVVWLFSKKPRPTGQTAALFLGGYGVFRFIAE
                  190       200       210       220       230       240
```

-continued

```
              250        260        270        280
m137.pep  FARQPDDYLGLLTLGLSMGQWLSVPMIVLGIVGFVRFGMKKQHX
          ||||||||||||||||||||||||||||||||||||||||||||
g137      FARQPDDYLGLLTLGLSMGQWLSVPMIVLGIVGFVRFGMKKQHX
              250        260        270        280
```

The following partial DNA sequence was identified in *N. meningitidis* <SEQ ID 533>:

a137.seq

```
  1 ATGATTACCC ATCCCCAATT CGACCCCGTC CTTATCAGTA TCGGCCCGCT
 51 TGCCGTCCGC TGGTATGCCC TAAGCTACAT CCTCGGATTT ATTCTTTTTA
101 CCTTTCTCGG CAGAAGGCGC ATCGCGCAAG GCTTGTCCGT TTTTACCAAA
151 GAATCGCTCG ACGACTTCCT GACATGGGGC ATTTTGGGCG TAATTTTGGG
201 CGGGCGTTTG GGTTACGTCC TGTTTTACAA GTTTTCCGAC TACCTCGCCC
251 ATCCGCTTGA TATTTTCAAG GTATGGGAAG GCGGAATGTC GTTCCACGGC
301 GGCTTTTTGG GTGTAGTTAT TGCCATATGG TTGTTCGGTC GCAAACACGG
351 CATCGGCTTC CTCAAACTGA TGGACACGGT CGCACCGCTC GTTCCACTGG
401 GTCTCGCTTC GGGACGTATC GGCAACTTCA TCAACGGCGA ACTTTGGGGA
451 CGCGTTACCG ACATCAACGC ATTTTGGGCA ATGGGCTTCC CGCAGGCGCG
501 TTACGAAGAC CTCGAAGCCG CCGCGCACAA TCCGCTTTGG GCAGAATGGC
551 TGCAACAATA CGGTATGCTG CCGCGTCATC CCTCGCAGCT TTATCAGTTT
601 GCACTTGAAG GCATCTGCCT GTTCGCCGTC GTTTGGCTGT TCTCTAAAAA
651 ACAGCGGCCG ACCGGACAAG TCGCCTCACT CTTCCTCGGC GGCTACGGCA
701 TATTCCGCTT CATTGCCGAA TTTGCACGCC AACCCGACGA CTATCTCGGG
751 CTGCTGACCT TGGGGCTGTC GATGGGGCAA TGGTTGAGCG TCCCGATGAT
801 TGTTTTGGGT ATCGTCGGCT TTGTCCGGTT CGGCATGAAA AAACAGCACT
851 GA
```

This corresponds to the amino acid sequence <SEQ ID 534; ORF 137.a>:

a137.pep

```
  1 MITHPQFDPV LISIGPLAVR WYALSYILGF ILFTFLGRRR IAQGLSVFTK
 51 ESLDDFLTWG ILGVILGGRL GYVLFYKFSD YLAHPLDIFK VWEGGMSFHG
101 GFLGVVIAIW LFGRKHGIGF LKLMDTVAPL VPLGLASGRI GNFINGELWG
151 RVTDINAFWA MGFPQARYED LEAAAHNPLW AEWLQQYGML PRHPSQLYQF
201 ALEGICLFAV VWLFSKKQRP TGQVASLFLG GYGIFRFIAE FARQPDDYLG
251 LLTLGLSMGQ WLSVPMIVLG IVGFVRFGMK KQH*
```

m137/a137 98.2% identity in 283 aa overlap

```
                  10        20        30        40        50        60
m137.pep  MITHPQFDPVLISIGPLAVRWYALSYILGFILFTFLGRRRIAQGLSVFTKESLDDFLTWG
          ||||||||||||||||||||||||||||||||||||||||||||||||||||||||||||
a137      MITHPQFDPVLISIGPLAVRWYALSYILGFILFTFLGRRRIAQGLSVFTKESLDDFLTWG
                  10        20        30        40        50        60

                  70        80        90       100       110       120
m137.pep  ILGVILGGRLGYVLFYKFSDYLAHPLDIFKVWEGGMSFHGGFLGVVIAIRLFGRKHGIGF
          ||||||||||||||||||||||||||||||||||||||||||||||||| ||||||||||
a137      ILGVILGGRLGYVLFYKFSDYLAHPLDIFKVWEGGMSFHGGFLGVVIAIWLFGRKHGIGF
                  70        80        90       100       110       120

                 130       140       150       160       170       180
m137.pep  LKLMDTVAPLVPLGLASGRIGNFINGELWGRVTDINAFWAMGFPQARYEDAEAAAHNPLW
          |||||||||||||||||||||||||||||||||||||||||||||||||| |||||||||
a137      LKLMDTVAPLVPLGLASGRIGNFINGELWGRVTDINAFWAMGFPQARYEDLEAAAHNPLW
                 130       140       150       160       170       180

                 190       200       210       220       230       240
m137.pep  AEWLQQYGMLPRHPSQLYQFALEGICLFTVIWLFSKKQRSTGQVASLFLGGYGIFRFIAE
          ||||||||||||||||||||||||||||:|:|||||||| ||||||||||||||||||||
a137      AEWLQQYGMLPRHPSQLYQFALEGICLFAVVWLFSKKQRPTGQVASLFLGGYGIFRFIAE
                 190       200       210       220       230       240

                 250       260       270       280
m137.pep  FARQPDDYLGLLTLGLSMGQWLSVPMIVLGIVGFVRFGMKKQHX
          |||||||||||||||||||||||||||||||||||||||||||
a137      FARQPDDYLGLLTLGLSMGQWLSVPMIVLGIVGFVRFGMKKQHX
                 250       260       270       280
```

The following partial DNA sequence was identified in *N. gonorrhoeae* <SEQ ID 535>:

g138.seq

```
  1 ATGGAGTTTG AAAACATTAT TTCCGCCGCc gaCAAGGCGC GTATCCTTGC
 51 CGAAGCACTG CCTTACAtcc gccgGTTTTC CGGTTCGGTC GCCGTCATCA
101 AGTATGGCGG CAACGCGATG ACCGAACCTG CCTTGAAAGA AGGGTTTGCC
151 CGCGATGTCG TGCTGCTGAA GCTGGTCGGC ATTCATCCCG TCATCGTTCA
201 CGGCGGCGGG CCGCAGATCA ATGCGATGCT TGAAAAAGTC GGCAAAAAGG
251 GCGAATTTGT CCAAGGAATG CGCGTTACCG ACAAAGAGAC GATGGATATT
301 GTCGAAATGG TATTGGGCGG GCACGTCAAC AAGGAAATCG TGTCGATGAT
351 TAACACATAT GGAGGGCACG CGGTCGGCGT GAGCGGGCGC GACGACCATT
401 TCATTAAGGC GAAGAAACTT TTGGTCGATA CGCCCGAACA GAATAGCGTG
451 GACATCGGAC AGGTCGGTAC GGTGGAAAGC ATCGATACCG GTTTGGTTAA
501 AGGGCTGATA GAACGCGGCT GCATTCCCGT CGTCGCCCCC GTCGGCGTAG
551 GTGAAAAAGG CGAAGCGTTC AACATCAACG CCGATTTGGT GGCAGGCAAA
601 TTGGCGGAAG AATTGAACGC CGAAAAACTC TTGATGATGA CGAAtatcgc
651 cgGTGTGATG GACAAAACGG GCAATCTGCT GACCAAACTC acgCCGAAAC
701 GGATTGATGG GCTGATTGCC GACGGCACGC TGTATGGCGG TATGCTGCCG
751 AAAATCGCTT CTGCGGTCGA AGCcgccgtc aACGGTGTGA AAGCCACGCA
801 CATCATCGAC GGCAGGTTGC CCAACGCGCT TTTGCTGGAA ATCTTTACCG
851 ATGCCGGTAT CGGGTCGATG ATTTTAGGCA GAGGGGAAGA TGCCTGA
```

This corresponds to the amino acid sequence <SEQ ID 536; ORF 138.ng>:

g138.pep

```
  1 MEFENIISAA DKARILAEAL PYIRRFSGSV AVIKYGGNAM TEPALKEGFA
 51 RDVVLLKLVG IHPVIVHGGG PQINAMLEKV GKKGEFVQGM RVTDKETMDI
```

-continued

```
101 VEMVLGGHVN KEIVSMINTY GGHAVGVSGR DDHFIKAKKL LVDTPEQNSV

151 DIGQVGTVES IDTGLVKGLI ERGCIPVVAP VGVGEKGEAF NINADLVAGK

201 LAEELNAEKL LMMTNIAGVM DKTGNLLTKL TPKRIDGLIA DGTLYGGMLP

251 KIASAVEAAV NGVKATHIID GRLPNALLLE IFTDAGIGSM ILGRGEDA*
```

The following partial DNA sequence was identified in N meningitidis <SEQ ID 537>:

m138.seq

```
  1 ATGGAGTCTG AAAACATTAT TTCCGCCGCC GACAAGGCGC GTATCCTTGC

 51 CGAAGCGCTG CCTTACATCC GCCGGTTTTC CGGTTCGGTC GCCGTCATCA

101 AATACGGCGG CAACGCGATG ACCGAACCTG CCTTGAAAGA AGGGTTTGCC

151 CGCGATGTCG TGCTGCTGAA GCTGGTCGGC ATTCATCCCG TCATCGTTCA

201 CGGCGGCGGG CCGCAGATCA ATGCGATGCT TGAAAAAGTC GGCAAAAAGG

251 GTGAGTTTGT CCAAGGAATG CGCGTTACCG ACAAAGAGGC GATGGATATT

301 GTCGAAATGG TGTTGGGCGG GCATGTCAAT AAAGAAATCG TGTCGATGAT

351 TAACACATAT GGCGGACACG CGGTCGGCGT AAGCGGACGC GACGACCATT

401 TCATTAAGGC GAAGAAACTT TTGATCGATA CGCCCGAACA GAATGGCGTG

451 GACATCGGAC AGGTCGGTAC GGTGGAAAGC ATCGATACCG GTTTGGTTAA

501 AGGGCTGATA GAACGTGGCT GCATTCCCGT CGTCGCCCCC GTCGGCGTAG

551 GTGAAAAAGG CGAAGCGTTC AACATCAACG CCGATTTGGT AGCAGGCAAA

601 TTGGCGGAAG AATTGAACGC CGAAAAACTC TTGATGATGA CGAATATCGC

651 CGGTGTGATG GACAAAACGG GCAATCTGCT GACCAAACTC ACGCCGAAAC

701 GGATTGATGA ACTGATTGCC GACGGCACGC TGTATGGCGG TATGCTGCCG

751 AAAATCGCTT CTGCGGTCGA AGCCGCCGTC AACGGTGTGA AAGCCACGCA

801 TATCATCGAC GGCAGGTTGC CCAACGCGCT TTTGCTGGAA ATCTTTACCG

851 ATGCCGGTAT CGGTTCGATG ATTTTGGGCG GTGGGGAAGA TGCCTGA
```

This corresponds to the amino acid sequence <SEQ ID 538; ORF 138>:

m138.pep

```
  1 MESENIISAA DKARILAEAL PYIRRFSGSV AVIKYGGNAM TEPALKEGFA

 51 RDVVLLKLVG IHPVIVHGGG PQINAMLEKV GKKGEFVQGM RVTDKEAMDI

101 VEMVLGGHVN KEIVSMINTY GGHAVGVSGR DDHFIKAKKL LIDTPEQNGV

151 DIGQVGTVES IDTGLVKGLI ERGCIPVVAP VGVGEKGEAF NINADLVAGK

201 LAEELNAEKL LMMTNIAGVM DKTGNLLTKL TPKRIDELIA DGTLYGGMLP

251 KIASAVEAAV NGVKATHIID GRLPNALLLE IFTDAGIGSM ILGGGEDA*
```

Computer analysis of this amino acid sequence gave the following results:

Homology with a predicted ORF from *N. gonorrhoeae*

ORF 138 shows 98.0% identity over a 298 aa overlap with a predicted ORF (ORF 138.ng) from *N. gonorrhoeae*:

m138/g138

```
                   10        20        30        40        50        60
m138.pep   MESENIISAADKARILAEALPYIRRFSGSVAVIKYGGNAMTEPALKEGFARDVVLLKLVG
           || |||||||||||||||||||||||||||||||||||||||||||||||||||||||||
g138       MEFENIISAADKARILAEALPYIRRFSGSVAVIKYGGNAMTEPALKEGFARDVVLLKLVG
                   10        20        30        40        50        60

                   70        80        90       100       110       120
m138.pep   IHPVIVHGGGPQINAMLEKVGKKGEFVQGMRVTDKEAMDIVEMVLGGHVNKEIVSMINTY
           |||||||||||||||||||||||||||||||||||||:||||||||||||||||||||||
g138       IHPVIVHGGGPQINAMLEKVGKKGEFVQGMRVTDKETMDIVEMVLGGHVNKEIVSMINTY
                   70        80        90       100       110       120

                  130       140       150       160       170       180
m138.pep   GGHAVGVSGRDDHFIKAKKLLIDTPEQNGVDIGQVGTVESIDTGLVKGLIERGCIPVVAP
           |||||||||||||||||||||:||||||:|||||||||||||||||||||||||||||||
g138       GGHAVGVSGRDDHFIKAKKLLVDTPEQNSVDIGQVGTVESIDTGLVKGLIERGCIPVVAP
                  130       140       150       160       170       180

                  190       200       210       220       230       240
m138.pep   VGVGEKGEAFNINADLVAGKLAEELNAEKLLMMTNIAGVMDKTGNLLTKLTPKRIDELIA
           |||||||||||||||||||||||||||||||||||||||||||||||||||||||| |||
g138       VGVGEKGEAFNINADLVAGKLAEELNAEKLLMMTNIAGVMDKTGNLLTKLTPKRIDGLIA
                  190       200       210       220       230       240
                  250       260       270       280       290      299
m138.pep   DGTLYGGMLPKIASAVEAAVNGVKATHIIDGRLPNALLEIFTDAGIGSMILGGGEDAX
           |||||||||||||||||||||||||||||||||||||||||||||||||||| |||||
g138       DGTLYGGMLPKIASAVEAAVNGVKATHIIDGRLPNALLEIFTDAGIGSMILGRGEDAX
                  250       260       270       280       290
```

The following partial DNA sequence was identified in *N. meningitidis* <SEQ ID 539>:

a138.seq

```
  1 ATGGAGTCTG AAAACATTAT TTCCGCCGCC GACAAGGCGC GTATCCTTGC
 51 CGAAGCGCTG CCTTACATCC GCCGGTTTTC CGGTTCGGTC GCCGTCATCA
101 AATACGGCGG CAACGCGATG ACCGAACCTG CCTTGAAAGA AGGGTTTGCC
151 CGCGATGTCG TGCTGCTGAA GCTGGTCGGC ATTCATCCCG TCATCGTTCA
201 CGGCGGCGGG CCGCAGATCA ATGCGATGCT TGAAAAAGTC GGCAAAAAGG
251 GTGAGTTTGT CCAAGGAATG CGCGTTACCG ACAAAGAGGC GATGGATATT
301 GTCGAAATGG TGTTGGGCGG GCATGTCAAT AAAGAAATCG TGTCGATGAT
351 TAACACATAT GGCGGACACG CGGTCGGCGT AAGCGGACGC GACGACCATT
401 TCATTAAGGC GAAGAAACTT TTGATCGATA CGCCCGAACA GAATGGCGTG
451 GACATCGGAC AGGTCGGTAC GGTGGAAAGC ATCGATACCG GTTTGGTTAA
501 AGGGCTGATA GAACGTGGCT GCATTCCCGT CGTCGCCCCC GTCGGCGTAG
551 GTGAAAAAGG CGAAGCGTTC AACATCAACG CCGATTTGGT AGCAGGCAAA
601 TTGGCGGAAG AATTGAACGC CGAAAAACTC TTGATGATGA CGAATATCGC
651 CGGTGTGATG GACAAAACGG GCAATCTGCT GACCAAACTC ACGCCGAAAC
701 GGATTGATGA ACTGATTGCC GACGGCACGC TGTATGGCGG TATGCTGCCG
751 AAAATCGCTT CTGCGGTCGA AGCCGCCGTC AACGGCGTGA AAGCCACGCA
801 TATCATCGAC GGCAGGGTGC CCAACGCGCT TTTGCTGGAA ATCTTTACCG
851 ATGCCGGTAT CGGTTCGATG ATTTTGGGCG GTGGGGAAGA TGCCTGA
```

This corresponds to the amino acid sequence <SEQ ID 540; ORF 138.a>:

a138.pep

```
  1 MESENIISAA DKARILAEAL PYIRRFSGSV AVIKYGGNAM TEPALKEGFA
 51 RDVVLLKLVG IHPVIVHGGG PQINAMLEKV GKKGEFVQGM RVTDKEAMDI
101 VEMVLGGHVN KEIVSMINTY GGHAVGVSGR DDHFIKAKKL LIDTPEQNGV
151 DIGQVGTVES IDTGLVKGLI ERGCIPVVAP VGVGEKGEAF NINADLVAGK
201 LAEELNAEKL LMMTNIAGVM DKTGNLLTKL TPKRIDELIA DGTLYGGMLP
251 KIASAVEAAV NGVKATHIID GRVPNALLLE IFTDAGIGSM ILGGGEDA*
```

m138/a138 99.7% identity in 298 aa overlap

```
                    10        20        30        40        50        60
m138.pep    MESENIISAADKARILAEALPYIRRFSGSVAVIKYGGNAMTEPALKEGFARDVVLLKLVG
            ||||||||||||||||||||||||||||||||||||||||||||||||||||||||||||
a138        MESENIISAADKARILAEALPYIRRFSGSVAVIKYGGNAMTEPALKEGFARDVVLLKLVG
                    10        20        30        40        50        60

                    70        80        90       100       110       120
m138.pep    IHPVIVHGGGPQINAMLEKVGKKGEFVQGMRVTDKEAMDIVEMVLGGHVNKEIVSMINTY
            ||||||||||||||||||||||||||||||||||||||||||||||||||||||||||||
a138        IHPVIVHGGGPQINAMLEKVGKKGEFVQGMRVTDKEAMDIVEMVLGGHVNKEIVSMINTY
                    70        80        90       100       110       120

                   130       140       150       160       170       180
m138.pep    GGHAVGVSGRDDHFIKAKKLLIDTPEQNGVDIGQVGTVESIDTGLVKGLIERGCIPVVAP
            ||||||||||||||||||||||||||||||||||||||||||||||||||||||||||||
a138        GGHAVGVSGRDDHFIKAKKLLIDTPEQNGVDIGQVGTVESIDTGLVKGLIERGCIPVVAP
                   130       140       150       160       170       180

                   190       200       210       220       230       240
m138.pep    VGVGEKGEAFNINADLVAGKLAEELNAEKLLMMTNIAGVMDKTGNLLTKLTPKRIDELIA
            ||||||||||||||||||||||||||||||||||||||||||||||||||||||||||||
a138        VGVGEKGEAFNINADLVAGKLAEELNAEKLLMMTNIAGVMDKTGNLLTKLTPKRIDELIA
                   190       200       210       220       230       240

                   250       260       270       280       290       299
m138.pep    DGTLYGGMLPKIASAVEAAVNGVKATHIIDGRLPNALLLEIFTDAGIGSMILGGGEDAX
            ||||||||||||||||||||||||||||||||:||||||||||||||||||||||||||
a138        DGTLYGGMLPKIASAVEAAVNGVKATHIIDGRVPNALLLEIFTDAGIGSMILGGGEDAX
                   250       260       270       280       290
```

The following partial DNA sequence was identified in *N. gonorrhoeae* <SEQ ID 541>:

g139.seq

```
  1 ATGCGAACCA CCTCAACCTT CCCTACAAAA ACTTTCAAAC CGGCTGCCAT
 51 GGCGTTAGCT GTTGCAACAA CACTTTCTGC CTGCTTAggc ggcggcggag
101 gcGGCACTTC TGCTCCCGAC TTTAATGCAG GCGGCACCGG TATCGGCAGC
151 AACAGCAGGG CAACGATAGC GGAATCAGCA GCAGTATCTT ACGCCGGTAT
201 AAAAAACGAA ATGTGCAAAG ACAGAAGCAT GCTCTGTGCC GGTCGGGATG
251 ACGTTGCGGT TACAGACAGG GATGCCAAAA TCAAAGCCCC CCGAATCTGC
301 ATACCGGAGA CTTTTCAAAC CCAAATGACC AATATTAAGA ATATGATCAA
351 CCTCAAACCT GCAATTGAAG CAGGCTATAC AGGACGCGGG GTAGAGGTAG
401 GTATCGTCGA TACAGGCGAA TCCGTCGGCA GCATATCCTT TCCCGAACTG
451 TATGGCAGAA AAGAACACGG CTATAACGAA AATTACAAAA ACAAATTACA
501 AAAACTATAC GGCGTATATG CGGAAGGAAG CGCCTGA
```

This corresponds to the amino acid sequence <SEQ ID 542; ORF 138.ng>:

g139.pep

```
  1 MRTTSTFPTK TFKPAAMALA VATTLSACLG GGGGGTSAPD FNAGGTGIGS
 51 NSRATIAESA AVSYAGIKNE MCKDRSMLCA GRDDVAVTDR DAKIKAPRIC
101 IPETFQTQMT NIKNMINLKP AIEAGYTGRG VEVGIVDTGE SVGSISFPEL
151 YGRKEHGYNE NYKNKLQKLY GVYAEGSA*
```

The following partial DNA sequence was identified in *N. meningitidis* <SEQ ID 543>:

m139.seq

```
  1 ATGCGAACGA CCCCAACCTT CCCTACAAAA ACTTTCAAAC CGACTGCCAT
 51 GGCGTTAGCT GTTGCAACAA CACTTTCTGC CTGCTTAGGC GGCGGCGGAG
101 GCGGCACTTC TGCGCCCGAC TTCAATGCAG GCGGTACCGG TATCGGCAGC
151 AACAGCAGAG CAACAACAGC GAAATCAGCA GCAGTATCTT ACGCCGGTAT
201 CAAGAACGAA ATGTGCAAAG ACAGAAGCAT GCTCTGTGCC GGTCGGGATG
251 ACGTTGCGGT TACAGACAGG GATGCCAAAA TCAATGCCCC CCCCCGAATC
301 TGCATACCGG AGACTTTCCA AACCCAAATG ACGCATtACA AGAATTTGAT
351 CAACCTCAAA CCTGCAATTG AAGCAGGCTA TACAGGACGC GGGGTAGAGG
401 TAGGTATCGT CGACACAGGC GAATCCGTCG GCAGCATATC CTTTCCCGAA
451 CTGTATGGCA GAAAAGAACA CGGCTATAAC GAAAATTACG AAAAACTATA
501 CGGCGTATAT GCGGAAGGAA GCGCCTGA
```

This corresponds to the amino acid sequence <SEQ ID 544; ORF 138>:

m139.pep

```
  1 MRTTPTFPTK TFKPTAMALA VATTLSACLG GGGGGTSAPD FNAGGTGIGS
 51 NSRATTAKSA AVSYAGIKNE MCKDRSMLCA GRDDVAVTDR DAKINAPPRI
101 CIPETFQTQM THYKNLINLK PAIEAGYTGR GVEVGIVDTG ESVGSISFPE
151 LYGRKEHGYN ENYEKLYGVY AEGSA*
```

Computer analysis of this amino acid sequence gave the following results:

Homology with a predicted ORF from *N. gonorrhoeae*

ORF 138 shows 92.2% identity over a 179 aa overlap with a predicted ORF (ORF 138.ng) from *N. gonorrhoeae*:

m139/g139

```
                   10        20        30        40        50        60
m139.pep    MRTTPTFPTKTFKPTAMALAVATTLSACLGGGGGGTSAPDFNAGGTGIGSNSRATTAKSA
            |||| |||||||||:||||||||||||||||||||||||||||||||||||||||| |:||
g139        MRTTSTFPTKTFKPAAMALAVATTLSACLGGGGGGTSAPDFNAGGTGIGSNSRATIAESA
                   10        20        30        40        50        60

                   70        80        90       100       110       120
m139.pep    AVSYAGIKNEMCKDRSMLCAGRDDVAVTDRDAKINAPPRICIPETFQTQMTHYKNLINLK
            ||||||||||||||||||||||||||||||||||:|| ||||||||||||: ||:||||
g139        AVSYAGIKNEMCKDRSMLCAGRDDVAVTDRDAKIKAP-RICIPETFQTQMTNIKNMINLK
                   70        80        90        100       110
```

-continued

```
                 130       140       150       160       170
m139.pep    PAIEAGYTGRGVEVGIVDTGESVGSISFPELYGRKEHGYNENY----EKLYGVYAEGSAX
            |||||||||||||||||||||||||||||||||||||||||||    :|||||||||||
g139        PAIEAGYTGRGVEVGIVDTGESVGSISFPELYGRKEHGYNENYKNKLQKLYGVYAEGSAX
        120       130       140       150       160       170
```

The following partial DNA sequence was identified in *N. meningitidis* <SEQ ID 545>:

```
a139.seq
  1 ATGCGAACGA CCCCAACCTT CCCTACAAAA ACTTTCAAAC CGGCTGCCAT
 51 GGCGTTAGCT GTTGCAACAA CACTTTCTGC CTGCTTAGGC GGCGGCGGAG
101 GCGGCACTTC TGCGCCCGAC TTCAATGCAG GCGGCACCGG TATCGGCAGC
151 AACAGCAGGG CAACAACAGC GAAATCAGCA GCAATATCTT ACGCCGGTAT
201 CAAGAACGAA ATGTGCAAAG ACAGAAGCAT GCTCTGTGCC GGTCGGGATG
251 ACGTTGCGGT TACAGACAGG GATGCCAAAA TCAATGCCCC CCCCCGAATC
301 TGCATACCGG AGACTTTACA AACCCAAATG ACGCAT.ACA AGAATTTGAT
351 CAACCTCAAA CCTGCAATTG AAGCAGGCTA TACAGGACGC GGGGTAGAGG
401 TAGGTATCGT CGACACAGGC GAATCCGTCG GCAGCATATC CTTTCCCGAA
451 CTGTATGGCA GAAAAGAACA CGGCTATAAC GAAAATTAC. AAAAACTATA
501 CGGCGTATAT GCGGAAGGAA GCGCCTGA
```

This corresponds to the amino acid sequence <SEQ ID 546; ORF 139.a>:

```
a139.pep
  1 MRTTPTFPTK TFKPAAMALA VATTLSACLG GGGGGTSAPD FNAGGTGIGS
 51 NSRATTAKSA AISYAGIKNE MCKDRSMLCA GRDDVAVTDR DAKINAPPRI
101 CIPETLQTQM THXKNLINLK PAIEAGYTGR GVEVGIVDTG ESVGSISFPE
151 LYGRKEHGYN ENYXKLYGVY AEGSA*
```

m139/a139 97.1% identity in 175 aa overlap

```
                    10        20        30        40        50        60
m139.pep    MRTTPTFPTKTFKPTAMALAVATTLSACLGGGGGGTSAPDFNAGGTGIGSNSRATTAKSA
            ||||||||||||||:|||||||||||||||||||||||||||||||||||||||||||||
a139        MRTTPTFPTKTFKPAAMALAVATTLSACLGGGGGGTSAPDFNAGGTGIGSNSRATTAKSA
                    10        20        30        40        50        60

                    70        80        90       100       110       120
m139.pep    AVSYAGIKNEMCKDRSMLCAGRDDVAVTDRDAKINAPPRICIPETFQTQMTHYKNLINLK
            |:|||||||||||||||||||||||||||||||||||||||||||:|||||| |||||||
a139        AISYAGIKNEMCKDRSMLCAGRDDVAVTDRDAKINAPPRICIPETLQTQMTHXKNLINLK
                    70        80        90       100       110       120

                   130       140       150       160       170
m139.pep    PAIEAGYTGRGVEVGIVDTGESVGSISFPELYGRKEHGYNENYEKLYGVYAEGSAX
            ||||||||||||||||||||||||||||||||||||||||||| ||||||||||||
a139        PAIEAGYTGRGVEVGIVDTGESVGSISFPELYGRKEHGYNENYXKLYGVYAEGSAX
                   130       140       150       160       170
```

The following partial DNA sequence was identified in *N. gonorrhoeae* <SEQ ID 547>:

g140.seq

```
   1 Atgtcggcac gCGGCAAGGG GGCAGgctat ctcAACAGTA CCGGACGACa
  51 TGTTCCCTTC CTGAGTGCCG CCAAAATCGG GCAGGATTAT TCTTTCTTCA
 101 AAAATATCAA AACCGACGGC GGTCTGCTGG CTTCCCTCGA CAGCGTCGAA
 151 AAAACAGCGG GCAGTGAAGG CGACACGCCG TCCTATTATG TCCGTCGCGG
 201 CAATGCGGCA CGGACTGCTT CGGCAGCGGC ACATTCCGCG CCCGCCGGTC
 251 TGAAACACGC CGTAGAACAG GGCGGCAGCA ATCTGGAAAA CCTGATGGTC
 301 GAGCTGGATG CCTCCGAATC ATCCGCAACA CCCGAGACGG TTGAAACTGC
 351 GGTCGCCGAC CGCACAGATA TGCCGGGCAT CCGCCTACGG CGCACAACTT
 401 TCCGCACAGC GGCAGCCGTA CAGCATGCGA ATACCGCCGA CGGCGTACGc
 451 aTCTTcaaCA GTCTCGCCGC TAccgTCTAt GccgACAGTG CCGCCGCCCA
 501 TGccgATATG CAGGGACGCC GCCTGAAAGC CGTATCGGAC GGGTTGGACC
 551 ACAACGGTAC GGGTCTGCGC GTCATCGCGC AAACCCAACA GGACGGTGGA
 601 ACGTGGGAAC AGGGCGGTGT CGAAGGCAAA ATGCGCGGCA GTACCCAAAC
 651 TATCGGCATT GCCGCGAAAA CCGGCGAAAA TACGACAGCA GCCGCCACAC
 701 TGGGCATAGG ACGCAGCACA TGGAGCGAAA ACAGTGCAAA TGCAAAAACC
 751 GACAGCATTA GTCTGTTTGC AGGCATACGG CACGATGTGG GCGATATCGG
 801 CTATCTCAAA GGCCTGTTCT CctaCGGACG CTACAAAAAC AGCATCAGCC
 851 GCAGCACCGG TGCGGATGAA TATGCGGAAG GCAGCGTCAA CGGCACGCTG
 901 ATGCAGCTGG GCGCACTGGG TGGTGTCAAC GTTCCGTTTG CCGCAACGGG
 951 AGATTTGACG GTTGAAGGCG GTCTGCGCCA CGACCTGCTC AAACAGGATG
1001 CATTCGCCGA AAAAGGCagt GCTTTGGGCT GGAGCGGCAA CAGCCTCACT
1051 GAAGGCACAC TGGTCGGACT CGCGGGTCTG AAACTGTCGC AACCCTTGAG
1101 CGATAAAGCC GTCCTGTCTG CGACGGCGGG CGTGGAACGC GACCTGAACG
1151 GACGCGACTA CGCGGTAACG GGCGGCTTTA CCGGCGCGGC TGCAGCAACC
1201 GGCAAGACGG GTGCACGCAA TATGCCGCAC ACCCGCCGGG TTGCCGGTCT
1251 GGGGGTGGAT GTCGAATTCG GCAACGGCTG GAACGGCTTG GCACGTTACA
1301 GCTACACCGG TTCCAAACAG TACGGCAACC ACAGCGGACA AATCGGCGTA
1351 GGCTACCGGT TCTGA
```

This corresponds to the amino acid sequence <SEQ ID 548; ORF 140.ng>:

g140.pep

```
  1 MSARGKGAGY LNSTGRHVPF LSAAKIGQDY SFFKNIKTDG GLLASLDSVE
 51 KTAGSEGDTP SYYVRRGNAA RTASAAAHSA PAGLKHAVEQ GGSNLENLMV
101 ELDASESSAT PETVETAVAD RTDMPGIRLR RTTFRTAAAV QHANTADGVR
151 IFNSLAATVY ADSAAAHADM QGRRLKAVSD GLDHNGTGLR VIAQTQQDGG
201 TWEQGGVEGK MRGSTQTIGI AAKTGENTTA AATLGIGRST WSENSANAKT
251 DSISLFAGIR HDVGDIGYLK GLFSYGRYKN SISRSTGADE YAEGSVNGTL
301 MQLGALGGVN VPFAATGDLT VEGGLRHDLL KQDAFAEKGS ALGWSGNSLT
```

-continued

```
351 EGTLVGLAGL KLSQPLSDKA VLSATAGVER DLNGRDYAVT GGFTGAAAAT

401 GKTGARNMPH TRRVAGLGVD VEFGNGWNGL ARYSYTGSKQ YGNHSGQIGV

451 GYRF*
```

The following partial DNA sequence was identified in *N. meningitidis* <SEQ ID 549>:

m140.seq

```
   1 ATGTCGGCAC GCGGCAAGGG GGCAGGCTAT CTCAACAGTA CCGGACGACG
  51 TGTTCCCTTC CTGAGTGCCG CCAAAATCGG GCAGGATTAT TCTTTCTTCA
 101 CAAACATCGA AACCGACGGC GGCCTGCTGG CTTCCCTCGA CAGCGTCGAA
 151 AAAACAGCGG GCAGTGAAGG CGACACGCTG TCCTATTATG TCCGTCGCGG
 201 CAATGCGGCA CGGACTGCTT CGGCAGCGGC ACATTCCGCG CCCGCCGGTC
 251 TGAAACACGC CGTAGAACAG GGCGGCAGCA ATCTGGAAAA CCTGATGGTC
 301 GAACTGGATG CCTCCGAATC ATCCGCAACA CCCGAGACGG TTGAAACTGC
 351 GGCAGCCGAC CGCACAGATA TGCCGGGCAT CCGCCCCTAC GGCGCAACTT
 401 TCCGCGCAGC GGCAGCCGTA CAGCATGCGA ATGCCGCCGA CGGTGTACGC
 451 ATCTTCAACA GTCTCGCCGC TACCGTCTAT GCCGACAGTA CCGCCGCCCA
 501 TGCCGATATG CAGGGACGCC GCCTGAAAGC CGTATCGGAC GGGTTGGACC
 551 ACAACGGCAC GGGTCTGCGC GTCATCGCGC AAACCCAACA GGACGGTGGA
 601 ACGTGGGAAC AGGGCGGTGT TGAAGGCAAA ATGCGCGGCA GTACCCAAAC
 651 CGTCGGCATT GCCGCGAAAA CCGGCGAAAA TACGACAGCA GCCGCCACAC
 701 TGGGCATGGG ACGCAGCACA TGGAGCGAAA ACAGTGCAAA TGCAAAAACC
 751 GACAGCATTA GTCTGTTTGC AGGCATACGG CACGATGCGG GCGATATCGG
 801 CTATCTCAAA GGCCTGTTCT CCTACGGACG CTACAAAAAC AGCATCAGCC
 851 GCAGCACCGG TGCGGACGAA CATGCGGAAG GCAGCGTCAA CGGCACGCTG
 901 ATGCAGCTGG GCGCACTGGG CGGTGTCAAC GTTCCGTTTG CCGCAACGGG
 951 AGATTTGACG GTCGAAGGCG GTCTGCGCTA CGACCTGCTC AAACAGGATG
1001 CATTCGCCGA AAAAGGCAGT GCTTTGGGCT GGAGCGGCAA CAGCCTCACT
1051 GAAGGCACGC TGGTCGGACT CGCGGGTCTG AAGCTGTCGC AACCCTTGAG
1101 CGATAAAGCC GTCCTGTTTG CAACGGCGGG CGTGGAACGC GACCTGAACG
1151 GACGCGACTA CACGGTAACG GGCGGCTTTA CCGGCGCGAC TGCAGCAACC
1201 GGCAAGACGG GGGCACGCAA TATGCCGCAC ACCCGTCTGG TTGCCGGCCT
1251 GGGCGCGGAT GTCGAATTCG GCAACGGCTG GAACGGCTTG GCACGTTACA
1301 GCTACGCCGG TTCCAAACAG TACGGCAACC ACAGCGGACG AGTCGGCGTA
1351 GGCTACCGGT TCTGA
```

This corresponds to the amino acid sequence <SEQ ID 550; ORF 140>:

m140.pep

```
  1 MSARGKGAGY LNSTGRRVPF LSAAKIGQDY SFFTNIETDG GLLASLDSVE

 51 KTAGSEGDTL SYYVRRGNAA RTASAAAHSA PAGLKHAVEQ GGSNLENLMV

101 ELDASESSAT PETVETAAAD RTDMPGIRPY GATFRAAAAV QHANAADGVR

151 IFNSLAATVY ADSTAAHADM QGRRLKAVSD GLDHNGTGLR VIAQTQQDGG

201 TWEQGGVEGK MRGSTQTVGI AAKTGENTTA AATLGMGRST WSENSANAKT

251 DSISLFAGIR HDAGDIGYLK GLFSYGRYKN SISRSTGADE HAEGSVNGTL

301 MQLGALGGVN VPFAATGDLT VEGGLRYDLL KQDAFAEKGS ALGWSGNSLT

351 EGTLVGLAGL KLSQPLSDKA VLFATAGVER DLNGRDYTVT GGFTGATAAT

401 GKTGARNMPH TRLVAGLGAD VEFGNGWNGL ARYSYAGSKQ YGNHSGRVGV

451 GYRF*
```

Computer analysis of this amino acid sequence gave the following results:

Homology with a predicted ORF from *N. gonorrhoeae*

ORF 140 shows 94.5% identity over a 454 aa overlap with a predicted ORF (ORF 140.ng) from *N. gonorrhoeae*:

m140/g140

```
                  10        20        30        40        50        60
m140.pep  MSARGKGAGYLNSTGRRVPFLSAAKIGQDYSFFTNIETDGGLLASLDSVEKTAGSEGDTL
          ||||||||||||||||:|||||||||||||||| ||:|||||||||||||||||||||| 
g140      MSARGKGAGYLNSTGRHVPFLSAAKIGQDYSFFKNIKTDGGLLASLDSVEKTAGSEGDTP
                  10        20        30        40        50        60


                  70        80        90       100       110       120
m140.pep  SYYVRRGNAARTASAAAHSAPAGLKHAVEQGGSNLENLMVELDASESSATPETVETAAAD
          |||||||||||||||||||||||||||||||||||||||||||||||||||||||||:||
g140      SYYVRRGNAARTASAAAHSAPAGLKHAVEQGGSNLENLMVELDASESSATPETVETAVAD
                  70        80        90       100       110       120
                 130       140       150       160       170       180
m140.pep  RTDMPGIRPYGATFRAAAAVQHANAADGVRIFNSLAATVYADSTAAHADMQGRRLKAVSD
          ||||||||   :|||:||||||||:||||||||||||||||||:||||||||||||||||
g140      RTDMPGIRLRRTTFRTAAAVQHANTADGVRIFNSLAATVYADSAAAHADMQGRRLKAVSD
                 130       140       150       160       170       180
                 190       200       210       220       230       240
m140.pep  GLDHNGTGLRVIAQTQQDGGTWEQGGVEGKMRGSTQTVGIAAKTGENTTAAATLGMGRST
          |||||||||||||||||||||||||||||||||||||:|||||||||||||||||:||||
g140      GLDHNGTGLRVIAQTQQDGGTWEQGGVEGKMRGSTQTIGIAAKTGENTTAAATLGIGRST
                 190       200       210       220       230       240
                 250       260       270       280       290       300
m140.pep  WSENSANAKTDSISLFAGIRHDAGDIGYLKGLFSYGRYKNSISRSTGADEHAEGSVNGTL
          ||||||||||||||||||||||:|||||||||||||||||||||||||||:|||||||||
g140      WSENSANAKTDSISLFAGIRHDVGDIGYLKGLFSYGRYKNSISRSTGADEYAEGSVNGTL
                 250       260       270       280       290       300
                 310       320       330       340       350       360
m140.pep  MQLGALGGVNVPFAATGDLTVEGGLRYDLLKQDAFAEKGSALGWSGNSLTEGTLVGLAGL
          ||||||||||||||||||||||||||:|||||||||||||||||||||||||||||||||
g140      MQLGALGGVNVPFAATGDLTVEGGLRHDLLKQDAFAEKGSALGWSGNSLTEGTLVGLAGL
                 310       320       330       340       350       360
                 370       380       390       400       410       420
m140.pep  KLSQPLSDKAVLFATAGVERDLNGRDYTVTGGFTGATAATGKTGARNMPHTRLVAGLGAD
          |||||||||||| ||||||||||||||:||||||||:||||||||||||||| |||||:|
g140      KLSQPLSDKAVLSATAGVERDLNGRDYAVTGGFTGAAAATGKTGARNMPHTRRVAGLGVD
                 370       380       390       400       410       420
                 430       440       450
m140.pep  VEFGNGWNGLARYSYAGSKQYGNHSGRVGVGYRFX
          |||||||||||||||:||||||||||::|||||||
g140      VEFGNGWNGLARYSYTGSKQYGNHSGQIGVGYRFX
                 430       440       450
```

The following partial DNA sequence was identified in *N. meningitidis* <SEQ ID 551>:

a140.seq

```
   1 ATGTCGGCAG GCGGTAAGGG GGCAGGCTAT CTCAACCGTA CCGGACAACG
  51 TGTTCCCTTC CTGAGTGCCG CCAAAATCGG GCGGGATTAT TCTTTCTTCA
 101 CAAACATCGA AACCGACGGC GGTCTGCTGG CTTCCCTCGA CAGCGTCGAA
 151 AAAACAGCGG GTAGTGAAGG CGACACGCTG TCCTATTATG TCCGTCGCGG
 201 CAATGCGGCA CGGACTGCTT CGGCAGCGGC ACATTCCGCG CCCGCCGGTC
 251 TGAAACACGC CGTAGAACAG GGCGGCAGCA ATCTGGAAAA CCTGATGGTC
 301 GAACTGGATG CCTCCGAATC ATCCGCAACA CCCGAGACGG TTGAAACTGC
 351 GGCCGCCGAC CGCACAGATA TGCCGGGCAT CCGCCCCTAC GGCGCAACTT
 401 TCCGCGCAGC GGCAGCCGTA CAGCATGCGA ATGCCGCCGA CGGTGTACGC
 451 ATCTTCAACA ATCTCGCCGC TACCGTCTAT GCCGACAGTA CCGCCGCCCA
 501 TGCCGATATG CAGGGACGCC GCCTGAAAGC CGTATCGGAC GGGTTGGACC
 551 ACAACGCTAC GGGTCTGCGC GTCATCGCGC AAACCCAACA GGACGGTGGA
 601 ACGTGGGAAC AGGGCGGTGT TGAAGGCAAA ATGCGCGGCA GTACCCAAAC
 651 CGTCGGCATT GCCGCGAAAA CCGGCGAAAA TACGACAGCA GCCGCCACAC
 701 TGGGCATGGG ACACAGCACA TGGAGCGAAA ACAGTGCAAA TGCAAAAACC
 751 GACAGCATTA GTCTGTTTGC AGGCATACGG CACGATGCGG GCGATATCGG
 801 CTATCTCAAA GGCCTGTTCT CCTACGGACG CTACAAAAAC AGCATCAGCC
 851 GCAGCACCGG TGCGGACGAA CATGCGGAAG GCAGCGTCAA CGGCACGCTG
 901 ATGCAGCTGG GCGCACTGGG CGGTGTCAAC GTTCCGTTTG CCGCAACGGG
 951 AGATTTGACG GTCGAAGGCG GTCTGCGCTA CGACCTGCTC AAACAGGATG
1001 CATTCGCCGA AAAAGGCAGT GCTTTGGGCT GGAGCGGCAA CAGCATCACT
1051 GAAGGCACAC TGGTCGGACT CGCGGGTCTG AAGCTGTCGC AACCCTTGAG
1101 CGATAAAGCC GTCCTGTTTG CAACGGCGGG CGTGGAACGC GACCTGAACG
1151 GACGCGACTA CACGGTAACG GGCGGCTTTA CCGGCGCGAC TGCAGCAACC
1201 GGCAAGACGG GGCACGCAA TATGCCGCAC ACCCGCCTGG TTGCCGGTCT
1251 GGGCGCGGAT GTCGAATTCG GCAACGGCTG GAACGGCTTG GCACGTTACA
1301 GCTACGCCGG TTCCAAACAG TACGGCAACC ACAGCGGACG AGTCGGCGTA
1351 GGCTACCGGT TCTGA
```

This corresponds to the amino acid sequence <SEQ ID 552; ORF 140.a>:

a140.pep

```
  1 MSAGGKGAGY LNRTGQRVPF LSAAKIGRDY SFFTNIETDG GLLASLDSVE
 51 KTAGSEGDTL SYYVRRGNAA RTASAAAHSA PAGLKHAVEQ GGSNLENLMV
101 ELDASESSAT PETVETAAAD RTDMPGIRPY GATFRAAAAV QHANAADGVR
151 IFNNLAATVY ADSTAAHADM QGRRLKAVSD GLDHNATGLR VIAQTQQDGG
201 TWEQGGVEGK MRGSTQTVGI AAKTGENTTA AATLGMGHST WSENSANAKT
251 DSISLFAGIR HDAGDIGYLK GLFSYGRYKN SISRSTGADE HAEGSVNGTL
301 MQLGALGGVN VPFAATGDLT VEGGLRYDLL KQDAFAEKGS ALGWSGNSIT
```

-continued

```
351 EGTLVGLAGL KLSQPLSDKA VLFATAGVER DLNGRDYTVT GGFTGATAAT

401 GKTGARNMPH TRLVAGLGAD VEFGNGWNGL ARYSYAGSKQ YGNHSGRVGV

451 GYRF*
```

m140/a140 98.2% identity in 454 aa overlap

```
                   10        20        30        40        50        60
m140.pep   MSARGKGAGYLNSTGRRVPLFSAAKIGQDYSFFTNIETDGGLLASLDSVEKTAGSEGDTL
           ||| |||||||| ||:||||||||||:|||||||||||||||||||||||||||||||||
a140       MSAGGKGAGYLNRTGQRVPFLSAAKIGRDYSFFTNIETDGGLLASLDSVEKTAGSEGDTL
                   10        20        30        40        50        60

                   70        80        90       100       110       120
m140.pep   SYYVRRGNAARTASAAAHSAPAGLKHAVEQGGSNLENLMVELDASESSATPETVETAAAD
           ||||||||||||||||||||||||||||||||||||||||||||||||||||||||||||
a140       SYYVRRGNAARTASAAAHSAPAGLKHAVEQGGSNLENLMVELDASESSATPETVETAAAD
                   70        80        90       100       110       120

                  130       140       150       160       170       180
m140.pep   RTDMPGIRPYGATFRAAAAVQHANAADGVRIFNSLAATVYADSTAAHADMQGRRLKAVSD
           |||||||||||||||||||||||||||||||||:||||||||||||||||||||||||||
a140       RTDMPGIRPYGATFRAAAAVQHANAADGVRIFNNLAATVYADSTAAHADMQGRRLKAVSD
                  130       140       150       160       170       180

                  190       200       210       220       230       240
m140.pep   GLDHNGTGLRVIAQTQQDGGTWEQGGVEGKMRGSTQTVGIAAKTGENTTAAATLGMGRST
           |||||:||||||||||||||||||||||||||||||||||||||||||||||||||:||
a140       GLDHNATGLRVIAQTQQDGGTWEQGGVEGKMRGSTQTVGIAAKTGENTTAAATLGMGHST
                  190       200       210       220       230       240
                  250       260       270       280       290       300
m140.pep   WSENSANAKTDSISLFAGIRHDAGDIGYLKGLFSYGRYKNSISRSTGADEHAEGSVNGTL
           ||||||||||||||||||||||||||||||||||||||||||||||||||||||||||||
a140       WSENSANAKTDSISLFAGIRHDAGDIGYLKGLFSYGRYKNSISRSTGADEHAEGSVNGTL
                  250       260       270       280       290       300

                  310       320       330       340       350       360
m140.pep   MQLGALGGVNVPFAATGDLTVEGGLRYDLLKQDAFAEKGSALGWSGNSLTEGTLVGLAGL
           |||||||||||||||||||||||||||||||||||||||||||||||||:||||||||||
a140       MQLGALGGVNVPFAATGDLTVEGGLRYDLLKQDAFAEKGSALGWSGNSITEGTLVGLAGL
                  310       320       330       340       350       360

                  370       380       390       400       410       420
m140.pep   KLSQPLSDKAVLFATAGVERDLNGRDYTVTGGFTGATAATGKTGARNMPHTRLVAGLGAD
           ||||||||||||||||||||||||||||||||||||||||||||||||||||||||||||
a140       KLSQPLSDKAVLFATAGVERDLNGRDYTVTGGFTGATAATGKTGARNMPHTRLVAGLGAD
                  370       380       390       400       410       420

                  430       440       450
m140.pep   VEFGNGWNGLARYSYAGSKQYGNHSGRVGVGYRFX
           |||||||||||||||||||||||||||||||||||
a140       VEFGNGWNGLARYSYAGSKQYGNHSGRVGVGYRFX
                  430       440       450
```

The following partial DNA sequence was identified in *N. gonorrhoeae* <SEQ ID 553>:

g141.seq

```
  1 atgagcttca aAAccgATGC CGAAACCGCC CAATCCTCCA CCATGCGCCC

 51 GATTGGCGAA ATTGCCGCCA AGCTGGGTTT GAACGTTGAC AACATTGAGC

101 CTTACGGTCA TTACAAAGCC AAAATCAATC CTGCCGAAGC GTTCAAGCTG

151 CCGCAAAAAC AAGGCAGGCT GATTTTGGTT ACCGCCATCA ACCCGACTCC

201 GGCGGGCGAA GGCAAAACCA CCGTAACCAT CGGTTTGGCG GACGCATTGC

251 GCCATATCGG CAAAGACTCT GTGATTGCTT TGCGCGAGCC TTCTTTGGGT
```

-continued

```
 301 CCGGTGTTCG GCGTGAAAGG CGGCGCGGCA GGCGGCGGCT ACGCGCAAGT
 351 TTTGCCGATG GAAGACATCA ACCTGCACTT CACCGGCGAC TTCCACGCCA
 401 TCGGTGCGGC GAATAACCTC CTCGCCGCCA TGCTCGACAA CCATATCTAC
 451 CAAGGTAACG AGTTGAACAT CGACCCCAAA CGCGTGCTGT GGCGGCGCGT
 501 GGTCGATATG AACGACCGCC AGTTGCGCAA CATCATCGAC GGTATGGGCA
 551 AGCCTGTtga cggCGTGATG CGtcccGACG GCTTCGACAT CACCGTCGCC
 601 TCCGAAGTGa tggcgGTATT CTGCCTTGCC AAAGACATCA GCGATTTGAA
 651 AGAGCGTTtt gGCAATATTC TCGTCGCCTA CGCCAAAGAC GGCAGCCCCG
 701 TTTACGCCAA AGATTTGAAG GCACACGGCG CGATGGCGGC ATTGCTAAAA
 751 GATGCGATTA AGCCCAATTT GGTGCAAACC ATCGAAGGCA CTCCGGCCTT
 801 TGTACACGGC GGCCCGTTCG CCAACATCGC CCACGGCTGC AACTCCGTTA
 851 CCGCAACCCG TCTGGCGAAA CACCTTGCCG ATTACGCCGT AACCGAAGCA
 901 GGCTTCGGCG CGGACTTGGG TGCGGAAAAA TTCTGCGACA TCAAATGCCG
 951 CCTTGCCGGT TTGAAACCTG ATGCGGCAGT CGTCGTGGCG ACTGTCCGCG
1001 CCCTGAAATA CAACGGCGGC GTGGAACGCG CCAACCTTGG TGAAGAAAAC
1051 CTCGAAGCCT TGGCAAAAGG TTTGCCCAAC CTGTTGAAAC ACATTTCCAA
1101 CCTGAAAAAC GTATTCGGAC TGCCCGTCGT CGTTGCGCTC AACCGCTTCG
1151 TGTCCGACTC CGATGCCGAG TTGGCGATGA TTGAAAAAGC CTGTGCCGAA
1201 CACGGCGTTG AAGTTTCCCT GACCGAAGTG TGGGGCAAAG GCGGCGCGGG
1251 CGGCGCGGAT TTGGCGCGCA AAGTCGTCAA TGCCATCGAC AACCAACCTA
1301 ATAACTTCGG TTTCGCCTAC GATGTCGAGT TGGGCATCAA AGACAAAATC
1351 CGTGCGATTG CCCAAAAAGT GTACGGCGCG GAAGATGTCG ATTTCAGCGC
1401 GGAAGCGTCT GCCGAAATCG CCTCGCTGGA AAAACTGGGC TTGGACAAAA
1451 TGCCGATCTG CATGGCGAAA ACCCAATATT CATTGAGCGA CAACGCCAAA
1501 CTCTTGGGCT GCCCCGAAGG CTTCCGCATC GCCGTACGCG GTATCACTGT
1551 TTCCGCCGGC GCGGGCTTCA TCGTTGCGTT GTGCGGCAAT ATGATGAAAA
1601 TGCCGGGCCT GCCGAAAGTT CCGGCTGCCG AGAAAATCGA TGTGGACGAA
1651 CACGGCGTGA TTCACGGCTT GTTCTGA
```

This corresponds to the amino acid sequence <SEQ ID 554: ORF 141.ng>:

g141.pep

```
  1 MSFKTDAETA QSSTMRPIGE IAAKLGLNVD NIEPYGHYKA KINPAEAFKL
 51 PQKQGRLILV TAINPTPAGE GKTTVTIGLA DALRHIGKDS VIALREPSLG
101 PVFGVKGGAA GGGYAQVLPM EDINLHFTGD FHAIGAANNL LAAMLDNHIY
151 QGNELNIDPK RVLWRRVVDM NDRQLRNIID GMGKPVDGVM RPDGFDITVA
201 SEVMAVFCLA KDISDLKERF GNILVAYAKD GSPVYAKDLK AHGAMAALLK
251 DAIKPNLVQT IEGTPAFVHG GPFANIAHGC NSVTATRLAK HLADYAVTEA
301 GFGADLGAEK FCDIKCRLAG LKPDAAVVVA TVRALKYNGG VERANLGEEN
```

-continued

```
351 LEALAKGLPN LLKHISNLKN VFGLPVVVAL NRFVSDSDAE LAMIEKACAE

401 HGVEVSLTEV WGKGGAGGAD LARKVVNAID NQPNNFGFAY DVELGIKDKI

451 RAIAQKVYGA EDVDFSAEAS AEIASLEKLG LDKMPICMAK TQYSLSDNAK

501 LLGCPEGFRI AVRGITVSAG AGFIVALCGN MMKMPGLPKV PAAEKIDVDE

551 HGVIHGLF*
```

The following partial DNA sequence was identified in *N. meningitidis* <SEQ ID 555>:

m141.seq

```
   1 ATGAGCTTCA AAACCGATGC CGAAATCGCC CAATCCTCCA CCATGCGCCC

  51 GATTGGCGAA ATTGCCGCCA AGCTTGGTCT GAATGCCGAC AACATTGAGC

 101 CTTACGGTCA TTACAAGGCG AAAATCAATC CTGCCGAAGC GTTCAAACTG

 151 CCGCAAAAAC AGGGCAGGCT GATTTTGGTT ACCGCCATCA ACCCGACTCC

 201 GGCGGGCGAA GGCAAAACCA CCGTAACCAT CGGTTTGGCG GACGCGTTGC

 251 GCCACATCGG CAAAGATGCC GTGATTGCCC TGCGCGAACC TTCTCTGGGG

 301 CCGGTGTTCG GCGTGAAAGG CGGCGCGGCA GGCGGCGGCT ATGCCCAAGT

 351 TTTGCCGATG GAAGACATCA ACCTGCACTT CACCGGAGAT TTTCACGCCA

 401 TCGGTGCGGC AAATAATCTG CTTGCCGCGA TGCTCGACAA CCATATCTAC

 451 CAAGGCAACG AGTTGAACAT CGACCCCAAA CGCGTGCTGT GGCGGCGCGT

 501 GGTCGATATG AACGACCGCC AGTTGCGCAA CATCATCGAC GGCATGGGTA

 551 AACCCGTTGA CGGCGTGATG CGTCCTGACG GTTTCGATAT TACCGTTGCT

 601 TCCGAAGTGA TGGCGGTATT CTGTCTTGCC AAAGACATCA GCGATTTGAA

 651 AGAGCGTTTG GGCAACATCC TTGTCGCCTA CGCCAAAGAC GGCAGCCCCG

 701 TTTACGCCAA AGATTTGAAA GCGAATGGCG CGATGGCGGC ATTGCTTAAA

 751 GATGCGATTA AGCCCAACTT GGTGCAAACC ATCGAAGGCA CGCCCGCCTT

 801 CGTACACGGC GGCCCGTTCG CCAACATCGC CCACGGCTGC AACTCCGTAA

 851 CCGCAACCCG TCTGGCGAAA CACCTTGCCG ATTACGCCGT AACCGAAGCA

 901 GGCTTCGGCG CGGACTTGGG CGCGGAAAAA TTCTGCGACA TCAAATGCCG

 951 CCTTGCCGGT TTGAAACCTG ATGCGGCTGT TGTCGTGGCG ACTGTCCGCG

1001 CGTTGAAATA TAACGGCGGC GTGGAACGCG CCAACCTCGG CGAAGAAAAT

1051 TTAGACGCTT TGGAAAAAGG TTTGCCCAAC CTGCTGAAAC ACATTTCCAA

1101 CCTGAAAAAC GTATTCGGAC TGCCCGTCGT CGTTGCGCTC AACCGCTTCG

1151 TGTCCGACGC CGATGCCGAG TTGGCGATGA TTGAAAAAGC CTGTGCCGAA

1201 CACGGCGTTG AAGTTTCCCT GACCGAAGTG TGGGGCAAAG GTGGTGCGGG

1251 CGGCGCGGAT TTGGCGCGCA AAGTCGTCAA CGCCATTGAA AGTCAAACCA

1301 ATAACTTCGG TTTCGCCTAC GATGTCGAGT TGGGCATCAA AGACAAAATC

1351 CGTGCGATTG CCCAAAAAGT GTACGGCGCG GAAGATGTTG ATTTCAGCGC

1401 GGAAGCGTCT GCCGAAATCG CTTCACTGGA AAAACTGGGC TTGGACAAAA

1451 TGCCGATCTG CATGGCGAAA ACCCAATACT CTTTGAGCGA CAACGCCAAA

1501 CTGTTGGGCT GCCCCGAAGA CTTCCGCATC GCCGTGCGCG GCATCACCGT
```

-continued

```
1551 TTCCGCAGGC GCAGGTTTCA TCGTCGCCCT GTGCGGCAAC ATGATGAAAA

1601 TGCCCGGCCT GCCCAAAGTT CCGGCTGCCG AGAAAATCGA TGTGGACGCA

1651 GAAGGCGTGA TTCACGGCTT GTTCTGA
```

This corresponds to the amino acid sequence <SEQ ID 556; ORF 141>:

m141.pep

```
  1 MSFKTDAEIA QSSTMRPIGE IAAKLGLNAD NIEPYGHYKA KINPAEAFKL

 51 PQKQGRLILV TAINPTPAGE GKTTVTIGLA DALRHIGKDA VIALREPSLG

101 PVFGVKGGAA GGGYAQVLPM EDINLHFTGD FHAIGAANNL LAAMLDNHIY

151 QGNELNIDPK RVLWRRVVDM NDRQLRNIID GMGKPVDGVM RPDGFDITVA

201 SEVMAVFCLA KDISDLKERL GNILVAYAKD GSPVYAKDLK ANGAMAALLK

251 DAIKPNLVQT IEGTPAFVHG GPFANIAHGC NSVTATRLAK HLADYAVTEA

301 GFGADLGAEK FCDIKCRLAG LKPDAAVVVA TVRALKYNGG VERANLGEEN

351 LDALEKGLPN LLKHISNLKN VFGLPVVVAL NRFVSDADAE LAMIEKACAE

401 HGVEVSLTEV WGKGGAGGAD LARKVVNAIE SQTNNFGFAY DVELGIKDKI

451 RAIAQKVYGA EDVDFSAEAS AEIASLEKLG LDKMPICMAK TQYSLSDNAK

501 LLGCPEDFRI AVRGITVSAG AGFIVALCGN MMKMPGLPKV PAAEKIDVDA

551 EGVIHGLF*
```

Computer analysis of this amino acid sequence gave the following results:

Homology with a predicted ORF from *N. gonorrhoeae*

ORF 141 shows 97.5% identity over a 558 aa overlap with a predicted ORF (ORF 141.ng) from *N. gonorrhoeae*:

```
m141/g141

                  10        20        30        40        50        60
m141.pep  MSFKTDAEIAQSSTMRPIGEIAAKLGLNADNIEPYGHYKAKINPAEAFKLPQKQGRLILV
          |||||||| |||||||||||||||||||:|||||||||||||||||||||||||||||||
g141      MSFKTDAETAQSSTMRPIGEIAAKLGLNVDNIEPYGHYKAKINPAEAFKLPQKQGRLILV
                  10        20        30        40        50        60

                  70        80        90       100       110       120
m141.pep  TAINPTPAGEGKTTVTIGLADALRHIGKDAVIALREPSLGPVFGVKGGAAGGGYAQVLPM
          ||||||||||||||||||||||||||||||||||||||||||||||||||||||||||||
g141      TAINPTPAGEGKTTVTIGLADALRHIGKDAVIALREPSLGPVFGVKGGAAGGGYAQVLPM
                  70        80        90       100       110       120

                 130       140       150       160       170       180
m141.pep  EDINLHFTGDFHAIGAANNLLAAMLDNHIYQGNELNIDPKRVLWRRVVDMNDRQLRNIID
          ||||||||||||||||||||||||||||||||||||||||||||||||||||||||||||
g141      EDINLHFTGDFHAIGAANNLLAAMLDNHIYQGNELNIDPKRVLWRRVVDMNDRQLRNIID
                 130       140       150       160       170       180

                 190       200       210       220       230       240
m141.pep  GMGKPVDGVMRPDGFDITVASEVMAVFCLAKDISDLKERLGNILVAYAKDGSPVYAKDLK
          |||||||||||||||||||||||||||||||||||||||:||||||||||||||||||||
g141      GMGKPVDGVMRPDGFDITVASEVMAVFCLAKDISDLKERFGNILVAYAKDGSPVYAKDLK
                 190       200       210       220       230       240

                 250       260       270       280       290       300
m141.pep  ANGAMAALLKDAIKPNLVQTIEGTPAFVHGGPFANIAHGCNSVTATRLAKHLADYAVTEA
          |:||||||||||||||||||||||||||||||||||||||:|||||||||||||||||||
g141      AHGAMAALLKDAIKPNLVQTIEGTPAFVHGGPFANIAHGCNSVTATRLAKHLADYAVTEA
                 250       260       270       280       290       300
```

-continued

```
                310        320        330        340        350        360
m141.pep  GFGADLGAEKFCDIKCRLAGLKPDAAVVVATVRALKYNGGVERANLGEENLDALEKGLPN
          ||||||||||||||||||||||||||||||||||||||||||||||||||:|| |||||
g141      GFGADLGAEKFCDIKCRLAGLKPDAAVVVATVRALKYNGGVERANLGEENLEALAKGLPN
                310        320        330        340        350        360

                370        380        390        400        410        420
m141.pep  LLKHISNLKNVFGLPVVVALNRFVSDADAELAMIEKACAEHGVEVSLTEVWGKGGAGGAD
          |||||||||||||||||||||||||:||||||||||||||||||||||||||||||||||
g141      LLKHISNLKNVFGLPVVVALNRFVSDSDAELAMIEKACAEHGVEVSLTEVWGKGGAGGAD
                370        380        390        400        410        420

                430        440        450        460        470        480
m141.pep  LARKVVNAIESQTNNFGFAYDVELGIKDKIRAIAQKVYGAEDVDFSAEASAEIASLEKLG
          |||||||||::| |||||||||||||:|||||||||||||||||||||||||||||||||
g141      LARKVVNAIDNQPNNFGFAYDVELGIKDKIRAIAQKVYGAEDVDFSAEASAEIASLEKLG
                430        440        450        460        470        480

                490        500        510        520        530        540
m141.pep  LDKMPICMAKTQYSLSDNAKLLGCPEDFRIAVRGITVSAGAGFIVALCGNMMKMPGLPKV
          ||||||||||||||||||||||||||||||||||||||||||||||||||||||||||||
g141      LDKMPICMAKTQYSLSDNAKLLGCPEDFRIAVRGITVSAGAGFIVALCGNMMKMPGLPKV
                490        500        510        520        530        540

                550       559
m141.pep  PAAEKIDVDAEGVIHGLFX
          ||||||||| :||||||||
g141      PAAEKIDVDEHGVIHGLFX
                550
```

The following partial DNA sequence was identified in *N. meningitidis* <SEQ ID 557>:

a141.seq

```
   1 ATGAGTTTCA AAACCGATGC CGAAATCGCC CAATCCTCCA CCATGCGCCC
  51 GATTGGCGAA ATTGCCGCCA AGCTGGGTTT GAACGTTGAC AACATTGAGC
 101 CTTACGGTCA TTACAAAGCC AAAATCAATC CTGCCGAAGC GTTCAAACTG
 151 CCGCAAAAAC AGGGCAGGCT GATTTTGGTT ACCGCCATCA ACCCGACTCC
 201 GGCGGGCGAA GGTAAAACCA CCGTAACCAT CGGTTTGGCG GACGCATTGC
 251 GCCATATCGG CAAAGACTCT GTGATTGCTT TGCGCGAGCC TTCTTTGGGT
 301 CCGGTGTTCG GCGTGAAAGG CGGCGCGGCA GGCGGCGGCT ATGCCCAAGT
 351 TTTGCCGATG GAAGACATCA ACCTGCACTT CACCGGAGAT TTTCACGCCA
 401 TCGGTGCGGC AAATAATCTG CTTGCCGCGA TGCTCGACAA CCATATCTAC
 451 CAAGGCAACG AGTTGAACAT CGACCCCAAA CGCGTGCTGT GGCGGCGCGT
 501 GGTCGATATG AACGACCGCC AGTTGCGCAA CATCATCGAC GGCATGGGCA
 551 AGCCTGTTGA CGGCGTGATG CGTCCTGACG GTTTCGATAT TACCGTTGCT
 601 TCCGAAGTGA TGGCGGTATT CTGTCTTGCC AAAGACATCA GCGATTTGAA
 651 AGAGCGTTTG GGCAACATCC TTGTCGCCTA CGCCAAAGAC GGCAGCCCCG
 701 TTTACGCCAA AGATTTGAAA GCGAATGGCG CGATGGCGGC ATTGCTTAAA
 751 GATGCGATTA AGCCCAACTT GGTGCAAACC ATCGAAGGCA CGCCCGCCTT
 801 CGTACACGGC GGCCCGTTCG CCAACATCGC CCACGGCTGC AACTCCGTAA
 851 CCGCAACCCG TCTGGCGAAA CACCTTGCCG ATTACGCCGT AACCGAAGCA
 901 GGCTTCGGCG CGGACTTGGG CGCGGAAAAA TTCTGCGACA TCAAATGCCG
 951 CCTTGCCGGT TTGAAACCTG ATGCGGCTGT TGTCGTGGCG ACTGTCCGCG
1001 CGTTGAAATA TAACGGCGGC GTGGAACGCG CCAACCTCGG CGAAGAAAAT
```

-continued

```
1051 TTAGACGCTT TGGAAAAAGG TTTGCCCAAC CTGCTGAAAC ACATTTCCAA

1101 CCTGAAAAAC GTATTCGGAC TGCCCGTCGT CGTTGCGCTC AACCGCTTCG

1151 TGTCCGACTC CGATGCCGAG TTGGCGATGA TTGAAAAAGC CTGTGCCGAA

1201 CACGGCGTTG AAGTTTCCCT GACCGAAGTG TGGGGCAAAG GTGGTGCGGG

1251 CGGCGCGGAT TTGGCGCGCA AAGTCGTCAA CGCCATTGAA AGTCAAACCA

1301 ATAACTTCGG TTTCGCCTAC GATGTCGAGT TGGGCATCAA AGACAAAATC

1351 CGTGCGATTG CCCAAAAAGT GTACGGCGCG GAAGATGTTG ATTTCAGCGC

1401 GGAAGCGTCT GCCGAAATCG CTTCACTGGA AAAACTGGGC TTGGACAAAA

1451 TGCCGATCTG CATGGCGAAA ACCCAATACT CTTTGAGCGA CAACGCCAAA

1501 CTGTTGGGCT GCCCCGAAGA CTTCCGCATC GCCGTGCGCG GCATCACCGT

1551 TTCCGCAGGC GCAGGTTTCA TCGTCGCCCT GTGCGGCAAC ATGATGAAAA

1601 TGCCCGGCCT GCCCAAAGTT CCGGCTGCCG AGAAAATCGA TGTGGACGCA

1651 GAAGGCGTGA TTCACGGCTT GTTCTGA
```

This corresponds to the amino acid sequence <SEQ ID 558; ORF 141.a>:

a141.pep

```
  1 MSFKTDAEIA QSSTMRPIGE IAAKLGLNVD NIEPYGHYKA KINPAEAFKL
 51 PQKQGRLILV TAINPTPAGE GKTTVTIGLA DALRHIGKDS VIALREPSLG
101 PVFGVKGGAA GGGYAQVLPM EDINLHFTGD FHAIGAANNL LAAMLDNHIY
151 QGNELNIDPK RVLWRRVVDM NDRQLRNIID GMGKPVDGVM RPDGFDITVA
201 SEVMAVFCLA KDISDLKERL GNILVAYAKD GSPVYAKDLK ANGAMAALLK
251 DAIKPNLVQT IEGTPAFVHG GPFANIAHGC NSVTATRLAK HLADYAVTEA
301 GFGADLGAEK FCDIKCRLAG LKPDAAVVVA TVRALKYNGG VERANLGEEN
351 LDALEKGLPN LLKHISNLKN VFGLPVVVAL NRFVSDSDAE LAMIEKACAE
401 HGVEVSLTEV WGKGGAGGAD LARKVVNAIE SQTNNFGFAY DVELGIKDKI
451 RAIAQKVYGA EDVDFSAEAS AEIASLEKLG LDKMPICMAK TQYSLSDNAK
501 LLGCPEDFRI AVRGITVSAG AGFIVALCGN MMKMPGLPKV PAAEKIDVDA
551 EGVIHGLF*
```

65 m141/a141 99.5% identity in 558 aa overlap

```
                10        20        30        40        50        60
m141.pep  MSFKTDAEIAQSSTMRPIGEIAAKLGLNADNIEPYGHYKAKINPAEAFKLPQKQGRLILV
          |||||||||||||||||||||||||||:||||||||||||||||||||||||||||||||
a141      MSFKTDAEIAQSSTMRPIGEIAAKLGLNVDNIEPYGHYKAKINPAEAFKLPQKQGRLILV
                10        20        30        40        50        60

                70        80        90       100       110       120
m141.pep  TAINPTPAGEGKTTVTIGLADALRHIGKDAVIALREPSLGPVFGVKGGAAGGGYAQVLPM
          ||||||||||||||||||||||||||||||:|||||||||||||||||||||||||||||
a141      TAINPTPAGEGKTTVTIGLADALRHIGKDSVIALREPSLGPVFGVKGGAAGGGYAQVLPM
                70        80        90       100       110       120

               130       140       150       160       170       180
m141.pep  EDINLHFTGDFHAIGAANNLLAAMLDNHIYQGNELNIDPKRVLWRRVVDMNDRQLRNIID
          ||||||||||||||||||||||||||||||||||||||||||||||||||||||||||||
a141      EDINLHFTGDFHAIGAANNLLAAMLDNHIYQGNELNIDPKRVLWRRVVDMNDRQLRNIID
               130       140       150       160       170       180

               190       200       210       220       230       240
m141.pep  GMGKPVDGVMRPDGFDITVASEVMAVFCLAKDISDLKERLGNILVAYAKDGSPVYAKDLK
          ||||||||||||||||||||||||||||||||||||||||||||||||||||||||||||
a141      GMGKPVDGVMRPDGFDITVASEVMAVFCLAKDISDLKERLGNILVAYAKDGSPVYAKDLK
               190       200       210       220       230       240

               250       260       270       280       290       300
m141.pep  ANGAMAALLKDAIKPNLVQTIEGTPAFVHGGPFANIAHGCNSVTATRLAKHLADYAVTEA
          ||||||||||||||||||||||||||||||||||||||||||||||||||||||||||||
a141      ANGAMAALLKDAIKPNLVQTIEGTPAFVHGGPFANIAHGCNSVTATRLAKHLADYAVTEA
               250       260       270       280       290       300
               310       320       330       340       350       360
m141.pep  GFGADLGAEKFCDIKCRLAGLKPDAAVVVATVRALKYNGGVERANLGEENLDALEKGLPN
          ||||||||||||||||||||||||||||||||||||||||||||||||||||||||||||
a141      GFGADLGAEKFCDIKCRLAGLKPDAAVVVATVRALKYNGGVERANLGEENLDALEKGLPN
               310       320       330       340       350       360

               370       380       390       400       410       420
m141.pep  LLKHISNLKNVFGLPVVVALNRFVSDADAELAMIEKACAEHGVEVSLTEVWGKGGAGGAD
          ||||||||||||||||||||||||||:|||||||||||||||||||||||||||||||||
a141      LLKHISNLKNVFGLPVVVALNRFVSDSDAELAMIEKACAEHGVEVSLTEVWGKGGAGGAD
               370       380       390       400       410       420

               430       440       450       460       470       480
m141.pep  LARKVVNAIESQTNNFGFAYDVELGIKDKIRAIAQKVYGAEDVDFSAEASAEIASLEKLG
          ||||||||||||||||||||||||||||||||||||||||||||||||||||||||||||
a141      LARKVVNAIESQTNNFGFAYDVELGIKDKIRAIAQKVYGAEDVDFSAEASAEIASLEKLG
               430       440       450       460       470       480

               490       500       510       520       530       540
m141.pep  LDKMPICMAKTQYSLSDNAKLLGCPEDFRIAVRGITVSAGAGFIVALCGNMMKMPGLPKV
          ||||||||||||||||||||||||||||||||||||||||||||||||||||||||||||
a141      LDKMPICMAKTQYSLSDNAKLLGCPEDFRIAVRGITVSAGAGFIVALCGNMMKMPGLPKV
               490       500       510       520       530       540

               550      559
m141.pep  PAAEKIDVDAEGVIHGLFX
          |||||||||||||||||||
a141      PAAEKIDVDAEGVIHGLFX
               550
```

The following partial DNA sequence was identified in *N. gonorrhoeae* <SEQ ID 559>:

<u>g142.seq</u>

```
  1 ATGCGTGCCG ATTTCATGTT TGCCGACAAT ATGCCCGTGC AGGTGCGCCA

 51 ACGCGCCTTC TATTTCAAGT TGTCCCGTTT TGCCGCGATG CCAAATATGG

101 TAGGCAAACC GCTCTTCGGG CGACAGGCCG GTCAGCCCGG CAAAATGTTC

151 GGCAACATCC TGATGTTCGT CCGCCAGCAT ATTGATGCAG AGgCTGCCGT

201 TTTCCGACAG GATcggaATG AttcgCGCAC TCCGGTTTAT GCACAGCATC

251 ACGGTCGGCG GCTCGTCGGT AACCGGCGCA ACCGCCGTCA TTGTAATGCC

301 GTAACGCCCT GCCGCACCGT CTGTCGTGAT GACATGAACG CCTGCCGCAC

351 AGGATGCCAT CGCATCACGG AACGAAGTTT GAAAAGTTTT CTGCAAATCC
```

-continued

```
401 GCCATTTTTC CCCTTTAAAC CGTCCCCTAT ATAAGAATGC TGCACACAAG

451 GCATCCCCCC ATGTGCAGCA GTTCTGA
```

This corresponds to the amino acid sequence <SEQ ID 560; ORF 142.ng>:

g142.pep

```
  1 MRADFMFADN MPVQVRQRAF YFKLSRFAAM PNMVGKPLFG RQAGQPGKMF
 51 GNILMFVRQH IDAEAAVFRQ DRNDSRTPVY AQHHGRRLVG NRRNRRHCNA
101 VTPCRTVCRD DMNACRTGCH RITERSLKSF LQIRHFSPLN RPLYKNAAHK
151 ASPHVQQF*
```

The following partial DNA sequence was identified in *N. meningitidis* <SEQ ID 561>:

m142.seq

```
  1 ATGCGTGCCG ATTTCATGTT TGCCGACAAT ATGCCCGTGC AGGTGCGCCA
 51 ACGCGCCCTC TATTTCAAGT TGTCCCGTTT TGCCGCGATG CCAGATGTGG
101 TAGGCAAACC GCTCTTCGGG CGACAGGCCG GTCAGCCCGG CAAAATGTTC
151 GGCAACATCC TGATGTTCGT CCGCCAGCGT ATTGATGCAG AGGCTGCCGT
201 TTTCCGACAG GATCGGAATG ATTCGCGCAC TCCGGTTGAT GCACAGCATC
251 ACGGTCGGCG GCTCGTCGGT AACCGGCGCG ACCGCCGTCA TTGTAATGCC
301 GTAACGCCCT GCCGCACCGT CTGTCGTGAT GACATGAACG CCTGCCGCGC
351 AAGATGCCAT CGCATCACGG AACGAAGTTT GAAAATTTTT CTGCAAATCC
401 GCCATTTTTC CCCTTTAAAC TGTCCCCTAT ATAAGAATGC TGCACACAAG
451 GCATCCCCcC ATGTGCAGCA GTTTTGA
```

This corresponds to the amino acid sequence <SEQ ID 562; ORF 142>:

m142.pep

```
  1 MRADFMFADN MPVQVRQRAL YFKLSRFAAM PDVVGKPLFG RQAGQPGKMF
 51 GNILMFVRQR IDAEAAVFRQ DRNDSRTPVD AQHHGRRLVG NRRDRRHCNA
101 VTPCRTVCRD DMNACRARCH RITERSLKIF LQIRHFSPLN CPLYKNAAHK
151 ASPHVQQF*
```

Computer analysis of this amino acid sequence gave the following results:

Homology with a predicted ORF from *N. gonorrhoeae*

ORF 142 shows 93.7% identity over a 158 aa overlap with a predicted ORF (ORF 142.ng) from *N. gonorrhoeae*:

m142/g142

```
                10         20         30         40         50         60
m142.pep  MRADFMFADNMPVQVRQRALYFKLSRFAAMPDVVGKPLFGRQAGQPGKMFGNILMFVRQR
          ||||||||||||||||||:||||||||||||::||||||||||||||||||||||||||:
g142      MRADFMFADNMPVQVRQRAFYFKLSRFAAMPNMVGKPLFGRQAGQPGKMFGNILMFVRQH
                10         20         30         40         50         60

                70         80         90        100        110        120
m142.pep  IDAEAAVFRQDRNDSRTPVDAQHHGRRLVGNRRDRRHCNAVTPCRTVCRDDMNACRARCH
          ||||||||||||||||||||||||||||||||||:|||||||||||||||||||||: ||
g142      IDAEAAVFRQDRNDSRTPVDAQHHGRRLVGNRRNRRHCNAVTPCRTVCRDDMNACRTGCH
                70         80         90        100        110        120

               130        140        150       159
m142.pep  RITERSLKIFLQIRHFSPLNCPLYKNAAHKASPHVQQFX
          |||||||| ||||||||||| ||||||||||||||||||
g142      RITERSLKSFLQIRHFSPLNRPLYKNAAHKASPHVQQFX
               130        140        150
```

The following partial DNA sequence was identified in *N. meningitidis* <SEQ ID 563>:

a142.seq

```
  1 ATGCGTGCCG ATTTCATGTT TGCCGACAAT ATGCCCGTGC AGGTGCGCCA
 51 ACGCGCCCTC TATTTCAAGT TGTCCCGTTT TGCCGCGATG CCAGATGTGG
101 TAGGCAAACC GCTCTTCGGG CGACAGGCCG GTCAGCCCGG CAAAATGTTC
151 GGCAACATCC TGATGTTCGT CCGCCAGCGT ATTGATGCAG AGGCTGCCGT
201 TTTCCGACAG GATCGGAATG ATTCGCGCAC TCCGGTTGAT GCACAGCATC
251 ACGGTCGGCG GCTCGTCCGT AACCGGCGCA ACCGCCGTCA TTGTAATGCC
301 GTAACGCCCT GCCGCACCGT CTGTCGTGAT GACATGAACG CCTGCCGCAC
351 AGGATGCCAT CGCATCACGG AACGAAGTTT GAAAAGTTTT CTGCAAATCC
401 GCCATTTTTC CCCTTTAAAC TGTCCCCTAT ATAAGAATGC TGCACACAAG
451 GCACCCCCCA TGTGCAGCAG TTCTGATTCA AAAAGCCGTC GGTCGGACAT
501 TTCCGCGCGT TACGGCGTAT TACGAGTTCA ACGCATCCTC GATTTTGGCA
551 AGTTCTGCCA ACAGGTCTTT AAGCAGCAGC ATTTTCTCGC GGCCCAGCAC
601 TTCCTCGATA GCGTCGTAAC GCTCGTCCAC TTCTTCGCCG ATTTCCTCAT
651 ACAGCTTCTC GCCCTCGGCA GTCAGCTTCA GAAAAACACG TCGTTGGTCG
701 TTGGAAGGTT TCAGGCGGAC AACCAAACCC GCTTTTTCAA GGCGGGTCAG
751 GATACCGGTC AGGCTGGGGC GCAAAATGCA CGCCTGATTC GCCAAATCTT
801 GAAAGTCCAG CGTGCCGTTT TCCGCCAAAA GACGGATAAT CCGCCATTGC
851 TGATCGGTAA TATTCGCCTG ATTCAGAATA GGCCTGAATT GGGTCATCAG
901 GGCTTCCCTT GCCTGTATCA GACCGATATT GATAGACGCA TGTTTTGA
```

This corresponds to the amino acid sequence <SEQ ID 564; ORF 142.a>:

a142.pep

```
  1 MRADFMFADN MPVQVRQRAL YFKLSRFAAM PDVVGKPLFG RQAGQPGKMF
 51 GNILMFVRQR IDAEAAVFRQ DRNDSRTPVD AQHHGRRLVR NRRNRRHCNA
101 VTPCRTVCRD DMNACRTGCH RITERSLKSF LQIRHFSPLN CPLYKNAAHK
```

-continued

```
151 APPMCSSSDS KSRRSDISAR YGVLRVQRIL DFGKFCQQVF KQQHFLAAQH

201 FLDSVVTLVH FFADFLIQLL ALGSQLQKNT SLVVGRFQAD NQTRFFKAGQ

251 DTGQAGAQNA RLIRQILKVQ RAVFRQKTDN PPLLIGNIRL IQNRPELGHQ

301 GFPCLYQTDI DRRMF*
```

m142/a142 96.1% identity in 153 aa overlap

```
                  10        20        30        40        50        60
m142.pep  MRADFMFADNMPVQVRQRALYFKLSRFAAMPDVVGKPLFGRQAGQPGKMFGNILMFVRQR
          ||||||||||||||||||||||||||||||||||||||||||||||||||||||||||||
a142      MRADFMFADNMPVQVRQRALYFKLSRFAAMPDVVGKPLFGROAGQPGKMFGNILMFVRQR
                  10        20        30        40        50        60

                  70        80        90       100       110       120
m142.pep  IDAEAAVFRQDRNDSRTPVDAQHHGRRLVGNRRDRRHCNAVTPCRTVCRDDMNACRARCH
          ||||||||||||||||||||||||||||| |||:||||||||||||||||||||||: ||
a142      IDAEAAVFRQDRNDSRTPVDAQHHGRRLVRNRRNRRHCNAVTPCRTVCRDDMNACRTGCH
                  70        80        90       100       110       120

                 130       140       150      159
m142.pep  RITERSLKIFLQIRHFSPLNCPLYKNAAHKASPHVQQFX
          |||||||| |||||||||||||||||||||| |
a142      RITERSLKSFLQIRHFSPLNCPLYKNAAHKAPPMCSSSDSKSRRSDISARYGVLRVQRIL
                 130       140       150       160       170       180


a142      DFGKFCQQVFKQQHFLAAQHFLDSVVTLVHFFADFLIQLLALGSQLQKNTSLVVGRFQAD
                 190       200       210       220       230       240
```

The following partial DNA sequence was identified in *N. gonorrhoeae* <SEQ ID 565>:

g143.seq

```
  1 ATGTTGAGCT TCGGCTATCT CGGCGTTCAG ACGGCCTTTA CCCTGCAAAG

 51 CTCGCAGATG AGCCGCATTT TTCAAACGCT AGGCGCAGAC CCGCACAATT

101 TGGGCTGGTT TTTCATCCTG CCGCCGCTGG CGGGGATGCT GGTTCAGCCG

151 ATAGTGgGCT ACTACTCAGA CCGCACTTGG AAGCCGCGCT TGGGCGGCCG

201 CCGCCTGCCG TATCTGCTTT ACGGCACGCT GATTGCGGTC ATCGTGATGA

251 TTTTGATGCC GAACTCGGGC AGCTTCGGTT TCGGCTATGC GTCGCTGGCG

301 GCCTTGTCGT TCGGCGCGCT GATGATTGCG CTGTTGGACG TGTCGTCGAA

351 TATGGCGATG CAGCCGTTTA AGATGATGGT CGGCGATATG GTCAACGAGG

401 AGCAGAAAAG CTACGCCTAC GGGATTCAAA GTTTCTTAGC GAATACGGAC

451 GCGGTTGTGG CAGCGATTCT GCCGTTTGTG TTcgcgtata TCGGTTTGGC

501 GAACACTGCC GAGAAAGGCG TTGTGCCACA AACCGTGGTC GTAGCATTCT

551 ATGTGGGTGC GGCGTTACTG ATTATTACCA GTGCGTTCAC AATCTCCAAA

601 GTCAAAGAAT ACGACCCGGA AACCTACGCC CGTTACCACG GCATCGATGT

651 CGCCGCGAAT CAGGAAAAAG CCAACTGGTT CGAACTCTTA AAAACCGCGC

701 CTAAAGTGTT TTGGACGGTT ACTCCGGTAC AGTTTTTCTG CTGGTTCGCC

751 TTCCGGTATA TGTGGACTTA CTCGGCAGGC GCGATTGCAG AAAACGTCTG

801 GCACACTACC GATGCGTCTT CCGTAGGCCA TCAGGAGGCG GGCAACCGGT

851 ACGGCGTTTT GGCGGCGGTG TAGTCGGTTG CGGCGGTGAT TTGTTCGTTT
```

-continued

```
 901 ATTCTGGCAA AAGTACCGAA TAAATACCAT AAGGCGGGTT ATTTCGGCTG

 951 TTTGGCTTTG GGCGCGCTCG GTTTCTTCTC TATCTTCTTC ATCTACAATC

1001 AATACGCACT CATCCTGTCT TATATCTTAA TCGGCATCGC TTGGGCGGGC

1051 ATTATCACTT ATCCGCTGAC GATTGTGGCC AACGCTTTGT CGGGCAAACA

1101 CATGGATACT TATTTGGGCC TGTttaacgg ctctgtCTGT ATGCcgcaaa

1151 tcgTcgctTC GctgttgAGT TTCGTGCTTT TCCCGATGCT GGGCGGCCAT

1201 CAGGCAACCA TGTTCTTGGT TGCAGGCGCA GTCTTGCTGC TGGGAGCCTT

1251 CTCAGTCTGT CTGATTAAAG AGATCCACGG CGGGGTTTGA
```

This corresponds to the amino acid sequence <SEQ ID 566; ORF 143.ng>:

g143.pep

```
  1 MLSFGYLGVQ TAFTLQSSQM SRIFQTLGAD PHNLGWFFIL PPLAGMLVQP

 51 IVGYYSDRTW KPRLGGRRLP YLLYGTLIAV IVMILMPNSG SFGFGYASLA

101 ALSFGALMIA LLDVSSNMAM QPFKMMVGDM VNEEQKSYAY GIQSFLANTD

151 AVVAAILPFV FAYIGLANTA EKGVVPQTVV VAFYVGAALL IITSAFTISK

201 VKEYDPETYA RYHGIDVAAN QEKANWFELL KTAPKVFWTV TPVQFFCWFA

251 FRYMWTYSAG AIAENVWHTT DASSVGHQEA GNRYGVLAAV *SVAAVICSF

301 ILAKVPNKYH KAGYFGCLAL GALGFFSIFF IYNQYALILS YILIGIAWAG

351 IITYPLTIVA NALSGKHMDT YLGLFNGSVC MPQIVASLLS FVLFPMLGGH

401 QATMFLVAGA VLLLGAFSVC LIKEIHGGV*
```

The following partial DNA sequence was identified in *N. meningitidis* <SEQ ID 567>:

m143.seq

```
  1 ATGCTCAGTT TCGGCTTTCT CGGCGTTCAG ACGGCCTTTA CCCTGCAAAG

 51 CTCGCAAATG AGCCGCATTT TTCAAACGCT AGGCGCAGAC CCGCACAATT

101 TGGGCTGGTT TTTCATCCTG CCGCCGCTGG CGGGGATGCT GGTGCAGCCG

151 ATTGTCGGCC ATTACTCCGA CCGCACTTGG AAGCCGCGTT TGGGCGGCCG

201 CCGTCTGCCG TATCTGCTTT ATGGCACGCT GATTGCGGTT ATTGTGATGA

251 TTTTGATGCC GAACTCGGGC AGCTTCGGTT TCGGCTATGC GTCGCTGGCG

301 GCTTTGTCGT TCGGCGCGCT GATGATTGCG CTGTTAGACG TGTCGTCAAA

351 TATGGCGATG CAGCCGTTTA AGATGATGGT CGGCGACATG GTCAACGAGG

401 AGCAGAAAGG CTACGCCTAC GGGATTCAAA GTTTCTTAGC AAATACGGGC

451 GCGGTCGTGG CGGCGATTCT GCCGTTTGTG TTTGCGTATA TCGGTTTGGC

501 GAACACCGCC GAGAAAGGCG TTGTGCCGCA GACCGTGGTC GTGGCGTTTT

551 ATGTGGGTGC GGCGTTGCTG GTGATTACCA GCGCGTTCAC GATTTTCAAA

601 GTGAAGGAAT ACGATCCGGA AACCTACGCC CGTTACCACG GCATCGATGT

651 CGCCGCGAAT CAGGAAAAAG CCAACTGGAT CGAACTCTTG AAAACCGCGC

701 CTAAGGCGTT TTGGACGGTT ACTTTGGTGC AATTCTTCTG CTGGTTCGCC
```

-continued

```
 751 TTCCAATATA TGTGGACTTA CTCGGCAGGC GCGATTGCGG AAAACGTCTG

 801 GCACACCACC GATGCGTCTT CCGTAGGTTA TCAGGAGGCG GGTAACTGGT

 851 ACGGCGTTTT GGCGGCGGTG CAGTCGGTTG CGGCGGTGAT TTGTTCGTTT

 901 GTATTGGCGA AAGTGCCGAA TAAATACCAT AAGGCGGGTT ATTTCGGCTG

 951 TTTGGCTTTG GGCGCGCTCG GCTTTTTCTC CGTTTTCTTC ATCGGCAACC

1001 AATACGCGCT GGTGTTGTCT TATACCTTAA TCGGCATCGC TTGGGCGGGC

1051 ATTATCACTT ATCCGCTGAC GATTGTGACC AACGCCTTGT CGGGCAAGCA

1101 TATGGGCACT TACTTGGGCT TGTTTAACGG CTCTATCTGT ATGCCTCAAA

1151 TCGTCGCTTC GCTGTTGAGT TTCGTGCTTT TCCCTATGCT GGGCGGCTTG

1201 CAGGCCACTA TGTTCTTGGT AGGGGGCGTC GTCCTGCTGC TGGGCGCGTT

1251 TTCCGTGTTC CTGATTAAAG AAACACACGG CGGGGTTTGA
```

This corresponds to the amino acid sequence <SEQ ID 568; ORF 143>:

m143.pep

```
  1 MLSFGFLGVQ TAFTLQSSQM SRIFQTLGAD PHNLGWFFIL PPLAGMLVQP

 51 IVGHYSDRTW KPRLGGRRLP YLLYGTLIAV IVMILMPNSG SFGFGYASLA

101 ALSFGALMIA LLDVSSNMAM QPFKMMVGDM VNEEQKGYAY GIQSFLANTG

151 AVVAAILPFV FAYIGLANTA EKGVVPQTVV VAFYVGAALL VITSAFTIFK

201 VKEYDPETYA RYHGIDVAAN QEKANWIELL KTAPKAFWTV TLVQFFCWFA

251 FQYMWTYSAG AIAENVWHTT DASSVGYQEA GNWYGVLAAV QSVAAVICSF

301 VLAKVPNKYH KAGYFGCLAL GALGFFSVFF IGNQYALVLS YTLIGIAWAG

351 IITYPLTIVT NALSGKHMGT YLGLFNGSIC MPQIVASLLS FVLFPMLGGL

401 QATMFLVGGV VLLLGAFSVF LIKETHGGV*
```

Computer analysis of this amino acid sequence gave the following results:

Homology with a predicted ORF from *N. gonorrhoeae*
m143/g143 93.9% identity in 429 aa overlap

```
                    10        20        30        40        50        60
m143.pep    MLSFGFLGVQTAFTLQSSQMSRIFQTLGADPHNLGWFFILPPLAGMLVQPIVGHYSDRTW
            |||||:|||||||||||||||||||||||||||||||||||||||||||||||:||||||
g143        MLSFGYLGVQTAFTLQSSQMSRIFQTLGADPHNLGWFFILPPLAGMLVQPIVGYYSDRTW
                    10        20        30        40        50        60

                    70        80        90       100       110       120
m143.pep    KPRLGGRRLPYLLYGTLIAVIVMILMPNSGSFGFGYASLAALSFGALMIALLDVSSNMAM
            ||||||||||||||||||||||||||||||||||||||||||||||||||||||||||||
g143        KPRLGGRRLPYLLYGTLIAVIVMILMPNSGSFGFGYASLAALSFGALMIALLDVSSNMAM
                    70        80        90       100       110       120

                   130       140       150       160       170       180
m143.pep    QPFKMMVGDMVNEEQKGYAYGIQSFLANTGAVVAAILPFVFAYIGLANTAEKGVVPQTVV
            ||||||||||||||||:|||||||||||| ||||||||||||||||||||||||||||||
g143        QPFKMMVGDMVNEEQKSYAYGIQSFLANTDAVVAAILPFVFAYIGLANTAEKGVVPQTVV
                   130       140       150       160       170       180

                   190       200       210       220       230       240
m143.pep    VAFYVGAALLVITSAFTIFKVKEYDPETYARYHGIDVAANQEKANWIELLKTAPKAFWTV
            ||||||||||:||||||| |||||||||||||||||||||||||||:||||||||:||||
g143        VAFYVGAALLIITSAFTISKVKEYDPETYARYHGIDVAANQEKANWFELLKTAPKVFWTV
                   190       200       210       220       230       240
```

-continued

```
                250       260       270       280       290       300
m143.pep  TLVQFFCWFAFQYMWTYSAGAIAENVWHTTDASSVGYQEAGNWYGVLAAVQSVAAVICSF
          | |||||||||:||||||||||||||||||||||||:||||| ||||||| |||||||||
g143      TPVQFFCWFAFRYMWTYSAGAIAENVWHTTDASSVGHQEAGNRYGVLAAVXSVAAVICSF
                250       260       270       280       290       300

310       320       330       340       350       360
m143.pep  VLAKVPNKYHKAGYFGCLALGALGFFSVFFIGNQYALVLSYTLIGIAWAGIITYPLTIVT
          :||||||||||||||||||||||||||:||| |||||:||| |||||||||||||||||:
g143      ILAKVPNKYHKAGYFGCLALGALGFFSIFFIYNQYALILSYILIGIAWAGIITYPLTIVA
                310       320       330       340       350       360

370       380       390       400       410       420
m143.pep  NALSGKHMGTYLGLFNGSICMPQIVASLLSFVLFPMLGGLQATMFLVGGVVLLLGAFSVF
          |||||||| |||||||||:|||||||||||||||||||| |||||||:|:||||||||| 
g143      NALSGKHMDTYLGLFNGSVCMPQIVASLLSFVLFPMLGGHQATMFLVAGAVLLLGAFSVC
                370       380       390       400       410       420

430
m143.pep  LIKETHGGVX
          |||| |||||
g143      LIKEIHGGVX
                430
```

The following partial DNA sequence was identified in *N. meningitidis* <SEQ ID 569>:

a143.seq

```
   1 ATGCTCAGTT TCGGCTTTCT CGGCGTTCAG ACGGCCTTTA CCCTGCAAAG
  51 CTCGCAGATG AGCCGCATCT TCCAGACGCT CGGTGCCGAT CCGCACAGCC
 101 TCGGCTGGTT CTTTATCCTG CCGCCGCTGG CGGGGATGCT GGTGCAGCCG
 151 ATTGTCGGCC ATTACTCCGA CCGCACTTGG AAGCCGCGTT TGGGCGGCCG
 201 CCGTCTGCCG TATCTGCTTT ATGGCACGCT GATTGCGGTT ATTGTGATGA
 251 TTTTGATGCC GAACTCGGGC AGCTTCGGTT TCGGCTATGC GTCGCTGGCG
 301 GCTTTGTCGT TCGGCGCGCT GATGATTGCG CTGTTAGACG TGTCGTCAAA
 351 TATGGCGATG CAGCCGTTTA AGATGATGGT CGGCGACATG GTCAACGAGG
 401 AGCAGAAAGG CTACGCCTAC GGGATTCAAA GTTTCTTAGC GAATACGGGC
 451 GCGGTCGTGG CGGCGATTCT GCCGTTTGTG TTTGCGTATA TCGGTTTGGC
 501 GAACACCGCC GAGAAAGGCG TTGTGCCGCA GACCGTGGTC GTGGCGTTTT
 551 ATGTGGGTGC GGCGTTGCTG GTGATTACCA GCGCGTTCAC GATTTTCAAA
 601 GTGAAGGAAT ACAATCCGGA AACCTACGCC CGTTACCACG GCATCGATGT
 651 CGCCGCGAAT CAGGAAAAAG CCAACTGGAT CGAACTCTTG AAAACCGCGC
 701 CTAAGGCGTT TTGGACGGTT ACTTTGGTGC AATTCTTCTG CTGGTTCGCC
 751 TTCCAATATA TGTGGACTTA CTCGGCAGGC GCGATTGCGG AAAACGTCTG
 801 GCACACCACC GATGCGTCTT CCGTAGGTTA TCAGGAGGCG GGTAACTGGT
 851 ACGGCGTTTT GGCGGCGGTG CAGTCGGTTG CGGCGGTGAT TTGTTCGTTT
 901 GTATTGGCGA AAGTGCCGAA TAAATACCAT AAGGCGGGTT ATTTCGGCTG
 951 TTTGGCTTTG GGCGCGCTCG GCTTTTTCTC CGTTTTCTTC ATCGGCAACC
1001 AATACGCGCT GGTGTTGTCT TATACCTTAA TCGGCATCGC TTGGGCGGGC
1051 ATTATCACTT ATCCGCTGAC GATTGTGACC AACGCCTTGT CGGGCAAGCA
1101 TATGGGCACT TACTTGGGCC TGTTTAACGG CTCTATCTGT ATGCCGCAAA
1151 TCGTCGCTTC GCTGTTGAGT TTCGTGCTTT TCCCTATGCT GGGCGGCTTG
1201 CAGGCCACTA TGTTCTTGGT AGGGGGCGTC GTCCTGCTGC TGGGCGCGTT
1251 TTCCGTGTTC CTGATTAAAG AAACACACGG CGGGGTTTGA
```

This corresponds to the amino acid sequence <SEQ ID 570; ORF 143.a>:

a143.pep

```
  1 MLSFGFLGVQ TAFTLQSSQM SRIFQTLGAD PHSLGWFFIL PPLAGMLVQP
 51 IVGHYSDRTW KPRLGGRRLP YLLYGTLIAV IVMILMPNSG SFGFGYASLA
101 ALSFGALMIA LLDVSSNMAM QPFKMMVGDM VNEEQKGYAY GIQSFLANTG
151 AVVAAILPFV FAYIGLANTA EKGVVPQTVV VAFYVGAALL VITSAFTIFK
201 VKEYNPETYA RYHGIDVAAN QEKANWIELL KTAPKAFWTV TLVQFFCWFA
251 FQYMWTYSAG AIAENVWHTT DASSVGYQEA GNWYGVLAAV QSVAAVICSF
301 VLAKVPNKYH KAGYFGCLAL GALGFFSVFF IGNQYALVLS YTLIGIAWAG
351 IITYPLTIVT NALSGKHMGT YLGLFNGSIC MPQIVASLLS FVLFPMLGGL
401 QATMFLVGGV VLLLGAFSVF LIKETHGGV*
```

m143/a143 99.5% identity in 429 aa overlap

```
                    10        20        30        40        50        60
m143.pep    MLSFGFLGVQTAFTLQSSQMSRIFQTLGADPHNLGWFFILPPLAGMLVQPIVGHYSDRTW
            ||||||||||||||||||||||||||||||||:|||||||||||||||||||||||||||
a143        MLSFGFLGVQTAFTLQSSQMSRIFQTLGADPHSLGWFFILPPLAGMLVQPIVGHYSDRTW
                    10        20        30        40        50        60

                    70        80        90       100       110       120
m143.pep    KPRLGGRRLPYLLYGTLIAVIVMILMPNSGSFGFGYASLAALSFGALMIALLDVSSNMAM
            ||||||||||||||||||||||||||||||||||||||||||||||||||||||||||||
a143        KPRLGGRRLPYLLYGTLIAVIVMILMPNSGSFGFGYASLAALSFGALMIALLDVSSNMAM
                    70        80        90       100       110       120

                   130       140       150       160       170       180
m143.pep    QPFKMMVGDMVNEEQKGYAYGIQSFLANTGAVVAAILPFVFAYIGLANTAEKGVVPQTVV
            ||||||||||||||||||||||||||||||||||||||||||||||||||||||||||||
a143        QPFKMMVGDMVNEEQKGYAYGIQSFLANTGAVVAAILPFVFAYIGLANTAEKGVVPQTVV
                   130       140       150       160       170       180

                   190       200       210       220       230       240
m143.pep    VAFYVGAALLVITSAFTIFKVKEYDPETYARYHGIDVAANQEKANWIELLKTAPKAFWTV
            ||||||||||||||||||||||||:|||||||||||||||||||||||||||||||||||
a143        VAFYVGAALLVITSAFTIFKVKEYNPETYARYHGIDVAANQEKANWIELLKTAPKAFWTV
                   190       200       210       220       230       240

                   250       260       270       280       290       300
m143.pep    TLVQFFCWFAFQYMWTYSAGAIAENVWHTTDASSVGYQEAGNWYGVLAAVQSVAAVICSF
            ||||||||||||||||||||||||||||||||||||||||||||||||||||||||||||
a143        TLVQFFCWFAFQYMWTYSAGAIAENVWHTTDASSVGYQEAGNWYGVLAAVQSVAAVICSF
                   250       260       270       280       290       300

                   310       320       330       340       350       360
m143.pep    VLAKVPNKYHKAGYFGCLALGALGFFSVFFIGNQYALVLSYTLIGIAWAGIITYPLTIVT
            ||||||||||||||||||||||||||||||||||||||||||||||||||||||||||||
a143        VLAKVPNKYHKAGYFGCLALGALGFFSVFFIGNQYALVLSYTLIGIAWAGIITYPLTIVT
                   310       320       330       340       350       360

                   370       380       390       400       410       420
m143.pep    NALSGKHMGTYLGLFNGSICMPQIVASLLSFVLFPMLGGLQATMFLVGGVVLLLGAFSVF
            ||||||||||||||||||||||||||||||||||||||||||||||||||||||||||||
a143        NALSGKHMGTYLGLFNGSICMPQIVASLLSFVLFPMLGGLQATMFLVGGVVLLLGAFSVF
                   370       380       390       400       410       420

                   430
m143.pep    LIKETHGGVX
            ||||||||||
a143        LIKETHGGVX
                   430
```

The following partial DNA sequence was identified in *N. gonorrhoeae* <SEQ ID 571>:

g144.seq

```
  1 ATGAGCGATA CCCCCGCTAC CCGCGATTTC GGCCTGATCG ACGGGCGGGC
 51 CGTAACCGGC TATGTGCTGT CCAACCGGCG TGGTACGTGC GTCTTCGTGC
```

-continued

```
101 TGGACTTGGG CGGGATTGTG CAGGAATTTT CCGTTTTGGC AGACGGCGTG
151 CGCGAAAACC CCGTGGTGTC GTTCGACGAT GCGGCTTCCT ATGCGGACAA
201 TCCGTTTCAG ATTAACAAGC AGATAGGGCG CGTGGCCGGA CGCATCCGCG
251 GTGCGGCGTT CGACATCAAC GGTAGGACTT ACCGCGTGGA GGCCAACGAA
301 GGCAGGAACG CGCTGCACGG CGGTTCGCAC GGGCTGGCCG TTACCcgtTT
351 CAACGCGGTG GCGGCAGACG GccgacggTt atCCCAACGA TTTGGatatT
401 TCctaccgCT TGGACGAGGA CGGCCGGCTT ACCGTtaccT ATCGCGCCAC
451 CGCgctCGGC GACACGGTGT TCGACCCGAC GCTGCACATT TACTGGCGGC
501 TGGACGCGGG CCTGCACGAT GCGGTTCTGC ATATTCCGCA GGGCGGACAT
551 ATTCCGGCCG ATGCCGAAAA ACTGCCCGTC TTAACGGTTT CAGACGGCCT
601 CGAAGTATTT GA
```

This corresponds to the amino acid sequence <SEQ ID 572; ORF 144.ng>:

g144.pep

```
  1 MSDTPATRDF GLIDGRAVTG YVLSNRRGTC VFVLDLGGIV QEFSVLADGV
 51 RENPVVSFDD AASYADNPFQ INKQIGRVAG RIRGAAFDIN GRTYRVEANE
101 GRNALHGGSH GLAVTRFNAV AADGRRLSQR FGYFLPLGRG RPAYRYLSRH
151 PARRHGVRPD AAHLLAAGRG PARCGSAYSA GRTYSGRCRK TARLNGFRRP
201 RSI*
```

The following partial DNA sequence was identified in *N. meningitidis* <SEQ ID 573>:

m144.seq

```
  1 ATGAGCGATA CCCCCGCTAC CCGCGATTTC GGTCTGATCG ACGGGCGTGC
 51 CGTAACCGGC TATGTGCTGT CCAACCGGCG TGGTACGCGT GTCTGCGTGC
101 TGGACTTGGG CGGGATTGTG CAGGAATTTT CCGTTTTGGC AGACGGCGTG
151 CGCGAAAACC TCGTGGTGTC GTTCGATGAT GCGGCTTCCT ATGCGGACAA
201 TCCGTTTCAG ATTAACAAAC AGATAGGGCG CGTGGCCGGA CGCATCCGCG
251 GTGCGGCGTT CGACATCAAC GGCAGGACTT ACCGCGTGGA GGCCAACGAA
301 GGCAGGAACG CGCTGCACGG CGGTTCGCAC GGGCTGGCCG TTACCCGTTT
351 CAACGCGGTG GCGGCAGACG GCCGTTCGGT GGTGCTGCGC AGCCGCCTGg
401 CAACAGTCGG CCGACGGTTA TCCCAACGAT TTGGATTTGG ATATTTCCTA
451 CCGCTTGGAC GAGGACGACC GGCTTACCGT TAcCTATCGC GCCACCGCGC
501 TCGGCGACAC GGTGTTCGAC CCGACGCTGC ACATTTACTG GCGGCTGGAC
551 GCGGGCCTGC ACGATGCGGT TCTGCATATT CCGCAGGGCG GACATATGCC
601 GGCCGATGCC GAAAAACTGC CCGTCTCAAC GGTTTCAGAC GACCTCGAAG
651 TATTTGA
```

This corresponds to the amino acid sequence <SEQ ID 574; ORF 144>:

m144.pep

```
  1 MSDTPATRDF GLIDGRAVTG YVLSNRRGTR VCVLDLGGIV QEFSVLADGV
 51 RENLVVSFDD AASYADNPFQ INKQIGRVAG RIRGAAFDIN GRTYRVEANE
101 GRNALHGGSH GLAVTRFNAV AADGRSVVLR SRLATVGRRL SQRFGFGYFL
151 PLGRGRPAYR YLSRHRARRH GVRPDAAHLL AAGRGPARCG SAYSAGRTYA
201 GRCRKTARLN GFRRPRSI*
```

Computer analysis of this amino acid sequence gave the following results:

Homology with a predicted ORF from *N. gonorrhoeae*
m144/g144 91.3% identity in 218 aa overlap

```
                   10        20        30        40        50        60
m144.pep   MSDTPATRDFGLIDGRAVTGYVLSNRRGTRVCVLDLGGIVQEFSVLADGVRENLVVSFDD
           |||||||||||||||||||||||||||||| | |||||||||||||||||||| ||||||
g144       MSDTPATRDFGLIDGRAVTGYVLSNRRGTCVFVLDLGGIVQEFSVLADGVRENPVVSFDD
                   10        20        30        40        50        60

                   70        80        90       100       110       120
m144.pep   AASYADNPFQINKQIGRVAGRIRGAAFDINGRTYRVEANEGRNALHGGSHGLAVTRFNAV
           ||||||||||||||||||||||||||||||||||||||||||||||||||||||||||||
g144       AASYADNPFQINKQIGRVAGRIRGAAFKINGRTYRVEANEGRNALHGGSHGLAVTRFNAV
                   70        80        90       100       110       120

                  130       140       150       160       170       180
m144.pep   AADGRSVVLRSRLATVGRRLSQRFGFGYFLPLGRGRPAYRYLSRHRARRHGVRPDAAHLL
           |||             ||||||||  ||||||||||||||||||||||||||||||||||
g144       AAD-------------GRRLSQRFG--YFLPLGRGRPAYRYLSRHRARRHGVRPDAAHLL
                             130       140       150       160

                  190       200       210      219
m144.pep   AAGRGRARCGSAYSAGRTYAGRCRKTARLNGFRRPRSIX
           ||||||||||||||||||:||||||||||||||||||||
g144       AAGRGPARCGSAYSAGRTYSGRCRKTARLNGFRRPRSIX
             170       180       190       200
```

The following partial DNA sequence was identified in *N. meningitidis* <SEQ ID 575>:

a144.seq

```
  1 ATGAGCGATA CCCCCGCTAC CCGCGATTTC GGCCTGATCG ACGGGCGTGC
 51 CGTAACCGGC TATGTGCTGT CCAACCGGCG TGGTACGCGT GTCTGCGTGC
101 TGGACTTGGG CGGGATTGTG CAGGAATTTT CCGTTTTGGC AGACGGCGTG
151 CGCGAAAACC TCGTGGTGTC GTTCGACGAT GCGGCTTCCT ATGCGGACAA
201 TCCGTTTCAG ATTAACAAGC AGATAGGGCG CGTGGCCGGA CGCATCCGCG
251 GTGCGGCGTT CGACATCAAC GGCAGGACTT ACCGCGTGGA GGCCAACGAA
301 GGCAGGAACG CGCTGCACGG CGGTTCGCAC GGGCTGGCCG TTACCCGTTT
351 CAACGCGGTG GCGGCAGACG GCCGTTCGGT GGTGCTGCGC AGCCGCCTG.
401 CAACAGTCGG CCGACGGTTA TCCCAACGAT TTGGATTTGG ATATTTCCTA
451 CCGCTTGGAC GAGGACGACC GGCTTACCGT TACCTATCGC GCCACCGCGC
501 TCGGCGACAC GGTGTTCGAC CCGACGCTGC ACATTTACTG GCGGCTGGAC
551 GCGGGCCTGC ACGATGCGGT TCTGCATATT CCGCAGGGCG GACATATTCC
601 GGCCGATGCC GAAAAACTGC CCGTCTCAAC GGTTTCAGAC GACCTCGAAG
651 TATTTGA
```

This corresponds to the amino acid sequence <SEQ ID 576; ORF 144.a>:

```
a144.pep

  1 MSDTPATRDF GLIDGRAVTG YVLSNRRGTR VCVLDLGGIV QEFSVLADGV

 51 RENLVVSFDD AASYADNPFQ INKQIGRVAG RIRGAAFDIN GRTYRVEANE

101 GRNALHGGSH GLAVTRFNAV AADGRSVVLR SRLXTVGRRL SQRFGFGYFL

151 PLGRGRPAYR YLSRHRARRH GVRPDAAHLL AAGRGPARCG SAYSAGRTYS

201 GRCRKTARLN GFRRPRSI*
```

m144/a144 99.1% identity in 218 aa overlap

```
                  10        20        30        40        50        60
m144.pep  MSDTPATRDFGLIDGRAVTGYVLSNRRGTRVCVLDLGGIVQEFSVLADGVRENLVVSFDD
          ||||||||||||||||||||||||||||||||||||||||||||||||||||||||||||
a144      MSDTPATRDFGLIDGRAVTGYVLSNRRGTRVCVLDLGGIVQEFSVLADGVRENLVVSFDD
                  10        20        30        40        50        60

                  70        80        90       100       110       120
m144.pep  AASYADNPFQINKQIGRVAGRIRGAAFDINGRTYRVEANEGRNALHGGSHGLAVTRFNAV
          ||||||||||||||||||||||||||||||||||||||||||||||||||||||||||||
a144      AASYADNPFQINKQIGRVAGRIRGAAFKINGRTYRVEANEGRNALHGGSHGLAVTRFNAV
                  70        80        90       100       110       120
                 130       140       150       160       170       180
m144.pep  AADGRSVVLRSRLATVGRRLSQRFGFGYFLPLGRGRPAYRYLSRHRARRHGVRPDAAHLL
          |||||||||||| |||||||||||||||||||||||||||||||||||||||||||||||
a144      AADGRSVVLRSRLXTVGRRLSQRFGFGYFLPLGRGRPAYRYLSRHRARRHGVRPDAAHLL
                 130       140       150       160       170       180
                 190       200       210      219
m144.pep  AAGRGPARCGSAYSAGRTYAGRCRKTARLNGFRRPRSIX
          |||||||||||||||||||:|||||||||||||||||||
a144      AAGRGPARCGSAYSAGRTYSGRCRKTARLNGFRRPRSIX
                 190       200       210
```

The following partial DNA sequence was identified in *N. gonorrhoeae* <SEQ ID 577>:

```
g146.seq

  1 ATGAAGCAAA TCCCCCTCCG CCTTCTCCAG GTCGTCATTG ACCACGACAA

 51 AGTCGAACAA TACGGACTGT TCGATTTCAT GCCTTGCCTT CGACAGCCTC

101 CTTTGGATAa ctTCCCGACT GTCCGTCCCG CGCcctTTGA GGCGCGCGGC

151 AAGCACGTCG AAAGAAGGCG GCAGGATAAA GATACCGACA GCTTCCGGCA

201 GCGCGTTGCG AACCTGCGCC GCGCCCTGAA CGTCGATTTC CAAAATCACG

251 TCATAGCCTG CCGCCGCCAA CGCATTCACG CCCTCCGTGC TTGTGCCGTA

301 ATAGTTGCCG AATACGTCTG CGTATTCCAA AAAAGCCTCC TGCGCGATAA

351 GCGATTCAAA CTCTTCTTTG GAAACAAAGT GATAATGTAC GCCGTTTGCT

401 TCGCCTTCAC GCGGCGGGCG CGTCGTATGC GACACGGAAA CGCGCAAACC

451 GTTATGGTTT GCCAACAGCC GCGACACCAG CGTGGTTTTG CCCGTGCCGG

501 AAGCGGCCGA AATGATAAAG ATGTTGCCTT TTCGATAAGC GGACATATTT

551 TTTACCTGTA TATTTTCCAA CCGATTGTAT CACAACGGAC ACCCTATTTC

601 ATATTTGCCG ATGCCCATAT TTTGCCGCTA TTGTTTTGA
```

This corresponds to the amino acid sequence <SEQ ID 578; ORF 146.ng>:

g146.pep

```
  1 MKQIPLRLLQ VVIDHDKVEQ YGLFDFMPCL RQPPLDNFPT VRPAPFEARG
 51 KHVERRRQDK DTDSFRQRVA NLRRALNVDF QNHVIACRRQ RIHALRACAV
101 IVAEYVCVFQ KSLLRDKRFK LFFGNKVIMY AVCFAFTRRA RRMRHGNAQT
151 VMVCQQPRHQ RGFARAGSGR NDKDVAFSIS GHIFYLYIFQ PIVSQRTPYF
201 IFADAHILPL LF*
```

The following partial DNA sequence was identified in *N. meningitidis* <SEQ ID 579>:

m146.seq

```
  1 ATGGCGCAAA TCCTCCTCCG CTCGCGCCAA GTCGTCATTG ACCACGACAA
 51 AGTCAAACAA TACGGACTGC TCGATTTCAT GCCTTGCCTT CGACAGCCTC
101 CTTTGGATAA CTTCCCGACT GTCCGTCCCG CGTCCGTTGA GGCGCGCGGC
151 AAGTACGTCG AAAGAAGGCG GCAGGATAAA GATGCCGACG GCTTCGGGCA
201 GCGCGTCGCG AACCTGCGCC GCGCCCTGAA CGTCGATTTC CAAAATCACG
251 TCATAGCCTG CCGCCGCCAA CGCATTCACA CCCTCCGCGC CTGTGCCGTA
301 ATAGTTGCCA AATACGTCGG CGTATTCCAA AAAAGCTTCC TGCGCGATAA
351 GCGACTCAAA CTCTTCTTTG GAAACAAAGT GATAATGTAC GCCGTTTGCT
401 TCGCCTTCAC GCGGCGGGCG CGTCGTGTGC GACACGGAAA CGCGCAAACC
451 GTTATGGTTT GCCAACAGCC GCGACACCAG CGTGGTTTTG CCCGTGCCGG
501 AAGCGGCCGA AATGATAAAG ATGTTGCCTT TTCGATAAGC GGACATATTT
551 TTTACCTGTA TATTTTCCAG CCGATTGTAT CACAATGGAC ACCCAGTTTC
601 CTATTTGCCG ATGCCCATAT TTTGCCGCTA TTGTTTTGA
```

This corresponds to the amino acid sequence <SEQ ID 580; ORF 146>:

m146.pep

```
  1 MAQILLRSRQ VVIDHDKVKQ YGLLDFMPCL RQPPLDNFPT VRPASVEARG
 51 KYVERRRQDK DADGFGQRVA NLRRALNVDF QNHVIACRRQ RIHTLRACAV
101 IVAKYVGVFQ KSFLRDKRLK LFFGNKVIMY AVCFAFTRRA RRVRHGNAQT
151 VMVCQQPRHQ RGFARAGSGR NDKDVAFSIS GHIFYLYIFQ PIVSQWTPSF
201 LFADAHILPL LF*
```

Computer analysis of this amino acid sequence gave the following results:

Homology with a predicted ORF from *N. gonorrhoeae* m146/g146 90.1% identity in 212 aa overlap

```
                    10        20        30        40        50        60
m146.pep   MAQILLRSRQVVIDHDKVKQYGLLDFMPCLRQPPLDNFPTVRPASVEARGKYVERRRQDK
           | || ||  |||||||||:||||:||||||||||||||||||||  |||||:||||||||
g146       MKQIPLRLLQVVIDHDKVEQYGLFDFMPCLRQPPLDNFPTVRPAPFEARGKHVERRRQDK
                    10        20        30        40        50        60
```

-continued

```
                 70         80         90        100        110        120
m146.pep  DADGFGQRVANLRRALNVDFQNHVIACRRQRIHTLRACAVIVAKYVGVFQKSFLRDKRLK
          |:|:| |||||||||||||||||||||||||||:||||||||:|| |||||:|||||:|
g146      DTDSFRQRVANLRRALNVDFQNHVIACRRQRIHALRACAVIVAEYVCVFQKSLLRDKRFK
                 70         80         90        100        110        120

                130        140        150        160        170        180
m146.pep  LFFGNKVIMYAVCFAFTRRARRVRHGNAQTVMVCQQPRHQRGFARAGSGRNDKDVAFSIS
          |||||||||||||||||||||:||||||||||||||||||||||||||||||||||||||
g146      LFFGNKVIMYAVCFAFTRRARRMRHGNAQTVMVCQQPRHQRGFARAGSGRNDKDVAFSIS
                130        140        150        160        170        180

                190        200        210
m146.pep  GHIFYLYIFQPIVSQWTPSFLFADAHILPLLFX
          |||||||||||||| || |:||||||||||||
g146      GHIFYLYIFQPIVSQRTPYFIFADAHILPLLFX
                190        200        210
```

The following partial DNA sequence was identified in *N. meningitidis* <SEQ ID 581>:

<u>a146.seq</u>

```
  1 ATGGCGCAAA TCCTCCTCCG CCCGCGCCAA GTCATCATTG ACCACGACAA
 51 AATCGAACAA TACGGACTGT TCGATTTCAT GCCTTGCCTT CGACAGCCTC
101 CTTTGGATAA CTTCCCGACT GTCCGTCCCG CGTCCGTTGA GACGCGCAGC
151 AAGCACATCG AAAGACGGCG GCAGGATAAA GATGCCGACG GCTTCGGGCA
201 GCGCATCTCG AACCTGAGCC GCGCCCTGAA CGTCGATTTC CAAAATCACG
251 TCATAACCTG CCGCCGCCAA CGCATTCACA CCCTCCGCGC TTGTGCCGTA
301 ATAGTTGCCG AACACGTCCG CGTATTCCAA AAAAGCCTCC TGCGCGATAA
351 GCGACTCAAA CTCTTCTTTG GAAACAAAGT GATAATGTAC GCCGTTTGCT
401 TCGCCTTCAC GCGGCGGACG CGTCGTGTGC GACACGGAAA CGCGCAAACC
451 GTTATGGTTT GCCAACAGCC GCGACACCAG CGTGGTTTTG CCCGTGCCGG
501 AAGCGGCCGA AATGATAAAG ATGTTGCCTT TTCGATAAGC GGACATATTT
551 TTTACCTGTA TATTTTCCAG CCGATTGTAT CACAACGGAC ACCCGGTTTC
601 CTATTTGCCG ATGCCCATAT TTTGCCGCTA TTGTTTTGA
```

This corresponds to the amino acid sequence <SEQ ID 582; ORF 146.a>:

<u>a146.pep</u>

```
  1 MAQILLRPRQ VIIDHDKIEQ YGLFDFMPCL RQPPLDNFPT VRPASVETRS
 51 KHIERRRQDK DADGFGQRIS NLSRALNVDF QNHVITCRRQ RIHTLRACAV
101 IVAEHVRVFQ KSLLRDKRLK LFFGNKVIMY AVCFAFTRRT RRVRHGNAQT
151 VMVCQQPRHQ RGFARAGSGR NDKDVAFSIS GHIFYLYIFQ PIVSQRTPGF
201 LFADAHILPL LF*
```

m146/a146 90.6% identity in 212 aa overlap

```
                 10         20         30         40         50         60
m146.pep  MAQILLRSRQVVIDHDKVKQYGLLDFMPCLRQPPLDNFPTVRPASVEARGKYVERRRQDK
          ||||||| |||:|||||::||||:||||||||||||||||||||||:|:|::|||||||
a146      MAQILLRPRQVIIDHDKIEQYGLFDFMPCLRQPPLDNFPTVRPASVETRSKHIERRRQDK
                 10         20         30         40         50         60
```

-continued

```
                70        80        90       100       110       120
m146.pep  DADGFGQRVANLRRALNVDFQNHVIACRRQRIHTLRACAVIVAKYVGVFQKSFLRDKRLK
          ||||||||::|| ||||||||||||:||||||||||||||||::| |||||:|||||||
a146      DADGFGQRISNLSRALNVDFQNHVITCRRQRIHTLRACAVIVAEHVRVFQKSLLRDKRLK
                70        80        90       100       110       120

               130       140       150       160       170       180
m146.pep  LFFGNKVIMYAVCFAFTRRARRVRHGNAQTVMVCQQPRHQRGFARAGSGRNDKDVAFSIS
          ||||||||||||||||||||:|||||||||||||||||||||||||||||||||||||||
a146      LFFGNKVIMYAVCFAFTRRTRRVRHGNAQTVMVCQQPRHQRGFARAGSGRNDKDVAFSIS
               130       140       150       160       170       180

               190       200       210
m146.pep  GHIFYLYIFQPIVSQWTPSFLFADAHILPLLFX
          |||||||||||||| ||:||||||||||||||
a146      GHIFYLYIFQPIVSQRTPGFLFADAHILPLLFX
               190       200       210
```

The following partial DNA sequence was identified in *N. gonorrhoeae* <SEQ ID 583>:

g147.seq (partial)

```
  1 ..ATGCGACGAG AAGCCAAAAT GGCACAAATC ACACTCAAAC CCATTGTTTT
 51   ATCAATTCTT TTAATCAACA CACCCCTCCT CGCCCAAGCG CATGAAACTG
101   AGCAATCGGT GGGCTTGGAA ACGGTCAGCG TCGTCGGCAA AAGCCGTCCG
151   CGCGCGACTT CGGGGCTGCT GCACACTTCG ACCGCCTCCG ACAAAATCAT
201   CTCCGGCGAT ACTTTGCGCC AAAAAGCCGT CAACTTGGGC GACGCTTTGG
251   ACGGCGTACC GGGCATCCAC GCTTCGCAAT ACGGCGGCGG CGCATCCGCT
301   CCCGTTATTC GCGGTCAAAC GGGCAGACGG ATTAAAGTAT TGAACCATCA
351   CGGCGAAACG GGCGATATGG CGGACTTTTC TCCCGATCAC GCCATTATGG
401   TAGATACCGC CTTGTCGCAA CAGGTTGAAA TCCTGCGCGG GCCGGTTACG
451   CTCTTGTACA GCTCGGgcaa tgtggccgGG GCTGGtcaat gttgccgatg
501   gAAAAAtccc ccaaaaAAtg cc..
```

This corresponds to the amino acid sequence <SEQ ID 584; ORF 147.ng>:

g147.pep (partial)

```
  1 ..MRREAKMAQI TLKPIVLSIL LINTPLLAQA HETEQSVGLE TVSVVGKSRP
 51   RATSGLLHTS TASDKIISGD TLRQKAVNLG DALDGVPGIH ASQYGGGASA
101   PVIRGQTGRR IKVLNHHGET GDMADFSPDH AIMVDTALSQ QVEILRGPVT
151   LLYSSGNVAG AGQCCRWKNP PKNA..
```

The following partial DNA sequence was identified in *N. meningitidis* <SEQ ID 585>:

m147.seq (partial)

```
  1 ..CCGCATAAAA CTGAGCAATC GGTGGATTTG GAAACGGTCA GCGTCGTCGG
 51   CAAAAGCCGT CCGCGCGCCA CGTCGGGGCT GTTGCACACT TCGACCGCCT
101   CCGACAAAAT CATCTCCGGC GATACCTTGC GCCAAAAAGC CGTCAACTTG
151   GGCGACGCTT TAGACGGCGT ACCGGGCATC CACGCTTCGC AATACGGCGG
201   CGGCGCGTCT GCTCCCGTCA TTCGCGGTCA AACAGGCAGG CGGATTAAAG
```

-continued

```
251   TGTTGAACCA TCACGGCGAA ACAGGCGATA TGGCGGATTT TTCGCCCGAT
301   CACGCCATTA TGGTAGATAC CGCCTTGTCG CAACAGGTCG AAATCCTGCG
351   CGGGCCGGTT ACGCTCTTGT ACAGCTCGGG CAATGTGGCG GGGCTGGTCG
401   ATGTTGCCGA TGGCAAAATC CCCGAAAAAA TGCCTGAAAA CGGCGTATCG
451   GGCGAACTCG GATTGCGTTT GAGCAGCGGC AATCTGGAAA AACTCACGTC
501   CGGCGGCATC AATATCGGTT TGGGCAAAAA CTTTGTATTG CACACGGAAG
551   GGCTGTACCG CAAATCGGGG GATTACGCCG TACCGCGTTA CCGCAATCTG
601   AAACGCCTGC CCGACAGCCA CGCCGATTCG CAAACGGGCA GCATCGGGCT
651   GTCTTGGGTT GGCGAAAAAG GTTTTATCGG CGTAGCGTAC AGCGACCGTC
701   GCGACCAATA TGGTCTGCCT GCCCACAGCC ACGAATACGA TGATTGCCAC
751   GCCGACATCA TCTGGCAAAA GAGCTTGATT AACAAACGCT ATTTACAGCT
801   TTATCCGCAC CTGTTGACCG AAGAAGACAT CGATTACGAC AATCCGGGCT
851   TGAGCTGCGG CTTCCACGAC GACGATAATG CACACGCACA CACCCACAGC
901   GGCAGACCGT GGATAGACCT GCGCAACAAA CGCTACGAAC TCCGTGCCGA
951   ATGGAAGCAA CCGTTCCCCG GTTTTGAAGC CCTGCGCGTA CACCTGAACC
1001  GCAACGACTA CCGCCACGAC GAAAAAGCAG GCGATGCAGT CGAAAACTTT
1051  TTTAACAACC AAACGCAAAA CGCCCGCATC GAGTTGCGCC ACCAACCCAT
1101  AGGTCGTCTG AAAGGCAGCT GGGGCGTGCA ATATTTACAA CAAAAATCCA
1151  GTGCTTTATC TGCCATATCC GAAGCGGTTA AACAACCGAT GCTGCTTGAC
1201  AACAAAGTGC AACATTACAG CTTTTTCGGT GTAGAACAGG CAAACTGGGA
1251  CAACTTCACG CTTGAAGGAG GCGTACGCGT GGAAAAACAA AAAGCCTCCA
1301  TTCAGTACGA CAAAGCATTG ATTGATCGGG AAAACTACTA CAACCACCCC
1351  CTGCCCGACC TCGGCGCGCA CCGCCAAACC GCCCGCTCAT TCGCACTTTC
1401  GGGCAACTGG TATTTCACGC CACAACACAA ACTCAGCCTG ACCGCCTCCC
1451  ATCAGGAACG CCTGCCGTCA ACGCAAGAGC TGTACGCACA CGGCAAACAC
1501  GTCGCCACCA ACACCTTTGA AGTCGGCAAC AAACACCTCA ACAAAGAGCG
1551  TTCCAACAAT ATCGAACTCG CGCTGGGCTA CGAAGGCGAC CGCTGGCAAT
1601  ACAATCTGGC ACTCTACCGC AACCGCTTCG GTAACTACAT TTACGCCCAA
1651  ACCTTAAACG ACGGACGCGG CCCCAAATCC ATCGAAGACG ACAGCGAAAT
1701  GAAGCTCGTG CGCTACAACC AATCCGGCGC CGACTTCTAC GGCGCGGAAG
1751  GCGAAATCTA CTTCAAACCG ACACCGCGCT ACCGCATCGG CGTTTCCGGC
1801  GACTATGTAC GAGGCCGTCT GAAAAACCTG CCTTCCCTAC CCGGCAGAGA
1851  AGATGCCTAC GGCAACCGTC CTTTCATCGC ACAGGACGAC CAAAATGCCC
1901  CCCGTGTTCC GGCTGCGCGC CTCGGCTTCC ACCTGAAAGC CTCGCTGACC
1951  GACCGTATCG ATGCCAATTT GGACTACTAC CGCGTGTTCG CCCAAAACAA
2001  ACTCGCCCGC TACGAAACGC GCACGCCCGG ACACCATATG CTCAACCTCG
2051  GCGCAAACTA CCGCCGCAAT ACGCGCTATG GCGAGTGGAA TTGGTACGTC
2101  AAAGCCGACA ACCTGCTCAA CCAATCCGTT TACGCCCACA GCAGCTTTCT
2151  CTCTGATACG CCGCAAATGG GCCGCAGCTT TACCGGCGGC GTGAACGTGA
2201  AGTTTTAA
```

This corresponds to the amino acid sequence <SEQ ID 586; ORF 147>:

m147.pep (partial)

```
  1 ..PHKTEQSVDL ETVSVVGKSR PRATSGLLHT STASDKIISG DTLRQKAVNL
 51   GDALDGVPGI HASQYGGGAS APVIRGQTGR RIKVLNHHGE TGDMADFSPD
101   HAIMVDTALS QQVEILRGPV TLLYSSGNVA GLVDVADGKI PEKMPENGVS
151   GELGLRLSSG NLEKLTSGGI NIGLGKNFVL HTEGLYRKSG DYAVPRYRNL
201   KRLPDSHADS QTGSIGLSWV GEKGFIGVAY SDRRDQYGLP AHSHEYDDCH
251   ADIIWQKSLI NKRYLQLYPH LLTEEDIDYD NPGLSCGFHD DDNAHAHTHS
301   GRPWIDLRNK RYELRAEWKQ PFPGFEALRV HLNRNDYRHD EKAGDAVENF
351   FNNQTQNARI ELRHQPIGRL KGSWGVQYLQ QKSSALSAIS EAVKQPMLLD
401   NKVQHYSFFG VEQANWDNFT LEGGVRVEKQ KASIQYDKAL IDRENYYNHP
451   LPDLGAHRQT ARSFALSGNW YFTPQHKLSL TASHQERLPS TQELYAHGKH
501   VATNTFEVGN KHLNKERSNN IELALGYEGD RWQYNLALYR NRFGNYIYAQ
551   TLNDGRGPKS IEDDSEMKLV RYNQSGADFY GAEGEIYFKP TPRYRIGVSG
601   DYVRGRLKNL PSLPGREDAY GNRPFIAQDD QNAPRVPAAR LGFHLKASLT
651   DRIDANLDYY RVFAQNKLAR YETRTPGHHM LNLGANYRRN TRYGEWNWYV
701   KADNLLNQSV YAHSSFLSDT PQMGRSFTGC VNVKF*
```

Computer analysis of this amino acid sequence gave the following results:

Homology with a predicted ORF from *N. gonorrhoeae* m147/g147 92.3% identity in 142 aa overlap

```
                                                10        20        30
m147.pep                                PHKTEQSVDLETVSVVGKSRPRATSGLLHTS
                                         |:||||| ||||||||||||||||||||||
g147       MRREAKMAQITLKPIVLSILLINTPLLAQAHETEQSVGLETVSVVGKSRPRATSGLLHTS
                   10        20        30        40        50        60

                   40        50        60        70        80        90
m147.pep   TASDKIISGDTLRQKAVNLGDALDGVPGIHASQYGGGASAPVIRGQTGRRIKVLNHHGET
           ||||||||||||||||||||||||||||||||||||||||||||||||||||||||||||
g147       TASDKIISGDTLRQKAVNLGDALDGVPGIHASQYGGGASAPVIRGQTGRRIKVLNHHGET
                   70        80        90       100       110       120

                  100       110       120       130       140       150
m147.pep   GDMADFSPDHAIMVDTALSQQVEILRGPVTLLYSSGNVAGLVDVADGKIPEKMPENGVSG
           ||||||||||||||||||||||||||||||||||||||||  :    | | |
g147       GDMADFSPDHAIMVDTALSQQVEILRGPVTLLYSSGNVAGAGQCCRWKNPPKNA
```

The following partial DNA sequence was identified in *N. meningitidis* <SEQ ID 587>:

a147.seq

```
  1 ATGCGACGAG AAGCCAAAAT GGCACAAACT ACACTCAAAC CCATTGTTTT
 51 ATCAATTCTT TTAATCAACA CACCCCTCCT CTCCCAAGCG CATGGAACTG
101 AGCAATCAGT GGGCTTGGAA ACGGTCAGCG TCGTCGGCAA AAGCCGTCCG
151 CGCGCCACTT CGGGGCTGCT GCACACTTCT ACCGCCTCCG ACAAAATCAT
201 CAGCGGCGAC ACCTTGCGAC AAAAAGCCGT CAACTTGGGT GATGCTTTAG
251 ACGGCGTACC GGGCATTCAT GCCTCGCAAT ACGGCGGCGG CGCATCCGCT
```

-continued

```
301 CCCGTTATTC GCGGTCAAAC AGGCAGACGG ATTAAAGTGT TGAACCATCA
351 CGGCGAAACG GGCGACATGG CGGACTTCTC TCCAGACCAT GCAATCATGG
401 TGGACAGCGC CTTGTCGCAA CAGGTCGAAA TCCTGCGCGG TCCGGTTACG
451 CTCTTGTACA GCTCGGGCAA TGTGGCGGGG CTGGTCGATG TTGCCGATGG
501 CAAAATCCCC GAAAAAATGC CTGAAAACGG CGTATCGGGC GAACTCGGAT
551 TGCGTTTGAG CAGCGGCAAT CTGGAAAAAC TCACGTCCGG CGGCATCAAT
601 ATCGGTTTGG GCAAAAACTT TGTATTGCAC ACGGAAGGGC TGTACCGCAA
651 ATCGGGGGAT TACGCCGTAC CGCGTTACCG CAATCTGAAA CGCCTGCCCG
701 ACAGCCACGC CGATTCGCAA ACGGGCAGCA TCGGGCTGTC TTGGGTTGGC
751 GAAAAAGGCT TTATCGGCGC AGCATACAGC GACCGTCGCG ACCAATATGG
801 TCTGCCTGCC CACAGCCACG AATACGATGA TTGCCACGCC GACATCATCT
851 GGCAAAAGAG TTTGATTAAC AAACGCTATT TGCAGCTTTA TCCGCACCTG
901 TTGACCGAAG AAGACATCGA TTACGACAAT CCGGGCTTGA GCTGCGGCTT
951 TCACGACGAC GATGATGCAC ACGCCCATGC CCACAACGGC AAACCTTGGA
1001 TAGACCTGCG CAACAAACGC TACGAACTCC GCGCCGAATG GAAGCAACCG
1051 TTCCCCGGTT TTGAAGCCCT GCGCGTACAC CTGAACCGCA ACGACTACCG
1101 CCACGACGAA AAAGCAGGCG ATGCAGTAGA AAACTTTTTT AACAACCAAA
1151 CGCAAAACGC CCGTATCGAG TTGCGCCACC AACCCATAGG CCGTCTGAAA
1201 GGCAGCTGGG GCGTGCAATA TTTGGGACAA AAATCCAGTG CTTTATCTGC
1251 CACATCCGAA GCGGTCAAAC AACCGATGCT GCTTGACAAT AAAGTGCAAC
1301 ATTACAGCTT TTTCGGTGTA GAACAGGCAA ACTGGGACAA CTTCACGCTT
1351 GAAGGCGGCG TACGCGTGGA AAAACAAAAA GCCTCCATCC GCTACGACAA
1401 AGCATTGATT GATCGGGAAA ACTACTACAA CCATCCCCTG CCCGACCTCG
1451 GCGCGCACCG CCAAACCGCC CGCTCATTCG CACTTTCGGG CAACTGGTAT
1501 TTCACGCCAC AACACAAACT CAGCCTGACC GCCTCCCATC AGGAACGCCT
1551 GCCGTCAACG CAAGAGCTGT ACGCACACGG CAAACACGTC GCCACCAACA
1601 CCTTTGAAGT CGGCAACAAA CACCTCAACA AAGAGCGTTC CAACAATATC
1651 GAACTCGCGC TGGGCTACGA AGGCGACCGC TGGCAATACA ATCTGGCACT
1701 CTACCGCAAC CGCTTCGGCA ACTACATTTA CGCCCAAACC TTAAACGACG
1751 GACGCGGCCC CAAATCCATC GAAGACGACA GCGAAATGAA GCTCGTGCGC
1801 TACAACCAAT CCGGTGCGGA CTTCTACGGC GCGGAAGGCG AAATCTACTT
1851 CAAACCGACA CCGCGCTACC GCATCGGCGT TTCCGGCGAC TATGTACGAG
1901 GCCGTCTGAA AAACCTGCCT TCCCTACCCG GCAGGGAAGA CGCCTACGGC
1951 AACCGCCCAC TCATTGCCCA AGCCGACCAA AACGCCCCTC GCGTTCCGGC
2001 TGCGCGCCTC GGCGTCCACC TGAAAGCCTC GCTGACCGAC CGCATCGATG
2051 CCAATTTGGA CTACTACCGC GTGTTCGCCC AAAACAAACT CGCCCGCTAC
2101 GAAACGCGCA CGCCCGGACA CCATATGCTC AACCTCGGCG CAAACTACCG
2151 CCGCAATACG CGCTATGGCG AGTGGAATTG GTACGTCAAA GCCGACAACC
2201 TGCTCAACCA ATCCGTTTAC GCCCACAGCA GCTTCCTCTC TGATACGCCG
2251 CAAATGGGCC GCAGCTTTAC CGGCGGCGTG AACGTGAAGT TTTAA
```

This corresponds to the amino acid sequence <SEQ ID 588; ORF 147.a>:

```
a147.pep

  1 MRREAKMAQT TLKPIVLSIL LINTPLLSQA HGTEQSVGLE TVSVVGKSRP

 51 RATSGLLHTS TASDKIISGD TLRQKAVNLG DALDGVPGIH ASQYGGGASA

101 PVIRGQTGRR IKVLNHHGET GDMADFSPDH AIMVDSALSQ QVEILRGPVT

151 LLYSSGNVAG LVDVADGKIP EKMPENGVSG ELGLRLSSGN LEKLTSGGIN

201 IGLGKNFVLH TEGLYRKSGD YAVPRYRNLK RLPDSHADSQ TGSIGLSWVG

251 EKGFIGAAYS DRRDQYGLPA HSHEYDDCHA DIIWQKSLIN KRYLQLYPHL

301 LTEEDIDYDN PGLSCGFHDD DDAHAHAHNG KPWIDLRNKR YELRAEWKQP

351 FPGFEALRVH LNRNDYRHDE KAGDAVENFF NNQTQNARIE LRHQPIGRLK

401 GSWGVQYLGQ KSSALSATSE AVKQPMLLDN KVQHYSFFGV EQANWDNFTL

451 EGGVRVEKQK ASIRYDKALI DRENYYNHPL PDLGAHRQTA RSFALSGNWY

501 FTPQHKLSLT ASHQERLPST QELYAHGKHV ATNTFEVGNK HLNKERSNNI

551 ELALGYEGDR WQYNLALYRN RFGNYIYAQT LNDGRGPKSI EDDSEMKLVR

601 YNQSGADFYG AEGEIYFKPT PRYRIGVSGD YVRGRLKNLP SLPGREDAYG

651 NRPLIAQADQ NAPRVPAARL GVHLKASLTD RIDANLDYYR VFAQNKLARY

701 ETRTPGHHML NLGANYRRNT RYGEWNWYVK ADNLLNQSVY AHSSFLSDTP

751 QMGRSFTGGV NVKF*
```

m147/a147 98.1% identity in 734 aa overlap

```
                                               10        20        30
m147.pep                               PHKTEQSVDLETVSVVGKSRPRATSGLLHTS
                                        | ||||| ||||||||||||||||||||||
a147      MRREAKMAQTTLKPIVLSILLINTPLLSQAHGTEQSVGLETVSVVGKSRPRATSGLLHTS
                  10        20        30        40        50        60

                  40        50        60        70        80        90
m147.pep  TASDKIISGDTLRQKAVNLGDALDGVPGIHASQYGGGASAPVIRGQTGRRIKVLNHHGET
          ||||||||||||||||||||||||||||||||||||||||||||||||||||||||||||
a147      TASDKIISGDTLRQKAVNLGDALDGVPGIHASQYGGGASAPVIRGQTGRRIKVLNHHGET
                  70        80        90       100       110       120

                 100       110       120       130       140       150
m147.pep  GDMADFSPDHAIMVDTALSQQVEILRGPVTLLYSSGNVAGLVDVADGKIPEKMPENGVSG
          ||||||||||||||||:|||||||||||||||||||||||||||||||||||||||||||
a147      GDMADFSPDHAIMVDSALSQQVEILRGPVTLLYSSGNVAGLVDVADGKIPEKMPENGVSG
                 130       140       150       160       170       180

                 160       170       180       190       200       210
m147.pep  ELGLRLSSGNLEKLTSGGINIGLGKNFVLHTEGLYRKSGDYAVPRYRNLKRLPDSHADSQ
          ||||||||||||||||||||||||||||||||||||||||||||||||||||||||||||
a147      ELGLRLSSGNLEKLTSGGINIGLGKNFVLHTEGLYRKSGDYAVPRYRNLKRLPDSHADSQ
                 190       200       210       220       230       240

                 220       230       240       250       260       270
m147.pep  TGSIGLSWVGEKGFIGVAYSDRRDQYGLPAHSHEYDDCHADIIWQKSLINKRYLQLYPHL
          ||||||||||||||||:|||||||||||||||||||||||||||||||||||||||||||
a147      TGSIGLSWVGEKGFIGAAYSDRRDQYGLPAHSHEYDDCHADIIWQKSLINKRYLQLYPHL
                 250       260       270       280       290       300

                 280       290       300       310       320       330
m147.pep  LTEEDIDYDNPGLSCGFHDDDNAHAHTHSGRPWIDLRNKRYELRAEWKQPFPGFEALRVH
          |||||||||||||||||||||:||||:|:|:|||||||||||||||||||||||||||||
a147      LTEEDIDYDNPGLSCGFHDDDDAHAHAHNGKPWIDLRNKRYELRAEWKQPFPGFEALRVH
                 310       320       330       340       350       360

                 340       350       360       370       380       390
m147.pep  LNRNDYRHDEKAGDAVENFFNNQTQNARIELRHQPIGRLKGSWGVQYLQQKSSALSAISE
          |||||||||||||||||||||||||||||||||||||||||||||||| |||||||| ||
a147      LNRNDYRHDEKAGDAVENFFNNQTQNARIELRHQPIGRLKGSWGVQYLGQKSSALSATSE
                 370       380       390       400       410       420
```

-continued

```
                 400       410       420       430       440       450
m147.pep  AVKQPMLLDNKVQHYSFFGVEQANWDNFTLEGGVRVEKQKASIQYDKALIDRENYYNHPL
          |||||||||||||||||||||||||||||||||||||||||||:||||||||||||||||
a147      AVKQPMLLDNKVQHYSFFGVEQANWDNFTLEGGVRVEKQKASIRYDKALIDRENYYNHPL
                    430       440       450       460       470       480

                 460       470       480       490       500       510
m147.pep  PDLGAHRQTARSFALSGNWYFTPQHKLSLTASHQERLPSTQELYAHGKHVATNTFEVGNK
          ||||||||||||||||||||||||||||||||||||||||||||||||||||||||||||
a147      PDLGAHRQTARSFALSGNWYFTPQHKLSLTASHQERLPSTQELYAHGKHVATNTFEVGNK
                    490       500       510       520       530       540

                 520       530       540       550       560       570
m147.pep  HLNKERSNNIELALGYEGDRWQYNLALYRNRFGNYIYAQTLNDGRGPKSIEDDSEMKLVR
          ||||||||||||||||||||||||||||||||||||||||||||||||||||||||||||
a147      HLNKERSNNIELALGYEGDRWQYNLALYRNRFGNYIYAQTLNDGRGPKSIEDDSEMKLVR
                    550       560       570       580       590       600

                 580       590       600       610       620       630
m147.pep  YNQSGADFYGAEGEIYFKPTPRYRIGVSGDYVRGRLKNLPSLPGREDAYGNRPFIAQDDQ
          |||||||||||||||||||||||||||||||||||||||||||||||||||||:||| ||
a147      YNQSGADFYGAEGEIYFKPTPRYRIGVSGDYVRGRLKNLPSLPGREDAYGNRPLIAQADQ
                    610       620       630       640       650       660

                 640       650       660       670       680       690
m147.pep  NAPRVPAARLGFHLKASLTDRIDANLDYYRVFAQNKLARYETRTPGHHMLNLGANYRRNT
          ||||||||||| ||||||||||||||||||||||||||||||||||||||||||||||||
a147      NAPRVPAARLGVHLKASLTDRIDANLDYYRVFAQNKLARYETRTPGHHMLNLGANYRRNT
                    670       680       690       700       710       720

                 700       710       720       730
m147.pep  RYGEWNWYVKADNLLNQSVYAHSSFLSDTPQMGRSFTGGVNVKFX
          |||||||||||||||||||||||||||||||||||||||||||||
a147      RYGEWNWYVKADNLLNQSVYAHSSFLSDTPQMGRSFTGGVNVKFX
                    730       740       750       760
```

The following partial DNA sequence was identified in *N. gonorrhoeae* <SEQ ID 589>:

g148.seq

```
  1 ATGGCGTTAA AAACATCAAA CTTGGAACAC GCAATGctgg ttcaTCCCGA

 51 AgctATgagt gtcggcgCGC TTGccgAcaa AATCCGCAAA AtcgaAAact

101 gGCCGCAAAA AGgcaTCTTA TTCCACGACA TCACGCCCGT CCTGCAAAGT

151 GCGGAATACT TCCGCCTTTT GGTCGATTTG CTGGTTTACC GCTATATGGA

201 TCAGAAAATC GACATCGTTG CCGGCTTGGA CGCGCGCGGC TTCATTATCG

251 GCGCGGCACT CGCCTACCAG CTCAaCGtcg gctTCGTCCC CATCCGCAAA

301 AAAGGCAAGC TGCCTTTTGA AACCGTATCG CAAAGCTAcg cgcTCGAATA

351 CGGGGAAGCT GCGGTGGAAA TCCACACCGa tgccgTCAAA CCCGGTTCGC

401 GCGTCCTGCT GGTCGATGAT TTGGTTGCCA CGGGCGGCAC AATGCTTGCC

451 GGGCTGGAAC TGATCCGCAA ACTCGGCGGG GAAATTGTCG AAgccgccgC

501 CATTTTGGAA TTTACCGACC TTCAAGGCGG CAAGAATATC CGCGCAAGTG

551 GCGCGCCCTT ATTTACCCTG CTTCAAAACG AAGGCTGCAT GAAAGGCTGA
```

This corresponds to the amino acid sequence <SEQ ID 590; ORF 148.ng>:

g148.pep

```
  1 MALKTSNLEH AMLVHPEAMS VGALADKIRK IENWPQKGIL FHDITPVLQS

 51 AEYFRLLVDL LVYRYMDQKI DIVAGLDARG FIIGAALAYQ LNVGFVPIRK

101 KGKLPFETVS QSYALEYGEA AVEIHTDAVK PGSRVLLVDD LVATGGTMLA

151 GLELIRKLGG EIVEAAAILE FTDLQGGKNI RASGAPLFTL LQNEGCMKG*
```

The following partial DNA sequence was identified in *N. meningitidis* <SEQ ID 591>:

m148.seq

```
  1 ATGGCGTTAA AAACATCAAA CTTGGAACAC GCAATGCTGG TTCATCCCGA

 51 AGCTATGAGT GTCGGCGCGC TTGCCGACAA AATCCGCAAA ATCGAAAACT

101 GGCCGCAAAA AGGCATCTTA TTCCACGACA TCACGCCCGT CCTTCAAAGC

151 GCGGAATACT TCCGCCTTTT GGTTGATTTA TTGGTTTACC GCTATATGGA

201 TCAGAAAATC GACATCGTTG CCGGTTTGGA CGCGCGCGGC TTCATTATCG

251 GCGCGGCACT CGCCTACCAG CTCAACGTCG GTTTCGTCCC CATCCGCAAA

301 AAAGGCAAGC TGCCTTTTGA AACCGTATCG CAAAGCTACG CGCTCGAATA

351 CGGGGAAGCT GCGGTGGAAA TCCACACCGA TGCCGTCAAA CTCGGTTCGC

401 GCGTGCTGCT GGTCGATGAT TTGATTGCCA CGGGCGGCAC GATGCTTGCC

451 GGACTGGAAC TGATCCGCAA ACTCGGCGGA GAAATTGTCG AAGCCGCCGC

501 CATTTTGGAA TTTACCGACC TTCAAGGCGG CAAGAATATC CGTGCAAGCG

551 GCGCGCCCTT ATTTACCCTG CTTCAAAACG AAGGCTGTAT GAAGGGCTGA
```

This corresponds to the amino acid sequence <SEQ ID 592; ORF 148>:

m148.pep

```
  1 MALKTSNLEH AMLVHPEAMS VGALADKIRK IENWPQKGIL FHDITPVLQS

 51 AEYFRLLVDL LVYRYMDQKI DIVAGLDARG FIIGAALAYQ LNVGFVPIRK

101 KGKLPFETVS QSYALEYGEA AVEIHTDAVK LGSRVLLVDD LIATGGTMLA

151 GLELIRKLGG EIVEAAAILE FTDLQGGKNI RASGAPLFTL LQNEGCMKG*
```

Computer analysis of this amino acid sequence gave the following results:

Homology with a predicted ORF from *N. gonorrhoeae* m148/g148 99.0% identity in 199 aa overlap

```
                   10        20        30        40        50        60
m148.pep   MALKTSNLEHAMLVHPEAMSVGALADKIRKIENWPQKGILFHDITPVLQSAEYFRLLVDL
           ||||||||||||||||||||||||||||||||||||||||||||||||||||||||||||
g148       MALKTSNLEHAMLVHPEAMSVGALADKIRKIENWPQKGILFHDITPVLQSAEYFRLLVDL
                   10        20        30        40        50        60

                   70        80        90       100       110       120
m148.pep   LVYRYMDQKIDIVAGLDARGFIIGAALAYQLNVGFVPIRKKGKLPFETVSQSYALEYGEA
           ||||||||||||||||||||||||||||||||||||||||||||||||||||||||||||
g148       LVYRYMDQKIDIVAGLDARGFIIGAALAYQLNVGFVPIRKKGKLPFETVSQSYALEYGEA
                   70        80        90       100       110       120

                  130       140       150       160       170       180
m148.pep   AVEIHTDAVKLGSRVLLVDDLIATGGTMLAGLELIRKLGGEIVEAAAILEFTDLQGGKNI
           |||||||||| ||||||||||:||||||||||||||||||||||||||||||||||||||
g148       AVEIHTDAVKPGSRVLLVDDLVATGGTMLAGLELIRKLGGEIVEAAAILEFTDLQGGKNI
                  130       140       150       160       170       180

                  190       200
m148.pep   RASGAPLFTLLQNEGCMKGX
           |||||||||||||||||||
g148       RASGAPLFTLLQNEGCMKGX
                  190       200
```

The following partial DNA sequence was identified in *N. meningitidis* <SEQ ID 593>:

a148.seq

```
  1 ATGGCGTTAA AAACATCAAA CTTGGAACAC GCAATGCTGG TTCATCCCGA
 51 AGCTATGAGT GTCGGTGCGC TTGCCGACAA AATCCGCAAA ATCGAAAACT
101 GGCCGCAAAA AGGCATCTTA TTCCACGACA TCACGCCCGT CCTGCAAAGC
151 GCGGAATACT TCCGACTTTT GGTTGATTTA TTGGTTTACC GCTATATGGA
201 TCAGAAAATC GACATCGTTC CCGGTTTGGA CGCGCGCGGC TTCATTATCG
251 GCGCGGCACT CGCCTACCAG CTCAACGTCG GTTTCGTCCC CATCCGCAAA
301 AAAGGCAAGC TGCCTTTTGA AACCGTATCG CAAAGCTACG CGCTCGAATA
351 CGGGGAAGCT GCGGTGGAAA TCCACACCGA TGCCGTCAAA CTCGGTTCGC
401 GCGTGCTGCT GGTCGATGAT TTGGTTGCCA CGGGCGGCAC GATGCTTGCC
451 GGACTGGAGC TGATCCGCAA ACTCGGCGGG GAAATTGTCG AAGCCGCCGC
501 CATTTTGGAA TTTACCGACC TTCAAGGCGG CAAGAATATC CGTGCAAGCG
551 GCGCGCCCTT ATTTACCCTG CTTCAAAACG AAGGCTGTAT GAAGGGCTGA
```

This corresponds to the amino acid sequence <SEQ ID 594; ORF 148.a>:

a148.pep

```
  1 MALKTSNLEH AMLVHPEAMS VGALADKIRK IENWPQKGIL FHDITPVLQS
 51 AEYFRLLVDL LVYRYMDQKI DIVAGLDARG FIIGAALAYQ LNVGFVPIRK
101 KGKLPFETVS QSYALEYGEA AVEIHTDAVK LGSRVLLVDD LVATGGTMLA
151 GLELIRKLGG EIVEAAAILE FTDLQGGKNI RASGAPLFTL LQNEGCMKG*
```

m148/a148 99.5% identity in 199 aa overlap

```
                    10        20        30        40        50        60
m148.pep    MALKTSNLEHAMLVHPEAMSVGALADKIRKIENWPQKGILFHDITPVLQSAEYFRLLVDL
            ||||||||||||||||||||||||||||||||||||||||||||||||||||||||||||
a148        MALKTSNLEHAMLVHPEAMSVGALADKIRKIENWPQKGILFHDITPVLQSAEYFRLLVDL
                    10        20        30        40        50        60

                    70        80        90       100       110       120
m148.pep    LVYRYMDQKIDIVAGLDARGFIIGAALAYQLNVGFVPIRKKGKLPFETVSQSYALEYGEA
            ||||||||||||||||||||||||||||||||||||||||||||||||||||||||||||
a148        LVYRYMDQKIDIVAGLDARGFIIGAALAYQLNVGFVPIRKKGKLPFETVSQSYALEYGEA
                    70        80        90       100       110       120

                   130       140       150       160       170       180
m148.pep    AVEIHTDAVKLGSRVLLVDDLIATGGTMLAGLELIRKLGGEIVEAAAILEFTDLQGGKNI
            |||||||||||||||||||||:||||||||||||||||||||||||||||||||||||||
a148        AVEIHTDAVKLGSRVLLVDDLVATGGTMLAGLELIRKLGGEIVEAAAILEFTDLQGGKNI
                   130       140       150       160       170       180

                   190       200
m148.pep    RASGAPLFTLLQNEGCMKGX
            ||||||||||||||||||||
a148        RASGAPLFTLLQNEGCMKGX
                   190       200
```

The following partial DNA sequence was identified in *N. gonorrhoeae* <SEQ ID 595>:

g149.seq

```
  1 ATGTTGATTG ACAACAATGT CCGCCATTAC AGCTTTTTCG GTGTAGAACA
```

-continued

```
  51 GGCAAATTGG GACAACTTCA CGCTTGAAGG CGGCGTACGC GTGGAAAAAC

101 AAAAAGCCTC CATCCGGTAC GACAAAGCAT TGATTGATCG AGAAAACTAC

151 TACAACCAGC CCCTGCCCGA CCTCGGCGCG CACCGCCAAA CCGCCCGCTC

201 GTTCGCACTT TCGGGCAACT GGTATTTCAC GCCACACCAC AAACTCAGCC

251 TGACCGCCTC CCATCAGGAa cgCCTGCCGT CAACGCaagA actGtACgca 301 cacggcAAGC ACGtcgccac CAACACCTTT GAagtcggca acaaACACCT 351 CAACAAAGaG CgttccaacA atatcgaACT CGCGCTGGgc tAcaaaggcg 401 accGCTGGCA ATACAATCTG GCAGCCTACC GCAACCGAtT CGGCAACTAC 451 ATTTACGCCC AAACCTTAaa cgacggacgC GGCCCCAAAT CCATCgaaga 501 cgacagcgaA ATGaagcTCG TGCGCTACAA CCAATCCGGT GCCGACTTCT 551 ACGgcgcggA aggcgaaatc tACTTcaaaC CGAcACCGCG CTACCGCATC 601 GGTGTTTCCG GCGACTatgt acgaggccgT CTGAAAAACC TGCCGTCCCT 651 ACCCGGCAGG gaagatccCT AcggcAAACG TCccttcaTC GCACAAGCCG 701 ACCAAAACGC CCCCCGCATT ccggctGCGC GCCTCGGCTT CCACCTGAAA

751 ACCTCGCTAA CCGACCGTAT CGATGCCAAT TTGGACTACT ACCGCGTGTT

801 CGCCCAAAAC AAACTCGCCC GCTACGAAAC GCGTACGCCC GGACACCATA

851 TGCTCAACCT CGGTGCAAAC TACCGCCGCA ATACGCGCTA TGGCGAGTGG

901 AATTGGTACG TCAAAGCCGA CAACCTGCtc aACcaatCcg tTTACGCCCa 951 cAGCAGCTTC CTCTCTGATA CGCCGCAAAt gGGCCGCAGC TTtgccgGCg 1001 gcgtaAACGT GaAGTTttaA
```

This corresponds to the amino acid sequence <SEQ ID 596; ORF 149.ng>:

g149.pep

```
  1 MLIDNNVRHY SFFGVEQANW DNFTLEGGVR VEKQKASIRY DKALIDRENY

51 YNQPLPDLGA HRQTARSFAL SGNWYFTPHH KLSLTASHQE RLPSTQELYA

101 HGKHVATNTF EVGNKHLNKE RSNNIELALG YKGDRWQYNL AAYRNRFGNY

151 IYAQTLNDGR GPKSIEDDSE MKLVRYNQSG ADFYGAEGEI YFKPTPRYRI

201 GVSGDYVRGR LKNLPSLPGR EDPYGKRPFI AQADQNAPRI PAARLGFHLK

251 TSLTDRIDAN LDYYRVFAQN KLARYETRTP GHHMLNLGAN YRRNTRYGEW

301 NWYVKADNLL NQSVYAHSSF LSDTPQMGRS FAGGVNVKF*
```

The following partial DNA sequence was identified in *N. meningitidis* <SEQ ID 597>:

m149.seq

```
  1 ATGCTGCTTG ACAACAAAGT GCAACATTAC AGCTTTTTCG GTGTAGAACA

51 GGCAAACTGG GACAACTTCA CGCTTGAAGG AGGCGTACGC GTGGAAAAAC

101 AAAAAGCCTC CATTCAGTAC GACAAAGCAT TGATTGATCG GGAAAACTAC

151 TACAACCACC CCCTGCCCGA CCTCGGCGCG CACCGCCAAA CCGCCCGCTC

201 ATTCGCACTT TCGGGCAACT GGTATTTCAC GCCACAACAC AAACTCAGCC
```

-continued

```
 251 TGACCGCCTC CCATCAGGAA CGCCTGCCGT CAACGCAAGA GCTGTACGCA
 301 CACGGCAAAC ACGTCGCCAC CAACACCTTT GAAGTCGGCA ACAAACACCT
 351 CAACAAAGAG CGTTCCAACA ATATCGAACT CGCGCTGGGC TACGAAGGCG
 401 ACCGCTGGCA ATACAATCTG GCACTCTACC GCAACCGCTT CGGTAACTAC
 451 ATTTACGCCC AAACCTTAAA CGACGGACGC GGCCCCAAAT CCATCGAAGA
 501 CGACAGCGAA ATGAAGCTCG TGCGCTACAA CCAATCCGGC GCCGACTTCT
 551 ACGGCGCGGA AGGCGAAATC TACTTCAAAC CGACACCGCG CTACCGCATC
 601 GGCGTTTCCG GCGACTATGT ACGAGGCCGT CTGAAAAACC TGCCTTCCCT
 651 ACCCGGCAGA GAAGATGCCT ACGGCAACCG TCCTTTCATC GCACAGGACG
 701 ACCAAAATGC CCCCCGTGTT CCGGCTGCGC GCCTCGGCTT CCACCTGAAA
 751 GCCTCGCTGA CCGACCGTAT CGATGCCAAT TTGGACTACT ACCGCGTGTT
 801 CGCCCAAAAC AAACTCGCCC GCTACGAAAC GCGCACGCCC GGACACCATA
 851 TGCTCAACCT CGGCGCAAAC TACCGCCGCA ATACGCGCTA TGGCGAGTGG
 901 AATTGGTACG TCAAAGCCGA CAACCTGCTC AACCAATCCG TTTACGCCCA
 951 CAGCAGCTTT CTCTCTGATA CGCCGCAAAT GGGCCGCAGC TTTACCGGCG
1001 GCGTGAACGT GAAGTTTTAA
```

This corresponds to the amino acid sequence <SEQ ID 598; ORF 149>:

m149.pep

```
  1 MLLDNKVQHY SFFGVEQANW DNFTLEGGVR VEKQKASIQY DKALIDRENY
 51 YNHPLPDLGA HRQTARSFAL SGNWYFTPQH KLSLTASHQE RLPSTQELYA
101 HGKHVATNTF EVGNKHLNKE RSNNIELALG YEGDRWQYNL ALYRNRFGNY
151 IYAQTLNDGR GPKSIEDDSE MKLVRYNQSG ADFYGAEGEI YFKPTPRYRI
201 GVSGDYVRGR LKNLPSLPGR EDAYGNRPFI AQDDQNAPRV PAARLGFHLK
251 ASLTDRIDAN LDYYRVFAQN KLARYETRTP GHHMLNLGAN YRRNTRYGEW
301 NWYVKADNLL NQSVYAHSSF LSDTPQMGRS FTGGVNVKF*
```

Computer analysis of this amino acid sequence gave the following results:

Homology with a predicted ORF from *N. gonorrhoeae*

ORF 149 shows 95.9% identity over a 339 aa overlap with a predicted ORF (ORF 149.ng) from *N. gonorrhoeae*:

m149/g149

```
                   10        20        30        40        50        60
m149.pep    MLLDNKVQHYSFFGVEQANWDNFTLEGGVRVEKQKASIQYDKALIDRENYYNHPLPDLGA
            ||:||:|:||||||||||||||||||||||||||||||:||||||||||||:||||||
g149        MLIDNNVRHYSFFGVEQANWDNFTLEGGVRVEKQKASIRYDKALIDRENYYNQPLPDLGA
                   10        20        30        40        50        60

                   70        80        90       100       110       120
m149.pep    HRQTARSFALSGNWYFTPQHKLSLTASHQERLPSTQELYAHGKHVATNTFEVGNKHLNKE
            ||||||||||||||||||:|||||||||||||||||||||||||||||||||||||||||
g149        HRQTARSFALSGNWYFTPHHKLSLTASHQERLPSTQELYAHGKHVATNTFEVGNKHLNKE
                   70        80        90       100       110       120
```

-continued

```
                    130       140       150       160       170       180
m149.pep     RSNNIELALGYEGDRWQYNLALYRNRFGNYIYAQTLNDGRGPKSIEDDSEMKLVRYNQSG
             ||||||||||:|||||||| ||||||||||||||||||||||||||||||||||||||||
g149         RSNNIELALGYKGDRWQYNLAAYRNRFGNYIYAQTLNDGRGPKSIEDDSEMKLVRYNQSG
                    130       140       150       160       170       180

                    190       200       210       220       230       240
m149.pep     ADFYGAEGEIYFKPTPRYRIGVSGDYVRGRLKNLPSLPGREDAYGNRPFIAQDDQNAPRV
             |||||||||||||||||||||||||||||||||||||||| ||:|||||| ||||||:
g149         ADFYGAEGEIYFKPTPRYRIGVSGDYVRGRLKNLPSLPGREDPYGKRPFIAQADQNAPRI
                    190       200       210       220       230       240

                    250       260       270       280       290       300
m149.pep     PAARLGFHLKASLTDRIDANLDYYRVFAQNKLARYETRTPGHHMLNLGANYRRNTRYGEW
             ||||||||||:|||||||||||||||||||||||||||||||||||||||||||||||||
g149         PAARLGFHLKTSLTDRIDANLDYYRVFAQNKLARYETRTPGHHMLNLGANYRRNTRYGEW
                    250       260       270       280       290       300

                    310       320       330       340
m149.pep     NWYVKADNLLNQSVYAHSSFLSDTPQMGRSFTGGVNVKFX
             |||||||||||||||||||||||||||||||:||||||||
             NWYVKADNLLNQSVYAHSSFLSDTPQMGRSFAGGVNVKFX
g149                310       320       330       340
```

The following partial DNA sequence was identified in *N. meningitidis* <SEQ ID 599>:

a149.seq

```
   1 ATGCTGCTTG ACAATAAAGT GCAACATTAC AGCTTTTTCG GTGTAGAACA
  51 GGCAAACTGG GACAACTTCA CGCTTGAAGG CGGCGTACGC GTGGAAAAAC
 101 AAAAAGCCTC CATCCGCTAC GACAAAGCAT TGATTGATCG GGAAAACTAC
 151 TACAACCATC CCCTGCCCGA CCTCGGCGCG CACCGCCAAA CCGCCCGCTC
 201 ATTCGCACTT TCGGGCAACT GGTATTTCAC GCCACAACAC AAACTCAGCC
 251 TGACCGCCTC CCATCAGGAA CGCCTGCCGT CAACGCAAGA GCTGTACGCA
 301 CACGGCAAAC ACGTCGCCAC CAACACCTTT GAAGTCGGCA ACAAACACCT
 351 CAACAAAGAG CGTTCCAACA ATATCGAACT CGCGCTGGGC TACGAAGGCG
 401 ACCGCTGGCA ATACAATCTG GCACTCTACC GCAACCGCTT CGGCAACTAC
 451 ATTTACGCCC AAACCTTAAA CGACGGACGC GGCCCCAAAT CCATCGAAGA
 501 CGACAGCGAA ATGAAGCTCG TGCGCTACAA CCAATCCGGT GCGGACTTCT
 551 ACGGCGCGGA AGGCGAAATC TACTTCAAAC CGACACCGCG CTACCGCATC
 601 GGCGTTTCCG GCGACTATGT ACGAGGCCGT CTGAAAAACC TGCCTTCCCT
 651 ACCCGGCAGG GAAGACGCCT ACGGCAACCG CCCACTCATT GCCCAAGCCG
 701 ACCAAAACGC CCCTCGCGTT CCGGCTGCGC GCCTCGGCGT CCACCTGAAA
 751 GCCTCGCTGA CCGACCGCAT CGATGCCAAT TTGGACTACT ACCGCGTGTT
 801 CGCCCAAAAC AAACTCGCCC GCTACGAAAC GCGCACGCCC GGACACCATA
 851 TGCTCAACCT CGGCGCAAAC TACCGCCGCA ATACGCGCTA TGGCGAGTGG
 901 AATTGGTACG TCAAAGCCGA CAACCTGCTC AACCAATCCG TTTACGCCCA
 951 CAGCAGCTTC CTCTCTGATA CGCCGCAAAT GGGCCGCAGC TTTACCGGCG
1001 GCGTGAACGT GAAGTTTTAA
```

This corresponds to the amino acid sequence <SEQ ID 600; ORF 149.a>:

a149.pep

```
  1 MLLDNKVQHY SFFGVEQANW DNFTLEGGVR VEKQKASIRY DKALIDRENY
 51 YNHPLPDLGA HRQTARSFAL SGNWYFTPQH KLSLTASHQE RLPSTQELYA
101 HGKHVATNTF EVGNKHLNKE RSNNIELALG YEGDRWQYNL ALYRNRFGNY
151 IYAQTLNDGR GPKSIEDDSE MKLVRYNQSG ADFYGAEGEI YFKPTFRYRI
201 GVSGDYVRGR LKNLPSLPGR EDAYGNRPLI AQADQNAPRV PAARLGVHLK
251 ASLTDRIDAN LDYYRVFAQN KLARYETRTP GHHMLNLGAN YRRNTRYGEW
301 NWYVKADNLL NQSVYAHSSF LSDTPQMGRS FTGGVNVKF*
```

m149/a149 98.8% identity in 339 aa overlap

```
                   10        20        30        40        50        60
m149.pep   MLLDNKVQHYSFFGVEQANWDNFTLEGGVRVEKQKASIQYDKALIDRENYYNHPLPDLGA
           |||||||||||||||||||||||||||||||||||||:||||||||||||||||||||||
a149       MLLDNKVQHYSFFGVEQANWDNFTLEGGVRVEKQKASIRYDKALIDRENYYNHPLPDLGA
                   10        20        30        40        50        60

                   70        80        90       100       110       120
m149.pep   HRQTARSFALSGNWYFTPQHKLSLTASHQERLPSTQELYAHGKHVATNTFEVGNKHLNKE
           ||||||||||||||||||||||||||||||||||||||||||||||||||||||||||||
a149       HRQTARSFALSGNWYFTPQHKLSLTASHQERLPSTQELYAHGKHVATNTFEVGNKHLNKE
                   70        80        90       100       110       120

                  130       140       150       160       170       180
m149.pep   RSNNIELALGYEGDRWQYNLALYRNRFGNYIYAQTLNDGRGPKSIEDDSEMKLVRYNQSG
           ||||||||||||||||||||||||||||||||||||||||||||||||||||||||||||
a149       RSNNIELALGYEGDRWQYNLALYRNRFGNYIYAQTLNDGRGPKSIEDDSEMKLVRYNQSG
                  130       140       150       160       170       180

                  190       200       210       220       230       240
m149.pep   ADFYGAEGEIYFKPTPRYRIGVSGDYVRGRLKNLPSLPGREDAYGNRPFIAQDDQNAPRV
           ||||||||||||||||||||||||||||||||||||||||||||||||:||| |||||||
a149       ADFYGAEGEIYFKPTPRYRIGVSGDYVRGRLKNLPSLPGREDAYGNRPLIAQADQNAPRV
                  190       200       210       220       230       240

                  250       260       270       280       290       300
m149.pep   PAARLGFHLKASLTDRIDANLDYYRVFAQNKLARYETRTPGHHMLNLGANYRRNTRYGEW
           |||||| |||||||||||||||||||||||||||||||||||||||||||||||||||||
a149       PAARLGVHLKASLTDRIDANLDYYRVFAQNKLARYETRTPGHHMLNLGANYRRNTRYGEW
                  250       260       270       280       290       300

                  310       320       330       340
m149.pep   NWYVKADNLLNQSVYAHSSFLSDTPQMGRSFTGGVNVKFX
           ||||||||||||||||||||||||||||||||||||||||
           NWYVKADNLLNQSVYAHSSFLSDTPQMGRSFTGGVNVKFX
a149              310       320       330       340
```

The following partial DNA sequence was identified in *N. gonorrhoeae* <SEQ ID 601>:

g149-1.seq

```
  1 ATGGCACAAA TCACACTCAA ACCCATTGTT TTATCAATTC TTTTAATCAA
 51 CACACCCCTC CTCGCCCAAG CGCATGAAAC TGAGCAATCG GTGGGCTTGG
101 AAACGGTCAG CGTCGTCGGC AAAAGCCGTC CGCGCGCGAC TTCGGGGCTG
151 CTGCACACTT CGACCGCCTC CGACAAAATC ATCTCCGGCG ATACTTTGCG
201 CCAAAAAGCC GTCAACTTGG GCGACGCTTT GGACGGCGTA CCGGGCATCC
251 ACGCTTCGCA ATACGGCGGC GGCGCATCCG CTCCCGTTAT TCGCGGTCAA
301 ACGGGCAGAC GGATTAAAGT ATTGAACCAT CACGGCGAAA CGGGCGATAT
351 GGCGGACTTT TCTCCCGATC ACGCCATTAT GGTAGATACC GCCTTGTCGC
401 AACAGGTTGA AATCCTGCGC GGGCCGGTTA CGCTCTTGTA CAGCTCGGGC
```

-continued

```
 451 AATGTGGCGG GGCTGGTCGA TGTTGCCGAT GGAAAAATCC CCGAAAAAAT
 501 GCCTGAAAAC GGCGTATCGG GCGaagccgG ATTGCGTTTG AGCAGCGGCA
 551 ATTTAGAAAA ACTGACATCC GCAGGCATCA ATATCGGACT GGGCAAAAAC
 601 TTCGTGCTGC ATACCGAAGG CTTGTACCGC AAATCGGGCG ATTACGCCGT
 651 ACCGCGTTAC CGCAATCTGA AACGCCTGCC CGACAGCCAT GCCGATTCGC
 701 AAACGGGCAG CATCGGGCTG TCTTGGGTGG GCGAAAAAGG CTTTATCGGC
 751 GCAGCATACA GCGACCGTCG CGACCGCTAC GGCCTGCCTG CCCACAGCCA
 801 CGAATACGAT GATTGCCACG CCGACATCAT CTGGCAAAAG AGTTTGATCA
 851 ACAAACGCTA TTTGCAGCTT TATCCGCACT TGTTGACCGA AGAAGACATC
 901 GATTACGACA ATCCGGGCTT GAGCTGCGGC TTCCACGACG GCGACGGTGC
 951 ACACGCACAC ACCCACAACG GCAAACCGTG GATAGACCTG CGCAACAAAC
1001 GCTACGAACT CCGCGCCGAA TGGAAGCAGC CATTCCCCGG TTTTGAAGCC
1051 CTGCGCGTAC ATCTGAACCG CAATGACTAC CACCACGACG AAAAAGCAGG
1101 CGATGCAGTA GAAAACTTCT TCAACAACAA AACACACAAC GCCCGTATCG
1151 AGTTGCGCCA CCAACCCATA GGCCGTCTGA AAGGCAGCTG GGGCGTGCAA
1201 TATTTGGGAC AAAAATCCAG CGCGCTTTCC GCCATTCCCG AAACCGTCCA
1251 ACAACCGATG TTGATTGACA ACAATGTCCG CCATTACAGC TTTTTCGGTG
1301 TAGAACAGGC AAATTGGGAC AACTTCACGC TTGAAGGCGG CGTACGCGTG
1351 GAAAAACAAA AAGCCTCCAT CCGGTACGAC AAAGCATTGA TTGATCGAGA
1401 AAACTACTAC AACCAGCCCC TGCCCGACCT CGGCGCGCAC CGCCAAACCG
1451 CCCGCTCGTT CGCACTTTCG GGCAACTGGT ATTTCACGCC ACACCACAAA
1501 CTCAGCCTGA CCGCCTCCCA TCAGGAACGC CTGCCGTCAA CGCAAGAACT
1551 GTACGCACAC GGCAAGCACG TCGCCACCAA CACCTTTGAA GTCGGCAACA
1601 AACACCTCAA CAAAGAGCGT TCCAACAATA TCGAACTCGC GCTGGGCTAC
1651 GAAGGCGACC GCTGGCAATA CAATCTGGCA GCCTACCGCA ACCGATTCGG
1701 CAACTACATT TACGCCCAAA CCTTAAACGA CGGACGCGGC CCCAAATCCA
1751 TCGAAGACGA CAGCGAAATG AAGCTCGTGC GCTACAACCA ATCCGGTGCC
1801 GACTTCTACG GCGCGGAAGG CGAAATCTAC TTCAAACCGA CACCGCGCTA
1851 CCGCATCGGT GTTTCCGGCG ACTATGTACG AGGCCGTCTG AAAAACCTGC
1901 CGTCCCTACC CGGCAGGGAA GATCCCTACG GCAAACGTCC CTTCATCGCA
1951 CAAGCCGACC AAAACGCCCC CCGCATTCCG GCTGCGCGCC TCGGCTTCCA
2001 CCTGAAAACC TCGCTAACCG ACCGTATCGA TGCCAATTTG GACTACTACC
2051 GCGTGTTCGC CCAAAACAAA CTCGCCCGCT ACGAAACGCG TACGCCCGGA
2101 CACCATATGC TCAACCTCGG TGCAAACTAC CGCCGCAATA CGCGCTATGG
2151 CGAGTGGAAT TGGTACGTCA AAGCCGACAA CCTGCTCAAC CAATCCGTTT
2201 ACGCCCACAG CAGCTTCCTC TCTGATACGC CGCAAATGGG CCGCAGCTTT
2251 ACCGGCGGCG TAAACGTGAA GTTTTAA
```

This corresponds to the amino acid sequence <SEQ ID 602; ORF 149-1.ng>:

g149-1.pep

```
  1 MAQITLKPIV LSILLINTPL LAQAHETEQS VGLETVSVVG KSRPRATSGL
 51 LHTSTASDKI ISGDTLRQKA VNLGDALDGV PGIHASQYGG GASAPVIRGQ
101 TGRRIKVLNH HGETGDMADF SPDHAIMVDT ALSQQVEILR GPVTLLYSSG
151 NVAGLVDVAD GKIPEKMPEN GVSGEAGLRL SSGNLEKLTS AGINIGLGKN
201 FVLHTEGLYR KSGDYAVPRY RNLKRLPDSH ADSQTGSIGL SWVGEKGFIG
251 AAYSDRRDRY GLPAHSHEYD DCHADIIWQK SLINKRYLQL YPHLLTEEDI
301 DYDNPGLSCG FHDGDGAHAH THNGKPWIDL RNKRYELRAE WKQPFPGFEA
351 LRVHLNRNDY HHDEKAGDAV ENFENNKTHN ARIELRHQPI GRLKGSWGVQ
401 YLGQKSSALS AIPETVQQPM LIDNNVRHYS FFGVEQANWD NFTLEGGVRV
451 EKQKASIRYD KALIDRENYY NQPLPDLGAH RQTARSFALS GNWYFTPHHK
501 LSLTASHQER LPSTQELYAH GKHVATNTFE VGNKHLNKER SNNIELALGY
551 EGDRWQYNLA AYRNRFGNYI YAQTLNDGRG PKSIEDDSEM KLVRYNQSGA
601 DFYGAEGEIY FKPTPRYRIG VSGDYVRGRL KNLPSLPGRE DPYGKRPFIA
651 QADQNAPRIP AARLGFHLKT SLTDRIDANL DYYRVFAQNK LARYETRTPG
701 HHMLNLGANY RRNTRYGEWN WYVKADNLLN QSVYAHSSFL SDTPQMGRSF
751 TGGVNVKF*
```

The following partial DNA sequence was identified in *N. meningitidis* <SEQ ID 603>:

m149-1.seq

```
  1 ATGGCACAAA CTACACTCAA ACCCATTGTT TTATCAATTC TTTTAATCAA
 51 CACACCCCTC CTCGCCCAAG CGCATGAAAC TGAGCAATCG GTGGATTTGG
101 AAACGGTCAG CGTCGTCGGC AAAAGCCGTC CGCGCGCCAC GTCGGGGCTG
151 TTGCACACTT CGACCGCCTC CGACAAAATC ATCTCCGGCG ATACCTTGCG
201 CCAAAAAGCC GTCAACTTGG GCGACGCTTT AGACGGCGTA CCGGGCATCC
251 ACGCTTCGCA ATACGGCGGC GGCGCGTCTG CTCCCGTCAT TCGCGGTCAA
301 ACAGGCAGGC GGATTAAAGT GTTGAACCAT CACGGCGAAA CAGGCGATAT
351 GGCGGATTTT TCGCCCGATC ACGCCATTAT GGTAGATACC GCCTTGTCGC
401 AACAGGTCGA AATCCTGCGC GGGCCGGTTA CGCTCTTGTA CAGCTCGGGC
451 AATGTGGCGG GGCTGGTCGA TGTTGCCGAT GGCAAAATCC CCGAAAAAAT
501 GCCTGAAAAC GGCGTATCGG GCGAACTCGG ATTGCGTTTG AGCAGCGGCA
551 ATCTGGAAAA ACTCACGTCC GGCGGCATCA ATATCGGTTT GGGCAAAAAC
601 TTTGTATTGC ACACGGAAGG GCTGTACCGC AAATCGGGGG ATTACGCCGT
651 ACCGCGTTAC CGCAATCTGA AACGCCTGCC CGACAGCCAC GCCGATTCGC
701 AAACGGGCAG CATCGGGCTG TCTTGGGTTG GCGAAAAAGG TTTTATCGGC
751 GTAGCGTACA GCGACCGTCG CGACCAATAT GGTCTGCCTG CCCACAGCCA
801 CGAATACGAT GATTGCCACG CCGACATCAT CTGGCAAAAG AGCTTGATTA
851 ACAAACGCTA TTTACAGCTT TATCCGCACC TGTTGACCGA AGAAGACATC
901 GATTACGACA ATCCGGGCTT GAGCTGCGGC TTCCACGACG ACGATAATGC
```

-continued

951 ACACGCACAC ACCCACAGCG GCAGACCGTG GATAGACCTG CGCAACAAAC

1001 GCTACGAACT CCGTGCCGAA TGGAAGCAAC CGTTCCCCGG TTTTGAAGCC

1051 CTGCGCGTAC ACCTGAACCG CAACGACTAC CGCCACGACG AAAAAGCAGG

1101 CGATGCAGTC GAAAACTTTT TTAACAACCA AACGCAAAAC GCCCGCATCG

1151 AGTTGCGCCA CCAACCCATA GGTCGTCTGA AAGGCAGCTG GGGCGTGCAA

1201 TATTTACAAC AAAAATCCAG TGCTTTATCT GCCATATCCG AAGCGGTTAA

1251 ACAACCGATG CTGCTTGACA ACAAAGTGCA ACATTACAGC TTTTTCGGTG

1301 TAGAACAGGC AAACTGGGAC AACTTCACGC TTGAAGGAGG CGTACGCGTG

1351 GAAAAACAAA AAGCCTCCAT TCAGTACGAC AAAGCATTGA TTGATCGGGA

1401 AAACTACTAC AACCACCCCC TGCCCGACCT CGGCGCGCAC CGCCAAACCG

1451 CCCGCTCATT CGCACTTTCG GGCAACTGGT ATTTCACGCC ACAACACAAA

1501 CTCAGCCTGA CCGCCTCCCA TCAGGAACGC CTGCCGTCAA CGCAAGAGCT

1551 GTACGCACAC GGCAAACACG TCGCCACCAA CACCTTTGAA GTCGGCAACA

1601 AACACCTCAA CAAAGAGCGT TCCAACAATA TCGAACTCGC GCTGGGCTAC

1651 GAAGGCGACC GCTGGCAATA CAATCTGGCA CTCTACCGCA ACCGCTTCGG

1701 TAACTACATT TACGCCCAAA CCTTAAACGA CGGACGCGGC CCCAAATCCA

1751 TCGAAGACGA CAGCGAAATG AAGCTCGTGC GCTACAACCA ATCCGGCGCC

1801 GACTTCTACG GCGCGGAAGG CGAAATCTAC TTCAAACCGA CACCGCGCTA

1851 CCGCATCGGC GTTTCCGGCG ACTATGTACG AGGCCGTCTG AAAAACCTGC

1901 CTTCCCTACC CGGCAGAGAA GATGCCTACG GCAACCGTCC TTTCATCGCA

1951 CAGGACGACC AAAATGCCCC CCGTGTTCCG GCTGCGCGCC TCGGCTTCCA

2001 CCTGAAAGCC TCGCTGACCG ACCGTATCGA TGCCAATTTG GACTACTACC

2051 GCGTGTTCGC CCAAAACAAA CTCGCCCGCT ACGAAACGCG CACGCCCGGA

2101 CACCATATGC TCAACCTCGG CGCAAACTAC CGCCGCAATA CGCGCTATGG

2151 CGAGTGGAAT TGGTACGTCA AAGCCGACAA CCTGCTCAAC CAATCCGTTT

2201 ACGCCCACAG CAGCTTTCTC TCTGATACGC CGCAAATGGG CCGCAGCTTT

2251 ACCGGCGGCG TGAACGTGAA GTTTTAA

This corresponds to the amino acid sequence <SEQ ID 604: ORF 149-1>:

m149-1.pep

1 MAQTTLKPIV LSILLINTPL LAQAHETEQS VDLETVSVVG KSRPRATSGL

51 LHTSTASDKI ISGDTLRQKA VNLGDALDGV PGIHASQYGG GASAPVIRGQ

101 TGRRIKVLNH HGETGDMADF SPDHAIMVDT ALSQQVEILR GPVTLLYSSG

151 NVAGLVDVAD GKIPEKMPEN GVSGELGLRL SSGNLEKLTS GGINIGLGKN

201 FVLHTEGLYR KSGDYAVPRY RNLKRLPDSH ADSQTGSIGL SWVGEKGFIG

251 VAYSDRRDQY GLPAHSHEYD DCHADIIWQK SLINKRYLQL YPHLLTEEDI

301 DYDNPGLSCG FHDDDNAHAH THSGRPWIDL RNKRYELRAE WKQPFPGFEA

351 LRVHLNRNDY RHDEKAGDAV ENFFNNQTQN ARIELRHQPI GRLKGSWGVQ

-continued

```
401 YLQQKSSALS AISEAVKQPM LLDNKVQHYS FFGVEQANWD NFTLEGGVRV

451 EKQKASIQYD KALIDRENYY NHPLPDLGAH RQTARSFALS GNWYFTPQHK

501 LSLTASHQER LPSTQELYAH GKHVATNTFE VGNKHLNKER SNNIELALGY

551 EGDRWQYNLA LYRNRFGNYI YAQTLNDGRG PKSIEDDSEM KLVRYNQSGA

601 DFYGAEGEIY FKPTPRYRIG VSGDYVRGRL KNLPSLPGRE DAYGNRPFIA

651 QDDQNAPRVP AARLGFHLKA SLTDRIDANL DYYRVFAQNK LARYETRTPG

701 HHMLNLGANY RRNTRYGEWN WYVKADNLLN QSVYAHSSFL SDTPQMGRSF

751 TGGVNVKF*
```

m149-1/g149-1 96.2% identity in 758 aa overlap

```
                     10        20        30        40        50        60
m149-1.pep   MAQTTLKPIVLSILLINTPLLAQAHETEQSVDLETVSVVGKSRPRATSGLLHTSTASDKI
             ||| ||||||||||||||||||||||||||| ||||||||||||||||||||||||||||
g149-1       MAQITLKPIVLSILLINTPLLAQAHETEQSVGLETVSVVGKSRPRATSGLLHTSTASDKI
                     10        20        30        40        50        60

                     70        80        90       100       110       120
m149-1.pep   ISGDTLRQKAVNLGDALDGVPGIHASQYGGGASAPVIRGQTGRRIKVLNHHGETGDMADF
             ||||||||||||||||||||||||||||||||||||||||||||||||||||||||||||
g149-1       ISGDTLRQKAVNLGDALDGVPGIHASQYGGGASAPVIRGQTGRRIKVLNHHGETGDMADF
                     70        80        90       100       110       120

                    130       140       150       160       170       180
m149-1.pep   SPDHAIMVDTALSQQVEILRGPVTLLYSSGNVAGLVDVADGKIPEKMPENGVSGELGLRL
             ||||||||||||||||||||||||||||||||||||||||||||||||||||||| ||||
g149-1       SPDHAIMVDTALSQQVEILRGPVTLLYSSGNVAGLVDVADGKIPEKMPENGVSGEAGLRL
                    130       140       150       160       170       180

                    190       200       210       220       230       240
m149-1.pep   SSGNLEKLTSGGINIGLGKNFVLHTEGLYRKSGDYAVPRYRNLKRLPDSHADSQTGSIGL
             ||||||||||:|||||||||||||||||||||||||||||||||||||||||||||||||
g149-1       SSGNLEKLTSAGINIGLGKNFVLHTEGLYRKSGDYAVPRYRNLKRLPDSHADSQTGSIGL
                    190       200       210       220       230       240

                    250       260       270       280       290       300
m149-1.pep   SWVGEKGFIGVAYSDRRDQYGLPAHSHEYDDCHADIIWQKSLINKRYLQLYPHLLTEEDI
             ||||||||||:|||||||:|||||||||||||||||||||||||||||||||||||||||
g149-1       SWVGEKGFIGAAYSDRRDRYGLPAHSHEYDDCHADIIWQKSLINKRYLQLYPHLLTEEDI
                    250       260       270       280       290       300

                    310       320       330       340       350       360
m149-1.pep   DYDNPGLSCGFHDDDNAHAHTHSGRPWIDLRNKRYELRAEWKQPFPGFEALRVHLNRNDY
             ||||||||||||| |:||||||:|:|||||||||||||||||||||||||||||||||||
g149-1       DYDNPGLSCGFHDGDGAHAHTHNGKPWIDLRNKRYELRAEWKQPFPGFEALRVHLNRNDY
                    310       320       330       340       350       360

                    370       380       390       400       410       420
m149-1.pep   RHDEKAGDAVENFFNNQTQNARIELRHQPIGRLKGSWGVQYLQQKSSALSAISEAVKQPM
             :|||||||||||||||:|:||||||||||||||||||||||| ||||||||| |:|:|||
g149-1       HHDEKAGDAVENFFNNKTHNARIELRHQPIGRLKGSWGVQYLGQKSSALSAIPETVQQPM
                    370       380       390       400       410       420

                    430       440       450       460       470       480
m149-1.pep   LLDNKVQHYSFFGVEQANWDNFTLEGGVRVEKQKASIQYDKALIDRENYYNHPLPDLGAH
             |:||:|:||||||||||||||||||||||||||||||:|||||||||||||:||||||||
g149-1       LIDNNVRHYSFFGVEQANWDNFTLEGGVRVEKQKASIRYDKALIDRENYYNQPLPDLGAH
                    430       440       450       460       470       480

                    490       500       510       520       530       540
m149-1.pep   RQTARSFALSGNWYFTPQHKLSLTASHQERLPSTQELYAHGKHVATNTFEVGNKHLNKER
             |||||||||||||||||:||||||||||||||||||||||||||||||||||||||||||
g149-1       RQTARSFALSGNWYFTPHHKLSLTASHQERLPSTQELYAHGKHVATNTFEVGNKHLNKER
                    490       500       510       520       530       540

                    550       560       570       580       590       600
m149-1.pep   SNNIELALGYEGDRWQYNLALYRNRFGNYIYAQTLNDGRGPKSIEDDSEMKLVRYNQSGA
             |||||||||||||||||||| |||||||||||||||||||||||||||||||||||||||
g149-1       SNNIELALGYEGDRWQYNLAAYRNRFGNYIYAQTLNDGRGPKSIEDDSEMKLVRYNQSGA
                    550       560       570       580       590       600

                    610       620       630       640       650       660
m149-1.pep   DFYGAEGEIYFKPTPRYRIGVSGDYVRGRLKNLPSLPGREDAYGNRPFIAQDDQNAPRVP
             ||||||||||||||||||||||||||||||||||||||||| ||:|||||| ||||||:|
g149-1       DFYGAEGEIYFKPTPRYRIGVSGDYVRGRLKNLPSLPGREDPYGKRPFIAQADQNAPRIP
                    610       620       630       640       650       660

                    670       680       690       700       710       720
m149-1.pep   AARLGFHLKASLTDRIDANLDYYRVFAQNKLARYETRTPGHHMLNLGANYRRNTRYGEWN
             |||||||||:||||||||||||||||||||||||||||||||||||||||||||||||||
g149-1       AARLGFHLKTSLTDRIDANLDYYRVFAQNKLARYETRTPGHHMLNLGANYRRNTRYGEWN
                    670       680       690       700       710       720
```

-continued

```
                  730        740        750       759
m149-1.pep  WYVKADNLLNQSVYAHSSFLSDTPQMGRSFTGGVNVKFX
            |||||||||||||||||||||||||||||||||||||||
g149-1      WYVKADNLLNQSVYAHSSFLSDTPQMGRSFTGGVNVKFX
                  730        740        750
```

The following partial DNA sequence was identified in *N. meningitidis* <SEQ ID 605>:

a149-1.seq

```
   1 ATGGCACAAA CTACACTCAA ACCCATTGTT TTATCAATTC TTTTAATCAA
  51 CACACCCCTC CTCTCCCAAG CGCATGGAAC TGAGCAATCA GTGGGCTTGG
 101 AAACGGTCAG CGTCGTCGGC AAAAGCCGTC CGCGCGCCAC TTCGGGGCTG
 151 CTGCACACTT CTACCGCCTC CGACAAAATC ATCAGCGGCG ACACCTTGCG
 201 ACAAAAAGCC GTCAACTTGG GTGATGCTTT AGACGGCGTA CCGGGCATTC
 251 ATGCCTCGCA ATACGGCGGC GGCGCATCCG CTCCCGTTAT TCGCGCTCAA
 301 ACAGGCAGAC GGATTAAAGT GTTGAACCAT CACGGCGAAA CGGGCGACAT
 351 GGCGGACTTC TCTCCAGACC ATGCAATCAT GGTGGACAGC GCCTTGTCGC
 401 AACAGGTCGA AATCCTGCGC GGTCCGGTTA CGCTCTTGTA CAGCTCGGGC
 451 AATGTGGCGG GGCTGGTCGA TGTTGCCGAT GGCAAAATCC CCGAAAAAAT
 501 GCCTGAAAAC GGCGTATCGG GCGAACTCGG ATTGCGTTTG AGCAGCGGCA
 551 ATCTGGAAAA ACTCACGTCC GGCGGCATCA ATATCGGTTT GGGCAAAAAC
 601 TTTGTATTGC ACACGGAAGG GCTGTACCGC AAATCGGGGG ATTACGCCGT
 651 ACCGCGTTAC CGCAATCTGA AACGCCTGCC CGACAGCCAC GCCGATTCGC
 701 AAACGGGCAG CATCGGGCTG TCTTGGGTTG GCGAAAAAGG CTTTATCGGC
 751 GCAGCATACA GCGACCGTCG CGACCAATAT GGTCTGCCTG CCCACAGCCA
 801 CGAATACGAT GATTGCCACG CCGACATCAT CTGGCAAAAG AGTTTGATTA
 851 ACAAACGCTA TTTGCAGCTT TATCCGCACC TGTTGACCGA AGAAGACATC
 901 GATTACGACA ATCCGGGCTT GAGCTGCGGC TTTCACGACG ACGATGATGC
 951 ACACGCCCAT GCCCACAACG GCAAACCTTG GATAGACCTG CGCAACAAAC
1001 GCTACGAACT CCGCGCCGAA TGGAAGCAAC CGTTCCCCGG TTTTGAAGCC
1051 CTGCGCGTAC ACCTGAACCG CAACGACTAC CGCCACGACG AAAAAGCAGG
1101 CGATGCAGTA GAAAACTTTT TTAACAACCA AACGCAAAAC GCCCGTATCG
1151 AGTTGCGCCA CCAACCCATA GGCCGTCTGA AAGGCAGCTG GGGCGTGCAA
1201 TATTTGGGAC AAAAATCCAG TGCTTTATCT GCCACATCCG AAGCGGTCAA
1251 ACAACCGATG CTGCTTGACA ATAAAGTGCA ACATTACAGC TTTTTCGGTG
1301 TAGAACAGGC AAACTGGGAC AACTTCACGC TTGAAGGCGG CGTACGCGTG
1351 GAAAAACAAA AAGCCTCCAT CCGCTACGAC AAAGCATTGA TTGATCGGGA
1401 AAACTACTAC AACCATCCCC TGCCCGACCT CGGCGCGCAC CGCCAAACCG
1451 CCCGCTCATT CGCACTTTCG GGCAACTGGT ATTTCACGCC ACAACACAAA
1501 CTCAGCCTGA CCGCCTCCCA TCAGGAACGC CTGCCGTCAA CGCAAGAGCT
1551 GTACGCACAC GGCAAACACG TCGCCACCAA CACCTTTGAA GTCGGCAACA
```

-continued

```
1601 AACACCTCAA CAAAGAGCGT TCCAACAATA TCGAACTCGC GCTGGGCTAC

1651 GAAGGCGACC GCTGGCAATA CAATCTGGCA CTCTACCGCA ACCGCTTCGG

1701 CAACTACATT TACGCCCAAA CCTTAAACGA CGGACGCGGC CCCAAATCCA

1751 TCGAAGACGA CAGCGAAATG AAGCTCGTGC GCTACAACCA ATCCGGTGCG

1801 GACTTCTACG GCGCGGAAGG CGAAATCTAC TTCAAACCGA CACCGCGCTA

1851 CCGCATCGGC GTTTCCGGCG ACTATGTACG AGGCCGTCTG AAAAACCTGC

1901 CTTCCCTACC CGGCAGGGAA GACGCCTACG GCAACCGCCC ACTCATTGCC

1951 CAAGCCGACC AAAACGCCCC TCGCGTTCCG GCTGCGCGCC TCGGCGTCCA

2001 CCTGAAAGCC TCGCTGACCG ACCGCATCGA TGCCAATTTG GACTACTACC

2051 GCGTGTTCGC CCAAAACAAA CTCGCCCGCT ACGAAACGCG CACGCCCGGA

2101 CACCATATGC TCAACCTCGG CGCAAACTAC CGCCGCAATA CGCGCTATGG

2151 CGAGTGGAAT TGGTACGTCA AAGCCGACAA CCTGCTCAAC CAATCCGTTT

2201 ACGCCCACAG CAGCTTCCTC TCTGATACGC CGCAAATGGG CCGCAGCTTT

2251 ACCGGCGGCG TGAACGTGAA GTTTTAA
```

This corresponds to the amino acid sequence <SEQ ID 606: ORF 149-1.a>:

```
a149-1.pep

  1 MAQTTLKPIV LSILLINTPL LSQAHGTEQS VGLETVSVVG KSRPRATSGL

 51 LHTSTASDKI ISGDTLRQKA VNLGDALDGV PGIHASQYGG GASAPVIRGQ

101 TGRRIKVLNH HGETGDMADF SPDHAIMVDS ALSQQVEILR GPVTLLYSSG

151 NVAGLVDVAD GKIPEKMPEN GVSGELGLRL SSGNLEKLTS GGINIGLGKN

201 FVLHTEGLYR KSGDYAVPRY RNLKRLPDSH ADSQTGSIGL SWVGEKGFIG

251 AAYSDRRDQY GLPAHSHEYD DCHADIIWQK SLINKRYLQL YPRLLTEEDI

301 DYDNPGLSCG FHDDDDAHAH AHNGKPWIDL RNKRYELRAE WKQPFPGFEA

351 LRVHLNRNDY RHDEKAGDAV ENFFNNQTQN ARIELRHQPI GRLKGSWGVQ

401 YLGQKSSALS ATSEAVKQPM LLDNKVQHYS FEGVEQANWD NFTLEGGVRV

451 EKQKASIRYD KALIDRENYY NHPLPDLGAH RQTARSFALS GNWYFTPQHK

501 LSLTASHQER LPSTQELYAH GKHVATNTFE VGNKHLNKER SNNIELALGY

551 EGDRWQYNLA LYRNRFGNYI YAQTLNDGRG PKSIEDDSEM KLVRYNQSGA

601 DFYGAEGEIY FKPTPRYRIG VSGDYVRGRL KNLPSLPGRE DAYGNRPLIA

651 QADQNAPRVP AARLGVHLKA SLTDRIDANL DYYRVEAQNK LARYETRTPG

701 HHMLNLGANY RRNTRYGEWN WYVKADNLLN QSVYAHSSFL SDTPQMGRSF

751 TGGVNVKF*
```

a149-1/m149-1 98.0% identity in 758 aa overlap

```
                    10        20        30        40        50        60
a149-1.pep   MAQTTLKPIVLSILLINTPLLSQAHGTEQSVGLETVSVVGKSRPRATSGLLHTSTASDKI
             |||||||||||||||||||||:||| ||||| ||||||||||||||||||||||||||||
m149-1       MAQITLKPIVLSILLINTPLLAQAHETEQSVDLETVSVVGKSRPRATSGLLHTSTASDKI
                    10        20        30        40        50        60
```

-continued

```
                 70         80         90        100        110        120
a149-1.pep  ISGDTLRQKAVNLGDALDGVPGIHASQYGGGASAPVIRGQTGRRIKVLNHHGETGDMADF
            ||||||||||||||||||||||||||||||||||||||||||||||||||||||||||||
m149-1      ISGDTLRQKAVNLGDALDGVPGIHASQYGGGASAPVIRGQTGRRIKVLNHHGETGDMADF
                 70         80         90        100        110        120

                130        140        150        160        170        180
a149-1.pep  SPDHAIMVDSALSQQVEILRGPVTLLYSSGNVAGLVDVADGKIPEKMPENGVSGELGLRL
            |||||||||:||||||||||||||||||||||||||||||||||||||||||||||||||
m149-1      SPDHAIMVDTALSQQVEILRGPVTLLYSSGNVAGLVDVADGKIPEKMPENGVSGELGLRL
                130        140        150        160        170        180

                190        200        210        220        230        240
a149-1.pep  SSGNLEKLTSGGINIGLGKNFVLHTEGLYRKSGDYAVPRYRNLKRLPDSHADSQTGSIGL
            ||||||||||||||||||||||||||||||||||||||||||||||||||||||||||||
m149-1      SSGNLEKLTSGGINIGLGKNFVLHTEGLYRKSGDYAVPRYRNLKRLPDSHADSQTGSIGL
                190        200        210        220        230        240

                250        260        270        280        290        300
a149-1.pep  SWVGEKGFIGAAYSDRRDQYGLPAHSHEYDDCHADIIWQKSLINKRYLQLYPHLLTEEDI
            ||||||||||:|||||||||||||||||||||||||||||||||||||||||||||||||
m149-1      SWVGEKGFIGVAYSDRRDQYGLPAHSHEYDDCHADIIWQKSLINKRYLQLYPHLLTEEDI
                250        260        270        280        290        300

                310        320        330        340        350        360
a149-1.pep  DYDNPGLSCGFHDDDDAHAHAHNGKPWIDLRNKRYELRAEWKQPFPGFEALRVHLNRNDY
            |||||||||||||||:||||:|:|:|||||||||||||||||||||||||||||||||||
m149-1      DYDNPGLSCGFHDDDNAHAHTHSGRPWIDLRNKRYELRAEWKQPFPGFEALRVHLNRNDY
                310        320        330        340        350        360

                370        380        390        400        410        420
a149-1.pep  RHDEKAGDAVENFFNNQTQNARIELRHQPIGRLKGSWGVQYLGQKSSALSATSEAVKQPM
            |||||||||||||||||||||||||||||||||||||||||| |||||||| ||||||||
m149-1      RHDEKAGDAVENFFNNQTQNARIELRHQPIGRLKGSWGVQYLQQKSSALSAISEAVKQPM
                370        380        390        400        410        420

                430        440        450        460        470        480
a149-1.pep  LLDNKVQHYSFFGVEQANWDNFTLEGGVRVEKQKASIRYDKALIDRENYYNHPLPDLGAH
            |||||||||||||||||||||||||||||||||||||:||||||||||||||||||||||
m149-1      LLDNKVQHYSFFGVEQANWDNFTLEGGVRVEKQKASIQYDKALIDRENYYNHPLPDLGAH
                430        440        450        460        470        480

                490        500        510        520        530        540
a149-1.pep  RQTARSFALSGNWYFTPQHKLSLTASHQERLPSTQELYAHGKHVATNTFEVGNKHLNKER
            ||||||||||||||||||||||||||||||||||||||||||||||||||||||||||||
m149-1      RQTARSFALSGNWYFTPQHKLSLTASHQERLPSTQELYAHGKHVATNTFEVGNKHLNKER
                490        500        510        520        530        540

                550        560        570        580        590        600
a149-1.pep  SNNIELALGYEGDRWQYNLALYRNRFGNYIYAQTLNDGRGPKSIEDDSEMKLVRYNQSGA
            ||||||||||||||||||||||||||||||||||||||||||||||||||||||||||||
m149-1      SNNIELALGYEGDRWQYNLALYRNRFGNYIYAQTLNDGRGPKSIEDDSEMKLVRYNQSGA
                550        560        570        580        590        600

                610        620        630        640        650        660
a149-1.pep  DFYGAEGEIYFKPTPRYRIGVSGDYVRGRLKNLPSLPGREDAYGNRPLIAQADQNAPRVP
            |||||||||||||||||||||||||||||||||||||||||||||||:||| ||||||||
m149-1      DFYGAEGEIYFKPTPRYRIGVSGDYVRGRLKNLPSLPGREDAYGNRPFIAQDDQNAPRVP
                610        620        630        640        650        660

                670        680        690        700        710        720
a149-1.pep  AARLGVHLKASLTDRIDANLDYYRVFAQNKLARYETRTPGHHMLNLGANYRRNTRYGEWN
            ||||| ||||||||||||||||||||||||||||||||||||||||||||||||||||||
m149-1      AARLGFHLKASLTDRIDANLDYYRVFAQNKLARYETRTPGHHMLNLGANYRRNTRYGEWN
                670        680        690        700        710        720

                730        740        750       759
a149-1.pep  WYVKADNLLNQSVYAHSSFLSDTPQMGRSFTGGVNVKFX
            ||||||||||||||||||||||||||||||||||||||
m149-1      WYVKADNLLNQSVYAHSSFLSDTPQMGRSFTGGVNVKFX
                730        740        750
```

The following partial DNA sequence was identified in *N. gonorrhoeae* <SEQ ID 607>:

<u>g150.seq (partial)</u>

```
  1 ..TACTGCAAGG CAGACCCCTT TCCCGCCGCC CTGCTGGCCA ATCAGAAAAT
 51 CACCGCCCGC CAATCCGATA AAGACGTGCG CCACATCGAA ATCGATTTGA
101 GCGGTTCGGA TTTGCACTAC CTCCCGGGCG ACGCGCTCGG CGTTTGGTTT
151 GACAACGATC CGGCACTGGT CGGGGAAATC CTAGACCTGC TCGGCATCAA
201 TCCGGCAACG GAAATACAGG CGGGCGGAAA AACCCTGCCG GTTGCCTCCG
251 CACTGTTATC CCATTTCGAA CTCACGCAAA ACACCCCCGC CTTTGTCAAA
```

-continued

```
 301 GGCTATGCCA CGTTCGCCGA TAATGACGAA CTCGACCGTA TTGCTGCCGA
 351 CAACGCCGTT TTGCAAGGCT TTGTGCAAAG CACGCCGATT GCCGGTGTGC
 401 TGCACCGCTT CCCGGCAAAA CTGACGGCGG AACAATTCGC CGGCCTGCTG
 451 CGCCCGCTTG CGCCGCGCCT GTATTCGATT TCCTCGTCGC AGGCGGAAGC
 501 GGGGGACGAA GTGCACCTGA CCGTCGGCGC AGTGCGTTTC GAACACGAAG
 551 GGCGCGCCAG GGCGGGCGGC GCATCGGGTT TCTTTGCCGA CCGGCTGGAA
 601 GAGGACGGCA CGGTGCGCGT GTTTGCGGAA CGCAACGACG GCTTCAGGCT
 651 GCCCGAAGAC AGCCGCAAGC CGATTGTGAT GATCGGCTCC GGTACCGGCG
 701 TCGCACCGTT CCGCGCCTTC GTCCAACAAC GTGCCGCAGA AAATGCGGAA
 751 GGCAGAAACT GGCTGATTTT CGGCAATCCG CATTTTGCCG CCGACTTCCT
 801 CTATCAGACC GAATGGCAGC AGTTTGCCAA AGACGGCTTC CTGCACAGAT
 851 ATGACTTCGC CTGGTCGCGC GATCAGGAAG AAAAAATCTA TGTGCAGGAC
 901 AAAATCCGCG AACAGGCGGA AGGACTTTGG CAATGGCTGC AGGAAGGCGC
 951 GCATATCTAT GTGTGCGGCG ATGCGGCAAA AATGGCAAAA GAAGTGGAAG
1001 CCGCCTTGCT GGATGTGATT ATCGGGGCAG GGCATTCGGA CGAAGACGGC
1051 GCAGAAGGAT ATTTGGATAT GCTGCGCGAA GAAAAACGCT ATCAGCGTGA
1101 TGTTTATTGA
```

This corresponds to the amino acid sequence <SEQ ID 608; ORF 150.ng>:

g150.pep (partial)

```
  1 ..YCKADPFPAA LLANQKITAR QSDKDVRHIE IDLSGSDLHY LPGDALGVWF
 51 DNDPALVGEI LDLLGINPAT EIQAGGKTLP VASALLSHFE LTQNTPAFVK
101 GYATFADNDE LDRIAADNAV LQGFVQSTPI AGVLHRFPAK LTAEQFAGLL
151 RPLAPRLYSI SSSQAEAGDE VHLTVGAVRF EHEGRARAGG ASGFFADRLE
201 EDGTVRVFAE RNDGFRLPED SRKPIVMIGS GTGVAPFRAF VQQRAAENAE
251 GRNWLIFGNP HFAADFLYQT EWQQFAKDGF LHRYDFAWSR DQEEKIYVQD
301 KIREQAEGLW QWLQEGAHIY VCGDAAKMAK EVEAALLDVI IGAGHSDEDG
351 AEGYLDMLRE EKRYQRDVY*
```

The following partial DNA sequence was identified in *N. meningitidis* <SEQ ID 609>:

m150.seq

```
  1 ATGCAGAACA CAAATCCGCC ATTACCGCCT CTGCCGCCCG AAATCACGCA
 51 GCTCCTGTCG GGGCTGGACG CGGCACAATG GGCGTGGCTG TCCGGCTACG
101 CTTGGGCAAA AGCAGGAAAC GGGGCATCTG CAGGACTGCC CGCGCTTCAG
151 ACGGCATTGC CGGCGGCAGA ACCTTTTTCC GTAACCGTCC TTTCCGCCTC
201 GCAAACCGGC AATGCGAAAT CCGTTGCCGA CAAAGCGGCG GACAGCCTGG
251 AAGCCGCCGG CATCCAAGTC AGTCGCGCCG AACTGAAAGA CTATAAGGCG
301 AAAAACATCG CCGGCGAACG CCGCCTGCTG CTGGTTACCT CCACCCAAGG
```

-continued

```
 351 CGAAGGCGAA CCGCCGAAAG AAGCCGTCGT GCTGCACAAA CTGCTGAACG
 401 GCAAAAAAGC CCCGAAATTG GACAAACTCC AATTTGCCGT ACTGGGTTTG
 451 GGCGACAGTT CCTATCCGAA TTTCTGTCAG GCAGGTAAAG ATTTCGACCG
 501 GCGTTTTGAA GAATTGGGCG CAAAACGGCT GCTCGAACGC GTTGATGCGG
 551 ATTTGGACTT TACCGCCTCC GCAAACGCCT GGACAGATAA TATCGCCGCA
 601 CTCTTAAAAG AAGAAGCCGC AAAAAACCGG GCAACGCCCG CGCCGCAGAC
 651 AACGCCCCCC GCCGGCCTTC AGACGGCACC GGATGGCAGG TACTGCAAGG
 701 CAGCCCCCTT TCCCGCCGCC CTGCTGGCCA ATCAGAAAAT CACCGCCCGC
 751 CAATCCGATA AAGACGTGCG CCACATCGAA ATCGATTTGA GCGGTTCGGA
 801 TTTGCACTAC CTCCCGGGCG ACGCGCTCGG CGTTTGGTTT GACAACGATC
 851 CGGCACTGGT CAGGGAAATC CTAGACCTGC TCGGCATCGA TCCGGCAACG
 901 GAAATACAGG CGGGCGGAAA GATGATGCCG GTTGCGCGCG CACTTTCATC
 951 TCATTTCGAA CTCACGCAAA ACACTCCGGC TTTCGTCAAA GGCTATGCCG
1001 CGTTCGCCCA TTATGAAGAA CTCGATAAAA TCATTGCCGA TAACGCCGTT
1051 TTGCAGGATT TCGTGCAAAA CACGCCTATT GTCGATGTGC TGCACCGCTT
1101 CCCGGCAAGC CTGACGGCAG AACAATTCAT CCGTTTACTG CGTCCGCTTG
1151 CACCCCGTTT GTATTCGATT TCTTCAGCAC AGGCGGAAGT GGGCGATGAA
1201 GTGCATTTAA CTGTCGGCGT GGTTCGTTTT GAACACGAAG GCCGCGCCAG
1251 AACGGGCGGC GCATCGGGTT TCCTTGCCGA CCGGCTGGAA GAGGACGGCA
1301 CGGTGCGCGT GTTTGTGGAA CGCAACGACG GCTTCAGGCT GCCCGAAGAC
1351 AGCCGCAAGC CGATTGTGAT GATCGGCTCG GGCACCGGCG TCGCACCGTT
1401 CCGCGCTTTC GTCCAACAAC GTGCCGCAGA AAATGCGGAA GGCAAAAACT
1451 GGCTGATTTT CGGCAATCCG CATTTTGCCC GTGATTTTCT CTATCAAACC
1501 GAATGGCAGC AGTTTGCCAA AGACGGCTTC CTGCACAGGT ACGATTTCGC
1551 CTGGTCCCGC GATCAGGAAG AAAAAATCTA TGTGCAGGAC AAAATCCGCG
1601 AACAGGCGGA AGGACTTTGG CAATGGCTGC AGGAAGGCGC GCATATCTAT
1651 GTGTGCGGCG ATGCGGCAAA AATGGCAAAA GACGTGGAAG CCGCCTTGCT
1701 GGATGTGATT ATCGGGGCAG GACATTTGGA CGAAGAGGGC GCAGAAGAAT
1751 ATTTGGATAT GCTGCGCGAA GAAAAACGCT ATCAGCGTGA TGTTTATTGA
```

This corresponds to the amino acid sequence <SEQ ID 610; ORF 150>:

m150.pep

```
  1 MQNTNPPLPP LPPEITQLLS GLDAAQWAWL SGYAWAKAGN GASAGLPALQ
 51 TALPAAEPFS VTVLSASQTG NAKSVADKAA DSLEAAGIQV SRAELKDYKA
101 KNIAGERRLL LVTSTQGEGE PPKEAVVLHK LLNGKKAPKL DKLQFAVLGL
151 GDSSYPNFCQ AGKDFDRRFE ELGAKRLLER VDADLDFTAS ANAWTDNIAA
```

-continued

```
201 LLKEEAAKNR ATPAPQTTPP AGLQTAPDGR YCKAAPFPAA LLANQKITAR

251 QSDKDVRHIE IDLSGSDLHY LPGDALGVWF DNDPALVREI LDLLGIDPAT

301 EIQAGGKMMP VARALSSHFE LTQNTPAFVK GYAAFAHYEE LDKIIADNAV

351 LQDFVQNTPI VDVLHRFPAS LTAEQFIRLL RPLAPRLYSI SSAQAEVGDE

401 VHLTVGVVRF EHEGRARTGG ASGFLADRLE EDGTVRVFVE RNDGFRLPED

451 SRKPIVMIGS GTGVAPFRAF VQQRAAENAE GKNWLIFGNP HFARDFLYQT

501 EWQQFAKDGF LHRYDFAWSR DQEEKIYVQD KIREQAEGLW QWLQEGAHIY

551 VCGDAAKMAK DVEAALLDVI IGAGHLDEEG AEEYLDMLRE EKRYQRDVY*
```

Computer analysis of this amino acid sequence gave the following results:

Homology with a predicted ORF from *N. gonorrhoeae*

ORF 150 shows 91.3% identity over a 369 aa overlap with a predicted ORF (ORF 150.ng) from *N. gonorrhoeae*:

m150/g150

```
                 210       220       230       240       250       260
m150.pep  LLKEEAAKNRATPAPQTTPPAGLQTAPDGRYCKAAPFPAALLANQKITARQSDKDVRHIE
                                        |||| |||||||||||||||||||||||||
g150                                    YCKADPFPAALLANQKITARQSDKDVRHIE
                                                  10        20        30

                 270       280       290       300       310       320
m150.pep  IDLSGSDLHYLPGDALGVWFDNDPALVREILDLLGIDPATEIQAGGKMMPVARALSSHFE
          ||||||||||||||||||||||||||| ||||||||:|||||||||| :||| || ||||
g150      IDLSGSDLHYLPGDALGVWFDNDPALVGEILDLLGINPATEIQAGGKTLPVASALLSHFE
                  40        50        60        70        80        90

                 330       340       350       360       370       380
m150.pep  LTQNTPAFVKGYAAFAHYEELDKIIADNAVLQDFVQNTPIVDVLHRFPASLTAEQFIRLL
          |||||||||||||:||  :|||:| ||||||| |||:|||: |||||||:||||||  ||
g150      LTQNTPAFVKGYATFADNDELDRIAADNAVLQGFVQSTPIAGVLHRFPAKLTAEQFAGLL
                 100       110       120       130       140       150

                 390       400       410       420       430       440
m150.pep  RPLAPRLYSISSAQAEVGDEVHLTVGVVRFEHEGRARTGGASGFLADRLEEDGTVRVFVE
          ||||||||||||:|||:|||||||||:||||||||||:||||||:|||||||||||||:|
g150      RPLAPRLYSISSSQAEAGDEVHLTVGAVRFEHEGRARAGGASGFFADRLEEDGTVRVFAE
                 160       170       180       190       200       210

                 450       460       470       480       490       500
m150.pep  RNDGFRLPEDSRKPIVMIGSGTGVAPFRAFVQQRAAENAEGKNWLIFGNPHFARDFLYQT
          |||||||||||||||||||||||||||||||||||||||||:||||||||||| ||||||
g150      RNDGFRLPEDSRKPIVMIGSGTGVAPFRAFVQQRAAENAEGRNWLIFGNPHFAADFLYQT
                 220       230       240       250       260       270

                 510       520       530       540       550       560
m150.pep  EWQQFAKDGFLHRYDFAWSRDQEEKIYVQDKIREQAEGLWQWLQEGAHIYVCGDAAKMAK
          ||||||||||||||||||||||||||||||||||||||||||||||||||||||||||||
g150      EWQQFAKDGFLHRYDFAWSRDQEEKIYVQDKIREQAEGLWQWLQEGAHIYVCGDAAKMAK
                 280       290       300       310       320       330

                 570       580       590       600
m150.pep  DVEAALLDVIIGAGHLDEEGAEEYLDMLREEKRYQRDVYX
          :|||||||||||||| ||:||| |||||||||||||||||
g150      EVEAALLDVIIGAGHSDEDGAEGYLDMLREEKRYQRDVYX
                 340       350       360       370
```

The following partial DNA sequence was identified in *N. meningitidis* <SEQ ID 611>:

a150.seq

```
  1 ATGCAGAACA CAAATCCGCC ATTACCGCCT ATGCCGCCCG AAATCACGCA

 51 GCTCCTGTCG GGGCTGGACG CGGCACAATG GGCGTGGCTG TCCGGCTACG

101 CTTGGGCAAA AGCAGGAAAC GGGGCATCTG CAGGACTGCC CGCGCTTCAG
```

-continued

151 ACGGCATTGC CGACGGCAGA ACCTTTTTCC GTAACCGTCC TTTCCGCCTC

201 GCAAACCGGC AATGCGAAAT CCGTTGCCGA CAAAGCGGCG GACAGCCTGG

251 AAGCCGCCGG CATCCAAGTC AGTCGCGCCG AACTGAAAGA CTATAAGGCG

301 AAAAACATCG CCGGCGAACG CCGCCTGCTG CTGGTTACCT CCACCCAAGG

351 CGAAGGCGAA CCGCCGGAAG AAGCCGTCGT GCTGCACAAA CTGCTGAACG

401 GCAAAAAAGC CCCGAAATTG GACAAACTCC AATTTGCCGT ACTGGGTTTG

451 GGCGACAGCT CCTATCCGAA TTTCTGCCGG GCGGGCAAAG ATTTCGACAA

501 ACGTTTTGAA GAATTGGGCG CAAAACGCCT GCTCGAACGC GTTGATGCGG

551 ATTTGGACTT TGCCGCCGCC GCAGACGGAT GGACAGATAA TATCGCCGCA

601 CTCTTAAAAG AAGAAGCCGC AAAAAACCGG GCAACGCCCG CGCCGCAGAC

651 AACGCCCCCC GCCGGCCTTC AGACGGCACC GGATGGCAGG TACTGCAAGG

701 CAGACCCCTT TCCCGCCGCC CTGCTGGCCA ATCAGAAAAT CACCGCCCGC

751 CAATCCGATA AAGACGTGCG CCACATCGAA ATCGATTTGA GCGGTTCGGA

801 TTTGCACTAC CTCCCGGGCG ACGCGCTCGG CGTTTGGTTT GACAACGATC

851 CGGCACTGGT CAGGGAAATC CTAGACCTGC TCGGCATCGA TCAGGCAACG

901 GAAATACAGG CGGGCGGAAA AACCCTGCCG GTTGCCTCCG CACTGTTATC

951 CCATTTTGAA CTCACGCAAA ACACCCCCGC CTTTGTCAAA GGCTATGCCC

1001 CGTTCGCCGA TGATGACGAA CTCGACCGTA TTGCTGCCGA CAACGCCGTT

1051 TTGCAAGGCT TTGTGCAAAG CACGCCGATT GCCGATGTGC TGCACCGCTT

1101 CCCGGCAAAA CTGACAGCGG AACAATTCGC CGGCCTACTG CGCCCGCTTG

1151 CGCCGCGCCT GTATTCGATT TCCTCGTCGC AGGCGGAAGT GGGGGACGAA

1201 GTGCACCTGA CCGTCGGCGC GGTGCGTTTC GAACACGAAG GGCGCGCCAG

1251 GGCGGGCGGC GCATCGGGTT TCCTTGCCGA CCGGCTGGAA GAGGACGGCA

1301 CGGTGCGCGT GTTTGTGGAA CGCAACGACG GCTTCAGGCT GCCCGAAGAC

1351 AGCCGCAAGC CGATTGTGAT GATCGGCTCG GGCACCGGCG TCGCACCGTT

1401 CCGCGCTTTC GTCCAACAAC GTGCCGCAGA AAATGCGGAA GGCAAAAACT

1451 GGCTGTTTTT CGGCAATCCG CATTTTGCCC GTGATTTTCT CTATCAAACC

1501 GAATGGCAGC AGTTTGCCAA AGACGGCTTC CTGCACAGAT ACGATTTCGC

1551 CTGGTCGCGC GATCAGGAAG AAAAAATCTA TGTGCAGGAC AAAATCCGCG

1601 AACAGGCGGA AGGACTTTGG CAATGGCTGC AGGAAGGCGC GCATATCTAT

1651 GTGTGCGGCG ATGCGGCAAA AATGGCAAAA GACGTGGAAG CCGCCTTGCT

1701 GGATGTGATT ATCGGGGCAG GACATTTGGA CGAAGAGGGC GCAGAAGAAT

1751 ATTTGGATAT GCTGCGCGAA GAAAAACGCT ATCAGCGTGA TGTTTATTGA

This corresponds to the amino acid sequence <SEQ ID 612; ORF 150.a>:

a150.pep

1 MQNTNPPLPP MPPEITQLLS GLDAAQWAWL SGYAWAKAGN GASAGLPALQ

51 TALPTAEPFS VTVLSASQTG NAKSVADKAA DSLEAAGIQV SRAELKDYKA

-continued

```
101 KNIAGERRLL LVTSTQGEGE PPEEAVVLHK LLNGKKAPKL DKLQFAVLGL

151 GDSSYPNFCR AGKDFDKRFE ELGAKRLLER VDADLDFAAA ADGWTDNIAA

201 LLKEEAAKNR ATPAPQTTPP AGLQTAPDGR YCKADPFPAA LLANQKITAR

251 QSDKDVRHIE IDLSGSDLHY LPGDALGVWF DNDPALVREI LDLLGIDQAT

301 EIQAGGKTLP VASALLSHFE LTQNTPAFVK GYAPFADDDE LDRIAADNAV

351 LQGFVQSTPI ADVLHRFPAK LTAEQFAGLL RPLAPRLYSI SSSQAEVGDE

401 VHLTVGAVRF EHEGRARAGG ASGFLADRLE EDGTVRVFVE RNDGFRLPED

451 SRKPIVMIGS GTGVAPFRAF VQQRAAENAE GKNWLFFGNP HFARDFLYQT

501 EWQQFAKDGF LHRYDFAWSR DQEEKIYVQD KIREQAEGLW QWLQEGAHIY

551 VCGDAAKMAK DVEAALLDVI IGAGHLDEEG AEEYLDMLRE EKRYQRDVY*
```

m150/a150 94.8% identity in 599 aa overlap

```
                   10        20        30        40        50        60
m150.pep   MQNTNPPLPPLPPEITQLLSGLDAAQWAWLSGYAWAKAGNGASAGLPALQTALPAAEPFS
           ||||||||||:|||||||||||||||||||||||||||||||||||||||||||:|||||
a150       MQNTNPPLPPMPPEITQLLSGLDAAQWAWLSGYAWAKAGNGASAGLPALQTALPTAEPFS
                   10        20        30        40        50        60

                   70        80        90       100       110       120
m150.pep   VTVLSASQTGNAKSVADKAADSLEAAGIQVSRAELKDYKAKNIAGERRLLLVTSTQGEGE
           ||||||||||||||||||||||||||||||||||||||||||||||||||||||||||||
a150       VTVLSASQTGNAKSVADKAADSLEAAGIQVSRAELKDYKAKNIAGERRLLLVTSTQGEGE
                   70        80        90       100       110       120

                  130       140       150       160       170       180
m150.pep   PPKEAVVLHKLLNGKKAPKLDKLQFAVLGLGDSSYPNFCQAGKDFDRRFEELGAKRLLER
           ||:||||||||||||||||||||||||||||||||||||:||||||:|||||||||||||
a150       PPEEAVVLHKLLNGKKAPKLDKLQFAVLGLGDSSYPNFCRAGKDFDKRFEELGAKRLLER
                  130       140       150       160       170       180

                  190       200       210       220       230       240
m150.pep   VDADLDFTASANAWTDNIAALLKEEAAKNRATPAPQTTPPAGLQTAPDGRYCKAAPFPAA
           |||||||:|:|::||||||||||||||||||||||||||||||||||||||||| |||||
a150       VDADLDFAAAADGWTDNIAALLKEEAAKNRATPAPQTTPPAGLQTAPDGRYCKADPFPAA
                  190       200       210       220       230       240

                  250       260       270       280       290       300
m150.pep   LLANQKITARQSDKDVRHIEIDLSGSDLHYLPGDALGVWFDNDPALVREILDLLGIDPAT
           ||||||||||||||||||||||||||||||||||||||||||||||||||||||||| ||
a150       LLANQKITARQSDKDVRHIEIDLSGSDLHYLPGDALGVWFDNDPALVREILDLLGIDQAT
                  250       260       270       280       290       300

                  310       320       330       340       350       360
m150.pep   EIQAGGKMMPVARALSSHFELTQNTPAFVKGYAAFAHYEELDKIIADNAVLQDFVQNTPI
           ||||||| :||| || ||||||||||||||||| ||  :|||:| ||||||| |||:|||
a150       EIQAGGKTLPVASALLSHFELTQNTPAFVKGYAPFADDDELDRIAADNAVLQGFVQSTPI
                  310       320       330       340       350       360

                  370       380       390       400       410       420
m150.pep   VDVLHRFPASLTAEQFIRLLRPLAPRLYSISSAQAEVGDEVHLTVGVVRFEHEGRARTGG
           :||||||||:||||||  ||||||||||||||:|||||||||||||:||||||||||:||
a150       ADVLHRFPAKLTAEQFAGLLRPLAPRLYSISSSQAEVGDEVHLTVGAVRFEHEGRARAGG
                  370       380       390       400       410       420

                  430       440       450       460       470       480
m150.pep   ASGFLADRLEEDGTVRVFVERNDGFRLPEDSRKPIVMIGSGTGVAPFRAFVQQRAAENAE
           ||||||||||||||||||||||||||||||||||||||||||||||||||||||||||||
a150       ASGFLADRLEEDGTVRVFVERNDGFRLPEDSRKPIVMIGSGTGVAPFRAFVQQRAAENAE
                  430       440       450       460       470       480

                  490       500       510       520       530       540
m150.pep   GKNWLIFGNPHFARDFLYQTEWQQFAKDGFLHRYDFAWSRDQEEKIYVQDKIREQAEGLW
           |||||:||||||||||||||||||||||||||||||||||||||||||||||||||||||
a150       GKNWLFFGNPHFARDFLYQTEWQQFAKDGFLHRYDFAWSRDQEEKIYVQDKIREQAEGLW
                  490       500       510       520       530       540

                  550       560       570       580       590       600
m150.pep   QWLQEGAHIYVCGDAAKMAKDVEAALLDVIIGAGHLDEEGAEEYLDMLREEKRYQRDVYX
           ||||||||||||||||||||||||||||||||||||||||||||||||||||||||||||
a150       QWLQEGAHIYVCGDAAKMAKDVEAALLDVIIGAGHLDEEGAEEYLDMLREEKRYQRDVYX
                  550       560       570       580       590       600
```

The following partial DNA sequence was identified in *N. gonorrhoeae* <SEQ ID 613>:

g151.seq

```
   1 ATGAAACAAA TCCGCAACAT CGCCATCATC GCACACGTCG ACCACGGCAA
  51 AACCACATTG GTCGACCAAC TGCTGCGCCA ATCCGGCACA TTCCGCGCCA
 101 ACCAGCAGGT TGACGAGCGC GTGATGGACA GCAACGACCT TGAAAAAGAA
 151 CGCGGCATCA CCATCCTCGC CAAAAACACC GCCATCGATT ACGAAGGCTG
 201 CCACATCAAT ATCGTCGACA CGCCGGGACA CGCCGACTTC GGCGGCGAAG
 251 TGGAGCGCGT TTTGGGGATG GTGGATTGCG TCGTCTTGTT GGTGGACGCA
 301 CAGGAAGGTC CGATGCCGCA AACCCGTTTC GTGACCAAAA AAGCCTTGGC
 351 TTTGGGGCTG AAACCGATTG TCGTCATCAA CAAAATCGAC AAACCGTCCG
 401 CCCGTCCGAG CTGGGTTATC GACCAGACTT TCGAGTTGTT CGACAACTTG
 451 GGTGCGACCG ACGAGCAGTT GGATTTCCCG ATTGTTTACG CTTCAGGTTT
 501 GAGCGGCTTT GCCAAGCTGG AAGAAAccga CGAGAGCAGC GATATGCGCC
 551 CGCtgttcgA CACCATCCTA AAATACAcgc ctgCACCGAG CGGCAGCGCG
 601 GACGAGCCGC TGCAACTGCA AATTTCCCAA CTCGACTACG ACAACTACAC
 651 CGGCCGCCTC GGTATCGGTC GTATCTTGAA CGGACGCATC AAACCCGGCC
 701 AAACCGTTGC CGTGATGAAC CACGAGCAGC AAATCGCCCA AGGCCGCATC
 751 AACCAGCTTT TGGGTTTCAA AGGCTTGGAA CGCGTGCCGC TTGAAGAAGC
 801 CGAAGCCGGC GACATTGTGA TTATTTCCGG TATCGAAGAC ATCGGCATCG
 851 GCGTAACCAT CACCGACAAA GACAACCCCA AAGGCCTGCC GATGTTGAGC
 901 GTGGACGAAC CGACGCTGAC GATGGACTTT ATGGTAAACA CCAGCCCGCT
 951 CGCAGGTACA GAAGGCAAAT TCGTGACCAG CCGCCAAATC CGCGACCGCC
1001 TGCAAAAAGA ATTGCTGACC AACGTTGCCC TGCGCGTGGA AGACACCGCC
1051 GatgCCGACG TGTTCCGCGT ATCcgGGCGC GGCGAACTGC ACCTGACGAT
1101 TTTGCTGGAA AATATGCGCC GCGAAGGCTA CGAACTCGCC GTCGGCAAGC
1151 CGCGCGTCGT GTACCGAGAC ATCGACGGTC AAAAATGCGA ACCTTATGAA
1201 AACCTGACTG TGGACGTACc cgacgacAAC CAAGGCGCGG TAATGGAAGA
1251 ACTCGGCCGC CGCCGTGGCG AACTGACCAA TATGGAAAGC GACGGCAACG
1301 GacgCACCCG CCTCGAATAC CATATTCCAG CGCGCGGCTT GATCGGTTTC
1351 CAAGGCGAAT TCATGACCCT GACGCGCGGC GTCGGGCTGA TGAgccacGT
1401 GTTcgacgac tacgcgcccg tcaAACCCGA TATGCCCGGC CGCCACAACG
1451 GCGTactggt GtcccaAGAG CAGGGCGAGG CGGTTGCTTA CGCCTTGTGG
1501 AATCTTGAAG ACCGCGGCCG TATGTTCGTA TCGCCCAACG ACAAAATCTA
1551 CGAAGGTATG ATTATCGGCA TCCACAGCCG CGACAACGAT TTGGTGGTCA
1601 ACCCGCTCAA AGGCAAAAAA CTCACCAATA TCCGTGCCAG CGGTACCGAC
1651 GAAGCGGTGC GCCTGACCAC GCCGATCAAA CTGAcgcTGG AAGGCGCGGT
1701 CGAGTTTATC GACGATGACG AGCTGGTGGA AATCACGCCG CAAtccatcc
1751 gcctgcgcat gcgttacctG AGCGaattgg aacgccgccg tcaTTTTAAA
1801 AagctgGATT AA
```

This corresponds to the amino acid sequence <SEQ ID 614; ORF 151.ng>:

g151.pep

```
  1 MKQIRNIAII AHVDHGKTTL VDQLLRQSGT FRANQQVDER VMDSNDLEKE
 51 RGITILAKNT AIDYEGCHIN IVDTPGHADF GGEVERVLGM VDCVVLLVDA
101 QEGPMPQTRF VTKKALALGL KPIVVINKID KPSARPSWVI DQTFELFDNL
151 GATDEQLDFP IVYASGLSGF AKLEETDESS DMRPLFDTIL KYTPAPSGSA
201 DEPLQLQISQ LDYDNYTGRL GIGRILNGRI KPGQTVAVMN HEQQIAQGRI
251 NQLLGFKGLE RVPLEEAEAG DIVIISGIED IGIGVTITDK DNPKGLPMLS
301 VDEPTLTMDF MVNTSPLAGT EGKFVTSRQI RDRLQKELLT NVALRVEDTA
351 DADVFRVSGR GELHLTILLE NMRREGYELA VGKPRVVYRD IDGQKCEPYE
401 NLTVDVPDDN QGAVMEELGR RRGELTNMES DGNGRTRLEY HIPARGLIGF
451 QGEFMTLTRG VGLMSHVFDD YAPVKPDMPG RHNGVLVSQE QGEAVAYALW
501 NLEDRGRMFV SPNDKIYEGM IIGIHSRDND LVVNPLKGKK LTNIRASGTD
551 EAVRLTTPIK LTLEGAVEFI DDDELVEITP QSIRLRMRYL SELERRRHFK
601 KLD*
```

The following partial DNA sequence was identified in *N. meningitidis* <SEQ ID 615>:

m151.seq

```
   1 ATGAAACAAA TCCGCAACAT CGCCATCATC GCCCACGTCG ACCACGGCAA
  51 AACCACATTG GTCGACCAAC TGCTGCGCCA ATCCGGCACA TTCCGCGCCA
 101 ACCAGCAGGT TGACGAGCGC GTGATGGACA GCAACGACCT TGAAAAAGAA
 151 CGCGGCATCA CCATCCTCGC CAAAAACACC GCCATCGATT ACGAAGGCTA
 201 CCACATCAAT ATCGTCGACA CGCCGGGACA CGCCGACTTC GGCGGCGAAG
 251 TAGAGCGCGT TTTGGGGATG GTGGACTGCG TCGTCTTGTT GGTGGACGCG
 301 CAGGAAGGCC CGATGCCGCA AACCCGTTTC GTGACCAAAA AAGCCTTGGC
 351 TTTGGGGCTG AAACCGATTG TCGTCATCAA CAAAATCGAC AAGCCGTCCG
 401 CTCGTCCGAG CTGGGTTATC GACCAAACTT TCGAGCTGTT CGACAACTTG
 451 GGCGCGACCG ACGAGCAGTT GGATTTCCCG ATTGTTTACG CTTCAGGGTT
 501 GAGCGGTTTC GCCAAATTGG AAGAAACCGA CGAGAGCAAC GACATGCGTC
 551 CGCTGTTCGA TACTATCTTA AAATATACGC CTGCACCGAG CGGCAGCGCG
 601 GACGAAACGC TGCAACTGCA AATTTCCCAA CTCGACTACG ACAACTACAC
 651 CGGCCGCCTC GGTATCGGTC GTATCTTGAA CGGACGCATC AAACCCGGCC
 701 AAACCGTTGC CGTCATGAAC CACGATCAGC AAATCGCCCA AGGCCGCATC
 751 AACCAGCTTT TGGGTTTCAA AGGTTTGGAA CGCGTGCCGC TTGAAGAAGC
 801 CGAAGCCGGC GACATCGTGA TTATTTCCGG TATCGAAGAC ATCGGTATCG
 851 GCGTAACCAT CACCGACAAA GACAATCCCA AAGGCCTACC GATGTTGAGC
 901 GTGGACGAAC CGACGCTGAC GATGGACTTT ATGGTCAACA CCAGCCCGCT
 951 GGCGGGTACG GAAGGCAAAT TCGTAACCAG CCGCCAAATC CGCGACCGCC
1001 TGCAAAAAGA ATTGCTGACC AACGTCGCCC TGCGCGTGGA AGATACCGCC
1051 GATGCCGACG TGTTCCGCGT ATCCGGGCGC GGCGAGCTGC ACCTGACCAT
```

-continued

```
1101 TTTGCTGGAA AACATGCGCC GCGAAGGCTA CGAACTCGCC GTCGGCAAAC
1151 CGCGCGTCGT GTACCGCGAC ATCGACGGTC AAAAATGCGA ACCGTATGAA
1201 AACCTGACCG TGGATGTACC CGACGACAAC CAAGGCGCGG TAATGGAAGA
1251 ACTCGGCCGC CGCCGTGGCG AACTGACTAA TATGGAAAGC GACGGCAACG
1301 GACGCACCCG CCTCGAATAC CATATTCCAG CGCGCGGCTT GATCGGTTTC
1351 CAAGGCGAAT TTATGACCCT GACGCGCGGG GTCGGGCTGA TGAGCCACGT
1401 GTTCGACGAT TACGCGCCCG TCAAACCCGA TATGCCCGGC CGCCACAACG
1451 GCGTGCTGGT GTCCCAAGAG CAGGGCGAGG CAGTCGCTTA CGCCTTGTGG
1501 AATCTGGAAG ACCGCGGCCG TATGTTCGTA TCGCCCAACG ACAAAATCTA
1551 CGAAGGCATG ATTATCGGCA TCCACAGTCG CGACAACGAT TTGGTGGTCA
1601 ACCCGCTCAA AGGCAAAAAA CTTACCAACA TCCGTGCCAG CGGTACCGAC
1651 GAAGCCGTTC GCCTGACCAC GCCAATCAAG CTGACGCTGG AAGGTGCGGT
1701 TGAGTTTATC GACGATGACG AACTCGTTGA AATCACGCCG CAATCCATCC
1751 GTCTGCGCAA GCGTTACTTG AGCGAATTGG AACGCCGCCG CCACTTTAAA
1801 AAGCTGGATT GA
```

This corresponds to the amino acid sequence <SEQ ID 616; ORF 151>:

m151.pep

```
  1 MKQIRNIAII AHVDHGKTTL VDQLLRQSGT FRANQQVDER VMDSNDLEKE
 51 RGITILAKNT AIDYEGYHIN IVDTPGHADF GGEVERVLGM VDCVVLLVDA
101 QEGPMPQTRF VTKKALALGL KPIVVINKID KPSARPSWVI DQTFELFDNL
151 GATDEQLDFP IVYASGLSGF AKLEETDESN DMRPLFDTIL KYTPAPSGSA
201 DETLQLQISQ LDYDNYTGRL GIGRIINGRI KPGQTVAVMN HDQQIAQGRI
251 NQLLGFKGLE RVPLEEAEAG DIVIISGIED IGIGVTITDK DNPKGLPMLS
301 VDEPTLTMDF MVNTSPLAGT EGKFVTSRQI RDRLQKELLT NVALRVEDTA
351 DADVFRVSGR GELHLTILLE NMRREGYELA VGKPRVVYRD IDGQKCEPYE
401 NLTVDVPDDN QGAVMEELGR RRGELTNMES DGNGRTRLEY HIPARGLIGF
451 QGEFMTLTRG VGLMSHVFDD YAPVKPDMPG RHNGVLVSQE QGEAVAYALW
501 NLEDRGRMFV SPNDKIYEGM IIGIHSRDND LVVNPLKGKK LTNIRASGTD
551 EAVRLTTPIK LTLEGAVEFI DDDELVEITP QSIRLRKRYL SELERRRHFK
601 KLD*
```

Computer analysis of this amino acid sequence gave the following results:

Homology with a predicted ORF from *N. gonorrhoeae*

ORF 151 shows 99.2% identity over a 603 aa overlap with a predicted ORF (ORF 151.ng) from *N. gonorrhoeae*:

m151/g151

```
                10        20        30        40        50        60
m151.pep  MKQIRNIAIIAHVDHGKTTLVDQLLRQSGTFRANQQVDERVMDSNDLEKERGITILAKNT
          ||||||||||||||||||||||||||||||||||||||||||||||||||||||||||||
g151      MKQIRNIAIIAHVDHGKTTLVDQLLRQSGTFRANQQVDERVMDSNDLEKERGITILAKNT
                10        20        30        40        50        60

                70        80        90       100       110       120
m151.pep  AIDYEGYHINIVDTPGHADFGGEVERVLGMVDCVVLLVDAQEGPMPQTRFVTKKALALGL
          |||||| |||||||||||||||||||||||||||||||||||||||||||||||||||||
g151      AIDYEGCHINIVDTPGHADFGGEVERVLGMVDCVVLLVDAQEGPMPQTRFVTKKALALGL
                70        80        90       100       110       120

               130       140       150       160       170       180
m151.pep  KPIVVINKIDKPSARPSWVIDQTFELFDNLGATDEQLDFPIVYASGLSGFAKLEETDESN
          |||||||||||||||||||||||||||||||||||||||||||||||||||||||||||:
g151      KPIVVINKIDKPSARPSWVIDQTFELFDNLGATDEQLDFPIVYASGLSGFAKLEETDESS
               130       140       150       160       170       180

               190       200       210       220       230       240
m151.pep  DMRPLFDTILKYTPAPSGSADETLQLQISQLDYDNYTGRLGIGRILNGRIKPGQTVAVMN
          ||||||||||||||||||||| ||||||||||||||||||||||||||||||||||||||
g151      DMRPLEDTILKYTPAPSGSAGEPLQLQISQLDYDNYTGRLGIGRILNGRIKPGQTVAVMN
               190       200       210       220       230       240

               250       260       270       280       290       300
m151.pep  HDQQIAQGRINQLLGFKGLERVPLEEAEAGDIVIISGIEDIGIGVTITDKDNPKGLPMLS
          |:||||||||||||||||||||||||||||||||||||||||||||||||||||||||||
g151      HEQQIAQGRINQLLGFKGLERVPLEEAEAGDIVIISGIEDIGIGVTITDKDNPKGLPMLS
               250       260       270       280       290       300

               310       320       330       340       350       360
m151.pep  VDEPTLTMDFMVNTSPLAGTEGKFVTSRQIRDRLQKELLTNVALRVEDTADADVFRVSGR
          ||||||||||||||||||||||||||||||||||||||||||||||||||||||||||||
g151      VDEPTLTMDFMVNTSPLAGTEGKFVTSRQIRDRLQKELLTNVALRVEDTADADVFRVSGR
               310       320       330       340       350       360

               370       380       390       400       410       420
m151.pep  GELHLTILLENMRREGYELAVGKPRVVYRDIDGQKCEPYENLTVDVPDDNQGAVMEELGR
          ||||||||||||||||||||||||||||||||||||||||||||||||||||||||||||
g151      GELHLTILLENMRREGYELAVGKPRVVYRDIDGQKCEPYENLTVDVPDDNQGAVMEELGR
               370       380       390       400       410       420

               430       440       450       460       470       480
m151.pep  RRGELTNMESDGNGRTRLEYHIPARGLIGFQGEFMTLTRGVGLMSHVFDDYAPVKPDMPG
          ||||||||||||||||||||||||||||||||||||||||||||||||||||||||||||
g151      RRGELTNMESDGNGRTRLEYHIPARGLIGFQGEFMTLTRGVGLMSHVFDDYAPVKPDMPG
               430       440       450       460       470       480

               490       500       510       520       530       540
m151.pep  RHNGVLVSQEQGEAVAYALWNLEDRGRMFVSPNDKIYEGMIIGIHSRDNDLVVNPLKGKK
          ||||||||||||||||||||||||||||||||||||||||||||||||||||||||||||
g151      RHNGVLVSQEQGEAVAYALWNLEDRGRMFVSPNDKIYEGMIIGIHSRDNDLVVNPLKGKK
               490       500       510       520       530       540

               550       560       570       580       590       600
m151.pep  LTNIRASGTDEAVRLTTPIKLTLEGAVEFIDDDELVEITPQSIRLRKRYLSELERRRHFK
          |||||||||||||||||||||||||||||||||||||||||||||| |||||||||||||
g151      LTNIRASGTDEAVRLTTPIKLTLEGAVEFIDDDELVEITPQSIRLRMRYLSELERRRHFK
               550       560       570       580       590       600

m151.pep  KLDX
          ||||
g151      KLDX
```

The following partial DNA sequence was identified in *N. meningitidis* <SEQ ID 617>:

a151.seq

```
  1 ATGAAACAAA TCCGCAACAT CGCCATCATC GCCCACGTCG ACCACGGCAA
 51 AACCACATTG GTCGACCAAC TGCTGCGCCA ATCCGGCACA TTCCGCGCCA
101 ACCAGCAGGT TGACGAGCGC GTGATGGACA GCAACGACCT TGAAAAAGAA
151 CGCGGCATCA CCATCCTCGC CAAAAACACC GCCATCGATT ACGAAGGCTA
201 CCACATCAAT ATCGTCGACA CGCCGGGACA CGCCGACTTC GGCGGCGAAG
251 TAGAGCGAGT TTTGGGGATG GTGGACTGCG TCGTCTTGTT GGTGGACGCG
301 CAGGAAGGCC CGATGCCGCA AACCCGTTTC GTGACCAAAA AAGCCTTGGC
351 TTTGGGGCTG AAACCGATTG TCGTCATCAA TAAAATCGAC AAACCGTCCG
```

-continued

```
 401 CCCGTCCGAG CTGGGTCATC GACCAAACTT TCGAGCTGTT CGACAACTTG
 451 GGCGCGACCG ACGAGCAGTT GGATTTCCCG ATTGTTTATG CTTCCGGTCT
 501 GTCCGGTTTC GCCAAATTGG AAGAAACCGA CGAGAGCAAC GACATGCGTC
 551 CGCTGTTCGA TACTATCTTA AAATATACGC CTGCACCGAG CGGCAGCGCG
 601 GACGAAACGC TGCAACTGCA AATTTCCCAA CTCGACTACG ACAACTACAC
 651 CGGCCGCCTC GGTATCGGTC GTATCTTGAA CGGACGTATC AAGCCCGGTC
 701 AAGTTGTTGC CGTCATGAAC CACGATCAAC AAATCGCCCA AGGCCGCATC
 751 AACCAGCTTT TGGGTTTCAA AGGTTTAGAA CGCGTGCCGC TTGAAGAAGC
 801 CGAAGCCGGC GACATCGTGA TTATTTCCGG TATTGAAGAC ATCGGCATCG
 851 GCGTAACCAT CACCGACAAA GACAACCCCA AAGGCCTGCC GATGTTGAGC
 901 GTGGACGAAC CGACGCTGAC GATGGACTTT ATGGTCAACA CCAGCCCGTT
 951 GGCAGGTACG GAAGGCAAAT TCGTAACCAG CCGCCAAATC CGCGACCGCC
1001 TGCAAAAAGA ATTGCTGACC AACGTCGCCC TGCGCGTGGA AGATACCGCC
1051 GATGCCGACG TGTTCCGCGT ATCCGGGCGC GGCGAGCTGC ACCTGACCAT
1101 TTTGCTGGAA AACATGCGCC GCGAAGGCTA CGAACTCGCC GTCGGCAAAC
1151 CGCGCGTCGT GTACCGCGAC ATCGACGGTC AAAAATGCGA ACCGTATGAA
1201 AACCTGACCG TGGACGTACC CGACGACAAC CAAGGCGCGG TAATGGAAGA
1251 ACTCGGCCGC CGCCGTGGCG AACTGACTAA TATGGAAAGC GACGGCAACG
1301 GACGCACCCG CCTCGAATAC CATATTCCAG CGCGCGGCTT GATCGGCTTC
1351 CAAGGCGAAT TTATGACCCT GACGCGCGGG GTCGGGCTGA TGAGCCACGT
1401 GTTCGACGAT TACGCGCCCG TCAAACCCGA TATGCCTGGC CGCCACAACG
1451 GCGTGCTGGT GTCCCAAGAG CAGGGCGAGG CAGTCGCTTA CGCCTTGTGG
1501 AATCTGGAAG ACCGCGGCCG TATGTTCGTA TCGCCCAACG ACAAAATCTA
1551 CGAAGGTATG ATTATCGGCA TCCACAGTCG CGACAACGAT TTGGTGGTCA
1601 ACCCGCTCAA AGGCAAAAAA CTTACCAACA TCCGTGCCAG CGGTACCGAC
1651 GAAGCCGTTC GCCTGACCAC GCCGATTAAG CTGACGCTGG AAGGTGCGGT
1701 CGAGTTTATC GACGATGATG AGCTGGTAGA AATCACGCCG CAATCCATCC
1751 GTCTGCGCAA GCGTTACTTG AGCGAATTGG AACGCCGCCG CCATTTCAAA
1801 AAGCTAGATT GA
```

This corresponds to the amino acid sequence <SEQ ID 618; ORF 15.a>:

a151.pep

```
  1 MKQIRNIAII AHVDHGKTTL VDQLLRQSGT FRANQQVDER VMDSNDLEKE
 51 RGITILAKNT AIDYEGYHIN IVDTPGHADF GGEVERVLGM VDCVVLLVDA
101 QEGPMPQTRF VTKKALALGL KPIVVINKID KPSARPSWVI DQTFELFDNL
151 GATDEQLDFP IVYASGLSGF AKLEETDESN DMRPLFDTIL KYTPAPSGSA
201 DETLQLQISQ LDYDNYTGRL GIGRILNGRI KPGQVVAVMN HDQQIAQGRI
251 NQLLGFKGLE RVPLEEAEAG DIVIISGIED IGIGVTITDK DNPKGLPMLS
```

-continued

```
301 VDEPTLTMDF MVNTSPLAGT EGKFVTSRQI RDRLQKELLT NVALRVEDTA

351 DADVFRVSGR GELHLTILLE NMRREGYELA VGKPRVVYRD IDGQKCEPYE

401 NLTVDVPDDN QGAVMEELGR RRGELTNMES DGNGRTRLEY HIPARGLIGF

451 QGEFMTLTRG VGLMSHVFDD YAPVKPDMPG RHNGVLVSQE QGEAVAYALW

501 NLEDRGRMFV SPNDKIYEGM IIGIHSRDND LVVNPLKGKK LTNIRASGTD

551 EAVRLTTPIK LTLEGAVEFI DDDELVEITP QSIRLRKRYL SELERRRHFK

601 KLD*
```

m151/a115 99.8% identity in 603 aa overlap

```
                    10        20        30        40        50        60
m151.pep   MKQIRNIAIIAHVDHGKTTLVDQLLRQSGTFRANQQVDERVMDSNDLEKERGITILAKNT
           ||||||||||||||||||||||||||||||||||||||||||||||||||||||||||||
a151       MKQIRNIAIIAHVDHGKTTLVDQLLRQSGTFRANQQVDERVMDSNDLEKERGITILAKNT
                    10        20        30        40        50        60

                    70        80        90       100       110       120
m151.pep   AIDYEGYHINIVDTPGHADFGGEVERVLGMVDCVVLLVDAQEGPMPQTRFVTKKALALGL
           ||||||||||||||||||||||||||||||||||||||||||||||||||||||||||||
a151       AIDYEGYHINIVDTPGHADFGGEVERVLGMVDCVVLLVDAQEGPMPQTRFVTKKALALGL
                    70        80        90       100       110       120

                   130       140       150       160       170       180
m151.pep   KPIVVINKIDKPSARPSWVIDQTFELFDNLGATDEQLDFPIVYASGLSGFAKLEETDESN
           ||||||||||||||||||||||||||||||||||||||||||||||||||||||||||||
a151       KPIVVINKIDKPSARPSWVIDQTFELFDNLGATDEQLDFPIVYASGLSGFAKLEETDESN
                   130       140       150       160       170       180

                   190       200       210       220       230       240
m151.pep   DMRPLFDTILKYTPAPSGSADETLQLQISQLDYDNYTGRLGIGRILNGRIKPGQTVAVMN
           ||||||||||||||||||||||||||||||||||||||||||||||||||||||:|||||
a151       DMRPLEDTILKYTPAPSGSAGETLQLQISQLDYDNYTGRLGIGRILNGRIKPGQVVAVMN
                   190       200       210       220       230       240
                   250       260       270       280       290       300
m151.pep   HDQQIAQGRINQLLGFKGLERVPLEEAEAGDIVIISGIEDIGIGVTITDKDNPKGLPMLS
           ||||||||||||||||||||||||||||||||||||||||||||||||||||||||||||
a151       HDQQIAQGRINQLLGFKGLERVPLEEAEAGDIVIISGIEDIGIGVTITDKDNPKGLPMLS
                   250       260       270       280       290       300
                   310       320       330       340       350       360
m151.pep   VDEPTLTMDFMVNTSPLAGTEGKFVTSRQIRDRLQKELLTNVALRVEDTADADVFRVSGR
           ||||||||||||||||||||||||||||||||||||||||||||||||||||||||||||
a151       VDEPTLTMDFMVNTSPLAGTEGKFVTSRQIRDRLQKELLTNVALRVEDTADADVFRVSGR
                   310       320       330       340       350       360
                   370       380       390       400       410       420
m151.pep   GELHLTILLENMRREGYELAVGKPRVVYRDIDGQKCEPYENLTVDVPDDNQGAVMEELGR
           ||||||||||||||||||||||||||||||||||||||||||||||||||||||||||||
a151       GELHLTILLENMRREGYELAVGKPRVVYRDIDGQKCEPYENLTVDVPDDNQGAVMEELGR
                   370       380       390       400       410       420
                   430       440       450       460       470       480
m151.pep   RRGELTNMESDGNGRTRLEYHIPARGLIGFQGEFMTLTRGVGLMSHVFDDYAPVKPDMPG
           ||||||||||||||||||||||||||||||||||||||||||||||||||||||||||||
a151       RRGELTNMESDGNGRTRLEYHIPARGLIGFQGEFMTLTRGVGLMSHVFDDYAPVKPDMPG
                   430       440       450       460       470       480
                   490       500       510       520       530       540
m151.pep   RHNGVLVSQEQGEAVAYALWNLEDRGRMFVSPNDKIYEGMIIGIHSRDNDLVVNPLKGKK
           ||||||||||||||||||||||||||||||||||||||||||||||||||||||||||||
a151       RHNGVLVSQEQGEAVAYALWNLEDRGRMFVSPNDKIYEGMIIGIHSRDNDLVVNPLKGKK
                   490       500       510       520       530       540
                   550       560       570       580       590       600
m151.pep   LTNIRASGTDEAVRLTTPIKLTLEGAVEFIDDDELVEITPQSIRLRKRYLSELERRRHFK
           ||||||||||||||||||||||||||||||||||||||||||||||||||||||||||||
a151       LTNIRASGTDEAVRLTTPIKLTLEGAVEFIDDDELVEITPQSIRLRKRYLSELERRRHFK
                   550       560       570       580       590       600

m151.pep   KLDX
           ||||
a151       KLDX
```

The following partial DNA sequence was identified in *N. gonorrhoeae* <SEQ ID 619>:

g152.seq

```
  1 ATGAAAAaca aAACCaaagt ctgGGacttc cCcacccgcc ttTTCCactG
 51 GctgcttgCC gCATCCctgc CCTTTATGTG gtatagCGCA AAAGCCGGCG
101 GcgataTGCT GcaatgGCAC ACGCGCGTCG GGCTGCTCGT CCTTTTCCTG
151 CTCGTATTCC GCCTCTGCTG GGGCATTTGG GGCAgcgATA CCGCCCGTTT
201 CTCccgTtTC GTCCGAGGTT GGGCAGGTAT ACGCGGCTAT CTGAAAAAcg
251 gCATTCCCGA ACAtatcCAG CCCGGACACA ACCCCTTGGG CGCACTgatg
301 gtcGTTGCGC TTTTGgccgc cgtcTCATTT CAagtcggcA CGGGGCTTTT
351 Tgccgccaat gaaaacacct tcagcaCCAa cggctacctc aaccatttgg
401 tttccgaaca tacgGGCAGC CTTATACGGA AAATCCACCT CAACTTTTTC
451 AAGCTGCTCG CCGTTTTTTC CGCAGTCCAC ATCGCCGCCG TCGCCGCATA
501 CCGCATATTC AAAAAGAAAA ACCTCGTCCG CCCGATGATA ACCGGCTTCA
551 AATACATCGA AGGCAAAACC TCAATCCGCT TTGCCGGCAA AGCCGCGCTT
601 GCCGCCGCAT TATCGGTTGC CGCGCTTGCC GCAGCCGCCA TCCTGCTCCT
651 GTCCTGA
```

This corresponds to the amino acid sequence <SEQ ID 620; ORF 152.ng>:

g152.pep

```
  1 MKNKTKVWDF PTRLFHWLLA ASLPFMWYSA KAGGDMLQWH TRVGLLVLFL
 51 LVFRLCWGIW GSDTARFSRF VRGWAGIRGY LKNGIPEHIQ PGHNPLGALM
101 VVALLAAVSF QVGTGLFAAN ENTFSTNGYL NHLVSEHTGS LIRKIHLNFF
151 KLLAVFSAVH IAAVAAYRIF KKKNLVRPMI TGFKYIEGKT SIRFAGKAAL
201 AAALSVAALA AAAILLLS*
```

The following partial DNA sequence was identified in *N. meningitidis* <SEQ ID 621>:

m152.seq

```
  1 ATGAAAAACA AAACCAAAGT CTGGGACCTC CCCACCCGCC TTTTCCACTG
 51 GCTGCTTGCC GCGTCCCTGC CCTTTATGTG GTATAGCGCG AAAGCCGGCG
101 GCGATATGCT GCAATGGCAC ACGCGCGTCG GGCTGTTCGT CCTTTTCCTG
151 CTCGTATTTC GCCTCTGCTG GGGCATTTGG GGCAGCGATA CCGCCCGTTT
201 TTCCCGTTTC GTCCAAGGCT GGGCAGGCAT ACGCGGCTAT CTGAAAAACG
251 GTATTCCCGA ACACATCCAG CCCGGACACA ACCCCTTGGG CGCACTGATG
301 GTCGTTGCGC TTTTGGCCGC CGTGTCCTTC CAAGTCGGCA CCGGGCTTTT
351 TGCCGCCGAT GAAAACACCT TCAGCACCAA CGGCTACCTC AACCATTTGG
401 TTTCCGAACA TACGGGCAGC CTTATGCGGA AAATCCACCT CAACTTTTTC
451 AAGCTGCTCG CCGTTTTTTC TGCAATCCAC ATCGCCGCCG TCGCCGCATA
501 CCGCGTATTC AAAAAGAAAA ACCTCATCCT CCCGATGATA ACCGGCTTCA
551 AATACATCGA AGGCAAAACC TCAATCCGCT TTGCAGGCAA AGCCGCGCTT
```

-continued

```
601 GCCGCCGCAT TATCGGTTGC CTCGCTTGCC GCAGCCGCCA TCCTGCTCCT

651 GTCCTGA
```

This corresponds to the amino acid sequence <SEQ ID 622; ORF 152>:

m152.pep

```
  1 MKNKTKVWDL PTRLFHWLLA ASLPFMWYSA KAGGDMLQWH TRVGLFVLFL

 51 LVFRLCWGIW GSDTARFSRF VQGWAGIRGY LKNGIPEHIQ PGHNPLGALM

101 VVALLAAVSF QVGTGLFAAD ENTFSTNGYL NHLVSEHTGS LMRKIHLNFF

151 KLLAVFSAIH IAAVAAYRVF KKKNLILPMI TGFKYIEGKT SIRFAGKAAL

201 AAALSVASLA AAAILLLS*
```

Computer analysis of this amino acid sequence gave the following results:

Homology with a predicted ORF from *N. gonorrhoeae*

ORF 152 shows 95.4% identity over a 218 aa overlap with a predicted ORF (ORF 152.ng) from *N. gonorrhoeae*:

m152/g152

```
                   10         20         30         40         50         60
m152.pep    MKNKTKVWDLPTRLFHWLLAASLPFMWYSAKAGGDMLQWHTRVGLFVLFLLVFRLCWGIW
            |||||||||:||||||||||||||||||||||||||||||||||||:|||||||||||||
g152        MKNKTKVWDFPTRLFHWLLAASLPFMWYSAKAGGDMLQWHTRVGLLVLFLLVFRLCWGIW
                   10         20         30         40         50         60
                   70         80         90        100        110        120
m152.pep    GSDTARFSRFVQGWAGIRGYLKNGIPEHIQPGHNPLGALMVVALLAAVSFQVGTGLFAAD
            ||||||||||:|||||||||||||||||||||||||||||||||||||||||||||||||:
g152        GSDTARFSRFVRGWAGIRGYLKNGIPEHIQPGHNPLGALMVVALLAAVSFQVGTGLFAAN
                   70         80         90        100        110        120
                  130        140        150        160        170        180
m152.pep    ENTFSTNGYLNHLVSEHTGSLMRKIHLNFFKLLAVFSAIHIAAVAAYRVFKKKNLILPMI
            ||||||||||||||||||||:|||||||||||||||:|||||||||:||||||: |||
g152        ENTFSTNGYLNHLVSEHTGSLIRKIHLNFFKLLAVFSAVHIAAVAAYRIFKKKNLVRPMI
                  130        140        150        160        170        180
                  190        200        210       219
m152.pep    TGFKYIEGKTSIRFAGKAALAAALSVASLAAAAILLLSX
            |||||||||||||||||||||||||||||:|||||||||||
g152        TGFKYIEGKTSIRFAGKAALAAALSVAALAAAAILLLSX
                  190        200        210
```

The following partial DNA sequence was identified in *N. meningitidis* <SEQ ID 623>:

a152.seq

```
  1 ATGAAAAACA AAACCAAAGT CTGGGACTTC CCCACCCGCC TTTTCCACTG

 51 GCTGCTTGCC GCATCCCTAC CCTTTATGTG GTATAGCGCG AAAACCGGCG

101 GCGATATGCT GCAATGGCAC ACGCGCGTCG GGCTGTTTAT CCTTTTCCTG

151 CTCGTATTCC GCCTCTGCTG GGGCATTTGG GGCAGCGATA CCGCCCGTTT

201 CTCCCGTTTC GTCCGCGGAT GGTCGGGTAT CAGAGAGTAT ATGAAAAACG

251 GTATTCCCGA ACACGTCCAA CCCGGACACA ACCCCTTGGG CGCACTGATG

301 GTCGTTGCGC TTTTGGCCGC CGTGTCGTTC CAAGTCGGCA CAGGGCTTTT
```

-continued

```
351 TGCCGCCGAT GTAAACACCT TCAGCACCAA CGGCTACCTC AACCATTTGG

401 TTTCCGAACA TACGGGCAGC CTTATGCGGA AAATCCATCT CAACTTTTTC

451 AAACTGCTCG CCGTTTTTTC CGCAGTCCAC ATCGCCGNCG TCGCCGCATA

501 CCGCGTGTTC AAAAAGAAAA ACCTCGTCCT CCCGATGATA ACCGGCTTCA

551 AATACATCGA AGGCAAAACC TCAATCCGCT TTGCCGGCAA AGCCGCGCTT

601 GCCGCCGCAT TATCGGTTGC CGCGCTTGCC GCAGCCGCCA TCCTGCTCCT

651 GTCCTGA
```

This corresponds to the amino acid sequence <SEQ ID 624; ORF 152.a>:

a152.pep

```
  1 MKNKTKVWDF PTRLFHWLLA ASLPFMWYSA KTGGDMLQWH TRVGLFILFL

 51 LVFRLCWGIW GSDTARFSRF VRGWSGIREY MKNGIPEHVQ PGHNPLGALM

101 VVALLAAVSF QVGTGLFAAD VNTFSTNGYL NHLVSEHTGS LMRKIHLNFF

151 KLLAVFSAVH IAXVAAYRVF KKKNLVLPMI TGFKYIEGKT SIRFAGKAAL

201 AAALSVAALA AAAILLLS*
```

m152/a152 94.0% identity in 218 aa overlap

```
                  10        20        30        40        50        60
m152.pep  MKNKTKVWDLPTRLFHWLLAASLPFMWYSAKAGGDMLQWHTRVGLFVLFLLVFRLCWGIW
          |||||||||:|||||||||||||||||||||:||||||||||||||:|||||||||||||
a152      MKNKTKVWDFPTRLFHWLLAASLPFMWYSAKTGGDMLQWHTRVGLFILFLLVFRLCWGIW
                  10        20        30        40        50        60

                  70        80        90       100       110       120
m152.pep  GSDTARFSRFVQGWAGIRGYLKNGIPEHIQPGHNPLGALMVVALLAAVSFQVGTGLFAAD
          |||||||||||:||:||| |:|||||||:|||||||||||||||||||||||||||||||
a152      GSDTARFSRFVRGWSGIREYMKNGIPEHVQPGHNPLGALMVVALLAAVSFQVGTGLFAAD
                  70        80        90       100       110       120

                 130       140       150       160       170       180
m152.pep  ENTFSTNGYLNHLVSEHTGSLMRKIHLNFFKLLAVFSAIHIAAVAAYRVFKKKNLILPMI
           |||||||||||||||||||||||||||||||||||||:||| ||||||||||||:||||
a152      VNTFSTNGYLNHLVSEHTGSLMRKIHLNFFKLLAVFSAVHIAXVAAYRVFKKKNLVLPMI
                 130       140       150       160       170       180

                 190       200       210      219
m152.pep  TGFKYIEGKTSIRFAGKAALAAALSVASLAAAAILLLSX
          |||||||||||||||||||||||||||:|||||||||||
a152      TGFKYIEGKTSIRFAGKAALAAALSVAALAAAAILLLSX
                 190       200       210
```

The following partial DNA sequence was identified in *N. gonorrhoeae* <SEQ ID 625>:

g153.seq

```
  1 atggggtttg cttaCAgtat gacgtatatc gaggtCGGGa taccggaggc

 51 ggcatccgtc ctttCgctGC CCGAGATgat gcgcctgatG GTGTTtCagg

101 attATGGTTT TttggcCGAA GTGATGTTTG TGctgaCTTT cGGCGcgcCG

151 GTTCTGTTtC TGCTGCTGTG CCTGTATGTC TATGCCGCGC TGATACGGAA

201 ACAGGCGTAT CCTGCGCTGC GTTTGGCAAC GCGTGTGATG GTGCGCTTGA

251 GGCAGGCGAT GATGGTGGAT GTGTTTTTTG TTTCCACTCT GGTGGCGTAT
```

-continued

```
 301 ATCAAGCTCT CGTCTGTGGC AAAGGTTCGC TTCGGGCCGG CGTTTTATCT
 351 GATGTTCGCG CTGTCGGTTA TGCTGATTCG GACTTCGGTA TCGGTTCCCC
 401 AGCATTGGGT GTATTTCCAA ATCGGGCGGC TGACGGGGAA TAATGCGGTT
 451 CAGACGGCAT CGGAAGGCAA AACCTGTTGC AGCCGCTGCC TGTATTTccg
 501 cgacAGTgcc gaatccCCCT GCGGGGTGTg cgGCGcggaA CTgtacggcg
 551 gacggccgaa aagtCTGAGt atttCgtCGG CGTTTCTgac ggcggcggTT
 601 GTTTTGTATT TCCctgCcaa TATCctgccg attaTGAttt cgtccAATCc
 651 tgccgccacg GAGGcCAACA CCATCTTTAG CGGCATCGCT TATATGTGGG
 701 ACGagggcgA CAGGCTGATT GCGGCGGTTA TTTTCAGCGC GAGTATTTTG
 751 GTGCCGGTGC TGAAGATTGC GGCAATGTCG GTTTTGATTG CGGCGGCACG
 801 GTTCGCTTTG CCGGCGGGCG CAAAGAAATT GTCGCACCTC tacCGCATCA
 851 CCGAAGCGGT CGGCCGCTGG TCGATGATTG ATATTTTTGT GATTATTATT
 901 TTGATGTGTT CGTTCCacaC TTATGCCGCG CGCGTCATTC CGGGCAGTGC
 951 GGCAGTCTAT TTCTGCCTGG TCGTGATTTT GACGATGCTG TCCGCCTATT
1001 ATTTCGACCC GCGCCTGCTT TGGGACAAAC GCGCTTCAGA CGGCATTGCT
1051 TTCAACGAAA CGGAAAAATA TGACTGA
```

This corresponds to the amino acid sequence <SEQ ID 626; ORF 153.ng>:

g153.pep

```
  1 MGFAYSMTYI EVGIPEAASV LSLPEMMRLM VFQDYGFLAE VMFVLTFGAP
 51 VLFLLLCLYV YAALIRKQAY PALRLATRVM VRLRQAMMVD VFFVSTLVAY
101 IKLSSVAKVR FGPAFYLMFA LSVMLIRTSV SVPQHWVYFQ IGRLTGNNAV
151 QTASEGKTCC SRCLYFRDSA ESPCGVCGAE LYGGRPKSLS ISSAFLTAAV
201 VLYFPANILP IMISSNPAAT EANTIFSGIA YMWDEGDRLI AAVIFSASIL
251 VPVLKIAAMS VLIAAARFAL PAGAKKLSHL YRITEAVGRW SMIDIFVIII
301 LMCSFHTYAA RVIPGSAAVY FCLVVILTML SAYYFDPRLL WDKRASDGIA
351 FNETEKYD*
```

The following partial DNA sequence was identified in *N. meningitidis* <SEQ ID 627>:

m153.seq

```
  1 ATGGCGTTTG CTTACGGTAT GACGTATATC GAGGTCGGGA TACCGGGTGC
 51 GGCATCCGTC CTTTCGCTGC CCGAGATGAT GCGCCTGATG GTGTTTCAGG
101 ATTATGGTTT TTTGGCCGAA GTGATGTTTG TGCTGACTTT CGGCGCGCCG
151 GTTCTGTTTC TGCTGCTGTG CCTGTATGTC TATGCCGCGC TGATACGGAA
201 ACAGGCGTAT CCTGCGCTGC GTTTGGCAAC GCGTGTGATG GTGCGCTTGA
251 GACAGGCGAT GATGGTGGAT GTGTTTTTTG TTTCCACTTT GGTGGCGTAT
301 ATCAAGCTCT CGTCTGTGGC AGAGGTTCGC TTCGGGCCGG CGTTTTATCT
```

-continued

```
 351 GATGTTCGCG CTGTCAGTTA TGCTGATTCG GACTTCGGTA TCGGTTCCCC

 401 AGCATTGGGT GTATTTTCAA ATCGGGCGGC TGACGGGGGA TAATGCGGTT

 451 CAGACGGCAT CGGAAGGTAA AACCTGTTGC AGCCGCTGCC TGTATTTCCG

 501 CGACAGTGCC GAATCCCCCT GCGGCGTGTG CGGTGCGGAA CTGTACCGCC

 551 GACGGCCGAA AAGTCTGAGT ATTTCGTCGG CGTTTCTGAC GGCGGCGGTT

 601 ATTTTGTATT TCCCTGCCAA TATCCTGCCG ATTATGATTT CGTCCAATCC

 651 TGCCGCCACG GAGGTCAATA CCATCCTTAA CGGCATCGCT TATATGTGGG

 701 ACGAGGGCGA CAGGCTGATT GCGGCGGTTA TTTTCAGCGC GAGTATTTTG

 751 GTGCCGGTAC TGAAGATTGC GGCAATGTCG GTTTTGATTG CGTCCGCCCG

 801 CTTCGCTTTG CCAACGGGTG CAAAGAAATT GTCGCACCTC TACCGCATCA

 851 CCGAAGCGGT CGGCCGCTGG TCGATGATTG ATATTTTTGT GATTATTATT

 901 TTGATGTGTT CGTTCCACAC TTATGCCGCG CGCGTCATTC CGGGCAGTGC

 951 GGCAGTCTAT TTCTGCCTGG TCGTGATTCT GACGATGCTG TCCGCCTATT

1001 ATTTCGACCC GCGCCTGCTT TGGGACAAAC GCGCTTCAGA CGGCATTGCT

1051 TTCAATGAAA CGGAAAAACA TGACTGA
```

This corresponds to the amino acid sequence <SEQ ID 628; ORF 153>:

m153.pep

```
  1 MAFAYGMTYI EVGIPGAASV LSLPEMMRLM VFQDYGFLAE VMFVLTFGAP

 51 VLFLLLCLYV YAALIRKQAY PALRLATRVM VRLRQAMMVD VFFVSTLVAY

101 IKLSSVAEVR FGPAFYLMFA LSVMLIRTSV SVPQHWVYFQ IGRLTGDNAV

151 QTASEGKTCC SRCLYFRDSA ESPCGVCGAE LYRRRPKSLS ISSAFLTAAV

201 ILYFPANILP IMISSNPAAT EVNTILNGIA YMWDEGDRLI AAVIFSASIL

251 VPVLKIAAMS VLIASARFAL PTGAKKLSHL YRITEAVGRW SMIDIFVIII

301 LMCSFHTYAA RVIPGSAAVY FCLVVILTML SAYYFDPRLL WDKRASDGIA

351 FNETEKHD*
```

m153/g153 96.1% identity in 358 aa overlap

```
                 10        20        30        40        50        60
m153.pep   MAFAYGMTYIEVGIPGAASVLSLPEMMRLMVFQDYGFLAEVMFVLTFGAPVLFLLLCLYV
           |:|||:||||||||| ||||||||||||||||||||||||||||||||||||||||||||
g153       MGFAYSMTYIEVGIPEAASVLSLPEMMRLMVFQDYGFLAEVMFVLTFGAPVLFLLLCLYV
                 10        20        30        40        50        60

                 70        80        90       100       110       120
m153.pep   YAALIRKQAYPALRLATRVMVRLRQAMMVDVFFVSTLVAYIKLSSVAEVRFGPAFYLMFA
           ||||||||||||||||||||||||||||||||||||||||||||||||:|||||||||||
g153       YAALIRKQAYPALRLATRVMVRLRQAMMVDVFFVSTLVAYIKLSSVAKVRFGPAFYLMFA
                 70        80        90       100       110       120

                130       140       150       160       170       180
m153.pep   LSVMLIRTSVSVPQHWVYFQIGRLTGDNAVQTASEGKTCCSRCLYFRDSAESPCGVCGAE
           ||||||||||||||||||||||||||:|||||||||||||||||||||||||||||||||
g153       LSVMLIRTSVSVPQHWVYFQIGRLTGNNAVQTASEGKTCCSRCLYFRDSAESPCGVCGAE
                130       140       150       160       170       180

                190       200       210       220       230       240
m153.pep   LYRRRPKSLSISSAFLTAAVILYFPANILPIMISSNPAATEVNTILNGIAYMWDEGDRLI
           ||  ||||||||||||||||:||||||||||||||||||||:|||::|||||||||||||
g153       LYGGRPKSLSISSAFLTAAVVLYFPANILPIMISSNPAATEANTIFSGIAYMWDEGDRLI
                190       200       210       220       230       240
```

-continued

```
                250       260       270       280       290       300
m153.pep  AAVIFSASILVPVLKIAAMSVLIASARFALPTGAKKLSHLYRITEAVGRWSMIDIFVIII
          ||||||||||||||||||||||||:||||||:||||||||||||||||||||||||||||
g153      AAVIFSASILVPVLKIAAMSVLIAAARFALPAGAKKLSHLYRITEAVGRWSMIDIFVIII
                250       260       270       280       290       300

                 310       320       330       340       350      359
m153.pep   LMCSFHTYAARVIPGSAAVYFCLVVILTMLSAYYFDPRLLWDKRASDGIAFNETEKHDX
           |||||||||||||||||||||||||||||||||||||||||||||||||||||||:||
g153       LMCSFHTYAARVIPGSAAVYFCLVVILTMLSAYYFDPRLLWDKRASDGIAFNETEKYDX
                 310       320       330       340       350
```

The following partial DNA sequence was identified in *N. meningitidis* <SEQ ID 629>:

<u>a153.seq</u>

```
   1 ATGGCGTTTG CTTACGGTAT GACGTATATC GAGGTCGGGA TACCGGGTGC
  51 GGCATCCGTC CTTTCGCTGC CCGAGATGAT GCGCCTGATG GTGTTTCAGG
 101 ATTATGGTTT TTTGGCCGAA GTGATGTTTG TGCTGACCTT CGGCGCGCCG
 151 GTTCTGTTTC TGCTGCTGTG CCTGTATGTC TATGCCGCGC TGATACGGAA
 201 ACAGGCGTAT CCTGCGCTGC GTTTGGCAAC GCGTGTGATG GTGCGCTTGA
 251 GACAGGCGAT GATGGTGGAT GTGTTTTTTG TTTCCACTTT GGTGGCGTAT
 301 ATCAAGCTCT CGTCTGTGGC AGAGGTTCGC TTCGGATCGG CGTTTTATCT
 351 GATGTTCGCG CTGTCGGTTA TGCTGATTCG GACTTCGGTA TCGGTTCCCC
 401 AGCATTGGGT GTATTTTCAA ATCGGGCGGC TGACGGGGGA TAATGCGGTT
 451 CAGACGGCAT CGGAAGGTAA AACCTGTTGC AGCCGCTGCC TGTATTTCCG
 501 CGACAGTGCC GAATCCCCCT GCGGCGTGTG CGGTGCGGAA CTGTACCGCC
 551 GACGGCCGAA AAGTCTGAGT ATTTCGTCGG CGTTTCTGAC GGCGGCGGTT
 601 ATTTTGTATT TCCCTGCCAA TATCCTGCCG ATTATGATTT CGTCCAATCC
 651 TGCCGCCACG GAGGTCAATA CCATCCTTAA CGGCATCGCT TATATGTGGG
 701 ACGAGGGCGA CAGGCTGATT GCGGCGGTTA TTTTCAGCGC GAGTATTTTG
 751 GTGCCGGTAC TGAAGATTGC GGCAATGTCG GTTTTGATTG CGTCCGCCCG
 801 CTTCGCTTTG CCAACGGGTG CAAAGAAATT GTCGCACCTC TACCGCATCA
 851 CCGAAGCGGT CGGCCGCTGG TCGATGATTG ATATTTTTGT GATTATTATT
 901 TTGATGTGTT CGTTCCACAC TTATGCCGCG CGCGTCATTC CGGGCAGTGC
 951 GGCAGTCTAT TTCTGCCTGG TCGTGATTCT GACGATGCTG TCCGCCTATT
1001 ATTTCGACCC GCGCCTGCTT TGGGACAAAC GCGCTTCAGA CGGCATTGCT
1051 TTCAATGAAA CGGAAAAACA TGACTGA
```

This corresponds to the amino acid sequence <SEQ ID 630; ORF 153.a>:

<u>a153.pep</u>

1 MAFAYGMTYI EVGIPGAASV LSLPEMMRLM VFQDYGFLAE <u>VMFVLTFGAP</u>

51 <u>VLFLLLC</u>LYV YAALIRKQAY PALRLATRVM VRLRQA<u>MMVD VFFVSTLVAY</u>

101 <u>IKL</u>SSVAEVR FGS<u>AFYLMFA LSVMLIRTSV</u> SVPQHWVYFQ IGRLTGDNAV

151 QTASEGKTCC SRCLYFRDSA ESPCGVCGAE LYRRRPKSLS ISSA<u>FLTAAV</u>

-continued

```
201 ILYFPANILP IMISSNPAAT EVNTILNGIA YMWDEGDRLI AAVIFSASIL

251 VPVLKIAAMS VLIASARFAL PTGAKKLSHL YRITEAVGRW SMIDIFVIII

301 LMCSFHTYAA RVIPGSAAVY FCLVVILTML SAYYFDPRLL WDKRASDGIA

351 FNETEKHD*
```

m153/a153 99.7% identity in 358 aa overlap

```
                   10        20        30        40        50        60
m153.pep    MAFAYGMTYIEVGIPGAASVLSLPEMMRLMVFQDYGFLAEVMFVLTFGAPVLFLLLCLYV
            ||||||||||||||||||||||||||||||||||||||||||||||||||||||||||||
a153        MAFAYGMTYIEVGIPGAASVLSLPEMMRLMVFQDYGFLAEVMFVLTFGAPVLFLLLCLYV
                   10        20        30        40        50        60

                   70        80        90       100       110       120
m153.pep    YAALIRKQAYPALRLATRVMVRLRQAMMVDVFFVSTLVAYIKLSSVAEVRFGPAFYLMFA
            |||||||||||||||||||||||||||||||||||||||||||||||||||| |||||||
a153        YAALIRKQAYPALRLATRVMVRLRQAMMVDVFFVSTLVAYIKLSSVAEVRFGSAFYLMFA
                   70        80        90       100       110       120

                  130       140       150       160       170       180
m153.pep    LSVMLIRTSVSVPQHWVYFQIGRLTGDNAVQTASEGKTCCSRCLYFRDSAESPCGVCGAE
            ||||||||||||||||||||||||||||||||||||||||||||||||||||||||||||
a153        LSVMLIRTSVSVPQHWVYFQIGRLTGDNAVQTASEGKTCCSRCLYFRDSAESPCGVCGAE
                  130       140       150       160       170       180

                  190       200       210       220       230       240
m153.pep    LYRRRPKSLSISSAFLTAAVILYFPANILPIMISSNPAATEVNTILNGIAYMWDEGDRLI
            ||||||||||||||||||||||||||||||||||||||||||||||||||||||||||||
a153        LYRRRPKSLSISSAFLTAAVILYFPANILPIMISSNPAATEVNTILNGIAYMWDEGDRLI
                  190       200       210       220       230       240

                  250       260       270       280       290       300
m153.pep    AAVIFSASILVPVLKIAAMSVLIASARFALPTGAKKLSHLYRITEAVGRWSMIDIFVIII
            ||||||||||||||||||||||||||||||||||||||||||||||||||||||||||||
a153        AAVIFSASILVPVLKIAAMSVLIASARFALPTGAKKLSHLYRITEAVGRWSMIDIFVIII
                  250       260       270       280       290       300

                  310       320       330       340       350      359
m153.pep    LMCSFHTYAARVIPGSAAVYFCLVVILTMLSAYYFDPRLLWDKRASDGIAFNETEKHDX
            |||||||||||||||||||||||||||||||||||||||||||||||||||||||||||
a153        LMCSFHTYAARVIPGSAAVYFCLVVILTMLSAYYFDPRLLWDKRASDGIAFNETEKHDX
                  310       320       330       340       350
```

The following partial DNA sequence was identified in *N. gonorrhoeae* <SEQ ID 631>:

g154.seq

```
  1 ATGACTGACA ACAGCCCTCC TCCAAACGGA CACGCTCAAG CACGCGTCCG

 51 CAAAAACAAC accttcctCT CCGCCGTCTG GCTGGTCCCG CTGATCGCGC

101 TGATTGCCGG CGGCTGGCTT TGGGTTAAGG AAATCCGCAA CAGGGGGCCT

151 GTGGTTACGC TCTTGATGGA CAGCGCGGAA GGCATCGAAG TCAACAATAC

201 GGTCATTAAG GTATTGAGCA TCGATGTCGG ACGCGTTACC CGAATCAAAC

251 TGCGCGACGA CCAAAAAGGC GTGGAAGTTA CTGCCCAACT CAATGCGGAC

301 GTATCCGGCC TCATCCGCAG CGATACCCAG TTTTGGGTGG TCAAGCCGCG

351 TATCGACCAA AGCGGcgtAA CCGGTTTGGG TACGCTGCTT TCGGGTTCGT

401 ACATCGCTTT TACACCCGGC AAAAGCGGCG AGGCAAAAGA CGTGTTCCAA

451 GTGCAGGACA TTCCGCCCGT TACCGCCATC GGGCAAAgcg GGCTGCGCTT

501 GAATTTGATT GGTAAAAACG AccgCATCCT CAACGTcaaC AGCCCTGTTT

551 TGTATGAAAA CTTTATGGTC GGGCAAATCG AAAGCGCGCA TTTCGAcccG

601 TCCGACCAAA GCGTGCATTA CACCATCTTC ATCCAAAGCC CCAACGACAA
```

-continued

```
 651 ACTGATTCAT TCCGCCAGCC GTTTTTGGCT GGAAAGCGGC ATCAATATCG
 701 AAACCACAGG CAGCGGCATC AAACTCAATT CCGCCCCTCT GCCTGCCCTG
 751 CTGTCAGGCG CGATTTCATT TGATTCGCCG AAAACCAAAA ACAGTAAAAA
 801 CGTCAAAAGC GAGGACAGCT TCACGCTTTA CGACAGCCGC AGCGAAATCG
 851 CCAACCTGCC TGACGACCGC TCGCTGTACT ACACCGCGTT TTTCAAACAA
 901 TCCGTGCGCG GACTGACCGT cggTTCGCCT GTcgaATACA AAGGGCtgaA
 951 TGTcggCATG GTTTCCGATG TCCCTTATTT TGACCGCAAt gacagCCTGC
1001 ACCtgtTTGA aaacggctgg aTTcccGtac gCATCCGCAT cgagccTTCC
1051 CGTTTGGAAA TCAATGCCGA CGAGCAAAGC AAAGAGCATT GGAAACAACA
1101 ATTCCAGACG GCCTTAAACA AAGGCCTGAC CGCCACCATC TCCAGCAACA
1151 ACCTGCTGAC CGGCGGCAAA ATGATTGAGT TGAACGATCA GCCTTCCGCC
1201 TCGCCCAAGC TGCGACCGCA TACCGTTTAT GCAGGCGATA CCGTCATCGC
1251 CACACGGGGC GGCGGTTTGG ATGACTTGCA GGTCAAATTG GCGGATTTGC
1301 TGGACaaatT CAACAATCTG CCATTggata aAACCGTTGC CGAATTGAAC
1351 GGCTCGCTCG CCGAACTCAA GTCCGCACTC AAATCCGCCA ATGCCGCCCT
1401 AAGCTCCATT GacaAACTGG TCGgcaaTCC GCAGACGCAA AACATCCCGA
1451 ACGAACTGAA CCAAACTCTG AAAGAGTTGC GCATAACCCT GCAAGGCGTA
1501 TCGcctCAAT CGCCTATCTa cgGAgacgta caAAATAcgc tgCaAAGTTT
1551 GGACAAAACC TTAAAagacg TtcaACCCGT CATTAACACT TTGAaAGAAa
1601 aacCCaaCgc actGATTTtc aacaACAGCA GCAAAGAccc tATCCCGAAA
1651 GGAAGCCGAT AA
```

This corresponds to the amino acid sequence <SEQ ID 632; ORF 154.ng>:

g154.pep

```
  1 MTDNSPPPNG HAQARVRKNN TFLSAVWLVP LIALIAGGWL WVKEIRNRGP
 51 VVTLLMDSAE GIEVNNTVIK VLSIDVGRVT RIKLRDDQKG VEVTAQLNAD
101 VSGLIRSDTQ FWVVKPRIDQ SGVTGLGTLL SGSYIAFTPG KSGEAKDVFQ
151 VQDIPPVTAI GQSGLRLNLI GKNDRILNVN SPVLYENFMV GQIESAHFDP
201 SDQSVHYTIF IQSPNDKLIH SASRFWLESG INIETTGSGI KLNSAPLPAL
251 LSGAISFDSP KTKNSKNVKS EDSFTLYDSR SEIANLPDDR SLYYTAFFKQ
301 SVRGLTVGSP VEYKGLNVGM VSDVPYFDRN DSLHLFENGW IPVRIRIEPS
351 RLEINADEQS KEHWKQQFQT ALNKGLTATI SSNNLLTGGK MIELNDQPSA
401 SPKLRPHTVY AGDTVIATRG GGLDDLQVKL ADLLDKFNNL PLDKTVAELN
451 GSLAELKSAL KSANAALSSI DKLVGNPQTQ NIPNELNQTL KELRITLQGV
501 SPQSPIYGDV QNTLQSLDKT LKDVQPVINT LKEKPNALIF NNSSKDPIPK
551 GSR*
```

The following partial DNA sequence was identified in *N. meningitidis* <SEQ ID 633>:

m154.seq

```
   1 ATGACTGACA ACAGCCCTCC TCCAAACGGA CACGCCCAAG CACGCGTCCG
  51 CAAAAACAAC ACCTTCCTCT CTGCCGTCTG GCTGGTTCCG CTGATCGCGC
 101 TGATTGCCGG CGGCTGGCTT TGGGTTAAGG AAATCCGCAA CAGGGGGCCT
 151 GTGGTTACGC TCTTGATGGA CAGCGCGGAA GGCATTGAGG TCAACAATAC
 201 GGTCATCAAA GTATTGAGCA TCGATGTCGG ACGCGTTACC CGAATCAAAC
 251 TGCGCGACGA CCAAAAAGGC GTGGAAGTAA CCGCCCAACT CAATGCGGAC
 301 GTATCCGGCC TCATCCGCAG CGATACCCAG TTTTGGGTGG TCAAGCCGCG
 351 TATCGACCAA AGCGGCGTAA CCGGTTTGGG TACGCTGCTT TCGGGTTCGT
 401 ACATCGCCTT TACACCCGGC AAAAGCGACG AGGCAAAAGA CGTGTTCCAA
 451 GTGCAGGACA TTCCGCCCGT TACCGCCATC GGGCAAAGCG GGCTGCGCTT
 501 GAATTTGATT GGTAAAAACG ACCGCATCCT CAACGTCAAC AGCCCTGTTT
 551 TGTATGAAAA TTTTATGGTC GGGCAAGTCG AAAGCGCGCA TTTCGACCCG
 601 TCCGACCAAA GCGTGCATTA CACCATCTTC ATCCAAAGCC CCAACGACAA
 651 ACTGATTCAT TCCGCCAGCC GTTTTTGGCT GGAAAGCGGC ATCAATATCG
 701 AAACCACAGG CAGCGGCATC AAACTCAATT CCGCCCCTCT GCCTGCCCTG
 751 CTGTCGGGCG CGATTTCATT TGATTCGCCG AAAACCAAAA ACAGTAAAAA
 801 CGTCAAAAGC GAAGACAGCT TCACGCTTTA CGACAGCCGC AGCGAAGTCG
 851 CCAACCTGCC TGACGACCGC TCGCTGTACT ACACCGCGTT TTTCAAACAA
 901 TCCGTGCGCG GCCTGACCGT CGGTTCGCCC GTCGAGTACA AAGGGCTGAA
 951 TGTCGGCGTG GTTTCCGACG TTCCTTATTT CGACCGCAAC GACAGCCTGC
1001 ACCTGTTTGA AAACGGCTGG ATACCCGTAC GCATCCGCAT TGAACCTTCC
1051 CGTTTGGAAA TCAATGCCGA CGAACAAAGC AAAGAACATT GGAAACAACA
1101 ATTTCAGACG GCCTTAAACA AAGGCCTGAC CGCCACCATC TCCAGCAACA
1151 ACCTGCTGAC CGGAAGCAAA ATGATTGAGT TGAACGATCA GCCTTCCGCA
1201 TCACCTAAGC TGCGACCGCA TACCGTTTAT GCAGGCGATA CCGTTATCGC
1251 GACCCAGGGC GGCGGTTTGG ACGATTTGCA GGTCAAATTG GCGGATTTGC
1301 TGGACAAGTT CGACAAACTG CCTTTAGATA AGACGGTTGC CGAATTGAAC
1351 GGTTCGCTTG CCGAGCTCAA ATCCACACTC AAATCTGCCA ATGCCGCCCT
1401 AAGCTCCATC GACAAACTGG TCGGCAAACC GCAGACACAA AACATTCCGA
1451 ACGAACTGAA CCAAACCCTG AAAGAGTTGC GCACAACCCT GCAAGGCGTA
1501 TCGCCGCAAT CGCCTATCTA CGGCGACGTA CAAAATACGC TGCAAAGTTT
1551 GGACAAAACT TTAAAAGACC TTCAACCCGT GATTAATACT TTGAAAGAAA
1601 AACCCAACGC GCTGATTTTC AACAGCAGCA GCAAAGACCC TATCCCGAAA
1651 GGAAGCCGAT AA
```

This corresponds to the amino acid sequence <SEQ ID 634 ORF 154.a>:

m154.pep

```
  1 MTDNSPPPNG HAQARVRKNN TFLSAVWLVP LIALIAGGWL WVKEIRNRGP
```

-continued

```
 51 VVTLLMDSAE GIEVNNTVIK VLSIDVGRVT RIKLRDDQKG VEVTAQLNAD

101 VSGLIRSDTQ FWVVKPRIDQ SGVTGLGTLL SGSYIAFTPG KSDEAKDVFQ

151 VQDIPPVTAI GQSGLRLNLI GKNDRILNVN SPVLYENFMV GQVESAHFDP

201 SDQSVHYTIF IQSPNDKLIH SASRFWLESG INIETTGSGI KLNSAPLPAL

251 LSGAISFDSP KTKNSKNVKS EDSFTLYDSR SEVANLPDDR SLYYTAFFKQ

301 SVRGLTVGSP VEYKGLNVGV VSDVPYFDRN DSLHLFENGW IPVRIRIEPS

351 RLEINADEQS KEHWKQQFQT ALNKGLTATI SSNNLLTGSK MIELNDQPSA

401 SPKLRPHTVY AGDTVIATQG GGLDDLQVKL ADLLDKFDKL PLDKTVAELN

451 GSLAELKSTL KSANAALSSI DKLVGKPQTQ NIPNELNQTL KELRTTLQGV

501 SPQSPIYGDV QNTLQSLDKT LKDVQPVINT LKEKPNALIF NSSSKDPIPK

551 GSR*
```

m154/g154 97.8% identity in 553 aa overlap

```
                   10        20        30        40        50        60
m154.pep   MTDNSPPPNGHAQARVRKNNTFLSAVWLVPLIALIAGGWLWVKEIRNRGPVVTLLMDSAE
           ||||||||||||||||||||||||||||||||||||||||||||||||||||||||||||
g154       MTDNSPPPNGHAQARVRKNNTFLSAVWLVPLIALIAGGWLWVKEIRNRGPVVTLLMDSAE
                   10        20        30        40        50        60

                   70        80        90       100       110       120
m154.pep   GIEVNNTVIKVLSIDVGRVTRIKLRDDQKGVEVTAQLNADVSGLIRSDTQFWVVKPRIDQ
           ||||||||||||||||||||||||||||||||||||||||||||||||||||||||||||
g154       GIEVNNTVIKVLSIDVGRVTRIKLRDDQKGVEVTAQLNADVSGLIRSDTQFWVVKPRIDQ
                   70        80        90       100       110       120

                  130       140       150       160       170       180
m154.pep   SGVTGLGTLLSGSYIAFTPGKSDEAKDVFQVQDIPPVTAIGQSGLRLNLIGKNDRILNVN
           ||||||||||||||||||||| ||||||||||||||||||||||||||||||||||||||
g154       SGVTGLGTLLSGSYIAFTPGKSGEAKDVFQVQDIPPVTAIGQSGLRLNLIGKNDRILNVN
                  130       140       150       160       170       180

                  190       200       210       220       230       240
m154.pep   SPVLYENFMVGQVESAHFDPSDQSVHYTIFIQSPNDKLIHSASRFWLESGINIETTGSGI
           |||||||||||:||||||||||||||||||||||||||||||||||||||||||||||||
g154       SPVLYENFMVGQIESAHFDPSDQSVHYTIFIQSPNDKLIHSASRFWLESGINIETTGSGI
                  190       200       210       220       230       240
                  250       260       270       280       290       300
m154.pep   KLNSAPLPALLSGAISFDSPKTKNSKNVKSEDSFTLYDSRSEVANLPDDRSLYYTAFFKQ
           ||||||||||||||||||||||||||||||||||||||||||:|||||||||||||||||
g154       KLNSAPLPALLSGAISFDSPKTKNSKNVKSEDSFTLYDSRSEIANLPDDRSLYYTAFFKQ
                  250       260       270       280       290       300
                  310       320       330       340       350       360
m154.pep   SVRGLTVGSPVEYKGLNVGVVSDVPYFDRNDSLHLFENGWIPVRIRIEPSRLEINADEQS
           ||||||||||||||||||||:|||||||||||||||||||||||||||||||||||||||
g154       SVRGLTVGSPVEYKGLNVGMVSDVPYFDRNDSLHLFENGWIPVRIRIEPSRLEINADEQS
                  310       320       330       340       350       360
                  370       380       390       400       410       420
m154.pep   KEHWKQQFQTALNKGLTATISSNNLLTGSKMIELNDQPSASPKLRPHTVYAGDTVIATQG
           ||||||||||||||||||||||||||||:|||||||||||||||||||||||||||||:|
g154       KEHWKQQFQTALNKGLTATISSNNLLTGGKMIELNDQPSASPKLRPHTVYAGDTVIATRG
                  370       380       390       400       410       420
                  430       440       450       460       470       480
m154.pep   GGLDDLQVKLADLLDKFDKLPLDKTVAELNGSLAELKSTLKSANAALSSIDKLVGKPQTQ
           |||||||||||||||||::|||||||||||||||||||:||||||||||||||||:||||
g154       GGLDDLQVKLADLLDKFNNLPLDKTVAELNGSLAELKSALKSANAALSSIDKLVGNPQTQ
                  430       440       450       460       470       480
                  490       500       510       520       530       540
m154.pep   NIPNELNQTLKELRTTLQGVSPQSPIYGDVQNTLQSLDKTLKDVQPVINTLKEKPNALIF
           ||||||||||||||| ||||||||||||||||||||||||||||||||||||||||||||
g154       NIPNELNQTLKELRITLQGVSPQSPIYGDVQNTLQSLDKTLKDVQPVINTLKEKPNALIF
                  490       500       510       520       530       540
                  550
m154.pep   NSSSKDPIPKGSRX
           |:||||||||||||
g154       NNSSKDPIPKGSRX
                  550
```

The following partial DNA sequence was identified in *N. meningitidis* <SEQ ID 635>:

a154.seq

```
   1 ATGACTGACA ACAGCCCTCC TCCAAACGGA CACGCCCAAG CACGCGTCCG
  51 CAAAAACAAC ACCTTCCTCT CTGCCGTCTG GCTGGTTCCG CTGATCGCGC
 101 TGATTGCCGG CGGCTGGCTT TGGGTTAAGG AAATCCGCAA CAGGGGGCCT
 151 GTGGTTACGC TCTTGATGGA CAGCGCGGAA GGCATTGAGG TCAACAATAC
 201 GGTCATCAAA GTATTGAGCA TCGATGTCGG ACGCGTTACC CGAATCAAAC
 251 TGCGCGACGA CCAAAAAGGC GTGGAAGTAA CCGCCCAACT CAATGCGGAC
 301 GTATCCGGCC TCATCCGCAG CGATACCCAG TTTTGGGTGG TCAAGCCGCG
 351 TATCGACCAA AGCGGCGTAA CCGGTTTGGG TACGCTGCTT TCGGGTTCGT
 401 ACATCGCCTT TACACCCGGC AAAAGCGACG AGGCAAAAGA CGTGTTCCAA
 451 GTGCAGGACA TTCCGCCCGT TACCGCCATC GGGCAAAGCG GGCTGCGCTT
 501 GAATTTGATT GGTAAAAACG ACCGCATCCT CAACGTCAAC AGCCCTGTTT
 551 TGTATGAAAA CTTTATGGTC GGGCAAGTCG AAAGCGCGCA TTTCCACCCG
 601 TCCGACCAAA GCGTGCATTA CACCATCTTC ATCCAAAGCC CCAACGACAA
 651 ACTGATTCAT TCCGCCAGCC GTTTCTGGCT GGAAAGCGGC ATCAATATCG
 701 AAACCACAGG CAGCGGCATC AAACTCAATT CCGCCCCTCT GCCTGCCCTG
 751 CTGTCGGGCG CGATTTCATT TGATTCGCCG AAAACCAAAA ACAGTAAAAA
 801 CGTCAAAAGC GAAGACAGCT TCACGCTTTA CGACAGCCGC AGCGAAGTCG
 851 CCAACCTGCC TGATGACCGT TCGCTGTACT ACACCGCGTT TTTCAAACAA
 901 TCCGTGCGCG GACTGACCGT CGGTTCGCCT GTCGAGTACA AAGGGCTGAA
 951 TGTCGGCGTG GTTTCCGATG TTCCTTATTT CGACCGCAAC GACAGCCTGC
1001 ACCTGTTTGA AAACGGCTGG ATTCCCGTAC GCATCCGTAT TGAGCCTTCC
1051 CGTTTGGAAA TCAATGCCGA CGAACAAAGC AAAGAACATT GGAAACAACA
1101 ATTTCAGACG GCCTTAAACA AAGGCCTGAC CGCCACCATC TCCAGCAACA
1151 ACCTGCTGAC CGGCAGCAAA ATGATTGAGT TGAACGATCA GCCTTCCGCC
1201 TCGCCCAAGC TGCGACCGCA TACCGTTTAT GCAGGCGATA CCGTTATCGC
1251 GACCCAGGGC GGCGGTTTGG ACGATTTGCA GGTCAAATTG GCGGATTTGC
1301 TGGACAAGTT CGACAAACTG CCTTTAGATA AGACGGTTGC CGAATTGAAC
1351 GGTTCGCTTG CCGAGCTCAA ATCCACACTC AAATCTGCCA ATGCCGCCCT
1401 AAGCTCCATC GACAAACTGG TCGGCAAACC GCAGACACAA AACATTCCGA
1451 ACGAACTGAA CCAAACCCTG AAAGAGTTGC GCACAACCCT GCAAGGCGTA
1501 TCGCCTCAAT CGCCTATCTA CGGCGACGTA CAAAATACGC TGCAAAGTTT
1551 GGACAAAACC TTAAAAGACG TTCAACCCGT CATTAACACT TTGAAAGAAA
1601 AACCCAACGC GCTGATTTTC AACAGCAGCA GCAAAGACCC TATCCCGAAA
1651 GGAAGCCGAT AA
```

This corresponds to the amino acid sequence <SEQ ID 636; ORF 154.a>:

a154.pep

```
  1 MTDNSPPPNG HAQARVRKNN TFLSAVWLVP LIALIAGGWL WVKEIRNRGP
 51 VVTLLMDSAE GIEVNNTVIK VLSIDVGRVT RIKLRDDQKG VEVTAQLNAD
101 VSGLIRSDTQ FWVVKPRIDQ SGVTGLGTLL SGSYIAFTPG KSDEAKDVFQ
151 VQDIPPVTAI GQSGLRLNLI GKNDRILNVN SPVLYENFMV GQVESAHFDP
201 SDQSVHYTIF IQSPNDKLIH SASRFWLESG INIETTGSGI KLNSAPLPAL
251 LSGAISFDSP KTKNSKNVKS EDSFTLYDSR SEVANLPDDR SLYYTAFFKQ
301 SVRGLTVGSP VEYKGLNVGV VSDVPYFDRN DSLHLFENGW IPVRIRIEPS
351 RLEINADEQS KEHWKQQFQT ALNKGLTATI SSNNLLTGSK MIELNDQPSA
401 SPKLRPHTVY AGDTVIATQG GGLDDLQVKL ADLLDKFDKL PLDKTVAELN
451 GSLAELKSTL KSANAALSSI DKLVGKPQTQ NIPNELNQTL KELRTTLQGV
501 SPQSPIYGDV QNTLQSLDKT LKDVQPVINT LKEKPNALIF NSSSKDPIPK
551 GSR*
```

m154/a154 100.0% identity in 553 aa overlap

```
                   10        20        30        40        50        60
m154.pep   MTDNSPPPNGHAQARVRKNNTFLSAVWLVPLIALIAGGWLWVKEIRNRGPVVTLLMDSAE
           ||||||||||||||||||||||||||||||||||||||||||||||||||||||||||||
a154       MTDNSPPPNGHAQARVRKNNTFLSAVWLVPLIALIAGGWLWVKEIRNRGPVVTLLMDSAE
                   10        20        30        40        50        60

                   70        80        90       100       110       120
m154.pep   GIEVNNTVIKVLSIDVGRVTRIKLRDDQKGVEVTAQLNADVSGLIRSDTQFWVVKPRIDQ
           ||||||||||||||||||||||||||||||||||||||||||||||||||||||||||||
a154       GIEVNNTVIKVLSIDVGRVTRIKLRDDQKGVEVTAQLNADVSGLIRSDTQFWVVKPRIDQ
                   70        80        90       100       110       120

                  130       140       150       160       170       180
m154.pep   SGVTGLGTLLSGSYIAFTPGKSDEAKDVFQVQDIPPVTAIGQSGLRLNLIGKNDRILNVN
           ||||||||||||||||||||||||||||||||||||||||||||||||||||||||||||
a154       SGVTGLGTLLSGSYIAFTPGKSDEAKDVFQVQDIPPVTAIGQSGLRLNLIGKNDRILNVN
                  130       140       150       160       170       180

                  190       200       210       220       230       240
m154.pep   SPVLYENFMVGQVESAHFDPSDQSVHYTIFIQSPNDKLIHSASRFWLESGINIETTGSGI
           ||||||||||||||||||||||||||||||||||||||||||||||||||||||||||||
a154       SPVLYENFMVGQVESAHFDPSDQSVHYTIFIQSPNDKLIHSASRFWLESGINIETTGSGI
                  190       200       210       220       230       240

                  250       260       270       280       290       300
m154.pep   KLNSAPLPALLSGAISFDSPKTKNSKNVKSEDSFTLYDSRSEVANLPDDRSLYYTAFFKQ
           ||||||||||||||||||||||||||||||||||||||||||||||||||||||||||||
a154       KLNSAPLPALLSGAISFDSPKTKNSKNVKSEDSFTLYDSRSEVANLPDDRSLYYTAFFKQ
                  250       260       270       280       290       300

                  310       320       330       340       350       360
m154.pep   SVRGLTVGSPVEYKGLNVGVVSDVPYFDRNDSLHLFENGWIPVRIRIEPSRLEINADEQS
           ||||||||||||||||||||||||||||||||||||||||||||||||||||||||||||
a154       SVRGLTVGSPVEYKGLNVGVVSDVPYFDRNDSLHLFENGWIPVRIRIEPSRLEINADEQS
                  310       320       330       340       350       360

                  370       380       390       400       410       420
m154.pep   KEHWKQQFQTALNKGLTATISSNNLLTGSKMIELNDQPSASPKLRPHTVYAGDTVIATQG
           ||||||||||||||||||||||||||||||||||||||||||||||||||||||||||||
a154       KEHWKQQFQTALNKGLTATISSNNLLTGSKMIELNDQPSASPKLRPHTVYAGDTVIATQG
                  370       380       390       400       410       420

                  430       440       450       460       470       480
m154.pep   GGLDDLQVKLADLLDKFDKLPLDKTVAELNGSLAELKSTLKSANAALSSIDKLVGKPQTQ
           ||||||||||||||||||||||||||||||||||||||||||||||||||||||||||||
a154       GGLDDLQVKLADLLDKFDKLPLDKTVAELNGSLAELKSTLKSANAALSSIDKLVGKPQTQ
                  430       440       450       460       470       480

                  490       500       510       520       530       540
m154.pep   NIPNELNQTLKELRTTLQGVSPQSPIYGDVQNTLQSLDKTLKDVQPVINTLKEKPNALIF
           ||||||||||||||||||||||||||||||||||||||||||||||||||||||||||||
a154       NIPNELNQTLKELRTTLQGVSPQSPIYGDVQNTLQSLDKTLKDVQPVINTLKEKPNALIF
                  490       500       510       520       530       540
```

-continued

```
                550
m154.pep  NSSSKDPIPKGSRX
          ||||||||||||||
a154      NSSSKDPIPKGSRX
                550
```

The following partial DNA sequence was identified in *N. gonorrhoeae* <SEQ ID 637>:

g155.seq

```
   1 atGAAaatcg GtatcCCACG CGAGTCAtta tcCGGCGAAA cccgcgtagc
  51 ctgcAcgccc gCCACCGTTG CCctgctggg caAactAGGC TTTGAAACCG
 101 TTGtcgaAAG CGGTGCAggt TTGGCGGCAA GTTTggaCGA TGCCGCTTAC
 151 CAAACAGCAG GCGCAACCGT TGCCGACAAA GCGGCGGTTT GGGCCTGCCC
 201 TTTAATTTAT AAGGTCAACG CGCCGTCCGA AGGCGAGCTG CCGCTGCTCA
 251 AAGAAGGTCA AACCATCGTC AGCTTCCTGT GGCCGCGCCA AAACGAGGCT
 301 TTGGTCGAGG CCTTGCGCGC CAAGAAAGTC AACGCGCTGG CGATGGACAT
 351 GGTTCCCCGC ATTTCCCGCG CTCAGGCCTT GGACGCTTTG TCTTCAATGG
 401 CAAACATCAG CGGCTACCGC GCCGTGATTG AAGCCGCCAA CGCCTTCGGC
 451 CGTTTCTTCA CCGGTCAAAT CACTGCCGCC GGCAAAGTGC CGCCTGCGCA
 501 GGTTTTGGTG ATTGGCGCCG GTGTGGCGGG TTTGGCGGCA ATCGGTACGG
 551 CAAATTCGCT CGGCGCAGTG GTGCGCGCGT TCGATACCCG CTTGGAAGTG
 601 GCGGAACAAA TCGAATCGAT GGGCGGTAAG TTcctGAAAC TCGACTTCCT
 651 GCAAGAATCG GGCGGCAGCG GAGACGgctA CGCCAAAGTG ATGAGCGACG
 701 AATTTATCGC CGCCGAAATG AAGCTCTTTG CCGAACAGGC GAAAGAAGTG
 751 GACATCATCA TCACCACCGC CGCCATTCCG GGCAAACCCG CTCCCAAGCT
 801 GATTACCAAA GAAATGGTGG AAAGCATGAA ATCCGGATCC GTCATCGTCG
 851 ATTTGGCGGC GACGGGCGGC AACTGCGAAC TCACCCGACC GGGCGAATTG
 901 TCCGTAACCG GCAACGGCGT GAAAATCATC GGCTACACCG ACATGGCAAA
 951 CCGCCTTGCC GGACAGTCTT CCCAGCTTTA CGCCACCAAC TTGGTGAACC
1001 TGACCAAGCT GTTAAGCCCG AACAAAGAcg gcgaAATCAC GCTGGACTTC
1051 GAAGacgtGA TTATCCGCAA TATGACCGTT ACCCGcgacg gcgaaATCAC
1101 CTTCCCGCCT CCGccgaTTc aggtTTCcgc ccggccgCAG CAAAcgccgt
1151 ctgaAAAagc cgcGCCTGCC GCCAagcccg AgccGaaacc tgttCCcctg
1201 tggaAAAaac tcgCGCCCGC CGCcatcgCC GCCGTATTGG tgctgtgGgt
1251 cggCgcggtc gcacccgcag CATTCTTGAA CCACTTTATC GTCTTCGTCC
1301 TCGCCTGCGT CATCGGCTAC CATGTCGTTT GgaacgTCAG CCACTCGCTG
1351 CACACACCGC TGAtgtcggt aaccaaCgcc atctccGGCA tcatggtcgt
1401 cggCGCGCTG CTGCAAATCG GTCAGGGcaa cggcttcgtT TCgctGCTGT
1451 CGTTTGTTGC CATCCTGATT GCCGGCATCA ATATCTTCGG CGGCTTTGCG
1501 GTTACACGGC GTATGCTGAA TATGTTTAAG AAAGGGTAA
```

This corresponds to the amino acid sequence <SEQ ID 638; ORF 155.ng>:

g155.pep

```
  1 MKIGIPRESL SGETRVACTP ATVALLGKLG FETVVESGAG LAASLDDAAY
 51 QTAGATVADK AAVWACPLIY KVNAPSEGEL PLLKEGQTIV SFLWPRQNEA
101 LVEALRAKKV NALAMDMVPR ISRAQALDAL SSMANISGYR AVIEAANAFG
151 RFFTGQITAA GKVPPAQVLV IGAGVAGLAA IGTANSLGAV VRAFDTRLEV
201 AEQIESMGGK FLKLDFLQES GGSGDGYAKV MSDEFIAAEM KLFAEQAKEV
251 DIIITTAAIP GKPAPKLITK EMVESMKSGS VIVDLAATGG NCELTRPGEL
301 SVTGNGVKII GYTDMANRLA GQSSQLYATN LVNLTKLLSP NKDGEITLDF
351 EDVIIRNMTV TRDGEITFPP PPIQVSARPQ QTPSEKAAPA AKPEPKPVPL
401 WKKLAPAAIA AVLVLWVGAV APAAFLNHFI VFVLACVIGY HVVWNVSHSL
451 HTPLMSVTNA ISGIMVVGAL LQIGQGNGFV SLLSFVAILI AGINIFGGFA
501 VTRRMLNMFK KG*
```

The following partial DNA sequence was identified in *N. meningitidis* <SEQ ID 639>:

m155.seq

```
   1 ATGAAAATCG GTATCCCACG CGAGTCATTA TCCGGCGAAA CCCGCGTCGC
  51 CTGTACGCCC GCCACCGTCG CCCTGCTGGG CAAACTGGGC TTTGAAACCG
 101 TTGTCGAAAG CGGTGCAGGT TTGGCGGCAA GTTTGGACGA TGCCGCTTAC
 151 CAAACAGCAG GCGCAACCGT TGCCGACAAA GCGGCGGTTT GGGTCTGCCC
 201 TTTGATTTAT AAGGTCAACG CGCCGTCCGA ACAGGAACTG CCGCTTTTGA
 251 ACGAAGGTCA AACCATCGTC AGCTTCCTGT GGCCGCGCCA AAACGAGGCT
 301 TTGGTCGAAG CCTTGCGCGC CAAGAAAGTG AACGCGCTGG CGATGGATAT
 351 GGTGCCCCGC ATTTCGCGCG CGCAGGCTTT GGACGCTTTG TCTTCGATGG
 401 CAAACATCAG CGGCTACCGC GCCGTAATTG AAGCCGCCAA CGCCTTCGGC
 451 CGTTTCTTCA CCGGTCAAAT TACCGCCGCC GGCAAAGTGC CGCCCGCGCA
 501 GGTTTTGGTG ATTGGTGCAG GTGTGGCAGG TTTGGCGGCG ATCGGTACGG
 551 CAAACTCGCT CGGCGCAGTG GTACGCGCGT TCGATACCCG CTTGGAAGTG
 601 GCGGAACAAA TCGAATCGAT GGGCGGCAAG TTCCTGAAAC TCGACTTCCC
 651 ACAAGAATCG GGCGGCAGCG GAGACGGCTA CGCCAAAGTG ATGAGCGACG
 701 AATTTATCGC AGCCGAGATG AAGCTCTTTG CCGAGCAGGC GAAAGAAGTG
 751 GACATCATCA TCACCACCGC CGCCATTCCG GGCAAACCCG CGCCCAAGCT
 801 GATTACCAAA GAAATGGTGG AAAGCATGAA ATCCGGCTCC GTCATCGTCG
 851 ATTTGGCGGC GGCGACGGGC GGCAACTGCG AACTCACCCG CCCGGGCGAA
 901 TTGTCCGTAA CCGGCAACGG CGTGAAAATC ATCGGCTACA CCGACATGGC
 951 AAACCGCCTT GCCGGACAGT CTTCCCAGCT TTACGCCACC AACTTGGTCA
1001 ACCTGACCAA GCTGTTAAGC CCGAACAAAG ACGGCGAAAT CACGTTGGAC
1051 TTCGAAGACG TGATTATCCG CAACATGACC GTTACCCACG ACGGCGAAAT
1101 CACCTTCCCG CCTCCGCCGA TTCAAGTTTC CGCCCAGCCG CAGCAAACGC
1151 CGTCTGAAAA AGCCGTGCCT GCCGCCAAGC CCGAGCCAAA ACCCGTTCCC
```

-continued

```
1201 CTGTGGAAAA AACTCGCGCC CGCCGTCATC GCCGCCGTCT TGGTACTGTG
1251 GGTCGGCGCG GTCGCACCCG CAGCATTCCT GAACCACTTT ATCGTGTTCG
1301 TTCTCGCCTG CGTCATCGGC TACTACGTCG TCTGGAACGT CAGCCACTCG
1351 CTGCACACAC CGCTGATGTC GGTAACCAAC GCCATCTCCG GCATCATCGT
1401 CGTCGGCGCG CTGCTGCAAA TCGGTCAGGG CAACGGCTTC GTTTCGCTGC
1451 TGTCGTTTGT TGCCATCCTG ATTGCCGGCA TCAACATCTT CGGCGGCTTT
1501 GCGGTAACAC GGCGTATGCT GAATATGTTT AAGAAAGGGT AA
```

This corresponds to the amino acid sequence <SEQ ID 640; ORF 155>:

```
m155.pep
  1 MKIGIPRESL SGETRVACTP ATVALLGKLG FETVVESGAG LAASLDDAAY
 51 QTAGATVADK AAVWVCPLIY KVNAPSEQEL PLLNEGQTIV SFLWPRQNEA
101 LVEALRAKKV NALAMDMVPR ISRAQALDAL SSMANISGYR AVIEAANAFG
151 RFFTGQITAA GKVPPAQVLV IGAGVAGLAA IGTANSLGAV VRAFDTRLEV
201 AEQIESMGGK FLKLDFPQES GGSGDGYAKV MSDEFIAAEM KLFAEQAKEV
251 DIIITTAAIP GKPAPKLITK EMVESMKSGS VIVDLAAATG GNCELTRPGE
301 LSVTGNGVKI IGYTDMANRL AGQSSQLYAT NLVNLTKLLS PNKDGEITLD
351 FEDVIIRNMT VTHDGEITFP PPPIQVSAQP QQTPSEKAVP AAKPEPKPVP
401 LWKKLAPAVI AAVLVLWVGA VAPAAFLNHF IVFVLACVIG YYVVWNVSHS
451 LHTPLMSVTN AISGIIVVGA LLQIGQGNGF VSLLSFVAIL IAGINIFGGF
501 AVTRRMLNMF KKG*
```

Computer analysis of this amino acid sequence gave the following results:

Homology with a predicted ORF from *N. gonorrhoeae*

ORF 155 shows 97.9% identity over a 513 aa overlap with a predicted ORF (ORF 155.ng) from *N. gonorrhoeae:* m155/g155 97.9% identity in 513 aa overlap

```
                    10        20        30        40        50        60
m155.pep    MKIGIPRESLSGETRVACTPATVALLGKLGFETVVESGAGLAASLDDAAYQTAGATVADK
            ||||||||||||||||||||||||||||||||||||||||||||||||||||||||||||
g155        MKIGIPRESLSGETRVACTPATVALLGKLGFETVVESGAGLAASLDDAAYQTAGATVADK
                    10        20        30        40        50        60

                    70        80        90       100       110       120
m155.pep    AAVWVCPLIYKVNAPSEQELPLLNEGQTIVSFLWPRQNEALVEALRAKKVNALAMDMVPR
            ||||:||||||||||| |||||:|||||||||||||||||||||||||||||||||||||
g155        AAVWACPLIYKVNAPSEGELPLLKEGQTIVSFLWPRQNEALVEALRAKKVNALAMDMVPR
                    70        80        90       100       110       120

                   130       140       150       160       170       180
m155.pep    ISRAQALDALSSMANISGYRAVIEAANAFGRFFTGQITAAGKVPPAQVLVIGAGVAGLAA
            ||||||||||||||||||||||||||||||||||||||||||||||||||||||||||||
g155        ISRAQALDALSSMANISGYRAVIEAANAFGRFFTGQITAAGKVPPAQVLVIGAGVAGLAA
                   130       140       150       160       170       180

                   190       200       210       220       230       240
m155.pep    IGTANSLGAVVRAFDTRLEVAEQIESMGGKFLKLDFPQESGGSGDGYAKVMSDEFIAAEM
            |||||||||||||||||||||||||||||||||||| |||||||||||||||||||||||
g155        IGTANSLGAVVRAFDTRLEVAEQIESMGGKFLKLDFLQESGGSGDGYAKVMSDEFIAAEM
                   190       200       210       220       230       240
```

-continued

```
                250       260       270       280       290       300
m155.pep    KLFAEQAKEVDIIITTAAIPGKPAPKLITKEMVESMKSGSVIVDLAAATGGNCELTRPGE
            |||||||||||||||||||||||||||||||||||||||||||||||| |||||||||||
g155        KLFAEQAKEVDIIITTAAIPGKPAPKLITKEMVESMKSGSVIVDLAA-TGGNCELTRPGE
                250       260       270       280       290

                310       320       330       340       350       360
m155.pep    LSVTGNGVKIIGYTDMANRLAGQSSQLYATNLVNLTKLLSPNKDGEITLDFEDVIIRNMT
            ||||||||||||||||||||||||||||||||||||||||||||||||||||||||||||
g155        LSVTGNGVKIIGYTDMANRLAGQSSQLYATNLVNLTKLLSPNKDGEITLDFEDVIIRNMT
         300       310       320       330       340       350

                370       380       390       400       410       420
m155.pep    VTHDGEITFPPPPIQVSAQPQQTPSEKAVPAAKPEPKPVPLWKKLAPAVIAAVLVLWVGA
            ||:|||||||||||||||:|||||||||:|||||||||||||||||||:|||||||||||
g155        VTRDGEITFPPPPIQVSARPQQTPSEKAAPAAKPEPKPVPLWKKLAPAAIAAVLVLWVGA
         360       370       380       390       400       410

                430       440       450       460       470       480
m155.pep    VAPAAFLNHFIVFVLACVIGYYVVWNVSHSLHTPLMSVTNAISGIIVVGALLQIGQGNGF
            ||||||||||||||||||||:|||||||||||||||||||||||||:|||||||||||||
g155        VAPAAFLNHFIVFVLACVIGYHVVWNVSHSLHTPLMSVTNAISGIMVVGALLQIGQGNGF
         420       430       440       450       460       470

                490       500       510
m155.pep    VSLLSFVAILIAGINIFGGFAVTRRMLNMFKKGX
            ||||||||||||||||||||||||||||||||||
g155        VSLLSFVAILIAGINIFGGFAVTRRMLNMFKKGX
         480       490       500       510
```

The following partial DNA sequence was identified in *N. meningitidis* <SEQ ID 641>:

a155.seq

```
   1 ATGAAAATCG GTATCCCACG TGAGTCATTA TCCGGCGAAA CCCGCGTCGC
  51 CTGTACGCCC GCCACCGTCG CCCTGCTGGG CAAACTGGGC TTTGAAACCG
 101 TTGTCGAAAG CGGCGCAGGT TTGGCGGCAA GTTTGGACGA TGCCGCTTAC
 151 CAAGCAGCAG GCGCAACCGT TGCCGACAAA GCAGCGGTTT GGGCATACCC
 201 TTTAATTTAT AAGGTTAACG CGCCGTCCGA AGACGAGCTG CCGCTGCTCA
 251 AAGAAGGACA GACCATCGTC AGCTTCCTGT GGCCGCGCCA AAACGAGGCT
 301 TTGGTCGAAG CCTTGCGCGC CAAGAAAGTG AACGCGCTGG CAATGGACAT
 351 GGTGCCCCGC ATTTCGCGCG CGCAGGCTTT GGACGNTTTG TCTTNGATGG
 401 CAAACATCAG CGGCTACCGC GCCGTGATTG AAGCCGCCAA CGCCTTCGGC
 451 CGTTTNTTCA CCGGCCAAAT TACTGCCGCA GGCAAAGTGC CGCCCGCGCA
 501 GGTTTTGGTG ATTGGTGCAG GTGTGGCAGG TTTGGCGGCG ATCGGTACGG
 551 CAAACTCGCT CGGCGCAGTG GTACGCGTGT TCGATACCCG CCTG.AAGTG
 601 GCGGAACAAT TAGAATCGAT GGGCGGCAAG TTCCTGAAAC TCGACTTCCC
 651 GCAAGAATCG GGCGGCAGCG GCGACGGCTA CGCCAAAGTG ATGAGCGACG
 701 AATTTATCGC CGCCGAGATG AAGCTTTTTG CCGAGCAGGC GAAAGAAGTG
 751 GACATCATCA TCACCACCGC CGCCATTCCG GGCAAACCCG CGCCCAAGCN
 801 NNTNANCAAA GAAATGGTCG AAAGCATGAA ACCCGGCTCC GTCATCGTCG
 851 ATTTGGCGGC GGCGACGGGC GGCAACTGCG AACTCACCAA ACAGGGCGAA
 901 TTGTTCGTAA CCGGCAACGG CGTGAAAATC ATCGGCTACA CCGACATGGC
 951 AAACCGCCTT GCCGGACAGT CTTCGCAGCT TTACGCCACC AACTTGGTCA
1001 ACCTGACCAA GCTGTTAAGC CCGAACAAAG ACGGCGAAAT CACGCTGGAC
1051 TTCGAAGACG TGATTATCCG CAACATGACC GTTACCCGCG ACGGCGAAAT
1101 CACCTTCCCG CCTCCGCCGA TTCAAGTTTC CGCCCAACCG CAGCAAACGC
```

-continued

```
1151 CGTCTGAAAA AGCCGCGCCT GCCGCCAAGC CCGAACCGAA ACCCGTTCCC

1201 CTGTGGAAAA AACTCGCGCC CGCCNTNATC GCCGCCGTGT TGGTACTGTG

1251 GGTCGGCGCG GTCGCACCCG CAGCATTCCT GAACCACTTT ATCGTCTTCG

1301 TCCTCGCCTG CGTCATCGGC TACTATGTCG TTTGGAACGT CAGCCACTCG

1351 CTGCACACAC CGCTGATGTC GGTGACCAAC GCCATTTCCG GCATCATCGT

1401 CGTCGGCGCG CTGCTGCAAA TCGGTCAGGG CAACGGCTTC GTTTCGCTGC

1451 TGTCGTTTGT TGCCATCCTG ATTGCCAGCA TCAACATCTT CGGCGGCTTC

1501 TTTGTAACGC GGCGGATGCT GAATATGTTT AGGAAAGGGT AA
```

This corresponds to the amino acid sequence <SEQ ID 642; ORF 155.a>:

```
a155.pep

  1 MKIGIPRESL SGETRVACTP ATVALLGKLG FETVVESGAG LAASLDDAAY

 51 QAAGATVADK AAVWAYPLIY KVNAPSEDEL PLLKEGQTIV SFLWPRQNEA

101 LVEALRAKKV NALAMDMVPR ISRAQALDXL SXMANISGYR AVIEAANAFG

151 RXFTGQITAA GKVPPAQVLV IGAGVAGLAA IGTANSLGAV VRVFDTRLXV

201 AEQLESMGGK FLKLDFPQES GGSGDGYAKV MSDEFIAAEM KLFAEQAKEV

251 DIIITTAAIP GKPAPKXXXK EMVESMKPGS VIVDLAAATG GNCELTKQGE

301 LFVTGNGVKI IGYTDMANRL AGQSSQLYAT NLVNLTKLLS PNKDGEITLD

351 FEDVIIRNMT VTRDGEITFP PPPIQVSAQP QQTPSEKAAP AAKPEPKPVP

401 LWKKLAPAXI AAVLVLWVGA VAPAAFLNHF IVFVLACVIG YYVVWNVSHS

451 LHTPLMSVTN AISGIIVVGA LLQIGQGNGF VSLLSFVAIL IASINIFGGF

501 FVTRRMLNMF RKG*
```

m155/a155 95.3% identity in 513 aa overlap

```
                    10        20        30        40        50        60
m155.pep    MKIGIPRESLSGETRVACTPATVALLGKLGFETVVESGAGLAASLDDAAYQTAGATVADK
            ||||||||||||||||||||||||||||||||||||||||||||||||||||:|||||||
a155        MKIGIPRESLSGETRVACTPATVALLGKLGFETVVESGAGLAASLDDAAYQAAGATVADK
                    10        20        30        40        50        60

                    70        80        90       100       110       120
m155.pep    AAVWVCPLIYKVNAPSEQELPLLNEGQTIVSFLWPRQNEALVEALRAKKVNALAMDMVPR
            ||||: |||||||||||:|||||:||||||||||||||||||||||||||||||||||||
a155        AAVWAYPLIYKVNAPSEDELPLLKEGQTIVSFLWPRQNEALVEALRAKKVNALAMDMVPR
                    70        80        90       100       110       120

                   130       140       150       160       170       180
m155.pep    ISRAQALDALSSMANISGYRAVIEAANAFGRFFTGQITAAGKVPPAQVLVIGAGVAGLAA
            |||||||| || |||||||||||||||||||| |||||||||||||||||||||||||||
a155        ISRAQALDXLSXMANISGYRAVIEAANAFGRXFTGQITAAGKVPPAQVLVIGAGVAGLAA
                   130       140       150       160       170       180

                   190       200       210       220       230       240
m155.pep    IGTANSLGAVVRAFDTRLEVAEQIESMGGKFLKLDFPQESGGSGDGYAKVMSDEFIAAEM
            ||||||||||||:||||| ||||:||||||||||||||||||||||||||||||||||||
a155        IGTANSLGAVVRVFDTRLXVAEQLESMGGKFLKLDFPQESGGSGDGYAKVMSDEFIAAEM
                   190       200       210       220       230       240

                   250       260       270       280       290       300
m155.pep    KLFAEQAKEVDIIITTAAIPGKPAPKLITKEMVESMKSGSVIVDLAAATGGNCELTRPGE
            ||||||||||||||||||||||||||  :|||||||| ||||||||||||||||||: ||
a155        KLFAEQAKEVDIIITTAAIPGKPAPKXXXKEMVESMKPGSVIVDLAAATGGNCELTKQGE
                   250       260       270       280       290       300
```

-continued

```
                310        320        330        340        350        360
m155.pep   LSVTGNGVKIIGYTDMANRLAGQSSQLYATNLVNLTKLLSPNKDGEITLDFEDVIIRNMT
           | ||||||||||||||||||||||||||||||||||||||||||||||||||||||||||
a155       LFVTGNGVKIIGYTDMANRLAGQSSQLYATNLVNLTKLLSPNKDGEITLDFEDVIIRNMT
                310        320        330        340        350        360

                370        380        390        400        410        420
m155.pep   VTHDGEITEPPPPIQVSAQPQQTPSEKAVPAAKPEPKPVPLWKKLAPAVIAAVLVLWVGA
           ||:|||||||||||||||||||||||||:||||||||||||||||||| |||||||||||
a155       VTRDGEITFPPPPIQVSAQPQQTPSEKAAPAAKPEPKPVPLWKKLAPAXIAAVLVLWVGA
                370        380        390        400        410        420

                430        440        450        460        470        480
m155.pep   VAPAAFLNHFIVFVLACVIGYYVVWNVSHSLHTPLMSVTNAISGIIVVGALLQIGQGNGF
           ||||||||||||||||||||||||||||||||||||||||||||||||||||||||||||
a155       VAPAAFLNHFIVFVLACVIGYYVVWNVSHSLHTPLMSVTNAISGIIVVGALLQIGQGNGF
                430        440        450        460        470        480

                490        500        510
m155.pep   VSLLSFVAILIAGINIFGGFAVTRRMLNMFKKGX
           ||||||||||||:||||||| |||||||||:|||
a155       VSLLSFVAILIASINIFGGFFVTRRMLNMFRKGX
                490        500        510
```

The following partial DNA sequence was identified in *N. gonorrhoeae* <SEQ ID 643>:

g156.seq

```
  1 ATGACTTTCG CCTATTGGTG CATTCTGATT GCCTGCCTAT TGCCGCTTTT
 51 TTGTGCGGCG TATGCCAAAA AAGCGGGCGG ATTCCGGTTT AAAGACAACC
101 ACAATCCTCG CGGTTTTCTG GCACATACGC AAGGCGCAGC CGCCCGTGCC
151 CACGCCGCGC AGCAAAACGG TTTTGAAGCC TTTGCACCGT TTGCCGCCGC
201 CGTTTTGACG GCACACGCAA CCGGCAATGC CGGACAAGCA ACCGTCAACA
251 CGCTTGCCGG ATTGTTCATC CTGTTCCGCC TCGCCTTTAT CTGGTGCTAC
301 ATCGCAGACA AAGCAGCATT GCGCTCGCTG ATGTGGGCGG GCGGATTTGC
351 CTGCACCGTC GGACTGTTTG TCGCGGCTGC TTGA
```

This corresponds to the amino acid sequence <SEQ ID 644; ORF 156.ng>:

g156.pep

```
  1 MTFAYWCILI ACLLPLFCAA YAKKAGGFRF KDNHNPRGFL AHTQGAAARA
 51 HAAQQNGFEA FAPFAAAVLT AHATGNAGQA TVNTLAGLFI LFRLAFIWCY
101 IADKAALRSL MWAGGFACTV GLFVAAA*
```

The following partial DNA sequence was identified in *N. meningitidis* <SEQ ID 645>:

m156.seq

```
  1 ATGACTTTCG CCTATTGGTG TATTCTGATT GCCTGCCTAT TGCCGCTTTT
 51 TTGTGCGGCG TATGCCAAAA AAGCGGGCGG ATTCCGGTTT AAAGACAACC
101 ACAATCCGCG CGGTTTTCTA GCGCACACGC AAGGCGCAGC CGCCCGTGCC
151 CACGCCGCAC AGCAAAACGG TTTTGAAGCC TTTGCACCGT TTGCCGCCGC
201 CGTTTTGACG GCACACGCAA CCGGCAATGC GGCGCAATCG ACCATCAACA
251 CGCTTGCCTG CCTGTTCATC CTGTTCCGCC TCGCCTTTAT CTGGTGCTAT
```

-continued

```
301 ATCGCCGACA AAGCCGCTAT GCGCTCACTG ATGTGGGCAG GCGGATTTGC

351 CTGCACCGTC GGGCTGTTTG TCGCGGCTGC TTGA
```

This corresponds to the amino acid sequence <SEQ ID 646; ORF 156>:

```
m156.pep

  1 MTFAYWCILI ACLLPLFCAA YAKKAGGFRF KDNHNPRGFL AHTQGAAARA

 51 HAAQQNGFEA FAPFAAAVLT AHATGNAAQS TINTLACLFI LFRLAFIWCY

101 IADKAAMRSL MWAGGFACTV GLFVAAA*
```

Computer analysis of this amino acid sequence gave the following results:

Homology with a predicted ORF from *N. gonorrhoeae* m156/g156 96.1% identity in 127 aa overlap

```
                  10        20        30        40        50        60
m156.pep   MTFAYWCILIACLLPLFCAAYAKKAGGFRFKDNHNPRGFLAHTQGAAARAHAAQQNGFEA
           ||||||||||||||||||||||||||||||||||||||||||||||||||||||||||||
g156       MTFAYWCILIACLLPLFCAAYAKKAGGFRFKDNHNPRGFLAHTQGAAARAHAAQQNGFEA
                  10        20        30        40        50        60
                  70        80        90       100       110       120
m156.pep   FAPFAAAVLTAHATGNAAQSTINTLACLFILFRLAFIWCYIADKAAMRSLMWAGGFACTV
           ||||||||||||||||:|:|:|||| ||||||||||||||||||:||||||||||||
g156       FAPFAAAVLTAHATGNAGQATVNTLAGLFILFRLAFIWCYIADKAALRSLMWAGGFACTV
                  70        80        90       100       110       120

m156.pep   GLFVAAAX
           ||||||||
g156       GLFVAAAX
```

The following partial DNA sequence was identified in *N. meningitidis* <SEQ ID 647>:

```
a156.seq

  1 ATGACTTTCG CCTATTGGTG TATTCTGATT GCCTACCTAT TGCCGCTTTT

 51 TTGTGCGGCG TATGCCAAAA AAGCGGGCGG ATTCCGGTTT AAAGACAACC

101 ACAATCCGCG CGATTTTCTG GCGCGCACGC AAGGCACAGC CGCCCGTGCC

151 CACGCCGCGC AGCAAAACGG TTTTGAAGCC TTTGCACCGT TTGCAGCCGC

201 CGTTTTGACG GCACACGCAA CCGGCAATGC CGGACAAGCA ACCGTCAACA

251 CGCTTGCCGG CCTCTTCATC CTGTTCCGCC TCGCCTTTAT CTGGTGCTAC

301 ATCGCAGACA AAGCAGCATT ACGCTCGCTG ATGTGGGTGG GCGGATTTGT

351 CTGCACCGTC GGGCTGTTTG TCGTGGCTGC TTGA
```

This corresponds to the amino acid sequence <SEQ ID 648; ORF 156.a>:

```
a156.pep

  1 MTFAYWCILI AYLLPLFCAA YAKKAGGFRF KDNHNPRDFL ARTQGTAARA

 51 HAAQQNGFEA FAPFAAAVLT AHATGNAGQA TVNTLAGLFI LFRLAFIWCY

101 IADKAALRSL MWVGGFVCTV GLFVVAA*
```

m156/a156 90.6% identity in 127 aa overlap

```
                    10        20        30        40        50        60
m156.pep    MTFAYWCILIACLLPLFCAAYAKKAGGFRFKDNHNPRGFLAHTQGAAARAHAAQQNGFEA
            |||||||||| ||||||||||||||||||||||||| |||:|||:|||||||||||||
a156        MTFAYWCILIAYLLPLFCAAYAKKAGGFRFKDNHNPRDFLARTQGTAARAHAAQQNGFEA
                    10        20        30        40        50        60

                    70        80        90       100       110       120
m156.pep    FAPFAAAVLTAHATGNAAQSTINTLACLFILFRLAFIWCYIADKAAMRSLMWAGGFACTV
            ||||||||||||||||:|:|:|||| ||||||||||||||||||:|||||:|||:|||
a156        FAPFAAAVLTAHATGNAGQATVNTLAGLFILFRLAFIWCYIADKAALRSLMWVGGFVCTV
                    70        80        90       100       110       120

m156.pep    GLFVAAAX
            ||||:|||
a156        GLFVVAAX
```

The following partial DNA sequence was identified in *N. gonorrhoeae* <SEQ ID 649>:

g157.seq

```
  1 atgaggaacg aggAAAAACg cgccctgcgc cgcgaattgC gCgGgcggcg
 51 ttcgcAAATg GGgcgagacg tGCGggCGGC GGCGgCgatA Aaaatcaacc
101 gcctgctcaa aCGTtatatc AAGCGCggtc gGaAaatcgG CGTGTATTgg
151 cCGATGGGCA AGGAATTGcg TTTGGGCGgc tTtgtcCGCG CGGCGCAAAA
201 ACGCgGCGCA AAactctatc tgccttATAT CGAACCGCAC ACGCGGCGGA
251 TGTGGTTTAC GCCGTATCCT GAACGCGGAA TGGAACGGGA ACGCAAGCGC
301 GGTAGGGCGA AGCTGCATGT CCCTCAGTTT GCAGGGCGCA AAATCCGCGT
351 GCACGGTTTG TCGGTATTGC TCGTCCCGCT TGTCGGCATA GACCGCGAAG
401 GCTACCGTTT GGGGCAGGCA GGCGGCTATT ACGATGCGAC GCTTTCGGCG
451 ATGAAATACC GTTTGCAGGC GAAAACCGTG GGCGTGGGCT TTGCCTGCCA
501 GTTGGTGGAC AGGCTCCCAC GCGAGGCGCA CGACCTGCCG CTGGACGGTT
551 TTGTATCGGA AGCGGGGATA TTGTGTTTTT AG
```

This corresponds to the amino acid sequence <SEQ ID 650; ORF 157.ng>:

g157.pep

```
  1 MRNEEKRALR RELRGRRSQM GRDVRAAAAI KINRLLKRYI KRGRKIGVYW
 51 PMGKELRLGG FVRAAQKRGA KLYLPYIEPH TRRMWFTPYP ERGMERERKR
101 GRAKLHVPQF AGRKIRVHGL SVLLVPLVGI DREGYRLGQA GGYYDATLSA
151 MKYRLQAKTV GVGFACQLVD RLPREAHDLP LDGFVSEAGI LCF*
```

The following partial DNA sequence was identified in *N. meningitidis* <SEQ ID 651>:

m157.seq

```
  1 ATGAGGAACG AGGAAAAACG CGCCCTGCGC CGCGAATTGC GCGGGCGGCG
 51 TTCGCAAATG GGGCGGGACG TGCGGGCGGC GGCAACGGTA AAAATCAACC
101 ACCTGCTCAA ACGTTATATT AAAAAAGGGC GGAAAATCGG CGTGTATTGG
```

-continued

```
151 CCGATGGGCA AGGAATTGCG TTTGGACGGC TTTGTCCGCG CGGCGCAAAA

201 ACGCGGTGCG GAACTCTACC TGCCTTATAT CGAACCGCGT TCGCGGCGGA

251 TGTGGTTTAC GCCGTATCCT GCCGATGGAG TAAAACAAGA ACGCAAGCGC

301 GGTAGGGCGA AGCTGCATGT CCCTCAGTTT GCAGGTCGGA AAAAGCGTGT

351 GCATGATTTG AACCTCCTGC TTGTGCCAGT GGTCGGTATG GACAGGCTGG

401 GCTACCGCTT GGGACAGGCA GGCGGCTATT ACGATGCGAC GCTTTCAGCG

451 ATGAAATACC GTTTGCAGGC AAAAACCGTG GGCGTGGGCT TTGCCTGCCA

501 GTTGGTGGAC AGGCTGCCGG TCGAGGCGCA CGACCGGTCT TTGGACGGTT

551 TTGTGTCGGA GGCGGGGATA TTGTGTTTTT AG
```

This corresponds to the amino acid sequence <SEQ ID 652; ORF 157>:

m157.pep

```
  1 MRNEEKRALR RELRGRRSQM GRDVRAAATV KINHLLKRYI KKGRKIGVYW

 51 PMGKELRLDG FVRAAQKRGA ELYLPYIEPR SRRMWFTPYP ADGVKQERKR

101 GRAKLHVPQF AGRKKRVHDL NLLLVPVVGM DRLGYRLGQA GGYYDATLSA

151 MKYRLQAKTV GVGFACQLVD RLPVEAHDRS LDGFVSEAGI LCF*
```

Computer analysis of this amino acid sequence gave the following results:

Homology with a predicted ORF from *N. gonorrhoeae* m157/g157 88.1% identity in 193 aa overlap

```
                   10        20        30        40        50        60
m157.pep   MRNEEKRALRRELRGRRSQMGRDVRAAATVKINHLLKRYIKKGRKIGVYWPMGKELRLDG
           ||||||||||||||||||||||||||||::|||:|||||||:|||||||||||||||| |
g157       MRNEEKRALRRELRGRRSQMGRDVRAAAAIKINRLLKRYIKRGRKIGVYWPMGKELRLGG
                   10        20        30        40        50        60

                   70        80        90       100       110       120
m157.pep   FVRAAQKRGAELYLPYIEPRSRRMWFTPYPADGVKQERKRGRAKLHVPQFAGRKKRVHDL
           ||||||||||:||||||||::|||||||||  |:::|||||||||||||||||| ||| |
g157       FVRAAQKRGAKLYLPYIEPHTRRMWFTPYPERGMERERKRGRAKLHVPQFAGRKIRVHGL
                   70        80        90       100       110       120

                  130       140       150       160       170       180
m157.pep   NLLLVPVVGMDRLGYRLGQAGGYYDATLSAMKYRLQAKTVGVGFACQLVDRLPVEAHDRS
           ::||||:||:|| |||||||||||||||||||||||||||||||||||||||| ||||
g157       SVLLVPLVGIDREGYRLGQAGGYYDATLSAMKYRLQAKTVGVGFACQLVDRLPREAHDLP
                  130       140       150       160       170       180

                  190
m157.pep   LDGFVSEAGILCFX
           ||||||||||||||
g157       LDGFVSEAGILCFX
                  190
```

The following partial DNA sequence was identified in *N. meningitidis* <SEQ ID 653>:

a157.seq

```
  1 ATGAGGAACG AGGAAAAACA CGCCTTGCGC CGAGAGTTGC GCCGCGCCCG

 51 CGCGCAGATG GGGCATCAAG GGCGGTTGGC GGCGGGGCAA ACGATTAACC

101 GCCTGCTCAA ACGTTATATC AAGCGTGGTC GGAAAATCGG CGTGTATTGG
```

-continued

```
151 CCGATGGGCA AGGAATTGCG TTTGGACGGC TTTGTCCGCG CGGCGCAAAA

201 ACGCGGTGCA AAACTTTATC TGCCTTATAT CGAACCGCGT TCGCGGCGGA

251 TGTGGTTTAC GCCGTATCCT GAAAGCGGAA TGGAACGGGA GCGCATACGG

301 GGCAGGGCGA AGTTGAACGT GCCGCAGTTT GCAGGGCGCA AAATCCGCGT

351 GCACGGTTTG TCGGTATTGC TCGTCCCGCT TGTCGGCATA GACCGCGAGG

401 GCTACCGCTT AGGACAGGCA GGCGGCTATT ACGATGCGAC GCTTGCGGCG

451 ATGAAATACC GTTTGCAGGC AAAAACCGTG GGCGTGGGCT TTGCCTGCCA

501 GTTTGTGGAC AGGCTGCCGC GCGAACCGCA CGATCTGCTG CTGGACGGTT

551 TTGTGTCGGA GGCGGGGATA TTGTGCTTTT AG
```

This corresponds to the amino acid sequence <SEQ ID 654; ORF 157.a>:

a157.pep

```
  1 MRNEEKHALR RELRRARAQM GHQGRLAAGQ TINRLLKRYI KRGRKIGVYW

 51 PMGKELRLDG FVRAAQKRGA KLYLPYIEPR SRRNWFTPYP ESGMERERIR

101 GRAKLNVPQF AGRKIRVHGL SVLLVPLVGI DREGYRLGQA GGYYDATLAA

151 MKYRLQAKTV GVGFACQFVD RLPREPHDLL LDGFVSEAGI LCF*
```

m157/a157 82.4% identity in 193 aa overlap

```
                   10        20        30        40        50        60
m157.pep   MRNEEKRALRRELRGRRSQMGRDVRAAATVKINHLLKRYIKKGRKIGVYWPMGKELRLDG
           ||||||:|||||||  |:|||:: | ||   ||:||||||:||||||||||||||||||
a157       MRNEEKHALRRELRRRARAQMGHQGRLAAGQTINRLLKRYIKRGRKIGVYWPMGKELRLDG
                   10        20        30        40        50        60

                   70        80        90       100       110       120
m157.pep   FVRAAQKRGAELYLPYIEPRSRRMWFTPYPADGVKQERKRGRAKLHVPQFAGRKKRVHDL
           |||||||||:|||||||||||||||||| :|:::|| ||||||:|||||||| ||| |
a157       FVRAAQKRGAKLYLPYIEPRSRRMWFTPYPESGMERERIRGRAKLNVPQFAGRKIRVHGL
                   70        80        90       100       110       120

                  130       140       150       160       170       180
m157.pep   NLLLVPVVGMDRLGYRLGQAGGYYDATLSAMKYRLQAKTVGVGFACQLVDRLPVEAHDRS
           ::||||:||:|| |||||||||||||||:||||||||||||||||||:|||||  | ||
a157       SVLLVPLVGIDREGYRLGQAGGYYDATLAAMKYRLQAKTVGVGFACQFVDRLPREPHDLL
                  130       140       150       160       170       180

                  190
m157.pep   LDGFVSEAGILCFX
           ||||||||||||||
a157       LDGFVSEAGILCFX
                  190
```

The following partial DNA sequence was identified in *N. gonorrhoeae* <SEQ ID 655>:

g158.seq

```
  1 ATGAAAACCA ATTCAGAAGA ACTGACCGTA TTTGTTCAAG TGGTGGAAAG

 51 CGGCAGCTTC AGCCGTGCGG CGgagcAGTT GGAGAtggCA AATTCTGCCG

101 TAAGCCGCAT CGTCAAACGG CTGGAGGAAA AGTTGGGCGT GAAcCTGCtc

151 aACCGCACCA CGCGGCAACT CAATCTGACG GAAGAAGGCG CGCAATATTT

201 CCGCCGCGCG CAGAGAATCC TGCAAGAAAT GGCAGCGGCG GAAACCGAAA
```

-continued

```
251 TGCTGGCAGT GCACGAAGTA CCGCAAGGCG TGTTGCGCGT GGATTCCGCG
301 ATGCcgatgg TGCTGCATCT GCTGGCGCCG CTGGCAGCAA AATTCAACGA
351 ACGCTATCCG CATATCcgaC TTTCGCTCGT TTCTTCCGAa ggctatatca
401 atctGattGA Acgcaaagtc gAtatTGCCT TACGGGCCGG AGAATTGGAC
451 GATTCCGGGC TGCGTGCACG CCATCTGTTT GACAGCCACT TCCGCGtagt
501 cgCCAGTCCT GAATATTTAG CAAAACACGG CACGCCACAA TCTGCAGAAG
551 atcTTGCCAA CCATCAATGT TTAGGCTTCA CAGAACCCGG TTCTCTAAAT
601 ACATGGGCGG TTTTAGAtgC GCAGGGAAAT CCCTATAAAA TTTCACCGCA
651 CTTTACCGCC AGCAGCGGTG AAATCTTACG CTCGTTGTGC CTTTCAAGtt
701 gCGGTATTGC TTGCTTATCA GATTTTTTGG TTGACAACGA CATCACTGAA
751 GGAAAGTTAA TTCCcctatt cgCCGAACAA ACCTCCAATA AAACACACCC
801 CTTTAATGCT GTTTATTACA GCGATAAAGC CGTCAACCTC CGCTTACGCG
851 TATTTTTGGA TTTTTTAGTG AAGGAACTGG GAAAAAATAT GAATAGAACG
901 AATACCAAAT AA
```

This corresponds to the amino acid sequence <SEQ ID 656; ORF 158.ng>:

g158.pep

```
  1 MKTNSEELTV FVQVVESGSF SRAAEQLEMA NSAVSRIVKR LEEKLGVNLL
 51 NRTTRQLNLT EEGAQYFRRA QRILQEMAAA ETEMLAVHEV PQGVLRVDSA
101 MPMVLHLLAP LAAKFNERYP HIRLSLVSSE GYINLIERKV DIALRAGELD
151 DSGLRARHLF DSHFRVVASP EYLAKHGTPQ SAEDLANNQC LGFTEPGSLN
201 TWAVLDAQGN PYKISPHFTA SSGEILRSLC LSSCGIACLS DFLVDNDITE
251 GKLIFLFAEQ TSNKTHPFNA VYYSDKAVNL RLRVFLDFLV KELGKNMNRT
301 NTK*
```

The following partial DNA sequence was identified in *N. meningitidis* <SEQ ID 657>:

m158.seq

```
  1 ATGAAAACCA ATTCAGAAGA ACTGACCGTA TTTGTTGAAG TGGTGGAAAG
 51 CGGCAGCTTC AGCCGTGCGG CGGAGCAGTT GGCGATGGCA AATTCTGCCG
101 TAAGCCGCAT CGTCAAACGG CTGGAGGAAA AGTTGGGTGT GAACCTGCTC
151 AACCGCACCA CGCGGCAACT CAGTCTGACG GAAGAAGGCG CGCAATATTT
201 CCGCCGCGCG CAGAGAATCC TGCAAGAAAT GGCAGCGGCG GAAACCGAAA
251 TGCTGGCAGT GCACGAAATA CCGCAAGGCG TGTTGAGCGT GGATTCCGCG
301 ATGCCGATGG TGCTGCATCT GCTGGCGCCG CTGGCAGCAA AATTCAACGA
351 ACGCTATCCG CATATCCGAC TTTCGCTCGT TTCTTCCGAA GGCTATATCA
401 ATCTGATTGA ACGCAAAGTC GATATTGCCT TACGGGCCGG AGAATTGGAC
451 GATTCCGGGC TGCGTGCACG CCATCTGTTT GACAGCCGCT TCCGCGTAAT
```

-continued

```
501 CGCCAGTCCT GAATACCTGG CAAAACACGG CACGCCGCAA TCTACAGAAG

551 AGCTTGCCGG CCACCAATGT TTAGGCTTCA CCGAACCCGG TTCTCTAAAT

601 ACATGGGCGG TTTTAGATGC GCAGGGAAAT CCCTATAAGA TTTCACCGCA

651 CTTTACCGCC AGCAGCGGTG AAATCTTACG CTCGTTGTGC CTTTCAGGTT

701 GCGGTATTGT TTGCTTATCA GATTTTTTGG TTGACAACGA CATCGCTGAA

751 GGAAAGTTAA TTCCCCTGCT CGCGGAACAA ACCTCCGATA AAACACACCC

801 CTTTAATGCT GTTTATTACA GCGATAAAGC CGTCAATCTC CGCTTACGCG

851 TATTTTTGGA TTTTTTAGTG GAGGAACTGG GAAACAATCT CTGTGGATAA
```

This corresponds to the amino acid sequence <SEQ ID 658; ORF 158>:

m158.pep

```
  1 MKTNSEELTV FVQVVESGSF SRAAEQLAMA NSAVSRIVKR LEEKLGVNLL

 51 NRTTRQLSLT EEGAQYFRRA QRILQEMAAA ETEMLAVHEI PQGVLSVDSA

101 MPMVLHLLAP LAAKFNERYP HIRLSLVSSE GYINLIERKV DIALRAGELD

151 DSGLRARHLF DSRFRVIASP EYLAKHGTPQ STEELAGHQC LGFTEPGSLN

201 TWAVLDAQGN PYKISPHFTA SSGEILRSLC LSGCGIVCLS DFLVDNDIAE

251 GKLIPLLAEQ TSDKTHPFNA VYYSDKAVNL RLRVFLDFLV EELGNNLCG*
```

Computer analysis of this amino acid sequence gave the following results:

Homology with a predicted ORF from *N. gonorrhoeae* m158/g158 94.3% identity in 297 aa overlap

```
                  10        20        30        40        50        60
m158.pep  MKTNSEELTVFVQVVESGSFSRAAEQLAMANSAVSRIVKRLEEKLGVNLLNRTTRQLSLT
          |||||||||||||||||||||||||||||| |||||||||||||||||||||||||||:||
g158      MKTNSEELTVFVQVVESGSFSRAAEQLEMANSAVSRIVKRLEEKLGVNLLNRTTRQLNLT
                  10        20        30        40        50        60

                  70        80        90       100       110       120
m158.pep  EEGAQYFRRAQRILQEMAAAETEMLAVHEIPQGVLSVDSAMPMVLHLLAPLAAKFNERYP
          ||||||||||||||||||||||||||||:|||| |||||||||||||||||||||||||||
g158      EEGAQYFRRAQRILQEMAAAETEMLAVHEVPQGVLRVDSAMPMVLHLLAPLAAKFNERYP
                  70        80        90       100       110       120

                 130       140       150       160       170       180
m158.pep  HIRLSLVSSEGYINLIERKVDIALRAGELDDSGLRARHLFDSRFRVIASPEYLAKHGTPQ
          |||||||||||||||||||||||||||||||||||||||||:|||:|||||||||||||
g158      HIRLSLVSSEGYINLIERKVDIALRAGELDDSGLRARHLFDSHFRVVASPEYLAKHGTPQ
                 130       140       150       160       170       180

                 190       200       210       220       230       240
m158.pep  STEELAGHQCLGFTEPGSLNTWAVLDAQGNPYKISPHFTASSGEILRSLCLSGCGIVCLS
          |:|:||:||||||||||||||||||||||||||||||||||||||||||||:|||:|||
g158      SAEDLANHQCLGFTEPGSLNTWAVLDAQGNPYKISPHFTASSGEILRSLCLSSCGIACLS
                 190       200       210       220       230       240

                 250       260       270       280       290       300
m158.pep  DFLVDNDIAEGKLIPLLAEQTSDKTHPFNAVYYSDKAVNLRLRVFLDFLVEELGNNLCGX
          ||||||||:|||||||:|||||:||||:||||||||||||||||||||||:|||:|:
g158      DFLVDNDITEGKLIPLFAEQTSNKTHPENAVYYSDKAVNLRLRVFLDFLVKELGKNMNRT
                 250       260       270       280       290       300

g158      NTKX
```

The following partial DNA sequence was identified in *N. meningitidis* <SEQ ID 659>:

a158.seq

```
  1 ATGAAAACCA ATTCAGAAGA ACTGACCGTA TTTGTTCAAG TGGTGGAAAG
 51 CGGCAGCTTC AGCCGTGCGG CGGAGCAGTT GGCGATGGCA AATTCTGCCG
101 TAAGCCGCAT CGTCAAACGG CTGGAGGAAA AGTTGGGTGT GAACCTGCTC
151 AACCGCACCA CGCGGCAACT CAGTCTGACG GAAGAAGGCG CGCAATATTT
201 CCGCCGCGCG CAGAGAATCC TGCAAGAAAT GGCAGCGGCG GAAACCGAAA
251 TGCTGGCAGT GCACGAAATA CCGCAAGGCG TGTTGCGCGT GGATTCCGCG
301 ATGCCGATGG TGCTGCATCT GCTGGCGCCG CTGGCAGCAA AATTCAACGA
351 ACGCTATCCG CATATCCGAC TTTCGCTCGT TTCTTCCGAA GGCTATATCA
401 ATCTGATTGA ACGCAAAGTC GATATTGCCT TACGGGCCGG AGAATTGGAC
451 GATTCCGGGC TGCGTGCACG CCATCTGTTT GACAGCCGCT TCCGGGTAAT
501 CGCCAGTCCT GAATACCTGG CAAAACACGG CACGCCGCAA TCTACAGAAG
551 AGCTTGCCGG CCACCAATGT TTAGGCTTCA CCGAACCCGG TTCTCTAAAT
601 ACATGGGCGG TTTTAGATGC GCAGGGAAAT CCCTATAAGA TTTCACCGCA
651 CTTTACCGCC AGCAGCGGTG AAATCTTACG CTCGTTGTGC CTTTCAGGTT
701 GCGGTATTGC TTGCTTATCA GATTTTTTGG TTGACAACGA CATCGCTGAA
751 GGAAAGTTAA TTCCCCTGCT CGCCGAACAA ACCTCCAATA AAACGCACCC
801 CTTTAATGCT GTTTATTACA GCGATAAAGC CGTCAACCTC CGCTTACGCG
851 TATTTTTGGA TTTTTTAGTG GAGGAACTGG GAAACAATCT CTGTGGATAA
```

This corresponds to the amino acid sequence <SEQ ID 660; ORF 158.a>:

a158.pep

```
  1 MKTNSEELTV FVQVVESGSF SRAAEQLAMA NSAVSRIVKR LEEKLGVNLL
 51 NRTTRQLSLT EEGAQYFRRA QRILQEMAAA ETEMLAVHEI PQGVLRVDSA
101 MPMVLHLLAP LAAKFNERYP HIRLSLVSSE GYINLIERKV DIALRAGELD
151 DSGLRARHLF DSRFRVIASP EYLAKHGTPQ STEELAGHQC LGFTEPGSLN
201 TWAVLDAQGN PYKISPHFTA SSGEILRSLC LSGCGIACLS DFLVDNDIAE
251 GKLIFLLAEQ TSNKTHPFNA VYYSDKAVNL RLRVFLDFLV EELGNNLCG*
```

m158/a158 99.0% identity in 299 aa overlap

```
                   10        20        30        40        50        60
m158.pep   MKTNSEELTVFVQVVESGSFSRAAEQLAMANSAVSRIVKRLEEKLGVNLLNRTTRQLSLT
           ||||||||||||||||||||||||||||||||||||||||||||||||||||||||||||
a158       MKTNSEELTVFVQVVESGSFSRAAEQLAMANSAVSRIVKRLEEKLGVNLLNRTTRQLSLT
                   10        20        30        40        50        60

                   70        80        90       100       110       120
m158.pep   EEGAQYFRRAQRILQEMAAAETEMLAVHEIPQGVLSVDSAMPMVLHLLAPLAAKFNERYP
           ||||||||||||||||||||||||||||||||||| ||||||||||||||||||||||||
a158       EEGAQYFRRAQRILQEMAAAETEMLAVHEIPQGVLRVDSAMPMVLHLLAPLAAKFNERYP
                   70        80        90       100       110       120

                  130       140       150       160       170       180
m158.pep   HIRLSLVSSEGYINLIERKVDIALRAGELDDSGLRARHLFDSRFRVIASPEYLAKHGTPQ
           ||||||||||||||||||||||||||||||||||||||||||||||||||||||||||||
a158       HIRLSLVSSEGYINLIERKVDIALRAGELDDSGLRARHLFDSRFRVIASPEYLAKHGTPQ
                  130       140       150       160       170       180
```

-continued

```
                190       200       210       220       230       240
m158.pep  STEELAGHQCLGFTEPGSLNTWAVLDAQGNPYKISPHFTASSGEILRSLCLSGCGIVCLS
          ||||||||||||||||||||||||||||||||||||||||||||||||||||||||:|||
a158      STEELAGHQCLGFTEPGSLNTWAVLDAQGNPYKISPHFTASSGEILRSLCLSGCGIACLS
                190       200       210       220       230       240

                250       260       270       280       290       300
m158.pep  DFLVDNDIAEGKLIPLLAEQTSDKTHPFNAVYYSDKAVNLRLRVFLDFLVEELGNNLCGX
          ||||||||||||||||||||||:|||||||||||||||||||||||||||||||||||||
a158      DFLVDNDIAEGKLIPLLAEQTSNKTHPENAVYYSDKAVNLRLRVFLDFLVEELGNNLCGX
                250       260       270       280       290       300
```

The following partial DNA sequence was identified in *N. gonorrhoeae* <SEQ ID 661>:

g160.seq

```
  1 ATGGAcattc tgGACAAact ggtcgatCTC GCccaATTGA CGGGCAGTGC
 51 GGATGTGCAG TgcctTTTGG GCGGACAATG gcATGaaacc TTGCAACGCG
101 AAGGGCTGGT ACACATTGTT ACGGCGGGCA GCGGTTATCT CTGCATCGAC
151 GGCGAAACTT CCCCGCGTCC GGTCGGCACG GGCGATATTG TATTTTTCCC
201 GCGCGGCTTG GGTCATGTGT TGAGCCACGA CGGAAAATAC GGAGAAAGTT
251 TACAACCGGA CATACGACAA AACGGCACAT TTATGGTCAA ACAGTGCGGC
301 AACGGGCTGG ATATGAGCCT GTTTTGCGCC CGTTTCCGCT ACGACACCGA
351 CGCCGATTTG ATGAACGGGC TGCCGGAAAC CGTTTTTCTG AACATTGCCC
401 ATCCAAGTTT GCAGTATGTG GTTTCAATGC TGCAACTGGA AAGCGAAAAA
451 CCTTTGACGG GGACGGTTTC CGTGGTCAAC GCATTACCGT CCGTCCTGCT
501 GGTGCTTATC CTGCGCGCCT ATCTCGAACA GGATAAGGAT GTCGAACTCT
551 CGGGCGTATT GAAAGGTTGG CAGGACAAAC GTTTGGGACA TTTGATCCAA
601 AAGGTGATAG ACAAACCGGA AGACGAATGG AATATTGACA AAATGGTTGC
651 CGCCGCCAAT ATGTCGCGCG CGCAACTGAT GCGCCGCTTC AAAAGCCAAG
701 TCGGACTCAG CCCGCACGCC TTTGTGAACC ATATCCGCCT GCAAAAAGGC
751 GCATTGCTGC TGAAGAAAAC CCCGGATTCG GTTTTGGAGG TCGCGCTGTC
801 GGTGGGCTTT CAGTCGGAAA CGCATTTCGG CAAGGCGTTC AAACGGCAAT
851 ATCACGTTTC GCCGGGGCAA TACCGGAAAG AAGGCGGGCA AAAATAA
```

This corresponds to the amino acid sequence <SEQ ID 662; ORF 160.ng >:

g160.pep

```
  1 MDILDKLVDL AQLTGSADVQ CLLGGQWHET LQREGLVHIV TAGSGYLCID
 51 GETSPRPVGT GDIVFFPRGL GHVLSHDGKY GESLQPDIRQ NGTFMVKQCG
101 NGLDMSLFCA RFRYDTHADL MNGLPETVFL NIAHPSLQYV VSMLQLESEK
151 PLTGTVSVVN ALPSVLLVLI LRAYLEQDKD VELSGVLKGW QDKRLGHLIQ
201 KVIDKPEDEW NIDKMVAAAN MSRAQLMRRF KSQVGLSPHA FVNHIRLQKG
251 ALLLKKTPDS VLEVALSVGF QSETHFGKAF KRQYHVSPGQ YRKEGGQK*
```

The following partial DNA sequence was identified in *N. meningitidis* <SEQ ID 663>:

m160.seq

```
  1 ATGGACATTC TGGACAAACT GGTCGATTTC GCCCAATTGA CGGGCAGTGT
 51 GGATGTGCAG TGCCTTTTGG GCGGACAATG GTCGGTACGG CATGAAACCT
101 TGCAACGCGA AGGATTGGTA CACATTGTTA CATCGGGCAG CGGCTATCTC
151 TGCATCGACG GCGAAACTTC CCCGCGTCCG GTCAGTACAG GGGATATTGT
201 ATTTTTCCCG CGCGGCTTGG GTCATGTGTT GAGCCACGAC GGAAAATGCG
251 GAGAAAGTTT ACAACCGGAT ATGCGGCAGC ACGGTGCGTT TACGGTCAAG
301 CAGTGCGGCA ACGGACAGGA TATGAGCCTG TTTTGCGCCC GTTTCCGCTA
351 CGACACCCAC GCCGATTTGA TGAACGGGCT GCCTGAAACC GTTTTTCTGA
401 ACATTGCCCA TCCGAGTTTA CAGTATGTGG TTTCAATGCT GCAACTGGAA
451 AGCAAAAAAC CTTTGACGGG GACGGTTTCC ATGGTCAACG CATTGTCGTC
501 CGTCCTGCTG GTGCTTATCC TGCGCGCCTA TCTCGAACAG GATAAGGATG
551 TCGAACTCTC GGGCGTATTG AAAGGTTGGC AGGACAAACG TTTGGGACAT
601 TTAATCCAAA AGGTGATAGA CAAACCGGAA GACGAATGGA ATGTCGACAA
651 AATGGTGGCG GCTGCCAATA TGTCGCGCGC GCAACTGATG CGCCGTTTCA
701 AAAGCCGGGT CGGACTCAGC CCGCACGCCT TTGTGAACCA TATCCGCCTG
751 CAAAAAGGCG CGTTGCTGCT GAAAAAAAAC CCGGATTCGG TTTTGTCGGT
801 CGCACTGTCG GTAGGCTTTC AGTCGGAAAC GCACTTCGGC AAGGCGTTCA
851 AACGGCAATA TCACGTTTCG CCGGGTCAAT ACCGGAAAGA AggCGGGCAA
901 AAATAA
```

This corresponds to the amino acid sequence <SEQ ID 664; ORF 160>:

m160.pep

```
  1 MDILDKLVDF AQLTGSVDVQ CLLGGQWSVR HETLQREGLV HIVTSGSGYL
 51 CIDGETSPRP VSTGDIVFFP RGLGHVLSHD GKCGESLQPD MRQHGAFTVK
101 QCGNGQDMSL FCARFRYDTH ADLMNGLPET VFLNIAHPSL QYVVSMLQLE
151 SKKPLTGTVS MVNALSSVLL VLILRAYLEQ DKDVELSGVL KGWQDKRLGH
201 LIQKVIDKPE DEWNVDKMVA AANMSRAQLM RRFKSRVGLS PHAFVNHIRL
251 QKGALLLKKN PDSVLSVALS VGFQSETHFG KAFKRQYHVS PGQYRKEGGQ
301 K*
```

Computer analysis of this amino acid sequence gave the following results:

Homology with a predicted ORF from *N. gonorrhoeae* m160/g160 93.4% identity in 301 aa overlap

```
                   10        20        30        40        50        60
m160.pep   MDILDKLVDFAQLTGSVDVQCLLGGQWSVRHETLQREGLVHIVTSGSGYLCIDGETSPRP
           |||||||||:||||||:||||||||||   |||||||||||||||:||||||||||||||
g160       MDILDKLVDLAQLTGSADVQCLLGGQW---HETLQREGLVHIVTAGSGYLCIDGETSPRP
                   10        20           30        40        50

                   70        80        90       100       110       120
m160.pep   VSTGDIVFFPRGLGHVLSHDGKCGESLQPDMRQHGAFTVKQCGNGQDMSLFCARFRYDTH
           |:|||||||||||||||||||| |||||||:||:|:| ||||||| ||||||||||||||
g160       VGTGDIVFFPRGLGHVLSHDGKYGESLQPDIRQNGTFMVKQCGNGLDMSLFCARFRYDTH
            60        70        80        90       100       110
```

-continued

```
                 130        140        150        160        170        180
m160.pep  ADLMNGLPETVFLNIAHPSLQYVVSMLQLESKKPLTGTVSMVNALSSVLLVLILRAYLEQ
          ||||||||||||||||||||||||||||||:|||||||:|||| ||||||||||||||
g160      ADLMNGLPETVFLNIAHPSLQYVVSMLQLESEKPLTGTVSVVNALPSVLLVLILRAYLEQ
          120        130        140        150        160        170

                 190        200        210        220        230        240
m160.pep  DKDVELSGVLKGWQDKRLGHLIQKVIDKPEDEWNVDKMVAAANMSRAQLMRRFKSRVGLS
          |||||||||||||||||||||||||||||||||:|||||||||||||||||||:||||
g160      DKDVELSGVLKGWQDKRLGHLIQKVIDKPEDEWNIDKMVAAANMSRAQLMRRFKSQVGLS
          180        190        200        210        220        230

                 250        260        270        280        290        300
m160.pep  PHAFVNHIRLQKGALLLKKNPDSVLSVALSVGFQSETHFGKAFKRQYHVSPGQYRKEGGQ
          |||||||||||||||||:||||| |||||||||||||||||||||||||||||||||
g160      PHAFVNHIRLQKGALLLKKTPDSVLEVALSVGFQSETHFGKAFKRQYHVSPGQYRKEGGQ
          240        250        260        270        280        290

m160.pep  KX
          ||
g160      KX
```

The following partial DNA sequence was identified in *N. meningitidis* <SEQ ID 665>:

a160.seq

```
  1 ATGGACATTC TGGACAAACT GGTCGATTTC GCCCAATTGA CGGGCAGTGT
 51 GGATGTGCAG TGCCTTTTGG GCGGACAATG GTCGGTACGG CATGAAACCT
101 TGCAACGCGA AGGATTGGTA CACATTGTTA CATCGGGCAG GGGCTATCTC
151 TGCATCGACG GCGAAACTTC CCCGCGTCCG GTCAGTACAG GGGATATTGT
201 ATTTTTCCCG CGCGGCTTGG GTCATGTGTT GAGCCACGAC GGAAAATGCG
251 GAGAAAGTTT ACAACCGGAT ATGCGGCAGC ACGGTGCGTT TACGGTCAAG
301 CAGTGCGGCA ACGGACAGGA TATGAGCCTG TTTTGCGCCC GTTTCCGCTA
351 CGACACCCAC GCCGATTTGA TGAACGGGCT GCCTGAAACC GTTTTTCTGA
401 ACATTGCCCA TCCGAGTTTA CAGTATGTGG TTTCAATGCT GCAACTGGAA
451 AGCAAAAAAC CTTTGACGGG GACGGTTTCC ATGGTCAACG CATTGTCGTC
501 CGTCCTGCTG GTGCTTATCC TGCGCGCCTA TCTCGAACAG GATAAGGATG
551 TCGAACTCTC GGGCGTATTG AAAGGTTGGC AGGACAAACG TTTGGGACAT
601 TTAATCCAAA AGGTGATAGA CAAACCGGAA GACGAATGGA ATGTCGACAA
651 AATGGTGGCG GCTGCCAATA TGTCGCGCGC GCAACTGATG CGCCGTTTCA
701 AAAGCCGGGT CGGACTCAGC CCGCACGCCT TTGTGAACCA TATCCGCCTG
751 CAAAAAGGCG CGTTGCTGCT GAAAAAAAAC CCGGATTCGG TTTTGTCGGT
801 CGCACTGTCG GTAGGCTTTC AGTCGGAAAC GCACTTCGGC AAGGCGTTCA
851 AACGGCAATA TCACGTTTCG CCGGGTCAAT ACCGGAAAGA AGGCGGGCAA
901 AAATAA
```

This corresponds to the amino acid sequence <SEQ ID 666; ORF 160.a>:

a160.pep

```
  1 MDILDKLVDF AQLTGSVDVQ CLLGGQWSVR HETLQREGLV HIVTSGSGYL
 51 CIDGETSPRP VSTGDIVFFP RGLGHVLSHD GKCGESLQPD MRQHGAFTVK
```

-continued

```
101 QCGNGQDMSL FCARFRYDTH ADLMNGLPET VFLNIAHPSL QYVVSMLQLE

151 SKKPLTGTVS MVNALSSVLL VLILRAYLEQ DKDVELSGVL KGWQDKRLGH

201 LIQKVIDKPE DEWNVDKMVA AANMSRAQLM RRFKSRVGLS PHAFVNHIRL

251 QKGALLLKKN PDSVLSVALS VGFQSETHFG KAFKRQYHVS PGQYRKEGGQ

301 K*
```

m160/a160 100.0% identity in 301 aa overlap

```
                    10        20        30        40        50        60
m160.pep    MDILDKLVDFAQLTGSVDVQCLLGGQWSVRHETLQREGLVHIVTSGSGYLCIDGETSPRP
            ||||||||||||||||||||||||||||||||||||||||||||||||||||||||||||
a160        MDILDKLVDFAQLTGSVDVQCLLGGQWSVRHETLQREGLVHIVTSGSGYLCIDGETSPRP
                    10        20        30        40        50        60

                    70        80        90       100       110       120
m160.pep    VSTGDIVFFPRGLGHVLSHDGKCGESLQPDMRQHGAFTVKQCGNGQDMSLFCARFRYDTH
            ||||||||||||||||||||||||||||||||||||||||||||||||||||||||||||
a160        VSTGDIVFFPRGLGHVLSHDGKCGESLQPDMRQHGAFTVKQCGNGQDMSLFCARFRYDTH
                    70        80        90       100       110       120

                   130       140       150       160       170       180
m160.pep    ADLMNGLPETVFLNIAHPSLQYVVSMLQLESKKPLTGTVSMVNALSSVLLVLILRAYLEQ
            ||||||||||||||||||||||||||||||||||||||||||||||||||||||||||||
a160        ADLMNGLPETVFLNIAHPSLQYVVSMLQLESKKPLTGTVSMVNALSSVLLVLILRAYLEQ
                   130       140       150       160       170       180

                   190       200       210       220       230       240
m160.pep    DKDVELSGVLKGWQDKRLGHLIQKVIDKPEDEWNVDKMVAAANMSRAQLMRRFKSRVGLS
            ||||||||||||||||||||||||||||||||||||||||||||||||||||||||||||
a160        DKDVELSGVLKGWQDKRLGHLIQKVIDKPEDEWNVDKMVAAANMSRAQLMRRFKSRVGLS
                   190       200       210       220       230       240

                   250       260       270       280       290       300
m160.pep    PHAFVNHIRLQKGALLLKKNPDSVLSVALSVGFQSETHFGKAFKRQYHVSPGQYRKEGGQ
            ||||||||||||||||||||||||||||||||||||||||||||||||||||||||||||
a160        PHAFVNHIRLQKGALLLKKNPDSVLSVALSVGFQSETHFGKAFKRQYHVSPGQYRKEGGQ
                   250       260       270       280       290       300

m160.pep    KX
            ||
a160        KX
```

The following partial DNA sequence was identified in *N. gonorrhoeae* <SEQ ID 667>:

g161.seq

```
  1 ATGGATACCG CAAAAAAAGA CATTTTAGGA TCGGGCTGGA TGCTGGTGGC

 51 GGCGGCCTGC TTCACCGTTA TGAACGTATT GATTAAAGAG GCATCGGCAA

101 AATTTGCCCT CGGCAGCGGC GAATTGGTCT TTTGGCGCAT GCTGTTTTCA

151 ACCGTTACGC TCGGTGCTGC CGCCGTATTG CGGCGCGACA CCTTCCGCAC

201 GCCCCATTGG AAAAACCACT TAAACCGCAG TATGGTCGGG ACGGGGGCGA

251 TGCTGCTGCT GTTTTACGCG GTAACGCATC TGCCTTTGAC AACCGGCGTT

301 ACCCTGAGTT ACACCTCGTC GATTTTTttg GCGGTATTTT CCTTCCTGAT

351 TTTGAAAGAA CGGATTTCCG TTTACACGCA GGCGGTGCTG CTCCTTGGTT

401 TTGCCGGCGT GGTATTGCTG CTTAATCCCT CGTTCCGCAG CGGTCAGGAA

451 CCGGCGGCAC TCGCCGGGCT GGCGGGCGGC GCGATGTCCG GCTGGGCGTA

501 TTTGAAAGTG CGCGAACTGT CTTTGGCGGG CGAACCCGGC TGGCGCGTCG

551 TGTTTTACCT TTCCGCAACC GGCGTGGCGA TGTCGTCggt ttgggcgacg

601 Ctgaccggct ggCACAcccT GTCCTTTcca tcggcagttt ATCtgtCGGG
```

-continued

```
651 CATCGGCGTG tccgcgCtgA TTGCCCAaCT GtcgatgAcg cGCGcctaca
701 aaGTCGGCGA CAAATTCACG GTTGCCTCGC tttcctaTAt gaccgtcGTC
751 TTTTCCGCCC TGTCTGCCGC ATTTTTTCTg ggcgaagagc ttttctggCA
801 GGAAATACTC GGTATGTGCA TCATTATcct CAGCGGCATT TTGAGCAGCA
851 TCCGCCCCAT TGCCTTCAAA CAGCGGCTGC AAGCCCTCTT CCGCCAAAGA
901 TAA
```

This corresponds to the amino acid sequence <SEQ ID 668; ORF 161.ng>:

g161.pep

```
  1 MDTAKKDILG SGWMLVAAAC FTVMNVLIKE ASAKFALGSG ELVFWRMLFS
 51 TVTLGAAAVL RRDTFRTPHW KNHLNRSMVG TGAMLLLFYA VTHLPLTTGV
101 TLSYTSSIFL AVFSFLILKE RISVYTQAVL LLGFAGVVLL LNPSFRSGQE
151 PAALAGLAGG AMSGWAYLKV RELSLAGEPG WRVVFYLSAT GVAMSSVWAT
201 LTGWHTLSFP SAVYLSGIGV SALIAQLSMT RAYKVGDKFT VASLSYMTVV
251 FSALSAAFFL GEELFWQEIL GMCIIILSGI LSSIRPIAFK QRLQALFRQR
301 *
```

The following partial DNA sequence was identified in *N. meningitidis* <SEQ ID 669>:

m161.seq

```
  1 ATGGATACCG CAAAAAAAGA CATTTTAGGA TCGGGCTGGA TGCTGGTGGC
 51 GGCGGCCTGC TTTACCATTA TGAACGTATT GATTAAAGAG GCATCGGCAA
101 AATTTGCCCT CGGCAGCGGC GAATTGGTCT TTTGGCGCAT GCTGTTTTCA
151 ACCGTTGCGC TCGGGGCTGC CGCCGTATTG CGTCGGGACA mCTTCCGCAC
201 GCCCCATTGG AAAAACCACT TAAACCGCAG TATGGTCGGG ACGGGGGCGA
251 TGCTGCTGCT GTTTTACGCG GTAACGCATC TGCCTTTGGC CACTGGCGTT
301 ACCCTGAGTT ACACCTCGTC GATTTTTTTG GCGGTATTTT CCTTCCTGAT
351 TTTGAAAGAA CGGATTTCCG TTTACACGCA GGCGGTGCTG CTCCTTGGTT
401 TTGCCGGCGT GGTATTGCTG CTTAATCCCT CGTTCCGCAG CGGTCAGGAA
451 ACGGCGGCAC TCGCCGGGCT GGCGGGCGGC GCGATGTCCG GCTGGGCGTA
501 TTTGAAAGTG CGCGAACTGT CTTTGGCGGG CGAACCCGGC TGGCGCGTCG
551 TGTTTTACCT TTCCGTGACA GGTGTGGCGA TGTCGTCGGT TTGGGCGACG
601 CTGACCGGCT GGCACACCCT GTCCTTTCCA TCGGCAGTTT ATCTGTCGTG
651 CATCGGCGTG TCCGCGCTGA TTGCCCAACT GTCGATGACG CGCGCCTACA
701 AAGTCGGCGA CAAATTCACG GTTGCCTCGC TTTCCTATAT GACCGTCGTT
751 TTTTCCGCTC TGTCTGCCGC ATTTTTTCTG GGCGAAGAGC TTTTCTGGCA
801 GGAAATACTC GGTATGTGCA TCATCATCCT CAGCGGTATT TTGAGCAGCA
851 TCCGCCCCAC TGCCTTCAAA CAGCGGCTGC AATCCCTGTT CCGCCAAAGA
901 TAA
```

This corresponds to the amino acid sequence <SEQ ID 670; ORF 161>:

m161.pep

```
  1 MDTAKKDILG SGWMLVAAAC FTIMNVLIKE ASAKFALGSG ELVFWRMLFS

 51 TVALGAAAVL RRDXFRTPHW KNHLNRSMVG TGAMLLLFYA VTHLPLATGV

101 TLSYTSSIFL AVFSFLILKE RISVYTQAVL LLGFAGVVLL LNPSFRSGQE

151 TAALAGLAGG AMSGWAYLKV RELSLAGEPG WRVVFYLSVT GVAMSSVWAT

201 LTGWHTLSFP SAVYLSCIGV SALIAQLSMT RAYKVGDKFT VASLSYMTVV

251 FSALSAAFFL GEELFWQEIL GMCIIILSGI LSSIRPTAFK QRLQSLFRQR

301 *
```

Computer analysis of this amino acid sequence gave the following results:

Homology with a predicted ORF from *N. gonorrhoeae*
m161/g161 97.0% identity in 300 aa overlap

```
                  10        20        30        40        50        60
m161.pep   MDTAKKDILGSGWMLVAAACFTIMNVLIKEASAKFALGSGELVFWRMLFSTVALGAAAVL
           |||||||||||||||||||||:|||||||||||||||||||||||||||||:||||||||
g161       MDTAKKDILGSGWMLVAAACFTVMNVLIKEASAKFALGSGELVFWRMLFSTVTLGAAAVL
                  10        20        30        40        50        60

                  70        80        90       100       110       120
m161.pep   RRDXFRTPHWKNHLNRSMVGTGAMLLLFYAVTHLPLATGVTLSYTSSIFLAVFSFLILKE
           |||:||||||||||||||||||||||||||||||||:|||||||||||||||||||||||
g161       RRDTFRTPHWKNHLNRSMVGTGAMLLLFYAVTHLPLTTGVTLSYTSSIFLAVFSFLILKE
                  70        80        90       100       110       120

                 130       140       150       160       170       180
m161.pep   RISVYTQAVLLLGFAGVVLLLNPSFRSGQETAALAGLAGGAMSGWAYLKVRELSLAGEPG
           |||||||||||||||||||||||||||||| |||||||||||||||||||||||||||||
g161       RISVYTQAVLLLGFAGVVLLLNPSFRSGQEPAALAGLAGGAMSGWAYLKVRELSLAGEPG
                 130       140       150       160       170       180

                 190       200       210       220       230       240
m161.pep   WRVVFYLSVTGVAMSSVWATLTGWHTLSFPSAVYLSCIGVSALIAQLSMTRAYKVGDKFT
           |||||||:|||||||||||||||||||||||||||| |||||||||||||||||||||||
g161       WRVVFYLSATGVAMSSVWATLTGWHTLSFPSAVYLSGIGVSALIAQLSMTRAYKVDGKFT
                 190       200       210       220       230       240

                 250       260       270       280       290       300
m161.pep   VASLSYMTVVFSALSAAFFLGEELFWQEILGMCIIILSGILSSIRPTAFKQRLQSLFRQR
           |||||||||||||||||||||||||||||||||||||||||||||| |||||||:|||||
g161       VASLSYMTVVFSALSAAFFLGEELFWQEILGMCIIILSGILSSIRPIAFKQRLQALFRQR
                 250       260       270       280       290       300

m161.pep   X
           |
g161       X
```

The following partial DNA sequence was identified in *N. meningitidis* <SEQ ID 671>:

a161.seq

```
  1 ATGGATACCG CAAAAAAAGA CATTTTAGCA TCGGGCTGGA TGCTGGTGGC

 51 GGCGGCCTGC TTTACCATTA TGAACGTATT GATTAAAGAG GCATCGGCAA

101 AATTTGCCCT CGGCAGCGGC GAATTGGTCT TTTGGCGCAT GCTGTTTTCA

151 ACCGTTGCGC TCGGGGCTGC CGCCGTATTG CGTCGGGACA CCTTCCGCAC

201 GCCCCATTGG AAAAACCACT TAAACCGCAG TATGGTCGGG ACGGGGGCGA

251 TGCTGCTGCT GTTTTACGCG GTAACGCATC TGCCTTTGGC CACCGGCGTT
```

-continued

```
301 ACCCTGAGTT ACACCTCGTC GATTTTTTTG GCGGTATTTT CCTTCCTGAT

351 TTTGAAAGAA CGGATTTCCG TTTACACGCA GGCGGTGCTG CTCCTTGGTT

401 TTGCCGGCGT GGTATTGCTG CTTAATCCCT CGTTCCGCAG CGGTCAGGAA

451 ACGGCGGCAC TCGCCGGGCT GGCGGGCGGC GCGATGTCCG GCTGGGCGTA

501 TTTGAAAGTG CGCGAACTGT CTTTGGCGGG CGAACCCGGC TGGCGCGTCG

551 TGTTTTACCT TTCCGTGACA GGTGTGGCGA TGTCATCGGT TTGGGCGACG

601 CTGACCGGCT GGCACACCCT GTCCTTTCCA TCGGCAGTTT ATCTGTCGTG

651 CATCGGCGTG TCCGCGCTGA TTGCCCAACT GTCGATGACG CGCGCCTACA

701 AAGTCGGCGA CAAATTCACG GTTGCCTCGC TTTCCTATAT GACCGTCGTT

751 TTTTCCGCTC TGTCTGCCGC ATTTTTTCTG GCCGAAGAGC TTTTCTGGCA

801 GGAAATACTC GGTATGTGCA TCATCATCCT CAGCGGTATT TTGAGCAGCA

851 TCCGCCCCAC TGCCTTCAAA CAGCGGCTGC AATCCCTGTT CCGCCAAAGA

901 TAA
```

This corresponds to the amino acid sequence <SEQ ID 672; ORF 161.a>:

a161.pep

```
  1 MDTAKKDILG SGWMLVAAAC FTIMNVLIKE ASAKFALGSG ELVFWRMLFS

 51 TVALGAAAVL RRDTFRTPHW KNHLNRSMVG TGAMLLLFYA VTHLPLATGV

101 TLSYTSSIFL AVFSFLILKE RISVYTQAVL LLGFAGVVLL LNPSFRSGQE

151 TAALAGLAGG AMSGWAYLKV RELSLAGEPG WRVVFYLSVT GVAMSSVWAT

201 LTGWHTLSFP SAVYLSCIGV SALIAQLSMT RAYKVGDKFT VASLSYMTVV

251 FSALSAAFFL AEELFWQEIL GMCIIILSGI LSSIRPTAFK QRLQSLFRQR

301 *
```

m161/a161 99.3% identity in 300 aa overlap

```
                  10        20        30        40        50        60
m161.pep   MDTAKKDILGSGWMLVAAACFTIMNVLIKEASAKFALGSGELVFWRMLFSTVALGAAAVL
           ||||||||||||||||||||||||||||||||||||||||||||||||||||||||||||
a161       MDTAKKDILGSGWMLVAAACFTIMNVLIKEASAKFALGSGELVFWRMLFSTVALGAAAVL
                  10        20        30        40        50        60

                  70        80        90       100       110       120
m161.pep   RRDXFRTPHWKNHLNRSMVGTGAMLLLFYAVTHLPLATGVTLSYTSSIFLAVFSFLILKE
           |||:||||||||||||||||||||||||||||||||||||||||||||||||||||||||
a161       RRDTFRTPHWKNHLNRSMVGTGAMLLLFYAVTHLPLATGVTLSYTSSIFLAVFSFLILKE
                  70        80        90       100       110       120

                 130       140       150       160       170       180
m161.pep   RISVYTQAVLLLGFAGVVLLLNPSFRSGQETAALAGLAGGAMSGWAYLKVRELSLAGEPG
           ||||||||||||||||||||||||||||||||||||||||||||||||||||||||||||
a161       RISVYTQAVLLLGFAGVVLLLNPSFRSGQETAALAGLAGGAMSGWAYLKVRELSLAGEPG
                 130       140       150       160       170       180

                 190       200       210       220       230       240
m161.pep   WRVVFYLSVTGVAMSSVWATLTGWHTLSFPSAVYLSCIGVSALIAQLSMTRAYKVGDKFT
           ||||||||||||||||||||||||||||||||||||||||||||||||||||||||||||
a161       WRVVFYLSVTGVAMSSVWATLTGWHTLSFPSAVYLSCIGVSALIAQLSMTRAYKVDGKFT
                 190       200       210       220       230       240

                 250       260       270       280       290       300
m161.pep   VASLSYMTVVFSALSAAFFLGEELFWQEILGMCIIILSGILSSIRPTAFKQRLQSLFRQR
           ||||||||||||||||||||:|||||||||||||||||||||||||||||||||||||||
a161       VASLSYMTVVFSALSAAFFLAEELFWQEILGMCIIILSGILSSIRPTAFKQRLQSLFRQR
                 250       260       270       280       290       300
```

-continued

```
m161.pep  X
          |
a161      X
```

The following partial DNA sequence was identified in *N. gonorrhoeae* <SEQ ID 673>:

```
g163.seq
   1 ATGGTTATTT TGACGACTTT GTTTTTTGTG TGTGTTTTGG TGGTATTGGT
  51 TTTAACCGTG CCGGATCAGG TGCAGATGTG gctCGACCGG GCAAAAGAAG
 101 TCATTTTTAC CGAGTTCAGC TGGTTTTATG TTTTAACGTT TTCCATTTTt
 151 ctgGGTTTtc tgctGATACT CTCGGTCAGC GGTTTGGGAA ACATcagGCT
 201 AGGACGGGAT GAAGATGTGC CGGAATTCGG CTTCCTGTCG TGGCTGGCGA
 251 TGCTGTTTGC GGCCGGGATG GGCGTGGGCC TGATGTTTTT CGGCGTGGCA
 301 GAGCCGTTGA TGCATTATTT TTCGGACATT ACGGTCGGCG CGCCGGAACA
 351 CAGGCAGCAG CAGGCATTGC TGCACACGGT GTTCCATTGG GGCGTTCACG
 401 CCTGGTCGGT GTACGGTACG ATTGCATTGG CTTTGGCTTA TTTCGGTTTC
 451 CGCTACAAAC TGCCGCTTGC CCTGCGTTCT TGTTTTTACC CCCTGTTGAA
 501 AGAAAAAATT TCCGGAAGGT TCGGCGATGC CATTGATATT ATGGCGTTGC
 551 TTGCTACTTT TTTCGGCATC ATCACCACAT TGGGGTTCGG GGCTTCGCAA
 601 CTGGGCGCCG GATTGCAGGA AATGGGCTGG ATTGCCGAAA ACAGCTTCGG
 651 CGTGCAGGTC TTGATTATCG CCGCCGTAAT GTCCCTCGCC GTCGTTTCGG
 701 CAATATCCGG CGTGGGGAAG GGCGTGAAGG TGTTGAGCGA GTTGAACCTG
 751 GGCCTTGCGT TTTTGCTGCT GTTTTTTGTT TTGGCGGCGG ACCCCACTGT
 801 TTACCTGTTG TCGGCATTCG GCGACAACAT AGGGAACTAC CTCGGAAATC
 851 TGGTGCGCCT CAGTTTGAAA ACTTATGCGT ACGAACGGGA ACACAAGCCG
 901 TGGTTTGAAT CTTGGACGGT GCTTTATTGG GCGTGGTGGT GTTCTTGGgc
 951 gcCGTTTGTG GGTTTGTTTA TCGCGCGCAT TTCAAAGGGg cgcaccatCc
1001 gcgagtttgt CTTCGGGGTT TTGCTCATCC CCGGCCTGTT CGGCGTTTTG
1051 TGGTTTACCG TCTTCGGCAA TACGGCGATT TGGCTGAATG ACGGGGTTGC
1101 GGGGGGAATG CTCGAAAAGA TGACCTCCTC TCCGGAAACG CTGCTTTTTA
1151 AATTCTTTAA TTACCTCCCC CTGCCCGAAC TGACGAGCAT CGTCAGCCTG
1201 CTGGTCATTT CCCTGTTTTT TGTAACTTCT GCCGACTCCG GGATTTATGT
1251 CCTGAACAAT ATTACCTCTC GGGACAAAGG CTTGAGCGCG CCACGGTGGC
1301 AGGCGGTTAT GTGGGGCGTG CTGatgtcTG CCGTTGCCGT TTTGCTGATG
1351 CGCTCGGGCG GACTCGGCAA CCTGCAGTCT ATGACCCTGA TTGTTTCCCT
1401 GCCGTTTGCC CTGCTGATGC TGATAATGTG TTTCAGCCTG TGGAAAGGCT
1451 TGAGTGCGGA TAAGAAATAT TTTGAGACCC GGGTCAACCC TACCAGTGTA
1501 TTTTGGACGG GCGGCAAGTG GAAAGAACGG CTGGTGCGGA TAATGAGCCA
1551 GACGCAGGAG CAGGATATTT TAAAATTCCT CAAACATACC GCATCGCCCG
1601 CTATGCACGA GTTGCAACGG GAGCTTTCGG AAGAATACGG CTTGAGCGTC
```

-continued

```
1651 CGGGTCGATA AGATGTTTCA TCAGGACGAG CCCGCAATCG AGTTCGTCAT
1701 TCGGAAAGAG ACGATGCGCG ATTTTATGTA CGGGATTAAG TCTGTCGGGC
1751 AGGATGTATC CGACCAGTTG ATTAACGACG GCAAGCTGCC GCATATCCGG
1801 CACCAGACAA CTTACAAACC CTACGCTTAT TTTTTCGACG GGCGCGTCGG
1851 GTACGATGTG CAGTATATGA ACAAGGACGA GCTGATTGCC GACATTTTGA
1901 AAAACTACGA ACGTTATTTG ATGTTGTTGG ATGATGTCGG TCAGGAACTG
1951 ATGGCGCACG AGCAGGTGGA ATTGGCAGAG TAA
```

This corresponds to the amino acid sequence <SEQ ID 674; ORF 163.ng>:

g163.pep

```
  1 MVILTTLFFV CVLVVLVLTV PDQVQMWLDR AKEVIFTEFS WFYVLTFSIF
 51 LGFLLILSVS GLGNIRLGRD EDVPEFGFLS WLAMLFAAGM GVGLMFFGVA
101 EPLMHYFSDI TVGAPEHRQQ QALLHTVFHW GVHAWSVYGT IALALAYFGF
151 RYKLPLALRS CFYPLLKEKI SGRFGDAIDI MALLATFFGI ITTLGFGASQ
201 LGAGLQEMGW IAENSFGVQV LIIAAVMSLA VVSAISGVGK GVKVLSELNL
251 GLAFLLLFFV LAADPTVYLL SAFGDNIGNY LGNLVRLSLK TYAYEREHKP
301 WFESWTVLYW AWWCSWAPFV GLFIARISKG RTIREFVFGV LLIPGLFGVL
351 WFTVFGNTAI WLNDGVAGGM LEKMTSSPET LLFKFFNYLP LPELTSIVSL
401 LVISLFFVTS ADSGIYVLNN ITSRDKGLSA PRWQAVMWGV LMSAVAVLLM
451 RSGGLGNLQS MTLIVSLPFA LLMLIMCFSL WKGLSADKKY FETRVNPTSV
501 FWTGGKWKER LVRIMSQTQE QDILKFLKHT ASPAMHELQR ELSEEYGLSV
551 RVDKMFHQDE PAIEFVIRKE TMRDFMYGIK SVGQDVSDQL INDGKLPHIR
601 HQTTYKPYAY FFDGRVGYDV QYMNKDELIA DILKNYERYL MLLDDVGQEL
651 MAHEQVELAE *
```

The following partial DNA sequence was identified in *N. meningitidis* <SEQ ID 675>:

m163.seq

```
  1 ATGGTTATTT TGACGACTTT GTTTTTTGTG TGTGTTTTGG TGGTATTGGT
 51 TTTAACCGTG CCGGATCAGG TGCAGATGTG GCTCGATCGG GCAAAAGAAG
101 TCATTTTTAC CGAGTTCAGC TGGTTTTATG TTTTAACGTT TTCCATTTTT
151 CTGGGTTTCC TGCTGATACT CTCGGTCAGC AGTTTGGGAA ACATCAGGCT
201 CGGACGGGAT GAAGATGTGC CGGAATTCGG CTTCCTGTCG TGGCTGGCGA
251 TGCTGTTTGC GGCCGGGATG GGCGTGGGTC TGATGTTTTT CGGCGTGGCA
301 GAGCCGTTGA TGCATTATTT TTCGGACATT ACGGCCGGCA CGCCGGAACA
351 CAGGCAGCAG CAGGCATTGC TGCACACGGT GTTCCATTGG GGCGTTCACG
401 CTTGGTCGGT GTACGGTACG ATTGCATTGG CTTTGGCTTA TTTCGGTTTC
451 CGCTACAAGC TGCCGCTTGC CCTGCGTTCT TGTTTTTACC CCCTGTTGAA
```

-continued

```
 501 AGAAAAAATT TCCGGAAGGT TCGGCGATGC CATTGATATT ATGGCGTTGC
 551 TTGCTACTTT TTTCGGCATC ATCACCACAT TGGGGTTCGG GGCTTCGCAA
 601 CTGGGCGCCG GATTGCAGGA AATGGGCTGG ATTGCCGAAA ACAGCTTCAG
 651 CGTGCAGGTT TTGATTATCG CCGCCGTCAT GTCCCTCGCC GTCGTTTCGG
 701 CAATATCCGG CGTGGGGAAG GGCGTGAAGG TGTTGAGCGA GTTGAACCTG
 751 GGCCTTGCGT TTTTGCTGCT GTTTTTTGTT TTGGCGGCGG GACCCACTGT
 801 TTACCTGTTG TCGGCATTCG GCGACAACAT AGGGAACTAC CTCGGAAATC
 851 TGGTGCGCCT CAGTTTTAAA ACTTATGCGT ACGAACGGGA ACACAAGCCG
 901 TGGTTTGAAT CTTGGACGGT GCTTTATTGG GCGTGGTGGT GTTCTTGGGC
 951 GCCGTTTGTG GGTTTGTTTA TCGCGCGCAT TTCAAAGGGG CGCACCATCC
1001 GCGAGTTTGT CTTCGGGGTT TTGCTCATCC CCGGCCTGTT CGGCGTTTTG
1051 TGGTTTACCG TCTTCGGCAA TACGGCGATT TGGCTGAATG ACGGGGTTGC
1101 GGGGGGAATG CTCGAAAAGA TGACCTCCTC TCCGGAAACG CTGCTTTTTA
1151 AATTCTTTAA TTACCTCCCC CTGCCCGAAT TGACGAGCAT CGTCAGCCTG
1201 CTGGTCATTT CTCTGTTTTT TGTAACTTCT GCCGATTCCG GGATTTATGT
1251 CCTGAACAAT ATTACCTCTC GGGACAAAGG CTTGAGCGCG CCACGGTGGC
1301 AGGCGGTTAT GTGGGGCGTG CTGATGTCTG CCGTTGCCGT TTTGCTGATG
1351 CGCTCGGGCG GACTCGGCAA CCTGCAGTCT ATGACCCTGA TTGTTTCCCT
1401 GCCGTTTGCC CTGCTGATGC TGATAATGTG TTTCAGCCTG TGGAAAGGCT
1451 TGAGTGCGGA TAAGAAATAT TTTGAGACCC GGGTTAACCC TACCAGTGTA
1501 TTTTGGACGG GCGGCAAGTG GAAAGAACGG CTGGTGCAGA TAATGAGCCA
1551 GACGCAGGAG CAGGATATTT TAAAATTCCT CAAACAGACT GCATCGCCCG
1601 CTATGCACGA GTTGCAACGG GAGCTTTCGG AAGAATACGG CTTGAGCGTC
1651 CGGGTCGATA AAATGTTTCA TCGGGACGAG CCCGCAATCG AGTTCGTCAT
1701 TCGGAAAGAG ACGATGCGCG ATTTTATGTA CGGGATTAAG TCTGTCGGGC
1751 AGGATGTATC CGACCAGTTG ATTAACGACG GCAAGCTGCC GCATATCCGG
1801 CATCAGACAA CTTACAAACC CTACGCTTAT TTTTTCGACG GGCGCGTCGG
1851 GTACGATGTG CAGTATATGA ACAAGGACGA GCTGATTGCC GACATTTTGA
1901 AAAACTACGA ACGTTATTTG ATGTTGTTGG ATGATGTCGG TCAGGAACTG
1951 ATGGCGCACG AGCAGGTGGA ATTGGCAGAG TAA
```

This corresponds to the amino acid sequence <SEQ ID 676; ORF 163>:

m163.pep

```
  1 MVILTTLFFV CVLVVLVLTV PDQVQMWLDR AKEVIFTEFS WFYVLTFSIF
 51 LGFLLILSVS SLGNIRLGRD EDVPEFGFLS WLAMLFAAGM GVGLMFFGVA
101 EPLMHYFSDI TAGTPEHRQQ QALLHTVFHW GVHAWSVYGT IALALAYFGF
151 RYKLPLALRS CFYPLLKEKI SGRFGDAIDI MALLATFFGI ITTLGFGASQ
201 LGAGLQEMGW IAENSFSVQV LIIAAVMSLA VVSAISGVGK GVKVLSELNL
251 GLAFLLLFFV LAAGPTVYLL SAFGDNIGNY LGNLVRLSFK TYAYEREHKP
```

-continued

```
301 WFESWTVLYW AWWCSWAPFV GLFIARISKG RTIREFVFGV LLIPGLFGVL

351 WFTVFGNTAI WLNDGVAGGM LEKMTSSPET LLFKFFNYLP LPELTSIVSL

401 LVISLFFVTS ADSGIYVLNN ITSRDKGLSA PRWQAVMWGV LMSAVAVLLM

451 RSGGLGNLQS MTLIVSLPFA LLMLIMCFSL WKGLSADKKY FETRVNPTSV

501 FWTGGKWKER LVQIMSQTQE QDILKFLKQT ASPAMHELQR ELSEEYGLSV

551 RVDKMFHRDE PAIEFVIRKE TMRDFMYGIK SVGQDVSDQL INDGKLPHIR

601 HQTTYKPYAY FFDGRVGYDV QYMNKDELIA DILKNYERYL MLLDDVGQEL

651 MAHEQVELAE *
```

Computer analysis of this amino acid sequence gave the following results:

Homology with a predicted ORF from *N. gonorrhoeae* m163/g163 98.6% identity in 660 aa overlap

```
                   10        20        30        40        50        60
m163.pep   MVILTTLFFVCVLVVLVLTVPDQVQMWLDRAKEVIFTEFSWFYVLTFSIFLGFLLILSVS
           ||||||||||||||||||||||||||||||||||||||||||||||||||||||||||||
g163       MVILTTLFFVCVLVVLVLTVPDQVQMWLDRAKEVIFTEFSWFYVLTFSIFLGFLLILSVS
                   10        20        30        40        50        60

                   70        80        90       100       110       120
m163.pep   SLGNIRLGRDEDVPEFGFLSWLAMLFAAGMGVGLMFFGVAEPLMHYFSDITAGTPEHRQQ
           :||||||||||||||||||||||||||||||||||||||||||||||||||:|:||||||
g163       GLGNIRLGRDEDVPEFGFLSWLAMLFAAGMGVGLMFFGVAEPLMHYFSDITVGAPEHRQQ
                   70        80        90       100       110       120

                  130       140       150       160       170       180
m163.pep   QALLHTVFHWGVHAWSVYGTIALALAYFGFRYKLPLALRSCFYPLLKEKISGRFGDAIDI
           ||||||||||||||||||||||||||||||||||||||||||||||||||||||||||||
g163       QALLHTVFHWGVHAWSVYGTIALALAYFGFRYKLPLALRSCFYPLLKEKISGRFGDAIDI
                  130       140       150       160       170       180

                  190       200       210       220       230       240
m163.pep   MALLATFFGIITTLGFGASQLGAGLQEMGWIAENSFSVQVLIIAAVMSLAVVSAISGVGK
           |||||||||||||||||||||||||||||||||||||:||||||||||||||||||||||
g163       MALLATFFGIITTLGFGASQLGAGLQEMGWIAENSFGVQVLIIAAVMSLAVVSAISGVGK
                  190       200       210       220       230       240

                  250       260       270       280       290       300
m163.pep   GVKVLSELNLGLAFLLLFFVLAAGPTVYLLSAFGDNIGNYLGNLVRLSFKTYAYEREHKP
           ||||||||||||||||||||||| ||||||||||||||||||||||||:|||||||||||
g163       GVKVLSELNLGLAFLLLFFVLAADPTVYLLSAFGDNIGNYLGNLVRLSLKTYAYEREHKP
                  250       260       270       280       290       300

                  310       320       330       340       350       360
m163.pep   WFESWTVLYWAWWCSWAPFVGLFIARISKGRTIREFVFGVLLIPGLFGVLWFTVFGNTAI
           ||||||||||||||||||||||||||||||||||||||||||||||||||||||||||||
g163       WFESWTVLYWAWWCSWAPFVGLFIARISKGRTIREFVFGVLLIPGLFGVLWFTVFGNTAI
                  310       320       330       340       350       360

                  370       380       390       400       410       420
m163.pep   WLNDGVAGGMLEKMTSSPETLLFKFFNYLPLPELTSIVSLLVISLFFVTSADSGIYVLNN
           ||||||||||||||||||||||||||||||||||||||||||||||||||||||||||||
g163       WLNDGVAGGMLEKMTSSPETLLFKFFNYLPLPELTSIVSLLVISLFFVTSADSGIYVLNN
                  370       380       390       400       410       420

                  430       440       450       460       470       480
m163.pep   ITSRDKGLSAPRWQAVMWGVLMSAVAVLLMRSGGLGNLQSMTLIVSLPFALLMLIMCFSL
           ||||||||||||||||||||||||||||||||||||||||||||||||||||||||||||
g163       ITSRDKGLSAPRWQAVMWGVLMSAVAVLLMRSGGLGNLQSMTLIVSLPFALLMLIMCFSL
                  430       440       450       460       470       480

                  490       500       510       520       530       540
m163.pep   WKGLSADKKYFETRVNPTSVFWTGGKWKERLVQIMSQTQEQDILKFLKQTASPAMHELQR
           ||||||||||||||||||||||||||||||||:|||||||||||||||:|||||||||||
g163       WKGLSADKKYFETRVNPTSVFWTGGKWKERLVRIMSQTQEQDILKFLKHTASPAMHELQR
                  490       500       510       520       530       540

                  550       560       570       580       590       600
m163.pep   ELSEEYGLSVRVDKMFHRDEPAIEFVIRKETMRDFMYGIKSVGQDVSDQLINDGKLPHIR
           |||||||||||||||||:||||||||||||||||||||||||||||||||||||||||||
g163       ELSEEYGLSVRVDKMFHQDEPAIEFVIRKETMRDFMYGIKSVGQDVSDQLINDGKLPHIR
                  550       560       570       580       590       600

                  610       620       630       640       650       660
m163.pep   HQTTYKPYAYFFDGRVGYDVQYMNKDELIADILKNYERYLMLLDDVGQELMAHEQVELAE
           ||||||||||||||||||||||||||||||||||||||||||||||||||||||||||||
g163       HQTTYKPYAYFFDGRVGYDVQYMNKDELIADILKNYERYLMLLDDVGQELMAHEQVELAE
                  610       620       630       640       650       660
```

-continued

```
m163.pep  X
          |
g163      X
```

The following partial DNA sequence was identified in *N. meningitidis* <SEQ ID 677>:

a163.seq

```
   1 ATGGTTATTT TGACGACTTT GTTTTTTGTG TGTGTTTTGG TGGTATTGGT
  51 TTTAACCGTG CCGGATCAGG TGCAGATGTG GCTCGATCGG GCAAAAGAAG
 101 TCATTTTTAC CGAGTTCAGC TGGTTTTATG TTTTAACGTT TTCCATTTTT
 151 CTGGGTTTCC TGCTGATACT CTCGGTCAGC AGTTTGGGAA ACATCAGGCT
 201 CGGACGGGAT GAAGATGTGC CGGAATTCGG CTTCCTGTCG TGGCTGGCGA
 251 TGCTGTTTGC GGCCGGGATG GGCGTGGGTC TGATGTTTTT CGGCGTGGCA
 301 GAGCCGTTGA TGCATTATTT TTCGGACATT ACGGCCGGCA CGCCGGAACA
 351 CAGGCAGCAG CAGGCATTGC TGCACACGGT GTTCCATTGG GGCGTTCACG
 401 CTTGGTCGGT GTACGGTACG ATTGCATTGG CTTTGGCTTA TTTCGGTTTC
 451 CGCTACAAGC TGCCGCTTGC CCTGCGTTCT TGTTTTTACC CCCTGTTGAA
 501 AGAAAAAATT TCCGGAAGGT TCGGCGATGC CATTGATATT ATGGCGTTGC
 551 TTGCTACTTT TTTCGGCATC ATCACCACAT TGGGGTTCGG GGCTTCGCAA
 601 CTGGGCGCCG GATTGCAGGA AATAGGCTGG ATTGCCGAAA ACAGCTTCAG
 651 CGTGCAGGTT TTGATTATCG CCGCCGTCAT GTCCCTCGCC GTCGTTTCGG
 701 CAATATCCGG CGTGGGGAAG GGTGTGAAGG TGTTGAGCGA GTTGAACCTG
 751 GGTCTTGCGT TTTTGCTGCT GTTTTTTGTT TTGGCGGCGG GTCCCACTGT
 801 TTACCTGTTG TCGGCATTCG GCGACAACAT AGGGAACTAC CTCGGAAATC
 851 TGGTGCGCCT CAGTTTTAAA ACTTATGCGT ACGAACGGGA ACACAAGCCG
 901 TGGTTTGAAT CTTGGACGGT GCTTTATTGG GCGTGGTGGT GTTCTTGGGC
 951 GCCGTTTGTG GGTTTGTTTA TCGCGCGCAT TTCAAAGGGG CGCACCATCC
1001 GCGAGTTTGT CTTCGGGGTT TTGCTCATCC CCGGCCTGTT CGGCGTTTTG
1051 TGGTTTACCG TCTTCGGCAA TACGCCGATT TGGCTGAATG ACGGGGTTGC
1101 GGGGGGAGTG CTCGAAAAGA TGACCTCCTC TCCGGAAACG CTGCTTTTTA
1151 AATTCTTTAA TTACCTCCCC CTGCCCGAAT TGACGAGCAT CGTCAGCCTG
1201 CTGGTCATTT CTCTGTTTTT TGTAACTTCT GCCGATTCCG GGATTTATGT
1251 CCTGAACAAT ATTACCTCTC GGGACAAAGG CTTGAGCGCG CCACGGTGGC
1301 AGGCGGTTAT GTGGGGCGTG CTGATGTCTG CCGTTGCCGT TTTGCTGATG
1351 CGCTCGGGCG GACTCGGCAA CCTGCAGTCT ATGACCCTGA TTGTTTCCCT
1401 GCCGTTTGCC CTGCTGATGC TGATAATGTG TTTCAGCCTG TGGAAAGGAT
1451 TGAGTGCGGA TAAGAAATAT TTTGAGACCC GGGTTAACCC TACCAGTGTA
1501 TTTTGGACGG GCGGCAAGTG GAAAGAACGG CTGGTGCAGA TAATGAGCCA
1551 GACGCAGGAG CAGGATATTT TAAAATTCCT CAAACATACC GCATCGCCCG
1601 CTATGCACGA GTTACAACGG GAGCTTTCGG AAGAATACGG CTTGAGCGTC
```

-continued

```
1651 CGGGTCGATA AGATGTTTCA TCAGGACGAG CCCGCAATCG AGTTCGTCAT

1701 TCGGAAAGAG ACGATGCGCG ATTTTATGTA CGGGATTAAG TCTGTCGGGC

1751 AGGATGTATC CGACCAGTTG ATTAACGACG GCAAGCTGCC GCATATCCGG

1801 CATCAGACAA CTTACAAACC CTACGCTTAT TTTTTCGACG GGCGCGTCGG

1851 GTACGATGTG CAGTATATGA ACAAGGACGA GCTGATTGCC GACATTTTGA

1901 AAAACTACGA ACGTTATTTG ATGTTGTTGG ATGATGTCGG TCAGGAACTG

1951 ATGGCGCACG AGCAGGTGGA ATTGGCAGAG TAA
```

This corresponds to the amino acid sequence <SEQ ID 678; ORF 163.a>:

```
a163.pep

  1 MVILTTLFFV CVLVVLVLTV PDQVQMWLDR AKEVIFTEFS WFYVLTFSIF

 51 LGFLLILSVS SLGNIRLGRD EDVPEFGFLS WLAMLFAAGM GVGLMFFGVA

101 EPLMHYFSDI TAGTPEHRQQ QALLHTVFHW GVHAWSVYGT IALALAYFGF

151 RYKLPLALRS CFYPLLKEKI SGRFGDAIDI MALLATFFGI ITTLGFGASQ

201 LGAGLQEIGW IAENSFSVQV LIIAAVMSLA VVSAISGVGK GVKVLSELNL

251 GLAFLLLFFV LAAGPTVYLL SAFGDNIGNY LGNLVRLSFK TYAYEREHKP

301 WFESWTVLYW AWWCSWAPFV GLFIARISKG RTIREFVEGV LLIPGLFGVL

351 WFTVFGNTAI WLNDGVAGGV LEKMTSSPET LLFKFFNYLP LPELTSIVSL

401 LVISLFFVTS ADSGIYVLNN ITSRDKGLSA PRWQAVMWGV LMSAVAVLLM

451 RSGGLGNLQS MTLIVSLPFA LLMLIMCFSL WKGLSADKKY FETRVNPTSV

501 FWTGGKWKER LVQIMSQTQE QDILKFLKHT ASPAMHELQR ELSEEYGLSV

551 RVDKMFHQDE PAIEFVIRKE TMRDFMYGIK SVGQDVSDQL INDGKLPHIR

601 HQTTYKPYAY FFDGRVGYDV QYMNKDELIA DILKNYERYL MLLDDVGQEL

651 MAHEQVELAE *
```

m163/a163 99.4% identity in 660 aa overlap

```
                   10        20        30        40        50        60
m163.pep   MVILTTLFFVCVLVVLVLTVPDQVQMWLDRAKEVIFTEFSWFYVLTFSIFLGFLLILSVS
           ||||||||||||||||||||||||||||||||||||||||||||||||||||||||||||
a163       MVILTTLFFVCVLVVLVLTVPDQVQMWLDRAKEVIFTEFSWFYVLTFSIFLGFLLILSVS
                   10        20        30        40        50        60

                   70        80        90       100       110       120
m163.pep   SLGNIRLGRDEDVPEFGFLSWLAMLFAAGMGVGLMFFGVAEPLMHYFSDITAGTPEHRQQ
           ||||||||||||||||||||||||||||||||||||||||||||||||||||||||||||
a163       SLGNIRLGRDEDVPEFGFLSWLAMLFAAGMGVGLMFFGVAEPLMHYFSDITAGTPEHRQQ
                   70        80        90       100       110       120

                  130       140       150       160       170       180
m163.pep   QALLHTVFHWGVHAWSVYGTIALALAYFGFRYKLPLALRSCFYPLLKEKISGRFGDAIDI
           ||||||||||||||||||||||||||||||||||||||||||||||||||||||||||||
a163       QALLHTVFHWGVHAWSVYGTIALALAYFGFRYKLPLALRSCFYPLLKEKISGRFGDAIDI
                  130       140       150       160       170       180

                  190       200       210       220       230       240
m163.pep   MALLATFFGIITTLGFGASQLGAGLQEMGWIAENSFSVQVLIIAAVMSLAVVSAISGVGK
           |||||||||||||||||||||||||||:||||||||||||||||||||||||||||||||
a163       MALLATFFGIITTLGFGASQLGAGLQEIGWIAENSFSVQVLIIAAVMSLAVVSAISGVGK
                  190       200       210       220       230       240
```

-continued

```
                250       260       270       280       290       300
m163.pep  GVKVLSELNLGLAFLLLFFVLAAGPTVYLLSAFGDNIGNYLGNLVRLSFKTYAYEREHKP
          ||||||||||||||||||||||||||||||||||||||||||||||||||||||||||||
a163      GVKVLSELNLGLAFLLLFFVLAAGPTVYLLSAFGDNIGNYLGNLVRLSFKTYAYEREHKP
                250       260       270       280       290       300

                310       320       330       340       350       360
m163.pep  WFESWTVLYWAWWCSWAPFVGLFIARISKGRTIREFVFGVLLIPGLFGVLWFTVFGNTAI
          ||||||||||||||||||||||||||||||||||||||||||||||||||||||||||||
a163      WFESWTVLYWAWWCSWAPFVGLFIARISKGRTIREFVFGVLLIPGLFGVLWFTVFGNTAI
                310       320       330       340       350       360

                370       380       390       400       410       420
m163.pep  WLNDGVAGGMLEKMTSSPETLLFKFFNYLPLPELTSIVSLLVISLFFVTSADSGIYVLNN
          |||||||||:||||||||||||||||||||||||||||||||||||||||||||||||||
a163      WLNDGVAGGVLEKMTSSPETLLFKFFNYLPLPELTSIVSLLVISLFFVTSADSGIYVLNN
                370       380       390       400       410       420

                430       440       450       460       470       480
m163.pep  ITSRDKGLSAPRWQAVMWGVLMSAVAVLLMRSGGLGNLQSMTLIVSLPFALLMLIMCFSL
          ||||||||||||||||||||||||||||||||||||||||||||||||||||||||||||
a163      ITSRDKGLSAPRWQAVMWGVLMSAVAVLLMRSGGLGNLQSMTLIVSLPFALLMLIMCFSL
                430       440       450       460       470       480

                490       500       510       520       530       540
m163.pep  WKGLSADKKYFETRVNPTSVFWTGGKWKERLVQIMSQTQEQDILKFLKQTASPAMHELQR
          ||||||||||||||||||||||||||||||||||||||||||||||||:|||||||||||
a163      WKGLSADKKYFETRVNPTSVFWTGGKWKERLVQIMSQTQEQDILKFLKHTASPAMHELQR
                490       500       510       520       530       540

                550       560       570       580       590       600
m163.pep  ELSEEYGLSVRVDKMFHRDEPAIEFVIRKETMRDFMYGIKSVGQDVSDQLINDGKLPHIR
          |||||||||||||||||:||||||||||||||||||||||||||||||||||||||||||
a163      ELSEEYGLSVRVDKMFHQDEPAIEFVIRKETMRDFMYGIKSVGQDVSDQLINDGKLPHIR
                550       560       570       580       590       600

                610       620       630       640       650       660
m163.pep  HQTTYKPYAYFFDGRVGYDVQYMNKDELIADILKNYERYLMLLDDVGQELMAHEQVELAE
          ||||||||||||||||||||||||||||||||||||||||||||||||||||||||||||
a163      HQTTYKPYAYFFDGRVGYDVQYMNKDELIADILKNYERYLMLLDDVGQELMAHEQVELAE
                610       620       630       640       650       660

m163.pep  X
          |
a163      X
```

The following partial DNA sequence was identified in *N. gonorrhoeae* <SEQ ID 679>:

g164.seq (partial)

```
  1 ..ATGAACACAT TTTTGAAAAA CAGCGAATAC GCGTATATCC TGAACGACTG
 51   CAAGGCGCGC TTCCTGTTCG CCTCGGCCGG CCTGTCAAAA GAATTGGCGG
101   GCCTGAAGGC GCAAACGCCC GTCGAAAAAA TCATTTGGAC GGACAAAAGC
151   CGGCCGGCCG GCGAAACGGC GGAAGGCGAT GCCTTTTTTG AAAACGTGCG
201   CCGCTTCCCC GAAAAACCCG ACTTGGGCCG CCAACCCCGG ATAAATGATT
251   TGGCACACAT CATCTACACC TCCGGCACGA CGGGGCATCC CAAAGGCGCG
301   CTAATCAGTT ACGCCAACCT GTTCGCCAAC CTGAACGGCA TCGAACGCAT
351   CTTtaaAATT TCCAAACGCG ACCGCTTTAT CGTTTTCctg ccgatgTTCC
401   ACAGCTTCAC GCTGACGGCT ATGGTGCTGC TGCCGATTTA TATGGCGTGT
451   TCGATTATTT TGGTCAAAtc cgttttCCCc ttttccaacG TTTTGAAACA
501   GGCCCTGCTC AAACGCGCAA CCGTGTTTTT GGGCGTACCC GCGATTTACA
551   CCGCGATGAG CAAGGCAAAA ATCCCTTGGT ATTTCAGATG GTTCAACCGC
601   ATCCGCCTGT TTATCAGCGG CGGCGCGCCT TTGGCGGAAC AAACCATCCT
651   CGATTTTAAA GCCAAGTTCC CCCGCGCCAA ATTGCTGGAA GGCTACGGAC
701   TGAGCGAAGC CTCGCCCGTC GTCGCCGTCA ATACGCCCGA ACGGCAAAAA
751   GCCCGCAGCG TCGGCATCCC CCTGCCCGGT TTGGAAGCCA AAGCCGTCGA
```

-continued

801 TGAAGAATTG GTCGAAGTGC CGCGCGGCGA AGTGGGCGAA CTGATCGTCA

851 GGGGCGGTTC GGTGATGCGG GGCTACCTCA ATATGCCTGC CGCCACCGAT

901 GAAACCATCG TCAACGGCTG GTTGAAAACG GGCGATTTCG TTACCATAGA

951 CGAGGACGGC TTTATCTTTA TCGTCGACCG CAAAAAAGAT TTGATTATTT

1001 CCAAAGGTCA AAACGTCTAT CCGCGCGAGA TCGAAGAAGA AATCCACAAA

1051 CTCGATGCCG TCGAAGCCGC CGCCGTCATC GGCGTGAAAG ACCGTTATGC

1101 CGACGAGGAA ATCGTCGCCT TCGTCCAATT GAAGGAAGGT ATGGATTTGG

1151 GCGAGGACGA aatccgccgc caccTGCGTA CCGTGCTGGC AAATTTCAAA

1201 ATCCCCAAAC AGATCCACTT TAAAGACGGG CTGCCGCGCA ACGCTACGGG

1251 CAAAGTATTG AAACGGGTGC TGAAGGAGCA GTTTGAAGGA AACAAATGA

This corresponds to the amino acid sequence <SEQ ID 680; ORF 164.ng>:

g164.pep (partial)

1 ..MNTFLKNSEY AYILNDCKAR FLFASAGLSK ELAGLKAQTP VEKIIWTDKS

51 RPAGETAEGD AFFENVRRFP EKPDLGRQPR INDLAHIIYT SGTTGHPKGA

101 LISYANLFAN LNGIERIFKI SKRDRFIVFL PMFHSFTLTA MVLLPIYMAC

151 SIILVKSVFP FSNVLKQALL KRATVFLGVP AIYTAMSKAK IPWYFRWFNR

201 IRLFISGGAP LAEQTILDFK AKFPRAKLLE GYGLSEASPV VAVNTPERQK

251 ARSVGIPLPG LEAKAVDEEL VEVPRGEVGE LIVRGGSVMR GYLNMPAATD

301 ETIVNGWLKT GDFVTIDEDG FIFIVDRKKD LIISKGQNVY PREIEEEIHK

351 LDAVEAAAVI GVKDRYADEE IVAFVQLKEG MDLGEDEIRR HLRTVLANFK

401 IPKQIHFKDG LPRNATGKVL KRVLKEQFEG NK*

The following partial DNA sequence was identified in *N. meningitidis* <SEQ ID 681>:

m164.seq

1 ATGAACCGGA CTTATGCCAA TTTCTACGAA ATGCTCGCCG CCGCCTGCCG

51 CAAAAACGGA AACGGCACGG CAGTGTTCGA CGGCAAGGAA AAAACCGCCT

101 ACCGCGCGCT CAAGCAGGAG GCCGAAGCCG TCGCGGCGTA TCTGCAAAAT

151 ATCGGCGTGA AGTTCGGCGA CACGGTCGCG CTGGCGGTTT CCAATTCCAC

201 AGAATTTATT ACCGCCTATT TCGCCATCTC CGCCATCGGC GCGGTCGCCG

251 TACCGATGAA CACATTTTTG AAAAACAGCG AATACGCGTA TATCCTGAAC

301 GACTGCAAGG CGCGCTTCCT GTTCGCCTCG GCCGGCCTGT CAAAAGAATT

351 GGCGGGCTTG AAGGCGCAAA CGCCCGTCGA AAAAATCATT TGGACGGACA

401 AAAGCCGTCC GACCGGCGAA ACGGCGGAAG GCGATGCCTT TTTTGAAGAC

451 GTGCGCCGCT TCCCCGAAAA ACCCGACTTG GGCCGCCAAC CCCGGATAAA

501 TGATTTGGCA CACATCATCT ACACCTCCGG CACGACGGGG CATCCCAAAG

551 GCGCGCTAAT CAGTTACGCC AACCTGTTCG CCAACCTGAA CGGCATCGAA

601 CGCATCTTTA AAATTTCCAA GCGCGACCGC TTTATCGTTT TCCTGCCGAT

-continued

```
 651 GTTCCACAGC TTCACGCTGA CGGCTATGGT GCTGCTGCCG ATTTATATGG
 701 CGTGTTCGAT TATTTTGGTC AAATCCGTTT TTCCGTTTTC CAACGTTTTG
 751 AAACAGACAC TGCTCAAACG CGCGACCGTG TTTTTGGGCG TACCCGCGAT
 801 TTACACCGCG ATGAGCAAGG CGAAAATCCC TTGGTATTTC AGATGGTTCA
 851 ACCGCATTCG CCTGTTTATC AGCGGCGGCG CGCCTTTGGC GGAACAAACC
 901 ATCCTCGATT TCAAAGCCAA GTTCCCCCGC GCCAAATTGC TGGAAGGCTA
 951 CGGACTGAGC GAAGCCTCTC CCGTCGTCGC CGTCAATACG CCCGAGAGGC
1001 AAAAAGCCCG CAGCGTCGGC ATCCCCCTGC CCGGTTTGGA AGCCAAAGCC
1051 GTCGATGAAG AATTGGTCGA AGTGCCGCGC GGCGAAGTGG GCGAACTGAT
1101 CGTCAGGGGC GGTTCGGTGA TGCGGGGCTA CCTCAATATG CCTGCCGCCA
1151 CCGATGAAAC CATCGTCAAC GGCTGGTTGA AAACGGGCGA TTTCGTTACC
1201 ATAGACGAAG ACGGCTTTAT CTTTATCGTC GACCGCAAAA AAGATTTGAT
1251 TATTTCCAAA GGTCAAAATG TCTATCCGCG CGAGATTGAA GAAGAAATCT
1301 ACAAACTCGA TGCCGTCGAA GCCGCCGCCG TCATCGGCGT GAAAGACCGT
1351 TATGCCGACG AGGAAATCGT CGCCTTCGTC CAATTGAAGG AAGGTATGGA
1401 TTTGGGCGAG AACGAAATCC GCCGCCACCT GCGTACCGTG CTGGCAAATT
1451 TCAAAATCCC CAAACAAATC CACTTTAAAG ACGGGCTGCC GCGCAACGCT
1501 ACGGGCAAGG TATTGAAACG GGTGTTGAAG GAGCAGTTTG ACGGAAACAA
1551 ATGA
```

This corresponds to the amino acid sequence <SEQ ID 682; ORF 164>:

m164.pep

```
  1 MNRTYANFYE MLAAACRKNG NGTAVFDGKE KTAYRALKQE AEAVAAYLQN
 51 IGVKFGDTVA LAVSNSTEFI TAYFAISAIG AVAVPMNTFL KNSEYAYILN
101 DCKARFLFAS AGLSKELAGL KAQTPVEKII WTDKSRPTGE TAEGDAFFED
151 VRRFPEKPDL GRQPRINDLA HIIYTSGTTG HPKGALISYA NLFANLNGIE
201 RIFKISKRDR FIVFLPMFHS FTLTAMVLLP IYMACSIILV KSVFPFSNVL
251 KQTLLKRATV FLGVPAIYTA MSKAKIPWYF RWFNRIRLFI SGGAPLAEQT
301 ILDFKAKFPR AKLLEGYGLS EASPVVAVNT PERQKARSVG IPLPGLEAKA
351 VDEELVEVPR GEVGELIVRG GSVMRGYLNM PAATDETIVN GWLKTGDFVT
401 IDEDGFIFIV DRKKDLIISK GQNVYPREIE EEIYKLDAVE AAAVIGVKDR
451 YADEEIVAFV QLKEGMDLGE NEIRRHLRTV LANFKIPKQI HFKDGLPRNA
501 TGKVLKRVLK EQFDGNK*
```

Computer analysis of this amino acid sequence gave the following results:

Homology with a predicted ORF from *N. gonorrhoeae* m164/g164 98.6% identity in 432 aa overlap

```
             60        70        80        90       100       110
m164.pep  GDTVALAVSNSTEFITAYFAISAIGAVAVPMNTFLKNSEYAYILNDCKARFLFASAGLSK
                                        ||||||||||||||||||||||||||||||
g164                                    MNTFLKNSEYAYILNDCKARFLFASAGLSK
                                                10        20        30

120       130       140       150       160       170
m164.pep  ELAGLKAQTPVEKIIWTDKSRPTGETAEGDAFFEDVRRFPEKPDLGRQPRINDLAHIIYT
          ||||||||||||||||||||||:|||||||||||:|||||||||||||||||||||||||
g164      ELAGLKAQTPVEKIIWTDKSRPAGETAEGDAFFENVRRFPEKPDLGRQPRINDLAHIIYT
                  40        50        60        70        80        90

180       190       200       210       220       230
m164.pep  SGTTGHPKGALISYANLFANLNGIERIFKISKRDRFIVFLPMFHSFTLTAMVLLPIYMAC
          ||||||||||||||||||||||||||||||||||||||||||||||||||||||||||||
g164      SGTTGHPKGALISYANLFANLNGIERIFKISKRDRFIVFLPMFHSFTLTAMVLLPIYMAC
                 100       110       120       130       140       150

240       250       260       270       280       290
m164.pep  SIILVKSVFPFSNVLKQTLLKRATVFLGVPAIYTAMSKAKIPWYFRWFNRIRLFISGGAP
          |||||||||||||||||:||||||||||||||||||||||||||||||||||||||||||
g164      SIILVKSVFPFSNVLKQALLKRATVFLGVPAIYTAMSKAKIPWYFRWFNRIRLFISGGAP
                 160       170       180       190       200       210

300       310       320       330       340       350
m164.pep  LAEQTILDFKAKFPRAKLLEGYGLSEASPVVAVNTPERQKARSVGIPLPGLEAKAVDEEL
          ||||||||||||||||||||||||||||||||||||||||||||||||||||||||||||
g164      LAEQTILDFKAKFPRAKLLEGYGLSEASPVVAVNTPERQKARSVGIPLPGLEAKAVDEEL
                 220       230       240       250       260       270

360       370       380       390       400       410
m164.pep  VEVPRGEVGELIVRGGSVMRGYLNMPAATDETIVNGWLKTGDFVTIDEDGFIFIVDRKKD
          ||||||||||||||||||||||||||||||||||||||||||||||||||||||||||||
g164      VEVPRGEVGELIVRGGSVMRGYLNMPAATDETIVNGWLKTGDFVTIDEDGFIFIVDRKKD
                 280       290       300       310       320       330

420       430       440       450       460       470
m164.pep  LIISKGQNVYPREIEEEIYKLDAVEAAAVIGVKDRYADEEIVAFVQLKEGMDLGENEIRR
          ||||||||||||||||||:||||||||||||||||||||||||||||||||||||:||||
g164      LIISKGQNVYPREIEEEIHKLDAVEAAAVIGVKDRYADEEIVAFVQLKEGMDLGEDEIRR
                 340       350       360       370       380       390

480       490       500       510
m164.pep  HLRTVLANFKIPKQIHFKDGLPRNATGKVLKRVLKEQFDGNKX
          ||||||||||||||||||||||||||||||||||||||:||||
g164      HLRTVLANFKIPKQIHFKDGLPRNATGKVLKRVLKEQFEGNKX
                 400       410       420       430
```

The following partial DNA sequence was identified in *N. meningitidis* <SEQ ID 683>:

<u>a164.seq</u>

```
  1 ATGAACCGGA CTTATGCCAA TTTCTACGAA ATGCTGACCG CCGCCTGCCG

51 CAAAAACGGC AACGGCACGG CAGTGTTCGA CGGCAAGGAA AAAACCGCCT

101 ACCGCGCGCT CAAGCAGGAA GCCGAAGCCG TTGCGGCGTA TCTGCAAAAT

151 ATCGGCGTGA AGTTCGGCGA CACGGTCGCG CTGGCGGTTT CCAATTCCAC

201 GGAATTTATT ACCGCCTATT TCGCCGTATC CGCCATCGGC GCGGTTGCCG

251 TACCGATGAA CACATTTTTG AAAAACAGCG AATACGCGTA TATCCTGAAC

301 GACTGCAAGG CGCGCTTCCT GTTCGCCTCG GCCGGCCTGT CAAAAGAATT

351 GGCGGGCTTG AAGGCGCAAA CGCCCGTCGA AAAAATCATT TGGACGGGCC

401 AAAGCCGTCC GGACGGCGAA ATGGCGGAAG GCGATGCCTT TTTTGAAGAC

451 GTGCGCCGCT TCCCCGAAAA ACCCGACTTG GGCCGCCAAC CCCGGATAAA

501 TGATTTGGCA CACATCATCT ACACCTCCGG CACGACGGGG CATCCCAAAG

551 GTGCGCTAAT CAGCTACGCC AACCTGTTCG CCAACCTGAA CGGCATCGAA

601 CGCATCTTTA AAATCTCCAA GCGCGACCGC TTTATCGTTT TCCTGCCGAT

651 GTTCCACAGC TTCACGCTGA CGGCTATGGT GCTGCTGCCG ATTTATATGG

701 CGTGTTCGAT TATTTTGGTC AAATCCGTTT TCCCCTTTTC CAACGTTTTG

751 AAACAGGCAC TGCTCAAACG CGCGACCGTG TTTTTGGGCG TGCCCGCGAT
```

-continued

```
 801 TTACACCGCG ATGAGCAAGA CGAAAATCCC TTGGTATTTC AGATGGTTCA

 851 ACCGCATCCG CCTGTTTATC AGCGGCGGAG CACCTTTGGC GGAACAAACC

 901 ATCCTCGATT TCAAAGCCAA GTTCCCCCGC GCCAAATTGC TGGAAGGCTA

 951 CGGACTGAGC GAAGCCTCGC CCGTCGTCGC CGTCAATACG CCCGAGAGGC

1001 AAAAAGCCCG CAGCGTCGGC ATCCCCCTGC CCGGTTTGGA AGTCAAAGCC

1051 GTCGATGAAG AATTGGTCGA AGTGCCGCGC GGCGAAGTGG GCGAACTGAT

1101 CGTCAGGGGC GGTTCGGTGA TGCGGGGCTA CCTCAATATG CCTGCCGCCA

1151 CCGATGAAAC CATCGTCAAC GGCTGGTTGA AAACGGGCGA TTTCGTTACC

1201 ATAGACGAAG ACGGCTTTAT CTTTATCGTC GACCGCAAAA AAGATTTGAT

1251 TATTTCCAAA GGTCAAAATG TCTATCCGCG CGAAATCGAA GAAGAAATCT

1301 ACAAACTCGA TGCCGTCGAA GCCGCCGCCG TCATCGGCGT GAAAGACCGT

1351 TATGCCGACG AGGAAATCGT CGCCTTCGTC CAATTGAAGG AAGGTATGGA

1401 TTTGGGCGAG AACGAAATCC GCCGCCACCT GCGTACCGTG CTGGCAAATT

1451 TCAAAATCCC CAAACAAATC CACTTTAAAG ACGGGCTGCC GCGCAACGCT

1501 ACGGGCAAGG TATTGAAACG GGTGTTGAAG GAGCAGTTTG ACGGAAACAA

1551 ATGA
```

This corresponds to the amino acid sequence <SEQ ID 684; ORF 164.a>:

a164.pep

```
  1 MNRTYANFYE MLTAACRKNG NGTAVFDGKE KTAYRALKQE AEAVAAYLQN

 51 IGVKFGDTVA LAVSNSTEFI TAYFAVSAIG AVAVPMNTFL KNSEYAYILN

101 DCKARFLFAS AGLSKELAGL KAQTPVEKII WTGQSRPDGE MAEGDAFFED

151 VRRFPEKPDL GRQPRINDLA HIIYTSGTTG HPKGALISYA NLFANLNGIE

201 RIFKISKRDR FIVFLPMFHS FTLTAMVLLP IYMACSIILV KSVFPFSNVL

251 KQALLKRATV FLGVPAIYTA MSKTKIPWYF RWFNRIRLFI SGGAPLAEQT

301 ILDFKAKFPR AKLLEGYGLS EASPVVAVNT PERQKARSVG IPLPGLEVKA

351 VDEELVEVPR GEVGELIVRG GSVMRGYLNM PAATDETIVN GWLKTGDFVT

401 IDEDGFIFIV DRKKDLIISK GQNVYPREIE EEIYKLDAVE AAAVIGVKDR

451 YADEEIVAFV QLKEGMDLGE NEIRRHLRTV LANFKIPKQI HFKDGLPRNA

501 TGKVLKRVLK EQFDGNK*
```

m164/a164 98.3% identity in 517 aa overlap

```
                   10        20        30        40        50        60
m164.pep   MNRTYANFYEMLAAACRKNGNGTAVFDGKEKTAYRALKQEAEAVAAYLQNIGVKFGDTVA
           ||||||||||||:|||||||||||||||||||||||||||||||||||||||||||||||
a164       MNRTYANFYEMLTAACRKNGNGTAVFDGKEKTAYRALKQEAEAVAAYLQNIGVKFGDTVA
                   10        20        30        40        50        60

                   70        80        90       100       110       120
m164.pep   LAVSNSTEFITAYFAISAIGAVAVPMNTFLKNSEYAYILNDCKARFLFASAGLSKELAGL
           |||||||||||||||:||||||||||||||||||||||||||||||||||||||||||||
a164       LAVSNSTEFITAYFAVSAIGAVAVPMNTFLKNSEYAYILNDCKARFLFASAGLSKELAGL
                   70        80        90       100       110       120
```

-continued

```
                 130       140       150       160       170       180
m164.pep  KAQTPVEKIIWTDKSRPTGETAEGDAFFEDVRRFPEKPDLGRQPRINDLAHIIYTSGTTG
          |||||||||||| :||| || |||||||||||||||||||||||||||||||||||||||
a164      KAQTPVEKIIWTGQSRPDGEMAEGDAFFEDVRRFPEKPDLGRQPRINDLAHIIYTSGTTG
                 130       140       150       160       170       180

                 190       200       210       220       230       240
m164.pep  HPKGALISYANLFANLNGIERIFKISKRDRFIVFLPMFHSFTLTAMVLLPIYMACSIILV
          ||||||||||||||||||||||||||||||||||||||||||||||||||||||||||||
a164      HPKGALISYANLFANLNGIERIFKISKRDRFIVFLPMFHSFTLTAMVLLPIYMACSIILV
                 190       200       210       220       230       240

                 250       260       270       280       290       300
m164.pep  KSVFPFSNVLKQTLLKRATVFLGVPAIYTAMSKAKIPWYFRWFNRIRLFISGGAPLAEQT
          ||||||||||||:||||||||||||||||||||:||||||||||||||||||||||||||
a164      KSVFPFSNVLKQALLKRATVFLGVPAIYTAMSKTKIPWYFRWFNRIRLFISGGAPLAEQT
                 250       260       270       280       290       300

                 310       320       330       340       350       360
m164.pep  ILDFKAKFPRAKLLEGYGLSEASPVVAVNTPERQKARSVGIPLPGLEAKAVDEELVEVPR
          |||||||||||||||||||||||||||||||||||||||||||||||:||||||||||||
a164      ILDFKAKFPRAKLLEGYGLSEASPVVAVNTPERQKARSVGIPLPGLEVKAVDEELVEVPR
                 310       320       330       340       350       360

                 370       380       390       400       410       420
m164.pep  GEVGELIVRGGSVMRGYLNMPAATDETIVNGWLKTGDFVTIDEDGFIFIVDRKKDLIISK
          ||||||||||||||||||||||||||||||||||||||||||||||||||||||||||||
a164      GEVGELIVRGGSVMRGYLNMPAATDETIVNGWLKTGDFVTIDEDGFIFIVDRKKDLIISK
                 370       380       390       400       410       420

                 430       440       450       460       470       480
m164.pep  GQNVYPREIEEEIYKLDAVEAAAVIGVKDRYADEEIVAFVQLKEGMDLGENEIRRHLRTV
          ||||||||||||||||||||||||||||||||||||||||||||||||||||||||||||
a164      GQNVYPREIEEEIYKLDAVEAAAVIGVKDRYADEEIVAFVQLKEGMDLGENEIRRHLRTV
                 430       440       450       460       470       480

                 490       500       510
m164.pep  LANFKIPKQIHFKDGLPRNATGKVLKRVLKEQFDGNKX
          |||||||||||||||||||||||||||||||||||||
a164      LANFKIPKQIHFKDGLPRNATGKVLKRVLKEQFDGNKX
                 490       500       510
```

The following partial DNA sequence was identified in *N. gonorrhoeae* <SEQ ID 685>:

g165.seq

```
  1 ATGGCTGAAG CGACAGACGT TGTCTTGGTG GGCGGCGGCA TTATGAGCGC

 51 GACTTTGGGC GTTTTGCTCA AAGAACTCGA ACCGTCTTGG GAAATCACCC

101 TGATTGAACG CTTGGAagat gTGGCGTTGG AATCGTCAAA cGCGTGGAAC

151 AACGcCGgca CGGGGCATTC CGcGCTGTGc GAATTGAACT AtgcgccGCT

201 GGGtgcggac ggcgtcatCA ATCCGGCGCg cgCCCTGAAT ATTGCCGAAC

251 AGTTTCATGT CAGCCGCCAG TTTTGGGcga cgctgGTCGC GGAAGGCAAG

301 TTGGAagaCA ATTCCTTCAT CAATGCCgtg ccgcatatGT Ctttggtgat

351 gAacgaagac cactgCCgtt acCTGCAAAA ACGCTATGAT GTGTTTAAAA

401 CGCAGAAACT TTTTGAAAAT ATGGAATTTT CCACCGATCG GAACAAAATT

451 TCCGATTGGG CtccgCTGAT TATGCGCGGC CGGgacgaaA ACCAACCCGT

501 CGCCGCCAAC TATTCCGCCG Aaggcacgga tgtcgATTTC GGACGGCTGA

551 CGCGCCAGAT GGTGAAATAT TTGCAGGGCA AGGGCGTAAA AACCGAGTTC

601 AACCGCCACG TCGAAGACAT CAAACGCGAA TCCGACGGCG CGTGGGTGCT

651 CAAAACCGCC GATACCCGCA ACCCAGACTG GCAGCTCACC CTCCGCACCC

701 GCTTCCTCTT CCTCGGCGCG GGCGGCGGCG CACTGACCCT GCTGCAAAAA

751 TCCGGCATCC CCGAAGGCAA AGGCTACGGC GGCTTACCCG TGTCCGGCCT

801 GTTCTTCCGC AACAGCAACC CCGAAACCGC CGAACAACAC AACGCCAAAG

851 TGTACGGGCA GGCTTCCGTC GGCGCGCCGC CGATGTCCGT CCCGCACCTC
```

-continued

```
 901 GACACACGCA ACGTAGACGG CAAACGACAC CTTATGTTCG GTCCTTACGC

 951 AGGTTTCCGT TCCAACTTCC TCAAGCAAGG CTCGTTTATG GATTTGCCGC

1001 TGTCCATCCA TATGGACAAC CTCTATCCTA TGCTGCGCGC CGGCTGGGCG

1051 AATATGCCGC TGACCAAATA CcTGCTGGgC gAaTTGCgtt aa
```

This corresponds to the amino acid sequence <SEQ ID 686; ORF 165.ng>:

g165.pep

```
  1 MAEATDVVLV GGGIMSATLG VLLKELEPSW EITLIERLED VALESSNAWN

 51 NAGTGHSALC ELNYAPLGAD GVINPARALN IAEQFHVSRQ FWATLVAEGK

101 LEDNSFINAV PHMSLVMNED HCRYLQKRYD VFKTQKLFEN MEFSTDRNKI

151 SDWAPLIMRG RDENQPVAAN YSAEGTDVDF GRLTRQMVKY LQGKGVKTEF

201 NRHVEDIKRE SDGAWVLKTA DTRNPDWQLT LRTRFLFLGA GGGALTLLQK

251 SGIPEGKGYG GLPVSGLFFR NSNPETAEQH NAKVYGQASV GAPPMSVPHL

301 DTRNVDGKRH LMFGPYAGFR SNFLKQGSFM DLPLSIHMDN LYPMLRAGWA

351 NMPLTKYLLG ELR*
```

The following partial DNA sequence was identified in *N. meningitidis* <SEQ ID 687>:

m165.seq (partial)

```
  1 ATGGCTGAAG CGACAGACGT TGTCTTGGTG GGCGGCGGCA TTATGAGCGC

 51 GACTTTGGGC GTTTTGCTCA AAGAACTCGA ACCGTCTTGG GAAATCACCC

101 TGATTGAACG CTTGGAAGAT GTGGCGTTGG AATCGTCAAA CGCGTGGAAC

151 AACGCCGGCA CGGGGCATTC CGCGCTGTGC GAATTGAACT ATGCGCCGTT

201 GGGTGCAAAT GGGATTATCG ATCCGGCGCG CGCCCTCAAT ATTGCCGAAC

251 AGTTTCATGT CAGCCGCCAG TTTTGGGCGA CGCTGGTCGC GGAAGGCAAG

301 TTGGAAGACA ATTCCTTCAT CAATGCCGTG CCGCATATGT CTTTGGTGAT

351 GAATGAAGAC CATTGTTCTT ATCTTCAAAA ACGTTATGAC GCGTTTAAAA

401 CCCAAAAACT TTTTGAAAAT ATGGAATTTT CCACCGATCG GAACAAAATT

451 TCCGATTGGG CTCCGCTGAT GATGCGCGGC CGGGACGAAA ACCAACCCGT

501 CGCCGCCAAC TACTCCGCCG AAGgTACGGA TGTCGATTTC GGACGGCTGA

551 CGCGCCAAAT GGTGAAATAT TTGCAGGGCA AGGGCGTAAA AACCGAGTTC

601 AACCGCCACG TCGAAGACAT CAAACGCGAA TCCGACGGCG CGTGGGTGCT

651 CAAAACCGCC GATACCCGCA ACCCCGACGG GCAGCTCACC CTCCGTACCC

701 GCTTCCTCTT CCTCGGCGCG GGCGGCGGCG CGCTGACCCT GCTGCAAAAA

751 TCCGGCATCC CCGAAGGCAA AGGCTACGGC GGCTTCCCCG TGTCCGGCCT

801 GTTCTTCCGC AACAGCAACC CCGAAACCGC CGAACAACAC AACGCCAAAG

851 TGTACGGGCA GGCTTCCGTC GGCGCGCCGC CGATGTCCGT CCCGCACCTC

901 GACACACGCA ACGTGGACGG CAAACGCCAC CTTATGTTCG GCCCTTACGC

951 AGGCTTCCGT TCCAACTTCC TCAAGCAAGG CTCGCTTATG GATTTGCCGC
```

-continued

```
1001 TGTCCATCCA TATGGACAAC CTCTATCCTA TGCTGTGCGC CGGCTGGGCG

1051 AATATGCCGC TGACCAAA...
```

This corresponds to the amino acid sequence <SEQ ID 688; ORF 165>:

m165.pep (partial)

```
  1 MAEATDVVLV GGGIMSATLG VLLKELEPSW EITLIERLED VALESSNAWN

 51 NAGTGHSALC ELNYAPLGAN GIIDPARALN IAEQFNVSRQ FWATLVAEGK

101 LEDNSFINAV PHMSLVMNED HCSYLQKRYD AFKTQKLFEN MEFSTDRNKI

151 SDWAPLMMRG RDENQPVAAN YSAEGTDVDF GRLTRQMVKY LQGKGVKTEF

201 NRHVEDIKRE SDGAWVLKTA DTRNPDGQLT LRTRFLFLGA GGGALTLLQK

251 SGIPEGKGYG GFPVSGLFFR NSNPETAEQH NAKVYGQASV GAPPMSVPHL

301 DTRNVDGKRH LMFGPYAGFR SNFLKQGSLM DLPLSIHMDN LYPMLCAGWA

351 NMPLTK...
```

Computer analysis of this amino acid sequence gave the following results:

Homology with a predicted ORF from *N. gonorrhoeae* m165/g165 97.2% identity in 356 aa overlap

```
                   10        20        30        40        50        60
m165.pep   MAEATDVVLVGGGIMSATLGVLLKELEPSWEITLIERLEDVALESSNAWNNAGTGHSALC
           ||||||||||||||||||||||||||||||||||||||||||||||||||||||||||||
g165       MAEATDVVLVGGGIMSATLGVLLKELEPSWEITLIERLEDVALESSNAWNNAGTGHSALC
                   10        20        30        40        50        60

                   70        80        90       100       110       120
m165.pep   ELNYAPLGANGIIDPARALNIAEQFHVSRQFWATLVAEGKLEDNSFINAVPHMSLVMNED
           |||||||||:|:|:||||||||||||||||||||||||||||||||||||||||||||||
g165       ELNYAPLGADGVINPARALNIAEQFHVSRQFWATLVAEGKLEDNSFINAVPHMSLVMNED
                   70        80        90       100       110       120

                  130       140       150       160       170       180
m165.pep   HCSYLQKRYDAFKTQKLFENMEFSTDRNKISDWAPLMMRGRDENQPVAANYSAEGTDVDF
           || |||||||:|||||||||||||||||||||||||:|||||||||||||||||||||||
g165       HCRYLQKRYDVFKTQKLFENMEFSTDRNKISDWAPLIMRGRDENQPVAANYSAEGTDVDF
                  130       140       150       160       170       180

                  190       200       210       220       230       240
m165.pep   GRLTRQMVKYLQGKGVKTEFNRHVEDIKRESDGAWVLKTADTRNPDGQLTLRTRFLFLGA
           |||||||||||||||||||||||||||||||||||||||||||||| |||||||||||||
g165       GRLTRQMVKYLQGKGVKTEFNRHVEDIKRESDGAWVLKTADTRNPDWQLTLRTRFLFLGA
                  190       200       210       220       230       240

                  250       260       270       280       290       300
m165.pep   GGGALTLLQKSGIPEGKGYGGFPVSGLFFRNSNPETAEQHNAKVYGQASVGAPPMSVPHL
           |||||||||||||||||||||:||||||||||||||||||||||||||||||||||||||
g165       GGGALTLLQKSGIPEGKGYGGLPVSGLFFRNSNPETAEQHNAKVYGQASVGAPPMSVPHL
                  250       260       270       280       290       300

                  310       320       330       340       350
m165.pep   DTRNVDGKRHLMFGPYAGFRSNFLKQGSLMDLPLSIHMDNLYPMLCAGWANMPLTK
           ||||||||||||||||||||||||||||:|||||||||||||||| ||||||||||
g165       DTRNVDGKRHLMFGPYAGFRSNFLKQGSFMDLPLSIHMDNLYPMLRAGWANMPLTKYLLG
                  310       320       330       340       350       360

g165       ELRX
```

The following partial DNA sequence was identified in *N. meningitidis* <SEQ ID 689>:

a165.seq

1 ATGGCTGAAG CGACAGACGT TGTCTTGGTG GGCGGCGGCA TTATGAGCGC
51 GACTTTGGGC GTTTTGCTCA AAGAACTCGA ACCGTCTTGG GAAATCACCC
101 TGATTGAACG CTTGGAAGAT GTGGCGTTGG AATCGTCAAA CGCGTGGAAC
151 AACGCCGGCA CGGGGCATTC CGCGCTGTGC GAATTGAACT ATGCGCCGTT
201 GGGTGCAAAT GGGATTATCG ATCCGGCGCG CGCCCTCAAT ATTGCCGAAC
251 AGTTTCATGT CAGCCGCCAG TTTTGGGCGA CGTTGGTCGC GGAAGGCAAG
301 TTGGAAGACA ATTCCTTCAT CAATGCCGTG CCGCATATGT CTTTGGTGAT
351 GAATGAAGAC CATTGTTCTT ATCTTCAAAA ACGTTATGAC GCGTTTAAAA
401 CCCAAAAACT TTTTGAAAAT ATGGAATTTT CCACCGATCG GAACAAAATT
451 TCCGATTGGG CTCCGCTGAT GATGCGCGGC CGGGACGAAA ACCAACCCGT
501 CGCCGCCAAC TACTCCGCCG AAGGCACGGA TGTCGATTTC GGACGGCTGA
551 CGCGCCAAAT GGTGAAATAT TTGCAGGGCA AGGGCGTAAA AACCGAGTTC
601 AACCGCCACG TCGAAGACAT CAAACGCGAA TCCGACGGCG CGTGGGTGCT
651 CAAAACCGCC GATACCCGCA ACCCCGACGG GCAGCTCACC CTCCGTACCC
701 GCTTCCTCTT CCTCGGCGCG GGCGGCGGCG CGCTGACCCT GCTGCAAAAA
751 TCCGGCATCC CCGAAGGCAA AGGCTACGGT GGCTTTCCCG TGTCCGGCCT
801 GTTCTTCCGC AACAGCAACC CCGAAACCGC CGAACAACAC AACGCCAAAG
851 TGTACGGGCA GGCTTCCGTC GGCGCGCCGC CGATGTCCGT CCCGCACCTC
901 GACACACGCA ACGTGGACGG CAAACGCCAC CTTATGTTCG GCCCTTACGC
951 AGGCTTCCGT TCCAACTTCC TCAAGCAAGG CTCACTTATG GATTTGCCGC
1001 TGTCCATCCA TATGGACAAC CTCTATCCTA TGCTGCGCGC CGGCTGGGCG
1051 AATATGCCGC TGACCAAATA CCTGCTGGGC GAATTGCGTA AAACCAAAGA
1101 AGAACGCTTC GCCTCCCTGC TGGAATACTA CCCCGAGGCA AACCCCGACG
1151 ACTGGGAACT CATCACCGCA GGGCAACGCG TTCAAATCAT TAAAAAAGAC
1201 TCCGAAAAAG GCGGCGTGTT GCAGTTTGGT ACGGAGATTG TCGCACACGC
1251 CGACGGCTCG CTCGCCGCAT TGCTGGGCGC GTCGCCGGGC GCATCGACCG
1301 CCGTGCCGCT GATGATCCGG CTGATGCACC AATGCTTCCC CGAACGCACC
1351 CCGTCTTGGG AAGGCCGTCT GAAAGAGCTG GTACCGGGTT ACGGCATCAA
1401 GTTGAACGAA AACCCCGAAA GGGCGGATGA AATTATCGCC TATACCGCGA
1451 AAGTGTTGGA TATTTAA

This corresponds to the amino acid sequence <SEQ ID 690; ORF 165.a>:

a165.pep

1 MAEATDVVLV GGGIMSATLG VLLKELEPSW EITLIERLED VALESSNAWN
51 NAGTGHSALC ELNYAPLGAN GIIDPARALN IAEQFHVSRQ FWATLVAEGK
101 LEDNSFINAV PHMSLVMNED HCSYLQKRYD AFKTQKLFEN MEFSTDRNKI
151 SDWAPLMMRG RDENQPVAAN YSAEGTDVDF GRLTRQMVKY LQGKGVKTEF
201 NRHVEDIKRE SDGAWVLKTA DTRNPDGQLT LRTRFLFLGA GGGALTLLQK

-continued

```
251 SGIPEGKGYG GFPVSGLFFR NSNPETAEQH NAKVYGQASV GAPPMSVPHL

301 DTRNVDGKRH LMFGPYAGFR SNFLKQGSLM DLPLSIHMDN LYPMLRAGWA

351 NMPLTKYLLG ELRKTKEERF ASLLEYYPEA NPDDWELITA GQRVQIIKKD

401 SEKGGVLQFG TEIVAHADGS LAALLGASPG ASTAVPLMIR LMHQCFPERT

451 PSWEGRLKEL VPGYGIKLNE NPERADEIIA YTAKVLDI*
```

m165/a165 99.7% identity in 356 aa overlap

```
                  10        20        30        40        50        60
m165.pep  MAEATDVVLVGGGIMSATLGVLLKELEPSWEITLIERLEDVALESSNAWNNAGTGHSALC
          ||||||||||||||||||||||||||||||||||||||||||||||||||||||||||||
a165      MAEATDVVLVGGGIMSATLGVLLKELEPSWEITLIERLEDVALESSNAWNNAGTGHSALC
                  10        20        30        40        50        60

                  70        80        90       100       110       120
m165.pep  ELNYAPLGANGIIDPARALNIAEQFHVSRQFWATLVAEGKLEDNSFINAVPHMSLVMNED
          ||||||||||||||||||||||||||||||||||||||||||||||||||||||||||||
a165      ELNYAPLGANGIIDPARALNIAEQFHVSRQFWATLVAEGKLEDNSFINAVPHMSLVMNED
                  70        80        90       100       110       120

                 130       140       150       160       170       180
m165.pep  HCSYLQKRYDAFKTQKLFENMEFSTDRNKISDWAPLMMRGRDENQPVAANYSAEGTDVDF
          ||||||||||||||||||||||||||||||||||||||||||||||||||||||||||||
a165      HCSYLQKRYDAFKTQKLFENMEFSTDRNKISDWAPLMMRGRDENQPVAANYSAEGTDVDF
                 130       140       150       160       170       180

                 190       200       210       220       230       240
m165.pep  GRLTRQMVKYLQGKGVKTEFNRHVEDIKRESDGAWVLKTADTRNPDGQLTLRTRFLFLGA
          ||||||||||||||||||||||||||||||||||||||||||||||||||||||||||||
a165      GRLTRQMVKYLQGKGVKTEFNRHVEDIKRESDGAWVLKTADTRNPDGQLTLRTRFLFLGA
                 190       200       210       220       230       240

                 250       260       270       280       290       300
m165.pep  GGGALTLLQKSGIPEGKGYGGFPVSGLFFRNSNPETAEQHNAKVYGQASVGAPPMSVPHL
          ||||||||||||||||||||||||||||||||||||||||||||||||||||||||||||
a165      GGGALTLLQKSGIPEGKGYGGFPVSGLFFRNSNPETAEQHNAKVYGQASVGAPPMSVPHL
                 250       260       270       280       290       300

                 310       320       330       340       350
m165.pep  DTRNVDGKRHLMFGPYAGFRSNFLKQGSLMDLPLSIHMDNLYPMLCAGWANMPLTK
          |||||||||||||||||||||||||||||||||||||||||||||| ||||||||||
a165      DTRNVDGKRHLMFGPYAGFRSNFLKQGSLMDLPLSIHMDNLYPMLRAGWANMPLTKYLLG
                 310       320       330       340       350       360


a165      ELRKTKEERFASLLEYYPEANPDDWELITAGQRVQIIKKDSEKGGVLQFGTEIVAHADGS
                 370       380       390       400       410       420
```

The following partial DNA sequence was identified in *N. gonorrhoeae* <SEQ ID 691>:

<u>g165-1. seq</u>

```
  1 ATGGCTGAAG CGACAGACGT TGTCTTGGTG GGCGGCGGCA TTATGAGCGC

 51 GACTTTGGGC GTTTTGCTCA AAGAACTCGA ACCGTCTTGG GAAATCACCC

101 TGATTGAACG CTTGGAagat gTGGCGTTGG AATCGTCAAA cGCGTGGAAC

151 AACGcCGgca CGGGGCATTC CGcGCTGTGc GAATTGAACT AtgcgccGCT

201 GGGtgcggac ggcgtcatCA ATCCGGCGCg cgCCCTGAAT ATTGCCGAAC

251 AGTTTCATGT CAGCCGCCAG TTTTGGGcga cgctggTCGC GGAAGGCAAG

301 TTGGAAGACA ATTCCTTCAT CAATGCCGTG CCGCATATGT CTTTGGTGAT

351 GAACGAAGAC CACTGCCGTT ACCTGCAAAA ACGCTATGAT GTGTTTAAAA

401 CGCAGAAACT TTTTGAAAAT ATGGAATTTT CCACCGATCG GAACAAAATT

451 TCCGATTGGG CtccgCTGAT TATGCGCGGC CGGGACGAAA ACCAACCCGT
```

-continued

```
 501 CGCCGCCAAC TATTCCGCCG AAGGCACGGA TGTCGATTTC GGACGGCTGA
 551 CGCGCCAGAT GGTGAAATAT TTGCAGGGCA AGGGCGTAAA AACCGAGTTC
 601 AACCGCCACG TCGAAGACAT CAAACGCGAA TCCGACGGCG CGTGGGTGCT
 651 CAAAACCGCC GATACCCGCA ACCCAGACTG GCAGCTCACC CTCCGCACCC
 701 GCTTCCTCTT CCTCGGCGCG GGCGGCGGCG CACTGACCCT GCTGCAAAAA
 751 TCCGGCATCC CCGAAGGCAA AGGCTACGGC GGCTTACCCG TGTCCGGCCT
 801 GTTCTTCCGC AACAGCAACC CCGAAACCGC CGAACAACAC AACGCCAAAG
 851 TGTACGGGCA GGCTTCCGTC GGCGCGCCGC CGATGTCCGT CCCGCACCTC
 901 GACACACGCA ACGTAGACGG CAAACGACAC CTTATGTTCG GTCCTTACGC
 951 AGGTTTCCGT TCCAACTTCC TCAAGCAAGG CTCGTTTATG GATTTGCCGC
1001 TGTCCATCCA TATGGACAAC CTCTATCCTA TGCTGCGCGC CGGCTGGGCG
1051 AATATGCCGC TGACCAAATA CCTGCTGGGC GAATTGCGTA AAACCAAAGA
1101 AGAACGCTtt gCCTCCCTGC TGgaatacta cccGaggcag acccGACGAc
1151 tggtactcat cacgcaggnc acGCGTcata tcattanata tgactCgaaa
1201 ctgcgcgtgc tgcagttgta cgagattgtg ccaCGCGacg ctcgctcgcg
1251 cattctggag cgtcgcggcg catcacgctn tgcgctgata tccgctgatg
1301 acactgctcc gaGCGcgccc gtcttggaaa gtgtctga
```

This corresponds to the amino acid sequence <SEQ ID 692; ORF 165-1.ng>:

g165-1.pep

```
  1 MAEATDVVLV GGGIMSATLG VLLKELEPSW EITLIERLED VALESSNAWN
 51 NAGTGHSALC ELNYAPLGAD GVINPARALN IAEQFHVSRQ FWATLVAEGK
101 LEDNSFINAV PHMSLVMNED HCRYLQKRYD VFKTQKLFEN MEFSTDRNKI
151 SDWAPLIMRG RDENQPVAAN YSAEGTDVDF GRLTRQMVKY LQGKGVKTEF
201 NRHVEDIKRE SDGAWVLKTA DTRNPDWQLT LRTRFLFLGA GGGALTLLQK
251 SGIPEGKGYG GLPVSGLFFR NSNPETAEQH NAKVYGQASV GAPPMSVPHL
301 DTRNVDGKRH LMFGPYAGFR SNFLKQGSFM DLPLSIHMDN LYPMLRAGWA
351 NMPLTKYLLG ELRKTKEERF ASLLEYYPRQ TRRLVLITQX TRHIIXYDSK
401 LRVLQLYEIV PRDARSRILE RRGASRXALI SADDTAPSAP VLESV*
```

The following partial DNA sequence was identified in *N. meningitidis* <SEQ ID 693>:

m165-1.seq

```
  1 ATGGCTGAAG CGACAGACGT TGTCTTGGTG GGCGGCGGCA TTATGAGCGC
 51 GACTTTGGGC GTTTTGCTCA AAGAACTCGA ACCGTCTTGG GAAATCACCC
101 TGATTGAACG CTTGGAAGAT GTGGCGTTGG AATCGTCAAA CGCGTGGAAC
151 AACGCCGGCA CGGGGCATTC CGCGCTGTGC GAATTGAACT ATGCGCCGTT
201 GGGTGCAAAT GGGATTATCG ATCCGGCGCG CGCCCTCAAT ATTGCCGAAC
```

-continued

```
 251 AGTTTCATGT CAGCCGCCAG TTTTGGGCGA CGCTGGTCGC GGAAGGCAAG
 301 TTGGAAGACA ATTCCTTCAT CAATGCCGTG CCGCATATGT CTTTGGTGAT
 351 GAATGAAGAC CATTGTTCTT ATCTTCAAAA ACGTTATGAC GCGTTTAAAA
 401 CCCAAAAACT TTTTGAAAAT ATGGAATTTT CCACCGATCG GAACAAAATT
 451 TCCGATTGGG CTCCGCTGAT GATGCGCGGC CGGGACGAAA ACCAACCCGT
 501 CGCCGCCAAC TACTCCGCCG AAGGTACGGA TGTCGATTTC GGACGGCTGA
 551 CGCGCCAAAT GGTGAAATAT TTGCAGGGCA AGGGCGTAAA AACCGAGTTC
 601 AACCGCCACG TCGAAGACAT CAAACGCGAA TCCGACGGCG CGTGGGTGCT
 651 CAAAACCGCC GATACCCGCA ACCCCGACGG GCAGCTCACC CTCCGTACCC
 701 GCTTCCTCTT CCTCGGCGCG GGCGGCGGCG CGCTGACCCT GCTGCAAAAA
 751 TCCGGCATCC CCGAAGGCAA AGGCTACGGC GGCTTCCCCG TGTCCGGCCT
 801 GTTCTTCCGC AACAGCAACC CCGAAACCGC CGAACAACAC AACGCCAAAG
 851 TGTACGGGCA GGCTTCCGTC GGCGCGCCGC CGATGTCCGT CCCGCACCTC
 901 GACACACGCA ACGTGGACGG CAAACGCCAC CTTATGTTCG GCCCTTACGC
 951 AGGCTTCCGT TCCAACTTCC TCAAGCAAGG CTCGCTTATG GATTTGCCGC
1001 TGTCCATCCA TATGGACAAC CTCTATCCTA TGCTGTGCGC CGGCTGGGCG
1051 AATATGCCGC TGACCAAATA CCTGCTGGGC GAATTGCGTA AAACCAAAGA
1101 AGAACGCTTC GCCTCCCTGC TGGAATACTA CCCCGAGGCA AACCCCGACG
1151 ACTGGGAACT CATCACCGCA GGGCAACGCG TCCAAATCAT TAAAAAAGAC
1201 TCCGAAAAAG GCGGCGTGCT CCAGTTTGGT ACGGAGATTG TCGCCCACGC
1251 CGACGGCTCA CTCGCCGCAT TGCTGGGCGC GTCGCCGGGC GCATCGACCG
1301 CTGTGCCGCT GATGATCCGG CTGATGCACC AATGCTTCCC CGAGCGCGCC
1351 CCGTCTTGGG AAGACCGTCT GAAAGAGCTG GTACCGGGTT ACGGCATCAA
1401 GTTGAACGAA AACCCTGAAA GGGCGGATGA AATTATCGCC TATACCGCGA
1451 AAGTATTGGA TATTTAA
```

This corresponds to the amino acid sequence <SEQ ID 694; ORF 165-1>:

m165-1.pep

```
  1 MAEATDVVLV GGGIMSATLG VLLKELEPSW EITLIERLED VALESSNAWN
 51 NAGTGHSALC ELNYAPLGAN GIIDPARALN IAEQFHVSRQ FWATLVAEGK
101 LEDNSFINAV PHMSLVMNED HCSYLQKRYD AFKTQKLFEN MEFSTDRNKI
151 SDWAPLMMRG RDENQPVAAN YSAEGTDVDF GRLTRQMVKY LQGKGVKTEF
201 NRHVEDIKRE SDGAWVLKTA DTRNPDGQLT LRTRFLFLGA GGGALTLLQK
251 SGIPEGKGYG GFPVSGLFFR NSNPETAEQH NAKVYGQASV GAPPMSVPHL
301 DTRNVDGKRH LMFGPYAGFR SNFLKQGSLM DLPLSIHMDN LYPMLCAGWA
351 NMPLTKYLLG ELRKTKEERF ASLLEYYPEA NPDDWELITA GQRVQIIKKD
401 SEKGGVLQFG TEIVAHADGS LAALLGASPG ASTAVPLMIR LMHQCFPERA
451 PSWEDRLKEL VPGYGIKLNE NPERADEIIA YTAKVLDI*
```

m165-1/g165-1 89.7% identity in 428 aa overlap

```
                      10        20        30        40        50        60
m165-1.pep    MAEATDVVLVGGGIMSATLGVLLKELEPSWEITLIERLEDVALESSNAWNNAGTGHSALC
              ||||||||||||||||||||||||||||||||||||||||||||||||||||||||||||
g165-1        MAEATDVVLVGGGIMSATLGVLLKELEPSWEITLIERLEDVALESSNAWNNAGTGHSALC
                      10        20        30        40        50        60

                      70        80        90       100       110       120
m165-1.pep    ELNYAPLGANGIIDPARALNIAEQFHVSRQFWATLVAEGKLEDNSFINAVPHMSLVMNED
              |||||||||:|:|:||||||||||||||||||||||||||||||||||||||||||||||
g165-1        ELNYAPLGADGVINPARALNIAEQFHVSRQFWATLVAEGKLEDNSFINAVPHMSLVMNED
                      70        80        90       100       110       120

                     130       140       150       160       170       180
m165-1.pep    HCSYLQKRYDAFKTQKLFENMEFSTDRNKISDWAPLMMRGRDENQPVAANYSAEGTDVDF
              || |||||||:|||||||||||||||||||||||||:|||||||||||||||||||||||
g165-1        HCRYLQKRYDVFKTQKLFENMEFSTDRNKISDWAPLIMRGRDENQPVAANYSAEGTDVDF
                     130       140       150       160       170       180

                     190       200       210       220       230       240
m165-1.pep    GRLTRQMVKYLQGKGVKTEFNRHVEDIKRESDGAWVLKTADTRNPDGQLTLRTRFLFLGA
              |||||||||||||||||||||||||||||||||||||||||||||| |||||||||||||
g165-1        GRLTRQMVKYLQGKGVKTEFNRHVEDIKRESDGAWVLKTADTRNPDWQLTLRTRFLFLGA
                     190       200       210       220       230       240

                     250       260       270       280       290       300
m165-1.pep    GGGALTLLQKSGIPEGKGYGGFPVSGLFFRNSNPETAEQHNAKVYGQASVGAPPMSVPHL
              |||||||||||||||||||||:||||||||||||||||||||||||||||||||||||||
g165-1        GGGALTLLQKSGIPEGKGYGGLPVSGLFFRNSNPETAEQHNAKVYGQASVGAPPMSVPHL
                     250       260       270       280       290       300

                     310       320       330       340       350       360
m165-1.pep    DTRNVDGKRHLMFGPYAGFRSNFLKQGSLMDLPLSIHMDNLYPMLCAGWANMPLTKYLLG
              ||||||||||||||||||||||||||||:|||||||||||||||| ||||||||||||||
g165-1        DTRNVDGKRHLMFGPYAGFRSNFLKQGSFMDLPLSIHMDNLYPMLRAGWANMPLTKYLLG
                     310       320       330       340       350       360

                     370       380       390       400       410       420
m165-1.pep    ELRKTKEERFASLLEYYPEANPDDWELITAGQRVQIIKKDSEKGGVLQFGTEIVAHADGS
              ||||||||||||||||||: :     |||   | :||  || |  |||:   :   |  :
g165-1        ELRKTKEERFASLLEYYPR-QTRRLVLITQXTR-HIIXYDS-KLRVLQLYEIVRRDARSR
                     370       380        390         400       410

                     430       440       450       460       470       480
m165-1.pep    LAALLGASPGASTAVPLMIRLMHQCEPERTPSWEGRLKELVPGYGIKLNENPERADEIIA
              :    |||
g165-1        ILERRGASRXALISADDTAPSAPVLESVX
              420       430       440
```

The following partial DNA sequence was identified in *N. meningitidis* <SEQ ID 695>:

a165-1.seq

```
  1 ATGGCTGAAG CGACAGACGT TGTCTTGGTG GGCGGCGGCA TTATGAGCGC
 51 GACTTTGGGC GTTTTGCTCA AAGAACTCGA ACCGTCTTGG GAAATCACCC
101 TGATTGAACG CTTGGAAGAT GTGGCGTTGG AATCGTCAAA CGCGTGGAAC
151 AACGCCGGCA CGGGGCATTC CGCGCTGTGC GAATTGAACT ATGCGCCGTT
201 GGGTGCAAAT GGGATTATCG ATCCGGCGCG CGCCCTCAAT ATTGCCGAAC
251 AGTTTCATGT CAGCCGCCAG TTTTGGGCGA CGTTGGTCGC GGAAGGCAAG
301 TTGGAAGACA ATTCCTTCAT CAATGCCGTG CCGCATATGT CTTTGGTGAT
351 GAATGAAGAC CATTGTTCTT ATCTTCAAAA ACGTTATGAC GCGTTTAAAA
401 CCCAAAAACT TTTTGAAAAT ATGGAATTTT CCACCGATCG GAACAAAATT
451 TCCGATTGGG CTCCGCTGAT GATGCGCGGC CGGGACGAAA ACCAACCCGT
501 CGCCGCCAAC TACTCCGCCG AAGGCACGGA TGTCGATTTC GGACGGCTGA
551 CGCGCCAAAT GGTGAAATAT TTGCAGGGCA AGGGCGTAAA AACCGAGTTC
601 AACCGCCACG TCGAAGACAT CAAACGCGAA TCCGACGGCG CGTGGGTGCT
651 CAAAACCGCC GATACCCGCA ACCCCGACGG GCAGCTCACC CTCCGTACCC
701 GCTTCCTCTT CCTCGGCGCG GGCGGCGGCG CGCTGACCCT GCTGCAAAAA
751 TCCGGCATCC CCGAAGGCAA AGGCTACGGT GGCTTTCCCG TGTCCGGCCT
```

-continued

```
 801 GTTCTTCCGC AACAGCAACC CCGAAACCGC CGAACAACAC AACGCCAAAG

 851 TGTACGGGCA GGCTTCCGTC GGCGCGCCGC CGATGTCCGT CCCGCACCTC

 901 GACACACGCA ACGTGGACGG CAAACGCCAC CTTATGTTCG GCCCTTACGC

 951 AGGCTTCCGT TCCAACTTCC TCAAGCAAGG CTCACTTATG GATTTGCCGC

1001 TGTCCATCCA TATGGACAAC CTCTATCCTA TGCTGCGCGC CGGCTGGGCG

1051 AATATGCCGC TGACCAAATA CCTGCTGGGC GAATTGCGTA AAACCAAAGA

1101 AGAACGCTTC GCCTCCCTGC TGGAATACTA CCCCGAGGCA AACCCCGACG

1151 ACTGGGAACT CATCACCGCA GGGCAACGCG TTCAAATCAT TAAAAAAGAC

1201 TCCGAAAAAG GCGGCGTGTT GCAGTTTGGT ACGGAGATTG TCGCACACGC

1251 CGACGGCTCG CTCGCCGCAT TGCTGGGCGC GTCGCCGGGC GCATCGACCG

1301 CCGTGCCGCT GATGATCCGG CTGATGCACC AATGCTTCCC CGAACGCACC

1351 CCGTCTTGGG AAGGCCGTCT GAAAGAGCTG GTACCGGGTT ACGGCATCAA

1401 GTTGAACGAA AACCCCGAAA GGGCGGATGA AATTATCGCC TATACCGCGA

1451 AAGTGTTGGA TATTTAA
```

This corresponds to the amino acid sequence <SEQ ID 696; ORF 165-1.a>:

```
a165-1.pep

  1 MAEATDVVLV GGGIMSATLG VLLKELEPSW EITLIERLED VALESSNAWN

 51 NAGTGHSALC ELNYAPLGAN GIIDPARALN IAEQFHVSRQ FWATLVAEGK

101 LEDNSFINAV PHMSLVMNED HCSYLQKRYD AFKTQKLFEN MEFSTDRNKI

151 SDWAPLMMRG RDENQPVAAN YSAEGTDVDF GRLTRQMVKY LQGKGVKTEF

201 NRHVEDIKRE SDGAWVLKTA DTRNPDGQLT LRTRFLFLGA GGGALTLLQK

251 SGIPEGKGYG GFPVSGLFFR NSNPETAEQH NAKVYGQASV GAPPMSVPHL

301 DTRNVDGKRH LMFGPYAGFR SNFLKQGSLM DLPLSIHMDN LYPMLRAGWA

351 NMPLTKYLLG ELRKTKEERF ASLLEYYPEA NPDDWELITA GQRVQIIKKD

401 SEKGGVLQFG TEIVAHADGS LAALLGASPG ASTAVPLMIR LMHQCFPERT

451 PSWEGRLKEL VPGYGIKLNE NPERADEIIA YTAKVLDI*
```

a165-1/m165-1 99.4% identity in 488 aa overlap

```
                   10        20        30        40        50        60
a165-1.pep  MAEATDVVLVGGGIMSATLGVLLKELEPSWEITLIERLEDVALESSNAWNNAGTGHSALC
            ||||||||||||||||||||||||||||||||||||||||||||||||||||||||||||
m165-1      MAEATDVVLVGGGIMSATLGVLLKELEPSWEITLIERLEDVALESSNAWNNAGTGHSALC
                   10        20        30        40        50        60

                   70        80        90       100       110       120
a165-1.pep  ELNYAPLGANGIIDPARALNIAEQFHVSRQFWATLVAEGKLEDNSFINAVPHMSLVMNED
            ||||||||||||||||||||||||||||||||||||||||||||||||||||||||||||
m165-1      ELNYAPLGANGIIDPARALNIAEQFHVSRQFWATLVAEGKLEDNSFINAVPHMSLVMNED
                   70        80        90       100       110       120

                  130       140       150       160       170       180
a165-1.pep  HCSYLQKRYDAFKTQKLFENMEFSTDRNKISDWAPLMMRGRDENQPVAANYSAEGTDVDF
            ||||||||||||||||||||||||||||||||||||||||||||||||||||||||||||
m165-1      HCSYLQKRYDAFKTQKLFENMEFSTDRNKISDWAPLMMRGRDENQPVAANYSAEGTDVDF
                  130       140       150       160       170       180
```

-continued

```
               190       200       210       220       230       240
a165-1.pep  GRLTRQMVKYLQGKGVKTEFNRHVEDIKRESDGAWVLKTADTRNPDGQLTLRTRFLFLGA
            ||||||||||||||||||||||||||||||||||||||||||||||||||||||||||||
m165-1      GRLTRQMVKYLQGKGVKTEFNRHVEDIKRESDGAWVLKTADTRNPDGQLTLRTRFLFLGA
               190       200       210       220       230       240

               250       260       270       280       290       300
a165-1.pep  GGGALTLLQKSGIPEGKGYGGFPVSGLFFRNSNPETAEQHNAKVYGQASVGAPPMSVPHL
            ||||||||||||||||||||||||||||||||||||||||||||||||||||||||||||
m165-1      GGGALTLLQKSGIPEGKGYGGFPVSGLFFRNSNPETAEQHNAKVYGQASVGAPPMSVPHL
               250       260       270       280       290       300

               310       320       330       340       350       360
a165-1.pep  DTRNVDGKRHLMFGPYAGFRSNFLKQGSLMDLPLSIHMDNLYPMLRAGWANMPLTKYLLG
            |||||||||||||||||||||||||||||||||||||||||||||| |||||||||||||
m165-1      DTRNVDGKRHLMFGPYAGFRSNFLKQGSLMDLPLSIHMDNLYPMLCAGWANMPLTKYLLG
               310       320       330       340       350       360

               370       380       390       400       410       420
a165-1.pep  ELRKTKEERFASLLEYYPEANPDDWELITAGQRVQIIKKDSEKGGVLQFGTEIVAHADGS
            ||||||||||||||||||||||||||||||||||||||||||||||||||||||||||||
m165-1      ELRKTKEERFASLLEYYPEANPDDWELITAGQRVQIIKKDSEKGGVLQFGTEIVAHADGS
               370       380       390       400       410       420

               430       440       450       460       470       480
a165-1.pep  LAALLGASPGASTAVPLMIRLMHQCEPERTPSWEGRLKELVPGYGIKLNENPERADEIIA
            |||||||||||||||||||||||||||||:|||| |||||||||||||||||||||||||
m165-1      LAALLGASPGASTAVPLMIRLMHQCFPERAPSWEDRLKELVPGYGIKLNENPERADEIIA
               430       440       450       460       470       480

                    489
a165-1.pep  YTAKVLDIX
            |||||||||
m165-1      YTAKVLDIX
```

a165-1/p33940 sp|P33940|YOJH_ECOLI HYPOTHETICAL 60.2 KD PROTEIN IN ECO-ALKB INTERGENIC REGION >gi|1736851|gnl|PID|d1016718 (D90850) ORF_ID: o372#5; similar to [SwissProt Accession Number P33940] [*Escherichia coli*] >gi|1788539 (AE000310) f548; This 548 aa ORF is 100 pct identical to 490 residues of YOJH_ECOLI SW: P33940 (492 aa) but contains 56 additional N-ter aa; 100 pct identical to GB: ECOHU49_33 ACCESSION: U00008 (490 aa) but contains 58 aditional N-term resi . . . Length=548

Score=458 bits (1167), Expect=e−128

Identities=233/490 (47%), Positives=303/490 (61%), Gaps=5/490 (1%)

```
Query:   3 EATDVVLVGGGIMSATLGVLLKELEPSWEITLIERLEDVALESSNAWNNAGTGHSALCEL 62
            + TDV+L+GGGIMSATLG  L+ELEP W +T++ERLE VA ESSN WNNAGTGHSAL EL
Sbjct:  30 QETDVLLIGGGIMSATLGTYLRELEPEWSMTMVERLEGVAQESSNGWNNAGTGHSALMEL 89

Query:  63 NYAPLGANGIIDPARALNIAEQFHVSRQFWATLVAEGKLED-NSFINAVPHMSLVMNEDH 121
           NY P  A+G I   +A+ I E F +SRQFWA  V  G L     SFIN VPHMS V  ED+
Sbjct:  90 NYTPQNADGSISIEKAVAINEAFQISRQFWAHQVERGVLRTPRSFINTVPHMSFVWGEDN 149

Query: 122 CSYLQKRYDAFKTQKLFENMEFSTDRNKISDWAPLMMRGRDENQPVAANYSAEGTDVDFG 181
            ++L+ RY A +    LF  M +S D  +I  30 WAPL+M GRD  Q VAA  +  GTDV++G
Sbjct: 150 VNFLRARYAALQQSSLFRGMRYSEDHAQIKEWAPLVMEGRDPQQKVAATRTEIGTDVNYG 209

Query: 182 RLTRQMVKYLQGKG-VKTEFNRHVEDIKRESDGAWVLKTADTRNPDGQLTXXXXXXXXXX 240
            +TRQ++  LQ K      + +  V  +KR  D  W +  AD +N    Q
Sbjct: 210 EITRQLIASLQKKSNFSLQLSSEVRALKRNDDNTWTVTVADLKNGTAQ-NIRAKFVFIGA 268

Query: 241 XXXXXXXXQKSGIPEGKGYGGFPVSGLFFRNSNPETAEQHNAKVYGQASVGAPPMSVPHL 300
                   Q+SGIPE K Y GFPV G F   + NP+     H AKVYG+ASVGAPPMSVPH+
Sbjct: 269 GGAALKLLQESGIPEAKDYAGFPVGGQFLVSENPDVVNHHLAKVYGKASVGAPPMSVPHI 328

Query: 301 DTRNVDGKRHLMFGPYAGFRSNFLKQGSLMDLPLSIHMDNLYPMLRAGWANMPLTKYLLG 360
           DTR +DGKR ++FGP+A F + FLK GSL DL  S    N+ PM+  G  N  L KYL+
Sbjct: 329 DTRVLDGKRVVLFGPFATFSTKFLKNGSLWDLMSSTTTSNVMPMMHVGLDNFDLVKYLVS 388

Query: 361 ELRKTKEERFASLLEYYPEANPDDWELITAGQRVQIIKKDSEKGGVLQFGTEIVXXXXXX 420
           ++  ++E+RF +L EYYP+A  +DW L  AGQRVQIIK+D+EKCCVL+ GTE+V
Sbjct: 389 QVMLSEEDRFEALKEYYPQAKKEDWRLWQAGQRVQIIKRDAEKGGVLRLGTEVVSDQQGT 448

Query: 421 XXXXXXXXXXXXXVPLMIRLMHQCFPER--TPSWEGRLKELVPGYGIKLNENPERADEI 478
                        P+M+ L+ + F +R  +P W+  LK +VP YG KLN +    +
Sbjct: 449 IAALLGASPGASTAAPIMLNLLEKVFGDRVSSPQWQATLKAIVPSYGRKLNGDVAATERE 508

Query: 479 IAYTAKVLDI 488
           + YT++VL +
Sbjct: 509 LQYTSEVLGL 518
```

The following partial DNA sequence was identified in *N. gonorrhoeae* <SEQ ID 697>:

g204.seq

```
  1 atggcggcgg cggaaataaa acgccccctc gctgtcgatt tccagcacat
 51 agcgtccgtt ctgcacggcg gcatagccgc ttttgcctgc ctgatagggt
101 tgcagggcgg aatgcgaaat caggtaatca gtcagtttgc cgccgtcttc
151 ggcgatattg cccaccagtt tggcaaacaa ggtatggcac acgccgtttt
201 ccgcccagcc cgaaggcgcg tcctttccgt cggtttccat acatttgccg
251 acgacggctt ccaagtcgtt gggatgcttt ccggtcagcc ggacggcgtt
301 ttgttccggc aagcctttaa tcggataact gatttgtttt ttgccgtcgt
351 tggttttgcc ttcgctactt tgtcccaaag ccaaaccggc aatcgccgta
401 ttgtcgatgt atttgacttt gaaaaccggt ttcggcgcgc tttgtgccgc
451 attttgcggc tgttccgccg tattttcgga tttgccgcag gcggcaagca
501 gcaggcagcc gcccaacacg gcaaaaggta ttttcagcat tccgcactcc
551 tgatggtttc aaaatgccgt ctgaaatgcc gtctgaaacg tggcaggcgg
601 aggttcggac ggcattgggt ttatttcaac gggcggatgc cgaccgcatc
651 gcgtacttta tccaacaatt cgcgcgcttc tttgcgcgct tttgcgcgc
701 ctgcctgcaa aatctcttcg atttgcgaag gattagaggt caatgcgttg
751 tag
```

This corresponds to the amino acid sequence <SEQ ID 698; ORF 204.ng>:

g204.pep

```
  1 MAAAEIKRPL AVDFQHIASV LHGGIAAFAC LIGLQGGMRN QVISQFAAVF
 51 GDIAHQFGKQ GMAHAVFRPA RRRVLSVGFH TFADDGFQVV GMLSGQPDGV
101 LFRQAFNRIT DLFFAVVGFA FATLSQSQTG NRRIVDVFDF ENRFRRALCR
151 ILRLFRRIFG FAAGGKQQAA AQHGKRYFQH SALLMVSKCR LKCRLKRGRR
201 RFGRHWVYFN GRMPTASRTL SNNSRASLRA FCAPACKISS ICEGLEVNAL
251 *
```

The following partial DNA sequence was identified in *N. meningitidis* <SEQ ID 699>:

m204.seq

```
  1 ATGGCGGCGG CGGAAATAAA ACGCCCCTTC GCTGTCGATT TCCAGCACAT
 51 AGCGTCCGTT CTGCACGGCG GCATAGCCGC TTTTGCCTGC CTGATAGGGT
101 TGCAGGGCGG CATGCGAAAC TAGGTAATCC GTCAGTTTGC CGCCGTCTTC
151 GGCGATATTG CCCACCAGTT TGGCAAACAA GGTATGGCAC ACGCCGTTTT
201 CTGCCCAACC TGCCGGACTG TCCTTATCAT CGGTTTCCAT ACATTTGCCG
251 CTGACGGCTT CCAAGTCGCC GGGATGCTTG CCGATCAGTC GGATAACATT
301 TTGTTCCGGC AAGCCTTTAA TCGGATAACT GATTTGTTTT TTGCCGTCGT
```

-continued

```
351 TGGTTTTGCC TTCGCTGCTT TGTCCCAAAT CCAAACCGGC AATCGCCGTA

401 TTGTCGATAT ATATGACTTT GAAAACCGGT TTCGGCGCGC TTTGTACCGC

451 GTTTTGCGGC TGTACCGCCG TATTTwCGGA TTTGCCGCaC GGCaArGCAG

501 CAGGCAGCCG CCCAATACGG CAAAArAwGT wTTCAGCATT CCACAyTCCT

551 GATGGTTTCA AAATGCCGTC TGAAACGCGG CAGGCGGAGG TTCGGACGGC

601 ATCGGGTTCA TTTCAACGGG CGGATGcCGA CCGCATCgGT ACTTTGTCCA

651 ATAATTCGCG TGCTTCTTTA CGCGCTTTCG CCGCGCCTGC CTGCAAAATC

701 TCTTCGATTT GCGAAGGGTC GGCGGTCAGC TCGTTGTAG
```

This corresponds to the amino acid sequence <SEQ ID 700; ORF 204>:

m204.pep

```
  1 MAAAEIKRPF AVDFQHIASV LHGGIAAFAC LIGLQGGMRN *VIRQFAAVF

 51 GDIAHQFGKQ GMAHAVFCPT CRTVLIIGFH TFAADGFQVA GMLADQSDNI

101 LFRQAFNRIT DLFFAVVGFA FAALSQIQTG NRRIVDIYDF ENRFRRALYR

151 VLRLYRRIXG FAATAXQQAA AQYGKXXXQH STXLMVSKCR LKRGRRRFGR

201 HRVHFNGRMP TASGTLSNNS RASLRAFAAP ACKISSICEG SAVSSL*
```

Computer analysis of this amino acid sequence gave the following results:

Homology with a predicted ORF from *N. gonorrhoeae*

ORF 204 shows 82.0% identity over a 250 aa overlap with a predicted ORF (ORF 204.ng) from *N. gonorrhoeae*:

m204/g204

```
                  10        20        30        40        50        60
m204.pep  MAAAEIKRPFAVDFQHIASVLHGGIAAFACLIGLQGGMRNXVIRQFAAVFGDIAHQFGKQ
          |||||||||:|||||||||||||||||||||||||||||| || ||||||||||||||||
g204      MAAAEIKRPLAVDFQHIASVLHGGIAAFACLIGLQGGMRNQVISQFAAVFGDIAHQFGKQ
                  10        20        30        40        50        60

                  70        80        90       100       110       120
m204.pep  GMAHAVFCPTCRTVLIIGFHTFAADGFQVAGMLADQSDNILFRQAFNRITDLFFAVVGFA
          ||||||| |: | || :|||||| |||||:|||: | |::||||||||||||||||||||
g204      GMAHAVFRPARRRVLSVGFHTFADDGFQVVGMLSGQPDGVLFRQAFNRITDLFFAVVGFA
                  70        80        90       100       110       120

                 130       140       150       160       170       180
m204.pep  FAALSQIQTGNRRIVDIYDFENRFRRALYRVLRLYRRIXGFAATAXQQAAAQYGKXXXQH
          ||:||| |||||||||::|||||||||| |:|||:||| |||| : ||||||:||   ||
g204      FATLSQSQTGNRRIVDVFDFENRFRRALCRILRLFRRIFGFAAGGKQQAAAQHGKRYFQH
                 130       140       150       160       170       180

                 190           200       210       220       230
m204.pep  STXLMVSKCRLK----RGRRRFGRHRVHFNGRMPTASGTLSNNSRASLRAFAAPACKISS
          |: |||||||||    ||||||||| |:||||||||| ||||||||||||| ||||||||
g204      SALLMVSKCRLKCRLKRGRRRFGRHWVYFNGRMPTASRTLSNNSRASLRAFCAPACKISS
                 190       200       210       220       230       240

        240
m204.pep  ICEGSAVSSLX
          ||||  |::|
g204      ICEGLEVNAL
                 250
```

The following partial DNA sequence was identified in *N. meningitidis* <SEQ ID 701>:

a204.seq

```
  1 ATGGCGGCGG CGGAAATAAA ACGCCCCCTC GCTGTCGATT TCCAGCACAT
 51 AGCGTCCGTT CTGCACGGCG GCATAGCCGC TTTTGCCTGC CTGATAGGGT
101 TGCAGGGCGG AATGCGAAAT CAGGTAATCC GTCAGTTTGC CGCCGTCTTC
151 GGCGATATTG CCCACCAGTT TGGCAAACAA GGTATGGCAC ACGCCGTTTG
201 CCGCCCAGCC CGAAGGCGCG CCCTTTCCGT CGGTTTCCAT ACATTTGCCG
251 ACGACGGCTT CCAAGTCGTT GGGATGCTTG CCGGTCAGCC GGACGACGTT
301 TTGTTCCGGC AAGCCTTT.. .......... .......... ..........
351 .......... .......... .......... .......... ..........
401 .......... .......... .......... .......... ..........
451 .......... .......... .......... .......... ..........
501 .......... .......... .......... .......... ..........
551 .......... .......... .......... .....AAGAG GTTCGGACGG
601 CATTGGGTTT ATTTCAACGG GCGGATACCG ACCGCATCAC GTACTTTGCC
651 CAATAATTCG CGTGCTTCTT TACGCGCTTT TTGCGCGCCT GCCTGCAAAA
701 TCTCTTCGAT TTGCGAAGGG TCGGCGGTCA GCTCGTTGTA G
```

This corresponds to the amino acid sequence <SEQ ID 702; ORF 204.a>:

a204.pep

```
  1 MAAAEIKRPL AVDFQHIASV LHGGIAAFAC LIGLQGGMRN QVIRQFAAVF
 51 GDIAHQFGKQ GMAHAVCRPA RRRALSVGFH TFADDGFQVV GMLAGQPDDV
101 LFRQAF.... .......... .......... .......... ..........
151 .......... .......... .......... .......... .....KRFGR
201 HWVYFNGRIP TASRTLPNNS RASLRAFCAP ACKISSICEG SAVSSL*
```

m204/a204 54.5% identity in 246 aa overlap

```
                   10        20        30        40        50        60
m204.pep   MAAAEIKRPFAVDFQHIASVLHGGIAAFACLIGLQGGMRNXVIRQFAAVFGDIAHQFGKQ
           |||||||||:||||||||||||||||||||||||||||||| ||||||||||||||||||
a204       MAAAEIKRPLAVDFQHIASVLHGGIAAFACLIGLQGGMRNQVIRQFAAVFGDIAHQFGKQ
                   10        20        30        40        50        60

                   70        80        90       100       110       120
m204.pep   GMAHAVFCPTCRTVLIIGFHTFAADGFQVAGMLADQSDNILFRQAFNRITDLFFAVVGFA
           ||||||  |: | :| :|||||| |||||:|||| | |::||||||
a204       GMAHAVCRPARRRALSVGFHTFADDGFQVVGMLAGQPDDVLFRQAF--------------
                   70        80        90       100

                  130       140       150       160       170       180
m204.pep   FAALSQIQTGNRRIVDIYDFENRFRRALYRVLRLYRRIXGFAATAXQQAAAQYGKXXXQH

a204       ------------------------------------------------------------

                  190       200       210       220       230       240
m204.pep   STXLMVSKCRLKRGRRRFGRHRVHFNGRMPTASGTLSNNSRASLRAFAAPACKISSICEG
                          :||||| |:||||:|||| || |||||||||| |||||||||||
a204       ---------------KRFGRHWVYFNGRIPTASRTLPNNSRASLRAFCAPACKISSICEG
                          110       120       130       140       150

m204.pep   SAVSSLX
           |||||||
a204       SAVSSLX
```

The following partial DNA sequence was identified in *N. gonorrhoeae* <SEQ ID 703>:

g205.seq

```
  1 atgctgaaaa taccttttgc cgtgttgggc ggctgcctgc tgcttgccgc
 51 ctgcggcaaa tccgaaaata cggcggaaca gccgcaaaat gcggcacaaa
101 gcgcgccgaa accggttttc aaagtcaaat acatcgacaa tacggcgatt
151 gccggtttgg ctttgggaca aagtagcgaa ggcaaaacca acgacggcaa
201 aaaacaaatc agttatccga ttaaaggctt gccggaacaa aacgccgtcc
251 ggctgaccgg aaagcatccc aacgacttgg aagccgtcgt cggcaaatgt
301 atggaaaccg acggaaagga cgcgccttcg ggctgggcgg aaaacggcgt
351 gtgccatacc ttgtttgcca aactggtggg caatatcgcc gaagacggcg
401 gcaaactgac tgattacctg atttcgcatt ccgccctgca accctatcag
451 gcaggcaaaa gcggctatgc cgccgtgcag aacggacgct atgtgctgga
501 aatcgacagc gagggggcgt tttatttccg ccgccgccat tattga
```

This corresponds to the amino acid sequence <SEQ ID 704; ORF 205.ng>:

g205.pep

```
  1 MLKIPFAVLG GCLLLAACGK SENTAEQPQN AAQSAPKPVF KVKYIDNTAI
 51 AGLALGQSSE GKTNDGKKQI SYPIKGLPEQ NAVRLTGKHP NDLEAVVGKC
101 METDGKDAPS GWAENGVCHT LFAKLVGNIA EDGGKLTDYL ISHSALQPYQ
151 AGKSGYAAVQ NGRYVLEIDS EGAFYFRRRH Y
```

The following partial DNA sequence was identified in *N. meningitidis* <SEQ ID 705>:

m205.seq

```
  1 ATGCTGAAwA CwTyTTTTGC CGTATTGGGC GGCTGCCTGC TGCyTtGCCG
 51 tGCGGCAAAT CCGwAAATAC GGCGGTACAG CCGCAAAACG CGGTACAAAG
101 CGCGCCGAAA CCGGTTTTCA AAGTCATATA TATCGACAAT ACGGCGATTG
151 CCGGTTTGGA TTTGGGACAA AGCAGCGAAG GCAAAACCAA CGACGGCAAA
201 AAACAAATCA GTTATCCGAT TAAAGGCTTG CCGGAACAAA ATGTTATCCG
251 ACTGATCGGC AAGCATCCCG GCGACTTGGA AGCCGTCAGC GGCAAATGTA
301 TGGAAACCGA TGATAAGGAC AGTCCGGCAG GTTGGGCAGA AAACGGCGTG
351 TGCCATACCT TGTTTGCCAA ACTGGTGGGC AATATCGCCG AAGACGGCGG
401 CAAACTGACG GATTACCTAG TTTCGCATGC CGCCCTGCAA CCCTATCAGG
451 CAGGCAAAAG CGGCTATGCC GCCGTGCAGA ACGGACGCTA TGTGCTGGAA
501 ATCGACAGCG AAGGGGCGTT TTATTTCCGC CGCCGCCATT ATTGA
```

This corresponds to the amino acid sequence <SEQ ID 706; ORF 205>:

m205.pep

```
  1 MLXTXFAVLG GCLLXCRCGK SXNTAVQPQN AVQSAPKPVF KVIYIDNTAI
 51 AGLDLGQSSE GKTNDGKKQI SYPIKGLPEQ NVIRLIGKHP GDLEAVSGKC
101 METDDKDSPA GWAENGVCHT LFAKLVGNIA EDGGKLTDYL VSHAALQPYQ
151 AGKSGYAAVQ NGRYVLEIDS EGAFYFRRRH Y*
```

Computer analysis of this amino acid sequence gave the following results:

Homology with a predicted ORF from *N. gonorrhoeae*

ORF 205 shows 88.4% identity over a 181 aa overlap with a predicted ORF (ORF 205.ng) from *N. gonorrhoeae*:

m205/g205

```
                    10        20        30        40        50        60
m205.pep    MLXTXFAVLGGCLLXCRCGKSXNTAVQPQNAVQSAPKPVFKVIYIDNTAIAGLDLGQSSE
            ||   |||||||||   |||| ||| |||||:|||||||||| |||||||||| ||||||
g205        MLKIPFAVLGGCLLLAACGKSENTAEQPQNAAQSAPKPVFKVKYIDNTAIAGLALGQSSE
                    10        20        30        40        50        60

                    70        80        90       100       110       120
m205.pep    GKTNDGKKQISYPIKGLPEQNVIRLIGKHPGDLEAVSGKCMETDDKDSPAGWAENGVCHT
            |||||||||||||||||||||::|| ||||:||||| ||||||| ||:|:||||||||||
g205        GKTNDGKKQISYPIKGLPEQNAVRLTGKHPNDLEAVVCKCMETDGKDAPSGWAENGVCHT
                    70        80        90       100       110       120

                   130       140       150       160       170       180
m205.pep    LFAKLVGNIAEDGGKLTDYLVSHAALQPYQAGKSGYAAVQNGRYVLEIDSEGAFYFRRRH
            ||||||||||||||||||||:||:||||||||||||||||||||||||||||||||||||
g205        LFAKLVGNIAEDGGKLTDYLISHSALQPYQAGKSGYAAVQNGRYVLEIDSEGAFYFRRRH
                   130       140       150       160       130       180

m205.pep    YX
            |
g205        Y
```

The following partial DNA sequence was identified in *N. meningitidis* <SEQ ID 707>:

a205.seq (partial)

```
  1 TCCGAACCTC TTAAAGGCTT GCCGGAACAA AACGTCGTCC GGCTGACCGG
 51 CAAGCATCCC AACGACTTGG AAGCCGTCGT CGGCAAATGT ATGGAAACCG
101 ACGGAAAGGG CGCGCCTTCG GGCTGGGCGG CAAACGGCGT GTGCCATACC
151 TTGTTTGCCA AACTGGTGGG CAATATCGCC GAAGACGGCG GCAAACTGAC
201 GGATTACCTG ATTTCGCATT CCGCCCTGCA ACCCTATCAG GCAGGCAAAA
251 GCGGCTATGC CGCCGTGCAG AACGGACGCT ATGTGCTGGA AATCGACAGC
301 GAGGGGGCGT TTTATTTCCG CCGCCGCCAT TATTGA
```

This corresponds to the amino acid sequence <SEQ ID 708; ORF 205.a>:

a205.pep (partial)

```
  1 SEPLKGLPEQ NVVRLTGKHP NDLEAVVGKC METDGKGAPS GWAANGVCHT
 51 LFAKLVGNIA EDGGKLTDYL ISHSALQPYQ AGKSGYAAVQ NGRYVLEIDS
101 EGAFYFRRRH Y*
```

m205/a205 88.3% identity in 111 aa overlap

```
                      50        60        70        80        90       100
m205.pep      KVIYIDNTAIAGLDLGQSSEGKTNDGKKQISYPIKGLPEQNVIRLIGKHPGDLEAVSGKC
                                            | |:||||||||:|| ||||:||||| |||
a205                                        SEPLKGLPEQNVVRLTGKHPNDLEAVVCKC
                                                      10        20        30

                     110       120       130       140       150       160
m205.pep      METDDKDSPAGWAENGVCHTLFAKLVGNIAEDGGKLTDYLVSHSHLQPYQAGKSGYAAVQ
              |||| | :|:||| ||||||||||||||||||||||||||:|||:|||||||||||||||
a205          METDGKGAPSGWAANGVCHTLFAKLVGNIAEDGGKLTDYLISHSALQPYQAGKSGYAAVQ
                      40        50        60        70        80        90

                     170       180
m205.pep      NGRYVLEIDSEGAFYFRRRHYX
              ||||||||||||||||||||||
a205          NGRYVLEIDSEGAFYFRRRHYX
                     100       110
```

The following partial DNA sequence was identified in *N. gonorrhoeae* <SEQ ID 709>:

g205-1.seq (partial)

```
  1 ATGCTGAAAA TAcCTTTTGC CGTGTTGGGC GGCTGCCTGC TGCTTGCCGC
 51 CTGCGGCAAA TCCGAAAATA CGGCGGAACA GCCGCAAAAT GCGGCACAAA
101 GCGCGCCGAA ACCGGTTTTC AAAGTCAAAT ACATCGACAA TACGGCGATT
151 GCCGGTTTGG CTTTGGGACA AAGTAGCGAA GGCAAAACCA ACGACGGCAA
201 AAAACAAATC AGTTATCCGA TTAAAGGCTT CCCGGAACAA AACGCCGTCC
251 GGCTGACCGG AAAGCATCCC AACGACTTGG AAGCCGTCGT CGGCAAATGT
301 ATGGAAACCG ACGGAAAGGA CGCGCCTTCG GGCTGGGCGG AAAACGGCGT
351 GTGCCATACC TTGTTTGCCA AACTGGTGGG CAATATCGCC GAAGACGGCG
401 GCAAACTGAC TGATTACCTG ATTTCGCATT CCGCCCTGCA ACCCTATCAG
451 GCAGGCAAAA GCGGCTATGC CGCCGTGCAG AACGGACGCT ATGTGCTGGA
501 AATCGACAGC GAGGGGGCGT TTTA
```

This corresponds to the amino acid sequence <SEQ ID 710; ORF 205-1.ng>:

g205-1.pep (partial).

```
  1 MLKIPFAVLG GCLLLAACGK SENTAEQPQN AAQSAPKPVF KVKYIDNTAI
 51 AGLALGQSSE GKTNDGKKQI SYPIKGLPEQ NAVRLTGKHP NDLEAVVGKC
101 METDGKDAPS GWAENGVCHT LFAKLVGNIA EDGGKLTDYL ISHSALQPYQ
151 AGKSGYAAVQ NGRYVLEIDS EGAF
```

The following partial DNA sequence was identified in *N. meningitidis* <SEQ ID 711>:

m205-1.seq..

```
  1 ATGCTGAAAA CATCTTTTGC CGTATTGGGC GGCTGCCTGC TGCTTGCCGC
 51 CTGCGGCAAA TCCGAAAATA CGGCGGAACA GCCGCAAAAC GCGGTACAAA
101 GCGCGCCGAA ACCGGTTTTC AAAGTCAAAT ATATCGACAA TACGGCGATT
151 GCCGGTTTGG ATTTGGGACA AAGCAGCGAA GGCAAAACCA ACGACGGCAA
```

-continued

```
201 AAAACAAATC AGTTATCCGA TTAAAGGCTT GCCGGAACAA AATGTTATCC

251 GACTGATCGG CAAGCATCCC GGCGACTTGG AAGCCGTCAG CGGCAAATGT

301 ATGGAAACCG ATGATAAGGA CAGTCCGGCA GGTTGGGCAG AAAACGGCGT

351 GTGCCATACC TTGTTTGCCA AACTGGTGGG CAATATCGCC GAAGACGGCG

401 GCAAACTGAC GGATTACCTA GTTTCGCATG CCGCCCTGCA ACCCTATCAG

451 GCAGGCAAAA GCGGCTATGC CGCCGTGCAG AACGGACGCT ATGTGCTGGA

501 AATCGACAGC GAAGGGGCGT TTTATTTCCG CCGCCGCCAT TATTGA
```

This corresponds to the amino acid sequence <SEQ ID 712; ORF 205-1>:

m205-1.pep

```
  1 MLKTSFAVLG GCLLLAACGK SENTAEQPQN AVQSAPKPVF KVKYIDNTAI

 51 AGLDLGQSSE GKTNDGKKQI SYPIKGLPEQ NVIRLIGKHP GDLEAVSGKC

101 METDDKDSPA GWAENGVCHT LFAKLVGNIA EDGGKLTDYL VSHAALQPYQ

151 AGKSGYAAVQ NGRYVLEIDS EGAFYFRRRH Y*
```

m205-1/g205-1 92.0% identity in 174 aa overlap

```
                    10        20        30        40        50        60
g205-1.pep  MLKIPFAVLGGCLLLAACGKSENTAEQPQNAAQSAPKPVFKVKYIDNTAIAGLALGQSSE
            |||  ||||||||||||||||||||||||||:|||||||||||||||||||||| ||||||
m205-1      MLKTSFAVLGGCLLLAACGKSENTAEQPQNVAQSAPKPVFKVKYIDNTAIAGLDLGQSSE
                    10        20        30        40        50        60

                    70        80        90       100       110       120
g205-1.pep  GKTNDGKKQISYPIKGLPEQNAVRLTGKHPNDLEAVVGKCMETDGKDAPSGWAENGVCHT
            ||||||||||||||||||||::|| ||||:||||| ||||||| ||:|:||||||||||
m205-1      GKTNDGKKQISYPIKGLPEQNVIRLIGKHPGDLEAVSGKCMETDDKDSPAGWAENGVCHT
                    70        80        90       100       110       120

                   130       140       150       160       170
g205-1.pep  LFAKLVGNIAEDGGKLTDYLISHSALQPYQAGKSGYAAVQNGRYVLEIDSEGAF
            ||||||||||||||||||||:||:||||||||||||||||||||||||||||||
m205-1      LFAKLVGNIAEDGGKLTDYLVSHAALQPYQAGKSGYAAVQNGRYVLEIDSEGAFYFRRRH
                   130       140       150       160       130       180

m205-1      YX
```

The following partial DNA sequence was identified in *N. meningitidis* <SEQ ID 713>:

a205-1.seq (partial)

```
  1 CCTCTTAAAG GCTTGCCGGA ACAAAACGTC GTCCGGCTGA CCGGCAAGCA

 51 TCCCAACGAC TTGGAAGCCG TCGTCGGCAA ATGTATGGAA ACCGACGGAA

101 AGGGCGCGCC TTCGGGCTGG GCGGCAAACG GCGTGTGCCA TACCTTGTTT

151 GCCAAACTGG TGGGCAATAT CGCCGAAGAC GGCGGCAAAC TGACGGATTA

201 CCTGATTTCG CATTCCGCCC TGCAACCCTA TCAGGCAGGC AAAAGCGGCT

251 ATGCCGCCGT GCAGAACGGA CGCTATGTGC TGGAAATCGA CAGCGAGGGG

301 GCGTTTTATT TCCGCCGCCG CCATTATTGA
```

This corresponds to the amino acid sequence <SEQ ID 714; ORF 205-1.a>:

<u>a205-1.pep (partial)</u>

```
  1 PLKGLPEQNV VRLTGKHPND LEAVVGKCME TDGKGAPSCW AANGVCHTLF

 51 AKLVGNIAED GGKLTDYLIS HSALQPYQAG KSGYAAVQNG RYVLEIDSEG

101 AFYFRRRHY*
```

m205-1/a205-1 89.0% identity in 109 aa overlap

```
                    50        60        70        80        90       100
m205-1.pep  KYIDNTAIAGLDLGQSSEGKTNDGKKQISYPIKGLPEQNVIRLIGKHPGDLEAVSGKCME
                                          |:||||||||:|| ||||:||||| |||||
a205-1                                    PLKGLPEQNVVRLTGKHPNDLEAVVCKCME
                                                  10        20        30

                   110       120       130       140       150       160
m205-1.pep  TDDKDSPAGWAENGVCHTLFAKLVGNIAEDGGKLTDYLVSHAALQPYQAGKSGYAAVQNG
            || | :|:||| ||||||||||||||||||||||||||:||:||||||||||||||||||
a205-1      TDGKGAPSGWAANGVCHTLFAKLVGNIAEDGGKLTDYLISHSALQPYQAGKSGYAAVQNG
                      40        50        60        70        80        90

                   170       180
m205-1.pep  RYVLEIDSEGAFYFRRRHYX
            ||||||||||||||||||||
a205-1      RYVLEIDSEGAFYFRRRHYX
                     100       110
```

The following partial DNA sequence was identified in *N. gonorrhoeae* <SEQ ID 715>:

<u>g206.seq</u>

```
  1 atgttttccc ccgacaaaac ccttttcctc tgtctcggcg cactgctcct

 51 cgcctcatgc ggcacgacct ccggcaaaca ccgccaaccg aaacccaaac

101 agacagtccg gcaaatccaa gccgtccgca tcagccacat cggccgcaca

151 caaggctcgc aggaactcat gctccacagc ctcggactca tcggcacgcc

201 ctacaaatgg ggcggcagca gcaccgcaac cggcttcgac tgcagcggca

251 tgattcaatt ggtttacaaa aacgccctca acgtcaagct gccgcgcacc

301 gcccgcgaca tggcggcggc aagccgcaaa atccccgaca gccgcctcaa

351 ggccggcgac atcgtattct tcaacaccgg cggcgcacac cgctactcac

401 acgtcggact ctacatcggc aacggcgaat tcatccatgc ccccggcagc

451 ggcaaaacca tcaaaaccga aaaactctcc acaccgtttt acgccaaaaa

501 ctaccttgga gcgcatacgt tttttacaga atga
```

This corresponds to the amino acid sequence <SEQ ID 716; ORF 206.ng>:

<u>g206.pep</u>

1 <u>MFSPDKTLFL CLGALLLASC GTTSG</u>KHRQP KPKQTVRQIQ AVRISHIGRT

51 QGSQELMLHS LGLIGTPYKW GGSSTATGFD CSGMIQLVYK NALNVKLPRT

101 ARDMAAASRK IPDSRLKAGD IVFFNTGGAH RYSHVGLYIG NGEFIHAPGS

151 GKTIKTEKLS TPFYAKNYLG AHTFFTE*

The following partial DNA sequence was identified in *N. meningitidis* <SEQ ID 717>:

```
m206.seq

  1 ATGTTTCCCC CCGACAAAAC CCTTTTCCTC TGTCTCAGCG CACTGCTCCT

 51 CGCCTCATGC GGCACGACCT CCGGCAAACA CCGCCAACCG AAACCCAAAC

101 AGACAGTCCG GCAAATCCAA GCCGTCCGCA TCAGCCACAT CGACCGCACA

151 CAAGGCTCGC AGGAACTCAT GCTCCACAGC CTCGGACTCA TCGGCACGCC

201 CTACAAATGG GGCGGCAGCA GCACCGCAAC CGGCTTCGAT TGCAGCGGCA

251 TGATTCAATT CGTTTACAAr AACGCCCTCA ACGTCAAGCT GCCGCGCACC

301 GCCCGCGACA TGGCGGCGGC AAGCCGsAAA ATCCCCGAcA GCCGCyTCAA

351 GGCCGGCGAC CTCGTATTCT TCAACACCGG CGGCGCACAC CGCTACTCAC

401 ACGTCGGACT CTACATCGGC AACGGCGAAT TCATCCATGC CCCCAGCAGC

451 GGCAAAACCA TCAAAACCGA AAAACTCTCC ACACCGTTTT ACGCCAAAAA

501 CTACCTCGGC GCACATACTT TTTTTACAGA ATGA
```

This corresponds to the amino acid sequence <SEQ ID 718; ORF 206>:

```
m206.pep..

  1 MFPPDKTLFL CLSALLLASC GTTSGKHRQP KPKQTVRQIQ AVRISHIDRT

 51 QGSQELMLHS LGLIGTPYKW GGSSTATGFD CSGMIQFVYK NALNVKLPRT

101 ARDMAAASRK IPDSRXKAGD LVFFNTGGAH RYSHVGLYIG NGEFIHAPSS

151 GKTIKTEKLS TPFYAKNYLG AHTFFTE*
```

Computer analysis of this amino acid sequence gave the following results:

Homology with a predicted ORF from *N. gonorrhoeae*

ORF 206 shows 96.0% identity over a 177 aa overlap with a predicted ORF (ORF 206.ng) from *N. gonorrhoeae*:

```
m206/g206
                 10         20         30         40         50         60
m206.pep  MFPPDKTLFLCLSALLLASCGTTSGKHRQPKPKQTVRQIQAVRISHIDRTQGSQELMLHS
          || |||||||||:||||||||||||||||||||||||||||||||||||| |||||||||
g206      MFSPDKTLFLCLGALLLASCGTTSGKHRQPKPKQTVRQIQAVRISHIGRTQGSQELMLHS
                 10         20         30         40         50         60

                 70         80         90        100        110        120
m206.pep  LGLIGTPYKWGGSSTATGFDCSGMIQFVYKNALNVKLPRTARDMAAASRKIPDSRXKAGD
          ||||||||||||||||||||||||||||:|||||||||||||||||||||||||||| |||
g206      LGLIGTPYKWGGSSTATGFDCSGMIQLVYKNALNVKLPRTARDMAAASRKIPDSRLKAGD
                 70         80         90        100        110        120

                130        140        150        160        170
m206.pep  LVFFNTGGAHRYSHVGLYIGNGEFIHAPSSGKTIKTEKLSTPFYAKNYLGAHTFFTEX
          :|||||||||||||||||||||||||||||:|||||||||||||||||||||||||||
g206      IVFFNTGGAHRYSHVGLYIGNGEFIHAPGSGKTIKTEKLSTPFYAKNYLGAHTFFTE
                130        140        150        160        130
```

The following partial DNA sequence was identified in *N. meningitidis* <SEQ ID 719>:

a206.seq

```
  1 ATGTTTCCCC CCGACAAAAC CCTTTTCCTC TGTCTCAGCG CACTGCTCCT

 51 CGCCTCATGC GGCACGACCT CCGGCAAACA CCGCCAACCG AAACCCAAAC

101 AGACAGTCCG GCAAATCCAA GCCGTCCGCA TCAGCCACAT CGACCGCACA

151 CAAGGCTCGC AGGAACTCAT GCTCCACAGC CTCGGACTCA TCGGCACGCC

201 CTACAAATGG GGCGGCAGCA GCACCGCAAC CGGCTTCGAT TGCAGCGGCA

251 TGATTCAATT CGTTTACAAA AACGCCCTCA ACGTCAAGCT GCCGCGCACC

301 GCCCGCGACA TGGCGGCGGC AAGCCGCAAA ATCCCCGACA GCCGCCTTAA

351 GGCCGGCGAC CTCGTATTCT TCAACACCGG CGGCGCACAC CGCTACTCAC

401 ACGTCGGACT CTATATCGGC AACGGCGAAT TCATCCATGC CCCCAGCAGC

451 GGCAAAACCA TCAAAACCGA AAAACTCTCC ACACCGTTTT ACGCCAAAAA

501 CTACCTCGGC GCACATACTT TCTTTACAGA ATGA
```

This corresponds to the amino acid sequence <SEQ ID 720; ORF 206.a>:

a206.pep

```
  1 MFPPDKTLFL CLSALLLASC GTTSGKHRQP KPKQTVRQIQ AVRISHIDRT

 51 QGSQELMLHS LGLIGTPYKW GGSSTATGFD CSGMIQFVYK NALNVKLPRT

101 ARDMAAASRK IPDSRLKAGD LVFFNTGGAH RYSHVGLYIG NGEFIHAPSS

151 GKTIKTEKLS TPFYAKNYLG AHTFFTE*
```

m206/a206 99.4% identity in 177 aa overlap

```
                   10        20        30        40        50        60
m206.pep   MFPPDKTLFLCLSALLLASCGTTSGKHRQPKPKQTVRQIQAVRISHIDRTQGSQELMLHS
           ||||||||||||||||||||||||||||||||||||||||||||||||||||||||||||
a206       MFPPDKTLFLCLSALLLASCGTTSGKHRQPKPKQTVRQIQAVRISHIDRTQGSQELMLHS
                   10        20        30        40        50        60

                   70        80        90       100       110       120
m206.pep   LGLIGTPYKWGGSSTATGFDCSGMIQFVYKNALNVKLPRTARDMAAASRKIPDSRXKAGD
           ||||||||||||||||||||||||||||||||||||||||||||||||||||||| ||||
a206       LGLIGTPYKWGGSSTATGFDCSGMIQFVYKNALNVKLPRTARDMAAASRKIPDSRLKAGD
                   70        80        90       100       110       120

                  130       140       150       160       170
m206.pep   LVFFNTGGAHRYSHVGLYIGNGEFIHAPSSGKTIKTEKLSTPFYAKNYLGAHTFFTEX
           ||||||||||||||||||||||||||||||||||||||||||||||||||||||||||
a206       LVFFNTGGAHRYSHVGLYIGNGEFIHAPSSGKTIKTEKLSTPFYAKNYLGAHTFFTEX
                  130       140       150       160       170
```

The following partial DNA sequence was identified in *N. gonorrhoeae* <SEQ ID 721>:

g209.seq

```
  1 atgctgcggc atttaggaaa cgacttcgcc ttgggcgcgt tgtttttcga

 51 tgctgcggtt gatgtgccac tgctgggcga tggtcaggag gttgttgacc

101 acccagtaga gaaccaaacc ggcagggaag aagaagaaca tgacggagaa

151 aaccaacggc atgattttca tcattttcgc ctgcatcggg tcggtcggcg

201 gcgggttcag ataggtttgg gcgaacatcg ttgccgccat aatgatgggc
```

-continued

```
251 aggatgtagt aggggtcggc gcggctgagg tcggtaatcc agcccagcca
301 aggtgcctgg cgcaattcta cggaggcgaa caatgcccag tacaagccga
351 tgaagacggg gatttgcaac agcataggca gacagccgcc cagcgggttg
401 atttcctcgt cttcgaaaag ctgcatcatc gcttgctgtt gcgccatacg
451 gtcgtcgccg tatttttctt tgatggtctg cagttcgggt gcggcggcac
501 gcattttcgc catcgaacgg taggaggcgt tggtcaatgg atacagtacg
551 gctttgacga tgatggtcaa aacgacgatt gcccagcccc agttgccgat
601 aatgttgtgc agttggttca ggagccagaa gagcggcgat gcgaaccagt
651 gtactttacc gtagtctttt gccagttgca ggttgtcggc gatgtttgcg
701 ataacggatg tggtttgcgg accggcatac aggttgaccg ccattttcgg
751 ttttggcccc cgggttggga tagcggttaa
```

This corresponds to the amino acid sequence <SEQ ID 722; ORF 209.ng>:

g209.pep

```
  1 MLRHLGNDFA LGALFFDAAV DVPLLGDGQE VVDHPVENQT GREEEEHDGE
 51 NQRHDFHHFR LHRVGRRRVQ IGLGEHRCRH NDGQDVVGVG AAEVGNPAQP
101 RCLAQFYGGE QCPVQADEDG DLQQHRQTAA QRVDFLVFEK LHHRLLLRHT
151 VVAVFFFDGL QFGCGGTHFR HRTVGGVGQW IQYGFDDDGQ NDDCPAPVAD
201 NVVQLVQEPE ERRCEPVYFT VVFCQLQVVG DVCDNGCGLR TGIQVDRHFR
251 FWPPGWDSG*
```

The following partial DNA sequence was identified in *N. meningitidis* <SEQ ID 723>:

m209.seq

```
  1 ATGCTGCGGC ATTTAGGAAA CGACTTCGCC TTGGgGCGTT GTTTTTCGAT
 51 GCTGCGGTTG ATGTGCCATT GCTGGGCGAT GGTCAGGAGG TTGTTGACTA
101 CCCAGTACAA TACCAGACCG GCAGGGAAGA AGAAGAACAT GACGGAGAAA
151 ACCAACGGCA TGATTTTCAT CATTTTCGCC TGCATCGGGT CGGTCGGCGG
201 CGGGTTCAGA TAAGTTTGGG CGAACATCGT TGCCGCCATA ATGATGGGCA
251 GGATGTAGTA GGGGTCGGCG CGGCTGAGGT CGGTAATCCA ACCCAGCCAA
301 GGTGCCTGGC GCAATTCTAC GGAGGCGAAC AATGCCCAAT ACAATCCGAT
351 GAAGACGGGG ATTTGCAACA GCATAGGCAG GCAGCCGCCC AGCGGGTTGA
401 TTTTCTCGTC TGTGTAAAGC TGCATCATCG CCTGTTGTTG CGCCATACGG
451 TCGTCGCCGT ATTTCTCTTT GATGGCTTGC AGTTTGGGTG CGGCGGCACG
501 CATTTTCGCC ATAGAGCGGT AAGAGGCGTT GGTCAATGGA TACAGTACGG
551 CTTTGACGAT GATGGTTAAA ACGATAATCG CCCAGCCCCA GTTGCCGATG
601 ATGTTGTGCA GTTGGTTCAG GAGCCAGAAG AGCGGGGAGG CGAACCAGTG
651 TACTTTGCCG TAGTCTTTGG CCAGTTGCAG GTTGTCGGCG ATGTTTGCGA
```

-continued

```
 701 TGACGGATGT GGTCTGCGGG CCGGCGTAGA GGTTGATGGA GGCTTCGgTT

 751 TCGCGCCGTT TTGGATGGCG GCTAAAGGCA CGCTGACGCT GGTGCTGTAC

 801 AGCTTGTCGT TGCGGCGTTT GATGTCGATG TTGCACTCGC CTGCGGCGCA

 851 AACGCTTTGT CTGCCTTTAG GTTGGAGAAT CCAGGTGGAC ATGAAGTGGT

 901 GTTCAATCAT GCCGAGCCAG CCGGTCGGGG TTTTGCGGAT GTATTCGGCC

 951 TCGGATTTGC CGGATTTGGC ATCGTCGTCC AAGTCGGAAA AGCTGACTTT

1001 TTGGAAGTTG CCTTCAGGGG TATAA
```

This corresponds to the amino acid sequence <SEQ ID 724; ORF 209>:

m209.pep

```
  1 MLRHLGNDFA LGALFFDAAV DVPLLGDGQE VVDYPVQYQT GREEEEHDGE

 51 NQRHDFHHFR LHRVGRRRVQ ISLGEHRCRH NDGQDVVGVG AAEVGNPTQP

101 RCLAQFYGGE QCPIQSDEDG DLQQHRQAAA QRVDFLVCVK LHHRLLLRHT

151 VVAVFLFDGL QFGCGGTHFR HRAVRGVGQW IQYGFDDDG* NDNRPAPVAD

201 DVVQLVQEPE ERGGEPVYFA VVFGQLQVVG DVCDDGCGLR AGVEVDGGFG

251 FAPFWMAAKG TLTLVLYSLS LRRLMSMLHS PAAQTLCLPL GWRIQVDMKW

301 CSIMPSQPVG VLRMYSASDL PDLASSSKSE KLTFWKLPSG V*
```

Computer analysis of this amino acid sequence gave the following results:

Homology with a predicted ORF from *N. gonorrhoeae*

ORF 209 shows 88.5% identity over a 253 aa overlap with a predicted ORF (ORF 209.ng) from *N. gonorrhoeae*:

m209/g209

```
                     10        20        30        40        50        60
m209.pep    MLRHLGNDFALGALFFDAAVDVPLLGDGQEVVDYPVQYQTGREEEEHDGENQRHDFHHFR
            |||||||||||||||||||||||||||||||||:||: ||||||||||||||||||||||
g209        MLRHLGNDFALGALFFDAAVDVPLLGDGQEVVDHPVENQTGREEEEHDGENQRHDFHHFR
                     10        20        30        40        50        60

                     70        80        90       100       110       120
m209.pep    LHRVGRRRVQISLGEHRCRHNDGQDVVGVGAAEVGNPTQPRCLAQFYGGEQCPIQSDEDG
            |||||||||||:|||||||||||||||||||||||||:|||||||||||||||:|:||||
g209        LHRVGRRRVQIGLGEHRCRHNDGQDVVGVGAAEVGNPAQPRCLAQFYGGEQCPVQADEDG
                     70        80        90       100       110       120

                    130       140       150       160       170       180
m209.pep    DLQQHRQAAAQRVDFLVCVKLHHRLLLRHTVVAVFLFDGLQFGCGGTHFRHRAVRGVGQW
            |||||||:|||||||||  ||||||||||||||||:||||||||||||||||:| |||||
g209        DLQQHRQTAAQRVDFLVFEKLHHRLLLRHTVVAVFFFDGLQFGCGGTHFRHRTVGGVGQW
                    130       140       150       160       170       180

                    190       200       210       220       230       240
m209.pep    IQYGFDDDGXNDNRPAPVADDVVQLVQEPEERGGEPVYFAVVFGQLQVVGDVCDDGCGLR
            ||||||||| ||: ||||||:|||||||||||  |||||:||| ||||||||||:|||||
g209        IQYGFDDDGQNDDCPAPVADNVVQLVQEPEERRCEPVYFTVVFCQLQVVGDVCDNGCGLR
                    190       200       210       220       230       240

                    250       260       270       280       290       299
m209.pep    AGVEVDGGFGF-APFWMAAKGTLTLVLYSLSLRRLMSMLHSPAAQTLCLPLGWRIQVDMK
            :|::||  | |  | |
g209        TGIQVDRHFRFWPPGWDSG
                    250
```

The following partial DNA sequence was identified in *N. meningitidis* <SEQ ID 725>:

a209.seq

```
   1 ATGCTGCGGC ATTTAGGAAA CGACTTCGCC TTGGGCGCGT TGTTTTTCGA
  51 TGCTGCGGTT GATGTGCCAT TGCTGGGCGA TGGTCAGGAG GTTGTTGATC
 101 ACCCAGTACA ATACCAGACC GGCAGGGAAG AAGAAGAACA TGACGGAGAA
 151 AACCAAAGGC ATGATTTTCA TCATTTTCGC CTGCATCGGG TCGGTCGGCG
 201 GCGGGTTCAG ATAGGTTTGG GCGAACATCG TTGCCGCCAT AATGATGGGC
 251 AGGATGTAGT AGGGGTCGGC GCGGCTGAGG TCGGTAATCC AACCCAGCCA
 301 AGGTGCCTGG CGCAATTCTA CGGAGGCGAA CAATGCCCAA TACAATCCGA
 351 TGAAGACGGG GATTTGCAAC AGCATAGGCA GGCAGCCGCC CAGCGGGTTG
 401 ATTTTCTCGT CTGTGTAAAG CTGCATCATG GCTTGTTGCT GCGCCATACG
 451 GTCGTCGCCG TATTTCTCTT TGATGGCTTG CAGTTTGGGC GCGGCGGCAC
 501 GCATTTTCGC CATCGAACGG TAAGAGGCGT TGGTCAATGG ATACAGTACG
 551 GCTTTGACGA TGATGGTTAA AACGATAATC GCCCAGCCCC AGTTGCCGAT
 601 GATGTTGTGC AGTTGGTTCA AAAGCCAAAA GAGGGGGGAG GCGAACCAGT
 651 GTACTTTGCC GTAGTCTTTG GCCAGTTGCA GGTTGTCGGC GATGTTTGCG
 701 ATAACGGATG TGGTCTGTGG GCCGGCGTAG AGGTTGATGG AGGCTTCGGT
 751 TTCGCACCGT TTTGGATAGC GGCTAAAGGC ACGCTGACGC TGGTGCTGTA
 801 CAGCTTGTCG TTGCGGCGTT TGATGTCGAT ACGGCAGTCG CCAGCGGCGC
 851 AAACGCTTTG TCCGCCTTTG GGTTGGAGGA TCCAGGTGGA CATGAAGTGG
 901 TGTTCAATCA TGCCGAGCCA GCCGGTCGGG GTTTTGCGGA TGTATTCGGC
 951 CTCGGATTTG CCGGATTTGG CATCGTCGTC CAAGTCGGAG AAGCTGACTT
1001 TTTGGAAGTT GCCTTCAGGG GTATAA
```

This corresponds to the amino acid sequence <SEQ ID 726; ORF 209.a>:

a209.pep

```
   1 MLRHLGNDFA LGALFFDAAV DVPLLGDGQE VVDHPVQYQT GREEEEHDGE
  51 NQRHDFHHFR LHRVGRRRVQ IGLGEHRCRH NDGQDVVGVG AAEVGNPTQP
 101 RCLAQFYGGE QCPIQSDEDG DLQQHRQAAA QRVDFLVCVK LHHGLLLRHT
 151 VVAVFLFDGL QFGRGGTHFR HRTVRGVGQW IQYGFDDDG* NDNRPAPVAD
 201 DVVQLVQKPK EGGGEPVYFA VVFGQLQVVG DVCDNGCGLW AGVEVDGGFG
 251 FAPFWIAAKG TLTLVLYSLS LRRLMSIRQS PAAQTLCPPL GWRIQVDMKW
 301 CSIMPSQPVG VLRMYSASDL PDLASSSKSE KLTFWKLPSG V*
```

m209/a209 95.6% identity in 341 aa overlap

```
                    10        20        30        40        50        60
m209.pep    MLRHLGNDFALGALFFDAAVDVPLLGDGQEVVDYPYQYQTGREEEEHDGENQRHDFHHFR
            |||||||||||||||||||||||||||||||||:||||||||||||||||||||||||||
a209        MLRHLGNDFALGALFFDAAVDVPLLGDGQEVVDHPVQYQTGREEEEHDGENQRHDFHHFR
                    10        20        30        40        50        60
```

-continued

```
                  70        80        90       100       110       120
m209.pep  LHRVGRRRVQISLGEHRCRHNDGQDVVGVGAAEVGNPTQPRCLAQFYGGEQCPIQSDEDG
          |||||||||||:||||||||||||||||||||||||||||||||||||||||||||||||
a209      LHRVGRRRVQIGLGEHRCRHNDGQDVVGVGAAEVGNPTQPRCLAQFYGGEQCRIQSDEDG
                  70        80        90       100       110       120

                 130       140       150       160       170       180
m209.pep  DLQQHRQAAAQRVDFLVCVKLHHRLLLRHTVVAVFLFDGLQFGCGGTHFRHRAVRGVGQW
          ||||||||||||||||||||||| ||||||||||||||||||| ||||||||:|||||||
a209      DLQQHRQAAAQRVDFLVCVKLHHGLLLRHTVVAVFLFDGLQFGRGGTHFRHRTVRGVGQW
                 130       140       150       160       170       180

                 190       200       210       220       230       240
m209.pep  IQYGFDDDGXNDNRPAPVADDVVQLVQEPEERGGEPVYFAVVFGQLQVVGDVCDDGCGLR
          |||||||||||||||||||||||||||:|:| ||||||||||||||||||||||:|||| 
a209      IQYGFDDDGXNDNRPAPVADDVVQLVQKPKEGGGEPVYFAVVFGQLQVVGDVCDNGCGLW
                 190       200       210       220       230       240
                 250       260       270       280       290       300
m209.pep  AGVEVDGGFGFAPFWMAAKGTLTLVLYSLSLRRLMSMLHSPAAQTLCLPLGWRIQVDMKW
          |||||||||||||||:||||||||||||||||||||: :|||||||| ||||||||||||
a209      AGVEVDGGFGFAPFWIAAKGTLTLVLYSLSLRRLMSIRQSPAAQTLCPPLGWRIQVDMKW
                 250       260       270       280       290       300
                 310       320       330       340
m209.pep  CSIMPSQPVGVLRMYSASDLPDLASSSKSEKLTFWKLPSGVX
          ||||||||||||||||||||||||||||||||||||||||||
a209      CSIMPSQPVGVLRMYSASDLPDLASSSKSEKLTFWKLPSGVX
                 310       320       330       340
```

The following partial DNA sequence was identified in *N. gonorrhoeae* <SEQ ID 727>:

g211.seq

```
  1 atgttgcgga ttgctgctgc caatcagttg ggcggtcgaa atggtgcggc
 51 ggtgggaaac ggggtcgata agtttgggcg tggtgctgat aatcaggttg
101 agtttttgga aggaaacctg attgtagtcg gcgcgtccgg gcgtgccgct
151 gtaacggtag ccgtggcgca attcgagcgt gcgtttgttg tccttcagcg
201 agaagttacc ttctttggcg aagatgatgt tgtcgccgcc gtttttgtcc
251 tgttcgcgca ggaacaggtt tttcatgatg ccggattcgg tgtcaaaggt
301 ttcgacgaaa taaaccctgc cgttgcgctt gcccaagtta ttgaactcgc
351 cggcttccac caaagacaat tcctgcttct gcttcaaaat ttcggcatat
401 tcgcggctgc gcagctctgc ccacggtatc acccaaagct gcatgacggc
451 aatcaggatg gcaaacggca cggcaaactg catgacgggg cgtatccact
501 gtttcaacgc caatccgcag gatag
```

This corresponds to the amino acid sequence <SEQ ID 728; ORF 211.ng>:

g211.pep

```
  1 MLRIAAANQL GGRNGAAVGN GVDKFGRGAD NQVEFLEGNL IVVGASGRAA
 51 VTVAVAQFER AFVVLQREVT FFGEDDVVAA VFVLFAQEQV FHDAGFGVKG
101 FDEINPAVAL AQVIELAGFH QRQFLLLLQN FGIFAAAQLC PRYHPKLHDG
151 NQDGKRHGKL HDGAYPLFQR QSAG*
```

The following partial DNA sequence was identified in *N. meningitidis* <SEQ ID 729>:

m211.seq

```
  1 ATGTTGCGGG TTGCTGCTGC CAATCAGTTG GGCGGTCGGA ATGGTACGGC

 51 GGTGGGAAAC GGGGTCGATG AGTTTGGGCG TGGTGCTGAT AATCAGGTTG

101 AGTTTTTGGA AGGAAACCTG ATTGTAGTCG GCGCGTCCGG GCGTGCCGCT

151 GTAACGGTAG CCGTGGCGCA ATTCGAGCGT GCGTTTGTTG TCGTTCAGCG

201 AGAAGTTACC TTCTTTGGCG AAGATGATGT TGTCGCCGCC GTTTTTGTCC

251 TGTTCGCGCA GGAACAGGTT TTTCATGATG CCGGATTCGG TATCGAAGGT

301 TTCGACAAAA TAAACCCTGC CGTTGCGCTT GCCCAAACTG TTGAACTCGC

351 CTGCCTCCAC CAAAGACAAT TCCTGCTTCT GCTTCAGGAT TTCAGCGTAT

401 TCGCGGCTGC GTAGCTCTGC CCACGGTATC ACCCAAAGCT GCATGACGGC

451 AACCAAAACG GCAAACGGCA CGGCAAACTG CATCACCGGG CGTATCCATT

501 GTTTCAATGC CAATCCGCAg GATAG
```

This corresponds to the amino acid sequence <SEQ ID 730; ORF 211>:

m211.pep

```
  1 MLRVAAANQL GGRNGTAVGN GVDEFGRGAD NQVEFLEGNL IVVGASGRAA

 51 VTVAVAQFER AFVVVQREVT FFGEDDVVAA VFVLFAQEQV FHDAGFGIEG

101 FDKINPAVAL AQTVELACLH QRQFLLLLQD FSVFAAAXLC PRYHPKLHDG

151 NQNGKRHGKL HHRAYPLFQC QSAG*
```

Computer analysis of this amino acid sequence gave the following results:

Homology with a predicted ORF from *N. gonorrhoeae*

ORF 211 shows 89.1% identity over a 174 aa overlap with a predicted ORF (ORF 211.ng) from *N. gonorrhoeae*:

m211/g211

```
                   10        20        30        40        50        60
m211.pep   MLRVAAANQLGGRNGTAVGNGVDEFGRGADNQVEFLEGNLIVVGASGRAAVTVAVAQFER
           |||:|||||||||||:|||||||:||||||||||||||||||||||||||||||||||||
g211       MLRIAAANQLGGRNGAAVGNGVDKFGRGADNQVEFLEGNLIVVGASGRAAVTVAVAQFER
                   10        20        30        40        50        60

                   70        80        90       100       110       120
m211.pep   AFVVVQREVTFEGEDDVVAAVFVLFAQEQVFHDAGFGIEGFDKINPAVALAQTVELACLH
           |||||:|||||||||||||||||||||||||||||||::|||:|||||||||::||| :|
g211       AFVVVLREVTFFGEDDVVAAVFVLFAQEQVFHDAGFGVKGFDEINPAVALAQVIELAGFH
                   70        80        90       100       110       120

                  130       140       150       160       170
m211.pep   QRQFLLLLQDFSVFAAAXLCPRYHPKLHDGNQNGKRHGKLHHRAYPLFQCQSAGX
           |||||||||:|::|||| ||||||||||||||:||||||||  |||||| ||||
g211       QRQFLLLLQNFGIFAAAQLCPRYHPKLHDGNQDGKRHGKLHDGAYPLFQRQSAG
                  130       140       150       160       170
```

The following partial DNA sequence was identified in *N. meningitidis* <SEQ ID 731>:

a211.seq

```
  1 ATGTTGCGGG TTGCTGCTGC CAATCAGTTG GGCGGTCGGA ATGGTACGGC

 51 GGTGGGAAAC GGGGTCGATG AGTTTGGGCG TGGTGCTGAT AATCAGGTTG
```

-continued

```
101 AGTTTTTGGA AGGAAACCTG ATTGTAGTCG GCGCGTCCGG GCGTGCCGCT

151 GTAACGGTAG CCGTGGCGCA ATTCGAGCGT GCGTTTGTTG TCGTTCAGCG

201 AGAAGTTACT TTCTTTGGCG AAGATGATGT TGTCGCCGCC GTTTTTGTCC

251 TGTTCGCGCA GGAACAGGTT TTTCATGATG CCGGATTCGG TATCGAAGGT

301 TTCGACAAAA TAAACCCTGC CGTTGCGCTT GCCCAAACTG TTGAACCCGC

351 CTGCCTCCAC CAAAGACAAT TCCTGCTTCT GCTTCAGGAT TTCAGCGTAT

401 TCGCGGCTGC GTAGCTCTGC CCACGGTATC ACCCAAAGCT GCATGACGGC

451 AACCAAAACG GCAAACGGCA CGGCAAACTG CATCACCGGG CGTATCCATT

501 GTTTCAATGC CAATCCGCAG GATAG
```

This corresponds to the amino acid sequence <SEQ ID 732; ORF 211.a>:

a211.pep

```
  1 MLRVAAANQL GGRNGTAVGN GVDEFGRGAD NQVEFLEGNL IVVGASGRAA

 51 VTVAVAQFER AFVVVQREVT FFGEDDVVAA VFVLFAQEQV FHDAGFGIEG

101 FDKINPAVAL AQTVEPACLH QRQFLLLLQD FSVFAAA*LC PRYHPKLHDG

151 NQNGKRHGKL HHRAYPLFQC QSAG*
```

m211/a211 99.4% identity in 174 aa overlap

```
                10         20         30         40         50         60
m211.pep  MLRVAAANQLGGRNGTAVGNGVDEFGRGADNQVEFLEGNLIVVGASGRAAVTVAVAQFER
          ||||||||||||||||||||||||||||||||||||||||||||||||||||||||||||
a211      MLRVAAANQLGGRNGTAVGNGVDEFGRGADNQVEFLEGNLIVVGASGRAAVTVAVAQFER
                10         20         30         40         50         60
                70         80         90        100        110        120
m211.pep  AFVVVQREVTFEGEDDVVAAVFVLFAQEQVFHDAGFGIEGFDKINPAVALAQTVELACLH
          |||||||||| |||||||||||||||||||||||||||||||||||||||||||| |||
a211      AFVVVQREVTFFGEDDVVAAVFVLFAQEQVFHDAGFGIEGFDKINPAVALAQTVEPACLH
                70         80         90        100        110        120
               130        140        150        160        170
m211.pep  QRQFLLLLQDFSVFAAAXLCPRYHPKLHDGNQNGKRHGKLHHRAYPLFQCQSAGX
          ||||||||||||||||||||||||||||||||||||||||||||||||||||||
a211      QRQFLLLLQDFSVFAAAXLCPRYHPKLHDGNQNGKRHGKLHHRAYPLFQCQSAGX
               130        140        150        160        170
```

The following partial DNA sequence was identified in *N. gonorrhoeae* <SEQ ID 733>:

g212.seq (partial)

```
  1 atggacaatc tcgtatggga cggcattccc gacatccgca cactcgacca

 51 aaccatccgc aaacacgcac acccgctcaa cctgattgtc tgcctccccg

101 ataatcagat tcccgatttt caaaccgcac aagatgcttc ggactcggaa

151 tgccgtctga agcaccgttt ggatcaggca acccagtgcc tccagttcga

201 cagcatcaac ctcatcgaac acatcctgcc cgatgtccgc ttctggctgg

251 ttcccccttc acgcacccgc cgcctgcacg aacacttcca ccacatttcc

301 tggcagaccg aagccatccc gcaaaccgaa agcaagtccg acaaaccctg

351 gtttgcactt ccacaaacat ccgaacggaa aaaaccggaa cacgtcctcg
```

-continued

```
 401 tcatcggtgc aggcattgcc ggcgcatcga ccgcccacgc cttagcatca
 451 cacggcattt ccgttaccgt attggaagcc cgaaaagccg ctcaagccgc
 501 cagcggcaac cggcaagggc tgctttacgc caaaatctcg ccgcacgaca
 551 ccggacagac cgaactgctg cttgccggct acggctacac caaacgcctg
 601 ctcggacaca tcctgcccga ctccgacact tggggcggca acggcatcat
 651 ccacctcaat tacagccgca ccgaacaaca acgcaatcac gaattgggtt
 701 tgcaaaaaca ccataaccac ctctaccgca gcatcacgtc tgcagaagcc
 751 gaaaaaatcg ccggcatccc gctgaacacg ccctacgccg aaccattatg
 801 cggactctac tggcaacacg gcgtatggct caatccgccc gcattcgtcc
 851 gcaccctcct cagccatccg ctgatcgaac tatatgaaaa cacaacgtta
 901 accggcattt cccacgacgg agaaaagtgg attgcaagca cgccaaacgg
 951 cacatttacc gccacacaca tcatctactg caccggcgcg cacagcccct
1001 gcctgcccga aaccaacctc gccgccctac ccctcaggca aatacgcgga
1051 caaaccggcc tcacaccgtc caccccgttt tccgaacaac tgcgttgcgc
1101 cgtttcaggc gaaagctaca tcagcccgtc gtggcacgga ctgcactgct
1151 acggcgcgag ttttattccc aacagcagca ataccggatg gaacgaagcc
1201 gaagaagcct caaaccgcca agcattggca caccttaacc ccgcccttgc
1251 cgaatcattg ttt...
```

This corresponds to the amino acid sequence <SEQ ID 734; ORF 212.ng>:

g212.pep (partial)

```
  1 MDNLVWDGIP DIRTLDQTIR KHAHPLNLIV CLPDNQIPDF QTAQDASDSE
 51 CRLKHRLDQA TQCLQFDSIN LIEHILPDVR FWLVPPSRTR RLHEHFHHIS
101 WQTEAIPQTE SKSDKPWFAL PQTSERKKPE HVLVIGAGIA GASTAHALAS
151 HGISVTVLEA RKAAQAASGN RQGLLYAKIS PHDTGQTELL LAGYGYTKRL
201 LGHILPDSDT WGGNGIIHLN YSRTEQQRNH ELGLQKHHNH LYRSITSAEA
251 EKIAGIPLNT PYAEPLCGLY WQHGVWLNPP AFVRTLLSHP LIELYENTTL
301 TGISHDGEKW IASTPNGTFT ATHIIYCTGA HSPCLPETNL AALPLRQIRG
351 QTGLTPSTPF SEQLRCAVSG ESYISPSWHG LHCYGASFIP NSSNTGWNEA
401 EEASNRQALA HLNPALAESL F...
```

The following partial DNA sequence was identified in *N. meningitidis* <SEQ ID 735>:

m212.seq

```
  1 ATGGACAATC TCGTATGGGA CGGCATTCCC GACATCCGCA CACTCGACCA
 51 AGCCATCCGC AAACACGCAC CCCCGCTCAA CCTGATTATC TGCCTCCCCG
101 ATAATCAGAT TCCCGATTTT CAAACCGCAC AAGATGCTTC GGACGCGGAA
151 TGCCGTCTGA AGCACCGTTT GGATCAGGCA ATGCAGTGCC TCCAGTTCGA
```

-continued

```
 201 CAGCATCAAC CTCATCGAAC ACATCCTGCC CGATGTCCGC TTCTGGCTGG
 251 TTCCCCCTTC ACGCACCCAC CACCTGCACG AACATTTCCA CCACATTTCC
 301 TGGCAGACCG AAGCCATCCC GCAAACCGAA AGCAAGCCCG ACAAACCCTG
 351 GTTTGCACTT CCACAAACAT CCGAACGGCA AAAACCGGAA CACATCCTCG
 401 TTATCGGCGC GGGCATATCC GGCGCGGCAA CCGCCCACGC CTTAGCATCA
 451 CACGGCATTT CCGTTACCGT ATTGGAAGCC CGAAAAGCCG CCCAAGCCGC
 501 CAGCGGCAAC CGCCAAGGGC TGCTCTACGC CAAAATCTCG CCGCACGACA
 551 CCGAACAGAC CGAACTTTTG CTTGCCGGCT ACGGCTACAC CAAACGCCTG
 601 CTCGGACACA TCCTGCCCGA ATCCGAAACC TGGGGCGGCA ACGGCATCAT
 651 CCACCTCAAT TACAGCCGCA CCGAACAACA ACGCAATCAC GAATTGGGTT
 701 TGCAAAAACA CCATAACCAC CTCTACCGCA GCATCACATC TGCAGAAGCC
 751 GAAAAAATCG CCGGTATCCC ACTGTCCGTC CCATACGACC ACCCTTCATG
 801 CGGACTCTAC TGGCAACACG GCGTATGGCT CAATCCACCC GCATTCGTCC
 851 GCACCCTCCT CAACCATCCG CTCATTGGAC TACACGAAGA CACACCCTTG
 901 ACCGACATTT CCCACGACGG GGaAAAGTGG ATTGCAAGCA CGCCAAACGG
 951 CACATTTACC GCCACACACA TCATCTACTG CACCGGTGCG AACAGCCCCT
1001 ACCTACCCGA AACCAACCTC GCCGCCCTGC CTCTCAGGCA AATACGCGGA
1051 CAAACCGGCC TCACACCGTC CACCCCGTTT TCCGAACAAC TGCGTTGCGC
1101 CGTTTCAGGC GAAAGCTACA TCAGCCCGTC GTGGCACGGA CTGCACTGCT
1151 ACGGCGCGAG TTTTATTCCC AACAGCAGCC ATACCGGATG GAACGAAGCC
1201 GAAGAAGCCT CAAACCGCCA AGCATTGGCA CACCTTAACC CCGCCCTTTC
1251 CGAATCATTG TTTGCCGCCA ACCCAAACCC CCAAAAACAC CAAGGGCACG
1301 CCGCCATACG CTGCGACAGC CCCGACCACC TTCCCCTAGT CGGCGCACTC
1351 GGCGACATTG CCGCCATGCG GCAGACCTAC ACCAAACTCG CGCTGGACAA
1401 AAACTACCGC ATCGACACCC CATGCCCATA CCTGCCTAAT GCCTACGTCA
1451 ACACCGCGCA CGGCACCCGC GGACTCGCCA CCGCCCCCAT CTGCGCCGCC
1501 GmCAwTGCAG CCCAAATCsT AGGCyTGCCC CATCCCTTTT yAcAAcGCCT
1551 gCGCCACGCC cTAcACCCCA ACCGCACCAT CATCCGCGCC ATCGTCAGAA
1601 GGAAGGATCT AACCCCTTAA
```

This corresponds to the amino acid sequence <SEQ ID 736; ORF 212>:

m212.pep

```
  1 MDNLVWDGIP DIRTLDQAIR KHAPPLNLII CLPDNQIPDF QTAQDASDAE
 51 CRLKMRLDQA MQCLQFDSIN LIEMILPDVR FWLVPPSRTH HLNEHFHHIS
101 WQTEAIPQTE SKPDKPWFAL PQTSERQKPE HILVIGAGIS GAATAHALAS
151 HGISVTVLEA RKAAQAASGN RQGLLYAKIS PHDTEQTELL LAGYGYTKRL
201 LGHILPESET WGGNGIIHLN YSRTEQQRNH ELGLQKHHNH LYRSITSAEA
251 EKIAGIPLSV PYDHPSCGLY WQHGVWLNPP AFVRTLLNHP LIGLHEDTPL
301 TDISHDGEKW IASTPNGTFT ATHIIYCTGA NSPYLPETNL AALPLRQIRG
```

-continued

```
351 QTGLTPSTPF SEQLRCAVSG ESYISPSWHG LHCYGASFIP NSSHTGWNEA

401 EEASNRQALA HLNPALSESL FAANPNPQKH QGHAAIRCDS PDHLPLVGAL

451 GDIAAMRQTY TKLALDKNYR IDTPCPYLPN AYVNTAHGTR GLATAPICAA

501 XXAAQIXGLP HPFXQRLRHA LHPNRTIIRA IVRRKDLTP*
```

Computer analysis of this amino acid sequence gave the following results:

Homology with a predicted ORF from *N. gonorrhoeae*

ORF 212 shows 92.9% identity over a 421 aa overlap with a predicted ORF (ORF 212.ng) from *N. gonorrhoeae*:

m212/g212

```
                        10        20        30        40        50        60
m212.pep        MDNLVWDGIPDIRTLDQAIRKHAPPLNLIICLPDNQIPDFQTAQDASDAECRLKHRLDQA
                ||||||||||||||||||:||||| |||||:||||||||||||||||||:||||||||||
g212            MDNLVWDGIPDIRTLDQTIRKHAHPLNLIVCLPDNQIPDFQTAQDASDSECRLKHRLDQA
                        10        20        30        40        50        60

                        70        80        90       100       110       120
m212.pep        MQCLQFDSINLIEHILPDVRFWLVPPSRTHHLHEHFHHISWQTEAIPQTESKPDKPWFAL
                 ||||||||||||||||||||||||||||::||||||||||||||||||||| |||||||
g212            TQCLQFDSINLIEHILPDVRFWLVPPSRTRRLHEHFHHISWQTEAIPQTESKSDKPWFAL
                        70        80        90       100       110       120

                       130       140       150       160       170       180
m212.pep        PQTSERQKPEHILVIGAGISGAATAHALASHGISVTVLEARKAAQAASGNRQGLLYAKIS
                ||||||:||||:|||||||:||:|||||||||||||||||||||||||||||||||||||
g212            PQTSERKKPEHVLVIGAGIAGASTAHALASHGISVTVLEARKAAQAASGNRQGLLYAKIS
                       130       140       150       160       170       180

                       190       200       210       220       230       240
m212.pep        PHDTEQTELLLAGYGYTKRLLGHILPESETWGGNGIIHLNYSRTEQQRNHELGLQKHHNH
                |||| |||||||||||||||||||||:|:|||||||||||||||||||||||||||||||
g212            PHDTGQTELLLAGYGYTKRLLGHILPDSDTWGGNGIIHLNYSRTEQQRNHELGLQKHHNH
                       190       200       210       220       230       240

                       250       260       270       280       290       300
m212.pep        LYRSITSAEAEKIAGIPLSVPYDHPSCGLYWQHGVWLNPPAFVRTLLNHPLIGLHEDTPL
                ||||||||||||||||||::|| :| |||||||||||||||||||||:|||| |:|:| |
g212            LYRSITSAEEAKIAGIPLNTPYAEPLCGLYWQHGVWLNPPAFVRTLLSHPLIELYENTTL
                       250       260       270       280       290       300

                       310       320       330       340       350       360
m212.pep        TDISHDGEKWIASTPNGTFTATHIIYCTGANSPYLPETNLAALPLRQIRGQTGLTPSTPF
                | ||||||||||||||||||||||||||||:|| ||||||||||||||||||||||||||
g212            TGISHDGEKWIASTPNGTFTATHIIYCTGAHSPCLPETNLAALPLRQIRGQTGLTPSTPF
                       310       320       330       340       350       360

                       370       380       390       400       410       420
m212.pep        SEQLRCAVSGESYISPSWHGLHCYGASFIPNSSHTGWNEAEEASNRQALAHLNPALSESL
                |||||||||||||||||||||||||||||||||:||||||||||||||||||||||:|||
g212            SEQLRCAVSGESYISPSWHGLHCYGASFIPNSSNTGWNEAEEASNRQALAHLNPALAESL
                       370       380       390       400       410       420

                       430       440       450       460       470       480
m212.pep        FAANPNPQKHQGHAAIRCDSPDHLPLVGALGDIAAMRQTYTKLALDKNYRIDTPCPYLPN
                |
g212            F
```

The following partial DNA sequence was identified in *N. meningitidis* <SEQ ID 737>:

a212.seq

```
  1 ATGGACAATC TCGCATGGAA CGGCATTCCC GACATCCGCA CACTCGACCA

 51 AACCATCCGC AAACACGCAC ACCCGCTCAA CCTGATTGTC TGCCTCCCCG

101 ATAATCAGAT TCCCAATTTT CAAACCGCAC AAGATGCTTC GGACGCGGAA

151 TGCCGTCTGA AGCACCGTTT GGATCAGGCA ACCCAGTGCC TCCAGTTCGA

201 CAGCATCAAC CTGATTGAAC ACATCCTCCC CGATGTCCGC TTCTGGCTGG
```

-continued

```
 251 TTCCCCCTTC ACGCACCCGC CGCCTGCACG AACACTTCCA CCACATTTCC
 301 TGGCAGACCG AAGCCATCCC GCAAACCGAA AGTAAGCCCG ACAAACCCTG
 351 GTTTGCACTT CCACAAACAT CCGAACGGCA AAAACCGGAA CACATCCTCG
 401 TTATCGGAGC GGGCATATCC GGCGCGGCAA CCGCCCACGC CTTAGCATCA
 451 TACGGCATTT CCGTTACCGT ATTGGAAGCC CGAAAAGCCG CCCAAGCCGC
 501 CAGCGGCAAC CGCCAAGGGC TGCTCTACGC CAAAATCTCG CCGCACGACA
 551 CCGAACAAAC CGAACTGCTG CTTGCCGGCT ACGGCTACAC CAAACGCCTG
 601 CTCGGACATA TCCTGCCCGA ATCCGAAACC TGGGGCGGCA ACGGCATCAT
 651 CCACCTCAAT TACAGCCGCA CCGAACAACA ACGCAATCAC GAATTGGGTT
 701 TGCAAAAACA CCATAACCAC CTCTACCGCA GCATCACGCA GGCAGAAGCC
 751 GAAAAAATCG CCGGCATCCC TCTGAACACG CCCTACGCCG AACCATTATG
 801 CGGACTGTTT TGGCAGTACG GCGTATGGCT CAATCCTCCC ACATTCGTCC
 851 GCGCCCTCCT CAGCCATCCG CTCATTGGAC TACACGAAGA CACACCGTTA
 901 ACCGACATTT CCCACGACGG GGAAAAGTGG ATTGCAAGCA CGCCAAACGG
 951 CACATTTACC GCCACACACA TCATCTACTG CACCGGTGCG AACAGCCCCT
1001 ACCTACCCGA AACCAACCTC GCCACCCTGC CCCTCAGGCA AATACGCGGA
1051 CAAACCGGCC TCACACCGTC CACCCCGTTT TCCGAACAAC TGCGTTGCGC
1101 CGTTTCAGGC GAAAGCTACA TCAGCCCGTC GTGGCACGGA CTGCACTGCT
1151 ACGGCGCGAG TTTTATTCCC AACAGCAGCC ATACCGGATG GAACGAAGCC
1201 GAAGAAGCCT CAAACCGCCA AGCATTGGCA CACCTTAACC CCGCCCTTTC
1251 CGAATCATTG TTTGCCGCCA ACCCAAACCC CCAAAAACAC CAAGGGCACG
1301 CCGCCATACG CTGCGACAGC CCCGACCACC TTCCCCTAGT CGGCGCACTC
1351 GGCGACATTG CCGCTATGCA ACAAACTTAC GCCAAACTCG CGCTGGACAA
1401 AAACTATCGC ATCGATGCCC CCTGCCCGTA CCTGCCCAAT GCCTACGCCA
1451 ACACCGCCCA CGGCACACGC GGGCTTGCCA CCGCCCCCAT CTGCGCCGCC
1501 GCCGTTGCAG CCGAAATCCT AGGCTTGCCC CATCCCCTCT CAAAACGCCT
1551 GCGCCACGCC CTACACCCCA ACCGCGCCAT CATCCGCGCC ATCGTCAGAA
1601 GGAAGGATCT AACCCCTTAA
```

This corresponds to the amino acid sequence <SEQ ID 738; ORF 212.a>:

a212.pep

```
  1 MDNLAWNGIP DIRTLDQTIR KHAHPLNLIV CLPDNQIPNF QTAQDASDAE
 51 CRLKHRLDQA TQCLQFDSIN LIEHILPDVR FWLVPPSRTR RLHEHFHHIS
101 WQTEAIPQTE SKPDKPWFAL PQTSERQKPE HILVIGAGIS GAATAHALAS
151 YGISVTVLEA RKAAQAASGN RQGLLYAKIS PHDTEQTELL LAGYGYTKRL
201 LGHILPESET WGGNGIIHLN YSRTEQQRNH ELGLQKHHNH LYRSITQAEA
251 EKIAGIPLNT PYAEPLCGLF WQYGVWLNPP TFVRALLSHP LIGLHEDTPL
301 TDISHDGEKW IASTPNGTFT ATHIIYCTGA NSPYLPETNL ATLPLRQIRG
```

-continued

```
351 QTGLTPSTPF SEQLRCAVSG ESYISPSWHG LHCYGASFIP NSSHTGWNEA

401 EEASNRQALA HLNPALSESL FAANPNPQKH QGHAAIRCDS PDHLPLVGAL

451 GDIAAMQQTY AKLALDKNYR IDAPCPYLPN AYANTAHGTR GLATAPICAA

501 AVAAEILGLP HPLSKRLRHA LHPNRAIIRA IVRRKDLTP*
```

m212/a212 93.7% identity in 539 aa overlap

```
                    10        20        30        40        50        60
m212.pep    MDNLVWDGIPDIRTLDQAIRKHAPPLNLIICLPDNQIPDFQTAQDASDAECRLKHRLDQA
            ||||:|:|||||||||||:|||| |||||:||||||||:|||||||||||||||||||||
a212        MDNLAWNGIPDIRTLDQTIRKHAHPLNLIVCLPDNQIPNFQTAQDASDAECRLKHRLDQA
                    10        20        30        40        50        60

                    70        80        90       100       110       120
m212.pep    MQCLQFDSINLIEHILPDVRFWLVPPSRTHHLHEHFHHISWQTEAIPQTESKPDKPWFAL
             ||||||||||||||||||||||||||||::|||||||||||||||||||||||||||||
a212        TQCLQFDSINLIEHILPDVRFWLVPPSRTRRLHEHFHHISWQTEAIPQTESKPDKPWFAL
                    70        80        90       100       110       120

                   130       140       150       160       170       180
m212.pep    PQTSERQKPEHILVIGAGISGAATAHALASHGISVTVLEARKAAQAASGNRQGLLYAKIS
            ||||||||||||||||||||||||||||||:|||||||||||||||||||||||||||||
a212        PQTSERQKPEHILVIGAGISGAATAHALASYGISVTVLEARKAAQAASGNRQGLLYAKIS
                   130       140       150       160       170       180

                   190       200       210       220       230       240
m212.pep    PHDTEQTELLLAGYGYTKRLLGHILPESETWGGNGIIHLNYSRTEQQRNHELGLQKHHNH
            ||||||||||||||||||||||||||||||||||||||||||||||||||||||||||||
a212        PHDTEQTELLLAGYGYTKRLLGHILPESETWGGNGIIHLNYSRTEQQRNHELGLQKHHNH
                   190       200       210       220       230       240

                   250       260       270       280       290       300
m212.pep    LYRSITSAEAEKIAGIPLSVPYDHPSCGLYWQHGVWLNPPAFVRTLLNHPLIGLHEDTPL
            ||||||:|||||||||||::|| :| |||:||:|||||||:|||:||:||||||||||||
a212        LYRSITQAEAEKIAGIPLNTPYAEPLCGLFWQYGVWLNPPTFVRALLSHPLIGLHEDTPL
                   250       260       270       280       290       300

                   310       320       330       340       350       360
m212.pep    TDISHDGEKWIASTPNGTFTATHIIYCTGANSPYLPETNLAALPLRQIRGQTGLTPSTPF
            |||||||||||||||||||||||||||||||||||||||||:||||||||||||||||||
a212        TDISHDGEKWIASTPNGTFTATHIIYCTGANSPYLPETNLATLPLRQIRGQTGLTPSTPF
                   310       320       330       340       350       360

                   370       380       390       400       410       420
m212.pep    SEQLRCAVSGESYISPSWHGLHCYGASFIPNSSHTGWNEAEEASNRQALAHLNPALSESL
            ||||||||||||||||||||||||||||||||||||||||||||||||||||||||||||
a212        SEQLRCAVSGESYISPSWHGLHCYGASFIPNSSHTGWNEAEEASNRQALAHLNPALSESL
                   370       380       390       400       410       420

                   430       440       450       460       470       480
m212.pep    FAANPNPQKHQGHAAIRCDSPDHLPLVGALGDIAAMRQTYTKLALDKNYRIDTPCPYLPN
            ||||||||||||||||||||||||||||||||||||:|||:|||||||||||:|||||||
a212        FAANPNPQKHQGHAAIRCDSPDHLPLVGALGDIAAMQQTYAKLALDKNYRIDAPCPYLPN
                   430       440       450       460       470       480

                   490       500       510       520       530       540
m212.pep    AYVNTAHGTRGLATAPICAAXXAAQIXGLPHPFXQRLRHALHPNRTIIRAIVRRKDLTPX
            ||:|||||||||||||||||  ||:| |||||: :||||||||||:||||||||||||||
a212        AYANTAHGTRGLATAPICAAAVAAEILGLPHPLSKRLRHALHPNRAIIRAIVRRKDLTPX
                   490       500       510       520       530       540
```

The following partial DNA sequence was identified in *N. gonorrhoeae* <SEQ ID 739>:

g214.seq

```
  1 atgatacaaa agatatgtaa gctatttgtt ttaattgtaa tttttgcaac

 51 ttctcccgct tttgcccttc aaagcgacag cagacggccc atccaaatcg

101 aagccgacca aggttcgctc gatcaagcca accaaaggac cacatttagc

151 ggcaatgtca tcatcagaca gggtacgctc aacatttccg cctcgtgtgt

201 caacgtcaca cgcggcaggc aaaggcggcg aatccgtgag ggcggaaggt

251 tcgcccgtcc gcttcagcca aacgttggac gggggcaaag ggacggtgcg

301 cggtcaggca aacaacgtta cctattcctc cgcaggaagc actgtcgttc
```

-continued

```
351 tgaccggcaa tgccaaagtg cagcgcggcg gcgacgttgc cgaaggtgcg
401 gtcattacct acaacaccaa aaccgaagtc tataccatca acggcagcac
451 gaaatcgggt gcgaaatccg cttccaaaac cggcagggtc agcgtcgtca
501 tccagccttc aagcacacaa aaaaccgaat aaccccgatg ccgtctgaaa
551 cggaaacgca gttcagacgg catttgccga ccgaaatgcc gagaagagat
601 tattga
```

This corresponds to the amino acid sequence <SEQ ID 740; ORF 214.ng>:

g214.pep

```
  1 MIQKICKLFV LIVIFATSPA FALQSDSRRP IQIEADQGSL DQANQRTTFS
 51 GNVIIRQGTL NISASCVNVT RGRQRRRIRE GGRFARPLQP NVGRGQRDGA
101 RSGKQRYLFL RRKHCRSDRQ CQSAARRRRC RRCGHYLQHQ NRSLYHQRQH
151 EIGCEIRFQN RQGQRRHPAF KHTKNRITPM PSETETQFRR HLPTEMPRRD
201 Y
```

The following partial DNA sequence was identified in *N. meningitidis* <SEQ ID 741>:

m214.seq (partial)

```
  1 ATGATACAAA AGATATGTAA GCTATTTGTT TTAATAGCAT TTTTTTCGGC
 51 GTCCCCCGCT TTTGCCCTTC AAAGCGACAG CAGGCAGCCT ATTCAGATTG
101 AGGCCGACCA AGGTTCGCTC GATCAAGCCA ACCAAAGCAC CACATTCAGC
151 GGAAACGTCG TCATCAGACA GGGTACGCTC AATATTTCCG CCGCCCGCGT
201 CAATGTTACA CGCGGCGGCA AAGGCGGCGA ATCCGTGAGG GCGGAAGGTT
251 CGCCAGTCCG CTTCAGCCAG ACATTGGACG GCGGCAAAGG CACGGTGCGC
301 GGACAGGCAA ACAACGTTGC TTATTCATCT GCAGGCAGCA CCGTAGTCTT
351 AACCGGTAAT GCCAAAGTAC AGCGCGGCGG CGATGTCGCC GAAGGTGCGG
401 TGATTACATA CAACACCAAA ACCGAAGTCT ATACCATCAG CGGCAGCACA
451 AAATT...
```

This corresponds to the amino acid sequence <SEQ ID 742; ORF 214>:

m214.pep (partial)

```
  1 MIQKICKLFV LIAFFSASPA FALQSDSRRP IQIEADQGSL DQANQSTTFS
 51 GNVVIRQGTL NISAARVNVT RGRQRRRIRE GGRFASPLQP DIGRRQRRGA
101 RTGKQRCLFI CRQHRSLR* CQSTARRRCR RRCGDYIQHQ NRSLYHQRQH
151 KI..
```

Computer analysis of this amino acid sequence gave the following results:

Homology with a predicted ORF from *N. gonorrhoeae*

ORF 214 shows 80.3% identity over a 152 aa overlap with a predicted ORF (ORF 214.ng) from *N. gonorrhoeae*:

m214/g214

```
                    10        20        30        40        50        60
m214.pep    MIQKICKLFVLIAFFSASPAFALQSDSRQPIQIEADQGSLDQANQSTTFSGNVVIRQGTL
            ||||||||||||::|::|||||||||||:|||||||||||||||| |||||||:||||||
g214        MIQKICKLFVLIVIFATSPAFALQSDSRRPIQIEADQGSLDQANQRTTFSGNVIIRQGTL
                    10        20        30        40        50        60

                    70        80        90       100       110       120
m214.pep    NISAARVNVTRGRQRRRIREGGRFASPLQPDIGRRQRHGARTGKQRCLFICRQHRSLNRX
            ||||: ||||||||||||||||||| ||||::|| || |||:|||| ||: |:|   :| 
g214        NISASCVNVTRGRQRRRIREGGRFARPLQPNVGRGQRDGARSGKQRYLFLRRKHCRSDRQ
                    70        80        90       100       110       120

                   130       140       150
m214.pep    CQSTARRRCRRRCGDYIQHQNRSLYHQRQHKI
            |||:||||  |||| |:|||||||||||||:|
g214        CQSAARRRRCRRCGHYLQHQNRSLYHQRQHEIGCEIRFQNRQGQRRHPAFKHTKNRITPM
                   130       140       150       160       170       180


g214        PSETETQFRRHLPTEMPRRDY
                   190       200
```

The following partial DNA sequence was identified in *N. meningitidis* <SEQ ID 743>:

a214.seq

```
  1 ATGATACAAA AGATATGTAA GCTATTTGTT TTAATAGCAT TTTTTTCGGC

 51 GTCCCCCGCT TTTGCCCTTC AAAGCGACAG CAGGCAGCCT ATTCAGATTG

101 AGGCCGACCA AGGTTCGCTC GATCAAGCCA ACCAAAGCAC CACATTCAGC

151 GGAAACGTCG TCATCAGACA GGGTACGCTC AATATTTCCG CCGCCCGCGT

201 CAATGTTACA CGCGGC.GGC AAAGGCGGCG AATCCGTGAG GGCGGAAGGT

251 TCGCCAGTCC GCTTCAGCCA GACATTGGAC GGCGGCAAAG GCACGGTGCG

301 CGGACAGGCA AACAACGTTG CTTATTCATC TGCAGGCAGC ACCGTAGTCT

351 TAACCGGTAA TGCCAAAGTA CAGCGCGGCG GCGATGTCGC CGAAGGTGCG

401 GTGATTACAT ACAACACCAA AACCGAAGTC TATACCATCA GCGGCAGCAC

451 AAAATCCGGC GCAAAATCCG CTTCCAAATC CGGCAGGGTC AGCGTCGTTA

501 TCCAGCCTTC GAGTACGCAA AAATCCGAAT AATCCCAATG CCGTCTGAAA

551 CATAAACCTG GTTCGGACGG CATTTGCCGA CCGAAATATT GAAGAGATAT

601 TTATGA
```

This corresponds to the amino acid sequence <SEQ ID 744; ORF 214.a>:

a214.pep

```
  1 MIQKICKLFV LIAFFSASPA FALQSDSRQP IQIEADQGSL DQANQSTTFS

 51 GNVVIRQGTL NISAARVNVT RGXQRRRIRE GGRFASPLQP DIGRRQRHGA

101 RTGKQRCLFI CRQHRSLNR* CQSTARRRCR RRCGDYIQHQ NRSLYHQRQH

151 KIRRKIRFQI RQGQRRYPAF EYAKIRIIPM PSET*TWFGR HLPTEILKRY

201 L*
```

m214/a214 99.3% identity in 152 aa overlap

```
                10        20        30        40        50        60
m214.pep  MIQKICKLFVLIAFFSASPAFALQSDSRQPIQIEADQGSLDQANQSTTFSGNVVIRQGTL
          ||||||||||||||||||||||||||||||||||||||||||||||||||||||||||||
a214      MIQKICKLFVLIAFFSASPAFALQSDSRQPIQIEADQGSLDQANQSTTFSGNVVIRQGTL
                10        20        30        40        50        60

                70        80        90       100       110       120
m214.pep  NISAARVNVTRGRQRRRIREGGRFASPLQPDIGRRQRHGARTGKQRCLFICRQHRSLNRX
          ||||||||||| ||||||||||||||||||||||||||||||||||||||||||||||||
a214      NISAARVNVTRGXQRRRIREGGRFASPLQPDIGRRQRHGARTGKQRCLFICRQHRSLNRX
                70        80        90       100       110       120

               130       140       150
m214.pep  CQSTARRRCRRRCGDYIQHQNRSLYHQRQHKI
          ||||||||||||||||||||||||||||||||
a214      CQSTARRRCRRRCGDYIQHQNRSLYHQRQHKIRRKIRFQIRQGQRRYPAFEYAKIRIIPM
               130       140       150       160       170       180

a214      PSETXTWFGRHLPTEILKRYLX
               190       200
```

The following partial DNA sequence was identified in *N. gonorrhoeae* <SEQ ID 745>:

g214-1.seq

```
  1 ATGATACAAA AGATATGTAA GCTATTTGTT TTAATTGTAA TTTTTGCAAC
 51 TTCTCCCGCT TTTGCCCTTC AAAGCGACAG CAGACGGCCC ATCCAAATCG
101 AAGCCGACCA AGGTTCGCTC GATCAAGCCA ACCAAAGTAC CACATTTAGC
151 GGCAATGTCA TCATCAGACA GGGTACGCTC AACATTTCCG CCTCGCGCGT
201 CAACGTCACA CGCGGCGGCA AAGGCGGCGA ATCCGTGAGG GCGGAAGGTT
251 CGCCCGTCCG CTTCAGCCAA ACGTTGGACG GGGGCAAAGG GACGGTGCGC
301 GGTCAGGCAA ACAACGTTAC CTATTCCTCC GCAGGAAGCA CCGTCGTTCT
351 GACCGGCAAT GCCAAAGTGC AGCGCGGCGG CGACGTTGCC GAAGGTGCGG
401 TCATTACCTA CAACACCAAA ACCGAAGTCT ATACCATCAA CGGCAGCACG
451 AAATCGGGTG CGAAATCCGC TTCCAAAACC GGCAGGGTCA GCGTCGTCAT
501 CCAGCCTTCA AGCACACAAA AAACCGAATA A
```

This corresponds to the amino acid sequence <SEQ ID 746; ORF 214-1.ng>:

g214-1.pep

```
  1 MIQKICKLFV LIVIFATSPA FALQSDSRRP IQIEADQGSL DQANQSTTFS
 51 GNVIIRQGTL NISASRVNVT RGGKGGESVR AEGSPVRFSQ TLDGGKGTVR
101 GQANNVTYSS AGSTVVLTGN AKVQRGGDVA EGAVITYNTK TEVYTINGST
151 KSGAKSASKT GRVSVVIQPS STQKTE*
```

The following partial DNA sequence was identified in *N. meningitidis* <SEQ ID 747>:

m214-1.seq

```
  1 ATGATACAAA AGATATGTAA GCTATTTGTT TTAATAGCAT TTTTTTCGGC
```

-continued

```
 51 GTCCCCCGCT TTTGCCCTTC AAAGCGACAG CAGGCAGCCT ATTCAGATTG

101 AGGCCGACCA AGGTTCGCTC GATCAAGCCA ACCAAAGCAC CACATTCAGC

151 GGAAACGTCG TCATCAGACA GGGTACGCTC AATATTTCCG CCGCCCGCGT

201 CAATGTTACA CGCGGCGGCA AAGGCGGCGA ATCCGTGAGG GCGGAAGGTT

251 CGCCAGTCCG CTTCAGCCAG ACATTGGACG GCGGCAAAGG CACGGTGCGC

301 GGACAGGCAA ACAACGTTGC TTATTCATCT GCAGGCAGCA CCGTAGTCTT

351 AACCGGTAAT GCCAAAGTAC AGCGCGGCGG CGATGTCGCC GAAGGTGCGG

401 TGATTACATA CAACACCAAA ACCGAAGTCT ATACCATCAG CGGCAGCACA

451 AAATCCGGCG CAAAATCCGC TTCCAAATCC GGCAGGGTCA GCGTCGTTAT

501 CCAGCCTTCG AGTACGCAAA AATCCGAATA A
```

This corresponds to the amino acid sequence <SEQ ID 748; ORF 214-1>:

m214-1.pep

```
  1 MIQKICKLFV LIAFFSASPA FALQSDSRQP IQIEADQGSL DQANQSTTFS

 51 GNVVIRQGTL NISAARVNVT RGGKGGESVR AEGSPVRFSQ TLDGGKGTVR

101 GQANNVAYSS AGSTVVLTGN AKVQRGGDVA EGAVITYNTK TEVYTISGST

151 KSGAKSASKS GRVSVVIQPS STQKSE*
```

m214-1/g214-1 93.8% identity in 176 aa overlap

```
                    10        20        30        40        50        60
m214-1.pep   MIQKICKLFVLIAFFSASPAFALQSDSRQPIQIEADQGSLDQANQSTTFSGNVVIRQGTL
             ||||||||||||::|::||||||||||||:|||||||||||||||||||||||:||||||
g214-1       MIQKICKLFVLIVIFATSPAFALQSDSRRPIQIEADQGSLDQANQSTTFSGNVIIRQGTL
                    10        20        30        40        50        60

                    70        80        90       100       110       120
m214-1.pep   NISAARVNVTRGGKGGESVRAEGSPVRFSQTLDGGKGTVRGQANNVAYSSAGSTVVLTGN
             ||||:||||||||||||||||||||||||||||||||||||||:||||||||||||||||
g214-1       NISASRVNVTRGGKGGESVRAEGSPVRFSQTLDGGKGTVRGQAMNVTYSSAGSTVVLTGN
                    70        80        90       100       110       120

                   130       140       150       160       170
m214-1.pep   AKVQRGGDVAEGAVITYNTKTEVYTISGSTKSGAKSASKSGRVSVVIQPSSTQKSEX
             |||||||||||||||||||||||||:|||||||||||||:||||||||||||||:||
g214-1       AKVQRGGDVAEGAVITYNTKTEVYTINGSTKSGAKSASKTGRVSVVIQPSSTQKTEX
                   130       140       150       160       170
```

g214-1/p38685 sp|P38685|YHBN_ECOLI 17.3 KD PROTEIN IN MURA-RPON INTERGENIC REGION PRECURSOR (ORF185) >gi|551336 (U12684) orf185 [*Escherichia coli*]>gi|606139 (U18997) ORF_o185 [*Escherichia coli*]>gi|1789592 (AE000399) orf, hypothetical protein [*Escherichia coli*] Length=185

Score=97.1 bits (238), Expect=6e−20
Identities=57/126 (45%), Positives=74/126 (58%), Gaps=3/126 (2%)

```
Query:  19 PAFALQSDSRQPIQIEADQGSLDQAN-
QSTTFSNVVIRQGTLNISAARVNVTR--GGKGG  76
            PAFA+  D+ QPI IE+DQ SLD    TF+GNV++ QGT+ I+A +
V VTR   G +G
Sbjct:  24 PAFAVTGDTDQPIHIESDQQSLDMQGWV-
VTFTGNVIVTQGTIKINADKVVVTRPGGEQGK  83

Query:  77 ESVRAEGSPVRFSQTLDGGKGTVRGQAN-
NVAYSSAGSTVVLTGNAKVQRGGDVAEGAVIT 136
```

-continued

```
          E +   G P  F Q  D GK  V G A+ Y  A   VVLTGNA +Q+
     +G  IT
Sbjct:  84 EVIDGYGKPATFYQMQDNGK-PVEGHASQMHYELAKDFVVLTGNAY-
LQQVDSNIKGDKIT 142
Query: 137 YNTKTE 142
           Y  K +
Sbjct: 143 YLVKEQ 148
```

The following partial DNA sequence was identified in *N. meningitidis* <SEQ ID 749>:

a214-1.seq

```
  1 ATGATACAAA AGATATGTAA GCTATTTGTT TTAATAGCAT TTTTTTCGGC
 51 GTCCCCCGCT TTTGCCCTTC AAAGCGACAG CAGGCAGCCT ATTCAGATTG
101 AGGCCGACCA AGGTTCGCTC GATCAAGCCA ACCAAAGCAC CACATTCAGC
151 GGAAACGTCG TCATCAGACA GGGTACGCTC AATATTTCCG CCGCCCGCGT
201 CAATGTTACA CGCGGCGGCA AAGGCGGCGA ATCCGTGAGG GCGGAAGGTT
251 CGCCAGTCCG CTTCAGCCAG ACATTGGACG GCGGCAAAGG CACGGTGCGC
301 GGACAGGCAA ACAACGTTGC TTATTCATCT GCAGGCAGCA CCGTAGTCTT
351 AACCGGTAAT GCCAAAGTAC AGCGCGGCGG CGATGTCGCC GAAGGTGCGG
401 TGATTACATA CAACACCAAA ACCGAAGTCT ATACCATCAG CGGCAGCACA
451 AAATCCGGCG CAAAATCCGC TTCCAAATCC GGCAGGGTCA GCGTCGTTAT
501 CCAGCCTTCG AGTACGCAAA AATCCGAATA A
```

This corresponds to the amino acid sequence <SEQ ID 750; ORF 214-1.a>:

a214-1.pep

```
  1 MIQKICKLFV LIAFFSASPA FA LQSDSRQP IQIEADQGSL DQANQSTTFS
 51 GNVVIRQGTL NISAARVNVT RGGKGGESVR AEGSPVRFSQ TLDGGKGTVR
101 GQANNVAYSS AGSTVVLTGN AKVQRGGDVA EGAVITYNTK TEVYTISGST
151 KSGAKSASKS GRVSVVIQPS STQKSE*
```

a214-1/m214-1 100.0% identity in 176 aa overlap

```
                    10        20        30        40        50        60
a214-1.pep   MIQKICKLFVLIAFFSASPAFALQSDSRQPIQIEADQGSLDQANQSTTFSGNVVIRQGTL
             ||||||||||||||||||||||||||||||||||||||||||||||||||||||||||||
m214-1       MIQKICKLFVLIAFFSASPAFALQSDSRQPIQIEADQGSLDQANQSTTFSGNVVIRQGTL
                    10        20        30        40        50        60
                    70        80        90       100       110       120
a214-1.pep   NISAARVNVTRGGKGGESVRAEGSPVRFSQTLDGGKGTVRGQANNVAYSSAGSTVVLTGN
             ||||||||||||||||||||||||||||||||||||||||||||||||||||||||||||
m214-1       NISAARVNVTRGGKGGESVRAEGSPVRFSQTLDGGKGTVRGQANNVAYSSAGSTVVLTGN
                    70        80        90       100       110       120
                   130       140       150       160       170
a214-1.pep   AKVQRGGDVAEGAVITYNTKTEVYTISGSTKSGAKSASKSGRVSVVIQPSSTQKSEX
             |||||||||||||||||||||||||||||||||||||||||||||||||||||||||
m214-1       AKVQRGGDVAEGAVITYNTKTEVYTISGSTKSGAKSASKSGRVSVVIQPSSTQKSEX
                   130       140       150       160       170
```

The following partial DNA sequence was identified in *N. gonorrhoeae* <SEQ ID 751>:

g215.seq

```
  1 atgaaagtaa gatggcggta cggaattgcg ttcccattga tattggcggt
 51 tgccttgggc agcctgtcgg catggttggg ccgtatcagc gaagtcgaaa
101 tcgaggaagt caggctcaat cccgacgaac ctcaatacac aatggacggc
151 ttggacggaa ggcggtttga cgaacaggga tacttgaaag aacatttgag
201 cgcgaaaggt gcgaaacagt ttcccgaaaa cagcgacatc cattttgatt
251 cgccgcatct cgtgttcttc caagaaggca ggctgttgta cgaagtcggc
301 agcgatgaag ccgtttacca taccgaaaac aaacaggttc tttttaaaaa
351 caacgttgtg ctgaccaaaa ccgccgacgg caggcggcag gcgggtaaag
401 tcgaaaccga aaaactgcac gtcgataccg aatctcaata tgcccaaacc
451 gatacgcctg tcagtttcca atatggcgcg tcgcacggtc aggcgggcgg
501 tatgacctac aaccacaaaa caggcatgtt gaacttctca tctaaagtga
551 aagccgcgat ttatgataca aaagatatgt aa
```

This corresponds to the amino acid sequence <SEQ ID 752; ORF 215.ng>:

g215.pep

```
  1 MKVRWRYGIA FPLILAVAlG SLSAWLGRIS EVEIEEVRLN PDEPQYTMDG
 51 LDGRRFDEQG YLKEHLSAKG AKQFPENSDI HFDSPHLVFF QEGRLLYEVG
101 SDEAVYHTEN KQVLFKNNVV LTKTADGRRQ AGKVETEKLH VDTESQYAQT
151 DTPVSFQYGA SHGQAGGMTY NHKTGMLNFS SKVKAAIYDT KDM*
```

The following partial DNA sequence was identified in *N. meningitidis* <SEQ ID 753>:

m215.seq (partial)

```
  1 ..AGCCTGTCGG CATGGTTGGG TCGTATCAGC GAAGTCGAGA TTGAAGAAGT
 51   CAGGCTCAAT CCCGACGAAC CGCAATACAC AATGGACAGC TTGGACGGCA
101   GGCGGTTTGA CGAACAGGGA TACTTGAAAG AACATTTGAG CGCGAAGGGC
151   GCGAAACAGT TTCCGGAAAG CAGCGACATC CATTTTGATT CGCCGCATCT
201   CGTGTTCTTC CAAGAAGGCA GGTTGTTGTA CGAAGTCGGC AGCGACGAAG
251   CCGTTTACCA TACCGAAAAC AAACAGGTTC TTTTTAAAAA CAACGTTGTG
301   CTGACCAAAA CCGCCGACGG CAAACGGCAG GCGGGTAAAG TTGAAGCCGA
351   AAAGCTGCAC GTCGATACCG AATCTCAATA TGCCCAAACC GATACGCCTG
401   CAGTTTCCA ATATGGTGCA TCGCACGGTC AGGCGGGCGG CATGACTTAC
451   GACCACAwwA CAGGCATGTT GAACTTCTCA TCTAAAGTGA AAGCCACGAT
501   TTATGATACA AAAGATATGT AA
```

This corresponds to the amino acid sequence <SEQ ID 754; ORF 215>:

M215.pep (partial)

```
  1 ..SLSAWLGRIS EVEIEEVRLN PDEPQYTMDS LDGRRFDEQG YLKEHLSAKG

 51   AKQFPESSDI HFDSPHLVFF QEGRLLYEVG SDEAVYHTEN KQVLFKNNVV

101   LTKTADGKRQ AGKVEAEKLH VDTESQYAQT DTPVSFQYGA SHGQAGGMTY

151   DHXTGMLNFS SKVKATIYDT KDM*
```

Computer analysis of this amino acid sequence gave the following results:

Homology with a predicted ORF from *N. gonorrhoeae*

ORF 215 shows 96.0% identity over a 173 aa overlap with a predicted ORF (ORF 215.ng) from *N. gonorrhoeae*:

m215/g215

```
                                   10        20        30        40
m215.pep                   SLSAWLGRISEVEIEEVRLNPDEPQYTMDSLDGRRFDEQG
                           ||||||||||||||||||||||||||||:||||||||||
g215      MKVRWRYGIAFPLILAVALGSLSAWLGRISEVEIEEVRLNPDEPQYTMDGLDGRRFDEQG
                 10        20        30        40        50        60
                 50        60        70        80        90       100
m215.pep  YLKEHLSAKGAKQFPESSDIHFDSPHLVFFQEGRLLYEVGSDEAVYHTENKQVLFKNNVV
          ||||||||||||||||:|||||||||||||||||||||||||||||||||||||||||||
g215      YLKEHLSAKGAKQFPENSDIHFDSPHLVFFQEGRLLYEVGSDEAVYHTENKQVLFKNNVV
                 70        80        90       100       110       120
                110       120       130       140       150       160
m215.pep  LTKTADGKRQAGKVEAEKLHVDTESQYAQTDTPVSFQYGASHGQAGGMTYDHXTGMLNFS
          |||||||:|||||||:|||||||||||||||||||||||||||||||||||:| |||||||
g215      LTKTADGRRQAGKVETEKLHVDTESQYAQTDTPVSFQYGASHGQAGGMTYNHKTGMLNFS
                130       140       150       160       170       180
                170
m215.pep  SKVKATIYDTKDMX
          |||||:|||||||
g215      SKVKAAIYDTKDM
                190
```

The following partial DNA sequence was identified in *N. meningitidis* <SEQ ID 755>:

a215.seq

```
  1 ATGAAAGTAA GATGGCGGTA CGGAATTGCG TTCCCATTGA TATTGGCGGT

 51 TGCCTTGGGC AGCCTGTCGG CATGGTTGGG ACGCATCAGC GAAGTCGAGA

101 TTGAAGAAGT CAGGCTCAAT CCCGACGAAC CGCAATACAC AATGGACGGA

151 TTGGATGGCA GGCGGTTTGA CGAACAGGGA TACTTGAAAG AACATTTGAG

201 TTCGAAGGGC GCGAAACAGT TTCCCGAAAG CAGCGACATT CATTTCGACT

251 CACCGCATCT CGTGTTCTTC CAAGAAGGCA GGTTGTTGTA CGAAGTCGGC

301 AGCGATGAAG CCGTTTACCA TACCGAAAAC AAACAGGTTC TTTTTAAAAA

351 CAACGTTGTG CTGACCAAAA CCGCCGACGG CAAACGGCAG GCGGGTAAAG

401 TTGAAGCCGA AAAGCTGCAC GTCGATACCG AATCTCAATA TGCCCAAACC

451 GATACGCCTG TCAGTTTCCA ATATGGTGCA TCGCACGGTC AGGCGGGCGG

501 CATGACTTAC GACCACAAAA CAGGCATGTT GAACTTCTCA TCTAAAGTGA

551 AAGCCACGAT TTATGATACA AAAGATATGT AA
```

This corresponds to the amino acid sequence <SEQ ID 756; ORF 215.a>:

a215.pep

```
  1 MKVRWRYGIA FPLILAVALG SLSAWLGRIS EVEIEEVRLN PDEPQYTMDG
 51 LDGRRFDEQG YLKEHLSSKG AKQFPESSDI HFDSPHLVFF QEGRLLYEVG
101 SDEAVYHTEN KQVLFKNNVV LTKTADGKRQ AGKVEAEKLH VDTESQYAQT
151 DTPVSFQYGA SHGQAGGMTY DHKTGMLNFS SKVKATIYDT KDM*
```

m215/a215 98.3% identity in 173 aa overlap

```
                                     10        20        30        40
m215.pep                     SLSAWLGRISEVEIEEVRLNPDEPQYTMDSLDGRRFDEQG
                             ||||||||||||||||||||||||||||||:||||||||||
a215      MKVRWRYGIAFPLILAVALGSLSAWLGRISEVEIEEVRLNPDEPQYTMDGLDGRRFDEQG
                  10        20        30        40        50        60
                  50        60        70        80        90       100
m215.pep  YLKEHLSAKGAKQFPESSDIHFDSPHLVFFQEGRLLYEVGSDEAVYHTENKQVLFKNNVV
          |||||||:||||||||||||||||||||||||||||||||||||||||||||||||||||
a215      YLKEHLSSKGAKQFPESSDIHFDSPHLVFFQEGRLLYEVGSDEAVYHTENKQVLFKNNVV
                  70        80        90       100       110       120
                 110       120       130       140       150       160
m215.pep  LTKTADGKRQAGKVEAEKLHVDTESQYAQTDTPVSFQYGASHGQAGGMTYDHXTGMLNFS
          |||||||||||||||||||||||||||||||||||||||||||||||||||| |||||||
a215      LTKTADGKRQAGKVEAEKLHVDTESQYAQTDTPVSFQYGASHGQAGGMTYDHKTGMLNFS
                 130       140       150       160       170       180
                 170
m215.pep  SKVKATIYDTKDMX
          ||||||||||||||
a215      SKVKATIYDTKDMX
                 190
```

The following partial DNA sequence was identified in *N. gonorrhoeae* <SEQ ID 757>:

g216.seq (partial)

```
  1 ..atgatatcga tttcgagctc ggtacccagc gacgaaatca ccgccatcat
 51   ccccgcactc aaacgcaaag acattaccct cgtctgcatc accgcccgcc
102   ccgattcaac catggcgcgc catgccgata tccacatcac cgcatcggtt
151   tcgcaagaag cctgcccgtt ggggcttgcc ccgaccacca gcaccaccgc
201   cgttatggct ttgggcgacg cgttggcggt cgtcctgctg cgcgcccgcg
251   cgttcacgcc cgacgacttc gccttgatcc accctgccgg cagcctcggc
301   aaacgcctgc ttttgcgcgt tgccgacatt atgcacaaag gcggcggcct
351   gcccgccgtc cgactcggca cgcccttgaa aggagccatc gtcagcatga
401   gcgagaaagg tttgggcatg tgggcgggaa cggacgggca aaggctgtct
451   gaaaggcctt tttactga
```

This corresponds to the amino acid sequence <SEQ ID 758; ORF 216.ng>:

g216.pep (partial)

```
  1 ..MISISSSVPS DEITAIIPAL KRKDITLVCI TARPDSTMAR HADIHITASV
 51   SQEACPLGLA PTTSTTAVMA LGDALAVVLL RARAFTPDDF ALIHPAGSLG
101   KRLLLRVADI MHKGGGLPAV RLGTPLKGAI VSMSEKGLGM WAGTDGQRLS
151   ERPFY*
```

The following partial DNA sequence was identified in *N. meningitidis* <SEQ ID 759>:

m216.seq

```
  1 ATGGCAATGG CAGAAAACGG AAAATATCTC GACTGGGCAC GCGAAGTGTT
 51 GCACGCCGAA GCGGAAGGCT TGCGCGAAAT TGCAGCGGAA TTGsACAAAA
101 ACTTCGTCCT TGCGGCAGAC GCGTTGTTGC ACTGCAAGGG CAGGGTCGTT
151 ATCACGGGCA TGGTCAAGTC GGGACATATC GGGCGCAAAA TGGCGGCAAC
201 TATGGCCTCG ACCGGCACGC CTGCGTTTTT CGTCCACCCT GCGGAAGCGG
251 CACACGgCGA TTTGGGTATG ATTGTGGACA rCGACGTGGT CGTCGCGATT
301 TCCAATTCCG GCGAAAGCGA CGAAATCGCC GCCATCATCC CCGCACTCAA
351 ACGCAAAGAC ATCACGCTTG TCTGCATCAC CGCCCGCCCC GATTCAACCA
401 TGGCGCGCCA TGCCGACATC CACATCACGG CGTCGGTTTC CAAAGAAGCC
451 TGCCCGCTGG GGCTTGCCCC GACCACCAGC ACCACCGCCG TCATGGCTTT
501 GGGCGATGCG TTGGCGGTCG TCCtGCTGCG CgcACGCGCG TTCACGCCCG
551 ACGATTTCGC CTTGAGCCAT CCTGCCGGCA GCCTCGGCAA ACGCCTACTT
601 TTGCGCGTTG CCGACATTAT GCACAAAGGC GGCGGCCTGC CTGCCGTCCG
651 ACTCGGCACG CCCTTGAAAG AAGCCATCGT CAGCATGAGT GAAAAAGGGC
701 TGGGCATGTT GGCGGTAACG GACGGGCAAG GCCGTCTGAA AGGCGTATTC
751 ACCGACGGCG ATTTGCGCCG CCTGTTTCAA GAATGCGACA ATTTTACCGG
801 TCTTTCGATA GACGAAGTCA TGCATACGCA TCCTAAAACC ATCTCCGCCG
851 AACGTCTCGC CACCGAAGCC CTGAAAGTCA TGCAGGCAAA CCATGTGAAC
901 GGGCTTCTGG TTACCGATGC AGATGGCGTG CTGATCGGCG CGCTGAATAT
951 GCACGACCTG CTGGCGGCAC GGATTGTATA G
```

This corresponds to the amino acid sequence <SEQ ID 760; ORF 216>:

m216.pep

```
  1 MAMAENGKYL DWAREVLHAE AEGLREIAAE LXKNFVLAAD ALLHCKGRVV
 51 ITGMVKSGHI GRKMAATMAS TGTPAFFVHP AEAAHGDLGM IVDXDVVVAI
101 SNSGESDEIA AIIPALKRKD ITLVCITARP DSTMARHADI HITASVSKEA
151 CPLGLAPTTS TTAVMALGDA LAVVLLRARA FTPDDFALSH PAGSLGKRLL
201 LRVADIMHKG GGLPAVRLGT PLKEAIVSMS EKGLGMLAVT DGQGRLKGVF
251 TDGDLRRLFQ ECDNFTGLSI DEVMHTHPKT ISAERLATEA LKVMQANHVN
301 GLLVTDADGV LIGALNMHDL LAARIV*
```

Computer analysis of this amino acid sequence gave the following results:

Homology with a predicted ORF from *N. gonorrhoeae*

ORF 216 shows 91.8% identity over a 147 aa overlap with a predicted ORF (ORF 216.ng) from *N. gonorrhoeae*:

m216/g216

```
            70        80        90       100       110       120
m216.pep  TMASTGTPAFFVHPAEAAHGDLGMIVDXDVVVAISNSGESDEIAAIIPALKRKDITLVCI
                                                :::||:|  ||||:|||||||||||||||
g216                                            MISISSSVPSDEITAIIPALKRKDITLVCI
                                                        10        20        30

           130       140       150       160       170       180
m216.pep  TARPDSTMARHADIHITASVSKEACPLGLAPTTSTTAVMALGDALAVVLLRARAFTPDDF
          ||||||||||||||||||||:|||||||||||||||||||||||||||||||||||||||
g216      TARPDSTMARHADIHITASVSQEACPLGLAPTTSTTAVMALGDALAVVLLRARAFTPDDF
                  40        50        60        70        80        90

           190       200       210       220       230       240
m216.pep  ALSHPAGSLGKRLLLRVADIMHKGGGLPAVRLGTPLKEAIVSMSEKGLGMLAVTDGQGRL
          || |||||||||||||||||||||||||||||||||| |||||||||||| |  ||||
g216      ALIHPAGSLGKRLLLRVADIMHKGGGLPAVRLGTPLKGAIVSMSEKGLGMWAGTDGQRLS
                 100       110       120       130       140       150
```

The following partial DNA sequence was identified in *N. meningitidis* <SEQ ID 761>:

a216.seq

```
  1 ATGGCGATGG CAGGAAACGA AAAATATCTT GATTGGGCAC GCGAAGTGTT
 51 GCACACCGAA GCGGAAGGCT TGCGCGAAAT TGCGGCGGAT TTGGACGAAA
101 ACTTCGCCCT TGCGGCGGAC GCGTTGTTGC ACTGCAAAGG CAGGGTCGTT
151 ATCACGGGCA TGGGCAAGTC GGGACATATC GGGCGCAAAA TGGCGGCAAC
201 CATGGCCTCG ACCGGCACGC CCGCGTTTTT CGTCCACCCT GCGGAAGCGG
251 CACACGGCGA TTTGGGCATG ATTGTGGACA ACGACGTGGT CGTCGCGATT
301 TCCAATTCCG GTGAAAGCGA CGAAATCGCC GCCATCATCC CCGCGCTCAA
351 ACGCAAAGAT ATCACGCTTG TCTGCATCAC CGCCCGCCCC GATTCAACCA
401 TGGCGCGCCA TGCCGACATC CACATCACGG CGTCGGTTTC CAAAGAAGCC
451 TGCCCGCTGG GGCTTGCCCC GACCACCAGC ACCACCGCCG TTATGGCTTT
501 GGGCGATGCG TTGGCGGTTG TCCTGCTGCG CGCCCGCGCG TTCACGCCCG
551 ACGACTTCGC CTTGAGCCAC CCTGCCGGCA GCCTCGGCAA ACGCCTACTT
601 TTGCGCGTTG CCGACATTAT GCACAAAGGC GGCGGCCTGC CTGCCGTCCG
651 ACTCGGCACG CCCTTGAAAG AAGCCATCGT CAGCATGAGT GAAAAAGGGC
701 TGGGCATGTT GGCGGTAACG GACGGGCAAG GCCGTCTGAA AGGCGTATTC
751 ACCGACGGCG ATTTGCGCCG CCTGTTTCAA GAATGCGACA ATTTTACCGG
801 TCTTTCGATA GACGAAGTCA TGCATACGCA TCCTAAAACC ATCTCCGCCG
851 AACGTCTCGC CACCGAAGCC CTGAAAGTCA TGCAGGCAAA CCATGTGAAC
901 GGGCTTCTGG TTACCGATGC AGATGGCGTG CTGATCGGCG CGCTGAATAT
951 GCACGACCTT TTGGCGGCGC GGATTGTATA G
```

This corresponds to the amino acid sequence <SEQ ID 762; ORF 216.a>:

a216.pep

```
  1 MAMAGNEKYL DWAREVLHTE AEGLREIAAD LDENFALAAD ALLHCKGRVV
 51 ITGMGKSGHI GRKMAATMAS TGTPAFFVHP AEAAHGDLGM IVDNDVVVAI
```

-continued

```
101 SNSGESDEIA AIIPALKRKD ITLVCITARP DSTMARHADI HITASVSKEA

151 CPLGLAPTTS TTAVMALGDA LAVVLLRARA FTPDDFALSH PAGSLGKRLL

201 LRVADIMHKG GGLPAVRLGT PLKEAIVSMS EKGLGMLAVT DGQGRLKGVF

251 TDGDLRRLFQ ECDNFTGLSI DEVMHTHPKT ISAERLATEA LKVMQANHVN

301 GLLVTDADGV LIGALNMHDL LAARIV*
```

m216/a216 97.2% identity in 326 aa overlap

```
                    10        20        30        40        50        60
m216.pep    MAMAENGKYLDWAREVLHAEAEGLREIAAELXKNFVLAADALLHCKGRVVITGMVKSGHI
            |||| | ||||||||||:|||||||||:|  :||:||||||||||||||||| |||||
a216        MAMAGNEKYLDWAREVLHTEAEGLREIAADLDENFALAADALLHCKGRVVITGMGKSGHI
                    10        20        30        40        50        60

                    70        80        90       100       110       120
m216.pep    GRKMAATMASTGTPAFFVHPAEAAHGDLGMIVDXDVVVAISNSGESDEIAAIIPALKRKD
            |||||||||||||||||||||||||||||||||| |||||||||||||||||||||||||
a216        GRKMAATMASTGTPAFFVHPAEAAHGDLGMIVDNDVVVAISNSGESDEIAAIIPALKRKD
                    70        80        90       100       110       120

                   130       140       150       160       170       180
m216.pep    ITLVCITARPDSTMARHADIHITASVSKEACPLGLAPTTSTTAVMALGDALAVVLLRARA
            ||||||||||||||||||||||||||||||||||||||||||||||||||||||||||||
a216        ITLVCITARPDSTMARHADIHITASVSKEACPLGLAPTTSTTAVMALGDALAVVLLRARA
                   130       140       150       160       170       180

                   190       200       210       220       230       240
m216.pep    FTPDDFALSHPAGSLGKRLLLRVADIMHKGGGLPAVRLGTPLKEAIVSMSEKGLGMLAVT
            ||||||||||||||||||||||||||||||||||||||||||||||||||||||||||||
a216        FTPDDFALSHPAGSLGKRLLLRVADIMHKGGGLPAVRLGTPLKEAIVSMSEKGLGMLAVT
                   190       200       210       220       230       240

                   250       260       270       280       290       300
m216.pep    DGQGRLKGVFTDGDLRRLFQECDNFTGLSIDEVMHTHPKTISAERLATEALKVMQANHVN
            ||||||||||||||||||||||||||||||||||||||||||||||||||||||||||||
a216        DGQGRLKGVFTDGDLRRLFQECDNFTGLSIDEVMHTHPKTISAERLATEALKVMQANHVN
                   250       260       270       280       290       300

                   310       320
m216.pep    GLLVTDADGVLIGALNMHDLLAARIVX
            |||||||||||||||||||||||||||
a216        GLLVTDADGVLIGALNMHDLLAARIVX
                   310       320
```

The following partial DNA sequence was identified in *N. gonorrhoeae* <SEQ ID 763>:

g217.seq

```
  1 atggcggatg acggtttgtt gcggcaactg tccgaaaaac ccagccaaag

 51 tgctctcttc ctgccatttg acccattcgt tttcgaggtt ttggactgcc

101 ttttggtcat cgggcccggc ttgaaacaat gtttcaagca aatcccggca

151 acgcgccacc cattcgccga ccgtcgcagg ttgccgccat atccgggcaa

201 tatccgacag ggtttcgagg aaggcggcaa aacgtccgaa catggcggtt

251 tgattcacgt cggcatacca cgcgctgaca tcctgccaca tcgggttgcc

301 gccttcgggc agcatccagc ccaatatcat acggtctgcc gcctgcttcc

351 aggtaaacag ctgatccgtg ccgccgcgca tttctccgtc caatccccaa

401 tggacgttca aatcggcaac catatcgtgc aaaagcggca aatcgtcccc

451 ggtcagtccg aaacggcgca acacgggcgc ggtttccaaa agcgcgagca

501 ctttgccgac ttcaaaacgg ctttccagca agtcggacac gcactccaac
```

-continued

```
551 gcataaaaaa acggttgccg gcggctgatt ttcacgtccg aaacggaata
601 cggcaatgcc tgcgcgccgg gttgcgcctg tccgaacacg gcttccataa
651 aaggcgtata gggttcgata ttcggggtta a
```

This corresponds to the amino acid sequence <SEQ ID 764; ORF 217.ng>:

g217.pep..

```
  1 MADDGLLRQL SEKPSQSALF LPFDPFVFEV LDCLLVIGPG LKQCFKQIPA
 51 TRHPFADRRR LPPYPGNIRQ GFEEGGKTSE HGGLIHVGIP RADILPHRVA
101 AFGQNPAQYN TVCRLLPGKQ LIRAAAHFSV QSPMDVQIGN HIVQKRQIVP
151 GQSETAQHGR GFQKREHFAD FKTAFQQVGH ALQRIKKRLP AADFHVRNGI
201 RQCLRAGLRL SEHGFHKRRI GFDIRG*
```

The following partial DNA sequence was identified in *N. meningitidis* <SEQ ID 765>:

m217.seq

```
  1 ATGGCGGATG ACGGTGTGCG GCGGCAACTG TCCGGAAAAT TGCGCCAATT
 51 CGGTTTCCGC CTrCCATTTG ACCCATTCGT TTTCAAGGTT TTGGACTGAC
101 TTTTGGTCAT CGGCTTCAGC TTGGAACAAT GTTTCAAGCA AATCCCGGCA
151 ACGCGCCACC CATTCGCCGA CCGTTGCGGG CTGCCGCCAT ATCCGTACAA
201 TATCCGTCAG GGTTTCGAGG AAGGCGGCAA AACGTCCGAA CATGGCGGTT
251 TGATTCACGT CGGCATACCA CGCGCTGACA TCCTGCCACA TCGGATTGCC
301 GCCTTTGGGC AGCATCCAGC CCAATATCAT GCGTTCTACC GCCTGCTTCC
351 AGGTGAACAG CTGATCCGTG CCGCCGCGCA TTTCTCCGTC CAAACCCCAG
401 TGGACGTTCA AATCGGCAAC CATGTCGTGC AAAAGCGGTA AATCGTCCTC
451 AGTCAGTCCG AAACGGCGCA ACACGGGCGC GGTTTCTAAA AGCACAAGCA
501 CTTTATCGAC TTCAAATCGG CTTTCCAACA AGTCGAACAG GCATGACAAA
551 GCATGAAACA GCGGTTGGCG GCGGCTGATT TTCACGTCTG ACACGGAATA
601 CGGCAATGCC TGCGCACCgG GctGCGCCTG TCCGAACACG GCTTCGATAA
651 AAGGCGTATA GGATTCGATA TTCGGGGTTA A
```

This corresponds to the amino acid sequence <SEQ ID 766; ORF 217>:

m217.pep

```
  1 MADDGVRRQL SGKLRQFGFR LPFDPFVFKV LDXLLVIGFS LEQCFKQIPA
 51 TRHPFADRCG LPPYPYNIRQ GFEEGGKTSE HGGLIHVGIP RADILPHRIA
101 AFGQHPAQYH AFYRLLPGEQ LIRAAAHFSV QTPVDVQIGN HVVQKRXIVL
151 SQSETAQHGR GFXKHKHFID FKSAFQQVEQ AXQSMKQRLA AADFHVXHGI
201 RQCLRTGLRL SEHGFDKRRI GFDIRG*
```

Computer analysis of this amino acid sequence gave the following results:

Homology with a predicted ORF from *N. gonorrhoeae*

ORF 217 shows 80.5% identity over a 226 aa overlap with a predicted ORF (ORF 217.ng) from *N. gonorrhoeae*:

m217/g217

```
                   10        20        30        40        50        60
m217.pep   MADDGVRRQLSGKLRQFGFRLPFDPFVFKVLDXLLVIGFSLEQCFKQIPATRHPFADRCG
           |||||: |||| |   | :: ||||||||:||| ||||| :|:||||||||||||||||
g217       MADDGLLRQLSEKPSQSALFLPFDPFVFEVLDCLLVIGPGLKQCFKQIPATRHPFADRRR
                   10        20        30        40        50        60

                   70        80        90       100       110       120
m217.pep   LPPYPYNIRQGFEEGGKTSEHGGLIHVGIPRADILPHRIAAFGQHPAQYHAFYRLLPGEQ
           ||||| ||||||||||||||||||||||||||||||||:|||||||||||:  |||||:|
g217       LPPYPGNIRQGFEEGGKTSEHGGLIHVGIPRADILPHRVAAFGQHPAQYHTVCRLLPGKQ
                   70        80        90       100       110       120

                  130       140       150       160       170       180
m217.pep   LIRAAAHFSVQTPVDVQIGNHVVQKRXIVLSQSETAQHGRGFXKHKHFIDFKSAFQQVEQ
           ||||||||||:|:|||||||:||||  || :||||||||||| |::|| |||:||||| :
g217       LIRAAAHFSVQSPMDVQIGNHIVQKRQIVPGQSETAQHGRGFQKREHFADFKTAFQQVGH
                  130       140       150       160       170       180

                  190       200       210       220
m217.pep   AXQSMKQRLAAADFHVXHGIRQCLRTGLRLSEHGFDKRRIGFDIRGX
           | | :|:|| |||||| :|||||||:|||||||||| ||||||||||
g217       ALQRIKKRLPAADFHVRNGIRQCLRAGLRLSEHGFHKRRIGFDIRG
                  190       200       210       220
```

The following partial DNA sequence was identified in *N. meningitidis* <SEQ ID 767>:

a217.seq

```
  1 GTGGCGGATG ACGGTGTGCA GCGGCAACTG TCCGGAAAAT TGCGCCAATT
 51 CGGTTTCCGC CTGCCATTTG ACCCATTCGT TTTCGAGGCT TTGGACTGCC
101 TTTTGGTCAT CGCCTTCGAC TTGGAACAAT GTTTCAAGCA AATCCCGGCA
151 ACGCGCCACC CATTCGTCAA CCGTCGCAGG TTGCCGCCAT ATCCGTACAA
201 TATCCGTCAG GGTTTCGAGG AAGGCGGCAA AACGTCCGAA CAGGGCGGTT
251 TGGTTCACGT CGGCATACCA CGCGCTGACC CCCTGCCACA TCGGATTGCC
301 GCCTTCGGGC AGCATCCAGC CCAATATCAT GCGTTCTACC GCCTGCTTCC
351 AGGTGAACAG CTGATCCGTG CCGCCGCGCA TTTCTCCGTC CAAACCCCAG
401 CGGACGTTCA AATCGGCAAC CATGTCGTGC AAAAGCGGCA AATCGTCCTC
451 AGTCAGTCCG AAATGGCGCA ACACGGGCGC GGTTTCTAAA AGCACAAGCA
501 CTTTATCGAC TTCAAATCGG CTTTCCAACA AGTCGAACAG GCATGACAAA
551 GCATGAAACA GCGGTTGTCG GCGGCTGATT TTCACATCCG AAACGGAATA
601 CGGCAATGCC TGCGCGCCGG GCTGCGCCTG TCCGAACACG GCTTCGATAA
651 AAGGCGTATA GGATTCGATA TTCGGGGTTA A
```

This corresponds to the amino acid sequence <SEQ ID 768; ORF 217.a>:

a217.pep

```
  1 VADDGVQRQL SGKLRQFGFR LPFDPFVFEA LDCLLVIAFD LEQCFKQIPA
 51 TRHPFVNRRR LPPYPYNIRQ GFEEGGKTSE QGGLVHVGIP RADPLPHRIA
```

-continued

```
101 AFGQHPAQYH AFYRLLPGEQ LIRAAAHFSV QTPADVQIGN HVVQKRQIVL

151 SQSEMAQHGR GF*KHKHFID FKSAFQQVEQ A*QSMKQRLS AADFHIRNGI

201 RQCLRAGLRL SEHGFDKRRI GFDIRG*
```

m217/a217 90.3% identity in 226 aa overlap

```
                   10        20        30        40        50        60
m217.pep   MADDGVRRQLSGKLRQFGFRLPFDPFVFKVLDXLLVIGFSLEQCFKQIPATRHPFADRCG
           :|||||:|||||||||||||||||||||::|| ||||:|:|||||||||||||||::|  
a217       VADDGVQRQLSGKLRQFGFRLPFDPFVFEALDCLLVIAFDLEQCFKQIPATRHPFVNRRR
                   10        20        30        40        50        60

                   70        80        90       100       110       120
m217.pep   LPPYPYNIRQGFEEGGKTSEHGGLIHVGIPRADILPHRIAAFGQHPAQYHAFYRLLPGEQ
           ||||||||||||||||||||:|||:|||||||| ||||||||||||||||||||||||||
a217       LPPYPYNIRQGFEEGGKTSEQGGLVHVGIPRADPLPHRIAAFGQHPAQYHAFYRLLPGEQ
                   70        80        90       100       110       120

                  130       140       150       160       170       180
m217.pep   LIRAAAHFSVQTPVDVQIGNHVVQKRXIVLSQSETAQHGRGFXKHKHFIDFKSAFQQVEQ
           |||||||||||||:|||||||||||| ||||||| |||||||||||||||||||||||||
a217       LIRAAAHFSVQTPADVQIGNHVVQKRQIVLSQSEMAQHGRGFXKHKHFIDFKSAFQQVEQ
                  130       140       150       160       170       180

                  190       200       210       220
m217.pep   AXQSMKQRLAAADFHVXHGIRQCLRTGLRLSEHGFDKRRIGFDIRGX
           |||||||||:|||||: :|||||||:|||||||||||||||||||||
a217       AXQSMKQRLSAADFHIRNGIRQCLRAGLRLSEHGFDKRRIGFDIRGX
                  190       200       210       220
```

The following partial DNA sequence was identified in *N. gonorrhoeae* <SEQ ID 769>:

g218.seq

```
  1 atggttgcgg tggatcctta tacggcaaaa gtggtcaaca ccatgccgcg

 51 caatcagggt tggtatcaca ctatggatga aatccacggc gatatgatgc

101 tcggtgcggc aggcgattat cttttggaaa cggcagcttc actgaccatt

151 attatggttg tcagcggctt gtacctttgg tgggcgaaac agcgcggcat

201 taaagcgatg ctgctgccgc caaaaagcag ggcgcgttct tggtggcgga

251 atctgcacgg cgcgtttgga acttgggtgt cgttgatttt actgttgttc

301 tgcctgtcgg gtattgcttg ggcaggtatt tggggcggca aattcgtgca

351 ggcttggaat cagttcccgg ccggcaaatg gggtgtcgaa ccgaaccccg

401 tttcaatcgt gccgacccac ggcgaggtat tgaatgacgg caaggttaag

451 gaagtgccgt ggattttgga gcttatgcct atgcctgtct cagggacgac

501 tgtgggtgaa aacggcatta accccaccga gcccaataac attggaaacc

551 gtcgaccgtt tcgcgcggga aatcggtttc aaagggcgtt atcagttgaa

601 tttgcccaaa ggcgaggacg gggtatggac tttgtcgcag gattctatga

651 gttatga
```

This corresponds to the amino acid sequence <SEQ ID 770; ORF 218.ng>:

g218.pep

```
  1 MVAVDPYTAK VVNTMPRNQG WYHTMDEIHG DMMLGAAGDY LLETAASLTI

 51 IMVVSGLYLW WAKQRGIKAM LLPPKSRARS WWRNLHGAFG TWVSLILLLF
```

-continued

```
101 CLSGIAWAGI WGGKFVQAWN QFPAGKWGVE PNPVSIVPTH GEVLNDGKVK

151 EVPWILELMP MPVSGTTVGE NGINPTEPNN IGNRRPFRAG NRFQRALSVE

201 FAQRRGRGMD FVAGFYEL*
```

The following partial DNA sequence was identified in *N. meningitidis* <SEQ ID 771>:

m218.seq

```
  1 ATGGTCGCGG TCGATCCTTA TACGGCAAAA GTGGTCAGTA CCATGCCGCG

 51 CAATCAGGGT TGGTATTACA CGATGGATGA AATCCACAGC GATATGATGC

101 TCGGTGCGGC AGGCGATTAT CTTTTGGAAA CGGCAGCTTC ACTGACCATT

151 ATTATGGTTG TCAGCGGCTT GTACCTTTGG TGGGTGAAAC GGCGCGGCAT

201 CAAGGCGATG CTGCTGCCGT CAAAAGGCAr GGCGCGTTCT TGGTGGCGGA

251 ATCTGCACGG CACGTTTGGA ACTTGGGTGT CGTTGATTTT GCTGTTGTTC

301 TGCCTGTCGG GTATTGCTTG GGCGGGTATT TGGGGCGGCA AGTTCGTACA

351 GGCTTGGAGT CAGTTCCCTG CCGGTAAATG GGGTGTCGAA CCGAACCCCG

401 TTTCAGTCGT GCCGACCCAC GGCGAGGTAT TGAATGACGG CAAGGTTAAG

451 GAAGTGCCGT GGGTTTTGGA GCTTACGCCT ATGCCTGTTT CAGGGACGaC

501 yGtgGGCAAA GACGGCATTA ACCCTGACGA GCCGATGACA TTGGAAACCG

551 TCGACCGCTT TGCGCGGnGA AATCGGTTTC AAAGGGCGTT ATCAGTTGAA

601 TTTGCCCAAA GGCGAGGACG GCGTATGGAC TTTGTCGCAG GATTCTATGA

651 GTTA
```

This corresponds to the amino acid sequence <SEQ ID 772; ORF 218>:

m218.pep

```
  1 MVAVDPYTAK VVSTMPRNQG WYYTMDEIHS DMMLGAAGDY LLETAASLTI

 51 IMVVSGLYLW WVKRRGIKAM LLPSKGXARS WWRNLHGTFG TWVSLILLLF

101 CLSGIAWAGI WGGKFVQAWS QFPAGKWGVE PNPVSVVPTH GEVLNDGKVK

151 EVPWVLELTP MPVSGTTVGK DGINPDEPMT LETVDRFARX NRFQRALSVE

201 FAQRRGRRMD FVAGFYEL
```

Computer analysis of this amino acid sequence gave the following results:

Homology with a predicted ORF from *N. gonorrhoeae*

ORF 218 shows 87.2% identity over a 218 aa overlap with a predicted ORF (ORF 218.ng) from *N. gonorrhoeae*:

m218/g218

```
                    10        20        30        40        50        60
m218.pep   MVAVDPYTAKVVSTMPRNQGWYYTMDEIHSDMMLGAAGDYLLETAASLTIIMVVSGLYLW
           |||||||||||:|||||||||:||||||:|||||||||||||||||||||||||||||||
g218       MVAVDPYTAKVVNTMPRNQGWYHTMDEIHGDMMLGAAGDYLLETAASLTIIMVVSGLYLW
                    10        20        30        40        50        60
```

-continued

```
                  70        80        90       100       110       120
m218.pep  WVKRRGIKAMLLPSKGXARSWWRNLHGTFGTWVSLILLLFCLSGIAWAGIWGGKFVQAWS
          |:|:||||||||| |: ||||||||||:||||||||||||||||||||||||||||||:
g218      WAKQRGIKAMLLPPKSRARSWWRNLHGAFGTWVSLILLLFCLSGIAWAGIWGGKFVQAWN
                  70        80        90       100       110       120

                 130       140       150       160       170       180
m218.pep  QFPAGKWGVEPNPVSVVPTHGEVLNDGKVKEVPWVLELTPMPVSGTTVGKDGINPDEPMT
          |||||||||||||||:||||||||||||||||||:||| ||||||||||::|||| || :
g218      QFPAGKWGVEPNPVSIVPTHGEVLNDGKVKEVPWILELMPMPVSGTTVGENGINPTEPNN
                 130       140       150       160       170       180

                 190       200       210
m218.pep  LETVDRFARXNRFQRALSVEFAQRRGRRMDFVAGFYEL
          : :   |   ||||||||||||||||| ||||||||||
g218      IGNRRPFRAGNRFQRALSVEFAQRRGRGMDFVAGFYEL
                 190       200       210
```

The following partial DNA sequence was identified in *N. meningitidis* <SEQ ID 773>:

a218.seq

```
  1 ATGGTCGCGG TCGATCCTTA TACGGCAAAA GTGGTCAGTA CCATGCCGCG
 51 CAATCAGGGT TGGTATTACG CGATGGATGA AATCCACAGC GATATGATGC
101 TCGGTTCGAC AGGTGATTAT CTTTTGGAAA CGGCTGCATC GCTGACGATT
151 ATCATGATAA TCAGCGGTTT GTACCTTTGG TGGGTGAAAC GGCGCGGCAT
201 CAAGGCGATG CTGCTGCCGC CAAAAGGCAG GGCGCGTTCT TGGTGGCGGA
251 ATCTGCACGG CGCGTTTGGA ACTTGGGTGT CGTTGATTTT ACTGTTGTTC
301 TGCCTGTCGG GTATTGCTTG GGCAGGTATT TGGGGCGGCA AGTTCGTGCA
351 GGCTTGGAGT CAGTTCCCGG CAGGCAAATG GGGTGTCGAA CCGAACCCTG
401 TTTCAGTCGT GCCGACCCAC GGCGAGGTAT TGAATGACGG CAAGGTTAAG
451 GAAGTGCCGT GGGTTTTGGA GCTTACGCCT ATGCCTGTTT CAGGGACGAC
501 TGTGGGCAAA GACGGTATTA ACCCTGACGA GCCGATGACA TTGGAAACCG
551 TCGACCGTTT TGCGCGG.GA AATCGGTTTC AAAGGGCGTT ATCAGCTGAA
601 TTTGCCCAAA GGCGAGGACG GCGTATGGAC TTTGTCGCAG GATTCTATGA
651 GTTA
```

This corresponds to the amino acid sequence <SEQ ID 774; ORF 218.a>:

a218.pep

```
  1 MVAVDPYTAK VVSTMPRNQG WYYAMDEIHS DMMLGSTGDY LLETAASLTI
 51 IMIISGLYLW WVKRRGIKAM LLPPKGRARS WWRNLHGAFG TWVSLILLLF
101 CLSGIAWAGI WGGKFVQAWS QFPAGKWGVE PNPVSVVPTH GEVLNDGKVK
151 EVPWVLELTP MPVSGTTVGK DGINPDEPMT LETVDRFARX NRFQRALSAE
201 FAQRRGRRMD FVAGFYEL
```

m218/a218 95.9% identity in 218 aa overlap

```
                   10        20        30        40        50        60
m218.pep  MVAVDPYTAKVVSTMPRNQGWYYTMDEIHSDMMLGAAGDYLLETAASLTIIMVVSGLYLW
          |||||||||||||||||||||||:|||||||||||::|||||||||||||||::||||||
a218      MVAVDPYTAKVVSTMPRNQGWYYAMDEIHSDMMLGSTGDYLLETAASLTIIMIISGLYLW
                   10        20        30        40        50        60

                   70        80        90       100       110       120
m218.pep  WVKRRGIKAMLLPSKGXARSWWRNLHGTFGTWVSLILLLFCLSGIAWAGIWGGKFVQAWS
          ||||||||||||| || ||||||||||:||||||||||||||||||||||||||||||||
a218      WVKRRGIKAMLLPPKGRARSWWRNLHGAFGTWVSLILLLFCLSGIAWAGIWGGKFVQAWS
                   70        80        90       100       110       120

                  130       140       150       160       170       180
m218.pep  QFPAGKWGVEPNPVSVVPTHGEVLNDGKVKEVPWVLELTPMPVSGTTVGKDGINPDEPMT
          ||||||||||||||||||||||||||||||||||||||||||||||||||||||||||||
a218      QFPAGKWGVEPNPVSVVPTHGEVLNDGKVKEVPWVLELTPMPVSGTTVGKDGINPDEPMT
                  130       140       150       160       170       180
                  190       200       210
m218.pep  LETVDRFARXNRFQRALSVEFAQRRGRRMDFVAGFYEL
          ||||||||||||||||||:|||||||||||||||||||
a218      LETVDRFARXNRFQRALSAEFAQRRGRRMDFVAGFYEL
                  190       200       210
```

The following partial DNA sequence was identified in *N. gonorrhoeae* <SEQ ID 775>:

```
g219.seq

  1 atgacggcaa ggttaaggaa gtgccgtgga ttttggagct tatgcctatg
 51 cctgtctcag ggacgactgt gggtgaaaac ggcattaacc ccaccgagcc
101 caataacatt ggaaaccgtc gaccgtttcg cgcgggaaat cggtttcaaa
151 gggcgttatc agttgaattt gcccaaaggc gaggacgggg tatggacttt
201 gtcgcaggat tctatgagtt atgacatgat cagcccgttt gccgaccgca
251 cggtacatat cgaccagtac agcggcgaga ttcttgccga catccgtttt
301 gacgattaca acccgttcgg caaatttatg gcggcaagca ttgcgctgca
351 tatggggact ttgggctggt ggagcgtgtt ggcgaacgtc gtgttctgcc
401 ttgccgtgat ttttatcggc atcagcggct gcgtgatgtg gtggaaacgc
451 cgtccgtccg gcgtggcggg cattgttcct ccggcgcaaa aaatcaaact
501 gcccgtctgg tgggcgatgg cattgccgct gctgttgatt gcactgcttt
551 tcccgaccgc gctgcttgcc attgccgtga tttggctgtt ggataccttg
601 ctgctgtcgc ggattcctgt gttgaggaaa tggtttaaat ga
```

This corresponds to the amino acid sequence <SEQ ID 776; ORF 219.ng>:

```
g219.pep

  1 MTARLRKCRG FWSLCLCLSQ GRLWVKTALT PPSPITLETV DRFAREIGFK
 51 GRYQLNLPKG EDGVWTLSQD SMSYDMISPF ADRTVHIDQY SGEILADIRF
101 DDYNPFGKFM AASIALHMGT LGWWSVLANV VFCLAVIFIG ISGCVMWWKR
151 RPSGVAGIVP PAQKIKLPVW WAMALPLLLI ALLFPTALLA IAVIWLLDTL
201 LLSRIPVLRK WFK*
```

The following partial DNA sequence was identified in *N. meningitidis* <SEQ ID 777>:

m219.seq

```
  1 ATGACGGCAA GGTTAAGGAA GTGCCGTGGG TTTTGGAGCT TACGCCTATG
 51 CCTGTTTCAG GGACGaCyGt gGGCAAAGAC GGCATTAACC CTGACGAGCC
101 GATGACATTG GAAACCGTCG ACCGCTTTGC GCGGnGAAAT CGGTTTCAAA
151 GGGCGTTATC AGTTGAATTT GCCCAAAGGC GAGGACGGCG TATGGACTTT
201 GTCGCAGGAT TCTATGAGTT ACGACATGAT CAGCCCGTTT GCCGACCGCA
251 CGGTACATAT CGACCAGTAC AGCGGCAAAA TCCTTGCCGA CATCCGTTTT
301 GACGATTACA ACCCGTTCGG CAAATTTATG GCGGCAAGCA TTGCGCTGCA
351 TATGGGGACT CTGGGCTGGT GGAGCGTGTT GGCGAACGTC TTGTTCTGCC
401 TTGCCGTCAT TTTTATCGGT ATCAGCGGCT GCGTGATGTG GTGGAAACGC
451 CGTCCGACCG GAGCGGTGGG CATCGTTCCG CCGGCGCAGA AAGTCAAGCT
501 GCCGGTTTGG TGGATGATGG CATTGCCGCT ATTGGCAATC GCACTGCTCT
551 TCCCGACCTC ACTGCTTGCC ATTGCCGTGA TTTGGCTGTT GGATACGCTG
601 CTGTTGTCGC GGATTCCTGT TTTGAGGAGA TGGTTTAAAT GA
```

This corresponds to the amino acid sequence <SEQ ID 778; ORF 219>:

m219.pep

```
  1 MTARLRKCRG FWSLRLCLFQ GRXWAKTALT LTSRXHWKPS TALRGEIGFK
 51 GRYQLNLPKG EDGVWTLSQD SMSYDMISPF ADRTVHIDQY SGKILADIRF
101 DDYNPFGKFM AASIALHMGT LGWWSVLANV LFCLAVIFIG ISGCVMWWKR
151 RPTGAVGIVP PAQKVKLPVW WMMALPLLAI ALLFPTSLLA IAVIWLLDTL
201 LLSRIPVLRR WFK*
```

Computer analysis of this amino acid sequence gave the following results:

Homology with a predicted ORF from *N. gonorrhoeae*

ORF 219 shows 86.9% identity over a 213 aa overlap with a predicted ORF (ORF 219.ng) from *N. gonorrhoeae*:

m219/g219

```
                    10        20        30        40        50        60
m219.pep    MTARLRKCRGFWSLRLCLFQGRXWAKTALTLTSRXHWKPSTALRGEIGFKGRYQLNLPKG
            |||||||||||||| ||| ||| |:|||||  |    :    : ||||||||||||||||
g219        MTARLRKCRGFWSLCLCLSQGRLWVKTALTPPSPITLETVDRFAREIGFKGRYQLNLPKG
                    10        20        30        40        50        60

                    70        80        90       100       110       120
m219.pep    EDGVWTLSQDSMSYDMISPFADRTVHIDQYSGKILADIRFDDYNPFGKFMAASIALHMGT
            ||||||||||||||||||||||||||||||||:|||||||||||||||||||||||||||
g219        EDGVWTLSQDSMSYDMISPFADRTVHIDQYSGEILADIRFDDYNPFGKFMAASIALHMGT
                    70        80        90       100       110       120

                   130       140       150       160       170       180
m219.pep    LGWWSVLANVLFCLAVIFIGISGCVMWWKRRPTGAVGIVPPAQKVKLPVWWMMALPLLAI
            ||||||||||:|||||||||||||||||||||:|::||||||||:|||||| |||||| |
g219        LGWWSVLANVVFCLAVIFIGISGCVMWWKRRPSGVAGIVPPAQKIKLPVWWAMALPLLLI
                   130       140       150       160       170       180

                   190       200       210
m219.pep    ALLFPTSLLAIAVIWLLDTLLLSRIPVLRRWFKX
            ||||||:||||||||||||||||||||||:|||
g219        ALLFPTALLAIAVIWLLDTLLLSRIPVLRKWFK
                   190       200       210
```

The following partial DNA sequence was identified in *N. meningitidis* <SEQ ID 779>:

a219.seq

```
  1 ATGACGGCAA GGTTAAGGAA GTGCCGTGGG TTTTGGAGCT TACGCCTATG
 51 CCTGTTTCAG GGACGACTGT GGGCAAAGAC GGTATTAACC CTGACGAGCC
101 GATGACATTG GAAACCGTCG ACCGTTTTGC GCGG.GAAAT CGGTTTCAAA
151 GGGCGTTATC AGCTGAATTT GCCCAAAGGC GAGGACGGCG TATGGACTTT
201 GTCGCAGGAT TCTATGAGTT ACGACATGAT CAGCCCGTTT GCTGACCGCA
251 CGGTGCATAT CGACCAGTAC AGCGGCAAGA TTCTTGCCGA CATCCGTTTT
301 GACGATTACA ACCCGTTCGG CAAATTTATG GCGGCAAGCA TTGCGCTGCA
351 TATGGGGACT TTGGGCTGGT GGAGCGTGTT GGCGAACGTT TTGTTCTGCC
401 TTGCCGTGAT TTTTATCGGC ATCAGCGGCT GCGTGATGTG GTGGAAACGC
451 CGTCCGTCCG GCGCGGTGGG CATGGTTCCG CCGGCGCAAA AAATCAAGCT
501 GCCCGTCTGG TGGGCAATGG CGGTGCCGCT GCTGCTGATT GCATTGCTTT
551 TCCCGACCGC GTTGCTTGCC ATTGCCGTGA TTTGGCTGTT GGATACGCTG
601 CTGTTGTCGC GGATTCCTGT TTTGAGGAGA TGGTTTAAAT GA
```

This corresponds to the amino acid sequence <SEQ ID 780; ORF 219.a>:

a219.pep

```
  1 MTARLRKCRG FWSLRLCLFQ GRLWAKTVLT LTSR*HWKPS TVLRXEIGFK
 51 GRYQLNLPKG EDGVWTLSQD SMSYDMISPF ADRTVHIDQY SGKILADIRF
101 DDYNPFGKFM AASIALHMGT LGWWSVLANV LFCLAVIFIG ISGCVMWWKR
151 RPSGAVGMVP PAQKIKLPVW WAMAVPLLLI ALLFPTALLA IAVIWLLDTL
201 LLSRIPVLRR WFK*
```

m219/a219 94.8% identity in 213 aa overlap

```
                      10        20        30        40        50        60
m219.pep      MTARLRKCRGFWSLRLCLFQGRXWAKTALTLTSRXHWKPSTALRGEIGFKGRYQLNLPKG
              |||||||||||||||||||||| ||||:||||||||||||||:|| ||||||||||||||
a219          MTARLRKCRGFWSLRLCLFQGRLWAKTVLTLTSRXHWKPSTVLRXEIGFKGRYQLNLPKG
                      10        20        30        40        50        60

                      70        80        90       100       110       120
m219.pep      EDGVWTLSQDSMSYDMISPFADRTVHIDQYSGKILADIRFDDYNPFGKFMAASIALHMGT
              ||||||||||||||||||||||||||||||||||||||||||||||||||||||||||||
a219          EDGVWTLSQDSMSYDMISPFADRTVHIDQYSGKILADIRFDDYNPFGKFMAASIALHMGT
                      70        80        90       100       110       120

                     130       140       150       160       170       180
m219.pep      LGWWSVLANVLFCLAVIFIGISGCVMWWKRRPTGAVGIVPPAQKVKLPVWWMMALPLLAI
              ||||||||||||||||||||||||||||||||:||||:||||||:|||||| ||:||| |
a219          LGWWSVLANVLFCLAVIFIGISGCVMWWKRRPSGAVGMVPPAQKIKLPVWWAMAVPLLLI
                     130       140       150       160       170       180

                     190       200       210
m219.pep      ALLFPTSLLAIAVIWLLDTLLLSRIPVLRRWFKX
              ||||||:|||||||||||||||||||||||||||
a219          ALLFPTALLAIAVIWLLDTLLLSRIPVLRRWFKX
                     190       200       210
```

The following partial DNA sequence was identified in *N. gonorrhoeae* <SEQ ID 781>:

g221.seq

```
  1 atgcacgacc acggcgccat ggatcgccgc ctccccgctt tcggaagtct
 51 gatgcggcga gccgtaaatc adatcgacgc tgacggattt gaaccctgcc
101 tcacgggcgg catcgatgac ttctttggtt tcttcgtagc tttggatgcg
151 gttgactgcc gcctgcactt tggggtcgaa atcctgaatg ccgacgctca
201 tgcggttgaa gccgagtctg ccgagcatga ggacggtgtc gcggctgact
251 ttgcgcgggt cgatttcgat ggaatattcg ccggacggta tcagttcgaa
301 atgtttgcgg atcatgcgga agacacgttc gatctgttcg tcgctcaaaa
351 aggtcggcgt gccgccgccg aagtgcagtt gggcaagctg gtgccgtccg
401 ttcagatgtg gagcgagcag ttccatttct ttttcaagat attcgatgta
451 ggtatcggcg cggcttttgt ctttggtgat gattttgttg cagccgcagt
501 agtagcagat ggtgttgcaa aacggaatgt gaatgtaaag ggaaagcggt
551 ttgtttaa
```

This corresponds to the amino acid sequence <SEQ ID 782; ORF 221.ng>:

g221.pep

```
  1 MHDHGAMDRR LPAFGSLMRR AVNXIDADGF EPCLTGGIDD FFGFFVALDA
 51 VDCRLHFGVE ILNADAHAVE AESAEHEDGV AADFARVDFD GIFAGRYQFE
101 MFADHAEDTF DLFVAQKGRR AAAEVQLGKL VPSVQMWSEQ FHFFFKIFDV
151 GIGAAFVFGD DFVAAAVVAD GVAKRNVNVK GKRFV*
```

The following partial DNA sequence was identified in *N. meningitidis* <SEQ ID 783>:

m221.seq

```
  1 ATGGyGGTTT TGATGcwcmg AAGTCTGGTG CGGCAGGCCG TAAATCAAAT
 51 CGACGCTGAC GGATTTGAAC CCCGCTTCGC GCGCCGCATC GATGACTTCT
101 TTGGTTTCTT CGTAACTTTG GATGCGGTTG ACCGCCGCCT GCACTTTGGG
151 GTCGAAATCC TGAATGCCGA TGCTCATGCG GTTGAAGCCG AGTCTGCCGA
201 GCATGAGGAC GGTGTCGCGG CTGACTTTGC GCGGGTCGAT TTCGATGGAG
251 TATTCGCCGG TGGGGATTAA CTCGAAATGT TTGCGTATCA TGCGGAAGAC
301 ACGTTCGATC TGTTCGTCGC TCAAAAAGGt GCGTGCcCCG CCGAAGTGCA
351 GTTGGGCAAG CTGGTGCCGT CCGTTCAGAT GTGGAGCGAG CAGTTCCATT
401 TCTTTTTCAA GATATTCGAT GTAGGCATCG GCGCGGCTTT TGTCTTTGGT
451 GATGATTTTG TTGCAGCCGC AGTAGTAGCA GATGGTGTTG CAGAACGGAA
501 TGTGAATGTA AAGGGAAAGC GGTTTGTTTA A
```

This corresponds to the amino acid sequence <SEQ ID 784; ORF 221>:

m221.pep

```
  1 MXVLMXRSLV RQAVNQIDAD GFEPRFARRI DDFFGFFVTL DAVDRRLHFG
 51 VEILNADAHA VEAESAEHED GVAADFARVD FDGVFAGGDX LEMFAYHAED
101 TFDLFVAQKG ACPAEVQLGK LVPSVQMWSE QFHFFFKIFD VGIGAAFVFG
151 DDFVAAAVVA DGVAERNVNV KGKRFV*
```

Computer analysis of this amino acid sequence gave the following results:

Homology with a predicted ORF from *N. gonorrhoeae*

ORF 221 shows 87.6% identity over a 170 aa overlap with a predicted ORF (ORF 221.ng) from *N. gonorrhoeae*:

m221/g221

```
                            10        20        30        40        50
m221.pep            MXVLMXRSLVRQAVNQIDADGFEPRFARRIDDFFGFFVTLDAVDRRLHFGVE
                           ||:|:||| ||||||||  ::  |||||||||:||||| |||||||
g221        MHDHGAMDRRLPAFGSLMRRAVNXIDADGFEPCLTGGIDDFFGFFVALDAVDCRLHFGVE
                    10        20        30        40        50        60

                  60        70        80        90       100       110
m221.pep    ILNADAHAVEAESAEHEDGVAADFARVDFDGVFAGGDXLEMFAYHAEDTFDLFVAQKGA-
            |||||||||||||||||||||||||||||||:|||   :|||| ||||||||||||||
g221        ILNADAHAVEAESAEHEDGVAADFARVDFDGIFAGRYQFEMFADHAEDTFDLFVAQKGRR
                    70        80        90       100       110       120

                  120       130       140       150       160       170
m221.pep    CPAEVQLGKLVPSVQMWSEQFHFFFKIFDVGIGAAFVFGDDFVAAAVVADGVAERNVNVK
              |||||||||||||||||||||||||||||||||||||||||||||||||||:||||||
g221        AAAEVQLGKLVPSVQMWSEQFHFFFKIFDVGIGAAFVFGDDFVAAAVVADGVAKRNVNVK
                   130       140       150       160       170       180

m221.pep    GKRFVX
            ||||||
g221        GKRFVX
```

The following partial DNA sequence was identified in *N. meningitidis* <SEQ ID 785>:

a221.seq

```
  1 ATGGTGGTTT TGATGCTCCG AAGTCTGGTG CGGCAGGCCG TAAATCAAAT
 51 CGACGCTGAC GGATTTGAAC CCCGCTTCGC GCGCCGCATC GATGACTTCT
101 TTGGTTTCTT CGTAACTTTG GATGCGGTTG ACCGCCGCCT GCACTTTGGG
151 GTCGAAATCC TGAATGCCGA TGCTCATGCG GTTGAAGCCG AGTCTGCCGA
201 GCATGAGGAC GGTGTCGCGG CTGACTTTGC GCGGGTCGAT TTCGATGGAG
251 TATTCGCCGG TGGGGATTAA CTCGAAATGT TTGCGTATCA TGCGGAAGAC
301 ACGTTCGATT TGGTCGTCGC TCAAAAAGGT CGGCGTGCCG CCGCCGAAGT
351 GCAGTTGGGC AAGCTGGTGC CGTCCGTTCA GATGTGGAGC GAGCAGTTCC
401 ATTTCTTTTT CAAGAAATTC GATGTAGGCA TCGGCGCGGC TTTTGTCTTT
451 GGTGATGATT TTGTTGCAGC CGCAGTAGTA GCAGATGGTG TTGCAGAACG
501 GAATGTGAAT GTAAAGGGAA AGCGGTTTGT TTAA
```

This corresponds to the amino acid sequence <SEQ ID 786; ORF 221.a>:

a221.pep

```
  1 MVVLMLRSLV RQAVNQIDAD GFEPRFARRI DDFFGFFVTL DAVDRRLHFG

 51 VEILNADAHA VEAESAEHED GVAADFARVD FDGVFAGGD* LEMFAYHAED

101 TFDLVVAQKG RRAAAEVQLG KLVPSVQMWS EQFHFFFKKF DVGIGAAFVF

151 GDDFVAAAVV ADGVAERNVN VKGKRFV*
```

m221/a221 95.5% identity in 177 aa overlap

```
                      10        20        30        40        50        60
m221.pep      MXVLMXRSLVRQAVNQIDADGFEPRFARRIDDFFGFFVTLDAVDRRLHFGVEILNADAHA
              | ||| ||||||||||||||||||||||||||||||||||||||||||||||||||||||
a221          MVVLMLRSLVRQAVNQIDADGFEPRFARRIDDFFGFFVTLDAVDRRLHFGVEILNADAHA
                      10        20        30        40        50        60

                      70        80        90       100       110       119
m221.pep      VEAESAEHEDGVAADFARVDFDGVFAGGDXLEMFAYHAEDTFDLFVAQKGA-CPAEVQLG
              |||||||||||||||||||||||||||||||||||||||||||| |||||    ||||||
a221          VEAESAEHEDGVAADFARVDFDGVFAGGDXLEMFAYHAEDTFDLVVAQKGRRAAAEVQLG
                      70        80        90       100       110       120

            120       130       140       150       160       170
m221.pep      KLVPSVQMWSEQFHFFFKIFDVGIGAAFVFGDDFVAAAVVADGVAERNVNVKGKRFVX
              |||||||||||||||||| |||||||||||||||||||||||||||||||||||||||
a221          KLVPSVQMWSEQFHFFFKKFDVGIGAAFVFGDDFVAAAVVADGVAERNVNVKGKRFVX
                     130       140       150       160       170
```

The following partial DNA sequence was identified in *N. gonorrhoeae* <SEQ ID 787>:

g223.seq

```
  1 atggaattca ggcaccaggt agtggtagtt ggtgtcgaac catttggtca

 51 tttcgatggc gaattggtct ttgttgccgc gcgccagttg gaagaattgt

101 tccaaaggca ggttttggct atcgaagccg aaacgggcgg gaatcgcgcc

151 cgtggatact tgcaggtcga ggatgtgatg gtagaaagtg aaatcacgta

201 cagcaacgta atcagcgtta ggagcagctt ggtgtttcca gtttttctcg

251 cgcaggtctt tggcaacgtc gagcagctct tgttcactga tctctttgcg

301 ccagtatttt tcttgggcga atttcaattc acggaaggcg ccgacacgcg

351 ggaagcctga
```

This corresponds to the amino acid sequence <SEQ ID 788; ORF 223.ng>:

g223.pep..

```
  1 MEFRHQVVVV GVEPFGHFDG ELVFVAARQL EELFQRQVLA IEAETGGNRA

 51 RGYLQVEDVM VESEITYSNV ISVRSSLVFP VFLAQVFGNV EQLLFTDLFA

101 PVFFLGEFQF TEGADTREA*
```

The following partial DNA sequence was identified in *N. meningitidis* <SEQ ID 789>:

m223.seq

```
  1 GTGGAATTCA GGCACCAAGT AGTGGTAGTT GGTGTCGAAC CATTTGGTCA
 51 TTTCGATAGC GAATTGGTCT TTGTTACCGC GCGCCAGTTG GAAGAATTGT
101 TCCAAAGACA GGTTTTGGCT GTCGAAGCCG AAGCGGGCGG GAATCGCGCC
151 GGTGGCGACT TGCAGGTCGA GGATGTGGTC GTAGAAAGTG AAATCsCTAC
201 GGCAACGAAA TCGGCGTTGG CAGCGACCTG GTGTTTCCAG TTTTTCTCGC
251 GCAAGTCTTT AGCAACAGCC AGCAATTCTT GCTCGCTGAT TTCTTTGCGC
301 CAGTATTTTT CTTGTGCGAA TTTCAATTCG CGGAAGGCGC CGACACGCGG
351 GAAGCCTGA
```

This corresponds to the amino acid sequence <SEQ ID 790; ORF 223>:

m223.pep

```
  1 VEFRHQVVVV GVEPFGHFDS ELVFVTARQL EELFQRQVLA VEAEAGGNRA
 51 GGDLQVEDVV VESEIXYGNE IGVGSDLVFP VFLAQVFSNS QQFLLADFFA
101 PVFFLCEFQF AEGADTREA*
```

Computer analysis of this amino acid sequence gave the following results:

Homology with a predicted ORF from *N. gonorrhoeae*

ORF 223 shows 80.7% identity over a 119 aa overlap with a predicted ORF (ORF 223.ng) from *N. gonorrhoeae*:

m223/g223

```
                    10        20        30        40        50        60
m223.pep    VEFRHQVVVVGVEPFGHFDSELVFVTARQLEELFQRQVLAVEAEAGGNRAGGDLQVEDVV
            :||||||||||||||||||:|||||:||||||||||||||:|||:||||| | ||||||:
g223        MEFRHQVVVVGVEPFGHFDGELVFVAARQLEELFQRQVLAIEAETGGNRARGYLQVEDVM
                    10        20        30        40        50        60

                    70        80        90       100       110       120
m223.pep    VESEIXYGNEIGVGSDLVFPVFLAQVFSNSQQFLLADFFAPVFFLCEFQFAEGADTREAX
            |||||:|:| |:| |:|||||||||||:| :|:|::|:||||||| ||||:|||||||||
g223        VESEITYSNVISVRSSLVFPVFLAQVFGNVEQLLFTDLFAPVFFLGEFQFTEGADTREAX
                    70        80        90       100       110
```

The following partial DNA sequence was identified in *N. meningitidis* <SEQ ID 791>:

a223.seq

```
  1 GTGGAATTCA GGCACCAAGT AGTGGTAGTT GGTGTCGAAC CATTTGGTCA
 51 TTTCGATAGC GAATTGGTCT TTGTTACCGC GCGCCAGTTG GAAGAATTGT
101 TCCAAAGATA GGTTTTGGCT GTCGAAGCCG AAGCGGGCGG GAATCGCGCC
151 GGTGGCGACT TGCAGGTCGA GGATGTGGTC GTAGAAAGTG AAATCGCCTA
201 CGGCAACGTA ATCGGCGTTG GCAGCGGCCT GGTGTTTCCA GTTTTTCTCG
251 CGCAAGTCTT TAGCAACAGC CAGCAATTCT TGCTCGCTGA TTTCTTTGCG
301 CCAGTATTTT TCTTGTGCGA ATTTCAATTC GCGGAAGGCA CCGACACGCG
351 GGAAGCCTGA
```

This corresponds to the amino acid sequence <SEQ ID 792; ORF 223.a>:

a223.pep

```
  1 VEFRHQVVVV GVEPFGHFDS ELVFVTARQL EELFQR*VLA VEAEAGGNRA

 51 GGDLQVEDVV VESEIAYGNV IGVGSGLVFP VFLAQVFSNS QQFLLADFFA

101 PVFFLCEFQF AEGTDTREA*
```

m223/a223 95.8% identity in 119 aa overlap

```
                     10        20        30        40        50        60
m223.pep    VEFRHQVVVVGVEPFGHFDSELVFVTARQLEELFQRQVLAVEAEAGGNRAGGDLQVEDVV
            ||||||||||||||||||||||||||||||||||||| ||||||||||||||||||||||
a223        VEFRHQVVVVGVEPFGHFDSELVFVTARQLEELFQRXVLAVEAEAGGNRAGGDLQVEDVV
                     10        20        30        40        50        60
                     70        80        90       100       110       120
m223.pep    VESEIXYGNEIGVGSDLVFPVFLAQVFSNSQQFLLADFFAPVFFLCEFQFAEGADTREAX
            ||||| ||| ||||| |||||||||||||||||||||||||||||||||||||:||||||
a223        VESEIAYGNVIGVGSGLVFPVFLAQVFSNSQQFLLADFFAPVFFLCEFQFAEGTDTREAX
                     70        80        90       100       110       120
```

The following partial DNA sequence was identified in *N. gonorrhoeae* <SEQ ID 793>:

g225.seq

```
  1 atggattctt ttttcaaacc ggcagtttgg gcggttttgt ggctgatgtt

 51 tgccgtccgc cccgcccttg ccgacgagtt gaccaacctg ctcagcagcc

101 gcgagcagat tctcagacag tttgccgaag acgaacagcc cgttttaccc

151 gtcaaccgag cccccgcccg gcgggcgggc aatgccgacg aactcatcgg

201 cggcgcgatg gggcttaacg aacagcccgt tgtacgcgtc aaccgagccn

251 ccgcccggcg ggcgggcaat gccgacaaac tcatcggcag cgcgatgcgg

301 cttttgggta ttgcctaccg ctacggcggc acatcggtgt ctaccggttt

351 tgactgcagc ggattcatgc agcacatctt caaacgcgcc atgggcatca

401 acctgccgcg cacgtcggcg gaacaggcgc ggatgggcgc acccgttgcc

451 cgaagcgaat tgcagcccgg ggatatggtg tttttccgca cgctcggcgg

501 cagccgcatt tcccatgtcg gactttatat cggcaacaac cgcttcatcc

551 acgcgccgcg cacggggaaa aatatcgaaa tcaccagcct gagccacaaa

601 tattggagcg gcaaatatgc gttcgcccgc cgggtcaaga aaaacgaccc

651 gtcacgcttt ctgaactga
```

This corresponds to the amino acid sequence <SEQ ID 794; ORF 225.ng>:

g225.pep

```
  1 MDSFFKPAVW AVLWLMFAVR PALADELTNL LSSREQILRQ FAEDEQPVLP

 51 VNRAPARRAG NADELIGGAM GLNEQPVVRV NRAXARRAGN ADKLIGSAMR

101 LLGIAYRYGG TSVSTGFDCS GFMQHIFKRA MGINLPRTSA EQARMGAPVA

151 RSELQPGDMV FFRTLGGSRI SHVGLYIGNN RFIHAPRTGK NIEITSLSHK

201 YWSGKYAFAR RVKKNDPSRF LN*
```

The following partial DNA sequence was identified in *N. meningitidis* <SEQ ID 795>:

m225.seq (partial)

```
  1 ..TTTTCAAACC CGGCAGTTTG GGCGGTTTTG TGGCTGAwGT TTGCCGTCCG
 51   CCCCGCCCTT GCCGACGAGT TGACCAACCT GCTCAGCAGC CGCGAGCAGA
101   TTCTCAGACA GTTTGCCGAA GACGAACAGC CCGTTTTACC CATCAACCGA
151   GCCCCCGCCC GGCGGGCGGG CAATGCCGAC GAACTCATCG GCAGCGCGAT
201   GGGGCTTAAC GAACAGCCCG TTTTACCCGT CAACCGAGTC CCCGCCCGGC
251   GGGCGGGCAA TGCCGACGAA CTCATCGGCA ACGCGATGGG GCTTAACGAA
301   CAGCCCGTTT TACCCGTCAA CCGAGCCCCC GCCCGGCGGG CGGGCAATGC
351   CGACGAACTC ATCGGCAACG CGATGGGACT TTTGGGTATT GCCTACCGCT
401   ACGGCGGCAC ATCGGTTTCT ACCGGTTTTG ACTGCAGCGG CTTCATGCAG
451   CACATCTTCA AACGCGCCAT GGGCATCAAC CTGCCGCGCA CGTCGGCAGA
501   ACAGGCACGG ATGGGTACGC CGGTTGCCCG AAGCGAATTG CAGCCCGGAG
551   ATATGGTGTT TTTCCGCACG CTCGGCGGCA GCCGCATTTC CCATGTCGGA
601   CTTTATATCG GCAACAACCG CTTCATCCAC GCGCCGCGCA CGGGGAAAAA
651   TATCGAAATC ACCAGCCTGA GCCACAAATA TTGGAGCGGC AAATACGCGT
701   TCGCCCGCCG GGTCAAGAAA AACGACCCGT CCCGCTTTCT GAACTGA
```

This corresponds to the amino acid sequence <SEQ ID 796; ORF 225>:

m225.pep (partial)

```
  1 ..FSNPAVWAVL WLXFAVRPAL ADELTNLLSS REQILRQFAE DEQPVLPINR
 51   APARRAGNAD ELIGSAMGLN EQPVLPVNRV PARRAGNADE LIGNAMGLNE
101   QPVLPVNRAP ARRAGNADEL IGNAMGLLGI AYRYGGTSVS TGFDCSGFMQ
151   HIFKRAMGIN LPRTSAEQAR MGTPVARSEL QPGDMVFFRT LGGSRISHVG
201   LYIGNNRFIH APRTGKNIEI TSLSHKYWSG KYAFARRVKK NDPSRFLN*
```

Computer analysis of this amino acid sequence gave the following results:

Homology with a predicted ORF from *N. gonorrhoeae*

ORF 225 shows 83.5% identity over a 248 aa overlap with a predicted ORF (ORF 225.ng) from *N. gonorrhoeae*:

m225/g225

```
                         10        20        30        40        50
m225.pep         FSNPAVWAVLWLXFAVRPALADELTNLLSSREQILRQFAEDEQPVLPINRAPARRAG
                 | :||||||||| ||||||||||||||||||||||||||||||||||:|||||||||
g225          MDSFFKPAVWAVLWLMFAVRPALADELTNLLSSREQILRQFAEDEQPVLPVNRAPARRAG
                      10        20        30        40        50        60

               60        70        80        90        100       110
m225.pep      NADELIGSAMGLNEQPVLPVNRVPARRAGNADELIGNAMGLNEQPVLPVNRAPARRAGNA
              |||||||                             :|||||||||: |||| |||||||
g225          NADELIG-----------------------------GAMGLNEQPVVRVNRAXARRAGNA
                                                   70        80        90
```

-continued

```
             120       130       140       150       160       170
m225.pep     DELIGNAMGLLGIAYRYGGTSVSTGFDCSGFMQHIFKRAMGINLPRTSAEQARMGTPVAR
             |:|||:|| ||||||||||||||||||||||||||||||||||||||||||:||||
g225         DKLIGSAMRLLGIAYRYGGTSVSTGFDCSGFMQHIFKRAMGINLPRTSAEQARMGAPVAR
                   100       110       120       130       140       150

180       190       200       210       220       230
m225.pep     SELQPGDMVFFRTLGGSRISHVGLYIGNNRFIHAPRTGKNIEITSLSHKYWSGKYAFARR
             ||||||||||||||||||||||||||||||||||||||||||||||||||||||||||||
g225         SELQPGDMVFFRTLGGSRISHVGLYIGNNRFIHAPRTGKNIEITSLSHKYWSGKYAFARR
                   160       170       180       190       200       210

240       249
m225.pep     VKKNDPSRFLNX
             |||||||||||
g225         VKKNDPSRFLN
                   220
```

The following partial DNA sequence was identified in *N. meningitidis* <SEQ ID 797>:

<u>a225.seq</u>

```
  1 ATGGATTCTT TTTTCAAACC GGCAGTTTGG GCGGTTTTGT GGCTGATGTT
 51 TGCCGTCCGC CCCGCCCTTG CCGACGAGTT GACCAACCTG CTCAGCAGCC
101 GCGAGCAGAT TCTCAGACAG TTTGCCGAAG ACGAACAGCC CGTTTTACCC
151 ATCAACCGAN CCGCCGCCCG GCGGGCGGGC AATGCCGACG AACTCATCGG
201 CAGCGCGATG GGGCTTAACG AACAGCCCGT TTTACCCGTC AACCGANTCC
251 CCGCCCGGCG GGCGGGCAAT GCCGACNAAC TCATCGGCAA CGCGATGGGG
301 CTTAACGAAC AGCCCGTTTT ACCCGTCAAC CGAGTCCCCG CCCGGCGGGC
351 GGGCAATGCC GACGAACTCA TCGGCAACGC GATGGGGCTT AACGAACAGC
401 CCGTTTTACC CGTCAACCGA GCCCCCGCCC GGCGGGCGGG CAATGCCGAC
451 GAACTCATCG GCAACGCGAT GGGACTTTTG GGTATTGCCT ACCGCTACGG
501 CGGCACATCG ATTTCTACCG GTTTTGACTG CAGCGGCTTC ATGCAGCACA
551 TCTTCAAACG CGCCATGGGC ATCAACCTGC CGCGCACGTC GGCAGAACAG
601 GCGCGGATGG GTACGCCGGT TGCCCGAAGC GAATTGCAGC CCGGGGATAT
651 GGTGTNTTTC CGCACGCTCG GCGGCAGCCG CATTTCCCAT GTCGGACTTT
701 ATATCGGCAA CAACCGCTTC ATCCACGCGC CGCGCACGGG GAAAAATATC
751 GAAATCACCA GCCTGAGCCA CAAATATTGG AGCGGCAAAT ACGCGTTCGC
801 CCGCCGGGTC AAGAAAAACG ACCCGTCCCG CTTTCTGAAC TGA
```

This corresponds to the amino acid sequence <SEQ ID 798; ORF 225.a>:

<u>a225.pep</u>

```
  1 MDSFFKPAVW AVLWLMFAVR PALADELTNL LSSREQILRQ FAEDEQPVLP
 51 INRXPARRAG NADELIGSAM GLNEQPVLPV NRXPARRAGN ADXLIGNAMG
101 LNEQPVLPVN RVPARRAGNA DELIGNAMGL NEQPVLPVNR APARRAGNAD
151 ELIGNAMGLL GIAYRYGGTS ISTGFDCSGF MQHIFKRAMG INLPRTSAEQ
201 ARMGTPVARS ELQPGDMVXF RTLGGSRISH VGLYIGNNRF IHAPRTGKNI
251 EITSLSHKYW SGKYAFARRV KKNDPSRFLN *
```

m225/a225 87.4% identity in 277 aa overlap

```
                   10        20        30        40        50
m225.pep      FSNPAVWAVLWLXFAVRPALADELTNLLSSREQILRQFAEDEQPVLPINRAPARRAG
              | :||||||||| ||||||||||||||||||||||||||||||||||| ||||||
a225       MDSFFKPAVWAVLWLMFAVRPALADELTNLLSSREQILRQFAEDEQPVLPINRXPARRAG
                   10        20        30        40        50        60

            60        70       79                           80
m225.pep   NADELIGSAMGLNEQPVLPVNR----------------------------VPARRAGNA
           ||||||||||||||||||||||                            |||||||||
a225       NADELIGSAMGLNEQPVLPVNRXPARRAGNADXLIGNAMGLNEQPVLPVNRVPARRAGNA
                   70        80        90       100       110       120

            90       100       110       120       130       140
m225.pep   DELIGNAMGLNEQPVLPVNRAPARRAGNADELIGNAMGLLGIAYRYGGTSVSTGFDCSGF
           ||||||||||||||||||||||||||||||||||||||||||||||||||:|||||||||
a225       DELIGNAMGLNEQPVLPVNRAPARRAGNADELIGNAMGLLGIAYRYGGTSISTGFDCSGF
                  130       140       150       160       170       180

          150       160       170       180       190       200
m225.pep   MQHIFKRAMGINLPRTSAEQARMGTPVARSELQPGDMVFFRTLGGSRISHVGLYIGNNRF
           |||||||||||||||||||||||||||||||||||||| |||||||||||||||||||||
a225       MQHIFKRAMGINLPRTSAEQARMGTPVARSELQPGDMVXFRTLGGSRISHVGLYIGNNRF
                  190       200       210       220       230       240

            210       220       230       240      249
m225.pep   IHAPRTGKNIEITSLSHKYWSGKYAFARRVKKNDPSRFLNX
           |||||||||||||||||||||||||||||||||||||||||
a225       IHAPRTGKNIEITSLSHKYWSGKYAFARRVKKNDPSRFLNX
                  250       260       270       280
```

The following partial DNA sequence was identified in *N. gonorrhoeae* <SEQ ID 799>:

g225-1.seq

```
  1 atggattctt ttttcaaacc ggcagtttgg gcggttttgt ggctgatgtt
 51 tgccgtccgc cccgcccttg ccgacgagtt gaccaacctg ctcagcagcc
101 gcgagcagat tctcagacag tttgccgaag acgaacagcc cgttttaccc
151 gtcaaccgag cccccgcccg gcgggcgggc aatgccgacg aactcatcgg
201 cggcgcgatg ggcttaacg aacagcccgt tgtacgcgtc aaccgagccn
251 ccgcccggcg ggcgggcaat gccgacaaac tcatcggcag cgcgatgcgg
301 cttttgggta ttgcctaccg ctacggcggc acatcggtgt ctaccggttt
351 tgactgcagc ggattcatgc agcacatctt caaacgcgcc atgggcatca
401 acctgccgcg cacgtcggcg gaacaggcgc ggatgggcgc acccgttgcc
451 cgaagcgaat tgcagcccgg ggatatggtg tttttccgca cgctcggcgg
501 cagccgcatt tcccatgtcg gactttatat cggcaacaac cgcttcatcc
551 acgcgccgcg cacggggaaa aatatcgaaa tcaccagcct gagccacaaa
601 tattggagcg gcaaatatgc gttcgcccgc cgggtcaaga aaaacgaccc
651 gtcacgcttt ctgaactga
```

This corresponds to the amino acid sequence <SEQ ID 800; ORF 225-1.ng>:

g225-1.pep

```
  1 MDSFFKPAVW AVLWLMFAVR PALADELTNL LSSREQILRQ FAEDEQPVLP
 51 VNRAPARRAG NADELIGGAM GLNEQPVVRV NRAXARRAGN ADKLIGSAMR
101 LLGIAYRYGG TSVSTGFDCS GFMQHIFKRA MGINLPRTSA EQARMGAPVA
151 RSELQPGDMV FFRTLGGSRI SHVGLYIGNN RFIHAPRTGK NIEITSLSHK
201 YWSGKYAFAR RVKKNDPSRF LN*
```

The following partial DNA sequence was identified in *N. meningitidis* <SEQ ID 801>:

```
m225-1.seq
  1 ATGGATTCTT TTTTCAAACC GGCAGTTTGG GCGGTTTTGT GGCTGATGTT
 51 TGCCGTCCGC CCCGCCCTTG CCGACGAGTT GACCAACyTG CTCAGCAGCC
101 GCGAGCAGAT TCTCAGACAG TTTGCCGAAG ACGAACAGCC CGTTTTACCC
151 ATCAACCGAG CCCCCGCCCG GCGGGCGGGC AATGCCGACG AACTCATCGG
201 CAGCGCGATG GGGCTTAACG AACAGCCCGT TTTACCCGTC AACCGAGTCC
251 CCGCCCGGCG GGCGGGCAAT GCCGACGAAC TCATCGGCAA CGCGATGGGG
301 CTTAACGAAC AGCCCGTTTT ACCCGTCAAC CGAGCCCCCG CCCGGCGGGC
351 GGGCAATGCC GACGAACTCA TCGGCAACGC GATGGGACTT TTGGGTATTG
401 CCTACCGCTA CGGCGGCACA TCGGTTTCTA CCGGTTTTGA CTGCAGCGGC
451 TTCATGCAGC ACATCTTCAA ACGCGCCATG GGCATCAACC TGCCGCGCAC
501 GTCGGCAGAA CAGGCACGGA TGGGTACGCC GGTTGCCCGA AGCGAATTGC
551 AGCCCGGAGA TATGGTGTTT TTCCGCACGC TCGGCGGCAG CCGCATTTCC
601 CATGTCGGAC TTTATATCGG CAACAACCGC TTCATCCACG CGCCGCGCAC
651 GGGGAAAAAT ATCGAAATCA CCAGCCTGAG CCACAAATAT TGGAGCGGCA
701 AATACGCGTT CGCCCGCCGG GTCAAGAAAA ACGACCCGTC CCGCTTTCTG
751 AACTGA
```

This corresponds to the amino acid sequence <SEQ ID 802; ORF 217>:

```
m225-1.pep
  1 MDSFFKPAVW AVLWLMFAVR PALADELTNL LSSREQILRQ FAEDEQPVLP
 51 INRAPARRAG NADELIGSAM GLNEQPVLPV NRVPARRAGN ADELIGNAMG
101 LNEQPVLPVN RAPARRAGNA DELIGNAMGL LGIAYRYGGT SVSTGFDCSG
151 FMQHIFKRAM GINLPRTSAE QARMGTPVAR SELQPGDMVF FRTLGGSRIS
201 HVGLYIGNNR FIHAPRTGKN IEITSLSHKY WSGKYAFARR VKKNDPSRFL
251 N*
```

m225-1/g225-1 84.9% identity in 251 aa overlap

```
                    10        20        30        40        50        60
m225-1.pep  MDSFFKPAVWAVLWLMFAVRPALADELTNLLSSREQILRQFAEDEQPVLPINRAPARRAG
            ||||||||||||||||||||||||||||||||||||||||||||||||||:|||||||||
g225-1      MDSFFKPAVWAVLWLMFAVRPALADELTNLLSSREQILRQFAEDEQPVLPVNRAPARRAG
                    10        20        30        40        50        60

                    70        80        90       100       110       120
m225-1.pep  NADELIGSAMGLNEQPVLPVNRVPARRAGNADELIGNAMGLNEQPVLPVNRAPARRAGNA
            ||||                             |||:|||||||||: |||| ||||||
g225-1      NADE-----------------------------LIGGAMGLNEQPVVRVNRAXARRAGNA
                                                70        80        90

                   130       140       150       160       170       180
m225-1.pep  DELIGNAMGLLGIAYRYGGTSVSTGFDCSGFMQHIFKRAMGINLPRTSAEQARMGTPVAR
            |:|||:|| |||||||||||||||||||||||||||||||||||||||||||||:||||
g225-1      DKLIGSAMRLLGIAYRYGGTSVSTGFDCSGFMQHIFKRAMGINLPRTSAEQARMGAPVAR
                  100       110       120       130       140       150
```

-continued

```
                190       200       210       220       230       240
m225-1.pep  SELQPGDMVFFRTLGGSRISHVGLYIGNNRFIHAPRTGKNIEITSLSHKYWSGKYAFARR
            ||||||||||||||||||||||||||||||||||||||||||||||||||||||||||||
g225-1      SELQPGDMVFFRTLGGSRISHVGLYIGNNRFIHAPRTGKNIEITSLSHKYWSGKYAFARR
               160       170       180       190       200       210

                250
m225-1.pep  VKKNDPSRFLNX
            ||||||||||||
g225-1      VKKNDPSRFLNX
               220
```

The following partial DNA sequence was identified in *N. meningitidis* <SEQ ID 803>:

a225-1.seq

```
  1 ATGGATTCTT TTTTCAAACC GGCAGTTTGG GCGGTTTTGT GGCTGATGTT
 51 TGCCGTCCGC CCCGCCCTTG CCGACGAGTT GACCAACCTG CTCAGCAGCC
101 GCGAGCAGAT TCTCAGACAG TTTGCCGAAG ACGAACAGCC CGTTTTACCC
151 ATCAACCGAN CCCCCGCCCG GCGGGCGGGC AATGCCGACG AACTCATCGG
201 CAGCGCGATG GGGCTTAACG AACAGCCCGT TTTACCCGTC AACCGANTCC
251 CCGCCCGGCG GGCGGGCAAT GCCGACNAAC TCATCGGCAA CGCGATGGGG
301 CTTAACGAAC AGCCCGTTTT ACCCGTCAAC CGAGTCCCCG CCCGGCGGGC
351 GGGCAATGCC GACGAACTCA TCGGCAACGC GATGGGGCTT AACGAACAGC
401 CCGTTTTACC CGTCAACCGA GCCCCCGCCC GGCGGGCGGG CAATGCCGAC
451 GAACTCATCG GCAACGCGAT GGGACTTTTG GGTATTGCCT ACCGCTACGG
501 CGGCACATCG ATTTCTACCG GTTTTGACTG CAGCGGCTTC ATGCAGCACA
551 TCTTCAAACG CGCCATGGGC ATCAACCTGC CGCGCACGTC GGCAGAACAG
601 GCGCGGATGG GTACGCCGGT TGCCCGAAGC GAATTGCAGC CCGGGGATAT
651 GGTGTNTTTC CGCACGCTCG GCGGCAGCCG CATTTCCCAT GTCGGACTTT
701 ATATCGGCAA CAACCGCTTC ATCCACGCGC CGCGCACGGG GAAAAATATC
751 GAAATCACCA GCCTGAGCCA CAAATATTGG AGCGGCAAAT ACGCGTTCGC
801 CCGCCGGGTC AAGAAAAACG ACCCGTCCCG CTTTCTGAAC TGA
```

This corresponds to the amino acid sequence <SEQ ID 804; ORF 225-1.a>:

a225-1.pep

```
  1 MDSFFKPAVW AVLWLMFAVR PALADELTNL LSSREQILRQ FAEDEQPVLP
 51 INRXPARRAG NADELIGSAM GLNEQPVLPV NRXPARRAGN ADXLIGNAMG
101 LNEQPVLPVN RVPARRAGNA DELIGNAMGL NEQPVLPVNR APARRAGNAD
151 ELIGNAMGLL GIAYRYGGTS ISTGFDCSGF MQHIFKRAMG INLPRTSAEQ
201 ARMGTPVARS ELQPGDMVXF RTLGGSRISH VGLYIGNNRF IHAPRTGKNI
251 EITSLSHKYW SGKYAFARRV KKNDPSRFLN *
```

a225-1/m225-1 88.6% identity in 280 aa overlap

```
                  10        20        30        40        50        60
a225-1.pep  MDSFFKPAVWAVLWLMFAVRPALADELTNLLSSREQILRQFAEDEQPVLPINRXPARRAG
            |||||||||||||||||||||||||||||||||||||||||||||||||||||| |||||
m225-1      MDSFFKPAVWAVLWLMFAVRPALADELTNLLSSREQILRQFAEDEQPVLPINRAPARRAG
                  10        20        30        40        50        60

                  70        80        90       100       110       120
a225-1.pep  NADELIGSAMGLNEQPVLPVNRXPARRAGNADXLIGNAMGLNEQPVLPVNRVPARRAGNA
            ||||||||||||||||                             |||||||||||||||
m225-1      NADELIGSAMGLNEQP-----------------------------VLPVNRVPARRAGNA
                  70                                        80        90

                 130       140       150       160       170       180
a225-1.pep  DELIGNAMGLNEQPVLPVNRAPARRAGNADELIGNAMGLLGIAYRYGGTSISTGFDCSGF
            ||||||||||||||||||||||||||||||||||||||||||||||||||:|||||||||
m225-1      DELIGNAMGLNEQPVLPVNRAPARRAGNADELIGNAMGLLGIAYRYGGTSVSTGFDCSGF
                100       110       120       130       140       150

                 190       200       210       220       230       240
a225-1.pep  MQHIFKRAMGINLPRTSAEQARMGTPVARSELQPGDMVXFRTLGGSRISHVGLYIGNNRF
            |||||||||||||||||||||||||||||||||||||| |||||||||||||||||||||
m225-1      MQHIFKRAMGINLPRTSAEQARMGTPVARSELQPGDMVFFRTLGGSRISHVGLYIGNNRF
                160       170       180       190       200       210

                 250       260       270       280
a225-1.pep  IHAPRTGKNIEITSLSHKYWSGKYAFARRVKKNDPSRFLNX
            ||||||||||||||||||||||||||||||||||||||||
m225-1      IHAPRTGKNIEITSLSHKYWSGKYAFARRVKKNDPSRFLNX
                220       230       240       250
```

The following partial DNA sequence was identified in *N. gonorrhoeae* <SEQ ID 805>:

```
g226.seq

  1 ATGAGCGAAA TCCTCAGGCA GCCCAGCGTT CTGCTTTTCC TCACGCTTGC

 51 CGTGTACGCG CTTGCGATTA TCGTGCGCAC GCGCACGGGC AATATCTTCT

101 GCAACCCCGT ACTCGTCAGC ACTATCGTGC TGATTGCCTA CCTGAAAATC

151 CTCGGTATCG ATTATGCGGT GTACCACAAC GCCGCGCAAT TCATTGATTT

201 TCGGCTGAAA cccGccgtCG TCGTGCTTGC CGTGCCGCTC TACCAAAACC

251 GCCGTAAAAT CTTCAACCAG TGGCTGCCCG TCATCGTTTC GCAGCTTGCG

301 GGCAGCGTTA cggGCATTGT tacggggATG TATTTTgccg cttggctcgg

351 gccggatacc caattctcct tcccgcctcg tcttcaatat ctgttattta

401 caccctctgg aatcccaatt cacaccctgt atgcgcgggt tctcccgcca

451 tttctgttgc ctccgcctct cctgccgcgc ctcggcccgc atacattgcg

501 ccggttcaca atacttccaa aaaaactacg gccgtttaag cccctcctcc

551 cagttgtggt cctttctcct Ccgggcctcg cccctcccct cttataa
```

This corresponds to the amino acid sequence <SEQ ID 806; ORF 226.ng>:

```
g226.pep

  1 MSEILRQPSV LLFLTLAVYA LAIIVRTRTG NIFCNPVLVS TIVLIAYLKI

 51 LGIDYAVYHN AAQFIDFRLK PAVVVLAVPL YQNRRKIFNQ WLPVIVSQLA

101 GSVTGIVTGM YFAAWLGPDT QFSFPPRLQY LLFTPSGIPI HTLYARVLPP

151 FLLPPPLLPR LGPHTLRRFT ILPKKLRPFK PLLPVVVLSP PGLAPPLL*
```

The following partial DNA sequence was identified in *N. meningitidis* <SEQ ID 807>:

m226.seq

```
  1 ATGAACGAAA TCCTCAGGCA GCCCAGCGTT CTGCTTTTCC TCACGCTTGC
 51 CGTGTACGCG CTTGCGATTA TCGtGCGCAC GCGCACGGGC AATATCTTCT
101 GCAACCCCGT ACTCGTCAGC ACTATCGTGC TGATTGCCTA CCTGAAAATC
151 CTCGGTATCG ATTATGCGGT GTACCACAAC GCCGCGCAAT TCATTGATTT
201 TTGGCTGAAA CCCGCCGTCG TCGTGCTTGC CGTGCCGCTC TACCAAAACC
251 GCCGTAAAAT CTTCAACCAG TGGCTGCCCG TCATCGTTTC ACAGCTTGCG
301 GGCAGCGTTA CGGGCATTGT TACAGGGATG TATTTTGCCA AATGGCTGGG
351 CGCGGAACGC GAAGTCGTCC TCTCGCTCGC GTCCAAATCT GTTACCAACC
401 CCATCGCTAT TGAAATCACC CGCTCCATCG GCGGCATTCC CGCCATTACC
451 GCCGCCACCG TCATCATTGC CGGTCTGGTC GGACAGATTG CCGGTTACAA
501 AATGCTGAAG AACACGGTCG TCATGCCCTC GTCCGTGGGT ATGTCGCTCG
551 GCACGGCTTC GCACGCGATG GGGATTGCCG CCTCGCTCGA ACGCAGCCGC
601 CGTATGGCGG CATACGCGGG GCTGGGGCTG ACGTTCAACG GCGTACTGAC
651 CGCGCTGATT GCGCCGCTGC TCATCCCCGT TTTGGGATTT TGA
```

This corresponds to the amino acid sequence <SEQ ID 808; ORF 226>:

m226.pep

```
  1 MNEILRQPSV LLFLTLAVYA LAIIVRTRTG NIFCNPVLVS TIVLIAYLKI
 51 LGIDYAVYHN AAQFIDFWLK PAVVVLAVPL YQNRRKIFNQ WLPVIVSQLA
101 GSVTGIVTGM YFAKWLGAER EVVLSLASKS VTNPIAIEIT RSIGGIPAIT
151 AATVIIAGLV GQIAGYKMLK NTVVMPSSVG MSLGTASHAM GIAASLERSR
201 RMAAYAGLGL TFNGVLTALI APLLIPVLGF *
```

Computer analysis of this amino acid sequence gave the following results:

Homology with a predicted ORF from *N. gonorrhoeae*

ORF 226 shows 94.2% identity over a 121 aa overlap with a predicted ORF (ORF 226.ng) from *N. gonorrhoeae*:

m226/g226

```
                   10        20        30        40        50        60
m226.pep   MNEILRQPSVLLFLTLAVYALAIIVRTRTGNIFCNPVLVSTIVLIAYLKILGIDYAVYHN
           |:||||||||||||||||||||||||||||||||||||||||||||||||||||||||||
g226       MSEILRQPSVLLFLTLAVYALAIIVRTRTGNIFCNPVLVSTIVLIAYLKILGIDYAVYHN
                   10        20        30        40        50        60

                   70        80        90       100       110       120
m226.pep   AAQFIDFWLKPAVVVLAVPLYQNRRKIFNQWLPVIVSQLAGSVTGIVTGMYFAKWLGAER
           ||||||| ||||||||||||||||||||||||||||||||||||||||||||| |||  : 
g226       AAQFIDFRLKPAVVVLAVPLYQNRRKIFNQWLPVIVSQLAGSVTGIVTGMYFAAWLGPDT
                   70        80        90       100       110       120

                  130       140       150       160       170       180
m226.pep   EVVLSLASKSVTNPIAIEITRSIGGIPAITAATVIIAGLVGQIAGYKMLKNTVVMPSSVG
           :                                                           
g226       QFSFPPRLQYLLFTPSGIPIHTLYARVLPPFLLPPPLLPRLGPHTLRRFTILPKKLRPFK
                  130       140       150       160       170       180
```

The following partial DNA sequence was identified in *N. meningitidis* <SEQ ID 809>:

a226.seq

```
  1 ATGAACGAAA TCCTCAGGCA GCCGAGCATC CTGCTTTTCC TCACGCTTGC
 51 CGTGTACGCG CTTGCGATTA TCGTGCGCAC GCGCACGGGT AATATCTTCT
101 GCAACCCCGT ACTCGTCAGC ACTATCGTGC TGATTGCCTA CCTGAAAATC
151 CTCGGTATCG ATTATGCGGT GTACCACAAC GCCGCGCAGT TTATCGATTT
201 CTGGCTCAAG CCCGCCGTCG TCGTGCTTGC CGTGCCGCTC TACCAAAACC
251 GCCGTAAAAT CTTCAACCAA TGGCTGCCCG TCATCGTTTC GCAGCTTGCG
301 GGCAGCGTTA CGGGCATTGT TACGGGGATG TATTTTGCCA AATGGCTGGG
351 CGCGGAACGC GAAGTCGTCC TCTCGCTCGC GTCCAAATCT GTTACCAATC
401 CTATCGCCAT CGAAATCACC CGCTCCATCG GCGGCATTCC CGCCATTACC
451 GCCGCCACCG TCATCATTGC CGGCCTGGTC GGACAGATTG CCGGTTACAA
501 AATGTTGAAA AACACGGTCG TTATGCCCTC ATCTGTCGGA ATGTCGCTCG
551 GCACGGCTTC GCACGCGATG GGCATTGCCG CCTCGCTCGA ACGCAGCCGC
601 CGCATGGCGG CATACGCGGG GCTGGGGCTG ACGTTCAACG GCGTACTGAC
651 CGCGCTGATT GCGCCGCTGC TTATCCCCGT TTTGGGATTT TGA
```

This corresponds to the amino acid sequence <SEQ ID 810; ORF 226.a>:

a226.pep

```
  1 MNEILRQPSI LLFLTLAVYA LAIIVRTRTG NIFCNPVLVS TIVLIAYLKI
 51 LGIDYAVYHN AAQFIDFWLK PAVVVLAVPL YQNRRKIFNQ WLPVIVSQLA
101 GSVTGIVTGM YFAKWLGAER EVVLSLASKS VTNPIAIEIT RSIGGIPAIT
151 AATVIIAGLV GQIAGYKMLK NTVVMPSSVG MSLGTASHAM GIAASLERSR
201 RMAAYAGLGL TFNGVLTALI APLLIPVLGF *
```

m226/a226 99.6% identity in 230 aa overlap

```
                   10        20        30        40        50        60
m226.pep   MNEILRQPSVLLFLTLAVYALAIIVRTRTGNIFCNPVLVSTIVLIAYLKILGIDYAVYHN
           |||||||||:||||||||||||||||||||||||||||||||||||||||||||||||||
a226       MNEILRQPSILLFLTLAVYALAIIVRTRTGNIFCNPVLVSTIVLIAYLKILGIDYAVYHN
                   10        20        30        40        50        60

                   70        80        90       100       110       120
m226.pep   AAQFIDFWLKPAVVVLAVPLYQNRRKIFNQWLPVIVSQLAGSVTGIVTGMYFAKWLGAER
           ||||||||||||||||||||||||||||||||||||||||||||||||||||||||||||
a226       AAQFIDFWLKPAVVVLAVPLYQNRRKIFNQWLPVIVSQLAGSVTGIVTGMYFAKWLGAER
                   70        80        90       100       110       120

                  130       140       150       160       170       180
m226.pep   EVVLSLASKSVTNPIAIEITRSIGGIPAITAATVIIAGLVGQIAGYKMLKNTVVMPSSVG
           ||||||||||||||||||||||||||||||||||||||||||||||||||||||||||||
a226       EVVLSLASKSVTNPIAIEITRSIGGIPAITAATVIIAGLVGQIAGYKMLKNTVVMPSSVG
                  130       140       150       160       170       180
                  190       200       210       220       230
m226.pep   MSLGTASHAMGIAASLERSRRMAAYAGLGLTFNGVLTALIAPLLIPVLGFX
           ||||||||||||||||||||||||||||||||||||||||||||||||||
a226       MSLGTASHAMGIAASLERSRRMAAYAGLGLTFNGVLTALIAPLLIPVLGFX
                  190       200       210       220       230
```

The following partial DNA sequence was identified in *N. gonorrhoeae* <SEQ ID 811>:

g227.seq

```
  1 atgaacatca tccgcgcgct cctcatcatc ctcggctgcc tcgccgccgg
 51 cgaaaccgcc gttttcctag caggcatcaa actgcccggc agcatcgtcg
101 gcatgggcgt gctgtttgcg cttttgcagg cgggttggct caaaacgtct
151 tggctgcaac agcttaccga cgcgctgatg gcaaacctga cgctgttcct
201 cgtgccgccc tgcgtggcgg tcatcagcta tttggatttg attgccgacg
251 attggttttc gatactggtt tccgcctccg ccagcacttt gtgcgtactg
301 ctggttacgg gcaaggttca ccgctggata cggagcatta tctga
```

This corresponds to the amino acid sequence <SEQ ID 812; ORF 227.ng>:

g227.pep

```
  1 MNIIRALLII LGCLAAGETA VFLAGIKLPG SIVGMGVLFA LLQAGWLKTS
 51 WLQQLTDALM ANLTLFLVPP CVAVISYLDL IADDWFSILV SASASTLCVL
101 LVTGKVHRWI RSII*
```

The following partial DNA sequence was identified in *N. meningitidis* <SEQ ID 813>:

m227.seq (partial)

```
  1 ..ACGTCTTkGC TGCAACAGCT TACCGACGCG CTGATGTCGA ACCTGACGCT
 51   GTtCCTCGTG CCgCC.TGCG TGGCGGTCAT CAGCTATTTG GATTTGATTG
101   CCGACGATTG GTTTTCGATA CTGGTTTCCG CCTCCGCCAG cACTTTGTGC
151   GTACTGCTGG TTACGGGCAA AGTCCACCGG TGGATACGGG GTATTATCCG
201   ATGA
```

This corresponds to the amino acid sequence <SEQ ID 814; ORF 227>:

m227.pep (partial)

```
  1 ..TSXLQQLTDA LMSNLTLFLV PPCVAVISYL DLIADDWFSI LVSASASTLC
 51   VLLVTGKVHR WIRGIIR*
```

Computer analysis of this amino acid sequence gave the following results:

Homology with a predicted ORF from *N. gonorrhoeae*

ORF 227 shows 95.5% identity over a 66 aa overlap with a predicted ORF (ORF 227.ng) from *N. gonorrhoeae*:

m227/g227

```
                                                    10        20        30
m227.pep                                    TSXLQQLTDALMSNLTLFLVPPCVAVISYL
                                            || |||||||||:|||||||||||||||||
g227         TAVFLAGIKLPGSIVGMGVLFALLQAGWLKTSWLQQLTDALMANLTLFLVPPCVAVISYL
             20        30        40        50        60        70
```

-continued

```
                   40        50        60
m227.pep     DLIADDWFSILVSASASTLCVLLVTGKVHRWIRGIIRX
             ||||||||||||||||||||||||||||||||||:|||
g227         DLIADDWFSILVSASASTLCVLLVTGKVHRWIRSIIX
             80        90        100       110
```

The following partial DNA sequence was identified in *N. meningitidis* <SEQ ID 815>:

a227.seq

```
  1 ATGAACATCA TCCGCGCGCT CCTCATCATC CTCGGCTGCC TCGCCACCGG
 51 CGAAACCGCC GTTTTCCTAG CAGGCATCAA ACTGCCCGGC AGCATCGTCG
101 GCATGGGCGT ACTGTTTGCG CTTTTGCAGG CGGGTTGGGT CAAAACGTCT
151 TGGCTGCAAC AGCTTACCGA CGCGCTGATG GCGAATCTGA CGTTGTTTCT
201 CGTGCCGCCC TGCGTGGCGG TCATCAGCTA TTTGGATTTG ATTGCCGACG
251 ATTGGTTTTC GATACTGGTT TCCGCCTCCG CCAGCACTTT GTGCGTACTG
301 CTGGTTACAG GCAAGGTTCA CCGCTGGATA CGGAGCATTA TCTGA
```

This corresponds to the amino acid sequence <SEQ ID 816; ORF 227.a>:

a227.pep

```
  1 MNIIRALLII LGCLATGETA VFLAGIKLPG SIVGMGVLFA LLQAGWVKTS
 51 WLQQLTDALM ANLTLFLVPP CVAVISYLDL IADDWFSILV SASASTLCVL
101 LVTGKVHRWI RSII*
```

m227/a227 95.5% identity in 66 aa overlap

```
                                                   10        20        30
m227.pep                                     TSXLQQLTDALMSNLTLFLVPPCVAVISYL
                                             || |||||||||:||||||||||||||||
a227         TAVFLAGIKLPGSIVGMGVLFALLQAGWVKTSWLQQLTDALMANLTLFLVPPCVAVISYL
             20        30        40        50        60        70
                   40        50        60
m227.pep     DLIADDWFSILVSASASTLCVLLVTGKVHRWIRGIIRX
             ||||||||||||||||||||||||||||||||||:||
a227         DLIADDWFSILVSASASTLCVLLVTGKVHRWIRSIIX
             80        90        100       110
```

The following partial DNA sequence was identified in *N. meningitidis* <SEQ ID 817>:

m228.seq

```
  1 ATGAAAAAAT TATTGATTGC CGCAATGATG GCGGCTGCCT TGGCAGCTTG
 51 TTCGCAAGAA GCCAAACAGG AGGTTAAGGA AGCGGTTCAA GCCGTTGAGT
101 CCGATGTTAA AGACACTGCG GCTTCTGCCG CCGAGTCTGC CGCTTCTGCC
151 GTCGAAGAAG CGAAAGACCA AGTCAAAGAT GCTGCGGCTG ATGCAAAGGC
201 AAGTGCCGAG GAAGCTGTAA CTGAAGCCAA AGAAGCTGTA ACTGAAGCAG
251 CTAAAGATAC TTTGAACAAA GCTGCCGACG CGACTCAGGA AGCGGCAGAC
301 AAAATGAAAG ATGCCGCCAA ATAA
```

This corresponds to the amino acid sequence <SEQ ID 818; ORF 228>:

m228.pep

```
  1 MKKLLIAAMM AAALAACSQE AKQEVKEAVQ AVESDVKDTA ASAAESAASA

 51 VEEAKDQVKD AAADAKASAE EAVTEAKEAV TEAAKDTLNK AADATQEAAD

101 KMKDAAK*
```

Computer analysis of this amino acid sequence gave the following results:

The following partial DNA sequence was identified in *N. meningitidis* <SEQ ID 819>:

a228.seq

```
  1 ATGAAAAAAT TATTGATTGC CGCAATGATG GCGGCTGCCT TGGCAGCTTG

 51 TTCGCAAGAA GCCAAACAGG AGGTTAAGGA AGCGGTTCAA GCCGTTGAGT

101 CCGATGTTAA AGACACTGCG GCTTCTGCCG CCGAGTCTGC CGCTTCTGCC

151 GTCGAAGAAG CGAAAGACCA AGTCAAAGAT GCTGCGGCTG ATGCAAAGGC

201 AAGTGCCGAG GAAGCTGTAA CTGAAGCCAA AGAAGCTGTA ACTGAAGCAG

251 CTAAAGATAC TTTGAACAAA GCTGCCGACG CGACTCAGGA AGCGGCAGAC

301 AAAATGAAAG ATGCCGCCAA ATAA
```

This corresponds to the amino acid sequence <SEQ ID 820; ORF 228.a>:

a228.pep

```
  1 MKKLLIAAMM AAALAACSQE AKQEVKEAVQ AVESDVKDTA ASAAESAASA

 51 VEEAKDQVKD AAADAKASAE EAVTEAKEAV TEAAKDTLNK AADATQEAAD

101 KMKDAAK*
```

m228/a228 100.0% identity in 107 aa overlap

```
                    10        20        30        40        50        60
m228.pep    MKKLLIAAMMAAALAACSQEAKQEVKEAVQAVESDVKDTAASAAESAASAVEEAKDQVKD
            ||||||||||||||||||||||||||||||||||||||||||||||||||||||||||||
a228        MKKLLIAAMMAAALAACSQEAKQEVKEAVQAVESDVKDTAASAAESAASAVEEAKDQVKD
                    10        20        30        40        50        60

                    70        80        90       100
m228.pep    AAADAKASAEEAVTEAKEAVTEAAKDTLNKAADATQEAADKMKDAAKX
            ||||||||||||||||||||||||||||||||||||||||||||||||
a228        AAADAKASAEEAVTEAKEAVTEAAKDTLNKAADATQEAADKMKDAAKX
                    70        80        90       100
```

The following partial DNA sequence was identified in *N. gonorrhoeae* <SEQ ID 821>:

g229.seq

```
  1 atggctgccg tatcgggcgg cggtgcggtc ttcctgataa tgcttccaca

 51 tattgcccgc gttcagcgtc agccgccagc gttcgcccaa gcgtcgggag

101 aaatcggcat tgaagccgcc ggcgaaattg tatcggctgc cgcccaagag
```

-continued 151 gttttgcccg acaaacggca cggtgccgaa cgagcgcgtt accgaacggt 201 tttgatggcc gaacgacagg cgcaggttct gttcgctgaa atctttgtta 251 tcccaataat gcacgccgcg gctgatgccg ccgtagagga aatgatgccc 301 gcccgcattg atttcgcgcg acacgcccaa gccgtagcgc aaaccgtgtg 351 ccttttgcgg caggctgtcg gcggttttcg tccagcttct gcccgcaaat 401 tcaatcgttt tttcggacga agcgttgttt atagcggatt aacaaaaatc 451 aggacaaggc ggcgggccgc aggcagtacg gatggtacgg aaccggttcg 501 cccggtgctt ggacgcctta gggaaccgtt ccctttgagc cggggcgggg 551 caacccgtac cggtttttgt tcatccgcca tattgtgttg a This corresponds to the amino acid sequence <SEQ ID 822; ORF 229.ng>:

g229.pep

1 MAAVSGGGAV FLIMLPHIAR VQRQPPAFAQ ASGEIGIEAA GEIVSAAAQE

51 VLPDKRHGAE RARYRTVLMA ERQAQVLFAE IFVIPIMHAA ADAAVEEMMP

101 ARIDFARHAQ AVAQTVCLLR QAVGGFRPAS ARKFNRFFGR SVVYSGLTKI

151 RTRRRAAGST DGTEPVRPVL GRLREPFPLS RGGATRTGFC SSAILC*

The following partial DNA sequence was identified in *N. meningitidis* <SEQ ID 823>:

m229.seq (partial)

1 ..GCTCAAGCGT TGGGAGAAAT CGGCATTGAA GCCGCCGACG AAATTGTATC

51 GGCTGCCGCC TAAGAGGTTT TGCTCGACAA ACGGCACGAT GCCGAACGAG

101 CGCGTTACCG AACGGTTTTT ATAGCCGAAC GACAGGCGCA GGCTCTGTTC

151 GCTGAAATCT TTGTTATCCC AATAATGCAC GCCGCCGCCG CTGATGCCGC

201 CGTAGAGGAA ATGATGCCTG CCCGCATTGA TTTCGCGCGA CACGCCTAAG

251 CCCTAGCGCA AACCGTGTGC CTTTTGCGGC AGGCTGTCGG CGGTTTTCGT

301 CCAGCTTCTG CCCGCAAATT CAATCGTTTT TTCGGACGAA GCGTTGTTTA

351 TAGCGGATTA ACAAAAATCA GGACAAGGCA ACGAAGCCGC AGACAGTACA

401 AATAGTACGG AACCGATTCA CTTGGTGCTT CAGCACcTTA GAGAATCGTT

451 CTCTTTTTTG TTCATCCGCT ATATTGTGTT GA

This corresponds to the amino acid sequence <SEQ ID 824; ORF 229>:

m229.pep (partial)

1 ..AQALGEIGIE AADEIVSAAA XEVLLDKRHD AERARYRTVF IAERQAQALF

51 AEIFVIPIMH AAAADAAVEE MMPARIDFAR HAXALAQTVC LLRQAVGGFR

101 PASARKFNRF FGRSVVYSGL TKIRTRQRSA DSTNSTEPIH LVLQHLRESR

151 SLFCSSAILC *

Computer analysis of this amino acid sequence gave the following results:

Homology with a predicted ORF from *N. gonorrhoeae*

ORF 229 shows 80.5% identity over a 169 aa overlap with a predicted ORF (ORF 229.ng) from *N. gonorrhoeae*:

m229/g209

```
                                                    10        20        30
m229.pep                                    AQALGEIGIEAADEIVSAAAXEVLLDKRHDAE
                                            ||| |||||||| ||||||| ||| |||| ||
g229          MAAVSGGGAVFLIMLPHIARVQRQPPAFAQASGEIGIEAAGEIVSAAAQEVLPDKRHGAE
                      10        20        30        40        50        60

                    40        50        60        70        80        90
m229.pep      RARYRTVFIAERQAQALFAEIFVIPIMHAAAADAAVEEMMPARIDFARHAXALAQTVCLL
              |||||||::||||||:||||||||||||||| |||||||||||||||||| |:|||||||
g229          RARYRTVLMAERQAQVLFAEIFVIPIMHAAA-DAAVEEMMPARIDFARHAQAVAQTVCLL
                      70        80        90        100       110

                   100       110       120       130       140
m229.pep      RQAVGGFRPASARKFNRFFGRSVVYSGLTKIRTRQRSADSTNSTEPIHLVLQHLRE----
              ||||||||||||||||||||||||||||||||||:|:| ||::|||:: || :|||
g229          RQAVGGFRPASARKFNRFFGRSVVYSGLTKIRTRRRAAGSTDGTEPVRPVLGRLREPFPL
            120       130       140       150       160       170

                  150       160
m229.pep      -----SRSLFCSSAILCX
                   :|: ||||||||
g229          SRGGATRTGFCSSAILC
            180       190
```

The following partial DNA sequence was identified in *N. meningitidis* <SEQ ID 825>:

a229.seq (partial)

```
  1 ATGGCTGTCG TATCGGGCGG CGGTGCGGTC TTCCTGATAA CGCTTCCACA

 51 TATTGCCCAC GTTCAGCGTC AGCCGCCA.. GTTCGCTCAA GCGTCGGGAG

101 AAATCGGCAT TGAAGCCGCC GACGAAATTG TATCGGCTGC CGCCTAAGAG

151 GTTTTGCTCG ATAAACGGCA CGATGCCGAA TGAGCGCGTT ACTGAACGGT

201 TTTTATAGCC GAGCGACAGG CGCAGGCTCT GTTCGCTGAA ATCTTTGTTA

251 TCCTAATAGT GCACGCCGCC GCCGCTGATG TCTCCGTAGA GGAAATGATG

301 CCCGCCCGCA TTGATTTCGC GCGACACGCC CAAGCCGTAG CGCAAACCGT

351 GTGCCTTTTG CGGCAGGCTG TCGGCGGTTT TCGTCCAGCT TCTGCCTGCA

401 AATTCAATCG TTTTTTCGGA CGAAGCGTTG TTTATAGCGG ATTAACAAAA

451 ATCAGGACAA GGCGACGAAG CGCAGACAGT ACAGATAGTA CGGAACCGAT

501 TCACTTGGTG CTTCAGCACC TTAGAGAATC GTCTCTTTGA GCTAAGGCGA

551 GGCAACGCCG TACTGGTTTT TGTTCATCCA CTATA
```

This corresponds to the amino acid sequence <SEQ ID 826; ORF 229.a>:

a229.pep (partial)

```
  1 MAVVSGGGAV FLITLPHIAH VQRQPPXFAQ ASGEIGIEAA DEIVSAAA*E

 51 VLLDKRHDAE *ARY*TVFIA ERQAQALFAE IFVILIVHAA AADVSVEEMM

101 PARIDFARHA QAVAQTVCLL RQAVGGFRPA SACKFNRFFG RSVVYSGLTK

151 IRTRRRSADS TDSTEPIHLV LQHLRESSL* AKARQRRTGF CSSTI
```

m229/a229 85.6% identity in 167 aa overlap

```
                                                 10        20        30
m229.pep                             AQALGEIGIEAADEIVSAAAXEVLLDKRHDAE
                                     ||| ||||||||||||||||||||||||||||
a229         MAVVSGGGAVFLITLPHIAHVQRQPPXFAQASGEIGIEAADEIVSAAAXEVLLDKRHDAE
                     10        20        30        40        50        60

                 40        50        60        70        80        90
m229.pep   RARYRTVFIAERQAQALFAEIFVIPIMHAAAADAAVEEMMPARIDFARHAXALAQTVCLL
            ||| ||||||||||||||||||| |:||||||::||||||||||||||| |:|||||||
a229       XARYXTVFIAERQAQALFAEIFVILIVHAAAADVSVEEMMPARIDFARHAQAVAQTVCLL
                   70        80        90       100       110       120

                  100       110       120       130       140      149
m229.pep     RQAVGGFRPASARKFNRFFGRSVVYSGLTKIRTRQRSADSTNSTEPIHLVLQHLRES---
             |||||||||||| |||||||||||||||||||||:||||||:|||||||||||||||   
a229         RQAVGGFRPASACKFNRFFGRSVVYSGLTKIRTRRRSADSTDSTEPIHLVLQHLRESSLX
                    130       140       150       160       170       180

                  150       160
m229.pep     ------RSLFCSSAILCX
                   |: ||||:|
a229         AKARQRRTGFCSSTI
                    190
```

The following partial DNA sequence was identified in *N. gonorrhoeae* <SEQ ID 827>:

g230.seq

```
   1 atgttccatt ccatcgaaaa atacagaaca cccgcccaag tcttattagg
  51 cctgattgca ttaacttttg tcggcttcgg cgtcagcacg gtttcccatc
 101 cgggcgccga ctacatcgtc caagtgggcg acgaaaaaat cagcgagcac
 151 tcaatcaaca acgccatgca gaacgagcag gcggacggcg gcagcccttg
 201 gcgcgacgcg gtgttccaat ccctgctgca acgcgcctac ctgaaacagg
 251 gcgcgaagct gatgggcatt tcggtttctt ccgaacaaat caagcagatg
 301 attgtggacg atcccaattt ccacgacgca aacggcaaat tcagtcacgc
 351 gcttttgagt caatacctgt cgcaacgcca tatgtctgaa gaccagtttg
 401 tcgaagaaat ccgcgatcag tttgccttgc agaatttggt aagcctcgtc
 451 caaaacggcg tattggtcgg cgacgcgcag gcggaacagc tgatcaggct
 501 gacgcaggtc aaccgcacca tccgttcgca cactttcaac cccgacgagt
 551 tcatcgccca agtcaaagcg tctgaagccg atttgcagaa attttataat
 601 gcgaacaaaa aagactatct gctgccgcag gcggtcaaat tggaatatgt
 651 cgccttgaat ctgaaggatt ttgcagacaa gcagaccgtc agtgaaacgg
 701 aagtgaaaaa tgcgtttgaa gagcgcgtgg cgcgtttgcc ggcacatgaa
 751 gccaaacctt ctttcgagca ggaaaaagcc gccgtcgaaa acgaattgaa
 801 aatgaaaaag gcggttgccg acttcaacaa ggcaaaagaa aagctgggcg
 851 acgatgcgtt caatcatccc tcctcgcttg ccgaagccgc caaaaacagc
 901 ggtttgaaag tggaaaccca agaaacttgg ctgagcaggc aggacgcaca
 951 aatgtccggc atgcccgaaa acctaatcaa tgccgtattc agcgacgacg
1001 tattgaagaa aaaacacaat tccgaagtgc tgaccatcaa cagcgaaacc
1051 gcgtgggtcg tccgcgccaa agaagtccgc gaagaaaaaa acctactgtt
1101 tgaagaagcc aaagatgcgg tgcgtcaggc ctatatccgt accgaagccg
1151 ccaaactttt gaaaacaatg taa
```

This corresponds to the amino acid sequence <SEQ ID 828; ORF 230.ng>:

g230.pep

```
  1 MFHSIEKYRT PAQVLLGLIA LTFVGFGVST VSHPGADYIV QVGDEKISEH
 51 SINNAMQNEQ ADGGSPWRDA VFQSLLQRAY LKQGAKLMGI SVSSEQIKQM
101 IVDDPNFHDA NGKFSHALLS QYLSQRHMSE DQFVEEIRDQ FALQNLVSLV
151 QNGVLVGDAQ AEQLIRLTQV NRTIRSHTFN PDEFIAQVKA SEADLQKFYN
201 ANKKDYLLPQ AVKLEYVALN LKDFADKQTV SETEVKNAFE ERVARLPAHE
251 AKPSFEQEKA AVENELKMKK AVADFNKAXE KLGDDAFNHP SSLAEAAKNS
301 GLKVETQETW LSRQDAQMSG MPENLINAVF SDDVLKKKHN SEVLTINSET
351 AWVVRAKEVR EEKNLLFEEA KDAVRQAYIR TEAAKLLKTM *
```

The following partial DNA sequence was identified in *N. meningitidis* <SEQ ID 829>:

m230.seq (partial)

```
   1 ATGTTCCATT CCATCGAAAA ATACAGAACG CCCGCCCAAG TCCTTTTGGG
  51 CCTGATTGCA TTAACCTTCG TCGGCTTCGG GGTCAGCACG GTATCCCATC
 101 CGGGTGCCGA CTACATCGTC CAAGTGGGCG ACGAAAAAaT CAGCGACCAC
 151 TCCATCAACA ACGCCATACA GAACGAACAG GCGGACGGCG GCGGCCCTTC
 201 GCc.GACGCG GTGTTCCAAT CCCTGCTGCA ACGCGCCTAC CTGAAACAGG
 251 GCGCGAAGCT GATGGGCATT TCGGTTTCTT CCGAACAAAT CAAGCAAATT
 301 ATCGTGGACG ATCCCAATTT CCACGACGCA AACGGCAAAT TCGACCACGC
 351 GCTTTTAAAC CGCTACCTTT CCCAACGCCA TATGTCTGAA GACCAGTTTG
 401 TCGAAGAAAT CCGCGATCAG TTTGCCTTGC AGAATTTGGT AAACCTCGTC
 451 CAAAACGGCG TATTGGTCGG CGACGCGCAG GCGGAACAGC TGATCAGGCT
 501 GACACAGGTC AACCGCACCA TCCGTTCGCA CACTTTCAAC CCCGACGAGT
 551 TCATCGCCCA AGTCAAAGTG TCTGAAGCCG ATTTGCAGAA ATTTTATAAT
 601 GCGAACAAAA AAGACTATCT GCTGCCGCAG gCGGTCAAAT TGGAATATGT
 651 CGCCTTGAAT CTGAAGGATT TTGCAGACAA GCAGACCGTC AGTGAAACGg
 701 AAGTGAAAAA TGCATTTGAA GAGCGCGTGG CGCGTTTGCC GGCAAATGAA
 751 GCCAAACCTT CTTTCGAGCA GGAAAAAGCC GCCGTCGAAA ACGAATTGAA
 801 AATGAAAAAG GCGGTTGCCG ACTTCAACAA GGCAAAAGAA AAATTGGGCG
 851 ACGATGC.GT cAACCATCCT TCyTCGCTTG CCGAAGCCGC CAAAAACAGC
 901 GGTTTGAAAG TCGAAACCCA AGAAACTTGG CTGAGTAGGC AGGACGCGCA
 951 AATGTCCGGT ATGCCCGAAA ACCTGATCAA TGCCGTATTC AGCGACGACG
1001 TATTGAAGAA AAAACACAAT TCCGAAGTGC TGACCATCAA CAGCGAAACC
1051 GCGTGGGTCG TCCGCGCCAA AGAAGTCCGC GAAGAGAAAA CCCTGCCGTT
1101 TGCCGAAGCC AAAGACGCGG TACGTCAGGC TTATATCCGT ACCGAAGCCG
1151 CCAAACTT.. ...
```

This corresponds to the amino acid sequence <SEQ ID 830; ORF 230>:

m230.pep (partial)

```
  1 MFHSIEKYRT PAQVLLGLIA LTFVGFGVST VSHPGADYIV QVGDEKISDH
 51 SINNAIQNEQ ADGGGPSPDA VFQSLLQRAY LKQGAKLMGI SVSSEQIKQI
101 IVDDPNFHDA NGKFDHALLN RYLSQRHMSE DQFVEEIRDQ FALQNLVNLV
151 QNGVLVGDAQ AEQLIRLTQV NRTIRSHTFN PDEFIAQVKV SEADLQKFYN
201 ANKKDYLLPQ AVKLEYVALN LKDFADKQTV SETEVKNAFE ERVARLPANE
251 AKPSFEQEKA AVENELKMKK AVADFNKAKE KLGDDAVNHP SSLAEAAKNS
301 GLKVETQETW LSRQDAQMSG MPENLINAVF SDDVLKKKHN SEVLTINSET
351 AWVVRAKEVR EEKTLPFAEA KDAVRQAYIR TEAAKL....
```

Computer analysis of this amino acid sequence gave the following results:

Homology with a predicted ORF from *N. gonorrhoeae*

ORF 230 shows 95.9% identity over a 386 aa overlap with a predicted ORF (ORF 230.ng) from *N. gonorrhoeae*:

m230/g230

```
                      10        20        30        40        50        60
m230.pep    MFHSIEKYRTPAQVLLGLIALTFVGFGVSTVSHPGADYIVQVGDEKISDHSINNAIQNEQ
            |||||||||||||||||||||||||||||||||||||||||||||||||:|||||:||||
g230        MFHSIEKYRTPAQVLLGLIALTFVGFGVSTVSHPGADYIVQVGDEKISEHSINNAMQNEQ
                      10        20        30        40        50        60

                      70        80        90       100       110       120
m230.pep    ADGGGPSPDAVFQSLLQRAYLKQGAKLMGISVSSEQIKQIIVDDPNFHDANGKFDHALLN
            ||||:|  |||||||||||||||||||||||||||||||:||||||||||||||:||||:
g230        ADGGSPWRDAVFQSLLQRAYLKQGAKLMGISVSSEQIKQMIVDDPNFHDANGKFSHALLS
                      70        80        90       100       110       120

                     130       140       150       160       170       180
m230.pep    RYLSQRHMSEDQFVEEIRDQFALQNLVNLVQNGVLVGDAQAEQLIRLTQVNRTIRSHTFN
            :||||||||||||||||||||||||||:||||||||||||||||||||||||||||||||
g230        QYLSQRHMSEDQFVEEIRDQFALQNLVSLVQNGVLVGDAQAEQLIRLTQVNRTIRSHTFN
                     130       140       150       160       170       180

                     190       200       210       220       230       240
m230.pep    PDEFIAQVKVSEADLQKFYNANKKDYLLPQAVKLEYVALNLKDFADKQTVSETEVKNAFE
            |||||||||:||||||||||||||||||||||||||||||||||||||||||||||||||
g230        PDEFIAQVKASEADLQKFYNANKKDYLLPQAVKLEYVALNLKDFADKQTVSETEVKNAFE
                     190       200       210       220       230       240

                     250       260       270       280       290       300
m230.pep    ERVARLPANEAKPSFEQEKAAVENELKMKKAVADFNKAKEKLGDDAVNHPSSLAEAAKNS
            ||||||||:||||||||||||||||||||||||||||||||||||| |||||||||||||
g230        ERVARLPAHEAKPSFEQEKAAVENELKMKKAVADFNKAKEKLGDDAFNHPSSLAEAAKNS
                     250       260       270       280       290       300

                     310       320       330       340       350       360
m230.pep    GLKVETQETWLSRQDAQMSGMPENLINAVFSDDVLKKKHNSEVLTINSETAWVVRAKEVR
            ||||||||||||||||||||||||||||||||||||||||||||||||||||||||||||
g230        GLKVETQETWLSRQDAQMSGMPENLINAVFSDDVLKKKHNSEVLTINSETAWVVRAKEVR
                    310       320       330       340       350       360

                     370       380
m230.pep    EEKTLPFAEAKDAVRQAYIRTEAAKL
            |||:| | ||||||||||||||||||
g230        EEKNLLFEEAKDAVRQAYIRTEAAKLLKTM
                     370       380       390
```

The following partial DNA sequence was identified in *N. meningitidis* <SEQ ID 831>:

a230.seq (partial)

```
  1 ATGTTCCATT CCATCGAAAA ATACAGAACG CCCGCCCAAG TCCTTTTGGG
 51 CCTGATTGCA TTAACCTTCG TCGGCTTCGG GGTCAGCACG GTATCCCATC
```

-continued

```
 101 CGGGTGCCGA CTACATCGTC CAAGTGGGCG ACGAAAAAAT CAGCGACCAC

 151 TCCATCAACA ACGCCATACA GAACGAACAG GCGGACGGCG GCGGCCCTTC

 201 GCGCGACGCG GTGTTCCAAT CCCTGCTACA ACGCGCCTAC CTGAAACAGG

 251 GCGCGAAGCT GATGGGCATT TCGGTTTCTT CCGAACAAAT CAAGCAGATT

 301 ATCGTGGACG ATCCCAATTT CCACGACGCA AACGGCAAAT TCGACCACGC

 351 GCTTTTAAAC CGCTACCTTT CCCAACGTCA TATGTCTGAA GACCAGTTTG

 401 TCGAAGAAAT CCGCGATCAG TTTGCCTTGC AGAATTTGGT AAACCTCGTC

 451 CAAAACGGCG TATTGGTCGG CGACGCGCAG GCGGAACAGC TGATCAGGCT

 501 GACGCAGGTC AACCGCACCA TCCGTTCGCA CACTTTCAAC CCCGACGAAT

 551 TCATCGCCCA AGTCAAAGTG TCTGAAGCCG ATTTGCAGAA GTTTTATAAC

 601 GCAAACAAAA AAGACTACCT GCTTCCCAAA GCGGTCAAAT TGGAATATGT

 651 CGCCTTGAAT CTGAAAGACT TTGCAGACAA ACAGACCGTC AGCGAAACAG

 701 AAGTGAAAAA TGCGTTTGAA GAGCGCGTGG CGCGTTTGCC GGCAAATGAA

 751 GCCAAACCTT CTTTCGAGCA GGAAAAAGCC GCCGTCGAAA ACGAATTGAA

 801 AATGAAAAAG GCGGTTGCCG ACTTCAATAA GGCAAAAGAA AAGCTGGGCG

 851 ATGACGCGTT CAACCATCCT TCCTCGCTTG CCGAAGCCGC CAAAAACAGC

 901 GGTTTGAAAG TCGAAACCCA AGAAACTTGG CTGAGCAGGC AGGATGCGCA

 951 AATGTCCGGT ATGCCCGAAA ACCTGATCAA TGCCGTATTC AGCGACGACG

1001 TATTGAAGAA AAAACACAAT TCCGAAGTGC TGACCATCAA CAGCGAAACC

1051 GCGTGGGTCG TCCGCGCCAA AGAAGTCCGC GAAGAGAAAA CCCTGCCGTT

1101 TGCCGAAGCC AAAGACGCGG TACGTCAGGC TTATATCCGT ACCGAAGCCG

1151 CCAAACTT
```

This corresponds to the amino acid sequence <SEQ ID 832; ORF 230.a>:

a230.pep (partial)

```
  1 MFHSIEKYRT PAQVLLGLIA LTFVGFGVST VSHPGADYIV QVGDEKISDH

 51 SINNAIQNEQ ADGGGPSRDA VFQSLLQRAY LKQGAKLMGI SVSSEQIKQI

101 IVDDPNFHDA NGKFDHALLN RYLSQRHMSE DQFVEEIRDQ FALQNLVNLV

151 QNGVLVGDAQ AEQLIRLTQV NRTIRSHTFN PDEFIAQVKV SEADLQKFYN

201 ANKKDYLLPK AVKLEYVALN LKDFADKQTV SETEVKNAFE ERVARLPANE

251 AKPSFEQEKA AVENELKMKK AVADFNKAKE KLGDDAFNHP SSLAEAAKNS

301 GLKVETQETW LSRQDAQMSG MPENLINAVF SDDVLKKKHN SEVLTINSET

351 AWVVRAKEVR EEKTLPFAEA KDAVRQAYIR TEAAKL
```

m230/a230 99.2% identity in 386 aa overlap

```
                    10        20        30        40        50        60
m230.pep    MFHSIEKYRTPAQVLLGLIALTFVGFGVSTVSHPGADYIVQVGDEKISDHSINNAIQNEQ
            ||||||||||||||||||||||||||||||||||||||||||||||||||||||||||||
a230        MFHSIEKYRTPAQVLLGLIALTFVGFGVSTVSHPGADYIVQVGDEKISDHSINNAIQNEQ
                    10        20        30        40        50        60
```

-continued

```
                  70        80        90       100       110       120
m230.pep  ADGGGPSPDAVFQSLLQRAYLKQGAKLMGISVSSEQIKQIIVDDPNFHDANGKFDHALLN
          ||||||| ||||||||||||||||||||||||||||||||||||||||||||||||||||
a230      ADGGGPSRDAVFQSLLQRAYLKQGAKLMGISVSSEQIKQIIVDDPNFHDANGKFDHALLN
                  70        80        90       100       110       120

                 130       140       150       160       170       180
m230.pep  RYLSQRHMSEDQFVEEIRDQFALQNLVNLVQNGVLVGDAQAEQLIRLTQVNRTIRSHTFN
          ||||||||||||||||||||||||||||||||||||||||||||||||||||||||||||
a230      RYLSQRHMSEDQFVEEIRDQFALQNLVNLVQNGVLVGDAQAEQLIRLTQVNRTIRSHTFN
                 130       140       150       160       170       180

                 190       200       210       220       230       240
m230.pep  PDEFIAQVKVSEADLQKFYNANKKDYLLPQAVKLEYVALNLKDFADKQTVSETEVKNAFE
          |||||||||||||||||||||||||||||:||||||||||||||||||||||||||||||
a230      PDEFIAQVKVSEADLQKFYNANKKDYLLPKAVKLEYVALNLKDFADKQTVSETEVKNAFE
                 190       200       210       220       230       240

                 250       260       270       280       290       300
m230.pep  ERVARLPANEAKPSFEQEKAAVENELKMKKAVADFNKAKEKLGDDAVNHPSSLAEAAKNS
          ||||||||||||||||||||||||||||||||||||||||||||||| |||||||||||||
a230      ERVARLPANEAKPSFEQEKAAVENELKMKKAVADFNKAKEKLGDDAFNHPSSLAEAAKNS
                 250       260       270       280       290       300

                 310       320       330       340       350       360
m230.pep  GLKVETQETWLSRQDAQMSGMPENLINAVFSDDVLKKKHNSEVLTINSETAWVVRAKEVR
          ||||||||||||||||||||||||||||||||||||||||||||||||||||||||||||
a230      GLKVETQETWLSRQDAQMSGMPENLINAVFSDDVLKKKHNSEVLTINSETAWVVRAKEVR
                310       320       330       340       350       360

                 370       380
m230.pep  EEKTLPFAEAKDAVRQAYIRTEAAKL
          ||||||||||||||||||||||||||
a230      EEKTLPFAEAKDAVRQAYIRTEAAKL
                 370       380
```

The following partial DNA sequence was identified in *N. gonorrhoeae* <SEQ ID 833>:

g230-1.seq

```
  1 ATGTTCCATT CCATCGAAAA ATACAGAACA CCCGCCCAAG TCTTATTAGG
 51 CCTGATTGCA TTAACTTTTG TCGGCTTCGG CGTCAGCACG GTTTCCCATC
101 CGGGCGCCGA CTACATCGTC CAAGTGGGCG ACGAAAAAAT CAGCGAGCAC
151 TCAATCAACA ACGCCATGCA GAACGAGCAG GCGGACGGCG GCAGCCCTTG
201 GCGCGACGCG GTGTTCCAAT CCCTGCTGCA ACGCGCCTAC CTGAAACAGG
251 GCGCGAAGCT GATGGGCATT TCGGTTTCTT CCGAACAAAT CAAGCAGATG
301 ATTGTGGACG ATCCCAATTT CCACGACGCA AACGGCAAAT TCAGTCACGC
351 GCTTTTGAGT CAATACCTGT CGCAACGCCA TATGTCTGAA GACCAGTTTG
401 TCGAAGAAAT CCGCGATCAG TTTGCCTTGC AGAATTTGGT AAGCCTCGTC
451 CAAAACGGCG TATTGGTCGG CGACGCGCAG GCGGAACAGC TGATCAGGCT
501 GACGCAGGTC AACCGCACCA TCCGTTCGCA CACTTTCAAC CCCGACGAGT
551 TCATCGCCCA AGTCAAAGCG TCTGAAGCCG ATTTGCAGAA ATTTTATAAT
601 GCGAACAAAA AAGACTATCT GCTGCCGCAG GCGGTCAAAT TGGAATATGT
651 CGCCTTGAAT CTGAAGGATT TTGCAGACAA GCAGACCGTC AGTGAAACGG
701 AAGTGAAAAA TGCGTTTGAA GAGCGCGTGG CGCGTTTGCC GGCACATGAA
751 GCCAAACCTT CTTTCGAGCA GGAAAAAGCC GCCGTCGAAA ACGAATTGAA
801 AATGAAAAAG GCGGTTGCCG ACTTCAACAA GGCAAAAGAA AAGCTGGGCG
851 ACGATGCGTT CAATCATCCC TCCTCGCTTG CCGAAGCCGC CAAAAACAGC
901 GGTTTGAAAG TGGAAACCCA AGAAACTTGG CTGAGCAGGC AGGACGCACA
951 AATGTCCGGC ATGCCCGAAA ACCTAATCAA TGCCGTATTC AGCGACGACG
```

-continued

```
1001 TATTGAAGAA AAAACACAAT TCCGAAGTGC TGACCATCAA CAGCGAAACC
1051 GCGTGGGTCG TCCGCGCCAA AGAAGTCCGC GAAGAAAAAA ACCTACTGTT
1101 TGAAGAAGCC AAAGATGCGG TGCGTCAGGC CTATATCCGT ACCGAAGCCG
1151 CCAAACTTGC CGAAAACAAG GCAAAAGAAG TGCTTACCCA ACTGAACGGC
1201 GGCAAGGCAG TTGACGTGAA ATGGTCGGAA GTGTCCGTTT TGGGCGCGCA
1251 GCAGGCAAGG CAGTCCATGC CGCCCGAGGC TTATGCGGAA CTGCTGAAAG
1301 CAAAACCGGC AAACGGCAAA CCCGCCTATG TCAGACTGAC CGGTCTGCCG
1351 GCACCCGTGA TTGTCGAGGC GCAGGCAGTC ACGCCTCCGG AGGATATTGC
1401 CGCACAGCTT CCTCCTGCGA AACAGGCTTT GGCGCAACAG CAGTCTGCCA
1451 ATACTTTCGA CCTGCTGATC CGCTATTTCA ACGGAAAAAT CAAACAGACT
1501 AAAGGAGCAC AATCGGTTGA CAACGGCGAT GGTCAGTAA
```

This corresponds to the amino acid sequence <SEQ ID 834; ORF 230-1.ng>:

g230-1.pep

```
  1 MFHSIEKYRT PAQVLLGLIA LTFVGFGVST VSHPGADYIV QVGDEKISEH
 51 SINNAMQNEQ ADGGSPWRDA VFQSLLQRAY LKQGAKLMGI SVSSEQIKQM
101 IVDDPNFHDA NGKFSHALLS QYLSQRHMSE DQFVEEIRDQ FALQNLVSLV
151 QNGVLVGDAQ AEQLIRLTQV NRTIRSHTFN PDEFIAQVKA SEADLQKFYN
201 ANKKDYLLPQ AVKLEYVALN LKDFADKQTV SETEVKNAFE ERVARLPAHE
251 AKPSFEQEKA AVENELKMKK AVADFNKAKE KLGDDAFNHP SSLAEAAKNS
301 GLKVETQETW LSRQDAQMSG MPENLINAVF SDDVLKKKHN SEVLTINSET
351 AWVVRAKEVR EEKNLLFEEA KDAVRQAYIR TEAAKLAENK AKEVLTQLNG
401 GKAVDVKWSE VSVLGAQQAR QSMPPEAYAE LLKAKPANGK PAYVRLTGLP
451 APVIVEAQAV TPPEDIAAQL PPAKQALAQQ QSANTFDLLI RYFNGKIKQT
501 KGAQSVDNGD GQ*
```

The following partial DNA sequence was identified in *N. meningitidis* <SEQ ID 835>:

m230-1.seq

```
  1 ATGTTCCATT CCATCGAAAA ATACAGAACG CCCGCCCAAG TCCTTTTGGG
 51 CCTGATTGCA TTAACCTTCG TCGGCTTCGG GGTCAGCACG GTATCCCATC
101 CGGGTGCCGA CTACATCGTC CAAGTGGGCG ACGAAAAAAT CAGCGACCAC
151 TCCATCAACA ACGCCATACA GAACGAACAG GCGGACGGCG GCGGCCCTTC
201 GCGCGACGCG GTGTTCCAAT CCCTGCTGCA ACGCGCCTAC CTGAAACAGG
251 GCGCGAAGCT GATGGGCATT TCGGTTTCTT CCGAACAAAT CAAGCAAATT
301 ATCGTGGACG ATCCCAATTT CCACGACGCA AACGGCAAAT TCGACCACGC
```

-continued

```
 351 GCTTTTAAAC CGCTACCTTT CCCAACGCCA TATGTCTGAA GACCAGTTTG
 401 TCGAAGAAAT CCGCGATCAG TTTGCCTTGC AGAATTTGGT AAACCTCGTC
 451 CAAAACGGCG TATTGGTCGG CGACGCGCAG GCGGAACAGC TGATCAGGCT
 501 GACACAGGTC AACCGCACCA TCCGTTCGCA CACTTTCAAC CCCGACGAGT
 551 TCATCGCCCA AGTCAAAGTG TCTGAAGCCG ATTTGCAGAA ATTTTATAAT
 601 GCGAACAAAA AAGACTATCT GCTGCCGCAG GCGGTCAAAT TGGAATATGT
 651 CGCCTTGAAT CTGAAGGATT TTGCAGACAA GCAGACCGTC AGTGAAACGG
 701 AAGTGAAAAA TGCATTTGAA GAGCGCGTGG CGCGTTTGCC GGCAAATGAA
 751 GCCAAACCTT CTTTCGAGCA GGAAAAAGCC GCCGTCGAAA ACGAATTGAA
 801 AATGAAAAAG GCGGTTGCCG ACTTCAACAA GGCAAAAGAA AAATTGGGCG
 851 ACGATGCGTT CAACCATCCT TCCTCGCTTG CCGAAGCCGC CAAAAACAGC
 901 GGTTTGAAAG TCGAAACCCA AGAAACTTGG CTGAGTAGGC AGGACGCGCA
 951 AATGTCCGGT ATGCCCGAAA ACCTGATCAA TGCCGTATTC AGCGACGACG
1001 TATTGAAGAA AAAACACAAT TCCGAAGTGC TGACCATCAA CAGCGAAACC
1051 GCGTGGGTCG TCCGCGCCAA AGAAGTCCGC GAAGAGAAAA CCCTGCCGTT
1101 TGCCGAAGCC AAAGACGCGG TACGTCAGGC TTATATCCGT ACCGAAGCCG
1151 CCAAACTTGC CGAAAACAAG GCAAAAGACG TGCTTACCCA ACTGAACGGC
1201 GGCAAGGCTG TTGACGTGAA ATGGTCGGAA GTGTCCGTTT TGGGCGCACA
1251 GCAGGCAAGG CAGTCCATGC CGCCCGAGGC TTATGCGGAA CTGCTGAAAG
1301 CAAAACCGGC AAACGGCAAA CCCGCCTACG TCAGGCTGAT CGGTCTGCCG
1351 GCACCCGTGA TTGTCGAAGT ACAGGCTGTA ACCCCGCCGG ATGATATCGC
1401 CGCACAGCTT CCGCTTGCAA AACAGGCTTT GGCGCAACAG CAGTCTGCCA
1451 ATACTTTCGA CTTGTTGATA CGTTATTTCA ACGGCAAAAT CAAACAGACC
1501 AAAGGAGCGC AATCGGTCGA CAACGGCGAC GGTCAGTAA
```

This corresponds to the amino acid sequence <SEQ ID 836; ORF 230-1>:

m230-1.pep

```
  1 MFHSIEKYRT PAQVLLGLIA LTFVGFGVST VSHPGADYIV QVGDEKISDH
 51 SINNAIQNEQ ADGGGPSRDA VFQSLLQRAY LKQGAKLMGI SVSSEQIKQI
101 IVDDPNFHDA NGKFDHALLN RYLSQRHMSE DQFVEEIRDQ FALQNLVNLV
151 QNGVLVGDAQ AEQLIRLTQV NRTIRSHTFN PDEFIAQVKV SEADLQKFYN
201 ANKKDYLLPQ AVKLEYVALN LKDFADKQTV SETEVKNAFE ERVARLPANE
251 AKPSFEQEKA AVENELKMKK AVADFNKAKE KLGDDAFNHP SSLAEAAKNS
301 GLKVETQETW LSRQDAQMSG MPENLINAVF SDDVLKKKHN SEVLTINSET
351 AWVVRAKEVR EEKTLPFAEA KDAVRQAYIR TEAAKLAENK AKDVLTQLNG
401 GKAVDVKWSE VSVLGAQQAR QSMPPEAYAE LLKAKPANGK PAYVRLIGLP
451 APVIVEVQAV TPPDDIAAQL PLAKQALAQQ QSANTFDLLI RYFNGKIKQT
501 KGAQSVDNGD GQ*
```

m230-1/g230-1 96.3% identity in 512 aa overlap

```
                    10        20        30        40        50        60
m230-1.pep  MFHSIEKYRTPAQVLLGLIALTFVGFGVSTVSHPGADYIVQVGDEKISDHSINNAIQNEQ
            |||||||||||||||||||||||||||||||||||||||||||||||||:||||||:|||
g230-1      MFHSIEKYRTPAQVLLGLIALTFVGFGVSTVSHPGADYIVQVGDEKISEHSINNAMQNEQ
                    10        20        30        40        50        60

                    70        80        90       100       110       120
m230-1.pep  ADGGGPSRDAVFQSLLQRAYLKQGAKLMGISVSSEQIKQIIVDDPNFHDANGKFDHALLN
            ||||:| ||||||||||||||||||||||||||||||||:||||||||||||||:||||:
g230-1      ADGGSPWRDAVFQSLLQRAYLKQGAKLMGISVSSEQIKQMIVDDPNFHDANGKFSHALLS
                    70        80        90       100       110       120

                   130       140       150       160       170       180
m230-1.pep  RYLSQRHMSEDQFVEEIRDQFALQNLVNLVQNGVLVGDAQAEQLIRLTQVNRTIRSHTFN
            :||||||||||||||||||||||||||:||||||||||||||||||||||||||||||||
g230-1      QYLSQRHMSEDQFVEEIRDQFALQNLVSLVQNGVLVGDAQAEQLIRLTQVNRTIRSHTFN
                   130       140       150       160       170       180

                   190       200       210       220       230       240
m230-1.pep  PDEFIAQVKVSEADLQKFYNANKKDYLLPQAVKLEYVALNLKDFADKQTVSETEVKNAFE
            |||||||||:||||||||||||||||||||||||||||||||||||||||||||||||||
g230-1      PDEFIAQVKASEADLQKFYNANKKDYLLPQAVKLEYVALNLKDFADKQTVSETEVKNAFE
                   190       200       210       220       230       240

                   250       260       270       280       290       300
m230-1.pep  ERVARLPANEAKPSFEQEKAAVENELKMKKAVADFNKAKEKLGDDAFNHPSSLAEAAKNS
            ||||||||:|||||||||||||||||||||||||||||||||||||||||||||||||||
g230-1      ERVARLPAHEAKPSFEQEKAAVENELKMKKAVADFNKAKEKLGDDAFNHPSSLAEAAKNS
                   250       260       270       280       290       300

                   310       320       330       340       350       360
m230-1.pep  GLKVETQETWLSRQDAQMSGMPENLINAVFSDDVLKKKHNSEVLTINSETAWVVRAKEVR
            ||||||||||||||||||||||||||||||||||||||||||||||||||||||||||||
g230-1      GLKVETQETWLSRQDAQMSGMPENLINAVFSDDVLKKKHNSEVLTINSETAWVVRAKEVR
                   310       320       330       340       350       360

                   370       380       390       400       410       420
m230-1.pep  EEKTLPFAEAKDAVRQAYIRTEAAKLAENKAKDVLTQLNGGKAVDVKWSEVSVLGAQQAR
            |||:| | ||||||||||||||||||||||||:|||||||||||||||||||||||||||
g230-1      EEKNLLFEEAKDAVRQAYIRTEAAKLAENKAKEVLTQLNGGKAVDVKWSEVSVLGAQQAR
                   370       380       390       400       410       420

                   430       440       450       460       470       480
m230-1.pep  QSMPPEAYAELLKAKPANGKPAYVRLIGLPAPVIVEVQAVTPPDDIAAQLPLAKQALAQQ
            |||||||||||||||||||||||||| |||||||||:|||||||:|||||| ||||||||
g230-1      QSMPPEAYAELLKAKPANGKPAYVRLTGLPAPVIVEAQAVTPPEDIAAQLPPAKQALAQQ
                   430       440       450       460       470       480

                   490       500       510
m230-1.pep  QSANTFDLLIRYFNGKIKQTKGAQSVDNGDGQX
            |||||||||||||||||||||||||||||||||
g230-1      QSANTFDLLIRYFNGKIKQTKGAQSVDNGDGQX
                   490       500       510
```

The following partial DNA sequence was identified in *N. meningitidis* <SEQ ID 837>:

a230-1.seq

```
  1 ATGTTCCATT CCATCGAAAA ATACAGAACG CCCGCCCAAG TCCTTTTGGG
 51 CCTGATTGCA TTAACCTTCG TCGGCTTCGG GGTCAGCACG GTATCCCATC
101 CGGGTGCCGA CTACATCGTC CAAGTGGGCG ACGAAAAAAT CAGCGACCAC
151 TCCATCAACA ACGCCATACA GAACGAACAG GCGGACGGCG GCGGCCCTTC
201 GCGCGACGCG GTGTTCCAAT CCCTGCTACA ACGCGCCTAC CTGAAACAGG
251 GCGCGAAGCT GATGGGCATT TCGGTTTCTT CCGAACAAAT CAAGCAGATT
301 ATCGTGGACG ATCCCAATTT CCACGACGCA AACGGCAAAT TCGACCACGC
351 GCTTTTAAAC CGCTACCTTT CCCAACGTCA TATGTCTGAA GACCAGTTTG
401 TCGAAGAAAT CCGCGATCAG TTTGCCTTGC AGAATTTGGT AAACCTCGTC
451 CAAAACGGCG TATTGGTCGG CGACGCGCAG GCGGAACAGC TGATCAGGCT
501 GACGCAGGTC AACCGCACCA TCCGTTCGCA CACTTTCAAC CCCGACGAAT
551 TCATCGCCCA AGTCAAAGTG TCTGAAGCCG ATTTGCAGAA GTTTTATAAC
601 GCAAACAAAA AAGACTACCT GCTTCCCAAA GCGGTCAAAT TGGAATATGT
```

-continued

```
 651 CGCCTTGAAT CTGAAAGACT TTGCAGACAA ACAGACCGTC AGCGAAACAG
 701 AAGTGAAAAA TGCGTTTGAA GAGCGCGTGG CGCGTTTGCC GGCAAATGAA
 751 GCCAAACCTT CTTTCGAGCA GGAAAAAGCC GCCGTCGAAA ACGAATTGAA
 801 AATGAAAAAG GCGGTTGCCG ACTTCAATAA GGCAAAAGAA AAGCTGGGCG
 851 ATGACGCGTT CAACCATCCT TCCTCGCTTG CCGAAGCCGC CAAAAACAGC
 901 GGTTTGAAAG TCGAAACCCA AGAAACTTGG CTGAGCAGGC AGGATGCGCA
 951 AATGTCCGGT ATGCCCGAAA ACCTGATCAA TGCCGTATTC AGCGACGACG
1001 TATTGAAGAA AAAACACAAT TCCGAAGTGC TGACCATCAA CAGCGAAACC
1051 GCGTGGGTCG TCCGCGCCAA AGAAGTCCGC GAAGAGAAAA CCCTGCCGTT
1101 TGCCGAAGCC AAAGACGCGG TACGTCAGGC TTATATCCGT ACCGAAGCCG
1151 CCAAACTTGC CGAAAACAAG GCAAAAGACG TGCTTACCCA ACTGAACGGC
1201 GGCAAGGCTG TTGACGTGAA ATGGTCGGAA GTGTCCGTTT TGGGCGCACA
1251 GCAGGCAAGG CAGTCCATGC CGCCCGAGGC TTATGCGGAA CTGCTGAAAG
1301 CAAAACCGGC AAACGGCAAA CCCGCCTACG TCAGGCTGAT CGGTCTGCCG
1351 GCACCCGTGA TTGTCGAAGT ACAGGCTGTA ACCCCGCCGG ATGATATCGC
1401 CGCACAGCTT CCGCTTGCAA AACAGGCTTT GGCGCAACAG CAGTCTGCCA
1451 ATACTTTCGA CTTGTTGATA CGTTATTTCA ACGGCAAAAT CAAACAGACC
1501 AAAGGAGCGC AATCGGTCGA CAACGGCGAC GGTCAGTAA
```

This corresponds to the amino acid sequence <SEQ ID 838; ORF 230-1.a>:

a230-1.pep

```
  1 MFHSIEKYRT PAQVLLGLIA LTFVGFGVST VSHPGADYIV QVGDEKISDH
 51 SINNAIQNEQ ADGGGPSRDA VFQSLLQRAY LKQGAKLMGI SVSSEQIKQI
101 IVDDPNFHDA NGKFDHALLN RYLSQRHMSE DQFVEEIRDQ FALQNLVNLV
151 QNGVLVGDAQ AEQLIRLTQV NRTIRSHTFN PDEFIAQVKV SEADLQKFYN
201 ANKKDYLLPK AVKLEYVALN LKDFADKQTV SETEVKNAFE ERVARLPANE
251 AKPSFEQEKA AVENELKMKK AVADFNKAKE KLGDDAFNHP SSLAEAAKNS
301 GLKVETQETW LSRQDAQMSG MPENLINAVF SDDVLKKKHN SEVLTINSET
351 AWVVRAKEVR EEKTLPFAEA KDAVRQAYIR TEAAKLAENK AKDVLTQLNG
401 GKAVDVKWSE VSVLGAQQAR QSMPPEAYAE LLKAKPANGK PAYVRLIGLP
451 APVIVEVQAV TPPDDIAAQL PLAKQALAQQ QSANTFDLLI RYFNGKIKQT
501      KGAQSVDNGD GQ*
```

a230-1/m230-1 99.8% identity in 512 aa overlap

```
                    10        20        30        40        50        60
a230-1.pep  MFHSIEKYRTPAQVLLGLIALTFVGFGVSTVSHPGADYIVQVGDEKISDHSINNAIQNEQ
            ||||||||||||||||||||||||||||||||||||||||||||||||||||||||||||
m230-1      MFHSIEKYRTPAQVLLGLIALTFVGFGVSTVSHPGADYIVQVGDEKISDHSINNAIQNEQ
                    10        20        30        40        50        60
```

-continued

```
               70         80         90        100        110        120
a230-1.pep  ADGGGPSRDAVFQSLLQRAYLKQGAKLMGISVSSEQIKQIIVDDPNFHDANGKFDHALLN
            ||||||||||||||||||||||||||||||||||||||||||||||||||||||||||||
m230-1      ADGGGPSRDAVFQSLLQRAYLKQGAKLMGISVSSEQIKQIIVDDPNFHDANGKFDHALLN
               70         80         90        100        110        120

              130        140        150        160        170        180
a230-1.pep  RYLSQRHMSEDQFVEEIRDQFALQNLVNLVQNGVLVGDAQAEQLIRLTQVNRTIRSHTFN
            ||||||||||||||||||||||||||||||||||||||||||||||||||||||||||||
m230-1      RYLSQRHMSEDQFVEEIRDQFALQNLVNLVQNGVLVGDAQAEQLIRLTQVNRTIRSHTFN
              130        140        150        160        170        180

              190        200        210        220        230        240
a230-1.pep  PDEFIAQVKVSEADLQKFYNANKKDYLLPKAVKLEYVALNLKDFADKQTVSETEVKNAFE
            ||||||||||||||||||||||||||||:|||||||||||||||||||||||||||||||
m230-1      PDEFIAQVKVSEADLQKFYNANKKDYLLPQAVKLEYVALNLKDFADKQTVSETEVKNAFE
              190        200        210        220        230        240

              250        260        270        280        290        300
a230-1.pep  ERVARLPANEAKPSFEQEKAAVENELKMKKAVADFNKAKEKLGDDAFNHPSSLAEAAKNS
            ||||||||||||||||||||||||||||||||||||||||||||||||||||||||||||
m230-1      ERVARLPANEAKPSFEQEKAAVENELKMKKAVADFNKAKEKLGDDAFNHPSSLAEAAKNS
              250        260        270        280        290        300

              310        320        330        340        350        360
a230-1.pep  GLKVETQETWLSRQDAQMSGMPENLINAVFSDDVLKKKHNSEVLTINSETAWVVRAKEVR
            ||||||||||||||||||||||||||||||||||||||||||||||||||||||||||||
m230-1      GLKVETQETWLSRQDAQMSGMPENLINAVFSDDVLKKKHNSEVLTINSETAWVVRAKEVR
              310        320        330        340        350        360

              370        380        390        400        410        420
a230-1.pep  EEKTLPFAEAKDAVRQAYIRTEAAKLAENKAKDVLTQLNGGKAVDVKWSEVSVLGAQQAR
            ||||||||||||||||||||||||||||||||||||||||||||||||||||||||||||
m230-1      EEKTLPFAEAKDAVRQAYIRTEAAKLAENKAKDVLTQLNGGKAVDVKWSEVSVLGAQQAR
              370        380        390        400        410        420

              430        440        450        460        470        480
a230-1.pep  QSMPPEAYAELLKAKPANGKPAYVRLIGLPAPVIVEVQAVTPPDDIAAQLPLAKQALAQQ
            ||||||||||||||||||||||||||||||||||||||||||||||||||||||||||||
m230-1      QSMPPEAYAELLKAKPANGKPAYVRLIGLPAPVIVEVQAVTPPDDIAAQLPLAKQALAQQ
              430        440        450        460        470        480

              490        500        510
a230-1.pep  QSANTFDLLIRYFNGKIKQTKGAQSVDNGDGQX
            |||||||||||||||||||||||||||||||||
m230-1      QSANTFDLLIRYFNGKIKQTKGAQSVDNGDGQX
              490        500        510
```

The following partial DNA sequence was identified in *N. gonorrhoeae* <SEQ ID 839>:

g231.seq

```
  1 atgtcaaaac gaaaatccat aaaccgtccg tatcaaaaac cggcggaact
 51 gccgccgttg caaaataatc cgccatttta ccgtaaaaac cgccgcctga
101 actttttat cgcggcagac ggcggttgcg cgtctccgca aaaatgcagg
151 gcgcgcggtt ttcagacggc atttgccgtt caaggccgtg cggtgtcttt
201 accaaatgcc caaccattcg cccacggaat ccatccaatc cttattgccc
251 ccgccgctcc tgcctgcccg gcggtacgcc cacggcgctt gcggattttt
301 agctttccac aatcctttgc gttccctttc cgcctgaatt tgagcgtcgg
351 catagtcggc aaaatccgcc ttatcctgct gttctttagc ataactttta
401 taatgccacg ccgccccgtc ctgcacctgc atcaggttca aatcggtttt
451 gccggcggat acctgcgcca cttcgcgctg atagcggtcg gtttcaaaca
501 cacgtacact gactttccta ccctccgccg ccgcgcgcag gttgtcgcgc
551 gaacgtgtac cgtaagcctg tttcatctcc ggtgcgtcga tatacgccat
601 ccgaatttta tgtttcgcgc cgtcgccgtc gatgacgtga agggtatcgc
651 cgtcatagac tttggacacc gtgcctgtgt agctgtggcc ggatttcgcc
701 gatgcccgtc ggcgaacggg cgcgtcgaaa cccacgtccc ctgcagtgcc
751 gagtacgtcg agtacggcaa ccgccgtccg caccgcctca ctgtcatatc
```

-continued

```
801 ccgtataacc caacgcgccc aaaagcgaca gggcgacggg aagccatttc

851 atgatttttt taatctgcat atttttcaaa tgccgatgcc gtctgaacat

901 ctctga
```

This corresponds to the amino acid sequence <SEQ ID 840; ORF 231.ng>:

g231.pep

```
  1 MSKRKSINRP YQKPAELPPL QNNPPFYRKN RRLNFFIAAD GGCASPQKCR

 51 ARGFQTAFAV QGRAVSLPNA QPFAHGIHPI LIAPAAPACP AVRPRRLRIF

101 SFPQSFAFPF RLNLSVGIVG KIRLILLFFS ITFIMPRRPV LHLHQVQIGF

151 AGGYLRHFAL IAVGFKHTYT DFPTLRRRAQ VVARTCTVSL FHLRCVDIRH

201 PNFMFRAVAV DDVKGIAVID FGHRACVAVA GFRRCPSANG RVETHVPCSA

251 EYVEYGNRRP HRLTVISRIT QRAQKRQGDG KPFHDFFNLH IFQMPMPSEH

301 L*
```

The following partial DNA sequence was identified in *N. meningitidis* <SEQ ID 841>:

m231.seq (partial)

```
  1 ATGTCAAAAC GAAAATCCAT AAACCGTCCG TATCAAAAAC CGGCGGAACT

 51 GCCGCCGTTG CAAAATAATC CGCCATTTTA CCGTAAAAAC CGCCGCCTGA

101 ACTTTTTTAT CGCGGCAGAC GGCGGTTGCG CGTCTCCGCA AAAATGCAGG

151 GCGCGCGGTT TTCAGACGGC ATTTGCCGTT CAAAGCCGTG CGGTGTCTTT

201 ACCAAATGCC CAACCATTCG GC....
```

This corresponds to the amino acid sequence <SEQ ID 842; ORF 231>:

m231.pep (partial)

```
 1 MSKRKSINRP YQKPAELPPL QNNPPFYRKN RRLNFFIAAD GGCASPQKCR

51 ARGFQTAFAV QSRAVSLPNA QPFG.....
```

Computer analysis of this amino acid sequence gave the following results:

Homology with a predicted ORF from *N. gonorrhoeae*

ORF 231 shows 98.6% identity over a 73 aa overlap with a predicted ORF (ORF 231.ng) from *N. gonorrhoeae*:

m231/g231

```
                    10        20        30        40        50        60
m231.pep    MSKRKSINRPYQKPAELPPLQNNPPFYRKNRRLNFFIAADGGCASPQKCRARGFQTAFAV
            ||||||||||||||||||||||||||||||||||||||||||||||||||||||||||||
g231        MSKRKSINRPYQKPAELPPLQNNPPFYRKNRRLNFFIAADGGCASPQKCRARGFQTAFAV
                    10        20        30        40        50        60
```

-continued

```
                   70
m231.pep      QSRAVSLPNAQPFG
              |:|||||||||||:
g231          QGRAVSLPNAQPFAHGIHPILIAPAAPACPAVRPRRLRIFSFPQSFAFPPFRLNLSVGIVG
                   70         80         90        100        110        120
```

The following partial DNA sequence was identified in *N. meningitidis* <SEQ ID 843>:

a231.seq (partial)

```
  1 ATGTCAAAAC GAAAATCCAT AAACCGTCCG TATCAAAAAC CGGCGGAACT
 51 GCCGCCGTTG CAAAATAATC CGCCATTTTA CCGTAAAAAC CGCCGCCTGA
101 ACTTTTTTAT CGNGGCAGAC GGCGGTTGCG CGTCTCCGCA AAAATGCAGG
151 GCGCGCGGTT TTCAGACGGC ATTTGCCGTT CAAAGCCGTG CGGTGTCTTT
201 ACCAAATGCC CAACCATTCG CCCACGGCAT CCATCCAATC CTTATTGCCC
251 CCGCCGCTCC TGCCTGCCCG GCGGTACGCC CACGGCGCTT GCGGATTTTT
301 AGCTTTCCAC AATCCTTTGC GTTCCCTTTC CGCCTGAATT TGAGCGTCGG
351 CATAATCGGC AAAATCCGCC TTATCCTGCT GTTCTTTAGC ATAACTTTTA
401 TAATGCCACG CCGCCCCGTC CTGCACCTGC ATCAGGTTCA AATCGGTTTT
451 GCCGACAGAA ACCTGCGCCA CTTCGCGCTG GTAGCGGTCG GTGTCGAACA
501 CGCGGACGCT GACTTTCCTG CCTTCCGCCG CCGCGCGCAG GTTGTCGCGC
551 GAACGCGTGC CGTAAGCCTG TTTCATCTCC GGCGCGTCGA TATACGCCAT
601 CCGGATTTTG TGTTTCGCGC CGTCGCCGTC GATAACGTGA AGGGTGTCGC
651 CGTCATAGAC TTTGGACACC GTGCCTGTGT AGCGGTGGCC GGATTTCGCC
701 GATGCTCGGC GGCGGGCGGG CGCGTCGGAA CCCGCGTCCC CTGCCGCGCC
751 GAGTACGTCG AGTACGGCAA CCGCCGTCCG CACCGCCTCG CTGCCGTACC
801 CCGTATAACC CAACGCACCC AAAAGCGACA AGGCGACGGG AAGCCATTTC
851 ATGATTTTTT TAATCTGCAT ATTTTTCAAA TGCCGATGCC GTCTGAACAT
901 ATC
```

This corresponds to the amino acid sequence <SEQ ID 844; ORF 217.a>:

a231.pep (partial)

```
  1 MSKRKSINRP YQKPAELPPL QNNPPFYRKN RRLNFFIXAD GGCASPQKCR
 51 ARGFQTAFAV QSRAVSLPNA QPFAHGIHPI LIAPAAPACP AVRPRRLRIF
101 SFPQSFAFPF RLNLSVGIIG KIRLILLFFS ITFIMPRRPV LHLHQVQIGF
151 ADRNLRHFAL VAVGVEHADA DFPAFRRRAQ VVARTRAVSL FHLRRVDIRH
201 PDFVFRAVAV DNVKGVAVID FGHRACVAVA GFRRCSAAGG RVGTRVPCRA
251 EYVEYGNRRP HRLAAVPRIT QRTQKRQGDG KPFHDFFNLH IFQMPMPSEH
301 I
```

m231/a231 98.6% identity in 73 aa overlap

```
                    10        20        30        40        50        60
m231.pep      MSKRKSINRPYQKPAELPPLQNNPPFYRKNRRLNFFIAADGGCASPQKCRARGFQTAFAV
              |||||||||||||||||||||||||||||||||||||| |||||||||||||||||||||
a231          MSKRKSINRPYQKPAELPPLQNNPPFYRKNRRLNFFIXADGGCASPQKCRARGFQTAFAV
                    10        20        30        40        50        60

                    70
m231.pep      QSRAVSLPNAQPFG
              |||||||||||||:
a231          QSRAVSLPNAQPFAHGIHPILIAPAAPACPAVRPRRLRIFSFPQSFAFPFRLNLSVGIIG
                    70        80        90       100       110       120
```

The following partial DNA sequence was identified in *N. gonorrhoeae* <SEQ ID 845>:

g231-1.seq

```
  1 ATGTCAAAAC GAAAATCCAT AAACCGTCCG TATCAAAAAC CGGCGGAACT
 51 GCCGCCGTTG CAAAATAATC CGCCATTTTA CCGTAAAAAC CGCCGcCTGA
101 ACTTTTTTAT CGCGGCAGAC GGCGGTTGCG CGTCTCCGCA AAAATGCAGG
151 GCGCGCGGTT TTCAGACGGC ATTTGCCGTT CAAGGCCGTG CGGTGTCTTT
201 ACCAAATGCC CAACCATTCG CCCACGGAAT CCATCCAATC CTTATTGCCC
251 CCGCCGCTCC TGCCTGCCCG GCGGTACGCC CACGGCGCTT GCGGATTTTT
301 AGCTTTCCAC AATCCTTTGC GTTCCCTTTC CGCCTGAATT TGAGCGTCGG
351 CATAGTCGGC AAAATCCGCC TTATCCTGCT GTTCTTTAGC ATAACTTTTA
401 TAATGCCACG CCGCCCCGTC CTGCACCTGC ATCAGGTTCA AATCGGTTTT
451 GCCGGCGGAT ACCTGCGCCA CTTCGCGCTG ATAGCGGTCG GTTTCAAACa
501 CaCgTaCaat gagtttcgtA ccctccGCCG ccgcgcgCAG GTTGtcgcGC
551 GAACgTGTAC CGTAagcgtg TTtcatctcc GGTGCgtcgA TATACGCCaT
601 cCgAATTTta tGTttcgcgc cgtcgcCgtc gATGACGTGA AGGGtatcGC
651 CgtcATAGAC TTTGGACACC Gtgcctgcgt AGctGTGGCC GGATttcgc
```

This corresponds to the amino acid sequence <SEQ ID 846; ORF 231-1.ng>:

g231-1.pep

```
  1 MSKRKSINRP YQKPAELPPL QNNPPFYRKN RRLNFFIAAD GGCASPQKCR
 51 ARGFQTAFAV QGRAVSLPNA QPFAHGIHPI LIAPAAPACP AVRPRRLRIF
101 SFPQSFAFPF RLNLSVGIVG KIRLILLFFS ITFIMPRRPV LHLHQVQIGF
151 AGGYLRHFAL IAVGFKHTYN EFRTLRRRAQ VVARTCTVSV FHLRCVDIRH
201 PNFMFRAVAV DDVKGIAVID FGHRACVAVA GFR
```

The following partial DNA sequence was identified in *N. meningitidis* <SEQ ID 847>:

m231-1.seq

```
  1 ATGTCAAAAC GAAAATCCAT AAACCGTCCG TATCAAAAAC CGGCGGAACT
 51 GCCGCCGTTG CAAAATAATC CGCCATTTTA CCGTAAAAAC CGCCGCCTGA
101 ACTTTTTTAT CGCGGCAGAC GGCGGTTGCG CGTCTCCGCA AAAATGCAGG
```

-continued

```
151 GCGCGCGGTT TTCAGACGGC ATTTGCCGTT CAAAGCCGTG CGGTGTCTTT
201 ACCAAATGCC CAACCATTCG CCCACGGCAT CCATCCAATC CTTATTGCCC
251 CCGCCGCTCC TGCCTGCTCG GCGGTACGCC CACGGCGCTT GCGGATTTTT
301 AGCTTTCCAC AATCCTTTGC GTTCCCTTTC CGCCTGAATT TGAGCGTCGG
351 CATAATCGGC AAAATCCGCC TTATCCTGCT GTTCTTTAGC ATAACTTTTA
401 TAATGCCACG CCGCCCCGTC CTGCACCTGC ATCAGGTTCA AATCGGTTTT
451 GCCGACAGAA ACCTGCGCCA CTTCGCGCTG GTAGCGGTCG GTATCGAACA
501 CGCGCACGCT GACTTTCCTG CCTTCCGCCG CCGCGCGCAG GTTGTCGCGC
551 GAACGCGTGC CGTAAGCCTG TTTCATCTCC GGCGCGTCGA TATACGCCAT
601 CCGGATTTTG TGTTTCGCGC CGTCGCCGTC GATAACGTGA AGGGTGTCGC
651 CGTCATAGAC TTTGGACACC GTGCCTGTGT AGCGGTGGCC GGATTTCGCC
701 GATGCTCGGC GGCGGGCGGG CGCGTCGGAA CCCGCGTCCC CTGCCGCGCC
751 GAGTACGTCG AGTACGGCAA CCGCCGTCCG CACCGCCTCG CTGCCGTACC
801 CCGTATAACC CAACGCACCC AAAAGCGACA GGGCGACGGG AAGCCATTTC
851 ATGATTTTTT TAATCTGCAT ATTTTTCAAA TGCCGATGCC GTCTGAACAT
901 ATCGGAATCG GATTTCAGAC GGCATCTTAA
```

This corresponds to the amino acid sequence <SEQ ID 848; ORF 231-1>:

m231-1.pep

```
  1 MSKRKSINRP YQKPAELPPL QNNPPFYRKN RRLNFFIAAD GGCASPQKCR
 51 ARGFQTAFAV QSRAVSLPNA QPFAHGIHPI LIAPAAPACS AVRPRRLRIF
101 SFPQSFAFPF RLNLSVGIIG KIRLILLFFS ITFIMPRRPV LHLHQVQIGF
151 ADRNLRHFAL VAVGIEHAHA DFPAFRRRAQ VVARTRAVSL FHLRRVDIRH
201 PDFVFRAVAV DNVKGVAVID FGHRACVAVA GFRRCSAAGG RVGTRVPCRA
251 EYVEYGNRRP HRLAAVPRIT QRTQKRQGDG KPFHDFFNLH IFQMPMPSEH
301 IGIGFQTAS*
```

g231-1/m231-1 87.0% identity in 262 aa overlap

```
                       10        20        30        40        50        60
g231-1.pep  MSKRKSINRPYQKPAELPPLQNNPPFYRKNRRLNFFIAADGGCASPQKCRARGFQTAFAV
            ||||||||||||||||||||||||||||||||||||||||||||||||||||||||||||
m231-1      MSKRKSINRPYQKPAELPPLQNNPPFYRKNRRLNFFIAADGGCASPQKCRARGFQTAFAV
                       10        20        30        40        50        60

                       70        80        90       100       110       120
g231-1.pep  QGRAVSLPNAQPFAHGIHPILIAPAAPACPAVRPRRLRIFSFPQSFAFPFRLNLSVGIVG
            |:||||||||||||||||||||||||||| ||||||||||||||||||||||||||||:|
m231-1      QSRAVSLPNAQPFAHGIHPILIAPAAPACSAVRPRRLRIFSFPQSFAFPFRLNLSVGIIG
                       70        80        90       100       110       120

                      130       140       150       160       170       180
g231-1.pep  KIRLILLFFSITFIMPRRPVLHLHQVQIGFAGGYLRHFALIAVGFKHTYNEFRTLRRRAQ
            |||||||||||||||||||||||||||||||   ||||||:|||::|:: :| ::|||||
m231-1      KIRLILLFFSITFIMPRRPVLHLHQVQIGFADRNLRHFALVAVGIEHAHADFPAFRRRAQ
                      130       140       150       160       170       180

                      190       200       210       220       230       240
g231-1.pep  VVARTCTVSVFHLRCVDIRHPNFMFRAVAVDDVKGIAVIDFGHRACVAVAGFRXCPSANG
            ||||| :||:|||| ||||||:|:|||||||:|||:||||||||||||||||| | :|:|
m231-1      VVARTRAVSLFHLRRVDIRHPDFVFRAVAVDNVKGVAVIDFGHRACVAVAGFRRCSAAGG
                      190       200       210       220       230       240
```

-continued

```
                  250       260
g231-1.pep   CVETHVPCSAEYVVXGNRRPHR
              | |:||| ||||  |||||||
m231-1       RVGTRVPCRAEYVEYGNRRPHRLAAVPRITQRTQKRQGDGKPFHDFFNLHIFQMPMPSEH
                  250       260       270       280       290       300
```

The following partial DNA sequence was identified in *N. meningitidis* <SEQ ID 849>:

a231-1.seq

```
  1 ATGTCAAAAC GAAAATCCAT AAACCGTCCG TATCAAAAAC CGGCGGAACT
 51 GCCGCCGTTG CAAAATAATC CGCCATTTTA CCGTAAAAAC CGCCGCCTGA
101 ACTTTTTTAT CGCGGCAGAC GGCGGTTGCG CGTCTCCGCA AAAATGCAGG
151 GCGCGCGGTT TTCAGACGGC ATTTGCCGTT CAAAGCCGTG CGGTGTCTTT
201 ACCAAATGCC CAACCATTCG CCCACGGCAT CCATCCAATC CTTATTGCCC
251 CCGCCGCTCC TGCCTGCCCG GCGGTACGCC CACGGCGCTT GCGGATTTTT
301 AGCTTTCCAC AATCCTTTGC GTTCCCTTTC CGCCTGAATT TGAGCGTCGG
351 CATAATCGGC AAAATCCGCC TTATCCTGCT GTTCTTTAGC ATAACTTTTA
401 TAATGCCACG CCGCCCCGTC CTGCACCTGC ATCAGGTTCA AATCGGTTTT
451 GCCGACAGAA ACCTGCGCCA CTTCGCGCTG GTAGCGGTCG GTGTCGAACA
501 CGCGGACGCT GACTTTCCTG CCTTCCGCCG CCGCGCGCAG GTTGTCGCGC
551 GAACGCGTGC CGTAAGCCTG TTTCATCTCC GGCGCGTCGA TATACGCCAT
601 CCGGATTTTG TGTTTCGCGC CGTCGCCGTC GATAACGTGA AGGGTGTCGC
651 CGTCATAGAC TTTGGACACC GTGCCTGTGT AGCGGTGGCC GGATTTCGCC
701 GATGCTCGGC GGCGGGCGGG CGCGTCGGAA CCCGCGTCCC CTGCCGCGCC
751 GAGTACGTCG AGTACGGCAA CCGCCGTCCG CACCGCCTCG CTGCCGTACC
801 CCGTATAACC CAACGCACCC AAAAGCGACA AGGCGACGGG AAGCCATTTC
851 ATGATTTTTT TAATCTGCAT ATTTTTCAAA TGCCGATGCC GTCTGAACAT
901 ATCGGAATCG GATTTCAGAC GGCATCTTAA
```

This corresponds to the amino acid sequence <SEQ ID 850; ORF 231-1.a>:

a231-1.pep

```
  1 MSKRKSINRP YQKPAELPPL QNNPPFYRKN RRLNFFIAAD GGCASPQKCR
 51 ARGFQTAFAV QSRAVSLPNA QPFAHGIHPI LIAPAAPACP AVRPRRLRIF
101 SFPQSFAFPF RLNLSVGIIG KIRLILLFFS ITFIMPRRPV LHLHQVQIGF
151 ADRNLRHFAL VAVGVEHADA DFPAFRRRAQ VVARTRAVSL FHLRRVDIRH
201 PDFVFRAVAV DNVKGVAVID FGHRACVAVA GFRRCSAAGG RVGTRVPCRA
251 EYVEYGNRRP HRLAAVPRIT QRTQKRQGDG KPFHDFFNLH IFQMPMPSEH
301 IGIGFQTAS*
```

a231-1/m231-1 99.0% identity in 309 aa overlap

```
                     10        20        30        40        50        60
a231-1.pep   MSKRKSINRPYQKPAELPPLQNNPPFYRKNRRLNFFIAADGGCASPQKCRARGFQTAFAV
             ||||||||||||||||||||||||||||||||||||||||||||||||||||||||||||
m231-1       MSKRKSINRPYQKPAELPPLQNNPPFYRKNRRLNFFIAADGGCASPQKCRARGFQTAFAV
                     10        20        30        40        50        60

                     70        80        90       100       110       120
a231-1.pep   QSRAVSLPNAQPFAHGIHPILIAPAAPACPAVRPRRLRIFSFPQSFAFPFRLNLSVGIIG
             ||||||||||||||||||||||||||||| ||||||||||||||||||||||||||||||
m231-1       QSRAVSLPNAQPFAHGIHPILIAPAAPACSAVRPRRLRIFSFPQSFAFPFRLNLSVGIIG
                     70        80        90       100       110       120

                    130       140       150       160       170       180
a231-1.pep   KIRLILLFFSITFIMPRRPVLHLHQVQIGFADRNLRHFALVAVGVEHADADFPAFRRRAQ
             ||||||||||||||||||||||||||||||||||||||||||||:||| |||||||||||
m231-1       KIRLILLFFSITFIMPRRPVLHLHQVQIGFADRNLRHFALVAVGIEHAHADFPAFRRRAQ
                    130       140       150       160       170       180

                    190       200       210       220       230       240
a231-1.pep   VVARTRAVSLFHLRRVDIRHPDFVFRAVAVDNVKGVAVIDFGHRACVAVAGFRRCSAAGG
             ||||||||||||||||||||||||||||||||||||||||||||||||||||||||||||
m231-1       VVARTRAVSLFHLRRVDIRHPDFVFRAVAVDNVKGVAVIDFGHRACVAVAGFRRCSAAGG
                    190       200       210       220       230       240

                    250       260       270       280       290       300
a231-1.pep   RVGTRVPCRAEYVEYGNRRPHRLAAVPRITQRTQKRQGDGKPFHDFFNLHIFQMPMPSEH
             ||||||||||||||||||||||||||||||||||||||||||||||||||||||||||||
m231-1       RVGTRVPCRAEYVEYGNRRPHRLAAVPRITQRTQKRQGDGKPFHDFFNLHIFQMPMPSEH
                    250       260       270       280       290       300

                    310
a231-1.pep   IGIGFQTASX
             ||||||||||
m231-1       IGIGFQTASX
                    310
```

The following partial DNA sequence was identified in *N. gonorrhoeae* <SEQ ID 851>:

g232.seq

```
  1 atgatgggca acagcctgat tgaatccggt acgtttgtcg ccatcctgtt

 51 tggtcagatt ttgggaacgg cggttgccgg cgcgccgcct tatattgtcg

101 ggatactggt tttgctggtc gccgtcggag gaacggccgg cagcctgttt

151 atgccgtccg tacccgccaa ggctgccgat acccaaatcg agtggaatat

201 tgtccgtggt acaaaatccc tgctgcgtga aacggtgcgg cacaatcccg

251 tttttaccgc cattatcggc atctcgtggt tttggtttgt cggcgcggtt

301 tataccacgc aactgccgac ctttacccaa atccatttgg gcggcaacga

351 taatgttttt aacctgatgc ttgctttgtt ttccatcggt attgccgccg

401 gttcggtact gtgtgccaag ttcggcaggg aacggctgat gttggcttgg

451 gtaacggttg gtgcgttggg ttcgacggtt tgcggcctgg ttttggtgtg

501 gctgacgcac ggacaccgtt ttgaagggct gaacggcatt ttttggtttt

551 tatcgcaagg atgggcatac cccgtgatgg cggtgatgac gctgatcggc

601 tttttcggcg gatttttctc cgttccgctc tatacctggc tgcaaaccgc

651 cagcagcgag actttccgcg cccgcgccgt tgccgccaac aatatcgtta

701 acggcatctt tatggtttcc gccgccgttt tgagcgcggt attgctgttt
```

-continued 751 ttgtttgaca gcatttccct gctgtatctg attgtcgcct tgggcaatat 801 tccgttggcg gtatttttga ttaagcgcga aaggcggttt ttaggcgcgg 851 cggcaatcag gaaaaaacct tga This corresponds to the amino acid sequence <SEQ ID 852; ORF 232.ng>:

g232.pep

1 MMGNSLIESG TFVAILFGQI LGTAVAGAPP YIVGILVLLV AVGGTAGSLF

51 MPSVPAKAAD TQIEWNIVRG TKSLLRETVR HNPVFTAIIG ISWFWFVGAV

101 YTTQLPTFTQ IHLGGNDNVF NLMLALFSIG IAAGSVLCAK FGRERLMLAW

151 VTVGALGSTV CGLVLVWLTH GHRFEGLNGI FWFLSQGWAY PVMAVMTLIG

201 FFGGFFSVPL YTWLQTASSE TFRARAVAAN NIVNGIFMVS AAVLSAVLLF

251 LFDSISLLYL IVALGNIPLA VFLIKRERRF LGAAAIRKKP *

The following partial DNA sequence was identified in *N. meningitidis* <SEQ ID 853>:

m232.seq

1 ATGATGGGCA ACAGCCTGAT TGAATCGGGT ACGTTTGTCG CCATCCTGTT

51 CGGTCAGATT TTGGGAACGG CGGTGGCAGG TGTACCGCCT TATATTGTCG

101 GGATACTGGT TTTGCTGGTC GCCGTCGGAG GCACGGTCGG CAGCCTGTTT

151 ATGCCGTCCG TACCCGCCAA GGCTGCCGAT ACACAAATTG AGTGGAATAT

201 TGTCCGTGGC ACAAAATCCC TGCTGCGTGA AACGGTGCGG CACAAGCCCG

251 TTTTTACCGC CATTATCGGT ATTTCGTGGT TTTGGTTTGT CGGCGCGGTT

301 TATACCACGC AACTGCCGAC CTTTACCCAA ATCCATCTGG GCGGCAACGA

351 CAATGTTTTC AACCTGATGC TTGCTCTGTT TTCCATCGGT ATTGCCGCCG

401 GTTCGGTACT GTGTGCCAAG TTCAGCAkGG AACGCCTGAT GTTGGCTTGG

451 GTAACGGTTG GTGCGTTGGG TTTGACGGTT TGCGGCTTGG TTTTGGTGTG

501 GCTGACGCAC GGACACCGTT TTGAAGGGCT GAACGGCATT TTTTrGTTTT

551 TATCGCAAGG ATGGGCATAT CCCGTGATGG CGGTGATGAC GCTGATCGGC

601 TTTTTCGGCG GATTTTTCTC CGTTCCGCTC TATACCt(g)TG CAAACCGCCa

651 TAGCGAGaTT TCCGCGCCCg GCCGTTGCCG CCAACAATAT CGTTAACGGT

701 ATTTTTATGG TTTCCGCTGC CGTTTTGAGC GCGGTGTTGC TGTTTTTGTT

751 TGACAGCATT TCCTTGTTGT ATCTGATTGT CGCTTTGGGC AATATTCCGT

801 TGTCGGTATT TTTGATTAAG CGCGAAAGGC GGTTTTTAGG CGCGGCGGCA

851 ATCAGGAAAA AACCTTGA

This corresponds to the amino acid sequence <SEQ ID 854; ORF 232>:

m232.pep

```
  1 MMGNSLIESG TFVAILFGQI LGTAVAGVPP YIVGILVLLV AVGGTVGSLF

 51 MPSVPAKAAD TQIEWNIVRG TKSLLRETVR HKPVFTAIIG ISWFWFVGAV

101 YTTQLPTFTQ IHLGGNDNVF NLMLALFSIG IAAGSVLCAK FSXERLMLAW

151 VTVGALGLTV CGLVLVWLTH GHRFEGLNGI FXFLSQGWAY PVMAVMTLIG

201 FFGGFFSVPL YTVQTAIARF PRPAVAANNI VNGIFMVSAA VLSAVLLFLF

251 DSISLLYLIV ALGNIPLSVF LIKRERRFLG AAAIRKKP*
```

Computer analysis of this amino acid sequence gave the following results:

Homology with a predicted ORF from *N. gonorrhoeae*

ORF 232 shows 94.1% identity over a 290 aa overlap with a predicted ORF (ORF 232.ng) from *N. gonorrhoeae*:

m232/g232

```
                  10         20         30         40         50         60
m232.pep  MMGNSLIESGTFVAILFGQILGTAVAGVPPYIVGILVLLVAVGGTVGSLFMPSVPAKAAD
          ||||||||||||||||||||||||||||:|||||||||||||||||:|||||||||||||
g232      MMGNSLIESGTFVAILFGQILGTAVAGAPPYIVGILVLLVAVGGTAGSLFMPSVPAKAAD
                  10         20         30         40         50         60

                  70         80         90        100        110        120
m232.pep  TQIEWNIVRGTKSLLRETVRHKPVFTAIIGISWFWFVGAVYTTQLPTFTWIHLGGNDNVF
          |||||||||||||||||||||||:||||||||||||||||||||||||||||||||||||
g232      TQIEWNIVRGTKSLLRETVRHNPVFTAIIGISWFWFVGAVYTTQLPTFTWIHLGGNDNVF
                  70         80         90        100        110        120

                 130        140        150        160        170        180
m232.pep  NLMLALFSIGIAAGSVLCAKFSXERLMLAWVTVGALGLTVCGLVLVWLTHGHRFEGLNGI
          ||||||||||||||||||||||:|||||||||||||:|||||||||||||||||||||||
g232      NLMLALFSIGIAAGSVLCAKFGRERLMLAWVTVGALGSTVCGLVLVWLTHGHRFEGLNGI
                 130        140        150        160        170        180

                 190        200        210        220        230
m232.pep  FXFLSQGWAYPVMAVMTLIGFFGGFFSVPLYT-VQTAIARFPRP-AVAANNIVNGIFMVS
          | ||||||||||||||||||||||||||||||:||| ::  |  ||||||||||||||||
g232      FWFLSQGWAYPVMAVMTLIGFFGGFFSVPLYTWLQTASSETFRARAVAANNIVNGIFMVS
                 190        200        210        220        230        240

                 240        250        260        270        280        289
m232.pep  AAVLSAVLLFLFDSISLLYLIVALGNIPLSVFLIKRERRFLGAAAIRKKPX
          |||||||||||||||||||||||||||||:||||||||||||||||||||
g232      AAVLSAVLLFLFDSISLLYLIVALGNIPLAVFLIKRERRFLGAAAIRKKP
                 250        260        270        280        290
```

The following partial DNA sequence was identified in *N. meningitidis* <SEQ ID 855>:

a232.seq

```
  1 ATGTACGCTA AAAAAGGCGG TTTGGGACTG GTTAAAAGCC GCCGTTTCGC

 51 ACCTCTTTTC GCTACGCAGT TTCTCGGCGC GTTCAACGAC AATGTGTTCA

101 AAACCGCGCT GTTTGTGATG ATTGGGTTTT ACGGTTTGGG GCAAAACGGC

151 TTCCTGCCTG CCGGACAGAT GTTGAACTTG GGCGCGTTGC TGTTTATTTT

201 GCCGTATTTC CTGTTTTCCT CGCTGTCGGG GCAGTTGGGT AACAAATTCG

251 ACAAGGCCGT TTTGGCGCGT TGGGCCAAGG TGCTGGAAAT GATCATTATG

301 GCGGTGGCGG CATACGGGTT TTATATCCGG TCTGCCCCGC TGCTTTTGGC

351 GTGTCTGTTT TGCATGGGCG CGCAATCGAC GCTGTTCGGG CCGCTGAAAT

401 ACGCCATCCT GCCCGATTAT CTCGACGACA AAGAGTTGAT GATGGGCAAC
```

-continued

```
 451 AGCCTGATTG AATCGGGTAC GTTTGTCGCC ATCCTGTTCG GTCAGATACT

 501 GGGGACTGCG GTGGCAGGTG TACCGCCTTA TATTGTCGGG ATACTGGTTT

 551 TGCTGGTCGC CGTAGGAGGC ACGGTCGGCA GCCTGTTTAT GCCGTCCGTA

 601 CCCGCCAAGG CTGCCGATAC ACAAATTGAG TGGAATATTG TCCGGGGTAC

 651 AAAATCCCTG CTGCGTGAAA CGGTGCGGCA CAAGCCCGTT TTTACCGCCA

 701 TTATCGGTAT TTCGTGGTTT TGGTTTGTCG GCGCGGTTTA TACCACGCAA

 751 CTGCCGACCT TTACCCAAAT CCATCTAGGC GGCAACGACA ATGTTTTCAA

 801 CCTGATGCTT GCCCTGTTTT CCATCGGTAT TGCCGCCGGT TCGGTACTGT

 851 GTGCCAAGTT CAGCAGGGAA CGGCTGAGGT TGGCTTGGGT AACGGTTGGT

 901 GCGTTGGGTT TGACGGTTTG CGGCTTGGTT TTGGTGTGGC TGACGCACGG

 951 ACACCGTTTT GAAGGGCTGA ACGGCATTTT TTGGTTTTTA TCGCAAGGAT

1001 GGGCATATCC CGTGATGGCG GTGATGACGC TGATCGGCTT TTTCGGCGGA

1051 TTTTTCTCCG TTCCGCTCTA TACCTGGCTG CAAACCGCCA GTAGCGAGAC

1101 TTTCCGCGCC CGCGCCGTTG CCGCCAACAA TATCGTTAAC GGTATTTTTA

1151 TGGTTTCCGC TGCCGTTTTG AGCGCGGTGT TGCTGTTTTT GTTTGACAGC

1201 ATTTCCTTGT TGTATCTGAT TGTCGCTTTG GGCAATATTC CGTTGTCGGT

1251 ATTTTTGATT AAGCGCGAAA GGCGGTTTTT AGGCGCGGCG GCAATCAGGA

1301 AAAAACCTTG A
```

This corresponds to the amino acid sequence <SEQ ID 856; ORF 232.a>:

```
a232.pep

  1 MYAKKGGLGL VKSRRFAPLF ATQFLGAFND NVFKTALFVM IGFYGLGQNG

 51 FLPAGQMLNL GALLFILPYF LFSSLSGQLG NKFDKAVLAR WAKVLEMIIM

101 AVAAYGFYIR SAPLLLACLF CMGAQSTLFG PLKYAILPDY LDDKELMMGN

151 SLIESGTFVA ILFGQILGTA VAGVPPYIVG ILVLLVAVGG TVGSLFMPSV

201 PAKAADTQIE WNIVRGTKSL LRETVRHKPV FTAIIGISWF WFVGAVYTTQ

251 LPTFTQIHLG GNDNVFNLML ALFSIGIAAG SVLCAKFSRE RLRLAWVTVG

301 ALGLTVCGLV LVWLTHGHRF EGLNGIFWFL SQGWAYPVMA VMTLIGFFGG

351 FFSVPLYTWL QTASSETFRA RAVAANNIVN GIFMVSAAVL SAVLLFLFDS

401 ISLLYLIVAL GNIPLSVFLI KRERRFLGAA AIRKKP*
```

m232/a232 95.9% identity in 290 aa overlap

```
                                                   10        20        30
m232.pep                                 MMGNSLIESGTFVAILFGQILGTAVAGVPP
                                         ||||||||||||||||||||||||||||||
a232        ACLFCMGAQSTLFGPLKYAILPDYLDDKELMMGNSLIESGTFVAILFGQILGTAVAGVPP
             120       130       140       150       160       170

                   40        50        60        70        80        90
m232.pep    YIVGILVLLVAVGGTVGSLFMPSVPAKAADTQIEWNIVRGTKSLLRETVRHKPVFTAIIG
            ||||||||||||||||||||||||||||||||||||||||||||||||||||||||||||
a232        YIVGILVLLVAVGGTVGSLFMPSVPAKAADTQIEWNIVRGTKSLLRETVRHKPVFTAIIG
             180       190       200       210       220       230
```

-continued

```
                    100       110       120       130       140       150
m232.pep     ISWFWFVGAVYTTQLPTFTQIHLGGNDNVFNLMLALFSIGIAAGSVLCAKFSXERLMLAW
             |||||||||||||||||||||||||||||||||||||||||||||||||||| ||| |||
a232         ISWFWFVGAVYTTQLPTFTQIHLGGNDNVFNLMLALFSIGIAAGSVLCAKFSRERLRLAW
              240       250       260       270       280       290

                    160       170       180       190       200       210
m232.pep     VTVGALGLTVCGLVLVWLTHGHRFEGLNGIFXFLSQGWAYPVMAVMTLIGFFGGFFSVPL
             ||||||||||||||||||||||||||||||| ||||||||||||||||||||||||||||
a232         VTVGALGLTVCGLVLVWLTHGHRFEGLNGIFWFLSQGWAYPVMAVMTLIGFFGGFFSVPL
              300       310       320       330       340       350

                     220       230       240       250       260
m232.pep     YT-VQTAIARFPRP-AVAANNIVNGIFMVSAAVLSAVLLFLFDSISLLYLIVALGNIPLS
             || :||| ::  |  |||||||||||||||||||||||||||||||||||||||||||||
a232         YTWLQTASSETFRARAVAANNIVNGIFMVSAAVLSAVLLFLFDSISLLYLIVALGNIPLS
              360       370       380       390       400       410

            270       280      289
m232.pep     VFLIKRERRFLGAAAIRKKPX
             |||||||||||||||||||||
a232         VFLIKRERRFLGAAAIRKKPX
              420       430
```

The following partial DNA sequence was identified in *N. gonorrhoeae* <SEQ ID 857>:

g233.seq 1 atgaaacgca aaaatatcgc gctgattccc gccgccggca tcggggtgcg 51 tttcggtgcg gacaaaccca agcaatatgt cgaaatcgga agcaaaaccg 101 ttttagaaca tgtacttggg atttttgaac ggcatgaggc cgtcgatttg 151 accgtcgttg tcgtctcgcc cgaagacacg tttgccgata aggttcagac 201 ggcatttcca caggttcggg tgtggaaaaa cggtggacag acccgcgccg 251 aaactgtccg caacggtgtg gcaaaactgt tggaaaccgg tttggcggcg 301 gaaaccgaca atattctggt acacgatgcc gcccgctgct gcctgccgtc 351 tgaagctctg gcgcggttga tagaacaggc gggcaacgcc gccgaaggcg 401 ggattttggc agttcccgtt gccgatacgc tcaagcgcgc agaaagcgga 451 caaatcagtg caactgtcga ccgttcgggg ctttggcagg cgcaaacgcc 501 gcagcttttt caagcgggtt tgctgcaccg cgcattggct gcggaaaact 551 tgggcggcat taccgatgaa gcgtccgccg tggaaaaact gggtgtgcgt 601 ccgctactga tacagggcga cgcgcgcaat ttgaaactga cgcagccgca 651 ggacgcatac atcgtcaggc tgctgctcaa tgccgtctga This corresponds to the amino acid sequence <SEQ ID 858; ORF 233.ng>:

g233.pep

1 MKRKNIALIP AAGIGVRFGA DKPKQYVEIG SKTVLEHVLG IFERHEAVDL

51 TVVVVSPEDT FADKVQTAFP QVRVWKNGGQ TRAETVRNGV AKLLETGLAA

101 ETDNILVHDA ARCCLPSEAL ARLIEQAGNA AEGGILAVPV ADTLKRAESG

151 QISATVDRSG LWQAQTPQLF QAGLLHRALA AENLGGITDE ASAVEKLGVR

201 PLLIQGDARN LKLTQPQDAY IVRLLLNAV*

The following partial DNA sequence was identified in *N. meningitidis* <SEQ ID 859>:

m233.seq (partial)

```
  1 ATGAAGCGCA AAAATATCGC GCTGATTCCC GCCGCCGGCA TCGGGGCGCG
 51 TTTCGGTGCG GACAAACCCA AGCAATATGT CGAAATCGGA AGCAAAACCG
101 TTTTAGAACA TACGATTGGG ATTTTTGAAC GGCATGAGGC CGTCGATTTG
151 ACCGTCGTTG TCGTCTCGCC CGAAGACACG TTTGCCGATA AGGTTCAGAC
201 GGCATTTCCA CAGGTTCGGG TGTGGAAAAA CGGCGGACAG ACCCGCGCCG
251 AAACCGTCCG CAACGGTGTG GCAAAACTGT TGGAAACCGG TTTGGCGGCG
301 GAAACCGACA ATATTCTGGT ACACGATGCC GCGCGTTGCT GCCTGCCGTC
351 TGAAGCTTTG ACGCGGTTGA TAGAACAGGC GGGCAACGCC GCCGAAGGCG
401 GGATTTTGGC AATTCCCATT GCCGATACGC TCAAGTGCGC GGACGGTGGG
451 AACATT . . .
```

This corresponds to the amino acid sequence <SEQ ID 860; ORF 233>:

m233.pep (partial)

```
  1 MKRKNIALIP AAGIGARFGA DKPKQYVEIG SKTVLEHTIG IFERHEAVDL
 51 TVVVVSPEDT FADKVQTAFP QVRVWKNGGQ TRAETVRNGV AKLLETGLAA
101 ETDNILVHDA ARCCLPSEAL TRLIEQAGNA AEGGILAIPI ADTLKCADGG
151 NI . . .
```

Computer analysis of this amino acid sequence gave the following results:

Homology with a predicted ORF from *N. gonorrhoeae*

ORF 233 shows 93.4% identity over a 152 aa overlap with a predicted ORF (ORF 233.ng) from *N. gonorrhoeae*:

m233/g233

```
                   10        20        30        40        50        60
m233.pep    MKRKNIALIPAAGIGARFGADKPKQYVEIGSKTVLEHTIGIFERHEAVDLTVVVVSPEDT
            |||||||||||||||:||||||||||||||||||||::||||||||||||||||||||||
g233        MKRKNIALIPAAGIGVRFGADKPKQYVEIGSKTVLEHVLGIFERHEAVDLTVVVVSPEDT
                   10        20        30        40        50        60

                   70        80        90       100       110       120
m233.pep    FADKVQTAFPQVRVWKNGGQTRAETVRNGVAKLLETGLAAETDNILVHDAARCCLPSEAL
            ||||||||||||||||||||||||||||||||||||||||||||||||||||||||||||
g233        FADKVQTAFPQVRVWKNGGQTRAETVRNGVAKLLETGLAAETDNILVHDAARCCLPSEAL
                   70        80        90       100       110       120

                  130       140       150
m233.pep    TRLIEQAGNAAEGGILAIPIADTLKCADGGNI
            :||||||||||||||||:|:||||| |::|:|
g233        ARLIEQAGNAAEGGILAVPVADTLKRAESGQISATVDRSGLWQAQTPQLFQAGLLHRALA
                  130       140       150       160       170       180
```

The following partial DNA sequence was identified in *N. meningitidis* <SEQ ID 861>:

a233.seq

```
  1 ATGAAGCGCA AAAATATCGC GCTGATTCCC GCCGCCGGCA TCGGGGCGCG
 51 TTTCGGTGCG GACAAACCCA AGCAATATGT CGAAATCGGA AGCAAAACCG
101 TTTTAGAACA TACGATTGGG ATTTTTGAAC GGCATGAGGC CGTCGATTTG
```

-continued

```
151 ACCGTCGTTG TCGTCTCGCC CGAAGACACG TTTGCCGATA AGGTTCAGAC

201 GGCATTTCCA CAGGTTCGGG TGTGGAAAAA CGGCGGACAG ACCCGCGCCG

251 AAACTGTCCG CAACGGTGTG GCAAAATTGT TGGAAACCGG TTTGGCGGCG

301 GAAACCGACA ATATTCTGGT ACACGATGCC GCGCGTTGCT GCCTGCCGTC

351 TGAAGCTTTG ACGCGGTTGA TAGAACAGGC GGGCAACGCT GCCGAAGGTG

401 GGATTTTGGC AATTCCCGTT GCCGATACGC TCAAGTGCGC GGACGGTGGG

451 AACATTAGTG CAACCGTCGA GCGGACGAGC CTTTGGCAGG CGCAAACGCC

501 GCAGCTTTTC CGCGCCGGGC TGCTGCACCG CGCATTGGCT GCGGAAAACT

551 TGGACGGCAT TACCGATGAA GCGTCCGCCG TGGAAAAATT GGGCATCCGC

601 CCTTTGCTGG TGCAGGGCGA CGCGCGCAAT TTGAAACTGA CGCAGCCGCA

651 GGACGCATAC ATCGTCAGGC TGCTGCTCGA TGCCGTCTGA
```

This corresponds to the amino acid sequence <SEQ ID 862; ORF 233.a>:

a233.pep

```
  1 MKRKNIALIP AAGIGARFGA DKPKQYVEIG SKTVLEHTIG IFERHEAVDL

 51 TVVVVSPEDT FADKVQTAFP QVRVWKNGGQ TRAETVRNGV AKLLETGLAA

101 ETDNILVHDA ARCCLPSEAL TRLIEQAGNA AEGGILAIPV ADTLKCADGG

151 NISATVERTS LWQAQTPQLF RAGLLHRALA AENLDGITDE ASAVEKLGIR

201 PLLVQGDARN LKLTQPQDAY IVRLLLDAV*
```

m233/a233 99.3% identity in 152 aa overlap

```
                    10        20        30        40        50        60
m233.pep     MKRKNIALIPAAGIGARFGADKPKQYVEIGSKTVLEHTIGIFERHEAVDLTVVVVSPEDT
             ||||||||||||||||||||||||||||||||||||||||||||||||||||||||||||
a233         MKRKNIALIPAAGIGARFGADKPKQYVEIGSKTVLEHTIGIFERHEAVDLTVVVVSPEDT
                    10        20        30        40        50        60
                    70        80        90       100       110       120
m233.pep     FADKVQTAFPQVRVWKNGGQTRAETVRNGVAKLLETGLAAETDNILVHDAARCCLPSEAL
             ||||||||||||||||||||||||||||||||||||||||||||||||||||||||||||
a233         FADKVQTAFPQVRVWKNGGQTRAETVRNGVAKLLETGLAAETDNILVHDAARCCLPSEAL
                    70        80        90       100       110       120
                   130       140       150
m233.pep     TRLIEQAGNAAEGGILAIPIADTLKCADGGNI
             |||||||||||||||||||:||||||||||||
a233         TRLIEQAGNAAEGGILAIPVADTLKCADGGNISATVERTSLWQAQTPQLFRAGLLHRALA
                   130       140       150       160       170       180
a233         AENLDGITDEASAVEKLGIRPLLVQGDARNLKLTQPQDAYIVRLLLDAVX
                   190       200       210       220       230
```

The following partial DNA sequence was identified in *N. gonorrhoeae* <SEQ ID 863>:

g234.seq

```
  1 atgaaaaccg tttccgccgc catcgctttt gccgccgctg ccgtttcact

 51 gaccggctgt gcgaccgagt cctcacgcag cctcgaggtt gcaaaagtcg

101 cctcctgcaa tacgcaatat cacggtgttc gcaccccgat ttccgtcgga

151 acattcgaca accgctccag cttccaaaaa ggcattttct ccgacagtga
```

-continued

```
201 agaccgtctg ggcagccagg caaaaaccat cctggtaaca cacctgcaac
251 aaaccaaccg cttcaacgta ctgaaccgca ccaaccttag cgcattgaaa
301 caggaatccg gcatttccgg caaagcgcag aacctgaaag gcgcagatta
351 tgtcgttacc ggcgatgtaa ccgaattcgg acgcagagat gtcggcgatc
401 atcagctctt cggcattttg ggtcgcggca aatcgcaaat cgcctatgca
451 aaagtggctc tgaatatcgt caacgtcaat acttccgaaa tcgtctattc
501 cacacagggc gcgggcgaat acgcactttc caaccgcgaa atcatcggtt
551 tcggcggcac ttccggctac gatgcgactt tgaacggcaa agttttagac
601 ttggcaatcc gcgaagccgt cgacaacttg gttcaggctg tcgacaacgg
651 cgcatggcaa tccaaccgtt aa
```

This corresponds to the amino acid sequence <SEQ ID 864; ORF 234.ng>:

g234.pep

```
  1 MKTVSAAIAF AAAAVSLTGC ATESSRSLEV AKVASCNTQY HGVRTPISVG
 51 TFDNRSSFQK GIFSDSEDRL GSQAKTILVT HLQQTNRFNV LNRTNLSALK
101 QESGISGKAQ NLKGADYVVT GDVTEFGRRD VGDHQLFGIL GRGKSQIAYA
151 KVALNIVNVN TSEIVYSTQG AGEYALSNRE IIGFGGTSGY DATLNGKVLD
201 LAIREAVDNL VQAVDNGAWQ SNR*
```

The following partial DNA sequence was identified in *N. meningitidis* <SEQ ID 865>:

m234.seq (partial)

```
  1 GGCGCGGGCG AATACGCACT TTCCAACCGt GAAATCATCG GTTTCGGCGG
 51 CACTTCCGGC TACGATGCGA CTTTGAACGG CAAAGTTTTA GACTTGGCAA
101 TCCGCGAAGC .gTCAACAGC CTGGTTCAGG CTGTTGACAA CGGCGCATGG
151 CAACCCAACC GTTAA
```

This corresponds to the amino acid sequence <SEQ ID 866; ORF 234>:

m234.pep (partial)

```
 1 GAGEYALSNR EIIGFGGTSG YDATLNGKVL DLAIREAVNS LVQAVDNGAW
51 QPNR*
```

Computer analysis of this amino acid sequence gave the following results:

Homology with a predicted ORF from *N. gonorrhoeae*

ORF 234 shows 94.4% identity over a 54 aa overlap with a predicted ORF (ORF 234.ng) from *N. gonorrhoeae*:

m234/g234

```
                                              10        20        30
m234.pep                                GAGEYALSNREIIGFGGTSGYDATLNGKVL
                                        ||||||||||||||||||||||||||||||
g234       LGRGKSQIAYAKVALNIVNVNTSEIVYSTQGAGEYALSNREIIGFGGTSGYDATLNGKVL
         140       150       160       170       180       190

                  40        50
m234.pep   DLAIREAVNSLVQAVDNGAWQPNRX
           ||||||||::||||||||||| |||
g234       DLAIREAVDNLVQAVDNGAWQSNRX
         200       210       220
```

The following partial DNA sequence was identified in *N. meningitidis* <SEQ ID 867>:

a234.seq (partial)

```
  1 AACCGCACCT ATTTGAACGC ATTAAAACAG GAATCCGGCA TTTCCGGCAA

 51 AGCGCATAAC CTGAAAGGCG CAAATTATGT CGNNACCGGC GATGTAACCG

101 AATTCGGACG CANAGATGTC GGCGATCATC AGCTCTTCGG CATTTTGGGT

151 CGCGGCAAAT CGCAAATCGC CTATGCAAAA GTGGCTCTGA ATATCGTCAA

201 CGTCAATACT TCCGAAATCG TCTATTCCGC ACAGGGCGCG GGCGAATACG

251 CACTTTCCAA CCGTGAAATC ATCGGTTTCG GCGGCACTTC CGGCTACGAT

301 GCGACTTTGA ACGGCAAAGT TTTAGACTTG GCAATCCGCG AAGCCGTCAA

351 CAGCCTGGTT CAGGCTGTTG ACAACGGCGC ATGGCAACCC AACCGTTAA
```

This corresponds to the amino acid sequence <SEQ ID 868; ORF 234.a>:

a234.pep (partial)

```
  1 NRTYLNALKQ ESGISGKAHN LKGANYVXTG DVTEFGRXDV GDHQLFGILG

 51 RGKSQIAYAK VALNIVNVNT SEIVYSAQGA GEYALSNREI IGFGGTSGYD

101 ATLNGKVLDL AIREAVNSLV QAVDNGAWQP NR*
```

m234/a234 100.0% identity in 54 aa overlap

```
                                              10        20        30
m234.pep                                GAGEYALSNREIIGFGGTSGYDATLNGKVL
                                        ||||||||||||||||||||||||||||||
a234       LGRGKSQIAYAKVALNIVNVNTSEIVYSAQGAGEYALSNREIIGFGGTSGYDATLNGKVL
                        50        60        70        80        90

                  40        50
m234.pep   DLAIREAVNSLVQAVDNGAWQPNRX
           |||||||||||||||||||||||||
a234       DLAIREAVNSLVQAVDNGAWQPNRX
         110        120       130
```

The following partial DNA sequence was identified in *N. gonorrhoeae* <SEQ ID 869>:

g235.seq

```
  1 atgaaacctt tgattttagg gcttgccgcc gtgttggctc tgtctgcctg

 51 ccaagttcga aaagctcccg acctcgacta cacgtcattc aaagaaagca
```

-continued

```
101 aaccggcttc aattttggtg gttccgccgc tgaacgagtc gcctgatgtc
151 aacggcactt gggggatgct ggcttcgacc gccgcgccga tttccgaagc
201 cggctattac gtctttcccg ccgcagtcgt ggaggaaacc ttcaaagaaa
251 acggcttgac caatgccgcc gatattcacg ccgtccggcc ggaaaaactg
301 catcaaattt tcggcaatga tgcggttttg tacattacgg ttaccgaata
351 cggcacttca tatcaaattt tagacagcgt gacgaccgta tccgccaaag
401 cacggctggt cgattcccgc aacgggaaag agttgtggtc gggttcggcc
451 agcatccgcg aaggcagcaa caacagcaac agcggcctgt tgggggcttt
501 ggtcggcgca gtggtcaatc agattgccaa cagcctgacc gaccgcggtt
551 atcaggtttc caaaaccgcc gcatacaacc tactgtcgcc ctattcccgc
601 aacggtatct tgaaaggtcc gagattcgtc gaagagcagc ccaaataa
```

This corresponds to the amino acid sequence <SEQ ID 870; ORF 235.ng>:

g235.pep

```
  1 MKPLILGLAA VLALSACQVR KAPDLDYTSF KESKPASILV VPPLNESPDV
 51 NGTWGMLAST AAPISEAGYY VFPAAVVEET FKENGLTNAA DIHAVRPEKL
101 HQIFGNDAVL YITVTEYGTS YQILDSVTTV SAKARLVDSR NGKELWSGSA
151 SIREGSNNSN SGLLGALVGA VVNQIANSLT DRGYQVSKTA AYNLLSPYSR
201 NGILKGPRFV EEQPK*
```

The following partial DNA sequence was identified in *N. meningitidis* <SEQ ID 871>:

m235.seq

```
  1 ATGAAACCTT TGATTTTAGG GCTTGCCGCC GTGTTGGCGC TGTCTGCCTG
 51 CCAAGTTCAA AAAGCGCCCG ATTTCGACTA CACGTCATTC AAGGAAAGCA
101 AACCGGCTTC AATTTTGGTG GTTCCGCCGC TGAACGAATC GCCCGATGTC
151 AACGGAACAT GGGGTGTACT GGCTTCGACC GCCGCGCCGC TTTCCGAAGC
201 CGGCTATTAC GTCTTCCCCG CCGCAGTCGT GGAGGAAACC TTCAAACAAA
251 ACGGCTTGAC CAATGCCGCC GATATTCACG CCGTCCGGCC GGAAAAACTG
301 CATCAGATTT TCGGCAATGA TGCGGTTTTG TACATTACGG TTACCGAATA
351 CGGCACTTCA TATCAAATTT TAGACAGCGT GACGACCGTA TCCGCCAAAG
401 CACGGCTGGT CGATTCCCGC AACGGAAAAG AGTTGTGGTC GGGTTCGGCC
451 AGCATCCGCG AAGGCAGCAA CAACAGCAAC AGCGGCCTGT TGGGGGCTTT
501 GGTCAGCGCA GTGGTCAATC AGATTGCCAA CAGCCTGACC GACCGCGGTT
551 ATCAGGTTTC CAAAACCGCC GCATACAACC TGCTGTCGCC CTATTCTCAC
601 AACGGCATCT TGAAAGGTCC GAGATTCGTT GAAGAGCAGC CCAAATAA
```

This corresponds to the amino acid sequence <SEQ ID 872; ORF 235>:

m235.pep

```
  1 MKPLILGLAA VLALSACQVQ KAPDFDYTSF KESKPASILV VPPLNESPDV
 51 NGTWGVLAST AAPLSEAGYY VFPAAVVEET FKQNGLTNAA DIHAVRPEKL
101 HQIFGNDAVL YITVTEYGTS YQILDSVTTV SAKARLVDSR NGKELWSGSA
151 SIREGSNNSN SGLLGALVSA VVNQIANSLT DRGYQVSKTA AYNLLSPYSH
201 NGILKGPRFV EEQPK*
```

Computer analysis of this amino acid sequence gave the following results:

Homology with a predicted ORF from *N. gonorrhoeae*

ORF 235 shows 96.7% identity over a 215 aa overlap with a predicted ORF (ORF 235.ng) from *N. gonorrhoeae*:

m235/g235

```
                    10        20        30        40        50        60
m235.pep    MKPLILGLAAVLALSACQVQKAPDFDYTSFKESKPASILVVPPLNESPDVNGTWGVLAST
            |||||||||||||||||||:||||:||||||||||||||||||||||||||||||:||||
g235        MKPLILGLAAVLALSACQVRKAPDLDYTSFKESKPASILVVPPLNESPDVNGTWGMLAST
                    10        20        30        40        50        60

                    70        80        90       100       110       120
m235.pep    AAPLSEAGYYVFPAAVVEETFKQNGLTNAADIHAVRPEKLHQIFGNDAVLYITVTEYGTS
            |||:|||||||||||||||||:||||||||||||||||||||||||||||||||||||||
g235        AAPISEAGYYVFPAAVVEETFKENGLTNAADIHAVRPEKLHQIFGNDAVLYITVTEYGTS
                    70        80        90       100       110       120

                   130       140       150       160       170       180
m235.pep    YQILDSVTTVSAKARLVDSRNGKELWSGSASIREGSNNSNSGLLGALVSAVVNQIANSLT
            ||||||||||||||||||||||||||||||||||||||||||||||||:|||||||||||
g235        YQILDSVTTVSAKARLVDSRNGKELWSGSASIREGSNNSNSGLLGALVGAVVNQIANSLT
                   130       140       150       160       170       180

                   190       200       210
m235.pep    DRGYQVSKTAAYNLLSPYSHNGILKGPRFVEEQPKX
            |||||||||||||||||||:||||||||||||||||
g235        DRGYQVSKTAAYNLLSPYSRNGILKGPRFVEEQPKX
                   190       200       210
```

The following partial DNA sequence was identified in *N. meningitidis* <SEQ ID 873>:

a235.seq

```
  1 ATGAAACCTT TGATTTTAGG GCTTGCCGCC GTGTTGGCGC TGTCTGCCTG
 51 CCAAGTTCAA AAAGCGCCCG ATTTCGACTA CACGTCATTC AAGGAAAGCA
101 AACCGGCTTC AATTTTGGTG GTTCCGCCGC TGAACGAATC GCCCGATGTC
151 AACGGAACAT GGGGTGTACT GGCTTCGACC GCCGCGCCGC TTTCCGAAGC
201 CGGCTATTAC GTCTTCCCCG CCGCAGTCGT GGAGGAAACC TTCAAACAAA
251 ACGGCTTGAC CAATGCCGCC GATATTCACG CCGTCCGGCC GGAAAAACTG
301 CATCAGATTT TCGGCAATGA TGCGGTTTTG TACATTACGG TTACCGAATA
351 CGGCACTTCA TATCAAATTT TAGACAGCGT GACGACCGTA TCCGCCAAAG
401 CACGGCTGGT CGATTCCCGC AACGGAAAAG AGTTGTGGTC GGGTTCGGCC
451 AGCATCCGCG AAGGCAGCAA CAACAGCAAC AGCGGCCTGT TGGGGGCTTT
501 GGTCAGCGCA GTGGTCAATC AGATTGCCAA CAGCCTGACC GACCGCGGTT
551 ATCAGGTTTC TAAAACCGCC GCATACAACC TGCTGTCGCC CTATTCTCAC
601 AACGGCATCT TGAAAGGTCC GAGATTCGTC GAAGAGCAGC CCAAATAA
```

This corresponds to the amino acid sequence <SEQ ID 874; ORF 235.a>:

a235.pep

```
  1 MKPLILGLAA VLALSACQVQ KAPDFDYTSF KESKPASILV VPPLNESPDV
 51 NGTWGVLAST AAPLSEAGYY VFPAAVVEET FKQNGLTNAA DIHAVRPEKL
101 HQIFGNDAVL YITVTEYGTS YQILDSVTTV SAKARLVDSR NGKELWSGSA
151 SIREGSNNSN SGLLGALVSA VVNQIANSLT DRGYQVSKTA AYNLLSPYSH
201 NGILKGPRFV EEQPK*
```

m235/a235 100.0% identity in 215 aa overlap

```
                   10        20        30        40        50        60
m235.pep    MKPLILGLAAVLALSACQVQKAPDFDYTSFKESKPASILVVPPLNESPDVNGTWGVLAST
            ||||||||||||||||||||||||||||||||||||||||||||||||||||||||||||
a235        MKPLILGLAAVLALSACQVQKAPDFDYTSFKESKPASILVVPPLNESPDVNGTWGVLAST
                   10        20        30        40        50        60

                   70        80        90       100       110       120
m235.pep    AAPLSEAGYYVFPAAVVEETFKQNGLTNAADIHAVRPEKLHQIFGNDAVLYITVTEYGTS
            ||||||||||||||||||||||||||||||||||||||||||||||||||||||||||||
a235        AAPLSEAGYYVFPAAVVEETFKQNGLTNAADIHAVRPEKLHQIFGNDAVLYITVTEYGTS
                   70        80        90       100       110       120

                  130       140       150       160       170       180
m235.pep    YQILDSVTTVSAKARLVDSRNGKELWSGSASIREGSNNSNSGLLGALVSAVVNQIANSLT
            ||||||||||||||||||||||||||||||||||||||||||||||||||||||||||||
a235        YQILDSVTTVSAKARLVDSRNGKELWSGSASIREGSNNSNSGLLGALVSAVVNQIANSLT
                  130       140       150       160       170       180

                  190       200       210
m235.pep    DRGYQVSKTAAYNLLSPYSHNGILKGPRFVEEQPKX
            ||||||||||||||||||||||||||||||||||||
a235        DRGYQVSKTAAYNLLSPYSHNGILKGPRFVEEQPKX
                  190       200       210
```

The following partial DNA sequence was identified in *N. gonorrhoeae* <SEQ ID 875>:

g236.seq

```
  1 ATGGCGCGTT TCGCCTTCTC CGCCGACATT CTCCGCACAG CGTTTGCAGA
 51 CGGTTTCATA ACCTGCAACC GCGCCCACAT CGCGGGTGTA ATGCCAGCAG
101 CGTTCGCATT TTTCGCCGTC GCTGGCTTTG GCGGCAACGG CAAGTTCATC
151 ACCGACTTTC ACTTCTGCTT TAGACACCAG CAGGGCAAAG CGCAATTCTT
201 CGCCCAAAGC ATTCAGATAG CCGGCCATTT CTTCCGGCGC GGTAATTTCG
251 GCTTCCGCCT GCAAggacga accgacagTT TTGTcggcGC GCAAAGGCTC
301 GAtagcggcg gTTACTGCTT CGCGCGCTTC GCGGATTGCC GTCCATTTTT
351 TCACCAGTTC GGCTTCGGCT TTTTCGTTGA TGGCCGGGAA CTCGTGCCAA
401 GTATGGAAGA GGACGCTGTC TTCTTCGCCG CCGCCGATGA TGTCCCACGC
451 TTCTTCGCCG GTGAAGCACA AAATCGGTGC AATCAAGAGA ACCAGGCTGC
501 GCGTGATGTG GTACAGGGCG GTTTGCGCGC TGCGGCGGGC GCGGCTGTCG
551 GCTTTGGTGG TGTAGAGGCG GTCTTTCAGG ATGTCGAGGT AGAACGCGCC
601 CAAGTCTTCC GAGCAGAAAG AAACAATGTC TTTCACGGCG AAGTGGAAGG
651 CATAGCGCGG ATAGTAACCG CCTGCCAAAC GCTCTTGCAG CCGCCGCGCC
701 AATACCAAGG CGTAGCGGTC GATTTCCACC ATATCCGCCT GTTGCACGGC
751 ATCTTCAATC GGATTAAAGT CGCTCAAATT GGCAAAcagG AAGCTCAAGG
801 TATTGCGGAT GCGGCGGTAG CTTTCGGTAA CGCGTTTGAG GATTTCTTTG
```

-continued

```
 851 GAAatcgCCA ATtcgccgct gTAATCGGTG GATGCCGCCC ACAGGCGCAG
 901 GATGTCCGCG CCGAATTCGT TATAGACTTC CTGCGGCGCG ACGACGTTGC
 951 CGATGGATTT CGACATTTTG CGGCCGTTTT GGTCAACCAC GAAACCGTGG
1001 GTCAGCAGCT GTTTATACGG TGCGCGTCCC ATGGATGA
```

This corresponds to the amino acid sequence <SEQ ID 876; ORF 236.ng>:

g236.pep

```
  1 MARFAFSADI LRTAFADGFI TCNRAHIAGV MPAAFAFFAV AGFGGNGKFI
 51 TDFHFCFRHQ QGKAQFFAQS IQIAGHFFRR GNFGFRLQGR TDSFVGAQRL
101 DSGGYCFARF ADCRPFFHQF GFGFFVDGRE LVPSMEEDAV FFAAADDVPR
151 FFAGEAQNRC NQENQAARDV VQGGLRAAAG AAVGFGGVEA VFQDVEVERA
201 QVFRAERNNV FHGEVEGIAR IVTACQTLLQ PPRQYQGVAV DFHHIRLLHG
251 IFNRIKVAQI GKQEAQGIAD AAVAFGNAFE DFFGNRQFAA VIGGCRPQAQ
301 DVRAEFVIDF LRRDDVADGF RHFAAVLVNH ETVGQQLFIR CASHG*
```

The following partial DNA sequence was identified in *N. meningitidis* <SEQ ID 877>:

m236.seq (partial)

```
  1 ..TTGCACGGAC GAACCGACGG TTTTGTCGGC GCGCAAAGGC TCGATGGCGG
 51   CGGTTACCGC TTCGCGGGCT TCGCGGATTG CCGTCCATTT TTTCACCAGT
101   TCGGCTTCGG TTTTTTCGTT GATGGTCGGG AACTCGTGCC AAGTATGGAA
151   GAGGACGCTG TCkTCTTCGC CGCCGCCGwT GAyGTCCCAC GCTTCTTCGC
201   CGGTGAAGCA CAAAATCGGT GCAATCAAGA GAACCAAACT GCGTGTGATG
251   TGATACAGGG CAGTTTGTGC GCTGCGGCGT GCATGGCTGT CTGCTTTGGT
301   GGTGTAGAGG CGGTCTTTCA GGATGTCGAG GTAGAACGCA CCCAAGTCTT
351   CCGAGCAGAA AGAAACArTG TCTTTTACGG CAAAGTGGaA kGCATAACGC
401   GGATAGTAAT CGCCTGCCAG ACACTCTTGC AGCTGACGTG CCAATACCAC
451   GGCGTAGCGG TCGATTTCCA CCATATCCGC CTGTTGCACG GCATCTTCAA
501   TCGGATTAAA GTCGCTCAAG TTGGCAAACA AAAAGCTCAA GGTATTGCGG
551   ATACGGCGGT AgCTTTCGGT TACGCGTTTG AGGATTTCTT TGGAAATCGC
601   CAATTCGCCG CTGTAATCGG TAGATGCCGC CCACAGGCGC AGGATGTCTG
651   CGCCGAATTC GTTATAAACC TCTTGCGGTG CAACGACGTT GCCGATGGAT
701   TTCGACATTT TTTTGCCTTC GCCGTCGACA ACGAAACCAT GGGTCAGCAG
751   CTGTTTATAC GGCGCGCGAC CCATTGA
```

This corresponds to the amino acid sequence <SEQ ID 878; ORF 236>:

m236.pep (partial)

```
  1 ..LHGRTDGFVG AQRLDGGGYR FAGFADCRPF FHQFGFGFFV DGRELVPSME
 51   EDAVXFAAAX DVPRFFAGEA QNRCNQENQT ACDVIQGSLC AAACMAVCFG
101   GVEAVFQDVE VERTQVFRAE RNXVFYGKVE XITRIVIACQ TLLQLTCQYH
151   GVAVDFHHIR LLHGIFNRIK VAQVGKQKAQ GIADTAVAFG YAFEDFFGNR
201   QFAAVIGRCR PQAQDVCAEF VINLLRCNDV ADGFRHFFAF AVDNETMGQQ
251   LFIRRATH*
```

Computer analysis of this amino acid sequence gave the following results:

Homology with a predicted ORF from *N. gonorrhoeae*

ORF 236 shows 82.9% identity over a 258 aa overlap with a predicted ORF (ORF 236.ng) from *N. gonorrhoeae*:

m236/g236

```
                                                 10        20        30
m236.pep                                  LHGRTDGFVGAQRLDGGGYRFAGFADCRPF
                                          |:||||:||||||||:||| || |||||||
g236       FRHQQGKAQFFAQSIQIAGHFFRRGNFGFRLQGRTDSFVGAQRLDSGGYCFARFADCRPF
             60        70        80        90       100       110

                   40        50        60        70        80        90
m236.pep   FHQFGFGFFVDGRELVPSMEEDAVXFAAAXDVPRFFAGEAQNRCNQENQTACDVIQGSLC
           |||||||||||||||||||||||| |||| |||||||||||||||||||:| ||:||:| 
g236       FHQFGFGFFVDGRELVPSMEEDAVFFAAADDVPRFFAGEAQNRCNQENQAARDVVQGGLR
            120       130       140       150       160       170

                  100       110       120       130       140       150
m236.pep   AAACMAVCFGGVEAVFQDVEVERTQVFRAERNXVFYGKVEXITRIVIACQTLLQLTCQYH
           |||  || |||||||||||||||:|||||||| ||:|:|| |:||| |||||||   ||:
g236       AAAGAAVGFGGVEAVFQDVEVERAQVFRAERNNVFHGEVEGIARIVTACQTLLQPPRQYQ
            180       190       200       210       220       230

                  160       170       180       190       200       210
m236.pep   GVAVDFHHIRLLHGIFNRIKVAQVGKQKAQGIADTAVAFGYAFEDFFGNRQFAAVIGRCR
           |||||||||||||||||||||||:|||:||||||:||||| |||||||||||||||| ||
g236       GVAVDFHHIRLLHGIFNRIKVAQIGKQEAQGIADAAVAFGNAFEDFFGNRQFAAVIGGCR
            240       250       260       270       280       290

                  220       230       240       250      259
m236.pep   PQAQDVCAEFVINLLRCNDVADGFRHFFAFAVDNETMGQQLFIRRATHX
           |||||| |||||::|| :||||||||| |  |::||:||||||| |:| 
g236       PQAQDVRAEFVIDFLRRDDVADGFRHFAAVLVNHETVGQQLFIRCASHG
            300       310       320       330       340
```

The following partial DNA sequence was identified in *N. meningitidis* <SEQ ID 879>:

a236.seq

```
  1 ATGGCGCGTT TCGCCTTCTC CGCCGACATT CTCTGCACAG CGTTTGCAGA
 51 CGGTTTCATG GCCTGCAACC GCGCCCACAT CGCGGGTGTA GTGCCAGCAG
101 CGTTCGCATT TTTCACCATC ACTGGCTTTA GCGGCAACGG CAAGTTCGCT
151 GCCTACTTTC ACTTCTGCTT TAGACACCAG CAAAGCAAAG CGCAATTCTT
201 CGCCCAAAGC ATTCAGATAG CCGGCCATTT CTTCCGGCGC GGTAATTTCG
251 GCTTCGGCTT GCAAGGACGA ACCGACGGTT TTGTCGGCGC GCAAAGGCTC
301 GATGGCGGCG GTTACCGCTT CGCGGGCTTC GCGGATTGCC GTCCATTTTT
351 TCACCAGTTC GGCTTCGGCT TTTTCGTTGA TGGTCGGGAA CTCGTGCCAA
401 GTATGGAAAA GCACGCTGTC TTCTGCGCCG CCGCCGATGA TGTCCCACGC
```

-continued

```
 451 TTCTTCGCCG GTGAAGCACA AAATCGGTGC AATCAAGAGA ACCAGGCTGC

 501 GCGTGATGTG GTACAGGGCG GTTTGCGCGC TGCGGCGGGC GCGGCTGTCG

 551 GCTTTGGTGG TATAGAGGCG GTCTTTCAGG ATATCGAGGT AGAACGCGCC

 601 CAAGTCTTCC GAGCAGAAAG AAACCATTTC TTTCACGGCA AAGTGGAAGG

 651 CATAACGCGG ATAAAAATCA CCGGCAACGC GTTCTTGCAG CCGCCTTGCC

 701 AACACCAAGG CATAGCGGTC GATTTCCACC ATATCCGCCT GTTGCACGGC

 751 ATCTTCAATA GGATTGAAGT CGCTCAAGTT GGCAAACAAA AAGCTCAAGG

 801 TATTGCGGAT ACGGCGGTAG CTTTCGGTTA CGCGCTTGAG GATTTCTTTG

 851 GAAATCGCCA ATTCGCCGCT GTAATCGGTG GATGCCGCCC ACAGGCGCAG

 901 GATGTCCGCG CCGAACTCGT TATACACTTC TTGCGGCGCG ACGACGTTGC

 951 CGATGGATTT CGACATTTTG CGCCCGTTTT GATCCACCAC GAAACCATGG

1001 GTCAGCAGCT GTTTGTACGG CGCGCGACCC ATTGA
```

This corresponds to the amino acid sequence <SEQ ID 880; ORF 236.a>:

a236.pep

```
  1 MARFAFSADI LCTAFADGFM ACNRAHIAGV VPAAFAFFTI TGFSGNGKFA

 51 AYFHFCFRHQ QSKAQFFAQS IQIAGHFFRR GNFGFGLQGR TDGFVGAQRL

101 DGGGYRFAGF ADCRPFFHQF GFGFFVDGRE LVPSMEKHAV FCAAADDVPR

151 FFAGEAQNRC NQENQAARDV VQGGLRAAAG AAVGFGGIEA VFQDIEVERA

201 QVFRAERNHF FHGKVEGITR IKITGNAFLQ PPCQHQGIAV DFHHIRLLHG

251 IFNRIEVAQV GKQKAQGIAD TAVAFGYALE DFFGNRQFAA VIGGCRPQAQ

301 DVRAELVIHF LRRDDVADGF RHFAPVLIHH ETMGQQLFVR RATH*
```

m236/a236 81.0% identity in 258 aa overlap

```
                                                    10        20        30
m236.pep                                LHGRTDGFVGAQRLDGGGYRFAGFADCRPF
                                        |:||||||||||||||||||||||||||||
a236          FRHQQGKAQFFAQSIQIAGHFFRRGNFGFRLQGRTDGFVGAQRLDGGGYRFAGFADCRPF
                60        70        80        90       100       110

                      40        50        60        70        80        90
m236.pep      FHQFGFGFFVDGRELVPSMEEDAVXFAAAXDVPRFFAGEAQNRCNQENQTACDVIQGSLC
              ||||||||||||||||||||: ||  ||| |||||||||||||||||||:| ||:||:|
a236          FHQFGFGFFVDGRELVPSMEKHAVFCAAADDVPRFFAGEAQNRCNQENQAARDVVQGGLR
               120       130       140       150       160       170

                     100       110       120       130       140       150
m236.pep      AAACMAVCFGGVEAVFQDVEVERTQVFRAERNXVFYGKVEXITRIVIACQTLLQLTCQYH
              |||  || |||:||||||:||||:||||||||  |:|||| |||| |: :::||  ||::
a236          AAAGAAVGFGGIEAVFQDIEVERAQVFRAERNHFFHGKVEGITRIKITGNAFLQPPCQHQ
               180       190       200       210       220       230

                     160       170       180       190       200       210
m236.pep      GVAVDFHHIRLLHGIFNRIKVAQVGKQKAQGIADTAVAFGYAFEDFFGNRQFAAVOGRCR
              |:|||||||||||||||||:||||||||||||||||||||||:|||||||||||||| ||
a236          GIAVDFHHIRLLHGIFNRIEVAQVGKQKAQGIADTAVAFGYALEDFFGNRQFAAVOGGCR
               240       250       260       270       280       290

                     220       230       240       250       259
m236.pep      PQAQDVCAEFVINLLRCNDVADGFRHFFAFAVDNETMGQQLFIRRATHX
              |||||| ||:||::|| :|||||||||    : :||||||||:||||||
a236          PQAQDVRAELVIHFLRRDDVADGFRHFAPVLIHHETMGQQLFVRRATHX
               300       310       320       330       340
```

The following partial DNA sequence was identified in *N. gonorrhoeae* <SEQ ID 881>:

g237.seq

```
   1 atgcgggaca aggttggcgg taatatcgca ctccccgccc cacgaatatt
  51 cgattctaac atcggcaagc tgcggaaaaa ctttaagcat atcttggcgg
 101 acaagctcgg tcatacgcgc aggattgtcg ataaattcgt tatccttacc
 151 gccgaaaagc agcctgccgt ccgcgctgag gcggtaataa tccaaaatat
 201 ggcggttgtc gcatactgcc atattgttgc ggataagccc ttttgtgcgc
 251 gcgcccaagg gttcggtggc aataataaag gtgctgacgg caatcgcctt
 301 gcgttccaaa ggccggaata tcgggttcaa accgacataa gtattgacgg
 351 catagaccac atttttacac tcgacgctgc cttcgggcgt gtaaaccagc
 401 caaccgtttt gatacggttc gatgcgcgtc atcggggatt gctcgaaaat
 451 ctgcgcgccg gcttcggcag cggcgctggc aacacccaac gtgtaattga
 501 gcggatgaag atgcccggac aagggatcga actgtgcgcc ttggtacata
 551 tcgctgtcaa gctgctgttt caactcggct ttatcccaaa gttgataatg
 601 actcgcaccg taatgccgtt gggcgtgttc atgccactgc tgcaactctt
 651 cccaatgctg cggacggacg gcaaccgtgg cataaccgcg ctgccaatcg
 701 caatcgatgg catgtttgcg gacgcgttcg tccaccagtt cgaccgcctg
 751 caaagactgt tgccaaaacc attgcgcctg ctccaagccg acctgttttt
 801 caatttcccc cataccgcag gcgtagtcgc tgataacctg cccgccactc
 851 ctgccggacg cgccgaagcc gatacgtgcg gcttccaaaa cgacggcttc
 901 atgtccgtgt tccgccagcg gcaatgcggt acacaaaccg ctcaaaccgc
 951 cgccgataat gcaggtttcg gctttcagac ggcattggag tttcggataa
1001 acagtatgcg gattaaccga actaaaataa taagaaggca gatattcttg
1051 aaaatcaggg cgaatcattg tgtttgcttt atcgggtata ttttcggacg
1101 gaatgataca gactgtcggg ccatatcgtc caaacagaaa atcggttga
```

This corresponds to the amino acid sequence <SEQ ID 882; ORF 237.ng>:

g237.pep

```
   1 MRDKVGGNIA LPAPRIFDSN IGKLRKNFKH ILADKLGHTR RIVDKFVILT
  51 AEKQPAVRAE AVIIQNMAVV AYCHIVADKP FCARAQGFGG NNKGADGNRL
 101 AFQRPEYRVQ TDISIDGIDH IFTLDAAFGR VNQPTVLIRF DARHRGLLEN
 151 LRAGFGSGAG NTQRVIERMK MPGQGIELCA LVHIAVKLLF QLGFIPKLIM
 201 TRTVMPLGVF MPLLQLFPML RTDGNRGITA LPIAIDGMFA DAFVHQFDRL
 251 QRLLPKPLRL LQADLFFNFP HTAGVVADNL PATPAGRAEA DTCGFQNDGF
 301 MSVFRQRQCG TQTAQTAADN AGFGFQTALE FRINSMRINR TKIIRRQIFL
 351 KIRANHCVCF IGYIFGRNDT DCRAISSKQK IG*
```

The following partial DNA sequence was identified in *N. meningitidis* <SEQ ID 883>:

m237.seq

```
   1 ATGCGGGACA AGGTTGGCGG TAATGTCGCA CTCCCCGCCC CACGAATATT
  51 CGATTTTGAC ATCGGCAAGC TGCGGAAAAA CTTTAAGCAT ATCTTGGCGG
 101 ACAAGCTCGG TCATaCGCTC AGGATTGTCG ATAAACTCGT TATCCTTACC
 151 GCCGAAAAGC AGTCTGCCGT CCGCGCTGAG GCGGTAATAA TCCAAAATAT
 201 GGCGGTTGTC GCATACTGCC ATATTGTTAC GGATAAGCCC TTTTGCGCGC
 251 GCCCCCAAGG GTTCGGTCGC AATAATAAAG GTGCTGACAG CAATCGCCTT
 301 GCGTTCCAAA GGCCGGAATA TCGGGTTCAA ACCTGCATAA GTATTGACAG
 351 CATAGACCAC ATTTTTGCAC TCGACGCTGC CTTCGGGCGT GTAAACCAGC
 401 CAACCGTTTT GATGCGGTTC GATGCACGTC ATCGGGGATT GCTCGAAAAT
 451 CTGCGCACCG GCTTCGGCAG CGGCACGAGC GATGCCCAAA GTGTAAGTGA
 501 GCGGATGCAG GTGTCCGGAT AAGGGGTCGA ATTGTGCCCC TTGGTACATA
 551 TCGCTGTCAA GCTGCTGTTT CAACTCGGCT TTATCCCAAA GTTGATAATG
 601 ACTCGCACCG TAATGCCGTT GGGCGTGTTC ATGCCACTGC TGCAACTCTT
 651 CCCAATGCTG CGGACGGACG GCAACCGTGG CATAACCGCG CTGCCAATCA
 701 CAATCGACGG CATGTTTGCG GACGCGTTCG TCCACCAGTT CGACCGCCTG
 751 CAAAGACTGT TGCCAAAACC ATTGCGCCTG CTCCAAGCCG ACCTGTTTTT
 801 CAATTTCCCC CATACCGCAG nCGTAATCGC TGATAACCTG CCCGCCACTC
 851 CGTCCCGACG CGCCGAAACC GATACGCGCG GCTTCCAACA CAACCGTTTC
 901 ATGTCCCTGC TCCGCCAAGG GCAATGCAGT GCACAAACCA CCCAATCCGC
 951 CGCCGATGAT ACAGGTATCG GTTTTCAGAC GGCATTGAAG TTtCGGATAA
1001 ACAGTATGAG GATTAACCGA ACTGAAATAA TAAGAAGGCA GATATTCTTG
1051 AAAATCAGGG CGAATCATTG TGTTTGCTTT ATCAGGTGTA TTTTCGGACG
1101 GAATGATACA GGCTGTCGGG CCATATCGTC CAwACAGAAA ATCGGTTGA
```

This corresponds to the amino acid sequence <SEQ ID 884; ORF 237>:

m237.pep

```
  1 MRDKVGGNVA LPAPRIFDFD IGKLRKNFKH ILADKLGHTL RIVDKLVILT
 51 AEKQSAVRAE AVIIQNMAVV AYCHIVTDKP FCARPQGFGR NNKGADSNRL
101 AFQRPEYRVQ TCISIDSIDH IFALDAAFGR VNQPTVLMRF DARHRGLLEN
151 LRTGFGSGTS DAQSVSERMQ VSGXGVELCP LVHIAVKLLF QLGFIPKLIM
201 TRTVMPLGVF MPLLQLFPML RTDGNRGITA LPITIDGMFA DAFVHQFDRL
251 QRLLPKPLRL LQADLFFNFP HTAXVIADNL PATPSRRAET DTRGFQHNRF
301 MSLLRQGQCS AQTTQSAADD TGIGFQTALK FRINSMRINR TEIIRRQIFL
351 KIRANHCVCF IRCIFGRNDT GCRAISSXQK IG*
```

Computer analysis of this amino acid sequence gave the following results:

Homology with a predicted ORF from *N. gonorrhoeae*

ORF 237 shows 86.1% identity over a 382 aa overlap with a predicted ORF (ORF 237.ng) from *N. gonorrhoeae*:

m237/g237

```
                        10        20        30        40        50        60
m237.pep       MRDKVGGNVALPAPRIFDFDIGKLRKNFKHILADKLGHTLRIVDKLVILTAEKQSAVRAE
               ||||||||:||||||||| :||||||||||||||||||| |||||:|||||||| |||||
g237           MRDKVGGNIALPAPRIFDSNIGKLRKNFKHILADKLGHTRRIVDKFVILTAEKQPAVRAE
                        10        20        30        40        50        60

                        70        80        90       100       110       120
m237.pep       AVIIQNMAVVAYCHIVTDKPFCARPQGFGRNNKGADSNRLAFQRPEYRVQTCISIDSIDH
               ||||||||||||||||:||||||| |||| ||||||:|||||||||||||| ||||:|||
g237           AVIIQNMAVVAYCHIVADKPFCARAQGFGGNNKGADGNRLAFQRPEYRVQTDISIDGIDH
                        70        80        90       100       110       120

                       130       140       150       160       170       180
m237.pep       IFALDAAFGRVNQPTVLMRFDARHRGLLENLRTGFGSGTSDAQSVSERMQVSGXGVELCP
               ||:||||||||||||||:||||||||||||||:|||||::::| | |||:: | |:||| 
g237           IFTLDAAFGRVNQPTVLIRFDARHRGLLENLRAGFGSGAGNTQRVIERMKMPGQGIELCA
                       130       140       150       160       170       180

                       190       200       210       220       230       240
m237.pep       LVHIAVKLLFQLGFIPKLIMTRTVMPLGVFMPLLQLFPMLRTDGNRGITALPITIDGMFA
               ||||||||||||||||||||||||||||||||||||||||||||||||||||||:|||||
g237           LVHIAVKLLFQLGFIPKLIMTRTVMPLGVFMPLLQLFPMLRTDGNRGITALPIAIDGMFA
                       190       200       210       220       230       240

                       250       260       270       280       290       300
m237.pep       DAFVHQFDRLQRLLPKPLRLLQADLFFNFPHTAXVIADNLPATPSRRAETDTRGFQHNRF
               ||||||||||||||||||||||||||||||||| |:||||||||: |||:|| |||:: |
g237           DAFVHQFDRLQRLLPKPLRLLQADLFFNFPHTAGVVADNLPATPAGRAEADTCGFQNDGF
                       250       260       270       280       290       300

                       310       320       330       340       350       360
m237.pep       MSLLRQGQCSAQTTQSAADDTGIGFQTALKFRINSMRINRTEIIRRQIFLKIRANHCVCF
               ||::|| ||::||:|:|||::|:||||||:|||||||||||:||||||||||||||||||
g237           MSVFRQRQCGTQTAQTAADNAGFGFQTALEFRINSMRINRTKIIRRQIFLKIRANHCVCF
                       310       320       330       340       350       360

                       370       380
m237.pep       IRCIFGRNDTGCRAISSXQKIGX
               |  ||||||| |||||| |||||
g237           IGYIFGRNDTDCRAISSKQKIGX
                       370       380
```

The following partial DNA sequence was identified in *N. meningitidis* <SEQ ID 885>:

a237.seq

```
  1 ATGCGGGACA AGGTTGGCGG TAATGTCGCA CTCCCCGCCC CACGAATATT

 51 CGATTTTGAC ATCGGCAAGC TGCGGAAAAA CTTTAAGCAT ATCTTGGCGG

101 ACAAGCTCGG TCATACGCGC GGGATTGTCG ATAAACTCGT TATCCTTACC

151 GCCGAAAAGC AGTCTGCCGT CCGCGCTGAG GCGGTAATAA TCCAAAATAT

201 GACGGTTGTC GCATACTGCC ATATTGTTGC GGATAAGCCC TTTTGCACGC

251 GCGCCCAAGG GTTCTGTGGC AATAATAAAG GTGCTGACAG CAATCGCCTT

301 GCGCTCCAAA GGCTTGAATA TCGGATTCAA ACCGGCATAA GTATTGACGG

351 CGTACACCAG ATTTTTGCAT TCGACGCTGC CTTCGGGGGT GTAAACCAGC

401 CAACCGTTTT GATAAGGTTC AATGCGTATC ATGGGAGAAT GCTCAAAAAT

451 CTTCGTACCA GCTTCGGCAG CGGCGCGGGC GATGCCCAAC GTGTAATTGA

501 GCGGATGGAG ATGCCCGGAC AAGGGATCGA ACTGTGCGCC TTGGTACATA

551 TCGCTGTCAA GCTGCTGCTT CAGTTCAGTG TTATCCCAGA GTTGATAATG

601 AGTTGCACCG TAATATTTTT GGGCGTGCTC ATGCCATTGT TGCAATTCTT

651 CCCAATGCTG CGAACGGATG GCAACCGTGG CATAACCGCG CTGCCAATCG

701 CAATCAATGG CATGTTTGCG GACGCGTTCG TCCACCAGTT CGACCGCCTG

751 CAAAGACTGT TGCCAAAACC ATTGCGCTTG CTCCAAACCG ACCTGTTTTT

801 CAATTTCCTC CATACCGCAG GCGTAATCGC TGATAACCTG CCCGCCACTC
```

-continued

```
 851 CGTCCCGACG CGCCGAAACC GATACGCGCG GCTTCCAACA CAACCGTTTC

 901 ATGTCCCTGC TCCGCCAAGG GCAATGCAGT GCACAAACCA CTCAATCCGC

 951 CGCCGATGAT ACAGGTATCG GTTTTCAGAC GGCATTGAAG TTTCGGATAA

1001 ACAGTATGAG GATTAACCGA ACTGAAATAA TAAGAAGGCA GATATTCTTG

1051 AAAATCAGGG CGAATCATTG TGTTTGCTTT ATCGGGTATA TTTTCGGACG

1101 GAATGATACA GGCTGTCGAG CCATATCGTC CAAACAGAAA ATCGGTTGA
```

This corresponds to the amino acid sequence <SEQ ID 886; ORF 237.a>:

```
a237.pep

  1 MRDKVGGNVA LPAPRIFDFD IGKLRKNFKH ILADKLGHTR GIVDKLVILT

 51 AEKQSAVRAE AVIIQNMTVV AYCHIVADKP FCTRAQGFCG NNKGADSNRL

101 ALQRLEYRIQ TGISIDGVHQ IFAFDAAFGG VNQPTVLIRF NAYHGRMLKN

151 LRTSFGSGAG DAQRVIERME MPGQGIELCA LVHIAVKLLL QFSVIPELIM

201 SCTVIFLGVL MPLLQFFPML RTDGNRGITA LPIAINGMFA DAFVHQFDRL

251 QRLLPKPLRL LQTDLFFNFL HTAGVIADNL PATPSRRAET DTRGFQHNRF

301 MSLLRQGQCS AQTTQSAADD TGIGFQTALK FRINSMRINR TEIIRRQIFL

351 KIRANHCVCF IGYIFGRNDT GCRAISSKQK IG*
```

m237/a237 85.6% identity in 382 aa overlap

```
                    10        20        30        40        50        60
m237.pep    MRDKVGGNVALPAPRIFDFDIGKLRKNFKHILADKLGHTLRIVDKLVILTAEKQSAVRAE
            |||||||||||||||||||||||||||||||||||||||  |||||||||||||||||||
a237        MRDKVGGNVALPAPRIFDFDIGKLRKNFKHILADKLGHTRGIVDKLVILTAEKQSAVRAE
                    10        20        30        40        50        60

                    70        80        90       100       110       120
m237.pep    AVIIQNMAVVAYCHIVTDKPFCARPQGFGRNNKGADSNRLAFQRPEYRVQTCISIDSIDH
            |||||||:||||||||:|||||:| |||  |||||||||||:|| |||:|| ||||:: :
a237        AVIIQNMTVVAYCHIVADKPFCTRAQGFCGNNKGADSNRLALQRLEYRIQTGISIDGHHQ
                    70        80        90       100       110       120

                   130       140       150       160       170       180
m237.pep    IFALDAAFGRVNQPTVLMRFDARHRGLLENLRTGFGSGTSDAQSVSERMQVSGXGVELCP
            |||:||||| |||||||:||:| |  :|:||||:||||::||| | |||:: | |:|||
a237        IFAFDAAFGGVNQPTVLIRFNAYHGRMLKNLRTSFGSGAGDAQRVIERMEMPGQGIELCA
                   130       140       150       160       170       180

                   190       200       210       220       230       240
m237.pep    LVHIAVKLLFQLGFIPKLIMTRTVMPLGVFMPLLQLFPMLRTDGNRGITALPITIDGMFA
            |||||||||:|:: ||:|||: ||: |||:|||||:|||||||||||||||||:|:||||
a237        LVHIAVKLLLQFSVIPELIMSCTVIFLGVLMPLLQFFPMLRTDGNRGITALPIAINGMFA
                   190       200       210       220       230       240

                   250       260       270       280       290       300
m237.pep    DAFVHQFDRLQRLLPKPLRLLQADLFFNFPHTAXVIADNLPATPSRRAETDTRGRQHNRF
            ||||||||||||||||||||||:|||||| ||| ||||||||||||||||||||||||||
a237        DAFVHQFDRLQRLLPKPLRLLQTDLFFNFLHTAGVIADNLPATPSRRAETDTRGRQHNRF
                   250       260       270       280       290       300

                   310       320       330       340       350       360
m237.pep    MSLLRQGQCSAQTTQSAADDTGIGFQTALKFRINSMRINRTEIIRRQIFLKIRANHCVCF
            ||||||||||||||||||||||||||||||||||||||||||||||||||||||||||||
a237        MSLLRQGQCSAQTTQSAADDTGIGFQTALKFRINSMRINRTEIIRRQIFLKIRANHCVCF
                   310       320       330       340       350       360

                   370       380
m237.pep    IRCIFGRNDTGCRAISSXQKIGX
            |  |||||||||||||| |||||
a237        IGYIFGRNDTGCRAISSKQKIGX
                   370       380
```

The following partial DNA sequence was identified in *N. gonorrhoeae* <SEQ ID 887>:

g238.seq

```
   1 atgaatttgc ctattcaaaa attcatgatg ctgttggcag cggcaatatc
  51 gatgctgcat atccccatta gtcatgcgaa cggtttggat gcccgtttgc
 101 gcgatgatat gcaggcaaaa cactacgaac cgggtggcaa ataccatctg
 151 tttggtaatg ctcgcggcag tgttaaaaat cgggtttgcg ccgtccaaac
 201 atttgatgca actgcggtcg gccccatact gcctattaca cacgaacgga
 251 caggatttga aggtgttatc ggctatgaaa cccatttttc aggacacgga
 301 cacgaagtac acagtccgtt cgataatcat gattcaaaaa gcacttctga
 351 tttcagcggc ggcgtagacg gcggttttac cgtttaccaa cttcatcgga
 401 cagggtcgga aatacatccc gcagacggat atgacgggcc tcaaggcggc
 451 ggttatccgg aaccacaagg ggcaagggat atatacagct accatatcaa
 501 aggaacttca accaaaacaa agataaacac tgttccgcaa gccccttttt
 551 cagaccgctg gctaaaagaa aatgccggtg ccgcttccgg ttttctcagc
 601 cgtgcggatg aagcaggaaa actgatatgg gaaaacgacc ccgataaaaa
 651 ttggcgggct aaccgtatgg atgatattcg cggcatcgtc caaggtgcgg
 701 ttaatccttt tttaacgggt tttcaagggg tagggattgg ggcaattaca
 751 gacagtgcgg taagcccggt cacagataca gccgctcagc agactctaca
 801 aggtattaat gatttaggaa atttaagtcc ggaagcacaa cttgccgccg
 851 cgagcctatt acaggacagt gcctttgcgg taaaagacgg catcaattcc
 901 gccagacaat gggctgatgc ccatccgaat ataacagcaa cagcccaaac
 951 tgcccttgcc gtagcagagg ccgcaggtac ggtttggcgc ggtaaaaaag
1001 tagaacttaa cccgaccaaa tgggattggg ttaaaaatac cggctataaa
1051 aaacctgctg cccgccatat gcagactgta gatggggaga tggcaggggg
1101 gaatagaccg cctaaatcta taacgtcgga aggaaaagct aatgctgcaa
1151 cctatcctaa gttggttaat cagctaaatg agcaaaactt aaataacatt
1201 gcggctcaag atccaagatt gagtctagct attcatgagg gtaaaaaaaa
1251 ttttccaata ggaactgcaa cttatgaaga ggcagataga ctaggtaaaa
1301 tttgggttgg tgagggtgca agacaaacta gtggaggcqg atggttaagt
1351 agagatggca ctcgacaata tcggccacca acagaaaaaa aatcacaatt
1401 tgcaactaca ggtattcaag caaattttga aacttatact attgattcaa
1451 atgaaaaaag aaataaaatt aaaaatggac atttaaatat taggtaa
```

This corresponds to the amino acid sequence <SEQ ID 888; ORF 238.ng>:

g238.pep

```
   1 MNLPIQKFMM LLAAAISMLH IPISHANGLD ARLRDDMQAK HYEPGGKYHL
  51 FGNARGSVKN RVCAVQTFDA TAVGPILPIT HERTGFEGVI GYETHFSGHG
 101 HEVHSPFDNH DSKSTSDFSG GVDGGFTVYQ LHRTGSEIHP ADGYDGPQGG
 151 GYPEPQGARD IYSYHIKGTS TKTKINTVPQ APFSDRWLKE NAGAASGFLS
 201 RADEAGKLIW ENDPDKNWRA NRMDDIRGIV QGAVNPFLTG FQGVGIGAIT
```

-continued

```
251 DSAVSPVTDT AAQQTLQGIN DLGNLSPEAQ LAAASLLQDS AFAVKDGINS

301 ARQWADAHPN ITATAQTALA VAEAAGTVWR GKKVELNPTK WDWVKNTGYK

351 KPAARHMQTV DGEMAGGNRP PKSITSEGKA NAATYPKLVN QLNEQNLNNI

401 AAQDPRLSLA IHEGKKNFPI GTATYEEADR LGKIWVGEGA RQTSGGGWLS

451 RDGTRQYRPP TEKKSQFATT GIQANFETYT IDSNEKRNKI KNGHLNIR*
```

The following partial DNA sequence was identified in *N. meningitidis* <SEQ ID 889>:

m238.seq

```
   1 ATGAATTTGC CTATTCAAAA ATTCATGATG CTGTTTGCAG CAGCAATATC
  51 GTTGCTGCAA ATCCCCATTA GTCATGCGAA CGGTTTGGAT GCCCGTTTGC
 101 GCGATGATAT GCAGGCAAAA CAcTACGAAC CGGGTGGTAA ATACCATCTG
 151 TTTGGTAATG CTCGCGGCAG TGTTAAAAAG CGGGTTTACG CCGTCCAGAC
 201 ATTTGATGCA ACTGCGGTCA GTCCTGTACT GCCTATTACA CACGAACGGA
 251 CAGGGTTTGA AGGTGTTATC GGTTATGAAA CCCATTTTTC AGGGCACGGA
 301 CATGAAGTAC ACAGTCCGTT CGATCATCAT GATTCAAAAA GCACTTCTGA
 351 TTTCAGCGGC GGTGTAGACG GCGGTTTTAC TGTTTACCAA CTTCATCGAA
 401 CAGGGTCGGA AATCCATCCG GAGGATGGAT ATGACGGGCC GCAAGGCAGC
 451 GATTATCCGC CCCCCGGAGG AGCAAGGGAT ATATACAGCT ATTATGTCAA
 501 AGGAACTTCA ACAAAAACAA AGACTAATAT TGTCCCTCAA GCCCCATTTT
 551 CAGACCGTTG GCTAAAAGAA AATGCCGGTG CCGCCTCTGG TTTTTTCAGC
 601 CGTGCGGATG AAGCAGGAAA ACTGATATGG GAAAGCGACC CCAATAAAAA
 651 TTGGTGGGCT AACCGTATGG ATGATGTTCG CGGCATCGTC CAAGGTGCGG
 701 TTAATCCTTT TTTAATGGGT TTTCAAGGAG TAGGGATTGG GGCAATTACA
 751 GACAGTGCAG TAAGCCCGGT CACAGATACA GCCGCGCAGC AGACTCTACA
 801 AGGTATTAAT GATTTAGGAA AATTAAGTCC GGAAGCACAA CTTGCTGCCG
 851 CGAGCCTATT ACAGGACAGT GCTTTTGCGG TAAAAGACGG TATCAACTCT
 901 GCCAAACAAT GGGCTGATGC CCATCCAAAT ATAACAGCTA CTGCCCAAAC
 951 TGCCCTTTCC GCAGCAGAGG CCGCAGGTAC GGTTTGGAGA GGTAAAAAAG
1001 TAGAACTTAA CCCGACTAAA TGGGATTGGG TTAAAAATAC CGGTTATAAA
1051 AAACCTGCTG CCCGCCATAT GCAGACTTTA GATGGGGAGA TGGCAGGTGG
1101 GAATAAACCT ATTAAATCTT TACCAAACAG TGCCGCTGAA AAAAGAAAAC
1151 AAAATTTTGA GAAGTTTAAT AGTAACTGGA GTTCAGCAAG TTTTGATTCA
1201 GTGCACAAAA CACTAACTCC CAATGCACCT GGTATTTTAA GTCCTGATAA
1251 AGTTAAAACT CGATACACTA GTTTAGATGG AAAAATTACA ATTATAAAAG
1301 ATAACGAAAA CAACTATTTT AGAATCCATG ATAATTCACG AAAACAGTAT
1351 CTTGATTCAA ATGGTAATGC TGTGAAAACC GGTAATTTAC AAGGTAAGCA
1401 AGCAAAAGAT TATTTACAAC AACAAACTCA TATCAGGAAC TTAGACAAAT
1451 GA
```

This corresponds to the amino acid sequence <SEQ ID 890; ORF 238>:

m238.pep

```
  1 MNLPIQKFMM LFAAAISLLQ IPISHANGLD ARLRDDMQAK HYEPGGKYHL

 51 FGNARGSVKK RVYAVQTFDA TAVSPVLPIT HERTGFEGVI GYETHFSGHG

101 HEVHSPFDHH DSKSTSDFSG GVDGGFTVYQ LHRTGSEIHP EDGYDGPQGS

151 DYPPPGGARD IYSYYVKGTS TKTKTNIVPQ APFSDRWLKE NAGAASGFFS

201 RADEAGKLIW ESDPNKNWWA NRNDDVRGIV QGAVNPFLMG FQGVGIGAIT

251 DSAVSPVTDT AAQQTLQGIN DLGKLSPEAQ LAAASLLQDS AFAVKDGINS

301 AKQWADAHPN ITATAQTALS AAEAAGTVWR GKKVELNPTK WDWVKNTGYK

351 KPAARHMQTL DGEMAGGNKP IKSLPNSAAE KRKQNFEKFN SNWSSASFDS

401 VHKTLTPNAP GILSPDKVKT RYTSLDGKIT IIKDNENNYF RIHDNSRKQY

451 LDSNGNAVKT GNLQGKQAKD YLQQQTHIRN LDK*
```

Computer analysis of this amino acid sequence gave the following results:

Homology with a predicted ORF from *N. gonorrhoeae*

ORF 238 shows 86.0% identity over a 401 aa overlap with a predicted ORF (ORF 238.ng) from *N. gonorrhoeae*:

m238/g238

```
                      10        20        30        40        50        60
m238.pep      MNLPIQKFMMLFAAAISLLQIPISHANGLDARLRDDMQAKHYEPGGKYHLFGNARGSVKK
              |||||||||||:|||||:|:|||||||||||||||||||||||||||||||||||||||:
g238          MNLPIQKFMMLLAAAISMLHIPISHANGLDARLRDDMQAKHYEPGGKYHLFGNARGSVKN
                      10        20        30        40        50        60

                      70        80        90       100       110       120
m238.pep      RVYAVQTFDATAVSPVLPITHERTGFEGVIGYETHFSGHGHEVHSPFDHHDSKSTSDFSG
              || |||||||||||:|:||||||||||||||||||||||||||||||||:||||||||||
g238          RVCAVQTFDATAVGPILPITHERTGFEGVIGYETHFSGHGHEVHSPFDNHDSKSTSDFSG
                      70        80        90       100       110       120

                     130       140       150       160       170       180
m238.pep      GVDGGFTVYQLHRTGSEIHPEDGYDGPQGSDYPPPGGARDIYSYYVKGTSTKTKTNIVPQ
              |||||||||||||||||||| ||||||||: || ||||||||||::|||||||| | |||
g238          GVDGGFTVYQLHRTGSEIHPADGYDGPQGGGYPEPGGARDIYSYHIKGTSTKTKINTVPQ
                     130       140       150       160       170       180

                     190       200       210       220       230       240
m238.pep      APFSDRWLKENAGAASGFFSRADEAGKLIWESDPNKNWWANRMDDVRGIVQGAVNPFLMG
              ||||||||||||||||||:||||||||||||:||:||| ||||||:|||||||||||| |
g238          APFSDRWLKENAGAASGFLSRADEAGKLIWENDPDKNWRANRMDDIRGIVQGAVNPFLTG
                     190       200       210       220       230       240

                     250       260       270       280       290       300
m238.pep      FQGVGIGAITDSAVSPVTDTAAQQTLQGINDLGKLSPEAQLAAASLLQDSAFAVKDGINS
              |||||||||||||||||||||||||||||||||:||||||||||||||||||||||||||
g238          FQGVGIGAITDSAVSPVTDTAAQQTLQGINDLGNLSPEAQLAAASLLQDSAFAVKDGINS
                     250       260       270       280       290       300

                     310       320       330       340       350       360
m238.pep      AKQWADAHPNITATAQTALSAAEAAGTVWRGKKVELNPTKWDWVKNTGYKKPAARHMQTL
              |:|||||||||||||||||::||||||||||||||||||||||||||||||||||||||:
g238          ARQWADAHPNITATAQTALAVAEAAGTVWRGKKVELNPTKWDWVKNTGYKKPAARHMQTV
                     310       320       330       340       350       360

                     370       380       390       400       410       420
m238.pep      DGEMAGGNKPIKSLPNSAAEKRKQNFEKFNSNWSSASFDSVHKTLTPNAPGILSPDKVKT
              ||||||||:| ||: :| ::    :: |: :: :  :::::
g238          DGEMAGGNRPPKSI-TSEGKANAATYPKLVNQLNEQNLNNIAAQDPRLSLAIHEGKKNFP
                     370        380       390       400       410

                     430       440       450       460       470       480
m238.pep      RYTSLDGKITIIKDNENNYFRIHDNSRKQYLDSNGNAVKTGNLQGKQAKDYLQQQTHIRN

g238          IGTATYEEADRLGKIWVGEGARQTSGGGWLSRDGTRQYRPPTEKKSQFATTGIQANFETY
                      430       440       450       460       470
```

The following partial DNA sequence was identified in *N. meningitidis* <SEQ ID 891>:

a238.seq (partial)

```
   1 ATGAATTTGC CTATTCAAAA ATTCATGATG CTGTTTGCAG CAGCAATATC
  51 GTTGCTGCAA ATCCCCATTA GTCATGCGAA CGGTTTGGAT GCCCGTTTGC
 101 GCGATGATAT GCAGGCAAAA CACTACGAAC CGGGTGGTAA ATACCATCTG
 151 TTTGGTAATG CTCGCGGCAG TGTTAAAAAT CGGGTTTACG CCGTCCAAAC
 201 ATTTGATGCA ACTGCGGTCG GCCCCATACT GCCTATTACA CACGAACGGA
 251 CAGGATTTGA AGGCATTATC GGTTATGAAA CCCATTTTTC AGGACATGGA
 301 CATGAAGTAC ACAGTCCGTT CGATAATCAT GATTCAAAAA GCACTTCTGA
 351 TTTCAGCGGC GGCCTAGACG GTGGTTTTAC CGTTTACCAA CTTCATCGGA
 401 CAGGGTCGGA AATCCATCCG GAGGATGGAT ATGACGGGCC GCAAGGCAGC
 451 GATTATCCGC CCCCCGGAGG AGCAAGGGAT ATATACAGCT ACTATGTCAA
 501 AGGAACTTCA ACAAAAACAA AGAGTAATAT TGTTCCCCGA GCCCCATTTT
 551 CAGACCGCTG GCTAAAAGAA AATGCCGGTG CCGCCTCTGG TTTTTTCAGC
 601 CGTGCTGATG AAGCAGGAAA ACTGATATGG GAAAGCGACC CCAATAAAAA
 651 TTGGTGGGCT AACCGTATGG ATGATATTCG CGGCATCGTC CAAGGTGCGG
 701 TTAATCCTTT TTTAATGGGT TTTCAAGGAG TAGGGATTGG GGCAATTACA
 751 GACAGTGCAG TAAGCCCGGT CACAGATACA GCCGCGCAGC AGACTCTACA
 801 AGGTATTAAT CATTTAGGAA ATTTAAGTCC CGAAGCACAA CTTGCGGCTG
 851 CAACCGCATT ACAAGACAGT GCTTTTGCGG TAAAAGACGG TATCAATTCC
 901 GCCAGACAAT GGGCTGATGC CCATCCGAAT ATAACTGCAA CAGCCCAAAC
 951 TGCCCTTGCC GTAGCAGAGG CCGCAACTAC GGTTTGGGGC GGTAAAAAAG
1001 TAGAACTTAA CCCGACCAAA TGGGATTGGG TTAAAAATAC CGGCTATAAA
1051 ACACCTGCTG TTCGCACCAT GCATACTTTG GATGGGGAAA TGGCCGGTGG
1101 GAATAGACCG CCTAAATCTA TAACGTCCAA CAGCAAAGCA GATGCTTCCA
1151 CACAA
```

This corresponds to the amino acid sequence <SEQ ID 892; ORF 238.a>:

a238.pep (partial)

```
  1 MNLPIQKFMM LFAAAISLLQ IPISHANGLD ARLRDDMQAK HYEPGGKYHL
 51 FGNARGSVKN RVYAVQTFDA TAVGPILPIT HERTGFEGII GYETHFSGHG
101 HEVHSPFDNH DSKSTSDFSG GVDGGFTVYQ LHRTGSEIHP EDGYDGPQGS
151 DYPPPGGARD IYSYYVKGTS TKTKSNIVPR APFSDRWLKE NAGAASGFFS
201 RADEAGKLIW ESDPNKNWWA NRMDDIRGIV QGAVNPFLMG FQGVGIGAIT
251 DSAVSPVTDT AAQQTLQGIN HLGNLSPEAQ LAAATALQDS AFAVKDGINS
301 ARQWADAHPN ITATAQTALA VAEAATTVWG GKKVELNPTK WDWVKNTGYK
351 TPAVRTMHTL DGEMAGGNRP PKSITSNSKA DASTQ
```

m238/a238 91.9% identity in 385 aa overlap

```
                    10         20         30         40         50         60
m238.pep    MNLPIQKFMMLFAAAISLLQIPISHANGLDARLRDDMQAKHYEPGGKYHLFGNARGSVKK
            |||||||||||||||||||||||||||||||||||||||||||||||||||||||||||:
a238        MNLPIQKFMMLFAAAISLLQIPISHANGLDARLRDDMQAKHYEPGGKYHLFGNARGSVKN
                    10         20         30         40         50         60

                    70         80         90        100        110        120
m238.pep    RVYAVQTFDATAVSPVLPITHERTGFEGVIGYETHFSGHGHEVHSPFDHHDSKSTSDFSG
            |||||||||||||:|:||||||||||||:|||||||||||||||||||:|||||||||||
a238        RVYAVQTFDATAVGPILPITHERTGFEGIIGYETHFSGHGHEVHSPFDNHDSKSTSDFSG
                    70         80         90        100        110        120

                   130        140        150        160        170        180
m238.pep    GVDGGFTVYQLHRTGSEIHPEDGYDGPQGSDYPPPGGARDIYSYYVKGTSTKTKTNIVPQ
            ||||||||||||||||||||||||||||||||||||||||||||||||||||||:||||:
a238        GVDGGFTVYQLHRTGSEIHPEDGYDGPQGSDYPPPGGARDIYSYYVKGTSTKTKSNIVPR
                   130        140        150        160        170        180

                   190        200        210        220        230        240
m238.pep    APFSDRWLKENAGAASGFFSRADEAGKLIWESDPNKNWWANRMDDVRGIVQGAVNPFLMG
            |||||||||||||||||||||||||||||||||||||||||||||:||||||||||||||
a238        APFSDRWLKENAGAASGFFSRADEAGKLIWESDPNKNWWANRMDDIRGIVQGAVNPFLMG
                   190        200        210        220        230        240

                   250        260        270        280        290        300
m238.pep    FQGVGIGAITDSAVSPVTDTAAQQTLQGINDLGKLSPEAQLAAASLLQDSAFAVKDGINS
            |||||||||||||||||||||||||||||| ||:||||||||||: ||||||||||||||
a238        FQGVGIGAITDSAVSPVTDTAAQQTLQGINHLGNLSPEAQLAAATALQDSAFAVKDGINS
                   250        260        270        280        290        300

                   310        320        330        340        350        360
m238.pep    AKQWADAHPNITATAQTALSAAEAAGTVWRGKKVELNPTKWDWVKNTGYKKPAARHMQTL
            |:|||||||||||||||||::|||| ||| |||||||||||||||||||| ||:| |:||
a238        ARQWADAHPNITATAQTALAVAEAATTVWGGKKVELNPTKWDWVKNTGYKTPAVRHMHTL
                   310        320        330        340        350        360

                   370        380        390        400        410        420
m238.pep    DGEMAGGNKPIKSLP-NSAAEKRKQNFEKFNSNWSSASFDSVHKTLTPNAPGILSPDKVK
            ||||||||:| ||:  || |:    |
a238        DGEMAGGNRPPKSLTSNSKADASTQ
```

The following partial DNA sequence was identified in *N. gonorrhoeae* <SEQ ID 893>:

<u>g239.seq</u>

```
  1 atgttccacc ataaaggtat tgcccgaaac cggcggatgg aggttttgtt
 51 tttctgccgc cgccctgatc gcttcgtgat tcgccaaacg cgcctgttgc
101 agcctcattt gcgcataatc ctgctccaag gcgatttcct gttttttcgc
151 cttgtccaaa gctgtgaagt tgagcctgta ctggttttgc tgcatcacaa
201 cggaaaaagc ggaaacgcac accgcaagca gcagaaagaa attcgatttg
251 ttcattgccg ttcagacgtt tttctctgtt attattccgg tatcggaccg
301 gcagtccgct ccgccacacg caaaactgcg ctcctcgccc tcgggttggc
351 ggcaatttcc gcttcacccg gctttaatgc cctgcccacg attttcaggg
401 gcggatcggg caaatccgct tctctgaccg ccgcccagct cggcaggggc
451 tcgtgttgcg aatatttttt gacaaactgc ttcacaatgc ggtcttccaa
501 cgaatggaaa gcaatgaccg ccaaacgccc gccctctttc agacggcaca
551 tgacctgcgg caataccgcc cctacttctt caagctcgcg gttaataaag
601 atgcggattg cctggaaggt gcgcgtcgca ggatcctgcc cccgctcgcg
651 agtacggacg ttttgtgcca cgatctgcgc cagcttgcgg gttgtatcga
701 ttggactttc cgcccgttgc gcgacaatgg cgcgcacaat ctggcggcta
751 aaccgctctt caccataa
```

This corresponds to the amino acid sequence <SEQ ID 894; ORF 239.ng>:

g239.pep

```
  1 MFHHKGIARN RRMEVLFFCR RPDRFVIRQT RLLQPHLRII LLQGDFLFFR
 51 LVQSCEVEPV LVLLHHNGKS GNAHRKQQKE IRFVHCRSDV FLCYYSGIGP
101 AVRSATRKTA LLALGLAAIS ASPGFNALPT IFRGGSGKSA SLTAAQLGRG
151 SCCEYFLTNC FTMRSSNEWK AMTAKRPPSF RRHMTCGNTA PTSSSSRLIK
201 MRIAWKVRVA GSCPRSRVRT FCATICASLR VVSIGLSARC ATMARTIWRL
251 NRSSP*
```

The following partial DNA sequence was identified in *N. meningitidis* <SEQ ID 895>:

m239.seq

```
  1 ATGCTCCACC ATAAAGGTmy kGCCCGAAAC CGGCkGATGG AGGTTTTGTT
 51 TTTCTGCCGC CGCCCTGATC GCTTCGTGGT TCGCCAAACG CGCCTGTTGC
101 AGCCTCATTT GCGCATAATC CTGCTCCAAG GCGATTTCCT GTTTTTTCGC
151 CTTATCCAAA GCTGTGAAAT TGAGCCTGTA CTGGTTTTGC TGCATCACAA
201 CGGAAAAAGC GGAAACGCAC ACCGCAAGCA GCAGAAGGAA ATTCAATTTG
251 TTCATTGCCA TTCAGACGTT TTTCTCTGTG ATTGTTCCGG TATCGGACCG
301 GCAGTCCGCT CCGCCACACG CAAAACCGCA CTTCTCGCCC TCGGATTGGC
351 GGCAATTTCC GCCTCACCCG GCTTTAATGC CCTGCCCACG ATTTTCAGGG
401 GCAGCTCGGG CAAATCCGCT TCCCTGaCCG CCGCCCAGCG CGGCAGGGGC
451 GCGTGTTGCG AATATTTTTT GACAAACTGC TTCACAATGC GATCTTCCAA
501 CGAATGGAAA GCAATGACCG CCAAACGTCC GCCCTCTTTC AGACGACACA
551 TGACCTGCGG CAATACTGCC CCTACTTCTT CAAGCTCGCG GTTAATAAAG
601 ATGCGGACCG CCTGGAAGGT GCGCGTCGCA GGATCCTGCC CCCGCTCGCG
651 AGTACGGACG TTTTGTGCCA CGATCTGCGC CAGCTTGCGG GTTGTATCGA
701 TTGGACTTTC CGCCCGTTGC GCAACAATGG CGCGCGCAAT cCGGCGGCTa
751 AACCGCTCTT cACCATAA
```

This corresponds to the amino acid sequence <SEQ ID 896; ORF 239>:

m239.pep

```
  1 MLHHKGXARN RXMEVLFFCR RPDRFVVRQT RLLQPHLRII LLQGDFLFFR
 51 LIQSCEIEPV LVLLHHNGKS GNAHRKQQKE IQFVHCHSDV FLCDCSGIGP
101 AVRSATRKTA LLALGLAAIS ASPGFNALPT IFRGSSGKSA SLTAAQRGRG
151 ACCEYFLTNC FTMRSSNEWK AMTAKRPPSF RRHMTCGNTA PTSSSSRLIK
201 MRTAWKVRVA GSCPRSRVRT FCATICASLR VVSIGLSARC ATMARAIRRL
251 NRSSP*
```

Computer analysis of this amino acid sequence gave the following results:

Homology with a predicted ORF from *N. gonorrhoeae*

ORF 239 shows 93.7% identity over a 255 aa overlap with a predicted ORF (ORF 239.ng) from *N. gonorrhoeae*:

```
m239/g239

                   10        20        30        40        50        60
m239.pep    MLHHKGXARNRXMEVLFFCRRPDRFVVRQTRLLQPHLRIILLQGDFLFFRLIQSCEIEPV
            |:||||||||| ||||||||||||||:|||||||||||||||||||||||:||||:|||
g239        MFHHKGXARNRRMEVLFFCRRPDRFVIRQTRLLQPHLRIILLQGDFLFFRLVQSCEVEPV
                   10        20        30        40        50        60

                   70        80        90       100       110       120
m239.pep    LVLLHHNGKSGNAHRKQQKEIQFVHCHSDVFLCDCSGIGPAVRSATRKTALLALGLAAIS
            |||||||||||||||||||||:||||:||||||  ||||||||||||||||||||||||
g239        LVLLHHNGKSGNAHRKQQKEIRFVHCRSDVFLCYYSGIGPAVRSATRKTALLALGLAAIS
                   70        80        90       100       110       120

                  130       140       150       160       170       180
m239.pep    ASPGFNALPTIFRGSSGKASALTAAQRGRGACCEYFLTNCFTMRSSNEWKAMTAKRPPSF
            ||||||||||||||:||||||||||| |||:||||||||||||||||||||||||||||
g239        ASPGFNALPTIFRGGSGKASALTAAQLGRGSCCEYFLTNCFTMRSSNEWKAMTAKRPPSF
                  130       140       150       160       170       180

                  190       200       210       220       230       240
m239.pep    RRHMTCGNTAPTSSSSRLIKMRTAWKVRVAGSCPRSRVRTFCATICASLRVVSIGLSARC
            |||||||||||||||||||||| |||||||||||||||||||||||||||||||||||||
g239        RRHMTCGNTAPTSSSSRLIKMRIAWKVRVAGSCPRSRVRTFCATICASLRVVSIGLSARC
                  190       200       210       220       230       240

                  250
m239.pep    ATMARAIRRLNRSSPX
            |||||:| ||||||||
g239        ATMARTIWRLNRSSPX
                  250
```

The following partial DNA sequence was identified in *N. meningitidis* <SEQ ID 897>:

```
a239.seq

  1 ATGCTCCACC ATAAAGGTAT TGCCCGAAAC CGGCGGATGG AGGTTTTGTT
 51 TTTCTGCCGC CGCCCTGATC GCTTCGTGGT TCGCCAAACG CGCCTGTTGC
101 AGCCTCATTT GCGCATAATC CTGCTCCAAG GCGATTTCCT GTTTTTTCGC
151 CTTATCCAAA GCTGTGAAGT TGAGCCTGTA CTGGTTTTGC TGCATCACAA
201 CGGAAAAAGC GGAAACGCAC ACCGCAAGCA GCAGAAGGAA ATTCAATTTG
251 TTCATTGCCA TTCAGACGTT TTTCTCTGTG ATTGTTCCGG TATCGGACCC
301 GCAGTCCGCT CCGCCACACG CAAAACCGCA CTTCTCGCCC TCGGATTGGC
351 GGCAATTTCC GCCTCACCCG GCTTTAATGC CCTGCCCGCG ATTTTCAGGG
401 GCGGCTCGGG CAAATCCGCT TCCCTGACCG CCGCCCAGCG CGGCAGGGGC
451 GCGTGTTGCG AATATTTTTT GACAAACTGC TTCACAATGC GGTCTTCCAA
501 CGAATGGAAA GCAATGACCG CCAAACGTCC GCCCTCTTTC AGAGGACACA
551 TGACCTGCGG CAATACTGCC CCTACTTCTT CAAGCTCGCG GTTAATAAAG
601 ATGCGGATTG CCTGGAAGGT GCGCGTCGCA GGATCCTGCC CCCGCTCGCG
651 AGTACGGACG TTTTGTGCCA CGATCTGCGC CAGCTTGCGG GTTGTATCGA
701 TTGGACTTTC CGCCCGTTGC GCAACAATGG CGCGCGCAAT CTGGCGGCTA
751 AACCGCTCTT CACCATAA
```

This corresponds to the amino acid sequence <SEQ ID 898; ORF 239.a>:

a239.pep

```
  1 MLHHKGIARN RRMEVLFFCR RPDRFVVRQT RLLQPHLRII LLQGDFLFFR
 51 LIQSCEVEPV LVLLHHNGKS GNAHRKQQKE IQFVHCHSDV FLCDCSGIGP
101 AVRSATRKTA LLALGLAAIS ASPGFNALPA IFRGGSGKSA SLTAAQRGRG
151 ACCEYFLTNC FTMRSSNEWK ANTAKRPPSF RRHMTCGNTA PTSSSSRLIK
201 MRIAWKVRVA GSCPRSRVRT FCATICASLR VVSIGLSARC ATMARAIWRL
251 NRSSP*
```

m239/a239 97.3% identity in 255 aa overlap

```
                    10        20        30        40        50        60
m239.pep    MLHHKGXARNRXMEVLFFCRRPDRFVVRQTRLLQPHLRIILLQGDFLFFRLIQSCEIEPV
            |||||| |||| ||||||||||||||||||||||||||||||||||||||||||||:|||
a239        MLHHKGIARNRRMEVLFFCRRPDRFVVRQTRLLQPHLRIILLQGDFLFFRLIQSCEVEPV
                    10        20        30        40        50        60
                    70        80        90       100       110       120
m239.pep    LVLLHHNGKSGNAHRKQQKEIQFVHCHSDVFLCDCSGIGPAVRSATRKTALLALGLAAIS
            ||||||||||||||||||||||||||||||||||||||||||||||||||||||||||||
a239        LVLLHHNGKSGNAHRKQQKEIQFVHCHSDVFLCDCSGIGPAVRSATRKTALLALGLAAIS
                    70        80        90       100       110       120
                   130       140       150       160       170       180
m239.pep    ASPGFNALPTIFRGSSGKSASLTAAQRGRGACCEYFLTNCFTMRSSNEWKAMTAKRPPSF
            |||||||||:||||:|||||||||||||||||||||||||||||||||||||||||||||
a239        ASPGFNALPAIFRGGSGKSASLTAAQRGRGACCEYFLTNCFTMRSSNEWKAMTAKRPPSF
                   130       140       150       160       170       180
                   190       200       210       220       230       240
m239.pep    RRHMTCGNTAPTSSSSRLIKMRTAWKVRVAGSCPRSRVRTFCATICASLRVVSIGLSARC
            |||||||||||||||||||||| |||||||||||||||||||||||||||||||||||||
a239        RRHMTCGNTAPTSSSSRLIKMRIAWKVRVAGSCPRSRVRTFCATICASLRVVSIGLSARC
                   190       200       210       220       230       240
                   250
m239.pep    ATMARAIRRLNRSSPX
            ||||||| ||||||||
a239        ATMARAIWRLNRSSPX
                   250
```

The following partial DNA sequence was identified in *N. gonorrhoeae* <SEQ ID 899>:

g240.seq

```
  1 atgatagaag tcatacattt cttcggcgcc gaaacgcgca gacagtttgc
 51 ttgtgccgac gttggacgat ttctgcataa tgccgcgcac atccaaagag
101 gggtaaacat gggtatcatc gcgcacggga gacggtccga ttttataagg
151 ctgcgtattc agccgttcgt tcaaatcggt tttgcccgca tccaatgcct
201 tcgcaatcac gaacggtttg attgccgaac caggttcgat catatcggtt
251 acggcacggt tgcgccgctg ttcgctgtct gcccggccgg gtctgttggg
301 atcgtaggcy ggcgtattgg ccaaggcgag gatttccccc gtgcgggcat
351 ccaaaaccac caccgttccg gcttttgcct gatggtattc gaccgccttg
401 ttcaactctt cataggccaa ggtctgaatc ctctgatcga gggaaaggat
451 gatgtctttg ccgttttgcg gtgctttatt gcgcggggag tccaagctgt
501 ccacaatatt gccctgccgg tcccgcaaaa caacttccgc gccgtcttcg
551 ceatacaggc tgtcttcaag cgaaagttcc aaaccttcct gacctttgcc
601 gtcaatatcg gtaaatccga tgacgtgtgc aaacaggttg cccatcgggt
651 aatggcgttt taa
```

This corresponds to the amino acid sequence <SEQ ID 900; ORF 240.ng>:

g240.pep

```
  1 MIEVIHFFGA ETRRQFACAD VGRFLHNAAH IQRGVNMGII AHGRRSDFIR
 51 LRIQPFVQIG FARIQCLRNH ERFDCRTRFD HIGYGTVAPL FAVCPAGSVG
101 IVGGRIGQGE DFPRAGIQNH HRSGFCLMVF DRLVQLFIGQ GLNPLIEGKD
151 DVFAVLRCFI ARGVQAVHNI ALPVPQNNFR AVFAIQAVFK RKFQTFLTFA
201 VNIGKSDDVC KQVAHRVMAF*
```

The following partial DNA sequence was identified in *N. meningitidis* <SEQ ID 901>:

m240.seq

```
  1 ATGATAGAAG TCATACATTT CTTCGGCACC GAAACGCGCA GACAGTTTGC
 51 TTGTGCCGAC GTTGGACGAT TTCTGCATGA TGCCGCGCAC ATCCAAAGAG
101 GGGTAAACAT GGGTATCGCG CACGGGAGAC GGTCCGATTT TATAAGGCTG
151 CGTATTCAGC CGTTCGTTCA AATCGGTTTT GCCCGCATCC AATGCCTTCG
201 CAATCACAAA CGGTTTGATT GCCGAACCGG GTTCGATCAT ATCGGTTACG
251 GCACGGTTGC GCCGCTGTTC GCTGTCTGCC CGGCCGGGCC TGTTGGGATC
301 GTAGGCGGGC GTATTGGCCA AGGCGAGGAT TTCCCCCGTG CGGGCATCCA
351 ArACCACCAC CGTTCCGGCT TTTGCCTGAT GGTATTCGAC CGCCTTGTTC
401 AACTCTTCAT AGGCCAAGGT CTGAATCCTC TGATCGAGGG AAAGGATGAT
451 GTCTTTGCCG TTTTTCGGGG CTTTAkTGCG CGGGGAGTCC AAGCTGTCCA
501 CAATATTGCC CTGCCGGTCC CGCAAAACGA CTTCCGCGCC GTCTTCGCCA
551 TGCAAGCTGT CTTCAAGCGA AAGTTCCAAA CCTTCCTGAC CTTTGCCGTC
601 AATATCGGTA AATCCGATGA CGTGTGCAAA CAGGTTGCCC ATCGGGTAAT
651 GGCGTTTTAA
```

This corresponds to the amino acid sequence <SEQ ID 902, ORF 240>:

m240.pep

```
  1 MIEVIHFFGT ETRRQFACAD VGRFLHDAAH IQRGVNMGIA HGRRSDFIRL
 51 RIQPFVQIGF ARIQCLRNHK RFDCRTGFDH IGYGTVAPLF AVCPAGPVGI
101 VGGRIGQGED FPRAGIQXHH RSGFCLMVFD RLVQLFIGQG LNPLIEGKDD
151 VFAVFRGFXA RGVQAVHNIA LPVPQNDFRA VFAMQAVFKR KFQTFLTFAV
201 NIGKSDDVCK QVAHRVMAF*
```

Computer analysis of this amino acid sequence gave the following results:

Homology with a predicted ORF from *N. gonorrhoeae*

ORF 240 shows 94.5% identity over a 220 aa overlap with a predicted ORF (ORF 240.ng) from *N. gonorrhoeae*:

m240/g240

```
                10        20        30         40        50        60
m240.pep   MIEVIHFFGTETRRQFACADVGRFLHDAAHIQRGVNMGI-AHGRRSDFIRLRIQPFVQIG
           |||||||||:||||||||||||||||:|||||||||||| ||||||||||||||||||||
g240       MIEVIHFFGAETRRQFACADVGRFLHNAAHIQRGVNMGIIAHGRRSDFIRLRIQPFVQIG
                10        20        30         40        50        60

          60        70        80        90       100       110       119
m240.pep   FARIQCLRNHKRFDCRTGFDHIGYGTVAPLFAVCPAGPVGIVGGRIGQGEDFPRAGIQXH
           ||||||||||:|||||| ||||||||||||||||||| |||||||||||||||||||| |
g240       FARIQCLRNHERFDCRTRFDHIGYGTVAPLFAVCPAGSVGIVGGRIGQGEDFPRAGIQNH
                70        80        90       100       110       120

         120       130       140       150       160       170       179
m240.pep   HRSGFCLMVFDRLVQLFIGQGLNPLIEGKDDVFAVFRGFXARGVQAVHNIALPVPQNDFR
           |||||||||||||||||||||| ||||||||||||:| | ||||||||||||||||:||
g240       HRSGFCLMVFDRLVQLFIGQGLNPLIEGKDDVFAVLRCFIARGVQAVHNIALPVPQNNFR
               130       140       150       160       170       180

         180       190       200       210       220
m240.pep   AVFAMQAVFKRKFQTFLTFAVNIGKSDDVCKQVAHRVMAFX
           ||||:|||||||||||||||||||||||||||||||
g240       AVFAIQAVFKRKFQTFLTFAVNIGKSDDVCKQVAHRVMAF
               190       200       210       220
```

The following partial DNA sequence was identified in *N. meningitidis* <SEQ ID 903>:

a240.seq

```
  1 ATGATAGAAG TCATACATTT CTTCGGCACC GAAACGCGCA GACAGTTTGC
 51 TTGTGCCGAC GTTGGACGAT TTCTGCATGA TGCCGCGCAC ATCCAAAGAG
101 GGGTAAACAT GGGTATCGCG CACGGGAGAC GGTCCGATTT TATAAGGCTG
151 CGTATTCAGC CGTTCGTTCA AATCGGTTTT GCCCGCATCC AATGCCTTCG
201 CAATCACAAA CGGTTTGATT GCCGAACCGG GTTCGATCAT ATCGGTTACG
251 GCACGGTTGC GCCGCTGTTC GCTGTCTGCC CGGCCGGGCC TGTTGGGATC
301 GTAGGCGGGC GTATTGGCCA AGGCGAGGAT TTCCCCCGTG CGGGCATCCA
351 AAACCACCAC CGTTCCGGCT TTTGCCTGAT GGTATTCGAC CGCCTTGTTC
401 AACTCTTCAT AGGCCAAGGT CTGAATCCTC TGATCGAGGG AAAGGATGAT
451 GTCTTTGCCG TTTTTCGGGG CTTTATTGCG CGGGGAGTCC AAGCTGTCCA
501 CAATATTGCC CTGCCGGTCC CGCAAAACGA CTTCCGCGCC GTCTTCGCCA
551 TGCAGGCTGT CTTCAAGCGA AAGTTCCAAA CCTTCCTGAC CTTTGCCGTC
601 AATATCGGTA AATCCGATGA CGTGTGCAAA CAGGTTGCCC ATCGGGTAAT
651 GGCGTTTTAA
```

This corresponds to the amino acid sequence <SEQ ID 904; ORF 240.a>:

a240.pep

```
  1 MIEVIHFFGT ETRRQFACAD VGRFLHDAAH IQRGVNMGIA HGRRSDFIRL
 51 RIQPFVQIGF ARIQCLRNHK RFDCRTGFDH IGYGTVAPLF AVCPAGPVGI
101 VGGRIGQGED FPRAGIQNHH RSGFCLMVFD RLVQLFIGQG LNPLIEGKDD
151 VFAVFRGFIA RGVQAVHNIA LPVPQNDFRA VFAMQAVFKR KFQTFLTFAV
201 NIGKSDDVCK QVAHRVMAF*
```

m240/a240 99.1% identity in 219 aa overlap

```
                 10         20         30         40         50         60
m240.pep  MIEVIHFFGTETRRQFACADVGRFLHDAAHIQRGVNMGIAHGRRSDFIRLRIQPFVQIGF
          ||||||||||||||||||||||||||||||||||||||||||||||||||||||||||||
a240      MIEVIHFFGTETRRQFACADVGRFLHDAAHIQRGVNMGIAHGRRSDFIRLRIQPFVQIGF
                 10         20         30         40         50         60

                 70         80         90        100        110        120
m240.pep  ARIQCLRNHKRFDCRTGFDHIGYGTVAPLFAVCPAGPVGIVGGRIGQGEDFPRAGIQXHH
          ||||||||||||||||||||||||||||||||||||||||||||||||||||||||| ||
a240      ARIQCLRNHKRFDCRTGFDHIGYGTVAPLFAVCPAGPVGIVGGRIGQGEDFPRAGIQNHH
                 70         80         90        100        110        120

                130        140        150        160        170        180
m240.pep  RSGFCLMVFDRLVQLFIGQGLNPLIEGKDDVFAVFRGFXARGVQAVHNIALPVPQNDFRA
          |||||||||||||||||||||||||||||||||||||| |||||||||||||||||||||
a240      RSGFCLMVFDRLVQLFIGQGLNPLIEGKDDVFAVFRGFIARGVQAVHNIALPVPQNDFRA
                130        140        150        160        170        180

                190        200        210        220
m240.pep  VFAMQAVFKRKFQTFLTFAVNIGKSDDVCKQVAHRVMAFX
          ||||||||||||||||||||||||||||||||||||||||
a240      VFAMQAVFKRKFQTFLTFAVNIGKSDDVCKQVAHRVMAFX
                190        200        210        220
```

The following partial DNA sequence was identified in *N. gonorrhoeae* <SEQ ID 905>:

g241.seq

```
  1 ATGATAGAAG TCATACATTT CTTCGGCACC GAAACGCGCA GACAGTTTGC
 51 TTGTGCCGAC GTTGGACGAT TTCTGCATGA TGCCGCGCAC ATCCAAAGAG
101 GGGTAAACAT GGGTATCGCG CACGGGAGAC GGTCCGATTT TATAAGGCTG
151 CGTATTCAGC CGTTCGTTCA AATCGGTTTT GCCCGCATCC AATGCCTTCG
201 CAATCACAAA CGGTTTGATT GCCGAACCGG GTTCGATCAT ATCGGTTACG
251 GCACGGTTGC GCCGCTGTTC GCTGTCTGCC CGGCCGGGCC TGTTGGGATC
301 GTAGGCGGGC GTATTGGCCA AGGCGAGGAT TTCCCCCGTG CGGGCATCCA
351 ArACCACCAC CGTTCCGGCT TTTGCCTGAT GGTATTCGAC CGCCTTGTTC
401 AACTCTTCAT AGGCCAAGGT CTGAATCCTC TGATCGAGGG AAAGGATGAT
451 GTCTTTGCCG TTTTTCGGGG CTTTAkTGCG CGGGGAGTCC AAGCTGTCCA
501 CAATATTGCC CTGCCGGTCC CGCAAAACGA CTTCCGCGCC GTCTTCGCCA
551 TGCAAGCTGT CTTCAAGCGA AAGTTCCAAA CCTTCCTGAC CTTTGCCGTC
601 AATATCGGTA AATCCGATGA CGTGTGCAAA CAGGTTGCCC ATCGGGTAAT
651 GGCGTTTTAA
```

This corresponds to the amino acid sequence <SEQ ID 906; ORF 241.ng>:

g241.pep

```
  1 MPTRPTRAAN PPTPTTWLQT AYCPRPPYRP PSVQTHTPHE PASSTCAAKS
 51 ANRRENSHNA QPTYLLHPSN KMPSETEQTL FRRHQIPPSC RQSVVVMTVR
101 TVDMTVCDFL IGCIAHAFNR SFKADFHACQ RMVAVHHRLA VGNIGYTIDD
151 NIAGFRIVRF KHHTDLDFNR ERARIFNTDQ LRIMLTERIV GRKRHFDRIA
201 GILTVQRLFH QRENAVVTAV QIRNRFFGFI QKLIVGIIHL IMQRNHGIFC
251 NSHICPFRNS RLITGAF*
```

The following partial DNA sequence was identified in *N. meningitidis* <SEQ ID 907>:

m241.seq (partial)

```
  1 ..CGGCAATCAG TGGTGGTGAT GACCGTGCGG GCCGTGGACA TGACCGTGTG
 51   CGATTTCCTC ATCGGATGCA TCGCGCACGC TTTCAACTGT AGCCTTAAAG
101   CGGATTTTCA TGCCTGCCAA AGGATGGTTG CCGTCCACCA CCGCCTTGCC
151   GTCGGCAACA TCGGTTACAC GATAGACGAC AACATCGCCG GTTTCAGGAT
201   CGTCGGCTTC AAACATCATG CCGACTTCGA CTTCAACAGG GAACACGCCC
251   GCATCTTCGA TACGGACCAA CTCCGGATCC TGCTCGCCGA ACGCATCGTC
301   GGGCGACAGC GCCACATCGA CCGTATCGCC GGCATCCTTA CCGTGCAACG
351   CCTCTTCCAC CAAAGGGAAA ATGCCGTCGT AACCGCCGTG CAGATACGCA
401   ATCGGTTCTT CGGTTTTGTC CAAAAGCTGA TTGTTGGCAT CATACATCTC
451   ATAATGCAGC GAAACCACGG AATTTTTCAC GATAGCCATA TTTGTCCTTT
501   CAGGAACAGC AGATTAATTA CAGGCGCATT CTAA
```

This corresponds to the amino acid sequence <SEQ ID 908; ORF 241>:

m241.pep (partial)

```
  1 ..RQSVVVMTVR AVDMTVCDFL IGCIAHAFNC SLKADFHACQ RMVAVHHRLA
 51   VGNIGYTIDD NIAGFRIVGF KHHADFDFNR EHARIFDTDQ LRILLAERIV
101   GRQRHIDRIA GILTVQRLFH QRENAVVTAV QIRNRFFGFV QKLIVGIIHL
151   IMQRNHGIFH DSHICPFRNS RLITGAF*
```

Computer analysis of this amino acid sequence gave the following results:

Homology with a predicted ORF from *N. gonorrhoeae*

ORF 241 shows 91.5% identity over a 177 aa overlap with a predicted ORF (ORF 241.ng) from *N. gonorrhoeae*:

m241/g241

```
                                                    10        20        30
m241.pep                                  RQSVVVMTVRAVDMTVCDFLIGCIAHAFNC
                                          |||||||||:||||||||||||||||||| 
g241      QPTYLLHPSNKMPSETEQTLFRRHQIPPSCRQSVVVMTVRTVDMTVCDFLIGCIAHAFNR
                  70        80        90       100       110       120

                  40        50        60        70        80        90
m241.pep  SLKADFHACQRMVAVHHRLAVGNIGYTIDDNIAGFRIVGFKHHADFDFNREHARIFDTDQ
          |:|||||||||||||||||||||||||||||||||||| ||||:|:|||||:||||:|||
g241      SFKADFHACQRMVAVHHRLAVGNIGYTIDDNIAGFRIVRFKHHTDLDFNRERARIFNTDQ
                 130       140       150       160       170       180

                 100       110       120       130       140       150
m241.pep  LRILLAERIVGRQRHIDRIAGILTVQRLFHQRENAVVTAVQIRNRFFGFVQKLIVGIIHL
          |||:|:||||||:||:||||||||||||||||||||||||||||||||:|||||||||||
g241      LRIMLTERIVGRKRHFDRIAGILTVQRLFHQRENAVVTAVQIRNRFFGFIQKLIVGIIHL
                 190       200       210       220       230       240

                 160       170
m241.pep  IMQRNHGIFHDSHICPFRNSRLITGAFX
          ||||||||| :|||||||||||||||||
g241      IMQRNHGIFCNSHICPFRNSRLITGAFX
                 250       260
```

The following partial DNA sequence was identified in *N. meningitidis* <SEQ ID 909>:

a241.seq

```
  1 ATGCCAACAC GTCCAACTCG CGCCGCAAAG CATCCAACCC CGCCAACCTG
 51 GCTTCAGACG GCATACTGCC CTCGTCCGCC ATATCGTCCG CCGTCCGTGC
101 AAACGCATAC ACCGCATGAA CCGGCTTCCT CAACCTGCGC GGCAAAATCA
151 GCGAACCGAC GGGAAAATTT TCATAATGCC CAACCGACAT ACCTTCTCCA
201 TCCATCAAAC AAAATGCCGT CTGAAATGGA ACAAACCCTT TTCAGACGGC
251 ATCAGATACC TCCAAGCTGC CGGCAATCAG TGGTGGTGAT GACCGTGCGG
301 ACCGTGGACA TGACCGTGTG CGATTTCCTC ATCGGATGCA TCGCGCACAC
351 TTTCAACCGT AGCCTTAAAG CGGATTTTCA TGCCTGCCAA AGGATGGTTG
401 CCGTCCACCA CCGCCTTACC GTCGGCAACA TCGGTTACAC GATAGAGGAC
451 AACATCGCCG GTTTCAGGAT CGTCGGCTTC AAACATCATG CCGACTTCGA
501 CTTCAACAGG GAACACGCCC GCATCTTCAA TACGGACCAA CTCCGGATCC
551 TGCTCGCCGA ACGCATCGTC GGGCGAAAGC GCCACATCGA CCGTATCGCC
601 GGCATCCTTA CCGTGCAACG CCTCTTCCAC CAAAGGGAAA ATGCCGTCGT
651 AACCGCCGTG CAGATACGCA ATCGGTTCTT CGGTTTTGTC CAAAAGCTGA
701 TTGTTGGCAT CATACATCTC ATAATGCAGC GAAACCACGG AATTCTTCAC
751 GATAGCCATA TTTGTCCTTT CAGGAACAGC AGATTAATTA CAGGCGCATT
801 CTAA
```

This corresponds to the amino acid sequence <SEQ ID 910; ORF 241.a>:

a241.pep

```
  1 MPTRPTRAAK HPTPPTWLQT AYCPRPPYRP PSVQTHTPHE PASSTCAAKS
 51 ANRRENFHNA QPTYLLHPSN KMPSEMEQTL FRRHQIPPSC RQSVVVMTVR
101 TVDMTVCDFL IGCIAHTFNR SLKADFHACQ RMVAVHHRLT VGNIGYTIDD
151 NIAGFRIVGF KHHADFDFNR EHARIFNTDQ LRILLAERIV GRKRHIDRIA
201 GILTVQRLFH QRENAVVTAV QIRNRFFGFV QKLIVGIIHL IMQRNHGILH
251 DSHICPFRNS RLITGAF*
```

m241/a241 96.0% identity in 177 aa overlap

```
                                                 10        20        30
m241.pep                                 RQSVVVMTVRAVDMTVCDFLIGCIAHAFNC
                                         |||||||||:||||||||||||||||:||
a241       QPTYLLHPSNKMPSEMEQTLFRRHQIPPSCRQSVVVMTVRTVDMTVCDFLIGCIAHTFNR
                70        80        90       100       120       130

                40        50        60        70        80        90
m241.pep   SLKADFHACQRMVAVHHRLAVGNIGYTIDDNIAGFRIVGFKHHADFDFNREHARIFDTDQ
           |||||||||||||||||||:||||||||||||||||||||||||||||||||||||:|||
a241       SLKADFHACQRMVAVHHRLTVGNIGYTIDDNIAGFRIVGFKHHADFDFNREHARIFNTDQ
                130       140       150       160       170       180

               100       110       120       130       140       150
m241.pep   LRILLAERIVGRQRHIDRIAGILTVQRLFHQRENAVVTAVQIRNRFFGFVQKLIVGIIHL
           ||||||||||||:|||||||||||||||||||||||||||||||||||||||||||||||
a241       LRILLAERIVGRKRHIDRIAGILTVQRLFHQRENAVVTAVQIRNRFFGFVQKLIVGIIHL
               190       200       210       220       230       240
```

-continued

```
                 160        170
m241.pep    IMQRNHGIFHDSHICPFRNSRLITGAFX
            ||||||||:|||||||||||||||||||
a241        IMQRNHGILHDSHICPFRNSRLITGAFX
                 250        260
```

The following partial DNA sequence was identified in *N. gonorrhoeae* <SEQ ID 911>:

g241-1.seq

```
  1 ATGATAGAAG TCATACATTT CTTCGGCACC GAAACGCGCA GACAGTTTGC
 51 TTGTGCCGAC GTTGGACGAT TTCTGCATGA TGCCGCGCAC ATCCAAAGAG
101 GGGTAAACAT GGGTATCGCG CACGGGAGAC GGTCCGATTT TATAAGGCTG
151 CGTATTCAGC CGTTCGTTCA AATCGGTTTT GCCCGCATCC AATGCCTTCG
201 CAATCACAAA CGGTTTGATT GCCGAACCGG GTTCGATCAT ATCGGTTACG
251 GCACGGTTGC GCCGCTGTTC GCTGTCTGCC CGGCCGGGCC TGTTGGGATC
301 GTAGGCGGGC GTATTGGCCA AGGCGAGGAT TTCCCCCGTG CGGGCATCCA
351 ArACCACCAC CGTTCCGGCT TTTGCCTGAT GGTATTCGAC CGCCTTGTTC
401 AACTCTTCAT AGGCCAAGGT CTGAATCCTC TGATCGAGGG AAAGGATGAT
451 GTCTTTGCCG TTTTTCGGGG CTTTAkTGCG CGGGGAGTCC AAGCTGTCCA
501 CAATATTGCC CTGCCGGTCC CGCAAAACGA CTTCCGCGCC GTCTTCGCCA
551 TGCAAGCTGT CTTCAAGCGA AAGTTCCAAA CCTTCCTGAC CTTTGCCGTC
601 AATATCGGTA AATCCGATGA CGTGTGCAAA CAGGTTGCCC ATCGGGTAAT
651 GGCGTTTTAA
```

This corresponds to the amino acid sequence <SEQ ID 912; ORF 241-1.ng>:

g241-1.pep

```
  1 MPTRPTRAAN PPTPTTWLQT AYCPRPPYRP PSVQTHTPHE PASSTCAAKS
 51 ANRRENSHNA QPTYLLHPSN KMPSETEQTL FRRHQIPPSC RQSVVVMTVR
101 TVDMTVCDFL IGCIAHAFNR SFKADFHACQ RMVAVHHRLA VGNIGYTIDD
151 NIAGFRIVRF KHHTDLDFNR ERARIFNTDQ LRIMLTERIV GRKRHFDRIA
201 GILTVQRLFH QRENAVVTAV QIRNRFFGFI QKLIVGIIHL IMQRNHGIFC
251 NSHICPFRNS RLITGAF*
```

The following partial DNA sequence was identified in *N. meningitidis* <SEQ ID 913>:

m241-1.seq

```
  1 ATGCCAACAC GTCCAACTCG CGCTGCAAAC CCTCCAACCC CGCCAACCTG
 51 GCTTCAGACG GCATACTGCC CTCGTCCGCC ATATCGTCCG CCGTCCGTGC
101 AAACGCGTAC ACCGCGTGAA CCGGCTTCCT CAACCTGCGC GGCAAAATCA
151 GCGAACCGAC GGGAAAATTC TCATAATGCC CAACCGACAT ACCTTCTCCA
```

-continued

```
201 TCCATCAAAC AAAATGCCGT CTGAAACGGA ACAAACCCTT TTCAGACGGC

251 ATCAGATACC TCCAAGCTGC CGGCAATCAG TGGTGGTGAT GACCGTGCGG

301 GCCGTGGACA TGACCGTGTG CGATTTCCTC ATCGGATGCA TCGCGCACGC

351 TTTCAACTGT AGCCTTAAAG CGGATTTTCA TGCCTGCCAA AGGATGGTTG

401 CCGTCCACCA CCGCCTTGCC GTCGGCAACA TCGGTTACAC GATAGACGAC

451 AACATCGCCG GTTTCAGGAT CGTCGGCTTC AAACATCATG CCGACTTCGA

501 CTTCAACAGG GAACACGCCC GCATCTTCGA TACGGACCAA CTCCGGATCC

551 TGCTCGCCGA ACGCATCGTC GGGCGACAGC GCCACATCGA CCGTATCGCC

601 GGCATCCTTA CCGTGCAACG CCTCTTCCAC CAAAGGGAAA ATGCCGTCGT

651 AACCGCCGTG CAGATACGCA ATCGGTTCTT CGGTTTTGTC CAAAAGCTGA

701 TTGTTGGCAT CATACATCTC ATAATGCAGC GAAACCACGG AATTTTTCAC

751 GATAGCCATA TTTGTCCTTT CAGGAACAGC AGATTAATTA CAGGCGCATT

801 CTAA
```

This corresponds to the amino acid sequence <SEQ ID 914; ORF 241-1>:

```
m241-1.pep

  1 MPTRPTRAAN PPTPPTWLQT AYCPRPPYRP PSVQTRTPRE PASSTCAAKS

 51 ANRRENSHNA QPTYLLHPSN KMPSETEQTL FRRHQIPPSC RQSVVVMTVR

101 AVDMTVCDFL IGCIAHAFNC SLKADFHACQ RMVAVHHRLA VGNIGYTIDD

151 NIAGFRIVGF KHHADFDFNR EHARIFDTDQ LRILLAERIV GRQRHIDRIA

201 GILTVQRLFH QRENAVVTAV QIRNRFFGFV QKLIVGIIHL IMQRNHGIFH

251 DSHICPFRNS RLITGAF*
```

m241-1/g241-1 93.3% identity in 267 aa overlap

```
                   10        20        30        40        50        60
m241-1.pep MPTRPTRAANPPTPPTWLQTAYCPRPPYRPPSVQTRTPREPASSTCAAKSANRRENSHNA
           |||||||||||||| ||||||||||||||||||||:||:|||||||||||||||||||||
g241       MPTRPTRAANPPTPTTWLQTAYCPRPPYRPPSVQTHTPHEPASSTCAAKSANRRENSHNA
                   10        20        30        40        50        60

                   70        80        90       100       110       120
m241-1.pep QPTYLLHPSNKMPSETEQTLFRRHQIPPSCRQSVVVMTVRAVDMTVCDFLIGCIAHAFNC
           |||||||||||||||||||||||||||||||||||||||||:|||||||||||||||||
g241       QPTYLLHPSNKMPSETEQTLFRRHQIPPSCRQSVVVMTVRTVDMTVCDFLIGCIAHAFNR
                   70        80        90       100       110       120

                  130       140       150       160       170       180
m241-1.pep SLKADFHACQRMVAVHHRLAVGNIGYTIDDNIAGFRIVGFKHHADFDFNREHARIFDTDQ
           |:|||||||||||||||||||||||||||||||||||| ||||:|:|||||:||||:|||
g241       SFKADFHACQRMVAVHHRLAVGNIGYTIDDNIAGFRIVRFKHHTDLDFNRERARIFNTDQ
                  130       140       150       160       170       180

                  190       200       210       220       230       240
m241-1.pep LRILLAERIVGRQRHIDRIAGILTVQRLFHQRENAVVTAVQIRNRFFGFVQKLIVGIIHL
           |||:|:||||||:||:|||||||||||||||||||||||||||||||||:||||||||||
g241       LRIMLTERIVGRKRHFDRIAGILTVQRLFHQRENAVVTAVQIRNRFFGFIQKLIVGIIHL
                  190       200       210       220       230       240

                  250       260
m241-1.pep IMQRNHGIFHDSHICPFRNSRLITGAFX
           ||||||||| :|||||||||||||||||
g241       IMQRNHGIFCNSHICPFRNSRLITGAFX
                  250       260
```

The following partial DNA sequence was identified in *N. meningitidis* <SEQ ID 915>:

a241-1.seq

```
  1 ATGCCAACAC GTCCAACTCG CGCCGCAAAG CATCCAACCC CGCCAACCTG
 51 GCTTCAGACG GCATACTGCC CTCGTCCGCC ATATCGTCCG CCGTCCGTGC
101 AAACGCATAC ACCGCATGAA CCGGCTTCCT CAACCTGCGC GGCAAAATCA
151 GCGAACCGAC GGGAAAATTT TCATAATGCC CAACCGACAT ACCTTCTCCA
201 TCCATCAAAC AAAATGCCGT CTGAAATGGA ACAAACCCTT TTCAGACGGC
251 ATCAGATACC TCCAAGCTGC CGGCAATCAG TGGTGGTGAT GACCGTGCGG
301 ACCGTGGACA TGACCGTGTG CGATTTCCTC ATCGGATGCA TCGCGCACAC
351 TTTCAACCGT AGCCTTAAAG CGGATTTTCA TGCCTGCCAA AGGATGGTTG
401 CCGTCCACCA CCGCCTTACC GTCGGCAACA TCGGTTACAC GATAGACGAC
451 AACATCGCCG GTTTCAGGAT CGTCGGCTTC AAACATCATG CCGACTTCGA
501 CTTCAACAGG GAACACGCCC GCATCTTCAA TACGGACCAA CTCCGGATCC
551 TGCTCGCCGA ACGCATCGTC GGGCGAAAGC GCCACATCGA CCGTATCGCC
601 GGCATCCTTA CCGTGCAACG CCTCTTCCAC CAAAGGGAAA ATGCCGTCGT
651 AACCGCCGTG CAGATACGCA ATCGGTTCTT CGGTTTTGTC CAAAAGCTGA
701 TTGTTGGCAT CATACATCTC ATAATGCAGC GAAACCACGG AATTCTTCAC
751 GATAGCCATA TTTGTCCTTT CAGGAACAGC AGATTAATTA CAGGCGCATT
801 CTAA
```

This corresponds to the amino acid sequence <SEQ ID 916; ORF 241-1.a>:

a241-1.pep

```
  1 MPTRPTRAAK HPTPPTWLQT AYCPRPPYRP PSVQTHTPHE PASSTCAAKS
 51 ANRRENFHNA QPTYLLHPSN KMPSEMEQTL FRRHQIPPSC RQSVVVMTVR
101 TVDMTVCDFL IGCIAHTFNR SLKADFHACQ RMVAVHHRLT VGNIGYTIDD
151 NIAGFRIVGF KHHADFDFNR EHARIFNTDQ LRILLAERIV GRKRHIDRIA
201 GILTVQRLFH QRENAVVTAV QIRNRFFGFV QKLIVGIIHL IMQRNHGILH
251 DSHICPFRNS RLITGAF*
```

m241-1/a241-1 95.1% identity in 267 aa overlap

```
                    10        20        30        40        50        60
m241-1.pep  MPTRPTRAANPPTPPTWLQTAYCPRPPYRPPSVQTRTPREPASSTCAAKSANRRENSHNA
            |||||||||: ||||||||||||||||||||||||:||:||||||||||||||||| |||
a241        MPTRPTRAAKHPTPPTWLQTAYCPRPPYRPPSVQTHTPHEPASSTCAAKSANRRENFHNA
                    10        20        30        40        50        60

                    70        80        90       100       110       120
m241-1.pep  QPTYLLHPSNKMPSETEQTLFRRHQIPPSCRQSVVVMTVRAVDMTVCDFLIGCIAHAFNC
            ||||||||||||||| ||||||||||||||||||||||||:|||||||||||||||:|||
a241        QPTYLLHPSNKMPSEMEQTLFRRHQIPPSCRQSVVVMTVRTVDMTVCDFLIGCIAHTFNC
                    70        80        90       100       110       120

                   130       140       150       160       170       180
m241-1.pep  SLKADFHACQRMVAVHHRLAVGNIGYTIDDNIAGFRIVGFKHHADFDFNREHARIFDTDQ
            |||||||||||||||||||:||||||||||||||||||||||||||||||||||||:|||
a241        SLKADFHACQRMVAVHHRLTVGNIGYTIDDNIAGFRIVGFKHHADFDFNREHARIFNTDQ
                   130       140       150       160       170       180
```

-continued

```
                190       200       210       220       230       240
m241-1.pep  LRILLAERIVGRQRHIDRIAGILTVQRLFHQRENAVVTAVQIRNRFFGFVQKLIVGIIHL
            ||||||||||||:|||||||||||||||||||||||||||||||||||||||||||||||
a241        LRILLAERIVGRKRHIDRIAGILTVQRLFHQRENAVVTAVQIRNRFFGFVQKLIVGIIHL
                190       200       210       220       230       240

                250       260
m241-1.pep  IMQRNHGIFHDSHICPFRNSRLITGAFX
            ||||||||:|||||||||||||||||||
a241        IMQRNHGILHDSHICPFRNSRLITGAFX
                250       260
```

The following partial DNA sequence was identified in *N. gonorrhoeae* <SEQ ID 917>:

g242.seq

```
  1 atgatcggcg aacttgttgt tttgttcgtg atcgagcact tcaagcaacg
 51 cgctggcggg atcgccccga aagtcgctgc ccaatttgtc gatttcgtcg
101 agcaggaaca acgggtttct tacgcctgct tttgccatat tctgcaaaat
151 cttgccgggc atagagccga tataggtacg gcggtgcccg cggatttcgc
201 tttcgtcgcg cacgccgccc aaggccatac ggacatattt ccgccccgtt
251 gctttggcga tggattcgcc caaagaggtt ttgcccacgc ccggagggcc
301 gaccaaacac agaatcggac ctttgagctt gtccatacgt tttggacgg
351 cgaggtattc caaaatccgt tctttgactt tttccaggcc gtagtggtcg
401 gcatccagca ccagtccggc tttggcgatg tctttgctga cgcgggattt
451 tttcttccac ggcagtccga gcagggtgtc gatgtagttg cgtacgacgg
501 tggattcggc agacatcggc ggcatcattt tgagtttttt cagttcggac
551 aggcattttt cttccgcttc tttggtcata cccgcctttt tgatgcctgc
601 ctccaaggca tccagttcgc cgttttcgtc ttcttcgccc aattctttgt
651 gtatcgcttt aatctgttcg ttcagataat attcgcgttg ggatttttcc
701 atttggcgtt tgacgcgtcc gcgtatgcgt tttcggcct gcataatgtc
751 gagttcggat tccagctttg ccagcaggaa ttccatccgt ttgccgattt
801 cgggaatctc caaaatctgt tggcgttgcg ccagtttcaa ctgcaaatgc
851 gctgcgaccg tatcggttag
```

This corresponds to the amino acid sequence <SEQ ID 918; ORF 242.ng>:

g242.pep

```
  1 MIGELVVLFV IEHFKQRAGG IAPKVAAQFV DFVEQEQRVS YACFCHILQN
 51 LAGHRADIGT AVPADFAFVA HAAQGHTDIF PPRCFGDGFA QRGFAHARRA
101 DQTQNRTFEL VHTFLDGEVF QNPFFDFFQA VVVGIQHQSG FGDVFADAGF
151 FLPRQSEQGV DVVAYDGGFG RHRRHHFEFF QFGQAFFFRF FGHTRLFDAC
201 LQGIQFAVFV FFAQFFVYRF NLFVQIIFAL GFFHLAFDAS AYAFFGLHNV
251 EFGFQLCQQE FHPFADFGNL QNLLALRQFQ LQMRCDRIG*
```

The following partial DNA sequence was identified in *N. meningitidis* <SEQ ID 919>:

m242.seq

```
  1 ATGATCGGCA AACTTGTTGT TTTGTTCGGG ATCGAGCACT TCGAGCAACG
 51 CGCTGGCGGG ATCGCCTCGG AAGTCGTTAC CCAATTTGTC GATTTCGTCG
101 AGCAGGAACA AGGGGTTTTT CACGCCGGCT TTTGCCATAT TCTGCAAAAT
151 CTTACCGGGC ATAGAGCCGA TATAGGTGCG GCGGTGTCCC CTGATTTCGC
201 TTTCGTCGCG CACGCCGCCC AAAGCCATGC GGACATATTT CCGCCCCGTT
251 GCTTTGGCGA TGGATTCGCC CAAAGAGGTT TTGCCCACGC CCGGAGGGCC
301 GACCAGGCAC AGAATCGGGC CTTTGAGTTT GTCCATACGT TTTTGGACGG
351 CGAGGTATTC CAAAATCCGT TCTTTGACTT TTTCCAGGCC GTAGTGGTCG
401 GCATCCAGCA CCAGTCCGGC TTTGGCGATG TCTTTGCTGA CGCGGGATTT
451 TTTCTTCCAC GGCAGCTCGA GCAAAGTGTC GATGTAGTTG CGTACGACGG
501 TGGATTCCGC AGACATCGGT GGCATCATTT TGAGCTTTTT CAGTTCGGAC
551 AGGCATTTTT CTTCCGCTTC TTTGGTCATA CCCGCCTTTT TGATATCTGC
601 TTCCAAGGCA TCCAGTTCGC CGTTTTCGTC TTCTTCGCCC AGTTCTTTGT
651 GTATCGCTTT AATCTGTTCG TTCAGATAAT ATTCGCGCTG GGATTTTTCC
701 ATTTGGCGTT TGACGCGTCC GCGTATGCGT TTTTCGGCCT GCATAATGTC
751 GAGTTCGGAT TCCAGCTGTG CCAGCAGGAA TTCCATCCGT TTGCCGATTT
801 CGGGAATTTC CAAAATCTGT TGGCGTTGCG CCAGTTTCAA CTGCAAATGC
851 GCTGCGACCG TATCGGTTAG
```

This corresponds to the amino acid sequence <SEQ ID 920; ORF 242>:

m242.pep

```
  1 MIGKLVVLFG IEHFEQRAGG IASEVVTQFV DFVEQEQGVF HAGFCHILQN
 51 LTGHRADIGA AVSPDFAFVA HAAQSHADIF PPRCFGDGFA QRGFAHARRA
101 DQAQNRAFEF VHTFLDGEVF QNPFFDFFQA VVVGIQHQSG FGDVFADAGF
151 FLPRQLEQSV DVVAYDGGFR RHRWHHFELF QFGQAFFFRF FGHTRLFDIC
201 FQGIQFAVFV FFAQFFVYRF NLFVQIIFAL GFFHLAFDAS AYAFFGLHNV
251 EFGFQLCQQE FHPFADFGNF QNLLALRQFQ LQMRCDRIG*
```

Computer analysis of this amino acid sequence gave the following results:

Homology with a predicted ORF from *N. gonorrhoeae*

ORF 242 shows 90.3% identity over a 289 aa overlap with a predicted ORF (ORF 242.ng) from *N. gonorrhoeae:*
m242/g24290.3% identity in 289 aa overlap

```
                     10        20        30        40        50        60
m242.pep    MIGKLVVLFGIEHFEQRAGGIASEVVTQFVDFVEQEQGVFHAGFCHILQNLTGHRADIGA
            |||:||||| ||||:||||||| :|::|||||||||| | :| ||||||||:|||||||:
g242        MIGELVVLFVIEHFKQRAGGIAPKVAAQFVDFVEQEQRVSYACFCHILQNLAGHRADIGT
                     10        20        30        40        50        60

                    70        80        90       100       110       120
m242.pep   AVSPDFAFVAHAAQSHADIFPPRCFGDGFAQRGFAHARRADQAQNRAFEFVHTFLDGEVF
           ||  ||||||||||:|:|||||||||||||||||||||||||:|||:||:||||||||||
g242       AVPADFAFVAHAAQGHTDIFPPRCFGDGFAQRGFAHARRADQTQNRTFELVHTFLDGEVF
                    70        80        90       100       110       120
```

-continued

```
                130       140       150       160       170       180
m242.pep  QNPFFDFFQAVVVGIQHQSGFGDVFADAGFFLPRQLEQSVDVVAYDGGFRRHRWHHFELF
          ||||||||||||||||||||||||||||||||||| ||:|||||||||| ||| ||||:|
g242      QNPFFDFFQAVVVGIQHQSGFGDVFADAGFFLPRQSEQGVDVVAYDGGFGRHRRHHFEFF
                130       140       150       160       170       180

                190       200       210       220       230       240
m242.pep  QFGQAFFFRFFGHTRLFDICFQGIQFAVFVFFAQFFVYRFNLFVQIIFALGFFHLAFDAS
          |||||||||||||||||| |:|||||||||||||||||||||||||||||||||||||||
g242      QFGQAFFFRFFGHTRLFDACLQGIQFAVFVFFAQFFVYRFNLFVQIIFALGFFHLAFDAS
                190       200       210       220       230       240

                250       260       270       280       290
m242.pep  AYAFFGLHNVEFGFQLCQQEFHPFADFGNFQNLLALRQFQLQMRCDRIGX
          |||||||||||||||||||||||||||||:||||||||||||||||||||
g242      AYAFFGLHNVEFGFQLCQQEEHPEADFGNLQNLLALRQFQLQMRCDRIGX
                250       260       270       280
```

The following partial DNA sequence was identified in *N. meningitidis* <SEQ ID 921>:

a242.seq

```
  1 ATGATCGGCG AACTTGTTGT TTTGCTCGGG ATCAAGCACT TCGAGCAACG
 51 CGCTGGCGGG ATCGCCCCGG AAGTCGCTAN CCAATTTGTC GATTTCGTCG
101 AGCAGGAACA ATGGGTTTTT TACGCCGGCT TTTGCCATAT TCTGCAAAAT
151 CTTACCGGGC ATGGAGCCGA TATAGGTGCG GCGGTGTCCC CGGATTTCGC
201 TTTCGTCGCG CACGCCGCCC AAAGCCATGC GGACATATTT CCGCCCCGTT
251 GCTTTGGCGA TGGATTCGCC CAAAGAGGTT TTGCCCACGC CTGGAGGGCC
301 GACCAGGCAC AGAATCGGGC CTTTGAGTTT GTCCATACGT TTTTGGACGG
351 CGAGGTATTC CAAAATCCGT TCTTTGACTT TTTCCAGGCC GTAGTGGTCG
401 GTATCCAGCA CCAATCCGGC TTTGGCGATG TCTTTGCTGA CGCGGGATTT
451 TTTCTTCCAC GGCAGTTCGA GCAGGGTGTC GATGTAGTTG CGTACGACGG
501 TGGATTCGGC AGACATCGGC GGCATCATTT TGAGCTTTTT CAGTTCGGAC
551 AGGCATTTTT CTTCCGCTTC TTTGGTCATA CCCGCCTTTT TGATATCTGC
601 TTCCAAGGCA TCCAGTTCGC CGTTTTCGTC TTCTTCGCCC AGTTCTTTGT
651 GTATCGCTTT AATCTGTTCG TTCAGATAAT ATTCGCGCTG GGATTTTTCC
701 ATTTGGCGTT TGACGCGTCC GCGTATGCGT TTTTCGGCCT GCATAATGTC
751 GAGTTCGGAT TCCAGCTGTG CCAGCAGGAA TTCCATCCGT TTGCCGATTT
801 CGGGAATTTC CAAAATCTGT TGGCGTTGCG CCAGTTTCAA CTGCAAATGC
851 GCTGCGACCG TATCGGTTAG
```

This corresponds to the amino acid sequence <SEQ ID 922; ORF 242.a>:

a242.pep

```
  1 MIGELVVLLG IKHFEQRAGG IAPEVAXQFV DFVEQEQWVF YAGFCHILQN
 51 LTGHGADIGA AVSPDFAFVA HAAQSHADIF PPRCFGDGFA QRGFAHAWRA
101 DQAQNRAFEF VHTFLDGEVF QNPFFDFFQA VVVGIQHQSG FGDVFADAGF
151 FLPRQFEQGV DVVAYDGGFG RHRRHHFELF QFGQAFFFRF FGHTRLFDIC
201 FQGIQFAVFV FFAQFFVYRF NLFVQIIFAL GFFHLAFDAS AYAFFGLHNV
251 EFGFQLCQQE FHPFADFGNF QNLLALRQFQ LQMRCDRIG*
```

m242/a242 95.2% identity in 289 aa overlap

```
                  10        20        30        40        50        60
m242.pep  MIGKLVVLFGIEHFEQRAGGIASEVVTQFVDFVEQEQGVFHAGFCHILQNLTGHRADIGA
          |||:||||:||:|||||||||| ||::|||||||||| ||:|||||||||||||| ||||
a242      MIGELVVLLGIKHFEQRAGGIAPEVAXQFVDFVEQEQWVFYAGFCHILQNLTGHGADIGA
                  10        20        30        40        50        60
                  70        80        90       100       110       120
m242.pep  AVSPDFAFVAHAAQSHADIFPPRCFGDGFAQRGFAHARRADQAQNRAFEFVHTFLDGEVF
          ||||||||||||||||||||||||||||||||||||| ||||||||||||||||||||||
a242      AVSPDFAFVAHAAQSHADIFPPRCFGDGFAQRGFAHAWRADQAQNRAFEFVHTFLDGEVF
                  70        80        90       100       110       120
                 130       140       150       160       170       180
m242.pep  QNPFFDFFQAVVVGIQHQSGFGDVFADAGFFLPRQLEQSVDVVAYDGGFRRHRWHHFELF
          |||||||||||||||||||||||||||||||||||:||:|||||||||| ||| ||||||
a242      QNPFFDFFQAVVVGIQHQSGFGDVFADAGFFLPRQFEQGVDVVAYDGGFGRHRRHHFELF
                 130       140       150       160       170       180
                 190       200       210       220       230       240
m242.pep  QFGQAFFFRFFGHTRLFDICFQGIQFAVFVFFAQFFVYRFNLFVQIIFALGFFHLAFDAS
          ||||||||||||||||||||||||||||||||||||||||||||||||||||||||||||
a242      QFGQAFFFRFFGHTRLFDICFQGIQFAVFVFFAQFFVYRFNLFVQIIFALGFFHLAFDAS
                 190       200       210       220       230       240
                 250       260       270       280       290
m242.pep  AYAFFGLHNVEFGFQLCQQEFHPFADFGNFQNLLALRQFQLQMRCDRIGX
          ||||||||||||||||||||||||||||||||||||||||||||||||||
a242      AYAFFGLHNVEFGFQLCQQEEHPEADFGNFQNLLALRQFQLQMRCDRIGX
                 250       260       270       280       290
```

The following partial DNA sequence was identified in *N. gonorrhoeae* <SEQ ID 923>:

g243.seq

```
  1 ATGGTaatcg tctGGTTGCc cgAGTTaccg CCGATGCCGG CGACGATGGG
 51 CATCAGCGCG GCGAGTGCGA CGATTTTTTC gatactgcCT TCAAACGCGC
101 CGATGACGCG GCTGGCGAGG AAGGCGGTGC AGAGGTTGAC GGCGAGCCAC
151 ATCCAGCGGT TTTTGACGGA ATCCAAGACG GGGGCGAACA GGTCTTCCTC
201 TTCCTGCAAA CCTGCCATGT TCAACATATC CGCTTCGGAT TCTTCGCGGA
251 TCACGTCCAC CATCTCGTCG ATGGTAATCc tgCCGATGAG CTTTTTGTTT
301 TCATCAACGA CGGGCGCGGT AACCAAGTCG TAG
```

This corresponds to the amino acid sequence <SEQ ID 924; ORF 243.ng>:

g243.pep

```
  1 MVIVWLPELP PMPATMGISA ASATIFSILP SNAPMTRLAR KAVQRLTASH
 51 IQRFLTESKT GANRSSSSCK PAMFNISASD SSRITSTISS MVILPMSFLF
101 SSTTGAVTKS *
```

The following partial DNA sequence was identified in *N. meningitidis* <SEQ ID 925>:

m243.seq

```
  1 ATGGTAATCG TCTGGTTGCC CGAGTTACCG CCTATGCCGG CGACGATGGG
 51 CATCAGCGCG GyGAGTGCGA CGATTTTTTC GATGCTGCCT TCAAACGCGC
101 CGATAACACG GyTGGCGAGG AAGGCGGTGC AGAGGTTGAC GGCGAGCCAC
```

-continued

```
151 ATCCAGyGGT TTTTCACCGA ATCCCACACG GGGGCGAAyA GGTCTTCCTC

201 TTCCTGCAAA CCCGCCATAT TCAGCATATC CGCTTCCGAT TCTTCGCGGA

251 TCACGTCCAC CATCTCGTCG ATGGTAATCC TGCCGATGAG CTTTTTGTTT

301 TCATCGACGA CGGGCGCGGT AACCAAGTCG TAG
```

This corresponds to the amino acid sequence <SEQ ID 926; ORF 243>:

m243.pep

```
  1 MVIVWLPELP PMPATMGISA XSATIFSMLP SNAPITRLAR KAVQRLTASH

 51 IQXFFTESHT GANRSSSSCK PAIFSISASD SSRITSTISS MVILPMSFLF

101 SSTTGAVTKS *
```

Computer analysis of this amino acid sequence gave the following results:

Homology with a predicted ORF from *N. gonorrhoeae*

ORF 243 shows 92.7% identity over a 110 aa overlap with a predicted ORF (ORF 243.ng) from *N. gonorrhoeae*:

m243/g243

```
                   10        20        30        40        50        60
m243.pep  MVIVWLPELPPMPATMGISAXSATIFSMLPSNAPITRLARKAVQRLTASHIQXFFTESHT
          |||||||||||||||||||| ||||||:||||||:|||||||||||||||| |:|||:|
g243      MVIVWLPELPPMPATMGISAASATIFSILPSNAPMTRLARKAVQRLTASHIQRFLTESKT
                   10        20        30        40        50        60
                  70        80        90       100       110
m243.pep GANRSSSSCKPAIFSISASDSSRITSTISSMVILPMSFLFSSTTGAVTKSX
         ||||||||||||:|:||||||||||||||||||||||||||||||||||||
g243     GANRSSSSCKPAMFNISASDSSRITSTISSMVILPMSFLFSSTTGAVTKSX
                  70        80        90       100       110
```

The following partial DNA sequence was identified in *N. meningitidis* <SEQ ID 927>:

a243.seq

```
  1 ATGGTAATCG TCTGGTTGCC CGAGTTACCG CCTATGCCGG CGACGATGGG

 51 CATCAGCGCG GCGAGTGCGA CGATTTTTTC GATGCTGCCT TCAAACGCGC

101 CGATAACACG GCTGGCGAGG AAGGCGGTGC AGAGGTTGAC GGCGAGCCAC

151 ATCCAGCGGT TTTTGACGGA ATCCAAGACG GGGGCGAATA AGTCTTCCTC

201 TTCTTGCAAA CCCGCCATAT TCAACATATC CGCTTCGGAT TCTTCGCGGA

251 TCACGTCCAC CATTTCGTCA ACGGTCACCC TGCCGATGAG CTTTTTGTTT

301 TCATCGACGA CGGGCGCGGT AACCAAGTCA TAG
```

This corresponds to the amino acid sequence <SEQ ID 928; ORF 243.a>:

a243.pep

```
  1 MVIVWLPELP PMPATMGISA ASATIFSMLP SNAPITRLAR KAVQRLTASH

 51 IQRFLTESKT GANKSSSSCK PAIFNISASD SSRITSTISS TVTLPMSFLF

101 SSTTGAVTKS *
```

m243/a243 92.7% identity in 110 aa overlap

```
                  10        20        30        40        50        60
m243.pep  MVIVWLPELPPMPATMGISAXSATIFSMLPSNAPITRLARKAVQRLTASHIQXFFTESHT
          |||||||||||||||||||| ||||||||||||||||||||||||||||||| |:|||:|
a243      MVIVWLPELPPMPATMGISAASATIFSMLPSNAPITRLARKAVQRLTASHIQRFLTESKT
                  10        20        30        40        50        60

                  70        80        90       100       110
m243.pep  GANRSSSSCKPAIFSISASDSSRITSTISSMVILPMSFLFSSTTGAVTKSX
          |||:||||||||||:||||||||||||||| | ||||||||||||||||||
a243      GANKSSSSCKPAIFNISASDSSRITSTISSTVTLPMSFLFSSTTGAVTKSX
                  70        80        90       100       110
```

The following partial DNA sequence was identified in *N. gonorrhoeae* <SEQ ID 929>:

g244.seq

```
  1 atgccgcctg aagcccggcc ggcgggttca gacggcattg ccgctttact
 51 tcgatcggtt tatacgcaaa acgcgcttca ggaaataaat cagattattc
101 cccagacgcc ttcaggcttc cttccgtgcc accgtaacca tagccgggcg
151 caacacacgg tcggacaggg tataaccctt cttcatcaca ccaaccacgg
201 tattgggttc ctgctcactg gccaccgcct gcatcgcctg atggatattc
251 ggatcgagct tatcgcccgc tttaggattg atttccttga tttgcgtggc
301 atcaaacgcc ttctgcaact cattcaaagt catctgcaca cccattttca
351 gcgcatcgaa attaccgctc tgatccaaaa gcgccatttc cagataatcc
401 ttgaccggca acatttccac ggcaaacttc tgtccggcga acttgtgcgt
451 atcggcaatt tcctgctggt ggcggcggcg caggttttgc tcgtttgcca
501 aagcgcgcag ttgttcgtct ttcaactgcg cttccagctc ggcaatccgc
551 gcctgcaaat cctcataagc cggctcggcg gcagcctgtt cctgtacacc
601 gtccgcattt cctactgtct cgacggtttc caccgcctcc acattttcaa
651 ccgcttcttc actgttttgc tgctgtgtct gttcgctcat atcgtatccc
701 tcaaaacaaa ttggaaatca aaatccggtt attacccgag caagataagg
751 acattttcaa gaaacttcaa gcaaaggcag gaaatttcac atccgccgcc
801 gaatacccta ccgcaaaaac catataaacg gtaa
```

This corresponds to the amino acid sequence <SEQ ID 930; ORF 244.ng>:

g244.pep

```
  1 MPPEARPAGS DGIAALLRSV YTQNALQEIN QIIPQTPSGF LPCHRNHSRA
 51 QHTVGQGITL LHHTNHGIGF LLTGHRLHRL MDIRIELIAR FRIDFLDLRG
101 IKRLLQLIQS HLHTHFQRIE ITALIQKRHF QIILDRQHFH GKLLSGELVR
151 IGNFLLVAAA QVLLVCQSAQ LFVFQLRFQL GNPRLQILIS RLGGSLFLYT
201 VRISYCLDGF HRLHIFNRFF TVLLLCLFAH IVSLKTNWKS KSGYYPSKIR
251 TFSRNFKQRQ EISHPPPNTL PQKPYKR*
```

The following partial DNA sequence was identified in *N. meningitidis* <SEQ ID 931>:

m244.seq

```
  1 ATGCCGTCTG AAGCCCGACA GGCGGGTTCA GACGGCATTG CCGCTTTACT
 51 TCGATCGGTT TATACGCAAA ACGCGCTTCA GGAAATAAAT CAGATTATTC
101 CCCAGACGCC TTCAGGCTTC CTTCTGCGCC ACCGTAACCA TAGCCGGGCG
151 CAACACGCGG TCGGACAGCG TATAACCCTT CTTCATCACA CCCACCACGG
201 TATTCGGCTC CTGTTCGCTT GCCACCGCCT GCATCGCCTG ATGGATATTC
251 GGATCGAGCT TATCGCCCGC TTTAGGGTTG ATTTCCTTGA TTTGCGTAGC
301 ATCAAATGCT TTCTGCAACT CGTTCAAAGT CATCTGCACG CCCATTTTCA
351 GCGCATCGAA ATTGCCGCTC TGATCCAAAA GCGCCATTTC CAGATAATCC
401 TTGACCGGCA GCATTTCCAC GGCAAACTTC TGTCCGGCGA ACTTGTGCGT
451 ATCCGCAATT TyCTGCTGGT GGCGGCGGCG CAGGTTTTGC TCGTTTGCCA
501 AAGCGCGCTG CTCGTCTTTC AACTGCGTTT CCAGCTCGGC AATCCGCGCC
551 TGCAAATCCT CATAAGCCGG CTCTGCGGCA GCCTGTTCCT GCACACCGTC
601 CGCATTTCCT ACTGTTTCGA CGGTTTCCAC CGCCTCCACA TTTTCAACCG
651 CTTCTTCACT GTTTTGCTGC TGTGTCTGTT CGCTCATATC GTATCCCTTA
701 AAACAAATTG GAAATCAAAA TCCAGTTATT ACCCGCGCAA GATAAGGACA
751 TTTTCAAGAA ACTTCAAkCA AAAkCAGAGA ATTTCAAATT CATTTTCAAA
801 TCCCCTACCG AAAAAATAAT ATAGACGGTA A
```

This corresponds to the amino acid sequence <SEQ ID 932; ORF 244>:

m244.pep

```
  1 MPSEARQAGS DGIAALLRSV YTQNALQEIN QIIPQTPSGF LLRHRNHSRA
 51 QHAVGQRITL LHHTHHGIRL LFACHRLHRL MDIRIELIAR FRVDFLDLRS
101 IKCFLQLVQS HLHAHFQRIE IAALIQKRHF QIILDRQHFH GKLLSGELVR
151 IRNFLLVAAA QVLLVCQSAL LVFQLRFQLG NPRLQILISR LCGSLFLHTV
201 RISYCFDGFH RLHIFNRFFT VLLLCLFAHI VSLKTNWKSK SSYYPRKIRT
251 FSRNFXQXQR ISNSFSNPLP KKXYRR*
```

Computer analysis of this amino acid sequence gave the following results:

Homology with a predicted ORF from *N. gonorrhoeae*

ORF 244 shows 86.3% identity over a 277 aa overlap with a predicted ORF (ORF 244.ng) from *N. gonorrhoeae*:

M244/G244

```
                       10        20        30        40        50        60
m244.pep       MPSEARQAGSDGIAALLRSVYTQNALQEINQIIPQTPSGFLLRHRNHSRAQHAVGQRITL
               || ||| ||||||||||||||||||||||||||||||||||  |||||||||:||| |||
g244           MPPEARPAGSDGIAALLRSVYTQNALQEINQIIPQTPSGFLPCHRNHSRAQHTVGQGITL
                       10        20        30        40        50        60

                       70        80        90       100       110       120
m244.pep       LHHTHHGIRLLFACHRLHRLMDIRIELIARFRVDFLDLRSIKCFLQLVQSHLHAHFQRIE
               ||||:||| :|:: ||||||||||||||||||:||||||:|| :|||:|||||:||||||
g244           LHHTNHGIGFLLTGHRLHRLMDIRIELIARFRIDFLDLRGIKRLLQLIQSHLHTHFQRIE
                       70        80        90       100       110       120
```

-continued

```
                  130       140       150       160       170       180
m244.pep   IAALIQKRHFQIILDRQHFHGKLLSGELVRIRNFLLVAAAQVLLVCQSAALLVFQLRFQL
           |:||||||||||||||||||||||||||||| |||||||||||||||||| |:|||||||
g244       ITALIQKRHFQIILDRQHFHGKLLSGELVRIGNFLLVAAAQVLLVCQSAQLFVFQLRFQL
                  130       140       150       160       170       180

                  190       200       210       220       230       240
m244.pep   GNPRLQILISRLCGSLFLHTVRISYCFDGFHRLHIFNRFFTVLLLCLFAHIVSLKTNWKS
           |||||||||||| |||||:|||||||:|||||||||||||||||||||||||||||||||
g244       GNPRLQILISRLGGSLFLYTVRISYCLDGFHRLHIFNRFFTVLLLCLFAHIVSLKTNWKS
                  190       200       210       220       230       240

                  250       260       270
m244.pep   KSSYYPRKIRTFSRNFXQXQRISNSFSNPLPKKXYRRX
           ||:||| ||||||||| | |:||:   | ||:| |:||
g244       KSGYYPSKIRTFSRNFKQRQEISHPPPNTLPQKPYKRX
                  250       260       270
```

The following partial DNA sequence was identified in *N. meningitidis* <SEQ ID 933>:

a244.seq

```
  1 ATGCCGTCTG AAGCCCGACA GGCGGGTTCA GACGGCATTG CCGCTTTACT
 51 TCGATCGGTT TATACGCAAA ACGCGCTTCA GGAAATAAAT CAGATTATTC
101 CCCAGACGCC TTCAGGCTTC CTTCTGTGCC ACCGTAACCA TAGCCGGGCG
151 CAACACGCGG TCGGACAGCG TATAACCCTT CTTCATCACG CCCACCACGG
201 TATTGGGTTC CTGTTCGCTT GCCACCGCCT GCATCGCCTG ATGGATATTC
251 GGATCGAGCT TATCGCCCGC TTTAGGATTG ATTTCCTTGA TTTGCGTAGC
301 ATCAAATGCT TTCTGCAACT CGTTCAAAGT CATCTGCACG CCCATTTTCA
351 GCGCATCGAA ATTGCCGCTC TGATCCAAAA GCGCCATTTC CAGATAATCC
401 TTGACCGGCA GCATTTCCAC GGCAAACTTC TGTCCGGCGA ACTTGTGCGT
451 ATCCGCAATT TCCTGCTGGT GGCGGCGGCG CAGGTTTTGC TCGTTTGCCA
501 AAGCGCGCAG CTGCTCGTCT TTCAACTGCG CTTCCAGCTC GGCAATCCGC
551 GCCTGCAAAT CCTCATAAGC CGGCTCTGCG GCAGCCTGTT CCTGCACACC
601 GTCCGCATTT CCTACTGTCT CGACGGTTTC CACCGCCTCC ACATTTTCAA
651 CCGCTTCTTC ACTGTTTTGC TGCTGTGTCT GTTCGCTCAT ATCGTATCCC
701 TTAAAACAAA TTGGAAATCA AAATCCAGTT ATTACCCGCG CAAGATAAGG
751 ACATTTTCAA GAAACTTCAA GCAAAGGCAG AGAATTTCAA ATTCATTTTC
801 AAATCCCCTA CCGAAAAAAT AATATAGACG GTAA
```

This corresponds to the amino acid sequence <SEQ ID 934; ORF 244.a>:

a244.pep

```
  1 MPSEARQAGS DGIAALLRSV YTQNALQEIN QIIPQTPSGF LLCHRNHSRA
 51 QHAVGQRITL LHHAHHGIGF LFACHRLHRL MDIRIELIAR FRIDFLDLRS
101 IKCFLQLVQS HLHAHFQRIE IAALIQKRHF QIILDRQHFH GKLLSGELVR
151 IRNFLLVAAA QVLLVCQSAQ LLVFQLRFQL GNPRLQILIS RLCGSLFLHT
201 VRISYCLDGF HRLHIFNRFF TVLLLCLFAH IVSLKTNWKS KSSYYPRKIR
251 TFSRNFKQRQ RISNSFSNPL PKK*YRR*
```

m244/a244 96.8% identity in 277 aa overlap

```
                     10        20        30        40        50        60
m244.pep     MPSEARQAGSDGIAALLRSVYTQNALQEINQIIPQTPSGFLLRHRNHSRAQHAVGQRITL
             |||||||||||||||||||||||||||||||||||||||||| |||||||||||||||||
a244         MPSEARQAGSDGIAALLRSVYTQNALQEINQIIPQTPSGFLLCHRNHSRAQHAVGQRITL
                     10        20        30        40        50        60

                     70        80        90       100       110       120
m244.pep     LHHTHHGIRLLFACHRLHRLMDIRIELIARFRVDFLDLRSIKCFLQLVQSHLHAHFQRIE
             |||:|||| :||||||||||||||||||||||:|||||||||||||||||||||||||||
a244         LHHAHHGIGFLFACHRLHRLMDIRIELIARFRIDFLDLRSIKCFLQLVQSHLHAHFQRIE
                     70        80        90       100       110       120

                    130       140       150       160       170       179
m244.pep     IAALIQKRHFQIILDRQHFHGKLLSGELVRIRNFLLVAAAQVLLVCQSA-LLVFQLRFQL
             ||||||||||||||||||||||||||||||||||||||||||||||||| ||||||||||
a244         IAALIQKRHFQIILDRQHFHGKLLSGELVRIRNFLLVAAAQVLLVCQSAQLLVFQLRFQL
                    130       140       150       160       170       180

           180       190       200       210       220       230      239
m244.pep     GNPRLQILISRLCGSLFLHTVRISYCFDGFHRLHIFNRFFTVLLLCLFAHIVSLKTNWKS
             ||||||||||||||||||||||||||:|||||||||||||||||||||||||||||||||
a244         GNPRLQILISRLCGSLFLHTVRISYCLDGFHRLHIFNRFFTVLLLCLFAHIVSLKTNWKS
                    190       200       210       220       230       240

           240       250       260       270
m244.pep     KSSYYPRKIRTFSRNFXQXQRISNSFSNPLPKKXYRRX
             |||||||||||||||| | |||||||||||||||||||
a244         KSSYYPRKIRTFSRNFKQRQRISNSFSNPLPKKXYRRX
                    250       260       270
```

The following partial DNA sequence was identified in *N. gonorrhoeae* <SEQ ID 935>:

g244-1.seq

```
  1 atgccgcctg aagcccggcc ggcgggttca gacggcattg ccgctttact
 51 tcgatcggtt tatacgcaaa acgcgcttca ggaaataaat cagattattc
101 cccagacgcc ttcaggcttc cttccgtgcc accgtaacca tagccgggcg
151 caacacacgg tcggacaggg tataaccctt cttcatcaca ccaaccacgg
201 tattgggttc ctgctcactg gccaccgcct gcatcgcctg atggatattc
251 ggatcgagct tatcgcccgc tttaggattg atttccttga tttgcgtggc
301 atcaaacgcc ttctgcaact cattcaaagt catctgcaca cccattttca
351 gcgcatcgaa attaccgctc tgatccaaaa gcgccatttc cagataatcc
401 ttgaccggca acatttccac ggcaaacttc tgtccggcga acttgtgcgt
451 atcggcaatt tcctgctggt ggcggcggcg caggttttgc tcgtttgcca
501 aagcgcgcag ttgttcgtct ttcaactgcg cttccagctc ggcaatccgc
551 gcctgcaaat cctcataagc cggctcggcg gcagcctgtt cctgtacacc
601 gtccgcattt cctactgtct cgacggtttc caccgcctcc acattttcaa
651 ccgcttcttc actgttttgc tgctgtgtct gttcgctcat atcgtatccc
701 tcaaaacaaa ttggaaatca aaatccggtt attacccgag caagataagg
751 acattttcaa gaaacttcaa gcaaaggcag gaaatttcac atccgccgcc
801 gaatacccta ccgcaaaaac catataaacg gtaa
```

This corresponds to the amino acid sequence <SEQ ID 936; ORF 244-1.ng>:

g244-1.pep

```
  1 MPPEARPAGS DGIAALLRSV YTQNALQEIN QIIPQTPSGF LPCHRNHSRA
 51 QHTVGQGITL LHHTNHGIGF LLTGHRLHRL MDIRIELIAR FRIDFLDLRG
```

-continued

101 IKRLLQLIQS HLHTHFQRIE ITALIQKRHF QIILDRQHFH GKLLSGELVR

151 IGNFLLVAAA QVLLVCQSAQ LFVFQLRFQL GNPRLQILIS RLGGSLFLYT

201 VRISYCLDGF HRLHIFNRFF TVLLLCLFAH IVSLKTNWKS KSGYYPSKIR

251 TFSRNFKQRQ EISHPPPNTL PQKPYKR*

The following partial DNA sequence was identified in *N. meningitidis* <SEQ ID 937>:

m244-1.seq

1 ATGCCGTCTG AAGCCCGACA GGCGGGTTCA GACGGCATTG CCGCTTTACT

51 TCGATCGGTT TATACGCAAA ACGCGCTTCA GGAAATAAAT CAGATTATTC

101 CCCAGACGCC TTCAGGCTTC CTTCTGCGCC ACCGTAACCA TAGCCGGGCG

151 CAACACGCGG TCGGACAGCG TATAACCCTT CTTCATCACA CCCACCACGG

201 TATTCGGCTC CTGTTCGCTT GCCACCGCCT GCATCGCCTG ATGGATATTC

251 GGATCGAGCT TATCGCCCGC TTTAGGGTTG ATTTCCTTGA TTTGCGTAGC

301 ATCAAATGCT TTCTGCAACT CGTTCAAAGT CATCTGCACG CCCATTTTCA

351 GCGCATCGAA ATTGCCGCTC TGATCCAAAA GCGCCATTTC CAGATAATCC

401 TTGACCGGCA GCATTTCCAC GGCAAACTTC TGTCCGGCGA ACTTGTGCGT

451 ATCCGCAATT TyCTGCTGGT GGCGGCGGCG CAGGTTTTGC TCGTTTGCCA

501 AAGCGCGCTG CTCGTCTTTC AACTGCGTTT CCAGCTCGGC AATCCGCGCC

551 TGCAAATCCT CATAAGCCGG CTCTGCGGCA GCCTGTTCCT GCACACCGTC

601 CGCATTTCCT ACTGTTTCGA CGGTTTCCAC CGCCTCCACA TTTTCAACCG

651 CTTCTTCACT GTTTTGCTGC TGTGTCTGTT CGCTCATATC GTATCCCTTA

701 AAACAAATTG GAAATCAAAA TCCAGTTATT ACCCGCGCAA GATAAGGACA

751 TTTTCAAGAA ACTTCAAkCA AAAkCAGAGA ATTTCAAATT CATTTTCAAA

801 TCCCCTACCG AAAAAATAA

This corresponds to the amino acid sequence <SEQ ID 938; ORF 244-1>:

m244-1.pep

1 MPSEARQAGS DGIAALLRSV YTQNALQEIN QIIPQTPSGF LLRHRNHSRA

51 QHAVGQRITL LHHTHHGIRL LFACHRLHRL MDIRIELIAR FRVDFLDLRS

101 IKCFLQLVQS HLHAHFQRIE IAALIQKRHF QIILDRQHFH GKLLSGELVR

151 IRNFLLVAAA QVLLVCQSAL LVFQLRFQLG NPRLQILISR LCGSLFLHTV

201 RISYCFDGFH RLHIFNRFFT VLLLCLFAHI VSLKTNWKSK SSYYPRKIRT

251 FSRNFXQXQR ISNSFSNPLP KK* m244-1/G244-1 86.3% identity in 277 aa overlap

```
                    10        20        30        40        50        60
m244-1.pep  MPSEARQAGSDGIAALLRSVYTQNALQEINQIIPQTPSGFLLRHRNHSRAQHAVGQRITL
            || ||| ||||||||||||||||||||||||||||||||||  |||||||||:||| |||
g244-1      MPPEARPAGSDGIAALLRSVYTQNALQEINQIIPQTPSGFLPCHRNHSRAQHTVGQGITL
                    10        20        30        40        50        60

                    70        80        90       100       110       120
m244-1.pep  LHHTHHGIRLLFACHRLHRLMDIRIELIARFRVDFLDLRSIKCFLQLVQSHLHAHFQRIE
            ||||:||| :|:: ||||||||||||||||||:||||||:|| :|||:|||||:||||||
g244-1      LHHTNHGIGFLLTGHRLHRLMDIRIELIARFRIDFLDLRGIKRLLQLIQSHLHTHFQRIE
                    70        80        90       100       110       120

                   130       140       150       160       170       180
m244-1.pep  IAALIQKRHFQIILDRQHFHGKLLSGELVRIRNFLLVAAAQVLLVCQSAALLVFQLRFQL
            |:||||||||||||||||||||||||||||| ||||||||||||||||| |:||||||||
g244-1      ITALIQKRHFQIILDRQHFHGKLLSGELVRIGNFLLVAAAQVLLVCQSAQLFVFQLRFQL
                   130       140       150       160       170       180

                   190       200       210       220       230       240
m244-1.pep  GNPRLQILISRLCGSLFLHTVRISYCFDGFHRLHIFNRFFTVLLLCLFAHIVSLKTNWKS
            |||||||||||| |||||:|||||||:|||||||||||||||||||||||||||||||||
g244-1      GNPRLQILISRLGGSLFLYTVRISYCLDGFHRLHIFNRFFTVLLLCLFAHIVSLKTNWKS
                   190       200       210       220       230       240

                     250       260       270
m244-1.pep  KSSYYPRKIRTFSRNFXQXQRISNSFSNPLPKKX
            ||:||| ||||||||| | |:||:   | ||:|
g244-1      KSGYYPSKIRTFSRNFKQRQEISHPPPNTLPQKPYKRX
                     250       260       270
```

The following partial DNA sequence was identified in *N. meningitidis* <SEQ ID 939>:

a244-1.seq

```
  1 ATGCCGTCTG AAGCCCGACA GGCGGGTTCA GACGGCATTG CCGCTTTACT
 51 TCGATCGGTT TATACGCAAA ACGCGCTTCA GGAAATAAAT CAGATTATTC
101 CCCAGACGCC TTCAGGCTTC CTTCTGTGCC ACCGTAACCA TAGCCGGGCG
151 CAACACGCGG TCGGACAGCG TATAACCCTT CTTCATCACG CCCACCACGG
201 TATTGGGTTC CTGTTCGCTT GCCACCGCCT GCATCGCCTG ATGGATATTC
251 GGATCGAGCT TATCGCCCGC TTTAGGATTG ATTTCCTTGA TTTGCGTAGC
301 ATCAAATGCT TTCTGCAACT CGTTCAAAGT CATCTGCACG CCCATTTTCA
351 GCGCATCGAA ATTGCCGCTC TGATCCAAAA GCGCCATTTC CAGATAATCC
401 TTGACCGGCA GCATTTCCAC GGCAAACTTC TGTCCGGCGA ACTTGTGCGT
451 ATCCGCAATT TCCTGCTGGT GGCGGCGGCG CAGGTTTTGC TCGTTTGCCA
501 AAGCGCGCAG CTGCTCGTCT TTCAACTGCG CTTCCAGCTC GGCAATCCGC
551 GCCTGCAAAT CCTCATAAGC CGGCTCTGCG GCAGCCTGTT CCTGCACACC
601 GTCCGCATTT CCTACTGTCT CGACGGTTTC CACCGCCTCC ACATTTTCAA
651 CCGCTTCTTC ACTGTTTTGC TGCTGTGTCT GTTCGCTCAT ATCGTATCCC
701 TTAAAACAAA TTGGAAATCA AAATCCAGTT ATTACCCGCG CAAGATAAGG
751 ACATTTTCAA GAAACTTCAA GCAAAGGCAG AGAATTTCAA ATTCATTTTC
801 AAATCCCCTA CCGAAAAAAT AA
```

This corresponds to the amino acid sequence <SEQ ID 940; ORF 244-1.a>:

a244-1.pep

```
  1 MPSEARQAGS DGIAALLRSV YTQNALQEIN QIIPQTPSGF LLCHRNHSRA
 51 QHAVGQRITL LHHAHHGIGF LFACHRLHRL MDIRIELIAR FRIDFLDLRS
```

-continued

```
101 IKCFLQLVQS HLHAHFQRIE IAALIQKRHF QIILDRQHFH GKLLSGELVR

151 IRNFLLVAAA QVLLVCQSAQ LLVFQLRFQL GNPRLQILIS RLCGSLFLHT

201 VRISYCLDGF HRLHIFNRFF TVLLLCLFAH IVSLKTNWKS KSSYYPRKIR

251 TFSRNFKQRQ RISNSFSNPL PKK*
```

m244-1/a244-1 96.8% identity in 274 aa overlap

```
                    10        20        30        40        50        60
m244-1.pep   MPSEARQAGSDGIAALLRSVYTQNALQEINQIIPQTPSGFLLRHRNHSRAQHAVGQRITL
             |||||||||||||||||||||||||||||||||||||||||||| ||||||||||||||||
a244-1       MPSEARQAGSDGIAALLRSVYTQNALQEINQIIPQTPSGFLLCHRNHSRAQHAVGQRITL
                    10        20        30        40        50        60

                    70        80        90       100       110       120
m244-1.pep   LHHTHHGIRLLFACHRLHRLMDIRIELIARFRVDFLDLRSIKCFLQLVQSHLHAHFQRIE
             |||:|||| :|||||||||||||||||||||||:||||||||||||||||||||||||||
a244-1       LHHAHHGIGFLFACHRLHRLMDIRIELIARFRIDFLDLRSIKCFLQLVQSHLHAHFQRIE
                    70        80        90       100       110       120

                   130       140       150       160       170       179
m244-1.pep   IAALIQKRHFQIILDRQHFHGKLLSGELVRIRNFLLVAAAQVLLVCQSA-LLVFQLRFQL
             ||||||||||||||||||||||||||||||||||||||||||||||||| ||||||||||
a244-1       IAALIQKRHFQIILDRQHFHGKLLSGELVRIRNFLLVAAAQVLLVCQSAQLLVFQLRFQL
                   130       140       150       160       170       180

          180       190       200       210       220       230       239
m244-1.pep   GNPRLQILISRLCGSLFLHTVRISYCFDGFHRLHIFNRFFTVLLLCLFAHIVSLKTNWKS
             ||||||||||||||||||||||||||:|||||||||||||||||||||||||||||||||
a244-1       GNPRLQILISRLCGSLFLHTVRISYCLDGFHRLHIFNRFFTVLLLCLFAHIVSLKTNWKS
                   190       200       210       220       230       240

          240       250       260       270
m244-1.pep   KSSYYPRKIRTFSRNFXQXQRISNSFSNPLPKKX
             |||||||||||||||| | ||||||||||||||||
a244-1       KSSYYPRKIRTFSRNFKQRQRISNSFSNPLPKKX
                   250       260       270
```

The following partial DNA sequence was identified in *N. gonorrhoeae* <SEQ ID 941>:

g246.seq

```
  1 atgtacgggc ggaacggtag tactcaagcg gccgttgcct tcgttttcga

 51 ccagacacag cgtgcccgtt tcggcaacgg cgaagtttac gccgctcaag

101 ccgacatcgg cagtgctgta aatatcgcgc agggctttgc gggcgaatcc

151 ggtcagttgg tccacgtcgt ctgtaagcgg tgtgccgagg ttttggtgga

201 acagttcgct gacctgttct ttggttttat ggattgcggg catcacgata

251 tgggtcggtt tttcgcctgc catttggacg ataaactcgc ccaagtcgct

301 ttccaccgcc ttaatgcctt ttgcttcaag ataatggttc agctcgattt

351 cttcgctgac catggatttg cctttgacca tcagcttgcc gtttttggct

401 gtgatgatgt cgtggataat ttggcaggct tcggcagggg tttccgccca

451 gtgtactttc acgcccaact tagtcaggtt ttcttccaac tgctccagca

501 gcgcgggtaa
```

This corresponds to the amino acid sequence <SEQ ID 942; ORF 246.ng>:

g246.pep

```
  1 MYGRNGSTQA AVAFVFDQTQ RARFGNGEVY AAQADIGSAV NIAQGFAGES
 51 GQLVHVVCKR CAEVLVEQFA DLFFGFMDCG HHDMGRFFAC HLDDKLAQVA
101 FHRLNAFCFK IMVQLDFFAD HGFAFDHQLA VFGCDDVVDN LAGFGRGFRP
151 VYFHAQLSQV FFQLLQQRG*
```

The following partial DNA sequence was identified in *N. meningitidis* <SEQ ID 943>:

m246.seq (partial)

```
  1 ATGCACGGGC GGTACGGTGG TACTCAAGCG ACCGTTgCTT CGTTTTCCAC
 51 CAGACACAGC GTACCTGTTT CAGCAACGGC AAAGTTTACG CCACTCAAAC
101 CGACATCGGC AGTGCTGTAA ATATCGCGCA GTGCTTTACG GGCGAAGCCG
151 GTCAGTTGGT CTACATCGTC TGTCAGCGGC GTACCGAGGT TTTGGTGGAA
201 CAGTTCGCTA ACCTGTTCTT TGGTTTTGTG GATAGCAGGC ATCACGATAT
251 GGGTCGGTTT TTCGCCTGCC ATTTGGACGA TGAACTCGCC CAAGTCGCTT
301 TCTACCGCTT TAATGCyTTT TGCTTCAAGA TAATGrTTCA GCTCGATTTC
351 CTCGCTGACC ATCGATTTGC CTTTGACCAT CAGCTTGCCG TTTTTGGCTG
401 TGATGATGTC GTGGATAATT TGGCAGGCTT CGGTCGGGGT TTCTGCCCG...
```

This corresponds to the amino acid sequence <SEQ ID 944; ORF 246>:

m246.pep (partial)

```
  1 MHGRYGGTQA TVAFVFHQTQ RTCFSNGKVY ATQTDIGSAV NIAQCFTGEA
 51 GQLVYIVCQR RTEVLVEQFA NLFFGFVDSR HHDMGRFFAC HLDDELAQVA
101 FYRFNAFCFK IMXQLDFLAD HRFAFDHQLA VFGCDDVVDN LAGFGRGFCP...
```

Computer analysis of this amino acid sequence gave the following results:

Homology with a predicted ORF from *N. gonorrhoeae*

ORF 246 shows 80.0% identity over a 150 aa overlap with a predicted ORF (ORF 246.ng) from *N. gonorrhoeae*:

m246/g246

```
                    10        20        30        40        50        60
m246.pep    MHGRYGGTQATVAFVFHQTQRTCFSNGKVYATQTDIGSAVNIAQCFTGEAGQLVYIVCQR
            |:|| |:|||:||||| ||||: |:||:|||:|:|||||||||| |:||:||||::||:|
g246        MYGRNGSTQAAVAFVFDQTQRARFGNGEVYAAQADIGSAVNIAQGFAGESGQLVHVVCKR
                    10        20        30        40        50        60

                    70        80        90       100       110       120
m246.pep    RTEVLVEQFANLFFGFVDSRHHDMGRFFACHLDDELAQVAFYRFNAFCFKIMXQLDFLAD
             :||||||||:|||||:|  ||||||||||||||:||||||:|:|||||||| ||||:||
g246        CAEVLVEQFADLFFGFMDCGRHHDMGRFFACHLDKLAQVAFHRLNAFCFKIMVQLDFFAD
                    70        80        90       100       110       120

                   130       140       150
m246.pep    HRFAFDHQLAVFGCDDVVDNLAGFGRGFCP
            | |||||||||||||||||||||||||| |
g246        HGFAFDHQLAVFGCDDVVDNLAGFGRGFRPVYFHAQLSQVFFQLLQQRGX
                   130       140       150       160
```

The following partial DNA sequence was identified in *N. meningitidis* <SEQ ID 945>:

a246.seq (partial)

```
  1 ATGCACGGGC GGAACGGTGG TACTCAAGCG ACCGTTGCCT TCGTTTTCCA
 51 CCAGACACAG CGTACCTGTT TCAGCAACGG CGAAGTTCAC GCCACTCAAA
101 CCGACATCGG CAGTGCTGTA AATATCGCGC AGTGCTTTAC GGGCGAAGCC
151 GGTCAGTTGG TCTACGTCGT CCGTTAACGG TGTGCCGAGG TTTTGGTGGA
201 ACAGTTCGCT AACCTGTTCT TTGGTTTTAT GGATTGCGGG CATCACGATA
251 TGGGTCGGTT TTTCACCTGC CATTTGGACG ATGAACTCGC CCAAGTCGCT
301 TTCCACCGCT TTAATGCCTT TTGCTTCAAG ATAATGGTTC AGCTCGATTT
351 CCTCGCTGAC CATCGATTTG CCTTTGACCA TCAGCTTGCC GTTTTTGGCT
401 GTGATGATGT CGTGGATGAT TTCGCAGGCT TCGGCCGGTG TTTCCGCCCA
451 GTGTACTTTT ACGCCCAACT TGGTCAGGTT TTCTTCCAGC TGCTCCAGCA
501 G
```

This corresponds to the amino acid sequence <SEQ ID 946; ORF 246.a>:

a246.pep (partial)

```
  1 MHGRNGGTQA TVAFVFHQTQ RTCFSNGEVH ATQTDIGSAV NIAQCFTGEA
 51 GQLVYVVR*R CAEVLVEQFA NLFFGFMDCG HHDMGRFFTC HLDDELAQVA
101 FHRFNAFCFK IMVQLDFLAD HRFAFDHQLA VFGCDDVVDD FAGFGRCFRP
151 VYFYAQLGQV FFQLLQQ
```

m246/a246 88.0% identity in 150 aa overlap

```
                   10        20        30        40        50        60
m246.pep  MHGRYGGTQATVAFVFHQTQRTCFSNGKVYATQTDIGSAVNIAQCFTGEAGQLVYIVCQR
          |||| ||||||||||||||||||||||:|:|||||||||||||||||||||||||:|  |
a246      MHGRNGGTQATVAFVFHQTQRTCFSNGEVHATQTDIGSAVNIAQCFTGEAGQLVYVVRXR
                   10        20        30        40        50        60

                   70        80        90       100       110       120
m246.pep  RTEVLVEQFANLFFGFVDSRHHDMGRFFACHLDDELAQVAFYRFNAFCFKIMXQLDFLAD
           :||||||||||||||:|  ||||||||:||||||||||||:|||||||||| |||||||
a246      CAEVLVEQFANLFFGFMDCGHHDMGRFFTCHLDDELAQVAFHRFNAFCFKIMVQLDFLAD
                   70        80        90       100       110       120

                  130       140       150
m246.pep  HRFAFDHQLAVFGCDDVVDNLAGFGRGFCP
          |||||||||||||||||||::||||| | |
a246      HRFAFDHQLAVFGCDDVVDDFAGFGRCFRPVYFYAQLGQVFFQLLQQ
                  130       140       150       160
```

The following partial DNA sequence was identified in *N. gonorrhoeae* <SEQ ID 947>:

g247.seq

```
  1 atgaaacgta aaatgctaaa cgtaccaaag ggcggttatg atggtatgaa
 51 gggttttacc attgttgaat ttctggttgc gggcctgctc agtataattg
101 tcctgatagc ggtcgtatcg agttacttta catcccggaa attaaatgat
```

-continued

```
151 gtggcaaacg agcgtcttgc cattcaacag gatttgcgga atgcggcaac

201 attaattgtc cgcgatgcaa gaatggcggg gagcttcggt tgtttcaata

251 tgtccgagca tactaaagac gatattgttg attcaagtaa tcaaactcaa

301 tctaaccttg caaaacccgg tgccaaacaa gaaaatcccc ttttttcctt

351 aaaaaggagc ggcatggata aacaactgat tcccgttgct gaatccatag

401 atattaaata tccgggtttt atccagcgcc ttaacgcatt ggttttccaa

451 tacggtatcg atgatcttga tgcgagtgct gagactgttg tagtcagcag

501 ctgttccaaa atagcaaaac cgggtaagaa aatatctacc ttgcaagaag

551 caaagagtgc attacagatt actaatgatg ataaacaaaa tggaaatatc

601 acccgtcaga aacatgtggt caatgcctat gcggtcggca ggtttggcaa

651 taatgaggaa agtttgttcc gcttccaatt ggatgataag ggcaagtggg

701 gtaatcctca gttgctcgtg aaaaaggtta aacgtatgga tgtgcggtat

751 atttatgttt ccggttgtcc tgaagatgaa gatgccggca aagaggaaaa

801 attcagatat acgaataaat tcgacaaatc caaaaatgct gttacgcctg

851 ccggggtgga ggttttattg gatagcggcc ttaatgccaa gattgccgct

901 tcttcagaca atagtattta tgcttaccgt atcaatgcga caatacgcgg

951 gggaaatgta tgcgcaaaca gaacactttg a
```

This corresponds to the amino acid sequence <SEQ ID 948; ORF 247.ng>:

g247.pep

```
  1 MKRKMLNVPK GGYDGMKGFT IVEFLVAGLL SIIVLIAVVS SYFTSRKLND

 51 VANERLAIQQ DLRNAATLIV RDARMAGSFG CFNMSEHTKD DIVDSSNQTQ

101 SNLAKPGAKQ ENPLFSLKRS GMDKQLIPVA ESIDIKYPGF IQRLNALVFQ

151 YGIDDLDASA ETVVVSSCSK IAKPGKKIST LQEAKSALQI TNDDKQNGNI

201 TRQKHVVNAY AVGRFGNNEE SLFRFQLDDK GKWGNPQLLV KKVKRMDVRY

251 IYVSGCPEDE DAGKEEKFRY TNKFDKSKNA VTPAGVEVLL DSGLNAKIAA

301 SSDNSIYAYR INATIRGGNV CANRTL*
```

The following partial DNA sequence was identified in *N. meningitidis* <SEQ ID 949>:

m247.seq (partial)

```
  1 ATsAGACGTA AAATGCTAAA CGTwsyArAA GGCAGTTATG ATGGTATGAA

 51 AGGTTTTACC ATTATTGAAT TTTTGGTTGC GGGCCTGCTC AGTATGATTG

101 TCCTGATGGC GGTCGGATCG AGTTACTTCA CATCCCGGAA ATTAAATGAT

151 GCGGCAAACG AGCGTCTTGC CGCGCAACAG GATTTGCGGA ATGCGGCAAC

201 ATTGATTGTC CGCGATGCGA GAATGGCAGG CGGCTTCGGT TGTTTCAATA

251 TGTCCGAGCA TCCTGCAACT GATGTTATTC CCGATACGAC GCAACAAAAT

301 TCTCCTTTTT CCTTAAAAAG GAACGGTATA GATAAACTTA TTCCCATAGC

351 GGAATCTTCA AATATCAATT ATCAGAATTT TTTCCAGGTT GGTAGCGCAT
```

-continued

```
401 TGATTTTTCA ATACGGAATC GATGATGTTA ATGCAAGCAC CGCGACTACC

451 GTCGTCAGCA GCTGTGCCGC AATATCGAAA CCGGGCAAGC AAATCCCTAC

501 TTTAGAAGAT GCAAAAAAAG AATTGAAGAT TCCGGATCAG GATAAGGAGC

551 AAAATGGCAA TATAGCGCGT CAAAGGCATG TGGTCAATGC CTATGCGGTC

601 GGCAGGATTG CCGATGAGGA AAGTTTGTTC CGCTTCCAAT TGGATGATAA

651 GGGCAAGTGG GGTAATCCTC AGTTGC...
```

This corresponds to the amino acid sequence <SEQ ID 950; ORF 247>:

m247.pep (partial)

```
  1 XRRKMLNVXX GSYDGMKGFT IIEFLVAGLL SMIVLMAVGS SYFTSRKLND

 51 AANERLAAQQ DLRNAATLIV RDARMAGGFG CFNMSEHPAT DVIPDTTQQN

101 SPFSLKRNGI DKLIPIAESS NINYQNFFQV GSALIFQYGI DDVNASTATT

151 VVSSCAAISK PGKQIPTLED AKKELKIPDQ DKEQNGNIAR QRHVVNAYAV

201 GRIADEESLF RFQLDDKGKW GNPQL....
```

Computer analysis of this amino acid sequence gave the following results:

Homology with a predicted ORF from *N. gonorrhoeae*

ORF 247 shows 69.3% identity over a 238 aa overlap with a predicted ORF (ORF 247.ng) from *N. gonorrhoeae*:

m247/g247

```
                    10        20        30        40        50        60
m247.pep    XRRKMLNVXXGSYDGMKGFTIIEFLVAGLLSMIVLMAVGSSYFTSRKLNDAANERLAAQQ
             :||||||  |:|||||||||:|||||||||:|||:|| |||||||||||:|||||| ||
g247        MKRKMLNVPKGGYDGMKGFTIVEFLVAGLLSIIVLIAVVSSYFTSRKLNDVANERLAIQQ
                    10        20        30        40        50        60

                    70        80        90                   100
m247.pep    DLRNAATLIVRDARMAGGFGCFNMSEHPATDVI------------PDTTQQNSPESLKRN
            |||||||||||||||||:|||||||||   |::            | : |:|  |||||:
g247        DLRNAATLIVRDARMAGSFGCFNMSEHTKDDIVDSSNQTQSNLAKPGAKQENPLFSLKRS
                    70        80        90       100       110       120

           110       120       130       140       150       160
m247.pep    GIDK-LIPIAESSNINYQNFFQVGSALIFQYGIDDVNASTATTVVSSCAAISKPGKQIPT
            |:|| |||:||| :|:| :|:|  :||:|||||||::||: |:|||||: |:||||:| |
g247        GMDKQLIPVAESIDIKYPGFIQRLNALVFQYGIDDLDASAETVVVSSCSKIAKPGKKIST
                   130       140       150       160       170       180

           170       180       190       200        210       220
m247.pep    LEDAKKELKIPDQDKEQNGNIARQRHVVNAYAVGRIAD-EESLFRFQLDDKGKWGNPQL
            |::||: |:| ::|| |||||:||:||||||||||::: ||||||||||||||||||||
g247        LQEAKSALQITNDDK-QNGNITRQKHVVNAYAVGRFGNNEESLFRFQLDDKGKWGNPQLL
                   190        200       210       220       230


g247        VKKVKRMDVRYIYVSGCPEDEDAGKEEKFRYTNKFDKSKNAVTPAGVEVLLDSGLNAKIA
         240       250       260       270       280       290
```

The following partial DNA sequence was identified in *N. meningitidis* <SEQ ID 951>:

a247.seq

```
  1 ATGAGACGTA AAATGCTAAA CGTACCAAAA GGCAATTATG ATGGTATGAA

 51 GGGTTTTACC ATTATTGAAT TTTTGGTTGC GGGCATGCTC AGTATGATTG
```

-continued

```
101 TCCTGATGGC GGTCGGATCG AGTTACTTCA CATCCCGGAA ATTAAATGAT

151 GCGGCAAACG AGCGTCTTTC CGCGCAACAG GATTTGCGGA ATGCGGCAAC

201 ATTGATTGTC CGCGATGCAA GAATGGCAGG GGGCTTCGGT TGTTTCAATA

251 TGTCCGAGCA TACTAAAAAT GATATTATTG TTGATCCAAG TAAGCAAACT

301 CAACATGTCC CTGTAAAACC CGGTGCCAAA CAAGAAAATC CCCTTTTTTC

351 TTTAGAGTGG GCTAATACTA ATAATACTAA TAATAATACA GCTAAATTGA

401 TTCCTATTGC TGAATCCACA GATATTAAAT ATCCGGGTTT TGCCCAGGCT

451 CGTCCGGCAT TGATTTTCCA ATACGGCATC GATGATCTTG ATGCGAGTGC

501 TGAGACTGTT GTAGTCAGCA GCTGTTCCAA AATAGCAAAA CCGGGTAAGA

551 AAATATCTAC CTTGCAAGAA GCAAAGAGTG CATTACAGAT TACTAATGAT

601 GATAAACAAA ATGGAAATAT CACCCGTCAA AGGCATGTGG TCAATGCCTA

651 TGCGGTCGGC AGGATTGCCG GTGAGGAAGG TTTGTTCCGC TTCCAATTGG

701 ATGATAAGGG CAAGTGGGGT AATCCTCAGT TGCTCGTGAA AAAGATTAGA

751 CATATGAAAG TGCGGTATAT CTATGTTTCC GACTGTCCTG AAGATGACGA

801 TGCCGGCAAA GAGGAAAAAT TCAAATATAC GGGTACATTC GACAGCTCCA

851 CAAATGCTGT TACGCCCGCC GGGGTGGAGG TTTTATTGAG TANCGGTACT

901 GATACCAAGA TTGCCGCTTC TTCAGACAAT CATATTTATG CTTACCGTAT

951 CGATGCGACA ATACGCGGGG GAAATGTATG CGCAAACAGA ACACTTTGA
```

This corresponds to the amino acid sequence <SEQ ID 952; ORF 247.a>:

a247.pep

```
  1 MRRKMLNVPK GNYDGMKGFT IIEFLVAGML SMIVLMAVGS SYFTSRKLND

 51 AANERLSAQQ DLRNAATLIV RDARMAGGFG CFNMSEHTKN DIIVDPSKQT

101 QHVPVKPGAK QENPLFSLEW ANTNNTNNNT AKLIPIAEST DIKYPGFAQA

151 RPALIFQYGI DDLDASAETV VVSSCSKIAK PGKKISTLQE AKSALQITND

201 DKQNGNITRQ RHVVNAYAVG RIAGEEGLFR FQLDDKGKWG NPQLLVKKIR

251 HMKVRYIYVS DCPEDDDAGK EEKFKYTGTF DSSTNAVTPA GVEVLLSXGT

301 DTKIAASSDN HIYAYRIDAT IRGGNVCANR TL*
```

m247/a247 70.9% identity in 244 aa overlap

```
                       10        20        30        40        50        60
m247.pep      XRRKMLNVXXGSYDGMKGFTIIEFLVAGLLSMIVLMAVGSSYFTSRKLNDAANERLAAQQ
               |||||||  |:||||||||||||||||:|||||||||||||||||||||||||||:|||
a247          MRRKMLNVPKGNYDGMKGFTIIEFLVAGMLSMIVLMAVGSSYFTSRKLNDAANERLSAQQ
                       10        20        30        40        50        60

                       70        80        90                     100
m247.pep      DLRNAATLIVRDARMAGGFGCFNMSEHPATDVI-------------PDTTQQNSPFSLK-
              |||||||||||||||||||||||||||  :|:|             | : |:|  |||:
a247          DLRNAATLIVRDARMAGGFGCFNMSEHTKNDIIVDPSKQTQHVPVKPGAKQENPLFSLEW
                       70        80        90       100       110       120

                      110       120       130       140       150       160
m247.pep      ------RNGIDKLIPIAESSNINYQNFFQVGSALIFQYGIDDVNASTATTVVSSCAAISK
                     |:  ||||||||::|:| :| |:  ||||||||||::||: |:|||||: |:|
a247          ANTNNTNNNTAKLIPIAESTDIKYPGFAQARPALIFQYGIDDLDASAETVVVSSCSKIAK
                      130       140       150       160       170       180
```

-continued

```
                 170        180        190        200        210        220
m247.pep    PGKQIPTLEDAKKELKIPDQDKEQNGNIARQRHVVNAYAVGRIADEESLFRFQLDDKGKW
            |||:| ||::||: |:| ::|| |||||:|||||||||||||| ||:||||||||||||
a247        PGKKISTLQEAKSALQITNDDK-QNGNITRQRHVVNAYAVGRIAGEEGLFRFQLDDKGKW
                 190        200         210        220        230

m247.pep    GNPQL
            |||||
a247        GNPQLLVKKIRHMKVRYIYVSDCPEDDDAGKEEKFKYTGTFDSSTNAVTPAGVEVLLSXG
          240        250        260        270        280        290
```

The following partial DNA sequence was identified in *N. gonorrhoeae* <SEQ ID 953>:

```
g247-1.seq (partial) ..

  1 CCCGGTGCCA AACAAGAAAA TCCCCTTTTT TCCTTAAAAA GGAGCGGCAT

 51 GGATAAACAA CTGATTCCCG TTGCTGAATC CATAGATATT AAATATCCGG

101 GTTTTATCCA GCGCCTTAAC GCATTGGTTT TCCAATACGG TATCGATGAT

151 CTTGATGCGA GTGCTGAGAC TGTTGTAGTC AGCAGCTGTT CCAAAATAGC

201 AAAACCGGGT AAGAAAATAT CTACCTTGCA AGAAGCAAAG AGTGCATTAC

251 AGATTACTAA TGATGATAAA CAAAATGGAA ATATCACCCG TCAGAAACAT

301 GTGGTCAATG CCTATGCGGT CGGCAGGTTT GGCAATAATG AGGAAAGTTT

351 GTTCCGCTTC CAATTGGATG ATAAGGGCAA GTGGGGTAAT CCTCAGTTGC

401 TCGTGAAAAA GGTTAAACGT ATGGATGTGC GGTATATTTA TGTTTCCGGT

451 TGTCCTGAAG ATGAAGATGC CGGCAAAGAG GAAAAATTCA GATATACGAA

501 TAAATTCGAC AAATCCAAAA ATGCTGTTAC GCCTGCCGGG GTGGAGGTTT

551 TATTGGATAG CGGCCTTAAT GCCAAGATTG CCGCTTCTTC AGACAATAGT

601 ATTTATGCTT ACCGTATCAA TGCGACAATA CGCGGGGGAA ATGTATGCGC

651 AAACAGAACA CTTTGA
```

This corresponds to the amino acid sequence <SEQ ID 954; ORF 247-1.ng>:

```
g247-1.pep (partial) ..

  1 PGAKQENPLF SLKRSGMDKQ LIPVAESIDI KYPGFIQRLN ALVFQYGIDD

 51 LDASAETVVV SSCSKIAKPG KKISTLQEAK SALQITNDDK QNGNITRQKH

101 VVNAYAVGRF GNNEESLFRF QLDDKGKWGN PQLLVKKVKR MDVRYIYVSG

151 CPEDEDAGKE EKFRYTNKFD KSKNAVTPAG VEVLLDSGLN AKIAASSDNS

201 IYAYRINATI RGGNVCANRT L*
```

The following partial DNA sequence was identified in *N. meningitidis* <SEQ ID 955>:

```
m247-1.seq

  1 ATGAGACGTA AAATGCTAAA CGTACCAAAA GGCAGTTATG ATGGTATGAA

 51 AGGTTTTACC ATTATTGAAT TTTTGGTTGC GGGCCTGCTC AGTATGATTG

101 TCCTGATGGC GGTCGGATCG AGTTACTTCA CATCCCGGAA ATTAAATGAT
```

-continued

```
151 GCGGCAAACG AGCGTCTTGC CGCGCAACAG GATTTGCGGA ATGCGGCAAC

201 ATTGATTGTC CGCGATGCGA GAATGGCAGG CGGCTTCGGT TGTTTCAATA

251 TGTCCGAGCA TCCTGCAACT GATGTTATTC CCGATACGAC GCAACAAAAT

301 TCTCCTTTTT CCTTAAAAAG GAACGGTATA GATAAACTTA TTCCCATAGC

351 GGAATCTTCA AATATCAATT ATCAGAATTT TTTCCAGGTT GGTAGCGCAT

401 TGATTTTTCA ATACGGAATC GATGATGTTA ATGCAAGCAC CGCGACTACC

451 GTCGTCAGCA GCTGTGCCGC AATATCGAAA CCGGGCAAGC AAATCCCTAC

501 TTTAGAAGAT GCAAAAAAAG AATTGAAGAT TCCGGATCAG GATAAGGAGC

551 AAAATGGCAA TATAGCGCGT CAAAGGCATG TGGTCAATGC CTATGCGGTC

601 GGCAGGATTG CCGATGAGGA AGGTTTGTTC CGCTTCCAAT TGGATGATAA

651 GGGCAAGTGG GGTAATCCTC AGTTGCTCGT GAAAAAGGTT AGACATATGA

701 AAGTGCGGTA TATCTATGTT TCCGGCTGTC CTGAAGATGA CGATGCCGGC

751 AAAGAGGAAA CATTCAAATA TACGGATAAA TTCGACAGCG CCCAAAAATGC

801 TGTTACGCCC GCCGGGGTGG AGGTTTTATT GAGTAGCGGT ACTGATACCA

851 AGATTGCCGC TTCTTCAGAC AATCATATTT ATGCTTACCG TATCGATGCG

901 ACAATACGCG GGGGAAATGT ATGCGCAAAC AGAACACTTT GA
```

This corresponds to the amino acid sequence <SEQ ID 956; ORF 247-1>:

m247-1.pep

```
  1 MRRKMLNVPK GSYDGMKGFT IIEFLVAGLL SMIVLMAVGS SYFTSRKLND

 51 AANERLAAQQ DLRNAATLIV RDARMAGGFG CFNMSEHPAT DVIPDTTQQN

101 SPFSLKRNGI DKLIPIAESS NINYQNFFQV GSALIFQYGI DDVNASTATT

151 VVSSCAAISK PGKQIPTLED AKKELKIPDQ DKEQNGNIAR QRHVVNAYAV

201 GRIADEEGLF RFQLDDKGKW GNPQLLVKKV RHMKVRYIYV SGCPEDDDAG

251 KEETFKYTDK FDSAQNAVTP AGVEVLLSSG TDTKIAASSD NHIYAYRIDA

301 TIRGGNVCAN RTL*
```

m247-1/g247-1 72.1% identity in 222 aa overlap

```
                       70        80        90       100       110       120
m247-1.pep     NAATLIVRDARMAGGFGCFNMSEHPATDVIPDTTQQNSPFSLKRNGIDK-LIPIAESSNI
                                             | : |:|  |||||:|:|| |||:||| :|
g247-1                                       PGAKQENPLFSLKRSGMDKQLIPVAESIDI
                                                      10        20        30

                      130       140       150       160       170       180
m247-1.pep     NYQNFFQVGSALIFQYGIDDVNASTATTVVSSCAAISKPGKQIPTLEDAKKELKIPDQDK
               :| :|:|  :||:|||||||::||: |:|||||: |:||||:| ||::||: |:| ::||
g247-1         KYPGFIQRLNALVFQYGIDDLDASAETVVVSSCSKIAKPGKKISTLQEAKSALQITNDDK
                       40        50        60        70        80        90

                      190       200       210       220       230       240
m247-1.pep     EQNGNIARQRHVVNAYAVGRIAD-EEGLFRFQLDDKGKWGNPQLLVKKVRHMKVRYIYVS
                |||||:||:||||||||||::: ||:|||||||||||||||||||||||::| |||||||
g247-1         -QNGNITRQKHVVNAYAVGRFGNNEESLFRFQLDDKGKWGNPQLLVKKVKRMDVRYIYVS
                       100       110       120       130       140

                      250       260       270       280       290       300
m247-1.pep     GCPEDDDAGKEETFKYTDKFDSAQNAVTPAGVEVLLSSGTDTKIAASSDNHIYAYRIDAT
               |||||:|||||| |:||:|||:::||||||||||||:|| ::|||||||| ||||||:||
g247-1         GCPEDEDAGKEEKFRYTNKFDKSKNAVTPAGVEVLLDSGLNAKIAASSDNSIYAYRINAT
             150       160       170       180       190       200
```

-continued

```
                        310
m247-1.pep     IRGGNVCANRTLX
               |||||||||||||
g247-1         IRGGNVCANRTLX
             210       220
```

The following partial DNA sequence was identified in *N. meningitidis* <SEQ ID 957>:

```
a247-1.seq (partial)

  1 AATAATACAG CTAAATTGAT TCCTATTGCT GAATCCACAG ATATTAAATA
 51 TCCGGGTTTT GCCCAGGCTC GTCCGGCATT GATTTTCCAA TACGGCATCG
101 ATGATCTTGA TGCGAGTGCT GAGACTGTTG TAGTCAGCAG CTGTTCCAAA
151 ATAGCAAAAC CGGGTAAGAA AATATCTACC TTGCAAGAAG CAAAGAGTGC
201 ATTACAGATT ACTAATGATG ATAAACAAAA TGGAAATATC ACCCGTCAAA
251 GGCATGTGGT CAATGCCTAT GCGGTCGGCA GGATTGCCGG TGAGGAAGGT
301 TTGTTCCGCT TCCAATTGGA TGATAAGGGC AAGTGGGGTA ATCCTCAGTT
351 GCTCGTGAAA AAGATTAGAC ATATGAAAGT GCGGTATATC TATGTTTCCG
401 ACTGTCCTGA AGATGACGAT GCCGGCAAAG AGGAAAAATT CAAATATACG
451 GGTACATTCG ACAGCTCCAC AAATGCTGTT ACGCCCGCCG GGGTGGAGGT
501 TTTATTGAGT AGCGGTACTG ATACCAAGAT TGCCGCTTCT TCAGACAATC
551 ATATTTATGC TTACCGTATC GATGCGACAA TACGCGGGGG AAATGTATGC
601 GCAAACAGAA CACTTTGA
```

This corresponds to the amino acid sequence <SEQ ID 958; ORF 247-1.a>:

```
a247-1.pep (partial) ..

  1 NNTAKLIPIA ESTDIKYPGF AQARPALIFQ YGIDDLDASA ETVVVSSCSK
 51 IAKPGKKIST LQEAKSALQI TNDDKQNGNI TRQRHVVNAY AVGRIAGEEG
101 LFRFQLDDKG KWGNPQLLVK KIRHMKVRYI YVSDCPEDDD AGKEEKFKYT
151 GTFDSSTNAV TPAGVEVLLS SGTDTKIAAS SDNHIYAYRI DATIRGGNVC
201 ANRTL*
```

m247-1/a247-1 80.6% identity in 206 aa overlap

```
                                                          10        20        30
a247-1.pep                                        NNTAKLIPIAESTDIKYPGFAQARPALIFQ
                                                  |:  ||||||||::|:|  :|  |:  |||||
m247-1         GFGCFNMSEHPATDVIPDTTQQNSPFSLKRNGIDKLIPIAESSNINYQNFFQVGSALIFQ
                80        90       100       110       120       130

                      40        50        60        70        80       89
a247-1.pep     YGIDDLDASAETVVVSSCSKIAKPGKKISTLQEAKSALQITNDDK-QNGNITRQRHVVNA
               |||||::||: |:|||||: |:||||:| ||::||: |:| ::|| |||||:||||||||
m247-1         YGIDDVNASTATTVVSSCAAISKPGKQIPTLEDAKKELKIPDQDKEQNGNIARQRHVVNA
               140       150       160       170       180       190

             90       100       110       120       130       140      149
a247-1.pep     YAVGRIAGEEGLFRFQLDDKGKWGNPQLLVKKIRHMKVRYIYVSDCPEDDDAGKEEKFKY
               ||||||| |||||||||||||||||||||||:||||||||||| |||||||||| |||
m247-1         YAVGRIADEEGLFRFQLDDKGKWGNPQLLVKKVRHMKVRYIYVSGCPEDDDAGKEETFDY
               200       210       220       230       240       250
```

-continued

```
             150        160        170        180        190        200
a247-1.pep     TGTFDSSTNAVTPAGVEVLLSSGTDTKIAASSDNHIYAYRIDATIRGGNVCANRTLX
               |  |||: ||||||||||||||||||||||||||||||||||||||||||||||||
m247-1         TDKFDSAQNAVTPAGVEVLLSSGTDTKIAASSDNHIYAYRIDATIRGGNVCANRTLX
               260        270        280        290        300        310
```

The following partial DNA sequence was identified in *N. gonorrhoeae* <SEQ ID 959>:

g248.seq

```
  1 atgcgcaaac agaacacttt gacaggaatc ccgacttctg acggacagag
 51 ggggtccgca ctgtttatcg tgctgatggt gatgatagtc gtggcctttt
101 tggttgtaac tgccgcccag tcctacaata ccgaacagag gatcagtgcc
151 aacgaatcag acaggaaatt ggctttgtct ttagccgagg cggctttgcg
201 ggagggcgaa tttcaggttt tggatttgga atatgctgcg gacagtaagg
251 ttacgtttag cgaaaactgt gaaaaaggtc tgtgtaccgc agtgaatgtg
301 cggacaaata ataatggtag tgaagaggct tttggcaata tcgtggtgca
351 aggcaagccc gccgttgagg cggtgaaacg ttcttgccct gcaaagtctg
401 gcaaaaattc taccgacctg tgcattgaca ataaagggat ggaatataat
451 aaaggcgcgg caggcgtcag caaaatgccg cgctatatta tcgaatattt
501 aggcgtgaag aacggacaaa atgtttatcg ggttactgcc aaggcttggg
551 gtaagaatgc caataccgtg gtcgtccttc aatcttatgt aggcaataat
601 gatgagcaat aa
```

This corresponds to the amino acid sequence <SEQ ID 960; ORF 248.ng>:

g248.pep

```
  1 MRKQNTLTGI PTSDGQRGSA LFIVLMVMIV VAFLVVTAAQ SYNTEQRISA
 51 NESDRKLALS LAEAALREGE FQVLDLEYAA DSKVTFSENC EKGLCTAVNV
101 RTNNNGSEEA FGNIVVQGKP AVEAVKRSCP AKSGKNSTDL CIDNKGMEYN
151 KGAAGVSKMP RYIIEYLGVK NGQNVYRVTA KAWGKNANTV VVLQSYVGNN
201 DEQ*
```

The following partial DNA sequence was identified in *N. meningitidis* <SEQ ID 961>:

m248.seq (partial)

```
  1 ..GGGTTTGCAC TGTTAATCGT GCTGATGGTG ATrATCGTCG TGGCT.TywT
 51   gGwTGTAACT GCCGCGCAGT CTTACAATAC cGAGCAGCGk ATCAGTkCCA
101   ACGAATCAGA CAGGAAATTG GCTwTGTCTT TGGCCGAGkC GkCTwTGCGG
151   GAAGGCGAAC TTCAGGTTTT GGATTTGGAA TATGATACGG ACAGTAAGGT
201   TACATTTAGC GAAAACTGTG GAAAAGGTCT GTsTGCCGCA GTGAATGTGC
251   GGACAAATAA TGATAATGAA GAGGCTTTTG ACAATATCGT GGTGCAAGGC
```

-continued

```
301   AAGCCCACCG TTGAGGCGGT GAAGCGTTCT TGCCCTGCAA ATTCTACCGA

351   CCTGTGCATT GACAAGAAAG GGwTGGAATA TAAGAAAGGC ACGAGAAGCG

401   TCAc.AAAAT GCCACGTTAT ATTATCGAAT ATTTGGGCGT GwAGAACGGA

451   GAAAATGTTT ATCGGGTTAC TGCCAAGGCT TGGGGtAAGA ATGCCAATAC

501   CGTGGTCGTC CTTCAATCTT ATGTAAGCAA TAATGATGAG TAA
```

This corresponds to the amino acid sequence <SEQ ID 962; ORF 248>:

m248.pep (partial)

```
  1 ..GFALLIVLMV XIVVAFXXVT AAQSYNTEQR ISXNESDRKL AXSLAEXXXR

 51   EGELQVLDLE YDTDSKVTFS ENCGKGLXAA VNVRTNNDNE EAFDNIVVQG

101   KPTVEAVKRS CPANSTDLCI DKKGXEYKKG TRSVTKMPRY IIEYLGVXNG

151   ENVYRVTAKA WGKNANTVVV LQSYVSNNDE *
```

Computer analysis of this amino acid sequence gave the following results:

Homology with a predicted ORF from *N. gonorrhoeae*

ORF 248 shows 81.1% identity over a 185 aa overlap with a predicted ORF (ORF 248.ng) from *N. gonorrhoeae*:

m248/g248

```
                                    10        20        30        40
m248.pep                    GFALLIVLMVXIVVAFXXVTAAQSYNTEQRISXNESDRKLAXS
                            | ||:||||| |||||  ||||||||||||| ||||||| |
g248        MRKQNTLTGIPTSDGQRGSALFIVLMVMIVVAFLVVTAAQSYNTEQRISANESDRKLALS
                    10        20        30        40        50        60

                50        60        70        80        90       100
m248.pep    LAEXXXREGELQVLDLEYDTDSKVTFSENCGKGLXAAVNVRTNND-NEEAFDNIVVQGKP
            |||   |||||||||||| :||||||||| ||| :|||||||: :|||| |||||||
g248        LAEAALREGELQVLDLEYAADSKVTFSENCEKGLCTAVNVRTNNNGSEEAFGNIVVQGKP
                    70        80        90       100       110       120

              110            120       130       140       150
m248.pep    TVEAVKRSCPA----NSTDLCIDKKGXEYKKGTRSVTKMPRYIIEYLGVXNGENVYRVTA
            :||||||||||    ||||||||:|| ||:||: :|:||||||||||| ||:|||||||
g248        AVEAVKRSCPAKSGKNSTDLCIDNKGMEYNKGAAGVSKMPRYIIEYLGVKNGQNVYRVTA
                   130       140       150       160       170       180

           160       170       180
m248.pep    KAWGKNANTVVVLQSYVSNNDEX
            |||||||||||||||||:||||
g248        KAWGKNANTVVVLQSYVGNNDEQX
                   190       200
```

The following partial DNA sequence was identified in *N. meningitidis* <SEQ ID 963>:

a248.seq

```
  1 ATGCGCAAAC AGAACACTTT GACGGGAATC CCGACTTCTG ACGGACAGAG

 51 GGGGTTTGCA CTGTTTATCG TGCTGATGGT GATGATCGTC GTGGCTTTTT

101 TGGTTGTAAC TGCCGCGCAG TCTTACAATA CCGAGCAGCG GATCAGTGCC

151 AACGAATCAG ACAGGAAATT GGCTTTGTCT TTGGCCGAGG CGGCTTTGCG

201 GGAAGGCGAA CTTCAGGTTT TGGATTTGGA ATATGATACG GACAGTAAGG

251 TTACATTTAG CGAAAACTGT GGAAAAGGTC TGTGTACCGC AGTGAATGTG
```

-continued

301 CGGACAAATA ATGATAATGA AGAGGCTTTT GACAATATCG TGGTGCAAGG

351 CAAGCCCACC GTTGAGGCGG TGAAGCGTTC TTGCACTGCA AAATCTACAG

401 GCCTGTGCAT TGACAATAAA GGGATGGAAT ATAAGAAAGG CACGCAAAGC

451 GTCAGCAAAA TGCCACGTTA TATTATCGAA TATTTGGGCG TGAAGAACGG

501 AGAAAATGTT TATCGGGTTA CTGCCAAGGC TTGGGGTAAG AATGCCAATA

551 CCGTGGTCGT CCTTCAATCT TATGTAAGCA ATAATGATGA GTAA

This corresponds to the amino acid sequence <SEQ ID 964; ORF 248.a>:

a248.pep

1 MRKQNTLTGI PTSDGQRGFA LFIVLMVMIV VAFLVVTAAQ SYNTEQRISA

51 NESDRKLALS LAEAALREGE LQVLDLEYDT DSKVTFSENC GKGLCTAVNV

101 RTNNDNEEAF DNIVVQGKPT VEAVKRSCTA KSTGLCIDNK GMEYKKGTQS

151 VSKMPRYIIE YLGVKNGENV YRVTAKAWGK NANTVVVLQS YVSNNDE* m248/a248 89.4% identity in 180 aa overlap

```
                                      10        20        30        40
m248.pep                      GFALLIVLMVXIVVAFXXVTAAQSYNTEQRISXNESDRKLAXS
                              ||||:||||| |||||  |||||||||||||| |||||||| |
a248         MRKQNTLTGIPTSDGQRGFALFIVLMVMIVVAFLVVTAAQSYNTEQRISANESDRKLALS
                     10        20        30        40        50        60

                  50        60        70        80        90       100
m248.pep     LAEXXXREGELQVLDLEYDTDSKVTFSENCGKGLXAAVNVRTNNDNEEAFDNIVVQGKPT
             |||   |||||||||||||||||||||||||||| :||||||||||||||||||||||||
a248         LAEAALREGELQVLDLEYDTDSKVTFSENCGKGLCTAVNVRTNNDNEEAFDNIVVQGKPT
                     70        80        90       100       110       120

                 110       120       130       140       150       160
m248.pep     VEAVKRSCPANSTDLCIDKKGXEYKKGTRSVTKMPRYIIEYLGVXNGENVYRVTAKAWGK
             |||||||| |:|| ||||:|| ||||||:||:|||||||||||| |||||||||||||||
a248         VEAVKRSCTAKSTGLCIDNKGMEYKKGTQSVSKMPRYIIEYLGVKNGENVYRVTAKAWGK
                    130       140       150       160       170       180

                 170       180
m248.pep     NANTVVVLQSYVSNNDEX
             ||||||||||||||||||
a248         NANTVVVLQSYVSNNDEX
                    190
```

The following partial DNA sequence was identified in *N. meningitidis* <SEQ ID 965>:

m248-1.seq

1 ATGCGCAAAC AGAACACTTT GACGGGAATC CCGACTTCTG ACGGACAGAG

51 GGGGTTTGCA CTGTTTATCG TGCTGATGGT GATGATCGTC GTGGCTTTTT

101 TGGTTGTAAC TGCCGCGCAG TCTTACAATA CCGAGCAGCG GATCAGTGCC

151 AACGAATCAG ACAGGAAATT GGCTTTGTCT TTGGCCGAGG CGGCTTTGCG

201 GGAAGGCGAA CTTCAGGTTT TGGATTTGGA ATATGATACG GACAGTAAGG

251 TTACATTTAG CGAAAACTGT GGAAAAGGTC TGTGTGCCGC AGTGAATGTG

301 CGGACAAATA ATGATAATGA AGAGGCTTTT GACAATATCG TGGTGCAAGG

351 CAAGCCCACC GTTGAGGCGG TGAAGCGTTC TTGCCCTGCA AATTCTACCG

-continued

```
401 ACCTGTGCAT TGACAAGAAA GGGATGGAAT ATAAGAAAGG CACGAGAAGC

451 GTCAGCAAAA TGCCACGTTA TATTATCGAA TATTTGGGCG TGAAGAACGG

501 AGAAAATGTT TATCGGGTTA CTGCCAAGGC TTGGGGTAAG AATGCCAATA

551 CCGTGGTCGT CCTTCAATCT TATGTAAGCA ATAATGATGA GTAA
```

This corresponds to the amino acid sequence <SEQ ID 966; ORF 248-1>:

m248-1.pep

```
  1 MRKQNTLTGI PTSDGQRGFA LFIVLMVMIV VAFLVVTAAQ SYNTEQRISA

 51 NESDRKLALS LAEAALREGE LQVLDLEYDT DSKVTFSENC GKGLCAAVNV

101 RTNNDNEEAF DNIVVQGKPT VEAVKRSCPA NSTDLCIDKK GMEYKKGTRS

151 VSKMPRYIIE YLGVKNGENV YRVTAKAWGK NANTVVVLQS YVSNNDE*
```

m248-1/g248 89.1% identity in 202 aa overlap

```
                      10        20        30        40        50        60
m248-1.pep    MRKQNTLTGIPTSDGQRGFALFIVLMVMIVVAFLVVTAAQSYNTEQRISANESGRKLALS
              |||||||||||||||||| |||||||||||||||||||||||||||||||||||||||||
g248          MRKQNTLTGIPTSDGQRGSALFIVLMVMIVVAFLVVTAAQSYNTEQRISANESGRKLALS
                      10        20        30        40        50        60

                      70        80        90       100       110       119
m248-1.pep    LAEAALREGELQVLDLEYDTDSKVTFSENCGKGLCAAVNVRTNND-NEEAFDNIVVQGKP
              ||||||||||:||||||| :|||||||||| ||||:||||||||: :|||| ||||||||
g248          LAEAALREGEFQVLDLEYAADSKVTFSENCEKGLCTAVNVRTNNNGSEEAFGNIVVQGKP
                      70        80        90       100       110       120

            120       130           140       150       160       170
m248-1.pep    TVEAVKRSCPA----NSTDLCIDKKGMEYKKGTRSVSKMPRYIIEYLGVKNGENVYRVTA
              :||||||||||    ||||||||:|||||:||: :|||||||||||||||||:|||||||
g248          AVEAVKRSCPAKSGKNSTDLCIDNKGMEYNKGARGVSKMPRYIIEYLGVKNGQNVYRVTA
                     130       140       150       160       170       180

                 180       190
m248-1.pep    KAWGKNANTVVVLQSYVSNNDEX
              |||||||||||||||||:||||
g248          KAWGKNANTVVVLQSYVGNNDEQX
                     190       200
```

m248-1/a248 97.0% identity in 197 aa overlap

```
                      10        20        30        40        50        60
m248-1.pep    MRKQNTLTGIPTSDGQRGFALFIVLMVMIVVAFLVVTAAQSYNTEQRISANESDRKLALS
              ||||||||||||||||||||||||||||||||||||||||||||||||||||||||||||
a248          MRKQNTLTGIPTSDGQRGFALFIVLMVMIVVAFLVVTAAQSYNTEQRISANESDRKLALS
                      10        20        30        40        50        60

                      70        80        90       100       110       120
m248-1.pep    LAEAALREGELQVLDLEYDTDSKVTFSENCGKGLCAAVNVRTNNDNEEAFDNIVVQGKPT
              |||||||||||||||||||||||||||||||||||:|||||||||||||||| ||||||||
a248          LAEAALREGELQVLDLEYDTDSKVTFSENCGKGLCTAVNVRTNNDNEEAFDNIVVQGKPT
                      70        80        90       100       110       120

                     130       140       150       160       170       180
m248-1.pep    VEAVKRSCPANSTDLCIDKKGMEYKKGTRSVSKMPRYIIEYLGVKNGENVYRVTAKAWGK
              |||||||| |:|||||||:|||||||||:|||||||||||||||||||||||||||||||
a248          VEAVKRSCTAKSTDLCIDNKGMEYKKGTQSVSKMPRYIIEYLGVKNGENVYRVTAKAWGK
                     130       140       150       160       170       180

                     190
m248-1.pep    NANTVVVLQSYVSNNDEX
              |||||||||||||||||
a248          NANTVVVLQSYVSNNDEX
                     190
```

The following partial DNA sequence was identified in *N. gonorrhoeae* <SEQ ID 967>:

g249.seq

```
  1 atgaagaata atgattgctt gcgcctgaaa aatccccagt ccggtatggc
 51 gttgatagaa gtcttggtcg ctatgctcgt tctgaccatc ggtattttgg
101 cattgctgtc cgtacagttg cggacagtcg cttccgtcag ggaggcggaa
151 acgcaaacca tcgtcagcca aatcacgcaa aacctgatgg aaggaatgtt
201 gatgaatccg accattgatt tggacagcaa caagaaaaac tatagtcttt
251 acatgggaaa acagacacta tcagctgtgg atggtgagtt tatgcttgat
301 gccgagaaaa gtaaggcgca gttggcagag gaacaattga agagatttag
351 tcatgagctg aaaaatgcct tgccggatgc ggtagctatt cattacgccg
401 tctgcaagga ttcgtcgggt gacgcgccga cattgtccga cagcggtgct
451 tttcttcaa attgcgacaa taaggcaaac ggggatactt tgattaaagt
501 attgtgggta aatgattcgg caggggattc ggatatttcc cgtacgaatc
551 ttgaagtgag cggcgacaat atcgtatata cctatcaggc aagggtcgga
601 ggtcgtgaat ga
```

This corresponds to the amino acid sequence <SEQ ID 968; ORF 249.ng>:

g249.pep

```
  1 MKNNDCLRLK NPQSGMALIE VLVAMLVLTI GILALLSVQL RTVASVREAE
 51 TQTIVSQITQ NLMEGMLMNP TIDLDSNKKN YSLYMGKQTL SAVDGEFMLD
101 AEKSKAQLAE EQLKRFSHEL KNALPDAVAI HYAVCKDSSG DAPTLSDSGA
151 FSSNCDNKAN GDTLIKVLWV NDSAGDSDIS RTNLEVSGDN IVYTYQARVG
201 GRE*
```

The following partial DNA sequence was identified in *N. meningitidis* <SEQ ID 969>:

m249.seq

```
  1 ATGAAGAATA ATGATTGCTT CCGCCTGAAA GATTCCCAGT CCGGTATGGC
 51 GCTGATAGAA GTCTTGGTTG CTATGCTCGT TCTGACCATC GGTATTTTGG
101 CACTATTGTC TGTACAGTTG CGGACAGTCN NNNNNNNNNN NNNNNNNNNN
151 NNNNNNNNNN NNNNNNNNNN NNNNNNNNNN NNNTTGATGG AGGGAATGTT
201 GATGAATCCG ACCATTGATT CGGACAGCAA CAAGAAAAAC TATAATCTTT
251 ACATGGGAAA CCATACACTA TCAGCTGTGG ATGGCGATTT TGCGATTGAT
301 GCCATGAAAA CTAAGGGGCA ATTGGCAGAG GCACAATTGA AGAGATTTAG
351 TTATGAGCTG AAAAATGCCT TGCCGGATGC GGCAGCCATC CATTACGCCG
401 TCTGCAAGGA TTCGTCGGGT AACGCGCCGA CATTGTCCGG CAATGCTTTT
451 TCTTCAAATT GCGACAATAA GGCAAACGGG GATACTTTAA TTAAAGTATT
501 GTGGGTAAAT GATTCGGCAG GGGATTCGGA TATTTCCCGT ACGAATCTTG
551 AGGTGAGCGG CGACAATATC GTATATACTT ATCAGGCAAG GGTCGGAGGT
601 CGGGAATGA
```

This corresponds to the amino acid sequence <SEQ ID 970; ORF 249>:

m249.pep

```
  1 MKNNDCFRLK DSQSGMALIE VLVAMLVLTI GILALLSVQL RTVXXXXXXX

 51 XXXXXXXXXX XLMEGMLMNP TIDSDSNKKN YNLYMGNHTL SAVDGDFAID

101 AMKTKGQLAE AQLKRFSYEL KNALPDAAAI HYAVCKDSSG NAPTLSGNAF

151 SSNCDNKANG DTLIKVLWVN DSAGDSDISR TNLEVSGDNI VYTYQARVGG

201 RE*
```

Computer analysis of this amino acid sequence gave the following results:

Homology with a predicted ORF from *N. gonorrhoeae*

ORF 249 shows 81.3% identity over a 203 aa overlap with a predicted ORF (ORF 249.ng) from *N. gonorrhoeae*:

m249/g249

```
                     10        20        30        40        50        60
m249.pep     MKNNDCFRLKDSQSGMALIEVLVAMLVLTIGILALLSVQLRTVXXXXXXXXXXXXXXXXX
             ||||||:|||: |||||||||||||||||||||||||||||||       : :     : 
g249         MKNNDCLRLKNPQSGMALIEVLVAMLVLTIGILALLSVQLRTVASVREAETQTIVSQITQ
                     10        20        30        40        50        60

                     70        80        90       100       110       120
m249.pep     XLMEGMLMNPTIDSDSNKKNYNLYMGNHTLSAVDGDFAIDAMKTKGQLAEAQLKRFSYEL
              |||||||||||| |||||||:||||::|||||||:| :|| |:|:|||| ||||||:||
g249         NLMEGMLMNPTIDLDSNKKNYSLYMGKQTLSAVDGEFMLDAEKSKAQLAEEQLKRFSHEL
                     70        80        90       100       110       120

                    130       140       150       160       170       179
m249.pep     KNALPDAAAIHYAVCKDSSGNAPTLSGN-AFSSNCDNKANGDTLIKVLWVNDSAGDSDIS
             |||||||:||||||||||||:||||| : |||||||||||||||||||||||||||||||
g249         KNALPDAVAIHYAVCKDSSGDAPTLSDSGAFSSNCDNKANGDTLIKVLWVNDSAGDSDIS
                     70        80        90       160       170       180

          180       190       200
m249.pep     RTNLEVSGDNIVYTYQARVGGREX
             ||||||||||||||||||||||||
g249         RTNLEVSGDNIVYTYQARVGGREX
                    190       200
```

The following partial DNA sequence was identified in *N. meningitidis* <SEQ ID 971>:

a249.seq

```
  1 ATGAAGAATA ATGATTGCTT CCGCCTGAAA AACCCCCAGT CCGGTATGGC

 51 GCTGATAGAA GTCTTGGTCG CTATGCTCGT TCTGACCATC GGTATTTTGG

101 CACTATTGTC TGTTCAGTTG CGGACAGTCG CTTCCGTCAG GGAGGCAGAG

151 ACGCAAACCA TCGTCAGTCA AATCACGCAA AACCTGATGG AAGGAATGTT

201 GATGAATCCG ACCATTGATT CGGACAGCAA CAAGAAAAAC TATAATCTTT

251 ACATGGGAAA CCATCATGCA CTATCAGTTG TGGATGGCGA TTTTCAGGTT

301 GATGCCATAA AAACTAAGAC GCAGTTGGCA GAGGCACAAT TGAAGAGATT

351 TAGTTATGAG CTGAAAAATG CCTTGCCGGA TGCGGCAGCC ATCCATTACG

401 CCGTCTGCAA GGATTCGTCG GGTGTTGCGC CGACATTGTC CGCCGGCAGT

451 ACTTTTTCTT CAAATTGCGA TGGTAGTGCA AATGGGGATA CTTTGATTAA

501 AGTATTGTGG GTAAATGATT CGGCAGGGGA TTCGGATATC GCCCGTACGA

551 ATCTTGAGAC GAACGGCAAC AATATCGTAT ATACCTATCA GGCAAGGGTC

601 GGAGGTCGGG AATGA
```

This corresponds to the amino acid sequence <SEQ ID 972; ORF 249.a>:

a249.pep

```
  1 MKNNDCFRLK NPQSGMALIE VLVAMLVLTI GILALLSVQL RTVASVREAE
 51 TQTIVSQITQ NLMEGMLMNP TIDSDSNKKN YNLYMGNHHA LSVVDGDFQV
101 DAIKTKTQLA EAQLKRFSYE LKNALPDAAA IHYAVCKDSS GVAPTLSAGS
151 TFSSNCDGSA NGDTLIKVLW VNDSAGDSDI ARTNLETNGN NIVYTYQARV
201 GGRE*
```

m249/a249 81.9% identity in 204 aa overlap

```
                        10        20        30        40        50        60
m249.pep       MKNNDCFRLKDSQSGMALIEVLVAMLVLTIGILALLSVQLRTVXXXXXXXXXXXXXXXXX
               ||||||||||: |||||||||||||||||||||||||||||||       : :     :
a249           MKNNDCFRLKNPQSGMALIEVLVAMLVLTIGILALLSVQLRTVASVREAETQTIVSQITQ
                        10        20        30        40        50        60

                        70        80        90       100       110       119
m249.pep       XLMEGMLMNPTIDSDSNKKNYNLYMGNH-TLSAVDGDFAIDAMKRKGQLAEAQLKRFSYE
                ||||||||||||||||||||||||||| :||:||||| :||:||| |||||||||||||
a249           NLMEGMLMNPTIDSDSNKKNYNLYMGNHHALSVVDGDFQVDAIKRKTQLAEAQLKRFSYE
                        70        80        90       100       100       120

            120       130       140       150       160       170
m249.pep       LKNALPDAAAIHYAVCKDSSGNAPTLS-GNAFSSNCDNKANGDTLIKVLWVNDSAGDSDI
               ||||||||||||||||||||| ||||| |::||||||::|||||||||||||||||||||
a249           LKNALPDAAAIHYAVCKDSSGVAPTLSAGSTFSSNCDGSANGDTLIKVLWVNDSAGDSDI
                        70        80        90       100       100       180

             180       190       200
m249.pep       SRTNLEVSGDNIVYTYQARVGGREX
               :|||||::|:|||||||||||||||
a249           ARTNLETNGNNIVYTYQARVGGREX
                       190       200
```

The following partial DNA sequence was identified in *N. meningitidis* <SEQ ID 973>:

m249-1.seq

```
  1 ATGAAGAATA ATGATTGCTT CCGCCTGAAA GATTCCCAGT CCGGTATGGC
 51 GCTGATAGAA GTCTTGGTTG CTATGCTCGT TCTGACCATC GGTATTTTGG
101 CACTATTGTC TGTACAGTTG CGGACAGTCG CTTCCGTCAG GGAGGCGGAG
151 ACACAAACCA TCGTCAGCCA AATCACGCAA AACCTGATGG AGGGAATGTT
201 GATGAATCCG ACCATTGATT CGGACAGCAA CAAGAAAAAC TATAATCTTT
251 ACATGGGAAA CCATACACTA TCAGCTGTGG ATGGCGATTT TGCGATTGAT
301 GCCATGAAAA CTAAGGGGCA ATTGGCAGAG GCACAATTGA AGAGATTTAG
351 TTATGAGCTG AAAAATGCCT TGCCGGATGC GGCAGCCATC CATTACGCCG
401 TCTGCAAGGA TTCGTCGGGT AACGCGCCGA CATTGTCCGG CAATGCTTTT
451 TCTTCAAATT GCGACAATAA GGCAAACGGG GATACTTTAA TTAAAGTATT
501 GTGGGTAAAT GATTCGGCAG GGGATTCGGA TATTTCCCGT ACGAATCTTG
551 AGGTGAGCGG CGACAATATC GTATATACTT ATCAGGCAAG GGTCGGAGGT
601 CGGGAATGA
```

This corresponds to the amino acid sequence <SEQ ID 974; ORF 249-1>:

m249-1.pep

```
  1 MKNNDCFRLK DSQSGMALIE VLVAMLVLTI GILALLSVQL RTVASVREAE

 51 TQTIVSQITQ NLMEGMLMNP TIDSDSNKKN YNLYMGNHTL SAVDGDFAID

101 AMKTKGQLAE AQLKRFSYEL KNALPDAAAI HYAVCKDSSG NAPTLSGNAF

151 SSNCDNKANG DTLIKVLWVN DSAGDSDISR TNLEVSGDNI VYTYQARVGG

201 RE*
```

m249-1/g249 90.1% identity in 203 aa overlap

```
                      10        20        30        40        50        60
m249-1.pep    MKNNDCFRLKDSQSGMALIEVLVAMLVLTIGILALLSVQLRTVASVREAETQTIVSQITQ
              ||||||:|||: ||||||||||||||||||||||||||||||||||||||||||||||||
g249          MKNNDCLRLKNPQSGMALIEVLVAMLVLTIGILALLSVQLRTVASVREAETQTIVSQITQ
                      10        20        30        40        50        60

                      70        80        90       100       110       120
m249-1.pep    NLMEGMLMNPTIDSDSNKKNYNLYMGNHTLSAVDGDFAIDAMKTKGQLAEAQLKRFSYEL
              ||||||||||||| |||||||:||||::|||||||:| :|| |:|:|||| ||||||:||
g249          NLMEGMLMNPTIDLDSNKKNYSLYMGKQTLSAVDGEFMLDAEKSKAQLAEEQLKRFSHEL
                      70        80        90       100       110       120

                     130       140       150       160       170       179
m249-1.pep    KNALPDAAAIHYAVCKDSSGNAPTLSGN-AFSSNCDNKANGDTLIKVLWVNDSAGDSDIS
              |||||||:||||||||||||:||||| : |||||||||||||||||||||||||||||||
g249          KNALPDAVAIHYAVCKDSSGDAPTLSDSGAFSSNCDNKANGDTLIKVLWVNDSAGDSDIS
                     130       140       150       160       170       180

           180       190       200
m249-1.pep    RTNLEVSGDNIVYTYQARVGGREX
              ||||||||||||||||||||||||
g249          RTNLEVSGDNIVYTYQARVGGREX
                    190       200
```

a249/L36117 gi|643582 (L36117) prepilin leader sequence requires cleavage to be active [*Pseudomonas aeruginosa*] >gi|1161222 (L48934) involved in type 4 fimbrial biogenesis; contains pre-pilin like leader sequence [*Pseudomonas aeruginosa*] >gi|1246299 (L76605) reference L36117, L48934 [*Pseudomonas aeruginosa*] Length=185

Score=50.4 bits (118), Expect=9e−06

Identities=45/183 (24%), Positives=84/183 (45%), Gaps=26/183 (14%)

```
Query:  13 QSGMALIEVLVAMLVLTIGILALLSVQLRTVASVREAETQTIVSQITQNLMEGMLMNPTI   72
           QSG ++IEVLVA+L+++IG+L ++++Q +T+    ++  +   + +  NL+E M  +P
Sbjct:  12 QSGFSMIEVLVALLLISIGVLGMIAMQGKTIQYTADSVERNKAAMLGSNLLESMRASPKA   71

Query:  73 DSDSNKKNYNLYMGNHHALSVVDGDFQVDAIKTKTQLAEA---QLKRFSYELKNALPDAA  129
             D   +     M          G     A  + T L +A   +L  ++ ++KN LP A
Sbjct:  72 LYDVKDQ-----MATQSDFFKAKGSAFPTAPSSCTPLPDAIKDRLGCWAEQVKNELPGAG  126

Query: 130 AI---HYAVCKDSSGVAPTLSAGSTFSSNCDGSANGDTL-IKVLWVNDSAGDSDIARTNL  185
            +    Y +C+ S               +CDG   G  L I++ W        + A ++
Sbjct: 127 DLLKSDYYICRSSK------------PGDCDG--KGSMLEIRLAWRGKQGACVNAADSSA  172

Query: 186 ETN                                                          188
           +T+
Sbjct: 173 DTS                                                          175
```

m249-1/a249 90.7% identity in 204 aa overlap

```
                      10        20        30        40        50        60
m249-1.pep    MKNNDCFRLKDSQSGMALIEVLVAMLVLTIGILALLSVQLRTVASVREAETQTIVSQITQ
              ||||||||||: ||||||||||||||||||||||||||||||||||||||||||||||||
a249          MKNNDCLRLKNPQSGMALIEVLVAMLVLTIGILALLSVQLRTVASVREAETQTIVSQITQ
                      10        20        30        40        50        60

                      70        80         90       100       110      119
m249-1.pep    NLMEGMLMNPTIDSDSNKKNYNLYMGNH-TLSAVDGDFAIDAMKTKGQLAEAQLKRFSYE
              |||||||||||||||||||||||||||| :||:||||| :||:||| |||||||||||||
a249          NLMEGMLMNPTIDSDSNKKNYNLYMGNHHALSVVDGDFQVDAIKTKTQLAEAQLKRFSYE
                      70        80        90       100       110       120
```

-continued

```
             120        130        140         150        160        170
m249-1.pep   LKNALPDAAAIHYAVCKDSSGNAPTLS-GNAFSSNCDNKANGDTLIKVLWVNDSAGDSDI
             ||||||||||||||||||||| ||||| |::||||||::|||||||||||||||||||||
a249         LKNALPDAAAIHYAVCKDSSGVAPTLSAGSTFSSNCDGSANGDTLIKVLWVNDSAGDSDI
                     130        140        150        160        170        180
```

```
             180         190        200
m249-1.pep   SRTNLEVSGDNIVYTYQARVGGREX
             :|||||::|:|||||||||||||||
a249         ARTNLETNGNNIVYTYQARVGGREX
                     190        200
```

The following partial DNA sequence was identified in *N. gonorrhoeae* <SEQ ID 975>:

g250.seq

```
  1 atgacgcaca cagcctctcc acgtgatgaa ttcatacgcg gcataaaaga
 51 aagttcgccc atgctgattg ggcttttgcc ttgggcattg atactcggta
101 tgcagggcgg gcaaaaaggt atgggccggc tggaaatgct gctgatgacg
151 gggatgaact ttgccggcgg ctccgaattt gccacggtca acctgtgggc
201 ggaacctctg ccgatactgc ttatcgccac cataaccttt atgattaatt
251 cgcggcatat cctgatgggg ggcggcgctt gccacgcaca tgaaagaaat
301 accgctgaaa aaagccgcgc ccgcgctgtt ttttatgtgt ga
```

This corresponds to the amino acid sequence <SEQ ID 976; ORF 250.ng>:

g250.pep

```
  1 MTHTASPRDE FIRGIKESSP MLIGLLPWAL ILGMQGGQKG MGRLEMLLMT
 51 GMNFAGGSEF ATVNLWAEPL PILLIATITF MINSRHILMG GGACHAHERN
101 TAEKSRARAV FYV
```

The following partial DNA sequence was identified in *N. meningitidis* <SEQ ID 977>:

m250.seq

```
  1 ATGCACACCT TCCCCGCATA ACGAATTTAT ACGCGGCATC AAAGAAAGTT
 51 CGCCTATGCT GATTGGGCTG CTGCCTTGGG CATTAATACT CGGTATGCAG
101 GGCGGACAAA AAGGCATGAG CTGGCTGGAA ATGTTGTTGA TGACCAGTAT
151 GAACTTCGCC GGCGGCTCCG AGTTTGCCAC GGTCAACCTG TGGGCsGAAC
201 CTCTGCCGAT ACTGCTTATC GCCACCGTAA CCTTTATGAT TAATTCTCGG
251 CATATCCTGA T.GGGGGCGG CGCTTGCCCC GCACCTGAAA GGAaTACCGC
301 TGAAAAAAGC CGTGCCCGCA CTGTTTTTTA TGTGTGA
```

This corresponds to the amino acid sequence <SEQ ID 978; ORF 250>:

m250.pep

```
  1 MHTPSPHNEF IRGIKESSPM LIGLLPWALI LGMQGGQKGM SWLEMLLMTS

 51 MNFAGGSEFA TVNLWAEPLP ILLIATVTFM INSRHILMGG GACPAPERNT

101 AEKSRARTVF YV
```

Computer analysis of this amino acid sequence gave the following results:

Homology with a predicted ORF from *N. gonorrhoeae*

ORF 250 shows 91.0% identity over a 111 aa overlap with a predicted ORF (ORF 250.ng) from *N. gonorrhoeae*:

m250/g250

```
                       10        20        30        40        50        59
m250.pep       MHTPSPHNEFIRGIKESSPMLIGLLPWALILGMQGGQKGMSWLEMLIMTSMNFAGGSEF
                || ||::||||||||||||||||||||||||||||||||: |||||||:|||||||||
g250          MTHTASPRDEFIRGIKESSPMLIGLLPWALILGNQGGQKGMGRLEMLIMTGMNFAGGSEF
                      10        20        30        40        50        60

             60        70        80        90       100       110
m250.pep      ATVNLWAEPLPILLIATVTFMINSRHILMGGGACPAPERNTAEKSRARTVFYVX
              |||||||||||||||||:|||||||||||||||| | ||||||||||||:||||
g250          ATVNLWAEPLPILLIATITFMINSRHILMGGGACHAHERNTAEKSRARAVFYV
                      70        80        90       100       110
```

The following partial DNA sequence was identified in *N. meningitidis* <SEQ ID 979>:

a250.seq

```
  1 ATGACACACA TAAGCTCGCC CCGTAACGAA TTTATACGCG GCATCAAAGA

 51 AAGTTCGCCC ATGCTGATCG GGCTTTTGCC TTGGGCATTA ATACTCGGTA

101 TGCAGGGTGG ACAAAAAGGC ATGAGCTGGC TGGAAATGTT GTTGATGACC

151 GGTATGAACT TCGCCGGCGG CTCCGAGTTT GCCACGGTCA ACCTGTGGGC

201 GGAACCTCTG CCGATACTGC TTATCGCCAC CGTAACCTTT ATGATTAATT

251 CTCGGCATAT CCTGATGGGG G.CGGCACTT GCCCCGCACC TGAAAGAAAT

301 ACCGCTGAAA AAAGCCGTGC CCGCACTGTT TTTTATGTGT GA
```

This corresponds to the amino acid sequence <SEQ ID 980; ORF 250.a>:

a250.pep

```
  1 MTHISSPRNE FIRGIKESSP MLIGLLPWAL ILGMQGGQKG MSWLEMLLMT

 51 GMNFAGGSEF ATVNLWAEPL PILLIATVTF MINSRHILMG XGTCPAPERN

101 TAEKSRARTV FYV*
```

m250/a250 94.6% identity in 111 aa overlap

```
                       10        20        30        40        50        59
m250.pep       MHTPSPHNEFIRGIKESSPMLIGLLPWALILGMQGGQKGMSWLEMLLMTSMNFAGGSEF
                |  ||:||||||||||||||||||||||||||||||||||||||||||:|||||||||
a250          MTHISSPRNEFIRGIKESSPMLIGLLPWALILGMQGGQKGMSWLEMLLMTGMNFAGGSEF
                      10        20        30        40        50        60
```

-continued

```
                60         70         80         90         100        110
m250.pep       ATVNLWAEPLPILLIATVTFMINSRHILMGGGACPAPERNTAEKSRARTVFYVX
               |||||||||||||||||||||||||||||| |:|||||||||||||||||||||
a250           ATVNLWAEPLPILLIATVTFMINSRHILMGXGTCPAPERNTAEKSRARTVFYVX
                         70         80         90         100        110
```

The following partial DNA sequence was identified in *N. gonorrhoeae* <SEQ ID 981>:

g251.seq

```
  1 atgcctgacc caatagggat tcttttcgct gccgtcgggg ttgatttttt
 51 tgccgttgtt ttgagggggc gttttcaacg aataggcgcg gttggcatgt
101 tgataataat aatcctgatg gcggaggtcg gaaccaaaac ggtcgtaacc
151 gaggttgacg ctcaggttgt ggcggatttt ggcggtatcg aaggattttt
201 tgaatgccgc ctgcaagagc ctgtggcttt ccccgtaaat cacgcggtcg
251 gatttgtagt aggaagacgg cttgtcggca ctcgggcggc aatatttgtc
301 cgaaccgtcg gcggaacagt gcgtctgctg aaaatgattg tccaaaccga
351 tgccctgccg gtcgtaagag aggcgggcat aatccgccca agtgtcttta
401 tcggcattgg tatagacata ttccaaaccg tagcggcttt tggtgtgcgt
451 ctcgtcgtaa aacacgcccg taccgtattc cgcgcccacc tccgcaccgt
501 tttcaccgtt ggtaatcagc ccgctgtatt tgcggccgcc cgcgtatttg
551 ccgtagcctc ttatcgatcc gtatttttta ttttcatcaa aaaccgcctt
601 ggtcaggaat gccggaaccg tcatatcgcg cgtgtcgaaa gtttgctgcg
651 tgcgttcgag tatgccgccg atgtagtgcc gtttgttttc aaaacgaaaa
701 cccgggcgga acagccacga ccggctttcg tatga
```

This corresponds to the amino acid sequence <SEQ ID 982; ORF 251.ng>:

g251.pep

```
  1 MPDPIGILFA AVGVDFFAVV LRGRFQRIGA VGMLIIIILM AEVGTKTVVT
 51 EVDAQVVADF GGIEGFFECR LQEPVAFPVN HAVGFVVGRR LVGTRAAIFV
101 RTVGGTVRLL KMIVQTDALP VVREAGIIRP SVFIGIGIDI FQTVAAFGVR
151 LVVKHARTVF RAHLRTVFTV GNQPAVFAAA RVFAVASYRS VFFIFIKNRL
201 GQECRNRHIA RVESLLRAFE YAADVVPFVF KTKTRAEQPR PAFV*
```

The following partial DNA sequence was identified in *N. meningitidis* <SEQ ID 983>:

m251.seq

```
  1 ATGCGTGCTG CGGTAGTCGT AGCGCAAGCC CGCGCCGACA TCCGCCCACC
 51 TGCCCAAACG GACATTGTCC CGAACTGCCG CGTAATAGCT TTTACCGTTG
101 ATGCTGCGCG GCGTGCAGTC CGTATAAGTA TTGTTGCCCA AGCGGCAGAT
151 TTGCCCCGTA ACGACATTTC CCCTGCCTAT GGTGACCCAA TAGGGGCTGG
```

-continued

```
201 TTTCACTGCC GTTGGGGCTG ATTTTTTTGC CGTTGTTTTG AGGGGGCGTG

251 TTCGACGAAT AGGCGCGGTT GGCATGTTGA TAATAATAAT CCTGATGGCG

301 GAGATTAGAG CCAAAGCGGT CAAACCCGAG ATTCACGCTC AGGTTGTGGC

351 GGATTTTGGC GGTATCGAAG GATTTTTTGA ATGCCGCCTG CAAGAGCCTG

401 TGGCTTTCCC CGTAAATCAC GCGATCGGAT TTGTAATAGG AAAACGGCTT

451 GTCGGCACTC GGGCGGCAAT ATTTGTCCGA ACCGTCGGCA GAACAGTGCG

501 TCTGCTGAAA ATGATTATCC AAACCGATGC CCTGCCGGTC GTAAGAGAGG

551 CGGGCATAAT CCGCCCAAGT GTCTTTATCG GCATTGGTAT AGACATATTC

601 CAAACCGTAG CGGCTTTTGG TGTGCGTCTC GTCGTAAAAC ACGCCCGTAC

651 CGTATTCCGC GCCCACCAGC GCACCGTTTT CGCCGTTGGT AAACAGTCCG

701 CCGTATTTGT GGTTGCCCGC GTATTTGCCG TTACCGGGCA AAGAACCCGC

751 CTGTTTTTTA TTTGCATCAA AAACCGCCTT GGTCAGGAAT GCCGGAACCG

801 TCATATCGCG CGTGTCGAAA GTTTGTTGCG TGTGTTCGAG TATGCCGCCG

851 ATGTAGTGCC GCTTATTCTC AAAACGAAAA CCCGGGCGGA ACAGCCACGA

901 CCGGCTTTCG TATGA
```

This corresponds to the amino acid sequence <SEQ ID 984; ORF 251>:

m251.pep

```
  1 MRAAVVVAQA RADIRPPAQT DIVPNCRVIA FTVDAARRAV RISIVAQAAD

 51 LPRNDISPAY GDPIGAGFTA VGADFFAVVL RGRVRRIGAV GMLIIIILMA

101 EIRAKAVKPE IHAQVVADFG GIEGFFECRL QEPVAFPVNH AIGFVIGKRL

151 VGTRAAIFVR TVGRTVRLLK MIIQTDALPV VREAGIIRPS VFIGIGIDIF

201 QTVAAFGVRL VVKHARTVFR AHQRTVFAVG KQSAVFVVAR VFAVTGQRTR

251 LFFICIKNRL GQECRNRHIA RVESLLRVFE YAADVVPLIL KTKTRAEQPR

301 PAFV*
```

Computer analysis of this amino acid sequence gave the following results:

Homology with a predicted ORF from *N. gonorrhoeae*

ORF 251 shows 85.2% identity over a 243 aa overlap with a predicted ORF (ORF 251.ng) from *N. gonorrhoeae*:

m251/g251

```
                        40        50        60        70        80        90
m251.pep        TVDAARRAVRISIVAQAADLPRNDISPAYGDPIGAGFTAVGADFFAVVLRGRVRRIGAVG
                                              ||||  |:|||:|||||||||| :||||||
g251                                        MPDPIGILFAAVGVDFFAVVLRGRFQRIGAVG
                                                    10        20        30

                       100       110       120       130       140       150
m251.pep        MLIIIILMAEIRAKAVKPEIHAQVVADFGGIEGFFECRLQEPVAFPVNHAIGFVIGKRLV
                ||||||||||: :|:|  |: |||||||||||||||||||||||||||||:|||:|:|||
g251            MLIIIILMAEVGTKTVVTEVDAQVVADFGGIEGFFECRLQEPVAFPVNHAVGFVVGRRLV
                        40        50        60        70        80        90

                       160       170       180       190       200       210
m251.pep        GTRAAIFVRTVGRTVRLLKMIIQTDALPVVREAGIIRPSVFIGIGIDIFQTVAAFGVRLV
                |||||||||||| ||||||||:||||||||||||||||||||||||||||||||||||||
g251            GTRAAIFVRTVGGTVRLLKMIVQTDALPVVREAGIIRPSVFIGIGIDIFQTVAAFGVRLV
                       100       110       120       130       140       150
```

-continued

```
                   220       230       240       250       260       270
m251.pep     VKHARTVFRAHQRTVFAVGKQSAVFVVARVFAVTGQRTRLFFICIKNRLGQECRNRHIAR
             ||||||||||| ||||:||:| |||::||||||:: |: :||| ||||||||||||||||
g251         VKHARTVFRAHLRTVFTVGNQPAVFAAARVFAVASYRS-VFFIFIKNRLGQECRNRHIAR
                  160       170       180       190        200       210

                   280       290       300
m251.pep     VESLLRVFEYAADVVPLILKTKTRAEQPRPAFVX
             ||||||:|||||||||:::|||||||||||||||
g251         VESLLRAFEYAADVVPFVFKTKTRAEQPRPAFVX
                   220       230       240
```

The following partial DNA sequence was identified in *N. meningitidis* <SEQ ID 985>:

a251.seq

```
  1 ATGCGTGCTG CGGTAGTCGT AGCGCAACCC CGCGCCGACA TCCGCCCACC
 51 TGCCCAAACG GACATTGTCC CGAACTGCCG CGTAATAGCT TTTGCCGTTG
101 ATGCTGCGCG GCGTGCAGTC CGTATAAGTA TTGTTGCCCA AGCGGCAGAT
151 TTGCCCCGTA ACCACATTTC CCCTGCCTAT GCTGACCCAA TAGGGTTGGT
201 CCTTGCCGCC GTTGGGGTTG GCGGTTTTAG GGGGCGTTTT CGACGAATAG
251 GCGCGGTTGG CATGTTGATA ATAATAATCC TGATGGCGGA GATTAGAGTC
301 AAAGCGGTCA AAACCGAGAT TCACGCTCAG GTTGTGGCGG ATTTTGGCGG
351 TATCGAAGGA TTTTTTGAAT GCCGCCTGCA AGAGCCTGTG GCTTTCCCCG
401 TAAATCACGC GGTCGGATTT GTAGTAGGAA AACGGCTTGT CGGCACTCGG
451 GCGGCAATAT TTGTCCGAAC CGTCGGCAGA ACAGTGCGTC TGCTGAAAAT
501 GATTGTCCAA ACCGATGCCC TGCCGGTCGT AAGAGAGGCG GGCATAATCC
551 ACCCAAGTGT CTTTATCGGC ATTGGTATAG ACATATTCCA AACCGTAGCG
601 GCTTTTGGTG TGCGTCTCGT CGTAAAACAC GCCCGTACCG TATTCCGCGC
651 CCACCAGCGC ACCGTTTTCG CCGTTGGTAA ACAGACCGCC GTATTTGTGG
701 TCGCCCGCGT ATTTGCCGTT GCCTCTTATC GGTCCGTATT TTCTATTTTC
751 ATCAAAAACC GCCTTGGTCA GGAATGCCGG AACCGTCATA TCGCGCGTGT
801 CGAAAGTTTG TTGCGTGTGT TCGAGTATGC CGCCGATGTA GTGCCGTTTG
851 TTTTCAAAAC GAAAACCCGG GCGGAACAGC CACGATCGGC TTTCGTATGA
```

This corresponds to the amino acid sequence <SEQ ID 986; ORF 251.a>:

a251.pep

```
  1 MRAAVVVAQP RADIRPPAQT DIVPNCRVIA FAVDAARRAV RISIVAQAAD
 51 LPRNHISPAY ADPIGLVLAA VGVGGFRGRF RRIGAVGMLI IIILMAEIRV
101 KAVKTEIHAQ VVADFGGIEG FFECRLQEPV AFPVNHAVGF VVGKRLVGTR
151 AAIFVRTVGR TVRLLKMIVQ TDALPVVREA GIIHPSVFIG IGIDIFQTVA
201 AFGVRLVVKH ARTVFRAHQR TVFAVGKQTA VFVVARVFAV ASYRSVFSIF
251 IKNRLGQECR NRHIARVESL LRVFEYAADV VPFVFKTKTR AEQPRSAFV*
```

m251/a251 88.5% identity in 304 aa overlap

```
                  10        20        30        40        50        60
m251.pep    MRAAVVVAQARADIRPPAQTDIVPNCRVIAFTVDAARRAVRISIVAQAADLPRNDISPAY
            ||||||||| ||||||||||||||||||||:|||||||||||||||||||||| |||||
a251        MRAAVVVAQPRADIRPPAQTDIVPNCRVIAFAVDAARRAVRISIVAQAADLPRNHISPAY
                  10        20        30        40        50        60

                  70        80        90       100       110       120
m251.pep    GDPIGAGFTAVGADFFAVVLRGRVRRIGAVGMLIIIILMAEIRAKAVKPEIHAQVVADFG
            :||||  ::|||:  |     ||| |||||||||||||||||:|||| |||||||||||
a251        ADPIGLVLAAVGVGGF----RGRFRRIGAVGMLIIIILMAEIRVKAVKTEIHAQVVADFG
                  70              80        90       100       110

                 130       140       150       160       170       180
m251.pep    GIEGFFECRLQEPVAFPVNHAIGFVIGKRLVGTRAAIFVRTVGRTVRLLKMIIQTDALPV
            ||||||||||||||||||||:|||:||||||||||||||||||||||||||:|||||||
a251        GIEGFFECRLQEPVAFPVNAHVGFVVGKRLVGTRAAIFVRTVGRTVRLLKMIVQTDALPV
             120       130       140       150       160       170

                 190       200       210       220       230       240
m251.pep    VREAGIIRPSVFIGIGIDIFQTVAAFGVRLVVKHARTVFRAHQRTVEAVGKQSAVFVVAR
            |||||||:||||||||||||||||||||||||||||||||||||||||||:|||||||
a251        VREAGIIHPSVFIGIGIDIFQTVAAFGVRLVVKHARTVFRAHQRTVEAVGKQTAVFVVAR
             180       190       200       210       220       230

                 260       260       270       280       290       300
m251.pep    VFAVTGQRTRLFFICIKNRLGQECRNRHIARVESLLRVFEYAADVVPLILKTKTRAEQPR
            ||||::  |: :| | |||||||||||||||||||||||||||||||:::||||||||||
a251        VFAVASYRS-VFSIFIKNRLGQECRNRHIARVESLLRVFEYAADVVPFVFKTKTRAEQPR
             240        250       260       270       280       290

m251.pep    PAFVX
             ||||
a251        SAFVX
              300
```

The following partial DNA sequence was identified in *N. gonorrhoeae* <SEQ ID 987>:

<u>g253.seq</u>

```
   1 atgatcgaca gggaccgtat gttgcgggac acgttggaac gtgtgcgtgc
  51 ggggtcgttc tggttatggg tggtggtggc atcgatgatg tttaccgccg
 101 gattttcagg cacttatctt ctgatggaca atcaggggct gaatttcttt
 151 ttagttttgg cgggagtgtt gggcatgaat acgctgatgc tggcagtatg
 201 gttggcaacg ttgttcctgc gcgtgaaagt gggacggttt ttcagcagtc
 251 cggcgacgtg gtttcggggc aaaggccctg taaatcaggc ggtgttgcgg
 301 ctgtatgcgg accagtggcg gcaaccttcg gtacgatgga aaataggcgc
 351 aacggcgcac agcttgtggc tctgcacgct gctcggaatg ctggtgtcgg
 401 tattgctgct gcttttggtg cggcaatata cgttcaactg ggaaagcacg
 451 ctgttgagca atgccgcttc ggtacgcgcg gtggaaatgt tggcatggct
 501 gccgtcgaaa ctcggtttcc ctgtccccga tgcgcgggcg gtcatcgaag
 551 gtcgtctgaa cggcaatatt gccgatgcgc gggcttggtc ggggctgctg
 601 gtcggcagta tcgtctgcta cggcatcctg ccgcgcctct tggcttgggt
 651 agtgtgtaaa atcctttttga aaacaagcga aaacggattg gatttggaaa
 701 aaacctatta tcaggcggtc atccgccgct ggcagaacaa aatcaccgat
 751 gcggatacgc gtcgggaaac cgtgtccgcc gtttcgccga aaatcgtctt
 801 gaacgatgcg ccgaaatggg cgctcatgct ggagaccgag tggcaggacg
 851 gccaatggtt cgagggcagg ctggcgcagg aatggctgga taagggcgtt
 901 gccgccaatc gggaacaggt tgccgcgctg gagacagagc tgaagcagaa
 951 accggcgcaa ctgcttatcg gcgtacgcgc ccaaactgtg ccggaccggg
1001 gcgtgctgcg gcagattgtg cggctttcgg aagcggcgca gggcggcgcg
```

-continued

```
1051 gtggtgcagc ttttggcgga acaggggctt tcagacgacc tttcggaaaa
1101 gctggaacat tggcgtaacg cgctgaccga atgcggcgcg gcgtggcttg
1151 agcctgacag ggtggcgcag gaaggccgtt tgaaagacca ataa
```

This corresponds to the amino acid sequence <SEQ ID 988; ORF 253.ng>:

g253.pep

```
  1 MIDRDRMLRD TLERVRAGSF WLWVVVASMM FTAGFSGTYL LMDNQGLNFF
 51 LVLAGVLGMN TLMLAVWLAT LFLRVKVGRF FSSPATWFRG KGPVNQAVLR
101 LYADQWRQPS VRWKIGATAH SLWLCTLLGM LVSVLLLLLV RQYTFNWEST
151 LLSNAASVRA VEMLAWLPSK LGFPVPDARA VIEGRLNGNI ADARAWSGLL
201 VGSIVCYGIL PRLLAWVVCK ILLKTSENGL DLEKTYYQAV IRRWQNKITD
251 ADTRRETVSA VSPKIVLNDA PKWALMLETE WQDGQWFEGR LAQEWLDKGV
301 AANREQVAAL ETELKQKPAQ LLIGVRAQTV PDRGVLRQIV RLSEAAQGGA
351 VVQLLAEQGL SDDLSEKLEH WRNALTECGA AWLEPDRVAQ EGRLKDQ*
```

The following partial DNA sequence was identified in *N. meningitidis* <SEQ ID 989>:

m253.seq

```
  1 ATGATTGACA GGAACCGTAT GCTGCGGGAG ACGTTGGAAC GTGTGCGTGC
 51 GGGGTCGTTC TGGTTGTGGG TGGTGGCGGC GACGTTTGCA TTTTTTACCG
101 GTTTTTCAGT CACTTATCTT CTAATGGACA ATCAGGGTCT GAATTTCTTT
151 TTGGTTTTGG CGGGCGTGTT GGGCATGAAT ACGCTGATGC TGGCAGTATG
201 GTTGGCAATG TTGTTCCTGC GTGTGAAAGT GGGGCGTTTT TTCAGCAGTC
251 CGGCGACGTG GTTTCGGGGC AAAGACCCTG TAAATCAGGC GGTGTTGCGG
301 CTGTATGCGG ACGAGTGGCG GCAACCTTCG GTACGTTGGA AAATAGGCGC
351 AACGTCGCAC AGCCTGTGGC TCTGCACGCT GCTCGGAATG CTGGTGTCGG
401 TATTGTTGCT GCTTTTGGTG CGGCAATATA CGTTCAACTG GGAAAGCACG
451 CTGTTGAGCA ATGCCGCTTC GGTACGCGCG GTGGAAATGT TGGCATGGCT
501 GCCGTCGAAA CTCGGTTTCC CTGTCCCCGA TGCGCGGGCG GTCATCGAAG
551 GCCGTCTGAA CGGCAATATT GCCGATGCGC GGGCTTGGTC GGGGCTGCTG
601 GTCGGCAGTA TCGCCTGCTA CGGCATCCTG CCGCGCCTGC TGGCTTGGGT
651 AGTGTGTAAA ATCCTTTTGA AAACAAGCGA AAACGGATTG GATTTGGAAA
701 AGCCCTATTA TCAGGCGGTC ATCCGCCGCT GGCAGAACAA AATCACCGAT
751 GCGGATACGC GTCGGGAAAC CGTGTCCGCC GTTTCACCGA AAATCATCTT
801 GAACGATGCG CCGAAATGGG CGGTCATGCT GGAGACCGAG TGGCAGGACG
851 GCGAATGGTT CGAGGGCAGG CTGGCGCAGG AATGGCTGGA TAAGGGCGTT
901 GCCACCAATC GGGAACAGGT TGCCGCGCTG GAGACAGAGC TGAAGCAGAA
951 ACCGGCGCAA CTGCTTATCG GCGTGCGCGC CCAAACTGTG CCGGACCGCG
```

-continued

```
1001 GCGTGTTGCG GCAGATTGTC CGACTCTCGG AAGCGGCGCA GGGCGGCGCG

1051 GTGGTGCAGC TTTTGGCGGA ACAGGGGCTT TCAGACGACC TTTCGGAAAA

1101 GCTGGAACAT TGGCGTAACG CGCTGGCCGA ATGCGGCGCG GCGTGGCTTG

1151 AGCCTGACAG GGCGGCGCAG GAAGGGCGTT TGAAAGACCA ATAA
```

This corresponds to the amino acid sequence <SEQ ID 990; ORF 253>:

m253.pep

```
  1 MIDRNRMLRE TLERVRAGSF WLWVVAATFA FFTGFSVTYL LMDNQGLNFF

 51 LVLAGVLGMN TLMLAVWLAM LFLRVKVGRF FSSPATWFRG KDPVNQAVLR

101 LYADEWRQPS VRWKIGATSH SLWLCTLLGM LVSVLLLLLV RQYTFNWEST

151 LLSNAASVRA VEMLAWLPSK LGFPVPDARA VIEGRLNGNI ADARAWSGLL

201 VGSIACYGIL PRLLAWVVCK ILLKTSENGL DLEKPYYQAV IRRWQNKITD

251 ADTRRETVSA VSPKIILNDA PKWAVMLETE WQDGEWFEGR LAQEWLDKGV

301 ATNREQVAAL ETELKQKPAQ LLIGVRAQTV PDRGVLRQIV RLSEAAQGGA

351 VVQLLAEQGL SDDLSEKLEH WRNALAECGA AWLEPDRAAQ EGRLKDQ*
```

Computer analysis of this amino acid sequence gave the following results:

Homology with a predicted ORF from *N. gonorrhoeae*

ORF 253 shows 94.7% identity over a 397 aa overlap with a predicted ORF (ORF 253.ng) from *N. gonorrhoeae*:

m253/g253

```
                             10        20        30        40        50        60
m253.pep            MIDRNRMLRETLERVRAGSFWLWVVAATFAFFTGFSVTYLLMDNQGLNFFLVLAGVLGMN
                    ||||:||||:|||||||||||||||:|:: | :||| |||||||||||||||||||||||
g253                MIDRDRMLRDTLERVRAGSFWLWVVVASMMFTAGFSGTYLLMDNQGLNFFLVLAGVLGMN
                            10        20        30        40        50        60

                             70        80        90       100       110       120
m253.pep            TLMLAVWLAMLFLRVKVGRFFSSPATWFRGKDPVNQAVLRLYADEWRQPSVRWKIGATSH
                    ||||||||| ||||||||||||||||||||| ||||||||||||| |||||||||||| :|
g253                TLMLAVWLATLFLRVKVGRFFSSPATWFRGKGPVNQAVLRLYADQWRQPSVRWKIGATAH
                            70        80        90       100       110       120

                            130       140       150       160       170       180
m253.pep            SLWLCTLLGMLVSVLLLLLVRQYTFNWESTLLSNAASVRAVEMLSWLPSKLGFPVPDARA
                    ||||||||||||||||||||||||||||||||||||||||||||||||||||||||||||
g253                SLWLCTLLGMLVSVLLLLLVRQYTFNWESTLLSNAASVRAVEMLSWLPSKLGFPVPDARA
                            130       140       150       160       170       180

                            190       200       210       220       230       240
m253.pep            VIEGRLNGNIADARAWSGLLVGSIACYGILPRLLAWVVCKILLITSENGLDLEKPYYQAV
                    ||||||||||||||||||||||||:||||||||||||||||||||||||||||| |||||
g253                VIEGRLNGNIADARAWSGLLVGSIVCYGILPRLLAWVVCKILLITSENGLDLEKTYYQAV
                           190       200       210       220       230       240

                            250       260       270       280       290       300
m253.pep            IRRWQNKITDADTRRETVSAVSPKIILNDAPKWAVMLETEWQDGEWFEGRLAQEWLDKGV
                    |||||||||||||||||||||||||:||||||||:|||||||||:|||||||||||||||
g253                IRRWQNKITDADTRRETVSAVSPKIVLNDAPKWALMLETEWQDGQWFEGRLAQEWLDKGV
                            250       260       270       280       290       300

                            310       320       330       340       350       360
m253.pep            ATNREQVAALETELKQKPAQLLIGVRAQTVPDRGVLTQIVRLSEAAQGGAVVQLLAEQGL
                    |:||||||||||||||||||||||||||||||||||||||||||||||||||||||||||
g253                AANREQVAALETELKQKPAQLLIGVRAQTVPDRGVLTQIVRLSEAAQGGAVVQLLAEQGL
                            310       320       330       340       350       360

                            370       380       390
m253.pep            SDDLSEKLEHWRNALAECGAAWLEPDRAAQEGRLKDQX
                    |||||||||||||||:|||||||||||:|||||||||
g253                SDDLSEKLEHWRNALTECGAAWLEPDRVAQEGRLKDQX
                            370       380       390
```

The following partial DNA sequence was identified in *N. meningitidis* <SEQ ID 991>:

a253.seq

```
   1 ATGATCGACA GGAACCGTAT GCTGCGGGAG ACGTTGGAAC GTGTGCGTGC
  51 GGGGTCGTTC TGGTTGTGGG TGGCGGCGGC GACGTTTGCG TTTTTTACCG
 101 GTTTTTCAGT TACTTATCTT CTAATGGACA ATCAGGGTCT GAATTTCTTT
 151 TTGGTTTTGG CGGGCGTGTT GGGCATGAAT ACGCTGATGC TGGCAGTATG
 201 GTTGGCAATG TTGTTCCTGC GCGTGAAAGT GGGGCGTTTT TTCAGCAGTC
 251 CGGCGACGTG GTTTCGGGGC AAAGACCCTG TCAATCAGGC GGTGTTGCGG
 301 CTGTATGCGG ACGAGTGGCG GCAACCTTCG GTACGTTGGA AAATAGGCGC
 351 AACGTCGCAC AGCCTGTGGC TCTGCACGCT GCTCGGAATG CTGGTGTCGG
 401 TATTGTTGCT GCTTTTGGTG CGGCAATATA CGTTCAACTG GGAAAGCACG
 451 CTGTTGGGCG ATTCGTCTTC GGTACGGCTG GTGGAAATGT TGGCATGGCT
 501 GCCTGCGAAA CTGGGTTTTC CCGTGCCTGA TGCGCGGGCG GTCATCGAAG
 551 GTCGTCTGAA CGGCAATATT GCCGATGCGC GGGCTTGGTC GGGGCTGCTG
 601 GTCGGCAGTA TCGCCTGCTA CGGCATCCTG CCGCGCCTCT TGGCTTGGGC
 651 GGTATGCAAA ATCCTTTTGA AAACAAGCGA AAACGGCTTG GATTTGGAAA
 701 AGCCCTATTA TCAGGCGGTC ATCCGCCGCT GGCAGAACAA AATCACCGAT
 751 GCGGATACGC GTCGGGAAAC CGTGTCCGCC GTTTCGCCGA AAATCGTCTT
 801 GAACGATGCG CCGAAATGGG CGGTCATGCT GGAGACCGAA TGGCAGGACG
 851 GCGAATGGTT CGAGGGCAGG CTGGCGCAGG AATGGCTGGA TAAGGGCGTT
 901 GCCGCCAATC GGGAACAGGT TGCCGCGCTG GAGACAGAGC TGAAGCAGAA
 951 ACCGGCGCAA CTGCTTATCG GCGTGCGCGC CCAAACTGTG CCCGACCGCG
1001 GCGTGTTGCG GCAGATCGTC CGACTTTCGG AAGCGGCGCA GGGCGGCGCG
1051 GTGGTGCAGC TTTTGGCGGA ACAGGGGCTT TCAGACGACC TTTCGGAAAA
1101 GCTGGAACAT TGGCGTAACG CGCTGACCGA ATGCGGCGCG GCGTGGCTGG
1151 AACCCGACAG AGCGGCGCAG GAAGGCCGTC TGAAAACCAA CGACCGCACT
1201 TGA
```

This corresponds to the amino acid sequence <SEQ ID 992; ORF 253.a>:

a253.pep

```
  1 MIDRNRMLRE TLERVRAGSF WLWVAAATFA FFTGFSVTYL LMDNQGLNFF
 51 LVLAGVLGMN TLMLAVWLAM LFLRVKVGRF FSSPATWFRG KDPVNQAVLR
101 LYADEWRQPS VRWKIGATSH SLWLCTLLGM LVSVLLLLLV RQYTFNWEST
151 LLGDSSSVRL VEMLAWLPAK LGFPVPDARA VIEGRLNGNI ADARAWSGLL
201 VGSIACYGIL PRLLAWAVCK ILLKTSENGL DLEKPYYQAV IRRWQNKITD
251 ADTRRETVSA VSPKIVLNDA PKWAVMLETE WQDGEWFEGR LAQEWLDKGV
301 AANREQVAAL ETELKQKPAQ LLIGVRAQTV PDRGVLRQIV RLSEAAQGGA
351 VVQLLAEQGL SDDLSEKLEH WRNALTECGA AWLEPDRAAQ EGRLKTNDRT
401 *
```

m253/a253 97.2% identity in 395 aa overlap

```
                    10        20        30        40        50        60
m253.pep    MIDRNRMLRETLERVRAGSFWLWVVAATFAFFTGFSVTYLLMDNQGLNFFLVLAGVLGMN
            |||||||||||||||||||||||:||||||||||||||||||||||||||||||||||||
a253        MIDRNRMLRETLERVRAGSFWLWVAAATFAFFTGFSVTYLLMDNQGLNFFLVLAGVLGMN
                    10        20        30        40        50        60

                    70        80        90       100       110       120
m253.pep    TLMLAVWLAMLFLRVKVGRFFSSPATWFRGKDPVNQAVLRLYADEWRQPSVRWKIGATSH
            ||||||||||||||||||||||||||||||||||||||||||||||||||||||||||||
a253        TLMLAVWLAMLFLRVKVGRFFSSPATWFRGKDPVNQAVLRLYADEWRQPSVRWKIGATSH
                    70        80        90       100       110       120

                   130       140       150       160       170       180
m253.pep    SLWLCTLLGMLVSVLLLLLVRQYTFNWESTLLSNAASVRAVEMLAWLPSKLGFPVPDARA
            ||||||||||||||||||||||||||||||||::::||| |||||||||:||||||||||
a253        SLWLCTLLGMLVSVLLLLLVRWYTFNWESTLLGDSSSVRLVEMLAWLPAKLGFPVPDARA
                   130       140       150       160       170       180

                   190       200       210       220       230       240
m253.pep    VIEGRLNGNIADARAWSGLLVGSIACYGILPRLLAWVVCKILLKTSENGLDLEKPYYQAV
            |||||||||||||||||||||||||||||||||||:||||||||||||||||||||||||
a253        VIEGRLNGNIADARAWSGLLVGSIACYGILPRLLAWAVCKILLKTSENGLDLEKPYYQAV
                   190       200       210       220       230       240

                   250       260       270       280       290       300
m253.pep    IRRWQNKITDADTRRETVSAVSPKIILNDAPKWAVMLETEWQDGEWFEGRLAQEWLDKGV
            ||||||||||||||||||||||||:|||||||||||||||||||||||||||||||||||
a253        IRRWQNKITDADTRRETVSAVSPKIVLNDAPKWALMLETEWQDGEWFEGRLAQEWLDKGV
                   250       260       270       280       290       300

                   310       320       330       340       350       360
m253.pep    ATNREQVAALETELKQKPAQLLIGVRAQTVPDRGVLRQIVRLSEAAQGGAVVQLLAEQGL
            |:||||||||||||||||||||||||||||||||||||||||||||||||||||||||||
a253        AANREQVAALETELKQKPAQLLIGVRAQTVPDRGVLRQIVRLSEAAQGGAVVQLLAEQGL
                  310       320       330       340       350       360

                   370       380       390
m253.pep    SDDLSEKLEHWRNALAECGAAWLEPDRAAQEGRLKDQX
            |||||||||||||||:|||||||||||||||||||
a253        SDDLSEKLEHWRNALTECGAAWLEPDRAAQEGRLKTNDRTX
                   370       380       390       400
```

The following partial DNA sequence was identified in *N. gonorrhoeae* <SEQ ID 993>:

<u>g254.seq</u>

```
  1 atgtatgcag gcgaacgctt caatacttac agccatttga gcggtttgat
 51 tctggcggcg gcaggtttga tgctgatgct gctgaaaacc ataggacacg
101 gggacggata ccgtatcttc agcgtatcgg tttacggcat cagccttctt
151 ctgctctatt tgagttcctc gctgtaccac ggaattgcag ccggaaaact
201 gaaaagcatt ttgaaaaaaa ccgaccactg catgatttat gtgctgattg
251 ccggaagcta cacaccgttt gcactggttt ctttgagaaa cgggccgggc
301 tggacggtat tttcactgtc ctggctgctg gcggctgcag gaatcgcaca
351 agaactcacc atcggacgga aaagcgaaaa acgtctgctg tctattgcga
401 tttatatcgt aatgggctgg atggtcttgg cggtaatgaa atccctgaca
451 gcctcactcc cgccggcagg actggcttgg ctggcggcag gcggtatgct
501 gtacagcgtc ggcatttact ggtttgtaaa cgatgaaaaa atccgacacg
551 ggcacggaat ctggcatctg ttcgtattgg gcggcagcat aacccaattt
601 gtcagcgtgt acggttatgt aatctga
```

This corresponds to the amino acid sequence <SEQ ID 994; ORF 254.ng>:

g254.pep

```
  1 MYAGERFNTY SHLSGLILAA AGLMLMLLKT IGHGDGYRIF SVSVYGISLL
 51 LLYLSSSLYH GIAAGKLKSI LKKTDHCMIY VLIAGSYTPF ALVSLRNGPG
101 WTVFSLSWLL AAAGIAQELT IGRKSEKRLL SIAIYIVMGW MVLAVMKSLT
151 ASLPPAGLAW LAAGGMLYSV GIYWFVNDEK IRHGHGIWHL FVLGGSITQF
201 VSVYGYVI*
```

The following partial DNA sequence was identified in *N. meningitidis* <SEQ ID 995>:

m254.seq (partial)

```
  1 ..GTATCGGTTT ACGGCATCAG CCTTCTTCTG CTCTATTTGA GTTCCTGGCT
 51   GTACCACGGA ATTGCAGCCG GAAAACTGAA AAGCATTTTG AAAAAAACCG
101   ACCACTGCAT GATTTATGTG CTGATTGCCG GAAGCTACAC ACCGTTTGCA
151   CTGGTTTCTT TGAGAAACGG GCCGGGCTGG ACGGTATTTT CACTGTCCTG
201   GCTGCTGGCG GCTGCAGGAA TCGCACAAGA ACTCACCATC GGACGGAAAA
251   GCGAAAAACG TCTGCTGTCT ATTGTGATTT ATGTCGTCAT GGGTTGGATG
301   GTCTTGGCGG TAATGAAATC CCTGACAGCC TCACTCCCGT CGGCAGGACT
351   GGCTTGGCTG GCGGCAGGCG GTATGCTGTA CAGTGTCGGC ATTTACTGGT
401   TTGTAAACGA TGAAAAAATC CGACACGGGC ACGGAATCTG GCATCTGTTC
451   GTATTGGGCG GCAGCATCAC CCAATTTGTC AGCGTGTACG GTTACGTAAT
501   CTGA
```

This corresponds to the amino acid sequence <SEQ ID 996; ORF 254>:

m254.pep (partial)

```
  1 ..VSVYGISLLL LYLSSWLYHG IAAGKLKSIL KKTDHCMIYV LIAGSYTPFA
 51   LVSLRNGPGW TVFSLSWLLA AAGIAQELTI GRKSEKRLLS IVIYVVMGWM
101   VLAVMKSLTA SLPSAGLAWL AAGGMLYSVG IYWFVNDEKI RHGHGIWHLF
151   VLGGSITQFV SVYGYVI*
```

Computer analysis of this amino acid sequence gave the following results:

Homology with a predicted ORF from *N. gonorrhoeae*

ORF 254 shows 97.6% identity over a 167 aa overlap with a predicted ORF (ORF 254.ng) from *N. gonorrhoeae*:

m254/g254

```
                                                   10        20        30
m254.pep                                     VSVYGISLLLLYLSSWLYHGIAAGKLKSIL
                                             |||||||||||||| |||||||||||||||
g254          HLSGLILAAAGLMLMLLKTIGHGDGYRIFSVSVYGISLLLLYLSSSLYHGIAAGKLKSIL
                      20        30        40        50        60        70

                  40        50        60        70        80        90
m254.pep      KKTDHCMIYVLIAGSYTPFALVSLRNGPGWTVFSLSWLLAAAGIAQELTIGRKSEKRLLS
              ||||||||||||||||||||||||||||||||||||||||||||||||||||||||||||
g254          KKTDHCMIYVLIAGSYTPFALVSLRNGPGWTVFSLSWLLAAAGIAQELTIGRKSEKRLLS
                      80        90       100       110       120       130
```

-continued

```
                 100       110       120       130       140       150
m254.pep    IVIYVVMGWMVLAVMKSLTASLPSAGLAWLAAGGMLYSVGIYWFVNDEKIRHGHGIWHLF
            |:||:|||||||||||||||||| ||||||||||||||||||||||||||||||||||||
g254        IAIYIVMGWMVLAVMKSLTASLPPAGLAWLAAGGMLYSVGIYWFVNDEKIRHGHGIWHLF
                 140       150       160       170       180       190

                 160
m254.pep    VLGGSITQFVSVYGYVIX
            ||||||||||||||||||
g254        VLGGSITQFVSVYGYVIX
                200
```

The following partial DNA sequence was identified in *N. meningitidis* <SEQ ID 997>:

a254.seq

```
  1 ATGTATACAG GCGAACGCTT CAATACTTAC AGCCATTTGA GCGGTTTGAT
 51 TCTGGCGGCG GCAGGTTTGG CGCTGATGCT GCTGAAAACC ATAGGACACG
101 GGGACGGCTA CCGTATCTTC AGCGTATCGG TTTACGGCAT CAGCCTTCTT
151 CTGCTCTATT TGAGTTCCTC GCTGTACCAC GGAATTGCAG CCGGAAAACT
201 GAAAAGCATT TTGAAAAAAA CCGACCACTG CATGATTTAT GTGCTGATTG
251 CCGGAAGCTA CACACCGTTT GCACTGGTTT CTTTGAGAAA CGGGCCGGGC
301 TGGACGGTAT TTTCACTGTC CTGGCTGCTG GCGGCTGCAG GAATCGCACA
351 AGAACTCACC ATTGGACGGA AAAGCGAAAA ACGACTGCTG TCTATTGCGA
401 TTTATATCGT AATGGGCTGG ATGGTCTTGG CGGTAATGAA ATCCCTGACA
451 GCCTCACTCC CGCCGGCAGG ACTGGCTTGG CTGGCGGCAG GCGGTATGCT
501 GTACAGCGTC GGCATTTACT GGTTTGTAAA CGATGAAAAA ATCCGACACG
551 GGCACGGAAT CTGGCATCTG TTCGTATTGG GCGGCAGCAT CACCCAATTT
601 GTCAGCGTGT ACGGTTACGT AATCTGA
```

This corresponds to the amino acid sequence <SEQ ID 998; ORF 254.a>:

a254.pep

```
  1 MYTGERFNTY SHLSGLILAA AGLALMLLKT IGHGDGYRIF SVSVYGISLL
 51 LLYLSSSLYH GIAAGKLKSI LKKTDHCMIY VLIAGSYTPF ALVSLRNGPG
101 WTVFSLSWLL AAAGIAQELT IGRKSEKRLL SIAIYIVMGW MVLAVMKSLT
151 ASLPPAGLAW LAAGGMLYSV GIYWFVNDEK IRHGHGIWHL FVLGGSITQF
201 VSVYGYVI*
```

m254/a254 97.6% identity in 167 aa overlap

```
                                                 10        20        30
m254.pep                                     VSVYGISLLLLYLSSWLYHGIAAGKLKSIL
                                             ||||||||||||||| ||||||||||||||
a254        HLSGLILAAAGLALMLLKTIGHGDGYRIFSVSVYGISLLLLYLSSSLYHGIAAGKLKSIL
                    20        30        40        50        60        70

                 40        50        60        70        80        90
m254.pep    KKTDHCMIYVLIAGSYTPFALVSLRNGPGWTVFSLSWLLAAAGIAQELTIGRKSEKRLLS
            ||||||||||||||||||||||||||||||||||||||||||||||||||||||||||||
a254        KKTDHCMIYVLIAGSYTPFALVSLRNGPGWTVFSLSWLLAAAGIAQELTIGRKSEKRLLS
                    80        90       100       110       120       130
```

-continued

```
                 100       110       120       130       140       150
m254.pep   IVIYVVMGWMVLAVMKSLTASLPSAGLAWLAAGGMLYSVGIYWFVNDEKIRHGHGIWHLF
           |:||:|||||||||||||||||| ||||||||||||||||||||||||||||||||||||
a254       IAIYIVMGWMVLAVMKSLTASLPPAGLAWLAAGGMLYSVGIYWFVNDEKIRHGHGIWHLF
                140       150       160       170       180       190

                   160
m254.pep    VLGGSITQFVSVYGYVIX
            ||||||||||||||||||
a254        VLGGSITQFVSVYGYVIX
                  200
```

The following partial DNA sequence was identified in *N. gonorrhoeae* <SEQ ID 999>:

g255.seq

```
  1 atggttggac aggaagcctt gcggggtcag ttcgtcgccg tgttcgctgc
 51 cgcgttgcgt tacgctgtca aaacctgcgc cgatttccac gcctttgacg
101 gcgttgatgc ccatcatcgc gtaggcgatt tcggcatcga ggcggtcgaa
151 aacgggttcg cccaaaccga cggggacgtt ggcggcttcg atatgcagtt
201 tcgcgccgac ggaatccaag gatttgcgca caccgtccat atagtgttcc
251 agttcggcga tttggctttg gttggcggca aaaaaaggat tttgggaaat
301 gtgttcgctg ccttcaaacc ggattttttt ttcgccgact tgggtaacgt
351 aggcggtgat ttccgtgccg aatttttctt tcagccattt tttggcaacg
401 gctccggcgg caacgcgggc tgcggtttcg cgggcggaac tcctgccgcc
451 gccccggtag tcgcgcgtac cgtatttgtg ccaataggta tagtcggcgt
501 gtccggggcg gaaggcggtg gcgatgtcgc cgtagtcttc gctgcgctgg
551 tcggtgttgc ggattag
```

This corresponds to the amino acid sequence <SEQ ID 1000; ORF 255.ng>:

g255.pep

```
  1 MVGQEALRGQ FVAVFAAALR YAVKTCADFH AFDGVDAHHR VGDFGIEAVE
 51 NGFAQTDGDV GGFDMQFRAD GIQGFAHTVH IVFQFGDLAL VGGKKRILGN
101 VFAAFKPDFF FADLGNVGGD FRAEFFFQPF FGNGSGGNAG CGFAGGTPAA
151 APVVARTVFV PIGIVGVSGA EGGGDVAVVF AALVGVAD*
```

The following partial DNA sequence was identified in *N. meningitidis* <SEQ ID 1001>:

m255.seq

```
  1 GTGGTTGGAC AGGAAGCCTT GCGGGGTCAG TTCGTCGCCG TGTTCGCTGC
 51 CGCGTTGCGT TACGCTGTCA AAACCTGCGC CGATTTCCAC GCCTTTGACG
101 GCGTTGATGC CCATCATCGC GTAGGCGATT TCGGCATCGA GGCGGTCAAA
151 AACAGGTTCG CCCAAGCCGA CAGGGACATT GGCTGCTTCG ATATGCAGCT
201 TCGCGCCGAC GGAATCCAAG GATTTGCGCA CGCTGTCCAT ATAGTTTTCC
251 AGCTCGGCAA TTTGGCTATG GTTGGCGGCA AAAAAAGGAT TTTGGGAAAT
```

-continued

```
301 GTGTTCGCAG CCTTCAAACC GGATTTCTTT TTCGCCGACT TGGGTAACGT

351 AGGCGGTGAT TTCCGTGCCG AATTTTTCTT TCAACCATTT TTTGGCAACG

401 GCTCCGGCAG CAACGCGGGC GGCGGTTTCA CGGGCGGAGC TCCTGCCGCC

451 GCCGCGGTAG TCGCGCGTGC CGTATTTGTG CCAATAGGTA TAGTCGGCGT

501 GGCCGGGGCG GAAGCTGGTG GCGATGTTGC CGTAGTCTTT GCTGCGCTGG

551 TCGGTATTGC GGATTAA
```

This corresponds to the amino acid sequence <SEQ ID 1002; ORF 255>:

m255.pep

```
  1 VVGQEALRGQ FVAVFAAALR YAVKTCADFH AFDGVDAHHR VGDFGIEAVK

 51 NRFAQADRDI GCFDMQLRAD GIQGFAHAVH IVFQLGNLAM VGGKKRILGN

101 VFAAFKPDFF FADLGNVGGD FRAEFFFQPF FGNGSGSNAG GGFTGGAPAA

151 AAVVARAVFV PIGIVGVAGA EAGGDVAVVF AALVGIAD*
```

Computer analysis of this amino acid sequence gave the following results:

Homology with a predicted ORF from *N. gonorrhoeae*

ORF 255 shows 88.8% identity over a 188 aa overlap with a predicted ORF (ORF 255.ng) from *N. gonorrhoeae*:

m255/g255

```
                      10        20        30        40        50        60
  m255.pep    VVGQEALRGQFVAVFAAALRYAVKTCADFHAFDGVDAHHRVGDFGIEAVKNRFAQADRDI
              :||||||||||||||||||||||||||||||||||||||||||||||||:| |||:| |:
  g255        MVGQEALRGQFVAVFAAALRYAVKTCADFHAFDGVDAHHRVGDFGIEAVENGFAQTDGDV
                      10        20        30        40        50        60

                    70        80        90       100       110       120
m255.pep    GCFDMQLRADGIQGFAHAVHIVFQLGNLAMVGGKKRILGNVFAAFKPDFFFADLGNVGGD
            | ||||:||||||||||:||||||:|:||:||||||||||||||||||||||||||||||
g255        GGFDMQFRADGIQGFAHTVHIVFQFGDLALVGGKKRILGNVFAAFKPDFFFADLGNVGGD
                    70        80        90       100       110       120

                   130       140       150       160       170       180
m255.pep    FRAEFFFQPFFGNGSGSNAGGGFTGGAPAAAAVVARAVFVPIGIVGVAGAEAGGDVAVVF
            ||||||||||||||||:||| ||:||:|||| ||||:||||||||||:|||:||||||||
g255        FRAEFFFQPFFGNGSGGNAGCGFAGGTPAAAPVVARTVFVPIGIVGVSGAEGGGDVAVVF
                   130       140       150       160       170       180

                 189
m255.pep    AALVGIADX
            |||||:|||
g255        AALVGVADX
```

The following partial DNA sequence was identified in *N. meningitidis* <SEQ ID 1003>:

a255.seq

```
  1 GTGGTTGGAC AGGAAGCCTT GCGGGGTGAG TTCGTCGCCG TGTTCGCTGC

 51 CGCGTTGCGT TACGCTGTCA AAACCTGCGC CGATTTCCAC GCCTTTGACG

101 GCGTTGATGC CCATCATGGC GTAGGCGATT TCGGCATCGA GGCGGTCGAA

151 TACGGGTTCG CCCAAGCCGA CGGGGACGTT GGCGGCTTCA ATATGCAGCT

201 TCGCGCCGAC GGAATCCAAG GATTTGCGCA CGCTGTCCAT ATAGTTTTCC
```

-continued

```
251 AGCTCGGCAA TTTGGCTATG GTTGGCGGCA AAAAAAGGAT TTTGGGAAAT

301 GTGTTCGCAG CCTTCAAACC GGATTTCTTT TTCGCCGACT TGGGTAACGT

351 AGGCGGTGAT TTCCGTGCCG AATTTTTCTT TCAACCATTT TTTGGCAACG

401 GCTCCGGCGG CAACGCGGGC GGCGGTTTCG CGGGCGGAAC TCCTGCCGCC

451 GCCCCGGTAG TCGCGCGTGC CGTATTTGTG CCAATAGGTA TAGTCGGCGT

501 GGCCGGGGCG GAAGCTGGTG GCGATGTTGC CGTAGTCTTT GCTGCGCTGG

551 TCGGTATTGC GGATTAA
```

This corresponds to the amino acid sequence <SEQ ID 1004; ORF 255.a>:

a255.pep

```
  1 VVGQEALRGE FVAVFAAALR YAVKTCADFH AFDGVDAHHG VGDFGIEAVE

 51 YGFAQADGDV GGFNMQLRAD GIQGFAHAVH IVFQLGNLAM VGGKKRILGN

101 VFAAFKPDFF FADLGNVGGD FRAEFFFQPF FGNGSGGNAG GGFAGGTPAA

151 APVVARAVFV PIGIVGVAGA EAGGDVAVVF AALVGIAD*
```

m255/a255 93.1% identity in 188 aa overlap

```
                   10        20        30        40        50        60
m255.pep   VVGQEALRGQFVAVFAAALRYAVKTCADFHAFDGVDAHHRVGDFGIEAVKNRFAQADRDI
           |||||||||:||||||||||||||||||||||||||||| |||||||||:  ||||| |:
a255       VVGQEALRGEFVAVFAAALRYAVKTCADFHAFDGVDAHHGVGDFGIEAVEYGFAQADGDV
                   10        20        30        40        50        60

                   70        80        90       100       110       120
m255.pep   GCFDMQLRADGIQGFAHAVHIVFQLGNLAMVGGKKRILGNVFAAFKPDFFFADLGNVGGD
           | |:||||||||||||||||||||||||||||||||||||||||||||||||||||||||
a255       GGFNMQLRADGIQGFAHAVHIVFQLGNLAMVGGKKRILGNVFAAFKPDFFFADLGNVGGD
                   70        80        90       100       110       120

                  130       140       150       160       170       180
m255.pep   FRAEFFFQPFFGNGSGSNAGGGFTGGAPAAAAVVARAVFVPIGIVGVAGAEAGGDVAVVF
           ||||||||||||||||:||||||:||:|||| ||||||||||||||||||||||||||||
a255       FRAEFFFQPFFGNGSGGNAGGGFAGGTPAAAPVVARAVFVPIGIVGVAGAEAGGDVAVVF
                  130       140       150       160       170       180

                189
m255.pep   AALVGIADX
           |||||||||
a255       AALVGIADX
```

The following partial DNA sequence was identified in *N. gonorrhoeae* <SEQ ID 1005>:

g256.seq

```
  1 atgctcgcgg tacgcaatcg gggttggcac ggcgcagtcg tccatttccg

 51 cagctgcggc ggcgtagcga acaccgcccc ggtgttctac cacttgggtg

101 ataccgccga aatcgccttt gctttggaca cgctcaccgc gcgttaccgt

151 gaaatatacg ccgtcggcgt atcgctgggc ggcaacgcgc cggcaaaata

201 tttgggcgaa cagggcaaaa aggcattgcc gcacgcctcg gccgccgtat

251 ccgccccgt tgatgcagag gcggcaggca gccgcttcga cagcggcatc

301 acgcggctgc tctacacgcg ctacttcctc cgcacactga tacccaaagc
```

-continued

```
351 acgttcgctc caaggttttc agacggcatt tgccgcaggg tgcaaaacac
401 tgggcgagtt tgacgaccgt ttcaccgcac cgctgcacgg ctttgccgac
451 cggcacgact actaccgcca aacttcctgc aaaccgctgc tcaaacacgt
501 tgccaaaccg ctgctcctgc tcaatgccgc caacgacccc ttcctgccgc
551 ccgaagccct gccccgtgca gacgaagcgt ccgaagccgt taccctgttc
601 caacctgcac acggcgggca cgccggcttt gtcagcagca ccggcggcag
651 gctgcacctg caatggctgc cgcagaccgt cctgtcctat tttgacagct
701 tccgcacaaa caggcgttaa
```

This corresponds to the amino acid sequence <SEQ ID 1006, ORF 256.ng>:

g256.pep

```
  1 MLAVRNRGWH GAVVHFRSCG GVANTAPVFY HLGDTAEIAF ALDTLTARYR
 51 EIYAVGVSLG GNAPAKYLGE QGKKALPHAS AAVSAPVDAE AAGSRFDSGI
101 TRLLYTRYFL RTLIPKARSL QGFQTAFAAG CKTLGEFDDR FTAPLHGFAD
151 RHDYYRQTSC KPLLKHVAKP LLLLNAANDP FLPPEALPRA DEASEAVTLF
201 QPAHGGHAGF VSSTGGRLHL QWLPQTVLSY FDSFRTNRR*
```

The following partial DNA sequence was identified in *N. meningitidis* <SEQ ID 1007>:

m256.seq

```
  1 ATGCTTGCGG TACGCGATCG GGGTTGGCAC GGCGTAGTCG TCCATTTCCG
 51 CAGCTGCGGC GGCATTGCCA ACACCGCTCC GGTGTTCTAC CA.CTtGGCG
101 ATACCGCCGA AATCGCCTTT ACTTTGGACA CGTTCGCCGC GCGTTACCGT
151 GAAAtATACG CCGTCGGCGT ATCGCTGGGC GGCAACGCGC TGGCAAAATA
201 TTTGGGCGAA CAGGGCAAAA AGGCATTGCC GCAAGCCGCT GCCGTCATCT
251 CCGCCCCCGT CGATGCAGAG GCGGCAGGCA GACGCTTCGA CAGCGGCATC
301 ACGCGGCTGC TCTACACGCG CTACTTCCTC CGCACCCTGA TACCCAAAGC
351 AAAATCGCTC CAAGGTTTTC AGACGGCATT TGCCGCAGGG TGCAAAACAC
401 TGGGCGAGTT TGACGACCGC TTCACCGCAC CGCTGCACGG CTTTGCCGAC
451 CGGCACGACT ACTACCGCCA AACTTCCTGC AAACCGCTGC TCAAACACGT
501 TGCCAAACCG CTGCTCCTGC TCAATGCCGT CAACGACCCC TTCCTGCCGC
551 CCGAAGCCCT GCCCCGCGCA GACGAAGTAT CCGAAGCCGT TACCCTGTTC
601 CAGCCGGCAT ATGGTGGTCA TGTCGGCTTT GTCAGCAGCA CCGGCGGCAG
651 GCTGCACCTG CAATGGCTGC CGCAGACCGT CCTGTCCTAT TTCGACAGCT
701 TCCGCACAAA CAGGCGTTAA
```

This corresponds to the amino acid sequence <SEQ ID 1008; ORF 256>:

m256.pep

```
  1 MLAVRDRGWH GVVVHFRSCG GIANTAPVFY XLGDTAEIAF TLDTFAARYR
 51 EIYAVGVSLG GNALAKYLGE QGKKALPQAA AVISAPVDAE AAGRRFDSGI
101 TRLLYTRYFL RTLIPKAKSL QGFQTAFAAG CKTLGEFDDR FTAPLHGFAD
151 RHDYYRQTSC KPLLKHVAKP LLLLNAVNDP FLPPEALPRA DEVSEAVTLF
201 QPAYGGHVGF VSSTGGRLHL QWLPQTVLSY FDSFRTNRR*
```

Computer analysis of this amino acid sequence gave the following results:

Homology with a predicted ORF from *N. gonorrhoeae*

ORF 256 shows 92.9% identity over a 239 aa overlap with a predicted ORF (ORF 256.ng) from *N. gonorrhoeae*:

m256/g256

```
                     10        20        30        40        50        60
  m256.pep   MLAVRDRGWHGVVVHFRSCGGIANTAPVFYHLGDTAEIAFTLDTFAARYREIYAVGVSLG
             |||||:|||||:|||||||||:|||||||||||||||||||:|||::|||||||||||||
  g256       MLAVRNRGWHGAVVHFRSCGGVANTAPVFYHLGDTAEIAFALDTLTARYREIYAVGVSLG
                     10        20        30        40        50        60

                   70        80        90       100       110       120
m256.pep     GNALAKYLGEQGKKALPQAAAVISAPVDAEAAGRRFDSGITRLLYTRYFLRTLIPKAKSL
             ||| |||||||||||||:|:|::|||||||||| |||||||||||||||||||||||:||
g256         GNAPAKYLGEQGKKALPHASAAVSAPVDAEAAGSRFDSGITRLLYTRYFLRTLIPKARSL
                   70        80        90       100       110       120

                  130       140       150       160       170       180
m256.pep     QGFQTAFAAGCKTLGEFDDRFTAPLHGFADRHDYYRQTSCKPLLKHVAKPLLLLNAVNDP
             ||||||||||||||||||||||||||||||||||||||||||||||||||||||||:|||
g256         QGFQTAFAAGCKTLGEFDDRFTAPLHGFADRHDYYRQTSCKPLLKHVAKPLLLLNAANDP
                  130       140       150       160       170       180

                  190       200       210       220       230       240
m256.pep     FLPPEALPRADEVSEAVTLFQPAYGGHVGFVSSTGGRLHLQWLPQTVLSYFDSFRTNRRX
             ||||||||||||:||||||||||:|||:||||||||||||||||||||||||||||||||
g256         FLPPEALPRADEASEAVTLFQPAHGGHAGFVSSTGGRLHLQWLPQTVLSYFDSFRTNRRX
                  190       200       210       220       230
```

The following partial DNA sequence was identified in *N. meningitidis* <SEQ ID 1009>:

a256.seq

```
  1 ATGCTCGCGG TACGCGATCG GGGTTGGAAC GGCGTAGTCG TCCATTTCCG
 51 CAGCTGCGGC GGCGTAGCGA ACACCGCCCC GGTGTTCTAC CACTTGGGCG
101 ATACCGCCGA AATTGCCTTT ACTTTGGACA CGCTCGCCGC GCGTTACCGT
151 GAAATATACG CCGTCGGCGT ATCGCTGGGC GGCAACGCGC TGGCAAAATA
201 TTTGGGCGAA CAGGGCGAAA ACGCGCTGCC GCAAGCCGCC GCCGTCATCT
251 CCGCACCCGT CGATGCAGAG GCGGCAGGCA ACCGCTTCGA CAGCGGCATC
301 ACACGGCTGC TCTACACGCG CTACTTCCTC CGCACACTGA TACCCAAAGC
351 ACGGTCGCTC CAAGGTTTTC AGACGGCATT TGCCGCAGGG TGCAAAACAC
401 TGGGCGAGTT TGACGACCGT TTCACCGCAC CGCTGCACGG CTTTGCCGAT
451 CGGCACGACT ACTACCGCCA AACTTCCTGC AAACCGCTGC TCAAACACGT
501 TGCCAAACCG CTGCTCCTGC TCAATGCCGT CAACGACCCC TTCCTGCCGC
551 CCGAAGCGCT GCCCCGCGCA GACGAAGTGT CCGAAGCCGT TACCCTGTTC
601 CAGCCGACAC ACGGTGGTCA TGTCGGCTTT GTCGGCAGCA CCGGCGGCAG
```

-continued

```
651 GCTGCACCTG CAATGGTTGC CGCAGACCGT CCTGTCCTAT TTCGACAGCT

701 TCCGCACAAA CAGGCGTTAA
```

This corresponds to the amino acid sequence <SEQ ID 1010; ORF 256.a>:

a256.pep

```
  1 MLAVRDRGWN GVVVHFRSCG GVANTAPVFY HLGDTAEIAF TLDTLAARYR

 51 EIYAVGVSLG GNALAKYLGE QGENALPQAA AVISAPVDAE AAGNRFDSGI

101 TRLLYTRYFL RTLIPKARSL QGFQTAFAAG CKTLGEFDDR FTAPLHGFAD

151 RHDYYRQTSC KPLLKHVAKP LLLLNAVNDP FLPPEALPRA DEVSEAVTLF

201 QPTHGGHVGF VGSTGGRLHL QWLPQTVLSY FDSFRTNRR*
```

m256/a256 95.4% identity in 239 aa overlap

```
                      10        20        30        40        50        60
m256.pep    MLAVRDRGWHGVVVHFRSCGGIANTAPVFYXLGDTAEIAFTLDTFAARYREIYAVGVSLG
            |||||||||:|||||||||||:|||||||| |||||||||||||:|||||||||||||||
a256        MLAVRDRGWNGVVVHFRSCGGVANTAPVFYHLGDTAEIAFTLDTLAARYREIYAVGVSLG
                      10        20        30        40        50        60

                      70        80        90       100       110       120
m256.pep    GNALAKYLGEQGKKALPQAAAVISAPVDAEAAGRRFDSGITRLLYTRYFLRTLIPKAKSL
            ||||||||||||::||||||||||||||||||| |||||||||||||||||||||||:||
a256        GNALAKYLGEQGENALPQAAAVISAPVDAEAAGNRFDSGITRLLYTRYFLRTLIPKARSL
                      70        80        90       100       110       120

                     130       140       150       160       170       180
m256.pep    QGFQTAFAAGCKTLGEFDDRFTAPLHGFADRHDYYRQTSCKPLLKHVAKPLLLLNAVNDP
            ||||||||||||||||||||||||||||||||||||||||||||||||||||||||||||
a256        QGFQTAFAAGCKTLGEFDDRFTAPLHGFADRHDYYRQTSCKPLLKHVAKPLLLLNAVNDP
                     130       140       150       160       170       180

                     190       200       210       220       230       240
m256.pep    FLPPEALPRADEVSEAVTLFQPAYGGHVGFVSSTGGRLHLQWLPQTVLSYFDSFRTNRRX
            ||||||||||||||||||||||::|||||||:||||||||||||||||||||||||||||
a256        FLPPEALPRADEVSEAVTLFQPTHGGHVGFVGSTGGRLHLQWLPQTVLSYFDSFRTNRRX
                     190       200       210       220       230       240
```

The following partial DNA sequence was identified in *N. gonorrhoeae* <SEQ ID 1011>:

g256-1.seq

```
  1 ATGATTTTGA CACCGCCGGA CACGCCCTTT TTCCTCCGCA ACGGCAATGC

 51 CGACACGATT GCCGCCAAAT TCCTGCAACA CCCCGCACCC GCATACCGCC

101 GCGAGATGCT TCCCGACAGC ACGGGTAAAA CCAAAACCGC CTACGACTTT

151 TCAGCAGGCG GCATTTCGCC CGATGCGCCG CTGGTCGTGC TGTTTCACGG

201 TTTGGAAGGA AGCAGCCGCA GCCATTACGC CGTCGAACTG ATGCTCGCGG

251 TACGCAATCG GGGTTGGCAC GGCGCAGTCG TCCATTTCCG CAGCTGCGGC

301 GGCGTAGCGA ACACCGCCCC GGTGTTCTAC CACTTGGGTG ATACCGCCGA

351 AATCGCCTTT GCTTTGGACA CGCTCACCGC GCGTTACCGT GAAATATACG

401 CCGTCGGCGT ATCGCTGGGC GGCAACGCGC CGGCAAAATA TTTGGGCGAA

451 CAGGGCAAAA AGGCATTGCC GCACGCCTCG GCCGCCGTAT CCGCCCCCGT

501 TGATGCAGAG GCGGCAGGCA GCCGCTTCGA CAGCGGCATC ACGCGGCTGC
```

-continued

```
551 TCTACACGCG CTACTTCCTC CGCACACTGA TACCCAAAGC ACGTTCGCTC
601 CAAGGTTTTC AGACGGCATT TGCCGCAGGG TGCAAAACAC TGGGCGAGTT
651 TGACGACCGT TTCACCGCAC CGCTGCACGG CTTTGCCGAC CGGCACGACT
701 ACTACCGCCA AACTTCCTGC AAACCGCTGC TCAAACACGT TGCCAAACCG
751 CTGCTCCTGC TCAATGCCGC CAACGACCCC TTCCTGCCGC CCGAAGCCCT
801 GCCCCGTGCA GACGAAGCGT CCGAAGCCGT TACCCTGTTC CAACCTGCAC
851 ACGGCGGGCA CGCCGGCTTT GTCAGCAGCA CCGGCGGCAG GCTGCACCTG
901 CAATGGCTGC CGCAGACCGT CCTGTCCTAT TTTGACAGCT TCCGCACAAA
951 CAGGCGTTAA
```

This corresponds to the amino acid sequence <SEQ ID 1012; ORF 256-1.ng>:

g256-1.pep

```
  1 MILTPPDTPF FLRNGNADTI AAKFLQHPAP AYRREMLPDS TGKTKTAYDF
 51 SAGGISPDAP LVVLFHGLEG SSRSHYAVEL MLAVRNRGWH GAVVHFRSCG
101 GVANTAPVFY HLGDTAEIAF ALDTLTARYR EIYAVGVSLG GNAPAKYLGE
151 QGKKALPHAS AAVSAPVDAE AAGSRFDSGI TRLLYTRYFL RTLIPKARSL
201 QGFQTAFAAG CKTLGEFDDR FTAPLHGFAD RHDYYRQTSC KPLLKHVAKP
251 LLLLNAANDP FLPPEALPRA DEASEAVTLF QPAHGGHAGF VSSTGGRLHL
301 QWLPQTVLSY FDSFRTNRR*
```

The following partial DNA sequence was identified in *N. meningitidis* <SEQ ID 1013>:

m256-1.seq

```
  1 ATGATTTTAA CACCGCCGGA CACGCCCTTT TTCCTCCGCA ACGGCAATGC
 51 CGACACGATT GCCGCCAAAT TCCTGCAACG CCCCGCGCCC GCATACCGCC
101 GAGAGCTGCT TCCCGACAGC ACGGGTAAAA CCAAAGTCGC CTACGACTTT
151 TCAGACGGCA TTTCGCCCGA TGCGCCGCTG GTCGTGCTGT TTCACGGTTT
201 GGAAGGAAGC AGCCGCAGCC ATTACGCGGT CGAACTGATG CTTGCGGTAC
251 GCGATCGGGG TTGGCACGGC GTAGTCGTCC ATTTCCGCAG CTGCGGCGGC
301 ATTGCCAACA CCGCTCCGGT GTTCTACCAC TTGGGCGATA CCGCCGAAAT
351 CGCCTTTACT TTGGACACGT TCGCCGCGCG TTACCGTGAA ATATACGCCG
401 TCGGCGTATC GCTGGGCGGC AACGCGCTGG CAAAATATTT GGGCGAACAG
451 GGCAAAAAGG CATTGCCGCA AGCCGCTGCC GTCATCTCCG CCCCCGTCGA
501 TGCAGAGGCG GCAGGCAGAC GCTTCGACAG CGGCATCACG CGGCTGCTCT
551 ACACGCGCTA CTTCCTCCGC ACCCTGATAC CCAAAGCAAA ATCGCTCCAA
601 GGTTTTCAGA CGGCATTTGC CGCAGGGTGC AAAACACTGG GCGAGTTTGA
651 CGACCGCTTC ACCGCACCGC TGCACGGCTT TGCCGACCGG CACGACTACT
701 ACCGCCAAAC TTCCTGCAAA CCGCTGCTCA AACACGTTGC CAAACCGCTG
751 CTCCTGCTCA ATGCCGTCAA CGACCCCTTC CTGCCGCCCG AAGCCCTGCC
```

-continued

```
801 CCGCGCAGAC GAAGTATCCG AAGCCGTTAC CCTGTTCCAG CCGGCATATG

851 GTGGTCATGT CGGCTTTGTC AGCAGCACCG GCGGCAGGCT GCACCTGCAA

901 TGGCTGCCGC AGACCGTCCT GTCCTATTTC GACAGCTTCC GCACAAACAG

951 GCGTTAA
```

This corresponds to the amino acid sequence <SEQ ID 1014; ORF 256-1>:

m256-1.pep

```
  1 MILTPPDTPF FLRNGNADTI AAKFLQRPAP AYRRELLPDS TGKTKVAYDF

 51 SDGISPDAPL VVLFHGLEGS SRSHYAVELM LAVRDRGWHG VVVHFRSCGG

101 IANTAPVFYH LGDTAEIAFT LDTFAARYRE IYAVGVSLGG NALAKYLGEQ

151 GKKALPQAAA VISAPVDAEA AGRRFDSGIT RLLYTRYFLR TLIPKAKSLQ

201 GFQTAFAAGC KTLGEFDDRF TAPLHGFADR HDYYRQTSCK PLLKHVAKPL

251 LLLNAVNDPF LPPEALPRAD EVSEAVTLFQ PAYGGHVGFV SSTGGRLHLQ

301 WLPQTVLSYF DSFRTNRR*
```

m256-1/g256-1 93.1% identity in 319 aa overlap

```
                       10        20        30        40        50        59
m256-1.pep     MILTPPDTPFFLRNGNADTIAAKFLQRPAPAYRRELLPDSTGKTKVAYDFS-DGISPDAP
               ||||||||||||||||||||||||||:||||||||:|||||||||:|||||  |||||||
g256-1         MILTPPDTPFFLRNGNADTIAAKFLQHPAPAYRREMLPDSTGKTKTAYDFSAGGISPDAP
                       10        20        30        40        50        60

             60        70        80        90       100       110      119
m256-1.pep     LVVLFHGLEGSSRSHYAVELMLAVRDRGWHGVVVHFRSCGGIANTAPVFYHLGDTAEIAF
               |||||||||||||||||||||||||:|||||:|||||||||:||||||||||||||||||
g256-1         LVVLFHGLEGSSRSHYAVELMLAVRNRGWHGAVVHFRSCGGVANTAPVFYHLGDTAEIAF
                        70        80        90       100       110       120

            120       130       140       150       160       170      179
m256-1.pep     TLDTFAARYREIYAVGVSLGGNALAKYLGEQGKKALPQAAAVISAPVDAEAAGRRFDSGI
               :|||::||||||||||||||||| |||||||||||||:|:|::|||||||||| ||||||
g256-1         ALDTLTARYREIYAVGVSLGGNAPAKYLGEQGKKALPHASAAVSAPVDAEAAGSRFDSGI
                      130       140       150       160       170       180

            180       190       200       210       220       230      239
m256-1.pep     TRLLYTRYFLRTLIPKAKSLQGFQTAFAAGCKTLGEFDDRFTAPLHGFADRHDYYRQTSC
               |||||||||||||||||:||||||||||||||||||||||||||||||||||||||||||
g256-1         TRLLYTRYFLRTLIPKARSLQGFQTAFAAGCKTLGEFDDRFTAPLHGFADRHDYYRQTSC
                       190       200       210       220       230       240

            240       250       260       270       280       290      299
m256-1.pep     KPLLKHVAKPLLLLNAVNDPFLPPEALPRADEVSEAVTLFQPAYGGHVGFVSSTGGRLHL
               ||||||||||||||||:|||||||||||||||:||||||||||:|||:||||||||||||
g256-1         KPLLKHVAKPLLLLNAANDPFLPPEALPRADEASEAVTLFQPAHGGHAGFVSSTGGRLHL
                      250       260       270       280       290       300

           300       310      319
m256-1.pep    QWLPQTVLSYFDSFRTNRRX
              ||||||||||||||||||||
g256-1        QWLPQTVLSYFDSFRTNRRX
                     310       320
```

The following partial DNA sequence was identified in *N. meningitidis* <SEQ ID 1015>:

a256-1.seq

```
  1 ATGATTTTGA CACCGCCGGA CACACCCTTT TTCCTCCGCA ACGGCAATGC

 51 CGACACGATT GCCGCCAAAT TCCTGCAACG CTCCGCACCT GCATACCGCC
```

-continued

```
101 GCGAGCTGCT TCCCGACAGC ACGGGTAAAA CCAAAACCGC CTACGACTTT

151 TCAGACGGCA TTTCGCCCGA TGCGCCGCTG GTCGTGCTGT TTCACGGTTT

201 GGAGGGCGGC AGTGGCAGCC ATTACGCGGT CGAACTGATG CTCGCGGTAC

251 GCGATCGGGG TTGGAACGGC GTAGTCGTCC ATTTCCGCAG CTGCGGCGGC

301 GTAGCGAACA CCGCCCCGGT GTTCTACCAC TTGGGCGATA CCGCCGAAAT

351 TGCCTTTACT TTGGACACGC TCGCCGCGCG TTACCGTGAA ATATACGCCG

401 TCGGCGTATC GCTGGGCGGC AACGCGCTGG CAAAATATTT GGGCGAACAG

451 GGCGAAAACG CGCTGCCGCA AGCCGCCGCC GTCATCTCCG CACCCGTCGA

501 TGCAGAGGCG GCAGGCAACC GCTTCGACAG CGGCATCACA CGGCTGCTCT

551 ACACGCGCTA CTTCCTCCGC ACACTGATAC CCAAAGCACG GTCGCTCCAA

601 GGTTTTCAGA CGGCATTTGC CGCAGGGTGC AAAACACTGG GCGAGTTTGA

651 CGACCGTTTC ACCGCACCGC TGCACGGCTT TGCCGATCGG CACGACTACT

701 ACCGCCAAAC TTCCTGCAAA CCGCTGCTCA AACACGTTGC CAAACCGCTG

751 CTCCTGCTCA ATGCCGTCAA CGACCCCTTC CTGCCGCCCG AAGCGCTGCC

801 CCGCGCAGAC GAAGTGTCCG AAGCCGTTAC CCTGTTCCAG CCGACACACG

851 GTGGTCATGT CGGCTTTGTC GGCAGCACCG GCGGCAGGCT GCACCTGCAA

901 TGGTTGCCGC AGACCGTCCT GTCCTATTTC GACAGCTTCC GCACAAACAG

951 GCGTTAA
```

This corresponds to the amino acid sequence <SEQ ID 1016; ORF 256-1.a>:

a256-1.pep

```
  1 MILTPPDTPF FLRNGNADTI AAKFLQRSAP AYRRELLPDS TGKTKTAYDF

 51 SDGISPDAPL VVLFHGLEGG SGSHYAVELM LAVRDRGWNG VVVHFRSCGG

101 VANTAPVFYH LGDTAEIAFT LDTLAARYRE IYAVGVSLGG NALAKYLGEQ

151 GENALPQAAA VISAPVDAEA AGNRFDSGIT RLLYTRYFLR TLIPKARSLQ

201 GFQTAFAAGC KTLGEFDDRF TAPLHGFADR HDYYRQTSCK PLLKHVAKPL

251 LLLNAVNDPF LPPEALPRAD EVSEAVTLFQ PTHGGHVGFV GSTGGRLHLQ

301 WLPQTVLSYF DSFRTNRR*
```

a256-1/m256-1 95.6% identity in 318 aa overlap

```
                       10        20          30      40        50        60
a256-1.pep     MILTPPDTPFFLRNGNADTIAAKFLQRSAPAYRRELLPDSTGKTKTAYDFSDGISPDAPL
               ||||||||||||||||||||||||| |||||||||||||||||:||||||||||||||||
m256-1         MILTPPDTPFFLRNGNADTIAAKFLQRPAPAYRRELLPDSTGKTKVAYDFSDGISPDAPL
                       10        20          30      40        50        60

                       70        80       90        100       110      120
a256-1.pep     VVLFHGLEGGSGSHYAVELMLAVRDRGWNGVVVHFRSCGGVANTAPVFYHLGDTAEIAFT
               ||| |||||:| ||||||||||||||||:|||||||||||:|||||||||||||||||||
m256-1         VLLFHGLEGSSRSHYAVELMLAVRDRGWHGVVVHFRSCGGIANTAPVFYHLGDTAEIAFT
                         70        80       90        100       110       120

                      130       140       150       160       170       180
a256-1.pep     LDTLAARYREIYAVGVSLGGNALAKYLGEQGENALPQAAAVISAPVDAEAAGNRFDSGIT
               |||:|||||||||||||||||||||||||||::||||||||||||||||||| |||||||
m256-1         LDTFAARYREIYAVGVSLGGNALAKYLGEQGKKALPQAAAVISAPVDAEAAGRRFDSGIT
                      130       140       150       160       170       180
```

-continued

```
                190       200       210       220       230       240
a256-1.pep   RLLYTRYFLRTLIPKARSLQGFQTAFAAGCKTLGEFDDRFTAPLHGFADRHDYYRQTSCK
             |||||||||||||||:||||||||||||||||||||||||||||||||||||||||||||
m256-1       RLLYTRYFLRTLIPKAKSLQGFQTAFAAGCKTLGEFDDRFTAPLHGFADRHDYYRQTSCK
                190       200       210       220       230       240

                250       260       270       280       290       300
a256-1.pep   PLLKHVAKPLLLLNAVNDPFLPPEALPRADEVSEAVTLFQPTHGGHVGFVGSTGGRLHLQ
             |||||||||||||||||||||||||||||||||||||||||::|||||||:|||||||||
m256-1       PLLKHVAKPLLLLNAVNDPFLPPEALPRADEVSEAVTLFQPAYGGHVGFVSSTGGRLHLQ
                250       260       270       280       290       300

                310      319
a256-1.pep   WLPQTVLSYFDSFRTNRRX
             ||||||||||||||||||
m256-1       WLPQTVLSYFDSFRTNRRX
                310
```

The following partial DNA sequence was identified in *N. gonorrhoeae* <SEQ ID 1017>:

<u>g257.seq</u>

```
  1 atgggcaggc atttcgggcg cagacgtttt ctgacggctg ccgccgttgc
 51 tgtggccggt gcggcggttt cttttttgcc gaatcctttt gccgccggcg
101 gcgaaaaacg caacatggat aaaaaacgcg atgaaaatgt gtttttctgg
151 aaaggtgtcg cgctgggttc cggcgcggag ctgcgcctgt tcggcgtgga
201 cgacagacag gcggcggatt tggtcaataa ggttttggcg gaagtggcgc
251 gtttggaaaa aatgttcagc ctttaccgtg aagacagcct gatcagccgt
301 ctgaaccgcg acggttatct gacttcgcct ccggcggatt ttttggaact
351 gttgagcctg gccgcgatat tcacgcgctg a
```

This corresponds to the amino acid sequence <SEQ ID 1018; ORF 257.ng>:

<u>g257.pep</u>

```
  1 MGRHFGRRRF LTAAAVAVAG AAVSFLPNPF AAGGEKRNMD KKRDENVFFW
 51 KGVALGSGAE LRLFGVDDRQ AADLVNKVLA EVARLEKMFS LYREDSLISR
101 LNRDGYLTSP PADFLELLSL AAIFTR*
```

The following partial DNA sequence was identified in *N. meningitidis* <SEQ ID 1019>:

<u>m257.seq</u>

```
  1 ATGGGCAGGC ATTTCGGGCG .CAGCGTTTT CTGACGGTTG CCGCCGTTGC
 51 GGCGGGGaC. GCGGcGGTTT CTTTCCTGCC GAATCCTTTT GCCGCCGATG
101 ATGAAAAACG CAAcGGGGAT GAAAAACGCA ATGAAAATGT GTTTTTCTGG
151 AAAGGTGTCG CACTGGGTTC CGGTGCGGa. CTCCGTCTGT TCGGTGTGGA
201 CGACAGGCGT GCGGCGGATT TGGTCAACAA GGTTTTGGCG GAAGTGGCGC
251 GTTTGGAAAA ATTGTTCAGC CTTTACCGTG AAGACAGCCT GATCAGCCGC
301 CTGAACAGGG ACGGTTATCT GACTTCGCCG TCGGCGGATT TTTTGGAACT
351 GkTGAGCCTG GCCGCGATAT TCACGCkCTG A
```

This corresponds to the amino acid sequence <SEQ ID 1020; ORF 257>:

m257.pep

```
  1 MGRHFGXQRF LTVAAVAAGX AAVSFLPNPF AADDEKRNGD EKRNENVFFW
 51 KGVALGSGAX LRLFGVDDRR AADLVNKVLA EVARLEKLFS LYREDSLISR
101 LNRDGYLTSP SADFLELXSL AAIFTX*
```

Computer analysis of this amino acid sequence gave the following results:

Homology with a predicted ORF from *N. gonorrhoeae*

ORF 257 shows 88.0% identity over a 125 aa overlap with a predicted ORF (ORF 257.ng) from *N. gonorrhoeae*:

m257/g257

```
                   10        20        30        40        50        60
m257.pep   MGRHFGRQRFLTVAAVAAGTAAVSFLPNPFAADDEKRNGDEKRNENVFFWKGVALGSGAD
           ||||||:||||:||||::|||||||||||||  ||||||:||:|||||||||||||||||:
g257       MGRHFGRRRFLTAAAVAVAGAAVSFLPNPFAAGGEKRNMDKKRDENVFFWKGVALGSGAE
                   10        20        30        40        50        60

                   70        80        90       100       110       120
m257.pep   LRLFGVDDRRAADLVNKVLAEVARLEKLFSLYREDSLISRLNRDGYLTSPSADFLELXSL
           ||| |||||:|||||||||||||||||:|||||||||||||||||||| |||||| ||
g257       LRLFGVDDRQAADLVNKVLAEVARLEKMFSLYREDSLISRLNRDGYLTSPPADFLELLSL
                   70        80        90       100       110       120

m257.pep   AAIFTXX
           ||||| |
g257       AAIFTRX
```

The following partial DNA sequence was identified in *N. meningitidis* <SEQ ID 1021>:

a257.seq

```
  1 ATGGGCAGGC ATTTCGGGCG CAGGCGTTTT TTGACAGTTG CCGCCGTTGC
 51 GGCGGCGGGC GCGGCGGTTT CTTTCCTGCC GAATCCTTTT GCCGCCGATG
101 ATGAAAAACG CAATAAAGAT GAAAAACGCA ATGAAAATGT GTTTTTCTGG
151 AAAGGTGTCG CACTGGGTTC CGGTGCGGAG CTCCGTCTGT TCGGTGTGGA
201 CGACAGGCGT GCGGCGGATT TGGTCAACAA GGTTTTGGCG GAAGTGGCGC
251 GTTTGGAAAA AATGTTCAGC CTTTACCGTG AAGACAGCCT GATCAGCCGT
301 CTGAACCGTG ACGGTTATTT GACTTCGCCG CCGGCGGATT TTTTGGAACT
351 GTTGAGCCTG GCCGTGATAT TCACGCGCTG A
```

This corresponds to the amino acid sequence <SEQ ID 1022; ORF 257.a>:

a257.pep

```
  1 MGRHFGRRRF LTVAAVAAAG AAVSFLPNPF AADDEKRNKD EKRNENVFFW
 51 KGVALGSGAE LRLFGVDDRR AADLVNKVLA EVARLEKMFS LYREDSLISR
101 LNRDGYLTSP PADFLELLSL AVIFTR*
```

m257/a257 92.0% identity in 125 aa overlap

```
                10        20          30      40        50        60
m257.pep  MGRHFGXQRFLTVAAVAAGXAAVSFLPNPFAADDEKRNGDEKRNENVFFWKGVALGSGAX
          |||||| :||||||||||: |||||||||||||||||| ||||||||||||||||||||
a257      MGRHFGRRRFLTAAAVAAAGAAVSFLPNPFAAGGEKRNKDEKRNENVFFWKGVALGSGAE
                10        20          30      40        50        60
                70        80        90        100       110       120
m257.pep  LRLFGVDDRRAADLVNKVLAEVARLEKLFSLYREDSLISRLNRDGYLTSPSADFLELXSL
          |||||||||||||||||||||||||||:|||||||||||||||||||||| |||||| ||
a257      LRLFGVDDRRAADLVNKVLAEVARLEKMFSLYREDSLISRLNRDGYLTSPPADFLELLSL
                70        80        90        100       110       120

m257.pep  AAIFTXX
          |:|||
a257      AVIFTRX
```

The following partial DNA sequence was identified in *N. gonorrhoeae* <SEQ ID 1023>:

g258.seq

```
   1 atgcgccgct tcctaccgat cgcagccata tgcgccgtcg tcctgctgta
  51 cggattgacg gcggcgaccg gcagcaccag ttcgctggcg gattatttct
 101 ggtggatagt ctcgttcagc gcaatgctgc tgctggtgtt gtccgccgtt
 151 ttggcacgtt atgtcatatt gctgttgaaa gacaggcgca acggcgtgtt
 201 cggttcgcag attgccaaac gcctttccgg gatgttcacg ctggtcgccg
 251 tactgcccgg cttgttcctg ttcggcattt ccgcgcagtt tatcaacggc
 301 acgattaatt cgtggttcgg caacgacacc cacgaagccc tcgaacgcag
 351 ccttaatttg agcaagtccg cactggattt ggcggcagac aatgccgtca
 401 gcaacgccgt tcccgtacag atagacctca tcggcaccgc ctccctgtcg
 451 ggcaatatgg gcagtgtgct ggaacactac gccggcagcg gttttgccca
 501 gcttgccctg tacaatgccg caagcgggaa aatcgaaaaa agcatcaatc
 551 cgcaccaatt cgaccagccg cttcccgaca aagaacattg ggaacagatt
 601 cagcagaccg gttcggttcg gagtttggaa agcataggcg gcgtattgta
 651 cgcgcaggga tggttgtcgg caggtacgca caacgggcgc gattacgcgc
 701 tgttcttccg ccagccgatt cccgaaaatg tggcacagga tgccgttctg
 751 attgaaaagg cgcgggcgaa atatgccgaa ttgagttaca gcaaaaaagg
 801 tttgcagacc ttttttctgg taaccctgct gattgcctcg ctgctgtcga
 851 tttttcttgc gctggtaatg gcactgtatt ttgcccgccg tttcgtcgaa
 901 cccattctgt cgcttgccga gggcgcaaag gcggtggcgc agggtgattt
 951 cagccagacg cgccccgtat tgcgcaacga cgagttcgga cgtttgacca
1001 agctgttcaa ccatatgacc gagcagcttt ccatcgccaa agaagcagac
1051 gaacgcaacc gccggcgcga ggaagccgcc cgtcactacc tcgagtgcgt
1101 gttggatggg ttgactaccg gtgtggtggt ctcntacccc ctctcttgtt
1151 gccgtaccgc ggtgttttcc acttgtcatt cctcccctct ttcttatttc
1201 taa
```

This corresponds to the amino acid sequence <SEQ ID 1024; ORF 258.ng>:

g258.pep

```
  1 MRRFLPIAAI CAVVLLYGLT AATGSTSSLA DYFWWIVSFS AMLLLVLSAV
 51 LARYVILLLK DRRNGVFGSQ IAKRLSGMFT LVAVLPGLFL FGISAQFING
101 TINSWFGNDT HEALERSLNL SKSALDLAAD NAVSNAVPVQ IDLIGTASLS
151 GNMGSVLEHY AGSGFAQLAL YNAASGKIEK SINPHQFDQP LPDKEHWEQI
201 QQTGSVRSLE SIGGVLYAQG WLSAGTHNGR DYALFFRQPI PENVAQDAVL
251 IEKARAKYAE LSYSKKGLQT FFLVTLLIAS LLSIFLALVM ALYFARRFVE
301 PILSLAEGAK AVAQGDFSQT RPVLRNDEFG RLTKLFNHMT EQLSIAKEAD
351 ERNRRREEAA RHYLECVLDG LTTGVVVSYP LSCCRTAVFS TCHSSPLSYF*
```

The following partial DNA sequence was identified in *N. meningitidis* <SEQ ID 1025>:

m258.seq

```
   1 ATGCGCCGTT TTCTACCGAT CGCAGCCATA TGCGCCGTCG TCCTGTTGTA
  51 CGGACTGACG GCGGCAACCG GCAGCACCAG TTCGCTGGCG GATTATTTCT
 101 GGTGGATTGT TGCGTTCAGC GCAATGCTGC TGCTGGTGTT GTCCGCCGTT
 151 TTGGCACGTT ATGTCATATT GCTGTTGAAA GACAGGCGCG ACGGCGTATT
 201 CGGTTCGCAG ATTGCCAAAC GCCTTTCTGG GATGTTTACG CTGGTTGCCG
 251 TACTGCCCGG CGTGTTTCTG TTCGGCGTTT CCGCACAGTT CATCAACGGC
 301 ACGATTAATT CGTGGTTCGG CAACGATACC CACGAGGCGC TTGAACGCAG
 351 CCTCAATTTG AGCAAGTCCG CATTGAATTT GGCGGCAGAC AACGCCCTCG
 401 GCAACGCCGT CCCCGTGCAG ATAGACCTCA TCGGCGCGGC TTCCCTGCCC
 451 GGGGATATGG GCAGGGTGCT GGAACATTAC GCCGGCAGCG GTTTTGCCCA
 501 GCTTGCCCTG TACAATGCCG CAAGCGGCAA AATCGAAAAA AGCATCAACC
 551 CGCACAAGCT CGATCAGCCG TTTCCAGGTA AGGCGCGTTG GGAAAAAATC
 601 CAACGGGCGG GTTCGGTCAG GGATTTGGAA AGCATAGGCG GCGTATTGTA
 651 CGCGCAGGGC TGGCTGTCGG CGGGTACGCA CAACGGGCGC GATTACGCCT
 701 TGTTTTTCCG TCAGCCGGTT CCCAAAGGCG TGGCAGAGGA TGCCGTCTTA
 751 ATCGAAAAGG CAAGGGCGAA ATATGCTGAG TTGAGTTACA GCAAAAAAGG
 801 TTTGCAGACC TTTTTCCTGG CAACCCTGCT GATTGCCTCG CTGCTGTCGA
 851 TTTTTCTTGC ACTGGTCATG GCACTGTATT TCGCCCGCCG TTTCGTCGAA
 901 CCCGTCCTAT CGCTTGCCGA GGGGGCGAAG GCGGTGGCGC AAGGCGATTT
 951 CAGCCAGACG CGCCCCGTGT TGCGCAACGA CGAGTTCGGA CGCTTGACCA
1001 AGTTGTTCAA CCACATGACC GAGCAGCTTT CCATCGCCAA AGAAGCAGAC
1051 GAGCGCAACC GCCGGCGCGA GGAAGCCGCC AGGCATTATC TTGAATGCGT
1101 GTTGGAGGGG CTGACCACGG GCGTGGTGGT GTTTGACGAA CAAGGCTGTC
1151 TGAAAACsTT CAACAAAGCG GCGGAACAGA TTyTGGGGAT GCCGCTTACC
1201 CCCcTGTGGG GCAGCAGCCG GCACGGTTGG CACGGCGTTT CGGCGCAGCA
1251 GTCCCTGCTT GCCGAAGTGT TTGCCGCCAT CGGCGCGGCG GCAGGTACGG
1301 ACAAACCGGT CCATGTGAAA TATGCCGCGC CGGACGATGC CAAAATCCTG
```

-continued

```
1351 CTGGGCAAGG CAACCGTCCT GCCCGAAGAC AACGGCAACg GCGTGGTAAT

1401 GGTGATTGAC GACATCACCG TTTTGATACA CGCGCAAAAA GAAGCCGCGT

1451 GGGGCGAAgT GGCGaAgCGG CTGGCACACG AAATCCGCAA TCCGCTCACG

1501 CCCATCCAGC TTTCCGCCGA ACgGsTGGCG TkGAAATTGG GCGGGAAGCT

1551 GGATGAGCAG GATGCGCAAA TCCTGACGCG TTCGACCGAC ACCATCGTCA

1601 AACAGGTGGC GGCATTGAAG GAAATGGTCG AAGCATTCCG CAATTATGCG

1651 CGTTCCCCTT CGCTCAAATT GGAAAATCAG GATTTGAACG CCTTAATCGG

1701 CGATGTGTTG GCATTGTATG AAGCCGGTCC GTGCCGGTTT GCGGCGGACT

1751 TGCCGGCGAA CCGCTGA
```

This corresponds to the amino acid sequence <SEQ ID 1026; ORF 258>:

```
m258.pep

  1 MRRFLPIAAI CAVVLLYGLT AATGSTSSLA DYFWWIVAFS AMLLLVLSAV

 51 LARYVILLLK DRRDGVFGSQ IAKRLSGMFT LVAVLPGVFL FGVSAQFING

101 TINSWFGNDT HEALERSLNL SKSALNLAAD NALGNAVPVQ IDLIGAASLP

151 GDMGRVLEHY AGSGFAQLAL YNAASGKIEK SINPHKLDQP FPGKARWEKI

201 QRAGSVRDLE SIGGVLYAQG WLSAGTHNGR DYALFFRQPV PKGVAEDAVL

251 IEKARAKYAE LSYSKKGLQT FFLATLLIAS LLSIFLALVM ALYFARRFVE

301 PVLSLAEGAK AVAQGDFSQT RPVLRNDEFG RLTKLFNHMT EQLSIAKEAD

351 ERNRRREEAA RHYLECVLEG LTTGVVVFDE QGCLKTFNKA AEQILGMPLT

401 PLWGSSRHGW HGVSAQQSLL AEVFAAIGAA AGTDKPVHVK YAAPDDAKIL

451 LGKATVLPED NGNGVVMVID DITVLIHAQK EAAWGEVAKR LAHEIRNPLT

501 PIQLSAERXA XKLGGKLDEQ DAQILTRSTD TIVKQVAALK EMVEAFRNYA

551 RSPSLKLENQ DLNALIGDVL ALYEAGPCRF AADLPANR*
```

Computer analysis of this amino acid sequence gave the following results:

Homology with a predicted ORF from *N. gonorrhoeae*

ORF 258 shows 90.9% identity over a 386 aa overlap with a predicted ORF (ORF 258.ng) from *N. gonorrhoeae*:

```
m258/g258

                    10        20        30        40        50        60
m258.pep    MRRFLPIAAICAVVLLYGLTAATGSTSSLADYFWWIVAFSAMLLLVLSAVLARYVILLLK
            |||||||||||||||||||||||||||||||||||||:||||||||||||||||||||||
g258        MRRFLPIAAICAVVLLYGLTAATGSTSSLADYFWWIVSFSAMLLLVLSAVLARYVILLLK
                    10        20        30        40        50        60

                    70        80        90       100       110       120
m258.pep    DRRDGVFGSQIAKRLSGMFTLVAVLPGVFLFGVSAQFINGTINSWFGNDTHEALERSLNL
            |||:|||||||||||||||||||||||:||||:|||||||||||||||||||||||||||
g258        DRRNGVFGSQIAKRLSGMFTLVAVLPGLFLFGISAQFINGTINSWFGNDTHEALERSLNL
                    70        80        90       100       110       120

                   130       140       150       160       170       180
m258.pep    SKSALNLAADNALGNAVPVQIDLIGAASLPGDMGRVLEHYAGSGFAQLALYNAASGKIEK
            |||||:||||||::|||||||||||:||| |:|| |||||||||||||||||||||||||
g258        SKSALDLAADNAVSNAVPVQIDLIGTASLSGNMGSVLEHYAGSGFAQLALYNAASGKIEK
                   130       140       150       160       170       180
```

-continued

```
                     190       200       210      220      230        240
m258.pep      SINPHKLDQPFPGKARWEKIQRAGSVRDLESIGGVLYAQGWLSAGTHNGRDYALFFRQPV
              |||||::|||:| | :||:||::||||:|||||||||||||||||||||||||||||||:
g258          SINPHQFDQPLPDKEHWEQIQQTGSVRSLESIGGVLYAQGWLSAGTHNGRDYALFFRQPI
                     190       200       210      220      230        240

                     250       260        270      280       290       300
m258.pep      PKGVAEDAVLIEKARAKYAELSYSKKGLQTFFLATLLIASLLSIFLALVMALYFARRFVE
              |::||:|||||||||||||||||||||||||||:||||||||||||||||||||||||||
g258          PENVAQDAVLIEKARAKYAELSYSKKGLQTFFLVTLLIASLLSIFLALVMALYFARRFVE
                     250       260        270      280       290       300

                     310       320       330       340       350       360
m258.pep      PVLSLAEGAKAVAQGDFSQTRPVLRNDEFGRLTKLFNHMTEQLSIAKEADERNRRREEAA
              |:||||||||||||||||||||||||||||||||||||||||||||||||||||||||||
g258          PILSLAEGAKAVAQGDFSQTRPVLRNDEFGRLTKLFNHMTEQLSIAKEADERNRRREEAA
                     310       320       330       340       350       360

                     370       380       390       400       410       420
m258.pep      RHYLECVLEGLTTGVVVFDEQGCLKTFNKAAEQILGMPLTPLWGSSRHGWHGVSAQQSLL
              ||||||||:||||||||    :| :|
g258          RHYLECVLDGLTTGVVVSYPLSCCRTAVFSTCHSSPLSYFX
                     370       380       390       400
```

The following partial DNA sequence was identified in *N. meningitidis* <SEQ ID 1027>:

a258.seq

```
   1 ATGCGCCGTT TTCTACCGAT CGCAGCCATA TGCGCCGTCG TCCTGTTGTA
  51 CGGACTGACG GCGGCAACCG GCAGCACCAG TTCGCTGGCG GATTATTTCT
 101 GGTGGATTGT TGCGTTCAGC GCAATGCTGC TGCTGGTGTT GTCCGCCGTT
 151 TTGGCACGTT ATGTCATATT GCTGTTGAAA GACAGGCGCG ACGGCGTATT
 201 CGGTTCGCAG ATTGCCAAAC GCCTTTCCGG GATGTTTACG CTGGTTGCCG
 251 TACTGCCCGG CGTGTTTCTG TTCGGCGTTT CCGCACAGTT TATCAACGGC
 301 ACGATTAATT CGTGGTTCGG CAACGATACC CACGAGGCGC TTGAACGCAG
 351 CCTCAATTTG AGCAAGTCCG CATTGAATCT GGCGGCAGAC AACGCCCTTG
 401 GCAACGCCAT CCCCGTGCAG ATAGACCTCA TCGGCGCGGC TTCCCTGCCC
 451 GGGGATATGG GCAGGGTGCT GGAACATTAC GCCGGCAGCG GTTTTGCCCA
 501 GCTTGCCCTG TACAATGCCG CAAGCGGCAA AATCGAAAAA AGCATCAACC
 551 CGCACAAGCT CGATCAGCCG TTTCCAGGTA AGGCGCGTTG GGAAAAAATC
 601 CAACAGGCGG GTTCGGTCAG GGATTTGGAA AGCATAGGCG GCGTATTGTA
 651 CGCGCAGGGC TGGCTGTCGG CAGGTACGCA CAACGGGCGC GATTACGCCT
 701 TGTTTTTCCG TCAGCCGGTT CCCAAAGGCG TGGCAGAGGA TGCCGTCTTA
 751 ATCGAAAAGG CAAGGGCGAA ATATGCTGAG TTGAGTTACA GCAAAAAAGG
 801 TTTGCAGACC TTTTTCCTGG CAACCCTGCT GATTGCCTCG CTGCTGTCGA
 851 TTTTTCTTGC ACTGGTCATG GCACTGTATT TCGCCCGCCG TTTCGTCGAA
 901 CCCGTCCTAT CGCTTGCCGA GGGGGCGAAG GCGGTGGCGC AAGGCGATTT
 951 CAGCCAGACG CGCCCCGTGT TGCGCAACGA CGAGTTCGGA CGCTTGACCA
1001 AGTTGTTCAA CCACATGACC GAGCAGCTTT CCATCGCCAA AGAAGCAGAC
1051 GAGCGCAACC GCCGGCGCGA GGAAGCCGCC AGACATTATC TCGAATGCGT
1101 GTTGGAGGGG CTGACCACGG GCGTGGTGGT GTTTGACGAA CAAGGCTGTC
1151 TGAAAACCTT CAACAAAGCG GCGGAACAGA TTTTGGGGAT GCCGCTTACC
1201 CCCCTGTGGG GCAGCAGCCG GCACGGTTGG CACGGCGTTT CGGCGCAGCA
```

-continued

```
1251 GTCCCTGCTT GCCGAAGTGT TTGCCGCCAT CGGCGCGGCG GCAGGTACGG
1301 ACAAACCGGT CCATGTGAAA TATGCCGCGC CGGACGATGC CAAAATCCTG
1351 CTGGGCAAGG CAACCGTCCT GCCCGAAGAC AACGGCAACG GCGTGGTAAT
1401 GGTGATTGAC GACATCACCG TTTTGATACA CGCGCAAAAA GAAGCCGCGT
1451 GGGGCGAAGT GGCAAAACGG CTGGCACACG AAATCCGCAA TCCGCTCACG
1501 CCCATCCAGC TTTCTGCCGA ACGGCTGGCG TGGAAATTGG GCGGGAAGCT
1551 GGACGAGCAG GACGCGCAAA TCCTGACACG TTCGACCGAC ACCATCATCA
1601 AACAAGTGGC GGCATTAAAA GAAATGGTCG AGGCATTCCG CAATTACGCG
1651 CGTTCCCCTT CGCTCAAATT GGAAAATCAG GATTTGAACG CCTTAATCGG
1701 CGATGTGTTG GCATTGTACG AAGCTGGTCC GTGCCGGTTT GCGGCGGAAC
1751 TTGCCGGCGA ACCGCTGATG ATGGCGGCGG ATACGACCGC CATGCGGCAG
1801 GTGCTGCACA ATATTTTCAA AAATGCCGCC GAAGCGGCGG AAGAAGCCGA
1851 TGTGCCCGAA GTCAGGGTAA AATCGGAAGC GGGGCAGGAC GGACGGATTG
1901 TCCTGACAGT TTGCGACAAC GGCAAGGGGT TCGGCAGGGA AATGCTGCAC
1951 AATGCCTTCG AGCCGTATGT AACGGACAAA CCGGCTGGAA CGGGATTGGG
2001 ACTGCCCGTG GTGAAAAAAA TCATTGAAGA ACACGGCGGC CGCATCAGCC
2051 TGAGCAATCA GGATGCGGGC GGCGCGTGTG TCAGAATCAT CTTGCCAAAA
2101 ACGGTAGAAA CTTATGCGTA G
```

This corresponds to the amino acid sequence <SEQ ID 1028; ORF 258.a>:

a258.pep

```
  1 MRRFLPIAAI CAVVLLYGLT AATGSTSSLA DYFWWIVAFS AMLLLVLSAV
 51 LARYVILLLK DRRDGVFGSQ IAKRLSGMFT LVAVLPGVFL FGVSAQFING
101 TINSWFGNDT HEALERSLNL SKSALNLAAD NALGNAIPVQ IDLIGAASLP
151 GDMGRVLEHY AGSGFAQLAL YNAASGKIEK SINPHKLDQP FPGKARWEKI
201 QQAGSVRDLE SIGGVLYAQG WLSAGTHNGR DYALFFRQPV PKGVAEDAVL
251 IEKARAKYAE LSYSKKGLQT FFLATLLIAS LLSIFLALVM ALYFARRFVE
301 PVLSLAEGAK AVAQGDFSQT RPVLRNDEFG RLTKLFNHMT EQLSIAKEAD
351 ERNRRREEAA RHYLECVLEG LTTGVVVFDE QGCLKTFNKA AEQILGMPLT
401 PLWGSSRHGW HGVSAQQSLL AEVFAAIGAA AGTDKPVHVK YAAPDDAKIL
451 LGKATVLPED NGNGVVMVID DITVLIHAQK EAAWGEVAKR LAHEIRNPLT
501 PIQLSAERLA WKLGGKLDEQ DAQILTRSTD TIIKQVAALK EMVEAFRNYA
551 RSPSLKLENQ DLNALIGDVL ALYEAGPCRF AAELAGEPLM MAADTTAMRQ
601 VLHNIFKNAA EAAEEADVPE VRVKSEAGQD GRIVLTVCDN GKGFGREMLH
651 NAFEPYVTDK PAGTGLGLPV VKKIIEEHGG RISLSNQDAG GACVRIILPK
701 TVETYA*
```

m258/a258 99.0% identity in 584 aa overlap

```
                 10         20         30         40         50         60
m258.pep   MRRFLPIAAICAVVLLYGLTAATGSTSSLADYFWWIVAFSAMLLLVLSAVLARYVILLLK
           ||||||||||||||||||||||||||||||||||||||||||||||||||||||||||||
g258       MRRFLPIAAICAVVLLYGLTAATGSTSSLADYFWWIVAFSAMLLLVLSAVLARYVILLLK
                 10         20         30         40         50         60

                 70         80         90        100        110        120
m258.pep   DRRDGVFGSQIAKRLSGMFTLVAVLPGVFLFGVSAQFINGTINSWFGNDTHEALERSLNL
           ||||||||||||||||||||||||||||||||||||||||||||||||||||||||||||
a258       DRRDGVFGSQIAKRLSGMFTLVAVLPGVFLFGVSAQFINGTINSWFGNDTHEALERSLNL
                 70         80         90        100        110        120

                130        140        150        160        170        180
m258.pep   SKSALNLAADNALGNAVPVQIDLIGAASLPGDMGRVLEHYAGSGFAQLALYNAASGKIEK
           ||||||||||||||||:|||||||||||||||||||||||||||||||||||||||||||
a258       SKSALNLAADNALGNAIPVQIDLIGAASLPGDMGRVLEHYAGSGFAQLALYNAASGKIEK
                130        140        150        160        170        180

              190        200        210       220        230        240
m258.pep   SINPHKLDQPFPGKARWEKIQRAGSVRDLESIGGVLYAQGWLSAGTHNGRDYALFFRQPV
           |||||||||||||||||||||:||||||||||||||||||||||||||||||||||||||
a258       SINPHKLDQPFPGKARWEKIQQAGSVRDLESIGGVLYAQGWLSAGTHNGRDYALFFRQPV
              190        200        210       220        230        240

                250        260        270        280        290        300
m258.pep   PKGVAEDAVLIEKARAKYAELSYSKKGLQTFFLATLLIASLLSIFLALVMALYFARRFVE
           ||||||||||||||||||||||||||||||||||||||||||||||||||||||||||||
a258       PKGVAEDAVLIEKARAKYAELSYSKKGLQTFFLATLLIASLLSIFLALVMALYFARRFVE
                250        260        270        280        290        300

               310        320        330        340       350        360
m258.pep   PVLSLAEGAKAVAQGDFSQTRPVLRNDEFGRLTKLFNHMTEQLSIAKEADERNRRREEAA
           ||||||||||||||||||||||||||||||||||||||||||||||||||||||||||||
a258       PVLSLAEGAKAVAQGDFSQTRPVLRNDEFGRLTKLFNHMTEQLSIAKEADERNRRREEAA
               310        320        330        340       350        360

                370        380        390        400        410        420
m258.pep   RHYLECVLEGLTTGVVVFDEQGCLKTFNKAAEQILGMPLTPLWGSSRHGWHGVSAQQSLL
           ||||||||||||||||||||||||||||||||||||||||||||||||||||||||||||
a258       RHYLECVLEGLTTGVVVFDEQGCLKTFNKAAEQILGMPLTPLWGSSRHGWHGVSAQQSLL
                370        380        390        400        410        420

                430        440        450        460        470        480
m258.pep   AEVFAAIGAAAGTDKPVHVKYAAPDDAKILLGKATVLPEDNGNGVVMVIDDITVLIHAQK
           ||||||||||||||||||||||||||||||||||||||||||||||||||||||||||||
a258       AEVFAAIGAAAGTDKPVHVKYAAPDDAKILLGKATVLPEDNGNGVVMVIDDITVLIHAQK
                430        440        450        460        470        480

                490        500        510        520        530        540
m258.pep   EAAWGEVAKRLAHEIRNPLTPIQLSAERXAXKLGGKLDEQDAQILTRSTDTIVKQVAALK
           |||||||||||||||||||||||||||| | |||||||||||||||||||||:|||||||
a258       EAAWGEVAKRLAHEIRNPLTPIQLSAERLAWKLGGKLDEQDAQILTRSTDTIIKQVAALK
                490        500        510        520        530        540

                 550        560        570        580        589
m258.pep   EMVEAFRNYARSPSLKLENQDLNALIGDVLALYEAGPCRFAADLPANRX
           ||||||||||||||||||||||||||||||||||||||||||:|
a258       EMVEAFRNYARSPSLKLENQDLNALIGDVLALYEAGPCRFAAELAGEPLMMAADTTAMRQ
                550        560        570        580        590        600

a258       VLHNIFKNAAEAAEEADVPEVRVKSEAGQDGRIVLTVCDNGKGFGREMLHNAFEPYVTDK
                610        620        630        640        650        660
```

The following partial DNA sequence was identified in *N. gonorrhoeae* <SEQ ID 1029>:

g259.seq

```
  1 atgatgatgc acgcttctgt ccaaagtcgt ttcgcaccga tactttatgt
 51 tttgattttc tttgccggtt ttttgaccgc gcaaatctgg ttcaatcaga
101 aagcctatac tgaagagctg cctccgcttc tgtccgcatt gtccgccgtc
151 gcgctggtgt ggctggcgtg ggcgttcgtg tcggtgcgtt caaaggctaa
201 ggcagaaaag ttctaccgcg aaaaaatgat acagaacgaa agcatacacc
251 ccgtcctgca cgcttctttg caacacttgg aacacaagcc gcaaatgctc
301 gccctgctgg tcaaaaacca cggcaaaggc atggcggaac aggtcaggtt
351 caaggcggaa gtgctgcccg acgacgaaga cgcgcgcacg attgccgccg
401 agttggcaaa aatggatatg ttcgcattgg ggacggacgc ggtcgcctcg
```

-continued

```
451 ggcgaaacct atgggcgcgt gttcgccgat attttcgagt tgtcggcggc

501 tttggaaagg cgcgcgttca aagggatact gaaactgacg gcggaatata

551 aaaaacatct tcggcgatgc ctgccgttcg gaaacggcgt tggatttggg

601 cgcgctcaat caggcgttga gggaaatctc gaaaacgccg gaaaagccta

651 a
```

This corresponds to the amino acid sequence <SEQ ID 1030; ORF 259.ng>:

g259.pep

```
  1 MMMHASVQSR FAPILYVLIF FAGFLTAQIW FNQKAYTEEL PPLLSALSAV

 51 ALVWLAWAFV SVRSKAKAEK FYREKMIQNE SIHPVLHASL QHLEHKPQML

101 ALLVKNHGKG MAEQVRFKAE VLPDDEDART IAAELAKMDM FALGTDAVAS

151 GETYGRVFAD IFELSAALER RAFKGILKLT AEYKKHLRRC LPFGNGVGFG

201 RAQSGVEGNL ENAGKA*
```

The following partial DNA sequence was identified in *N. meningitidis* <SEQ ID 1031>:

m259.seq (partial)

```
  1 ATGATGATGC ACGCTTCTGT CCAAAGCCGT TTCGCACCGA TACTTTATGT

 51 TTTGATTTTC TTTGCCGGTT TTTTGACCGC GCAAATCTGG TTCAATCAGA

101 AAGCCTATAC TGAAGAGCTG CCTCCGCTTC TGTCCGCATT GTCCGCCGTC

151 GCGCTGGTGT GGCTGGCGTG GGCGTTCGTG TCGGCGCGTT CAAAGGCCAA

201 GGCGGAAAAG TTCTACCGCG AAAAAATGAT ACAGAACGAA AGCATACACC

251 CCGTCsTGCA CGCCTCTTTG CAACACTTGG AACACAAGCC GCAAATACTC

301 GCCCTGCTGG TCAAAAACCA CGGCAAAGGG ATGGCGGAAC AGGTCAGGTT

351 CAAGGCGGAA GTGCTGCCCG ACGACGAAGA CGCGCGCACG ATTGCCGCCG

401 AGTTGGCAAA AATGGATATG TTCGCATTGG GGACkGACGC GGTCGCCTCG

451 GGCGAAACCT ATGGACGCGT GTTCGCCGAT ATTTTCGAGT TGTCGGmGGC

501 TTTGGAAGGG CGCGCGTTCA AAGGAATGTT GAAACTGACG GCGGAATATA

551 AA.AACATCT TCGGmGATGC CTGCCGTTCG GAAACGGCGT TGGAGTTGGG

601 CGCACTCAAT CAGGCGTTGC AGGAGATTTC AAAAACATCC GG . . .
```

This corresponds to the amino acid sequence <SEQ ID 1032; ORF 259>:

m259.pep (partial)

```
  1 MMMHASVQSR FAPILYVLIF FAGFLTAQIW FNQKAYTEEL PPLLSALSAV

 51 ALVWLAWAFV SARSKAKAEK FYREKMIQNE SIHPVXHASL QHLEHKPQIL

101 ALLVKNHGKG MAEQVRFKAE VLPDDEDART IAAELAKMDM FALGTDAVAS

151 GETYGRVFAD IFELSXALEG RAFKGMLKLT AEYKXHLRRC LPFGNGVGVG

201 RTQSGVAGDF KNIR . . .
```

Computer analysis of this amino acid sequence gave the following results:

Homology with a predicted ORF from *N. gonorrhoeae*

ORF 259 shows 94.3% identity over a 212 aa overlap with a predicted ORF (ORF 259.ng) from *N. gonorrhoeae*:

```
m259/g259

                  10        20        30        40        50        60
m259.pep   MMMHASVQSRFAPILYVLIFFAGFLTAQIWFNQKAYTEELPPLLSALSAVALVWLAWAFV
           ||||||||||||||||||||||||||||||||||||||||||||||||||||||||||||
g259       MMMHASVQSRFAPILYVLIFFAGFLTAQIWFNQKAYTEELPPLLSALSAVALVWLAWAFV
                  10        20        30        40        50        60

                  70        80        90       100       110       120
m259.pep   SARSKAKAEKFYREKMIQNESIHPVXHASLQHLEHKPQILALLVKNHGKGMAEQVRFKAE
           |:||||||||||||||||||||||| |||||||||||||:||||||||||||||||||||
g259       SVRSKAKAEKFYREKMIQNESIHPVLHASLQHLEHKPQMLALLVKNHGKGMAEQVRFKAE
                  70        80        90       100       110       120

                 130       140       150       160       170       180
m259.pep   VLPDDEDARTIAAELAKMDMFALGTDAVASGETYGRVFADIFELSXALEGRAFKGMLKLT
           ||||||||||||||||||||||||||||||||||||||||||||| ||| |||||:||||
g259       VLPDDEDARTIAAELAKMDMFALGTDAVASGETYGRVFADIFELSAALERRAFKGILKLT
                 130       140       150       160       170       180

                 190       200       210
m529.pep   AEYKKHLRRCLPFGNGVGVGRTQSGVAGDFKNIR
           |||||||||||||||||| ||:|||| |:::|
g259       AEYKKHLRRCLPFGNGVGFGRAQSGVEGNLENAGKAX
                 190       200       210
```

The following partial DNA sequence was identified in *N. meningitidis* <SEQ ID 1033>:

<u>a259.seq (partial)</u>

```
  1 ATGATGATGC ACGCTTCTGT CCAAAGCCGT TTCGCACCGA TACTTTATGT
 51 TTTGATTTTC TTTGCCGGTT TTTTGACCGC GCAAATCTGG TTCAATCAGA
101 AAGCCTATAC TGAAGAGCTG CCTCCGCTTC TGTCCGCATT GTCCGCCGTC
151 GCGCTGGTGT GGCTGGCGTG GGCGTTCGTG TCGGCGCGTT CAAAGGCTAA
201 GGCGGAAAAG TTCTACCGCG AAAAAATGAT ACAGAACGAA AGCATACACC
251 CCGTCCTGCA CGCTTCTTTG CAACACTTGG AACACAAGCC GCAAATGCTC
301 GCCCTGCTGG TCAAAAACCA CGGCAAAGGG ATGGCGGAAC AGGTCAGGTT
351 CAAGGCGGAA GTGCTGCCCG ACGACGAAGA CGCGCGCACG ATTGCCGCCG
401 AGTTGGCAAA AATGGATATG TTTGCATTGG GGACGGACGC GGTCGCCTCG
451 GGCGAAACCT ATGGACGCGT GTTCGCCGAT ATTTTCGAGT TGTCGGCGGC
501 TTTGGAAGGG CGCGCGTTCA AAGGAATGTT GAAACTGACG GCGGAATATA
551 AAAA.CATCT TCGGCGATGC CTGCCGTTCG GAAACGGCGT TGGAGTTGGG
601 CGCGCTCAAT CAGGCGTTGC AGGAGATTTC AAAAACATCG GAAAAGTCCA
651 A
```

This corresponds to the amino acid sequence <SEQ ID 1034: ORF 259.a>:

<u>a259.pep (partial)</u>

1 <u>MMMHASVQSR FAPILYVLIF FAGFLTAQIW FNQKAYT</u>EEL PPL<u>LSALSAV</u>

51 <u>ALVWLAWAFV</u> SARSKAKAEK FYREKMIQNE SIHPVLHASL QHLEHKPQML

101 ALLVKNHGKG MAEQVRFKAE VLPDDEDART IAAELAKMDM FALGTDAVAS

-continued

```
151 GETYGRVFAD IFELSAALEG RAFKGMLKLT AEYKXHLRRC LPFGNGVGVG

201 RAQSGVAGDF KNIGKVQ
```

m259/a259 98.1% identity in 213 aa overlap

```
                   10        20        30        40        50        60
m259.pep    MMMHASVQSRFAPILYVLIFFAGFLTAQIWFNQKAYTEELPPLLSALSAVALVWLAWAFV
            ||||||||||||||||||||||||||||||||||||||||||||||||||||||||||||
a259        MMMHASVQSRFAPILYVLIFFAGFLTAQIWFNQKAYTEELPPLLSALSAVALVWLAWAFV
                   10        20        30        40        50        60

                   70        80        90       100       110       120
m259.pep    SARSKAKAEKFYREKMIQNESIHPVXHASLQHLEHKPQILALLVKNHGKGMAEQVRFKAE
            ||||||||||||||||||||||||| ||||||||||||:|||||||||||||||||||||
a259        SARSKAKAEKFYREKMIQNESIHPVLHASLQHLEHKPQMLALLVKNHGKGMAEQVRFKAE
                   70        80        90       100       110       120

                  130       140       150       160       170       180
m259.pep    VLPDDEDARTIAAELAKMDMFALGTDAVASGETYGRVFADIFELSXALEGRAFKGMLKLT
            ||||||||||||||||||||||||||||||||||||||||||||| ||||||||||||||
a259        VLPDDEDARTIAAELAKMDMFALGTDAVASGETYGRVFADIFELSAALEGRAFKGMLKLT
                  130       140       150       160       170       180

                  190       200       210
m259.pep    AEYKXHLRRCLPFGNGVGVGRTQSGVAGDFKNIR
            |||||||||||||||||||||:|||||||||||
a259        AEYKXHLRRCLPFGNGVGVGRAQSGVAGDFKNIGKVQ
                  190       200       210
```

The following partial DNA sequence was identified in *N. gonorrhoeae* <SEQ ID 1035>:

g259-1.seq

```
  1 ATGATGATGC ACGCTTCTGT CCAAAGTCGT TTCGCACCGA TACTTTATGT

 51 TTTGATTTTC TTTGCCGGTT TTTTGACCGC GCAAATCTGG TTCAATCAGA

101 AAGCCTATAC TGAAGAGCTG CCTCCGCTTC TGTCCGCATT GTCCGCCGTC

151 GCGCTGGTGT GGCTGGCGTG GGCGTTCGTG TCGGTGCGTT CAAAGGCTAA

201 GGCAGAAAAG TTCTACCGCG AAAAAATGAT ACAGAACGAA AGCATACACC

251 CCGTCCTGCA CGCTTCTTTG CAACACTTGG AACACAAGCC GCAAATGCTC

301 GCCCTGCTGG TCAAAAACCA CGGCAAAGGC ATGGCGGAAC AGGTCAGGTT

351 CAAGGCGGAA GTGCTGCCCG ACGACGAAGA CGCGCGCACG ATTGCCGCCG

401 AGTTGGCAAA AATGGATATG TTCGCATTGG GGACGGACGC GGTCGCCTCG

451 GGCGAAACCT ATGGGCGCGT GTTCGCCGAT ATTTTCGAGT TGTCGGCGGC

501 TTTGGAA
```

This corresponds to the amino acid sequence <SEQ ID 1036; ORF 259-1.ng>:

g259-1.pep

```
  1 MMMHASVQSR FAPILYVLIF FAGFLTAQIW FNQKAYTEEL PPLLSALSAV

 51 ALVWLAWAFV SVRSKAKAEK FYREKMIQNE SIHPVLHASL QHLEHKPQML

101 ALLVKNHGKG MAEQVRFKAE VLPDDEDART IAAELAKMDM FALGTDAVAS

151 GETYGRVFAD IFELSAALE
```

The following partial DNA sequence was identified in *N. meningitidis* <SEQ ID 1037>:

m259-1.seq

```
  1 ATGATGATGC ACGCTTCTGT CCAAAGCCGT TTCGCACCGA TACTTTATGT
 51 TTTGATTTTC TTTGCCGGTT TTTTGACCGC GCAAATCTGG TTCAATCAGA
101 AAGCCTATAC TGAAGAGCTG CCTCCGCTTC TGTCCGCATT GTCCGCCGTC
151 GCGCTGGTGT GGCTGGCGTG GGCGTTCGTG TCGGCGCGTT CAAAGGCCAA
201 GGCGGAAAAG TTCTACCGCG AAAAAATGAT ACAGAACGAA AGCATACACC
251 CCGTCCTGCA CGCCTCTTTG CAACACTTGG AACACAAGCC GCAAATACTC
301 GCCCTGCTGG TCAAAAACCA CGGCAAAGGG ATGGCGGAAC AGGTCAGGTT
351 CAAGGCGGAA GTGCTGCCCG ACGACGAAGA CGCGCGCACG ATTGCCGCCG
401 AGTTGGCAAA AATGGATATG TTCGCATTGG GGACGGACGC GGTCGCCTCG
451 GGCGAAACCT ATGGACGCGT GTTCGCCGAT ATTTTCGAGT TGTCGGCGGC
501 TTTGGAAGGG CGCGCGTTCA AAGGAATGTT GAAACTGACG GCGGAATATA
551 AAAACATCTT CGGCGATGCC TGCCGTTCGG AAACGGCGTT GGAGTTGGGC
601 GCACTCAATC AGGCGTTGCA GGAGATTTCA AAAACATCGG AAAAGTCCAA
651 ACGGATATTT TATTGA
```

This corresponds to the amino acid sequence <SEQ ID 1038; ORF 259-1>:

m259-1.pep

```
  1 MMMHASVQSR FAPILYVLIF FAGFLTAQIW FNQKAYTEEL PPLLSALSAV
 51 ALVWLAWAFV SARSKAKAEK FYREKMIQNE SIHPVLHASL QHLEHKPQIL
101 ALLVKNHGKG MAEQVRFKAE VLPDDEDART IAAELAKMDM FALGTDAVAS
151 GETYGRVFAD IFELSAALEG RAFKGMLKLT AEYKNIFGDA CRSETALELG
201 ALNQALQEIS KTSEKSKRIF Y*
```

g259-1/m259-1 98.8% identity in 169 aa overlap

```
                    10        20        30        40        50        60
g259-1.pep  MMMHASVQSRFAPILYVLIFFAGFLTAQIWFNQKAYTEELPPLLSALSAVALVWLAWAFV
            ||||||||||||||||||||||||||||||||||||||||||||||||||||||||||||
m259-1      MMMHASVQSRFAPILYVLIFFAGFLTAQIWFNQKAYTEELPPLLSALSAVALVWLAWAFV
                    10        20        30        40        50        60

                    70        80        90       100       110       120
g259-1.pep  SVRSKAKAEKFYREKMIQNESIHPVLHASLQHLEHKPQMLALLVKNHGKGMAEQVRFKAE
            |:||||||||||||||||||||||||||||||||||||:|||||||||||||||||||||
m259-1      SARSKAKAEKFYREKMIQNESIHPVLHASLQHLEHKPQILALLVKNHGKGMAEQVRFKAE
                    70        80        90       100       110       120

                   130       140       150       160       169
g259-1.pep  VLPDDEDARTIAAELAKMDMFALGTDAVASGETYGRVFADIFELSAALE
            |||||||||||||||||||||||||||||||||||||||||||||||||
m259-1      VLPDDEDARTIAAELAKMDMFALGTDAVASGETYGRVFADIFELSAALEGRAFKGMLKLT
                   130       140       150       160       170       180
```

The following partial DNA sequence was identified in *N. meningitidis* <SEQ ID 1039>:

a259-1.seq

```
  1 ATGATGATGC ACGCTTCTGT CCAAAGCCGT TTCGCACCGA TACTTTATGT
 51 TTTGATTTTC TTTGCCGGTT TTTTGACCGC GCAAATCTGG TTCAATCAGA
101 AAGCCTATAC TGAAGAGCTG CCTCCGCTTC TGTCCGCATT GTCCGCCGTC
151 GCGCTGGTGT GGCTGGCGTG GGCGTTCGTG TCGGCGCGTT CAAAGGCTAA
201 GGCGGAAAAG TTCTACCGCG AAAAAATGAT ACAGAACGAA AGCATACACC
251 CCGTCCTGCA CGCTTCTTTG CAACACTTGG AACACAAGCC GCAAATGCTC
301 GCCCTGCTGG TCAAAAACCA CGGCAAAGGG ATGGCGGAAC AGGTCAGGTT
351 CAAGGCGGAA GTGCTGCCCG ACGACGAAGA CGCGCGCACG ATTGCCGCCG
401 AGTTGGCAAA AATGGATATG TTTGCATTGG GGACGGACGC GGTCGCCTCG
451 GGCGAAACCT ATGGACGCGT GTTCGCCGAT ATTTTCGAGT TGTCGGCGGC
501 TTTGGAAGGG CGCGCGTTCA AAGGAATGTT GAAACTGACG GCGGAATATA
551 AAAACATCTT CGGCGATGCC TGCCGTTCGG AAACGGCGTT GGAGTTGGGC
601 GCGCTCAATC AGGCGTTGCA GGAGATTTCA AAAACATCGG AAAAGTCCAA
651 ACGGATATTT TATTGA
```

This corresponds to the amino acid sequence <SEQ ID 1040; ORF 259-1.a>:

a259-1.pep

```
  1 MMMHASVQSR FAPILYVLIF FAGFLTAQIW FNQKAYTEEL PPLLSALSAV
 51 ALVWLAWAFV SARSKAKAEK FYREKMIQNE SIHPVLHASL QHLEHKPQML
101 ALLVKNHGKG MAEQVRFKAE VLPDDEDART IAAELAKMDM FALGTDAVAS
151 GETYGRVFAD IFELSAALEG RAFKGMLKLT AEYKNIFGDA CRSETALELG
201 ALNQALQEIS KTSEKSKRIF Y*
```

a259-1/m259-1 99.5% identity in 221 aa overlap

```
                        10        20        30        40        50        60
a259-1.pep      MMMHASVQSRFAPILYVLIFFAGFLTAQIWFNQKAYTEELPPLLSALSAVALVWLAWAFV
                ||||||||||||||||||||||||||||||||||||||||||||||||||||||||||||
m259-1          MMMHASVQSRFAPILYVLIFFAGFLTAQIWFNQKAYTEELPPLLSALSAVALVWLAWAFV
                        10        20        30        40        50        60

                        70        80        90       100       110       120
a259-1.pep      SARSKAKAEKFYREKMIQNESIHPVLHASLQHLEHKPQMLALLVKNHGKGMAEQVRFKAE
                ||||||||||||||||||||||||||||||||||||||:|||||||||||||||||||||
m259-1          SARSKAKAEKFYREKMIQNESIHPVLHASLQHLEHKPQILALLVKNHGKGMAEQVRFKAE
                        70        80        90       100       110       120

                       130       140       150       160       170       180
a259-1.pep      VLPDDEDARTIAAELAKMDMFALGTDAVASGETYGRVFADIFELSAALEGRAFKGMLKLT
                ||||||||||||||||||||||||||||||||||||||||||||||||||||||||||||
m259-1          VLPDDEDARTIAAELAKMDMFALGTDAVASGETYGRVFADIFELSAALEGRAFKGMLKLT
                       130       140       150       160       170       180

                    190       200       210       220
a259-1.pep      AEYKNIFGDACRSETALELGALNQALQEISKTSEKSKRIFYX
                |||||||||||||||||||||||||||||||||||||||||
m259-1          AEYKNIFGDACRSETALELGALNQALQEISKTSEKSKRIFYX
                    190       200       210       220
```

The following partial DNA sequence was identified in *N. gonorrhoeae* <SEQ ID 1041>:

g260.seq

```
  1 atgggtgcgg gtgtagtatt cgttgtcttt cagccgttct tcagcctgtt
 51 tcgagcgttg ttcgagggcg gagtcggtat agtcgaggga gcgcacgatg
101 ccgctgaatg cgacttcttg tccgaggaat ttacccgtat ccggatcggt
151 gatgttttta ttgattcggt aggtcagata acggcccggt tctttcaggc
201 ctttggtgta aaccctggcg cctttggtgt acagcagcct gccttccggg
251 cccgagagca ggcgcggcgc ggcagcggtt tctttgcggg aaacgatttg
301 cgggtgctgc ataaagacgc ggtagaagtt gacatcgatg gcgggaatac
351 cgtatccgga cacttcctta tccggactga ttttgacgac ggggatgccg
401 tctgtctgtt ccaagccgag gcgcggttcg ccgccaacgt agcgcaacac
451 caatacctgg cccggataaa tcaggtcggg attgtggatt tgatcccggt
501 tcgcgcccca caggggggga ccattgccac gggctgtaca ggtatttgcc
551 cgaaataccc cacagggtgt cgccctgttt ga
```

This corresponds to the amino acid sequence <SEQ ID 1042; ORF 260.ng>:

g260.pep

```
  1 MGAGVVFVVF QPFFSLFRAL FEGGVGIVEG AHDAAECDFL SEEFTRIRIG
 51 DVFIDSVGQI TARFFQAFGV NPGAFGVQQP AFRAREQARR GSGFFAGNDL
101 RVLHKDAVEV DIDGGNTVSG HFLIRTDFDD GDAVCLFQAE ARFAANVAQH
151 QYLARINQVG IVDLIPVRAP QGGTIATGCT GICPKYPTGC RPV*
```

The following partial DNA sequence was identified in *N. meningitidis* <SEQ ID 1043>:

m260.seq

```
  1 ATGGGTGCGG GTATGGTATT CGTTGTCTTT CGGCCGTTCT CCAGCCTGTT
 51 TCGAGCGTTG TTCGAGGACA GAGTCGGTAT AGTCGAGGGA GCGCACGATG
101 CCGCTGAATG CGACTTCCTG CCCGAGGAAT TTACCCGTAT CCGGATCGGT
151 GATGTTTTTA TTGATTCGGT AGGTCAGGTA GCGGCCCGGC TCTTTCAGGC
201 CTTTGGTGTA AACCCTGGTG CCTTTGGTGT ACAGCAGCCT GCCTTCCGGG
251 CCCGAGwrCA sGCGCGGyGC GGCAGCGGTT TCTTTGCGGG AAACGATTTG
301 CGGATGCCGC ATAAAGATGC GGTAGAAGTT GACATCGATG GCGGGAATAC
351 CGTATCCGGA CACTTCCTTA TCCGGACTCA TTTTGACGAC GGGGATGCCG
401 TCTGTCTGTT CCAAGCCGAG GCGCGGTTCG CCGTCAACGT GGCGCAACAC
451 CAATACCTGG TCCGGATAAA TCAGGTCGGG ATTGTGGATT TGATCCCGGT
501 TCGCGTyCCA CAG
```

This corresponds to the amino acid sequence <SEQ ID 1044; ORF 260>:

m260.pep

```
  1 MGAGMVFVVF RPFSSLFRAL FEDRVGIVEG AHDAAECDFL PEEFTRIRIG

 51 DVFIDSVGQV AARLFQAFGV NPGAFGVQQP AFRARXXARX GSGFFAGNDL

101 RMPHKDAVEV DIDGGNTVSG HFLIRTHFDD GDAVCLFQAE ARFAVNVAQH

151 QYLVRINQVG IVDLIPVRVP Q
```

Computer analysis of this amino acid sequence gave the following results:

Homology with a predicted ORF from *N. gonorrhoeae*

ORF 260 shows 89.5% identity over a 171 aa overlap with a predicted ORF (ORF 260.ng) from *N. gonorrhoeae*:

m260/g260

```
                      10        20        30        40        50        60
m260.pep      MGAGMVFVVFRPFSSLFRALFEDRVGIVEGAHDAAECDFLPEEFTRIRIGDVFIDSVGQV
              ||||:|||||:|| ||||||||  |||||||||||||||| ||||||||||||||||||:
g260          MGAGVVFVVFQPFFSLFRALFEGGVGIVEGAHDAAECDFLSEEFTRIRIGDVFIDSVGQI
                      10        20        30        40        50        60

                      70        80        90       100       110       120
m260.pep      AARLFQAFGVNPGAFGVQQPAFRARXXARXGSGFFAGNDLRMPHKDAVEVDIDGGNTVSG
              :||:|||||||||||||||||||||  || |||||||||||: |||||||||||||||||
g260          TARFFQAFGVNPGAFGVQQPAFRAREQARRGSGFFAGNDLRVLHKDAVEVDIDGGNTVSG
                      70        80        90       100       110       120

                     130       140       150       160       170
m260.pep      HFLIRTHFDDGDAVCLFQAEARFAVNVAQHQYLVRINQVGIVDLIPVRVPQ
              |||||| |||||||||||||||||:||||||||:||||||||||||||:||
g260          HFLIRTDFDDGDAVCLFQAEARFAANVAQHQYLARINQVGIVDLIPVRAPQGGTIATGCT
                     130       140       150       160       170       180

g260          GICPKYPTGCRPV
                     190
```

The following partial DNA sequence was identified in *N. meningitidis* <SEQ ID 1045>:

a260.seq

```
  1 ATGGGTGCGG GTATGGTATT CGTTGTCTTT CGGCCGTTCT CCAGCCTGTT

 51 TCGAGCGTTG TTCGAGGACA GAGTCGGTAT AGTCGAGGGA GCGCACGATG

101 CCGCTGAATG CGACTTCCTG CCCGAGGAAT TTACCCGTAT CCGGATCGGT

151 GATGTTTTTA TTGATTCGGT AGGTCAGGTA GCGGCCCGGC TCTTTCAGGC

201 CTTTGGTGTA AACCCTGGTG CCTTTGGTGT ACAGCAGCCT GCCTTCCGGG

251 CCCGAGAGCA GGCGCGGCGC GGCAGCGGTT TCTTTGCGGG AAACGATTTG

301 CGGGTGCCGC ATAAAGATGC GGTAGAAGTT GACATCGATG GCGGGAATAC

351 CGTATCCGGA CACTTCCTTA TCCGGACTCA TTTTGACGAC GGGGATGCCG

401 TCTGTCTGTT CCAAGCCGAG GCGCGGTTCG CCGTCAACGT GGCGCAACAC

451 CAATACCTGG TCCAGATAAA TCAGGTCGGG ATTGTGGATT TGATCCCGGT

501 TCGCGTCCCA CAGGCGGCC. CCATTGCCAC GGGCTGTACA GGTATTTGCC

551 CGAAATGCCC CACAGGGTGT CGCCCTGTTT GA
```

This corresponds to the amino acid sequence <SEQ ID 1046; ORF 260.a>:

a260.pep

```
  1 MGAGMVFVVF RPFSSLFRAL FEDRVGIVEG AHDAAECDFL PEEFTRIRIG

 51 DVFIDSVGQV AARLFQAFGV NPGAFGVQQP AFRAREQARR GSGFFAGNDL

101 RVPHKDAVEV DIDGGNTVSG HFLIRTHFDD GDAVCLFQAE ARFAVNVAQH

151 QYLVQINQVG IVDLIPVRVP QAAXIATGCT GICPKCPTGC RPV*
```

m260/a260 97.1% identity in 171 aa overlap

```
                  10        20        30        40        50        60
m260.pep  MGAGMVFVVFRPFSSLFRALFEDRVGIVEGAHDAAECDFLPEEFTRIRIGDVFIDSVGQV
          ||||||||||||||||||||||||||||||||||||||||||||||||||||||||||||
a260      MGAGMVFVVFRPFSSLFRALFEDRVGIVEGAHDAAECDFLPEEFTRIRIGDVFIDSVGQV
                  10        20        30        40        50        60

                  70        80        90       100       110       120
m260.pep  AARLFQAFGVNPGAFGVQQPAFRARXXARXGSGFFAGNDLRMPHKDAVEVDIDGGNTVSG
          |||||||||||||||||||||||||  || ||||||||||:|||||||||||||||||||
a260      AARLFQAFGVNPGAFGVQQPAFRAREQARRGSGFFAGNDLRVPHKDAVEVDIDGGNTVSG
                  70        80        90       100       110       120

                 130       140       150       160       170
m260.pep  HFLIRTHFDDGDAVCLFQAEARFAVNVAQHQYLVRINQVGIVDLIPVRVPQ
          ||||||||||||||||||||||||||||||||||:||||||||||||||||
a260      HFLIRTHFDDGDAVCLFQAEARFAVNVAQHQYLVQINQVGIVDLIPVRVPQAAXIATGCT
                 130       140       150       160       170       180

a260      GICPKCPTGCRPVX
                 190
```

The following partial DNA sequence was identified in *N. gonorrhoeae* <SEQ ID 1047>:

g261.seq

```
  1 atggagcttg ggcatatcgt attccttgtg ctttgcgcgc gttcagacgg

 51 ccttttttact ttccagacat tccgccagcc cgcgttcgcg caagatacag

101 ctcgggcatt cgcggcagcc gccgacgata cccttgtagc aggtgtgggt

151 ctgttcgcgg atgtagtcca acacgcccat ttcgtccgcc aacgcccacg

201 tttgcgcctt ggtcaggtac atcagcggcg tgtggatttg aaaatcgtag

251 tccatcgcca gattaagggt aacgttcatg gatttgacga acacgccgcg

301 gcagtcggga tagcccgaaa aatcggtttc gcacacgccc gcgatgatgt

351 gccggatacc ctgccctttg gcaaaaatgg cggcgtaaag caggaaaagc

401 gcgttacgcc cgtccacaaa ggtattggga acgccgttgt cggcggtttc

451 gatggcggcg gtttcgatgg cggcggtttc gtccatcagg gcgttgtgcg

501 taatctgccg catcaggctc aaatcgagta cggtttgact gacacccaaa

551 tcctgcgcga tccactctgc gcgttccagc tcgacggcat ggcgttgccc

601 gtatcggaag gtgatggctt ggacgttttc gcgcccgtag gtttggattg

651 cctgaatcag gcaggtggtc gaatcctgac cgcccgagaa gatgaccaag

701 gctttttggt ttga
```

This corresponds to the amino acid sequence <SEQ ID 1048; ORF 261.ng>:

g261.pep

```
  1 MELGHIVFLV LCARSDGLFT FQTFRQPAFA QDTARAFAAA ADDTLVAGVG
 51 LFADVVQHAH FVRQRPRLRL GQVHQRRVDL KIVVHRQIKG NVHGFDEHAA
101 AVGIARKIGF AHARDDVPDT LPFGKNGGVK QEKRVTPVHK GIGNAVVGGF
151 DGGGFDGGGF VHQGVVRNLP HQAQIEYGLT DTQILRDPLC AFQLDGMALP
201 VSEGDGLDVF APVGLDCLNQ AGGRILTARE DDQGFLV*
```

The following partial DNA sequence was identified in *N. meningitidis* <SEQ ID 1049>:

m261.seq

```
  1 ATGGAGCTTG GGCATATCGT ATTCCTTATG GTTTGCGCGT GTTCAGACGG
 51 CCTTTTTACT TTCCAGATAT TCCGCCAGCC cGcGTTCGCG CAAGATACAG
101 CTCGGGCATT CGCGgCAGCC GCCGACGATG CCGTTATAGC AGGTGTGGGT
151 TTGCTCGCGG ATATAGTCCA GCACGCCCAT TTCGTCCGCC AACGCCCACG
201 TTTGCGCCTT GGTCAGATAC ATCAGCGGCG TGTGGATTTG AAAATCATAG
251 TCCATCGCCA AATTAAGGGT AACGTTCATC GATTTGACAA ACACGTCGCG
301 GCAGTCGGGA TAGCCGGAGA AGTCGGTTTC GCACACGCCC GCGATGATGT
351 GCCGTATCCC CTGCCCTTTG GCGTAAATCG CGGCATAGAG CAGGAAAAGC
401 gCGTTGCGGC CGTCTACAAA GGTATTCGGA ACGCCGTTTT CGGCAGTTTC
451 GATGGCGGCG GTGTCGTCCA TCAGGGCATT GTGCGTAATC TGCCGCATCA
501 GgCTcAAGTC GAGTACGGTT TGTTTGACGC CCAAATCCTG CGCAATCCAG
551 CGGGCACGTT CCAGCTCGAC GGCATGGCGT TGCCCGTATT GGAAAGTAAT
601 GGCTTGGACG TTTTCGCGCC CGTAGGTTTG GATTGCCTGA ATCAGGCAGG
651 TGGTCGAATC CTGACCGCCC GAAAAGATGA CCAAGGCTTG TTGGTTTGA
```

This corresponds to the amino acid sequence <SEQ ID 1050; ORF 261>:

m261.pep

```
  1 MELGHIVFLM VCACSDGLFT FQIFRQPAFA QDTARAFAAA ADDAVIAGVG
 51 LLADIVQHAH FVRQRPRLRL GQIHQRRVDL KIIVHRQIKG NVHRFDKHVA
101 AVGIAGEVGF AHARDDVPYP LPFGVNRGIE QEKRVAAVYK GIRNAVFGSF
151 DGGGVVHQGI VRNLPHQAQV EYGLFDAQIL RNPAGTFQLD GMALPVLESN
201 GLDVFAPVGL DCLNQAGGRI LTARKDDQGL LV*
```

Computer analysis of this amino acid sequence gave the following results:

Homology with a predicted ORF from *N. gonorrhoeae*

ORF 261 shows 79.7% identity over a 237 aa overlap with a predicted ORF (ORF 261.ng) from *N. gonorrhoeae*:

m261/g261

```
                  10        20        30        40        50        60
m261.pep  MELGHIVFLMVCACSDGLFTFQIFRQPAFAQDTARAFAAAADDAVIAGVGLLADIVQHAH
          |||||||||::|| |||||||| ||||||||||||||||||||:::|||||:||:|||||
g261      MELGHIVFLVLCARSDGLFTFQTFRQPAFAQDTARAFAAAADDTLVAGVGLFADVVQHAH
                  10        20        30        40        50        60

                  70        80        90       100       110       120
m261.pep  FVRQRPRLRLGQIHQRRVDLKIIVHRQIKGNVHRFDKHVAAVGIAGEVGFAHARDDVPYP
          ||||||||||||:|||||||||:|||||||||| ||:|:|||||| ::||||||||||
g261      FVRQRPRLRLGQVHQRRVDLKIVVHRQIKGNVHGFDEHAAAVGIARKIGFAHARDDVPDT
                  70        80        90       100       110       120

                 130       140       150            160       170
m261.pep  LPFGVNRGIEQEKRVAAVYKGIRNAVFGSFDGGGV-----VHQGIVRNLPHQAQVEYGLF
          |||| | |::|||||: |:||| ||| |:|||||      ||||:|||||||||:||||
g261      LPFGKNGGVKQEKRVTPVHKGIGNAVVGGFDGGGFDGGGFVHQGVVRNLPHQAQIEYGLT
                 130       140       150       160       170       180

               180       190       200       210       220       230
m261.pep  DAQILRNPAGTFQLDGMALPVLESNGLDVFAPVGLDCLNQAGGRILTARKDDQGLLVX
          |:||||:|  :|||||||||| |::||||||||||||||||||||||||:||||:|||
g261      DTQILRDPLCAFQLDGMALPVSEGDGLDVFAPVGLDCLNQAGGRILTAREDDQGFLVX
                 190       200       210       220       230
```

The following partial DNA sequence was identified in *N. meningitidis* <SEQ ID 1051>:

a261.seq

```
  1 ATGGAGCTTG GGCATATCGT ATTCCTTATG GTTTGCGCGT GTTCAGACGG
 51 CCTTTTTACT TTCCAGATAT TCCGCCAGCC CGCGTTCGCG CAAGATACAG
101 CTCGGGCATT CGCGGCAGCC GCCGACGATG CCGTTATAGC AGGTGTGGGT
151 TTGCTCGCGG ATATAGTCCA GCGCGCCCAT TTCGTCCGCC AACGCCCAAG
201 TTTGCGCCTT GGTCAGATAC ATCAGCGGCG TGTGGATTTG AAAATCATAG
251 TCCATCGCCA GATTAAGGGT AACGTTCATG GATTTGACAA ACACGTCACG
301 GCAGTCGGGA TAGCCGGAGA AGTCGGTTTC GCACACGCCC GCGATGATGT
351 GCCGTATCCC CTGCCCTTTG GCGTAAATCG CGGCATAGAG CAGGAAAAGC
401 GCGTTGCGGC CGTCTACAAA GGTATTCGGA ACGCCGTTTT CGGCAGTTTC
451 GATGGCGGCG GTGTCGTCCA TCAGGGCATT GTGCGTAATC TGCCGCATCA
501 GGCTCAAGTC GAGTACGGTT TGTTTGACGC CCAAATCCTG CGCAATCCAG
551 CGGGCACGTT CCAGCTCGAC GGCATGGCGT TGCCCGTATT GGAAAGTAAT
601 GGCTTGGACG TTTTCGCGCC CGTAGGTTTG GATTGCCTGA ATCAGGCAGG
651 TGGTCGAATC CTGACCGCCC GAAAAGATGA CCAAGGCTTT TTGGTTTGA
```

This corresponds to the amino acid sequence <SEQ ID 1052; ORF 261.a>:

a261.pep

```
  1 MELGHIVFLM VCACSDGLFT FQIFRQPAFA QDTARAFAAA ADDAVIAGVG
 51 LLADIVQRAH FVRQRPSLRL GQIHQRRVDL KIIVHRQIKG NVHGFDKHVT
101 AVGIAGEVGF AHARDDVPYP LPFGVNRGIE QEKRVAAVYK GIRNAVFGSF
151 DGGGVVHQGI VRNLPHQAQV EYGLFDAQIL RNPAGTFQLD GMALPVLESN
201 GLDVFAPVGL DCLNQAGGRI LTARKDDQGF LV*
```

m261/a261 97.8% identity in 232 aa overlap

```
                      10        20        30        40        50        60
m261.pep      MELGHIVFLMVCACSDGLFTFQIFRQPAFAQDTARAFAAAADDAVIAGVGLLADIVQHAH
              |||||||||||||||||||||||||||||||||||||||||||||||||||||||||:||
a261          MELGHIVFLMVCACSDGLFTFQIFRQPAFAQDTARAFAAAADDAVIAGVGLLADIVQRAH
                      10        20        30        40        50        60

                      70        80        90       100       110       120
m261.pep      FVRQRPRLRLGQIHQRRVDLKIIVHRQIKGNVHRFDKHVAAVGIAGEVGFAHARDDVPYP
              |||||| |||||||||||||||||||||||||| |||||:||||||||||||||||||||
a261          FVRQRPSLRLGQIHQRRVDLKIIVHRQIKGNVHGFDKHVTAVGIAGEVGFAHARDDVPYP
                      70        80        90       100       110       120

                     130       140       150       160       170       180
m261.pep      LPFGVNRGIEQEKRVAAVYKGIRNAVFGSFDGGGVVHQGIVRNLPHQAQVEYGLFDAQIL
              ||||||||||||||||||||||||||||||||||||||||||||||||||||||||||||
a261          LPFGVNRGIEQEKRVAAVYKGIRNAVFGSFDGGGVVHQGIVRNLPHQAQVEYGLFDAQIL
                     130       140       150       160       170       180

                     190       200       210       220       230
m261.pep      RNPAGTFQLDGMALPVLESNGLDVFAPVGLDCLNQAGGRILTARKDDQGLLVX
              |||||||||||||||||||||||||||||||||||||||||||||||||:|||
a261          RNPAGTFQLDGMALPVLESNGLDVFAPVGLDCLNQAGGRILTARKDDQGFLVX
                     190       200       210       220       230
```

The following partial DNA sequence was identified in *N. gonorrhoeae* <SEQ ID 1053>:

g263.seq

```
  1 atggcacgtt taaccgtaca caccctcgaa accgcccccg aagccgccaa
 51 accgcgcgta gaggccgtac ccaaaaacaa cggctttatc cccaacctca
101 tcggcgtatt ggcaaacgcc cccgaagctt tggcgtttta ccaagaagtc
151 ggcaagctca acgccgccaa cagcctgacc gccggcgaag tcgaagtgat
201 ccggatcatc gccgtccgca ccaaccaatg cagcttctgc gtggcagggc
251 acaccaaact cgcaaccctg aaaaaactcc tgtccgagca atccctcaat
301 gccgcccgcg ctttggcggc aggtaaatct gacgatgcca aactcggcgc
351 gcttgccgcc ttcacccaag ccgtaatggc gaaaaaaggc gcagtatccg
401 acgacgaact caacgccttc ctcgaagcgg gctacaaccg gcagcaggca
451 gtcgaagtcg taatgggcgt agccttggca actttgtgca actacgccaa
501 caacctcgcc caaaccgaaa tcaaccccaa attgcaggca tacgcctaa
```

This corresponds to the amino acid sequence <SEQ ID 1054; ORF 263.ng>:

g263.pep

```
  1 MARLTVHTLE TAPEAAKPRV EAVPKNNGFI PNLIGVLANA PEALAFYQEV
 51 GKLNAANSLT AGEVEVIRII AVRTNQCSFC VAGHTKLATL KKLLSEQSLN
101 AARALAAGKS DDAKLGALAA FTQAVMAKKG AVSDDELNAF LEAGYNRQQA
151 VEVVMGVALA TLCNYANNLA QTEINPKLQA YA*
```

The following partial DNA sequence was identified in *N. meningitidis* <SEQ ID 1055>:

m263.seq (partial)

```
  1 ..GCAGCAGGCG AATTTGACGA TGCCAAACTC GGCGCGCTCG CCGCCTTCAC
 51   CCAAGCCGTA ATGGCGAAAA AAGGCGCGGT ATCCGACGAG GAACTCAAAG
```

-continued

```
101   CATTTTTCGA TGCGGGCTAC AACCAGCAGC AGGCAGTCGA AGTCGTGATG
151   GGCGT.AsyC TgGCAACCCT GTGCAACTAC GTCAACAACC TCGGACAAAC
201   CGAAATCAAC CCCGAATTGC AGGCTTACGC CTGA
```

This corresponds to the amino acid sequence <SEQ ID 1056; ORF 263>:

m263.pep (partial)

```
  1 ..GCAGCAGGCG AATTTGACGA TGCCAAACTC GGCGCGCTCG CCGCCTTCAC
 51   CCAAGCCGTA ATGGCGAAAA AAGGCGCGGT ATCCGACGAG GAACTCAAAG
101   CATTTTTCGA TGCGGGCTAC AACCAGCAGC AGGCAGTCGA AGTCGTGATG
151   GGCGT.AsyC TgGCAACCCT GTGCAACTAC GTCAACAACC TCGGACAAAC
201   CGAAATCAAC CCCGAATTGC AGGCTTACGC CTGA
```

Computer analysis of this amino acid sequence gave the following results:

Homology with a predicted ORF from *N. gonorrhoeae*

ORF 263 shows 85.7% identity over a 77 aa overlap with a predicted ORF (ORF 263.ng) from *N. gonorrhoeae*:

m263/g263

```
                                                  10        20        30
m263.pep                                AAGEFDDAKLGALAAFTQAVMAKKGAVSDE
                                        |||: ||||||||||||||||||||||||:
g263      QCSFCVAGHTKLATLKKLLSEQSLNAARALAAGKSDDAKLGALAAFTQAVMAKKGAVSDD
              80        90       100       110       120       130

                  40        50        60        70
m263.pep  ELKAFFDAGYNQQQAVEVVMGVXLATLCNYVNNLGQTEINPELQAYAX
          ||:||::||||:|||||||||| |||||||:|||:||||||:||||||
g263      ELNAFLEAGYNRQQAVEVVMGVALATLCNYANNLAQTEINPKLQAYAX
             140       150       160       170       180
```

The following partial DNA sequence was identified in *N. meningitidis* <SEQ ID 1057>:

a263.seq

```
  1 ATGGCACGTT TAACCGTACA CACCCTCGAA ACCGCCCCCG AAGCCGCCAA
 51 AGCGCGCGTC GAGGCGGTAC TTCAAAACAA CGGCTTTATC CCCAACCTTA
101 TCGGCGTATT ATCAAACGCC CCCGAAGCCT TGGCGTTTTA CCAAGAAGTC
151 GGCAAGCTCA ACGCCGCCAA CAGCCTGACC GCCGGCGAAG TCGAAGTAAT
201 CCAGATTATT GCCGCCCGCA CCAACCAATG CGGCTTCTGC GTGGCAGGGC
251 ACACCAAACT CGCAACCCTG AAAAAACTCC TTTCCGAACA ATCCGTCAAA
301 GCCGCGCGCG CTTTGGCGGC AGGCGAATTT GACGATGCTA AACTCGGCGC
351 GCTCGCCGCC TTTACCCAAG CCGTAATGGC AAAAAAAGGC GCGGTATCCG
401 ACGAGGAACT CAAAGCATTT TTTGATGCGG GCTACAACCA GCAGCAGGCA
451 GTCGAAGTCG TGATGGGCGT AGCCTTGGCA ACTTTGTGCA ACTACGTCAA
501 CAACCTCGGA CAAACCGAAA TCAACCCCGA ATTGCAGGCT TACGCCTGA
```

This corresponds to the amino acid sequence <SEQ ID 1058; ORF 263.a>:

a263.pep

```
  1 MARLTVHTLE TAPEAAKARV EAVLQNNGFI PNLIGVLSNA PEALAFYQEV
 51 GKLNAANSLT AGEVEVIQII AARTNQCGFC VAGHTKLATL KKLLSEQSVK
101 AARALAAGEF DDAKLGALAA FTQAVMAKKG AVSDEELKAF FDAGYNQQQA
151 VEVVMGVALA TLCNYVNNLG QTEINPELQA YA*
```

m263/a263 97.4% identity in 77 aa overlap

```
                                                 10        20        30
m263.pep                                      AAGEFDDAKLGALAAFTQAVMAKKGAVSDE
                                              ||||||||||||||||||||||||||||||
a263      QCGFCVAGHTKLATLKKLLSEQSVKAARALAAGEFDDAKLGALAAFTQAVMAKKGAVSDE
             80        90       100       110       120       130
               40        50        60        70
m263.pep  ELKAFFDAGYNQQQAVEVVMGXXLATLCNYVNNLGQTEINPELQAYAX
          ||||||||||||||||||||  ||||||||||||||||||||||||
a263      ELKAFFDAGYNQQQAVEVVMGVALATLCNYVNNLGQTEINPELQAYAX
            140       150       160       170       180
```

The following partial DNA sequence was identified in *N. gonorrhoeae* <SEQ ID 1059>:

g264.seq

```
  1 ttgactttaa cccgaaaaac ccttttcctc ctcaccgccg cgttcggcac
 51 acactccctt cagacggcat ccgccgacgc agtggtcaag ccggaaaaac
101 tgcacgcctc cgccaaccgc agctacaaag tcgccgaatt cacgcaaacc
151 ggcaacgcct cgtggtacgg cggcaggttt cacgggcgca aaacttccgg
201 cggagaccgc tacgatatga acgcctttac cgccgcccac aaaaccctgc
251 ccatccccag ccatgtgcgc gtaaccaaca ccaaaaacgg caaaagcgtc
301 atcgtccgcg tcaacgaccg cggccccttc cacggcaacc gcatcatcga
351 cgtatccaaa gccgccgcgc aaaaattggg ctttgtcagc caagggacgg
401 cacacgtcaa aatcgaacaa atcgtcccgg gccaatccgc accggttgcc
451 gaaaacaaag acatctttat cgacttgaaa tctttcggta cggaacacga
501 agcacaagcc tatctgaacc aagccgccca aaatttcgcc gcttcgtcat
551 caagcccgaa cctctcggtt gaaaaacgcc gttacgaata cgttgtcaaa
601 atgggcccgt ttgcctcgca ggaacgcgcc gccgaagccg aagcgcaggc
651 acgcggtatg gttcgggcgg tactgacctc cggttga
```

This corresponds to the amino acid sequence <SEQ ID 1060; ORF 264.ng>:

g264.pep

```
  1 LTLTRKTLFL LTAAFGTHSL QTASADAVVK PEKLHASANR SYKVAEFTQT
 51 GNASWYGGRF HGRKTSGGDR YDMNAFTAAH KTLPIPSHVR VTNTKNGKSV
101 IVRVNDRGPF HGNRIIDVSK AAAQKLGFVS QGTAHVKIEQ IVPGQSAPVA
```

-continued

```
151 ENKDIFIDLK SFGTEHEAQA YLNQAAQNFA ASSSSPNLSV EKRRYEYVVK

201 MGPFASQERA AEAEAQARGM VRAVLTSG*
```

The following partial DNA sequence was identified in *N. meningitidis* <SEQ ID 1061>:

m264.seq

```
  1 TTGACTTTAA CCCGAAAAAC CCTTTTCCTT CTCACCGCCG CATTCGGCAC

 51 ACACTCCCTT CAGACGGCAT CCGCCGACGC AGTGGTCAAG GCAGAAAAAC

101 TGCACGCCTC CGCCAACCGC AGCTACAAAG TCGCCGGAAA ACGCTACACG

151 CCGAAAAACC AAGTCGCCGA ATTCACGCAA ACCGGCAACG CCTCGTGGTA

201 CGGCGGCAGG TTTCACGGGC GCAAAACTTC CGGCGGAGAA CGATACGATA

251 TGAACGCCTT TACCGCCGCC CACAAAACCC TGCCCATCCC CAGCTATGTG

301 CGCGTAACCA ATACCAAAAA CGGCAAAAGC GTCATCGTCC GCGTCAACGA

351 CCGCGGCCCC TTCCACGGCA ACCGCATCAT CGACGTATCC AAAGCCGCCG

401 CGCAAAAATT GGGCTTTGTC AACCAAGGGA CGGCACACGT CAAAATCGAA

451 CAAATCGTCC CGGGCCAATC CGCACCGGTT GCCGAAAACA AAGACATCTT

501 TATCGACTTG AAATCTTTCG GTACGGAACA CGAAGCACAA GCCTATCTGA

551 ACCAAGCCGC CCAAAACTTC GCCGTTTCGT CATCGGGTAC GAACCTCTCG

601 GTTGAAAAAC GCCGTTACGA ATACGTCGTC AAAATGGGAC CGTTTACCTC

651 GCAGGAACGC GCCGCCGAAG CCGAAGCTCA GGCGCGCGGT ATGGTTCGGG

701 CGGTATTGAC CGCCGGCTGA
```

This corresponds to the amino acid sequence <SEQ ID 1062: ORF 264>:

m264.pep

```
  1 LTLTRKTLFL LTAAFGTHSL QTASADAVVK AEKLHASANR SYKVAGKRYT

 51 PKNQVAEFTQ TGNASWYGGR FHGRKTSGGE RYDMNAFTAA HKTLPIPSYV

101 RVTNTKNGKS VIVRVNDRGP FHGNRIIDVS KAAAQKLGFV NQGTAHVKIE

151 QIVPGQSAPV AENKDIFIDL KSFGTEHEAQ AYLNQAAQNF AVSSSGTNLS

201 VEKRRYEYVV KMGPFTSQER AAEAEAQARG MVRAVLTAG*
```

Computer analysis of this amino acid sequence gave the following results:

Homology with a predicted ORF from *N. gonorrhoeae*

ORF 264 shows 91.6% identity over a 239 aa overlap with a predicted ORF (ORF 264.ng) from *N. gonorrhoeae*:

m264/g264

```
                   10        20        30        40        50        60
m264.pep   LTLTRKTLFLLTAAFGTHSLQTASADAVVKAEKLHASANRSYKVAGKRYTPKNQVAEFTQ
           |||||||||||||||||||||||||||||| ||||||||||||||           ||||
g264       LTLTRKTLFLLTAAFGTHSLQTASADAVVKPEKLHASANRSYKVA-----------EFTQ
                   10        20        30        40
```

-continued

```
                 70        80        90        100       110       120
m264.pep   TGNASWYGGRFHGRKTSGGERYDMNAFTAAHKTLPIPSYVRVTNTKNGKSVIVRVNDRGP
           ||||||||||||||||||||:||||||||||||||||||:|||||||||||||||||||||
g264       TGNASWYGGRFHGRKTSGGDRYDMNAFTAAHKTLPIPSHVRVTNTKNGKSVIVRVNDRGP
          50        60        70        80        90        100

                 130       140       150       160       170       180
m264.pep   FHGNRIIDVSKAAAQKLGFVNQGTAHVKIEQIVPGQSAPVAENKDIFIDLKSFGTEHEAQ
           ||||||||||||||||||||:||||||||||||||||||||||||||||||||||||||||
g264       FHGNRIIDVSKAAAQKLGFVSQGTAHVKIEQIVPGQSAPVAENKDIFIDLKSFGTEHEAQ
         110       120       130       140       150       160

                 190       200       210       220       230       240
m264.pep   AYLNQAAQNFAVSSSGTNLSVEKRRYEYVVKMGPFTSQERAAEAEAQARGMVRAVLTAGX
           |||||||||||:|||: ||||||||||||||||||:||||||||||||||||||||:||
g264       AYLNQAAQNFAASSSSPNLSVEKRRYEYVVKMGPFASQERAAEAEAQARGMVRAVLTSGX
         170       180       190       200       210       220
```

The following partial DNA sequence was identified in *N. meningitidis* <SEQ ID 1063>:

<u>a264.seq</u>

```
  1 TTGACTTTAA CCCGAAAAAC CCTTTTCCTC CTCACCGCCG CATTCGGCAT
 51 ACATTCCTTT CAGACGGCAT CCGCCGACGC AGTGGTCAGG GCAGAAAAAC
101 TGCACGCCTC CGCCAACCGC AGCTACAAAG TCGCCGGAAA ACGCTACACG
151 CCGAAAAACC AAGTCGCCGA ATTCACGCAA ACCGGCAACG CCTCGTGGTA
201 CGGCGGCAGG TTTCACGGGC GCAAAACTTC CGGCGGAGAA CGATACGATA
251 TGAACGCCTT TACCGCCGCC CACAAAACCC TGCCCATCCC CAGCTATGTG
301 CGCGTAACCA ATACCAAAAA CGGCAAAAGC GTCATCGTCC GCGTCAACGA
351 CCGCGGCCCC TTCCACGGCA ACCGCATCAT CGACGTATCC AAAGCCGCCG
401 CGCAAAAATT GGGCTTTGTC AACCAAGGGA CGGCGCACGT CAAAATCGAA
451 CAAATCGTCC CGGGCCAATC CGCACCGGTT GCCGAAAACA AAGACATCTT
501 CATCGACTTG AAATCTTTCG GTACGGAACA CGAAGCACAA GCCTATCTGA
551 ACCAAGCCGC CCAAAACCTG GCTTCATCGG CATCAAACCC GAACCTCTCG
601 GTTGAAAAAC GCCGTTACGA ATACGTCGTC AAAATGGGAC CGTTTGCCTC
651 GCAGGAACGC GCCGCCGAGG CCGAAGCTCA GGCGCGCGGT ATGGTTCGGG
701 CGGTATTAAC CGCCGGTTGA
```

This corresponds to the amino acid sequence <SEQ ID 1064; ORF 264.a>:

<u>a264.pep</u>

```
  1 LTLTRKTLFL LTAAFGIHSF QTASADAVVR AEKLHASANR SYKVAGKRYT
 51 PKNQVAEFTQ TGNASWYGGR FHGRKTSGGE RYDMNAFTAA HKTLPIPSYV
101 RVTNTKNGKS VIVRVNDRGP FHGNRIIDVS KAAAQKLGFV NQGTAHVKIE
151 QIVPGQSAPV AENKDIFIDL KSFGTEHEAQ AYLNQAAQNL ASSASNPNLS
201 VEKRRYEYVV KMGPFASQER AAEAEAQARG MVRAVLTAG*
```

m264/a264 96.2% identity in 239 aa overlap

```
                   10        20        30        40        50        60
m264.pep   LTLTRKTLFLLTAAFGTHSLQTASADAVVKAEKLHASANRSYKVAGKRYTPKNQVAEFTQ
           |||||||||||||||| ||:||||||||||:|||||||||||||||||||||||||||||
a264       LTLTRKTLFLLTAAFGIHSFQTASADAVVRAEKLHASANRSYKVAGKRYTPKNQVAEFTQ
                   10        20        30        40        50        60

                   70        80        90       100       110       120
m264.pep   TGNASWYGGRFHGRKTSGGERYDMNAFTAAHKTLPIPSYVRVTNTKNGKSVIVRVNDRGP
           ||||||||||||||||||||||||||||||||||||||||||||||||||||||||||||
a264       TGNASWYGGRFHGRKTSGGERYDMNAFTAAHKTLPIPSYVRVTNTKNGKSVIVRVNDRGP
                   70        80        90       100       110       120

                  130       140       150       160       170       180
m264.pep   FHGNRIIDVSKAAAQKLGFVNQGTAHVKIEQIVPGQSAPVAENKDIFIDLKSFGTEHEAQ
           ||||||||||||||||||||||||||||||||||||||||||||||||||||||||||||
a264       FHGNRIIDVSKAAAQKLGFVNQGTAHVKIEQIVPGQSAPVAENKDIFIDLKSFGTEHEAQ
                  130       140       150       160       170       180

                  190       200       210       220       230       240
m264.pep   AYLNQAAQNFAVSSSGTNLSVEKRRYEYVVKMGPFTSQERAAEAEAQARGMVRAVLTAGX
           |||||||||:| |:|: |||||||||||||||||:|||||||||||||||||||||||||
a264       AYLNQAAQNLASSASNPNLSVEKRRYEYVVKMGPFASQERAAEAEAQARGMVRAVLTAGX
                  190       200       210       220       230       240
```

The following partial DNA sequence was identified in *N. meningitidis* <SEQ ID 1065>:

m265.seq

```
  1 ATGTCGGTGA TTTTGCCGCC GACACGCGCC AACGCTGCTT TTTCGGCTTG
 51 GGCGCGGCTG ATGATTTTGT CTTGTTTGTT GTGTTGGTGT GCGGCGTGTC
101 CGTGGTCGTC ATCGCCGTGT CCGTCGTGGT GGGCGAGCGC GGGGGCGGAA
151 ATGCTCAGCA GTGCGGTTGC GGCGGAGGTC AAGAGAAGGT GTTTGATGTT
201 CATAT.TTTT GCCTTTGTAA ATCGTGGGTT GGAAAATGTG GATATTAATA
251 AGGTATCAAA TAACCGTCAG CCGGCGGTCA ATACCGCCCG AACCATACCG
301 CGCGCCTGAG CTTCGGCTTC GGCGGCGCGT TCCTGCGAGG TAAACGGTCC
351 CATTTTGACG ACGTATTCGT AA
```

This corresponds to the amino acid sequence <SEQ ID 1066; ORF 265>:

m265.pep

```
  1 MSVILPPTRA NAAFSAWARL MILSCLLCWC AACPWSSSPC PSWWASAGAE
 51 MLSSAVAAEV KRRCLMFIXF AFVNRGLENV DINKVSNNRQ PAVNTARTIP
101 RAXASASAAR SCEVNGPILT TYS*
```

Computer analysis of this amino acid sequence gave the following results:

Homology with a predicted ORF from *N. gonorrhoeae*

ORF 265 shows 88.6% identity over a 123 aa overlap with a predicted ORF (ORF 265.ng) from *N. gonorrhoeae*:

m265/g265

```
                   10        20        30        40        50        60
m265.pep   MSVILPPTRANAAFSAWARLMILSCLLCWCAACPWSSSPCPSWWASAGAEMLSSAVAAEV
           ||||||||||:||||||||||||||| |||||||||||||||||||||||| :||||| |
g265       MSVILPPTRAQAAFSAWARLMILSCLPCWCAACPWSSSPCPSWWASAGAEMPNSAVAAAV
                   10        20        30        40        50        60
```

-continued

```
                70         80         90        100        110        120
m265.pep   KRRCLMFIXFAFVNRGLENVDINKVSNNRQPAVNTARTIPRAXASASAARSCEVNGPILT
           |||||||| ||:||:||:| ||||||||||| |:|||||||| ||||||||||:||||||
g265       KRRCLMFI-FALVNQGLKNGDINKVSNNRQPEVSTARTIPRACASASAARSCEANGPILT
                 70         80         90        100        110

           TYSX
m265.pep   ||||
           TYSX
g265     120
```

The following partial DNA sequence was identified in *N. meningitidis* <SEQ ID 1067>:

```
a265.seq

  1 ATGTCGGTGA TTTTGCCGCC GACACGCGCC AACGCTGCTT TTTCGGCTTG

 51 GGCGCGGCTG ATGATTTTGT CTTGTTTGCT GTGTTGGTGT GCGGCGTGTC

101 CGTGGTCGTC ATCGCCGTGT CCGTCGTGGT GGGCGAGTGC GGGGGCGGAA

151 ATGCCCATCA GTGCGGTTGC GGCGGCGGTC AAGAGAAGGC GTTTGAAGTT

201 CATTTTTGCT CCTGCGAAGT ATCTGGT... .....GGTGT TTGAAGGACG

251 TAAAGGCGGG ACATCAACCG GCGGTTAATA CCGCCCGAAC CATACCGCGC

301 GCCTGAGCTT CGGCCTCGGC GGCGCGTTCC TGCGAGGCAA ACGGTCCCAT

351 TTTGACGACG TATTCGTAA
```

This corresponds to the amino acid sequence <SEQ ID 1068; ORF 265.a>:

```
a265.pep

  1 MSVILPPTRA NAAFSAWARL MILSCLLCWC AACPWSSSPC PSWWASAGAE

 51 MPISAVAAAV KRRRLKFIFA PAKYLX..XC LKDVKAGHQP AVNTARTIPR

101 A*ASASAARS CEANGPILTT YS*
```

m265/a265 79.7% identity in 123 aa overlap

```
                  10        20        30        40        50        60
m265.pep   MSVILPPTRANAAFSAWARLMILSCLLCWCAACPWSSSPCPSWWASAGAEMLSSAVAAEV
           |||||||||||||||||||||||||||||||||||||||||||||||||||  ||||| |
a265       MSVILPPTRANAAFSAWARLMILSCLLCWCAACPWSSSPCPSWWASAGAEMPISAVAAAV
                  10        20        30        40        50        60
                  70        80        90       100       110       120
m265.pep   KRRCLMFIXFAFVNRGLENVDINKVSNNRQPAVNTARTIPRAXASASAARSCEVNGPILT
           ||| | ||   |:        :: |: ::||||||||||||||||||||||||:||||||
a265       KRRRLKFI---FAPAKYLXXCLKDVKAGHQPAVNTARTIPRAXASASAARSCEANGPILT
                     70        80        90       100       110

m265.pep   TYSX
           ||||
a265       TYSX
           120
```

The following partial DNA sequence was identified in *N. gonorrhoeae* <SEQ ID 1069>:

g266.seq

```
  1 agttcagacg gcatcgccgc cgacaatgcc caaacagaaa gcccatcatg
 51 accgcatcca tgtacatcct tttggtcttg gcactcatct ttgccaacgc
101 ccccttcctc acgaccagac tgttcggcgt ggccgcgctc aagcgcaaac
151 atttcggaca ccacctgatc gagctggcgg caggtttcgc gctgaccgcc
201 tctcttgcct acatcctcga atcccgtgcg ggagcggtac acaatcaggg
251 ttgggagttt tacgccaccg tcgtctgcct gtacctcatt ttcgccttcc
301 cgtgtttcgt gcggcggtat ttttggcaca cgcgcaacag ggaataa
```

This corresponds to the amino acid sequence <SEQ ID 1070; ORF 266.ng>:

g266.pep

```
  1 MQFRRHRRRQ CPNRKPIMTA SMYILLVLAL IFANAPFLTT RLFGVAALKR
 51 KHFGHHLIEL AAGFALTASL AYILESRAGA VHNQGWEFYA TVVCLYLIFA
101 FPCFVRRYFW HTRNRE*
```

The following partial DNA sequence was identified in *N. meningitidis* <SEQ ID 1071>:

m266.seq

```
  1 ATGCCGTTCC GCAACGCGtT cAGACGGCAT CGCCGCCGAC AACGCCTAAA
 51 CAGAAAGCCC ACCATGACCG CATCCATGTA CATCCTTTTG GTCTTGGCAC
101 TCATCTTTGC CAACGCCCCC TTCCTCACGA CCAGACTGTT CGGCGTGGCC
151 rCACTCAAGC GCAAACATTT CGGACACCAC ATGATCGAGC TGGCGGCAGG
201 TTTCGCGCTG ACCGCCGTTC TTGCCTACAT CCTsGAATCC CGTGCAGGAT
251 CGGTACACGA TCAGGGTTGG GAGTTTTATG CCACAGTCGT CTGCCTGTAC
301 CTGATTTTTG CGTTTCCATG TTTTGTGTGG CGGTATTTTT GGCACACGCG
351 CAACAGGGAA TAG
```

This corresponds to the amino acid sequence <SEQ ID 1072; ORF 266>:

m266.pep

```
  1 MPFRNAFRRH RRRQRLNRKP TMTASMYILL VLALIFANAP FLTTRLFGVA
 51 XLKRKHFGHH MIELAAGFAL TAVLAYILES RAGSVHDQGW EFYATVVCLY
101 LIFAFPCFVW RYFWHTRNRE *
```

Computer analysis of this amino acid sequence gave the following results:

Homology with a predicted ORF from *N. gonorrhoeae*

ORF 266 shows 92.1% identity over a 114 aa overlap with a predicted ORF (ORF 266.ng) from *N. gonorrhoeae*:

m266/g266

```
                10         20         30         40         50         60
m266.pep  MPFRNAFRRHRRRQRLNRKPTMTASMYILLVLALIFANAPFLTTRLFGVAXLKRKHFGHH
                ||||||||  |||| |||||||||||||||||||||||||||| |||||||||
g266          MQFRRHRRRQCPNRKPIMTASMYILLVLALIFANAPFLTTRLFGVAALKRKHFGHH
                    10         20         30         40         50

                70         80         90        100        110        120
m266.pep  MIELAAGFALTAVLAYILESRAGSVHDQGWEFYATVVCLYLIFAFPCFVWRYFWHTRNREX
          :|||||||||| |||||||||:||:||||||||||||||||||||| ||||||||||
g266      LIELAAGFALTASLAYILESRAGAVHNQGWEFYATVVCLYLIFAFPCFVRRYFWHTRNREX
            60         70         80         90        100        110
```

The following partial DNA sequence was identified in *N. meningitidis* <SEQ ID 1073>:

a266.seq

```
  1 ATGCCGTTCC GCAATGCGTT CAGACGGCAT CGCCGCCGAC AATGCGCAAA
 51 CAGAAAGCCC GCCATGACCG CATCCATGTA CATCCTTTTG CTGCTTGCCT
101 TGATTTTTGC CAACGCCCCC TTCCTCACGA CCAAGCTGTT CGGCATCGTA
151 CCGCTCAAGC GCAAACATTT CGGACACCAC CTGATCGAGC TGGCGGCAGG
201 TTTCGCGCTG ACCGCCGTTC TTGCCTACAT CCTCGAATCC CGTGCGGGAG
251 CGGTACACGA TCAGGGTTGG GAGTTTTACG CCACCGTCGT CTGCCTGTAC
301 CTGATTTTTG CGTTTCCCTG TTTCGTGTGG CGGTATTTTT GGCACACGCG
351 CAACAGGGAA TAG
```

This corresponds to the amino acid sequence <SEQ ID 1074; ORF 266.a>:

a266.pep

```
  1 MPFRNAFRRH RRRQCPNRKP AMTASMYILL LLALIFANAP FLTTKLFGIV
 51 PLKRKHFGHH LIELAAGFAL TAVLAYILES RAGAVHDQGW EFYATVVCLY
101 LIFAFPCFVW RYFWHTRNRE *
```

m266/a266 91.7% identity in 120 aa overlap

```
                10         20         30         40         50         60
m266.pep  MPFRNAFRRHRRRQRLNRKPTMTASMYILLVLALIFANAPFLTTRLFGVAXLKRKHFGHH
          ||||||||||||||  ||||:||||||||:||||||||||||:|||::  ||||||||
a266      MPFRNAFRRHRRRQCPNRKPAMTASMYILLLLALIFANAPFLTTKLFGIVPLKRKHFGHH
                10         20         30         40         50         60

                70         80         90        100        110        120
m266.pep  MIELAAGFALTAVLAYILESRAGSVHDQGWEFYATVVCLYLIFAFPCFVWRYFWHTRNRE
          :||||||||||||||||||||||:|||||||||||||||||||||||||||||||||||
a266      LIELAAGFALTAVLAYILESRAGAVHDQGWEFYATVVCLYLIFAFPCFVWRYFWHTRNRE
                70         80         90        100        110        120

m266.pep  X
          |
a266      X
```

The following partial DNA sequence was identified in *N. gonorrhoeae* <SEQ ID 1075>:

g267.seq

```
  1 atgcaagtcg cctttttttct cgccgtggta ttcaaaaata tgggtttcca
 51 caatcgcatc ggtcgggcag gcctcttcgc agaaaccgca gaagatgcac
101 ttggtcaggt cgatgtcgta acgcttggtg cggcgggtgc cgtcttcgcg
151 ttcttccgat tcgatgttga tcgccattgc cggacacacc gcctcgcaca
201 atttacacgc gatgcagcgt tcctctccgt tcggaaaacg gcgttgcgcg
251 tgcagaccgc ggaaacgcac ggattgcggc gttttctctt cgggaaaata
301 aattgtgtct ttgcgggcaa aaaagttttt gagcgttacg cccatgcctt
351 tgaccagttc gccaagcaga aaggttttta ctaa
```

This corresponds to the amino acid sequence <SEQ ID 1076; ORF 267.ng>:

g267.pep

```
  1 MQVAFFLAVV FKNMGFHNRI GRAGLFAETA EDALGQVDVV TLGAAGAVFA
 51 FFRFDVDRHC RTHRLAQFTR DAAFLSVRKT ALRVQTAETH GLRRFLFGKI
101 NCVFAGKKVF ERYAHAFDQF AKQKGFY*
```

The following partial DNA sequence was identified in *N. meningitidis* <SEQ ID 1077>:

m267.seq

```
  1 GTGCAAGTCG CCTTTTTTCT CGCCGTGGTA TTCAAAAATA TGGGTTTCCA
 51 CAATCGCATC AGTCGGGCAT GCCTCTTCGC AGAAACCGCA GAAGATGCAC
101 TTGGTCAGGT CGATGTCGTA ACGCTTGGTG CGGCGCGTAC CGTCTTCACG
151 TTCTTCCGAT TCGATGTTAA TCGCCATTGC CGGACACACT GCCTCACACA
201 ACTTACACGC GATACACCGC TCTTCGCCGT TCGGATACCG CcGCTGCGCG
251 TGCAGACCGC GGAAACGCAC GGATTGCGGC GTTTTCTCTT CGGGGAAATA
301 AATTGTGTCT TTGCGOGCGA AAAAGTTTTT GAGCGTTACG CCCATACCTT
351 TTACCAATTC GCCAAGCAGA AAGGTTTTTA CTAA
```

This corresponds to the amino acid sequence <SEQ ID 1078; ORF 267>:

m267.pep

```
  1 VQVAFFLAVV FKNMGFHNRI SRACLFAETA EDALGQVDVV TLGAARTVFT
 51 FFRFDVNRHC RTHCLTQLTR DTPLFAVRIP PLRVQTAETH GLRRFLFGEI
101 NCVFAGEKVF ERYAHTFYQF AKQKGFY*
```

Computer analysis of this amino acid sequence gave the following results:

Homology with a predicted ORF from *N. gonorrhoeae*

ORF 267 shows 82.7% identity over a 127 aa overlap with a predicted ORF (ORF 267.ng) from *N. gonorrhoeae*:

m267/g267

```
                    10        20        30        40        50        60
m267.pep   VQVAFFLAVVFKNMGFHNRISRACLFAETAEDALGQVDVVTLGAARTVFTFFRFDVNRHC
           :|||||||||||||||||||:|| ||||||||||||||||||||| :||:||||||:|||
g267       MQVAFFLAVVFKNMGFHNRIGRAGLFAETAEDALGQVDVVTLGAAGAVFAFFRFDVDRHC
                    10        20        30        40        50        60
                    70        80        90       100       110       120
m267.pep   RTHCLTQLTRDTPLFAVRIPPLRVQTAETHGLRRFLFGEINCVFAGEKVFERYAHTFYQF
           ||| |:|:|||: :::||   |||||||||||||||||:|||||||:||||||||:| ||
g267       RTHRLAQFTRDAAFLSVRKTALRVQTAETHGLRRFLFGKINCVFAGKKVFERYAHAFDQF
                    70        80        90       100       110       120

m267.pep   AKQKGFYX
           ||||||||
g267       AKQKGFYX
```

The following partial DNA sequence was identified in *N. meningitidis* <SEQ ID 1079>:

a267.seq

```
  1 GTGCAAGTCG CCTTTTTTCT CGCCGTGGTA TTCAAAAATA TGGGTTTCCA
 51 CAATCGCATC GGTCGGGCAG GCTTCTTCGC AGAAACCGCA GAAGATGCAC
101 TTGGTCAGGT CGATCTCGTA ACGCTTGGTG CGGCGCGTGC CGTCTTCGCG
151 TTCTTCCGAT TCGATGTTGA TCGCCATTGC GGGGCAAACG GCTTCACACA
201 ATTTACACGC GATGCAGCGT TCCTCGCCGT TTGGATAACG GCGTTGCGCG
251 TGCAGACCGC GGAAACGCAC GGATTGCGGC GTTTTCTCTT CGGGAAAATA
301 AATCGTGTCT TTGCGGGCAA AAAAGTTTTT GAGCGTTACG CCCATACCTT
351 TTACCAATTC GCCAAGCAGA AAGGTTTTTA CTAA
```

This corresponds to the amino acid sequence <SEQ ID 1080; ORF 267.a>:

a267.pep

```
  1 VQVAFFLAVV FKNMGFHNRI GRAGFFAETA EDALGQVDVV TLGAARAVFA
 51 FFRFDVDRHC GANGFTQFTR DAAFLAVWIT ALRVQTAETH GLRRFLFGKI
101 NRVFACKKVF ERYAHTFYQF AKQKGFY*
```

m267/a267 82.7% identity in 127 aa overlap

```
                    10        20        30        40        50        60
m267.pep   VQVAFFLAVVFKNMGFHNRISRACLFAETAEDALGQVDVVTLGAARTVFTFFRFDVNRHC
           ||||||||||||||||||||:|| :|||||||||||||||||||||:||:||||||:|||
a267       VQVAFFLAVVFKNMGFHNRIGRAGFFAETAEDALGQVDVVTLGAARAVFAFFRFDVDRHC
                    10        20        30        40        50        60
                    70        80        90       100       110       120
m267.pep   RTHCLTQLTRDTPLFAVRIPPLRVQTAETHGLRRFLFGEINCVFAGEKVFERYAHTFYQF
            :: :||:|||: ::|| |  |||||||||||||||||:|| ||||:|||||||||||||
a267       GANGFTQFTRDAAFLAVWITALRVQTAETHGLRRFLFGKINRVFAGKKVFERYAHTFYQF
                    70        80        90       100       110       120

m267.pep   AKQKGFYX
           ||||||||
a267       AKQKGFYX
```

The following partial DNA sequence was identified in *N. gonorrhoeae* <SEQ ID 1081>:

G268.seq

```
   1 atgaaaaaaa atttacccgc actggcattg gcaagtatgc tgattttgtc
  51 gggctgcgac cgtttgggaa taggcaaccc gttttccgga aaggaaattt
 101 cctgcggaag cgaagagact aaagagattt tggtcaaact ggtccgcgac
 151 aatgtcgaag gtgaaaccgt caaaactttt gacgacgacg cattcaaaga
 201 ccaagcattt gccgatatcg gcatatcgca tatccgcaga atggtcgaac
 251 gtttgggcat aaccgtcgat gaagtccgaa ctaccgagaa aaccgacacg
 301 tccagcaaac tcaaatgtga agccgcgtta aaactggacg tgcccgacga
 351 tgttgtcgat tatgccgtcg ccgccaacca atctataggc aacagccata
 401 agaaaacgcc cgactttttt gaaccctact accgcaaaga aggcgcgtat
 451 tatgtcaaaa ctatttctta cagcgtccag ccgacagacg acaaaagcaa
 501 aatctttgcc gaactcagtc aggcacacga tatcatccat ccgctcagcg
 551 agctggtgtc tatggcactg attaaagagc cgttggacaa agcgaaacaa
 601 aggaacgaaa aacttgaagc ggcagaagcc accgcgcagg aagcgaggga
 651 ggcagaagaa gcggcggcgc aggaggcatt gggtcgggag caggaagccg
 701 cccgcgtatc cgaatgggaa gaacgctaca agctgtcgcg cagcgagttc
 751 gagcagtttt ggaaaggatt gcctcaaact gtacagaata agctgcaagc
 801 ctcgcagaaa acatggaaaa gcggtatgga caagatctgt gccaacaatg
 851 cgaaagccga aggtgaaacg ccaaacggca taaaagtcag tgagttggcg
 901 tgtaaaacgg cagaaaccga agcacgcttg gaagagctgc acaaccgtaa
 951 aaaagccctt atcgacgaaa tggtcaggga agaggacaag aaagaactgc
1001 caaagcggct ctga
```

This corresponds to the amino acid sequence <SEQ ID 1082. ORF 268.ng>:

m268.pep

```
  1 MKKNLPALAL ASMLILSGCD RLGIGNPFSG KEISCGSEET KEILVKLVRD
 51 NVEGETVKTF DDDAFKDQAF ADIGISHIRR MVERLGITVD EVRTTEKTDT
101 SSKLKCEAAL KLDVPDDVVD YAVAANQSIG NSHKKTPDFF EPYYRKEGAY
151 YVKTISYSVQ PTDDKSKIFA ELSQAHDIIH PLSELVSMAL IKEPLDKAKQ
201 RNEKLEAAEA TAQEAREAEE AAAQEALGRE QEAARVSEWE ERYKLSRSEF
251 EQFWKGLPQT VQNKLQASQK TWKSGMDKIC ANNAKAEGET PNGIKVSELA
301 CKTAETEARL EELHNRKKAL IDEMVREEDK KELPKRL*
```

The following partial DNA sequence was identified in *N. meningitidis* <SEQ ID 1083>:

m268.seq (partial)

```
  1 ..ATGGCACTGA TTAAAGAGCC GTTGGACAAA GTGAAACAAA GGAACGAAGA
 51   ACTTGAAGCG GCAGAAGAAG CGGCGGCGCA GGAGGCATTG GGTCGGGAGC
101   AGGAAGCCGC CCGCGTATCC GAATGGGAAG AACGCTACAA GCTGTCGCGC
```

-continued

```
151   AG.CAGTTCG AGCAGTTCTG GAAAGGATTG CCTCAAACCG TACAGAATAA

201   GCTGCAACCn TCACAGAAAA CATGGAAAAG CGGGATGGAT AAAATCTGTG

251   CCAACAATGC GAAAGCTGAA GGTAAAACGC CAAACGGCAT AAAATTCAGC

301   GAACTGGCAT GCAAAACGGC GAAAACCGAA GCACGCTTGG AAGAGCTGCA

351   CAACCGTAAA AAAGCCCTTA TCGACGAAAT GGyCAGGGAA GCGGACAmGA

401   AAGAACTGTC AAAGCGGCTs TGA
```

This corresponds to the amino acid sequence <SEQ ID 1084; ORF 268>:

m268.pep (partial)

```
  1 ..MALIKEPLDK VKQRNEELEA AEEAAAQEAL GREQEAARVS EWEERYKLSR

 51   XQFEQFWKGL PQTVQNKLQP SQKTWKSGMD KICANNAKAE GKTPNGIKFS

101   ELACKTAKTE ARLEELHNRK KALIDEMXRE ADXKELSKRL *
```

Computer analysis of this amino acid sequence gave the following results:

Homology with a predicted ORF from *N. gonorrhoeae*

ORF 268 shows 86.0% identity over a 150 aa overlap with a predicted ORF (ORF 268.ng) from *N. gonorrhoeae*:

m268/g268

```
                                                   10        20
m268.pep                                   MALIKEPLDKVKQRNEELEAAE--------
                                           ||||||||||:|||||:|||||
g268      SVQPTDDKSKIFAELSQAHDIIHPLSELVSMALIKEPLDKAKQRNEKLEAAEATAQEARE
          160       170       180       190       200       210
         SVQPTDDKSKIFAELSQAHDIIHPLSELVS
                  30        40        50        60        70        80
m268.pep  --EAAAQEALGREQEAARVSEWEERYKLSRSQFEQFWKGLPQTVQNKLQPSQKTWKSGMD
            ||||||||||||||||||||||||||||:||||||||||||||||| ||||||||||
g268      AEEAAAQEALGREQEAARVSEWEERYKLSRSEFEQFWKGLPQTVQNKLQASQKTWKSGMD
          220       230       240       250       260       270
                  90       100       110       120       130       140
m268.pep  KICANNAKAEGKTPNGIKFSELACKTAKTEARLEELHNRKKALIDEMXREADXKELSKRLX
          ||||||||||:|||||| ||||||||:||||||||||||||||| || | ||| ||||
g268      KICANNAKAEGETPNGIKVSELACKTAETEARLEELHNRKKALIDEMVREEDKKELPKRLX
          280       290       300       310       320       330
```

The following partial DNA sequence was identified in *N. meningitidis* <SEQ ID 1085>:

a268.seq

```
  1 ATGGCACTGA TTAAAGAGCC GTTGGACAAA GCGAAACAAA GGAACGAAGA

 51 ACTTGAAGCG GCAGAAGAAG CGGCGGCGCA GGAGGCATTG GGTCGGGAGC

101 AGGAAGTCGA CCGCGTATCC GAATGGGAAG AACGCTACAA GCTGTCGCGC

151 AGCGAGTTCG AGCAGTTCTG GAAAGGATTG CCTCAAACCG TACAGAATAA

201 GCTGCAAGCC TCACAGAAAA CATGGAAAAG CGGGATGGAT AAAATCTGTG

251 CCAACAATGC GAAAGCTGAA GGTGAAACGC CAAACGGCAT AAAATTCAGC

301 GAACTGGCAT GCAAAACGGC GGAAACCGAA GCACGCTTGG AAGAGCTGCA
```

-continued

```
351 CAACCGTAAA AAAGCCCTTC TCGACGAAAT GGCCAGGGAA GCGGACAAGA

401 AAGAACTGCC AAAGCGGCTC TGA
```

This corresponds to the amino acid sequence <SEQ ID 1086; ORF 268.a>:

a268.pep

```
  1 MALIKEPLDK AKQRNEELEA AEEAAAQEAL GREQEVDRVS EWEERYKLSR

 51 SEFEQFWKGL PQTVQNKLQA SQKTWKSGMD KICANNAKAE GETPNGIKFS

101 ELACKTAETE ARLEELHNRK KALLDEMARE ADKKELPKRL *
```

m268/a268 91.4% identity in 140 aa overlap

```
                    10        20        30        40        50        60
m268.pep   MALIKEPLDKVKQRNEELEAAEEAAAQEALGREQEAARVSEWEERYKLSRXQFEQFWKGL
           ||||||||||:|||||||||||||||||||||||: |||||||||||||| :||||||||
a268       MALIKEPLDKAKQRNEELEAAEEAAAQEALGREQEVDRVSEWEERYKLSRSEFEQFWKGL
                    10        20        30        40        50        60

                    70        80        90       100       110       120
m268.pep   PQTVQNKLQPSQKTWKSGMDKICANNAKAEGKTPNGIKFSELACKTAKTEARLEELHNRK
           ||||||||| |||||||||||||||||||||:|||||||||||||||:||||||||||||
a268       PQTVQNKLQASQKTWKSGMDKICANNAKAEGETPNGIKFSELACKTAETEARLEELHNRK
                    70        80        90       100       110       120

                   130       140
m268.pep   KALIDEMXREADXKELSKRLX
           |||:||| |||| ||| ||||
a268       KALLDEMAREADKKELPKRLX
                   130       140
```

The following partial DNA sequence was identified in *N. meningitidis* <SEQ ID 1087>:

m268-1.seq

```
  1 GTGCAATCCC GATATGATGG TTTGCATAAA TTTAAACATA TATGTTCCGC

 51 AGCTATGGCA CTGATTAAAG AGCCGTTGGA CAAAGTGAAA CAAAGGAACG

101 AAGAACTTGA AGCGGCAGAA GAAGCGGCGG CGCAGGAGGC ATTGGGTCGG

151 GAGCAGGAAG CCGCCCGCGT ATCCGAATGG GAAGAACGCT ACAAGCTGTC

201 GCGCAGCGAG TTCGAGCAGT TCTGGAAAGG ATTGCCTCAA ACCGTACAGA

251 ATAAGCTGCA AGCCTCACAG AAAACATGGA AAAGCGGGAT GGATAAAATC

301 TGTGCCAACA ATGCGAAAGC TGAAGGTAAA ACGCCAAACG GCATAAAATT

351 CAGCGAACTG GCATGCAAAA CGGCGAAAAC CGAAGCACGC TTGGAAGAGC

401 TGCACAACCG TAAAAAAGCC CTTATCGACG AAATGGCCAG GGAAGCGGAC

451 AAGAAAGAAC TGTCAAAGCG GCTCTGA
```

This corresponds to the amino acid sequence <SEQ ID 1088; ORF 268-1>:

m268-1.pep

```
  1 VQSRYDGLHK FKHICSAAMA LIKEPLDKVK QRNEELEAAE EAAAQEALGR

 51 EQEAARVSEW EERYKLSRSE FEQFWKGLPQ TVQNKLQASQ KTWKSGMDKI
```

-continued

```
101 CANNAKAEGK TPNGIKFSEL ACKTAKTEAR LEELHNRKKA LIDEMAREAD

151 KKELSKRL*
```

m268-1/g268 82.3% identity in 164 aa overlap

```
                                             10        20        30
m268-1.pep                           VQSRYDGLHKFKHICSAAMALIKEPLDKVKQRNE
                                     :| :| :::: |  |||||||||:|||||
g268        KEGAYYVKTISYSVQPTDDKSKIFAELSQAHDIIHPLSELVS--MALIKEPLDKAKQRNE
              150       160       170       180         190       200

                40                  50        60        70        80
m268-1.pep  ELEAAE----------EAAAQEALGREQEAARVSEWEERYKLSRSEFEQFWKGLPQTVQN
            :|||||          ||||||||||||||||||||||||||||||||||||||||||||
g268        KLEAAEATAQEAREAEEAAAQEALGREQEAARVSEWEERYKLSRSEFEQFWKGLPQTVQN
                210       220       230       240       250       260

                90       100       110       120       130       140
m268-1.pep  KLQASQKTWKSGMDKICANNAKAEGKTPNGIKFSELACKTAKTEARLEELHNRKKALLDE
            |||||||||||||||||||||||:|||||| |||||||:|||||||||||||||||
g268        KLQASQKTWKSGMDKICANNAKAEGETPNGIKVSELACKTAETEARLEELHNRKKALLDE
                270       280       290       300       310       320

               150      159
m268-1.pep  MAREADKKELSKRLX
            |:|| ||||| ||||
g268        MVREEDKKELPKRLX
                330
```

The following partial DNA sequence was identified in *N. meningitidis* <SEQ ID 1089>:

a268-1.seq

```
  1 GTGCAATCCC GATATGATGG TTTGCATAAA TTTAAACATA TATGTTCCGC

 51 AGCTATGGCA CTGATTAAAG AGCCGTTGGA CAAAGCGAAA CAAAGGAACG

101 AAGAACTTGA AGCGGCAGAA GAAGCGGCGG CGCAGGAGGC ATTGGGTCGG

151 GAGCAGGAAG TCGACCGCGT ATCCGAATGG GAAGAACGCT ACAAGCTGTC

201 GCGCAGCGAG TTCGAGCAGT TCTGGAAAGG ATTGCCTCAA ACCGTACAGA

251 ATAAGCTGCA AGCCTCACAG AAAACATGGA AAGCGGGAT GGATAAAATC

301 TGTGCCAACA ATGCGAAAGC TGAAGGTGAA ACGCCAAACG GCATAAAATT

351 CAGCGAACTG GCATGCAAAA CGGCGGAAAC CGAAGCACGC TTGGAAGAGC

401 TGCACAACCG TAAAAAAGCC CTTCTCGACG AAATGGCCAG GGAAGCGGAC

451 AAGAAAGAAC TGCCAAAGCG GCTCTGA
```

This corresponds to the amino acid sequence <SEQ ID 1090; ORF 268-1.a>:

a268-1.pep

```
  1 VQSRYDGLHK FKHICSAAMA LIKEPLDKAK QRNEELEAAE EAAAQEALGR

 51 EQEVDRVSEW EERYKLSRSE FEQFWKGLPQ TVQNKLQASQ KTWKSGMDKI

101 CANNAKAEGE TPNGIKFSEL ACKTAETEAR LEELHNRKKA LLDEMAREAD

151 KKELPKRL*
```

a268-1/m268-1 95.6% identity in 158 aa overlap

```
                10        20        30        40        50        60
a268-1.pep  VQSRYDGLHKFKHICSAAMALIKEPLDKAKQRNEELEAAEEAAAQEALGREQEVDRVSEW
            ||||||||||||||||||||||||||||:|||||||||||||||||||||||: |||||
m268-1      VQSRYDGLHKFKHICSAAMALIKEPLDKVKQRNEELEAAEEAAAQEALGREQEAARVSEW
                10        20        30        40        50        60

                70        80        90       100       110       120
a268-1.pep  EERYKLSRSEFEQFWKGLPQTVQNKLQASQKTWKSGMDKICANNAKAEGETPNGIKFSEL
            ||||||||||||||||||||||||||||||||||||||||||||||||:|||||||||||
m268-1      EERYKLSRSEFEQFWKGLPQTVQNKLQASQKTWKSGMDKICANNAKAEGKTPNGIKFSEL
                70        80        90       100       110       120

               130       140       150      159
a268-1.pep  ACKTAETEARLEELHNRKKALLDEMAREADKKELPKRLX
            |||||:||||||||||||||:||||||||||| ||||
m268-1      ACKTAKTEARLEELHNRKKALIDEMAREADKKELSKRLX
               130       140       150
```

The following partial DNA sequence was identified in *N. gonorrhoeae* <SEQ ID 1091>:

g269.seq

```
  1 atggtttggc gtgtgaattg cgcggcaacg gcggcgctga ttttttcgtc
 51 cagcccttgg atttgggcgg tggtgtgggt gtggtcgcgg tcggcttttt
101 cctgcaaacc ttgcgccagc cttgacgcgt ccagtgcgcc ggcgttggcg
151 gtttcgccgt gggactttat ccggaacacg gcttcgccca aggtgtcggc
201 ggctttgatg cacagtttta aaaccagggc tttggggcgg ttttctgcgc
251 cgcccgttgc cattttgctg tccaatcgcg gggttaaaaa accgttgtcg
301 tttaagtcgc cgtccgtcca agtcgatacg agcgcgcttc tttgcctttc
351 attgcggtct tcgtaa
```

This corresponds to the amino acid sequence <SEQ ID 1092; ORF 269.ng>:

g269.pep

```
  1 MVWRVNCAAT AALIFSSSPW IWAVVWVWSR SAFSCKPCAS LDASSAPALA
 51 VSPWDFIRNT ASPKVSAALM HSFKTRALGR FSAPPVAILL SNRGVKKPLS
101 FKSPSVQVDT SALLCLSLRS S*
```

The following partial DNA sequence was identified in *N. meningitidis* <SEQ ID 1093>:

m269.seq

```
  1 ATGGTTTGGC GTGTGAATTG CGCGGCAACG GCGGTGCTGA TTTTTTCGTC
 51 CAGCCCTTGG ATTTGGGCGG CGGTGTGGGT GTGGTCTCGG TCGGCTTTGT
101 CTTGCAAACC TTGCGCCaCG TGCCCGCGTC CAGCGCCTGC GTTGATGGTT
151 TCGCCGTGGG ACTTTATCCA AAACACGGCT TCGCCCAAGG TGTCGGCGGC
201 TTTGATGCAC AGTTTTAAAA CCAGGGCTTT GGGGCGGTTT TCGTCGCCGC
251 CTGTCGCCAT TTTGCTGTCC GAGCGCGGGG TTAAAAAGCC GTTGTCGTTT
301 AAATTTTCGT CCGTCCAAGT CGATACGAGC GCGCTTCTCT GCCTTTCGTT
351 GCGGTCTTCG TAA
```

This corresponds to the amino acid sequence <SEQ ID 1094; ORF 269>:

```
m269.pep

  1 MVWRVNCAAT AVLIFSSSPW IWAAVWVWSR SALSCKPCAT CPRPAPALMV

 51 SPWDFIQNTA SPKVSAALMH SFKTRALGRF SSPPVAILLS ERGVKKPLSF

101 KFSSVQVDTS ALLCLSLRSS *
```

Computer analysis of this amino acid sequence gave the following results:

Homology with a predicted ORF from *N. gonorrhoeae*

ORF 269 shows 87.6% identity over a 121 aa overlap with a predicted ORF (ORF 269.ng) from *N. gonorrhoeae*:

```
m269.pep   MVWRVNCAATAVLIFSSSPWIWAAVWVWSRSALSCKPCATCP-RPAPALMVSPWDFIQNT   59
           ||||||||||:||||||||||:||||||||:||||||:     |||| |||||||:||
g269       MVWRVNCAATAALIFSSSPWIWAVVWVWSRSAFSCKPCASLDASSAPALAVSPWDFIRNT   60

m269.pep   ASPKVSAALMHSFKTRALGRFSSPPVAILLSERGVKKPLSFKFSSVQVDTSALLCLSLRS  119
           ||||||||||||||||||||||:||||||||:||||||||||  ||||||||||||||||
g269       ASPKVSAALMHSFKTRALGRFSAPPVAILLSNRGVKKPLSFKSPSVQVDTSALLCLSLRS  120

m269.pep   SX  121
           ||
g269       SX  122
```

The following partial DNA sequence was identified in *N. meningitidis* <SEQ ID 1095>:

```
a269.seq

  1 ATGGTTTGGC GTGTGAATTG CGCGGCAACG GCGGTGCTGA TTTTTTCGTC

 51 CAGCCCTTGG ATTTGGGCGG CGGTGTGGGT GTGGGCGCGG TCTGCTTTGT

101 CTTGGAGGTT TTGCGCCAGC GTGCCCGCGT CCAGCGCGCC GGCGTTGACG

151 GTTTCGCCGT GGGACTTTAT CCAGAACACG GCTTCGCCCA AGGTGTCGGC

201 GGCTTTGATG CACAGTTTTA AAACCAGGGC TTTGGGGCGG TTTTCGTCGC

251 CGCCTGTCGC CATTTTGCTG TCCGGGCGCG GGGTTAAAAA GCCGTTGTCG

301 TTTAAATTTT CGTCCGTCCA AGTCGATACG AGCGCGCTTC TCTGCCTTTC

351 GTTGTGGTCT TCGTAA
```

This corresponds to the amino acid sequence <SEQ ID 1096; ORF 269.a>:

```
a269.pep

  1 MVWRVNCAAT AVLIFSSSPW IWAAVWVWAR SALSWRFCAS VPASSAPALT

 51 VSPWDFIQNT ASPKVSAALM HSFKTRALGR FSSPPVAILL SGRGVKKPLS

101 FKFSSVQVDT SALLCLSLWS S*
```

m269/a269 90.1% identity in 121 aa overlap

```
                   10        20        30        40         50        59
m269.pep    MVWRVNCAATAVLIFSSSPWIWAAVWVWSRSALSCKPCATCP-RPAPALMVSPWDFIQNT
            ||||||||||||||||||||||||||||:||||| : ||: |   |||| ||||||||||
a269        MVWRVNCAATAVLIFSSSPWIWAAVWVWARSALSWRFCASVPASSAPALTVSPWDFIQNT
                   10        20        30        40        50        60

           60        70        80        90       100       110       119
m269.pep    ASPKVSAALMHSFKTRALGRFSSPPVAILLSERGVKKPLSFKFSSVQVDTSALLCLSLRS
            ||||||||||||||||||||||||||||||| |||||||||||||||||||||||||| |
a269        ASPKVSAALMHSFKTRALGRFSSPPVAILLSGRGVKKPLSFKFSSVQVDTSALLCLSLWS
                   70        80        90       100       110       120

          120
m269.pep    SX
            ||
a269        SX
```

The following partial DNA sequence was identified in *N. gonorrhoeae* <SEQ ID 1097>:

<u>g270.seq</u>

```
  1 atgaataaaa accgcaaatt actgcttgcc gcactgctgc tgactgcctt
 51 tgccgccttc aagctcgttt tgttgcaatg gtggcaggcg cagcagccgc
101 aagccgtggc ggcgcaatgc gatttgaccg agggttgcac gctgccggac
151 ggaagccgtg tccgcgccgc cgccgtttca accaaaaaac cgtttgatat
201 ttatatcgaa cacgcgcccg ccggcacgga acaggtcagc atcagcttca
251 gtatgaaaaa tatggatatg ggtttcaacc gctatatgtt cgagcggcaa
301 ccgtcgggga cttggcaggc agcacgcatc cgcctgcccg tctgtgtcga
351 aggcaggcgc gattttacgg cggacattac aatcggcagc cggacatttc
401 agacggcatt taccgccgaa taa
```

This corresponds to the amino acid sequence <SEQ ID 1098; ORF 270.ng>:

<u>g270.pep</u>

```
  1 MNKNRKLLLA ALLLTAFAAF KLVLLQWWQA QQPQAVAAQC DLTEGCTLPD
 51 GSRVRAAAVS TKKPFDIYIE HAPAGTEQVS ISFSMKNMDM GFNRYMFERQ
101 PSGTWQAARI RLPVCVEGRR DFTADITIGS RTFQTAFTAE*
```

The following partial DNA sequence was identified in *N. meningitidis* <SEQ ID 1099>:

<u>m270.seq</u>

```
  1 ATGAATAAAA ACCGTAAATT ACTGCTTGCC GCACTGCTGC TGATTGCCTT
 51 TGCCGCCGTC AAGCTCGTTT TGTTGCAATG GTGGCAGGCG Ca.CAGCCGC
101 AAGCTGTGGC GGCGCAATGC GATTTGACCG AGGGTTGCAC GCTGCCGGAC
151 GGAAGCCGCG TCCGCGCCGC CGCcGTTTCA ACCAAAAAAC CGTTTGATAT
201 TTATATCGAA CACGCGCCCG CCGGCACGGA ACAGGTCAGC ATCAGCTTCA
251 GTATGAAAAA TATGGATATG GGTTTCaACC GCTATATGTT CGAGCGGCAA
301 cCGTCGGGGA CTTGGCAGGC AGTACGCATC CGCCTGCCCA TCTGTGTCGA
351 AGGCAGGCGC GATTTTACGG CGGACATTAC AATCGGCAGT CGGACATTTC
401 AGACGGCATT TACCGCCGAA TAA
```

This corresponds to the amino acid sequence <SEQ ID 1100; ORF 270>:

m270.pep

```
  1 MNKNRKLLLA ALLLIAFAAV KLVLLQWWQA XQPQAVAAQC DLTEGCTLPD
 51 GSRVRAAAVS TKKPFDIYIE HAPAGTEQVS ISFSMKNMDM GFNRYMFERQ
101 PSGTWQAVRI RLPICVEGRR DFTADITIGS RTFQTAFTAE *
```

Computer analysis of this amino acid sequence gave the following results:

Homology with a predicted ORF from *N. gonorrhoeae*

ORF 270 shows 96.4% identity over a 140 aa overlap with a predicted ORF (ORF 270.ng) from *N. gonorrhoeae*:

m270/g270

```
                    10        20        30        40        50        60
m270.pep    MNKNRKLLLAALLLIAFAAVKLVLLQWWQAXQPQAVAAQCDLTEGCTLPDGSRVRAAAVS
            ||||||||||||| |||| |||||||||| |||||||||||||||||||||||||||||
g270        MNKNRKLLLAALLLTAFAAFKLVLLQWWQAQQPQAVAAQCDLTEGCTLPDGSRVRAAAVS
                    10        20        30        40        50        60

                    70        80        90       100       110       120
m270.pep    TKKPFDIYIEHAPAGTEQVSISFSMKNMDMGFNRYMFERQPSGTWQAVRIRLPICVEGRR
            ||||||||||||||||||||||||||||||||||||||||||||||||:|||||:||||||
g270        TKKPFDIYIEHAPAGTEQVSISFSMKNMDMGFNRYMFERQPSGTWQAARIRLPVCVEGRR
                    70        80        90       100       110       120

                   130       140
m270.pep    DFTADITIGSRTFQTAFTAEX
            |||||||||||||||||||||
g270        DFTADITIGSRTFQTAFTAEX
                   130       140
```

The following partial DNA sequence was identified in *N. meningitidis* <SEQ ID 1101>:

a270.seq

```
  1 ATGAATAAAA ACCGTAAATT ACTGCTTGCC GCACTGCTGC TGATTGCCTT
 51 TGCCGCCGTC AAGCTCGTTT TGTTGCAATG GTGGCAGGCG CAGCAGCCGC
101 AAGCTGTGGC GGCGCAATGC GATTTGACCG AGGGTTGCAC GCTGCCGGAC
151 GCAAGCCGCG TCCGCGCCGC CGCCGTTTCA ACCAAAAAAC CGTTTGATAT
201 TTATATCGAA CACGCGCCCG CCGGCACGGA ACAGGTCAGC ATCAGCTTCA
251 GTATGAAAAA TATGGATATG GGTTTCAACC GCTATATGTT CGAGCGGCAA
301 CCGTCGGGGA CTTGGCAGGC AGTACGCATC CGCCTGCCCA TCTGTGTCGA
351 AGGCAGGCGC GATTTTACGG CGGACATTAC AATCGGCAGC CGGACATTTC
401 AGACGGCATT TACCGCCGAA TAA
```

This corresponds to the amino acid sequence <SEQ ID 1102; ORF 270.a>:

a270.pep

```
  1 MNKNRKLLLA ALLLIAFAAV KLVLLQWWQA QQPQAVAAQC DLTEGCTLPD
 51 GSRVRAAAVS TKKPFDIYIE HAPAGTEQVS ISFSMKNMDM GFNRYMFERQ
101 PSGTWQAVRI RLPICVEGRR DFTADITIGS RTFQTAFTAE *
```

m270/a270 99.3% identity in 140 aa overlap

```
                10         20         30         40         50         60
m270.pep  MNKNRKLLLAALLLIAFAAVKLVLLQWWQAXQPQAVAAQCDLTEGCTLPDGSRVRAAAVS
          |||||||||||||||||||||||||||||| |||||||||||||||||||||||||||||
a270      MNKNRKLLLAALLLIAFAAVKLVLLQWWQAQQPQAVAAQCDLTEGCTLPDGSRVRAAAVS
                10         20         30         40         50         60
                70         80         90        100        110        120
m270.pep  TKKPFDIYIEHAPAGTEQVSISFSMKNMDMGFNRYMFERQPSGTWQAVRIRLPICVEGRR
          ||||||||||||||||||||||||||||||||||||||||||||||||||||||||||||
a270      TKKPFDIYIEHAPAGTEQVSISFSMKNMDMGFNRYMFERQPSGTWQAVRIRLPICVEGRR
                70         80         90        100        110        120
               130        140
m270.pep  DFTADITIGSRTFQTAFTAEX
          ||||||||||||||||||||
a270      DFTADITIGSRTFQTAFTAEX
               130        140
```

The following partial DNA sequence was identified in *N. gonorrhoeae* <SEQ ID 1103>:

g271.seq

```
  1 atgttcagtt cgcggatggc gaggatttgg gcgacggggg taacgttgtg
 51 tatggtcagt ccgtgtccgg cgttgacgac caagcccaaa tcgccggcga
101 aatgcgcgcc gttttggatg cgctcgaact gcctgatttg ttcggcgtgg
151 ctttgtgcgt cggcatatgc gccggtgtgc agctcgacaa cgggcgcgcc
201 gacatcacgg gcggcttgga tttgcctgtc gtcggcatcg ataaacaagg
251 acacgcgtat gcccgcgtcg gtcaggattt tggcgaattc ggcgattttt
301 tcctgttgcg ccaatacgtc caaaccgcct tcggtcgtga tttcctgccg
351 tttttcaggc acgatgcaca cgtcttccgg catcacttta agcgcgtttt
401 cgagcatttc ttccgtcaac gccatttcaa ggttcaggcg cgtgcggatg
451 gcgtttttga cggcaaatac atccgcgtct ttgatgtggc ggcggtcttc
501 gcgcaggtgc atggtaatca ggtctgcacc gtgcgtttcg gcaaccagtg
551 ccgcctccac ggggctggga taa
```

This corresponds to the amino acid sequence <SEQ ID 1104; ORF 271.ng>:

g271.pep

```
  1 MFSSRMARIW ATGVTLCMVS PCPALTTKPK SPAKCAPFWM RSNCLICSAW
 51 LCASAYAPVC SSTTGAPTSR AAWICLSSAS INKDTRMPAS VRILANSAIF
101 SCCANTSKPP SVVISCRFSG TMHTSSGITL SAFSSISSVN AISRFRRVRM
151 AFLTANTSAS LMWRRSSRRC MVIRSAPCVS ATSAASTGLG*
```

The following partial DNA sequence was identified in *N. meningitidis* <SEQ ID 1105>:

m271.seq

```
  1 AwGTTCAGTT CGCGGATGGC GAGGATTTGG GCGATGGGGG TAACGTTGTG
 51 TATGGTCAGT CCGTGTCCGG CGTTGACGAC CAAGCCCAAA TCGCCGGCGA
101 AATGCGCGCC GTTTTGGATG CGCTCGAACT GCCTGATTTG TTCGGCGTGG
```

-continued

```
151 CTGCGCGCGT CGGCATACGC GCCTGTGTGC AGCTCGACAA CGGGCGCGCC

201 GACATCACGG GCGGCTTGGA TTTGCCTGTC GTCGGCATCG ATAAACAAAG

251 ACACGCGTAT GCCTGCGTCG GTCAGGATTT TGGTGAACCC GGCGATTTTT

301 TCCTGTTGCG CCAATACGTC CAAACCGCCT TCGGTCGTGA TTTCCTGACG

351 TTTTTCAGGC ACGATGCACA CGTCTTCCGG CATCACTTTC AAAGCGTTTT

401 CCAACATTTC TTCCGTCAAC GCCATTTCAA GGTTCAGGCG CGTGCGGATG

451 GCGTTTTTGA CGGCAAACAC GTCCGCGTCT TTGATGTGGC GGCGGTCTTC

501 GCGCAGGTGC ATGGTAATCA AATCCGCACC GTGCGTTTCG GCAACCAGTG

551 CCGCCTCCAC GGGGCTGGGA TAA
```

This corresponds to the amino acid sequence <SEQ ID 1106; ORF 271>:

m271.pep

```
  1 XFSSRMARIW AMGVTLCMVS PCPALTTKPK SPAKCAPFWM RSNCLICSAW

 51 LRASAYAPVC SSTTGAPTSR AAWICLSSAS INKDTRMPAS VRILVNPAIF

101 SCCANTSKPP SVVISXRFSG TMHTSSGITF KAFSNISSVN AISRFRRVRM

151 AFLTANTSAS LMWRRSSRRC MVIKSAPCVS ATSAASTGLG *
```

Computer analysis of this amino acid sequence gave the following results:

Homology with a predicted ORF from *N. gonorrhoeae*

ORF 271 shows 95.2% identity over a 189 aa overlap with a predicted ORF (ORF 271.ng) from *N. gonorrhoeae*:

```
m271/g271

                    10        20        30        40        50        60
m271.pep   XFSSRMARIWAMGVTLCMVSPCPALTTKPKSPAKCAPFWMRSNCLICSAWLRASAYAPVC
            |||||||||| ||||||||||||||||||||||||||||||||||||||| ||||||||
g271       MFSSRMARIWATGVTLCMVSPCPALTTKPKSPAKCAPFWMRSNCLICSAWLCASAYAPVC
                    10        20        30        40        50        60

                    70        80        90       100       110       120
m271.pep   SSTTGAPTSRAAWICLSSASINKDTRMPASVRILVNPAIFSCCANTSKPPSVVISXRFSG
           ||||||||||||||||||||||||||||||||||:| |||||||||||||||||| ||||
g271       SSTTGAPTSRAAWICLSSASINKDTRMPASVRILANSAIFSCCANTSKPPSVVISCRFSG
                    70        80        90       100       110       120

                   130       140       150       160       170       180
m271.pep   TMHTSSGITFKAFSNISSVNAISRFRRVRMAFLTANTSASLMWRRSSRRCMVIKSAPCVS
           |||||||||::|||:||||||||||||||||||||||||||||||||||||||:||||||
g271       TMHTSSGITLSAFSSISSVNAISRFRRVRMAFLTANTSASLMWRRSSRRCMVIRSAPCVS
                   130       140       150       160       170       180

                   190
m271.pep   ATSAASTGLGX
           |||||||||||
g271       ATSAASTGLGX
                   190
```

The following partial DNA sequence was identified in *N. meningitidis* <SEQ ID 1107>:

a271.seq

```
  1 ATGTTCAGTT CGCGGATGGC GAGGATTTGG GCGATGGGGG TAACGTTGTG

 51 TATGGTCAGT CCGTGTCCGG CGTTGACGAC CAAGCCCAAA TCGCTGGCAA

101 AATGCGCGCC GTTTTGGATG CGCTCGAACT GCCTGATTTG TTCGGCGTGG
```

-continued

```
151 CTGCGCGCGT CGGCATACGC GCCTGTGTGC AGCTCGACAA CGGGCGCGCC

201 GACATCACGG GCGGCTTGGA TTTGCCTGTC GTCGGCATCG ATAAACAAGG

251 ACACGCGTAT GCCCGCGTCG GTCAGGATTT TGGTGAATTC GGCAATTTTG

301 TCTTGTTGCG CCAATACGTC CAAGCCGCCT TCGGTCGTGA TTTCCTGACG

351 TTTTTCCGGC ACGATGCACA CGTCTTCCGG CATCACTTTA AGCGCGTTTT

401 CGAGCATTTC TTCCGTCAAC GCCATTTCAA GGTTCAGGCG CGTGCGGATG

451 GCGTTTTTGA CAGCAAACAC GTCCGCGTCT TTGATGTGGC GGCGGTCTTC

501 GCGCAGGTGC ATGGTAATCA GGTCGGCACC GTGCGTTTCG GCAACCAGTG

551 CCGCCTCCAC GGGGCTGGGA TAA
```

This corresponds to the amino acid sequence <SEQ ID 1108; ORF 271.a>:

a271.pep

```
  1 MFSSRMARIW AMGVTLCMVS PCPALTTKPK SLAKCAPFWM RSNCLICSAW

 51 LRASAYAPVC SSTTGAPTSR AAWICLSSAS INKDTRMPAS VRILVNSAIL

101 SCCANTSKPP SVVIS*RFSG TMHTSSGITL SAFSSISSVN AISRFRRVRM

151 AFLTANTSAS LMWRRSSRRC MVIRSAPCVS ATSAASTGLG *
```

m271/a271 96.3% identity in 189 aa overlap

```
                  10        20        30        40        50        60
m271.pep  XFSSRMARIWAMGVTLCMVSPCPALTTKPKSPAKCAPFWMRSNCLICSAWLRASAYAPVC
           ||||||||||||||||||||||||||||| ||||||||||||||||||||||||||||
a271      MFSSRMARIWAMGVTLCMVSPCPALTTKPKSLAKCAPFWMRSNCLICSAWLRASAYAPVC
                  10        20        30        40        50        60

                  70        80        90       100       110       120
m271.pep  SSTTGAPTSRAAWICLSSASINKDTRMPASVRILVNPAIFSCCANTSKPPSVVISXRFSG
          |||||||||||||||||||||||||||||||||||| ||:||||||||||||||||||||
a271      SSTTGAPTSRAAWICLSSASINKDTRMPASVRILVNSAILSCCANTSKPPSVVISXRFSG
                  70        80        90       100       110       120

                 130       140       150       160       170       180
m271.pep  TMHTSSGITFKAFSNISSVNAISRFRRVRMAFLTANTSASLMWRRSSRRCMVIKSAPCVS
          |||||||||::|||:|||||||||||||||||||||||||||||||||||||||:|||||
a271      TMHTSSGITLSAFSSISSVNAISRFRRVRMAFLTANTSASLMWRRSSRRCMVIRSAPCVS
                 130       140       150       160       170       180

                 190
m271.pep  ATSAASTGLGX
          |||||||||||
a271      ATSAASTGLGX
                 190
```

The following partial DNA sequence was identified in *N. gonorrhoeae* <SEQ ID 1109>:

g272.seq

```
  1 atgactgcaa aggaagaact gttcgcatgg ctgcgccata tgaacaaaaa

 51 caaaggttcc gacctgtttg tgacgaccca tttcccgccc gctatgaagc

101 tggacggcaa aatcacccgc atcacggacg aaccgctgac ggcggaaaaa

151 tgtatggaaa tcgccttttc gattatgagt gcgaagcagg cggaagaatt

201 ttcatcgacc aacgagtgca atttcgccat cagcctgccg gacaccagcc
```

-continued 251 gcttccgcgt caatgcgatg atacagcgcg gtgcgacggc gttggtattc 301 cgcgcgatta ccagcaagat tcccaagttt gaaagcctga acctgccgcc 351 ggccttgaag gatgttgcgc tgaaaaaacg cgggctggtt atttttgtcg 401 gcggcaccgg ctcgggcaaa tcgacttcgc tcgcctcgct tatcgactac 451 cgcaatgaaa attcgttcgg acacatcatc accatcgaag atccgatcga 501 gtttgtccac gaacacaaaa actgcatcat tacccagcgc gaggtcggcg 551 tggacacgga aaactggatg gcggcgttga aaaatacgct gcgtcaggcg 601 ccggatgtga tccttatcgg cgaaatccgc gaccgtgaaa caatggacta 651 cgccatcgcc tttgccgaaa cggggcattt gtgtatggcg acgctgcacg 701 ccaacagcac caatcaggcg ctcgaccgca tcatcaactt cttccccgag 751 gagcggcgcg aacaattgct gacggatttg tcgctcaacc ttcaggcgtt 801 tatttcgcaa cgcctcgttc cgcgagacgg cggcaagggc agggtggcgg 851 cagtcgaggt gctgctcaat tcgcccctga tttcggagtt gattcacaac 901 ggcaacatcc atgaaatcaa agaagtgatg aaaaaatcca ctaccctggg 951 tatgcagacc ttcgaccaac acctttacca attgtatgaa aaaggcgaga 1001 tttccttgca ggatgccttg aaaaatgccg attccgcaca tgatttgcgt 1051 ttggcggtac agttgcgcag ccgcagggca caaagttccg accccgattt 1101 ggaactgctc tga This corresponds to the amino acid sequence <SEQ ID 1110; ORF 272.ng>:

g272.pep

1 MTAKEELFAW LRHMNKNKGS DLFVTTHFPP AMKLDGKITR ITDEPLTAEK

51 CMEIAFSIMS AKQAEEFSST NECNFAISLP DTSRFRVNAM IQRGATALVF

101 RAITSKIPKF ESLNLPPALK DVALKKRGLV IFVGGTGSGK STSLASLIDY

151 RNENSFGHII TIEDPIEFVH EHKNCIITQR EVGVDTENWM AALKNTLRQA

201 PDVILIGEIR DRETMDYAIA FAETGHLCMA TLHANSTNQA LDRIINFFPE

251 ERREQLLTDL SLNLQAFISQ RLVPRDGGKG RVAAVEVLLN SPLISELIHN

301 GNIHEIKEVM KKSTTLGMQT FDQHLYQLYE KGEISLQDAL KNADSAHDLR

351 LAVQLRSRRA QSSDPDLELL*

The following partial DNA sequence was identified in *N. meningitidis* <SEQ ID 1111>:

m272.seq

1 ATGACCGCAA AGGAAGAACT GTTCGCATGG CTGCGCCATA TGAwCCAAAA

51 CAAAGGTTCC GACCTGTTCG TGACAACCCA TTTCCCGCCC GCAATGAAGC

101 TGGACGGCAA AATCACCCGC ATCACGGACG AACCGCTGAC GGCGGAAAAA

151 TGTATGGAAA TCGCCTTTTC GATTATGAGT GCGAAGCAGG CGGAAGAATT

201 TTCATCGACC AACGAGTGCA ACTTCGCCAT CAGCCTGCCG GACACCAGCC

-continued

```
 251 GCTTCCGCGT CAATGCGATG ATACAGCgCG GCGCGACGGC GTTGGTATTC
 301 CGTACGATTA CCAGCAAGAT TCCCAAGTTT GAAAGCCTGA ACCTGCCGCC
 351 AGTCTTGAAG GATGTCGCGC TGAAAAAACG CGGGCTGGTT ATTTTTGTCG
 401 GCGGCACCGG CTCGGGTAAA TCGACTTCGC TTGCCTCGCT TATCGACTAC
 451 CGCAATGAAA ATTCGTTCGG ACACATCATC ACCATCGAAG ACCCGATCGA
 501 GTTTGTCCAC GAACACAAAA ACTGCATCAT CACCCAGCGC GAGGTCGGCG
 551 TGGATACGGA AAACTGGATG GcGGCGTTGA AAAACACGCT GCGTCAGGCG
 601 CCTGATGTCA TCCTTATCGG CGAAATCCGT GACCGCGAAA CAATGGACTA
 651 CGCCATTGCC TTTGCCGAAA CGGGGCATTT GTGTATGGCG ACGCTGCACG
 701 CCAACAGCAC CAATCAGGCA CTCGACCGCA TCATCAACTT TTTCCCCGAG
 751 GAGCGGCGCG AACAATTGCT GACGGATTTG TCGCTCAACC TTCAGGCGTT
 801 TATTTCGCAA CGCCTCGTTC CGCGAGACGG CGGCAAGGGC AGGGTGGCGG
 851 CAGTCGAGGT GCTGCTCAAT TCGCCCCtGA TTTCGGAGTT GATTCACAAC
 901 GGCAACATCC ATGAAATCAA AGAAGTGATG AAAAAATCCA CTACCCTGGG
 951 TATGCAGACC TTCGATCAAC ACCTTTACCA ATTGTATGAA AAAGGCGATA
1001 TTTCCCTGCA AGAAGCATTG AAAAATGCCG ATTCCGCACA CGATTTGCGT
1051 TTGGCGGTAC AGTTGCGCAG CCGCCGCGCG CAaAGTTyCA GCCCCGATTT
1101 GGnACTGCTC TGA
```

This corresponds to the amino acid sequence <SEQ ID 1112; ORF 272>:

m272.pep

```
  1 MTAKEELFAW LRHMXQNKGS DLFVTTHFPP AMKLDGKITR ITDEPLTAEK
 51 CMEIAFSIMS AKQAEEFSST NECNFAISLP DTSRFRVNAM IQRGATALVF
101 RTITSKIPKF ESLNLPPVLK DVALKKRGLV IFVGGTGSGK STSLASLIDY
151 RNENSFGHII TIEDPIEFVH EHKNCIITQR EVGVDTENWM AALKNTLRQA
201 PDVILIGEIR DRETMDYAIA FAETGHLCMA TLHANSTNQA LDRIINFFPE
251 ERREQLLTDL SLNLQAFISQ RLVPRDGGKG RVAAVEVLLN SPLISELIHN
301 GNIHEIKEVM KKSTTLGMQT FDQHLYQLYE KGDISLQEAL KNADSAHDLR
351 LAVQLRSRRA QSXSPDLXLL *
```

Computer analysis of this amino acid sequence gave the following results:

Homology with a predicted ORF from *N. gonorrhoeae*

ORF 272 shows 97.6% identity over a 370 aa overlap with a predicted ORF (ORF 272.ng) from *N. gonorrhoeae*:

m272/g272

```
                   10        20        30        40        50        60
m272.pep   MTAKEELFAWLRHMXQNKGSDLFVTTHFPPAMKLDGKITRITDEPLTAEKCMEIAFSIMS
           |||||||||||||| :|||||||||||||||||||||||||||||||||||||||||||||
g272       MTAKEELFAWLRHMNKNKGSDLFVTTHFPPAMKLDGKITRITDEPLTAEKCMEIAFSIMS
                   10        20        30        40        50        60
```

-continued

```
                   70        80        90       100       110       120
m272.pep  AKQAEEFSSTNECNFAISLPDTSRFRVNAMIQRGATALVFRTITSKIPKFESLNLPPVLK
          ||||||||||||||||||||||||||||||||||||||||:|||||||||||||||:||
g272      AKQAEEFSSTNECNFAISLPDTSRFRVNAMIQRGATALVFRAITSKIPKFESLNLPPALK
                   70        80        90       100       110       120

                  130       140       150       160       170       180
m272.pep  DVALKKRGLVIFVGGTGSGKSTSLASLIDYRNENSFGHIITIEDPIEFVHEHKNCIITQR
          ||||||||||||||||||||||||||||||||||||||||||||||||||||||||||||
g272      DVALKKRGLVIFVGGTGSGKSTSLASLIDYRNENSFGHIITIEDPIEFVHEHKNCIITQR
                  130       140       150       160       170       180

                  190       200       210       220       230       240
m272.pep  EVGVDTENWMAALKNTLRQAPDVILIGEIRDRETMDYAIAFAETGHLCMATLHANSTNQA
          ||||||||||||||||||||||||||||||||||||||||||||||||||||||||||||
g272      EVGVDTENWMAALKNTLRQAPDVILIGEIRDRETMDYAIAFAETGHLCMATLHANSTNQA
                  190       200       210       220       230       240

                  250       260       270       280       290       300
m272.pep  LDRIINFFPEERREQLLTDLSLNLQAFISQRLVPRDGGKGRVAAVEVLLNSPLISELIHN
          ||||||||||||||||||||||||||||||||||||||||||||||||||||||||||||
g272      LDRIINFFPEERREQLLTDLSLNLQAFISQRLVPRDGGKGRVAAVEVLLNSPLISELIHN
                  250       260       270       280       290       300

                  310       320       330       340       350       360
m272.pep  GNIHEIKEVMKKSTTLGMQTFDQHLYQLYEKGDISLQEALKNADSAHDLRLAVQLRSRRA
          ||||||||||||||||||||||||||||||||:||||:||||||||||||||||||||||
g272      GNIHEIKEVMKKSTTLGMQTFDQHLYQLYEKGEISLQDALKNADSAHDLRLAVQLRSRRA
                  310       320       330       340       350       360

                  370
m272.pep  QSXSPDLXLLX
          || :||| |||
g272      QSSDPDLELLX
                  370
```

The following partial DNA sequence was identified in *N. meningitidis* <SEQ ID 1113>:

a272.seq

```
   1 ATGACCGCAA AGGAAGAACT GTTCGCATGG CTGCGCCATA TGAACAAAAA
  51 CAAAGGTTCC GACCTGTTCG TGACGACCCA TTTCCCGCCC GCAATGAAGC
 101 TGGACGGCAA AATCACCCGC ATCACGGACG AACCGCTGAC GGCGGAAAAA
 151 TGTATGGAAA TCGCCTTTTC GATTATGAGT GCGAAGCAGG CGGAAGAATT
 201 TTCATCGACC AACGAGTGCA ACTTCGCCAT CAGTCTGCCG GACACCAGCC
 251 GCTTCCGCGT CAATGCGATG ATACAGCGCG GTGCGACGGC GTTGGTATTC
 301 CGTGCGATTA CCAGCAAGAT TCCCAAGTTT GAAAGCCTGA ACCTGCCGCC
 351 GGTCTTGAAG GATGTCGCGC TGAAAAAACG CGGGCTGGTT ATTTTTGTCG
 401 GCGGCACCGG CTCGGGCAAA TCGACTTCGC TTGCCTCGCT TATCGACTAC
 451 CGCAATGAAA ATTCGTTCGG ACACATCATC ACCATCGAAG ACCCGATCGA
 501 GTTTGTCCAC GAACACAAAA ACTGCATCAT CACCCAGCGC GAGGTCGGCG
 551 TGGATACGGA AAACTGGATG GCGGCGTTGA AAAACACGCT GCGTCAGGCA
 601 CCGGATGTGA TTCTGATCGG CGAAATCCGC GACCGCGAAA CAATGGACTA
 651 CGCCATTGCT TTTGCCGAAA CGGGGCATTT GTGTATGGCG ACGCTGCACG
 701 CCAACAGCAC CAATCAGGCA CTCGACCGCA TCATCAACTT TTTCCCCGAG
 751 GAGCGGCGCG AACAATTGCT GACGGATTTG TCGCTCAACC TTCAGGCATT
 801 TATTTCGCAA CGCCTCGTTC CGCGAGACGG CGGCAAGGGC AGGGTGGCGG
 851 CAGTCGAGGT GCTGCTCAAT TCGCCCCTGA TTTCGGAGTT GATTCACAAC
 901 GGCAATATCC ATGAAATCAA AGAAGTGATG AAAAAATCCA CTACCCTGGG
 951 TATGCAGACT TTCGACCAAC ACCTTTACCA ATTGTATGAA AAAGGCGAGA
1001 TTTCCTTGCA GGATGCCTTG AAAAATGCCG ATTCCGCACA CGATTTGCGT
```

-continued

```
1051 TTGGCGGTAC AGTTGCGCAG CCGCCAGGCG CAAAGTTCCG GTCCCGATTT

1101 GGAACTGCTC TGA
```

This corresponds to the amino acid sequence <SEQ ID 1114; ORF 272.a>:

a272.pep

```
  1 MTAKEELFAW LRHMNKNKGS DLFVTTHFPP AMKLDGKITR ITDEPLTAEK

 51 CMEIAFSIMS AKQAEEFSST NECNFAISLP DTSRFRVNAM IQRGATALVF

101 RAITSKIPKF ESLNLPPVLK DVALKKRGLV IFVGGTGSGK STSLASLIDY

151 RNENSFGHII TIEDPIEFVH EHKNCIITQR EVGVDTENWM AALKNTLRQA

201 PDVILIGEIR DRETMDYAIA FAETGHLCMA TLHANSTNQA LDRIINFFPE

251 ERREQLLTDL SLNLQAFISQ RLVPRDGGKG RVAAVEVLLN SPLISELIHN

301 GNIHEIKEVM KKSTTLGMQT FDQHLYQLYE KGEISLQDAL KNADSAHDLR

351 LAVQLRSRQA QSSGPDLELL *
```

m272/a272 97.6% identity in 370 aa overlap

```
                   10        20        30        40        50        60
m272.pep    MTAKEELFAWLRHMXQNKGSDLFVTTHFPPAMKLDGKITRITDEPLTAEKCMEIAFSIMS
            |||||||||||||| :||||||||||||||||||||||||||||||||||||||||||||
a272        MTAKEELFAWLRHMNKNKGSDLFVTTHFPPAMKLDGKITRITDEPLTAEKCMEIAFSIMS
                   10        20        30        40        50        60

                   70        80        90       100       110       120
m272.pep    AKQAEEFSSTNECNFAISLPDTSRFRVNAMIQRGATALVFRTITSKIPKFESLNLPPVLK
            |||||||||||||||||||||||||||||||||||||||||:||||||||||||||||||
a272        AKQAEEFSSTNECNFAISLPDTSRFRVNAMIQRGATALVFRAITSKIPKFESLNLPPVLK
                   70        80        90       100       110       120

                  130       140       150       160       170       180
m272.pep    DVALKKRGLVIFVGGTGSGKSTSLASLIDYRNENSFGHIITIEDPIEFVHEHKNCIITQR
            ||||||||||||||||||||||||||||||||||||||||||||||||||||||||||||
a272        DVALKKRGLVIFVGGTGSGKSTSLASLIDYRNENSFGHIITIEDPIEFVHEHKNCIITQR
                  130       140       150       160       170       180

                  190       200       210       220       230       240
m272.pep    EVGVDTENWMAALKNTLRQAPDVILIGEIRDRETMDYAIAFAETGHLCMATLHANSTNQA
            ||||||||||||||||||||||||||||||||||||||||||||||||||||||||||||
a272        EVGVDTENWMAALKNTLRQAPDVILIGEIRDRETMDYAIAFAETGHLCMATLHANSTNQA
                  190       200       210       220       230       240

                  250       260       270       280       290       300
m272.pep    LDRIINFFPEERREQLLTDLSLNLQAFISQRLVPRDGGKGRVAAVEVLLNSPLISELIHN
            ||||||||||||||||||||||||||||||||||||||||||||||||||||||||||||
a272        LDRIINFFPEERREQLLTDLSLNLQAFISQRLVPRDGGKGRVAAVEVLLNSPLISELIHN
                  250       260       270       280       290       300

                  310       320       330       340       350       360
m272.pep    GNIHEIKEVMKKSTTLGMQTFDQHLYQLYEKGDISLQEALKNADSAHDLRLAVQLRSRRA
            ||||||||||||||||||||||||||||||||:||||:||||||||||||||||||||:|
a272        GNIHEIKEVMKKSTTLGMQTFDQHLYQLYEKGEISLQDALKNADSAHDLRLAVQLRSRQA
                  310       320       330       340       350       360

                  370
m272.pep    QSXSPDLXLLX
            || :||| |||
a272        QSSGPDLELLX
                  370
```

The following partial DNA sequence was identified in *N. gonorrhoeae* <SEQ ID 1115>:

g273.seq

```
  1 atgagtcttc aggcggtatt tatataccccc ccaagccgta ccgcacaata

 51 caacgaaaat caggaaaacg gcggtaaagc tcataaacag ggacaaagcg
```

-continued

```
101 gcaaacacac cgaccgccgt caggatatag gcgtattcga ggccggaact
151 ccattcaccg ttttcctgcc gtttcttgtc gcttttgaaa taaaggatga
201 tgccggcaag cagcgcggca gccgcgcccg acattggcat tgtgttcatt
251 gttgttcctt aacggttaaa aacccgcccg gccgtgcaac cgttttaagg
301 cgggaaattg caaaatttgt ttgcgggcgc gtgccgctga aatcaaggcg
351 gtttgagaag tgtttccnac gcgcccgccc tatgtgccga aatattattt
401 gtcgctcacc tgcaaaatcg ccaagaacgc gctttgcgga atttccacgt
451 tgcccacttg tttcatacgg cgtttgcctg ctttttgttt ttcaagcagt
501 tttttcttac gcgtaa
```

This corresponds to the amino acid sequence <SEQ ID 1116; ORF 273.ng>:

g273.pep

```
  1 MSLQAVFIYP PSRTAQYNEN QENGGKAHKQ GQSGKHTDRR QDIGVFEAGT
 51 PFTVFLPFLV AFEIKDDAGK QRGSRARHWH CVHCCSLTVK NPPGRATVLR
101 REIAKFVCGR VPLKSRRFEK CFXRARPMCR NIICRSPAKS PRTRFAEFPR
151 CPLVSYGVCL LFVFQAVFSY A*
```

The following partial DNA sequence was identified in *N. meningitidis* <SEQ ID 1117>:

m273.seq

```
  1 ATGAGTCTTC AGGCGGTATT TATATACCCm CCAAGCCGTA CCGCACAATA
 51 CAACGAAAAT CAGGAAAACG GCGGTAAAGC TCAyAAACAG GGACAAAGCG
101 GCAAACACGC CGACCGCTGT CAGGATATAG GCGTATTCAA GGCCGGAACT
151 CCATTCCCCG TTTTCCTGCC GCTTCTTGTC GCTTTTGAAA TAAAGGATGA
201 TGCCGGCAAG CAGCGCGGCA GCCGCGCCCG ACATTAGCAT TGTGTTCATT
251 GTTGTTCCTT AATGCTTAAA AACCCGCCTG TCCGTGCAAC CGTTTTAAGG
301 CGGCAAATTG CAAAATTTGT TTGCGGGCGC GTGCCCCTGA AATCAGGGCG
351 GTTTGAGGGG TGTTCCCGAC GCGCCGCCCT GTGTGCCGGA GTTATTTGTC
401 GCTCACCTGC AAAATCGCCA AGAACGCGCT TTGCGGAATT TCCACATTGC
451 CCACTTGTTT CATACGGCGT TTACCTGCCT TTTGTkTwTC AAGCAGTTTT
501 TTCTTACGCG TAA
```

This corresponds to the amino acid sequence <SEQ ID 1118; ORF 273>:

m273.pep

```
  1 MSLQAVFIYP PSRTAQYNEN QENGGKAHKQ GQSGKHADRC QDIGVFKAGT
 51 PFPVFLPLLV AFEIKDDAGK QRGSRARH*H CVHCCSLMLK NPPVRATVLR
101 RQIAKFVCGR VPLKSGRFEG CSRRAALCAG VICRSPAKSP RTRFAEFPHC
151 PLVSYGVYLP FVXQAVFSYA *
```

Computer analysis of this amino acid sequence gave the following results:

Homology with a predicted ORF from *N. gonorrhoeae*

ORF 273 shows 86.0% identity over a 171 aa overlap with a predicted ORF (ORF 273.ng) from *N. gonorrhoeae*:

m273/g273

```
                    10        20        30        40        50        60
m273.pep    MSLQAVFIYPPSRTAQYNENQENGGKAHKQGQSGKHADRCQDIGVFKAGTPFPVFLPLLV
            ||||||||||||||||||||||||||||||||||||:|| ||||||:||||| ||||:||
g273        MSLQAVFIYPPSRTAQYNENQENGGKAHKQGQSGKHTDRRQDIGVFEAGTPFTVFLPFLV
                    10        20        30        40        50        60

                    70        80        90       100       110       120
m273.pep    AFEIKDDAGKQRGSRARHXHCVHCCSLMLKNPPVRATVLRRQIAKFVCGRVPLKSGRFEG
            ||||||||||||||||| |||||||| :|||| ||||||:||||||||||||| |||
g273        AFEIKDDAGKQRGSRARHWHNVHCCSLTVKNPPGRATVLRREIAKFVCGRVPLKSRRFEK
                    70        80        90       100       110       120

                   130       140       150       160       170
m273.pep    CSRRA-ALCAGVICRSPAKSPRTRFAEFPHCPLVSYGVYLPFVXQAVFSYAX
            |  ||  :|  ::||||||||||||||||:|||||||| | || |||||||
g273        CFXRARPMCRNIICRSPAKLPRTRFAGFPRCPLVSYGVCLLFVFQAVFSYAX
                  130       140       150       160       170
```

The following partial DNA sequence was identified in *N. meningitidis* <SEQ ID 1119>:

a273.seq

```
  1 ATGAGTCTTC AGGCGGTATT TGTATACCCC CCAAGCCGTA CCGCACAATA
 51 CAACGAAAAT CAGGAAAACG GCGGTAAAGC TCATAAACAG GGACAAAGCG
101 GCAAACACGC CGACCGCCGT CAGGATATAG GCGTATTCCA GACCGGAACT
151 CCATTCACCG TTTTCCTGCC GCTTTTTGTC GCTTTTGAAA TAAAGGATGA
201 TGCCGGCAAG CAGCGCGGCA GCCGCGCCCG ACATTAGCAT AATGTTCATT
251 GTTGTTCCTT AACGGTTAAA AACCCGCCCG TCCGTGCAAC CGTTTTTAAG
301 AGGCGGTAAA TCACAAAGTT TGTTGGCGGA CGTGCTCTCT TACAATCAGG
351 GCGGTTTAAG GGGCATGATG CACTGCCCCG TGTGCCGGAT ATTATTTGTC
401 GCTCACCTGC AAAATTGCCA AGAACGCGCT TTGCGGGATT TCCACATTGC
451 CCACTTGTTT CATACGGCGT TTGCCTGCTT TTTGTTTTTC AAGCAGTTTT
501 TTCTTACGCG TAA
```

This corresponds to the amino acid sequence <SEQ ID 1120; ORF 273.a>:

a273.pep

```
  1 MSLQAVFVYP PSRTAQYNEN QENGGKAHKQ GQSGKHADRR QDIGVFQTGT
 51 PFTVFLPLFV AFEIKDDAGK QRGSRARH*H NVHCCSLTVK NPPVRATVFK
101 RR*ITKFVGG RALLQSGRFK GHDALPRVPD IICRSPAKLP RTRFAGFPHC
151 PLVSYGVCLL FVFQAVFSYA *
```

m273/a273 80.1% identity in 171 aa overlap

```
                    10        20        30        40        50        60
m273.pep   MSLQAVFIYPPSRTAQYNENQENGGKAHKQGQSGKHADRCQDIGVFKAGTPFPVFLPLLV
           |||||||:||||||||||||||||||||||||||||||| ||||||::|||| |||||:|
a273       MSLQAVFVYPPSRTAQYNENQENGGKAHKQGQSGKHADRRQDIGVFQTGTPFTVFLPLFV
                    10        20        30        40        50        60

                    70        80        90       100       110      119
m273.pep   AFEIKDDAGKQRGSRARHXHCVHCCSLMLKNPPVRATVL-RRQIAKFVCGRVPLKSGRFE
           |||||||||||||||||||| |||||| :|||||||||: || |:||| ||: |:||||:
a273       AFEIKDDAGKQRGSRARHXHNVHCCSLTVKNPPVRATVFKRRXITKFVGGRALLQSGRFK
                    70        80        90       100       110       120

         120       130       140       150       160       170
m273.pep   GCSRRAALCAGVICRSPAKSPRTRFAEFPHCPLVSYGVYLPFVXQAVFSYAX
           | :     :  :||||||| |||||| ||||||||||| | || ||||||||
a273       GHDALPRV-PDIICRSPAKLPRTRFAGFPHCPLVSYGVCLLFVFQAVFSYAX
                   130       140       150       160       170
```

The following partial DNA sequence was identified in *N. gonorrhoeae* <SEQ ID 1121>:

g274.seq

```
  1 ATGGCGGGGC CGATTTTTGT CGTCatCGCC AgcgTCGCTA TGTTTTTTGT
 51 CGCGCAGCAG CACGCGACAG ATTTGGTTAC GGACGATTAT TATAAGGATG
101 GCAAGCATAT CGACATCCAG CTTCATCGGG ATGAAGAAGC CGTCAGACGG
151 CATATCGGGG TGCAGGTCCT CATTTCTCCC GATATGAATG CGGCAAAAGT
201 GTTTGTCGGc ggCgagtTTG ACGGCAAACA GCCTTTGAAC CTGCTGCTGA
251 TGCACCCGAC CCGCAAGGCG GACGATCAAA CCGTCGCCCT CAAGCCCGTC
301 GGCAGCGCGC AGAACGGCAG GGCGGAATAT GAGGCGGTgt tcaaAACCCT
351 TCCGCCGGCC AACCACTGGT ATGTGCGCGT GGAggacgCG GCAGGCGTGT
401 GGCGCGTCGA GAACAAATGG ATTACCAGCC AGGGCAATGC GGTCGATTTG
451 ACCCCGATGG ACAAACTTTT CAATAATGCA GGAAGCAAAT AA
```

This corresponds to the amino acid sequence <SEQ ID 1122; ORF 274.ng>:

g274.pep

```
  1 MAGPIFVVIA SVAMFFVAQQ HATDLVTDDY YKDGKHIDIQ LHRDEEAVRR
 51 HIGVQVLISP DMNAAKVFVG GEFDGKQPLN LLLMHPTRKA DDQTVALKPV
101 GSAQNGRAEY EAVFKTLPPA NHWYVRVEDA AGVWRVENKW ITSQGNAVDL
151 TPMDKLFNNA GSK*
```

The following partial DNA sequence was identified in *N. meningitidis* <SEQ ID 1123>:

m274.seq

```
  1 ATGGCGGGGC CGATTTTTGT CGTCATCGCC AGCGTCGCTA TGTTTTTTGT
 51 CGCGCAGCAG CACGCGACAG ATTTGGTTAC GGACGATTAT TATAAAGACG
101 GCAAACATAT CGACATCCAG CTTCATCGGG ATGAAGAAGC CGTCAGACGG
151 CATATCGGGG TGCAGGTTCT CATTTCCCCC GATATGAATG CGGCAAAAGT
201 GTTTGTCGGC GGCGAGTTTG ACGGCAAACA GCCTTTGAAC CTGCTGCTGA
```

-continued

```
251 TGCACCCGAC CCGCAAGGCG GACGATCAAA CCGTCGCCCT CAAGCCCGTC

301 GGCAGCGCGC AGAACGGCAG GGCGGAATAT GAGGCGGTGT TCAAAACCCT

351 TTCGCCGACC AACCACTGGT ATGTGCGCGT GGAGGACGCG GCAGGCGTGT

401 GGCGCGTCGA GAACAAATGG ATTACCAGCC AAGGCAATGC GGTCGATTTG

451 ACCCCGATGG ACAAGCTTTT CAATAATACT GAAAGCAAAT AA
```

This corresponds to the amino acid sequence <SEQ ID 1124: ORF 274>:

m274.pep

```
  1 MAGPIFVVIA SVAMFFVAQQ HATDLVTDDY YKDGKHIDIQ LHRDEEAVRR

 51 HIGVQVLISP DMNAAKVFVG GEFDGKQPLN LLLMHPTRKA DDQTVALKPV

101 GSAQNGRAEY EAVFKTLSPT NHWYVRVEDA AGVWRVENKW ITSQGNAVDL

151 TPMDKLFNNT ESK*
```

Computer analysis of this amino acid sequence gave the following results:

Homology with a predicted ORF from *N. gonorrhoeae*

ORF 274 shows 97.5% identity over a 163 aa overlap with a predicted ORF (ORF 274.ng) from *N. gonorrhoeae*:

m274/g274

```
                   10        20        30        40        50        60
m274.pep   MAGPIFVVIASVAMFFVAQQHATDLVTDDYYKDGKHIDIQLHRDEEAVRRHIGVQVLISP
           ||||||||||||||||||||||||||||||||||||||||||||||||||||||||||||
g274       MAGPIFVVIASVAMFFVAQQHATDLVTDDYYKDGKHIDIQLHRDEEAVRRHIGVQVLISP
                   10        20        30        40        50        60

                   70        80        90       100       110       120
m274.pep   DMNAAKVFVGGEFDGKQPLNLLLMHPTRKADDQTVALKPVGSAQNGRAEYEAVFKTLPPA
           |||||||||||||||||||||||||||||||||||||||||||||||||||||||||| |:
g274       DMNAAKVFVGGEFDGKQPLNLLLMHPTRKADDQTVALKPVGSAQNGRAEYEAVFKTLSPT
                   70        80        90       100       110       120

                  130       140       150       160
m274.pep   NHWYVRVEDAAGVWRVENKWITSQGNAVDLTPMDKLFNNAGSKX
           |||||||||||||||||||||||||||||||||||||||: |||
g274       NHWYVRVEDAAGVWRVENKWITSQGNAVDLTPMDKLFNNTESKX
                  130       140       150       160
```

The following partial DNA sequence was identified in *N. meningitidis* <SEQ ID 1125>:

a274.seq

```
  1 ATGGCGGGGC CGATTTTTGT CGTCATCGCC AGCGTCGCTA TGTTTTTTGT

 51 CGCGCAGCAG CACGCGACAG ATTTGGTTAC GGACGATTAT TATAAAGACG

101 GCAAGCATAT CGACATCCAG CTTCATCGGG ATGAAGAAGC CGTCAGACGG

151 CATATCGGGG TGCAGGTTCT CATTTCCCCC GATATGAATG CGGCAAAAGT

201 GTTTGTCGGC GGCGAGTTTG ACGGCAAACA GCCTTTGAAC CTGCTGCTGA

251 TGCACCCGAC CCGCAAGGCG GACGATCAAA CCGTCGCCCT CAAGCCCGTC

301 GGCAGCGCGC AGAACGGCAG GGCGGAATAT GAGGCGGTGT TCAAAACCCT
```

-continued

```
351 TTCGCCGACC AACCACTGGT ATGTGCGCGT GGAGGACGCG GCAGGCGTGT

401 GGCGCGTCGA GAACAAATGG ATTACCAGCC AAGGCAATGC GGTCGATTTG

451 ACCCCGATGG ACAAACTTTT CAATAATACT GAAAGCAAAT AA
```

This corresponds to the amino acid sequence <SEQ ID 1126; ORF 274.a>:

a274.pep

```
  1 MAGPIFVVIA SVAMFFVAQQ HATDLVTDDY YKDGKHIDIQ LHRDEEAVRR

 51 HIGVQVLISP DMNAAKVFVG GEFDGKQPLN LLLMHPTRKA DDQTVALKPV

101 GSAQNGRAEY EAVFKTLSPT NHWYVRVEDA AGVWRVENKW ITSQGNAVDL

151 TPMDKLFNNT ESK*
```

m274/a274 100.0% identity in 163 aa overlap

```
                   10        20        30        40        50        60
m274.pep   MAGPIFVVIASVAMFFVAQQHATDLVTDDYYKDGKHIDIQLHRDEEAVRRHIGVQVLISP
           ||||||||||||||||||||||||||||||||||||||||||||||||||||||||||||
a274       MAGPIFVVIASVAMFFVAQQHATDLVTDDYYKDGKHIDIQLHRDEEAVRRHIGVQVLISP
                   10        20        30        40        50        60

                   70        80        90       100       110       120
m274.pep   DMNAAKVFVGGEFDGKQPLNLLLMHPTRKADDQTVALKPVGSAQNGRAEYEAVFKTLSPT
           ||||||||||||||||||||||||||||||||||||||||||||||||||||||||||||
a274       DMNAAKVFVGGEFDGKQPLNLLLMHPTRKADDQTVALKPVGSAQNGRAEYEAVFKTLSPT
                   70        80        90       100       110       120

                  130       140       150       160
m274.pep   NHWYVRVEDAAGVWRVENKWITSQGNAVDLTPMDKLFNNTESKX
           ||||||||||||||||||||||||||||||||||||||||||||
a274       NHWYVRVEDAAGVWRVENKWITSQGNAVDLTPMDKLFNNTESKX
                  130       140       150       160
```

The following partial DNA sequence was identified in *N. gonorrhoeae* <SEQ ID 1127>:

g276.seq

```
  1 atgattttgc cgccatccat gacgatgatg cggtcggcgg attcgacggt

 51 ggtcaggcgg tgggcgacga tgatgccggt gcggttttcc atcaggcgtt

101 cgagcgcttg ttggacgagg cgttcggatt cgttgtccaa tgcgctggtg

151 gcttcgtcca ataataatat cggcgcgtct ttcaaaatgg cgcgggcgat

201 ggcgacgcgt tgccgctgtc cgccggataa gttgctgccg ttcgatccga

251 tgggctggtg cagtccgagc ggggatgcgt cgatcaggct ttgcaggttg

301 gcggcttgga gggcggacag gacttcggct tcgcccgcgt cgggacggct

351 gtatcggacg ttttcaaaca gggtgtcgtc aaacaggaat acgtcttggg

401 agacgagggc gaattgggcg cgcaggcagt cgagtttgat gtcggcgatg

451 tcgataccgt ctatgcagat gttgccggca gacggttcga caaagcgggg

501 cagaaggttg acgacggtgg atttgccgct gccggaacgt ccgaccaggg

551 cgacgcgttc gccttgtctg atgtcgaggt tgaagttgtc gagggctttg

601 atgccgtctg aacggtattc gacatcgacg ttgcggaagc tgatgcgccc

651 ttcgacacgc tgcggcgcga gcgtgccttt gtcctgttcg ggcggggtgt
```

-continued

```
701 cgagaaatgc acatacgccg tcggcggcga ggaacatcgt ctgcataggg
751 atgctgatgt tggcaaggct tttgatgggg gcgtacattt gcagcatcgc
801 gacgatgaat gccataaatt cgccgatggt ggtgtag
```

This corresponds to the amino acid sequence <SEQ ID 1128; ORF 276.ng>:

g276.pep

```
  1 MILPPSMTMM RSADSTVVRR WATMMPVRFS IRRSSACWTR RSDSLSNALV
 51 ASSNNNIGAS FKMARAMATR CRCPPDKLLP FDPMGWCSPS GDASIRLCRL
101 AAWRADRTSA SPASGRLYRT FSNRVSSNRN TSWETRANWA RRQSSLMSAM
151 SIPSMQMLPA DGSTKRGRRL TTVDLPLPER PTRATRSPCL MSRLKLSRAL
201 MPSERYSTST LRKLMRPSTR CGASVPLSCS GGVSRNAHTP SAARNIVCIG
251 MLMLARLLMG AYICSIATMN AINSPMVV*
```

The following partial DNA sequence was identified in *N. meningitidis* <SEQ ID 1129>:

m276.seq

```
  1 ATGATTTTGC CGTCGTCCAT CACGATGATG CGGTCGGCCC CTTCGATGGT
 51 GGTCAGGCGG TGGGCGACGA TGATGCCGGT GCGGTTTTCC ATCAGGCGTT
101 CGAGCGCCTG TTGGACGAGG CGTTCGGATT CGTTGTCTAA TGCGCTGGTG
151 GCTTCGTCCA ATAATAATAT CGGCGCGTCT TTCAAAATGG CGCGGGCAAT
201 GGCGACGCGT TGCCGCTGTC CGCCGGATAA GTTGCTGCCG TTCGATCCGA
251 TGGGCTGGTG CAGTCCGAGC GGGGAGCTGT CAATCAGGCT TTGCAGGTTG
301 GCGGTTTGGA GGGCGAACAG GACTTCGGCT TCGCCCGCGT CGGGACGGCT
351 GTATCGGACG TTTTCAAACA GGGTGTCGTC AAACAGGAAT ACGTCTTGGG
401 AGACGAGGGC GAATTGGGCG CGCAGGCAGT CGAGTTTGAT GTCGGCGATG
451 TCGATACCGT CTATGCAGAT GTTGCCGGCA GACGGTTCGA CAAAGCGGGG
501 CAGCAGGTTG ACGACGGTGG ATTTGCCGCT GCCGGAACGT CCGACCAGGG
551 CGACGCGTTC GCCTTGTCTG ATGTCGAGGT TGAAGTTGTC GAGGGCTTTG
601 ATGCCGTCTG AACGGTATTC GACATCGACG TTGCGGAAGC TGATGCGCCC
651 TTCGACACGC TGCGGTGCGA GCGTGCCCTT GTCCTGTTCG GGCGGGGTGT
701 CGAGAAATGC ACATACACCG TCGGCGGCGA GGAACATCGT CTGCATAGGG
751 ATGCTGATGT TGGCAAGGCT TTTGATGGGG GCGTACATTT GCAGCATCGC
801 GACGATGAAT GCCATAAATT CGCCGATGGT GGTGTAG
```

This corresponds to the amino acid sequence <SEQ ID 1130; ORF 276>:

m276.pep

```
  1 MILPSSITMM RSAPSMVVRR WATMMPVRFS IRRSSACWTR RSDSLSNALV
 51 ASSNNNIGAS FKMARAMATR CRCPPDKLLP FDPMGWCSPS GELSIRLCRL
```

-continued

```
101 AVWRANRTSA SPASGRLYRT FSNRVSSNRN TSWETRANWA RRQSSLMSAM

151 SIPSMQMLPA DGSTKRGSRL TTVDLPLPER PTRATRSPCL MSRLKLSRAL

201 MPSERYSTST LRKLMRPSTR CGASVPLSCS GGVSRNAHTP SAARNIVCIG

251 MLMLARLLMG AYICSIATMN AINSPMVV*
```

Computer analysis of this amino acid sequence gave the following results:

Homology with a predicted ORF from *N. gonorrhoeae*

ORF 276 shows 96.8% identity over a 278 aa overlap with a predicted ORF (ORF 276.ng) from *N. gonorrhoeae*:

m276/g276

```
                       10        20        30        40        50        60
m276.pep      MILPSSITMMRSAPSMVVRRWATMMPVRFSIRRSSACWTRRSDSLSNALVASSNNNIGAS
              |||| |:|||||| | ||||||||||||||||||||||||||||||||||||||||||||
g276          MILPPSMTMMRSADSTVVRRWATMMPVRFSIRRSSACWTRRSDSLSNALVASSNNNIGAS
                       10        20        30        40        50        60

                       70        80        90       100       110       120
m276.pep      FKMARAMATRCRCPPDKLLPFDPMGWCSPSGELSIRLCRLAVWRANRTSASPASGRLYRT
              |||||||||||||||||||||||||||||||: ||||||||:|||:||||||||||||||
g276          FKMARAMATRCRCPPDKLLPFDPMGWCSPSGDASIRLCRLAAWRADRTSASPASGRLYRT
                       70        80        90       100       110       120

                      130       140       150       160       170       180
m276.pep      FSNRVSSNRNTSWETRANWARRQSSLMSAMSIPSMQMLPADGSTKRGSRLTTVDLPLPER
              ||||||||||||||||||||||||||||||||||||||||||||||| ||||||||||||
g276          FSNRVSSNRNTSWETRANWARRQSSLMSAMSIPSMQMLPADGSTKRGRRLTTVDLPLPER
                      130       140       150       160       170       180

                      190       200       210       220       230       240
m276.pep      PTRATRSPCLMSRLKLSRALMPSERYSTSTLRKLMRPSTRCGASVPLSCSGGVSRNAHTP
              ||||||||||||||| ||||||||||||||||||||||||||||||||||||||||||||
g276          PTRATRSPCLMSRLKPSRALMPSERYSTSTLRKLMRPSTRCGASVPLSCSGGVSRNAHTP
                      190       200       210       220       230       240

                      250       260       270      279
m276.pep      SAARNIVCIGMLMLARLLMGAYICSIATMNAINSPMVVX
              |||||||||||||||||||||||||||||||||||||||
g276          SAARNIVCIGMLMLARLLMGAYICSIATMNAINSPMVVX
                      250       260       270
```

The following partial DNA sequence was identified in *N. meningitidis* <SEQ ID 1131>:

a276.seq

```
  1 ATGATTTTGC CGTCGTCCAT TACGATGATG CGGTCGGCCC CTTCGATGGT

 51 GGTCAGGCGG TGGGCGACGA TGATGCCGGT GCGGTTTTCC ATCAGGCGTT

101 CGAGCGCCTG TTGGACGAGG CGTTCGGATT CGTTGTCCAA TGCGCTGGTG

151 GCTTCGTCCA ATAATAATAT CGGCGCGTCT TTCAAAATGG CGCGGGCAAT

201 GGCAACGCGT TGCCGCTGTC CGCCGGATAA GTTGCTGCCG TTCGATCCGA

251 TGGGCTGGTG CAGTCCGAGC GGTGATGCGT CGATCAGGCT TTGCAGGTTA

301 GCGGCTTGGA GGGCGGATAG GACTTCGGCT TCGCCCGCGT CGGGACGGCT

351 ATATCGGACG TTTTCAAACA GGGTGTCGTC AAACAGGAAT ACGTCTTGGG

401 AGACGAGGGC AAATTGGGCG CGCAGGCAGT CGAGTTTGAT GTCGGCGATG

451 TCGATACCGT CTATGCAGAT GTTGCCGGCA GACGGTTCGA CAAAGCGGGG

501 CAGCAGGTTG ACGACGGTGG ATTTGCCGCT GCCGGAACGT CCGACCAGGG

551 CGACGCGTTC GCCTTGTCTG ATGTCGAGGT TGAAGCCGTC GAGGGCTTTG

601 ATGCCGTCCG AACGGTATTC GACATCGACG TTGCGGAAGC TGATGCGCCC
```

-continued

```
651 TTCGACACGC TGCGGTGCGA GCGTGCCTTT GTCCTGTTCG GGCGGGGTGT

701 CGAGAAATGC ACATACGCCG TCGGCGGCGA GGAACATCGT CTGCATAGGG

751 ATGCTAATGT TGGCAAGGCT TTTGATGGGG GCGTACATTT GCAGCATCGC

801 GACGATGAAT GCCATAAATT CGCCGATGGT GGTGTAG
```

This corresponds to the amino acid sequence <SEQ ID 1132; ORF 276.a>:

a276.pep

```
  1 MILPSSITMM RSAPSMVVRR WATMMPVRFS IRRSSACWTR RSDSLSNALV

 51 ASSNNNIGAS FKMARAMATR CRCPPDKLLP FDPMGWCSPS GDASIRLCRL

101 AAWRADRTSA SPASGRLYRT FSNRVSSNRN TSWETRANWA RRQSSLMSAM

151 SIPSMQMLPA DGSTKRGSRL TTVDLPLPER PTRATRSPCL MSRLKPSRAL

201 MPSERYSTST LRKLMRPSTR CGASVPLSCS GGVSRNAHTP SAARNIVCIG

251 MLMLARLLMG AYICSIATMN AINSPMVV*
```

m276/a276 98.2% identity in 278 aa overlap

```
                   10        20        30        40        50        60
m276.pep   MILPSSITMMRSAPSMVVRRWATMMPVRFSIRRSSACWTRRSDSLSNALVASSNNNIGAS
           ||||||||||||||||||||||||||||||||||||||||||||||||||||||||||||
a276       MILPSSITMMRSAPSMVVRRWATMMPVRFSIRRSSACWTRRSDSLSNALVASSNNNIGAS
                   10        20        30        40        50        60

                   70        80        90       100       110       120
m276.pep   FKMARAMATRCRCPPDKLLPFDPMGWCSPSGELSIRLCRLAVWRANRTSASPASGRLYRT
           |||||||||||||||||||||||||||||||: ||||||||:|||:||||||||||||||
a276       FKMARAMATRCRCPPDKLLPFDPMGWCSPSGDASIRLCRLAAWRADRTSASPASGRLYRT
                   70        80        90       100       110       120

                  130       140       150       160       170       180
m276.pep   FSNRVSSNRNTSWETRANWARRQSSLMSAMSIPSMQMLPADGSTKRGSRLTTVDLPLPER
           ||||||||||||||||||||||||||||||||||||||||||||||||||||||||||||
a276       FSNRVSSNRNTSWETRANWARRQSSLMSAMSIPSMQMLPADGSTKRGSRLTTVDLPLPER
                  130       140       150       160       170       180

                  190       200       210       220       230       240
m276.pep   PTRATRSPCLMSRLKLSRALMPSERYSTSTLRKLMRPSTRCGASVPLSCSGGVSRNAHTP
           ||||||||||||||| ||||||||||||||||||||||||||||||||||||||||||||
a276       PTRATRSPCLMSRLKPSRALMPSERYSTSTLRKLMRPSTRCGASVPLSCSGGVSRNAHTP
                  190       200       210       220       230       240

                  250       260       270      279
m276.pep   SAARNIVCIGMLMLARLLMGAYICSIATMNAINSPMVVX
           |||||||||||||||||||||||||||||||||||||||
a276       SAARNIVCIGMLMLARLLMGAYICSIATMNAINSPMVVX
                  250       260       270
```

The following partial DNA sequence was identified in *N. gonorrhoeae* <SEQ ID 1133>:

g277.seq (partial)

```
  1 ..atggtacacg tcgccgtagc ttacggtatt gccgtccggc gtttttgccc

 51   aaacgaggtc atagacgttt tccacgcctt gcaggtacat cgccaagcgt

101   tcgatgccgt aggtaatttc gccgagtacg ggcgtgcaat cgataccgcc

151   gacttgttgg aaataggtaa actgggttac ttccatgccg ttgagccaga

201   cttcccagcc caaaccccac gcaccgaggg tggggttttc ccagtcgtct

251   tcgacaaagc ggatgtcgtg gactttggga tcgatgccca attcgcgcag
```

-continued

```
301   ggagtcgaga tagaggtctt ggatattggc gggggcgggt ttgagggcga

351   cttggaattg gtaatagtgt tgcaggcggt tggggttgtc gccgtagcgg

401   ccgtctttgg ggcggcggct gggttggacg taggcggcaa accaaggctc

451   ggggccgagc gcgcgcaggc aggtggcggg atgggatgtg ccggcaccga

501   cttccatgtc gaagggttgg atgacggtgc agcctttgtc tgcccagaag

551   gtttgcagtt tgaagatgat ttgttggaag gtaagcatgg cttattgttc

601   gataaaataa aggttttatt ttactgtttc catagccgct tgaatagatt

651   tatctcgaag acagcctga
```

This corresponds to the amino acid sequence <SEQ ID 1134; ORF 277.ng>:

g277.pep (partial)

```
  1 ..MVHVAVAYGI AVRRFCPNEV IDVFHALQVH RQAFDAVGNF AEYGRAIDTA

 51   DLLEIGKLGY FHAVEPDFPA QTPRTEGGVF PVVFDKADVV DFGIDAQFAQ

101   GVEIEVLDIG GGGFEGDLEL VIVLQAVGVV AVAAVFGAAA GLDVGGKPRL

151   GAERAQAGGG MGCAGTDFHV EGLDDGAAFV CPEGLQFEDD LLEGKHGLLF

201   DKIKVLFYCF HSRLNRFISK TA*
```

The following partial DNA sequence was identified in *N. meningitidis* <SEQ ID 1135>:

m277.seq

```
  1 ATGCCCCGCT TTGAGGACAA GCTCGTAGGC AGGCAGGGCG AGGGCGGCGT

 51 TTTCTTCGGC AAGCAGGCGT TTGGCTTGCG CTTCGTAGTC GTTGAACTGG

101 CGCAGCAGCC AGTCGGCATC GCTGTATTCG AAGTTGTAGG TGGATTGCTC

151 GACTTCGTTT TGGTGGTACA CGTCGCCGTA GGTGACGGTG TTGCCGTCGA

201 GCGTTTTTGC CCAAACGAGG TCGTAGACGT TTTCTACACC TTGCAAGTAC

251 ATCGCCAAGC GTTCGATGCC GTAGGTGATT TCGCCGAGTA CGGGCGTGCA

301 GTCGATGCCG CCGACTTGTT GGAAATAGGT AAACTGGGTT ACTTCCATGC

351 CGTTGAGCCA GACTTCCCAG CCCAAACCCC ACGCGCCGAG GGTGGGGTTT

401 TCCCAGTCGT CTTCGACAAA GCGGATGTCG TGGACTTTGG GATCGATGCC

451 CAATTCGCGC AGAGAGTCGA GATAGAGGTC TTGGATATTG GCGGGAGCGG

501 GCTTGAGGGC GACTTGGAAT TGGTAATAGT GTTGCAGGCG GTTGGGGTTG

551 TCGCCGTAGC GGCCGTCTTT GGGGCGGCGG CTGGGTTGGA CGTAGGCGGC

601 AAACCAAGGC TCGGGGCCGA GTGCGCGCAG GCAGGTGGCG GGATGGGATG

651 TGCCGGCACC GACTTCCATG TCGAAGGGTT GGATGACGGT GCAGCCTTTG

701 TCTGCCCAGA ATGTTTGCAG TTTGAAGATG ATTTGTTGGA AGGTAAGCAT

751 GGCTTATGA
```

This corresponds to the amino acid sequence <SEQ ID 1136; ORF 277>:

m277.pep

```
  1 MPRFEDKLVG RQGEGGVFFG KQAFGLRFVV VELAQQPVGI AVFEVVGGLL

 51 DFVLVVHVAV GDGVAVERFC PNEVVDVFYT LQVHRQAFDA VGDFAEYGRA

101 VDAADLLEIG KLGYFHAVEP DFPAQTPRAE GGVFPVVFDK ADVVDFGIDA

151 QFAQRVEIEV LDIGGSGLEG DLELVIVLQA VGVVAVAAVF GAAAGLDVGG

201 KPRLGAECAQ AGGGMGCAGT DFHVEGLDDG AAFVCPECLQ FEDDLLEGKH

251 GL*
```

Computer analysis of this amino acid sequence gave the following results:

Homology with a predicted ORF from *N. gonorrhoeae*

ORF 277 shows 90.0% identity over a 221 aa overlap with a predicted ORF (ORF 277.ng) from *N. gonorrhoeae*:

g277/m277

```
                                                    10        20        30
g277.pep                                    MVHVAVAYGIAVRRFCPNEVIDVFHALQVH
                                            :|||||: |:||:|||||||:|||::||||
m277          GLRFVVVELAQQPVGIAVFEVVGGLLDFVLVVHVAVGDGVAVERFCPNEVVDVFYTLQVH
                  30        40        50        60        70        80

                      40        50        60        70        80        90
g277.pep      RQAFDAVGNFAEYGRAIDTADLLEIGKLGYFHAVEPDFPAQTPRTEGGVFPVVFDKADVV
              ||||||||:|||||||:|:|||||||||||||||||||||||||:|||||||||||||||
m277          RQAFDAVGDFAEYGRAVDAADLLEIGKLGYFHAVEPDFPAQTPRAEGGVFPVVFDKADVV
                  90       100       110       120       130       140

                     100       110       120       130       140       150
g277.pep      DFGIDAQFAQGVEIEVLDIGGGGLFGDLELVIVLQAVGVVAVAAVFGAAAGLDVGGKPRL
              |||||||||| |||||||||||:|:||||||||||||||||||||||||||||||||||
m277          DFGIDAQFAQRVEIEVLDIGGSGLEGDLELVIVLQAVGVVAVAAVFGAAAGLDVGGKPRL
                 150       160       170       180       190       200

                     160       170       180       190       200
g277.pep      GAERAQAGGGMGCAGTDFHVEGLDDGAAFVCPEGLQFEDDLLEGKHGLL
              ||| ||||||||||||||||||||||||||||| ||||||||||||||
m277          GAECAQAGGGMGCAGTDFHVEGLDDGAAFVCPECLQFEDDLLEGKHGLX
                 210       220       230       240       250
```

The following partial DNA sequence was identified in *N. meningitidis* <SEQ ID 1137>:

a277.seq

```
  1 ATGCCCCGCT TTGAGGACAA GCTCGTAGGC AGGCAGGGCG AGGGCGGCGT

 51 TTTCTTCGGC AAGCAGGCGT TTGGCTTGCG CTTCGTAGTC GTTGAACTGG

101 CGCAGCAGCC AATCGGCATC GCTGTATTCG AAGTTGTAGG TGGATTGTTC

151 GACTTCGTTT TGGTGGTACA CGTCGCCGTA AGTTACTGTA TTACCGTCCA

201 GCGTTTTTGC CCAAACGAGG TCATAGACGT TTTCCACGCC TTGCAGGTAC

251 ATCGCCAAGC GTTCGATGCC GTAGGTGATT TCGCCGAGTA CGGGGGTGCA

301 GTCGATGCCG CCGACTTGTT GGAAATAGGT GAACTGGGTT ACTTCCATAC

351 CGTTGAGCCA GACTTCCCAG CCCAAACCCC ACGCGCCGAG GGTGGGGTTT

401 TCCCAGTCGT CTTCGACAAA GCGGATGTCG TGCACTTTGG GGTCGATGCC

451 CAATTCGCGC AGGGAGTCGA GATAGAGGTC TTGGATATTG GCGGGAGCGG

501 GCTTGAGGGC GACTTGGAAT TGGTAATAGT GTTGCAGGCG GTTGGGGTTG
```

-continued

```
551 TCGCCGTAGC GACCGTCTTT GGGGCGGCGG CTGGGTTGGA CGTAGGCGGC

601 AAACCAAGGC TCGGGGCCGA GTGCGCGCAG ACAGGTGGCG GGATGGGATG

651 TGCCGGCACC GACTTCCATG TCGAAGGGTT GGATGACGGT GCAGCCTTTG

701 TCTGCCCAGA ATGTTTGCAG TTTGAAGATG ATTTGTTGGA AGGTAAGCAT

751 GGCTTATGA
```

This corresponds to the amino acid sequence <SEQ ID 1138; ORF 277.a>:

a277.pep

```
  1 MPRFEDKLVG RQGEGGVFFG KQAFGLRFVV VELAQQPIGI AVFEVVGGLF

 51 DFVLVVHVAV SYCITVQRFC PNEVIDVFHA LQVHRQAFDA VGDFAEYGGA

101 VDAADLLEIG ELGYFHTVEP DFPAQTPRAE GGVFPVVFDK ADVVHFGVDA

151 QFAQGVEIEV LDIGGSGLEG DLELVIVLQA VGVVAVATVF GAAAGLDVGG

201 KPRLGAECAQ TGGGMGCAGT DFHVEGLDDG AAFVCPECLQ FEDDLLEGKH

251 GL*
```

m277/a277 92.5% identity in 252 aa overlap

```
                  10        20        30        40        50        60
m277.pep  MPRFEDKLVGRQGEGGVFFGKQAFGLRFVVVELAQQPVGIAVFEVVGGLLDFVLVVHVAV
          |||||||||||||||||||||||||||||||||||||:||||||||||||:|||||||||
a277      MPRFEDKLVGRQGEGGVFFGKQAFGLRFVVVELAQQPIGIAVFEVVGGLFDFVLVVHVAV
                  10        20        30        40        50        60

                  70        80        90       100       110       120
m277.pep  GDGVAVERFCPNEVVDVFYTLQVHRQAFDAVGDFAEYGRAVDAADLLEIGKLGYFHAVEP
          :  ::|:|||||||:|||::|||||||||||||||||| |||||||||||:|||||:|||
a277      SYCITVQRFCPNEVIDVFHALQVHRQAFDAVGDFAEYGGAVDAADLLEIGELGYFHTVEP
                  70        80        90       100       110       120

                 130       140       150       160       170       180
m277.pep  DFPAQTPRAEGGVFPVVFDKADVVDFGIDAQFAQRVEIEVLDIGGSGLEGDLELVIVLQA
          |||||||||||||||||||||||| ||:|||||| |||||||||||||||||||||||||
a277      DFPAQTPRAEGGVFPVVFDKADVVHFGVDAQFAQGVEIEVLDIGGSGLEGDLELVIVLQA
                 130       140       150       160       170       180

                 190       200       210       220       230       240
m277.pep  VGVVAVAAVFGAAAGLDVGGKPRLGAECAQAGGGMGCAGTDFHVEGLDDGAAFVCPECLQ
          |||||||:||||||||||||||||||||||:|||||||||||||||||||||||||||||
a277      VGVVAVATVFGAAAGLDVGGKPRLGAECAQTGGGMGCAGTDFHVEGLDDGAAFVCPECLQ
                 190       200       210       220       230       240

                 250
m277.pep  FEDDLLEGKHGLX
          |||||||||||||
a277      FEDDLLEGKHGLX
                 250
```

The following partial DNA sequence was identified in *N. gonorrhoeae* <SEQ ID 1139>:

g278.seq (partial)

```
  1 ttgcgtgcaa tcacgcccgg tgcgattttt tcgacagggg cggtcaaagt

 51 tgtattaatc ggacctttgc cgtcgatagg ccgacccaat gcatcgacga

101 cgcgtccgac caattcgcgt ccgaccggca cttctaaaat acggccggta

151 caggtaaccg tgtcgccttc tttaatatgt tcgtactcgc ccaacactac

201 ggcaccgacg gagtcgcgct ccaggttcat cgccaagcct aaagtgttac
```

-continued

```
251 ccgggaattc gagcatctca ccttgcattg catctgacaa accatggatg

301 cgaacgatac cgtcagttac cgaaatcacc gtaccacggg tactcacttc

351 ggcatttaca gacagatttt cgatcttggc tttaatcaga tcgctaattt

401 cagcaggatt aagctgcatg aaaactctcc taattcgtca tagtcgtgta

451 caaagcactc agtttgcctt gtacagacaa atccaaaacc tgatcaccca

501 cttcaacttt ta...
```

This corresponds to the amino acid sequence <SEQ ID 1140; ORF 278.ng>:

g278.pep (partial)

```
  1 LRAITPGAIF STGAVKVVLI GPLPSIGRPN ASTTRPTNSR PTGTSKIRPV

 51 QVTVSPSLIC SYSPNTTAPT ESRSRFIAKP KVLPGNSSIS PCIASDKPWM

101 RTIPSVTEIT VPRVLTSAFT DRFSILALIR SLISAGLSCM KTLLIRHSRV

151 QSTQFALYRQ IQNLITHFNF
```

The following partial DNA sequence was identified in *N. meningitidis* <SEQ ID 1141>:

m278.seq..

```
  1 TTGCGCGCAA TCACGCCCGG TGCGATTTTT TCGATAGGGG CGGTCAAAGT

 51 TGTATTAATC GGGCCTTTGC CGTCGATAGG CCGACCCAAT GCATCAACGA

101 CGCGTCCGAC CAGTTCGCGT CCGACCGGCA CTTCCAAGAT ACGACCGGTA

151 CAGGTAACCG TGTCGCCTTC TTTAATGTGT TCGTACTCGC CCAACACTAC

201 GGCGCCGACG GAGTCGCGCT CCAGGTTCAT CGCCAAGCCG AAAGTGTTAC

251 CCGGGAATTC GAGCATCTCA CCTTGCATTG CATCTGACAA ACCATGGATG

301 CGAACGATAC CGTCAGTTAC CGAAATTACC GTACCACAGG TACGCACTTC

351 GGCATTTACA GACAGATTTT CGATCTTGGC TTTAATCAAA TCGCTAATTT

401 CAGCAGGATT AAGCTGCATG AAAACTCTCC TAATTCGTCA TAGTCGTGTA

451 CAAGGCACTC AATTTGCCTT GTACAGACAA ATCCAAAACC TGATCACCCA

501 CTTCAACTTT TATGCCGCCA ATCAGCTCCG GTTCGATTTC GACAGAGATT

551 TTCAGCTCGC TGTCGAAACG CTTATTCAGC ATTTGCACCA ACTCGCCGAC

601 CTGTTTGTCG GTCAACGGAT AGGCACTGTA AATGACGGCA GATTTGATAT

651 GGTTGAATGA
```

This corresponds to the amino acid sequence <SEQ ID 1142; ORF 278>:

m278.pep

```
  1 LRAITPGAIF SIGAVKVVLI GPLPSIGRPN ASTTRPTSSR PTGTSKIRPV

 51 QVTVSPSLMC SYSPNTTAPT ESRSRFIAKP KVLPGNSSIS PCIASDKPWM

101 RTIPSVTEIT VPQVRTSAFT DRFSILALIK SLISAGLSCM KTLLIRHSRV
```

-continued

```
151 QGTQFALYRQ IQNLITHFNF YAANQLRFDF DRDFQLAVET LIQHLHQLAD

201 LFVGQRIGTV NDGRFDMVE*
```

Computer analysis of this amino acid sequence gave the following results:

Homology with a predicted ORF from *N. gonorrhoeae*

ORF 278 shows 95.9% identity over a 170 aa overlap with a predicted ORF (ORF 278.ng) from *N. gonorrhoeae*:

g278/m278

```
                    10        20        30        40        50        60
g278.pep    LRAITPGAIFSTGAVKVVLIGPLPSIGRPNASTTRPTNSRPTGTSKIRPVQVTVSPSLIC
            ||||||||||| ||||||||||||||||||||||||| :|||||||||||||||||||| :|
m278        LRAITPGAIFSIGAVKVVLIGPLPSIGRPNASTTRPTSSRPTGTSKIRPVQVTVSPSLMC
                    10        20        30        40        50        60

                    70        80        90       100       110       120
g278.pep    SYSPNTTAPTESRSRFIAKPKVLPGNSSISPCIASDKPWMRTIPSVTEITVPRVLTSAFT
            ||||||||||||||||||||||||||||||||||||||||||||||||||||:| |||||
m278        SYSPNTTAPTESRSRFIAKPKVLPGNSSISPCIASDKPWMRTIPSVTEITVPQVRTSAFT
                    70        80        90       100       110       120

                   130       140       150       160       170
g278.pep    DRFSILALIRSLISAGLSCMKTLLIRHSRVQSTQFALYRQIQNLITHFNF
            |||||||||:|||||||||||||||||||||:||||||||||||||||||
m278        DRFSILALIKSLISAGLSCMKTLLIRHSRVQGTQFALYRQIQNLITHFNFYAANQLRFDF
                   130       140       150       160       170       180


m278        DRDFQLAVETLIQHLHQLADLFVGQRIGTVNDGRFDMVE*
                   190       200       210
```

The following partial DNA sequence was identified in *N. meningitidis* <SEQ ID 1143>:

a278.seq

```
  1 TTGCGCGCAA TCACGCCCGG TGCGATTTTT TCGATAGGGG CGGTCAAAGT

 51 TGTATTAATC GGGCCTTTGC CGTCGATAGG CCGACCCAAT GCATCAACGA

101 CGCGTCCGAC CAGTTCGCGT CCGACCGGCA CTTCCAAGAT ACGACCGGTA

151 CAGGTAACCG TGTCGCCTTC TTTAATATGT TCGTGCTCGC CCAACACTAC

201 GGCGCCGACG GAGTCGCGCT CCAGGTTCAT CGCCAAGCCG AAAGTGTTAC

251 CCGGGAATTC GAGCATCTCA CCTTGCATTG CATCTGACAA ACCATGGATG

301 CGAACGATAC CGTCAGTTAC CGAAATCACC GTACCACGGG TACGCACTTC

351 GGCATTTACA GACAGATTTT CGATCTTGGC TTTAATCAAA TCGCTAATTT

401 CAGCAGGATT AAGCTGCATG AAAACTCTCC TAATTCGTCA TAGTCGTGTA

451 CAAGGCACTC AATTTGCCTT GTACAGACAA ATCCAAAACC TGATCACCCA

501 CTTCAACTTT TATGCCGCCA ATCAGCTCCG GTTCGATTTC GACAGAGATT

551 TTCAGCTCGC TGTCGAAACG CTTATTCAGC ATTTGCGCCA ACTCGCCGAC

601 CTGTTTGTCG GTCAACGGAT AGGCACTGTA AATGACGGCA GATTTGATAT

651 GGTTGAATGA
```

This corresponds to the amino acid sequence <SEQ ID 1144; ORF 278.a>:

a278.pep

```
  1 LRAITPGAIF SIGAVKVVLI GPLPSIGRPN ASTTRPTSSR PTGTSKIRPV
 51 QVTVSPSLIC SCSPNTTAPT ESRSRFIAKP KVLPGNSSIS PCIASDKPWM
101 RTIPSVTEIT VPRVRTSAFT DRFSILALIK SLISAGLSCM KTLLIRHSRV
151 QGTQFALYRQ IQNLITHFNF YAANQLRFDF DRDFQLAVET LIQHLRQLAD
201 LFVGQRIGTV NDGRFDMVE*
```

m278/a278 98.2% identity in 219 aa overlap

```
                   10        20        30        40        50        60
m278.pep   LRAITPGAIFSIGAVKVVLIGPLPSIGRPNASTTRPTSSRPTGTSKIRPVQVTVSPSLMC
           ||||||||||||||||||||||||||||||||||||||||||||||||||||||||||:|
a278       LRAITPGAIFSIGAVKVVLIGPLPSIGRPNASTTRPTSSRPTGTSKIRPVQVTVSPSLIC
                   10        20        30        40        50        60

                   70        80        90       100       110       120
m278.pep   SYSPNTTAPTESRSRFIAKPKVLPGNSSISPCIASDKPWMRTIPSVTEITVPQVRTSAFT
           | ||||||||||||||||||||||||||||||||||||||||||||||||||:|||||||
a278       SCSPNTTAPTESRSRFIAKPKVLPGNSSISPCIASDKPWMRTIPSVTEITVPRVRTSAFT
                   70        80        90       100       110       120

                  130       140       150       160       170       180
m278.pep   DRFSILALIKSLISAGLSCMKTLLIRHSRVQGTQFALYRQIQNLITHFNFYAANQLRFDF
           ||||||||||||||||||||||||||||||||||||||||||||||||||||||||||||
a278       DRFSILALIKSLISAGLSCMKTLLIRHSRVQGTQFALYRQIQNLITHFNFYAANQLRFDF
                  130       140       150       160       170       180

                  190       200       210       220
m278.pep   DRDFQLAVETLIQHLHQLADLFVGQRIGTVNDGRFDMVEX
           |||||||||||||||:||||||||||||||||||||||||
a278       DRDFQLAVETLIQHLRQLADLFVGQRIGTVNDGRFDMVEX
                  190       200       210       220
```

The following partial DNA sequence was identified in *N. gonorrhoeae* <SEQ ID 1145>:

g279.seq

```
  1 atgacgcgga tttgcggctg cttgatttca acggttttga gtgtttcggc
 51 aagtttgtcg gcggcgggtt tcatcaggct gcaatgggaa ggaacggata
101 ccggcagcgg cagggcgcgt ttggctccgg cttctttggc ggcagccatg
151 gtgcgtccga cggcggcggc gttgcctgca atcacgactt gtccgggcga
201 gttgaagttg acggcttcga ccacttcgcc ctgtgcggat tcggcacaaa
251 tctgcctgac ctgttcatct tccaaaccca aaatggccgc cattgcgcct
301 acgccttgcg gtacggcgga ctgcatcagt tcggcgcgca ggcggacgag
351 tttgacggca tcggcaaaat ccaatgcttc ggcggcgaca agcgcggtgt
401 attcgccgag gctgtgtccg gcaacggcgg caggcgtttt gccgcccact
451 tccaaatag
```

This corresponds to the amino acid sequence <SEQ ID 1146; ORF 279.ng>:

g279.pep

```
  1 MTRICGCLIS TVLSVSASLS AAGFIRLQWE GTDTGSGRAR LAPASLAAAM
 51 VRPTAAALPA ITTCPGELKL TASTTSPCAD SAQICLTCSS SKPKMAAIAP
```

-continued

```
101 TPCGTADCIS SARRRTSLTA SAKSNASAAT SAVYSPRLCP ATAAGVLPPT

151 SK*
```

The following partial DNA sequence was identified in *N. meningitidis* <SEQ ID 1147>:

m279.seq

```
  1 ATAACGCGGA TTTGCGGCTG CTTGATTTCA ACGGTTTTCA GGGCTTCGGC

 51 AAGTTTGTCG GCGGCGGGTT TCATCAGGCT GCAATGGGAA GGTACGGACA

101 CGGGCAGCGG CAGGGCGCGT TTGGCACCGG CTTCTTTGGC GGCAGCCATG

151 GCGCGTCCGA CGGCGGCGGC GTTGCCTGCA ATCACGATTT GTCCGGGTGA

201 GTTGAAGTTG ACGGCTTCGA CCACTTCGCT TTGGGCGGCT TCGGCACAAA

251 TGGCTTTAAC CTGCTCATCT TCCAAGCCGA GAATCGCCGC CATTGCGCCC

301 ACGCCTTGCG GTACGGCGGA CTGCATCAGT TCGGCGCGCA GGCGCACGAG

351 TTTGACCGCG TCGGCAAAAT TCAATGCGCC GGCGGCAACG AGTGCGGTGT

401 ATTCGCCGAG GCTGTGTCCG GCAACGGCGG CAGGCGTTTT GCCGCCCGCT

451 TCTAAATAG
```

This corresponds to the amino acid sequence <SEQ ID 1148; ORF 279>:

m279.pep

```
  1 ITRICGCLIS TVFRASASLS AAGFIRLQWE GTDTGSGRAR LAPASLAAAM

 51 ARPTAAALPA ITICPGELKL TASTTSLWAA SAQMALTCSS SKPRIAAIAP

101 TPCGTADCIS SARRRTSLTA SAKFNAPAAT SAVYSPRLCP ATAAGVLPPA

151 SK*
```

Computer analysis of this amino acid sequence gave the following results:

Homology with a predicted ORF from *N. gonorrhoeae*

ORF 279 shows 89.5% identity over a 152 aa overlap with a predicted ORF (ORF 279.ng) from *N. gonorrhoeae*:

```
                    10        20        30        40        50        60
m279.pep   ITRICGCLISTVFRASASLSAAGFIRLQWEGTDTGSGRARLAPASLAAAMARPTAAALPA
           :|||||||||||: :|||||||||||||||||||||||||||||||||||:|||||||||
g279       MTRICGCLISTVLSVSASLSAAGFIRLQWEGTDTGSGRARLAPASLAAAMVRPTAAALPA
                    10        20        30        40        50        60

                    70        80        90       100       110       120
m279.pep   ITICPGELKLTASTTSLWAASAQMALTCSSSKPRIAAIAPTPCGTADCISSARRRTSLTA
           || |||||||||||||  | |||: ||||||||::|||||||||||||||||||||||||
g279       ITTCPGELKLTASTTSPCADSDQICLTCSSSKPKMAAIAPTPCGTADCISSARRRTSLTA
                    70        80        90       100       110       120

                   130       140       150
m279.pep   SAKFNAPAATSAVYSPRLCPATAAGVLPPASKX
           ||| || ||||||||||||||||||||||:|||
g279       SAKSNASAATSAVYSPRLCPATAAGVLPPTSKX
                   130       140       150
```

The following partial DNA sequence was identified in *N. meningitidis* <SEQ ID 1149>:

a279.seq

```
  1 ATGACNCNGA TTTGCGGCTG CTTGATTTCA ACGGTTTNNA GGGCTTCGGC
 51 GAGTTTGTCG GCGGCGGGTT TCATGAGGCT GCAATGGGAA GGTACNGACA
101 CNGGCAGCGG CAGGGCGCGT TTGGCGCCGG CTTCTTTGGC CGCAAGCATA
151 GCGCGCTCGA CGGCGGCGGC ATTGCCTGCA ATCACGACTT GTCCGGGCGA
201 GTTGAAGTTG ACGGCTTCAA CCACTTCATC CTGTGCGGAT TCGGCGCAAA
251 TTTGTTTTAC CTGTTCATCT TCCAAGCCGA GAATCGCCGC CATTGCGCCC
301 ACGCCTTGCG GTACGGCGGA CTGCATCAGT TCGGCGCGCA NGCGCACGAG
351 TTTGACCGCG TCGGCAAAAT CCAATGCGCC GGCGGCAACN AGTGCGGTGT
401 ATTCGCCGAN GCTGTGTCCG GCAACGGCGG CAGGCGTTTT GCCGCCCGCT
451 TCCGAATAG
```

This corresponds to the amino acid sequence <SEQ ID 1150; ORF 279.a>:

a279.pep

```
  1 MTXICGCLIS TVXRASASLS AAGFMRLQWE GTDTGSGRAR LAPASLAASI
 51 ARSTAAALPA ITTCPGELKL TASTTSSCAD SAQICFTCSS SKPRIAAIAP
101 TPCGTADCIS SARXRTSLTA SAKSNAPAAT SAVYSPXLCP ATAAGVLPPA
151 SE*
```

m279/a279 88.2% identity in 152 aa overlap

```
                   10        20        30        40        50        60
m279.pep   ITRICGCLISTVFRASASLSAAGFIRLQWEGTDTGSGRARLAPASLAAAMARPTAAALPA
           :| ||||||||| |||||||||||:|||||||||||||||||||||||::|| |||||||
a279       MTXICGCLISTVXRASASLSAAGFMRLQWEGTDTGSGRARLAPASLAASIARSTAAALPA
                   10        20        30        40        50        60

                   70        80        90       100       110       120
m279.pep   ITICPGELKLTASTTSLWAASAQMALTCSSSKPRIAAIAPTPCGTADCISSARRRTSLTA
           || |||||||||||||  | |||: :||||||||||||||||||||||||||| ||||||
a279       ITTCPGELKLTASTTSSCADSAQICFTCSSSKPRIAAIAPTPCGTADCISSARXRTSLTA
                   70        80        90       100       110       120

                  130       140       150
m279.pep   SAKFNAPAATSAVYSPRLCPATAAGVLPPASKX
           ||| |||||||||||| ||||||||||||||:|
a279       SAKSNAPAATSAVYSPXLCPATAAGVLPPASEX
                  130       140       150
```

Expression of ORF 279

The primer described in Table 1 for ORF 279 was used to locate and clone ORF 279. ORF 279 was cloned in pET and pGex vectors and expressed in *E. coli* as above-described. The products of protein expression and purification were analyzed by SDS-PAGE. FIG. 2A shows the results of affinity purification and FIG. 2B shows the expression in *E. coli*. Purified GST-fusion protein was used to immunize mice whose sera were used for ELISA (positive result), FACS analysis (FIG. 2C), western blot (FIG. 2D). These experiments confirm that 279 is a surface-exposed protein and that it is a useful immunogen. The hydrophilicity plots, antigenic index, and amphipatic regions of ORF 279 are provided in FIG. 6. The AMPHI program is used to predict putative T-cell epitopes (Gao et al 1989, *J. Immunol* 143:3007; Roberts et al. 1996, *AIDS Res Human Retroviruses* 12:593; Quakyi et al. 1992, *Scand J Immunol Suppl* 11:9). The nucleic acid sequence of ORF 279 and the amino acid sequence encoded thereby is provided herein.

The following partial DNA sequence was identified in *N. gonorrhoeae* <SEQ ID 1151>:

g280.seq

```
  1 atgaaacacc tcaaacttac ccttattgcc gcattgctgg ccaccgccgc
 51 aactgccgca ccccttccgg ttgtaaccag tttcagcatt ttaggcgacg
101 tagccaaaca aatcggcggt gagcgcgtag ccgtacaaag cctcgtcgga
151 gccaaccaag atactcatgc ctatcacatg accagtggcg acattaaaaa
201 aatccgcagt gcaaaactcg tcctgctcaa cggcttggga cttgaagccg
251 ccgacatcca acgcgccgtc aaacagagca aagtatccta tgccgaagcg
301 accaaaggca tccaacccct caaagccgaa gaagaaggcg gacaccatca
351 cgaccaccat cacgaccacg atcatgacca cgaaggacac caccacgacc
401 acggcgaata tgacccccac gtctggaacg accctgttct tatgtccgac
451 tatgcccaaa acgtcgctga aaccctgata aaggccgatc ccgaaggcaa
501 agtttattat caacaacgct tgggcaacta ccaaatgcag cttaaaaaac
551 tgcacagcga cgcacaagcc gcatttaatg ccgtccctgc cgccaaacgc
601 aaagtcctga ccgggcacga cgcattttcc tacatgggca accgctacaa
651 catcagcttc atcgccccgc aaggcgtgag cagcgaagcc gagccgtccg
701 ccaaacaagt cgccgccatc atccggcaaa tcaaacgcga aggcatcaaa
751 gccgtattta ccgaaaatat caaagacacc cgcatggttg accgcatcgc
801 caaagaaacc ggcgtcaacg tcagcggcaa actgtattcc gacgcactcg
851 gcaacgcgcc cgcagacacc tacatcggca tgtaccgcca caacgtcgaa
901 gccttgacca acgcgatgaa gcaataa
```

This corresponds to the amino acid sequence <SEQ ID 1152; ORF 280.ng>:

g280.pep

```
  1 MKHLKLTLIA ALLATAATAA PLPVVTSFSI LGDVAKQIGG ERVAVQSLVG
 51 ANQDTHAYHM TSGDIKKIRS AKLVLLNGLG LEAADIQRAV KQSKVSYAEA
101 TKGIQPLKAE EEGGHHHDHH HDHDHDHEGH HHDHGEYDPH VWNDPVLMSD
151 YAQNVAETLI KADPEGKVYY QQRLGNYQMQ LKKLHSDAQA AFNAVPAAKR
201 KVLTGHDAFS YMGNRYNISF IAPQGVSSEA EPSAKQVAAI IRQIKREGIK
251 AVFTENIKDT RMVDRIAKET GVNVSGKLYS DALGNAPADT YIGMYRHNVE
301 ALTNAMKQ*
```

The following partial DNA sequence was identified in *N. meningitidis* <SEQ ID 1153>:

m280.seq

```
  1 ATGAAACACC TCAAACTCAC CCTTATTGCC GCATTGCTGA CCGCCTCCGC
 51 AACTGCCGCC CCCCTGCCGG TTGTAACCAG CTTCAGCATT TTAGGCGACG
101 TAGCCAAACA AATCGGCGGA GAGCGCGTAT CCATACAAAG TTTGGTCGGA
```

-continued

```
151 GCCAACCAAG ATACGCACGC CTATCATATG ACCAGTGGCG ACATTAAAAA

201 AATCCGCAGT GCAAAACTCG TCCTGCTCAA CGGCTTAGGA CTTGAAGCTG

251 CCGATGTGCA ACGCGCCGTC AAACAAAGCA AAGTATCCTA TACCGAAGCG

301 ACCAAAGGCA TCCAACCCCT CAAAGCCGAA GAAGAAGGCG GACACCATCA

351 CGACCACGAT CATGACCACG AAGGACACCA CCATGACCAC GGCGAATATG

401 ACCCGCACGT CTGGAACGAC CCCGTCCTTA TGTCCGCCTA TGCCCAAAAC

451 GTTGCCAAAG CCCTGATAAA GGCCGATCCC GAAGGCAAAG TTTATTATCA

501 ACAACGCTTG GGCAACTACC AAATGCAGCT CAAAAAACTG CACAGCGACG

551 CACAAGCCGC ATTTAATGCC GTCCCTGCTG CCAAACGCAA AGTCCTGACC

601 GGGCACGATG CCTTTTCCTA TATGGGCAAA CGTTACCATA TCGAATTCAT

651 CGCCCCGCAA GGCGTGAGCA GCGAAGCCGA GCCTTCGGCC AAACAAGTCG

701 CCGCCATCAT CCGACAAATC AAACGCGAAG GCATCAAAGC CGTCTTTACC

751 GAAAACATCA AGGACACCCG TATGGTTGAC CGTATCGCCA AAGAAACCGG

801 TGTCAACGTC AGCGGCAAAC TGTATTCCGA CGCACTCGGC AACGCGCCCG

851 CAGACACCTA CATCGGAATG TACCGCCACA ACATCAAAGC CTTGACCAAC

901 GCGATGAAGC AATAA
```

This corresponds to the amino acid sequence <SEQ ID 1154; ORF 280>:

m280.pep

```
  1 MKHLKLTLIA ALLTASATAA PLPVVTSFSI LGDVAKQIGG ERVSIQSLVG

 51 ANQDTHAYHM TSGDIKKIRS AKLVLLNGLG LEAADVQRAV KQSKVSYTEA

101 TKGIQPLKAE EEGGHHHDHD HDHEGHHHDH GEYDPHVWND PVLMSAYAQN

151 VAKALIKADP EGKVYYQQRL GNYQMQLKKL HSDAQAAFNA VPAAKRKVLT

201 GHDAFSYMGK RYHIEFIAPQ GVSSEAEPSA KQVAAIIRQI KREGIKAVFT

251 ENIKDTRMVD RIAKETGVNV SGKLYSDALG NAPADTYIGM YRHNIKALTN

301 AMKQ*
```

Computer analysis of this amino acid sequence gave the following results:

Homology with a predicted ORF from *N. gonorrhoeae*

ORF 280 shows 93.8% identity over a 308 aa overlap with a predicted ORF (ORF 280.ng) from *N. gonorrhoeae*:

m280/g280

```
                  10        20        30        40        50        60
m280.pep  MKHLKLTLIAALLTASATAAPLPVVTSFSILGDVAKQIGGERVSIQSLVGANQDTHAYHM
          |||||||||||||:::||||||||||||||||||||||||||||::||||||||||||||
g280      MKHLKLTLIAALLATAATAAPLPVVTSFSILGDVAKQIGGERVAVQSLVGANQDTHAYHM
                  10        20        30        40        50        60

                  70        80        90       100       110      119
m280.pep  TSGDIKKIRSAKLVLLNGLGLEAADVQRAVKQSKVSYTEATKGIQPLKAEEEGGHHHDH-
          |||||||||||||||||||||||||:|||||||||||:|||||||||||||||||||||
g280      TSGDIKKIRSAKLVLLNGLGLEAADIQRAVKQSKVSYAEATKGIQPLKAEEEGGHHHDHH
                  70        80        90       100       110       120
```

-continued

```
            120       130       140       150       160       170
m280.pep    ---DHDHEGHHHDHGEYDPHVWNDPVLMSAYAQNVAKALIKADPEGKVYYQQRLGNYQMQ
               ||||||||||||||||||||||||| ||||||::||||||||||||||||||||||
g280        HDHDHDHEGHHHDHGEYDPHVWNDPVLMSDYAQNVAETLIKADPEGKVYYQQRLGNYQMQ
                  130       140       150       160       170       180

            180       190       200       210       220       230
m280.pep    LKKLHSDAQAAFNAVPAAKRKVLTGHDAFSYMGKRYHIEFIAPQGVSSEAEPSAKQVAAI
            ||||||||||||||||||||||||||||||||||:||:| ||||||||||||||||||||
g280        LKKLHSDAQAAFNAVPAAKRKVLTGHDAFSYMGNRYNISFIAPQGVSSEAEPSAKQVAAI
                  190       200       210       220       230       240

            240       250       260       270       280       290
m280.pep    IRQIKREGIKAVFTENIKDTRMVDRIAKETGVNVSGKLYSDALGNAPADTYIGMYRGNIK
            ||||||||||||||||||||||||||||||||||||||||||||||||||||||||||::
g280        IRQIKREGIKAVFTENIKDTRMVDRIAKETGVNVSGKLYSDALGNAPADTYIGMYRGNVE
                  250       260       270       280       290       300

            300
m280.pep    ALTNAMKQX
            |||||||||
g280        ALTNAMKQX
```

The following partial DNA sequence was identified in *N. meningitidis* <SEQ ID 1155>:

a280.seq

```
  1 ATGAAACACC CCAAACTCAC CCTTATCGCC GCATTGCTGA CCACTGCCGC
 51 AACTGCCGCC CCCCTGCCGG TTGTAACCAG CTTCAGCATT TTAGGCGACG
101 TAGCCAAACA AATCGGCGGA GAGCGCGTAT CCATACAAAG TTTGGTCGGA
151 GCCAACCAAG ATACGCACGC CTATCATATG ACCAGCGGCG ACATTAAAAA
201 AATCCGCAGT GCAAAACTCG TCCTGATTAA CGGCTTAGGA CTTGAAGCTG
251 CCGACATCCA ACGTGCCGTC AAACAGAGCA AAGTATCCTA TGCCGAAGCG
301 ACCAAAGGCA TCCAACCCCT CAAAGCCGAA GAAGAAGGCG GACACCATCA
351 CGACCACGAT CATGACCACG ACCATGACCA CGAAGGACAC CACCACGACC
401 ACGGCGAATA TGACCCCCAC GTCTGGAACG ACCCCGTCCT TATGTCCGCC
451 TATGCCCAAA ACGTCGCCGA AGCCCTGATA AAGGCCGACC CCGAAGGCAA
501 AGTTTATTAT CAACAACGCT TGGGCAACTA CCAAATGCAG CTCAAAAAAC
551 TGCACAGTGA CGCACAAGCC GCATTTAATG CCGTCCCTGC CGCCAAACGC
601 AAAGTCCTGA CCGGGCACGA TGCCTTTTCC TATATGGGCA AACGTTACCA
651 TATCGAATTC ATCGCCCCAC AAGGTGTGAG CAGCGAAGCC GAGCCTTCAG
701 CCAAACAAGT CGCCGCCATC ATCCGACAAA TCAAACGCGA AGGCATCAAA
751 GCCGTATTTA CCGAAAATAT CAAAGACACC CGCATGGTTG ACCGCATCGC
801 CAAAGAAACC GGTGTCAACG TCAGCGGCAA ACTGTATTCC GACGCACTCG
851 GCAACGCACC CGCAGACACC TACATCGGCA TGTACCGCCA CAACATCAAA
901 GCCTTAACCA ACGCGATGAA GCAATAA
```

This corresponds to the amino acid sequence <SEQ ID 1156; ORF 280.a>:

a280.pep

```
  1 MKHPKLTLIA ALLTTAATAA PLPVVTSFSI LGDVAKQIGG ERVSIQSLVG
 51 ANQDTHAYHM TSGDIKKIRS AKLVLINGLG LEAADIQRAV KQSKVSYAEA
```

-continued

```
101 TKGIQPLKAE EEGGHHHDHD HDHDHDHEGH HHDHGEYDPH VWNDPVLMSA

151 YAQNVAEALI KADPEGKVYY QQRLGNYQMQ LKKLHSDAQA AFNAVPAAKR

201 KVLTGHDAFS YMGKRYHIEF IAPQGVSSEA EPSAKQVAAI IRQIKREGIK

251 AVFTENIKDT RMVDRIAKET GVNVSGKLYS DALGNAPADT YIGMYRHNIK

301 ALTNAMKQ*
```

m280/a280 96.4% identity in 308 aa overlap

```
                     10        20        30        40        50        60
m280.pep     MKHLKLTLIAALLTASATAAPLPVVTSFSILGDVAKQIGGERVSIQSLVGANQDTHAYHM
             ||| ||||||||||::||||||||||||||||||||||||||||||||||||||||||||
a280         MKHPKLTLIAALLTTAATAAPLPVVTSFSILGDVAKQIGGERVSIQSLVGANQDTHAYHM
                     10        20        30        40        50        60

                     70        80        90       100       110       120
m280.pep     TSGDIKKIRSAKLVLLNGLGLEAADVQRAVKQSKVSYTEATKGIQPLKAEEEGGHHHDHD
             |||||||||||||||:|||||||||:|||||||||||:||||||||||||||||||||||
a280         TSGDIKKIRSAKLVLINGLGLEAADIQRAVKQSKVSYAEATKGIQPLKAEEEGGHHHDHD
                     70        80        90       100       110       120

                        130       140       150       160       170
m280.pep     HDH----EGHHHDHGEYDPHVWNDPVLMSAYAQNVAKALIKADPEGKVYYQQRLGNYQMQ
             |||    |||||||||||||||||||||||||||||:|||||||||||||||||||||||
a280         HDHDHDHEGHHHDHGEYDPHVWNDPVLMSAYAQNVAEALIKADPEGKVYYQQRLGNYQMQ
                    130       140       150       160       170       180

              180       190       200       210       220       230
m280.pep     LKKLHSDAQAAFNAVPAAKRKVLTGHDAFSYMGKRYHIEFIAPQGVSSEAEPSAKQVAAI
             ||||||||||||||||||||||||||||||||||||||||||||||||||||||||||||
a280         LKKLHSDAQAAFNAVPAAKRKVLTGHDAFSYMGKRYHIEFIAPQGVSSEAEPSAKQVAAI
                    190       200       210       220       230       240

              240       250       260       270       280       290
m280.pep     IRQIKREGIKAVFTENIKDTRMVDRIAKETGVNVSGKLYSDALGNAPADTYIGMYRGNIK
             ||||||||||||||||||||||||||||||||||||||||||||||||||||||||||||
a280         IRQIKREGIKAVFTENIKDTRMVDRIAKETGVNVSGKLYSDALGNAPADTYIGMYRGNIK
                    250       260       270       280       290       300

              300
m280.pep     ALTNAMKQX
             |||||||||
a280         ALTNAMKQX
```

The following partial DNA sequence was identified in *N. gonorrhoeae* <SEQ ID 1157>:

g281.seq

```
  1 atgcactacg ccctcgcatc cgtcttctgc ctgtccctca gcgccgcacc

 51 cgtcggcgta ttcctcgtca tgcgccgtat gagcctgata ggcgacgcat

101 tgagccacgc cgtcctgccc ggtgccgccg tcggctacat gtttgccggc

151 ttgagcctgc ccgctatggg tgtgggcggg tttgccgccg gtatgctgat

201 ggcgctgctt gccggactcg tcagccgctt taccaccctg aaagaagatg

251 ccaactttgc cgccttttac ctgagcagcc tcgccatcgg cgtaatcctc

301 atcagcaaaa acggcagcag cgtcgattta ctccacctcc ttttcggatc

351 tgtgcttgcc gtcgatattc ccgcactgca actcatcgcc gccgtctccg

401 gcctcacgct cattaccctt gccgtcatct accgcccccct ggtgctagaa

451 agcatagacc cccttttcct caagtccgtc aacggcaaag gcgggctttg

501 gcacgtcatt ttcctcatcc tcgtcgttat gaacctcgta tccggcttcc

551 aagctctcgg catcctgatg tcggtcggaa ttatgatgct gcccgccatt

601 accgcccgtt tatgggcaag aaatatgggg acgctcattc tgttgtccgt
```

-continued

```
651 cctcatcgcc cttttttgcg gtttgatcgg gctgctcatt tcctaccaca
701 tcgaaatccc ttccggcccc gccatcatcc tctgttgcag cgtcctttat
751 ctttttttccg tcatactcgg caaagaaggc ggcatcttgc ccaaatggtt
801 caaaaaccac cgccaccaca ccacctga
```

This corresponds to the amino acid sequence <SEQ ID 1158; ORF 281.ng>:

g281.pep

```
  1 MHYALASVFC LSLSAAPVGV FLVMRRMSLI GDALSHAVLP GAAVGYMFAG
 51 LSLPAMGVGG FAAGMLMALL AGLVSRFTTL KEDANFAAFY LSSLAIGVIL
101 ISKNGSSVDL LHLLFGSVLA VDIPALQLIA AVSGLTLITL AVIYRPLVLE
151 SIDPLFLKSV NGKGGLWHVI FLILVVMNLV SGFQALGILM SVGIMMLPAI
201 TARLWARNMG TLILLSVLIA LFCGLIGLLI SYHIEIPSGP AIILCCSVLY
251 LFSVILGKEG GILPKWFKNH RHHTT*
```

The following partial DNA sequence was identified in *N. meningitidis* <SEQ ID 1159>:

m281.seq (partial)

```
  1 ATGCGCTACG CCCTCGCATC CGTCTTCTGC CTGTCCCTCA GTGCCGCACC
 51 CGTCGGCGTA TTCCTCGTCA TGCGCCGTAT GAGCCTGATA GGCGACGCAT
101 TGAGCCACGC CGTCCTGCCC GGTGCCGCCG TCGGCTACAT GTTTGCCGGC
151 TTGAGCCTGC CCGCCATGGG TTTGGGCGGC GTAGCCGCAG GCATGCTGAT
201 GGCACTGCTT GCCGGACTCG TCAGCCGCTT CACCACCCTG AAAGAAGATG
251 CCAACTTTGC CGCCTTTTAT CTCAGCAGCC TCGCCATCGG CGTAGTCCTC
301 GTCAGCAAAA ACGGGAGCAG CGTCGATTTG CTCCACCTCC TTTTCGGCTC
351 TGTACTTGCC GTCGATATTC CTGCCCTGCA GCTCATCGCC GCCGTCTCCA
401 GCCTCACGCT CATTACCCTT GCCGTCATCT ACCGCCCGCT CGTACTCGAA
451 AGCATCGACC CCCTGTTTCT CAAATCCGTC GGCGGCAAAG GCGGGCTTTG
501 GCACGTCCTC TTTCTCGTCC TGGTCGTCAT GAACCTCGTA TCCGGCTTTC
551 AAGCCCTCGG CACACTCATG TCCGTCGGAC TCATGATGCT GCCAGCCATT
601 ACCGCCCGCC TGTGGGCGAA GCATATGGGC GCACTCATCC TCCTATCCGT
651 TCTGACAGCC CTGCTGTGCG GCTTGAGCGG ACTGCTCATT TCCTACCACA
701 TCGAAATTCC TTCCGGTCCC GCCATCATCC TCTGTTGCAG CGTCCTTTAT
751 CTCTTTTCCG TCATACTCGG CAAAGAAGGC GGCATTCTGA CC..
```

This corresponds to the amino acid sequence <SEQ ID 1160; ORF 281>:

m281.pep (partial)

```
  1 MRYALASVFC LSLSAAPVGV FLVMRRMSLI GDALSHAVLP GAAVGYMFAG
 51 LSLPAMGLGG VAAGMLMALL AGLVSRFTTL KEDANFAAFY LSSLAIGVVL
```

-continued

```
101 VSKNGSSVDL LHLLFGSVLA VDIPALQLIA AVSSLTLITL AVIYRPLVLE

151 SIDPLFLKSV GGKGGLWHVL FLVLVVMNLV SGFQALGTLM SVGLMMLPAI

201 TARLWAKHMG ALILLSVLTA LLCGLSGLLI SYHIEIPSGP AIILCCSVLY

251 LFSVILGKEG GILT..
```

Computer analysis of this amino acid sequence gave the following results:

Homology with a predicted ORF from *N. gonorrhoeae*

ORF 281 shows 93.5% identity over a 263 aa overlap with a predicted ORF (ORF 281.ng) from *N. gonorrhoeae*:

m281/g281

```
                   10        20        30        40        50        60
m281.pep   MRYALASVFCLSLSAAPVGVFLVMRRMSLIGDALSHAVLPGAAVGYMFAGLSLPAMGLGG
           |:||||||||||||||||||||||||||||||||||||||||||||||||||||||||:||
g281       MHYALASVFCLSLSAAPVGVFLVMRRMSLIGDALSHAVLPGAAVGYMFAGLSLPAMGVGG
                   10        20        30        40        50        60

                   70        80        90       100       110       120
m281.pep   VAAGMLMALLAGLVSRFTTLKEDANFAAFYLSSLAIGVVLVSKNGSSVDLLHLLFGSVLA
            |||||||||||||||||||||||||||||||||||:|:|||||||||||||||||||
g281       FAAGMLMALLAGLVSRFTTLKEDANFAAFYLSSLAIGVILISKNGSSVDLLHLLFGSVLA
                   70        80        90       100       110       120

                  130       140       150       160       170       180
m281.pep   VDIPALQLIAAVSSLTLITLAVIYRPLVLESIDPLFLKSVGGKGGLWHVLFLVLVVMNLV
           ||||||||||||:|||||||||||||||||||||||||||:||||||||:||:|||||||
g281       VDIPALQLIAAVSGLTLITLAVIYRPLVLESIDPLFLKSVNGKGGLWHVIFLILVVMNLV
                  130       140       150       160       170       180

                  190       200       210       220       230       240
m281.pep   SGFQALGTLMSVGLMMLPAITARLWAKHMGALILLSVLTALLCGLSGLLISYHIEIPSGP
           |||||| |||||:|||||||||||||::||:||||||| ||:||| ||||||||||||||
g281       SGFQALGILMSVGIMMLPAITARLWARNMGTLILLSVLIALFCGLIGLLISYHIEIPSGP
                  190       200       210       220       230       240

                  250       260
m281.pep   AIILCCSVLYLFSVILGKEGGILT
           ||||||||||||||||||||||
g281       AIILCCSVLYLFSVILGKEGGILPKWLKNHRHHTTX
                  250       260       270
```

The following partial DNA sequence was identified in *N. meningitidis* <SEQ ID 1161>:

a281.seq

```
  1 ATGCGCTACG CCCTCGCATC CGTCTTCTGC CTGTCCCTCA GTGCCGCACC

 51 CGTCGGCGTA TTCCTCGTCA TGCGCCGTAT GAGCCTGATA GGCGACGCAT

101 TGAGCCACGC CGTCCTGCCC GGTGCCGCCG TCGGCTACAT GTTTGCCGGC

151 TTAAGCCTGC CCGCCATGGG TTTGGGCGGC GTAGCCGCAG GTATGCTGAT

201 GGCACTGCTT GCCGGACTCG TCAGCCGCTT CACCACCCTG AAAGAAGATG

251 CCAACTTTGC CGCCTTTTAT CTCAGCAGCC TCGCCATCGG TGTAGTCCTC

301 GTCAGCAAAA ACGGCAGCAG CGTCGATTTG CTCCACCTCC TTTTCGGCTC

351 CGTACTTGCC GTCGATATTC CTGCCCTGCA ACTCATCGCC GCCGTATCCA

401 CCCTCACACT GCTTACCCTT GCCGTCATCT ACCGCCCGCT CGTACTCGAA

451 AGCATCGACC CCCTGTTTCT CAAATCTGTC GGCGGCAAAG GCGGGCTTTG

501 GCACGTCCTC TTTCTCGTCC TGGTCGTCAT GAACCTCGTA TCCGGCTTTC

551 AAGCCCTCGG CACACTCATG TCCGTCGGAC TTATGATGCT GCCAGCCATT
```

-continued

```
601 ACCGCCCGCC TATGGGCGAA GCACATGGGC GCACTCATCC TCCTATCCGT

651 TCTGACAGCC CTGCTGTGCC GCTTGAGCGG ACTGCTCATT TCCTACCACA

701 TCGAAATTCC TTCCGGTCCC GCCATCATCC TCTGTTGCAG CGTCCTTTAT

751 CTCTTTTCCG TCATACTCGG CAAAGAAGGC GGCATTCTGA CCAAATGGCT

801 CAAAAACCAC CGCCACCACA CCACCTGA
```

This corresponds to the amino acid sequence <SEQ ID 1162; ORF 281.a>:

a281.pep

```
  1 MRYALASVFC LSLSAAPVGV FLVMRRMSLI GDALSHAVLP GAAVGYMFAG

 51 LSLPAMGLGG VAAGMLMALL AGLVSRFTTL KEDANFAAFY LSSLAIGVVL

101 VSKNGSSVDL LHLLFGSVLA VDIPALQLIA AVSTLTLLTL AVIYRPLVLE

151 SIDPLFLKSV GGKGGLWHVL FLVLVVMNLV SGFQALGTLM SVGLMMLPAI

201 TARLWAKHMG ALILLSVLTA LLCGLSGLLI SYHIEIPSGP AIILCCSVLY

251 LFSVILGKEG GILTKWLKNH RHHTT*
```

m281/a281 99.2% identity in 264 aa overlap

```
                  10        20        30        40        50        60
m281.pep  MRYALASVFCLSLSAAPVGVFLVMRRMSLIGDALSHAVLPGAAVGYMFAGLSLPAMGLGG
          ||||||||||||||||||||||||||||||||||||||||||||||||||||||||||||
a281      MRYALASVFCLSLSAAPVGVFLVMRRMSLIGDALSHAVLPGAAVGYMFAGLSLPAMGLGG
                  10        20        30        40        50        60

                  70        80        90       100       110       120
m281.pep  VAAGMLMALLAGLVSRFTTLKEDANFAAFYLSSLAIGVVLVSKNGSSVDLLHLLFGSVLA
          ||||||||||||||||||||||||||||||||||||||||||||||||||||||||||||
a281      VAAGMLMALLAGLVSRFTTLKEDANFAAFYLSSLAIGVVLVSKNGSSVDLLHLLFGSVLA
                  70        80        90       100       110       120

                 130       140       150       160       170       180
m281.pep  VDIPALQLIAAVSSLTLITLAVIYRPLVLESIDPLFLKSVGGKGGLWHVLFLVLVVMNLV
          ||||||||||||:|||:|||||||||||||||||||||||||||||||||||||||||||
a281      VDIPALQLIAAVSTLTLLTLAVIYRPLVLESIDPLFLKSVGGKGGLWHVLFLVLVVMNLV
                 130       140       150       160       170       180

                 190       200       210       220       230       240
m281.pep  SGFQALGTLMSVGLMMLPAITARLWAKHMGALILLSVLTALLCGLSGLLISYHIEIPSGP
          ||||||||||||||||||||||||||||||||||||||||||||||||||||||||||||
a281      SGFQALGTLMSVGLMMLPAITARLWAKHMGALILLSVLTALLCGLSGLLISYHIEIPSGP
                 190       200       210       220       230       240

                 250       260
m281.pep  AIILCCSVLYLFSVILGKEGGILT
          ||||||||||||||||||||||||
a281      AIILCCSVLYLFSVILGKEGGILTKWLKNHRHHTTX
                 250       260       270
```

The following partial DNA sequence was identified in *N. gonorrhoeae* <SEQ ID 1163>:

g282.seq

```
  1 atgggattgg gtatggaaat cggcaagctg attgtggctc ttttggtgct

 51 gatcaatccg tttagcgcgt tgtcgcttta ccttgacctg accaacggac

101 acagcacgaa ggagcgcagg aaggtcgcgc ggacggccgc cgtcgccgtg

151 tttgccgtga ttgcggtatt tgcgctgatc ggcggtgcgc tattgaaggt

201 tttgggcatc agcgtcggtt cgtttcaggt cggcggcggg attttggtgc
```

-continued

```
251 tgctgatcgc catttcgatg atgaacggca acgacaatcc cgccaagcag
301 aatctcggcg cgcagccgga aacggggcaa gcgcgccccg cccgcaatgc
351 aggggcgatt gccgtcgtgc ccatcgccat accgatcacc atcggtccgg
401 gcggtatttc gactgtgatt atttatgctt cggcagccaa aacgtacagc
451 gatatcgcgc tgattatcgc ggccggtttg gtggtcagtg cgatttgtta
501 tgccatttta atcgttgccg ggaaggtcag ccgcctgctg ggcgcgacgg
551 ggctgacgat tttaaaccgc attatgggta tgatgctggc ggcggtatcg
601 gtggagatta ttgtgtcggg actgaaaacg atattcccgc aactggcagg
651 ttga
```

This corresponds to the amino acid sequence <SEQ ID 1164; ORF 282.ng>:

g282.pep

```
  1 MGLGMEIGKL IVALLVLINP FSALSLYLDL TNGHSTKERR KVARTAAVAV
 51 FAVIAVFALI GGALLKVLGI SVGSFQVGGG ILVLLIAISM MNGNDNPAKQ
101 NLGAQPETGQ ARPARNAGAI AVVPIAIPIT IGPGGISTVI IYASAAKTYS
151 DIALIIAAGL VVSAICYAIL IVAGKVSRLL GATGLTILNR IMGMMLAAVS
201 VEIIVSGLKT IFPQLAG*
```

The following partial DNA sequence was identified in *N. meningitidis* <SEQ ID 1165>:

m282.seq

```
  1 ATGGGATTGG GCATGGAAAT CGGCAAGCTG ATTGTGGCTT TTTTGGTGCT
 51 GATTAATCCG TTTAGCGCGT TGTCGCTTTA CCTTGACCTG ACCAACGGGC
101 ACAGCACGAA GGAGCGCAGG AAGGTCGCGC GGACGGCCGC CGTTGCCGTG
151 TTTGCCGTGA TTGCGGTATT TGCGCTGATC GGCGGTACGC TGCTGAAGGT
201 TTTGGGCATC AGCGTCGGTT CGTTTCAGGT CGGCGGCGGG ATTTTGGTGC
251 TGCTGATCGC CATTTCGATG ATGAACGGCA ACGACAATCC CGCCAAGCAG
301 AATCTCGGCG CGCAGCCGGA AACGGGGCAG GCGCGCCCCG CCCGCAATGC
351 CGGAGCGATT GCCGTCGTGC CCATCGCCAT ACCGATCACC ATCGGCCCGG
401 GCGGTATTTC GACCGTGATT ATTTACGCTT CGGCGGCTAA AACATACGGC
451 GACATCGCGT TGATTATCGC GGCCGGTTTG GTGGTCAGTG CGATTTGTTA
501 TGCCATTTTA ATCGTTGCCG GGAAGGTCAG CCGCCTGCTG GGCGCGACGG
551 GGCTGACGAT TTTAAACCGC ATTATGGGTA TGATGCTGGC GGCGGTATCG
601 GTGGAGATTA TTGTGTCGGG ACTGAAAACG ATATTCCCGC AACTGGCAGG
651 TTGA
```

This corresponds to the amino acid sequence <SEQ ID 1166; ORF 282.ng>:

m282.pep

```
  1 MGLGMEIGKL IVAFLVLINP FSALSLYLDL TNGHSTKERR KVARTAAVAV
 51 FAVIAVFALI GGTLLKVLGI SVGSFQVGGG ILVLLIAISM MNGNDNPAKQ
101 NLGAQPETGQ ARPARNAGAI AVVPIAIPIT IGPGGISTVI IYASAAKTYG
151 DIALIIAAGL VVSAICYAIL IVAGKVSRLL GATGLTILNR IMGMMLAAVS
201 VEIIVSGLKT IFPQLAG*
```

Computer analysis of this amino acid sequence gave the following results:

Homology with a predicted ORF from *N. gonorrhoeae*

ORF 282 shows 98.6% identity over a 217 aa overlap with a predicted ORF (ORF 282.ng) from *N. gonorrhoeae*:

m282/g282

```
                   10        20        30        40        50        60
m282.pep    MGLGMEIGKLIVAFLVLINPFSALSLYLDLTNGHSTKERRKVARTAAVAVFAVIAVFALI
            |||||||||||||:||||||||||||||||||||||||||||||||||||||||||||||
g282        MGLGMEIGKLIVALLVLINPFSALSLYLDLTNGHSTKERRKVARTAAVAVFAVIAVFALI
                   10        20        30        40        50        60

                   70        80        90       100       110       120
m282.pep    GGTLLKVLGISVGSFQVGGGILVLLIAISMMNGNDNPAKQNLGAQPETGQARPARNAGAI
            ||:|||||||||||||||||||||||||||||||||||||||||||||||||||||||||
g282        GGALLKVLGISVGSFQVGGGILVLLIAISMMNGNDNPAKQNLGAQPETGQARPARNAGAI
                   70        80        90       100       110       120

                  130       140       150       160       170       180
m282.pep    AVVPIAIPITIGPGGISTVIIYASAAKTYGDIALIIAAGLVVSAICYAILIVAGKVSRLL
            |||||||||||||||||||||||||||||:||||||||||||||||||||||||||||||
g282        AVVPIAIPITIGPGGISTVIIYASAAKTYSDIALIIAAGLVVSAICYAILIVAGKVSRLL
                  130       140       150       160       170       180

                  190       200       210
m282.pep    GATGLTILNRIMGMMLAAVSVEIIVSGLKTIFPQLAGX
            ||||||||||||||||||||||||||||||||||||||
g282        GATGLTILNRIMGMMLAAVSVEIIVSGLKTIFPQLAGX
                  190       200       210
```

The following partial DNA sequence was identified in *N. meningitidis* <SEQ ID 1167>:

a282.seq

```
  1 ATGGGATTGG GCATGGAAAT CGGCAAGCTG ATTGTGGCTT TTTTGGTGCT
 51 GATTAATCCG TTTAGCGCGT TGTCGCTTTA CCTTGACCTG ACCAACGGGC
101 ACAGCACGAA GGAGCGCAGG AAGGTCGCGC GGACGGCCGC CGTTGCCGTG
151 TTTGCCGTGA TTGCGGTATT TGCGCTGATC GGCGGTACGC TGCTGAAGGT
201 TTTGGGCATC AGCGTCGGTT CGTTTCAGGT CGGCGGCGGA ATTTTGGTGT
251 TGCTGATTGC CATTTCGATG ATGAACGGCA ACGACAATCC CGCCAAGCAG
301 AATCTCGGCG CGCAGCCGGA AACGGGGCAG GTGCGCCCCG CCCGCAATGC
351 CGGAGCGATT GCCGTCGTGC CCATCGCCAT ACCGATCACC ATCGGCCCGG
401 GCGGTATTTC GACCGTGATT ATTTACGCTT CGGCGGCTAA AACATACGGC
451 GACATCGCGT TGATTATCGC GGCCGGTTTG GTGGTCAGTG CGATTTGTTA
501 TGCCATTTTA ATCGTTGCCG GGAAGGTCAG GCGCCTGCTG GGTGCGACGG
551 GGCTGACGAT TTTAAACCGT ATCATGGGTA TGATGCTGGC GGCGGTATCG
601 GTGGAGATTA TTGTGTCGGG ACTGAAAATG ATATTCCCGC AACTGGCAGG
651 TTGA
```

This corresponds to the amino acid sequence <SEQ ID 1168; ORF 282.a>:

a282.pep

```
  1 MGLGMEIGKL IVAFLVLINP FSALSLYLDL TNGHSTKERR KVARTAAVAV

 51 FAVIAVFALI GGTLLKVLGI SVGSFQVGGG ILVLLIAISM MNGNDNPAKQ

101 NLGAQPETGQ VRPARNAGAI AVVPIAIPIT IGPGGISTVI IYASAAKTYG

151 DTALIIAAGL VVSAICYAIL IVAGKVSRLL GATGLTILNR IMGMMLAAVS

201 VEIIVSGLKM IFPQLAG*
```

m282/a282 99.1% identity in 217 aa overlap

```
                    10        20        30        40        50        60
m282.pep  MGLGMEIGKLIVAFLVLINPFSALSLYLDLTNGHSTKERRKVARTAAVAVFAVIAVFALI
          ||||||||||||||||||||||||||||||||||||||||||||||||||||||||||||
a282      MGLGMEIGKLIVAFLVLINPFSALSLYLDLTNGHSTKERRKVARTAAVAVFAVIAVFALI
                    10        20        30        40        50        60

                    70        80        90       100       110       120
m282.pep  GGTLLKVLGISVGSFQVGGGILVLLIAISMMNGNDNPAKQNLGAQPETGQARPARNAGAI
          |||||||||||||||||||||||||||||||||||||||||||||||||||:||||||||
a282      GGTLLKVLGISVGSFQVGGGILVLLIAISMMNGNDNPAKQNLGAQPETGQVRPARNAGAI
                    70        80        90       100       110       120

                   130       140       150       160       170       180
m282.pep  AVVPIAIPITIGPGGISTVIIYASAAKTYGDIALIIAAGLVVSAICYAILIVAGKVSRLL
          ||||||||||||||||||||||||||||||||||||||||||||||||||||||||||||
a282      AVVPIAIPITIGPGGISTVIIYASAAKTYGDIALIIAAGLVVSAICYAILIVAGKVSRLL
                   130       140       150       160       170       180

                   190       200       210
m282.pep  GATGLTILNRIMGMMLAAVSVEIIVSGLKTIFPQLAGX
          ||||||||||||||||||||||||||||| ||||||||
a282      GATGLTILNRIMGMMLAAVSVEIIVSGLKMIFPQLAGX
                   190       200       210
```

The following partial DNA sequence was identified in *N. gonorrhoeae* <SEQ ID 1169>:

g283.seq

```
  1 atgaactttg ctttatccgt catcacattt accctcgcct ctttcctgcc

 51 cgtcccgcct gccggaaccg ccgtctttac ttggaaagac ggcggcggca

101 acagctattc ggatgtgccg aaacagcttc atcccgacca gagccaaatc

151 ctcaacctgc ggacgctcca aaccaaaccg gcggtcaagc ccaaacctgc

201 cgtcgatacg aatgcggaca gtgcgaagga aaacgaaaag gatatcgccg

251 agaaaaacgg gcagcttgag gaagaaaaga aaaaaattgc cgaaaccgaa

301 cggcagaaca aagaagaaaa ctgccggatt tcaaaaatga acctgaaggc

351 ggtgggaaac tcaaatgcga aaaacaagga tgatttgatc cgtaaataca

401 ataacgccgt aaacaaatac tgccgttaa
```

This corresponds to the amino acid sequence <SEQ ID 1170; ORF 283.ng>:

g283.pep

```
  1 MNFALSVITF TLASFLPVPP AGTAVFTWKD GGGNSYSDVP KQLHPDQSQI

 51 LNLRTLQTKP AVKPKPAVDT NADSAKENEK DIAEKNGQLE EEKKKIAETE

101 RQNKEENCRI SKMNLKAVGN SNAKNKDDLI RKYNNAVNKY CR*
```

The following partial DNA sequence was identified in *N. meningitidis* <SEQ ID 1171>:

m283.seq

```
  1 ATGAACTTTG CTTTATCCGT CATTATGTTG ACCCTCGCCT CTTTCCTGCC
 51 CGTCCCGCCT GCCGGAGCCG CCGTCTTTAC TTGGAAGGAC GGCGGCGGCA
101 ACAGCTATTC GGATGTACCG AAACAGCTTC ATCCCGACCA AAGCCAAATC
151 TTAAACCTGC GGACGCGCCA AACCAAACCG GCGGTCAAAC CCGCCCAAGC
201 CGACGCAGGG AAGCGCACAG ACGGCGCGGC ACAGGAAAAC AATCCCGACA
251 CTGCCGAGAA AAACCGGCAG CTTGAGGAAG AAAAGAAAAG AATTGCCGAA
301 ACCGAACGGC AGAACAAAGA AGAAAACTGC CGGATTTCAA AAATGAACCT
351 GAAGGCGGTG GGAAATTCAA ATGCAAAAAA CAAGGATGAT TTGATTCGGA
401 AATACAATAA CGCCGTAAAC AAATACTGCC GTTAA
```

This corresponds to the amino acid sequence <SEQ ID 1172; ORF 283>:

m283.pep

```
  1 MNFALSVIML TLASFLPVPP AGAAVFTWKD GGGNSYSDVP KQLHPDQSQI
 51 LNLRTRQTKP AVKPAQADAG KRTDGAAQEN NPDTAEKNRQ LEEEKKRIAE
101 TERQNKEENC RISKMNLKAV GNSNAKNKDD LIRKYNNAVN KYCR*
```

Computer analysis of this amino acid sequence gave the following results:

Homology with a predicted ORF from *N. gonorrhoeae* m283/g283 86.1% identity in 144 aa overlap

```
                    10        20        30        40        50        60
m283.pep    MNFALSVIMLTLASFLPVPPAGAAVFTWKDGGGNSYSDVPKQLHPDQSQILNLRTRQTKP
            |||||||| :||||||||||||:|||||||||||||||||||||||||||||||| ||||
g283        MNFALSVITFTLASFLPVPPAGTAVFTWKDGGGNSYSDVPKQLHPDQSQILNLRTLQTKP
                    10        20        30        40        50        60

                    70        80        90       100       110       120
m283.pep    AVKPAQADAGKRTDGAAQENNPDTAEKNRQLEEEKKRIAETERQNKEENCRISKMNLKAV
            ||||  | :   :| :|:||: | |||| |||||||||||||||||||||||||||||||
g283        AVKPKPA-VDTNAD-SAKENEKDIAEKNGQLEEEKKRIAETERQNKEENCRISKMNLKAV
                     70         80        90       100       110

                   130       140
m283.pep    GNSNAKNKDDLIRKYNNAVNKYCRX
            |||||||||||||||||||||||||
g283        GNSNAKNKDDLIRKYNNAVNKYCRX
           120       130       140
```

The following partial DNA sequence was identified in *N. meningitidis* <SEQ ID 1173>:

a283.seq

```
  1 ATGAACTTTG CTTTATCCGT CATTATGTTG ACCCTCGCCT CTTTCCTGCC
 51 CGTCCCGCCT GCCGGAGCCG CCGTCTTTAC TTGGAAGGAC GGCGGCGGCA
101 ACAGCTATTC GGATGTACCG AAACAGCTTC ATCCCGACCA AAGCCAAATC
151 TTAAACCTGC GGACGCGCCA AACCAAACCG GCGGTCAAAC CCGCCCAAGC
```

-continued

```
201 CGACGCAGGG AAGCGCACAG ACGGCGCGGC ACAGGAAAAC AATCCCGACA

251 CTGCCGAGAA AAACCGGCAG CTTGAGGAAG AAAAGAAAAG AATTGCCGAA

301 ACCGAACGGC AGAACAAAGA AGAAAACTGC CGGATTTCAA AAATGAACCT

351 GAAAGCGGTG GGAAATTCAA ATGCAAAAAA CAAGGATGAT TTGATTCGGA

401 AATACAATAA CGCCGTAAAC AAATACTGCC GTTAA
```

This corresponds to the amino acid sequence <SEQ ID 1174; ORF 283.a>:

a283.pep

```
  1 MNFALSVIML TLASFLPVPP AGAAVFTWKD GGGNSYSDVF KQLHPDQSQI

 51 LNLRTRQTKP AVKPAQADAG KRTDGAAQEN NPDTAEKNRQ LEEEKKRIAE

101 TERQNKEENC RISKMNLKAV GNSNAKNKDD LIRKYNNAVN KYCR*
```

m283/a283 100.0% identity in 144 aa overlap

```
                  10        20        30        40        50        60
m283.pep  MNFALSVIMLTLASFLPVPPAGAAVFTWKDGGGNSYSDVPKQLHPDQSQILNLRTRQTKP
          ||||||||||||||||||||||||||||||||||||||||||||||||||||||||||||
a283      MNFALSVIMLTLASFLPVPPAGAAVFTWKDGGGNSYSDVPKQLHPDQSQILNLRTRQTKP
                  10        20        30        40        50        60

                  70        80        90       100       110       120
m283.pep  AVKPAQADAGKRTDGAAQENNPDTAEKNRQLEEEKKRIAETERQNKEENCRISKMNLKAV
          ||||||||||||||||||||||||||||||||||||||||||||||||||||||||||||
a283      AVKPAQADAGKRTDGAAQENNPDTAEKNRQLEEEKKRIAETERQNKEENCRISKMNLKAV
                  70        80        90       100       110       120

                 130       140
m283.pep  GNSNAKNKDDLIRKYNNAVNKYCRX
          |||||||||||||||||||||||||
a283      GNSNAKNKDDLIRKYNNAVNKYCRX
                 130       140
```

The following partial DNA sequence was identified in *N. gonorrhoeae* <SEQ ID 1175>:

g284.seq.

```
  1 atgccgtctg aaactcgaaa tcggtttcag acggcattgg tttacgcggc

 51 aggttggggc ttagcggtct ttgtaacggc attcgctttt gcctgcaaaa

101 gagtcgccgg ctttgcgttt gcctttgaag ccttcgccgg ttttttgaa

151 actgtctttc ttaaagcctt ctttcttgaa accttcgccg cgcgttttgc

201 cgccgaagcc ttctttgccc ggtttatgat cgccgcgccg gccgccggat

251 ttcctatcgc cccagccgcc tttgcctttc ggcttgccgc ctgcggattt

301 gcgtttgcgg gccggctcca tgccttcgat ggtcagttcg ggcagtttgc

351 ggttaatgta tttttcgatt ttgtggactt tgacgtattc gttcacttcg

401 gcaaacgtaa tcgcaatacc cgtgcggcct gcgcggccgg tgcgcccgat

451 gcggtggacg tagtcttccg cctgtttcgg caggtcgtag tttatgacgt

501 gggtaatggt cggtacgtca ataccgcgtg cggcaacgtc ggtggcaacc

551 aaaattttgc agcggccttt acgcaaatcc gtcagcgtgc ggttgcgcca
```

-continued

```
601 gccctgcggc atatcgccgt gcaggcagtt ggcggcgaaa cctttctcgt

651 acaattcatc cgcgatgact tcggtcatcg ctttggtgga cgtgaaaatc

701 acacattggt cgatgttggc atcgcgcagg atgtggtcga gcaggcggtt

751 tttgtggcgc atatcgtcgc agtacaacaa ctgctcttcg attttgcctt

801 ggccgtccac gcgttcgact tcgataattt cagagtcttt ggtcagtttg

851 cgcgccagtt tgccgactgc gccgtcccaa gtggcggaga acaataa
```

This corresponds to the amino acid sequence <SEQ ID 1176; ORF 284.ng>:

g284.pep

```
  1 MPSETRNRFQ TALVYAAGWG LAVFVTAFAF ACKRVAGFAF AFEAFAGFFE

 51 TVFLKAFFLE TFAARFAAEA FFARFMIAAP AAGFPIAPAA FAFRLAACGF

101 AFAGRLHAFD GQFGQFAVNV FFDFVDFDVF VHFGKRNRNT RAACAAGAPD

151 AVDVVFRLFR QVVVYDVGNG RYVNTACGNV GGNQNFAAAF TQIRQRAVAP

201 ALRHIAVQAV GGETFFVQFI RDDFGHRFGG RENHTLVDVG IAQDVVEQAV

251 FVAHIVAVQQ LLFDFALAVH AFDFDNFRVF GQFARQFADC AVPSGGEQ*
```

The following partial DNA sequence was identified in *N. meningitidis* <SEQ ID 1177>:

m284.seq..

```
  1 ATGCCGTCTG AAACTCGAAA TCGGTTTCAG ACGGCATTGG TTTATGCGGC

 51 AGGTTGGGCC TTAGCGGTCT TTGTAACGGC GTTCGCCTTT GCCTGCAAAA

101 GAATCGCCGG CTTTGCGTTT GCCTTTGAAG CCTTCGCCGG TTTTTTTGAA

151 ACCGTCTCTC TTAAAGCCTT CTTTCTTGAA ACCTTCGCCG CGCGTTTTGC

201 CGCCGAAGCC TTCTTTGCTC GGTTTATGAT CGCCGCGCCA ACCGCCGGAT

251 TTACGATCGC CCCAGCCGCC TTTGCCTTTC GGCTTGCCGC CTGCGGATTT

301 GCGTTTGCGG GTCGGTTCCA TGCCTTCGAT GGTCAGTTCG GGCAGTTTTC

351 GGTTAATGTA TTTTTCGATT TTGTGGACTT TGACGTATTC GTTCACTTCG

401 GCAAACGTAA TCGCAATACC CGTGCGGCCT GCGCGGCCGG TGCGCCCGAT

451 GCGGTGGACG TAGTCTTCCG CCTGTTTCGG CAGGTCGTAG TTGATAACGT

501 GGGTAATGGT CGGTACGTCG ATACCGCGTG CGGCAACATC GGTGGCAACC

551 AAAATTTTGC AGCGGCCTTT ACGCAAATCC ATCAGCGTGC GGTTGCGCCA

601 GCCTTGCGGC ATATCGCCGT GCAGGCAGTT TGCGGCGAAA CCTTTTTCGT

651 ACAGTTCATC CGCAATGACT TCGGTCATGG CTTTGGTGGA CGTGAAAATC

701 ACGCATTGAT CGATATTGGC ATCGCGCAAG ATATGATCGA GCAGGCGGTT

751 TTTGTGGCGC ATATCGTCGC AGTACAGCAG TTGTTCTTCG ATTTTGCCTT

801 GATCGTCCAC GCGTTCGACT TCGATGATTT CAGGGTCTTT GGTCAGTTTG

851 CGCGCCAGTT TGCCGACCGC GCCGTCCCAA GTGGCGGAGA ACAACAAAGT

901 CTGACGGTCG CTCGGCGTTG CTTCCACGAT GGTTTCGATG TCGTCGATAA

951 AGCCCATATC CAACATACGG TCGGCTTCGT CCAAAATCAG CACTTCCAAA
```

-continued

```
1001 CGTTCAAAAT CAACTTTGCC GCTTTGCATC AGGTCCATCA GACGGCCCGG

1051 CGTGGCGACA ATCAGATCGA CCGGTTTGCT CAGGGCACGG GTTTGGTAGC

1101 CGAAAGACGC GCCGCCGACG ATGCTGACGG TGCGGAACCA ACGCATATTT

1151 TTGGCATACG CCAGCGCGTT TTTCTCGACT TGAGCCGCCA GTTCGCGGGT

1201 CGGGGTCAAC ACCAAAGCAC GCGGGCCTTT GCCCGGTTTT TCGCTGCGTT

1251 TGGTCAGTTT TTGCAAAGTC GGTAA
```

This corresponds to the amino acid sequence <SEQ ID 1178; ORF 284>:

```
m284.pep

  1 MPSETRNRFQ TALVYAAGWG LAVFVTAFAF ACKRIAGFAF AFEAFAGFFE

 51 TVSLKAFFLE TFAARFAAEA FFARFMIAAP TAGFTIAPAA FAFRLAACGF

101 AFAGRFHAFD GQFGQFSVNV FFDFVDFDVF VHFGKRNRNT RAACAAGAPD

151 AVDVVFRLFR QVVVDNVGNG RYVDTACGNI GGNQNFAAAF TQIHQRAVAP

201 ALRHIAVQAV CGETFFVQFI RNDFGHGFGG RENHALIDIG IAQDMIEQAV

251 FVAHIVAVQQ LFFDFALIVH AFDFDDFRVF GQFARQFADR AVPSGGEQQS

301 LTVARRCFHD GFDVVDKAHI QHTVGFVQNQ HFQTFKINFA ALHQVHQTAR

351 RGDNQIDRFA QGTGLVAERR AADDADGAEP THIFGIRQRV FLDLSRQFAG

401 RGQHQSTRAF ARFFAAFGQF LQSR*
```

Computer analysis of this amino acid sequence gave the following results:

Homology with a predicted ORF from *N. gonorrhoeae*
m284/g284 92.3% identity in 298 aa overlap

```
                     10        20        30        40        50        60
m284.pep    MPSETRNRFQTALVYAAGWGLAVFVTAFAFACKRIAGFAFAFEAFAGFFETVSLKAFFLE
            ||||||||||||||||||||||||||||||||||:||||||||||||||||| |||||||
G284        MPSETRNRFQTALVYAAGWGLAVFVTAFAFACKRVAGFAFAFEAFAGFFETVFLKAFFLE
                     10        20        30        40        50        60

                     70        80        90       100       110       120
m284.pep    TFAARFAAEAFFARFMIAAPTAGFTIAPAAFAFRLAACGFAFAGRFHAFDGQFGQFSVNV
            ||||||||||||||||||||:||| ||||||||||||||||||||:||||||||||:|||
g284        TFAARFAAEAFFARFMIAAPAAGFPIAPAAFAFRLAACGFAFAGRLHAFDGQFGQFAVNV
                     70        80        90       100       110       120

                    130       140       150       160       170       180
m284.pep    FFDFVDFDVFVHFGKRNRNTRAACAAGAPDAVDVVFRLFRQVVVDNVGNGRYVDTACGNI
            |||||||||||||||||||||||||||||||||||||||||||| :|||||||:|||||:
g284        FEDFVDFDVFVHFGKRNRNTRAACAAGAPDAVDVVFRLFRQVVVYDVGNGRYVNTACGNV
                    130       140       150       160       170       180

                    190       200       210       220       230       240
m284.pep    GGNQNFAAAFTQIHQRAVAPALRHIAVQAVCGETFFVQFIRNDFGHGFGGRENHALIDIG
            |||||||||||||:|||||||||||||||| ||||||||||:|||| |||||||:|:|:|
g284        GGNQNFAAAFTQIRQRAVAPALRHIAVQAVGGETFFVQFIRDDFGHRFGGRENHTLVDVG
                    190       200       210       220       230       240

                    250       260       270       280       290       300
m284.pep    IAQDMIEQAVFVAHIVAVQQLFFDFALIVHAFDFDDFRVFGQFARQFADRAVPSGGEQQS
            ||||::|||||||||||||||:||||| |||||||:||||||||||||| |||||||||
g284        IAQDVVEQAVFVAHIVAVQQLLFDFALAVHAFDFDNFRVFGQFARQFADCAVPSGGEQX
                    250       260       270       280       290

                    310       320       330       340       350       360
m284.pep    LTVARRCFHDGFDVVDKAHIQHTVGFVQNQHFQTFKINFAALHQVHQTARRGDNQIDRFA
```

The following partial DNA sequence was identified in *N. meningitidis* <SEQ ID 1179>:

a284.seq

```
   1 ATGCCGTCTG AAACTCGAAA TCGGTTTCAG ACGGCATTGG TTTATGCGGC
  51 AGGTTGGGGC TTAGCGGTCT TTGTAACGGC GTTCGCCTTT GCCTGCAAAA
 101 GAATCGCCGG CTTTGCGTTT GCCTTTGAAG CCTTCGCCGG TTTTTTTGAA
 151 ACCGTCTCTC TTAAAGCCTT CTTTCTTGAA ACCTTCGCCG CGCGTTTTGC
 201 CGCCGAAGCC TTCTTTGCTC GGTTTATGAT CGCCGCGCCA ACCGCCGGAT
 251 TTACGATCGC CCCAGCCGCC TTTGCCTTTC GGCTTGCCGC CTGCGGATTT
 301 GCGTTTGCGG GTCGGTTCCA TGCCTTCGAT GGTCAGTTCG GGCAGTTTTC
 351 GGTTAATGTA TTTTTCGATT TTGTGGACTT TGACGTATTC GTTCACTTCG
 401 GCAAACGTAA TCGCAATACC CGTGCGGCCT GCGCGGCCGG TGCGCCCGAT
 451 GCGGTGGACG TAGTCTTCCG CCTGTTTCGG CAGGTCGTAG TTGATAACGT
 501 GGGTAATGGT CGGTACGTCG ATACCGCGTG CGGCAACGTC GGTGGCAACC
 551 AAAATTTTGC AGCGGCCTTT GCGCAAATCC ATCAGCGTGC GGTTGCGCCA
 601 GCCTTGCGGC ATATCGCCGT GCAGGCAGTT GGCGGCGAAA CCTTTTTCGT
 651 ACAATTCATC CGCGATGACT TCGGTCATGG CTTTGGTGGA CGTGAAAATC
 701 ACGCATTGAT CGATGTCGGC ATCGCGCAAG ATATGATCGA GCAGGCGGTT
 751 TTTGTGGCGC ATATCGTCGC AGTACAGCAG TTGTTCTTCG ATTTTGCCTT
 801 GGTCGTCCAC GCGTTCGACT TCGATGATTT CAGGGTCTTT GGTCAGTTTG
 851 CGCGCCAGTT TGCCGACCGC GCCGTCCCAA GTGGCGGAGA ACAACAAAGT
 901 CTGACGGTCT TCCGGCGTGG CTTCGACGAT GGTTTCGATG TCGTCGATAA
 951 AGCCCATATC CAACATACGG TCGGCTTCGT CCAAAATCAG CACTTCCAAG
1001 CGGGCGAAAT CGACTTTGCC GCTTTGCATC AAGTCCATCA GACGGCCCGG
1051 CGTGGCGACA ATCAGATCGA CCGGTTTGCT CAGGGCGCGG GTTTGGTAGC
1101 CGAACGATGC ACCACCGACG ATGCTGACGG TACGGAACCA ACGCATATTT
1151 TTGGCATACG CCAGCGCGTT TTTCTCGACT TGAGCCGCCA ATTCGCGGGT
1201 CGGCGTCAAC ACCAACGCGC GCGGGCCTTT GCCCGGTTTT TCGCTGCGTT
1251 TGGTCAGTCG CTGCAAAGTC GGTAA
```

This corresponds to the amino acid sequence <SEQ ID 1180; ORF 284.a>:

a284.pep

```
   1 MPSETRNRFQ TALVYAAGWG LAVFVTAFAF ACKRIAGFAF AFEAFAGFFE
  51 TVSLKAFFLE TFAARFAAEA FFARFMIAAP TAGFTIAPAA FAFRLAACGF
 101 AFAGRFHAFD GQFGQFSVNV FFDFVDFDVF VHFGKRNRNT RAACAAGAPD
 151 AVDVVFRLFR QVVVDNVGNG RYVDTACGNV GGNQNFAAAF AQIHQRAVAP
 201 ALRHIAVQAV GGETFFVQFI RDDFGHGFGG RENHALIDVG IAQDMIEQAV
 251 FVAHIVAVQQ LFFDFALVVH AFDFDDFRVF GQFARQFADR AVPSGGEQQS
 301 LTVFRRGFDD GFDVVDKAHI QHTVGFVQNQ HFQAGEIDFA ALHQVHQTAR
 351 RGDNQIDRFA QGAGLVAERC TTDDADGTEP THIFGIRQRV FLDLSRQFAG
 401 RRQHQRARAF ARFFAAFGQS LQSR*
```

m284/a284 94.8% identity in 424 aa overlap

```
                10        20        30        40        50        60
m284.pep  MPSETRNRFQTALVYAAGWGLAVFVTAFAFACKRIAGFAFAFEAFAGFFETVSLKAFFLE
          ||||||||||||||||||||||||||||||||||||||||||||||||||||||||||||
a284      MPSETRNRFQTALVYAAGWGLAVFVTAFAFACKRIAGFAFAFEAFAGFFETVSLKAFFLE
                10        20        30        40        50        60

                70        80        90       100       110       120
m284.pep  TFAARFAAEAFFARFMIAAPTAGFTIAPAAFAFRLAACGFAFAGRFHAFDGQFGQFSVNV
          ||||||||||||||||||||||||||||||||||||||||||||||||||||||||||||
a284      TFAARFAAEAFFARFMIAAPTAGFTIAPAAFAFRLAACGFAFAGRFHAFDGQFGQFSVNV
                70        80        90       100       110       120

               130       140       150       160       170       180
m284.pep  FFDFVDFDVFVHFGKRNRNTRAACAAGAPDAVDVVFRLFRQVVVDNVGNGRYVDTACGNI
          |||||||||||||||||||||||||||||||||||||||||||||||||||||||||||:
a284      FEDFVDFDVFVHFGKRNRNTRAACAAGAPDAVDVVFRLFRQVVVDNVGNGRYVDTACGNV
               130       140       150       160       170       180

               190       200       210       220       230       240
m284.pep  GGNQNFAAAFTQIHQRAVAPALRHIAVQAVCGETFFVQFIRNDFGHGFGGRENHALIDIG
          ||||||||||:|||||||||||||||||||| ||||||||||:|||||||||||||||:|
a284      GGNQNFAAAFAQIHQRAVAPALRHIAVQAVGGETFFVQFIRDDFGHGFGGRENHALIDVG
               190       200       210       220       230       240

               250       260       270       280       290       300
m284.pep  IAQDMIEQAVFVAHIVAVQQLFFDFALIVHAFDFDDFRVFGQFARQFADRAVPSGGEQQS
          |||||||||||||||||||||||||||:||||||||||||||||||||||||||||||||
a284      IAQDMIEQAVFVAHIVAVQQLFFDFALVVHAFDFDDFRVFGQFARQFADRAVPSGGEQQS
               250       260       270       280       290       300

               310       320       330       340       350       360
m284.pep  LTVARRCFHDGFDVVDKAHIQHTVGFVQNQHFQTFKINFAALHQVHQTARRGDNQIDRFA
          ||| || | ||||||||||||||||||||||||: :|:||||||||||||||||||||||
a284      LTVFRRGFDDGFDVVDKAHIQHTVGFVQNQHFQAGEIDFAALHQVHQTARRGDNQIDRFA
               310       320       330       340       350       360

               370       380       390       400       410       420
m284.pep  QGTGLVAERRAADDADGAEPTHIFGIRQRVFLDLSRQFAGRGQHQSTRAFARFFAAFGQF
          ||:||||||  ::|||||:||||||||||||||||||||||| ||| :||||||||||||
a284      QGAGLVAERCTTDDADGTEPTHIFGIRQRVFLDLSRQFAGRRQHQRARAFARFFAAFGQS
               370       380       390       400       410       420

m284.pep  LQSRX
          |||||
a284      LQSRX
```

The following partial DNA sequence was identified in *N. gonorrhoeae* <SEQ ID 1181>:

g285.seq

```
  1 atgaccgata ccacaccgac agataccgat ccgaccgaaa acggcacgcg
 51 caaaatgccg tctgaacacc gccccgcccc gccggcaaaa aaacgccgcc
101 cgctgctgaa gctgtcggcg gcactgctgt ctgtcctgat tttggcagta
151 tgtttcctcg gctggatcgc cggtacggaa gcaggtttgc gcttcgggct
201 gtaccaaatc ccgtcctggt tcggcgtaaa catttcctcc caaaacctca
251 aaggcacact gctcgacggc ttcgacggcg acaactggtc gatagaaacc
301 gagggggcag accttaaaat cagccgcttc cgcttcgcgt ggaaaccgtc
351 cgaactgatg cgccgcagcc tgcacatcac cgacatctcc gccggcgaca
401 tcgccatcgt aaccaaaccg actccgccta aagaagaacg cccgcctcaa
451 ggcctgcccg acagcataga cctgcccgcc gctgtctatc tcgaccgctt
501 cgagacgggc aaaatcagca tgggcaaaac ctttgacaaa caaaccgtct
551 atctcgaacg cctcaacgcg gcataccgtt acgaccgtaa agggcaccgc
601 ctcgacctga aggccgccga cacgccgtgg agcagttcgt cggggtcagc
651 ctcggtcggc ttgaaaaaac cgtttgccct cgataccgcc atttacacca
701 aaggcggatt cgaaggcgaa accatacaca gtacggcgcg gctgagcggc
```

-continued 751 agcctgaagg atgtgcgcgc cgaactgacg atcgacggcg gcaatatccg 801 cctctcggga aaatccgtca tccacccgtt tgccgaatca ttggataaaa 851 cattggaaga agtactggtc aaaggattca acatcaatcc gtccgccttc 901 gtgccttccc tgcccgatgc cgggctgaat ttcgacctga ccgccatccc 951 gtcgttttca gacggcatcg cgctggaagg ctcgctcgat ttggaaaaca 1001 ccaaagccgg ctttgccgac cgcaacggca tccccgtccg tcaggttttg 1051 ggcggctttg tcatccggca ggacggcacg gtgcatatcg gcaatacgtc 1101 cgccgccctg ctcggacggg gcggcatcag gctgtcgggc aaaatcgaca 1151 ccgaaaaaga catccttgat ttaaatatag gcatcaactc cgtcggcgcg 1201 gaagacgtgc tgcaaaccgc gttcaaaggc aggttggacg gcagcatcgg 1251 catcggcggc acgaccgcct cgcccaaaat ctcttggcaa ctcggcaccg 1301 gcacggcacg cacggacggc agcctcccca tcgcaagcga ccccgcaaac 1351 gaacagcgga aactggtgtt cgacaccgtc aacatctccg ccggggaagg 1401 cagcctgacc gcgcaaggct atctcgagct gtttaaagac cgcctgctca 1451 agctggacat ccgttcccgc gcattcgacc cttcgcgcat cgatccgcaa 1501 tttccggcag gcaatatcaa cggttcgatt catcttgccg gtgaactggc 1551 aaaagagaaa tttacgggca aaatgcgttt tttgcccggt acgttcaacg 1601 gcgtgccgat tgccggcagc gccgacattg tttacgagtc ccgccacctt 1651 ccgcgcgccg ccgtcgattt gcggttgggg cggaacatcg tcaaaacaga 1701 cggcggcttc ggcaaaaaag gcgaccggct taacctcaat atcaccgcac 1751 ccgatttatc ccgtttcggt ttcggactcg cggggtcttt aaatgtacgc 1801 ggacaccttt ccggcgattt ggacggcggc atccgaacct ttgaaaccga 1851 cctttccggc acggcgcgca acttacacat cggcaaagcg gcagacatcc 1901 gttcgctcga ttttaccctc aaaggctcac ccggcacaag ccgcccgatg 1951 cgcgccgata tcaagggcgg ccgcctttcc ctgtcgggcg gcgcggcggt 2001 tgtcgatacc gccggcctga cgctggaagg tacgggcgcg cagcaccgca 2051 tccgcacaca cgccgccatg acgctggacg gcaaaccgtt caaactcgat 2101 ttggacgctt caggcggcat caacagggaa cttacccgat ggaaaggcag 2151 catcggcatc ctcgacatcg gcggcgcatt caacctcaag ctgcaaaacc 2201 gtatgacgct cgaagccggt gcggaacacg tggcggcaag tgcggcaaat 2251 tggcaggcaa tgggcggcag cctcaacctg caacactttt cttgggacag 2301 gaaaaccggc atatcggcaa aaggcggcgc acgcggcctg cacatcgccg 2351 agttgcacaa tttcttcaaa ccgcccttcg aacacaatct ggttttaaac 2401 ggcgactggg atgtcgccta cgggcacaac gcgcgcggct acctcaatat 2451 cagccggcaa agcggcgatg ccgtattgcc cggcgggcag gctttgggtt 2501 tgaacgcatt ttccctgaaa acgcgctttc aaaacgaccg catcggaatc 2551 ctgcttgacg gcggcgcgcg tttcggacgg attaacgccg atttgggcat 2601 cggcaacgcc ttcggcggca atatggcaaa tacaccgctc ggcggcagga 2651 ttacagcctc ccttcccgac ttgggcgcat tgaagccctt tctgcccgcc 2701 gccgcgcaaa acattaccgg cagcctgaat gcctccgcgc aaatcggcgg -continued 2751 acgggtaggc tctccgtccg tcaatgccgc cgtcaacggt agcagcaact
2801 acgggaaaat caacggcaat atcaccgtcg ggcaaagccg ctccttcgat
2851 accgcacctt tgggcggcag gctcaacctg accgttgccg atgccgaagc
2901 attccgcaac ttcctaccgg tcggacaaac cgtcaaaggc agcctgaatg
2951 ccgccgtaac cctcggcggc agcatcgccg acccgcactt gggcggcagt
3001 atcaacggcg acaagctcta ttaccgcaac caaacccaag gcatcatctt
3051 ggacaacggc tcgctgcgtt cgcatattgc aggcaggaaa tgggtaatcg
3101 acagcctgaa attccggcac gaagggacgg cggaactctc cggcacggtc
3151 agcatggaaa acagcgtgcc cgatgtcgat atcggcgcgg tgttcgacaa
3201 ataccgcatc ctgtcccgcc ccaaccgccg cctgacggtt tccggcaaca
3251 cccgcctgcg ctattcgccg caaaaaggca tatccgttac cggtatgatt
3301 aaaactgatc aggggctgtt cggttcgcaa aaatcctcga tgccgtccgt
3351 cggcgacgat gtcgtcgtat tgggcgaagt caagaaagag gcggcggcat
3401 cgctccccgt caatatgaac ctgactttag acctcaatga cggcatccgc
3451 ttctccggct acggcgcgga cgttaccata ggcggcaaac tgaccctgac
3501 cgcgcaaccg ggcggaaatg tgcgtggggt gggcacggtc cgcgtcatca
3551 aagggcgtta caaagcatac gggcaggatt tagacattac caaaggcaca
3601 gtctcctttg tcggcccgct caacgacccc aacctgaaca tccgcgccga
3651 acgccgcctt tcccccgtcg gtgcgggcgt ggaaatattg ggcagcctca
3701 acagcccgcg cattacgctg acggcaaacg aaccgatgag tgaaaaagac
3751 aagctctcct ggctcatcct caaccgtgcc ggcagcggca gcagcggcga
3801 caatgccgcc ctgtccgcag ccgcaggcgc gctgcttgcc gggcaaatca
3851 acgaccgcat cgggctggtg gatgatttgg gctttaccag caagcgcagc
3901 cgcaacgcgc aaaccggcga actcaacccc gccgaacagg tgctgaccgt
3951 cggcaaacaa ctgaccggca aactctacat cggctacgaa tacggcatct
4001 ccagcgcgga acagtccgtc aaactgattt accggctgac ccgcgccata
4051 caggcggttg cccgtatcgg cagccgttcg tcgggcggcg agctgacata
4101 caccatacgt ttcgaccgcc tcttcggttc ggacaaaaaa gactccgcag
4151 gaaacggcaa agggaaataa This corresponds to the amino acid sequence <SEQ ID 1182; ORF 285.ng>:

g285.pep

1 MTDTTPTDTD PTENGTRKMP SEHRPAPPAK KRRPLLKLSA ALLSVLILAV
51 CFLGWIAGTE AGLRFGLYQI PSWFGVNISS QNLKGTLLDG FDGDNWSIET
101 EGADLKISRF RFAWKPSELM RRSLHITDIS AGDIAIVTKP TPPKEERPPQ
151 GLPDSIDLPA AVYLDRFETG KISMGKTFDK QTVYLERLNA AYRYDRKGHR
201 LDLKAADTPW SSSSGSASVG LKKPFALDTA IYTKGGFEGE TIHSTARLSG
251 SLKDVRAELT IDGGNIRLSG KSVIHPFAES LDKTLEEVLV KGFNINPSAF

-continued

```
301 VPSLPDAGLN FDLTAIPSFS DGIALEGSLD LENTKAGFAD RNGIPVRQVL
351 GGFVIRQDGT VHIGNTSAAL LGRGGIRLSG KIDTEKDILD LNIGINSVGA
401 EDVLQTAFKG RLDGSIGIGG TTASPKISWQ LGTGTARTDG SLPIASDPAN
451 EQRKLVFDTV NISAGEGSLT AQGYLELFKD RLLKLDIRSR AFDPSRIDPQ
501 FPAGNINGSI HLAGELAKEK FTGKMRFLPG TFNGVPIAGS ADIVYESRHL
551 PRAAVDLRLG RNIVKTDGGF GKKGDRLNLN ITAPDLSRFG FGLAGSLNVR
601 GHLSGDLDGG IRTFETDLSG TARNLHIGKA ADIRSLDFTL KGSPGTSRPM
651 RADIKGGRLS LSGGAAVVDT AGLTLEGTGA QHRIRTHAAM TLDGKPFKLD
701 LDASGGINRE LTRWKGSIGI LDIGGAFNLK LQNRMTLEAG AEHVAASAAN
751 WQAMGGSLNL QHFSWDRKTG ISAKGGARGL HIAELHNFFK PPFEHNLVLN
801 GDWDVAYGHN ARGYLNISRQ SGDAVLPGGQ ALGLNAFSLK TRFQNDRIGI
851 LLDGGARFGR INADLGIGNA FGGNMANTPL GGRITASLPD LGALKPFLPA
901 AAQNITGSLN ASAQIGGRVG SPSVNAAVNG SSNYGKINGN ITVGQSRSFD
951 TAPLGGRLNL TVADAEAFRN FLPVGQTVKG SLNAAVTLGG SIADPHLGGS
1001 INGDKLYYRN QTQGIILDNG SLRSHIAGRK WVIDSLKFRH EGTAELSGTV
1051 SMENSVPDVD IGAVFDKYRI LSRPNRRLTV SGNTRLRYSP QKGISVTGMI
1101 KTDQGLFGSQ KSSMPSVGDD VVVLGEVKKE AAASLPVNMN LTLDLNDGIR
1151 FSGYGADVTI GGKLTLTAQP GGNVRGVGTV RVIKGRYKAY GQDLDITKGT
1201 VSFVGPLNDP NLNIRAERRL SPVGAGVEIL GSLNSPRITL TANEPMSEKD
1251 KLSWLILNRA GSGSSGDNAA LSAAAGALLA GQINDRIGLV DDLGFTSKRS
1301 RNAQTGELNP AEQVLTVGKQ LTGKLYIGYE YGISSAEQSV KLIYRLTRAI
1351 QAVARIGSRS SGGELTYTIR FDRLFGSDKK DSAGNGKGK*
```

The following partial DNA sequence was identified in *N. meningitidis* <SEQ ID 1183>:

m285.seq

```
  1 ATGACCGATA CCGCACCGAC AGATACCGAT CCGACCGAAA ACGGCACGCG
 51 CAAAATGCCG TCTGAACACC GCCCTACCCC GCCGGCAAAA AAACGCCGCC
101 CGTTGCTGAA GCTGTCGGCG GCACTGCTGT CTGTCCTGAT TTTGGCAGTA
151 TGTTTCCTCG GCTGGCTCGC CGGTACGGAA GCAGGTTTGC GCTTCGGGCT
201 GTACCAAATC CCGTCTTGGT TCGGCGTAAA CATTTCCTCC CAAAACCTCA
251 AAGGCACGCT GCTCGACGGC TTCGACGGCG ACAACTGGTC GATAGAAACC
301 GAGGGGGCAG ACCTTAAAAT CAGCCGCTTC CGCTTCGCGT GGAAACCGTC
351 CGAACTGATG CGCCGCAGCC TGCACATTAC CGAAATTTCC GCCGGCGACA
401 TCGCCATCGT TACCAAACCG ACTCCGCCTA AAGAAGAACG CCCGCCGCTC
451 AGCCTTCCCG ACAGCATAGA CCTGCCTGCC GCCGTCTATC TCGACCGCTT
501 CGAGACGGGC AAAATCAGCA TGGGCAAAGC CTTTGACAAA CAAACCGTCT
551 ATCTCGAACG GCTGGATGCT TCATACCGTT ACGACCGCAA AGGACACCGC
601 CTTGACCTGA AGGCCGCCGA CACGCCGTGG AGCAGTTCGT CGGGGGCGGC
651 CTCGGTCGGC TTGAAAAAAC CGTTTGCCCT CGATACCGCC ATTTACACCA
```

-continued

```
701 AAGGCGGACT CGAAGGCAAA ACCATACACA GTACGGCTCG GCTGAGCGGC
751 AGCCTGAAGG ATGTGCGCGC CGAACTGGCG ATCGACGGCG GCAATATCCG
801 CCTCTCGGGA AAATCCGTCA TCCACCCGTT TGCCGAATCA TTGGATAAAA
851 CATTGGAAGA AGTACTGGTC AAAGGGTTCA ACATCAATCC GGCCGCCTTC
901 GTGCCTTCCC TGCCCGATGC CGGACTGAAT TTCGACCTGA CCGCCATCCC
951 GTCGTTTTCA GACGGCATCG CGCTGGAAGG TTCGCTCGAT TTGGAAAACA
1001 CCAAAGCCGG CTTTGCCGAC CGCAACGGCA TCCCCGTCCG TCAGGTTTTA
1051 GGCGGCTTTG TCATCCGGCA GGACGGCACG GTGCATATCG GCAATACGTC
1101 CGCCGCCCTG CTCGGACGGG GCGGCATCAG GCTGTCGGGC AAAATCGACA
1151 CCGAAAAAGA CATCCTCGAT TTAAATATAG GCATCAACTC CGTCGGCGCG
1201 GAAGACGTAC TGCAAACCGC GTTCAAAGGC AGGTTGGACG GCAGCATCGG
1251 CATCGGTGGC ACGACCGCCT CGCCCAAAAT CTCTTGGCAA CTCGGCATCG
1301 GCACGGCGCG CACGGACGGC AGCCTCGCCA TTGCAAGCGA CCCAGCAAAC
1351 GGACAGCGGA AACTGGTGCT CGACACCGTC AACATCGCCG CCGGGCAAGG
1401 CAGCCTGACC GCGCAAGGCT ATCTCGAGCT GTTTAAAGAC CGCCTGCTCA
1451 AGCTGGACAT CCGTTCCCGC GCATTCGACC CTTCGCGCAT CGATCCGCAA
1501 CTTCCGGCAG GCAATATCAA CGGCTCAATA AACCTTGCCG GCGAACTGGC
1551 AAAAGAGAAA TTCACAGGCA AAATGCGGTT TTTACCCGGC ACGTTCAACG
1601 GCGTACCGAT TGCCGGCAGT GCCGACATTG TTTACGAGTC CCGCCACCTT
1651 CCGCGTGCCG CCGTCGATTT GCGGCTGGGG CGGAACATTA TTAAAACAGA
1701 CGGCGGCTTC GGCAAAAAAG GCGACCGGCT TAACCTCAAT ATCACCGCAC
1751 CCGATTTATC CCGTTTCGGT TTCGGACTCG CGGGGTCTTT AAATGTACGC
1801 GGACACCTTT CCGGTGATTT GGACGGCGGC ATCCGAACCT TTGAAACCGA
1851 CCTTTCCGGC GCGGCGCGCA ACCTGCACAT CGGCAAGGCG GCAGACATCC
1901 GTTCGCTCGA TTTCACGCTC AAAGGTTCGC CCGACACAAG CCGCCCGATA
1951 CGCGCCGACA TCAAAGGCAG CCGCCTTTCG CTGTCGGGCG GAGCGGCGGT
2001 TGTCGATACC GCCGACCTGA TGCTGGACGG CACGGGCGTG CAGCACCGCA
2051 TCCGCACACA CGCCGCCATG ACGCTGGATG GCAAACCGTT CAAATTCGAT
2101 TTGGACGCTT CAGGCGGCAT CAACAGGGAA CTTACCCGAT GGAAAGGCAG
2151 CATCGGCATC CTCGACATCG GCGGCGCATT CAACCTCAAG CTGCAAAACC
2201 GTATGACGCT CGAAGCCGGT GCGGAACGCG TGGCGGCAAG TGCGGCAAAT
2251 TGGCAGGCAA TGGGCGGCAG CCTCAACCTG CAACACTTTT CTTGGGATAA
2301 AAAAACCGGC ATATCGGCAA AAGGCGGCGC ACACGGTCTG CATATCGCCG
2351 AGTTGCACAA TTTCTTCAAA CCGCCCTTCG AACACAATCT GGTTTTAAAC
2401 GGCGACTGGG ATGTCGCCTA CGGGCGCAAC GCGCGCGGCT ACCTCAATAT
2451 CAGCCGGCAA AGCGGCGATG CCGTATTGCC CGGCGGGCAG GCTTTGGGTT
2501 TGAACGCATT TTCCCTGAAA ACGCGCTTTC AAAACGACCG CATCGGAATC
2551 CTGCTTGACG GCGGCGCGCG TTTCGGGCGG ATTAACGCCG ATTTGGGCAT
2601 CGCCAACGCC TTCGGCGGCA ATATGGCAAA TGCACCGCTC GGCGGCAGGA
2651 TTACCGCCTC CCTTCCCGAC TTGGGCGCAT TGAAGCCCTT TCTGCCCGCC
```

-continued

2701 GCCGCGCAAA ACATTACCGG CAGCCTGAAT GCCGCCGCGC AAATCGGCGG

2751 ACGGGTAGGC TCTCCGTCCG TCAATGCCGC CGTCAACGGC AGCAGCAACT

2801 ACGGGAAAAT CAACGGCAAC ATCACCGTCG GGCAAAGCCG CTCTTTCGAT

2851 ACCGCGCCTT TGGGCGGCAG GCTCAACCTG ACCGTTGCCG ATGCCGAAGT

2901 ATTCCGCAAC TTCCTACCGG TCGGACAAAC CGTCAAAGGC AGCCTGAATG

2951 CCGCCGTAAC CCTCGGCGGC AGCATCGCCG ATCCGCACTT GGGCGGCAGC

3001 ATCAACGGCG ACAAACTCTA TTACCGCAAC CAAACCCAAG GCATCATCTT

3051 GGACAACGGC TCGCTGCGTT CGCATATCGC GGGCAGGAAA TGGGTAATCG

3101 ACAGCCTGAA ATTCCGGCAC GAAGGGACGG CGGAACTCTC CGGTACGGTC

3151 GGTATGGAAA ACAGCGGACC CGATGTCGAT ATCGGCGCGG TGTTCGACAA

3201 ATACCGCATC CTGTCCCGCC CCAACCGCCG CCTGACGGTT TCCGGCAACA

3251 CCCGCCTGCG CTATTCGCCG CAAAAAGGCA TATCCGTTAC CGGGATGATT

3301 AAAACGGATC AGGGGCTGTT CGGTTCGCAA AAATCCTCGA TGCCGTCCGT

3351 CGGCGACGAT GTCGTCGTAT TAGGCGAAGT CAAAAAAGAG GCGGCGGCAC

3401 CGCTCCCCGT CAATATGAAC CTGACTTTAG ACCTCAATGA CGGCATCCGC

3451 TTCGCCGGCT ACGGCGCGGA CGTTACCATA GGCGGCAAAC TGACCCTGAC

3501 CGCCCAATCG GGCGGAAGCG TACGGGGCGT GGGCACGGTC CGCGTCATCA

3551 AAGGGCGTTA TAAGGCATAC GGGCAGGATT TGGACATTAC CAAAGGCACG

3601 GTCTCCTTTG TCGGCCCGCT CAACGATCCC AACCTCAACA TCCGCGCCGA

3651 ACGCCGCCTT TCCCCCGTCG GTGCGGGCGT GGAAATATTG GGCAGCCTCA

3701 ACAGCCCGCG CATTACGCTG ACGGCAAACG AACCGATGAG TGAAAAAGAC

3751 AAGCTCTCTT GGCTCATCCT CAACCGCGCC GGCAGCGGCA GCAGCGGCGA

3801 CAATGCCGCC CTGTCTGCAG CCGCAGGTGC GCTGCTTGCC GGGCAAATCA

3851 ACGACCGCAT CGGGCTGGTG GATGATTTGG GCTTTACCAG CAAGCGCAGC

3901 CGCAACGCGC AAACCGGCGA ACTCAACCCC GCCGAACAGG TGCTGACCGT

3951 CGGCAAACAA CTGACCGGCA AACTCTACAT CGGCTACGAA TACAGCATCT

4001 CCAGCGCGGA ACAGTCCGTC AAACTGATTT ACCGGCTGAC CCGCGCCATA

4051 CAGGCGGTTG CCCGTATCGG CAGCCGTTCG TCGGGCGGCG AGCTGACATA

4101 CACCATACGT TTCGACCGCT TCTCCGGTTC GGACAAAAAA GACTCCGCCG

4151 GAAACGGCAA AGGAAAATAA

This corresponds to the amino acid sequence <SEQ ID 11184; ORF 285>:

m285.pep

1 MTDTAPTDTD PTENGTRKMP SEHRPTPPAK KRRPLLKLSA ALLSVLILAV

51 CFLGWLAGTE AGLRFGLYQI PSWFGVNISS QNLKGTLLDG FDGDNWSIET

101 EGADLKISRF RFAWKPSELM RRSLHITEIS AGDIAIVTKP TPPKEERPPL

151 SLPDSIDLPA AVYLDRFETG KISMGKAFDK QTVYLERLDA SYRYDRKGHR

201 LDLKAADTPW SSSSGAASVG LKKPFALDTA IYTKGGLEGK TIHSTARLSG

-continued

```
 251 SLKDVRAELA IDGGNIRLSG KSVIHPFAES LDKTLEEVLV KGFNINPAAF

 301 VPSLPDAGLN FDLTAIPSFS DGIALEGSLD LENTKAGFAD RNGIPVRQVL

 351 GGFVIRQDGT VHIGNTSAAL LGRGGIRLSG KIDTEKDILD LNIGINSVGA

 401 EDVLQTAFKG RLDGSIGIGG TTASPKISWQ LGIGTARTDG SLAIASDPAN

 451 GQRKLVLDTV NIAAGQGSLT AQGYLELFKD RLLKLDIRSR AFDPSRIDPQ

 501 LPAGNINGSI NLAGELAKEK FTGKMRFLPG TFNGVPIAGS ADIVYESRHL

 551 PRAAVDLRLG RNIIKTDGGF GKKGDRLNLN ITAPDLSRFG FGLAGSLNVR

 601 GHLSGDLDGG IRTFETDLSG AARNLHIGKA ADIRSLDFTL KGSPDTSRPI

 651 RADIKGSRLS LSGGAAVVDT ADLMLDGTGV QHRIRTHAAM TLDGKPFKFD

 701 LDASGGINRE LTRWKGSIGI LDIGGAFNLK LQNRMTLEAG AERVAASAAN

 751 WQAMGGSLNL QHFSWDKKTG ISAKGGAHGL HIAELHNFFK PPFEHNLVLN

 801 GDWDVAYGRN ARGYLNISRQ SGDAVLPGGQ ALGLNAFSLK TRFQNDRIGI

 851 LLDGGARFGR INADLGIANA FGGNMANAPL GGRITASLPD LGALKPFLPA

 901 AAQNITGSLN AAAQIGGRVG SPSVNAAVNG SSNYGKINGN ITVGQSRSFD

 951 TAPLGGRLNL TVADAEVFRN FLPVGQTVKG SLNAAVTLGG SIADPHLGGS

1001 INGDKLYYRN QTQGIILDNG SLRSHIAGRK WVIDSLKFRH EGTAELSGTV

1051 GMENSGPDVD IGAVFDKYRI LSRPNRRLTV SGNTRLRYSP QKGISVTGMI

1101 KTDQGLFGSQ KSSMPSVGDD VVVLGEVKKE AAAPLPVNMN LTLDLNDGIR

1151 FAGYGADVTI GGKLTLTAQS GGSVRGVGTV RVIKGRYKAY GQDLDITKGT

1201 VSFVGPLNDP NLNIRAERRL SPVGAGVEIL GSLNSPRITL TANEPMSEKD

1251 KLSWLILNRA GSGSSGDNAA LSAAAGALLA GQINDRIGLV DDLGFTSKRS

1301 RNAQTGELNP AEQVLTVGKQ LTGKLYIGYE YSISSAEQSV KLIYRLTRAI

1351 QAVARIGSRS SGGELTYTIR FDRFSGSDKK DSAGNGKGK*
```

Computer analysis of this amino acid sequence gave the following results:

Homology with a predicted ORF from *N. gonorrhoeae*
m285/g285 96.5% identity in 1389 aa overlap

```
                  10        20        30        40        50        60
m285.pep  MTDTAPTDTDPTENGTRKMPSEHRPTPPAKKRRPLLKLSAALLSVLILAVCFLGWLAGTE
          ||||:||||||||||||||||||||:|||||||||||||||||||||||||||||:||||
g285      MTDTTPTDTDPTENGTRKMPSEHRPAPPAKKRRPLLKLSAALLSVLILAVCFLGWIAGTE
                  10        20        30        40        50        60

                  70        80        90       100       110       120
m285.pep  AGLRFGLYQIPSWFGVNISSQNLKGTLLDGFDGDNWSIETEGADLKISRFRFAWKPSELM
          ||||||||||||||||||||||||||||||||||||||||||||||||||||||||||||
g285      AGLRFGLYQIPSWFGVNISSQNLKGTLLDGFDGDNWSIETEGADLKISRFRFAWKPSELM
                  70        80        90       100       110       120

                 130       140       150       160       170       180
m285.pep  RRSLHITEISAGDIAIVTKPTPPKEERPPLSLPDSIDLPAAVYLDRFETGKISMGKAFDK
          |||||||:||||||||||||||||||||| :|||||||||||||||||||||||||:|||
g285      RRSLHITDISAGDIAIVTKPTPPKEERPPQGLPDSIDLPAAVYLDRFETGKISMGKTFDK
                 130       140       150       160       170       180

                 190       200       210       220       230       240
m285.pep  QTVYLERLDASYRYDRKGHRLDLKAADTPWSSSSGAASVGLKKPFALDTAIYTKGGLEGK
          ||||||||:|:||||||||||||||||||||||||:||||||||||||||||||||:||:
g285      QTVYLERLNANYRYDRKGHRLDLKAADTPWSSSSGSASVGLKKPFALDTAIYTKGGFEGE
                 190       200       210       220       230       240

                 250       260       270       280       290       300
m285.pep  TIHSTARLSGSLKDVRAELAIDGGNIRLSGKSVIHPFAESLDKTLEEVLVKGFNINPAAF
          |||||||||||||||||||:|||||||||||||||||||||||||||||||||||||:||
g285      TIHSTARLSGSLKDVRAELTIDGGNIRLSGKSVIHPFAESLDKTLEEVLVKGFNINPSAF
                 250       260       270       280       290       300
```

-continued

```
                 310       320       330       340       350       360
m285.pep  VPSLPDAGLNFDLTAIPSFSDGIALEGSLDLENTKAGFADRNGIPVRQVLGGFVIRQDGT
          ||||||||||||||||||||||||||||||||||||||||||||||||||||||||||||
g285      VPSLPDAGLNFDLTAIPSFSDGIALEGSLDLENTKAGFADRNGIPVRQVLGGFVIRQDGT
                 310       320       330       340       350       360

                 370       380       390       400       410       420
m285.pep  VHIGNTSAALLGRGGIRLSGKIDTEKDILDLNIGINSVGAEDVLQTAFKGRLDGSIGIGG
          ||||||||||||||||||||||||||||||||||||||||||||||||||||||||||||
g285      VHIGNTSAALLGRGGIRLSGKIDTEKDILDLNIGINSVGAEDVLQTAFKGRLDGSIGIGG
                 370       380       390       400       410       420

                 430       440       450       460       470       480
m285.pep  TTASPKISWQLGIGTARTDGSLAIASDPANGQRKLVLDTVNIAAGQGSLTAQGYLELFKD
          |||||||||||| ||||||||| ||||||| |||||:|||||:||:||||||||||||||
g285      TTASPKISWQLGTGTARTDGSLPIASDPANEQRKLVFDTVNISAGEGSLTAQGYLELFKD
                 430       440       450       460       470       480

                 490       500       510       520       530       540
m285.pep  RLLKLDIRSRAFDPSRIDPQLPAGNINGSINLAGELAKEKFTGKMRFLPGTFNGVPIAGS
          ||||||||||||||||||||:|||||||||:|||||||||||||||||||||||||||||
g285      RLLKLDIRSRAFDPSRIDPQFPAGNINGSIHLAGELAKEKFTGKMRFLPGTFNGVPIAGS
                 490       500       510       520       530       540

                 550       560       570       580       590       600
m285.pep  ADIVYESRHLPRAAVDLRLGRNIIKTDGGFGKKGDRLNLNITAPDLSRFGFGLAGSLNVR
          |||||||||||||||||||||||:||||||||||||||||||||||||||||||||||||
g285      ADIVYESRHLPRAAVDLRLGRNIVKTDGGFGKKGDRLNLNITAPDLSRFGFGLAGSLNVR
                 550       560       570       580       590       600

                 610       620       630       640       650       660
m285.pep  GHLSGDLDGGIRTFETDLSGAARNLHIGKAADIRSLDFTLKGSPDTSRPIRADIKGSRLS
          ||||||||||||||||||||:||||||||||||||||||||||| ||||:||||||:|||
g285      GHLSGDLDGGIRTFETDLSGTARNLHIGKAADIRSLDFTLKGSPGTSRPMRADIKGGRLS
                 610       620       630       640       650       660

                 670       680       690       700       710       720
m285.pep  LSGGAAVVDTADLMLDGTGVQHRIRTHAAMTLDGKPFKFDLDASGGINRELTRWKGSIGI
          ||||||||||| | |:|||:||||||||||||||||||:|||||||||||||||||||||
g285      LSGGAAVVDTAGLTLEGTGAQHRIRTHAAMTLDGKPFKLDLDASGGINRELTRWKGSIGI
                 670       680       690       700       710       720

                 730       740       750       760       770       780
m285.pep  LDIGGAFNLKLQNRMTLEAGAERVAASAANWQAMGGSLNLQHFSWDKKTGISAKGGAHGL
          ||||||||||||||||||||||:|||||||||||||||||||||||:||||||||||:||
g285      LDIGGAFNLKLQNRMTLEAGAEHVAASAANWQAMGGSLNLQHFSWDRKTGISAKGGARGL
                 730       740       750       760       770       780

                 790       800       810       820       830       840
m285.pep  HIAELHNFFKPPFEHNLVLNGDWDVAYGRNARGYLNISRQSGDAVLPGGQALGLNAFSLK
          ||||||||||||||||||||||||||||:|||||||||||||||||||||||||||||||
g285      HIAELHNFFKPPFEHNLVLNGDWDVAYGHNARGYLNISRQSGDAVLPGGQALGLNAFSLK
                 790       800       810       820       830       840

                 850       860       870       880       890       900
m285.pep  TRFQNDRIGILLDGGARFGRINADLGIANAFGGNMANAPLGGRITASLPDLGALKPFLPA
          |||||||||||||||||||||||||||:|||||||||:||||||||||||||||||||||
g285      TRFQNDRIGILLDGGARFGRINADLGIGNAFGGNMANTPLGGRITASLPDLGALKPFLPA
                 850       860       870       880       890       900

                 910       920       930       940       950       960
m285.pep  AAQNITGSLNAAAQIGGRVGSPSVNAAVNGSSNYGKINGNITVGQSRSFDTAPLGGRLNL
          |||||||||||:||||||||||||||||||||||||||||||||||||||||||||||||
g285      AAQNITGSLNASAQIGGRVGSPSVNAAVNGSSNYGKINGNITVGQSRSFDTAPLGGRLNL
                 910       920       930       940       950       960

                 970       980       990      1000      1010      1020
m285.pep  TVADAEVFRNFLPVGQTVKGSLNAAVTLGGSIADPHLGGSINGDKLYYRNQTQGIILDNG
          ||||||:|||||||||||||||||||||||||||||||||||||||||||||||||||||
g285      TVADAEAFRNFLPVGQTVKGSLNAAVTLGGSIADPHLGGSINGDKLYYRNQTQGIILDNG
                 970       980       990      1000      1010      1020

                1030      1040      1050      1060      1070      1080
m285.pep  SLRSHIAGRKWVIDSLKFRHEGTAELSGTVGMENSGPDVDIGAVFDKYRILSRPNRRLTV
          ||||||||||||||||||||||||||||||:|||| ||||||||||||||||||||||||
g285      SLRSHIAGRKWVIDSLKFRHEGTAELSGTVSMENSVPDVDIGAVFDKYRILSRPNRRLTV
                1030      1040      1050      1060      1070      1080

                1090      1100      1110      1120      1130      1140
m285.pep  SGNTRLRYSPQKGISVTGMIKTDQGLFGSQKSSMPSVGDDVVVLGEVKKEAAAPLPVNMN
          ||||||||||||||||||||||||||||||||||||||||||||||||||||| ||||||
g285      SGNTRLRYSPQKGISVTGMIKTDQGLFGSQKSSMPSVGDDVVVLGEVKKEAAASLPVNMN
                1090      1100      1110      1120      1130      1140

                1150      1160      1170      1180      1190      1200
m285.pep  LTLDLNDGIRFAGYGADVTIGGKLTLTAQSGGSVRGVGTVRVIKGRYKAYGQDLDITKGT
          |||||||||||:||||||||||||||||| ||:|||||||||||||||||||||||||||
g285      LTLDLNDGIRFSGYGADVTIGGKLTLTAQPGGNVRGVGTVRVIKGRYKAYGQDLDITKGT
                1150      1160      1170      1180      1190      1200

                1210      1220      1230      1240      1250      1260
m285.pep  VSFVGPLNDPNLNIRAERRLSPVGAGVEILGSLNSPRITLTANEPMSEKDKLSWLILNRA
          ||||||||||||||||||||||||||||||||||||||||||||||||||||||||||||
g285      VSFVGPLNDPNLNIRAERRLSPVGAGVEILGSLNSPRITLTANEPMSEKDKLSWLILNRA
                1210      1220      1230      1240      1250      1260
```

-continued

```
              1270       1280       1290       1300       1310       1320
m285.pep  GSGSSGDNAALSAAAGALLAGQINDRIGLVDDLGFTSKRSRNAQTGELNPAEQVLTVGKQ
          ||||||||||||||||||||||||||||||||||||||||||||||||||||||||||||
g285      GSGSSGDNAALSAAAGALLAGQINDRIGLVDDLGFTSKRSRNAQTGELNPAEQVLTVGKQ
              1270       1280       1290       1300       1310       1320

              1330       1340       1350       1360       1370       1380
m285.pep  LTGKLYIGYEYSISSAEQSVKLIYRLTRAIQAVARIGSRSSGGELTYTIRFDRFSGSDKK
          |||||||||||:||||||||||||||||||||||||||||||||||||||||||: |||||
g285      LTGKLYIGYEYGISSAEQSVKLIYRLTRAIQAVARIGSRSSGGELTYTIRFDRLFGSDKK
              1330       1340       1350       1360       1370       1380

              1390
m285.pep  DSAGNGKGKX
          ||||||||||
g285      DSAGNGKGKX
```

The following partial DNA sequence was identified in *N. meningitidis* <SEQ ID 1185>:

a285.seq

```
   1 ATGACCGATA CCGCACCGAC AGATACCGAT CCGACCGAAA ACGGCACGCG
  51 CAAAATGCCG TCTGAACACC GCCCTACCCC GCCGGCAAAA AAACGCCGCC
 101 CGCTGCTGAA GCTGTCGGCG GCACTGCTGT CTGTTCTGAT TTTGGCAGTA
 151 TGTTTCCTCG GCTGGCTCGC CGGCACGGAA GCGGGTTTGC GCTTCGGGCT
 201 GTACCAAATC CCGTCTTGGT TCGGCGTAAA CATTTCCTCC CAAAACCTCA
 251 AAGGCACGCT GCTCGACGGC TTCGACGGCG ACAACTGGTC GATAGAAACC
 301 GAGGGGGCAG ACCTTAAAAT CAGCCGCTTC CGCTTCGCGT GGAAACCGTC
 351 CGAACTGATG CGCCGCAGCC TGCACATTAC CGAAATTTCC GCCGGCGACA
 401 TCGCCATCGT TACCAAACCG ACTCCGCCTA AAGAAGAACG CCCGCCGCTC
 451 AGCCTTCCCG ACAGCATAGA CCTGCCTGCC GCCGTCTATC TCGACCGCTT
 501 CGAGACGGGC AAAATCAGCA TGGGCAAAGC CTTTGACAAA CAAACCGTCT
 551 ATCTCGAACG GCTGGATGCT TCATACCGTT ACGACCGCAA AGGACACCGC
 601 CTCGACCTGA AGGCTGCCGA CACGCCGTGG AGCAGTTCGT CGGGGTCAGC
 651 CTCGGTCGGC TTGAAAAAAC CGTTTGCCCT CGATACCGCC ATTTACACCA
 701 AAGGCGGACT CGAAGGCAAA ACCATACACA GTACGGCTCG GCTGAGCGGC
 751 AGCCTGAAGG ATGTGCGCGC CGAACTGGCG ATCGACGGCG GCAATATCCG
 801 CCTCTCGGGA AAATCCGTCA TCCACCCGTT TGCCGAATCA TTGGATAAAA
 851 CATTGGAAGA AGTACTGGTC AAAGGGTTCA ACATCAATCC GTCCGCCTTC
 901 GTGCCTTCCC TGCCCGATGC CGGGCTGAAT TTCGACCTGA CCGCCATCCC
 951 GTCGTTTTCA GACGGCATCG CGCTGGAAGG CTCGCTCGAT TTGGAAAACA
1001 CCAAAGCCGG CTTTGCCGAC CGCAACGGCA TCCCCGTCCG TCAGGTTTTA
1051 GGCAGCTTTG TCATCCGGCA GGACGGCACG GTGCATATCG GCAATACGTC
1101 CGTCGCCCTG CTCGGACGGG GCGGCATCAG GCTGTCGGGC AAAATCGACA
1151 CCGAAAAAGA CATCCTCGAT TTAAATATAG GCATCAACTC CGTCGGCGCG
1201 GAAGACGTAC TGCAAACCGC GTTCAAAGGC AGGTTGGACG GCAGCATCGG
1251 CATCGGTGGC ACGACCGCCT CGCCCAAAAT CTCTTGGCAA CTCGGCATCG
1301 GCACGGCGCG CACGGACGCC AGCCTCGCCA TTGCAAGCGA CCCCGCAAAC
1351 GGACAGCGGA AACTGGTGCT CGACACCGTC AACATCGCCG CCGGGCAAGG
```

-continued

1401 CAGCCTGACC GCGCAAGGCT ATCTCGAGCT GTTTAAAGAC CGCCTGCTCA

1451 AGCTGGACAT CCGTTCCCGC GCATTCGACC CTTCGCGCAT CGATCCGCAA

1501 CTTCCGGCAG GCAATATCAA CGGCTCAATA AACCTTGCCG GCGAACTGGC

1551 AAAAGAGAAA TTCACAGGCA AAATGCGGTT TTTACCCGGC ACGTTCAACG

1601 GCGTACCGAT TGCCGGCAGT GCCGACATTG TTTACGAGTC CCGCCACCTT

1651 CCGCGTGCCG CCGTCGATTT GCGGCTGGGG CGCAACATTA TTAAAACAGA

1701 CGGCGGCTTC GGCAAAAAAG GCGACCGGCT TAACCTCAAT ATCACCGCAC

1751 CCGATTTATC CCGTTTCGGT TTCGGACTCG CGGGGTCTTT AAATGTACGC

1801 GGACACCTTT CCGGCGATTT GGACGGTGGC ATCCGAACCT TTGAAACCGA

1851 CCTTTCCGGC GCGGCGCGCA ACCTGCACAT CGGCAAGGCG GCAGACATCC

1901 GTTCGCTCGA TTTCACGCTC AAAGGTTCGC CCGACACAAG CCGCCCGATA

1951 CGCGCCGACA TCAAAGGCAG CCGCCTTTCG CTGTCGGGCG GAGCGGAGGT

2001 TGTCGATACC GCCGACCTGA TGCTGGACGG CACGGGCGTG CAGCACCGCA

2051 TCCGCACACA CGCCGCCATG ACGCTGGATG GCAAACCGTT CAAATTCGAT

2101 TTGGACGCTT CAGGCGGCAT CAACAGGGAA CTTACCCGAT GGAAAGGCAG

2151 CATCGGCATC CTCGACATCG GCGGCGCATT CAACCTCAAG CTGCAAAACC

2201 GTATGACGCT CGAAGCCGGT GCGGAACGCG TGGCGGCAAG TGCGGCAAAT

2251 TGGCAGGCAA TGGGCGGCAG CCTCAACCTG CAACACTTTT CTTGGGATAA

2301 AAAAACCGGC ATATCGGCAA AAGGCGGCGC ACACGGTCTG CATATCGCCG

2351 AGTTGCACAA TTTCTTCAAA CCGCCCTTCG AACACAATCT GGTTTTAAAC

2401 GGCGACTGGG ATGTCGCCTA CGGGCGAAAC GCGCGCGGCT ACCTCAATAT

2451 CAGCCGGCAA AGCGGCGATG CCGTATTGCC CGGCGGGCAG GCTTTGGGTT

2501 TGAACGCATT TTCCCTGAAA ACGCGCTTTC AAAACGACCG TATCGGAATC

2551 CTGCTTGACG GCGGCGCGCG TTTCGGGCGG ATTAACGCCG ATTTGGACAT

2601 CGGCAACGCC TTCGGCGGCA ATATGGCAAA TGCACCGCTC GGCGGCAGGA

2651 TTACCGCCTC CCTTCCCGAC TTGGGCACAT TGAAGCCCTT TCTGCCCGCC

2701 GCCGCGCAAA ACATTACCGG CAGCCTGAAT GCCGCCGCGC AAATCGGCGG

2751 ACGGGTCGGC TCTCCGTCCG TCAATGCCGC CGTCAACGGC AGCAGCAACT

2801 ACGGGAAAAT CAACGGCAAC ATCACCGTCG GGCAAAGCCG CTCTTTCGAT

2851 ACCGCGCCTT TGGGCGGCAG GCTCAACCTG ACCGTTGCCG ATGCCGAAGT

2901 ATTCCGCAAC TTCCTACCGG TCGGACAAAC CGTCAAAGGC AGCCTGAATG

2951 CCGCCGTAAC CCTCGGCGGC AGCATCGCCG ATCCGCACTT GGGCGGCAGC

3001 ATCAACGGCG ACAAACTCTA TTACCGCAAC CAAACCCAAG GCATCATCTT

3051 GGACAACGGC TCGCTGCGTT CGCATATCGC GGGCAGGAAA TGGGTAATCG

3101 ACAGCCTGAA ATTCCGGCAC GAAGGGACGG CGGAACTCTC CGGTACGGTC

3151 GGTATGGAAA ACAGCGGACC CGATGTCGAT ATCGGCGCGG TGTTCGACAA

3201 ATACCGCATC CTGTCCCGCC CCAACCGCCG CCTGACGGTT TCCGGCAACA

3251 CCCGCCTGCG CTATTCGCCG CAAAAAGGCA TATCCGTTAC CGGGATGATT

3301 AAAACGGATC AGGGGCTGTT CGGTTCGCAA AAATCCTCGA TGCCGTCCGT

3351 CGGCGACGAT GTCGTCGTAT TAGGCGAAGT CAAAAAAGAG GCGGCGGCAC

-continued

```
3401 CGCTCCCCGT CAATATGAAC CTGACTTTAG ACCTCAATGA CGGCATCCGC
3451 TTCGCCGGCT ACGGCGCGGA CGTTACCATA GGCGGCAAAC TGACCCTGAC
3501 CGCCCAATCG GGCGGAAGCG TGCGGGGCGT GGGCACGGTC CGCGTCATCA
3551 AAGGGCGTTA TAAGGCATAC GGGCAGGATT TGGACATTAC CAAAGGCACG
3601 GTCTCCTTTG TCGGCCCGCT CAACGACCCC AACCTCAACA TCCGCGCCGA
3651 ACGCCGCCTT TCCCCCGTCG GTGCGGGCGT GGAAATATTG GGCAGCCTCA
3701 ACAGTCCGCG CATTACGCTG ACGGCAAACG AACCGATGAG TGAAAAAGAC
3751 AAGCTCTCCT GGCTCATCCT CAACCGCGCC GGCAGTGGCA GCAGCGGCGA
3801 CAATGCCGCC CTGTCCGCAG CCGCCGGCGC GCTGCTTGCC GGGCAAATCA
3851 ACGACCGCAT CGGGCTGGTG GATGATTTGG GCTTTACCAG CAAGCGCAGC
3901 CGCAACGCGC AAACCGGCGA ACTCAACCCC GCCGAACAGG TGCTGACCGT
3951 CGGCAAACAA CTGACCGGCA AACTCTACAT CGGCTACGAA TACAGCATCT
4001 CCAGCGCGGA ACAGTCCGTC AAACTGATTT ACCGGCTGAC CCGCGCCATA
4051 CAGGCGGTTG CCCGTATCGG CAGCCGTTCG TCGGGCGGCG AGCTGACATA
4101 CACCATACGT TTCGACCGCT TCTCCGGTTC GGACAAAAAA GACTCCGCCG
4151 GAAACAGCAA AGGAAAATAA
```

This corresponds to the amino acid sequence <SEQ ID 1186; ORF 285.a>:

a285.pep

```
  1 MTDTAPTDTD PTENGTRKMP SEHRPTPPAK KRRPLLKLSA ALLSVLILAV
 51 CFLGWLAGTE AGLRFGLYQI PSWFGVNISS QNLKGTLLDG FDGDNWSIET
101 EGADLKISRF RFAWKPSELM RRSLHITEIS AGDIAIVTKP TPPKEERPPL
151 SLPDSIDLPA AVYLDRFETG KISMGKAFDK QTVYLERLDA SYRYDRKGHR
201 LDLKAADTPW SSSSGSASVG LKKPFALDTA IYTKGGLEGK TIHSTARLSG
251 SLKDVRAELA IDGGNIRLSG KSVIHPFAES LDKTLEEVLV KGFNINPSAF
301 VPSLPDAGLN FDLTAIPSFS DGIALEGSLD LENTKAGFAD RNGIPVRQVL
351 GSFVIRQDGT VHIGNTSVAL LGRGGIRLSG KIDTEKDILD LNIGINSVGA
401 EDVLQTAFKG RLDGSIGIGG TTASPKISWQ LGIGTARTDG SLAIASDPAN
451 GQRKLVLDTV NIAAGQGSLT AQGYLELFKD RLLKLDIRSR AFDPSRIDPQ
501 LPAGNINGSI NLAGELAKEK FTGKMRFLPG TFNGVPIAGS ADIVYESRHL
551 PRAAVDLRLG RNIIKTDGGF GKKGDRLNLN ITAPDLSRFG FGLAGSLNVR
601 GHLSGDLDGG IRTFETDLSG AARNLHIGKA ADIRSLDFTL KGSPDTSRPI
651 RADIKGSRLS LSGGAEVVDT ADLMLDGTGV QHRIRTHAAM TLDGKPFKFD
701 LDASGGINRE LTRWKGSIGI LDIGGAFNLK LQNRMTLEAG AERVAASAAN
751 WQAMGGSLNL QHFSWDKKTG ISAKGGAHGL HIAELHNFFK PPFEHNLVLN
801 GDWDVAYGRN ARGYLNISRQ SGDAVLPGGQ ALGLNAFSLK TRFQNDRIGI
851 LLDGGARFGR INADLDIGNA FGGNMANAPL GGRITASLPD LGTLKPFLPA
901 AAQNITGSLN AAAQIGGRVG SPSVNAAVNG SSNYGKINGN ITVGQSRSFD
```

-continued

```
 951 TAPLGGRLNL TVADAEVFRN FLPVGQTVKG SLNAAVTLGG SIADPHLGGS

1001 INGDKLYYRN QTQGIILDNG SLRSHIAGRK WVIDSLKFRH EGTAELSGTV

1051 GMENSGPDVD IGAVFDKYRI LSRPNRRLTV SGNTRLRYSP QKGISVTGMI

1101 KTDQGLFGSQ KSSMPSVGDD VVVLGEVKKE AAAPLPVNMN LTLDLNDGIR

1151 FAGYGADVTI GGKLTLTAQS GGSVRGVGTV RVIKGRYKAY GQDLDITKGT

1201 VSFVGPLNDP NLNIRAERRL SPVGAGVEIL GSLNSPPRIL TANEPMSEKD

1251 KLSWLILNRA GSGSSGDNAA LSAAAGALLA GQINDRIGLV DDLGFTSKRS

1301 RNAQTGELNP AEQVLTVGKQ LTGKLYIGYE YSISSAEQSV KLIYRLTRAI

1351 QAVARIGSRS SGGELTYTIR FDRFSGSDKK DSAGNSKGK*
```

m285/a285 99.4% identity in 1389 aa overlap

```
                   10        20        30        40        50        60
m285.pep    MTDTAPTDTDPTENGTRKMPSEHRPTPPAKKRRPLLKLSAALLSVLILAVCFLGWLAGTE
            ||||||||||||||||||||||||||||||||||||||||||||||||||||||||||||
a285        MTDTAPTDTDPTENGTRKMPSEHRPTPPAKKRRPLLKLSAALLSVLILAVCFLGWLAGTE
                   10        20        30        40        50        60

                   70        80        90       100       110       120
m285.pep    AGLRFGLYQIPSWFGVNISSQNLKGTLLDGFDGDNWSIETEGADLKISRFRFAWKPSELM
            ||||||||||||||||||||||||||||||||||||||||||||||||||||||||||||
a285        AGLRFGLYQIPSWFGVNISSQNLKGTLLDGFDGDNWSIETEGADLKISRFRFAWKPSELM
                   70        80        90       100       110       120

                  130       140       150       160       170       180
m285.pep    RRSLHITEISAGDIAIVTKPTPPKEERPPLSLPDSIDLPAAVYLDRFETGKISMGKAFDK
            ||||||||||||||||||||||||||||||||||||||||||||||||||||||||||||
a285        RRSLHITEISAGDIAIVTKPTPPKEERPPLSLPDSIDLPAAVYLDRFETGKISMGKAFDK
                  130       140       150       160       170       180

                  190       200       210       220       230       240
m285.pep    QTVYLERLDASYRYDRKGHRLDLKAADTPWSSSSGAASVGLKKPFALDTAIYTKGGLEGK
            |||||||||||||||||||||||||||||||||||:||||||||||||||||||||||||
a285        QTVYLERLDASYRYDRKGHRLDLKAADTPWSSSSGSASVGLKKPFALDTAIYTKGGLEGK
                  190       200       210       220       230       240

                  250       260       270       280       290       300
m285.pep    TIHSTARLSGSLKDVRAELAIDGGNIRLSGKSVIHPFAESLDKTLEEVLVKGFNINPAAF
            |||||||||||||||||||||||||||||||||||||||||||||||||||||||||:||
a285        TIHSTARLSGSLKDVRAELAIDGGNIRLSGKSVIHPFAESLDKTLEEVLVKGFNINPSAF
                  250       260       270       280       290       300

                  310       320       330       340       350       360
m285.pep    VPSLPDAGLNFDLTAIPSFSDGIALEGSLDLENTKAGFADRNGIPVRQVLGGFVIRQDGT
            |||||||||||||||||||||||||||||||||||||||||||||||||||:||||||||
a285        VPSLPDAGLNFDLTAIPSFSDGIALEGSLDLENTKAGFADRNGIPVRQVLGSFVIRQDGT
                  310       320       330       340       350       360

                  370       380       390       400       410       420
m285.pep    VHIGNTSAALLGRGGIRLSGKIDTEKDILDLNIGINSVGAEDVLQTAFKGRLDGSIGIGG
            |||||||:||||||||||||||||||||||||||||||||||||||||||||||||||||
a285        VHIGNTSVALLGRGGIRLSGKIDTEKDILDLNIGINSVGAEDVLQTAFKGRLDGSIGIGG
                  370       380       390       400       410       420

                  430       440       450       460       470       480
m285.pep    TTASPKISWQLGIGTARTDGSLAIASDPANGQRKLVLDTVNIAAGQGSLTAQGYLELFKD
            ||||||||||||||||||||||||||||||||||||||||||||||||||||||||||||
a285        TTASPKISWQLGIGTARTDGSLAIASDPANGQRKLVLDTVNIAAGQGSLTAQGYLELFKD
                  430       440       450       460       470       480

                  490       500       510       520       530       540
m285.pep    RLLKLDIRSRAFDPSRIDPQLPAGNINGSINLAGELAKEKFTGKMRFLPGTFNGVPIAGS
            ||||||||||||||||||||||||||||||||||||||||||||||||||||||||||||
a285        RLLKLDIRSRAFDPSRIDPQLPAGNINGSINLAGELAKEKFTGKMRFLPGTFNGVPIAGS
                  490       500       510       520       530       540

                  550       560       570       580       590       600
m285.pep    ADIVYESRHLPRAAVDLRLGRNIIKTDGGFGKKGDRLNLNITAPDLSRFGFGLAGSLNVR
            ||||||||||||||||||||||||||||||||||||||||||||||||||||||||||||
a285        ADIVYESRHLPRAAVDLRLGRNIIKTDGGFGKKGDRLNLNITAPDLSRFGFGLAGSLNVR
                  550       560       570       580       590       600

                  610       620       630       640       650       660
m285.pep    GHLSGDLDGGIRTFETDLSGAARNLHIGKAADIRSLDFTLKGSPDTSRPIRADIKGSRLS
            ||||||||||||||||||||||||||||||||||||||||||||||||||||||||||||
a285        GHLSGDLDGGIRTFETDLSGAARNLHIGKAADIRSLDFTLKGSPDTSRPIRADIKGSRLS
                  610       620       630       640       650       660
```

-continued

```
             670       680       690       700       710       720
m285.pep  LSGGAAVVDTADLMLDGTGVQHRIRTHAAMTLDGKPFKFDLDASGGINRELTRWKGSIGI
          ||||| ||||||||||||||||||||||||||||||||||||||||||||||||||||||
a285      LSGGAEVVDTADLMLDGTGVQHRIRTHAAMTLDGKPFKFDLDASGGINRELTRWKGSIGI
             670       680       690       700       710       720

             730       740       750       760       770       780
m285.pep  LDIGGAFNLKLQNRMTLEAGAERVAASAANWQAMGGSLNLQHFSWDKKTGISAKGGAHGL
          ||||||||||||||||||||||||||||||||||||||||||||||||||||||||||||
a285      LDIGGAFNLKLQNRMTLEAGAERVAASAANWQAMGGSLNLQHFSWDKKTGISAKGGAHGL
             730       740       750       760       770       780

             790       800       810       820       830       840
m285.pep  HIAELHNFFKPPFEHNLVLNGDWDVAYGRNARGYLNISRQSGDAVLPGGQALGLNAFSLK
          ||||||||||||||||||||||||||||||||||||||||||||||||||||||||||||
a285      HIAELHNFFKPPFEHNLVLNGDWDVAYGRNARGYLNISRQSGDAVLPGGQALGLNAFSLK
             790       800       810       820       830       840

             850       860       870       880       890       900
m285.pep  TRFQNDRIGILLDGGARFGRINADLGIANAFGGNMANAPLGGRITASLPDLGALKPFLPA
          ||||||||||||||||||||||||| |:||||||||||||||||||||||||:|||||||
a285      TRFQNDRIGILLDGGARFGRINADLDIGNAFGGNMANAPLGGRITASLPDLGTLKPFLPA
             850       860       870       880       890       900

             910       920       930       940       950       960
m285.pep  AAQNITGSLNAAAQIGGRVGSPSVNAAVNGSSNYGKINGNITVGQSRSFDTAPLGGRLNL
          ||||||||||||||||||||||||||||||||||||||||||||||||||||||||||||
a285      AAQNITGSLNAAAQIGGRVGSPSVNAAVNGSSNYGKINGNITVGQSRSFDTAPLGGRLNL
             910       920       930       940       950       960

             970       980       990      1000      1010      1020
m285.pep  TVADAEVFRNFLPVGQTVKGSLNAAVTLGGSIADPHLGGSINGDKLYYRNQTQGIILDNG
          ||||||||||||||||||||||||||||||||||||||||||||||||||||||||||||
a285      TVADAEVFRNFLPVGQTVKGSLNAAVTLGGSIADPHLGGSINGDKLYYRNQTQGIILDNG
             970       980       990      1000      1010      1020

            1030      1040      1050      1060      1070      1080
m285.pep  SLRSHIAGRKWVIDSLKFRHEGTAELSGTVGMENSGPDVDIGAVFDKYRILSRPNRRLTV
          ||||||||||||||||||||||||||||||||||||||||||||||||||||||||||||
a285      SLRSHIAGRKWVIDSLKFRHEGTAELSGTVGMENSGPDVDIGAVFDKYRILSRPNRRLTV
            1030      1040      1050      1060      1070      1080

            1090      1100      1110      1120      1130      1140
m285.pep  SGNTRLRYSPQKGISVTGMIKTDQGLFGSQKSSMPSVGDDVVVLGEVKKEAAAPLPVNMN
          ||||||||||||||||||||||||||||||||||||||||||||||||||||||||||||
a285      SGNTRLRYSPQKGISVTGMIKTDQGLFGSQKSSMPSVGDDVVVLGEVKKEAAAPLPVNMN
            1090      1100      1110      1120      1130      1140

            1150      1160      1170      1180      1190      1200
m285.pep  LTLDLNDGIRFAGYGADVTIGGKLTLTAQSGGSVRGVGTVRVIKGRYKAYGQDLDITKGT
          ||||||||||||||||||||||||||||||||||||||||||||||||||||||||||||
a285      LTLDLNDGIRFAGYGADVTIGGKLTLTAQSGGSVRGVGTVRVIKGRYKAYGQDLDITKGT
            1150      1160      1170      1180      1190      1200

            1210      1220      1230      1240      1250      1260
m285.pep  VSFVGPLNDPNLNIRAERRLSPVGAGVEILGSLNSPRITLTANEPMSEKDKLSWLILNRA
          ||||||||||||||||||||||||||||||||||||||||||||||||||||||||||||
a285      VSFVGPLNDPNLNIRAERRLSPVGAGVEILGSLNSPRITLTANEPMSEKDKLSWLILNRA
            1210      1220      1230      1240      1250      1260

            1270      1280      1290      1300      1310      1320
m285.pep  GSGSSGDNAALSAAAGALLAGQINDRIGLVDDLGFTSKRSRNAQTGELNPAEQVLTVGKQ
          ||||||||||||||||||||||||||||||||||||||||||||||||||||||||||||
a285      GSGSSGDNAALSAAAGALLAGQINDRIGLVDDLGFTSKRSRNAQTGELNPAEQVLTVGKQ
            1270      1280      1290      1300      1310      1320

            1330      1340      1350      1360      1370      1380
m285.pep  LTGKLYIGYEYSISSAEQSVKLIYRLTRAIQAVARIGSRSSGGELTYTIRFDRFSGSDKK
          ||||||||||||||||||||||||||||||||||||||||||||||||||||||||||||
a285      LTGKLYIGYEYSISSAEQSVKLIYRLTRAIQAVARIGSRSSGGELTYTIRFDRFSGSDKK
            1330      1340      1350      1360      1370      1380

            1390
m285.pep  DSAGNGKGKX
          |||||:||||
a285      DSAGNSKGKX
            1390
```

The following partial DNA sequence was identified in *N. gonorrhoeae* <SEQ ID 1187>:

```
g285-1.seq

  1 CTGAAGCTGT CGGCGGCACT GCTGTCTGTC CTGATTTTGG CAGTATGTTT

 51 CCTCGGCTGG ATCGCCGGTA CGGAAGCAGG TTTGCGCTTC GGGCTGTACC

101 AAATCCCGTC CTGGTTCGGC GTAAACATTT CCTCCCAAAA CCTCAAAGGC

151 ACACTGCTCG ACGGCTTCGA CGGCGACAAC TGGTCGATAG AAACCGAGGG
```

-continued

201 GGCAGACCTT AAAATCAGCC GCTTCCGCTT CGCGTGGAAA CCGTCCGAAC

251 TGATGCGCCG CAGCCTGCAC ATCACCGACA TCTCCGCCGG CGACATCGCC

301 ATCGTAACCA AACCGACTCC GCCTAAAGAA GAACGCCCGC CTCAAGGCCT

351 GCCCGACAGC ATAGACCTGC CCGCCGCCGT CTATCTCGAC CGCTTCGAGA

401 CGGGCAAAAT CAGCATGGGC AAAACCTTTG ACAAACAAAC CGTCTATCTC

451 GAACGCCTCA ACGCGGCATA CCGTTACGAC CGTAAAGGGC ACCGCCTCGA

501 CCTGAAGGCC GCCGACACGC CGTGGAGCAG TTCGTCGGGG TCAGCCTCGG

551 TCGGCTTGAA AAAACCGTTT GCCCTCGATA CCGCCATTTA CACCAAAGGC

601 GGATTCGAAG GCGAAACCAT ACACAGTACG GCGCGGCTGA GCGGCAGCCT

651 GAAGGATGTG CGCGCCGAAC TGACGATCGA CGGCGGCAAT ATCCGCCTCT

701 CGGGAAAATC CGTCATCCAC CCGTTTGCCG AATCATTGGA TAAAACATTG

751 GAAGAAGTAC TGGTCAAAGG ATTCAACATC AATCCGTCCG CCTTCGTGCC

801 TTCCCTGCCC GATGCCGGGC TGAATTTCGA CCTGACCGCC ATCCCGTCGT

851 TTTCAGACGG CATCGCGCTG GAAGGCTCGC TCGATTTGGA AAACACCAAA

901 GCCGGCTTTG CCGACCGCAA CGGCATCCCC GTCCGTCAGG TTTTGGGCGG

951 CTTTGTCATC CGGCAGGACG GCACGGTGCA TATCGGCAAT ACGTCCGCCG

1001 CCCTGCTCGG ACGGGGCGGC ATCAGGCTGT CGGGCAAAAT CGACACCGAA

1051 AAAGACATCC TTGATTTAAA TATAGGCATC AACTCCGTCG GCGCGGAAGA

1101 CGTGCTGCAA ACCGCGTTCA AAGGCAGGTT GGACGGCAGC ATCGGCATCG

1151 GCGGCACGAC CGCCTCGCCC AAAATCTCTT GGCAACTCGG CACCGGCACG

1201 GCACGCACGG ACGGCAGCCt cgcCATCGCA AGCGAcCCCG CAAACGAACA

1251 GCGGAAACTG GTGTTCGACA CCGTCAACAT CTCCGCCGGG GAAGGCAGCC

1301 TGACCGCGCA AGGCTATCTC GAGCTGTTTA AAGACCGCCT GCTCAAGCTG

1351 GACATCCGTT CCCGCGCATT CGACCCTTCG CGCATCGATC CGCAATTTCC

1401 GGCAGGCgat atCAACGGTT CGATTCATCT TGCCGGTGAA CTGGCAAAAG

1451 AGAAATTTAC GGGCAAAATG CGTTTTTTGC CCGGTACGTT CAACGGCGTG

1501 CCGATTGCCG GCAGCGCCGA CATTGTTTAC GAGTCCCGCC ACCTTCCGCG

1551 CGCCGCCGTC GATTTGCGGT TGGGGCGGAA CATCGTCAAA ACAGACGGCG

1601 GCTTCGGCAA AAAAGGCGAC CGGCTTAACC TCAATATCAC CGCACCCGAT

1651 TTATCCCGTT TCGGTTTCGG ACTCGCGGGG TCTTTAAATG TACGCGGACA

1701 CCTTTCCGGC GATTTGGACG GCGGCATCCG AACCTTTGAA ACCGACCTTT

1751 CCGGCACGGC GCGCAACTTA CACATCGGCA AAGCGGCAGA CATCCGTTCG

1801 CTCGATTTTA CCCTCAAAGG CTCACCCGGC ACAAGCCGCC CGATGCGCGC

1851 CGATATCAAG GGCGGCCGCC TTTCCCTGTC GGGCGGCGCG GCGGTTGTCG

1901 ATACCGCCGG CCTGACGCTG GAAGGTACGG GCGCGCAGCA CCGCATCCGC

1951 ACACACGCCG CCATGACGCT GGACGGCAAA CCGTTCAAAC TCGATTTGGA

2001 CGCTTCAGGC GGCATCAACA GGGAACTTAC CCGATGGAAA GGCAGCATCG

2051 GCATCCTCGA CATCGGCGGC GCATTCAACC TCAAGCTGCA AAACCGTATG

2101 ACGCTCGAAG CCGGTGCGGA ACACGTGGCG GCAAGTGCGG CAAATTGGCA

2151 GGCAATGGGC GGCAGCCTCA ACCTGCAACA CTTTTCTTGG GACAGGAAAA

-continued

```
2201 CCGGCATATC GGCAAAAGGC GGCGCACGCG GCCTGCACAT CGCCGAGTTG
2251 CACAATTTCT TCAAACCGCC CTTCGAACAC AATCTGGTTT TAAACGGCGA
2301 CTGGGATGTC GCCTACGGGC ACAACGCGCG CGGCTACCTC AATATCAGCC
2351 GGCAAAGCGG CGATGCCGTA TTGCCCGGCG GGCAGGCTTT GGGTTTGAAC
2401 GCATTTTCCC TGAAAACGCG CTTTCAAAAC GACCGCATCG GAATCCTGCT
2451 TGACGGCGGC GCGCGTTTCG GACGGATTAA CGCCGATTTG GGCATCGGCA
2501 ACGCCTTCGG CGGCAATATG GCAAATACAC CGCTCGGCGG CAGGATTACA
2551 GCCTCCCTTC CCGACTTGGG CGCATTGAAG CCCTTTCTGC CCGCCGCCGC
2601 GCAAAACATT ACCGGCAGCC TGAATGCCTC CGCGCAAATC GGCGGACGGG
2651 TAGGCTCTCC GTCCGTCAAT GCCGCCGTCA ACGGTAGCAG CAACTACGGG
2701 AAAATCAACG GCAATATCAC CGTCGGGCAA AGCCGCTCCT TCGATACCGC
2751 ACCTTTGGGC GGCAGGCTCA ACCTGACCGT TGCCGATGCC GAAGCATTCC
2801 GCAACTTCCT ACCGGTCGGA CAAACCGTCA AAGGCAGCCT GAATGCCGCC
2851 GTAACCCTCG GCGGCAGCAT CGCCGACCCG CACTTGGGCG GCAGTATCAA
2901 CGGCGACAAG CTCTATTACC GCAACCAAAC CCAAGGCATC ATCTTGGACA
2951 ACGGCTCGCT GCGTTCGCAT ATTGCAGGCA GGAAATGGGT AATCGACAGC
3001 CTGAAATTCC GGCACGAAGG GACGGCGGAA CTCTCCGGCA CGGTCAGCAT
3051 GGAAAACAGC GTGCCCGATG TCGATATCGG CGCGGTGTTC GACAAATACC
3101 GCATCCTGTC CCGCCCCAAC CGCCGCCTGA CGGTTTCCGG CAACACCCGC
3151 CTGCGCTATT CGCCGCAAAA AGGCATATCC GTTACCGGTA TGATTAAAAC
3201 TGATCAGGGG CTGTTCGGTT CGCAAAAATC CTCGATGCCG TCCGTCGGCG
3251 ACGATGTCGT CGTATTGGGC GAAGTCAAGA AAGAGGCGGC GGCATCGCTC
3301 CCCGTCAATA TGAACCTGAC TTTAGACCTC AATGACGGCA TCCGCTTCTC
3351 CGGCTACGGC GCGGACGTTA CCATAGGCGG CAAACTGACC CTGACCGCGC
3401 AACCGGGCGG AAATGTGCGT GGGGTGGGCA CGGTCCGCGT CATCAAAGGG
3451 CGTTACAAAG CATACGGGCA GGATTTAGAC ATTACCAAAG GCACAGTCTC
3501 CTTTGTCGGC CCGCTCAACG ACCCCAACCT GAACATCCGC GCCGAACGCC
3551 GCCTTTCCCC CGTCGGTGCG GGCGTGGAAA TATTGGGCAG CCTCAACAGC
3601 CCGCGCATTA CGCTGACGGC AAACGAACCG ATGAGTGAAA AAGACAAGCT
3651 CTCCTGGCTC ATCCTCAACC GTGCCGGCAG CGGCAGCAGC GGCGACAATG
3701 CCGCCCTGTC CGCAGCCGCA GGCGCGCTGC TTGCCGGGCA AATCAACGAC
3751 CGCATCGGGC TGGTGGATGA TTTGGGCTTT ACCAGCAAGC GCAGCCGCAA
3801 CGCGCAAACC GGCGAACTCA ACCCCGCCGA ACAGGTGCTG ACCGTCGGCA
3851 AACAACTGAC CGGCAAACTC TACATCGGCT ACGAATACGG CATCTCCAGC
3901 GCGGAACAGT CCGTCAAACT GATTTACCGG CTGACCCGCG CCATACAGGC
3951 GGTTGCCCGT ATCGGCAGCC GTTCGTCGGG CGGCGAGCTG ACATACACCA
4001 TACGTTTCGA CCGCCTCTTC GGTTCGGACA AAAAAGACTC CGCAGGAAAC
4051 GGCAAAGGGA AATAA
```

This corresponds to the amino acid sequence <SEQ ID 1188; ORF 285-1.ng>:

g285-1.pep

```
   1 LKLSAALLSV LILAVCFLGW IAGTEAGLRF GLYQIPSWFG VNISSQNLKG
  51 TLLDGFDGDN WSIETEGADL KISRFRFAWK PSELMRRSLH ITDISAGDIA
 101 IVTKPTPPKE ERPPQGLPDS IDLPAAVYLD RFETGKISMG KTFDKQTVYL
 151 ERLNAAYRYD RKGHRLDLKA ADTPWSSSSG SASVGLKKPF ALDTAIYTKG
 201 GFEGETIHST ARLSGSLKDV RAELTIDGGN IRLSGKSVIH PFAESLDKTL
 251 EEVLVKGFNI NPSAFVPSLP DAGLNFDLTA IPSFSDGIAL EGSLDLENTK
 301 AGFADRNGIP VRQVLGGFVI RQDGTVHIGN TSAALLGRGG IRLSGKIDTE
 351 KDILDLNIGI NSVGAEDVLQ TAFKGRLDGS IGIGGTTASP KISWQLGTGT
 401 ARTDGSLAIA SDPANEQRKL VFDTVNISAG EGSLTAQGYL ELFKDRLLKL
 451 DIRSRAFDPS RIDPQFPAGD INGSIHLAGE LAKEKFTGKM RFLPGTFNGV
 501 PIAGSADIVY ESRHLPRAAV DLRLGRNIVK TDGGFGKKGD RLNLNITAPD
 551 LSRFGFGLAG SLNVRGHLSG DLDGGIRTFE TDLSGTARNL HIGKAADIRS
 601 LDFTLKGSPG TSRPMRADIK GGRLSLSGGA AVVDTAGLTL EGTGAQHRIR
 651 THAAMTLDGK PFKLDLDASG GINRELTRWK GSIGILDIGG AFNLKLQNRM
 701 TLEAGAEHVA ASAANWQAMG GSLNLQHFSW DRKTGISAKG GARGLHIAEL
 751 HNFFKPPFEH NLVLNGDWDV AYGHNARGYL NISRQSGDAV LPGGQALGLN
 801 AFSLKTRFQN DRIGILLDGG ARFGRINADL GIGNAFGGNM ANTPLGGRIT
 851 ASLPDLGALK PFLPAAAQNI TGSLNASAQI GGRVGSPSVN AAVNGSSNYG
 901 KINGNITVGQ SRSFDTAPLG GRLNLTVADA EAFRNFLPVG QTVKGSLNAA
 951 VTLGGSIADP HLGGSINGDK LYYRNQTQGI ILDNGSLRSH IAGRKWVIDS
1001 LKFRHEGTAE LSGTVSMENS VPDVDIGAVF DKYRILSRPN RRLTVSGNTR
1051 LRYSPQKGIS VTGMIKTDQG LFGSQKSSMP SVGDDVVVLG EVKKEAAASL
1101 PVNMNLTLDL NDGIRFSGYG ADVTIGGKLT LTAQPGGNVR GVGTVRVIKG
1151 RYKAYGQDLD ITKGTVSFVG PLNDPNLNIR AERRLSPVGA GVEILGSLNS
1201 PRITLTANEP MSEKDKLSWL ILNRAGSGSS GDNAALSAAA GALLAGQIND
1251 RIGLVDDLGF TSKRSRNAQT GELNPAEQVL TVGRQLTGKL YIGYEYGISS
1301 AEQSVKLIYR LTRAIQAVAR IGSRSSGGEL TYTIRFDRLF GSDKKDSAGN
1351 GKGK*
```

The following partial DNA sequence was identified in *N. meningitidis* <SEQ ID 1189>:

m285-1.seq

```
   1 CTGAAGCTGT CGGCGGCACT GCTGTCTGTC CTGATTTTGG CAGTATGTTT
  51 CCTCGGCTGG CTCGCCGGTA CGGAAGCAGG TTTGCGCTTC GGGCTGTACC
 101 AAATCCCGTC TTGGTTCGGC GTAAACATTT CCTCCCAAAA CCTCAAAGGC
 151 ACGCTGCTCG ACGGCTTCGA CGGCGACAAC TGGTCGATAG AAACCGAGGG
 201 GGCAGACCTT AAAATCAGCC GCTTCCGCTT CGCGTGGAAA CCGTCCGAAC
 251 TGATGCGCCG CAGCCTGCAC ATTACCGAAA TTTCCGCCGG CGACATCGCC
 301 ATCGTTACCA AACCGACTCC GCCTAAAGAA GAACGCCCGC CGCTCAGCCT
```

-continued

```
351 TCCCGACAGC ATAGACCTGC CTGCCGCCGT CTATCTCGAC CGCTTCGAGA

401 CGGGCAAAAT CAGCATGGGC AAAGCCTTTG ACAAACAAAC CGTCTATCTC

451 GAACGGCTGG ATGCTTCATA CCGTTACGAC CGCAAAGGAC ACCGCCTTGA

501 CCTGAAGGCC GCCGACACGC CGTGGAGCAG TTCGTCGGGG GCGGCCTCGG

551 TCGGCTTGAA AAAACCGTTT GCCCTCGATA CCGCCATTTA CACCAAAGGC

601 GGACTCGAAG GCAAAACCAT ACACAGTACG GCTCGGCTGA GCGGCAGCCT

651 GAAGGATGTG CGCGCCGAAC TGGCGATCGA CGGCGGCAAT ATCCGCCTCT

701 CGGGAAAATC CGTCATCCAC CCGTTTGCCG AATCATTGGA TAAAACATTG

751 GAAGAAGTAC TGGTCAAAGG GTTCAACATC AATCCGGCCG CCTTCGTGCC

801 TTCCCTGCCC GATGCCGGAC TGAATTTCGA CCTGACCGCC ATCCCGTCGT

851 TTTCAGACGG CATCGCGCTG GAAGGTTCGC TCGATTTGGA AAACACCAAA

901 GCCGGCTTTG CCGACCGCAA CGGCATCCCC GTCCGTCAGG TTTTAGGCGG

951 CTTTGTCATC CGGCAGGACG GCACGGTGCA TATCGGCAAT ACGTCCGCCG

1001 CCCTGCTCGG ACGGGGCGGC ATCAGGCTGT CGGGCAAAAT CGACACCGAA

1051 AAAGACATCC TCGATTTAAA TATAGGCATC AACTCCGTCG GCGCGGAAGA

1101 CGTACTGCAA ACCGCGTTCA AAGGCAGGTT GGACGGCAGC ATCGGCATCG

1151 GTGGCACGAC CGCCTCGCCC AAAATCTCTT GGCAACTCGG CATCGGCACG

1201 GCGCGCACGG ACGGCAGCCT CGCCATTGCA AGCGACCCAG CAAACGGACA

1251 GCGGAAACTG GTGCTCGACA CCGTCAACAT CGCCGCCGGG CAAGGCAGCC

1301 TGACCGCGCA AGGCTATCTC GAGCTGTTTA AAGACCGCCT GCTCAAGCTG

1351 GACATCCGTT CCCGCGCATT CGACCCTTCG CGCATCGATC CGCAACTTCC

1401 GGCAGGCAAT ATCAACGGCT CAATAAACCT TGCCGGCGAA CTGGCAAAAG

1451 AGAAATTCAC AGGCAAAATG CGGTTTTTAC CCGGCACGTT CAACGGCGTA

1501 CCGATTGCCG GCAGTGCCGA CATTGTTTAC GAGTCCCGCC ACCTTCCGCG

1551 TGCCGCCGTC GATTTGCGGC TGGGGCGGAA CATTATTAAA ACAGACGGCG

1601 GCTTCGGCAA AAAAGGCGAC CGGCTTAACC TCAATATCAC CGCACCCGAT

1651 TTATCCCGTT TCGGTTTCGG ACTCGCGGGG TCTTTAAATG TACGCGGACA

1701 CCTTTCCGGT GATTTGGACG GCGGCATCCG AACCTTTGAA ACCGACCTTT

1751 CCGGCGCGGC GCGCAACCTG CACATCGGCA AGGCGGCAGA CATCCGTTCG

1801 CTCGATTTCA CGCTCAAAGG TTCGCCCGAC ACAAGCCGCC CGATACGCGC

1851 CGACATCAAA GGCAGCCGCC TTTCGCTGTC GGGCGGAGCG GCGGTTCTCG

1901 ATACCGCCGA CCTGATGCTG GACGGCACGG GCGTGCAGCA CCGCATCCGC

1951 ACACACGCCG CCATGACGCT GGATGGCAAA CCGTTCAAAT TCGATTTGGA

2001 CGCTTCAGGC GGCATCAACA GGGAACTTAC CCGATGGAAA GGCAGCATCG

2051 GCATCCTCGA CATCGGCGGC GCATTCAACC TCAAGCTGCA AAACCGTATG

2101 ACGCTCGAAG CCGGTGCGGA ACGCGTGGCG GCAAGTGCGG CAAATTGGCA

2151 GGCAATGGGC GGCAGCCTCA ACCTGCAACA CTTTTCTTGG GATAAAAAAA

2201 CCGGCATATC GGCAAAAGGC GGCGCACACG GTCTGCATAT CGCCGAGTTG

2251 CACAATTTCT TCAAACCGCC CTTCGAACAC AATCTGGTTT TAAACGGCGA

2301 CTGGGATGTC GCCTACGGGC GCAACGCGCG CGGCTACCTC AATATCAGCC
```

-continued

```
2351 GGCAAAGCGG CGATGCCGTA TTGCCCGGCG GGCAGGCTTT GGGTTTGAAC
2401 GCATTTTCCC TGAAAACGCG CTTTCAAAAC GACCGCATCG GAATCCTGCT
2451 TGACGGCGGC GCGCGTTTCG GGCGGATTAA CGCCGATTTG GGCATCGCCA
2501 ACGCCTTCGG CGGCAATATG GCAAATGCAC CGCTCGGCGG CAGGATTACC
2551 GCCTCCCTTC CCGACTTGGG CGCATTGAAG CCCTTTCTGC CCGCCGCCGC
2601 GCAAAACATT ACCGGCAGCC TGAATGCCGC CGCGCAAATC GGCGGACGGG
2651 TAGGCTCTCC GTCCGTCAAT GCCGCCGTCA ACGGCAGCAG CAACTACGGG
2701 AAAATCAACG GCAACATCAC CGTCGGGCAA AGCCGCTCTT TCGATACCGC
2751 GCCTTTGGGC GGCAGGCTCA ACCTGACCGT TGCCGATGCC GAAGTATTCC
2801 GCAACTTCCT ACCGGTCGGA CAAACCGTCA AAGGCAGCCT GAATGCCGCC
2851 GTAACCCTCG GCGGCAGCAT CGCCGATCCG CACTTGGGCG GCAGCATCAA
2901 CGGCGACAAA CTCTATTACC GCAACCAAAC CCAAGGCATC ATCTTGGACA
2951 ACGGCTCGCT GCGTTCGCAT ATCGCGGGCA GGAAATGGGT AATCGACAGC
3001 CTGAAATTCC GGCACGAAGG GACGGCGGAA CTCTCCGGTA CGGTCGGTAT
3051 GGAAAACAGC GGACCCGATG TCGATATCGG CGCGGTGTTC GACAAATACC
3101 GCATCCTGTC CCGCCCCAAC CGCCGCCTGA CGGTTTCCGG CAACACCCGC
3151 CTGCGCTATT CGCCGCAAAA AGGCATATCC GTTACCGGGA TGATTAAAAC
3201 GGATCAGGGG CTGTTCGGTT CGCAAAAATC CTCGATGCCG TCCGTCGGCG
3251 ACGATGTCGT CGTATTAGGC GAAGTCAAAA AAGAGGCGGC GGCACCGCTC
3301 CCCGTCAATA TGAACCTGAC TTTAGACCTC AATGACGGCA TCCGCTTCGC
3351 CGGCTACGGC GCGGACGTTA CCATAGGCGG CAAACTGACC CTGACCGCCC
3401 AATCGGGCGG AAGCGTACGG GGCGTGGGCA CGGTCCGCGT CATCAAAGGG
3451 CGTTATAAGG CATACGGGCA GGATTTGGAC ATTACCAAAG GCACGGTCTC
3501 CTTTGTCGGC CCGCTCAACG ATCCCAACCT CAACATCCGC GCCGAACGCC
3551 GCCTTTCCCC CGTCGGTGCG GGCGTGGAAA TATTGGGCAG CCTCAACAGC
3601 CCGCGCATTA CGCTGACGGC AAACGAACCG ATGAGTGAAA AAGACAAGCT
3651 CTCTTGGCTC ATCCTCAACC GCGCCGGCAG CGGCAGCAGC GGCGACAATG
3701 CCGCCCTGTC TGCAGCCGCA GGTGCGCTGC TTGCCGGGCA AATCAACGAC
3751 CGCATCGGGC TGGTGGATGA TTTGGGCTTT ACCAGCAAGC GCAGCCGCAA
3801 CGCGCAAACC GGCGAACTCA ACCCCGCCGA ACAGGTGCTG ACCGTCGGCA
3851 AACAACTGAC CGGCAAACTC TACATCGGCT ACGAATACAG CATCTCCAGC
3901 GCGGAACAGT CCGTCAAACT GATTTACCGG CTGACCCGCG CCATACAGGC
3951 GGTTGCCCGT ATCGGCAGCC GTTCGTCGGG CGGCGAGCTG ACATACACCA
4001 TACGTTTCGA CCGCTTCTCC GGTTCGGACA AAAAAGACTC CGCCGGAAAC
4051 GGCAAAGGAA AATAA
```

This corresponds to the amino acid sequence <SEQ ID 1190; ORF 285-1>:

m285-1.pep

```
   1 LKLSAALLSV LILAVCFLGW LAGTEAGLRF GLYQIPSWFG VNISSQNLKG
```

-continued

```
  51 TLLDGFDGDN WSIETEGADL KISRFRFAWK PSELMRRSLH ITEISAGDIA
 101 IVTKPTPPKE ERPPLSLPDS IDLPAAVYLD RFETGKISMG KAFDKQTVYL
 151 ERLDASYRYD RKGHRLDLKA ADTPWSSSSG AASVGLKKPF ALDTAIYTKG
 201 GLEGKTIHST ARLSGSLKDV RAELAIDGGN IRLSGKSVIH PFAESLDKTL
 251 EEVLVKGFNI NPAAFVPSLP DAGLNFDLTA IPSFSDGIAL EGSLDLENTK
 301 AGFADRNGIP VRQVLGGFVI RQDGTVHIGN TSAALLGRGG IRLSGKIDTE
 351 KDILDLNIGI NSVGAEDVLQ TAFKGRLDGS IGIGGTTASP KISWQLGIGT
 401 ARTDGSLAIA SDPANGQRKL VLDTVNIAAG QGSLTAQGYL ELFKDRLLKL
 451 DIRSRAFDPS RIDPQLPAGN INGSINLAGE LAKEKFTGKM RFLPGTFNGV
 501 PIAGSADIVY ESRHLPRAAV DLRLGRNIIK TDGGFGKKGD RLNLNITAPD
 551 LSRFGFGLAG SLNVRGHLSG DLDGGIRTFE TDLSGAARNL HIGKAADIRS
 601 LDFTLKGSPD TSRPIRADIK GSRLSLSGGA AVVDTADLML DGTGVQHRIR
 651 THAAMTLDGK PFKFDLDASG GINRELTRWK GSIGILDIGG AFNLKLQNRM
 701 TLEAGAERVA ASAANWQAMG GSLNLQHFSW DKKTGISAKG GAHGLHIAEL
 751 HNFFKPPFEH NLVLNGDWDV AYGRNARGYL NISRQSGDAV LPGGQALGLN
 801 AFSLKTRFQN DRIGILLDGG ARFGRINADL GIANAFGGNM ANAPLGGRIT
 851 ASLPDLGALK PFLPAAAQNI TGSLNAAAQI GGRVGSPSVN AAVNGSSNYG
 901 KINGNITVGQ SRSFDTAPLG GRLNLTVADA EVFRNFLPVG QTVKGSLNAA
 951 VTLGGSIADP HLGGSINGDK LYYRNQTQGI ILDNGSLRSH IAGRKWVIDS
1001 LKFRHEGTAE LSGTVGMENS GPDVDIGAVF DKYRILSRPN RRLTVSGNTR
1051 LRYSPQKGIS VTGMIKTDQG LFGSQKSSMP SVGDDVVVLG EVKKEAAAPL
1101 PVNMNLTLDL NDGIRFAGYG ADVTIGGKLT LTAQSGGSVR GVGTVRVIKG
1151 RYKAYGQDLD ITKGTVSFVG PLNDPNLNIR AERRLSPVGA GVEILGSLNS
1201 PRITLTANEP MSEKDKLSWL ILNRAGSGSS GDNAALSAAA GALLAGQIND
1251 RIGLVDDLGF TSKRSRNAQT GELNPAEQVL TVGKQLTGKL YIGYEYSISS
1301 AEQSVKLIYR LTRAIQAVAR IGSRSSGGEL TYTIRFDRFS GSDKKDSAGN
1351 GKGK*
```

g285-1/m285-1 96.5% identity in 1354 aa overlap

```
                    10        20        30        40        50        60
g285-1.pep  LKLSAALLSVLILAVCFLGWIAGTEAGLRFGLYQIPSWFGVNISSQNLKGTLLDGFDGDN
            |||||||||||||||||||:||||||||||||||||||||||||||||||||||||||||
m285-1      LKLSAALLSVLILAVCFLGWLAGTEAGLRFGLYQIPSWFGVNISSQNLKGTLLDGFDGDN
                    10        20        30        40        50        60

                    70        80        90       100       110       120
g285-1.pep  WSIETEGADLKISRFRFAWKPSELMRRSLHITDISAGDIAIVTKPTPPKEERPPQGLPDS
            ||||||||||||||||||||||||||||||||:||||||||||||||||||||||| :||||
m285-1      WSIETEGADLKISRFRFAWKPSELMRRSLHITEISAGDIAIVTKPTPPKEERPPLSLPDS
                    70        80        90       100       110       120

                   130       140       150       160       170       180
g285-1.pep  IDLPAAVYLDRFETGKISMGKTFDKQTVYLERLNAAYRYDRKGHRLDLKAADTPWSSSSG
            |||||||||||||||||||||:|||||||||||:|:||||||||||||||||||||||||
m285-1      IDLPAAVYLDRFETGKISMGKAFDKQTVYLERLDASYRYDRKGHRLDLKAADTPWSSSSG
                   130       140       150       160       170       180

                   190       200       210       220       230       240
g285-1.pep  SASVGLKKPFALDTAIYTKGGFEGETIHSTARLSGSLKDVRAELTIDGGNIRLSGKSVIH
            :||||||||||||||||||||:||:||||||||||||||||||||:||||||||||||||
m285-1      AASVGLKKPFALDTAIYTKGGLEGKTIHSTARLSGSLKDVRAELAIDGGNIRLSGKSVIH
                   190       200       210       220       230       240
```

-continued

```
                   250       260       270       280       290       300
g285-1.pep  PFAESLDKTLEEVLVKGFNINPSAFVPSLPDAGLNFDLTAIPSFSDGIALEGSLDLENTK
            ||||||||||||||||||||||:|||||||||||||||||||||||||||||||||||||
m285-1      PFAESLDKTLEEVLVKGFNINPAAFVPSLPDAGLNFDLTAIPSFSDGIALEGSLDLENTK
                   250       260       270       280       290       300

                   310       320       330       340       350       360
g285-1.pep  AGFADRNGIPVRQVLGGFVIRQDGTVHIGNTSAALLGRGGIRLSGKIDTEKDILDLNIGI
            ||||||||||||||||||||||||||||||||||||||||||||||||||||||||||||
m285-1      AGFADRNGIPVRQVLGGFVIRQDGTVHIGNTSAALLGRGGIRLSGKIDTEKDILDLNIGI
                   310       320       330       340       350       360

                   370       380       390       400       410       420
g285-1.pep  NSVGAEDVLQTAFKGRLDGSIGIGGTTASPKISWQLGTGTARTDGSLAIASDPANEQRKL
            ||||||||||||||||||||||||||||||||||||| ||||||||||||||||| ||||
m285-1      NSVGAEDVLQTAFKGRLDGSIGIGGTTASPKISWQLGIGTARTDGSLAIASDPANGQRKL
                   370       380       390       400       410       420

                   430       440       450       460       470       480
g285-1.pep  VFDTVNISAGEGSLTAQGYLELFKDRLLKLDIRSRAFDPSRIDPQFPAGDINGSIHLAGE
            |:|||||:||:|||||||||||||||||||||||||||||||||||:||||:|||||:|||
m285-1      VLDTVNIAAGQGSLTAQGYLELFKDRLLKLDIRSRAFDPSRIDPQLPAGNINGSINLAGE
                   430       440       450       460       470       480

                   490       500       510       520       530       540
g285-1.pep  LAKEKFTGKMRFLPGTFNGVPIAGSADIVYESRHLPRAAVDLRLGRNIVKTDGGFGKKGD
            ||||||||||||||||||||||||||||||||||||||||||||||||:|||||||||||
m285-1      LAKEKFTGKMRFLPGTFNGVPIAGSADIVYESRHLPRAAVDLRLGRNIIKTDGGFGKKGD
                   490       500       510       520       530       540

                   550       560       570       580       590       600
g285-1.pep  RLNLNITAPDLSRFGFGLAGSLNVRGHLSGDLDGGIRTFETDLSGTARNLHIGKAADIRS
            |||||||||||||||||||||||||||||||||||||||||||||:||||||||||||||
m285-1      RLNLNITAPDLSRFGFGLAGSLNVRGHLSGDLDGGIRTFETDLSGAARNLHIGKAADIRS
                   550       560       570       580       590       600

                   610       620       630       640       650       660
g285-1.pep  LDFTLKGSPGTSRPMRADIKGGRLSLSGGAAVVDTAGLTLEGTGAQHRIRTHAAMTLDGK
            ||||||||| ||||:||||||:|||||||||||||| | |:||||:||||||||||||||
m285-1      LDFTLKGSPDTSRPIRADIKGSRLSLSGGAAVVDTADLMLDGTGVQHRIRTHAAMTLDGK
                   610       620       630       640       650       660

                   670       680       690       700       710       720
g285-1.pep  PFKLDLDASGGINRELTRWKGSIGILDIGGAFNLKLQNRMTLEAGAEHVAASAANWQAMG
            |||:|||||||||||||||||||||||||||||||||||||||||||:||||||||||||
m285-1      PFKFDLDASGGINRELTRWKGSIGILDIGGAFNLKLQNRMTLEAGAERVAASAANWQAMG
                   670       680       690       700       710       720

                   730       740       750       760       770       780
g285-1.pep  GSLNLQHFSWDRKTGISAKGGARGLHIAELHNFFKPPFEHNLVLNGDWDVAYGHNARGYL
            |||||||||||:|||||||||||:|||||||||||||||||||||||||||||:||||||
m285-1      GSLNLQHFSWDKKTGISAKGGAHGLHIAELHNFFKPPFEHNLVLNGDWDVAYGRNARGYL
                   730       740       750       760       770       780

                   790       800       810       820       830       840
g285-1.pep  NISRQSGDAVLPGGQALGLNAFSLKTRFQNDRIGILLDGGARFGRINADLGIGNAFGGNM
            ||||||||||||||||||||||||||||||||||||||||||||||||||||:|||||||
m285-1      NISRQSGDAVLPGGQALGLNAFSLKTRFQNDRIGILLDGGARFGRINADLGIANAFGGNM
                   790       800       810       820       830       840

                   850       860       870       880       890       900
g285-1.pep  ANTPLGGRITASLPDLGALKPFLPAAAQNITGSLNASAQIGGRVGSPSVNAAVNGSSNYG
            ||:|||||||||||||||||||||||||||||||||:|||||||||||||||||||||||
m285-1      ANAPLGGRITASLPDLGALKPFLPAAAQNITGSLNAAAQIGGRVGSPSVNAAVNGSSNYG
                   850       860       870       880       890       900

                   910       920       930       940       950       960
g285-1.pep  KINGNITVGQSRSFDTAPLGGRLNLTVADAEAFRNFLPVGQTVKGSLNAAVTLGGSIADP
            |||||||||||||||||||||||||||||||:||||||||||||||||||||||||||||
m285-1      KINGNITVGQSRSFDTAPLGGRLNLTVADAEVFRNFLPVGQTVKGSLNAAVTLGGSIADP
                   910       920       930       940       950       960

                   970       980       990      1000      1010      1020
g285-1.pep  HLGGSINGDKLYYRNQTQGIILDNGSLRSHIAGRKWVIDSLKFRHEGTAELSGTVSMENS
            |||||||||||||||||||||||||||||||||||||||||||||||||||||||:||||
m285-1      HLGGSINGDKLYYRNQTQGIILDNGSLRSHIAGRKWVIDSLKFRHEGTAELSGTVGMENS
                   970       980       990      1000      1010      1020

                  1030      1040      1050      1060      1070      1080
g285-1.pep  VPDVDIGAVFDKYRILSRPNRRLTVSGNTRLRYSPQKGISVTGMIKTDQGLFGSQKSSMP
             |||||||||||||||||||||||||||||||||||||||||||||||||||||||||||
m285-1      GPDVDIGAVFDKYRILSRPNRRLTVSGNTRLRYSPQKGISVTGMIKTDQGLFGSQKSSMP
                  1030      1040      1050      1060      1070      1080

                  1090      1100      1110      1120      1130      1140
g285-1.pep  SVGDDVVVLGEVKKEAAASLPVNMNLTLDLNDGIRFSGYGADVTIGGKLTLTAQPGGNVR
            |||||||||||||||||| |||||||||||||||||:||||||||||||||||| ||:||
m285-1      SVGDDVVVLGEVKKEAAAPLPVNMNLTLDLNDGIRFAGYGADVTIGGKLTLTAQSGGSVR
                  1090      1100      1110      1120      1130      1140

                  1150      1160      1170      1180      1190      1200
g285-1.pep  GVGTVRVIKGRYKAYGQDLDITKGTVSFVGPLNDPNLNIRAERRLSPVGAGVEILGSLNS
            ||||||||||||||||||||||||||||||||||||||||||||||||||||||||||||
m285-1      GVGTVRVIKGRYKAYGQDLDITKGTVSFVGPLNDPNLNIRAERRLSPVGAGVEILGSLNS
                  1150      1160      1170      1180      1190      1200
```

-continued

```
                1210       1220       1230       1240       1250       1260
g285-1.pep  PRITLTANEPMSEKDKLSWLILNRAGSGSSGDNAALSAAAGALLAGQINDRIGLVDDLGF
            ||||||||||||||||||||||||||||||||||||||||||||||||||||||||||||
m285-1      PRITLTANEPMSEKDKLSWLILNRAGSGSSGDNAALSAAAGALLAGQINDRIGLVDDLGF
                1210       1220       1230       1240       1250       1260

                1270       1280       1290       1300       1310       1320
g285-1.pep  TSKRSRNAQTGELNPAEQVLTVGKQLTGKLYIGYEYGISSAEQSVKLIYRLTRAIQAVAR
            |||||||||||||||||||||||||||||||||||:||||||||||||||||||||||||
m285-1      TSKRSRNAQTGELNPAEQVLTVGKQLTGKLYIGYEYSISSAEQSVKLIYRLTRAIQAVAR
                1270       1280       1290       1300       1310       1320

                1330       1340       1350
g285-1.pep  IGSRSSGGELTYTIRFDRLFGSDKKDSAGNGKGK
            ||||||||||||||||||: |||||||||||||||
m285-1      IGSRSSGGELTYTIRFDRFSGSDKKDSAGNGKGKX
                1330       1340       1350
```

The following partial DNA sequence was identified in *N. meningitidis* <SEQ ID 1191>:

<u>a285-1.seq</u>

```
   1 CTGAAGCTGT CGGCGGCACT GCTGTCTGTT CTGATTTTGG CAGTATGTTT
  51 CCTCGGCTGG CTCGCCGGCA CGGAAGCGGG TTTGCGCTTC GGGCTGTACC
 101 AAATCCCGTC TTGGTTCGGC GTAAACATTT CCTCCCAAAA CCTCAAAGGC
 151 ACGCTGCTCG ACGGCTTCGA CGGCGACAAC TGGTCGATAG AAACCGAGGG
 201 GGCAGACCTT AAAATCAGCC GCTTCCGCTT CGCGTGGAAA CCGTCCGAAC
 251 TGATGCGCCG CAGCCTGCAC ATTACCGAAA TTTCCGCCGG CGACATCGCC
 301 ATCGTTACCA AACCGACTCC GCCTAAAGAA GAACGCCCGC CGCTCAGCCT
 351 TCCCGACAGC ATAGACCTGC CTGCCGCCGT CTATCTCGAC CGCTTCGAGA
 401 CGGGCAAAAT CAGCATGGGC AAAGCCTTTG ACAAACAAAC CGTCTATCTC
 451 GAACGGCTGG ATGCTTCATA CCGTTACGAC CGCAAAGGAC ACCGCCTCGA
 501 CCTGAAGGCT GCCGACACGC CGTGGAGCAG TTCGTCGGGG TCAGCCTCGG
 551 TCGGCTTGAA AAAACCGTTT GCCCTCGATA CCGCCATTTA CACCAAAGGC
 601 GGACTCGAAG GCAAAACCAT ACACAGTACG GCTCGGCTGA GCGGCAGCCT
 651 GAAGGATGTG CGCGCCGAAC TGGCGATCGA CGGCGGCAAT ATCCGCCTCT
 701 CGGGAAAATC CGTCATCCAC CCGTTTGCCG AATCATTGGA TAAAACATTG
 751 GAAGAAGTAC TGGTCAAAGG GTTCAACATC AATCCGTCCG CCTTCGTGCC
 801 TTCCCTGCCC GATGCCGGGC TGAATTTCGA CCTGACCGCC ATCCCGTCGT
 851 TTTCAGACGG CATCGCGCTG GAAGGCTCGC TCGATTTGGA AAACACCAAA
 901 GCCGGCTTTG CCGACCGCAA CGGCATCCCC GTCCGTCAGG TTTTAGGCAG
 951 CTTTGTCATC CGGCAGCACG GCACGGTGCA TATCGGCAAT ACGTCCGTCG
1001 CCCTGCTCGG ACGGGGCGGC ATCAGGCTGT CGGGCAAAAT CGACACCGAA
1051 AAAGACATCC TCGATTTAAA TATAGGCATC AACTCCGTCG GCGCGGAAGA
1101 CGTACTGCAA ACCGCGTTCA AAGGCAGGTT GGACGGCAGC ATCGGCATCG
1151 GTGGCACGAC CGCCTCGCCC AAAATCTCTT GGCAACTCGG CATCGGCACG
1201 GCGCGCACGG ACGGCAGCCT CGCCATTGCA AGCGACCCCG CAAACGGACA
1251 GCGGAAACTG GTGCTCGACA CCGTCAACAT CGCCGCCGGG CAAGGCAGCC
1301 TGACCGCGCA AGGCTATCTC GAGCTGTTTA AAGACCGCCT GCTCAAGCTG
1351 GACATCCGTT CCCGCGCATT CGACCCTTCG CGCATCGATC CGCAACTTCC
```

-continued

1401 GGCAGGCAAT ATCAACGGCT CAATAAACCT TGCCGGCGAA CTGGCAAAAG

1451 AGAAATTCAC AGGCAAAATG CGGTTTTTAC CCGGCACGTT CAACGGCGTA

1501 CCGATTGCCG GCAGTGCCGA CATTGTTTAC GAGTCCCGCC ACCTTCCGCG

1551 TGCCGCCGTC GATTTGCGGC TGGGGCGGAA CATTATTAAA ACAGACGGCG

1601 GCTTCGGCAA AAAAGGCGAC CGGCTTAACC TCAATATCAC CGCACCCGAT

1651 TTATCCCGTT TCGGTTTCGG ACTCGCGGGG TCTTTAAATG TACGCGGACA

1701 CCTTTCCGGC GATTTGGACG GTGGCATCCG AACCTTTGAA ACCGACCTTT

1751 CCGGCGCGGC GCGCAACCTG CACATCGGCA AGGCGGCAGA CATCCGTTCG

1801 CTCGATTTCA CGCTCAAAGG TTCGCCCGAC ACAAGCCGCC CGATACGCGC

1851 CGACATCAAA GGCAGCCGCC TTTCGCTGTC GGGCGGAGCG GAGGTTGTCG

1901 ATACCGCCGA CCTGATGCTG GACGGCACGG GCGTGCAGCA CCGCATCCGC

1951 ACACACGCCG CCATGACGCT GGATGGCAAA CCGTTCAAAT TCGATTTGGA

2001 CGCTTCAGGC GGCATCAACA GGGAACTTAC CCGATGGAAA GGCAGCATCG

2051 GCATCCTCGA CATCGGCGGC GCATTCAACC TCAAGCTGCA AAACCGTATG

2101 ACGCTCGAAG CCGGTGCGGA ACGCGTGGCG GCAAGTGCGG CAAATTGGCA

2151 GGCAATGGGC GGCAGCCTCA ACCTGCAACA CTTTTCTTGG GATAAAAAAA

2201 CCGGCATATC GGCAAAAGGC GGCGCACACG GTCTGCATAT CGCCGAGTTG

2251 CACAATTTCT TCAAACCGCC CTTCGAACAC AATCTGGTTT TAAACGGCGA

2301 CTGGGATGTC GCCTACGGGC GAAACGCGCG CGGCTACCTC AATATCAGCC

2351 GGCAAAGCGG CGATGCCGTA TTGCCCGGCG GGCAGGCTTT GGGTTTGAAC

2401 GCATTTTCCC TGAAAACGCG CTTTCAAAAC GACCGTATCG GAATCCTGCT

2451 TGACGGCGGC GCGCGTTTCG GGCGGATTAA CGCCGATTTG GACATCGGCA

2501 ACGCCTTCGG CGGCAATATG GCAAATGCAC CGCTCGGCGG CAGGATTACC

2551 GCCTCCCTTC CCGACTTGGG CACATTGAAG CCCTTTCTGC CCGCCGCCGC

2601 GCAAAACATT ACCGGCAGCC TGAATGCCGC CGCGCAAATC GGCGGACGGG

2651 TCGGCTCTCC GTCCGTCAAT GCCGCCGTCA ACGGCAGCAG CAACTACGGG

2701 AAAATCAACG GCAACATCAC CGTCGGGCAA AGCCGCTCTT TCGATACCGC

2751 GCCTTTGGGC GGCAGGCTCA ACCTGACCGT TGCCGATGCC GAAGTATTCC

2801 GCAACTTCCT ACCGGTCGGA CAAACCGTCA AAGGCAGCCT GAATGCCGCC

2851 GTAACCCTCG GCGGCAGCAT CGCCGATCCG CACTTGGGCG GCAGCATCAA

2901 CGGCGACAAA CTCTATTACC GCAACCAAAC CCAAGGCATC ATCTTGGACA

2951 ACGGCTCGCT GCGTTCGCAT ATCGCGGGCA GGAAATGGGT AATCGACAGC

3001 CTGAAATTCC GGCACGAAGG GACGGCGGAA CTCTCCGGTA CGGTCGGTAT

3051 GGAAAACAGC GGACCCGATG TCGATATCGG CGCGGTGTTC GACAAATACC

3101 GCATCCTGTC CCGCCCCAAC CGCCGCCTGA CGGTTTCCGG CAACACCCGC

3151 CTGCGCTATT CGCCGCAAAA AGGCATATCC GTTACCGGGA TGATTAAAAC

3201 GGATCAGGGG CTGTTCGGTT CGCAAAAATC CTCGATGCCG TCCGTCGGCG

3251 ACGATGTCGT CGTATTAGGC GAAGTCAAAA AAGAGGCGGC GGCACCGCTC

3301 CCCGTCAATA TGAACCTGAC TTTAGACCTC AATGACGGCA TCCGCTTCGC

3351 CGGCTACGGC GCGGACGTTA CCATAGGCGG CAAACTGACC CTGACCGCCC

-continued

3401 AATCGGGCGG AAGCGTGCGG GGCGTGGGCA CGGTCCGCGT CATCAAAGGG

3451 CGTTATAAGG CATACGGGCA GGATTTGGAC ATTACCAAAG GCACGGTCTC

3501 CTTTGTCGGC CCGCTCAACG ACCCCAACCT CAACATCCGC GCCGAACGCC

3551 GCCTTTCCCC CGTCGGTGCG GGCGTGGAAA TATTGGGCAG CCTCAACAGT

3601 CCGCGCATTA CGCTGACGGC AAACGAACCG ATGAGTGAAA AAGACAAGCT

3651 CTCCTGGCTC ATCCTCAACC GCGCCGGCAG TGGCAGCAGC GGCGACAATG

3701 CCGCCCTGTC CGCAGCCGCC GGCGCGCTGC TTGCCGGGCA AATCAACGAC

3751 CGCATCGGGC TGGTGGATGA TTTGGGCTTT ACCAGCAAGC GCAGCCGCAA

3801 CGCGCAAACC GGCGAACTCA ACCCCGCCGA ACAGGTGCTG ACCGTCGGCA

3851 AACAACTGAC CGGCAAACTC TACATCGGCT ACGAATACAG CATCTCCAGC

3901 GCGGAACAGT CCGTCAAACT GATTTACCGG CTGACCCGCG CCATACAGGC

3951 GGTTGCCCGT ATCGGCAGCC GTTCGTCGGG CGGCGAGCTG ACATACACCA

4001 TACGTTTCGA CCGCTTCTCC GGTTCGGACA AAAAAGACTC CGCCGGAAAC

4051 AGCAAAGGAA AATAA

This corresponds to the amino acid sequence <SEQ ID 1192; ORF 285-1.a>:

a285-1.pep

1 LKLSAALLSV LILAVCFLGW LAGTEAGLRF GLYQIPSWFG VNISSQNLKG

51 TLLDGFDGDN WSIETEGADL KISRFRFAWK PSELMRRSLH ITEISAGDIA

101 IVTKPTPPKE ERPPLSLPDS IDLPAAVYLD RFETGKISMG KAFDKQTVYL

151 ERLDASYRYD RKGHRLDLKA ADTPWSSSSG SASVGLKKPF ALDTAIYTKG

201 GLEGKTIHST ARLSGSLKDV RAELAIDGGN IRLSGKSVIH PFAESLDKTL

251 EEVLVKGFNI NPSAFVPSLP DAGLNFDLTA IPSFSDGIAL EGSLDLENTK

301 AGFADRNGIP VRQVLGSFVI RQDGTVHIGN TSVALLGRGG IRLSGKIDTE

351 KDILDLNIGI NSVGAEDVLQ TAFKGRLDGS IGIGGTTASP KISWQLGIGT

401 ARTDGSLAIA SDPANGQRKL VLDTVNIAAG QGSLTAQGYL ELFKDRLLKL

451 DIRSRAFDPS RIDPQLPAGN INGSINLAGE LAKEKFTGKM RFLPGTFNGV

501 PIAGSADIVY ESRHLPRAAV DLRLGRNIIK TDGGFGKKGD RLNLNITAPD

551 LSRFGFGLAG SLNVRGHLSG DLDGGIRTFE TDLSGAARNL HIGKAADIRS

601 LDFTLKGSPD TSRPIPADIK GSRLSLSGGA EVVDTADLML DGTGVQHRIR

651 THAAMTLDGK PFKFDLDASG GINRELTRWK GSIGILDIGG AFNLKLQNRM

701 TLEAGAERVA ASAANWQAMG GSLNLQHFSW DKKTGISAKG GAHGLHIAEL

751 HNFFKPPFEH NLVLNGDWDV AYGRNARGYL NISRQSGDAV LPGGQALGLN

801 AFSLKTRFQN DRIGILLDGG ARFGRINADL DIGNAFGGNM ANAPLGGRIT

851 ASLPDLGTLK PFLPAAAQNI TGSLNAAAQI GGRVGSPSVN AAVNGSSNYG

901 KINGNITVGQ SRSFDTAPLG GRLNLTVADA EVFRNFLPVG QTVKGSLNAA

951 VTLGGSIADP HLGGSINGDK LYYRNQTQGI ILDNGSLRSH IAGRKWVIDS

1001 LKFRHEGTAE LSGTVGMENS GPDVDIGAVF DKYRILSRPN RRLTVSGNTR

-continued

```
1051 LRYSPQKGIS VTGMIKTDQG LFGSQKSSMP SVGDDVVVLG EVKKEAAAPL

1101 PVNMNLTLDL NDGIRFAGYG ADVTIGGKLT LTAQSGGSVR GVGTVRVIKG

1151 RYKAYGQDLD ITKGTVSFVG PLNDPNLNIR AERRLSPVGA GVEILGSLNS

1201 PRITLTANEP MSEKDKLSWL ILNRAGSGSS GDNAALSAAA GALLAGQIND

1251 RIGLVDDLGF TSKRSRNAQT GELNPAEQVL TVGKQLTGKL YIGYEYSISS

1301 AEQSVKLIYR LTRAIQAVAR IGSRSSGGEL TYTIRFDRFS GSDKKDSAGN

1351 SKGK*
```

a285-1/m285-1 99.3% identity in 1354 aa overlap

```
                    10        20        30        40        50        60
a285-1.pep  LKLSAALLSVLILAVCFLGWLAGTEAGLRFGLYQIPSWFGVNISSQNLKGTLLDGFDGDN
            ||||||||||||||||||||||||||||||||||||||||||||||||||||||||||||
m285-1      LKLSAALLSVLILAVCFLGWLAGTEAGLRFGLYQIPSWFGVNISSQNLKGTLLDGFDGDN
                    10        20        30        40        50        60

                    70        80        90       100       110       120
a285-1.pep  WSIETEGADLKISRFRFAWKPSELMRRSLHITEISAGDIAIVTKPTPPKEERPPLSLPDS
            ||||||||||||||||||||||||||||||||||||||||||||||||||||||||||||
m285-1      WSIETEGADLKISRFRFAWKPSELMRRSLHITEISAGDIAIVTKPTPPKEERPPLSLPDS
                    70        80        90       100       110       120

                   130       140       150       160       170       180
a285-1.pep  IDLPAAVYLDRFETGKISMGKAFDKQTVYLERLDASYRYDRKGHRLDLKAADTPWSSSSG
            ||||||||||||||||||||||||||||||||||||||||||||||||||||||||||||
m285-1      IDLPAAVYLDRFETGKISMGKAFDKQTVYLERLDASYRYDRKGHRLDLKAADTPWSSSSG
                   130       140       150       160       170       180

                   190       200       210       220       230       240
a285-1.pep  SASVGLKKPFALDTAIYTKGGLEGKTIHSTARLSGSLKDVRAELAIDGGNIRLSGKSVIH
            :|||||||||||||||||||||||||||||||||||||||||||||||||||||||||||
m285-1      AASVGLKKPFALDTAIYTKGGLEGKTIHSTARLSGSLKDVRAELAIDGGNIRLSGKSVIH
                   190       200       210       220       230       240

                   250       260       270       280       290       300
a285-1.pep  PFAESLDKTLEEVLVKGFNINPSAFVPSLPDAGLNFDLTAIPSFSDGIALEGSLDLENTK
            ||||||||||||||||||||||:|||||||||||||||||||||||||||||||||||||
m285-1      PFAESLDKTLEEVLVKGFNINPAAFVPSLPDAGLNFDLTAIPSFSDGIALEGSLDLENTK
                   250       260       270       280       290       300

                   310       320       330       340       350       360
a285-1.pep  AGFADRNGIPVRQVLGSFVIRQDGTVHIGNTSVALLGRGGIRLSGKIDTEKDILDLNIGI
            ||||||||||||||||:|||||||||||||||:|||||||||||||||||||||||||||
m285-1      AGFADRNGIPVRQVLGGFVIRQDGTVHIGNTSAALLGRGGIRLSGKIDTEKDILDLNIGI
                   310       320       330       340       350       360

                   370       380       390       400       410       420
a285-1.pep  NSVGAEDVLQTAFKGRLDGSIGIGGTTASPKISWQLGIGTARTDGSLAIASDPANGQRKL
            ||||||||||||||||||||||||||||||||||||||||||||||||||||||||||||
m285-1      NSVGAEDVLQTAFKGRLDGSIGIGGTTASPKISWQLGIGTARTDGSLAIASDPANGQRKL
                   370       380       390       400       410       420

                   430       440       450       460       470       480
a285-1.pep  VLDTVNIAAGQGSLTAQGYLELFKDRLLKLDIRSRAFDPSRIDPQLPAGNINGSINLAGE
            ||||||||||||||||||||||||||||||||||||||||||||||||||||||||||||
m285-1      VLDTVNIAAGQGSLTAQGYLELFKDRLLKLDIRSRAFDPSRIDPQLPAGNINGSINLAGE
                   430       440       450       460       470       480

                   490       500       510       520       530       540
a285-1.pep  LAKEKFTGKMRFLPGTFNGVPIAGSADIVYESRHLPRAAVDLRLGRNIIKTDGGFGKKGD
            ||||||||||||||||||||||||||||||||||||||||||||||||||||||||||||
m285-1      LAKEKFTGKMRFLPGTFNGVPIAGSADIVYESRHLPRAAVDLRLGRNIIKTDGGFGKKGD
                   490       500       510       520       530       540

                   550       560       570       580       590       600
a285-1.pep  RLNLNITAPDLSRFGFGLAGSLNVRGHLSGDLDGGIRTFETDLSGAARNLHIGKAADIRS
            ||||||||||||||||||||||||||||||||||||||||||||||||||||||||||||
m285-1      RLNLNITAPDLSRFGFGLAGSLNVRGHLSGDLDGGIRTFETDLSGAARNLHIGKAADIRS
                   550       560       570       580       590       600

                   610       620       630       640       650       660
a285-1.pep  LDFTLKGSPDTSRPIRADIKGSRLSLSGGAEVVDTADLMLDGTGVQHRIRTHAAMTLDGK
            |||||||||||||||||||||||||||||| |||||||||||||||||||||||||||||
m285-1      LDFTLKGSPDTSRPIRADIKGSRLSLSGGAAVVDTADLMLDGTGVQHRIRTHAAMTLDGK
                   610       620       630       640       650       660

                   670       680       690       700       710       720
a285-1.pep  PFKFDLDASGGINRELTRWKGSIGILDIGGAFNLKLQNRMTLEAGAERVAASAANWQAMG
            ||||||||||||||||||||||||||||||||||||||||||||||||||||||||||||
m285-1      PFKFDLDASGGINRELTRWKGSIGILDIGGAFNLKLQNRMTLEAGAERVAASAANWQAMG
                   670       680       690       700       710       720
```

-continued

```
                730        740        750        760        770        780
a285-1.pep  GSLNLQHFSWDKKTGISAKGGAHGLHIAELHNFFKPPFEHNLVLNGDWDVAYGRNARGYL
            ||||||||||||||||||||||||||||||||||||||||||||||||||||||||||||
m285-1      GSLNLQHFSWDKKTGISAKGGAHGLHIAELHNFFKPPFEHNLVLNGDWDVAYGRNARGYL
                730        740        750        760        770        780

                790        800        810        820        830        840
a285-1.pep  NISRQSGDAVLPGGQALGLNAFSLKTRFQNDRIGILLDGGARFGRINADLDIGNAFGGNM
            |||||||||||||||||||||||||||||||||||||||||||||||||| |:|||||||
m285-1      NISRQSGDAVLPGGQALGLNAFSLKTRFQNDRIGILLDGGARFGRINADLGIANAFGGNM
                790        800        810        820        830        840

                850        860        870        880        890        900
a285-1.pep  ANAPLGGRITASLPDLGTLKPFLPAAAQNITGSLNAAAQIGGRVGSPSVNAAVNGSSNYG
            ||||||||||||||||:|||||||||||||||||||||||||||||||||||||||||||
m285-1      ANAPLGGRITASLPDLGALKPFLPAAAQNITGSLNAAAQIGGRVGSPSVNAAVNGSSNYG
                850        860        870        880        890        900

                910        920        930        940        950        960
a285-1.pep  KINGNITVGQSRSFDTAPLGGRLNLTVADAEVFRNFLPVGQTVKGSLNAAVTLGGSIADP
            ||||||||||||||||||||||||||||||||||||||||||||||||||||||||||||
m285-1      KINGNITVGQSRSFDTAPLGGRLNLTVADAEVFRNFLPVGQTVKGSLNAAVTLGGSIADP
                910        920        930        940        950        960

                970        980        990       1000       1010       1020
a285-1.pep  HLGGSINGDKLYYRNQTQGIILDNGSLRSHIAGRKWVIDSLKFRHEGTAELSGTVGMENS
            ||||||||||||||||||||||||||||||||||||||||||||||||||||||||||||
m285-1      HLGGSINGDKLYYRNQTQGIILDNGSLRSHIAGRKWVIDSLKFRHEGTAELSGTVGMENS
                970        980        990       1000       1010       1020

               1030       1040       1050       1060       1070       1080
a285-1.pep  GPDVDIGAVFDKYRILSRPNRRLTVSGNTRLRYSPQKGISVTGMIKTDQGLFGSQKSSMP
            ||||||||||||||||||||||||||||||||||||||||||||||||||||||||||||
m285-1      GPDVDIGAVFDKYRILSRPNRRLTVSGNTRLRYSPQKGISVTGMIKTDQGLFGSQKSSMP
               1030       1040       1050       1060       1070       1080

               1090       1100       1110       1120       1130       1140
a285-1.pep  SVGDDVVVLGEVKKEAAAPLPVNMNLTLDLNDGIRFAGYGADVTIGGKLTLTAQSGGSVR
            ||||||||||||||||||||||||||||||||||||||||||||||||||||||||||||
m285-1      SVGDDVVVLGEVKKEAAAPLPVNMNLTLDLNDGIRFAGYGADVTIGGKLTLTAQSGGSVR
               1090       1100       1110       1120       1130       1140

               1150       1160       1170       1180       1190       1200
a285-1.pep  GVGTVRVIKGRYKAYGQDLDITKGTVSFVGPLNDPNLNIRAERRLSPVGAGVEILGSLNS
            ||||||||||||||||||||||||||||||||||||||||||||||||||||||||||||
m285-1      GVGTVRVIKGRYKAYGQDLDITKGTVSFVGPLNDPNLNIRAERRLSPVGAGVEILGSLNS
               1150       1160       1170       1180       1190       1200

               1210       1220       1230       1240       1250       1260
a285-1.pep  PRITLTANEPMSEKDKLSWLILNRAGSGSSGDNAALSAAAGALLAGQINDRIGLVDDLGF
            ||||||||||||||||||||||||||||||||||||||||||||||||||||||||||||
m285-1      PRITLTANEPMSEKDKLSWLILNRAGSGSSGDNAALSAAAGALLAGQINDRIGLVDDLGF
               1210       1220       1230       1240       1250       1260

               1270       1280       1290       1300       1310       1320
a285-1.pep  TSKRSRNAQTGELNPAEQVLTVGKQLTGKLYIGYEYSISSAEQSVKLIYRLTRAIQAVAR
            ||||||||||||||||||||||||||||||||||||||||||||||||||||||||||||
m285-1      TSKRSRNAQTGELNPAEQVLTVGKQLTGKLYIGYEYSISSAEQSVKLIYRLTRAIQAVAR
               1270       1280       1290       1300       1310       1320

               1330       1340       1350
a285-1.pep  IGSRSSGGELTYTIRFDRFSGSDKKDSAGNSKGKX
            ||||||||||||||||||||||||||||||:||||
m285-1      IGSRSSGGELTYTIRFDRFSGSDKKDSAGNGKGKX
               1330       1340       1350
```

The following partial DNA sequence was identified in *N. gonorrhoeae* <SEQ ID 1193>:

g286.seq

```
  1 atgcagaaca ccggtaccat gatgatcaaa ccgaccgccc tgctcctgcc
 51 ggctttattt ttctttccgc acgcatacgc gcctgccgcc gacctttccg
101 aaaacaaggc ggcgggtttc gcattgttca aaagcaaaag ccccgacacc
151 gaatcagtca aattaaaacc caaattcccc gtccgcatcg acacgcagga
201 cagtgaaatc aaagatatgg tcgaagaaca cctgccgctc atcacgcagc
251 agcaggaaga ggttttggat aaggaacaga cgggattcct tgccgaagaa
301 gcaccggaca acgttaaaac aatgctccgc agcaaaggct atttcagcag
351 caaggtcagc ctgacggaaa aagacggagc ttatacggtg cacatcacac
401 cgggcccgcg caccaaaatc gccaacgtcg gcgtcgccat cctcggcgac
```

-continued

```
 451 atcctttcag acggcaacct cgccgaatac taccgcaacg cgctggaaaa
 501 ctggcagcag ccggtaggca gcgatttcga tcaggacagt tgggaaaaca
 551 gcaaaacttc cgtcctcggc gcggtaacgc gcaaaggcta cccgcttgcc
 601 aagctcggca acacccgggc ggccgtcaac cccgataccg ccaccgccga
 651 tttgaacgtc gtcgtggaca gcggccgccc cattgccttc ggcgactttg
 701 aaatcaccgg cacacagcgt taccccgaac aaaccgtctc cggcctggcg
 751 cgcttccaac cgggcacgcc ctacgacctc gacctgctgc tcgacttcca
 801 acaggcgctc gaacaaaacg ggcattattc cggcgcgtcc gtacaagccg
 851 acttcgaccg cctcccaagg ggaccgcgtc cccgtcaaag tcagcgtaac
 901 cgaggtcaaa cgccacaaac tcgaaaccgg catccgcctc gattcggaat
 951 acggtttggg cggcaaaatc gcctacgact attacaacct cttcaacaaa
1001 ggctatatcg gctcggtcgt ctgggatatg gacaaatacg aaaccacgct
1051 tgccgccggc atcagccagc cgcgcaacta tcggggcaac tactggacaa
1101 gcaacgtttc ctacaaccgt tcgaccaccc aaaacctcga aaaacgcgcc
1151 ttctccggcg gcatctggta tgtgcgcgac cgcgcgggca tcgatgccag
1201 gctgggggcg gaatttctcg cagaaggccg gaaaatcccc ggctcggatg
1251 tcgatttggg caacagccac gccacgatgc tgaccgcctc ttggaaacgc
1301 cagctgctca acaacgtgct gcaccccgaa aacggccatt acctcgacgg
1351 caaaatcggg acgactttgg gcacattcct gtcctccacc gcgctaatcc
1401 gcacctctgc ccgcgcaggt tatttcttca cgcccgaaaa caaaaaactc
1451 ggcacgttca tcatacgcgg acaagcgggt tacaccgttg cacgcgacaa
1501 tgccgatgtc ccctcggggc tgatgttccg cagcggcggc gcgtcttccg
1551 tgcgcggtta cgaacttga
```

This corresponds to the amino acid sequence <SEQ ID 1194; ORF 286.ng>:

g286.pep

```
  1 MQNTGTMMIK PTALLLPALF FFPHAYAPAA DLSENKAAGF ALFKSKSPDT
 51 ESVKLKPKFP VRIDTQDSEI KDMVEEHLPL ITQQQEEVLD KEQTGFLAEE
101 APDNVKTMLR SKGYFSSKVS LTEKDGAYTV HITPGPRTKI ANVGVAILGD
151 ILSDGNLAEY YRNALENWQQ PVGSDFDQDS WENSKTSVLG AVTRKGYPLA
201 KLGNTRAAVN PDTATADLNV VVDSGRPIAF GDFEITGTQR YPEQTVSGLA
251 RFQPGTPYDL DLLLDFQQAL EQNGHYSGAS VQADFDRLPR GPRPRQSQRN
301 RGQTPQTRNR HPPRFGIRFG RQNRLRLLQP LQQRLYRLGR LGYGQIRNHA
351 CRRHQPAAQL SGQLLDKQRF LQPFDHPKPR KTRLLRRHLV CARPRGHRCQ
401 AGGGISRRRP ENPRLGCRFG QQPRHDADRL LETPAAQQRA APRKRPLPRR
451 QNRDDFGHIP VLHRANPHLC PRRLFLHARK QKTRHVHHTR TSGLHRCTRQ
501 CRCPLGADVP QRRRVFRARL RT*
```

The following partial DNA sequence was identified in *N. meningitidis* <SEQ ID 1195>:

m286.seq

```
   1 ATGCACGACA CCCGTACCAT GATGATCAAA CCGACCGCCC TGCTCCTGCC
  51 GGCTTTATTT TTCTTTCCGC ACGCATACGC GCCTGCCGCC GACCTTTCCG
 101 AAAACAAGGC GGCGGGTTTC GCATTGTTCA AAAACAAAAG CCCCGACACC
 151 GAATCAGTCA AATTAAAACC CAAATTCCCC GTCCTCATCG ACACGCAGGA
 201 CAGTGAAATC AAAGATATGG TCGAAGAACA CCTGCCGCTC ATCACGCAGC
 251 AGCAGGAAGA AGTATTGGAC AAGGAACAGA CGGGCTTCCT CGCCGAAGAA
 301 GCGCCGGACA ACGTTAAAAC GATGCTCCGC AGCAAAGGCT ATTTCAGCAG
 351 CAAAGTCAGC CTGACGGAAA AAGACGGAGC TTATACGGTA CACATCACAC
 401 CGGGCCCGCG CACCAAAATC GCCAACGTCG GCGTCGCCAT CCTCGGCGAC
 451 ATCCTTTCAG ACGGCAACCT CGCCGAATAC TACCGCAACG CGCTGGAAAA
 501 CTGGCAGCAG CCGGTAGGCA GCGATTTCGA TCAGGACAGT TGGGAAAACA
 551 GCAAAACTTC CGTCCTCGGC GCGGTAACGC GCAAAGCCTA CCCGCTTGCC
 601 AAGCTCGGCA ATACGCAGGC GGCCGTCAAC CCCGATACCG CCACCGCCGA
 651 TTTGAACGTC GTCGTGGACA GCGGCCGCCC CATCGCCTTC GGCGACTTTG
 701 AAATCACCGG CACACAGCGT TACCCCGAAC AAATCGTCTC CGGCCTTGCG
 751 CGTTTCCAGC CCGGTATGCC GTACGACCTC GACCTGCTGC TCGACTTCCA
 801 ACAGGCGCTC GAACAAAACG GGCATTATTC CGGCGCGTCC GTACAAGCCG
 851 ACTTCGACCG CCTCCAAGGC GACCGCGTCC CCGTCAAAGT CAGCGTAACC
 901 GAGGTCAAAC GCCACAAACT CGAAACCGGC ATCCGCCTCG ATTCGGAATA
 951 CGGTTTGGGC GGCAAAATCG CCTACGACTA TTACAACCTC TTCAACAAAG
1001 GCTATATCGG TTCGGTCGTC TGGGATATGG ACAAATACGA AACCACGCTT
1051 GCCGCCGGCA TCAGCCAGCC GCGCAACTAT CGGGGCAACT ACTGGACAAG
1101 CAACGTTTCC TACAACCGTT CGACCACCCA AAACCTCGAA AAACGCGCCT
1151 TCTCCGGCGG CGTCTGGTAT GTGCGCGACC GCGCGGGCAT CGATGCCAGG
1201 CTGGGGGCGG AATTTCTCGC AGAAGGCCGG AAAATCCCCG GCTCGGCTGT
1251 CGATTTGGGC AACAGCCACG CCACGATGCT GACCGCCTCT TGGAAACGCC
1301 AGCTGCTCAA CAACGTGCTG CATCCCGAAA ACGGCCATTA CCTCGACGGC
1351 AAAATCGGTA CGACTTTGGG CACATTCCTG TCCTCCACCG CGCTGATCCG
1401 CACCTCTGCC CGTGCAGGTT ATTTCTTCAC GCCCGAAAAC AAAAAACTCG
1451 GCACGTTCAT CATACGCGGA CAAGCGGGTT ACACCGTTGC CCGCGACAAT
1501 GCCGACGTTC CTTCAGGGCT GATGTTCCGC AGCGGCGGCG CGTCTTCCGT
1551 GCGCGGTTAC GAACTCGACA GCATCGGACT TGCCGGCCCG AACGGATCGG
1601 TCCTGCCCGA ACGCGCCCTC CTGGTGGGCA GCCTGGAATA CCAACTGCCG
1651 TTTACGCGCA CCCTTTCCGG CGCGGTGTTC CACGATATGG GCGATGCCGC
1701 CGCCAATTTC AAACGTATGA AGCTGAAACA CGGTTCGGGA CTGGGCGTGC
1751 GCTGGTTCAG CCCGCTTGCG CCGTTTTCCT TCGACATCGC CTACGGGCAC
1801 AGCGATAAGA AAATCCGCTG GCACATCAGC TTGGGAACGC GCTTCTAA
```

This corresponds to the amino acid sequence <SEQ ID 1196; ORF 286>:

m286.pep

```
  1 MHDTRTMMIK PTALLLPALF FFPHAYAPAA DLSENKAAGF ALFKNKSPDT
 51 ESVKLKPKFP VLIDTQDSEI KDMVEEHLPL ITQQQEEVLD KEQTGFLAEE
101 APDNVKTMLR SKGYFSSKVS LTEKDGAYTV HITPGPRTKI ANVGVAILGD
151 ILSDGNLAEY YRNALENWQQ PVGSDFDQDS WENSKTSVLG AVTRKAYPLA
201 KLGNTQAAVN PDTATADLNV VVDSGRPIAF GDFEITGTQR YPEQIVSGLA
251 RFQPGMPYDL DLLLDFQQAL EQNGHYSGAS VQADFDRLQG DRVPVKVSVT
301 EVKRHKLETG IRLDSEYGLG GKIAYDYYNL FNKGYIGSVV WDMDKYETTL
351 AAGISQPRNY RGNYWTSNVS YNRSTTQNLE KRAFSGGVWY VRDRAGIDAR
401 LGAEFLAEGR KIPGSAVDLG NSHATMLTAS WKRQLLNNVL HPENGHYLDG
451 KIGTTLGTFL SSTALIRTSA RAGYFFTPEN KKLGTFIIRG QAGYTVARDN
501 ADVPSGLMFR SGGASSVRGY ELDSIGLAGP NGSVLPERAL LVGSLEYQLP
551 FTRTLSGAVF HDMGDAAANF KRMKLKHGSG LGVRWFSPLA PFSFDIAYGH
601 SDKKIRWHIS LGTRF*
```

Computer analysis of this amino acid sequence gave the following results:

Homology with a predicted ORF from *N. gonorrhoeae*
m286/g286 95.9% identity in 293 aa overlap

```
                      10        20        30        40        50        60
m286.pep    MHDTRTMMIKPTALLLPALFFFPHAYAPAADLSENKAAGFALFKNKSPDTESVKLKPKFP
            |::| |||||||||||||||||||||||||||||||||||||||:|||||||||||||||
g286        MQNTGTMMIKPTALLLPALFFFPHAYAPAADLSENKAAGFALFKSKSPDTESVKLKPKFP
                      10        20        30        40        50        60

                      70        80        90       100       110       120
m286.pep    VLIDTQDSEIKDMVEEHLPLITQQQEEVLDKEQTGFLAEEAPDNVKTMLRSKGYFSSKVS
            | ||||||||||||||||||||||||||||||||||||||||||||||||||||||||||
g286        VRIDTQDSEIKDMVEEHLPLITQQQEEVLDKEQTGFLAEEAPDNVKTMLRSKGYFSSKVS
                      70        80        90       100       110       120

                     130       140       150       160       170       180
m286.pep    LTEKDGAYTVHITPGPRTKIANVGVAILGDILSDGNLAEYYRNALENWQQPVGSDFDQDS
            ||||||||||||||||||||||||||||||||||||||||||||||||||||||||||||
g286        LTEKDGAYTVHITPGPRTKIANVGVAILGDILSDGNLAEYYRNALENWQQPVGSDFDQDS
                     130       140       150       160       170       180

                     190       200       210       220       230       240
m286.pep    WENSKTSVLGAVTRKAYPLAKLGNTQAAVNPDTATADLNVVVDSGRPIAFGDFEITGTQR
            |||||||||||||||:|||||||||:||||||||||||||||||||||||||||||||||
g286        WENSKTSVLGAVTRKGYPLAKLGNTRAAVNPDTATADLNVVVDSGRPIAFGDFEITGTQR
                     190       200       210       220       230       240

                     250       260       270       280       290       299
m286.pep    YPEQIVSGLARFQPGMPYDLDLLLDFQQALEQNGHYSGASVQADFDRL-QGDRVPVKVSV
            |||| |||||||||| |||||||||||||||||||||||||||||||| :| |
g286        YPEQTVSGLARFQPGTPYDLDLLLDFQQALEQNGHYSGASVQADFDRLPRGPRPRQSQRN
                     250       260       270       280       290       300

                300       310       320       330       340       350       359
m286.pep    TEVKRHKLETGIRLDSEYGLGGKIAYDYYNLFNKGYIGSVVWDMDKYETTLAAGISQPRN

g286        RGQTPQTRNRHPPRFGIRFGRQNRLRLLQPLQQRLYRLGRLGYGQIRNHACRRHQPAAQL
                     310       320       330       340       350       360
```

The following partial DNA sequence was identified in *N. meningitidis* <SEQ ID 1197>:

a286.seq

```
  1 ATGCACGACA CCCGTACCAT GATGATTAAA CCGACCGCCC TGCTCCTGCC
 51 GGCTTTATTT TTCTTTCCGC ACGCATACGC GCCTGCCGCC GACCTTTCCG
101 AAAACAAGGC GGCGGGTTTC GCATTGTTCA AAAACAAAAG CCCCGACACC
```

-continued

```
 151 GAATCAGTTA AATTAAAACC CAAATTCCCC GTCCGCATCG ACACGCAGGA
 201 TAGTGAAATC AAAGATATGG TCGAAGAACA CCTGCCGCTC ATCACGCAGC
 251 AGCAGGAAGA AGTATTGGAC AAGGAACAGA CGGGCTTCCT CGCCGAAGAA
 301 GCACCGGACA ACGTTAAAAC AATGCTCCGC AGCAAAGGCT ATTTCAGCAG
 351 CAAAGTCAGC CTGACGGAAA AAGACGGAGC TTATACGGTA CACATCACAC
 401 CGGGCCCGCG CACCAAAATC GCCAACGTCG GCGTCGCCAT CCTCGGCGAC
 451 ATCCTTTCAG ACGGCAACCT CGCCGAATAC TACCGCAACG CGCTGGAAAA
 501 CTGGCAGCAG CCGGTAGGCA GTGATTTCGA TCAGGACAGT TGGGAAAACA
 551 GCAAAACTTC CGTCCTCGGC GCGGTAACGC GCAAAGCCTA CCCGCTTGCC
 601 AAGCTCGGCA ACACCCGGGC GGCCGTCAAC CCCGATACCG CCACCGCCGA
 651 TTTGAACGTC GTCGTGGACA GCGGCCGCCC CATCGCCTTC GGCGACTTTG
 701 AAATTACCGG CACGCAGCGT TACCCCGAAC AAATCGTCTC CGGCTTGGCG
 751 CGCTTCCAAC CGGGCACGCC CTACGACCTC GACCTGCTGC TCGACTTCCA
 801 ACAGGCGCTC GAACAAAACG GGCATTATTC CGGCGCGTCC GTACAAGCCG
 851 ACTTCGACCG CCTCCAAGGC GACCGCGTCC CCGTCAAAGT CAGCGTAACC
 901 GAGGTCAAAC GCCACAAGCT CGAAACCGGC ATCCGCCTCG ATTCGGAATA
 951 CGGTTTGGGC GGCAAAATCG CCTACGACTA TTACAACCTC TTCAACAAAG
1001 GCTATATCGG TTCGGTCGTC TGGGATATGG ACAAATACGA AACCACGCTT
1051 GCCGCCGGCA TCAGCCAGCC GCGCAACTAT CGGGGCAACT ACTGGACAAG
1101 CAACGTTTCC TACAACCGTT CGACCACCCA AAACCTCGAA AAACGCGCCT
1151 TCTCCGGCGG CATCTGGTAT GTGCGCGACC GCGCGGGCAT CGATGCCAGG
1201 CTGGGGGCGG AGTTTCTCGC AGAAGGCCGG AAAATCCCCG GCTCGGATAT
1251 CGATTTGGGC AACAGCCACG CCACGATGCT GACCGCCTCT TGGAAACGCC
1301 AGCTGCTCAA CAACGTGCTG CATCCCGAAA ACGGCCATTA CCTCGACGGC
1351 AAAATCGGTA CGACTTTGGG CGCATTCCTG TCCTCCACCG CGCTGATCCG
1401 CACCTCTGCC CGCGCAGGTT ATTTCTTCAC GCCCGAAAAC AAAAAACTCG
1451 GCACGTTCAT CATACGCGGA CAAGCGGGTT ACACCGTTGC CCGCGACAAT
1501 GCCAACGTTC CTTCAGGGCT GATGTTCCGC AGCGGCGGCG CGTCTTCCGT
1551 GCGCGGTTAC GAACTCGACA GCATCGGGCT TGCCGGCCCG AACGGATCGG
1601 TCCTGCCCGA ACGCGCCCTC TTGGTGGGCA GCCTGGAATA CCAACTGCCG
1651 TTTACGCGCA CCCTTTCCGG CGCGGTGTTC CACGATATGG GCGACGCCGC
1701 CGCCAATTTC AAACGTATGA AGCTGAAACA CGGTTCGGGA CTGGGCGTGC
1751 GCTGGTTCAG CCCGCTCGCG CCGTTTTCCT TCGACATCGC CTACGGGCAC
1801 AGCGACAAGA AAATCCGCTG GCACATCAGC TTGGGAACGC GCTTCTAA
```

This corresponds to the amino acid sequence <SEQ ID 1198; ORF 286.a>:

<u>a286.pep</u>

```
  1 MHDTRTMMIK PTALLLPALF FFPHAYAPAA DLSENKAAGF ALFKNKSPDT
 51 ESVKLKPKFP VRIDTQDSEI KDMVEEHLPL ITQQQEEVLD KEQTGFLAEE
```

-continued

```
101 APDNVKTMLR SKGYFSSKVS LTEKDGAYTV HITPGPRTKI ANVGVAILGD

151 ILSDGNLAEY YRNALENWQQ PVGSDFDQDS WENSKTSVLG AVTRKAYPLA

201 KLGNTRAAVN PDTATADLNV VVDSGRPIAF GDFEITGTQR YPEQIVSGLA

251 RFQPGTPYDL DLLLDFQQAL EQNGHYSGAS VQADFDRLQG DRVPVKVSVT

301 EVKRHKLETG IRLDSEYGLG GKIAYDYYNL FNKGYIGSVV WDMDKYETTL

351 AAGISQPRNY RGNYWTSNVS YNRSTTQNLE KRAFSGGIWY VRDRAGIDAR

401 LGAEFLAEGR KIPGSDIDLG NSHATMLTAS WKRQLLNNVL HPENGHYLDG

451 KIGTTLGAFL SSTALIRTSA RAGYFFTPEN KKLGTFIIRG QAGYTVARDN

501 ANVPSGLMFR SGGASSVRGY ELDSIGLAGP NGSVLPERAL LVGSLEYQLP

551 FTRTLSGAVF HDMGDAAANF KRMKLKHGSG LGVRWFSPLA PFSFDIAYGH

601 SDKKIRWHIS LGTRF*
```

m286/a286 98.7% identity in 615 aa overlap

```
                  10        20        30        40        50        60
m286.pep  MHDTRTMMIKPTALLLPALFFFPHAYAPAADLSENKAAGFALFKNKSPDTESVKLKPKFP
          ||||||||||||||||||||||||||||||||||||||||||||||||||||||||||||
a286      MHDTRTMMIKPTALLLPALFFFPHAYAPAADLSENKAAGFALFKNKSPDTESVKLKPKFP
                  10        20        30        40        50        60

                  70        80        90       100       110       120
m286.pep  VLIDTQDSEIKDMVEEHLPLITQQQEEVLDKEQTGFLAEEAPDNVKTMLRSKGYFSSKVS
          | ||||||||||||||||||||||||||||||||||||||||||||||||||||||||||
a286      VRIDTQDSEIKDMVEEHLPLITQQQEEVLDKEQTGFLAEEAPDNVKTMLRSKGYFSSKVS
                  70        80        90       100       110       120

                 130       140       150       160       170       180
m286.pep  LTEKDGAYTVHITPGPRTKIANVGVAILGDILSDGNLAEYYRNALENWQQPVGSDFDQDS
          ||||||||||||||||||||||||||||||||||||||||||||||||||||||||||||
a286      LTEKDGAYTVHITPGPRTKIANVGVAILGDILSDGNLAEYYRNALENWQQPVGSDFDQDS
                 130       140       150       160       170       180

                 190       200       210       220       230       240
m286.pep  WENSKTSVLGAVTRKAYPLAKLGNTQAAVNPDTATADLNVVVDSGRPIAFGDFEITGTQR
          |||||||||||||||||||||||||||:||||||||||||||||||||||||||||||||
a286      WENSKTSVLGAVTRDAYPLAKLGNTRAAVNPDTATADLNVVVDSGRPIAFGDFEITGTQR
                 190       200       210       220       230       240

                 250       260       270       280       290       300
m286.pep  YPEQIVSGLARFQPGMPYDLDLLLDFQQALEQNGHYSGASVQADFDRLQGDRVPVKVSVT
          ||||||||||||||| ||||||||||||||||||||||||||||||||||||||||||||
a286      YPEQIVSGLARFQPGTPYDLDLLLDFQQALEQNGHYSGASVQADFDRLQGDRVPVKVSVT
                 250       260       270       280       290       300

                 310       320       330       340       350       360
m286.pep  EVKRHKLETGIRLDSEYGLGGKIAYDYYNLFNKGYIGSVVWDMDKYETTLAAGISQPRNY
          ||||||||||||||||||||||||||||||||||||||||||||||||||||||||||||
a286      EVKRHKLETGIRLDSEYGLGGKIAYDYYNLFNKGYIGSVVWDMDKYETTLAAGISQPRNY
                 310       320       330       340       350       360

                 370       380       390       400       410       420
m286.pep  RGNYWTSNVSYNRSTTQNLEKRAFSGGVWYVRDRAGIDARLGAEFLAEGRKIPGSAVDLG
          |||||||||||||||||||||||||||:||||||||||||||||||||||||||| :|||
a286      RGNYWTSNVSYNRSTTQNLEKRAFSGGIWYVRDRAGIDARLGAEFLAEGRKIPGSDIDLG
                 370       380       390       400       410       420

                 430       440       450       460       470       480
m286.pep  NSHATMLTASWKRQLLNNVLHPENGHYLDGKIGTTLGTFLSSTALIRTSARAGYFFTPEN
          |||||||||||||||||||||||||||||||||||||:||||||||||||||||||||||
a286      NSHATMLTASWKRQLLNNVLHPENGHYLDGKIGTTLGAFLSSTALIRTSARAGYFFTPEN
                 430       440       450       460       470       480

                 490       500       510       520       530       540
m286.pep  KKLGTFIIRGQAGYTVARDNADVPSGLMFRSGGASSVRGYELDSIGLAGPNGSVLPERAL
          |||||||||||||||||||||:||||||||||||||||||||||||||||||||||||||
a286      KKLGTFIIRGQAGYTVARDNANVPSGLMFRSGGASSVRGYELDSIGLAGPNGSVLPERAL
                 490       500       510       520       530       540

                 550       560       570       580       590       600
m286.pep  LVGSLEYQLPFTRTLSGAVFHDMGDAAANFKRMKLKHGSGLGVRWFSPLAPFSFDIAYGH
          ||||||||||||||||||||||||||||||||||||||||||||||||||||||||||||
a286      LVGSLEYQLPFTRTLSGAVFHDMGDAAANFKRMKLKHGSGLGVRWFSPLAPFSFDIAYGH
                 550       560       570       580       590       600
```

-continued

```
              610
m286.pep  SDKKIRWHISLGTRFX
          ||||||||||||||||
a286      SDKKIRWHISLGTRFX
              610
```

The following partial DNA sequence was identified in *N. gonorrhoeae* <SEQ ID 1199>:

g287.seq

```
   1 atgtttaaac gcagtgtgat tgcaatggct tgtatttttc ccctttcagc
  51 ctgtgggggc ggcggtggcg gatcgcccga tgtcaagtcg gcggacacgc
 101 cgtcaaaacc ggccgccccc gttgttgctg aaaatgccgg ggaaggggtg
 151 ctgccgaaag aaaagaaaga tgaggaggca gcgggcggtg cgccgcaagc
 201 cgatacgcag gacgcaaccg ccggagaagg cagccaagat atggcggcag
 251 tttcggcaga aaatacaggc aatggcggtg cggcaacaac ggacaacccc
 301 aaaaatgaag acgcgggggc gcaaaatgat atgccgcaaa atgccgccga
 351 atccgcaaat caaacaggga acaaccaacc cgccggttct tcagattccg
 401 cccccgcgtc aaaccctgcc cctgcgaatg gcggtagcga ttttggaagg
 451 acgaacgtgg gcaattctgt tgtgattgac ggaccgtcgc aaaatataac
 501 gttgacccac tgtaaaggcg attcttgtaa tggtgataat ttattggatg
 551 aagaagcacc gtcaaaatca gaatttgaaa aattaagtga tgaagaaaaa
 601 attaagcgat ataaaaaaga cgagcaacgg gagaattttg tcggtttggt
 651 tgctgacagg gtaaaaaagg atggaactaa caaatatatc atcttctata
 701 cggacaaacc acctactcgt tctgcacggt cgaggaggtc gcttccggcc
 751 gagattccgc tgattcccgt caatcaggcc gatacgctga ttgtggatgg
 801 ggaagcggtc agcctgacgg ggcattccgg caatatcttc gcgcccgaag
 851 ggaattaccg gtatctgact tacggggcgg aaaaattgcc cggcggatcg
 901 tatgccctcc gtgtgcaagg cgaaccggca aaaggcgaaa tgcttgttgg
 951 cacggccgtg tacaacggcg aagtgctgca tttccatatg gaaaacggcc
1001 gtccgtaccc gtccggaggc aggtttgccg caaaagtcga tttcggcagc
1051 aaatctgtgg acggcattat cgacagcggc gatgatttgc atatgggtac
1101 gcaaaaattc aaagccgcca tcgatggaaa cggctttaag gggacttgga
1151 cggaaaatgg cggcggggat gtttccggaa ggttttacgg cccggccggc
1201 gaggaagtgg cgggaaaata cagctatcgc ccgacagatg ctgaaaaggg
1251 cggattcggc gtgtttgccg gcaaaaaaga tcgggattga
```

This corresponds to the amino acid sequence <SEQ ID 1200; ORF 287.ng>:

g287.pep

```
  1 MFKRSVIAMA CIFPLSACGG GGGGSPDVKS ADTPSKPAAP VVAENAGEGV
 51 LPKEKKDEEA AGGAPQADTQ DATAGEGSQD MAAVSAENTG NGGAATTDNP
101 KNEDAGAQND MPQNAAESAN QTGNNQPAGS SDSAPASNPA PANGGSDFGR
```
(Residues 1–17, MFKRSVIAMA CIFPLSA, are underlined.)

-continued

```
151 TNVGNSVVID GPSQNITLTH CKGDSCNGDN LLDEEAPSKS EFEKLSDEEK

201 IKRYKKDEQR ENFVGLVADR VKKDGTNKYI IFYTDKPPTR SARSRRSLPA

251 EIPLIPVNQA DTLIVDGEAV SLTGHSGNIF APEGNYRYLT YGAEKLPGGS

301 YALRVQGEPA KGEMLVGTAV YNGEVLHFHM ENGRPYPSGG RFAAKVDFGS

351 KSVDGIIDSG DDLHMGTQKF KAAIDGNGFK GTWTENGGGD VSGRFYGPAG

401 EEVAGKYSYR PTDAEKGGFG VFAGKKDRD*
```

The following partial DNA sequence was identified in *N. meningitidis* <SEQ ID 1201>:

m287.seq

```
   1 ATGTTTAAAC GCAGCGTAAT CGCAATGGCT TGTATTTTTG CCCTTTCAGC
  51 CTGCGGGGGC GGCGGTGGCG GATCGCCCGA TGTCAAGTCG GCGGACACGC
 101 TGTCAAAACC TGCCGCCCCT GTTGTTTCTG AAAAAGAGAC AGAGGCAAAG
 151 GAAGATGCGC CACAGGCAGG TTCTCAAGGA CAGGGCGCGC CATCCGCACA
 201 AGGCAGTCAA GATATGGCGG CGGTTTCGGA AGAAAATACA GGCAATGGCG
 251 GTGCGGTAAC AGCGGATAAT CCCAAAAATG AAGACGAGGT GGCACAAAAT
 301 GATATGCCGC AAAATGCCGC CGGTACAGAT AGTTCGACAC CGAATCACAC
 351 CCCGGATCCG AATATGCTTG CCGGAAATAT GGAAAATCAA GCAACGGATG
 401 CCGGGGAATC GTCTCAGCCG GCAAACCAAC CGGATATGGC AAATGCGGCG
 451 GACGGAATGC AGGGGGACGA TCCGTCGGCA GGCGGGCAAA ATGCCGGCAA
 501 TACGGCTGCC CAAGGTGCAA ATCAAGCCGG AAACAATCAA GCCGCCGGTT
 551 CTTCAGATCC CATCCCCGCG TCAAACCCTG CACCTGCGAA TGGCGGTAGC
 601 AATTTTGGAA GGGTTGATTT GGCTAATGGC GTTTTGATTG ACGGGCCGTC
 651 GCAAAATATA ACGTTGACCC ACTGTAAAGG CGATTCTTGT AGTGGCAATA
 701 ATTTCTTGGA TGAAGAAGTA CAGCTAAAAT CAGAATTTGA AAAATTAAGT
 751 GATGCAGACA AAATAAGTAA TTACAAGAAA GATGGGAAGA ATGATAAATT
 801 TGTCGGTTTG GTTGCCGATA GTGTGCAGAT GAAGGGAATC AATCAATATA
 851 TTATCTTTTA TAAACCTAAA CCCACTTCAT TTGCGCGATT TAGGCGTTCT
 901 GCACGGTCGA GGCGGTCGCT TCCGGCCGAG ATGCCGCTGA TTCCCGTCAA
 951 TCAGGCGGAT ACGCTGATTG TCGATGGGGA AGCGGTCAGC CTGACGGGGC
1001 ATTCCGGCAA TATCTTCGCG CCCGAAGGGA ATTACCGGTA TCTGACTTAC
1051 GGGGCGGAAA AATTGCCCGG CGGATCGTAT GCCCTTCGTG TTCAAGGCGA
1101 ACCGGCAAAA GGCGAAATGC TTGCGGGCGC GGCCGTGTAC AACGGCGAAG
1151 TACTGCATTT CCATACGGAA AACGGCCGTC CGTACCCGAC CAGGGGCAGG
1201 TTTGCCGCAA AAGTCGATTT CGGCAGCAAA TCTGTGGACG GCATTATCGA
1251 CAGCGGCGAT GATTTGCATA TGGGTACGCA AAAATTCAAA GCCGCCATCG
1301 ATGGAAACGG CTTTAAGGGG ACTTGGACGG AAAATGGCAG CGGGGATGTT
1351 TCCGGAAAGT TTTACGGCCC GGCCGGCGAG GAAGTGGCGG GAAAATACAG
1401 CTATCGCCCG ACAGATGCGG AAAAGGGCGG ATTCGGCGTG TTTGCCGGCA
1451 AAAAAGAGCA GGATTGA
```

This corresponds to the amino acid sequence <SEQ ID 1202; ORF 287>:

```
m287.pep

  1 MFKRSVIAMA CIFALSACGG GGGGSPDVKS ADTLSKPAAP VVSEKETEAK

 51 EDAPQAGSQG QGAPSAQGSQ DMAAVSEENT GNGGAVTADN PKNEDEVAQN

101 DMPQNAAGTD SSTPNHTPDP NMLAGNMENQ ATDAGESSQP ANQPDMANAA

151 DGMQGDDPSA GGQNAGNTAA QGANQAGNNQ AAGSSDPIPA SNPAPANGGS

201 NFGRVDLANG VLIDGPSQNI TLTHCKGDSC SGNNFLDEEV QLKSEFEKLS

251 DADKISNYKK DGKNDKFVGL VADSVQMKGI NQYIIFYKPK PTSFARFRRS

301 ARSRRSLPAE MPLIPVNQAD TLIVDGEAVS LTGHSGNIFA PEGNYRYLTY

351 GAEKLPGGSY ALRVQGEPAK GEMLAGAAVY NGEVLHFHTE NGRPYPTRGR

401 FAAKVDFGSK SVDGIIDSGD DLHMGTQKFK AAIDGNGFKG TWTENGSGDV

451 SGKFYGPAGE EVAGKYSYRP TDAEKGGFGV FAGKKEQD*
```

Computer analysis of this amino acid sequence gave the following results:

Homology with a predicted ORF from *N. gonorrhoeae* m287/g287 70.1% identity in 499 aa overlap

```
                      10        20        30        40                  49
m287.pep      MFKRSVIAMACIFALSACGGGGGGSPDVKSADTLSKPAAPVVSE-----------KETEA
              ||||||||||||| ||||||||||||||||||| ||||||||:|           |: ||
g287          MFKRSVIAMACIFPLSACGGGGGGSPDVKSADTPSKPAAPVVAEDVGEEVLPKEKKDEEA
                      10        20        30        40        50        60

            50        60        70        80        90       100       109
m287.pep      KEDAPQAGSQGQGAPSAQGSQDMAAVSEENTGNGGAVTADNPKNEDEVAQNDMPQNAAGT
                 |||| :|   | :::||||||||| ||||||||:|:|||||||  ||||||||||
g287          AGGAPQADTQD--ATAGEGSQDMAAVSAENTGNGGAATTDNPKNEDAGAQNDMPQNAA--
                      70          80        90       100       110

           110       120       140       140       150       160       169
m287.pep      DSSTPNHTPDPNMLAGNMENQATDAGESSQPANQPDMANAADGMQGDDPSAGGQNAGNTA

g287          ------------------------------------------------------------

           170       180       190       200       210       220       229
m287.pep      AQGANQAGNNQAAGSSDPIPASNPAPANGGSNFGRVDLANGVLIDGPSQNITLTHCKGDS
               ::|||:|||| |||||  ||||||||||||:|||::::|:|:|||||||||||||||||
g287          -ESANQTGNNQPAGSSDSAPASNPAPANGGSDFGRTNVGNSVVIDGPSQNITLTHCKGDS
                 120       130       140       150       160       170

           230       240       250       260       270       280       289
m287.pep      CSGNNFLDEEVQLKSEFEKLSDADKISNYKKDGKNDKFVGLVADSVQMKGINQYIIFYKP
              |:|:|:||||:  |||||||||  :||: ||||  : ::||||||| |:  | |:|||||
g287          CNGDNLLDEEAPSKSEFEKLSDEEKIKRYKKDEQRENFVGLVADRVKKDGTNKYIIFYTD
                 180       190       200       210       220       230

           290       300       310       320       330       340       349
m287.pep      KPTSFARFRRSARSRRSLPAEMPLIPVNQADTLIVDGEAVSLTGHSGNIFAPEGNYRYLT
              ||  :     ||||||||||||:||||||||||||||||||||||||||||||||||||||
g287          KPPT-----RSARSRRSLPAEIPLIPVNQADTLIVDGEAVSLTGHSGNIFAPEGNYRYLT
                     240       250       260       270       280       290

           350       360       370       380       390       400       409
m287.pep      YGAEKLPGGSYALRVQGEPAKGEMLAGAAVYNGEVLHFHTENGRPYPTRGRFAAKVDFGS
              |||||||||||||||||||||||||:|:||||||||||| |||||||: |||||||||||
g287          YGAEKLPGGSYALRVQGEPAKGEMLVGTAVYNGEVLHFHMENGRPYPSGGRFAAKVDFGS
                     300       310       320       330       340       350

           410       420       430       440       450       460       469
m287.pep      KSVDGIIDSGDDLHMGTQKFKAAIDGNGFKGTWTENGSGDVSGKFYGPAGEEVAGKYSYR
              |||||||||||||||||||||||||||||||||||||:|||||:||||||||||||||||
g287          KSVDGIIDSGDDLHMGTQKFKAAIDGNGFKGTWTENGGGDVSGRFYGPAGEEVAGKYSYR
                     360       370       380       390       400       410

           470       480       489
m287.pep      PTDAEKGGFGVFAGKKEQDX
              ||||||||||||||||::||
g287          PTDAEKGGFGVFAGKKDRDX
                     420       430
```

The following partial DNA sequence was identified in *N. meningitidis* <SEQ ID 1203>:

a287.seq

```
   1 ATGTTTAAAC GCAGTGTGAT TGCAATGGCT TGTATTGTTG CCCTTTCAGC
  51 CTGTGGGGGC GGCGGTGGCG GATCGCCCGA TGTTAAGTCG GCGGACACGC
 101 TGTCAAAACC TGCCGCCCCT GTTGTTACTG AAGATGTCGG GGAAGAGGTG
 151 CTGCCGAAAG AAAAGAAAGA TGAGGAGGCG GTGAGTGGTG CGCCGCAAGC
 201 CGATACGCAG GACGCAACCG CCGGAAAAGG CGGTCAAGAT ATGGCGGCAG
 251 TTTCGGCAGA AAATACAGGC AATGGCGGTG CGGCAACAAC GGATAATCCC
 301 GAAAATAAAG ACGAGGGACC GCAAAATGAT ATGCCGCAAA ATGCCGCCGA
 351 TACAGATAGT TCGACACCGA ATCACACCCC TGCACCGAAT ATGCCAACCA
 401 GAGATATGGG AAACCAAGCA CCGGATGCCG GGGAATCGGC ACAACCGGCA
 451 AACCAACCGG ATATGGCAAA TGCGGCGGAC GGAATGCAGG GGGACGATCC
 501 GTCGGCAGGG GAAAATGCCG GCAATACGGC AGATCAAGCT GCAAATCAAG
 551 CTGAAAACAA TCAAGTCGGC GGCTCTCAAA ATCCTGCCTC TTCAACCAAT
 601 CCTAACGCCA CGAATGGCGG CAGCGATTTT GGAAGGATAA ATGTAGCTAA
 651 TGGCATCAAG CTTGACAGCG GTTCGGAAAA TGTAACGTTG ACACATTGTA
 701 AAGACAAAGT ATGCGATAGA GATTTCTTAG ATGAAGAAGC ACCACCAAAA
 751 TCAGAATTTG AAAAATTAAG TGATGAAGAA AAAATTAATA AATATAAAAA
 801 AGACGAGCAA CGAGAGAATT TTGTCGGTTT GGTTGCTGAC AGGGTAGAAA
 851 AGAATGGAAC TAACAAATAT GTCATCATTT ATAAAGACAA GTCCGCTTCA
 901 TCTTCATCTG CGCGATTCAG GCGTTCTGCA CGGTCGAGGC GGTCGCTTCC
 951 GGCCGAGATG CCGCTGATTC CCGTCAATCA GGCGGATACG CTGATTGTCG
1001 ATGGGGAAGC GGTCAGCCTG ACGGGGCATT CCGGCAATAT CTTCGCGCCC
1051 GAAGGGAATT ACCGGTATCT GACTTACGGG GCGGAAAAAT TGTCCGGCGG
1101 ATCGTATGCC CTCAGTGTGC AAGGCGAACC GGCAAAAGGC GAAATGCTTG
1151 CGGGCACGGC CGTGTACAAC GGCGAAGTGC TGCATTTCCA TATGGAAAAC
1201 GGCCGTCCGT CCCCGTCCGG AGGCAGGTTT GCCGCAAAAG TCGATTTCGG
1251 CAGCAAATCT GTGGACGGCA TTATCGACAG CGGCGATGAT TTGCATATGG
1301 GTACGCAAAA ATTCAAAGCC GTTATCGATG GAAACGGCTT TAAGGGGACT
1351 TGGACGGAAA ATGGCGGCGG GGATGTTTCC GGAAGGTTTT ACGGCCCGGC
1401 CGGCGAAGAA GTGGCGGGAA AATACAGCTA TCGCCCGACA GATGCGGAAA
1451 AGGGCGGATT CGGCGTGTTT GCCGGCAAAA AAGAGCAGGA TTGA
```

This corresponds to the amino acid sequence <SEQ ID 1204; ORF 287.a>:

a287.pep

```
  1 MFKRSVIAMA CIVALSACGG GGGGSPDVKS ADTLSKPAAP VVTEDVGEEV
 51 LPKEKKDEEA VSGAPQADTQ DATAGKGGQD MAAVSAENTG NGGAATTDNP
101 ENKDEGPQND MPQNAADTDS STPNHTPAPN MPTRDMGNQA PDAGESAQPA
151 NQPDMANAAD GMQGDDPSAG ENAGNTADQA ANQAENNQVG GSQNPASSTN
201 PNATNGGSDF GRINVANGIK LDSGSENVTL THCKDKVCDR DFLDEEAPPK
```

-continued

```
251 SEFEKLSDEE KINKYKKDEQ RENFVGLVAD RVEKNGTNKY VIIYKDKSAS

301 SSSARFRRSA RSRRSLPAEM PLIPVNQADT LIVDGEAVSL TGHSGNIFAP

351 EGNYRYLTYG AEKLSGGSYA LSVQGEPAKG EMLAGTAVYN GEVLHFHMEN

401 GRPSPSGGRF AAKVDFGSKS VDGIIDSGDD LHMGTQKFKA VIDGNGFKGT

451 WTENGGGDVS GRFYGPAGEE VAGKYSYRPT DAEKGGFGVF AGKKEQD*
```

m287/a287 77.2% identity in 501 aa overlap

```
                     10        20        30        40                  49
m287.pep     MFKRSVIAMACIFALSACGGGGGGSPDVKSADTLSKPAAPVVSE-----------KETEA
             |||||||||||| ||||||||||||||||||||||||||||||:|          |: ||
a287         MFKRSVIAMACIVALSACGGGGGGSPDVKSADTLSKPAAPVVTEDVGEEVLPKEKKDEEA
                     10        20        30        40        50        60

            50        60        70        80        90       100      109
m287.pep     KEDAPQAGSQGQGAPSAQGSQDMAAVSEENTGNGGAVTADNPKNEDEVAQNDMPQNAAGT
                |||| :|   | :::|:||||||| ||||||||:|:|||:|:||  ||||||||| |
a287         VSGAPQADTQ--DATAGKGGQDMAAVSAENTGNGGAATTDNPENKDEGPQNDMPQNAADT
                     70          80        90       100       110

           110       120       140       140       150       160      169
m287.pep     DSSTPNHTPDPNMLAGNMENQATDAGESSQPANQPDMANAADGMQGDDPSAGGQNAGNTA
             ||||||||| ||| : :| ||| |||||:||||||||||||||||||||||| :||||||
a287         DSSTPNHTPAPNMPTRDMGNQAPDAGESAQPANQPDMANAADGMQGDDPSAG-ENAGNTA
            120       130       140       150       160       170

           170       180       190       200       210       220      229
m287.pep     AQGANQAGNNQAAGSSDPIPASNPAPANGGSNFGRVDLANGVLIDGPSQNITLTHCKGDS
              |:|||  |||::||::|  ::||  :||||:|||:::|||: :|: |:|:||||||
a287         DQAANQAENNQVGGSQNPASSTNPNATNGGSDFGRINVANGIKLDSGSENVTLTHCKDKV
             180       190       200       210       220       230

           230       240       250       260       270       280      289
m287.pep     CSGNNFLDEEVQLKSEFEKLSDADKISNYKKDGKNDKFVGLVADSVQMKGINQYIIFYKP
             |:  :|||||:  ||||||||| :||::|||| : ::||||||| |: :| |:|:|:||
a287         CD-RDFLDEEAPPKSEFEKLSDEEKINKYKKDEQRENFVGLVADRVEKNGTNKYVIIYKD
              240       250       260       270       280       290

           290         300       310       320       330       340
m287.pep     KP--TSFARFRRSARSRRSLPAEMPLIPVNQADTLIVDGEAVSLTGHSGNIFAPEGNYRY
             |   :| |||||||||||||||||||||||||||||||||||||||||||||||||||||
a287         KSASSSFARFRRSARSRRSLPAEMPLIPVNQADTLIVDGEAVSLTGHSGNIFAPEGNYRY
              300       310       320       330       340       350

             350       360       370       380       390       400
m287.pep     LTYGAEKLPGGSYALRVQGEPAKGEMLAGAAVYNGEVLHFHTENGRPYPTRGRFAAKVDF
             |||||||| |||||| |||||||||||||:||||||||||| ||||| |: |||||||||
a287         LTYGAEKLSGGSYALSVQGEPAKGEMLAGTAVYNGEVLHFHMENGRPSPSGGRFAAKVDF
              360       370       380       390       400       410

             410       420       430       440       450       460
m287.pep     GSKSVDGIIDSGDDLHMGTQKFKAAIDGNGFKGTWTENGSGDVSGKFYGPAGEEVAGKYS
             ||||||||||||||||||||||||:||||||||||||||:|||||:||||||||||||||
a287         GSKSVDGIIDSGDDLHMGTQKFKAVIDGNGFKGTWTENGGGDVSGRFYGPAGEEVAGKYS
              420       430       440       450       460       470

             470       480      489
m287.pep     YRPTDAEKGGFGVFAGKKEQDX
             |||||||||||||||||||||||
a287         YRPTDAEKGGFGVFAGKKEQDX
              480       490
```

The following partial DNA sequence was identified in *N. gonorrhoeae* <SEQ ID 1205>:

<u>g288.seq</u>

```
  1 atgcacaccg gacaggcggt aagccgggtt ctgtctcgga cagtcattcc

 51 tctaggcata ccgttgccgg tatgctcaag caacctaccc gaacgctcgg

101 cgggcagcgt cattgcgttc tgtttggtct tgctccgaat ggggtttggc

151 ctgccgcata ttgttaccaa atgcgcggtg cgcccttacc gcaccttttc

201 acccttgcct gtgctgccaa agcagccatc ggcggttttg ctttctgttc
```

-continued

```
251 cactttccgt cgcgttaccg cgcccggccg ttaaccggca ttctaccctg

301 cggagcccgg actttcctcc ccgtatgcct tacgcgatac gcggcgactg

351 tctgcccgtc ccgtgtgcgg cgcggattat aacacgaaac gcaaaaatgc

401 cgtctgaaac ggtacaggtt tcagacggca tacagcctaa actacacacc

451 ctgtttcagg ctggcttcga tgaagccgtc caagtcgccg tccaatacgg

501 ctttgtggtt gccgacttcg tagcctgtac gcaagtcttt gatgcgtga
```

This corresponds to the amino acid sequence <SEQ ID 1206; ORF 288.ng>:

g288.pep

```
  1 MHTGQAVSRV LSRTVIPLGI PLPVCSSNLP ERSAGSVIAF CLVLLRMGFG

 51 LPHIVTKCAV RPYRTFSPLP VLPKQPSAVL LSVPLSVALP RPAVNRHSTL

101 RSPDFPPRMP YAIRGDCLPV PCAARIITRN AKMPSETVQV SDGIQPKLHT

151 LFQAGFDEAV QVAVQYGFVV ADFVACTQVF DA*
```

The following partial DNA sequence was identified in *N. meningitidis* <SEQ ID 1207>:

m288.seq

```
  1 ATGCACACCG GACAGGCGGT AAGCCGGGTT CTGTCTCGGA CAGTCATTCC

 51 TCTAGGCATA CCGTTACCGG TATGCTCAAG CAACCTACCC GAACGCTCGG

101 CGGGCAGCGT CATTGCGTTC TGTTTGGTCT TGCTCCGAAT GGGGTTTGGC

151 CTGCCGCATA TTGTTACCAA ATGCGCGGTG CGCCCTTACC GCACCTTTTC

201 ACCCTTACCT GTGCTGCCAA AGCAGCCATC GGCGGTTTTG CTTTCTGTTC

251 CACTTTCCGT CGCGTTACCG CGCCCGGCCG TTAACCGGCA TTCTACCCTG

301 CGGAGCCCGG ACTTTCCTCC CCGTATGCCT TACGCGATAC GCGGCGACTG

351 TCTGCCCGTC CCGTGTGCGG CGCGGATTAT AACACGAAAC ACAAAAATGC

401 CGTCTGAAAC GGTACAGGTT TCAGACGGCA TACAGCCTAA ACTACACGCC

451 CTGTTTCAGG CTGGCTTCGA TGAAGCCGTC CAAGTCGCCA TCCAATACGG

501 CTTTGGTGTT GCCGACTTCG TAGCCTGTAC GCAAGTCTTT GATACGTGA
```

This corresponds to the amino acid sequence <SEQ ID 1208; ORF 288>:

m288.pep

```
  1 MHTGQAVSRV LSRTVIPLGI PLPVCSSNLP ERSAGSVIAF CLVLLRMGFG

 51 LPHIVTKCAV RPYRTFSPLP VLPKQPSAVL LSVPLSVALP RPAVNRHSTL

101 RSPDFPPRMP YAIRGDCLPV PCAARIITRN TKMPSETVQV SDGIQPKLHA

151 LFQAGFDEAV QVAIQYGFGV ADFVACTQVF DT*
```

Computer analysis of this amino acid sequence gave the following results:

Homology with a predicted ORF from *N. gonorrhoeae* m288/g288 97.8% identity in 181 aa overlap

```
                   10        20        30        40        50        60
m288.pep    MHTGQAVSRVLSRTVIPLGIPLPVCSSNLPERSAGSVIAFCLVLLRMGFGLPHIVTKCAV
            ||||||||||||||||||||||||||||||||||||||||||||||||||||||||||||
g288        MHTGQAVSRVLSRTVIPLGIPLPVCSSNLPERSAGSVIAFCLVLLRMGFGLPHIVTKCAV
                   10        20        30        40        50        60

                   70        80        90       100       110       120
m288.pep    RPYRTFSPLPVLPKQPSAVLLSVPLSVALPRPAVNRHSTLRSPDFPPRMPYAIRGDCLPV
            ||||||||||||||||||||||||||||||||||||||||||||||||||||||||||||
g288        RPYRTFSPLPVLPKQPSAVLLSVPLSVALPRPAVNRHSTLRSPDFPPRMPYAIRGDCLPV
                   70        80        90       100       110       120

                  130       140       150       160       170       180
m288.pep    PCAARIITRNTKMPSETVQVSDGIQPKLHALFQAGFDEAVQVAIQYGFGVADFVACTQVF
            ||||||||||:||||||||||||||||||:|||||||||||||:|||| |||||||||||
g288        PCAARIITRNAKMPSETVQVSDGIQPKLHTLFQAGFDEAVQVAVQYGFVVADFVACTQVF
                  130       140       150       160       170       180

m288.pep    DTX
            |:|
g288        DAX
```

The following partial DNA sequence was identified in *N. meningitidis* <SEQ ID 1209>:

a288.seq

```
  1 ATGCACACCG GACAGGCGGT AAGCCGGGTT CTGTCTCGGA CAGTCATTCC
 51 TCTAGGCATA CCGTTGCCGG TATGCTCAAG CAACCTACCC GAACGCTCGG
101 CGGGCAGCGT CATTGCGTTC TGTTTGGTCT TGCTCCGAAT GGGGTTTGGC
151 CTGCCGCATA TTGTTACCAA ATGCGCGGTG CGCCCTTACC GCACCTTTTC
201 ACCCTTGCCT GTGCTGCCAA AGCAGCCATC GGCGGTTTTG CTTTCTGTTC
251 CACTTTCCGT CGCGTTACCG CGCCCGGCCG TTAACCGGCA TTCTACCCTG
301 CGGAGCCCGG ACTTTCCTCC CCGTATGCCT TACGCGATAC GCGGCGACTG
351 TCTGCCCGTC CCGTGTGCGG CGCGGATTAT AACACGAAAC GCAAAAATGC
401 CGTCTGAAAC GGTACAGGTT TCAGACGGCA TACAGCCTAA ACTACACGCC
451 CTGTTTCAGG CTGGCTTCGA TAAAGCCGTC CAAGTCGCCG TCCAATACGG
501 CTTTGGTGTT GCCGACTTCG TAGCCTGTGC GCAAGTCTTT AATGCGTGA
```

This corresponds to the amino acid sequence <SEQ ID 1210; ORF 288.a>:

a288.pep

```
  1 MHTGQAVSRV LSRTVIPLGI PLPVCSSNLP ERSAGSVIAF CLVLLRMGFG
 51 LPHIVTKCAV RPYRTFSPLP VLPKQPSAVL LSVPLSVALP RPAVNRHSTL
101 RSPDFPPRMP YAIRGDCLPV PCAARIITRN AKMPSETVQV SDGIQPKLHA
151 LFQAGFDKAV QVAVQYGFGV ADFVACAQVF NA*
```

m288/a288 97.2% identity in 181 aa overlap

```
                   10        20        30        40        50        60
m288.pep    MHTGQAVSRVLSRTVIPLGIPLPVCSSNLPERSAGSVIAFCLVLLRMGFGLPHIVTKCAV
            ||||||||||||||||||||||||||||||||||||||||||||||||||||||||||||
a288        MHTGQAVSRVLSRTVIPLGIPLPVCSSNLPERSAGSVIAFCLVLLRMGFGLPHIVTKCAV
                   10        20        30        40        50        60
```

-continued

```
                 70        80        90       100       110       120
m288.pep    RPYRTFSPLPVLPKQPSAVLLSVPLSVALPRPAVNRHSTLRSPDFPPRMPYAIRGDCLPV
            ||||||||||||||||||||||||||||||||||||||||||||||||||||||||||||
a288        RPYRTFSPLPVLPKQPSAVLLSVPLSVALPRPAVNRHSTLRSPDFPPRMPYAIRGDCLPV
                 70        80        90       100       110       120

                130       140       150       160       170       180
m288.pep    PCAARIITRNTKMPSETVQVSDGIQPKLHALFQAGFDEAVQVAIQYGFGVADFVACTQVF
            ||||||||||:||||||||||||||||||||||||||||:|||||:||||||||||||:|||
a288        PCAARIITRNAKMPSETVQVSDGIQPKLHALFQAGFDKAVQVAVQYGFGVADFVACAQVF
                130       140       150       160       170       180

m288.pep    DTX
            ::
a288        NAX
```

The following partial DNA sequence was identified in *N. gonorrhoeae* <SEQ ID 1211>:

g290.seq

```
   1 atggcaaaaa tgatgaaatg ggcggctgtt gcggcggtcg cggcggcagc
  51 ggtttggggc ggatggtctt atctgaagcc cgaaccgcag gctgcttata
 101 ttacggaagc ggtcaggcgc ggcgatatca gccggacggt ttccgcgacg
 151 ggcgagattt cgccgtccaa cctggtatcg gtcggcgcgc aggcttcggg
 201 gcagattaaa aagctttatg tcaaactcgg gcaacaggtc aaaaagggcg
 251 atttgattgc ggaaatcaat tcgaccacgc agaccaacac gatcgatatg
 301 gaaaaatcca aattggaaac gtatcaggcg aagctggtgt ccgcacagat
 351 tgcattgggc agcgcggaaa aaaaatataa gcgtcaggcg gcgttgtgga
 401 aggatgatgc gacctctaaa gaagatttgg aaagcgcgca ggatgcgctt
 451 gccgccgcca aagccaatgt tgccgagttg aaggctttaa tcagacagag
 501 caaaatttcc atcaataccg ccgagtcgga tttgggctac acgcgcatta
 551 ccgcgacgat ggacggcacg gtggtggcga ttcccgtgga agaggggcag
 601 actgtgaacg cggcgcagtc tacgccgacg attgtccaat tggcgaatct
 651 ggatatgatg ttgaacaaaa tgcagattgc cgagggcgat attaccaagg
 701 tgaaggcggg gcaggatatt tcgtttacga ttttgtccga accggatacg
 751 ccgattaagg cgaagctcga cagcgtcgac cccgggctga ccacgatgtc
 801 gtcgggcggc tacaacagca gtacggatac ggcttccaat gcggtctatt
 851 attatgcccg ttcgtttgtg ccgaatccgg acggcaaact cgccacgggg
 901 atgacgacgc agaatacggt tgaaatcgac ggtgtgaaaa atgtgttgct
 951 tattccgtcg ctgaccgtga aaaatcgcgg cggcaaggcg ttcgtacgcg
1001 tgttgggtgc ggacggcaag gcagtggaac gcgaaatccg gaccggtatg
1051 aaagacagta tgaataccga agtgaaaagc gggttgaaag agggggacaa
1101 agtggtcatc tccgaaataa ccgccgccga gcagcaggaa agcggcgaac
1151 gcgccctagg cggcccgccg cgccgataa
```

This corresponds to the amino acid sequence <SEQ ID 1212; ORF 290.ng>:

g290.pep

```
  1 MAKMMKWAAV AAVAAAAVWG GWSYLKPEPQ AAYITEAVRR GDISRTVSAT
 51 GEISPSNLVS VGAQASGQIK KLYVKLGQQV KKGDLIAEIN STTQTNTIDM
101 EKSKLETYQA KLVSAQIALG SAEKKYKRQA ALWKDDATSK EDLESAQDAL
151 AAAKANVAEL KALIRQSKIS INTAESDLGY TRITATMDGT VVAIPVEEGQ
201 TVNAAQSTPT IVQLANLDMM LNKMQIAEGD ITKVKAGQDI SFTILSEPDT
251 PIKAKLDSVD PGLTTMSSGG YNSSTDTASN AVYYYARSFV PNPDGKLATG
301 MTTQNTVEID GVKNVLLIPS LTVKNRGGKA FVRVLGADGK AVEREIRTGM
351 KDSMNTEVKS GLKEGDKVVI SEITAAEQQE SGERALGGPP RR*
```

The following partial DNA sequence was identified in *N. meningitidis* <SEQ ID 1213>:

m290.seq (partial)

```
   1 ..GTATCGGTCG GCGCGCAGGC ATCGGGGCAG ATTAAGATAC TTTATGTCAA
  51   ACTCGGGCAA CAGGTTAAAA AGGGCGATTT GATTGCGGAA ATCAATTCGA
 101   CCTCGCAGAC CAATACGCTC AATACGGAAA AATCCAAGTT GGAAACGTAT
 151   CAGGCGAAGC TGGTGTCGGC ACAGATTGCA TTGGGCAGCG CGGAGAAGAA
 201   ATATAAGCGT CAGGCGGCGT TATGGAAGGA AAACGCGACT TCCAAAGAGG
 251   ATTTGGAAAG CGCGCAGGAT GCGTTTGCCG CCGCCAAAGC CAATGTTGCC
 301   GAGCTGAAGG CTTTAATCAG ACAGAGCAAA ATTTCCATCA ATACCGCCGA
 351   GTCGGAATTG GGCTACACGC GCATTACCGC AACGATGGAC GGCACGGTGG
 401   TGGCGATTCT CGTGGAAGAG GGGCAGACTG TGAACGCGGC GCAGTCTACG
 451   CCGACGATTG TCCAATTGGC GAATCTGGAT ATGATGTTGA ACAAAATGCA
 501   GATTGCCGAG GGCGATATTA CCAAGGTGAA GGCGGGGCAG GATATTTCGT
 551   TTACGATTTT GTCCGAACCG GATACGCCGA TTAAGGCGAA GCTCGACAGC
 601   GTCGACCCCG GGCTGACCAC GATGTCGTCG GGCGGTTACA ACAGCAGTAC
 651   GGATACGGCT TCCAATGCCG TCTACTATTA TGCCCGTTCG TTTGTGCCGA
 701   ATCCGGACGG CAAACTCGCC ACGGGGATGA CGACGCAGAA TACGGTTGAA
 751   ATCGACGGCG TGAAAAATGT GCTGATTATT CCGTCGCTGA CCGTGAAAAA
 801   TCGCGGCGGC AAGGCGTTTG TGCGCGTGTT GGGTGCGGAC GGCAAGGCGG
 851   CGGAACGCGA AATCCGGACC GGTATGAGAG ACAGTATGAA TACCGAAGTA
 901   AAAAGCGGGT TGAAAGAGGG GGACAAAGTG GTCATCTCCG AAATAACCGC
 951   CGCCGAGCAA CAGGAAAGCG GCGAACGCGC CCTAGGCGGC CCGCCGCGCC
1001   GATAA
```

This corresponds to the amino acid sequence <SEQ ID 1214; ORF 290>:

m290.pep (partial)

```
  1 ..VSVGAQASGQ IKILYVKLGQ QVKKGDLIAE INSTSQTNTL NTEKSKLETY
 51   QAKLVSAQIA LGSAEKKYKR QAALWKENAT SKEDLESAQD AFAAAKANVA
```

-continued

```
101   ELKALIRQSK ISINTAESEL GYTRITATMD GTVVAILVEE GQTVNAAQST

151   PTIVQLANLD MMLNKMQIAE GDITKVKAGQ DISFTILSEP DTPIKAKLDS

201   VDPGLTTMSS GGYNSSTDTA SNAVYYYARS FVPNPDGKLA TGMTTQNTVE

251   IDGVKNVLII PSLTVKNRGG KAFVRVLGAD GKAAEREIRT GMRDSMNTEV

301   KSGLKEGDKV VISEITAAEQ QESGERALGG PPRR*
```

Computer analysis of this amino acid sequence gave the following results:

Homology with a predicted ORF from *N. gonorrhoeae*
m290/g290 96.1% identity in 334 aa overlap

```
                                                   10        20        30
m290.pep                                     VSVGAQASGQIKILYVKLGQQVKKGDLIAE
                                             |||||||||||| |||||||||||||||||
g290      PQAAYITEAVRRGDISRTVSATGEISPSNLVSVGAQASGQIKKLYVKLGQQVKKGDLIAE
          30        40        50        60        70        80

                  40        50        60        70        80        90
m290.pep  INSTSQTNTLNTEKSKLETYQAKLVSAQIALGSAEKKYKRQAALWKENATSKEDLESAQD
          ||||:||||:: |||||||||||||||||||||||||||||||||::|||||||||||
g290      INSTTQTNTIDMEKSKLETYQAKLVSAQIALGSAEKKYKRQAALWKDDATSKEDLESAQD
          90        100       110       120       130       140

                 100       110       120       130       140       150
m290.pep  AFAAAKANVAELKALIRQSKISINTAESELGYTRITATMDGTVVAILVEEGQTVNAAQST
          |:|||||||||||||||||||||||||:||||||||||||||||| ||||||||||||
g290      ALAAAKANVAELKALIRQSKISINTAESDLGYTRITATMDGTVVAIPVEEGQTVNAAQST
        150       160       170       180       190       200

                 160       170       180       190       200       210
m290.pep  PTIVQLANLDMMLNKMQIAEGDITKVKAGQDISFTILSEPDTPIKAKLDSVDPGLTTMSS
          ||||||||||||||||||||||||||||||||||||||||||||||||||||||||||||
g290      PTIVQLANLDMMLNKMQIAEGDITKVKAGQDISFTILSEPDTPIKAKLDSVDPGLTTMSS
        210       220       230       240       250       260

                 220       230       240       250       260       270
m290.pep  GGYNSSTDTASNAVYYYARSFVPNPDGKLATGMTTQNTVEIDGVKNVLIIPSLTVKNRGG
          ||||||||||||||||||||||||||||||||||||||||||||||||:|||||||||||
g290      GGYNSSTDTASNAVYYYARSFVPNPDGKLATGMTTQNTVEIDGVKNVLLIPSLTVKNRGG
        270       280       290       300       310       320

                 280       290       300       310       320       330
m290.pep  KAFVRVLGADGKAAEREIRTGMRDSMNTEVKSGLKEGDKVVISEITAAEQQESGERALGG
          ||||||||||||:|||||||:|||||||||||||||||||||||||||||||||||||||
g290      KAFVRVLGADGKAVEREIRTGMKDSMNTEVKSGLKEGDKVVISEITAAEQQESGERALGG
        330       340       350       360       370       380

m290.pep  PPRRX
          |||||
g290      PPRRX
        390
```

The following partial DNA sequence was identified in *N. meningitidis* <SEQ ID 1215>:

a290.seq

```
  1 ATGGCAAAAA TGATGAAATG GGCGGCTGTT GCGGCGGTCG CGGCGGCAGC

 51 GGTTTGGGGC GGATGGTCTT ATCTGAAGCC CGAGCCGCAG GCTGCTTATA

101 TTACGGAAAC GGTCAGGCGC GGCGACATCA GCCGGACGGT TTCTGCAACA

151 GGGGAGATTT CGCCGTCCAA CCTGGTATCG GTCGGCGCGC AGGCATCGGG

201 GCAGATTAAG AAACTTTATG TCAAACTCGG GCAACAGGTT AAAAAGGGCG

251 ATTTGATTGC GGAAATCAAT TCGACCTCGC AGACCAATAC GCTCAATACG

301 GAAAAATCCA AATTGGAAAC GTATCAGGCG AAGCTGGTGT CGGCACAGAT

351 TGCATTGGGC AGCGCGGAGA AGAAATATAA GCGTCAGGCG GCGTTGTGGA
```

-continued

```
 401 AGGATGATGC GACCGCTAAA GAAGATTTGG AAAGCGCACA GGATGCGCTT
 451 GCCGCCGCCA AAGCCAATGT TGCCGAGCTG AAGGCTCTAA TCAGACAGAG
 501 CAAAATTTCC ATCAATACCG CCGAGTCGGA ATTGGGCTAC ACGCGCATTA
 551 CCGCAACGAT GGACGGCACG GTGGTGGCGA TTCTCGTGGA AGAGGGGCAG
 601 ACTGTGAACG CGGCGCAGTC TACGCCGACG ATTGTCCAAT TGGCGAATCT
 651 GGATATGATG TTGAACAAAA TGCAGATTGC CGAGGGCGAT ATTACCAAGG
 701 TGAAGGCGGG GCAGGATATT TCGTTTACGA TTTTGTCCGA ACCGGATACG
 751 CCGATTAAGG CGAAGCTCGA CAGCGTCGAC CCCGGGCTGA CCACGATGTC
 801 GTCGGGCGGC TACAACAGCA GTACGGATAC GGCTTCCAAT GCGGTCTACT
 851 ATTATGCCCG TTCGTTTGTG CCGAATCCGG ACGGCAAACT CGCCACGGGG
 901 ATGACGACGC AGAATACGGT TGAAATCGAC GCTGTGAAAA ATGTGCTGAT
 951 TATTCCGTCG CTGACCGTGA AAAATCGCGG CGGCAGGGCG TTTGTGCGCG
1001 TGTTGGGTGC AGACGGCAAG GCGGCGGAAC GCGAAATCCG GACCGGTATG
1051 AGAGACAGTA TGAATACCGA AGTAAAAAGC GGGTTGAAAG AGGGGGACAA
1101 AGTGGTCATC TCCGAAATAA CCGCCGCCGA GCAGCAGGAA AGCGGCGAAC
1151 GCGCCCTAGG CGGCCCGCCG CGCCGATAA
```

This corresponds to the amino acid sequence <SEQ ID 1216; ORF 290.a>:

a290.pep

```
  1 MAKMMKWAAV AAVAAAAVWG GWSYLKPEPQ AAYITETVRR GDISRTVSAT
 51 GEISPSNLVS VGAQASGQIK KLYVKLGQQV KKGDLIAEIN STSQTNTLNT
101 EKSKLETYQA KLVSAQIALG SAEKKYKRQA ALWKDDATAK EDLESAQDAL
151 AAAKANVAEL KALIRQSKIS INTAESELGY TRITATMDGT VVAILVEEGQ
201 TVNAAQSTPT IVQLANLDMM LNKMQIAEGD ITKVKAGQDI SFTILSEPDT
251 PIKAKLDSVD PGLTTMSSGG YNSSTDTASN AVYYYARSFV PNPDGKLATG
301 MTTQNTVEID GVKNVLIIPS LTVKNRGGRA FVRVLGADGK AAEREIRTGM
351 RDSMNTEVKS GLKEGDKVVI SEITAAEQQE SGERALGGPP RR*
```

m290/a290 98.2% identity in 334 aa overlap

```
                                                 10        20        30
m290.pep                              VSVGAQASGQIKILYVKLGQQVKKGDLIAE
                                      ||||||||||| ||||||||||||||||||
a290          PQAAYITETVRRGDISRTVSATGEISPSNLVSVGAQASGQIKKLYVKLGQQVKKGDLIAE
              30        40        50        60        70        80

                       40        50        60        70        80        90
m290.pep      INSTSQTNTLNTEKSKLETYQAKLVSAQIALGSAEKKYKRQAALWKENATSKEDLESAQD
              ||||||||||||||||||||||||||||||||||||||||||||||::||:|||||||||
a290          INSTSQTNTLNTEKSKLETYQAKLVSAQIALGSAEKKYKRQAALWKDDATAKEDLESAQD
              90       100       110       120       130       140

                      100       110       120       130       140       150
m290.pep      AFAAAKANVAELKALIRQSKISINTAESELGYTRITATMDGTVVAILVEEGQTVNAAQST
              |:||||||||||||||||||||||||||||||||||||||||||||||||||||||||||
a290          ALAAAKANVAELKALIRQSKISINTAESELGYTRITATMDGTVVAILVEEGQTVNAAQST
            150       160       170       180       190       200
```

-continued

```
                160       170       180       190       200       210
m290.pep  PTIVQLANLDMMLNKMQIAEGDITKVKAGQDISFTILSEPDTPIKAKLDSVDPGLTTMSS
          ||||||||||||||||||||||||||||||||||||||||||||||||||||||||||||
a290      PTIVQLANLDMMLNKMQIAEGDITKVKAGQDISFTILSEPDTPIKAKLDSVDPGLTTMSS
        210       220       230       240       250       260

                220       230       240       250       260       270
m290.pep  GGYNSSTDTASNAVYYYARSFVPNPDGKLATGMTTQNTVEIDGVKNVLIIPSLTVKNRGG
          ||||||||||||||||||||||||||||||||||||||||||||||||||||||||||||
a290      GGYNSSTDTASNAVYYYARSFVPNPDGKLATGMTTQNTVEIDGVKNVLIIPSLTVKNRGG
        270       280       290       300       310       320

                280       290       300       310       320       330
m290.pep  KAFVRVLGADGKAAEREIRTGMRDSMNTEVKSGLKEGDKVVISEITAAEQQESGERALGG
          :|||||||||||||||||||||||||||||||||||||||||||||||||||||||||||
a290      RAFVRVLGADGKAAEREIRTGMRDSMNTEVKSGLKEGDKVVISEITAAEQQESGERALGG
        330       340       350       360       370       380

m290.pep  PPRRX
          |||||
a290      PPRRX
        390
```

The following partial DNA sequence was identified in *N. gonorrhoeae* <SEQ ID 1217>:

g292.seq

```
  1 atgaaaacca agttaatcaa aatcttgacc ccctttaccg tcctgccgct
 51 gctggcttgc gggcaaacgc ccgtttccaa tgccaacgcc gaatccgccg
101 tcaaagccga atccgccggc aaatccgttg ccgcttcttt gaaagcgcgt
151 ttggaaaaaa cctattccgc ccaagatttg aaagtgttga gcgtcagcga
201 aacaccggtc aaaggcattt acgaagtcgt cgtcagcggc aggcagatta
251 tctacaccga tgccgaaggc ggctatatgt tcgtcggcga actcatcaac
301 atcgacacgc gcaaaaacct gaccgaagaa cgcgccgccg atttgaacaa
351 aatcgacttc gcctccctgc ctttggacaa agccatcaaa gaagtacgcg
401 gcaacggcaa gctgaaagtc gccgtcttct ccgaccccga ttgtccgttc
451 tgcaaacgct tggaacatga gtttgaaaaa atgaccgacg tgacggttta
501 cagctttatg atgcccattg ccggcctgca cccagatgcc gcgcgcaagg
551 cgcaaatctt atggtgtcag cccgaccgtg ccaaagcgtg gacggattgg
601 atgcgtaaag gcaaattccc ggtcggcggc agcatctgcg acaatcccgt
651 cgcggaaacc acttccttgg gcgaacagtt cggcttcaac ggcacgccga
701 cccttcgtct tccccaacgg gcgcacccaa agcggttaca gcccgatgcc
751 ccaactggag gaaatcatcc gcaaaaacca gcagtaaacc cgcaatga
```

This corresponds to the amino acid sequence <SEQ ID 1218; ORF 292.ng>:

g292.pep

```
  1 MKTKLIKILT PFTVLPLLAC GQTPVSNANA ESAVKAESAG KSVAASLKAR
 51 LEKTYSAQDL KVLSVSETPV KGIYEVVVSG RQIIYTDAEG GYMFVGELIN
101 IDTRKNLTEE RAADLNKIDF ASLPLDKAIK EVRGNGKLKV AVFSDPDCPF
151 CKRLEHEFEK MTDVTVYSFM MPIAGLHPDA ARKAQILWCQ PDRAKAWTDW
201 MRKGKFPVGG SICDNPVAET TSLGEQFGFN GTPTLRLPQR AHPKRLQPDA
251 PTGGNHPQKP AVNPQ*
```

The following partial DNA sequence was identified in *N. meningitidis* <SEQ ID 1219>:

m292.seq

```
  1 ATGAAAACCA AGTTAATCAA AATCTTGACC CCCTTTACCG TCCTCCCGCT
 51 GCTGGCTTGC GGGCAAACGC CCGTTTCCAA TGCCAACGCC GAACCCGCCG
101 TCAAAGCCGA GTCCGCCGGC AAATCCGTTG CCGCCTCTTT GAAAGCGCGT
151 TTGGAAAAAA CCTATTCCGC CCAAGATTTG AAAGTGTTGA GCGTCAGCGA
201 AACACCGGTC AAAGGCATTT ACGAAGTCGT CGTCAGCGGC AGGCAGATTA
251 TCTACACCGA TGCCGAAGGC GGCTATATGT TCGTCGGCGA ACTCATCAAC
301 ATCGACACGC GCAAAAACCT GACCGAAGAA CGCGCCGCCG ATTTGAACAA
351 AATCGACTTC GCCTCCCTGC CTTTGGACAA AGCCATCAAA GAAGTGCGCG
401 GCAACGGCAA GCTGAAAGTC GCCGTCTTCT CCGACCCCGA TTGTCCGTTC
451 TGCAAACGCT TGGAACACGA GTTTGAAAAA ATGACCGACG TGACGGTTTA
501 CAGCTTTATG ATGCCCATTG CCGGCCTGCA CCCCGATGCC GCGCGCAAGG
551 CGCAAATCTT ATGGTGTCAG CCCGACCGCG CCAAAGCGTG GACGGATTGG
601 ATGCGTAAAG GCAAATTCCC GGTCGGCGGC AGCATCTGCG ACAATCCCGT
651 CGCGGAAACC ACTTCCTTGG GCGAACAATT CGGCTTCAAC GGCACGCCGA
701 CCCTCGTCTT CCCCAACGGG CGCAGCCAAA GCGGCTACAG CCCGATGCCC
751 CAACTGGAGG AAATCATCCG CAAAAATCAA TAA
```

This corresponds to the amino acid sequence <SEQ ID 1220; ORF 292>:

m292.pep

```
  1 MKTKLIKILT PFTVLPLLAC GQTPVSNANA EPAVKAESAG KSVAASLKAR
 51 LEKTYSAQDL KVLSVSETPV KGIYEVVVSG RQIIYTDAEG GYMFVGELIN
101 IDTRKNLTEE RAADLNKIDF ASLPLDKAIK EVRGNGKLKV AVFSDPDCPF
151 CKRLEHEFEK MTDVTVYSFM MPIAGLHPDA ARKAQILWCQ PDRAKAWTDW
201 MRKGKFPVGG SICDNPVAET TSLGEQFGFN GTPTLVFPNG RSQSGYSPMP
251 QLEEIIRKNQ *
```

Computer analysis of this amino acid sequence gave the following results:

Homology with a predicted ORF from *N. gonorrhoeae* m292/g292 98.7% identity in 238 aa overlap

```
                10        20        30        40        50        60
m292.pep  MKTKLIKILTPFTVLPLLACGQTPVSNANAEPAVKAESAGKSVAASLKARLEKTYSAQDL
          |||||||||||||||||||||||||||||||| ||||||||||||||||||||||||||||
g292      MKTKLIKILTPFTVLPLLACGQTPVSNANAESAVKAESAGKSVAASLKARLEKTYSAQDL
                10        20        30        40        50        60

                70        80        90       100       110       120
m292.pep  KVLSVSETPVKGIYEVVVSGRQIIYTDAEGGYMFVGELINIDTRKNLTEERAADLNKIDF
          ||||||||||||||||||||||||||||||||||||||||||||||||||||||||||||
g292      KVLSVSETPVKGIYEVVVSGRQIIYTDAEGGYMFVGELINIDTRKNLTEERAADLNKIDF
                70        80        90       100       110       120
```

-continued

```
                 130       140       150       160       170       180
m292.pep  ASLPLDKAIKEVRGNGKLKVAVFSDPDCPFCKRLEHEFEKMTDVTVYSFMMPIAGLHPDA
          ||||||||||||||||||||||||||||||||||||||||||||||||||||||||||||
g292      ASLPLDKAIKEVRGNGKLKVAVFSDPDCPFCKRLEHEFEKMTDVTVYSFMMPIAGLHPDA
                 130       140       150       160       170       180

                 190       200       210       220       230       240
m292.pep  ARKAQILWCQPDRAKAWTDWMRKGKFPVGGSICDNPVAETTSLGEQFGFNGTPTLVFPNG
          ||||||||||||||||||||||||||||||||||||||||||||||||||||||| :|: 
g292      ARKAQILWCQPDRAKAWTDWMRKGKFPVGGSICDNPVAETTSLGEQFGFNGTPTLRLPQR
                 190       200       210       220       230       240

                 250       260
m292.pep  RSQSGYSPMPQLEEIIRKNQX

g292      AHPKRLQPDAPTGGNHPQKPAVNPQX
                 250       260
```

The following partial DNA sequence was identified in *N. meningitidis* <SEQ ID 1221>:

<u>a292.seq</u>

```
  1 ATGAAAACCA AGTTAATCAA AATCTTGACC CCCTTTACCG TCCTCCCGCT

 51 GCTGGCTTGC GGGCAAACGC CCGTTTCCAA TGCCAACGCC GAACCCGCCG

101 TCAAAGCCGA GTCCGCCGGC AAATCCGTTG CCGCCTCTTT GAAAGCGCGT

151 TTGGAAAAAA CCTATTCCGC CCAAGATTTG AAAGTGTTGA GCGTCAGCGA

201 AACACCGGTC AAAGGCATTT ACGAAGTCGT CGTCAGCGGC AGGCAGATTA

251 TCTACACCGA TGCCGAAGGC GGCTATATGT TCGTCGGCGA ACTCATCAAC

301 ATCGACACGC GCAAAAACCT GACCGAAGAA CGCGCCGCCG ATTTGAACAA

351 AATCGACTTC GCCTCCCTGC CTTTGGACAA AGCCATCAAA GAAGTGCGCG

401 GCAACGGCAA GCTGAAAGTC GCCGTCTTCT CCGACCCCGA TTGTCCGTTC

451 TGCAAACGCT TGGAACACGA GTTTGAAAAA ATGACCGACG TGACGGTTTA

501 CAGCTTTATG ATGCCCATTG CCGGCCTGCA CCCCGATGCC GCGCGCAAGG

551 CGCAAATCTT ATGGTGTCAG CCCGACCGCG CCAAAGCGTG GACGGATTGG

601 ATGCGTAAAG GCAAATTCCC GGTCGGCGGC AGCATCTGCG ACAATCCCGT

651 CGCGGAAACC ACTTCCTTGG GCGAACAATT CGGCTTCAAC GGCACGCCGA

701 CCCTCGTCTT CCCCAACGGG CGCAGCCAAA GCGGCTACAG CCCGATGCCC

751 CAACTGGAGG AAATCATCCG CAAAAATCAA TAA
```

This corresponds to the amino acid sequence <SEQ ID 1222; ORF 292.a>:

<u>a292.pep</u>

```
  1 MKTKLIKILT PFTVLPLLAC GQTPVSNANA EPAVKAESAG KSVAASLKAR

 51 LEKTYSAQDL KVLSVSETPV KGIYEVVVSG RQIIYTDAEG GYMFVGELIN

101 IDTRKNLTEE RAADLNKIDF ASLPLDKAIK EVRGNGKLKV AVFSDPDCPF

151 CKRLEHEFEK MTDVTVYSFM MPIAGLHPDA ARKAQILWCQ PDRAKAWTDW

201 MRKGKFPVGG SICDNPVAET TSLGEQFGFN GTPTLVFPNG RSQSGYSPMP

251 QLEEIIRKNQ *
```

m292/a292 100.0% identity in 260 aa overlap

```
                  10         20         30         40         50         60
m292.pep  MKTKLIKILTPFTVLPLLACGQTPVSNANAEPAVKAESAGKSVAASLKARLEKTYSAQDL
          ||||||||||||||||||||||||||||||||||||||||||||||||||||||||||||
a292      MKTKLIKILTPFTVLPLLACGQTPVSNANAEPAVKAESAGKSVAASLKARLEKTYSAQDL
                  10         20         30         40         50         60
                  70         80         90        100        110        120
m292.pep  KVLSVSETPVKGIYEVVVSGRQIIYTDAEGGYMFVGELINIDTRKNLTEERAADLNKIDF
          ||||||||||||||||||||||||||||||||||||||||||||||||||||||||||||
a292      KVLSVSETPVKGIYEVVVSGRQIIYTDAEGGYMFVGELINIDTRKNLTEERAADLNKIDF
                  70         80         90        100        110        120
                 130        140        150        160        170        180
m292.pep  ASLPLDKAIKEVRGNGKLKVAVFSDPDCPFCKRLEHEFEKMTDVTVYSFMMPIAGLHPDA
          ||||||||||||||||||||||||||||||||||||||||||||||||||||||||||||
a292      ASLPLDKAIKEVRGNGKLKVAVFSDPDCPFCKRLEHEFEKMTDVTVYSFMMPIAGLHPDA
                 130        140        150        160        170        180
                 190        200        210        220        230        240
m292.pep  ARKAQILWCQPDRAKAWTDWMRKGKFPVGGSICDNPVAETTSLGEQFGFNGTPTLVFPNG
          ||||||||||||||||||||||||||||||||||||||||||||||||||||||||||||
a292      ARKAQILWCQPDRAKAWTDWMRKGKFPVGGSICDNPVAETTSLGEQFGFNGTPTLVFPNG
                 190        200        210        220        230        240
                 250        260
m292.pep  RSQSGYSPMPQLEEIIRKNQX
          |||||||||||||||||||||
a292      RSQSGYSPMPQLEEIIRKNQX
                 250        260
```

The following partial DNA sequence was identified in *N. gonorrhoeae* <SEQ ID 1223>:

<u>g294.seq (partial)</u>

```
  1 atgcgtatta cctgtgcgcc gatgtcgctt ttgtcggcgg cagtctggtc
 51 ggttcgggct gtcagaacat catcgaaccg ctttcctgcg gcgttacgac
101 gatattcggc ttttcgacct acaatttttc cgaagcctgc cggcacgcct
151 tggcatcggg tgcggcggtt caagtcgaat cggcggacgc gtggcgtgaa
201 gccgttgaaa aaaccttatc tggcgagggg ggcggaatgc agatgcaggc
251 gcgcgtggac ggctttatcg cacaacatcg cggagcgggc gcgagaatcg
301 ccgaggcggt gcgggaagcg gtatgcggac atcgggggcg atagtgatac
351 aatccgtatc cgagttttcc ggttggagca tcgtatgagt atttatgccg
401 tcgcgcacat catccacctg tattgcgcca ccgcctttgt cggcggcgtg
451 tttttgaag tgctggtttt gtccgtcctg catacgggac gggtgtcgcg
501 cgaggcgcgg cgcgaagtgg aaaaggcaat gtcttaccgc gccgtcaggg
551 tgatgccgtt tgcggtcgga ctgctgttcg ccaggggaac tctagagtcg
601 actgcagcag catgccctc...
```

This corresponds to the amino acid sequence <SEQ ID 1224; ORF 294.ng>:

<u>g294.pep (partial)</u>

1 <u>MRITCAPMSL LSAAV</u>WSVRA VRTSSNRFPA ALRRYSAFRP TIFPKPAGTP

51 WHRVRRFKSN RRTRGVKPLK KPYLARGAEC RCRRAWTALS HNIAERARES

101 PRRCGKRYAD IGGDSDTIRI RVFRLEHRMS IYAVAHIIHL Y<u>CATAFVGGV</u>

151 <u>FFEVLVLS</u>VL HTGRVSREAR REVEKAMSYR <u>AVRVMPFAVG LLFARGT</u>LES

201 TAACP....

The following partial DNA sequence was identified in *N. meningitidis* <SEQ ID 1225>:

m294.seq

```
  1 ATGCGTATTA CCTGTGCGCC GATGTCGCTT TTGTCGGCGG CAGTCTGGTC
 51 GATTCGGGTT GTCAGAACAT CATCGAACCG CTTTCCTGCG GCGTTCCGAC
101 GATATTCGGC TTTTCAACCT ACAATTTTTC CGAAGCCTGC CGACACGCCT
151 TGGCATCGGG TGCGGCGGTT CAAGTCGAAT CGGCGGATGC GTGGCGGGAA
201 GCCGTTGAAA AAACCTTATC GTCCGAGGGG GGGGGGATGC AGATGCAGGC
251 GCGCGTGGAC GGCTTTATCG CACAACATCG CGGAGCGGGC GCGAGAATCG
301 CCGAGGCGGT GCGGGAAGCG GTATGCGGAT ATCGGGGGCG ATAGTGATAC
351 AATCCGTATC CGAGTTTTCC GTTTGGAGCA TCGTATGAGT ATTTATGCCG
401 TCGCGCACAT CGTTCATCTG TATTGCGCTA TTGCCTTTGT CGGCGGCGTG
451 TTTTTTGAAG TGCTGGTTTT GTCCGTCCTG CATACGGGAC GGGTGTCGCG
501 CGAGGCGCGG CGCGAAGTGG AAAAGGCAAT GTCTTACCGC GCCGTCAGGG
551 TGATGCCGTT TGTGGTCGGA CTGCTGTTCG CCAGCGGCAT CGTGATGGCG
601 GCAAACCGCT ATCTTTCTAT ATTGGGCGAA CCGTTTGCCA CTTCCTTCGG
651 TACGATGCTG ACGCTGAAAA TCCTGTTGGC GTTCAGCGTA TTGGCGCACT
701 TCGCCATCGC CGTCGTCAAA ATGGCGCGTT CCACACTGAC GGTCGGTTGG
751 TCGAAATACA TACACGCCGT CGTCTTTACC CATATGcTGC TGATTGTCTT
801 TTTGGCAAAA GCGATGTTTT ATATCAGCTG GTAA
```

This corresponds to the amino acid sequence <SEQ ID 1226; ORF 294>:

m294.pep

```
  1 MRITCAPMSL LSAAVWSIRV VRTSSNRFPA AFRRYSAFQP TIFPKPADTP
 51 WHRVRRFKSN RRMRGGKPLK KPYRPRGGGC RCRRAWTALS HNIAERARES
101 PRRCGKRYAD IGGDSDTIRI RVFRLEHRMS IYAVAHIVHL YCAIAFVGGV
151 FFEVLVLSVL HTGRVSREAR REVEKAMSYR AVRVMPFVVG LLFASGIVMA
201 ANRYLSILGE PFATSFGTML TLKILLAFSV LAHFAIAVVK MARSTLTVGW
251 SKYIHAVVFT HMLLIVFLAK AMFYISW*
```

g294/m294 92.3% identity in 196 aa overlap

```
                   10        20        30        40        50        60
g294.pep   MRITCAPMSLLSAAVWSVRAVRTSSNRFPAALRRYSAFRPTIFPKPAGTPWHRVRRFKSN
           |||||||||||||||||:|:|||||||||||:||||||:|||||||| ||||||||||||
m294       MRITCAPMSLLSAAVWSIRVVRTSSNRFPAAFRRYSAFQPTIFPKPADTPWHRVRRFKSN
                   10        20        30        40        50        60

                   70        80        90       100       110       120
g294.pep   RRTRGVKPLKKPYLARGAECRCRRAWTALSHNIAERARESPRRCGKRYADIGGDSDTIRI
           || || |||||||  ||: |||||||||||||||||||||||||||||||||||||||||
m294       RRMRGGKPLKKPYRPRGGGCRCRRAWTALSHNIAERARESPRRCGKRYADIGGDSDTIRI
                   70        80        90       100       110       120

                  130       140       150       160       170       180
g294.pep   RVFRLEHRMSIYAVAHIIHLYCATAFVGGVFFEVLVLSVLHTGRVSREARREVEKAMSYR
           |||||||||||||||||:||||| ||||||||||||||||||||||||||||||||||||
m294       RVFRLEHRMSIYAVAHIVHLYCAIAFVGGVFFEVLVLSVLHTGRVSREARREVEKAMSYR
                  130       140       150       160       170       180
```

-continued

```
              190        200
g294.pep  AVRVMPFAVGLLFARGTLESTAAACP
          |||||||:|||||| |
m294      AVRVMPFVVGLLFASGIVMAANRYLSILGEPFATSFGTMLTLKILLAFSVLAHFAIAVVK
              190        200        210        220        230        240
```

The following partial DNA sequence was identified in *N. meningitidis* <SEQ ID 1227>:

a294.seq

```
  1 ATGCGTATTA CCTGTGCGCC GATGTCGCTT TTGTCGGCGG CAGTCTGGTC
 51 GATTCGGGCT GTCAGAACAT CATCGAACCG CTTTCCTGCG GCGTTCCGAC
101 GATATTCGGC TTTTCGACCT ACAATTTTTC CGAAGCCTGC CGGCACGCCT
151 TGGCATCGGG TGCGGCGGTT CAAGTCGAAT CGGCGGACGC GTGGCGGGAA
201 GCCGTTGAAA AAAACTTATC GTCCGAGGAG GGCGGAATGC AGATGCAGGC
251 GCGCGCGGAC GGCTTTATCG CACAACATCG CGGAGCGGGC GCGAGAATCG
301 CCGAGGCGGT ACGGGAAGCG GTATGCGGAC ATCGGGGACG ATAGTGATAC
351 AATCCGTATC CGAGTTTTCC GGTTGGAGTA CCGTATGAGT ATTTATGCCG
401 TCGCGCACAT CGTCCACCTG TATTGCGCCA TCGCCTTTGT CGGCGGCGTG
451 TTTTTTGAAG TGCTGGTTTT GTCCGTCCTG CATACGGGAC GGGTGTCGTG
501 CGAGGCGCGG CGCGAAGTGG AAAAGGCAAT GTCTTACCGC GCCGTCAGGG
551 TGATGCCGTT TGTGGTCGGA CTGCTGTTCG CCAGCGGCAT CGTGATGGCG
601 GCAAACCGCT ATCTTTCTAT ATTGGGCGAA CCGTTTGCCA CTTCCTTCGG
651 TACGATGCTG ACGCTGAAAA TCCTGTTGGC GTTCAGCGTG TTGGCGCACT
701 TCGCCATCGC CGTCGTCAAA ATGGCGCGTT CCACACTGAC CGTCGGCTGG
751 TCGAAATACA TACACACCGT CGTCTTTACC CATATGCTGC TGATTGTCTT
801 TTTGGCAAAA GCGATGTTTT ATATCAGCTG GTAA
```

This corresponds to the amino acid sequence <SEQ ID 1228, ORF 294.a>:

a294.pep

```
  1 MRITCAPMSL LSAAVWSIRA VRTSSNRFPA AFRRYSAFRP TIFPKPAGTP
 51 WHRVRRFKSN RRTRGGKPLK KTYRPRRAEC RCRRARTALS HNIAERARES
101 PRRYGKRYAD IGDDSDTIRI RVFRLEYRMS IYAVAHIVHL YCAIAFVGGV
151 FFEVLVLSVL HTGRVSCEAR REVEKAMSYR AVRVMPFVVG LLFASGIVMA
201 ANRYLSILGE PFATSFGTML TLKILLAFSV LAHFAIAVVK MARSTLTVGW
251 SKYIHTVVFT HMLLIVFLAK AMFYISW*
```

m294/a294 94.9% identity in 277 aa overlap

```
              10         20         30         40         50         60
m294.pep  MRITCAPMSLLSAAVWSIRVVRTSSNRFPAAFRRYSAFQPTIFPKPADTPWHRVRRFKSN
          |||||||||||||||||||:||||||||||||||||||:||||||||| ||||||||||||
a294      MRITCAPMSLLSAAVWSIRAVRTSSNRFPAAFRRYSAFRPTIFPKPAGTPWHRVRRFKSN
              10         20         30         40         50         60
```

```
                        70         80         90        100        110        120
m294.pep    RRMRGGKPLKKPYRPRGGGCRCRRAWTALSHNIAERARESPRRCGKRYADIGGDSDTIRI
            ||  ||||||||| ||||  :  ||||| ||||||||||||||||| ||||||| |||||||
a294        RRTRGGKPLKKTYRPRRAECRCRRARTALSHNIAERARESPRRYGKRYADIGDDSDTIRI
                        70         80         90        100        110        120
                       130        140        150        160        170        180
m294.pep    RVFRLEHRMSIYAVAHIVHLYCAIAFVGGVFFEVLVLSVLHTGRVSREARREVEKAMSYR
            |||||| :||||||||||||||||||||||||||||||||||||||||| ||||||||||
a294        RVFRLEYRMSIYAVAHIVHLYCAIAFVGGVFFEVLVLSVLHTGRVSCEARREVEKAMSYR
                       130        140        150        160        170        180
                       190        200        210        220        230        240
m294.pep    AVRVMPFVVGLLFASGIVMAANRYLSILGEPFATSFGTMLTLKILLAFSVLAHFAIAVVK
            ||||||||||||||||||||||||||||||||||||||||||||||||||||||||||||
a294        AVRVMPFVVGLLFASGIVMAANRYLSILGEPFATSFGTMLTLKILLAFSVLAHFAIAVVK
                       190        200        210        220        230        240
                       250        260        270
m294.pep    MARSTLTVGWSKYIHAVVFTHMLLIVFLAKAMFYISWX
            |||||||||||||| :|||||||||||||||||||||
a294        MARSTLTVGWSKYIHTVVFTHMLLIVFLAKAMFYISWX
                       250        260        270
```

The following partial DNA sequence was identified in *N. gonorrhoeae* <SEQ ID 1229>:

```
g295.seq

  1 atgctcggga tggcgcggca cgacggccag cagggcatcg ccgcgatatt

 51 gttgccacgc cgccagcagt ttttccgcct cgtcttcgcc ccgataaacg

101 cgcgtgctgc cgcacacggc aaccggccgg cctccgatgc gttttcaaa

151 ctgccccgcc agcgttttca tgtcttcaga cggcatcagg tcgtatttgg

201 tattgccgca cacctgcacg gatgccgcgc caatttcgc caaccgcgcc

251 gcatccgcct ccgtctgcgc cagacagccc gtcagcgaag cggctgcggg

301 acggatcagg cggcggactt tcagataacc gttcagcgat ttttccgaca

351 gccgcgcatt cgccaaaaac agcggcacac ccgctcgccg gcattccttc

401 atcagattgg gccagatttc ggtttccatc aaaatgccga acatcgggcg

451 gtgttcgcgc aaaaactgcc gtacccacgt ttttttgtca tacggaagat

501 agcggcattg cgcatcggga aacagaactt gcgcggtttc ccgtcccgtc

551 ggggtcatct gcgtcatcag cagcggcgca tcgggaaaac gccgccgcaa

601 ctcgcgtatc aagggctggg cggcacgcgt ttctccgacc gaaacggcgt

651 gtatccaaac cgcgccggta acgggattcg gatgcggctt gccgaaacgc

701 tcgtccctat gcgcccggta tgccggggca cttccggagc gtttgtccaa

751 ataacgccgt atccatatcg gcgcaagcag ccacaataca tcataaagcc

801 attggaacat ctttctattt cctgcaaaac aaatgccgtc cgaacggttc

851 ggacggcatt tcggcaacgg aatcaaatat cgtag
```

This corresponds to the amino acid sequence <SEQ ID 1230; ORF 295.ng>:

```
g295.pep

  1 MLGMARHDGQ QGIAAILLPR RQQFFRLVFA PINARAAAHG NRPASDAFFK

 51 LPRQRFHVFR RHQVVFGIAA HLHGCRAQFR QPRRIRLRLR QTARQRSGCG

101 TDQAADFQIT VQRFFRQPRI RQKQRHTRSP AFLHQIGPDF GFHQNAEHRA
```

-continued

```
151 VFAQKLPYPR FFVIRKIAAL RIGKQNLRGF PSRRGHLRHQ QRRIGKTPPQ

201 LAYQGLGGTR FSDRNGVYPN RAGNGIRMRL AETLVPMRPV CRGTSGAFVQ

251 ITPYPYRRKQ PQYIIKPLEH LSISCKTNAV RTVRTAFRQR NQIS*
```

The following partial DNA sequence was identified in *N. meningitidis* <SEQ ID 1231>:

m295.seq

```
  1 ATGCTCGGGA TGGCGCGGCA CGACGACCAG CAGCGCATCG CCGCGATATT
 51 GTTGCCACGC CGCCAGCAGT TTTTCCGCCT CGTCTTCACC CCGATAAACG
101 CGCGTGCTGC CGCACACGGC AACCGGCCGG CCTCCGATGC GTTTTTCAAA
151 CTGCCCCGCC AGCGTTTTCA TCTGTTCCGA CGGTATGATG TCGTATTTGG
201 TATTGCCGCA CACCTGCACG GATGCCGCGC CCAATTTCGC CAACCGCGCC
251 GCATCCGCCT CTGTCTGCGC CAGACACCCC GTCAGCGAAG CGGCGGCAGG
301 ACGGATCAGG CGGCGGACTT TCAGATAACC GTTCAACGAT TTTTCCGACA
351 GCCGCGCATT CGCCAAAAAC AGCGGCACAC CCGCGCGCCG GCATTCCCTC
401 ATCAGGTTGG GCCAGATTTC GGTTTCCATC AAAATGCCGA ACATCGGGCG
451 GTGTTCGCGC AAAAACTGCC GTACCCACGT TTTTTTGTCA TACGGAAGAT
501 AGCGGCATTG CGCATCGGGA AACAGAACTT GCGCGGTTTC CCGCCCCGTC
551 GGGGTCATCT GCGTCATCAG CAGCGGCGCA TCGGGAAAAC GCCGCCGCAA
601 CTCGCGTATC AAGGACTGGG CGGCACGCGT TTCTCCGACC GAAACGGCGT
651 GTATCCAAAC CGCGCCGGTA ACGGGATTCG GATACGGCTT GCCGAAACGC
701 TCGTCCCGAT GCGCCCGATA TGCCGGGGCA CTTCCGGAGC GTTTGTCCAA
751 ATAACGCCGT ATCCATATCG GCGCAAGCAG CCACAATACA TCATAAAGCC
801 ATTGGAACAT CTTTCTATTT CCTGCAAAAC AAATGCCGTC TGAACGGTTC
851 AGACGGCATT TCGGCAACGG AATCAAATAT CGTAG
```

This corresponds to the amino acid sequence <SEQ ID 1232; ORF 295>:

m295.pep

```
  1 MLGMARHDDQ QRIAAILLPR RQQFFRLVFT PINARAAAHG NRPASDAFFK
 51 LPRQRFHLFR RYDVVFGIAA HLHGCRAQFR QPRRIRLCLR QTPRQRSGGR
101 TDQAADFQIT VQRFFRQPRI RQKQRHTRAP AFPHQVGPDF GFHQNAEHRA
151 VFAQKLPYPR FFVIRKIAAL RIGKQNLRGF PPRRGHLRHQ QRRIGKTPPQ
201 LAYQGLGGTR FSDRNGVYPN RAGNGIRIRL AETLVPMRPI CRGTSGAFVQ
251 ITPYPYRRKQ PQYIIKPLEH LSISCKTNAV XTVQTAFRQR NQIS*
```

m295/g295 93.9% identity in 294 aa overlap

```
                      10        20        30        40        50        60
m295.pep     MLGMARHDDQQRIAAILLPRRQQFFRLVFTPINARAAAHGNRPASDAFFKLPRQRFHLFR
             |||||||| || ||||||||||||||||||:|||||||||||||||||||||||||||:|
g295         MLGMARHDGQQGIAAILLPRRQQFFRLVFAPINARAAAHGNRPASDAFFKLPRQRFHVFR
                      10        20        30        40        50        60

                      70        80        90       100       110       120
m295.pep     RYDVVFGIAAHLHGCRAQFRQPRRIRLCLRQTPRQRSGGRTDQAADFQITVQRFFRQPRI
             |::|||||||||||||||||||||||| |||| |||||  ||||||||||||||||||||
g295         RHQVVFGIAAHLHGCRAQFRQPRRIRLRLRQTARQRSGCGTDQAADFQITVQRFFRQPRI
                      70        80        90       100       110       120

                     130       140       150       160       170       180
m295.pep     RQKQRHTRAPAFPHQVGPDFGFHQNAEHRAVFAQKLPYPRFFVIRKIAALRIGKQNLRGF
             ||||||||:||| ||:||||||||||||||||||||||||||||||||||||||||||||
g295         RQKQRHTRSPAFLHQIGPDFGFHQNAEHRAVFAQKLPYPRFFVIRKIAALRIGKQNLRGF
                     130       140       150       160       170       180

                     190       200       210       220       230       240
m295.pep     PPRRGHLRHQQRRIGKTPPQLAYQGLGGTRFSDRNGVYPNRAGNGIRIRLAETLVPMRPI
             | |||||||||||||||||||||||||||||||||||||||||||||:|||||||||||:
g295         PSRRGHLRHQQRRIGKTPPQLAYQGLGGTRFSDRNGVYPNRAGNGIRMRLAETLVPMRPV
                     190       200       210       220       230       240

                     250       260       270       280       290
m295.pep     CRGTSGAFVQITPYPYRRKQPQYIIKPLEHLSISCKTNAVXTVQTAFRQRNQISX
             |||||||||||||||||||||||||||||||||||||||| ||:||||||||||
g295         CRGTSGAFVQITPYPYRRKQPQYIIKPLEHLSISCKTNAVRTVRTAFRQRNQIS
                     250       260       270       280       290
```

The following partial DNA sequence was identified in *N. meningitidis* <SEQ ID 1233>:

a295.seq

```
  1 ATGCTCGGGA TGGCGCGGCA CGACGACCAG CAGGGCATCG CCGCGATATT
 51 GTTGCCACGC CGCCAGCAGT TTTTCCGCCT CGTCTTCACC CCGATAAACG
101 CGCGTGCTGC CGCACACGGC AACCTGCCGG TCTCCGATGC GTTTTTCAAA
151 CTGCCCCGCC AGCGTTTTCA TCTGTTCCGA CGGCATCAGG TCGTATTTGG
201 TATTGCCGCA CACCTGCACG GATGCCGCGC CCAATTTCGC CAACCGCGCC
251 GCATCCGCCT CCGTCTGTGC CAGACAGCCC GTCAGCGAAG CGGCGGCAGG
301 ACGGATCAGG CTGCGGACTT TCAGATAACC GTTTAGCGAT TTTTCCGACA
351 GCCGCGCATT CGCCAAAAAC AGCGGCACAC CCGTGCGCCG GCATTCCTTC
401 ATCAGATTGG GCCAGATTTC GGTTTCCATC AAAATGCCGA ACATCGGGCG
451 GTGTTCGCGC AAAAACTGCC GTACCCACGT TTTTTTGTCA TACGGAAGAT
501 AGCGGCATTG TGCATCAGGA AACAGAACTT GCGCGGTTTC CCGTCCCGTC
551 GGGGTCATCT GCGTCATCAG CAGCGGCGCA TCGGGAAAAC GCTGCCGCAA
601 CTCGCGTATC AAAGGTTGGG CGGCACGCGT TTCCCCGACC GAAACGGCGT
651 GTATCCAAAC CGCGCCGGTA ACGGGATTCG GATACGGCTT GCCGAAACGC
701 TCGCCCCGAT GCGCCCGATA TGCAGGGGCA CTTCCGGAGC GTTTGTCCAA
751 ATAACGCCGT ATCCATATCG GCGCAAGCAG CCACAATACA TCATAAAGCC
801 ATTGGAACAT CTTTCTATTT CCTGCAAAAC AAATGCCGTC CGAACGGTTC
851 GGACGGCATT TCGGCAACGG AATCAAATAT CGTAG
```

This corresponds to the amino acid sequence <SEQ ID 1234; ORF 295.a>:

a295.pep

```
  1 MLGMARHDDQ QGIAAILLPR RQQFFRLVFT PINARAAAHG NLPVSDAFFK
 51 LPRQRFHLFR RHQVVFGIAA HLHGCRAQFR QPRRIRLRLC QTARQRSGGR
```

-continued

```
101 TDQAADFQIT V*RFFRQPRI RQKQRHTRAP AFLHQIGPDF GFHQNAEHRA

151 VFAQKLPYPR FFVIRKIAAL CIRKQNLRGF PSRRGHLRHQ QRRIGKTLPQ

201 LAYQRLGGTR FPDRNGVYPN RAGNGIRIRL AETLAPMRPI CRGTSGAFVQ

251 ITPYPYRRKQ PQYIIKPLEH LSISCKTNAV RTVRTAFRQR NQIS*
```

m295/a295 93.2% identity in 294 aa overlap

```
                       10        20        30        40        50        60
m295.pep       MLGMARHDDQQRIAAILLPRRQQFFRLVFTPINARAAAHGNRPASDAFFKLPRQRFHLFR
               ||||||||||| ||||||||||||||||||||||||||||| |:||||||||||||||||
a295           MLGMARHDDQQGIAAILLPRRQQFFRLVFTPINARAAAHGNLPVSDAFFKLPRQRFHLFR
                       10        20        30        40        50        60

                       70        80        90       100       110       120
m295.pep       RYDVVFGIAAHLHGCRAQFRQPRRIRLCLRQTPRQRSGGRTDQAADFQITVQRFFRQPRI
               |::|||||||||||||||||||||||| | || |||||||||||||||||| ||||||||
a295           RHQVVFGIAAHLHGCRAQFRQPRRIRLRLCQTARQRSGGRTDQAADFQITVXRFFRQPRI
                       70        80        90       100       110       120

                      130       140       150       160       170       180
m295.pep       RQKQRHTRAPAFPHQVGPDFGFHQNAEHRAVFAQKLPYPRFFVIRKIAALRIGKQNLRGF
               |||||||||||| ||:|||||||||||||||||||||||||||||||||| | |||||||
a295           RQKQRHTRAPAFLHQIGPDFGFHQNAEHRAVFAQKLPYPRFFVIRKIAALCIRKQNLRGF
                      130       140       150       160       170       180

                      190       200       210       220       230       240
m295.pep       PPRRGHLRHQQRRIGKTPPQLAYQGLGGTRFSDRNGVYPNRAGNGIRIRLAETLVPMRPI
               | ||||||||||||||| |||||| |||||| ||||||||||||||||||||||:|||||
a295           PSRRGHLRHQQRRIGKTLPQLAYQRLGGTRFPDRNGVYPNRAGNGIRIRLAETLAPMRPI
                      190       200       210       220       230       240

                      250       260       270       280       290
m295.pep       CRGTSGAFVQITPYPYRRKQPQYIIKPLEHLSISCKTNAVXTVQTAFRQRNQISX
               |||||||||||||||||||||||||||||||||||||||| ||:|||||||||||
a295           CRGTSGAFVQITPYPYRRKQPQYIIKPLEHLSISCKTNAVRTVRTAFRQRNQISX
                      250       260       270       280       290
```

The following partial DNA sequence was identified in *N. gonorrhoeae* <SEQ ID 1235>:

g297.seq

```
  1 ATGGCTGTCT TCCCACTTTC GGCAAAACAT CGGAAATACG CGCTGCGCGC

 51 GCTTGCCGTT TCGATTATTC TGGTGtcgGC GGCATACATT GCttcgacag

101 aggggaccga gcgcgtcaga ccgCAGCGCG TggaacaaAA ACTGCCGCCG

151 CTGTCtTGGg gcggcaacgg CGTtcagacg gcaTATTGGG TGCAGGAGGC

201 GGTGCagccg ggggactcgC TGGCGGACGT GCTGGCGCGT TCGGGTATGG

251 CGCGGGacga gattgCCcga ATcacGGAAA aataTggcgG CGAAGCCGAT

301 TTGCGgcatt tGCGTGCCGA CCAGTCGGTT CATGTTTTGG TCGGCGGCGA

351 CGGCAGTGCG CGCGAAGTGC AGTTTTttaC CGACGAAGAC GGCGAGCGCA

401 aTctGGTCGC TTTGGAAAAA AAAGGCGGCA TATGGCGGCG GTCGGCTTCT

451 GATGCGGATA TGAAGGTTTT GCCGACACTG CGTTCGGTCG TGGTCAAAAC

501 GTCGGCGCGC GGTTCGCTGG CGCGGGCGGA AGTGCCCGTC GAAATCCGCG

551 AATCCTTAAG CGGGATTTTT GCCGGCCGCT TCAGCCTTGA CGGTTTGAAG

601 GAAGGCGATG CCGTGCGCCT GCTTTACGAC AGCCTGTATT TCCACGGGCA

651 GCAGGTGGCG GCGGGCGATA TTTTGGCGGC GGAAGTTGTC AAGGGCGGCA

701 CAACCCATCA GGCGTTCTAT TACCGTTCGG ACAAGGAAGG CGGAGGGGGC

751 GGCAATTATT ACGATGAAGA CGGCAGGGTG TTGCAGGAAA AAGGCGGCTT
```

-continued

```
 801 CAACATCgaG CCGCTGGTCT ATACGCGCAT TTCTTCGCCG TTCGGCTACC
 851 GTATGCACCC CATCCTGCAC ACATGGCGGC TGCACACGGG CATCGATTAT
 901 GCCGCACCGC AGGGAACGCC GGTCAGGGCT TCCGCCGACG GCGTGATTAC
 951 CTTTAAAGGC CGGAAGGGCG GATACGGCAA CGCGGTGATG ATACGCCACG
1001 CCAACGGTGT GGAAACGCTG TACGCGCACT TGAGCGCGTT TTCGCAGGCA
1051 CAAGGCAATG TGCGCGGCGG CGAGGTCATC GGTTTTGTCG GTTCGACAGG
1101 GCGTTCGACC GGGCCGCACC TGCATTACGA GGCGCGCATC AACGGGCAGC
1151 CCGTCAATCC TGTTTCGGTC GCATTGCCGA CACCCGAATT GACGCAGGCG
1201 GACAAGGCGG CGTTTGCCGC GCAGAAACAG AAGGCGGACG CGCTGCTTGC
1251 GCGCTTGCGC GGCATACCGG TTACCGTGTC GCAATCGGAT TGA
```

This corresponds to the amino acid sequence <SEQ ID 1236; ORF 297.ng>:

g297.pep

```
  1 MAVFPLSAKH RKYALRALAV SIILVSAAYI ASTEGTERVR PQRVEQKLPP
 51 LSWGGNGVQT AYWVQEAVQP GDSLADVLAR SGMARDEIAR ITEKYGGEAD
101 LRHLRADQSV HVLVGGDGSA REVQFFTDED GERNLVALEK KGGIWRRSAS
151 DADMKVLPTL RSVVVKTSAR GSLARAEVPV EIRESLSGIF AGRFSLDGLK
201 EGDAVRLLYD SLYFHGQQVA AGDILAAEVV KGGTTHQAFY YRSDKEGGGG
251 GNYYDEDGRV LQEKGGFNIE PLVYTRISSP FGYRMHPILH TWRLHTGIDY
301 AAPQGTPVRA SADGVITFKG RKGGYGNAVM IRHANGVETL YAHLSAFSQA
351 QGNVRGGEVI GFVGSTGRST GPHLHYEARI NGQPVNPVSV ALPTPELTQA
401 DKAAFAAQKQ KADALLARLR GIPVTVSQSD *
```

The following partial DNA sequence was identified in *N. meningitidis* <SEQ ID 1237>:

m297.seq

```
  1 ATGGCTGTCT TCCCACTTTC GGCAAAACAT CGGAAATACG CGCTGCGTGC
 51 GCTTGCCGTT TCGATTATTT TGGTGTCGGC GGCATACATT GCTTCGACAG
101 AGAGGACGGA GCGCGTCAGA CCGCAGCGCG TGGAACAAAA TCTGCCGCCG
151 CTGTCTTGGG GCGGCAGCGG CGTTCAGACG GCATATTGGG TGCAGGAGGC
201 GGTGCAGCCG GGCGACTCGC TGGCGGACGT GCTGGCGCGT TCGGGTATGG
251 CGCGGGACGA GATTGCCCGA ATCACGGAAA AATATGGCGG CGAAGCCGAT
301 TTGCGGCATT TGCGTGCCGA CCAGTCGGTT CATGTTTTGC TCGGCGGCGA
351 CGGCGGCGCG CGCGAAGTGC AGTTTTTTAC CGACGAAGAC GGCGAGCGCA
401 ATCTGGTCGC TTTGGAAAAG AAAGGCGGCA TATGGCGGCG GTCGGCTTCT
451 GAGGCGGATA TGAAGGTTTT GCCGACGCTG CGTTCGGTCG TGGTCAAAAC
501 GTCGGCGCGC GGTTCGCTGG CGCGGGCGGA AGTGCCCGTC GAAATCCGCG
551 AATCCTTAAG CGGGATTTTC GCCGGCCGCT TCAGCCTTGA CGGTTTGAAG
```

-continued

```
 601 GAAGGCGATG CCGTGCGCCT GATGTACGAC AGCCTGTATT TCCACGGGCA
 651 GCAGGTGGCG GCGGGCGATA TTTTGGCGGC TGAAGTCGTT AAGGGCGGCA
 701 CAAGGCATCA GGCGTTCTAT TACCGTTCGG ACAAGGAAGG CGGAGGGGGC
 751 GGCAATTATT ATGATGAAGA CGGCAAGGTG TTGCAGGAAA AAGGCGGCTT
 801 CAACATCGAG CCGCTGGTCT ATACGCGCAT TTCTTCGCCG TTCGGCTACC
 851 GTATGCACCC CATCCTGCAC ACATGGCGGC TGCACACGGG CATCGATTAT
 901 GCCGCACCGC AGGGAACGCC GGTCAGGGCT TCCGCCGACG GCGTGATTAC
 951 CTTTAAAGGC CGGAAGGGCG GATACGGCAA CGCGGTGATG ATACGCCACG
1001 CCAACGGTGT GGAAACGCTG TACGCGCACT TGAGCGCGTT TTCGCAGGCG
1051 GAAGGCAATG TGCGCGGCGG CGAGGTCATC GGTTTTGTCG GTTCGACCGG
1101 GCGTTCGACC GGGCCGCACC TGCATTACGA GGCGCGCATC AACGGGCAGC
1151 CCGTCAATCC TGTTTCGGTC GCATTGCCGA CACCGGAATT GACGCAGGCG
1201 GACAAGGCGG CGTTTGCCGC GCAGAAACAG AAGGCGGACG CGCTGCTTGC
1251 GCGCTTGCGC GGCATACCGG TTACCGTGTC GCAATCGGAT TGA
```

This corresponds to the amino acid sequence <SEQ ID 1238; ORF 297>:

m297.pep

```
  1 MAVFPLSAKH RKYALRALAV SIILVSAAYI ASTERTERVR PQRVEQNLPP
 51 LSWGGSGVQT AYWVQEAVQP GDSLADVLAR SGMARDEIAR ITEKYGGEAD
101 LRHLRADQSV HVLVGGDGGA REVQFFTDED GERNLVALEK KGGIWRRSAS
151 EADMKVLPTL RSVVVKTSAR GSLARAEVPV EIRESLSGIF AGRFSLDGLK
201 EGDAVRLMYD SLYFHGQQVA AGDILAAEVV KGGTRHQAFY YRSDKEGGGG
251 GNYYDEDGKV LQEKGGFNIE PLVYTRISSP FGYRMHPILH TWRLHTGIDY
301 AAPQGTPVRA SADGVITFKG RKGGYGNAVM IRHANGVETL YAHLSAFSQA
351 EGNVRGGEVI GFVGSTGRST GPHLHYEARI NGQPVNPVSV ALPTPELTQA
401 DKAAFAAQKQ KADALLARLR GIPVTVSQSD *
```

m297/g297 97.9% identity in 430 aa overlap

```
                   10        20        30        40        50        60
m297.pep   MAVFPLSAKHRKYALRALAVSIILVSAAYIASTERTERVRPQRVEQNLPPLSWGGSGVQT
           |||||||||||||||||||||||||||||||||| ||||||||||:||||||||:|||||
g297       MAVFPLSAKHRKYALRALAVSIILVSAAYIASTEGTERVRPQRVEQKLPPLSWGGNGVQT
                   10        20        30        40        50        60

                   70        80        90       100       110       120
m297.pep   AYWVQEAVQPGDSLADVLARSGMARDEIARITEKYGGEADLRHLRADQSVHVLVGGDGGA
           |||||||||||||||||||||||||||||||||||||||||||||||||||||||||:|
g297       AYWVQEAVQPGDSLADVLARSGMARDEIARITEKYGGEADLRHLRADQSVHVLVGGDGSA
                   70        80        90       100       110       120

                  130       140       150       160       170       180
m297.pep   REVQFFTDEDGERNLVALEKKGGIWRRSASEADMKVLPTLRSVVVKTSARGSLARAEVPV
           ||||||||||||||||||||||||||||||:|||||||||||||||||||||||||||||
g297       REVQFFTDEDGERNLVALEKKGGIWRRSASDADMKVLPTLRSVVVKTSARGSLARAEVPV
                  130       140       150       160       170       180

                  190       200       210       220       230       240
m297.pep   EIRESLSGIFAGRFSLDGLKEGDAVRLMYDSLYFHGQQVAAGDILAAEVVKGGTRHQAFY
           |||||||||||||||||||||||||||:|||||||||||||||||||||||||| |||||
g297       EIRESLSGIFAGRFSLDGLKEGDAVRLLYDSLYFHGQQVAAGDILAAEVVKGGTTHQAFY
                  190       200       210       220       230       240
```

-continued

```
            250       260       270       280       290       300
m297.pep  YRSDKEGGGGGNYYDEDGKVLQEKGGFNIEPLVYTRISSPFGYRMHPILHTWRLHTGIDY
          ||||||||||||||||||:|||||||||||||||||||||||||||||||||||||||||
g297      YRSDKEGGGGGNYYDEDGRVLQEKGGFNIEPLVYTRISSPFGYRMHPILHTWRLHTGIDY
            250       260       270       280       290       300

            310       320       330       340       350       360
m297.pep  AAPQGTPVRASADGVITFKGRKGGYGNAVMIRHANGVETLYAHLSAFSQAEGNVRGGEVI
          |||||||||||||||||||||||||||||||||||||||||||||||||||:||||||||
g297      AAPQGTPVRASADGVITFKGRKGGYGNAVMIRHANGVETLYAHLSAFSQAQGNVRGGEVI
            310       320       330       340       350       360

            370       380       390       400       410       420
m297.pep  GFVGSTGRSTGPHLHYEARINGQPVNPVSVALPTPELTQADKAAFAAQKQKADALLARLR
          ||||||||||||||||||||||||||||||||||||||||||||||||||||||||||||
g297      GFVGSTGRSTGPHLHYEARINGQPVNPVSVALPTPELTQADKAAFAAQKQKADALLARLR
            370       380       390       400       410       420

            430
m297.pep  GIPVTVSQSDX
          |||||||||||
g297      GIPVTVSQSDX
            430
```

The following partial DNA sequence was identified in *N. meningitidis* <SEQ ID 1239>:

a297.seq

```
   1 ATGGCTGTCT TCCCACTTTC GGCAAAACAT CGGAAATACG CGCTGCGCGC
  51 GCTTGCCGTT TCGATTATTT TGGTGTCGGC GGCATACATT GCTTCGACAG
 101 AGAGGACGGA GCGCGTCAGA CCGCAGCGCG TGGAACAAAA ACTGCCGCCG
 151 CTGTCTTGGG GCGGCAGCGG TGTTCAGACG GCATATTGGG TGCAGGAGGC
 201 GGTGCAGCCA GGCGACTCGC TGGCGGACGT GCTGGCGCGT TCGGGTATGG
 251 CGCGGGACGA AATTGCCCGA ATAACGGAAA AATATGGCGG CGAAGCCGAT
 301 TTGCGGCATT TGCGTGCCGA CCAGTCGGTT CATGTTTTGG TCGGCGGCGA
 351 CGGCGGCGCG CGCGAAGTGC AGTTTTTTAC CGACGAAGAC GGCGAGCGCA
 401 ATCTGGTCGC TTTGGAAAAA AAAGGCGGCA TATGGCGGCG GTCGGCTTCT
 451 GAGGCGGATA TGAAGGTTTT GCCGACGCTG CGTTCGGTCG TGGTCAAAAC
 501 GTCGGCGCGC GGTTCGCTGG CGCGGGCGGA AGTGCCCGTC GAAATTCGCG
 551 AATCCTTAAG CGGGATTTTC GCCGGCCGCT TCAGCCTTGA TGGTTTGAAG
 601 GAAGGCGATG CCGTGCGCCT GATTTACGAC AGCCTGTATT TCCACGGGCA
 651 GCAGGTGGCG GCGGGCGATA TTCTGGCGGC GGAAGTCGTT AAGGGCGGCA
 701 CAAGGCATCA GGCGTTCTAT TACCGTTCGG ACAAGGAAGG AGGAGGGGGC
 751 GGCAATTATT ACGATGAAGA CGGCAGGGTG TTGCAGGAAA AAGGCGGCTT
 801 CAACATCGAG CCACTGGTCT ATACGCGCAT TTCTTCGCCG TTCGGCTACC
 851 GTATGCACCC CATCCTGCAC ACTTGGCGGC TGCACACGGG CATCGATTAT
 901 GCCGCACCGC AGGGAACGCC GGTCAGGGCT TCCGCCGACG GCGTGATTAC
 951 CTTTAAAGGC CGGAAGGGTG GCTACGGCAA CGCGGTGATG ATACGCCACG
1001 CCAACGGTGT GGAAACGCTG TATGCGCACT TGAGGGCGTT TTCTCAGGCA
1051 GAAGGCAATG TGCGCGGCGG CGAGGTCATC GGTTTTGTCG GTTCGACCGG
1101 GCGTTCGACG GGGCCGCACC TGCATTACGA GGCGCGCATC AATGGGCAGC
1151 CCGTCAATCC TGTTTCGGTC GCATTGCCGA CACCCGAATT GACGCAGGCG
1201 GACAAGGCGG CGTTTGCCGC GCAGAAACAG AAGGCGGACG CGCTGCTTGC
1251 GCGCTTGCGC GGCATACCGG TTACCGTGTC GCAATCGGAT TGA
```

This corresponds to the amino acid sequence <SEQ ID 1240; ORF 297.a>:

```
a297.pep

  1 MAVFPLSAKH RKYALRALAV SIILVSAAYI ASTERTERVR PQRVEQKLPP

 51 LSWGGSGVQT AYWVQEAVQP GDSLADVLAR SGMARDEIAR ITEKYGGEAD

101 LRHLRADQSV HVLVGGDGGA REVQFFTDED GERNLVALEK KGGIWRRSAS

151 EADMKVLPTL RSVVVKTSAR GSLARAEVPV EIRESLSGIF AGRFSLDGLK

201 EGDAVRLIYD SLYFHGQQVA AGDILAAEVV KGGTRHQAFY YRSDKEGGGG

251 GNYYDEDGRV LQEKGGFNIE PLVYTRISSP FGYRMHPILH TWRLHTGIDY

301 AAPQGTPVRA SADGVITFKG RKGGYGNAVM IRHANGVETL YAHLSAFSQA

351 EGNVRGGEVI GFVGSTGRST GPHLHYEARI NGQPVNPVSV ALPTPELTQA

401 DKAAFAAQKQ KADALLARLR GIPVTVSQSD *
```

m297/a297 99.3% identity in 430 aa overlap

```
                  10        20        30        40        50        60
m297.pep  MAVFPLSAKHRKYALRALAVSIILVSAAYIASTERTERVRPQRVEQNLPPLSWGGSGVQT
          ||||||||||||||||||||||||||||||||||||||||||||||:|||||||||||||
a297      MAVFPLSAKHRKYALRALAVSIILVSAAYIASTERTERVRPQRVEQKLPPLSWGGSGVQT
                  10        20        30        40        50        60

                  70        80        90       100       110       120
m297.pep  AYWVQEAVQPGDSLADVLARSGMARDEIARITEKYGGEADLRHLRADQSVHVLVGGDGGA
          ||||||||||||||||||||||||||||||||||||||||||||||||||||||||||||
a297      AYWVQEAVQPGDSLADVLARSGMARDEIARITEKYGGEADLRHLRADQSVHVLVGGDGGA
                  70        80        90       100       110       120

                 130       140       150       160       170       180
m297.pep  REVQFFTDEDGERNLVALEKKGGIWRRSASEADMKVLPTLRSVVVKTSARGSLARAEVPV
          ||||||||||||||||||||||||||||||||||||||||||||||||||||||||||||
a297      REVQFFTDEDGERNLVALEKKGGIWRRSASEADMKVLPTLRSVVVKTSARGSLARAEVPV
                 130       140       150       160       170       180

                 190       200       210       220       230       240
m297.pep  EIRESLSGIFAGRFSLDGLKEGDAVRLMYDSLYFHGQQVAAGDILAAEVVKGGTRHQAFY
          |||||||||||||||||||||||||||:||||||||||||||||||||||||||||||||
a297      EIRESLSGIFAGRFSLDGLKEGDAVRLIYDSLYFHGQQVAAGDILAAEVVKGGTRHQAFY
                 190       200       210       220       230       240

                 250       260       270       280       290       300
m297.pep  YRSDKEGGGGGNYYDEDGKVLQEKGGFNIEPLVYTRISSPFGYRMHPILHTWRLHTGIDY
          ||||||||||||||||||:|||||||||||||||||||||||||||||||||||||||||
a297      YRSDKEGGGGGNYYDEDGRVLQEKGGFNIEPLVYTRISSPFGYRMHPILHTWRLHTGIDY
                 250       260       270       280       290       300

                 310       320       330       340       350       360
m297.pep  AAPQGTPVRASADGVITFKGRKGGYGNAVMIRHANGVETLYAHLSAFSQAEGNVRGGEVI
          ||||||||||||||||||||||||||||||||||||||||||||||||||||||||||||
a297      AAPQGTPVRASADGVITFKGRKGGYGNAVMIRHANGVETLYAHLSAFSQAEGNVRGGEVI
                 310       320       330       340       350       360

                 370       380       390       400       410       420
m297.pep  GFVGSTGRSTGPHLHYEARINGQPVNPVSVALPTPELTQADKAAFAAQKQKADALLARLR
          ||||||||||||||||||||||||||||||||||||||||||||||||||||||||||||
a297      GFVGSTGRSTGPHLHYEARINGQPVNPVSVALPTPELTQADKAAFAAQKQKADALLARLR
                 370       380       390       400       410       420

                 430
m297.pep  GIPVTVSQSDX
          |||||||||||
a297      GIPVTVSQSDX
                 430
```

The following partial DNA sequence was identified in *N. gonorrhoeae* <SEQ ID 1241>:

```
g298.seq

  1 ATGAAAAACT TTCTTTCCCT TTTCGCCTCC ATACTGATGT CTGCCCTGAT

 51 TGCCGTGTGC TTCAGCCAAA ACCCCATCAA CGCCTACTGG CAGCAGACCT
```

-continued

```
101 ACCACCGCAA CAGCCCGCTC GAACCGCTTG CCGCCTACGG ATGGTGGCGG
151 AGCGGAGCGG CGTTGCAAGA AAACGCCTAC GCCCTTTCAG ACGGCATCAA
201 AACCTTCCTG TCCGGCGAAA cgccccccac ggCTCAAGAC GGCGGTTCGG
251 CAGATATGCC GCCTGAAGCC GCCGCATCCG AAGCCGCCCC GCCGGCCGGC
301 GGAACAGAAT GGAAACAAGG CACCGAAGCC GCCGCCGTCC GCAGCGGCGA
351 CAAAGTCTTT TTCGCCGGAG ATTCGCTGAT GCAGGGCGTT GCGCCTTTCG
401 TGCAAAAAAG CCTGAAACAG CAATACGGCA TCGAATCCGC CAACCTCAGC
451 AAACAAAGCA CGGGGCTTTC CTATCCCTCA TTCTTCGACT GGCCGAAAAC
501 GATTGAAGAA ACCTTGAAAA AACATCCCGA AATCAGCGTA CTCGCCGTCT
551 TCCTCGGCCC GAACGACCCG TGGGATTTCC CCGTCGGCAA ACGCTACCTC
601 AAATTCGCTT CCGACGAATG GGCGCAAGAA TACCTGAAAC GCGTCGACCG
651 CATCCTTGAA GCCGCACACA CGCACCGCGT CCAAGTCGTC TGGCTCGGCA
701 TCCCCTACAT GAAAAAAGTC AAGCTCGACG GTCAGATGCG CTACCTCGAC
751 AAACTGCTTT CGGAACACTT GAAAGGCAAA ATCATCCTGA TTCCCACCGC
801 GCAAACACTG AGCGGCGGGA AAGgccGCTA CACCGATTCC GTCAACGTCA
851 ACGGCAAACC CGTCCGCTAC CGCAGTAAGG ACGGCATACA CTTTACCGCC
901 GAAGGACAAA AACTGCTGGC GGAAAAAATA ATGGAAAAAA TCGTTTTTGA
951 ACCGAGTACG CAACCATCAA GTACACAGCC ATGA
```

This corresponds to the amino acid sequence <SEQ ID 1242; ORF 298.ng>:

g298.pep

```
  1 MKNFLSLFAS ILMSALIAVW FSQNPINAYW QQTYHRNSPL EPLAAYGWWR
 51 SGAALQENAY ALSDGIKTFL SGETPPTAQD GGSADMPPEA AASEAAPPAG
101 GTEWKQGTEA AAVRSGDKVF FAGDSLMQGV APFVQKSLKQ QYGIESANLS
151 KQSTGLSYPS FFDWPKTIEE TLKKHPEISV LAVFLGPNDP WDFPVGKRYL
201 KFASDEWAQE YLKRVDRILE AAHTHRVQVV WLGIPYMKKV KLDGQMRYLD
251 KLLSEHLKGK IILIPTAQTL SGGKGRYTDS VNVNGKPVRY RSKDGIHFTA
301 EGQKLLAEKI MEKIVFEPST QPSSTQP*
```

The following partial DNA sequence was identified in *N. meningitidis* <SEQ ID 1243>:

m298.seq

```
  1 ATGAAAAACT TTCTTTCCCT TTTCTCCTCC ATACTGATGT CTGCCCTGAT
 51 TGCCGTGTGG TTCAGCCAAA ACCCCATCAA CGCCTACTGG CAGCAGACCT
101 ACCACCGCAA CAGCCCGCTC GAACCGCTTG CCGCCTACGG ATGGTGGCGG
151 AGCGGTGCGG CGTTGCAAGA AAACGCCTAC GCCCTTTCAG ACGGCATCAA
201 AGCCTTCCTG TCCGGCGAAA CGCCGCCGAC GGCTCAAGAC GGCGGTTCGG
251 CAGATATGCC GTCTGAAGCC GCCGCATCCG AAGCCGTCCC TCAAACCGGT
```

-continued

```
301 GAAACAGAAT GGAAACAAGA CACCGAAGCC GCCGCCGTCC GCAGCGGCGA

351 CAAAGTCTTT TTTGTCGGCG ACTCGCTGAT GCAGGGCGTT GCCCCCTTCG

401 TGCAAAAAAG CCTGAAACAG CAATACGGCA TCGAATCCGT CAACCTCAGC

451 AAACAAAGCA CGGGGCTGTC CTACCCCTCA TTCTTCGACT GGCCGAAAAC

501 GATTGAAGAA ACCCTGCAAA AACATCCCGA AATCAGCGTA CTCGCCGTCT

551 TCCTCGGACC GAACGACCCG TGGGATTTCC CCGTCGGCAA ACTCTATCTC

601 AAATTCGCTT CCGACGAATG GGCGCAAGAA TACCTGAAAC GTGTCGACCG

651 CATCCTTGAA GCCGCACACA CGCACCGCGT CCAAGTCGTC TGGCTCGGCA

701 TCCCCTACAT GAAAAAAGCC AAGCTCGACG GACAGATGCG CTACCTAGAC

751 AAACTGCTTT CGGAACATTT GAAAGGCAAA ATCATCCTGA TTCCCACCAC

801 GCACACCCTG AGCGGCGGGA AAGACCGCTA CACCGACTCC GTCAACGTCA

851 ACGGCAAACC CGTCCGCTAC CGCAGCAAGG ACGGCATACA CTTTACCGCC

901 GAAGGACAAA AACTGCTGGC GGCAAAAATA ATGGAAAAAA TCGTTTTTGA

951 ACCAAGTACG CAACCATCAA GTACACAGCC ATGA
```

This corresponds to the amino acid sequence <SEQ ID 1244; ORF 298>:

m298.pep

```
  1 MKNFLSLFSS ILMSALIAVW FSQNPINAYW QQTYHRNSPL EPLAAYGWWR

 51 SGAALQENAY ALSDGIKAFL SGETPPTAQD GGSADMPSEA AASEAVPQTG

101 ETEWKQDTEA AAVRSGDKVF FVGDSLMQGV APFVQKSLKQ QYGIESVNLS

151 KQSTGLSYPS FFDWPKTIEE TLQKHPEISV LAVFLGPNDP WDFPVGKLYL

201 KFASDEWAQE YLKRVDRILE AAHTHRVQVV WLGIPYMKKA KLDGQMRYLD

251 KLLSEHLKGK IILIPTTHTL SGGKDRYTDS VNVNGKPVRY RSKDGIHFTA

301 EGQKLLAAKI MEKIVFEPST QPSSTQP*
```

m298/g298 94.8% identity in 327 aa overlap

```
                    10        20        30        40        50        60
m298.pep    MKNFLSLFSSILMSALIAVWFSQNPINAYWQQTYHRNSPLEPLAAYGWWRSGAALQENAY
            ||||||||:|||||||||||||||||||||||||||||||||||||||||||||||||||
g298        MKNFLSLFASILMSALIAVWFSQNPINAYWQQTYHRNSPLEPLAAYGWWRSGAALQENAY
                    10        20        30        40        50        60

                    70        80        90       100       110       120
m298.pep    ALSDGIKAFLSGETPPTAQDGGSADMPSEAAASEAVPQTGETEWKQDTEAAAVRSGDKVF
            |||||||:||||||||||||||||||| |||||||:| :| ||||| |||||||||||||
g298        ALSDGIKTFLSGETPPTAQDGGSADMPPEAAASEAAPPAGGTEWKQGTEAAAVRSGDKVF
                    70        80        90       100       110       120

                   130       140       150       160       170       180
m298.pep    FVGDSLMQGVAPFVQKSLKQQYGIESVNLSKQSTGLSYPSFFDWPKTIEETLQKHPEISV
            |:||||||||||||||||||||||||:||||||||||||||||||||||||||:||||||
g298        FAGDSLMQGVAPFVQKSLKQQYGIESANLSKQSTGLSYPSFFDWPKTIEETLKKHPEISV
                   130       140       150       160       170       180

                   190       200       210       220       230       240
m298.pep    LAVFLGPNDPWDFPVGKLYLKFASDEWAQEYLKRVDRILEAAHTHRVQVVWLGIPYMKKA
            ||||||||||||||||| |||||||||||||||||||||||||||||||||||||||||:
g298        LAVFLGPNDPWDFPVGKRYLKFASDEWAQEYLKRVDRILEAAHTHRVQVVWLGIPYMKKV
                   190       200       210       220       230       240

                   250       260       270       280       290       300
m298.pep    KLDGQMRYLDKLLSEHLKGKIILIPTTHTLSGGKDRYTDSVNVNGKPVRYRSKDGIHFTA
            ||||||||||||||||||||||||||::|||||| |||||||||||||||||||||||||
g298        KLDGQMRYLDKLLSEHLKGKIILIPTAQTLSGGKGRYTDSVNVNGKPVRYRSKDGIHFTA
                   250       260       270       280       290       300
```

-continued

```
                310       320
m298.pep  EGQKLLAAKIMEKIVFEPSTQPSSTQPX
          ||||||| ||||||||||||||||||||
g298      EGQKLLAEKIMEKIVFEPSTQPSSTQPX
                310       320
```

The following partial DNA sequence was identified in *N. meningitidis* <SEQ ID 1245>:

a298.seq

```
  1 ATGAAAAACT TTCTTTCCCT TTTCGCCTCC ATACTGATGT CTGCCCTGAT
 51 TGCCGTGTGG TTCAGCCAAA ACCCCATCAA CGCCTACTGG CAGCAGACCT
101 ACCACCGCAA CAGCCCGCTC GAACCGCTTG CCGCCTACGG ATGGTGGCGG
151 AGCGGTGCGG CATTGCAAGA AAACGCCTAC GCCCTTTCAG ACGGCATCAA
201 AGCCTTCCTG TCCGGCGAAA CGCCGCCGAC GGCTCAAGAC GGCGGTTCGG
251 CAGATATGCC GTCTGAAGCC GCCGCACCCG AAACCGCCCC TCAAACTGGC
301 GAAACAGAAT GGAAACAAAA CACCGAAGCC GCCGCCGTCC GAACAGGGGA
351 CAAAGTCTTT TTCGCCGGCG ACTCGCTGAT GCAGGGCGTT GCACCCTTCG
401 TGCAAAAAAG CCTGAAACAG CAATACGGCA TCGAATCCGT CAACCTCAGC
451 AAACAAAGCA CGGGGCTGTC CTACCCCTCA TTCTTCGACT GGCCGAAAAC
501 GATTGAAGAA ACCCTGAAAA AACATCCCGA AATCAGCGTG CTCGCCGTCT
551 TCCTCGGTCC GAACGACCCG TGGGATTTCC CCGTTGGCAA ACGCTACCTC
601 AAATTCGCTT CCGACGAATG GGCGCAAGAA TACCTGAAAC GCGTCGACCG
651 CATCCTTGAA GCCGCACACA CGCACTACGT CCAAGTCGTC TGGCTCGGCA
701 TCCCCTACAT GAAAAAAGCC AAGCTCGACG GACAGATGCG CTACCTAGAC
751 AAACTGCTTT CGGAATATTT GAAAGGCAAA ATCATCCTGA TTCCCACCGC
801 GCACACCCTG AGCGGCGGGA AAGACCGCTA CACCGACTCC GTCAACGTCA
851 ACGGCAAACC CGTCCGCTAC CGCAGCAAGG ACGGCATACA CTTTACCGCC
901 GAAGGACAAA AACTGCTGGC GGCAAAAATA ATGGAAAAAA TCGTTTTTGA
951 ACCAAGTACG CAACCATCAA GTACACAGCC ATGA
```

This corresponds to the amino acid sequence <SEQ ID 1246; ORF 298.a>:

a298.pep

```
  1 MKNFLSLFAS ILMSALIAVW FSQNPINAYW QQTYHRNSPL EPLAAYGWWR
 51 SGAALQENAY ALSDGIKAFL SGETPPTAQD GGSADMPSEA AAPETAPQTG
101 ETEWKQNTEA AAVRTGDKVF FAGDSLMQGV APFVQKSLKQ QYGIESVNLS
151 KQSTGLSYPS FFDWPKTIEE TLKKHPEISV LAVFLGPNDP WDFPVGKRYL
201 KFASDEWAQE YLKRVDRILE AAHTHYVQVV WLGIPYMKKA KLDGQMRYLD
251 KLLSEYLKGK IILIPTAHTL SGGKDRYTDS VNVNGKPVRY RSKDGIHFTA
301 EGQKLLAAKI MEKIVFEPST QPSSTQP*
```

m298/a298 96.3% identity in 327 aa overlap

```
                   10        20        30        40        50        60
m298.pep   MKNFLSLFSSILMSALIAVWFSQNPINAYWQQTYHRNSPLEPLAAYGWWRSGAALQENAY
           ||||||||:|||||||||||||||||||||||||||||||||||||||||||||||||||
a298       MKNFLSLFASILMSALIAVWFSQNPINAYWQQTYHRNSPLEPLAAYGWWRSGAALQENAY
                   10        20        30        40        50        60

                   70        80        90       100       110       120
m298.pep   ALSDGIKAFLSGETPPTAQDGGSADMPSEAAASEAVPQTGETEWKQDTEAAAVRSGDKVF
           |||||||||||||||||||||||||||||||| |::||||||||||:|||||||:|||||
a298       ALSDGIKAFLSGETPPTAQDGGSADMPSEAAAPETAPQTGETEWKQNTEAAAVRTGDKVF
                   70        80        90       100       110       120

                  130       140       150       160       170       180
m298.pep   FVGDSLMQGVAPFVQKSLKQQYGIESVNLSKQSTGLSYPSFFDWPKTIEETLQKHPEISV
           |:||||||||||||||||||||||||||||||||||||||||||||||||||:|||||||
a298       FAGDSLMQGVAPFVQKSLKQQYGIESVNLSKQSTGLSYPSFFDWPKTIEETLKKHPEISV
                  130       140       150       160       170       180

                  190       200       210       220       230       240
m298.pep   LAVFLGPNDPWDFPVGKLYLKFASDEWAQEYLKRVDRILEAAHTHRVQVVWLGIPYMKKA
           ||||||||||||||||| ||||||||||||||||||||||||||| ||||||||||||||
a298       LAVFLGPNDPWDFPVGKRYLKFASDEWAQEYLKRVDRILEAAHTHYVQVVWLGIPYMKKA
                  190       200       210       220       230       240

                  250       260       270       280       290       300
m298.pep   KLDGQMRYLDKLLSEHLKGKIILIPTTHTLSGGKDRYTDSVNVNGKPVRYRSKDGIHFTA
           |||||||||||||||:||||||||||:|||||||||||||||||||||||||||||||||
a298       KLDGQMRYLDKLLSEYLKGKIILIPTAHTLSGGKDRYTDSVNVNGKPVRYRSKDGIHFTA
                  250       260       270       280       290       300

                  310       320
m298.pep   EGQKLLAAKIMEKIVFEPSTQPSSTQPX
           ||||||||||||||||||||||||||||
a298       EGQKLLAAKIMEKIVFEPSTQPSSTQPX
                  310       320
```

The following partial DNA sequence was identified in *N. gonorrhoeae* <SEQ ID 1247>:

g299.seq

```
  1 ATGAACCCCA AACACTTCAT CGCATTTTCC GCCCTGTTCG CCGCCACGCA
 51 GGCAGAAGCC CTGCCCGTCG CCTCCGTCAG CCCCGACACC GTTACCGTTT
101 CCCCGTCCGC CCCCTACACC GATACAAACG GGCTGCTGAC CGACTACGGC
151 AACGCCGCCG CCTCGCCTTG GATGAAAAAA CTCCGATCCG TCGCACAAGG
201 CAGCGGCGAG GCCTTCCGCA TCCTGCAAAT CGGCGACTCG CATACCGCCG
251 GCGACTTCTT TACCGACGCC CTGCGCAAAC GCCTGCAAAA AACATGGGGC
301 GACGGCGGCA TAGGCTGGGT TTACCCCGCC AACGTCAAAG GGCAGCGCAT
351 GGCGGCCGTC CGTCACAGCG GCAACTGGCA AAGCTTCACC AGCAGGAACA
401 ATACCGGAGA TTTCCCGCTC GGCGGCATCC TCGCCCAAAC CGGCAGCGGC
451 GGCGGCATGA CCCTGACCGC GTCTGACGGC AAAACCGGCA AACAGCGCGT
501 TTCCCTGTTT GCCAAACCGC TGCTCGCCGA ACAAACCCTG ACCGTCAACG
551 GCAACACCGT CTCCGCCAAC GGCGGCGGCT GGCAGGTACT GGATACGGGC
601 GCGGCACTGC CCCTGGCCAT ACAGACCGAA ATGCCGTGGG ACATCGGCTT
651 CATCAACATC GAAAATCCCG CCGGCGGCAT TACCGTTTCC GCGATGGGCA
701 TCAACGGCGC ACAATTGACC CAGTGGTCGA AATGGCGTGC CGACCGTATG
751 AACGACCTTG CCCAAACCGG CGCCGATTTG GTTATCCTTT CCTACGGCAC
801 CAACGAAGCC TTCAACAACA ACATCGACAT TGCCGATACC GAACAAAAAT
851 GGCTGGATAC CGTCCGCCAA ATCCGCGACA GCCTGCCCGC CGCCGGCATC
901 CTCATCATCG GCGCGCCCGA ATCCCTGAAA AACACGCTCG GCGTATGCGG
951 CACGCGCCCC GTCCTCCTGA CCGAAGTCCA ACAGATGCAG CGGCGCGTCG
```

-continued

```
1001 CCCGTCAGGG GCAGACGATG TTTTGGTCTT GGCAAAACGC AATGGGCGGC
1051 ATATGCAGCA TGAAAAACTG GCTCAACCAA GGATCGGCCG CCAAAGACGG
1101 CGTACACTTC TCCGCCCAAG GCTACCGGCG CGCGGCGGAA ATGCTTGCCG
1151 ACAGCCTCGA AGAACTCGTC CGCGCCGCCG CAATCAGGCA ATAA
```

This corresponds to the amino acid sequence <SEQ ID 1248; ORF 299.ng>:

g299.pep

```
  1 MNPKHFIAFS ALFAATQAEA LPVASVSPDT VTVSPSAPYT DTNGLLTDYG
 51 NAAASPWMKK LRSVAQGSGE AFRILQIGDS HTAGDFFTDA LRKRLQKTWG
101 DGGIGWVYPA NVKGQRMAAV RHSGNWQSFT SRNNTGDFPL GGILAQTGSG
151 GGMTLTASDG KTGKQRVSLF AKPLLAEQTL TVNGNTVSAN GGGWQVLDTG
201 AALPLAIQTE MPWDIGFINI ENPAGGITVS AMGINGAQLT QWSKWRADRM
251 NDLAQTGADL VILSYGTNEA FNNNIDIADT EQKWLDTVRQ IRDSLPAAGI
301 LIIGAPESLK NTLGVCGTRP VLLTEVQQMQ RRVARQGQTM FWSWQNAMGG
351 ICSMKNWLNQ GWAAKDGVHF SAQGYRRAAE MLADSLEELV RAAAIRQ*
```

The following partial DNA sequence was identified in *N. meningitidis* <SEQ ID 1249>:

m299.seq

```
  1 ATGAACCCCA AACACCTCAT CGCATTTTCC GCCCTATTCG CCGCCACGCA
 51 GGCAGAAGCC CTACCTGTCG CCTCCGTCAG CCTCGACACC GTTACCGTTT
101 CCCCGTCCGC CCCCTACACC GATACAAACG GGCTGCTGAC CGACTACGGC
151 AACGCCTCCG CCTCGCCTTG GATGAAAAAA CTCCAATCCG TCGCACAAGG
201 CAGCGGCGAG ACCTTCCGTA TCCTGCAAAT CGGCGACTCG CATACCGCCG
251 GCGACTTCTT TACCGACAGC CTGCGCAAAC GCCTGCAAAA AACTTGGGGC
301 GACGGCGGCA TAGGCTGGGT TTACCCCGCC AACGTCAAAG GGCAGCGCAT
351 GGCGGCCGTC CGGCACAACG GTAACTGGCA AAGCCTCACC AGCAGGAACA
401 ACACCGGAGA CTTCCCGCTC GGCGGCATCC TCGCCCACAC CGGCAGCGGC
451 GGCAGCATGA CCCTGACCGC ATCGGACGGC ATAGCAAGCA AGCAGCGCGT
501 TTCCCTGTTT GCCAAACCCC TGCTTGCCGA ACAAACCCTG ACCGTCAACG
551 GCAACACCGT CTCCGCCAAC GGCGGCGGCT GGCAGGTACT GGATACGGGC
601 GCGGCACTGC CCCTGACCAT ACACACCGAA ATGCCGTGGG ACATCGGCTT
651 CATCAACATC GAAAATCCCG CCGGCGGCAT TACCGTTTCC GCGATGGGCA
701 TCAACGGCGC ACAATTAACC CAGTGGTCGA AATGGCGTGC CGACCGTATG
751 AACGACCTCG CCCAAACCGG CGCCGATTTG GTTATCCTTT CCTACGGCAC
801 CAACGAAGCT TTCAACAACA ACATCGACAT TGCCGACACC GAACAAAAAT
851 GGCTGGATAC CGTCCGCCAA ATCCGCGACA GCCTGCCTGC CGCCGGCATC
901 CTCATCATCG GCGCACCCGA ATCCCTGAAA AACACGCTCG GCGTATGCGG
951 CACACGCCCC GTCCGCCTGA CCGAAGTCCA ACAGATGCAG CGGCGCGTCG
```

-continued

```
1001 CCCGTCAGGG GCAGACGATG TTCTGGTCTT GGCAAAACGC CATGGGCGGC

1051 ATATGCAGCA TGAAAAACTG GCTCAACCAA GGATGGGCCG CCAAAGACGG

1101 CGTACACTTC TCCGCCAAAG GCTACCGGCG CGCGGCGGAA ATGCTCGCCG

1151 ACAGCCTCGA AGAACTCGTC CGCTCCGCTG CAATCAGGCA ATAA
```

This corresponds to the amino acid sequence <SEQ ID 1250; ORF 299>:

m299.pep

```
  1 MNPKHLIAFS ALFAATQAEA LPVASVSLDT VTVSPSAPYT DTNGLLTDYG

 51 NASASPWMKK LQSVAQGSGE TFRILQIGDS HTAGDFFTDS LRKRLQKTWG

101 DGGIGWVYPA NVKGQRMAAV RHNGNWQSLT SRNNTGDFPL GGILAHTGSG

151 GSMTLTASDG IASKQRVSLF AKPLLAEQTL TVNGNTVSAN GGGWQVLDTG

201 AALPLTIHTE MPWDIGFINI ENPAGGITVS AMGINGAQLT QWSKWRADRM

251 NDLAQTGADL VILSYGTNEA FNNNIDIADT EQKWLDTVRQ IRDSLPAAGI

301 LIIGAPESLK NTLGVCGTRP VRLTEVQQMQ RRVARQGQTM FWSWQNAMGG

351 ICSMKNWLNQ GWAAKDGVHF SAKGYRRAAE MLADSLEELV RSAAIRQ*
```

m299/g299 95.596 identity in 397 aa overlap

```
                    10        20        30        40        50        60
m299.pep    MNPKHLIAFSALFAATQAEALPVASVSLDTVTVSPSAPYTDTNGLLTDYGNASASPWMKK
            |||||:||||||||||||||||||||| ||||||||||||||||||||||||:|||||||
g299        MNPKHFIAFSALFAATQAEALPVASVSPDTVTVSPSAPYTDTNGLLTDYGNAAASPWMKK
                    10        20        30        40        50        60

                    70        80        90       100       110       120
m299.pep    LQSVAQGSGETFRILQIGDSHTAGDFFTDSLRKRLQKTWGDGGIGWVYPANVKGQRMAAV
            |:||||||||:|||||||||||||||||||:|||||||||||||||||||||||||||||
g299        LRSVAQGSGEAFRILQIGDSHTAGDFFTDALRKRLQKTWGDGGIGWVYPANVKGQRMAAV
                    70        80        90       100       110       120

                   130       140       150       160       170       180
m299.pep    RHNGNWQSLTSRNNTGDFPLGGILAHTGSGGSMTLTASDGIASKQRVSLFAKPLLAEQTL
            ||:|||||:||||||||||||||||:||||||:||||||| ::|||||||||||||||||
g299        RHSGNWQSFTSRNNTGDFPLGGILAQTGSGGGMTLTASDGKTGKQRVSLFAKPLLAEQTL
                   130       140       150       160       170       180

                   190       200       210       220       230       240
m299.pep    TVNGNTVSANGGGWQVLDTGAALPLTIHTEMPWDIGFINIENPAGGITVSAMGINGAQLT
            |||||||||||||||||||||||||:|:||||||||||||||||||||||||||||||||
g299        TVNGNTVSANGGGWQVLDTGAALPLAIQTEMPWDIGFINIENPAGGITVSAMGINGAQLT
                   190       200       210       220       230       240

                   250       260       270       280       290       300
m299.pep    QWSKWRADRMNDLAQTGADLVILSYGTNEAFNNNIDIADTEQKWLDTVRQIRDSLPAAGI
            ||||||||||||||||||||||||||||||||||||||||||||||||||||||||||||
g299        QWSKWRADRMNDLAQTGADLVILSYGTNEAFNNNIDIADTEQKWLDTVRQIRDSLPAAGI
                   250       260       270       280       290       300

                   310       320       330       340       350       360
m299.pep    LIIGAPESLKNTLGVCGTRPVRLTEVQQMQRRVARQGQTMFWSWQNAMGGICSMKNWLNQ
            ||||||||||||||||||||| ||||||||||||||||||||||||||||||||||||||
g299        LIIGAPESLKNTLGVCGTRPVLLTEVQQMQRRVARQGQTMFWSWQNAMGGICSMKNWLNQ
                   310       320       330       340       350       360

                   370       380       390
m299.pep    GWAAKDGVHFSAKGYRRAAEMLADSLEELVRSAAIRQX
            |||||||| |||:||||||||||||||||||:||||||
g299        GWAAKDGVGFSAQGYRRAAEMLADSLEELVRAAAIRQX
                   370       380       390
```

The following partial DNA sequence was identified in *N. meningitidis* <SEQ ID 1251>:

a299.seq

```
   1 ATGAACCCCA AACACCTCAT CGCATTTTCC GCCCTATTCG CCGCCACGCA
  51 GGCAGAAGCC CTACCTGTCG CCTCAGTCAG CCTCGACACC GTTACCGTTT
 101 CCCCGTCCGC CCCCTACACC GATACAAACG GGCTGCTGAC CGACTACGGC
 151 AACGCCTCCG CCTCGCCTTG GATGAAAAAA CTCCAATCCG TCGCACAAGG
 201 CAGCGGCGAG ACCTTCCGTA TCCTGCAAAT CGGCGACTCG CATACCGCCG
 251 GCGACTTCTT TACCGACAGC CTGCGCAAAC GCCTACAAAA AACTTGGGGC
 301 GACGGCGGCA TAGGCTGGGT TTACCCCGCC AACGTCAAAG GGCAGCGCAT
 351 GGCGGCCGTC CGGCACAACG GTAACTGGCA AAGCCTCACC AGCAGGAACA
 401 ACACCGGAGA CTTCCCGCTC GGCGGCATCC TCGCCCACAC CGGCAGCGGC
 451 GGCAGCATGA CCCTGACCGC ATCGGACGGC ATAGCAAGCA AGCAGCGCGT
 501 TTCCCTGTTT GCCAAACCCC TGCTTGCCGA ACAAACCCTG ACCGTCAACG
 551 GCAACACCGT CTCCGCCAAC GGCGGCGGCT GGCAGGTACT GGATACGGGC
 601 GCGGCACTGC CCCTGACCAT ACACACCGAA ATGCCGTGGG ACATCGGCTT
 651 CATCAACATC GAAAATCCCG CCGGCGGCAT TACCGTTTCC GCGATGGGCA
 701 TCAACGGCGC ACAATTAACC CAGTGGTCGA AATGGCGTGC CGACCGTATG
 751 AACGACCTTG CCCAAACCGG CGCCGATCTA GTCATCCTTG CCTACGGTAC
 801 CAACGAAGCC TTCGGCGACA ACATCGACAT TGCCGATACC GAACAGAAAT
 851 GGCTGGATAC CGTCCGCCAA ATCCGCGACA GCCTACCTGC CGCCGGCATC
 901 CTCATCATCG GCGCGCCCGA ATCCCTGAAA AACACGCTCG GCGTATGCGG
 951 CACACGCCCC GTCCGCCTGA CCGAAGTCCA ACAGATGCAG CGGCGCATCG
1001 CCCGTCAGGG GCAGACGATG TTCTGGTCTT GGCAAAACGC GATGGGCGGC
1051 GTTTGCACCA TGAAAAACTG GCTCAACCAC GGATGGGCCG CCAAAGACGG
1101 CGTACACTTT TCCGCCAAAG GCTACCAACG GTCGGCGGAA ATGCTCGCCG
1151 ACAGCCTCGA AGAACTCGTC CGCTCCGCTG CAATCAGGCA ATAA
```

This corresponds to the amino acid sequence <SEQ ID 1252; ORF 299.a>:

a299.pep

```
   1 MNPKHLIAFS ALFAATQAEA LPVASVSLDT VTVSPSAPYT DTNGLLTDYG
  51 NASASPWMKK LQSVAQGSGE TFRILQIGDS HTAGDFFTDS LRKRLQKTWG
 101 DGGIGWVYPA NVKGQRMAAV RHNGNWQSLT SRNNTGDFPL GGILAHTGSG
 151 GSMTLTASDG IASKQRVSLF AKPLLAEQTL TVNGNTVSAN GGGWQVLDTG
 201 AALPLTIHTE MPWDIGFINI ENPAGGITVS AMGINGAQLT QWSKWRADRM
 251 NDLAQTGADL VILAYGTNEA FGDNIDIADT EQKWLDTVRQ IRDSLPAAGI
 301 LIIGAPESLK NTLGVCGTRP VRLTEVQQMQ RRIARQGQTM FWSWQNAMGG
 351 VCSMKNWLNH GWAAKDGVHF SAKGYQRSAE MLADSLEELV RSAAIRQ*
```

m299/a299 98.0% identity in 397 aa overlap

```
                      10         20         30         40         50         60
m299.pep      MNPKHLIAFSALFAATQAEALPVASVSLDTVTVSPSAPYTDTNGLLTDYGNASASPWMKK
              ||||||||||||||||||||||||||||||||||||||||||||||||||||||||||||
a299          MNPKHLIAFSALFAATQAEALPVASVSLDTVTVSPSAPYTDTNGLLTDYGNASASPWMKK
                      10         20         30         40         50         60

                      70         80         90        100        110        120
m299.pep      LQSVAQGSGETFRILQIGDSHTAGDFFTDSLRKRLQKTWGDGGIGWVYPANVKGQRMAAV
              ||||||||||||||||||||||||||||||||||||||||||||||||||||||||||||
a299          LQSVAQGSGETFRILQIGDSHTAGDFFTDSLRKRLQKTWGDGGIGWVYPANVKGQRMAAV
                      70         80         90        100        110        120

                     130        140        150        160        170        180
m299.pep      RHNGNWQSLTSRNNTGDFPLGGILAHTGSGGSMTLTASDGIASKQRVSLFAKPLLAEQTL
              ||||||||||||||||||||||||||||||||||||||||||||||||||||||||||||
a299          RHNGNWQSLTSRNNTGDFPLGGILAHTGSGGSMTLTASDGIASKQRVSLFAKPLLAEQTL
                     130        140        150        160        170        180

                     190        200        210        220        230        240
m299.pep      TVNGNTVSANGGGWQVLDTGAALPLTIHTEMPWDIGFINIENPAGGITVSAMGINGAQLT
              ||||||||||||||||||||||||||||||||||||||||||||||||||||||||||||
a299          TVNGNTVSANGGGWQVLDTGAALPLTIHTEMPWDIGFINIENPAGGITVSAMGINGAQLT
                     190        200        210        220        230        240

                     250        260        270        280        290        300
m299.pep      QWSKWRADRMNDLAQTGADLVILSYGTNEAFNNNIDIADTEQKWLDTVRQIRDSLPAAGI
              |||||||||||||||||||||||:|||||||::|||||||||||||||||||||||||||
a299          QWSKWRADRMNDLAQTGADLVILAYGTNEAFGDNIDIADTEQKWLDTVRQIRDSLPAAGI
                     250        260        270        280        290        300

                     310        320        330        340        350        360
m299.pep      LIIGAPESLKNTLGVCGTRPVRLTEVQQMQRRVARQGQTMFWSWQNAMGGICSMKNWLNQ
              ||||||||||||||||||||||||||||||||:|||||||||||||||||:||||||||:
a299          LIIGAPESLKNTLGVCGTRPVRLTEVQQMQRRIARQGQTMFWSWQNAMGGVCSMKNWLNH
                     310        320        330        340        350        360

                     370        380        390
m299.pep      GWAAKDGVHFSAKGYRRAAEMLADSLEELVRSAAIRQX
              |||||||||||||||:|:||||||||||||||||||||
a299          GWAAKDGVHFSAKGYQRSAEMLADSLEELVRSAAIRQX
                     370        380        390
```

The following partial DNA sequence was identified in *N. gonorrhoeae* <SEQ ID 1253>:

g302.seq

```
  1 ATGCACTCAA TATATTTTTT TAAGGAGAAG CAGATGAGTC AAACCGACGC
 51 GCGTCGTAGC GGACGATTTT TACGCACAGT CGAATGGCTG GGCAATATGT
101 TGCCGCACCC GGTTACGCTT TTTATTATTT TCATTGTGTT ATTGCTGATT
151 GCCTCTGCCG TCGGTGCGTA TTTCGGACTA TCCGTCCCCG ATCCGCGTCC
201 TGTTGGGGCG AAAGGACGTG CCGATGACGG TTTGATTCAC GTTGTCAGCC
251 TGCTCGATGC CGACGGTTTG ATCAAAATCC TGACGCATAC CGTTAAAAAT
301 TTCACCGGTT TCGCGCCGTT GGGAACGGTG TTGGTTTCTT TATTGGGCGT
351 GGGGATTGCG GAAAAATCGG GCTTGATTTC CGCATTAATG CGCTTATTGC
401 TCACAAAATC CCCACGCAAA CTCACTACTT TTATGGTTGT TTTTACAGGG
451 ATTTTATCCA ATACGGCTTC TGAATTGGGC TATGTCGTCC TAATCCCTTT
501 GTCCGCCGTC ATCTTTCATT CGCTCGGCCG CCATCCGCTT GCCGGTTTGG
551 CTGCGGCTTT CGCCGGCGTT TCGGGCGGTT ATTCGGCCAA TCTGTTCTTA
601 GGCACAATCG ATCCGCTCTT GGCAGGCATC ACCCAACAGG CGGCGCAAAT
651 CATCCATCCC GACTACGTCG TAGGCCCTGA AGCCAACTGG TTTTTTATGG
701 CAGCCAGTAC GTTTGTGATT GCTTTGATTG GTTATTTTGT TACTGAAAAA
751 ATCGTCGAAC CGCAATTGGG CCCTTATCAA TCAGATTTGT CACAAGAAGA
801 AAAAGACATT CGGCATTCCA ATGAAATCAC GCCTTTGGAA TATAAAGGAT
851 TAATTTGGGC AGGCGTGGTG TTTGTTGCCT TATCCGCCCT ATTGGCTTGG
```

-continued

```
 901 AGCATCGTCC CTGCCGACGG TATTTTGCGT CATCCTGAAA CAGGATTGGT
 951 TGCCGGTTCG CCGTTTTTAA AATCGATTGT TGTTTTTATT TTCTTGTTGT
1001 TTGCGCTGCC GGGCATTGTT TATGGCCGGA TAACCCGAAG TTTGCGCGGC
1051 GAACGGGAAG TCGTTAATGC GATGGCCGAA TCGATGAGTA CTTTGGGACT
1101 TTATTTGGTC ATCATCTTTT TTGCCGCACA GTTTGTCGCA TTTTTTAATT
1151 GGACGAATAT TGGGCAATAT ATTGCCGTTA AAGGGGCGGT GTTCTTAAAA
1201 GAAGTCGGCT TGGGCGGCAG TGTGTTGTTT ATCGGTTTTA TTTTAATTTG
1251 TGCTTTTATC AATCTGATGA TAGGCTCCGC CTCCGCGCAA TGGGCGGTAA
1301 CTGCGCCGAT TTTCGTCCCT ATGCTGATGT TGGCCGGCTA CGCGCCCCAA
1351 GTCATTCAAG CCGCTTACCG CATCGGTGAT TCCGTTACCA ATATTATTAC
1401 GCCGATGATG AGTTATTTCG GGCTGATTAT GGCGACGGTA ATCAAATACA
1451 AAAAAGATGC GGGCGTAGGC ACGCTGATTT CTATGATGTT GCCGTATTCC
1501 GCTTTCTTCT TAATTGCATG GATCGCCTTA TTCTGCATTT GGGTATTTGT
1551 TTTGGGTCTG CCCGTCGGTC CCGGCACACC CACATTCTAT CCGGTGCCTT
1601 AA
```

This corresponds to the amino acid sequence <SEQ ID 1254; ORF 302.ng>:

g302.pep

```
  1 MHSIYFFKEK QMSQTDARRS GRFLRTVEWL GNMLPHPVTL FIIFIVLLLI
 51 ASAVGAYFGL SVPDPRPVGA KGRADDGLIH VVSLLDADGL IKILTHTVKN
101 FTGFAPLGTV LVSLLGVGIA EKSGLISALM RLLLTKSPRK LTTFMVVFTG
151 ILSNTASELG YVVLIPLSAV IFHSLGRHPL AGLAAAFAGV SGGYSANLFL
201 GTIDPLLAGI TQQAAQIIHP DYVVGPEANW FFMAASTFVI ALIGYFVTEK
251 IVEPQLGPYQ SDLSQEEKDI RHSNEITPLE YKGLIWAGVV FVALSALLAW
301 SIVPADGILR HPETGLVAGS PFLKSIVVFI FLLFALPGIV YGRITRSLRG
351 EREVVNAMAE SMSTLGLYLV IIFFAAQFVA FFNWTNIGQY IAVKGAVFLK
401 EVGLGGSVLF IGFILICAFI NLMIGSASAQ WAVTAPIFVP MLMLAGYAPQ
451 VIQAAYRIGD SVTNIITPMM SYFGLIMATV IKYKKDAGVG TLISMMLPYS
501 AFFLIAWIAL FCIWVFVLGL PVGPGTPTFY PVP*
```

The following partial DNA sequence was identified in *N. meningitidis* <SEQ ID 1255>:

m302.seq

```
  1 ATGCACTCAA TATATTTTTT TAAGGAGAAG CAGATGAGTC AAACCGATAC
 51 GCAACGGGAC GGACGATTTT TACGCACAGT CGAATGGCTG GGCAATATGT
101 TGCCGCATCC GGTTACGCTT TTTATTATTT TCATTGTGTT ATTGCTGATT
151 GCCTCTGCCG TCGGTGCGTA TTTCGGACTA TCCGTCCCCG ATCCGCGCCC
201 TGTTGGTGCG AAAGGACGTG CCGATGACGG TTTGATTTAC ATTGTCAGCC
251 TGCTCAATGC CGACGGTTTT ATCAAAATCC TGACGCATAC CGTTAAAAAT
```

-continued

301 TTCACCGGTT TCGCGCCGTT GGGAACGGTG TTGGTTTCTT TATTGGGCGT

351 GGGGATTGCG GAAAAATCGG GCTTGATTTC CGCATTAATG CGCTTATTGC

401 TCACAAAATC GCCACGCAAA CTCACTACTT TTATGGTTGT TTTTACAGGG

451 ATTTTATCTA ATACCGCTTC TGAATTGGGC TATGTCGTCC TAATCCCTTT

501 GTCCGCCATC ATCTTTCATT CCCTCGGCCG CCATCCGCTT GCCGGTCTGG

551 CTGCGGCTTT CGCCGGCGTT TCGGGCGGTT ATTCGGCCAA TCTGTTCTTA

601 AGCACAATCG ATCCGCTCTT GGCATGCATC ACCCATCAGG CGGCGGTCGT

651 AGGCCCTGAA GCCAACTGGT TTTTTATGGT AGCCAGTACG TTTGTGATTG

701 CTTTGATTGG TTATTTTGTT ACTGAAAAAA TCGTCGAACC GCAATTGGGC

751 CCTTATCAAT CAGATTTGTC ACAAGAAGAA AAAGACATTC GGCATTCCAA

801 TGAAATCACG CCTTTGGAAT ATAAAGGATT AATTTGGGCT GGCGTGGTGT

851 TTGTTGCCTT ATCCGCCCTA TTGGCTTGGA GCATCGTCCC TGCCGACGGT

901 ATTTTGCGTC ATCCTGAAAC AGGATTGGTT TCCGGTTCGC CGTTTTTAAA

951 ATCGATTGTT GTTTTTATTT TCTTGTTGTT TGCACTGyCG GGCmTTGTTT

1001 ATGGmCGGGT AACCCGAAGT TTGCGCGGCG AACAGGAAGT CGTTAATGCG

1051 ATGGCCGAAT CGATGAGTAC TCTGGsGCTT TmTTTGswCA kcATCTTTTT

1101 TGCCGCACAG TTTGTCGCAT TTTTTAATTG GACGAATATT GGGCAATATA

1151 TTGCCGTTAA AGGGGCGACG TTCTTAAAAG AAGTCGGCTT GGGCGGCAGC

1201 GTGTTGTTTA TCGGTTTTAT TTTAATTTGT GCTTTTATCA ATCTGATGAT

1251 AGGCTCCGCC TCCGCGCAAT GGGCGGTAAC TGCGCCGATT TTCGTCCCTA

1301 TGCTGATGTT GGCCGGCTAC GCGCCCGAAG TCATTCAAGC CGCTTACCGC

1351 ATCGGTGATT CCGTTACCAA TATTATTACG CCGATGATGA GTTATTTCGG

1401 GCTGATTATG GCGACGGTGA TCAAATACAA AAAAGATGCG GGCGTGGGTA

1451 CGCTGATTTC TATGATGTTG CCGTATTCCG CTTTCTTCTT GATTGCGTGG

1501 ATTGCCTTAT TCTGCATTTG GGTATTTGTT TTGGGCCTGC CCGTCGGTCC

1551 CGGCGCGCCC ACATTCTATC CCGCACCTTA A

This corresponds to the amino acid sequence <SEQ ID 1256; ORF 302>:

m302.pep

1 MHSIYFFKEK QMSQTDTQRD GRFLRTVEWL GNMLPHPVTL FIIFIVLLLI

51 ASAVGAYFGL SVPDPRPVGA KGRADDGLIY IVSLLNADGF IKILTHTVKN

101 FTGFAPLGTV LVSLLGVGIA EKSGLISALM RLLLTKSPRK LTTFMVVFTG

151 ILSNTASELG YVVLIPLSAI IFHSLGRHPL AGLAAAFAGV SGGYSANLFL

201 STIDPLLACI THQAAVVGPE ANWFFMVAST FVIALIGYFV TEKIVEPQLG

251 PYQSDLSQEE KDIRHSNEIT PLEYKGLIWA GVVFVALSAL LAWSIVPADG

301 ILRHPETGLV SGSPFLKSIV VFIFLLFALX GXVYGRVTRS LRGEQEVVNA

351 MAESMSTLXL XLXXIFFAAQ FVAFFNWTNI GQYIAVKGAT FLKEVGLGGS

401 VLFIGFILIC AFINLMIGSA SAQWAVTAPI FVPMLMLAGY APEVIQAAYR

-continued

```
451 IGDSVTNIIT PMMSYFGLIM ATVIKYKKDA GVGTLISMML PYSAFFLIAW

501 IALFCIWVFV LGLPVGPGAP TFYPAP*
```

Computer analysis of this amino acid sequence gave the following results:

Homology with a predicted ORF from *N. gonorrhoeae*

ORF 302 shows 94.0% identity over a 533 aa overlap with a predicted ORF (ORF 302.ng) from *N. gonorrhoeae*:

m302/g302

```
                   10        20        30        40        50        60
m302.pep   MHSIYFFKEKQMSQTDTQRDGRFLRTVEWLGNMLPHPVTLFIIFIVLLLIASAVGAYPGL
           ||||||||||||||||::|:||||||||||||||||||||||||||||||||||||||||
g302       MHSIYFFKEKQMSQTDARRSGRFLRTVEWLGNMLPHPVTLFIIFIVLLLIASAVGAYPGL
                   10        20        30        40        50        60

                   70        80        90       100       110       120
m302.pep   SVPDPRPVGAKGRADDGLIYIVSLLNADGFIKILTHTVKNFTGFAPLGTVLVSLLGVGIA
           |||||||||||||||||||::||||:|||:||||||||||||||||||||||||||||||
g302       SVPDPRPVGAKGRADDGLIHVVSLLDADGLIKILTHTVKNFTGFAPLGTVLVSLLGVGIA
                   70        80        90       100       110       120

                  130       140       150       160       170       180
m302.pep   EKSGLISALMRLLLTKSPRKLTTFMVVFTGILSNTASELGYVVLIPLSAIIFHSLGRHPL
           |||||||||||||||||||||||||||||||||||||||||||||||||:||||||||||
g302       EKSGLISALMRLLLTKSPRKLTTFMVVFTGILSNTASELGYVVLIPLSAVIFHSLGRHPL
                  130       140       150       160       170       180

                  190       200       210              220       230
m302.pep   AGLAAAFAGVSGGYSANLFLSTIDPLLACITHQAA-------VVGPEANWFFMVASTFVI
           ||||||||||||||||||||:||||||| ||:|||       |||||||||||:||||||
g302       AGLAAAFAGVSGGYSANLFLGTIDPLLAGITQQAAQIIHPDYVVGPEANWFFMAASTFVI
                  190       200       210       220       230       240

               240       250       260       270       280       290
m302.pep   ALIGYFVTEKIVEPQLGPYQSDLSQEEKDIRHSNEITPLEYKGLIWAGVVFVALSALLAW
           ||||||||||||||||||||||||||||||||||||||||||||||||||||||||||||
g302       ALIGYFVTEKIVEPQLGPYQSDLSQEEKDIRHSNEITPLEYKGLIWAGVVFVALSALLAW
                  250       260       270       280       290       300

               300       310       320       330       340       350
m302.pep   SIVPADGILRHPETGLVSGSPFLKSIVVFIFLLFALXGXVYGRVTRSLRGEQEVVNAMAE
           |||||||||||||||||:|||||||||||||||||| | ||||:|||||||:||||||||
g302       SIVPADGILRGPETGLVAGSPFLKSIVVFIFLLFALPGIVYGRITRSLRGEREVVNAMAE
                  310       320       330       340       350       360

               360       370       380       390       400       410
m302.pep   SMSTLXLXLXXIFFAAQFVAFFNWTNIGQYIAVKGATFLKEVGLGGSVLFIGFILICAFI
           ||||| | |  |||||||||||||||||||||||||:|||||||||||||||||||||||
g302       SMSTLGLYLVIIFFAAQFVAFFNWTNIGQYIAVKGAVFLKEVGLGGSVLFIGFILICAFI
                  370       380       390       400       410       420

               420       430       440       450       460       470
m302.pep   NLMIGSASAQWAVTAPIFVPMLMLAGYAPEVIQAAYRIGDSVTNIITPMMSYFGLIMATV
           |||||||||||||||||||||||||||||:||||||||||||||||||||||||||||||
g302       NLMIGSASAQWAVTAPIFVPMLMLAGYAPQVIQAAYRIGDSVTNIITPMMSYFGLIMATV
                  430       440       450       460       470       480

               480       490       500       510       520
m302.pep   IKYKKDAGVGTLISMMLPYSAFFLIAWIALFCIWVFVLGLPVGPGAPTFYPAPX
           |||||||||||||||||||||||||||||||||||||||||||||:|||||:||
g302       IKYKKDAGVGTLISMMLPYSAFFLIAWIALFCIWVFVLGLPVGPGTPTFYPVPX
                  490       500       510       520       530
```

The following partial DNA sequence was identified in *N. meningitidis* <SEQ ID 1257>:

a302.seq

```
  1 ATGCACTCAA TATATTTTTT TAAGGAGAAG CAGATGAGTC AAACCGATAC

 51 GCAACGGGAC GGACGATTTT TACGCACAGT CGAATGGCTG GGCAATATGT

101 TGCCGCACCC GGTTACGCTT TTTATTATTT TCATTGTGTT ATTGCTGATT

151 GCCTCTGCCG CCGGTGCGTA TTTCGGACTA TCCGTCCCCG ATCCGCGCCC
```

-continued

```
 201 TGTTGGTGCG AAAGGACGTG CCGATGACGG TTTGATTCAC GTTGTCAGCC
 251 TGCTCGATGC TGACGGTTTG ATCAAAATCC TGACGCATAC CGTTAAAAAT
 301 TTCACCGGTT TCGCGCCGTT GGGAACGGTG TTGGTTTCTT TATTGGGCGT
 351 GGGGATTGCG GAAAAATCGG GCTTGATTTC CGCATTAATG CGCTTATTGC
 401 TCACAAAATC TCCACGCAAA CTCACTACTT TTATGGTTGT TTTTACAGGG
 451 ATTTTATCTA ATACCGCTTC TGAATTGGGC TATGTCGTCC TAATCCCTTT
 501 GTCCGCCATC ATCTTTCATT CCCTCGGCCG CCATCCGCTT GCCGGTCTGG
 551 CTGCGGCTTT CGCCGGCGTT TCGGGCGGTT ATTCGGCCAA TCTGTTCTTA
 601 GGCACAATCG ATCCGCTCTT GGCAGGCATC ACCCAACAGG CGGCGCAAAT
 651 CATCCATCCC GACTACGTCG TAGGCCCTGA AGCCAACTGG TTTTTTATGG
 701 TAGCCAGTAC GTTTGTGATT GCTTTGATTG GTTATTTTGT TACTGAAAAA
 751 ATCGTCGAAC CGCAATTGGG CCCTTATCAA TCAGATTTGT CACAAGAAGA
 801 AAAAGACATT CGACATTCCA ATGAAATCAC GCCTTTGGAA TATAAAGGAT
 851 TAATTTGGGC TGGCGTGGTG TTTGTTGCCT TATCCGCCCT ATTGGCTTGG
 901 AGCATCGTCC CTGCCGACGG TATTTTGCGT CATCCTGAAA CAGGATTGGT
 951 TTCCGGTTCG CCGTTTTTAA AATCAATTGT TGTTTTTATT TTCTTGTTGT
1001 TTGCACTGCC GGGCATTGTT TATGGCCGGG TAACCCGAAG TTTGCGCGGC
1051 GAACAGGAAG TCGTTAATGC GATGGCCGAA TCGATGAGTA CTCTGGGGCT
1101 TTATTTGGTC ATCATCTTTT TTGCCGCACA GTTTGTCGCA TTTTTTAATT
1151 GGACGAATAT TGGGCAATAT ATTGCCGTTA AAGGGGCGAC GTTCTTAAAA
1201 GAAGTCGGCT TGGGCGGCAG CGTGTTGTTT ATCGGTTTTA TTTTAATTTG
1251 TGCTTTTATC AATCTGATGA TAGGCTCCGC CTCCGCGCAA TGGGCGGTAA
1301 CTGCGCCGAT TTTCGTCCCT ATGCTGATGT TGGCCGGCTA CGCGCCCGAA
1351 GTCATTCAAG CCGCTTACCG CATCGGTGAT TCCGTTACCA ATATTATTAC
1401 GCCGATGATG AGTTATTTCG GGCTGATTAT GGCGACGGTG ATCAAATACA
1451 AAAAAGATGC GGGCGTGGGT ACGCTGATTT CTATGATGTT GCCGTATTCC
1501 GCTTTCTTCT TGATTGCGTG GATTGCCTTA TTCTGCATTT GGGTATTTGT
1551 TTTGGGCCTG CCCGTCGGTC CCGGCGCGCC CACATTCTAT CCCGCACCTT
1601 AA
```

This corresponds to the amino acid sequence <SEQ ID 1258; ORF 302.a>:

a302.pep

```
  1 MHSIYFFKEK QMSQTDTQRD GRFLRTVEWL GNMLPHPVTL FIIFIVLLLI
 51 ASAAGAYFGL SVPDPRPVGA KGRADDGLIH VVSLLDADGL IKILTHTVKN
101 FTGFAPLGTV LVSLLGVGIA EKSGLISALM RLLLTKSPRK LTTFMVVFTG
151 ILSNTASELG YVVLIPLSAI IFHSLGRHPL AGLAAAFAGV SGGYSANLFL
201 GTIDPLLAGI TQQAAQIIHP DYVVGPEANW FFMVASTFVI ALIGYFVTEK
251 IVEPQLGPYQ SDLSQEEKDI RHSNEITPLE YKGLIWAGVV FVALSALLAW
301 SIVPADGILR HPETGLVSGS PFLKSIVVFI FLLFALPGIV YGRVTRSLRG
```

-continued

```
351 EQEVVNAMAE SMSTLGLYLV IIFFAAQFVA FFNWTNIGQY IAVKGATFLK

401 EVGLGGSVLF IGFILICAFI NLMIGSASAQ WAVTAPIFVP MLMLAGYAPE

451 VIQAAYRIGD SVTNIITPMM SYFGLIMATV IKYKKDAGVG TLISMMLPYS

501 AFFLIAWIAL FCIWVFVLGL PVGPGAPTFY PAP*
```

m302/a302 96.1% identity in 533 aa overlap

```
                      10        20        30        40        50        60
m302.pep     MHSIYFFKEKQMSQTDTQRDGRFLRTVEWLGNMLPHPVTLFIIFIVLLLIASAVGAYFGL
             |||||||||||||||||||||||||||||||||||||||||||||||||||||:||||||
a302         MHSIYFFKEKQMSQTDARRSGRFLRTVEWLGNMLPHPVTLFIIFIVLLLIASAAGAYFGL
                      10        20        30        40        50        60

                      70        80        90       100       110       120
m302.pep     SVPDPRPVGAKGRADDGLIYIVSLLNADGFIKILTHTVKNFTGFAPLGTVLVSLLGVGIA
             |||||||||||||||||||::|||:|||:|||||||||||||||||||||||||||||||
a302         SVPDPRPVGAKGRADDGLIHVVSLLDADGLIKILTHTVKNFTGFAPLGTVLVSLLGVGIA
                      70        80        90       100       110       120

                     130       140       150       160       170       180
m302.pep     EKSGLISALMRLLLTKSPRKLTTFMVVFTGILSNTASELGYVVLIPLSAIIFHSLGRHPL
             ||||||||||||||||||||||||||||||||||||||||||||||||||||||||||||
a302         EKSGLISALMRLLLTKSPRKLTTFMVVFTGILSNTASELGYVVLIPLSAIIFHSLGRHPL
                     130      140       150       160       170        180

                     190       200       210              220       230
m302.pep     AGLAAAFAGVSGGYSANLFLSTIDPLLACITHQAA-------VVGPEANWFFMVASTFVI
             ||||||||||||||||||||:||||||| ||:|||       ||||||||||||||||||
a302         AGLAAAFAGVSGGYSANLFLGTIDPLLAGITQQAAQIIHPDYVVGPEANWFFMVASTFVI
                     190       200       210       220       230       240

                  240       250       260       270       280       290
m302.pep     ALIGYFVTEKIVEPQLGPYQSDLSQEEKDIRHSNEITPLEYKGLIWAGVVFVALSALLAW
             ||||||||||||||||||||||||||||||||||||||||||||||||||||||||||||
a302         ALIGYFVTEKIVEPQLGPYQSDLSQEEKDIRHSNEITPLEYKGLIWAGVVFVALSALLAW
                     250       260       270       280       290       300

                  300       310       320       330       340       350
m302.pep     SIVPADGILRHPETGLVSGSPFLKSIVVFIFLLFALXGXVYGRVTRSLRGEQEVVNAMAE
             |||||||||||||||||:|||||||||||||||||| | |||||||||||||||||||||
a302         SIVPADGILRGPETGLVAGSPFLKSIVVFIFLLFALPGIVYGRVTRSLRGEQEVVNAMAE
                     310       320       330       340       350       360

                  360       370       380       390       400       410
m302.pep     SMSTLXLXLXXIFFAAQFVAFFNWTNIGQYIAVKGATFLKEVGLGGSVLFIGFILICAFI
             ||||| | |  |||||||||||||||||||||||||||||||||||||||||||||||||
a302         SMSTLGLYLVIIFFAAQFVAFFNWTNIGQYIAVKGATFLKEVGLGGSVLFIGFILICAFI
                     370       380       390       400       410       420

                  420       430       440       450       460       470
m302.pep     NLMIGSASAQWAVTAPIFVPMLMLAGYAPEVIQAAYRIGDSVTNIITPMMSYFGLIMATV
             ||||||||||||||||||||||||||||||||||||||||||||||||||||||||||||
a302         NLMIGSASAQWAVTAPIFVPMLMLAGYAPEVIQAAYRIGDSVTNIITPMMSYFGLIMATV
                     430       440       450       460       470       480

                  480       490       500       510       520
m302.pep     IKYKKDAGVGTLISMMLPYSAFFLIAWIALFCIWVFVLGLPVGPGAPTFYPAPX
             ||||||||||||||||||||||||||||||||||||||||||||||||||||||
a302         IKYKKDAGVGTLISMMLPYSAFFLIAWIALFCIWVFVLGLPVGPGAPTFYPAPX
                     490       500       510       520       530
```

The following partial DNA sequence was identified in *N. gonorrhoeae* <SEQ ID 1259>:

g305.seq

```
  1 ATGGATTTTT TGATTGTCCT GAAAGCCCTG ATGATGGGCT TGGTAGAAGG

 51 TTTTACCGAA TTTTTACCGA TTTCCAGCAC CGGACATTTG ATTGTGTTCG

101 GCAATCTGAT TGGTTTTCAC AGCAATCACA AGGTTTTTGA AATTGCCATC

151 CAGCTCGGTG CGGTTTTGGC GGTAGTGTTT GAATACCGGC AGCGTTTCAG

201 CAATGTGTTG CATGGCGTGG GAAAAGACCG GAAAGCCAAC CGTTTCGTCC

251 TCAATCTTGC CATTGCTTTT ATACCTGCCG CCGTGATGGG GCTGTTGTTC
```

-continued

```
301 GACAAACAAA TCAAAGAGTA TCTGTTTAAC CCCTTGAGTG TTGCAGTCAT
351 GCTGGTTTTG GGCGGTTTTT TTATTTTGTG GGTGGAGAAA CGCCAAAGCC
401 GAGCAGAGCC TAAAATTGCC GATGTTGATG CATTGCGTCC GATTGATGCG
451 TTGATGATCG GTGTTGCCCA AGTGTTTGCA CTGGTTCCGG GTACGTCCCG
501 TTCGGGCAGT ACGGTTATGG GCGGGATGCT TTGGGGAATC GAGCGGAAAA
551 CGGCAACGGA GTTTTCATTT TTCTTGGCCG TTCCGATGAT GGTTGCAGCA
601 ACGGCTTATG ATGTCCTGAA ACATTACCGA TTTTTCACCC TGCATGATGT
651 CGGTTTGATT TTGATAGGCT TTATTGCCGC TTTTGTTTCC GGTTTGGTAG
701 CGGTTAAAGC ACTGCTGAAG TTTGTTTCCA AGAAAAACTA TATCCCGTTT
751 GCCTATTACC GCATTGTTTT CGGCATTGTC ATCATAATAT TGTGGTTGTC
801 GGGCTGGATA AGTTGGGAAT GA
```

This corresponds to the amino acid sequence <SEQ ID 1260; ORF 305.ng>:

g305.pep

```
  1 MDFLIVLKAL MMGLVEGFTE FLPISSTGHL IVFGNLIGFH SNHKVFEIAI
 51 QLGAVLAVVF EYRQRFSNVL HGVGKDRKAN RFVLNLAIAF IPAAVMGLLF
101 DKQIKEYLFN PLSVAVMLVL GGFFILWVEK RQSRAEPKIA DVDALRPIDA
151 LMIGVAQVFA LVPGTSRSGS TVMGGMLWGI ERKTATEFSF FLAVPMMVAA
201 TAYDVLKHYR FFTLHDVGLI LIGFIAAFVS GLVAVKALLK FVSKKNYIPF
251 AYYRIVFGIV IIILWLSGWI SWE*
```

The following partial DNA sequence was identified in *N. meningitidis* <SEQ ID 1261>:

m305.seq (partial)

```
  1 AtGGATTTTC TGATTGTCCT GAAAGCCCTG ATGATGGGCT TGGTAGAAGG
 51 TTTTACCGAA TTTTTACCGA TTTCCAGCAC CGGACATTTG ATTGTGTTCG
101 GCAATCTGAT TGGTTTTCAC AGCAATCACA AGGTTTTTGA AATTGCCATC
151 CAGCTCGGTG CAGTTTTGGC GGTAGTGTTT GAATACCGGC AACGTTTCAG
201 CAATGTGTTG CACGGCTTGG GAAAAGACCG GAAAGCCAAC CGCTTCGTCC
251 TTAATCTTGC CATTGCTTTT ATACCTGCCG CCGTGATGGG GCTGTTGTTC
301 GGCAwACAAA TCAAAGAGyA TCTGTTTAAC CCCTTGAGTG TTGCAGTCAT
351 GCTGGTTyTG GrCGGTTTTT yTATTTTGTG GGTGGAGAAA CGCCAAAGCC
401 GAGCAGAGCC TAAAATTGCC GATGTTGATG CATTGCGTCC GATTGATGCC
451 TTGATGATCG GCGTTGCCCA AGTGTTTGCA CTGGTTCCGG GTACGTCCCG
501 TTCGGGCAGT ACGATTATGG GCGGGATGCT TTGGGGCATC GAACGGAAAA
551 CTGCGACAGA ATTCTCGTTT TTCTTGGCTG TGCCGATGAT GGTTGCCGCA
601 ACGGCTTATG ATGTCCTGAA ACATTACCGA TTTTTCACCC TGCATGATGT
651 CGGTTTGATT CTGATAGGCT TTATTGCTGC CTTTGTTTCA GGCTTGGTAG
701 CGGTAAAAGC GTTGCTGAGG TTTGTTTCGG GTAC...
```

This corresponds to the amino acid sequence <SEQ ID 1262; ORF 305>:

```
m305.pep (partial)

  1 MDFLIVLKAL MMGLVEGFTE FLPISSTGHL IVFGNLIGFH SNHKVFEIAI

 51 QLGAVLAVVF EYRQRFSNVL HGLGKDRKAN RFVLNLAIAF IPAAVMGLLF

101 GXQIKEXLFN PLSVAVMLVL XGFXILWVEK RQSRAEPKIA DVDALRPIDA

151 LMIGVAQVFA LVPGTSRSGS TIMGGMLWGI ERKTATEFSF FLAVPMMVAA

201 TAYDVLKHYR FFTLHDVGLI LIGFIAAFVS GLVAVKALLR FVSG...
```

Computer analysis of this amino acid sequence gave the following results:

Homology with a predicted ORF from *N. gonorrhoeae*

ORF 305 shows 96.7% identity over a 243 aa overlap with a predicted ORF (ORF 305.ng) from *N. gonorrhoeae*:

```
g305/m305

                   10        20        30        40        50        60
g305.pep    MDFLIVLKALMMGLVEGFTEFLPISSTGHLIVFGNLIGFHSNHKVFEIAIQLGAVLAVVF
            ||||||||||||||||||||||||||||||||||||||||||||||||||||||||||||
m305        MDFLIVLKALMMGLVEGFTEFLPISSTGHLIVFGNLIGFHSNHKVFEIAIQLGAVLAVVF
                   10        20        30        40        50        60

                   70        80        90       100       110       120
g305.pep    EYRQRFSNVLHGVGKDRKANRFVLNLAIAFIPAAVMGLLFDKQIKEYLFNPLSVAVMLVL
            ||||||||||||:|||||||||||||||||||||||||||  |||| |||||||||||||
m305        EYRQRFSNVLHGLGKDRKANRFVLNLAIAFIPAAVMGLLFGXQIKEXLFNPLSVAVMLVL
                   70        80        90       100       110       120

                  130       140       150       160       170       180
g305.pep    GGFFILWVEKRQSRAEPKIADVDALRPIDALMIGVAQVFALVPGTSRSGSTVMGGMLWGI
             || |||||||||||||||||||||||||||||||||||||||||||||||:||||||||
m305        XGFXILWVEKRQSRAEPKIADVDALRPIDALMIGVAQVFALVPGTSRSGSTIMGGMLWGI
                  130       140       150       160       170       180

                  190       200       210       220       230       240
g305.pep    ERKTATEFSFFLAVPMMVAATAYDVLKHYRFFTLHDVGLILIGFIAAFVSGLVAVKALLK
            |||||||||||||||||||||||||||||||||||||||||||||||||||||||||||:
m305        ERKTATEFSFFLAVPMMVAATAYDVLKHYRFFTLHDVGLILIGFIAAFVSGLVAVKALLR
                  190       200       210       220       230       240

                  250       260       270
g305.pep    FVSKKNYIPFAYYRIVFGIVIIILWLSGWISWEX
            |||
m305        FVSG
```

The following partial DNA sequence was identified in *N. meningitidis* <SEQ ID 1263>:

```
a305.seq

  1 ATGGATTTTC TGATTGTCCT GAAAGCCCTG ATGATGGGCT TGGTAGAAGG

 51 TTTTACCGAA TTTTTACCGA TTTCCAGCAC CGGACATTTG ATTGTGTTCG

101 GCAATCTGAT TGATTTTCAC AGCAATCACA AGGTTTTTGA AATTACCATC

151 CAGCTCGGTG CGGTTTTGGC GGTAGTGTTT GAATACCGGC AGCGTTTCAG

201 CAATGTGTTG CATGGCGTGG GAAAAGACCG GAAAGCCAAC CGTTTCGTCC

251 TTAATCTTGC CATTGCTTTT ATACCTGCCG CCGTGATGGG GCTGTTGTTC

301 GGCAAACAAA TCAAAGAGTA TCTGTTTAAC CCCTTGAGTG TTGCAGTCAT

351 GCTGGTTTTG GGCGGTTTTT TTATTTTGTG GGTGGAGAAA CGCCAAAGCC

401 GAGCAGAGCC TAAAATTGTC GATGTTGATG CATTGCGTCC GATTGATGCG
```

-continued

```
451 TTGATGATCG GCGTTGCCCA AGTGTTTGCA CTGGTTCCAG GTACGTCCCG
501 TTCGGGCAGT ACGATTATGG GCGGGATGCT TTGGGGAATC GAGCGGAAAA
551 CGGCAACGGA GTTTTCATTT TTCTTGGCCG TTCCGATGAT GGTTGCAGCA
601 ACGGCTTATG ATGTCCTGAA GCATTACCGG TTTTTCACCC TGCATGATGT
651 CGGTTTGATT TTGATTGGCT TTGTTGCTGC CTTTGTTTCA GGCTTGGTGG
701 CGGTCAAAGC GTTGCTGAGG TTTGTTTCCA AGAAAAATTA TATTCCTTTT
751 GCCTATTACC GCATTGTTTT TGGTATTGCC ATCATTATAT TGTGGCTGTC
801 AGGCTGGATA AGTTGGGAAT GA
```

This corresponds to the amino acid sequence <SEQ ID 1264; ORF 305.a>:

a305.pep

```
  1 MDFLIVLKAL MMGLVEGFTE FLPISSTGHL IVFGNLIDFH SNHKVFEITI
 51 QLGAVLAVVF EYRQRFSNVL HGVGKDRKAN RFVLNLAIAF IPAAVMGLLF
101 GKQIKEYLFN PLSVAVMLVL GGFFILWVEK RQSRAEPKIV DVDALRPIDA
151 LMIGVAQVFA LVPGTSRSGS TIMGGMLWGI ERKTATEFSF FLAVPMMVAA
201 TAYDVLKHYR FFTLHDVGLI LIGFVAAFVS GLVAVKALLR FVSKKNYIPF
251 AYYRIVFGIA IIILWLSGWI SWE*
```

m305/a305 96.3% identity in 243 aa overlap

```
                     10        20        30        40        50        60
m305.pep     MDFLIVLKALMMGLVEGFTEFLPISSTGHLIVFGNLIGFHSNHKVFEIAIQLGAVLAVVF
             ||||||||||||||||||||||||||||||||||||| ||||||||||:|||||||||||
a305         MDFLIVLKALMMGLVEGFTEFLPISSTGHLIVFGNLIDFHSNHKVFEITIQLGAVLAVVF
                     10        20        30        40        50        60

                     70        80        90       100       110       120
m305.pep     EYRQRFSNVLHGLGKDRKANRFVLNLAIAFIPAAVMGLLFGXQIKEXLFNPLSVAVMLVL
             ||||||||||||:|||||||||||||||||||||||||||| |||| |||||||||||||
a305         EYRQRFSNVLHGVGKDRKANRFVLNLAIAFIPAAVMGLLFGKQIKEYLFNPLSVAVMLVL
                     70        80        90       100       110       120

                    130       140       150       160       170       180
m305.pep     XGFXILWVEKRQSRAEPKIADVDALRPIDALMIGVAQVFALVPGTSRSGSTIMGGMLWGI
              || |||||||||||||||:||||||||||||||||||||||||||||||||||||||||
a305         GGFFILWVEKRQSRAEPKIVDVDALRPIDALMIGVAQVFALVPGTSRSGSTIMGGMLWGI
                    130       140       150       160       170       180

                    190       200       210       220       230       240
m305.pep     ERKTATEFSFFLAVPMMVAATAYDVLKHYRFFTLHDVGLILIGFIAAFVSGLVAVKALLR
             ||||||||||||||||||||||||||||||||||||||||||||:|||||||||||||||
a305         ERKTATEFSFFLAVPMMVAATAYDVLKHYRFFTLHDVGLILIGFVAAFVSGLVAVKALLR
                    190       200       210       220       230       240

m305.pep     FVSG
             |||
a305         FVSKKNYIPFAYYRIVFGIAIIILWLSGWISWEX
                    250       260       270
```

The following partial DNA sequence was identified in *N. gonorrhoeae* <SEQ ID 1265>:

g306.seq

```
  1 ATGTTTATGA ACAAATTTTC CCAATCCGGA AAAGGTCTGT CCGGTTTCTT
 51 CTTCGGTTTG ATACTGGCAA CGGTCATTAT TGCCGGTATT TTGCTTTATC
```

-continued

```
101 TGAACCAGGG CGGTCAAAAT GCGTTCAAAA TCCCGGCTCC GTCGAAGCAG
151 CCTGCAGAAA CGGAAATCCT GAAACTGAAA AACCAGCCTA AGGAAGACAT
201 CCAACCTGAA CCGGCCGATC AAAACGCCTT GTCCGAACCG GATGTTGCGA
251 AAGAGGCAGA GCAGTCGGAT GCGGAAAAAG CTGCCGACAA GCAGCCCGTT
301 GCCGACAAAG CCGACGAGGT TGAAGAAAAG GCGGGCGAGC CGGAACGGGA
351 AGAGCCGGAC GGACAGGCAG TGCGCAAGAA AGCACTGACT GAAGAGCGTG
401 AACAAACCGT CAGGGAAAAA GCGCAGAAGA AAGATGCCGA AACGGTTAAA
451 AAAAAAGCGG TAAAACCGTC TAAAGAAACA GAGAAAAAAG CTTCAAAAGA
501 AGAGAAAAAG GCGGCGAAAG AAAAAGTTGC ACCCAAACCG ACCCCGGAAC
551 AAATCCTCAA CAGCCGCAGT ATCGAAAAAG CGCGTAGTGC CGCTGCCAAA
601 GAAGTGCAGA AAATGAAAAA CTTTGGGCAA GGCGGAAGCC AACGCATTAT
651 CTGCAAATGG GCGCGTATGC CGAACCCCGG AGCGCGGAAG GGCAGCGTGC
701 CAAACTGGCA ATCTTGGGCA TATCTTCCGA AGTGGTCGGC TATCAGGCGG
751 GACATAAAAC GCTTTACCGC GTGCAAAGCG GCAATATGTC CGCCGATGCG
801 GTGA
```

This corresponds to the amino acid sequence <SEQ ID 1266; ORF 306.ng>:

g306.pep

```
  1 MFMNKFSQSG KGLSGFFFGL ILATVIIAGI LLYLNQGGQN AFKIPAPSKQ
 51 PAETEILKLK NQPKEDIQPE PADQNALSEP DVAKEAEQSD AEKAADKQPV
101 ADKADEVEEK AGEPEREEPD GQAVRKKALT EEREQTVREK AQKKDAETVK
151 KKAVKPSKET EKKASKEEKK AAKEKVAPKP TPEQILNSRS IEKARSAAAK
201 EVQKMKNFGQ GGSQRIICKW ARMPNPGARK GSVPNWQSWA YLPKWSAIRR
251 DIKRFTACKA AICPPMR*
```

The following partial DNA sequence was identified in *N. meningitidis* <SEQ ID 1267>:

m306.seq (partial)

```
  1 ..GGTTTGTTCT TCGGTTTGAT ACTGGCGACG GTCATTATTG CCGGTATTTT
 51   GTTTTATCTG AACCAGAGCG GTCAAAATGC GTTCAAAATC CCGGCTTCGT
101   CGAAGCAGCC TGCAGAAACG GAAATCCTGA AACCGmAwAA CCAGCyTAAG
151   GAAGACATCC AACCTGAwCC GGCCGATCAA AACGCCTTGT CCGAACCGGA
201   TGCTGCGACA GAGGCAGAGC AGTCGGATGC GGAAAAwGCT GCCGACAAGC
251   AGCCCGTTGC CGATAAAGCC GACGAGGTTG AAGAAAAGGC GGGCGAGCCG
301   GAACGGGAAG AGCCGGACGG ACAGGCAGTG CGTAAGAAAG CGCTGACGGA
351   AGAGCGTGAA CAAACCGTCA GGGAAAAAGC GCAGAAGAAA GATGCCGAAA
401   CGGTTAAAAw ACAAGCGGTA AAACCGTCTA AAGAAACAGA GAAAAAAGCT
451   TCAAAAGAAG AGAAAAAGGC GGCGAAGGAA AAAGTTGCAC CCAAACCAAC
```

-continued

```
501   CCCGGAACAA ATCCTCAACA GCGGCAGCAT CGAAAAAGCG CGCAGTGCCG

551   CCGCCAAAGA AGTGCAGAAA ATGAAAACGC CGACAAGGCG GAAGCAACGC

601   ATTATCTGCA AATGGGCGCG TATGCCGACC GTCAGAGCGC GGAAGGGCAG

651   CGTGCCAAAC TGGCAATCTT GGGCATATCT TCCAAGGTGG TCGGTTATCA

701   GGCGGGACAT AAAACGCTTT ACCGGGTGCA AAGCGGCAAT ATGTCTGCCG

751   ATGCGGTGA
```

This corresponds to the amino acid sequence <SEQ ID 1268; ORF 306>:

m306.pep (partial)

```
  1 ..GLFFGLILAT VIIAGILFYL NQSGQNAFKI PASSKQPAET EILKPXNQXK

 51   EDIQPXPADQ NALSEPDAAT EAEQSDAEXA ADKQPVADKA DEVEEKAGEP

101   EREEPDGQAV RKKALTEERE QTVREKAQKK DAETVKXQAV KPSKETEKKA

151   SKEEKKAAKE KVAPKPTPEQ ILNSGSIEKA RSAAAKEVQK MKTPTRRKQR

201   IICKWARMPT VRARKGSVPN WQSWAYLPRW SVIRRDIKRF TGCKAAICLP

251   MR*
```

Computer analysis of this amino acid sequence gave the following results:

Homology with a predicted ORF from *N. gonorrhoeae*

ORF 306 shows 88.9% identity over a 253 aa overlap with a predicted ORF (ORF 306.ng) from *N. gonorrhoeae*:

m306/g306

```
                                  10        20        30        40
m306.pep                  GLFFGLILATVIIAGILFYLNQSGQNAFKIPASSKQPAETEILKPX
                          |:|||||||||||||||:||||:||||||||| |||||||||||
g306        MFMNKFSQSGKGLSGFFFGLILATVIIAGILLYLNQGGQNAFKIPAPSKQPAETEILKLK
                    10        20        30        40        50        60

              50        60        70        80        90       100
m306.pep    NQXKEDIQPXPADQNALSEPDAATEAEQSDAEXAADKQPVADKADEVEEKAGEPEREEPD
            || |||||| |||||||||||:| |||||||| |||||||||||||||||||||||||||
g306        NQPKEDIQPEPADQNALSEPDVAKEAEQSDAEDAADKQPVADKADEVEEKAGEPEREEPD
                    70        80        90       100       110       120

             110       120       130       140       150       160
m306.pep    GQAVRKKALTEEREQTVREKAQKKDAETVKXQAVKPSKETEKKASKEEKKAAKEKVAPKP
            |||||||||||||||||||||||||||||| :||||||||||||||||||||||||||||
g306        GQAVRKKALTEEREQTVREKAQKKDAETVKKKAVKPSKETEKKASKEEKKAAKEKVAPKP
                   130       140       150       160       170       180

                   190       200       210       220       230       240
m306.pep    TPEQILNSGSIEKARSAAAKEVQKMKTPTRR-KQRIICKWARMPTVRARKGSVPNWQSWA
            |||||||| |||||||||||||||||:  :  :|||||||||||:  |||||||||||||
g306        TPEQILNSRSIEKARSAAAKEVQKMKNFGQGGSQRIICKWARMPNPGARKGSVPNWQSWA
                   190       200       210       220       230       240

             230       240       250
m306.pep    YLPRWSVIRRDIKRFTGCKAAICLPMRX
            |||:||:|||||||||:|||||| ||||
g306        YLPKWSAIRRDIKRFTACKAAICPPMRX
                   250       260
```

The following partial DNA sequence was identified in *N. meningitidis* <SEQ ID 1269>:

a306.seq

```
  1 ATGTTTATGA ACAAATTTTC CCAATCCGGA AAAGGTCTGT CCGGTTTTTT
```

-continued

```
 51 CTTCGGTTTG ATACTGGCGA CGGTCATTAT TGCCGGTATT TTGTTTTATC
101 TGAACCAGAG CGGTCAAAAT GCGTTCAAAA TCCCGGTTCC GTCGAAGCAG
151 CCTGCAGAAA CGGAAATCCT GAAACCGAAA AACCAGCCTA AGGAAGACAT
201 CCAACCTGAA CCGGCCGATC AAAACGCCTT GTCCGAACCG GATGCTGCGA
251 AAGAGGCAGA GCAGTCGGAT GCGGAAAAAG CTGCCGACAA GCAGCCCGTT
301 GCCGACAAAG CCGACGAGGT TGAGGAAAAG GCGGACGAGC CGGAGCGGGA
351 AAAGTCGGAC GGACAGGCAG TGCGCAAGAA AGCACTGACG GAAGAGCGTG
401 AACAAACCGT CGGGGAAAAA GCGCAGAAGA AAGATGCCGA AACGGTTAAA
451 AAACAAGCGG TAAAACCATC TAAAGAAACA GAGAAAAAAG CTTCAAAAGA
501 AGAGAAAAAG GCGGAGAAGG AAAAAGTTGC ACCCAAACCG ACCCCGGAAC
551 AAATCCTCAA CAGCGGCAGC ATCGAAAAAG CGCGCAGTGC CGCTGCCAAA
601 GAAGTGCAGA AAATGAAAAC GCCGACAAGG CGGAAGCAAC GCATTATCTG
651 CAAATGGGCG CGTATGCCGA CCGCCGGAGC GCGGAAGGGC AGCGTGCCAA
701 ACTGGCAATC TTGGGCATAT CTTCCAAGGT GGTCGGTTAT CAGGCGGGAC
751 ATAAAACGCT TTACCGGGTG CAAAGCGGCA ATATGTCTGC CGATGCGGTG
801 A
```

This corresponds to the amino acid sequence <SEQ ID 1270; ORF 306.a>:

a306.pep

```
  1 MFMNKFSQSG KGLSGFFFGL ILATVIIAGI LFYLNQSGQN AFKIPVPSKQ
 51 PAETEILKPK NQPKEDIQPE PADQNALSEP DAAKEAEQSD AEKAADKQPV
101 ADKADEVEEK ADEPEREKSD GQAVRKKALT EEREQTVGEK AQKKDAETVK
151 KQAVKPSKET EKKASKEEKK AEKEKVAPKP TPEQILNSGS IEKARSAAAK
201 EVQKMKTPTR RKQRIICKWA RMPTAGARKG SVPNWQSWAY LPRWSVIRRD
251 IKRFTGCKAA ICLPMR*
```

m306/a306 93.7% identity in 252 aa overlap

```
                              10        20        30        40
m306.pep                GLFFGLILATVIIAGILFYLNQSGQNAFKIPASSKQPAETEILKPX
                        |:|||||||||||||||||||||||||||||: |||||||||||
a306          MFMNKFSQSGKGLSGFFFGLILATVIIAGILFYLNQSGQNAFKIPVPSKQPAETEILKPK
                      10        20        30        40        50        60

                50        60        70        80        90       100
m306.pep      NQXKEDIQPXPADQNALSEPDAATEAEQSDAEXAADKQPVADKADEVEEKAGEPEREEPD
              || |||||| |||||||||||| |||||||| |||||||||||||||| |||||: |
a306          NQPKEDIQPEPADQNALSEPDAAKEAEQSDAEKAADKQPVADKADEVEEKADEPEREKSD
                      70        80        90       100       110       120

               110       120       130       140       150       160
m306.pep      GQAVRKKALTEEREQTVREKAQKKDAETVKXQAVKPSKETEKKASKEEKKAAKEKVAPKP
              ||||||||||||||||| ||||||||||||| |||||||||||||||||||| ||||||||
a306          GQAVRKKALTEEREQTVGEKAQKKDAETVKKQAVKPSKETEKKASKEEKKAEKEKVAPKP
                     130       140       150       160       170       180

               170       180       190       200       210       220
m306.pep      TPEQILNSGSIEKARSAAAKEVQKMKTPTRRKQRIICKWARMPTVRARKGSVPNWQSWAY
              ||||||||||||||||||||||||||||||||||||||||||||||: |||||||||||||
a306          TPEQILNSGSIEKARSAAAKEVQKMKTPTRRKQRIICKWARMPTVRARKGSVPNWQSWAY
                     190       200       210       220       230       240
```

-continued

```
         230        240        250
m306.pep  LPRWSVIRRDIKRFTGCKAAICLPMRX
          |||||||||||||||||||||||||||
a306      LPRWSVIRRDIKRFTGCKAAICLPMRX
                250        260
```

The following partial DNA sequence was identified in *N. gonorrhoeae* <SEQ ID 1271>:

g307.seq

```
  1 atgaaaacct tcttcaaaac cctttcgacc gcgtcactcg cgctcatcct
 51 cgcagcctgc ggcggtcaaa aagacagcgc gcccgcagcc tctgccgccg
101 ccccttctgc cgataacggc gcggcgaaaa aagaaatcgt cttcggcacg
151 accgtgggcg acttcggcga tatggtcaaa gaacaaatcc aagccgagct
201 ggagaaaaaa ggctacaccg tcaaattggt cgaatttacc gactatgtgc
251 gcccgaatct ggcattggcg gagggcgagt tggacatcaa cgtcttccaa
301 cacaaaccct atcttgacga tttcaaaaaa gaacacaacc tggacatcac
351 cgaagccttc caagtgccga ccgcgccttt gggactgtat ccgggcaaac
401 tgaaatcgct ggaagaagtc aaagacggca gcaccgtatc cgcgcccaac
451 gacccgtcca acttcgcacg cgccttggtg atgctgaacg aactgggttg
501 gatcaaactc aaagacggca tcaatccgct gaccgcatcc aaagccgaca
551 tcgcggaaaa cctgaaaaac atcaaaatcg tcgagcttga agccgcacaa
601 ctgccgcgca gccgcgccga cgtggatttt gccgtcgtca acggcaacta
651 cgccataagc agcggcatga agctgaccga agccctgttc caagagccga
701 gctttgccta tgtcaactgg tctgccgtca aaaccgccga caaagacagc
751 caatggctta aagacgtaac cgaggcctat aactccgacg cgttcaaagc
801 ctacgcgcac aaacgcttcg agggctacaa ataccctgcc gcatggaatg
851 aaggcgcagc caaataa
```

This corresponds to the amino acid sequence <SEQ ID 1272; ORF 307.ng>:

g307.pep

```
  1 MKTFFKTLST ASLALILAAC GGQKDSAPAA SAAAPSADNG AAKKEIVFGT
 51 TVGDFGDMVK EQIQAELEKK GYTVKLVEFT DYVRPNLALA EGELDINVFQ
101 HKPYLDDFKK EHNLDITEAF QVPTAPLGLY PGKLKSLEEV KDGSTVSAPN
151 DPSNFARALV MLNELGWIKL KDGINPLTAS KADIAENLKN IKIVELEAAQ
201 LPRSRADVDF AVVNGNYAIS SGMKLTEALF QEPSFAYVNW SAVKTADKDS
251 QWLKDVTEAY NSDAFKAYAH KRFEGYKYPA AWNEGAAK*
```

The following partial DNA sequence was identified in *N. meningitidis* <SEQ ID 1273>:

m307.seq (partial)

```
  1 ..CAATGGCTTA AAGACGTAAC CGAGGCCTAT AACTCCGACG CGTTCAAAGC
 51   CTACGCGCAC AAACGCTTCG AGGGCTACAA ATCCCCTGCC GCATGGAATG
101   AAGGCGCAGC CAAATAA
```

This corresponds to the amino acid sequence <SEQ ID 1274; ORF 307>:

m307.pep (partial)

```
1 ..QWLKDVTEAY NSDAFKAYAH KRFEGYKSPA AWNEGAAK*
```

Computer analysis of this amino acid sequence gave the following results:

Homology with a predicted ORF from *N. gonorrhoeae*

ORF 307 shows 97.4% identity over a 38 aa overlap with a predicted ORF (ORF 307.ng) from *N. gonorrhoeae*:

m307/g307

```
                                                  10        20        30
m307.pep                                 QWLKDVTEAYNSDAVKAYAHKRFEGYKSPA
                                         |||||||||||||||||||||||||| ||
g307       SGMKLTEALFQEPSFAYVNWSAVKTADKDSQWLKDVTEAYNSDAFKAYAHKRFEGYKYPA
                  230       240       250       260       270       280

                   39
m307.pep   AWNEGAAKX
           |||||||||
g307       AWNEGAAKX
```

The following partial DNA sequence was identified in *N. meningitidis* <SEQ ID 1275>:

a307.seq

```
  1 ATGAAAACCT TCTTCAAAAC CCTTTCCGCC GCCGCACTCG CGCTCATCCT
 51 CGCCGCCTGC GGCGGTCAAA AAGATAGCGC GCCCGCCGCA TCCGCTTCTG
101 CCGCCGCCGA CAACGGCGCG GCGAAAAAAG NAATCGTCTT CGGCACGACC
151 GTCGGCGACT TCGGCGATAT GGTCAAAGAA CAAATCCAAC CCGAGCTGGA
201 GAAAAAAGGC TACACCGTCA AACTGGTCGA GTTTACCGAC TATGTGCGCC
251 CGAATCTGGC ATTGGCTGAG GGCGAGTNGG ACATCAACGT CTTCCAACAC
301 AAACCCTATC TTGACGACTT CAAAAAAGAA CACAATCTGG ACATCACCGA
351 AGTCTTCCAA GTGCCGACCG CGCCTTTGGG ACTGTACCCG GGCAAGCTGA
401 AATCGCTGGA AGAAGTCAAA GACGGCAGCA CCGTATCCGC GCCCAACGAC
451 CCGTCCAACT TCGCCCGCGT CTTGGTGATG CTCGACGAAC TGGGTTGGAT
501 CAAACTCAAA GANGGCATCA ATCCGCTGAC CGCATCCAAA GCGGACATTG
551 CCGAAAACCT GAAAAACATC AAAATCGTCG AGCTTGAAGC CGCGCAACTG
601 CCGCGTAGCC GCGCCGACGT GGATTTTGNC GTCGTCAACG GCAANTACGC
651 CATAAGCAGC GGCATGAAGC TGACCGAAGC CCTGTTCCAA GAACCGAGCT
701 TTGCCTATGT CAACTGGTCT GCCGTCAAAA CCGCCGACAA AGACAGCCAA
751 TGGCTTAAAG ACGTAACCGA GGCCTATAAC TCCGACGCGT TCAAAGCCTA
```

-continued

```
801 CGCGCACAAA CGCTTCGAGG GCTACAAATC CCCTGCCGCA TGGAATGAAG

851 GCGCAGCCAA ATAA
```

This corresponds to the amino acid sequence <SEQ ID 1276; ORF 307.a>:

a307.pep

```
  1 MKTFFKTLSA AALALILAAC GGQKDSAPAA SASAAADNGA AKKXIVFGTT

 51 VGDFGDMVKE QIQPELEKKG YTVKLVEFTD YVRPNLALAE GEXDINVFQH

101 KPYLDDFKKE HNLDITEVFQ VPTAPLGLYP GKLKSLEEVK DGSTVSAPND

151 PSNFARVLVM LDELGWIKLK XGINPLTASK ADIAENLKNI KIVELEAAQL

201 PRSRADVDFX VVNGXYAISS GMKLTEALFQ EPSFAYVNWS AVKTADKDSQ

251 WLKDVTEAYN SDAFKAYAHK RFEGYKSPAA WNEGAAK*
```

m307/a307 100.0% identity in 38 aa overlap

```
                                               10        20        30
m307.pep                                 QWLKDVTEAYNSDAFKAYAHKRFEGYKSPA
                                         ||||||||||||||||||||||||||||||
a307       SGMKLTEALFQEPSFAYVNWSAVKTADKDSQWLKDVTEAYNSDAFKAYAHKRFEGYKSPA
         220       230       240       250       260       270

               39
m307.pep   AWNEGAAKX
           |||||||||
a307       AWNEGAAKX
         280
```

The following partial DNA sequence was identified in *N. gonorrhoeae* <SEQ ID 1277>:

g308.seq

```
  1 ATGTTAAATC GGGTATTTTA TCGGATATTG GGTGTTGCCG ACAATTTGTA

 51 TCCGTGTTTA TCGGATTTCT GTTTTTTCAC TATAATAGCC GGTTTGCCGT

101 TGCAGGCGGT TTTATGGGAA AGGCGGATGA TGGTACGGCG TTTGATAATC

151 GGCATCAGCG GGGCGAGCGG TTTCCAATAC GGCGTGAAGG CTTTGGAACT

201 TTTGCGCGCG CAAGATGTCG AAACGCACCT TGTGGTATCG AAAGGCGCGG

251 AGATGGCGCG CGCTTCGGAA ACGGATTATA CGAAAGACGA AGTATATGCC

301 TTGGCTGATT TCGTCCATCC GATCGGCAAT ATCGGGGCGT GCATTGCCAG

351 CGGTACGTTT AAAACGGACG GGATGCTGGT CGCACCCTGT TCGATGCGGA

401 CGCTTGCCTC TGTCGCGCAC GGCTTCGGCG ACAACCTCTT GACGCGTGCG

451 GCGGATGTGG TTTTGAAGGA AAGGCGGCGG CTGGTGCTGA TGGTGCGCGA

501 AACGCCGCTG AACCTTGCCC ATTTGGACAA TATGAAGCGG GTAACGGAAA

551 TGGGCGGCGT GGTGTTTCCC CCTGTTCCTG CGATGTACCG CAAGCCGCAG

601 ACGGCGGACG ACATAGTGGC GCACAGTATC GCACACACGC TGTCGCTGTT

651 CGGAATCGAT ACGCCGGATT TGGCGGAATG GCAGGGAATG GCGGATTAA
```

This corresponds to the amino acid sequence <SEQ ID 1278; ORF 308.ng>:

g308.pep

```
  1 MLNRVFYRIL GVADNLYPCL SDFCFFTIIA GLPLQAVLWE RRMMVRRLII
 51 GISGASGFQY GVKALELLRA QDVETHLVVS KGAEMARASE TDYTKDEVYA
101 LADFVHPIGN IGACIASGTF KTDGMLVAPC SMRTLASVAH GFGDNLLTRA
151 ADVVLKERRR LVLMVRETPL NLAHLDNMKR VTEMGGVVFP PVPAMYRKPQ
201 TADDIVAHSI AHTLSLFGID TPDLAEWQGM AD*
```

The following partial DNA sequence was identified in *N. meningitidis* <SEQ ID 1279>:

m308.seq (partial)

```
  1 ATGTTAAATC GGGTATTTTA TCGGATATTG GGTGTTGCCG ACAATTTGTA
 51 TCCGCGTTTA TCGGATTTCT GTTTTTTCAC TATAATAGCC GGTTTGCCGT
101 TGCAGGCGGT TTTATGGGAA AGGCGGATGA TGGTACGGCG TTTGATAATC
151 GGCATCAGCG GGGCGAGCGG TTTCCAATAC GGCGTGAAGG CTTTGGAACT
201 TTTGCGCGCG CAAGATGTCG AAACGCACCT TGTGGTATCG AAAGGTGCGG
251 AGATGGCGCG CGCTTCGGAA ACGGCTTATG CGAGAGACGA GGTATATGCC
301 TTGGCGGACT TCGTGCATCC GATCGGCAAT ATCGGGGCGT GCATTGCCAG
351 CGGTACGTTT AAAACGGATG GGATGCTGGT CGCCCCCTGT TCGATGCGGA
401 CGCTTGCCTC TGTCGCGCAC GGCTTCGGCG ACAATCTGcT GACGCgTGCG
451 GCGGATGTGG TTTTGAAGGA AAGGCGGCGG CTGGTGCTGA TGGTGCGCGA
501 AACGCCGCTG AACCTTGCCC ATTTGGACAA TATGAAGCGG GwAACGGAAA
551 TGGGCGGCGT GGTGTTTCCC CCTGTTCCTG CGATGTACCG CAAACCGCAG
601 ACGGCGGACG ACATAGTGGC GCACAGTGTT GCACACGCtT TGTCGCTGTT
651 CGGAATCGAT ACGCCGGATT CGGCGGAATG GCArGGAATG gcG...
```

This corresponds to the amino acid sequence <SEQ ID 1280; ORF 308>:

m308.pep (partial)

```
  1 MLNRVFYRIL GVADNLYPRL SDFCFFTIIA GLPLQAVLWE RRMMVRRLII
 51 GISGASGFQY GVKALELLRA QDVETHLVVS KGAEMARASE TAYARDEVYA
101 LADFVNPIGN IGACIASGTF KTDGMLVAPC SMRTLASVAH GFGDNLLTRA
151 ADVVLKERRR LVLMVRETPL NLAHLDNMKR XTEMGGVVFP PVPAMYRKPQ
201 TADDIVAHSV AHALSLFGID TPDSAEWQGM A..
```

Computer analysis of this amino acid sequence gave the following results:

Homology with a predicted ORF from *N. gonorrhoeae*

ORF 308 shows 96.5% identity over a 231 aa overlap with a predicted ORF (ORF 308.ng) from *N. gonorrhoeae*.

m308/g308

```
                  10        20        30        40        50        60
m308.pep  MLNRVFYRILGVADNLYPRLSDFCFFTIIAGLPLQAVLWERRMMVRRLIIGISGASGFQY
          ||||||||||||||||| ||||||||||||||||||||||||||||||||||||||||||
g308      MLNRVFYRILGVADNLYPCLSDFCFFTIIAGLPLQAVLWERRMMVRRLIIGISGASGFQY
                  10        20        30        40        50        60

                  70        80        90       100       110       120
m308.pep  GVKALELLRAQDVETHLVVSKGAEMARASETAYARDEVYALADFVHPIGNIGACIASGTF
          ||||||||||||||||||||||||||||||| |::|||||||| ||||||||||||||||
g308      GVKALELLRAQDVETHLVVSKGAEMARASETXYTKDXVYALADXVHPIGNIGACIASGTF
                  70        80        90       100       110       120

                 130       140       150       160       170       180
m308.pep  KTDGMLVAPCSMRTLASVAHGFGDNLLTRAADVVLKERRRLVLMVRETPLNLAHLDNMKR
          ||||||||||||||||||||||||||||||||||||||||||||||||||||||||||||
g308      KTDGMLVAPCSMRTLASVVHGFGDNLLTRAADVVLKERRRLVLMVRETPLNLAHLDNMKR
                 130       140       150       160       170       180

                 190       200       210       220       230
m308.pep  XTEMGGVVFPPVPAMYRKPQTADDIVAHSVAHALSLFGIDTPDSAEWQGMA
           ||||||||||||||||||||||||||||:||:||||||||||| ||||||
g308      VTEMGGVVFPPVPAMYRKPQTADDIVAHSIAHTLSLFGIDTPDLAEWQGMADX
                 190       200       210       220       230
```

The following partial DNA sequence was identified in *N. meningitidis* <SEQ ID 1281>:

a308.seq

```
  1 ATGTTAAATC GGATATTTTA TCGGATATTG GGTGTTGCCG ACAATTTGTA
 51 TCCGTATTTA TCGGATTTCT GTTTTTTCAC TATAATAGCC GGTTTGCCGT
101 TGCAGGCGGT TTTATGGGAA AGGCGGATGA TGGTACGGCG TTTGATAATC
151 GGCATCAGTG GGGCGAGCGG TTTCCAATAC GGCGTGAAGG CTTTGGANCT
201 TTTACGCGCG CAAGATATCG AAACGCACCT TGTGGTATCG AAAGGTGCGG
251 AGATGGCGCG CGCTTCGGAA ACGGNTTATG CGAGAGACGA NGTATATGCC
301 TTGGCGGACT TNGTGCATCC GATCGGCAAT ATCGGGGCGT GCATTGCCAG
351 CGGTACGTTT AAAACGGACG GGATGCTGGT CGCCCCCTGT TCGATGCGGA
401 CGCTTGCCTC GGTCGTGCAC GGCTTCGGCG ACAACCTCTT GACGCGTGCG
451 GCGGATGTGG TTTTGAAGGA AAGGCGGCGG CTGGTGCTGA TGGTGCGCGA
501 AACGCCGCTG AACCTTGCCC ATTTGGACAA TATGAANCGG GTAACGGAAA
551 TGGGCGGCGT GGTGTTTCCC CCTGTTCCTG CGATGTACCG CAAACCGCAG
601 ACGGCGGACG ACATAGTGGC GCACAGTGTT GCACACGCTT TGTCGCTGTT
651 CGGAATCGAT ACGCCGGATT CGGCGGAATG GCAGGGAATG GCGGATTAA
```

This corresponds to the amino acid sequence <SEQ ID 1282; ORF 308.a>:

a308.pep

```
  1 MLNRIFYRIL GVADNLYPYL SDFCFFTIIA GLPLQAVLWE RRMMVRRLII
 51 GISGASGFQY GVKALXLLRA QDIETHLVVS KGAEMARASE TXYARDXVYA
101 LADXVHPIGN IGACIASGTF KTDGMLVAPC SMRTLASVVH GFGDNLLTRA
151 ADVVLKERRR LVLMVRETPL NLAHLDNMXR VTEMGGVVFP PVPAMYRKPQ
201 TADDIVAHSV AHALSLFGID TPDSAEWQGM AD*
```

m308/a308 95.7% identity in 231 aa overlap

```
                   10         20         30         40         50         60
m308.pep    MLNRVFYRILGVADNLYPRLSDFCFFTIIAGLPLQAVLWERRMMVRRLIIGISGASGFQY
            ||||:||||||||||||| |||||||||||||||||||||||||||||||||||||||||
a308        MLNRIFYRILGVADNLYPYLSDFCFFTIIAGLPLQAVLWERRMMVRRLIIGISGASGFQY
                   10         20         30         40         50         60

                   70         80         90        100        110        120
m308.pep    GVKALELLRAQDVETHLVVSKGAEMARASETAYARDEVYALADFVHPIGNIGACIASGTF
            ||||| ||||||:|||||||||||||||||| |||| |||||| ||||||||||||||||
a308        GVKALXLLRAQDIETHLVVSKGAEMARASETXYARDXVYALADXVHPIGNIGACIASGTF
                   70         80         90        100        110        120

                  130        140        150        160        170        180
m308.pep    KTDGMLVAPCSMRTLASVAHGFGDNLLTRAADVVLKERRRLVLMVRETPLNLAHLDMNKR
            ||||||||||||||||||:|||||||||||||||||||||||||||||||||||||||||
a308        KTDGMLVAPCSMRTLASVVHGFGDNLLTRAADVVLKERRRLVLMVRETPLNLAHLDMNKR
                  130       140        150        160        170        180

                  190        200        210        220        230
m308.pep    XTEMGGVVFPPVPAMYRKPQTADDIVAHSVAHALSLFGIDTPDSAEWQGMA
             ||||||||||||||||||||||||||||||||||||||||||||||||||
a308        VTEMGGVVFPPVPAMYRKPQTADDIVAHSVAHTLSLFGIDTPDLAEWQGMADX
                  190        200        210        220        230
```

The following partial DNA sequence was identified in *N. gonorrhoeae* <SEQ ID 1283>:

<u>g308-1.seq</u>

```
  1 ATGTTAAATC GGGTATTTTA TCGGATATTG GGTGTTGCCG ACAATTTGTA
 51 TCCGTGTTTA TCGGATTTCT GTTTTTTCAC TATAATAGCC GGTTTGCCGT
101 TGCAGGCGGT TTTATGGGAA AGGCGGATGA TGGTACGGCG TTTGATAATC
151 GGCATCAGCG GGGCGAGCGG TTTCCAATAC GGCGTGAAGG CTTTGGAACT
201 TTTGCGCGCG CAAGATGTCG AAACGCACCT TGTGGTATCG AAAGGCGCGG
251 AGATGGCGCG CGCTTCGGAA ACGGATTATA CGAAAGACGA AGTATATGCC
301 TTGGCTGATT TCGTCCATCC GATCGGCAAT ATCGGGGCGT GCATTGCCAG
351 CGGTACGTTT AAAACGGACG GGATGCTGGT CGCACCCTGT TCGATGCGGA
401 CGCTTGCCTC TGTCGCGCAC GGCTTCGGCG ACAACCTCTT GACGCGTGCG
451 GCGGATGTGG TTTTGAAGGA AAGGCGGCGG CTGGTGCTGA TGGTGCGCGA
501 AACGCCGCTG AACCTTGCCC ATTTGGACAA TATGAAGCGG GTAACGGAAA
551 TGGGCGGCGT GGTGTTTCCC CCTGTTCCTG CGATGTACCG CAAGCCGCAG
601 ACGGCGGACG ACATAGTGGC GCACAGTATC GCACACACGC TGTCGCTGTT
651 CGGAATCGAT ACGCCGGATT TGGCGGAATG GCAGGGAATG GCGGATTAA
```

This corresponds to the amino acid sequence <SEQ ID 1284; ORF 308-1.ng>:

<u>g308-1.pep</u>

1 MLNRVFYRIL GVADNLYPCL SD<u>FCFFTIIA GLPLQAVLW</u>E RRMMVRRLII

51 GISGASGFQY GVKALELLRA QDVETHLVVS KGAEMARASE TDYTKDEVYA

101 LADFVHPIGN IGACIASGTF KTDGMLVAPC SMRTLASVAH GFGDNLLTRA

151 ADVVLKERRR LVLMVRETPL NLAHLDNMKR VTEMGGVVFP PVPAMYRKPQ

201 TADDIVAHSI AHTLSLFGID TPDLAEWQGM AD*

The following partial DNA sequence was identified in *N. meningitidis* <SEQ ID 1285>:

m308-1.seq

```
  1 ATGTTAAATC GGGTATTTTA TCGGATATTG GGTGTTGCCG ACAATTTGTA
 51 TCCGCGTTTA TCGGATTTCT GTTTTTTCAC TATAATAGCC GGTTTGCCGT
101 TGCAGGCGGT TTTATGGGAA AGGCGGATGA TGGTACGGCG TTTGATAATC
151 GGCATCAGCG GGGCGAGCGG TTTCCAATAC GGCGTGAAGG CTTTGGAACT
201 TTTGCGCGCG CAAGATGTCG AAACGCACCT TGTGGTATCG AAAGGTGCGG
251 AGATGGCGCG CGCTTCGGAA ACGGCTTATG CGAGAGACGA GGTATATGCC
301 TTGGCGGACT TCGTGCATCC GATCGGCAAT ATCGGGGCGT GCATTGCCAG
351 CGGTACGTTT AAAACGGATG GGATGCTGGT CGCCCCCTGT TCGATGCGGA
401 CGCTTGCCTC TGTCGCGCAC GGCTTCGGCG ACAATCTGCT GACGCGTGCG
451 GCGGATGTGG TTTTGAAGGA AAGGCGGCGG CTGGTGCTGA TGGTGCGCGA
501 AACGCCGCTG AACCTTGCCC ATTTGGACAA TATGAAGCGG GTAACGGAAA
551 TGGGCGGCGT GGTGTTTCCC CCTGTTCCTG CGATGTACCG CAAACCGCAG
601 ACGGCGGACG ACATAGTGGC GCACAGTGTT GCACACGCTT TGTCGCTGTT
651 CGGAATCGAT ACGCCGGATT CGGCGGAATG GCAGGGAATG GCGGATTAA
```

This corresponds to the amino acid sequence <SEQ ID 1286; ORF 308-1>:

m308-1.pep

```
  1 MLNRVFYRIL GVADNLYPRL SDFCFFTIIA GLPLQAVLWE RRMMVRRLII
 51 GISGASGFQY GVKALELLRA QDVETHLVVS KGAEMARASE TAYARDEVYA
101 LADFVHPIGN IGACIASGTF KTDGMLVAPC SMRTLASVAH GFGDNLLTRA
151 ADVVLKERRR LVLMVRETPL NLAHLDNMKR VTEMGGVVFP PVPAMYRKPQ
201 TADDIVAHSV AHALSLFGID TPDSAEWQGM AD*
```

m308-1/g308-1 97.0% identity in 232 aa overlap

```
                        10        20        30        40        50        60
m308-1.pep     MLNRVFYRILGVADNLYPRLSDFCFFTIIAGLPLQAVLWERRMMVRRLIIGISGASGFQY
               |||||||||||||||||| |||||||||||||||||||||||||||||||||||||||||
a308-1         MLNRVFYRILGVADNLYPYLSDFCFFTIIAGLPLQAVLWERRMMVRRLIIGISGASGFQY
                        10        20        30        40        50        60

                        70        80        90       100       110       120
m308-1.pep     GVKALELLRAQDVETHLVVSKGAEMARASETAYARDEVYALADFVHPIGNIGACIASGTF
               ||||||||||||||||||||||||||||||| |::|||||||||||||||||||||||||
a308-1         GVKALELLRAQDVETHLVVSKGAEMARASETDYTKDEVYALADXVHPIGNIGACIASGTF
                        70        80        90       100       110       120

                       130       140       150       160       170       180
m308-1.pep     KTDGMLVAPCSMRTLASVAHGFGDNLLTRAADVVLKERRRLVLMVRETPLNLAHLDMNKR
               ||||||||||||||||||||||||||||||||||||||||||||||||||||||||||||
a308-1         KTDGMLVAPCSMRTLASVVHGFGDNLLTRAADVVLKERRRLVLMVRETPLNLAHLDMNKR
                       130      140       150       160       170        180

                       190       200       210       220       230
m308-1.pep     VTEMGGVVFPPVPAMYRKPQTADDIVAHSVAHALSLFGIDTPDSAEWQGMADX
               |||||||||||||||||||||||||||||:||:|||||||||| |||||||||
a308-1         VTEMGGVVFPPVPAMYRKPQTADDIVAHSIAHTLSLFGIDTPDLAEWQGMADX
                       190       200       210       220       230
```

The following partial DNA sequence was identified in *N. meningitidis* <SEQ ID 1287>:

a308-1.seq

```
  1 ATGTTAAATC GGATATTTTA TCGGATATTG GGTGTTGCCG ACAATTTGTA
 51 TCCGTATTTA TCGGATTTCT GTTTTTTCAC TATAATAGCC GGTTTGCCGT
101 TGCAGGCGGT TTTATGGGAA AGGCGGATGA TGGTACGGCG TTTGATAATC
151 GGCATCAGTG GGGCGAGCGG TTTCCAATAC GGCGTGAAGG CTTTGGANCT
201 TTTACGCGCG CAAGATATCG AAACGCACCT TGTGGTATCG AAAGGTGCGG
251 AGATGGCGCG CGCTTCGGAA ACGGNTTATG CGAGAGACGA NGTATATGCC
301 TTGGCGGACT TNGTGCATCC GATCGGCAAT ATCGGGGCGT GCATTGCCAG
351 CGGTACGTTT AAAACGGACG GGATGCTGGT CGCCCCCTGT TCGATGCGGA
401 CGCTTGCCTC GGTCGTGCAC GGCTTCGGCG ACAACCTCTT GACGCGTGCG
451 GCGGATGTGG TTTTGAAGGA AAGGCGGCGG CTGGTGCTGA TGGTGCGCGA
501 AACGCCGCTG AACCTTGCCC ATTTGGACAA TATGAANCGG GTAACGGAAA
551 TGGGCGGCGT GGTGTTTCCC CCTGTTCCTG CGATGTACCG CAAACCGCAG
601 ACGGCGGACG ACATAGTGGC GCACAGTGTT GCACACGCTT TGTCGCTGTT
651 CGGAATCGAT ACGCCGGATT CGGCGGAATG GCAGGGAATG GCGGATTAA
```

This corresponds to the amino acid sequence <SEQ ID 1288; ORF 308-1.a>:

a308-1.pep

```
  1 MLNRIFYRIL GVADNLYPYL SDFCFFTIIA GLPLQAVLWE RRMMVRRLII
 51 GISGASGFQY GVKALXLLRA QDIETHLVVS KGAEMARASE TXYARDXVYA
101 LADXVHPIGN IGACIASGTF KTDGMLVAPC SMRTLASVVH GFGDNLLTRA
151 ADVVLKERRR LVLMVRETPL NLAHLDNMXR VTEMGGVVFP PVPAMYRKPQ
201 TADDIVAHSV AHALSLFGID TPDSAEWQGM AD*
```

a308-1/m308-1 96.1% identity in 232 aa overlap

```
                   10        20        30        40        50        60
a308-1     MLNRIFYRILGVADNLYPYLSDFCFFTIIAGLPLQAVLWERRMMVRRLIIGISGASGFQY
           ||||:||||||||||||| |||||||||||||||||||||||||||||||||||||||||
m308-1     MLNRVFYRILGVADNLYPRLSDFCFFTIIAGLPLQAVLWERRMMVRRLIIGISGASGFQY
                   10        20        30        40        50        60

                   70        80        90       100       110       120
a308-1     GVKALXLLRAQDIETHLVVSKGAEMARASETXYARDEVYALADXVHPIGNIGACIASGTF
           ||||| ||||||:|||||||||||||||||| ||||||||||| ||||||||||||||||
m308-1     GVKALELLRAQDVETHLVVSKGAEMARASETAYARDEVYALADFVHPIGNIGACIASGTF
                   70        80        90       100       110       120

                  130       140       150       160       170       180
a308-1     KTDGMLVAPCSMRTLASVVHGFGDNLLTRAADVVLKERRRLVLMVRETPLNLAHLDMNXR
           ||||||||||||||||||:||||||||||||||||||||||||||||||||||||||| |
m308-1     KTDGMLVAPCSMRTLASVAHGFGDNLLTRAADVVLKERRRLVLMVRETPLNLAHLDMNKR
                  130       140       150       160       170       180

                  190       200       210       220       230
a308-1     VTEMGGVVFPPVPAMYRKPQTADDIVAHSVAGALSLFGIDTPDSAEWQGMADX
           ||||||||||||||||||||||||||||||||||||||||||||||||||||
m308-1     VTEMGGVVFPPVPAMYRKPQTADDIVAHSVAGALSLFGIDTPDSAEWQGMADX
                  190       200       210       220       230
```

The following partial DNA sequence was identified in *N. gonorrhoeae* <SEQ ID 1289>:

g311.seq

```
   1 atgttcagtt tcggctgggc gtttgaccgc ccgcagtatg agttgggttc
  51 gctgtcgcct gttgcggcac ttgcgtgccg gcgcgctttg gggtgtttgg
 101 gtttggaaac gcaaatcaag tggccaaacg atttggtcgt cggacgcgac
 151 aaattgggcg gcattctgat tgaaacagtc agggcgggcg gtaaaacggt
 201 tgccgtggtc ggtatcggca tcaatttcgt gctgcccaag gaagtggaaa
 251 acgccgcttc cgtgcagtcg ctgtttcaga cggcatcgcg gcggggcaat
 301 gccgatgccg ccgtattgct ggaaacattg cttgcggaac tgggcgcggt
 351 gttggaacaa tatgcggaag aagggttcgc gccattttta aatgagtatg
 401 aaacggccaa ccgcgaccac ggcaaggcgg tattgctgtt gcgcgacggc
 451 gaaaccgtgt gcgaaggcac ggttaaaggc gtggacggac gaggcgttct
 501 gcacttggaa acggcagaag gcgaacagac ggtcgtcagc ggcgaaatca
 551 gcctgcggcc cgacaacagg tcggtttccg tgccgaagcg gccggattcg
 601 gaacgttttt tgctgttgga aggcgggaac agccggctca agtgggcgtg
 651 ggtggaaaac ggcacgttcg caaccgtggg cagcgcgccg taccgcgatt
 701 tgtcgccttt gggcgcggag tgggcggaaa aggcggatgg aaatgtccgc
 751 atcgtcggtt gcgccgtgtg cggagaatcc aaaaaggcac aagtgaagga
 801 acagctcgcc cgaaaaatcg agtggctgcc gtcttccgca caggctttgg
 851 gcatacgcaa ccactaccgc caccccgaag aacacggttc cgaccgttgg
 901 ttcaacgcct tgggcagccg ccgcttcagc cgcaacgcct gcgtcgtcgt
 951 cagttgcggc acggcggtaa cggttgacgc gctcaccgat gacggacatt
1001 atctcggcgg aaccatcatg cccggcttcc acctgatgaa agaatcgctc
1051 gccgtccgaa ccgccaacct caaccgcccc gccggcaaac gttacccttt
1101 cccgaccaca acgggcaacg ccgtcgcaag cggcatgatg gacgcggttt
1151 gcggctcgat aatgatgatg cacggccgtt tgaaagaaaa aaacggcgcg
1201 ggcaagcctg tcgatgtcat cattaccggc ggcggcgcgg cgaaagtcgc
1251 cgaagccctg ccgcctgcat tttggcgga aaataccgtg cgcgtggcgg
1301 acaacctcgt catccacggg ctgctgaacc tgattgccgc cgaaggcggg
1351 gaatcggaac acgcttaa
```

This corresponds to the amino acid sequence <SEQ ID 1290; ORF 311.ng>:

g311.pep

```
   1 MFSFGWAFDR PQYELGSLSP VAALACRRAL GCLGLETQIK WPNDLVVGRD
  51 KLGGILIETV RAGGKTVAVV GIGINFVLPK EVENAASVQS LFQTASRRGN
 101 ADAAVLLETL LAELGAVLEQ YAEEGFAPFL NEYETANRDH GKAVLLLRDG
 151 ETVCEGTVKG VDGRGVLHLE TAEGEQTVVS GEISLRPDNR SVSVPKRPDS
 201 ERFLLLEGGN SRLKWAWVEN GTFATVGSAP YRDLSPLGAE WAEKADGNVR
 251 IVGCAVCGES KKAQVKEQLA RKIEWLPSSA QALGIRNHYR HPEEHGSDRW
 301 FNALGSRRFS RNACVVVSCG TAVTVDALTD DGHYLGGTIM PGFHLMKESL
```

-continued

```
351 AVRTANLNRP AGKRYPFPTT TGNAVASGMM DAVCGSIMMM HGRLKEKNGA

401 GKPVDVIITG GGAAKVAEAL PPAFLAENTV RVADNLVIHG LLNLIAAEGG

451 ESEHA*
```

The following partial DNA sequence was identified in *N. meningitidis* <SEQ ID 1291>:

m311.seq (partial)

```
   1 ATGTTCAGTT TTGGCTGGGT GTTTGACCGG CCGCAGTATG AGTTGGGTTC

  51 GCTGTCGCCT GTTGCGGCAG TGGCGTGTCG GCGCGCCTTG TCGCGTTTAG

 101 GTTTGGATGT GCArATTAAG TGGCCCAATG ATTTGGTTGT CGGACGCGAC

 151 AAATTGGGCG GCATTCTGAT TGAAACGGTC AGGACGGGCG GCAAAACGGT

 201 TGCCGTGGTC GGTATCGGCA TCAATTTTGT CCTGCCCAAn GAAGTAGAAA

 251 ATGCCGCTTC CGTGCAATCG CTGTTTCAGA CGGCATCGCG GCGGGGCAAT

 301 GCCGATGCCG CCGTGCTGCT nnnnnnnnnn nnnnnnnnnn nnnnGGAAAT

 351 CAGCCTGCGG TCCGACnACA GGCCGGTTTC CGTGnCGAAG CGGCGGGATT

 401 CGGAACGTTT TCTGCTGTTG GACGGCGGCA ACAGCCGGCT CAAGTGGgCG

 451 TGGGTGGAAA ACGGCACGTT CGCAACCGTC GGTAGCGCGC CGTACCgCGA

 501 TTTGTCGCCT TTGGGCGCGG AGTGGGCGGA AAAGGCGGAT GGAAATGTCC

 551 GCATCGTCGG TTGCGCTGTG TGCGGAGAAT TCAAAAAGGC ACAAGTGCAG

 601 GAACAGCTCG CCCGAAAAAT CGAGTGGCTG CCGTCTTCCG CACAGGCTTT

 651 GTTTGGCATA CGCAACCACT ACCGCCACCC CGAAGAACAC GGTTCCGACC

 701 GCTGGTTCAA CGCCTTGGGC AGCCGCCGCT TCAGCCGCAA CGCyTGCGTC

 751 GTCGTCAGTT GCGGCACGGC GGTAACGGTT GACGCGCTCA CCGATGACGG

 801 ACATTATCTC GGrgGAACCA TCATGCCCGG TTTCCACCTG ATGAAAGAAT

 851 CGCTCGCCGT CCGAACCGCC AACCTCAACC GGCACGCCGG TAAGCGTTAT

 901 CCTTTCCCGA CCACAACGGG CAATGCCGTC GCCAGCGGCA TGATGGATGC

 951 GGTTTGCGGC TCGGTTATGA TGATGCACGG GCGTTTGAAA GAAAAAACCG

1001 GGGCGGGCAA GCCTGTCGAT GTCATCATTA CCGGCGGCGG CGCGGCAAAA

1051 GTTGCCGAAG CCCTGCCGCC TGCATTTTTG GCGGAAAATA CCGTGCGCGT

1101 GGCGGACAAC CTCGTCATTT ACGGGTTGTT GAACATGATT GCCGCCGAAG

1151 GCAGGGAATA TGAACAT....
```

This corresponds to the amino acid sequence <SEQ ID 1292; ORF 311>:

m311.pep (partial)

```
  1 MFSFGWVFDR PQYELGSLSP VAAVACRRAL SRLGLDVQIK WPNDLVVGRD

 51 KLGGILIETV RTGGKTVAVV GIGINFVLPX EVENAASVQS LFQTASRRGN

101 ADAAVLLXXX XXXXXEISLR SDXRPVSVXK RRDSERFLLL DGGNSRLKWA

151 WVENGTFATV GSAPYRDLSP LGAEWAEKAD GNVRIVGCAV CGEFKKAQVQ
```

-continued

```
201 EQLARKIEWL PSSAQALFGI RNHYRHPEEH GSDRWFNALG SRRFSRNACV

251 VVSCGTAVTV DALTDDGHYL GGTIMPGFHL MKESLAVRTA NLNRHAGKRY

301 PFPTTTGNAV ASGMMDAVCG SVMMMHGRLK EKTGAGKPVD VIITGGGAAK

351 VAEALPPAFL AENTVRVADN LVIYGLLNMI AAEGREYEH.
```

Computer analysis of this amino acid sequence gave the following results:

Homology with a predicted ORF from *N. gonorrhoeae*

ORF 311 shows 78.5% identity over a 455 aa overlap with a predicted ORF (ORF 311.ng) from *N. gonorrhoeae*:

m311/g311

```
                    10        20        30        40        50        60
m311.pep    MFSFGWVFDRPQYELGSLSPVAAVACRRALSRLGLDVQIKWPNDLVVGRDKLGGILIETV
            ||||||:||||||||||||||||:||||||: |||::|||||||||||||||||||||||
g311        MFSFGWAFDRPQYELGSLSPVAALACRRALGCLGLETQIKWPNDLVVGRDKLGGILIETV
                    10        20        30        40        50        60

                    70        80        90       100       110
m311.pep    RTGGKTVAVVGIGINFVLPXEVENAASVQSLFQTASRRGNADAAVLLXXX----------
            |:||||||||||||||||| |||||||||||||||||||||||||||  :
g311        RAGGKTVAVVGIGINFVLPKEVENAASVQSLFQTASRRGNADAAVLLETLLAELGAVLEQ
                    70        80        90       100       110       120

m311.pep    --------------------------------------------------------XXXX
                                                                    :
g311        YAEEGFAPFLNEYETANRDHGKAVLLLRDGETVCEGTVKGVDGRGVLHLETAEGEQTVVS
                   130       140       150       160       170       180

                120       130       140       150       160      170
m311.pep    XEISLRSDXRPVSVXKRRDSERFLLLDGGNSRLKWAWVENGTFATVGSAPYRDLSPLGAE
             ||||| | | ||| || ||||||||:|||||||||||||||||||||||||||||||||
g311        GEISLRPDNRSVSVPKRPDSERFLLLEGGNSRLKWAWVENGTFATVGSAPYRDLSPLGAE
                   190       200       210       220       230       240

                180       190       200       210       220      230
m311.pep    WAEKADGNVRIVGCAVCGEFKKAQVQEQLARKIEWLPSSAQALFGIRNHTRHPEEHGSDR
            ||||||||||||||||||| |||||:||||||||||||||||| ||||||||||||||||
g311        WAEKADGNVRIVGCAVCGESKKAQVKEQLARKIEWLPSSAQAL-GIRNHYRHPEEHGSDR
                   250       260       270       280       290

               240       250       260       270       280      290
m311.pep     WFNALGSRRFSRNACVVVSCGTAVTVDALTDDGHYLGGTIMPGFHLMKESLAVRTANLNR
             ||||||||||||||||||||||||||||||||||||||||||||||||||||||||||||
g311         WFNALGSRRFSRNACVVVSCGTAVTVDALTDDGHYLGGTIMPGFHLMKESLAVRTANLNR
          300       310       320       330       340       350

                300       310       320       330       340      350
m311.pep     HAGKRYPFPTTTGNAVASGMMDAVCGSVMMMHGRLKEKTGAGKPVDVIITGGGAAKVAEA
              ||||||||||||||||||||||||||:|||||||||||:||||||||||||||||||||
g311         PAGKRYPFPTTTGNAVASGMMDAVCGSIMMMHGRLKEKNGAGKPVDVIITGGGAAKVAEA
          360       370       380       390       400       410

                360       370       380       389
m311.pep     LPPAFLAENTVRVADNLVIYGLLNMIAAEGREYEH
             |||||||||||||||||||:||||:||||| | ||
g311         LPPAFLAENTVRVADNLVIHGLLNLIAAEGGESEHAX
          420       430       440       450
```

The following partial DNA sequence was identified in *N. meningitidis* <SEQ ID 1293>:

a311.seq

```
  1 ATGTTCAGTT TTGGCTGGGT GTTTGACCGG CCGCAGTATG AGTTGGGTTC

 51 GCTGTCGCCT GTTGCGGCAG TGGCGTGCCG GCGCGCCTTG TCGCGTTTGG

101 GTTTGAAAAC GCAAATCAAG TGGCCAAACG ATTTGGTCGT CGGACGCGAC

151 AAATTGGGCG GCATTCTGAT TGAAACGGTC AGGACGGGCG GCAAAACGGT

201 TGCCGTGGTC GGTATCGGCA TCAATTTCGT GCTGCCCAAG GAAGTGGAAA
```

-continued

```
 251 ACGCCGCTTC CGTGCAATCG CTGTTTCAGA CGGCATCGCG GCGGGGAAAT
 301 GCCGATGCCG CCGTGTTGCT GGAAACGCTG TTGGCGGAAC TTGATGCGGT
 351 GTTGTTGCAA TATGCGCGGG ACGGATTTGC GCCTTTTGTG GCGGAATATC
 401 AGGCTGCCAA CCGCGACCAC GGCAAGGCGG TATTGCTGTT GCGCGACGGC
 451 GAAACCGTGT TCGAAGGCAC GGTTAAAGGC GTGGACGGAC AAGGCGTTCT
 501 GCACTTGGAA ACGGCAGAGG GCAAACAGAC GGTCGTCAGC GGCGAAATCA
 551 GCCTGCGGTC CGACGACAGG CCGGTTTCCG TGCCGAAGCG GCGGGATTCG
 601 GAACGTTTTC TGCTGTTGGA CGGCGGCAAC AGCCGGCTCA AGTGGGCGTG
 651 GGTGGAAAAC GGCACGTTCG CAACCGTCGG TAGCGCGCCG TACCGCGATT
 701 TGTCGCCTTT GGGCGCGGAG TGGGCGGAAA AGGTGGATGG AAATGTCCGC
 751 ATCGTCGGTT GCGCCGTGTG CGGAGAATTC AAAAAGGCAC AAGTGCAGGA
 801 ACAGCTCGCC CGAAAAATCG AGTGGCTGCC GTCTTCCGCA CAGGCTTTGG
 851 GCATACGCAA CCACTACCGC CACCCCGAAG AACACGGTTC CGACCGCTGG
 901 TTCAACGCCT TGGGCAGCCG CCGCTTCAGC CGCAACGCCT GCGTCGTCGT
 951 CAGTTGCGGC ACGGCGGTAA CGGTTGACGC GCTCACCGAT GACGGACATT
1001 ATCTCGGGGG AACCATCATG CCCGGTTTCC ACCTGATGAA AGAATCGCTC
1051 GCCGTCCGAA CCGCCAACCT CAACCGGCAC GCCGGTAAGC GTTATCCTTT
1101 CCCGACCACA ACGGGCAATG CCGTCGCCAG CGGCATGATG GATGCGGTTT
1151 GCGGCTCGGT TATGATGATG CACGGGCGTT TGAAAGAAAA AACCGGGGCG
1201 GGCAAGCCTG TCGATGTCAT CATTACCGGC GGCGGCGCGG CAAAAGTTGC
1251 CGAAGCCCTG CCGCCTGCAT TTTTGGCGGA AAATACCGTG CGCGTGGCGG
1301 ACAACCTCGT CATTCACGGG CTGCTGAACC TGATTGCCGC CGAAGGCGGG
1351 GAATCGGAAC ATACTTAA
```

This corresponds to the amino acid sequence <SEQ ID 1294; ORF 311.a>:

a311.pep

```
  1 MFSFGWVFDR PQYELGSLSP VAAVACRRAL SRLGLKTQIK WPNDLVVGRD
 51 KLGGILIETV RTGGKTVAVV GIGINFVLPK EVENAASVQS LFQTASRRGN
101 ADAAVLLETL LAELDAVLLQ YARDGFAPFV AEYQAANRDH GKAVLLLRDG
151 ETVFEGTVKG VDGQGVLHLE TAEGKQTVVS GEISLRSDDR PVSVPKRRDS
201 ERFLLLDGGN SRLKWAWVEN GTFATVGSAP YRDLSPLGAE WAEKVDGNVR
251 IVGCAVCGEF KKAQVQEQLA RKIEWLPSSA QALGIRNHYR HPEEHGSDRW
301 FNALGSRRFS RNACVVVSCG TAVTVDALTD DGHYLGGTIM PGFHLMKESL
351 AVRTANLNRH AGKRYPFPTT TGNAVASGMM DAVCGSVMMM HGRLKEKTGA
401 GKPVDVIITG GGAAKVAEAL PPAFLAENTV RVADNLVIHG LLNLIAAEGG
451 ESEHT*
```

m311/a311 81.3% identity in 455 aa overlap

```
                10        20        30        40        50        60
m311.pep  MFSFGWVFDRPQYELGSLSPVAAVACRRALSRLGLDVQIKWPNDLVVGRDKLGGILIETV
          |||||||||||||||||||||||||||||||||||| :||||||||||||||||||||||
a311      MFSFGWVFDRPQYELGSLSPVAALACRRALGCLGLKTQIKWPNDLVVGRDKLGGILIETV
                10        20        30        40        50        60

                70        80        90       100       110
m311.pep  RTGGKTVAVVGIGINFVLPXEVENAASVQSLFQTASRRGNADAAVLLXXXXXXXX-----
          ||||||||||||||||||| ||||||||||||||||||||||||||| :
a311      RTGGKTVAVVGIGINFVLPKEVENAASVQSLFQTASRRGNADAAVLLETLLAELDAVLLQ
                70        80        90       100       110       120

m311.pep  ------------------------------------------------------------

a311      YARDGFAPFVAEYQAANRDHGKAVLLLRDGETVCEGTVKGVDGQGVLHLETAEGEQTVVS
                   130       140       150       160       170       180

             120       130       140       150       160       170
m311.pep  -EISLRSDXRPVSVXKRRDSERFLLLDGGNSRLKWAWVENGTFATVGSAPYRDLSPLGAE
           ||||||| ||||| ||||||||||||||||||||||||||||||||||||||||||||||
a311      GEISLRSDDRPVSVPKRPDSERFLLLDGGNSRLKWAWVENGTFATVGSAPYRDLSPLGAE
                   190       200       210       220       230       240

             180       190       200       210       220       230
m311.pep  WAEKADGNVRIVGCAVCGEFKKAQVQEQLARKIEWLPSSAQALFGIRNHYRHPEEHGSDR
          ||||:||||||||||||||||||||||||||||||||||||||| |||||||||||||||
a311      WAEKVDGNVRIVGCAVCGEFKKAQVKEQLARKIEWLPSSAQAL-GIRNHYRHPEEHGSDR
                   250       260       270       280       290

             240       250       260       270       280       290
m311.pep  WFNALGSRRFSRNACVVVSCGTAVTVDALTDDGHYLGGTIMPGFHLMKESLAVRTANLNR
          ||||||||||||||||||||||||||||||||||||||||||||||||||||||||||||
a311      WFNALGSRRFSRNACVVVSCGTAVTVDALTDDGHYLGGTIMPGFHLMKESLAVRTANLNR
        300       310       320       330       340       350

             300       310       320       330       340       350
m311.pep  HAGKRYPFPTTTGNAVASGMMDAVCGSVMMMHGRLKEKTGAGKPVDVIITGGGAAKVAEA
          ||||||||||||||||||||||||||||||||||||||||||||||||||||||||||||
a311      HAGKRYPFPTTTGNAVASGMMDAVCGSVMMMHGRLKEKTGAGKPVDVIITGGGAAKVAEA
        360       370       380       390       400       410

             360       370       380       389
m311.pep  LPPAFLAENTVRVADNLVIYGLLNMIAAEGREYEH
          ||||||||||||||||||:||||:||||| | ||
a311      LPPAFLAENTVRVADNLVIHGLLNLIAAEGGESEHTX
        420       430       440       450
```

The following partial DNA sequence was identified in *N. gonorrhoeae* <SEQ ID 1295>:

g311-1.seq

```
  1 ATGACGGTTT TGAAGCCTTC GCATTGGCGG GTGTTGGCGG AGCTTGCCGA
 51 CGGTTTGCCG CAACACGTAT CGCAATTGGC GCGTGAGGCG GACATGAAGC
101 CGCAGCAGCT CAACGGTTTT TGGCAGCAGA TGCCGGCGCA TATACGCGGG
151 CTGTTGCGCC AACACGACGG CTATTGGCGG CTGGTGCGCC CCTTGGCGGT
201 TTTCGATGCC GAAGGTTTGC GCGATCTGGG GGAAAGGTCG GGTTTTCAGA
251 CGGCATTGAA GCACGAGTGC GCGTCCAGCA ACGACGAGAT ACTGGAATTG
301 GCGCGGATTG CGCCGGACAA GGCGCACAAA ACCATATGCG TGACCCACCT
351 GCAAAGTAAG GGCAGGGGGC GGCAGGGGCG GAAGTGGTCG CACCGTTTGG
401 GCGAGTGCCT GATGTTCAGT TTCGGCTGGG CGTTTGACCG GCCGCAGTAT
451 GAGTTGGGTT CGCTGTCGCC TGTTGCGGCA CTTGCGTGCC GGCGCGCTTT
501 GGGGTGTTTG GGTTTGGAAA CGCAAATCAA GTGGCCAAAC GATTTGGTCG
551 TCGGACGCGA CAAATTGGGC GGCATTCTGA TTGAAACAGT CAGGGCGGGC
601 GGTAAAACGG TTGCCGTGGT CGGTATCGGC ATCAATTTCG TGCTGCCCAA
651 GGAAGTGGAA AACGCCGCTT CCGTGCAGTC GCTGTTTCAG ACGGCATCGC
701 GGCGGGGCAA TGCCGATGCC GCCGTATTGC TGGAAACATT GCTTGCGGAA
751 CTGGGCGCGG TGTTGGAACA ATATGCGGAA GAAGGGTTCG CGCCATTTTT
```

-continued

```
801 AAATGAGTAT GAAACGGCCA ACCGCGACCA CGGCAAGGCG GTATTGCTGT
851 TGCGCGACGG CGAAACCGTG TGCGAAGGCA CGGTTAAAGG CGTGGACGGA
901 CGAGGCGTTC TGCACTTGGA AACGGCAGaa ggCGAACAGa cggtcGtcag
951 cggcGaaaTC AGccTGCGGc CCGacaacag gtcggtttcc GTgccgaagc
1001 gGccggatTC GgaacgtttTT tTGCTgttgg aaggcgggaa cagccggctc
1051 aAGTGGgcgt gGGTggAAAA Cggcacgttc gcaaccgtgg gcAGCGCgCC
1101 gtaCCGCGAT TTGTCGCCTT TGGGCGCGGA GTGGGCGGAA AAGGCGGATG
1151 GAAATGTCCG CATCGTCGGT TGCGCCGTGT GCGGAGAATC CAAAAAGGCA
1201 CAAGTGAAGG AACAGCTCGC CCGAAAAATC GAGTGGCTGC CGTCTTCCGC
1251 ACAGGCTTTG GGCATACGCA ACCACTACCG CCACCCCGAA GAACACGGTT
1301 CCGACCGTTG GTTCAACGCC TTGGGCAGCC GCCGCTTCAG CCGCAACGCC
1351 TGCGTCGTCG TCAGTTGCGG CACGGCGGTA ACGGTTGACG CGCTCACCGA
1401 TGACGGACAT TATCTCGGCG GAACCATCAT GCCCGGCTTC CACCTGATGA
1451 AAGAATCGCT CGCCGTCCGA ACCGCCAACC TCAACCGCCC CGCCGGCAAA
1501 CGTTACCCTT TCCCGACCAC AACGGGCAAC GCCGTCGCAA GCGGCATGAT
1551 GGACGCGGTT TGCGGCTCGA TAATGATGAT GCACGGCCGT TTGAAAGAAA
1601 AAAACGGCGC GGGCAAGCCT GTCGATGTCA TCATTACCGG CGGCGGCGCG
1651 GCGAAAGTCG CCGAAGCCCT GCCGCCTGCA TTTTTGGCGG AAAATACCGT
1701 GCGCGTGGCG GACAACCTCG TCATCCACGG GCTGCTGAAC CTGATTGCCG
1751 CCGAAGGCGG GGAATCGGAA CACGCTTAA
```

This corresponds to the amino acid sequence <SEQ ID 1296; ORF 311-1.ng>:

g311-1.pep

```
  1 MTVLKPSHWR VLAELADGLP QHVSQLAREA DMKPQQLNGF WQQMPAHIRG
 51 LLRQHDGYWR LVRPLAVFDA EGLRDLGERS GFQTALKHEC ASSNDEILEL
101 ARIAPDKAHK TICVTHLQSK GRGRQGRKWS HRLGECLMFS FGWAFDRPQY
151 ELGSLSPVAA LACRRALGCL GLETQIKWPN DLVVGRDKLG GILIETVRAG
201 GKTVAVVGIG INFVLPKEVE NAASVQSLFQ TASRRGNADA AVLLETLLAE
251 LGAVLEQYAE EGFAPFLNEY ETANRDHGKA VLLLRDGETV CEGTVKGVDG
301 RGVLHLETAE GEQTVVSGEI SLRPDNRSVS VPKRPDSERF LLLEGGNSRL
351 KWAWVENGTF ATVGSAPYRD LSPLGAEWAE KADGNVRIVG CAVCGESKKA
401 QVKEQLARKI EWLPSSAQAL GIRNHYRHPE EHGSDRWFNA LGSRRFSRNA
451 CVVVSCGTAV TVDALTDDGH YLGGTIMPGF HLMKESLAVR TANLNRPAGK
501 RYPFPTTTGN AVASGMMDAV CGSIMMMHGR LKEKNGAGKP VDVIITGGGA
551 AKVAEALPPA FLAENTVRVA DNLVIHGLLN LIAAEGGESE HA*
```

The following partial DNA sequence was identified in *N. meningitidis* <SEQ ID 1297>:

m311-1.seq

```
   1 ATGACGGTTT TGAAGCTTTC GCACTGGCGG GTGTTGGCGG AGCTTGCCGA
  51 CGGTTTGCCG CAACACGTCT CGCAACTGGC GCGTATGGCG GATATGAAGC
 101 CGCAGCAGCT CAACGGTTTT TGGCAGCAGA TGCCGGCGCA CATACGCGGG
 151 CTGTTGCGCC AACACGACGG CTATTGGCGG CTGGTGCGCC CATTGGCGGT
 201 TTTCGATGCC GAAGGTTTGC GCGAGCTGGG GGAAAGGTCG GGTTTTCAGA
 251 CGGCATTGAA GCACGAGTGC GCGTCCAGCA ACGACGAGAT ACTGGAATTG
 301 GCGCGGATTG CGCCGGACAA GGCGCACAAA ACCATATGCG TGACCCACCT
 351 GCAAAGTAAG GGCAGGGGGC GGCAGGGGCG GAAGTGGTCG CACCGTTTGG
 401 GCGAGTGTCT GATGTTCAGT TTTGGCTGGG TGTTTGACCG GCCGCAGTAT
 451 GAGTTGGGTT CGCTGTCGCC TGTTGCGGCA GTGGCGTGTC GGCGCGCCTT
 501 GTCGCGTTTA GGTTTGGATG TGCAGATTAA GTGGCCCAAT GATTTGGTTG
 551 TCGGACGCGA CAAATTGGGC GGCATTCTGA TTGAAACGGT CAGGACGGGC
 601 GGCAAAACGG TTGCCGTGGT CGGTATCGGC ATCAATTTTG TCCTGCCCAA
 651 GGAAGTAGAA AATGCCGCTT CCGTGCAATC GCTGTTTCAG ACGGCATCGC
 701 GGCGGGGCAA TGCCGATGCC GCCGTGCTGC TGGAAACGCT GTTGGTGGAA
 751 CTGGACGCGG TGTTGTTGCA ATATGCGCGG GACGGATTTG CGCCTTTTGT
 801 GGCGGAATAT CAGGCTGCCA ACCGCGACCA CGGCAAGGCG GTATTGCTGT
 851 TGCGCGACGG CGAAACCGTG TTCGAAGGCA CGGTTAAAGG CGTGGACGGA
 901 CAAGGCGTTT TGCACTTGGA AACGGCAGAG GGCAAACAGA CGGTCGTCAG
 951 CGGCGAAATC AGCCTGCGGT CCGACGACAG GCCGGTTTCC GTGCCGAAGC
1001 GGCGGGATTC GGAACGTTTT CTGCTGTTGG ACGGCGGCAA CAGCCGGCTC
1051 AAGTGGGCGT GGGTGGAAAA CGGCACGTTC GCAACCGTCG GTAGCGCGCC
1101 GTACCGCGAT TTGTCGCCTT TGGGCGCGGA GTGGGCGGAA AAGGCGGATG
1151 GAAATGTCCG CATCGTCGGT TGCGCTGTGT GCGGAGAATT CAAAAAGGCA
1201 CAAGTGCAGG AACAGCTCGC CCGAAAAATC GAGTGGCTGC CGTCTTCCGC
1251 ACAGGCTTTG GGCATACGCA ACCACTACCG CCACCCCGAA GAACACGGTT
1301 CCGACCGCTG GTTCAACGCC TTGGGCAGCC GCCGCTTCAG CCGCAACGCC
1351 TGCGTCGTCG TCAGTTGCGG CACGGCGGTA ACGGTTGACG CGCTCACCGA
1401 TGACGGACAT TATCTCGGGG GAACCATCAT GCCCGGTTTC CACCTGATGA
1451 AAGAATCGCT CGCCGTCCGA ACCGCCAACC TCAACCGGCA CGCCGGTAAG
1501 CGTTATCCTT TCCCGACCAC AACGGGCAAT GCCGTCGCCA GCGGCATGAT
1551 GGATGCGGTT TGCGGCTCGG TTATGATGAT GCACGGGCGT TTGAAAGAAA
1601 AAACCGGGGC GGGCAAGCCT GTCGATGTCA TCATTACCGG CGGCGGCGCG
1651 GCAAAAGTTG CCGAAGCCCT GCCGCCTGCA TTTTTGGCGG AAAATACCGT
1701 GCGCGTGGCG GACAACCTCG TCATTTACGG GTTGTTGAAC ATGATTGCCG
1751 CCGAAGGCAG GGAATATGAA CATATTTAA
```

This corresponds to the amino acid sequence <SEQ ID 1298; ORF 311-1>:

m311-1.pep

```
  1 MTVLKLSHWR VLAELADGLP QHVSQLARMA DMKPQQLNGF WQQMPAHIRG

 51 LLRQHDGYWR LVRPLAVFDA EGLRELGERS GFQTALKHEC ASSNDEILEL

101 ARIAPDKAHK TICVTHLQSK GRGRQGRKWS HRLGECLMFS FGWVFDRPQY

151 ELGSLSPVAA VACRRALSRL GLDVQIKWPN DLVVGRDKLG GILIETVRTG

201 GKTVAVVGIG INFVLPKEVE NAASVQSLFQ TASRRGNADA AVLLETLLVE

251 LDAVLLQYAR DGFAPFVAEY QAANRDHGKA VLLLRDGETV FEGTVKGVDG

301 QGVLHLETAE GKQTVVSGEI SLRSDDRPVS VPKRRDSERF LLLDGGNSRL

351 KWAWVENGTF ATVGSAPYRD LSPLGAEWAE KADGNVRIVG CAVCGEFKKA

401 QVQEQLARKI EWLPSSAQAL GIRNHYRHPE EHGSDRWFNA LGSRRFSRNA

451 CVVVSCGTAV TVDALTDDGH YLGGTIMPGF HLMKESLAVR TANLNRHAGK

501 RYPFPTTTGN AVASGMMDAV CGSVMMMHGR LKEKTGAGKP VDVIITGGGA

551 AKVAEALPPA FLAENTVRVA DNLVIYGLLN MIAAEGREYE HI*
```

m311-1/g311-1 93.9% identity in 591 aa overlap

```
                      10        20        30        40        50        60
m311-1.pep    MTVLKLSHWRVLAELADGLPQHVSQLARMADMKPQQLNGFWQQMPAHIRGLLRQHDGYWR
              ||||| ||||||||||||||||||||||| ||||||||||||||||||||||||||||||
g311-1        MTVLKPSHWRVLAELADGLPQHVSQLAREADMKPQQLNGFWQQMPAHIRGLLRQHDGYWR
                      10        20        30        40        50        60

                      70        80        90       100       110       120
m311-1.pep    LVRPLAVFDAEGLRELGERSGFQTALKHECASSNDEILELARIAPDKAHKTICVTHLQSK
              |||||||||||||:||||||||||||||||||||||||||||||||||||||||||||||
g311-1        LVRPLAVFDAEGLRDLGERSGFQTALKHECASSNDEILELARIAPDKAHKTICVTHLQSK
                      70        80        90       100       110       120

                     130       140       150       160       170       180
m311-1.pep    GRGRQGRKWSHRLGECLMFSFGWVFDRPQYELGSLSPVAAVACRRALSRLGLDVQIKWPN
              |||||||||||||||||||||||:||||||||||||||||:||||||: |||::||||||
g311-1        GRGRQGRKWSHRLGECLMFSFGWAFDRPQYELGSLSPVAALACRRALGCLGLETQIKWPN
                     130       140       150       160       170       180

                     190       200       210       220       230       240
m311-1.pep    DLVVGRDKLGGILIETVRTGGKTVAVVGIGINFVLPKEVENAASVQSLFQTASRRGNADA
              ||||||||||||||||||:|||||||||||||||||||||||||||||||||||||||||
g311-1        DLVVGRDKLGGILIETVRAGGKTVAVVGIGINFVLPKEVENAASVQSLFQTASRRGNADA
                     190       200       210       220       230       240

                     250       260       270       280       290       300
m311-1.pep    AVLLETLLVELDAVLLQYARDGFAPFVAEYQAANRDHGKAVLLLRDGETVFEGTVKGVDG
              ||||||||:|| ||| |||::|||||: ||::|||||||||||||||||| |||||||||
g311-1        AVLLETLLAELGAVLEQYAEEGFAPFLNEYETANRDHGKAVLLLRDGETVCEGTVKGVDG
                     250       260       270       280       290       300

                     310       320       330       340       350       360
m311-1.pep    QGVLHLETAEGKQTVVSGEISLRSDDRPVSVPKRRDSERFLLLDGGNSRLKWAWVENGTF
              :||||||||||:||||||||||| |:| |||||| ||||||||:||||||||||||||||
g311-1        RGVLHLETAEGEQTVVSGEISLRPDNRSVSVPKRPDSERFLLLEGGNSRLKWAWVENGTF
                     310       320       330       340       350       360

                     370       380       390       400       410       420
m311-1.pep    ATVGSAPYRDLSPLGAEWAEKADGNVRIVGCAVCGEFKKAQVQEQLARKIEWLPSSAQAL
              |||||||||||||||||||||||||||||||||||| |||||:|||||||||||||||||
g311-1        ATVGSAPYRDLSPLGAEWAEKADGNVRIVGCAVCGESKKAQVKEQLARKIEWLPSSAQAL
                     370       380       390       400       410       420

                     430       440       450       460       470       480
m311-1.pep    GIRNHYRHPEEHGSDRWFNALGSRRFSRNACVVVSCGTAVTVDALTDDGHYLGGTIMPGF
              ||||||||||||||||||||||||||||||||||||||||||||||||||||||||||||
g311-1        GIRNHYRHPEEHGSDRWFNALGSRRFSRNACVVVSCGTAVTVDALTDDGHYLGGTIMPGF
                     430       440       450       460       470       480

                     490       500       510       520       530       540
m311-1.pep    HLMKESLAVRTANLNRHAGKRYPFPTTTGNAVASGMMDAVCGSVMMMHGRLKEKTGAGKP
              |||||||||||||||| ||||||||||||||||||||||||||:||||||||||:|||||
g311-1        HLMKESLAVRTANLNRPAGKRYPFPTTTGNAVASGMMDAVCGSIMMMHGRLKEKNGAGKP
                     490       500       510       520       530       540

                     550       560       570       580       590
m311-1.pep    VDVIITGGGAAKVAELPPAFLAENTVRVADNLVIYGLLNMIAAEGREYEHIX
              ||||||||||||||||||||||||||||||||||:||||:||||| | ||
g311-1        VDVIITGGGAAKVAELPPAFLAENTVRVADNLVIHGLLNLIAAEGGESEHAX
                     550       560       570       580       590
```

The following partial DNA sequence was identified in *N. meningitidis* <SEQ ID 1299>:

a311-1.seq

```
   1 ATGACGGTTT TGAAGCCTTC GCACTGGCGG GTGTTGGCGG AGCTTGCCGA
  51 CGGTTTGCCG CAACACGTCT CGCAACTGGC GCGTATGGCG GATATGAAGC
 101 CGCAGCAGCT CAACGGTTTT TGGCAGCAGA TGCCGGCGCA CATACGCGGG
 151 CTGTTGCGCC AACACGACGG CTATTGGCGG CTGGTGCGCC CATTGGCGGT
 201 TTTCGATGCC GAAGGTTTGC GCGAGCTGGG GGAAAGGTCG GGTTTTCAGA
 251 CGGCATTGAA GCACGAGTGC GCGTCCAGCA ACGACGAGAT ACTGGAATTG
 301 GCGCGGATTG CGCCGGACAA GGCGCACAAA ACCATATGTG TGACCCACCT
 351 GCAAAGTAAG GGCAGGGGGC GGCAGGGGCG GAAGTGGTCG CACCGTTTGG
 401 GCGAGTGTCT GATGTTCAGT TTTGGCTGGG TGTTTGACCG GCCGCAGTAT
 451 GAGTTGGGTT CGCTGTCGCC TGTTGCGGCA GTGGCGTGCC GGCGCGCCTT
 501 GTCGCGTTTG GGTTTGAAAA CGCAAATCAA GTGGCCAAAC GATTTGGTCG
 551 TCGGACGCGA CAAATTGGGC GGCATTCTGA TTGAAACGGT CAGGACGGGC
 601 GGCAAAACGG TTGCCGTGGT CGGTATCGGC ATCAATTTCG TGCTGCCCAA
 651 GGAAGTGGAA AACGCCGCTT CCGTGCAATC GCTGTTTCAG ACGGCATCGC
 701 GGCGGGGAAA TGCCGATGCC GCCGTGTTGC TGGAAACGCT GTTGGCGGAA
 751 CTTGATGCGG TGTTGTTGCA ATATGCGCGG GACGGATTTG CGCCTTTTGT
 801 GGCGGAATAT CAGGCTGCCA ACCGCGACCA CGGCAAGGCG GTATTGCTGT
 851 TGCGCGACGG CGAAACCGTG TTCGAAGGCA CGGTTAAAGG CGTGGACGGA
 901 CAAGGCGTTC TGCACTTGGA AACGGCAGAG GGCAAACAGA CGGTCGTCAG
 951 CGGCGAAATC AGCCTGCGGT CCGACGACAG GCCGGTTTCC GTGCCGAAGC
1001 GGCGGGATTC GGAACGTTTT CTGCTGTTGG ACGGCGGCAA CAGCCGGCTC
1051 AAGTGGGCGT GGGTGGAAAA CGGCACGTTC GCAACCGTCG GTAGCGCGCC
1101 GTACCGCGAT TTGTCGCCTT TGGGCGCGGA GTGGGCGGAA AAGGTGGATG
1151 GAAATGTCCG CATCGTCGGT TGCGCCGTGT GCGGAGAATT CAAAAAGGCA
1201 CAAGTGCAGG AACAGCTCGC CCGAAAAATC GAGTGGCTGC CGTCTTCCGC
1251 ACAGGCTTTG GGCATACGCA ACCACTACCG CCACCCCGAA GAACACGGTT
1301 CCGACCGCTG GTTCAACGCC TTGGGCAGCC GCCGCTTCAG CCGCAACGCC
1351 TGCGTCGTCG TCAGTTGCGG CACGGCGGTA ACGGTTGACG CGCTCACCGA
1401 TGACGGACAT TATCTCGGGG GAACCATCAT GCCCGGTTTC CACCTGATGA
1451 AAGAATCGCT CGCCGTCCGA ACCGCCAACC TCAACCGGCA CGCCGGTAAG
1501 CGTTATCCTT TCCCGACCAC AACGGGCAAT GCCGTCGCCA GCGGCATGAT
1551 GGATGCGGTT TGCGGCTCGG TTATGATGAT GCACGGGCGT TTGAAAGAAA
1601 AAACCGGGGC GGGCAAGCCT GTCGATGTCA TCATTACCGG CGGCGGCGCG
1651 GCAAAAGTTG CCGAAGCCCT GCCGCCTGCA TTTTTGGCGG AAAATACCGT
1701 GCGCGTGGCG GACAACCTCG TCATTCACGG GCTGCTGAAC CTGATTGCCG
1751 CCGAAGGCGG GGAATCGGAA CATACTTAA
```

This corresponds to the amino acid sequence <SEQ ID 1300; ORF 311-1.a>:

a311-1.pep

```
  1 MTVLKPSHWR VLAELADGLP QHVSQLARMA DMKPQQLNGF WQQMPAHIRG
 51 LLRQHDGYWR LVRPLAVFDA EGLRELGERS GFQTALKHEC ASSNDEILEL
101 ARIAPDKAHK TICVTHLQSK GRGRQGRKWS HRLGECLMFS FGWVFDRPQY
151 ELGSLSPVAA VACRRALSRL GLKTQIKWPN DLVVGRDKLG GILIETVRTG
201 GKTVAVVGIG INFVLPKEVE NAASVQSLFQ TASRRGNADA AVLLETLLAE
251 LDAVLLQYAR DGFAPFVAEY QAANRDHGKA VLLLRDGETV FEGTVKGVDG
301 QGVLHLETAE GKQTVVSGEI SLRSDDRPVS VPKRRDSERF LLLDGGNSRL
351 KWAWVENGTF ATVGSAPYRD LSPLGAEWAE KVDGNVRIVG CAVCGEFKKA
401 QVQEQLARKI EWLPSSAQAL GIRNHYRHPE EHGSDRWFNA LGSRRFSRNA
451 CVVVSCGTAV TVDALTDDGH YLGGTIMPGF HLMKESLAVR TANLNRHAGK
501 RYPFPTTTGN AVASGMMDAV CGSVMMMHGR LKEKTGAGKP VDVIITGGGA
551 AKVAEALPPA FLAENTVRVA DNLVIHGLLN LIAAEGGESE HT*
```

a311-1/m311-1 98.5% identity in 591 aa overlap

```
                        10        20        30        40        50        60
a311-1.pep      MTVLKPSHWRVLAELADGLPQHVSQLARMADMKPQQLNGFWQQMPAHIRGLLRQHDGYWR
                ||||| |||||||||||||||||||||| |||||||||||||||||||||||||||||||
m311-1          MTVLKLSHWRVLAELADGLPQHVSQLAREADMKPQQLNGFWQQMPAHIRGLLRQHDGYWR
                        10        20        30        40        50        60

                        70        80        90       100       110       120
a311-1.pep      LVRPLAVFDAEGLRELGERSGFQTALKHECASSNDEILELARIAPDKAHKTICVTHLQSK
                ||||||||||||||||||||||||||||||||||||||||||||||||||||||||||||
m311-1          LVRPLAVFDAEGLRELGERSGFQTALKHECASSNDEILELARIAPDKAHKTICVTHLQSK
                        70        80        90       100       110       120

                       130       140       150       160       170       180
a311-1.pep      GRGRQGRKWSHRLGECLMFSFGWVFDRPQYELGSLSPVAAVACRRALSRLGLKTQIKWPN
                |||||||||||||||||||||||||||||||||||||||||||||||||||| :||||||
m311-1          GRGRQGRKWSHRLGECLMFSFGWVFDRPQYELGSLSPVAAVACRRALSRLGLDVQIKWPN
                       130       140       150       160       170       180

                       190       200       210       220       230       240
a311-1.pep      DLVVGRDKLGGILIETVRTGGKTVAVVGIGINFVLPKEVENAASVQSLFQTASRRGNADA
                ||||||||||||||||||||||||||||||||||||||||||||||||||||||||||||
m311-1          DLVVGRDKLGGILIETVRTGGKTVAVVGIGINFVLPKEVENAASVQSLFQTASRRGNADA
                       190       200       210       220       230       240

                       250       260       270       280       290       300
a311-1.pep      AVLLETLLAELDAVLLQYARDGFAPFVAEYQAANRDHGKAVLLLRDGETVFEGTVKGVDG
                ||||||||:|||||||||||||||||||||||||||||||||||||||||||||||||||
m311-1          AVLLETLLVELDAVLLQYARDGFAPFVAEYQAANRDHGKAVLLLRDGETVFEGTVKGVDG
                       250       260       270       280       290       300

                       310       320       330       340       350       360
a311-1.pep      QGVLHLETAEGKQTVVSGEISLRSDDRPVSVPKRRDSERFLLLDGGNSRLKWAWVENGTF
                ||||||||||||||||||||||||||||||||||||||||||||||||||||||||||||
m311-1          QGVLHLETAEGKQTVVSGEISLRSDDRPVSVPKRRDSERFLLLDGGNSRLKWAWVENGTF
                       310       320       330       340       350       360

                       370       380       390       400       410       420
a311-1.pep      ATVGSAPYRDLSPLGAEWAEKVDGNVRIVGCAVCGEFKKAQVQEQLARKIEWLPSSAQAL
                |||||||||||||||||||||:||||||||||||||||||||||||||||||||||||||
m311-1          ATVGSAPYRDLSPLGAEWAEKADGNVRIVGCAVCGEFKKAQVQEQLARKIEWLPSSAQAL
                       370       380       390       400       410       420

                       430       440       450       460       470       480
a311-1.pep      GIRNHYRHPEEHGSDRWFNALGSRRFSRNACVVVSCGTAVTVDALTDDGHYLGGTIMPGF
                ||||||||||||||||||||||||||||||||||||||||||||||||||||||||||||
m311-1          GIRNHYRHPEEHGSDRWFNALGSRRFSRNACVVVSCGTAVTVDALTDDGHYLGGTIMPGF
                       430       440       450       460       470       480

                       490       500       510       520       530       540
a311-1.pep      HLMKESLAVRTANLNRHAGKRYPFPTTTGNAVASGMMDAVCGSVMMMHGRLKEKTGAGKP
                ||||||||||||||||||||||||||||||||||||||||||||||||||||||||||||
m311-1          HLMKESLAVRTANLNRHAGKRYPFPTTTGNAVASGMMDAVCGSVMMMHGRLKEKTGAGKP
                       490       500       510       520       530       540

                       550       560       570       580       590
a311-1.pep      VDVIITGGGAAKVAELPPAFLAENTVRVADNLVIHGLLNLIAAEGGESEHTX
                ||||||||||||||||||||||||||||||||||:||||:||||| | ||
m311-1          VDVIITGGGAAKVAELPPAFLAENTVRVADNLVIYGLLNMIAAEGREYEHIX
                       550       560       570       580       590
```

The following partial DNA sequence was identified in *N. gonorrhoeae* <SEQ ID 1301>:

g312.seq

```
   1 atgaGtatCc aatCcGgcga AATTTtagaa accgtCAAAA TGGTTGCCGA
  51 ccggaATttt gAtgtccgCA CCATTAccat cggcaTTgaT ttgcacgact
 101 gcatcagcac cgacatcgac gtgttaAACC AAAACATtta caaCAaaaTc
 151 accacggtcg gcaaagactT GGTGGCAacg Gcgaaacacc tTTccgcCAA
 201 ATACGGCGTG CCGATTGTGA ATCAGCGCAT TTCCGTTACG CCGAttgccc
 251 AaatcGCGGC GGcgaccaAa gccgaCAGTT AtgtcAGCgt ggcgcAGact
 301 tTGGACAAGG CAGCCAAAGC CATCGGCGTG TCCTTTATCG GcggCTTTTC
 351 CGCGCTGGTG CAAAAAGGTA TGTCGCCTTC GGATGAGGTG TTGATCCGTT
 401 CCGTTCCCGA AGCGATGAAA ACTACCGATA TCGTGTGCAG CTCCATCAAT
 451 ATCGGCAGCA CGCGTGCCGG TATCAATATG GATGCGGTCA AGCTGGCAGG
 501 CGAAACCATC AAACGCACGG CTGAAATCAC ACCCGAAGGT TTCGGCTGCG
 551 CCAAAATCGT CGTGTTCTGC AACGCGGTGG AAGACAATCC GTTTATGGCG
 601 GGTGCGTTCC ACGGCTCGGG CGAAGCGGAT GCTGTGATTA ATGTCGGCGT
 651 ATCCGGTCCA GGCGTGGTCA AAGCCGCGCT GGAAAATTCG GACGCGGTCA
 701 GCCTGACCGA GGTCGCCGAA GTCGTGAAGA AAACCGCTTT CAAAATCACC
 751 CGCGTGGGCG AACTCATCGG TCGCGAAGCC TCAAAAATGC TGAATATCCC
 801 GTTCGGCATT CTCGATTTGT CGCTGGCACC GACCCCCGCC GTCGGCGACT
 851 CGGTGGCGCG CATTCTTGAA GAAATGGGCT TGAGCGTCTG CGGTACGCAC
 901 GGCACAACAG CAGCTTTGGC ATTGCTGAAC GATGCCGTGA AAAAGGGCGG
 951 CATGATGGCT TCCAGCGCGG TCGGCGGTTT GAGCGGCGCG TTTATCCCCG
1001 TTTCCGAAGA CGAAGGTATG ATTGCCGCCG CCGAGGCAGG CGTGTTGACG
1051 CTGGACAAAC TCGAAGCCAT GACCGCCGTC TGCTCCGTTG GTTTGGACAT
1101 GATTGCCGTT CCCGGCGACA CGCCCGCGCA CACCATTTCC GGCATCATCG
1151 CCGACGAAGC CGCCATCGGC ATGATCAACA GCAAAACCAC CGCCGTGCGC
1201 ATTATTCCGG TAACGGGCAA AACCGTCGGC GACAGCGTCG AGTTCGGCGG
1251 TCTGTTGGGC TACGCGCCTG TAATGCCGGC AAAAGAAGGT TCGTGCGAAG
1301 TGTTCGTCAA CCGGGGCGGC AGGATTCCCG CACCGGTTCA ATCGATGAAA
1351 AACTGA
```

This corresponds to the amino acid sequence <SEQ ID 1302; ORF 312.ng>:

g312.pep

```
  1 MSIQSGEILE TVKMVADRNF DVRTITIGID LHDCISTDID VLNQNIYNKI
 51 TTVGKDLVAT AKHLSAKYGV PIVNQRISVT PIAQIAAATK ADSYVSVAQT
101 LDKAAKAIGV SFIGGFSALV QKGMSPSDEV LIRSVPEAMK TTDIVCSSIN
151 IGSTRAGINM DAVKLAGETI KRTAEITPEG FGCAKIVVFC NAVEDNPFMA
201 GAFHGSGEAD AVINVGVSGP GVVKAALENS DAVSLTEVAE VVKKTAFKIT
```

-continued

```
251 RVGELIGREA SKMLNIPFGI LDLSLAPTPA VGDSVARILE EMGLSVCGTH

301 GTTAALALLN DAVKKGGMMA SSAVGGLSGA FIPVSEDEGM IAAAEAGVLT

351 LDKLEAMTAV CSVGLDMIAV PGDTPAHTIS GIIADEAAIG MINSKTTAVR

401 IIPVTGKTVG DSVEFGGLLG YAPVMPAKEG SCEVFVNRGG RIPAPVQSMK

451 N*
```

The following partial DNA sequence was identified in *N. meningitidis* <SEQ ID 1303>:

m312.seq

```
   1 ATGAGTATCC AATCCGGCGA AATTTTAGAA ACCGTCAAAA TGGTTGCCGA

  51 CCAGAATTTT GATGTCCGCA CCATTACCAT CGGCATTGAT TTGCACGACT

 101 GCATCAGCAG CGATATCAAT GTGTTGAACC AAAATATTTA CAATAAAATT

 151 ACCACAGTCG GCAAAGACTT GGTCACTACG GCAAAATATC TGTCTGCCAA

 201 ATACGGCGTA CCGATTGTGA ATCAGCGCAT TTCCGTTACG CCGATTGCCC

 251 AAATCGCGGC GGCCACCCAT GCTGATTCTT ACGTCAGCGT GGCGCAAACT

 301 TTGGATAAAG CTGCCAAAGC CATCGGTGTG TCTTTTATCG GCGGTTTTTC

 351 CGCGTTGGTG CAAAAAGGGA TGTCGCcTTC GGATGAGGTG TTAATCCGCT

 401 CCATTCCCGA AGCGATGAAG ACTACCGATA TTGTGTGCwG CTCCATCAAT

 451 ATCGGCAGTA CGCGTGCCGG TATCAATATG GATGCGGTCA AGCTGGCGGG

 501 CGAAACcGTc AAACGCACGG CGGAAATCAC GCCCGAAGGT TTCGGCTGCG

 551 CTAAAATTGT CGTGTTCTGC AACGCGGTGG AAGACAACCC GTTTwTGGCG

 601 GGCGCGTTTC ATGGTTCGGG CGATGCCGTT ATCAATGTCG GCGTATCCGG

 651 CCCAGGTGTC GTAAAAGCCG CGTTGGAAAA TTCAGATGCA ACGACATTGA

 701 CCGAAGTTGC GGAAGTAGTG AAGAAAACTG CTTTCAAAAT TACCCGCGTG

 751 GGCGAACTCA TCGGCCGCGA AGCcTCAAAA ATGCTGAATA TCCCGTTTGG

 801 TATTCTCGAC TTGTCGCCGA CCCCGCCCGT CGGCGACTCA GTGGCACGCA

 851 TTCTTGAAGA AATGGGCTTG AGCGTCTGCG GTACGCACGG CACAACAGCA

 901 GCTTTGGCAT TGCTGAACGA TGCCGTGAAA AAAGGCGGCA TGATGGCTTC

 951 CAGCGCGGTC GGGGGTTTGA GTGGCGCGTT TATCCCCGTT TCCGAAGACG

1001 AAGGTATGAT yGmCgCcGCC GAAGCAGGCG TGCTGACGCT GGACAAACTC

1051 GAAGCCATGA CCGCCGTTTG TTCGGTCGGC TTGGATATGA TTGCCGTTCC

1101 CGGCGACACG CCCGCGCACA CCATTTCCGG CATCATTGCC GACGAAGCCG

1151 CCATCGGCAt GATCAACAGC AAAACCACTG CCGTGCGCAT TATTCCGGTA

1201 ACCGGTAAAA CCGTCGGCGA CAcGGTCGAG TTCGGCGGCT TGTTGGgCTA

1251 CGCGCCTGTG ATGCCGGTCA AAGAAGGTTC GTGCGAAGTA TTCGTCAACC

1301 GAGGCGGCAG AATTCCGGCT CCGGTTCAAT CGATGAAAAA CTGA
```

This corresponds to the amino acid sequence <SEQ ID 1304; ORF 312>:

m312.pep

```
  1 MSIQSGEILE TVKMVADQNF DVRTITIGID LHDCISSDIN VLNQNIYNKI

 51 TTVGKDLVTT AKYLSAKYGV PIVNQRISVT PIAQIAAATH ADSYVSVAQT

101 LDKAAKAIGV SFIGGFSALV QKGMSPSDEV LIRSIPEAMK TTDIVCXSIN

151 IGSTRAGINM DAVKLAGETV KRTAEITPEG FGCAKIVVFC NAVEDNPFXA

201 GAFHGSGDAV INVGVSGPGV VKAALENSDA TTLTEVAEVV KKTAFKITRV

251 GELIGREASK MLNIPFGILD LSPTPPVGDS VARILEEMGL SVCGTHGTTA

301 ALALLNDAVK KGGMMASSAV GGLSGAFIPV SEDEGMIXAA EAGVLTLDKL

351 EAMTAVCSVG LDMIAVPGDT PAHTISGIIA DEAAIGMINS KTTAVRIIPV

401 TGKTVGDTVE FGGLLGYAPV MPVKEGSCEV FVNRGGRIPA PVQSMKN*
```

Computer analysis of this amino acid sequence gave the following results:

Homology with a predicted ORF from *N. gonorrhoeae*

ORF 312 shows 95.6% identity over a 451 aa overlap with a predicted ORF (ORF 312.ng) from *N. gonorrhoeae*:

m312/g312

```
                    10        20        30        40        50        60
m312.pep    MSIQSGEILETVKMVADQNFDVRTITIGIDLHDCISSDINVLNQNIYNKITTVGKDLVTT
            |||||||||||||||||:||||||||||||||||||:||:||||||||||||||||||:|
g312        MSIQSGEILETVKMVADRNFDVRTITIGIDLHDCISTDIDVLNQNIYNKITTVGKDLVAT
                    10        20        30        40        50        60

                    70        80        90       100       110       120
m312.pep    AKYLSAKYGVPIVNQRISVTPIAQIAAATHADSYVSVAQTLDKAAKAIGVSFIGGFSALV
            ||:||||||||||||||||||||||||||:||||||||||||||||||||||||||||||
g312        AKHLSAKYGVPIVNQRISVTPIAQIAAATKADSYVSVAQTLDKAAKAIGVSFIGGFSALV
                    70        80        90       100       110       120

                   130       140       150       160       170       180
m312.pep    QKGMSPSDEVLIRSIPEAMKTTDIVCXSINIGSTRAGINMDAVKLAGETVKRTAEITPEG
            ||||||||||||||:||||||||||| ||||||||||||||||||||||:||||||||||
g312        QKGMSPSDEVLIRSVPEAMKTTDIVCSSINIGSTRAGINMDAVKLAGETIKRTAEITPEG
                   130       140       150       160       170       180

                   190       200         210       220       230
m312.pep    FGCAKIVVFCNAVEDNPFXAGAFHGSG--DAVINVGVSGPGVVKAALENSDATTLTEVAE
            |||||||||||||||||| ||||||||  |||||||||||||||||||||||::||||||
g312        FGCAKIVVFCNAVEDNPFMAGAFHGSGEADAVINVGVSGPGVVKAALENSDAVSLTEVAE
                   190       200       210       220       230       240

            240       250       260       270       280       290
m312.pep     VVKKTAFKITRVGELIGREASKMLNIPFGILDLS--PTPPVGDSVARILEEMGLSVCGTH
             ||||||||||||||||||||||||||||||||||  ||| ||||||||||||||||||||
g312         VVKKTAFKITRVGELIGREASKMLNIPFGILDLSLAPTPAVGDSVARILEEMGLSVCGTH
                    250       260       270       280       290       300

             300       310       320       330       340       350
m312.pep    GTTAALALLNDAVKKGGMMASSAVGGLSGAFIPVSEDEGMIXAAEAGVLTLDKLEAMTAV
            ||||||||||||||||||||||||||||||||||||||||| ||||||||||||||||||
g312        GTTAALALLNDAVKKGGMMASSAVGGLSGAFIPVSEDEGMIAAAEAGVLTLDKLEAMTAV
                   310       320       330       340       350       360

            360       370       380       390       400       410
m312.pep    CSVGLDMIAVPGDTPAHTISGIIADEAAIGMINSKTTAVRIIPVTGKTVGDTVEFGGLLG
            |||||||||||||||||||||||||||||||||||||||||||||||||||:||||||||
g312        CSVGLDMIAVPGDTPAHTISGIIADEAAIGMINSKTTAVRIIPVTGKTVGDSVEFGGLLG
                   370       380       390       400       410       420

              420       430       440
m312.pep     YAPVMPVKEGSCEVFVNRGGRIPAPVQSMKNX
             ||||||:|||||||||||||||||||||||||
g312         YAPVMPAKEGSCEVFVNRGGRIPAPVQSMKNX
                    430       440       450
```

The following partial DNA sequence was identified in *N. meningitidis* <SEQ ID 1305>:

a312.seq

```
  1 ATGAGTATCC AATCCGGCGA AATTTTAGAA ACCGTCAAAA TGGTTGCCGA
```

-continued

51 CCAGAATTTC GATGTCCGCA CCATTACCAT CGGCATTGAT TTGCACGACT

101 GCATCAGCAC CGACATCGAC GTGTTGAACC AAAATATTTA CAACAAAATT

151 ACCACGGTCG GCAAAGACTT GGTGGCGACA GCAAAATATC TGTCTGCCAA

201 ATACGGCGTG CCGATTGTGA ATCAGCGCAT TTCTGTCACG CCGATTGCCC

251 AAATCGCGGC GGCCACCCAT GCTGATTCTT ACGTCAGCGT GGCGCAAACT

301 TTGGATAAGG CTGCCAAAGC CATCGGCGTG TCTTTTATTG GCGGCTTTTC

351 CGCGCTGGTG CAAAAAGGTA TGTCGCCTTC TGACGAGGTG TTAATCCGTT

401 CCATTCCCGA AGCGATGAAG ACTACTGATA TCGTGTGCAG CTCCATCAAT

451 ATCGGCAGTA CGCGCGCCGG TATCAATATG GACGCGGTCA GACTGGCGGG

501 CGAAACCATC AAACGCACGG CTGAAATCAC ACTAGAAGGT TTCGGCTGCG

551 CCAAAATCGT CGTGTTCTGC AACGCGGTGG AAGACAACCC GTTTATGGCG

601 GGCGCGTTTC ACGGCTCAGG CGAAGCGGAT GCTGTGATTA ATGTCGGCGT

651 ATCCGGCCCG GGTGTCGTAA AAGCCGCGTT GGAAAATTCG GATGCAACGA

701 CATTGACCGA AGTTGCCGAA GTTGTGAAGA AAACCGCCTT CAAAATTACC

751 CGCGTGGGCG AACTCATCGG CCGCGAAGCC TCAAAAATGC TGAATATCCC

801 GTTTGGTATT CTCGACTTGT CGCTGGCACC GACCCCTGCC GTCGGCGACT

851 CGGTGGCGCG CATTCTTGAA GAAATGGGTT TGAGCGTCTG CGGTACGCAC

901 GGCACAACAG CAGCTTTGGC ATTGCTGAAC GATGCCGTGA AAAAGGGCGG

951 CATGATGGCT TCGAGCGCGG TTGGCGGTTT GAGTGGCGCG TTTATCCCCG

1001 TTTCCGAAGA CGAAGGTATG ATTGCCGCCG CCGAAGCAGG CGTGCTGACG

1051 TTGGATAAAC TCGAAGCGAT GACCGCCGTT TGTTCGGTCG GCTTGGATAT

1101 GATTGCCGTT CCCGGCGACA CACCCGCGCA CACCATTTCC GGCATCATTG

1151 CCGACGAAGC CGCCATCGGC ATGATCAACA GCAAAACCAC TGCCGTGCGC

1201 ATTATTCCGG TAACCGGTAA AACCGTCGGC GACAGCGTCG AGTTCGGCGG

1251 CCTGTTGGGC TACGCGCCTG TAATGCCGGT AAAAGAAGGC TCATGCGAAG

1301 TGTTCGTCAA CCGGGGCGGC AGGATTCCCG CACCGGTTCA ATCGATGAAA

1351 AACTGA

This corresponds to the amino acid sequence <SEQ ID 1306; ORF 312.a>:

<u>a312.pep</u>

1 MSIQSGEILE TVKMVADQNF DVRTITIGID LHDCISTDID VLNQNIYNKI

51 TTVGKDLVAT AKYLSAKYGV PIVNQRISVT PIAQIAAATH ADSYVSVAQT

101 LDK<u>AAKAIGV SFIGGFSALV</u> QKGMSPSDEV LIRSIPEAMK TTDIVCSSIN

151 IGSTRAGINM DAVRLAGETI KRTAEITLEG FGCAKIVVFC NAVEDNPFMA

201 GAFHGSGEAD AVINVGVSGP GVVKAALENS DATTLTEVAE VVKKTAFKIT

251 RVGELIGREA SKMLNIPFGI LDLSLAPTPA VGDSVARILE EMGLSVCGTH

301 GTTAALALLN DAVKKGGMMA SSAVGGLSGA FIPVSEDEGM IAAAEAGVLT

351 LDK<u>LEAMTAV CSVGLDMIAV</u> PGDTPAHTIS GIIADEAAIG MINSKTTAVR

-continued

```
401 IIPVTGKTVG DSVEFGGLLG YAPVMPVKEG SCEVFVNRGG RIPAPVQSMK

451 N*
```

m312/a312 96.7% identity in 451 aa overlap

```
                   10        20        30        40        50        60
m312.pep   MSIQSGEILETVKMVADQNFDVRTITIGIDLHDCISSDINVLNQNIYNKITTVGKDLVTT
           ||||||||||||||||||||||||||||||||||||:||:||||||||||||||||||:|
a312       MSIQSGEILETVKMVADQNFDVRTITIGIDLHDCISTDIDVLNQNIYNKITTVGKDLVAT
                   10        20        30        40        50        60

                   70        80        90       100       110       120
m312.pep   AKYLSAKYGVPIVNQRISVTPIAQIAAATHADSYVSVAQTLDKAAKAIGVSFIGGFSALV
           ||||||||||||||||||||||||||||||||||||||||||||||||||||||||||||
a312       AKYLSAKYGVPIVNQRISVTPIAQIAAATHADSYVSVAQTLDKAAKAIGVSFIGGFSALV
                   70        80        90       100       110       120

                  130       140       150       160       170       180
m312.pep   QKGMSPSDEVLIRSIPEAMKTTDIVCXSINIGSTRAGINMDAVKLAGETVKRTAEITPEG
           |||||||||||||||||||||||||| |||||||||||||||:|||||:||||||| ||
a312       QKGMSPSDEVLIRSIPEAMKTTDIVCSSINIGSTRAGINMDAVRLAGETIKRTAEITLEG
                  130       140       150       160       170       180

                  190       200         210       220       230
m312.pep   FGCAKIVVFCNAVEDNPFXAGAFHGSG--DAVINVGVSGPGVVKKAALENSDATTLTEVAE
           |||||||||||||||||| ||||||||  ||||||||||||||||||||||||||||||||
a312       FGCAKIVVFCNAVEDNPFMAGAFHGSGEADAVINVGVSGPGVVKKAALENSDATTLTEVAE
                  190       200       210       220       230       240

             240       250       260       270       280       290
m312.pep    VVKKTAFKITRVGELIGREASKMLNIPFGILDLS--PTPPVGDSVARILEEMGLSVCGTH
            ||||||||||||||||||||||||||||||||||  ||| ||||||||||||||||||||
a312        VVKKTAFKITRVGELIGREASKMLNIPFGILDLSLAPTPAVGDSVARILEEMGLSVCGTH
                  250       260       270       280       290       300

            300       310       320       330       340       350
m312.pep   GTTAALALLNDAVKKGGMMASSAVGGLSGAFIPVSEDEGMIXAAEAGVLTLDKLEAMTAV
           ||||||||||||||||||||||||||||||||||||||||| ||||||||||||||||||
a312       GTTAALALLNDAVKKGGMMASSAVGGLSGAFIPVSEDEGMIAAAEAGVLTLDKLEAMTAV
                  310       320       330       340       350       360

            360       370       380       390       400       410
m312.pep   CSVGLDMIAVPGDTPAHTISGIIADEAAIGMINSKTTAVRIIPVTGKTVGDTVEFGGLLG
           ||||||||||||||||||||||||||||||||||||||||||||||||||:|||||||||
a312       CSVGLDMIAVPGDTPAHTISGIIADEAAIGMINSKTTAVRIIPVTGKTVGDSVEFGGLLG
                  370       380       390       400       410       420

              420       430       440
m312.pep    YAPVMPVKEGSCEVFVNRGGRIPAPVQSMKNX
            ||||||||||||||||||||||||||||||||
a312        YAPVMPVKEGSCEVFVNRGGRIPAPVQSMKNX
                  430       440       450
```

The following partial DNA sequence was identified in *N. gonorrhoeae* <SEQ ID 1307>:

<u>g313.seq</u>

```
  1 atggacgacc cgcgcaccta cggatcgggc aatcccggcg cgaccaatgt

 51 tttacgcagc ggcaaaaaaa aggcggccgc gctgacgctc ttgggcgatg

101 ccgccaaagg tttggttgcc gttttgcttg cacgcgtgct tcaagaaccg

151 ctcggtttat ccgacagcgc aatcgccgcc gtcgcactcg ccgcgctggt

201 cgggcatatg tggccggtgt ttttcggatt taagggcggc aaaggcgtgg

251 caacggcatt gggcgtgctt ctggcactct ctcctgcaac tgccttggtc

301 tgcgcgttga tttggcttgt gatggcattc ggcttcaaag tatcctccct

351 tgccgcgctg gtcgccacaa ccgccgcccc ccttgccgca ctgtttttta

401 tgccgcatac ttcttggatt ttcgcaaccc tcgcaatcgc catattggtg

451 ttgctccgcc ataagagcaa catcctcaac ctgattaaag gcaaagaaag

501 caaaatcggc gaaaaacgct ga
```

This corresponds to the amino acid sequence <SEQ ID 1308; ORF 313.ng>:

```
g313.pep
  1 MDDPRTYGSG NPGATNVLRS GKKKAAALTL LGDAAKGLVA VLLARVLQEP
 51 LGLSDSAIAA VALAALVGHM WPVFFGFKGG KGVATALGVL LALSPATALV
101 CALIWLVMAF GFKVSSLAAL VATTAAPLAA LFFMPHTSWI FATLAIAILV
151 LLRHKSNILN LIKGKESKIG EKR*
```

The following partial DNA sequence was identified in *N. meningitidis* <SEQ ID 1309>:

```
m313.seq
  1 ATGGACGACC CGCGCACCTA CGGATCGGGC AATCCGGGGG CAACCAATGT
 51 TTTACGCAGC GGCAAAAAAA AGGCGGCCGC GCTGACGCTC TTGGGCGATG
101 CCGCCAAAGG TTTAGTTGCC GTTTTGCTTG CACGCGTGCT TCAAGAACCG
151 CTCGGTTTAT CCGACAGCGC AATCGCGGCC GTCGCACTCG CCGCGCTGGT
201 CGGGCATATG TGGCCGGTGT TTTTCGGATT TAAAGGCGGC AAAGGCGTGG
251 CAACGGCATT GGGCGTGCTT CTGGCACTCT CTCCCGCAAC TGCCTTGGTC
301 TGCGCGTTGA TTTGGCTTGT TATGGCATTC GGCTTCAAGG TGTCCTCCCT
351 TGCCGCATTA ACCGCCACAA TCGCCGCACC GGTCGCCGCA TCCTTCTTTA
401 TGCCGCACGT CTCGTGGGTT TGGGCGACCG TCGCCATTGC TTTGCTGGTG
451 TTGTTCCGCC ACAAAAGTAA TATCGTCAAG CTGCTCGAAG GCAGAGAAAG
501 CAAAATCGGC GGCAGCCGCT GA
```

This corresponds to the amino acid sequence <SEQ ID 1310; ORF 313>:

```
m313.pep
  1 MDDPRTYGSG NPGATNVLRS GKKKAAALTL LGDAAKGLVA VLLARVLQEP
 51 LGLSDSAIAA VALAALVGHM WPVFFGFKGG KGVATALGVL LALSPATALV
101 CALIWLVMAF GFKVSSLAAL TATIAAPVAA SFFMPHVSWV WATVAIALLV
151 LFRHKSNIVK LLEGRESKIG GSR*
```

Computer analysis of this amino acid sequence gave the following results:

Homology with a predicted ORF from *N. gonorrhoeae*

ORF 313 shows 90.2% identity over a 173 aa overlap with a predicted ORF (ORF 313.ng) from *N. gonorrhoeae*:

```
m313/g313
                    10        20        30        40        50        60
m313.pep   MDDPRTYGSGNPGATNVLRSGKKKAAALTLLGDAAKGLVAVLLARVLQEPLGLSDSAIAA
           ||||||||||||||||||||||||||||||||||||||||||||||||||||||||||||
g313       MDDPRTYGSGNPGATNVLRSGKKKAAALTLLGDAAKGLVAVLLARVLQEPLGLSDSAIAA
                    10        20        30        40        50        60
```

-continued

```
                70        80        90        100       110       120
m313.pep  VALAALVGHMWPVFFGFKFFKGVATALGVLLALSPATALVCALIWLVMAFGFKVSSLAAL
          ||||||||||||||||||||||||||||||||||||||||||||||||||||||||||||
g313      VALAALVGHMWPVFFGFKFFKGVATALGVLLALSPATALVCALIWLVMAFGFKVSSLAAL
                70        80        90        100       110       120

                130       140       150       160       170
m313.pep  TATIAAPVAASFFMPHVSWVWATVAIALLVLFRHKSNIVKLLEGRESKIGGSRX
          :|| |||:|| |||||:||::||:|||:|||:||||||::|::|:||||| :||
g313      TATTAAPLAALFFMPHTSWIFATLAIAILVLLRHKSNILNLIKGKESKIGEKRX
                130       140       150       160       170
```

The following partial DNA sequence was identified in *N. meningitidis* <SEQ ID 1311>:

```
a313.seq

  1 ATGGACGACC CGCGCACCTA CGGATCGGGC AATCCGGGGG CAACCAATGT

 51 TTTACGCAGC GGCAAAAAAA AGGCGGCCGC GCTGACGCTC TTGGGCGATG

101 CCGCCAAAGG TTTGGTTGCC GTTTTGCTTG CACGCGTGCT TCAAGAACCG

151 CTCGGTTTAT CCGACAGCGC AATCGCGGCC GTCGCACTCG CCGCGCTGGT

201 CGGGCATATG TGGCCGGTGT TTTTCGGATT TAAAGGCGGC AAAGGCGTGG

251 CAACGGCATT GGGCGTGCTT CTGGCACTCT CTCCCACAAC TGCCTTGGTC

301 TGCGCGTTGA TTTGGCTTGT GATGGCATTC GGCTTCAAGG TGTCCTCCCT

351 TGCCGCATTA ACCGCCACAA TCGCCGCCCC CCTTGCCGCA CTGTTTTTTA

401 TGCCGCATAC TTCTTGGATT TTCGCAACCC TCGCAATCGC CATATTGGTG

451 TTGCTCCGCC ATAAGAGCAA CATCCTCAAC CTGATTAAAG GCAAAGAAAG

501 CAAAATCGGC GAAAAACGCT GA
```

This corresponds to the amino acid sequence <SEQ ID 1312; ORF 313.a>:

```
a313.pep

  1 MDDPRTYGSG NPGATNVLRS GKKKAAALTL LGDAAKGLVA VLLARVLQEP

 51 LGLSDSAIAA VALAALVGHM WPVFFGFKGG KGVATALGVL LALSPTTALV

101 CALIWLVMAF GFKVSSLAAL TATIAAPLAA LFFMPHTSWI FATLAIAILV

151 LLRHKSNILN LIKGKESKIG EKR*
```

m313/a313 90.8% identity in 173 aa overlap

```
                10        20        30        40        50        60
m313.pep  MDDPRTYGSGNPGATNVLRSGKKKAAALTLLGDAAKGLVAVLLARVLQEPLGLSDSAIAA
          ||||||||||||||||||||||||||||||||||||||||||||||||||||||||||||
a313      MDDPRTYGSGNPGATNVLRSGKKKAAALTLLGDAAKGLVAVLLARVLQEPLGLSDSAIAA
                10        20        30        40        50        60

                70        80        90        100       110       120
m313.pep  VALAALVGHMWPVFFGFKFFKGVATALGVLLALSPATALVCALIWLVMAFGFKVSSLAAL
          ||||||||||||||||||||||||||||||||||||:|||||||||||||||||||||||
a313      VALAALVGHMWPVFFGFKFFKGVATALGVLLALSPTTALVCALIWLVMAFGFKVSSLAAL
                70        80        90        100       110       120

                130       140       150       160       170
m313.pep  TATIAAPVAASFFMPHVSWVWATVAIALLVLFRHKSNIVKLLEGRESKIGGSRX
          |||||||:|| |||||:||::||:|||:|||:||||||::|::|:||||| :||
a313      TATIAAPLAALFFMPHTSWIFATLAIAILVLLRHKSNILNLIKGKESKIGEKRX
                130       140       150       160       170
```

The following partial DNA sequence was identified in *N. gonorrhoeae* <SEQ ID 1313>:

g401.seq

```
  1 atgaaattac aacaattggc tgaagaaaaa atcggcgttc tgattgtgtt
 51 cacgctgctt gtagtcagtg tcggtctgtt gattgaagtt gtgcccttgg
101 cctttaccaa ggcggcaaca cagccggcgc cgggcgtgaa gccttacaat
151 gccctgcagg ttgccggacg cgatatttac atccgtgagg gctgttacaa
201 ctgccactct caaatgattc gtccgttccg tgcggaaacc gagcgttacg
251 gtcattactc tgttgccgga gagtcggttt acgaccatcc gttccaatgg
301 ggttccaaac gtaccggtcc tgatttggca cgtgtgggcg gccgctattc
351 cgacgaatgg caccgcatcc acctgctgaa tccccgtgat gtcgtgcctg
401 agtccaatat gccggcattc ccgtggcttg cacgcaataa agtcgatgtc
451 gatgcaaccg ttgccaacat gaaggctttg cgtaaagtag gtactcctta
501 cagtgatgag gaaattgcga aagcgcctga ggctttggca aacaaatccg
551 agctggatgc tgtagtcgcc tatctgcaag gattgggtct ggctttgaaa
601 aacgtaaggt aa
```

This corresponds to the amino acid sequence <SEQ ID 1314; ORF 401.ng>:

g401.pep

```
  1 MKLQQLAEEK IGVLIVFTLL VVSVGLLIEV VPLAFTKAAT QPAPGVKPYN
 51 ALQVAGRDIY IREGCYNCHS QMIRPFRAET ERYGHYSVAG ESVYDHPFQW
101 GSKRTGPDLA RVGGRYSDEW HRIHLLNPRD VVPESNMPAF PWLARNKVDV
151 DATVANMKAL RKVGTPYSDE EIAKAPEALA NKSELDAVVA YLQGLGLALK
201 NVR*
```

The following partial DNA sequence was identified in *N. meningitidis* <SEQ ID 1315>:

m401.seq

```
  1 ATGAAATTAC AaCAATTGGC TGAAGAAAAA ATCGGCGTTC TGATTGTGTT
 51 CACGCTGCTT GTAGTCAGTG TCGGTCTGTT GATTGAAGTT GTGCCCTTGG
101 CCTTTACCAA GGCGGCAACA CAGCCGGCGC CGGGCGTGAA GCCTTACAAT
151 GCCCTGCAGG TTGCCGGACG CGATATTTAC ATCCGTGAGG GCTGTTACAA
201 CTGCCACTCG CAAATGATTC GTCCGTTCCG TGCGGAAACC GAGCGTTACG
251 GTCATTACTC TGTTGCCGGA GAGTCGGTTT ACGACCATCC GTTCCAATGG
301 GGTTCCAAAC GTACCGGTCC TGATTTGGCA CGTGTGGGCG GTCGCTATTC
351 CGACGAATGG CACCGTATCC ACCTGCTGAA TCCCCGTGAT GTCGTGCCTG
401 AGTCCAATAT GCCGGCATTC CCGTGGCTTG CACGCAATAA AGTCGATGTC
451 GATGCAACCG TTGCCAACAT GAAGGCTTTG CGTAAAGTAG GTACTCCTTA
501 CAGTGATGAG GAAATTGCGA AAGCACCTGA GGCTTTGGCA AACAAATCCG
```

-continued

```
551 AGCTGGATGC TGTAGTCGCC TATCTGCAAG GATTGGGTCT CGCTTTGAAA

601 AACGTAAGGT AA
```

This corresponds to the amino acid sequence <SEQ ID 1316; ORF 401>:

m401.pep

```
  1 MKLQQLAEEK IGVLIVFTLL VVSVGLLIEV VPLAFTKAAT QPAPGVKPYN

 51 ALQVAGRDIY IREGCYNCHS QMIRPFRAET ERYGHYSVAG ESVYDHPFQW

101 GSKRTGPDLA RVGGRYSDEW HRIHLLNPRD VVPESNMPAF PWLARNKVDV

151 DATVANMKAL RKVGTPYSDE EIAKAPEALA NKSELDAVVA YLQGLGLALK

201 NVR*
```

Computer analysis of this amino acid sequence gave the following results:

Homology with a predicted ORF from *N. gonorrhoeae*

ORF 401 shows 100.0% identity over a 203 aa overlap with a predicted ORF (ORF 401.ng) from *N. gonorrhoeae*:

m401/g401

```
                   10        20        30        40        50        60
m401.pep   MKLQQLAEEKIGVLIVFTLLVVSVGLLIEVVPLAFTKAATQPAPGVKPYNALQVAGRDIY
           ||||||||||||||||||||||||||||||||||||||||||||||||||||||||||||
g401       MKLQQLAEEKIGVLIVFTLLVVSVGLLIEVVPLAFTKAATQPAPGVKPYNALQVAGRDIY
                   10        20        30        40        50        60

                   70        80        90       100       110       120
m401.pep   IREGCYNCHSQMIRPFRAETERYGHYSVAGESVYDHPFQWGSKRTGPDLARVGGRYSDEW
           ||||||||||||||||||||||||||||||||||||||||||||||||||||||||||||
g401       IREGCYNCHSQMIRPFRAETERYGHYSVAGESVYDHPFQWGSKRTGPDLARVGGRYSDEW
                   70        80        90       100       110       120

                  130       140       150       160       170       180
m401.pep   HRIHLLNPRDVVPESNMPAFPWLARNKVDVDATVANMKALRKVGTPYSDEEIAKAPEALA
           ||||||||||||||||||||||||||||||||||||||||||||||||||||||||||||
g401       HRIHLLNPRDVVPESNMPAFPWLARNKVDVDATVANMKALRKVGTPYSDEEIAKAPEALA
                  130       140       150       160       170       180

                  190       200
m401.pep   NKSELDAVVAYLQGLGLALKNVRX
           ||||||||||||||||||||||||
g401       NKSELDAVVAYLQGLGLALKNVRX
                  190       200
```

The following partial DNA sequence was identified in *N. meningitidis* <SEQ ID 1317>:

a401.seq

```
  1 ATGAAATTAC AACAATTGGC TGAAGAAAAA ATCGGCGTTC TGATTGTGTT

 51 CACGCTGCTT GTAGTCAGTG TCGGTCTGTT GATTGAAGTT GTGCCCTTGG

101 CCTTTACCAA GGCGGCAACA CAGCCGGCGT CGGGCGTGAA GCCTTACAAT

151 GCCCTGCAGG TTGCCGGACG CGATATTTAC ATCCGTGAGG GCTGTTACAA

201 CTGCCACTCG CAAATGATTC GTCCGTTCCG TGCGGAAACC GAGCGTTACG

251 GTCATTACTC TGTTGCCGGA GAGTCGGTTT ACGACCATCC GTTCCAATGG

301 GGTTCCAAAC GTACCGGTCC TGATTTGGCA CGTGTGGGCG GTCGCTATTC
```

-continued

```
351 CGACGAATGG CACCGTATCC ACCTGCTGAA TCCCCGTGAT GTCGTGCCTG

401 AGTCCAATAT GCCGGCATTC CCGTGGCTTG CACGCAATAA AGTCGATGTC

451 GATGCAACCG TTGCCAACAT GAAGGCTTTG CGTAAAGTAG GTACTCCTTA

501 CAGTGATGAG GAAATTGCGA AAGCGCCTGA GGCTTTGGCA AACAAATCCG

551 AGCTGGATGC TGTAGTCGCC TATCTGCAAG GATTGGGTCT GGCTTTGAAA

601 AACGTAAGGT AA
```

This corresponds to the amino acid sequence <SEQ ID 1318; ORF 401.a>:

a401.pep

```
  1 MKLQQLAEEK IGVLIVFTLL VVSVGLLIEV VPLAFTKAAT QPASGVKPYN

 51 ALQVAGRDIY IREGCYNCHS QMIRPFRAET ERYGHYSVAG ESVYDHPFQW

101 GSKRTGPDLA RVGGRYSDEW HRIHLLNPRD VVPESNMPAF PWLARNKVDV

151 DATVANMKAL RKVGTPYSDE EIAKAPEALA NKSELDAVVA YLQGLGLALK

201 NVR*
```

m401/a401 99.5% identity in 203 aa overlap

```
                   10        20        30        40        50        60
m401.pep   MKLQQLAEEKIGVLIVFTLLVVSVGLLIEVVPLAFTKAATQPAPGVKPYNALQVAGRDIY
           ||||||||||||||||||||||||||||||||||||||||||||||||||||||||||||
a401       MKLQQLAEEKIGVLIVFTLLVVSVGLLIEVVPLAFTKAATQPAPGVKPYNALQVAGRDIY
                   10        20        30        40        50        60

                   70        80        90       100       110       120
m401.pep   IREGCYNCHSQMIRPFRAETERYGHYSVAGESVYDHPFQWGSKRTGPDLARVGGRYSDEW
           ||||||||||||||||||||||||||||||||||||||||||||||||||||||||||||
a401       IREGCYNCHSQMIRPFRAETERYGHYSVAGESVYDHPFQWGSKRTGPDLARVGGRYSDEW
                   70        80        90       100       110       120

                  130       140       150       160       170       180
m401.pep   HRIHLLNPRDVVPESNMPAFPWLARNKVDVDATVANMKALRKVGTPYSDEEIAKAPEALA
           ||||||||||||||||||||||||||||||||||||||||||||||||||||||||||||
a401       HRIHLLNPRDVVPESNMPAFPWLARNKVDVDATVANMKALRKVGTPYSDEEIAKAPEALA
                  130       140       150       160       170       180

                  190       200
m401.pep   NKSELDAVVAYLQGLGLALKNVRX
           ||||||||||||||||||||||||
a401       NKSELDAVVAYLQGLGLALKNVRX
                  190       200
```

The following partial DNA sequence was identified in *N. gonorrhoeae* <SEQ ID 1319>:

g402.seq

```
  1 ATGGATATGG TGAACACTAA Accgaatact agtgtgatta atatgctttc

 51 tttccttacc ggatTATTGA GCTTGGGTat agaagtCtTg tGGGTAAGGA

101 TGttttcgTT CGCagcAcag tccgtgcctc aggCATTTTC atttattctt

151 gcctGttttc tgACCGgtat cgccgtcggc gCgTATTTTG GCAAACGGAT

201 TTGCCGCAGC CGCTTTGTTG ATATTCCctT TATCGGGCAG TgcttcttgT

251 GGGCGGGTAT TgccgaTttt ttgatTTTGG GTGCTGCGTG GTTGTTGACG

301 GGTTTTTccg gtttcGTCCA CCACGCCGGT AtttTCATTA CCCTgtctgc
```

-continued

```
 351 CGtcGTCAGG GGGTTGATTT TCCCACTTGT ACACCATgtg GGTACGGATG
 401 GCAACAAATC CGGACGACAG GTTTCCAATG TTTATTTCGC CAACGTTGCC
 451 GGCAGTGCAT TGGGTCCGGT CCTTATCGGC TTTGTGATAC TTGATttgtt
 501 gTCCACCCAA CAGATTtacc tgctcatCTG TTTGATTTCT GCTGCtgtcc
 551 cTTTGTTTTg tacaCTGtTC CAAAAAAGTC TCCGACTGAA TGCAGTGTCG
 601 GTAGCAGTTT CCCTAATGTT CGGCATCCTC ATGTTCCTAC TGCCGGATTC
 651 TGTCTTTCAA AATATTGCTG GCCGTCCGGA TAGGTTGATT GAAAACAAAC
 701 ACGGCATTGT TGCGGTTTAC CATAGAGATG GTGATAAGGT TGTTTATGGG
 751 GCGAATGTAT ACGACGGCGC ATACAATACC GATATATTCA ATAGTGTCAA
 801 CGGCATCGAA CGTGCCTATC TGCTACCCTC CCTGAAGTCC GGCATACGCC
 851 GCATTTTCGT CGTTGGATTG AGTACAGGTT CGTGGGCGCG CGTCTTGTCT
 901 GCCATTCCGG AAATGCAGTC GATGATCGTT GCGGAAATCA ATCCGGCATA
 951 CCGTAGCCTT ATCGCGGAcg agccgcAAAT CGCACCGCTT TTGCAGGACA
1001 AACGTGTTGA AATTGTATTG GATGACGGTA GGAAATGGCT GCGTCGCCAT
1051 CCTGATGAAA AATTCGACCT GATTTTGATG AATTCGACTT GGTACTGGCG
1101 TGCCTATTCC ACTAACCTGT TGAGTGCGGA ATTTTTAAAA CAGGTGCAAA
1151 GCCACCTTAC CCCGGATGGT ATTGTAATGT TTAATACCAC GCACAGCCCG
1201 CATgctTTTG CTACCGCCGT ACACAGTATT CCCTATGCAT ACCGCTACGG
1251 GCATATGGTA GTCGGCTCGG CAACCCCGGT AGTTTTCcct AATAAAGAAC
1301 TGCTCaagca aCGCCTTTcc cgGTTGATTT GGCCGGAAAG CGGCAGgcac
1351 gtATTTGACA GCAGCACCGT GGATGCTGCA GCACAAAAGG TTGtctctCG
1401 TATGCTGATT CGGATGACGG AAcctTCGGC TGGGGCGGAA GTCATTACTG
1451 ACGATAATAT GATTGTAGAA TACAAATACG GCAGAGGGAT TTAA
```

This corresponds to the amino acid sequence <SEQ ID 1320; ORF 402.ng>:

g402.pep

```
  1 MDMVNTKPNT SVINMLSFLT GLLSLGIEVL WVRMFSFAAQ SVPQAFSFIL
 51 ACFLTGIAVG AYFGKRICRS RFVDIPFIGQ CFLWAGIADF LILGAAWLLT
101 GFSGFVHHAG IFITLSAVVR GLIFPLVHHV GTDGNKSGRQ VSNVYFANVA
151 GSALGPVLIG FVILDLLSTQ QIYLLICLIS AAVPLFCTLF QKSLRLNAVS
201 VAVSLMFGIL MFLLPDSVFQ NIAGRPDRLI ENKHGIVAVY HRDGDKVVYG
251 ANVYDGAYNT DIFNSVNGIE RAYLLPSLKS GIRRIFVVGL STGSWARVLS
301 AIPEMQSMIV AEINPAYRSL IADEPQIAPL LQDKRVEIVL DDGRKWLRRH
351 PDEKFDLILM NSTWYWRAYS TNLLSAEFLK QVQSHLTPDG IVMFNTTHSP
401 HAFATAVHSI PYAYRYGHMV VGSATPVVFP NKELLKQRLS RLIWPESGRH
451 VFDSSTVDAA AQKVVSRMLI RMTEPSAGAE VITDDNMIVE YKYGRGI*
```

The following partial DNA sequence was identified in *N. meningitidis* <SEQ ID 1321>:

m402.seq

1 ATGGATATAG TGAACACTAA ACCGAATACT AGTTTGATTT ATATGCnTTC

51 TTTCCTTAGC GGCTTATTGA GCTTGGGTAT AGAAGTCTTG TGGGTGAGGA

101 TGTTTTCGTT CGCAGCACAG TCCGTGCCTC AGGCATTTTC ATTTACCCTT

151 GCCTGTTTTC TGACCGGTAT CGCCGTCGGC GCGTATTTTG GCAAACGGAT

201 TTGCCGCAGC CGCTTTGTTG ATATTCCCTT TATCGGGCAG TGCTTCTTGT

251 GGGCGGGTAT TGCCGACTTT TTGATTTTGG GTGCTGCGTG GTTGTTGACG

301 GGTTTTTCCG GCTTCGTCCA CCACGCCGGT ATCTTCATTA CCCTGTCTGC

351 CGTCGTCAsA sGGTTGATTT TCCCGCTCGT ACACCATGTG GGTACGGATG

401 GCAACAAATC CGGACGACAG GTTTCCAATG TTTATTTCGC CAmCGTTGCC

451 GGCAGTGCAT TGGGTCCGGT CCTTATCGGC TTTGTGATAC TTGATTTCTT

501 GTCCACCCAA CAGATTTACC TGCTCATCTG TwTGATTTCT GCTGCTGTCC

551 CTTTGTTTTG TACACTGTTC CAAAAAAGTC TCCGACTGAA TGCAGTGTCG

601 GTAGCAGTTT CCCTAATGTT CGGCATCCTC ATGTTCyTAC TGCCGGATTC

651 TGTCTTTCAA AATATTGCTG ACCGTCCGGA TAgGCTGATT GAAAACAAAC

701 ACGGCATTGT TGCGGTTTAC CATAGAGATG GTGATAAGGT TGTTTATGGG

751 GCGAATGTAT ACGACGGCGC ATACAATACC GATGTATTCA ATAGTGTCAA

801 CGGCATCGAA CGTGCCTATC TGCTACCCTC CCTGAAGTCT GGCATACGCC

851 GCATTTTCGT CGTTGGACTG AGTACAGGTT CGTGGGCGCG CGTCTTGTCT

901 GCCATTCCGG AAATGCAGTC GATGATCGTT GCGGAAATCA ATCCGGCATA

951 CCGTAGCCTT ATCGCGGACG AGCCGCAAAT CGCCCCGCTT TTGCAGGACA

1001 AACGTGTTGA AATTGTATTG GATGACGGTA GGAAATGGCT GCGTCGCCAT

1051 CCTGATGAAA AATTCGACCT GATTTTGATG AATACGACTT GGTACTGGCG

1101 TGCCTATTCC ACCAACCTGT TGAGTGCGGA ATTTTTAAAA CAGGTGCAAA

1151 GCCACCTTAC CCCGGATGGT ATTGTAATGT TTAATACCAC GCACAGCCCG

1201 CATGCTTTTG CTACCGCCGT ACACAGTATT CCCTATGCAT ACCGCTATGG

1251 GCATATGGTA GTCGGCTCGG CAACCCCGGT AGTTTTCCCT AATAAAGAAC

1301 TGCTCAAGCA ACGTCTCTCC CGGTTGATTT GGCCGGAAAG CGGCAGGCAC

1351 GTATTTGACA GCAGCACCGT GGATGCTGCA GCACAAAAGG TTGTCTCTCG

1401 TATGCTGATT CAGATGACGG aAcCTTCGGC TGGGGCGGAA GTTATTACCG

1451 ACGATAATAT GATTGTAGAA TACAAATACG GCAGAGGGAT TTAA

This corresponds to the amino acid sequence <SEQ ID 1322; ORF 402>:

m402.pep

1 MDIVNTKPNT SLIYMXSFLS GLLSLGIEVL WVRMFSFAAQ SVPQAFSFTL

51 ACFLTGIAVG AYFGKRICRS RFVDIPFIGQ CFLWAGIADF LILGAAWLLT

101 GFSGFVHHAG IFITLSAVVX XLIFPLVHHV GTDGNKSGRQ VSNVYFAXVA

151 GSALGPVLIG FVILDFLSTQ QIYLLICXIS AAVPLFCTLF QKSLRLNAVS

201 VAVSLMFGIL MFLLPDSVFQ NIADRPDRLI ENKHGIVAVY HRDGDKVVYG

-continued

```
251 ANVYDGAYNT DVFNSVNGIE RAYLLPSLKS GIRRIFVVGL STGSWARVLS

301 AIPEMQSMIV AEINPAYRSL IADEPQIAPL LQDKRVEIVL DDGRKWLRRH

351 PDEKFDLILM NTTWYWRAYS TNLLSAEFLK QVQSHLTPDG IVMFNTTHSP

401 HAFATAVHSI PYAYRYGHMV VGSATPVVFP NKELLKQRLS RLIWPESGRH

451 VFDSSTVDAA AQKVVSRMLI QMTEPSAGAE VITDDNMIVE YKYGRGI*
```

Computer analysis of this amino acid sequence gave the following results:

Homology with a predicted ORF from *N. gonorrhoeae*

ORF 402 shows 97.0% identity over a 497 aa overlap with a predicted ORF (ORF 402.ng) from *N. gonorrhoeae*:

```
m402/g402
                   10        20        30        40        50        60
m402.pep    MDIVNTKPNTSLIYMXSFLSGLLSLGIEVLWVRMFSFAAQSVPQAFSFTLACFLTGIAVG
            ||:||||||||:| | |||:|||||||||||||||||||||||||||| ||||||||||||
g402        MDMVNTKPNTSVINMLSFLTGLLSLGIEVLWVRMFSFAAQSVPQAFSFILACFLTGIAVG
                   10        20        30        40        50        60

                   70        80        90       100       110       120
m402.pep    AYFGKRICRSRFVDIPFIGQCFLWAGIADFLILGAAWLLTGFSGFVHHAGIFITLSAVVX
            |||||||||||||||||||||||||||||||||||||||||||||||||||||||||||
g402        AYFGKRICRSRFVDIPFIGQCFLWAGIADFLILGAAWLLTGFSGFVHHAGIFITLSAVVR
                   70        80        90       100       110       120

                  130       140       150       160       170       180
m402.pep    XLIFPLVHHVGTDGNKSGRQVSNVYFAXVAGSALGPVLIGFVILDFLSTQQIYLLICXIS
             ||||||||||||||||||||||||||| |||||||||||||||||:||||||||||| ||
g402        GLIFPLVHHVGTDGNKSGRQVSNVYFANVAGSALGPVLIGFVILDLLSTQQIYLLICLIS
                  130       140       150       160       170       180

                  190       200       210       220       230       240
m402.pep    AAVPLFCTLFQKSLRLNAVSVAVSLMFGILMFLLPDSVFQNIADRPDRLIENKHGIVAVY
            |||||||||||||||||||||||||||||||||||||||||||| ||||||||||||||||
g402        AAVPLFCTLFQKSLRLNAVSVAVSLMFGILMFLLPDSVFQNIAGRPDRLIENKHGIVAVY
                  190       200       210       220       230       240

                  250       260       270       280       290       300
m402.pep    HRDGDKVVYGANVYDGAYNTDVFNSVNGIERAYLLPSLKSGIRRIFVVGLSTGSWARVLS
            |||||||||||||||||||||:||||||||||||||||||||||||||||||||||||||
g402        HRDGDKVVYGANVYDGAYNTDIFNSVNGIERAYLLPSLKSGIRRIFVVGLSTGSWARVLS
                  250       260       270       280       290       300

                  310       320       330       340       350       360
m402.pep    AIPEMQSMIVAEINPAYRSLIADEPQIAPLLQDKRVEIVLDDGRKWLRRHPDEKFDLILM
            ||||||||||||||||||||||||||||||||||||||||||||||||||||||||||||
g402        AIPEMQSMIVAEINPAYRSLIADEPQIAPLLQDKRVEIVLDDGRKWLRRHPDEKFDLILM
                  310       320       330       340       350       360

                  370       380       390       400       410       420
m402.pep    NTTWYWRAYSTNLLSAEFLKQVQSHLTPDGIVMFNTTHSPHAFATAVHSIPYAYRYGHMV
            |:||||||||||||||||||||||||||||||||||||||||||||||||||||||||||
g402        NSTWYWRAYSTNLLSAEFLKQVQSHLTPDGIVMFNTTHSPHAFATAVHSIPYAYRYGHMV
                  370       380       390       400       410       420

                  430       440       450       460       470       480
m402.pep    VGSATPVVFPNKELLKQRLSRLIWPESGRHVFDSSTVDAAAQKVVSRMLIQMTEPSAGAE
            ||||||||||||||||||||||||||||||||||||||||||||||||||:|||||||||
g402        VGSATPVVFPNKELLKQRLSRLIWPESGRHVFDSSTVDAAAQKVVSRMLIRMTEPSAGAE
                  430       440       450       460       470       480

                  490
m402.pep    VITDDNMIVEYKYGRGIX
            |||||||||||||||||
g402        VITDDNMIVEYKYGRGI
                  490
```

The following partial DNA sequence was identified in *N. meningitidis* <SEQ ID 1323>:

```
a402.seq

   1 ATGGATATAG TGAACACTAA ACCGAATACT AGTTTGATTT ATATGCTTTC

  51 TTTCCTTAGC GGCTTATTGA GCTTGGGTAT AGAAGTCTTG TGGGTAAGGA
```

-continued

```
101 TGTTTTCGTT CGCAGCACAG TCCGTGCCTC AGGCATTTTC ATTTACTCTT
151 GCCTGTTTTC TGACCGGTAT CGCCGTCGGC GCGTATTTTG GCAAACGGAT
201 TTGCCGCAGC CGCTTTGTTG ATATTCCCTT TATCGGGCAG TGCTTCTTGT
251 GGGCGGGTAT TGCCGACTTT TTGATTTTGG GTGCTGCGTG GTTGTTGACG
301 GGTTTTTCCG GCTTCGTCCA CCACGCCGGT ATCTTCATTA CCCTGTCTGC
351 CGTCGTCAGA GGGTTGATTT TCCCGCTCGT ACACCATGTG GGTACGGATG
401 GCAACAAATC CGGACGACAG GTTTCCAATG TTTATTTCGC CAACGTTGCC
451 GGCAGTGCAT TGGGTCCGGT CCTTATCGGC TTTGTGATAC TTGATTTCTT
501 GTCCACCCAA CAGATTTACC TGCTCATCTG TTTGATTTCT GCTGCTGTCC
551 CTTTGTTTTG TACACTGTTC CAAAAAAGTC TCCGACTGAA TGCAGTGTCG
601 GTAGCAGTTT CCCTAATGTT CGGCATCCTC ATGTTCCTAC TGCCGGATTC
651 TGTCTTTCAA AATATTGCTG ACCGTCCGGA TAGGCTGATT GAAAACAAAC
701 ACGGCATTGT TGCGGTTTAC CATAGAGATG GTGATAAGGT TGTTTATGGG
751 GCGAATGTAT ACGACGGCGC ATACAATACC GATGTATTCA ATAGTGTCAA
801 CGGCATCGAA CGTGCCTATC TGCTACCCTC CCTGAAGTCT GGCATACGCC
851 GCATTTTCGT CGTTGGATTG AGTACAGGTT CGTGGGCGCG CGTCTTGTCT
901 GCCATTCCGG AAATGCAGTC GATGATCGTT GCGGAAATCA ATCCGGCATA
951 CCGTAGCCTT ATCGCGGACG AGCCGCAAAT CGCCCCGCTT TTGCAGGACA
1001 AACGTGTTGA AATTGTATTG GATGACGGTA GGAAATGGCT GCGTCGCCAT
1051 CCTGATGAAA AATTCGACCT GATTTTGATG AATACGACTT GGTACTGGCG
1101 TGCCTATTCC ACCAACCTGT TGAGTGCGGA ATTTTTAAAA CAGGTGCAAA
1151 GCCACCTTAC CCCGGATGGT ATTGTAATGT TTAATACCAC GCACAGCCCG
1201 CATGCTTTTG CTACCGCCGT ACACAGTATT CCCTATGCAT ACCGCTATGG
1251 GCATATGGTA GTCGGCTCGG CAACCCCGGT AGTTTTCCCT AATAAAGAAC
1301 TGCTCAAGCA ACGTCTCTCC CGGTTGATTT GGCCGGAAAG CGGCAGGCAC
1351 GTATTTGACA GCAGCACCGT GGATGCTGCA GCACAAAAGG TTGTCTCTCG
1401 TATGCTGATT CAGATGACGG AACCTTCGGC TGGTGCGGAA GTCATTACCG
1451 ACGATAATAT GATTGTAGAA TACAAATACG GCAGAGGGAT TTAA
```

This corresponds to the amino acid sequence <SEQ ID 1324; ORF 402.a>:

a402.pep

```
  1 MDIVNTKPNT SLIYMLSFLS GLLSLGIEVL WVRMFSFAAQ SVPQAFSFTL
 51 ACFLTGIAVG AYFGKRICRS RFVDIPFIGQ CFLWAGIADF LILGAAWLLT
101 GFSGFVHHAG IFITLSAVVR GLIFPLVHHV GTDGNKSGRQ VSNVYFANVA
151 GSALGPVLIG FVILDFLSTQ QIYLLICLIS AAVPLFCTLF QKSLRLNAVS
201 VAVSLMFGIL MFLLPDSVFQ NIADRPDRLI ENKHGIVAVY HRDGDKVVYG
251 ANVYDGAYNT DVFNSVNGIE RAYLLPSLKS GIRRIFVVGL STGSWARVLS
301 AIPEMQSMIV AEINPAYRSL IADEPQIAPL LQDKRVEIVL DDGRKWLRRH
```

-continued

```
351 PDEKFDLILM NTTWYWRAYS TNLLSAEFLK QVQSHLTPDG IVMFNTTHSP

401 HAFATAVHSI PYAYRYGHMV VGSATPVVFP NKELLKQRLS RLIWPESGRH

451 VFDSSTVDAA AQKVVSRMLI QMTEPSAGAE VITDDNMIVE YKYGRGI*
```

m402/a402 99.0% identity in 497 aa overlap

```
                   10        20        30        40        50        60
m402.pep    MDIVNTKPNTSLIYMXSFLSGLLSLGIEVLWVRMFSFAAQSVPQAFSFTLACFLTGIAVG
            ||||||||||||||| ||||||||||||||||||||||||||||||||||||||||||||
a402        MDIVNTKPNTSLIYMLSFLSGLLSLGIEVLWVRMFSFAAQSVPQAFSFTLACFLTGIAVG
                   10        20        30        40        50        60

                   70        80        90       100       110       120
m402.pep    AYFGKRICRSRFVDIPFIGQCFLWAGIADFLILGAAWLLTGFSGFVHHAGIFITLSAVVX
            ||||||||||||||||||||||||||||||||||||||||||||||||||||||||||| 
a402        AYFGKRICRSRFVDIPFIGQCFLWAGIADFLILGAAWLLTGFSGFVHHAGIFITLSAVVR
                   70        80        90       100       110       120

                  130       140       150       160       170       180
m402.pep    XLIFPLVHHVGTDGNKSGRQVSNVYFAXVAGSALGPVLIGFVILDFLSTQQIYLLICXIS
             |||||||||||||||||||||||||| ||||||||||||||||||||||||||||| ||
a402        GLIFPLVHHVGTDGNKSGRQVSNVYFANVAGSALGPVLIGFVILDFLSTQQIYLLICLIS
                  130       140       150       160       170       180

                  190       200       210       220       230       240
m402.pep    AAVPLFCTLFQKSLRLNAVSVAVSLMFGILMFLLPDSVFQNIADRPDRLIENKHGIVAVY
            ||||||||||||||||||||||||||||||||||||||||||||||||||||||||||||
a402        AAVPLFCTLFQKSLRLNAVSVAVSLMFGILMFLLPDSVFQNIADRPDRLIENKHGIVAVY
                  190       200       210       220       230       240

                  250       260       270       280       290       300
m402.pep    HRDGDKVVYGANVYDGAYNTDVFNSVNGIERAYLLPSLKSGIRRIFVVGLSTGSWARVLS
            ||||||||||||||||||||||||||||||||||||||||||||||||||||||||||||
a402        HRDGDKVVYGANVYDGAYNTDVFNSVNGIERAYLLPSLKSGIRRIFVVGLSTGSWARVLS
                  250       260       270       280       290       300

                  310       320       330       340       350       360
m402.pep    AIPEMQSMIVAEINPAYRSLIADEPQIAPLLQDKRVEIVLDDGRKWLRRHPDEKFDLILM
            ||||||||||||||||||||||||||||||||||||||||||||||||||||||||||||
a402        AIPEMQSMIVAEINPAYRSLIADEPQIAPLLQDKRVEIVLDDGRKWLRRHPDEKFDLILM
                  310       320       330       340       350       360

                  370       380       390       400       410       420
m402.pep    NTTWYWRAYSTNLLSAEFLKQVQSHLTPDGIVMFNTTHSPHAFATAVHSIPYAYRYGHMV
            ||||||||||||||||||||||||||||||||||||||||||||||||||||||||||||
a402        NTTWYWRAYSTNLLSAEFLKQVQSHLTPDGIVMFNTTHSPHAFATAVHSIPYAYRYGHMV
                  370       380       390       400       410       420

                  430       440       450       460       470       480
m402.pep    VGSATPVVFPNKELLKQRLSRLIWPESGRHVFDSSTVDAAAQKVVSRMLIQMTEPSAGAE
            ||||||||||||||||||||||||||||||||||||||||||||||||||||||||||||
a402        VGSATPVVFPNKELLKQRLSRLIWPESGRHVFDSSTVDAAAQKVVSRMLIQMTEPSAGAE
                  430       440       450       460       470       480

                  490
m402.pep    VITDDNMIVEYKYGRGIX
            |||||||||||||||||
a402        VITDDNMIVEYKYGRGIX
                  490
```

The following partial DNA sequence was identified in *N. gonorrhoeae* <SEQ ID 1325>:

g406.seq

```
  1 ATGCGGGCAC GGCTGCTGAT ACCTATTCTT TTTTCAGTTT TTATTTTATC

 51 CGCCTGCGGG ACACTGACAG GTATTCCATC GCATGGCGGA GGCAAACGCT

101 TCGCGGTCGA ACAAGAACTT GTGGCCGCTT CTGCCAGAGC TGCCGTTAAA

151 GACATGGATT TACAGGCATT ACACGGACGA AAAGTTGCAT TGTACATTGC

201 AACTATGGGC GACCAAGGTT CAGGCAGTTT GACAGGGGGT CGCTACTCCA

251 TTGATGCACT GATTCGCGGC GAATACATAA ACAGCCCTGC CGTCCGCACC

301 GATTACACCT ATCCGCGTTA CGAAACCACC GCTGAAACAA CATCAGGCGG
```

-continued

351 TTTGACGGGT TTAACCACTT CTTTATCTAC ACTTAATGCC CCTGCACTCT

401 CGCGCACCCA ATCAGACGGT AGCGGAAGTA GGAGCAGTCT GGGCTTAAAT

451 ATTGGCGGGA TGGGGGATTA TCGAAATGAA ACCTTGACGA CCAACCCGCG

501 CGACACTGCC TTTCTTTCCC ACTTGGTGCA GACCGTATTT TTCCTGCGCG

551 GCATAGACGT TGTTTCTCCT GCCAATGCCG ATACAGATGT GTTTATTAAC

601 ATCGACGTAT TCGGAACGAT ACGCAACAGA ACCGAAATGC ACCTATACAA

651 TGCCGAAACA CTGAAAGCCC AAACAAAACT GGAATATTTC GCAGTAGACA

701 GAACCAATAA AAAATTGCTC ATCAAACCCA AAACCAATGC GTTTGAAGCT

751 GCCTATAAAG AAAATTACGC ATTGTGGATG GGGCCGTATA AAGTAAGCAA

801 AGGAATCAAA CCGACGGAAG GATTGATGGT CGATTTCTCC GATATCCAAC

851 CATACGGCAA TCATACGGGT AACTCCGCCC CATCCGTAGA GGCTGATAAC

901 AGTCATGAGG GGTATGGATA CAGCGATGAA GCAGTGCGAC AACATAGACA

951 AGGGCAACCT TGA

This corresponds to the amino acid sequence <SEQ ID 1326; ORF 406>:

g406.pep

1 MRARLLIPIL FSVFILSACG TLTGIPSHGG GKRFAVEQEL VAASARAAVK

51 DMDLQALHGR KVALYIATMG DQGSGSLTGG RYSIDALIRG EYINSPAVRT

101 DYTYPRYETT AETTSGGLTG LTTSLSTLNA PALSRTQSDG SGSRSSLGLN

151 IGGMGDYRNE TLTTNPRDTA FLSHLVQTVF FLRGIDVVSP ANADTDVFIN

201 IDVFGTIRNR TEMHLYNAET LKAQTKLEYF AVDRTNKKLL IKPKTNAFEA

251 AYKENYALWM GPYKVSKGIK PTEGLMVDFS DIQPYGNHTG NSAPSVEADN

301 SHEGYGYSDE AVRQHRQGQP *

The following partial DNA sequence was identified in *N. meningitidis* <SEQ ID 1327>:

m406.seq

1 ATGCAAGCAC GGCTGCTGAT ACCTATTCTT TTTTCAGTTT TTATTTTATC

51 CGCCTGCGGG ACACTGACAG GTATTCCATC GCATGGCGGA GGTAAACGCT

101 TTGCGGTCGA ACAAGAACTT GTGGCCGCTT CTGCCAGAGC TGCCGTTAAA

151 GACATGGATT TACAGGCATT ACACGGACGA AAAGTTGCAT TGTACATTGC

201 CACTATGGGC GACCAAGGTT CAGGCAGTTT GACAGGGGGT CGCTACTCCA

251 TTGATGCACT GATTCGTGGC GAATACATAA ACAGCCCTGC CGTCCGTACC

301 GATTACACCT ATCCACGTTA CGAAACCACC GCTGAAACAA CATCAGGCGG

351 TTTGACAGGT TTAACCACTT CTTTATCTAC ACTTAATGCC CCTGCACTCT

401 CTCGCACCCA ATCAGACGGT AGCGGAAGTA AAAGCAGTCT GGGCTTAAAT

451 ATTGGCGGGA TGGGGGATTA TCGAAATGAA ACCTTGACGA CTAACCCGCG

501 CGACACTGCC TTTCTTTCCC ACTTGGTACA GACCGTATTT TTCCTGCGCG

551 GCATAGACGT TGTTTCTCCT GCCAATGCCG ATACAGATGT GTTTATTAAC

-continued

```
601 ATCGACGTAT TCGGAACGAT ACGCAACAGA ACCGAAATGC ACCTATACAA

651 TGCCGAAACA CTGAAAGCCC AAACAAAACT GGAATATTTC GCAGTAGACA

701 GAACCAATAA AAAATTGCTC ATCAAACCAA AAACCAATGC GTTTGAAGCT

751 GCCTATAAAG AAAATTACGC ATTGTGGATG GGGCCGTATA AAGTAAGCAA

801 AGGAATTAAA CCGACGGAAG GATTAATGGT CGATTTCTCC GATATCCGAC

851 CATACGGCAA TCATACGGGT AACTCCGCCC CATCCGTAGA GGCTGATAAC

901 AGTCATGAGG GGTATGGATA CAGCGATGAA GTAGTGCGAC AACATAGACA

951 AGGACAACCT TGA
```

This corresponds to the amino acid sequence <SEQ ID 1328; ORF 406>:

m406.pep

```
  1 MQARLLIPIL FSVFILSACG TLTGIPSHGG GKRFAVEQEL VAASARAAVK

 51 DMDLQALHGR KVALYIATMG DQGSGSLTGG RYSIDALIRG EYINSPAVRT

101 DYTYPRYETT AETTSGGLTG LTTSLSTLNA PALSRTQSDG SGSKSSLGLN

151 IGGMGDYRNE TLTTNPRDTA FLSHLVQTVF FLRGIDVVSP ANADTDVFIN

201 IDVFGTIRNR TEMHLYNAET LKAQTKLEYF AVDRTNKKLL IKPKTNAFEA

251 AYKENYALWM GPYKVSKGIK PTEGLMVDFS DIRPYGNHTG NSAPSVEADN

301 SHEGYGYSDE VVRQHRQGQP *
```

Computer analysis of the amino acid sequences gave the following results:

Homology with a predicted ORF from *N. meningitidis* menA with menB

ORF 406 shows 98.8% identity over a 320 aa overlap with a predicted ORF (ORF406.a) from *N. gonorrhoeae*:

g406/m406

```
                   10        20        30        40        50        60
g406.pep    MRARLLIPILFSVFILSACGTLTGIPSHGGGKRFAVEQELVAASARAAVKDMDLQALHGR
            |:||||||||||||||||||||||||||||||||||||||||||||||||||||||||||
m406        MQARLLIPILFSVFILSACGTLTGIPSHGGGKRFAVEQELVAASARAAVKDMDLQALHGR
                   10        20        30        40        50        60

                   70        80        90       100       110       120
g406.pep    KVALYIATMGDQGSGSLTGGRYSIDALIRGEYINSPAVRTDYTYPRYETTAETTSGGLTG
            ||||||||||||||||||||||||||||||||||||||||||||||||||||||||||||
m406        KVALYIATMGDQGSGSLTGGRYSIDALIRGEYINSPAVRTDYTYPRYETTAETTSGGLTG
                   70        80        90       100       110       120

                  130       140       150       160       170       180
g406.pep    LTTSLSTLNAPALSRTQSDGSGSRSSLGLNIGGMGDYRNETLTTNPRDTAFLSHLVQTVF
            |||||||||||||||||||||||:||||||||||||||||||||||||||||||||||||
m406        LTTSLSTLNAPALSRTQSDGSGSKSSLGLNIGGMGDYRNETLTTNPRDTAFLSHLVQTVF
                  130       140       150       160       170       180

                  190       200       210       220       230       240
g406.pep    FLRGIDVVSPANADTDVFINIDVFGTIRNRTEMHLYNAETLKAQTKLEYFAVDRTNKKLL
            ||||||||||||||||||||||||||||||||||||||||||||||||||||||||||||
m406        FLRGIDVVSPANADTDVFINIDVFGTIRNRTEMHLYNAETLKAQTKLEYFAVDRTNKKLL
                  190       200       210       220       230       240

                  250       260       270       280       290       300
g406.pep    IKPKTNAFEAAYKENYALWMGPYKVSKGIKPTEGLMVDFSDIQPYGNHTGNSAPSVEADN
            ||||||||||||||||||||||||||||||||||||||||||:|||||||||||||||||
m406        IKPKTNAFEAAYKENYALWMGPYKVSKGIKPTEGLMVDFSDIRPYGNHTGNSAPSVEADN
                  250       260       270       280       290       300

                  310       320
g406.pep    SHEGYGYSDEAVRQHRQGQPX
            ||||||||||:||||||||||
m406        SHEGYGYSDEVVRQHRQGQPX
                  310       320
```

The following partial DNA sequence was identified in *N. meningitidis* <SEQ ID 1329>:

a406.seq

```
  1 ATGCAAGCAC GGCTGCTGAT ACCTATTCTT TTTTCAGTTT TTATTTTATC
 51 CGCCTGCGGG ACACTGACAG GTATTCCATC GCATGGCGGA GGTAAACGCT
101 TCGCGGTCGA ACAAGAACTT GTGGCCGCTT CTGCCAGAGC TGCCGTTAAA
151 GACATGGATT TACAGGCATT ACACGGACGA AAAGTTGCAT TGTACATTGC
201 AACTATGGGC GACCAAGGTT CAGGCAGTTT GACAGGGGGT CGCTACTCCA
251 TTGATGCACT GATTCGTGGC GAATACATAA ACAGCCCTGC CGTCCGTACC
301 GATTACACCT ATCCACGTTA CGAAACCACC GCTGAAACAA CATCAGGCGG
351 TTTGACAGGT TTAACCACTT CTTTATCTAC ACTTAATGCC CCTGCACTCT
401 CGCGCACCCA ATCAGACGGT AGCGGAAGTA AAAGCAGTCT GGGCTTAAAT
451 ATTGGCGGGA TGGGGGATTA TCGAAATGAA ACCTTGACGA CTAACCCGCG
501 CGACACTGCC TTTCTTTCCC ACTTGGTACA GACCGTATTT TTCCTGCGCG
551 GCATAGACGT TGTTTCTCCT GCCAATGCCG ATACGGATGT GTTTATTAAC
601 ATCGACGTAT TCGGAACGAT ACGCAACAGA ACCGAAATGC ACCTATACAA
651 TGCCGAAACA CTGAAAGCCC AAACAAAACT GGAATATTTC GCAGTAGACA
701 GAACCAATAA AAAATTGCTC ATCAAACCAA AAACCAATGC GTTTGAAGCT
751 GCCTATAAAG AAAATTACGC ATTGTGGATG GGACCGTATA AAGTAAGCAA
801 AGGAATTAAA CCGACAGAAG GATTAATGGT CGATTTCTCC GATATCCAAC
851 CATACGGCAA TCATATGGGT AACTCTGCCC CATCCGTAGA GGCTGATAAC
901 AGTCATGAGG GGTATGGATA CAGCGATGAA GCAGTGCGAC GACATAGACA
951 AGGGCAACCT TGA
```

This corresponds to the amino acid sequence <SEQ ID 1330; ORF 406.a>:

a406.pep

```
  1 MQARLLIPIL FSVFILSACG TLTGIPSHGG GKRFAVEQEL VAASARAAVK
 51 DMDLQALHGR KVALYIATMG DQGSGSLTGG RYSIDALIRG EYINSPAVRT
101 DYTYPRYETT AETTSGGLTG LTTSLSTLNA PALSRTQSDG SGSKSSLGLN
151 IGGMGDYRNE TLTTNPRDTA FLSHLVQTVF FLRGIDVVSP ANADTDVFIN
201 IDVFGTIRNR TEMHLYNAET LKAQTKLEYF AVDRTNKKLL IKPKTNAFEA
251 AYKENYALWM GPYKVSKGIK PTEGLMVDFS DIQPYGNHMG NSAPSVEADN
301 SHEGYGYSDE AVRRHRQGQP *
```

m406/a406 98.8% identity in 320 aa overlap

```
                   10        20        30        40        50        60
m406.pep   MQARLLIPILFSVFILSACGTLTGIPSHGGGKRFAVEQELVAASARAAVKDMDLQALHGR
           ||||||||||||||||||||||||||||||||||||||||||||||||||||||||||||
a406       MQARLLIPILFSVFILSACGTLTGIPSHGGGKRFAVEQELVAASARAAVKDMDLQALHGR
                   10        20        30        40        50        60
```

-continued

```
                  70        80        90       100       110       120
m406.pep  KVALYIATMGDQGSGSLTGGRYSIDALIRGEYINSPAVRTDYTYPRYETTAETTSGGLTG
          ||||||||||||||||||||||||||||||||||||||||||||||||||||||||||||
a406      KVALYIATMGDQGSGSLTGGRYSIDALIRGEYINSPAVRTDYTYPRYETTAETTSGGLTG
                  70        80        90       100       110       120

                 130       140       150       160       170       180
m406.pep  LTTSLSTLNAPALSRTQSDGSGSKSSLGLNIGGMGDYRNETLTTNPRDTAFLSHLVQTVF
          ||||||||||||||||||||||||||||||||||||||||||||||||||||||||||||
a406      LTTSLSTLNAPALSRTQSDGSGSKSSLGLNIGGMGDYRNETLTTNPRDTAFLSHLVQTVF
                 130       140       150       160       170       180

                 190       200       210       220       230       240
m406.pep  FLRGIDVVSPANADTDVFINIDVFGTIRNRTEMHLYNAETLKAQTKLEYFAVDRTNKKLL
          ||||||||||||||||||||||||||||||||||||||||||||||||||||||||||||
a406      FLRGIDVVSPANADTDVFINIDVFGTIRNRTEMHLYNAETLKAQTKLEYFAVDRTNKKLL
                 190       200       210       220       230       240

                 250       260       270       280       290       300
m406.pep  IKPKTNAFEAAYKENYALWMGPYKVSKGIKPTEGLMVDFSDIRPYGNHTGNSAPSVEADN
          ||||||||||||||||||||||||||||||||||||||||||:||||| |||||||||||
a406      IKPKTNAFEAAYKENYALWMGPYKVSKGIKPTEGLMVDFSDIQPYGNHMGNSAPSVEADN
                 250       260       270       280       290       300

                 310       320
m406.pep  SHEGYGYSDEVVRQHRQGQPX
          ||||||||||:||:|||||||
a406      SHEGYGYSDEAVRRHRQGQPX
                 310       320
```

The following partial DNA sequence was identified in *N. gonorrhoeae* <SEQ ID 1331>:

g501.seq

```
   1 atggtcggac ggaccttgac cgcagatacc gacatatttg ttctgcttgc,
  51 ggcaggcgga gatggcaaga tgcagcatca ctttgacggc agggttgcgt
 101 tcgtcaaacg attcggacac caagccgctg tctcggtcga ggccgagggt
 151 cagctgggtc atgtcgttcg agccgatgga gaagccgtcg aagtattgca
 201 ggaattgttc cgccaatacc gcgttgctcg gcagctcgca catcataatc
 251 aggcgcaggc cgtttttgcc gcgttccaag ccgttttctt tcaatgcctt
 301 aaccactgct tcggcttcgc ccaaagtgcg gacgaacgga atcatgattt
 351 cgacgttggt cagacccatt tcgtcacgaa cgcgtttcaa ggctttgcat
 401 tccaaggcga aacagtcttt gaagctctcg gcaacataac gcgccgcacc
 451 acggaagccc aacatcgggt tttcttcatg cggttcgtat acgctgccgc
 501 cgaccaggtt ggcgtattcg ttggatttga agtcggacat acggacgatg
 551 gttttacgcg gataaaccga tgcggcaagc gttgccacgc cttcggcgat
 601 tttatcgacg tagaagtcga caggggatgc gtaaccggcg atgcggcgga
 651 taatttccgc tttcagttcg tcgtcttgtt tgtcaaattc caacaaggct
 701 ttcgggtgga tgccgatttg gcggttgatg ataaattcca tacgcgccaa
 751 gccgatgcct tcgctgggca gattggcgaa gctgaatgcg agttcgggat
 801 tgccgacgtt catcatgact ttgacgggtg cttttggcat attgtccaag
 851 gcgacatcgg taatttgtac gtccagcagg ccggcataga taaagccggt
 901 atcgccttcg gcacaggata cggtaacttc ctgaccgttt tccaagagtt
 951 cggtcgcatt gccgcagccg acgacggcag gaatacccag ttcgcgcgcg
1001 atgatggcgg cgtggcaggt gcgtccgccg cggttggtca cgatggcgga
1051 agcacgtttc atcacgggtt cccaatccgg atcggtcatg tcggtaacca
1101 gtacgtcgcc ggcttcgacg gaatccatct cggaagcatc tttaatcagg
```

-continued

```
1151 cgcaccttgc cctgaccgac tttttgaccg atggcacgac cttcgcacaa
1201 gacggttttt tcgccgttga tggcgtagcg gcgcaggttg cggctgcctt
1251 cttcttggga tttgacggtt tcggggcggg cttgcaggat gtagagtttg
1301 ccgtccaggc cgtcgcgtcc ccattcgata tccatcgggc ggccgtagtg
1351 tttttcgatg gtcagcgcgt agtgtgccaa ctcggtgatt tcttcgtcgg
1401 taatggagaa gcggttgcgg tcttcttcgg ggacttcgac gttggttacc
1451 gatttgccgg cttcggcttt gtcggtgaaa atcattttga tgtgtttcga
1501 acccatggtc ttgcgcagga tggcgggttt gcctgctttg agcgtgggtt
1551 tgaacacata aaattcgtcc gggttgaccg cgccttgtac gacgttttcg
1601 cccagaccgt aagaggaggt aacaaagacg acttggttgt agccggattc
1651 ggtgtcgagg gtgaacatca cacctga
```

This corresponds to the amino acid sequence <SEQ ID 1332; ORF 501.ng>:

g501.pep

```
  1 MVGRTLTADT DIFVLLAAGG DGKMQHHFDG RVAFVKRFGH QAAVSVEAEG
 51 QLGHVVRADG EAVEVLQELF RQYRVARQLA HHNQAQAVFA AFQAVFFQCL
101 NHCFGFAQSA DERNHDFDVG QTHFVTNAFQ GFAFQGETVF EALGNITRRT
151 TEAQHRVFFM RFVYAAADQV GVFVGFEVGH TDDGFTRINR CGKRCHAFGD
201 FIDVEVDRGC VTGDAADNFR FQFVVLFVKF QQGFRVDADL AVDDKFHTRQ
251 ADAFAGQIGE AECEFGIADV HHDFDGCFWH IVQGDIGNLY VQQAGIDKAG
301 IAFGTGYGNF LTVFQEFGRI AAADDGRNTQ FARDDGGVAG ASAAVGHDGG
351 STFHHGFPIR IGHVGNQYVA GFDGIHLGSI FNQAHLALTD FLTDGTTFAQ
401 DGFFAVDGVA AQVAAAFFLG FDGFGAGLQD VEFAVQAVAS PFDIHRAAVV
451 FFDGQRVVCQ LGDFFVGNGE AVAVFFGDFD VGYRFAGFGF VGENHFDVFR
501 THGLAQDGGF ACFERGFEHI KFVRVDRALY DVFAQTVRGG NKDDLVVAGF
551 GVEGEHHT*
```

The following partial DNA sequence was identified in *N. meningitidis* <SEQ ID 1333>:

m501.seq

```
  1 atggtcggac sggccttgac cgcagatgcc gacatatttg ttctgcttgc
 51 ggcaggcgga gatggcaagg tgcagcatca ctttgacggc agggttgcgt
101 tcgtcaaacg attcggatac caagccgctg tcgcggtcga gaccgagggt
151 cagttgggtc atgtcgttcg agccgatgga gaagccgtcg aagtattgca
201 ggaattgttc cgccaatacc gcgttgctcg gcagctcgca catcataatc
251 aggcgcaggc cgtttttgcc gcgttccaag ccgttttctt tcagggcttt
301 gacaacggmt tcggcttcgc ccaaagtgcg gacgaacgga atcatgattt
351 caacgttggy caaccccatt tcatcgcgga cgcgtttcaa ggctttgcat
```

-continued 401 tccaaggcga aacagtcttt gaagttgtcg gcgacataac gcgccgcacc 451 acggaagccc aacatcgggt tttcttcatg cggttcgtat acgttgccgc 501 cgaccaggtt ggcgtattcg ttggatttga agtcggacat acggacgatg 551 gttttacgcg gataaaccga tgcggccaat gtcgccacgc cttcggcgat 601 tttatcgacg tagaagtcga caggggacgc gtaaccggcg atacggcggg 651 taatttccgc ttttaattcg tcgtcttgtt tgtcaaattc caacaargct 701 ttggggtgga taccgatttg gcggttgatg ataaattcca tacgcgccaa 751 gccgatgcct tcgctgggca ggttggcgaa gctgaatgcg agttcgggat 801 tgccgacgtt catcatgact tttacaggtg ctttaggcat attgtctaag 851 gcgacatcgg taatctgtac gtccaacaga ccggcataga taaagccggt 901 atcgccttcg gcacaggata cggtaacttc ttgaccgttt ttcagcaatt 951 cggttgcatt gccgcagccg acaacggcag gaatgcccaa ttcacgcgcg 1001 atgatggcgg cgtggcaggt acggccgccg cggttggtaa cgatggcaga 1051 agcacgtttc atcacgggtt cccaatccgg atcggtcatg tcggtaacga 1101 gtacgtcgcc ggcttcgacg gaatccatct cggaagcatc tttaatcagg 1151 cgcaccttgc cctgaccgac tttctgaccg atggcgcggc cttcgcataa 1201 tacggttttg tcgccgttga tggcgaagcg gcgcaggttg cggttgccct 1251 cttcttggga ttttacggtt tcgggacggg cttgcaggat gtagagtttg 1301 ccgtccaagc cgtcgcgtcc ccattcgata tccatcgggc ggccgtagtg 1351 tttttcgatg gtcagtgcgt aatgcgccaa ctcagtaatt tcttcgtcgg 1401 taatggagaa gcggttgcgg tcttcctcgg ggacatcgac gttggttacg 1451 gatttaccgg cttctgcttt gtcggtaaaa atcattttga tgtgttttga 1501 acccatggtt ttacgcagga tggcgggctt gcccgytttg agcgtgggtt 1551 tgaacacatr aaattcgtcc gggttgaccg caccttgtac gacgttttcg 1601 cccagaccgt aagaggaggt aacaaagacg acytgatcgt akccggattc 1651 ggtgtcgagg gtgaacatca cacctga This corresponds to the amino acid sequence <SEQ ID 1334; ORF 501>:

m501.pep

1 MVGXALTADA DIFVLLAAGG DGKVQHHFDG RVAFVKRFGY QAAVAVETEG

51 QLGHVVRADG EAVEVLQELF RQYRVARQLA HHNQAQAVFA AFQAVFFQGF

101 DNGFGFAQSA DERNHDFNVG QPHFIADAFQ GFAFQGETVF EVVGDITRRT

151 TEAQHRVFFM RFVYVAADQV GVFVGFEVGH TDDGFTRINR CGQCRHAFGD

201 FIDVEVDRGR VTGDTAGNFR FXFVVLFVKF QQXFGVDTDL AVDDKFHTRQ

251 ADAFAGQVGE AECEFGIADV HHDFYRCFRH IVXGDIGNLY VQQTGIDKAG

301 IAFGTGYGNF LTVFQQFGCI AAADNGRNAQ FTRDDGGVAG TAAAVGNDGR

351 STFHHGFPIR IGHVGNEYVA GFDGIHLGSI FNQAHLALTD FLTDGAAFAX

401 YGFVAVDGEA AQVAVALFLG FYGFGTGLQD VEFAVQAVAS PFDIHRAAVV

451 FFDGQCVMRQ LSNFFVGNGE AVAVFLGDID VGYGFTGFCF VGKNHFDVFX

-continued

```
501 THGFTQDGGL ARFERGFEHX KFVRVDRTLY DVFAQTVRGG NKDDLIVXGF

551 GVEGEHHT*
```

Computer analysis of this amino acid sequence gave the following results:

Homology with a predicted ORF from *N. gonorrhoeae*

ORF 501 shows 86.2% identity over a 558 aa overlap with a predicted ORF (ORF 501.ng) from *N. gonorrhoeae*:

```
m501/g501
                   10        20        30        40        50        60
m501.pep   MVGXALTADADIFVLLAAGGDGKVQHHFDGRVAFVKRFGYQAAVAVETEGQLGHVVRADG
           ||| :||||:|||||||||||||:|||||||||||||||:||||:||:||||||||||||
g501       MVGRTLTADTDIFVLLAAGGDGKMQHHFDGRVAFVKRFGHQAAVSVEAEGQLGHVVRADG
                   10        20        30        40        50        60

                   70        80        90       100       110       120
m501.pep   EAVEVLQELFRQYRVARQLAHHNQAQAVFAAFQAVFFQGFDNGFGFAQSADERNHDFNVG
           |||||||||||||||||||||||||||||||||||||| ::: ||||||||||||||:||
g501       EAVEVLQELFRQYRVARQLAHHNQAQAVFAAFQAVFFQCLNHCFGFAQSADERNHDFDVG
                   70        80        90       100       110       120

                  130       140       150       160       170       180
m501.pep   QPHFIADAFQGFAFQGETVFEVVGDITRRTTEAQHRVFFMRFVYVAADQVGVFVGFEVGH
           | ||:::||||||||||||||::|:|||||||||||||||||||:|||||||||||||||
g501       QTHFVTNAFQGFAFQGETVFEALGNITRRTTEAQHRVFFMRFVYAAADQVGVFVGFEVGH
                  130       140       150       160       170       180

                  190       200       210       220       230       240
m501.pep   TDDGFTRINRCGQCRHAFGDFIDVEVDRGRVTGDTAGNFRFXFVVLFVKFQQXFGVDTDL
           ||||||||||||:  |||||||||||||| ||||:| |||| |||||||||| | ||:||
g501       TDDGFTRINRCGKRCHAFGDFIDVEVDRGCVTGDAADNFRFQFVVLFVKFQQGFRVDADL
                  190       200       210       220       230       240

                  250       260       270       280       290       300
m501.pep   AVDDKFHTRQADAFAGQVGEAECEFGIADVHHDFYRCFRHIVXGDIGNLYVQQTGIDKAG
           |||||||||||||||||:||||||||||||||||  || ||| ||||||||||:||||||
g501       AVDDKFHTRQADAFAGQIGEAECEFGIADVHHDFDGCFWHIVQGDIGNLYVQQAGIDKAG
                  250       260       270       280       290       300

                  310       320       330       340       350       360
m501.pep   IAFGTGYGNFLTVFQQFGCIAAADNGRNAQFTRDDGGVAGTAAAVGNDGRSTFHHGFPIR
           |||||||||||||||:|| |||||:|||:||:||||||||::||||:|| ||||||||||
g501       IAFGTGYGNFLTVFQEFGRIAAADDGRNTQFARDDGGVAGASAAVGHDGGSTFHHGFPIR
                  310       320       330       340       350       360

                  370       380       390       400       410       420
m501.pep   IGHVGNEYVAGFDGIHLGSIFNQAHLALTDFLTDGAAFAXYGFVAVDGEAAQVAVALFLG
           ||||||:||||||||||||||||||||||||||||::||  || |||| |||||:|:|||
g501       IGHVGNQYVAGFDGIHLGSIFNQAHLALTDFLTDGTTFAQDGFFAVDGVAAQVAAAFFLG
                  370       380       390       400       410       420

                  430       440       450       460       470       480
m501.pep   FYGFGTGLQDVEFAVQAVASPFDIHRAAVVFFDGQCVMRQLSNFFVGNGEAVAVFLGDID
           | |||:||||||||||||||||||||||||||||| |: ||::||||||||||||:||:|
g501       FDGFGAGLQDVEFAVQAVASPFDIHRAAVVFFDGQRVVCQLGDFFVGNGEAVAVFFGDFD
                  430       440       450       460       470       480

                  490       500       510       520       530       540
m501.pep   VGYGFTGFCFVGKNHFDVFXTHGFTQDGGLARFERGFEHXKFVRVDRTLYDVFAQTVRGG
           ||| |:|| |||:|||||| |||::||||:| ||||||| |||||||:||||||||||||
g501       VGYRFAGFGFVGENHFDVFRTHGLAQDGGFACFERGFEHIKFVRVDRALYDVFAQTVRGG
                  490       500       510       520       530       540

                  550
m501.pep   NKDDLIVXGFGVEGEHHT
           |||||:| ||||||||||
g501       NKDDLIVAGFGVEGEHHT
                  550
```

The following partial DNA sequence was identified in *N. meningitidis* <SEQ ID 1335>:

```
a501.seq (partial)

  1 ATGGTCGGAC GGGCCTTGAC CGCAGATGCC GACATATTTG TTCTGCTTGC

 51 GGCAGGCGGA GATGGCAAGG TGCAGCATCA CTTTGACGGC AGGGTTGCGT

101 TCGTCAAACG ATTCGGATAC CAAGCCGCTG TCGCGGTCGA GACCGAGGGT
```

-continued

```
151 CAGTTGGGTC ATGTCGTTCG AGCCGATGGA GAAGCCGTCG AAGTATTGCA
201 GGAATTGTTC CGCCAATACC GCGTTGCTCG GCAGCTCGCA CATCATAATC
251 AGGCGCAGGC CGTTTTTGCC GCGTTCCAAG CCGTTTTCTT TCAGGGCTTT
301 GACAACGGCT TCGGCTTCGC CCAAAGTGCG GACGAACGGA ATCATGATTT
351 CAACGTTGGT CAACCCCATT TCATCGCGGA CGCGTTTCAA GGCTTTGCAT
401 TCCAAGGCGA AACAGTCTTT GAAGTTGTCG GCGACATAAC GCGCCGCACC
451 ACGGAAGCCC AACATCGGGT TTTCTTCATG CGGTTCGTAT ACGTTGCCGC
501 CGACCAGGTT GGCGTATTCG TTGGATTTGA AGTCGGACAT ACGGACGATG
551 GTTTTACGCG GATAAACCGA TGCGGCCAAT GTCGCCACGC CTTCGGCGAT
601 TTTATCGACG TAGAAGTCGA CAGGGGACGC GTAACCGGCG ATACGGCGGG
651 TAATTTCCGC TTTTAATTCG TCGTCTTGTT TGTCAAATTC CAACAAGGCT
701 TTGGGGTGGA TACCGATTTG GCGGTTGATG ATAAATTCCA TACGCGCCAA
751 GCCGATGCCT TCGCTGGGCA GGTTGGCGAA GCTGAATGCG AGTTCGGGAT
801 TGCCGACGTT CATCATGACT TTTACAGGTG CTTTAGGCAT GTTGTCCAAA
851 GCAACATCGG TAATTTGTAC GTCCAGCAGG CCGGAGTAGA TGAAGCCGGT
901 ATCGCCTTCG GCACAGGATA CGGTAACTTC TTGACCGTTT TTCAGCAATT
951 CGGTTGCATT GCCGCAGCCG ACAACGGCAG GAATACCCAG TTCGCGCGCG
1001 ATGATGGCGG CGTGGCAGGT ACGTCCGCCC CTGTTGGTCA CGATGGCGGA
1051 AGCGCGTTTC ATCACCGGTT CCCAATCTGG GTCGGTCATG TCGGTAACCA
1101 GTACGTCGCC GGCTTCGACG GAATCCATCT CGGAAGCATC TTTAATCAGG
1151 CGTACCTTGC CCTGACCGAC TTTCTGACCG ATGGCGCGGC CTTCGCACAA
1201 GACGGTTTTT TCGCCGTTGA TAGAAAAGCG GCGCAGGTTG CGGCTGCCTT
1251 CTTCCTGGGA TTTGACGGTT TCGGGACGGG CTTGCAGGAT GTAGAGTTTG
1301 CCGTCCAAGC CGTCGCGTCC CCATTCGATG TCCATCGGGC GGCCGTAGTG
1351 TTTTTCGATG GTCAGTGCGT AATGCGCCAA CTCGGTGATT TCTTCGTCGG
1401 TAATGGAGAA GCGGTTGCGG TCTTCTTCGG GGACATCGAC GTTGGTTACC
1451 GATTTGCCGG CTTCTGCTTT GTCGGTAAAA ATCATTTTGA TGTGTTTTGA
1501 GCCCATGGTT TTGCGCAGGA TGGCAGGTTT GCCTGCTTTC AGCGTGGGTT
1551 TGAACACATA GAATTCGTCG GGATTGACTG CGCCTTGTAC GACGTTTTCG
1601 CCCAGACCGT AGGATGAAGT GACAAAGACG ACTTGGTCGT AACGGGATTC
1651 GGTATCGAGG GTGAACATCA C
```

This corresponds to the amino acid sequence <SEQ ID 1336; ORF 501.a>:

a501.pep

```
  1 MVGRALTADA DIFVLLAAGG DGKVQHHFDG RVAFVKRFGY QAAVAVETEG
 51 QLGHVVRADG EAVEVLQELF RQYRVARQLA HHNQAQAVFA AFQAVFFQGF
101 DNGFGFAQSA DERNHDFNVG QPHFIADAFQ GFAFQGETVF EVVGDITRRT
151 TEAQHRVFFM RFVYVAADQV GVFVGFEVGH TDDGFTRINR CGQCRHAFGD
201 FIDVEVDRGR VTGDTAGNFR F*FVVLFVKF QQGFGVDTDL AVDDKFHTRQ
```

-continued

```
251 ADAFAGQVGE AECEFGIADV HHDFYRCFRH VVQSNIGNLY VQQAGVDEAG

301 IAFGTGYGNF LTVFQQFGCI AAADNGRNTQ FARDDGGVAG TSAPVGHDGG

351 SAFHHRFPIW VGHVGNQYVA GFDGIHLGSI FNQAYLALTD FLTDGAAFAQ

401 DGFFAVDRKA AQVAAAFFLG FDGFGTGLQD VEFAVQAVAS PFDVHRAAVV

451 FFDGQCVMRQ LGDFFVGNGE AVAVFFGDID VGYRFAGFCF VGKNHFDVF*

501 AHGFAQDGRF ACFQRGFEHI EFVGIDCALY DVFAQTVG*S DKDDLVVTGF

551 GIEGEHH
```

m501/a501 90.3% identity in 557 aa overlap

```
                   10        20        30        40        50        60
m501.pep   MVGXALTADADIFVLLAAGGDGKVQHHFDGRVAFVKRFGYQAAVAVETEGQLGHVVRADG
           ||| ||||||||||||||||||||||||||||||||||||||||||||||||||||||||
a501       MVGRALTADADIFVLLAAGGDGKVQHHFDGRVAFVKRFGYQAAVAVETEGQLGHVVRADG
                   10        20        30        40        50        60

                   70        80        90       100       110       120
m501.pep   EAVEVLQELFRQYRVARQLAHHNQAQAVFAAFQAVFFQGFDNGFGFAQSADERNHDFNVG
           ||||||||||||||||||||||||||||||||||||||||||||||||||||||||||||
a501       EAVEVLQELFRQYRVARQLAHHNQAQAVFAAFQAVFFQGFDNGFGFAQSADERNHDFNVG
                   70        80        90       100       110       120

                  130       140       150       160       170       180
m501.pep   QPHFIADAFQGFAFQGETVFEVVGDITRRTTEAQHRVFFMRFVYVAADQVGVFVGFEVGH
           ||||||||||||||||||||||||||||||||||||||||||||||||||||||||||||
a501       QPHFIADAFQGFAFQGETVFEVVGDITRRTTEAQHRVFFMRFVYVAADQVGVFVGFEVGH
                  130       140       150       160       170       180

                  190       200       210       220       230       240
m501.pep   TDDGFTRINRCGQCRHAFGDFIDVEVDRGRVTGDTAGNFRFXFVVLFVKFQQXFGVDTDL
           |||||||||||||||||||||||||||||||||||||||||||||||||||| |||||||
a501       TDDGETRINRCGQCRHAFGDFIDVEVDRGRVTGDTAGNFRFXFVVLFVKFQQGFGVDTDL
                  190       200       210       220       230       240

                  250       260       270       280       290       300
m501.pep   AVDDKFHTRQADAFAGQVGEAECEFGIADVHHDFYRCFRHIVXGDIGNLYVQQTGIDKAG
           ||||||||||||||||||||||||||||||||||||||||:| ::||||||||:|:|:||
a501       AVDDKFHTRQADAFAGQVGEAECEFGIADVHHDFYRCFRHVVQSNIGNLYVQQAGVDEAG
                  250       260       270       280       290       300

                  310       320       330       340       350       360
m501.pep   IAFGTGYGNFLTVFQQFGCIAAADNGRNAQFTRDDGGVAGTAAAVGNDGRSTFHHGFPIR
           ||||||||||||||||||||||||||||:||:|||||||||:| ||:|| |:||| |||
a501       IAFGTGYGNFLTVFQQFGCIAAADNGRNTQFARDDGGVAGTSAPVGHDGGSAFHHRFPIW
                  310       320       330       340       350       360

                  370       380       390       400       410       420
m501.pep   IGHVGNEYVAGFDGIHLGSIFNQAHLALTDFLTDGAAFAXYGFVAVDGEAAQVAVALFLG
           :|||||:|||||||||||||||||:||||||||||||||  || ||| :|||||:|:|||
a501       VGHVGNQYVAGFDGIHLGSIFNQAYLALTDFLTDGAAFAQDGFFAVDRKAAQVAAAFFLG
                  370       380       390       400       410       420

                  430       440       450       460       470       480
m501.pep   FYGFGTGLQDVEFAVQAVASPFDIHRAAVVFFDGQCVMRQLSNFFVGNGEAVAVFLGDID
           | |||||||||||||||||||||:|||||||||||||||||::||||||||||||:||||
a501       FDGFGTGLQDVEFAVQAVASPFDVHRAAVVFFDGQCVMRQLGDFFVGNGEAVAVFFGDID
                  430       440       450       460       470       480

                  490       500       510       520       530       540
m501.pep   VGYGFTGFCFVGKNHFDVFXTHGFTQDGGLARFERGFEHXKFVRVDRTLYDVFAQTVRGG
           ||| |:||||||||||||||:|||:||| :| |:||||| :|| :| :|||||||||  :
a501       VGYRFAGFCFVGKNHFDVFXAHGFAQDGRFACFQRGFEHIEFVGIDCALYDVFAQTVGXS
                  490       500       510       520       530       540

                  550       559
m501.pep   NKDDLIVXGFGVEGEHHTX
           :||||:|:|||:|||||
a501       DKDDLVVTGFGIEGEHH
                  550
```

The following partial DNA sequence was identified in *N. gonorrhoeae* <SEQ ID 1337>:

g502.seq

```
  1 atgatgaaac cgcacaacct gttccaattc ctcgccgttt gctccctgac

 51 cgtcgccgtc gcttccgcac aggcgggcgc ggtggacgcg ctcaagcaat
```

-continued

```
101 tcaacaacga tgccgacggt atcagcggca gcttcaccca aaccgtccaa
151 agcaaaaaga aaacccaaac cgcgcacggc acgttcaaaa tcctgcgccc
201 gggcctcttc aaatgggaat acactttgcc ctacagacag actattgtcg
251 gcgacggtca aaccgtttgg ctctacgatg ttgatttggc acaagtgacc
301 aagtcgtccc aagaccaggc catcggcggc agccccgccg ccatcctgtc
351 gaacaaaacc gccctcgaaa gcagttacac gctgaaagag gacggttcgt
401 ccaacggcat cgattatgtg cggggcaacg cccaaacgca acaacgccgg
451 ctaccaatac atccgcatcg gcttcaaagg cggcaacctc gccgccatgc
501 agcttaa
```

This corresponds to the amino acid sequence <SEQ ID 1338; ORF 502.ng>:

g502.pep

```
  1 MMKPHNLFQF LAVCSLTVAV ASAQAGAVDA LKQFNNDADG ISGSFTQTVQ
 51 SKKKTQTAHG TFKILRPGLF KWEYTLPYRQ TIVGDGQTVW LYDVDLAQVT
101 KSSQDQAIGG SPAAILSNKT ALESSYTLKE DGSSNGIDYV RGNAQTQQRR
151 LPIHPHRLQR RQPRRHAA*
```

The following partial DNA sequence was identified in *N. meningitidis* <SEQ ID 1339>:

m502.seq

```
  1 atgatgaaac cgcacaacct gttccaattc ctcgccgttt gctccctgac
 51 cgtcgccgtc gcttccgcac aggcgggcgc ggtagacgcg cttaagcaat
101 tcaacaacga tgccgacggt atcagcggca gcttcaccca amccgtccaa
151 wgcaaaaaga aaacccaaac cgcgcacggc acgttcaaaa tcctgcgacc
201 gggccttttc aaatgggaat acaccaaact t.acaggcaa accatcgtcg
251 gcgacggtca aacygtttgg ctmtacgatg tygatctggc acaagtgacc
301 aagtcgtccc aagaccaggc cataggcgsc agccccgccg ccatcctgtc
351 gaacaaarcc gccctcgaaa gcagctacac gctgaaagag gacggttcgt
401 ccaacggcat cgattatgtg ggcaacgccc aaacgcaaca acgccggcta
451 ccaatacatc cgcatcggct tcaaaggcgg caacctcgcc gccatgcagc
501 tyaa
```

This corresponds to the amino acid sequence <SEQ ID 1340; ORF 502.ng>:

m502.pep

```
  1 MMKPHNLFQF LAVCSLTVAV ASAQAGAVDA LKQFNNDADG ISGSFTQXVQ
 51 XKKKTQTAHG TFKILRPGLF KWEYTKLYRQ TIVGDGQTVW LYDVDLAQVT
101 KSSQDQAIGX SPAAILSNKX ALESSYTLKE DGSSNGIDYV GNAQTQQRRL
151 PIHPHRLQRR QPRRHAAX
```

Computer analysis of this amino acid sequence gave the following results:

Homology with a predicted ORF from *N. gonorrhoeae*

ORF 502 shows 95.8% identity over a 168 aa overlap with a predicted ORF (ORF 502.ng) from *N. gonorrhoeae*:

m502/g502

```
                10        20        30        40        50        60
m502.pep  MMKPHNLFQFLAVCSLTVAVASAQAGAVDALKQFNNDADGISGSFTQXVQXKKKTQTAHG
          ||||||||||||||||||||||||||||||||||||||||||||||||:|| ||||||||
g502      MMKPHNLFQFLAVCSLTVAVASAQAGAVDALKQFNNDADGISGSFTQTVQSKKKTQTAHG
                10        20        30        40        50        60

                70        80        90       100       110       120
m502.pep  TFKILRPGLFKWEYTKLYRQTIVGDGQTVWLYDVDLAQVTKSSQDQAIGXSPAAILSNKX
          ||||||||||||||| |||||||||||||||||||||||||||||||||| ||||||||:
g502      TFKILRPGLFKWEYTLPYRQTIVGDGQTVWLYDVDLAQVTKSSQDQAIGGSPAAILSNKT
                70        80        90       100       110       120

               130       140       150       160
m502.pep  ALESSYTLKEDGSSNGIDYV-GNAQTQQRRLPIHPHRLQRRQPRRHAA
          |||||||||||||||||||| |||||||||||||||||||||||||||
g502      ALESSYTLKEDGSSNGIDYVRGNAQTQQRRLPIHPHRLQRRQPRRHAA
               130       140       150       160
```

The following partial DNA sequence was identified in *N. meningitidis* <SEQ ID 1341>:

a502.seq

```
  1 ATGATGAAAC CGCACAACCT GTTCCAATTC CTCGCCGTTT GCTCCCTGAC
 51 CGTCTCCGTC GCTTCCGCAC AGGCGGGCGC GGTGGACGCG CTCAAGCAAT
101 TCAACAACGA TGCCGACGGT ATCAGCGGCA GCTTCACCCA AACCGTCCAA
151 AGCAAAAAGA AAACCCAAAC CGCGCACGGC ACGTTCAAAA TCCTGCGCCC
201 GGGCCTCTTT AAATGGGAAT ACACTTCGCC TTACAAACAG ACTATTGTCG
251 GCGACGGTCA AACCGTTTGG CTCTACGATG TCGATTTGGC ACAAGTGACC
301 AAGTCGTCCC AAGACCAGGC CATAGGCGGC AGCCCCGCCG CCATCCTGTC
351 GAACAAAACC GCCCTCGAAA GCAGCTACAC GCTGAAAGAG GACGGTTCGT
401 CCAACGGCAT CGATTATGTG GGCAACGCCC AAACGCAACA ACGCCGGCTA
451 CCAATACATC CGCATCGGCT TCAAAGGCGG CAACCTCGCC GCCATGCAGC
501 TTAA
```

This corresponds to the amino acid sequence <SEQ ID 1342; 502 217.a>:

a502.pep

```
  1 MMKPHNLFQF LAVCSLTVSV ASAQAGAVDA LKQFNNDADG ISGSFTQTVQ
 51 SKKKTQTAHG TFKILRPGLF KWEYTSPYKQ TIVGDGQTVW LYDVDLAQVT
101 KSSQDQAIGG SPAAILSNKT ALESSYTLKE DGSSNGIDYV GNAQTQQRRL
151 PIHPHRLQRR QPRRHAA*
```

m502/a502 95.2% identity in 167 aa overlap

```
                10        20        30        40        50        60
m502.pep  MMKPHNLFQFLAVCSLTVAVASAQAGAVDALKQFNNDADGISGSFTQXVQXKKKTQTAHG
          |||||||||||||||||:||||||||||||||||||||||||||||:|| |||||||||
a502      MMKPHNLFQFLAVCSLTVSVASAQAGAVDALKQFNNDADGISGSFTQTVQSKKKTQTAHG
                10        20        30        40        50        60

                70        80        90       100       110       120
m502.pep  TFKILRPGLFKWEYTKLYRQTIVGDGQTVWLYDVDLAQVTKSSQDQAIGXSPAAILSNKX
          |||||||||||||||:  |:|||||||||||||||||||||||||||||| |||||||||:
a502      TFKILRPGLFKWEYTSPYKQTIVGDGQTVWLYDVDLAQVTKSSQDQAIGGSPAAILSNKT
                70        80        90       100       110       120

               130       140       150       160
m502.pep  ALESSYTLKEDGSSNGIDYVGNAQTQQRRLPIHPHRLQRRQPRRHAAX
          ||||||||||||||||||||||||||||||||||||||||||||||||
a502      ALESSYTLKEDGSSNGIDYVGNAQTQQRRLPIHPHRLQRRQPRRHAAX
               130       140       150       160
```

The following partial DNA sequence was identified in *N. gonorrhoeae* <SEQ ID 1343>:

g502-1.seq

```
  1 ATGatGAAAc cgcaCaacct gttccaaTTc CTCGCCGTTT GCTCCCTGAC
 51 CGTCGCCGTC GCTTCCGCAC AGGCGGGCGC GGTGGACGCG CTCAAGCAAT
101 TCAACAACGA TGCCGACGGT ATCAGCGGCA GCTTCACCCA AACCGTCCAA
151 AGCAAAAAGA AAACCCAAAC CGCGCACGGC ACGTTCAAAA TCCTGCGCCC
201 GGGCCTCTTC AAATGGGAAT ACACTTTGCC CTACAGACAG ACTATTGTCG
251 GCGACGGTCA AACCGTTTGG CTCTACGATG TTGATTTGGC ACAAGTGACC
301 AAGTCGTCCC AAGACCAGGC CATCGGCGGC AGCCCCGCCG CCATCCTGTC
351 GAACAAAACC GCCCTCGAAA GCAGTTACAC GCTGAAAGAG GACGGTTCGT
401 CCAACGGCAT CGATTATGTG CGGGCAACGC CCAAACGCAA CAACGCCGGC
451 TACCAATACA TCCGCATCGG CTTCAAAGGC GGCAACCTCG CCGCCATGCA
501 GCTTAAAGAC AGCTTCGGCA ACCAAACCTC CATCAGTTTC GGCGGTTTGA
551 ATACCAATCC CCAACTCTCG CGCGGCGCGT TCAAGTTTAC CCCGCCCAAA
601 GGCGTGGACG TGTTGAGCAA CTGA
```

This corresponds to the amino acid sequence <SEQ ID 1344; ORF 502-1.ng>:

g502-1.pep

```
  1 MMKPHNLFQF LAVCSLTVAV ASAQAGAVDA LKQFNNDADG ISGSFTQTVQ
 51 SKKKTQTAHG TFKILRPGLF KWEYTLPYRQ TIVGDGQTVW LYDVDLAQVT
101 KSSQDQAIGG SPAAILSNKT ALESSYTLKE DGSSNGIDYV RATPKRNNAG
151 YQYIRIGFKG GNLAAMQLKD SFGNQTSISF GGLNTNPQLS RGAFKFTPPK
201 GVDVLSN*
```

The following partial DNA sequence was identified in *N. meningitidis* <SEQ ID 1345>:

m502-1.seq

```
  1 ATGATGAAAC CGCACAACCT GTTCCAATTC CTCGCCGTTT GCTCCCTGAC
 51 CGTCGCCGTC GCTTCCGCAC AGGCGGGCGC GGTAGACGCG CTTAAGCAAT
101 TCAACAACGA TGCCGACGGT ATCAGCGGCA GCTTCACCCA AACCGTCCAA
```

-continued

```
151 AGCAAAAAGA AAACCCAAAC CGCGCACGGC ACGTTCAAAA TCCTGCGACC
201 GGGCCTTTTC AAATGGGAAT ACACCAAACC TTACAGGCAA ACCATCGTCG
251 GCGACGGTCA AACCGTTTGG CTCTACGATG TTGATCTGGC ACAAGTGACC
301 AAGTCGTCCC AAGACCAGGC CATAGGCGGC AGCCCCGCCG CCATCCTGTC
351 GAACAAAACC GCCCTCGAAA GCAGCTACAC GCTGAAAGAG GACGGTTCGT
401 CCAACGGCAT CGATTATGTG CTGGCAACGC CCAAACGCAA CAACGCCGGC
451 TACCAATACA TCCGCATCGG CTTCAAAGGC GGCAACCTCG CCGCCATGCA
501 GCTTAAAGAC AGCTTCGGCA ACCAAACCTC CATCAGTTTC GGCGGTTTGA
551 ATACCAATCC CCAACTCTCG CGCGGCGCGT TCAAGTTTAC CCCGCCCAAA
601 GGCGTGGACG TGTTGAGCAA CTGA
```

This corresponds to the amino acid sequence <SEQ ID 1346; ORF 502-1>:

m502-1.pep

```
  1 MMKPHNLFQF LAVCSLTVAV ASAQAGAVDA LKQFNNDADG ISGSFTQTVQ
 51 SKKKTQTAHG TFKILRPGLF KWEYTKPYRQ TIVGDGQTVW LYDVDLAQVT
101 KSSQDQAIGG SPAAILSNKT ALESSYTLKE DGSSNGIDYV LATPKRNNAG
151 YQYIRIGFKG GNLAAMQLKD SFGNQTSISF GGLNTNPQLS RGAFKFTPPK
201 GVDVLSN*
```

m502-1/g502-1 99.0% identity in 207 aa overlap

```
                    10        20        30        40        50        60
m502-1.pep  MMKPHNLFQFLAVCSLTVAVASAQAGAVDALKQFNNDADGISGSFTQTVQSKKKTQTAHG
            ||||||||||||||||||||||||||||||||||||||||||||||||||||||||||||
g502-1      MMKPHNLFQFLAVCSLTVAVASAQAGAVDALKQFNNDADGISGSFTQTVQSKKKTQTAHG
                    10        20        30        40        50        60

                    70        80        90       100       110       120
m502-1.pep  TFKILRPGLFKWEYTKPYRQTIVGDGQTVWLYDVDLAQVTKSSQDQAIGGSPAAILSNKT
            ||||||||||||||| ||||||||||||||||||||||||||||||||||||||||||||
g502-1      TFKILRPGLFKWEYTLPYRQTIVGDGQTVWLYDVDLAQVTKSSQDQAIGGSPAAILSNKT
                    70        80        90       100       110       120

                   130       140       150       160       170       180
m502-1.pep  ALESSYTLKEDGSSNGIDYVLATPKRNNAGYQYIRIGFKGGNLAAMQLKDSFGNQTSISF
            |||||||||||||||||||| |||||||||||||||||||||||||||||||||||||||
g502-1      ALESSYTLKEDGSSNGIDYVRATPKRNNAGYQYIRIGFKGGNLAAMQLKDSFGNQTSISF
                   130       140       150       160       170       180

                   190       200
m502-1.pep  GGLNTNPQLSRGAFKFTPPKGVDVLSNX
            ||||||||||||||||||||||||||||
g502-1      GGLNTNPQLSRGAFKFTPPKGVDVLSNX
                   190       200
```

The following partial DNA sequence was identified in *N. meningitidis* <SEQ ID 1347>:

a502-1.seq

```
  1 ATGATGAAAC CGCACAACCT GTTCCAATTC CTCGCCGTTT GCTCCCTGAC
 51 CGTCTCCGTC GCTTCCGCAC AGGCGGGCGC GGTGGACGCG CTCAAGCAAT
101 TCAACAACGA TGCCGACGGT ATCAGCGGCA GCTTCACCCA AACCGTCCAA
```

-continued

```
151 AGCAAAAAGA AAACCCAAAC CGCGCACGGC ACGTTCAAAA TCCTGCGCCC

201 GGGCCTCTTT AAATGGGAAT ACACTTCGCC TTACAAACAG ACTATTGTCG

251 GCGACGGTCA AACCGTTTGG CTCTACGATG TCGATTTGGC ACAAGTGACC

301 AAGTCGTCCC AAGACCAGGC CATAGGCGGC AGCCCCGCCG CCATCCTGTC

351 GAACAAAACC GCCCTCGAAA GCAGCTACAC GCTGAAAGAG GACGGTTCGT

401 CCAACGGCAT CGATTATGTG CTGGCAACGC CCAAACGCAA CAACGCCGGC

451 TACCAATACA TCCGCATCGG CTTCAAAGGC GGCAACCTCG CCGCCATGCA

501 GCTTAAAGAC AGCTTCGGCA ATCAAACCTC CATCAGTTTC GGCGGTTTGA

551 ATACCAATCC CCAACTCTCG CGCGGCGCGT TCAAGTTTAC CCCGCCCAAA

601 GGCGTGGACG TGTTGAGCAA CTGA
```

This corresponds to the amino acid sequence <SEQ ID 1348; ORF 502-1.a>:

a502-1.pep

```
  1 MMKPHNLFQF LAVCSLTVSV ASAQAGAVDA LKQFNNDADG ISGSFTQTVQ

 51 SKKKTQTAHG TFKILRPGLF KWEYTSPYKQ TIVGDGQTVW LYDVDLAQVT

101 KSSQDQAIGG SPAAILSNKT ALESSYTLKE DGSSNGIDYV LATPKRNNAG

151 YQYIRIGFKG GNLAAMQLKD SFGNQTSISF GGLNTNPQLS RGAFKFTPPK

201 GVDVLSN*
```

a502-1/m502-1 98.6% identity in 207 aa overlap

```
                   10        20        30        40        50        60
a502-1.pep  MMKPHNLFQFLAVCSLTVSVASAQAGAVDALKQFNNDADGISGSFTQTVQSKKKTQTAHG
            |||||||||||||||||||:||||||||||||||||||||||||||||||||||||||||
m502-1      MMKPHNLFQFLAVCSLTVAVASAQAGAVDALKQFNNDADGISGSFTQTVQSKKKTQTAHG
                   10        20        30        40        50        60

                   70        80        90       100       110       120
a502-1.pep  TFKILRPGLFKWEYTSPYKQTIVGDGQTVWLYDVDLAQVTKSSQDQAIGGSPAAILSNKT
            |||||||||||||||:||:|||||||||||||||||||||||||||||||||||||||||
m502-1      TFKILRPGLFKWEYTKPYRQTIVGDGQTVWLYDVDLAQVTKSSQDQAIGGSPAAILSNKT
                   70        80        90       100       110       120

                  130       140       150       160       170       180
a502-1.pep  ALESSYTLKEDGSSNGIDYVLATPKRNNAGYQYIRIGFKGGNLAAMQLKDSFGNQTSISF
            ||||||||||||||||||||||||||||||||||||||||||||||||||||||||||||
m502-1      ALESSYTLKEDGSSNGIDYVLATPKRNNAGYQYIRIGFKGGNLAAMQLKDSFGNQTSISF
                  130       140       150       160       170       180

                  190       200
a502-1.pep  GGLNTNPQLSRGAFKFTPPKGVDVLSNX
            ||||||||||||||||||||||||||||
m502-1      GGLNTNPQLSRGAFKFTPPKGVDVLSNX
                  190       200
```

The following partial DNA sequence was identified in *N. gonorrhoeae* <SEQ ID 1349>:

g503.seq

```
  1 atgtccgcgc cgtcggcatc ggtaatcatt ttgttccatg ccgcttcgat

 51 ttcggcatcg agctgttcgg ggaagggcgt gtccaaaatc cattggcgga

101 tttctttgcc gacgcgtgcc agttcggaaa cgtcttcgac atccaatttt
```

-continued

```
151 gccagagcgg cggaaatgcg ttcgttcaga ccgttgtgtg cgagaaatgc

201 gcggtag
```

This corresponds to the amino acid sequence <SEQ ID 1350; ORF 503.ng>:

g503.pep

```
  1 MSAPSASVII LFHAASISAS SCSGKGVSKI HWRISLPTRA SSETSSTSNF

 51 ARAAEMRSFR PLCARNAR*
```

The following partial DNA sequence was identified in *N. meningitidis* <SEQ ID 1351>:

m503.seq

```
  1 atgtccgcac cgccggcatc ggcaaccatt ttgttccatg ccgcttcgat

 51 ttcggcatcg agctgttcgg ggaaaggcgt atccaaaatc cattggcgga

101 tttctttgcc gacgcgtgcc agttcggcaa cgtcttcgac atccaatttt

151 gccagtgcgg cggaaatgcg ttcgctcaga ccgttgtgtg cgaggaatgc

201 gcggtag
```

This corresponds to the amino acid sequence <SEQ ID 1352; ORF 503>:

m503.pep

```
 1 MSAPPASATI LFHAASISAS SCSGKGVSKI HWRISLPTRA SSATSSTSNF

51 ASAAEMRSLR PLCARNAR*
```

Computer analysis of this amino acid sequence gave the following results:

Homology with a predicted ORF from *N. gonorrhoeae*

ORF 503 shows 91.2% identity over a 68 aa overlap with a predicted ORF (ORF 503.ng) from *N. gonorrhoeae*:

m503/g503

```
                   10        20        30        40        50        60
m503.pep    MSAPPASATILFHAASISASSCSGKGVSKIHWRISLPTRASSATSSTSNFASAAEMRSLR
            |||| ||: ||||||||||||||||||||||||||||||||| |||||||| ||||||:|
g503        MSAPSASVIILFHAASISASSCSGKGVSKIHWRISLPTRASSETSSTSNFARAAEMRSFR
                   10        20        30        40        50        60

                   69
m503.pep    PLCARNAR
            ||||||||
g503        PLCARNAR
```

The following partial DNA sequence was identified in *N. meningitidis* <SEQ ID 1353>:

a503.seq

```
  1 ATGTCCGCGC CGCCGGCATC GGCAACCATT TTGTTCCATG CCGCTTCGAT
 51 TTCGGCATCG AGCTGTTCGG GGAAGGGCGT GTCCAAAATC CATTGGCGGA
101 TTTCTTTGCC GACGCGTGCC AGTTCGGCAA CGTCTTCGAC ATCTAATTTT
151 GCCAGTGCGG CGGAAATGCG TTCGCTCAGA CCGTTGTGTG CGAGGAATGC
201 GCGGTAG
```

This corresponds to the amino acid sequence <SEQ ID 1354; ORF 503.a>:

a503.pep

```
 1 MSAPPASATI LFHAASISAS SCSGKGVSKI HWRISLPTRA SSATSSTSNF
51 ASAAEMRSLR PLCARNAR*
```

m503/a503 100.0% identity in 68 aa overlap

```
                    10        20        30        40        50        60
m503.pep   MSAPPASATILFHAASISASSCSGKGVSKIHWRISLPTRASSATSSTSNFASAAEMRSLR
           ||||||||||||||||||||||||||||||||||||||||||||||||||||||||||||
a503       MSAPPASATILFHAASISASSCSGKGVSKIHWRISLPTRASSATSSTSNFASAAEMRSLR
                    10        20        30        40        50        60

                  69
m503.pep   PLCARNARX
           |||||||||
a503       PLCARNARX
```

The following partial DNA sequence was identified in *N. gonorrhoeae* <SEQ ID 1355>:

g503.1-seq

```
  1 ATGGCGCGGT CGTTGTACAG GGAGGCGAAA ACGTGGCGCA TCGCTTTTTT
 51 AACGTTATCC AAGCCATTGA TATTCAGGAA GGTTTCCTGT TGGCCGGCAA
101 ATGATGCGTC GGGCAGGTCT TCGGCGGTTG CGGAAGAGCG TACGGCAACG
151 GAAATGTCCG CGCCGTCGGC ATCGGTAATC ATTTTGTTCC ATGCCGCTTC
201 GATTTCGGCA TCGAGCTGTT CGGGGAAGGG CGTGTCCAAA ATCCATTGGC
251 GGATTTCTTT GCCGACGCGT GCCAGTTCGG AAACGTCTTC GACATCCAAT
301 TTTGCCAGAG CGGCGGAAAT GCGTTCGTTC AGACCGTTGT GTGCGAGAAA
351 TGCGCGGTAG
```

This corresponds to the amino acid sequence <SEQ ID 1356; ORF 214.ng>:

g503-1.pep

```
  1 MARSLYREAK TWRIAFLTLS KPLIFRKVSC WPANDASGRS SAVAEERTAT
 51 EMSAPSASVI ILFHAASISA SSCSGKGVSK IHWRISLPTR ASSETSSTSN
101 FARAAEMRSF RPLCARNAR*
```

The following partial DNA sequence was identified in *N. meningitidis* <SEQ ID 1357>:

m503-1.seq

```
  1 ATGGCACGGT CGTTATACAG GGAAGCGAAT ACATGGTGCA TCGCTTCTTT
 51 AACGTTATCC AAGCCGTTGA TGTTCAAGAA GGTTTCCTGT TGTCCAGCGA
101 ATGATGCGTC CGGCAGGTCT TCGGCAGTTG CGGAAGAACG TACGGCAACG
151 GAAATGTCCG CACCGCCGGC ATCGGCAACC ATTTTGTTCC ATGCCGCTTC
201 GATTTCGGCA TCGAGCTGTT CGGGGAAAGG CGTATCCAAA ATCCATTGGC
251 GGATTTCTTT GCCGACGCGT GCCAGTTCGG CAACGTCTTC GACATCCAAT
301 TTTGCCAGTG CGGCGGAAAT GCGTTCGCTC AGACCGTTGT GTGCGAGGAA
351 TGCGCGGTAG
```

This corresponds to the amino acid sequence <SEQ ID 1358; ORF 503-1>:

m503-1.pep

```
  1 MARSLYREAN TWCIASLTLS KPLMFKKVSC CPANDASGRS SAVAEERTAT
 51 EMSAPPASAT ILFHAASISA SSCSGKGVSK IHWRISLPTR ASSATSSTSN
101 FASAAEMRSL RPLCARNAR*
```

g503-1/m503-1 89.9% identity in 119 aa overlap

```
                    10        20        30        40        50        60
g503-1.pep  MARSLYREAKTWRIAFLTLSKPLIFRKVSCWPANDASGRSSAVAEERTATEMSAPSASVI
            |||||||||:|| || |||||||:|:|||| ||||||||||||||||||||||| ||:
m503-1      MARSLYREANTWCIASLTLSKPLMFKKVSCCPANDASGRSSAVAEERTATEMSAPPASAT
                    10        20        30        40        50        60

                    70        80        90       100       110       120
g503-1.pep  ILFHAASISASSCSGKGVSKIHWRISLPTRASSETSSTSNFARAAEMRSFRPLCARNARX
            |||||||||||||||||||||||||||||||| |||||||| ||||||:||||||||||
m503-1      ILFHAASISASSCSGKGVSKIHWRISLPTRASSATSSTSNFASAAEMRSLRPLCARNARX
                    70        80        90       100       110       120
```

The following partial DNA sequence was identified in *N. meningitidis* <SEQ ID 1359>:

a503-1.seq

```
  1 ATGGCGCGGT CGTTGTACAG GGAGGCGAAT ACATGGCGCA TCGCTTCTTT
 51 AACGTTTTCC AAGCCGTTGA TATTCAGGAA GGTTTCCTGT TGGCCGGCAA
101 ATGATGCGTC GGGCAGGTCT TCGGCGGTTG CGGAAGAGCG TACGGCAACG
151 GAAATGTCCG CGCCGCCGGC ATCGGCAACC ATTTTGTTCC ATGCCGCTTC
201 GATTTCGGCA TCGAGCTGTT CGGGGAAGGG CGTGTCCAAA ATCCATTGGC
251 GGATTTCTTT GCCGACGCGT GCCAGTTCGG CAACGTCTTC GACATCTAAT
301 TTTGCCAGTG CGGCGGAAAT GCGTTCGCTC AGACCGTTGT GTGCGAGGAA
351 TGCGCGGTAG
```

This corresponds to the amino acid sequence <SEQ ID 1360; ORF 503-1.a>:

a503-1.pep

```
  1 MARSLYREAN TWRIASLTFS KPLIFRKVSC WPANDASGRS SAVAEERTAT

 51 EMSAPPASAT ILFHAASISA SSCSGKGVSK IHWRISLPTR ASSATSSTSN

101 FASAAEMRSL RPLCARNAR*
```

a503-1/m503-1 95.8% identity in 119 aa overlap

```
                    10        20        30        40        50        60
a503-1.pep  MARSLYREANTWRIASLTFSKPLIFRKVSCWPANDASGRSSAVAEERTATEMSAPPASAT
            |||||||||||| |||||:||||:|:|||| |||||||||||||||||||||||||||||
m503-1      MARSLYREANTWCIASLTLSKPLMFKKVSCCPANDASGRSSAVAEERTATEMSAPPASAT
                    10        20        30        40        50        60

                    70        80        90       100       110       120
a503-1.pep  ILFHAASISASSCSGKGVSKIHWRISLPTRASSATSSTSNFASAAEMRSLRPLCARNARX
            ||||||||||||||||||||||||||||||||||||||||||||||||||||||||||||
m503-1      ILFHAASISASSCSGKGVSKIHWRISLPTRASSATSSTSNFASAAEMRSLRPLCARNARX
                    70        80        90       100       110       120
```

The following partial DNA sequence was identified in *N. gonorrhoeae* <SEQ ID 1361>:

g504.seq

```
   1 atgttggttc aggacttgcc ttttgaagtc aaactgaaaa aattccatat

  51 cgatttttac aatacgggta tgccgcgcga ttttgccagc gatattgaag

 101 taacggacaa ggcaaccggt gagaaactcg agcgcaccat ccgcgtgaac

 151 catcctttga ccttgcacgg catcacgatt tatcaggcga gttttgccga

 201 cggcggttcg gatttgacat tcaaggcgtg gaatttgagg gatgcttcgc

 251 gcgaacctgt cgtgttgaag gcaacctcca tacaccagtt tccgttggaa

 301 atcggcaaac acaaatatcg tcttgagttc gatcagttca cttctatgaa

 351 tgtggaggac atgagcgagg gtgcggaacg ggaaaaaagc ctgaaatcca

 401 ctctgaacga tgtccgcgcc gttactcagg aaggtaaaaa atacaccaat

 451 atcggccctt ccatcgtgta ccgcatccgt gatgcggcag ggcaggcggt

 501 cgaatataaa aactatatgc tgccgatttt gcaggacaaa gattattttt

 551 ggctgaccgg cacgcgcagc ggcttgcagc agcaataccg ctggctgcgt

 601 atccccttgg acaagcagtt gaaagcggac acctttatgg cattgcgtga

 651 gtttttgaaa gatggggaag ggcgcaaacg tctggttgcc gacgcaacca

 701 aagacgcacc tgccgaaatc cgcgaacaat tcatgctggc tgcggaaaac

 751 acgctgaata tctttgcgca aaaaggctat ttgggattgg acgaatttat

 801 tacgtccaat atcccgaaag ggcagcagga taagatgcag ggctatttct

 851 acgaaatgct ttacggcgtg atgaacgctg ctttggatga aaccatacgc

 901 cggtacggct tgcccgaatg gcagcaggat gaagcgcgga accgtttcct

 951 gctgcacagt atggatgcct atacggggct gacggaatat cccgcgccta

1001 tgctgctcca gcttgacggg ttttccgagg tgcgttcctc aggtttgcag

1051 atgacccgtt cgccgggtgc gcttttggtc tatctcggct cggtattgtt

1101 ggttttgggt acagtattta tgttttatgt gcccaaaaaa cgggcgtggg
```

-continued

```
1151 tattgttttc aaacdgcaaa atccgttttg ctatgtcttc ggcccgcagc

1201 gaacgggatt tgcagaagga atttccaaaa cacgtcgaga gcctgcaacg

1251 gctcggcaag gacttgaatc atgactga
```

This corresponds to the amino acid sequence <SEQ ID 1362; ORF 504.ng>:

g504.pep

```
  1 MLVQDLPFEV KLKKFHIDFY NTGMPRDFAS DIEVTDKATG EKLERTIRVN

 51 HPLTLHGITI YQASFADGGS DLTFKAWNLR DASREPVVLK ATSIHQFPLE

101 IGKHKYRLEF DQFTSMNVED MSEGAEREKS LKSTLNDVRA VTQEGKKYTN

151 IGPSIVYRIR DAAGQAVEYK NYMLPILQDK DYFWLTGTRS GLQQQYRWLR

201 IPLDKQLKAD TFMALREFLK DGEGRKRLVA DATKDAPAEI REQFMLAAEN

251 TLNIFAQKGY LGLDEFITSN IPKGQQDKMQ GYFYEMLYGV MNAALDETIR

301 RYGLPEWQQD EARNRFLLHS MDAYTGLTEY PAPMLLQLDG FSEVRSSGLQ

351 MTRSPGALLV YLGSVLLVLG TVFMFYVPKK RAWVLFSNKI RFAMSSARSE

401 RDLQKEFPKH VESLQRLGKD LNHD*
```

The following partial DNA sequence was identified in *N. meningitidis* <SEQ ID 1363>:

m504.seq..

```
  1 atattggttc aggacttgcc ttttgaagtc aaactgaaaa aattccatat

 51 cgatttttac aatacgggta tgccgcgtga tttcgccagc gatattgaag

101 tgacggacaa ggcaaccggt gagaaactcg agcgcaccat ccgcgtgaac

151 catcctttga ccttgcacgg catcacgatt tatcaggcga gttttgccga

201 cggcggttcg gatttgacat tcaaggcgtg gaatttgggt gatgcttcgc

251 gcgagcctgt cgtgttgaag gcaacatcca tacaccagtt tccgttggaa

301 attggcaaac acaaatatcg tcttgagttc gatcagttca cttctatgaa

351 tgtggaggac atgagcgagg gcgcggaacg ggaaaaaagc ctgaaatcca

401 cgctgmmcga tgtccgcgcc gttactcagg aaggtaaaaa atacaccaat

451 atcggccctt ccattgttta ccgtatccgt gatgcggcag ggcaggcggt

501 cgaatataaa aactatatgc tgccggtttt gcaggaacag gattattttt

551 ggattaccgg cacgcgcagc ggcttgcagc agcaataccg ctggctgcgt

601 atccccttgg acaagcagtt gaaagcggac acctttatgg cattgcgtga

651 gtttttgaaa gatggggaag ggcgcaaacg tctggttgcc gacgcaacca

701 aaggcgcacc tgccgaaatc cgcgaacaat tcatgctggc tgcggaaaac

751 acgctgaaca tctttgcaca aaaaggctat ttgggattgg acgaatttat

801 tacgtccaat atcccgaaag agcagcagga taagatgcag ggctatttct

851 acgaaatgct ttacggcgtg atgaacgctg ctttggatga aaccatacgc

901 cggtacggct tgcccgaatg gcagcaggat gaagcgcgga atcgtttcct

951 gctgcacagt atggatgcgt acacgggttt gaccgaatat cccgcgccta
```

-continued

```
1001 tgctgctgca acttgatggg ttttccgagg tgcgttcgtc gggtttgcag

1051 atgacccgtt ccccgggtgc gcttttggtc tatctcggct cggtgctgtt

1101 ggtattgggt acggtattga tgttttatgt gcgcgaaaaa cgggcgtggg

1151 tattgttttc agacggcaaa atccgttttg ccatgtcttc ggcccgcagc

1201 gaacgggatt tgcagaagga atttccaaaa cacgtcgaga gtctgcaacg

1251 gctcggcaag gacttgaatc atga
```

This corresponds to the amino acid sequence <SEQ ID 1364; ORF 504>:

```
m504.pep..

  1 ILVQDLPFEV KLKKFHIDFY NTGMPRDFAS DIEVTDKATG EKLERTIRVN

 51 HPLTLHGITI YQASFADGGS DLTFKAWNLG DASREPVVLK ATSIHQFPLE

101 IGKHKYRLEF DQFTSMNVED MSEGAEREKS LKSTLXDVRA VTQEGKKYTN

151 IGPSIVYRIR DAAGQAVEYK NYMLPVLQEQ DYFWITGTRS GLQQQYRWLR

201 IPLDKQLKAD TFMALREFLK DGEGRKRLVA DATKGAPAEI REQFMLAAEN

251 TLNIFAQKGY LGLDEFITSN IPKEQQDKMQ GYFYEMLYGV MNAALDETIR

301 RYGLPEWQQD EARNRFLLHS MDAYTGLTEY PAPMLLQLDG FSEVRSSGLQ

351 MTRSPGALLV YLGSVLLVLG TVLMFYVREK RAWVLFSDGK IRFAMSSARS

401 ERDLQKEFPK HVESLQRLGK DLNHD*
```

Computer analysis of this amino acid sequence gave the following results:

Homology with a predicted ORF from *N. gonorrhoeae*

ORF 504 shows 96.7% identity over a 425 aa overlap with a predicted ORF (ORF 504.ng) from *N. gonorrhoeae*:

```
m504/g504

                   10        20        30        40        50        60
m504.pep    ILVQDLPFEVKLKKFHIDFYNTGMPRDFASDIEVTDKATGEKLERTIRVNHPLTLHGITI
            :|||||||||||||||||||||||||||||||||||||||||||||||||||||||||||
g504        MLVQDLPFEVKLKKFHIDFYNTGMPRDFASDIEVTDKATGEKLERTIRVNHPLTLHGITI
                   10        20        30        40        50        60

                   70        80        90       100       110       120
m504.pep    YQASFADGGSDLTFKAWNLGDASREPVVLKATSIHQFPLEIGKHKYRLEFDQFTSMNVED
            ||||||||||||||||||| ||||||||||||||||||||||||||||||||||||||||
g504        YQASFADGGSDLTFKAWNLRDASREPVVLKATSIHQFPLEIGKHKYRLEFDQFTSMNVED
                   70        80        90       100       110       120

                  130       140       150       160       170       180
m504.pep    MSEGAEREKSLKSTLXDVRAVTQEGKKYTNIGPSIVYRIRDAAGQAVEYKNYMLPVLQEQ
            ||||||||||||||| |||||||||||||||||||||||||||||||||||||||:||::
g504        MSEGAEREKSLKSTLNDVRAVTQEGKKYTNIGPSIVYRIRDAAGQAVEYKNYMLPILQDK
                  130       140       150       160       170       180

                  190       200       210       220       230       240
m504.pep    DYFWITGTRSGLQQQYRWLRIPLDKQLKADTFMALREFLKDGEGRKRLVADATKGAPAEI
            ||||:||||||||||||||||||||||||||||||||||||||||||||||||| |||||
g504        DYFWLTGTRSGLQQQYRWLRIPLDKQLKADTFMALREFLKDGEGRKRLVADATKDAPAEI
                  190       200       210       220       230       240

                  250       260       270       280       290       300
m504.pep    REQFMLAAENTLNIFAQKGYLGLDEFITSNIPKEQQDKMQGYFYEMLYGVMNAALDETIR
            ||||||||||||||||||||||||||||||||| ||||||||||||||||||||||||||
g504        REQFMLAAENTLNIFAQKGYLGLDEFITSNIPKGQQDKMQGYFYEMLYGVMNAALDETIR
                  250       260       270       280       290       300
```

-continued

```
                       310       320       330       340       350       360
m504.pep      RYGLPEWQQDEARNRFLLHSMDAYTGLTEYPAPMLLQLDGFSEVRSSGLQMTRSPGALLV
              ||||||||||||||||||||||||||||||||||||||||||||||||||||||||||||
g504          RYGLPEWQQDEARNRFLLHSMDAYTGLTEYPAPMLLQLDGFSEVRSSGLQMTRSPGALLV
                       310       320       330       340       350       360

                       370       380       390       400       410       420
m504.pep      YLGSVLLVLGTVLMFYVREKRAWVLFSDGKIRFAMSSARSERDLQKEFPKHVESLQRLGK
              ||||||||||||:|||| :||||||||: |||||||||||||||||||||||||||||||
g504          YLGSVLLVLGTVFMFYVPKKRAWVLFSN-KIRFAMSSARSERDLQKEFPKHVESLQRLGK
                       370       380        390       400       410

m504.pep      DLNHD
              |||||
g504          DLNHD
            420
```

The following partial DNA sequence was identified in *N. meningitidis* <SEQ ID 1365>:

a504.seq

```
   1 ATATTGGTTC AGGACTTGCC TTTTGAAGTC AAACTGAAAA AATTCCATAT
  51 CGATTTTTAC AATACGGGTA TGCCGCGCGA TTTTGCCAGT GATATTGAAG
 101 TAACGGATAA GGCAACCGGT GAGAAACTCG AGCGCACCAT CCGCGTGAAC
 151 CATCCTTTGA CCTTGCACGG CATCACGATT TATCAGGCGA GTTTTGCCGA
 201 CGGCGGTTCG GATTTGACAT TCAAGGCGTG GAATTTGGGT GATGCTTCGC
 251 GCGAGCCTGT CGTGTTGAAG GCAACATCCA TACACCAGTT TCCGTTGGAA
 301 ATTGGCAAAC ACAAATATCG TCTTGAGTTC GATCAGTTTA CTTCTATGAA
 351 TGTGGAGGAC ATGAGCGAGG GCGCGGAACG GGAAAAAAGC CTGAAATCCA
 401 CGCTGAACGA TGTCCGCGCC GTTACTCAGG AAGGTAAAAA ATACACCAAT
 451 ATCGGCCCTT CCATTGTTTA CCGTATCCGT GATGCGGCAG GGCAGGCGGT
 501 CGAATATAAA AACTATATGC TGCCGGTTTT GCAGGAACAG GATTATTTTT
 551 GGATTACCGG CACGCGCAGC GGCTTGCAGC AGCAATACCG CTGGCTGCGT
 601 ATCCCCTTGG ACAAGCAGTT GAAAGCGGAC ACCTTTATGG CATTGCGTGA
 651 GTTTTTGAAA GATGGGGAAG GGCGCAAACG TCTGGTTGCC GACGCAACCA
 701 AAGGCGCACC TGCCGAAATC CGCGAACAAT TCATGCTGGC TGCGGAAAAC
 751 ACGCTGAACA TCTTTGCACA AAAAGGCTAT TTGGGATTGG ACGAATTTAT
 801 TACGTCCAAT ATCCCGAAAG AGCAGCAGGA TAAGATGCAG GGCTATTTCT
 851 ACGAAATGCT TTACGGCGTG ATGAACGCTG CTTTGGATGA AACCATACGC
 901 CGGTACGGCT TGCCCGAATG GCAGCAGGAT GAAGCGCGGA ATCGTTTCCT
 951 GCTGCACAGT ATGGATGCGT ACACGGGTTT GACCGAATAT CCCGCGCCTA
1001 TGCTGCTGCA ACTTGATGGG TTTTCCGAGG TGCGTTCGTC GGGTTTGCAG
1051 ATGACCCGTT CCCCGGGTGC GCTTTTGGTC TATCTCGGCT CGGTGCTGTT
1101 GGTATTGGGT ACGGTATTGA TGTTTTATGT GCGCGAAAAA CGGGCGTGGG
1151 TATTGTTTTC AGACGGCAAA ATCCGTTTTG CCATGTCTTC GGCCCGCAGC
1201 GAACGGGATT TGCAGAAGGA ATTTCCAAAA CACGTCGAGA GTCTGCAACG
1251 GCTCGGCAAG GACTTGAATC ATGACTGA
```

This corresponds to the amino acid sequence <SEQ ID 1366; ORF 504.a>:

a504.pep

```
  1 ILVQDLPFEV KLKKFHIDFY NTGMPRDFAS DIEVTDKATG EKLERTIRVN
 51 HPLTLHGITI YQASFADGGS DLTFKAWNLG DASREPVVLK ATSIHQFPLE
101 IGKHKYRLEF DQFTSMNVED MSEGAEREKS LKSTLNDVRA VTQEGKKYTN
151 IGPSIVYRIR DAAGQAVEYK NYMLPVLQEQ DYFWITGTRS GLQQQYRWLR
201 IPLDKQLKAD TFMALREFLK DGEGRKRLVA DATKGAPAEI REQFMLAAEN
251 TLNIFAQKGY LGLDEFITSN IPKEQQDKMQ GYFYEMLYGV MNAALDETIR
301 RYGLPEWQQD EARNRFLLHS MDAYTGLTEY PAPMLLQLDG FSEVRSSGLQ
351 MTRSPGALLV YLGSVLLVLG TVLMFYVREK RAWVLFSDGK IRFAMSSARS
401 ERDLQKEFPK HVESLQRLGK DLNHD*
```

m504/a504 99.8% identity in 425 aa overlap

```
                   10        20        30        40        50        60
m504.pep   ILVQDLPFEVKLKKFHIDFYNTGMPRDFASDIEVTDKATGEKLERTIRVNHPLTLHGITI
           ||||||||||||||||||||||||||||||||||||||||||||||||||||||||||||
a504       ILVQDLPFEVKLKKFHIDFYNTGMPRDFASDIEVTDKATGEKLERTIRVNHPLTLHGITI
                   10        20        30        40        50        60

                   70        80        90       100       110       120
m504.pep   YQASFADGGSDLTFKAWNLGDASREPVVLKATSIHQFPLEIGKHKYRLEFDQFTSMNVED
           ||||||||||||||||||||||||||||||||||||||||||||||||||||||||||||
a504       YQASFADGGSDLTFKAWNLGDASREPVVLKATSIHQFPLEIGKHKYRLEFDQFTSMNVED
                   70        80        90       100       110       120

                  130       140       150       160       170       180
m504.pep   MSEGAEREKSLKSTLXDVRAVTQEGKKYTNIGPSIVYRIRDAAGQAVEYKNYMLPVLQEQ
           ||||||||||||||| ||||||||||||||||||||||||||||||||||||||||||||
a504       MSEGAEREKSLKSTLNDVRAVTQEGKKYTNIGPSIVYRIRDAAGQAVEYKNYMLPVLQEQ
                  130       140       150       160       170       180

                  190       200       210       220       230       240
m504.pep   DYFWITGTRSGLQQQYRWLRIPLDKQLKADTFMALREFLKDGEGRKRLVADATKGAPAEI
           ||||||||||||||||||||||||||||||||||||||||||||||||||||||||||||
a504       DYFWITGTRSGLQQQYRWLRIPLDKQLKADTFMALREFLKDGEGRKRLVADATKGAPAEI
                  190       200       210       220       230       240

                  250       260       270       280       290       300
m504.pep   REQFMLAAENTLNIFAQKGYLGLDEFITSNIPKEQQDKMQGYFYEMLYGVMNAALDETIR
           ||||||||||||||||||||||||||||||||||||||||||||||||||||||||||||
a504       REQFMLAAENTLNIFAQKGYLGLDEFITSNIPKEQQDKMQGYFYEMLYGVMNAALDETIR
                  250       260       270       280       290       300

                  310       320       330       340       350       360
m504.pep   RYGLPEWQQDEARNRFLLHSMDAYTGLTEYPAPMLLQLDGFSEVRSSGLQMTRSPGALLV
           ||||||||||||||||||||||||||||||||||||||||||||||||||||||||||||
a504       RYGLPEWQQDEARNRFLLHSMDAYTGLTEYPAPMLLQLDGFSEVRSSGLQMTRSPGALLV
                  310       320       330       340       350       360

                  370       380       390       400       410       420
m504.pep   YLGSVLLVLGTVLMFYVREKRAWVLFSDGKIRFAMSSARSERDLQKEFPKHVESLQRLGK
           ||||||||||||||||||||||||||||||||||||||||||||||||||||||||||||
a504       YLGSVLLVLGTVLMFYVREKRAWVLFSDGKIRFAMSSARSERDLQKEFPKHVESLQRLGK
                  370       380       390       400       410       420

m504.pep   DLNHDX
           ||||||
a504       DLNHDX
```

The following partial DNA sequence was identified in *N. gonorrhoeae* <SEQ ID 1367>:

g505.seq

```
  1 atgtttcgtt tacaattcag gctgtttccc cctttgcgaa ccgccatgca
 51 catcctgttg accgccctgc tcaaatgcct ctccctgctg tcgctttcct
101 gtctgcacac gctgggaaac cggctcggac atctggcgtt ttacctttta
```

-continued

```
151 aaggaagacc gcgcgcgcat cgtcgccaat atgcggcagg cgggtttgaa
201 ccccgacacg cagacggtca aagccgtttt tgcggaaacg gcaaaatgcg
251 gtttggaact tgccccccgcg tttttcaaaa aaccggaaga catcgaaaca
301 atgttcaaag cggtacacgg ctgggaacac gtgcagcagg ctttggacaa
351 gggcgaaggg ctgctgttca tcacgccgca catcggcagc tacgatttgg
401 gcggacgcta catcagccag cagcttccgt tccacctgac cgccatgtac
451 aagccgccga aaatcaaagc gatagacaaa atcatgcagg cgggcagggt
501 gcgcggcaaa ggcaaaaccg cgcccaccgg catacaaggg gtcaaacaaa
551 tcatcaaggc cctgcgcgcg ggcgaggcaa ccatcatcct gcccgaccac
601 gtcccttctc cgcaggaagg cggcggcgtg tgggcggatt ttttcggcaa
651 acctgcatac accatgacac tggcggcaaa attggcacac gtcaaaggcg
701 tgaaaaccct gtttttctgc tgcgaacgcc tgcccgacgg acaaggcttc
751 gtgttgcaca tccgccccgt ccaaggggaa ttgaacggca acaaagccca
801 cgatgccgcc gtgttcaacc gcaataccga atattggata cgccgttttc
851 cgacgcagta tctgtttatg tacaaccgct ataaaaacgcc gtaa
```

This corresponds to the amino acid sequence <SEQ ID 1368; ORF 505.ng>:

<u>g505.pep</u>

```
  1 MFRLQFRLFP PLRTAMHILL TALLKCLSLL SLSCLHTLGN RLGHLAFYLL
 51 KEDRARIVAN MRQAGLNPDT QTVKAVFAET AKCGLELAPA FFKKPEDIET
101 MFKAVHGWEH VQQALDKGEG LLFITPHIGS YDLGGRYISQ QLPFHLTAMY
151 KPPKIKAIDK IMQAGRVRGK GKTAPTGIQG VKQIIKALRA GEATIILPDH
201 VPSPQEGGGV WADFFGKPAY TMTLAAKLAH VKGVKTLFFC CERLPDGQGF
251 VLHIRPVQGE LNGNKAHDAA VFNRNTEYWI RRFPTQYLFM YNRYKTP*
```

The following partial DNA sequence was identified in *N. meningitidis* <SEQ ID 1369>:

<u>m505.seq (partial)</u>

```
  1 GGCATGTTTC GTTTACAATT CAGGCTGTTT CCCCCTTTGC GAACCGCCAT
 51 GCACATCCTG TTGACCGCCC TGCTCAAATG CCTCTCCCTG CTGCCGCTTT
101 CCTGTCTGCA CACGCTGGGA AACCGGCTCG GACATCTGGC GTTTTACCTT
151 TTAAAGGAAG ACCGCGCGCG CATCGTCGCC AATATGCGGC AGGCGGGTTT
201 GAACCCCGAC CCCAAAACGG TCAAAGCCGT TTTTGCGGAA ACGGCAAAAG
251 GCGGTTTGGA ACTTGCCCCC GCGTTTTTCA GAAAACCGGA AGACATAGAA
301 ACAATGTTCA AAGCGGTACA CGGCTGGGAA CATGTGCAGC AGGCTTTGGA
351 CAAACACGAA GGGCTGCTAT TCATCACGCC GCACATCGGC AGCTACGATT
401 TGGGCGGACG CTACATCAGC CAGCAGCTTC CGTTCCCGCT GACCGCCATG
451 TACAAACCGC CGAAAATCAA AGCGATAGAC AAAATCATGC AGGCGGGCAG
501 GGTTCGCGGC AAAGGAAAAA CCGCGCCTAC CAGCATACAA GGGGTCAAAC
```

-continued

```
551 AAATCATCAA AGCCCTGCGT TCGGGCGAgC AACCATCGTC CTGCCCGACC

601 ACGTCCCCTC CCCTCAAGAA GGCGGGGAAG GCGTATGGGT GGATTTCTTC

651 GGCAAACCTG CCTATACCAT GACGCTGGCG GCAArATTGG CACACGTCAA

701 AGGCGTGAAA ACCCTGTTTT TCTGCTGCGA ACGCCTGCCT GGCGGACAAG

751 GTTTCGATTT GCACATCCGC CCCGTCCAAG GGGAATTGAA CGGCGACAAA

801 GCCCATGATG CCGCCGTGTT CAACCGCAAT GCCGAATATT GGATACGCCG

851 TTTTCCGACG CAtATC....
```

This corresponds to the amino acid sequence <SEQ ID 1370; ORF 505>:

m505.pep (partial)

```
  1 MFRLQFRLFP PLRTAMHILL TALLKCLSLL PLSCLHTLGN RLGHLAFYLL

 51 KEDRARIVAN MRQAGLNPDP KTVKAVFAET AKGGLELAPA FFRKPEDIET

101 MFKAVHGWEH VQQALDKHEG LLFITPHIGS YDLGGRYISQ QLPFPLTAMY

151 KPPKIKAIDK IMQAGRVRGK GKTAPTSIQG VKQIIKALRS GEATIVLPDH

201 VPSPQEGGEG VWVDFFGKPA YTMTLAAXLA HVKGVKTLFF CCERLPGGQG

251 FDLHIRPVQG ELNGDKAHDA AVFNRNAEYW IRRFPTHI...
```

Computer analysis of this amino acid sequence gave the following results:

Homology with a predicted ORF from *N. gonorrhoeae*

ORF 505 shows 93.7% identity over a 287 aa overlap with a predicted ORF (ORF 505.ng) from *N. gonorrhoeae*:

m505/g505

```
                    10        20        30        40        50        60
m505.pep    MFRLQFRLFPPLRTAMHILLTALLKCLSLLPLSCLHTLGNRLGHLAFYLLKEDRARIVAN
            |||||||||||||||||||||||||||||| |||||||||||||||||||||||||||||
g505        MFRLQFRLFPPLRTAMHILLTALLKCLSLLSLSCLHTLGNRLGHLAFYLLKEDRARIVAN
                    10        20        30        40        50        60

                    70        80        90       100       110       120
m505.pep    MRQAGLNPDPKTVKAVFAETAKGGLELAPAFFRKPEDIETMFKAVHGWEHVQQALDKHEG
            ||||||||| :||||||||||| |||||||||:||||||||||||||||||||||| ||
g505        MRQAGLNPDTQTVKAVFAETAKCGLELAPAFFKKPEDIETMFKAVHGWEHVQQALDKGEG
                    70        80        90       100       110       120

                   130       140       150       160       170       180
m505.pep    LLFITPHIGSYDLGGRYISQQLPFPLTAMYKPPKIKAIDKIMQAGRVRGKGKTAPTSIQG
            |||||||||||||||||||||||| |||||||||||||||||||||||||||||||:|||
g505        LLFITPHIGSYDLGGRYISQQLPFHLTAMYKPPKIKAIDKIMQAGRVRGKGKTAPTGIQG
                   130       140       150       160       170       180

                   190       200       210       220       230       240
m505.pep    VKQIIKALRSGEATIVLPDHVPSPQEGGEGVWVDFFGKPAYTMTLAAXLAHVKGVKTLFF
            |||||||||:|||||:||||||||||||| |||:||||||||||||||| |||||||||||
g505        VKQIIKALRAGEATIILPDHVPSPQEGG-GVWADFFGKPAYTMTLAAKLAHVKGVKTLFF
                   190       200       210       220       230

                   250       260       270       280      289
m505.pep    CCERLPGGQGFDLHIRPVQGELNGDKAHDAAVFNRNAEYWIRRFPTHI
            |||||| |||| ||||||||||||:||||||||||||:|||||||||:
g505        CCERLPDGQGFVLHIRPVQGELNGNKAHDAAVFNRNTEYWIRRFPTQYLFMYNRYKTP
         240       250       260       270       280       290
```

The following partial DNA sequence was identified in *N. meningitidis* <SEQ ID 1371>:

a505.seq

```
  1 ATGTTTCGTT TACAATTCAG GCTGTTTCCC CCTTTGCGAA CCGCCATGCA
 51 CATCCTGTTG ACCGCCCTGC TCAAATGCCT CTCCCTGCTG CCGCTTTCCT
101 GTCTGCACAC GCTGGGAAAC CGGCTCGGAC ATCTGGCGTT TTACCTTTTA
151 AAGGAAGACC GCGCGCGCAT CGTCGCCAAT ATGCGTCAGG CAGGCATGAA
201 TCCCGACCCC AAAACGGTCA AAGCCGTTTT TGCGGAAACG GCAAAAGGCG
251 GTTTGGAACT TGCCCCCGCG TTTTTCAGAA AACCGGAAGA CATAGAAACA
301 ATGTTCAAAG CGGTACACGG CTGGGAACAT GTGCAGCAGG CTTTGGACAA
351 ACACGAAGGG CTGCTATTCA TCACGCCGCA CATCGGCAGC TACGATTTGG
401 GCGGACGCTA CATCAGCCAG CAGCTTCCGT TCCCGCTGAC CGCCATGTAC
451 AAACCGCCGA AAATCAAAGC GATAGACAAA ATCATGCAGG CGGGCAGGGT
501 TCGCGGCAAA GGAAAAACCG CGCCTACCAG CATACAAGGG GTCAAACAAA
551 TCATCAAAGC CCTGCGTTCG GGCGAAGCAA CCATCGTCCT GCCCGACCAC
601 GTCCCCTCCC CTCAAGAAGG CGGGGAAGGC GTATGGGTGG ATTTCTTCGG
651 CAAACCTGCC TATACCATGA CGCTGGCGGC AAAATTGGCA CACGTCAAAG
701 GCGTGAAAAC CCTGTTTTTC TGCTGCGAAC GCCTGCCTGG CGGACAAGGT
751 TTCGATTTGC ACATCCGCCC CGTCCAAGGG GAATTGAACG GCGACAAAGC
801 CCATGATGCC GCCGTGTTCA ACCGCAATGC CGAATATTGG ATACGCCGTT
851 TTCCGACGCA GTATCTGTTT ATGTACAACC GCTACAAAAT GCCGTAA
```

This corresponds to the amino acid sequence <SEQ ID 1372; ORF 505.a>:

a505.pep

```
  1 MFRLQFRLFP PLRTAMHILL TALLKCLSLL PLSCLHTLGN RLGHLAFYLL
 51 KEDRARIVAN MRQAGMNPDP KTVKAVFAET AKGGLELAPA FFRKPEDIET
101 MFKAVHGWEH VQQALDKHEG LLFITPHIGS YDLGGRYISQ QLPFPLTAMY
151 KPPKIKAIDK IMQAGRVRGK GKTAPTSIQG VKQIIKALRS GEATIVLPDH
201 VPSPQEGGEG VWVDFFGKPA YTMTLAAKLA HVKGVKTLFF CCERLPGGQG
251 FDLHIRPVQG ELNGDKAHDA AVFNRNAEYW IRRFPTQYLF MYNRYKMP*
```

m505/a505 99.0% identity in 287 aa overlap

```
                   10        20        30        40        50        60
m505.pep   MFRLQFRLFPPLRTAMHILLTALLKCLSLLPLSCLHTLGNRLGHLAFYLLKEDRARIVAN
           ||||||||||||||||||||||||||||||||||||||||||||||||||||||||||||
a505       MFRLQFRLFPPLRTAMHILLTALLKCLSLLPLSCLHTLGNRLGHLAFYLLKEDRARIVAN
                   10        20        30        40        50        60

                   70        80        90       100       110       120
m505.pep   MRQAGLNPDPKTVKAVFAETAKGGLELAPAFFRKPEDIETMFKAVHGWEHVQQALDKHEG
           |||||:||||||||||||||||||||||||||||||||||||||||||||||||||||||
a505       MRQAGMNPDPKTVKAVFAETAKGGLELAPAFFRKPEDIETMFKAVHGWEHVQQALDKHEG
                   70        80        90       100       110       120

                  130       140       150       160       170       180
m505.pep   LLFITPHIGSYDLGGRYISQQLPFPLTAMYKPPKIKAIDKIMQAGRVRGKGKTAPTSIQG
           ||||||||||||||||||||||||||||||||||||||||||||||||||||||||||||
a505       LLFITPHIGSYDLGGRYISQQLPFPLTAMYKPPKIKAIDKIMQAGRVRGKGKTAPTSIQG
                  130       140       150       160       170       180
```

-continued

```
              190         200         210         220         230         240
m505.pep  VKQIIKALRSGEATIVLPDHVPSPQEGGEGVWVDFFGKPAYTMTLAAXLAHVKGVKTLFF
          |||||||||||||||||||||||||||||||||||||||||||||||| |||||||||||
a505      VKQIIKALRSGEATIVLPDHVPSPQEGGEGVWVDFFGKPAYTMTLAAKLAHVKGVKTLFF
              190         200         210         220         230         240

              250         260         270         280
m505.pep  CCERLPGGQGFDLHIRPVQGELNGDKAHDAAVFNRNAEYWIRRFPTHI
          ||||||||||||||||||||||||||||||||||||||||||||||:
a505      CCERLPGGQGFDLHIRPVQGELNGDKAHDAAVFNRNAEYWIRRFPTQYLFMYNRYKMPX
              250         260         270         280         290
```

The following partial DNA sequence was identified in *N. meningitidis* <SEQ ID 1373>:

m505-1.seq

```
  1 ATGTTTCGTT TACAATTCAG GCTGTTTCCC CCTTTGCGAA CCGCCATGCA
 51 CATCCTGTTG ACCGCCCTGC TCAAATGCCT CTCCCTGCTG CCGCTTTCCT
101 GTCTGCACAC GCTGGGAAAC CGGCTCGGAC ATCTGGCGTT TTACCTTTTA
151 AAGGAAGACC GCGCGCGCAT CGTCGCCAAT ATGCGGCAGG CGGGTTTGAA
201 CCCCGACCCC AAAACGGTCA AAGCCGTTTT TGCGGAAACG GCAAAAGGCG
251 GTTTGGAACT TGCCCCCGCG TTTTTCAGAA AACCGGAAGA CATAGAAACA
301 ATGTTCAAAG CGGTACACGG CTGGGAACAT GTGCAGCAGG CTTTGGACAA
351 ACACGAAGGG CTGCTATTCA TCACGCCGCA CATCGGCAGC TACGATTTGG
401 GCGGACGCTA CATCAGCCAG CAGCTTCCGT TCCCGCTGAC CGCCATGTAC
451 AAACCGCCGA AAATCAAAGC GATAGACAAA ATCATGCAGG CGGGCAGGGT
501 TCGCGGCAAA GGAAAAACCG CGCCTACCAG CATACAAGGG GTCAAACAAA
551 TCATCAAAGC CCTGCGTTCG GGCGAAGCAA CCATCGTCCT GCCCGACCAC
601 GTCCCCTCCC CTCAAGAAGG CGGGGAAGGC GTATGGGTGG ATTTCTTCGG
651 CAAACCTGCC TATACCATGA CGCTGGCGGC AAAATTGGCA CACGTCAAAG
701 GCGTGAAAAC CCTGTTTTTC TGCTGCGAAC GCCTGCCTGG CGGACAAGGT
751 TTCGATTTGC ACATCCGCCC CGTCCAAGGG GAATTGAACG GCGACAAAGC
801 CCATGATGCC GCCGTGTTCA ACCGCAATGC CGAATATTGG ATACGCCGTT
851 TTCCGACGCA GTATCTGTTT ATGTACAACC GCTACAAAAT GCCGTAA
```

This corresponds to the amino acid sequence <SEQ ID 1374; ORF 505-1>:

m505-1.pep

```
  1 MFRLQFRLFP PLRTAMHILL TALLKCLSLL PLSCLHTLGN RLGHLAFYLL
 51 KEDRARIVAN MRQAGLNPDP KTVKAVFAET AKGGLELAPA FFRKPEDIET
101 MFKAVHGWEH VQQALDKHEG LLFITPHIGS YDLGGRYISQ QLPFPLTAMY
151 KPPKIKAIDK IMQAGRVRGK GKTAPTSIQG VKQIIKALRS GEATIVLPDH
201 VPSPQEGGEG VWVDFFGKPA YTMTLAAKLA HVKGVKTLFF CCERLPGGQG
251 FDLHIRPVQC ELNGDKAHDA AVFNRNAEYW IRRFPTQYLF MYNRYKMP*
```

m505-1/g505 94.3% identity in 298 aa overlap

```
                      10        20        30        40        50        60
m505-1.pep    MFRLQFRLFPPLRTAMHILLTALLKCLSLLPLSCLHTLGNRLGHLAFYLLKEDRARIVAN
              |||||||||||||||||||||||||||||| |||||||||||||||||||||||||||||
g505          MFRLQFRLFPPLRTAMHILLTALLKCLSLLSLSCLHTLGNRLGHLAFYLLKEDRARIVAN
                      10        20        30        40        50        60

                      70        80        90       100       110       120
m505-1.pep    MRQAGLNPDPKTVKAVFAETAKGGLELAPAFFRKPEDIETMFKAVHGWEHVQQALDKHEG
              ||||||||| :||||||||||| |||||||||:|||||||||||||||||||||||| ||
g505          MRQAGLNPDTQTVKAVFAETAKCGLELAPAFFKKPEDIETMFKAVHGWEHVQQALDKGEG
                      70        80        90       100       110       120

                     130       140       150       160       170       180
m505-1.pep    LLFITPHIGSYDLGGRYISQQLPFPLTAMYKPPKIKAIDKIMQAGRVRGKGKTAPTSIQG
              |||||||||||||||||||||||| |||||||||||||||||||||||||||||||:|||
g505          LLFITPHIGSYDLGGRYISQQLPFHLTAMYKPPKIKAIDKIMQAGRVRGKGKTAPTGIQG
                     130       140       150       160       170       180

                     190       200       210       220       230       240
m505-1.pep    VKQIIKALRSGEATIVLPDHVPSPQEGGEGVWVDFFGKPAYTMTLAAKLAHVKGVKTLFF
              |||||||||:|||||:|||||||||||| |||:|||||||||||||||||||||||||||
g505          VKQIIKALRAGEATIILPDHVPSPQEGG-GVWADFFGKPAYTMTLAAKLAHVKGVKTLFF
                     190       200       210        220       230

                     250       260       270       280       290      299
m505-1.pep    CCERLPGGQGFDLHIRPVQGELNGDKAHDAAVFNRNAEYWIRRFPTQYLFMYNRYKMPX
              |||||| |||| ||||||||||||:|||||||||||:||||||||||||||||||| ||
g505          CCERLPDGQGFVLHIRPVQGELNGNKAHDAAVFNRNTEYWIRRFPTQYLFMYNRYKTPX
            240       250       260       270       280       290
```

m505-1/a505 99.7% identity in 298 aa overlap

```
                    10        20        30        40        50        60
m505-1.pep  MFRLQFRLFPPLRTAMHILLTALLKCLSLLPLSCLHTLGNRLGHLAFYLLKEDRARIVAN
            ||||||||||||||||||||||||||||||||||||||||||||||||||||||||||||
a505        MFRLQFRLFPPLRTAMHILLTALLKCLSLLPLSCLHTLGNRLGHLAFYLLKEDRARIVAN
                    10        20        30        40        50        60

                    70        80        90       100       110       120
m505-1.pep  MRQAGLNPDPKTVKAVFAETAKGGLELAPAFFRKPEDIETMFKAVHGWEHVQQALDKHEG
            |||||:||||||||||||||||||||||||||||||||||||||||||||||||||||||
a505        MRQAGMNPDPKTVKAVFAETAKGGLELAPAFFRKPEDIETMFKAVHGWEHVQQALDKHEG
                    70        80        90       100       110       120

                   130       140       150       160       170       180
m505-1.pep  LLFITPHIGSYDLGGRYISQQLPFPLTAMYKPPKIKAIDKIMQAGRVRGKGKTAPTSIQG
            ||||||||||||||||||||||||||||||||||||||||||||||||||||||||||||
a505        LLFITPHIGSYDLGGRYISQQLPFPLTAMYKPPKIKAIDKIMQAGRVRGKGKTAPTSIQG
                   130       140       150       160       170       180

                   190       200       210       220       230       240
m505-1.pep  VKQIIKALRSGEATIVLPDHVPSPQEGGEGVWVDFFGKPAYTMTLAAKLAHVKGVKTLFF
            ||||||||||||||||||||||||||||||||||||||||||||||||||||||||||||
a505        VKQIIKALRSGEATIVLPDHVPSPQEGGEGVWVDFFGKPAYTMTLAAKLAHVKGVKTLFF
                   190       200       210       220       230       240

                   250       260       270       280       290      299
m505-1.pep  CCERLPGGQGFDLHIRPVQGELNGDKAHDAAVFNRNAEYWIRRFPTQYLFMYNRYKMPX
            |||||||||||||||||||||||||||||||||||||||||||||||||||||||||||
a505        CCERLPGGQGFDLHIRPVQGELNGDKAHDAAVFNRNAEYWIRRFPTQYLFMYNRYKMPX
                   250       260       270       280       290
```

The following partial DNA sequence was identified in *N. gonorrhoeae* <SEQ ID 1375>:

g506.seq

```
  1 ATGGCGGTAT TTGATGAAGT CGGGCGCATC GCCCATGGCT GCGGCGGTGT

 51 TGTCAAACAA AGCCTGTTTC TGCGCGTCGT TCATCAGGTT GAACAAGGCG

101 CGCGGTTGGC TGAAGTAGTC GTCATCGTCT TGGCGGTAGT CCCAGTGTGC

151 CGCGTCGCCG TTGATTTTCA AAGGCGGTTC GGCGAAGTCG GGTTGTTGCT

201 GCCATTGGCC GAAGCTGTTG GGTTCGTAGT GCGGCAGGCT GCCGTAGTTG

251 CCGTCGGCGC GGCCTTGTCC GTCGCGCTGG TTGCTGTGAA CAGGGCAACG

301 CGGACGATTG ACGGGGATTT GGCGGAAGTT CACACCCAAG CGGTAACGTT
```

-continued

```
 351 GCGCGTCGGC GTAATTGAAC AAACGGGCTT GCAACATTTT ATCCGGGCTC
 401 GCGCCGATAC CGGGAACGAG GTTGCTCGGT GCGAAGGCGG ATTGTTCCAC
 451 ATCGGCGAAG AAGTTTTCGG GATTGCGGTT CAACTCGAAT TCGCCCACTT
 501 CAATCAGCGG ATAGTCTTTT TTCGGCCAAA CTTTGGTCAA GTCAAACGGA
 551 TGATAAGGCA CTTTTTCGGC ATCGGCTTCA GGCATGACTT GGATGTACAT
 601 CGTCCATTTC GGGAACTCGC CGCGCTCGAT GGCTTCGTAC AGGTCGCGCT
 651 GATGGCTTTC GCGGTCGTCG GCGATGATTT TTGCAGCTTC TTCGTTGGTC
 701 AGGTTTTTAA TCCCTTGCTG GCTGCGGAAA TGGAATTTCA CCCAAAAACG
 751 TTCGCCCGCT TCGTTCCAGA AGCTGTAGGT ATGCGAACCG AAGCCGTGCA
 801 TATGGCGGTA GCTGGCGGGA ATACCGCGGT CGCTCATCAC GATGGTAACT
 851 TGGTGCAGGG CTTCGGGCAG CAGCGTCCAG AAGTCCCAGT TGTTTGTGGC
 901 GGAACGCATA TTGGTGCGCG GATCGCGTTT GACGGCTTTG TTCAGGTCGG
 951 GGAATTTGCG CGGGTCGCGC AGGAAGAACA CGGGCGTGTT GTTGCCGACC
1001 ACATCCCAGT TGCCTTCTTC GGTATAGAAT TTCAACGCAA AACCGCGGAT
1051 GTCGCGTTCC GCATCGGCTG CGCCGCGCTC GCCTGCCACG GTGGTGAAAC
1101 GGGCGAACAT CTCGGTTTTT TTGCCGACTT CGCTGAAAAT TTTGGCGCGG
1151 GTGTATTTGG TGATGTCGTG TGTTACGGTA AACGTACCGA ACGCGCCCGA
1201 ACCTTTGGCG TGCATACGGC GTTCGGGGAT GACTTCGCGC ACGAAGTCGG
1251 CGAGTTTTTC ATTCAGCCAC AAATCTTGCG TCAGCAGGGG GCCGCGCGGG
1301 CCGGCGGTCA GGCTGTTTTG ATTGTCGGCA ACGGGCGCGC CGTTGTTCAT
1351 GGTCAGATGG GTTACGGGGC ATTTGGAGGT AGTCATCGCT CTTGTTCCTT
1401 TTCTCAGGTT GGTCAAATGG GGGGCAAACG GCTTACAGTA CGATTTGGCG
1451 GAAAGCGTAT TCGTAACCGG TTTCTTGATT GTAATAAATT TCTTGAATCG
1501 ACATTTTATT TTCCTTTTGC AAAAACTATG GATGCGATTA TACGCCAAGA
1551 TTTTCGTTAT TAA
```

This corresponds to the amino acid sequence <SEQ ID 1376; ORF 506.ng>:

g506.pep

```
  1 MAVFDEVGRI AHGCGGVVKQ SLFLRVVHQV EQGARLAEVV VIVLAVVPVC
 51 RVAVDFQRRF GEVGLLLPLA EAVGFVVRQA AVVAVGAALS VALVAVNRAT
101 RTIDGDLAEV HTQAVTLRVG VIEQTGLQHF IRARADTGNE VARCEGGLFH
151 IGEEVFGIAV QLEFAHFNQR IVFFRPNFGQ VKRMIRHFFG IGFRHDLDVH
201 RPFRELAALD GFVQVALMAF AVVGDDFCSF FVGQVFNPLL AAEMEFHPKT
251 FARFVPEAVG MRTEAVHMAV AGGNTAVAHH DGNLVQGFGQ QRPEVPVVCG
301 GTHIGARIAF DGFVQVGEFA RVAQEEHGRV VADHIPVAFF GIEFQRKTAD
351 VAFRIGCAAL ACHGGETGEH LGFFADFAEN FGAGVFGDVV CYGKRTERAR
401 TFGVHTAFGD DFAHEVGEFF IQPQILRQQG AARAGGQAVL IVGNGRAVVH
451 GQMGYGAFGG SHRSCSFSQV GQMGGKRLTV RFGGKRIRNR FLDCNKFLES
501 TFYFPFAKTM DAIIRQDFRY *
```

The following partial DNA sequence was identified in *N. meningitidis* <SEQ ID 1377>:

m506.seq

```
   1 ATGGCGGTAT TTGATGAAGT CGGGCGCGTC GCCCATTGCG GCGGCGGTGT
  51 TGCCGAACAA TGCCTGTTTC TGCGCGTCGT TCATCAGGTT GAACAGGGCG
 101 CGCGGTTGGC TGAAATAGTC GTCATCGTCT TGGCGGTAGT CCCAGTGTGC
 151 CGCGTCGCCG TTGATTTTCA AAGGCGGTTC GGCGAAtCGg GGTTGTTGCT
 201 GCCATTGGCC GAAGCTGTyG GGTTCGTAGT GCGGCAGGCT GCCGyAGTTG
 251 CCGTCGGCGC GGCCTTGCCC GTyGCGsTgr TTgCTGTgAA CAsGGCAACG
 301 CGGACGATTG ACGGGAATTT GGCGGAAGTT TACGCCCAAA CGGTAGCGTT
 351 GTGCGTCGGC GTAATTGAAC AAACGCGCTT GCAGCATTTT ATCTsGGCTG
 401 GCGCCGACAC CGGGAACGAG GTTGCTCGGT GCGAAGGCGG ATTGTTCCAC
 451 ATCGGCGAAG AAGTTTTCGG GATTGCGGTT CTCAAACGGA TGATAAGGTA
 501 CTTTTTCCGC GTCTGCTTCA GGCATGACTT GGATGTACAT CGTCCATTTC
 551 GGAAACTCGC CGCGTTCGAT GGCTTCsTAT AAGTCGCGCT GATGGCTTTC
 601 GCGGTCGTCG GCGATGATTT TGGCGGCTTC TTCGTTGGTC AGGTTTTTAA
 651 TGCCTTGTTG GGTGCGGAAA TGGAATTTCA CCCAAAAACG CTCGCCTGCT
 701 TCGTTCCAGA AGCTGTAGGT ATGCGAACCG AAGCCGTGCA TATGGCGGTA
 751 GCCGGCGGGG ATGCCGCGGT CGCTCATCAC GATGGTAACT TGGTGCAGTG
 801 CTTCGGGCAG CAGCGTCCAG AAGTCCCAGT TGTTTGTGGC AGAGCGCATA
 851 TTGGTGCGCG GGTCGCGTTT GACGGCTTTG TTCAGGTCGG GGAACTTACG
 901 CGGGTCGCGC AGGAAGAACA CGGGCGTGTT GTTGCCGACC ACATCCCAGT
 951 TGCCTTCTTC GGTATAAAAT TTCAAGGCAA AACCGCGGAT GTCGCGTTCT
1001 GCATCGGCTG CGCCGCGTTC GCCTGCCACG GTGGTGAAAC GGGCGAACAT
1051 CTCGGTTTTT TTGCCGACTT CGCTGAAGAT TCCTTTGGCG TGCATACGGC
1101 GTTCGGGGAT GACTTCGCGC ACGAAGTCGG CGAGTTTTTC AGTCATCGCT
1151 CTTGTTCCTT TTCTCAGGTT GGTCAAATGG GGGTAAACGG CTTACAGTAC
1201 GATTTGGCGG AAAGCGTATT CGTAACCGGT TTCTTGATTG CAATAAATTT
1251 CTTGAATCGA CATTTTATTT CCCTTTTGTA AAAACTATGG ATGCGACTAT
1301 ACGCCAAGAT TTTCGCTATT AA
```

This corresponds to the amino acid sequence <SEQ ID 1378; ORF 506>:

m506.pep

```
   1 MAVFDEVGRV AHCGGGVAEQ CLFLRVVHQV EQGARLAEIV VIVLAVVPVC
  51 RVAVDFQRRF GESGLLLPLA EAVGFVVRQA AXVAVGAALP VAXXAVNXAT
 101 RTIDGNLAEV YAQTVALCVG VIEQTRLQHF IXAGADTGNE VARCEGGLFH
 151 IGEEVFGIAV QLEFAHFNQR IVFFRPNFGQ VKRMIRYFFR VCFRHDLDVH
 201 RPFRKLAAFD GFXXVALMAF AVVGDDFGGF FVGQVFNALL GAEMEFHPKT
 251 LACFVPEAVG MRTEAVHMAV AGGDAAVAHH DGNLVQCFGQ QRPEVPVVCG
```

-continued

```
301 RAHIGARVAF DGFVQVGELT RVAQEEHGRV VADHIPVAFF GIKFQGKTAD

351 VAFCIGCAAF ACHGGETGEH LGFFADFAED FGAGVFGDVV RYGKRTERAR

401 TFGVHTAFGD DFAHEVGEFF IQPQILRQQR AARTGGQAVL IVGNRRAVVH

451 GQMGYRAFGG SHRSCSFSQV GQMGGKRLTV RFGGKRIRNR FLDCNKFLES

501 TFYFPFVKTM DATIRQDFRY *
```

Computer analysis of this amino acid sequence gave the following results:

Homology with a predicted ORF from *N. gonorrhoeae*

ORF 506 shows 89.2% identity over a 520 aa overlap with a predicted ORF (ORF 506.ng) from *N. gonorrhoeae*:

m506/g506

```
                    10        20        30        40        50        60
m506.pep   MAVFDEVGRVAHCGGGVAEQCLFLRVVHQVEQGARLAEIVVIVLAVVPVCRVAVDFQRRF
           |||||||||:||  |||::| |||||||||||||||||:|||||||||||||||||||||
g506       MAVFDEVGRIAHGCGGVVKQSLFLRVVHQVEQGARLAEVVVIVLAVVPVCRVAVDFQRRF
                    10        20        30        40        50        60

                    70        80        90       100       110       120
m506.pep   GESGLLLPLAEAVGFVVRQAAXVAVGAALPVAXXAVNXATRTIDGNLAEVYAQTVALCVG
           || |||||||||||||||||| ||||||| ||  ||| |||||||:||||::|:|:| ||
g506       GEVGLLLPLAEAVGFVVRQAAVVAVGAALSVALVAVNRATRTIDGDLAEVHTQAVTLRVG
                    70        80        90       100       110       120

                   130       140       150       160       170       180
m506.pep   VIEQTRLQHFIXAGADTGNEVARCEGGLFHIGEEVFGIAVQLEFAHFNQRIVFFRPNFGQ
           ||||| ||||| | ||||||||||||||||||||||||||||||||||||||||||||||
g506       VIEQTGLQHFIRARADTGNEVARCEGGLFHIGEEVFGIAVQLEFAHFNQRIVFFRPNFGQ
                   130       140       150       160       170       180

                   190       200       210       220       230       240
m506.pep   VKRMIRYFFRVCFRHDLDVHRPFRKLAAFDGFXXVALMAFAVVGDDFGGFFVGQVFNALL
           ||||||:|| : ||||||||||||:|||:|||  ||||||||||||| :|||||||| ||
g506       VKRMIRHFFGIGFRHDLDVHRPFRELAALDGFVQVALMAFAVVGDDFCSFFVGQVFNPLL
                   190       200       210       220       230       240

                   250       260       270       280       290       300
m506.pep   GAEMEFHPKTLACFVPEAVGMRTEAVHMAVAGGDAAVAHHDGNLVQCFGQQRPEVPVVCG
           :|||||||||:| ||||||||||||||||||||::||||||||||| |||||||||||||
g506       AAEMEFHPKTFARFVPEAVGMRTEAVHMAVAGGNTAVAHHDGNLVQGFGQQRPEVPVVCG
                   250       260       270       280       290       300

                   310       320       330       340       350       360
m506.pep   RAHIGARVAFDGFVQVGELTRVAQEEHGRVVADHIPVAFFGIKFQGKTADVAFCIGCAAF
            :|||||:||||||||||::||||||||||||||||||||||:|| ||||||| |||||:
g506       GTHIGARIARDGFVQVGEFARVAQEEHGRVVADHIPVAFFGIEFQRKTADVAFRIGCAAL
                   310       320       330       340       350       360

                   370       380       390       400       410       420
m506.pep   ACHGGETGEHLGFFADFAEDFGAGVFGDVVRYGKRTERARTFGVHTAFGDDFAHEVGEFF
           |||||||||||||||||||:|||||||||| |||||||||||||||||||||||||||||
g506       ACHGGETGEHLGFFADFAENFGAGVFGDVVCYGKRTERARTFGVHTAFGDDFAHEVGEFF
                   370       380       390       400       410       420

                   430       440       450       460       470       480
m506.pep   IQPQILRQQRAARTGGQAVLIVGNRRAVVHGQMGYRAFGGSHRSCSFSQVGQMGGKRLTV
           ||||||||| |||:|||||||||| |||||||||| ||||||||||||||||||||||||
g506       IQPQILRQQGAARAGGQAVLIVGNGRAVVHGQMGYGAFGGSHRSCSFSQVGQMGGKRLTV
                   430       440       450       460       470       480

                   490       500       510       520
m506.pep   RFGGKRIRNRFLDCNKFLESTFYFPFVKTMDATIRQDFRY
           ||||||||||||||||||||||||||:||||| |||||||
g506       RFGGKRIRNRFLDCNKFLESTFYFPFAKTMDAIIRQDFRY
                   490       500       510       520
```

The following partial DNA sequence was identified in *N. meningitidis* <SEQ ID 1379>:

a506.seq

```
 1 ATGGCGGTAT TTGATGAAGT CGGGCGCGTC GCCCATTGCG GCGGCGGTGT

51 TGCCGAACAA TGCCTGTTTC TGCGCGTCGT TCATCAGGTT GAACAGGGCG
```

-continued

```
 101 CGCGGTTGGC TGAAATAGTC GTCATCGTCT TGGCGGTAGT CCCAGTGCGC
 151 CGCGTCGCCG TTGATTTTCA AAGGCGGTTC GGCGAAGTCG GGCTGCTGCT
 201 GCCATTGGCC GAAGCTGTTG GGTTCGTAGT GCGGCAGGCT GCCGTAGTTG
 251 CCGTCGGCGC GTCCTTGTCC GTCGCGCTGG TTGCTGTGAA CAGGGCAACG
 301 CGGACGGTTG ACAGGGATTT GGCGGAAGTT CACGCCCAAG CGGTAGCGTT
 351 GCGCGTCGGC GTAATTGAAC AAACGCGCCT GCAACATTTT ATCTGGGCTG
 401 GCGCCGACAC CGGGAACGAG GTTGCTCGGT GCGAAGGCGG ATTGTTCCAC
 451 ATCGGCGAAG AAGTTTTCGG GATTGCGGTT CAACTCGAAT TCGCCCACTT
 501 CAATCAGCGG ATAGTCTTTT TTCGGCCAAA CTTTGGTCAA GTCAAACGGA
 551 TGATACGGCA CTTTTTCCGC ATCGGCTTCA GGCATGACTT GGATGTACAT
 601 CGTCCATTTC GGAAACTCGC CGCGCTCGAT GGCTTCGTAC AGGTCGCGCT
 651 GATGGCTTTC ACGGTCGTCG GCGATGATTT TGGCGGCTTC TTCGTTGGTC
 701 AGGTTTTTAA TGCCTTGTTG GGTGCGGAAA TGGAATTTCA CCCAAAAACG
 751 CTCGCCTGCT TCGTTCCAGA AGCTGTAGGT ATGCGAACCG AAGCCGTGCA
 801 TATGGCGGTA GCCGGCGGGG ATGCCGCGGT CGCTCATCAC GATGGTAACT
 851 TGGTGCAGTG CTTCGGGCAG CAGCGTCCAG AAGTCCCAGT TGTTTGTGGC
 901 AGAGCGCATA TTGGTGCGCG GGTCGCGTTT GACGGCTTTG TTCAGGTCGG
 951 GGAACTTACG CGGGTCGCGC AGGAAGAACA CGGGCGTGTT GTTGCCGACC
1001 ACATCCCAGT TGCCTTCTTC GGTATAGAAC TTCAACGCAA AACCGCGGAT
1051 GTCGCGTTCT GCATCGGCTG CGCCGCGTTC GCCTGCCACG GTGGTGAAAC
1101 GGGCGAACAT CTCGGTTTTT TTGCCGACTT CGCTGAAGAT TTTGGCGCGG
1151 GTGTATTTGG TGATGTCGTG CGTTACGGTA AACGTACCGA ACGCGCCCGA
1201 ACCTTTGGCG TGCATACGGC GTTCGGGGAT GACTTCGCGC ACGAAGTCGG
1251 CGAGTTTTTC ATTCAGCCAC AAATCCTGCG CCAGCAGAGG GCCGCGAGGA
1301 CCGGCGGTCA GGCTGTTTTG ATTGTCGGCA ACAGGCGCGC CGTTGTTCAT
1351 GGTCAGATGG GTTACAGGGC ATTTGGAGGT ANTCATCGCT CTTGTTCCTT
1401 TTCTCAGGTT GGTCAAAT.G GGGGTAAACG GCTTACAGTA CGATTTGGCG
1451 GAAAGCGTAT TCGTAACCGG TTTCTTGATT GCAATAAATT TCTTGAATCG
1501 ACATTTTATT TCCCTTTTGT AAAAACTATG GATGCGACTA TACGCCAAGA
1551 TTTTCGCTAT TAA
```

This corresponds to the amino acid sequence <SEQ ID 1380; ORF 506.a>:

a506.pep

```
  1 MAVFDEVGRV AHCGGGVAEQ CLFLRVVHQV EQGARLAEIV VIVLAVVPVR
 51 RVAVDFQRRF GEVGLLLPLA EAVGFVVRQA AVVAVGASLS VALVAVNRAT
101 RTVDRDLAEV HAQAVALRVG VIEQTRLQHF IWAGADTGNE VARCEGGLFH
151 IGEEVFGIAV QLEFAHFNQR IVFFRPNFGQ VKRMIRHFFR IGFRHDLDVH
201 RPFRKLAALD GFVQVALMAF TVVGDDFGGF FVGQVFNALL GAEMEFHPKT
```

-continued

```
251 LACFVPEAVG MRTEAVHMAV AGGDAAVAHH DGNLVQCFGQ QRPEVPVVCG

301 RAHIGARVAF DGFVQVGELT RVAQEEHGRV VADHIPVAFF GIELQRKTAD

351 VAFCIGCAAF ACHGGETGEH LGFFADFAED FGAGVFGDVV RYGKRTERAR

401 TFGVHTAFGD DFAHEVGEFF IQPQILRQQR AARTGGQAVL IVGNRRAVVH

451 GQMGYRAFGG XHRSCSFSQV GQXGGKRLTV RFGGKRIRNR FLDCNKFLES

501 TFYFPFVKTM DATIRQDFRY *
```

m506/a506 94.8% identity in 520 aa overlap

```
                    10        20        30        40        50        60
m506.pep    MAVFDEVGRVAHCGGGVAEQCLFLRVVHQVEQGARLAEIVVIVLAVVPVCRVAVDFQRRF
            |||||||||||||||||||||||||||||||||||||||||||||||||| |||||||||
a506        MAVFDEVGRVAHCGGGVAEQCLFLRVVHQVEQGARLAEIVVIVLAVVPVRRVAVDFQRRF
                    10        20        30        40        50        60

                    70        80        90       100       110       120
m506.pep    GESGLLLPLAEAVGFVVRQAAXVAVGAALPVAXXAVNXATRTIDGNLAEVYAQTVALCVG
            || ||||||||||||||||| ||||:| ||  ||| ||||:| :||||:||:||| ||
a506        GEVGLLLPLAEAVGFVVRQAAVVAVGASLSVALVAVNRATRTVDRDLAEVHAQAVALRVG
                    70        80        90       100       110       120

                   130       140       150       160       170       180
m506.pep    VIEQTRLQHFIXAGADTGNEVARCEGGLFHIGEEVFGIAVQLEFAHFNQRIVFFRPNFGQ
            ||||||||||| ||||||||||||||||||||||||||||||||||||||||||||||||
a506        VIEQTRLQHFIWAGADTGNEVARCEGGLFHIGEEVFGIAVQLEFAHFNQRIVFFRPNFGQ
                   130       140       150       160       170       180

                   190       200       210       220       230       240
m506.pep    VKRMIRYFFRVCFRHDLDVHRPFRKLAAFDGFXXVALMAFAVVGDDFGGFFVGQVFNALL
            ||||||:|||: ||||||||||||||||:|||  ||||||:|||||||||||||||||||
a506        VKRMIRHFFRIGFRHDLDVHRPFRKLAALDGFVQVALMAFTVVGDDFGGFFVGQVFNALL
                   190       200       210       220       230       240

                   250       260       270       280       290       300
m506.pep    GAEMEFHPKTLACFVPEAVGMRTEAVHMAVAGGDAAVAHHDGNLVQCFGQQRPEVPVVCG
            ||||||||||||||||||||||||||||||||||||||||||||||||||||||||||||
a506        GAEMEFHPKTLACFVPEAVGMRTEAVHMAVAGGDAAVAHHDGNLVQCFGQQRPEVPVVCG
                   250       260       270       280       290       300

                   310       320       330       340       350       360
m506.pep    RAHIGARVAFDGFVQVGELTRVAQEEHGRVVADHIPVAFFGIKFQGKTADVAFCIFCAAF
            ||||||||||||||||||||||||||||||||||||||||||::| ||||||||||||||
a506        RAHIGARVAFDGFVQVGELTRVAQEEHGRVVADHIPVAFFGIELQRKTADVAFCIFCAAF
                   310       320       330       340       350       360

                   370       380       390       400       410       420
m506.pep    ACHGGETGEHLGFFADFAEDFGAGVFGDVVRYGKRTERARTFGVHTAFGDDFAHEVGEFF
            ||||||||||||||||||||||||||||||||||||||||||||||||||||||||||||
a506        ACHGGETGEHLGFFADFAEDFGAGVFGDVVRYGKRTERARTFGVHTAFGDDFAHEVGEFF
                   370       380       390       400       410       420

                   430       440       450       460       470       480
m506.pep    IQPQILRQQRAARTGGQAVLIVGNRRAVVHGQMGYRAFGGSHRSCSFSQVGQMGGKRLTV
            |||||||||||||||||||||||||||||||||||||||| ||||||||||| |||||||
a506        IQPQILRQQRAARTGGQAVLIVGNRRAVVHGQMGYRAFGGXHRSCSFSQVGQXGGKRLTV
                   430       440       450       460       470       480

                   490       500       510       520
m506.pep    RFGGKRIRNRFLDCNKFLESTFYFPFVKTMDATIRQDFRYX
            ||||||||||||||||||||||||||||||||||||||||
a506        RFGGKRIRNRFLDCNKFLESTFYFPFVKTMDATIRQDFRYX
                   490       500       510       520
```

The following partial DNA sequence was identified in *N. gonorrhoeae* <SEQ ID 1381>:

g507.seq

```
  1 ATGCTCTTGC CGGCTTTGCA ACAAGGCGGC GGCTTCCTGA GCGGCGGCGG

 51 TTTCGGCCTC GTCGGGCAGG TTCAGGGCTT GGTTTTCCTG CTTCAGACGG

101 CCTTTGCGCT CTTCGTGCTT GGCAACGGTT TGTTCGGCAT GGGCAAGCTG

151 CTGCTGCTTC AACGCCAGTT CGCGGCGGAT GCGGTTTGCC TCGTCCTGCT
```

-continued

```
201 GGGTTTGGAA GGCAGCGTTG AGCGTGGCTT GGACTTCTTC CAATTCGGGC

251 AGACGCTCTT CGTGTTCGGC AACCTGCATC GCCCATTCCG CCAATTCGGT

301 TTGCTTTTCT TCGACCTGCA ACTCGTTTTC CTCAAGCTGC ACGCGGATTT

351 GCTGCTGCTC CTGCCGGATG CGTTGCAACT GCGCCTGCGC TGCCTGCTTG

401 TCGCGTTCGA TGCGTTGGTG CAGGTTTTGC CGGTGGCGGA TTTGTTCTTC

451 CAAACGGGCA ATCTGCTCGC GCAACACGCC GCGTTTGTTG CTCAATTCGT

501 GTACTGCCTG CTGCTGCGAC TGTTCGGCAG TCTGCAAGGC GTGTACTTCG

551 TTATTTAA
```

This corresponds to the amino acid sequence <SEQ ID 1382; ORF 507.ng>:

g507.pep

```
  1 MLLPALQQGG GFLSGGGFGL VGQVQGLVFL LQTAFALFVL GNGLFGMGKL

 51 LLLQRQFAAD AVCLVLLGLE GSVERGLDFF QFGQTLFVFG NLHRPFRQFG

101 LLFFDLQLVF LKLHADLLLL LPDALQLRLR CLLVAFDALV QVLPVADLFF

151 QTGNLLAQHA AFVAQFVYCL LLRLFGSLQG VYFVI*
```

The following partial DNA sequence was identified in *N. meningitidis* <SEQ ID 1383>:

m507.seq

```
  1 ATGCTCTTGC TGACTTTGCA ACAAGGCGGC TGCTTCCTGC GCGGCGGCGG

 51 TTTCGGCTTC GTCGGGCAGG TTTAAGGCTT GGTTTTCCTG TTTCAGACGA

101 CCTTTGCGCT CTTCGTGCTT GGCAATCGTT TGTTCGGCAT GGGCAAGCTG

151 CTGCTGCTTC AACGCCAGTT CGCGGCGGAT GCGGTTTGCC TCGTCCTGCT

201 GGGTTTGGAA GGCGGCGTTG AGCGTGGCTT GGGCTTCTTC CAATTCGGGC

251 AGACGCTCCT CGTGTTCGGC AACCTGCATC GCCCATTCCG CCAGCTCGGT

301 TTGTTTTTCT TCGACCTGCA ACTCGTTTTC TTCAAGCTGC ACGCGGATTT

351 GCTGCTGCTC TTGATGAATG CGTTGTAACT GCGCCTGCGC TGCCTGCTTG

401 TCGCGTTCGA TGCGTTGGTG CAGGTTTTGC TGATGGCGGA TTTGTTCTTC

451 CAAACGGGCA ATCTGCTCGC GCAACACGCC GCGCTTGTTG CTCAATTCAT

501 GCACTGCCTG CTGCTGCGAC TGTTCGGCAG TCTGCAAGGC GTGTACTTCG

551 TCGTTTAA
```

This corresponds to the amino acid sequence <SEQ ID 1384; ORF 507>:

m507.pep

```
  1 MLLLTLQQGG CFLRGGGFGF VGQVXGLVFL FQTTFALFVL GNRLFGMGKL

 51 LLLQRQFAAD AVCLVLLGLE GGVERGLGFF QFGQTLLVFG NLHRPFRQLG

101 LFFFDLQLVF FKLHADLLLL LMNALXLRLR CLLVAFDALV QVLLMADLFF

151 QTGNLLAQHA ALVAQFMHCL LLRLFGSLQG VYFVV*
```

Computer analysis of this amino acid sequence gave the following results:

Homology with a predicted ORF from *N. gonorrhoeae*

ORF 507 shows 87.0% identity over a 185 aa overlap with a predicted ORF (ORF 507.ng) from *N. gonorrhoeae*:

```
m506/g507
                    10        20        30        40        50        60
m507.pep    MLLLTLQQGGCFLRGGGFGFVGQVXGLVFLFQTTFALFVLGNRLFGMGKLLLLQRQFAAD
            ||| :||||| || |||||:|||| |||||:||:|||||||| |||||| ||||||||||
g507        MLLPALQQGGGFLSGGGFGLVGQVQGLVFLLQTAFALFVLGNGLFGMGKLLLLQRQFAAD
                    10        20        30        40        50        60

                    70        80        90       100       110       120
m507.pep    AVCLVLLGLEGGVERGLGFFQFQGQTLLVFGNLHRPFRQLGLFFFDLQLVFFKLHADLLL
            |||||||||||:||||| |||||||||:|||||||||||:||:||||||||:||||||||
g507        AVCLVLLGLEGSVERGLDFFQFQGQTLFVFGNLHRPFRQFGLLFFDLQLVFLKLHADLLL
                    70        80        90       100       110       120

                   130       140       150       160       170       180
m507.pep    LMNALXLRLRCLLVAFDALVQVLLMADLFFQTGNLLAQHAALVAQFMHCLLLRLFGSLQG
            | :|| ||||||||||||||||| :||||||||||||||||:||||::||||||||||||
g507        LPDALQLRLRCLLVAFDALVQVLPVADLFFQTGNLLAQHAAFVAQFVYCLLLRLFGSLQG
                   130       140       150       160       170       180

m507.pep    VYFVV
            ||||:
g507        VYFVI
```

The following partial DNA sequence was identified in *N. meningitidis* <SEQ ID 1385>:

```
a507.seq

  1 ATGCTCTTGC TGGCTTTGCA ACAAGGCGGC AGCTTCCTGC GCGGCGGCGG
 51 TTTCGGCTTC GTCAGGCAGA TTCAGGGCTT GGTTTTCCTG TTTCAGACGA
101 CCTTTGCGCT CTTCGTGCTT GGCAACGGTT TGTTCGGCAT GGGCAAGCTG
151 CTGCTGCTTC AACGCCAGTT CGCGGCGGAT GCGGTTTGCC TCGTCCTGCT
201 GGGTTTGGAA GGCGGCATTG AGTGTGGCTT GGGTTTCTTC CAATTCGGGC
251 AGACGCTCTT CGTGTTCGGC AACCTGCATC GCCCATTCCG CCAATTCGGT
301 TTGCTTTTCT TCCGCCTGCA ACTCGTTTTC TTCAAGCTGC ACGCGGATTT
351 GCTGCTGCTC CTGATGGATG CGCTGCATCT GCGCCTGCGC CGCCTGCTTG
401 TCGCGTTCGA TGCGTTGGTG CAGGTTTTGC TGATGGCGGA TTTGTTCTTC
451 CAAACGGGCA ATCTGTTCGC GCAACACGCC GCGTTTGTTG CCCAATTCGT
501 GCACCGCCTG CTGCTGCGAC TGTTCGGCAG TCTGCAAGGC GTGTACTTCG
551 TCGTTTAA
```

This corresponds to the amino acid sequence <SEQ ID 1386; ORF 507.a>:

```
a507.pep

  1 MLLLALQQGG SFLRGGGFGF VRQIQGLVFL FQTTFALFVL GNGLFGMGKL
 51 LLLQRQFAAD AVCLVLLGLE GGIECGLGFF QFGQTLFVFG NLHRPFRQFG
101 LLFFRLQLVF FKLHADLLLL LMDALHLRLR RLLVAFDALV QVLLMADLFF
151 QTGNLFAQHA AFVAQFVHRL LLRLFGSLQG VYFVV*
```

m507/a507 89.7% identity in 185 aa overlap

```
                   10        20        30        40        50        60
m507.pep  MLLLTLQQGGCFLRGGGFGFVGQVXGLVFLFQTTFALFVLGNRLFGMGKLLLLQRQFAAD
          ||||:||||| |||||||||| |: ||||||||||||||||| |||||||||||||||||
a507      MLLLALQQGGSFLRGGGFGFVRQIQGLVFLFQTTFALFVLGNGLFGMGKLLLLQRQFAAD
                   10        20        30        40        50        60

                   70        80        90       100       110       120
m507.pep  AVCLVLLGLEGGVERGLGFFQFQGQTLLVFGNLHRPFRQLGLFFFDLQLVFFKLHADLLL
          ||||||||||||:| ||||||||||||:|||||||||||:||:|| ||||||||||||||
a507      AVCLVLLGLEGGIECGLGFFQFQGQTLFVFGNLHRPFRQFGLLFFRLQLVFFKLHADLLL
                   70        80        90       100       110       120

                  130       140       150       160       170       180
m507.pep  LMNALXLRLRCLLVAFDALVQVLLMADLFFQTGNLLAQHAALVAQFMHCLLLRLFGSLQG
          ||:|| |||| ||||||||||||||||||||||||:|||||:||||:| |||||||||||
a507      LMDALHLRLRRLLVAFDALVQVLLMADLFFQTGNLFAQHAAFVAQFVHRLLLRLFGSLQG
                  130       140       150       160       170       180

m507.pep  VYFVVX
          ||||||
a507      VYFVVX
```

The following partial DNA sequence was identified in *N. gonorrhoeae* <SEQ ID 1387>:

<u>g508.seq</u>

```
  1 ATGGTAGCGT TTGGCGTTGA TCAGGGCCTC CTGCTGCTGC AACAGGGCGG
 51 TTTGGGTGGC GGCCTGAAGC TGCGGCAGCT TGGTTTGCAG GGTTTGTACG
101 CGGGCGTATT GCTCCCTGCC CTGTTCCTGA ATCTGCGCGA GTTTTTCCTG
151 CACGGCGATG TATTCTTCGT CCAGCGTGTG TACGGTTTCG GTCAACTCGT
201 CGAGCTTGAT GTGCTGCTCG TCGTTTTGGA ACTCGGTTTC ATAGGCGAGG
251 GCAAGCTCTT GCCGGCGTTC CTGCCAGTCC AGGGTTTGCT GTTCGAGCCG
301 GGCGATTTGC TGCCGGTAGT TTTGTTTTTG CGGGTTGAGT TTGTGGACGG
351 CGACTTCGGC AAGCCCGTAT TGGCGGTTGG CTTCCAACAG GGCAAGCTGC
401 GCCTGTTTCA GACGGCCTTG CTGCTCTTGG CGGCTGTGCG CGGTGGTTTG
451 CTGCTGGTGT TCGAGTTCGG CGGCGGCTTC CTGCAAAGTA GCGATGTCGT
501 CTGA
```

This corresponds to the amino acid sequence <SEQ ID 1388; ORF 508.ng>:

<u>g508.pep</u>

```
  1 MVAFGVDQGL LLLQQGGLGG GLKLRQLGLQ GLYAGVLLPA LFLNLREFFL
 51 HGDVFFVQRV YGFGQLVELD VLLVVLELGF IGEGKLLPAF LPVQGLLFEP
101 GDLLPVVLFL RVEFVDGDFG KPVLAVGFQQ GKLRLFQTAL LLLAAVRGGL
151 LLVFEFGGGF LQSSDVV
```

The following partial DNA sequence was identified in *N. meningitidis* <SEQ ID 1389>:

<u>m508.seq</u>

```
  1 ATGGTAGCGT TTGGCGTTGA TCAGGGCTTC CTGCTGCTGC AACAAGGCGG
 51 TTTGGGTGGC GGCCTGAAGC TGCGGCAGCT TGGTTTGCAG GGTTTGCACT
101 TTAGCGTATT GCTCCCTGCC CTGTTCCTGA ATCTGCGCGA GTTTCTCTTG
```

-continued

```
151 CACAACAATA TATTCTTCGT CCAAGGTCTG TACGGCTTCG CTTAATTCTT

201 CAAGCTTGAT GTGCTGCTCG TCGTTTTGGA ACTCGGTTTC ATAGGCGAGG

251 GCAAGCTCTT GCTGGCGTTC CTGCCAGTCG AGGGTTTGCT GTTCAAGCTG

301 GGCGATTTGC TGCCGGTAGT TTTGTTTTTG CTGGTTGAGT TTGTGGACGG

351 CGACTTCGGC AAGCCCGTAT TGGCGGTTGG CTTCCAACAG GGCAAGCTGC

401 GCCTGTTTCA GACGGCCTTG CTGCTCTTGG CGGCTGTGCG CGGTGGTTTG

451 CTGCTGGTGT TCGAGTTCGG CGGCGGCTTC CTGCAAGGTA ACGATGTCGT

501 CTGA
```

This corresponds to the amino acid sequence <SEQ ID 1390; ORF 508.ng>:

m508.pep

```
  1 MVAFGVDQGF LLLQQGGLGG GLKLRQLGLQ GLHFSVLLPA LFLNLREFLL

 51 HNNIFFVQGL YGFAXFFKLD VLLVVLELGF IGEGKLLLAF LPVEGLLFKL

101 GDLLPVVLFL LVEFVDGDFG KPVLAVGFQQ GKLRLFQTAL LLLAAVRGGL

151 LLVFEFGGGF LQGNDVV*
```

Computer analysis of this amino acid sequence gave the following results:

Homology with a predicted ORF from *N. gonorrhoeae*

ORF 508 shows 86.8% identity over a 167 aa overlap with a predicted ORF (ORF 508.ng) from *N. gonorrhoeae*:

m508/g508

```
                   10        20        30        40        50        60
m508.pep   MVAFGVDQGFLLLQQGGLGGGLKLRQLGLQGLHFSVLLPALFLNLREFLLHNNIFFVQGL
           |||||||||:||||||||||||||||||||||: :|||||||||||||:||:::|||| :
g508       MVAFGVDQGLLLLQQGGLGGGLKLRQLGLQGLYAGVLLPALFLNLREFFLHGDVFFVQRV
                   10        20        30        40        50        60

                   70        80        90       100       110       120
m508.pep   YGFAXFFKLDVLLVVLELGFIGEGKLLLAFLPVEGLLFKLGDLLPVVLFLLVEFVDGDFG
           |||: : :||||||||||||||||||| |||||:||||: |||||||||| |||||||||
g508       YGFGQLVELDVLLVVLELGFIGEGKLLPAFLPVQGLLFEPGDLLPVVLFLRVEFVDGDFG
                   70        80        90       100       110       120

                  130       140       150       160
m508.pep   KPVLAVGFQQGKLRLFQTALLLLAAVRGGLLLVFEFGGGFLQGNDVV
           ||||||||||||||||||||||||||||||||||||||||||::|||
g508       KPVLAVGFQQGKLRLFQTALLLLAAVRGGLLLVFEFGGGFLQSSDVV
                  130       140       150       160
```

The following partial DNA sequence was identified in *N. meningitidis* <SEQ ID 1391>:

a508.seq

```
  1 ATGGTAGCGT TTGGCGTTGA TCAGGGCTTC CTGCTGCTGC AACAGGGCGG

 51 TTTGGGTGGC GGCCTGAAGC TGCGGCAGCT TGGTTTGCAG GGTTTGTACG

101 CGGGCGTATT GTTCCCTACC CTGCTCCTGA ATCTGCGCGA GTTTCTCCTG

151 TACGACAATA TATTCTTCGT CCAAACTCTG TACGGCTTCG CTCAACTCTT
```

-continued

```
201 CGAGCTTGAT GTGCTGCTCG TCGTTTTGGA ACTCGGTTTC ATAGGCGAGG

251 GCAAGCTCTT GCTGGCGTTC CTGCCAATCG AAGGTTTGTT GTTCAAGCTG

301 GGCAATTTGC TGTTGGTAGT TTTGTTTTTG CTGGTTGAGC TTGTGGACGG

351 CGACTTCGGC AAGCCCGTAT TGGCGGTTGG CTTCCAACAG GGCAAGCTGC

401 GCCTGTTTCA GACGACCTTG CTGCTCTTGG CGGCTGTGCG CGGCGGTTTG

451 CTGCTGGTGT TCGAGTTCGG CGGCGGCTTC CTGCAAAATG GCGATGTCGT

501 CTGA
```

This corresponds to the amino acid sequence <SEQ ID 1392; ORF 508.a>:

a508.pep

```
  1 MVAFGVDQGF LLLQQGGLGG GLKLRQLGLQ GLYAGVLFPT LLLNLREFLL

 51 YDNIFFVQTL YGFAQLFELD VLLVVLELGF IGEGKLLLAF LPIEGLLFKL

101 GNLLLVVLFL LVELVDGDFG KPVLAVGFQQ GKLRLFQTTL LLLAAVRGGL

151 LLVFEFGGGF LQNGDVV*
```

m508/a508 88.6% identity in 167 aa overlap

```
                    10        20        30        40        50        60
m508.pep   MVAFGVDQGFLLLQQGGLGGGLKLRQLGLQGLHFSVLLPALFLNLREFLLHNNIFFVQGL
           ||||||||||||||||||||||||||||||||: :||:|:|:||||||||::|||||| |
a508       MVAFGVDQGFLLLQQGGLGGGLKLRQLGLQGLYAGVLFPTLLLNLREFLLYDNIFFVQTL
                    10        20        30        40        50        60

                    70        80        90       100       110       120
m508.pep   YGFAXFFKLDVLLVVLELGFIGEGKLLLAFLPVEGLLFKLGDLLPVVLFLLVEFVDGDFG
           ||||  :|:||||||||||||||||||:|||||||:|| ||||||||:||||||
a508       YGFGQLVELDVLLVVLELGFIGEGKLLPAFLPIQGLLFKPGNLLLVVLFLLVELVDGDFG
                    70        80        90       100       110       120

                   130       140       150       160
m508.pep   KPVLAVGFQQGKLRLFQTALLLLAAVRGGLLLVFEFGGGFLQGNDVVX
           ||||||||||||||||||:|||||||||||||||||||||||::||||
a508       KPVLAVGFQQGKLRLFQTTLLLLAAVRGGLLLVFEFGGGFLQNGDVVX
                   130       140       150       160
```

The following partial DNA sequence was identified in *N. gonorrhoeae* <SEQ ID 1393>:

g509.seq

```
  1 atggtcgctg tatgtgatga acgggctgta cagcggacgt tggtggccca

 51 attcgcgcaa caaggcggct tgtttttgct cttcgttcag gctgttgtag

101 tcttccaagc ctgcgtgttg gaaaagctcg gcaaccacat cggcgtgttt

151 gcctgcgtgt tggcgcaggt cgagcggcat catgtggaag ccgaacacgg

201 acacggaacg gatgaggtct gccaaacggc cttcggcaag caggcggctg

251 ccgttgtcga taagggaacg ttgcaatttt ttcaaatcat cgagaaattt

301 ttgggccgaa gcataaggct cgagaaagcc gaatttgcag cccatgccca

351 aaccgagcga gcgcgctttg cccatagcgc gcgccataat gtaggcaatg

401 gcgcggcggt aaggttcttc ggtgcgggcg atttcttcgt caggcgagag

451 ggctgccagt gccattacgt cgtcgttgac tttgacgcgg cggatggaaa
```

-continued

```
 501 gcggcagttc gcggtaaagt ttgtcgagtt cgctgcggta aaaacggaac
 551 acggcatcgg cgtggcggcg gaaggcaaag cgcagggttt cgccagaaac
 601 aaacggattg ccgtcgcggt cgccgccgat ccagccgccg attttaagga
 651 tattcggaac gcggacatcg ggataggccg tctgaaagtc gtgttccatc
 701 ttgcggtaga gtttgggcag ggcttcaaaa aagctcatcg ggaagatgga
 751 cacgccgttg ttgatttcgt cgttgacgct gagtttgtgg cggcgcgttt
 801 cgctggtctg ccacaagccc agaagcacgg tgtcgatttc gcggcgcagc
 851 cgtgccagcg cgtcggcatt ggtgcagcgt tcgcgttgcg gcagcagcgc
 901 gcggatgcgg cggttgaaat tcaaaacggt ttggcgttgc acttcggtcg
 951 ggtgcgcggt caaaacggcg gtaacggacg tattgtccaa ctgccgctgc
1001 accgatttgc cgtcggcttt ccccgctttg agcctgcgga cggtttccgt
1051 caggctgcct tctgctgcgt tgtggccggc atcttcgtgg atttggcggc
1101 ggcgttcgtg gtgcacgtct tcggcgatat tcagaatctg ggcgaacagc
1151 ccgcaggcaa gcgtcagatc gtaggtctgc cgttcgtcca attgcggcaa
1201 tactttttca atcaatgccg cgctgtcgtc ggaagtggac aagagtttga
1251 ccgtttcgac aaccaacggc gaggcttctt cgtgcaggag gttgaacagg
1301 gactgtttca aaaattccgc gtccgccgcc aaagccgcgt ccttcggatt
1351 gttcaggata tgcagttgca tgattttcct ctcattgccg taaatactgt
1401 aaatgtacct caaatgccgc atccgtgcca aaccgttcac actttaacca
1451 ctcatgtccc gaaatgccgt ctgaagttga acgccgcccg acggcggcgt
1501 tacaatcgcc cgcaactgtt tttttccgaa catcatcatg accgcgaccg
1551 aacacgacaa cgacgacgca ctcctgctgc ggtacagccg ccacatcctc
1601 ttggacgaaa tcggcatcga agggcagcag aagctttccg ccgcgcatat
1651 tttggtcgtc ggctgcggcg gattgggcgc cgccgcccct gccctatctc
1701 gccgcctcgg gggtcggcac gctga
```

This corresponds to the amino acid sequence <SEQ ID 1394; ORF 509.ng>:

g509.pep

```
  1 MVAVCDERAV QRTLVAQFAQ QGGLFLLFVQ AVVVFQACVL EKLGNHIGVF
 51 ACVLAQVERH HVEAEHGHGT DEVCQTAFGK QAAAVVDKGT LQFFQIIEKF
101 LGRSIRLEKA EFAAHAQTER ARFAHSARHN VGNGAAVRFF GAGDFFVRRE
151 GCQCHYVVVD FDAADGKRQF AVKFVEFAAV KTEHGIGVAA EGKAQGFARN
201 KRIAVAVAAD PAADFKDIRN ADIGIGRLKV VFHLAVEFGQ GFKKAHREDG
251 HAVVDFVVDA EFVAARFAGL PQAQKHGVDF AAQPCQRVGI GAAFALRQQR
301 ADAAVEIQNG LALHFGRVRG QNGGNGRIVQ LPLHRFAVGF PRFEPADGFR
351 QAAFCCVVAG IFVDLAAAFV VHVFGDIQNL GEQPAGKRQI VGLPFVQLRQ
401 YFFNQCRAVV GSGQEFDRFD NQRRGFFVQE VEQGLFQKFR VRRQSRVLRI
451 VQDMQLHDFP LIAVNTVNVP QMPHPCQTVH TLTTHVPKCR LKLNAARRRR
```

-continued

```
501 YNRPQLFFSE HHHDRDRTRQ RRRTPAAVQP PHPLGRNRHR RAAEAFRRAY

551 FGRRLRRIGR RRPCPISPPR GSAR*
```

The following partial DNA sequence was identified in *N. meningitidis* <SEQ ID 1395>:

m509.seq

```
   1 ATGGTCGCTG TATGTGATAA ACGGGCTGTA CAGAGGACGT TGATGGCTCA
  51 ATTCGCGCAA CAGGGCGGTT TGTTTTTGCT CTTCGTTCAG GCGGTTGTAG
 101 TCTTCCAAGC CTGCGTGTTG GAAAAGCTCG GCAACCACAT CGGCGTGTTT
 151 GCCTGCGTGT TGGCGCAAGT CGAGCGGCAT CATGTGAAAG CCGAACACGG
 201 ATACGGAACG GATGAGGTCT GCCAAACGGC CTTCGGCAAG CAGACGGCTG
 251 CCGTTGTCGA TAAGGGAACG TTGCAATTTT TTCAAATCAT CCAGAAACTC
 301 TTGTGCCGAA GCATAAGGCT CGAGAAAGCC GAATTTGCAG CCCATACCCA
 351 AACCGAGCGC GCGCGCTTTG CCCATAGCGC GCGCCATAAT GTAGGCGATG
 401 GCGCGGCGGT AGGGTTCTTC GGCGCGGGCG ATTTCTTCGT CGGGCGATTT
 451 GTCGGACAAC GCCGTTACAT CGCCGTTGAC TTTGACGCGG CGGATGGAGA
 501 GCGGCAGTTC GCGGTAGAGT TTGTCGAGTT CGCCGCGATA GAAGCGGAAC
 551 ACGGCATCGG CGTGGCGGCG GAAGGCAAAG CGCAGGGTTT CGGCAGAAAC
 601 AAACGGATTG CCGTCGCGGT CGCCGCCGAT CCAGCCGCCG ATTTTGAGGA
 651 TGTCCGGAAC GCGGACGCCG GGATAGGCCG TCTGAAAGTC GTGTTCCATC
 701 TTGCGGTAGA GCTTGGGCAG GGCTTCGAAA AAGCTCATCG GGAAGATGGA
 751 CACGCCGTTG TTGATTTCGT CGTTGACGCT GAGTTTGTGG CGGCGCGTTT
 801 CGCTGGTCTG CCACAAGCCC AGCAGGATAG TGTCGATTtC GCgGCGCAGC
 851 CGTGCCAGCG CGTCGGCATT GGTGCAGCGT TCgCGTTGCG GCAACAGTGC
 901 GCGGATGCGG CGGTTGAAGC TTAAGACGGT TTGGCGTTGC ACTTCGGTCG
 951 GGTGCGCGGT CAAAACGGCG GTAACGGACG TATTGTCCAA CTGCCGCTGC
1001 ACCGATTTGC CGTCGGCTTT CCCCGCTTTG AGCCTGCGGA CGGTTTCCGT
1051 CAGGCTGCCT TCCGCGCCGC CGCGTCCGGC TTCTTCGTGG ATTTGGCGGC
1101 GGCGTTCGTG GTGCACGTCT TCGGCGATGT TCAAAATCTG GGCGAACAGG
1151 CCGCAGGCCA AGGTTAAATC GTGGGTTTGT TGTTCGTCCA ATTGCGGCAA
1201 TACTTTTTCA ATCAATGCCG CGCTGTCGTC GGAAGTGGAC AAGAGTTTGA
1251 CTGTTTCGAC AACCAACGGC GAGGCTTCTT CGTGCAGGAG GTTGAACAGG
1301 GATTGTTTCA GAAATTCCGC GTCCGCCGCC AAAGCCGCGT CCTTTGGATT
1351 GTTCAGAATA TGCAGTTGCA TGATTTTTCT CTCTCGTCTG CCGTAAATAT
1401 TGTAAATGTA CCCCAAATGC CGCATCCGTG CCAAACCGTT CACACTTTAA
1451 CCGCCCGTGT CCCGAAATGC CGTCTGAAGT TGAACGCCGC CCGACGGCAG
1501 CGTTACAATC GCCCGCAACT GTTTTtTTCC GAACATCATC ATGACCACGA
1551 CCGAACACGA CAACGACGAT GCATTCCTGC TGCGGTACAG CCGCCACATC
1601 CTCTTGGACG AAATCGGCAT CGAAGGGCAG CAGAAACTTT CCGCCGCGCA
```

-continued

```
1651 TATTTTGGTC GTCGGCTGCG GCGGTTTGGG TGCCGCCGCA CT.GCCCTAC

1701 CTTGCCGCTT CGGGTGTCGG CACGCTGA
```

This corresponds to the amino acid sequence <SEQ ID 1396; ORF 509>:

m509.pep

```
  1 MVAVCDKRAV QRTLMAQFAQ QGGLFLLFVQ AVVVFQACVL EKLGNHIGVF

 51 ACVLAQVERH HVKAEHGYGT DEVCQTAFGK QTAAVVDKGT LQFFQIIQKL

101 LCRSIRLEKA EFAAHTQTER ARFARSARHN VGDGAAVGFF GAGDFFVGRF

151 VGQRRYIAVD FDAADGERQF AVEFVEFAAI EAEHGIGVAA EGKAQGFGRN

201 KRIAVAVAAD PAADFEDVRN ADAGIGRLKV VFHLAVELGQ GFEKAHREDG

251 HAVVDFVVDA EFVAARFAGL PQAQQDSVDF AAQPCQRVGI GAAFALRQQC

301 ADAAVEAXDG LALHFGRVRG QNGGNGRIVQ LPLHRFAVGF PRFEPADGFR

351 QAAFRAAASG FFVDLAAAFV VHVFGDVQNL GEQAAGQGXI VGLLFVQLRQ

401 YFFNQCRAVV GSGQEFDCFD NQRRGFFVQE VEQGLFQKFR VRRQSRVLWI

451 VQNMQLHDFS LSSAVNIVNV PQMPHPCQTV HTLTARVPKC RLKLNAARRQ

501 RYNRPQLFFS EHHHDHDRTR QRRCIPAAVQ PPHPLGRNRH RRAAETFRRA

551 YFGRRLRRFG CRRTXPTLPL RVSAR*
```

Computer analysis of this amino acid sequence gave the following results:

Homology with a predicted ORF from *N. gonorrhoeae*

ORF 509 shows 87.8% identity over a 575 aa overlap with a predicted ORF (ORF 509.ng) from *N. gonorrhoeae*:

m509/g509

```
                    10        20        30        40        50        60
m509.pep    MVAVCDKRAVQRTLMAQFAQQGGLFLLFVQAVVVFQACVLEKLGNHIGVFACVLAQVERH
            ||||||:|||||||:|||||||||||||||||||||||||||||||||||||||||||||
g509        MVAVCDERAVQRTLVAQFAQQGGLFLLFVQAVVVFQACVLEKLGNHIGVFACVLAQVERH
                    10        20        30        40        50        60

                    70        80        90       100       110       120
m509.pep    HVKAEHGYGTDEVCQTAFGKQTAAVVDKGTLQFFQIIQKLLCRSIRLEKAEFAAHTQTER
            ||:||||:|||||||||||||:|||||||||||||||:|:| |||||||||||||:||||
g509        HVEAEHGHGTDEVCQTAFGKQAAAVVDKGTLQFFQIIEKFLGRSIRLEKAEFAAHAQTER
                    70        80        90       100       110       120

                   130       140       150       160       170       180
m509.pep    ARFAHSARHNVGDGAAVGFFGAGDFFVGRFVGQRRYIAVDFDAADGERQFAVEFVEFAAI
            ||||||||||||:|||| ||||||||| |   | :|::||||||||:|||||:|||||:
g509        ARFAHSARHNVGNGAAVRFFGAGDFFVRREGCQCHYVVVDFDAADGKRQFAVKFVEFAAV
                   130       140       150       160       170       180

                   190       200       210       220       230       240
m509.pep    EAEHGIGVAAEGKAQGFGRNKRIAVAVAADPAADFEDVRNADAGIGRLKVVFHLAVELGQ
            ::|||||||||||||||:|||||||||||||||||:|:|||| ||||||||||||||:||
g509        KTEHGIGVAAEGKAQGFARNKRIAVAVAADPAADFKDIRNADIGIGRLKVVFHLAVEFGQ
                   190       200       210       220       230       240

                   250       260       270       280       290       300
m509.pep    GFEKAHREDGHAVVDFVVDAEFVAARFAGLPQAQQDSVDFAAQPCQRVGIGAAFALRQQC
            ||:|||||||||||||||||||||||||||||||: :||||||||||||||||||||||
g509        GFKKAHREDGHAVVDFVVDAEFVAARFAGLPQAQKHGVDFAAQPCQRVGIGAAFALRQQR
                   250       260       270       280       290       300

                   310       320       330       340       350       360
m509.pep    ADAAVEAXDGLALHFGRVRGQNGGNGRIVQLPLHRFAVGFPRFEPADGFRQAAFRAAASG
            ||||||  :|||||||||||||||||||||||||||||||||||||||||||||| :::|
g509        ADAAVEIQNGLALHFGRVRGQNGGNGRIVQLPLHRFAVGFPRFEPADGFRQAAFCCVVAG
                   310       320       330       340       350       360
```

-continued

```
                  370       380       390       400       410       420
m509.pep   FFVDLAAAFVVHVFGDVQNLGEQAAGQGXIVGLLFVQLRQYFFNQCRAVVGSGQEFDCFD
           :|||||||||||||||:|||||| ||:  |||| ||||||||||||||||||||||| ||
g509       IFVDLAAAFVVHVFGDIQNLGEQPAGKRQIVGLPFVQLRQYFFNQCRAVVGSGQEFDRFD
                  370       380       390       400       410       420

                  430       440       450       460       470       480
m509.pep   NQRRGFFVQEVEQGLFQKFRVRRQSRVLWIVQNMQLHDFSLSSAVNIVNVPQMPHPCQTV
           |||||||||||||||||||||||||||| |||:|||||| |  ||| |||||||||||||
g509       NQRRGFFVQEVEQGLFQKFRVRRQSRVLRIVQDMQLHDFPLI-AVNTVNVPQMPHPCQTV
                  430       440       450       460       470       480

                  490       500       510       520       530       540
m509.pep   HTLTARVPKCRLKLNAARRQRYNRPQLFFSEHHHDHDRTRQRRCIPAAVQPPHPLGRNRH
           ||||::|||||||||||||:|||||||||||||||:|||||||  |||||||||||||||
g509       HTLTTHVPKCRLKLNAARRRRYNRPQLFFSEHHHDRDRTRQRRRTPAAVQPPHPLGRNRH
                  490       500       510       520       530       540

                  550       560       570
m509.pep   RRAAETFRRAYFGRRLRRFGCRRTCPTLPLRVSAR
           |||||:||||||||||||:| || ||  | | |||
g509       RRAAEAFRRAYFGRRLRRIGRRRPCPISPPRGSAR
                  550       560       570
```

The following partial DNA sequence was identified in *N. meningitidis* <SEQ ID 1397>:

a509.seq

```
   1 ATGGTCGCTG TATGTGATGA ACGGACTGTA CAGTGGACGT TGATGGCTCA
  51 ATTCGCGCAA CAGGGCGGCT TGTTTTTGCT CTTCGTTGAG GCTGTTGTAG
 101 TCTTCCAAGC CTGCGTGTTG GAAAAGCTCG GCAACCACAT CGGCGTGTTT
 151 GCCTGCGTGT TGGCGCAGGT CGAGCGGCAT CATGTGGAAG CCGAACACGG
 201 ATACGGAACG GATGAGGTCT GCCAAACGGC CTTCGGCAAG CAGGCGGCTG
 251 CCGTTGTCGA TAAGGGAATG TTGCAATTTT TTCAAATCAT CGAGAAATTC
 301 TTGTGCCGAA GCATAAGGCT CGAGAAAGCC GAATTTGCAG CCCATACCCA
 351 AACCGAGCGC GCGCGCTTTG CCCATAGCGC GCGCCATAAT GTAGGCAATG
 401 GCGCGACGGT AGGGTTCTTC GGCGCGGGCG GTTTCTTCGT CGGGCGATTT
 451 GTCGGACAAC GCCATCACAT CGCGGTTGAC TTTGACGCGG CGGATGGAGA
 501 GCGGCAGTTC GCGGTAGAGT TTGTCGAGTT CGCCACGGTA AAAACGGAAC
 551 ACGGCATCGG CGTGGCGGCG GAAGGCAAAA CGCAAGGTTT CGGCAGAAAC
 601 GAACGGATTG CCGTCGCGGT CGCCGCCGAT CCAGCCGCCG ATTTTGAGGA
 651 TGTCCGGAAC GCGGACATCG GGATAGGCCG TCTGAAAGTC GTGTTCCATC
 701 TTGCGGTAGA GCTTGGGCAG GGCTTCAAAA AAGCTCATCG GAAAGATGGA
 751 CACGCCGTTG TTGATTTCGT CGTTGACGCT GAGTTTGTGG CGGCGCGTTT
 801 CGCTGGTCTG CCACAAGCCC AGCAGGATAG TGTCGATTTC GCGGCGCAGC
 851 CGTGCCAGCG CGTCGGCATT GGTACAGCGT TCGCGTTGCG GCAGCAGCGC
 901 GCGGATGCGG CGGTTGAAAT TCAAGACGGT CTGGCGTTGC ACTTCGGTCG
 951 GGTGCGCGGT CAAAACGGCG GTAACGGACG TATTGTCCAA CTGCCGCTGC
1001 ACCGATTTGC CGTCGGCTTT CCCCGCTTTG AGCCTGCGGA CGGTTTCCGT
1051 CAGGCTGCCT TCCGCGCCGC CGCGTCCGGC TTCTTCGTGG ATTTGGCGGC
1101 GGCGTTCGTG GTGCACGTCT TCGGCGATGT TCAAAATCTG GGCGAACAGG
1151 CCGCAGGCCA AGGTTAAATC GTGGGTTTGT TGTTCGTCCA ATTGCGGCAA
1201 TACTTTTTCA ATCAATGCCG CGCTGTCGTC GGAAGTGGAC AAGAGTTTGA
```

-continued

```
1251 CCGTTTCGAC AACCAACGGC GAGGCTTCTT CGTGCAGGAG GTTGAACAGG

1301 GATTGTTTCA GAAATTCCGC GTCCGCCGCC AAAGCCGCGT CCTTTGGATT

1351 GTTCAGAATA TGCAGTTGCA TGATTTTTCT CTCATTGCCG TAAATACTGT

1401 AAATGTACCT CAAATGCCGC ATCCGTGCCA AACCGTTCAC ACTTTAACCG

1451 CCCGTGTCCC GAAATGCCGT CTGAAGTTGA ACGCCGCCCG ACGGCAGCGT

1501 TACAATCGCC CACAACTGTT TTT.TCCGAA CATCATCATG ACCACGACCG

1551 AACACGACAA CGACGATGCA TTCCTGCTGC GGTACAGCCG CCACATCCTC

1601 TTGGACGAAA TTGGCATCGA AGGGCAGCAG AAACTTTCCG CCGCGCATAT

1651 TTTGGTCGTC GGCTGCGGCG GTTTGGGTGC CGCCG.CCCT GCCCTATCTC

1701 GCCGCTTCCG GCATCGGCAC GCTGA
```

This corresponds to the amino acid sequence <SEQ ID 1398; ORF 509.a>:

a509.pep

```
  1 MVAVCDERTV QWTLMAQFAQ QGGLFLLFVE AVVVFQACVL EKLGNHIGVF

 51 ACVLAQVERH HVEAEHGYGT DEVCQTAFGK QAAAVVDKGM LQFFQIIEKF

101 LCRSIRLEKA EFAAHTQTER ARFAHSARHN VGNGATVGFF GAGGFFVGRF

151 VGQRHHIAVD FDAADGERQF AVEFVEFATV KTEHGIGVAA EGKTQGFGRN

201 ERIAVAVAAD PAADFEDVRN ADIGIGRLKV VFHLAVELGQ GFKKAHRKDG

251 HAVVDFVVDA EFVAARFAGL PQAQQDSVDF AAQPCQRVGI GTAFALRQQR

301 ADAAVEIQDG LALHFGRVRG QNGGNGRIVQ LPLHRFAVGF PRFEPADGFR

351 QAAFRAAASG FFVDLAAAFV VHVFGDVQNL GEQAAGQG*I VGLLFVQLRQ

401 YFFNQCRAVV GSGQEFDRFD NQRRGFFVQE VEQGLFQKFR VRRQSRVLWI

451 VQNMQLHDFS LIAVNTVNVP QMPHPCQTVH TLTARVPKCR LKLNAARRQR

501 YNRPQLFXSE HHHDHDRTRQ RRCIPAAVQP PHPLGRNWHR RAAETFRRAY

551 FGRRLRRFGC RXPCPISPLP ASAR*
```

m509/a509 93.0% identity in 575 aa overlap

```
                    10        20        30        40        50        60
m509.pep    MVAVCDKRAVQRTLMAQFAQQGGLFLLFVQAVVVFQACVLEKLGNHIGVFACVLAQVERH
            ||||||:|:|| |||||||||||||||||:||||||||||||||||||||||||||||||
a509        MVAVCDERTVQWTLMAQFAQQGGLFLLFVEAVVVFQACVLEKLGNHIGVFACVLAQVERH
                    10        20        30        40        50        60

                    70        80        90       100       110       120
m509.pep    HVKAEHGYGTDEVCQTAFGKQTAAVVDKGTLQFFQIIQKLLCRSIRLEKAEFAAHTQTER
            ||:||||||||||||||||||:||||||| |||||||:|:||||||||||||||||||||
a509        HVEAEHGYGTDEVCQTAFGKQAAAVVDKGMLQFFQIIEKFLCRSIRLEKAEFAAHTQTER
                    70        80        90       100       110       120

                   130       140       150       160       170       180
m509.pep    ARFAHSARHNVGDGAAVGFFGAGDFFVGRFVGQRRYIAVDFDAADGERQFAVEFVEFAAI
            ||||||||||||:||:||||||| ||||||||||::||||||||||||||||||||||::
a509        ARFAHSARHNVGNGATVGFFGAGGFFVGRFVGQRHHIAVDFDAADGERQFAVEFVEFATV
                   130       140       150       160       170       180

                   190       200       210       220       230       240
m509.pep    EAEHGIGVAAEGKAQGFGRNKRIAVAVAADPAADFEDVRNADAGIGRLKVVFHLAVELGQ
            ::|||||||||||:||||||:|||||||||||||||||||||| ||||||||||||||||
a509        KTEHGIGVAAEGKTQGFGRNERIAVAVAADPAADFEDVRNADIGIGRLKVVFHLAVELGQ
                   190       200       210       220       230       240
```

-continued

```
                   250       260       270       280       290       300
m509.pep    GFEKAHREDGHAVVDFVVDAEFVAARFAGLPQAQQDSVDFAAQPCQRVGIGAAFALRQQC
            ||:||||:|||||||||||||||||||||||||||||||||||||||||||:||||||| 
a509        GFKKAHRKDGHAVVDFVVDAEFVAARFAGLPQAQQDSVDFAAQPCQRVGIGTAFALRQQR
                   250       260       270       280       290       300

                   310       320       330       340       350       360
m509.pep    ADAAVEAXDGLALHFGRVRGQNGGNGRIVQLPLHRFAVGFPRFEPADGFRQAAFRAAASG
            ||||||  ||||||||||||||||||||||||||||||||||||||||||||||||||||
a509        ADAAVEIQDGLALHFGRVRGQNGGNGRIVQLPLHRFAVGFPRFEPADGFRQAAFRAAASG
                   310       320       330       340       350       360

                   370       380       390       400       410       420
m509.pep    FFVDLAAAFVVHVFGDVQNLGEQAAGQGXIVGLLFVQLRQYFFNQCRAVVGSGQEFDCFD
            ||||||||||||||||||||||||||||||||||||||||||||||||||||||||| ||
a509        FFVDLAAAFVVHVFGDVQNLGEQAAGQGXIVGLLFVQLRQYFFNQCRAVVGSGQEFDRFD
                   370       380       390       400       410       420

                   430       440       450       460       470       480
m509.pep    NQRRGFFVQEVEQGLFQKFRVRRQSRVLWIVQNMQLHDFSLSSAVNIVNVPQMPHPCQTV
            |||||||||||||||||||||||||||||||||||||||||  ||| |||||||||||||
a509        NQRRGFFVQEVEQGLFQKFRVRRQSRVLWIVQNMQLHDFSLI-AVNTVNVPQMPHPCQTV
                   430       440       450       460       470       480

                   490       500       510       520       530       540
m509.pep    HTLTARVPKCRLKLNAARRQRYNRPQLFFSEHHHDHDRTRQRRCIPAAVQPPHPLGRNRH
            |||||||||||||||||||||||||||| ||||||||||||||||||||||||||||| |
a509        HTLTARVPKCRLKLNAARRQRYNRPQLFXSEHHHDHDRTRQRRCIPAAVQPPHPLGRNWH
                   490       500       510       520       530       540

                   550       560       570
m509.pep    RRAAETFRRAYFGRRLRRFGCRRTCPTLPLRVSARX
            ||||||||||||||||||||||   |  || :||||
a509        RRAAETFRRAYFGRRLRRFGCRXPCPISPLPASARX
                   550       560       570
```

The following partial DNA sequence was identified in *N. gonorrhoeae* <SEQ ID 1399>:

g510.seq

```
  1 atgccttcgc ggacaccgca gggaaaaagg ggttattcct gccccaagcg
 51 ggatagtgcc ttttggcagg cgttgtccat atcggttatt ttacgcgcaa
101 aatcgccgat tgccaaatcg ccgccgttca gggaggtttt caataggtcg
151 tggacgacgt tgagcgcggc cataatgacg attttttcgc tgtccgcgac
201 gcggccgcct tcgcggatgg cttcggcttt gccgttgagc attccgactg
251 cctgcaacag tgtgtctttt tcttctgccg gcgtgttgac agtcagccgg
301 ggcgtgcatg acttcgatgt agacttgttc gatgttcatc ctttaatcct
351 tattgctgcg tttcctgccg ttgggggagg cgcgctgcca gtgcgctga
```

This corresponds to the amino acid sequence <SEQ ID 1400; ORF 510.ng>:

g510.pep

```
  1 MPSRTPQGKR GYSCPKRDSA FWQALSISVI LRAKSPIAKS PPFREVFNRS
 51 WTTLSAAIMT IFSLSATRPP SRMASALPLS IPTACNSVSF SSAGVLTVSR
101 GVHDFDVDLF DVHPLILIAA FPAVGGGALP VR*
```

The following partial DNA sequence was identified in *N. meningitidis* <SEQ ID 1401>:

m510.seq

```
  1 ATGCCTTCGC GGACACCGCA GGGnAAAAGG GGTTATTCCT GCGCCAAGCG
 51 GGATAGTGCT TTTTGGCAGG CGTTGTCCAT ATCGGCTATT TTACGCGCAA
```

-continued

```
101 AATCGCCGAT TGCCAAATCG CCGCCGTTCA GGGAGGTTTT CAACAGGTCG

151 TGGACGACGT TGAGCGCGGC CATAATGACG ATTTTTTCGC TGTCCGCGAC

201 GCGTCCGCCT TCGCGGATGG CTTCGGCTTT GCCGTTGAGC ATTCCGACTG

251 CCTGCAACAG TGTGTCTTTT TCTTCTGCCG GCGTGTTGAC GGTCAGCCGG

301 GGCGTGCAwG ACTTCsAtGT GGACTTGTTC GATGTTCATC CTTTAATCCT

351 TATTGCTGCG TTTCCTGCCA TTGGGGGAGG CGCGCTGCCA GTGCGCTGA
```

This corresponds to the amino acid sequence <SEQ ID 1402; ORF 510>:

m510.pep

```
  1 MPSRTPQGKR GYSCAKRDSA FWQALSISAI LRAKSPIAKS PPFREVFNRS

 51 WTTLSAAIMT IFSLSATRPP SRMASALPLS IPTACNSVSF SSAGVLTVSR

101 GVXDFXVDLF DVHPLILIAA FPAIGGGALP VR*
```

Computer analysis of this amino acid sequence gave the following results:

Homology with a predicted ORF from *N. gonorrhoeae*

ORF 510 shows 96.2% identity over a 132 aa overlap with a predicted ORF (ORF 510.ng) from *N. gonorrhoeae*.

m510/g510

```
                    10        20        30        40        50        60
m510.pep    MPSRTPWGKRGYSCAKRDSAFWQALSISAILRAKSPIAKSPPFREVFNRSWTTLSAAIMT
            ||||||||||||| |||||||||||||:||||||||||||||||||||||||||||||||
g510        MPSRTPWGKRGYSCPKRDSAFWQALSISVILRAKSPIAKSPPFREVFNRSWTTLSAAIMT
                    10        20        30        40        50        60
                    70        80        90       100       110       120
m510.pep    IFSLSARTPPSRMASALPLSIPTACNSVSFSSAGVLTVSRGVXDFXVDLFDVHPLILIAA
            |||||||||||||||||||||||||||||||||||||||| || ||||||||||||||
g510        IFSLSARTPPSRMASALPLSIPTACNSVSFSSAGVLTVSRGVHDFDVDLFDVHPLILIAA
                    70        80        90       100       110       120
                   130
m510.pep    FPAIGGGALPVRX
            |||:|||||||||
g510        FPAVGGGALPVRX
                   130
```

The following partial DNA sequence was identified in *N. meningitidis* <SEQ ID 1403>:

a510.seq

```
  1 ATGCCTTCGC GGACACCGCA GGGAAAAAGG GGTTATTCCT GCGCCAAGCG

 51 GGATAGTGCT TTTTGGCAGG CGTTGTCCAT ATCGGCTATT TTACGCGCAA

101 AATCGCCGAT TGCCAAATCG CCGCCGTTCA GGGAGGTTTT CAACAGGTCG

151 TGGACGACGT TGAGCGCGGC CATAATGACG ATTTTTTCGC TGTCCGCGAC

201 GCGTCCGCCT TCGCGGATGG CTTCGGCTTT GCCGTTGAGC ATTCCGACTG

251 CCTGCAACAG TGTGTCTTTT TCTTCTGCCG GCGTGTTGAC GGTCAGCCGG

301 G.CGTGCATG ACTTCGATGT GGACTTGTTC GATGTTCATC CTTTAATCCT

351 TATTGCTGCG TTTCCTGCCG TTGGGGGAGG CGCGCTGCCA GTGCGCTGA
```

This corresponds to the amino acid sequence <SEQ ID 1404; ORF 510.a>:

a510.pep

```
  1 MPSRTPQGKR GYSCAKRDSA FWQALSISAI LRAKSPIAKS PPFREVFNRS

 51 WTTLSAAIMT IFSLSATRPP SRMASALPLS IPTACNSVSF SSAGVLTVSR

101 XVHDFDVDLF DVHPLILIAA FPAVGGGALP VR*
```

m510/a510 97.0% identity in 132 aa overlap

```
                   10        20        30        40        50        60
m510.pep  MPSRTPWGKRGYSCAKRDSAFWQALSISAILRAKSPIAKSPPFREVFNRSWTTLSAAIMT
          ||||||||||||||||||||||||||||||||||||||||||||||||||||||||||||
a510      MPSRTPWGKRGYSCAKRDSAFWQALSISAILRAKSPIAKSPPFREVFNRSWTTLSAAIMT
                   10        20        30        40        50        60

                   70        80        90       100       110       120
m510.pep  IFSLSARTPPSRMASALPLSIPTACNSVSFSSAGVLTVSRGVXDFXVDLFDVHPLILIAA
          |||||||||||||||||||||||||||||||||||||||| | || ||||||||||||||
a510      IFSLSARTPPSRMASALPLSIPTACNSVSFSSAGVLTVSRXVHDFDVDLFDVHPLILIAA
                   70        80        90       100       110       120

                  130
m510.pep  FPAIGGGALPVRX
          |||:||||||||
a510      FPAVGGGALPVRX
                  130
```

The following partial DNA sequence was identified in *N. gonorrhoeae* <SEQ ID 1405>:

g512.seq

```
  1 atgaaagtgc ttgttttagg tgcgggtgtt gccggcgtat cctccgtgtg

 51 gtatctggca gaggccggac atgaagtaac ggtcatcgac cgcaccgagg

101 gtgtggcgat ggaaaccagt tttgccaatg caggccagct ttcttacggc

151 tataccacgc cttgggctgc acccggtatt ccgaccaaag cactgaaacg

201 gctgtttaaa agccatccgc ctttactgtt ccgccctgac ggcggcctgt

251 atcaaatcga atggctgtgg cggatgctgc aaaactgcac ggcaacgcgc

301 tatcaaatca ataaagagcg catggtcagg atttccgaat acagccgtga

351 aatgttccgc cgttttgaag cgcaaaccga catgaatttt gagggacgca

401 aaaaagggac gttgcagatt ttccgccaaa ccgaagaagt cgaagcggca

451 aaacaagaca ttgccgtttt ggaacgctac ggcgtgccgt accgccgtct

501 gaagcccgaa gaatgcgcag aattcgagcc tgcgctggca cgcgttaccg

551 ccaaaattgt cggcggtctg cacctgcctg cggatgcgac cggcgactgc

601 cgcctcttca ccgaaaacct gtacaaattg tgtcaagaga agggggtacg

651 gttctacttc aaccaaacca tcagccgcat cgaccacaac gggctgcgca

701 tcaaagccgt tgaaacgaaa cagggcggtt tgaaacagat gccgttgtct

751 gcgcgctcgg ctgcttcagc aggactgtgt tggcgcagtt ggatctcaat

801 ctgcccattt atcccgtcaa aggctattcc ttga
```

This corresponds to the amino acid sequence <SEQ ID 1406; ORF 512.ng>:

g512.pep

```
  1 MKVLVLGAGV AGVSSVWYLA EAGHEVTVID RTEGVAMETS FANAGQLSYG
 51 YTTPWAAPGI PTKALKRLFK SHPPLLFRPD GGLYQIEWLW RMLQNCTATR
101 YQINKERMVR ISEYSREMFR RFEAQTDMNF EGRKKGTLQI FRQTEEVEAA
151 KQDIAVLERY GVPYRRLKPE ECAEFEPALA RVTAKIVGGL HLPADATGDC
201 RLFTENLYKL CQEKGVRFYF NQTISRIDHN GLRIKAVETK QGGLKQMPLS
251 ARSAASAGLC WRSWISICPF IPSKAIP*
```

The following partial DNA sequence was identified in *N. meningitidis* <SEQ ID 1407>:

m512.seq (partial)

```
  1 ..GTTTTGGAAC GCTACGGCGT GCCGTACCGC CGTCTGAAAC CCGAAGAATG
 51   TGCAGAATTT GAGCCTGCGC TGGCACGCGT TACCGCCAAA ATTGCCGGCG
101   GCCTGCACCT GCCTGCAGAT GCGACCGGCG ACTggCGCCT CTTCACTGAA
151   AACCTATACA AATTGTGTCA GGAAAAGGGC GTACGGTTTC ATTTCAACCA
201   AAACATCAGC CGCATCGACC ACAACGGGCT GCGCATCAAA ACCGTTGAAA
251   CCAAACAGGG CGGTTTGAAG CAGATGCCGT TGTCTGCGCG CTCGGTTGCT
301   TCAGCAGGAC GGTTTTGGCG CAGTTGGATC TCAATCTGCC CATTTATCCC
351   GTCAAAGGCT ATTCCTTGA
```

This corresponds to the amino acid sequence <SEQ ID 1408; ORF 512>:

m512.pep (partial)

```
  1 ..VLERYGVPYR RLKPEECAEF EPALARVTAK IAGGLHLPAD ATGDWRLFTE
 51   NLYKLCQEKG VRFHFNQNIS RIDHNGLRIK TVETKQGGLK QMPLSARSVA
101   SAGRFWRSWI SICPFIPSKA IP*
```

Computer analysis of this amino acid sequence gave the following results:

Homology with a predicted ORF from *N. gonorrhoeae*

ORF 512 shows 93.4% identity over a 122 aa overlap with a predicted ORF (ORF 512.ng) from *N. gonorrhoeae*:

m512/g512

```
                                                  10        20        30
m512.pep                                VLERYGVPYRRLKPEECAEFEPALARVTAK
                                        ||||||||||||||||||||||||||||||
g512          TDMNFEGRKKGTLQIFRQTEEVEAAKQDIAVLERYGVPYRRLKPEECAEFEPALARVTAK
                130       140       150       160       170       180

                      40        50        60        70        80        90
m512.pep      IAGGLHLPADATGDWRLFTENLYKLCQEKGVRFHFNQNISRIDHNGLRIKTVETKQGGLK
              |:|||||||||||| ||||||||||||||||||:|||:||||||||||||:|||||||||
g512          IVGGLHLPADATGDCRLFTENLYKLCQEKGVRFYFNQTISRIDHNGLRIKAVETKQGGLK
                130       140       150       160       170       180

                     100       110       120
m512.pep      QMPLSARSVASAGRFWRSWISICPFIPSKAIP
              ||||||||:|||  |||||||||||||||||
g512          QMPLSARSAASAGLCWRSWISICPFIPSKAIP
                     250       260       270
```

The following partial DNA sequence was identified in *N. meningitidis* <SEQ ID 1409>:

a512.seq

```
  1 ATGAAAGTGC TTGTTTTAGG TGCTGGTGTT GCCGGCGTAT CTTCCGCGTG
 51 GTATCTGGCA GAGGCAGGAC ATGAAGTAAC GGTCATCGAC CGCGCCGAGG
101 GCGTGGCGAT GGAAACCAGT TTTGCCAACG CAGGCCAGCT TTCTTACGGC
151 TATACCACGC CTTGGGCTGC ACCCGGTATT CCGACCAAAG CACTGAAATG
201 GCTGTTTAAA AGCCATCCGC CTTTGCTGTT TCGCCCCGAC GGCAGCCTGT
251 ATCAAATCGA ATGGCTGTGG CAGATGCTGC AACACTGCAC GGCAGCGCGC
301 TATCAAATCA ATAAAGAGCG CATGGTCAGG ATGTCCGAAT ACAGCCGTGA
351 AATGTTCCGC CGTTTTGAAG CGCAAACCGG CATGAATTTT GAGGGACGCA
401 AAAAAGGGAC GTTGCAGATT TTCCGCCAAA CCAAAGAAGT CGAAGCGGCA
451 AAACAAGACA TTGCCGTTTT GGAACGCTAC GGCGTGCCGT ACCGCCGTCT
501 GAAGCCCGAA GAATGCGCAG AATTCGAGCC TGCGCTGGCA CGCGTTACCG
551 CCAAAATTGC CGGCGGCCTG CACCTGCCCG CAGACGCGAC CGGCGACTGC
601 CGCCTCTTCA CTGAAAACCT GTACAAATTG TGTCAGGAAA AGGGCGTACG
651 GTTTCATTTC AACCAAACCA TCAGCCGCAT CGACCACAAC GGGCTGCGCA
701 TCAAAACCGT TGAAACGAAA CAGGGCGGTT TGAAGCAGAT GCCGTTGTCT
751 GCGCGCTCGG CTGCTTCAGC AGGACGGTTT TGGCGCAAGT GGATCTCAAT
801 CTGCCGATTT ATCCCGTCAA AGGCTATTCC TTGA
```

This corresponds to the amino acid sequence <SEQ ID 1410; ORF 512.a>:

a512.pep

```
  1 MKVLVLGAGV AGVSSAWYLA EAGHEVTVID RAEGVAMETS FANAGQLSYG
 51 YTTPWAAPGI PTKALKWLFK SHPPLLFRPD GSLYQIEWLW QMLQHCTAAR
101 YQINKERMVR MSEYSREMFR RFEAQTGMNF EGRKKGTLQI FRQTKEVEAA
151 KQDIAVLERY GVPYRRLKPE ECAEFEPALA RVTAKIAGGL HLPADATGDC
201 RLFTENLYKL CQEKGVRFHF NQTISRIDHN GLRIKTVETK QGGLKQMPLS
251 ARSAASAGRF WRKWISICRF IPSKAIP*
```

m512/a512 95.9% identity in 122 aa overlap

```
                                                    10        20        30
m512.pep                                    VLERYGVPYRRLKPEECAEFEPALARVTAK
                                            ||||||||||||||||||||||||||||||
a512               TGMNFEGRKKGTLQIFRQTEEVEAAKQDIAVLERYGVPYRRLKPEECAEFEPALARVTAK
                     130       140       150       160       170       180

                           40        50        60        70        80        90
m512.pep           IAGGLHLPADATGDWRLFTENLYKLCQEKGVRFHFNQNISRIDHNGLRIKTVETKQGGLK
                   ||||||||||||| ||||||||||||||||||||||:|||||||||||||||||||||||
a512               IAGGLHLPADATGDCRLFTENLYKLCQEKGVRFHFNQTISRIDHNGLRIKTVETKQGGLK
                     130       140       150       160       170       180
```

-continued

```
                   100        110        120
m512.pep    QMPLSARSVASAGRFWRSWISICPFIPSKAIPX
            ||||||||:||||||||:||||| |||||||||
a512        QMPLSARSAASAGRFWRKWISICRFIPSKAIPX
                   250        260        270
```

The following partial DNA sequence was identified in *N. gonorrhoeae* <SEQ ID 1411>:

g513.seq

```
  1 ATGGGTTCCG CGCCGAACGC CGCCGCCGCC GCCGAAGTGA AACACCCTGT
 51 TTCGCAAGGT ATGATTCAAA TGCTGGGCGT GTTTGTCGAT ACCATCATCG
101 TTTGTTCTTG CACCGCCTTC ATCATCTTGA TTTACCAACA GCCTTATGGC
151 GATTTGAGCG GTGCGGCGCT GAcgcAGGCG GCGATTGTCA GCCAAGTGGG
201 GCAATGGGGC GCGGGTTTCC TCGCCGTCAT CCTGTTTATG TTTGCCTTTT
251 CCACCGTTAT CGGCAACTAT GCCTATGCCG AGTCCAACGT CCAATTCATC
301 AAAAGCCATT GGCTGATTAC CGCCGTTTTC CGTATGCTGG TTTTGGCGTG
351 GGTCTATTTC GGCGCGGTTG CCAATGTGCC TTTGGTCTGG GATATGGCGG
401 ATATGGCGAT GGGCATCATG GCGTGGATCA ACCTCGTCGC CATCCTGCTG
451 CTCTCGCCat TGGCGTTTAT GCTGCTGCGC GATTACACCG CCAAGCTGAA
501 AATGGGCAAA GACCCCGAGT TCAAACTTTc cgAACATCCG GGCCTGAAAC
551 GCCGCATCAA ATCCGATGTT TGGTAA
```

This corresponds to the amino acid sequence <SEQ ID 1412; ORF 513.ng>:

g513.pep

```
  1 MGSAPNAAAA AEVKHPVSQG MIQMLGVFVD TIIVCSCTAF IILIYQQPYG
 51 DLSGAALTQA AIVSQVGQWG AGFLAVILFM FAFSTVIGNY AYAESNVQFI
101 KSHWLITAVF RMLVLAWVYF GAVANVPLVW DMADMAMGIM AWINLVAILL
151 LSPLAFMLLR DYTAKLKMGK DPEFKLSEHP GLKRRIKSDV W*
```

The following partial DNA sequence was identified in *N. meningitidis* <SEQ ID 1413>:

m513.seq

```
  1 ATGGGTTCCG CGCCGAACGC CGCCGCCGCC GCCGAAGTGA AACACCCTGT
 51 TTCGCAAGGT ATGATTCAAA TGCTGGGCGT GTTTGTCGAT ACCATCATCG
101 TTTGTTCTTG CACCGCCTTC ATCATCTTGA TTTACCAACA GCCTTATGGC
151 GATTTGAGCG GTGCGGCGCT GAcgcAGGCG GCGATTGTCA GCCAAGTGGG
201 GCAATGGGGC GCGGGTTTCC TCGCCGTCAT CCTGTTTATG TTTGCCTTTT
251 CCACCGTTAT CGGCAACTAT GCCTATGCCG AGTCCAACGT CCAATTCATC
301 AAAAGCCATT GGCTGATTAC CGCCGTTTTC CGTATGCTGG TTTTGGCGTG
351 GGTCTATTTC GGCGCGGTTG CCAATGTGCC TTTGGTCTGG GATATGGCGG
```

-continued

```
401 ATATGGCGAT GGGCATCATG GCGTGGATCA ACCTCGTCGC CATCCTGCTG

451 CTCTCGCCat TGGCGTTTAT GCTGCTGCGC GATTACACCG CCAAGCTGAA

501 AATGGGCAAA GACCCCGAGT TCAAACTTTc cgAACATCCG GGCCTGAAAC

551 GCCGCATCAA ATCCGATGTT TGGTAA
```

This corresponds to the amino acid sequence <SEQ ID 1414; ORF 513>:

m513.pep

```
  1 MGSAPNAAAA AEVKHPVSQG MIQMLGVFVD TIIVCSCTAF IILIYQQPYG

 51 DLSGAALTQA AIVSQVGQWG AGFLAVILFM FAFSTVIGNY AYAESNVQFI

101 KSHWLITAVF RMLVLAWVYF GAVANVPLVW DMADMAMGIM AWINLVAILL

151 LSPLAFMLLR DYTAKLKMGK DPEFKLSEHP GLKRRIKSDV W*
```

Computer analysis of this amino acid sequence gave the following results:

Homology with a predicted ORF from *N. gonorrhoeae*

ORF 513 shows 99.5% identity over a 191 aa overlap with a predicted ORF (ORF 513.ng) from *N. gonorrhoeae*:

m513/g513

```
                   10        20        30        40        50        60
m513.pep   MGSAPNAAAAAEVKHPVSQGMIQMLGVFVDTITVCSCTAFIILIYQQPYGDLSGAALTQA
           ||||||||||||||||||||||||||||||||||||||||||||||||||||||||||||
g513       MGSAPNAAAAAEVKHPVSQGMIQMLGVFVDTITVCSCTAFIILIYQQPYGDLSGAALTQA
                   10        20        30        40        50        60

                   70        80        90       100       110       120
m513.pep   AIVSQVGQWGAGFLAVILFMFAFSTVIGNYAYAESNVQFIKSHWLITAVFRMLVLAWVYF
           ||||||||||||||||||||||||||||||||||||||||||||||||||||||||||||
g513       AIVSQVGQWGAGFLAVILFMFAFSTVIGNYAYAESNVQFIKSHWLITAVFRMLVLAWVYF
                   70        80        90       100       110       120

                  130       140       150       160       170       180
m513.pep   GAVANVPLVWDMADMAMGIMAWINLVAILLLSPLAFMXLRDYTAKLKMGKDPEFKLSEHP
           ||||||||||||||||||||||||||||||||||||| ||||||||||||||||||||||
g513       GAVANVPLVWDMADMAMGIMAWINLVAILLLSPLAFMLLRDYTAKLKMGKDPEFKLSEHP
                  130       140       150       160       170       180

                  190
m513.pep   GLKRRIKSDVW
           |||||||||||
g513       GLKRRIKSDVW
                  190
```

The following partial DNA sequence was identified in *N. meningitidis* <SEQ ID 1415>:

a513.seq

```
  1 ATGAACGAGA ACTTTACCGA ATGGCTGCAC GGCTGGGTCG GCGCCATCAA

 51 CGATCCGATG TGGTCATACT TGGTTTATNT GCTTTTGGGT ACGGGGCTTT

101 TCTTCACCGT AACCACGGGC TTTGTCCAAT TCCGCCTCTT CGGGCGCAGC

151 ATCAAAGAAA TGCTCGGCGG CCGCAAACAG GGGGACGACC CTCACGGCAT

201 CACGCCGTTT CAGGCATTTG TAACCGGCCT TGCCAGCCGC GTGGGCGTGG

251 GCAATATCGC GGGCGTGGCC ATCGCCATCA AAGTCGGCGG ACCGGGCGCG
```

-continued

```
 301 GTGTTTTGGA TGTGGGTAAC CGCCTTAATC GGTATGAGTT CGGCGTTTGT
 351 CGAATCTTCG CTGGCGCAGC TCTTTAAAGT CCGCGACTAC GACAACCACC
 401 ATTTCCGGGG CGGCCCTGCC TACTACATCA CTCAAGGGCT GGGGCAGAAA
 451 TGGCTGGGCG TGTTGTTCGC CCTGAGCCTG ATTTTCTGTT TCGGCTTTGT
 501 GTTTGAAGCG GTTCAGACCA ATACCATTGC CGATACCGTC AAAGCGGCGT
 551 GGGGTTGGGA GCCTCATTAT GTCGGCGTCG CCCTGGTGAT TTTAACCGCG
 601 CCGATTATCT TCGGCGGCAT CAGGCGCATA TCTAAAGCGG CGGAAATCGT
 651 CGTCCCCCTG ATGGCGGTTT TGTACCTCTT TATCGCGCTT TTCATCATTT
 701 TGACCAATAT TCCGATGATT CCGGACGTGT TCGGTCAGAT TTTTTCGGGC
 751 GCGTTCAAAT TCGACGCGGC AGCAGGCGGC TTACTCGGCG GTCTGATTTC
 801 GCAAACGATG ATGATGGGCA TCAAACGCGG CCTGTATTCC AACGAGGCGG
 851 GTATGGGTTC CGCGCCGAAC GCCGCCGCCG CCGCCGAAGT GAAACACCCT
 901 GTTTCGCAAG GTATGATTCA AATGCTGGGC GTGTTTGTCG ATACCATCAT
 951 CGTTTGTTCT TGCACCGCCT TCATCATCTT GATTTACCAA CAGCCTTACG
1001 GCGATTTGAG CGGTGCGGCG CTGACGCAGG CGGCGATTGT CAGCCAAGTG
1051 GGGCAATGGG GCGCGGGCTT CCTCGCCGTC ATCCTGTTTA TGTTTGCCTT
1101 TTCCACCGTT ATCGGCAACT ATGCCTATGC CGAGTCCAAC GTCCAATTCA
1151 TCAAAAGCCA TTGGCTGATT ACCGCCGTTT TCCGTATGCT GGTTTTGGCG
1201 TGGGTCTATT TCGGCGCGGT TGCCAATGTG CCTTTGGTCT GGGATATGGC
1251 GGATATGGCG ATGGGCATTA TGGCGTGGAT CAACCTTGTC GCCATCCTGC
1301 TGCTCTCGCC CTTGGCGTTT ATGCTGCTGC GCGATTACAC CGCCAAGCTG
1351 AAAATGGGCA AAGACCCCGA GTTCAAACTT TCCGAACATC CGGGCCTGAA
1401 ACGCCGTATC AAATCCGACG TTTGGTAA
```

This corresponds to the amino acid sequence <SEQ ID 1416; ORF 513.a>:

a513.pep

```
  1 MNENFTEWLH GWVGAINDPM WSYLVYXLLG TGLFFTVTTG FVQFRLFGRS
 51 IKEMLGGRKQ GDDPHGITPF QAFVTGLASR VGVGNIAGVA IAIKVGGPGA
101 VFWMWVTALI GMSSAFVESS LAQLFKVRDY DNHHFRGGPA YYITQGLGQK
151 WLGVLFALSL IFCFGFVFEA VQTNTIADTV KAAWGWEPHY VGVALVILTA
201 PIIFGGIRRI SKAAEIVVPL MAVLYLFIAL FIILTNIPMI PDVFGQIFSG
251 AFKFDAAAGG LLGGLISQTM MMGIKRGLYS NEAGMGSAPN AAAAAEVKHP
301 VSQGMIQMLG VFVDTIIVCS CTAFIILIYQ QPYGDLSGAA LTQAAIVSQV
351 GQWGAGFLAV ILFMFAFSTV IGNYAYAESN VQFIKSHWLI TAVFRMLVLA
401 WVYFGAVANV PLVWDMADMA MGIMAWINLV AILLLSPLAF MLLRDYTAKL
451 KMGKDPEFKL SEHPGLKRRI KSDVW*
```

m513/a513 100.0% identity in 191 aa overlap

```
                                                     10        20        30
m513.pep                                     MGSAPNAAAAAEVKHPVSQGMIQMLGVFVD
                                             ||||||||||||||||||||||||||||||
a513      DAAAGGLLGGLISQTMMMGIKRGLYSNEAGMGSAPNAAAAAEVKHPVSQGMIQMLGVFVD
                  10        20        30        40        50        60

                  70        80        90       100       110       120
m513.pep  TIIVCSCTAFIILIYQQPYGDLSGAALTQAAIVSQVGQWGAGFLAVILFMFAFSTVIGNY
          ||||||||||||||||||||||||||||||||||||||||||||||||||||||||||||
a513      TIIVCSCTAFIILIYQQPYGDLSGAALTQAAIVSQVGQWGAGFLAVILFMFAFSTVIGNY
                  70        80        90       100       110       120

                 100       110       120       130       140       150
m513.pep  AYAESNVQFIKSHWLITAVFRMLVLAWVYFGAVANVPLVWDMADMAMGIMAWINLVAILL
          ||||||||||||||||||||||||||||||||||||||||||||||||||||||||||||
a513      AYAESNVQFIKSHWLITAVFRMLVLAWVYFGAVANVPLVWDMADMAMGIMAWINLVAILL
                 100       110       120       130       140       150
                 160       170       180       190
m513.pep  LSPLAFMLLRDYTAKLKMGKDPEFKLSEHPGLKRRIKSDVWX
          ||||||||||||||||||||||||||||||||||||||||||
a513      LSPLAFMLLRDYTAKLKMGKDPEFKLSEHPGLKRRIKSDVWX
             440       450       460       470
```

The following partial DNA sequence was identified in *N. gonorrhoeae* <SEQ ID 1417>:

g515.seq

```
   1 atggttcaaa tacaggttgt gcgcgccgcc ggcgttgccc gtggtctgca
  51 ttccgagttt gcgcgcgctg taactgccga ggaaatagcc ttcgacaatg
 101 ccgttttgaa tcacgaagcg cggcgcggtg gcaacacctt ccgcatcaaa
 151 atagctgctg cggaaagagc gggggatgtg cggttcttcg cgcaggttga
 201 ggaaatcggg caggactttt ttgccgatgc tgtcgatcag gaaactgctt
 251 tggcggtaga gcgcgccgcc ggagagtgtg ccgacgaggt gtccgatcag
 301 cccgcccgaa acggtggtat cgaagaggac ggggtagctg cctgtcggga
 351 tgctgcggct gccgagtcgg cgcaaagtgc ggcgggcggc ggtttgaccg
 401 atggtttcgg ggctgtccat atccggatgg cggcaggcgg aatcgtacca
 451 gtagtcgcgc tgcattccgt tttcgtcggc ggcgacgacg ctgcaggaaa
 501 tgctgtggtg cgtgctttgc cggtgtgcgg caaaaccgtg ggtgttgccg
 551 taaacgtatt ggtactgtcc ggtttgcacc gccgcgcctt cggagttttc
 601 gatgcggctg tccgtgtcca acgctgcctg ttcgcattgt tttgccaagc
 651 cgacggcggc ttccgtatcc aaatcccatt cgtggtaaag gtcggggtcg
 701 ccgatgtgtt gcgccatcaa ctcggggtcg gcaagtccgg cgcaaccgtc
 751 ttcggcggtg tggcgggcga tgtcggcggc ggcgcggacg gtgtcgcgca
 801 gggcttgttc ggagaagtcg gcggtgccgg cgcggccttt gcgtttgccg
 851 acgtaaacgg taatgtccag cgatttgtcc tgctggaact cgatttgttc
 901 gatttcgccc aagcgcacgc tgacgctttg tccgagcgat tcgctgaagt
 951 cggcttcggc ggcggtcgcg cccgctgctt ttgccaagtc gagcgtgcgg
1001 cggcagaggt cgaggagttc ggaagcggtg tggttgaaca gcataacaat
1051 ctttcttggt ggagcgttgt ggcattttaa
```

This corresponds to the amino acid sequence <SEQ ID 1418; ORF 515.ng>:

g515.pep

```
  1 MVQIQVVRAA GVARGLHSEF ARAVTAEEIA FDNAVLNHEA RRGGNTFRIK
 51 IAAAERAGDV RFFAQVEEIG QDFFADAVDQ ETALAVERAA GECADEVSDQ
101 PARNGGIEED GVAACRDAAA AESAQSAAGG GLTDGFGAVH IRMAAGGIVP
151 VVALHSVFVG GDDAAGNAVV RALPVCGKTV GVAVNVLVLS GLHRRAFGVF
201 DAAVRVQRCL FALFCQADGG FRIQIPFVVK VGVADVLRHQ LGVGKSGATV
251 FGGVAGDVGG GADGVAQGLF GEVGGAGAAF AFADVNGNVQ RFVLLELDLF
301 DFAQAHADAL SERFAEVGFG GGRARCFCQV ERAAAEVEEF GSGVVEQHNN
351 LSWWSVVAF*
```

The following partial DNA sequence was identified in *N. meningitidis* <SEQ ID 1419>:

m515.seq (partial)

```
  1 ..GGAAAGAGCG GGGGATGTGC GTTCTTCGCG CAGGTTGAGG AAATCGGGCA
 51   GGACTTTTCT GCCGATGCTG TCGATCAGGA AACTGCTTTG GCGGTAGAGC
101   GCGCCGCCGG AGAGTGCGCC GACGAGGTGT CCGATAAGAC CGCCCGAAAC
151   GGTGGTATCG AAGAGGACGG GGTAGCTGCC TGTCGGGATG CTGCGGCTGC
201   CGAGTCGGCG CAAAGTGCGG CGGGCGGCGG TTTGACCGAT GGTTTCGGGG
251   CTGTCCATAT CCGGATGGCG GCAGGCGGAA TCGTACCAGT AGTCGCGCTG
301   CATGCCGTTT TCGTCGGCGG CAACGACGCT GCAGGAAATG CTGTGGTGCG
351   TGCCTTGCCG GTGTGCGGCA AAACCGTGGG TGTTGCCGTA AACGTATTGG
401   TAATGGCCGG TTTGCACCGC CGCGCCTTCG GAGTTTTCGA TGCGCTCATC
451   CTCGTTCAGG GCGGCTTGTT CGCATTGTTT TGCCAAGCCG ACGGCGGCTk
501   CCGTATCCAA ATCCCATTCG TGGTAAAGGT CGGGGTCGCC GATGTGTTTT
551   GCCATCAGAC AGGCATCGGC AAGTCCGGCG CAACCGTCTT CGGCGGTGTG
601   GCGGGCGATG TCGATGGCGG CTTTGACGGT GTCTTGCAGG GCTTTTTCGG
651   AGAAGTCGGC AGTACTGGCG CGGCCTTTGC GTTTGCCGAC GTAAACGGTA
701   ATGTCCAGCG ACTTGTCCTG CTGGAACTCG ATTTGTTsGA TTTsGCCCAG
751   CCGCACGCTG ACGCTTTGTC CCAATGATTC GCTGAAATCG GCTTCGGCGG
801   CGGTTGCGCC CGTCGCTTTT GCCAAGTCGA GCGTGCGGCG GCAGAGGTCG
851   AGGAGTTCGG AAGCGGTGTG GTTgAACAGC ATAGAAATCT TTCTTGATGA
901   TGCTTTGCGG CATTTTAA
```

This corresponds to the amino acid sequence <SEQ ID 1420; ORF 515>:

m515.pep (partial)

```
  1 ..GKSGGCAFFA QVEEIGQDFS ADAVDQETAL AVERAAGECA DEVSDKTARN
 51   GGIEEDGVAA CRDAAAAESA QSAAGGGLTD GFGAVHIRMA AGGIVPVVAL
101   HAVFVGGNDA AGNAVVRALP VCGKTVGVAV NVLVMAGLHR RAFGVFDALI
151   LVQGGLFALF CQADGGXRIQ IPFVVKVGVA DVFCHQTGIG KSGATVFGGV
```

-continued

```
201   AGDVDGGFDG VLQGFFGEVG STGAAFAFAD VNGNVQRLVL LELDLXDXAQ

251   PHADALSQXF AEIGFGGGCA RRFCQVERAA AEVEEFGSGV VEQHRNLSXX

301   CFAAF*
```

Computer analysis of this amino acid sequence gave the following results:

Homology with a predicted ORF from *N. gonorrhoeae*

ORF 515 shows 85.9% identity over a 304 aa overlap with a predicted ORF (ORF 515.ng) from *N. gonorrhoeae*.

m515/g515

```
                                                 10        20        30
m515.pep                              GKSGGCAFFAQVEEIGQDFSADAVDQETALA
                                       ::|   |||||||||||| |||||||||||
g515       AEEIAFDNAVLNHEARRGGNTFRIKIAAAERAGDVRFFAQVEEIGQDFFADAVDQETALA
             30        40        50        60        70        80

                   40        50        60        70        80        90
m515.pep   VERAAGECADEVSDKTARNGGIEEDGVAACRDAAAAESAQSAAGGGLTDGFGAVHIRMAA
           ||||||||||||||: ||||||||||||||||||||||||||||||||||||||||||||
g515       VERAAGECADEVSDQPARNGGIEEDGVAACRDAAAAESAQSAAGGGLTDGFGAVHIRMAA
             90       100       110       120       130       140

                  100       110       120       130       140       150
m515.pep   GGIVPVVALHAVFVGGNDAAGNAVVRALPVCGKTVGVAVNVLVMAGLHRRAFGVFDALIL
           ||||||||||:|||||:|||||||||||||||||||||||||||::||||||||||||| : 
g515       GGIVPVVALHSVFVGGDDAAGNAVVRALPVCGKTVGVAVNVLLLSGLHRRAFGVFDAAVR
             150       160       170       180     190          200

                 160       170       180       190       200       210
m515.pep   VQGGLFALFCQADGGXRIQIPFVVKVGVADVFCHQTGIGKSGATVFGGVAGDVDGGFDGV
           ||  ||||||||||| |||||||||||||||: || |:||||||||||||||| || |||
g515       VQRCLFALFCQADGGFRIQIPFVVKVGVADVLRHQLGVGKSGATVFGGVAGDVGGGADGV
             210       220       230       240       250       260

                 220       230       240       250       260       270
m515.pep   LQGFFGEVGSTGAAFAFADVNGNVQRLVLLELDLXDXAQPHADALSQXFAEIGFGGGCAR
            ||:|||||::|||||||||||||||:||||||| | || ||||||: |||:||||| ||
g515       AQGLFGEVGGAGAAFAFADVNGNVQRFVLLELDLFDFAQAHADALSERFAEVGFGGGRAR
             270       280       290       300       310       320

                  280       290       300
m515.pep   RFCQVERAAAEVEEFGSGVVEQHRNLSXXCFAAF
            |||||||||||||||||||||| |||    :||
g515       CFCQVERAAAEVEEFGSGVVEQHNNLSWWSVVAF
              330       340       350
```

The following partial DNA sequence was identified in *N. meningitidis* <SEQ ID 1421>:

a515.seq

```
  1 ATGGTTCAAA TAAAGGTTGT GCGCGCCGCC GGCGTTGCCC GTGGTCTGCA

 51 TTCCGAGTTT GCGCGCGCTG TAACTGCTGA GGAAATAGCC TTCGACAATG

101 CCGTTTTGAA TCACGAAGCG CGGTGCGGTG GCAACGCCTT CCGCATCAAA

151 ATAGCTGCTG CGGAAAGAGC GGGGGATGTG CGGTTCTTCG CGCAGGTTGA

201 GGAAATCGGG CAGGACTTTT TTGCCGATGC TGTCGATCAG GAAACTGCTT

251 TGGCGGTAGA GCGCTCCGCC GGAGAGTGCG CCGACGAGGT GTCCGATAAG

301 ACCGCCCGAA ACGGTGGTAT CGAAGAGGAC GGGGTAGTTG CCTGTCGGGA

351 TGCTGCGGCT GCCGAGTCGG CGCAAAGTGC GGCGGGCGGC GGTTTGACCG

401 ATGGTTTCGG GGCTGTCCAT ATCCGGATGG CGGCAGGCGG AATCGTACCA

451 GTAGTCGCGC TGCATGCCGT TTTCGTCGGC GGCAACGACG CTGCAGGAAA
```

-continued

```
 501 TGCTGTGGTG CGTGCTTTGC CGGTGTGCGG CAAAACCGTA GGTGTTGCCG

 551 TAAACGTATT GGTAATGGCC GGTTTGCACC GCCGCGCCTT CGGAGTTTTC

 601 GATGCGCTCA TCCTCGTTCA GGGCGGCTTG TTCGCATTGT TTTGCCAAGC

 651 CGACGGCGGC TTCCGTATCC AAATCCCATT CGTGGTAAAG GTCGGGGTCG

 701 CCGATGTGTT GCGCCATCAA CTCGGGGTCG GCAAGTCCGG CGCAACCGTC

 751 TTCGGCGGTG TGGCGGGCGA TGTCNNNNGC GGCGCGGACG GTGTCGCGCA

 801 GGGCTTGTTC GGAGAAATCG GCGGTGCCGG CGCGGCCTTT GCGTTTGCCG

 851 ACGTAAACGG TAATGTCCAG CGACTTGTCC TGCTGAAACT CGATTTGTTC

 901 GATTTCGCCC AGCCGCACGC TGACGCTTTG TCCCAATGAT TCGCTGAAAT

 951 CCGCTTCGGC GGCGGTTGCG CCCGTCGCTT TTGCCAAGTC GAGCGTGCGG

1001 CGGCAGAGGT CGAGGAGTTC GGAAGCGGTG TGGTTGAACA GCATAGAAAT

1051 CTTTCTTGAT GATGCTTTGC GGCATTTTAA
```

This corresponds to the amino acid sequence <SEQ ID 1422; ORF 515.a>:

```
a515.pep

  1 MVQIKVVRAA GVARGLHSEF ARAVTAEEIA FDNAVLNHEA RCGGNAFRIK

 51 IAAAERAGDV RFFAQVEEIG QDFFADAVDQ ETALAVERSA GECADEVSDK

101 TARNGGIEED GVVACRDAAA AESAQSAAGG GLTDGFGAVH IRMAAGGIVP

151 VVALHAVFVG GNDAAGNAVV RALPVCGKTV GVAVNVLVMA GLHRRAFGVF

201 DALILVQGGL FALFCQADGG FRIQIPFVVK VGVADVLRHQ LGVGKSGATV

251 FGGVAGDVXX GADGVAQGLF GEIGGAGAAF AFADVNGNVQ RLVLLKLDLF

301 DFAQPHADAL SQ*FAEIGFG GGCARRFCQV ERAAAEVEEF GSGVVEQHRN

351 LS**CFAAF*
```

m515/a515 92.1% identity in 304 aa overlap

```
                                                 10        20        30
m515.pep                                GKSGGCAFFAQVEEIGQDFSADAVDQETALA
                                         ::|   |||||||||||| |||||||||||
a515       AEEIAFDNAVLNHEARRGGNTFRIKIAAAERAGDVRFFAQVEEIGQDFFADAVDQETALA
              30        40        50        60        70        80

                  40        50        60        70        80        90
m515.pep   VERAAGECADEVSDKTARNGGIEEDGVAACRDAAAAESAQSAAGGGLTDGFGAVHIRMAA
           |||:|||||||||||||||||||||||:||||||||||||||||||||||||||||||||
a515       VERSAGECADEVSDKTARNGGIEEDGVVACRDAAAAESAQSAAGGGLTDGFGAVHIRMAA
              90       100       110       120       130       140

                 100       110       120       130       140       150
m515.pep   GGIVPVVALHAVFVGGNDAAGNAVVRALPVCGKTVGVAVNVLVMAGLHRRAFGVFDALIL
           ||||||||||||||||||||||||||||||||||||||||||||||||||||||||||||
a515       GGIVPVVALHAVFVGGNDAAGNAVVRALPVCGKTVGVAVNVLVMAGLHRRAFGVFDALIL
             150       160       170       180       190       200

                 160       170       180       190       200       210
m515.pep   VQGGLFALFCQADGGXRIQIPFVVKVGVADVFCHQTGIGKSGATVFGGVAGDVDGGFDGV
           ||||||||||||||| |||||||||||||||: || |:|||||||||||||||  | |||
a515       VQGGLFALFCQADGGFRIQIPFVVKVGVADVLRHQLGVGKSGATVFGGVAGDVXXGADGV
             210       220       230       240       250       260

                 220       230       240       250       260       270
m515.pep   LQGFFGEVGSTGAAFAFADVNGNVQRLVLLELDLXDXAQPHADALSQXFAEIGFGGGCAR
            ||:|||:|::|||||||||||||||||||:||| | |||||||||||||||||||||||
a515       AQGLFGEIGGAGAAFAFADVNGNVQRLVLLKLDLFDFAQPHADALSQXFAEIGFGGGCAR
             270       280       290       300       310       320
```

-continued

```
                280       290        300
m515.pep   RFCQVERAAAEVEEFGSGVVEQHRNLSXXCFAAF
           ||||||||||||||||||||||||||||||||||
a515       RFCQVERAAAEVEEFGSGVVEQHRNLSXXCFAAF
              330       340        350       360
```

The following partial DNA sequence was identified in *N. gonorrhoeae* <SEQ ID 1423>:

g515-1.seq

```
   1 ATGGTTCAAA TACAGGTTGT GCGCGCCGCC GGCGTTGCCC GTGGTCTGCA
  51 TTCCGAGTTT GGGCGCGCTG TAACTGCCGA GGAAATAGCC TTCGACAATG
 101 CCGTTTTGAA TCACGAAGCG CGGCGCGGTG GCAACACCTT CCGCATCAAA
 151 ATAGCTGCTG CGGAAAGAGC GGGGGATGTG CGGTTCTTCG CGCAGGTTGA
 201 GGAAATCGGG CAGGACTTTT TTGCCGATGC TGTCGATCAG GAAACTGCTT
 251 TGGCGGTAGA GCGCGCCGCC GGAGAGTGTG CCGACGAGGT GTCCGATCAG
 301 CCCGCCCGAA ACGGTGGTAT CGAAGAGGAC GGGGTAGCTG CCTGTCGGGA
 351 TGCTGCGGCT GCCGAGTCGG CGCAAAGTGC GGCGGGCGGC GGTTTGACCG
 401 ATGGTTTCGG GGCTGTCCAT ATCCGGATGG CGGCAGGCGG AATCGTACCA
 451 GTAGTCGCGC TGCATTCCGT TTTCGTCGGC GGCAACGACG CTGCAGGAAA
 501 TGCTGTGGTG CGTGCTTTGC CGGTGTGCGG CAAAACCGTG GGTGTTGCCG
 551 TAAACGTATT GGTAGTGTCC GGTTTGCACC GCCGCGCCTT CGGAGTTTTC
 601 GATGCGGCTG TCCGTGTCCA ACGCTGCCTG TTCGCATTGT TTTGCCAAGC
 651 CGACGGCGGC TTCCGTATCC AAATCCCATT CGTGGTAAAG GTCGGGGTCG
 701 CCGATGTGTT GCGCCATCAA CTCGGGGTCG GCAAGTCCGG CGCAACCGTC
 751 TTCGGCGGTG TGGCGGGCGA TGTCGGCGGC GGCGCGGACG GTGTCGCGCA
 801 GGGCTTGTTC GGAGAAGTCG GCGGTGCCGG CGCGGCCTTT GCGTTTGCCG
 851 ACGTAAACGG TAATGTCCAG CGATTTGTCC TGCTGGAACT CGATTTGTTC
 901 GATTTCGCCC AAGCGCACGC TGACGCTTTG TCCGAGCGAT TCGCTGAAGT
 951 CGGCTTCGGC GGCGGTCGCG CCCGCTGCTT TTGCCAAGTC GAGCGTGCGG
1001 CGGCAGAGGT CGAGGAGTTC GGAAGCGGTG TGGTTGAACA GCATAACAAT
1051 CTTTCTTGGT GGAGCGTTGT GGCATTTTAA
```

This corresponds to the amino acid sequence <SEQ ID 1424; ORF 515-1.ng>:

g515-1.pep

```
  1 MVQIQVVRAA GVARGLHSEF ARAVTAEEIA FDNAVLNHEA RRGGNTFRIK
 51 IAAAERAGDV RFFAQVEEIG QDFFADAVDQ ETALAVERAA GECADEVSDQ
101 PARNGGIEED GVAACRDAAA AESAQSAAGG GLTDGFGAVH IRMAAGGIVP
151 VVALHSVFVG GNDAAGNAVV RALPVCGKTV GVAVNVLVVS GLHRRAFGVF
201 DAAVRVQRCL FALFCQADGG FRIQIPFVVK VGVADVLRHQ LGVGKSGATV
251 FGGVAGDVGG GADGVAQGLF GEVGGAGAAF AFADVNGNVQ RFVLLELDLF
```

-continued

```
301 DFAQAHADAL SERFAEVGFG GGRARCFCQV ERAAAEVEEF GSGVVEQHNN

351 LSWWSVVAF*
```

The following partial DNA sequence was identified in *N. meningitidis* <SEQ ID 1425>:

m515-1.seq

```
  1 ATGGTTCAAA TACAGGTTGT GCGCGCCGCC GGCGTTGCCC GTGGTCTGCA
 51 TACCGAGTTT GCGCGCGCTG TAACTGCTGA GGAAATAGCC TTCGACAATG
101 CCGTTTTGAA TCACGAAGCG CGGTGCGGTG GCAACGCCTT CCGCATCAAA
151 ATAGCTGCTG CGGAAAGAGC GGGGGATGTG CGGTTCTTCG CGCAGGTTGA
201 GGAAATCGGG CAGGACTTTT TTGCCGATGC TGTCGATCAG GAAACTGCTT
251 TGGCCGTAGA GCGCGCCGCC GGAGAGTGCG CCGACGAGGT GTCCGATAAG
301 ACCGCCCGAA ACGGTGGTAT CGAAGAGGAC GGGGTAGCTG CCTGTCGGGA
351 TGCTGCGGCT GCCGAGTCGG CGCAAAGTGC GGCGGGCGGC GGTTTGACCG
401 ATGGTTTCGG GGCTGTCCAT ATCCGGATGG CGGCAGGCGG AATCGTACCA
451 GTAGTCGCGC TGCATGCCGT TTTCGTCGGC GGCAACGACG CTGCAGGAAA
501 TGCTGTGGTG CGTGCCTTGC CGGTGTGCGG CAAAACCGTG GGTGTTGCCG
551 TAAACGTATT GGTAATGGCC GGTTTGCACC GCCGCGCCTT CGGAGTTTTC
601 GATGCGCTCA TCCTCGTTCA GGGCGGCTTG TTCGCATTGT TTTGCCAAGC
651 CGACGGCGGC TTCCGTATCC AAATCCCATT CGTGGTAAAG GTCGGGGTCG
701 CCGATGTGTT TTGCCATCAG ACAGGCATCG GCAAGTCCGG CGCAACCGTC
751 TTCGGCGGTG TGGCGGGCGA TGTCGATGGC GGCTTTGACG GTGTCTTGCA
801 GGGCTTTTTC GGAGAAGTCG GCAGTACTGG CGCGGCCTTT GCGTTTGCCG
851 ACGTAAACGG TAATGTCCAG CGACTTGTCC TGCTGGAACT CGATTTGTTC
901 GATTTCGCCC AGCCGCACGC TGACGCTTTG TCCCAATGA
```

This corresponds to the amino acid sequence <SEQ ID 1426; ORF 515-1>:

m515-1.pep

```
  1 MVQIQVVRAA GVARGLHTEF ARAVTAEEIA FDNAVLNHEA RCGGNAFRIK
 51 IAAAERAGDV RFFAQVEEIG QDFFADAVDQ ETALAVERAA GECADEVSDK
101 TARNGGIEED GVAACRDAAA AESAQSAAGG GLTDGFGAVH IRMAAGGIVP
151 VVALHAVFVG GNDAAGNAVV RALPVCGKTV GVAVNVLVMA GLHRRAFGVF
201 DALILVQGGL FALFCQADGG FRIQIPFVVK VGVADVFCHQ TGIGKSGATV
251 FGGVAGDVDG GFDGVLQGFF GEVGSTGAAF AFADVNGNVQ RLVLLELDLF
301 DFAQPHADAL SQ*
```

m515-1/g515-1 91.7% identity in 312 aa overlap

```
                    10        20        30        40        50        60
g515-1.pep  MVQIQVVRAAGVARGLHSEFARAVTAEEIAFDNAVLNHEARRGGNTFRIKIAAAERAGDV
            |||||||||||||||||:||||||||||||||||||||||| |||:||||||||||||||
m515-1      MVQIQVVRAAGVARGLHTEFARAVTAEEIAFDNAVLNHEARCGGNAFRIKIAAAERAGDV
                    10        20        30        40        50        60

                    70        80        90       100       110       120
g515-1.pep  RFFAQVEEIGQDFFADAVDQETALAVERAAGECADEVSDQPARNGGIEEDGVAACRDAAA
            |||||||||||||||||||||||||||||||||||||||: ||||||||||||||||||||
m515-1      RFFAQVEEIGQDFFADAVDQETALAVERAAGECADEVSDKTARNGGIEEDGVAACRDAAA
                    70        80        90       100       110       120

                   130       140       150       160       170       180
g515-1.pep  AESAQSAAGGGLTDGFGAVHIRMAAGGIVPVVALHSVFVGGNDAAGNAVVRALPVCGKTV
            |||||||||||||||||||||||||||||||||||:||||||||||||||||||||||||
m515-1      AESAQSAAGGGLTDGFGAVHIRMAAGGIVPVVALHAVFVGGNDAAGNAVVRALPVCGKTV
                   130       140       150       160       170       180

                   190       200       210       220       230       240
g515-1.pep  GVAVNVLVVSGLHRRAFGVFDAAVRVQRCLFALFCQADGGFRIQIPFVVKVGVADVLRHQ
            ||||||||::|||||||||||| : ||  |||||||||||||||||||||||||||: ||
m515-1      GVAVNVLVMAGLHRRAFGVFDALILVQGGLFALFCQADGGFRIQIPFVVKVGVADVFCHQ
                   190       200       210       220       230       240

                   250       260       270       280       290       300
g515-1.pep  LGVGKSGATVFGGVAGDVGGGADGVAQGLFGEVGGAGAAFAFADVNGNVQRFVLLELDLF
             |:||||||||||||||| || ||| ||:|||||::|||||||||||||||:||||||||
m515-1      TGIGKSGATVFGGVAGDVDGGFDGVLQGFFGEVGSTGAAFAFADVNGNVQRLVLLELDLF
                   250       260       270       280       290       300

                   310       320       330       340       350       360
g515-1.pep  DFAQAHADALSERFAEVGFGGGAARCFCQVERAAAEVEEFGSGVVEQHNNLSWWSVVAFX
            |||| ||||||:
            DFAQPHADALSQX
m515-1             310
```

The following partial DNA sequence was identified in *N. meningitidis* <SEQ ID 1427>:

a515-1.seq

```
  1 ATGGTTCAAA TAAAGGTTGT GCGCGCCGCC GGCGTTGCCC GTGGTCTGCA
 51 TTCCGAGTTT GCGCGCGCTG TAACTGCTGA GGAAATAGCC TTCGACAATG
101 CCGTTTTGAA TCACGAAGCG CGGTGCGGTG GCAACGCCTT CCGCATCAAA
151 ATAGCTGCTG CGGAAAGAGC GGGGGATGTG CGGTTCTTCG CGCAGGTTGA
201 GGAAATCGGG CAGGACTTTT TTGCCGATGC TGTCGATCAG GAAACTGCTT
251 TGGCGGTAGA GCGCTCCGCC GGAGAGTGCG CCGACGAGGT GTCCGATAAG
301 ACCGCCCGAA ACGGTGGTAT CGAAGAGGAC GGGGTAGTTG CCTGTCGGGA
351 TGCTGCGGCT GCCGAGTCGG CGCAAAGTGC GGCGGGCGGC GGTTTGACCG
401 ATGGTTTCGG GGCTGTCCAT ATCCGGATGG CGGCAGGCGG AATCGTACCA
451 GTAGTCGCGC TGCATGCCGT TTTCGTCGGC GGCAACGACG CTGCAGGAAA
501 TGCTGTGGTG CGTGCTTTGC CGGTGTGCGG CAAAACCGTA GGTGTTGCCG
551 TAAACGTATT GGTAATGGCC GGTTTGCACC GCCGCGCCTT CGGAGTTTTC
601 GATGCGCTCA TCCTCGTTCA GGGCGGCTTG TTCGCATTGT TTTGCCAAGC
651 CGACGGCGGC TTCCGTATCC AAATCCCATT CGTGGTAAAG GTCGGGGTCG
701 CCGATGTGTT GCGCCATCAA CTCGGGGTCG GCAAGTCCGG CGCAACCGTC
751 TTCGGCGGTG TGGCGGGCGA TGTCGGCGGC GGCGCGGACG GTGTCGCGCA
801 GGGCTTGTTC GGAGAAATCG GCGGTGCCGG CGCGGCCTTT GCGTTTGCCG
851 ACGTAAACGG TAATGTCCAG CGACTTGTCC TGCTGAAACT CGATTTGTTC
901 GATTTCGCCC AGCCGCACGC TGACGCTTTG TCCCAATGA
```

This corresponds to the amino acid sequence <SEQ ID 1428; ORF 515-1.a>:

a515-1.pep

```
  1 MVQIKVVRAA GVARGLHSEF ARAVTAEEIA FDNAVLNHEA RCGGNAFRIK
 51 IAAAERAGDV RFFAQVEEIG QDFFADAVDQ ETALAVERSA GECADEVSDK
101 TARNGGIEED GVVACRDAAA AESAQSAAGG GLTDGFGAVH IRMAAGGIVP
151 VVALHAVWVG GNDAAGNAVV RALPVCGKTV GVAVNVLVMA GLHRRAFGVF
201 DALILVQGGL FALFCQADGG FRIQIPFVVK VGVADVLRHQ LGVGKSGATV
251 FGGVAGDVGG GADGVAQGLF GEIGGAGAAF AFADVNGNVQ RLVLLKLDLF
301 DFAQPHADAL SQ*
```

m515-1/a515-1 94.9% identity in 312 aa overlap

```
                      10        20        30        40        50        60
a515-1.pep    MVQIKVVRAAGVARGLHSEFARAVTAEEIAFDNAVLNHEARCGGNAFRIKIAAAERAGDV
              ||||:||||||||||||:||||||||||||||||||||||||||||||||||||||||||
m515-1        MVQIQVVRAAGVARGLHTEFARAVTAEEIAFDNAVLNHEARCGGNAFRIKIAAAERAGDV
                      10        20        30        40        50        60

                      70        80        90       100       110       120
a515-1.pep    RFFAQVEEIGQDFFADAVDQETALAVERSAGECADEVSDKTARNGGIEEDGVVACRDAAA
              |||||||||||||||||||||||||||||:||||||||||||||||||||||:|||||||
m515-1        RFFAQVEEIGQDFFADAVDQETALAVERAAGECADEVSDKTARNGGIEEDGVAACRDAAA
                      70        80        90       100       110       120

                     130       140       150       160       170       180
a515-1.pep    AESAQSAAGGGLTDGFGAVHIRMAAGGIVPVVALHAVFVGGNDAAGNAVVRALPVCGKTV
              ||||||||||||||||||||||||||||||||||||||||||||||||||||||||||||
m515-1        AESAQSAAGGGLTDGFGAVHIRMAAGGIVPVVALHAVFVGGNDAAGNAVVRALPVCGKTV
                     130       140       150       160       170       180

                     190       200       210       220       230       240
a515-1.pep    GVAVNVLVMAGLHRRAFGVFDALILVQGGLFALFCQADGGFRIQIPFVVKVGVADVLRHQ
              ||||||||||||||||||||||||||||||||||||||||||||||||||||||||: ||
m515-1        GVAVNVLVMAGLHRRAFGVFDALILVQGGLFALFCQADGGFRIQIPFVVKVGVADVFCHQ
                     190       200       210       220       230       240

                     250       260       270       280       290       300
a515-1.pep    LGVGKSGATVFGGVAGDVGGGADGVAQGLFGEIGGAGAAFAFADVNGNVQRLVLLKLDLF
               |:||||||||||||||| || ||| ||:|||:|::|||||||||||||||||||:||||
m515-1        TGIGKSGATVFGGVAGDVDGGFDGVLQGFFGEVGSTGAAFAFADVNGNVQRLVLLELDLF
                     250       260       270       280       290       300

                     310
a515-1.pep    DFAQPHADALSQX
              |||||||||||||
m515-1        DFAQPHADALSQX
                     310
```

The following partial DNA sequence was identified in *N. gonorrhoeae* <SEQ ID 1429>:

g516.seq

```
  1 atgttgttcc gtaaaacgac cgccgccgtt ttggcggcaa ccttgatact
 51 gaacggctgt acgatgatgt tgcgggggat gaacaacccg gtcagccaaa
101 caatcacccg caaacacgtt gacaaagacc aaatccgcgc cttcggtgtg
151 gttgccgaag acaatgccca attggaaaag ggcagcctgg tgatgatggg
201 cgggaaatac tggttcgccg tcaatcccga agattcggcg aagctgacgg
251 gccttttgaa ggccgggttg gacaagccct tccaaatagt tgaggatacc
301 ccgagctatg cccgccacca agccctgccg gtcaaattcg aagcgcccgg
351 cagccagaat ttcagtaccg gaggtctttg cctgcgctat gataccggca
401 gacctgacga catcgccaag ctgaaacagc ttgagtttaa agcggtcaaa
451 ctcgacaatc ggaccattta cacgcgctgc gtatccgcca aaggcaaata
```

-continued 501 ctacgccacg ccgcaaaaac tgaacgccga ttatcatttt gagcaaagtg 551 tgcccgccga tatttattat acggttactg aaaaacatac cgacaaatcc 601 aagctgtttg gaaatatctt atatacgccc cccttgttga tattggatgc 651 ggcggccgcg gtgctggtct tgcctatggc tctgattgca gccgcgaatt 701 cctcagacaa atga This corresponds to the amino acid sequence <SEQ ID 1430; ORF 516.ng>:

g516.pep

1 MLFRKTTAAV LAATLILNGC TMMLRGMNNP VSQTITRKHV DKDQIRAFGV

51 VAEDNAQLEK GSLVMMGGKY WFAVNPEDSA KLTGLLKAGL DKPFQIVEDT

101 PSYARHQALP VKFEAPGSQN FSTGGLCLRY DTGRPDDIAK LKQLEFKAVK

151 LDNRTIYTRC VSAKGKYYAT PQKLNADYHF EQSVPADIYY TVTEKHTDKS

201 KLFGNILYTP PLLILDAAAA VLVLPMALIA AANSSDK*

The following partial DNA sequence was identified in *N. meningitidis* <SEQ ID 1431>:

m516.seq

1 ATGTTGTTCC GTAAAACGAC CGCCGCCGTT TTGGCGGCAA CCTTGATGCT

51 GAACGGCTGT ACGTTGATGT TGTGGGGAAT GAACAACCCG GTCAGCGAAA

101 CAATCACCCG CAAACACGTT GACAAAGACC AAATCCGCGC CTTCGGTGTG

151 GTTGCCGAAG ACAATGCCCA ATTGGAAAAG GGCAGCCTGG TGATGATGGG

201 CGGAAAATAC TGGTTCGTCG TCAATCCCGA AGATTCGGCG AAGCTGACGG

251 GCATTTTGAA GGCAGGGCTG GACAAACCCT TCCAAATAGT TGAGGATACC

301 CCGAGCTATG CTCGCCACCA AGCCCTGCCG GTCAAACTCG AATCGCCTGG

351 CAGCCAGAAT TTCAGTACCG AAGGCCTTTG CCTGCGCTAC GATACCGACA

401 AGCCTGCCGA CATCGCCAAG CTGAAACAGC TCGGGTTTGA AGCGGTCAAA

451 CTCGACAATC GGACCATTTA CACGCGCTGC GTATCCGCCA AAGGCAAATA

501 CTACGCCACA CCGCAAAAAC TGAACGCCGA TTACCATTTT GAGCAAAGTG

551 TGCCTGCCGA TATTTATTAC ACGGTTACTG AAGAACATAC CGACAAATCC

601 AAGCTGTTTG CAAATATCTT ATATACGCCC CCCTTTTTGA TACTGGATGC

651 GGCGGGCGCG GTACTGGCCT TGCCTGCGGC GGCTCTGGGT GCGGTCGTGG

701 ATGCCGCCCG CAAATGA

This corresponds to the amino acid sequence <SEQ ID 1432; ORF 516>:

m516.pep

1 MLFRKTTAAV LAATLMLNGC TLMLWGMNNP VSETITRKHV DKDQIRAFGV

51 VAEDNAQLEK GSLVMMGGKY WFVVNPEDSA KLTGILKAGL DKPFQIVEDT

-continued

```
101 PSYARHQALP VKLESPGSQN FSTEGLCLRY DTDKPADIAK LKQLGFEAVK

151 LDNRTIYTRC VSAKGKYYAT PQKLNADYHF EQSVPADIYY TVTEEHTDKS

201 KLFANILYTP PFLILDAAGA VLALPAAALG AVVDAARK*
```

Computer analysis of this amino acid sequence gave the following results:

Homology with a predicted ORF from *N. gonorrhoeae*

ORF 516 shows 90.0% identity over a 231 aa overlap with a predicted ORF (ORF 516.ng) from *N. gonorrhoeae*:

m516/g516

```
                   10        20        30        40        50        60
m516.pep    MLFRKTTAAVLAATLMLNGCTLMLWGMNNPVSETITRKHVDKDQIRAFGVVAEDNAQLEK
            ||||||||||||||:|||||:|| ||||||:|||||||||||||||||||||||||||||
g516        MLFRKTTAAVLAATLILNGCTMMLRGMNNPVSQTITRKHVDKDQIRAFGVVAEDNAQLEK
                   10        20        30        40        50        60

                   70        80        90       100       110       120
m516.pep    GSLVMMGGKYWFVVNPEDSAKLTGILKAGLDKPFQIVEDTPSYARHQALPVKLESPGSQN
            ||||||||||||:|||||||||||:|||||||||||||||||||||||||||:|:|||||
g516        GSLVMMGGKYWFAVNPEDSAKLTGLLKAGLDKPFQIVEDTPSYARHQALPVKFEAPGSQN
                   70        80        90       100       110       120

                  130       140       150       160       170       180
m516.pep    FSTEGLCLRYDTDKPADIAKLKQLGFEAVKLDNRTIYTRCVSAKGKYYATPQKLNADYHF
            ||| |||||||| :| ||||||| |:||||||||||||||||||||||||||||||||||
g516        FSTGGLCLRYDTGRPDDIAKLKQLEFKAVKLDNRTIYTRCVSAKGKYYATPQKLNADYHF
                  130       140       150       160       170       180

                  190       200       210       220       230      239
m516.pep    EQSVPADIYYTVTEEHTDKSKLFANILYTPPFLILDAAGAVLALPAAALGAVVDAARK
            |||||||||||||:||||||||:|||||||:||||||:|||:|| | ::|:
g516        EQSVPADIYYTVTEKHTDKSKLFGNILYTPPLLILDAAAAVLVLPMALIAAANSSDK
                  190       200       210       220       230
```

The following partial DNA sequence was identified in *N. meningitidis* <SEQ ID 1433>:

a516.seq

```
  1 ATGTTGTTCC GTAAAACGAC CGCCGCCGTT TTGGCGGCAA CCTTGATGTT

 51 GAACGGCTGT ACGGTAATGA TGTGGGGTAT GAACAGCCCG TTCAGCGAAA

101 CGACCGCCCG CAAACACGTT GACAAGGACC AAATCCGCGC CTTCGGTGTG

151 GTTGCCGAAG ACAATGCCCA ATTGGAAAAG GGCAGCCTGG TGATGATGGG

201 CGGGAAATAC TGGTTCGTCG TCAATCCTGA AGATTCGGCG AAGCTGACGG

251 GCATTTTGAA GGCCGGGTTG GACAAGCAGT TTCAAATGGT TGAGCCCAAC

301 CCGCGCTTTG CCTACCAAGC CCTGCCGGTC AAACTCGAAT CGCCCGCCAG

351 CCAGAATTTC AGTACCGAAG GCCTTTGCCT GCGCTACGAT ACCGACAGAC

401 CTGCCGACAT CGCCAAGCTG AAACAGCTTG AGTTTGAAGC GGTCGAACTC

451 GACAATCGGA CCATTTACAC GCGCTGCGTC TCCGCCAAAG GCAAATACTA

501 CGCCAGACCG CAAAAACTGA ACGCCGATTA TCATTTTGAG CAAAGTGTGC

551 CTGCCGATAT TTATTACACG GTTACGAAAA AACATACCGA CAAATCCAAG

601 TTGTTTGAAA ATATTGCATA TACGCCCACC ACGTTGATAC TGGATGCGGT

651 GGGCGCGGTG CTGGCCTTGC CTGTCGCGGC GTTGATTGCA GCCACGAATT

701 CCTCAGACAA ATGA
```

This corresponds to the amino acid sequence <SEQ ID 1434; ORF 516.a>:

a516.pep

```
  1 MLFRKTTAAV LAATLMLNGC TVMMWGMNSP FSETTARKHV DKDQIRAFGV

 51 VAEDNAQLEK GSLVMMGGKY WFVVNPEDSA KLTGILKAGL DKQFQMVEPN

101 PRFAYQALPV KLESPASQNF STEGLCLRYD TDRPADIAKL KQLEFEAVEL

151 DNRTIYTRCV SAKGKYYATP QKLNADYHFE QSVPADIYYT VTKKHTDKSK

201 LFENIAYTPT TLILDAVGAV LALPVAALIA ATNSSDK*
```

m516/a516 86.1% identity in 238 aa overlap

```
                   10        20        30        40        50        60
m516.pep   MLFRKTTAAVLAATLMLNGCTLMLWGMNNPVSETITRKHVDKDQIRAFGVVAEDNAQLEK
           |||||||||||||||||||||:|:||||:| ||| :||||||||||||||||||||||||
a516       MLFRKTTAAVLAATLMLNGCTVMMWGMNSPFSETTARKHVDKDQIRAFGVVAEDNAQLEK
                   10        20        30        40        50        60

                   70        80        90       100       110       120
m516.pep   GSLVMMGGKYWFVVNPEDSAKLTGILKAGLDKPFQIVEDTPSYARHQALPVKLESPGSQN
           |||||||||||||||||||||||||||||||| ||:|| :| :| :||||||||||:|||
a516       GSLVMMGGKYWFVVNPEDSAKLTGILKAGLDKQFQMVEPNPRFA-YQALPVKLESPASQN
                   70        80        90       100       110       120

                  130       140       150       160       170       180
m516.pep   FSTEGLCLRYDTDKPADIAKLKQLGFEAVKLDNRTIYTRCVSAKGKYYATPQKLNADYHF
           |||||||||||||:|||||||||| ||||:||||||||||||||||||||||||||||||
a516       FSTEGLCLRYDTDRPADIAKLKQLEFEAVELDNRTIYTRCVSAKGKYYATPQKLNADYHF
         120       130       140       150       160       170

                  190       200       210       220       230      239
m516.pep   EQSVPADIYYTVTEEHTDKSKLFANILYTPPFLILDAAGAVLALPAAALGAVVDAARKX
           |||||||||||||::|||||||| || |||  |||||:|||||||:||| |::::: ||
a516       EQSVPADIYYTVTKKHTDKSKLFENIAYTPTTLILDAVGAVLALPVAALIAATNSSDKX
         180       190       200       210       220       230
```

The following partial DNA sequence was identified in *N. gonorrhoeae* <SEQ ID 1435>:

g517.seq

```
  1 atgcatcggg tttcagacgg cattggagtg tcagtcgtgt tctgccgatt

 51 cgtaggcttc gacgattttt tgcaccagag gatgccggac aacgtcttcg

101 ccggtgaagg tatggaaata cagtcctgcc acgccgtgca gtttctcacg

151 tgcgtctttc aatcccgatt tgatgttttt gggcaggtcg atttggctgg

201 tgtcgccggt aatgacggct ttcgcgccga agccgatgcg ggtcaggaac

251 attttcattt gttcgggcgt ggtgttttgc gcttcgtcga ggatgatgta

301 tgcgccgttg agcgtcctgc cgcgcatata ggcgagcggg gcgatttcaa

351 tcaggccttt ttcaatcagc ttggttacac ggtcaaagcc catcaggtca

401 tagagggcat cataaagcgg acggaggtag gggtcgactt tttgggtcag

451 gtctccgggc aggaagccca gtttctcacc ggcttcgacg gcaggccgaa

501 ctaa
```

This corresponds to the amino acid sequence <SEQ ID 1436; ORF 517.ng>:

g517.pep

```
  1 MHRVSDGIGV SVVFCRFVGF DDFLHQRMPD NVFAGEGMEI QSCHAVQFLT

 51 CVFQSRFDVF GQVDLAGVAG NDGFRAEADA GQEHFHLFGR GVLRFVEDDV
```

-continued

```
101 CAVERPAAHI GERGDFNQAF FNQLGYTVKA HQVIEGIIKR TEVGVDFLGQ

151 VSGQEAQFLT GFDGRPN*
```

The following partial DNA sequence was identified in *N. meningitidis* <SEQ ID 1437>:

m517.seq

```
  1 ATGCATCGGG TTTCAGACGG CATTGGAATG TCAGTCGTGT TCTGCCGATT

 51 CGTAGGCTTC GACGATTTTT TGCACCAAAG GATGCCGGAC AACGTCTTCG

101 CCGGTAAAGG TGTGGAAATA CAGCCCTTCC ACGTTGTGCA GTTTCTCACG

151 CGCATCTTTT AATCCCGATT TGATGTTTTT GGGCAGGTCG ATTTGGCTGG

201 TGTCGCCGGT AATGACGGCT TTCGCGCCGA AGCCGATGCG GGTCAGGAAC

251 ATTTTCATTT GTTCGGGCGT GGTGTTTTGC GCTTCGTCGA GGATGATGTA

301 TGCGCCGTTG AGCGTCCTGC CGCGCATATA GGCGAGCGGG GCGATTTCAA

351 TCAGGCCTTT TTCAATCAGC TTGGTTACAC GGTCAAAGCC CATCAGGTCA

401 TAGAGGGCAT CATAAAGCGG ACGAAGGTAG GGATCGACTT TCTGGGTCAG

451 GTCTCCGGGC AGGAAGCCCA GTTTCTCGCC GGCTTCGACG GCTGgGCGCA

501 CTAA
```

This corresponds to the amino acid sequence <SEQ ID 1438; ORF 517>:

m517.pep

```
  1 MHRVSDGIGM SVVFCRFVGF DDFLHQRMPD NVFAGKGVEI QPFHVVQFLT

 51 RIFXSRFDVF GQVDLAGVAG NDGFRAEADA GQEHFHLFGR GVLRFVEDDV

101 CAVERPAAHI GERGDFNQAF FNQLGYTVKA HQVIEGIIKR TKVGIDFLGQ

151 VSGQEAQFLA GFDGWAH*
```

Computer analysis of this amino acid sequence gave the following results:

Homology with a predicted ORF from *N. gonorrhoeae*

ORF 517 shows 92.7% identity over a 164 aa overlap with a predicted ORF (ORF 517.ng) from *N. gonorrhoeae*:

m517/g517

```
                   10        20        30        40        50        60
m517.pep  MHRVSDGIGMSVVFCRFVGFDDFLHQRMPDNVFAGKGVEIQPFHVVQFLTRIFXSRFDVF
          |||||||||:|||||||||||||||||||||||||:|:|||  |:||||| :| ||||||
g517      MHRVSDGIGVSVVFCRFVGFDDFLHQRMPDNVFAGEGMEIQSCHAVQFLTCVFQSRFDVF
                   10        20        30        40        50        60

                   70        80        90       100       110       120
m517.pep  GQVDLAGVAGNDGFRAEADAGQEHFHLFGRGVLRFVEDDVCAVERPAAHIGERGDFNQAF
          ||||||||||||||||||||||||||||||||||||||||||||||||||||||||||||
g517      GQVDLAGVAGNDGFRAEADAGQEHFHLFGRGVLRFVEDDVCAVERPAAHIGERGDFNQAF
                   70        80        90       100       110       120

                  130       140       150       160
m517.pep  FNQLGYTVKAHQVIEGIIKRTKVGIDFLGQVSGQEAQFLAGFDGWAH
          |||||||||||||||||||||:||:||||||||||||||:||||
g517      FNQLGYTVKAHQVIEGIIKRTEVGVDFLGQVSGQEAQFLTGFDGRPN
                  130       140       150       160
```

The following partial DNA sequence was identified in *N. meningitidis* <SEQ ID 1439>:

```
a517.seq

1 ATGCATCGGG TTTCAGACGG CATTGGAATG TCAGTCGTGT TCTGCCGATT

51 CGTAGGCTTC GACGATTTTT TGCACCAAAG GATGCCGGAC AACGTCTTCG

101 CCGGTAAAGG TGTGGAAATA CAGCCCTTCC ACGCCGTGCA GTTTCTCACG

151 CGCATCTTTT AATCCCGATT TGATGTTTTT GGGCAGGTCG ATTTGGCTGG

201 TGTCGCCGGT AATGACGGCT TTCGCGCCGA AGCCGATGCG GGTCAGGAAC

251 ATTTTCATTT GTTCGGGCGT GGTGTTTTGC GCTTCGTCGA GGATGATGTA

301 TGCGCCGTTG AGCGTCCTGC CGCGCATATA GGCGAGCGGG GCAATCTCAA

351 TCAGACCTTT TTCAATCAGC TTGGTGACAC GGTCGAAGCC CATCAGGTCA

401 TAGAGGGCAT CATAAAGCGG ACGAAGGTAG GGATCGACTT TCTGGGTCAG

451 GTCACCGGGC AGAAAACCCA GTTTCTCGCC GGCTTCGACG GCAGGCCGCA

501 CTAA
```

This corresponds to the amino acid sequence <SEQ ID 1440; ORF 517.a>:

```
a511.pep

1 MHRVSDGIGM SVVFCRFVGF DDFLHQRMPD NVFAGKGVEI QPFHAVQFLT

51 RIF*SRFDVF GQVDLAGVAG NDGFRAEADA GQEHFHLFGR GVLRFVEDDV

101 CAVERPAAHI GERGNLNQTF FNQLGDTVEA HQVIEGIIKR TKVGIDFLGQ

151 VTGQKTQFLA GFDGRPH*
``` m517/a517 93.4% identity in 167 aa overlap

```
                  10        20        30        40        50        60
m517.pep  MHRVSDGIGMSVVFCRFVGFDDFLHQRMPDNVFAGKGVEIQPFHVVQFLTRIFXSRFDVF
          ||||||||||||||||||||||||||||||||||||||||||||:|||||||||||||||
a517      MHRVSDGIGMSVVFCRFVGFDDFLHQRMPDNVFAGKGVEIQPFHAVQFLTRIFXSRFDVF
                  10        20        30        40        50        60

70        80        90       100       110       120
m517.pep  GQVDLAGVAGNDGFRAEADAGQEHFHLFGRGVLRFVEDDVCAVERPAAHIGERGDFNQAF
          ||||||||||||||||||||||||||||||||||||||||||||||||||||||::||:|
a517      GQVDLAGVAGNDGFRAEADAGQEHFHLFGRGVLRFVEDDVCAVERPAAHIGERGNLNQTF
                  70        80        90       100       110       120

130       140       150       160
m517.pep  FNQLGYTVKAHQVIEGIIKRTKVGIDFLGQVSGQEAQFLAGFDGWAHX
          ||||| ||:||||||||||||||||||||||:||::||||||||  ||
a517      FNQLGDTVEAHQVIEGIIKRTKVGIDFLGQVTGQKTQFLAGFDGRPHX
                 130       140       150       160
```

The following partial DNA sequence was identified in *N. gonorrhoeae* <SEQ ID 1441>:

```
g518.seq 1 atgacgtttt cggcggcaaa gctcaacatt tcggcactga tgttgtgtct 51 ttcggcagga atgaccgttt tactttccgc ttttttactg ctccgaccgg 101 aaggcagcat cttattcaac catttttca gcataaatat tctgacccga
```

-continued

```
151 agagcggcat ctccacgggc aaccgtgttc agactgcatc aggcggtacg

201 attccacaag atgccgaaaa ccataagcaa aatgcgtaga aactacgccg

251 tccgaatcac gccgcctcct cgggcggcaa cgcttcatta taacagattg

301 ccccttaaaa aatcagaccc tgcttttgtg gcggagtctg aaatttga
```

This corresponds to the amino acid sequence <SEQ ID 1442; ORF 518.ng>:

g518.pep

```
  1 MTFSAAKLNI SALMLCLSAG MTVLLSAFLL LRPEGSILFN HFFSINILTR

 51 RAASPRATVF RLHQAVRFHK MPKTISKMRR NYAVRITPPP RAATLHYNRL

101 PLKKSDPAFV AESEI*
```

The following partial DNA sequence was identified in *N. meningitidis* <SEQ ID 1443>:

m518.seq

```
  1 ATGACGTTTT CGGCGGCAAA GCTCAACATT TCGGCACGGA TGTTGTGTCT

 51 TTCGGCAGGA ATGACCGTTT TACTTTCCGC TTTTTTACTG CTCCGACCGG

101 AAGGCAGCAT CTTATTCAAC CATTTTTTCA GCATAAATAT TCTGACCCGA

151 AGAGCGGCAT CTCCACAGGC AACCGTGTTC AGACGGCATC AGGCGCGGTT

201 TGCAAGATGC CGTACCATAA ACAAAAGGCG TAGAAACTAC GCCGTCCGAA

251 TCACGCCGCC CTCGCG.GCG GCAACGCGTC ATTATAACAG ATTGCCCTCC

301 GCGGCAGGCT TAGTGCGGCG GGAGCGCCGC CGTTGCGCAG TAATATTGTC

351 TAACGGGAGG AAAAAATCAG ACCCTGCTTT TGTGGCAGAG TCTGAAATTT

401 GA
```

This corresponds to the amino acid sequence <SEQ ID 1444; ORF 518>:

m518.pep

```
  1 MTFSAAKLNI SARMLCLSAG MTVLLSAFLL LRPEGSILFN HFFSINILTR

 51 RAASPQATVF RRHQARFARC RTINKRRRNY AVRITPPSXA ATRHYNRLPS

101 AAGLVRRERR RCAVILSNGR KKSDPAFVAE SEI*
```

Computer analysis of this amino acid sequence gave the following results:

Homology with a predicted ORF from *N. gonorrhoeae*

ORF 518 shows 74.1% identity over a 135 aa overlap with a predicted ORF (ORF 518.ng) from *N. gonorrhoeae*:

m518/g518

```
m518.pep    MTFSAAKLNISARMLCLSAGMTVLLSAFLLLRPEGSILFNHFFSINILTRRAASPQATVF
            |||||||||||| ||||||||||||||||||||||||||||||||||||||||||:||||
g518        MTFSAAKLNISALMLCLSAGMTVLLSAFLLLRPEGSILFNHFFSINILTRRAASPRATVF
                    10        20        30        40        50        60
```

-continued

```
                  70          80          90         100         110
m518.pep   RRHQA-RFARC-RTINKRRRNYAVRITPPSXAATRHYNRLPSAAGLVRRERRRCAVILSN
           | ||| || :  :||:| ||||||||||  ||| ||||||
g518       RLHQAVRFHKMPKTISKMRRNYAVRITPPPRAATLHYNRLPL------------------
                 70         80         90        100

         120        130
m518.pep   GRKKSDPAFVAESEI
             ||||||||||||
g518       --KKSDPAFVAESEI
                 110
```

The following partial DNA sequence was identified in *N. meningitidis* <SEQ ID 1445>:

a518.seq

```
  1 ATGACGTTTT CGGCGGCAAA GCTCAACATT TCGGCACGGA TGTTGTGTCT
 51 TTCGGCAGGA ATGACCGTTT TACTTTCCGC TTTTTTACTG CTCCGACCGG
101 AAGGCAGCAT CTTATTCAAC CATTTTTTCA GCATAAATAT TCTAACCCGA
151 AGAGCGGCAT CTCCACGGGC AACCGTGTTC AGACGGCATC AGGCGGTACG
201 ATTCCGCAAG ATGCCGACCA TAAACAAAAG GCGTAGAAAC TACGCCGTCC
251 GAATCACGCC GTCCTCG.CG GCGGCAACGC GTCATTATAA CAGATTGCCC
301 TCC....... .......... .......... .......... ..........
351 .......... ...AAAAAAT CAGACCCTGC TTTTGTGGCA GAGTCTGAAA
401 TTTGA
```

This corresponds to the amino acid sequence <SEQ ID 1446; ORF 518.a>:

a518.pep

```
  1 MTFSAAKLNI SARMLCLSAG MTVLLSAFLL LRPEGSILFN HFFSINILTR
 51 RAASPRATVF RRHQAVRFRK MPTINKRRRN YAVRITPSSX AATRHYNRLP
101 S......... .......... .KKSDPAFVA ESEI*
```

m518/a518 79.9% identity in 134 aa overlap

```
                   10         20         30         40         50         60
m518.pep   MTFSAAKLNISARMLCLSAGMTVLLSAFLLLRPEGSILFNHFESINILTRRAASPQATVF
           ||||||||||||||||||||||||||||||||||||||||||||||||||||||||:||||
a518       MTFSAAKLNISARMLCLSAGMTVLLSAFLLLRPEGSILFNHFFSINILTRRAASPRATVF
                   10         20         30         40         50         60
                   70         80         90        100        110        119
m518.pep   RRHQA-RFARCRTINKRRRNYAVRITPPSXAATRHYNRLPSAAGLVRRERRRCAVILSNG
           ||||| || :  |||||||||||||| ||||||||||||
a518       RRHQAVRFRKMPTINKRRRNYAVRITPSSXAATRHYNRLPS------------------
                   70         80         90        100
         120        130
m518.pep   RKKSDPAFVAESEIX
            ||||||||||||||
a518       -KKSDPAFVAESEIX
                   110
```

The following partial DNA sequence was identified in *N. gonorrhoeae* <SEQ ID 1447>:

g519.seq

```
  1 atggaatttt tcattatctt gttggcagcc gtcgccgttt tcggcttcaa
 51 atcctttgtc gtcatccccc agcaggaagt ccacgttgtc gaaaggctcg
101 ggcgtttcca tcgcgccctg acggccggtt tgaatatttt gattcccttt
151 atcgaccgcg tcgcctaccg ccattcgctg aaagaaatcc ctttagacgt
201 acccagccag gtctgcatca cgcgcgataa tacgcaattg actgttgacg
251 gcatcatcta tttccaagta accgatccca aactcgcctc atacggttcg
301 agcaactaca ttatggcaat tacccagctt gcccaaacga cgctgcgttc
351 cgttatcggg cgtatggagt tggacaaaac gtttgaagaa cgcgacgaaa
401 tcaacagtac cgtcgtctcc gccctcgatg aagccgccgg ggcttggggt
451 gtgaaagtcc tccgttacga aatcaaggat ttggttccgc cgcaagaaat
501 ccttcgcgca atgcaggcac aaattaccgc cgaacgcgaa aaacgcgccc
551 gtattgccga atccgaaggc cgtaaaatcg aacaaatcaa ccttgccagt
601 ggtcagcgtg aagccgaaat ccaacaatcc gaaggcgagg ctcaggctgc
651 ggtcaatgcg tccaatgccg agaaaatcgc ccgcatcaac cgcgccaaag
701 gcgaagcgga atccctgcgc cttgttgccg aagccaatgc cgaagccaac
751 cgtcaaattg ccgccgccct tcaaacccaa agcggggcgg atgcggtcaa
801 tctgaagatt gcgggacaat acgttaccgc gttcaaaaat cttgccaaag
851 aagacaatac gcggattaag cccgccaagg ttgccgaaat cgggaaccct
901 aattttcggc ggcatgaaaa attttcgcca gaagcaaaaa cggccaaata
951 a
```

This corresponds to the amino acid sequence <SEQ ID 1448; ORF 519.ng>:

g519.pep

```
  1 MEFFIILLAA VAVFGFKSFV VIPQQEVHVV ERLGRFHRAL TAGLNILIPF
 51 IDRVAYRHSL KEIPLDVPSQ VCITRDNTQL TVDGIIYFQV TDPKLASYGS
101 SNYIMAITQL AQTTLRSVIG RMELDKTFEE RDEINSTVVS ALDEAAGAWG
151 VKVLRYEIKD LVPPQEILRA MQAQITAERE KRARIAESEG RKIEQINLAS
201 GQREAEIQQS EGEAQAAVNA SNAEKIARIN RAKGEAESLR LVAEANAEAN
251 RQIAAALQTQ SGADAVNLKI AGQYVTAFKN LAKEDNTRIK PAKVAEIGNP
301 NFRRHEKFSP EAKTAK*
```

The following partial DNA sequence was identified in *N. meningitidis* <SEQ ID 1449>:

m519.seq (partial)

```
  1 ..TCCGTTATCG GGCGTATGGA GTTGGACAAA ACGTTTGAAG AACGCGACGA
 51   AATCAACAGT ACTGTTGTTG CGGCTTTGGA CGAGGCGGCC GGGgCTTgGG
101   GTGTGAAGGT TTTGCGTTAT GAGATTAAAG ACTTGGTTCC GCCGCAAGAA
151   ATCCTTCGCT CAATGCAGGC GCAAATTACT GCCGAACGCG AAAAACGCGC
```

-continued

```
201   CCGTATCGCC GAATCCGAAG GTCGTAAAAT CGAACAAATC AACCTTGCCA

251   GTGGTCAGCG CGAAGCCGAA ATCCAACAAT CCGAAGGCGA GGCTCAGGCT

301   GCGGTCAATG CGTCAAATGC CGAGAAAATC GCCCGCATCA ACCGCGCCAA

351   AGGTGAAGCG GAATCCTTGC GCCTTGTTGC CGAAGCCAAT GCCGAAGCCA

401   TCCGTCAAAT TGCCGCCGCC CTTCAAACCC AAGGCGGTGC GGATGCGGTC

451   AATCTGAAGA TTGCGGAACA ATACGTCGCT GCGTTCAACA ATCTTGCCAA

501   AGAAAGCAAT ACGCTGATTA TGCCCGCCAA TGTTGCCGAC ATCGGCAGCC

551   TGATTTCTGC CGGTATGAAA ATTATCGACA GCAGCAAAAC CGCCAAaTAA
```

This corresponds to the amino acid sequence <SEQ ID 1450; ORF 519>:

m519.pep (partial)

```
  1 ..SVIGRMELDK TFEERDEINS TVVAALDEAA GAWGVKVLRY EIKDLVPPQE

 51   ILRSMQAQIT AEREKRARIA ESEGRKIEQI NLASGQREAE IQQSEGEAQA

101   AVNASNAEKI ARINRAKGEA ESLRLVAEAN AEAIRQIAAA LQTQGGADAV

151   NLKIAEQYVA AFNNLAKESN TLIMPANVAD IGSLISAGMK IIDSSKTAK*
```

Computer analysis of this amino acid sequence gave the following results:

Homology with a predicted ORF from *N. gonorrhoeae*

ORF 519 shows 87.5% identity over a 200 aa overlap with a predicted ORF (ORF 519.ng) from *N. gonorrhoeae*:

m519/g519

```
                                                10        20        30
m519.pep                                SVIGRMELDKTFEERDEINSTVVAALDEAA
                                        |||||||||||||||||||||||:||||||
g519      YFQVTDPKLASYGSSNYIMAITQLAQTTLRSVIGRMELDKTFEERDEINSTVVSALDEAA
            90       100       110       120       130       140
                  40        50        60        70        80        90
m519.pep  GAWGVKVLRYEIKDLVPPQEILRSMQAQITAEREKRARIAESEGRKIEQINLASGQREAE
          |||||||||||||||||||||||:||||||||||||||||||||||||||||||||||||
g519      GAWGVKVLRYEIKDLVPPQEILRAMQAQITAEREKRARIAESEGRKIEQINLASGQREAE
          150       160       170       180       190       200
               100       110       120       130       140       150
m519.pep  IQQSEGEAQAAVNASNAEKIARINRAKGEAESLRLVAEANAEAIRQIAAALQTQGGADAV
          ||||||||||||||||||||||||||||||||||||||||||| ||||||||||:|||||
g519      IQQSEGEAQAAVNASNAEKIARINRAKGEAESLRLVAEANAEANRQIAAALQTQSGADAV
          210       220       230       240       250       260
               160       170       180       190       200
m519.pep  NLKIAEQYVAAFNNLAKESNTLIMPANVADIGSL-ISAGMKIIDSSKTAK
          ||||| |||:||:|||||:|| | ||:||:||:  :    |:   :||||
g519      NLKIAGQYVTAFKNLAKEDNTRIKPAKVAEIGNPNFRRHEKFSPEAKTAK
          270       280       290       300       310
```

The following partial DNA sequence was identified in *N. meningitidis* <SEQ ID 1451>:

a519.seq

```
  1 ATGGAATTTT TCATTATCTT GCTGGCAGCC GTCGTTGTTT TCGGCTTCAA

 51 ATCCTTTGTT GTCATCCCAC AGCAGGAAGT CCACGTTGTC GAAAGGCTCG

101 GGCGTTTCCA TCGCGCCCTG ACGGCCGGTT TGAATATTTT GATTCCCTTT
```

-continued

```
151 ATCGACCGCG TCGCCTACCG CCATTCGCTG AAAGAAATCC CTTTAGACGT

201 ACCCAGCCAG GTCTGCATCA CGCGCGACAA TACGCAGCTG ACTGTTGACG

251 GTATCATCTA TTTCCAAGTA ACCGACCCCA AACTCGCCTC ATACGGTTCG

301 AGCAACTACA TTATGGCGAT TACCCAGCTT GCCCAAACGA CGCTGCGTTC

351 CGTTATCGGG CGTATGGAAT TGGACAAAAC GTTTGAAGAA CGCGACGAAA

401 TCAACAGCAC CGTCGTCTCC GCCCTCGATG AAGCCGCCGG AGCTTGGGGT

451 GTGAAGGTTT TGCGTTATGA GATTAAAGAC TTGGTTCCGC CGCAAGAAAT

501 CCTTCGCTCA ATGCAGGCGC AAATTACTGC TGAACGCGAA AAACGCGCCC

551 GTATCGCCGA ATCCGAAGGT CGTAAAATCG AACAAATCAA CCTTGCCAGT

601 GGTCAGCGCG AAGCCGAAAT CCAACAATCC GAAGGCGAGG CTCAGGCTGC

651 GGTCAATGCG TCAAATGCCG AGAAAATCGC CCGCATCAAC CGCGCCAAAG

701 GTGAAGCGGA ATCCTTGCGC CTTGTTGCCG AAGCCAATGC CGAAGCCATC

751 CGTCAAATTG CCGCCGCCCT TCAAACCCAA GGCGGTGCGG ATGCGGTCAA

801 TCTGAAGATT GCGGAACAAT ACGTCGCCGC GTTCAACAAT CTTGCCAAAG

851 AAAGCAATAC GCTGATTATG CCCGCCAATG TTGCCGACAT CGGCAGCCTG

901 ATTTCTGCCG GTATGAAAAT TATCGACAGC AGCAAAACCG CCAAATAA
```

This corresponds to the amino acid sequence <SEQ ID 1452; ORF 519.a>:

```
a519.pep

  1 MEFFIILLAA VVVFGFKSFV VIPQQEVHVV ERLGRFHRAL TAGLNILIPF

 51 IDRVAYRHSL KEIPLDVPSQ VCITRDNTQL TVDGIIYFQV TDPKLASYGS

101 SNYIMAITQL AQTTLRSVIG RMELDKTFEE RDEINSTVVS ALDEAAGAWG

151 VKVLRYEIKD LVPPQEILRS MQAQITAERE KRARIAESEG RKIEQINLAS

201 GQREAEIQQS EGEAQAAVNA SNAEKIARIN RAKGEAESLR LVAEANAEAI

251 RQIAAALQTQ GGADAVNLKI AEQYVAAFNN LAKESNTLIM PANVADIGSL

301 ISAGMKIIDS SKTAK*
```

m519/a519 99.5% identity in 199 aa overlap

```
                                                  10        20        30
m519.pep                                    SVIGRMELDKTFEERDEINSTVVAALDEAA
                                            ||||||||||||||||||||||:|||||||
a519        YFQVTDPKLASYGSSNYIMAITQLAQTTLRSVIGRMELDKTFEERDEINSTVVSALDEAA
              90       100       110       120       130       140

                     40        50        60        70        80        90
m519.pep    GAWGVKVLRYEIKDLVPPQEILRSMQAQITAEREKRARIAESEGRKIEQINLASGQREAE
            ||||||||||||||||||||||||||||||||||||||||||||||||||||||||||||
a519        GAWGVKVLRYEIKDLVPPQEILRSMQAQITAEREKRARIAESEGRKIEQINLASGQREAE
              150       160       170       180       190       200

                    100       110       120       130       140       150
m519.pep    IQQSEGEAQAAVNASNAEKIARINRAKGEAESLRLVAEANAEAIRQIAAALQTQGGADAV
            ||||||||||||||||||||||||||||||||||||||||||||||||||||||||||||
a519        IQQSEGEAQAAVNASNAEKIARINRAKGEAESLRLVAEANAEAIRQIAAALQTQGGADAV
              210       220       230       240       250       260

                    160       170       180       190       200
m519.pep    NLKIAEQYVAAFNNLAKESNTLIMPANVADIGSLISAGMKIIDSSKTAKX
            ||||||||||||||||||||||||||||||||||||||||||||||||||
a519        NLKIAEQYVAAFNNLAKESNTLIMPANVADIGSLISAGMKIIDSSKTAKX
              270       280       290       300       310
```

The following partial DNA sequence was identified in *N. gonorrhoeae* <SEQ ID 1453>:

g519-1.seq

```
  1 ATGGAATTTT TCATTATCTT GTTGGCAGCC GTCGCCGTTT TCGGCTTCAA
 51 ATCCTTTGTC GTCATCCCCC AGCAGGAAGT CCACGTTGTC GAAAGGCTCG
101 GGCGTTTCCA TCGCGCCCTG ACGGCCGGTT TGAATATTTT GATTCCCTTT
151 ATCGACCGCG TCGCCTACCG CCATTCGCTG AAAGAAATCC CTTTAGACGT
201 ACCCAGCCAG GTCTGCATCA CGCGCGATAA TACGCAATTG ACTGTTGACG
251 GCATCATCTA TTTCCAAGTA ACCGATCCCA AACTCGCCTC ATACGGTTCG
301 AGCAACTACA TTATGGCAAT TACCCAGCTT GCCCAAACGA CGCTGCGTTC
351 CGTTATCGGG CGTATGGAGT TGGACAAAAC GTTTGAAGAA CGCGACGAAA
401 TCAACAGTAC CGTCGTCTCC GCCCTCGATG AAGCCGCCGG GGCTTGGGGT
451 GTGAAAGTCC TCCGTTACGA AATCAAGGAT TTGGTTCCGC CGCAAGAAAT
501 CCTTCGCGCA ATGCAGGCAC AAATTACCGC CGAACGCGAA AAACGCGCCC
551 GTATTGCCGA ATCCGAAGGC CGTAAAATCG AACAAATCAA CCTTGCCAGT
601 GGTCAGCGTG AAGCCGAAAT CCAACAATCC GAAGGCGAGG CTCAGGCTGC
651 GGTCAATGCG TCCAATGCCG AGAAAATCGC CCGCATCAAC CGCGCCAAAG
701 GCGAAGCGGA ATCCCTGCGC CTTGTTGCCG AAGCCAATGC CGAAGCCATC
751 CGTCAAATTG CCGCCGCCCT TCAAACCCAA GGCGGGGCGG ATGCGGTCAA
801 TCTGAAGATT GCGGAACAAT ACGTAGCCGC GTTCAACAAT CTTGCCAAAG
851 AAAGCAATAC GCTGATTATG CCCGCCAATG TTGCCGACAT CGGCAGCCTG
901 ATTTCTGCCG GCATGAAAAT TATCGACAGC AGCAAAACCG CCAAATAA
```

This corresponds to the amino acid sequence <SEQ ID 1454; ORF 519-1.ng>:

g519-1.pep

```
  1 MEFFIILLAA VAVFGFKSFV VIPQQEVHVV ERLGRFHRAL TAGLNILIPF
 51 IDRVAYRHSL KEIPLDVPSQ VCITRDNTQL TVDGIIYFQV TDPKLASYGS
101 SNYIMAITQL AQTTLRSVIG RMELDKTFEE RDEINSTVVS ALDEAAGAWG
151 VKVLRYEIKD LVPPQEILRA MQAQITAERE KRARIAESEG RKIEQINLAS
201 GQREAEIQQS EGEAQAAVNA SNAEKIARIN RAKGEAESLR LVAEANAEAI
251 RQIAAALQTQ GGADAVNLKI AEQYVAAFNN LAKESNTLIM PANVADIGSL
301 ISAGMKIIDS SKTAK*
```

The following partial DNA sequence was identified in *N. meningitidis* <SEQ ID 1455>:

m519-1.seq

```
  1 ATGGAATTTT TCATTATCTT GTTGGTAGCC GTCGCCGTTT TCGGTTTCAA
 51 ATCCTTTGTT GTCATCCCAC AACAGGAAGT CCACGTTGTC GAAAGGCTGG
101 GGCGTTTCCA TCGCGCCCTG ACGGcCGGTT TGAATATTTT GATTCCCTTT
```

-continued

```
151 ATCGACCGCG TCGCCTACCG CCATTCGCTG AAAGAAATCC CTTTAGACGT

201 ACCCAGCCAG GTCTGCATCA CGCGCGACAA TACGCAGCTG ACTGTTGACG

251 GCATCATCTA TTTCCAAGTA ACCGACCCCA AACTCGCCTC ATACGGTTCG

301 AGCAACTACA TTATGGCGAT TACCCAGCTT GCCCAAACGA CGCTGCGTTC

351 CGTTATCGGG CGTATGGAGT TGGACAAAAC GTTTGAAGAA CGCGACGAAA

401 TCAACAGTAC TGTTGTTGCG GCTTTGGACG AGGCGGCCGG GGCTTGGGGT

451 GTGAAGGTTT TGCGTTATGA GATTAAAGAC TTGGTTCCGC CGCAAGAAAT

501 CCTTCGCTCA ATGCAGGCGC AAATTACTGC CGAACGCGAA AAACGCGCCC

551 GTATCGCCGA ATCCGAAGGT CGTAAAATCG AACAAATCAA CCTTGCCAGT

601 GGTCAGCGCG AAGCCGAAAT CCAACAATCC GAAGGCGAGG CTCAGGCTGC

651 GGTCAATGCG TCAAATGCCG AGAAAATCGC CCGCATCAAC CGCGCCAAAG

701 GTGAAGCGGA ATCCTTGCGC CTTGTTGCCG AAGCCAATGC CGAAGCCATC

751 CGTCAAATTG CCGCCGCCCT TCAAACCCAA GGCGGTGCGG ATGCGGTCAA

801 TCTGAAGATT GCGGAACAAT ACGTCGCTGC GTTCAACAAT CTTGCCAAAG

851 AAAGCAATAC GCTGATTATG CCCGCCAATG TTGCCGACAT CGGCAGCCTG

901 ATTTCTGCCG GTATGAAAAT TATCGACAGC AGCAAAACCG CCAAATAA
```

This corresponds to the amino acid sequence <SEQ ID 1456; ORF 519-1>:

```
m519-1.

  1 MEFFIILLVA VAVFGFKSFV VIPQQEVHVV ERLGRFHRAL TAGLNILIPF

 51 IDRVAYRHSL KEIPLDVPSQ VCITRDNTQL TVDGIIYFQV TDPKLASYGS

101 SNYIMAITQL AQTTLRSVIG RMELDKTFEE RDEINSTVVA ALDEAAGAWG

151 VKVLRYEIKD LVPPQEILRS MQAQITAERE KRARIAESEG RKIEQINLAS

201 GQREAEIQQS EGEAQAAVNA SNAEKIARIN RAKGEAESLR LVAEANAEAI

251 RQIAAALQTQ GGADAVNLKI AEQYVAAFNN LAKESNTLIM PANVADIGSL

301 ISAGMKIIDS SKTAK*
```

m519-1/g519-1 99.0% identity in 315 aa overlap

```
                    10        20        30        40        50        60
g519-1.pep  MEFFIILLAAVAVFGFKSFVVIPQQEVHVVERLGRFHRALTAGLNILIPFIDRVAYRHSL
            ||||||||:|||||||||||||||||||||||||||||||||||||||||||||||||||
m519-1      MEFFIILLVAVAVFGFKSFVVIPQQEVHVVERLGRFHRALTAGLNILIPFIDRVAYRHSL
                    10        20        30        40        50        60

                    70        80        90       100       110       120
g519-1.pep  KEIPLDVPSQVCITRDNTQLTVDGIIYFQVTDPKLASYGSSNYIMAITQLAQTTLRSVIG
            ||||||||||||||||||||||||||||||||||||||||||||||||||||||||||||
m519-1      KEIPLDVPSQVCITRDNTQLTVDGIIYFQVTDPKLASYGSSNYIMAITQLAQTTLRSVIG
                    70        80        90       100       110       120

                   130       140       150       160       170       180
g519-1.pep  RMELDKTFEERDEINSTVVSALDEAAGAWGVKVLRYEIKDLVPPQEILRAMQAQITAERE
            ||||||||||||||||||||:|||||||||||||||||||||||||||||:|||||||||
m519-1      RMELDKTFEERDEINSTVVAALDEAAGAWGVKVLRYEIKDLVPPQEILRSMQAQITAERE
                   130       140       150       160       170       180

                   190       200       210       220       230       240
g519-1.pep  KRARIAESEGRKIEQINLASGQREAEIQQSEGEAQAAVNASNAEKIARINRAKGEAESLR
            ||||||||||||||||||||||||||||||||||||||||||||||||||||||||||||
m519-1      KRARIAESEGRKIEQINLASGQREAEIQQSEGEAQAAVNASNAEKIARINRAKGEAESLR
                   190       200       210       220       230       240
```

-continued

```
                250       260       270       280       290       300
g519-1.pep  LVAEANAEAIRQIAAALQTQGGADAVNLKIAEQYVAAFNNLAKESNTLIMPANVADIGSL
            ||||||||||||||||||||||||||||||||||||||||||||||||||||||||||||
m519-1      LVAEANAEAIRQIAAALQTQGGADAVNLKIAEQYVAAFNNLAKESNTLIMPANVADIGSL
                250       260       270       280       290       300

                310
g519-1.pep  ISAGMKIIDSSKTAKX
            ||||||||||||||||
            ISAGMKIIDSSKTAKX
m519-1          310
```

The following partial DNA sequence was identified in *N. meningitidis* <SEQ ID 1457>:

a519-1.seq

```
  1 ATGGAATTTT TCATTATCTT GCTGGCAGCC GTCGTTGTTT TCGGCTTCAA
 51 ATCCTTTGTT GTCATCCCAC AGCAGGAAGT CCACGTTGTC GAAAGGCTCG
101 GGCGTTTCCA TCGCGCCCTG ACGGCCGGTT TGAATATTTT GATTCCCTTT
151 ATCGACCGCG TCGCCTACCG CCATTCGCTG AAAGAAATCC CTTTAGACGT
201 ACCCAGCCAG GTCTGCATCA CGCGCGACAA TACGCAGCTG ACTGTTGACG
251 GTATCATCTA TTTCCAAGTA ACCGACCCCA AACTCGCCTC ATACGGTTCG
301 AGCAACTACA TTATGGCGAT TACCCAGCTT GCCCAAACGA CGCTGCGTTC
351 CGTTATCGGG CGTATGGAAT TGGACAAAAC GTTTGAAGAA CGCGACGAAA
401 TCAACAGCAC CGTCGTCTCC GCCCTCGATG AAGCCGCCCG AGCTTGGGGT
451 GTGAAGGTTT TGCGTTATGA GATTAAAGAC TTGGTTCCGC CGCAAGAAAT
501 CCTTCGCTCA ATGCAGGCGC AAATTACTGC TGAACGCGAA AAACGCGCCC
551 GTATCGCCGA ATCCGAAGGT CGTAAAATCG AACAAATCAA CCTTGCCAGT
601 GGTCAGCGCG AAGCCGAAAT CCAACAATCC GAAGGCGAGG CTCAGGCTGC
651 GGTCAATGCG TCAAATGCCG AGAAAATCGC CCGCATCAAC CGCGCCAAAG
701 GTGAAGCGGA ATCCTTGCGC CTTGTTGCCG AAGCCAATGC CGAAGCCATC
751 CGTCAAATTG CCGCCGCCCT TCAAACCCAA GGCGGTGCGG ATGCGGTCAA
801 TCTGAAGATT GCGGAACAAT ACGTCGCCGC GTTCAACAAT CTTGCCAAAG
851 AAAGCAATAC GCTGATTATG CCCGCCAATG TTGCCGACAT CGGCAGCCTG
901 ATTTCTGCCG GTATGAAAAT TATCGACAGC AGCAAAACCG CCAAATAA
```

This corresponds to the amino acid sequence <SEQ ID 1458; ORF 519-1.a>:

a519-1.pep.

```
  1 MEFFIILLAA VVVFGFKSFV VIPQQEVHVV ERLGRFHRAL TAGLNILIPF
 51 IDRVAYRHSL KEIPLDVPSQ VCITRDNTQL TVDGIIYFQV TDPKLASYGS
101 SNYIMAITQL AQTTLRSVIG RMELDKTFEE RDEINSTVVS ALDEAAGAWG
151 VKVLRYEIKD LVPPQEILRS MQAQITAERE KRARIAESEG RKIEQINLAS
201 GQREAEIQQS EGEAQAAVNA SNAEKIARIN RAKGEAESLR LVAEANAEAI
251 RQIAAALQTQ GGADAVNLKI AEQYVAAFNN LAKESNTLIM PANVADIGSL
301 ISAGMKIIDS SKTAK*
```

m519-1/a519-1 99.0% identity in 315 aa overlap

```
                10        20        30        40        50        60
a519-1.pep  MEFFIILLAAVVVFGFKSFVVIPQQEVHVVERLGRFHRALTAGLNILIPFIDRVAYRHSL
            ||||||||:||:||||||||||||||||||||||||||||||||||||||||||||||||
m519-1      MEFFIILLVAVAVFGFKSFVVIPQQEVHVVERLGRFHRALTAGLNILIPFIDRVAYRHSL
                10        20        30        40        50        60

                70        80        90       100       110       120
a519-1.pep  KEIPLDVPSQVCITRDNTQLTVDGIIYFQVTDPKLASYGSSNYIMAITQLAQTTLRSVIG
            ||||||||||||||||||||||||||||||||||||||||||||||||||||||||||||
m519-1      KEIPLDVPSQVCITRDNTQLTVDGIIYFQVTDPKLASYGSSNYIMAITQLAQTTLRSVIG
                70        80        90       100       110       120

               130       140       150       160       170       180
a519-1.pep  RMELDKTFEERDEINSTVVSALDEAAGAWGVKVLRYEIKDLVPPQEILRSMQAQITAERE
            |||||||||||||||||||:||||||||||||||||||||||||||||||||||||||||
m519-1      RMELDKTFEERDEINSTVVAALDEAAGAWGVKVLRYEIKDLVPPQEILRSMQAQITAERE
               130       140       150       160       170       180

               190       200       210       220       230       240
a519-1.pep  KRARIAESEGRKIEQINLASGQREAEIQQSEGEAQAAVNASNAEKIARINRAKGEAESLR
            ||||||||||||||||||||||||||||||||||||||||||||||||||||||||||||
m519-1      KRARIAESEGRKIEQINLASGQREAEIQQSEGEAQAAVNASNAEKIARINRAKGEAESLR
               190       200       210       220       230       240

               250       260       270       280       290       300
a519-1.pep  LVAEANAEAIRQIAAALQTQGGADAVNLKIAEQYVAAFNNLAKESNTLIMPANVADIGSL
            ||||||||||||||||||||||||||||||||||||||||||||||||||||||||||||
m519-1      LVAEANAEAIRQIAAALQTQGGADAVNLKIAEQYVAAFNNLAKESNTLIMPANVADIGSL
               250       260       270       280       290       300

               310
a519-1.pep  ISAGMKIIDSSKTAKX
            ||||||||||||||||
            ISAGMKIIDSSKTAKX
m519-1         310
```

Expression of ORF 519

The primer described in Table 1 for ORF 519 was used to locate and clone ORF 519. ORF 519 was cloned in pET and pGex vectors and expressed in *E. coli* as above described. The products of protein expression and purification were analyzed by SDS-PAGE. FIG. 4A shows the results of affinity purification, and FIG. 4B shows the expression in *E. coli*. Purified Nis-fusion protein was used to immunize mice whose sera were used for ELISA (positive result), FACS analysis (FIG. 4C), western blot (FIG. 1E), and a bactericidal assay (FIG. 4D). These experiments confirm that 519 is a surface-exposed protein and that it is a useful immunogen. The hydrophilicity plots, antigenic index, and amphipatic regions of ORF 519 are provided in FIG. 8. The AMPHI program is used to predict putative T-cell epitopes (Gao et al 1989, *J. Immunol* 143: 3007; Roberts et al. 1996, *AIDS Res Human Retroviruses* 12:593; Quakyi et al. 1992, *Scand J Immunol Suppl* 11:9). The nucleic acid sequence of ORF 519 and the amino acid sequence encoded thereby as provided herein.

The following partial DNA sequence was identified in *N. gonorrhoeae* <SEQ ID 1459>:

```
g520.seq
  1 atgcctgcgc ttctttcaat acgtcgggca aacgcgctgc ctttttcgcg
 51 catttcggaa aggatgaagt tgctggtgcc gttaataatg ccggcgatgg
101 atttaatcct gtttgccgcc aaaccttcgc gcacggcttt gatgattggg
151 ataccgcccg ctactgccgc ttcaaattgg acgatgacgt tttgtttttc
201 cgccagcggg aagatttcgt tgccgtattc ggcgagcagt tttttgttgg
251 cggtaacgat gtgtttgccg ttttcaatgg ctttcaacac cgcttctttg
301 gcaatgcccg tgccgccgaa caattcgacc aagacatcga cgtctttacg
351 cgcgaacagt tcgaacggat cttttgacaa gggcgggcga cgggccgatt
401 ttggcgggct ttttcttcgc ttaagtcgca catggcagaa atacggattt
451 cgcgccccaa gcggcgggaa atttcctctg cgttgtcccg caacacggca
501 gccgcaccgc cgccgaccgt acctaagcct aaaagaccga tgtttactgg
551 cttcattgtg tctccttgta agccgactga aatgtaaata ttga
```

This corresponds to the amino acid sequence <SEQ ID 1460; ORF 520.ng>:

g520.pep

```
  1 MPALLSIRRA NALPFSRISE RMKLLVPLIM PAMDLILFAA KPSRTALMIG
 51 IPPATAASNW TMTFCFSASG KISLPYSASS FLLAVTMCLP FSMAFNTASL
101 AMPVPPNNST KTSTSLRANS SNGSFDKGGR RADFGGLFLR LSRTWQKYGF
151 RAPSGGKFPL RCPATRQPHR RRPYLSLKDR CLLASLCLLV SRLKCKY*
```

The following partial DNA sequence was identified in *N. meningitidis* <SEQ ID 1461>:

m520.seq

```
  1 ATGCCTGCGC TTCTTTCAGT ACATCG.GCA AACGCGCTGC CTTTTTCGCG
 51 CATTTCGGrk AGGATGAAGT TGCTGGTGCC GTTAATAATG CCGGCGATGG
101 ATTTAATCCT GTTTGCCGCC AAACCTTCGC GCAGGGCTTT GATGATTGGG
151 ATACCGCCCG CTACTGCCGC TTCAAATTGG ACGATGACGT TTTGTTTTTC
201 CGCCAGCGGG AAGATTTCGT TGCCGTATTC GGCGAGCAGT TTTTTGTTGG
251 CGGTAACGAT GTGTTTGCCG TTTTCAATGG CTTTCAACAC CGCATCTTTG
301 GCAATGCCGG TACCGCCGaA CAATTCGACG ACGACATCGA CGTCTTCACG
351 TGCGACCAGT TCGAACGGAT CTTTGACAAA GGCTGc.CGG ACGGGCAGGT
401 TTGTCGGGCT TTTTCTTCAC TCAAATCGCA CACGGCAGAA ATACGGATTT
451 CGCGCCCCAA GCGACGGGAA ATTTCCTCCG CGTTGTCsCG CAACACGGCA
501 GCCGTACCGC CGCCGACCGT ACCCAAACCT AAAAGACCGA TGTTTACTGG
551 CTTCATTGTG TCTCCTTGTA AGCCGACTGA AATGTAAATA TTGA
```

This corresponds to the amino acid sequence <SEQ ID 1462; ORF 520>:

m520.pep

```
  1 MPALLSVHXA NALPFSRISX RMKLLVPLIM PAMDLILFAA KPSRRALMIG
 51 IPPATAASNW TMTFCFSASG KISLPYSASS FLLAVTMCLP FSMAFNTASL
101 AMPVPPNNST TTSTSSRATS SNGSLTKAXR TGRFVGLFLH SNRTRQKYGF
151 RAPSDGKFPP RCXATRQPYR RRPYPNLKDR CLLASLCLLV SRLKCKY*
```

Computer analysis of this amino acid sequence gave the following results:

Homology with a predicted ORF from *N. gonorrhoeae*

ORF 520 shows 87.3% identity over a 197 aa overlap with a predicted ORF (ORF 520.ng) from *N. gonorrhoeae*:

m520/g520

```
                  10        20        30        40        50        60
m520.pep   MPALLSVHRANALPFSRISXRMKLLVPLIMPAMDLILFAAKPSRRALMIGIPPATAASNW
           ||||||::|||||||||||| |||||||||||||||||||||||| ||||||||||||||
g520       MPALLSIRRANALPFSRISERMKLLVPLIMPAMDLILFAAKPSRTALMIGIPPATAASNW
                  10        20        30        40        50        60

                  70        80        90       100       110       120
m520.pep   TMTFCFSASGKISLPYSASSFLLAVTMCLPFSMAFNTASLAMPVPPNNSTTTSTSSRATS
           |||||||||||||||||||||||||||||||||||||||||||||||||| |||| ||:|
g520       TMTFCFSASGKISLPYSASSFLLAVTMCLPFSMAFNTASLAMPVPPNNSTKTSTSLRANS
                  70        80        90       100       110       120
```

-continued

```
                     130       140       150       160       170       180
m520.pep      SNGSLTKAARTGRFVGLFLHSNRTRQKYGFRAPSDGKFPPRCXATRQPYRRRPYPNLKDR
              ||||: |::| : | ||||: :|| ||||||||| |||| || |||||:||||| :||||
g520          SNGSFDKGGRRADFGGLFLRLSRTWQKYGFRAPSGGKFPLRCPATRQPHRRRPYLSLKDR
                     130       140       150       160       170       180

                     190
m520.pep      CLLASLCLLVSRLKCKY
              |||||||||||||||||
g520          CLLASLCLLVSRLKCKY
                     190
```

The following partial DNA sequence was identified in *N. meningitidis* <SEQ ID 1463>:

a520.seq

```
  1 ATGCCTGCGC TTCTTTCAGT ACATCGG.CA AACGCGCTGC CTTTTTCGCG
 51 CATTTCGGAG AGGATGAAGT TGCTGGTGCC GTTAATAATG CCGGCGATGG
101 ATTTAATCCT GTTTGCCGCC AAACCTTCGC GCAGGGCTTT GATGATTGGG
151 ATACCGCCCG CTACTGCCGC TTCAAATTGG ACGATGACGT TTTGTTTTTC
201 CGCCAGCGGG AAGATTTCGT TGCCGTATTC GGCGAGCAGT TTTTTGTTGG
251 CGGTAACGAT GTGTTTGCCG TTTTCAATGG CTTTCAACAC CGCATCTTTG
301 GCAATGCCGG TACCGCCGAA CAATTCGACG ACGACATCGA CGTCTTCACG
351 TGCGACCAGT TCGAACGGAT CTTTGACAAA GGCTG..CGG ACGGGCAGGT
401 TTGTCGGGCT TTTTCTTCAC TCAAATCGCA CACGGCAGAA ATACGGATTT
451 CGCGCCCCAA GCGACGGGAA ATTTCCTCCG CGTTGTCCCG CAACACGGCA
501 GCCGTACCGC CGCCGACCGT ACCCAAACCT AAAAGACCGA TGTTTACTGG
551 CTTCATTGTG TCTCCTTGTA AGCCGACTGA AATGTAAATA TTGA
```

This corresponds to the amino acid sequence <SEQ ID 1464; ORF 520.a>:

a520.pep

```
  1 MPALLSVHRX NALPFSRISE RMKLLVPLIM PAMDLILFAA KPSRRALMIG
 51 IPPATAASNW TMTFCFSASG KISLPYSASS FLLAVTMCLP FSMAFNTASL
101 AMPVPPNNST TTSTSSRATS SNGSLTKAXR TGRFVGLFLH SNRTRQKYGF
151 RAPSDGKFPP RCPATRQPYR RRPYPNLKDR CLLASLCLLV SRLKCKY*
```

m520/a520 98.0% identity in 197 aa overlap

```
                      10        20        30        40        50        60
m520.pep      MPALLSVHXANALPFSRISXRMKLLVPLIMPAMDLILFAAKPSRRALMIGIPPATAASNW
              ||||||||  ||||||||| ||||||||||||||||||||||||||||||||||||||||
a520          MPALLSVHRXNALPFSRISERMKLLVPLIMPAMDLILFAAKPSRRALMIGIPPATAASNW
                      10        20        30        40        50        60

                      70        80        90       100       110       120
m520.pep      TMTFCFSASGKISLPYSASSFLLAVTMCLPFSMAFNTASLAMPVPPNNSTTTSTSSRATS
              ||||||||||||||||||||||||||||||||||||||||||||||||||||||||||||
a520          TMTFCFSASGKISLPYSASSFLLAVTMCLPFSMAFNTASLAMPVPPNNSTTTSTSSRATS
                      70        80        90       100       110       120
```

-continued

```
                130       140       150       160       170       180
m520.pep  SNGSLTKAXRTGRFVGLFLHSNRTRQKYGFRAPSDGKFPPRCXATRQPYRRRPYPNLKDR
          |||||||||||||||||||||||||||||||||||||||||| ||||||||||||||||
a520      SNGSLTKAXRTGRFVGLFLHSNRTRQKYGFRAPSDGKFPPRCPATRQPYRRRPYPNLKDR
                130       140       150       160       170       180

                190
m520.pep  CLLASLCLLVSRLKCKYX
          ||||||||||||||||||
a520      CLLASLCLLVSRLKCKYX
                190
```

The following partial DNA sequence was identified in *N. gonorrhoeae* <SEQ ID 1465>:

g520-1.seq

```
  1 ATGAAGTTGC TGGTGCCGTT AATAATGCCG GCGATGGATT TAATCCTGTT
 51 TGCCGCCAAA CCTTCGCGCA GGGCTTTGAT GATTGGGATA CCGCCCGCTA
101 CTGCCGCTTC AAATTGGACG ATGACGTTTT GTTTTTCCGC CAGCGGGAAG
151 ATTTCGTTGC CGTATTCGGC GAGCAGTTTT TTGTTGGCGG TAACGATGTG
201 TTTGCCGTTT TCAATGGCTT TCAACACCGC TTCTTTGGCA ATGCCCGTGC
251 CGccgAACAA TTCGACGACG ACATCGACGT CTTTACGCGC GACCAGTtCG
301 AACGGATCTT TGACAAAGGC GGCGGACGGG CAGATTTGGC GGGCTTTTTC
351 TTCGCTTAAG TCGCACATGG CAGAAATACG GATTTCGCGC CCCAAGCGGC
401 GGGAAATTTC CTCTGCGTTG TCCCGCAACA CGGCAGCCGC ACCGCCGCCG
451 ACCgTACCTA AGCCTAAAAG ACCGATGTTT ACTGGCTTCA TTGTGTCTCC
501 TTGTAAGCCG ACTGAAATGT AA
```

This corresponds to the amino acid sequence <SEQ ID 1466; ORF 520-1.ng>:

g520-1.pep

```
  1 MKLLVPLIMP AMDLILFAAK PSRRALMIGI PPATAASNWT MTFCFSASGK
 51 ISLPYSASSF LLAVTMCLPF SMAFNTASLA MPVPPNNSTT TSTSLRATSS
101 NGSLTKAADG QIWRAFSSLK SHMAEIRISR PKRREISSAL SRNTAAAPPP
151 TVPKPKRPMF TGFIVSPCKP TEM*
```

The following partial DNA sequence was identified in *N. meningitidis* <SEQ ID 1467>:

m520-1.seq

```
  1 ATGAAGTTGC TGGTGCCGTT AATAATGCCG GCGATGGATT TAATCCTGTT
 51 TGCCGCCAAA CCTTCGCGCA GGGCTTTGAT GATTGGGATA CCGCCCGCTA
101 CTGCCGCTTC AAATTGGACG ATGACGTTTT GTTTTTCCGC CAGCGGGAAG
151 ATTTCGTTGC CGTATTCGGC GAGCAGTTTT TTGTTGGCGG TAACGATGTG
201 TTTGCCGTTT TCAATGGCTT TCAACACCGC ATCTTTGGCA ATGCCGGTAC
251 CGCCGAACAA TTCGACGACG ACATCGACGT CTTCACGTGC GACCAGTTCG
301 AACGGATCTT TGACAAAGGC TGCGGACGGG CAGGTTTGTC GGGCTTTTTC
```

-continued

```
351 TTCACTCAAA TCGCACACGG CAGAAATACG GATTTCGCGC CCCAAGCGAC

401 GGGAAATTTC CTCCGCGTTG TCCCGCAACA CGGCAGCCGT ACCGCCGCCG

451 ACCGTACCCA AACCTAAAAG ACCGATGTTT ACTGGCTTCA TTGTGTCTCC

501 TTGTAAGCCG ACTGAAATGT AA
```

This corresponds to the amino acid sequence <SEQ ID 1468; ORF 520-1>:

m520-1.pep

```
  1 MKLLVPLIMP AMDLILFAAK PSRRALMIGI PPATAASNWT MTFCFSASGK

 51 ISLPYSASSF LLAVTMCLPF SMAFNTASLA MPVPPNNSTT TSTSSRATSS

101 NGSLTKAADG QVCRAFSSLK SHTAEIRISR PKRREISSAL SRNTAAVPPP

151 TVPKPKRPMF TGFIVSPCKP TEM*
```

g520-1/m520-1 97.1% identity in 173 aa overlap

```
                    10        20        30        40        50        60
g520-1.pep  MKLLVPLIMPAMDLILFAAKPSRRALMIGIPPATAASNWTMTFCFSASGKISLPYSASSF
            ||||||||||||||||||||||||||||||||||||||||||||||||||||||||||||
m520-1      MKLLVPLIMPAMDLILFAAKPSRRALMIGIPPATAASNWTMTFCFSASGKISLPYSASSF
                    10        20        30        40        50        60

                    70        80        90       100       110       120
g520-1.pep  LLAVTMCLPFSMAFNTASLAMPVPPNNSTTTSTSLRATSSNGSLTKAADGQIWRAFSSLK
            |||||||||||||||||||||||||||||||||| ||||||||||||||||: |||||||
m520-1      LLAVTMCLPFSMAFNTASLAMPVPPNNSTTTSTSSRATSSNGSLTKAADGQVCRAFSSLK
                    70        80        90       100       110       120

                   130       140       150       160       170
g520-1.pep  SHMAEIRISRPKRREISSALSRNTAAAPPPTVPKPKRPMFTGFIVSPCKPTEMX
            || |||||||||||||||||||||||:|||||||||||||||||||||||||||
m520-1      SHTAEIRISRPKRREISSALSRNTAAVPPPTVPKPKRPMFTGFIVSPCKPTEMX
                   130       140       150       160       170
```

The following partial DNA sequence was identified in *N. meningitidis* <SEQ ID 1469>:

a520-1.seq

```
  1 ATGAAGTTGC TGGTGCCGTT AATAATGCCG GCGATGGATT TAATCCTGTT

 51 TGCCGCCAAA CCTTCGCGCA GGGCTTTGAT GATTGGGATA CCGCCCGCTA

101 CTGCCGCTTC AAATTGGACG ATGACGTTTT GTTTTTCCGC CAGCGGGAAG

151 ATTTCGTTGC CGTATTCGGC GAGCAGTTTT TTGTTGGCGG TAACGATGTG

201 TTTGCCGTTT TCAATGGCTT TCAACACCGC ATCTTTGGCA ATGCCGGTAC

251 CGCCGAACAA TTCGACGACG ACATCGACGT CTTCACGTGC GACCAGTTCG

301 AACGGATCTT TGACAAAGGC TGCGGACGGG CAGGTTTGTC GGGCTTTTTC

351 TTCACTCAAA TCGCACACGG CAGAAATACG GATTTCGCGC CCCAAGCGAC

401 GGGAAATTTC CTCCGCGTTG TCCCGCAACA CGGCAGCCGT ACCGCCGCCG

451 ACCGTACCCA AACCTAAAAG ACCGATGTTT ACTGGCTTCA TTGTGTCTCC

501 TTGTAAGCCG ACTGAAATGT AA
```

This corresponds to the amino acid sequence <SEQ ID 1470; ORF 520-1.a>:

a520-1.pep

```
  1 MKLLVPLIMP AMDLILFAAK PSRRALMIGI PPATAASNWT MTFCFSASGK

 51 ISLPYSASSF LLAVTMCLPF SMAFNTASLA MPVPPNNSTT TSTSSRATSS

101 NGSLTKAADG QVCRAFSSLK SHTAEIRISR PKRREISSAL SRNTAAVPPF

151 TVPKPKRPMF TGFIVSPCKP TEM*
```

m520-1/a520-1 100.0% identity in 173 aa overlap

```
                      10        20        30        40        50        60
g520-1.pep    MKLLVPLIMPAMDLILFAAKPSRRALMIGIPPATAASNWTMTFCFSASGKISLPYSASSF
              ||||||||||||||||||||||||||||||||||||||||||||||||||||||||||||
m520-1        MKLLVPLIMPAMDLILFAAKPSRRALMIGIPPATAASNWTMTFCFSASGKISLPYSASSF
                      10        20        30        40        50        60

                      70        80        90       100       110       120
g520-1.pep    LLAVTMCLPFSMAFNTASLAMPVPPNNSTTTSTSSRATSSNGSLTKAADGQVCRAFSSLK
              ||||||||||||||||||||||||||||||||||||||||||||||||||||||||||||
m520-1        LLAVTMCLPFSMAFNTASLAMPVPPNNSTTTSTSLRATSSNGSLTKAADGQIWRAFSSLK
                      70        80        90       100       110       120

                     130       140       150       160       170
g520-1.pep    SHTAEIRISRPKRREISSALSRNTAAVPPPTVPKPKRPMFTGFIVSPCKPTEMX
              ||||||||||||||||||||||||||||||||||||||||||||||||||||||
m520-1        SHTAEIRISRPKRREISSALSRNTAAVPPPTVPKPKRPMFTGFIVSPCKPTEMX
                     130       140       150       160       170
```

The following partial DNA sequence was identified in *N. gonorrhoeae* <SEQ ID 1471>:

g521.seq

```
  1 ATGAAATCAA AACTCCCCTT AATCCTAATC AACCTTTCCC TGATTTCAAG

 51 CCCATTGGGT GCGAATGCGG CCAAAATCTA TACCTGCACA ATCAACGGAG

101 AAACCGTTTA CACCACCAAG CCGTCTAAAA GCTGCCACTC AACCGATTTG

151 CCCCCAATCG GCAACTACAG CAGCGAACGC TATATCCTGC CCCAAACTCC

201 CGAACCGGCA CCATCACCGT CAAACGGCGG ACAGGCTGTC AAATATAAAG

251 CCCCGGTCAA AACAGTATCC AAGCCGGCAA AATCCAATAC GCCGCCTCAA

301 CAAGCACCTG TAAATAACAG CAGACGCTCC ATTCTcgaag caGaattaag

351 cAatgaacgc aaagccctGa ctGaAGCCCA AAAAATGTTA TCACAagcac

401 gtCtGGCAAA AGGCGgcaAC AtcaaCCatc aaaAaatcaa cgcattgtaa

451 AGCAATGTTt tggacAGACA GCAAAATaTC Caagcactgc aaaGAgAATt

501 GGGACGTATG TAA
```

This corresponds to the amino acid sequence <SEQ ID 1472; ORF 521.ng>:

g521n.pep

```
  1 MKSKLPLILI NLSLISSPLG ANAAKIYTCT INGETVYTTK PSKSCHSTDL

 51 PPIGNYSSER YILPQTPEPA PSPSNGGQAV KYKAPVKTVS KPAKSNTPPQ

101 QAPVNNSRRS ILEAELSNER KALTEAQKML SQARLAKGGN INHQKINAL*

151 SNVLDRQQNI QALQRELGRM *
```

The following partial DNA sequence was identified in *N. meningitidis* <SEQ ID 1473>:

m521.seq

```
  1 ATGAAATCAA AACTCCTCTT AATCCTAATC AACTTTTCCC TGATTTCAAG
 51 CCCATTGGGT GCGAATGCGG CCAAAATCTA sACCTGCACA ATCAACGGAG
101 AAACCGTTTA CACCAsCAAG CCGTCCAAAA GCTGCCACTC AACCGATTTG
151 CCCCCAATCG GCAACTACAG CAGCGAACGC TATATCCCGC CCCAAACGCC
201 CGAACCGGTA TCATCACCGT CAAACGGCGG ACwGGTTGTC AAATATAAAG
251 CCCCGGTCAA AACAGTATCC AAGCCGGCAA AATCCArTAC GCCGCCGCCG
301 CAACAAGCAC CCTCAAACAA CAGCAGACGC TCCATTCTCG AAACAGAATT
351 GAGCAACGAA CGCAAAGCAT TGGTTGAAGC CCAAAAAATG TTATCACAAG
401 CACGTCTGGC AAAGGGCGGC AACATCAACC ATCAAGAAAT AAATGCATTA
451 CAAAGCAATG TATTGGACAG GCAGCAAAAT ATTCAAGCCC TGCAAAGGGA
501 ACTGGGGCGT ATGTAA
```

This corresponds to the amino acid sequence <SEQ ID 1474; ORF 521>:

m521.pep

```
  1 MKSKLLLILI NFSLISSPLG ANAAKIXTCT INGETVYTXK PSKSCHSTDL
 51 PPIGNYSSER YIPPQTPEPV SSPSNGGXVV KYKAPVKTVS KPAKSXTPPP
101 QQAPSNNSRR SILETELSNE RKALVEAQKM LSQARLAKGG NINHQEINAL
151 QSNVLDRQQN IQALQRELGR M*
```

Computer analysis of this amino acid sequence gave the following results:

Homology with a predicted ORF from *N. gonorrhoeae*

ORF 521 shows 90.6% identity over a 171 aa overlap with a predicted ORF (ORF 521.ng) from *N. gonorrhoeae*:

```
m521/g521
                    10        20        30        40        50        60
m521.pep    MKSKLLLILINFSLISSPLGANAAKIXTCTINGETVYTXKPSKSCHSTDLPPIGNYSSER
            ||||| |||||:|||||||||||||| ||||||||||||:||||||||||||||||||||
g521        MKSKLPLILINLSLISSPLGANAAKIYTCTINGETVYTTKPSKSCHSTDLPPIGNYSSER
                    10        20        30        40        50        60

                    70        80        90       100       110       120
m521.pep    YIPPQTPEPVSSPSNGGXVVKYKAPVKTVSKPAKSXTPPPQQAPSNNSRRSILETELSNE
            || ||||||: |||||| :|||||||||||||||| ||| |||| |||||||||:|||||
g521        YILPQTPEPAPSPSNGGQAVKYKAPVKTVSKPAKSNTPP-QQAPVNNSRRSILEAELSNE
                    70        80        90        100       110

                   130       140       150       160       170
m521.pep    RKALVEAQKMLSQARLAKGGNINHQEINALQSNVLDRQQNIQALQRELGRMX
            ||||:||||||||||||||||||||:|||| |||||||||||||||||||||
g521        RKALTEAQKMLSQARLAKGGNINHQKINALXSNVLDRQQNIQALQRELGRMX
          120       130       140       150       160       170
```

The following partial DNA sequence was identified in *N. meningitidis* <SEQ ID 1475>:

a521.seq

```
  1 ATGAAATCAA AACTCCCCTT AATCCTAATC AACTTTTCCC TGATTTCAAG
```

-continued

```
 51 CCCATTGGGT GCGAATGCGG CCAAAATCTA CACCTGCACA ATCAACGGAG

101 AAACCGTTTA CACCACCAAG CCGTCCAAAA GCTGCCTCTC AACCGATTTC

151 CCCCCAATCG GCAACTACAG CAGCGAACGC TATATCCCGC CCCAAACATC

201 CGAACCGACA CCATCACCGT CAAACGGCGG ACAGGCTGTC AAATATAAAG

251 CCCCGGTCAA AACAGTATCC AAGCCGGCAA AATCCAATAC GCCGCCGCCG

301 CAACAAGCAC CCTCAAACAA CAGCACACGC TCCATTCTCG AAACAGAATT

351 GAGCAACGAA CGCAAAGCAT TGGTTGAAGC CCAAAAAATG TTATCACAAG

401 CACGTCTGGC AAAAGGCGGC AACATCAACC ATCAAGAAAT CAACGCATTG

451 CAAAGCAATG TATTGGACAG GCAGCAAAAT ATCCAAGCAC TGCAAAGAGA

501 ATTGGGACGT ATGTAA
```

This corresponds to the amino acid sequence <SEQ ID 1476; ORF 521.a>:

a521.pep

```
  1 MKSKLPLILI NFSLISSPLG ANAAKIYTCT INGETVYTTK PSKSCLSTDL

 51 PPIGNYSSER YIPPQTSEPT PSPSNGGQAV KYKAPVKTVS KPAKSNTPPP

101 QQAPSNNSRR SILETELSNE RKALVEAQKM LSQARLAKGG NINHQEINAL

151 QSVLDRQQN IQALQRELGR M*
```

m521/a521 94.2% identity in 171 aa overlap

```
                     10        20        30        40        50        60
m521.pep      MKSKLLLILINFSLISSPLGANAAKIXTCTINGETVYTXKPSKSCHSTDLPPIGNYSSER
              ||||| |||||||||||||||||||| |||||||||||:|||||| ||||||||||||||
a521          MKSKLPLILINFSLISSPLGANAAKIYTCTINGETVYTTKPSKSCLSTDLPPIGNYSSER
                     10        20        30        40        50        60

                     70        80        90       100       110       120
m521.pep      YIPPQTPEPVSSPSNGGXVVKYKAPVKTVSKPAKSXTPPPQQAPSNNSRRSILETELSNE
              |||||| ||: |||||| :|||||||||||||||| ||||||||||||||||||||||||
a521          YIPPQTSEPTPSPSNGGQAVKYKAPVKTVSKPAKSNTPPPQQAPVNNSRRSILETELSNE
                     70        80        90       100       110       120

                    130       140       150       160       170
m521.pep      RKALVEAQKMLSQARLAKGGNINHQEINALQSNVLDRQQNIQALQRELGRMX
              ||||||||||||||||||||||||||||||||||||||||||||||||||||
a521          RKALVEAQKMLSQARLAKGGNINHQEINALQSNVLDRQQNIQALQRELGRMX
                    130       140       150       160       170
```

The following partial DNA sequence was identified in *N. gonorrhoeae* <SEQ ID 1477>:

g522.seq

```
  1 atgactgagc cgaaacacga aacgccgacg gaagagcagg ttgccgcgcg

 51 caaaaaagca aaagccaaaa tccgcaccat ccgcatttgg gcgtgggtca

101 ttttggcgtt gctcgcttca accgccctgc tctcccaatg cgcgatgtcc

151 aaaccgcagg caaaacagaa aattgtcgag tcttgcatga aaaatattcc

201 gtttgctgaa aaatggcaga acgatttgaa agcgcgcggc ttggatgcgg

251 acaatacccg tctcgccgtc gactactgca aatgtatgtg ggagcagcct
```

-continued

```
301 ttggacggat tgagcgagaa acagatcagc tccttcggca aactcggtgc

351 acaagaacag cttgacctgc tcggcggcgc aaacgcgttt gaaactcgag

401 acaaacaatg tgtcgcggat ttgaaagccg attga
```

This corresponds to the amino acid sequence <SEQ ID 1478; ORF 522.ng>:

g522.pep

```
  1 MTEPKHETPT EEQVAARKKA KAKIRTIRIW AWVILALLAS TALLSQCAMS

 51 KPQAKQKIVE SCMKNIPFAE KWQNDLKARG LDADNTRLAV DYCKCMWEQP

101 LDGLSEKQIS SFGKLGAQEQ LDLLGGANAF ETRDKQCVAD LKAD*
```

The following partial DNA sequence was identified in *N. meningitidis* <SEQ ID 1479>:

m522.seq

```
  1 ATGACTGAGC CGAAACACGA AATGCTGACG AAAGAGCAGG TTGCCGCGCG

 51 CAAAAAAGCA AAAGCCAAAA TCCGCACCAT CCGCATTTGG GCGTGGGTCA

101 TTTTGGCGTT GCTCGCTTTA ACCGCCCTGC TCTCCCAATG CGCGATGTCC

151 AAACCGCAGG CAAAACAGAA AATTGTCGAG TCTTGCGTGA AGAATATTCC

201 GTTTGCCGAA AAATGGCAAA ACGATTTGCG GGCCCGCGGT TTAGATTCAA

251 ACAATACCCG CCTCGCCGTC GACTACTGCA AATGTATGTG GGAGCAGCCT

301 TTGGACAGAT TGAGCGAGAA ACAGATTAGA TCCTTCGGCA AACTCGGCGC

351 ACAAGAACAG CTTGACCTGC TCGGCGGCGC AAATGCCTTT GAAGCACGTG

401 ACAAGCAGTG TGTTGCCGAT TTGAAATCAG AATAA
```

This corresponds to the amino acid sequence <SEQ ID 1480; ORF 522>:

m522.pep

```
  1 MTEPKHEMLT KEQVAARKKA KAKIRTIRIW AWILALLAL TALLSQCAMS

 51 KPQAKQKIVE SCVKNIPFAE KWQNDLRARG LDSNNTRLAV DYCKCMWEQP

101 LDRLSEKQIR SFGKLGAQEQ LDLLGGANAF EARDKQCVAD LKSE*
```

Computer analysis of this amino acid sequence gave the following results:

Homology with a predicted ORF from *N. gonorrhoeae*

ORF 522 shows 91.0% identity over a 144 aa overlap with a predicted ORF (ORF 522.ng) from *N. gonorrhoeae*:

```
m522/g522
                     10        20        30        40        50        60
m522.pep    MTEPKHEMLTKEQVAARKKAKAKIRTIRIWAWVILALLALTALLSQCAMSKPQAKQKIVE
            |||||||  |:|||||||||||||||||||||||||||||| ||||||||||||||||||
g522        MTEPKHETPTEEQVAARKKAKAKIRTIRIWAWVILALSASTALLSQCAMSKPQAKQKIVE
                     10        20        30        40        50        60
```

-continued

```
                70        80        90       100       110       120
m522.pep  SCVKNIPFAEKWQNDLRARGLDSNNTRLAVDYCKCMWEQPLDRLSEKQIRSFGKLGAQEQ
          ||:|||||||||||||:|||||::||||||||||||||||| ||||||| ||||||||||
g522      SCMKNIPFAEKWQNDLKARGLDADNTRLAVDYCKCMWEQPLDGLSEKQISSFGKLGAQEQ
                70        80        90       100       110       120

               130       140
m522.pep  LDLLGGANAFEARDKQCVADLKSEX
          |||||||||||:||||||||||::
g522      LDLLGGANAFETRDKQCVADLKAD
               130       140
```

The following partial DNA sequence was identified in *N. meningitidis* <SEQ ID 1481>:

a522.seq

```
  1 ATGACTGAGC CGAAACACGA AATGCCGACG GAAGAGCAGG TTGCCGCGCG
 51 CAAAAAAGCA AAAGCCAAAA TCCGCACCAT CCGCATTTGG GCATGGGTCA
101 TTTTGGCGTT GCTCGCTTCA ACCGCCCTGC TCTCCCAATG CGCGATGTCC
151 AAACCGCAGG CAAAACAGAA AATTGTCGAG TCTTGCGTGA AGAATATTCC
201 GTTTGCCGAA AAATGGCAAA ACGATTTGCG GGCCCGCGGT TTAGATTCAA
251 ACAATACCCG CCTTACCGTC GACTACTGCA AATGTATGTG GGAGCAGCCT
301 TTGGACAGAT TGAGCGAGAA ACAGATTAGT TCCTTCGGCA AACTCGGCGC
351 ACAAGAACAG CTTGACCTGC TCGGCGGCGC AAATGCCTTT GAAACGCGAG
401 ACAAGCAGTG TGTTGCCGAT TTGAAATCAG AATAA
```

This corresponds to the amino acid sequence <SEQ ID 1482; ORF 522.a>:

a522.pep

```
  1 MTEPKHEMPT EEQVAARKKA KAKIRTIRIW AWVILALLAS TALLSQCAMS
 51 KPQAKQKIVE SCVKNIPFAE KWQNDLRARG LDSNNTRLTV DYCKCMWEQP
101 LDRLSEKQIS SFGKLGAQEQ LDLLGGANAF ETRDKQCVAD LKSE*
```

m522/a522 95.8% identity in 144 aa overlap

```
                 10        20        30        40        50        60
m522.pep  MTEPKHEMLTKEQVAARKKAKAKIRTIRIWAWVILALLALTALLSQCAMSKPQAKQKIVE
          |||||||| |:|||||||||||||||||||||||||||| ||||||||||||||||||||
a522      MTEPKHEMPTEEQVAARKKAKAKIRTIRIWAWVILALLASTALLSQCAMSKPQAKQKIVE
                 10        20        30        40        50        60
                70        80        90       100       110       120
m522.pep  SCVKNIPFAEKWQNDLRARGLDSNNTRLAVDYCKCMWEQPLDRLSEKQIRSFGKLGAQEQ
          ||||||||||||||||||||||||||||:|||||||||||||||||||| ||||||||||
a522      SCVKNIPFAEKWQNDLRARGLDSNNTRLTVDYCKCMWEQPLDRLSEKQISSFGKLGAQEQ
                70        80        90       100       110       120
               130       140
m522.pep  LDLLGGANAFEARDKQCVADLKSEX
          |||||||||||:|||||||||||||
a522      LDLLGGANAFETRDKQCVADLKSEX
               130       140
```

The following partial DNA sequence was identified in *N. gonorrhoeae* <SEQ ID 1483>:

g523.seq

```
  1 atgactgtat ggtttgttgc cgctgttgcc gtcttaatca tcgaattatt
 51 gacgggaacg gtttatcttt tggttgtcag cgcggctttg gcgggttcgg
101 gcattgccta cgggctgact ggcagcacgc ctgccgccgt cttgaccgcc
151 gcactgcttt ccgcgctggg catttggttc gtacatgcca aaaccgccgt
201 gggaaaagtt gaaacggatt catatcagga tttggatacc ggaaaatatg
251 ccgaaatcct ccgatacaca ggcggcaacc gttacgaagt tttttatcgc
301 ggtacgcact ggcaggcgca aaatacgggg caggaagtgt ttgaaccggg
351 aacgcgcgcc ctcatcgtcc gcaaagaagg taaccttctt atcatcgcaa
401 acccttaa
```

This corresponds to the amino acid sequence <SEQ ID 1484; ORF 523.ng>:

g523.pep

```
  1 MTVWFVAAVA VLIIELLTGT VYLLVVSAAL AGSGIAYGLT GSTPAAVLTA
 51 ALLSALGIWF VHAKTAVGKV ETDSYQDLDT GKYAEILRYT GGNRYEVFYR
101 GTHWQAQNTG QEVFEPGTRA LIVRKEGNLL IIANP*
```

The following partial DNA sequence was identified in *N. meningitidis* <SEQ ID 1485>:

m523.seq (partial)

```
  1 ..GCCGTCTTAA TCATCGAATT ATTGACGGGA ACGGTTTATC TTTTGGTTGT
 51   nAGCGCGGCT TTGGCGGGTT CGGGCATTGC TTACGGGCTG ACCGGCAGTA
101   CGCCTGCCGC CGTCTTGACC GnCGCTCTGC TTTCCGCGCT GGGTATTTnG
151   TTCGTACACG CCAAAACCGC CGTTAGAAAA GTTGAAACGG ATTCATATCA
201   GGATTTGGAT GCCGGACAAT ATGTCGAAAT CCTCCGACAC ACAGGCGGCA
251   ACCGTTACGA AGTTTTtTAT CGCGGTACGc ACTGGCAGGC TCAAAATACG
301   GGGCAAGAAG AGCTTGAACC AGGAACTCGC GCCCTCATTG TCCGCAAGGA
351   AGGCAACCTT CTTATTATCA CACACCCTTAA
```

This corresponds to the amino acid sequence <SEQ ID 1486; ORF 523>:

m523.pep (partial)

```
  1 ..AVLIIELLTG TVYLLVVSAA LAGSGIAYGL TGSTPAAVLT XALLSALGIX
 51   FVHAKTAVRK VETDSYQDLD AGQYVEILRH TGGNRYEVFY RGTHWQAQNT
101   GQEELEPGTR ALIVRKEGNL LIITHP*
```

Computer analysis of this amino acid sequence gave the following results:

Homology with a predicted ORF from *N. gonorrhoeae*

ORF523 shows 91.3% identity over a 126 aa overlap with a predicted ORF (ORF 523.ng) from *N. gonorrhoeae*:

```
m523/g523

                           10         20         30         40         50
m523.pep           AVLIIELLTGTVYLLVVSAALAGSGIAYGLTGSTPAAVLTXALLSALGIXF
                   |||||||||||||||||||||||||||||||||||||||| |||||||| |
g523      MTVWFVAAVAVLIIELLTGTVYLLVVSAALAGSGIAYGLTGSTPAAVLTAALLSALGIWF
                  10         20         30         40         50         60

                 60         70         80         90        100        110
m523.pep  VHAKTAVRKVETDSYQDLDAGQYVEILRHTGGNRYEVFYRGTHWQAQNTGQEELEPGTRA
          ||||||| |||||||||||:|:|:||||:||||||||||||||||||||||| :||||||
g523      VHAKTAVGKVETDSYQDLDTGKYAEILRYTGGNRYEVFYRGTHWQAQNTGQEVFEPGTRA
                  70         80         90        100        110        120

                120
m523.pep  LIVRKEGNLLIITHP
          ||||||||||||::|
g523      LIVRKEGNLLIIANPX
                 130
```

The following partial DNA sequence was identified in *N. meningitidis* <SEQ ID 1487>:

a523.seq

```
  1 ATGACTGTAT GGTTTGTTGC CGCTGTTGCC GTCTTAATCA TCGAATTATT
 51 GACGGGAACG GTTTATCTTT TGGTTGTCAG CGCGGCTTTG GCGGGTTCGG
101 GCATTGCTTA CGGGCTGACC GGCAGCACGC CTGCCGCCGT CTTGACCGCC
151 GCTCTGCTTT CCGCGCTGGG TATTTGGTTC GTACACGCCA AAACCGCCGT
201 GGGAAAAGTT GAAACGGATT CATATCAGGA TTTGGATGCC GGGCAATATG
251 CCGAAATCCT CCGGCACGCA GGCGGCAACC GTTACGAAGT TTTTTATCGC
301 GGTACGCACT GGCAGGCTCA AAATACGGGG CAAGAAGAGC TTGAACCAGG
351 AACGCGCGCC CTAATCGTCC GCAAGGAAGG CAACCTTCTT ATCATCGCAA
401 AACCTTAA
```

This corresponds to the amino acid sequence <SEQ ID 1488; ORF 523.a>:

a523.pep

```
  1 MTVWFVAAVA VLIIELLTGT VYLLVVSAAL AGSGIAYGLT GSTPAAVLTA
 51 ALLSALGIWF VHAKTAVGKV ETDSYQDLDA GQYAEILRHA GGNRYEVFYR
101 GTHWQAQNTG QEELEPGTRA LIVRKEGNLL IIAKP*
```

m523/a523 94.4% identity in 126 aa overlap

```
                           10         20         30         40         50
m523.pep           AVLIIELLTGTVYLLVVSAALAGSGIAYGLTGSTPAAVLTXALLSALGIXF
                   |||||||||||||||||||||||||||||||||||||||| |||||||| |
a523      MTVWFVAAVAVLIIELLTGTVYLLVVSAALAGSGIAYGLTGSTPAAVLTAALLSALGIWF
                  10         20         30         40         50         60

                 60         70         80         90        100        110
m523.pep  VHAKTAVRKVETDSYQDLDAGQYVEILRHTGGNRYEVFYRGTHWQAQNTGQEELEPGTRA
          ||||||| |||||||||||||||:|||||:||||||||||||||||||||||||||||||
a523      VHAKTAVGKVETDSYQDLDAGQYAEILRHAGGNRYEVFYRGTHWQAQNTGQEELEPGTRA
                  70         80         90        100        110        120

                120
m523.pep  LIVRKEGNLLIITHPX
          ||||||||||||::||
a523      LIVRKEGNLLIIAKPX
                 130
```

The following partial DNA sequence was identified in *N. gonorrhoeae* <SEQ ID 1489>:

g525.seq

```
  1 atgaagtacg tccggttatt tttcctcggc acggcactcg ccggcactca
 51 agcggcggct gccgaaatgg ttcaaatcga aggcggcagc taccgcccgc
101 tttatctgaa aaaagatacc ggcctgatta aagtcaaacc gttcaaactg
151 gataaatatc ccgttaccaa tgccgagttt gccgaatttg tcaacagcca
201 cccccaatgg caaaaaggca ggatcggttc caaacaggca gaacccgctt
251 acctgaagca ttggatgaaa aacggcagcc gcagctatgc gccgaaggcg
301 ggcgaattga aacagccggt taccaatatt tcctggtttg ccgccaacgc
351 ctattgcgcc gcacaaggca aacgcctgcc gaccatcgac gaatgggaat
401 ttgccggact tgcttccgcc acgcagaaaa aacggctcaa acgaacccgg
451 ctacaaccgc actattctcg attggtatgc cgacggcgga cggaaaggcc
501 tgcacgatgt cggcaaagca ccgcccgaac tactggggtg tttatgatat
551 gcacgggctg a
```

This corresponds to the amino acid sequence <SEQ ID 1490; ORF 525.ng>:

g525.pep

```
  1 MKYVRLFFLG TALAGTQAAA AEMVQIEGGS YRPLYLKKDT GLIKVKPFKL
 51 DKYPVTNAEF AEFVNSHPQW QKGRIGSKQA EPAYLKHWMK NGSRSYAPKA
101 GELKQPVTNI SWFAANAYCA AQGKRLPTID EWEFAGLASA TQKKRLKRTR
151 LQPHYSRLVC RRRTERPARC RQSTARTTGV FMICTG *
```

The following partial DNA sequence was identified in *N. meningitidis* <SEQ ID 1491>:

m525.seq

```
  1 ATGAAGTATG TCCGGTTATT TTwCCTCGGC GCGGCACTCG cCrrCACTCA
 51 ArCGGCGGCT GcCGAAATGG TTCAAATCGA AGGCGGCAgC TACCGCCCrC
101 TTTATCTGAA AAAAGATACC GGCCTGATTA AAGTCAAACC GTTCAAACTG
151 GATAAATATC CCGTTACCAA TGCCGAGTTT GCCGAATTTG TCAACAGCCA
201 CCCCCAATGG CAAAAAGGCA GGATCGGTTC CAAACAGGCA GAACCCGCTT
251 ACCTGAAGCA TTGGATGAAA AACGGCAGCC GCAGCTATGc GCCGAAGgCG
301 GgCGAATTAA AACAACCGGT AACCAATGTT TCCTGGwTTG CCGCCAAcGC
351 CTAtTGCGCC GCACAAGGCA AACGCCTGCC GACCATTGAC GAATGGGAAT
401 TTGCCGGACT TGCTTCCGCC ACGCAGAAAA A.CGGCTCAA ACGAACCCGG
451 CTACAACCGC ACTATTCTCG ATTGGTATGC CGACGGCGGA CGGAAAGGCC
501 TGCACGATGT CGGCA.AAGG CCGCCCGAAC TACTGGGGCG TTTATGATAT
551 GCACGGGCTG A
```

This corresponds to the amino acid sequence <SEQ ID 1492; ORF 525>:

m525.pep

```
  1 MKYVRLFXLG AALAXTQXAA AEMVQIEGGS YRPLYLKKDT GLIKVKPFKL
 51 DKYPVTNAEF AEFVNSKPQW QKGRIGSKQA EPAYLKHWMK NGSRSYAPKA
101 GELKQPVTNV SWXAANAYCA AQGKRLPTID EWEFAGLASA TQKXRLKRTR
151 LQPHYSRLVC RRRTERPARC RXKAARTTGA FMICTG*
```

Computer analysis of this amino acid sequence gave the following results:

Homology with a predicted ORF from *N. gonorrhoeae*

ORF 525 shows 94.1% identity over a 186 aa overlap with a predicted ORF (ORF 525.ng) from *N. gonorrhoeae*:

```
m525/g525
                    10        20        30        40        50        60
m523.pep    MKYVRLFXLGAALAXTQXAAAEMVQIEGGSTRPLYLKKDTGLIKVKPFKLDKYPVTNAEF
            ||||||| ||:||| |||||||||||||||||||||||||||||||||||||||||||||
g525        MKYVRLFFLGTALAATQXAAAEMVQIEGGSTRPLYLKKDTGLIKVKPFKLDKYPVTNAEF
                    10        20        30        40        50        60

                    70        80        90       100       110       120
m523.pep    AEFVNSHPQWQKGRIGSKQAEPAYLKHWMKNGSRSYAPKAGELKQPVTNVSWXAANAYCA
            |||||||||||||||||||||||||||||||||||||||||||||||||:|| |||||||
g525        AEFVNSHPQWQKGRIGSKQAEPAYLKHWMKNGSRSYAPKAGELKQPVTNISWFAANAYCA
                    70        80        90       100       110       120

                   130       140       150       160       170       180
m523.pep    AQGKRLPTIDEWEFAGLASATQKXRLKRTRLQPHYSRLVCRRRTERPARCRXKAARTTGA
            ||||||||||||||||||||||| ||||||||||||||||||||||||||| ::|||||:
g525        AQGKRLPTIDEWEFAGLASATQKKRLKRTRLQPHYSRLVCRRRTERPARCRQSTARTTGV
                   130       140       150       160       170       180

m523.pep    FMICTGX
            |||||||
g525        FMICTGX
```

The following partial DNA sequence was identified in *N. meningitidis* <SEQ ID 1493>:

a525.seq

```
  1 ATGAAGTTTA CCCGGTTACT CTTTCTCTGT GCGGCACTCG CCGGCACTCA
 51 AGCGGCAGCT GCCGAAATGG TTCAAATCGA AGGCGGCAGC TACCGCCCGC
101 TTTATCTGAA AAAAGATACC GGCCTGATTA AAGTCAAACC GTTCAAACTG
151 GATAAATATC CCGTTACCAA TGCCGAGTTT GCCGAATTTG TCAACAGCCA
201 CCCCCAATGG CAAAAAGGCA GGATCGGTTC CAAACAGGCA GAACCCGCTT
251 ACCTGAAGCA TTGGATGAAA AACGGCAGCC GCAGCTATGC GCCGAAGGCG
301 GGCGATTTAA AACAACCGGT AACCAATGTT TCCTGGTTCG CCGCCAACGC
351 CTATTGCGCC GCACAAGGCA AACGCCTGCC GACCATTGAC GAATGGGAAT
401 TTGCCGGACT TGCCTCCGCC ACGCAG.AAA AACGGCTCAA ACGAACCCGG
451 CTACAACCGC ACTATTCTCG ACTGGTATGC GGATGGCGAC CGGAAAGACC
501 TGCACGATGT CGGCAAAG.G TCGCCCGAAC TACTGGGGCG TTTATGATAT
551 GCACGGTCTG A
```

This corresponds to the amino acid sequence <SEQ ID 1494; ORF 525.a>:

a525.pep

```
  1 MKFTRLLFLC AALAGTQAAA AEMVQIEGGS YRPLYLKKDT GLIKVKPFKL

 51 DKYPVTNAEF AEFVNSHPQW QKGRIGSKQA EPAYLKHWMK NGSRSYAPKA

101 GDLKQPVTNV SWFAANAYCA AQGKRLPTID EWEFAGLASA TQXKRLKRTR

151 LQPHYSRLVC GWRPERPARC RQXVARTTGA FMICTV*
```

m525/a525 90.8% identity in 185 aa overlap

```
                    10        20        30        40        50        60
m525.pep    MKYVRLFXLGAALAXTQXAAAEMVQIEGGSYRPLYLKKDTGLIKVKPFKLDKYPVTNAEF
            ||::||: | |||| || ||||||||||||||||||||||||||||||||||||||||||
a525        MKFTRLLFLCAALAGTQAAAAEMVQIEGGSYRPLYLKKDTGLIKVKPFKLDKYPVTNAEF
                    10        20        30        40        50        60

                    70        80        90       100       110       120
m525.pep    AEFVNSHPQWQKGRIGSKQAEPAYLKHWMKNGSRSYAPKAGELKQPVTNVSWXAANAYCA
            ||||||||||||||||||||||||||||||||||||||||||:|||||||||| ||||||
a525        AEFVNSHPQWQKGRIGSKQAEPAYLKHWMKNGSRSYAPKAGDLKQPVTNVSWFAANAYCA
                    70        80        90       100       110       120

                   130       140       150       160       170       180
m525.pep    AQGKRLPTIDEWEFAGLASATQKXRLKRTRLQPHYSRLVCRRRTERPARCRXKAARTTGA
            ||||||||||||||||||||||  ||||||||||||||||  | |||||||  :||||||
a525        AQGKRLPTIDEWEFAGLASATQXKRLKRTRLQPHYSRLVCGWRPERPARCRQXVARTTGA
                   130       140       150       160       170       180

m525.pep    FMICTGX
            |||||
a525        FMICTVX
```

The following partial DNA sequence was identified in *N. gonorrhoeae* <SEQ ID 1495>:

g525-1.seq

```
  1 ATGAAGTACG TCCGGTTATT TTTCCTCGGC ACGGCACTCG CCGGCACTCA

 51 AGCGGCGGCT GCCGAAATGG TTCAAATCGA AGGCGGCAGC TACCGCCCGC

101 TTTATCTGAA AAAAGATACC GGCCTGATTA AAGTCAAACC GTTCAAACTG

151 GATAAATATC CCGTTACCAA TGCCGAGTTT GCCGAATTTG TCAACAGCCA

201 CCCCCAATGG CAAAAAGGCA GGATCGGTTC CAAACAGGCA GAACCCGCTT

251 ACCTGAAGCA TTGGATGAAA AACGGCAGCC GCAGCTATGC GCCGAAGGCG

301 GGCGAATTGA AACAGCCGGT TACCAATATT TCCTGGTTTG CCGCCAACGC

351 CTATTGCGCC GCACAAGGCA AACGCCTGCC GACCATCGAC GAATGGGAAT

401 TTGCCGGACT TGCTTCCGCC ACGCAGAAAA ACGGCTCAAA CGAACCCGGC

451 TACAACCGCA CTATTCTCGA TTGGTATGCC GACGGCGGAC GGAAAGGCCT

501 GCACGATGTC GGCAAAGACC GCCCGAACTA CTGGGGTGTT TATGATATGC

551 ACGGGCTGAT TTGGGAATGG ACGGAAGATT TCAACAGCAG CCTGCTTTCT

601 TCCGGCAATG CCAACGCGCA AATGTTTTGC AGCGGCGCAT CTGTCGGGGC

651 GAGCGACTCG TCCAACTATG CCGCCTTCCT CCGCTACGGC ATCCGCACCA

701 GCCTGCAATC CAAATACGTC CTGCACAACT TGGGCTTCCG CTGCGCAAGC

751 CGATAA
```

This corresponds to the amino acid sequence <SEQ ID 1496; ORF 525-1.ng>:

g525-1.pep

```
  1 MKYVRLFFLG TALAGTQAAA AEMVQIEGGS YRPLYLKKDT GLIKVKPFKL
 51 DKYPVTNAEF AEFVNSHPQW QKGRIGSKQA EPAYLKHWMK NGSRSYAPKA
101 GELKQPVTNI SWFAANAYCA AQGKRLPTID EWEFAGLASA TQKNGSNEPG
151 YNRTILDWYA DGGRKGLHDV GKDRPNYWGV YDMHGLIWEW TEDFNSSLLS
201 SGNANAQMFC SGASVGASDS SNYAAFLRYG IRTSLQSKYV LHNLGFRCAS
251 R*
```

The following partial DNA sequence was identified in *N. meningitidis* <SEQ ID 1497>:

m525-1.seq

```
  1 ATGAAGTATG TCCGGTTATT TTTCCTCGGC GCGGCACTCG CCGGCACTCA
 51 AGCGGCGGCT GCCGAAATGG TTCAAATCGA AGGCGGCAGC TACCGCCCGC
101 TTTATCTGAA AAAAGATACC GGCCTGATTA AAGTCAAACC GTTCAAACTG
151 GATAAATATC CCGTTACCAA TGCCGAGTTT GCCGAATTTG TCAACAGCCA
201 CCCCCAATGG CAAAAAGGCA GGATCGGTTC CAAACAGGCA GAACCCGCTT
251 ACCTGAAGCA TTGGATGAAA AACGGCAGCC GCAGCTATGC GCCGAAGGCG
301 GGCGAATTAA AACAACCGGT AACCAATGTT TCCTGGTTTG CCGCCAACGC
351 CTATTGCGCC GCACAAGGCA AACGCCTGCC GACCATTGAC GAATGGGAAT
401 TTGCCGGACT TGCTTCCGCC ACGCAGAAAA ACGGCTCAAA CGAACCCGGC
451 TACAACCGCA CTATTCTCGA TTGGTATGCC GACGGCGGAC GGAAAGGCCT
501 GCACGATGTC GGCAAAGGCC GCCCGAACTA CTGGGGCGTT TATGATATGC
551 ACGGGCTGAT TTGGGAATGG ACGGAAGATT TCAACAGCAG CCTGCTTTCT
601 TCCGGCAATG CCAACGCGCA AATGTTTTGC AGCGGCGCGT CTATCGGGTC
651 GAGCGACTCG TCCAACTATG CCGCCTTCCT CCGCTACGGC ATCCGTACCA
701 GCCTGCAATC CAAATATGTC TTGCACAACT TGGGCTTCCG TTGCACAAGC
751 CGATAA
```

This corresponds to the amino acid sequence <SEQ ID 1498; ORF 525-1>:

m525-1.pep

```
  1 MKYVRLFFLG AALAGTQAAA AEMVQIEGGS YRPLYLKKDT GLIKVKPFKL
 51 DKYPVTNAEF AEFVNSHPQW QKGRIGSKQA EPAYLKHWMK NGSRSYAPKA
101 GELKQPVTNV SWFAANAYCA AQGKRLPTID EWEFAGLASA TQKNGSNEPG
151 YNRTILDWYA DGGRKGLHDV GKGRPNYWGV YDMHGLIWEW TEDFNSSLLS
201 SGNANAQMFC SGASIGSSDS SNYAAFLRYG IRTSLQSKYV LHNLGFRCTS
251 R*
```

m525-1/g525-1 97.6% identity in 251 aa overlap

```
                             10        20        30        40        50        60
m525-1.pep           MKYVRLFFLGAALAGTQAAAAEMVQIEGGSYRPLYLKKDTGLIKVKPFKLDKYPVTNAEF
                     ||||||||||:|||||||||||||||||||||||||||||||||||||||||||||||||
g525-1               MKYVRLFFLGTALAGTQAAAAEMVQIEGGSYRPLYLKKDTGLIKVKPFKLDKYPVTNAEF
                             10        20        30        40        50        60

                             70        80        90       100       110       120
m525-1.pep           AEFVNSHPQWQKGRIGSKQAEPAYLKHWMKNGSRSYAPKAGELKQPVTNVSWFAANAYCA
                     |||||||||||||||||||||||||||||||||||||||||||||||||:||||||||||
g525-1               AEFVNSHPQWQKGRIGSKQAEPAYLKHWMKNGSRSYAPKAGELKQPVTNISWFAANAYCA
                             70        80        90       100       110       120

                            130       140       150       160       170       180
m525-1.pep           AQGKRLPTIDEWEFAGLASATQKNGSNEPGYNRTILDWYADGGRKGLHDVGKGRPNYWGV
                     |||||||||||||||||||||||||||||||||||||||||||||||||||| |||||||
g525-1               AQGKRLPTIDEWEFAGLASATQKNGSNEPGYNRTILDWYADGGRKGLHDVGKDRPNYWGV
                            130       140       150       160       170       180

                            190       200       210       220       230       240
m525-1.pep           YDMHGLIWEWTEDFNSSLLSSGNANAQMFCSGASIGSSDSSNYAAFLRYGIRTSLQSKYV
                     ||||||||||||||||||||||||||||||||||:|:|||||||||||||||||||||||
g525-1               YDMHGLIWEWTEDFNSSLLSSGNANAQMFCSGASVGASDSSNYAAFLRYGIRTSLQSKYV
                            190       200       210       220       230       240

                            250
m525-1.pep           LHNLGFRCTSRX
                     ||||||||:|||
g525-1               LHNLGFRCASRX
                            250
```

The following partial DNA sequence was identified in *N. meningitidis* <SEQ ID 1499>:

a525-1.seq

```
  1 ATGAAGTTTA CCCGGTTACT CTTTCTCTGT GCGGCACTCG CCGGCACTCA
 51 AGCGGCAGCT GCCGAAATGG TTCAAATCGA AGGCGGCAGC TACCGCCCGC
101 TTTATCTGAA AAAAGATACC GGCCTGATTA AAGTCAAACC GTTCAAACTG
151 GATAAATATC CCGTTACCAA TGCCGAGTTT GCCGAATTTG TCAACAGCCA
201 CCCCCAATGG CAAAAAGGCA GGATCGGTTC CAAACAGGCA GAACCCGCTT
251 ACCTGAAGCA TTGGATGAAA AACGGCAGCC GCAGCTATGC GCCGAAGGCG
301 GGCGATTTAA AACAACCGGT AACCAATGTT TCCTGGTTCG CCGCCAACGC
351 CTATTGCGCC GCACAAGGCA AACGCCTGCC GACCATTGAC GAATGGGAAT
401 TTGCCGGACT TGCCTCCGCC ACGCAGAAAA ACGGCTCAAA CGAACCCGGC
451 TACAACCGCA CTATTCTCGA CTGGTATGCG GATGGCGACC GGAAAGACCT
501 GCACGATGTC GGCAAAGGTC GCCCGAACTA CTGGGGCGTT TATGATATGC
551 ACGGTCTGAT TTGGGAATGG ACGGAAGATT TCAACAGCAG CCTGCTTTCT
601 TCCGGCAATG CCAACGCGCA AATGTTTTGC AGCGGCGCGT CTATCGGGTC
651 GAGCGACTCG TCCAACTATG CCGCCTTCCT CCGCTACGGC ATCCGCACCA
701 GCCTGCAATC CAAATATGTC TTGCACAACT TGGGCTTCCG TTGCACAAGC
751 CGATAA
```

This corresponds to the amino acid sequence <SEQ ID 1500; ORF 525-1.a>:

a525-1.pep

```
  1 MKFTRLLFLC AALAGTQAAA AEMVQIEGGS YRPLYLKKDT GLIKVKPFKL
 51 DKYPVTNAEF AEFVNSHPQW QKGRIGSKQA EPAYLKHWMK NGSRSYAPKA
101 GDLKQPVTNV SWFAANAYCA AQGKRLPTID EWEFAGLASA TQKNGSNEPG
```

-continued

```
151 YNRTILDWYA DGDRKDLHDV GKGRPNYWGV YDMHGLIWEW TEDFNSSLLS

201 SGNANAQMFC SGASIGSSDS SNYAAFLRYG IRTSLQSKYV LHNLGFRCTS

251 R*
```

m525-1/a525-1 97.2% identity in 251 aa overlap

```
                    10        20        30        40        50        60
m525-1.pep  MKYVRLFFLGAALAGTQAAAAEMVQIEGGSYRPLYLKKDTGLIKVKPFKLDKYPVTNAEF
            ||::||:|| ||||||||||||||||||||||||||||||||||||||||||||||||||
a525-1      MKFTRLLFLCAALAGTQAAAAEMVQIEGGSYRPLYLKKDTGLIKVKPFKLDKYPVTNAEF
                    10        20        30        40        50        60

                    70        80        90       100       110       120
m525-1.pep  AEFVNSHPQWQKGRIGSKQAEPAYLKHWMKNGSRSYAPKAGELKQPVTNVSWXAANAYCA
            ||||||||||||||||||||||||||||||||||||||||:|||||||||||||||||||
a525-1      AEFVNSHPQWQKGRIGSKQAEPAYLKHWMKNGSRSYAPKAGDLKQPVTNVSWXAANAYCA
                    70        80        90       100       110       120

                   130       140       150       160       170       180
m525-1.pep  AQGKRLPTIDEWEFAGLASATQKNGSNEPGYNRTILDWYADGGRKGLHDVGKGRPNYWGV
            |||||||||||||||||||||||||||||||||||||||||| || ||||||||||||||
a525-1      AQGKRLPTIDEWEFAGLASATQKNGSNEPGYNRTILDWYADGDRKDLHDVGKGRPNYWGV
                   130       140       150       160       170       180

                   190       200       210       220       230       240
m525-1.pep  YDMHGLIWEWTEDFNSSLLSSGNANAQMFCSGASIGSSDSSNYAAFLRYGIRTSLQSKYV
            ||||||||||||||||||||||||||||||||||||||||||||||||||||||||||||
a525-1      YDMHGLIWEWTEDFNSSLLSSGNANAQMFCSGASIGSSDSSNYAAFLRYGIRTSLQSKYV
                   190       200       210       220       230       240

                   250
m525-1.pep  LHNLGFRCTSRX
            ||||||||||||
a525-1      LHNLGFRCTSRX
                   250
```

The following partial DNA sequence was identified in *N. gonorrhoeae* <SEQ ID 1501>:

g527.seq

```
  1 atggttttac cagtctcctt ttttcagcct gtccagttgg cggcggtcgc

 51 gcttggtcgg tctgccgtcg ggatgggcgg aagtgatgcg gctgaattgg

101 tcgagctgtt tgcactcttc cctcaatgct gccgttttcg cgtcttcttc

151 atacagaagc cgcgcctcgg gtgccgggcg gcgttggtgg ttcaaacctt

201 taaccttgat tttatgggga agggaattga gcgtcaggtc gataatatcg

251 ccgatgtcta tggttttact gtttttgact ttcgagccgt ttacttgaac

301 cctacccagt tcgatatgct tttgcgcaag ggaacgggtc ttgaaaaaac

351 gtgccgccca aagccatttg tccagccgca tggcggaaga atcgtgcttg

401 tctttcatac gattttgttt gaaataattg aatttgtttc gagtttagca

451 taa
```

This corresponds to the amino acid sequence <SEQ ID 1502; ORF 527.ng>:

g527.pep

```
  1 MVLPVSFFQP VQLAAVALGR SAVGMGGSDA AELVELFALF PQCCRFRVFF

 51 IQKPRLGCRA ALVVQTFNLD FMGKGIERQV DNIADVYGFT VFDFRAVYLN
```

-continued

```
101 PTQFDMLLRK GTGLEKTCRP KPFVQPHGGR IVLVFHTILF EIIEFVSSLA

151 *
```

The following partial DNA sequence was identified in *N. meningitidis* <SEQ ID 1503>:

m527.seq

```
  1 ATGGTTTTAC CAGTCTCCTT TTTTCAGCCT GTCCAGTTGG CGGCGGTCGC

 51 GCTTGGTCGG TCTGCCGTCG GGATAGGCGG AAGTGATGCG GCTGAATTGG

101 TCGAGCTGTT TGCGCTCTTC CCTCAATGTT GCCGTTwTCG CGTCCTCTTC

151 ATACAGAAGC CGCGCyTCGG ATGCCGGGCG GCGTTGGTGG TTCAAACCTT

201 TAACCkTGAT TTTATAGGGA AGGG.AATTk AgCkTCaGTy GrTwATaTCG

251 CsGATGTmTA TGGTTTTACT GTTTTTGACC TTCGAGCCGT TTACTTGAAC

301 CCTACCCAGT TCGATGTGCT TTTGCGCAAG GGAACGGGTC TTGAAAAAAC

351 GTGCCGCCCA AAGCCATTTG TCCAGCCGCA TGGCGGAAGA ATCGTGCTTG

401 TCTTTCATAC GATTTTGTTT GAAATAATTG AATTTGTTTC GAGTTTAGCA

451 TAA
```

This corresponds to the amino acid sequence <SEQ ID 1504; ORF 527>:

m527pep

```
  1 MVLPVSFFQP VQLAAVALGR SAVGIGGSDA AELVELFALF PQCCRXRVLF

 51 IQKPRXGCRA ALVVQTFNXD FIGKXNXASV XXIADVYGFT VFDLRAVYLN

101 PTQFDVLLRK GTGLEKTCRP KPFVQPHGGR IVLVFHTILF EIIEFVSSLA

151 *
```

Computer analysis of this amino acid sequence gave the following results:

Homology with a predicted ORF from *N. gonorrhoeae*

ORF 527 shows 90.0% identity over a 150 aa overlap with a predicted ORF (ORF 527.ng) from *N. gonorrhoeae*:

```
m527/g527
                    10        20        30        40        50        60
m527.pep   MVLPVSFFQPVQLAAVALGRSAVGIGGSDAAELVELFALFPQCCRXRVLFIQKPRXGCRA
           ||||||||||||||||||||||||:||||||||||||||||||||| ||:||||| ||||
g527       MVLPVSFFQPVQLAAVALGRSAVGMGGSDAAELVELFALFPQCCRFRVFFIQKPRLGCRA
                    10        20        30        40        50        60

                    70        80        90       100       110       120
m527.pep   ALVVQTFNXDFIGKXNXASVXXIADVYGFTVFDLRACYLNPTQFDVLLRKGTGLEKTCRP
           |||||||| ||:||    :|  |||||||||||:|||||||||||:||||||||||||||
g527       ALVVQTFNLDFMGKGIERQVDNIADVYGFTVFDFRAVYLNPTQFDMLLRKGTGLEKTCRP
                    70        80        90       100       110       120

                   130       140       150
m527.pep   KPFVQPHGGRIVLVFHTILFEIIEFVSSLA
           ||||||||||||||||||||||||||||||
g527       KPFVQPHGGRIVLVFHTILFEIIEFVSSLA
                   130       140       150
```

The following partial DNA sequence was identified in *N. meningitidis* <SEQ ID 1505>:

a527.seq

```
  1 ATGGTTTTAC CAGTCTCCTT TTTTCAGCCT GTCCAGTTGG CGGCGGTCGC
 51 GCTTGGTCGG TCTGCCGTCG GGATAGGCGG AAGTGATGCG GCTGAATTGG
101 TCGAGCTGTT TGCGCTCTTC CCTCAATGTT GCCGTTTTCG CGTCCTCTTC
151 ATACAGAAGC CGCGCCTCGG ATGCCGGGCG GCGTTGGTGG TTCAAACCTT
201 TAACCTTGAT TTTATAGGGA AGGGAATTGA GCGTCAGGTC GATAATATCG
251 CCGATGTCTA TGGTTTTACT GTTTTTGACC TTCGAGCCGT TTACTTGAAC
301 CCTACCCAGT TCGATGTGCT TTTGCGCAAG GGAACGGGTC TTGAAAAAAC
351 GTGCCGCCCA AAGCCATTTG TCCAGCCGCA TGGCGGAAGA ATCGTGCTTG
401 TCTTTCATAC GATTTTGTTT GAAATAATTG AATTTGTTTC GAGTTTAGCA
451 TAA
```

This corresponds to the amino acid sequence <SEQ ID 1506; ORF 527.a>:

a527.pep

```
  1 MVLPVSFFQP VQLAAVALGR SAVGIGGSDA AELVELFALF PQCCRFRVLF
 51 IQKPRLGCRA ALVVQTFNLD FIGKGIERQV DNIADVYGFT VFDLRAVYLN
101 PTQFDVLLRK GTGLEKTCRP KPFVQPHGGR IVLVFHTILF EIIEFVSSLA
151 *
```

m527/a527 93.3% identity in 150 aa overlap

```
                      10        20        30        40        50        60
m527.pep      MVLPVSFFQPVQLAAVALGRSAVGIGGSDAAELVELFALFPQCCRXRVLFIQKPRXGCRA
              ||||||||||||||||||||||||||||||||||||||||||||| ||||||||| ||||
a527          MVLPVSFFQPVQLAAVALGRSAVGIGGSDAAELVELFALFPQCCRFRVLFIQKPRLGCRA
                      10        20        30        40        50        60

                      70        80        90       100       110       120
m527.pep      ALVVQTFNXDFIGKXNXASVXXIADVYGFTVFDLRAVYLNPTQFDVLLRKGTGLEKTCRP
              ||||||| ||||||    :|  ||||||||||||||||||||||||||||||||||||||
a527          ALVVQTFNXDFIGKGIERQVDNIADVYGFTVFDLRACYLNPTQFDVLLRKGTGLEKTCRP
                      70        80        90      100       110       120

                     130       140       150
m527.pep      KPFVQPHGGRIVLVFHTILFEIIEFVSSLAX
              |||||||||||||||||||||||||||||||
a527          KPFVQPHGGRIVLVFHTILFEIIEFVSSLAX
                     130       140       150
```

The following partial DNA sequence was identified in *N. gonorrhoeae* <SEQ ID 1507>:

g528.seq

```
  1 atggaaattc gggtaataaa atatacggca acggctgcgt tgtttgcatt
 51 tacggttgca ggctgccggc tggcggggtg gtatgagtgt ttgtccttgt
101 ccggctggtg taagccgaga aaacctgccg ccatcgattt ttgggatatt
151 ggcggcgaga gtccgctgtc tttagaggac tacgagatac cgctttcaga
201 cggcaatcgt tccgtcaggg caaacgaata tgaatccgcg caaaaatctt
251 acttttatag gaaaataggg aagtttgaag cctgcgggtt ggattggcgt
```

-continued

```
301 acgcgtgacg gcaaaccttt ggttgagagg ttcaaacagg aaggtttcga
351 ctgtttggaa aagcaggggt tgcggcgcaa cggcctgtcc gagcgcgtcc
401 gatggtaa
```

This corresponds to the amino acid sequence <SEQ ID 1508; ORF 528.ng>:

g528.pep

```
  1 MEIRVIKYTA TAALFAFTVA GCRLAGWYEC LSLSGWCKPR KPAAIDFWDI
 51 GGESPLSLED YEIPLSDGNR SVRANEYESA QKSYFYRKIG KFEACGLDWR
101 TRDGKPLVER FKQEGFDCLE KQGLRRNGLS ERVRW*
```

The following partial DNA sequence was identified in *N. meningitidis* <SEQ ID 1509>:

m528.seq (partial)

```
  1 ATGGAAATTC GGGCAATAAA ATATACGGCA ATGGCTGCGT TGCTTGCATT
 51 TACGGTTGCA GGCTGCCGGC TGGCGGGGTG GTATGAGTGT TCGTCCCTCA
101 CCGGCTGGTG TAAGCCGAGA AAACCGGCTG CCATCGATTT TTGGGATATT
151 GGCGGCGAGA GTCCGCCGTC TTTAGGGGAC TACGAGATAC CGCTTTCAGA
201 CGGCAATAGT TCCGTCAGGG CAAACGAATA TGAATCCGCA CAACAATCTT
251 ACTTTTACAG GAAAATAGGG AAGTTTGAAG C.TGCGGGCT GGATTGGCGT
301 ACGCGTGACG GCAAACCTTT GATTGAGACG TTCAAACAGG GAGGATTTGA
351 CTGCTTGGAA AAG....
```

This corresponds to the amino acid sequence <SEQ ID 1510; ORF 528>:

m528.pep (partial)

```
  1 MEIRAIKYTA MAALLAFTVA GCRLAGWYEC SSLTGWCKPR KPAAIDFWDI
 51 GGESPPSLGD YEIPLSDGNS SVRANEYESA QQSYFYRKIG KFEXCGLDWR
101 TRDGKPLIET FKQGGFDCLE K....
```

Computer analysis of this amino acid sequence gave the following results:

Homology with a predicted ORF from *N. gonorrhoeae*

ORF 528 shows 89.3% identity over a 121 aa overlap with a predicted ORF (ORF 528.ng) from *N. gonorrhoeae*:

```
m528/g528
                    10        20        30        40        50        60
m528.pep    MEIRAIKYTAMAALLAFTVAGCRLAGWYECSSLTGWCKPRKPAAIDFWDIGGESPPSLGD
            ||||:||||| |||:||||||||||||||| ||:|||||||||||||||||||| || |
g528        MEIRVIKYTATAALFAFTVAGCRLAGWYECLSLSGWCKPPKPAAIDFWDIGGESPLSLED
                    10        20        30        40        50        60
```

-continued

```
                     70        80        90       100       110       120
m528.pep     YEIPLSDGNSSVRANEYESAQQSYFYRKIGKFEXCGLDWRTRDGKPLIETFKQGGFDCLE
             ||||||||| |||||||||||:|||||||||||| |||||||||||||:| ||| |||||
g528         YEIPLSDGNRSVRANEYESAQKSYFYRKIGKFEACGLDWRTRDGKPLVERFKQEGFDCLE
                     70        80        90       100       110       120

m528.pep     K
             |
g528         KQGLRRNGLSERVRW
```

The following partial DNA sequence was identified in *N. meningitidis* <SEQ ID 1511>:

a528.seq

```
  1 ATGGAAATTC GGGCAATAAA ATATACGGCA ATGGCTGCGT TGCTTGCATT
 51 TACGGTTGCA GGCTGCCGGT TGGCAGGTTG GTATGAGTGT TCGTCCCTGT
101 CCGGCTGGTG TAAGCCGAGA AAACCTGCCG CCATCGATTT TTGGGATATT
151 GGCGGCGAGA GTCCTCCGTC TTTAGAGGAC TACGAGATAC CGCTTTCAGA
201 CGGCAATCGT TCCGTCAGGG CAAACGAATA TGAATCCGCA CAACAATCTT
251 ACTTTTACAG GAAAATAGGG AAGTTTGAAG CCTGCGGGTT GGATTGGCGT
301 ACGCGTGACG GCAAACCTTT GATTGAGACG TTCAAACAGG AAGGTTTTGA
351 TTGTTTGAAA AAGCAGGGGT TGCGGCGCAA CGGTCTGTCC GAGCGCGTCC
401 GATGGTAA
```

This corresponds to the amino acid sequence <SEQ ID 1512; ORF 528.a>:

a528.pep

```
  1 MEIRAIKYTA MAALLAFTVA GCRLAGWYEC SSLSGWCKPR KPAAIDFWDI
 51 GGESPPSLED YEIPLSDGNR SVRANEYESA QQSYFYRKIG KFEACGLDWR
101 TRDGKPLIET FKQEGFDCLK KQGLRRNGLS ERVRW*
```

(In 1, "MEIRAIKYTA MAALLAFTVA G" is underlined.)

m528/a528 95.0% identity in 121 aa overlap

```
                     10        20        30        40        50        60
m528.pep     MEIRAIKYTAMAALLAFTVAGCRLAGWYECSSLTGWCKPRKPAAIDFWDIGGESPPSLGD
             |||||||||||||||||||||||||||||||||:|||||||||||||||||||||||| |
a528         MEIRAIKYTAMAALLAFTVAGCRLAGWYECSSLSGWCKPRKPAAIDFWDIGGESPPSLED
                     10        20        30        40        50        60

                     70        80        90       100       110       120
m528.pep     YEIPLSDGNSSVRANEYESAQQSYFYRKIGKFEXCGLDWRTRDGKPLIETFKQGGFDCLE
             ||||||||| |||||||||||||||||||||||| ||||||||||||||||||| ||||:
a528         YEIPLSDGNRSVRANEYESAQQSYFYRKIGKFEACGLDWRTRDGKPLIETFKQEGFDCLK
                     70        80        90       100       110       120

m528.pep     K
             |
a528         KQGLRRNGLSERVRWX
                    130
```

The following partial DNA sequence was identified in *N. gonorrhoeae* <SEQ ID 1513>:

g528-1.seq

```
  1 ATGGAAATTC GGGTAATAAA ATATACGGCA ACGGCTGCGT TGTTTGCATT
 51 TACGGTTGCA GGCTGCCGGC TGGCGGGGTG GTATGAGTGT TCGTCCTTGT
101 CCGGCTGGTG TAAGCCGAGA AAACCTGCCG CCATCGATTT TTGGGATATT
151 GGCGGCGAGA GTCCGCTGTC TTTAGAGGAC TACGAGATAC CGCTTTCAGA
201 CGGCAATCGT TCCGTCAGGG CAAACGAATA TGAATCCGCG CAAAAATCTT
251 ACTTTTATAG GAAAATAGGG AAGTTTGAAG CCTGCGGGTT GGATTGGCGT
301 ACGCGTGACG GCAAACCTTT GGTTGAGAGG TTCAAACAGG AAGGTTTCGA
351 CTGTTTGGAA AAGCAGGGGT TGCGGCGCAA CGGCCTGTCC GAGCGCGTCC
401 GATGGTAA
```

This corresponds to the amino acid sequence <SEQ ID 1514; ORF 528-1.ng>:

g528-1.pep

```
  1 MEIRVIKYTA TAALFAFTVA GCRLAGWYEC SSLSGWCKPR KPAAIDFWDI
 51 GGESPLSLED YEIPLSDGNR SVRANEYESA QKSYFYRKIG KFEACGLDWR
101 TRDGKPLVER FKQEGFDCLE KQGLRRNGLS ERVRW*
```

The following partial DNA sequence was identified in *N. meningitidis* <SEQ ID 1515>:

m528-1.seq

```
  1 ATGGAAATTC GGGCAATAAA ATATACGGCA ATGGCTGCGT TGCTTGCATT
 51 TACGGTTGCA GGCTGCCGGC TGGCGGGGTG GTATGAGTGT TCGTCCCTCA
101 CCGGCTGGTG TAAGCCGAGA AAACCGGCTG CCATCGATTT TTGGGATATT
151 GGCGGCGAGA GTCCGCCGTC TTTAGGGGAC TACGAGATAC CGCTTTCAGA
201 CGGCAATCGT TCCGTCAGGG CAAACGAATA TGAATCCGCA CAACAATCTT
251 ACTTTTACAG GAAAATAGGG AAGTTTGAAG CCTGCGGGCT GGATTGGCGT
301 ACGCGTGACG GCAAACCTTT GATTGAGACG TTCAAACAGG GAGGATTTGA
351 CTGCTTGGAA AAGCAGGGGT TGCGGCGCAA CGGTCTGTCC GAGCGCGTCC
401 GATGGTAA
```

This corresponds to the amino acid sequence <SEQ ID 1516; ORF 528-1>:

m528-1.pep..

```
  1 MEIRAIKYTA MAALLAFTVA GCRLAGWYEC SSLTGWCKPR KPAAIDFWDI
 51 GGESPPSLGD YEIPLSDGNR SVRANEYESA QQSYFYRKIG KFEACGLDWR
101 TRDGKPLIET FKQGGFDCLE KQGLRRNGLS ERVRW*
```

g528-1/m528-1 92.6% identity in 135 aa overlap

```
                    10        20        30        40        50        60
g528-1.pep  MEIRVIKYTATAALFAFTVAGCRLAGWYECSSLSGWCKPRKPAAIDFWDIGGESPLSLED
            ||||:||||| |||:|||||||||||||||||:|||||||||||||||||||| || |
m528-1      MEIRAIKYTAMAALLAFTVAGCRLAGWYECSSLTGWCKPRKPAAIDFWDIGGESPPSLGD
                    10        20        30        40        50        60

                    70        80        90       100       110       120
g528-1.pep  YEIPLSDGNRSVRANEYESAQKSYFYRKIGKFEACGLDWRTRDGKPLVERFKQEGFDCLE
            ||||||||||||||||||||:||||||||||||||||||||||||||:| ||| ||||||
m528-1      YEIPLSDGNRSVRANEYESAQQSYFYRKIGKFEACGLDWRTRDGKPLIETFKQGGFDCLE
                    70        80        90       100       110       120

                   130
g528-1.pep  KQGLRRNGLSERVRWX
            ||||||||||||||||
m528-1      KQGLRRNGLSERVRWX
                   130
```

The following partial DNA sequence was identified in *N. meningitidis* <SEQ ID 1517>:

a528-1.seq

```
  1 ATGGAAATTC GGGCAATAAA ATATACGGCA ATGGCTGCGT TGCTTGCATT
 51 TACGGTTGCA GGCTGCCGGT TGGCAGGTTG GTATGAGTGT TCGTCCCTGT
101 CCGGCTGGTG TAAGCCGAGA AAACCTGCCG CCATCGATTT TTGGGATATT
151 GGCGGCGAGA GTCCTCCGTC TTTAGAGGAC TAGGAGATAC CGCTTTCAGA
201 CGGCAATCGT TCCGTCAGGG CAAACGAATA TGAATCCGCA CAACAATCTT
251 ACTTTTACAG GAAAATAGGG AAGTTTGAAG CCTGCGGGTT GGATTGGCGT
301 ACGCGTGACG GCAAACCTTT GATTGAGACG TTCAAACAGG AAGGTTTTGA
351 TTGTTTGAAA AAGCAGGGGT TGCGGCGCAA CGGTCTGTCC GAGCGCGTCC
401 GATGGTAA
```

This corresponds to the amino acid sequence <SEQ ID 1518; ORF 528-1.a>:

a528-1.pep

```
  1 MEIRAIKYTA MAALLAFTVA GCRLAGWYEC SSLSGWCKPR KPAAIDFWDI
 51 GGESPPSLED YEIPLSDGNR SVRANEYESA QQSYFYRKIG KFEACGLDWR
101 TRDGKPLIET FKQEGFDCLK KQGLRRNGLS ERVRW*
```

a528-1/m528-1 97.0% identity in 135 aa overlap

```
                    10        20        30        40        50        60
a528-1.pep  MEIRAIKYTAMAALLAFTVAGCRLAGWYECSSLSGWCKPRKPAAIDFWDIGGESPPSLED
            |||||||||||||||||||||||||||||||||:||||||||||||||||||||||||| |
m528-1      MEIRAIKYTAMAALLAFTVAGCRLAGWYECSSLTGWCKPRKPAAIDFWDIGGESPPSLGD
                    10        20        30        40        50        60
                    70        80        90       100       110       120
a528-1.pep  YEIPLSDGNRSVRANEYESAQQSYFYRKIGKFEACGLDWRTRDGKPLIETFKQEGFDCLK
            ||||||||||||||||||||||||||||||||||||||||||||||||||||| |||||:
m528-1      YEIPLSDGNRSVRANEYESAQQSYFYRKIGKFEACGLDWRTRDGKPLIETFKQGGFDCLE
                    70        80        90       100       110       120
                   130
a528-1.pep  KQGLRRNGLSERVRWX
            ||||||||||||||||
m528-1      KQGLRRNGLSERVRWX
                   130
```

The following partial DNA sequence was identified in *N. gonorrhoeae* <SEQ ID 1519>:

g529.seq (partial)

```
  1 atgacccata tcaaacccgt cattgccgcg ctcgcactca tcgggcttgc
 51 cgcctgctcc ggcagcaaaa ccgaacagcc caagctcgac taccaaagcc
101 ggtcgcaccg cctgatcaaa ctcgaagtcc cgcctgattt gaacaacccc
151 gaccaaggca acctctaccg cctgcctgcc ggttcgggag ccgtccgcgc
201 cggggatttg gaaaaacgcc gcacacccgc cgtccaacag ccagcggatg
251 ccggaagtat tgaaaagcgt caaaggcgtc cgcttcgagc ggcgacggca
301 gccaacgcct ggcttgtcgt tgacggcaaa tcccccgccg aaatctccgc
351 cgctttctg.
```

This corresponds to the amino acid sequence <SEQ ID 1520; ORF 529.ng>:

g529.pep (partial)

```
  1 MTHIKPVIAA LALIGLAACS GSKTEQPKLD YQSRSHRLIK LEVPPDLNNP
 51 DQGNLYRLPA GSGAVRAGDL EKRRTPAVQQ PADAGSIEKR QRRPLRAATA
101 ANAWLVVDGK SPAEISAAF..
```

The following partial DNA sequence was identified in *N. meningitidis* <SEQ ID 1521>:

m529.seq

```
  1 ATGACCCATA TCAAACCCGT CATTGCCGCG CTCGCACTCA TCGGGCTTGC
 51 CGCCTGCTCC GGCAGCAAAA CCGAACAGCC CAAGCTCGAC TACCAAAGCC
101 GGTCGCACCG CCTGATCAAA CTTGAAGTCC CACCTGATTT GAACAACCCC
151 GACCAAGGCA ACCTCTACCG CCTGCCTGCC GGTTCGGGCG CCGTCCGCGC
201 CAGCGATTTG GAAAAACGCC GCACACCCGC CGTCCAACAG CCTGCCGATG
251 CCGAAGTATT GAAAAGCGTC AAAGGTGTCC GCCTCGAGCG CGACGGCAGC
301 CAACGCTGGC TCGTTGTCGA CGGCAAGTCT CCTGCCGAAA TCTGGCCGCT
351 CCTGAAAGCC TTTTGGCAGG AAAACGGCTT CGACATCAAA TCCGAAGAAC
401 CCGCCATCGG ACAAATGGAA ACCGAGTGGG CGGAAAACCG CGCCAAAATC
451 CCCCAAGACA GCTTGCGCCG CCTCTTCGAC AAAGTCGGCT TGGGCGGCAT
501 CTACTCCACC GGCGAGCGCG ACAAATTCAT CGTCCGTATC GAACAGGGCA
551 AAAACGGCGT TTCCGACATC TTCTTCGCCC ACAAAGCCAT GAAAGAAGTG
601 TACGGCGGCA AAGACAAAGA CACGACCGTA TGGCAGCCCT CCCCGTCCGA
651 TCCCAACCTC GAAGCCGCTT TCCTGACGCG CTTTATGCAA TATTTGGGCG
701 TTGACGGACA GCAGGCGGAA AACGCATCGG CAAAAAAACC TACCCTTCCC
751 GCCGCCAACG AAATGGCGCG TATCGAAGGC AAAAGCCTGA TTGTCTTTGG
801 CGACTACGGC AGAAACTGGC GGCGCACCGT GCTCGCCCTC GACCGCATCG
851 GGCTGACCGT CGTCGGTCAA AACACCGAAC GCCACGCCTT CCTGGTTCAA
```

-continued

```
 901 AAAGCCCCGA ACGAAAGCAA TGCAGTTACC GAACAAAAAC CCGGCCTGTT

 951 CAAACGCCTG CTGGGCAAAG GCAAAGCGGA GAAACCTGCC GAACAGCCGG

1001 AACTGATTGT CTATGCAGAA CCTGTCGCCA ACGGCTCGCG CATCGTCCTG

1051 CTCAACAAAG ACGGCAGCGC ATATGCCGGC AAAGACGCAT CCGCATTATT

1101 GGGCAAACTC CATTCCGAAC TGCGTTAA
```

This corresponds to the amino acid sequence <SEQ ID 1522; ORF 529>:

m529.pep

```
  1 MTHIKPVIAA LALIGLAACS GSKTEQPKLD YQSRSHRLIK LEVPPDLNNP

 51 DQGNLYRLPA GSGAVRASDL EKRRTPAVQQ PADAEVLKSV KGVRLERDGS

101 QRWLVVDGKS PAEIWPLLKA FWQENGFDIK SEEPAIGQME TEWAENRAKI

151 PQDSLRRLFD KVGLGGIYST GERDKFIVRI EQGKNGVSDI FFAHKAMKEV

201 YGGKDKDTTV WQPSPSDPNL EAAFLTRFMQ YLGVDGQQAE NASAKKPTLP

251 AANEMARIEG KSLIVFGDYG RNWRRTVLAL DRIGLTVVGQ NTERHAFLVQ

301 KAPNESNAVT EQKPGLFKRL LGKGKAEKPA EQPELIVYAE PVANGSRIVL

351 LNKDGSAYAG KDASALLGKL HSELR*
```

Computer analysis of this amino acid sequence gave the following results:

Homology with a predicted ORF from *N. gonorrhoeae*

ORF 529 shows 83.5% identity over a 115 aa overlap with a predicted ORF (ORF 529.ng) from *N. gonorrhoeae*:

g529/m529

```
                  10        20        30        40        50        60
g529.pep  MTHIKPVIAALALIGLAACSGSKTEQPKLDYQSRSHRLIKLEVPPDLNNPDQGNLYRLPA
          ||||||||||||||||||||||||||||||||||||||||||||||||||||||||||||
m529      MTHIKPVIAALALIGLAACSGSKTEQPKLDYQSRSHRLIKLEVPPDLNNPDQGNLYRLPA
                  10        20        30        40        50        60

                  70        80        90       100       110       120
g529.pep  GSGAVRAGDLEKRRTPAVQQPADAGSIEKRQRRPLRAATAANAWLVVDGKSPAEISAAFX
          |||||||:||||||||||||||||  ::: :   |:    ::: |||||||||||||
m529      GSGAVRASDLEKRRTPAVQQPADAEVLKSVKGVRLER-DGSQRWLVVDGKSPAEIWPLLK
                  70        80        90        100       110

m529      AFWQENGFDIKSEEPAIGQMETEWAENRAKIPQDSLRRLFDKVGLGGIYSTGERDKFIVR
        120       130       140       150       160       170
```

The following partial DNA sequence was identified in *N. meningitidis* <SEQ ID 1523>:

a529.seq

```
  1 ATGACCCATA TCAAACCCGT CATTGCCGCG CTCGCACTCA TCGGGCTTGC

 51 CGCCTGCTCC GGCAGCAAAA CCGAACAGCC CAAGCTCGAC TACCAAAGCC

101 GGTCGCACCG CCTGATCAAA CTCGAAGTCC CACCTGATTT GAACAACCCC

151 GACCAAGGCA ACCTCTACCG CCTGCCTGCC GGTTCGGGCG CCGTCCGCGC
```

-continued

```
 201 CAGCGATTTG GAAAAACGCC GCACACCCGC CGTCCAACAG CCTGCCGATG

 251 CCGAAGTATT GAAAAGCGTC AAAGGTGTCC GCCTCGAGCG CGACGGCAGC

 301 CAACGCTGGC TCGTTGTCGA CGGCAAGTCT CATGCCGAAA TCTGGCCGCT

 351 CCTGAAAGCC TTTTGGCAGG AAAACGGCTT CGACATCAAA TCCGAAGAAC

 401 CCGCCATCGG ACAAATGGAA ACCGAGTGGG CGGAAAACCG TGCCAAAATC

 451 CCCCAAGACA GCTTGCGCCG CCTATTCGAC ACAGTCGGTT TGGGCGGCAT

 501 CTACTCCACC GGCGAGCGCG ACAAATTCAT CGTCCGTATC GAACAGGGCA

 551 AAAACGGCGT TTCCGACATC TTCTTCGCCC ACAAAGCCAT GAAAGAAGTG

 601 TACGGCGGCA AAGACAAAGA CACGACCGTA TGGCAGCCCT CCCCGTCCGA

 651 TCCCAACCTC GAAGCCGCTT TCCTGACGCG CTTTATGCAA TATTTGGGCG

 701 TTGACGGACA GCAGGCGGAA AACGCATCGG CAAAAAAACC TACCCTTCCC

 751 GCCGCCAACG AAATGGCGCG TATCGAAGGC AAAAGCCTGA TTGTCTTTGG

 801 CGACTACGGC AGAAACTGGC GGCGCACCGC GCTCGCCCTC GACCGCATCG

 851 GGCTGACCGT CGTCGGTCAA AACACCGAAC GCCACGCTTT CCTGGTTCAA

 901 AAAGCCCCGA ACGAAAGCAA TGCAGTTACC GAACAAAAAC CCGGCCTGTT

 951 CAAACGCCTG CTGGGCAAAG GCAAAGCGGA GAAACCTGCC GAACAGCCGG

1001 AACTGATTGT CTATGCCGAG CCTGTCGCCA ACGGCTCGCG CATCGTCCTG

1051 CTCAACAAAG ACGGCAGCGC ATATGCCGGC AAAGACGCAT CCGCATTATT

1101 GGGCAAACTC CATTCCGAAC TGCGTTAA
```

This corresponds to the amino acid sequence <SEQ ID 1524; ORF 529.a>:

a529.pep

```
  1 MTHIKPVIAA LALIGLAACS GSKTEQPKLD YQSRSHRLIK LEVPPDLNNP

 51 DQGNLYRLPA GSGAVRASDL EKRRTPAVQQ PADAEVLKSV KGVRLERDGS

101 QRWLVVDGKS HAEIWPLLKA FWQENGFDIK SEEPAIGQME TEWAENRAKI

151 PQDSLRRLFD TVGLGGIYST GERDKFIVRI EQGKNGVSDI FFAHKAMKEV

201 YGGKDKDTTV WQPSPSDPNL EAAFLTRFMQ YLGVDGQQAE NASAKKPTLP

251 AANEMARIEG KSLIVFGDYG RNWRRTALAL DRIGLTVVGQ NTERHAFLVQ

301 KAPNESNAVT EQKPGLFKRL LGKGKAEKPA EQPELIVYAE PVANGSRIVL

351 LNKDGSAYAG KDASALLGKL HSELR*
```

m529/a529 99.2% identity in 375 aa overlap

```
                    10        20        30        40        50        60
m529.pep    MTHIKPVIAALALIGLAACSGSKTEQPKLDYQSRSHRLIKLEVPPDLNNPDQGNLYRLPA
            ||||||||||||||||||||||||||||||||||||||||||||||||||||||||||||
a529        MTHIKPVIAALALIGLAACSGSKTEQPKLDYQSRSHRLIKLEVPPDLNNPDQGNLYRLPA
                    10        20        30        40        50        60

                    70        80        90       100       110       120
m529.pep    GSGAVRASDLEKRRTPAVQQPADAEVLKSVKGVRLERDGSQRWLVVDGKSPAEIWPLLKA
            |||||||||||||||||||||||||||||||||||||||||||||||||| |||||||||
a529        GSGAVRASDLEKRRTPAVQQPADAEVLKSVKGVRLERDGSQRWLVVDGKSHAEIWPLLKA
                    70        80        90       100       110       120
```

-continued

```
              130       140       150       160       170       180
m529.pep  EWQENGFDIKSEEPAIGQMETEWAENRAKIPQDSLRRLFDKVGLGGIYSTGERDKFIVRI
          |||||||||||||||||||||||||||||||||||||||||| |||||||||||||||||||
a529      EWQENGFDIKSEEPAIGQMETEWAENRAKIPQDSLRRLFDTVGLGGIYSTGERDKFIVRI
              130       140       150       160       170       180

              190       200       210       220       230       240
m529.pep  EQGKNGVSDIFFAHKAMKEVYGGKDKDTTVWQPSPSDPNLEAAFLTRFMQYLGVDGQQAE
          ||||||||||||||||||||||||||||||||||||||||||||||||||||||||||||
a529      EQGKNGVSDIFFAHKAMKEVYGGKDKDTTVWQPSPSDPNLEAAFLTRFMQYLGVDGQQAE
              190       200       210       220       230       240

              250       260       270       280       290       300
m529.pep  NASAKKPTLPAANEMARIEGKSLIVFGDYGRNWRRTVLALDRIGLTVVGQNTERHAFLVQ
          ||||||||||||||||||||||||||||||||||||:|||||||||||||||||||||||
a529      NASAKKPTLPAANEMARIEGKSLIVFGDYGRNWRRTALALDRIGLTVVGQNTERHAFLVQ
              250       260       270       280       290       300

              310       320       330       340       350       360
m529.pep  KAPNESNAVTEQKPGLFKRLLGKGKAEKPAEQPELIVYAEPVANGSRIVLLNKDGSAYAG
          ||||||||||||||||||||||||||||||||||||||||||||||||||||||||||||
a529      KAPNESNAVTEQKPGLFKRLLGKGKAEKPAEQPELIVYAEPVANGSRIVLLNKDGSAYAG
              310       320       330       340       350       360

              370
m529.pep  KDASALLGKLHSELRX
          ||||||||||||||||
a529      KDASALLGKLHSELRX
              370
```

The following partial DNA sequence was identified in *N. gonorrhoeae* <SEQ ID 1525>:

g530.seq

```
  1 atgagtgcga gcgcggcaat gacgggtttg atatgggtca tcgtgtcatc
 51 ctgtgtgatg gatattaaag tgtttgtcat gttatgccgt ccgaacggtt
101 cagacggcat ggctatattt aaagttgtcc tgaggctttc agggcggcgc
151 ggacttttgc ctgtccgcct tccgtcagcg gaacgagcgg caggcgcacg
201 tgcggtccgc atccgcccaa ggcggatacc gcccatttcg gtgcggcggg
251 actgggttcg cagaacatgg tgtcgtaaat cggaatcagc cggtcgttga
```

This corresponds to the amino acid sequence <SEQ ID 1526; ORF 530.ng>:

g530.pep

```
 1 MSASAAMTGL IWVIVSSCVM DIKVFVMLCR PNGSDGMAIF KVVLRLSGRR
51 GLLPVRLPSA ERAAGARAVR IRPRRIPPIS VRRDWVRRTW CRKSESAGR*
```

The following partial DNA sequence was identified in *N. meningitidis* <SEQ ID 1527>:

m530.seq

```
  1 wTGAGTGCGA GCGCGGCAAT GACGGGTyTG ATATGGGTCA TCGTGTCATC
 51 sTGTGTGATG GATATTAAAG TGTyTGTTGC GwTATGCCGT CCGAACGGTT
101 CGGACGGCAT GGmTATATTT AAAGTTGTCC TGAGGCTTTC AGGGCGGCGC
151 GCACTkTTGC wTGTCCGTTT yCCGTCAGCG GAACGAGCGG CAGGCGGACG
201 TGCGGTTCGC ATCTGCCCAg GGCGGATACC GCCCATTTCG GTGCGGCGGG
251 GCTGGGTTCG CAGAACATGG TGTCGTAAAT CGGAATCAGT CGGTCGTTGA
```

This corresponds to the amino acid sequence <SEQ ID 1528; ORF 530>:

m530.pep

```
 1 XSASAAMTGL IWVIVSSCVM DIKVXVAXCR PNGSDGMXIF KVVLRLSGRR

51 GLLXVRFPSA ERAAGGRAVR ICPGRIPPIS VRRGWVRRTW CRKSESVGR*
```

Computer analysis of this amino acid sequence gave the following results:

Homology with a predicted ORF from *N. gonorrhoeae*

ORF 530 shows 88.8% identity over a 98 aa overlap with a predicted ORF (ORF 530.ng) from *N. gonorrhoeae*:

m530/g530

```
m530.pep  XSASAAMTGLIWVIVSSCVMDIKVXVAXCRPNGSDGMXIFKVVLRLSGRRGLLXVRFPSA  60
           ||||||||||||||||||||||| |  ||||||||| ||||||||||||||| ||:|||
g530      MSASAAMTGLIWVIVSSCVMDIKVFVMLCRPNGSDGMAIFKVVLRLSGRRGLLPVRLPSA  60
                  10        20        30        40        50        60
m530.pep  ERAAGGRAVRICPGRIPPISVRRGWVRRTWCRKSESVGR  99
          |||||:||||| | ||||||||| ||||||||||||:||
g530      ERAAGARAVRIRPRRIPPISVRRDWVRRTWCRKSESAGR  99
```

The following partial DNA sequence was identified in *N. meningitidis* <SEQ ID 1529>:

a530.seq

```
  1 ATGAGTGCGA GCGCGGCAAT GACGGGTTTG ATATGGGTCA TCGTGTCATC

 51 CTGTGTGATG GATATTAAAG TGTTTGTTGC GTTATGCCGT CCGAACGGTT

101 CGGACGGCAT GGCTATATTT AAAGTTGTCC TGAGGCTTTC AGGGCGGCGC

151 GGACTTTTGC CTGTCCGCCT TCCGTCAGCG GAACGAGCGG CAGGCGGACG

201 TGCGGTTCGC ATCTGCCCAG GGCGGATACC GCCCATTTCG GTGCGGCGGG

251 GCTGGGTTCG CAGAACATGG TGTCGTAAAT CGGAATCAGC CGGTCGTTGA
```

This corresponds to the amino acid sequence <SEQ ID 1530; ORF 530.a>:

a530.pep

```
 1 MSASAAMTGL IWVIVSSCVM DIKVFVALCR PNGSDGMAIF KVVLRLSGRR

51 GLLPVRLPSA ERAAGGRAVR ICPGRIPPIS VRRGWVRRTW CRKSESAGR*
```

m530/a530 93.9% identity in 98 aa overlap

```
                  10        20        30        40        50        60
m530.pep  XSASAAMTGLIWVIVSSCVMDIKVXVAXCRPNGSDGMXIFKVVLRLSGRRGLLXVRFPSA
           ||||||||||||||||||||||| || ||||||||| ||||||||||||||| ||:|||
a530      MSASAAMTGLIWVIVSSCVMDIKVFVALCRPNGSDGMAIFKVVLRLSGRRGLLPVRLPSA
                  10        20        30        40        50        60
                  70        80        90       100
m530.pep  ERAAGGRAVRICPGRIPPISVRRGWVRRTWCRKSESVGRX
          ||||||||||||||||||||||||||||||||||||:|||
a530      ERAAGGRAVRICPGRIPPISVRRGWVRRTWCRKSESAGRX
                  70        80        90       100
```

The following partial DNA sequence was identified in *N. gonorrhoeae* <SEQ ID 1531>:

g531.seq

```
  1 ATGACCGCCC TACTCGTCAT CCTCGCCCTC GCCCTGATAG CCGTCGGCAC
 51 GGCAGGCATC GTCTATCCCG CCCTGCCCGG CTTGGCATTG ATGTTTGCCG
101 GAACATGGCT GCTTGCCTAT GCCGGCGGCT ATCAAATCTA CGGCGCAGGC
151 ATCTTGTGGA CGGTCGGACT CATCAGCCTT GGCGGCATAC TGGCGGACTA
201 TATGGCAGGC ATGTTGGGGG TAAAATACAC TGGGGCAGGC AAACTCGCCG
251 TCCGAGGTGC ATTGGCCGGC AGCATCATCG GCATATTTTT CTCCCTTCCC
301 GGACTAATAC TCGGCCCCTT TATCGGCGCG GCGGCAGGCG AACTGATCGA
351 TCGGCGCAAT ATGCTTCAGG CAGGTAAAGC GGGCTTGGGT ACGCTGTTGG
401 GGCTTGTCGT CGGCACGGCG TTCAAAATCG GCTGCGCCGT ATCCATCTTG
451 TTTATCCTGT TGGTGAAATA CATCGCATAC CTGTTTTAA
```

This corresponds to the amino acid sequence <SEQ ID 1532; ORF 531.ng>:

g531.pep

```
  1 MTALLVILAL ALIAVGTAGI VYPALPGLAL MFAGTWLLAY AGGYQIYGAG
 51 ILWTVGLISL GGILADYMAG MLGVKYTGAG KLAVRGALAG SIIGIFFSLP
101 GLILGPFIGA AAGELIDRRN MLQAGKAGLG TLLGLVVGTA FKIGCAVSIL
151 FILLVKYIAY LF
```

The following partial DNA sequence was identified in *N. meningitidis* <SEQ ID 1533>:

m531.seq

```
  1 ATGACCGTAC TGACCGTCAT CCTCGCCCTC GCCCTGATAG CCGTCGGCAC
 51 GGCGGGCATC GTTTaCCCCG CCCTGCCCGG ATTGGCATTG ATGTTTGCCG
101 GAACATGGCT GCTTGCCTAT GCCGGCGGCT ACCAAATCTA CGGCGCGGGC
151 GTTTTGTGGA CGGTCGGACT CATCAGCCTT GCCGGCATAC TGGCGGACTA
201 TGTGGCAGGC ATATGGGGGA CAAAATATAC CGGAGCGGGC AAGCTCGCCG
251 TTCGCGGCGC ATTGGCCGGC AGCATCATCG GCATATTTTT CTCCCTTCCC
301 GGACTAATAC TCGGTCCCTT TATCGGCGCG GCGGCAGGCG AACTGATCGA
351 ACGGCGCAAT ATGCTTCAGG CAGGTAAAGC GGGCTTGGGT ACGCTGTTGG
401 GGCTTGTCGT CGGCACGGCG TTCAAAATCG GCTGCGCnGT ATCCATCTTG
451 TTTATCCTGT TGGTGAaATA CATCGCCTAC CTGTTTTAA
```

This corresponds to the amino acid sequence <SEQ ID 1534; ORF 531>:

m531.pep

```
  1 MTVLTVILAL ALIAVGTAGI VYPALPGLAL MFAGTWLLAY AGGYQIYGAG
 51 VLWTVGLISL AGILADYVAG IWGTKYTGAG KLAVRGALAG SIIGIFFSLP
```

-continued

```
101 GLILGPFIGA AAGELIERRN MLQAGKAGLG TLLGLVVGTA FKIGCAVSIL

151 FILLVKYIAY LF*
```

Computer analysis of this amino acid sequence gave the following results:

Homology with a predicted ORF from *N. gonorrhoeae*

ORF 531 shows 94.4% identity over a 162 aa overlap with a predicted ORF (ORF 531.ng) from *N. gonorrhoeae*:

```
m531/g531
                    10         20         30         40         50         60
m531.pep    MTVLTVILALALIAVGTAGIVYPALPGLALMFAGTWLLAYAGGYQIYGAGVLWTVGLISL
            ||:| |||||||||||||||||||||||||||||||||||||||||||||:|||||||||
g531        MTALLVILALALIAVGTAGIVYPALPGLALMFAGTWLLAYAGGYQIYGAGILWTVGLISL
                    10         20         30         40         50         60

                    70         80         90        100        110        120
m531.pep    AGILADYVAGIWGTKYTGAGKLAVRGALAGSIIGIFFSLPGLILGPFIGAAAGELIERRN
            :||||||:||: |:||||||||||||||||||||||||||||||||||||||||||:|||
g531        GGILADYMAGMLGVKYTGAGKLAVRGALAGSIIGIFFSLPGLILGPFIGAAAGELIDRRN
                    70         80         90        100        110        120

                   130        140        150        160
m531.pep    MLQAGKAGLGTLLGLVVGTAFKIGCAVSILFILLVKYIAYLF
            ||||||||||||||||||||||||||||||||||||||||||
g531        MLQAGKAGLGTLLGLVVGTAFKIGCAVSILFILLVKYIAYLF
                   130        140        150        160
```

The following partial DNA sequence was identified in *N. meningitidis* <SEQ ID 1535>:

```
a531.seq

  1 ATGACCGCCT TGCTCGTCAT CCTCGCCCTC GCCCTGATAG CCGCCGGTAC

 51 GGCGGGCATC GTTTACCCCG CCCTGCCCGG ATTGGCATTG ATGTTTGCCG

101 GAACCTGGCT GCTCGCCTAC TCCGGCGGCT ACCAAATCTA CGGCGCGGGC

151 GTTTTGTGGA CGGTCGGACT CATCAGCCTT GCCGGCATAC TGGCGGACTA

201 TGTGGCAGGC ATATGGGGGA CAAAATATAC CGGAGCGGGC AAGCTCGCCG

251 TTCGCGGCGC ATTGGCCGGC AGCATCATCG GCATATTTTT CTCCCTTCCC

301 GGACTAATAC TCGGTCCCTT TATCGGCGCG GCGGCAGGCG AACTGATCGA

351 ACGGCGCAAT ATGCTTCAGG CAGGTAAAGC GGGCTTGGGT ACGCTGTTGG

401 GGCTTATCGT CGGTACGGCG TTCAAAATCG GCTGCGCCGT ATCCATCTTG

451 TTTATCCTGT TGGTGAAATA CATCGCCTAC CTGTTTTAA
```

This corresponds to the amino acid sequence <SEQ ID 1536; ORF 531.a>:

```
a531.pep

  1 MTALLVILAL ALIAAGTAGI VYPALPGLAL MFAGTWLLAY SGGYQIYGAG

 51 VLWTVGLISL AGILADYVAG IWGTKYTGAG KLAVRGALAG SIIGIFFSLP

101 GLILGPFIGA AAGELIERRN MLQAGKAGLG TLLGLIVGTA FKIGCAVSIL

151 FILLVKYIAY LF*
```

m531/a531 96.9% identity in 162 aa overlap

```
                10        20        30        40        50        60
m531.pep  MTVLTVILALALIAVGTAGIVYPALPGLALMFAGTWLLAYAGGYQIYGAGVLWTVGLISL
          ||:| |||||||||:|||||||||||||||||||||||||:|||||||||||||||||||
a531      MTALLVILALALIAAGTAGIVYPALPGLALMFAGTWLLAYSGGYQIYGAGVLWTVGLISL
                10        20        30        40        50        60

                70        80        90       100       110       120
m531.pep  AGILADYVAGIWGTKYTGAGKLAVRGALAGSIIGIFFSLPGLILGPFIGAAAGELIERRN
          ||||||||||||||||||||||||||||||||||||||||||||||||||||||||||||
a531      AGILADYVAGIWGTKYTGAGKLAVRGALAGSIIGIFFSLPGLILGPFIGAAAGELIERRN
                70        80        90       100       110       120

               130       140       150       160
m531.pep  MLQAGKAGLGTLLGLVVGTAFKIGCAVSILFILLVKYIAYLFX
          |||||||||||||||:|||||||||||||||||||||||||||
a531      MLQAGKAGLGTLLGLIVGTAFKIGCAVSILFILLVKYIAYLFX
               130       140       150       160
```

The following partial DNA sequence was identified in *N. gonorrhoeae* <SEQ ID 1537>:

<u>g532.seq (partial)</u>

1 atggctgaaa caatgaaaaa acaggcggat tcgcctgatt tggtgtacgg 51 tttggaagac aggccgccgt tcggtaatgc gctcttgagc gcggttaccc 101 atcttttggc gattttcgtg ccgatgatta cgcccgcgct gattgtgggc 151 ggcgcgctgg aattgccggt ggagatgacg gcgtatctgg tgtcgatggc 201 gatggttgcg tcgggtgtcg gcacttattt gcaggtcaac cgcttcgggt 251 cggtcggctc ggggatgctg tccatccagc gttaccgtca tgattgcgct 301 cggcgcgggg atgaaagagg gcggtttgag ...

This corresponds to the amino acid sequence <SEQ ID 1538; ORF 532.ng>:

<u>g532.pep (partial)</u>

1 MAETMKKQAD SPDLVYGLED RPPFGNALLS AVTH<u>LLAIFV PMITPALIVG</u>

51 <u>G</u>ALELPVEMT AYLVSMAMVA SGVGTYLQVN RFGSVGSGML SIQRYRHDCA

102 RRGDERGRFE ...

The following partial DNA sequence was identified in *N. meningitidis* <SEQ ID 1539>:

<u>m532.seq</u>

1 ATGAGCGGTC AGTTGGGCAA AGGTGCGGAT GCGCCTGATT TGGTGTACGG

51 TTTGGAAGAC AGGCCGCCGT TCGGTAATGC GCTCTTGAGC GCGGTTACCC

101 ATCTTTTGGC GATTTTTGTG CCGATGATTA CGCCCGCGCT GATTGTGGGC

151 GGCGCGCTGG AATTGCCGGT GGAGATGACG GCGTATCTCG TGTCGATGGC

201 GATGGTTGCG TCGGGTGTCG GCACTTATTT GCAGGTCAAC CGCTTCGGGC

251 CGGTCGGTTC GGGGATGCTG TCCATCCAGT CGGTGAATTT TTCGTTCGTT

301 ACCGTGATGA TTGCGCTGGG CGCGGGGATG AAAGAGGGCG GTTTGACTAA

351 GGATGCGATG ATTTCGACGC TCTTGGGCGT ATCGTTTGTC GGCGCGTTTT

401 TGGTGTGTTT CTCGGCGTGG CTTCTGCCGT ATTTGAAAAA AGTGATTACG

-continued

```
 451 CCGACGGTCA GCGGCGTGGT CGTGATGCTC ATTGGTTTGA GTTTGGTACA
 501 CGTCGGCATT ACCGATTTCG GCGGCGGCTT CGGCGCGAAG GCGGACGGCA
 551 CGTTCGGCTC GATGGAAAAC TTGGGGCTGG CATCGCTGGT GTTGCTGATT
 601 GTGTTGGTGT TCAACTGCAT GAAAAACCCG CTGTTGCGCA TGAGCGGCAT
 651 TGCGGTCGGG CTGATTGCCG GCTATATCGT CGCGCTGTTT TTGGGCAAGG
 701 TGGATTTTTC CGCGCTGCAA AACCTGCCGC TGGTTACGCT GCCCGTACCG
 751 TTTAAATACG GTTTTGCTTT CGACTGGCAC GCGTTTATTG TGGCGGGCGC
 801 GATTTTCTTG TTGAGCGTGT TTGAGGCGGT CGGCGATTTA ACCGCGACGG
 851 CAATGGTGTC CGACCAGCCG ATTGAAGGCG AGGAATACAC CAAACGCCTG
 901 CGCGGCGGCG TGTTGGCTGA CGGCTTGGTG TCGGTGATTG CGACGGCTTT
 951 GGGTTCGCTG CCGCTGACGA CGTTTGCGCA AAACAACGGC GTGATTCAGA
1001 TGACCGGCGT GGCTTCGCGC CATGTGGGCA AATATATTGC CGTGATTTTG
1051 GTGCTGTTGG GTCTGTTCCC CGTTGTCGGT CGCGCGTTTA CGACGATTCC
1101 GAGTCCGGTG TTGGGCGGCG CGATGGTTTT GATGTTCGGC TTAATTGCGA
1151 TTGCGGGCGT GCGGATTTTG GTCAGTCACG GCATCCGCAG GCGCGAAGCG
1201 GTGATTGCGG CAACGTCGGT CGGTTTGGGC TTGGGTGTCG CGTTTGAGCC
1251 GGAAGTGTTT AAAAACCTGC CCGTCTTGTT CCAAAACTCT ATTTCCGCCG
1301 GCGGCATTAC GGCAGTCTTG CTGAATTTGG TCTTGCCCGA AGATAAAACC
1351 GAGGCGGCGG TCAAGTTTGA TACCGACCAC TTGGAACACT GA
```

This corresponds to the amino acid sequence <SEQ ID 1540; ORF 532>:

m532.pep

```
  1 MSGQLGKGAD APDLVYGLED RPPFGNALLS AVTHLLAIFV PMITPALIVG
 51 GALELPVEMT AYLVSMAMVA SGVGTYLQVN RFGPVGSGML SIQSVNFSFV
101 TVMIALGAGM KEGGLTKDAM ISTLLGVSFV GAFLVCFSAW LLPYLKKVIT
151 PTVSGVVVML IGLSLVHVGI TDFGGGFGAK ADGTFGSMEN LGLASLVLLI
201 VLVFNCMKNP LLRMSGIAVG LIAGYIVALF LGKVDFSALQ NLPLVTLPVP
251 FKYGFAFDWH AFIVAGAIFL LSVFEAVGDL TATAMVSDQP IEGEEYTKRL
301 RGGVLADGLV SVIATALGSL PLTTFAQNNG VIQMTGVASR HVGKYIAVIL
351 VLLGLFPVVG RAFTTIPSPV LGGAMVLMFG LIAIAGVRIL VSHGIRRREA
401 VIAATSVGLG LGVAFEPEVF KNLPVLFQNS ISAGGITAVL LNLVLPEDKT
451 EAAVKFDTDH LEH*
```

Computer analysis of this amino acid sequence gave the following results:

Homology with a predicted ORF from *N. gonorrhoeae*

ORF532 shows 91.4% identity over a 93 aa overlap with a predicted ORF (ORF 532.ng) from *N. gonorrhoeae*:

g532/m532

```
                10         20         30         40         50         60
g532.pep  MAETMKKQADSPDLVYGLEDRPPFGNALLSAVTHLLAIFVPMITPALIVGGALELPVEMT
          |:  : | ||:|||||||||||||||||||||||||||||||||||||||||||||||||
m532      MSGQLGKGADAPDLVYGLEDRPPFGNALLSAVTHLLAIFVPMITPALIVGGALELPVEMT
                10         20         30         40         50         60
                70         80         90        100        110
g532.pep  AYLVSMAMVASGVGTYLQVNRFGSVGSGMLSIQRYRHDCARRGDERGRFEX
          |||||||||||||||||||||| |||||||||
m532      AYLVSMAMVASGVGTYLQVNRFGPVGSGMLSIQSVNFSFVTVMIALGAGMKEGGLTKDAM
                70         80         90        100        110        120
```

The following partial DNA sequence was identified in *N. meningitidis* <SEQ ID 1541>:

a532.seq

```
   1 ATGAGCGGTC AGTTGGGCAA AGGTGCGGAT GCGCCTGATT TGGTGTACGG
  51 TTTGGAGGAT AGGCCGCCGT TCGGTAATGC GCTCTTGAGC GCGGTTACCC
 101 ATCTTTTGGC GATTTTTGTG CCGATGATTA CGCCCGCGCT GATTGTGGGC
 151 GGCGCGCTGG AATTGCCGGT GGAGATGACG GCGTATCTCG TGTCGATGGC
 201 GATGGTTGCG TCGGGTGTCG GCACTTATTT GCAGGTCAAC CGCTTCGGGC
 251 CGGTCGGTTC GGGGATGCTG TCCATCCAGT CGGTGAATTT CTCGTTCGTT
 301 ACCGTCATGA TTGCGCTCGG CGCGGGGATG AAAGAGGGCG GTTTGACTAA
 351 GGATGCGATG ATTTCGACGC TCTTGGGCGT ATCGTTTGTC GGCGCGTTTT
 401 TGGTGTGTTT TTCGGCGTGG CTTCTGCCGT ATTTGAAAAA AGTGATTACG
 451 CCGACGGTCA GCGGTGTGGT GGTGATGCTG ATCGGCTTGA GTTTGGTACA
 501 CGTCGGTATT ACCGATTTCG GCGGCGGCTT CGGCGCAAAG GCGGACGGCA
 551 CGTTCGGCTC GATGGAAAAC TTGGGGCTGG CATCGCTGGT GCTGCTGATT
 601 GTGCTGGTGT TCAATTGCAT GAAAAACCCG CTGCTGCGGA TGAGCGGCAT
 651 TGCGGTCGGT CTGATTGCCG GCTATATCGT CGCGCTGTTT TTGGGCAAGG
 701 TGGATTTTTC GGCACTGCAA AACCTGCCGC TGGTTACGCT GCCCGTACCG
 751 TTTAAATATG GTTTTGCTTT TGACTGGCAC GCATTTATTG TGGCGGGTGC
 801 GATTTTCTTG TTGAGCGTGT TTGAGGCGGT CGGCGATTTG ACGGCGACGG
 851 CAATGGTGTC CGACCAGCCG ATTGAAGGCG AGGAATACAC CAAACGCTTG
 901 CGCGGCGGCG TGTTGGCGGA CGGCTTGGTG TCGGTGATTG CGACGGCTTT
 951 GGGTTCGCTG CCGCTGACGA CGTTTGCACA AAACAACGGC GTGATTCAGA
1001 TGACCGGCGT GGCTTCGCGC CATGTGGGCA AATATATTGC CGTGATTTTG
1051 GTGCTGTTGG GTCTGTTCCC CGTTGTCGGA CGCGCGTTTA CGACGATTCC
1101 GAGTCCGGTG TTGGGCGGCG CGATGGTTTT GATGTTCGGC TTGATTGCGA
1151 TTGCGGGCGT GCGGATTTTG GTCAGCCACG GCATCCGCAG GCGCGAAGCG
1201 GTAATTGCGG CAACGTCGGT CGGTTTGGGC TTGGGTGTCG CGTTTGAGCC
1251 GGAAGTGTTT AAAAACCTGC CCGTCTTGTT CCAAAACTCT ATTTCCGCCG
1301 GCGGCATTAC GGCAGTCTTG CTGAATTTGG TCTTGCCCGA AGATAAAACC
1351 GAGGCGGCGG TCAAGTTTGA TACCGACCAC TTGGAACACT GA
```

This corresponds to the amino acid sequence <SEQ ID 1542; ORF 532.a>:

a532.pep

```
  1 MSGQLGKGAD APDLVYGLED RPPFGNALLS AVTHLLAIFV PMITPALIVG
 51 GALELPVEMT AYLVSMAMVA SGVGTYLQVN RFGPVGSGML SIQSVNFSFV
101 TVMIALGAGM KEGGLTKDAM ISTLLGVSFV GAFLVGFSAW LLPYLKKVIT
151 PTVSGVVVML IGLSLVHVGI TDFGGGFGAK ADGTFGSMEN LGLASLVLLI
201 VLVFNCMKNP LLRMSGIAVG LIAGYIVALF LGKVDFSALQ NLPLVTLPVP
251 FKYGFAFDWH AFIVAGAIFL LSVFEAVGDL TATAMVSDQP IEGEEYTKRL
301 RGGVLADGLV SVIATALGSL PLTTFAQNNG VIQMTGVASR HVGKYIAVIL
351 VLLGLFPVVG RAFTTIPSPV LGGAMVLMFG LIAIAGVRIL VSHGIRRREA
401 VIAATSVGLG LGVAFEPEVF KNLPVLFQNS ISAGGITAVL LNLVLPEDKT
451 EAAVKFDTDH LEH*
```

m532/a532 100.0% identity in 463 aa overlap

```
                   10        20        30        40        50        60
m532.pep   MSGQLGKGADAPDLVYGLEDRPPFGNALLSAVTHLLAIFVPMITPALIVGGALELPVEMT
           ||||||||||||||||||||||||||||||||||||||||||||||||||||||||||||
a532       MSGQLGKGADAPDLVYGLEDRPPFGNALLSAVTHLLAIFVPMITPALIVGGALELPVEMT
                   10        20        30        40        50        60
                   70        80        90       100       110       120
m532.pep   AYLVSMAMVASGVGTYLQVNRFGPVGSGMLSIQSVNFSFVTVMIALGAGMKEGGLTKDAM
           ||||||||||||||||||||||||||||||||||||||||||||||||||||||||||||
a532       AYLVSMAMVASGVGTYLQVNRFGPVGSGMLSIQSVNFSFVTVMIALGAGMKEGGLTKDAM
                   70        80        90       100       110       120
                  130       140       150       160       170       180
m532.pep   ISTLLGVSFVGAFLVCFSAWLLPYLKKVITPTVSGVVVMLIGLSLVHVGITDFGGGFGAK
           ||||||||||||||||||||||||||||||||||||||||||||||||||||||||||||
a532       ISTLLGVSFVGAFLVCFSAWLLPYLKKVITPTVSGVVVMLIGLSLVHVGITDFGGGFGAK
                  130       140       150       160       170       180
                  190       200       210       220       230       240
m532.pep   ADGTFGSMENLGLASLVLLIVLVFNCMKNPLLRMSGIAVGLIAGYIVALFLGKVDFSALQ
           ||||||||||||||||||||||||||||||||||||||||||||||||||||||||||||
a532       ADGTFGSMENLGLASLVLLIVLVFNCMKNPLLRMSGIAVGLIAGYIVALFLGKVDFSALQ
                  190       200       210       220       230       240
                  250       260       270       280       290       300
m532.pep   NLPLVTLPVPFKYGFAFDWHAFIVAGAIFLLSVFEAVGDLTATAMVSDQPIEGEEYTKRL
           ||||||||||||||||||||||||||||||||||||||||||||||||||||||||||||
a532       NLPLVTLPVPFKYGFAFDWHAFIVAGAIFLLSVFEAVGDLTATAMVSDQPIEGEEYTKRL
                  250       260       270       280       290       300
                  310       320       330       340       350       360
m532.pep   RGGVLADGLVSVIATALGSLPLTTFAQNNGVIQMTGVASRHVGKYIAVILVLLGLFPVVG
           ||||||||||||||||||||||||||||||||||||||||||||||||||||||||||||
a532       RGGVLADGLVSVIATALGSLPLTTFAQNNGVIQMTGVASRHVGKYIAVILVLLGLFPVVG
                  310       320       330       340       350       360
                  370       380       390       400       410       420
m532.pep   RAFTTIPSPVLGGAMVLMFGLIAIAGVRILVSHGIRRREAVIAATSVGLGLGVAFEPEVF
           ||||||||||||||||||||||||||||||||||||||||||||||||||||||||||||
a532       RAFTTIPSPVLGGAMVLMFGLIAIAGVRILVSHGIRRREAVIAATSVGLGLGVAFEPEVF
                  370       380       390       400       410       420
                  430       440       450       460
m532.pep   KNLPVLFQNSISAGGITAVLLNLVLPEDKTEAAVKFDTDHLEHX
           ||||||||||||||||||||||||||||||||||||||||||||
a532       KNLPVLFQNSISAGGITAVLLNLVLPEDKTEAAVKFDTDHLEHX
                  430       440       450       460
```

The following partial DNA sequence was identified in *N. gonorrhoeae* <SEQ ID 1543>:

g535.seq

```
  1 atgccctttc ccgttttcag acaantattt gcttngtcct tgctacggtt
 51 ttttgccgta ggtcggattc tcgaatccga catttccaac agcggttttt
```

-continued

```
101 cggaaacgat aaacgcgtca aatgtttttt ttgtcggata cgaatatccg
151 gcctgcattt caaatttaca tcgcttccaa tttcgcaaac ttggtatcca
201 gttctttcac gccctgtttg ccgaagttga tggtcagtcg ggcggattcg
251 cctttgtctg cggcatcgat aatcacgccg gtgccgaatt tggcgtgacg
301 gacgttttgt ccgatgcgga agcctgcgta ggtttgcggc tgtttgaagt
351 catcgatgat tttgtcccgt tgtacggtgg tttggcgcgt gttgccgtag
401 ctgtcgaagg cgggtttttt gacggacagg tagtgcaata cttctggcgg
451 gatttcttcg acgaagcggg atgcgatgcc gaattgggtt tgtccgtgca
501 gcatgcgttg ctgtgccatg gtgatgtaga ggcgtttgcg ggcgcgggtg
551 atggcgacgt acatgaggcg gcgttcttct tcgaggccgc cgcgctcggc
601 aaggctcatt tcgctgggga aacgcccctc ttccataccg gtgaggaaga
651 cggcgttgaa ttccaagcct ttggcggcgt ggacggtcat cagttggacg
701 gctttttcgc ctgcccctgc ttggttttcg ccggattcga gggcggcgtt
751 gctcaagaag gcgaggatgg ggaaggcggg atcgtctga
```

This corresponds to the amino acid sequence <SEQ ID 1544. ORF 535.ng>:

g535.pep

```
  1 MPFPVFRQXF AXSLLRFFAV GRILESDISN SGFSETINAS NVFFVGYEYP
 51 ACISNLHRFQ FRKLGIQFFH ALFAEVDGQS GGFAFVCGID NHAGAEFGVT
101 DVLSDAEACV GLRLFEVIDD FVPLYGGLAR VAVAVEGGFF DGQVVQYFWR
151 DFFDEAGCDA ELGLSVQHAL LCHGDVEAFA GAGDGDVHEA AFFFEAAALG
201 KAHFAGETPL FHTGEEDGVE FQAFGGVDGH QLDGFFACPC LVFAGFEGGV
251 AQEGEDGEGG IV*
```

The following partial DNA sequence was identified in *N. meningitidis* <SEQ ID 1545>:

m535.seq

```
  1 aTGCCCTTtC CCGTTTTCAG ACGGCCTTTT GCTTTGTCCT TACTtACGTT
 51 TTTTGCCGTA AGTCAGATTC TTGTATCCGA CATTTCCAAC AGCGGTGTTT
101 CGGAAACAAT AGACGCGTCA AATGTTTTTG TCGGATACGA ATATCCGACC
151 TACATTTCAA ATTTACATCT CTTCCAATTT CGCAAACTTG GTGTCCAACT
201 CTTTCACGCC CTGTTTGCCG AAATTGATGG TCAGTCGGGC GGATTCGCCT
251 TTATCTGCGG CATCGATAAT CACGCCGGTG CCGAATTTGG CGTGGCGGAC
301 GTTTTGTCCG ATACGGAAAC CTGCGTAGGT TTGGGGCTGT TTGTAGTCGT
351 CGATGATTTT ATCTTTGGAT GCGGCGGTTT GGCGCGTGTT GCCGTAACTG
401 TCGTAGGCAG GCTTTTTGAC GGACAGGTAG TGCAATACTT CGGGTGGGAT
451 CTCTTCGACG AAGCGGGAGA CGATGCCGAA TTGGGTTTGT CCGTGCAGCA
501 TGCGTTGTTG CGCCATGGTG ATGTAGAGGC GTTTGCGGGC GCGGGTGATG
```

-continued

```
551 GCGACGTACA TGAGGCGGCG TTCTTCTTCG AGGCCGCCGC GTTCGGCAAG

601 GCTCATTTCG CTGGGGAAGC GGCCTTCTTC CATGCCGGTG AGGAAGACGG

651 CGTTAAATTC CAAGCCTTTG GCGGCGTGGA CGGTCATGAG TTGGACGGCC

701 TTTTCGCCTG CGCCTGCCTG GTTTTCACCG GATTCGAGGG CGGCATTGCT

751 TAGGAAGGCG AGAATGGGGA AGGCGGGGTC GTCTGA
```

This corresponds to the amino acid sequence <SEQ ID 1546; ORF 535>:

m535.pep

```
  1 MPFPVFRRPF ALSLLTFFAV SQILVSDISN SGVSETIDAS NVFVGYEYPT

 51 YISNLHLFQF RKLGVQLFHA LFAEIDGQSG GFAFICGIDN HAGAEFGVAD

101 VLSDTETCVG LGLFVVVDDF IFGCGGLARV AVTVVGRLFD GQVVQYFGWD

151 LFDEAGDDAE LGLSVQHALL RHGDVEAFAG AGDGDVHEAA FFFEAAAFGK

201 AHFAGEAAFF HAGEEDGVKF QAFGGVDGHE LDGLFACACL VFTGFEGGIA

251 XEGENGEGGV V*
```

Computer analysis of this amino acid sequence gave the following results:

Homology with a predicted ORF from *N. gonorrhoeae*

ORF 535 shows 80.9% identity over a 262 aa overlap with a predicted ORF (ORF 535.ng) from *N. gonorrhoeae*:

m535/g535

```
                   10        20        30        40         50       59
m535.pep   MPFPVFRRPFALSLLTFFAVSQILVSDISNSGVSETIDASNVF-VGYEYPTYISNLHLFQ
           |||||||: || ||| ||||::|| ||||||| ||||:||||| ||||||: ||||| ||
g535       MPFPVFRQXFAXSLLRFFAVGRILESDISNSGFSETINASNVFFVGYEYPACISNLHRFQ
                   10        20        30        40        50        60

          60        70        80        90       100       110       119
m535.pep   FRKLGVQLFHALFAEIDGQSGGFAFICGIDNHAGAEFGVADVLSDTETCVGLGLFVVVDD
           |||||:|:|||||||:|||||||||:|||||||||||||:|||||:|:|||| || |:||
g535       FRKLGIQFFHALFAEVDGQSGGFAFVCGIDNHAGAEFGVTDVLSDAEACVGLRLFEVIDD
                   70        80        90       100       110       120

         120       130       140       150       160       170       179
m535.pep   FIFGCGGLARVAVTVVGRLFDGQVVQYFGWDLFDEAGDDAELGLSVQHALLRHGDVEAFA
           |:   ||||||||:| | :|||||||||  |:||||| ||||||||||||| ||||||||
g535       FVPLYGGLARVAVAVEGGFFDGQVVQYFWRDFFDEAGCDAELGLSVQHALLCHGDVEAFA
                  130       140       150       160       170       180

         180       190       200       210       220       230       239
m535.pep   GAGDGDVHEAAFFFEAAAFGKAHFAGEAAFFHAGEEDGVKFQAFGGVDGHELDGLFACAC
           ||||||||||||||||||:||||||||: :||:||||||:||||||||||:|||:||| |
g535       GAGDGDVHEAAFFFEAAALGKAHFAGETPLFHTGEEDGVEFQAFGGVDGHQLDGFFACPC
                  190       200       210       220       230       240

         240       250       260
m535.pep   LVFTGFEGGIAXEGENGEGGVV
           |||:|||||:| |||:||||:|
g535       LVFAGFEGGVAQEGEDGEGGIV
                  250       260
```

The following partial DNA sequence was identified in *N. meningitidis* <SEQ ID 1547>:

a535.seq (partial)

```
  1 TTCAGACGGC CTTTTGCCTT GTCCTTGCTA CAGTTTTTTG CCATAGGTCG

 51 GATTCTCGAA TCCGACATTT CCAACAGCGG TTTTTCGGAA ACGATAGACG
```

-continued

```
101 CGTCAAATAT TTTTGTCGGA TACGAGTATC CAGCCTGCAT TTCAAATTTA

151 CATCGCTTCC AATTTCGCAA ACTTGGTGTC CAACTCTTTC ACGCCCTGTT

201 TGCCGAAATT GATGGTCAGT CGGGCGGATT CGCCTTTATC TGCGGCATCG

251 ATAATCACGC CGGTGCCGAA TTTGGCGTGG CGGACGTTTT GTCCGATACG

301 GAAACCTGCG TAGGTTTGGG GCTGTTTGTA GTCGTCGATG ATTTTGTCTT

351 TGGGCGCGGC GGTTTGGCGC GTGTTGCCAT AGCGGTCGTA GGCGGGTTTT

401 TTGACGGACA GGTAGTGCAA TACTTCGGGC GGGATTTCTT CGACGAAGCG

451 GGAGACGATG CCGAATTGGG TTTGTCCGTG CAGCATGCGT TGTTGCGCCA

501 TGGTGATGTA GAGGCGTTTG CGGGCGCGGG TGATGGCGAC GTACATCAGG

551 CGGCGTTCTT CTTCGAGGCC GCCGCGTTCG GCAAGGCTCA TTTCGCTGGG

601 GAAGCGGCCT TCTTCCATGC CGGTGAGGAA TACGGCGTTA AATTCCAAGC

651 CTTTGGCGGC GTGCACGGTC ATGAGTTGTA CGGCTTTTTC GCCCGCGCCT

701 GCTTGGTTTT CGCCGGATTC GAGAGCAGCA TTGCTTAGGA AAGCGAGGAT

751 GGGGAAGGCG GGGTCGTCTG A
```

This corresponds to the amino acid sequence <SEQ ID 1548; ORF 535.a>:

a535.pep (partial)

```
  1 FRRPFALSLL QFFAIGRILE SDISNSGFSE TIDASNIFVG YEYPACISNL

 51 HRFQFRKLGV QLFHALFAEI DGQSGGFAFI CGIDNHAGAE FGVADVLSDT

101 ETCVGLGLFV VVDDFVFGRG GLARVAIAVV GGFFDGQVVQ YFGRDFFDEA

151 GDDAELGLSV QHALLRHGDV EAFAGAGDGD VHQAAFFFEA AAFGKAHFAG

201 EAAFFHAGEE YGVKFQAFGG VHGHELYGFF ARACLVFAGF ESSIA*ESED

251 GEGGVV*
```

m535/a535 88.7% identity in 256 aa overlap

```
                   10        20        30        40        50        60
m535.pep   MPFPVFRRPFALSLLTFFAVSQILVSDISNSGVSETIDASNVFVGYEYPTYISNLHLFQF
                |||||||||| |||:::|| ||||||| ||||||||:|||||||: ||||| |||
a535            FRRPFALSLLQFFAIGRILESDISNSGFSETIDASNIFVGYEYPACISNLHRFQF
                        10        20        30        40        50

                   70        80        90       100       110       120
m535.pep   RKLGVQLFHALFAEIDGQSGGFAFICGIDNHAGAEFGVADVLSDTETCVGLGLFVVVDDF
           ||||||||||||||||||||||||||||||||||||||||||||||||||||||||||||
a535       RKLGVQLFHALFAEIDGQSGGFAFICGIDNHAGAEFGVADVLSDTETCVGLGLFVVVDDF
              60        70        80        90       100       110

                  130       140       150       160       170       180
m535.pep   IFGCGGLARVAVTVVGRLFDGQVVQYFGWDLFDEAGDDAELGLSVQHALLRHGDVEAFAG
           :|| |||||||::||| :|||||||||| |:|||||||||||||||||||||||||||||
a535       VFGRGGLARVAIAVVGGFFDGQVVQYFGRDFFDEAGDDAELGLSVQHALLRHGDVEAFAG
             120       130       140       150       160       170

                  190       200       210       220       230       240
m535.pep   AGDGDVHEAAFFFEAAAFGKAHFAGEAAFFHAGEEDGVKFQAFGGVDGHELDGLFACACL
           |||||||:||||||||||||||||||||||||||| |||||||||| |||| |:|| |||
a535       AGDGDVHQAAFFFEAAAFGKAHFAGEAAFFHAGEEYGVKFQAFGGVHGHELYGFFARACL
             180       190       200       210       220       230

                  250       260
m535.pep   VFTGFEGGIAXEGENGEGGVVX
           ||:|||::||||:|:|||||||
a535       VFAGFESSIAXESEDGEGGVVX
             240       250
```

The following partial DNA sequence was identified in *N. gonorrhoeae* <SEQ ID 1549>:

g537.seq

```
   1 atgaaatccc tttttatttg gctgcttcta ttgggctcgg cggcaggcgt
  51 tttctaccat acccaaaacc aatccctgcc cgcgggcgaa cttgtctatc
 101 cgtccgcacc gcaaatcagg gacggcggcg atgcgctgca ctacctcaac
 151 cgcatccgca cacaaatcgg tttgcacgcg ctggcacacg cgccggtttt
 201 ggaaaattcc gcccgcaggc acgcacgcta tctcacgctc aatcccgaag
 251 acggacacgg cgaacaccat cccgacaatc cgcactacac cgcacaaaag
 301 ctgaccgaac gcacacgcct tgccgggtat ctctacaacg gcgtgcatga
 351 aaacatcagc acggaagagg aagccgccga atcgtccgac agcgacatcc
 401 gcacgcagca acgccaagtg gacgctttga tgagcgcaat ctaccaccgc
 451 ctttcgctgc ttgaacgcca taccgacgaa gcaggtgcgg catttgtgcg
 501 cgaaaacggc aaaaccgtcc tcgtattcaa tcagggcaac ggcagcttcg
 551 agcgcgcctg tgcaaaagga aggcggcagc cggaagcagg acggaaatat
 601 taccgcaacg cttgccacaa cggtgcggcc gtttatgctg acgaagccat
 651 gcccgtaacg gaattgcttt ataccgccta tccggttggc ggcggcgcgc
 701 tgccttattt ttacggggaa cgtcccgacc ccgtgccgga atatgaaatc
 751 acaggcaatc ctgccagcat tgatttttcc gaggcggcag gcaaaattgc
 801 gatgaaaagt ttcaagctgt atcagggtaa aaacgaaatc cgccccgtca
 851 gggttttaac cgccggcaac gaccctaacg gcaggctgac cgcgcaccaa
 901 ttcgcccttt tcccgctcaa acctttggaa tacggcacgc tttatacggc
 951 ggtattcgac tatgtccgca acggacggca cgcgcaggcg aaatggcagt
1001 ttagaacccg aaaacccgat tacccttatt ttgaggtaaa cggcggcgag
1051 acacttgcgg ttagaaaagg cgaaaaatat ttcatccact ggcgcggacg
1101 ctggtgtctg gaagcgtgta cccgttatac ctaccggcgg cagttcggca
1151 acagcctgtc catactccgg cacgaagcgg gcggcattgt cttcagcgtc
1201 agcggaatgg cgggaagccg catcaggctt actccggaag acagcccgga
1251 acgcggtgta accctttatt tgcaggattg a
```

This corresponds to the amino acid sequence <SEQ ID 1550; ORF 537.ng>:

g537.pep

```
   1 MKSLFIWLLL LGSAAGVFYH TQNQSLPAGE LVYPSAPQIR DGGDALHYLN
  51 RIRTQIGLHA LAHAPVLENS ARRHARYLTL NPEDGHGEHH PDNPHYTAQK
 101 LTERTRLAGY LYNGVHENIS TEEEAAESSD SDIRTQQRQV DALMSAIYHR
 151 LSLLDRHTDE AGAAFVRENG KTVLVFNQGN GSFERACAKG RRQPEAGRKY
 201 YRNACHNGAA VYADEAMPVT ELLYTAYPVG GGALPYFYGE RPDPVPEYEI
 251 TGNPASIDFS EAAGKIAMKS FKLYQGKNEI RPVRVLTAGN DPNGRLTAHQ
 301 FALFPLKPLE YGTLYTAVFD YVRNGRHAQA KWQFRTRKPD YPYFEVNGGE
```

-continued

```
351 TLAVRKGEKY FIHWRGRWCL EACTRYTYRR QFGNSLSILR HEAGGIVFSV

401 SGMAGSRIRL TPEDSPERGV TLYLQD *
```

The following partial DNA sequence was identified in *N. meningitidis* <SEQ ID 1551>:

m537.seq (partial)

```
  1 ATGAAATCCC TTTTTATTCG GCTGCTCCTG TTGGGTTCGG CGGCAGGCGT

 51 TTTCTACCAT ACCCAAAmCC AATCCCTGCC CGCGGGCGAA CTTGTCTATC

101 CGTCCGCACC GCAAATCAGG GACGGCGGCG ATGCGCTGCA CTACCTCAAC

151 CGCATCCGAG CCCAAATCGG TTTGCACAAG CTGGCACACG CGCCGGTTTT

201 GGAAAACTCC GCCCGCAgGC ACGCAAGCTA CCTCACGCTC AATCCCGAAG

251 ACGGACACGG CGAACACCAT CCCGACAATC CGCACTACAC CGCACAAAAG

301 CTGACCGAAC GCACACGCCT TGCCGGGTAT CTCTACAACG GCGTGCATGA

351 AAACATCAGC ACGGAAGAAG AAGCCGCCGA ATCGTCCGAC AGCGACATCC

401 GCACGCAGCA ACGCCAAGTG GACGGATTAA TGAGCGCAAT CTACCACCGC

451 CTTTCCCTAC TTGACCGCCA TACGGATGAG TCAGGAGCGG CATT...
```

This corresponds to the amino acid sequence <SEQ ID 1552; ORF 537>:

m537.pep (partial)

```
  1 MKSLFIRLLL LGSAAGVFYH TQXQSLPAGE LVYPSAPQIR DGGDALHYLN

 51 RIRAQIGLHK LAHAPVLENS ARRHASYLTL NPEDGHGEHH PDNPHYTAQK

101 LTERTRLAGY LYNGVHENIS TEEEAAESSD SDIRTQQRQV DGLMSAIYHR

151 LSLLDRHTDE SGAA...
```

Computer analysis of this amino acid sequence gave the following results:

Homology with a predicted ORF from *N. gonorrhoeae*

ORF 537 shows 95.7% identity over a 164 aa overlap with a predicted ORF (ORF 537.ng) from *N. gonorrhoeae*:

m537/g537

```
                   10        20        30        40        50        60
m537.pep   MKSLFIRLLLLGSAAGVFYHTQXQSLPAGELVYPSAPQIRDGGDALHYLNRIRAQIGLHK
           |||||| |||||||||||||| |||||||||||||||||||||||||||||:|||||
g537       MKSLFIWLLLLGSAAGVFYHTQNQSLPAGELVYPSAPQIRDGGDALHYLNRIRTQIGLHA
                   10        20        30        40        50        60

                   70        80        90       100       110       120
m537.pep   LAHAPVLENSARRHASYLTLNPEDGHGEHHPDNPHYTAQKLTERTRLAGYLYNGVHENIS
           |||||||||||||| |||||||||||||||||||||||||||||||||||||||||||||
g537       LAHAPVLENSARRHARYLTLNPEDGHGEHHPDNPHYTAQKLTERTRLAGYLYNGVHENIS
                   70        80        90       100       110       120

                  130       140       150       160
m537.pep   TEEEAAESSDSDIRTQQRQVDGLMSAIYHRLSLLDRHTDESGAA
           ||||||||||||||||||||:|||||||||||||||||:|||
g537       TEEEAAESSDSDIRTQQRQVDALMSAIYHRLSLLDRHTDEAGAAFVRENGKTVLVFNQGN
                  130       140       150       160       170       180

g537       GSFERACAKGRRQPEAGRKYYRNACHNGAAVYADEAMPVTELLYTAYPVGGGALPYFYGE
                  190       200       210       220       230       240
```

The following partial DNA sequence was identified in *N. meningitidis* <SEQ ID 1553>:

a537.seq

```
   1 ATGAAATCCC TTTTTATTCG GCTGCTCCTG TTGGGTTCGG CGGCCGGCGT
  51 TTTCTATCAT ACCCAAAACC AATCCCTGCC CGCGGGCGAA CTTGTCTATC
 101 CGTCCGCACC GCAAATCAGG GACGGCGGCG ATGCGCTGCA CTACCTCAAC
 151 CGCATCCGCG CCCAAATCGG TTTGCACAAG CTGGCACACG CGCCGGTTTT
 201 GGAAAATTCC GCCCGCAGGC ACGCACGCTA TCTCACGCTC AATCCCGAAG
 251 ACGGACACGG CGAACACCAT CCCGACAATC CGCACTACAC CGCACAAAAG
 301 CTGACCGAAC GCACACGCCT TGCCGGGTAT CTCTACAACG GCGTGCATGA
 351 AAACATCAGC ACGGAAGAGG AAGCCGCCGA ATCGTCCGAC AGCGACATCC
 401 GCACGCAGCA ACGCCAAGTG GACGGATTAA TGAGCGCAAT CTACCACCGC
 451 CTTTCCCTAC TTGACCGCCA TACGGATGAG GCAGGAGCGG CATTTGTGCG
 501 CGAAAACGGT AAAACCGTTC TCGTATTCAA TCAGGGCAAC GGCAGGTTTG
 551 AGCGGCATTG CGCCCAAGGC AGAAATCAGC CGGAAGCAGG ACGGAAATAT
 601 TACCGCAACG CCTGCCATAA CGGTGCGGTC GTGTACACCG ACGAAGCCAT
 651 GCCCGCACAG GAGCTGCTCT ATACAGCCTA TCCCGTCGGC AACGGCGCAC
 701 TGCCTTATTT CCACGGCGAG CGTCCAGACC CCGTGCCGGA ATATGAAATC
 751 ACGGGCAATC CTGCCAGCAT TGATTTTTCC GAGGCGGCAG GCAAAATTAC
 801 GATGAAAAGT TTCAAGCTGT ATCAGGGTAA AAACGAAATC CGCCCCGTCA
 851 GGGTTTTAAC CGCCGGCAAC GACCCCAACG GCAGGCTGAC CGCGTACCAA
 901 TTCGCGCTTT TCCCGCTCAA GCCTTTGGAA TACGGTACGC TTTATACGGC
 951 GGTATTCGAC TATGTCCGCA ACGGACGGCG CGCGCAGGCG AAATGGCAGT
1001 TTAGAACCCG AAAACCCGAT TACCCTTATT TTGAGGTAAA CGGCGGCGAG
1051 ACACTTGCGG TTAGAAAAGG CGAAAAATAT TTCATCCACT GGCGCGGACG
1101 CTGGTGTTTG GAAGCGTGTA CCCGTTATAC CTACCGGCAG CGACCCGGCA
1151 GCCGCCTGTC CATAGGAAGG CACAAGGCGG GCGGCATCGT CTTCAGCGTT
1201 GACGGAATGG CGGGCAGCCG CATCACGCTT GCACCGGAAG GAGAAACGGA
1251 ACGAGGCGTA ACCCTTTATT TACAGGATTG A
```

This corresponds to the amino acid sequence <SEQ ID 1554; ORF 537.a>:

a537.pep

```
   1 MKSLFIRLLL LGSAAGVFYH TQNQSLPAGE LVYPSAPQIR DGGDALHYLN
  51 RIRAQIGLHK LAHAPVLENS ARRHARYLTL NPEDGHGEHH PDNPHYTAQK
 101 LTERTRLAGY LYNGVHENIS TEEEAAESSD SDIRTQQRQV DGLMSAIYHR
 151 LSLLDRHTDE AGAAFVRENG KTVLVFNQGN GRFERHCAQG RNQPEAGRKY
 201 YRNACHNGAV VYTDEAMPAQ ELLYTAYPVG NGALPYFHGE RPDPVPEYEI
 251 TGNPASIDFS EAAGKITMKS FKLYQGKNEI RPVRVLTAGN DPNGRLTAYQ
 301 FALFPLKPLE YGTLYTAVFD YVRNGRRAQA KWQFRTRKPD YPYFEVNGGE
 351 TLAVRKGEKY FIHWRGRWCL EACTRYTYRQ RPGSRLSIGR HKAGGIVFSV
 401 DGMAGSRITL APEGETERGV TLYLQD*
```

m537/a537 98.2% identity in 164 aa overlap

```
                   10        20        30        40        50        60
m537.pep   MKSLFIRLLLLGSAAGVFYHTQXQSLPAGELVYPSAPQIRDGGDALHYLNRIRAQIGLHK
           ||||||||||||||||||||| ||||||||||||||||||||||||||||||||||||||
a537       MKSLFIRLLLLGSAAGVFYHTQNQSLPAGELVYPSAPQIRDGGDALHYLNRIRAQIGLHK
                   10        20        30        40        50        60

                   70        80        90       100       110       120
m537.pep   LAHAPVLENSARRHASYLTLNPEDGHGEHHPDNPHYTAQKLTERTRLAGYLYNGVHENIS
           ||||||||||||||| ||||||||||||||||||||||||||||||||||||||||||||
a537       LAHAPVLENSARRHARYLTLNPEDGHGEHHPDNPHYTAQKLTERTRLAGYLYNGVHENIS
                   70        80        90       100       110       120

                  130       140       150       160
m537.pep   TEEEAAESSDSDIRTQQRQVDGLMSAIYHRLSLLDRHTDESGAA
           ||||||||||||||||||||||||||||||||||||||||:|||
a537       TEEEAAESSDSDIRTQQRQVDGLMSAIYHRLSLLDRHTDEAGAAFVRENGKTVLVFNQGN
                  130       140       150       160       170       180

a537       GRFERHCAQGRNQPEAGRKYYRNACHNGAVVYTDEAMPAQELLYTAYPVGNGALPYFHGE
                  190       200       210       220       230       240
```

The following partial DNA sequence was identified in *N. gonorrhoeae* <SEQ ID 1555>:

g538.seq

```
   1 atgtcaggta gaacaggacg gaacagtgcc actcaggcgc aaccggaacg
  51 cgtcatgctg gtgggcgtaa tgttggataa agatgatacg ggcagcaatg
 101 ccgcccgtct gaacggtttt cagacggcat tggcggaagc cgtcgagctg
 151 gtcaaagcgg cgggcggcga ttccgtacgc gtggagactg ccaaacgcga
 201 ccgcccgcac actgcgctgt ttgtcggcac gggcaaggcg gcggagctgt
 251 cggaagcagt tgccgcagac ggcattgatt tggtcgtatt caaccacgaa
 301 cttactccca cgcaggaacg caatttggaa aaaatcctcc aatgccgcgt
 351 attggacaga gtggggctga ttctggcgat tttcgcccgc cgcgcccgca
 401 cgcaggaagg caggctgcaa gtcgagttgg cgcaattgag ccatttggcg
 451 ggacgcttga tacgcggtta cggacatttg caaagccagc gcggcggtat
 501 cggcatgaaa gggccgggcg aaaccaaact ggaaaccgac cgccgattaa
 551 ccgcccatcg gatcaacgcc ttgaaaaaac agcttgccaa cctcaaaaaa
 601 cagcgcgccc tgcgccgcaa gtcccgcgag tcgggcagaa tcaaaaacgtt
 651 tgcgctggtc ggctatacca atgtcggcaa atccagcctg ttcaaccggc
 701 tgaccaagtc gggcatatat gcgaaagacc agcttttcgc cactctcgac
 751 acgacggcgc ggcggctgta catcagtccc gcatgcagca ttatcctgac
 801 cgataccgtc ggattcgtca gcgatctgcc gcacaaactg atttccgcct
 851 tttccgccac cttggaagaa accgtgcaag ccgatgtgct gctgcacgtc
 901 gtcgatgctg ccgcccggaa cagcgggcag cagattgaag acgtggaaaa
 951 cgtactgcaa gaaatccatg cccacgatat tccgtgcatc aaggtgtaca
1001 acaaaaccga cctgctgccg tctgaagaac aaaacacggg catatggcgc
1051 gacgctgcgg gaaaaattgc cgccgtccgc atttccgttg ctgaaaatac
```

This corresponds to the amino acid sequence <SEQ ID 1556; ORF 538.ng>:

g538.pep

```
  1 MSGRTGRNSA TQAQPERVML VGVMLDKDDT GSNAARLNGF QTALAEAVEL
 51 VKAAGGDSVR VETAKRDRPH TALFVGTGKA AELSEAVAAD GIDLVVFNHE
101 LTPTQERNLE KILQCRVLDR VGLILAIFAR RARTQEGRLQ VELAQLSHLA
151 GRLIRGYGHL QSQRGGIGMK GPGETKLETD RRLTAHRINA LKKQLANLKK
201 QRALRRKSRE SGRIKTFALV GYTNVGKSSL FNRLTKSGIY AKDQLFATLD
251 TTARRLYISP ACSIILTDTV GFVSDLPHKL ISAFSATLEE TVQADVLLHV
301 VDAAARNSGQ QIEDVENVLQ EIHAHDIPCI KVYNKTDLLP SEEQNTGIWR
351 DAAGKIAAVR ISVAENTGID ALREAIAEYC AAAPNTDETE MP*
```

The following partial DNA sequence was identified in *N. meningitidis* <SEQ ID 1557>:

m538.seq

```
   1 ATGACAGGCA GAACAGGCGG CAACGGCAGT ACCCAAGCGC AACCCGAACG
  51 CGTCATGCTG GTGGGCGTAA TGTTGGACAA AGATGGTACG GGCAGTAGTG
 101 CCGCCCGTCT GAACGGTTTT CAGACGGCAT TGGCGGAAGC TGTCGAGCTG
 151 GTCAAAGCGG CGGGCGGCGA TTCCGTGCGC GTGGAGACTG CCAAACGCGA
 201 CCGTCCGCAC ACCGCGCTGT TTGTCGGCAC GGGCAAGGCG GCGGAGCTGT
 251 CAGAAGCAGT TGCCGCAGAC GGCATCGATT TGGTCGTATT CAACCACGAA
 301 CTCACGCCCA CGCAGGAACG CAACCTTGAA AAAGAACTsA AATGCCGCGT
 351 ATTGGACAGG GTAGGGCTGA TTCTGGCGAT TTTCGCTCGC CGCGCCCGCA
 401 CGCAGGAAGG CAGGCTGCAA GTCGAGTTGG CGCAATTGAG CCATTTGGCG
 451 GGACGCTTGA TACGCGGTTA CGGCCATCTG CAGAGCCAGC GCGGCGGTAT
 501 CGGCATGAAA GGCCCCGGCG AAACCAAACT GGAAACCGAC CGCCGATTGA
 551 TCGCCCATCG GATCAATGCC TTGATAAAAC AGCTTGCCAA CCTCAAAAAA
 601 CAGCGCGCCC TGCGCCGCAA GTCnCGCGAA TCGGGCACAA TCAAAACGTT
 651 TGCGCTGGTC GGCTATACAA ATGTCGGAAA ATCCAGCCTG TTCAACCGGC
 701 TGACAAAGTC GGGCATATAT GCAAAGGACA AGCTTAGTCC CGAATGCAGC
 751 ATTATCCTGA CCGATACCGT CGGATTCGTn AGCGATCTGC CGCAcAAACT
 801 GATTTCCGCC TTTTCgCC.A CGCTGGAAGA AACCGCGCAA GCCGATGTGC
 851 TGCTGCACGT CGTCGATGCC GCCGCTCCGA ACAGCGGACA GCAGATTGAA
 901 GACGTGGAAA ACGTACTGCA AGAAATCCAT GCCGGCGATA TTCCGTGCAT
 951 cAAGGTGTAC AACAAAACCG ACCTGCTGCC GTCTGAAGAA CAAAACACGG
1001 GCATATGGCG CGACGCTGCG GGAAAAATTG CCGCCGTCCG CATTTCCGTT
1051 GCTGAAAATA CCGGTATAGA CGCACTGCGC GAAGCcATTG CCGAGTCTTG
1101 TGCCGCCGCA CCAAACACAG ACGAAACCGA AATGCCATGA
```

This corresponds to the amino acid sequence <SEQ ID 1558; ORF 538>:

m538.pep

```
  1 MTGRTGGNGS TQAQPERVML VGVMLDKDGT GSSAARLNGF QTALAEAVEL

 51 VKAAGGDSVR VETAKRDRPH TALFVGTGKA AELSEAVAAD GIDLVVFNHE

101 LTPTQERNLE KELKCRVLDR VGLILAIFAR RARTQEGRLQ VELAQLSHLA

151 GRLIRGYGHL QSQRGGIGMK GPGETKLETD RRLIAHRINA LIKQLANLKK

201 QRALRRKSRE SGTIKTFALV GYTNVGKSSL FNRLTKSGIY AKDKLSPECS

251 IILTDTVGFV SDLPHKLISA FSXTLEETAQ ADVLLHVVDA AAPNSGQQIE

301 DVENVLQEIH AGDIPCIKVY NKTDLLPSEE QNTGIWRDAA GKIAAVRISV

351 AENTGIDALR EAIAESCAAA PNTDETEMP*
```

Computer analysis of this amino acid sequence gave the following results:

Homology with a predicted ORF from *N. gonorrhoeae*

ORF 538 shows 92.1% identity over a 392 aa overlap with a predicted ORF (ORF 538.ng) from *N. gonorrhoeae*:

m538/g538

```
                      10        20        30        40        50        60
m538.pep      MTGRTGGNGSTQAQPERVMLVGVMLDKDGTGSSAARLNGFQTALAEAVELVKAAGGDSVR
              |:|||| |::|||||||||||||||||| |||:|||||||||||||||||||||||||||
g538          MSGRTGRNSATQAQPERVMLVGVMLDKDDTGSNAARLNGFQTALAEAVELVKAAGGDSVR
                      10        20        30        40        50        60

                      70        80        90       100       110       120
m538.pep      VETAKRDRPHTALFVGTGKAAELSEAVAADGIDLVVFNHELTPTQERNLEKELKCRVLDR
              ||||||||||||||||||||||||||||||||||||||||||||||||||| |:||||||
g538          VETAKRDRPHTALFVGTGKAAELSEAVAADGIDLVVFNHELTPTQERNLEKILQCRVLDR
                      70        80        90       100       110       120

                     130       140       150       160       170       180
m538.pep      VGLILAIFARRARTQEGRLQVELAQLSHLAGRLIRGYGHLQSQRGGIGMKGPGETKLETD
              ||||||||||||||||||||||||||||||||||||||||||||||||||||||||||||
g538          VGLILAIFARRARTQEGRLQVELAQLSHLAGRLIRGYGHLQSQRGGIGMKGPGETKLETD
                     130       140       150       160       170       180

                     190       200       210       220       230       240
m538.pep      RRLIAHRINALIKQLANLKKQRALRRKSRESGTIKTFALVGYTNVGKSSLFNRLTKSGIY
              ||| ||||||| ||||||||||||||||||||| ||||||||||||||||||||||||||
g538          RRLTAHRINALKKQLANLKKQRALRRKSRESGRIKTFALVGYTNVGKSSLFNRLTKSGIY
                     190       200       210       220       230       240

                                   250       260       270       280
m538.pep      AKDKL-------------SPECSIILTDTVGFVSDLPHKLISAFSXTLEETAQADVLLHV
              |||:|             || |||||||||||||||||||||||| |||||:||||||||
g538          AKDQLFATLDTTARRLYISPACSIILTDTVGFVSDLPHKLISAFSATLEETVQADVLLHV
                     250       260       270       280       290       300

              290       300       310       320       330       340
m538.pep      VDAAAPNSGQQIEDVENVLQEIHAGDIPCIKVYNKTDLLPSEEQNTGIWRDAAGKIAAVR
              ||||| |||||||||||||||||| |||||||||||||||||||||||||||||||||||
g538          VDAAARNSGQQIEDVENVLQEIHAHDIPCIKVYNKTDLLPSEEQNTGIWRDAAGKIAAVR
                     310       320       330       340       350       360

              350       360       370       380
m538.pep      ISVAENTGIDALREAIAESCAAAPNTDETEMPX
              ||||||||||||||||| |||||||||||||||
g538          ISVAENTGIDALREAIAEYCAAAPNTDETEMPX
```

The following partial DNA sequence was identified in *N. meningitidis* <SEQ ID 1559>:

a538.seq

```
  1 ATGACAGGCA GAACAGGCCG CAACGGCAGT ACCCAAGCGC AACCCGAACG

 51 CGTCATGCTG GTGGGCGTAA TGTTGGACAA AGATGGTACG GGCAGCAGTG

101 CCACCCGTCT GAACGGTTTT CAGACGGCAT TGGCGGAAGC TGTCGAGCTG
```

-continued

```
 151 GTCAAAGCGG CGGGCGGCGA TTCCGTGCGC GTGGAGACTG CCAAACGCGA
 201 CCGTCCGCAC ACCGCGCTGT TTGTCGGCAC GGGCAAGGCG GCGGAGCTGT
 251 CGGAAGCAGT TGCCGCAGAC GGCATCGATT TGGTCGTATT CAACCACGAA
 301 CTTACGCCCA CGCAGGAACG CAATTTGGAA AAAATCCTCC AATGCCGCGT
 351 ATTGGACAGA GTGGGGCTGA TTCTGGCGAT TTTCGCCCGC CGCGCCCGCA
 401 CGCAGGAAGG CAGGCTGCAA GTCGAGTTGG CACAATTGAG CCATTTGGCG
 451 GGACGCTTGA TACGCGGTTA CGGCCATCTG CAGAGCCAGC GCGGCGGTAT
 501 CGGCATGAAA GGCCCCGGCG AAACCAAACT GGAAACCGAC CGCCGATTGA
 551 TCGCCCATCG GATCAATGCC TTGAAAAAAC AGCTTGCCAA CCTCAAAAAA
 601 CAGCGCGCCC TGCGCCGCAA GTCCCGCGAA TCGGGCACAA TCAAAACGTT
 651 TGCGCTGGTC GGCTATACCA ATGTCGGCAA ATCCAGTCTG TTCAACCGGC
 701 TGACCAAGTC GGGCATATAT GCGAAAGACC AGCTTTTCGC CACACTCGAC
 751 ACGACGGCGC GGCGGCTGTA CATCAGTCCC GAATGCAGCA TTATCCTGAC
 801 CGATACCGTC GGATTCGTCA GCGATCTGCC GCACAAACTG ATTTCCGCCT
 851 TTTCCGCCAC GCTGGAAGAA ACCGCGCAAG CCGATGTGCT GCTGCACGTC
 901 GTCGATGCCG CCGCTCCGAA CAGCGGACAG CAGATTGAAG ACGTGGAAAA
 951 CGTACTGCAA GAAATCCATG CCGGCGATAT TCCGTGCATC AAGGTGTACA
1001 ACAAAACCGA CCTGCTGCCG TCTGAAGAAC AAAACACGGG CATATGGCGC
1051 GACGCTGCGG GAAAAATTGC CGCCGTCCGC ATTTCCGTTG CTGAAAATAC
1101 CGGTATAGAC GCACTGCGCG AAGCCATTGC CGAGTATTGT GCCGCCGCAC
1151 CAAACACAGA CGAAACCGAA ATGCCATGA
```

This corresponds to the amino acid sequence <SEQ ID 1560; ORF 538.a>:

a538.pep

```
  1 MTGRTGRNGS TQAQPERVML VGVMLDKDGT GSSATRLNGF QTALAEAVEL
 51 VKAAGGDSVR VETAKRDRPH TALFVGTGKA AELSEAVAAD GIDLVVFNHE
101 LTPTQERNLE KILQCRVLDR VGLILAIFAR RARTQEGRLQ VELAQLSHLA
151 GRLIRGYGHL QSQRGGIGMK GPGETKLETD RRLIAHRINA LKKQLANLKK
201 QRALRRKSRE SGTIKTFALV GYTNVGKSSL FNRLTKSGIY AKDQLFATLD
251 TTARRLYISP ECSIILTDTV GFVSDLFHKL ISAFSATLEE TAQADVLLHV
301 VDAAAPNSGQ QIEDVENVLQ EIHAGDIPCI KVYNKTDLLP SEEQNTGIWR
351 DAAGKIAAVR ISVAENTGID ALREAIAEYC AAAPNTDETE MP*
```

m538/a538 94.6% identity in 392 aa overlap

```
                   10        20        30        40        50        60
m538.pep   MTGRTGGNGSTQAQPERVMLVGVMLDKDGTGSSAARLNGFQTALAEAVELVKAAGGDSVR
           ||||||||||||||||||||||||||||||||||:|||||||||||||||||||||||||
a538       MTGRTGGNGSTQAQPERVMLVGVMLDKDGTGSSATRLNGFQTALAEAVELVKAAGGDSVR
                   10        20        30        40        50        60
```

-continued

```
                  70        80        90       100       110       120
m538.pep  VETAKRDRPHTALFVGTGKAAELSEAVAADGIDLVVFNHELTPTQERNLEKELKCRVLDR
          ||||||||||||||||||||||||||||||||||||||||||||||||||| |:||||||
a538      VETAKRDRPHTALFVGTGKAAELSEAVAADGIDLVVFNHELTPTQERNLEKILQCRVLDR
                  70        80        90       100       110       120

                 130       140       150       160       170       180
m538.pep  VGLILAIFARRARTQEGRLQVELAQLSHLAGRLIRGYGHLQSQRGGIGMKGPGETKLETD
          ||||||||||||||||||||||||||||||||||||||||||||||||||||||||||||
a538      VGLILAIFARRARTQEGRLQVELAQLSHLAGRLIRGYGHLQSQRGGIGMKGPGETKLETD
                 130       140       150       160       170       180

                 190       200       210       220       230       240
m538.pep  RRLIAHRINALIKQLANLKKQRALRRKSRESGTIKTFALVGYTNVGKSSLFNRLTKSGIY
          ||||||||||| ||||||||||||||||||||||||||||||||||||||||||||||||
a538      RRLIAHRINALKKQLANLKKQRALRRKSRESGTIKTFALVGYTNVGKSSLFNRLTKSGIY
                 190       200       210       220       230       240

                             250       260       270       280
m538.pep  AKDKL-------------SPECSIILTDTVGFVSDLPHKLISAFSXTLEETAQADVLLHV
          |||:|             ||||||||||||||||||||||||||| ||||||||||||||
a538      AKDQLFATLDTTARRLYISPECSIILTDTVGFVSDLPHKLISAFSATLEETAQADVLLHV
                 250       260       270       280       290       300

          290       300       310       320       330       340
m538.pep  VDAAAPNSGQQIEDVENVLQEIHAGDIPCIKVYNKTDLLPSEEQNTGIWRDAAGKIAAVR
          ||||||||||| ||||||||||||||||||||||||||||||||||||||||||||||||
a538      VDAAAPNSGQQIEDVENVLQEIHAGDIPCIKVYNKTDLLPSEEQNTGIWRDAAGKIAAVR
                 310       320       330       340       350       360

          350       360       370       380
m538.pep  ISVAENTGIDALREAIAESCAAAPNTDETEMPX
          ||||||||||| |||||| ||||||||||||||
a538      ISVAENTGIDALREAIAEYCAAAPNTDETEMPX
                 370       380       390
```

The following partial DNA sequence was identified in *N. gonorrhoeae* <SEQ ID 1561>:

g539.seq

```
   1 atggaggatc tgcaggaaat cgggttcgat gtcgccgccg taaaggtagg
  51 tcggcagcgc gaacatcatc gtctgcatca tacccagtcc ggcaacggca
 101 aggcggacga tgtattgttt gcgttctttt tggttggcgg cttcgatttt
 151 ttgcgcgtca tagggtgcgg cggtgtagcc tgtctgccgg attttcaaca
 201 gaatgtcgga gaggcggatt ttgccgtcgt cccagacgac gcggcagcgg
 251 tgcgtgctgt aattgaggtc gatgcggacg atgccgtctg tgcgcaaaag
 301 ctgctgttcg atcagccaga cgcaggcggc gcaggtaatg ccgctgagca
 351 tcagcactgc ttcgtgcgtg ccattatggg tttccacaaa gtcggattgg
 401 acttcgggca ggtcgtacag gcggatttgg tcgaggattt cttggggcgg
 451 cagttcggtt tttttcgcgt cggcggtgcg tcgtttgtaa taactgccca
 501 agccggaatc gatgatgctt tgtgcgactg cctgacagcc gacgcagcag
 551 gtttcgcggt cttcgccttc gtagcggacg gtcagatgca ggttttcggg
 601 aacgtccagc ccgcagtgga aacaggtttt tttcatggca tttcggtttc
 651 gtctgtgttt ggtgcggcgg cacaatactc ggcaatggct tcgcgcagtg
 701 cgtctatacc ggtattttca gcaacggaaa tgcggacggc ggcaattttt
 751 cccgcagcgt cgcgccatat gcccgtgttt tgttcttcag acggcagcag
 801 gtcggttttg ttgtacacct tgatgcacgg aatatcgtgg gcatggattt
 851 cttgcagtac gttttccacg tcttcaatct gctgcccgct gttccgggcg
 901 gcagcatcga cgacgtgcag cagcacatcg gcttgcacgg tttcttccaa
 951 ggtggcggaa aaggcggaaa tcagtttgtg cggcagatcg ctgacgaatc
1001 cgacggtatc ggtcaggata atgctgcatg cgggactgat gtacagccgc
```

-continued

```
1051 cgcgccgtcg tgtcgagagt ggcgaaaagc tggtctttcg catatatgcc

1101 cgacttggtc agccggttga acaggctgga tttgccgaca ttggtatag
```

This corresponds to the amino acid sequence <SEQ ID 1562; ORF 539.ng>:

g539.pep

```
  1 MEDLQEIGFD VAAVKVGRQR EHHRLHHTQS GNGKADDVLF AFFLVGGFDF

 51 LRVIGCGGVA CLPDFQQNVG EADFAVVPDD AAAVRAVIEV DADDAVCAQK

101 LLFDQPDAGG AGNAAEHQHC FVRAIMGFHK VGLDFGQVVQ ADLVEDFLGR

151 QFGFFRVGGA SFVITAQAGI DDALCDCLTA DAAGFAVFAF VADGQMQVFG

201 NVQPAVETGF FHGISVSSVF GAAAQYSAMA SRSASIPVFS ATEMRTAAIF

251 PAASRHMPVF CSSDGSRSVL LYTLMHGISW AWISCSTFST SSICCPLFRA

301 AASTTCSSTS ACTVSSKVAE KAEISLCGRS LTNPTVSVRI MLHAGLMYSR

351 RAVVSRVAKS WSFAYMPDLV SRLNRLDLPT LV*
```

The following partial DNA sequence was identified in *N. meningitidis* <SEQ ID 1563>:

m539.seq (partial)

```
   1 ATGGAGGATT TGCAGGAAAT CGGGTTCGAT GTCGCCGCCG TAAAGGTAGG

  51 TCGGCAGCGC GAACATCATC GTCTGCATCA TCCCCAGCCC GGCAACGGCG

 101 AGGCGGACGA TGTATTGTTT GCGTTCTTTT TGGTTGGCGG CTTCGATTTT

 151 TTGCGCGTCA TAGGGTGCGG CGGTGTAGCC TATCTGCCTG ATTTTCAACA

 201 GAATGTCGGA AAGGCGGATT TTGCCGTCGT CCCAGACGAc GCGGCaGCgG

 251 TGCGTGCTGT AATTGAGGTC GATGCGGACG ATGCCGTCTG TACGCAAAAG

 301 CTGCTGTTCG ATCAGCCAGA CGCAGGCGGC GCAGGTGATG CCGCCGAGCA

 351 TTAAAACCGC CTCGCGCGTG CCGCCGTGGG TTTCCACAAA GTCGGACTGG

 401 ACTTCGGGCA GGTCGTACAG GCGGATTTGG TCGAGGATTT CTTGGGGCGG

 451 CAgCTCGGTT TTTTGCGCGT CGGCGGTGCG TTGTTTGTAA TAACTGCCCA

 501 AGCCCGCGTC AATAATGCTT TGTGCGACCG CCTGACAGCC GGCGCaCAgG

 551 GTTTCGCGGT CTTCGTTTTC GTAACGGACA GTCAGGTGGA GGTGTTCGGG

 601 AACATCCAGA CCGCAGTGGA AACAGGTTTT TTTCATGGCA TTTCGGTTTC

 651 GTCTGTGTTT GGTGCGGCGG CACAAGACTC GGCAATgGCT TCGCGCAGTG

 701 CGTCTATACC GGTATTTTCA GCAACGGAAA TGCGGACGGC GGCAATTTTT

 751 CCCGCAGCGT CGCGCCATAT GCCCGTGTTT TGTTCTTCAG ACGGCAGCAG

 801 GTCGGTTTTG TTGTACACCT TgATGCACGG AATATCGCCG GCATGGATTT

 851 CTTGCAGTAC GTTTTCCACG TCTTCAATCT GCTGTCCGCT GTTCGGAGCG

 901 GCGGCATCGA CGACGTGCAG CAGCACATCG GCTTGCGCGG TTTCTTCCAG

 951 CGTGGcG.AA AAGGCGGAAA TCAGTTTgTG CGGCAGATCG CTnACGAATC

1001 CGACGGTATC GGTCAGGATA ATGCTGCATT CGGGAC...
```

This corresponds to the amino acid sequence <SEQ ID 1564; ORF 539>:

```
m539.pep (partial)

  1 MEDLQEIGFD VAAVKVGRQR EHHRLHHPQP GNGEADDVLF AFFLVGGFDF

 51 LRVIGCGGVA YLPDFQQNVG KADFAVVPDD AAAVRAVIEV DADDAVCTQK

101 LLFDQPDAGG AGDAAEH*NR LARAAVGFHK VGLDFGQVVQ ADLVEDFLGR

151 QLGFLRVGGA LFVITAQARV NNALCDRLTA GAQGFAVFVF VTDSQVEVFG

201 NIQTAVETGF FHGISVSSVF GAAAQDSAMA SRSASIPVFS ATEMRTAAIF

251 PAASRHMPVF CSSDGSRSVL LYTLMHGISP AWISCSTFST SSICCPLFGA

301 AASTTCSSTS ACAVSSSVAX KAEISLCGRS LTNPTVSVRI MLHSG....
```

Computer analysis of this amino acid sequence gave the following results:

Homology with a predicted ORF from *N. gonorrhoeae*

ORF 539 shows 89% identity over a 345 aa overlap with a predicted ORF (ORF 539.ng) from *N. gonorrhoeae*:

```
m539/g539

                    10        20        30        40        50        60
m539.pep   MEDLQEIGFDVAAVKVGRQREHHRLHHPQPGNGEADDVLFAFFLVGGFDFLRVIGCGGVA
           ||||||||||||||||||||||||||| | |||:||||||||||||||||||||||||||
g539       MEDLQEIGFDVAAVKVGRQREHHRLHHTQSGNGKADDVLFAFFLVGGFDFLRVIGCGGVA
                    10        20        30        40        50        60

                    70        80        90       100       110       120
m539.pep   YLPDFQQNVGKADFAVVPDDAAAVRAVIEVDADDAVCTQKLLFDQPDAGGAGDAAEHXNR
            |||||||||:||||||||||||||||||||||||||:||||||||||||||:|||| :
g539       CLPDFQQNVGEADFAVVPDDAAAVRAVIEVDADDAVCAQKLLFDQPDAGGAGNAAEHQHC
                    70        80        90       100       110       120

                   130       140       150       160       170       180
m539.pep   LARAAVGFHKVGLDFGQVVQADLVEDFLGRQLGFLRVGGALFVITAQARVNNALCDRLTA
           ::|| :|||||||||||||||||||||||||:||:||||| ||||||| :::|||| |||
g539       FVRAIMGFHKVGLDFGQVVQADLVEDFLGRQFGFFRVGGASFVITAQAGIDDALCDCLTA
                   130       140       150       160       170       180

                   190       200       210       220       230       240
m539.pep   GAQGFAVFVFVTDSQVEVFGNIQTAVETGFFHGISVSSVFGAAAQDSAMASRSASIPVFS
            | |||||:||:|:|::||||:| ||||||||||||||||||||| ||||||||||||||
g539       DAAGFAVFAFVADGQMQVFGNVQPAVETGFFHGISVSSVFGAAAQYSAMASRSASIPVFS
                   190       200       210       220       230       240

                   250       260       270       280       290       300
m539.pep   ATEMRTAAIFPAASRHMPVFCSSDGSRSVLLYTLMHGISPAWISCSTFSTSSICCPLFGA
           ||||||||||||||||||||||||||||||||||||||| |||||||||||||||||| |
g539       ATEMRTAAIFPAASRHMPVFCSSDGSRSVLLYTLMHGISWAWISCSTFSTSSICCPLFRA
                   250       260       270       280       290       300

                   310       320       330       340
m539.pep   AASTTCSSTSACAVSSSVAXKAEISLCGRSLTNPTVSVRIMLHSG
           ||||||||||||:|||:|| |||||||||||||||||||||||:|
g539       AASTTCSSTSACTVSSKVAEKAEISLCGRSLTNPTVSVRIMLHAGLMYSRRAVVSRVAKS
                   310       320       330       340       350       360

g539       WSFAYMPDLVSRLNRLDLPTLV
                   370       380
```

The following partial DNA sequence was identified in *N. meningitidis* <SEQ ID 1565>:

```
a539.seq

  1 ATGGAGGATT TGCAGGAAAT CGGGTTCGAT GTCGCCGCCG TAAAGGTAGG

 51 TCGGCAGCGC GAACATCATC GTCTGCATCA TCCCCAGCCC GGCAACGGCG

101 AGGCGGACGA TGTATTGTTT GCGTTCTTTT TGGTTGGCGG CTTCGATTTT

151 TTGCGCGTCA TAGGGTGCGG CGGTGTAGCC TATCTGCCTG ATTTTCAACA
```

-continued

```
 201 GAATGTCGGA AAGGCGGATT TTGCCGTCGT CCCAGACGAC GCGGCAGCGG
 251 TGCGTGCTGT AATTGAGGTC GATGCGGACG ATGCCGTCTG TACGCAAAAG
 301 CTGCTGTTCG ATCAGCCAGA CGCAGGCGGC GCAGGTGATG CCGCCGAGCA
 351 TTAAAACCGC CTCGCGCGTG CCGCCGTGGG TTTCCACAAA GTCGGACTGG
 401 ACTTCGGGCA GGTCGTACAG GCGGATTTGG TCGAGGATTT CTTGGGGCGG
 451 CAGCTCGGTT TTTTGCGCGT CGGCGGTGCG TTGTTTGTAA TAACTGCCCA
 501 AGCCCGCGTC AATAATGCTT TGTGCGACTG CCTGACAACC GGCGCAGCAG
 551 GTTTCGCGGT CTTCGTTTTC GTAACGGACG GTCAGATGCA GGTTTTCGGG
 601 AACGTCCAGC CCGCAGTGGA AACAGGTTTT TTTCATGGCA TTTCGGTTTC
 651 GTCTGTGTTT GGTGCGGCGG CACAATACTC GGCAATGGCT TCGCGCAGTG
 701 CGTCTATACC GGTATTTTCA GCAACGGAAA TGCGGACGGC GGCAATTTTT
 751 CCCGCAGCGT CGCGCCATAT GCCCGTGTTT TGTTCTTCAG ACGGCAGCAG
 801 GTCGGTTTTG TTGTACACCT TGATGCACGG AATATCGCCG GCATGGATTT
 851 CTTGCAGTAC GTTTTCCACG TCTTCAATCT GCTGTCCGCT GTTCGGAGCG
 901 GCGGCATCGA CGACGTGCAG CAGCACATCG GCTTGCGCGG TTTCTTCCAG
 951 CGTGGCGGAA AAGGCGGAAA TCAGTTTGTG CGGCAGATCG CTGACGAATC
1001 CGACGGTATC GGTCAGGATA ATGCTGCATT CGGGACTGAT GTACAGCCGC
1051 CGCGCCGTCG TGTCGAGTGT GGCGAAAAGC TGGTCTTTCG CATATATGCC
1101 CGACTTGGTC AGCCGGTTGA ACAGACTGGA TTTGCCGACA TTGGTATAG
```

This corresponds to the amino acid sequence <SEQ ID 1566; ORF 539.a>:

a539.pep

```
  1 MEDLQEIGFD VAAVKVGRQR EHHRLHHPQP GNGEADDVLF AFFLVGGFDF
 51 LRVIGCGGVA YLPDFQQNVG KADFAVVPDD AAAVRAVIEV DADDAVCTQK
101 LLFDQPDAGG AGDAAEH*NR LAPAAVGFHK VGLDFGQVVQ ADLVEDFLGR
151 QLGFLRVGGA LFVITAQARV NNALCDCLTT GAAGFAVFVF VTDGQMQVFG
201 NVQPAVETGF FHGISVSSVF GAAAQYSAMA SRSASIPVFS ATEMRTAAIF
251 PAASRHMPVF CSSDGSRSVL LYTLMHGISP AWISCSTFST SSICCPLFGA
301 AASTTCSSTS ACAVSSSVAE KAEISLCGRS LTNPTVSVRI MLHSGLMYSR
351 RAVVSSVAKS WSFAYMPDLV SRLNRLDLPT LV*
```

m539/a539 97.1% identity in 345 aa overlap

```
                  10        20        30        40        50        60
m539.pep  MEDLQEIGFDVAAVKVGRQREHHRLHHPQPGNGEADDVLFAFFLVGGFDFLRVIGCGGVA
          ||||||||||||||||||||||||||||||||||||||||||||||||||||||||||||
a539      MEDLQEIGFDVAAVKVGRQREHHRLHHPQPGNGEADDVLFAFFLVGGFDFLRVIGCGGVA
                  10        20        30        40        50        60

                  70        80        90       100       110       120
m539.pep  YLPDFQQNVGKADFAVVPDDAAAVRAVIEVDADDAVCTQKLLFDQPDAGGAGDAAEHXNR
          ||||||||||||||||||||||||||||||||||||||||||||||||||||||||||||
a539      YLPDFQQNVGKADFAVVPDDAAAVRAVIEVDADDAVCTQKLLFDQPDAGGAGDAAEHXNR
                  70        80        90       100       110       120
```

-continued

```
                  130       140       150       160       170       180
m539.pep   LARAAVGFHKVGLDFGQVVQADLVEDFLGRQLGFLRVGGALFVITAQARVNNALCDRLTA
           |||||||||||||||||||||||||||||||||||||||||||||||||||||||| ||:
a539       LARAAVGFHKVGLDFGQVVQADLVEDFLGRQLGFLRVGGALFVITAQARVNNALCDCLTT
                  130       140       150       160       170       180

                  190       200       210       220       230       240
m539.pep   GAQGFAVFVFVTDSQVEVFGNIQTAVETGFFHGISVSSVFGAAAQDSAMASRSASIPVFS
           || ||||||||||:|::||||:| ||||||||||||||||||||| ||||||||||||||
a539       GAAGFAVFVFVTDGQMQVFGNVQPAVETGFFHGISVSSVFGAAAQYSAMASRSASIPVFS
                  190       200       210       220       230       240

                  250       260       270       280       290       300
m539.pep   ATEMRTAAIFPAASRHMPVFCSSDGSRSVLLYTLMHGISPAWISCSTFSTSSICCPLFGA
           ||||||||||||||||||||||||||||||||||||||||||||||||||||||||||||
a539       ATEMRTAAIFPAASRHMPVFCSSDGSRSVLLYTLMHGISPAWISCSTFSTSSICCPLFGA
                  250       260       270       280       290       300

                  310       320       330       340
m539.pep   ASSTTCSSTSACAVSSSVAXKAEISLCGRSLTNPTVSVRIMLHSG
           ||||||||||||||||||| |||||||||||||||||||||||||
a539       ASSTTCSSTSACAVSSSVAEKAEISLCGRSLTNPTVSVRIMLHSGLMYSRRAVVSSVAKS
                  310       320       330       340       350       360

a539       WSFAYMPDLVSRLNRLDLPTLVX
                  370       380
```

The following partial DNA sequence was identified in *N. gonorrhoeae* <SEQ ID 1567>:

g540.seq

```
  1 atgccgccct cccgacgcgg caacggggtg ttttatcaaa acggcaaact
 51 tgccaatgcg gtttccgctt gccgattgcc aaaccggcaa acctttcccg
101 tgccggtgcc gaacccgatg ccgtctgaac cttcagacgg catcgggtgt
151 ttatttgtcc actcggacgg gtgcaggttc gtattgtgtc gattcgtcgc
201 cgtaatacag cacgccgagt ttgacgggga tgcgtccctg cgatttgcgg
251 tgggcgttgg aatcgcgcaa ggaatacgcg cagccgcagt attcctgctg
301 gtagaagttt tcgcgtttgc tgatttcaat catacgcgcg ccgccgccgc
351 ctttgcgcca gttgaagtcc caataggcca catcatcgta aggcgcggcg
401 gcacggtgtc cgcagtcgtt gatttgcgcc atatttttcc agcgtga
```

This corresponds to the amino acid sequence <SEQ ID 1568; ORF 540.ng>:

g540.pep

```
  1 MPPSRRGNGV FYQNGKLANA VSACRLPNRQ TFPVPVPNPM PSEPSDGIGC
 51 LFVHSDGCRF VLCRFVAVIQ HAEFDGDASL RFAVGVGIAQ GIRAAAVFLL
101 VEVFAFADFN HTRAAAAFAP VEVPIGHIIV RRGGTVSAVV DLRHIFPA*
```

The following partial DNA sequence was identified in *N. meningitidis* <SEQ ID 1569>:

m540.seq (partial)

```
  1 ..CCGAACCCGA TGCCGTCTGA ACCTTCAGAC GGCATCGGGT GTTTATTTGT
 51   CCACCCGGAT GGGGGCAGGT TCGTATTGTG TCGATTCGTC GCCGTAATAC
101   AGCACGCCGA GTTTGATGGG GATTCTGCCC TGTGATTTGC GGTGGGCATT
151   GGAATCCCTC AGGGAATAGG CACAACCGCA ATATTCCTGC TGGTAGAAGT
```

-continued

```
201   TTTCACGTTT GCTGATTTCA ATCATGCGCG CGCTGCCGCC GCCTTTGCGC

251   CAGTTGAAAT CCCAATACAC CACATCATCG TAAGGCGCGG CGGCGCGGTG

301   TCCGCAGTCG TTGATTTGCG CCATATTTTT CCAGCGTGA
```

This corresponds to the amino acid sequence <SEQ ID 1570; ORF 540>:

m540.pep (partial)

```
  1 ..PNPMPSEPSD GIGCLFVHPD GGRFVLCRFV AVIQHAEFDG DSAL*FAVGI

 51   GIPQGIGTTA IFLLVEVFTF ADFNHARAAA AFAPVEIPIH HIIVRRGGAV

101   SAVVDLRHIF PA*
```

Computer analysis of this amino acid sequence gave the following results:

Homology with a predicted ORF from *N. gonorrhoeae*

ORF 540 shows 85.7% identity over a 112 aa overlap with a predicted ORF (ORF 540.ng) from *N. gonorrhoeae*:

```
m540/g540

                                                  10        20        30
m540.pep                                  PNPMPSEPSDGIGCLFVHPDGGRFVLCRFV
                                          |||||||||||||||||| || ||||||||
g540        GNGVFYQNGKLANAVSACRLPNRQTFPVPVPNPMPSEPSDGIGCLFVHSDGCRFVLCRFV
              10        20        30        40        50        60

                    40        50        60        70        80        90
m540.pep    AVIQHAEFDGDSALXFAVGIGIPQGIGTTAIFLLVEVFTFADFNHARAAAAFAPVEIPIH
            |||||||||||::| ||||:|| ||| ::|:|||||||:||||||:||||||||||:||
g540        AVIQHAEFDGDASLRFAVGVGIAQGIRAAAVFLLVEVFAFADFNHTRAAAAFAPVEVPIG
              70        80        90       100       110       120

                   100       110
m540.pep    HIIVRRGGAVSAVVDLRHIFPAX
            ||||||||:||||||||||||||
g540        HIIVRRGGTVSAVVDLRHIFPAX
             130       140
```

L' estremita' N-terminale di meningococco e' assente perche' interviene la fine del contig The following partial DNA sequence was identified in *N. meningitidis* <SEQ ID 1571>:

a540.seq

```
  1 ATGCCGTCCT CCCGACGCGG CAACGGGGTG TTTTATCAAA ACGGCAAACT

 51 TGCCAATGCG GTTTCCGATT GCAGATTGCC AAACCGGCAA ACCTTTCCCG

101 TGCCGATGCC GAACCCGATG CCGTCTGAAC CTTCAGACGG CATCGGGTGT

151 TTATTTGTCC ACCCGGATGG GTGCAGGTTC GTATTGTGTC GATTCGTCGC

201 CGTAATACAG CACGCCGAGT TTGATGGGGA TTCTGCCCTG TGATTTGCGG

251 TGGGCGTTGG AATCCCTCAG GGAATAGGCA CAACCGCAAT ATTCCTGCTC

301 GTAGAAGTTT TCACGTTTGC TGATTTCAAT CATACGCGCG CTGCCGCCGC

351 CTTTGCGCCA GTTGAAATCC CAATACACCA CATCATCGTA AGGCGCGGCG

401 GCGCGGCGGC CGCAGTCGTT AATCTGGTTC ATGTTTTTCC A
```

This corresponds to the amino acid sequence <SEQ ID 1572; ORF 540.a>:

a540.pep (partial)

```
  1 MPSSRRGNGV FYQNGKLANA VSDCRLPNRQ TFPVPMPNPM PSEPSDGIGC

 51 LFVHPDGCRF VLCRFVAVIQ HAEFDGDSAL *FAVGVGIPQ GIGTTAIFLL

101 VEFTFADFN HTRAAAAFAP VEIPIHHIIV RRGGAAAAVV NLVHVFP
```

m540/a540 92.8% identity in 111 aa overlap

```
                                                 10        20        30
m540.pep                                 PNPMPSEPSDGIGCLFVHPDGGRFVLCRFV
                                         ||||||||||||||||||||| ||||||||
a540       GNGVFYQNGKLANAVSDCRLPNRQTFPVPMPNPMPSEPSDGIGCLFVHPDGCRFVLCRFV
             10        20        30        40        50        60

                   40        50        60        70        80        90
m540.pep   AVIQHAEFDGDSALXFAVGIGIPQGIGTTAIFLLVEVFTFADFNHARAAAAFAPVEIPIH
           |||||||||||||||||||:|||||||||||||||||||||||||:||||||||||||||
a540       AVIQHAEFDGDSALXFAVGVGIPQGIGTTAIFLLVEVFTFADFNHTRAAAAFAPVEIPIH
             70        80        90       100       110       120

                  100       110
m540.pep   HIIVRRGGAVSAVVDLRHIFPAX
           |||||||||::|||:| |:||
a540       HIIVRRGGAAAAVVNLVHVFP
            130       140
```

The following partial DNA sequence was identified in *N. gonorrhoeae* <SEQ ID 1573>:

g542.seq

```
  1 atgccgaaat ggtcgcgcat acggcgttgc agcgtccttt cgctgatgtt

 51 cagcgcggct gtcagccggt tgacttggtg tgcgccgccg tcgaacgcgg

101 cattcagggt gcggctgaag tcttcagacg gcatagcgtc tgcttccgcc

151 gtttgccccg ccgccggctc gatgccgtct gaaaccgtgt cccacaaatc

201 cgacagcagc cgcaacacgt ccgcctcgcg gcgcaatgtt tcgcccaaat

251 gccccttttgg gacggtttgc aggcaggatg ccgccaagcc gcgcaggttt

301 gggggcaaat cccatatcct gaccggttcg cggtaa
```

This corresponds to the amino acid sequence <SEQ ID 1574; ORF 542.ng>:

g542.pep

```
  1 MPKWSRIRRC SVLSLMFSAA VSRLTWCAPP SNAAFRVRLK SSDGIASASA

 51 VCPAAGSMPS ETVSHKSDSS RNTSASRRNV SPKCPFGTVC RQDAAKPRRF

101 GGKSHILTGS R*
```

The following partial DNA sequence was identified in *N. meningitidis* <SEQ ID 1575>:

m542.seq

```
  1 ATGCCGAAAT GGTCGCGCAT ACGGCGTTGC AGCGTCCTTT CACTGATGTT

 51 CAGCGCGTCT GTCAGCCGGT TGACTTGGTG TGCGCCGTCG GCAAACGCGG

101 CATTTAGGGT GCGGCTGAAG TCTTCAGACG GCATAGCGTC TGCTTCCGCC
```

-continued

```
151 GTTTGCCCCG CCGCCGGCCC GATGCCGTCT GAAACCGTGT CCCACAAGTC

201 CGACAGCAGC CGCAACACGT CCGCCTCGCG .CGCAATGTT TCGCCCAAAT

251 GCCCCTTTGG GACGGCTTTC AGGCAGGATG CCGCCAAGCC GCGCAGGTTC

301 GGGGGCAAAT CCCATATCCT GACCGGTTCG CGGTAA
```

This corresponds to the amino acid sequence <SEQ ID 1576; ORF 542>:

m542.pep

```
  1 MPKWSRIRRC SVLSLMFSAS VSRLTWCAPS ANAAFRVRLK SSDGIASASA

 51 VCPAAGPMPS ETVSHKSDSS RNTSASRAMF RPNAPLGRNV SPKCPFGTAF

101 RODAAKPRRF GGKSHILTGS R*
```

Computer analysis of this amino acid sequence gave the following results:

Homology with a predicted ORF from *N. gonorrhoeae*

ORF 542 shows 93.7% identity over a 111 aa overlap with a predicted ORF (ORF 542.ng) from *N. gonorrhoeae*:

```
m542/g542

          10        20        30        40        50        60
m542.pep  MPKWSRIRRCSVLSLMFSASVSRLTWCAPSANAAFRVRLKSSDGIASASAVCPAAGPMPS
          |||||||||||||||||||:||||||||| :||||||||||||||||||||||||| |||
g542      MPKWSRIRRCSVLSLMFSAAVSRLTWCAPPSNAAFRVRLKSSDGIASASAVCPAAGSMPS
                  10        20        30        40        50        60

                  70        80        90       100       110
m542.pep  ETVSHKSDSSRNTSASXRNVSPKCPFGTAFRQDAAKPRRFGGKSHILTGSRX
          |||||||||||||||| |||||||||||: ||||||||||||||||||||||
g542      ETVSHKSDSSRNTSASRRNVSPKCPFGTVCRQDAAKPRRFGGKSHILTGSRX
                  70        80        90       100       110
```

The following partial DNA sequence was identified in *N. meningitidis* <SEQ ID 1577>:

a542.seq

```
  1 ATGCCGAAAT GGTCGCGCAT ACGGCGTTGC AGCGTCCTTT CGCTGATGTT

 51 CAGCGTGTCT GCCAGCCGGT TGACTTGATG TGCGCCGCCG GCAAACGCGG

101 CATTCAGGAT GCGGCTGAAG TCTTCAGACG GCATAGCGTC TGCTTCCGCC

151 GTTTGCCCCG CCGCCGGCCC GATGCCGTCT GAAACCGTGT CCCACAAGTC

201 CGACAGCAGC CGCAACACGT CCGCCTCGCG GCGCAATGTT TCGCCCAAAT

251 GCCCCTTTGG GACGGCTTTC AGGCAGGATG CCGCCAAGCC GCGCAGGTTC

301 GGGGGCAAAT CCCATATCCT GACCGGTTCG CGGTAA
```

This corresponds to the amino acid sequence <SEQ ID 1578; ORF 542.a>:

a542.pep

```
  1 MPKWSRIRRC SVLSLMFSVS ASRLT*CAPP ANAAFRMRLK SSDGIASASA

 51 VCPAAGPMPS ETVSHKSDSS RNTSASRRNV SPKCPFGTAF RQDAAKPRRF

101 GGKSHILTGS R*
```

m542/a542 94.6% identity in 111 aa overlap

```
                   10        20        30        40        50        60
m542.pep  MPKWSRIRRCSVLSLMFSASVSRLTWCAPSANAAFRVRLKSSDGIASASAVCPAAGPMPS
          ||||||||||||||||||:|:|||| ||| ||||||:|||||||||||||||||||||||
a542      MPKWSRIRRCSVLSLMFSVSASRLTXCAPPANAAFRMRLKSSDGIASASAVCPAAGPMPS
                   10        20        30        40        50        60

                   70        80        90       100       110
m542.pep  ETVSHKSDSSRNTSASXRNVSPKCPFGTAFRQDAAKPRRFGGKSHILTGSRX
          |||||||||||||||| |||||||||||||||||||||||||||||||||||
a542      ETVSHKSDSSRNTSASRRNVSPKCPFGTAFRQDAAKPRRFGGKSHILTGSRX
                   70        80        90       100       110
```

The following partial DNA sequence was identified in *N. gonorrhoeae* <SEQ ID 1579>:

<u>g543.seq</u>

```
   1 atggtttgtc ggttatttgc cgccgttttt ggctttcaac tcggcaatca
  51 gcccgtcgat gcctttggct ttgatgattt cgccgaattg gttgcggtac
 101 acggtaacca ggctcgtgcc ttcgatggcg acgttgtagg tacggtattt
 151 gccgccgctt tggtaggtgg taaagtccat attgacgggc ttctgaccgg
 201 ggatgccgac ttcggcacgg acgacgattt ccttgccgcc cttattgacg
 251 atgggattgt ctttgacgtt gacggtcgcg tttttgaatt tcagcatcgt
 301 gccggaatag gtgcggatca gcagggtttg aaattctttg gccaacgctt
 351 gtttttgcgc gtcggacgcg gtacgccaag ggttgccgac cgccaatgcg
 401 gtcatacgtt ggaaatcgaa atagggaacc gcataggctt cggcttttgg
 451 gcgtgcagaa gccgcgtcgc cgcttttgag gatggtcaaa acctgtgtgg
 501 cgttttggcg gatttgtccc actgcgtcgg ccggggaggc aaatgccatg
 551 ccgatgctca aaataccgat gcccaatgcg ctgatgaagg aggatttttt
 601 cacgatgtct ttcctgaaaa tggatgtgta tgtttattct gcggcttttt
 651 ccgCattgcc gccctcagcg tttttctcgg cgaagctggt catgaattta
 701 ccgatcaggt tttccagaac cattgcagaa ctggttacgg agatggtgtc
 751 gccggcagca aggttttccg tatcgccgcc ctgctgcagc ccgatgtact
 801 gttcgcccaa aagtcccgaa gtcaggattt gcgcggaaac gtcactgctg
 851 aactgatact tgccgtccaa atcaaggcgc accctcgcct gataggattt
 901 cgggtcaagc ccgatagcgc cgacgcgccc gaccaatacg cctgcggatt
 951 tgacgggggc attgaccttc aaaccgccga tgtcgccgaa atcggcataa
1001 acggcgtaag ttttgtccga accgccgaac gccgcgccgc ccgccacgcg
1051 gaaagcgaga aaggcaaccg ccgccgcgcc gatcaagacg aacagtccga
1101 cccaaaattc caatatgttc tttttcatta a
```

This corresponds to the amino acid sequence <SEQ ID 1580; ORF 543.ng>:

<u>g543.pep</u>

```
 1 MVCRLFAAVF GFQLGNQPVD AFGFDDFAEL VAVHGNQARA FDGDVVGTVF
51 AAALVGGKVH IDGLLTGDAD FGTDDDFLAA LIDDGIVFDV DGRVFEFQHR
```

-continued

101 AGIGADQQGL KFFGQRLFLR VGRGTPRVAD RQCGHTLEIE IGNRIGFGFW

151 ACRSRVAAFE DGQNLCGVLA DLSHCVGRGG KCHADAQNTD AQCADEGGFF

201 HDVFPENGCV CLFCGFFRIA ALSVFLGEAG HEFTDQVFQN HCRTGYGDGV

251 AGSKVFRIAA LLQPDVLFAQ KSRSQDLRGN VTAELILAVQ IKAHPRLIGF

301 RVKPDSADAP DQYACGFDGG IDLQTADVAE IGINGVSFVR TAERRAARHA

351 ESEKGNRRRA DQDEQSDPKF QYVLFH*

The following partial DNA sequence was identified in *N. meningitidis* <SEQ ID 1581>:

m543.seq

1 ATGGTTTGTC GGTTATTTGC CGCCGTTTTT GGCTTTCAAC TCGGCAATCA

51 GTCCGTCCAC GCCTTTCGCT TTGATAATTT CGCCGAATTG GTTGCGGTAC

101 ACGGTAACCA GGCTCGCGCC TTCGATGGCG ACGTTGTAGG TACGGTATTT

151 ACCGCCGCTT TGGTAGGTGG TGAAGTCCAT GTTGACGGGT TTTTGCCCGG

201 GTACGCCGAC TTCGGCGCGG ACGATGATTT CTTTGCCGCC TTTATTGACG

251 ATGGGATTGT CTTTGACGTT GACGTTGGCG TTTTTTAATT TCAGCATCGT

301 GCCGGAATAG GTGCGGATCA GCAGGGTTTG AAATTCTTTG GCCAACGCTT

351 GTTTTTGCGC GTCGGACGCG GTGCGCCAAG GGTTGCCGAC CGCCAATGCG

401 GTCATACGTT GGAAATCGAA ATAGGGAATC GCATAGGCTT CGGCTTTTTG

451 GCGAGCGGTG TTGGCATCGC CGTTTTTTAA GATGCTCAAT ACTTGAGTGG

501 CGTTTTGACG GATTTGGCTT ACCGCGTCGG CAGGGGCGGC AAATGCCATG

551 CCGATGCTCA AAATACCGAT GCCCAATGCG CTGATGAGGG AGGATTTTTT

601 CATGATTAAG TGTCCTAGTT TGAATATGAT GGCATACGTT TATTCGGCGG

651 CTTTTTCCGC ATTGCCGCCG TCGGCATTTT TCTCGGCAAA ACTCGTCATG

701 AATTTGCCGA TAAGGTTTTC CAGAACCATT GCAGAACTGG TTACGGAGAT

751 GGTGTCGCCG GCAGCAAGGT TTTCCGTGTC GCCGCCCTGC TGCAGCCCGA

801 TGTACTGCTC GCCCAAAAGT CCCGAAGTCA GGATTTGCGC GGAAACGTCG

851 CTGCTGAACT GATACTTGCC GTCCAAATCG AGGCGCACCC TCGCCTGATA

901 GGATTTCGGG TCAAGTCCGA TAGCGCCGAC GCGCCCGACC AATACGCCTG

951 CGGATTTGAC GGGGGCATTG ACCTTCAAAC CGCCGATGTC GCCGAAATCG

1001 GCATAAACGG CGTAAGTTTT GTCCGAACCG CCGAACGCCG CACCGCCGGC

1051 CACGCGGAAA GCGAGAAAGG CAACCGCCGC CGCGCCAATC AGGACGAACA

1101 GTCCGACCCA AAATTCCAAT ATGTTCTTCT TCATTAA

This corresponds to the amino acid sequence <SEQ ID 1582: ORF 543>:

m543.pep

1 MVCRLFAAVF GFQLGNQSVH AFRFDNFAEL VAVHGNQARA FDGDVVGTVF

51 TAALVGGEVH VDGFLPGYAD FGADDDFFAA FIDDGIVFDV DVGVFXFQHR

-continued

```
101 AGIGADQQGL KFFGQRLFLR VGRGAPRVAD RQCGHTLEIE IGNRIGFGFL

151 ASGVGIAVFX DAQYLSGVLT DLAYRVGRGG KCHADAQNTD AQCADEGGFF

201 HDXVSXFEYD GIRLFGGFFR IAAVGIFLGK TRHEFADKVF QNHCRTGYGD

251 GVAGSKVFRV AALLQPDVLL AQKSRSQDLR GNVAAELILA VQIEAHPRLI

301 GFRVKSDSAD APDQYACGFD GGIDLQTADV AEIGINGVSF VRTAERRTAG

351 HAESEKGNRR RANQDEQSDP KFQYVLLH*
```

Computer analysis of this amino acid sequence gave the following results:

Homology with a predicted ORF from *N. gonorrhoeae*

ORF 543 shows 84.2% identity over a 379 aa overlap with a predicted ORF (ORF 543.ng) from *N. gonorrhoeae*:

```
m543/g543

                   10        20        30        40        50        60
m543.pep   MVCRLFAAVFGFQLGNQSVHAFRFDNFAELVAVHGNQARAFDGDVVGTVFTAALVGGEVH
           ||||||||||||||||| | || ||:||||||||||||||||||||||||:||||||:||
g543       MVCRLFAAVFGFQLGNQPVDAFGFDDFAELVAVHGNQARAFDGDVVGTVFAAALVGGKVH
                   10        20        30        40        50        60

                   70        80        90       100       110       120
m543.pep   VDGFLPGYADFGADDDFFAAFIDDGIVFDVDVGVFXFQHRAGIGADQQGLKFFGQRLFLR
           :||:| | ||||:||||:||:||||||||||  || ||||||||||||||||||||||||
g543       IVDLFTPDADFGTDDDFLAALIDDGIVFDVDGRVFEFQHRAGIGADQQGLKFFGQRLFLR
                   70        80        90       100       110       120

                  130       140       150       160       170       180
m543.pep   VGRGAPRVADRQCGHTLEIEIGNRIGFGFLASGVGIAVFXDAQYLSGVLTDLAYRVGRGG
           ||||:|||||||||||||||||||||||| |    :|:| |:| | |||:||:: |||||
g543       VGRGTRVADRQCGHTLEIEIGNRIGFGFLWACRSRVAAFEDGQNLCGVLADLSHCVGRGG
                  130       140       150       160       170       180

                  190       200       210       220        230      239
m543.pep   KCHADAQNTDAQCADEGGFFHDXVSXFEYDG-IRLFGGFFRIAAVGIFLGKTRHEFADKV
           ||||||||||||||||||||||    |  :| : || |||||||:::|||:: |||:|:|
g543       KCHADAQNTDAQCADEGGFFHDV---FPENGCVCLFCGFFRIAALSVFLGEAGHEFTDQV
                  190       200          210       220       230

         240       250       260       270       280       290      299
m543.pep   FQNHCRTGYGDGVAGSKVFRVAALLQPDVLLAQKSRSQDLRGNVAAELILAVQIEAHPRL
           ||||||||||||||||||||:|||||||||:|||||||||||||:||||||||||:||||
g543       FQNHCRTGYGDGVAGSKVFRIAALLQPDVLFAQKSRSQDLRGNVTAELILAVQIKAHPRL
             240       250       260       270       280       290

         300       310       320       330       340       350      359
m543.pep   IGFRVKSDSADAPDQYACGFDGGIDLQTADVAEIGINGVSFVRTAERRTAGHAESEKGNR
           |||||| ||||||||||||||||||||||||||||||||||||||||||:| ||||||||
g543       IGFRVKPDSADAPDQYACGFDGGIDLQTADVAEIGINGVSFVRTAERRAARHAESEKGNR
             300       310       320       330       340       350

         360       370      379
m543.pep   RRANQDEQSDPKFQYVLLHX
           |||:|||||||||||||:||
g543       RRADQDEQSDPKFQYVLFHX
             360       370
```

The following partial DNA sequence was identified in *N. meningitidis* <SEQ ID 1583>:

a543.seq

```
  1 ATGGCTTATG GATTACTTGC TGCCGTTTNT AGCCTTCAAC TCGNCAATCA

 51 GTCCGTCCAC GCCTTTCGCT TTGATAATTT CGCCGAATTG GTTGCGGTAC

101 ACGGTAACCA GGCTCGCGCC TTCGATGGCG ACGTTGTAGG TACGGTATTT

151 ACCGCCGCTT TGGTAGGTGG TGAAGTCCAT GTTGACGGGT TTTTGCCCGG

201 NNACGCCGAC TTCGGCGCGG ACGATGATTT CTTTGCCGCC TTTATTGACG
```

-continued

```
 251 ATNGGATTGT CTTTGACGTT GACGTTGGCG TTTTTTAATT TCAGCATCGT
 301 GCCGGAATAG GTGCGGATCA GCAGGGTTTG AAATTCTTTG GCCAACGCTT
 351 GTTTTTGCGC GTCGGACGCG GTGCGCCAAG GGTTGCCGAC CGCCAATGCG
 401 GTCATACGTT GGAAATCGAA ATAGGGAATC GCATAGGCTT CGGCTTTTTG
 451 GCGGGCGGTG TTGGCATCAC CGCTTTTTAA GATGCTCAAT ACTTGAGTGG
 501 CGTTTTGACG GATTTGGTTT ACCGCGTCGG CAGGGGCGGC AAATGCCATG
 551 CCGATGCTCA AAATACCGAT GCCCAATGCG CTGATGAAGG AGGATTTTTT
 601 CATGATTAAG TGTCCTAGTT TGAATATGAT GGCATACGTT TATTCGGCGG
 651 CTTTTTCCGC ATTGCCGCCG TCGGCATTTT TCTCGGCAAA ACTCGTCATG
 701 AATTTGCCGA TAAGGTTTTC CAGAACCATT GCAGAACTGG TTACGGAGAT
 751 GGTGTCGCCG GCAGCAAGGT TTTCCGTGTC GCCGCCCTGC TGCAGCCCGA
 801 TGTACTGCTC GCCCAAAAGT CCCGAAGTCA GGATTTGCGC GGAAACGTCG
 851 CTGCTGAACT GATACTTGCC GTCCAAATCG AGGCGCACCC TCGCCTGATA
 901 GGATTTCGGG TCAAGTCCGA TAGCGCCGAC GCGCCCGACC AATACGCCTG
 951 CGGATTTGAC GGGGGCATTG ACCTTCAAAC CGCCGATGTC GCCGAAATCG
1001 GCATAAACGG CGTAAGTTTT GTCCGAACCG CCGAACGCCG CACCGCCGGC
1051 CACGCGGAAA GCGAGAAAGG CAACCGCCGC CGCGCCAATC AGGACGAACA
1101 GTCCGACCCA AAATTCCAAT ATGTTCTTTT TCATTAA
```

This corresponds to the amino acid sequence <SEQ ID 1584; ORF 543.a>:

a543.pep

```
  1 MAYGLLAAVX SLQLXNQSVH AFRFDNFAEL VAVHGNQARA FDGDVVGTVF
 51 TAALVGGEVH VDGFLPGXAD FGADDDFFAA FIDDXIVFDV DVGVF*FQHR
101 AGIGADQQGL KFFGQRLFLR VGRGAPRVAD RQCGHTLEIE IGNRIGFGFL
151 AGGVGITAF* DAQYLSGVLT DLVYRVGRGG KCHADAQNTD AQCADEGGFF
201 HD*VS*FEYD GIRLFGGFFR IAAVGIFLGK TRHEFADKVF QNHCRTGYGD
251 GVAGSKVFRV AALLQPDVLL AQKSRSQDLR GNVAAELILA VQIEAHPRLI
301 GFRVKSDSAD APDQYACGFD GGIDLQTADV AEIGINGVSF VRTAERRTAG
351 HAESEKGNRR RANQDEQSDP KFQYVLFH*
```

m543/a543 96.0% identity in 378 aa overlap

```
                   10        20        30        40        50        60
m543.pep    MVCRLFAAVFGFQLGNQSVHAFRFDNFAELVAVHGNQARAFDGDVVGTVFTAALVGGEVH
            |:  |:||| ::|| |||||||||||||||||||||||||||||||||||||||||||||
a543        MAYGLLAAVXSLQLXNQSVHAFRFDNFAELVAVHGNQARAFDGDVVGTVFTAALVGGEVH
                   10        20        30        40        50        60

                   70        80        90       100       110       120
m543.pep    VDGFLPGYADFGADDDFFAAFIDDGIVFDVDVGVFXFQHRAGIGADQQGLKFFGQRLFLR
            ||||||| |||||||||||||||| |||||||||||||||||||||||||||||||||||
a543        VDGFLPGXADFGADDDFFAAFIDDXIVFDVDVGVFXFQHRAGIGADQQGLKFFGQRLFLR
                   70        80        90       100       110       120
```

-continued

```
                 130       140       150       160       170       180
m543.pep  VGRGAPRVADRQCGHTLEIEIGNRIGFGFLASGVGIAVFXDAQYLSGVLTDLAYRVGRGG
          |||||||||||||||||||||||||||||||:||||::||||||||||||||:|||||||
a543      VGRGAPRVADRQCGHTLEIEIGNRIGFGFLAGGVGITAFXDAQYLSGVLTDLVYRVGRGG
                 130       140       150       160       170       180

                 190       200       210       220       230       240
m543.pep  KCHADAQNTDAQCADEGGFFHDXVSXFEYDGIRLFGGFFRIAAVGIFLGKTRHEFADKVF
          ||||||||||||||||||||||||||||||||||||||||||||||||||||||||||||
a543      KCHADAQNTDAQCADEGGFFHDXVSXFEYDGIRLFGGFFRIAAVGIFLGKTRHEFADKVF
                 190       200       210       220       230       240

                 250       260       270       280       290       300
m543.pep  QNHCRTGYGDGVAGSKVFRVAALLQPDVLLAQKSRSQDLRGNVAAELILAVQIEAHPRLI
          ||||||||||||||||||||||||||||||||||||||||||||||||||||||||||||
a543      QNHCRTGYGDGVAGSKVFRVAALLQPDVLLAQKSRSQDLRGNVAAELILAVQIEAHPRLI
                 250       260       270       280       290       300

                 310       320       330       340       350       360
m543.pep  GFRVKSDSADAPDQYACGFDGGIDLQTADVAEIGINGVSFVRTAERRTAGHAESEKGNRR
          ||||||||||||||||||||||||||||||||||||||||||||||||||||||||||||
a543      GFRVKSDSADAPDQYACGFDGGIDLQTADVAEIGINGVSFVRTAERRTAGHAESEKGNRR
                 310       320       330       340       350       360
                 370      379
m543.pep  RANQDEQSDPKFQYVLLHX
          ||||||||||||||||:||
a543      RANQDEQSDPKFQYVLFHX
                 370
```

The following partial DNA sequence was identified in *N. gonorrhoeae* <SEQ ID 1585>:

g544.seq

```
  1 atgaaaaaaa tactcaccgc cgccgccgtc gcactgatcg gcatcctcct
 51 cgccaccgtc ctcatccccg acagtaaaac cgcgcccgcc ttctccctgc
101 ccgacctgca cggaaaaacc gtttccaacg ccgacctgca aggcaaagtc
151 accctgatta atttttggtt tccctcctgt ccgggttgtg tgagcgaaat
201 gcccaaagtc accaaaacgg caaacgacta caaaaataaa gatttccaag
251 tcctcgccgt tgcccagccc atcgatccga tagaaagcgt ccgccaatac
301 gtcaaagact acggactgcc gtttaccgtc atttatgatg cggacaaagc
351 cgtcggacag gcattcggca cacaggttta tccgacttcc gtccttatcg
401 gcaaaaaagg cgaaatcctc aaaacttatg tcggcgaacc cgatttcggc
451 aaactctacc aagaaatcga taccgcgctg gcgcaatag
```

This corresponds to the amino acid sequence <SEQ ID 1586; ORF 544.ng>:

g544.pep

```
  1 MKKILTAAAV ALIGILLATV LIPDSKTAPA FSLPDLHGKT VSNADLQGKV
 51 TLINFWFPSC PGCVSEMPKV TKTANDYKNK DFQVLAVAQP IDPIESVRQY
101 VKDYGLPFTV IYDADKAVGQ AFGTQVYPTS VLIGKKGEIL KTYVGEPDFG
151 KLYQEIDTAL AQ*
```

The following partial DNA sequence was identified in *N. meningitidis* <SEQ ID 1587>:

m544.seq

```
  1 ATGAwAAAAA TACTCACCGC CGCCGTCGTC GCACTGATCG GCATCCTCCT

 51 TGCCATCGTC CTCmTCCCCG ACAGCAAAAC CGCGCCCGCC TTCTCCCmTGC

101 CCGACCTGCA CGGAAAAACC GTTTCCAACG CCGACCTGCA AGGCAAAGTA

151 ACCCTGATTA ATTTTTGGTT TCCCTCCTGT CCGGGTTGTG TGAGCGAwAT

201 GCCCAAAATC ATTAAAACGG CAAATGACTA TAAAAwCAAA AACTTCCAAG

251 TACTTGCCGT CGCCCAGCCC ATCGATCCGA TAGAAAGCGT CCGCCAATAT

301 GTCAAAGACT ACGGTTTGCC GTTTACCGTC ATGTATGATG CGGACAAAGC

351 TGTCGGACAG GCGTTCGGCA CACAGGTTTA TCCGACTTCC GTCCTTATCG

401 GCAAATAAGG CGAAATCTTC AAAACCTACG TCGGCGAACC CGATTTCGGC

451 AAACTCTACC AAGAAATCGA TACGCGCGTG GCGCAATAG
```

This corresponds to the amino acid sequence <SEQ ID 1588; ORF 544>:

m544.pep

```
  1 MXKILTAAVV ALIGILLAIV LXPDSKTAPA FSXPDLHGKT VSNADLQGKV

 51 TLINFWFPSC PGCVSXMPKI IKTANDYKXK NFQVLAVAQP IDPIESVRQY
```

-continued

```
101 VKDYGLPFTV MYDADKAVGQ AFGTQVYPTS VLIGK*GEIF KTYVGEPDFG

151 KLYQEIDTRV AQ*
```

Computer analysis of this amino acid sequence gave the following results:

Homology with a predicted ORF from *N. gonorrhoeae*

ORF 544 shows 90.7% identity over a 162 aa overlap with a predicted ORF (ORF 544.ng) from *N. gonorrhoeae*:

```
m544/g544

                    10        20        30        40        50        60
m544.pep    MXKILTAAVVALIGILLAIVLXPDSKTAPAFSXPDLHGKTVSNADLQGKVTLINFWFPSC
            | ||||||:||||||||| || |||||||||| |||||||||||||||||||||||||||
g544        MKKILTAAAVALIGILLATVLIPDSKTAPAFSLPDLHGKTVSNADLQGKVTLINFWFPSC
                    10        20        30        40        50        60

                    70        80        90       100       110       120
m544.pep    PGCVSXMPKIIKTANDYKXKNFQVLAVAQPIDPIESVRQYVKDYGLPFTVMYDADKAVGQ
            ||||| |||: ||||||| |:|||||||||||||||||||||||||||||:|||||||||
g544        PGCVSEMPKVTKTANDYKNKDFQVLAVAQPIDPIESVRQYVKDYGLPFTVIYDADKAVGQ
                    70        80        90       100       110       120

                   130       140       150       160
m544.pep    AFGTQVYPTSVLIGKXGEIFKTYVGEPDFGKLYQEIDTRVAQX
            ||||||||||||||| |||:|||||||||||||||||| :|||
g544        AFGTQVYPTSVLIGKKGEILKTYVGEPDFGKLYQEIDTALAQX
                   130       140       150       160
```

The following partial DNA sequence was identified in *N. meningitidis* <SEQ ID 1589>:

a544.seq

```
  1 ATGAAAAAAA TACTCACCGC CGCCGTCGTC GCACTGATCG GCATCCTCCT

 51 TGCCATCGTC CTCATCCCCG ACAGCAAAAC CGCGCCCGCT TTCTCCCTGT

101 CCGANCTGCA CGGAAAAANC GTTTNCAACG CCGACCTGCA AGGCNAAGTT

151 ANCCTGATTA ANTTTTGGTT TCCCTCCTGT CCGGGTTGTG TGAGCGAAAT

201 GNCCANAATC ATTAAAACGG CAAATGACTA TAAAAACAAA AACTTCCAAG

251 TCCTTGCCGT CGCCCAGCCC ATCGATCCGA TAGAAAGCGT CCGCCAATAT
```

-continued

```
301 GTCAAAGACT ACGGTTTGCC GTTTACCGTC ATGTATGATG CGGACAAAGC

351 TGTCGGACAG GCGTTCGGCA CACAGGTTTA TCCGACTTCC GTCCTTATCG

401 GCAAAAAAGG CGAAATCCTC AAAACTTATG TCGGCGAACC CGATTTCGGC

451 AAACTCTACC AAGAAATCGA TACCGCGCTG GCACAATAG
```

This corresponds to the amino acid sequence <SEQ ID 1590; ORF 544.a>:

a544.pep

```
  1 MKKILTAAVV ALIGILLAIV LIPDSKTAPA FSLSXLHGKX VXNADLQGXV

 51 XLIXFWFPSC PGCVSEMXXI IKTANDYKNK NFQVLAVAQP IDPIESVRQY

101 VKDYGLPFTV MYDADKAVGQ AFGTQVYPTS VLIGKKGEIL KTYVGEPDFG

151 KLYQEIDTAL AQ*
```

m544/a544 88.9% identity in 162 aa overlap

```
                   10        20        30        40        50        60
m544.pep   MXKILTAAVVALIGILLAIVLXPDSKTAPAFSXPDLHGKTVSNADLQGKVTLINFWFPSC
           | ||||||||||||||||||| ||||||||||   ||||:| |||||| |:|| ||||||
a544       MKKILTAAVVALIGILLAIVLIPDSKTAPAFSLSXLHGKXVXNADLQGXVXLIXFWFPSC
                   10        20        30        40        50        60

                   70        80        90       100       110       120
m544.pep   PGCVSXMPKIIKTANDYKXKNFQVLAVAQPIDPIESVRQYVKDYGLPFTVMYDADKAVGQ
           ||||| |  ||||||||| |||||||||||||||||||||||||||||||||||||||||
a544       PGCVSEMXXIIKTANDYKNKNFQVLAVAQPIDPIESVRQYVKDYGLPFTVMYDADKAVGQ
                   70        80        90       100       110       120

                  130       140       150       160
m544.pep   AFGTQVYPTSVLIGKXGEIFKTYVGEPDFGKLYQEIDTRVAQX
           ||||||||||||||| |||:|||||||||||||||||| :|||
a544       AFGTQVYPTSVLIGKKGEILKTYVGEPDFGKLYQEIDTALAQX
                  130       140       150       160
```

The following partial DNA sequence was identified in *N. gonorrhoeae* <SEQ ID 1591>:

g547.seq

```
  1 atgttcgtag ataacggatt taataaaacg gtagcgagtt ttgcccaaat

 51 cgtcgaaact ttcgacgtat tcttctttag gaacgattgc gcctttttta

101 cgcagatgaa acagcggtgc ggttgggtct gctcgttggt atatctcgtt

151 gatatattta caagatgcgg cttcgagatt ccgaaccgct cctttaaaga

201 gcttgggctt ttgatacaga taagtctgtc ggaacgtttt aggactaatg

251 ccgaagtcga gatggatgcc cattacttcc ccttactcag aaaatattta

301 aaatttataa tgttacatat agttacaaat attagagttt tttgtgtgtg

351 cgtcaaggaa ttgttgacaa ttttagttaa aaatttgtct ccaaacggaa

401 aaaagcggtt tgttttttgt tgttaa
```

This corresponds to the amino acid sequence <SEQ ID 1592; ORF 547.ng>:

g547.pep

```
  1 MFVDNGFNKT VASFAQIVET FDVFFFRNDC AFFTQMKQRC GWVCSLVYLV
 51 DIFTRCGFEI PNRSFKELGL LIQISLSERF RTNAEVEMDA HYFPLLRKYL
101 KFIMLHIVTN IRVFCVCVKE LLTILVKNLS PNGKKRFVFC C*
```

The following partial DNA sequence was identified in *N. meningitidis* <SEQ ID 1593>:

m547.seq

```
  1 ATGTTCGTAG ATAACGGATT TAATAAAACG GTAGCGAGTT TTGCCCAAAT
 51 CGTCGAAACT TTCGACGTAT TCTTCTTTAG GAACGATTGC GCCTTTTTTA
101 CGCAGATGAA ACAGCGGTGC GGTTGGGTCT GCTCGTTGGT ATATCTCGTT
151 GATATCTTTC CAAGATGCGG ATTCGAGATT CCGAACCGCT CCTTTAAAGA
201 GCTTGGGCTT TTGATACAGA TAAGTCTGTC GGAACGTTTT AGGACTAATG
251 CCGAAGTCGA GATGGATGCT CATTACTTCC CCTTACTCAG AAAATATTTA
301 AAATTTATAA TGTTACATAT ATTTACAAAT ATTAAAGTTT TTTwTTGTGT
351 GTGCGTCAAG GAATTGTTGA CAATTTTAGT TAAAAATTTG TCTCCAAACG
401 GAAAAAAGCG GTTTGTTTTT TGTTGTTAA
```

This corresponds to the amino acid sequence <SEQ ID 1594; ORF 547>:

m547.pep

```
  1 MFVDNGFNKT VASFAQIVET FDVFFFRNDC AFFTQMKQRC GWVCSLVYLV
 51 DIFPRCGFEI PNRSFKELGL LIQISLSERF RTNAEVEMDA HYFPLLRKYL
101 KFIMLHIFTN IKVFXCVCVK ELLTILVKNL SPNGKKRFVF CC*
```

Computer analysis of this amino acid sequence gave the following results:

Homology with a predicted ORF from *N. gonorrhoeae*

ORF 547 shows 97.2% identity over a 142 aa overlap with a predicted ORF (ORF 547.ng) from *N. gonorrhoeae*:

```
m547/g547

                    10        20        30        40        50        60
m547.pep   MFVDNGFNKTVASFAQIVETFDVFFFRNDCAFFTQMKQRCGWVCSLVYLVDIFPRCGFEI
           |||||||||||||||||||||||||||||||||||||||||||||||||||| ||||||
g547       MFVDNGFNKTVASFAQIVETFDVFFFRNDCAFFTQMKQRCGWVCSLVYLVDIFTRCGFEI
                    10        20        30        40        50        60

                    70        80        90       100       110       120
m547.pep   PNRSFKELGLLIQISLSERFRTNAEVEMDAHYFPLLRKYLKFIMLHIFTNIKVFXCVCVK
           |||||||||||||||||||||||||||||||||||||||||||||||| |||:|| |||||
g547       PNRSFKELGLLIQISLSERFRTNAEVEMDAHYFPLLRKYLKFIMLHIVTNIRVF-CVCVK
                    70        80        90       100       110       120

                   130       140
m547.pep   ELLTILVKNLSPNGKKRFVFCCX
           |||||||||||||||||||||||
g547       ELLTILVKNLSPNGKKRFVFCCX
                 120       130       140
```

The following partial DNA sequence was identified in *N. meningitidis* <SEQ ID 1595>:

a547.seq

```
  1 ATGTTCGTAG ATAACGGATT TAATAAAACG GTAGCGAGTT TTGCCCAAAT
 51 CGTCGAAACT TTCGACGTAT TCTTCTTTAG GAACAATTGC ACCTTTTTTA
101 CGCAGATGAA ACAGCGGTGC GGTTGGGTCT GCTCGTTGGT ATATCTCGTT
151 GATATCTTTC CAAGATGCGG CTTCGAGATT CCGAACCGCT CCTTTAAAGA
201 GCTTGGGCTT TTGATACAGA TAAGTCTGTC GGAACGTTTT AGGACTAATG
251 CCGAAGTCGA GATAGATGCT CATTACTTCC CCTTACTCAG AAAATATTTA
301 AAATTTATAA TGTTACATAT ATTTACAAAT ATTAAAGTTT TTTT.TGTGT
351 GTGCGTCAAG GAATTGTTGA CAATTTTAGT T
```

This corresponds to the amino acid sequence <SEQ ID 1596; ORF 547.a>:

a547.pep

```
  1 MFVDNGFNKT VASFAQIVET FDVFFFRNNC TFFTQMKQRC GWVCSLVYLV
 51 DIFPRCGFEI PNRSFKELGL LIQISLSERF RTNAEVEIDA HYFPLLRKYL
101 KFIMLHIFTN IKVFXCVCVK ELLTILV
```

m547/a547 97.6% identity in 127 aa overlap

```
                        10        20        30        40        50        60
m547.pep        MFVDNGFNKTVASFAQIVETFDVFFFRNDCAFFTQMKQRCGWVCSLVYLVDIFPRCGFEI
                ||||||||||||||||||||||||||||:|:|||||||||||||||||||||||||||||
a547            MFVDNGFNKTVASFAQIVETFDVFFFRNNCTFFTQMKQRCGWVCSLVYLVDIFPRCGFEI
                        10        20        30        40        50        60

                        70        80        90       100       110       120
m547.pep        PNRSFKELGLLIQISLSERFRTNAEVEMDAHYFPLLRKYLKFIMLHIFTNIKVFXCVCVK
                |||||||||||||||||||||||||||:||||||||||||||||||||||||||||||||
a547            PNRSFKELGLLIQISLSERFRTNAEVEIDAHYFPLLRKYLKFIMLHIFTNIKVFXCVCVK
                        70        80        90       100       110       120

                       130       140
m547.pep        ELLTILVKNLSPNGKKRFVFCCX
                |||||||
a547            ELLTILV
```

The following partial DNA sequence was identified in *N. gonorrhoeae* <SEQ ID 1597>:

g548.seq

```
  1 atgttttccg taccgcgttc ctttttgccg ggcgttttcg tacttgccgc
 51 gcttgccgcc tgcaaacctc aagacaacag tgcggcgcaa gccgcttctt
101 caagtgcatc cgcgccggct gcggaaaatg cggcaaagcc gcaaacgcgc
151 ggtacggata tgcgtaagga agacatcggc ggcgatttca cactgaccga
201 cggcgaaggc aagcctttca gcctgagcga tttgaaaggc aaggtcgtga
251 ttctgtcttt cggctttacg cactgtcccg atgtctgccc gacagggctt
301 ttgacgtaca gcgacacttt gaagcagttg ggcgggcagg ctaaggacgt
351 gaaagtggtg ttcgtcagca tcgatccgga acgcgacacg cctgaaatca
401 tcggcaagta tgccaaacag ttcaatccgg actttatcgg tctgacggca
```

-continued

```
451 acgggcggcc aaaacctgcc ggtcatcaag cagcaatacc gcgtggtttc

501 tgccaaaatc aatcaaaaag acgacagcga aaactatttg gtcgaccact

551 cttccggtgc gtatcttatc gataaaaacg gtgaggttgc cattttctcg

601 ccttacggaa gcgagccgga aacgattgct gccgatgtaa ggaccctgct

651 ctga
```

This corresponds to the amino acid sequence <SEQ ID 1598; ORF 548.ng>:

g548.pep

```
  1 MFSVPRSFLP GVFVLAALAA CKPQDNSAAQ AASSSASAPA AENAAKPQTR

 51 GTDMRKEDIG GDFTLTDGEG KPFSLSDLKG KVVILSFGFT HCPDVCPTGL

101 LTYSDTLKQL GGQAKDVKVV FVSIDPERDT PEIIGKYAKQ FNPDFIGLTA

151 TGGQNLPVIK QQYRVVSAKI NQKDDSENYL VDHSSGAYLI DKNGEVAIFS

201 PYGSEPETIA ADVRTLL*
```

The following partial DNA sequence was identified in *N. meningitidis* <SEQ ID 1599>:

m548.seq

```
  1 ATGTTTTCCG TACCGCGTTC CTTTTTGCCG GGCGTTTTCG TACTTGCCGC

 51 GCTTGCCGCC TGCAAACCTC AAGACAACAG TGCGGCGCAA GTCGCTTCTT

101 CAAGTGCATC CGCGTCGGCT GCGGAAAATG CGGCAAAGCA AnACACGCGC

151 GGTACGGATA TGCGTAAGGA AGACATCGGC GGCGATTTCA CGCTGACCGA

201 CGGCGAAGGC AAGCCTTTCA ACCTGAGCGA TTTGAAAGGC AAGGTCGTGA

251 TTCTGTCTTT CGGCTTTACG CACTGTCCCG ATGTCTGCCC GACAGAGCTT

301 TTGACGTACA GCGACACGTT GAAGCAGTTG GGCGGGCAGG CTAAGGACGT

351 GAAAGTGGTG TTCGTCAGCA TCGATCCGGA ACGCGACACG CCTGAAATCA

401 TCGGCAAGTA TGCCAAACAG TTCAATCCGG ACTTTATCGs TCTGACGGCA

451 ACGGGCGGCC AAAACCTGCC GGTCATCAAG CAGCAATACc GCGTGGTTTC

501 TGCCAAAGTC AATCAAAAmG ACGACAGCGA AAACTATTTG GTCGACCACT

551 CTTCCGGTGC GTATCTCATC GACAAAAACG GTGAGGTTGC CATTTTCTCG

601 CCTTACGGAA GCGAGCCGGA AACGATTGCT GCCGATGTAA GGACCCTGCT

651 CTGA
```

This corresponds to the amino acid sequence <SEQ ID 1600; ORF 548>:

m548.pep

```
  1 MFSVPRSFLP GVFVLAALAA CKPQDNSAAQ VASSSASASA AENAAKQXTR

 51 GTDMRKEDIG GDFTLTDGEG KPFNLSDLKG KVVILSFGFT HCPDVCPTEL

101 LTYSDTLKQL GGQAKDVKVV FVSIDPERDT PEIIGKYAKQ FNPDFIXLTA
```

-continued

```
151 TGGQNLPVIK QQYRVVSAKV NQXDDSENYL VDHSSGAYLI DKNGEVAIFS

201 PYGSEPETIA ADVRTLL*
```

Computer analysis of this amino acid sequence gave the following results:

Homology with a predicted ORF from *N. gonorrhoeae*

ORF 548 shows 95.9% identity over a 217 aa overlap with a predicted ORF (ORF 548.ng) from *N. gonorrhoeae*:

```
m548/g548

                   10        20        30        40        50        60
m548.pep   MFSVPRSFLPGVFVLAALAACKPQDNSAAQVASSSASASAAENAAKQXTRGTDMRKEDIG
           ||||||||||||||||||||||||||||||:||||||| ||||||   |||||||||||
g548       MFSVPRSFLPGVFVLAALAACKPQDNSAAQAASSSASAPAAENAAKPQTRGTDMRKEDIG
                   10        20        30        40        50        60

                   70        80        90       100       110       120
m548.pep   GDFTLTDGEGKPFNLSDLKGKVVILSFGFTHCPDVCPTELLTYSDTLKQLGGQAKDVKVV
           ||||||||||||:||||||||||||||||||||||| ||||||||||||||||||||
g548       GDFTLTDGEGKPFSLSDLKGKVVILSFGFTHCPDVCPTGLLTYSDTLKQLGGQAKDVKVV
                   70        80        90       100       110       120

                  130       140       150       160       170       180
m548.pep   FVSIDPERDTPEIIGKYAKQFNPDFIXLTATGGQNLPVIKQQYRVVSAKVNQXDDSENYL
           |||||||||||||||||||||||||| |||||||||||||||||||||:|| |||||||
g548       FVSIDPERDTPEIIGKYAKQFNPDFIGLTATGGQNLPVIKQQYRVVSAKINQKDDSENYL
                  130       140       150       160       170       180

                  190       200       210
m548.pep   VDHSSGAYLIDKNGEVAIFSPYGSEPETIAADVRTLLX
           ||||||||||||||||||||||||||||||||||||||
g548       VDHSSGAYLIDKNGEVAIFSPYGSEPETIAADVRTLLX
                 1930       200       210
```

The following partial DNA sequence was identified in *N. meningitidis* <SEQ ID 1601>:

<u>a548.seq</u>

```
  1 ATGTTTTCCG TACCGCGTTC CTTTTTGCCG GGCGTTTTCG TACTTGCCGC

 51 GCTTGCCGCC TGCAAACCTC AAGACAACAG TGCGGCGCAA GTCGCTTCTT

101 CAAGTGCATC CGCGTCGGCT GCGGAAAATG CGGCAAAGCC GCAAACGCGC

151 GGTACGGATA TGCGTAAGGA AGACATCGGC GGCGATTTCA CGCTGACCGA

201 CGGCGAAGGC AAGCCTTTCA ACCTGAGCGA TTTGAAAGGC AAGGTCGTGA

251 TTCTGTCTTT CGGCTTTACG CACTGTCCCG ATGTCTGCCC GACAGAGCTT

301 TTGACGTACA GCGACACGTT GAAGCAGTTG GGCGGGCAGG CTAAGGACGT

351 GAAAGTGGTG TTCGTCAGCA TCGATCCGGA ACGCGACACG CCTGAAATCA

401 TCGGCAAGTA TGCCAAACAG TTCAATCCGG ACTTTATCGG TCTGACGGCA

451 ACGGGCGACC AAAACCTGCC GGTCATCAAG CAGCAATACC GCGTGGTTTC

501 TGCCAAAGTC AATCAAAAAG ACGACAGCGA AAACTATTTG GTCGACCACT

551 CTTCCGGTGC GTATCTCATC GACAAAAACG GTGAGGTTGC CATTTTCTCG

601 CCTTACGGAA GCGAGCCGGA AACGATTGCT GCCGATGTAA GGACCCTGCT

651 CTGA
```

This corresponds to the amino acid sequence <SEQ ID 1602; ORF 548.a>:

a548.pep

```
  1 MFSVPRSFLP GVFVLAALAA CKPQDNSAAQ VASSSASASA AENAAKPQTR
 51 GTDMRKEDIG GDFTLTDGEG KPFNLSDLKG KVVILSFGFT HCPDVCPTEL
101 LTYSDTLKQL GGQAKDVKVV FVSIDPERDT PEIIGKYAKQ FNPDFIGLTA
151 TGDQNLPVIK QQYRVVSAKV NQKDDSENYL VDHSSGAYLI DKNGEVAIFS
201 PYGSEPETIA ADVRTLL*
```

m548/a548 97.7% identity in 217 aa overlap

```
                    10        20        30        40        50        60
m548.pep    MFSVPRSFLPGVFVLAALAACKPQDNSAAQVASSSASASAAENAAKQXTRGTDMRKEDIG
            |||||||||||||||||||||||||||||||||||||||||||||  |||||||||||||
a548        MFSVPRSFLPGVFVLAALAACKPQDNSAAQVASSSASASAAENAAKPQTRGTDMRKEDIG
                    10        20        30        40        50        60

                    70        80        90       100       110       120
m548.pep    GDFTLTDGEGKPFNLSDLKGKVVILSFGFTHCPDVCPTELLTYSDTLKQLGGQAKDVKVV
            ||||||||||||||||||||||||||||||||||||||||||||||||||||||||||||
a548        GDFTLTDGEGKPFNLSDLKGKVVILSFGFTHCPDVCPTELLTYSDTLKQLGGQAKDVKVV
                    70        80        90       100       110       120

                   130       140       150       160       170       180
m548.pep    FVSIDPERDTPEIIGKYAKQFNPDFIXLTATGGQNLPVIKQQYRVVSAKVNQXDDSENYL
            |||||||||||||||||||||||||| ||||| ||||||||||||||||||| |||||||
a548        FVSIDPERDTPEIIGKYAKQFNPDFIGLTATGDQNLPVIKQQYRVVSAKVNQKDDSENYL
                   130       140       150       160       170       180

                   190       200       210
m548.pep    VDHSSGAYLIDKNGEVAIFSPYGSEPETIAADVRTLLX
            ||||||||||||||||||||||||||||||||||||||
a548        VDHSSGAYLIDKNGEVAIFSPYGSEPETIAADVRTLLX
                  1930       200       210
```

The following partial DNA sequence was identified in *N. gonorrhoeae* <SEQ ID 1603>:

g550.seq

```
  1 atgataacgg acaggtttca tctctttcat tttccagtat ctttcattta
 51 tcaatctgac aacaaaatgc cgcctgaaaa cagttcagac ggcattttaa
101 ccacaaacgg cttacagctt ccattcgccc aacttggcag cgtaagcttc
151 caaatctgca atcggacggg ttgccacgcc gctttccatc gctgctttgg
201 cggcagccgt agcgacgcga ggcagcaggc gggaatcgaa cggagtagga
251 atcaggtatt ccgcgccgaa ttcgaatttc ttaccgtaag cggcaaccac
301 ttcttcggtt acttcttcca tcgccaaatc tgccaaagca tacacgcagg
351 cgcgtttcat ttcttcgttg atggtggttg cgccgacatc caacgcgccc
401 cggaagatga acgggaagca caatacgttg ttcacttggt tcgggaagtc
451 ggagcggccg gtaccgataa ccacgtccgg acgggtttct ttcgccagcg
501 gcggcaggat ttccggattc gggttggcca tggcgaacac gatgggtttt
551 tcgttcatcg tgttcaacat ttcaggcgtc agcaggtttg cgccggagag
601 gcccaagaag atgtctttgc ctttaaccgc atcggcaagt acgcgccggc
651 cgttgtcttc aacggcgtag aatttttttgg attcgtccat gcggtctttg
701 tcttcgcggg tttggtaaat cacgcctttg gagttgcaaa cggttacgtt
751 ttcacgtttc aagcccaaat ccagcagttg gttcaggcag gcaatcgcgg
801 cggcacctgc gccggagcac accaaagtcg cttcttcgat tttacggccg
```

-continued

```
851 gtataacgca gggcgttcaa tacggcggcg gcggtaatga tggccgtgcc

901 gtgctggtca tcatgaaata cggggatttt gcagcgtttg cgtaa
```

This corresponds to the amino acid sequence <SEQ ID 1604; ORF 550.ng>:

g550.pep

```
  1 MITDRFHLFH FPVSFIYQSD NKMPPENSSD GILTTNGLQL PFAQLGSVSF

 51 QICNRTGCHA AFHRCFGGSR SDARQQAGIE RSRNQVFRAE FEFLTVSGNH

101 FFGYFFHRQI CQSIHAGAFH FFVDGGCADI QRAPEDEREA QYVVELVREV

151 GAAGTDNHVR TGFFRQRRQD FRIRVGHGEH DGFFVHRVQN FRRQQVCAGE

201 AQEDVFAFNR IGKYAPAVVF NGVEFFGFVH AVFVFAGLVN HAFGVANGYV

252 FTFQAQIQQL VQAGNRGGTC AGAHQSRFFD FTAGITQGVQ YGGGGNDGRA

301 VLVIMKYGDF AAFA*
```

The following partial DNA sequence was identified in *N. meningitidis* <SEQ ID 1605>:

m550.seq (partial)

```
  1 GACGGCATCG GCAAGCACGC GCTGGCCGTT GTCTTCAATG GCGTAGAACT

 51 GTTTGGACTC GTCCATACGG TCTTTGTCTT CGCGGGTTTG GTAAATCACG

101 CCTTTGGAGT CGCAAACGGT CACGTTTTCG CGTTTCAAGC CCAAATCCAG

151 CAATTGGwTC AAGCAGGCAA TCGCGGCCGC ACCTGCGCCG GAACACACCA

201 AAGTCGCTTC TTCGATTTTA CGGCCGGTAA AACGCAkGGC GTTCAATACG

251 GCGGCGGCGG TAATGATGGC CGTGCCGTGC TGGTCGTCGT GGAATACGGG

301 GATTTTGCAG CGTTTGCGTA A
```

This corresponds to the amino acid sequence <SEQ ID 1606; ORF 550>:

m550.pep (partial)

```
  1 DGIGKHALAV VFNGVELFGL VHTVFVFAGL VNHAFGVANG HVFAFQAQIQ

 51 QLXQAGNRGR TCAGTHQSRF FDFTAGKTXG VQYGGGGNDG RAVLVVVEYG

101 DFAAFA*
```

Computer analysis of this amino acid sequence gave the following results:

Homology with a predicted ORF from *N. gonorrhoeae*

ORF 550 shows _% identity over a_aa overlap with a predicted ORF (ORF 550.ng) from *N. gonorrhoeae*:

m550/g550

```
                                            10        20        30
m550.pep                               DGIGKHALAVVFNGVELFGLVHTVFVFAGLVN
                                         |||:| ||||||||:||:||:||||||||
g550       DGFFVHRVQHFRRQQVCAGEAQEDVFAFNRIGKYAPAVVFNGVEFFGFVHAVFVFAGLVN
                   190       200       210       220       230       240
```

-continued

```
                 40         50         60         70         80         90
m550.pep  HAFGVANGHVFAFQAQIQQLXQAGNRGRTCAGTHQSRFFDFTAGKTXGVQYGGGGNDGRA
          ||||||||:||:|||||||| |||||| ||||:||||||||||| | |||||||||||||
g550      HAFGVANGYVFTFQAQIQQLVQAGNRGGTCAGAHQSRFFDFTAGITQGVQYGGGGNDGRA
                  250        260        270        280        290        300

                100
m550.pep  VLVVVEYGDFAAFAX
          |||:::|||||||||
g550      VLVIMKYGDFAAFAX
                  310
```

The following partial DNA sequence was identified in *N. meningitidis* <SEQ ID 1607>:

a550.seq

```
  1 CTATATCAAT CTGACAGCAA AATGCCGCCT GAAAACAGTT CAGACGGCAT
 51 TTTAACCGCA AACGGCTTAC AGCTTCCATT CGCTCAGCTT GGCAGCGTAA
101 GCTTCCAAAT CTGCAATCGG ACGGGTTGCC ACGCCGCTTT CCATCGCTGC
151 TTTGGCGGCA GCCGTAGCAA CGCGCGGCAG CAGGCGGGAA TCGAACGGAG
201 TCGGAATCAG GTATTCCGCG CCGAATTCAA ATTTCTTACC GTAAGCGGCA
251 ACCACTTCTT CGGTTACCTC TTCCATCGCC AAATCCGCCA AAGCATACAC
301 GCAGGCGCGT TTCATTTCTT CGTTGATGGT CGTCGCGCCG ACATCCAACG
351 CACCGCGGAA GATGAACGGG AAGCACAATA CATTGTTCAC TTGGTTCGGG
401 AAGTCGGAGC GGCCGGTACC GATAACCACG TCCGGACGGG TTTCTTTCGC
451 CAGCGGCGGC AGGATTTCCG GATTCGGGTT GGCCATAGCG AACACGATGG
501 GTTTTTCGTT CATGGTGTTC AGTATTTCAG GCGTCAGCAG GTTCGCGCCG
551 GAGAGGCCCA AGAAGATGTC TTTGCCTTTG ACGGCATCGG CAAGCACGCG
601 CTGGCCGTTG TCTTCAATGG CGTAGAACTG TTTGGACTCG TCCATACGGT
651 CTTTGTCTTC GCGGGTTTGG TAAATCACGC CTTTGGAGTC GCAAACGGTC
701 ACGTTTTCGC GTTTCAAGCC CAAATCCAGC AATTGGTTCA AGCAGGCAAT
751 CGCGGCCGCA CCTGCGCCGG AACACACCAA AGTCGCTTCT TCGATTTTAC
801 GGCCGGTAAA ACGCAGGGCG TTCAATACGG CAGCGGCGGT AATGATGGCC
851 GTGCCGTGCT GGTCGTCGTG GAATACGGGG ATTTTGCAGC GTTTGCGTAA
```

This corresponds to the amino acid sequence <SEQ ID 1608; ORF 550.a>:

a550.pep

```
  1 LYQSDSKMPP ENSSDGILTA NGLQLPFAQL GSVSFQICNR TGCHAAFHRC
 51 FGGSRSNARQ QAGIERSRNQ VFRAEFKFLT VSGNHFFGYL FHRQIRQSIH
101 AGAFHFFVDG RRADIQRTAE DEREAQYIVH LVREVGAAGT DNHVRTGFFR
151 QRRQDFRIRV GHSEHDGFFV HGVQYFRRQQ VRAGEAQEDV FAFDGIGKHA
201 LAVVFNGVEL FGLVHTVFVF AGLVNHAFGV ANGHVFAFQA QIQQLVQAGN
251 RGRTCAGTHQ SRFFDFTAGK TQGVQYGSGG NDGRAVLVVV EYGDFAAFA*
```

m550/a550 97.2% identity in 106 aa overlap

```
                                              10        20        30
m550.pep                                DGIGKHALAVVFNGVELFGLVHTVFVFAGL
                                        ||||||||||||||||||||||||||||||
a550      EHDGFFVHGVQYFRRQQVRAGEAQEDVFAFDGIGKHALAVVFNGVELFGLVHTVFVFAGL
              170       180       190       200       210       220

                 40        50        60        70        80        90
m550.pep  VNHAFGVANGHVFAFQAQIQQLXQAGNRGRTCAGTHQSRFFDFTAGKTXGVQYGGGGNDG
          |||||||||||||||||||||| ||||||||||||||||||||||||| |||||:|||||
a550      VNHAFGVANGHVFAFQAQIQQLVQAGNRGRTCAGTHQSRFFDFTAGKTQGVQYGSGGNDG
              230       240       250       260       270       280

                100
m550.pep  RAVLVVVEYGDFAAFAX
          |||||||||||||||||
a550      RAVLVVVEYGDFAAFAX
              290       300
```

The following partial DNA sequence was identified in *N. gonorrhoeae* <SEQ ID 1609>:

g552.seq

```
  1 atgaagctga aaaccttgtt attgcccttc gccgcactgg cattgtgtgc
 51 caacgcattt gccgccccgc ccggcgacgc gtcgttggca cgttggctgg
101 atacgcagaa tttcgaccgg gatatagaaa aaaatatgat tgaaggcttt
151 aatgccggat ttaaaccgta tgcggacaaa gcccttgccg aaatgccgga
201 agcgaaaaaa gatcaggcgg cagaagcctt taatcgttat cgtgagaatg
251 ttttgaaaga tttgattacg cccgaagtga aacaggctgt ccgcaatacc
301 ttattgaaga atgcccgtga aatatacacg caagaagaaa ttgacggcat
351 gattgccttt tacggttcgc ctgtcggtca gtccgtcgtt gccaaaaatc
401 cgcgcttaat caagaaatcg atgagtgaaa tagcggtatc ttggactgca
451 ttgtcaggga aaatcgcgcg acatcatctg cccgagttta cggaagagtt
501 acggcgcatc atctgcggcg gtatagtgga ttaa
```

This corresponds to the amino acid sequence <SEQ ID 1610; ORF552.ng>:

g552.pep

```
  1 MKLKTLLLPFAALALCANAFAAPPGDASLA RWLDTQNFDR DIEKNMIEGF
 51 NAGFKPYADK ALAEMPEAKK DQAAEAFNRY RENVLKDLIT PEVKQAVRNT
101 LLKNAREIYT QEEIDGMIAF YGSPVGQSVV AKNPRLIKKS MSEIAVSWTA
151 LSGKIARHHL PEFTEELRRI ICGGIVD*
```

The following partial DNA sequence was identified in *N. meningitidis* <SEQ ID 1611>:

m552.seq (partial)

```
  1 ATTAAACTGA AAACCTTGTT ATTGCCCTTC GCCACGCTGG CATTGTGCAC
 51 CAATGCTTTT GCCGCCCCGC CCAGCGACGC GTCGTTGGCG CGTTGGCTGG
101 ATACGCAGAA TTTTGACCGG GATATAGAAA AAAATATGAT TGAGGGCTTT
151 AATGCCGGAT TTAAACCGTA TGCGGACAAA GCCCTTGCCG AAATGCCGGA
```

-continued

```
201 AGCGAAAAAA GATCAGGCGG CAGAAGCCTT TAACCGTTAT CGTGAGAATG

251 TTTTGAAAGA TTTGATTACG CCCGAAGTGA AACAGGCTGT CCGCAATACT

301 TTATTGAAGA ATGCCCGTGA GATATACACG CAAGAAGAAA TTGACGGCAT

351 GATTGCCTTT TACGGTTCGC CTGTCGGTCA GTCCGTCGTT GCCAAAAATC

401 CGCGCTTAAT CAAGAAATCG ATGAGTGAAA TAGCGGTATC TTGGACTGCA

451 TTGTCAGGGA AAATCGCGCA ACATCATCTG CCCGAGTTTA CGGAAGAGTT

501 GCGGCGCATC ATCTGCGGCG GTAAAAATCC CGATGCGGGC TGTAAACAAG

551 CCGGACAGGT TGGGAAAAGG CATCAGAAAT AA
```

This corresponds to the amino acid sequence <SEQ ID 1612; ORF 552>:

m552.pep (partial)

```
  1 IKLKTLLLPFATLALCTNAFAAPPSDASLA RWLDTQNFDR DIEKNMIEGF

 51 NAGFKPYADK ALAEMPEAKK DQAAEAFNRY RENVLKDLIT PEVKQAVRNT

101 LLKNAREIYT QEEIDGMIAF YGSPVGQSVV AKMPRLIKKS MSEIAVSWTA

151 LSGKIAQHHL PEFTEELRRI ICGGKNPDAG CKQAGQVGKR HQK*
```

Computer analysis of this amino acid sequence gave the following results:

Homology with a predicted ORF from *N. gonorrhoeae*

ORF 552 shows 97.1% identity over a 174 aa overlap with a predicted ORF (ORF 552.ng) from *N. gonorrhoeae*:

m552/g552

```
                    10        20        30        40        50        60
m552.pep   IKLKTLLLPFATLALCTNAFAAPPSDASLARWLDTQNFDRDIEKNMIEGFNAGFKPYADK
           :||||||||||:||||:|||||||:|||||||||||||||||||||||||||||||||||
g552       MKLKTLLLPFAALALCANAFAAPPGDASLARWLDTQNFDRDIEKNMIEGFNAGFKPYADK
                    10        20        30        40        50        60

                    70        80        90       100       110       120
m552.pep   ALAEMPEAKKDQAAEAFNRYRENVLKDLITPEVKQAVRNTLLKNAREIYTQEEIDGMIAF
           ||||||||||||||||||||||||||||||||||||||||||||||||||||||||||||
g552       ALAEMPEAKKDQAAEAFNRYRENVLKDLITPEVKQAVRNTLIKNAREIYTQEEIDGMIAF
                    70        80        90       100       110       120

                   130       140       150       160       170       180
m552.pep   YGSPVGQSVVAKNPRLIKKSMSEIAVSWTALSGKIAQHHLPEFTEELRRIICGGKNPDAG
           |||||||||||||||||||||||||||||||||||:|||||||||||||||||
g552       YGSPVGQSVVAKNPRLIKKSMSEIAVSWTALSGKIARHHLPEFTEELRRIICGGIVDX
                   130       140       150       160       170

                   190
m552.pep   CKQAGQVGKRHQKX
```

The following partial DNA sequence was identified in *N. meningitidis* <SEQ ID 1613>:

a552.seq

```
  1 ATTAAACTGA AAACCTTGTT ATTGCCCTTC CCCACGCTGG CATTGTGCAC

 51 CAATGCTTTT GCCGCCCCGC CCAGCGACGC GTCGTTGGCG CGTTGGCTGG

101 ATACGCAGAA TTTTGACCGG GATATAGAAA AAAATATGAT TGAGGGCTTT
```

-continued

```
151 AATGCCGGAT TTAAACCGTA TGCGGACAAA GCCCTTGCCG AAATGCCGGA

201 AGCGAAAAAA GATCAGGCGG CAGAAGCCTT TAACCGTTAT CGTGAGAATG

251 TTTTGAAAGA TTTGATTACG CCCGAAGTGA AACAGGCTGT CCGGAATACT

301 TTATTGAAGA ATGCCCGTGA GATATACACG CAAGAAGAAA TTGACGGCAT

351 GATTGCCTTT TACGGTTCGC CTGTCGGTCA GTCCGTCGTT GCCAAAAATC

401 CGCGCTTAAT CAAGAAATCG ATGAGTGAAA TAGCGGTATC TTGGACTGCA

451 TTGTCAGGGA AAATCGCGCA ACATCATCTG CCCGAGTTTA CGGAAGAGTT

501 GCGGCGCATC ATCTGCGGCG GTAAAAATCC CGATGCGGGC TGTAAACAAG

551 CCGGACAGGT TGGGAAAAGG CATCAGAAAT AA
```

This corresponds to the amino acid sequence <SEQ ID 1614; ORF 552.a>:

a552.pep

```
  1 IKLKTLLLPFATLALCTNAFAAPPSDASLA RWLDTQNFDR DIEKNMIEGF

 51 NAGFKPYADK ALAEMPEAKK DQAAEAFNRY RENVLKDLIT PEVKQAVRNT

101 LLKNAREIYT QEEIDGMIAF YGSPVGQSVV AKNPRLIKKS MSEIAVSWTA

151 LSGKIAQHHL PEFTEELRRI ICGGKNPDAG CKQAGQVGKR HQK*
```

m552/a552 100.0% identity in 193 aa overlap

```
                   10        20        30        40        50        60
m552.pep   IKLKTLLLPFATLALCTNAFAAPPSDASLARWLDTQNFDRDIEKNMIEGFNAGFKPYADK
           ||||||||||||||||||||||||||||||||||||||||||||||||||||||||||||
a552       IKLKTLLLPFATLALCTNAFAAPPSDASLARWLDTQNFDRDIEKNMIEGFNAGFKPYADK
                   10        20        30        40        50        60

                   70        80        90       100       110       120
m552.pep   ALAEMPEAKKDQAAEAFNRYRENVLKDLITPEVKQAVRNTLLKNAREIYTQEEIDGMIAF
           ||||||||||||||||||||||||||||||||||||||||||||||||||||||||||||
a552       ALAEMPEAKKDQAAEAFNRYRENVLKDLITPEVKQAVRNTLIKNAREIYTQEEIDGMIAF
                   70        80        90       100       110       120

                  130       140       150       160       170       180
m552.pep   YGSPVGQSVVAKNPRLIKKSMSEIAVSWTALSGKIAQHHLPEFTEELRRIICGGKNPDAG
           ||||||||||||||||||||||||||||||||||||||||||||||||||||||||||||
a552       YGSPVGQSVVAKNPRLIKKSMSEIAVSWTALSGKIAQHHLPEFTEELRRIICGGKNPDAG
                  130       140       150       160       170       180

                  190
m552.pep   CKQAGQVGKRHQKX
           ||||||||||||||
a552       CKQAGQVGKRHQKX
                  190
```

The following partial DNA sequence was identified in *N. meningitidis* <SEQ ID 1615>:

m552-1.seq

```
  1 TTGAATATTA AACTGAAAAC CTTGTTATTG CCCTTCGCCA CGCTGGCATT

 51 GTGCACCAAT GCTTTTGCCG CCCCGCCCAG CGACGCGTCG TTGGCGCGTT

101 GGCTGGATAC GCAGAATTTT GACCGGGATA TAGAAAAAAA TATGATTGAG

151 GGCTTTAATG CCGGATTTAA ACCGTATGCG GACAAAGCCC TTGCCGAAAT

201 GCCGGAAGCG AAAAAAGATC AGGCGGCAGA AGCCTTTAAC CGTTATCGTG
```

-continued

```
251 AGAATGTTTT GAAAGATTTG ATTACGCCCG AAGTGAAACA GGCTGTCCGC
301 AATACTTTAT TGAAGAATGC CCGTGAGATA TACACGCAAG AAGAAATTGA
351 CGGCATGATT GCCTTTTACG GTTCGCCTGT CGGTCAGTCC GTCGTTGCCA
401 AAAATCCGCG CTTAATCAAG AAATCGATGA GTGAAATAGC GGTATCTTGG
451 ACTGCATTGT CAGGGAAAAT CGCGCAACAT CATCTGCCCG AGTTTACGGA
501 AGAGTTGCGG CGCATCATCT GCGGCGGTAA AAATCCCGAT GCGGGCTGTA
551 AACAAGCCGG ACAGGTTGGG AAAAGGCATC AGAAATAA
```

This corresponds to the amino acid sequence <SEQ ID 1616; ORF 552-1>:

m552-1.pep

```
  1 LNIKLKTLLLPFATLALCTNAFAAPPSDAS LARWLDTQNF DRDIEKNMIE
 51 GFNAGFKPYA DKALAEMPEA KKDQAAEAFN RYRENVLKDL ITPEVKQAVR
101 NTLLKNAREI YTQEEIDGMI AFYGSPVGQS VVAKNPRLIK KSMSEIAVSW
151 TALSGKIAQH HLPEFTEELR RIICGGKNPD AGCKQAGQVG KRHQK*
```

The following partial DNA sequence was identified in *N. meningitidis* <SEQ ID 1617>:

a552-1.seq

```
  1 TTGAATATTA AACTGAAAAC CTTGTTATTG CCCTTCGCCA CGCTGGCATT
 51 GTGCACCAAT GCTTTTGCCG CCCCGCCCAG CGACGCGTCG TTGGCGCGTT
101 GGCTGGATAC GCAGAATTTT GACCGGGATA TAGAAAAAAA TATGATTGAG
151 GGCTTTAATG CCGGATTTAA ACCGTATGCG GACAAAGCCC TTGCCGAAAT
201 GCCGGAAGCG AAAAAAGATC AGGCGGCAGA AGCCTTTAAC CGTTATCGTG
251 AGAATGTTTT GAAAGATTTG ATTACGCCCG AAGTGAAACA GGCTGTCCGC
301 AATACTTTAT TGAAGAATGC CCGTGAGATA TACACGCAAG AAGAAATTGA
351 CGGCATGATT GCCTTTTACG GTTCGCCTGT CGGTCAGTCC GTCGTTGCCA
401 AAAATCCGCG CTTAATCAAG AAATCGATGA GTGAAATAGC GGTATCTTGG
451 ACTGCATTGT CAGGGAAAAT CGCGCAACAT CATCTGCCCG AGTTTACGGA
501 AGAGTTGCGG CGCATCATCT GCGGCGGTAA AAATCCCGAT GCGGGCTGTA
551 AACAAGCCGG ACAGGTTGGG AAAAGGCATC AGAAATAA
```

This corresponds to the amino acid sequence <SEQ ID 1618; ORF 552-1.a>:

a552-1.pep

```
  1 LNIKLKTLLLPFATLALCTNAFAAPPSDAS LARWLDTQNF DRDIEKNMIE
 51 GFNAGFKPYA DKALAEMPEA KKDQAAEAFN RYRENVLKDL ITPEVKQAVR
101 NTLLKNAREI YTQEEIDGMI AFYGSPVGQS VVAKNPRLIK KSMSEIAVSW
151 TALSGKIAQH HLPEFTEELR RIICGGKNPD AGCKQAGQVG KRHQK*
```

a552-1/m552-1 100.0% identity in 195 aa overlap

```
                    10        20        30        40        50        60
a552-1.pep  LNIKLKTLLLPFATLALCTNAFAAPPSDASLARWLDTQNFDRDIEKNMIEGFNAGFKPYA
            ||||||||||||||||||||||||||||||||||||||||||||||||||||||||||||
m552        LNIKLKTLLLPFATLALCTNAFAAPPSDASLARWLDTQNFDRDIEKNMIEGFNAGFKPYA
                    10        20        30        40        50        60

                    70        80        90       100       110       120
a552-1.pep  DKALAEMPEAKKDQAAEAFNRYRENVLKDLITPEVKQAVRNTLLKNAREIYTQEEIDGMI
            ||||||||||||||||||||||||||||||||||||||||||||||||||||||||||||
m552        DKALAEMPEAKKDQAAEAFNRYRENVLKDLITPEVKQAVRNTLIKNAREIYTQEEIDGMI
                    70        80        90       100       110       120

                   130       140       150       160       170       180
a552-1.pep  AFYGSPVGQSVVAKNPRLIKKSMSEIAVSWTALSGKIAQHHLPEFTEELRRIICGGKNPD
            ||||||||||||||||||||||||||||||||||||||||||||||||||||||||||||
m552        AFYGSPVGQSVVAKNPRLIKKSMSEIAVSWTALSGKIAQHHLPEFTEELRRIICGGKNPD
                   130       140       150       160       170       180

                   190
a552-1.pep  AGCKQAGQVGKRHQKX
            ||||||||||||||||
m552        AGCKQAGQVGKRHQKX
                   190
```

The following partial DNA sequence was identified in *N. gonorrhoeae* <SEQ ID 1619>:

g553.seq

```
  1 atggattatc tgcaaaacct gtctttgggc ttgacaaaaa agctgcccgt
 51 tatactgcaa acagaagtag cggagtgtgg cttggcatgt ctagcggctg
101 tggccggatt ttatggtttc tatacggatt tgcgcgcact gcgttcaaaa
151 tactgtctgt cacttaaggg tgagaatttg gcagatattg ttcgttttgc
201 tgatgatatg gggctgacgg gacgggcgtt gaggctggat ttagacgaat
251 tgggcagttt gcgcctgccc tgtattctac attgggattt gaatcatttt
301 gtggtgctgg aatcggtatc ttcggacggg gctgccgtca tggatccggc
351 ttcgggacga cgcaaagtca agacggagga aatatcgcgc aagtttacgg
401 gaattgcttt ggaactgtgg ccaaacacgc gtttcgaggc aggggaagaa
451 aagcaggaaa tccgcatcct acccatgttg cgcgggattt ctgggctggg
501 gcggacattg tttcagcttt tggctttggc agcagcaatg gaagtgtttg
551 ctttttttaca aaacgtcagc ttcaagatcg gacgtggtga atcgcttgcg
601 ttaatcggac gatcgggctg cggtaaatcg acacttttgg atattttaag
651 cggcaatcta cctcccgaat caggcaaagt catgataaat gggcacgaca
701 tttacagctt accgccacct tttattccgc aatttgagtg cgatggtcaa
751 ggcaggacga tgttttatag tggattaaat ttaaaccggt ag
```

This corresponds to the amino acid sequence <SEQ ID 1620; ORF 553.ng>:

g553.pep

```
  1 MDYLQNLSLG LTKKLPVILQ TEVAECGLAC LAAVAGFYGF YTDLRALRSK
 51 YCLSLKGENL ADIVRFADDM GLTGRALRLD LDELGSLRLP CILHWDLNHF
101 VVLESVSSDG AAVMDPASGR RKVKTEEISR KFTGIALELW PNTRFEAGEE
151 KQEIRILPML RGISGLGRTL FQLLALAAAMEVFAFLQNVS FKIGRGESLA
```

-continued

```
201 LIGRSGCGKS TLLDILSGNL PPESGKVMIN GHDIYSLPPP FIPQFECDGQ

251 GRTMFYSGLN LNR*
```

The following partial DNA sequence was identified in *N. meningitidis* <SEQ ID 1621>:

m553.seq (partial)

```
  1 ATGGATTATT TATCAAGACT GTCCTTTGGA TTTAACAAAA AGCTACCTGT

 51 CATTCTGCAA ACAGAAGTTG CTGAATGTGG TTTAGCATGC CTGACATCCA

101 TCTTGTCCTA TTATGGCTTT CACACTGATT TAAGAACGTT ACGCCAAAAA

151 TACACCCTGT CATTAAAGGG CGCAAATCTT GCAGACATCA TGAGATTTGG

201 CAATGAAATG AATTTAACGC CACGAGCTTT GCGTTTAGAG TTAGATGAGC

251 TGTCAAATTT ACAACTACCC TGCATTCTCC ATTGGAACTT AAACCATTTT

301 GTTGTACTTT GTTCCATTTC CAAAGACAGT ATCGTCATTA TGGACCCTGC

351 TGTCGGTATG CGAAAAATCA AAATGGACGA AGTTTCACAA AAATTCACAG

401 GGATTGCCCT AGAATTATTC CCCAATACCC ATTTTGAAGA GAAAAAAGAA

451 ACAAAGAAAA TCAAAATATT ATCTCTATTA AGGGGGGG.T CAGGCTTAAA

501 ACGCTCTTTA ATTCAAATGC TTATATTAGC TATTTCTTTG GAAGTCTTTG

551 CATTG...
```

This corresponds to the amino acid sequence <SEQ ID 1622; ORF 553>:

m553.pep (partial)

```
  1 MDYLSRLSFG FNKKLPVILQ TEVAECGLAC LTSILSYYGF HTDLRTLRQK

 51 YTLSLKGANL ADIMRFGNEM NLTPRALRLE LDELSNLQLP CILHWNLNHF

101 VVLCSISKDS IVIMDPAVGM RKIKMDEVSQ KFTGIALELF PNTHFEEKKE

151 TKKIKILSLL RGXSGLKRSL IQMLILAISL EVFAL...
```

Computer analysis of this amino acid sequence gave the following results:

Homology with a predicted ORF from *N. gonorrhoeae*

ORF 553 shows 65.5% identity over a 185 aa overlap with a predicted ORF (ORF 553.ng) from *N. gonorrhoeae*:

m553/g553

```
                   10        20        30        40        50        60
g553.pep   MDYLQNLSLGLTKKLPVILQTEVAECGLACLAAVAGFYGFYTDLRALRSKYCLSLKGENL
           ||||: ||:|::|||||||||||||||||||::: ::|||:||||:||:|| ||||| ||
m553       MDYLSRLSFGFNKKLPVILQTEVAECGLACLTSILSYYGFHTDLRTLRQKYTLSLKGANL
                   10        20        30        40        50        60

                   70        80        90       100       110       120
g553.pep   ADIVRFADDMGLTGRALRLDLDELGSLRLPCILHWDLNHFVVLESVSSDGAAVMDPASGR
           |||:||:::|:|| |||||:||||::|:|||||||:||||||| |:|:|: ::|||| |
m553       ADIMRFGNEMNLTPRALRLELDELSNLQLPCILHWNLNHFVVLCSISKDSIVIMDPAVGM
                   70        80        90       100       110       120
```

-continued

```
                    130       140       150       160       170       180
g553.pep      RKVKTEEISRKFTGIALELWPNTRFEAGEEKQEIRILPMLRGISGLGRTLFQLLALAAAM
              ||:| :|:|:|||||||||:|||:||  :| ::|:|| :||| ||| |:|:|:| || ::
m553          RKIKMDEVSQKFTGIALELFPNTHFEEKKETKKIKILSLLRGXSGLKRSLIQMLILAISL
                    130       140       150       160       170       180

                    190       200       210       220       230       240
g553.pep      EVFAFLQNVSFKIGRGESLALIGRSGCGKSTLLDILSGNLPPESGKVMINGHDIYSLPPP
              ||||:
m553          EVFAL
```

The following partial DNA sequence was identified in *N. meningitidis* <SEQ ID 1623>:

a553.seq

```
  1 ATGCCCCATC TGCAAAACCT GTCTTTGGGC TTAAAGAAAA AGCTGCCTGT
 51 TATCCTGCAA ACAGAAATAT CAGAATGCGG CTTGGCATGT CTGGCGGCTG
101 TGGCGGGATT TCATGGTTTC CATACGAATT TACGCGCACT GCGTTCAAAA
151 TAC
```

This corresponds to the amino acid sequence <SEQ ID 1624; ORF 553.a>:

a553.pep

```
 1 MPHLQNLSLG LKKKLPVILQ TEISECGLAC LAAVAGFHGF HTNLRALRSK
51 Y
```

m553/a553 62.7% identity in 51 aa overlap

```
                       10        20        30        40        50        60
m553.pep      MDYLSRLSFGFNKKLPVILQTEVAECGLACLTSILSYYGFHTDLRTLRQKYTLSLKGANL
              | :|: ||:|::||||||||||::|||||||::: :::||||:||:||:||
a553          MPHLQNLSLGLKKKLPVILQTEISECGLACLAAVAGFHGFHTNLRALRSKY
                       10        20        30        40        50

                       70        80        90       100       110       120
m553.pep      ADIMRFGNEMNLTPRALRLELDELSNLQLPCILHWNLNHFVVLCSISKDSIVIMDPAVGM
```

The following partial DNA sequence was identified in *N. gonorrhoeae* <SEQ ID 1625>:

g554.seq..

```
  1 atgacagcac ataaaatcct gcccgtcctt cttcccatca tcttaggcgt
 51 ttctcacgca acggctgcat cgcccgcgcc caacagaccg acggtacacg
101 ccgccccccac gctccaaaca cccgaaaccc tcacggcggc acacatcgtt
151 atcgaccttc aaagcaggca gactttatcc gccaaaaaca ccaatacccc
201 tgtcgaaccg gcggcactaa cccaactgat gaccgcatat ttggttttca
251 aaaacatgaa atcgggaaat atccaatctg aagaaaactt aaaaataccc
301 gaatccgcat gggcttcaga aggaagcaga atgtttgtac gtcccggcga
351 tacggtcagc accgacaaac tcttaaaagg catgattgcc ctatgcgcaa
401 acgatgccgc cctaaccctt gccgaccggc tgggcaacgg ctcgattgaa
```

-continued

```
 451 aattttgtgc aacaaatgaa caaagaagcc cgacgcttgg gcatgaagaa
 501 caccgtattc aaaaacccga caggcttggg tagagaagga caggtttcca
 551 ccgccaaaga cctctccctg ctgtctgaag cattgatgcg cgactttccg
 601 gaatattacc cgctgttttc catcaaatcg ttcaagtttg aaaacataga
 651 acaaaacaac cgcaatatcc ttttatatag ggacaacaat gtaaacggcc
 701 tgaaagccgg gcacacagaa agcggcggct acaaccttgc cgtgtcatac
 751 tccggcaacg gcaggcacat ccttgtcatc acactaggtt cggaatcggc
 801 ggaaacccgc gcatcggaca acagcaagct gctgaaccgg gcattgcagg
 851 ccttcgatac gcccaaaata tatccgaaag gcaaaaccgt tgcccaaatc
 901 caaatttccg gaggcagcaa aaaaaccgtc cgcgcaggct tcctcaaaga
 951 agcctacatc actctgccac ataaagaagc gaaaatggca gaacagattt
1001 tggaaaccat acagccgatt cccgccccgg taaaaaaagg gcagatttta
1051 ggaaaaatca aaatcaggca aaacggacat accattgccg aaaaagaaat
1101 cgtcgcactg gaaaacgtag aaaaaagaag ccggtggcaa aggctttgga
1151 cgcgtctgac agggcagtaa
```

This corresponds to the amino acid sequence <SEQ ID 1626; ORF 554.ng>:

g554.pep..

```
  1 MTAHKILPVL LPIILGVSHA TAASPAPNRP TVHAAPTLQT PETLTAAHIV
 51 IDLQSRQTLS AKNTNTPVEP AALTQLMTAY LVFKNMKSGN IQSEENLKIP
101 ESAWASEGSR MFVRPGDTVS TDKLLKGMIA LCANDAALTL ADRLGNGSIE
151 NFVQQMNKEA RRLGMKNTVF KNPTGLGREG QVSTAKDLSL LSEALMRDFP
201 EYYPLFSIKS FKFENIEQNN RNILLYRDNN VNGLKAGHTE SGGYNLAVSY
251 SGNGRHILVI TLGSESAETR ASDNSKLLNR ALQAFDTPKI YPKGKTVAQI
301 QISGGSKKTV RAGFLKEAYI TLPHKEAKMA EQILETIQPI PAPVKKGQIL
351 GKIKIRQNGH TIAEKEIVAL ENVEKRSRWQ RLWTRLTGQ*
```

The following partial DNA sequence was identified in *N. meningitidis* <SEQ ID 1627>:

m554.seq..

```
  1 ATGACAGCAC ATAAAATCCT GCCCGTCCTG CTTTCCATCA TCTTAGGCGT
 51 TTCTCACGCA ACGGCTGCAT CGCCCGCGCC CAACAGACCG ACGGTACACG
101 CCGCCCCCAC GTTCCAAACA CCCGAAACCC TCACAGCGGC ACACATCGTT
151 ATCGACCTTC AAAGCAAACA GATTTTATCC GCCAAAAACA TCAATACCCC
201 TGTTGAACCG GCGGCACTAA CCCAACTGAT GACCGCATAT CTGGTTTTCA
251 AAAACATGAA ATCGGGCAAT ATCCAATCTG AAGAAAACTT AAAAATACCC
301 GAATCCGCAT GGGCTTCAGA AGGAAGCAGA ATGTTTGTAC GTCCCGGCGA
351 TACGGTCAGC ACCGACAAAC TCTTAAAAGG CATGATTGCA CTATCCGCAA
```

-continued

```
 401 ACGATGCCGC CCTAACCCTT GCCGGCCGGC TGGGCAACGG CTCGATTGAA

 451 AATTTTGTGC AACAAATGAA CAAAGAAGCC CGACGCTTGG GCATGAAGAA

 501 CACTGTATTC AAAAACCCGA CAGGCTTGAG TAGAGAAGGA CAGGTTTCCA

 551 CCGCCAAAGA CCTCGCCCTG CTGTCTGAAG CATTGATGCG CGACTTTCCG

 601 GAATATTACC CGCTGTTTTC CATCAAATCT TTCAAATTCA AAAATATAGA

 651 ACAAAACAAC CGCAATATCC TTTTATATAG GGACAACAAT GTAAACGGTC

 701 TGAAAGCCGG ACACACAGAA AGCGGCGGCT ACAACCTTGC CGTGTCATAC

 751 TCCGGCAACG GCAGGCACAT CCTTGTCATC ACATTGGGTT CGGAATCGGC

 801 GGAAACACGC GCATCAGACA ACAGCAAGCT GCTGAACTGG GCATTGCAGG

 851 CCTTCGATAC GCCCAAAATA TATCCGAAAG GCAAAACCGT TGCCCAAATC

 901 CAAATTTCCG GAGGCAGCAA AAAAACCGTC CGCGCAGGCT TCCTCAAAGA

 951 AGCCTACATC ACTCTGCCAC ATAAGGAAGC GAAAATGGCA GAACAAATTC

1001 TAGAAACCAT ACAGCCGATT CCCGCCCCAG TAAAAAAAGG GCAAATTTTA

1051 GGAAAAATCA AAATCAGACA AAACGGATAC ACCATTGCCG AAAAAGAAAT

1101 CGTCGCACTG GAAAATGTAA AAAAAAGAAG CCGGTGGCAA AGGCTTTGGG

1151 CGTGTCTGAC AGGGCAGTAA
```

This corresponds to the amino acid sequence <SEQ ID 1628; ORF 554>:

```
m554.pep..

  1 MTAHKILPVL LSIILGVSHA TAASPAPNRP TVHAAPTFQT PETLTAAHIV

 51 IDLQSKQILS AKNINTPVEP AALTQLMTAY LVFKNMKSGN IQSEENLKIP

101 ESAWASEGSR MFVRPGDTVS TDKLLKGMIA LSANDAALTL AGRLGNGSIE

151 NFVQQMNKEA RRLGMKNTVF KNPTGLSREG QVSTAKDLAL LSEALMRDFP

201 EYYPLFSIKS FKFKNIEQNN RNILLYRDNN VNGLKAGHTE SGGYNLAVSY

251 SGNGRHILVI TLGSESAETR ASDNSKLLNW ALQAFDTPKI YPKGKTVAQI

301 QISGGSKKTV RAGFLKEAYI TLPHKEAKMA EQILETIQPI PAPVKKGQIL

351 GKIKIRQNGY TIAEKEIVAL ENVKKRSRWQ RLWACLTGQ*
```

Computer analysis of this amino acid sequence gave the following results:

Homology with a predicted ORF from *N. gonorrhoeae*

ORF 554 shows 96.1% identity over a 389 aa overlap with a predicted ORF (ORF 554.ng) from *N. gonorrhoeae*:

```
m554/g554

                    10        20        30        40        50        60
m554.pep    MTAHKILPVLLSIILGVSHATAASPAPNRPTVHAAPTFQTPETLTAAHIVIDLQSKQILS
            ||||||||||| |||||||||||||||||||||||||:|||||||||||||||||:| ||
g554        MTAHKILPVLLPIILGVSHATAASPAPNRPTVHAAPTLQTPETLTAAHIVIDLQSRQTLS
                    10        20        30        40        50        60

                    70        80        90       100       110       120
m554.pep    AKNINTPVEPAALTQLMTAYLVFKNMKSGNIQSEENLKIPESAWASEGSRMFVRPGDTVS
            ||| ||||||||||||||||||||||||||||||||||||||||||||||||||||||||
g554        AKNTNTPVEPAALTQLMTAYLVFKNMKSGNIQSEENLKIPESAWASEGSRMFVRPGDTVS
                    70        80        90       100       110       120
```

-continued

```
                 130       140       150       160       170       180
m554.pep  TDKLLKGMIALSANDAALTLAGRLGNGSIENFVQQMNKEARRLGMKNTVFKNPTGLSREG
          ||||||||||| ||||||||| ||||||||||||||||||||||||||||||||||:|||
g554      TDKLLKGMIALCANDAALTLADRLGNGSIENFVQQMNKEARRLGMKNTVFKNPTGLGREG
                 130       140       150       160       170       180

190       200       210       220       230       240
m554.pep  QVSTAKDLALLSEALMRDFPEYYPLFSIKSFKFKNIEQNNRNILLYRDNNVNGLKAGHTE
          ||||||||:||||||||||||||||||||||||:||||||||||||||||||||||||||
g554      QVSTAKDLSLLSEALMRDFPEYYPLFSIKSFKFENIEQNNRNILLYRDNNVNGLKAGHTE
                 190       200       210       220       230       240

250       260       270       280       290       300
m554.pep  SGGYNLAVSYSGNGRHILVITLGSESAETRASDNSKLLNWALQAFDTPKIYPKGKTVAQI
          ||||||||||||||||||||||||||||||||||||||| ||||||||||||||||||||
g554      SGGYNLAVSYSGNGRHILVITLGSESAETRASDNSKLLNRALQAFDTPKIYPKGKTVAQI
                 250       260       270       280       290       300

310       320       330       340       350       360
m554.pep  QISGGSKKTVRAGFLKEAYITLPHKEAKMAEQILETIQPIPAPVKKGQILGKIKIRQNGY
          |||||||||||||||||||||||||||||||||||||||||||||||||||||||||||:
g554      QISGGSKKTVRAGFLKEAYITLPHKEAKMAEQILETIQPIPAPVKKGQILGKIKIRQNGH
                 310       320       330       340       350       360

370       380       390
m554.pep  TIAEKEIVALENVKKRSRWQRLWACLTGQX
          |||||||||||||:|||||||||: |||||
g554      TIAEKEIVALENVEKRSRWQRLWTRLTGQX
                 370       380       390
```

The following partial DNA sequence was identified in *N. meningitidis* <SEQ ID 1629>:

a554.seq

```
   1 ATGACAGCAC ATAAAATCCT GCCCGTCCTG CTTTCCATCA TCTTAGGCGT
  51 TTCTCACGCA ACGGCTGCAT CGCCCGCGCC CAACAGACCG ACGGCACACG
 101 CCGCCCCCAC GTTCCAAACA CCCGAAACCC TCACAGCGGC ACACATCGTT
 151 ATCGACCTTC AAAGCAAACA GATTTTATCC GCCAAAAACA TCAATACCCC
 201 TGTCGAACCG GCGGCACTAA CCCAACTGAT GACCGCATAT CTGGTTTTCA
 251 AAAACATGAA ATCGGGAAAT ATCCGATCTG AAGAAAACTT AAAAATACCC
 301 GAATCCGCAT GGGCTTCAGA AGGAAGCAGA ATGTTTGTAC GTCCCGGCGA
 351 TACGGTCAGC ACCGACAAAC TCTTAAAAGG CATGATTGCA CTATCCGCAA
 401 ACGATGCCGC CCTAACCCTT GCCGGCCGGC TGGGCAACGG CTCGATTGAA
 451 AATTTTGTGC AACAAATGAA CAAAGAAGCC CGACGCTTGG GCATGAAGAA
 501 CACTGTATTC AAAAATCCGA CAGGCTTGAG TAGAGAAGGA CAGGTTTCCA
 551 CCGCCAAAGA CCTCGCCCAG CTGTCTGAAG CATTGATGCG CGACTTTCCG
 601 GAATATTACC CGCTGTTTTC CATCAAATCT TTCAAATTCA AAAATATAGA
 651 GCAAAACAAC CGCAATATCC TTTTATATAG GGACAACAAT GTAAACGGTC
 701 TGAAAGCCGG ACACACAGAA AGCGGCGGCT ACAACCTTGC CGTGTCATAC
 751 TCCGGCAACG GCAGGCACAT CCTTGTCATC ACATTGGGTT CGGAATCGGC
 801 GGAAACACGC GCATCAGACA ACAGCAAGCT GCTGAACTGG GCATTGCAAG
 851 CCTTCGATAC GCCCAAAATA TATCCGAAAG GCAAAACCGT TGCCCAAATC
 901 CAAATTTCCG GAGGCAGCAA AAAAACCGTC CGCGCAGGCT TCCTCAAAGA
 951 AGCCTACATC ACTCTGCCAC ATAAGGAAGC GAAAATGGCA GAACAAATTC
1001 TAGAAACCAT ACAGCCGATT CCCGCCCCAG TAAAAAAAGG GCAAATTTTA
1051 GGAAAAATCA AAATCAGACA AAACGGATAC ACCATTGCCG AAAAAGAAAT
```

-continued

```
1101 CGTCGCACTG GAAAATGTAA AAAAAAGAAG CCGGTGGCAA AGGCTTTGGG

1151 CGTGTCTGAC AGGGCAGTAA
```

This corresponds to the amino acid sequence <SEQ ID 1630; ORF 554.a>:

a554.pep

```
  1 MTAHKILPVL LSIILGVSHA TAASPAPNRP TAHAAPTFQT PETLTAAHIV

 51 IDLQSKQILS AKNINTPVEP AALTQLMTAY LVFKNMKSGN IRSEENLKIP

101 ESAWASEGSR MFVRPGDTVS TDKLLKGMIA LSANDAALTL AGRLGNGSIE

151 NFVQQMNKEA RRLGMKNTVF KNPTGLSREG QVSTAKDLAQ LSEALMRDFP

201 EYYPLFSIKS FKFKNIEQNN RNILLYRDNN VNGLKAGHTE SGGYNLAVSY

251 SGNGRHILVI TLGSESAETR ASDNSKLLNW ALQAFDTPKI YPKGKTVAQI

301 QISGGSKKTV RAGFLKEAYI TLPHKEAKMA EQILETIQPI PAPVKKGQIL

351 GKIKIRQNGY TIAEKEIVAL ENVKKRSRWQ RLWACLTGQ*
```

m554/a554 99.2% identity in 389 aa overlap

```
                    10        20        30        40        50        60
m554.pep    MTAHKILPVLLSIILGVSHATAASPAPNRPTVHAAPTFQTPETLTAAHIVIDLQSKQILS
            |||||||||||||||||||||||||||||||:||||||||||||||||||||||||||||
a554        MTAHKILPVLLSIILGVSHATAASPAPNRPTAHAAPTFQTPETLTAAHIVIDLQSKQILS
                    10        20        30        40        50        60

                    70        80        90       100       110       120
m554.pep    AKNINTPVEPAALTQLMTAYLVFKNMKSGNIQSEENLKIPESAWASEGSRMFVRPGDTVS
            |||||||||||||||||||||||||||||||:||||||||||||||||||||||||||||
a554        AKNINTPVEPAALTQLMTAYLVFKNMKSGNIRSEENLKIPESAWASEGSRMFVRPGDTVS
                    70        80        90       100       110       120

                   130       140       150       160       170       180
m554.pep    TDKLLKGMIALSANDAALTLAGRLGNGSIENFVQQMNKEARRLGMKNTVFKNPTGLSREG
            ||||||||||||||||||||||||||||||||||||||||||||||||||||||||||||
a554        TDKLLKGMIALSANDAALTLAGRLGNGSIENFVQQMNKEARRLGMKNTVFKNPTGLSREG
                   130       140       150       160       170       180

                   190       200       210       220       230       240
m554.pep    QVSTAKDLALLSEALMRDFPEYYPLFSIKSFKFKNIEQNNRNILLYRDNNVNGLKAGHTE
            ||||||||| ||||||||||||||||||||||||||||||||||||||||||||||||||
a554        QVSTAKDLAQLSEALMRDFPEYYPLFSIKSFKFKNIEQNNRNILLYRDNNVNGLKAGHTE
                   190       200       210       220       230       240

                   250       260       270       280       290       300
m554.pep    SGGYNLAVSYSGNGRHILVITLGSESAETRASDNSKLLNWALQAFDTPKIYPKGKTVAQI
            ||||||||||||||||||||||||||||||||||||||||||||||||||||||||||||
a554        SGGYNLAVSYSGNGRHILVITLGSESAETRASDNSKLLNWALQAFDTPKIYPKGKTVAQI
                   250       260       270       280       290       300

                   310       320       330       340       350       360
m554.pep    QISGGSKKTVRAGFLKEAYITLPHKEAKMAEQILETIQPIPAPVKKGQILGKIKIRQNGY
            ||||||||||||||||||||||||||||||||||||||||||||||||||||||||||||
a554        QISGGSKKTVRAGFLKEAYITLPHKEAKMAEQILETIQPIPAPVKKGQILGKIKIRQNGY
                   310       320       330       340       350       360

                   370       380       390
m554.pep    TIAEKEIVALENVKKRSRWQRLWACLTGQX
            ||||||||||||||||||||||||||||||
a554        TIAEKEIVALENVKKRSRWQRLWACLTGQX
                   370       380       390
```

The following partial DNA sequence was identified in *N. gonorrhoeae* <SEQ ID 1631>:

g556.seq..

```
  1 atggacaata agaccaaact gcgcttgggc ggcctgattt tactgaccac

 51 cgccgtttta agcctcatta tcgtattgat tgtcgattcc tggccgcttg
```

-continued

```
101 ccatcctgct tgccgccgtc atcgtcgccg ccgctgcggg cggctttgtt
151 tggacatccc gccgacagca acgccagttt atcgaacgtc tgaaaaaatt
201 cgacatcgat cccgaaaaag gcagaatcaa cgaggcaaac ctgcgccgta
251 tgtaccacag cggcggacaa caccagaaag atgcgattac cctgatctgc
301 ctgtcgcaaa aatgttcggt ggacgaggcg cacgctatgt tcaaaaaacg
351 cccgacacgt caggaaatca atcaaatggc ggcaaaacag tcgcgcggtc
401 agaaacgtcc gcaccgttaa
```

This corresponds to the amino acid sequence <SEQ ID 1632; ORF 556.ng>:

```
g556.pep.
  1 MDNKTKLRLG GLILLTTAVL SLIIVLIVDS WPLAILLAAV IVAAAAGGFV
 51 WTSRRQQRQF IERLKKFDID PEKGRINEAN LRRMYHSGGQ HQKDAITLIC
101 LSQKCSVDEA HAMFKKRPTR QEINQMAAKQ SRGQKRPHR*
```

The following partial DNA sequence was identified in *N. meningitidis* <SEQ ID 1633>:

```
m556.seq..
  1 ATGGACAATA AGACCAAACT GCGCTTGGGC GGCCTGATTT TACTGACCAC
 51 CGCCGTTTTA AGCCTCATTA TCGTATTGAT TGTCGATTCC TGGCCGCTTG
101 CCATCCTGCT TGCAGCCGTC ATTGTCGCTG CCGCTGCGGG CGGTTTTGTT
151 TGGACATCCC GCCGACAGCA ACGCCAGTTT ATCGAACGCC TGAAAAAATT
201 CGACATCGAT CCCGAAAAAG GCAGAATCAA CGAGGCAAAC CTGCGCCGTA
251 TGTACCACAG CGGCGGACAA CACCAGAAAG ATGCGATTAC CCTGATCTGC
301 CTGTCGCAAA AATGTTCGGT GGACGAGGCG CACGCTATGT TCAAAAAACG
351 CCCGACACGT CAGGAAATCA ATCAAATGGC GGCAAAACAG TCGCGCGGTC
401 AGAAACGTCC GCACCGTTAA
```

This corresponds to the amino acid sequence <SEQ ID 1634; ORF 556>:

```
m556.pep..
  1 MDNKTKLRLG GLILLTTAVL SLIIVLIVDS WPLAILLAAV IVAAAAGGFV
 51 WTSRRQQRQF IERLKKFDID PEKGRINEAN LRRMYHSGGQ HQKDAITLIC
101 LSQKCSVDEA HAMFKKRPTR QEINQMAAKQ SRGQKRPHR*
```

Computer analysis of this amino acid sequence gave the following results:

Homology with a predicted ORF from *N. gonorrhoeae*

ORF 556 shows 100.0% identity over a 139 aa overlap with a predicted ORF (ORF 556.ng) from *N. gonorrhoeae*:

m556/g556

```
                10        20        30        40        50        60
m556.pep   MDNKTKLRLGGLILLTTAVLSLIIVLIVDSWPLAILLAAVIVAAAAGGFVWTSRRQQRQF
           ||||||||||||||||||||||||||||||||||||||||||||||||||||||||||||
g556       MDNKTKLRLGGLILLTTAVLSLIIVLIVDSWPLAILLAAVIVAAAAGGFVWTSRRQQRQF
                10        20        30        40        50        60

                70        80        90       100       110       120
m556.pep   IERLKKFDIDPEKGRINEANLRRMYHSGGQHQKDAITLICLSQKCSVDEAHAMFKKRPTR
           ||||||||||||||||||||||||||||||||||||||||||||||||||||||||||||
g556       IERLKKFDIDPEKGRINEANLRRMYHSGGQHQKDAITLICLSQKCSVDEAHAMFKKRPTR
                70        80        90       100       110       120

               130       140
m556.pep   QEINQMAAKQSRGQKRPHRX
           ||||||||||||||||||||
g556       QEINQMAAKQSRGQKRPHRX
               130       140
```

The following partial DNA sequence was identified in *N. meningitidis* <SEQ ID 1635>:

a556.seq

```
  1 ATGGACAATA AGACCAAACT GCGCTTGGGC GGCCTGATTT TACTGACCAC
 51 CGCCGTTTTA AGCCTCATTA TCGTATTGAT TGTCGATTCC TGGCCGCTTG
101 CCATCCTGCT TGCCGCCGTC ATCGTCGCCG CCGCTGCGGG CGGCTTTGTT
151 TGGACATCCC GCCGACAGCA ACGCCAGTTT ATCGAACGTC TGAAAAAATT
201 CGACATCGAT CCCGAAAAAG GCAGAATCAA CGAGGCAAAC CTGCGCCGTA
251 TGTACCACAG CGGCGGACAA CACCAAAAAG ATGCGATTAC CCTGATCTGC
301 CTGTCGCAAA AATGTTCGGT GGACGAGGCG CACGCTATGT TCAAAAAACG
351 CCCGACACGT CAGGAAATCA ATCAAATGGC GGCAAAACAG TCGCGCGGTC
401 AGAAACGTCC GCACCGTTAA
```

This corresponds to the amino acid sequence <SEQ ID 1636; ORF 556.a>:

a556.pep

```
  1 MDNKTKLRLG GLILLTTAVL SLIIVLIVDS WPLAILLAAV IVAAAAGGFV
 51 WTSRRQQRQF IERLKKFDID PEKGRINEAN LRRMYHSGGQ HQKDAITLIC
101 LSQKCSVDEA HAMFKKRPTR QEINQMAAKQ SRGQKRPHR*
```

m556/a556 100.0% identity in 139 aa overlap

```
                10        20        30        40        50        60
m556.pep   MDNKTKLRLGGLILLTTAVLSLIIVLIVDSWPLAILLAAVIVAAAAGGFVWTSRRQQRQF
           ||||||||||||||||||||||||||||||||||||||||||||||||||||||||||||
a556       MDNKTKLRLGGLILLTTAVLSLIIVLIVDSWPLAILLAAVIVAAAAGGFVWTSRRQQRQF
                10        20        30        40        50        60

                70        80        90       100       110       120
m556.pep   IERLKKFDIDPEKGRINEANLRRMYHSGGQHQKDAITLICLSQKCSVDEAHAMFKKRPTR
           ||||||||||||||||||||||||||||||||||||||||||||||||||||||||||||
a556       IERLKKFDIDPEKGRINEANLRRMYHSGGQHQKDAITLICLSQKCSVDEAHAMFKKRPTR
                70        80        90       100       110       120
```

-continued

```
               130        140
m556.pep  QEINQMAAKQSRGQKRPHRX
          ||||||||||||||||||||
a556      QEINQMAAKQSRGQKRPHRX
               130        140
```

The following partial DNA sequence was identified in *N. gonorrhoeae* <SEQ ID 1637>:

g557.seq

```
  1 atgaacaaaa tattccttac tgccgcagcc ttggtgctgg gcgcgtgcgg
 51 tttccacctg aaaggtgcag acggcatttc tccgccgctg acctaccgga
101 gctggcacat cgaaggcgga caggcattgc aatttccttt ggaaaccgcg
151 ctgtatcagg cttcgggcag ggtggacgat gctgccggcg cgcagatgac
201 cctgcgtata gacagcgttt cccaaaacaa ggaaacctat accgttaccc
251 gtgcggcagt catcaacgaa tatcttttga tattgacggt tgaagcgcag
301 gtattgaaac gcggcgagcc ggtcggcaaa ccgatgaccg tgtccgtccg
351 ccgcattttg gattatgccg acaacgaaat tttgggcaaa caggaagaag
401 aagaaaccct gtgggcggaa atgcggcagg atgttgccga acagattgtc
451 cgccgcctga cctttctgaa ggcggaatga
```

This corresponds to the amino acid sequence <SEQ ID 1638; ORF 557.ng>:

g557.pep..

```
  1 MNKIFLTAAA LVLGACGFHL KGADGISPPL TYRSWHIEGG QALQFPLETA
 51 LYQASGRVDD AAGAQMTLRI DSVSQNKETY TVTRAAVINE YLLILTVEAQ
101 VLKRGEPVGK PMTVSVRRIL DYADNEILGK QEEEETLWAE MRQDVAEQIV
151 RRLTFLKAE*
```

The following partial DNA sequence was identified in *N. meningitidis* <SEQ ID 1639>:

m557.seq..

```
  1 ATGAACAAAC TGTTTCTTAC TGCCGCAGTG CTGATGCTGG GCGCGTGCGG
 51 TTTCCACCTG AAAGGTGCAG ACGGCATTTC TCCGCCGCTG ACCTACCGGA
101 GCTGGCACAT CGAAGGCGGA CAGGCATTGC GGTTTCCTTT GGAAACCGCG
151 CTGTATCAGG CTTCGGGCAG GGTGGACGAT GCTGCCGGCG CGCAGATGAC
201 CCTGCGTATA GACAGCGTTT CCCAAAACAA GGAAACCTAC ACCGTTACCC
251 GTGCGGCAGT CATCAACGAA TATCTTTTGA TATTGACGGT TGAAGCGCAG
301 GTATTGAAAC GCGGCGAGCC GGTCGGTAAA CCGATGACCG TGTCCGTCCG
351 CCGCGTCCTT GCTTATGCCG ACAACGAGAT CTTGGGCAAA CAGGAAGAGG
401 AAGCGGCATT GTGGGCGGAA ATGCGGCAGG ATGCCGCCGA ACAGATTGTC
451 CGCCGCCTGA CCTTTCTGAA GGCGGAATGA
```

This corresponds to the amino acid sequence <SEQ ID 1640: ORF 557>:

m557.pep..

```
  1 MNKLFLTAAV LMLGACGFHL KGADGISPPL TYRSWHIEGG QALRFPLETA

 51 LYQASGRVDD AAGAQMTLRI DSVSQNKETY TVTRAAVINE YLLILTVEAQ

101 VLKRGEPVGK PMTVSVRRVL AYADNEILGK QEEEAALWAE MRQDAAEQIV

151 RRLTFLKAE*
```

Computer analysis of this amino acid sequence gave the following results:

Homology with a predicted ORF from *N. gonorrhoeae*

ORF 557 shows 94.3% identity over a 159 aa overlap with a predicted ORF (ORF 557.ng) from *N. gonorrhoeae*:

m557/g557

```
                  10        20        30        40        50        60
m557.pep  MNKLFLTAAVLMLGACGFHLKGADGISPPLTYRSWHIEGGQALRFPLETALYQASGRVDD
          |||:|||||:|:|||||||||||||||||||||||||||||||:||||||||||||||||
g557      MNKIFLTAAALVLGACGFHLKGADGISPPLTYRSWHIEGGQALQFPLETALYQASGRVDD
                  10        20        30        40        50        60

                  70        80        90       100       110       120
m557.pep  AAGAQMTLRIDSVSQNKETYTVTRAAVINEYLLILTVEAQVLKRGEPVGKPMTVSVRRVL
          ||||||||||||||||||||||||||||||||||||||||||||||||||||||||||:|
g557      AAGAQMTLRIDSVSQNKETYTVTRAAVINEYLLILTVEAQVLKRGEPVGKPMTVSVRRIL
                  70        80        90       100       110       120

                 130       140       150       160
m557.pep  AYADNEILGKQEEEAALWAEMRQDAAEQIVRRLTFLKAEX
           |||||||||||| :||||||||:|||||||||||||||
g557      DYADNEILGKQEEEETLWAEMRQDVAEQIVRRLTFLKAEX
                 130       140       150       160
```

The following partial DNA sequence was identified in *N. meningitidis* <SEQ ID 1641>:

a557.seq

```
  1 ATGAACAAAC TGTTTCTTAC TGCCGCAGTG CTGATGCTGG GCGCGTGCGG

 51 TTTCCACCTG AAAGGTGCAG ACGGCATTTC TCCGCCGCTG ACCTACCGGA

101 GCTGGCACAT CGAAGGCGGA CAGGCATTGC AGTTTCCTTT GGAAACCGCG

151 CTGTATCAGG CTTCGGGTAG GGTGGACGAT GCTGCCGGCG CGCAGATGAC

201 CCTGCGTATA GACAGCGTTT CCCAAAACAA GGAAACCTAC ACCGTTACCC

251 GTGCGGCAGT CATCAACGAA TATCTTTTGA TATTGACGGT TGAAGCGCAG

301 GTATTGAAAC GCGGCGAGCC GGTCGGCAAA CCGATGACCG TGTCCGTCCG

351 CCGCGTCCTT GCTTATGCCG ACAACGAGAT CTTGGGCAAA CAGGAAGAGG

401 AAGCGGCATT GTGGGCGGAA ATGCGGCAGG ATGCCGCCGA ACAGATTGTC

451 CGCCGCCTGA CCTTTCTGAA GGCGGAATGA
```

This corresponds to the amino acid sequence <SEQ ID 1642; ORF 557.a>:

a557.pep

```
  1 MNKLFLTAAV LMLGACGFHL KGADGISPPL TYRSWHIEGG QALQFPLETA

 51 LYQASGRVDD AAGAQMTLRI DSVSQNKETY TVTRAAVINE YLLILTVEAQ
```

-continued

```
101 VLKRGEPVGK PMTVSVRRVL AYADNEILGK QEEEAALWAE MRQDAAEQIV

151 RRLTFLKAE*
```

m557/a557 99.4% identity in 159 aa overlap

```
                  10        20        30        40        50        60
m557.pep  MNKLFLTAAVLMLGACGFHLKGADGISPPLTYRSWHIEGGQALRFPLETALYQASGRVDD
          ||||||||||||||||||||||||||||||||||||||||||||:|||||||||||||||
a557      MNKLFLTAAVLMLGACGFHLKGADGISPPLTYRSWHIEGGQALQFPLETALYQASGRVDD
                  10        20        30        40        50        60

                  70        80        90       100       110       120
m557.pep  AAGAQMTLRIDSVSQNKETYTVTRAAVINEYLLILTVEAQVLKRGEPVGKPMTVSVRRVL
          ||||||||||||||||||||||||||||||||||||||||||||||||||||||||||||
a557      AAGAQMTLRIDSVSQNKETYTVTRAAVINEYLLILTVEAQVLKRGEPVGKPMTVSVRRVL
                  70        80        90       100       110       120

                 130       140       150       160
m557.pep  AYADNEILGKQEEEAALWAEMRQDAAEQIVRRLTFLKAEX
          ||||||||||||||||||||||||||||||||||||||||
a557      AYADNEILGKQEEEAALWAEMRQDAAEQIVRRLTFLKAEX
                 130       140       150       160
```

The following partial DNA sequence was identified in *N. gonorrhoeae* <SEQ ID 1643>:

```
g558.seq..

  1 ATGGATGCTT GTTTTTTCGT CATTCCCGCA CAGGCGGGAA TTCGGAGATT

 51 CGGGATTGTT TTCAAACGTT CGGGTCGGAT TCTTGCCGGT GCGGGAATGA

101 TGCCCTTATA TACTTTCTCC GAGCTTTATA TGCTTCAACA GGGGACGGCA

151 CATCAAGCAC CGCACTGCGT GTTGCCCGAA CGAGGCTGCC CTCCGATTAG

201 ATTCTATCGC TATAAACAGA CGGGTTTCAA CCGAAAAGGA ATGGGGATAA

251 AGTCCATTTC CGACACCTCT CGGGCGATGC CGTCTGAAAA CCAATCTCCA

301 CTTTCAGACG GCATTGTTTA G
```

This corresponds to the amino acid sequence <SEQ ID 1644; ORF 558.ng>:

```
g558.pep..

  1 MDACFFVIPA QAGIRRFGIV FKRSGRILAG AGMMPLYTFS ELYMLQQGTA

 51 HQAPHCVLPE RGCPPIRFYR YKQTGFNRKG MGIKSISDTS RAMPSENQSP

101 LSDGIV*
```

The following partial DNA sequence was identified in *N. meningitidis* <SEQ ID 1645>:

```
m558.seq..

  1 ATGAATGCTT GTTTTTTCGT CATTCCCACA CAGGCGGGAA TTCGGAGATT

 51 CGGGATTGTT TTCAAACGTT CGGGTCGGAT TCTTGCCGGT GCAGGAATGA

101 TGCCCTTATA TACTTTCTCC GAGCTTTATA TGTTTCAACA GGGGACGGCA

151 CATCAAGCAC CGCACTGCGT GTTGCCCGAA CGAGACTACC CTCCGATTAG
```

-continued

```
201 ATTCTATCGC CATAAACAGA CGGGTTTCAA CCGAAAAGGA ATGGGGATAA
251 AGTCCATTTC CGACATCTsT CGGGCGATGC CGTCTGAAAA CCAATCTCCA
301 CTTTCAGACG GCATTGTTTA G
```

This corresponds to the amino acid sequence <SEQ ID 1646; ORF 558>:

m558.pep..

```
  1 MNACFFVIPT QAGIRFEGIV FKRSGRILAG AGMMPLYTFS ELYMFQQGTA
 51 HQAPHCVLPE RDYPPIRFYR HKQTGFNRKG MGIKSISDIX RAMPSENQSP
101 LSDGIV*
```

Computer analysis of this amino acid sequence gave the following results:

Homology with a predicted ORF from *N. gonorrhoeae*

ORF 558 shows 92.5% identity over a 106 aa overlap with a predicted ORF (ORF 558.ng) from *N. gonorrhoeae*:

m558/g558

```
                   10        20        30        40        50        60
m558.pep   MNACFFVIPTQAGIRRFGIVFKRSGRILAGAGMMPLYTFSELYMFQQGTAHQAPHCVLPE
           |:|||||||:|||||||||||||||||||||||||||||||||||:||||||||||||||
g558       MDACFFVIPAQAGIRRFGIVFKRSGRILAGAGMMPLYTFSELYMLQQGTAHQAPHCVLPE
                   10        20        30        40        50        60

                   70        80        90       100
m558.pep   RDYPPIRFYRHKQTGFNRKGMGIKSISDIXRAMPSENQSPLSDGIVX
           |  |||||||:||||||||||||||||||  ||||||||||||||||
g558       RGCPPIRFYRYKQTGFNRKGMGIKSISDTSRAMPSENQSPLSDGIVX
                   70        80        90       100
```

The following partial DNA sequence was identified in *N. meningitidis* <SEQ ID 1647>:

a558.seq

```
  1 ATGAATGCTT GTTTTTTCGT CATTCCCACA CAGGCGGGAA TTCGGAGATT
 51 CGGGATTGTT TTCAAACGTT CGGGTCGGAT TCTTGCCGGT GCGGGAATGA
101 TGCCCTTATA TATAGTGGAT TAAATTTAAA TCAGGACAAG GCCACGAAGC
151 CGCAGACAGT ACAAATAGTA CGGCAAGGCG AGGCAACGCC GTACTGGTTT
201 AAATTTAATC CACTATACTT TCTCCGAGCT TTATATGTTT CAACAGAGGA
251 CGGCACATCA AGCACCGCAC TGCGTGTTGC CCGAACGAGA CTGCCCTCCG
301 ATTAGATTCT ATCGCTATAA ACAGACGGGT TTCAACCGAA AAGGAATGGG
351 AATGAAGTCC GTTTCCGACA CCTCTCGGGC GATGCCGTCT GAAAACCAAT
401 CTCCACTTTC AGACGGCATT GTTTAG
```

This corresponds to the amino acid sequence <SEQ ID 1648; ORF 558.a>:

a558.pep

```
  1 MNACFFVIPT QAGIRRFGIV FKRSGRILAG AGMMPLYIVD *I*IRTRRRS

 51 RRQYK*YGKA RQRRTGLNLI HYTFSELYMF QQRTAHQAPH CVLPERDCPP

101 IRFYRYKQTG FNRKGMGMKS VSDTSRAMPS ENQSPLSDGI V*
```

m558/a558 70.2% identity in 141 aa overlap

```
                  10        20        30
m558.pep  MNACFFVIPTQAGIRRFGIVFKRSGRILAGAGMMPLY----------------------
          |||||||||||||||||||||||||||||||||||||
a558      MNACFFVIPTQAGIRRFGIVFKRSGRILAGAGMMPLYIVDXIXIRTRRRSRRQYKXYGKA
                  10        20        30        40        50        60

                       40        50        60        70        80
m558.pep  ------------TFSELYMFQQGTAHQAPHCVLPERDYPPIRFYRHKQTGFNRKGMGIKS
                      |||||||||| |||||||||||||| |||||||:|||||||||||:||
a558      RQRRTGLNLIHYTFSELYMFQQRTAHQAPHCVLPERDCPPIRFYRYKQTGFNRKGMGMKS
                  70        80        90       100       110       120

             90       100
m558.pep  ISDIXRAMPSENQSPLSDGIVX
          :||  ||||||||||||||||
a558      VSDTSRAMPSENQSPLSDGIVX
                 130       140
```

The following partial DNA sequence was identified in *N. gonorrhoeae* <SEQ ID 1649>:

g560.seq

```
  1 atgctcatca tccgcaacct gatttactgg ctgatactct gttccagcct

 51 gattttcctc tttcccttta tgctgctcgc ctcgcctttc cgggacgggg

101 cgcacaagat ggcgcgggtc tgggtcggca tcctcaactg gtcgctcaaa

151 cacatcgtcg ggctcaaata ccgcatcatc ggcgcggaac acattccgga

201 ccgcccctcc gtcatctgcg ccaaacacca aagcggctgg gaaacgctcg

251 cgctccaaga gatttttccg ccgcaggttt acgttgccaa gcgcgagttg

301 ttcaaaatcc ccttttttcgg ctggggcttg aaactggtca aaaccatagg

351 catagaccgc aacaaccgcc gcgaagccaa cgaacagctc ataaaacagg

401 gtttggcgcg caaaaacgaa ggttattgga ttaccatttt ccccgaaggc

451 acgcgccttg cgcccggaaa acgcggcaaa tacaaactcg gcggcgcgcg

501 catggcgaaa atgtttgaga tggacatcgt ccccgtcgcc ctcaacagcg

551 gcgaattttg gccgaaaaat tcctttctga aatatccggg ggaaatcacc

601 gtcatcatct gtccgaccat cccgcacgca agcggcagcg aagccgaatt

651 gatggaaaaa tgcgaacacc tcattgaaac gcaacaaccg cttatttccg

701 gcgcaggccc gtttqccgcc gaaatgccgt ctgaaaccgc atga
```

This corresponds to the amino acid sequence <SEQ ID 1650; ORF 560.ng>:

g560.pep..

```
  1 MLIIRNLIYW LILCSSLIFL FPFMLLASPF RDGAHKMARV WVGILNWSLK

 51 HIVGLKYRII GAEHIPDRPS VICAKHQSGW ETLALQEIFP PQVYVAKREL
```

-continued

```
101 FKIPPFFGWGL KLVKTIGIDR NNRREANEQL IKQGLARKNE GYWITIFPEG

151 TRLAPGKRGK YKLGGARMAK MFEMDIVPVA LNSGEFWPKN SFLKYPGEIT

201 VIICPTIPHA SGSEAELMEK CEHLIETQQP LISGAGPFAA EMPSET*
```

The following partial DNA sequence was identified in *N. meningitidis* <SEQ ID 1651>:

m560.seq

```
  1 ATGCTCATCA TCCGCAACCT GATTTACTGG CTGATACTCT GTTCCACCCT

 51 GATTTTCCTC TTTCCCTTTA TGCTGCTCGC CTCGCCTTTC CGGGACGGGG

101 CGCACAAGAT GGCGCGGGTC TGGGTCGGCA TTCTCAACTG GTCGCTCAAA

151 CACATCGTCG GGCTCAAATA CCGCATCATC GGCGCGGAAA ACATCCCCGA

201 CCGCCCCGCC GTCATCTGCG CCAAACACCA AAGCGGCTGG GAAACGCTCG

251 CCCTTCAGGA CATTTTTCCG CCGCAGGTTT ACGTTGCCAA ACGCGAGTTG

301 TTCAAAATCC CCTTTTTCGG CTGGGGCTTG AAACTGGTCA AAACCATAGG

351 CATAGACCGC AACAACCGCC GCGAAGCCAA CGAGCAGCTC ATAAAACAGG

401 GGTTGGTGCG CAAAAACGAA GGCTATTGGA TTACCATTTT CCCCGAAGGC

451 ACGCGCCTTG CGCCCGGAAA ACGCGGCAAA TACAAACTCG GCGGCGCGCG

501 CATGGCGAAA ATGTTTGAGA TGGACATCGT CCCCGTCGCC CTCAACAGCG

551 GCGAATTTTG GCCGAAAAAC TCCTTTCTGA AATATCCGGG GGAAATCACC

601 GTCGTCATCT GTCCGACCAT CCCGCACGCA AGCGGCAGCG AAGCCGAATT

651 GATGGAAAAA TGCGAACATC TCATCGAAAC GCAACAACCG CTTATTTCCG

701 GCGCAGGCCC GTTTGCCGCC AAAATGCCGT CTGAAACCGC ATGA
```

This corresponds to the amino acid sequence <SEQ ID 1652; ORF 560>:

m560.pep

```
  1 MLIIRNLIYW LILCSTLIFL FPFMLLASPF RDGAHKMARV WVGILNWSLK

 51 HIVGLKYRII GAENIPDRPA VICAKHQSGW ETLALQDIFP PQVYVAKREL

101 FKIPFFGWGL KLVKTIGIDR NNRREANEQL IKQGLVRKNE GYWITIFPEG

151 TRLAPGKRGK YKLGGARMAK MFEMDIVPVA LNSGEFWPKN SFLKYPGEIT

201 VVICPTIPHA SGSEAELMEK CEHLIETQQP LISGAGPFAA KMPSETA*
```

Computer analysis of this amino acid sequence gave the following results:

Homology with a predicted ORF from *N. gonorrhoeae*

ORF 560 shows 97.2% identity over a 246 aa overlap with a predicted ORF (ORF 560.ng) from *N. gonorrhoeae*:

m560/g560

```
                  10        20        30        40        50        60
m560.pep   MLIIRNLIYWLILCSTLIFLFPFMLLASPFRDGAHKMARVWVGILNWSLKHIVGLKYRII
           |||||||||||||||:||||||||||||||||||||||||||||||||||||||||||||
g560       MLIIRNLIYWLILCSSLIFLFPFMLLASPFRDGAHKMARVWVGILNWSLKHIVGLKYRII
                  10        20        30        40        50        60
```

-continued

```
                  70        80        90       100       110       120
m560.pep    GAENIPDRPAVICAKHQSGWETLALQDIFPPQVYVAKRELFKIPFFGWGLKLVKTIGIDR
            |||:|||||:|||||||||||||||||:||||||||||||||||||||||||||||||||
g560        GAEHIPDRPSVICAKHQSGWETLALQEIFPPQVYVAKRELFKIPFFGWGLKLVKTIGIDR
                  70        80        90       100       110       120

                 130       140       150       160       170       180
m560.pep    NNRREANEQLIKQGLVRKNEGYWITIFPEGTRLAPGKRGKYKLGGARMAKMFEMDIVPVA
            |||||||||||||||:||||||||||||||||||||||||||||||||||||||||||||
g560        NNRREANEQLIKQGLARKNEGYWITIFPEGTRLAPGKRGKYKLGGARMAKMFEMDIVPVA
                 130       140       150       160       170       180

                 190       200       210       220       230       240
m560.pep    LNSGEFWPKNSFLKYPGEITVVICPTIPHASGSEAELMEKCEHLIETQQPLISGAGPFAA
            ||||||||||||||||||||:|||||||||||||||||||||||||||||||||||||||
g560        LNSGEFWPKNSFLKYPGEITVIICPTIPHASGSEAELMEKCEHLIETQQPLISGAGPFAA
                 190       200       210       220       230       240

m560.pep    KMPSETAX
            :|||||
g560        EMPSETX
```

The following partial DNA sequence was identified in *N. meningitidis* <SEQ ID 1653>:

a560.seq

```
  1 ATGCTCATCA TCCGCAACCT GATTTACTGG CTGATACTCT GTTCCACCCT
 51 GATTTTCCTC TTTCCCTTTA TGCTGCTCGC CTCGCCTTTC CGAGACGGGG
101 CGCACAAGAT GGCGCGGGTC TGGGTCAAAA TCCTCAACCT CTCGCTCAAA
151 CACATCGTCG GGCTCAAATA CCGCATCATC GGCGCGGAAA ACATCCCCGA
201 CCGCCCCGCC GTCATCTGCG CCAAACACCA AAGCGGCTGG GAAACGCTCG
251 CCCTTCAGGA CATTTTTCCG CCGCAGGTTT ACGTTGCCAA ACGCGAGTTG
301 TTCAAAATCC CCTTTTTCGG CTGGGGCTTG AAACTGGTCA AAACCATAGG
351 CATAGACCGC AACAACCGCC GCGAAGCCAA CGAGCAGCTC ATAAAACAGG
401 GGTTGGCGCG CAAAAACGAA GGCTATTGGA TTACCATTTT CCCCGAAGGC
451 ACACGCCTTG CGCCCGGAAA ACGCGGCAAA TACAAACTCG GCGGCGCGCG
501 CATGGCGAAA ATGTTTGAGA TGGACATCGT CCCCGTCGCC CTCAACAGCG
551 GCGAATTTTG GCCGAAAAAC TCCTTTCTGA AATATCCGGG GGAAATCACC
601 GTCGTCATCT GTCCGACCAT CCCGCACGCA AGCGGCAGCG AAGCCGAATT
651 GATGGGAAAA TGCGAACACC TCATCGAAAC GCAGCAGCCG CTCATTTCCG
701 GCGCAGGCCC GTTTGCCGCC AAAATGCCGT CTGAAACCGC ATGA
```

This corresponds to the amino acid sequence <SEQ ID 1654; ORF 560.a>:

a560.pep

```
  1 MLIIRNLIYW LILCSTLIFL FPFMLLASPF RDGAHKMARV WVKILNLSLK
 51 HIVGLKYRII GAENIPDRPA VICAKHQSGW ETLALQDIFP PQVYVAKREL
101 FKIPFFGWGL KLVKTIGIDR NNRREANEQL IKQGLARKNE GYWITIFPEG
151 TRLAPGKRGK YKLGGARMAK MFEMDIVPVA LNSGEFWPKN SFLKYPGEIT
201 VVICPTIPHA SGSEAELMGK CEHLIETQQP LISGAGPFAA KMPSETA*
```

m560/a560 98.4% identity in 247 aa overlap

```
                10        20        30        40        50        60
m560.pep  MLIIRNLIYWLILCSTLIFLFPFMLLASPFRDGAHKMARVWVGILNWSLKHIVGLKYRII
          |||||||||||||||||||||||||||||||||||||||||| ||| ||||||||||||
a560      MLIIRNLIYWLILCSTLIFLFPFMLLASPFRDGAHKMARVWVKILNLSLKHIVGLKYRII
                10        20        30        40        50        60

                70        80        90       100       110       120
m560.pep  GAENIPDRPAVICAKHQSGWETLALQDIFPPQVYVAKRELFKIPFFGWGLKLVKTIGIDR
          ||||||||||||||||||||||||||||||||||||||||||||||||||||||||||||
a560      GAENIPDRPAVICAKHQSGWETLALQDIFPPQVYVAKRELFKIPFFGWGLKLVKTIGIDR
                70        80        90       100       110       120

               130       140       150       160       170       180
m560.pep  NNRREANEQLIKQGLVRKNEGYWITIFPEGTRLAPGKRGKYKLGGARMAKMFEMDIVPVA
          |||||||||||||||:||||||||||||||||||||||||||||||||||||||||||||
a560      NNRREANEQLIKQGLARKNEGYWITIFPEGTRLAPGKRGKYKLGGARMAKMFEMDIVPVA
               130       140       150       160       170       180

               190       200       210       220       230       240
m560.pep  LNSGEFWPKNSFLKYPGEITVVICPTIPHASGSEAELMEKCEHLIETQQPLISGAGPFAA
          ||||||||||||||||||||||||||||||||||||||| ||||||||||||||||||||
a560      LNSGEFWPKNSFLKYPGEITVVICPTIPHASGSEAELMGKCEHLIETQQPLISGAGPFAA
               190       200       210       220       230       240

m560.pep  KMPSETAX
          ||||||||
a560      KMPSETAX
```

The following partial DNA sequence was identified in *N. meningitidis* <SEQ ID 1655>:

m561.seq.

```
   1 ATGATACTGC CAGCCCGTTT TTCAGACGGC ATCAGCCTTT CCCTGCGCCT
  51 GAAACTCCTG ACCGGACTGT GGGTCGGGTT GGCGGCATTG TCTGTCGTTT
 101 TGACACTGCT GCTCTCTTTG CGTCTGGAAA ACGCGGCCTC CGTCATCGAA
 151 GAGGCGGGCA ACTTGAGAAT GCAGGCATAC CGTCTGGCAT ACATGGCGGG
 201 TGAAGGCTCG CCCCGTGCGC AAATTGACAA TCAGGTTGCC GAATTTGAAA
 251 AAAGTTTAAA ACGCATTGCC CAAAGCGATG CCATCCATCC GCTGATTCCT
 301 TCGGACACCC CTCTTGCTTA TGATTTGATA CAATCCATGC TGATTATAGA
 351 TTGGCAGGCA CACATCCTCC CCCCGCTCCA GTCCTACCGG CGACCGACTC
 401 AGGTCGATCT CTACCGCTTT GCCGGAAACA TCGAACTGTT TTTGCAGGCA
 451 TTGGAAAATG CCAACGAAAA AAACACATGG TGGCTCAGGC GTTTTCAATG
 501 GGCAATTATG TTGATGACGC TGGTGTCGTC TGTACTGATG CTGTTTTGGC
 551 ACCAGATTTG GGTTATCCGG CCGCTGCAGG CGTTAAGGGA AGGTGCGGAA
 601 CGCATCGGAC GGAGGTGTTT CGATATTCCG GTTCCCGAAG GCGGTACGCC
 651 GGAATTCAAA CAGGTCGGGC GTTGTTTCAA TCAAATGGGC GGCAGGTTGA
 701 AAATTTTATA TGATGATTTG GAAGGACAAG TCGCCGAGCA GACACGCAGT
 751 CTCGAAAAAC AAAATCAAAA CCTGACCCTG CTGTACCAAA CTACACGGGA
 801 CCTGCACCAA TCCTACATAC CGCAACAGGC TGCAGAACAT TTTCTAAACC
 851 GTATCCTGCC CGCCGTAGGA GCAGATTCCG GCAGAGTTTG TTTGGACGGC
 901 GGATCCGATG TTTATGTTTC CATTCATCAT GCGGATTGCG GCACAGCAGC
 951 TTCGGATTTG GGGAAGTACC ATGAGGAAAT CTTCCCCATT GAGTACCAGA
1001 ACGAAACATT GGGCAGGCTG TTGCTCAGCT TTCCAAACGG CATTTCTCTT
1051 GATGAAGACG ACCGCATCCT GCTTCAAACA CTAGGCAGGC AATTGGGCGT
1101 ATCGCTTGCC GGCGCAAAAC AGGAGGAAGA AAAACGCCTG CTTGCAGTAT
```

-continued

```
1151 TGCAGGAACG CAACCTGATT GCGCAAGGAT TACATGACAG CATCGCACAA

1201 GCATTAACGT TCCTAAACCT ACAGGTACAG ATGCTGGAAA CCGCCTTTGC

1251 CGAAAACAAA CGGGAGGAAG CCGCAGAAAA CATCAGCTTT ATCAAAACAG

1301 GCGTGCAGGA ATGTTATGAA GATGTCCGCG AACTGCTGCT CAACTTCCGT

1351 ACCAAAATCA GCAATAAAGA ATTTCCCGAA GCCGTTGCCG ACCTATTCGC

1401 CCGCTTTACG CAAGAAACCG GGATAACGGT CGAAACCGCC TGGGAAAACG

1451 GTTCGTTCCT GCCGCCTCAG GAAGCGCAGC TCCAAATGAT TTTTATCCTG

1501 CAGGAAAGCC TGTCCAACAT CCGCAAACAC GCCCGCGCCA CCCATGTAAA

1551 ATTCACCCTT TCCGAACACG GCGGACGCTT TACCATGACC ATCCAAGACA

1601 ACGGACAAGG TTTCGACACG GAGAAAATAG GAGAACCCAC GGGCAGCCAT

1651 GTCGGACTGC ACATCATGCA GGAGCGTGCC AAACGCATCC ATGCCGTTTT

1701 AGAAATCCGT TCCCAAGCTC AACAGGGAAC CACCGTCTCA TTGACGGTTG

1751 CATCTGAAGA AAGCTTGAAA TGA
```

This corresponds to the amino acid sequence <SEQ ID 1656; ORF 561>:

m561.pep

```
  1 MILPARFSDG ISLSLRLKLL TGLWVGLAAL SVVLTLLLSL RLENAASVIE

 51 EAGNLRMQAY RLAYMAGEGS PRAQIDNQVA EFEKSLKRIA QSDAIHPLIP

101 SDTPLAYDLI QSMLIIDWQA HILPPLQSYR RPTQVDLYRF AGNIELFLQA

151 LENANEKNTW WLRRFQWAIM LMTLVSSVLM LFWHQIWVIR PLQALREGAE

201 RIGRRCFDIP VPEGGTPEFK QVGRCFNQMG GRLKILYDDL EGQVAEQTRS

251 LEKQNQNLTL LYQTTRDLHQ SYIPQQAAEH FLNRILPAVG ADSGRVCLDG

301 GSDVYVSIHH ADCGTAASDL GKYHEEIFPI EYQNETLGRL LLSFPNGISL

351 DEDDRILLQT LGRQLGVSLA GAKQEEEKRL LAVLQERNLI AQGLHDSIAQ

401 ALTFLNLQVQ MLETAFAENK REEAAENISF IKTGVQECYE DVRELLLNFR

451 TKISNKEFPE AVADLFARFT QQTGITVETA WENGSFLPPQ EAQLQMIFIL

501 QESLSNIRKH ARATHVKFTL SEHGGRFTMT IQDNGQGFDT EKIGEPTGSH

551 VGLHIMQERA KRIHAVLEIR SQAQQGTTVS LTVASEESLK *
```

Computer analysis of this amino acid sequence gave the following results:

Homology with a predicted ORF from *N. gonorrhoeae* m561/g561 89.7% identity in 223 aa overlap

```
                   10        20        30        40        50        60
m561.pep   MILPARFSDGISLSLRLKLLTGLWVGLAALSVVLTLLLSLRLENAASVIEEAGNLRMQAY
           ||||:|||||| |||||||||||||||||||||||||:||||||||||||||:||||
g561       MILPTRFSDGIPLSLRLKLLTGLWVGLAALSVVLTLLLSFRLENAASVIEEAGNLKMQAY
                   10        20        30        40        50        60

                   70        80        90       100       110       120
m561.pep   RLAYMAGEGSPRAQIDNQVAEFEKSLKRIAQSDAIHPLIPSDTPLAYDLIQSMLIIDWQA
           |||||||||||||||||:||||||||||:|||||||||||:||||||||||||||||
g561       RLAYMAGEGSPRAQIDNQIAEFEKSLKRISQSDAIHPLIPSDNPLAYDLIQSMLIIDWQA
                   70        80        90       100       110       120

                  130       140       150       160       170       180
m561.pep   HILPPLQSYRRPTQVDLYRFAGNIELFLQALENANEKNTWWLRRFQWAIMLMTLVSSVLM
           :||||||:||||||::||||||||||||||||:||||||||||||:|||||||||||
g561       NILPPLQAYRRPTQIELYRFAGNIELFLQALENAGEKNTWWLRRFQWVIMLMTLVSSVLM
                  130       140       150       160       170       180
```

-continued

```
              190       200       210       220       230       240
m561.pep  LFWHQIWVIRPLQALREGAERIGRRCFDIPVPEGGTPEFKQVGRCFNQMGGRLKILYDDL
          ||||||||||||||||||||||:| |||||||    |: :: |
g561      LFWHQIWVIRPLQALREGAERIGQRHFDIPVPEDVRPNSNRSGGVSTKWRSGX
              190       200       210       220       230
              250       260       270       280       290       300
m561.pep  EGQVAEQTRSLEKQNQNLTLLYQTTRDLHQSYIPQQAAEHFLNRILPAVGADSGRVCLDG
```

The following partial DNA sequence was identified in *N. meningitidis* <SEQ ID 1657>:

<u>a561.seq</u>

```
   1 ATGATACTGC CAGCCCGTTT TTCAGACGGC ATCAGCCTTT CCCTGCGCCT
  51 GAAACTCCTG ACCGGACTGT GGGTCGGGTT GGCGGCATTG TCTGTCGTTT
 101 TGACACTGCT GCTCTCTTTG CGTCTGGAAA ACGCGGCCTC CGTCATCGAA
 151 GAGGCGGGCA ACTTGAGAAT GCAGGCATAC CGTCTGGCAT ACATGGCGGG
 201 TGAAGGCTCG CCCCGTGCGC AAATTGACAA TCAGGTTGCC GAATTTGAAA
 251 AAAGTTTAAA ACGCATTGCC CAAAGCGATG CCATCCATCC GCTGATTCCT
 301 TCGGACACCC CTCTTGCTTA TGATTTGATA CAATCCATGC TGATTATAGA
 351 TTGGCAGGCA CACATCCTCC CCCCGCTCCA GTCCTACCGG CGACCGACTC
 401 AGGTCGATCT CTACCGCTTT GCCGGAAACA TCGAACTGTT TTTGCAGGCA
 451 TTGGAAAATG CCAACGAAAA AAACACATGG TGGCTCAGGC GTTTTCAATG
 501 GGCAATTATG TTGATGACGC TGGTGTCGTC TGTACTGATG CTGTTTTGGC
 551 ACCAGATTTG GGTTATCCGG CCGCTGCAGG CGTTAAGGGA AGGTGCGGAA
 601 CGCATCGGAC GGAGGTGTTT CGATATTCCG GTTCCCGAAG GCGGTACGCC
 651 GGAATTCAAA CAGGTCGGGC GTTGTTTCAA TCAAATGGGC GGCAGGTTGA
 701 AAATTTTATA TGATGATTTG GAAGGACAAG TCGCCGAGCA GACACGCAGT
 751 CTCGAAAAAC AAAATCAAAA CCTGACCCTG CTGTACCAAA CTACACGGGA
 801 TCTGCACCAA TCCTACATAC CGCAACAGGC TGCAGAACAT TTTCTAAACC
 851 GTATCCTGCC CGCCGTAGGA GCAGATTCCG GCAGAGTTTG TTTGGACGGC
 901 GGATCCGATG TTTATGTTTC CATTCATCAT GCGGATTGCG GCACAGCAGC
 951 TTCGGATTTG GGGAAGTACC ATGAGGAAAT CTTCCCCATT GAGTACCAGA
1001 ACGAAACATT GGGCAGGCTG TTGCTCAGCT TTCCAAACGG CATTTCTCTT
1051 GATGAAGACG ACCGCATCCT GCTTCAAACA CTAGGCAGGC AATTGGGCGT
1101 ATCGCTTGCC GGCGCAAAAC AGGAGGAAGA AAAACGCCTG CTTGCAGTAT
1151 TGCAGGAACG CAACCTGATT GCGCAAGGAT TACATGACAG CATCGCACAA
1201 GCATTAACGT TCCTAAACCT ACAGGTACAG ATGCTGGAAA CCGCCTTTGC
1251 CGAAAACAAA CGGGAGGAAG CCGCAGAAAA CATCGGCTTC ATCAAAACAG
1301 GCGTGCAGGA ATGTTATGAA GATGTCCGCG AACTGCTGCT CAACTTCCGT
1351 ACCAAAATCA GTAATAAAGA ATTTCCCGAA GCCGTTGCCG ACCTATTCTC
1401 GCGCTTTACG CAACAGACCG GCACGACTGT CGAAACCGCT TGGGAAAACG
1451 GCACGCACCT GCCTACACAG GACGAGCAGC TCCAAATGAT TTTCATCCTG
1501 CAAGAAAGCT TGTCCAACAT CCGAAAACAT GCCCACGCCA CCCATATCAA
```

-continued

```
1551 ATTCAGACTG CTCAAACAGG ATGGAAGTTT TACAATGACC ATTCAAGACA

1601 ACGGACAGGG TTTTGACACG GAAAACATTG GAGAACCATC GGGCAGCCAT

1651 GTCGGACTGC ATATCATGCA GGAGCGTGCC AAACGCATCC ATGCCGTTTT

1701 AGAAATCCGT TCCCAAGCTC AACAGGGAAC CACCGTCTCA TTGACGGTTG

1751 CATCTGAAGA AAGCTTGAAA TGA
```

This corresponds to the amino acid sequence <SEQ ID 1658; ORF 561.a>:

```
a561.pep

  1 MILPARFSDG ISLSLRLKLL TGLWVGLAAL SVVLTLLLSL RLENAASVIE

 51 EAGNLRMQAY RLAYMAGEGS PRAQIDNQVA EFEKSLKRIA QSDAIHPLIP

101 SDTPLAYDLI QSMLIIDWQA HILPPLQSYR RPTQVDLYRF AGNIELFLQA

151 LENANEKNTW WLRRFQWAIM LMTLVSSVLM LFWHQIWVIR PLQALREGAE

201 RIGRRCFDIP VPEGGTPEFK QVGRCFNQMG GRLKILYDDL EGQVAEQTRS

251 LEKQNQNLTL LYQTTRDLHQ SYIPQQAAEH FLNRILPAVG ADSGRVCLDG

301 GSDVYVSIHH ADCGTAASDL GKYHEEIFPI EYQNETLGRL LLSFPNGISL

351 DEDDRILLQT LGRQLGVSLA GAKQEEEKRL LAVLQERNLI AQGLHDSIAQ

401 ALTFLNLQVQ MLETAFAENK REEAAENIGF IKTGVQECYE DVRELLLNFR

451 TKISNKEFPE AVADLFSRFT QQTGTTVETA WENGTHLPTQ DEQLQMIFIL

501 QESLSNIRKH AHATHIKFRL LKQDGSFTMT IQDNGQGFDT ENIGEPSGSH

551 VGLHIMQERA KRIHAVLEIR SQAQQGTTVS LTVASEESLK *
```

m561/a561 96.9% identity in 590 aa overlap

```
                   10        20        30        40        50        60
m561.pep   MILPARFSDGISLSLRLKLLTGLWVGLAALSVVLTLLLSLRLENAASVIEEAGNLRMQAY
           ||||||||||||||||||||||||||||||||||||||||||||||||||||||||||||
a561       MILPARFSDGISLSLRLKLLTGLWVGLAALSVVLTLLLSLRLENAASVIEEAGNLRMQAY
                   10        20        30        40        50        60

                   70        80        90       100       110       120
m561.pep   RLAYMAGEGSPRAQIDNQVAEFEKSLKRIAQSDAIHPLIPSDTPLAYDLIQSMLIIDWQA
           ||||||||||||||||||||||||||||||||||||||||||||||||||||||||||||
a561       RLAYMAGEGSPRAQIDNQVAEFEKSLKRIAQSDAIHPLIPSDTPLAYDLIQSMLIIDWQA
                   70        80        90       100       110       120

                  130       140       150       160       170       180
m561.pep   HILPPLQSYRRPTQVDLYRFAGNIELFLQALENANEKNTWWLRRFQWAIMLMTLVSSVLM
           ||||||||||||||||||||||||||||||||||||||||||||||||||||||||||||
a561       HILPPLQSYRRPTQVDLYRFAGNIELFLQALENANEKNTWWLRRFQWAIMLMTLVSSVLM
                  130       140       150       160       170       180

                  190       200       210       220       230       240
m561.pep   LFWHQIWVIRPLQALREGAERIGRRCFDIPVPEGGTPEFKQVGRCFNQMGGRLKILYDDL
           ||||||||||||||||||||||||||||||||||||||||||||||||||||||||||||
a561       LFWHQIWVIRPLQALREGAERIGRRCFDIPVPEGGTPEFKQVGRCFNQMGGRLKILYDDL
                  190       200       210       220       230       240

                  250       260       270       280       290       300
m561.pep   EGQVAEQTRSLEKQNQNLTLLYQTTRDLHQSYIPQQAAEHFLNRILPAVGADSGRVCLDG
           ||||||||||||||||||||||||||||||||||||||||||||||||||||||||||||
a561       EGQVAEQTRSLEKQNQNLTLLYQTTRDLHQSYIPQQAAEHFLNRILPAVGADSGRVCLDG
                  250       260       270       280       290       300

                  310       320       330       340       350       360
m561.pep   GSDVYVSIHHADCGTAASDLGKYHEEIFPIEYQNETLGRLLLSFPNGISLDEDDRILLQT
           ||||||||||||||||||||||||||||||||||||||||||||||||||||||||||||
a561       GSDVYVSIHHADCGTAASDLGKYHEEIFPIEYQNETLGRLLLSFPNGISLDEDDRILLQT
                  310       320       330       340       350       360
```

-continued

```
                 370        380        390        400        410        420
m561.pep    LGRQLGVSLAGAKQEEEKRLLAVLQERNLIAQGLHDSIAQALTFLNLQVQMLETAFAENK
            ||||||||||||||||||||||||||||||||||||||||||||||||||||||||||||
a561        LGRQLGVSLAGAKQEEEKRLLAVLQERNLIAQGLHDSIAQALTFLNLQVQMLETAFAENK
                 370        380        390        400        410        420

                 430        440        450        460        470        480
m561.pep    REEAAENISFIKTGVQECYEDVRELLLNFRTKISNKEFPEAVADLFARFTQQTGITVETA
            ||||||||:|||||||||||||||||||||||||||||||||||||:||||||| |||||
a561        REEAAENIGFIKTGVQECYEDVRELLLNFRTKISNKEFPEAVADLFSRFTQQTGTTVETA
                 430        440        450        460        470        480

                 490        500        510        520        530        540
m561.pep    WENGSFLPPQEAQLQMIFILQESLSNIRKHARATHVKFTLSEHGGRFTMTIQDNGQGFDT
            ||||: || |: |||||||||||||||||||:|||:|| | :: | ||||||||||||||
a561        WENGTHLPTQDEQLQMIFILQESLSNIRKHAHATHIKFRLLKQDGSFTMTIQDNGQGFDT
                 490        500        510        520        530        540

                 550        560        570        580        590
m561.pep    EKIGEPTGSHVGLHIMQERAKRIHAVLEIRSQAQQGTTVSLTVASEESLKX
            |:||||:|||||||||||||||||||||||||||||||||||||||||||
a561        ENIGEPSGSHVGLHIMQERAKRIHAVLEIRSQAQQGTTVSLTVASEESLKX
                 550        560        570        580        590
```

The following partial DNA sequence was identified in *N. gonorrhoeae* <SEQ ID 1659>:

g562.seq..

```
  1 atggcaagcc cgtcgagtct gcctttcaat tcgggcaaga ccaaaccgac
 51 ggcttttgcc gcgccggttt tggtcggaat catgttttcc acgccgctgc
101 gggcgcggcg caggtctttg tggcgcacgt cggtaacggt ttggtcgttg
151 gtcagtgcgt ggatggtggt cattgcgcct ttgacgatgc cgacgctttc
201 gctcaacact ttggcaaccg gcgagaggca gttggtggtg caggaagcgt
251 tggaaacgac ggtcatgtcg gcggtcagga cgctgtcgtt cacgccgtac
301 acgacggttg catcgacatc gtcgccgccc ggtgcggaaa tgaggacttt
351 tttcgcgccg ctttcgaggt ggattttggc tttttctttg ctggtgaacg
401 cgccggtgca ttccatgacc aaatcgacac cgagttcttt ccacggcagt
451 tcggcagggt tgcgggtcga gaagaagggg attttgtcgc cgttgacgat
501 gaggttgccg ccgtcgtggg atacgtcggc ttcaaagcgt ccgtgtacgg
551 tgtcgaattt ggtcagatgg gcgttggttt caaggctgcc gctggcgttg
601 acggcgacga tttggagttg gtcttga
```

This corresponds to the amino acid sequence <SEQ ID 1660; ORF 562.ng>:

g562.pep

```
  1 MASPSSLPFN SGKTKPTAFA APVLVGIMFS TPLRARRRSL WRTSVTVWSL
 51 VSAWMVVIAP LTMPTLSLNT LATGERQLVV QEALETTVMS AVRTLSFTPY
101 TTVASTSSPP GAEMRTFFAP LSRWILAFSL LVNAPVHSMT KSTPSSFHGS
151 SAGLRVEKKG ILSPLTMRLP PSWDTSASKR PCTVSNLVRW ALVSRLPLAL
201 TATIWSWS*
```

The following partial DNA sequence was identified in *N. meningitidis* <SEQ ID 1661>:

m562.seq

```
  1 ATGGCAAGCC CGTCGAGCCT GCCTTTCAAT TCGGGCAGTA CCAAACCGAC
 51 GGCTTTTGCC GCGCCGGTTT TGGTCGGAAT CATGTTTTCC ACGCCGCTGC
101 GGGCGCGGCG CAGGTCTTTG TGGCGCACGT CGGTAACGGT TTGGTCGTTG
151 GTCAGCGCGT GGATGGTGGT CATCGCGCCT TTGACGATGC CGACGCTTTC
201 GCTCAACACT TTGGCAACCG GCGAGAGGCA GTTGGTGGTG CAGGAAGCGT
251 TGGAAACGAC GGTCATGTCG GCGGTCAGGA CGCTGTCGTT CACGCCGTAC
301 ACGACGGTTG CATCGACATC GTCGCCGCCC GGTGCGGAAA TGAGGACTTT
351 TTTCGCGCCG CTTTCGAGGT GGATTTTGGC TTTTTCTTTG CTGGTGAACG
401 CGCCGGTGCA TTCCATGACC AAATCGACAC CGAGTTCTTT CCACGGCAGT
451 TCGGCAGGGT TGCGGGTCGA GAAGAAGGGG ATTTTGTCGC CGTTGACGAT
501 GAGGTTGCCG CCGTCGTGGG ATACGTCGGC TTCAAAGCGT CCGTGCACGG
551 TGTCGAATTT GGTCAGATGG GCGTTGGTTT CAAGGCTGCC CCTGGCGTTG
601 ACGGCGACGA GTTGGAGTTG GTCTTGA
```

This corresponds to the amino acid sequence <SEQ ID 1662; ORF 562>:

m562.pep

```
  1 MASPSSLPFN SGSTKPTAFA APVLVGIMFS TPLRARRRSL WRTSVTVWSL
 51 VSAWMVVIAP LTMPTLSLNT LATGERQLVV QEALETTVMS AVRTLSFTPY
101 TTVASTSSPP GAEMRTFFAP LSRWILAFSL LVNAPVHSMT KSTPSSFHGS
151 SAGLRVEKKG ILSPLTMRLP PSWDTSASKR PCTVSNLVRW ALVSRLPLAL
201 TATSWSWS*
```

Computer analysis of this amino acid sequence gave the following results:

Homology with a predicted ORF from *N. gonorrhoeae* m562/g562 99.0% identity in 208 aa overlap

```
                   10        20        30        40        50        60
m562.pep    MASPSSLPFNSGSTKPTAFAAPVLVGIMFSTPLRARRRSLWRTSVTVWSLVSAWMVVIAP
            |||||||||||:||||||||||||||||||||||||||||||||||||||||||||||||
g562        MASPSSLPFNSGKTKPTAFAAPVLVGIMFSTPLRARRRSLWRTSVTVWSLVSAWMVVIAP
                   10        20        30        40        50        60

                   70        80        90       100       110       120
m562.pep    LTMPTLSLNTLATGERQLVVQEALETTVMSAVRTLSFTPYTTVASTSSPPGAEMRTFFAP
            ||||||||||||||||||||||||||||||||||||||||||||||||||||||||||||
g562        LTMPTLSLNTLATGERQLVVQEALETTVMSAVRTLSFTPYTTVASTSSPPGAEMRTFFAP
                   70        80        90       100       110       120

                  130       140       150       160       170       180
m562.pep    LSRWILAFSLLVNAPVHSMTKSTPSSFHGSSAGLRVEKKGILSPLTMRLPPSWDTSASKR
            ||||||||||||||||||||||||||||||||||||||||||||||||||||||||||||
g562        LSRWILAFSLLVNAPVHSMTKSTPSSFHGSSAGLRVEKKGILSPLTMRLPPSWDTSASKR
                  130       140       150       160       170       180

                  190       200      209
m562.pep    PCTVSNLVRWALVSRLPLALTATSWSWSX
            ||||||||||||||||||||||| |||||
g562        PCTVSNLVRWALVSRLPLALTATIWSWSX
```

The following partial DNA sequence was identified in *N. meningitidis* <SEQ ID 1663>:

a562.seq

```
  1 ATGGCAAGCC CGTCGAGTTT GTCTTTCAAT TCGGGCAGTA CCAAACCGAC
 51 GGCTTTTGCC GCGCCAGTTT TGGTCGGAAT CATGTTTTCC ACGCCGCTGC
101 GGGCGCGGCG CAGGTCTTTG TGGCGCACGT CGGTAACGGT TTGGTCGTTG
151 GTCAGCGCGT GGATGGTGGT CATCGCGCCT TTGACGATGC CGACGCTTTC
201 GCTCAACACT TTGGCAACCG GCGAGAGGCA GTTGGTGGTG CAGGAAGCGT
251 TGGAAACGAC GGTCATGTCG GCGGTCAGGA TGCTGTCGTT CACGCCGTAC
301 ACGACGGTTG CATCGACATC GTCGCCGCCC GGTGCGGAAA TGAGGACTTT
351 TTTCGCGCCG CTTTCCAGAT GAACTTTGGC TTTTTCTTTG CTGGTGAACG
401 CGCCGGTGCA TTCCATGACC AAATCGACAC CGAGTTCTTT CCACGGCAGT
451 TCGGCAGGGT TGCGGGTCNA GAAGAANGGG ATTTTGTCGC CGTTGACGAT
501 GAGGTTGCCG CCGTCGTGGG ATACGTCGGC TTCAAAGCGT CCGTGCACGG
551 TGTCGAATTT GGTGAGGTGG GCGTTGGTTT CAAGGCTGCC GCTGGCGTTG
601 ACGGCGACGA TTTGGAGTTG GTCTTGA
```

This corresponds to the amino acid sequence <SEQ ID 1664; ORF 562.a>:

a562.pep

```
  1 MASPSSLSFN SGSTKPTAFA APVLVGIMFS TPLRARRRSL WRTSVTVWSL
 51 VSAWMVVIAP LTMPTLSLNT LATGERQLVV QEALETTVMS AVRMLSFTPY
101 TTVASTSSPP GAEMRTFFAP LSR*TLAFSL LVNAPVHSMT KSTPSSFHGS
151 SAGLRVXKXG ILSPLTMRLP PSWDTSASKR PCTVSNLVRW ALVSRLPLAL
201 TATIWSWS*
```

m562/a562 96.6% identity in 208 aa overlap

```
                   10        20        30        40        50        60
m562.pep   MASPSSLPFNSGSTKPTAFAAPVLVGIMFSTPLRARRRSLWRTSVTVWSLVSAWMVVIAP
           ||||||| ||||||||||||||||||||||||||||||||||||||||||||||||||||
a562       MASPSSLSFNSGSTKPTAFAAPVLVGIMFSTPLRARRRSLWRTSVTVWSLVSAWMVVIAP
                   10        20        30        40        50        60

                   70        80        90       100       110       120
m562.pep   LTMPTLSLNTLATGERQLVVQEALETTVMSAVRTLSFTPYTTVASTSSPPGAEMRTFFAP
           |||||||||||||||||||||||||||||||| |||||||||||||||||||||||||||
a562       LTMPTLSLNTLATGERQLVVQEALETTVMSAVRMLSFTPYTTVASTSSPPGAEMRTFFAP
                   70        80        90       100       110       120

                  130       140       150       160       170       180
m562.pep   LSRWILAFSLLVNAPVHSMTKSTPSSFHGSSAGLRVEKKGILSPLTMRLPPSWDTSASKR
           |||  |||||||||||||||||||||||||||||||| | ||||||||||||||||||||
a562       LSRXTLAFSLLVNAPVHSMTKSTPSSFHGSSAGLRVXKXGILSPLTMRLPPSWDTSASKR
                  130       140       150       160       170       180

                  190       200      209
m562.pep   PCTVSNLVRWALVSRLPLALTATSWSWSX
           |||||||||||||||||||||| |||||
a562       PCTVSNLVRWALVSRLPLALTATIWSWSX
                  190       200
```

The following partial DNA sequence was identified in *N. gonorrhoeae* <SEQ ID 1665>:

g563.seq

```
   1 ATGAACAAAA CCCTCTATCG TGTGATTTTC AACCGCAAAC GCGGTGCTGT
  51 GGTAGCTGTT GCCGAAACCA CCAAGCGCGA AGGTAAAAGC TGTGCCGATA
 101 GTGGTTCGGG CAGCGTTTAT GTGAAATCCG TTTCTTTCAT TCCTACTCAT
 151 TCCAAAGCCT TTTGTTTTTC TGCATTAGGC TTTTCTTTAT GTTTGGCTTT
 201 GGGTACGGTC AATATTGCTT TTGCTGACGG CATTATTACT GATAAAGCTG
 251 CTCCTAAAAC CCAACAAGCC ACGATTCTGC AAACAGGTAA CGGCATACCG
 301 CAAGTCAATA TTCAAACCcc tACTTCGGCa ggGGTTTCTG TTAATCAATA
 351 TGCCCAGTTT GATGTGGGTA ATcgcGGGGC GATTTTAAAC AACAGTCGCA
 401 GCAACACCCA AACACAGCTA GGCGGTTGGA TTCAAGGCAA TCCTTGGTTG
 451 ACAAGGGGCG AAGCACGTGT GGTTGTAAAC CAAATCAACA GCAGCCATCC
 501 TTCACAACTG AATGGCTATA TTGAAGTGGG TGGACGACGT GCAGAAGTCG
 551 TTATTGCCAA TCCGGCAGGG ATTGCAGTCA ATGGTGGTGG TTTTATCAAT
 601 GCTTCCCGTG CCACTTTGAC GACAGGCCAA CCGCAATATC AAGCAGGAGA
 651 CTTTAGCGGC TTTAAGATAA GGCAAGGCAA TGCTGTAATC GCCGGACACG
 701 GTTTGGATGC CCGTGATACC GATTTCACAC GTATTCTTTT GTATGCCAAC
 751 AAAATCACCT TGATCAGTAC GGCCGAACAA GCAGGCATTC GTAATCAAGG
 801 GCAGTTGTTT GCTTCTTCCG GTAATGTGGC GATTGATGCA AATGGCCGTT
 851 TGGTCAATAG TGGCACGATG GCTGCCGCCA ATGTGCAAGA TATGAATAAT
 901 ACAGCGGAAC ACAAAGTCAA TATCCGCAGT CAAGCCTTTG AAAACAGCGG
 951 TACGGCGGTA TCGCAACAAG GCACTCAAAT TCACAGTCAA TCGATTCAAA
1001 ACACTGGCAA ATTATTGTCG GCAGGAACAG AGGATTTAGC CGTTTCAGGC
1051 AGCCTGAACA ATCAAAATGG CGAAATAGCG ACCAATCAAC AACTGATTAT
1101 TCACGATGGT CAGCAATCTA CCGTTGTCAT TGATAATACG AATGGCACGA
1151 TACAATCAGG CCGTGATGTT GCCATTCAGG CAAAATCGTT ATCCAACAAC
1201 GGCACACTTG CCGCTGATAA TAAACTGGAT ATTGCGTTAC AAGATGATTT
1251 TTATGTAGAA CGCAAGATCG TGGCGGGCAA TGAATTGTCG CTCAGTACAC
1301 GAGGCAGCCT GAAAAATTCA CATACCTTGC AAGCAGGAAA ACGCATTCGG
1351 ATTAAAGCAA ATAACCTTGA TAATGCAGTA CAAGGCAACA TTCAATCCGG
1401 CGGTACGACA GACATTGGCA CGCAGCACAA TTTAACCAAT AGAGGCTTGA
1451 TTGACGGACA ACAAAACCAAA ATCCAAGCCG GGCAAATGAA TAATATCGGT
1501 ACAGGTCGGA TTTATGGCGA CAATATCGCT ATTGCGGCTA CCCGCTTAGA
1551 CAATCAAGAT GAAAACGGTA CAGGTGCCGC CATTGCGGCA CGCGAAAACC
1601 TGAATTTAGG CATTGAACAA TTAAATAACC GTGAAAACAG TCTGATTTAC
1651 AGCGGTAACG ATATGGCGGT TGGCGGCGCA TTAGATACCA ATGACCAAGC
1701 CACAGGCAAA GCCCAAAGGA TACACAATGC CGGCGCAATC ATTGAAGCTG
1751 CAGGCAAAAT GCGTTTAGGT GTAGAAAAGC TGCACAATAC CAATGAGCAT
1801 TTGAAAACGC AGTTGGTAGA AACAGGGCGC GAGCGTATTG TTGATTACGA
1851 AGCATTTGGA CGACACGAAT TATTGCGAGA AGGCACGCAA CATGAATTAG
1901 GCTGGTTTGT CTACAACAAT GAATCAGACC ACTTACGCAC CCCTGATGGA
```

-continued

1951 GTGGCGCATG AAAATTGGCA TAAATACGAT TATGAAAAAG TAACGCAAGA
2001 AACTCAAGTA ACCGGAACTG CGCCTGCTAA AATCATTGCA GGTAGCGATT
2051 TGATTATTGA TAGCAAAGCA GTCTTCAACA GCGACAGCCG AATCATTGCC
2101 GGCGGCCAAT TGCTTGTGCA AACAGAAAAA GACGGTTTGC ATAACGAGCA
2151 AACCTTTGGC GAGAAGAAAG TCTTCAGCGA AAATGGTAAG TTGCACAACT
2201 ACTGGCGTGC GCGTCGTAAA GGACATGATG AAACAGGGCA TCGTGAACAA
2251 AATTATACTT TGCCGGAGGA AATCACACGC GACATTTCAC TGGGTTCATT
2301 TGCCTATGAA TCGCATAGCA AAGCATTAAG CCGTCATGCG CCCAGCCAAG
2351 GCACTGAGTT GCCACAAAGT AACCGGGATA ATATCCGTAC TGCGAAAAGC
2401 AACGGTATTT CGCTACCCTA TACGCCCAAT TCTTTTACCC CATTACCCGG
2451 CAGCAGCTTA TACATTATCA ATCCTGCCAA TAAAGGCTAT CTTGTTGAAA
2501 CCGATCCACG CTTTGCCAAC TACCGTCAAT GGTTGGGTAG TGACTATATG
2551 CTGGGCAGCC TCAAACTAGA CCCAAACAAT TTACATAAAC GTTTGGGTGA
2601 TGGTTATTAC GAGCAACGTT TAATCAATGA ACAAATCGCA GAGCTGACAG
2651 GGCATCGTCG TTTAGACGGT TATCAAAACG ACGAAGAACA ATTTAAAGCC
2701 TTAATGGATA ATGGCGCGAC TGCGGCACGT TCGATGAATC TCAGCGTTGG
2751 CATTGCATTA AGTGCCGAGC AAGCAGCGCA ACTGACCAGC GATATTGTTT
2801 GGTTGGTACA AAAAGAAGTT AAACTTCCTG ATGGCGGCAC ACAAACCGTA
2851 TTGATGCCAC AGGTTTATGT ACGCGTTAAA AATGGCGGCA TAGACGGTAA
2901 AGGTGCATTG TTGTCAGGCA GCAATACACA AATCAATGTT TCAGGCAGCC
2951 TGAAAAACTC AGGCACGATT GCAGGGCGCA ATGCGCTTAT TATCAATACC
3001 GATACGCTAG ACAATATCGG TGGGCGTATT CATGCGCAAA AATCAGCGGT
3051 TACGGCCACA CAAGACATCA ATAATATTGG CGGCATTCTT TCTGCCGAAC
3101 AGACATTATT GCTCAATGCG GGTAACAACA TCAACAACCA AAGCACGGCC
3151 AAGAGCAGTC AAAATGCACA AGGTAGCAGC ACCTACCTAG ACCGAATGGC
3201 AGGTATTTAT ATCACAGGCA AAGAAAAAGG TGTTTTAGCA GCGCAGGCAG
3251 GCAAAGACAT CAACATCATT GCCGGTCAAA TCAGCAATCA ATCAGATCAA
3301 GGGCAAACCC GGCTGCAGGC AGGACGCGAC ATTAACCTGG ATACGGTACA
3351 AACCGGCAAA TATCAAGAAA TCCATTTTGA TGCCGATAAC CATACCATCC
3401 GAGGTTCAAC GAACGAAGTC GGCAGCAGCA TTCAAACAAA AGGCGATGTT
3451 ACCCtatTGT CAGGGAATAA TCTCAATGCC AAAGCTGCCG AAGTCGGCAG
3501 CGCAAAAGGC ACACTTGCCG TGTATGCTAA AAATGACATT ACTATCAGCT
3551 CAGGCATCCA TGCCGGCCAA GTTGATGATG CGTCCAAACA TACAGGCAGA
3601 AGCGGCGGCG GTAATAAATT AGTCATTACC GATAAAGCCC AAAGTCATCA
3651 CGAAACTGCT CAAAGCAGCA CCTTTGAAGG CAAGCAAGTT GTATTGCAGG
3701 CAGGAAACGA TGCCAACATC CTTGGCAGTA ATGTTATTTC CGATAATGGC
3751 ACCCGGATTC AAGCAGGCAA TCATGTTCGC ATTGGTACAA CCCAAACTCA
3801 AAGCCAAAGC GAAACCTATC ATCAAACCCA AAAATCAGGA TTGATGAGTG
3851 CAGGTATCGG CTTCACTATT GGCAGCAAGA CAAACACACA AGAAAACCAA
3901 TCCCAAAGCA ACGAACATAC AGGCAGTACC GTAGGCAGCC TGAAAGGCGA -continued

3951 TACCACCATT GTTGCAAGCA AACACTACGA ACAAACCGGC AGCAACGTTT

4001 CCAGCCCTGA GGGCAACAAC CTTATCAGCA CGCAAAGTAT GGATATTGGC

4051 GCAGCACAAA ACCAATTAAA CAGCAAAACC ACCCAAACCT ACGAACAAAA

4101 AGGCTTAACG GTGGGCATTC AGTTCGCCCG TTACCGATTT GGCACAACAA

4151 GCGATTGCCG TAGCACACAA AGCAGCAAAC AAGTCGGACA AAGCAAAAAC

4201 GACCGCGTTA ATGCCATGGC GGCTGCCAAT GCAGGTTGGC AGGCCTATCA

4251 AACAGGCAAA GGCGCACAAA ACTTAGCCAA TGGTACAACC AATGCCAAAC

4301 AAGTCAGCAT CTCCATAACC TACGGCGAAC AGCAAAACCG ACAAACCACC

4351 CAAGTTCAAG CCAATCAAGC CCAAGCGAGT CAAATTCAAG CAGGCGGCAA

4401 AACTACCCTT TATTGCCGAA GGTGCGGCGA ACAATCCAAT ATCAACATCA

4451 CAGGCTCAGG TGTTTCAGGC AGAGCAGGAA CCGGCCTGAT TGCCGATAAG

4501 CAAATCCATC TGCAATCAGC CGAGCAAAGC AATACCGAAC GCAGCCAAAA

4551 CAAATCAGCA GGCTGGAACG CAGGTGCTGC CGTATCATTC GGACAAGGAG

4601 GCTGGTCATT AGGCGTTGCC GCAGGCGGCA ATGTCGGCAA AGGCTACGGC

4651 TATGGCGATA GCGTAACCCA CCGCCATAGC CATATTGGCG ACAAAGGCAG

4701 CCAAACCCTT ATCCAAAGTG GTGGCGATAC CATCATCAAA GGCGCGCAAG

4751 TACGCGGCAA AGGCGTACAA GTCAATGCCA AAAACCTAAG CATTCAAAGT

4801 GTACAAGATA GAGAAACTTA TCAAAGCAAA CAACAAAACG CCGGTGCACA

4851 AGTTACCGTA GGTTATGGCT TCAGTGCCAG TGGCGATTAC AGCCAAAGCA

4901 AAATCCGAGC CGACCATGCT TCGGTAACCG AGCAAAGCGG TATTTATGCC

4951 GGAGAAGACG GCTATCAAAT CAAGGTCGGA AACCATACAG GCCTCAAAGG

5001 CGGCATCATC ACCAGCAGCC AAAGCGCAAA AGACAAGGGT AAAAACCGAT

5051 TCAGCACAGG CACACTCGCC GGCAGTGATA TTCAAAATTA CAGCCAATAC

5101 GAAGGAAAAA GTTTTGGATT GGGTGCCAGC GTTGCCGTAA GCGGCAAAAC

5151 ACTGGGACAG GGCGCAAAAA ATAAACCTCA AGACAAACAC CTGACAAGCA

5201 TAGCCGATAA AAACGGCGCA AGTTCATCAG TAGGGTACGG CAGCGACAGC

5251 GACAGTCAAA GCAGCATCAC AAAAAGCGGC ATCAATACCC CCAAAAACAT

5301 TCAAATCACA GACGAAGCCG CACAAATCAG GCTGACAGGC AAAATAGCGG

5351 CACAAACCAA AGCCGATATT GATACAAACG TAACCACAGA CACCGCCGAA

5401 CGACATTCGG GCAGCCTGAA AAACATATTT GACAAAGATA GAGTGCAAAG

5451 TGAACTGGAT TTACAAAgaA CCGTCAGCCA AGATTTTAGT AAAAATGTTC

5501 AACAAACCAA TACCGAGATT AACCAACATT TAGACAAACT CAAAGCAGAC

5551 AAAGAAGCAG CCGAAACAGC AGCAGCCGAG GCATTAGCCA ATGGCGATAT

5601 GGAAACTGCC AAACGCAAAG CCCATGAAGC TCAAGATGCG GCAGCAAAAG

5651 CAGATAATTG GCAACAAGGC AAAGTCATTC TCAACATGTT AGCCTCAGGT

5701 TTAGCTGAGC CGACCCAAAG CGGAGCgggc ATCGCTGCGG CTACCGCATC

5751 GCCagaCGTA TCGTATGCGA TTGGACAGCA CTTTAAagaT TTAGCCGGTC

5801 AAAACGCGAA TGGCAAACTA ACCGCCAGTC AagaAACCGC TCACGTTCTT

5851 GCCCACGCGG TATTAGGAGC AGCGGTTGCC GCAGCATGAG GCAACAATGC

5901 CCCGGCAGGA GCATTGGGTG CGGGCGGGTc ggAagcggCC GCCCCAATCA

-continued

```
5951 TCGGCAAATG GCTGTACGGC AAAGGAGAcg gcggcagccT GAATgcggag

6001 gaaaAAGaga CCGTTTCGGC GATTACAAGG ATGCTGggta cGgctGCCGG

6051 AGCAGCTGAG GGAAACTCGT CCGCCGATGC TGTGTGGGGT TGTTTTcaaa

6101 cggctTCaga TTTCGCTTCC TCTTTTTCAT ATCCTATAAA CATGTGA
```

This corresponds to the amino acid sequence <SEQ ID 1666; ORF 563.ng>:

```
g563.pep..

   1 MNKTLYRVIF NRKRGAVVAV AETTKREGKS CADSGSGSVY VKSVSFIPTH

  51 SKAFCFSALG FSLCLALGTV NIAFADGIIT DKAAPKTQQA TILQTGNGIP

 101 QVNIQTPTSA GVSVNQYAQF DVGNRGAILN NSRSNTQTQL GGWIQGNPWL

 151 TRGEARVVVN QINSSHPSQL NGYIEVGGRR AEVVIANPAG IAVNGGGFIN

 201 ASRATLTTGQ PQYQAGDFSG FKIRQGNAVI AGHGLDARDT DFTRILLYAN

 251 KITLISTAEQ AGIRNQGQLF ASSGNVAIDA NGRLVNSGTM AAANVQDMNN

 301 TAEHKVNIRS QAFENSGTAV SQQGTQIHSQ SIQNTGKLLS AGTEDLAVSG

 351 SLNNQNGEIA TNQQLIIHDG QQSTVVIDNT NGTIQSGRDV AIQAKSLSNN

 401 GTLAADNKLD IALQDDFYVE RKIVAGNELS LSTRGSLKNS HTLQAGKRIR

 451 IKANNLDNAV QGNIQSGGTT DIGTQHNLTN RGLIDGQQTK IQAGQMNNIG

 501 TGRIYGDNIA IAATRLDNQD ENGTGAAIAA RENLNLGIEQ LNNRENSLIY

 551 SGNDMAVGGA LDTNDQATGK AQRIHNAGAI IEAAGKMRLG VEKLHNTNEH

 601 LKTQLVETGR ERIVDYEAFG RHELLREGTQ HELGWFVYNN ESDHLRTPDG

 651 VAHENWHKYD YEKVTQETQV TGTAPAKIIA GSDLIIDSKA VFNSDSRIIA

 701 GGQLLVQTEK DGLHNEQTFG EKKVFSENGK LHNYWRARRK GHDETGHREQ

 751 NYTLPEEITR DISLGSFAYE SHSKALSRHA PSQGTELPQS NRDNIRTAKS

 801 NGISLPYTPN SFTPLPGSSL YIINPANKGY LVETDPRFAN YRQWLGSDYM

 851 LGSLKLDPNN LHKRLGDGYY EQRLINEQIA ELTGHRRLDG YQNDEEQFKA

 901 LMDNGATAAR SMNLSVGIAL SAEQAAQLTS DIVWLVQKEV KLPDGGTQTV

 951 LMPQVYVRVK NGGIDGKGAL LSGSNTQINV SGSLKNSGTI AGRNALIINT

1001 DTLDNIGGRI HAQKSAVTAT QDINNIGGIL SAEQTLLLNA GNNINNQSTA

1051 KSSQNAQGSS TYLDRMAGIY ITGKEKGVLA AQAGKDINII AGQISNQSDQ

1101 GQTRLQAGRD INLDTVQTGK YQEIHFDADN HTIRGSTNEV GSSIQTKGDV

1151 TLLSGNNLNA KAAEVGSAKG TLAVYAKNDI TISSGIHAGQ VDDASKHTGR

1201 SGGGNKLVIT DKAQSHHETA QSSTFEGKQV VLQAGNDANI LGSNVISDNG

1251 TRIQAGNHVR IGTTQTQSQS ETYHQTQKSG LMSAGIGFTI GSKTNTQENQ

1301 SQSNEHTGST VGSLKGDTTI VASKHYEQTG SNVSSPEGNN LISTQSMDIG

1351 AAQNQLNSKT TQTYEQKGLT VGIQFARYRF GTTSDCRSTQ SSKQVGQSKN

1401 DRVNAMAAAN AGWQAYQTGK GAQNLANGTT NAKQVSISIT YGEQQNRQTT

1451 QVQANQAQAS QIQAGGKTTL YCRRCGEQSN INITGSGVSG RAGTGLIADK

1501 QIHLQSAEQS NTERSQNKSA GWNAGAAVSF GQGGWSLGVA AGGNVGKGYG

1551 YGDSVTHRHS HIGDKGSQTL IQSGGDTIIK GAQVRGKGVQ VNAKNLSIQS
```

-continued

```
1601 VQDRETYQSK QQNAGAQVTV GYGFSASGDY SQSKIRADHA SVTEQSGIYA
1651 GEDGYQIKVG NHTGLKGGII TSSQSAKDKG KNRFSTGTLA GSDIQNYSQY
1701 EGKSFGLGAS VAVSGKTLGQ GAKNKPQDKH LTSIADKNGA SSSVGYGSDS
1751 DSQSSITKSG INTPKNIQIT DEAAQIRLTG KIAAQTKADI DTNVTTDTAE
1801 RHSGSLKNIF DKDRVQSELD LQRTVSQDFS KNVQQTNTEI NQHLDKLKAD
1851 KEAAETAAAE ALANGDMETA KRKAHEAQDA AAKADNWQQG KVILNMLASG
1901 LAEPTQSGAG IAAATASPDV SYAIGQHFKD LAGQNANGKL TASQETAHVL
1951 AHAVLGAAVA AAXGNNAPAG ALGAGGSEAA APIIGKWLYG KGDGGSLNAE
2001 EKETVSAITR MLGTAAGAAE GNSSADAVWG CFQTASDFAS SFSYPINM*
```

The following partial DNA sequence was identified in *N. meningitidis* <SEQ ID 1667>:

m563.seq..

```
   1 ATGAATAAAA CTCTCTATCG TGTAATTTTC AACCGCAAAC GTGGGGCTGT
  51 GGTAGCCGTT GCTGAAACTA CCAAGCGCGA AGGTAAAAGC TGTGCCGATA
 101 GTGATTCAGG CAGCGCTCAT GTGAAATCTG TTCCTTTTGG TACTACTCAT
 151 GCACCTGTTT GTCGTTCAAA TATCTTTTCT TTTTCTTTAT TGGGCTTTTC
 201 TTTATGTTTG GCTGTAGGTA CGGCCAATAT TGCTTTTGCT GATGGCATTA
 251 TTGCTGATAA AGCTGCTCCT AAAACTCAAC AAGCCACGAT TCTGCAAACA
 301 GGTAACGGCA TACCGCAAGT CAATATTCAA ACCCCTACTT CGGCAGGGGT
 351 TTCTGTTAAT CAATACGCCC AGTTTGATGT GGGTAATCGC GGGGCGATTT
 401 TAAACAACAG CCGCAGCAAC ACCCAAACAC AGCTAGGCGG TTGGATTCAA
 451 GGTAATCCTT GGTTGGCAAG GGGCGAAGCA CGTGTGGTTG TAAACCAAAT
 501 CAACAGCAGC CATTCTTCAC AAATGAATGG CTATATTGAA GTGGGCGGAC
 551 GACGTGCAGA AGTCGTTATT GCCAATCCGG CAGGGATTGC AGTCAATGGT
 601 GGTGGTTTTA TCAATGCTTC CCGTGCCACT TTGACGACAG GCCAACCGCA
 651 ATATCAAGCA GGAGACCTTA GCGGCTTTAA GATAAGGCAA GGCAATGTTG
 701 TAATCGCCGG ACACGGTTTG GATGCCCGTG ATACCGATTT CACACGTATT
 751 CTCAGTTATC ATTCCAAAAT TGATGCACCC GTATGGGGAC AAGATGTTCG
 801 TGTCGTCGCG GGACAAAACG ATGTGGTCGC AACAGGTAAT GCACATTCGC
 851 CTATTCTCAA TAATGCTGCT GCCAATACGT CAAACAATAC AGCCAACAAC
 901 GGCACACATA TCCCTTTATT TGCGATTGAT ACAGGCAAAT TAGGAGGTAT
 951 GTATGCCAAC AAAATCACCT TGATCAGTAC GGCCGAGCAA GCAGGCATTC
1001 GTAATCAAGG GCAGTTGTTT GCTTCTTCCG GTAATGTGGC GATTGATGCA
1051 AATGGCCGTT TAGTCAATAG TGGCACGATG GCTGCCGCCA ATGCGAAAGA
1101 TACGGATAAT ACAGCGGAAC ACAAAGTCAA TATCCGCAGT CAGGGCGTTG
1151 AAAACAGCGG TACGGCGGTA TCGCAACAAG GCACTCAAAT TCACAGTCAG
1201 TCGATTCAAA ACACTGGCAC ATTATTGTCC TCAGGCGAAA TATTGATTCA
1251 CAATTCGGGC AGCCTGAAAA ATGAAACATC AGGCACCATT GAAGCCGCTC
```

-continued

1301 GTTTGGCTAT TGATACCGAC ACACTTAATA ATCAAGGCAA ACTCTCTCAA

1351 ACAGGTTCAC AAAAACTCCA TATTGATGCA CAAGGCAAAA TGGATAACCG

1401 TGGCCGCATG GGTTTACAAG ATACCGCACC AACCGCGTCA AATGGTTCAA

1451 GCAATCAAAC CGGCAATAGT TACAATGCAT CTTTCCATTC ATCCACTACC

1501 ACACCAACAA CGGCAACAGG TACGGGTACT GCAACCGTTT CTATATCAAA

1551 CATAACTGCG CCTACCTTTG CTGATGGGAC AATTCGCACT CATGGTGCAC

1601 TGGATAATTC AGGCAGTATT ATTGCCAATG GTCAAACAGA TGTTAGTGCG

1651 CAACAAGGTT TAAATAATGC AGGACAAATA GACATTCATC AGTTAAATGC

1701 AAAAGGTTCG GCGTTTGACA ATCACAATGG AACAATTATC AGTGATGCGG

1751 TCCACATTCA AGCCGGCAGC CTGAATAATC AAAATGGCAA CATCACAACA

1801 CGCCAACAGT TAGAGATTGA AACCGATCAA CTGGATAACG CTCATGGCAA

1851 GTTATTATCA GCAGAAATAG CGGATTTAGC CGTTTCAGGC AGCCTGAACA

1901 ATCAAAATGG CGAAATAGCG ACCAATCAAC AACTGATTAT TCACGATGGT

1951 CAGCAATCTA CCGCTGTCAT TGATAATACG AATGGCACGA TACAATCAGG

2001 CCGTGATGTT GCTATTCAGG CAAAATCGTT ATCCAACAAC GGCACACTTG

2051 CCGCTGATAA TAAACTGGAT ATTGCGTTAC AAGATGATTT TTATGTAGAA

2101 CGCAATATCG TGGCGGGCAA TGAATTGTCG CTCAGTACAC GAGGCAGCCT

2151 GAAAAATTCA CATACTTTGC AAGCAGGAAA ACGCATTCGG ATTAAAGCAA

2201 ATAACCTTGA TAATGCAGCA CAAGGCAACA TTCAATCCGG CGGTACGACA

2251 GACATTGGCA CGCAGCACAA TTTAACCAAT AGAGGCTTGA TTGACGGACA

2301 ACAAACCAAA ATCCAAGCCG GGCAAATGAA TAATATCGGT ACAGGTCGGA

2351 TTTATGGCGA CAATATCGCT ATTGCGGCTA CCCGCTTAGA CAATCAAGAT

2401 GAAAACGGTA CAGGTGCCGC CATTGCGGCA CGTGAAAACC TGAATTTAGG

2451 CATCGGACAA TTAAACAACC GTGAAAACAG TCTGATTTAC AGCGGTAACG

2501 ATATGGCGGT TGGCGGCGCA TTAGATACCA ATGGCCAAGC CACAGGCAAA

2551 GCCCAAAGGA TACACAATGC CGGCGCAACC ATTGAAGCTG CAGGCAAAAT

2601 GCGTTTAGGT GTAGAAAAGC TGCACAATAC CAATGAGCAT TTGAAAACGC

2651 AGTTGGTAGA AACAGGGCGC GAGCATATTG TTGATTACGA AGCATTTGGA

2701 CGACACGAAT TATTGCGAGA AGGCACGCAA CATGAATTAG GCTGGTCTGT

2751 CTATAACGAT GAATCAGACC ACTTACGCAC CCCTGATGGA GCGGCGCATG

2801 AAAATTGGCA TAAATACGAT TATGAAAAAG TCACCCAAAA AACCCAAGTT

2851 ACCCAAACTG CGCCAGCCAA AATCATTTCA GGTAATGATT TAACCATTGA

2901 TGGTAAAGAA GTATTTAATA CCGATAGCCA AATCATTGCT GGTGGCAATC

2951 TCATTGTACA AACAGAAAAA GACGGTTTGC ATAACGAGCA AACCTTTGGC

3001 GAAAAGAAAG TATTCAGTGA AAATGGCAAA TTACACAGCT ATTGGCGTGA

3051 GAAACATAAA GGACGAGACT CAACGGGACA TAGCGAACAA AATTACACTT

3101 TGCCGGAGGA AATCACACGC AACATTTCAC TGGGTTCATT TGCCTATGAA

3151 TCGCATCGCA AAGCATTAAG CCATCATGCG CCCAGCCAAG GCACTGAGTT

3201 GCCGCAAAGC AACGGTATTT CGCTACCCTA TACGTCCAAT TCTTTTACCC

3251 CATTACCCAG CAGCAGCTTA TACATTATCA ATCCTGTCAA TAAAGGCTAT

-continued

3301 CTTGTTGAAA CCGATCCACG CTTTGCCAAC TACCGTCAAT GGTTGGGTAG

3351 TGACTATATG CTGGACAGCC TCAAACTAGA CCCAAACAAT TTACATAAAC

3401 GTTTGGGTGA TGGTTATTAC GAGCAACGTT TAATCAATGA ACAAATCGCA

3451 GAGCTGACAG GGCATCGTCG TTTAGACGGT TATCAAAACG ACGAAGAACA

3501 ATTTAAAGCC TTAATGGATA ATGGCGCGAC TGCGGCACGT TCGATGAATC

3551 TCAGCGTTGG CATTGCATTA AGTGCCGAGC AAGTAGCGCA ACTGACCAGC

3601 GATATTGTTT GGTTGGTACA AAAAGAAGTT AAGCTTCCTG ATGGCGGCAC

3651 ACAAACCGTA TTGGTGCCAC AGGTTTATGT ACGCGTTAAA AATGGCGACA

3701 TAGACGGTAA AGGTGCATTG TTGTCAGGCA GCAATACACA AATCAATGTT

3751 TCAGGCAGCC TGAAAAACTC AGGCACGATT GCAGGGCGCA ATGCGCTTAT

3801 TATCAATACC GATACGCTAG ACAATATCGG TGGGCGTATT CATGCGCAAA

3851 AATCAGCGGT TACGGCCACA CAAGACATCA ATAATATTGG CGGCATGCTT

3901 TCTGCCGAAC AGACATTATT GCTCAACGCA GGCAACAACA TCAACAGCCA

3951 AAGCACCACC GCCAGCAGTC AAAATACACA AGGCAGCAGC ACCTACCTAG

4001 ACCGAATGGC AGGTATTTAT ATCACAGGCA AAGAAAAAGG TGTTTTAGCA

4051 GCGCAGGCAG GAAAAGACAT CAACATCATT GCCGGTCAAA TCAGCAATCA

4101 ATCAGAGCAA GGGCAAACCC GGCTGCAAGC AGGGCGCGAC ATTAACCTAG

4151 ATACGGTACA AACCAGCAAA CATCAAGCAA CCCATTTTGA TGCCGATAAC

4201 CATGTTATTC GCGGTTCAAC GAACGAAGTC GGCAGCAGCA TTCAAACAAA

4251 AGGCGATGTT ACCCTATTGT CAGGGAATAA CCTCAATGCC AAAGCTGCCG

4301 AAGTCAGCAG CGCAAACGGT ACACTCGCTG TGTCTGCCAA AAATGACATC

4351 AACATCAGCG CAGGCATCAA CACGACCCAT GTTGATGATG CGTCCAAACA

4401 CACAGGCAGA AGCGGTGGTG GCAATAAATT AGTCATTACC GATAAAGCCC

4451 AAAGTCATCA CGAAACCGCC CAAAGCAGCA CCTTTGAAGG CAAGCAAGTT

4501 GTATTGCAGG CAGGAAACGA TGCCAACATC CTTGGCAGCA ATGTTATTTC

4551 CGATAATGGC ACCCAGATTC AAGCAGGCAA TCATGTTCGC ATTGGTACAA

4601 CCCAAACTCA AAGCCAAAGC GAAACCTATC ATCAAACCCA GAAATCAGGA

4651 TTGATGAGTG CAGGTATCGG CTTCACTATT GGCAGCAAGA CAAACACACA

4701 AGAAAACCAA TCCCAAAGCA ACGAACATAC AGGCAGTACC GTAGGCAGCT

4751 TGAAAGGCGA TACCACCATT GTTGCAGGCA AACACTACGA ACAAATCGGC

4801 AGTACCGTTT CCAGCCCGGA AGGCAACAAT ACCATCTATG CCCAAAGCAT

4851 AGACATTCAA GCGGCACACA ACAAATTAAA CAGTAATACC ACCCAAACCT

4901 ATGAACAAAA AGGCCTAACG GTGGCATTCA GTTCGCCCGT TACCGATTTG

4951 GCACAACAAG CGATTGCCGT AGCACAAAGC AGCAAACAAG TCGGACAAAG

5001 CAAAAACGAC CGCGTTAATG CCATGGCGGC TGCCAATGCA GGCTGGCAAG

5051 CCTATCAAAC AGGTAAGAGT GCACAAAACT TAGCCAATGG TACAACCAAT

5101 GCCAAACAAG TCAGCATCTC CATAACCTAC GGCGAACAGC AAAACCGACA

5151 AACCACCCAA GTTCAAGCCA ATCAAGCCCA AGCGAGTCAA ATTCAAGCAG

5201 GTGGTAAAAC CACATTAATC GCCACAGGCG CAGCAGAACA ATCCAATATC

5251 AACATCGCAG GCTCAGATGT TGCCGGCAAA GCAGGCACAA TCCTGATTGC

-continued

5301 CGATAACGAC ATCACACTCC AATCAGCCGA GCAAAGCAAT ACCGAACGCG

5351 GCCAAAACAA ATCGGCAGGC TGGAACGCAG GTGCTGCCGT ATCATTCGGA

5401 CAAGGAGGCT GGTCATTAGG CGTTACCGCA GGCGGCAATG TCGGCAAAGG

5451 CTACGGCAAT GGCGACAGCA TCACCCACCG CCATAGCCAT ATCGGCGACA

5501 AAGGCAGCCA AACCCTTATC CAAAGCGGTG GCGACACTAC CATCAAAGGC

5551 GCGCAAGTAC GCGGCAAAGG CGTACAAGTC AATGCCAAAA ACCTAAGTAT

5601 TCAAAGCGTA CAAGATAGAG AAACCTATCA AAGCAAACAA CAAAACGCCA

5651 GTGCACAAGT TACCGTAGGT TATGGCTTCA GTGCCGGTGG CGATTACAGC

5701 CAAAGCAAAA TCCGAGCCGA CCATGTTTCA GTAACCGAGC AAAGCGGTAT

5751 TTATGCCGGA GAAGACGGCT ATCAAATCAA GGTCGGAAAC CATACAGACC

5801 TCAAAGGCGG CATCATCACC AGTACCCAAA GCGCAGAAGA CAAGGGTAAA

5851 AACCGCTTTC AGACGGCCAC CCTCACCCAT AGCGACATCA AAAACCACAG

5901 CCAATACAAA GGCGAAAGTT TTGGATTGGG CGCAAGTGCG TCCATAAGCG

5951 GCAAAACACT GGGACAGGGC GCACAAAATA AACCTCAAAA CAAACACCTG

6001 ACAAGCGTAG CCGATAAAAA CAGCGCAAGT TCATCAGTGG GTTATGGCAG

6051 CGACAGCGAC AGTCAAAGCA GCATCACAAA AAGCGGCATC AACACCCGCA

6101 ACATTCAAAT CACCGACGAA GCCGCACAAA TCCGGCTGAC AGGCAAAACA

6151 GCGGCACAAA CCAAAGCCGA TATTGATACA AACGTAACCA CAGACACCGC

6201 CGAACGACAT TCGGGCAGCT TGAAGAACAC CTTCAACAAA GAAGCGGTGC

6251 AAAGTGAACT GGATTTACAA AGAACCGTCA GCCAAGATTT TAGTAAAAAT

6301 GTTCAACAAG CCAATACCGA GATTAACCAA CATTTAGACA AACTCAAAGC

6351 AGACAAAGAA GCAGCCGAAA CAGCAGCAGC CGAGGCATTA GCCAATGGCG

6401 ATATGGAAAC TGCCAAACGC AAAGCCCATG AAGCTCAAGA TGCGGCAGCA

6451 AAAGCAGATA ATTGGCAACA AGGCAAAGTC ATTCTCAACA TGTTAGCCTC

6501 AGGTTTAGCT GCGCCGACCC AAAGCGGAGC GGGCATCGCT GCGGCTACCG

6551 CATCGCCAGC CGTATCGTAT GCGATTGGAC AGCACTTTAA AGATTTAGCC

6601 GGTCAAAACG CGAATGGTAA ACTAACCGCC AGTCAAGAAA CCGCACACGT

6651 TCTTGCCCAC GCGGTATTAG GAGCAGCGGT TGCCGCAGTA GGAGACAACA

6701 ATGCTCTAGC AGGAGCATTG AGTGCGGGCG GGTCGGAAGC GGCTGCGCCT

6751 TACATCAGCA AATGGTTATA CGGCAAAGAA AAAGGAAGCG ACTTAACGGC

6801 GGAAGAGAAA GAGACTGTAA CAGCGATTAC AAATGTATTG GGTACGGCTA

6851 CGGGTGCGGC AGTCGGCAAC AGCGCAACAG ATGCAGCGCA AGGCAGCCTG

6901 AATGCGCAAA GTGCGGTGGA GAATAATGAT ACTGTAGAGC AAGTGAAATT

6951 TGCTCTTAGG CACCCTAGAA TTGCTATTGC AATTGGATCT GTACATAAAG

7001 ATCCTGGCTC TACATTAGAG CCTAATATTT CAACAATTGC TTCAACTTTT

7051 CAATTAAATT TATTTCCTAA TAGTGAATTT GGTGGTGAAG GTGGAGTTGG

7101 CAATGCATTC AGGCACGTTT TATGGCAAGC AACCATCACA CGAGAATTTG

7151 GCAAAGATAT TGCTGTTAAA GTAGGAAATA GTCATGAAAG TGGGGAAAAA

7201 ATTAATTATT CTATAAGACG TAATCTTTCA TTAGATAAAG CAGATGAAAT

7251 GATTGATCAA CTAAATAACG AAATAGGAAG AGAAATAGCA TTAAATACCA

-continued

```
7301 ATAGGTTAAA CACAAAAGAG TTAGTTGGAT TAATTCTGGA AACTTATAAA
7351 AATAATGGTT TTTATCAAGC AGAAAGAAAC AGTAATGGAA ATTATGATGT
7401 TGTAAGAAAA AGATTATCTG AAAAAGATTA CCAGAATACA AGCAATATAT
7451 TGATTCACTT AGATAATACT GGTGCCGGAT TTAAAATTCA GCAGAGGAGA
7501 AAACAAATCA GAGCACAAAT TTCAGCCAGA CAATGGAGAA GATAA
```

This corresponds to the amino acid sequence <SEQ ID 1668; ORF 563>:

m563.pep..

```
   1 MNKTLYRVIF NRKRGAVVAV AETTKREGKS CADSDSGSAH VKSVPFGTTH
  51 APVCRSNIFS FSLLGFSLCL AVGTANIAFA DGIIADKAAP KTQQATILQT
 101 GNGIPQVNIQ TPTSAGVSVN QYAQFDVGNR GAILNNSRSN TQTQLGGWIQ
 151 GNPWLARGEA RVVVNQINSS HSSQMNGYIE VGGRRAEVVI ANPAGIAVNG
 201 GGFINASRAT LTTGQPQYQA GDLSGFKIRQ GNVVIAGHGL DARDTDFTRI
 251 LSYHSKIDAP VWGQDVRVVA GQNDVVATGN AHSPILNNAA ANTSNNTANN
 301 GTHIPLFAID TGKLGGMYAN KITLISTAEQ AGIRNQGQLF ASSGNVAIDA
 351 NGRLVNSGTM AAANAKDTDN TAEHKVNIRS QGVENSGTAV SQQGTQIHSQ
 401 SIQNTGTLLS SGEILIHNSG SLKNETSGTI EAARLAIDTD TLNNQGKLSQ
 451 TGSQKLHIDA QGKMDNRGRM GLQDTAPTAS NGSSNQTGNS YNASFHSSTT
 501 TPTTATGTGT ATVSISNITA PTFADGTIRT HGALDNSGSI IANGQTDVSA
 551 QQGLNNAGQI DIHQLNAKGS AFDNHNGTII SDAVHIQAGS LNNQNGNITT
 601 RQQLEIETDQ LDNAHGKLLS AEIADLAVSG SLNNQNGEIA TNQQLIIHDG
 651 QQSTAVIDNT NGTIQSGRDV AIQAKSLSNN GTLAADNKLD IALQDDFYVE
 701 RNIVAGNELS LSTRGSLKNS HTLQAGKRIR IKANNLDNAA QGNIQSGGTT
 751 DIGTQHNLTN RGLIDGQQTK IQAGQMNNIG TGRIYGDNIA IAATRLDNQD
 801 ENGTGAAIAA RENLNLGIGQ LNNRENSLIY SGNDMAVGGA LDTNGQATGK
 851 AQRIHNAGAT IEAAGKMRLG VEKLHNTNEH LKTQLVETGR EHIVDYEAFG
 901 RHELLREGTQ HELGWSVYND ESDHLRTPDG AAHENWHKYD YEKVTQKTQV
 951 TQTAPAKIIS GNDLTIDGKE VFNTDSQIIA GGNLIVQTEK DGLHNEQTFG
1001 EKKVFSENGK LHSYWREKHK GRDSTGHSEQ NYTLPEEITR NISLGSFAYE
1051 SHRKALSHHA PSQGTELPQS NGISLPYTSN SFTPLPSSSL YIINPVNKGY
1101 LVETDPRFAN YRQWLGSDYM LDSLKLDPNN LHKRLGDGYY EQRLINEQIA
1151 ELTGHRRLDG YQNDEEQFKA LMDNGATAAR SMNLSVGIAL SAEQVAQLTS
1201 DIVWLVQKEV KLPDGGTQTV LVPQVYVRVK NGDIDGKGAL LSGSNTQINV
1251 SGSLKNSGTI AGRNALIINT DTLDNIGGRI HAQKSAVTAT QDINNIGGML
1301 SAEQTLLLNA GNNINSQSTT ASSQNTQGSS TYLDRMAGIY ITGKEKGVLA
1351 AQAGKDINII AGQISNQSEQ GQTRLQAGRD INLDTVQTSK HQATHFDADN
1401 HVIRGSTNEV GSSIQTKGDV TLLSGNNLNA KAAEVSSANG TLAVSAKNDI
1451 NISAGINTTH VDDASKHTGR SGGGNKLVIT DKAQSHHETA QSSTFEGKQV
1501 VLQAGNDANI LGSNVISDNG TQIQAGNHVR IGTTQTQSQS ETYHQTQKSG
```

-continued

```
1551 LMSAGIGFTI GSKTNTQENQ SQSNEHTGST VGSLKGDTTI VAGKHYEQIG

1601 STVSSPEGNN TIYAQSIDIQ AAHNKLNSNT TQTYEQKGLT VAFSSPVTDL

1651 AQQAIAVAQS SKQVGQSKND RVNAMAAANA GWQAYQTGKS AQNLANGTTN

1701 AKQVSISITY GEQQNRQTTQ VQANQAQASQ IQAGGKTTLI ATGAAEQSNI

1751 NIAGSDVAGK AGTILIADND ITLQSAEQSN TERGQNKSAG WNAGAAVSFG

1801 QGGWSLGVTA GGNVGKGYGN GDSITHRHSH IGDKGSQTLI QSGGDTTIKG

1851 AQVRGKGVQV NAKNLSIQSV QDRETYQSKQ QNASAQVTVG YGFSAGGDYS

1901 QSKIRADHVS VTEQSGIYAG EDGYQIKVGN HTDLKGGIIT STQSAEDKGK

1951 NRFQTATLTH SDIKNHISQYK GESFGLGASA SISGKTLGQG AQNKPQNKHL

2001 TSVADKNSAS SSVGYGSDSD SQSSITKSGI NTRNIQITDE AAQIRLTGKT

2051 AAQTKADIDT NVTTDTAERH SGSLKNTFNK EAVQSELDLQ RTVSQDFSKN

2101 VQQANTEINQ HLDKLKADKE AAETAAAEAL ANGDMETAKR KAHEAQDAAA

2151 KADNWQQGKV ILNMLASGLA APTQSGAGIA AATASPAVSY AIGQHFKDLA

2201 GQNANGKLTA SQETAHVLAH AVLGAAVAAV GDNNALAGAL SAGGSEAAAP

2251 YISKWLYGKE KGSDLTAEEK ETVTAITNVL GTATGAAVGN SATDAAQGSL

2301 NAQSAVENND TVEQVKFALR HPRIAIAIGS VHKDPGSTLE PNISTIASTF

2351 QLNLFPNSEF GGEGGVGNAF RHVLWQATIT REFGKDIAVK VGNSHESGEK

2401 INYSIRRNLS LDKADEMIDQ LNNEIGREIA LNTNRLNTKE LVGLILETYK

2451 NNGFYQAERN SNGNYDVVRK RLSEKDYQNT SNILIHLDNT GAGFKIQQRR

2501 KQIRAQISAR QWRR*
```

Computer analysis of this amino acid sequence gave the following results:

Homology with a predicted ORF from *N. gonorrhoeae*

ORF 563 shows 79.1% identity over a 2316 aa overlap with a predicted ORF (ORF 563.ng) from *N. gonorrhoeae*:

```
m563/g563

                      10        20        30        40        50
g563.pep      MNKTLYRVIFNRKRGAVVAVAETTKREGKSCADSGSGSVYVKSVSFIPTH-----SKAFC
              |||||||||||||||||||||||||||||||||| |||::|||| |  ||     |: |
m563.pep      MNKTLYRVIFNRKRGAVVAVAETTKREGKSCADSDSGSAHVKSVPFGTTHAPVCRSNIFS
                      10        20        30        40        50        60

                 60        70        80        90       100       110
g563.pep      FSALGFSLCLALGTVNIAFADGIITDKAAPKTQQATILQTGNGIPQVNIQTPTSAGVSVN
              || ||||||||:||:|||||||||:|||||||||||||||||||||||||||||||||||
m563.pep      FSLLGFSLCLAVGTANIAFADGIIADKAAPKTQQATILQTGNGIPQVNIQTPTSAGVSVN
                      70        80        90       100       110       120

                120       130       140       150       160       170
g563.pep      QYAQFDVGNRGAILNNSRSNTQTQLGGWIQGNPWLTRGEARVVVNQINSSHPSQLNGYIE
              |||||||||||||||||||||||||||||||||||:||||||||||||||| ||:|||||
m563.pep      QYAQFDVGNRGAILNNSRSNTQTQLGGWIQGNPWLARGEARVVVNQINSSHSSQMNGYIE
                     130       140       150       160       170       180

                180       190       200       210       220       230
g563.pep      VGGRRAEVVIANPAGIAVNGGGFINASRATLTTGQPQYQAGDFSGFKIRQGNAVIAGHGL
              ||||||||||||||||||||||||||||||||||||||||||:|||||||||:|||||||
m563.pep      VGGRRAEVVIANPAGIAVNGGGFINASRATLTTGQPQYQAGDLSGFKIRQGNVVIAGHGL
                     190       200       210       220       230       240

                240
g563.pep      DARDTDFTRIL-------------------------------------------------
              |||||||||||
m563.pep      DARDTDFTRILSYHSKIDAPVWGQDVRVVAGQNDVVATGNAHSPILNNAAANTSNNTANN
                     250       260       270       280       290       300
```

-continued

```
                               250       260       270       280       290
g563.pep      ----------------LYANKITLISTAEQAGIRNQGQLFASSGNVAIDANGRLVNSGTM
                             :|||||||||||||||||||||||||||||||||||||||||||
m563.pep      GTHIPLFAIDTGKLGGMYANKITLISTAEQAGIRNQGQLFASSGNVAIDANGRLVNSGTM
                     310       320       330       340       350       360

                     300       310       320       330       340
g563.pep      AAANVQDMNNTAEHKVNIRSQAFENSGTAVSQQGTQIHSQSIQNTGKLLSAGT-------
              ||||::| :||||||||||||: ||||||||||||||||||||||| |||:|
m563.pep      AAANAKDTDNTAEHKVNIRSQGVENSGTAVSQQGTQIHSQSIQNTGTLLSSGEILIHNSG
                     370       380       390       400       410       420

g563.pep      ------------------------------------------------------------

m563.pep      SLKNETSGTIEAARLAIDTDTLNNQGKLSQTGSQKLHIDAQGKMDNRGRMGLQDTAPTAS
                     430       440       450       460       470       480

g563.pep      ------------------------------------------------------------

m563.pep      NGSSNQTGNSYNASFHSSTTTPTTATGTGTATVSISNITAPTFADGTIRTHGALDNSGSI
                     490       500       510       520       530       540

g563.pep      ------------------------------------------------------------

m563.pep      IANGQTDVSAQQGLNNAGQIDIHQLNAKGSAFDNHNGTIISDAVHIQAGSLNNQNGNITT
                     550       560       570       580       590       600

                                         350       360       370       380
g563.pep      -----------------------EDLAVSGSLNNQNGEIATNQQLIIHDGQQSTVVIDNT
                                      ||||||||||||||||||||||||||||||:|||||
m563.pep      RQQLEIETDQLDNAHGKLLSAEIADLAVSGSLNNQNGEIATNQQLIIHDGQQSTAVIDNT
                     610       620       630       640       650       660

                     390       400       410       420       430       440
g563.pep      NGTIQSGRDVAIQAKSLSNNGTLAADNKLDIALQDDFYVERKIVAGNELSLSTRGSLKNS
              |||||||||||||||||||||||||||||||||||||||||:||||||||||||||||||
m563.pep      NGTIQSGRDVAIQAKSLSNNGTLAADNKLDIALQDDFYVERNIVAGNELSLSTRGSLKNS
                     670       680       690       700       710       720

                     450       460       470       480       490       500
g563.pep      HTLQAGKRIRIKANNLDNAVQGNIQSGGTTDIGTQHNLTNRGLIDGQQTKIQAGQMNNIG
              |||||||||||||||||||:||||||||||||||||||||||||||||||||||||||||
m563.pep      HTLQAGKRIRIKANNLDNAAQGNIQSGGTTDIGTQHNLTNRGLIDGQQTKIQAGQMNNIG
                     730       740       750       760       770       780

                     510       520       530       540       550       560
g563.pep      TGRIYGDNIAIAATRLDNQDENGTGAAIAARENLNLGIEQLNNRENSLIYSGNDMAVGGA
              |||||||||||||||||||||||||||||||||||||| |||||||||||||||||||||
m563.pep       TGRIYGDNIAIAATRLDNQDENGTGAAIAARENLNLGIGQLNNRENSLIYSGNDMAVGGA
                     790       800       810       820       830       840

                     570       580       590       600       610       620
g563.pep      LDTNDQATGKAQRIHNAGAIIEAAGKMRLGVEKLHNTNEHLKTQLVETGRERIVDYEAFG
              |||| |||||||||||||| |||||||||||||||||||||||||||||||:||||||||
m563.pep       LDTNGQATGKAQRIHNAGATIEAAGKMRLGVEKLHNTNEHLKTQLVETGREHIVDYEAFG
                     850       860       870       880       890       900

                     630       640       650       660       670       680
g563.pep      RHELLREGTQHELGWFVYNNESDHLRTPDGVAHENWHKYDYEKVTQETQVTGTAPAKIIA
              ||||||||||||||| |||:||||||||||:|||||||||||||||:|||| |||||||:
m563.pep      RHELLREGTQHELGWSVYNDESDHLRTPDGAAHENWHKYDYEKVTQKTQVTQTAPAKIIS
                     910       920       930       940       950       960

                     690       700       710       720       730       740
g563.pep      GSDLIIDSKAVFNSDSRIIAGGQLLVQTEKDGLHNEQTFGEKKVFSENGKLHNYWRARRK
              |:|| ||:| |||:||:|||||:|:|||||||||||||||||||||||||||:||| ::|
m563.pep      GNDLTIDGKEVFNTDSQIIAGGNLIVQTEKDGLHNEQTFGEKKVFSENGKLHSYWREKHK
                     970       980       990      1000      1010      1020

                     750       760       770       780       790       800
g563.pep      GHDETGHREQNYTLPEEITRDISLGSFAYESHSKALSRHAPSQGTELPQSNRDNIRTAKS
              |:| ||| ||||||||||||:||||||||||| ||||:|||||||||||||
m563.pep      GRDSTGHSEQNYTLPEEITRNISLGSFAYESHRKALSHHAPSQGTELPQSN---------
                    1030      1040      1050      1060      1070

                     810       820       830       840       850       860
g563.pep      NGISLPYTPNSFTPLPGSSLYIINPANKGYLVETDPRFANYRQWLGSDYMLGSLKLDPNN
               ||||||| |||||||:||||||||:||||||||||||||||||||||||||| ||||||||
m563.pep      -GISLPYTSNSFTPLPSSSLYIINPVNKGYLVETDPRFANYRQWLGSDYMLDSLKLDPNN
                    1080      1090      1100      1110      1120      1130

                     870       880       890       900       910       920
g563.pep      LHKRLGDGYYEQRLINEQIAELTGHRRLDGYQNDEEQFKALMDNGATAARSMNLSVGIAL
              ||||||||||||||||||||||||||||||||||||||||||||||||||||||||||||
m563.pep      LHKRLGDGYYEQRLINEQIAELTGHRRLDGYQNDEEQFKALMDNGATAARSMNLSVGIAL
                    1140      1150      1160      1170      1180      1190

                     930       940       950       960       970       980
g563.pep      SAEQAAQLTSDIVWLVQKEVKLPDGGTQTVLMPQVYVRVKNGGIDGKGALLSGSNTQINV
              ||||:||||||||||||||||||||||||||:|||||||||| |||||||||||||||||
m563.pep      SAEQVAQLTSDIVWLVQKEVKLPDGGTQTVLVPQVYVRVKNGDIDGKGALLSGSNTQINV
                    1200      1210      1220      1230      1240      1250
```

-continued

```
                990       1000       1010       1020       1030       1040
g563.pep    SGSLKNSGTIAGRNALIINTDTLDNIGGRIHAQKSAVTATQDINNIGGILSAEQTLLLNA
            ||||||||||||||||||||||||||||||||||||||||||||||||:|||||||||||
m563.pep    SGSLKNSGTIAGRNALIINTDTLDNIGGRIHAQKSAVTATQDINNIGGMLSAEQTLLLNA
               1260       1270       1280       1290       1300       1310

               1050       1060       1070       1080       1090       1100
g563.pep    GNNINNQSTAKSSQNAQGSSTYLDRMAGIYITGKEKGVLAAQAGKDINIIAGQISNQSDQ
            |||||:|||: ||||:||||||||||||||||||||||||||||||||||||||||||:|
m563.pep    GNNINSQSTTASSQNTQGSSTYLDRMAGIYITGKEKGVLAAQAGKDINIIAGQISNQSEQ
               1320       1330       1340       1350       1360       1370

               1110       1120       1130       1140       1150       1160
g563.pep    GQTRLQAGRDINLDTVQTGKYQEIHFDADNHTIRGSTNEVGSSIQTKGDVTLLSGNNLNA
            ||||||||||||||||||:|:|  ||||||:|||||||||||||||||||||||||||||
m563.pep    GQTRLQAGRDINLDTVQTSKHQATHFDADNHVIRGSTNEVGSSIQTKGDVTLLSGNNLNA
               1380       1390       1400       1410       1420       1430

               1170       1180       1190       1200       1210       1220
g563.pep    KAAEVGSAKGTLAVYAKNDITISSGIHAGQVDDASKHTGRSGGGNKLVITDKAQSHHETA
            |||||:||:||||| |||||:||:||:: :||||||||||||||||||||||||||||||
m563.pep    KAAEVSSANGTLAVSAKNDINISAGINTTHVDDASKHTGRSGGGNKLVITDKAQSHHETA
               1440       1450       1460       1470       1480       1490

               1230       1240       1250       1260       1270       1280
g563.pep    QSSTFEGKQVVLQAGNDANILGSNVISDNGTRIQAGNHVRIGTTQTQSQSETYHQTQKSG
            ||||||||||||||||||||||||||||||:|||||||||||||||||||||||||||||
m563.pep    QSSTFEGKQVVLQAGNDANILGSNVISDNGTQIQAGNHVRIGTTQTQSQSETYHQTQKSG
               1500       1510       1520       1530       1540       1550

               1290       1300       1310       1320       1330       1340
g563.pep    LMSAGIGFTIGSKTNTQENQSQSNEHTGSTVGSLKGDTTIVASKHYEQTGSNVSSPEGNN
            |||||||||||||||||||||||||||||||||||||||||:|||||  ||:||||||||
m563.pep    LMSAGIGFTIGSKTNTQENQSQSNEHTGSTVGSLKGDTTIVAGKHYEQIGSTVSSPEGNN
               1560       1570       1580       1590       1600       1610

               1350       1360       1370       1380       1390       1400
g563.pep    LISTQSMDIGAAQNQLNSKTTQTYEQKGLTVGIQFARYRFGTTSDCRSTQSSKQVGQSKN
             |  :||:||  ||:|:|||:||||||||||||:::      ::   :     :||||||||||
m563.pep    TIYAQSIDIQAAHNKLNSNTTQTYEQKGLTVAFSSPVTDLAQQA-IAVAQSSKQVGQSKN
               1620       1630       1640       1650       1660

               1410       1420       1430       1440       1450       1460
g563.pep    DRVNAMAAANAGWQAYQTGKGAQNLANGTTNAKQVSISITYGEQQNRQTTQVQANQAQAS
            |||||||||||||||||||:||||||||||||||||||||||||||||||||||||||||
m563.pep    DRVNAMAAANAGWQAYQTGKSAQNLANGTTNAKQVSISITYGEQQNRQTTQVQANQAQAS
         1670       1680       1690       1700       1710       1720

               1470       1480       1490       1500       1510       1520
g563.pep    QIQAGGKTTLYCRRCGEQSNINITGSGVSGRAGTGLIADKQIHLQSAEQSNTERSQNKSA
            |||||||||       :||||||:||  |:|:|||  ||||::|  |||||||||||:|||||
m563.pep     QIQAGGKTTLIATGAAEQSNINIAGSDVAGKAGTILIADNDITLQSAEQSNTERGQNKSA
         1730       1740       1750       1760       1770       1780

               1530       1540       1550       1560       1570       1580
g563.pep    GWNAGAAVSFGQGGWSLGVAAGGNVGKGYGYGDSVTHRHSHIGDKGSQTLIQSGGDTIIK
            ||||||||||||||||||:||||||||| |||:||||||||||||||||||||| ||
m563.pep    GWNAGAAVSFGQGGWSLGVTAGGNVGKGYGNGDSITHRHSHIGDKGSQTLIQSGGDTTIK
         1790       1800       1810       1820       1830       1840

               1590       1600       1610       1620       1630       1640
g563.pep    GAQVRGKGVQVNAKNLSIQSVQDRETYQSKQQNAGAQVTVGYGFSASGDYSQSKIRADHA
            ||||||||||||||||||||||||||||||||||:|||||||||||||:||||||||||||:
m563.pep    GAQVRGKGVQVNAKNLSIQSVQDRETYQSKQQNASAQVTVGYGFSAGGDYSQSKIRADHV
         1850       1860       1870       1880       1890       1900

               1650       1660       1670       1680       1690       1700
g563.pep    SVTEQSGIYAGEDGYQIKVGNHTGLKGGIITSSQSAKDKGKNRFSTGTLAGSDIQNYSQY
            |||||||||||||||||||||| |||||||:|||:||||||:|:||:  |||:|:|||
m563.pep    SVTEQSGIYAGEDGYQIKVGNHTDLKGGIITSTQSAEDKGKNRFQTATLTHSDIKNHSQY
         1910       1920       1930       1940       1950       1960

               1710       1720       1730       1740       1750       1760
g563.pep    EGKSFGLGASVAVSGKTLGQGAKNKPQDKHLTSIADKNGASSSVGYGSDSDSQSSITKSG
            :|:||||||:::|||||||||||:||||:|||||:||||:||||||||||||||||||||||
m563.pep     KGESFGLGASASISGKTLGQGAQNKPQNKHLTSVADKNSASSSVGYGSDSDSQSSITKSG
         1970       1980       1990       2000       2010       2020

               1770       1780       1790       1800       1810       1820
g563.pep    INTPKNIQITDEAAQIRLTGKIAAQTKADIDTNVTTDTAERHSGSLKNIFDKDRVQSELD
            ||| :|||||||||||||||||| |||||||||||||||||||||||||| |:|: ||||||
m563.pep    INT-RNIQITDEAAQIRLTGKTAAQTKADIDTNVTTDTAERHSGSLKNTFNKEAVQSELD
         2030       2040       2050       2060       2070       2080

               1830       1840       1850       1860       1870       1880
g563.pep    LQRTVSQDFSKNVQQTNTEINQHLDKLKADKEAAETAAAEALANGDMETAKRKAHEAQDA
            ||||||||||||||:|||||||||||||||||||||||||||||||||||||||||||||
m563.pep    LQRTVSQDFSKNVQQANTEINQHLDKLKADKEAAETAAAEALANGDMETAKRKAHEAQDA
          2090       2100       2110       2120       2130       2140

               1890       1900       1910       1920       1930       1940
g563.pep    AAKADNWQQGKVILNMLASGLAEPTQSGAGIAAATASPDVSYAIGQHFKDLAGQNANGKL
            |||||||||||||||||||||| |||||||||||||||| ||||||||||||||||||||
m563.pep    AAKADNWQQGKVILNMLASGLAAPTQSGAGIAAATASPAVSYAIGQHFKDLAGQNANGKL
          2150       2160       2170       2180       2190       2200
```

-continued

```
                  1950      1960      1970      1980      1990      2000
g563.pep   TASQETAHVLAHAVLGAAVAAAXGNNAPAGALGAGGSEAAAPIIGKWLYGKGDGGSLNAE
           |||||||||||||||||||||:  ||| ||||:||||||||| |:||||||  |::|:||
m563.pep   TASQETAHVLAHAVLGAAVAAVGDNNALAGALSAGGSEAAAPYISKWLYGKEKGSDLTAE
         2210      2220      2230      2240      2250      2260

                  2010      2020      2030      2040     2049
g563.pep   EKETVSAITRMLGTAAGAAEGNSSADAVWGCFQTASDFASSFSYPINMX
           |||||:||| :||||:||| |||::||: | ::: |
m563.pep   EKETVTAITNVLGTATGAAVGNSATDAAQGSLNAQSAVENNDTVEQVKFALRHPRIAIAI
         2270      2280      2290      2300      2310      2320


m563.pep   GSVHKDPGSTLEPNISTIASTFQLNLFPNSEFGGEGGVGNAFRHVLWQATITREFGKDIA
                  2330      2340      2350      2360      2370      2380
```

The following partial DNA sequence was identified in *N. meningitidis* <SEQ ID 1669>:

m564.seq

1 ATGAACCGCA CCCTGTACAA AGTTGTATTT AACAAACATC GAAACTGCAT

51 GATAGCCGTT GCTGAAAATG CCAAACGCGA GGGCAAAAAC ACAGCCGACA

101 CCCAAGCTGT AGGTATTTTG CCAAATGATA TTGCGGGCTT TGCGGGTTTT

151 ATCCATTCTA TCTCTGTTAT CTCATTCTCC CTTTCATTAC TGCTCGGTTC

201 TGCCCTTATC CTGACTTCTT CTTCTGCTAC TGCCCAAGGT ATCGTTGCCG

251 ACAAATCCGC ACCTGCACAG CAACAGCCTA CCATCCTGCA AACAGGTAAC

301 GGCATACCGC AAGTCAATAT TCAAACCCCT ACTTCGGCAG GGGTTTCTGT

351 TAATCAATAC GCCCAGTTTG ATGTGGGTAA TCGCGGGGCG ATTTTAAACA

401 ACAGTCGCAG CAACACCCAA ACACAGCTAG GCGGTTGGAT TCAAGGCAAT

451 CCTTGGTTGG CAAGGGGCGA AGCACGTGTG GTTGTAAACC AAATCAACAG

501 CAGCCATTCT TCACAACTGA ATGGCTATAT TGAAGTGGGC GGACGACGTG

551 CAGAAGTCGT TATTGCCAAT CCGGCAGGGA TTGCAGTCAA TGGTGGTGGT

601 TTTATCAATG CTTCCCGTGC CACTTTGACG ACAGCCCAAC CGCAATATCA

651 AGCAGGAGAC CTTAGCGGCT TTAAGATAAG GCAAGGCAAT GTTGTAATCG

701 CCGGACACGG TTTGGATGCA CGTGATACCG ATTACACACG TATTCTCAGT

751 TATCATTCCA AAATTGATGC ACCCGTATGG GGACAAGATG TTCGTGTCGT

801 CGCGGGACAA AACGATGTGG CCGCAACAGG TGATGCACAT TCGCCTATTC

851 TCAATAATGC TGCTGCCAAT ACGTCAAACA ATACAGCCAA CAACGGCACA

901 CATATCCCTT TATTTGCGAT TGATACAGGC AAATTAGGAG GTATGTATGC

951 CAACAAAATC ACCTTGATCA GTACGGTCGA GCAAGCAGGC ATTCGTAATC

1001 AAGGGCAATG GTTTGCCTCA GCCGGCAATG TGGCAGTGAA TGCTGAGGGT

1051 AAACTGGTCA ACACGGGCAT GATTGCAGCG ACGGGAGAAA ATCATGCGGT

1101 TTCACTTCAT GCCCGCAATG TTCATAATAG CGGTACGGTT GCCTCACAGG

1151 ATGATGCCAA TATTCACAGC CAGACGCTGG ACAATTCAGG TACGGTCTTA

1201 TCCTCAGGTC GATTGACTGT TCGTAATTTA GGCCGTCTGA AAAACCAAAA

1251 CAACGGTACG ATCCAGGCTG CCCGCTTAGA TATGTCAACA GGTGGTTTGG

1301 ATAACACAGG TAATATTACT CAAACAGGTT CACAAGCATT GGATTTGGTA

1351 TCTGCCGGCA AATTCGATAA CAGTGGCAAG ATTGGTGTAA GTGACGTTCC

-continued

1401 ACAGACCGGT TTGAATCCCA ATCCATCAGT CATACCACAG ATTCCGAGTA

1451 CTGCAACAGG TTCAGGCAGC AGCACTGTCT CGGTATCTAA GCCTGGTTCA

1501 AACAATCCCG TTTCACCTAC AGCACCTGCA AAAAACTACG CCGTAGGACG

1551 CATTCAAACA ACAGGAGCAT TTGACAATGC AGGATCAATT AATGCGGGTG

1601 GGCAAATTGA CATTGCCGCC CAAAACGGTT TGGGAAATTC GGGTAGTCTG

1651 AATGCGGCTA AACTACGAGT ATCAGGCGAT TCATTTAACA ATACGGTAAA

1701 AGGCAAACTC CAGGCACACG ATCTGGCTGT TAACACTCAA ACTGCTAAAA

1751 ACAGCGGTCA CTTATTAACT CAAACCGGCA AGATTGATAA CCGTGAACTG

1801 CATAATGCCG GAGAAATTGC CGCCAACAAT CTGACACTCA TTCATTCGGG

1851 CCGCTTGAGC AATGATAAAA AAGGCAATAT TCGAGCTGCA CATTTACAGC

1901 TTGATACCGC CGGTTTACAT AATGCAGGTA ACATTCTTGC CGATAGTGGA

1951 ACCGTTACCA CCAAGAATAA TCTTCGCAAT ACAGGAAAAG TTTCTGTTGC

2001 ACGACTGAAT ACCGAAGGTC AGACTCTAGA TAATACGCGC GGACGTATAG

2051 AGGCTGAAAC GGTTAACATC CAAAGTCAGC AACTGACTAA CCAAAGCGGC

2101 CATATTACTG CTACCGAACA ACTGACTATC AATAGTCGAA ATGTAGACAA

2151 CCAAAACGGC AAACTCCTAT CTGCAAACCA AGCACAATTA GCTGTTTCAG

2201 ACGGCCTATA CAACCAACAT GGTGAAATTG CCACCAACCG GCAGTTGTCT

2251 ATTCACGATA AAAATCAAAA CACTTTGGCG TTAAACAATG CGGATGGCAC

2301 GATTCAATCT GCCGGTAATG TATCGCTACA AGCCAAATCA CTCGCCAACA

2351 ATGGCACATT AACAGCCGGT AACAAACTGG ATATTGCTTT GACGGACGAT

2401 TTCGTCGTAG AGCGCGACCT CACTGCAGGC AAACAATTAA ATCTAAGCAT

2451 AAAAGGCCGT CTGAAAAATA CCCATACCCT ACAAGCAGGC CATACGCTCA

2501 AACTCAATGC CGGCAATATA GATAACCAAG TTACAGGCAA AATTATTGGT

2551 GGAGAACAAA CGGACATCAC ATCCGAACAG CATGTTGACA ACAGGGGCTT

2601 GATCAACAGC GACGGTTTGA CCCACATCGG TGCAGGTCAA ACCCTGACCA

2651 ACACCGGGAC AGGCAAAATC TATGGCAACC ATATTGCCCT GGACGCGCAA

2701 ATACTGCTTA ACCGGGAAGA AACGACGGAA GGCAGTACCA AAGCGGGGGC

2751 AATAGCTGCA AGGAAACGTT TGGATATTGG AGCGAAAGAG ATTCATAACC

2801 AAGAAGGTGC CCTACTATCC AGCGAAGGTA TTTTTGCCGT AgGTAATCGA

2851 CTGGATGAAC AACATCATGC GGCAGGCATG GCCGATACCT TTGTTAATGG

2901 CAGTGCCGGT TTGGAAGTAC AAGGTGATGC ATTGATGTCC GTTCGGAATA

2951 TGCAGAATAT CAATAATCAC TTTAAAACAG AGACATACTT AGCCAAAGCG

3001 GAAAAGCAAG TCCGCGACTA CACCGTACTG GGGCAAAATA CCTACTATCA

3051 GGCGGGAAAA GACGGTTTAT TCGACAACTC GCAAGGACAA AAAGACCAAA

3101 CTACTGCTAC GTTCCATTTA AAAAATGGTT CTCGTATTGA GGCCAACCAA

3151 TGGCATGTCC GAGACTACCA CATCGAGACT TATAAAGAAC GCATCATCGA

3201 AAACCGGCCG GCACACATTA CTGTGGGCGG TGATTTGACT GCCTCAGGTC

3251 AAAATTGGCT GAACAAAGAC AGCCGGATTG TAGTAGGCGG GCGTATTATC

3301 ACTGATGATT TAAACCAGAA AGAAATTACC AATCAAAGTA CAACAGGCAA

3351 AGGTCGCACA GATGCTGTCG GCACACAGTG GGATTCAGTT ACAAAAAAAG

-continued

3401 GATGGTACAG CGGTAGAAAA AGACAACGCC GTACTGAAAG AAACCATACT
3451 CCTTACCATG ATACCCAACT ATTTACCCAC GACTTCGACA CGCCTGTATC
3501 CGTCATCCAA CAGAATGCCG CCTCCCCTTC CTTTCAACCC GCCGCATCTG
3551 CAATCAAACT GATTGACGGA GTATCCACGG CAGCCGTCAA TGGTCAGCGC
3601 ATCCATACCG GTAATGTGGT CTCGTTAAAT AACGCTACTG TTACTCTGCC
3651 TAACAGCAGC CTCTATACCA CCCATCCTGA CAATAAAGGC TGGTTGGTTG
3701 AAACCGATCC TCAATTTGCA GACTACCGCC GCTGGTTGGG CAGCGACTAC
3751 ATGTTGCAAC AACTGCAATT GGACACCAAT CATCTACACA AACGGCTTGG
3801 CGACGGCTAC TACGAACAAA AACTTGTTAA TGAACAAATC CATCAGTTAA
3851 CAGGCTACCG CCGACTCGAC GGCTACAGGA GTGATGAAGA ACAATTCAAA
3901 GCTCTGATGG ACAACGGCCT TACTGCTGCC AAAACATTCG GTCTCACCCC
3951 AGGTATCGCC TTGAGTGCAG AGCAAGTTGC CCGCTTAACT TCAGATATCG
4001 TTTGGATGGA AAATCAAACC GTCACCCTGT CTGACGGTTC GACTCAAACC
4051 GTACTGGTTC CTAAAGTCTA TGCCCTGGCG CGCAAAGGTG ATCTCAATAC
4101 CTCCGGTGGC CTGATTAGTG CCGAACAAGT CTTACTTAAA CTGCAAAACG
4151 GCAACCTGAC TAACAGCGGT ACCATTGCGG GGCGACAGGC CGTACTCATC
4201 CAGGCACGGA ATATTAACAG CAACGGTAAC ATTCAAGCCG ACCAAATCGG
4251 CTTAAAAGCT GAAAAAAGTA TCAATATCGA CGGCGGGCAG GTACAAGCAG
4301 GCAGACTGCT GACTGCCCAA GCGCAAAATA TCAACCTTAA CGGTACAACC
4351 CAAACTTCCG GTAATGAACG TAACGGCAAT ACCGCCATCG ATCGTATGGC
4401 CGGCATTAAC GTGGTCGGAA GCCATACTGA ACAAGTAGAT AACAGAACTT
4451 CAGACGGCAT CCTATCCCTG CATGCCAGCA ACGATATCAA CCTCAATGCG
4501 GCCACCGTCT CTAACCAAGT TAAAGACGGC ACTACCCAAA TTACCGCCGG
4551 CAATAATCTC AACCTCGGCA CCATCCGTAC CGAACATCGC GAAGCCTATG
4601 GTACATTAGA TGACGAGAAC CATCGCCATG TCCGCCAAAG TACCGAAGTC
4651 GGCAGCAGTA TCCGCACGCA AAACGGCGCA CTGCTTAGAG CCGGTAACGA
4701 CTTAAAAATC CGCCAAGGCG AACTGGAGGC CGAAGAAGGC AAAACCGTCC
4751 TTGCCGCAGG ACGTGATGTC ACTATCAGCG AAGGACGCCA AATAACCGAA
4801 CTGGATACCT CGGTAAGCGG AAAAAGCAAA GGCATCCTTT CCAGTACCAA
4851 AACACACGAC CGCTACCGCT TCAGTCATGA TGAAGCAGTC GGCAGCAACA
4901 TCGGCGGCGG CAAAATGATT GTTGCAGCCG GGCAGGATAT CAATGTACGC
4951 GGCAGCAACC TTATTTCTGA TAAGGGCATT GTTTTAAAAG CAGGACACGA
5001 CATCGATATT TCTACTGCCC ATAATCGCTA TACCGGCAAT GAATACCACG
5051 AGAGCAAAAA ATCAGGCGTC ATGGGTACTG GCGGATTGGG CTTTACTATC
5101 GGTAACCGGA AAACTACCGA TGACACTGAT CGTACCAATA TTGTCCATAC
5151 AGGCAGCATT ATAGGCAGCC TGAATGGAGA CACCGTTACA GTTGCAGGAA
5201 ACCGCTACCG ACAAACCGGC AGTACCGTCT CCAGCCCCGA GGGGCGCAAT
5251 ACCGTCACAG CCAAAAGCAT AGATGTAGAG TTCGCAAACA ACCGGTATGC
5301 CACTGACTAC GCCCATACCC AGGAACAAAA AGGCCTTACC GTCGCCCTCA
5351 ATGTCCCGGT TGTCCAAGCT GCACAAAACT TCATACAAGC AGCCCAAAAT

-continued

5401 GTGGGCAAAA GTAAAAATAA ACGCGTTAAT GCCATGGCTG CAGCCAATGC

5451 TGCATGGCAG AGTTATCAAG CAACCCAACA AATGCAACAA TTTGCTCCAA

5501 GCAGCAGTGC GGGACAAGGT CAAAACAACA ATCAAAGCCC CAGTATCAGT

5551 GTGTCCATTA CCTACGGCGA ACAGAAAAGT CGTAACGAGC AAAAAAGACA

5601 TTACACCGAA GCGGCAGCAA GTCAAATTAT CGGCAAAGGG CAAACCACAC

5651 TTGCGGCAAC AGGAAGTGGG GAGCAGTCCA ATATCAATAT TACAGGTTCC

5701 GATGTCATCG GCCATGCAGG TACTGCCCTC ATTGCCGACA ACCATATCAG

5751 ACTCCAATCT GCCAAACAGG ACGGCAGCGA GCAAAGCAAA AACAAAAGCA

5801 GTGGTTGGAA TGCAGGCGTA GCCGTCAAAA TAGGCAACGG CATCAGGTTT

5851 GGAATTACCG CCGGAGGAAA TATCGGTAAA GGTAAAGAGC AAGGGGGAAG

5901 TACTACCCAC CGCCACACCC ATGTCGGCAG CACAACCGGC AAAACTACCA

5951 TCCGAAGCGG CGGGGATACC ACCCTCAAAG GTGTGCAGCT CATCGGCAAA

6001 GGCATACAGG CAGATACGCG CAACCTGCAT ATAGAAAGTG TTCAAGATAC

6051 TGAAACCTAT CAGAGCAAAC AGCAAAACGG CAATGTCCAA GTTACTGTCG

6101 GTTACGGATT CAGTGCAAGC GGCAGTTACC GCCAAAGCAA AGTCAAAGCA

6151 GACCATGCCT CCGTAACCGG GCAAAGCGGT ATTTATGCCG GAGAAGACGG

6201 CTATCAAATC AAAGTCAGAG ACAACACAGA CCTCAAGGGC GGTATCATCA

6251 CGTCTAGCCA AAGCGCAGAA GATAAGGGCA AAAACCTTTT TCAGACGGCC

6301 ACCCTTACTG CCAGCGACAT TCAAAACCAC AGCCGCTACG AAGGCAGAAG

6351 CTTCGGCATA GGCGGCAGTT TCGACCTGAA CGGCGGCTGG GACGGCACGG

6401 TTACCGACAA ACAAGGCAGG CCTACCGACA GGATAAGCCC GGCAGCCGGC

6451 TACGGCAGCG ACGGAGACAG CAAAAACAGC ACCACCCGCA GCGGCGTCAA

6501 CACCCACAAC ATACACATCA CCGACGAAGC GGGACAACTT GCCCGAACAG

6551 GCAGGACTGC AAAAGAAACC GAAGCGCGTA TCTACACCGG CATCGACACC

6601 GAAACTGCGG ATCAACACTC AGGCCATCTG AAAAACAGCT TCGACAAAGA

6651 CGCGGTCGCC AAAGAGATCA ACCTGCAAAG GGAAGTAACG AAGGAGTTCG

6701 GCAGAAACGC CGCCCAAGCC GTAGCGGCCG TTGCCGACAA ACTCGGCAAT

6751 ACCCAAAGTT ACGAACGGTA TCAGGAAGCC CGAACCCTGC TGGAGGCCGA

6801 ACTGCAAAAC ACGGACAGCG AAGCCGAAAA AGCCGCCTTC CGCGCATCCC

6851 TCGGCCAAGT AAACGCCTAT CTTGCCGAAA ACCAAAGCCG CTACGACACC

6901 TGGAAAGAAG GCGGCATAGG CAGGAGCATA CTGCACGGGG CGGCAGGCGG

6951 ACTGACGACC GGCAGCCTCG GCGGCATACT GGCCGGCGGC GGCACTTCCC

7001 TTGCCGCACC GTATTTGGAC AAAGCGGCGG AAAACCTCGG TCCGGCGGGC

7051 AAAGCGGCGG TCAACGCACT GGGCGGTGCG GCCATCGGCT ATGCAACTGG

7101 TGGTAGTGGT GGTGCTGTGG TGGGTGCGAA TGTAGATTGG AACAATAGGC

7151 AGCTGCATCC GAAAGAAATG GCGTTGGCCG ACAAATATGC CGAAGCCCTC

7201 AAGCGCGAAG TTGAAAAACG CGAAGGCAGA AAAATCAGCA GCCAAGAAGC

7251 GGCAATGAGA ATCCGCAGGC AGATACTGCG TTGGGTGGAC AAAGGTTCCC

7301 AAGACGGCTA TACCGACCAA AGCGTCATAT CCCTTATCGG AATGAAAGGC

7351 GAAGACAAAG CCTTGGGTTA TACTTGGGAC TACCGCGACT ACGGCGCAAG

-continued

7401 AAATCCGCAA ACCTACAACG ATCCGAAGCT GTTTGAGGAA TACCGCCGAC

7451 AGGACAAACC CGAATACCGC AACCTGACCT GGCTGCACAG CGGGACGAAA

7501 GACACCAAAA TCAGGCAGGG AGAGCGGAAA AACGAAGAGT TTGCACTGAA

7551 CGTTGCCGAA GGACTGACGA GCCTTGTCAA CCCCAATCCG AGGATAAAAG

7601 TCCCGATTCT TGCAGGCATC CGCAACCTGA AAAACATCAA GCCGACAGTT

7651 ACCGGCAGCG ATCCCTTATT GGCGGGTGCG GGGAATATCC GTATCCCTGC

7701 AAACGGCAAT GTTGCGAAGG GGGACAGGAT TCCGGATACG GCATTGGCTA

7751 GCAAGGGAAT CAAACATAAA GATCGTAAAG ATCAACTGGA GAAAAAATAA

This corresponds to the amino acid sequence <SEQ ID 1670; ORF 564>:

m564.pep

1 MNRTLYKVVF NKHRNCMIAV AENAKREGKN TADTQAVGIL PNDIAGFAGF

51 IHSISVISFS LSLLLGSALI LTSSSATAQG IVADKSAPAQ QQPTILQTGN

101 GIPQVNIQTP TSAGVSVNQY AQFDVGNRGA ILNNSRSNTQ TQLGGWIQGN

151 PWLARGEARV VVNQINSSHS SQLNGYIEVG GRRAEVVIAN PAGIAVNGGG

201 FINASRATLT TAQPQYQAGD LSGFKIRQGN VVIAGHGLDA RDTDYTRILS

251 YHSKIDAPVW GQDVRVVAGQ NDVAATGDAH SPILNNAAAN TSNNTANNGT

301 HIPLFAIDTG KLGGMYANKI TLISTVEQAG IRNQGQWFAS AGNVAVNAEG

351 KLVNTGMIAA TGENHAVSLH ARNVHNSGTV ASQDDANIHS QTLDNSGTVL

401 SSGRLTVRNL GRLKNQNNGT IQAARLDMST GGLDNTGNIT QTGSQALDLV

451 SAGKFDNSGK IGVSDVPQTG LNPNPSVIPQ IPSTATGSGS STVSVSKPGS

501 NNPVSPTAPA KNYAVGRIQT TGAFDNAGSI NAGGQIDIAA QNGLGNSGSL

551 NAAKLRVSGD SFNNTVKGKL QAHDLAVNTQ TAKNSGHLLT QTGKIDNREL

601 HNAGEIAANN LTLIHSGRLS NDKKGNIRAA HLQLDTAGLH NAGNILADSG

651 TVTTKNNLRN TGKVSVARLN TEGQTLDNTR GRIEAETVNI QSQQLTNQSG

701 HITATEQLTI NSRNVDNQNG KLLSANQAQL AVSDGLYNQH GEIATNRQLS

751 IHDKNQNTLA LNNADGTIQS AGNVSLQAKS LANNGTLTAG NKLDIALTDD

801 FVVERDLTAG KQLNLSIKGR LKNTHTLQAG HTLKLNAGNI DNQVTGKIIG

851 GEQTDITSEQ HVDNRGLINS DGLTHIGAGQ TLTNTGTGKI YGNHIALDAQ

901 ILLNREETTE GSTKAGAIAA RKRLDIGAKE IHNQEGALLS SEGIFAVGNR

951 LDEQHHAAGM ADTFVNGSAG LEVQGDALMS VRNMQNINNH FKTETYLAKA

1001 EKQVRDYTVL GQNTYYQAGK DGLFDNSQGQ KDQTTATFHL KNGSRIEANQ

1051 WHVRDYHIET YKERIIENRP AHITVGGDLT ASGQNWLNKD SRIVVGGRII

1101 TDDLNQKEIT NQSTTGKGRT DAVGTQWDSV TKKGWYSGRK RQRRTERNHT

1151 PYHDTQLFTH DFDTPVSVIQ QNAASPSFQP AASAIKLIDG VSTAAVNGQR

1201 IHTGNVVSLN NATVTLPNSS LYTTHPDNKG WLVETDPQFA DYRRWLGSDY

1251 MLQQLQLDTN HLHKRLGDGY YEQKLVNEQI HQLTGYRRLD GYRSDEEQFK

1301 ALMDNGLTAA KTFGLTPGIA LSAEQVARLT SDIVWMENQT VTLSDGSTQT

-continued

```
1351 VLVPKVYALA RKGDLNTSGG LISAEQVLLK LQNGNLTNSG TIAGRQAVLI

1401 QARNINSNGN IQADQIGLKA EKSINIDGGQ VQAGRLLTAQ AQNINLNGTT

1451 QTSGNERNGN TAIDRMAGIN VVGSHTEQVD NRTSDGILSL HASNDINLNA

1501 ATVSNQVKDG TTQITAGNNL NLGTIRTEHR EAYGTLDDEN HRHVRQSTEV

1551 GSSIRTQNGA LLRAGNDLKI RQGELEAEEG KTVLAAGRDV TISEGRQITE

1601 LDTSVSGKSK GILSSTKTHD RYRFSHDEAV GSNIGGGKMI VAAGQDINVR

1651 GSNLISDKGI VLKAGHDIDI STAHNRYTGN EYHESKKSGV MGTGGLGFTI

1701 GNRKTTDDTD RTNIVHTGSI IGSLNGDTVT VAGNRYRQTG STVSSPEGRN

1751 TVTAKSIDVE FANNRYATDY AHTQEQKGLT VALNVPVVQA AQNFIQAAQN

1801 VGKSKNKRVN AMAAANAAWQ SYQATQQMQQ FAPSSSAGQG QNNNQSPSIS

1851 VSITYGEQKS RNEQKRHYTE AAASQIIGKG QTTLAATGSG EQSNINITGS

1901 DVIGHAGTAL IADNHIRLQS AKQDGSEQSK NKSSGWNAGV AVKIGNGIRF

1951 GITAGGNIGK GKEQGGSTTH RHTHVGSTTG KTTIRSGGDT TLKGVQLIGK

2001 GIQADTRNLH IESVQDTETY QSKQQNGNVQ VTVGYGFSAS GSYRQSKVKA

2051 DHASVTGQSG IYAGEDGYQI KVRDNTDLKG GIITSSQSAE DKGKNLFQTA

2101 TLTASDIQNH SRYEGRSFGI GGSFDLNGGW DGTVTDKQGR PTDRISPAAG

2151 YGSDGDSKNS TTRSGVNTHN IHITDEAGQL ARTGRTAKET EARIYTGIDT

2201 ETADQHSGHL KNSFDKDAVA KEINLQREVT KEFGRNAAQA VAAVADKLGN

2251 TQSYERYQEA RTLLEAELQN TDSEAEKAAF RASLGQVNAY LAENQSRYDT

2301 WKEGGIGRSI LHGAAGGLTT GSLGGILAGG GTSLAAPYLD KAAENLGPAG

2351 KAAVNALGGA AIGYATGGSG GAVVGANVDW NNRQLHPKEM ALADKYAEAL

2401 KREVEKREGR KISSQEAAMR IRRQILRWVD KGSQDGYTDQ SVISLIGMKG

2451 EDKALGYTWD YRDYGARNPQ TYNDPKLFEE YRRQDKPEYR NLTWLHSGTK

2501 DTKIRQGERK NEEFALNVAE GLTSLVNPNP RIKVPILAGI RNLKNIKPTV

2551 TGSDPLLAGA GNIRIPANGN VAKGDRIPDT ALASKGIKHK DRKDQLEKK*
```

Computer analysis of this amino acid sequence gave the following results:

Homology with fha

| m564/fha | | | | |
|---|---|---|---|---|
| ID | FHAB_BORPE | STANDARD; | PRT; | 3591 AR. |
| AC | P12255; | | | |
| DT | 01-OCT-1989 (REL. 12, CREATED) | | | |

-continued

| | |
|---|---|
| DT | 01-FEB-1996 (REL. 33, LAST SEQUENCE UPDATE) |
| DT | 01-FEB-1996 (REL. 33, LAST ANNOTATION UPDATE) |
| DE | FILAMENTOUS HEMAGGLUTININ . . . |

SCORES Initl: 190 Initn: 524 Opt: 594

Smith-Waterman score: 866; 21.7% identity in 2427 aa overlap

```
                      10        20        30        40        50        60
m564.pep      MNRTLYKVVFNKHRNCMIAVAENAKREGKNTADTQAVGILPNDIAGFAGFIHSISVISFS
              || :||::||:: |: :: |:|:    | ||   :: |   :  :|  :   |::  :::
fhab_borpe    MNTNLYRLVFSHVRGMLVPVSEHCTV-G-NTFCGRTRG---QARSGARATSLSVAPNALA
                      10        20          30           40        50

                      70        80        90       100       110       119
m564.pep      LSLLLG-SALILTSSSATAQGIVADKSAPAQQQPTILQTGNGIPQVNIQTPTSAGVSVNQ
               :|:|: ::| |::    |||:|     | | |  :|| || :| |||  |:|:||| |:
fhab_borpe    WALMLACTGLPLVTH---AQGLV-----P-QGQTQVLQGGNKVPVVNIADPNSGGVSHNK
                 60        70                   80        90       100
```

-continued

```
               120       130       140       150       160       170      179
m564.pep       YAQFDVGNRGAILNNSRSNTQTQLGGWIQGNPWLARGEARVVVNQINSSHSSQLNGYIEV
               : ||:|:|  |:::||: ::  :::|| :   ||  |:| :|  ::: :::::   |:| | :||
fhab_borpe     FQQFNVANPGVVFNNGLTDGVSRIGGALTKNPNLTR-QASAILAEVTDTSPSRLAGTLEV
                 110       120       130       140       150       160

               180       190       200       210       220       230      239
m564.pep       GGRRAEVVIANPAGIAVNGGGFINASRATLTTAQPQYQAGDLSGFKIRQGNVVIAGHGLD
                |: |:::||||  ||:|||  : :|||  ||||::|: ::| : |: ::||:|:|    |::
fhab_borpe     YGKGADLIIANPNGISVNGLSTLNASNLTLTTGRPSVNGGRI-GLDVQQGTVTIERGGVN
                 170       180       190       200       210       220

               240       250       260       270       280       290
m564.pep       ARDTDYTRILSYHSKIDAPV---WGQ---DVRVVAGQNDVAATGDAHSPILNNAAANTSN
                |    |  :::   |::: |     |:    |: |||| |    :    :||    ||:: :
fhab_borpe     ATGLGYFDVVARLVKLQGAVSSKQGKPLADIAVVAGANRYDHATRRATPI----AAGARG
                 230       240       250       260       270             280

                 300       310       320       330       340       350
m564.pep       NTANNGTHIPLFAIDTGKLGGMYANKITLISTVEQAGIRNQGQWFASAGNVAVNAEGKLV
                :|:        :|||     |:||:::|||:|:     |:|:  |: ::|  : ::|:::|:::
fhab_borpe     AAAGA------YAIDGTAAGAMYGKHITLVSSDSGLGVRQLGS-LSSPSAITVSSQGEIA
                         290       300       310       320       330

                 360       370       380       390       400       410
m564.pep       NTGMIAATGENHAVSLHARNVHNSGTVASQDDANIHSQTLDNSGTVLSSGRLTVRNLGRL
                 :   || :     :||:: :|  ::| :||     |       :: ::|:|   :    :: ::| |
fhab_borpe     ---LGDATVQRGPLSLKGAGVVSAGKLASGGGAV----NVAGGGAVKIA---SASSVGNL
                    340       350       360            370            380

                 420       430       440       450       460       470
m564.pep       KNQNNGTIQAARLDMSTGGLDNTGNITQTGSQALDLVSAGKFDNSGKIGVSDVPQTGLNP
                 |::|  :||: |: :          |::   :| ||::| :|:: :   :   : : :     |:
fhab_borpe     AVQGGGKVQATLLNAG-------GTLLVSGRQAVQLGAASSRQALSVNAGGALKADKLSA
                 390                  400       410       420       430

                   480       490       500       510       520       530
m564.pep       NPSV-IPQIPSTATGSGSSTVSVSKPGSNNPVSPTAPAKNYAVGRIQTTGAFD-NAGSIN
               :   |  :      ::|  ||:||::    :  |:           :|   |:||::: |      : ||:
fhab_borpe     TRRVDVDGKQAVALGSASSNALSVRAGGA-----LKAGKLSATGRLDVDGKQAVTLGSVA
                440       450       460            470       480       490

                   540       550       55     560               570      579
m564.pep       AGGQIDIAAQNGLGNSGSLNAAKLRVSG------DSFNNT------VKGKLQAHDLAVNT
               : |  ::::|  ::|   :   :::|:|:|  |            |: :::         :  |  |  |::|   :
fhab_borpe     SDGALSVSAGGNLRANELVSSAQLEVRGQREVALDDASSARGMTVVAAGALAARNLQSKG
                       500       510       520       530       540       550

               580       590       600       610       620       630
m564.pep       QTAKNSGHLLTQTGKIDNRELH--NAGEIAANNLTLIHSGRLSNDKKGNIRAAHLQLDTA
                 :  ::|:  :: ::   ::  ||:   :  |::   ::|:   ::: :|:: :  ||   |:  :  |:
fhab_borpe     AIGVQGGEAVSVANANSDAELRVRGRGQVDLHDLSAARGADISGEGRVNIGRARSDSDVK
                       560       570       580       590       600       610

               640       650       660       670       680       690
m564.pep       GLHNAGNILADSGTVTTKNNLRNTGKVSVARLNTEGQTLDNTRGRIEAETVNIQSQQLTN
                 :     |  :    ||  |:      :::    |:||:   : ::|  :   :    |        :||: :  |
fhab_borpe     -VSAHGALSIDSMTALGAIGVQAGGSVSAKDMRSRGAVTVSGGG-----AVNLGDVQ---
                       620       630       640       650            660

               700       710       720       730       740       750
m564.pep       QSGHITATEQLTINSRNVDNQNGKLLSANQAQLAVSDGLYNQHGEIATNRQLSIHDKNQN
               ::|::  ||     ::: |:|               |   |:||::  |     |  |  :  :     ::::  ::
fhab_borpe     SDGQVRATSAGAMTVRDV---------AAAADLALQAGDALQAGFLKSAGAMTVNGRDAV
                     670       680                 690       700       710

               760       770       780       790       800       810
m564.pep       TLALNNADGTIQSAGNVSLQAKSLANNGTLTAGNKLDIALTDDFVVERDLTAGKQL-NLS
                |        ||:  :::|::  ::: :  |   |:|:|  ::|  ::   :     :|   :|     |:|  |:|
fhab_borpe     RL-----DGA-HAGGQLRVSSDGQAALGSLAAKGELTVSAARAATVA-EL---KSLDNIS
                         720       730       740       750             760

                 820       830       840       850       860       870
m564.pep       IKGRLK-NTHTLQAGHTLKLNA-GNIDNQVTGKIIGGEQTDITSEQHVDNRGLINSDGLT
               :  |   :  ::::::::   :  ::|  |  :|     :||:    :   ::   |     |      :  |  :::|:|
fhab_borpe     VTGGERVSVQSVNSASRVAISAHGALD---VGKV--SAKSGIGLE----GWGAVGADSL-
                 770       780       790                 800             810

                 880       890       900       910       920       930
m564.pep       HIGAGQTLTNTGTGKIYGNHIALDAQILLNREETTEGSTKAGAIAARKRLDI-GAKEIHN
                 |:   ::: :|      :    ::         |:|  |:        :||::    ||: |     :|: |:: :
fhab_borpe     --GSDGAISVSGRDAVRVDQARSLADISLG----AEGGATLGAVEAAGSIDVRGGSTV--
                     820       830       840            850       860

                 940       950       960       970       980       990
m564.pep       QEGALLSSEGIFAVGNRLDEQHHAAGMADTFVNGSAGLEVQGDALMSVRNMQNINNHFKT
                 ::|  ::: :  :  |:   |    :  :|: :   ::  |:| :::    |::: |:    :::    :
fhab_borpe     AANSLHANRDVRVSGK--DAVRVTAATSGGGLHVSSGRQLDLGAVQA-RGALALDGGAGV
                 870       880       890       900       910       920

                 1000        1010       1020       1030       1040       1050
m564.pep       ETYLAKAEK--QVRDYTVLGQNTYYQAGKDGLFDNSQGQKDQTTATFHLKNGSRIEANQ-
                   |||       :|:       |   :|     :|     :         :|    |    :|  :      |: ::|::
fhab_borpe     ALQSAKASGTLHVQGGEHLDLGTLAAVGAVDV----NGTGDVRVAKLVSDAGADLQAGRS
                   930       940       950                 960       970
```

-continued

```
                      1060      1060      1080      1090      1100
m564.pep      --WHVRDYHIETYKERIIENRPAHITVGGDLTASGQNWLNKDSRIVVGGRIITDDLNQKE
                  : |   :   :   : : : :   | | |:: : |:  :  |:|:  ::   :|
fhab_borpe    MTLGIVDTTGDLQARAQQKLELGSVKSDGGLQAAAGGALSLAAAEVAGALELS---GQGV
             980       990      1000      1010      1020      1030

            1110      1120      1130        1140      1150      1160
m564.pep      ITNQSTTGKGRTDAVGTQWDSVTKKGWY--SGRKRQRRTERNHTPYHDTQLFTHDFDTPV
               :::::::::| |::|:   :: | |    :: :| ||: |            :|| ||
fhab_borpe    TVDRASASRARIDSTGSVGIGALKAGAVEAASPRRARRALR------------QDFFTPG
               1040      1050      1060      1070                  1080

                 1170      1180      1190      1200      1210      1220
m564.pep      SVI---QQNAASPSFQPAASAIKLIDGVSTAAVNGQRIHTGNVVSLNNATVTLPNSSLYT
              ||:   | |::    :|  :::   | :  |  :|  :   | :  :|:|||:  :|
fhab_borpe    SVVVRAQGNVTVGRGDPHQGVLAQGDIIMDA--KGGTLLLRNDALTENGTVTISADSAVL
                 1090      1100      1110        1120      1130      1140

                 1230       1240      1250      1260      1270      1280
m564.pep      THPDNKGWLVETD-PQFADYRRWLGSDYMLQQLQLDTNHLHKRLGDGYYEQKLVNEQIHQ
               |   :: : ::     :|  :   |  : ::| |  |   : ::|:  :: : ::||
fhab_borpe    EHSTIESKISQSVLAAKGDKGKPAVSVKVAKKLFL--NGTLRAVNDN--NETMSGRQIDV
                   1150      1160      1170        1180        1190

                  1290      1300      1310       1320      1330      1340
m564.pep      LTGYRRLDGYRSDEEQFKALMDNGLTAAKTFGLTPG-IALSAEQVARLTSDIVWMENQTV
              : |  ::    :|    :|  |:::::  ::    | |:: | :::  :: |   :|:
fhab_borpe    VDGRPQI----TDAVTGEARKDESVVSDAALVADGGPIVVEAGELVSHAGGIGNGRNK--
             1200          1210      1220      1230      1240      1250

                   1350      1360      1370      1380      1390      1400
m564.pep      TLSDGSTQTVLVPKVYALARKGDLNTSGGLISAEQVLLKLQNGNLTNSGTIAGRQAVLIQ
                 :|:: || :         |:| ::| : :::| :|:: :| |||   :::  :  |:
fhab_borpe    --ENGASVTVRTT--------GNLVNKGYISAGKQGVLEV-GGALTNEFLVGSDGTQRIE
                     1260              1270      1280       1290      1300

                   1410             1420      1430      1440          1450
m564.pep      ARNINSNGNIQ-------ADQIGLKAEKSINIDGGQVQAGRLLTAQ----AQNINLNGTT
              |: |:: |::|       |  : :|| ::|  || ::  |::  |     : ::: :: :
fhab_borpe    AQRIENRGTFQSQAPAGTAGALVVKAAEAIVHDGVMATKGEMQIAGKGGGSPTVTAGAKA
                    1310      1320      1330      1340      1350      1360

                   1460       1470        1480       1490      1500
m564.pep      QTSGNERNGNTAI-DRMAGINVV-GSHTEQVDNRTSD-GILSLHASNDINLNAATVSNQV
               ||:|: : ::|  |  :::::  |:    | :| :: | :|::::  :: :| ::: ||
fhab_borpe    TTSANKLSVDVASWDNAGSLDIKKGGAQVTVAGRYAEHGEVSIQGDYTVSADAIALAAQV
                    1370      1380      1390      1400      1410      1420

               1510      1520          1530      1540               1550
m564.pep      --KDGTTQITAGNNLNLGT-IRTE---HREAYGTLDDENHRHVRQST---------EVGS
                : |::::|: ::  ::: ||     : :| | ::: :: :||:::         |:|:
fhab_borpe    TQRGGAANLTSRHDTRFSNKIRLMGPLQVNAGGPVSNTGNLKVREGVTVTAASFDNETGA
                    1430      1440      1450      1460      1470      1480

                  1560      1570      1580      1590         1600
m564.pep      SIRTQNGALLRAGNDLKIRQGELEAEEGKTVLAAGRDV--TISEGRQITELDTS---VSG
               : :::::|  :|   :   |:::::|: |::||: :   |:: |::||  : :     |
fhab_borpe    EVMAKSATLTTSGAARN--AGKMQVKEAATIVAASVSNPGTFTAGKDITVTSRGGFDNEG
                    1490        1500      1510      1520      1530

                1610      1620         1630       1640      1650      1660
m564.pep      K---SKGILSSTKTHDRYRF---SHDEAV-GSNIGGGKMIVAAGQDINVRGSNLISDKGI
              |   :| |: :|:  :  |    :|| :| :|: : ::  : ||:|::|::: :  |::
fhab_borpe    KMESNKDIVIKTEQFSNGRVLDAKHDLTVTASGQADNRGSLKAGHDFTVQAQRI--DNSG
            1540      1550      1560      1570      1580      1590

                    1670     16    1680      1690      1700      1710
m564.pep      VLKAGHDIDISTAHNRYTG-----NEYHESKKSGVMGTGGLGFTIGNRKTTDDTDRTNIV
              :: ||||  ::: | | |      :: |  ::: : :|| :     |  : | :| ||
fhab_borpe    TMAAGHDATLKAPHLRNTGQVVAGHDIHIINSAKLENTGRV--DARNDIALDVADFTN--
              1600      1610      1620      1630        1640      1650

                 1720      1730  1   1740      1750      1760      1770
m564.pep      HTGSIIGSLNGDTVTVAGNRYRQT----GSTVSSPEGRNTVTAKSIDVEFANNRYATDYA
               |||: :  :: |:|:| :  |:        :   ||   | |||: :|: ::  ::  |
fhab_borpe    -TGSLYAEHDA-TLTLAQGTQRDLVVDQDHILPVAEGTLRVKAKSLTTEIETGNPGSLIA
                   1660      1670       1680      1690      1700      1710

                   1780      1790      1800      1810       1820      1830
m564.pep      HTQEQKGLTVALNVPVVQAAQNFIQAAQNVGKSKNKRVNAMAAANAA-WQSYQATQQMQQ
              ::||        |:   ||    | :::::  | : : |:   |||  | : : | : |:
fhab_borpe    EVQE--------NIDNKQA----IVVGKDLTLS-SAHGNVANEANALLWAAGELTVKAQN
                            1720          1730       1740      1750

                    1840      1850      1860      1870      1880      1890
m564.pep      FAPSSSAGQGQNNNQSPSISVSITYGEQKSRNEQKRHYTEAAASQIIGKGQTTLAATGSG
              :: : :|    ::|   : :|::     : |  :  |     | :|    ::|   :|
fhab_borpe    ITNKRAALIEAGGNARLTAAVALINKLGRIRAGEDMHLD---APRI----ENTAKLSGEV
             1760       1770      1780      1790         1800          1810

                    1900      1910      1920      1930      1940      1950
m564.pep      EQSNINITGSDVIGHAGTALIADNHIRLQSAKQDGSEQSKNKSSGWNAGVAVKIGNGIRF
              :::::: :|:   |: :    ::  :|  ::|: |:      :: | :|  :   : |:
fhab_borpe    QRKGVQDVGGGEHGRWSGIGYVNYWLRAGNGKKAGT-----IAAPWYGGDLTAEQSLIEV
                    1820      1830      1840           1850      1860
```

-continued

```
                  1960       1970       1980       1990       2000       2010
m564.pep     GITAGGNIGKGKEQGGSTTHRHTHVGSTTGKTTIRSGGDTTLKGVQLIGKGIQADTRNLH
             |     |  |   |::      |||        :: :|::||    :  |        ::|:|::
fhab_borpe   GKDLYLNAGARKDE-----HRHL-----LNEGVIQAGGHGHIGG--------DVDNRSV-
              1870             1880              1890                1900

                  2020       2030       2040       2050            2060
m564.pep     IESVQDTETYQSKQQNGNVQVTVGYGFSASGSYRQSKVKA-----DHASVTGQSGIYAGE
             :::|:  |  :::     : :  :      |:|  :      ||   :        |:         |:|
fhab_borpe   VRTVSAMEYFKTPLPVSLTALDNRAGLSPATWNFQSTYELLDYLLDQNRYEYIWGLYPTY
             1910       1920       1930       1940       1950       1960

             2070       2080       2090       2100       2110           2120
m564.pep     DGYQIKVRDNTDLKGGIITSSQSAEDKGKNLFQTATLTASDIQNHS--RYEGRSFGIGGS
               :::::  |  ||  |       : :|      |              |:::|:      |||:: :|
fhab_borpe   TEWSVNTLKNLDL-GYQAKPAPTAPPMPKA-------PELDLRGHTLESAEGRKI-FGEY
             1970       1980       1990                   2000       2010

                2130             2140       2150       2160       2170
m564.pep     FDLNGGWDGT-----VTDKQGRPTDRISPAAGYGSDGDSKNSTTRSGVNTHNIHITDEAG
               |:| :: :       :::   |:  |  |:      |         :: :  : :|::::: ::
fhab_borpe   KKLQGEYEKAKMAVQAVEAYGEATRRVHDQLG------QRYGKALGGMDAETKEVDGIIQ
            2020       2030       2040               2050       2060       2070

           2180       2190       2200       2210       2220       2230
m564.pep     QLARTGRTAKETEARIYTGIDTETADQHSGHLKNSFDKDAVAKEINLQREVTKEFGRNAA
             ::|     ||:    :|     |  ||:||  |: :  :  |:::|   ||    :          :||    ::: :
fhab_borpe   EFAADLRTVYAKQADQAT-IDAET-DKVAQRYKSQID--AVRLQAIQPGRVT--LAKALS
                  2080       2090       2100       2110       2120

           2240       2250       2260       2270       2280       2290
m564.pep     QAVAAVADKLGNTQSYERYQEARTLLE-AELQNTDSEAEKAAFRASLGQVNAYL------
               |::|      ||::|  ::|::: ::   :  ||:      :|      |    |:|      |: :
fhab_borpe   AALGADWRALGHSQLMQRWKDFKAGKRGAEIAFYPKEQTVLAAGAGLTLSNGAIHNGENA
              2130       2140       2150       2160       2170       2180

                 2300       2310       2320       2330       2340       2350
m564.pep     AENQSRYDTWKEGGIGRSILHGAAGGLTTGSLGGILAGGGTSLAAPYLDKAAENLGPAGK
             |:|::|  :    |  |:  :  :  :  |:   :|
fhab_borpe   AQNRGRPEGLKIGAHSATSVSGSFDALRDVGLEKRLDIDDALAAVLVNPHIFTRIGAAQT
              2190       2200       2210       2220       2230       2240
```

The following partial DNA sequence was identified in *N. gonorrhoeae* <SEQ ID 1671>:

g565.seq

```
  1 atggacagca cattgtctaa aacgtgttgc gtttcgtgca tattgttgag
 51 cgtaaccacc accattttcg cccgtcccag accggcggct tccaatactt
101 ccctgcgttt cgcatcgccg aacgacaccg gctcgcctgc acttctggct
151 acctgcacgc gtgcgatgtc caagtcgagc gcgaaatacg gaatatcctc
201 tttgggcgaa gacgcgtccg accgtctgcc cgcccctgcc gaagccgaca
251 atcagcacat gatcagactt gctcatcgct tccaccaaca tgctgtgcag
301 atcgagcgac ttcatgtccc agcttga
```

This corresponds to the amino acid sequence <SEQ ID 1672; ORF 565.ng>:

g565.pep

```
  1 MDSTLSKTCC VSCILLSVTT TIFARPRPAA SNTSLRFASP NDTGSPALLA
 51 TCTRAMSKSS AKYGISSLGE DASDRLPAPA EADNQHMIRL AHRFHQHAVQ
101 IERLHVPA*
```

The following partial DNA sequence was identified in *N. meningitidis* <SEQ ID 1673>:

m565.seq

```
  1 ATGGACAGCA CATTGTCTAA AACGTGTTGC GTTTCGTGCA TATTGTTGAG
 51 CGTAACCACC ACCATTTTCG CCCGTCCCAG ACCGGCGGCT TCCAATACTT
101 CCCTGCGTTT CGCATCGCCG AACGACACCG GTTCGCCCGC ACTTCTGGCA
151 ACCTGCACCC GCGCAATGTC CAAGTCGAGC GCGAAATACG GAATATCCTC
201 TTGGGCAAGG ACGCGTCCGA CCGTCTGCCC GCCCCTGCCG AAGCCGACAA
251 TCAGCACATG GTCGGACTTG CTCATGGTTT CTACCAGCAT ACTGTGCAGA
301 TCGAGCGACT TCATGTCCCA GCTTGACTTG ACCAAACGCC CGACCAGCGC
351 ATCGCTGCCG CCCAAGAGGA AGGGCGCGAT AATCATCGAC AGCAGAACCG
401 CCGCCGTCGC CGCCTGTTCC CATTCTGGCG AAACCATATC AAGCTGCCCG
451 GCAATGGCCA GCATCACGAA GCCGAACTCG CCGCCCTGCG CGAGATACAA
501 AGCCGTTTTG AGGCTGTCGC CGACCGAATG TTTCATTTTG AAGGCAATGG
551 CAAACACAAC CAGTGCCTTC AACACCAGCA GCATTGCCAA CAGCATCAAT
601 ACCTGCCGCC AGCCGCCGAT CAATGCCTGA
```

This corresponds to the amino acid sequence <SEQ ID 1674; ORF 565>:

m565.pep

```
  1 MDSTLSKTCC VSCILLSVTT TIFARPRPAA SNTSLRFASP NDTGSPALLA
 51 TCTRAMSKSS AKYGISSWAR TRPTVCPPLP KPTISTWSDL LMVSTSILCR
101 SSDFMSQLDL TKRPTSASLP PKRKGAIIID SRTAAVAACS HSGETISSCP
151 AMASITKPNS PPCARYKAVL RLSPTECFIL KAMANTTSAF NTSSIANSIN
201 TCRQPPINA*
```

Computer analysis of this amino acid sequence gave the following results:

Homology with a predicted ORF from *N. gonorrhoeae*
m565/g565 100.0% identity in 67 aa overlap

```
                    10        20        30        40        50        60
m565.pep    MDSTLSKTCCVSCILLSVTTTIFARPRPAASNTSLRFASPNDTGSPALLATCTRAMSKSS
            ||||||||||||||||||||||||||||||||||||||||||||||||||||||||||||
g565        MDSTLSKTCCVSCILLSVTTTIFARPRPAASNTSLRFASPNDTGSPALLATCTRAMSKSS
                    10        20        30        40        50        60
                    70        80        90       100       110       120
m565.pep    AKYGISSWARTRPTVCPPLPKPTISTWSDLLMVSTSILCRSSDFMSQLDLTKRPTSASLP
            |||||||
g565        AKYGISSLGEDASDRLPAPAEADNQHMIRLAHRFHQHAVQIERLHVPAX
```

The following partial DNA sequence was identified in *N. meningitidis* <SEQ ID 1675>:

a565.seq

```
  1 ATGGACAGCA CATTGTCTAA AACGTGTTGC GTTTCGTGCA TATTGTTGAG
 51 CGTAACCACC ACCATTTTCG CCCGTCCCAG ACCGGCGGCT TCCAATACTT
101 CCCTGCGTTT CGCATCGCCG AACGACACCG GTTCGCCCGC ACTTCTGGCA
151 ACCTGCACCC GCGCAATGTC CAAGTCGAGC GCGAAATACG GAATATCCTC
```

-continued

```
201 TTGGGCAAGG ACGCGTCCGA CCGTCTGCCC GCCCCTGCCG AAGCCGACAA

251 TCAGCACATG GTCGGACTTG CTCATGGTTT CTACCAGCAT ACTGTGCAGA

301 TCGAGCGACT TCATGTCCCA GCTTGACTTG ACCAAACGCC CGACCAGTGC

351 ATCGCTGCCG CCCAAGAGGA AGGGCGCGAT AATCATCGAC AGCAGAACCG

401 CCGCCGTCGC CGCCTGTTCC CATTCTAGCG AAACCATATC AAGCTGCCCG

451 GCAATGGCCA GCATCACGAA GCCGAACTCG CCGCCCTGCG CGAGATACAA

501 AGCCGTTTTG AGGCTGTCGC CGACCGAATG TTTCATTTTG AAGGCAATGG

551 CAAACACAAC CAGTGCCTTC AACACCAGCA GCATTGCCAA CAGCATCAAT

601 ACCTGCCGCC AGCCGCCGAT TAATGCCTGA
```

This corresponds to the amino acid sequence <SEQ ID 1676; ORF 565.a>:

a565.pep

```
  1 MDSTLSKTCC VSCILLSVTT TIFARPRPAA SNTSLRFASP NDTGSPALLA

 51 TCTRAMSKSS AKYGISSWAR TRPTVCPPLP KPTISTWSDL LMVSTSILCR

101 SSDFMSQLDL TKRPTSASLP PKRKGAIIID SRTAAVAACS HSSETISSCP

151 AMASITKPNS PPCARYKAVL RLSPTECFIL KAMANTTSAF NTSSIANSIN

201 TCRQPPINA*
```

m565/a565 99.5% identity in 209 aa overlap

```
                   10        20        30        40        50        60
m565.pep   MDSTLSKTCCVSCILLSVTTTIFARPRPAASNTSLRFASPNDTGSPALLATCTRAMSKSS
           ||||||||||||||||||||||||||||||||||||||||||||||||||||||||||||
a565       MDSTLSKTCCVSCILLSVTTTIFARPRPAASNTSLRFASPNDTGSPALLATCTRAMSKSS
                   10        20        30        40        50        60

                   70        80        90       100       110       120
m565.pep   AKYGISSWARTRPTVCPPLPKPTISTWSDLLMVSTSILCRSSDFMSQLDLTKRPTSASLP
           ||||||||||||||||||||||||||||||||||||||||||||||||||||||||||||
a565       AKYGISSWARTRPTVCPPLPKPTISTWSDLLMVSTSILCRSSDFMSQLDLTKRPTSASLP
                   70        80        90       100       110       120

                  130       140       150       160       170       180
m565.pep   PKRKGAIIIDSRTAAVAACSHSGETISSCPAMASITKPNSPPCARYKAVLRLSPTECFIL
           ||||||||||||||||||||||:|||||||||||||||||||||||||||||||||||||
a565       PKRKGAIIIDSRTAAVAACSHSSETISSCPAMASITKPNSPPCARYKAVLRLSPTECFIL
                  130       140       150       160       170       180

                  190       200       210
m565.pep   KAMANTTSAFNTSSIANSINTCRQPPINAX
           ||||||||||||||||||||||||||||||
a565       KAMANTTSAFNTSSIANSINTCRQPPINAX
                  190       200       210
```

The following partial DNA sequence was identified in *N. gonorrhoeae* <SEQ ID 1677>:

g566.seq..

```
  1 atgccgtctg aacaatatct tttcagacgg cattttgtat gggggttaac

 51 ggttgttcag cccgagtacg tcctgcatat cgtacaaacc cgttttgccg

101 tttacccaaa ctgcggcgcg gacggcaccg gcggcaaagg tcatgcggct

151 gccggctttg tgggtgattt ccacgcgttc gccgtcggtg gcgaagaggg
```

-continued

```
201 cggtgtggtc gccgactatg tcgcctgcgc ggacggtggc aaagccgatg

251 gtggaaggat cgcgcggacc agtgtggcct tcgcggccgt aaacggcgca

301 ttgtttgagg tcgcggccga gcgcgccggc gatgacttcg cccattcgta

351 a
```

This corresponds to the amino acid sequence <SEQ ID 1678; ORF 566.ng>:

```
g566.pep..

  1 MPSEQYLFRR HFVWGLTVVQ PEYVLHIVQT RFAVYPNCGA DGTGGKGHAA

 51 AGFVGDFHAF AVGGEEGGVV ADYVACADGG KADGGRIART SVAFAAVNGA

101 LFEVAAERAG DDFAHS*
```

The following partial DNA sequence was identified in *N. meningitidis* <SEQ ID 1679>:

```
m566.seq..

  1 ATGCCGTCTG AACAATATCT TTTCAGACGG CATTTTGTAT GGGGGTTAAC

 51 GGTTGTTCAG CCCGAGTACG TCCTGCATAT CGTACAAACC CGTTTTGCCG

101 TTGACCCAAA CTGCGGCGCG GACGGCACCG GCGGCAAAGG TCATGCGGCT

151 GCTGGCCTTG TGGGTGATTT CCACGCGCTC GCCGTCGGTG GCGAAGAGGG

201 CGGTGTGGTC GCCGACGATG TCGCCTGCGC GGACGGTGGC AAAGCCGATG

251 GTCGACGGAT CGCGCGGACC GGTGTGGCCT TCGCGGCCGT AAACGGCGCA

301 TTGTTTGAGG TCTCTGCCGA GCGCGCCGGC GATGACTTCG CCCATGCGTA

351 A
```

This corresponds to the amino acid sequence <SEQ ID 1680; ORF 566>:

```
m566.pep..

  1 MPSEQYLFRR HFVWGLTVVQ PEYVLHIVQT RFAVDPNCGA DGTGGKGHAA

 51 AGLVGDFHAL AVGGEEGGVV ADDVACADGG KADGRRIART GVAFAAVNGA

101 LFEVSAERAG DDFAHA*
```

Computer analysis of this amino acid sequence gave the following results:

Homology with a predicted ORF from *N. gonorrhoeae*
m566/g566 93.1% identity in 116 aa overlap

```
                    10        20        30        40        50        60
m566.pep    MPSEQYLFRRHFVWGLTVVQPEYVLHIVQTRFAVDPNCGADGTGGKGHAAAGLVGDFHAL
            |||||||||||||||||||||||||||||||||| ||||||||||||||||:||||||:
g566        MPSEQYLFRRHFVWGLTVVQPEYVLHIVQTRFAVYPNCGADGTGGKGHAAAGFVGDFHAF
                    10        20        30        40        50        60

                    70        80        90       100       110
m566.pep    AVGGEEGGVVADDVACADGGKADGRRIARTGVAFAAVNGALFEVSAERAGDDFAHAX
            ||||||||||| |||||||||| |||||:|||||||||||||:||||||||||:|
g566        AVGGEEGGVVADYVACADGGKADGGRIARTSVAFAAVNGALFEVAAERAGDDFAHSX
                    70        80        90       100       110
```

The following partial DNA sequence was identified in *N. meningitidis* <SEQ ID 1681>:

a566.seq

```
  1 ATGCCGTCTG AACAATATCT TTTCAGACGG CATTTTGTAT GGGGGTTAAC
 51 GGTTGTTCAG CCCGAGTACG TCCTGCATAT CGTACAAACC CGTTTTACCG
101 TTTACCCAAA CTGCGGCGCG GACGGCGCCG GCGGCAAAGG TCATGCGGCT
151 GCTTGCCTTG TGGGTGATTT CCACGCGCTC GCCGTCGGTG GCGAAGAGGG
201 CGGTGTGGTC GCCGACGATG TCGCCCGCGC GGACGGTGGC AAAGCCGATG
251 GTGGACGGAT CGCGCGGGCC GGTGTGGCCT TCGCGGCCGT AAACGGCGCA
301 TTGTTTGAGG TCTCTGCCGA GCGCGCCGGC GATGACTTCG CCCATGCGTA
351 A
```

This corresponds to the amino acid sequence <SEQ ID 1682; ORF 566.a>:

a566.pep

```
  1 MPSEQYLFRR HFVWGLTVVQ PEYVLHIVQT RFTVYPNCGA DGAGGKGHAA
 51 ACLVGDFHAL AVGGEEGGVV ADDVARADGG KADGGRIARA GVAFAAVNGA
101 LFEVSAERAG DDFAHA*
```

m566/a566 94.0% identity in 116 aa overlap

```
                    10        20        30        40        50        60
m566.pep    MPSEQYLFRRHFVWGLTVVQPEYVLHIVQTRFAVDPNCGADGTGGKGHAAAGLVGDFHAL
            ||||||||||||||||||||||||||||||||:| |||||||:|||||||| |||||||
a566        MPSEQYLFRRHFVWGLTVVQPEYVLHIVQTRFTVYPNCGADGAGGKGHAAACLVGDFHAL
                    10        20        30        40        50        60

                    70        80        90       100       110
m566.pep    AVGGEEGGVVADDVACADGGKADGRRIARTGVAFAAVNGALFEVSAERAGDDFAHAX
            ||||||||||||||| |||||||| ||||:||||||||||||||||||||||||||
a566        AVGGEEGGVVADDVARADGGKADGGRIARAGVAFAAVNGALFEVSAERAGDDFAHAX
                    70        80        90       100       110
```

The following partial DNA sequence was identified in *N. gonorrhoeae* <SEQ ID 1683>:

g567.seq..

```
  1 atgcgacgac gggcagcggc atcgacaagg cgggtttgca gtccggcgtt
 51 tatcaggtct tattgggcga tgcggacgtg cagtcggcgg cggtacgcag
101 caaagagggc ggatacggcg tgttgggtgc gaacgcgcgc gcttgccggc
151 gcggaaatcg agctggtgca ggaaatcgcc cgggaagtgc gtttgaaaaa
201 cgcgctcaag gcagtggcgg aagattacga ctttatcctg atcgactgtc
251 cgccttcgct gacgctgttg acgcttaacg gcttggtggc ggcgggcggc
301 gtgattgtgc cgatgttgtg cgaatattac gcgctggaag ggatttccga
351 tttgattgcg accgtgcgca aaatccgtca ggcggtcaat cccgatttgg
401 acatcacggg catcgtgcgt acgatgtacg acagccgcag caggctggtt
451 gccgaagtca gcgaacagtt gcgcagccat ttcggggatt tgctttttga
```

-continued

```
501 aaccgccatc ccgcgcaata tccgccttgc ggaagcgccg agccacggta

551 tgccggtgat ggcttacgac gcgcaggcaa agggtgccaa ggcgtatctt

601 gccttggcgg acgaactggc ggcgagggtg tcggggaaat ag
```

This corresponds to the amino acid sequence <SEQ ID 1684; ORF 567.ng>:

g567.pep

```
  1 MRRRAAASTR RVCSPAFIRS YWAMRTCSRR RYAAKRADTA CWVRTRALAG

 51 AEIELVQEIA REVRLKNALK AVAEDYDFIL IDCPPSLTLL TLNGLVAAGG

101 VIVPMLCEYY ALEGISDLIA TVRKIRQAVN PDLDITGIVR TMYDSRSRLV

151 AEVSEQLRSH FGDLLFETAI PRNIRLAEAP SHGMPVMAYD AQAKGAKAYL

201 ALADELAARV SGK*
```

The following partial DNA sequence was identified in *N. meningitidis* <SEQ ID 1685>:

m567.seq..

```
  1 ATGAGTGCGA ACATCCTTGC CATCGCCAAT CAGAAGGGCG GTGTGGGCAA

 51 AACGACGACG ACGGTAAATT TGGCGGCTTC GCTGGCATCG CGCGGCAAAC

101 GCGTGCTGGT GGTCGATTTG GATCCGCAGG GCAATGCGAC GACGGGCAGC

151 GGCATCGACA AGGCGGGTTT GCAGTCCGGC GTTTATCAGG TCTTATTGGG

201 CGATGCGGAC GTGCAGTCGG CGGCGGTACG CAGCAAAGAG GGCGGATACG

251 CTGTGTTGGG TGCGAACCGC GCGCTGGCCG GCGCGGAAAT CGAACTGGTG

301 CAGGAAATCG CCCGGGAAGT GCGTTTGAAA AACGCGCTCA AGGCAGTGGA

351 AGAAGATTAC GACTTTATCC TGATCGACTG CCCGCCTTCG CTGACGCTGT

401 TGACGCTTAA CGGGCTGGTG GCGGCGGGCG GCGTGATTGT GCCGATGTTG

451 TGCGAATATT ACGCGCTGGA AGGGATTTCC GATTTGATTG CGACCGTGCG

501 CAAAATCCGT CAGGCGGTCA ATCCCGATTT GGACATCACG GGCATCGTGC

551 GCACGATGTA CGACAGCCGC AGCAGGCTGG TTGCCGAAGT CAGCGAACAG

601 TTGCGCAGCC ATTTCGGGGA TTTGCTTTTT GAAACCGTCA TCCCGCGCAA

651 TATCCGCCTT GCGGAAGCGC CGAGCCACGG TATGCCGGTG ATGGCTTACG

701 ACGCGCAGGC AAAGGGTACC AAGGCGTATC TTGCCTTGGC GGACGAGCTG

751 GCGGCGAGGG TGTCGGGGAA ATAG
```

This corresponds to the amino acid sequence <SEQ ID 1686; ORF 567>:

m567.pep..

```
  1 MSANILAIAN QKGGVGKTTT TVNLAASLAS RGKRVLVVDL DPQGNATTGS

 51 GIDKAGLQSG VYQVLLGDAD VQSAAVRSKE GGYAVLGANR ALAGAEIELV

101 QEIAREVRLK NALKAVEEDY DFILIDCPPS LTLLTLNGLV AAGGVIVPML
```

-continued

```
151 CEYYALEGIS DLIATVRKIR QAVNPDLDIT GIVRTMYDSR SRLVAEVSEQ

201 LRSHFGDLLF ETVIPRNIRL AEAPSHGMPV MAYDAQAKGT KAYLALADEL

251 AARVSGK*
```

Computer analysis of this amino acid sequence gave the following results:

Homology with a predicted ORF from *N. gonorrhoeae*
m567/g567 98.2% identity in 168 aa overlap

```
                60        70        80        90       100       110       119
m567.pep    GVYQVLLGDADVQSAAVRSKEGGYAVLGANRALAGAEIELVQEIAREVRLKNALKAVEED
                                              |||||||||||||||||||||||||||| ||
g567        AFIRSYWAMRTCSRRRYAAKRADTACWVRTRALAGAEIELVQEIAREVRLKNALKAVAED
                  20        30        40        50        60        70

               120       130       140       150       160       170       179
m567.pep    YDFILIDCPPSLTLLTLNGLVAAGGVIVPMLCEYYALEGISDLIATVRKIRQAVNPDLDI
            ||||||||||||||||||||||||||||||||||||||||||||||||||||||||||||
g567        YDFILIDCPPSLTLLTLNGLVAAGGVIVPMLCEYYALEGISDLIATVRKIRQAVNPDLDI
                  80        90       100       110       120       130

               180       190       200       210       220       230       239
m567.pep    TGIVRTMYDSRSRLVAEVSEQLRSHFGDLLFETVIPRNIRLAEAPSHGMPVMAYDAQAKG
            ||||||||||||||||||||||||||||||||:|||||||||||||||||||||||||||
a567        TGIVRTMYDSRSRLVAEVSEQLRSHFGDLLFETAIPRNIRLAEAPSHGMPVMAYDAQAKG
                 140       150       160       170       180       190

               240       250
m567.pep    TKAYLALADELAARVSGKX
            :||||||||||||||||||
g567        AKAYLALADELAARVSGKX
               200       210
```

The following partial DNA sequence was identified in *N. meningitidis* <SEQ ID 1687>:

a567.seq

```
  1 ATGAGTGCGA ACATCCTTGC CATCGCCAAT CAGAAGGGCG GTGTGGGCAA

 51 AACGACGACG ACGGTAAATT TGGCGGCTTC GCTGGCATCG CGCGGCAAAC

101 GCGTGCTGGT GGTCGATTTG GATCCGCAGG GCAATGCGAC GACGGGCAGC

151 GGCATCGACA AGGCGAGTTT GCAGTCCGGC GTTTATCAGG TCTTATTGGG

201 CGATGCGGAC GTGAAATCGG CGGCGGTACG CAGCAAAGAG GGCGGATACG

251 GCGTGTTGGG TGCGAACCGC GCGCTGGCCG GCGCGGAAAT CGAGCTGGTG

301 CAGGAAATCG CCCGGGAAGT GCGTTTGAAA AACGCGCTCA AGGCAGTGGC

351 GGAAGATTAC GACTTTATCC TGATCGACTG CCCGCCTTCG CTGACGCTGT

401 TGACGCTTAA CGGCTTGGTG GCGGCAGGCG GCGTGATTGT GCCGATGTTG

451 TGCGAATATT ACGCGCTGGA AGGGATTTCC GATTTGATTG CGACCGTGCG

501 CAAAATCCGT CAGGCGGTCA ATCCCGATTT GGATATCACG GGCATCGTGC

551 GTACGATGTA CGACAGCCGC AGCAGGCTAG TTGCCGAAGT CAGCGAACAG

601 TTGCGCAGCC ATTTCGGGGA TTTGCTGTTT GAAACCGTCA TCCCGCGCAA

651 TATCCGCCTT GCGGAAGCGC CGAGCCACGG TATGCCGGTG ATGGCTTATG

701 ATGCGCAGGC AAAGGGTGCC AAGGCGTATC TTGCCTTGGC GGACGAGCTG

751 ATGGCGAGGG TGTCGGGGAA ATAG
```

This corresponds to the amino acid sequence <SEQ ID 1688; ORF 567.a>:

a567.pep

```
  1 MSANILAIAN QKGGVGKTTT TVNLAASLAS RGKRVLVVDL DPQGNATTGS
 51 GIDKASLQSG VYQVLLGDAD VKSAAVRSKE GGYGVLGANR ALAGAEIELV
101 QEIAREVRLK NALKAVAEDY DFILIDCPPS LTLLTLNGLV AAGGVIVPML
151 CEYYALEGIS DLIATVRKIR QAVNPDLDIT GIVRTMYDSR SRLVAEVSEQ
201 LRSHFGDLLF ETVIPRNIRL AEAPSHGMPV MAYDAQAKGA KAYLALADEL
251 MARVSGK*
```

m567/a567 97.7% identity in 257 aa overlap

```
                   10        20        30        40        50        60
m567.pep   MSANILAIANQKGGVGKTTTTVNLAASLASRGKRVLVVDLDPQGNATTGSGIDKAGLQSG
           |||||||||||||||||||||||||||||||||||||||||||||||||||||||:||||
a567       MSANILAIANQKGGVGKTTTTVNLAASLASRGKRVLVVDLDPQGNATTGSGIDKASLQSG
                   10        20        30        40        50        60

                   70        80        90       100       110       120
m567.pep   VYQVLLGDADVQSAAVRSKEGGYAVLGANRALAGAEIELVQEIAREVRLKNALKAVEEDY
           ||||||||||:||||||||||||:|||||||||||||||||||||||||||||||| |||
a567       VYQVLLGDADKQSAAVRSKEGGYGVLGANRALAGAEIELVQEIAREVRLKNALKAVAEDY
                   70        80        90       100       110       120

                  130       140       150       160       170       180
m567.pep   DFILIDCPPSLTLLTLNGLVAAGGVIVPMLCEYYALEGISDLIATVRKIRQAVNPDLDIT
           ||||||||||||||||||||||||||||||||||||||||||||||||||||||||||||
a567       DFILIDCPPSLTLLTLNGLVAAGGVIVPMLCEYYALEGISDLIATVRKIRQAVNPDLDIT
                  130       140       150       160       170       180
                  190       200       210       220       230       240
m567.pep   GIVRTMYDSRSRLVAEVSEQLRSHFGDLLFETVIPRNIRLAEAPSHGMPVMAYDAQAKGT
           |||||||||||||||||||||||||||||||||||||||||||||||||||||||||||:
a567       GIVRTMYDSRSRLVAEVSEQLRSHFGDLLFETVIPRNIRLAEAPSHGMPVMAYDAQAKGA
                  190       200       210       220       230       240
                  250
m567.pep   KAYLALADELAARVSGKX
           |||||||||| |||||||
a567       KAYLALADELMARVSGKX
                  250
```

The following partial DNA sequence was identified in *N. gonorrhoeae* <SEQ ID 1689>:

g568.seq

```
  1 atgctcaggg tcagaccggt attatttgcc gtcaaggctt ccgcctcttc
 51 gataccttgc agaatctgcc gattaaagcg ttcgcggctg cccaatattt
101 tcaggcgcat attgttttcg tgcaggcggc gtacctgttt ttgcaaagcc
151 tgtaaaaaca gccccatcag gaacgaaact tcgtcttcgg ggcgacgcca
201 gttttcggtt gaaaaggcaa acacggtcag atattgcacg cccagtttgg
251 cgcaatgctt caccatattt tccaacgcgt ccaagccgcg tttgtgtccc
301 attatacgcg ggagaaaacg ttttttcgcc caacggccgt tgccgtccat
351 aattacggcg atgtgcctcg ggatggcggt gtgttccaaa atggtctgcg
401 tgctgctctt catatctgcc tttcgcggtt cggcgttcaa atgccgtctg
451 aacgccgcgc cgtga
```

This corresponds to the amino acid sequence <SEQ ID 1690; ORF 568.ng>:

g568.pep

```
  1 MLRVRPVLFA VKASASSIPC RICRLKRSRL PNIFRRILFS CRRRTCFCKA
 51 CKNSPIRNET SSSGRRQFSV EKANTVRYCT PSLAQCFTIF SNASKPRLCP
101 IIRGRKRFFA QRPLPSIITA MCLGMAVCSK MVCVLLFISA FRGSAFKCRL
151 NAAP*
```

The following partial DNA sequence was identified in *N. meningitidis* <SEQ ID 1691>:

m568.seq

```
  1 ATGCTCAGGG TCAGGCCGGT ATTGTTTGCC GTCAACGCTT CCGCCTCTTC
 51 GATGCCTTGC AGAATCTGCC GGTTGAAGCG TTCGCGGCTG CCCAATATCT
101 TCAGGCGCAT ATTGTTTTCG TGCAGGCGGC GTACCTGTTT TTGCAAAGCC
151 TGTAAAAACA GCCCCATCAG GAACGAAACT TCGTCTTCGG GGCGGCGCCA
201 GTTTTCGGTT GAAAAGGCAA ACACGGTCAG ATATTGCACA CCCAGTTTGG
251 CGCAATGCTT CACCATATTT TCCAATGCGT CCAAACCGCG TTTGTGTCCC
301 ATTATGCGCG GGAGGAAACG TTTTTTCGCC CAACGGCCGT TGCCGTCCAT
351 AATCACGGCG ATATGCTTGG GAATGGCGGT GTGTTCCAAA ACGGCCTGCG
401 TGCTGCTTTT CATGTCTGCC TTTCGCGGTT CGGCATTCAA ATGCCGTCTG
451 AACGCCGAAC CGTGCAGGTT AAATTGCCAT CAAATCTTCT TCTTTGGCAG
501 TCAGGAGTTT GTCGGCTTCG GTAATGTATT TGTCGGTCAG TTTTTGAACC
551 GCTTCTTCGC CGCGACGTGC CTCGTCTTCG GAAATTTCTT TGTCTTTGAG
601 GAGTTTTTTG ATGTGGTCGT TGGCATCGCG GCGCACGTTG CGGATAGAGA
651 CGCGGCCTTC TTCCGCTTCG CCGCGTACGA CTTTAATCAG GTCTTTGCGG
701 CGTTCCTCGG TCAGCATGGG CATCGGCACG CGGATCAGGT CGCCGACAGC
751 TGCCGGGTTC AGTCCCAAGT TTGA
```

This corresponds to the amino acid sequence <SEQ ID 1692; ORF 568>:

m568.pep..

```
  1 MLRVRPVLFA VNASASSMPC RICRLKRSRL PNIFRRILFS CRRRTCFCKA
 51 CKNSPIRNET SSSGRRQFSV EKANTVRYCT PSLAQCFTIF SNASKPRLCP
101 IMRGRKRFFA QRPLPSIITA ICLGMAVCSK TACVLLFMSA FRGSAFKCRL
151 NAEPCRLNCH QIFFFGSQEF VGFGNVFVGQ FLNRFFAATC LVFGNFFVFE
201 EFFDVVVGIA AHVADRDAAF FRFAAYDFNQ VFAAFLGQHG HRHADQVADS
251 CRVQSQV*
```

Computer analysis of this amino acid sequence gave the following results:

Homology with a predicted ORF from *N. gonorrhoeae* m568/g568 94.8% identity in 154 aa overlap

```
                  10         20         30         40         50         60
m568.pep  MLRVRPVLFAVNASASSMPCRICRLKRSRLPNIFRRILFSCRRRTCFCKACKNSPIRNET
          |||||||||||:|||||:||||||||||||||||||||||||||||||||||||||||||
g568      MLRVRPVLFAVKASASSIPCRICRLKRSRLPNIFRRILFSCRRRTCFCKACKNSPIRNET
                  10         20         30         40         50         60

70         80         90        100        110        120
m568.pep  SSSGRRQFSVEKANTVRYCTPSLAQCFTIFSNASKPRLCPIMRGRKRFFAQRPLPSIITA
          ||||||||||||||||||||||||||||||||||||||||:|||||||||||||||||||
g568      SSSGRRQFSVEKANTVRYCTPSLAQCFTIFSNASKPRLCPIIRGRKRFFAQRPLPSIITA
                  70         80         90        100        110        120
                 130        140        150        160        170        180
m568.pep  ICLGMAVCSKTACVLLFMSAFRGSAFKCRLNAEPCRLNCHQIFFFGSQEFVGFGNVFVGQ
          :||||||||| :|||||:|||||||||||||| |
g568      MCLGMAVCSKMVCVLLFISAFRGSAFKCRLNAAPX
                 130        140        150
                 190        200        210        220        230        240
m568.pep  FLNRFFAATCLVFGNFFVFEEFFDVVVGIAAHVADRDAAFFRFAAYDFNQVFAAFLGQHG
```

The following partial DNA sequence was identified in *N. meningitidis* <SEQ ID 1693>:

a568.seq

```
  1 ATGCTCAGGG TCAGGCCGGT ATTGTTTGCC GTCAAGGCTT CCGCCTCTTC
 51 GATGCCCTTC AGGATTTGAC GGTTGAAGCG TTCGCGGCTG CCCAGTATTT
101 TCAGGCGCAT ATTGTTTTCG TGCAGGCGGC GTACCTGTTT TTGCAAAGCC
151 TGTAAAAACA GCCCCATCAG GAACGAAACT TCGTCTTCGG GGCGGCGCCA
201 GTTTTCGGTT GAAAAGGCAA ACACGGTCAG ATATTGCACA CCCAGTTTGG
251 CGCAATGCTT CACCATATTT TCCAATGCGT CCAAACCGCG TTTGTGTCCC
301 ATTATGCGCG GGAGGAAACG TTTTTTCGCC CAACGGCCGT TGCCGTCCAT
351 AATCACGGCG ATATGCTTGG GAATGGCGGT GTGTTCCAAA ACGGCCTGCG
401 TGCTGCTTTT CATGTCTGCC TTTCGCGGTT CGGCATTCAA ATGCCGTCTG
451 AACGCCGAAC CGTGCAGGTT AAATTGCCAT CAAATCTTCT TCTTTGGCAG
501 TCAGGAGTTT GTCGGCTTCG GTAATGTATT TGTCGGTCAG TTTTTGAACC
551 GCTTCTTCGC CGCGACGTGC CTCGTCTTCG GAAATTTCTT TGTCTTTGAG
601 GAGTTTTTTG ATGTGGTCGT TGGCATCGCG GCGCACGTTG CGGATGGAGA
651 CGCGGCCTTC TTCCGCTTCG CCGCGTACGA CTTTAATCAG GTCTTTGCGG
701 CGTTCCTCGG TCAGCATGGG CATCGGCACG CGGATCAGGT CGCCGACAGC
751 TGCCGGGTTC AGTCCCAAGT TTGA
```

This corresponds to the amino acid sequence <SEQ ID 1694; ORF 568.a>:

a568.pep

```
  1 MLRVRPVLFA VKASASSMPF RI*RLKRSRL PSIFRRILFS CRRRTCFCKA
 51 CKNSPIRNET SSSGRRQFSV EKANTVRYCT PSLAQCFTIF SNASKPRLCP
101 IMRGRKRFFA QRPLPSIITA ICLGMAVCSK TACVLLFMSA FRGSAFKCRL
151 NAEPCRLNCH QIFFFGSQEF VGFGNVFVGQ FLNRFFAATC LVFGNFFVFE
201 EFFDVVVGIA AHVADGDAAF FRFAAYDFNQ VFAAFLGQHG HRHADQVADS
251 CRVQSQV*
```

m568/a568 98.1% identity in 257 aa overlap

```
                  10        20        30        40        50        60
m568.pep  MLRVRPVLFAVNASASSMPCRICRLKRSRLPNIFRRILFSCRRRTCFCKACKNSPIRNET
          |||||||||||:||||||| || ||||||||:||||||||||||||||||||||||||||
a568      MLRVRPVLFAVKASASSMPFRIXRLKRSRLPSIFRRILFSCRRRTCFCKACKNSPIRNET
                  10        20        30        40        50        60

                  70        80        90       100       110       120
m568.pep  SSSGRRQFSVEKANTVRYCTPSLAQCFTIFSNASKPRLCPIMRGRKRFFAQRPLPSIITA
          ||||||||||||||||||||||||||||||||||||||||||||||||||||||||||||
a568      SSSGRRQFSVEKANTVRYCTPSLAQCFTIFSNASKPRLCPIMRGRKRFFAQRPLPSIITA
                  70        80        90       100       110       120

                 130       140       150       160       170       180
m568.pep  ICLGMAVCSKTACVLLFMSAFRGSAFKCRLNAEPCRLNCHQIFFFGSQEFVGFGNVFVGQ
          ||||||||||||||||||||||||||||||||||||||||||||||||||||||||||||
a568      ICLGMAVCSKTACVLLFMSAFRGSAFKCRLNAEPCRLNCHQIFFFGSQEFVGFGNVFVGQ
                 130       140       150       160       170       180

                 190       200       210       220       230       240
m568.pep  FLNRFFAATCLVFGNFFVFEEFFDVVVGIAAHVADRDAAFFRFAAYDFNQVFAAFLGQHG
          ||||||||||||||||||||||||||||||||||| ||||||||||||||||||||||||
a568      FLNRFFAATCLVFGNFFVFEEFFDVVVGIAAHVADGDAAFFRFAAYDFNQVFAAFLGQHG
                 190       200       210       220       230       240

                 250
m568.pep  HRHADQVADSCRVQSQVX
          |||||||||||||||||
a568      HRHADQVADSCRVQSQVX
                 250
```

The following partial DNA sequence was identified in *N. gonorrhoeae* <SEQ ID 1695>:

```
g569.seq..
  1 atgctgaaac aacgggtaat aaccgctatg tggctgctgc cgctgatgct
 51 gggcatgctg ttttacgcgc cgcaatggct gtgggctgca ttttgcgggc
101 tgattgccct gaccgccttg tgggagtatg cccgtatggc cggtttgtgc
151 aaaaccgaaa ccaaccatta cctcgccgca accttggttt tcggcgtagt
201 tgcctatgcg ggcggctgga tgctgcctaa tttggtttgg tatgttgttt
251 tggcattttg gctcgccgtt atgcctttgt ggttgagatt caaatggagg
301 ctcaacggcg gttggcaggt ttatgccgtc ggctggcttt tgctcatgcc
351 gttttggttc gcgctcgtat ccctggcgcc cgcatcccga tga
```

This corresponds to the amino acid sequence <SEQ ID 1696; ORF 569.ng>:

```
g569.pep
  1 MLKQRVITAM WLLPLMLGML FYAPQWLWAA FCGLIALTAL WEYARMAGLC
 51 KTETNHYLAA TLVFGVVAYA GGWMLPNLVW YVVLAFWLAV MPLWLRFKWR
101 LNGGWQVYAV GWLLLMPFWF ALVSLAPASR *
```

The following partial DNA sequence was identified in *N. meningitidis* <SEQ ID 1697>:

```
m569.seq..
  1 ATGCTGAAAC AACGGGTAAT AACCGCCATG TGGCTGCTGC CGCTGATGCT
 51 GGGCATGCTG TTTTACGCGC CGCAATGGTT GTGGGCTGCA TTTTGCGGAC
```

-continued

```
101 TGATTGCCCT GATTGCCTTG TGGGAATATG CCCGTATGGG CGGTTTGTGC

151 AAAATTAAAA CCAACCATTA CCTCGCCGCA ACCTTGGTTT TCGGCGTGGT

201 TGCCTATGCG GGCGGCTGGA TGCTGCCTAA TTTGGTTTGG TATGTTGTTT

251 TGGCATTTTG GCTCGCCGTT ATGCCTTTAT GGTTGAGATT CAAATGGAGG

301 CTCAACGGCG GTTGGCAGGT TTATGCCGTC GGCTGGCTTC TGGTCATGCC

351 GTTTTGGTTC GCGCTCGTAT CCCTGCGCCC GCATCCCGAT GATGCCCTGC

401 CGCTGCTCGC CGTGATGGGT TTGGTGTGGG TTGCCGATAT TTGCGCGTAT

451 TTCAGCGGCA AGGCGTTCGG CAAACACAAA ATCGCGCCGG CAATCAGCCC

501 CGGCAAAAGC TGGGAAGGTG CAATCGGCGG CGCGGTTTGC GTGGCAGTGT

551 ACATGACCGC CGTACGAAGT GCCGGCTGGC TGGCATTCGA TACAGGCTGG

601 TTCGATACCG TGTTAATCGG TTTGGTGCTG ACCGTTGTCA GCGTATGCGG

651 CGACCTTTTG GAAAGCTGGC TCAAGCGCGC GGCAGGCATC AAAGACAGCA

701 GCAAGCTGCT GCCCGGACAC GGCGGCGTGT TCGACCGTAC CGACAGCCTG

751 ATTGCCGTTA TCAGCGTCTA TGCAGCGATG ATGTCGGTTT TAAATTGA
```

This corresponds to the amino acid sequence <SEQ ID 1698; ORF 569>:

m569.pep..

```
  1 MLKQRVITAM WLLPLMLGML FYAPQWLWAA FCGLIALIAL WEYARMGGLC

 51 KIKTNHYLAA TLVFGVVAYA GGWMLPNLVW YVVLAFWLAV MPLWLRFKWR

101 LNGGWQVYAV GWLLVMPFWF ALVSLRPHPD DALPLLAVMG LVWVADICAY

151 FSGKAFGKHK IAPAISPGKS WEGAIGGAVC VAVYMTAVRS AGWLAFDTGW

201 FDTVLIGLVL TVVSVCGDLL ESWLKRAAGI KDSSKLLPGH GGVFDRTDSL

251 IAVISVYAAM MSVLN*
```

m569/g569 95.3% identity in 127 aa overlap

```
                    10        20        30        40        50        60
m569.pep    MLKQRVITAMWLLPLMLGMLFYAPQWLWAAFCGLIALIALWEYARMGGLCKIKTNHYLAA
            |||||||||||||||||||||||||||||||||| |||||||||||:|||| :|||||||
g569        MLKQRVITAMWLLPLMLGMLFYAPQWLWAAFCGLIALTALWEYARMAGLCKTETNHYLAA
                    10        20        30        40        50        60

                    70        80        90       100       110       120
m569.pep    TLVFGVVAYAGGWMLPNLVWYVVLAFWLAVMPLWLRFKWRLNGGWQVYAVGWLLVMPFWF
            |||||||||||||||||||||||||||||||||||||||||||||||||||||:||||||
g569        TLVFGVVAYAGGWMLPNLVWYVVLAFWLAVMPLWLRFKWRLNGGWQVYAVGWLLLMPFWF
                    70        80        90       100       110       120

                   130       140       150       160       170       180
m569.pep    ALVSLRPHPDDALPLLAVMGLVWVADICAYFSGKAFGKHKIAPAISPGKSWEGAIGGAVC
            ||||| |
g569        ALVSLAPASRX
                   130
```

The following partial DNA sequence was identified in *N. meningitidis* <SEQ ID 1699>:

a569.seq

```
  1 ATGCTGAAAC AACGGGTGAT AACCGCCATG TGGCTGCTGC CGCTGATGCT

 51 GGGCATGCTG TTTTACGCGC CGCAATGGTT GTGGGCTGCA TTTTGCGGAC
```

-continued

```
101 TGATTGCCCT GATTGCCTTG TGGGAATATG CCCGTATGGG CGGTTTGTGC

151 AAAATTAAAA CCAACCATTA CCTCGCCGCA ACCTTGGTTT TCGGCGTGGT

201 TGCCTATGCG GGCGGCTGGA TGCTGCCTAA TTTGGTTTGG TATGTTGTTT

251 TGGCATTTTG GCTCGCCGTT ATGCCTTTAT GGTTGAGATT CAAATGGAGG

301 CTCAACGGCG GTTGGCAGGT TTATGCCGTC GGCTGGCTTC TGGTCATGCC

351 GTTTTGGTTC GCGCTCGTAT CCCTGCGCCC GCATCCCGAT GATGCCCTGC

401 CGCTGCTCGC CGTGATGGGT TTGGTGTGGG TTGCCGATAT TTGCGCGTAT

451 TTCAGCGGCA AGGCGTTCGG CAAACACAAA ATCGCACCGG CAATCAGCCC

501 CGGCAAAAGC TGGGAAGGTG CAATCGGCGG CGCGGTTTGC GTGGCCGTGT

551 ACATGACCGC CGTACGAAGT GCCGGCTGGC TGGCATTCGA TACAGGCTGG

601 TTCGATACCG TGTTAATCGG TTTGGTGTTG ACCGTTGTCA GCGTATGCGG

651 CGACCTTTTG GAAAGCTGGC TCAAGCGCGC GGCAGGCATC AAAGACAGCA

701 GCAACCTGCT GCCCGGACAC GGCGGCGTGT TCGACCGCAC CGACAGCCTG

751 ATTGCCGTTA TCAGCGTCTA TGCAGCGATG ATGTCGGTTT TAAATTGA
```

This corresponds to the amino acid sequence <SEQ ID 1700; ORF 569.a>:

```
a569.pep

  1 MLKQRVITAM WLLPLMLGML FYAPQWLWAA FCGLIALIAL WEYARMGGLC

 51 KIKTNHYLAA TLVFGVVAYA GGWMLPNLVW YVVLAFWLAV MPLWLRFKWR

101 LNGGWQVYAV GWLLVMPFWF ALVSLRPHPD DALPLLAVMG LVWVADICAY

151 FSGKAFGKHK IAPAISPGKS WEGAIGGAVC VAVYMTAVRS AGWLAFDTGW

201 FDTVLIGLVL TVVSVCGDLL ESWLKRAAGI KDSSNLLPGH GGVFDRTDSL

251 IAVISVYAAM MSVLN*
```

m569/a569 99.6% identity in 265 aa overlap

```
                   10        20        30        40        50        60
m569.pep   MLKQRVITAMWLLPLMLGMLFYAPQWLWAAFCGLIALIALWEYARMGGLCKIKTNHYLAA
           ||||||||||||||||||||||||||||||||||||||||||||||||||||||||||||
a569       MLKQRVITAMWLLPLMLGMLFYAPQWLWAAFCGLIALIALWEYARMGGLCKIKTNHYLAA
                   10        20        30        40        50        60

                   70        80        90       100       110       120
m569.pep   TLVFGVVAYAGGWMLPNLVWYVVLAFWLAVMPLWFRFKWRLNGGWQVYAVGWLLVMPFWF
           ||||||||||||||||||||||||||||||||||||||||||||||||||||||||||||
a569       TLVFGVVAYAGGWMLPNLVWYVVLAFWLAVMPLWLRFKWRLNGGWQVYAVGWLLVMPFWF
                   70        80        90       100       110       120

                  130       140       150       160       170       180
m569.pep   ALVSLRPHPDDALPLLAVMGLVWVADICAYFSGKAFGKHKIAPAISPGKSWEGAIGGAVC
           ||||||||||||||||||||||||||||||||||||||||||||||||||||||||||||
a569       ALVSLRPHPDDALPLLAVMGLVWVADICAYFSGKAFGKHKIAPAISPGKSWEGAIGGAVC
                  130       140       150       160       170       180

                  190       200       210       220       230       240
m569.pep   VAVYMTAVRSAGWLAFDTGWFDTVLIGLVLTVVSVCGDLLESWLKRAAGIKDSSKLLPGH
           ||||||||||||||||||||||||||||||||||| ||||||||||||||||||:|||||
a569       VAVYMTAVRSAGWLAFDTGWFDTVLIGLVLTVVSVCGDLLESWLKRAAGIKDSSNLLPGH
                  190       200       210       220       230       240

                  250       260
m569.pep   GGVFDRTDSLIAVISVYAAMMSVLNX
           |||||||||||||||||||||||||
a569       GGVFDRTDSLIAVISVYAAMMSVLNX
                  250       260
```

The following partial DNA sequence was identified in *N. gonorrhoeae* <SEQ ID 1701>:

g570.seq..

```
  1 atgatccgtt tgacccgcgc gtttgccgcc gccctgatcg gtttatgctg
 51 caccacaggc gcgcacgccg acaccttcca aaaaatcggc tttatcaaca
101 ccgagcgcat ctacctcgaa tccaagcagg cgcgcaacat ccaaaaaacg
151 ctggacggcg aattttccgc ccgtcaggac gaattgcaaa aactgcaacg
201 cgaaggcttg gatttggaaa ggcagctcgc cggcggcaaa cttaaggacg
251 caaaaaaggc gcaagccgaa gaaaaatggc gcgggctggt cgaagcgttc
301 cgcaaaaaac aggcgcagtt tgaagaagac tacaacctcc gccgcaacga
351 agagtttgcc tccctccagc aaaacgccaa ccgcgtcatc gtcaaaatcg
401 ccaaacagga aggttacgat gtcattttgc aggacgtgat ttacgtcaac
451 acccaatacg acgttaccga cagcgtcatt aaagaaatga acgcccgctg
501 a
```

This corresponds to the amino acid sequence <SEQ ID 1702; ORF 570.ng>:

g570.pep..

```
  1 MIRLTRAFAA ALIGLCCTTG AHADTFQKIG FINTERIYLE SKQARNIQKT
 51 LDGEFSARQD ELQKLQREGL DLERQLAGGK LKDAKKAQAE EKWRGLVEAF
101 RKKQAQFEED YNLRRNEEFA SLQQNANRVI VKIAKQEGYD VILQDVIYVN
151 TQYDVTDSVI KEMNAR*
```

The following partial DNA sequence was identified in *N. meningitidis* <SEQ ID 1703>:

m570.seq..

```
  1 ATGACCCGTT TGACCCGCGC GTTTGCCGCG GCTCTGATCG GTTTGTGCTG
 51 CACCGCAGGC GCGCACGCCG ACACCTTCCA AAAAATCGGC TTTATCAACA
101 CCGAGCGCAT CTACCTCGAA TCCAAGCAGG CGCGCAAGAT TCAAAAAACG
151 CTGGACAGCG AATTTTCCGC TCGTCAGGAC GAATTGCAAA AACTGCAACG
201 CGAAGGTCTG GATTTGGAAA GGCAGCTTGC CGAAGGCAAA CTCAGAAACG
251 CAAAAAAGGC GCAAGCCGAA GAAAAATGGC GCGGGCTGGT CGCAGCGTTC
301 CGCAAAAAAC AGGCGCAGTT TGAAGAAGAC TACAACCTCC GCCGCAACGA
351 AGAGTTTGCC TCCCTCCAGC AAAACGCCAA CCGCGTCATC GTCAAAATCG
401 CCAAACAGGA AGGTTACGAT GTCATTTTGC AGAACGTGAT TTACGTCAAC
451 ACCCAATACG ACGTTACCGA CAGCGTCATT AAAGAAATGA ACGCCCGCTG
501 A
```

This corresponds to the amino acid sequence <SEQ ID 1704; ORF 570>:

m570.pep

```
  1 MTRLTRAFAA ALIGLCCTAG AHADTFQKIG FINTERIYLE SKQARKIQKT

 51 LDSEFSARQD ELQKLQREGL DLERQLAEGK LRNAKKAQAE EKWRGLVAAF

101 RKKQAQFEED YNLRRNEEFA SLQQNANRVI VKIAKQEGYD VILQNVIYVN

151 TQYDVTDSVI KEMNAR*
```

m570/g570 94.6% identity in 166 aa overlap

```
                    10        20        30        40        50        60
m570.pep   MTRLTRAFAAALIGLCCTAGAHADTFQKIGFINTERIYLESKQARKIQKTLDSEFSARQD
           | ||||||||||||||||:||||||||||||||||||||||||||:||||||:|||||||
g570       MIRLTRAFAAALIGLCCTTGAHADTFQKIGFINTERIYLESKQARNIQKTLDGEFSARQD
                    10        20        30        40        50        60

                    70        80        90       100       110       120
m570.pep   ELQKLQREGLDLERQLAEGKLRNAKKAQAEEKWRGLVAAFRKKQAQFEEDYNLRRNEEFA
           ||||||||||||||||| |||::|||||||||||||| ||||||||||||||||||||||
g570       ELQKLQREGLDLERQLAGGKLKDAKKAQAEEKWRGLVEAFRKKQAQFEEDYNLRRNEEFA
                    70        80        90       100       110       120

                   130       140       150       160
m570.pep   SLQQNANRVIVKIAKQEGYDVILQNVIYVNTQYDVTDSVIKEMNARX
           ||||||||||||||||||||||||:|||||||||||||||||||||
g570       SLQQNANRVIVKIAKQEGYDVILQDVIYVNTQYDVTDSVIKEMNARX
                   130       140       150       160
```

The following partial DNA sequence was identified in *N. meningitidis* <SEQ ID 1705>:

a570.seq

```
  1 ATGACCCGTT TGACCCGCGC GTTTGCCGCG GCTCTGATCG GTTTGTGCTG

 51 CACCGCAGGC GCGCACGCCG ACACCTTCCA AAAAATCGGC TTTATCAACA

101 CCGAGCGCAT CTACCTCGAA TCCAAGCAGG CGCGCAAGAT TCAAAAAACG

151 CTGGACAGCG AATTTTCCGC CCGCCAGGAC GAATTGCAAA AACTGCAACG

201 CGAAGGTCTG GATTTGGAAA GGCAGCTTGC CGAAGGCAAA CTCAAAGACG

251 CAAAAAAGGC GCAAGCCGAA GAAAAATGGT GCGGGCTGGT CGCAGCGTTC

301 CGCAAAAAAC AGGCGCAGTT TGAAGAAGAC TACAACCTCC GCCGCAACGA

351 AGAGTTTGCC TCCCTCCAGC AAAACGCCAA CCGCGTCATC GTCAAAATCG

401 CCAAACAGGA AGGTTACGAT GTCATTTTGC AGGACGTGAT TTACGTCAAC

451 ACCCAATACG ACGTTACCGA CAGCGTCATT AAAGAAATGA ACGCCCGCTG

501 A
```

This corresponds to the amino acid sequence <SEQ ID 1706; ORF 570.a>:

a570.pep

```
  1 MTRLTRAFAA ALIGLCCTAG AHADTFQKIG FINTERIYLE SKQARKIQKT

 51 LDSEFSARQD ELQKLQREGL DLERQLAEGK LKDAKKAQAE EKWCGLVAAF

101 RKKQAQFEED YNLRRNEEFA SLQQNANRVI VKIAKQEGYD VILQDVIYVN

151 TQYDVTDSVI KEMNAR*
```

m570/a570 97.6% identity in 166 aa overlap

```
                10        20        30        40        50        60
m570.pep  MTRLTRAFAAALIGLCCTAGAHADTFQKIGFINTERIYLESKQARKIQKTLDSEFSARQD
          ||||||||||||||||||||||||||||||||||||||||||||||||||||||||||||
a570      MTRLTRAFAAALIGLCCTAGAHADTFQKIGFINTERIYLESKQARKIQKTLDSEFSARQD
                10        20        30        40        50        60
                70        80        90       100       110       120
m570.pep  ELQKLQREGLDLERQLAEGKLRNAKKAQAEEKWRGLVAAFRKKQAQFEEDYNLRRNEEFA
          ||||||||||||||||||||::||||||||||| ||||||||||||||||||||||||||
a570      ELQKLQREGLDLERQLAEGKLKDAKKAQAEEKWCGLVAAFRKKQAQFEEDYNLRRNEEFA
                70        80        90       100       110       120
               130       140       150       160
m570.pep  SLQQNANRVIVKIAKQEGYDVILQNVIYVNTQYDVTDSVIKEMNARX
          ||||||||||||||||||||||||:||||||||||||||||||||||
a570      SLQQNANRVIVKIAKQEGYDVILQDVIYVNTQYDVTDSVIKEMNARX
               130       140       150       160
```

The following partial DNA sequence was identified in *N. gonorrhoeae* <SEQ ID 1707>:

g571.seq (partial)

```
  1 atgcgcgttt tccgagtaaa ccgatttgtt gttaccgttt tcggcggcgg
 51 tataggttct gccgtcccac acgctgcctg cgtcggcaaa caggctcagg
101 cggacggtgc gtgcgtcttt cgcaccgggc atcgggaaga gcagctcggc
151 ggagacgttg gctttttgt tgccgccgta gctgattttt tcgccgtatt
201 cgtcatacac tttcgggccg agcgtgccgc tttcgtagcc gcgcaccgaa
251 cccaggccgc cgccgtagaa gttttcaaag aaggggattt ctttggttct
301 gccgtagccg cccgcaatgc cgacttcgcc gccgagcatc agcgtgaagg
351 ttttgct . . .
```

This corresponds to the amino acid sequence <SEQ ID 1708; ORF 571.ng>:

g571.pep (partial)

```
  1 MRVPRVNRFV VTVFGGGIGS AVPHAACVGK QAQADGACVF RTGHREEQLG
 51 GDVGFFVAAV ADFFAVFVIH FRAERAAFVA AHRTQAAAVE VFKEGDFFGS
101 AVAARNADFA AEHQREGFA . . .
```

The following partial DNA sequence was identified in *N. meningitidis* <SEQ ID 1709>:

m571.seq

```
  1 ATGGGTATTG CCGGCGCCGT AAATGTTTTG AACCCTGCCG CCGGTCGCGG
 51 AACTGCTGTT GTCGTCGTAG GTTTTGCCGT CCCACACGCT GCCTGCGTCG
101 GCAAACAGGC TCAGGCGGAC GGTGCGCGCG TCTTTCGCGC CGGGCATCGG
151 GAAGAGCAGC TCGGCGGAGA CGTTGGCTTT TTTGTTGCCG CCGTAGCTGA
201 TTTTTTCGCC GTATTCGTCA TAGACTTTCG GACCGAGCGT GCCGCTTTCG
251 TATCCGCGCA CCGAACCCAG GCCGCCGCCG TAGAAGTTTT CAAAGAAGGG
301 GATTTCTTTG GTTCTGCCGT AGCCGCCCGC AATCCCGACT TCGCCGCCGA
351 GCATCAGCGT GAAGGTTTTG CTCAGGGGGA AGAACCAGGT TTGGTTGTGG
```

-continued

```
401 GTGGCGGAGT ACTATTGCAG TTTGCTGCCA GGCAGGGCGA TTTCGGCGTT

451 CACGCCCGTC AGGTAGCCGC GCGTCGGCCA TAA
```

This corresponds to the amino acid sequence <SEQ ID 1710; ORF 571>:

m571.pep

```
  1 MGIAGAVNVL NPAAGRGTAV VVVGFAVPHA ACVGKQAQAD GARVFRAGHR

 51 EEQLGGDVGF FVAAVADFFA VFVIDFRTER AAFVSAHRTQ AAAVEVFKEG

101 DFFGSAVAAR NADFAAEHQR EGFAQGEEPG LVVGGGVVLQ FAARQGDFGV

151 HARQVAARRP *
```

m571/g571 93.1% identity in 102 aa overlap

```
                      10        20        30        40        50        60
m571.pep      MGIAGAVNVLNPAAGRGTAVVVVGFAVPHAACVGKQAQADGARVFRAGHREEQLGGDVGF
                                    :| ||||||||||||||||| |||:|||||||||||||
g571               MRVFRVNRFVVTVFGGGIGSAVPHAACVGKQAQADGACVFRTGHREEQLGGDVGF
                           10        20        30        40        50

                      70        80        90       100       110       120
m571.pep      FVAAVADFFAVFVIDFRTERAAFVSAHRTQAAAVEVFKEGDFFGSAVAARNADFAAEHQR
              |||||||||||||| ||:||||||:|||||||||||||||||||||||||||||||||||
g571          FVAAVADFFAVFVIHFRAERAAFVAAHRTQAAAVEVFKEGDFFGSAVAARNADFAAEHQR
                 60        70        80        90       100       110

                     130       140       150       160
m571.pep      EGFAQGEEPGLVVGGGVVLQFAARQGDFGVHARQVAARRPX
              ||||
g571          EGFA
               119
```

The following partial DNA sequence was identified in *N. meningitidis* <SEQ ID 1711>:

a571.seq

```
  1 ATGGGTATTG CCGGCGCCGT AAATGTTTTG AACCCTGCCG CCGGTCGCGG

 51 AACTGCTGTT GTCGTCGTAG GTTTTGCCGT CCCACACGCT GCCTGCGTCG

101 GCAAACAGGC TCAGGCGGAC GGTGCGCGCG TCTTTCGCGC CGGGCATCGG

151 GAAGAGCAGC TCGGCGGAGA CGTTGGCTTT TTTGTTGCCG CCGTAGCTGA

201 TTTTTTCGCC GTATTCGTCA TACACTTTCG GACCGAGCGT GCCGCTTTCG

251 TATCCGCGCA CCGAACCCAG GCCGCCGCCG TAGAAGTTTT CAAAGAAGGG

301 GATTTCTTTG GTTCTGCCGT AGCCGCCCGC AATGCCGACT TCGCCGCCGA

351 GCATCAGCGT GAAGGTTTTG CTTAAGGGGA AGAACCAGGT TTGGTTGTGG

401 GTGGCGGAGT AGTATTGCAG TTTGCTGCCG GGCAGGGCGA TTTCGGCGTT

451 CACGCCCGTC AGGTAGCCGC GCGTCGGCCA TAA
```

This corresponds to the amino acid sequence <SEQ ID 1712; ORF 571.a>:

a571.pep

```
  1 MGIAGAVNVL NPAAGRGTAV VVVGFAVPHA ACVGKQAQAD GARVFRAGHR

 51 EEQLGGDVGF FVAAVADFFA VFVIHFRTER AAFVSAHRTQ AAAVEVFKEG
```

-continued

```
101 DFFGSAVAAR NADFAAEHQR EGFA*GEEPG LVVGGGVVLQ FAAGQGDFGV

151 HARQVAARRP *
```

m571/a571 98.1% identity in 160 aa overlap

```
                    10        20        30        40        50        60
m571.pep   MGIAGAVNVLNPAAGRGTAVVVVGFAVPHAACVGKQAQADGARVFRAGHREEQLGGDVGF
           ||||||||||||||||||||||||||||||||||||||||||||||||||||||||||||
a571       MGIAGAVNVLNPAAGRGTAVVVVGFAVPHAACVGKQAQADGARVFRAGHREEQLGGDVGF
                    10        20        30        40        50        60

                    70        80        90       100       110       120
m571.pep   FVAAVADFFAVFVIDFRTERAAFVSAHRTQAAAVEVFKEGDFFGSAVAARNADFAAEHQR
           |||||||||||||| |||||||||||||||||||||||||||||||||||||||||||||
a571       FVAAVADFFAVFVIHFRTERAAFVSAHRTQAAAVEVFKEGDFFGSAVAARNADFAAEHQR
                    70        80        90       100       110       120

                   130       140       150       160
m571.pep   EGFAQGEEPGLVVGGGVVLQFAARQGDFGVHARQVAARRPX
           |||| |||||||||||||||||| ||||||||||||||||
a571       EGFAXGEEPGLVVGGGVVLQFAAGQGDFGVHARQVAARRPX
                   130       140       150       160
```

The following partial DNA sequence was identified in *N. gonorrhoeae* <SEQ ID 1713>:

g572.seq

```
  1 atgtgcgcca tcgtcggggc ggcggggctg ccttccgcgc tcgcagcggc

 51 gcaaaaaggc aaaaccattt atctggcaaa caaagaaacg ctggtggttt

101 ccggcgcgtt gtttatggaa accgcccgcg caaacggcgc ggcagtgttg

151 cccgtcgaca gcgaacacaa cgccattttc caagttttgc cgcgcgatta

201 cacagaccgt ctgaacgaac acggcatcga ttcgattatc ctgaccgctt

251 ccggcggccc gtttttaaca accgatttaa gcacgttcga cagcattacg

301 cccgagcagg cggtcaaaca ccccaattgg cgtatggggc gcaaaatctc

351 cgtcgattca gccactatgg caaacaaggg cttggaactg attgaagcgc

401 attggctgtt caactgtccg cccgacaaac tcgaagtcgt catccatccc

451 caatccgtga tacacagtat ggtgcgctac cgcgacggct ccgtgctggc

501 gcaactgggc aatcccgata tgcgaacgcc catcgcctat tgtttgggct

551 tgcccgagcg catcgattcg ggtgtcggca aactcgattt cggcgcattg

601 tccgcgctga ccttccaaaa gcccgacttc ggccgcttcc cctgcctgaa

651 gttcgcctat gaaaccataa acgcaggcgg agccgcgccc tgcgtattga

701 acgccgccaa cgaaaccgcc gtcgccgcct ttttggacgg acagattaag

751 tttaccgaca ttgccaaaac cgtcgcccac tgtcttgcac aagacttttc

801 aaacggcatg ggcgatatag aaggactgtt ggcgcaagat gcccggacac

851 gcgcacaagc gcgggcattt atcggcacac tgcgctga
```

This corresponds to the amino acid sequence <SEQ ID 1714; ORF 572.ng>:

g572.pep

```
  1 MCAIVGAAGL PSALAAAQKG KTIYLANKET LVVSGALFME TARANGAAVL
 51 PVDSEHNAIF QVLPRDYTDR LNEHGIDSII LTASGGPFLT TDLSTFDSIT
101 PEQAVKHPNW RMGRKISVDS ATMANKGLEL IEAHWLFNCP PDKLEVVIHP
151 QSVINSMVRY RDGSVLAQLG NPDMRTPIAY CLGLPERIDS GVGKLDFGAL
201 SALTFQKPDF GRFPCLKFAY ETINAGGAAP CVLNAANETA VAAFLDGQIK
```

The following partial DNA sequence was identified in *N. meningitidis* <SEQ ID 1715>:

m572.seq

```
  1 ATGTGCGCCA TCGTCGGGGC GGTGGGGCTG CCTTCCGCGC TCGCAGCGGC
 51 GCAAAAAGGC AAAACCATTT ATCTGGCAAA CAAAGAAACG CTGGTGGTTT
101 CCGGCGCGTT GTTTATGGAA ACCGCCCGTC CAAACGGCGC GGCAGTGCTG
151 CCCGTCGACA GCGAACACAA CGCCGTTTTC CAAGTTTTGC CGCGCGATTA
201 CGCCGGCCGT CTGAACGAAC ACGCCATCGC TTCGATTATC CTGACCGCTT
251 CCGGCGGCCC GTTTCTGACC GCCGATTTAA ACACGTTCGA CCGCATTACG
301 CCCGCCCAAG CGGTCAAACA CCCCAATTGG CGTATGGGAC GCAAAATCTC
351 CGTCGATTCC GCCACCATGA TGAACAAAGG TTTGGAGCTG ATTGAAGCGC
401 ATTGGCTGTT CAACTGTCCG CCCGACAAAC TCGAAGTCGT CATCCATCCG
451 CAATCCGTGA TACACAGCAT GGTGCGCTAC CGCGACGGCT CCGTGCTGGC
501 CCAACTGGGC AATCCCGATA TGCGAACGCC CATCGCTTAT TGTTTGGGTT
551 TGCCCGAGCG CATCGATTCC GGTGTCGGCG ACCTGGATTT CGACGCATTG
601 TCCGCGCTGA CCTTCCAAAA GCCCGACTTT GACCGCTTCC CCTGCCTGAG
651 GCTCGCCTAT GAAGCCATGA ACGCAGGCGG AGCCGCGCCC TGCGTATTGA
701 ACGCCGCCAA CGAAGCCGCC GTCGCCGCCT TTTTGGACGG ACAGATTAAG
751 TTTACCGACA TTGCCAAAAC CGTCGCCCAC TGTCTTGCAC AAGACTTTTC
801 AGACGGCATA GGCGATATAG GCGGGCTCTT GGGGCAAGAT GCCCGGACAC
851 GCGCACAAGC GCGAGCATTT ATCGGCACAC TGCGCTCA
```

This corresponds to the amino acid sequence <SEQ ID 1716; ORF 572>:

m572.pep

```
  1 MCAIVGAVGL PSALAAAQKG KTIYLANKET LVVSGALFME TARANGAAVL
 51 PVDSEHNAVF QVLPRDYAGR LNEHGIASII LTASGGPFLT ADLNTFDRIT
101 PAQAVKHPNW RMGRKISVDS ATMMNKGLEL IEAHWLFNCP PDKLEVVIHP
151 QSVIHSMVRY RDGSVLAQLG NPDMRTPIAY CLGLPERIDS GVGDLDFDAL
201 SALTFQKPDF DRFPCLRLAY EAMNAGGAAP CVLNAANEAA VAAFLDGQIK
251 FTDIAKTVAH CLAQDFSDCI GDIGGLLAQD ARTRAQARAF IGTLR*
```

m572/g572 92.9% identity in 295 aa overlap

```
                   10        20        30        40        50        60
m572.pep   MCAIVGAVGLPSALAAAQKGKTIYLANKETLVVSGALFMETARANGAAVLPVDSEHNAVF
           |||||||:||||||||||||||||||||||||||||||||||||||||||||||||||:|
g572       MCAIVGAAGLPSALAAAQKGKTIYLANKETLVVSGALFMETARANGAAVLPVDSEHNAIF
                   10        20        30        40        50        60

                   70        80        90       100       110       120
m572.pep   QVLPRDYAGRLNEHGIASIILTASGGPFLTADLNTFDRITPAQAVKHPNWRMGRKISVDS
           |||||||: ||||||| |||||||||||||:||:||| ||| ||||||||||||||||||
g572       QVLPRDYTDRLNEHGIDSIILTASGGPFLTTDLSTFDSITPEQAVKHPNWRMGRKISVDS
                   70        80        90       100       110       120

                  130       140       150       160       170       180
m572.pep   ATMMNKGLELIEAHWLFNCPPDKLEVVIHPQSVIHSMVRYRDGSVLAQLGNPDMRTPIAY
           ||| ||||||||||||||||||||||||||||||||||||||||||||||||||||||||
g572       ATMANKGLELIEAHWLFNCPPDKLEVVIHPQSVIHSMVRYRDGSVLAQLGNPDMRTPIAY
                  130       140       150       160       170       180

                  190       200       210       220       230       240
m572.pep   CLGLPERIDSGVGDLDFDALSALTFQKPDFDRFPCLRLAYEAMNAGGAAPCVLNAANEAA
           ||||||||||||| ||| |||||||||||| |||||::|||::|||||||||||||||:|
g572       CLGLPERIDSGVGKLDFGALSALTFQKPDFGRFPCLKFAYETINAGGAAPCVLNAANETA
                  190       200       210       220       230       240

                  250       260       270       280       290
m572.pep   VAAFLDGQIKFTDIAKTVAHCLAQDFSDGIGDIGGLLAQDARTRAQARAFIGTLRX
           |||||||||||||||||||||||||||:||||| ||||||||||||||||||||||
g572       VAAFLDGQIKFTDIAKTVAHCLAQDFSNGMGDIEGLLAQDARTRAQARAFIGTLRX
                  250       260       270       280       290
```

The following partial DNA sequence was identified in *N. meningitidis* <SEQ ID 1717>:

<u>a572.seq</u>

```
  1 ATGTGCGCCA TCGTCGGGGC GGTGGGGCTG CCTTCCGCGC TCGCAGCGGC
 51 GCAAAAAGGC AAAACCATTT ATCTGGCGAA CAAAGAGACG CTGGTGGTTT
101 CCGGCGCGTT GTTTATGGAA ACCGCCCGTG CAAACGGCGC GGCAGTGCTG
151 CCCGTCGACA GCGAACACAA CGCCGTTTTC CAAGTTTTGC CGCGCGATTA
201 CACAGGTCGC CTGAACGAAC ACGGCATCGC TTCGATTATC CTGACCGCTT
251 CCGGCGGCCC GTTTCTGACC GCCGATTTAA ACACGTTCGA CAGCATTACG
301 CCCGACCAAG CGGTCAAACA CCCCAATTGG CGTATGGGAC GCAAAATCTC
351 CGTCGATTCC GCCACCATGA TGAACAAAGG TTTGGAGCTG ATTGAAGCGC
401 ATTGGCTGTT CAACTGTCCG CCCGACAAAC TCGAAGTCGT CATCCATCCG
451 CAATCTGTGA TACACAGCAT GGTGCGCTAC CGCGACGGCT CCGTGTTGGC
501 GCAACTGGGC AATCCCGATA TGCGAACGCC TATCGCTTAT TGTTTGGGTT
551 TGCCCGAGCG CATCGATTCG GGTGTCGGCG ACCTGGATTT CGACGCATTG
601 TCCGCGCTGA CCTTCCAAAA GCCCGACTTT GACCGCTTCC CCTGCCTGAA
651 GCTCGCCTAT GAAGCCATGA ACGCAGGCGG AGCCGCGCCC TGCGTATTGA
701 ACGCCGCCAA CGAAGCCGCC GTCGCCGCCT TTTTGGACGG ACAGATTAAG
751 TTTACCGACA TTGCCAAAAC CGTCGCCCAT TGTCTTTCAC AAGACTTTTC
801 AGACGGCATA GGCGACATAG GGGGGCTCTT GGCGCAAGAT GCCCGGACAC
851 GCGCACAAGC GCGGGCATTT ATCGGCACAC TGCGCTGA
```

This corresponds to the amino acid sequence <SEQ ID 1718; ORF 572.a>:

a572.pep

```
  1 MCAIVGAVGL PSALAAAQKG KTIYLANKET LVVSGALFME TARANGAAVL
 51 PVDSEHNAVF QVLPRDYTGR LNEHGIASII LTASGGPFLT ADLNTFDSIT
101 PDQAVKHPNW RMGRKISVDS ATMMNKGLEL IEAHWLFNCP PDKLEVVIHP
151 QSVIHSMVRY RDGSVLAQLG NPDMRTPIAY CLGLPERIDS GVGDLDFDAL
201 SALTFQKPDF DRFPCLKLAY EAMNAGGAAP CVLNAANEAA VAAFLDGQIK
251 FTDIAKTVAH CLSQDFSDGI GDIGGLLAQD ARTRAQARAF IGTLR*
```

m572/a572 98.3% identity in 295 aa overlap

```
                     10        20        30        40        50        60
m572.pep    MCAIVGAVGLPSALAAAQKGKTIYLANKETLVVSGALFMETARANGAAVLPVDSEHNAVF
            ||||||||||||||||||||||||||||||||||||||||||||||||||||||||||||
a572        MCAIVGAVGLPSALAAAQKGKTIYLANKETLVVSGALFMETARANGAAVLPVDSEHNAVF
                     10        20        30        40        50        60

                     70        80        90       100       110       120
m572.pep    QVLPRDYAGRLNEHGIASIILTASGGPFLTADLNTFDRITPAQAVKHPNWRMGRKISVDS
            |||||||:|||||||||||||||||||||||||||||| ||| |||||||||||||||||
a572        QVLPRDYTGRLNEHGIASIILTASGGPFLTADLNTFDSITPDQAVKHPNWRMGRKISVDS
                     70        80        90       100       110       120

                    130       140       150       160       170       180
m572.pep    ATMMNKGLELIEAHWLFNCPPDKLEVVIHPQSVIHSMVRYRDGSVLAQLGNPDMRTPIAY
            ||||||||||||||||||||||||||||||||||||||||||||||||||||||||||||
a572        ATMMNKGLELIEAHWLFNCPPDKLEVVIHPQSVIHSMVRYRDGSVLAQLGNPDMRTPIAY
                    130       140       150       160       170       180

                    190       200       210       220       230       240
m572.pep    CLGLPERIDSGVGDLDFDALSALTFQKPDFDRFPCLRLAYEAMNAGGAAPCVLNAANEAA
            |||||||||||||||||||||||||||||||||||||:||||||||||||||||||||||
a572        CLGLPERIDSGVGDLDFDALSALTFQKPDFDRFPCLKLAYEAMNAGGAAPCVLNAANEAA
                    190       200       210       220       230       240

                    250       260       270       280       290
m572.pep    VAAFLDGQIKFTDIAKTVAHCLAQDFSDGIGDIGGLLAQDARTRAQARAFIGTLRX
            ||||||||||||||||||||||:|||||||||||||||||||||||||||||||||
a572        VAAFLDGQIKFTDIAKTVAHCLSQDFSDGIGDIGGLLAQDARTRAQARAFIGTLRX
                    250       260       270       280       290
```

The following partial DNA sequence was identified in *N. gonorrhoeae* <SEQ ID 1719>:

g573.seq..

```
  1 atgccctgtt tgtgccgcct taatcgcaat atcggcagtt tccaaatcac
 51 gaatctcacc gaccataatg atgtccgggt cctgacgcag gaaagacttc
101 aaagcagcgg caaaagtcag accctgctta tcattgacgt taacctgatt
151 gatgcccggc aggttaatct cggcagggtc ttccgccgtt gcaatattta
201 ccgactccgt attcaaaata ttcaaacagg tatagagcga caccgtctta
251 cccgaacccg tcggaccggt taccagcacc atcccgtaag gacggtgaat
301 cgcttccaac aacaattttt tctggaacgg ctcaaaaccg agctggtcga
351 tgttcaaaga cgcggcatcg gaattcaaaa tccgcatcac gaccttttcg
401 ccaaacagcg tcggcaatgt gctgacacgg aaatcgacag gcttgccgcc
451 cttttgaaag gtcagctgca tcctaccgtc ctgcggtatc cgtttttcgg
501 aaatgtccaa acgcgacatt accttaatcc gggaagcaag ctgcccccctt
551 accgcaatgg gcggctgaac cacctcgcgg agctgcccgt ccacacggaa
601 acggatacgc gcattgtgtt cgtaaaactc gaaatggatg tcggatgccc
```

-continued

```
 651 cgctacgcaa ggcatccgac aaagttttat ggataaacct cggaacaggg
 701 ccgtcttctg cctcctcgtc gtcgatatac agggtgtggc tttcctcttc
 751 ctcttgcccc tccccaagct cctgaagcag cgatgtcgaa cgcgaaccca
 801 cccaatcgag caaacccgcc aactggtcat cctcgacaat gaccaactca
 851 accgcaatcc ctgcggcaga aaccgttttc tgaatttgcg gcatctgggt
 901 cggatcggaa accgcaaaaa atactttgtc gcccccacgg aaaaccggca
 951 cacagtggaa ctccaccatc tgctcctccg tcaacacccc catcagcacc
1001 ctgtggcgcg gataatgacg caaatcaaga atcgaataac tgaacaccct
1051 cgcaatcaat gccgcaagcg acttgggcga aatgacaccg tctga
```

This corresponds to the amino acid sequence <SEQ ID 1720; ORF 573.ng>:

```
g573.pep..
  1 MPCLCRLNRN IGSFQITNLT DHNDVRVLTQ ERLQSSGKSQ TLLIIDVNLI
 51 DARQVNLGRV FRRCNIYRLR IQNIQTGIER HRLTRTRRTG YQHHPVRTVN
101 RFQQQFFLER LKTELVDVQR RGIGIQNPHH DLFAKQRRQC ADTEIDRLAA
151 LLKGQLHPTV LRYPFFGNVQ TRHYLNPGSK LPPYRNGRLN HLAELPVHTE
201 TDTRIVFVKL EMDVGCPATQ GIRQSFMDKP RNRAVFCLLV VDIQGVAFLF
251 LLPLPKLLKQ RCRTRTHPIE QTRQLVILDN DQLNRNPCGR NRFLNLRHLG
301 RIGNRKKYFV APTENRHTVE LHHLLLRQHP HQHPVARIMT QIKNRITEHP
351 RNQCRKRLGR NDTV*
```

The following partial DNA sequence was identified in *N. meningitidis* <SEQ ID 1721>:

```
m573.seq..
  1 ATGCCCTGTT TGTGCCGCCT TAATCGCAAT ATCGGCAGTT TCCAAATCAC
 51 GAATCTCACC GACCATAATG ATGTCCGGGT CCTGACGCAG GAAAGACTTC
101 AAAGCAGCGG CAAAAGTCAG GCCCTGCTTA TCATTGACGT TAACCTGATT
151 GATGCCCGGC AGGTTAATCT CGGCAGGGTC TTCCGCCGTT GCAATATTTA
201 CCGACTCCGT ATTCAAAATA TTCAAACAGG TATAGAGCGA CACCGTCTTA
251 CCCGAACCCG TCGGACCGGT TACCAGCACC ATCCCGTAGG GACGGTGAAT
301 CGCTACCAAC aCaw.TTTTT TCTGAAACGG CTCAAAACCG AGCTGGTCGA
351 TGTTCAAAGA CGCGGCATCG GAATTCAAAA TCCGCATCAC GACCTTTTCG
401 CCAAACAGCG TCGGCAATGT GCTGACACGG AAATCGACAG GCTTGCCGCC
451 CTTTTGAAAG GTCAGCTGCA TCCTGCCGTC CTGCGGTATC CGTTTTTCGG
501 AAATGTCCAA ACGCGACATT ACCTTAATCC GTGAAGCAAG CTGCCCCCTT
551 ACCGCAATGG GCGGCTGAAC CACCTCGCGG AGCTGCCCGT CCACACGGAA
601 ACGGATACGG GCATTGTGTT CGTAAAACTC GAAATGGATG TCCGATGCCC
651 CGCTGCGCAA GGCATCCGAC AAAGTCTTAT GGATAAACCT CGGAACAGGG
701 CCGTCTTCTG CCTCCTCGTT GTCGATATAC AGGGTGTGGC TTTCCTCTTC
```

-continued

```
 751 CTCCTGCCCC TCCCCAAGCT CCTGAAGCAG CGATGTCGAA CGCGAACCCA

 801 CCCAATCGAG CAAACCCGCC AACTGGTCAT CCTCGACAAT GACCAACTCA

 851 ACCTCAATCC CTGCGGCAGA AACGGTTTTC TGAATTTGCG GCATCTGTGT

 901 CGGATCGGAA ACCGCAAAAA ATACTTTGTC GCCCCGACGG AAAACCGGCA

 951 CACAGTGGAA CTCCACCATC TGCTCCTCCG TCAACACCCC CATCAGCACC

1001 CTGTGGCGCG GATAATGACG CAAATCAAGA ATCGAATAAC TGAACACCCT

1051 CGCAATCAAT GCCGCAAGCG ACTTGGGCGA AATGACACCG TCTGA
```

This corresponds to the amino acid sequence <SEQ ID 1722; ORF 573>:

m573.pep..

```
  1 MPCLCRLNRN IGSFQITNLT DHNDVRVLTQ ERLQSSGKSQ ALLIIDVNLI

 51 DARQVNLGRV FRRCNIYRLR IQNIQTGIER HRLTRTRRTG YQHHPVGTVN

101 RYQHXFFLKR LKTELVDVQR RGIGIQNPHH DLFAKQRRQC ADTEIDRLAA

151 LLKGQLHPAV LRYPFFGNVQ TRHYLNP*SK LPPYRNGRLN HLAELPVHTE

201 TDTGIVFVKL EMDVRCPAAQ GIRQSLMDKP RNRAVFCLLV VDIQGVAFLF

251 LLPLPKLLKQ RCRTRTHPIE QTRQLVILDN DQLNLNPCGR NGFLNLRHLC

301 RIGNRKKYFV APTENRHTVE LHHLLLRQHP HQHPVARIMT QIKNRITEHP

351 RNQCRKRLGR NDTV*
```

m573/g573 95.9% identity in 364 aa overlap

```
                   10        20        30        40        50        60
m573.pep   MPCLCRLNRNIGSFQITNLTDHNDVRVLTQERLQSSGKSQALLIIDVNLIDARQVNLGRV
           ||||||||||||||||||||||||||||||||||||||||:|||||||||||||||||||
g573       MPCLCRLNRNIGSFQITNLTDHNDVRVLTQERLQSSGKSQTLLIIDVNLIDARQVNLGRV
                   10        20        30        40        50        60

                   70        80        90       100       110       120
m573.pep   FRRCNIYRLRIQNIQTGIERHRLTRTRRTGYQHHPVGTVNRYQHXFFLKRLKTELVDVQR
           |||||||||||||||||||||||||||||||||||| ||||:|: |||:|||||||||||
g573       FRRCNIYRLRIQNIQTGIERHRLTRTRRTGYQHHPVRTVNRFQQQFFLERLKTELVDVQR
                   70        80        90       100       110       120

                  130       140       150       160       170       180
m573.pep   RGIGIQNPHHDLFAKQRRQCADTEIDRLAALLKGQLHPAVLRYPFFGNVQTRHYLNPXSK
           ||||||||||||||||||||||||||||||||||||||:|||||||||||||||||| ||
g573       RGIGIQNPHHDLFAKQRRQCADTEIDRLAALLKGQLHPTVLRYPFFGNVQTRHYLNPGSK
                  130       140       150       160       170       180

                  190       200       210       220       230       240
m573.pep   LPPYRNGRLNHLAELPVHTETDTGIVFVKLEMDVRCPAAQGIRQSLMDKPRNRAVFCLLV
           ||||||||||||||||||||||| |||||||||| |||:||||||:||||||||||||||
g573       LPPYRNGRLNHLAELPVHTETDTRIVFVKLEMDVGCPATQGIRQSFMDKPRNRAVFCLLV
                  190       200       210       220       230       240

                  250       260       270       280       290       300
m573.pep   VDIQGVAFLFLLPLPKLLKQRCRTRTHPIEQTRQLVILDNDQLNLNPCGRNGFLNLRHLC
           |||||||||||||||||||||||||||||||||||||||||||| |||||| ||||||| 
g573       VDIQGVAFLFLLPLPKLLKQRCRTRTHPIEQTRQLVILDNDQLNRNPCGRNRFLNLRHLG
                  250       260       270       280       290       300

                  310       320       330       340       350       360
m573.pep   RIGNRKKYFVAPTENRHTVELHHLLLRQHPHQHPVARIMTQIKNRITEHPRNQCRKRLGR
           ||||||||||||||||||||||||||||||||||||||||||||||||||||||||||||
g573       RIGNRKKYFVAPTENRHTVELHHLLLRQHPHQHPVARIMTQIKNRITEHPRNQCRKRLGR
                  310       320       330       340       350       360

m573.pep   NDTVX
           |||||
g573       NDTVX
```

The following partial DNA sequence was identified in *N. meningitidis* <SEQ ID 1723>:

a573.seq

```
   1 ATGCCCTGTT TGTGCCGCCT TAATCGCAAT ATCGGCAGTT TCCAAATCAC
  51 GAATCTCACC GACCATAATG ATGTCCGGGT CCTGACGCAG GAAAGACTTC
 101 AAAGCAGCGG CAAAAGTCAG ACCCTGCTTA TCATTGACGT TAACCTGATT
 151 GATGCCCGGC AGGTTAATCT CGGCAGGGTC TTCCGCCGTT GCAATATTTA
 201 CCGACTCCGT ATTCAAAATA TTCAAACAGG TATAGAGCGA CACCGTCTTA
 251 CCCGAACCCG TCGGACCGGT TACCAGCACC ATCCCGTAGG GACGGTGAAT
 301 CGCTTCCAAC AACAATTTTT TCTGAAACGG CTCAAAACCG AGCTGGTCGA
 351 TGTTCAAAGA CGCGGCATCG GAATTCAAAA TCCGCATCAC GACCTTTTCG
 401 CCAAACAGCG TCGGCAATGT GCTGACACGG AAATCGACAG GCTTGCCGCC
 451 CTTTTGAAAG GTCAGCTGCA TCCTGCCGTC CTGCGGTATC CGTTTTTCGG
 501 AAATGTCCAA ACGCGACATT ACCTTAATCC GGGAAGCAAG CTGCCCCCTT
 551 ACCGCAATGG GCGGCTGAAC CACCTCGCGG AGCTGCCCGT CCACACGGAA
 601 ACGGATACGG GCATTGTGTT CGTAAAACTC GAAATGGATG TCCGATGCCC
 651 CGCTGCGCAA GGCATCCGAC AAAGTCTTAT GGATAAACCT CGGAACAGGG
 701 CCGTCTTCTG CCTCCTCGTT GTCGATATAC AGGGTGTGGC TTTCCTCTTC
 751 CTCCTGCCCC TCCCCAAGCT CCTGAAGCAG CGATGTCGAA CGCGAACCCA
 801 CCCAATCGAG CAAACCCGCC AACTGGTCAT CCTCGACAAT GACCAACTCA
 851 ACCTCAATCC CTGCGGCAGA AACGGTTTTC TGAATTTGCG GCATCTGTGT
 901 CGGATCGGAA ACCGCAAAAA ATACTTTGTC GCCCCGACGG AAAACCGGCA
 951 CACAGTGGAA CTCCACCATC TGCTCCTCCG TCAACACCCC CATCAGCACC
1001 CTGTGGCGCG GATAATGACG CAAATCAAGA ATCGAATAAC TGAACACCCT
1051 CGCAATCAAT GCCGCAAGCG ACTTGGGCGA AATGACACCG TCTGA
```

This corresponds to the amino acid sequence <SEQ ID 1724; ORF 573.a>:

a573.pep

```
  1 MPCLCRLNRN IGSFQITNLT DHNDVRVLTQ ERLQSSGKSQ TLLIIDVNLI
 51 DARQVNLGRV FRRCNIYRLR IQNIQTGIER HRLTRTRRTG YQHHPVGTVN
101 RFQQQFFLKR LKTELVDVQR RGIGIQNPHH DLFAKQRRQC ADTEIDRLAA
151 LLKGQLHPAV LRYPFFGNVQ TRHYLNPGSK LPPYRNGRLN HLAELPVHTE
201 TDTGIVFVKL EMDVRCPAAQ GIRQSLMDKP RNRAVFCLLV VDIQGVAFLF
251 LLPLPKLLKQ RCRTRTHPIE QTRQLVILDN DQLNLNPCGR NGFLNLRHLC
301 RIGNRKKYFV APTENRHTVE LHHLLLRQHP HQHPVARIMT QIKNRITEHP
351 RNQCRKRLGR NDTV*
```

m573/a573 98.6% identity in 364 aa overlap

```
                   10        20        30        40        50        60
m573.pep   MPCLCRLNRNIGSFQITNLTDHNDVRVLTQERLQSSGKSQALLIIDVNLIDARQVNLGRV
           ||||||||||||||||||||||||||||||||||||||||:|||||||||||||||||||
a573       MPCLCRLNRNIGSFQITNLTDHNDVRVLTQERLQSSGKSQTLLIIDVNLIDARQVNLGRV
                   10        20        30        40        50        60

                   70        80        90       100       110       120
m573.pep   FRRCNIYRLRIQNIQTGIERHRLTRTRRTGYQHHPVGTVNRYQHXFFLKRLKTELVDVQR
           |||||||||||||||||||||||||||||||||||||||||:|: |||||||||||||||
a573       FRRCNIYRLRIQNIQTGIERHRLTRTRRTGYQHHPVGTVNRFQQQFFLKRLKTELVDVQR
                   70        80        90       100       110       120

                  130       140       150       160       170       180
m573.pep   RGIGIQNPHHDLFAKQRRQCADTEIDRLAALLKGQLHPAVLRYPFFGNVQTRHYLNPXSK
           ||||||||||||||||||||||||||||||||||||||||||||||||||||||||| ||
a573       RGIGIQNPHHDLFAKQRRQCADTEIDRLAALLKGQLHPAVLRYPFFGNVQTRHYLNPGSK
                  130       140       150       160       170       180

                  190       200       210       220       230       240
m573.pep   LPPYRNGRLNHLAELPVHTETDTGIVFVKLEMDVRCPAAQGIRQSLMDKPRNRAVFCLLV
           ||||||||||||||||||||||||||||||||||||||||||||||||||||||||||||
a573       LPPYRNGRLNHLAELPVHTETDTGIVFVKLEMDVRCPAAQGIRQSLMDKPRNRAVFCLLV
                  190       200       210       220       230       240

                  250       260       270       280       290       300
m573.pep   VDIQGVAFLFLLPLPKLLKQRCRTRTHPIEQTRQLVILDNDQLNLNPCGRNGFLNLRHLC
           ||||||||||||||||||||||||||||||||||||||||||||||||||||||||||||
a573       VDIQGVAFLFLLPLPKLLKQRCRTRTHPIEQTRQLVILDNDQLNLNPCGRNGFLNLRHLC
                  250       260       270       280       290       300

                  310       320       330       340       350       360
m573.pep   RIGNRKKYFVAPTENRHTVELHHLLLRQHPHQHPVARIMTQIKNRITEHPRNQCRKRLGR
           ||||||||||||||||||||||||||||||||||||||||||||||||||||||||||||
a573       RIGNRKKYFVAPTENRHTVELHHLLLRQHPHQHPVARIMTQIKNRITEHPRNQCRKRLGR
                  310       320       330       340       350       360

m573.pep   NDTVX
           |||||
a573       NDTVX
```

The following partial DNA sequence was identified in *N. gonorrhoeae* <SEQ ID 1725>:

g574.seq

```
  1 atgctgccga atctgccaaa cagccttaag aaagccgata tggacaacga
 51 attgtggatt atcctgctgc cgattatcct tttgcccgtc ttcttcacga
101 tgggctggtt tgccgcccgc gtggatatga aaaccgtatt gaagcaggca
151 aaaagcatcc cttcgggatt ttataaaagc ctggacgctt tggtcgaccg
201 caacagcggg cgcgcggcaa gggagttggc ggaagtcgtc gacggccggc
251 cgcaatcgta tgatttgaac cttaccctcg gcaaacttta ccgtcagcgc
301 ggcgaaaacg acaaagccat caacatacac cggacaatgc tcgattctcc
351 cgatacggtc ggcgaaaagc gcgcgcgcgt cctgtttgaa ttggcgcaaa
401 actaccaaag cgcgggtttg gtcgatcgtg ccgaacagat ttttttgggg
451 ctgcaagacg gtgaaatggc gcgtgaagcc agacagcacc tgctcaatat
501 ctaccagcag gacagggatt gggaaaaagc ggttgaaacc gcccaacttc
551 ttagtcacga cgaacagaca tatcagtttg agattgcaca gttttattgc
601 gaacttgccc aagccgcgct gttcaagtcc aatttcgatg ccgcgcgttt
651 caatgtcggc aaggcactcg aagccaacaa aaaatgcacc cgcgccaaca
701 tgattttggg cgacattgaa caccgacaag gcaatttccc tgccgccgtc
751 gaagcctatg ccgccatcga gcagcaaaac catgcatact tgagcatggt
801 cggcgagaag ctttacgaag cctatgccgc gcagggaaaa cctgaagaag
851 gcttgaaccg tctgacagga tatatgcaga cgtttcccga acttgacctg
```

-continued

```
 901 atcaatgtcg tgtacgagaa atccctgctg cttaagggcg agaaagaagc

 951 cgcgcaaacc gccgtcgagc ttgtccgccg caagcccgac cttaacggcg

1001 tgtaccgcct gctcggtttg aaactcagcg atttggatcc ggcttggaaa

1051 gccgatgccg acatgatgcg ttcggttatc ggacggcagc tccagcgcag

1101 cgtgatgtac cgttgccgca actgccactt caaatcccaa gtctttttct

1151 ggcactgtcc cgcctgcaac aaatggcaga cgtttacgcc gaataaaatc

1201 gaagtttaa
```

This corresponds to the amino acid sequence <SEQ ID 1726; ORF 574.ng>:

g574.pep..

```
  1 MLPNLPNSLK KADMDNELWI ILLPIILLPV FFTMGWFAAR VDMKTVLKQA

 51 KSIPSGFYKS LDALVDRNSG RAARELAEVV DGRPQSYDLN LTLGKLYRQR

101 GENDKAINIH RTMLDSPDTV GEKRARVLFE LAQNYQSAGL VDRAEQIFLG

151 LQDGEMAREA RQHLLNIYQQ DRDWEKAVET AQLLSHDEQT YQFEIAQFYC

201 ELAQAALFKS NFDAARFNVG KALEANKKCT RANMILGDIE HRQGNFPAAV

251 EAYAAIEQQN HAYLSMVGEK LYEAYAAQGK PEEGLNRLTG YMQTFPELDL

301 INVVYEKSLL LKGEKEAAQT AVELVRRKPD LNGVYRLLGL KLSDLDPAWK

351 ADADMMRSVI GRQLQRSVMY RCRNCHFKSQ VFFWHCPACN KWQTFTPNKI

401 EV*
```

The following partial DNA sequence was identified in *N. meningitidis* <SEQ ID 1727>:

m574.seq..

```
  1 ATGCGCCCGA ATCTACCAAA CAGCCTTAAG AAAGCCGATA TGGACAACGA

 51 ATTGTGGATT ATCCTGCTGC CGATTATCCT TTTGCCCGTC TTCTTCGCGA

101 TGGGCTGGTT TGCCGCCCGC GTGGATATGA AAACCGTATT GAAGCAGGCA

151 AAAAGCATCC CTTCGGGATT TTATAAAAGC TTGGACGCTT TGGTCGACCG

201 CAACAGCGGG CGCGCGGCAA GGGAGTTGGC GGAAGTCGTC GACGGCCGGC

251 CGCAATCGTA TGATTTGAAC CTCACCCTCG GCAAACTTTA CCGCCAGCGT

301 GGCGAAAACG ACAAAGCCAT CAACATACAC CGGACAATGC TCGATTCTCC

351 CGATACGGTC GGCGAAAAGC GCGCGCGCGT CCTGTTTGAA TTGGCGCAAA

401 ACTACCAAAG TGCGGGGTTG GTCGATCGTG CCGAACAGAT TTTTTTGGGG

451 CTGCAAGACG GTAAAATGGC GCGTGAAGCC AGACAGCACC TGCTCAATAT

501 CTACCAACAG GACAGGGATT GGGAAAAAGC GGTTGAAACC GCCCGGCTGC

551 TCAGCCATGA CGATCAGACC TATCAGTTTG AAATCGCCCA GTTTTATTGC

601 GAACTTGCCC AAGCCGCGCT GTTCAAGTCC AATTTCGATG TCGCGCGTTT

651 CAATGTCGGC AAGGCACTCG AAGCCAACAA AAAATGCACC CGCGCCAACA

701 TGATTTTGGG CGACATCGAA CACCGACAAG GCAATTTCCC TGCCGCCGTC

751 GAAGCCTATG CCGCCATCGA GCAGCAAAAC CATGCATACT TGAGCATGGT
```

-continued

```
 801 CGGCGAGAAG CTTTACGAAG CCTATGCCGC GCAGGGAAAA CCTGAAGAAG

 851 GCTTGAACCG TCTGACAGGA TATATGCAGA CGTTTCCCGA ACTTGACCTG

 901 ATCAATGTCG TGTACGAGAA ATCCCTGCTG CTTAAGTGCG AGAAAGAAGC

 951 CGCGCAAACC GCCGTCGAGC TTGTCCGCCG CAAGCCCGAC CTTAACGGCG

1001 TGTACCGCCT GCTCGGTTTG AAACTCAGCG ATATGAATCC GGCTTGGAAA

1051 GCCGATGCCG ACATGATGCG TTCGGTTATC GGACGGCAGC TACAGCGCAG

1101 CGTGATGTAC CGTTGCCGCA ACTGCCACTT CAAATCCCAA GTCTTTTTCT

1151 GGCACTGCCC CGCCTGCAAC AAATGGCAGA CGTTTACCCC GAATAAAATC

1201 GAAGTTTAA
```

This corresponds to the amino acid sequence <SEQ ID 1728; ORF 574>:

```
m574.pep..

  1 MRPNLPNSLK KADMDNELWI ILLPIILLPV FFAMGWFAAR VDMKTVLKQA

 51 KSIPSGFYKS LDALVDRNSG RAARELAEVV DGRPQSYDLN LTLGKLYRQR

101 GENDKAINIH RTMLDSPDTV GEKRARVLFE LAQNYQSAGL VDRAEQIFLG

151 LQDGKMAREA RQHLLNIYQQ DRDWEKAVET ARLLSHDDQT YQFEIAQFYC

201 ELAQAALFKS NFDVARFNVG KALEANKKCT RANMILGDIE HRQGNFPAAV

251 EAYAAIEQQN HAYLSMVGEK LYEAYAAQGK PEEGLNRLTG YMQTFPELDL

301 INVVYEKSLL LKCEKEAAQT AVELVRRKPD LNGVYRLLGL KLSDMNPAWK

351 ADADMMRSVI GRQLQRSVMY RCRNCHFKSQ VFFWHCPACN KWQTFTPNKI

401 EV*
```

m573/g573 97.8% identity in 402 aa overlap

```
                    10        20        30        40        50        60
m574.pep    MRPNLPNSLKKADMDNELWIILLPIILLPVFFAMGWFAARVDMKTVLKQAKSIPSGFYKS
            | ||||||||||||||||||||||||||||||:|||||||||||||||||||||||||||
g574        MLPNLPNSLKKADMDNELWIILLPIILLPVFFTMGWFAARVDMKTVLKQAKSIPSGFYKS
                    10        20        30        40        50        60

                    70        80        90       100       110       120
m574.pep    LDALVDRNSGRAARELAEVVDGRPQSYDLNLTLGKLYRQRGENDKAINIHRTMLDSPDTV
            ||||||||||||||||||||||||||||||||||||||||||||||||||||||||||||
g574        LDALVDRNSGRAARELAEVVDGRPQSYDLNLTLGKLYRQRGENDKAINIHRTMLDSPDTV
                    70        80        90       100       110       120

                   130       140       150       160       170       180
m574.pep    GEKRARVLFELAQNYQSAGLVDRAEQIFLGLQDGKMAREARQHLLNIYQQDRDWEKAVET
            ||||||||||||||||||||||||||||||||||:|||||||||||||||||||||||||
g574        GEKRARVLFELAQNYQSAGLVDRAEQIFLGLQDGEMAREARQHLLNIYQQDRDWEKAVET
                   130       140       150       160       170       180

                   190       200       210       220       230       240
m574.pep    ARLLSHDDQTYQFEIAQFYCELAQAALFKSNFDVARFNVGKALEANKKCTRANMILGDIE
            |:|||||:|||||||||||||||||||||||||:||||||||||||||||||||||||||
g574        AQLLSHDEQTYQFEIAQFYCELAQAALFKSNFDAARFNVGKALEANKKCTRANMILGDIE
                   190       200       210       220       230       240

                   250       260       270       280       290       300
m574.pep    HRQGNFPAAVEAYAAIEQQNHAYLSMVGEKLYEAYAAQGKPEEGLNRLTGYMQTFPELDL
            ||||||||||||||||||||||||||||||||||||||||||||||||||||||||||||
g574        HRQGNFPAAVEAYAAIEQQNHAYLSMVGEKLYEAYAAQGKPEEGLNRLTGYMQTFPELDL
                   250       260       270       280       290       300

                   310       320       330       340       350       360
m574.pep    INVVYEKSLLLKCEKEAAQTAVELVRRKPDLNGVYRLLGLKLSDMNPAWKADADMMRSVI
            |||||||||||| ||||||||||||||||||||||||||||||||::|||||||||||||
g574        INVVYEKSLLLKGEKEAAQTAVELVRRKPDLNGVYRLLGLKLSDLDPAWKADADMMRSVI
                   310       320       330       340       350       360
```

-continued

```
                370        380        390        400
m574.pep   GRQLQRSVMYRCRNCHFKSQVFFWHCPACNKWQTFTPNKIEVX
           |||||||||||||||||||||||||||||||||||||||||||
g574       GRQLQRSVMYRCRNCHFKSQVFFWHCPACNKWQTFTPNKIEVX
                370        380        390        400
```

The following partial DNA sequence was identified in *N. meningitidis* <SEQ ID 1729>:

a574.seq

```
   1 ATGCGCCCGA ATCTGCCAAA CAGCCTTGAG AAAGCCGATA TGGACAATGA
  51 ATTGTGGATT ATCCTGCTGC CGATTATCCT TTTGCCCGTT TTCTTCGCGA
 101 TGGGCTGGTT TGCCGCCCGC GTGGATATGA AGACTGTATT AAAGCAGGCA
 151 AAAAGCATAC CGTCGGGATT TTATAAAAGT CTGGATGCCT TGGTTGACCG
 201 CAACAGCGGG CGCGCGGCAA GGGAGTTGGC GGAAGTCGTC GACGGCCGGC
 251 CGCAATCGTA TGATTTGAAC CTCACCCTCG GCAAACTTTA CCGCCAGCGT
 301 GGCGAAAACG ACAAAGCCAT CAATATGCAC CAAACATTGC TTGACTCTCC
 351 CGATACAACC GGAGCCAAGC GCGCGCGCGT CCTGTTTGAA TTGGCGCAAA
 401 ACTACCAAAG TGCGGGGTTG GTCGATCGTG CCGAACAGAT TTTTTTGGGG
 451 CTGCAAGACG GTGAAATGGC GCGTGAAGCC AGACAGCACC TGCTCAATAT
 501 CTACCAACAG GACAGGGATT GGGAAAAAGC GGTTGAAACC GCCCGGCTGC
 551 TCAGCCATGA CGATCAGACC TATCAGTTTG AAATCGCCCA GTTTTATTGC
 601 GAACTTGCCC AAGCCGCGCT GTTCAAGTCC AATTTCGATG CCGCGCGTTT
 651 CAATGTCGGC AAGGCACTCG AAGCCAACAA AAAATGCACC CGCGCCAACA
 701 TGATTTTGGG CGACATCGAA CACCGACAAG GCAATTTCCC TGCCGCCGTC
 751 GAAGCCTATG CCGCCATCGA GCAGCAAAAC CATGCATACT TGAGTATGGT
 801 CGGCGAGAAG CTTTACGAAG CCTATGCCGC GCAGGGAAAA CCTGAAGAAG
 851 GCTTGAACCG TCTGACAGGA TATATGCAGA CGTTTCCCGA ACTTGACCTG
 901 ATCAATGTCG TGTACGAGAA ATCCCTGCTG CTTAAGTGCG AGAAAGAAGC
 951 CGCGCAAACC GCCGTCGAGC TTGTCCGCCG CAAGCCCGAC CTCAACGGCG
1001 TGTACCGCCT GCTTGGTTTG AAACTCAGCG ATTTGGATCC GGCTTGGAAA
1051 GCCGATGCCG ATATGATGCG TTCGGTTATC GGACGGCAGC TACAGCGCAG
1101 CGTGATGTAC CGGTGCCGAA ACTGCCACTT CAAATCACAA GTCTTTTTCT
1151 GGCATTGTCC TGCCTGCAAC AAATGGCAGA CGTTTACGCC AAACAAAATC
1201 GAAGTTTAA
```

This corresponds to the amino acid sequence <SEQ ID 1730; ORF 574.a>:

a574.pep

```
  1 MRPNLPNSLE KADMDNELWI ILLPIILLPV FFAMGWFAAR VDMKTVLKQA
 51 KSIPSGFYKS LDALVDRNSG RAARELAEVV DGRPQSYDLN LTLGKLYRQR
101 GENDKAINMH QTLLDSPDTT GAKRARVLFE LAQNYQSAGL VDRAEQIFLG
```

-continued

```
151 LQDGEMAREA RQHLLNIYQQ DRDWEKAVET ARLLSHDDQT YQFEIAQFYC

201 ELAQAALFKS NFDAARFNVG KALEANKKCT RANMILGDIE HRQGNFPAAV

251 EAYAAIEQQN HAYLSMVGEK LYEAYAAQGK PEEGLNRLTG YMQTFPELDL

301 INVVYEKSLL LKCEKEAAQT AVELVRRKPD LNGVYRLLGL KLSDLDPAWK

351 ADADMMRSVI GRQLQRSVMY RCRNCHFKSQ VFFWHCPACN KWQTFTPNKI

401 EV*
```

m574/a574 97.5% identity in 402 aa overlap

```
                    10        20        30        40        50        60
m574.pep   MRPNLPNSLKKADMDNELWIILLPIILLPVFFAMGWFAARVDMKTVLKQAKSIPSGFYKS
           |||||||||:||||||||||||||||||||||||||||||||||||||||||||||||||
a574       MRPNLPNSLEKADMDNELWIILLPIILLPVFFAMGWFAARVDMKTVLKQAKSIPSGFYKS
                    10        20        30        40        50        60

                    70        80        90       100       110       120
m574.pep   LDALVDRNSGRAARELAEVVDGRPQSYDLNLTLGKLYRQRGENDKAINIHRTMLDSPDTV
           ||||||||||||||||||||||||||||||||||||||||||||||||:|:|:||||||:
a574       LDALVDRNSGRAARELAEVVDGRPQSYDLNLTLGKLYRQRGENDKAINMHQTLLDSPDTT
                    70        80        90       100       110       120

                   130       140       150       160       170       180
m574.pep   GEKRARVLFELAQNYQSAGLVDRAEQIFLGLQDGKMAREARQHLLNIYQQDRDWEKAVET
           | ||||||||||||||||||||||||||||||||:|||||||||||||||||||||||||
a574       GAKRARVLFELAQNYQSAGLVDRAEQIFLGLQDGEMAREARQHLLNIYQQDRDWEKAVET
                   130       140       150       160       170       180

                   190       200       210       220       230       240
m574.pep   ARLLSHDDQTYQFEIAQFYCELAQAALFKSNFDVARFNVGKALEANKKCTRANMILGDIE
           |||||||||||||||||||||||||||||||||:||||||||||||||||||||||||||
a574       ARLLSHDDQTYQFEIAQFYCELAQAALFKSNFDAARFNVGKALEANKKCTRANMILGDIE
                   190       200       210       220       230       240

                   250       260       270       280       290       300
m574.pep   HRQGNFPAAVEAYAAIEQQNHAYLSMVGEKLYEAYAAQGKPEEGLNRLTGYMQTFPELDL
           ||||||||||||||||||||||||||||||||||||||||||||||||||||||||||||
a574       HRQGNFPAAVEAYAAIEQQNHAYLSMVGEKLYEAYAAQGKPEEGLNRLTGYMQTFPELDL
                   250       260       270       280       290       300

                   310       320       330       340       350       360
m574.pep   INVVYEKSLLLKCEKEAAQTAVELVRRKPDLNGVYRLLGLKLSDMNPAWKADADMMRSVI
           ||||||||||||||||||||||||||||||||||||||||||||::||||||||||||||
a574       INVVYEKSLLLKCEKEAAQTAVELVRRKPDLNGVYRLLGLKLSDLDPAWKADADMMRSVI
                   310       320       330       340       350       360

                   370       380       390       400
m574.pep   GRQLQRSVMYRCRNCHFKSQVFFWHCPACNKWQTFTPNKIEVX
           ||||||||||||||||||||||||||||||||||||||||||
a574       GRQLQRSVMYRCRNCHFKSQVFFWHCPACNKWQTFTPNKIEVX
                   370       380       390       400
```

The following partial DNA sequence was identified in *N. gonorrhoeae* <SEQ ID 1731>:

<u>g575.seq (partial)</u>

```
  1 ..atgccgtgcc tccgccggca agcagcaagg tgtacgaacc gccgaacaga

 51   ccgtcaaaca gtccgctttc ggtttcttct tcggcagaaa cctgttcgac

101   aggttcggca acgggttcgg cggcaacttc actggctgtt tccgcaacag

151   gttcggaaac ggtgttaccg gtttcgtcgg tcggcgtgtc gatggcagaa

201   gcggcggctt cttggggggg cggattcggc agcggtttcc gatgcggcag

251   tatttgcagc gggtacaggt ccgggttggc gttctgtcgc cgaagccgga

301   gtttcggaca ctgcgggttt gggttcgggt cgaacggccg gtttttccgc

351   ttttgcttcg ggcgcggcaa cttttgcttc aggtttttca accggttttt

401   cgacaggttt ctctatcggt ttctccacag ttgcctgttt ggacggttca
```

-continued

```
451   gacggcatgg atgcagtttc ggctttgggt ttcgccgttt gcggtttggg

501   ttgttccgct ttgatttttt tgggtgctgc cgctttgatc ctgttcagat

551   tcggaatgtg a*
```

This corresponds to the amino acid sequence <SEQ ID 1732; ORF 575.ng>:

g575.pep (partial)

```
  1 ..MPCLRRQAAR CTNRRTDRQT VRFRFLLRQK PVRQVRQRVR RQLHWLFPQQ

 51   VRKRCYRFRR SACRWQKRRL LGGADSAAVS DAAVFAAGTG PGWRSVAEAG

101   VSDTAGLGSG RTAGFSAFAS GAATFASGFS TGFSTGFSIG FSTVACLDGS

151   DGMDAVSALG FAVCGLGCSA LIFLGAAALI LFRFGM*
```

The following partial DNA sequence was identified in *N. meningitidis* <SEQ ID 1733>:

m575.seq..

```
   1 ATGGTTTCGG GCGAGGAAGC CTTCAGGAAG CCTGCCAGTC CGGAGGGTGA

  51 GGCAGGTTTT GCGGAAGCTG TTTCTTCTGT GCCGATATGG TTGTTTGAGG

 101 GCAGGTTGTC GGAGAAATCG GTATCGACGG TTTCCGGTTT GTTTTCGGCA

 151 GTTTGGGCGA CAGATTCCGG TTCGGGCGTG TCGATGACGA TTTCGACAGG

 201 GTTGTACGGG TTGAAGGTCT CGGGCTCGTA CACGCTGTCT GTGGATTCGA

 251 TGGCGTTCCA ATCGGCATCC GCGCGTTTTT GGGTTTCTTC ATCCTGCGTA

 301 AGTGCGCCGG ATAAAATGCC GTTTTGCGCG GCTGCCAGGC TGTCGAAATC

 351 CAAGTCGATG CGGTTGGAAG GCGTATCGGT TTCGACATCG AACGTTTGTT

 401 TTGCCGATAA CTCTTCTTCA GATTCCCCAT CTAAGGCAAG TGTGTCGTTT

 451 ACATCGTTTT TCGGAGCGGG TTCGGGCGTT GCCGGAGTTT CGACTTCGGC

 501 AAAGGTGATT TCTATGCCGT CGTCTGCCGC GTCGTCAAGG TCAGGCTCTT

 551 CCTCAGGGAC GGATTCTTCG GTACGGCGCG CGCGTTTGGA TTGGGCAAGG

 601 CGCAAAAGCA GCAGCAGGGC GATTAATGCC GCGCCTCCGC CGGCAAGCAG

 651 CAAGGTGTAC GAACCGCCGA ACAGACCGTC AAACAGTCCG CTTTCGGTTT

 701 CTTCTTCGGC AGAAACCTGT TCGACAGGTT CGGAAACGGC GTTACCGGTT

 751 TCGTCGGTCG GCGTGTCGAT GGCAGAAGCG GCGGCTTCTT GGGGGGCGGA

 801 TTCGGCAGCG GTTTCCGATG CGGCAGTATT TGCAGCGGGT ACAGGTTCGG

 851 GTCGAACGGC CGGTTTTTCC GCTTTTGCTT CGGGCGCGGC AACTTTTGCT

 901 TCAGGTTTTT CAACCGGTTT CTCTACCGTT GCCTGTTTGG ACGGTTCGGA

 951 CGGCATGGAT GCGGTTTCGG CTTTGGGTTT CGCCGTTTGC GGTTTGGGTT

1001 GTTCCGCTTT GATCCTGTTC AGATTCGGAA TGTGA
```

This corresponds to the amino acid sequence <SEQ ID 1734; ORF 575>:

m575.pep

```
  1 MVSGEEAFRK PASPEGEAGF AEAVSSVPIW LFEGRLSEKS VSTVSGLFSA

 51 VWATDSGSGV SMTISTGLYG LKVSGSYTLS VDSMAFQSAS ARFWVSSSCV

101 SAPDKMPFCA AARLSKSKSM RLEGVSVSTS NVCFADNSSS DSPSKASVSF

151 TSFFGAGSGV AGVSTSAKVI SMPSSAASSR SGSSSGTDSS VRRARLDWAR

201 RKSSSRAINA APPPASSKVY EPPNRPSNSP LSVSSSAETC STGSETALPV

251 SSVGVSMAEA AASWGADSAA VSDAAVFAAG TGSGRTAGFS AFASGAATFA

301 SGFSTGFSTV ACLDGSDGMD AVSALGFAVC GLGCSALILF RFGM*
```

m575/g575 70.2% identity in 114 aa overlap

```
                240       250       260       270       280
m575.pep   SSAETCSTGSETALPVSSVGVSMAEAAASWGADSAAVSDAAVFAAGTG------------
                                              |||||||||||||||||
g575       LHWLFPQQVRKRCYRFRRSACRWQKRRLLGGADSAAVSDAAVFAAGTGPGWRSVAEAGVS
                   50        60        70        80        90       100
                        290       300       309       310       320
m575.pep   ------SGRTAGFSAFASGAATFASGFSTGFST--------VACLDGSDGMDAVSALGFA
                 |||||||||||||||||||||||||||        ||||||||||||||||||
g575       DTAGLGSGRTAGFSAFASGAATFASGFSTGFSTGFSIGFSTVACLDGSDGMDAVSALGFA
                  110       120       130       140       150       160
          330                 340
m575.pep   VCGLGCSALI--------LFRFGMX
           ||||||||||        |||||||
g575       VCGLGCSALIFLGAAALILFRFGMX
                  170       180
```

The following partial DNA sequence was identified in *N. meningitidis* <SEQ ID 1735>:

a575.seq

```
  1 ATGGTTTCGG GCGAGGAAGC CTTCAGGAAG CCTGCCAGTC CGGAGGGTGA

 51 GGCAGGTTTT GCGGAAGCTG TTTCTTCTGT GCCGATATGG TTGTTTGAGG

101 GCAGGTTGTC GGAGAAATCG GTATCGACGG TTTCCGGTTT GTTTTCGGCA

151 GTTTGGGCGA CAGATTCCGG TTCGGGCGTG TCGATGACGA TTTCGACAGG

201 GTTGTACGGG TTGAAGGTCT CGGGCTCGTA CACGCTGTCT GTGGATTCGA

251 TGGCGTTCCA ATCGGCATCC GCGCGTTTTT GGGTTTCTTC ATCCTGCGTA

301 AGTGCGCCGG ATAAAATGCC GTTTTGCGCG GCTGCCAGGC TGTCGAAATC

351 CAAGTCGATG CGGTTGGAAG GCGTATCGGT TTCGACATCG AACGTTTGTT

401 TTGCCGACAA CTCTTCTTCA GATTCCCCAT CTAAGGCAAG TGTGTCGTTT

451 ACATCGTTTT TCGGAGCGGG TTCGGGCGTT GCCGGAGTTT CGACTTCGGC

501 AAAGGTGATT TCTATGCCGT CGTCTGCCGC GTCGTCAAGG TCAGGCTCTT

551 CCTCAGGGAC GGATTCTTCG GTACGGCGCG CGCGTTTGGA TTGGGCAAGG

601 CGCAAAAGCA GCAGCAGGGC GATCAATGCC GCGCCTCCGC CGGCAAGCAG

651 CAAGGTGTAC GAACCGCCGA ACAGTCCGCT TTCGGTTTCT TCTTCGGCAG

701 AAACCTGTTC GACAGGTTCG GAAACGGCGT TACCGGTTTC GTCGGTCGGC

751 GTGTCGATGG CAGAAGCGGC GGCTTCTTGG GGGGCGGATT CGGCAGCGGT

801 TTCCGATGCG GCAGTATTTG CAGCGGGTAC AGGTTCGGGT CGAACGGCCG
```

-continued

```
 851 GTTTTTCCGC TTTTGCTTCG GGCGCGGCAA CTTTTGCTTC AGGTTTTTCA

 901 ACCGGTTTCT CTACCGTTGC CTGTTTGGAC GGTTCGGACG GCATGGATGC

 951 GGTTTCGGCT TTGGGTTTCG CCGTTTGCGG TTTGGGTTGT TCCGCTTTGA

1001 TCCTGTTCAG ATTCGGAATG TGA
```

This corresponds to the amino acid sequence <SEQ ID 1736; ORF 575.a>:

a575.pep

```
  1 MVSGEEAFRK PASPEGEAGF AEAVSSVPIW LFEGRLSEKS VSTVSGLFSA

 51 VWATDSGSGV SMTISTGLYG LKVSGSYTLS VDSMAFQSAS ARFWVSSSCV

101 SAPDKMPFCA AARLSKSKSM RLEGVSVSTS NVCFADNSSS DSPSKASVSF

151 TSFFGAGSGV AGVSTSAKVI SMPSSAASSR SGSSSGTDSS VRRARLDWAR

201 RKSSSRAINA APPPASSKVY EPPNSPLSVS SSAETCSTGS ETALPVSSVG

251 VSMAEAAASW GADSAAVSDA AVFAAGTGSG RTAGFSAFAS GAATFASGFS

301 TGFSTVACLD GSDGMDAVSA LGFAVCGLGC SALILFRFGM *
```

m575/a575 98.8% identity in 344 aa overlap

```
                  10        20        30        40        50        60
m575.pep   MVSGEEAFRKPASPEGEAGFAEAVSSVPIWLFEGRLSEKSVSTVSGLFSAVWATDSGSGV
           ||||||||||||||||||||||||||||||||||||||||||||||||||||||||||||
a575       MVSGEEAFRKPASPEGEAGFAEAVSSVPIWLFEGRLSEKSVSTVSGLFSAVWATDSGSGV
                  10        20        30        40        50        60

                  70        80        90       100       110       120
m575.pep   SMTISTGLYGLKVSGSYTLSVDSMAFQSASARFWVSSSCVSAPDKMPFCAAARLSKSKSM
           ||||||||||||||||||||||||||||||||||||||||||||||||||||||||||||
a575       SMTISTGLYGLKVSGSYTLSVDSMAFQSASARFWVSSSCVSAPDKMPFCAAARLSKSKSM
                  70        80        90       100       110       120

                 130       140       150       160       170       180
m575.pep   RLEGVSVSTSNVCFADNSSSDSPSKASVSFTSFFGAGSGVAGVSTSAKVISMPSSAASSR
           ||||||||||||||||||||||||||||||||||||||||||||||||||||||||||||
a575       RLEGVSVSTSNVCFADNSSSDSPSKASVSFTSFFGAGSGVAGVSTSAKVISMPSSAASSR
                 130       140       150       160       170       180

                 190       200       210       220       230       240
m575.pep   SGSSSGTDSSVRRARLDWARRKSSSRAINAAPPPASSKVYEPPNRPSNSPLSVSSSAETC
           ||||||||||||||||||||||||||||||||||||||||||||    ||||||||||||
a575       SGSSSGTDSSVRRARLDWARRKSSSRAINAAPPPASSKVYEPPN----SPLSVSSSAETC
                 190       200       210       220           230

                 250       260       270       280       290       300
m575.pep   STGSETALPVSSVGVSMAEAAASWGADSAAVSDAAVFAAGTGSGRTAGFSAFASGAATFA
           ||||||||||||||||||||||||||||||||||||||||||||||||||||||||||||
a575       STGSETALPVSSVGVSMAEAAASWGADSAAVSDAAVFAAGTGSGRTAGFSAFASGAATFA
            240       250       260       270       280       290

                 310       320       330       340
m575.pep   SGFSTGFSTVACLDGSDGMDAVSALGFAVCGLGCSALILFRFGMX
           |||||||||||||||||||||||||||||||||||||||||||||
a575       SGFSTGFSTVACLDGSDGMDAVSALGFAVCGLGCSALILFRFGMX
            300       310       320       330       340
```

The following partial DNA sequence was identified in *N. gonorrhoeae* <SEQ ID 1737>:

g576.seq.. (partial)

```
  1 ..atgggcgtgg acatcggacg ctccctgaaa caaatgaagg aacagggcgc

 51   ggaaatcgat ttgaaagtct ttaccgatgc catgcaggca gtgtatgacg

101   gcaaagaaat caaaatgacc gaagagcagg cccaggaagt gatgatgaaa
```

-continued

```
151   ttcctgcagg agcagcaggc taaagccgta gaaaaacaca aggcggatgc
201   gaaggccaac aaagaaaaag gcgaagcctt cctgaaggaa aatgccgccg
251   aagacggcgt gaagaccact gcttccggtc tgcagtacaa aatcaccaaa
301   cagggtgaag gcaaacagcc gacaaaagac gacatcgtta ccgtggaata
351   cgaaggccgc ctgattgacg gtaccgtatt cgacagcagc aaagccaacg
401   gcggcccggc caccttccct ttgagccaag tgattccggg ttggaccgaa
451   ggcgtacggc ttctgaaaga aggcggcgaa gccacgttct acatcccgtc
501   caaccttgcc taccgcgaac agggtgcggg cgaaaaaatc ggtccgaacg
551   ccactttggt atttgacgtg aaactggtca aaatcggcgc acccgaaaac
601   gcgcccgcca agcagccgga tcaagtcgac atcaaaaaag taaattaa
```

This corresponds to the amino acid sequence <SEQ ID 1738; ORF 576.ng>:

g576.pep.. (partial)

```
  1 ..MGVDIGRSLK QMKEQGAEID LKVFTDAMQA VYDGKEIKMT EEQAQEVMMK
 51   FLQEQQAKAV EKHKADAKAN KEKGEAFLKE NAAEDGVKTT ASGLQYKITK
101   QGEGKQPTKD DIVTVEYEGR LIDGTVFDSS KANGGPATFP LSQVIPGWTE
151   GVRLLKEGGE ATFYIPSNLA YREQGAGEKI GPNATLVFDV KLVKIGAPEN
201   APAKQPDQVD IKKVN*
```

The following partial DNA sequence was identified in *N. meningitidis* <SEQ ID 1739>:

m576.seq.. (partial)

```
  1 ..ATGCAGCAGG CAAGCTATGC GATGGGCGTG GACATCGGAC GCTCCCTGAA
 51   GCAAATGAAG GAACAGGGCG CGGAAATCGA TTTGAAAGTC TTTACCGAAG
101   CCATGCAGGC AGTGTATGAC GGCAAAGAAA TCAAAATGAC CGAAGAGCAG
151   GCTCAGGAAG TCATGATGAA ATTCCTTCAG GAACAACAGG CTAAAGCCGT
201   AGAAAAACAC AAGGCGGACG CGAAGGCCAA TAAAGAAAAA GGCGAAGCCT
251   TTCTGAAAGA AAATGCCGCC AAAGACGGCG TGAAGACCAC TGCTTCCGGC
301   CTGCAATACA AAATCACCAA ACAGGGCGAA GGCAAACAGC CGACCAAAGA
351   CGACATCGTT ACCGTGGAAT ACGAAGGCCG CCTGATTGAC GGTACGGTAT
401   TCGACAGCAG CAAAGCCAAC GGCGGCCCGG TCACCTTCCC TTTGAGCCAA
451   GTGATTCCGG GTTGGACCGA AGgCGTACAG CTTCTGAAAG AAGGCGGCGA
501   AGCCACGTTC TACATCCCGT CCAACCTTGC CTACCGCGAA CAGGGTGCGG
551   GCGACAAAAT CGGTCCGAAC GCCACTTTGG TATTTGATGT GAAACTGGTC
601   AAAATCGGCG CACCCGAAAA CGCGCCCGCC AAGCAGCCGG CTCAAGTCGA
651   CATCAAAAAA GTAAATTAA
```

This corresponds to the amino acid sequence <SEQ ID 1740; ORF 576>:

m576.pep.. (partial)

```
  1 ..MQQASYAMGV DIGRSLKQMK EQGAEIDLKV FTEAMQAVYD GKEIKMTEEQ
 51   AQEVMMKFLQ EQQAKAVEKH KADAKANKEK GEAFLKENAA KDGVKTTASG
101   LQYKITKQGE GKQPTKDDIV TVEYEGRLID GTVFDSSKAN GGPVTFPLSQ
151   VIPGWTEGVQ LLKEGGEATF YIPSNLAYRE QGAGDKIGPN ATLVFDVKLV
201   KIGAPENAPA KQPAQVDIKK VN*
```

Computer analysis of this amino acid sequence gave the following results:

Homology with a predicted ORF from *N. gonorrhoeae* m576/g576 97.2% identity in 215 aa overlap

```
                   10        20        30        40        50        60
m576.pep   MQQASYAMGVDIGRSLKQMKEQGAEIDLKVFTEAMQAVYDGKEIKMTEEQAQEVMMKFLQ
                  |||||||||||||||||||||||:||||||||||||||||||||||||||
g576              MGVDIGRSLKQMKEQGAEIDLKVFTDAMQAVYDGKEIKMTEEQAQEVMMKFLQ
                          10        20        30        40        50

                   70        80        90       100       110       120
m576.pep   EQQAKAVEKHKADAKANKEKGEAFLKENAAKDGVKTTASGLQYKITKQGEGKQPTKDDIV
           ||||||||||||||||||||||||||||||:|||||||||||||||||||||||||||||
g576       EQQAKAVEKHKADAKANKEKGEAFLKENAAEDGVKTTASGLQYKITKQGEGKQPTKDDIV
                60        70        80        90       100       110

                  130       140       150       160       170       180
m576.pep   TVEYEGRLIDGTVFDSSKANGGPVTFPLSQVIPGWTEGVQLLKEGGEATFYIPSNLAYRE
           ||||||||||||||||||||||:|||||||||||||||:|||||||||||||||||||||
g576       TVEYEGRLIDGTVFDSSKANGGPATFPLSQVIPGWTEGVRLLKEGGEATFYIPSNLAYRE
               120       130       140       150       160       170

                  190       200       210       220
m576.pep   QGAGDKIGPNATLVFDVKLVKIGAPENAPAKQPAQVDIKKVNX
           ||||:|||||||||||||||||||||||||||| |||||||||
g576       QGAGEKIGPNATLVFDVKLVKIGAPENAPAKQPDQVDIKKVNX
               180       190       200       210
```

The following partial DNA sequence was identified in *N. meningitidis* <SEQ ID 1741>:

a576.seq

```
  1 ATGAACACCA TTTTCAAAAT CAGCGCACTG ACCCTTTCCG CCGCTTTGGC
 51 ACTTTCCGCC TGCGGCAAAA AAGAAGCCGC CCCCGCATCT GCATCCGAAC
101 CTGCCGCCGC TTCTTCCGCG CAGGGCGACA CCTCTTCGAT CGGCAGCACG
151 ATGCAGCAGG CAAGCTATGC GATGGGCGTG GACATCGGAC GCTCCCTGAA
201 GCAAATGAAG GAACAGGGCG CGGAAATCGA TTTGAAAGTC TTTACCGAAG
251 CCATGCAGGC AGTGTATGAC GGCAAAGAAA TCAAAATGAC CGAAGAGCAG
301 GCTCAGGAAG TCATGATGAA ATTCCTTCAG GAACAACAGG CTAAAGCCGT
351 AGAAAAACAC AAGGCGGACG CGAAGGCCAA TAAAGAAAAA GGCGAAGCCT
401 TTCTGAAAGA AAATGCCGCC AAAGACGGCG TGAAGACCAC TGCTTCCGGC
451 CTGCAATACA AAATCACCAA ACAGGGCGAA GGCAAACAGC CGACCAAAGA
501 CGACATCGTT ACCGTGGAAT ACGAAGGCCG CCTGATTGAC GGTACGGTAT
551 TCGACAGCAG CAAAGCCAAC GGCGGCCCGG TCACCTTCCC TTTGAGCCAA
601 GTGATTCTGG GTTGGACCGA AGGCGTACAG CTTCTGAAAG AAGGCGGCGA
651 AGCCACGTTC TACATCCCGT CCAACCTTGC CTACCGCGAA CAGGGTGCGG
```

-continued

```
701 GCGACAAAAT CGGCCCGAAC GCCACTTTGG TATTTGATGT GAAACTGGTC

751 AAAATCGGCG CACCCGAAAA CGCGCCCGCC AAGCAGCCGG CTCAAGTCGA

801 CATCAAAAAA GTAAATTAA
```

This corresponds to the amino acid sequence <SEQ ID 1742; ORF 576.a>:

a576.pep

```
  1 MNTIFKISAL TLSAALALSA CGKKEAAPAS ASEPAAASSA QGDTSSIGST

 51 MQQASYAMGV DIGRSLKQMK EQGAEIDLKV FTEAMQAVYD GKEIKMTEEQ

101 AQEVMMKFLQ EQQAKAVEKH KADAKANKEK GEAFLKENAA KDGVKTTASG

151 LQYKITKQGE GKQPTKDDIV TVEYEGRLID GTVFDSSKAN GGPVTFPLSQ

201 VILGWTEGVQ LLKEGGEATF YIPSNLAYRE QGAGDKIGPN ATLVFDVKLV

251 KIGAPENAPA KQPAQVDIKK VN*
```

m576/a576 99.5% identity in 222 aa overlap

```
                                                10        20        30
m576.pep                                    MQQASYAMGVDIGRSLKQMKEQGAEIDLKV
                                            ||||||||||||||||||||||||||||||
a576        CGKKEAAPASASEPAAASSAQGDTSSIGSTMQQASYAMGVDIGRSLKQMKEQGAEIDLKV
                    30        40        50        60        70        80
                    40        50        60        70        80        90
m575.pep    FTEAMQAVYDGKEIKMTEEQAQEVMMKFLQEQQAKAVEKHKADAKANKEKGEAFLKENAA
            ||||||||||||||||||||||||||||||||||||||||||||||||||||||||||||
a576        FTEAMQAVYDGKEIKMTEEQAQEVMMKFLQEQQAKAVEKHKADAKANKEKGEAFLKENAA
                    90       100       110       120       130       140
                   100       110       120       130       140       150
m576.pep    KDGVKTTASGLQYKITKQGEGKQPTKDDIVTVEYEGRLIDGTVFDSSKANGGPVTFPLSQ
            ||||||||||||||||||||||||||||||||||||||||||||||||||||||||||||
a576        KDGVKTTASGLQYKITKQGEGKQPTKDDIVTVEYEGRLIDGTVFDSSKANGGPVTFPLSQ
                   150       160       170       180       190       200
                   160       170       180       190       200       210
m576.pep    VIPGWTEGVQLLKEGGEATFYIPSNLAYREQGAGDKIGPNATLVFDVKLVKIGAPENAPA
            || |||||||||||||||||||||||||||||||||||||||||||||||||||||||||
a576        VILGWTEGVQLLKEGGEATFYIPSNLAYREQGAGDKIGPNATLVFDVKLVKIGAPENAPA
                   210       220       230       240       250       260
                   220
m576.pep    KQPAQVDIKKVNX
            |||||||||||||
a576        KQPAQVDIKKVNX
                   270
```

The following partial DNA sequence was identified in *N. gonorrhoeae* <SEQ ID 1743>:

g576-1.seq

```
  1 ATGAACACCA TTTTCAAAAT CAGCGCACTG ACCCTTTCCG CCGCTTTGGC

 51 ACTTTCCGCC TGCGGCAAAA AAGAAGCCGC CCCCGCATCT GCATCCGAAC

101 CTGCCGCCGC TTCTGCCGCG CAGGGCGACA CCTCTTCAAT CGGCAGCACG

151 ATGCAGCAGG CAAGCTATGC AATGGGCGTG GACATCGGAC GCTCCCTGAA

201 ACAAATGAAG GAACAGGGCG CGGAAATCGA TTTGAAAGTC TTTACCGATG

251 CCATGCAGGC AGTGTATGAC GGCAAAGAAA TCAAAATGAC CGAAGAGCAG

301 GCCCAGGAAG TGATGATGAA ATTCCTGCAG GAGCAGCAGG CTAAAGCCGT

351 AGAAAAACAC AAGGCGGATG CGAAGGCCAA CAAAGAAAAA GGCGAAGCCT
```

-continued

```
401 TCCTGAAGGA AAATGCCGCC AAAGACGGCG TGAAGACCAC TGCTTCCGGT
451 CTGCAGTACA AAATCACCAA ACAGGGTGAA GGCAAACAGC CGACAAAAGA
501 CGACATCGTT ACCGTGGAAT ACGAAGGCCG CCTGATTGAC GGTACCGTAT
551 TCGACAGCAG CAAAGCCAAC GGCGGCCCGG CCACCTTCCC TTTGAGCCAA
601 GTGATTCCGG GTTGGACCGA AGGCGTACGG CTTCTGAAAG AAGGCGGCGA
651 AGCCACGTTC TACATCCCGT CCAACCTTGC CTACCGCGAA CAGGGTGCGG
701 GCGAAAAAAT CGGTCCGAAC GCCACTTTGG TATTTGACGT GAAACTGGTC
751 AAAATCGGCG CACCCGAAAA CGCGCCCGCC AAGCAGCCGG ATCAAGTCGA
801 CATCAAAAAA GTAAATTAA
```

This corresponds to the amino acid sequence <SEQ ID 1744; ORF 576-1.ng>:

g576-1.pep

```
  1 MNTIFKISAL TLSAALALSA CGKKEAAPAS ASEPAAASAA QGDTSSIGST
 51 MQQASYAMGV DIGRSLKQMK EQGAEIDLKV FTDAMQAVYD GKEIKMTEEQ
101 AQEVMMKFLQ EQQAKAVEKH KADAKANKEK GEAFLKENAA KDGVKTTASG
151 LQYKITKQGE GKQPTKDDIV TVEYEGRLID GTVFDSSKAN GGPATFPLSQ
201 VIPGWTEGVR LLKEGGEATF YIPSNLAYRE QGAGEKIGPN ATLVFDVKLV
251 KIGAPENAPA KQPDQVDIKK VN*
```

The following partial DNA sequence was identified in *N. meningitidis* <SEQ ID 1745>:

m576-1.seq

```
  1 ATGAACACCA TTTTCAAAAT CAGCGCACTG ACCCTTTCCG CCGCTTTGGC
 51 ACTTTCCGCC TGCGGCAAAA AAGAAGCCGC CCCCGCATCT GCATCCGAAC
101 CTGCCGCCGC TTCTTCCGCG CAGGGCGACA CCTCTTCGAT CGGCAGCACG
151 ATGCAGCAGG CAAGCTATGC GATGGGCGTG GACATCGGAC GCTCCCTGAA
201 GCAAATGAAG GAACAGGGCG CGGAAATCGA TTTGAAAGTC TTTACCGAAG
251 CCATGCAGGC AGTGTATGAC GGCAAAGAAA TCAAAATGAC CGAAGAGCAG
301 GCTCAGGAAG TCATGATGAA ATTCCTTCAG GAACAACAGG CTAAAGCCGT
351 AGAAAAACAC AAGGCGGACG CGAAGGCCAA TAAAGAAAAA GGCGAAGCCT
401 TTCTGAAAGA AAATGCCGCC AAAGACGGCG TGAAGACCAC TGCTTCCGGC
451 CTGCAATACA AAATCACCAA ACAGGGCGAA GGCAAACAGC CGACCAAAGA
501 CGACATCGTT ACCGTGGAAT ACGAAGGCCG CCTGATTGAC GGTACGGTAT
551 TCGACAGCAG CAAAGCCAAC GGCGGCCCGG TCACCTTCCC TTTGAGCCAA
601 GTGATTCCGG GTTGGACCGA AGGCGTACAG CTTCTGAAAG AAGGCGGCGA
651 AGCCACGTTC TACATCCCGT CCAACCTTGC CTACCGCGAA CAGGGTGCGG
701 GCGACAAAAT CGGTCCGAAC GCCACTTTGG TATTTGATGT GAAACTGGTC
751 AAAATCGGCG CACCCGAAAA CGCGCCCGCC AAGCAGCCGG CTCAAGTCGA
801 CATCAAAAAA GTAAATTAA
```

This corresponds to the amino acid sequence <SEQ ID 1746; ORF 576-1>:

```
m576-1.pep

  1 MNTIFKISAL TLSAALALSA CGKKEAAPAS ASEPAAASSA QGDTSSIGST

 51 MQQASYAMGV DIGRSLKQMK EQGAEIDLKV FTEAMQAVYD GKEIKMTEEQ

101 AQEVMMKFLQ EQQAKAVEKH KADAKAHKEK GEAFLKENAA KDGVKTTASG

151 LQYKITKQGE GKQPTKDDIV TVEYEGRLID GTVFDSSKAN GGPVTFPLSQ

201 VIPGWTEGVQ LLKEGGEATF YIPSNLAYRE QGAGDKIGPN ATLVFDVKLV

251 KIGAPENAPA KQPAQVDIKK VN*
```

g576-1/m576-1 97.8% identity in 272 aa overlap

```
                      10        20        30        40        50        60
g576-1.pep   MNTIFKISALTLSAALALSACGKKEAAPASASEPAAASAAQGDTSSIGSTMQQASYAMGV
             |||||||||||||||||||||||||||||||||||||||:||||||||||||||||||||
m576-1       MNTIFKISALTLSAALALSACGKKEAAPASASEPAAASSAQGDTSSIGSTMQQASYAMGV
                      10        20        30        40        50        60

                      70        80        90       100       110       120
g576-1.pep   DIGRSLKQMKEQGAEIDLKVFTDAMQAVYDGKEIKMTEEQAQEVMMKFLQEQQAKAVEKH
             ||||||||||||||||||||||:|||||||||||||||||||||||||||||||||||||
m576-1       DIGRSLKQMKEQGAEIDLKVFTEAMQAVYDGKEIKMTEEQAQEVMMKFLQEQQAKAVEKH
                      70        80        90       100       110       120

                     130       140       150       160       170       180
g576-1.pep   KADAKANKEKGEAFLKENAAKDGVKTTASGLQYKITKQGEGKQPTKDDIVTVEYEGRLID
             ||||||||||||||||||||||||||||||||||||||||||||||||||||||||||||
m576-1       KADAKANKEKGEAFLKENAAKDGVKTTASGLQYKITKQGEGKQPTKDDIVTVEYEGRLID
                     130       140       150       160       170       180

                     190       200       210       220       230       240
g576-1.pep   GTVFDSSKANGGPATFPLSQVIPGWTEGVRLLKEGGEATFYIPSNLAYREQGAGEKIGPN
             |||||||||||||:|||||||||||||||:||||||||||||||||||||||||:|||||
m576-1       GTVFDSSKANGGPVTFPLSQVIPGWTEGVQLLKEGGEATFYIPSNLAYREQGAGDKIGPN
                     190       200       210       220       230       240

                     250       260       270
g576-1.pep   ATLVFDVKLVKIGAPENAPAKQPDQVDIKKVNX
             ||||||||||||||||||||||| |||||||||
m576-1       ATLVFDVKLVKIGAPENAPAKQPAQVDIKKVNX
                     250       260       270
```

The following partial DNA sequence was identified in *N. meningitidis* <SEQ ID 1747>:

```
a576-1.seq

  1 ATGAACACCA TTTTCAAAAT CAGCGCACTG ACCCTTTCCG CCGCTTTGGC

 51 ACTTTCCGCC TGCGGCAAAA AAGAAGCCGC CCCCGCATCT GCATCCGAAC

101 CTGCCGCCGC TTCTTCCGCG CAGGGCGACA CCTCTTCGAT CGGCAGCACG

151 ATGCAGCAGG CAAGCTATGC GATGGGCGTG GACATCGGAC GCTCCCTGAA

201 GCAAATGAAG GAACAGGGCG CGGAAATCGA TTTGAAAGTC TTTACCGAAG

251 CCATGCAGGC AGTGTATGAC GGCAAAGAAA TCAAAATGAC CGAAGAGCAG

301 GCTCAGGAAG TCATGATGAA ATTCCTTCAG GAACAACAGG CTAAAGCCGT

351 AGAAAAACAC AAGGCGGACG CGAAGGCCAA TAAAGAAAAA GGCGAAGCCT

401 TTCTGAAAGA AAATGCCGCC AAAGACGGCG TGAAGACCAC TGCTTCCGGC

451 CTGCAATACA AAATCACCAA ACAGGGCGAA GGCAAACAGC CGACCAAAGA

501 CGACATCGTT ACCGTGGAAT ACGAAGGCCG CCTGATTGAC GGTACGGTAT

551 TCGACAGCAG CAAAGCCAAC GGCGGCCCGG TCACCTTCCC TTTGAGCCAA
```

-continued

```
601 GTGATTCTGG GTTGGACCGA AGGCGTACAG CTTCTGAAAG AAGGCGGCGA

651 AGCCACGTTC TACATCCCGT CCAACCTTGC CTACCGCGAA CAGGGTGCGG

701 GCGACAAAAT CGGCCCGAAC GCCACTTTGG TATTTGATGT GAAACTGGTC

751 AAAATCGGCG CACCCGAAAA CGCGCCCGCC AAGCAGCCGG CTCAAGTCGA

801 CATCAAAAAA GTAAATTAA
```

This corresponds to the amino acid sequence <SEQ ID 1748; ORF 576-1.a>:

```
a576-1.pep

  1 MNTIFKISAL TLSAALALSA CGKKEAAPAS ASEPAAASSA QGDTSSIGST

 51 MQQASYAMGV DIGRSLKQMK EQGAEIDLKV FTEAMQAVYD GKEIKMTEEQ

101 AQEVMMKFLQ EQQAKAVEKH KADAKANKEK GEAFLKENAA KDGVKTTASG

151 LQYKITKQGE GKQPTKDDIV TVEYEGRLID GTVFDSSKAN GGPVTFPLSQ

201 VILGWTEGVQ LLKEGGEATF YIPSNLAYRE QGAGDKIGPN ATLVFDVKLV

251 KIGAPENAPA KQPAQVDIKK VN*
```

a576-1/m576-1 99.6% identity in 272 aa overlap

```
                    10        20        30        40        50        60
a576-1.pep  MNTIFKISALTLSAALALSACGKKEAAPASASEPAAASSAQGDTSSIGSTMQQASYAMGV
            ||||||||||||||||||||||||||||||||||||||||||||||||||||||||||||
m576-1      MNTIFKISALTLSAALALSACGKKEAAPASASEPAAASSAQGDTSSIGSTMQQASYAMGV
                    10        20        30        40        50        60
                    70        80        90       100       110       120
a576-1.pep  DIGRSLKQMKEQGAEIDLKVFTEAMQAVYDGKEIKMTEEQAQEVMMKFLQEQQAKAVEKH
            ||||||||||||||||||||||||||||||||||||||||||||||||||||||||||||
m576-1      DIGRSLKQMKEQGAEIDLKVFTEAMQAVYDGKEIKMTEEQAQEVMMKFLQEQQAKAVEKH
                    70        80        90       100       110       120
                   130       140       150       160       170       180
a576-1.pep  KADAKANKEKGEAFLKENAAKDGVKTTASGLQYKITKQGEGKQPTKDDIVTVEYEGRLID
            ||||||||||||||||||||||||||||||||||||||||||||||||||||||||||||
m576-1      KADAKANKEKGEAFLKENAAKDGVKTTASGLQYKITKQGEGKQPTKDDIVTVEYEGRLID
                   130       140       150       160       170       180
                   190       200       210       220       230       240
a576-1.pep  GTVFDSSKANGGPVTFPLSQVILGWTEGVQLLKEGGEATFYIPSNLAYREQGAGDKIGPN
            ||||||||||||||||||||| ||||||||||||||||||||||||||||||||||||||
m576-1      GTVFDSSKANGGPVTFPLSQVIPGWTEGVQLLKEGGEATFYIPSNLAYREQGAGDKIGPN
                   190       200       210       220       230       240
                   250       260       270
a576-1.pep  ATLVFDVKLVKIGAPENAPAKQPAQVDIKKVNX
            |||||||||||||||||||||||||||||||||
m576-1      ATLVFDVKLVKIGAPENAPAKQPAQVDIKKVNX
                   250       260       270
```

Expression of ORF 576

The primer described in Table 1 for ORF 576 was used to locate and clone ORF 576. ORF 576 was cloned in pET and pGex vectors and expressed in *E. coli* as above described. The products of protein expression and purification were analyzed by SDS-PAGE. FIG. 3A shows the results of affinity purification and FIG. 3B shows the expression in *E. coli*. Purified His-fusion protein was used to immunize mice, whose sera were used for ELISA (positive result), FACS analysis (FIG. 3C), western blot (FIG. 3D). These experiments confirm that ORF 576 is a surface-exposed protein and that it is a useful immunogen. The hydrophilicity plots, antigenic index, and amphipatic regions of ORF 576 are provided in FIG. 7. The AMPHI program is used to predict putative T-cell epitopes (Gao et al 1989, *J. Immunol* 143:3007; Roberts et al. 1996, *AIDS Res Human Retroviruses* 12:593; Quakyi et al. 1992, *Scand J Immunol Suppl* 11:9). The nucleic acid sequence of ORF 576 and the amino acid sequence encoded thereby is provided in Example 1.

The following partial DNA sequence was identified in *N. gonorrhoeae* <SEQ ID 1749>:

g577.seq..

```
  1 atggaaagga gcggtgtatt tggtaaaatt gtcggcaatc gcatactccg
 51 tatgccgtcc gaacacgctg ccgcattcta tccgaaaccg tgcaaatcgt
101 ttaaactaac gcaatcttgg ttcagagtgc gaagctgtcc gtgcggcgtt
151 tttatttacg gagcaaacat gaaacttatc tataccgtca tcaaaatcat
201 tatcctgctg ctcttcctgc tgcttgccgt cattaatatg gatgccgtta
251 ccttttccta tcttccgggg cagagtgtca atctgccgct gattgtcgta
301 ttgttcggcg cgtttgtcgt cggcatcgtg ttcggaatgt ttgccctgtt
351 cgggcggctg ctgtccttgc gcggcgaaaa cagccgcctg cgtgcggaag
401 tgaagaaaag tgcgcgcttg agcggacaga aattgactgc accgccgata
451 caaaatgctg ccgaatctgc caaacagcct taa
```

This corresponds to the amino acid sequence <SEQ ID 1750; ORF 577.ng>:

g577.pep

```
  1 MERSGVFGKI VGNRILRMPS EHAAAFYPKP CKSFKLTQSW FRVRSCPCGV
 51 FIYGANMKLI YTVIKIIILL LFLLLAVINM DAVTFSYLPG QSVNLPLIVV
101 LFGAFVVGIV FGMFALFGRL LSLRGENSRL RAEVKKSARL SGQKLTAPPI
151 QNAAESAKQP *
```

The following partial DNA sequence was identified in *N. meningitidis* <SEQ ID 1751>:

m577.seq..

```
  1 ATGGAAAGGA ACGGTGTATT TGGTAAAATT GTCGGCAATC GCATACTCCG
 51 TATGTCGTCC GAACACGCTG CCGCATCCTA TCCGAAACCG TGCAAATCGT
101 TTAAACTAGC GCAATCTTGG TTCAGAGTGC GAAGCTGTCT GGGCGGCGTT
151 TTTATTTACG GAGCAAACAT GAAACTTATC TATACCGTCA TCAAAATCAT
201 TATCCTGCTG CTCTTCCTGC TGCTTGCCGT CATTAATACG GATGCCGTTA
251 CCTTTTCCTA CCTGCCGGGG CAAAAATTCG ATTTGCCGCT GATTGTCGTA
301 TTGTTCGGCG CATTTGTAGT CGGTATTATT TTTGGAATGT TTGCCTTGTT
351 CGGACGGTTG TTGTCGTTAC GTGGCGAGAA CGGCAGGTTG CGTGCCGAAG
401 TAAAGAAAAA TGCGCGTTTG ACGGGGAAGG AGCTGACCGC ACCACCGGCG
451 CAAAATGCGC CCGAATCTAC CAAACAGCCT TAA
```

This corresponds to the amino acid sequence <SEQ ID 1752; ORF 577>:

m577.pep..

```
  1 MERNGVFGKI VGNRILRMSS EHAAASYPKP CKSFKLAQSW FRVRSCLGGV
 51 FIYGANMKLI YTVIKIIILL LFLLLAVINT DAVTFSYLPG QKFDLPLIVV
```

-continued

```
101 LFGAFVVGII FGMFALFGRL LSLRGENGRL RAEVKKNARL TGKELTAPPA

151 QNAPESTKQP *
```

Computer analysis of this amino acid sequence gave the following results:

Homology with a predicted ORF from *N. gonorrhoeae*
m577/g577 88.1% identity in 160 aa overlap

```
                  10        20        30        40        50        60
m577.pep   MERNGVFGKIVGNRILRMSSEHAAASYPKPCKSFKLAQSWFRVRSCLGGVFIYGANMKLI
           |||:|||||||||||||| |||||| ||||||||||:|||||||||  ||||||||||||
g577       MERSGVFGKIVGNRILRMPSEHAAAFYPKPCKSFKLTQSWFRVRSCPCGVFIYGANMKLI
                  10        20        30        40        50        60

                  70        80        90       100       110       120
m577.pep   YTVIKIIILLLFLLLAVINTDAVTFSYLPGQKFDLPLIVVLFGAFVVGIIFGMFALFGRL
           |||||||||||||||||| |||||||||||:  :||||||||||||||||||||||||||
g577       TYVIKIIILLLFLLLAVINMDAVTFSYLPGQSVNLPLIVVLFGAFVVGIVFGMFALFGRL
                  70        80        90       100       110       120

                 130       140       150       160
m577.pep   LSLRGENGRLRAEVKKNARLTGKELTAPPAQNAPESTKQPX
           |||||||:||||||||:|||:|::||||| ||| ||:||||
g577       LSLRGENSRLRAEVKKSARLSGQKLTAPPIQNAAESAKQPX
                 130       140       150       160
```

The following partial DNA sequence was identified in *N. meningitidis* <SEQ ID 1753>:

```
a577.seq

  1 ATGGAAAGGA ACGGTGTATT TGGTAAAATT CTCGGCAATC GCATACTCCG

 51 TATGTCGTCC GAACACGCTG CCGCATCCTA TCCGAAACCG TGCAAATCGT

101 TTAAACTAGC GCAATCTTGG TTCAGAGTGC GAAGCTGTCC GGGCGGCGTT

151 TTTATTTACG GAGCAAACAT GAAACTTATC TATACCGTCA TCAAAATCAT

201 TATCCTGCTG CTCTTCCTGC TGCTTGCTGT CATTAATACG GATGCCGTTA

251 CCTTTTCCTA CCTGCCGGGG CAAAAATTCG ATTTGCCGCT GATTGTCGTA

301 TTGTTCGGCG CGTTTGTCGT CGGCATCGTG TTCGGAATGT TTGCCTTGTT

351 CGGACGGTTG TTGTCGTTAC GTGGCGAGAA CGGCAGGTTG CGTGCCGAAG

401 TAAAGAAAAA TGCGCGTTTG ACGGGGAAGG AGCTGACCGC ACCACCGGCG

451 CAAAATGCGC CCGAATCTGC CAAACAGCCT TGA
```

This corresponds to the amino acid sequence <SEQ ID 1754; ORF 577.a>:

```
a577.pep

  1 MERNGVFGKI VGNRILRMSS EHAAASYPKP CKSFKLAQSW FRVRSCPGGV

 51 FIYGANMKLI YTVIKIIILL LFLLLAVINT DAVTFSYLPG QKFDLPLIVV

101 LFGAFVVGIV FGMFALFGRL LSLRGENGRL RAEVKKNARL TGKELTAPPA

151 QNAPESAKQP *
```

m577/a577 98.1% identity in 160 aa overlap

```
                10        20        30        40        50        60
m577.pep  MERNGVFGKIVGNRILRMSSEHAAASYPKPCKSFKLAQSWFRVRSCLGGVFIYGANMKLI
          |||||||||||||||||||||||||||||||||||||||||||||| |||||||||||||
a577      MERNGVFGKIVGNRILRMSSEHAAASYPKPCKSFKLAQSWFRVRSCPGGVFIYGANMKLI
                10        20        30        40        50        60

                70        80        90       100       110       120
m577.pep  YTVIKIIILLLFLLLAVINTDAVTFSYLPGQKFDLPLIVVLFGAFVVGIIFGMFALFGRL
          |||||||||||||||||||||||||||||||||||||||||||||||||:||||||||||
a577      YTVIKIIILLLFLLLAVINTDAVTFSYLPGQKFDLPLIVVLFGAFVVGIVFGMFALFGRL
                70        80        90       100       110       120

               130       140       150       160
m577.pep  LSLRGENGRLRAEVKKNARLTGKELTAPPAQNAPESTKQPX
          |||||||||||||||||||||||||||||||||||:||||
a577      LSLRGENGRLRAEVKKNARLTGKELTAPPAQNAPESAKQPX
               130       140       150       160
```

The following partial DNA sequence was identified in *N. gonorrhoeae* <SEQ ID 1755>:

g578.seq..

```
  1 atgggaaagc tcgacatcgg gatattgttt gccgatttct tcaaagattt
 51 cgcgccacag ttcggtggtt tccaaaacgt tggctttgcc tacggagcag
101 actttttgc tgcgtttttg ggcggattgg aaggccacgt gggcgatgcg
151 gcggatttcg ctttcgctgt atttcatggt gttgtagcct tcgtgttcgc
201 cgttttccaa aacacggatg ccgcgcggtt cgccgaaata aatatcgccg
251 gtaagttcgc gcacaatcaa aatatccaaa ccggcaacga tttcaggctt
301 gagcgtggag gcgttggcta a
```

This corresponds to the amino acid sequence <SEQ ID 1756; ORF 578.ng>:

g578.pep

```
  1 MGKLDIGILF ADFFKDFAPQ FGGFQNVGFA YGADFFAAFL GGLEGHVGDA
 51 ADFAFAVFHG VVAFVFAVFQ NTDAARFAEI NIAGKFAHNQ NIQTGNDFRL
101 ERGGVG*
```

The following partial DNA sequence was identified in *N. meningitidis* <SEQ ID 1757>:

m578.seq..

```
  1 ATGGGAAAGC TCGACATCAG GGTACTCTTT GCCGATTTCT TCAAAGATTT
 51 CGCGCCACAA TTCGGTGGTT TCCAAAACGT TGGCTTTGCC TACGGAACAG
101 ACTTTTTTGC TGCGTTTTTG GGCGGATTGG AAGGCAACAT GGGCAATACG
151 GCGGATTTCG CTTTCGCTGT ATTTCATGGT GTTGTAGCCT TCGCGTTCGC
201 CGTTTTCCAG AACGCGGATG CCGCGCGGTT CGCCGAAATA GATGTCGCCG
251 GTGAGTTCGC GCACAATCAA AATATCCAAA CCGGCAACGA TTTCAGGCTT
```

This corresponds to the amino acid sequence <SEQ ID 1758; ORF 578>:

m578.pep..

```
  1 MGKLDIRVLF ADFFKDFAPQ FGGFQNVGFA YGTDFFAAFL GGLEGNMGNT
 51 ADFAFAVFHG VVAFAFAVFQ NADAARFAEI DVAGEFAHNQ NIQTGNDFRL
101 QRGGVG*
```

m578/g578 87.7% identity in 106 aa overlap

```
                   10        20        30        40        50        60
m578.pep  MGKLDIRVLFADFFKDFAPQFGGFQNVGFAYGTDFFAAFLGGLEGNMGNTADFAFAVFHG
          |||||| :||||||||||||||||||||||||:||||||||||||::|::||||||||||
g578      MGKLDIGILFADFFKDFAPQFGGFQNVGFAYGADFFAAFLGGLEGHVGDAADFAFAVFHG
                   10        20        30        40        50        60

                   70        80        90       100
m578.pep  VVAFAFAVFQNADAARFAEIDVAGEFAHNQNIQTGNDFRLQRGGVGX
          ||||:||||||:||||||||::||:|||||||||||||||:||||||
g578      VVAFVFAVFQNTDAARFAEINIAGKFAHNQNIQTGNDFRLERGGVGX
                   70        80        90       100
```

The following partial DNA sequence was identified in *N. meningitidis* <SEQ ID 1759>:

a578.seq

```
  1 ATGGGAAAGC TCGACATCAG GGTATTCTTT GCCGATTTCT TCAAAGATTT
 51 CGCGCCACAA TTCGGTGGTT TCCAAAACGT TGGCTTTGCC TACGGAGCAG
101 ACTTTTTTGC TGCGTTTTTG GGCGGATTGG AAGGCGACGT GGGCAATACG
151 GCGGATTTCG CTTTCGCTGT ATTTCATGGT GTTGTAGCCT TCGCGTTCGC
201 CGTTTTCCAG AACACGGATG CCGCGCGGTT CGCCGAAATA AATATCGCCG
251 GTGAGTTCGC GCACAATCAA AATATCCAAA CCCGCAACGA TTTCAGACTT
301 GAGCGTGGAG GCGTTGGCTA G
```

This corresponds to the amino acid sequence <SEQ ID 1760; ORF 578.a>:

a578.pep

```
  1 MGKLDIRVFF ADFFKDFAPQ FGGFQNVGFA YGADFFAAFL GGLEGDVGNT
 51 ADFAFAVFHG VVAFAFAVFQ NTDAARFAEI NIAGEFAHNQ NIQTRNDFRL
101 ERGGVG*
```

m578/a578 91.5% identity in 106 aa overlap

```
                   10        20        30        40        50        60
m578.pep  MGKLDIRVLFADFFKDFAPQFGGFQNVGFAYGTDFFAAFLGGLEGNMGNTADFAFAVFHG
          ||||||||:|||||||||||||||||||||||:||||||||||||::|||||||||||||
a578      MGKLDIRVFFADFFKDFAPQFGGFQNVGFAYGADFFAAFLGGLEGDVGNTADFAFAVFHG
                   10        20        30        40        50        60
                   70        80        90       100
m578.pep  VVAFAFAVFQNADAARFAEIDVAGEFAHNQNIQTGNDFRLQRGGVGX
          |||||||||||:||||||||::|||||||||||| |||||:||||||
a578      VVAFAFAVFQNTDAARFAEINIAGEFAHNQNIQTRNDFRLERGGVGX
                   70        80        90       100
```

The following partial DNA sequence was identified in *N. gonorrhoeae* <SEQ ID 1761>:

g579.seq..

```
  1 ATGAGGGCGG CGATGACGCG CGCGCAGGTC GATGCCACGC TGATTAGTTT
 51 TTTGTGTAAT GTTGCCAATA TCGGCTTATT GATTTTGGTG ATTATTGCCG
101 CATTGGGACG GTTGGGCGTT TCCACAACAT CCGTAACCGC CTTAATCGGC
151 GGCGCGGGTT TGGCGGTGGC GTTGTCCTTA AAAGACCAGC TGTCCAATTT
201 TGCCGCCGGC GCGCTGATTA TCCTGTTCCG CCCGTTCAAA GTCGGCGACT
251 TTATCCGTGT CGGCGGTTTT GAAGGATATG TCCGGGAAAT CAAAATGGTG
301 CAGACTTCTT TGCGGACGAC CGACAACGAA GAAGTCGTGC TGCCCAACAG
351 CGTGGTGATG GGCAACAGCA TCGTCAACCG TTCCAGCCTG CCGCTTTGCC
401 GCGCCCAAGT GATAGTCGGC GTCGATTACA ACTGCGATTT GAAAGTGGCG
451 AAACAGGCGG TGTTGAAAGC CGCCGCCGAA CACCCCTTGA GCGTTCAAAA
501 CGAAGAGCGG CAGCCCGCCG CCTACATCAC CGCCTTGGGC GACAATGCCA
551 TCGAAATCAC ATTATGGGCT TGGGCAAACG AAGCAGACCG CTGGACGCTG
601 CAATGCGACT TGAACGAACA AGTGGTCGAA AACCTCCGCA AAGTCAATAT
651 CAACATCCCG TTCCCGCAAC GCGACATACA CATCATCAAT TCTTAA
```

This corresponds to the amino acid sequence <SEQ ID 1762; ORF 579.ng>:

g579.pep..

```
  1 MRAAMTRAQV DATLISFLCN VANIGLLILV IIAALGRLGV STTSVTALIG
 51 GAGLAVALSL KDQLSNFAAG ALIILFRPFK VGDFIRVGGF EGYVREIKMV
101 QTSLRTTDNE EVVLPNSVVM GNSIVNRSSL PLCRAQVIVG VDYNCDLKVA
151 KEAVLKAAAE HPLSVQNEER QPAAYITALG DNAIEITLWA WANEADRWTL
201 QCDLNEQVVE NLRKVNINIP FPQRDIHIIN S*
```

The following partial DNA sequence was identified in *N. meningitidis* <SEQ ID 1763>:

m579.seq..

```
  1 ATGAGGGCGG CGATGACGCG GGCGCAGGTC GATGCCACGC TGATTAGTTT
 51 TTTGTGTAAT GTTGCCAATA TCGGCTTATT GATTTTGGTG ATTATTGCCG
101 CATTGGGCAG ATTGGGCGTT TCCACAACAT CCGTAACCGC CTTAATCGGC
151 GGCGCGGGTT TGGCGGTGGC GTTGTCCCTG AAAGACCAGC TGTCCAATTT
201 TGCCGCCGGC GCACTGATTA TCCTGTTCCG CCCGTTCAAA GTCGGCGATT
251 TTATCCGCGT CGGCGGTTTT GAAGGATATG TCCGAGAGAT TAAAATGGTG
301 CAGACTTCTT TGCGGACGAC CGACAACGAA GAAGTCGTGC TGCCCAACAG
351 CGTGGTGATG GGCAACAGCA TCGTCAACCG TTCCACACTG CCGCTGTGCC
401 GCGCCCAAGT GATAGTCGGC GTCGATTACA ACTGCGATTT GAAAGTGGCG
451 AAAGAGGCGG TGTTGAAAGC CGCCGTCGAA CACCCCTTGA GCGTTCAAAA
```

-continued

```
501 CGAAGAGCGG CAGGCTGCCG CCTACATCAC CGCCTTGGGC GACAATGCCA

551 TCGAAATCAC ATTATGGGCT TGGGCAAACG AAGCAGACCG CTGGACGCTG

601 CAATGCGACT TGAACGAACA AGTGGTCGAA AACCTCCGCA AAGTCAATAT

651 CAACATCCCG TTCCCGCAAC GCGACATACA CATCATCAAT TCTTAA
```

This corresponds to the amino acid sequence <SEQ ID 1764; ORF 579>:

m579.pep..

```
  1 MRAAMTRAQV DATLISFLCN VANIGLLILV IIAALGRLGV STTSVTALIG

 51 GAGLAVALSL KDQLSNFAAG ALIILFRPFK VGDFIRVGGF EGYVREIKMV

101 QTSLRTTDNE EVVLPNSVVM GNSIVNRSTL PLCRAQVIVG VDYNCDLKVA

151 KEAVLKAAVE HPLSVQNEER QAAAYITALG DNAIEITLWA WANEADRWTL

201 QCDLNEQVVE NLRKVNINIP FPQRDIHIIN S*
```

Computer analysis of this amino acid sequence gave the following results:

Homology with a predicted ORF from *N. gonorrhoeae*
m579/g579 98.7% identity in 231 aa overlap

```
                   10        20        30        40        50        60
m579.pep   MRAAMTRAQVDATLISFLCNVANIGLLILVIIAALGRLGVSTTSVTALIGGAGLAVALSL
           ||||||||||||||||||||||||||||||||||||||||||||||||||||||||||||
g579       MRAAMTRAQVDATLISFLCNVANIGLLILVIIAALGRLGVSTTSVTALIGGAGLAVALSL
                   10        20        30        40        50        60
                   70        80        90       100       110       120
m579.pep   KDQLSNFAAGALIILFRPFKVGDFIRVGGFEGYVREIKMVQTSLRTTDNEEVVLPNSVVM
           ||||||||||||||||||||||||||||||||||||||||||||||||||||||||||||
g579       KDQLSNFAAGALIILFRPFKVGDFIRVGGFEGYVREIKMVQTSLRTTDNEEVVLPNSVVM
                   70        80        90       100       110       120
                  130       140       150       160       170       180
m579.pep   GNSIVNRSTLPLCRAQVIVGVDYNCDLKVAKEAVLKAAVEHPLSVQNEERQAAAYITALG
           ||||||||:||||||||||||||||||||||||||||||:|||||||||||| |||||||
g579       GNSIVNRSSLPLCRAQVIVGVDYNCDLKVAKEAVLKAAAEHPLSVQNEERQPAAYITALG
                  130       140       150       160       170       180
                  190       200       210       220       230
m579.pep   DNAIEITLWAWANEADRWTLQCDLNEQVVENLRKVNINIPFPQRDIHIINSX
           ||||||||||||||||||||||||||||||||||||||||||||||||||||
g579       DNAIEITLWAWANEADRWTLQCDLNEQVVENLRKVNINIPFPQRDIHIINSX
                  190       200       210       220       230
```

The following partial DNA sequence was identified in *N. meningitidis* <SEQ ID 1765>:

a579.seq

```
  1 ATGAGGGCGG CGATGACGCG CGCGCAGGTC GATGCCACGC TGATTAGTTT

 51 TTTGTGTAAT GTTGCCAATA TCGGCTTATT GATTTTGGTG ATTATTGCCG

101 CATTGGGCAG ATTGGGCGTT TCCACAACAT CCGTAACCGC CTTAATCGGC

151 GGCGCGGGTT TGGCGGTGGC GTTGTCCTTG AAAGACCAGC TGTCCAATTT

201 TGCCGCCGGC GCGCTGATTA TCCTGTTCCG CCCGTTCAAA GTCGGCGATT

251 TTATCCGCGT CGGCGGTTTT GAAGGATATG TCCGAGAGAT TAAAATGGTG

301 CAGACTTCTT TGCGGACGAC CGACAACGAA GAAGTCGTGC TGCCCAACAG

351 CGTGGTGATG GGCAACAGCA TCGTCAACCG TTCCACACTG CCGCTGTGCC
```

-continued

```
401 GCGCCCAAGT GATAGTCGGC GTCGATTACA ACTGCGATTT GAAAGTGGCG
451 AAAGAGGCGG TGTTGAAAGC CGCCGTCGAA CACCCCTTGA GCGTTCAAAA
501 CGAAGAGCGG CAGGCCGCCG CCTACATCAC CGCCTTGGGC GACAATGCCA
551 TCGAAATCAC ATTATGGGCT TGGGCAAACG AAGCAGACCG CTGGACGCTG
601 CAATGCGACT TGAACGAACA AGTGGTCGAA AACCTCCGCA AAGTCAATAT
651 CAACATCCCG TTCCCGCAAC GCGACATACA CATCATCAAT TCTTAA
```

This corresponds to the amino acid sequence <SEQ ID 1766; ORF 579.a>:

A579.pep

```
  1 MRAAMTRAQV DATLISFLCN VANIGLLILV IIAALGRLGV STTSVTALIG
 51 GAGLAVALSL KDQLSNFAAG ALIILFRPFK VGDFIRVGGF EGYVREIKMV
101 QTSLRTTDNE EVVLPNSVVM GNSIVNRSTL PLCRAQVIVG VDYNCDLKVA
151 KEAVLKAAVE HPLSVQNEER QAAAYITALG DNAIEITLWA WANEADRWTL
201 QCDLNEQVVE NLRKVNINIP FPQRDIHIIN S*
```

m579/a579 100.0% identity in 231 aa overlap

```
                 10         20         30         40         50         60
m579.pep MRAAMTRAQVDATLISFLCNVANIGLLILVIIAALGRLGVSTTSVTALIGGAGLAVALSL
         ||||||||||||||||||||||||||||||||||||||||||||||||||||||||||||
a579     MRAAMTRAQVDATLISFLCNVANIGLLILVIIAALGRLGVSTTSVTALIGGAGLAVALSL
                 10         20         30         40         50         60
                 70         80         90        100        110        120
m579.pep KDQLSNFAAGALIILFRPFKVGDFIRVGGFEGYVREIKMVQTSLRTTDNEEVVLPNSVVM
         ||||||||||||||||||||||||||||||||||||||||||||||||||||||||||||
a579     KDQLSNFAAGALIILFRPFKVGDFIRVGGFEGYVREIKMVQTSLRTTDNEEVVLPNSVVM
                 70         80         90        100        110        120
                130        140        150        160        170        180
m579.pep GNSIVNRSTLPLCRAQVIVGVDYNCDLKVAKEAVLKAAVEHPLSVQNEERQAAAYITALG
         ||||||||||||||||||||||||||||||||||||||||||||||||||||||||||||
a579     GNSIVNRSTLPLCRAQVIVGVDYNCDLKVAKEAVLKAAVEHPLSVQNEERQAAAYITALG
                130        140        150        160        170        180
                190        200        210        220        230
m579.pep DNAIEITLWAWANEADRWTLQCDLNEQVVENLRKVNINIPFPQRDIHIINSX
         ||||||||||||||||||||||||||||||||||||||||||||||||||||
a579     DNAIEITLWAWANEADRWTLQCDLNEQVVENLRKVNINIPFPQRDIHIINSX
                190        200        210        220        230
```

The following partial DNA sequence was identified in *N. gonorrhoeae* <SEQ ID 1767>:

g579-1.seq

```
  1 ATGGACTTCA AACAATTTGA TTTTTTACAC CTGATCAGTG TTTCCGCTTG
 51 GGGGCATCTG GCTGAAAAGG CGTGGGCGTT CGGGCTGAAC CTTGCCGCCG
101 CGCTGCTTAT TTTCTTGGTC GGGAAATGGG CGGCGAAACG CATTGTCGCC
151 GTAATGAGGG CGGCGATGAC GCGCGCGCAG GTCGATGCCA CGCTGATTAG
201 TTTTTTGTGT AATGTTGCCA ATATCGGCTT ATTGATTTTG GTGATTATTG
251 CCGCATTGGG ACGGTTGGGC GTTCCACAA CATCCGTAAC CGCCTTAATC
301 GGCGGCGCGG GTTTGGCGGT GGCGTTGTCC TTAAAAGACC AGCTGTCCAA
```

-continued

```
351 TTTTGCCGCC GGCGCGCTGA TTATCCTGTT CCGCCCGTTC AAAGTCGGCG
401 ACTTTATCCG TGTCGGCGGT TTTGAAGGAT ATGTCCGGGA AATCAAAATG
451 GTGCAGACTT CTTTGCGGAC GACCGACAAC GAAGAAGTCG TGCTGCCCAA
501 CAGCGTGGTG ATGGGCAACA GCATCGTCAA CCGTTCCAGC CTGCCGCTTT
551 GCCGCGCCCA AGTGATAGTC GGCGTCGATT ACAACTGCGA TTTGAAAGTG
601 GCGAAAGAGG CGGTGTTGAA AGCCGCCGCC GAACACCCCT TGAGCGTTCA
651 AAACGAAGAG CGGCAGCCCG CCGCCTACAT CACCGCCTTG GGCGACAATG
701 CCATCGAAAT CACATTATGG GCTTGGGCAA ACGAAGCAGA CCGCTGGACG
751 CTGCAATGCG ACTTGAACGA ACAAGTGGTC GAAAACCTCC GCAAAGTCAA
801 TATCAACATC CCGTTCCCGC AACGCGACAT ACACATCATC AATTCTTAA
```

This corresponds to the amino acid sequence <SEQ ID 1768; ORF 008.ng>:

g579-1.pep

```
  1 MDFKQFDFLH LISVSGWGHL AEKAWAFGLN LAAALLIFLV GKWAAKRIVA
 51 VMRAAMTRAQ VDATLISFLC NVANIGLLIL VIIAALGRLG VSTTSVTALI
101 GGAGLAVALS LKDQLSNFAA GALIILFRPF KVGDFIRVGG FEGYVREIKM
151 VQTSLRTTDN EEVVLPNSVV MGNSIVNRSS LPLCRAQVIV GVDYNCDLKV
201 AKEAVLKAAA EHPLSVQNEE RQPAAYITAL GDNAIEITLW AWANEADRWT
251 LQCDLNEQVV ENLRKVNINI PFPQRDIHII NS*
```

The following partial DNA sequence was identified in N. meningitidis <SEQ ID 1769>:

m579-1.seq

```
  1 ATGGACTTCA AACAATTTGA TTTTTTACAC CTGATCAGTG TTTCCGGTTG
 51 GGAGCATCTG GCTGAAAAGG CGTGGGCGTT CGGGCTGAAC CTTGCCGCCG
101 CGCTGCTTAT TTTTTTGGTC GGAAAATGGG CGGCGAAACG CATTGTCGCT
151 GTGATGAGGG CGGCGATGAC GCGCGCGCAG GTCGATGCCA CGCTGATTAG
201 TTTTTTGTGT AATGTTGCCA ATATCGGCTT ATTGATTTTG GTGATTATTG
251 CCGCATTGGG CAGATTGGGC GTTTCCACAA CATCCGTAAC CGCCTTAATC
301 GGCGGCGCGG GTTTGGCGGT GGCGTTGTCC CTGAAAGACC AGCTGTCCAA
351 TTTTGCCGCC GGCGCACTGA TTATCCTGTT CCGCCCGTTC AAAGTCGGCG
401 ATTTTATCCG CGTCGGCGGT TTTGAAGGAT ATGTCCGAGA GATTAAAATG
451 GTGCAGACTT CTTTGCGGAC GACCGACAAC GAAGAAGTCG TGCTGCCCAA
501 CAGCGTGGTG ATGGGCAACA GCATCGTCAA CCGTTCCACA CTGCCGCTGT
551 GCCGCGCCCA AGTGATAGTC GGCGTCGATT ACAACTGCGA TTTGAAAGTG
601 GCGAAAGAGG CGGTGTTGAA AGCCGCCGTC GAACACCCCT TGAGCGTTCA
651 AAACGAAGAG CGGCAGGCTG CCGCCTACAT CACCGCCTTG GGCGACAATG
701 CCATCGAAAT CACATTATGG GCTTGGGCAA ACGAAGCAGA CCGCTGGACG
```

-continued

```
751 CTGCAATGCG ACTTGAACGA ACAAGTGGTC GAAAACCTCC GCAAAGTCAA

801 TATCAACATC CCGTTCCCGC AACGCGACAT ACACATCATC AATTCTTAA
```

This corresponds to the amino acid sequence <SEQ ID 1770; ORF 579-1>:

m579-1.pep

```
  1 MDFKQFDFLH LISVSGWEHL AEKAWAFGLN LAAALLIFLV GKWAAKRIVA

 51 VMRAAMTRAQ VDATLISFLC NVANIGLLIL VIIAALGRLG VSTTSVTALI

101 GGAGLAVALS LKDQLSNFAA GALIILFRPF KVGDFIRVGG FEGYVREIKM

151 VQTSLRTTDN EEVVLPNSVV MGNSIVNRST LPLCRAQVIV GVDYNCDLKV

201 AKEAVLKAAV EHPLSVQNEE RQAAAYITAL GDNAIEITLW AWANEADRWT

251 LQCDLNEQVV ENLRKVNINI PFPQRDIHII NS*
```

m579-1/g579-1 98.6% identity in 282 aa overlap

```
                      10        20        30        40        50        60
m579-1.pep    MDFKQFDFLHLISVSGWEHLAEKAWAFGLNLAAALLIFLVGKWAAKRIVAVMRAAMTRAQ
              |||||||||||||||| |||||||||||||||||||||||||||||||||||||||||||
g579-1        MDFKQFDFLHLISVSGWGHLAEKAWAFGLNLAAALLIFLVGKWAAKRIVAVMRAAMTRAQ
                      10        20        30        40        50        60

                      70        80        90       100       110       120
m579-1.pep    VDATLISFLCNVANIGLLILVIIAALGRLGVSTTSVTALIGGAGLAVALSLKDQLSNFAA
              ||||||||||||||||||||||||||||||||||||||||||||||||||||||||||||
g579-1        VDATLISFLCNVANIGLLILVIIAALGRLGVSTTSVTALIGGAGLAVALSLKDQLSNFAA
                      70        80        90       100       110       120

                     130       140       150       160       170       180
m579-1.pep    GALIILFRPFKVGDFIRVGGFEGYVREIKMVQTSLRTTDNEEVVLPNSVVMGNSIVNRST
              |||||||||||||||||||||||||||||||||||||||||||||||||||||||||||:
g579-1        GALIILFRPFKVGDFIRVGGFEGYVREIKMVQTSLRTTDNEEVVLPNSVVMGNSIVNRSS
                     130       140       150       160       170       180

                     190       200       210       220       230       240
m579-1.pep    LPLCRAQVIVGVDYNCDLKVAKEAVLKAAVEHPLSVQNEERQAAAYITALGDNAIEITLW
              |||||||||||||||||||||||||||||:|||||||||| |||||||||||||||||||
g579-1        LPLCRAQVIVGVDYNCDLKVAKEAVLKAAAEHPLSVQNEERQPAAYITALGDNAIEITLW
                     190       200       210       220       230       240

                     250       260       270       280
m579-1.pep    AWANEADRWTLQCDLNEQVVENLRKVNINIPFPQRDIHIINSX
              |||||||||||||||||||||||||||||||||||||||||||
g579-1        AWANEADRWTLQCDLNEQVVENLRKVNINIPFPQRDIHIINSX
                     250       260       270       280
```

The following partial DNA sequence was identified in *N. meningitidis* <SEQ ID 1771>:

a579-1.seq

```
  1 ATGGACTTCA AACAATTTGA TTTTTTACAC CTGATAAGTG CTTCCGGCTG

 51 GGAGCATCTG GCTGAAAAGG CGTGGGCGTT CGGGCTGAAC CTTGCCGCCG

101 CGCTGCTTAT TTTTTTGGTC GGAAAATGGG CGGCGAAACG CATTGTCGCC

151 GTGATGAGGG CGGCGATGAC GCGCGCGCAG GTCGATGCCA CGCTGATTAG

201 TTTTTTGTGT AATGTTGCCA ATATCGGCTT ATTGATTTTG GTGATTATTG

251 CCGCATTGGG CAGATTGGGC GTTTCCACAA CATCCGTAAC CGCCTTAATC

301 GGCGGCGCGG GTTTGGCGGT GGCGTTGTCC TTGAAAGACC AGCTGTCCAA
```

-continued

```
351 TTTTGCCGCC GGCGCGCTGA TTATCCTGTT CCGCCCGTTC AAAGTCGGCG

401 ATTTTATCCG CGTCGGCGGT TTTGAAGGAT ATGTCCGAGA GATTAAAATG

451 GTGCAGACTT CTTTGCGGAC GACCGACAAC GAAGAAGTCG TGCTGCCCAA

501 CAGCGTGGTG ATGGGCAACA GCATCGTCAA CCGTTCCACA CTGCCGCTGT

551 GCCGCGCCCA AGTGATAGTC GGCGTCGATT ACAACTGCGA TTTGAAAGTG

601 GCGAAAGAGG CGGTGTTGAA AGCCGCCGTC GAACACCCCT TGAGCGTTCA

651 AAACGAAGAG CGGCAGGCCG CCGCCTACAT CACCGCCTTG GGCGACAATQG

701 CCATCGAAAT CACATTATGG GCTTGGGCAA ACGAAGCAGA CCGCTGGACG

751 CTGCAATGCG ACTTGAACGA ACAAGTGGTC GAAAACCTCC GCAAAGTCAA

801 TATCAACATC CCGTTCCCGC AACGCGACAT ACACATCATC AATTCTTAA
```

This corresponds to the amino acid sequence <SEQ ID 1772; ORF 579-1.a>:

a579-1.pep

```
  1 MDFKQFDFLH LISASGWEHL AEKAWAFGLN LAAALLIFLV GKWAAKRIVA

 51 VMRAAMTRAQ VDATLISFLC NVANIGLLIL VIIAALGRLG VSTTSVTALI

101 GGAGLAVALS LKDQLSNFAA GALIILFRPF KVGDFIRVGG FEGYVREIKQM

151 VQTSLRTTDN EEVVLPNSVV MGNSIVNRST LPLCRAQVIV GVDYNCDLKV

201 AKEAVLKAAV EHPLSVQNEE RQAAAYITAL GDNAIEITLW AWANEADRWT

251 LQCDLNEQVV ENLRKVNINI PFPQRDIHII NS*
```

a579-1/m579-1 99.6% identity in 282 aa overlap

```
               10         20         30         40         50         60
a579-1.pep MDFKQFDFLHLISASGWEHLAEKAWAFGLNLAAALLIFLVGKWAAKRIVAVMRAAMTRAQ
           ||||||||||||:|||||||||||||||||||||||||||||||||||||||||||||||
m579-1     MDFKQFDFLHLISVSGWEHLAEKAWAFGLNLAAALLIFLVGKWAAKRIVAVMRAAMTRAQ
               10         20         30         40         50         60

               70         80         90        100        110        120
a579-1.pep VDATLISFLCNVANIGLLILVIIAALGRLGVSTTSVTALIGGAGLAVALSLKDQLSNFAA
           ||||||||||||||||||||||||||||||||||||||||||||||||||||||||||||
m579-1     VDATLISFLCNVANIGLLILVIIAALGRLGVSTTSVTALIGGAGLAVALSLKDQLSNFAA
               70         80         90        100        110        120

              130        140        150        160        170        180
a579-1.pep GALIILFRPFKVGDFIRVGGFEGYVREIKMVQTSLRTTDNEEVVLPNSVVMGNSIVNRST
           ||||||||||||||||||||||||||||||||||||||||||||||||||||||||||||
m579-1     GALIILFRPFKVGDFIRVGGFEGYVREIKMVQTSLRTTDNEEVVLPNSVVMGNSIVNRST
              130        140        150        160        170        180

              190        200        210        220        230        240
a579-1.pep LPLCRAQVIVGVDYNCDLKVAKEAVLKAAVEHPLSVQNEERQAAAYITALGDNAIEITLW
           ||||||||||||||||||||||||||||||||||||||||||||||||||||||||||||
m579-1     LPLCRAQVIVGVDYNCDLKVAKEAVLKAAVEHPLSVQNEERQAAAYITALGDNAIEITLW
              190        200        210        220        230        240

              250        260        270        280
a579-1.pep AWANEADRWTLQCDLNEQVVENLRKVNINIPFPQRDIHIINSX
           ||||||||||||||||||||||||||||||||||||||||||
m579-1     AWANEADRWTLQCDLNEQVVENLRKVNINIPFPQRDIHIINSX
              250        260        270        280
```

The following partial DNA sequence was identified in *N. gonorrhoeae* <SEQ ID 1773>:

g580.seq

```
  1 atggattcgc ccaaggtcgg gtgcgggtgg atggttttgc cgatgtctgc
 51 cgcgtcgcag cccatttcga tggcaaggca gacttcgccg atcatgtcgc
101 caccgttcgg accgacaatg ccgccgccga tgatgcggcc ggtttcggca
151 tcgaaaatca gcttggtaaa gccgttgtcg caaccgttgg caatcgcacg
201 accggaagcc gcccatggga agttggcttt ggtaattttg cggcctgatg
251 ctttggcaga caattcggtt tcaccgaccc atgccacttc ggqggaagtg
301 tag
```

This corresponds to the amino acid sequence <SEQ ID 1774; ORF 580.ng>:

g580.pep..

```
  1 MDSPKVGCGW MVLPMSAASQ PISMARQTSP IMSPPFGPTM PPPMMRPVSA
 51 SKISLVKPLS QPLAIARPEA AHGKLALVIL RPDALADNSV SPTHATSGEV
101 *
```

The following partial DNA sequence was identified in *N. meningitidis* <SEQ ID 1775>:

m580.seq..

```
  1 ATGGATTCGC CCAAGGTCGG GTGCGGGTGG ATGGTTTTGC CGATGTCTGC
 51 CGCGTCGCAG CCCATTTCGA TGGCAAGGCA GACTTCGCCG ATCATATCGC
101 CACCGTTCGG ACCGACAATG CCGCCGCCGA TGATGCGGCC GGTTTCGGCA
151 TCAAAAATCA GCTTGGTAAA GCCGTTGTCG CAACCGTTGG CAATCGCACG
201 GCCGGAAGCC GCCCACGGGA AGTTGGCTTT GGTGATTTTG CGGCCGGAGG
251 CTTTGGCGGA CAGTTCGGTT TCGCCCACCC ACGCCACTTC GGGGGAAGTG
301 TAG
```

This corresponds to the amino acid sequence <SEQ ID 1776; ORF 580>:

m580.pep..

```
  1 MDSPKVGCGW MVLPMSAASQ PISMARQTSP IISPPFGPTM PPPMMRPVSA
 51 SKISLVKPLS QPLAIARPEA AHGKLALVIL RPEALADSSV SPTHATSGEV
101 *
```

m580/g50 97.0% identity in 100 aa overlap

```
                   10        20        30        40        50        60
m580.pep   MDSPKVGCGWMVLPMSAASQPISMARQTSPIISPPFGPTMPPPMMRPVSASKISLVKPLS
           ||||||||||||||||||||||||||||||:|||||||||||||||||||||||||||||
g580       MDSPKVGCGWMVLPMSAASQPISMARQTSPIMSPPFGPTMPPPMMRPVSASKISLVKPLS
                   10        20        30        40        50        60
```

-continued

```
                 70        80        90       100
m580.pep  QPLAIARPEAAHGKLALVILRPEALADSSVSPTHATSGEVX
          |||||||||||||||||||||:||||:|||||||||||||
g580      QPLAIARPEAAHGKLALVILRPDALADNSVSPTHATSGEVX
                 70        80        90       100
```

The following partial DNA sequence was identified in *N. meningitidis* <SEQ ID 1777>:

a580.seq

```
  1 ATGGATTCGC CCAAGGTCGG GTGCGGGTGG ATGGTTTTGC CGATGTCTGC
 51 CGCGTCGCAG CCCATTTCGA TGGCAAGGCA GACTTCGCCG ATCATGTCGC
101 CACCGTTCGG ACCGACAATG CCGCCGCCGA TGATGCGGCC GGTTTCAGCA
151 TCAAAAATCA GCTTGGTGAA ACCATTGTCG CAACCGTTGG CAATCGCACG
201 GCCGGAAGCA GCCCATGGGA AGTTGGCTTT GGTGATTTTG CGGCCGGAGG
251 CTTTGGCAGA CAATTCGGTT TCGCCCACCC ATGCCACTTC AGGAGAAGTG
301 TAA
```

This corresponds to the amino acid sequence <SEQ ID 1778; ORF 580.a>:

a580.pep

```
  1 MDSPKVGCGW MVLPMSAASQ PISMARQTSP IMSPPFGPTM PPPMMRPVSA
 51 SKISLVKPLS QPLAIARPEA AHGKLALVIL RPEALADNSV SPTHATSGEV
101 *
```

m580/a580 98.0% identity in 100 aa overlap

```
                 10        20        30        40        50        60
m580.pep  MDSPKVGCGWMVLPMSAASQPISMARQTSPIISPPFGPTMPPPMMRPVSASKISLVKPLS
          ||||||||||||||||||||||||||||||:|||||||||||||||||||||||||||||
a580      MDSPKVGCGWMVLPMSAASQPISMARQTSPIMSPPFGPTMPPPMMRPVSASKISLVKPLS
                 10        20        30        40        50        60
                 70        80        90       100
m580.pep  QPLAIARPEAAHGKLALVILRPEALADSSVSPTHATSGEVX
          |||||||||||||||||||||||||||:|||||||||||||
a580      QPLAIARPEAAHGKLALVILRPEALADNSVSPTHATSGEVX
                 70        80        90       100
```

The following partial DNA sequence was identified in *N. gonorrhoeae* <SEQ ID 1779>:

g581.seq..

```
  1 atgcacttcg cccagcttgt gggtcaaacc ggtatagaac aaaatacgtt
 51 ctgtcgtcgt ggttttaccc gcatcgatat gggcggaaat accgatgttg
101 cggtacaggc tgatcggggt cttacgagcc attttattag cctttcaaaa
151 ttagaaacgg aagtgagaga atgctttgtt ggcttcagcc atacggtgta
201 cttcttcacg ttttttcaac gcaccgccac ggccttcgga cgcatcaatc
```

-continued

```
251 aactcgcctg ccaaacgcag atccatggat ttctcaccac gtttgcgggc

301 cgcgtcgcga acccaacgca ttgccaaagc cagacggcgt ga
```

This corresponds to the amino acid sequence <SEQ ID 1780; ORF 581.ng>:

```
g581.pep..

  1 MHFAQLVGQT GIEQNTFCRR GFTRIDMGGN TDVAVQADRG LTSHFISLSK

 51 LETEVRECFV GFSHTVYFFT FFQRTATAFG RINQLACQTQ IHGFLTTFAG

101 RVANPTHCQS QTA*
```

The following partial DNA sequence was identified in *N. meningitidis* <SEQ ID 1781>:

```
m581.seq..

  1 ATGCACTTCG CCCAGCTTGT GGGTCAAACC GGTATAGAAC AAAATACGTT

 51 CTGTCGTCGT GGTTTTACCC GCGTCAATAT GGGCGGAAAT ACCGATGTTA

101 CGGTACAGGC TGATCGGGGT CTTACGAGCC ATTTTATTAG CCTTTCAAAA

151 TTAGAAACGG AAGTGAGAGA ATGCTTTGTT GGCTTCAGCC ATACGGTGTA

201 CTTCTTCACG TTTTTTCAAC GCACCGCCAC GGCCTTCGGA CGCATCAATC

251 AATTCGCCTG CCAAACGCAG GTCCATGGAT TTCTCACCAC GTTTGCGGGC

301 CGCATCGCGA ACCCAGCGCA TTGCCAAAGC CAAACGGCGT GA
```

This corresponds to the amino acid sequence <SEQ ID 1782: ORF 581>:

```
m581.pep..

  1 MHFAQLVGQT GIEQNTFCRR GFTRVNMGGN TDVTVQADRG LTSHFISLSK

 51 LETEVRECFV GFSHTVYFFT FFQRTATAFG RINQFACQTQ VHGFLTTFAG

101 RIANPAHCQS QTA*
```

m581/g581 93.8% identity in 113 aa overlap

```
                   10        20        30        40        50        60
m581.pep   MHGAQLVGQTGIEQNTFCRRGFTRVNMGGNTDVTVQADRGLTSHFISLSKLETEVRECFV
           ||||||||||||||||||||||||::|||||||:||||||||||||||||||||||||||
g581       MHFAQLVGQTGIEQNTFCRRGFTRIDMGGNTDVAVQADRGLTSHFISLSKLETEVRECFV
                   10        20        30        40        50        60

                   70        80        90       100       110
m581.pep   GFSHTVYFFTFFQRTATAFGRINQFACQTQVHGFLTTFAGRIANPAHCQSQTAX
           ||||||||||||||||||||||||:|||||:||||||||||:|||:||||||||
g581       GFSHTVYFFTFFQRTATAFGRINQLACQTQIHGFLTTFAGRVANPTHCQSQTAX
                   70        80        90       100       110
```

The following partial DNA sequence was identified in *N. meningitidis* <SEQ ID 1783>:

a581.seq

```
  1 ATGCACTTCG CCCAGCTTGT GGGTCAAACC GGTATAGAAC AAAATACGTT
 51 CTGTCGTCGT GGTTTTACCC GCATCGATAT GGGCGGAAAT ACCGATGTTA
101 CGGTACAGGC TGATCGGGGT CTTACGAGCC ATTTTATTAG CCTTTCAAAA
151 TTAGAAACGG AAGTGAGAGA ATGCTTTGTT GGCTTCAGCC ATACGGTGTA
201 CTTCTTCACG TTTTTTCAAC GCACCGCCAC GGCCTTCGGA CGCATCAATC
251 AATTCGCCTG CCAAACGCAG GTCCATGGAT TTCTCACCAC GTTTGCGGGC
301 CGCATCGCGA ACCCAGCGCA TTGCCAAAGC CAAACGGCGT GA
```

This corresponds to the amino acid sequence <SEQ ID 1784; ORF 581.a>:

a581.pep

```
  1 MHFAQLVGQT GIEQNTFCRR GFTRIDMGGN TDVTVQADRG LTSHFISLSK
 51 LETEVRECFV GFSHTVYFFT FFQRTATAFG RINQFACQTQ VHGFLTTFAG
101 RINPAHCQS QTA*
```

m581/a581 98.2% identity in 113 aa overlap

```
                    10        20        30        40        50        60
m581.pep    MHFAQLVGQTGIEQNTFCRRGFTRVNMGGNTDVTVQADRGLTSHFISLSKLETEVRECFV
            ||||||||||||||||||||||||::||||||||||||||||||||||||||||||||||
a581        MHFAQLVGQTGIEQNTFCRRGFTRIDMGGNTDVTVQADRGLTSHFISLSKLETEVRECFV
                    10        20        30        40        50        60

                    70        80        90       100       110
m581.pep    GFSHTVYFFTFFQRTATAFGRINQFACQTQVHGFLTTFAGRIANPAHCQSQTAX
            |||||||||||||||||||||||||||||||||||||||||||||||||||||
a581        GFSHTVYFFTFFQRTATAFGRINQFACQTQVHGFLTTFAGRIANPAHCQSQTAX
                    70        80        90       100       110
```

The following partial DNA sequence was identified in *N. gonorrhoeae* <SEQ ID 1785>:

g582.seq..

```
  1 atgcgctata ttcttttgac aggactgttg ccgacggcat ccgcttttgg
 51 agagaccgcg ctgcaatgcg ccgctttgac ggacaatgtt acgcgtttgg
101 cgtgttacga caggattttt gcggcacagc ttccgtcttc ggcagggcag
151 gaagggcagg agtcgaaagc cgtactcaat ctgacggaaa ccgtccgcag
201 cagcttggat aagggcgagg cggtcattgt tgttgaaaaa ggcggggatg
251 cgcttcctgc cgacagtgcg ggcgaaaccg ccgatatcta tacgcctttg
301 agcctgatgt acgacttgga caaaaacgat ttgcgcgggc tgttgggcgt
351 acgcgaacac aatccgatgt accttatgcc gttttggtat aacaattcgc
401 ccaactatgc cccgagttcg ccgacgcgcg gtacgactgt acaggaaaaa
451 ttcggacagc agaaacgtgc ggaaaccaaa ttgcaggttt cgttcaaaag
501 caaaattgcc gaaaatttgt ttaaaacccg cgcggatctg tggttcggct
551 acacccaaag atccgattgg cagatttaca accaaggcag gaaatccgcg
```

-continued

```
 601 ccgttccgca atacggatta caaacctgaa attttcctga cccagcctgt

 651 gaaggcggat ttgccgttcg gcggcaggct gcgtatgctc ggtgcgggtt

 701 ttgtccacca gtccaacgga cagagccgtc ccgaatcgcg ttcgtggaac

 751 aggatttatg ccatggcagg catggaatgg ggcaaattga cggtgattcc

 801 gcgcgtgtgg gtgcgtgcgt tcgatcagag cggcgataaa aacgacaatc

 851 ccgatattgc cgactatatg gggtatggcg acgtgaagct gcagtaccgc

 901 ctgaacgaca ggcagaatgt gtattccgta ttgcgctaca accccaaaac

 951 gggctacggc gcgattgaag ccgcctacac gtttccgatt aagggcaaac

1001 tcaaaggcgt ggtacgcgga ttccacggtt acggcgagag cctgatcgac

1051 tacaaccaca agcagaacgg tatcggtatc gggttgatgt tcaacgactg

1101 ggacggcatc tga
```

This corresponds to the amino acid sequence <SEQ ID 1786; ORF 582.ng>:

g582.pep..

```
  1 MRYILLTGLL PTASAFGETA LQCAALTDNV TRLACYDRIF AAQLPSSAGQ

 51 EGQESKAVLN LTETVRSSLD KGEAVIVVEK GGDALPADSA GETADIYTPL

101 SLMYDLDKND LRGLLGVREH NPMYLMPFWY NNSPNYAPSS PTRGTTVQEK

151 FGQQKRAETK LQVSFKSKIA ENLFKTRADL WFGYTQRSDW QIYNQGRKSA

201 PFRNTDYKPE IFLTQPVKAD LPFGGRLRML GAGFVHQSNG QSRPESRSWN

251 RIYAMAGMEW GKLTVIPRVW VRAFDQSGDK NDNPDIADYM GYGDVKLQYR

301 LNDRQNVYSV LRYNPKTGYG AIEAAYTFPI KGKLKGVVRG FHGYGESLID

351 YNHKQNGIGI GLMFNDWDGI *
```

The following partial DNA sequence was identified in *N. meningitidis* <SEQ ID 1787>:

m582.seq..

```
  1 ATGCGCTATA TTCTTTTGAC AGGACTGTTG CCGATGGCAT CCGCTTTTGG

 51 AGAGACCGCG CTGCAATGCG CCGCTTTGAC GGACAATGTT ACGCGTTTGG

101 CGTGTTACGA CAGGATTTTT GCGGCACAGC TTCCGTCTTC GGCAGGGCAG

151 GAAGGGCAGG AGTCGAAAGC CGTACTCAAT CTGACGGAAA CCGTCCGCAG

201 CAGCCTGGAT AAGGGCGAGG CGGTCATTGT TGTTGAAAAA GGCGGGGATG

251 CGCTTCCTGC CGACAGTGCG GGCGAAACCG CCGACATCTA TACGCCTTTG

301 AGCCTGATGT ACGACTTGGA CAAAAACGAT TTGCGCGGGC TGTTGGGCGT

351 ACGCGAACAC AATCCGATGT ACCTTATGCC GCTCTGGTAC AACAATTCGC

401 CCAACTATGC CCCGGGTTCG CCGACGCCCG GTACGACTGT ACAGGAAAAA

451 TTCGGACAGC AGAAACGTGC GGAAACCAAA TTGCAGGTTT CGTTCAAAAG

501 CAAAATTGCC GAAGATTTGT TTAAAACCCG CGCGGATCTG TGGTTCGGCT

551 ACACCCAAAG ATCCGATTGG CAGATTTACA ACCAAGGCAG GAAATCCGCG

601 CCGTTCCGCA ATACGGATTA CAAACCTGAA ATTTTCCTGA CCCAGCCTGT
```

-continued

```
 651 GAAGGCGGAT TTGCCGTTCG GCGGCAGGCT GCGTATGCTC GGTGCGGGTT

 701 TTGTCCACCA GTCCAACGGA CAGAGCCGTC CCGAATCGCG TTCGTGGAAC

 751 AGGATTTACG CCATGGCAGG CATGGAATGG GGCAAATTGA CGGTGATTCC

 801 GCGCGTGTGG GTGCGTGCGT TCGATCAGAG CGGCGATAAA AACGACAATC

 851 CCGATATTGC CGACTATATG GGGTATGGCG ACGTGAAGCT GCAGTACCGC

 901 CTGAACGACA GGCAGAATGT GTATTCCGTA TTGCGCTACA ACCCCAAAAC

 951 GGGCTACGGC GCGATTGAAG CCGCCTACAC GTTTCCGATT AAGGGCAAAC

1001 TCAAAGGCGT GGTACGCGGA TTCCACGGTT ACGGCGAGAG CCTGATCGAC

1051 TACAACCACA AGCAGAACGG TATCGGTATC GGGTTGATGT TCAACGACTT

1101 GGACGGCATC TGA
```

This corresponds to the amino acid sequence <SEQ ID 1788; ORF 582>:

m582.pep

```
  1 MRYILLTGLL PMASAFGETA LQCAALTDNV TRLACYDRIF AAQLPSSAGQ

 51 EGQESKAVLN LTETVRSSLD KGEAVIVVEK GGDALPADSA GETADIYTPL

101 SLMYDLDKND LRGLLGVREH NPMYLMPLWY NNSPNYAPGS PTRGTTVQEK

151 FGQQKRAETK LQVSFKSKIA EDLFKTRADL WFGYTQRSDW QIYNQGRKSA

201 PFRNTDYKPE IFLTQPVKAD LPFGGRLRML GAGFVHQSNG QSRPESRSWN

251 RIYAMAGMEW GKLTVIPRVW VRAFDQSGDK NDNPDIADYM GYGDVKLQYR

301 LNDRQNVYSV LRYNPKTGYG AIEAAYTFPI KGKLKGVVRG FHGYGESLID

351 YNHKQNGIGI GLMFNDLDGI *
```

m582/g582 98.6% identity in 370 aa overlap

```
                   10        20        30        40        50        60
m582.pep    MRYILLTGLLPMASAFGETALQCAALTDNVTRLACYDRIFAAQLPSSAGQEGQESKAVLN
            ||||||||||| ||||||||||||||||||||||||||||||||||||||||||||||||
g582        MRYILLTGLLPTASAFGETALQCAALTDNVTRLACYDRIFAAQLPSSAGQEGQESKAVLN
                   10        20        30        40        50        60

                   70        80        90       100       110       120
m582.pep    LTETVRSSLDKGEAVIVVEKGGDALPADSAGETADIYTPLSLMYDLDKNDLRGLLGVREH
            ||||||||||||||||||||||||||||||||||||||||||||||||||||||||||||
g582        LTETVRSSLDKGEAVIVVEKGGDALPADSAGETADIYTPLSLMYDLDKNDLRGLLGVREH
                   70        80        90       100       110       120

                  130       140       150       160       170       180
m582.pep    NPMYLMPLWYNNSPNYAPGSPTRGTTVQEKFGQQKRAETKLQVSFKSKIAEDLFKTRADL
            ||||||:|||||||||:|||||||||||||||||||||||||||||||||||:|||||||
g582        NPMYLMPFWYNNSPNYAPSSPTRGTTVQEKFGQQKRAETKLQVSFKSKIAENLFKTRADL
                  130       140       150       160       170       180

                  190       200       210       220       230       240
m582.pep    WFGYTQRSDWQIYNQGRKSAPFRNTDYKPEIFLTQPVKADLPFGGRLRMLGAGFVHQSNG
            ||||||||||||||||||||||||||||||||||||||||||||||||||||||||||||
g582        WFGYTQRSDWQIYNQGRKSAPFRNTDYKPEIFLTQPVKADLPFGGRLRMLGAGFVHQSNG
                  190       200       210       220       230       240

                  250       260       270       280       290       300
m582.pep    QSRPESRSWNRIYAMAGMEWGKLTVIPRVWVRAFDQSGDKNDNPDIADYMGYGDVKLQYR
            ||||||||||||||||||||||||||||||||||||||||||||||||||||||||||||
g582        QSRPESRSWNRIYAMAGMEWGKLTVIPRVWVRAFDQSGDKNDNPDIADYMGYGDVKLQYR
                  250       260       270       280       290       300

                  310       320       330       340       350       360
m582.pep    LNDRQNVYSVLRYNPKTGYGAIEAAYTFPIKGKLKGVVRGFHGYGESLIDYNHKQNGIGI
            ||||||||||||||||||||||||||||||||||||||||||||||||||||||||||||
g582        LNDRQNVYSVLRYNPKTGYGAIEAAYTFPIKGKLKGVVRGFHGYGESLIDYNHKQNGIGI
                  310       320       330       340       350       360
```

-continued

```
                  370
m582.pep  GLMFNDLDGIX
          ||||||  ||||
g582      GLMFNDWDGIX
                  370
```

The following partial DNA sequence was identified in *N. meningitidis* <SEQ ID 1789>:

a582.seq

```
   1  ATGCGCTATA TTCTTTTGAC AGGACTGTTG CCGATGGCAT CCGCTTTTGG
  51  AGAGACCGCG CTGCAATGCG CCGCTTTGAC GGACAATGTT ACGCGTTTGG
 101  CGTGTTACGA CAGGATTTTT GCGGCACAGC TTCCGTCTTC GGCAGGGCAG
 151  GAAGGGCAGG AGTCGAAAGC CGTACTCAAT CTGACGGAAA CCGTCCGCAG
 201  CAGCCTGGAT AAGGGCGAGG CGGTCATTGT TGTTGAAAAA GGCGGGGATG
 251  CGCTTCCTGC CGACAGTGCG GGCGAAACCG CCGACATCTA TACGCCTTTG
 301  AGCCTGATGT ACGACTTGGA CAAAAACGAT TTGCGCGGGC TGTTGGGCGT
 351  ACGCGAACAC AATCCGATGT ACCTTATGCC GCTCTGGTAC AACAATTCGC
 401  CCAACTATGC CCCGGGTTCG CCGACGCGCG GTACGACTGT ACAGGAAAAA
 451  TTCGGACAGC AGAAACGTGC GGAAACCAAA TTGCAGGTTT CGTTCAAAAG
 501  CAAAATTGCC GAAGATTTGT TTAAAACCCG CGCGGATCTG TGGTTCGGCT
 551  ACACCCAAAG ATCCGATTGG CAGATTTACA ACCAAGGCAG GAAATCCGCG
 601  CCGTTCCGCA ATACGGATTA CAAACCTGAA ATTTTCCTGA CCCAGCCTGT
 651  GAAGGCGGAT TTGCCGTTCG GCGGCAGGCT GCGTATGCTC GGTGCGGGTT
 701  TTGTCCACCA GTCCAACGGA CAGAGCCGTC CCGAATCGCG TTCGTGGAAC
 751  AGGATTTACG CCATGGCAGG CATGGAATGG GGCAAATTGA CGGTGATTCC
 801  GCGCGTGTGG GTGCGTGCGT TCGATCAGAG CGGCGATAAA AACGACAATC
 851  CCGATATTGC CGACTATATG GGGTATGGCG ACGTGAAGCT GCAGTACCGC
 901  CTGAACGACA GGCAGAATGT GTATTCCGTA TTGCGCTACA ATCCCAAAAC
 951  GGGCTACGGC GCGATTGAAG CCGCCTACAC GTTTCCGATT AAGGGCAAAC
1001  TCAAAGGCGT GGTACGCGGA TTCCACGGTT ACGGCGAGAG CCTGATCGAC
1051  TACAACCACA AGCAGAACGG TATCGGTATC GGGTTGATGT TCAACGACTT
1101  GGACGGCATC TGA
```

This corresponds to the amino acid sequence <SEQ ID 1790; ORF 582.a>:

a582.pep

```
  1  MRYILLTGLL PMASAFGETA LQCAALTDNV TRLACYDRIF AAQLPSSAGQ
 51  EGQESKAVLN LTETVRSSLD KGEAVIVVEK GGDALPADSA GETADIYTPL
101  SLMYDLDKND LRGLLGVREH NPMYLMPLWY NNSPNYAPGS PTRGTTVQEK
151  FGQQKRAETK LQVSFKSKIA EDLFKTRADL WFGYTQRSDW QIYNQGRKSA
201  PFRNTDYKPE IFLTQPVKAD LPFGGRLRML GAGFVHQSNG QSRPESRSWN
```

-continued

```
251 RIYAMAGMEW GKLTVIPRVW VRAFDQSGDK NDNPDIADYM GYGDVKLQYR

301 LNDRQNVYSV LRYNPKTGYG AIEAAYTFPI KGKLKGVVRG FHGYGESLID

351 YNHKQNGIGI GLMFNDLDGI *
```

m582/a582 100.0% identity in 370 aa overlap

```
                   10        20        30        40        50        60
m582.pep   MRYILLTGLLPMASAFGETALQCAALTDNVTRLACYDRIFAAQLPSSAGQEGQESKAVLN
           ||||||||||||||||||||||||||||||||||||||||||||||||||||||||||||
a582       MRYILLTGLLPMASAFGETALQCAALTDNVTRLACYDRIFAAQLPSSAGQEGQESKAVLN
                   10        20        30        40        50        60

                   70        80        90       100       110       120
m582.pep   LTETVRSSLDKGEAVIVVEKGGDALPADSAGETADIYTPLSLMYDLDKNDLRGLLGVREH
           ||||||||||||||||||||||||||||||||||||||||||||||||||||||||||||
a582       LTETVRSSLDKGEAVIVVEKGGDALPADSAGETADIYTPLSLMYDLDKNDLRGLLGVREH
                   70        80        90       100       110       120

                  130       140       150       160       170       180
m582.pep   NPMYLMPLWYNNSPNYAPGSPTRGTTVQEKFGQQKRAETKLQVSFKSKIAEDLFKTRADL
           ||||||||||||||||||||||||||||||||||||||||||||||||||||||||||||
a582       NPMYLMPLWYNNSPNYAPGSPTRGTTVQEKFGQQKRAETKLQVSFKSKIAEDLFKTRADL
                  130       140       150       160       170       180

                  190       200       210       220       230       240
m582.pep   WFGYTQRSDWQIYNQGRKSAPFRNTDYKPEIFLTQPVKADLPFGGRLRMLGAGFVHQSNG
           ||||||||||||||||||||||||||||||||||||||||||||||||||||||||||||
a582       WFGYTQRSDWQIYNQGRKSAPFRNTDYKPEIFLTQPVKADLPFGGRLRMLGAGFVHQSNG
                  190       200       210       220       230       240

                  250       260       270       280       290       300
m582.pep   QSRPESRSWNRIYAMAGMEWGKLTVIPRVWVRAFDQSGDKNDNPDIADYMGYGDVKLQYR
           ||||||||||||||||||||||||||||||||||||||||||||||||||||||||||||
a582       QSRPESRSWNRIYAMAGMEWGKLTVIPRVWVRAFDQSGDKNDNPDIADYMGYGDVKLQYR
                  250       260       270       280       290       300

                  310       320       330       340       350       360
m582.pep   LNDRQNVYSVLRYNPKTGYGAIEAAYTFPIKGKLKGVVRGFHGYGESLIDYNHKQNGIGI
           ||||||||||||||||||||||||||||||||||||||||||||||||||||||||||||
a582       LNDRQNVYSVLRYNPKTGYGAIEAAYTFPIKGKLKGVVRGFHGYGESLIDYNHKQNGIGI
                  310       320       330       340       350       360

                  370
m582.pep   GLMFNDLDGIX
           |||||||||||
a582       GLMFNDLDGIX
                  370
```

The following partial DNA sequence was identified in *N. gonorrhoeae* <SEQ ID 1791>:

g583.seq..

```
  1 atgataattg accaaagcca aatatttacc catcttgcct tctgtgcctt

 51 ttgcgggatt ggagccgtaa ctgccggcaa tcgactgcat aatcggatgt

101 ataatgccgc cgccgcgcgc ggtattggaa ggggtaacgg gagccagcag

151 cagttcggaa agagcgagac tgtaaccgat gcccagcgtt tttcttccaa

201 aaacggcgat aaacaaatat ccgatacgca tccccagccc tgttttgagc

251 aaaccgcgcg aaatcataac tgcgatggca atcagccaaa tcaacggatt

301 ggcgaacgca ctcaacgcat cgctcatcgc cgcgcccggt ttgtcggcgg

351 ttacgccggt tactgcgacc aacccgacgg caataatcga cagcgcgccc

401 aacggcataa ccttgccgat aatggcggca atcacaccga caaacatagc

451 cagcagcgtc caagcctgag gcttgacccc gtcgggtacg ggcagtgcca

501 aaaccagggc gcacaatact gcggcaatgg cgaggggtat cggtttgaaa

551 cccaatttca tcatattgac ctccgtaaaa aagaccgtcc cgaaaaatcg

601 gaaaaataa
```

This corresponds to the amino acid sequence <SEQ ID 1792; ORF 583.ng>:

```
g583.pep..

  1 MIIDQSQIFT HLAFCAFCGI GAVTAGNRLH NRMYNAAAAR GIGRGNGSQQ
 51 QFGKSETVTD AQRFSSKNGD KQISDTHPQP CFEQTARNHN CDGNQPNQRI
101 GERTQRIAHR RARFVGGYAG YCDQPDGNNR QRAQRHNLAD NGGNHTDKHS
151 QQRPSLRLDP VGYGQCQNQG AQYCGNGEGY RFETQFHHID LRKKDRPEKS
201 EK*
```

The following partial DNA sequence was identified in *N. meningitidis* <SEQ ID 1793>:

```
m583.seq..

  1 ATGATAGTTG ACCAAAGCCA AATATTTACC CATCTTGCCT TCTGTGCCTT
 51 TTGCGGGATT GGAGCCGTAA CTGCCGGCAA TCGACTGCAT AATCGGATGT
101 ATAATGCCGC CGCCGCGCGC GGTATTGGAA GGGGTAACGG GAGCCAGCAG
151 CAGTTCGGAA AGAGCGAGAC TGTAACCGAT GCCCAGCGTT TTTCTTCCAA
201 AAACGGCGAT AAACAAATAT CCGATACGCA TCCCCAGCCC TGTTTTGAGC
251 AAACCGCGCG AAATCATAAC TGCGATGGCA ATCAGCCAAA TCAACGGATT
301 GGCGAACGCA CTCAACGCAT CGCTCATCGC CGCGCCCGGT TTGTCGGCGG
351 TTACGCCGGT TACTGCGACC AACCCGACGG CAATAATCGA CAGCGCGCCC
401 AACGGCATGG CCTTGCCGAT AATGGCGGCA ATCACACCGA CAAACATGGC
451 CAGCAGCGTC CAAGCCTGAG GCTTGACCCC GTCGGGTACG GGCAGTGCCA
501 AAACCAGGGC GCACAATACT GCGGCAATGG CGAGGGGTAT CGGTTTGAAA
551 CCCAATTTCA TCATATTGAC CTCCGTAAAA AAGACCGTCC CGAAAAATCG
601 GAAAAATAA
```

This corresponds to the amino acid sequence <SEQ ID 1794; ORF 583>:

```
m583.pep..

  1 MIVDQSQIFT HLAFCAFCGI GAVTAGNRLH NRMYNAAAAR GIGRGNGSQQ
 51 QFGKSETVTD AQRFSSKNGD KQISDTHPQP CFEQTARNHN CDGNQPNQRI
101 GERTQRIAHR RARFVGGYAG YCDQPDGNNR QRAQRHGLAD NGGNHTDKHG
151 QQRPSLRLDP VGYGQCQNQG AQYCGNGEGY RFETQFHHID LRKKDRPEKS
201 EK*
```

m583/g583 98.5% identity in 202 aa overlap

```
                    10        20        30        40        50        60
m583.pep    MIVDQSQIFTHLAFCAFCGIGAVTAGNRLHNRMYNAAAARGIGRGNGSQQQFGKSETVTD
            ||:|||||||||||||||||||||||||||||||||||||||||||||||||||||||||
g583        MIIDQSQIFTHLAFCAFCGIGAVTAGNRLHNRMYNAAAARGIGRGNGSQQQFGKSETVTD
                    10        20        30        40        50        60
```

-continued

```
                 70        80        90       100       110       120
m583.pep  AQRFSSKNGDKQISDTHPQPCFEQTARNHNCDGNQPNQRIGERTQRIAHRRARFVGGYAG
          ||||||||||||||||||||||||||||||||||||||||||||||||||||||||||||
g583      AQRFSSKNGDKQISDTHPQPCFEQTARNHNCDGNQPNQRIGERTQRIAHRRARFVGGYAG
                 70        80        90       100       110       120

                130       140       150       160       170       180
m583.pep  YCDQPDGNNRQRAQRHGLADNGGNHTDKHGQQRPSLRLDPVGYGQCQNQGAQYCGNGEGY
          |||||||||||||||:|||||||||||||:||||||||||||||||||||||||||||||
g583      YCDQPDGNNRQRAQRHNLADNGGNHTDKHSQQRPSLRLDPVGYGQCQNQGAQYCGNGEGY
                130       140       150       160       170       180

                190       200
m583.pep  RFETQFHHIDLRKKDRPEKSEKX
          |||||||||||||||||||||||
g583      RFETQFHHIDLRKKDRPEKSEKX
                190       200
```

The following partial DNA sequence was identified in *N. meningitidis* <SEQ ID 1795>:

a583.seq

```
  1 ATGATAGTTG ACCAAAGCCA AATATTTACC CATCTTGCCT TCTGTGCCTT
 51 TTGCGGGATT GGAGCCGTAA CTGCCGGCAA TCGACTGCAT AATCGGATGT
101 ATAATGCCGC CGCCGCGCGC GGTATTGGAA GGGGTAACGG GAGCCAGCAG
151 CAGTTCGGAA AGAGCGAGAC TGTAACCGAT GCCCAGCGTT TTTCTTCCAA
201 AAACGGCGAT AAACAAATAT CCGATACGCA TCCCCAGCCC TGTTTTGAGC
251 AAACCGCGCG AAATCATAAC TGCGATGGCA ATCAGCCAAA TCAACGGATT
301 GGCGAACGCA CTCAACGCAT CGCTCATCGC CGCACCCGGT TTGTCGGCGG
351 TTACGCCGGT TACTGCGACC AACCCGACGG CAATAATCGA CAGCGCACCC
401 AACGGCATGG CCTTGCCGAT AATGGCGGCA ATCACACCGA TAAACATGGC
451 CAGCAGCGTC CAAGCCTGAG GCTTGACCCC GTCGGGTACG GGCAGTGCCA
501 AAACCAAGGC GCACAATACT GCGGCAATGG CGAGGGGTAT CGGTTTGAAA
551 CCCAATTTCA TCATATTGAC CTCCGTAAAA AAGACCGTCC CGAAAAATCG
601 GAAAAATAA
```

This corresponds to the amino acid sequence <SEQ ID 1796; ORF 583.a>:

a583.pep

```
  1 MIVDQSQIFT HLAFCAFCGI GAVTAGNRLH NRMYNAAAAR GIGRGNGSQQ
 51 QFGKSETVTD AQRFSSKNGD KQISDTHPQP CFEQTARNHN CDGNQPNQRI
101 GERTQRIAHR RTRFVGGYAG YCDQPDGNNR QRTQRHGLAD NGGNHTDKHG
151 QQRPSLRLDP VGYGQCQNQG AQYCGNGEGY RFETQFHHID LRKKDRPEKS
201 EK*
```

m583/a583 99.0% identity in 202 aa overlap

```
                 10        20        30        40        50        60
m583.pep  MIVDQSQIFTHLAFCAFCGIGAVTAGNRLHNRMYNAAAARGIGRGNGSQQQFGKSETVTD
          ||||||||||||||||||||||||||||||||||||||||||||||||||||||||||||
a583      MIVDQSQIFTHLAFCAFCGIGAVTAGNRLHNRMYNAAAARGIGRGNGSQQQFGKSETVTD
                 10        20        30        40        50        60
```

-continued

```
                 70        80        90       100       110       120
m583.pep   AQRFSSKNGDKQISDTHPQPCFEQTARNHNCDGNQPNQRIGERTQRIAHRRARFVGGYAG
           |||||||||||||||||||||||||||||||||||||||||||||||||||:||||||||
a583       AQRFSSKNGDKQISDTHPQPCFEQTARNHNCDGNQPNQRIGERTQRIAHRRTRFVGGYAG
                 70        80        90       100       110       120

                130       140       150       160       170       180
m583.pep   YCDQPDGNNRQRAQRHGLADNGGNHTDKHGQQRPSLRLDPVGYGQCQNQGAQYCGNGEGY
           ||||||||||||:|||||||||||||||||||||||||||||||||||||||||||||||
a583       YCDQPDGNNRQRTQRHGLADNGGNHTDKHGQQRPSLRLDPVGYGQCQNQGAQYCGNGEGY
                130       140       150       160       170       180

                190       200
m583.pep   RFETQFHHIDLRKKDRPEKSEKX
           |||||||||||||||||||||||
a583       RFETQFHHIDLRKKDRPEKSEKX
                190       200
```

The following partial DNA sequence was identified in *N. gonorrhoeae* <SEQ ID 1797>:

g584.seq..

```
  1 atgctgcgtt ctattttggc ggcttccctg ctggcggtat cttttccggc
 51 ggcggctgag gcattgaatt acaatattgt cgaattttcc gaatcggcgg
101 gtatcgaggt ggctcaggat acaatgtccg cgcgtttcca ggtggcggcg
151 gaaggacggg acaaaaatgc cgtcaatgcc gagtttgtta aaaaattcaa
201 caatttcacc agaaaatcga aaaatggtag ctttaaaacc gaattggtat
251 cgcgcagtgc gatgccgcgc tatcaatata ccaacggcag acgcattcaa
301 acaggctggg aggagcgtgc ggaatttaag gcggagggca gggattttga
351 tgctttaaac cgttttattg ctgatgttca gacggatgct tcgcttgaag
401 ataccgattt cagcgtgtcg cgcgaacgcc gaaacgaggt catcgatcag
451 gtcagcaagg atgccgtttt gcgtttcaag gcgcgtgccg aaaaactggc
501 gggcgttctg ggtgcgtccg gttataaaat cgtcaaattg aattttgggc
551 aaatcggcag ccatattgcg ggcgatgggg ctgttcgggc aaaaatgctg
601 cgcgcgatgc cgatggcggc aagcgtcaat atgaagggta cggattcagc
651 cgcaccgggt gtggaggaaa tcagcatcag catcaatggg acggttcagt
701 tctaa
```

This corresponds to the amino acid sequence <SEQ ID 1798; ORF 584.ng>:

g584.pep Length:..

```
  1 MLRSILAASL LAVSFPAAAE ALNYNIVEFS ESAGIEVAQD TMSARFQVAA
 51 EGRDKNAVNA EFVKKFNNFT RKSKNGSFKT ELVSRSAMPR YQYTNGRRIQ
101 TGWEERAEFK AEGRDFDALN RFIADVQTDA SLEDTDFSVS RERRNEVIDQ
151 VSKDAVLRFK ARAEKLAGVL GASGYKIVKL NFGQIGSHIA GDGAVRAKML
201 RAMPMAASVN MKGTDSAAPG VEEISISING TVQF*
```

The following partial DNA sequence was identified in *N. meningitidis* <SEQ ID 1799>:

m584.seq..

```
  1 ATGTTGCGTC TTGTTTTGGC GGCTTCGCTG TCGGCGGTAT CTTTTCCGGC
 51 AGCGGCTGAA GCATTGAATT ACAATATTGT CGAATTTTCC GAATCGGCGG
101 GTGTCGAGGT GGCTCAGGAT ACAATGTCCG CACGTTTCCA AGTGACGGCG
151 GAAGGACGGG ACAAAAATGC CGTCAATGCT GAGTTTGTTA AAAAATTCAA
201 CAAGTTCATC AGAAAATCGA AAAATGGTAG CTTTAAAACC GAATTGGTAT
251 CGCGCAGTGC GATGCCGCGC TATCAATATA CCAACGGCAG ACGCATTCAA
301 ACAGGCTGGG AGGAGCGTGC GGAATTTAAG GTCGAAGGTA GAGATTTTGA
351 TGAGTTAAAC CGTTTTATTG CCGATATTCA AGCAGATGCC GCGTTGGmAT
401 ATACGGATTT CCATGTGTCG CGCGAACGCC GCAACGAGGT CATCkATCAG
451 GTCAGCAAGG ATGCCGTTTT GCGTTTCAAG GCGCGTGCCG AAAAGTTGGC
501 GGGCGTTTTG GGTGCGTCCG GTTATAAAAT CGTCAAATTG AATTTGGGAC
551 ACATCGGCAG CCATATCGCG GGAGGGGGAG CTGCTCAGGC AAAAATGCTT
601 CGTGCCATGC CGATGGCGGC AAGCGTCAAT ATGGAGGGTG CGGATTCCGC
651 CGCGCCTGGT GTGGAGGAAA TCAGCATCAG CGTCAATGGG ACGGTTCAGT
701 TCTGA
```

This corresponds to the amino acid sequence <SEQ ID 1800; ORF 584>:

m584.pep..

```
  1 MLRLVLAASL SAVSFPAAAE ALNYNIVEFS ESAGVEVAQD TMSARFQVTA
 51 EGRDKNAVNA EFVKKFNKFI RKSKNGSFKT ELVSRSAMPR YQYTNGRRIQ
101 TGWEERAEFK VEGRDFDELN RFIADIQADA ALXYTDFNVS RERRNEVIXQ
151 VSKDAVLRFK ARAEKLAGVL GASGYKIVKL NLGHIGSHIA GGGAAQAKML
201 RAMPMAASVN MEGADSAAPG VEEISISVNG TVQF*
```

m584/g584 89.7% identity in 234 aa overlap

```
                   10        20        30        40        50        60
m584.pep   MLRLVLAASLSAVSFPAAAEALNYNIVEFSESAGVEVAQDTMSARFQVTAEGRDKNAVNA
           ||| :||||| |||||||||||||||||||||||:||||||||||||||:||||||||||
g584       MLRSILAASLLAVSFPAAAEALNYNIVEFSESAGIEVAQDTMSARFQVAAEGRDKNAVNA
                   10        20        30        40        50        60

                   70        80        90       100       110       120
m584.pep   EFVKKFNKFIRKSKNGSFKTELVSRSAMPRYQYTNGRRIQTGWEERAEFKVEGRDFDELN
           |||||||:| ||||||||||||||||||||||||||||||||||||||||:|||||| ||
g584       EFVKKFNNFTRKSKNGSFKTELVSRSAMPRYQYTNGRRIQTGWEERAEFKAEGRDFDALN
                   70        80        90       100       110       120

                  130       140       150       160       170       180
m584.pep   RFIADIQADAALXYTDFHVSRERRNEVIXQVSKDAVLRFKARAEKLAGVLGASGYKIVKL
           |||||:|:||:|  ||| |||||||||| |||||||||||||||||||||||||||||||
g584       RFIADVQTDASLEDTDFSVSRERRNEVIDQVSKDAVLRFKARAEKLAGVLGASGYKIVKL
                  130       140       150       160       170       180

                  190       200       210       220       230
m584.pep   NLGHIGSHIAGGGAAQAKMLRAMPMAASVNMEGADSAAPGVEEISISVNGTVQFX
           |:|:||||||| ||::|||||||||||||||:|:||||||||||||||:||||||
g584       NFGQIGSHIAGDGAVRAKMLRAMPMAASVNMKGTDSAAPGVEEISISINGTVQFX
                  190       200       210       220       230
```

The following partial DNA sequence was identified in *N. meningitidis* <SEQ ID 1801>:

a584.seq

```
  1 ATGTTGCGTT CTATTTTGGC GGCTTCCCTG CTG....... ..........
 51 .......... .......... .....ATTGT CGAATTTTCT GAATCGGCGG
101 GTGTCGAGGC GGTTCAGGAT ACAATGTCCG CACGTTTCCA AGTGACGGCG
151 GAAGGACGGG ACAAAAATGC CGTCAATGCC GAGTTTGTTA AAAAATTCAA
201 CAATTTCACC AGAAAATCAA AAAATGGTAG CTTTAAAACC GAATTGGTAT
251 CGCGCAGTGC GATGCCGCGC TATCAATATA CCAACCGCAG ACGCATTCAA
301 ACAGGTTGGG AGGAGCGTGC GGAATTTAAG GTCGAGGGTA GGAATTTTGA
351 TGCGTTGAAC CGTTTTATTG CCGATGTTCA GGCAGATGCC GCGTTGGAAT
401 ATACGGATTT CCATGTGTCG CGCGAACGCC GCAACGAGGT CATCGATCAG
451 GTCAGCAAGG ATGCCGTTTT GCGTTTCAAG GCGCGTGCCG AAAAGTTGGC
501 GGGCGTTTTG GGTGCGTCCG GTTATAAAAT CGTCAAATTG AATTTGGGAC
551 ACATCGGCAG CCATATCGCG GGAGGGGGAG CTGCTCAGGC AAAAATGCTT
601 CGTGCCATGC CGATGGCGGC AAGCGTCAAT ATGGAGGGTG CGGATTCCGC
651 CGCGCCTGGT GTGGAGGAAA TCAGCATCAG CGTCAATGGG ACGGTTCAGT
701 TCTGA
```

This corresponds to the amino acid sequence <SEQ ID 1802; ORF 584.a>:

a584.pep

```
  1 MLRSILAASL L......... .....IVEFS ESAGVEAVQD TMSARFQVTA
 51 EGRDKNAVNA EFVKKFNNFT RFSKNGSFKT ELVSRSAIPR YQYTNGRRIQ
101 TGWEERAEFK VEGRNFDALN RFIADVQADA ALEYTDFHVS RERRNEVIDQ
151 VSKDAVLRFK ARAEKLAGVL GASGYKIVKL NLGHIGSHIA GGGAAQAKML
201 RAMPMAASVN MEGADSAAPG VEEISISVNG TVQF*
```

m584/a584 88.9% identity in 234 aa overlap

```
                  10        20        30        40        50        60
m584.pep  MLRLVLAASLSAVSFPAAAEALNYNIVEFSESAGVEVAQDTMSARFQVTAEGRDKNAVNA
          ||| :|||||               |||||||||||::||||||||||||||||||||||
a584      MLRSILAASLL--------------IVEFSESAGVEAVQDTMSARFQVTAEGRDKNAVNA
                  10                      20        30        40

                  70        80        90       100       110       120
m584.pep  EFVKKFNKFIRKSKNGSFKTELVSRSAMPRYQYTNGRRIQTGWEERAEFKVEGRDFDELN
          |||||||:| |||||||||||||||||||||||||||||||||||||||||||||:|| ||
a584      EFVKKFNNFTRKSKNGSFKTELVSRSAMPRYQYTNGRRIQTGWEERAEFKVEGRNFDALN
            50        60        70        80        90       100

                 130       140       150       160       170       180
m584.pep  RFIADIQADAALXYTDFHVSRERRNEVIXQVSKDAVLRFKARAEKLAGVLGASGYKIVKL
          |||||:|||||| ||||||||||||||| |||||||||||||||||||||||||||||||
a584      RFIADVQADAALEYTDFHVSRERRNEVIDQVSKDAVLRFKARAEKLAGVLGASGYKIVKL
           110       120       130       140       150       160

                 190       200       210       220       230
m584.pep  NLGHIGSHIAGGGAAQAKMLRAMPMAASVNMEGADSAAPGVEEISISVNGTVQFX
          |||||||||||||||||||||||||||||||||||||||||||||||||||||||
a584      NLGHIGSHIAGGGAAQAKMLRAMPMAASVNMEGADSAAPGVEEISISVNGTVQFX
           170       180       190       200       210       220
```

The following partial DNA sequence was identified in *N. gonorrhoeae* <SEQ ID 1803>:

g585.seq..

```
  1 atgaaactgt tccaacgcat tttcgccaca ttttgcgcgg ttatcgtctg
 51 cgcaatcttt gtggcgagtt tttctttttg gctggtgcag aacacccttg
101 ccgaaaacca attcaaccaa cgccgcacca tcgaaaccac attgatgggc
151 agcattattt ccgcattcaa gacacggggc gacaacggcg cgcgcgaaat
201 cctgaccgaa tggaaaaaca gccccgtctc atccgccgtt tacgtcatac
251 agggcgacga gaaaaaagac atcttaaacc gctatatcga caattacacc
301 atagaacgcg cccggctgtt tgccgccaac aacccccatt ccaaccttgt
351 ccgcatcgaa tacgaccgtt tcggcgaaga atacctgttc ttcattaaag
401 gctgggacaa ccaccaggca caacgcctgc ccagcccgct gtttatcccg
451 ggcctgccgc ttgccccgat ttggcacgaa ttcatcatcc tctccttcat
501 catcattgtc ggactgctga tggcatatat ccttgccggc aacattgcca
551 aacccatcag aatcttaggc aacggcatgg acagggtggc agaacgagaa
601 cttgaagacc gcgtttgcca acaggttcgc gaccgcgacg acgaattggc
651 cgatgttgcc atgcaattcg acacaatggt ggaaaaactg gaataa
```

This corresponds to the amino acid sequence <SEQ ID 1804; ORF 585.ng>:

g585.pep..

```
  1 MKLFQRIFAT FCAVIVCAIF VASFSFWLVQ NTLAENQFNQ RRTIETTLMG
 51 SIISAFKTRG DNGAREILTE WKNSPVSSAV YVIQGDEKKD ILNRYIDNYT
101 IERARLFAAN NPHSNLVRIE YDRFGEEYLF FIKGWDNHQA QRLPSPLFIP
151 GLPLAPIWHE FIILSFIIIV GLLMAYILAG NIAKPIRILG NGMDRVAERE
201 LEDRVCQQVR DRDDELADVA MQFDTMVEKL E*
```

The following partial DNA sequence was identified in *N. meningitidis* <SEQ ID 1805>:

m585.seq..

```
  1 ATGAAACTGT TCCAACGCAT TTTCGCCACA TTTTGCGCGG TTATCGTCTG
 51 TGCAATCTTT GTGGCGAGTT TTTCTTTCTG GCTGGTGCAG AACACCCTTG
101 CCGAAAACCA GTTCAACCAA CGCCGCACCA TCGAAACCAC TTTGATGGGC
151 AGCATCATTT CCGCATTCCG GGCACGCGGG GACGCGGGTG CGCGCGAAAT
201 CCTGACGGAA TGGAAAGACA GCCCCGTCTC ATCGGGCGTG TACGTTATAC
251 AGGGCGACGA GAAAAAAGAT ATCCTGAACC GGTATATCGA CAGCTATACC
301 ATCGAACGCG CCCGCCTTTT CGCCGCCGGA CACCCGCATT CCAACCTCGT
351 CCATATCGAA TACGACCGCT TCGGCGAAGA ATACCTGTTC TTCACCAAAG
401 ACTGGGACAA ACTCCAAGCC CGCCGCCTGC CCAGCCCCCT GTTGATCCCC
451 GGCCTGCCGC TCGCCCCGAT TTGGCACGAA CTCATCATAT TGTCCTTCAT
```

-continued

```
 501 CATCATCGTC GGACTGCTGA TGGCATATAT CCTCGCCGGC AACATTGCCA
 551 AACCCATCAG AATCTTAGGC AACGGCATGG ACAGGGTGGC AAACGGAGAA
 601 CTTGAAACCC GTATCTCCCA ACAGGTCGAC GACCGCGACG ACGAATTGTC
 651 CCATCTTGCC ATCCAATTCG ACAAAATGGT GGAAAAACTC GAAAAACTCG
 701 TTGCCAAAGA ACGCCACCTG CTCCATCACG TCTCCCATGA AATGCGTTCT
 751 CCCCTTGCGC GCATGCAGGC AATTGTCGGA CTGATTCAGG CGCAGCCCCA
 801 AAAACAGGAG CAATATCTCA AACGGCTGGA AGGCGAACTG ACCCGCATGG
 851 ATACGCTGGC CGGGGAACTG TTAACCCTGT CCCGTCTCGA AACTTCCAAT
 901 ATGGCTTTGG AAAAAGAAAG CCTGAAACTC CTGCCCCTCC TGGGCAACCT
 951 GGTAGAAGAC AATCAAAGCA TTGCCCAGAA AAACGGACAA ACGGTTACCC
1001 TGTCTGCCGA CGGAAAAATC CCCGAAAACA CAACCATCCT TGCCAACGAA
1051 AGCTACCTGT ACCGCGCCTT CGACAACGTC ATCCGCAACG CCGTCAACTA
1101 CAGTCCCGAA GGCAGCACCA TCCTGATCAA CATCGGACAA GACCACAAAC
1151 ACTGGATAAT CGACGTTACC GACAACGGCC CCGGCGTGGA CGAAATGCAG
1201 CTCCCGCACA TCTTCACCGC TTTCTACCGT GCAGACTCCA GTGCCAACAA
1251 ACCCGGAACA GGACTGGGGC TTGCATTGAC CCAACATATT ATTGAACAGC
1301 ACTGCGGCAA AATCATCGCC GAAAACATCA AACCGAACGG TCTGCGGATG
1351 CGCTTTATCC TGCCCAAGAA AAAAACCGGT TCCAAAACAG AAAAAAGTGC
1401 GAACTGA
```

This corresponds to the amino acid sequence <SEQ ID 1806; ORF 585>:

```
m585.pep..

  1 MKLFQRIFAT FCAVIVCAIF VASFSFWLVQ NTLAENQFNQ RRTIETTLMG
 51 SIISAFRARG DAGAREILTE WKDSPVSSGV YVIQGDEKKD ILNRYIDSYT
102 IERARLFAAG HPHSNLVHIE YDRFGEEYLF FTKDWDKLQA RRLPSPLLIP
151 GLPLAPIWHE LIILSFIIIV GLLMAYILAG NIAKPIRILG NGMDRVANGE
201 LETRISQQVD DRDDELSHLA IQFDKMVEKL EKLVAKERHL LHHVSHEMRS
251 PLARMQAIVG LIQAQPQKQE QYLKRLEGEL TRMDTLAGEL LTLSRLETSN
301 MALEKESLKL LPFLGNLVED NQSIAQKNGQ TVTLSADGKI PENTTILANE
351 SYLYRAFDNV IRNAVNYSPE GSTILINIGQ DHKHWIIDVT DNGPGVDEMQ
401 LPHIFTAFYR ADSSANKPGT GLGLALTQHI IEQHCGKIIA ENIKPNGLRM
451 RFILPKKKTG SKTEKSAN*
```

m585/g585 88.3% identity in 231 aa overlap

```
                    10        20        30        40        50        60
m585.pep   MKLFQRIFATFCAVIVCAIFVASFSFWLVQNTLAENQFNQRRTIETTLMGSIISAFRARG
           ||||||||||||||||||||||||||||||||||||||||||||||||||||||||::||
g585       MKLFQRIFATFCAVIVCAIFVASFSFWLVQNTLAENQFNQRRTIETTLMGSIISAFKTRG
                    10        20        30        40        50        60
```

-continued

```
                   70        80        90       100       110       120
m585.pep   DAGAREILTEWKDSPVSSGVYVIQGDEKKDILNRYIDSYTIERARLFAAGHPHSNLVHIE
           | ||||||||||:|||||:||||||||||||||||||:|||||||||||::||||||:||
g585       DNGAREILTEWKNSPVSSAVYVIQGDEKKDILNRYIDNYTIERARLFAANNPHSNLVRIE
                   70        80        90       100       110       120

                  130       140       150       160       170       180
m585.pep   YDRFGEEYLFFTKDWDKLQARRLPSPLLIPGLPLAPIWHELIILSFIIIVGLIMAYILAG
           ||||||||||| | ||: ||:||||||:||||||||||||:|||||||||||||||||||
g585       YDRFGEEYLFFIKGWDNHQAQRLPSPLFIPGLPLAPIWHEFIILSFIIIVGLLMAYILAG
                  130       140       150       160       170       180

                  190       200       210       220       230       240
m585.pep   NIAKPIRILGNGMDRVANGELETRISQQVDDRDDELSHLAIQFDKMVEKLEKLVAKERHL
           |||||||||||||||||: ||| |: ||| ||||||: :|:||| ||||||
g585       NIAKPIRILGNGMDRVAERELEDRVCQQVRDRDDELADVAMQFDTMVEKLEX
                  190       200       210       220       230

                  250       260       270       280       290       300
m585.pep   LHHVSHEMRSPLARMQAIVGLIQAQPQKQEQYLKRLEGELTRMDTLAGELLTLSRLETSN
```

The following partial DNA sequence was identified in *N. meningitidis* <SEQ ID 1807>:

<u>a585.seq</u>

```
   1 ATGAAACTGT TCCAACGCAT CTTCGCCACA TTTTGCGCGG TTATCGTCTG
  51 TGCAATCTTT GTGGCGAGTT TTTCTTTCTG GCTGGTGCAG AACACCCTTG
 101 CCGAAAACCA GTTCAACCAA CGCCGCACCA TCGAAACCAC TTTGATGGGC
 151 AGCATCATTT CCGCATTCCG GGCACGCGGG GACGCGGGTG CGCGCGAAAT
 201 CCTGACGGAA TGGAAAGACA GCCCCGTCTC ATCGGGCGTG TACGTTATAC
 251 AGGGCGACGA GAAAAAAGAT ATCCTGCACC GGTATATCGA CAGCTACACC
 301 ATCGAACGCG CCCGGCTTTT CGCCGCCGGA CACCCGCATT CCAACCTCGT
 351 CCATATCGAA TACGACCGCT TCGGCGAAGA ATACCTGTTC TTCACCAAAG
 401 ACTGGGACAA ACTCCAAGCC CGCCGCCTGC CCAGCCCCCT GTTGATCCCC
 451 GGCCTGCCGC TCGCCCCGAT TTGGCACGAA CTCATCATAT TGTCCTTCAT
 501 CATCATCGTC GGACTGCTGA TCGCGTACAT CCTCGCCGGC AACATTGCCA
 551 AACCCATCAG AATCTTAGGC AACGGCATGG ACAGGGTGGC AAACGGAGAA
 601 CTTGAAACCC GTATCTCCCA ACAGGTCGAC GACCGCGACG ACGAATTGTC
 651 CCATCTTGCC ATCCAATTCG ACAAAATGGT GGAAAAACTC GAAAAACTCG
 701 TTGCCAAAGA ACGCCACCTG CTCCATCACG TCTCCCATGA AATGCGTTCT
 751 CCCCTTGCGC GCATGCAGGC AATTGTCGGA CTGATTCAGG CGCAGCCCCA
 801 AAAACAGGAG CAATATCTCA AACGGCTGGA AGGCGAACTG ACCCGCATGG
 851 ATACGCTGGC CGGGGAACTG TTAACCCTGT CCCGTCTCGA AACTTCCAAT
 901 ATGGCTTTGG AAAAAGAAAG CCTGAAACTC CTGCCCTTCC TGGGCAACCT
 951 GGTAGAAGAC AATCAAAGCA TTGCCCAGAA AAACGGACAA ACGGTTACCC
1001 TGTCTGCCGA CGGAAAAATC CCCGAAAACA CAACCATCCT TGCCAACGAA
1051 AGCTACCTGT ACCGCGCCTT CGACAACGTC ATCCGCAACG CCGTCAACTA
1101 CAGTCCCGAA GGCAGCACCA TCCTGATCAA CATCGGACAA GACCACAAAC
1151 ACTGGATAAT CGACGTTACC GACAACGGCC CCGGCGTGGA CGAAATGCAG
1201 CTCCCGCACA TCTTCACCGC TTTCTACCGT GCAGACTCCA GTGCCAACAA
1251 ACCCGGAACA GGACTGGGGC TTGCATTGAC CCAACATATT ATTGAACAGC
1301 ACTGCGGCAA AATCATCGCC GAAAACATCA AACCGAACGG TCTGCGGATG
```

-continued

```
1351 CGCTTTATCC TGCCCAAGAA AAAAACCGGT TCCAAAACAG AAAAAAGTGC

1401 GAACTGA
```

This corresponds to the amino acid sequence <SEQ ID 1808; ORF 585.a>:

```
a585.pep

  1 MKLFQRIFAT FCAVIVCAIF VASFSFWLVQ NTLAENQFNQ RRTIETTLMG

 51 SIISAFRARG DAGAREILTE WKDSPVSSGV YVIQGDEKKD ILHRYIDSYT

101 IERARLFAAG HPHSNLVHIE YDRFGEEYLF FTKDWDKLQA RRLPSPLLIP

151 GLPLAPIWHE LIILSFIIIV GLLMAYILAG NIAKPIRILG NGMDRVANGE

201 LETRISQQVD DRDDELSHLA IQFDKMVEKL EKLVAKERHL LHHVSHEMRS

251 PLARMQAIVG LIQAQPQKQE QYLKRLEGEL TRMDTLAGEL LTLSRLETSN

301 MALEKESLKL LPFLGNLVED NQSIAQKNGQ TVTLSADGKI PENTTILANE

351 SYLYRAFDNV IRNAVNYSPE GSTILINIGQ DHKHWIIDVT DNGPGVDEMQ

401 LPHIFTAFYR ADSSANKPGT GLGLALTQHI IEQHCGKIIA ENIKPNGLRM

451 RFILPKKKTG SKTEKSAN*
```

m585/a585 99.8% identity in 468 aa overlap

```
                   10        20        30        40        50        60
m585.pep   MKLFQRIFATFCAVIVCAIFVASFSFWLVQNTLAENQFNQRRTIETTLMGSIISAFRARG
           ||||||||||||||||||||||||||||||||||||||||||||||||||||||||||||
a585       MKLFQRIFATFCAVIVCAIFVASFSFWLVQNTLAENQFNQRRTIETTLMGSIISAFRARG
                   10        20        30        40        50        60

                   70        80        90       100       110       120
m585.pep   DAGAREILTEWKDSPVSSGVYVIQGDEKKDILNRYIDSYTIERARLFAAGHPHSNLVHIE
           ||||||||||||||||||||||||||||||||:|||||||||||||||||||||||||||
a585       DAGAREILTEWKDSPVSSGVYVIQGDEKKDILHRYIDSYTIERARLFAAGHPHSNLVHIE
                   70        80        90       100       110       120

                  130       140       150       160       170       180
m585.pep   YDRFGEEYLFFTKDWDKLQARRLPSPLLIPGLPLAPIWHELIILSFIIIVGLIMAYILAG
           ||||||||||||||||||||||||||||||||||||||||||||||||||||||||||||
a585       YDRFGEEYLFFTKDWDKLQARRLPSPLLIPGLPLAPIWHELIILSFIIIVGLLMAYILAG
                  130       140       150       160       170       180

                  190       200       210       220       230       240
m585.pep   NIAKPIRILGNGMDRVANGELETRISQQVDDRDDELSHLAIQFDKMVEKLEKLVAKERHL
           ||||||||||||||||||||||||||||||||||||||||||||||||||||||||||||
a585       NIAKPIRILGNGMDRVANGELETRISQQVDDRDDELSHLAIQFDKMVEKLEKLVAKERHL
                  190       200       210       220       230       240

                  250       260       270       280       290       300
m585.pep   LHHVSHEMRSPLARMQAIVGLIQAQPQKQEQYLKRLEGELTRMDTLAGELLTLSRLETSN
           ||||||||||||||||||||||||||||||||||||||||||||||||||||||||||||
a585       LHHVSHEMRSPLARMQAIVGLIQAQPQKQEQYLKRLEGELTRMDTLAGELLTLSRLETSN
                  250       260       270       280       290       300

                  310       320       330       340       350       360
m585.pep   MALEKESLKLLPFLGNLVEDNQSIAQKNGQTVTLSADGKIPENTTILANESYLYRAFDNV
           ||||||||||||||||||||||||||||||||||||||||||||||||||||||||||||
a585       MALEKESLKLLPFLGNLVEDNQSIAQKNGQTVTLSADGKIPENTTILANESYLYRAFDNV
                  310       320       330       340       350       360

                  370       380       390       400       410       420
m585.pep   IRNAVNYSPEGSTILINIGQDHKHWIIDVTDNGPGVDEMQLPHIFTAFYRADSSANKPGT
           ||||||||||||||||||||||||||||||||||||||||||||||||||||||||||||
a585       IRNAVNYSPEGSTILINIGQDHKHWIIDVTDNGPGVDEMQLPHIFTAFYRADSSANKPGT
                  370       380       390       400       410       420

                  430       440       450       460      469
m585.pep   GLGLALTQHIIEQHCGKIIAENIKPNGLRMRFILPKKKTGSKTEKSANX
           |||||||||||||||||||||||||||||||||||||||||||||||||
a585       GLGLALTQHIIEQHCGKIIAENIKPNGLRMRFILPKKKTGSKTEKSANX
                  430       440       450       460
```

The following partial DNA sequence was identified in *N. gonorrhoeae* <SEQ ID 1809>:

g586.seq..

```
  1 atggcagccc atctcgaaga acaacaagag ttagacaact ttaaatattt
 51 ttggaaaacc acgggcaaat ggctgtttgc cctgctgatt ttggcggcac
101 tcggctactt gggatacacg gtttaccaaa accgtgcggc ttcccaaaat
151 caggaagcgg cggcggtgct ggcaaacatc gtggaaaagg cgcaaaacaa
201 agccccgcaa agcgaaatca atgccgaact gtccaaactc caacaaagct
251 accccattc catttccgcc gcccaagcca cgctgatggc ggcggcaacc
301 gaatttgacg cgcagcgtta cgatgttgcc gaaggtcatt tgaaatgggt
351 gttgtccaac caaaaagaca gcctgattca ggcgttggcg gcgcagcgtc
401 tgggcgttgt gttgttgcaa caaaaaaaat acgatgccgc gcttgccgca
451 ctcgacacgc cggttgaggc ggacttcgcc cccctgctga tggaaactaa
501 aggcgatgtt tatgccgcac aggaaaaaag ccaggaagcc ttaaaaaact
551 acggacaggc tttggaaaaa atgcctcaag attctgtcgg tcgcgaattg
601 cttcaaatga aactcgattc gctgaaataa
```

This corresponds to the amino acid sequence <SEQ ID 1810; ORF 586.ng>:

g586.pep..

```
  1 MAAHLEEQQE LDNPKYFWKT TGKWLFALLI LAALGYLGYT VYQNRAASQN
 51 QEAAAVLANI VEKAQNKAPQ SEINAELSKL QQSYPHSISA AQATLMAAAT
101 EFDAQRYDVA EGHLKWVLSN QKDSLIQALA AQRLGVVLLQ QKKYDAALAA
151 LDTPVEADFA PLLMETKGDV YAAQEKSQEA LKNYGQALEK MPQDSVGREL
201 LQMKLDSLK*
```

The following partial DNA sequence was identified in *N. meningitidis* <SEQ ID 1811>:

m586.seq

```
  1 ATGGCAGCCC ATCTCGAAGA ACAACAAGAG TTAGACAACT TTAAATATTT
 51 TTGGAAAACC ACGGGCAAAT GGCTGTTTGC CTTGCTGATT TTGGCGGCAC
101 TCGGCTACTT GGGATACACG GTTTACCAAA ACCGTAAAGT TTCCCAAAAT
151 CAGGAAGCGG CGGCGGTGCT GGCAAACATC GTAGAAAAGG CGCAAAGCAA
201 AGCCCCGCAA AGCGAAATCA ATGCCGAATT GACCAAACTC CAACAAAGCT
251 ACCCGCATTC CATTTCCGCC GCCCAAGCCA CACTGATGGC GGCGGCAACC
301 GAATTTGACG CGCAGCGTTA CGATGTTGCC GAAGGCCATT TGAAATGGGT
351 GTTGTCCAAC CAAAAAGACA GCCTGATTCA AGCGTTGGCG GCGCAGCGTC
401 TGGGCGTTGT GTTGTTGCAA CAAAAAAAAT ACGATGCCGC GCTTGCCGCG
451 CTCGATACGC CGGTTGAAGC GGACTTCGCC CCCCTGCTGA TGGAAACCAA
501 AGGCGATGTC TATGCCGCAC AGGGAAAAAC CCAGGAAGCC TTAAAAAACT
```

-continued

```
551 ACGGACAGGC TTTAGAAAAA ATGCCTCAAG ATTCTGTCGG TCGCGAATTG

601 GTTCAAATGA AACTTGATTC GCTGAAATAA
```

This corresponds to the amino acid sequence <SEQ ID 1812; ORF 586>:

m586.pep

```
  1 MAAHLEEQQE LDNFKYFWKT TGKWLFALLI LAALGYLGYT VYQNRKVSQN

 51 QEAAAVLANI VEKAQSKAPQ SEINAELTKL QQSYPHSISA AQATLMAAAT

101 EFDAQRYDVA EGHLKWVLSN QKDSLIQALA AQRLGVVLLQ QKKYDAALAA

151 LDTPVEADFA PLLMETKGDV YAAQGKSQEA LKNYGQALEK MPQDSVGREL

201 VQMKLDSLK*
```

m586/g586 97.1% identity in 209 aa overlap

```
                   10        20        30        40        50        60
m586.pep   MAAHLEEQQELDNFKYFWKTTGKWLFALLILAALGYLGYTVYQNRKVSQNQEAAAVLANI
           |||||||||||||||||||||||||||||||||||||||||||||| :||||||||||||
g586       MAAHLEEQQELDNFKYFWKTTGKWLFALLILAALGYLGYTVYQNRAASQNQEAAAVLANI
                   10        20        30        40        50        60

                   70        80        90       100       110       120
m586.pep   VEKAQSKAPQSEINAELTKLQQSYPHSISAAQATLMAAATEFDAQRYDVAEGHLKWVLSN
           |||||:|||||||||||:||||||||||||||||||||||||||||||||||||||||||
g586       VEKAQNKAPQSEINAELSKLQQSYPHSISAAQATLMAAATEFDAQRYDVAEGHLKWVLSN
                   70        80        90       100       110       120

                  130       140       150       160       170       180
m586.pep   QKDSLIQALAAQRLGVVLLQQKKYDAALAALDTPVEADFAPLLMETKGDVYAAQGKSQEA
           ||||||||||||||||||||||||||||||||||||||||||||||||||||||| |||||
g586       QKDSLIQALAAQRLGVVLLQQKKYDAALAALDTPVEADFAPLLMETKGDVYAAQEKSQEA
                  130       140       150       160       170       180

                  190       200       210
m586.pep   LKNYGQALEKMPQDSVGRELVQMKLDSLKX
           ||||||||||||||||||||:|||||||||
g586       LKNYGQALEKMPQDSVGRELLQMKLDSLKX
                  190       200       210
```

The following partial DNA sequence was identified in *N. meningitidis* <SEQ ID 1813>:

a586.seq

```
  1 ATGGCAGCCC ATTTGGAAGA ACAACAAGAG TTGGACAACT TTAAATATTT

 51 TTGGAAAACC ACGGGCAAAT GGCTGTTTGC CGTGCTGATT TTGGCGGCAC

101 TCGGCTACTT GGGATACACG GTTTACCAAA ACCGTGCGGC TTCCCAAAAT

151 CAGGAAGCGG CGGCGGTGCT GGCAAACATC GTGGAAAAGG CGCAAAACAA

201 AGCCCCGCAA AGCGAAATCA ATGCCGAATT GGCCAAGCTC CAACAAAGCT

251 ACCCCCATTC CATTTCCGCC GCCCAAGCCA CGCTGATGGC GGCAGCAACC

301 GAATTTGACG CGCAGCGTTA CGATGTTGCC GAAGGCCATT TGAAATGGGT

351 ATTGTCCAAC CAAAAAGACA GCCTGATCCA GGCGTTGGCG GCGCAGCGTC

401 TGGGCGTTGT GTTGTTGCAA CAAAAAAAAT ACGATGCCGC GCTTGCCGCA

451 CTCGACACGC CGGTTGAAGC GGACTTCGCC CCCCTGCTGA TGGAAACCAA

501 AGGCGATGTC TATGCCGCAC AGGGAAAAAG CCAGGAAGCC TTAAAAAACT
```

-continued

```
551 ACGGACAGGC TTTAGAAAAA ATGCCTCAAG ATTCTGTCGG TCGCGAATTG

601 GTTCAAATGA AACTTGATTC GCTGAAATAA
```

This corresponds to the amino acid sequence <SEQ ID 1814; ORF 586.a>:

a586.pep

```
  1 MAAHLEEQQE LDNFKYFWKT TGKWLFAVLI LAALGYLGYT VYQNRAASQN

 51 QEAAAVLANI VEKAQNKAPQ SEINAELAKL QQSYPHSISA AQATLMAAAT

101 EFDAQRYDVA EGHLKWVLSN QKDSLIQALA AQRLGVVLLQ QKKYDAALAA

151 LDTPVEADFA PLLMETKGDV YAAQGKSQEA LKNYGQALEK MPQDSVGREL

201 VQMKLDSLK*
```

m586/a586 97.6% identity in 209 aa overlap

```
                   10        20        30        40        50        60
m586.pep   MAAHLEEQQELDNFKYFWKTTGKWLFALLILAALGYLGYTVYQNRKVSQNQEAAAVLANI
           ||||||||||||||||||||||||||||:|||||||||||||||| :|||||||||||||
a586       MAAHLEEQQELDNFKYFWKTTGKWLFAVLILAALGYLGYTVYQNRAASQNQEAAAVLANI
                   10        20        30        40        50        60

                   70        80        90       100       110       120
m586.pep   VEKAQSKAPQSEINAELTKLQQSYPHSISAAQATLMAAATEFDAQRYDVAEGHLKWVLSN
           |||||:|||||||||||:||||||||||||||||||||||||||||||||||||||||||
a586       VEKAQNKAPQSEINAELAKLQQSYPHSISAAQATLMAAATEFDAQRYDVAEGHLKWVLSN
                   70        80        90       100       110       120

                  130       140       150       160       170       180
m586.pep   QKDSLIQALAAQRLGVVLLQQKKYDAALAALDTPVEADFAPLLMETKGDVYAAQGKSQEA
           ||||||||||||||||||||||||||||||||||||||||||||||||||||||||||||
a586       QKDSLIQALAAQRLGVVLLQQKKYDAALAALDTPVEADFAPLLMETKGDVYAAQGKSQEA
                  130       140       150       160       170       180

                  190       200       210
m586.pep   LKNYGQALEKMPQDSVGRELVQMKLDSLKX
           ||||||||||||||||||||||||||||||
a586       LKNYGQALEKMPQDSVGRELVQMKLDSLKX
                  190       200       210
```

The following partial DNA sequence was identified in *N. gonorrhoeae* <SEQ ID 1815>:

g587.seq..

```
  1 atgaaacgta tctttttgcc cgccttgccc gccatcctgc ctttatccgc

 51 ttatgccgac ctgcccttga cgattgaaga cataatgacc gacaagggaa

101 aatggaaact ggaaacttcc cttacctatc tgaatagcga aaacagccgc

151 gccgcacttg ccgcaccggt ttacattcaa accggcgcaa cctcgtttat

201 ccccattccg accgaaattc aagaaaacgg cagcaatacc gatatgctcg

251 ccggcacgct cqgtttgcgc tacggactga ccggcaatac cgacatttac

301 ggcagcggca gctatctgtg gcacgaagaa cgcaaactcg acggcaacgg

351 caaaacccgc aacaaacgga tgtccgacat atccgccggc atcagccaca

401 ccttccttaa agacggcaaa aaccccgccc taatcagctt tcttgaaagc

451 acggtttacg aaaaatcgcg caacaaagcc tcgttaatca aaaaaagggg

501 gctttgcccc ttttataact taaggataaa ttatgaatat taa
```

This corresponds to the amino acid sequence <SEQ ID 1816; ORF 587.ng>:

g587.pep..

```
  1 MKRIFLPALP AILPLSAYAD LPLTIEDIMT DKGKWKLETS LTYLNSENSR
 51 AALAAPVYIQ TGATSFIPIP TEIQENGSNT DMLAGTLGLR YGLTGNTDIY
101 GSGSYLWHEE RKLDGNGKTR NKRMSDISAG ISHTFLKDGK NPALISFLES
151 TVYEKSRNKA SLIKKRGLCP FYNLRINYEY *
```

The following partial DNA sequence was identified in *N. meningitidis* <SEQ ID 1817>:

m587.seq..

```
  1 ATGAAGCGCA TCTTTTTGCC CGCCTTGCCC GCCATCCTGC CTTTATCCAC
 51 TTATGCCGAC CTCCCCTTGA CGATTGAAGA CATAATGACC GACAAGGGAA
101 AATGGAAACT GGAAACTTCC CTTACCTACC TGAACAGCGA AAACAACCGC
151 GCCGAACTTG CCCCACCGGT TTACATTCAA ACCGGCGCAA CCTCGTTTAT
201 CCCCATTCCG ACCGAAATCC AAGAAAACGG CAGCAATACC GATATGCTCG
251 TCGGCACGCT CGGTTTGCGC TACGGACTGA CCGGGAATAC CGACATTTAC
301 GGCAGCGGCA GCTATCTGTG GCACGAAGAA CGCAAACTCG ACGGCAACAG
351 CAAAACCCGC AACAAACGGA TGTCCGACGT ATCCCTCGGC ATCAGCCACA
401 CTTTCCTTAA AGACGACAAA AACCCCGCCC TAATCAGCTT TCTTGAAAGC
451 ACGGTTTACG AAAAATCGCG CAACAAAGCC TCGTCGGGAA AATCCTGGCT
501 CATCGGCGCC ACCACCTACA AAGCCATAGA TCCGATTGTC CTTTCCCTCA
551 CCGCCGCCTA CCGCATCAAC GGCAGCAAAA CCCTTTCAGA CCGCATCCGC
601 TACAAATCGG GCAACTACCT GCTGCTCAAC CCCAACATCT CATTTGCTGC
651 CAACGACAGA ATCAGCCTGA CCGGAGGCAT CCAATGGCTG GGCAGGCAGC
701 CCGACCGGAC GGACGGCAAA CGGGAATCCT CCAGAAACAC ATCCACCTAC
751 GCCCATTTCG GCGCAGGTTT CGGTTTCACC AAAACCACGG CTTTAAACGC
801 ATCCGCACGT TTCAACGTTT CAGGGCAAAG CAGTTCCGAA CTGAAATTTG
851 GCGTACAGCA TACATTTTAA
```

This corresponds to the amino acid sequence <SEQ ID 1818; ORF 587>:

m587.pep..

```
  1 MKRIFLPALP AILPLSTYAD LPLTIEDIMT DKGKWKLETS LTYLNSENNR
 51 AELAAPVYIQ TGATSFIPIP TEIQENGSNT DMLVGTLGLR YGLTGNTDIY
101 GSGSYLWHEE RKLDGNSKTR NKRMSDVSLG ISHTFLKDDK NPALISFLES
151 TVYEKSRNKA SSGKSWLIGA TTYKAIDPIV LSLTAAYRIN GSKTLSDGIR
201 YKSGNYLLLN PNISFAANDR ISLTGGIQWL GRQPDRTDGK RESSRNTSTY
251 AHFGAGFGFT KTTALNASAR FNVSGQSSSE LKFGVQHTF*
```

Computer analysis of this amino acid sequence gave the following results:

Homology with a predicted ORF from *N. gonorrhoeae*
m587/g587 95.0% identity in 161 aa overlap

```
                   10        20        30        40        50        60
m587.pep   MKRIFLPALPAILPLSTYADLPLTIEDIMTDKGKWKLETSLTYLNSENNRAELAAPVYIQ
           |||||||||||||||:||||||||||||||||||||||||||||||||:|| |||||||
g587       MKRIFLPALPAILPLSAYADLPLTIEDIMTDKGKWKLETSLTYLNSENSRAALAAPVYIQ
                   10        20        30        40        50        60

                   70        80        90       100       110       120
m587.pep   TGATSFIPIPTEIQENGSNTDMLVGTLGLRYGLTGNTDIYGSGSYLWHEERKLDGNSKTR
           ||||||||||||||||||||||:|||||||||||||||||||||||||||||||||:|||
g587       TGATSFIPIPTEIQENGSNTDMLAGTLGLRYGLTGNTDIYGSGSYLWHEERKLDGNGKTR
                   70        80        90       100       110       120

                  130       140       150       160       170       180
m587.pep   NKRMSDVSLGISHTFLKDDKNPALISFLESTVYEKSRNKASSGKSWLIGATTYKAIDPIV
           ||||||:| ||||||||| |||||||||||||||||||
g587       NKRMSDISAGISHTFLKDGKNPALISFLESTVYEKSRNKASLIKKRGLCPFYNLRINYEY
                  130       140       150       160       170       180

                  190       200       210       220       230       240
m587.pep   LSLTAAYRINGSKTLSDGIRYKSGNYLLLNPNISFAANDRISLTGGIQWLGRQPDRTDGK

g587       X
```

The following partial DNA sequence was identified in *N. meningitidis* <SEQ ID 1819>:

a587.seq

```
  1 ATGAAGCGCA TCTTTTTGCC CGCCTTGCCC GCCATCCTGC CTTTATCCGC
 51 TTATGCCGAC CTGCCCTTGA CGATTGAAGA CATAATGACC GACAAGGGCA
101 AATGGAAACT GGAAACTTCC CTTACCTACC TGAACAGCGA AAACAACCGC
151 GCCGAACTTG CCGCACCGCT TTACATCCAA ACCGGCGCAA CCTCCTTTAT
201 CCCCATTCCG ACCGAAATCC AAGAAAACGG CAGCAATACC GATATGCTCG
251 TTGGCACGCT CGGTTTGCGC TACGGACTGA CCGGGAATAC CGACATTTAC
301 GGCAGCGGCA GCTATCTGTG GCACGAAGAA CGCAAACTCG ACGGCAACGG
351 CAAAACCCGA AACAAACGGA TGTCCGACGT ATCCCTCGGC ATCAGCCACA
401 CCTTCCTTAA AGACGACAAA AACCCCGCCC TAATCAGCTT TCTTGAAAGC
451 ACGGTTTACG AAAAATCGCG CAACAAAGCC TCGTCGGGAA AATCCTGGCT
501 CATCGGCGCC ACCACCTACA AAGCCATCGA CCCCGTCGTC CTCTCATTGA
551 CCGCTGCCTA CCGTATCAAC GGCAGCAAAA CCCTTTCAAG CAACACCAAA
601 TACAAAGCAG GCAATTACTG GATGCTGAAT CCCAATATAT CCTTCGCCGC
651 CAACGACAGA ATCAGCCTCA CGGGCGGCAT CCAATGGCTG GGCAAGCAGC
701 CCGACCGTCT GGACGGCAAA AAAGAATCCG CAAGAAACAC ATCCACCTAT
751 GCCCATTTCG GCGCAGGTTT CGGTTTCACC AAAACCACGG CTTTAAACGC
801 ATCCGCACGT TTCAACGTTT CAGGGCAAAG CAGTTCCGAA CTGAAATTTG
851 GCGTACAGCA TACGTTTTAA
```

This corresponds to the amino acid sequence <SEQ ID 1820; ORF 587.a>:

a587.pep

```
  1 MKRIFLPALP AILPLSAYAD LPLTIEDIMT DKGKWKLETS LTYLNSENNR
 51 AELAAPVYIQ TGATSFIPIP TEIQENGSNT DMLVGTLGLR YGLTGNTDIY
```

-continued

```
101 GSGSYLWHEE RKLDGNGKTR NKRMSDVSLG ISHTFLKDDK NPALISFLES

151 TVYEKSRNKA SSGKSWLIGA TTYKAIDPVV LSLTAAYRIN GSKTLSSNTK

201 YKAGNYWMLN PNISFAANDR ISLTGGIQWL GKQPDRLDGK KESARNTSTY

251 AHFGAGFGFT KTTALNASAR FNVSGQSSSE LKFGVQHTF*
```

m587/a587 95.2% identity in 289 aa overlap

```
                   10        20        30        40        50        60
m587.pep   MKRIFLPALPAILPLSTYADLPLTIEDIMTDKGKWKLETSLTYLNSENNRAELAAPVYIQ
           |||||||||||||||:||||||||||||||||||||||||||||||||||||||||||||
a587       MKRIFLPALPAILPLSAYADLPLTIEDIMTDKGKWKLETSLTYLNSENNRAELAAPVYIQ
                   10        20        30        40        50        60

                   70        80        90       100       110       120
m587.pep   TGATSFIPIPTEIQENGSNTDMLVGTLGLRYGLTGNTDIYGSGSYLWHEERKLDGNSKTR
           |||||||||||||||||||||||||||||||||||||||||||||||||||||||||:|||
a587       TGATSFIPIPTEIQENGSNTDMLVGTLGLRYGLTGNTDIYGSGSYLWHEERKLDGNGKTR
                   70        80        90       100       110       120

                  130       140       150       160       170       180
m587.pep   NKRMSDVSLGISHTFLKDDKNPALISFLESTVYEKSRNKASSGKSWLIGATTYKAIDPIV
           ||||||||||||||||||||||||||||||||||||||||||||||||||||||||||:|
a587       NKRMSDVSLGISHTFLKDDKNPALISFLESTVYEKSRNKASSGKSWLIGATTYKAIDPVV
                  130       140       150       160       170       180

                  190       200       210       220       230       240
m587.pep   LSLTAAYRINGSKTLSDGIRYKSGNYLLLNPNISFAANDRISLTGGIQWLGRQPDRTDGK
           ||||||||||||||||:: :||:||| :|||||||||||||||||||||||:|||| |||
a587       LSLTAAYRINGSKTLSSNTKYKAGNYWMLNPNISFAANDRISLTGGIQWLGKQPDRLDGK
                  190       200       210       220       230       240

                  250       260       270       280       290
m587.pep   RESSRNTSTYAHFGAGFGFTKTTALNASARFNVSGQSSSELKFGVQHTFX
           :||:||||||||||||||||||||||||||||||||||||||||||||||
a587       KESARNTSTYAHFGAGFGFTKTTALNASARFNVSGQSSSELKFGVQHTFX
                  250       260       270       280       290
```

The following partial DNA sequence was identified in *N. gonorrhoeae* <SEQ ID 1821>:

g588.seq

```
  1 atgcttaaac atctcgcatt cctactgccc gccatgatgt tcgccctccc

 51 cgcccagacc gccgtcctaa gcccctatca ggaaaccggc tgcacctacg

101 aaggcgggat cggaaaagac gggcttcctt caggcaaagg catatggcgt

151 tgccgggatg ggcgcggtta taccggttca ttcaaaaacg gcaaattcga

201 cgggcaaggc gtttataccg ttgccgccgg ccgcgaagta tttctcgagc

251 cgttcaattc cgacagtacc aaattccgca atatggcatt gtcgggcacg

301 ttcaaacaag gcttggcaca cggcaggttc gccgcctcgc aaaacggcga

351 aaccctcttt tattatgaaa tgcgaacacg gcatgattaa
```

This corresponds to the amino acid sequence <SEQ ID 1822; ORF 588.ng>:

g588.pep..

```
  1 MLKHLAFLLP AMMFALPAQT AVLSPYQETG CTYEGGIGKD GLPSGKGIWR

 51 CRDGRGYTGS FKNGKFDGQG VYTVAAGREV FLEPFNSDST KFRNMALSGT

101 FKQGLAHGRF AASQNGETLF YYEMRTRHD*
```

The following partial DNA sequence was identified in *N. meningitidis* <SEQ ID 1823>:

```
m588.seq..

  1 ATGCTTAAAC ATCTCGCATT CCTACTGCCC GCCATGATGT TCGCCCTCCC

 51 CACTTCGGCC GCCGTCCTGA CTTCCTATCA AGAACCAGGC TGCACCTACG

101 ACGGCAATGT CGGCAAAGAC GGTAAACCCG CCGGCAAAGG CACATGGCGC

151 TGCCAAGACG GGCGCAACTA TACCGGTTCG TTTAAAAACG GCAAATTCGA

201 CGGGCAAGGC GTTTATACCG TTGCCGCCAA CCGCGAAATA TTTATCGAAC

251 CGTTCAATTC CGACAGTACC AAATTCCGCA ACATGGTACT CTCGGGCACG

301 TTCAAAAAAG GCTTGGCACA CGGCAGATTT ACCGTCTCGC AAAACGGCGA

351 AACCCTCTTC ATTATGAAAT GCGAAAACGG CATGATTAAA GAAGTGAAAC

401 TGCCCAAAAA CAAATAA
```

This corresponds to the amino acid sequence <SEQ ID 1824; ORF 588>:

```
m588.pep..

  1 MLKHLAFLLP AMMFALPTSA AVLTSYQEPG CTYDGNVGKD GKPAGKGTWR

 51 CQDGRNYTGS FKNGKFDGQG VYTVAANREI FIEPFNSDST KFRNMVLSGT

101 FKKGLAHGRF TVSQNGETLF IMKCENGMIK EVKLPKNK*
```

Computer analysis of this amino acid sequence gave the following results:

Homology with a predicted ORF from *N. gonorrhoeae*
m588/g588 82.5% identity in 120 aa overlap

```
                    10        20        30        40        50        60
m588.pep    MLKHLAFLLPAMMFALPTSAAVLTSYQEPGCTYDGNVGKDGKPAGKGTWRCQDGRNYTGS
            |||||||||||||||||:::|||: ||| ||||:|::|||| |:||| |||:|||:||||
g588        MLKHLAFLLPAMMFALPAQTAVLSPYQETGCTYEGGIGKDGLPSGKGIWRCRDGRGYTGS
                    10        20        30        40        50        60

                    70        80        90       100       110       120
m588.pep    FKNGKFDGQGVYTVAANREIFIEPFNSDSTKFRNMVLSGTFKKGLAHGRFTVSQNGETLF
            ||||||||||||||||:||:|:|||||||||||||:||||||:|||||||::||||||||
g588        FKNGKFDGQGVYTVAAGREVFLEPFNSDSTKFRNMALSGTFKQGLAHGRFAASQNGETLF
                    70        80        90       100       110       120

                   130       139
m588.pep    IMKCENGMIKEVKLPKNKX

g588        YYEMRTRHDX
                   130
```

The following partial DNA sequence was identified in *N. meningitidis* <SEQ ID 1825>:

```
a588.seq

  1 ATGCTTAAAC ATCTCGCATT CCTACTGCCC GCCATGATGT TCGCCCTCCC

 51 CGCCGCGTCC GCCGTTCTGA CTTCCTATCA AGAACCCGGC TGCACCTACG

101 AAGGCGATGT CGGCAAAGAC GGTAAACCCG CCGGCAAAGG CACATGGCGC

151 TGCCAAGACG GGCGCAACTA TACCGGTTCG TTTAAAAATG GCAAATTCGA

201 CGGACAAGGC GTTTATACCG TTGCCGCCAA CCGCGAAATA TTTATCGAAC
```

```
-continued
251 CGTTCAATTC CGACAGTACC AAATTCCGCA ACATGGTACT CTCGGGCACA

301 TTCAAAAAAG GCTTGGCACA CGGCAGATTT ACCGTCTCGC AAAACGGCGA

351 AACCCTCTTC ATTATGAAAT GCGAAAACGG CATGATTAAA GAAGTGAAGC

401 TGCCCAAAAA CAAATAA
```

This corresponds to the amino acid sequence <SEQ ID 1826; ORF 588.a>:

```
a588.pep

  1 MLKHLAFLLP AMMFALPAAS AVLTSYQEPG CTYEGDVGKD GKPAGKGTWR

 51 CQDGRNYTGS FKNGKFDGQG VYTVAANREI FIEPFNSDST KFRNMVLSGT

101 FKKGLAHGRF TVSQNGETLF IMKCENGMIK EVKLPKNK*
```

m588/a588 96.4% identity in 138 aa overlap

```
                10         20         30         40         50         60
m588.pep  MLKHLAFLLPAMMFALPTSAAVLTSYQEPGCTYDGNVGKDGKPAGKGTWRCQDGRNYTGS
          ||||||||||||||||| ::::||||||||||||| :|:||||||||||||||||||||||
a588      MLKHLAFLLPAMMFALPAASAVLTSYQEPGCTYEGDVGKDGKPAGKGTWRCQDGRNYTGS
                10         20         30         40         50         60

                70         80         90        100        110        120
m588.pep  FKNGKFDGQGVYTVAANREIFIEPFNSDSTKFRNMVLSGTFKKGLAHGRFTVSQNGETLF
          ||||||||||||||||||||||||||||||||||||||||||||||||||||||||||||
a588      FKNGKFDGQGVYTVAANREIFIEPFNSDSTKFRNMVLSGTFKKGLAHGRFTVSQNGETLF
                70         80         90        100        110        120

               130        139
m588.pep  IMKCENGMIKEVKLPKNKX
          ||||||||||||||||||
a588      IMKCENGMIKEVKLPKNKX
               130
```

The following partial DNA sequence was identified in *N. gonorrhoeae* <SEQ ID 1827>:

```
g589.seq..

   1 atgcaacaaa aaatccgttt ccaaatcgag gcgatgacct gtcaggcatg

  51 tgcttcgcgc attgaaaaag tgttgaacaa aaaagatttt gtcgaatcgg

 101 cgggagtgaa ctttgccagt gaggaagcgc aggttacgtt tgacggcagc

 151 aaaacctcgg ttgccgacat tgccaaaatc attgagaaaa ccggttacgg

 201 cgcgaaggaa aaaacggaag atacattgcc gcaacctgaa gcagaacacc

 251 atatcggctg gcggttgtgg cttttgctga ccatcaatat cccgttcctt

 301 atcggtatgg tagggatgat gctaaaaggg ctgaattgga cacggcacga

 351 ttggatgatt ccgcctgtat ggcagtttgt actggcaagc atagtgcaac

 401 tttggctggc aatcccgttt tacaaaagcg cgtgggcaag cattaaaggc

 451 gggctggcga atatggacgt actcgttacc atcggcacgg tgtcgattta

 501 cctgtattcc gtttatatgc tgtttttcag ttcgcatgcg gcgcacggta

 551 tggcgcatgt gtattttgaa gcgggcgtga tggtgatcgg ttttgtgtcg

 601 ctgggtaagt ttttggaaca ccgcaccaaa aaatccagcc tgaacagctt

 651 gggcttactg ctaaaactca cgccgaccca agtcaacgtg caacgcaacg
```

-continued

```
 701 gcgaatggaa acaactgccc atcgaccaag tgcaaatcgg cgaccttatc
 751 cgcaccaacc acggcgaacg catcgctgcc gacggcatta tcgaaagcgg
 801 cagcggttgg gcggacgaaa gccaccttac cggcgaatcc aatcccgaag
 851 agaaaaaggc gggcggcaaa gtgttggcgg gcgcgctgat gaccgaaggc
 901 agcgtggtgt accgcgccgc gcagctcggc agccaaaccc tgctcggcga
 951 catgatgaac gcgctctctg aagcacaagg cagtaaagca ccgattgcgc
1001 gcgtggccga taaagcggcg gcggtatttg tgccaactgt cgtgggcatc
1051 gcgcttctga cttttatcgt tgcttggctg attaagggcg attggacggt
1101 cgcactgatg cacgccgttg ccgttttggt gattgcctgc ccgtgcgcgc
1151 tcggtctggc gacccctgcc gcgattatgg tcggcatggg caaagcggtg
1201 aaacacggca tttggtttaa agacgcggcg gcaatggagg aagcagccca
1251 cgtcgatgcc gtcgtattgg acaaaaccgg tacgctgacc gaaggcaggc
1301 cgcaggttgc cgccgtttat tacgttcccg acagcggctt tgacgaagac
1351 gctttgtacc gcatcgccgc cgccgtcgag caaaacgccg cccacccgct
1401 cgcccgcgcc atcgtctccg ccgcacaagc gcgcggtttg gagattcccg
1451 ctgcacaaaa tgcgcaaacc gttgtcggag caggcattac cgccgaagtg
1501 gaaggcgtgg gtttggtgaa atcaggcaaa gccgaatttg ccgaactgac
1551 cttgccgaag ttttcagacg gcgtttggga aatcgccagt gcggttaccg
1601 tatctgtaaa cggcaaaccg atcggcgcat tcgcactctc cgacgcgttg
1651 aaagccgata ccgccgaagc cataggccgt ctgaaaaaac acaatatcga
1701 tgtctatatt atgagcggcg ataaccaaag tacggtcgaa tacgtcgcca
1751 aacaactggg catcgcacac gccttcggta atatgagtcc gtgcgacaaa
1801 gccgccgaag tgcagaaact caaagccgcc ggcaaaaccg tggcgatggt
1851 cggcgacggc atcaacgacg cgcccgcgct tgccgccgcc aacgtcagct
1901 tcgccatgaa aggcggtgcg gacgttgccg aacacaccgc ctccgccacg
1951 ctgatgcagc attcggtcaa tcagctcgcc gatgccctgc tgatatcgca
2001 ggcaacgttg gaaaacatca agcaaaacct atttttcgcc ttcttctaca
2051 atatattggg cattccgctc gccgcgctcg gctttttaaa tcccgtcata
2101 gcaggcgcgg caatggcggc aagctcggtt tcggtattgg gcaatgccct
2151 gcgcctgaaa tgggtaaaaa tcgattga
```

This corresponds to the amino acid sequence <SEQ ID 1828; ORF 589.ng>:

g589.pep..

```
  1 MQQKIRFQIE AMTCQACASR IEKVLNKKDF VESAGVNFAS EEAQVTFDGS
 51 KTSVADIAKI IEKTGYGAKE KTEDTLPQPE AEHHIGWRLW LLLTINIPFL
101 IGMVGMMLKG LNWTRHDWMI PPVWQFVLAS IVQLWLAIPF YKSAWASIKG
151 GLANMDVLVT IGTVSIYLYS VYMLFFSSHA AHGMAHVYFE AGVMVIGFVS
201 LGKFLEHRTK KSSLNSLGLL LKLTPTQVNV QRNGEWKQLP IDQVQIGDLI
```

-continued

```
251 RTNHGERIAA DGIIESGSGW ADESHLTGES NPEEKKAGGK VLAGALMTEG

301 SVVYRAAQLG SQTLLGDMMN ALSEAQGSKA PIARVADKAA AVFVPTVVGI

351 ALLTFIVAWL IKGDWTVALM HAVAVLVIAC PCALGLATPA AIMVGMGKAV

401 KHGIWFKDAA AMEEAAHVDA VVLDKTGTLT EGRPQVAAVY YVPDSGFDED

451 ALYRIAAAVE QNAAHPLARA IVSAAQARGL EIPAAQNAQT VVGAGITAEV

501 EGVGLVKSGK AEFAELTLPK FSDGVWEIAS AVTVSVNGKP IGAFALSDAL

551 KADTAEAIGR LKKHNIDVYI MSGDNQSTVE YVAKQLGIAH AFGNMSPCDK

601 AAEVQKLKAA GKTVAMVGDG INDAPALAAA NVSFAMKGGA DVAEHTASAT

651 LMQHSVNQLA DALLISQATL ENIKQNLFFA FFYNILGIPL AALGFLNPVI

701 AGAAMAASSV SVLGNALRLK WVKID*
```

The following partial DNA sequence was identified in *N. meningitidis* <SEQ ID 1829>:

M589.seq..

```
   1 ATGCAACAAA AAATCCGTTT CCAAATCGAA GGCATGACCT GCCAGGCCTG
  51 CGCTTCGCGC ATTGAAAAAG TGTTGAACAA AAAAGATTTT GTCGAATCGG
 101 CGGGGGTAAA CTTCGCCAGC GAAGAGGCGC AGGTAGTGTT TGACGACAGC
 151 AAAACCTCAG TAGCCGACAT TGCCAAAATC ATTGAGAAAA CCGGTTACGG
 201 CGCGAAGGAA AAAACGGAAG ATACATTGCC GCAACCCGAA GCAGAACACC
 251 ATATCGGCTG GCGGCTGTGG CTGCTGTTCA CCATCAACGT CCCGTTCCTT
 301 ATCGGCATGG CGGGGATGAT GATCGGCAGA CACGATTGGA TGATTCCGCC
 351 GTTGTGGCAG TTCGCATTGG CAAGCGTGGT GCAGCTTTGG CTGGCAATCC
 401 CGTTTTACAA AAGCGCGTGG GCGAGCATTA AGGGCGGACT GGCGAATATG
 451 GACGTGCTGG TTACCATCGG CACGGTCTCG ATTTACCTGT ATTCCGTCTA
 501 TATGCTGTTT TTCAGCCCGC ACGCGGCGTA CGGTATGGCG CATGTGTATT
 551 TTGAAGTGGG CGTGATGGTG ATCGGTTTTG TGTCACTGGG TAAATTTTTG
 601 GAACACCGTA CCAAAAAATC CAGCCTCAAC AGCTTGGGCT TGCTGCTCAA
 651 ACTTACACCA ACCCAAGTCA ACGTGCAACG CAACGGCGAA TGGAAACAGC
 701 TTCCCATCGA CCAAGTGCAA ATCGGCGACC TTATCCGCGC CAACCACGGC
 751 GAACGCATTG CCGCAGACGG CATCATTGAA AGCGGCAGCG GTTGGGCGGA
 801 CGAGAGCCAT CTTACCGGCG AATCCAATCC TGAAGAAAAA AAGGCGGGCG
 851 GCAAAGTGTT GGCGGGCGCG TTAATGACCG AAGGCAGTGT GGTGTACCGC
 901 GCCACGCAGC TCGGCAGCCA AACCCAGCTC GGCGACATGA TGAACGCGCT
 951 CTCTGAAGCA CAAGGCAGTA AAGCACCGAT TGCGCGCGTA GCCGATAAAG
1001 CGGCTGCGGT ATTCGTGCCT GCCGTCGTGG GCATTGCGTT GTTGACTTTT
1051 ATTGTTACTT GGCTGATTAA GGGCGATTGG ACGGTTGCGC TGATGCACGC
1101 CGTCGCCGTT TTGGTGATTG CCTGCCCGTG CGCGCTGGGT CTGGCAACCC
1151 CTGCCGCGAT TATGGTCGGT ATGGGCAAAG CGGTTAAACA CGGTATTTGG
1201 TTTAAAGACG CGGCAGCAAT GGAGGAAGCC GCCCACGTCG ATGCCGTCGT
1251 GTTGGACAAA ACCGGTACGC TGACCGAAGG CAGCCCGCAG GTTGCCGCCG
```

-continued

```
1301 TTTATTGCGT TCCCGACAGC GGCTTTGACG AAGACGCTTT GTACCGCATC

1351 GCCGCCGCCG TCGAACAAAA CGCCGCCCAT CCGCTCGCCC GTGCCATCGT

1401 CTCCGCCGCC CAAGCGCGCG GTTTGGACAT TCCCGCCGCA CAAAACGCAC

1451 AAACCGTTGT CGGCGCAGGC ATTACCGCCG AAGTGGAAGG CGTGGGTTTG

1501 GTGAAAGCAG GCAAAGCCGA ATTTGCCGAA CTGGCCTTGC CGAAGTTTTT

1551 AGACGGCGTT TGGGATATTG CAAGCATTGT TGCGGTCTCA GTCGATAACA

1601 AACCCATCGG CGCATTCGCA CTTGCCGACG CGTTGAAAGC CGATACCGCC

1651 GAAGCCATAG GCCGTCTGAA AAAACACAAT ATCGATGTCT ATATTATGAG

1701 CGGCGACAAC CAAGGCACGG TCGAATACGT CGCCAAACAA CTGGGCATCG

1751 CACACGCCTT CGGCAACATG AGTCCGCGCG ATAAAGCTGC CGAAGTGCAA

1801 AAACTCAAAG CCGCCGGCAA AACCGTGGCG ATGGTCGGCG ACGGCATCAA

1851 CGACGCGCCC GCGCTTGCCG CCGCTAACGT CAGCTTCGCC ATGAAAGGCG

1901 GAGCGGACGT TGCCGAACAT ACCGCATCCG CCACGCTGAT GCAGCATTCG

1951 GTCAACCAAC TCGCCGATGC TCTGCTGGTG TCGCAAGCCA CTTTGAAAAA

2001 CATCAAGCAA AACCTGTTTT TCGCCTTCTT CTACAATATT TTGGGCATTC

2051 CTCTCGCCGC GCTTGGCTTT TTAAATCCCG TCATCGCTGG CGCGGCAATG

2101 GCGGCAAGCT CGGTTTCCGT GTTGAGCAAT GCCTTGCGCC TGAAACGGGT

2151 AAAAATCGAT TAG
```

This corresponds to the amino acid sequence <SEQ ID 1830; ORF 589>:

m589.pep..

```
  1 MQQKIRFQIE GMTCQACASR IEKVLNKKDF VESAGVNFAS EEAQVVFDDS

 51 KTSVADIAKI IEKTGYGAKE KTEDTLPQPE AEHHIGWRLW LLFTINVPFL

101 IGMAGMMIGR HDWMIPPLWQ FALASVVQLW LAIPFYKSAW ASIKGGLANM

151 DVLVTIGTVS IYLYSVYMLF FSPHAAYGMA HVYFEVGVMV IGFVSLGKFL

201 EHRTKKSSLN SLGLLLKLTP TQVNVQRNGE WKQLPIDQVQ IGDLIRANHG

251 ERIAADGIIE SGSGWADESH LTGESNPEEK KAGGKVLAGA LMTEGSVVYR

301 ATQLGSQTQL GDMMNALSEA QGSKAPIARV ADKAAAVFVP AVVGIALLTF

351 IVTWLIKGDW TVALMHAVAV LVIACPCALG LATPAAIMVG MGKAVKHGIW

401 FKDAAAMEEA AHVDAVVLDK TGTLTEGSPQ VAAVYCVPDS GFDEDALYRI

451 AAAVEQNAAH PLARAIVSAA QARGLDIPAA QNAQTVVGAG ITAEVEGVGL

501 VKAGKAEFAE LALPKFLDGV WDIASIVAVS VDNKPIGAFA LADALKADTA

551 EAIGRLKKHN IDVYIMSGDN QGTVEYVAKQ LGIAHAFGNM SPRDKAAEVQ

601 KLKAAGKTVA MVGDGINDAP ALAAANVSFA MKGGADVAEH TASATLMQHS

651 VNQLADALLV SQATLKNIKQ NLFFAFFYNI LGIPLAALGF LNPVIAGAAM

701 AASSVSVLSN ALRLKRVKID *
```

Computer analysis of this amino acid sequence gave the following results:

Homology with a predicted ORF from *N. gonorrhoeae*
  m589/g589 94.2% identity in 725 aa overlap

```
                       10        20        30        40        50        60
m589.pep       MQQKIRFQIEGMTCQACASRIEKVLNKKDFVESAGVNFASEEAQVVFDDSKTSVADIAKI
               ||||||||||:||||||||||||||||||||||||||||||||||:|| |||||||||||
g589           MQQKIRFQIEAMTCQACASRIEKVLNKKDFVESAGVNFASEEAQVTFDGSKTSVADIAKI
                       10        20        30        40        50        60

                       70        80        90       100      1     110
m589.pep       IEKTGYGAKEKTEDTLPQPEAEHHIGWRLWLLFTINVPFLIGMAGMMIG-----RHDWMI
               ||||||||||||||||||||||||||||||||:|||:||||||:|||:      ||||||
g589           IEKTGYGAKEKTEDTLPQPEAEHHIGWRLWLLLTINIPFLIGMVGMMLKGLNWTRHDWMI
                       70        80        90       100       110       120

                  120       130       140       150       160       170
m589.pep       PPLWQFALASVVQLWLAIPFYKSAWASIKGGLANMDVLVTIGTVSIYLYSVYMLFFSPHA
               ||:|||:|||:|||||||||||||||||||||||||||||||||||||||||||||| ||
g589           PPVWQFVLASIVQLWLAIPFYKSAWASIKGGLANMDVLVTIGTVSIYLYSVYMLFFSSHA
                      130       140       150       160       170       180

                  180       190       200       210       220       230
m589.pep       AYGMAHVYFEVGVMVIGFVSLGKFLEHRTKKSSLNSLGLLLKLTPTQVNVQRNGEWKQLP
               |:||||||||:|||||||||||||||||||||||||||||||||||||||||||||||||
g589           AHGMAHVYFEAGVMVIGFVSLGKFLEHRTKKSSLNSLGLLLKLTPTQVNVQRNGEWKQLP
                      190       200       210       220       230       240

                  240       250       260       270       280       290
m589.pep       IDQVQIGDLIRANHGERIAADGIIESGSGWADESHLTGESNPEEKKAGGKVLAGALMTEG
               |||||||||||:||||||||||||||||||||||||||||||||||||||||||||||||
g589           IDQVQIGDLIRTNHGERIAADGIIESGSGWADESHLTGESNPEEKKAGGKVLAGALMTEG
                      250       260       270       280       290       300

                  300       310       320       330       340       350
m589.pep       SVVYRATQLGSQTQLGDMMNALSEAQGSKAPIARVADKAAAVFVPAVVGIALLTFIVTWL
               ||||||:|||||| |||||||||||||||||||||||||||||||:|||||||||||:||
g589           SVVYRAAQLGSQTLLGDMMNALSEAQGSKAPIARVADKAAAVFVPTVVGIALLTFIVAWL
                      310       320       330       340       350       360

                  360       370       380       390       400       410
m589.pep       IKGDWTVALMHAVAVLVIACPCALGLATPAAIMVGMGKAVKHGIWFKDAAAMEEAAHVDA
               ||||||||||||||||||||||||||||||||||||||||||||||||||||||||||||
g589           IKGDWTVALMHAVAVLVIACPCALGLATPAAIMVGMGKAVKHGIWFKDAAAMEEAAHVDA
                      370       380       390       400       410       420

                  420       430       440       450       460       470
m589.pep       VVLDKTGTLTEGSPQVAAVYCVPDSGFDEDALYRIAAAVEQNAAHPLARAIVSAAQARGL
               |||||||||||| ||||||| |||||||||||||||||||||||||||||||||||||||
g589           VVLDKTGTLTEGRPQVAAVYYVPDSGFDEDALYRIAAAVEQNAAHPLARAIVSAAQARGL
                      430       440       450       460       470       480

                  480       490       500       510       520       530
m589.pep       DIPAAQNAQTVVGAGITAEVEGVGLVKAGKAEFAELALPKFLDGVWDIASIVAVSVDNKP
               :||||||||||||||||||||||||||:||||||||:|||| ||||:||| |:|||::||
g589           EIPAAQNAQTVVGAGITAEVEGVGLVKSGKAEFAELTLPKFSDGVWEIASAVTVSVNGKP
                      490       500       510       520       530       540

                  540       550       560       570       580       590
m589.pep       IGAFALADALKADTAEAIGRLKKHNIDVYIMSGDNQGTVEYVAKQLGIAHAFGNMSPRDK
               ||||||:|||||||||||||||||||||||||||||:|||||||||||||||||||| ||
g589           IGAFALSDALKADTAEAIGRLKKHNIDVYIMSGDNQSTVEYVAKQLGIAHAFGNMSPCDK
                      550       560       570       580       590       600

                  600       610       620       630       640       650
m589.pep       AAEVQKLKAAGKTVAMVGDGINDAPALAAANVSFAMKGGADVAEHTASATLMQHSVNQLA
               ||||||||||||||||||||||||||||||||||||||||||||||||||||||||||||
g589           AAEVQKLKAAGKTVAMVGDGINDAPALAAANVSFAMKGGADVAEHTASATLMQHSVNQLA
                      610       620       630       640       650       660

                  660       670       680       690       700       710
m589.pep       DALLVSQATLKNIKQNLFFAFFYNILGIPLAALGFLNPVIAGAAMAASSVSVLSNALRLK
               ||||:|||||:|||||||||||||||||||||||||||||||||||||||||:|||||
g589           DALLISQATLENIKQNLFFAFFYNILGIPLAALGFLNPVIAGAAMAASSVSVLGNALRLK
                      670       680       690       700       710       720

                  720
m589.pep       RVKIDX
                |||||
g589           WVKIDX
```

The following partial DNA sequence was identified in *N. meningitidis* <SEQ ID 1831>:

a589.seq

```
  1 ATGCAACAAA AAGTCCGTTT CCAAATCGAA GGCATGACCT GCCAGGCATG

 51 TGCTTCGCGC ATTGAAAAAG TGTTGAACAA AAAAGATTTT GTCGAATCGG

101 CGGGGGTAAA CTTCGCCAGC GAAGAGGCTC AGGTAGTGTT TGACGACAGC

151 AAAACCTCAG TAGCCGACAT TGCCAAAATC ATTGAGAAAA CCGGTTACGG
```

-continued

```
 201 CGCGAAGGAA AAAACGGAAG ATACATTGCC GCAACCCGAA GCAGAACACC

 251 ATATCGGCTG GAGGTTGTGG CTTTTGCTGG CCATCAATAT CCCGTTCCTT

 301 ATCGGTATGG TAGGGATGAT GCTAAAAGGG CTGAATTGGA CACGGCATGA

 351 TTGGATGTTG TCGCCCTTGT TGCAGTTTGC ATTGGCGAGT GTGGTGCAGC

 401 TTTGGCTGGC GGTGCCATTT TACAAAAGCG CGTGGGCGAG CATTAAAGGC

 451 GGGCTGGCGA ATATGGACGT ACTCGTTACC ATCGGCACGG TCTCGATTTA

 501 CCTGTATTCC GTCTATATGC TGTTTTTCAG CCCGCACGCG GCGTACGGTA

 551 TGGCGCATGT GTATTTTGAA GTAGGCATAA TGGTGATTGG TTTTGTGTCA

 601 CTGGGTAAAT TTTTGGAACA CCGCACCAAA AAATCCAGCC TGAACAGCTT

 651 GGGCTTGCTG CTCAAACTCA CGCCAACCCA AGTCAACGTG CAACGCGATG

 701 GCGAATGGCG GCAGCTACCC ATCGACCAAG TGCAAATCGG CGACCTAATC

 751 CGCGCCAATC ACGGCGAACG CATTGCCGCC GACGGCATCA TAGAAAGCGG

 801 CAGCGGCTGG GCGGACGAAA GCCATCTTAC CGGCGAATCC AATCCCGAAG

 851 AGAAAAAGGC AGGCGGCAAA GTATTGGCGG GCGCGCTGAT GACTGAAGGC

 901 AGCGTGGTGT ACCGCGCCGC GCAGCTCGGC AGCCAAACCC TGCTCGGCGA

 951 CATGATGAAC GCGCTCTCCG AAGCGCAAGG CAGTAAAGCA CCGATTGCGC

1001 GTGTGGCGGA CAAGGCGGCG GCGGTATTCG TGCCTGCCGT TGTGGGCATC

1051 GCACTTTTGA CTTTTATCGC TACTTGGCTG ATTAAGGGCG ATTGGACGCT

1101 CGCATTGATG CACGCCGTCG CCGTTTTGGT GATTGCCTGC CCGTGTGCAC

1151 TCGGTTTGGC AACCCCTGCT GCGATTATGG TCGGTATGGG CAAAGCGGTT

1201 AAACACGGTA TTTGGTTTAA AGACGCGGCA GCAATGGAAG AAGCCGCCCA

1251 CGTTGATGCC GTCGTGCTGG ACAAAACCGG CACGCTGACC GAAGGCAAGC

1301 CGCAGGTTGC CGCCGTTTAT TGTGTTCCCG ACAGCGGCTT TGACGAAGAC

1351 GCTTTGTACC GCATCGCCGC CGCCGTCGAA CAAAACGCCG CCCATCCGCT

1401 CGCCCGTGCC ATCGTCTCCG CCGCCCAGGC GCGCGGTTTG GAGATTCCCA

1451 CCGCACAAAA TGCCCAAACC ATTGTCGGCG CGGGCATTAC CGCCGAAGTA

1501 AAAGGCGCGG GTTTGGTAAA AGCAGGCAAA GCCGAATTTG CCGAACTGAC

1551 CTTGCCGAAG TTTTCAGACG GCGTTTGGGA AATCGCCAGT GTGGTTGCCG

1601 TATCTGTAAA CGGCAAACCT ATCGGCGCAT TCGCACTCGC CGACGCGTTG

1651 AAAGCCGATA CCGCCGAAGC CATAGGCCGT CTGAAAAAAC ACAATATCGA

1701 TGTCTATATT ATGAGCGGCG ATAACCAAGG CACGGTCGAG TACGTCGCCA

1751 AACAACTGGG CATCGCACAC GCCTTCGGTA ATATGAGTCC GCGCGACAAA

1801 GCCGCCGAAG TGCAGAAACT CAAAGCCGCC GGCAAAACCG TGGCGATGGT

1851 CGGCGACGGC ATCAACGACG CGCCCGCGCT CGCCGCCGCC AACGTCAGCT

1901 TCGCCATGAA AGGCGGTGCA GACGTTGCCG AACACACCGC ATCCGCCACA

1951 CTGATGCAGC ATTCGGTCAA CCAGCTCGCC GATGCGCTAT CGGTATCGCG

2001 AGCGACGTTG AAAAACATCA AGCAAAACCT GTTTTTCGCC TTCTTCTACA

2051 ATATTTTGGG CATTCCGCTC GCCGCGCTCG GCTTTTTAAA CCCCGTCATC

2101 GCAGGCGCGG CAATGGCGGC AAGCTCGGTT TCCGTGTTGA GCAACGCCTT

2151 GCGCCTGAAA CGGGTAAAAA TCGATTGA
```

This corresponds to the amino acid sequence <SEQ ID 1832; ORF 589.a>:

```
a589.pep

  1 MQQKVRFQIE GMTCQACASR IEKVLNKKDF VESAGVNFAS EEAQVVFDDS

 51 KTSVADIAKI IEKTGYGAKE KTEDTLPQPE AEHHIGWRLW LLLAINIPFL

101 IGMVGMMLKG LNWTRHDWML SPLLQFALAS VVQLWLAVPF YKSAWASIKG

151 GLANMDVLVT IGTVSIYLYS VYMLFFSPHA AYGMAHVYFE VGIMVIGFVS

201 LGKFLEHRTK KSSLNSLGLL LKLTPTQVNV QRDGEWRQLP IDQVQIGDLI

251 RANHGERIAA DGIIESGSGW ADESHLTGES NPEEKKAGGK VLAGALMTEG

301 SVVYRAAQLG SQTLLGDMMN ALSEAQGSKA PIARVADKAA AVFVPAVVGI

351 ALLTFIATWL IKGDWTLALM HAVAVLVIAC PCALGLATPA AIMVGMGKAV

401 KHGIWFKDAA AMEEAAHVDA VVLDKTGTLT EGKPQVAAVY CVPDSGFDED

451 ALYRIAAAVE QNAAHPLARA IVSAAQARGL EIPTAQNAQT IVGAGITAEV

501 KGAGLVKAGK AEFAELTLPK FSDGVWEIAS VVAVSVNGKP IGAFALADAL

551 KADTAEAIGR LKKHNIDVYI MSGDNQGTVE YVAKQLGIAH AFGNMSPRDK

601 AAEVQKLKAA GKTVAMVGDG INDAPALAAA NVSFAMKGGA DVAEHTASAT

651 LMQHSVNQLA DALSVSRATL KNIKQNLFFA FFYNILGIPL AALGFLNPVI

701 AGAAMAASSV SVLSNALRLK RVKID*
```

m589/a589 94.9% identity in 725 aa overlap

```
                  10        20        30        40        50        60
m589.pep  MQQKIRFQIEGMTCQACASRIEKVLNKKDFVESAGVNFASEEAQVVFDDSKTSVADIAKI
          ||||:|||||||||||||||||||||||||||||||||||||||||||||||||||||||
a589      MQQKVRFQIEGMTCQACASRIEKVLNKKDFVESAGVNFASEEAQVVFDDSKTSVADIAKI
                  10        20        30        40        50        60

                  70        80        90       100       1    110
m589.pep  IEKTGYGAKEKTEDTLPQPEAEHHIGWRLWLLFTINVPFLIGMAGMMIG-----RHDWMI
          ||||||||||||||||||||||||||||||||::||:||||||:|||:      |||||:
a589      IEKTGYGAKEKTEDTLPQPEAEHHIGWRLWLLLAINIPFLIGMVGMMLKGLNWTRHDWML
                  70        80        90       100       110       120

            120       130       140       150       160       170
m589.pep  PPLWQFALASVVQLWLAIPFYKSAWASIKGGLANMDVLVTIGTVSIYLYSVYMLFFSPHA
           || |||||||||||||:||||||||||||||||||||||||||||||||||||||||||
a589      SPLLQFALASVVQLWLAVPFYKSAWASIKGGLANMDVLVTIGTVSIYLYSVYMLFFSPHA
                 130       140       150       160       170       180

            180       190       200       210       220       230
m589.pep  AYGMAHVYFEVGVMVIGFVSLGKFLEHRTKKSSLNSLGLLLKLTPTQVNVQRNGEWKQLP
          ||||||||||||:|||||||||||||||||||||||||||||||||||||||:|||:|||
a589      AYGMAHVYFEVGIMVIGFVSLGKFLEHRTKKSSLNSLGLLLKLTPTQVNVQRDGEWRQLP
                 190       200       210       220       230       240

            240       250       260       270       280       290
m589.pep  IDQVQIGDLIRANHGERIAADGIIESGSGWADESHLTGESNPEEKKAGGKVLAGALMTEG
          ||||||||||||||||||||||||||||||||||||||||||||||||||||||||||||
a589      IDQVQIGDLIRANHGERIAADGIIESGSGWADESHLTGESNPEEKKAGGKVLAGALMTEG
                 250       260       270       280       290       300

            300       310       320       330       340       350
m589.pep  SVVYRATQLGSQTQLGDMMNALSEAQGSKAPIARVADKAAAVFVPAVVGIALLTFIVTWL
          ||||||:|||||| ||||||||||||||||||||||||||||||||||||||||||:|||
a589      SVVYRAAQLGSQTLLGDMMNALSEAQGSKAPIARVADKAAAVFVPAVVGIALLTFIATWL
                 310       320       330       340       350       360

            360       370       380       390       400       410
m589.pep  IKGDWTVALMHAVAVLVIACPCALGLATPAAIMVGMGKAVKHGIWFKDAAAMEEAAHVDA
          ||||||:|||||||||||||||||||||||||||||||||||||||||||||||||||||
a589      IKGDWTLALMHAVAVLVIACPCALGLATPAAIMVGMGKAVKHGIWFKDAAAMEEAAHVDA
                 370       380       390       400       410       420

            420       430       440       450       460       470
m589.pep  VVLDKTGTLTEGSPQVAAVYCVPDSGFDEDALYRIAAAVEQNAAHPLARAIVSAAQARGL
          ||||||||||||:|||||||||||||||||||||||||||||||||||||||||||||||
a589      VVLDKTGTLTEGKPQVAAVYCVPDSGFDEDALYRIAAAVEQNAAHPLARAIVSAAQARGL
                 430       440       450       460       470       480
```

-continued

```
                480       490       500       510       520       530
m589.pep   DIPAAQNAQTVVGAGITAEVEGVGLVKAGKAEFAELALPKFLDGVWDIASIVAVSVDNKP
           :||:||||||:|||||||||:|:|||||||||||||:|||| ||||:|||:|||||::||
a589       EIPTAQNAQTIVGAGITAEVKGAGLVKAGKAEFAELTLPKFSDGVWEIASVVTVSVNGKP
                     490       500       510       520       530       540

                540       550       560       570       580       590
m589.pep   IGAFALADALKADTAEAIGRLKKHNIDVYIMSGDNQGTVEYVAKQLGIAHAFGNMSPRDK
           ||||||||||||||||||||||||||||||||||||||||||||||||||||||||||||
a589       IGAFALADALKADTAEAIGRLKKHNIDVYIMSGDNQGTVEYVAKQLGIAHAFGNMSPRDK
                     550       560       570       580       590       600

                600       610       620       630       640       650
m589.pep   AAEVQKLKAAGKTVAMVGDGINDAPALAAANVSFAMKGGADVAEHTASATLMQHSVNQLA
           ||||||||||||||||||||||||||||||||||||||||||||||||||||||||||||
a589       AAEVQKLKAAGKTVAMVGDGINDAPALAAANVSFAMKGGADVAEHTASATLMQHSVNQLA
                     610       620       630       640       650       660

                660       670       680       690       700       710
m589.pep   DALLVSQATLKNIKQNLFFAFFYNILGIPLAALGFLNPVIAGAAMAASSVSVLSNALRLK
           ||| ||:|||||||||||||||||||||||||||||||||||||||||||||||||||||
a589       DALSVSRATLKNIKQNLFFAFFYNILGIPLAALGFLNPVIAGAAMAASSVSVLSNALRLK
                     670       680       690       700       710       720

                720
m589.pep   RVKIDX
           ||||||
a589       RVKIDX
```

The following partial DNA sequence was identified in *N. gonorrhoeae* <SEQ ID 1833>:

g590.seq..

```
   1 atgaaaaaac ctttgatttc agttgcggca gtattgctcg gcgttgcttt
  51 gggtacacct tattatttgg gtgtcaaagc agaagaaagt ctgacgcagc
 101 agcaaaaaat attgcagaaa acgggctttt tgaccgtcga atcgcaccag
 151 tatgatcgag gctggtttac ctctacggaa acgacggtca tccgtctgaa
 201 acccgagttg ctgcataatg cgcagaaata cctgccggat aacttgaaaa
 2S1 tagtgttgga acagccggtt acgctggtaa accatatcac gcacggccct
 301 ttcgccggcg gattcggcac gcaggcgcac attgaaaccg agttcaaata
 351 cgcgcctgaa acggaaaaag ttttggaacg ctttttgggg aaacaagttc
 401 cggtttccct tgccaatacc gtttatttca acggcagcgg taaaatggaa
 451 gtcagtgttc ccgctttcga ttatgaagaa ctgtcgggca tcaggctgca
 501 ctgggaaggc ctgacggggg aaacggttta tcaaaaaggt ttcaaaagct
 551 accgcaacag ctatgatgcg cccttgttca aaatcaagct ggcagacaaa
 601 ggcgatgccg cgtttgaaaa agcgcatttc gattcggaaa cttcagacgg
 651 catcaatccg cttgctttgg gcagcagcaa tctgactttg gaaaaatttt
 701 cgctcgaatg gaaagagggt gtcgattaca acgtcaaatt gaacgaactg
 751 gtcaacctcg ttaccgattt gcagatcggc gcgtttatca atcccaacgg
 801 cagcatcgca ccttccaaaa tcgaagtcgg caagctggct tttcaacca
 851 agaccgggga atcgggcgcg tttatcgaca gcgaagggcg gttccgtttc
 901 gatacgttgg tgtacggcga tgaaaaatac ggcccgctgg acatccatat
 951 cgctgccgaa cacctcgatg cttctgcctt aaccgtattg aaacgcaagt
1001 ttgcacaaat ttctgccaaa aaaatgactg aggaacaaat ccgcaatgat
1051 ttgattgcgg cagtcaaagg cgatgcttcc ggattattta cccatgaccc
1101 ggtactaaat atcaaaattt tccgtttcac cctgcctcag ggaaaaattg
```

-continued

```
1151 atgtgggcgg aaaaatcatg tttaaaggca tgaagaagga agatttgaac
1201 caattgggac tgatgttaaa gaaaaccgag gcaaacatca gaatgagtat
1251 tcctcaaaaa atgttggaag atttggcggt aagtcaggct ggaaatattt
1301 tcagtgtaaa tgccgaagat gaggcggaag ccagagcaag cattgccgat
1351 attaatgaaa cattgcgcct gatggtggac agtacggtcc aaagtatggc
1401 aagggaaaaa tatcttactt tagacggtaa tcagattgat acggtcattt
1451 cccttaaaaa caacgccctg aagttaaacg ggaaaacgct gcaaaatgaa
1501 cccgatcctg attttgacga gggagatatg gtttccggcc agccgcatta
1551 a
```

This corresponds to the amino acid sequence <SEQ ID 1834: ORF 590.ng>:

```
g590.pep..
  1 MKKPLISVAA VLLGVALGTP YYLGVKAEES LTQQQKILQK TGFLTVESHQ
 51 YDRGWFTSTE TTVIRLKPEL LHNAQKYLPD NLKIVLEQPV TLVNHITHGP
101 FAGGFGTQAH IETEFKYAPE TEKVLERFFG KQVPVSLANT VYFNGSGKME
151 VSVPAFDYEE LSGIRLHWEG LTGETVYQKG FKSYRNSYDA PLFKIKLADK
201 GDAAFEKAHF DSETSDGINP LALGSSNLTL EKFSLEWKEG VDYNVKLNEL
251 VNLVTDLQIG AFINPNGSIA PSKIEVGKLA FSTKTGESGA FIDSEGRFRF
301 DTLVYGDEKY GPLDIHIAAE HLDASALTVL KRKFAQISAK KMTEEQIRND
351 LIAAVKGDAS GLFTHDPVLN IKIFRFTLPQ GKIDVGGKIM FKGMKKEDLN
401 QLGLMLKKTE ANIRMSIPQK MLEDLAVSQA GNIFSVNAED EAEARASIAD
451 INETLRLMVD STVQSMAREK YLTLDGNQID TVISLKNNAL KLNGKTLQNE
501 PDPDFDEGDM VSGQPH*
```

The following partial DNA sequence was identified in *N. meningitidis* <SEQ ID 1835>:

```
m590.seq (partial) ..
  1 ..TGGTTTACCT CTATGGAAAC GACGGTCATC CGTCTGAAAC CCGAGTTGCT
 51   GAATAATGCC CGAAAATACC TGCCGGATAA CCTGAAAACA GTGTTGGAAC
101   AGCCGGTTAC GCTGGTTAAC CATATCACGC ACGGCCCTTT CGCCGGCGGA
151   TTCGGCACGC AGGCGTACAT TGAAACCGAG TTCAAATACG CGCCTGAAAC
201   GGAAAAAGTT CTGGAACGCT TTTTTGGAAA ACAAGTCCCG GCTTCCCTTG
251   CCAATACCGT TTATTTTAAC GGCAGCGGTA AAATGGAAGT CAGTGTTCCC
301   GCCTTCGATT ATGAAGAGCT GTCGGGCATc AG.CTGCACT GGGAAkGCCT
351   GACGGGAGAA ACGGTTTATC AAAAAGGTTT CAAAAGCTAC CGGAACGGCT
401   ATGATGCCCC CTTGTTTAAA ATCAAGCTGG CAGACAAAGG CGATGCCGCG
451   TTTGAAAAAG TGCATTTCGA TTCGGAAACT TCAGACGGCA TCAATCCGCT
501   TGCTTTGGGC AGCAGCAATC TGACCTTGGA AAAATTCTCC CTAGAATGGA
551   AAGAGGGTGT CGATTACAAC GTCAAGTTAA ACGAACTGGT CAATCTTGTT
```

-continued

```
 601   ACCGATTTGC AGATTGGCGC GTTTATCAAT CCCAACGGCA GCATCGCACC
 651   TTCCAAAATC GAAGTCGGCA AACTGGCTTT TTCAACCAAG ACCGGGGAAT
 701   CAGGCGCGTT TATCAACAGT GAAGGGCAGT TCCGTTTCGA TACACTGGTG
 751   TACGGCGATG AAAAATACGG CCCGCTGGAC ATCCATATCG CTGCCGAACA
 801   CCTCGATGCT TCTGCCTTAA CCGTATTGAA ACGCAAGTTT GCACAAATTT
 851   CCGCCAAAAA AATGACCGAG GAACAAATCC GCAATGATTT GATTGCCGCC
 901   GTCAAAGGAG AGGCTTCCGG ACTGTTCACC AACAATCCCG TATTGGACAT
 951   TAAAACTTTC CGATTCACGC TGCCATCGGG AAAAATCGAT GTGGGCGGAA
1001   AAATCATGTT TAAAGACATG AAGAAGGAAG ATTTGAATCA ATTGGGTTTG
1051   ATGCTGAAGA AAACCGAAGC CGACATCAGA ATGAGTATTC CCCAAAAAAT
1101   GCTGGAAGAC TTGGCGGTCA GTCAAGCAGG CAATATTTTC AGCGTCAATG
1151   CCGAAGATGA GGCGGAAGGC AGGGCAAGTC TTGACGACAT CAACGAGACC
1201   TTGCGCCTGA TGGTGGACAG TACGGTTCAG AGTATGGCAA GGGAAAAATA
1251   TCTGACTTTG AACGGCGACC AGATTGATAC TGCCATTTCT CTGAAAAACA
1301   ATCAGTTGAA ATTGAACGGT AAAACGTTGC AAAACGAACC GGAGCCGGAT
1351   TTTGATGAAG GCGGTATGGT TTCAGAGCCG CAGCAGTAA
```

This corresponds to the amino acid sequence <SEQ ID 1836; ORF 590>:

```
m590.pep.. (partial)

  1   ..WFTSMETTVI RLKPELLNNA RKYLPDNLKT VLEQPVTLVN HITHGPFAGG
 51   FGTQAYIETE FKYAPETEKV LERFFGKQVP ASLANTVYFN GSGKMEVSVP
101   AFDYEELSGI XLHWEXLTGE TVYQKGFKSY RNGYDAPLFK IKLADKGDAA
151   FEKVHFDSET SDGINPLALG SSNLTLEKFS LEWKEGVDYN VKLNELVNLV
201   TDLQIGAFIN PNGSIAPSKI EVGKLAFSTK TGESGAFINS EGQFRFDTLV
251   YGDEKYGPLD IHIAAEHLDA SALTVLKRKF AQISAKKMTE EQIRNDLIAA
301   VKGEASGLFT NNPVLDIKTF RFTLPSGKID VGGKIMFKDM KKEDLNQLGL
351   MLKKTEADIR MSIPQKMLED LAVSQAGNIF SVNAEDEAEG RASLDDINET
401   LRLMVDSTVQ SMAREKYLTL NGDQIDTAIS LKNNQLKLNG KTLQNEPEPD
451   FDEGGMVSEP QQ*
```

m590/g590 93.1% identity in 462 aa overlap

```
                              10         20         30
m590.pep                   WFTSMETTVIRLKPELLNNARKYLPDNLKT
                           ||||||||||||||||||:||:||||||||
g590     VKAEESLTQQQKILQKTGFLTVESHQYERGWFTSTETTVIRLKPELLHNAQKYLPDNLKI
             30         40         50         60         70         80

                40         50         60         70         80         90
m590.pep VLEQPVTLVNHITHGPFAGGFGTQAYIETEFKYAPETEKVLERFFGKQVPASLANTVYFN
         |||||||||||||||||||||||||:||||||||||||||||||||||||:|||||||||
g590     VLEQPVTLVNHITHGPFAGGFGTQAHIETEFKYAPETEKVLERFFGKQVPVSLANTVYFN
             90        100        110        120        130        140
```

-continued

```
                   100       110       120       130       140       150
m590.pep    GSGKMEVSVPAFDYEELSGIXLHWEXLTGETVYQKGFKSYRNGYDAPLFKIKLADKGDAA
            |||||||||||||||||||| |||| ||||||||||||||||:|||||||||||||||||
g590        GSGKMEVSVPAFDYEELSGIRLHWEGLTGETVYQKGFKSYRNSYDAPLFKIKLADKGDAA
               150       160       170       180       190       200

                   160       170       180       190       200       210
m590.pep    FEKVHFDSETSDGINPLALGSSNLTLEKFSLEWKEGVDYNVKLNELVNLVTDLQIGAFIN
            |||:||||||||||||||||||||||||||||||||||||||||||||||||||||||||
g590        FEKAHFDSETSDGINPLALGSSNLTLEKFSLEWKEGVDYNVKLNELVNLVTDLQIGAFIN
               210       220       230       240       250       260

                   220       230       240       250       260       270
m590.pep    PNGSIAPSKIEVGKLAFSTKTGESGAFINSEGQFRFDTLVYGDEKYGPLDIHIAAEHLDA
            ||||||||||||||||||||||||||||:|||:|||||||||||||||||||||||||||
g590        PNGSIAPSKIEVGKLAFSTKTGESGAFIDSEGRFRFDTLVYGDEKYGPLDIHIAAEHLDA
               270       280       290       300       310       320

                   280       290       300       310       320       330
m590.pep    SALTVLKRKFAQISAKKMTEEQIRNDLIAAVKGEASGLFTNNPVLDIKTFRFTLPSGKID
            |||||||||||||||||||||||||||||||||:||||||::|||:|| ||||||:||||
g590        SALTVLKRKFAQISAKKMTEEQIRNDLIAAVKGDASGLFTHDPVLNIKIFRFTLPQGKID
               330       340       350       360       370       380

                   340       350       360       370       380       390
m590.pep    VGGKIMFKDMKKEDLNQLGLMLKKTEADIRMSIPQKMLEDLAVSQAGNIFSVNAEDEAEG
            |||||||| ||||||||||||||||||:||||||||||||||||||||||||||||||||:
g590        VGGKIMFKGMKKEDLNQLGLMLKKTEANIRMSIPQKMLEDLAVSQAGNIFSVNAEDEAEA
               390       400       410       420       430       440

                   400       410       420       430       440       450
m590.pep    RASLDDINETLRLMVDSTVQSMAREKYLTLNGDQIDTAISLKNNQLKLNGKTLQNEPEPD
            |||: |||||||||||||||||||||||||:|:||||:|||||| ||||||||||||:||
g590        RASIADINETLRLMVDSTVQSMAREKYLTLDGNQIDTVISLKNNALKLNGKTLQNEPDPD
               450       460       470       480       490       500

                    460
m590.pep    FDEGGMVS-EPQQX
            |||| ||| :|:
g590        FDEGDMVSGQPHX
               510
```

The following partial DNA sequence was identified in *N. meningitidis* <SEQ ID 1837>:

<u>a590.seq</u>

```
  1 ATGAAAAAAC CTTTGATTTC GGTTGCGGCA GCATTGCTCG GCGTTGCTTT
 51 GGGCACGCCT TATTATTTGG GTGTCAAAGC CGAAGAAAGC TTGACGCAGC
101 AGCAAAAAAT ATTGCAGGAA GCGGGCTTCT TGACCGTCGA ATCGCACCAA
151 TATGAGCGCG GCTGGTTTAC CTCTACGGAA ACGACGGTCA TCCGCTTGAA
201 ACCCGAGTTG CTGCATAATG CGCAGAAATA CCTGCCGGAT AACCTGAAAA
251 CAGTGTTGGA ACAGCCGGTT ACGCTGGTAA ACCATATCAC GCACGGTCCT
301 TTTGCCGGCG GATTCGGCAC GCAGGCGTAC ATTGAAACCG AGTTCAAATA
351 CGCGCCTGAA ACGGAAAAAG TTCTGGAACG CTTTTTTGGA AAACAAGTCC
401 CGGTTTCCCT TGCCAATACC GTTTATTTTA ACGGCAGCGG TAAAATGGAA
451 GTCAGTGTTC CCGCCTTCGA TTATGAAGAG CTGTCGGGCA TCAGGCTGCA
501 CTGGGAAGGC CTGACGGGAG AAACGGTTTA TCAAAAAGGT TTCAAAAGCT
551 ACCGGAACGG CTATGATGCC CCCTTGTTTA AAATCAAGCT GGCAGACAAA
601 GGCGATGCCG CGTTTGAAAA AGTGCATTTC GATTCGGAAA CTTCAGACGG
651 CATCAACCCG CTTGCTTTGG GCAGCAGCAA TCTGACCTTG GAAAAATTTT
701 CCTTAGAATG GAAAGAGGGT GTCGATTACA ACGTCAAGTT AAACGAACTG
751 GTCAATCTTG TTACCGATTT GCAGATTGGC GCGTTTATCA ATCCCAACGG
801 CAGCATCGCA CCTTCCAAAA TCGAAGTCGG CAAGCTGGCT TTTTCAACCA
851 AGACCGGGGA ATCGGGCGCG TTTATCGATA GCGAAGGGCA GTTCCGTTTT
```

-continued

```
 901 GGCACGCTGG TTTACGGCGA TGAAAAATAC GGCCCTCTGG ACATCCATAT

 951 CGCTGCCGAA CACCTCGATG CTTCTGCCTT AACCGTATTG AAACGCAAGT

1001 TTGCACGAAT TTCTGCCAAA AAAATGACTG AAGAACAAAT CCGCAATGAT

1051 TTGATTGCGG CAGTCAAAGG CGAGGCTTCC GGATTATTTA CCCATAACCC

1101 AGTATTGGAC ATTAAAACTT TCCGATTCAC GCTGCCATCG GGAAAAATCG

1151 ATGTGGGCGG AAAAATCATG TTTAAAGACA TGAAGAAGGA AGATTTGAAC

1201 CAATTGGGTT TGATGCTGAA GAAAACCGAA GCCGACATCA GAATGAGTAT

1251 TCCCCAAAAA ATGCTGGAAG ACTTGGCGGT CAGTCAAGCA GGCAATATTT

1301 TCAGCGTCAA TGCCGAAGAT GAGGCGGAAG GCAGGGCAAG TCTTGACGAC

1351 ATCAACGAGA CCTTGCGCCT GATGGTGGAC AGTACGGTTC AGAGTATGGC

1401 AAGGGAAAAA TATCTGACTT TGAACGGCGA CCAGATTGAT ACTGCCATTT

1451 CTCTGAAAAA CAATCAGTTG AAATTGAACG GTAAAACGTT GCAAAACGAA

1501 CCGGAGCCGG ATTTTGATGA AGGCGGTATG GTTTCAGAGC CGCAGCAGTA

1551 A
```

This corresponds to the amino acid sequence <SEQ ID 1838; ORF 590.a>:

a590.pep

```
  1 MKKPLISVAA ALLGVALGTP YYLGVKAEES LTQQQKILQE AGFLTVESHQ

 51 YERGWFTSTE TTVIRLKPEL LHNAQKYLPD NLKTVLEQPV TLVNHITHGP

101 FAGGFGTQAY IETEFKYAPE TEKVLERFFG KQVPVSLANT VYFNGSGKME

151 VSVPAFDYEE LSGIRLHWEG LTGETVYQKG FKSYRNGYDA PLFKIKLADK

201 GDAAFEKVHF DSETSDGINP LALGSSNLTL EKFSLEWKEG VDYNVKLNEL

251 VNLVTDLQIG AFINPNGSIA PSKIEVGKLA FSTKTGESGA FIDSEGQFRF

301 GTLVYGDEKY GPLDIHIAAE HLDASALTVL KRKFARISAK KMTEEQIRND

351 LIAAVKGEAS GLFTHNPVLD IKTFRFTLPS GKIDVGGKIM FKDMKKEDLN

401 QLGLMLKKTE ADIRMSIPQK MLEDLAVSQA GNIFSVNAED EAEGRASLDD

451 INETLRLMVD STVQSMAREK YLTLNGDQID TAISLKNNQL KLNGKTLQNE

501 PEPDFDEGGM VSEPQQ*
```

m590/a590 97.8% identity in 462 aa overlap

```
                                                10        20        30
m590.pep                                WFTSMETTVIRLKPELLNNARKYLPDNLKT
                                        |||| ||||||||||||:||:|||||||||
a590      VKAEESLTQQQKILQEAGFLTVESHQYERGWFTSTETTVIRLKPELLHNAQKYLPDNLKT
               30        40        50        60        70        80

                  40        50        60        70        80        90
m590.pep  VLEQPVTLVNHITHGPFAGGFGTQAYIETEFKYAPETEKVLERFFGKQVPASLANTVYFN
          ||||||||||||||||||||||||||||||||||||||||||||||||||:|||||||||
a590      VLEQPVTLVNHITHGPFAGGFGTQAYIETEFKYAPETEKVLERFFGKQVPVSLANTVYFN
               90       100       110       120       130       140

                 100       110       120       130       140       150
m590.pep  GSGKMEVSVPAFDYEELSGIXLHWEXLTGETVYQKGFKSYRNGYDAPLFKIKLADKGDAA
          |||||||||||||||||||| |||| ||||||||||||||||||||||||||||||||||
a590      GSGKMEVSVPAFDYEELSGIRLHWEGLTGETVYQKGFKSYRNGYDAPLFKIKLADKGDAA
              150       160       170       180       190       200
```

-continued

```
                 160       170       180       190       200       210
m590.pep  FEKVHFDSETSDGINPLALGSSNLTLEKFSLEWKEGVDYNVKLNELVNLVTDLQIGAFIN
          ||||||||||||||||||||||||||||||||||||||||||||||||||||||||||||
a590      FEKVHFDSETSDGINPLALGSSNLTLEKFSLEWKEGVDYNVKLNELVNLVTDLQIGAFIN
             210       220       230       240       250       260

                 220       230       240       250       260       270
m590.pep  PNGSIAPSKIEVGKLAFSTKTGESGAFINSEGQFRFDTLVYGDEKYGPLDIHIAAEHLDA
          ||||||||||||||||||||||||||||:||||||| |||||||||||||||||||||||
a590      PNGSIAPSKIEVGKLAFSTKTGESGAFIDSEGQFRFGTLVYGDEKYGPLDIHIAAEHLDA
             270       280       290       300       310       320

                 280       290       300       310       320       330
m590.pep  SALTVLKRKFAQISAKKMTEEQIRNDLIAAVKGEASGLFTNNPVLDIKTFRFTLPSGKID
          |||||||||||:||||||||||||||||||||||||||||:|||||||||||||||||||
a590      SALTVLKRKFARISAKKMTEEQIRNDLIAAVKGEASGLFTHNPVLDIKTFRFTLPSGKID
             330       340       350       360       370       380

                 340       350       360       370       380       390
m590.pep  VGGKIMFKDMKKEDLNQLGLMLKKTEADIRMSIPQKMLEDLAVSQAGNIFSVNAEDEAEG
          ||||||||||||||||||||||||||||||||||||||||||||||||||||||||||||
a590      VGGKIMFKDMKKEDLNQLGLMLKKTEADIRMSIPQKMLEDLAVSQAGNIFSVNAEDEAEG
             390       400       410       420       430       440

                 400       410       420       430       440       450
m590.pep  RASLDDINETLRLMVDSTVQSMAREKYLTLNGDQIDTAISLKNNQLKLNGKTLQNEPEPD
          ||||||||||||||||||||||||||||||||||||||||||||||||||||||||||||
a590      RASLDDINETLRLMVDSTVQSMAREKYLTLNGDQIDTAISLKNNQLKLNGKTLQNEPEPD
             450       460       470       480       490       500

                 460
m590.pep  FDEGGMVSEPQQX
          |||||||||||||
a590      FDEGGMVSEPQQX
             510
```

The following partial DNA sequence was identified in *N. meningitidis* <SEQ ID 1839>:

m590-1.seq

```
  1 ATGAAAAAAC CTTTGATTTC GGTTGCGGCA GCATTGCTCG GCGTTGCTTT
 51 GGGCACGCCT TATTATTTGG GTGTCAAAGC CGAAGAAAGC TTGACGCAGC
101 AGCAAAAAAT ATTGCAGGAA ACGGGCTTCT TGACCGTCGA ATCGCACCAA
151 TATGAGCGCG GCTGGTTTAC CTCTATGGAA ACGACGGTCA TCCGTCTGAA
201 ACCCGAGTTG CTGAATAATG CCCGAAAATA CCTGCCGGAT AACCTGAAAA
251 CAGTGTTGGA ACAGCCGGTT ACGCTGGTTA ACCATATCAC GCACGGCCCT
301 TTCGCCGGCG GATTCGGCAC GCAGGCGTAC ATTGAAACCG AGTTCAAATA
351 CGCGCCTGAA ACGGAAAAAG TTCTGGAACG CTTTTTTGGA AAACAAGTCC
401 CGGCTTCCCT TGCCAATACC GTTTATTTTA ACGGCAGCGG TAAAATGGAA
451 GTCAGTGTTC CCGCCTTCGA TTATGAAGAG CTGTCGGGCA TCAGGCTGCA
501 CTGGGAAGGC CTGACGGGAG AAACGGTTTA TCAAAAAGGT TTCAAAAGCT
551 ACCGGAACGG CTATGATGCC CCCTTGTTTA AAATCAAGCT GGCAGACAAA
601 GGCGATGCCG CGTTTGAAAA AGTGCATTTC GATTCGGAAA CTTCAGACGG
651 CATCAATCCG CTTGCTTTGG GCAGCAGCAA TCTGACCTTG GAAAAATTCT
701 CCCTAGAATG GAAAGAGGGT GTCGATTACA ACGTCAAGTT AAACGAACTG
751 GTCAATCTTG TTACCGATTT GCAGATTGGC GCGTTTATCA ATCCCAACGG
801 CAGCATCGCA CCTTCCAAAA TCGAAGTCGG CAAACTGGCT TTTTCAACCA
851 AGACCGGGGA ATCAGGCGCG TTTATCAACA GTGAAGGGCA GTTCCGTTTC
901 GATACACTGG TGTACGGCGA TGAAAAATAC GGCCCGCTGG ACATCCATAT
951 CGCTGCCGAA CACCTCGATG CTTCTGCCTT AACCGTATTG AAACGCAAGT
```

-continued

```
1001 TTGCACAAAT TTCCGCCAAA AAAATGACCG AGGAACAAAT CCGCAATGAT

1051 TTGATTGCCG CCGTCAAAGG AGAGGCTTCC GGACTGTTCA CCAACAATCC

1101 CGTATTGGAC ATTAAAACTT TCCGATTCAC GCTGCCATCG GGAAAAATCG

1151 ATGTGGGCGG AAAAATCATG TTTAAAGACA TGAAGAAGGA AGATTTGAAT

1201 CAATTGGGTT TGATGCTGAA GAAAACCGAA GCCGACATCA GAATGAGTAT

1251 TCCCCAAAAA ATGCTGGAAG ACTTGGCGGT CAGTCAAGCA GGCAATATTT

1301 TCAGCGTCAA TGCCGAAGAT GAGGCGGAAG GCAGGGCAAG TCTTGACGAC

1351 ATCAACGAGA CCTTGCGCCT GATGGTGGAC AGTACGGTTC AGAGTATGGC

1401 AAGGGAAAAA TATCTGACTT TGAACGGCGA CCAGATTGAT ACTGCCATTT

1451 CTCTGAAAAA CAATCAGTTG AAATTGAACG GTAAAACGTT GCAAAACGAA

1501 CCGGAGCCGG ATTTTGATGA AGGCGGTATG GTTTCAGAGC CGCAGCAGTA

1551 A
```

This corresponds to the amino acid sequence <SEQ ID 1840; ORF 590-1>:

m590-1.pep

```
  1 MKKPLISVAA ALLGVALGTP YYLGVKAEES LTQQQKILQE TGFLTVESHQ

 51 YERGWFTSME TTVIRLKPEL LNNARKYLPD NLKTVLEQPV TLVNHITHGP

101 FAGGFGTQAY IETEFKYAPE TEKVLERFFG KQVPASLANT VYFNGSGKME

151 VSVPAFDYEE LSGIRLHWEG LTGETVYQKG FKSYRNGYDA PLFKIKLADK

201 GDAAFEKVHF DSETSDGINP LALGSSNLTL EKFSLEWKEG VDYNVKLNEL

251 VNLVTDLQIG AFINPNGSIA PSKIEVGKLA FSTKTGESGA FINSEGQFRF

301 DTLVYGDEKY GPLDIHIAAE HLDASALTVL KRKFAQISAK KMTEEQIRND

351 LIAAVKGEAS GLFTNNPVLD IKTFRFTLPS GKIDVGGKIM FKDMKKEDLN

401 QLGLMLKKTE ADIRMSIPQK MLEDLAVSQA GNIFSVNAED EAEGRASLDD

451 INETLRLMVD STVQSMAREK YLTLNGDQID TAISLKNNQL KLNGKTLQNE

501 PEPDFDEGGM VSEPQQ*
```

m590-1/g590 93.6% identity in 516 aa overlap

```
                    10        20        30        40        50        60
m590-1.pep  MKKPLISVAAALLGVALGTPYYLGVKAEESLTQQQKILQETGFLTVESHQYERGWFTSME
            ||||||||||:||||||||||||||||||||||||||||:|||||||||||:|||||| |
g590        MKKPLISVAAVLLGVALGTPYYLGVKAEESLTQQQKILQKTGFLTVESHQYDRGWFTSTE
                    10        20        30        40        50        60

                    70        80        90       100       110       120
m590-1.pep  TTVIRLKPELLNNARKYLPDNLKTVLEQPVTLVNHITHGPFAGGFGTQAYIETEFKYAPE
            |||||||||||:||:|||||||| |||||||||||||||||||||||||:||||||||||
g590        TTVIRLKPELLHNAQKYLPDNLKIVLEQPVTLVNHITHGPFAGGFGTQAHIETEFKYAPE
                    70        80        90       100       110       120

                   130       140       150       160       170       180
m590-1.pep  TEKVLERFFGKQVPASLANTVYFNGSGKMEVSVPAFDYEELSGIRLHWEGLTGETVYQKG
            ||||||||||||||:|||||||||||||||||||||||||||||||||||||||||||||
g590        TEKVLERFFGKQVPVSLANTVYFNGSGKMEVSVPAFDYEELSGIRLHWEGLTGETVYQKG
                   130       140       150       160       170       180

                   190       200       210       220       230       240
m590-1.pep  FKSYRNGYDAPLFKIKLADKGDAAFEKVHFDSETSDGINPLALGSSNLTLEKFSLEWKEG
            ||||||:|||||||||||||||||||||:|||||||||||||||||||||||||||||||
g590        FKSYRNSYDAPLFKIKLADKGDAAFEKAHFDSETSDGINPLALGSSNLTLEKFSLEWKEG
                   190       200       210       220       230       240
```

-continued

```
                     250       260       270       280       290       300
m590-1.pep    VDYNVKLNELVNLVTDLQIGAFINPNGSIAPSKIEVGKLAFSTKTGESGAFINSEGQFRF
              ||||||||||||||||||||||||||||||||||||||||||||||||||||:|||:|||
g590          VDYNVKLNELVNLVTDLQIGAFINPNGSIAPSKIEVGKLAFSTKTGESGAFIDSEGRFRF
                     250       260       270       280       290       300

                     310       320       330       340       350       360
m590-1.pep    DTLVYGDEKYGPLDIHIAAEHLDASALTVLKRKFAQISAKKMTEEQIRNDLIAAVKGEAS
              |||||||||||||||||||||||||||||||||||||||||||||||||||||||||:||
g590          DTLVYGDEKYGPLDIHIAAEHLDASALTVLKRKFAQISAKKMTEEQIRNDLIAAVKGDAS
                     310       320       330       340       350       360

                     370       380       390       400       410       420
m590-1.pep    GLFTNNPVLDIKTFRFTLPSGKIDVGGKIMFKDMKKEDLNQLGLMLKKTEADIRMSIPQK
              ||||::|||:|| ||||||:|||||||||||| ||||||||||||||||||:||||||||
g590          GLFTHDPVLNIKIFRFTLPQGKIDVGGKIMFKGMKKEDLNQLGLMLKKTEANIRMSIPQK
                     370       380       390       400       410       420

                     430       440       450       460       470       480
m590-1.pep    MLEDLAVSQAGNIFSVNAEDEAEGRASLDDINETLRLMVDSTVQSMAREKYLTLNGDQID
              |||||||||||||||||||||||:|||: |||||||||||||||||||||||||:|:|||
g590          MLEDLAVSQAGNIFSVNAEDEAEARASIADINETLRLMVDSTVQSMAREKYLTLDGNQID
                     430       440       450       460       470       480

                     490       500       510
m590-1.pep    TAISLKNNQLKLNGKTLQNEPEPDFDEGGMVS-EPQQX
              |:|||||| ||||||||||||:|||||| |||  :|:
g590          TVISLKNNALKLNGKTLQNEPDPDFDEGDMVSGQPHX
                     490       500       510
```

a590/m590-1 98.3% identity in 516 aa overlap

```
                      10        20        30        40        50        60
a590.pep      MKKPLISVAAALLGVALGTPYYLGVKAEESLTQQQKILQEAGFLTVESHQYERGWFTSTE
              ||||||||||||||||||||||||||||||||||||||||:||||||||||||||||| |
m590-1        MKKPLISVAAALLGVALGTPYYLGVKAEESLTQQQKILQETGFLTVESHQYERGWFTSME
                      10        20        30        40        50        60

                      70        80        90       100       110       120
a590.pep      TTVIRLKPELLHNAQKYLPDNLKTVLEQPVTLVNHITHGPFAGGFGTQAYIETEFKYAPE
              |||||||||||:||:|||||||||||||||||||||||||||||||||||||||||||||
m590-1        TTVIRLKPELLNNARKYLPDNLKTVLEQPVTLVNHITHGPFAGGFGTQAYIETEFKYAPE
                      70        80        90       100       110       120

                     130       140       150       160       170       180
a590.pep      TEKVLERFFGKQVPVSLANTVYFNGSGKMEVSVPAFDYEELSGIRLHWEGLTGETVYQKG
              ||||||||||||||:|||||||||||||||||||||||||||||||||||||||||||||
m590-1        TEKVLERFFGKQVPASLANTVYFNGSGKMEVSVPAFDYEELSGIRLHWEGLTGETVYQKG
                     130       140       150       160       170       180

                     190       200       210       220       230       240
a590.pep      FKSYRNGYDAPLFKIKLADKGDAAFEKVHFDSETSDGINPLALGSSNLTLEKFSLEWKEG
              ||||||||||||||||||||||||||||||||||||||||||||||||||||||||||||
m590-1        FKSYRNGYDAPLFKIKLADKGDAAFEKVHFDSETSDGINPLALGSSNLTLEKFSLEWKEG
                     190       200       210       220       230       240

                     250       260       270       280       290       300
a590.pep      VDYNVKLNELVNLVTDLQIGAFINPNGSIAPSKIEVGKLAFSTKTGESGAFIDSEGQFRF
              ||||||||||||||||||||||||||||||||||||||||||||||||||||:|||||||
m590-1        VDYNVKLNELVNLVTDLQIGAFINPNGSIAPSKIEVGKLAFSTKTGESGAFINSEGQFRF
                     250       260       270       280       290       300

                     310       320       330       340       350       360
a590.pep      GTLVYGDEKYGPLDIHIAAEHLDASALTVLKRKFARISAKKMTEEQIRNDLIAAVKGEAS
               ||||||||||||||||||||||||||||||||||:||||||||||||||||||||||||
m590-1        DTLVYGDEKYGPLDIHIAAEHLDASALTVLKRKFAQISAKKMTEEQIRNDLIAAVKGEAS
                     310       320       330       340       350       360

                     370       380       390       400       410       420
a590.pep      GLFTHNPVLDIKTFRFTLPSGKIDVGGKIMFKDMKKEDLNQLGLMLKKTEADIRMSIPQK
              ||||:|||||||||||||||||||||||||||||||||||||||||||||||||||||||
m590-1        GLFTNNPVLDIKTFRFTLPSGKIDVGGKIMFKDMKKEDLNQLGLMLKKTEADIRMSIPQK
                     370       380       390       400       410       420

                     430       440       450       460       470       480
a590.pep      MLEDLAVSQAGNIFSVNAEDEAEGRASLDDINETLRLMVDSTVQSMAREKYLTLNGDQID
              ||||||||||||||||||||||||||||||||||||||||||||||||||||||||||||
m590-1        MLEDLAVSQAGNIFSVNAEDEAEGRASLDDINETLRLMVDSTVQSMAREKYLTLNGDQID
                     430       440       450       460       470       480

                     490       500       510
a590.pep      TAISLKNNQLKLNGKTLQNEPEPDFDEGGMVSEPQQX
              ||||||||||||||||||||||||||||||||||||
m590-1        TAISLKNNQLKLNGKTLQNEPEPDFDEGGMVSEPQQX
                     490       500       510
```

The following partial DNA sequence was identified in *N. gonorrhoeae* <SEQ ID 1841>:

g591.seq

```
   1 TTGCAAACCC TTCTAGCTTT TATCTTCGCC ATCCTGATTT TGGTCAGCCT
  51 GCACGAATTC GGACACTACA TCGTCGCCAG GTTGTGCGGC GTCAAGGTTG
 101 TGCGTTTTTC CGTCGGCTTC GGCAAACCGT TTTTCACCCG AAAGCGCGGC
 151 GACACCGAAT GGTGCCTCGC CCCGATTCCG TTGGGCGGCT ACGTCAAAAT
 201 GGTCGATACG CGCGAAGGCG AAGTATCAGA AGCCGATTTA CCCTACGCTT
 251 TTGACAAACA ACACCCCGCC AAGCGCATCG CCATCGTCGC CGCCGGTCCG
 301 CTGACCAACC TCGCActggc ggTTTTGCTG TACGGACTGa gctTttcctt
 351 cggcgtaaCC GAACTGCGGC CCtatgtcgg cacagtcgaA cccgacaccg
 401 ttgccgCCCG CACCGGCTTC caaagcggcg acaaAATACa atccgtcaac
 451 ggcgtTtccg tCCAAGACTG GAGCAGCGCG CAAACCGAAA TCGTcctcAA
 501 CCTCGAAGCC Ggcaaagtcg ccgtcggcgT TCAGACGGCA TCGGGCGCGC
 551 AAACCGTCCG CACCAtcgAT GCCGCAGGCA CGCCGGAAGC CGGTAAAATC
 601 GCAAAAAACC AAGGCTACAT CGGACTGATG CCCTTTAAAA TCACAACCGT
 651 TGCCGGCGGC GTGGAAAAAG GCAGCCCCGC CGAAAAAGCA GGCCTGAAAC
 701 CGGGCGACAG GCTGACTGCC GCCGACGGCA AACCCATCGc ctcaTGGCAG
 751 GAATGggcaa acctgACccg cCAAAGCCCg ggcAAAAAAA Tcaccctgac
 801 ctacgAaCGC GCcggacaaa cccaTAccgc CGACATCCGC CccgATactg
 851 TCGAAcagcc cgACCACACC CTGATCgggc gcgTCGGCCT CCGtccgcaG
 901 CCGGACAGGG CGTGGGACGC GCAAATCCGC CGCAGCTACC GTCCGTCTGT
 951 TGTCCGCGCA TTCGGCATGG GCTGGGAAAA AACCGTTTCC CACTCGTGGA
1001 CAACCCTCAA ATTTTTCGGC AAACTAATCA GCGGCAACGC CTCTGTCAGC
1051 CATATTTCCG GGCCGCTGAC CATTGCCGAC ATTGCCGGAC AGTCCGCCGA
1101 ACTCGGCTTG CAAAGTTATT TGGAATTTTT AGCGTTGGTC AGCATCAGCC
1151 TCGGCGTGCT GAACCTGCTG CCCGTCCCCG TTTTGGACGG CGGGCACCTC
1201 GTGTTTTATA CTGTCGAATG GATACGCGGC AAACCTTTGG GCGAACGTGT
1251 CCAAAACATC GGTTTGCGCT TCGGGCTCGC CCTGATGATG CTGATGATGG
1301 CGGCCGCCTT CTTCAACGAC GTTACCCGGC TGATCGGTTA G
```

This corresponds to the amino acid sequence <SEQ ID 1842; ORF 591.ng>:

g591.pep..

```
   1 LQTLLAFIFA ILILVSLHEF GHYIVARLCG VKVVRFSVGF GKPFFTRKRG
  51 DTEWCLAPIP LGGYVKMVDT REGEVSEADL PYAFDKQHPA KRIAIVAAGP
 101 LTNLALAVLL YGLSFSFGVT ELRPYVGTVE PDTVAARTGF QSGDKIQSVN
 151 GVSVQDWSSA QTEIVLNLEA GKVAVGVQTA SGAQTVRTID AAGTPEAGKI
 201 AKNQGYIGLM PFKITTVAGG VEKGSPAEKA GLKPGDRLTA ADGKPIASWQ
 251 EWANLTRQSP GKKITLTYER AGQTHTADIR PDTVEQPDHT LIGRVGLRPQ
 301 PDRAWDAQIR RSYRPSVVRA FGMGWEKTVS HSWTTLKFFG KLISGNASVS
```

-continued

351 HISGPLTIAD IAGQSAELGL QSYLEFLALV SISLGVLNLL PVPVLDGGHL

401 VFYTVEWIRG KPLGERVQNI GLRFGLALMM LMMAAAFFND VTRLIG*

The following partial DNA sequence was identified in *N. meningitidis* <SEQ ID 1843>:

m591.seq

1 TTGCACACCC TTCTAGCTTT TATCTTCGCC ATCCTGATTT TGGTCAGCCT

51 GCACGAGTTC GGACACTACA TCGTTGCCAG ATTGTGCGGC GTCAAAGTCG

101 TACGCTTTTC CGTCGGCTTC GGCAAACCGT TTTTCACCCG AAAGCGCGGC

151 GACACCGAAT GGTGCCTCGC CCCGATTCCG TTGGGCGGTT ACGTCAAAAT

201 GGTCGATACG CGCGAAGGCG AAGTATCAGA AGCCGATTTA CCCTACGCTT

251 TTGACAAACA ACACCCCGCC AAGCGCATCG CCATCGTCGC CGCCGGCCCA

301 CTGACCAACC TCGCACTGGC GGTTTTGCTG TACGGACTGA GCTTTTCCTT

351 CGGCGTAACC GAACTGCGCC CCTACGTCGG CACAGTCGAA CCCGACACCA

401 TTGCCGCCCG CGCCGGCTTC CAAAGCGGCG ACAAAATACA ATCCGTCAAC

451 GGCACACCCG TTGCAGATTG GGGCAGCGCG CAAACCGAAA TCGTCCTCAA

501 CCTCGAAGCC GGCAAAGTCG CCGTCGGCGT TCAGACGGCA TCGGGCGCGC

551 AAACCGTCCG CACCATCGAT GCCGCAGGCA CGCCGGAAGC CGGTAAAATC

601 GCAAAAAACC AAGGCTACAT CGGACTGATG CCCTTTAAAA TCACAACCGT

651 TGCCGGCGGC GTGGAAAAAG GCAGCCCCGC CGAAAAAGCA GGCCTGAAAC

701 CGGGCGACAG GCTGACTGCC GCCGACGGCA AACCCATCGC CTCATGGCAA

751 GAATGGGCAA ACCTGACCCG CCAAAGCCCC GGCAAAAAAA TCACCCTGAA

801 CTACGAACGC GCCGGACAAA CCCATACCGC CGACATCCGC CCCGATACTG

851 TCGAACAGTC CGACCACACC CTGATCGGGC GCGTCGGCCT CCGTCCGCAG

901 CCGGACAGGG CGTGGGACGC GCAAATCCGC CGCAGCTACC GTCCGTCTGT

951 TGTCCGCGCA TTCGGCATGG GCTGGGAAAA AACCGTTTCC CACTCGTGGA

1001 CAACCCTCAA ATTTTTCGGC AAACTAATCA GCGGCAACGC CTCCGTCAGC

1051 CATATTTCCG GGCCGCTGAC CATTGCCGAC ATTGCCGGAC AGTCCGCCGA

1101 ACTCGGCTTG CAAAGTTATT TGGAATTTTT AGCACTGGTC AGCATCAGCC

1151 TCGGCGTGCT GAACCTACTG CCCGTCCCTG TTTTGGACGG CGGGCACCTC

1201 GTGTTTTATA CTGCCGAATG GATACGCGGC AAACCTTTGG GCGAACGCGT

1251 CCAAAACATC GGTTTGCGCT TCGGGCTCGC CCTCATGATG CTGATGATGG

1301 CGGTCGCCTT CTTCAACGAC GTTACCCGGC TGCTCGGTTA G

This corresponds to the amino acid sequence <SEQ ID 1844; ORF 591>:

m591.pep..

1 LHTLLAFIFA ILILVSLHEF GHYIVARLCG VKVVRFSVGF GKPFFTRKRG

51 DTEWCLAPIP LGGYVKMVDT REGEVSEADL PYAFDKQHPA KRIAIVAAGP

101 LTNLALAVLL YGLSFSFGVT ELRPYVGTVE PDTIAARAGF QSGDKIQSVN

-continued

```
151 GTPVADWGSA QTEIVLNLEA GKVAVGVQTA SGAQTVRTID AAGTPEAGKI

201 AKNQGYIGLM PFKITTVAGG VEKGSPAEKA GLKPGDRLTA ADGKPIASWQ

251 EWANLTRQSP GKKITLNYER AGQTHTADIR PDTVEQSDHT LIGRVGLRPQ

301 PDRAWDAQIR RSYRPSVVRA FGMGWEKTVS HSWTTLKFFG KLISGNASVS

351 HISGPLTIAD IAGQSAELGL QSYLEFLALV SISLGVLNLL PVPVLDGGHL

401 VFYTAEWIRG KPLGERVQNI GLRFGLALMM LMMAVAFFND VTRLLG*
```

Computer analysis of this amino acid sequence gave the following results:

Homology with a predicted ORF from *N. gonorrhoeae*
m591/g591 97.3% identity in 446 aa overlap

```
                   10        20        30        40        50        60
m591.pep   LHTLLAFIFAILILVSLHEFGHYIVARLCGVKVVRFSVGFGKPFFTRKRGDTEWCLAPIP
           |:||||||||||||||||||||||||||||||||||||||||||||||||||||||||||
g591       LQTLLAFIFAILILVSLHEFGHYIVARLCGVKVVRFSVGFGKPFFTRKRGDTEWCLAPIP
                   10        20        30        40        50        60

                   70        80        90       100       110       120
m591.pep   LGGYVKMVDTREGEVSEADLPYAFDKQHPAKRIAIVAAGPLTNLALAVLLYGLSFSFGVT
           ||||||||||||||||||||||||||||||||||||||||||||||||||||||||||||
g591       LGGYVKMVDTREGEVSEADLPYAFDKQHPAKRIAIVAAGPLTNLALAVLLYGLSFSFGVT
                   70        80        90       100       110       120

                  130       140       150       160       170       180
m591.pep   ELRPYVGTVEPDTIAARAGFQSGDKIQSVNGTPVADWGSAQTEIVLNLEAGKVAVGVQTA
           |||||||||||||:|||:|||||||||||||: | ||:||||||||||||||||||||||
g591       ELRPYVGTVEPDTVAARTGFQSGDKIQSVNGVSVQDWSSAQTEIVLNLEAGKVAVGVQTA
                  130       140       150       160       170       180

                  190       200       210       220       230       240
m591.pep   SGAQTVRTIDAAGTPEAGKIAKNQGYIGLMPFKITTVAGGVEKGSPAEKAGLKPGDRLTA
           ||||||||||||||||||||||||||||||||||||||||||||||||||||||||||||
g591       SGAQTVRTIDAAGTPEAGKIAKNQGYIGLMPFKITTVAGGVEKGSPAEKAGLKPGDRLTA
                  190       200       210       220       230       240

                  250       260       270       280       290       300
m591.pep   ADGKPIASWQEWANLTRQSPGKKITLNYERAGQTHTADIRPDTVEQSDHTLIGRVGLRPQ
           ||||||||||||||||||||||||||:||||||||||||||||||| |||||||||||||
g591       ADGKPIASWQEWANLTRQSPGKKITLTYERAGQTHTADIRPDTVEQPDHTLIGRVGLRPQ
                  250       260       270       280       290       300

                  310       320       330       340       350       360
m591.pep   PDRAWDAQIRRSYRPSVVRAFGMGWEKTVSHSWTTLKFFGKLISGNASVSHISGPLTIAD
           ||||||||||||||||||||||||||||||||||||||||||||||||||||||||||||
g591       PDRAWDAQIRRSYRPSVVRAFGMGWEKTVSHSWTTLKFFGKLISGNASVSHISGPLTIAD
                  310       320       330       340       350       360

                  370       380       390       400       410       420
m591.pep   IAGQSAELGLQSYLEFLALVSISLGVLNLLPVPVLDGGHLVFYTAEWIRGKPLGERVQNI
           ||||||||||||||||||||||||||||||||||||||||||||:|||||||||||||||
g591       IAGQSAELGLQSYLEFLALVSISLGVLNLLPVPVLDGGHLVFYTVEWIRGKPLGERVQNI
                  370       380       390       400       410       420

                  430       440
m591.pep   GLRFGLALMMLMMAVAFFNDVTRLLGX
           ||||||||||||||:|||||||||:||
g591       GLRFGLALMMLMMAAAFFNDVTRLIGX
                  430       440
```

The following partial DNA sequence was identified in *N. meningitidis* <SEQ ID 1845>:

a591.seq

```
  1 TTGCACACCC TTCTAGCTTT TATCTTCGCC ATCCTGATTT TGGTCAGCCT

 51 GCACGAATTC GGACACTACA TCGTCGCCAG ATTGTGCGGC GTCAAGGTTG

101 TGCGTTTTTC CGTCGGCTTC GGCAAACCGT TTTTCACCCG AAAGCGCGGC

151 GACACCGAAT GGTGCCTCGC CCCGATTCCG TTGGGCGGTT ACGTCAAAAT

201 GGTCGACACG CGCGAAGGCG AAGTATCAGA AGCCGATTTA CCCTACGCTT
```

-continued

```
 251 TTGACAAACA ACACCCCGCC AAGCGCATCG CCATCGTCGC CGCCGGCCCG
 301 CTGACCAACC TCGCACTGGC GGTTTTGCTG TACGGACTGA GCTTTTCCTT
 351 CGGCGTTACC GAACTGCGCC CCTATGTCGG CACAGTCGAA CCCGACACCA
 401 TTGCCGCCCG CGCCGGCTTC CAAAGCGGCG ACAAAATACA ATCCGTCAAC
 451 GGCACACCCG TTGCAGATTG GGGCAGCGCG CAAACCGAAA TCGTCCTCAA
 501 CCTCGAAGCC GGCAAAGTCG CCGTCGGCGT TCAGACGGCA TCGGGCGCGC
 551 AAACCGTCCG CACCATCGAT GCCGCAGGCA CGCCGGAAGC CGGTAAAATC
 601 GCAAAAAACC AAGGCTACAT CGGACTGATG CCCTTTAAAA TCACAACCGT
 651 TGCCGGCGGC GTGGAAAAAG GCAGCCCCGC CGAAAAAGCA GGCCTGAAAC
 701 CGGGCGACAG GCTGACTGCC GCCGACGGCA AACCCATCGC CTCATGGCAA
 751 GAATGGGCAA ACCTGACCCG CCAAAGCCCC GGCAAAAAAA TCACCCTGAC
 801 CTACGAACGC GCCGGACAAA CCCATACCGC CGACATCCGC CCCGATACTG
 851 TCGAACAGCC CGACCACACC CTGATCGGGC GCGTCGGCCT CCGTCCGCAG
 901 CCGGACAGGG CGTGGGACGC GCAAATCCGC CGCAGCTACC GTCCGTCTGT
 951 TGTCCGCGCA TTCGGCATGG GCTGGGAAAA AACCGTTTCC CACTCGTGGA
1001 CAACCCTCAA ATTTTTCGGC AAACTAATCA GCGGCAACGC CTCCGTCAGC
1051 CATATTTCCG GTCCGCTGAC CATTGCCGAT ATTGCCGGAC AGTCCGCCGA
1101 ACTCGGCTTG CAAAGTTATT TGGAATTTTT GGCACTGGTC AGCATCAGCC
1151 TCGGCGTGCT GAACCTGCTG CCCGTCCCCG TTTTGGACGG CGGCCACCTC
1201 GTGTTTTATA CTGCCGAATG GATACGCGGC AAACCTTTGG GCGAACGCGT
1251 CCAAAACATC GGTTTGCGCT TCGGGCTTGC CCTCATGATG CTGATGATGG
1301 CGGTCGCCTT CTTCAACGAC GTTACCCGGC TGCTCGGTTA G
```

This corresponds to the amino acid sequence <SEQ ID 1846; ORF 591.a>:

a591.pep

```
  1 LHTLLAFIFA ILILVSLHEF GHYIVARLCG VKVVRFSVGF GKPFFTRKRG
 51 DTEWCLAPIP LGGYVKMVDT REGEVSEADL PYAFDKQHPA KRIAIVAAGP
101 LTNLALAVLL YGLSFSFGVT ELRPYVGTVE PDTIAARAGF QSGDKIQSVN
151 GTPVADWGSA QTEIVLNLEA GKVAVGVQTA SGAQTVRTID AAGTPEAGKI
201 AKNQGYIGLM PFKITTVAGG VEKGSPAEKA GLKPGDRLTA ADGKPIASWQ
251 EWANLTRQSP GKKITLTYER AGQTHTADIR PDTVEQPDHT LIGRVGLRPQ
301 PDRAWDAQIR RSYRPSVVRA FGMGWEKTVS HSWTTLKFFG KLISGNASVS
351 HISGPLTIAD IAGQSAELGL QSYLEFLALV SISLGVLNLL PVPVLDGGHL
401 VFYTAEWIRG KPLGERVQNI GLRFGLALMM LMMAVAFFND VTRLLG*
```

m591/a591 99.6% identity in 446 aa overlap

```
                10        20        30        40        50        60
m591.pep  LHTLLAFIFAILILVSLHEFGHYIVARLCGVKVVRFSVGFGKPFFTRKRGDTEWCLAPIP
          ||||||||||||||||||||||||||||||||||||||||||||||||||||||||||||
a591      LHTLLAFIFAILILVSLHEFGHYIVARLCGVKVVRFSVGFGKPFFTRKRGDTEWCLAPIP
                10        20        30        40        50        60

                70        80        90       100       110       120
m591.pep  LGGYVKMVDTREGEVSEADLPYAFDKQHPAKRIAIVAAGPLTNLALAVLLYGLSFSFGVT
          ||||||||||||||||||||||||||||||||||||||||||||||||||||||||||||
a591      LGGYVKMVDTREGEVSEADLPYAFDKQHPAKRIAIVAAGPLTNLALAVLLYGLSFSFGVT
                70        80        90       100       110       120

               130       140       150       160       170       180
m591.pep  ELRPYVGTVEPDTIAARAGFQSGDKIQSVNGTPVADWGSAQTEIVLNLEAGKVAVGVQTA
          ||||||||||||||||||||||||||||||||||||||||||||||||||||||||||||
a591      ELRPYVGTVEPDTIAARAGFQSGDKIQSVNGTPVADWGSAQTEIVLNLEAGKVAVGVQTA
               130       140       150       160       170       180

               190       200       210       220       230       240
m591.pep  SGAQTVRTIDAAGTPEAGKIAKNQGYIGLMPFKITTVAGGVEKGSPAEKAGLKPGDRLTA
          ||||||||||||||||||||||||||||||||||||||||||||||||||||||||||||
a591      SGAQTVRTIDAAGTPEAGKIAKNQGYIGLMPFKITTVAGGVEKGSPAEKAGLKPGDRLTA
               190       200       210       220       230       240

               250       260       270       280       290       300
m591.pep  ADGKPIASWQEWANLTRQSPGKKITLNYERAGQTHTADIRPDTVEQSDHTLIGRVGLRPQ
          ||||||||||||||||||||||||||:|||||||||||||||||||| ||||||||||||
a591      ADGKPIASWQEWANLTRQSPGKKITLTYERAGQTHTADIRPDTVEQPDHTLIGRVGLRPQ
               250       260       270       280       290       300

               310       320       330       340       350       360
m591.pep  PDRAWDAQIRRSYRPSVVRAFGMGWEKTVSHSWTTLKFFGKLISGNASVSHISGPLTIAD
          ||||||||||||||||||||||||||||||||||||||||||||||||||||||||||||
a591      PDRAWDAQIRRSYRPSVVRAFGMGWEKTVSHSWTTLKFFGKLISGNASVSHISGPLTIAD
               310       320       330       340       350       360

               370       380       390       400       410       420
m591.pep  IAGQSAELGLQSYLEFLALVSISLGVLNLLPVPVLDGGHLVFYTAEWIRGKPLGERVQNI
          ||||||||||||||||||||||||||||||||||||||||||||||||||||||||||||
a591      IAGQSAELGLQSYLEFLALVSISLGVLNLLPVPVLDGGHLVFYTAEWIRGKPLGERVQNI
               370       380       390       400       410       420

               430       440
m591.pep  GLRFGLALMMLMMAVAFFNDVTRLLGX
          |||||||||||||||||||||||||||
a591      GLRFGLALMMLMMAVAFFNDVTRLLGX
               430       440
```

The following partial DNA sequence was identified in *N. gonorrhoeae* <SEQ ID 1847>:

g592.seq..

```
  1 atgattccgg acgtgttcgg tcagattttt tcgggcgcgt tcaaattcga
 51 cgcggcagca ggcggcttac tcggcggtct gatttcgcaa acgatgatga
101 tgggcatcaa acgcggcctg tattccaacg aggcgggtat gggttccgcg
151 ccgaacgccg ccgccgccgc cgaagtgaaa caccctgttt cgcaaggtat
201 gattcaaatg ctgggcgtgt ttgtcgatac catcatcgtt tgttcttgca
251 ccgccttcat catcttgatt taccaacagc cttatggcga tttgagcggt
301 gcggcgctga cgcaggcggc gattgtcagc caagtggggc aatggggcgc
351 gggtttcctc gccgtcatcc tgtttatgtt tgccttttcc accgttatcg
401 gcaactatgc ctatgccgag tccaacgtcc aattcatcaa aagccattgg
451 ctgattaccg ccgttttccg tatgctggtt ttggcgtggg tctatttcgg
501 cgcggttgcc aatgtgcctt tggtctggga tatggcggat atggcgatgg
551 gcatcatggc gtggatcaac ctcgtcgcca tcctgctgct ctcgccattg
601 gcgtttatgc tgctgcgcga ttacaccgcc aagctgaaaa tgggcaaaga
651 ccccgagttc aaactttccg aacatccggg cctgaaacgc cgcatcaaat
701 ccgatgtttg gtaa
```

This corresponds to the amino acid sequence <SEQ ID 1848: ORF 592.ng>:

g592.pep..

```
  1 MIPDVFGQIF SGAFKFDAAA GGLLGGLISQ TMMMGIKRGL YSNEAGMGSA
 51 PNAAAAAEVK HPVSQGMIQM LGVFVDTIIV CSCTAFIILI YQQPYGDLSG
101 AALTQAAIVS QVGQWGAGFL AVILFMFAFS TVIGNYAYAE SNVQFIKSHW
151 LITAVFRMLV LAWVYFGAVA NVPLVWDMAD MAMGIMAWIN LVAILLLSPL
201 AFMLLRDYTA KLKMGKDPEF KLSEHPGLKR RIKSDVW*
```

The following partial DNA sequence was identified in *N. meningitidis* <SEQ ID 1849>:

m592.seq..

```
  1 ATGATTCCGG ACGTGTTCGG TCAGATTTTT TCGGGCGCGT TCAAATTCGA
 51 CGCGGCAGCA GGCGGCTTAC TCGGCGGTCT GATTTCGCAA ACGATGATGA
101 TGGGCATCAA ACGCGGCCTG TATTCCAACG AGGCGGGTAT GGGTTCCGCG
151 CCGAACGCCG CCGCCGCCGC CGAAGTGAAA CACCCTGTTT CGCAAGGTAT
201 GATTCAAATG CTGGGCGTGT TTGTCGATAC CATCATCGTT TGTTCTTGCA
251 CCGCCTTCAT CATCTTGATT TACCAACAGC CTTACGGCGA TTTGAGCGGT
301 GCGGCGCTGA CGCAGGCGGC GATTGTCAGC CAAGTGGGGC AATGGGGCGC
351 GGGCTTCCTC GCCGTCATCC TGTTTATGTT TGCCTTTTCC ACCGTTATCG
401 GCAACTATGC CTATGCCGAG TCCAACGTCC AATTCATCAA AAGCCATTGG
451 CTGATTACCG CCGTTTTCCG TATGCTGGTT TTGGCGTGGG TCTATTTCGG
501 CGCGGTTGCC AATGTGCCTT TGGTCTGGGA TATGGCGGAT ATGGCGATGG
551 GCATTATGGC GTGGATCAAC CTTGTCGCCA TCCTGCTGCT CTCGCCCTTG
601 GCGTTTATGC TGCTGCGCGA TTACACCGCC AAGCTGAAAA TGGGCAAAGA
651 CCCCGAGTTC AAACTTTCCG AACATCCGGG CCTGAAACGC CGTATCAAAT
701 CCGACGTTTG GTAA
```

This corresponds to the amino acid sequence <SEQ ID 1850; ORF 592>:

m592.pep..

```
  1 MIPDVFGQIF SGAFKFDAAA GGLLGGLISQ TMMMGIKRGL YSNEAGMGSA
 51 PNAAAAAEVK HPVSQGMIQM LGVFVDTIIV CSCTAFIILI YQQPYGDLSG
101 AALTQAAIVS QVGQWGAGFL AVILFMFAFS TVIGNYAYAE SNVQFIKSHW
151 LITAVFRMLV LAWVYFGAVA NVPLVWDMAD MAMGIMAWIN LVAILLLSPL
201 AFMLLRDYTA KLKMGKDPEF KLSEHPGLKR RIKSDVW*
```

m592/g592 100.0% identity in 237 aa overlap

```
                  10        20        30        40        50        60
m592.pep  MIPDVFGQIFSGAFKFDAAAGGLLGGLISQTMMMGIKRGLYSNEAGMGSAPNAAAAAEVK
          ||||||||||||||||||||||||||||||||||||||||||||||||||||||||||||
g592      MIPDVFGQIFSGAFKFDAAAGGLLGGLISQTMMMGIKRGLYSNEAGMGSAPNAAAAAEVK
                  10        20        30        40        50        60

                  70        80        90       100       110       120
m592.pep  HPVSQGMIQMLGVFVDTIIVCSCTAFIILIYQQPYGDLSGAALTQAAIVSQVGQWGAGFL
          ||||||||||||||||||||||||||||||||||||||||||||||||||||||||||||
g592      HPVSQGMIQMLGVFVDTIIVCSCTAFIILIYQQPYGDLSGAALTQAAIVSQVGQWGAGFL
                  70        80        90       100       110       120

                 130       140       150       160       170       180
m592.pep  AVILFMFAFSTVIGNYAYAESNVQFIKSHWLITAVFRMLVLAWVYFGAVANVPLVWDMAD
          ||||||||||||||||||||||||||||||||||||||||||||||||||||||||||||
g592      AVILFMFAFSTVIGNYAYAESNVQFIKSHWLITAVFRMLVLAWVYFGAVANVPLVWDMAD
                 130       140       150       160       170       180

                 190       200       210       220       230
m592.pep  MAMGIMAWINLVAILLLSPLAFMLLRDYTAKLKMGKDPEFKLSEHPGLKRRIKSDVWX
          ||||||||||||||||||||||||||||||||||||||||||||||||||||||||||
g592      MAMGIMAWINLVAILLLSPLAFMLLRDYTAKLKMGKDPEFKLSEHPGLKRRIKSDVWX
                 190       200       210       220       230
```

The following partial DNA sequence was identified in *N. meningitidis* <SEQ ID 1851>:

a592.seq

```
  1 ATGATTCCGG ACGTGTTCGG TCAGATTTTT TCGGGCGCGT TCAAATTCGA
 51 CGCGGCAGCA GGCGGCTTAC TCGGCGGTCT GATTTCGCAA ACGATGATGA
101 TGGGCATCAA ACGCGGCCTG TATTCCAACG AGGCGGGTAT GGGTTCCGCG
151 CCGAACGCCG CCGCCGCCGC CGAAGTGAAA CACCCTGTTT CGCAAGGTAT
201 GATTCAAATG CTGGGCGTGT TTGTCGATAC CATCATCGTT TGTTCTTGCA
251 CCGCCTTCAT CATCTTGATT TACCAACAGC CTTACGGCGA TTTGAGCGGT
301 GCGGCGCTGA CGCAGGCGGC GATTGTCAGC CAAGTGGGGC AATGGGGCGC
351 GGGCTTCCTC GCCGTCATCC TGTTTATGTT TGCCTTTTCC ACCGTTATCG
401 GCAACTATGC CTATGCCGAG TCCAACGTCC AATTCATCAA AAGCCATTGG
451 CTGATTACCG CCGTTTTCCG TATGCTGGTT TTGGCGTGGG TCTATTTCGG
501 CGCGGTTGCC AATGTGCCTT TGGTCTGGGA TATGGCGGAT ATGGCGATGG
551 GCATTATGGC GTGGATCAAC CTTGTCGCCA TCCTGCTGCT CTCGCCCTTG
601 GCGTTTATGC TGCTGCGCGA TTACACCGCC AAGCTGAAAA TGGGCAAAGA
651 CCCCGAGTTC AAACTTTCCG AACATCCGGG CCTGAAACGC CGTATCAAAT
701 CCGACGTTTG GTAA
```

This corresponds to the amino acid sequence <SEQ ID 1852; ORF 592.a>:

a592.pep

```
  1 MIPDVFGQIF SGAFKFDAAA GGLLGGLISQ TMMMGIKRGL YSNEAGMGSA
 51 PNAAAAAEVK HPVSQGMIQM LGVFVDTIIV CSCTAFIILI YQQPYGDLSG
101 AALTQAAIVS QVGQWGAGFL AVILFMFAFS TVIGNYAYAE SNVQFIKSHW
151 LITAVFRNLV LAWVYFGAVA NVPLVWDMAD MAMGIMAWIN LVAILLLSPL
201 AFMLLRDYTA KLKMGKDPEF KLSEHPGLKR RIKSDVW*
```

m592/a592 100.0% identity in 237 aa overlap

```
                10        20        30        40        50        60
m592.pep  MIPDVFGQIFSGAFKFDAAAGGLLGGLISQTMMMGIKRGLYSNEAGMGSAPNAAAAAEVK
          ||||||||||||||||||||||||||||||||||||||||||||||||||||||||||||
a592      MIPDVFGQIFSGAFKFDAAAGGLLGGLISQTMMMGIKRGLYSNEAGMGSAPNAAAAAEVK
                10        20        30        40        50        60

                70        80        90       100       110       120
m592.pep  HPVSQGMIQMLGVFVDTIIVCSCTAFIILIYQQPYGDLSGAALTQAAIVSQVGQWGAGFL
          |||||||||||||||||||||||||||||||||||||||||||||||||| |||||||||
a592      HPVSQGMIQMLGVFVDTIIVCSCTAFIILIYQQPYGDLSGAALTQAAIVSQVGQWGAGFL
                70        80        90       100       110       120

               130       140       150       160       170       180
m592.pep  AVILFMFAFSTVIGNYAYAESNVQFIKSHWLITAVFRMLVLAWVYFGAVANVPLVWDMAD
          ||||||||||||||||||||||||||||||||||||||||||||||||||||||||||||
a592      AVILFMFAFSTVIGNYAYAESNVQFIKSHWLITAVFRMLVLAWVYFGAVANVPLVWDMAD
               130       140       150       160       170       180

               190       200       210       220       230
m592.pep  MAMGIMAWINLVAILLLSPLAFMLLRDYTAKLKMGKDPEFKLSEHPGLKRRIKSDVWX
          ||||||||||||||||||||||||||||||||||||||||||||||||||||||||||
a592      MAMGIMAWINLVAILLLSPLAFMLLRDYTAKLKMGKDPEFKLSEHPGLKRRIKSDVWX
               190       200       210       220       230
```

The following partial DNA sequence was identified in *N. gonorrhoeae* <SEQ ID 1853>:

g593.seq..

```
  1 atgcttgaac tgaacggact ctgcaaatgc ttcggcggca aaacggtcgc
 51 cgacaacatc tgcctgactg tcgggcgcgg caaaatactc gccgtactgg
101 ggcggtcggg ctgcggcaaa tccaccctgc tgaatatgat tgcgggcatc
151 gtccggccgg acggcggcga aattcggctg aacggggaaa acattacctg
201 tatgccgccc gaaaaacgcc gtatctcgct gatgtttcaa gattacgcgc
251 tgtttcccca tatgagtgcg ctggaaaata cggcattcgg tttgaaaatg
301 caaaaaatgc cgaaagccga agccgaacgc ctcgccttgt cggcacttgc
351 cgaagtcggg ctggaaaacg aggcgcaccg caagcctgaa aaactttccg
401 gaggcgagaa gcaacggttg gcactggcgc gcgctttggt tgtccgccct
451 tccctgctgt tgctggatga atcgttttcc agtttggaca cgcatttgcg
501 cgaccggctg cgccgtatga ccgccgaacg catccgcaag ggcggcatcc
551 ctgccgtttt ggtaacgcat tcgcccgaag aggcctgcac ggcggcggac
601 gaaatcgccg tcatgcacga ggggaaaatc cttcaatgcg gtacgcccga
651 aaccttgatt caaacgcctg ccggcgtgca ggtcgcccgt ctgatggggc
701 tgcccaatac cgacgatgac cgccatattc cgcaaaatgc cgtgtgcttg
751 gacaatcatg gaacggaatg ccgtctgctg tccctcgtcc gcctgcccga
801 ctcgctccgg ctttccgccg tccatcccga acacggcgag ctgaccttaa
851 acctgactgt cggacaacat acggacggta tttccggaaa cggtacggtc
901 cgcatccgcg tcgatgaagg gcgtatcgtc cgtttccgat ga
```

This corresponds to the amino acid sequence <SEQ ID 1854; ORF 593.ng>:

g593.pep..

```
  1 MLELNGLCKC FGGKTVADNI CLTVGRGKIL AVLGRSGCGK STLLNMIAGI
 51 VRPDGGEIRL NGENITCMPP EKRRISLMFQ DYALFPHMSA LENTAFGLKM
```

-continued

```
101 QKMPKAEAER LALSALAEVG LENEAHRKPE KLSGGEKQRL ALARALVVRP
151 SLLLLDESFS SLDTHLRDRL RRMTAERIRK GGIPAVLVTH SPEEACTAAD
201 EIAVMHEGKI LQCGTPETLI QTPAGVQVAR LMGLPNTDDD RHIPQNAVCL
251 DNHGTECRLL SLVRLPDSLR LSAVHPEHGE LTLNLTVGQH TDGISGNGTV
301 RIRVDEGRIV RFR*
```

The following partial DNA sequence was identified in *N. meningitidis* <SEQ ID 1855>:

m593.seq

```
  1 ATGCTTGAAC TGAACGGACT CTGCAAACGC TTCGGCAATA AAACCGTCGC
 51 CGACAACATC TGCCTGACTG TCGGGCGCGG CAAAATACTC GCCGTTTTGG
101 GGCGGTCGGG CTGCGGAAAA TCCACCCTGC TGAATATAAT TGCGGGGATT
151 GTCCGGCCGG ACGGCGGGGA AATATGGCTG AACGGAGAAA ACATTACCCG
201 TATGCCGCCC GAAAAACGCC GTATCTCGCT GATGTTTCAA GATTACGCGC
251 TGTTTCCCCA TATGAGTGCG CTGGAAAATG CGGCATTCGG TTTGAAAATG
301 CAAAAAATGC CGAAAGCCGA AGCCGAACGC CTCGCCATGG CGGCACTTGC
351 CGAAGTCGGA CTGGAAAACG AGGCGCACCG CAAGCCTGAA AAACTTTCCG
401 GAGGCGAGAA GCAACGGCTG GCGTTGGCGC GCGCTTTGGT TGTCCGCCCT
451 TCCCTGCTGC TGTTGGACGA ATCGTTTTCC AGTTTGGACA CGCATTTGCG
501 CGGCACGCTG CGCCGTATGA CTGCCGAACG TATCCGAAAC GGCGGCATCC
551 CTGCCGTTTT GGTAACGCAT TCGCCCGAAG AAGCCTGTAC GACGGCAGAC
601 GAAATCGCCG TGATGCATAA AGGGAGGATT CTACAATACG GTACGCCCGA
651 AACATTGGTC AAAACACCAT CCTGCGTGCA GGTCGCCCGA CTGATGGGTT
701 TGCCCAATAC CGACGATAAC CGCCATATTC CGCAACATGC GGTGCGTTTC
751 GACCAAGACG GCATGGAGTG CCGCGTATTA TCCCGTACCT GTTTGCCCGA
801 ATCGTTCAGC CTGTCCGTCC TCCATCCGGA ACACGGCATC CTGTGGCTGA
851 ACCTCGATAT GCGGCACGCC GGGGCGGTAT CGGGCAAGGA TACGGTACGC
901 ATCCATATCG AAGAACGGGA AATCGTCCGC TTCCGCTGA
```

This corresponds to the amino acid sequence <SEQ ID 1856; ORF 593>:

m593.pep..

```
  1 MLELNGLCKR FGNKTVADNI CLTVGRGKIL AVLGRSGCGK STLLNIIAGI
 51 VRPDGGEIWL NGENITRMPP EKRRISLMFQ DYALFPHMSA LENAAFGLKM
101 QKMPKAEAER LAMAALAEVG LENEAHRKPE KLSGGEKQRL ALARALVVRP
151 SLLLLDESFS SLDTHLRGTL RRMTAERIRN GGIPAVLVTH SPEEACTTAD
201 EIAVMHKGRI LQYGTPETLV KTPSCVQVAR LMGLPNTDDN RHIPQHAVRF
251 DQDGMECRVL SRTCLPESFS LSVLHPEHGI LWLNLDMRHA GAVSGKDTVR
301 IHIEEREIVR FR*
```

Computer analysis of this amino acid sequence gave the following results:

Homology with a predicted ORF from *N. gonorrhoeae* m593/g593 83.4% identity in 313 aa overlap

```
              10        20        30        40        50        60
m593.pep  MLELNGLCKRFGNKTVADNICLTVGRGKILAVLGRSGCGKSTLLNIIAGIVRPDGGEIWL
          ||||||||||  |:||||||||||||||||||||||||||||:|||||||||||||| |
g593      MLELNGLCKCFGGKTVADNICLTVGRGKILAVLGRSGCGKSTLLNMIAGIVRPDGGEIRL
              10        20        30        40        50        60

              70        80        90       100       110       120
m593.pep  NGENITRMPPEKRRISLMFQDYALFPHMSALENAAFGLKMQKMPKAEAERLAMAALAEVG
          |||||| |||||||||||||||||||||||||||:|||||||||||||||||:|||||||
g593      NGENITCMPPEKRRISLMFQDYALFPHMSALENTAFGLKMQKMPKAEAERLALSALAEVG
              70        80        90       100       110       120

             130       140       150       160       170       180
m593.pep  LENEAHRKPEKLSGGEKQRLALARALVVRPSLLLLDESFSSLDTHLRGTLRRMTAERIRN
          |||||||||||||||||||||||||||||||||||||||||||||  |||||||||||:
g593      LENEAHRKPEKLSGGEKQRLALARALVVRPSLLLLDESFSSLDTHLRDRLRRMTAERIRK
             130       140       150       160       170       180

             190       200       210       220       230       240
m593.pep  GGIPAVLVTHSPEEACTTADEIAVMHKGRILQYGTPETLVKTPSCVQVARLMGLPNTDDN
          |||||||||||||||| ||||||||:|||| |:|||||:::||: |||||||||||||:
g593      GGIPAVLVTHSPEEACTAADEIAVMHEGKILQCGTPETLIQTPAGVQVARLMGLPNTDDD
             190       200       210       220       230       240

             250       260       270       280       290       299
m593.pep  RHIPQHAVRFDQDGMECRVLSRTCLPESFSLSVLHPEHGILWLNLDM-RHAGAVSGKDTV
          |||||:||  :|:   |||:|| :  ||:| |::|||| |||  :|: ::||: ||
g593      RHIPQNAVCLDNHGTECRLLSLVRLPDSLRLSAVHPEHGELTLNLTVGQHTDGISGNGTV
             250       260       270       280       290       300

             300       310
m593.pep  RIHIEEREIVRFRX
          ||:::| :||||||
g593      RIRVDEGRIVRFRX
             310
```

The following partial DNA sequence was identified in *N. meningitidis* <SEQ ID 1857>:

```
a593.seq

  1 ATGCTTGAAC TGAACGGACT CTGCAAACGC TTCGGCGGCA AAACGGTTGC

 51 CGACGATATC TGCCTGACTG TCGGGCGCGG CAAAATACTC GCCGTTTTGG

101 GGCGGTCGGG CTGCGGCAAA TCCACCCTGC TGAATATGAT TGCGGGCATC

151 GTCCGGCCGG ACGGCGGGGA AATATGGCTG AATGGGGAAA ACATTACCCG

201 TATGCCGCCC GAAAAACGCC GTATTTCGCT GATGTTTCAA GATTACGCGC

251 TGTTTCCCCA TATGAGTGCA CTGGAAAATG CGGCATTCGG TTTGAAAATG

301 CAAAAAATGC CGAAAGCCGA AGCCGAAAGC CTCGCCATGG CGGCACTTGC

351 CGAAGTCGGA CTGGAAAACG AGGCGCACCG CAAGCCTGAN AAACTTTCCG

401 GAGGCGAAAA GCAACGGTTG GCACTGGCGC GCGCTTTGGT TGTCCGCCCT

451 TCCCTGCTGC TGTTGGACGA ATCGTTTTCC AGTTTGGACA CGCATTTGCG

501 CGACCGGCTG CGCCGCATGA CTGCCGAACG TATCCGCAAG GGCGGCATCC

551 CTGCCGTTTT GGTAACGCAT TCGCCCGAAG AGGCCTGCAC GGCGGCAGAC

601 GAAATCGCCG TCATGCACGA GGGGAAAATC CTTCAATGCG GTACGCCCGA

651 AACCTTGGTT CAAACGCCTG CCGGCGTGCA GGTCGCCCAT CTGATGGGGC

701 TGCCCAATAC CGACGATGAC CGCCATATTC CGCAACATGC GGTGCGTTTC

751 GACCAAGACG GCATGGAGTG CCGCGTATTA TCCCGTACCT GTTTGCCCGA

801 ATCGTTCAGC CTGTCCGTCC TCCATCCGGA ACACGGCATC CTGTGGCTGA

851 ACCTCGATAT GCCGCACGCC GGTGAAATAT CGGGAAACGA TACGGTACGC

901 ATCCATATCG AAGACAGGGA AATCGTCCGC TTCCGCTGA
```

This corresponds to the amino acid sequence <SEQ ID 1858; ORF 593.a>:

a593.pep

```
  1 MLELNGLCKR FGGKTVADDI CLTVGRGKIL AVLGRSGCGK STLLNMIAGI

 51 VRPDGGEIWL NGENITRMPP EKRRISLMFQ DYALFPHMSA LENAAFGLKM

101 QKMPKAEAES LAMAALAEVG LENEAHRKPX KLSGGEKQRL ALARALVVRP

151 SLLLLDESFS SLDTHLRDRL RRMTAERIRK GGIPAVLVTH SPEEACTAAD

201 EIAVMHEGKI LQCGTPETLV QTPAGVQVAH LMGLPNTDDD RHIPQHAVRF

251 DQDGMECRVL SRTCLPESFS LSVLHPEHGI LWLNLDMPHA GEISGNDTVR

301 IHIEDREIVR FR*
```

m593/a593 92.9% identity in 312 aa overlap

```
                   10        20        30        40        50        60
m593.pep   MLELNGLCKRFGNKTVADNICLTVGRGKILAVLGRSGCGKSTLLNIIAGIVRPDGGEIWL
           ||||||||||||:|||||:||||||||||||||||||||||||||:||||||||||||||
a593       MLELNGLCKRFGGKTVADDICLTVGRGKILAVLGRSGCGKSTLLNMIAGIVRPDGGEIWL
                   10        20        30        40        50        60

                   70        80        90       100       110       120
m593.pep   NGENITRMPPEKRRISLMFQDYALFPHMSALENAAFGLKMQKMPKAEAERLAMAALAEVG
           ||||||||||||||||||||||||||||||||||||||||||||||||| ||||||||||
a593       NGENITRMPPEKRRISLMFQDYALFPHMSALENAAFGLKMQKMPKAEAESLAMAALAEVG
                   70        80        90       100       110       120

                  130       140       150       160       170       180
m593.pep   LENEAHRKPEKLSGGEKQRLALARALVVRPSLLLLDESFSSLDTHLRGTLRRMTAERIRN
           ||||||||| |||||||||||||||||||||||||||||||||||||  ||||||||||:
a593       LENEAHRKPXKLSGGEKQRLALARALVVRPSLLLLDESFSSLDTHLRDRLRRMTAERIRK
                  130       140       150       160       170       180

                  190       200       210       220       230       240
m593.pep   GGIPAVLVTHSPEEACTTADEIAVMHKGRILQYGTPETLVKTPSCVQVARLMGLPNTDDN
           |||||||||||||||||:||||||||:|:||| |||||||:||: ||||:|||||||||:
a593       GGIPAVLVTHSPEEACTAADEIAVMHEGKILQCGTPETLVQTPAGVQVAHLMGLPNTDDD
                  190       200       210       220       230       240

                  250       260       270       280       290       300
m593.pep   RHIPQHAVRFDQDGMECRVLSRTCLPESFSLSVLHPEHGILWLNLDMRHAGAVSGKDTVR
           ||||||||||||||||||||||||||||||||||||||||||||||| ||| :||:||||
a593       RHIPQHAVRFDQDGMECRVLSRTCLPESFSLSVLHPEHGILWLNLDMPHAGEISGNDTVR
                  250       260       270       280       290       300

                  310
m593.pep   IHIEEREIVRFRX
           ||||:||||||||
a593       IHIEDREIVRFRX
                  310
```

The following partial DNA sequence was identified in *N. gonorrhoeae* <SEQ ID 1859>:

g594.seq..

```
  1 atgggtgcag ataccgatgg cgacaaggat gttcggctta atcgaacggg

 51 tctcgttttt agcatactcc ggctgctgtt ccgcatcgga attgggatcg

101 gtaagttcgc cgttcaggcc tttcaggtct ttaagctgct gatctgtacg

151 gttgagcacc caaatcggtt tgccttgcca ctcggcggtc agcagctgac

201 ccgcttcgat tttactgaca tccacctcga cggcagcacc ggaggccttg

251 gctttttccg aagggaaaaa actggccaca aacggcgttg ccacacccaa

301 tgctgccact ccgcccgcgc cgcaggtcgc aagtgtcagg aaacggcggc

351 ggccgttgtt gatttcttga ttatccatta ttcagtcgtc ctaatatttt
```

-continued

```
401 gggaatgccg agccattaaa cattgcaatt ttacccagtt tgcagtgata

451 ctcaaagcat tatttaaaat aaggtaa
```

This corresponds to the amino acid sequence <SEQ ID 1860; ORF 594.ng>:

g594.pep

```
  1 MGADTDGDKD VRLNRTGLVF SILRLLFRIG IGIGKFAVQA FQVFKLLICT

 51 VEHPNRFALP LGGQQLTRFD FTDIHLDGST GGLGFFRREK TGHKRRCHTQ

101 CCHSARAAGR KCQETAAAVV DFLIIHYSVV LIFWECRAIK HCNFTQFAVI

151 LKALFKIR*
```

The following partial DNA sequence was identified in N meningitidis <SEQ ID 1861>:

m594.seg

```
  1 ATGGGTGCAG ATACCGATGG CGACAAGGAT GTTCGGCTTA ATCGAACGGG

 51 TCTCGTTTTT AGCATACTCC GGCTGCTGTT CCGCATCGGA ATTGGGATCG

101 GTAAGTTCGC CGTTCAGGCC TTTCAGGTCT TTAAGCTGCT GATCTGTACG

151 GTTGAGCACC CAAATCGGTT TGCCTTGCCA CTCGGCGGTC AGCAGCTGAC

201 CCGCTTCGAT TTTACTGACA TCCACCTCGA CGGCAGCACC GGCGGCCTTG

251 GCTTTTTCCG AAGGGAAAAA ACTGGCCACA AACGGCGTTG CCACACCCAA

301 TGCTGCCACT CCGCCCGCGC CGCAGGTCGC GAGTGTCAGG AAACGGCGGC

351 GGCCGTTGTT GATTTCTTGA TTATCCATTA TTCAGTCGTC CTAATATTTT

401 GGGAATACCG AGCCATTAAA CGTTGCAATT TTACCCAGTT TGCAGTGATA

451 CTCAAAGCAT TATTTAAAAT AAGGTAA
```

This corresponds to the amino acid sequence <SEQ ID 1862; ORF 594>:

m594.pep

```
  1 MGADTDGDKD VRLNRTGLVF SILRLLFRIG IGIGKFAVQA FQVFKLLICT

 51 VEHPNRFALP LGGQQLTRFD FTDIHLDGST GGLGFFRREK TGHKRRCHTQ

101 CCHSARAAGR ECQETAAAVV DFLIIHYSVV LIFWEYRAIK RCNFTQFAVI

151 LKALFKIR*
```

Computer analysis of this amino acid sequence gave the following results:

Homology with a predicted ORF from *N. gonorrhoeae* m594/g594 98.1% identity in 158 aa overlap

```
                   10        20        30        40        50        60
m594.pep   MGADTDGDKDVRLNRTGLVFSILRLLFRIGIGIGKFAVQAFQVFKLLICTVEHPNRFALP
           ||||||||||||||||||||||||||||||||||||||||||||||||||||||||||||
g594       MGADTDGDKDVRLNRTGLVFSILRLLFRIGIGIGKFAVQAFQVFKLLICTVEHPNRFALP
                   10        20        30        40        50        60
```

-continued

```
                 70        80        90       100       110       120
m594.pep  LGGQQLTRFDFTDIHLDGSTGGLGFFRREKTGHKRRCHTQCCHSARAAGRECQETAAAVV
          ||||||||||||||||||||||||||||||||||||||||||||||||||:|||||||||
g594      LGGQQLTRFDFTDIHLDGSTGGLGFFRREKTGHKRRCHTQCCHSARAAGRKCQETAAAVV
                 70        80        90       100       110       120

                130       140       150      159
m594.pep  DFLIIHYSVVLIFWEYRAIKRCNFTQFAVILKALFKIRX
          ||||||||||||||| ||||:|||||||||||||||||
g594      DFLIIHYSVVLIFWECRAIKHCNFTQFAVILKALFKIRX
                130       140       150
```

The following partial DNA sequence was identified in *N. meningitidis* <SEQ ID 1863>:

```
a594.seg

  1 ATGGGTGCAG ATACCGATGG CGACAAGGAT GTTCGGCTTA ATCGAACGGG

 51 TCTCGTTTTT AGCATACTCC GGCTGCTGTT CCGCATCGGA ATTGGGATCG

101 GTAAGTTCGC CGTTCAGGCC TTTCAGGTCT TTAAGCTGCT GATCTGTACG

151 GTTGAGCACC CAAATCGGTT TGCCTTGCCA CTCGGCGGTC AGCAACTGAC

201 CCGCTTCGAT TTTACTGACA TCCACCTCGA CGGCAGCACC GGCGGCCTTG

251 GCTTTTTCCG AAGGGAAAAA ACTGGCCACA AACGGCGTTG CCACACCCAA

301 TGCTGCCACT CCGCCCGCGC CGCAGGTCGC GAGTGTCAGG AAACGGCGGC

351 GGCCGTTGTT GATTTCTTGA TTATCCATTA TTCAGTCGTC CTAATATTTT

401 GGGAATACCG AGCCATTAAA CGTTGCAATT TTACCCAGTT TGCAGTGATA

451 CTCAAAGCAT TATTTAAAAT AAGGTAA
```

This corresponds to the amino acid sequence <SEQ ID 1864; ORF 594.a>:

```
a594.pep

  1 MGADTDGDKD VRLNRTGLVF SILRLLFRIG IGIGKFAVQA FQVFKLLICT

 51 VEHPNRFALP LGGQQLTRFD FTDIHLDGST GGLGFFRREK TGHKRRCHTQ

101 CCHSARAAGR ECQETAAAVV DFLIIHYSVV LIFWEYRAIK RCNFTQFAVI

151 LKALFKIR*
```

m594/a594 100.0% identity in 158 aa overlap

```
                 10        20        30        40        50        60
m594.pep  MGADTDGDKDVRLNRTGLVFSILRLLFRIGIGIGKFAVQAFQVFKLLICTVEHPNRFALP
          ||||||||||||||||||||||||||||||||||||||||||||||||||||||||||||
a594      MGADTDGDKDVRLNRTGLVFSILRLLFRIGIGIGKFAVQAFQVFKLLICTVEHPNRFALP
                 10        20        30        40        50        60

                 70        80        90       100       110       120
m594.pep  LGGQQLTRFDFTDIHLDGSTGGLGFFRREKTGHKRRCHTQCCHSARAAGRECQETAAAVV
          ||||||||||||||||||||||||||||||||||||||||||||||||||||||||||||
a594      LGGQQLTRFDFTDIHLDGSTGGLGFFRREKTGHKRRCHTQCCHSARAAGRECQETAAAVV
                 70        80        90       100       110       120

                130       140       150      159
m594.pep  DFLIIHYSVVLIFWEYRAIKRCNFTQFAVILKALFKIRX
          ||||||||||||||||||||||||||||||||||||||
a594      DFLIIHYSVVLIFWEYRAIKRCNFTQFAVILKALFKIRX
                130       140       150
```

The following partial DNA sequence was identified in *N. gonorrhoeae* <SEQ ID 1865>:

g595.seq..

```
   1 atgagaaaat tcaatttgac cgcattgtcc gtgatgcttg ccttgggttt
  51 gaccgcgtgc cagccgccgg aggcggagaa agccgcgccg gccgcgtccg
 101 gtgagaccca atccgccaac gaaggcggtt cggtcggtat cgccgtcaac
 151 gacaatgcct gcgaaccgat gaatctgacc gtgccgagcg gacaggttgt
 201 gttcaatatt aaaaacaaca gcggccgcaa gctcgaatgg gaaatcctga
 251 agggcgtgat ggtggtggac gaacgcgaaa atatcgcccc ggggctttcc
 301 gacaaaatga accgtaacct gctgccgggc gaatacgaaa tgacctgcgg
 351 ccttttgacc aatccgcgcg gcaagctggt ggtagccgac agcggcttta
 401 aagacaccgc caacgaagcg gatttggaaa aactgcccca accgctcgcc
 451 gactataaag cctacgttca aggcgaggtt aaagagctgg cggcgaaaac
 501 caaaaccttt accgaagccg tcaaagcagg cgacattgaa aaggcgaaat
 551 ccctgtttgc cgccacccgc gtccattacg aacgcatcga accgattgcc
 601 gagcttttca gcgaactcga ccccgtcatc gatgcgtgtg aagacgactt
 651 caaagacggt gcgaaagatg ccgggtttac cggcttccac cgtatcgaac
 701 acgccctttg ggtggaaaaa gacgtatccg gcgtgaagga aaccgcggcc
 751 aaactgatga ccgatgtcga agccctgcaa aaagaaatcg acgcattggc
 801 gttccctccg ggcaaagtgg tcggcggcgc gtccgaactg attgaagaag
 851 cggcgggcag taaaatcagc ggcgaagaag accgttacag ccacaccgat
 901 ttgagcgact tccaagctaa tgcggacgga tctaaaaaaa tcgtcgattt
 951 gttccgtccg ttgattgagg ccaaaaacaa agccttgttg gaaaaaaccg
1001 ataccaactt caaacaggtc aacgaaattc tggcgaaata ccgcaccaaa
1051 gacggttttg aaacctacga caagctgagc gaagccgacc gcaaagcatt
1101 acaggctcct attaacgcgc ttgccgaaga ccttgcccaa cttcgcggca
1151 tactcggctt gaaataa
```

This corresponds to the amino acid sequence <SEQ ID 1866; ORF 595.ng>:

g595.pep..

```
   1 MRKFNLTALS VMLALGLTAC QPPEAEKAAP AASGETQSAN EGGSVGIAVN
  51 DNACEPMNLT VPSGQVVFNI KNNSGRKLEW EILKGVMVVD ERENIAPGLS
 101 DKMNRNLLPG EYEMTCGLLT NPRGKLVVAD SGFKDTANEA DLEKLPQPLA
 151 DYKAYVQGEV KELAAKTKTF TEAVKAGDIE KAKSLFAATR VHYERIEPIA
 201 ELFSELDPVI DACEDDFKDG AKDAGFTGFH RIEHALWVEK DVSGVKETAA
 251 KLMTDVEALQ KEIDALAFPP GKVVGGASEL IEEAAGSKIS GEEDRYSHTD
 301 LSDFQANADG SKKIVDLFRP LIEAKNKALL EKTDTNFKQV NEILAKYRTK
 351 DGFETYDKLS EADRKALQAP INALAEDLAQ LRGILGLK*
```

The following partial DNA sequence was identified in *N. meningitidis* <SEQ ID 1867>:

m595.seq

```
   1 ATGAGAAAAT TCAATTTGAC CGCATTGTCC GTGATGCTTG CCTTAGGTTT
  51 GACCGCGTGC CAGCCGCCGG AGGCGGAGAA AGCTGCGCCG GCAGCGTCCG
 101 GTGAGGCGCA AACCGCCAAC GAGGGCGGTT CGGTCAGTAT CGCCGTCAAC
 151 GACAATGCCT GCGAACCGAT GGAACTGACC GTGCCGAGCG GACAGGTTGT
 201 GTTCAATATT AAAAACAACA GCGGCCGCAA GCTCGAATGG GAAATCCTGA
 251 AAGGCGTGAT GGTGGTGGAC GAGCGCGAAA ACATCGCCCC CGGACTTTCC
 301 GATAAAATGA CCGTCACCCT GTTGCCGGGC GAATACGAAA TGACTTGCGG
 351 TCTTTTGACC AATCCGCGCG GCAAGCTGGT GGTAACCGAC AGCGGCTTTA
 401 AAGACACCGC CAACGAAGCG GATTTGGAAA AACTGTCCCA ACCGCTCGCC
 451 GACTATAAAG CCTACGTTCA AGGCGAGGTT AAAGAGCTGG TGGCGAAAAC
 501 CAAAACTTTT ACCGAAGCCG TCAAAGCAGG CGACATTGAA AAGGCGAAAT
 551 CCCTGTTTGC CGACACCCGC GTCCATTACG AACGCATCGA ACCGATTGCC
 601 GAGCTTTTCA GCGAACTCGA CCCCGTCATC GATGCGCGTG AAGACGACTT
 651 CAAAGACGGC GCGAAAGATG CCGGATTTAC CGGCTTTCAC CGTATCGAAT
 701 ACGCCCTTTG GGTGGAAAAA GACGTGTCCG GCGTGAAGGA AATTGCAGCG
 751 AAACTGATGA CCGATGTCGA AGCCCTGCAA AAAGAAATCG ACGCATTGGC
 801 GTTTCCTCCG GGCAAGGTGG TCGGCGGCGC GTCCGAACTG ATTGAAGAAG
 851 TGGCGGGCAG TAAAATCAGC GGCGAAGAAG ACCGGTAGAG CCACACCGAT
 901 TTGAGCGACT TCCAAGCCAA TGTGGACGGA TCTAAAAAAA TCGTCGATTT
 951 GTTCCGTCCG CTGATCGAGG CCAAAAACAA AGCCTTGTTG GAAAAAACCG
1001 ATACCAACTT CAAACAGGTC AACGAAATTC TGGCGAAATA CCGGACTAAA
1051 GACGGTTTTG AAACCTACGA CAAGCTGGGC GAAGCCGACC GCAAAGCGTT
1101 ACAGGCCTCT ATTAACGCGC TTGCCGAAGA CCTTGCCCAA CTTCGCGGCA
1151 TACTCGGCTT GAAATAA
```

This corresponds to the amino acid sequence <SEQ ID 1868; ORF 595>:

m595.pep

```
   1 MRKFNLTALS VMLALGLTAC QPPEAEKAAP AASGEAQTAN EGGSVSIAVN
  51 DNACEPMELT VPSGQVVFNI KNNSGRKLEW EILKGVMVVD ERENIAPGLS
 101 DKMTVTLLPG EYEMTCGLLT NPRGKLVVTD SGFKDTANEA DLEKLSQPLA
 151 DYKAYVQGEV KELVAKTKTF TEAVKAGDIE KAKSLFADTR VHYERIEPIA
 201 ELFSELDPVI DAREDOFRDG AKDAGFTGFH RIEYALWVEK DVSGVKEIAA
 251 KLMTDVEALQ KEIDALAFPP GKVVGGASEL IEEVAGSKIS GEEDRYSHTD
 301 LSDFQANVDG SKKIVDLFRP LIEAKNKALL EKTDTNFKQV NEILAKYRTK
 351 DGFETYDKLG EADRKALQAS INALAEDLAQ LRGILGLK*
```

Computer analysis of this amino acid sequence gave the following results:

Homology with a predicted ORF from *N. gonorrhoeae* m595/g595 95.4% identity in 388 aa overlap

```
                  10        20        30        40        50        60
m595.pep  MRKFNLTALSVMLALGLTACQPPEAEKAAPAASGEAQTANEGGSVSIAVNDNACEPMELT
          |||||||||||||||||||||||||||||||||||:|:|||||||:|||||||||||:||
g595      MRKFNLTALSVMLALGLTACQPPEAEKAAPAASGETQSANEGGSVGIAVNDNACEPMNLT
                  10        20        30        40        50        60

                  70        80        90       100       110       120
m595.pep  VPSGQVVFNIKNNSGRKLEWEILKGVMVVDERENIAPGLSDKMTVTLLPGEYEMTCGLLT
          |||||||||||||||||||||||||||||||||||||||||||: :||||||||||||||
g595      VPSGQVVFNIKNNSGRKLEWEILKGVMVVDERENIAPGLSDKMNRNLLPGEYEMTCGLLT
                  70        80        90       100       110       120

                 130       140       150       160       170       180
m595.pep  NPRGKLVVTDSGFKDTANEADLEKLSQPLADYKAYVQGEVKELVAKTKTFTEAVKAGDIE
          ||||||||:|||||||||||||||| ||||||||||||||||||:|||||||||||||||
g595      NPRGKLVVADSGFKDTANEADLEKLPQPLADYKAYVQGEVKELAAKTKTFTEAVKAGDIE
                 130       140       150       160       170       180

                 190       200       210       220       230       240
m595.pep  KAKSLFADTRVHYERIEPIAELFSELDPVIDAREDDFKDGAKDAGFTGFHRIEYALWVEK
          ||||||| ||||||||||||||||||||||| |||||||||||||||||||||:||||||
g595      KAKSLFAATRVHYERIEPIAELFSELDPVIDACEDDFKDGAKDAGFTGFHRIEHALWVEK
                 190       200       210       220       230       240

                 250       260       270       280       290       300
m595.pep  DVSGVKEIAAKLMTDVEALQKEIDALAFPPGKVVGGASELIEEVAGSKISGEEDRYSHTD
          ||||||| |||||||||||||||||||||||||||||||||||:||||||||||||||||
g595      DVSGVKETAAKLMTDVEALQKEIDALAFPPGKVVGGASELIEEAAGSKISGEEDRYSHTD
                 250       260       270       280       290       300

                 310       320       330       340       350       360
m595.pep  LSDFQANVDGSKKIVDLFRPLIEAKNKALLEKTDTNFKQVNEILAKYRTKDGFETYDKLG
          |||||||:|||||||||||||||||||||||||||||||||||||||||||||||||||:
g595      LSDFQANADGSKKIVDLFRPLIEAKNKALLEKTDTNFKQVNEILAKYRTKDGFETYDKLS
                 310       320       330       340       350       360

                 370       380      389
m595.pep  EADRKALQASINALAEDLAQLRGILGLKX
          ||||||||| |||||||||||||||||||
g595      EADRKALQAPINALAEDLAQLRGILGLKX
                 370       380
```

The following partial DNA sequence was identified in *N. meningitidis* <SEQ ID 1869>:

<u>a595.seq</u>

```
  1 ATGAGAAAAT TCAATTTGAC CGCATTGTCC GTGATGCTTG CCTTAGGTTT
 51 GACCGCGTGC CAGCCGCCGG AGGCGGAGAA AGCTGCGCCG GCAGCGTCCG
101 GTGAGGCGCA AACCGCCAAC GAGGGCGGTT CGGTCAGTAT CGCCGTCAAC
151 GACAATGCCT GCGAACCGAT GGAACTGACC GTGCCGAGCG GACAGGTTGT
201 GTTCAATATT AAAAACAACA GCGGCCGCAA GCTCGAATGG GAAATCCTGA
251 AAGGCGTGAT GGTGGTGGAC GAGCGCGAAA ACATCGCCCC CGGACTTTCC
301 GATAAAATGA CCGTCACCCT GTTGCCGGGC GAATACGAAA TGACTTGCGG
351 TCTTTTGACC AATCCGCGCG GCAAGCTGGT GGTAACCGAC AGCGGCTTTA
401 AAGACACCGC CAACGAAGCG GATTTGGAAA AACTGTCCCA ACCGCTCGCC
451 GACTATAAAG CCTATGTTCA AGGCGAAGTC AAAGAGCTGG TGGCGAAAAC
501 CAAAACCTTT ACCGAAGCCG TCAAAGCAGG CGACATTGAA AAGGCGAAAT
551 CCCTGTTTGC CGACACCCGC GTCCATTACG AACGCATCGA ACCGATTGCC
601 GAGCTTTTCA GCGAACTCGA CCCCGTCATC GATGCGCGTG AAGACGACTT
651 CAAAGACGGC GCGAAAGATG CCGGATTTAC CGGCTTCCAC CGTATCGAAT
701 ACGCCCTTTG GGTGGAAAAA GACGTGTCCG GCGTGAAGGA AATTGCAGCG
751 AAACTGATGA CCGATGTCGA AGCCCTGCAA AAAGAAATCG ACGCATTGGC
801 GTTTCCTCCG GGCAAGGTGG TCGGCGGCGC GTCCGAACTG ATTGAAGAAG
851 TGGCGGGCAG TAAAATCAGC GGCGAAGAAG ACCGGTACAG CCACACCGAT
```

-continued

```
 901 TTGAGCGACT TCCAAGCCAA TGTGGACGGA TCGAAAAAAA TCGTCGATTT

 951 GTTCCGTCCG TTGATCGAGA CCAAAAACAA AGCCTTGTTG GAAAAAACCG

1001 ATACCAACTT CAAACAGGTC AACGAAATTC TGGCGAAATA CCGGACTAAA

1051 GACGGTTTTG AAACCTACGA CAAGCTGGGC GAAGCCGACC GCAAAGCGTT

1101 ACAGGCCTCT ATTAACGCGC TTGCCGAAGA CCTTGCCCAA CTTCGCGGCA

1151 TACTCGGCTT GAAATAA
```

This corresponds to the amino acid sequence <SEQ ID 1870, ORF 595.a>:

```
a595.pep

  1 MRKFNLTALS VMLALGLTAC QPPEAEKAAP AASGEAQTAN EGGSVSIAVN

 51 DNACEPMELT VPSGQVVFNI KNNSGRKLEW EILKGVNVVD ERENIAPGLS

101 DKMTVTLLPG EYEMTCGLLT NPRGKLVVTD SGFKDTANEA DLEKLSQPLA

151 DYKAYVQGEV KELVAKTKTF TEAVKAGDIE KAKSLFADTR VHYERIEPIA

201 ELFSELDPVI DAREDDFKDG AKDAGFTGFH RIEYALWVEK DVSGVKEIAA

251 KLMTDVEALQ KEIDALAFPP GKVVGGASEL IEEVAGSKIS GEEDRYSHTD

301 LSDFQANVDG SKKIVDLFRP LIETKNKALL EKTDTNFIQV NEILAKYRTK

351 DGFETYDKLG EADRKALQAS INALAEDLAQ LRGILGLK*
```

m595/a595 99.7% identity in 388 aa overlap

```
                    10        20        30        40        50        60
m595.pep    MRKFNLTALSVMLALGLTACQPPEAEKAAPAASGEAQTANEGGSVSIAVNDNACEPMELT
            ||||||||||||||||||||||||||||||||||||||||||||||||||||||||||||
a595        MRKFNLTALSVMLALGLTACQPPEAEKAAPAASGEAQTANEGGSVSIAVNDNACEPMELT
                    10        20        30        40        50        60

                    70        80        90       100       110       120
m595.pep    VPSGQVVFNIKNNSGRKLEWEILKGVMVVDERENIAPGLSDKMTVTLLPGEYEMTCGLLT
            ||||||||||||||||||||||||||||||||||||||||||||||||||||||||||||
a595        VPSGQVVFNIKNNSGRKLEWEILKGVMVVDERENIAPGLSDKMTVTLLPGEYEMTCGLLT
                    70        80        90       100       110       120

                   130       140       150       160       170       180
m595.pep    NPRGKLVVTDSGFKDTANEADLEKLSQPLADYKAYVQGEVKELVAKTKTFTEAVKAGDIE
            ||||||||||||||||||||||||||||||||||||||||||||||||||||||||||||
a595        NPRGKLVVTDSGFKDTANEADLEKLSQPLADYKAYVQGEVKELVAKTKTFTEAVKAGDIE
                   130       140       150       160       170       180

                   190       200       210       220       230       240
m595.pep    KAKSLFADTRVHYERIEPIAELFSELDPVIDAREDDFKDGAKDAGFTGFHRIEYALWVEK
            ||||||||||||||||||||||||||||||||||||||||||||||||||||||||||||
a595        KAKSLFADTRVHYERIEPIAELFSELDPVIDAREDDFKDGAKDAGFTGFHRIEYALWVEK
                   190       200       210       220       230       240

                   250       260       270       280       290       300
m595.pep    DVSGVKEIAAKLMTDVEALQKEIDALAFPPGKVVGGASELIEEVAGSKISGEEDRYSHTD
            ||||||||||||||||||||||||||||||||||||||||||||||||||||||||||||
a595        DVSGVKEIAAKLMTDVEALQKEIDALAFPPGKVVGGASELIEEVAGSKISGEEDRYSHTD
                   250       260       270       280       290       300

                   310       320       330       340       350       360
m595.pep    LSDFQANVDGSKKIVDLFRPLIEAKNKALLEKTDTNFKQVNEILAKYRTKDGFETYDKLG
            |||||||||||||||||||||||:||||||||||||||||||||||||||||||||||||
a595        LSDFQANVDGSKKIVDLFRPLIETKNKALLEKTDTNFKQVNEILAKYRTKDGFETYDKLG
                   310       320       330       340       350       360

                   370       380      389
m595.pep    EADRKALQASINALAEDLAQLRGILGLKX
            |||||||||||||||||||||||||||||
a595        EADRKALQASINALAEDLAQLRGILGLKX
                   370       380
```

The following partial DNA sequence was identified in *N. gonorrhoeae* <SEQ ID 1871>:

g596.seq.(partial).

```
   1 ..atgctgctct tggacgagcc gaccaaccac ttggatgcgg aatcggtgga
  51   atggctggag caattcctcg tgcgcttccc cggcacagtg gtcgcggtaa
 101   cgcacgaccg ctacttcctc gacaacgccg ccgaatggat tttggaactc
 151   gaccgcggac acggcattcc gtggaaaggc aattactcgt cttggctgga
 201   gcagaaagaa aaacgcttgg aaaacgaggc gaaatccgaa gccgcgcgcg
 251   tgaaggcgat gaagcaggaa ttggaatggg tgcgccaaaa tgccaaaggc
 301   cgccaagcca agcccaaagc gcgtttggcg cgttttgaag aaatgagcaa
 351   ctacgaatac caaaaacgca acgaaactca ggaaatcttt atccctgttg
 401   ccgagcgttt gggtaacgaa gtgattgaat ttgtgaatgt ttccaaatcg
 451   ttcggcgata aagtgctgat tgacggtttg agcttcaaag tgccggcggg
 501   cgcgattgtc ggcatcatcg gcccgaacgg cgcgggtaaa tcgacgctgt
 551   tcaaaatgat tgcgggcaaa gagcagcccg attcgggcga agtgaaaatc
 601   gggcaaaccg tgaaaatgag cttgattgac caaagccgcg aaggtttgca
 651   aaacgacaaa accgtgttcg acaacattgc cgaaggtcgc gatattttgc
 701   aggtcggaca gtttgaaatc cccgcccgcc aatatttggg acgcttcaac
 751   tttaaaggca gcgaccaaag caaaatcgca aggcagcttt ccggcggcga
 801   acgcggccgt ctgcacttgg caaaaacctt gttgggcggc ggcaatgtgt
 851   tgctgctgga cgaaccgtcc aacgatctcg acgtggaaac cctgcgcgcg
 901   ttggaagacg cattgttgga atttgccggc agcgtgatgg tgatttcgca
 951   cgaccgctgg tttctcgacc gcatagccac gcatatcttg gcgtgtgaag
1001   gcgactccaa atgggtgttc ttcgacggca actatcaaga atacgaagcc
1051   gacaagaaac gccgactcgg caaagaaggc gcgaaaccga aacgcatcaa
1101   atacaaaccg gtaacgcgtt aa
```

This corresponds to the amino acid sequence <SEQ ID 1872; ORF 596.ng>:

g596.pep (partial).

```
  1 ..MLLLDEPTNH LDAESVEWLE QFLVRFPGTV VAVTHDRYFL DNAAEWILEL
 51   DRGHGIPWKG NYSSWLEQKE KRLENEAKSE AARVKANKQE LEWVRQNAKG
101   RQAKPKARLA RFEEMSNYEY QKRNETQEIF IPVAERLGNE VIEFVNVSKS
151   FGDKVLIDGL SFKVPAGAIV GIIGPNGAGK STLFKMIAGK EQPDSGEVKI
201   GQTVKMSLID QSREGLQNDK TVFDNIAEGR DILQVGQFEI PARQYLGRFN
251   FKGSDQSKIA RQLSGGERGR LHLAKTLLGG GNVLLLDEPS NDLDVETLRA
301   LEDALLEFAG SVMVISHDRW FLDRIATHIL ACEGDSKWVF FDGNYQEYEA
351   DKKRRLGKEG AKPKRIKYKP VTR*
```

The following partial DNA sequence was identified in *N. meningitidis* <SEQ ID 1873>:

m596.seq..

```
   1 ATGTCCCAAC AATACGTCTA TTCTATGCTG CGCGTGAGCA AGGTTGTGCC
  51 GCCGCAGAAA ACCATCATTA AAGATATTTC CCTTTCTTTC TTCCCCGGCG
 101 CGAAAATCGG CCTGCTCGGT TTGAACGGCG CGGGCAAGTC CACCGTGCTG
 151 CGGATTATGG CGGGCGTGGA TAAGGAATTT GAGGGCGAAG CCGTGCCGAT
 201 GGGCGGCATC AAAATCGGCT ACCTGCCGCA AGAGCCTGAG CTTGATCCGG
 251 AAAAAACCGT GCGCGAGGAA GTGGAAAGCG GTTTGGGCGA AGTGGCTGCC
 301 GCGCAGAAAC GTTTGGAAGA AGTGTATGCC GAGTACGCCA ATCCTGATGC
 351 GGATTTTGAC GCGTTGGCAG AAGAGCAGGG CCGCTTGGAA GCGATTATTG
 401 CGGCAGGTTC GTCCACGGGC GGCGGTGCGG AACACGAATT GGAAATCGCC
 451 GCCGACGCGC TGCGCCTGCC GGAATGGGAT GCCAAAATCG ATAATTTGTC
 501 CGGCGGTGAA AAACGCCGCG TTGCCTTGTG CAAACTCTTG TTGAGCAAGC
 551 CCGATATGCT TTTCCTGGAC GAGCCGACCA ACCACTTGGA TGCGGAATCG
 601 GTCGAGTGGC TGGAGCAATT TCTCGTGCGC TTCCCCGGCA CAGTCGTTGC
 651 GGTAACGCAC GACCGCTACT TCCTCGACAA CGCCGCCGAA TGGATTTTGG
 701 AACTCGACCG CGGCCATGGT ATTCCGTGGA AAGGCAATTA CTCGTCTTGG
 751 CTGGAGCAGA AAGAAAAACG CTTGGAAAAC GAGGCAAAAT CCGAAGCCGC
 801 GCGCGTGAAG GCGATGAAGC AGGAATTGGA ATGGGTGCGC CAAAATGCCA
 851 AAGGCCGCCA AGCCAAGTCC AAAGCGCGTT TGGCTCGTTT TGAAGAAATG
 901 AGCAACTACG AATACCAAAA ACGCAATGAA ACGCAGGAAA TCTTTATTCC
 951 CGTTGCCGAG CGTTTGGGTA ACGAAGTGAT TGAATTTGTA AATGTTTCCA
1001 AATCGTTCGG CGATAAAGTG CTGATTGACG ATTTGAGCTT CAAAGTGCCT
1051 GCGGGCGCGA TTGTCGGCAT CATCGGCCCG AACGGCGCGG GTAAATCTAC
1101 GCTGTTCAAA ATGATTTCGG GCAAAGAGCA GCCTGATTCC GGCGAGGTGA
1151 AAATCGGACA AACCGTGAAA ATGAGCTTGA TTGACCAAAG CCGCGAAGGT
1201 TTGCAAAACG ACAAAACCGT GTTCGACAAC ATTGCCGAAG GCCGCGACAT
1251 TTTGCAGGTT GGTCAGTTTG AAATTCCCGC CCGCCAATAT TTGGGGCGTT
1301 TCAACTTCAA AGGCAGCGAC CAAAGCAAAA TTGCAGGTCA ATTCTCTGGC
1351 GGCGAACGCG GTCGTCTGCA CTTGGCAAAA ACCTTGTTGA GCGGCGGCAA
1401 TGTATTGCTG CTGGATGAAC CGTCTAACGA CCTTGACGTG GAAACCCTGC
1451 GCGCGTTGGA AGACGCATTG TTGGAATTTG CCGGCAGCGT GATGGTGATT
1501 TCGCACGACC GTTGGTTCCT CGACCGCATC GCCACGCATA TCTTGGCGTG
1551 TGAAGGCGAC TCTAAATGGG TGTTCTTCGA CGGCAACTAT CAGGAATACG
1601 AAGCCGACAA GAAACGCCGT TTGGGCGAAG AAGGCGCGAA ACCGAAACGC
1651 ATCAAATACA AACCGGTAAC GCGTTAA
```

This corresponds to the amino acid sequence <SEQ ID 1874; ORF 596>:

m596.pep..

```
 1 MSQQYVYSML RVSKVVPPQK TIIKDISLSF FPGAKIGLLG LNGAGKSTVL
51 RIMAGVDKEF EGEAVPMGGI KIGYLPQEPE LDPEKTVREE VESGLGEVAA
```

-continued

```
101 AQKRLEEVYA EYANPDADFD ALAEEQGRLE AIIAAGSSTG GGAEHELEIA

151 ADALRLPEWD AKIDNLSGGE KRRVALCKLL LSKPDMLLLD EPTNHLDAES

201 VEWLEQFLVR FPGTVVAVTH DRYFLDNAAE WILELDRGHG IPWKGNYSSW

251 LEQKEKRLEN EAKSEAARVK AMKQELEWVR QNAIGRQAKS KARLARFEEM

301 SNYEYQKRNE TQEIFIPVAE RLGNEVIEFV NVSKSFGDKV LIDDLSFKVP

351 AGAIVGIIGP NGAGKSTLFK MISGKEQPDS GEVKIGQTVK MSLIDQSREG

401 LQNDKTVFDN IAEGRDILQV GQFEIPARQY LGRFNFKGSD QSKIAGQLSG

451 GERGRLHLAK TLLSGGNVLL LDEPSNDLDV ETLRALEDAL LEFAGSVMVI

501 SHDRWFLDRI ATHILACEGD SKWVFFDGNY QEYEADKKRR LGEEGAKPKR

551 IKYKPVTR*
```

Computer analysis of this amino acid sequence gave the following results:

Homology with a predicted ORF from *N. gonorrhoeae* m596 g596 98.4% identity in 373 aa overlap

```
                160       170       180       190       200       210
m596.pep   LPEWDAKIDNLSGGEKRRVALCKLLLSKPDMLLLDEPTNHLDAESVEWLEQFLVRFPGTV
                                         ||||||||||||||||||||||||||||||
g596                                     MLLLDEPTNHLDAESVEWLEQFLVRFPGTV
                                                 10        20        30

                220       230       240       250       260       270
m596.pep   VAVTHDRYFLDNAAEWILELDRGHGIPWKGNYSSWLEQKEKRLENEAKSEAARVKAMKQE
           ||||||||||||||||||||||||||||||||||||||||||||||||||||||||||||
g596       VAVTHDRYFLDNAAEWILELDRGHGIPWKGNYSSWLEQKEKRLENEAKSEAARVKAMKQE
                     40        50        60        70        80        90

                280       290       300       310       320       330
m596.pep   LEWVRQNAKGRQAKSKARLARFEEMSNYEYQKRNETQEIFIPVAERLGNEVIEFVNVSKS
           |||||||||||||| |||||||||||||||||||||||||||||||||||||||||||||
g596       LEWVRQNAKGRQAKPKARLARFEEMSNYEYQKRNETQEIFIPVAERLGNEVIEFVNVSKS
                    100       110       120       130       140       150

                340       350       360       370       380       390
m596.pep   FGDKVLIDDLSFKVPAGAIVGIIGPNGAGKSTLFKMISGKEQPDSGEVKIGQTVKMSLID
           |||||||| ||||||||||||||||||||||||||||:||||||||||||||||||||||
g596       FGDKVLIDGLSFKVPAGAIVGIIGPNGAGKSTLFKMIAGKEQPDSGEVKIGQTVKMSLID
                    160       170       180       190       200       210

                400       410       420       430       440       450
m596.pep   QSREGLQNDKTVFDNIAEGRDILQVGQFEIPARQYLGRFNFKGSDQSKIAGQLSGGERGR
           |||||||||||||||||||||||||||||||||||||||||||||||||| |||||||||
g596       QSREGLQNDKTVFDNIAEGRDILQVGQFEIPARQYLGRFNFKGSDQSKIARQLSGGERGR
                    220       230       240       250       260       270

                460       470       480       490       500       510
m596.pep   LHLAKTLLSGGNVLLLDEPSNDLDVETLRALEDALLEFAGSVMVISHDRWFLDRIATHIL
           ||||||||:|||||||||||||||||||||||||||||||||||||||||||||||||||
g596       LHLAKTLLGGGNVLLLDEPSNDLDVETLRALEDALLEFAGSVMVISHDRWFLDRIATHIL
                    280       290       300       310       320       330

                520       530       540       550       559
m596.pep   ACEGDSKWVFFDGNYQEYEADKKRRLGEEGAKPKRIKYKPVTRX
           |||||||||||||||||||||||||||:||||||||||||||||
g596       ACEGDSKWVFFDGNYQEYEADKKRRLGKEGAKPKRIKYKPVTRX
                    340       350       360       370
```

The following partial DNA sequence was identified in *N. meningitidis* <SEQ ID 1875>:

<u>a596.seq</u>

```
  1 ATGTCCCAAC AATACGTCTA TTCTATGCTG CGCGTGAGCA AGGTTGTGCC

 51 GCCGCAGAAA ACCATCATTA AAGATATTTC CCTTTCTTTC TTCCCCGGCG

101 CGAAAATCGG TTTGCTCGGT TTGAACGGCG CGGGCAAGTC CACCGTGCTG

151 CGGATTATGG CGGGCGTGGA TAAAGAATTT GAGGGCGAAG CCGTGCCGAT
```

-continued

```
 201 GGGCGGTATT AAAATCGGCT ACCTGCCGCA AGAGCCTGAG CTTGATCCGG
 251 AAAAAACCGT GCGTGAGGAA GTGGAAAGCG GTTTGGGCGA AGTGGCTGCC
 301 GCGCAGAAAC GTTTGGAGGA AGTGTATGCC GAGTACGCCA ATCCCGATGC
 351 GGATTTTGAC GCGTTGGCGG AAGAGCAGGG GCGTTTGGAA GCGATTATTG
 401 CGGCGGGTTC GTCCACGGGC GGCGGTGCGG AACACGAATT GGAAATCGCT
 451 GCCGACGCGC TGCGCCTGCC GGAATGGGAT GCCAAAATCG ATAATTTGTC
 501 CGGCGGTGAA AAACGCCGCG TCGCTTTGTG CAAACTCTTG TTGAGCAAGC
 551 CCGATATGCT TTTGCTGGAC GAGCCGACCA ACCACTTGGA TGCGGAATCG
 601 GTCGAGTGGC TGGAGCAATT TCTCGTGCGC TTCCCCGGTA CAGTCGTTGC
 651 CGTAACACAC GACCGCTACT TCCTCGACAA CGCCGCCGAA TGGATTTTGG
 701 AACTCGACCG CGGGCACGGT ATTCCGTGGA AAGGAAATTA CTCGTCTTGG
 751 TTGGAGCAGA AAGAAAAACG TTTGGAAAAC GAGGCGAAAT CCGAAGCCGC
 801 GCGCGTGAAA GCGATGAAGC AGGAATTGGA ATGGGTGCGC CAAAATGCCA
 851 AAGGCCGTCA AGCCAAGTCC AAAGCGCGTT TGGCGCGTTT TGAAGAAATG
 901 AGCAACTATG AATACCAAAA ACGCAATGAA ACGCAGGAAA TCTTCATTCC
 951 CGTCGCCGAG CGTTTGGGTA ACGAAGTGAT TGAATTTGTG AATGTTTCCA
1001 AATCGTTCGG CGACAAAGTG CTGATTGACG ATTTGAGCTT CAAAGTGCCT
1051 GCGGGCGCGA TTGTCGGCAT CATCGGTCCG AACGGCGCGG GTAAATCGAC
1101 ACTGTTTAAA ATGATTGCGG GCAAAGAGCA GCCCGATTCC GGTGAAGTGA
1151 AAATCGGGCA AACCGTGAAA ATGAGCTTGA TTGACCAAAG CCGCGAAGGT
1201 TTGCAAAACG ACAAAACCGT GTTCGACAAC ATTGCCGAAG GTCGCGATAT
1251 TTTACAGGTC GGGCAGTTTG AAATCCCCGC CCGCCAATAT TTGGGACGCT
1301 TCAATTTCAA AGGCAGCGAC CAAAGCAAAA TCACGGGGCA GCTTTCCGGC
1351 GGCGAACGCG GACGTTTGCA CTTGGCAAAA ACCTTGTTGG GCGGTGGCAA
1401 TGTGTTGCTG CTGGACGAAC CGTCCAACGA CCTCGACGTG GAAACCCTGC
1451 GCGCGTTGGA AGACGCATTG CTGGAATTTG CCGGCAGCGT GATGGTGATT
1501 TCGCACGACC GCTGGTTCCT CGACCGTATT GCTACGCATA TCTTGGCTTG
1551 CGAAGGCGAC TCCAAATGGG TGTTCTTTGA CGGCAACTAT CAGGAATACG
1601 AAGCCGACAA GAAACGCCGA CTCGGCGAAG AAGGCACGAA ACCGAAACGC
1651 ATCAAATACA AACCGGTAAC GCGTTAA
```

This corresponds to the amino acid sequence <SEQ ID 1876; ORF 596.a>:

a596.pep

```
  1 MSQQYVYSML RVSKVVPPQK TIIKDISLSF FPGAKIGLLG LNGAGKSTVL
 51 RIMAGVDKEF EGEAVPMGGI KIGYLPQEPE LDPEKTVREE VESGLGEVAA
101 AQKRLEEVYA EYANPDADFD ALAEEQGRLE AIIAAGSSTG GGAEHELEIA
151 ADALRLPEWD AKIDNLSGGE KRRVALCKLL LSKPDMLLLD EPTNHLDAES
201 VEWLEQFLVR FPGTVVAVTH DRYFLDNAAE WILELDRGHG IPWKGNYSSW
```

-continued

```
251 LEQKEKRLEN EAKSEAARVK AMKQELEWVR QNAKGRQAKS KARLARFEEM

301 SNYEYQKRNE TQEIFIPVAE RLGNEVIEFV NVSKSFGDKV LIDDLSFKVP

351 AGAIVGIIGP NGAGKSTLFK MIAGKEQPDS GEVKIGQTVK MSLIDQSREG

401 LQNDKTVFDN IAEGRDILQV GQFEIPARQY LGRFNFKGSD QSKITGQLSG

451 GERGRLHLAK TLLGGGNVLL LDEPSNDLDV ETLRALEDAL LEFAGSVMVI

501 SHDRWFLDRI ATHILACEGD SKWVFFDGNY QEYEADKKRR LGEEGTKPKR

551 IKYKPVTR*
```

m596/a596 99.3% identity in 558 aa overlap

```
                  10        20        30        40        50        60
m596.pep   MSQQYVYSMLRVSKVVPPQKTIIKDISLSFFPGAKIGLLGLNGAGKSTVLRIMAGVDKEF
           ||||||||||||||||||||||||||||||||||||||||||||||||||||||||||||
a596       MSQQYVYSMLRVSKVVPPQKTIIKDISLSFFPGAKIGLLGLNGAGKSTVLRIMAGVDKEF
                  10        20        30        40        50        60

                  70        80        90       100       110       120
m596.pep   EGEAVPMGGIKIGYLPQEPELDPEKTVREEVESGLGEVAAAQKRLEEVYAEYANPDADFD
           ||||||||||||||||||||||||||||||||||||||||||||||||||||||||||||
a596       EGEAVPMGGIKIGYLPQEPELDPEKTVREEVESGLGEVAAAQKRLEEVYAEYANPDADFD
                  70        80        90       100       110       120

                 130       140       150       160       170       180
m596.pep   ALAEEQGRLEAIIAAGSSTGGGAEHELEIAADALRLPEWDAKIDNLSGGEKRRVALCKLL
           ||||||||||||||||||||||||||||||||||||||||||||||||||||||||||||
a596       ALAEEQGRLEAIIAAGSSTGGGAEHELEIAADALRLPEWDAKIDNLSGGEKRRVALCKLL
                 130       140       150       160       170       180

                 190       200       210       220       230       240
m596.pep   LSKPDMLLLDEPTNHLDAESVEWLEQFLVRFPGTVVAVTHDRYFLDNAAEWILELDRGHG
           ||||||||||||||||||||||||||||||||||||||||||||||||||||||||||||
a596       LSKPDMLLLDEPTNHLDAESVEWLEQFLVRFPGTVVAVTHDRYFLDNAAEWILELDRGHG
                 190       200       210       220       230       240

                 250       260       270       280       290       300
m596.pep   IPWKGNYSSWLEQKEKRLENEAKSEAARVKAMKQELEWVRQNAKGRQAKSKARLARFEEM
           ||||||||||||||||||||||||||||||||||||||||||||||||||||||||||||
a596       IPWKGNYSSWLEQKEKRLENEAKSEAARVKAMKQELEWVRQNAKGRQAKSKARLARFEEM
                 250       260       270       280       290       300

                 310       320       330       340       350       360
m596.pep   SNYEYQKRNETQEIFIPVAERLGNEVIEFVNVSKSFGDKVLIDDLSFKVPAGAIVGIIGP
           ||||||||||||||||||||||||||||||||||||||||||||||||||||||||||||
a596       SNYEYQKRNETQEIFIPVAERLGNEVIEFVNVSKSFGDKVLIDDLSFKVPAGAIVGIIGP
                 310       320       330       340       350       360

                 370       380       390       400       410       420
m596.pep   NGAGKSTLFKMISGKEQPDSGEVKIGQTVKMSLIDQSREGLQNDKTVFDNIAEGRDILQV
           |||||||||||:||||||||||||||||||||||||||||||||||||||||||||||||
a596       NGAGKSTLFKMIAGKEQPDSGEVKIGQTVKMSLIDQSREGLQNDKTVFDNIAEGRDILQV
                 370       380       390       400       410       420

                 430       440       450       460       470       480
m596.pep   GQFEIPARQYLGRFNFKGSDQSKIAGQLSGGERGRLHLAKTLLSGGNVLLLDEPSNDLDV
           ||||||||||||||||||||||||:||||||||||||||||||:||||||||||||||||
a596       GQFEIPARQYLGRFNFKGSDQSKITGQLSGGERGRLHLAKTLLGGGNVLLLDEPSNDLDV
                 430       440       450       460       470       480

                 490       500       510       520       530       540
m596.pep   ETLRALEDALLEFAGSVMVISHDRWFLDRIATHILACEGDSKWVFFDGNYQEYEADKKRR
           ||||||||||||||||||||||||||||||||||||||||||||||||||||||||||||
a596       ETLRALEDALLEFAGSVMVISHDRWFLDRIATHILACEGDSKWVFFDGNYQEYEADKKRR
                 490       500       510       520       530       540

                 550      559
m596.pep   LGEEGAKPKRIKYKPVTRX
           |||||:|||||||||||||
a596       LGEEGTKPKRIKYKPVTRX
                 550
```

The following partial DNA sequence was identified in *N. gonorrhoeae* <SEQ ID 1877> g597.seq

```
  1 ATGCTGCTTC ATGTCAGCAA TTCCCTCAAA CAGCTTCAGG AAGAGCGTAT

 51 CCGCCAAGAA CGTATCCGCC AAGAGCGTAT CCGTCAGGCG CGCGGCAACC
```

-continued

```
 101 TTGCTTCCGT CAACCGCAAA CAGCGCGAGG CTTGGGACAA ATTCCAAAAA

 151 CTCAATACCG AGCTGAACCG TTTGAAAACG GAAGTCGCCG CTACGAAAGC

 201 GCAGATTTCC CGTTTCGTAT CGGGGAACTA TAAAAACAGC CGGCCGAATG

 251 CGGTTGCCCT GTTCCTGAAA AACGCCGAAC CGGGTCAGAA AAACCGCTTT

 301 TTGCGTTATA CGCGTTATGT AAACGCCTCC AATCGGGAAG TTGTCAAGGA

 351 TTTGGAAAAA CAGCAGAAGG CTTTGGCGGT ACAAGAGCAG AAAATCAACA

 401 ATGAGCTTGC CCGTTTGAAG AAAATTCAGG CAAACGTGCA ATCCCTGCTG

 451 AAAAAACAGG GTGTAACCGA TGCGGCGGAA CAGACGGAAA GCCGCAGACA

 501 GAATGCCAAA ATCTCCAAAG ATGCCCGAAA ACTGCTGGAA CAGAAAGGGA

 551 ACGAGCAGCA GCTGAACAAG CTCTTGAGCA ATTTGgagaa aaAAAaagcc

 601 gaacaccgCA TTcaggAtgc ggAagcaaAA agaAAATTGG CTGAagcCaa

 651 actGgcggca gccgAAAAAG CCAGAAAAGA AGCGGCGCAG CAGAAGGCTG

 701 AAGCGCGACG TGCGGAAATG TCCAACCTGA CCGCCGAAGA CAGGAACATC

 751 CAAGCGCCTT CGGTTATGGG TATCGGCAGT GCCGACGgTT TCAGCCGCAT

 801 GCAGGGACGT TTGAAAAAAC CGGTTGACGG TGTGCCGACC GGGCTTTTCG

 851 GGCAGAACCG GAGCGGcggC GATGTTTGGA AAGGCGTGTT CTATTCCACT

 901 GCGCCTGCAA CGGTTGAAAG CATTGCGCcg gGAACggtaa GCTATGCGGA

 951 cgaGTTGGAC GGCTACGGCA AAGTGGTCGT GATCGATCAC GGCGAGAACT

1001 ACATCAGCAT CTATGCCGGT TTGAGCGAAA TTTCCGCCGG CAAGGGTTAT

1051 ACGGTCGCGG CAGGAAGCAA AATCGGCACG AGCGGGTCGC TGCCGGACGG

1101 GGAAGAGGGG CTTTACCTGC AAATACGTTA TCGAGGTCAG GTGTTGAACC

1151 CTTCGGGCTC GATACGTTGA
```

This corresponds to the amino acid sequence <SEQ ID 1878; ORF 597>:

g597.pep

```
  1 MLLHVSNSLK QLQEERIRQE RIRQERIRQA RGNLASVNRK QREAWDKFQK

 51 LNTELNRLKT EVAATKAQIS RFVSGNYKNS RPNAVALFLK NAEPGQKNRF

101 LRYTRYVNAS NREVVKDLEK QQKALAVQEQ KINNELARLK KIQANVQSLL

151 KKQGVTDAAE QTESRRQNAK ISKDARKLLE QKGNEQQLNK LLSNLEKKKA

201 EHRIQDAEAK RKLAEAKLAA AEKARKEAAQ QKAEARRAEM SNLTAEDRNI

251 QAPSVMGIGS ADGFSRMQGR LKKPVDGVPT GLFGQNRSGG DVWKGVFYST

301 APATVESIAP GTVSYADELD GYGKVVVIDH GENYISIYAG LSEISAGKGY

351 TVAAGSKIGT SGSLPDGEEG LYLQIRYRGQ VLNPSGWIR*
```

The following partial DNA sequence was identified in *N. meningitidis* <SEQ ID 1879>:

m597.seq

```
  1 ATGCTGCTTC ATGTCAGCAA TTCCCTCAAA CAGCTTCAGG AAGAGCGTAT

 51 CCGCCAAGAG CGTATCCGTC AGGCGCGCGG CAACCTTGCT TCCGTCAACC
```

-continued

```
 101 GCAAACAGCG CGAGGCTTGG GACAAGTTCC AAAAACTCAA TACCGAGCTG
 151 AACCGTTTGA AAACGGAAGT CGCCGCTACG AAAGCGCAGA TTTCCCGTTT
 201 CGTATCGGGG AACTATAAAA ACAGCCAGCC GAATGCGGTT GCCCTGTTCC
 251 TGAAAAACGC CGAACCGGGT CAGAAAAACC GCTTTTTGCG TTATACGCGT
 301 TATGTAAACG CCTCCAATCG GGAAGTTGTC AAGGATTTGG AAAAACAGCA
 351 GAAGGCTTTG GCGGTACAAG AGCAGAAAAT CAACAATGAG CTTGCCCGTT
 401 TGAAGAAAAT TCAGGCAAAC GTGCAATCTC TGCTGAAAAA ACAGGGTGTA
 451 ACCGATGCGG CGGAACAGAC GGAAAGCCGC AGACAGAATG CCAAAATCGC
 501 CAAAGATGCC CGAAAACTGC TGGAACAGAA AGGGAACGAG CAGCAGCTGA
 551 ACAAGCTCTT GAGCAATTTG GAGAAGAAAA AGGCCGAACA CCGCATTCAG
 601 GATGCGGAAG CAAAAAGAAA ATTGGCTGAA GCCAGACTGG CGGCAGCCGA
 651 AAAAGCCAGA AAAGAAGCGG CGCAGCAGAA GGCTGAAGCA CGACGTGCGG
 701 AAATGTCCAA CCTGACCGCC GAAGACAGGA ACATCCAAGC GCCTTCGGTT
 751 ATGGGTATCG GCAGTGCCGA CGGTTTCAGC CGCATGCAAG GACGTTTGAA
 801 AAAACCGGTT GACGGTGTGC CGACCGGACT TTTCGGGCAG AACCGGAGCG
 851 GCGGCGATAT TTGGAAAGGC GTGTTCTATT CCACTGCACC GGCAACGGTT
 901 GAAAGCATTG CGCCGGGAAC GGTAAGCTAT GCGGACGAGT TGGACGGCTA
 951 CGGCAAAGTG GTCGTGGTCG ATCACGGCGA GAACTACATC AGCATCTATG
1001 CCGGTTTGAG CGAAATTTCC GTCGGCAAGG GTTATATGGT CGCGGCAGGA
1051 AGCAAAATCG GCTCGAGCGG GTCGCTGCCG GACGGGGAAG AGGGGCTTTA
1101 CCTGCAAATA CGTTATCAAG GTCAGGTATT GAACCCTTCG AGCTGGATAC
1151 GTTGA
```

This corresponds to the amino acid sequence <SEQ ID 1880; ORF 597>:

m597.pep

```
  1 MLLHVSNSLK QLQEERIRQE RIRQARGNLA SVNRKQREAW DKFQKLNTEL
 51 NRLRTEVAAT KAQISRFVSG NYKNSQPNAV ALFLKNAEPG QKNRFLRYTR
101 YVNASNREVV KDLEKQQKAL AVQEQKINNE LARLKKIQAN VQSLLKKQGV
151 TDAAEQTESR RQNAKIAKDA RKLLEQKGNE QQLNKLLSNL EKKKAEHRIQ
201 DAEAKRKLAE ARLAAAEKAR KEAAQQKAEA RRAEMSNLTA EDRNIQAPSV
251 MGIGSADGFS RMQGRLKKPV DGVPTGLFGQ NRSGGDIWKG VFYSTAPATV
301 ESIAPGTVSY ADELDGYGKV VVVDHGENYI SIYAGLSEIS VGKGYMVAAG
351 SKIGSSGSLP DGEEGLYLQI RYQGQVLNPS SWIR*
```

Computer analysis of this amino acid sequence gave the following results:

Homology with a predicted ORF from *N. gonorrhoeae*

ORF 597 shows 96.1% identity over a 389 aa overlap with a predicted ORF (ORF 597) from *N. gonorrhoeae:* m597/g597 96.1% identity in 389 aa overlap

```
                10        20        30        40        50        60
g597.pep  MLLHVSNSLKQLQEERIRQERIRQERIRQARGNLASVNRKQREAWDKFQKLNTELNRLKT
          ||||||||||||||||||||||||     ||||||||||||||||||||||||||||||
m597      MLLHVSNSLKQLQEERIRQERIRQ-----ARGNLASVNRKQREAWDKFQKLNTELNRLKT
                10        20             30        40        50

                70        80        90       100       110       120
g597.pep  EVAATKAQISRFVSGNYKNSRPNAVALFLKNAEPGQKNRFLRYTRYVNASNREVVKDLEK
          |||||||||||||||||||:||||||||||||||||||||||||||||||||||||||||
m597      EVAATKAQISRFVSGNYKNSQPNAVALFLKNAEPGQKNRFLRYTRYVNASNREVVKDLEK
            60        70        80        90       100       110

               130       140       150       160       170       180
g597.pep  QQKALAVQEQKINNELARLKKIQANVQSLLKKQGVTDAAEQTESRRQNAKISKDARKLLE
          ||||||||||||||||||||||||||||||||||||||||||||||||||||:|||||||
m597      QQKALAVQEQKINNELARLKKIQANVQSLLKKQGVTDAAEQTESRRQNAKIAKDARKLLE
           120       130       140       150       160       170

               190       200       210       220       230       240
g597.pep  QKGNEQQLNKLLSNLEKKKAEHRIQDAEAKRKLAEAKLAAAEKARKEAAQQKAEARRAEM
          |||||||||||||||||||||||||||||||||||||:||||||||||||||||||||||
m597      QKGNEQQLNKLLSNLEKKKAEHRIQDAEAKRKLAEARLAAAEKARKEAAQQKAEARRAEM
           180       190       200       210       220       230

               250       260       270       280       290       300
g597.pep  SNLTAEDRNIQAPSVMGIGSADGFSRMQGRLKKPVDGVPTGLFGQNRSGGDVWKGVFYST
          |||||||||||||||||||||||||||||||||||||||||||||||||||:||||||||
m597      SNLTAEDRNIQAPSVMGIGSADGFSRMQGRLKKPVDGVPTGLFGQNRSGGDIWKGVFYST
           240       250       260       270       280       290

               310       320       330       340       350       360
g597.pep  APATVESIAPGTVSYADELDGYGKVVVIDHGENYISIYAGLSEISAGKGYTVAAGSKIGT
          ||||||||||||||||||||||||||:||||||||||||||||:|||| ||||||||:
m597      APATVESIAPGTVSYADELDGYGKVVVVDHGENYISIYAGLSEISVGKGYMVAAGSKIGS
           300       310       320       330       340       350

               370       380       390
g597.pep  SGSLPDGEEGLYLQIRYRGQVLNPSGWIRX
          ||||||||||||||||:|||||||:||||
m597      SGSLPDGEEGLYLQIRYQGQVLNPSSWIRX
           360       370       380
```

The following partial DNA sequence was identified in *N. meningitidis* <SEQ ID 1881>

<u>a597.seq</u>

```
  1 ATGCTGCTTC ATGTCAGCAA TTCCCTCAAG CAGCTTCAGG AAGAGCGTAT
 51 CCGCCAAGAA CGTATCCGCC AAGAGCGTAT CCGTCAGGCG CGCGGCAACC
101 TTGCTTCCGT CAACCGCAAA CAGCGCGAGG CTTGGGACAA GTTCCAAAAA
151 CTCAATACCG AGCTGAACCG TTTGAAAACG GAAGTCGCCG CTACGAAAGC
201 GCAGATTTCC CGTTTCGTAT CGGGGAACTA TAAAAACAGC CAGCCGAATG
251 CGGTTGCCCT GTTCCTGAAA AACGCCGAAC CGGGTCAGAA AAACCGCTTT
301 TTGCGTTATA CGCGTTATGT AAACGCCTCC AATCGGGAAG TTGTCAAGGA
251 TTTGGAAAAA CAGCAGAAGG CTTTGGCGGT ACAAGAGCAG AAAATCAACA
401 ATGAGCTTGC CCGTTTGAAG AAAATTCAGG CAAACGTGCA ATCCCTGCTG
451 AAAAAACAGG GTGTAACCGA TGCGGCGGAA CAGACGGAAA GCCGCAGACA
501 GAATGCCAAA ATCGCCAAAG ATGCCCGAAA ACTGCTGGAA CAGAAAGGGA
551 ACGAGCAGCA GCTGAACAAG CTCTTGAGCA ATTTGGAGAA GAAAAAGGCC
601 GAACACCGCA TTCAGGATGC GGAAGCAAAA AGAAAATTGG CTGAAGCCAG
651 ACTGGCGGCA GCCGAAAAAG CCAGAAAAGA AGCGGCGCAG CAGAAGGCTG
701 AAGCACGACG TGCGGAAATG TCCAACCTGA CCGCCGAAGA CAGGAACATC
751 CAAGCGCCTT CGGTTATGGG TATCGGCAGT GCCGACGGTT TCAGCCGCAT
801 GCAAGGACGT TTGAAAAAAC CGGTTGACGG TGTGCCGACC GGACTTTTCG
851 GGCAGAACCG GAGCGGCGGC GATGTTTGGA AAGGCGTGTT CTATTCCACT
```

-continued

```
 901 GCACCGGCAA CGGTTGAAAG CATTGCGCCG GGAACGGTAA GCTATGCGGA

 951 CGAGTTGGAC GGCTACGGCA AAGTGGTCGT GGTCGATCAC GGCGAGAACT

1001 ACATCAGCAT CTATGCCGGT TTGAGCGAAA TTTCCGTCGG CAAGGGTTAT

1051 ATGGTCGCGG CAGGAAGCAA AATCGGCTCG AGCGGGTCGC TGCCGGACGG

1101 GGAAGAGGGG CTTTACCTGC AAATACGTTA TCAAGGTCAG GTATTGAACC

1151 CTTCGAGCTG GATACGTTGA
```

This corresponds to the amino acid sequence <SEQ ID 1882; ORF 597.a>:

a597.pep

```
  1 MLLHVSNSLK QLQEERIRQE RIRQERIRQA RGNLASVNRK QREAWDKFQK

 51 LNTELNRLKT EVAATKAQIS RFVSGNYKNS QPNAVALFLK NAEPGQKNRF

101 LRYTRYVNAS NREVVKDLEK QQKALAVQEQ KINNELARLK KIQANVQSLL

151 KKQGVTDAAE QTESRRQNAK IAKDARKLLE QKGNEQQLNK LLSNLEKKKA

201 EHRIQDAEAK RKLAEARLAA AEKARKEAAQ QKAEARRAEM SNLTAEDRNI

251 QAPSVMGIGS ADGFSRMQGR LKKPVDGVPT GLFGQNRSGG DVWKGVFYST

301 APATVESIAP GTVSYADELD GYGKVVVVDH GENYISIYAG LSEISVGKGY

351 MVAAGSKIGS SGSLPDGEEG LYLQIRYQGQ VLNPSSWIR*
```

Computer analysis of this amino acid sequence gave the following results:

Homology with a predicted ORF from *N. meningitidis*

ORF 597 shows 98.5% identity over a 389 aa overlap with a predicted ORF (ORF 597) from *N. meningitidis* m597/a597 98.5% identity in 389 aa overlap

```
                    10        20        30        40        50        60
a597.pep    MLLHVSNSLKQLQEERIRQERIRQERIRQARGNLASVNRKQREAWDKFQKLNTELNRLKT
            ||||||||||||||||||||||||     |||||||||||||||||||||||||||||||
m597        MLLHVSNSLKQLQEERIRQERIRQ-----ARGNLASVNRKQREAWDKFQKLNTELNRLKT
                    10        20             30        40        50

                    70        80        90       100       110       120
a597.pep    EVAATKAQISRFVSGNYKNSQPNAVALFLKNAEPGQKNRFLRYTRYVNASNREVVKDLEK
            ||||||||||||||||||||||||||||||||||||||||||||||||||||||||||||
m597        EVAATKAQISRFVSGNYKNSQPNAVALFLKNAEPGQKNRFLRYTRYVNASNREVVKDLEK
              60        70        80        90       100       110

                   130       140       150       160       170       180
a597.pep    QQKALAVQEQKINNELARLKKIQANVQSLLKKQGVTDAAEQTESRRQNAKIAKDARKLLE
            ||||||||||||||||||||||||||||||||||||||||||||||||||||||||||||
m597        QQKALAVQEQKINNELARLKKIQANVQSLLKKQGVTDAAEQTESRRQNAKIAKDARKLLE
             120       130       140       150       160       170

                   190       200       210       220       230       240
a597.pep    QKGNEQQLNKLLSNLEKKKAEHRIQDAEAKRKLAEARLAAAEKARKEAAQQKAEARRAEM
            ||||||||||||||||||||||||||||||||||||||||||||||||||||||||||||
m597        QKGNEQQLNKLLSNLEKKKAEHRIQDAEAKRKLAEARLAAAEKARKEAAQQKAEARRAEM
             180       190       200       210       220       230

                   250       260       270       280       290       300
a597.pep    SNLTAEDRNIQAPSVMGIGSADGFSRMQGRLKKPVDGVPTGLFGQNRSGGDVWKGVFYST
            |||||||||||||||||||||||||||||||||||||||||||||||||||:||||||||
m597        SNLTAEDRNIQAPSVMGIGSADGFSRMQGRLKKPVDGVPTGLFGQNRSGGDIWKGVFYST
             240       250       260       270       280       290

                   310       320       330       340       350       360
a597.pep    APATVESIAPGTVSYADELDGYGKVVVVDHGENYISIYAGLSEISVGKGYMVAAGSKIGS
            ||||||||||||||||||||||||||||||||||||||||||||||||||||||||||||
m597        APATVESIAPGTVSYADELDGYGKVVVVDHGENYISIYAGLSEISVGKGYMVAAGSKIGS
             300       310       320       330       340       350
```

-continued

```
              370        380        390
a597.pep  SGSLPDGEEGLYLQIRYQGQVLNPSSWIRX
          ||||||||||||||||||||||||||||||
m597      SGSLPDGEEGLYLQIRYQGQVLNPSSWIRX
            360        370        380
```

The following partial DNA sequence was identified in *N. gonorrhoeae* <SEQ ID 1883>:

g601.seq

```
  1 ATGTTCCCAA CCGGCAATTT GGTCGACGAA ATTGATGTGC CGAATATAGG
 51 TCGTCTGAAA GCCACGCTCA TCAACGCGGG CATTCCGACC GTTTTCCTGA
101 ACGCCGCCGA CTTGGGCTAC ACGGGCAAAG AGTTGCAGGA CGACATCAAC
151 AACGATGCCG CCGCGCTGGA AAAATTTGAA ACCATCCGCG CATATGGCGC
201 GCTGAAAATG GGTTTGATCA GCGACGTATC CGAAGCCGCC GCCCGCGCGC
251 GCACGCCGAA ACCCGCCTTC GTCGCGCCCG CCGCCGATTA CACCGCCTCC
301 AGCGGCAAAA CCGTAAACGC CGCCGACATC GATTTGCCGG TACGCGCCCT
351 GAGCATGGGC AAACTGCACC ACGCTATGAT GGGCATCGCC TCGGTCGCCA
401 TCGCCGCCGC CGTGCTCGGT ACGCTGGTCA ACCTTGCCGC AGGCGGCGGA
451 ACGCGTAAAG AAGTGCGCTT CGGGCATCCG TCAGGTACGC TGCGTGTCGG
501 TGCTGCCGCC GAATGTCAGG ACGGACAATG GACGGCCGCc aaagcggtca
551 tgaGCCGCAG CGCACgcgtg attatggaaa gttgGGTGCg cgttcccgat
601 gattGTTTTT GA
```

This corresponds to the amino acid sequence <SEQ ID 1884; ORF 601.ng>:

g601.pep

```
  1 MFPTGNLVDE IDVPNIGRLK ATLINAGIPT VFLNAADLGY TGKELQDDIN
 51 NDAAALEKFE TIRAYGALKM GLISDVSEAA ARARTPKPAF VAPAADYTAS
101 SGKTVNAADI DLPVRALSMG KLHHAMMGIA SVAIAAAVLG TLVNLAAGGG
151 TRKEVRFGHP SGTLRVGAAA ECQDGQWTAA KAVMSRSARV IMESWVRVPD
201 DCF*
```

The following partial DNA sequence was identified in *N. meningitidis* <SEQ ID 1885>:

m601.seq

```
  1 ATGTTCCCAA CCGGCAATTT GGTCGATGAA ATTGATGTGC CGAATATAGG
 51 CCGTTTGAAA GCCACGCTCA TCAACGCGGG CATTCCGACC GTTTTCTTGA
101 ATGCCGCCGA CTTGGGCTAC ACAGGCAAAG AGTTGCAAGA CGACATCAAC
151 AACGATGCCG CGGCTTTGGA AAAATTCGAG AAAATCCGCG CTTACGGTGC
201 GCTGAAAATG GGTCTGATCA GCGACGTATC CGAAGCTGCC GCTCGCGCGC
251 ACACGCCGAA AGTCGCCTTC GTCGCGCCCG CCGCCGATTA CACCGCCTCC
```

-continued

```
301 AGTGGCAAAA CCGTGAACGC CGCCGACATC GATTTGCTGG TACGCGCCCT

351 GAGCATGGGC AAACTGCACC ACGCGATGAT GGGTACCGCC TCTGTTGCCA

401 TTGCGACCGC CGCCGCCGTA CCCGGTACGC TGGTCAACCT TGCCGCAGGC

451 GGCGGAACGC GTAAAGAAGT GCGCTTCGGG CATCCTTCCG GCACATTGCG

501 CGTCGGTGCA GCCGCCGAAT GTCAGGACGG ACAATGGACG GCCACCAAAG

551 CGGTCATGAG CCGTAGCGCA CGCGTGATGA TGGAAGGTTG GGTCAGGGTG

601 CCTGAGGATT GTTTTTAA
```

This corresponds to the amino acid sequence <SEQ ID 1886: ORF 601>:

m601.pep

```
  1 MFPTGNLVDE IDVPNIGRLK ATLINAGIPT VFLNAADLGY TGKELQDDIN

 51 NDAAALEKFE KIRAYGALKM GLISDVSEAA ARAHTPKVAF VAPAADYTAS

101 SGKTVNAADI DLLVRALSMG KLHHAMMGTA SVAIATAAAV PGTLVNLAAG

151 GGTRKEVRFG HPSGTLRVGA AAECQDGQWT ATKAVMSRSA RVMMEGWVRV

201 PEDCF*
```

Computer analysis of this amino acid sequence gave the following results:

Homology with a predicted ORF from *N. gonorrhoeae*

ORF 601 shows 94.1% identity over a 205 aa overlap with a predicted ORF (ORF 601.ng) from *N. gonorrhoeae*:

m601/g601

```
                   10        20        30        40        50        60
m601.pep   MFPTGNLVDEIDVPNIGRLKATLINAGIPTVFLNAADLGYTGKELQDDINNDAAALEKFE
           ||||||||||||||||||||||||||||||||||||||||||||||||||||||||||||
g601       MFPTGNLVDEIDVPNIGRLKATLINAGIPTVFLNAADLGYTGKELQDDINNDAAALEKFE
                   10        20        30        40        50        60

                   70        80        90       100       110       120
m601.pep   KIRAYGALKMGLISDVSEAAARAHTPKVAFVAPAADYTASSGKTVNAADIDLLVRALSMG
            ||||||||||||||||||||||:||| |||||||||||||||||||||||| |||||||
g601       TIRAYGALKMGLISDVSEAAARARTPKPAFVAPAADYTASSGKTVNAADIDLPVRALSMG
                   70        80        90       100       110       120

                  130       140       150       160       170       180
m601.pep   KLHHAMMGTASVAIATAAAVPGTLVNLAAGGGTRKEVRFGHPSGTLRVGAAAECQDGQWT
           |||||||| |||||  |||| |||||||||||||||||||||||||||||||||||||||
g601       KLHHAMMGIASVAI--AAAVLGTLVNLAAGGGTRKEVRFGHPSGTLRVGAAAECQDGQWT
                  130         140       150       160       170

                  190       200
m601.pep   ATKAVMSRSARVMMEGWVRVPEDCFX
           |:||||||||||:||:|||||:||||
g601       AAKAVMSRSARVIMESWVRVPDDCFX
         180       190       200
```

The following partial DNA sequence was identified in *N. meningitidis* <SEQ ID 1887>:

a601.seq

```
  1 ATGTTCCCAA CCGGCAATTT GGTCGATGAA ATTGATGTGC CGAATATAGG

 51 CCGTTTGAAA GCCACGCTCA TCAACGCGGG CATTCCGACC GTTTTCCTGA
```

-continued

```
101 ATGCCGCCGA CTTGGGCTAC ACGCGCAAAG AGTTGCAAGA CGACATCAAC

151 AACGATGCCG CAGCTTTGGA AAAATTCGAG AAAATCCGCG CTTACGGTGC

201 GCTGAAAATG GGTCTGATCA GCGACGTATC CGAAGCTGCC GCCCGCGCGC

251 ACACGCCGAA AGTCGCCTTC GTCGCGCCCG CCGCCGATTA CACCGCCTCC

301 AGTGGCAAAA CCGTGAATGC CGCCGACATC GATTTGCTGG TACGCGCCCT

351 GAGCATGGGC AAATTGCACC ACGCGATGAT GGGTACCGCC TCTGTTGCCA

401 TTGCGACCGC CGCCGCCGTG CCCGGTACGC TGGTCAACCT TGCCGCAGGC

451 GGCGGAACGC GTAAAGAAGT GCGCTTCGGG CATCCTTCCG GCACATTGCG

501 CGTCGGTGCA GCCGCCGAAT GTCAGGACGG ACAATGGACG GCCACCAAAG

551 CGGTTATGAG CCGCAGCGCA CGCGTGATGA TGGAAGGTTG GGTCAGGGTG

601 CCGGAAGATT GTTTTTAA
```

This corresponds to the amino acid sequence <SEQ ID 1888; ORF 601.a>:

a601.pep

```
  1 MFPTGNLVDE IDVPNIGRLK ATLINAGIPT VFLNAADLGY TGKELQDDIN

 51 NDAAALEKFE KIRAYGALKM GLISDVSEAA ARAHTPKVAF VAPAADYTAS

101 SGKTVNAADI DLLVRALSMG KLHHAMMGTA SVAIATAAAV PGTLVNLAAG

151 GGTRKEVRFG HPSGTLRVGA AAECQDGQWT ATKAVMSRSA RVMMEGWVRV

201 PEDCF*
```

m601/a601 100.0% identity in 205 aa overlap

```
                   10        20        30        40        50        60
m601.pep    MFPTGNLVDEIDVPNIGRLKATLINAGIPTVFLNAADLGYTGKELQDDINNDAAALEKFE
            ||||||||||||||||||||||||||||||||||||||||||||||||||||||||||||
a601        MFPTGNLVDEIDVPNIGRLKATLINAGIPTVFLNAADLGYTGKELQDDINNDAAALEKFE
                   10        20        30        40        50        60
                   70        80        90       100       110       120
m601.pep    KIRAYGALKMGLISDVSEAAARAHTPKVAFVAPAADYTASSGKTVNAADIDLLVRALSMG
            ||||||||||||||||||||||||||||||||||||||||||||||||||||||||||||
a601        KIRAYGALKMGLISDVSEAAARAHTPKVAFVAPAADYTASSGKTVNAADIDLLVRALSMG
                   70        80        90       100       110       120
                  130       140       150       160       170       180
m601.pep    KLHHAMMGTASVAIATAAAVPGTLVNLAAGGGTRKEVRFGHPSGTLRVGAAAECQDGQWT
            ||||||||||||||||||||||||||||||||||||||||||||||||||||||||||||
a601        KLHHAMMGTASVAIATAAAVPGTLVNLAAGGGTRKEVRFGHPSGTLRVGAAAECQDGQWT
                  130       140       150       160       170       180
                  190       200
m601.pep    ATKAVMSRSARVMMEGWVRVPEDCFX
            ||||||||||||||||||||||||||
a601        ATKAVMSRSARVMMEGWVRVPEDCFX
                  190       200
```

The following partial DNA sequence was identified in *N. gonorrhoeae* <SEQ ID 1889>:

g602.seq

```
  1 ATGTTGCTCC ATCAATGCGA CAAAGCGCGA CATATGCGTC CCTTTCTGCT

 51 CGGCGGGCAG ATAAACCGTC ATCGTCAGGC GAGCAACCGT GGATTGTCTT
```

-continued

```
101 CCTTCGGCGG TTTTCAGGGT AATCGGGAAG CGCAGGTCTT TAATGCCGAC

151 CTGATTGATC GGCAGGTTGC GCAAATCTCT GCTGGATTGC ACGTCTGCAA

201 TGGCGTTCAT GCGTTGTTTG TCCTTAATAT TCAGATAATT ATTGAGATGT

251 GTGTATTGTA TGGCAGGcag atgccgtctg aAAAAacgct gtcggCCGCC

301 TGCCTGCAAA TgcgagattA TATCACTTGC TTTtggcgGC TGCATTGA
```

This corresponds to the amino acid sequence <SEQ ID 1890; ORF 602.ng>:

g602.pep

```
  1 MLLHQCDKAR HMRPFLLGGQ INRHRQASNR GLCSFGGFQG NREAQVFNAD

 51 LIDRQVAQIS AGLHVCNGVH ALFVLNIQII IEMCVLYGRQ MPSEKTLSAA

101 CLQMRDYITC FWRLH*
```

The following partial DNA sequence was identified in *N. meningitidis* <SEQ ID 1891>:

m602.seq

```
  1 ATGTTGCTCC ATCAATGCGA CAAAACGCGA CATATGCGTC CCCTTCTGCT

 51 CAGCAGGCAG GTAAACCGTC ATGGTCAGAC GGGCAATGGT GGACTGGATG

101 CCTTCTGCAG TTTGCAGGGT AATCGGAAAG CGCAGGTCTT TGATACCGAC

151 CTGATTGATC GGCAGATTGC GCAAATCTCG GCTGGATTGC ACGTCTGCAA

201 TAGTGTTCAT GAGTTGTTTT TCCTTAATAT TCATGTAATT GTTGAGATGT

251 GTGCATGGTA TGGCGTTTCC GCCGGGGAAT ATACCGTCAA TCTGCAAATG

301 CGAGATTATA TCACTCGCTT TTAGCAGCTG CATTGA
```

This corresponds to the amino acid sequence <SEQ ID 1892: ORF 602>:

m602.pep

```
  1 MLLHQCDKTR HMRPLLLSRQ VNRHGQTGNG GLDAFCSLQG NRKAQVFDTD

 51 LIDRQIAQIS AGLHVCNSVH ELFFLNIHVI VEMCAWYGVS AGEYTVNLQM

101 RDYITRF*QL H*
```

m602/g602 65.2% identity in 115 aa overlap

```
                       10        20        30        40        50        60
m602.pep       MLLHQCDKTRHMRPLLLSRQVNRHGQTGNGGLDAFCSLQGNRKAQVFDTDLIDRQIAQIS
               ||||||||:|||||:||: |:||| |::| || :| ::||||:||||::||||||:||||
g602           MLLHQCDKARHMRPFLLGGQINRHRQASNRGLCSFGGFQGNREAQVFNADLIDRQVAQIS
                       10        20        30        40        50        60

                       70        80        90           100       110
m602.pep       AGLHVCNSVHELFFLNIHVIVEMCAWYGVSA-GEYTVN---LQMRDYITRFXQLHX
               |||||||:|| || |||::|:|||: || :  :| |::   |||||||| | :|||
g602           AGLHVCNGVHALFVLNIQIIIEMCVLYGRQMPSEKTLSAACLQMRDYITCFWRLHX
                       70        80        90       100       110
```

The following partial DNA sequence was identified in *N. meningitidis* <SEQ ID 1893>:

a602.seq

```
  1 ATGTTGCTCC ATCAATGCGA CAAAGCGCGA CATATGCGTA CCCTTCTGCT
 51 CGGCAGGCAG GTAAACCGTC ATGGTCAGAC GGGCAACTGT GGACTGGATG
101 CCTTCTGCAG TTTGCAGGGT AATCGGAAAG CGCAGGTCTT TGATACCGAC
151 CTGATTGATC GGCAGATTGC GCAAATCTCG GCTGGATTGC ACGTCTGCAA
201 TAGTGTTCAT GAGTTGTTTT TCCTTAATAT TCATGTAATT GTTGAGATGT
251 GTGCATGGTA TGGCGTTTCC ACCGGGGAAT ATACCGTCAA TCTGCAAATG
301 CGAGATTATA TCACTCGCTT TTAGCAGCTG CATTGA
```

This corresponds to the amino acid sequence <SEQ ID 1894; ORF 602.a>:

a602.pep

```
  1 MLLHQCDKAR HMRTLLLGRQ VNRHGQTGNC GLDAFCSLQG NRKAQVFDTD
 51 LIDRQIAQIS AGLHVCNSVH ELFFLNIHVI VEMCAWYGVS TGEYTVNLQM
101 RDYITRF*QL H*
```

m602/a602 95.5% identity in 111 aa overlap

```
                   10        20        30        40        50        60
m602.pep   MLLHQCDKTRHMRPLLLSRQVNRHGQTGNGGLDAFCSLQGNRKAQVFDTDLIDRQIAQIS
           ||||||||:|||| |||:||||||||||| ||||||||||||||||||||||||||||||
a602       MLLHQCDKARHMRTLLLGRQVNRHGQTGNCGLDAFCSLQGNRKAQVFDTDLIDRQIAQIS
                   10        20        30        40        50        60

                   70        80        90       100       110
m602.pep   AGLHVCNSVHELFFLNIHVIVEMCAWYGVSAGEYTVNLQMRDYITRFXQLHX
           ||||||||||||||||||||||||||||||:|||||||||||||||||||||
a602       AGLHVCNSVHELFFLNIHVIVEMCAWYGVSTGEYTVNLQMRDYITRFXQLHX
                   70        80        90       100       110
```

The following partial DNA sequence was identified in *N. gonorrhoeae* <SEQ ID 1895>:

g603.seq

```
  1 ATGGATTCCC GCCTGCGTGG GAATGACGCT AGGAAATACG GCATACGCTT
 51 TGCCCAAAGA GGCCGTCTGA AACACACTCC GCCCAACGCC CATCCTTTTT
101 CAGACGGCCC CGCACCAAAA AAACAACCAC AAACTACAAG GAGAAACATC
151 ATGTCCGACC AACTCATTCT TGTCCTGAAC TGCGTCAGTT CATCGCTCAA
201 AGGCGCCGTT ATCGACCGCA AAAGCGGCAG CGTCGTCCTA AGCTGCCTCG
251 GGGAACGCCT GACTACGCCC GAAGCCGTCA TTACCTTCAA CAAAGACGGC
301 AACAAACGCC AAGTTCCCCT GAGCGGCCGC AACTGCCACG CCGGCGCGGT
351 GGGTATGCTG TTGAACGAAC TGGAAAAACA CGGACTGCAC GACCGCATCA
401 AAGCCATCGG CCGCCGCATC GCCCACGGCG GCGAAAAATA TCACGAGTCC
451 GTCCTCATCG ACCAAGACGT CCTTGACGAA CTGAAAGCCT GCATCCCGTT
501 CGCCCCGCTG CACAACCCCG CCAACATCAG CGGCATCCTC GCCGCGCAGG
```

-continued

```
 551 AACACTTTCC CGGCCTGCCC AACGTCGGCG TGATGGACAC CTCGTTCCAC
 601 CAAACCATGC CGGAGCGGGC CTACACTTAT GCCGTGCCGC GCGAATTGCG
 651 CAAAAAATAC GCCTTCCGCC GCTACGGTTT CCACGGTACC GGTATGCGTT
 701 ACGTCGCCCC TGAAGCCGCA CGCATCTTGG GCAAACCTct ggaaGACATC
 751 CGCATGATTA TTGCCCACTT AGGCAACGGC GCATCTATTA CCGCCGTCAA
 801 AAACGGCAAA TCCGTCGATA CCGGTATGGG TTTCACGCCG ATCGAAGGTT
 851 TGGTAATGGG TACACGTTGC GGCGACACCG ATCCGGGCGT ATACAGCTAT
 901 CCGACTTTCC ACGCAGGGAT GGATGTTGCC CAAGTTGATG AAATGCTGAA
 951 CGAAAAATCA GGTTTCCCCG GTATTTCcgA actTCCCAAC GACTGCCGCA
1001 CCCTCGAAAT CGCCGCCGAC GAAGGCCGCG AAGGCGCGCG CCTCGCCCTc
1051 gaAGTCATGA CCTGCCGCCT CGCCAAATAC ATCGCTTCGA TGGCTGTGGC
1101 CTGCGGCAGT GTTGACGCAC TCGTGTTCAC CGGCGGTATC GGCGAAAACT
1151 CGCGTAATAT CCGTGCCAAA ACCGTTTCCT ATCTTGATTT CTTGGGTCTG
1201 CACATCGACA CCAAAGCCAA TATGGAAAAA CGCTACGGCA ATTCGGGCAT
1251 TATCAGCCCG ACCGATTCTT CTCCGGCTGT TTTGGTCGTC CCGACCAATG
1301 AAGAACTGAT GATTGCCTGC GACACTGCCG AACTTGCCGG CATCTTGTAG
```

This corresponds to the amino acid sequence <SEQ ID 1896; ORF 603.ng>:

g603.pep

```
  1 MDSRLRGNDA RKYGIRFAQR GRLKHTPPNA HPFSDGPAPK KQPQTTRRNI
 51 MSDQLILVLN CVSSSLKGAV IDRKSGSVVL SCLGERLTTP EAVITFNKDG
101 NKRQVPLSGR NCHAGAVGML LNELEKNGLH DRIKAIGRRI AHGGEKYHES
151 VLIDQDVLDE LKACIPFAPL HNPANISGIL AAQEHFPGLP NVGVMDTSFH
201 QTMPERAYTY AVPRELRKKY AFRRYGFHGT GMRYVAPEAA RILGKPLEDI
251 RMIIAHLGNG ASITAVKNGK SVDTGMGFTP IEGLVMGTRC GDTDPGVYSY
301 PTFHAGMDVA QVDEMLNEKS GFPGISELPN DCRTLEIAAD EGREGARLAL
351 EVMTCRLAKY IASMAVACGS VDALVFTGGI GENSRNIRAK TVSYLDFLGL
401 HIDTKANMEK RYGNSGIISP TDSSPAVLVV PTNEELMIAC DTAELAGIL*
```

The following partial DNA sequence was identified in *N. meningitidis* <SEQ ID 1897>:

m603.seq

```
  1 CTGTCCTCGC GTAGGCGGGG ACGGAATAAC GATAGAAAAT GCGGCATACG
 51 CTTTGCCCAA AGAGGCCGTC TGAAACACCT TGCGCCTGAT GTCTGC.CTT
101 TTTCAGACGA CCCCACACTA AAAAAACAAC CACAAACTAC AAGGAGAAAC
151 ATCATGTCCG ACCAACTCAT CCTCGTTCTG AACTGCGGCA GTTCATCGCT
201 CAAAGGCGCC GTTATCGACC GAmAAAGCGG CAGCGTCGTC CTAAGCTGCC
251 TCGGCGAACG cCtGACCACG CCCGAAGCCG TCATTACGTT CAACAAAGAC
```

-continued

```
 301 GGCAACAAAC GCCAAGTTCC CCTGAGCGGC CGAAATTGCC ACGCCGGCGC
 351 GGTGGGTATG CTTTTGAACG AACTGGAAAA ACACGGTCTG CACGACCGCA
 401 TCAAAGCCAT CGGCCACCGC ATCGCCCACG GCGGCGAAAA ATACAGCGAG
 451 TCTGTTTTGA TCGACCAGGC CGTAATGGAC GAACTCAATG CCTGCATTCC
 501 GCTTGCGCCG CTGCACAACC CCGCCAACAT CAGCGGCATC CTTGCCGCAC
 551 AGGAACATTT CCCCGGTCTG CCCAATGTCG GCGTGATGGA TACTTCGTTC
 601 CACCAAACCA TGCCGGAGCG TGCCTACACT TATGCCGTGC CGCGCGAGTT
 651 GCGTAAAAAA TACGCTTTCC GCCGCTACGG TTTCCACGGC ACCAGTATGC
 701 GTTACGTTGC CCCTGAAGCC GCACGCATCT TGGGCAAACC TCTGGAAGAC
 751 ATCCGCATGA TTATTGCCCA CTTAGGCAAC GGCGCATCCA TTACCGCCAT
 801 CAAAAACGGC AAATCCGTCG ATACCAGTAT GGGTTTCACG CCGATCGAAG
 851 GTTTGGTAAT GGGTACACGT TGCGGCGACA TCGATCCGGG CGTATACAGC
 901 TATCTGACTT CCCACGCCGG GATGGATGTT GCCCAAGTGG ATGAAATGCT
 951 GAACAAAAAA TCAGGTTTGC TCGGTATTTC CGAACTTTCC AACGACTGCC
1001 GCACCCTCGA AATCGCCGCC GACGAAGGCC ACGAAGGCGC GCGCCTCGCC
1051 CTCGAAGTCA TGACCTACCG CCTCGCCAAA TACATCGCTT CGATGGCTGT
1101 GGGCTGCGGC GGCGTTGACG CACTCGTGTT CACCGGCGGT ATCGGCGAAA
1151 ACTCGCGTAA TATCCGTGCC AAAACCGTTT CCTATCTTGA TTTCTTGGGT
1201 CTGCACATCG ACACCAAAGC CAATATGGAA AAACGCTACG GCAATTCGGG
1251 CATTATCAGC CCGACCGATT CTTCTCCGGC TGTTTTGGTT GTCCCGACCA
1301 ATGAAGAACT GATGATTGCC TGCGACACTG CCGAACTTGC CGGCATCTTG
1351 TAG
```

This corresponds to the amino acid sequence <SEQ ID 1898; ORF 603>:

<u>m603.pep</u>

```
  1 LSSRRRGRNN DRKCGIRFAQ RGRLKHLAPD VCXFSDDPTL KKQPQTTRRN
 51 IMSDQLILVL NCGSSSLKGA VIDRXSGSVV LSCLGERLTT PEAVITFNKD
101 GNKRQVPLSG RNCHAGAVGM LLNELEKHGL HDRIKAIGHR IAHGGEKYSE
151 SVLIDQAVMD ELNACIPLAP LHNPANISGI LAAQEHFPGL PNVGVMDTSF
201 HQTMPERAYT YAVPRELRKK YAFRRYGFHG TSMRYVAPEA ARILGKPLED
251 IRMIIAHLGN GASITAIKNG KSVDTSMGFT PIEGLVMGTR CGDIDPGVYS
301 YLTSHAGMDV AQVDEMLNKK SGLLGISELS NDCRTLEIAA DEGHEGARLQA
351 LEVMTYRLAK YIASMAVGCG GVDALVFTGG IGENSRNIRA KTVSYLDFLG
401 LHIDTKANME KRYGNSGIIS PTDSSPAVLV VPTNEELMIA CDTAELAGIL
451 *
```

Computer analysis of this amino acid sequence gave the following results:

Homology with a predicted ORF from *N. gonorrhoeae*

ORF 603 shows 91.6% identity over a 450 aa overlap with a predicted ORF (ORF 603.ng) from *N. gonorrhoeae*:

m603/g603

```
                   10        20        30        40        50        60
m603.pep   LSSRRRGRNNDRKCGIRFAQRGRLKHLAPDVCXFSDDPTLKKQPQTTRRNIMSDQLILVL
           ::|| || |: || ||||||||||||  |::  ||| |: ||||||||||||||||||||
g603       MDSRLRG-NDARKYGIRFAQRGRLKHTPPNAHPFSDGPAPKKQPQTTRRNIMSDQLILVL
                    10        20        30        40        50

                   70        80        90       100       110       120
m603.pep   NCGSSSLKGAVIDRXSGSVVLSCLGERLTTPEAVITFNKDGNKRQVPLSGRNCHAGAVGM
           || ||||||||||| |||||||||||||||||||||||||||||||||||||||||||||
g603       NCVSSSLKGAVIDRKSGSVVLSCLGERLTTPEAVITFNKDGNKRQVPLSGRNCHAGAVGM
          60        70        80        90       100       110

                  130       140       150       160       170       180
m603.pep   LLNELEKHGLHDRIKAIGHRIAHGGEKYSESVLIDQAVMDELNACIPLAPLHNPANISGI
           ||||||||||||||||||:||||||||| ||||||| |:|||:||||:||||||||||||
g603       LLNELEKHGLHDRIKAIGRRIAHGGEKYHESVLIDQDVLDELKACIPFAPLHNPANISGI
         120       130       140       150       160       170

                  190       200       210       220       230       240
m603.pep   LAAQEHFPGLPNVGVMDTSFHQTMPERAYTYAVPRELRKKYAFRRYGFHGTSMRYVAPEA
           |||||||||||||||||||||||||||||||||||||||||||||||||||:||||||||
g603       LAAQEHFPGLPNVGVMDTSFHQTMPERAYTYAVPRELRKKYAFRRYGFHGTGMRYVAPEA
         180       190       200       210       220       230

                  250       260       270       280       290       300
m603.pep   ARILGKPLEDIRMIIAHLGNGASITAIKNGKSVDTSMGFTPIEGLVMGTRCGDIDPGVYS
           ||||||||||||||||||||||||||:||||||||:||||||||||||||||| ||||||
g603       ARILGKPLEDIRMIIAHLGNGASITAVKNGKSVDTGMGFTPIEGLVMGTRCGDTDPGVYS
         240       250       260       270       280       290

                  310       320       330       340       350       360
m603.pep   YLTSHAGMDVAQVDEMLNKKSGLLGISELSNDCRTLEIAADEGHEGARLALEVMTYRLAK
           | | ||||||||||||||:|||: ||||| |||||||||||||:||||||||||| ||||
g603       YPTFHAGMDVAQVDEMLNEKSGFPGISELPNDCRTLEIAADEGREGARLALEVMTCRLAK
         300       310       320       330       340       350

                  370       380       390       400       410       420
m603.pep   YIASMAVGCGGVDALVFTGGIGENSRNIRAKTVSYLDFLGLHIDTKANMEKRYGNSGIIS
           |||||||:||:|||||||||||||||||||||||||||||||||||||||||||||||||
g603       YIASMAVACGSVDALVFTGGIGENSRNIRAKTVSYLDFLGLHIDTKANMEKRYGNSGIIS
         360       370       380       390       400       410

                  430       440       450
m603.pep   PTDSSPAVLVVPTNEELMIACDTAELAGILX
           |||||||||||||||||||||||||||||||
g603       PTDSSPAVLVVPTNEELMIACDTAELAGILX
         420       430       440       450
```

The following partial DNA sequence was identified in *N. meningitidis* <SEQ ID 1899>:

a603.seq

```
  1 CTGTCCTCGC GTAGGCGGGG ACGGAATAAC GATAGAAAAT GCGGCATACG
 51 CTTTGCCCAA AGAGGCCGTC TGAAACACAC TCCGCCCAAC GCCCATCCTT
101 TTTCAGACGA CCCCACACC. AAAAAACAAC CACAAACTAC AAGGAGAAAC
151 ATCATGTCCG ACCAACTCAT TCTTGTTCTG AACTGCGGCA GTTCATCGCT
201 CAAAGGTGCC GTTATCGACC GCAAAAGCGG CAGCGTCGTC CTAAGCTGCC
251 TCGGCGAACG CCTGACCACG CCCGAAGCCG TCATTACGTT CAGCAAAGAC
301 GGCAACAAAC GCCAAGTTCC CCTGAGCGGC CGGAACTGCC ACGCCGGCGC
351 GGTGGGTATG CTGTTGAACG AACTGGAAAA ACACGAACTG CACGACCGCA
401 TTCAAGCCGT CGGCCACCGC ATCGCCCACG GCGGCGAAAA ATACAGCGAG
451 TCTGTTTTGA TCGACCAGGC CGTAATGGAC GAACTCAATG CCTGCATTCC
501 GCTTGCGCCG CTGCACAACC CCGCGAACAT CAGCGGCATC CTCGCCGCAC
551 AGGAACATTT CCCCGGTCTG CCCAATGTCG GCGTGATGGA TACTTCGTTC
601 CACCAAACCA TGCCGGAGCG TGCCTACACT TATGCCGTGC CGCGCGAGTT
651 GCGTAAAAAA TACGCTTTCC GCCGCTACGG TTTCCACGGC ACCAGTATGC
701 GTTACGTTGC CCCTGAAGCC GCATGCATCT TGGGCAAACC TCTGGAAGAC
```

-continued

```
 751 ATCCGCATGA TTATTGCCCA CTTAGGCAAC GGCGCATCCA TTACCGCCAT

 801 CAAAAACGGC AAATCCGTCG ATACCAGTAT GGGTTTCACG CCGATCGAAG

 851 GTTTGGTAAT GGGTACGCGC TGCGGCGATA TCGACCCGGG CGTATACAGC

 901 TATCTGACTT CACACGCCGG TTTGGATGTT GCACAAGTTG ATGAAATGCT

 951 GAATAAAAAA TCAGGCTTGC TCGGTATTTC CGAACTCTCC AACGACTGCC

1001 GCACCCTCGA AATCGCCGCC GACGAAGGCC ACGAAGGCGC GCGCCTCGCC

1051 CTCGAAGTTA TGACCTACCG CCTCGCCAAA TACATCGCTT CGATGGCTGT

1101 GGGCTGCGGC GGCGTTGACG CACTCGTGTT CACCGGCGGT ATCGGCGAAA

1151 ACTCGCGTAA TATCCGTGCC AAAACCGTTT CCTATCTTGA TTTCTTGGGT

1201 CTGCACATCG ACACCAAAGC CAATATGGAA AAACGCTACG GCAATTCGGG

1251 TATTATCAGC CCGACCGATT CTTCTCCGGC TGTTTTGGTT GTCCCGACCA

1301 ATGAAGAACT GATGATTGCC TGCGACACTG CCGAACTTGT CGGCATCTTG

1351 TAG
```

This corresponds to the amino acid sequence <SEQ ID 1900; ORF 603.a>:

a603.pep

```
  1 LSSRRRGRNN DRKCGIRFAQ RGRLKHTPPN AHPFSDDPTX KKQPQTTRRN

 51 IMSDQLILVL NCGSSSLKGA VIDRKSGSVV LSCLGERLTT PEAVITFSKD

101 GNKRQVPLSG RNCHAGAVGM LLNELEKHEL HDRIQAVGHR IAHGGEKYSE

151 SVLIDQAVMD ELNACIPLAP LHNPANISGI LAAQEHFPGL PNVGVMDTSF

202 HQTMPERAYT YAVPRELRKK YAFRRYGFHG TSMRYVAPEA ACILGKPLED

251 IRMIIAHLGN GASITAIKNG KSVDTSMGFT PIEGLVMGTR CGDIDPGVYS

301 YLTSHAGLDV AQVDEMLNKK SGLLGISELS NDCRTLEIAA DEGHEGARLA

351 LEVMTYRLAK YIASMAVGCG GVDALVFTGG IGENSRNIRA KTVSYLDFLG

401 LHIDTKANME KRYGNSGIIS PTDSSPAVLV VPTNEELMIA CDTAELVGIL

451 *
```

m603/a603 96.7% identity in 450 aa overlap

```
                  10        20        30        40        50        60
m603.pep  LSSRRRGRNNDRKCGIRFAQRGRLKHLAPDVCXFSDDPTLKKQPQTTRRNIMSDQLILVL
          ||||||||||||||||||||||||||  |::  |||||| ||||||||||||||||||||
a603      LSSRRRGRNNDRKCGIRFAQRGRLKHTPPNAHPFSDDPTXKKQPQTTRRNIMSDQLILVL
                  10        20        30        40        50        60

                  70        80        90       100       110       120
m603.pep  NCGSSSLKGAVIDRXSGSVVLSCLGERLTTPEAVITFNKDGNKRQVPLSGRNCHAGAVGM
          |||||||||||||| ||||||||||||||||||||||:||||||||||||||||||||||
a603      NCGSSSLKGAVIDRKSGSVVLSCLGERLTTPEAVITFSKDGNKRQVPLSGRNCHAGAVGM
                  70        80        90       100       110       120

                 130       140       150       160       170       180
m603.pep  LLNELEKHGLHDRIKAIGHRIAHGGEKYSESVLIDQAVMDELNACIPLAPLHNPANISGI
          |||||||| |||||:|:||||||||||||||||||||||||||||||||||||||||||||
a603      LLNELEKHELHDRIQAVGHRIAHGGEKYSESVLIDQAVMDELNACIPLAPLHNPANISGI
                 130       140       150       160       170       180

                 190       200       210       220       230       240
m603.pep  LAAQEHFPGLPNVGVMDTSFHQTMPERAYTYAVPRELRKKYAFRRYGFHGTSMRYVAPEA
          ||||||||||||||||||||||||||||||||||||||||||||||||||||||||||||
a603      LAAQEHFPGLPNVGVMDTSFHQTMPERAYTYAVPRELRKKYAFRRYGFHGTSMRYVAPEA
                 190       200       210       220       230       240
```

-continued

```
                250       260       270       280       290       300
m603.pep   ARILGKPLEDIRMIIAHLGNGASITAIKNGKSVDTSMGFTPIECLVMGTRCGDIDPGVYS
           | |||||||||||||||||||||||||||||||||||||||||||||||||||||||||||
a603       ACILGKPLEDIRMIIAHLGNGASITAIKNGKSVDTSMGFTPIECLVMGTRCGDIDPGVYS
                250       260       270       280       290       300

                310       320       330       340       350       360
m603.pep   YLTSHAGMDVAQVDEMLNKKSGLLGISELSNDCRTLEIAADEGHEGARLALEVMTYRLAK
           |||||||:||||||||||||||||||||||||||||||||||||||||||||||||||||
a603       YLTSHAGLDVAQVDEMLNKKSGLLGISELSNDCRTLEIAADEGHEGARLALEVMTYRLAK
                310       320       330       340       350       360

                370       380       390       400       410       420
m603.pep   YIASMAVGCGGVDALVFTGGIGENSRNIRAKTVSYLDFLGLHIDTKANMEKRYGNSGIIS
           ||||||||||||||||||||||||||||||||||||||||||||||||||||||||||||
a603       YIASMAVGCGGVDALVFTGGIGENSRNIRAKTVSYLDFLGLHIDTKANMEKRYGNSGIIS
                370       380       390       400       410       420

                430       440       450
m603.pep   PTDSSPAVLVVPTNEELMIACDTAELAGILX
           |||||||||||||||||||||||||:||||
a603       PTDSSPAVLVVPTNEELMIACDTAELVGILX
                430       440       450
```

The following partial DNA sequence was identified in *N. gonorrhoeae* <SEQ ID 1901>:

g604.seq

```
  1 ATGCCCGAAG CGCACTTCTT TACGCGTTCC GCCGCCTGCG GCAAGGTTGA

 51 CCAGCGTACC GAGCACGGCG GCGGCGATGG CGACCGAGGC GATGCCCATC

101 ATAGCGTGGT GCAGTTTGCC CATGCTCAGG GCGCGTACCG GCAAATCGAT

151 GTCGGCGGCG TTTACGGTTT TGCCGCTGGA GGCGGTGTAA TCGGCGGCGG

201 GCGCGACGAA GGCGGGTTTC GGCGTGCGCG CGCGGGCGGC GGCTTCGGAT

251 ACGTCGCTGA TCAAACCCAT TTTCAGCGCG CCATATGCGC GGATGGTTTC

301 AAATTTTTCC AGCGCGGCGG CATCGTTGTT GATGTCGTCC TGCAACTCTT

351 TGCCCGTGTA GCCCAAGTCG GCGGCGTTCA GGAAAACGGT CGGAATGCCC

401 GCGTTGATGA GCGTGGCTTT CAGACGACCT ATATTCGGCA CATCAATTTC

451 GTCGACCAAA TTGCCGGTTG GGAACATACT GCCTTcgcCG TCGGCTGGAT

501 CTAA
```

This corresponds to the amino acid sequence <SEQ ID 1902; ORF 604.ng>:

g604.pep

```
  1 MPEAHFFTRS AACGKVDQRT EHGGGDGDRG DAHHSVVQFA HAQGAYRQID

 51 VGGVYGFAAG GGVIGGGRDE GGFRRARAGG GFGYVADQTH FQRAICADGF

101 KFFQRGGIVV DVVLQLFARV AQVGGVQENG RNARVDERGF QTTYIRHINF

151 VDQIAGWEHT AFAVGWI*
```

The following partial DNA sequence was identified in *N. meningitidis* <SEQ ID 1903>:

m604.seq

```
  1 ATGCCCGAAG CGCACTTCTT TACGCGTTCC GCCGCCTGCG GCAAGGTTGA

 51 CCAGCGTACC GGGTACGGCG GCGGCGGTCG CAATGGCAAC AGAGGCGGTA
```

-continued

```
101 CCCATCATCG CGTGGTGCAG TTTGCCCATG CTCAGGGCGC GTACCAGCAA

151 ATCGATGTCG GCGGCGTTCA CGGTTTTGCC ACTGGAGGCG GTGTAATCGG

201 CGGCGGGCGC GACGAAGGCG ACTTTCGGCG TGTGCGCGCG AGCGGCAGCT

251 TCGGATACGT CGCTGATCAG ACCCATTTTC AGCGCACCGT AAGCGCGGAT

301 TTTCTCGAAT TTTTCCAAAG CCGCGGCATC GTTGTTGATG TCGTCTTGCA

351 ACTCTTTGCC TGTGTAGCCC AAGTCGGCGG CATTCAAGAA AACGGTCGGA

401 ATGCCCGCGT TGATGAGCGT GGCTTTCAAA CGGCCTATAT TCGGCACATC

451 AATTTCATCG ACCAAATTGC CGGTTGGGAA CATACTGCCT TCGCCGTCGG

501 CTGGATC
```

This corresponds to the amino acid sequence <SEQ ID 1904; ORF 604>:

m604.pep

```
  1 MPEAHFFTRS AACGKVDQRT GYGGGGRNGN RGGTHHRVVQ FAHAQGAYQQ

 51 IDVGGVHGFA TGGGVIGGGR DEGDFRRVRA SGSFGYVADQ THFQRTVSAD

101 FLEFFQSRGI VVDVVLQLFA CVAQVGGIQE NGRNARVDER GFQTAYIRHI

151 NFIDQIAGWE HTAFAVGWI
```

Computer analysis of this amino acid sequence gave the following results:

Homology with a predicted ORF from *N. gonorrhoeae*

ORF 604 shows 83.4% identity over a 169 aa overlap with a predicted ORF (ORF 604.ng) from *N. gonorrhoeae*:

m604/g604

```
                   10        20        30        40        50        60
m604.pep   MPEAHFFTRSAACGKVDQRTGYGGGGRNGNRGGTHHRVVQFAHAQGAYQQIDVGGVHGFA
           |||||||||||||||||||| :|||  :|:|| :|| ||||||||||:|||||||:|||
g604       MPEAHFFTRSAACGKVDQRTEHGGG--DGDRGDAHHSVVQFAHAQGAYRQIDVGGVYGFA
                   10        20          30        40        50

                   70        80        90       100       110       120
m604.pep   TGGGVIGGGRDEGDFRRVRASGSFGYVADQTHFQRTVSADFLEFFQSRGIVVDVVLQLFA
           :||||||||||| |||:||:|:||||||||||||:: || ::|||  ||||||||||||
g604       AGGGVIGGGRDEGGFRRARAGGGFGYVADQTHFQRAICADGFKFFQRGGIVVDVVLQLFA
           60        70        80        90       100       110

                  130       140       150       160      169
m604.pep   CVAQVGGIQENGRNARVDERGFQTAYIRHINFIDQIAGWEHTAFAVGWI
            |||||:||||||||||||||||||:||||||:||||||||||||||||
g604       RVAQVGGVQENGRNARVDERGFQTTYIRHINFVDQIAGWEHTAFAVGWIX
         120       130       140       150       160
```

The following partial DNA sequence was identified in *N. meningitidis* <SEQ ID 1905>:

a604.seq

```
  1 ATGCCCGAAG CGCACTTCTT TACGCGTTCC GCCGCCTGCG GCAAGGTTGA

 51 CCAGCGTACC GGGCACGGCG GCGGCGGTCG CAATGGCAAC AGAGGCGGTA

101 CCCATCATCG CGTGGTGCAA TTTGCCCATG CTCAGGGCGC GTACCAGCAA

151 ATCGATGTCG GCGGCATTCA CGGTTTTGCC ACTGGAGGCG GTGTAATCGG
```

-continued

```
201 CGGCGGGCGC GACGAAGGCG ACTTTCGGCG TGTGCGCGCG GGCGGCAGCT

251 TCGGATACGT CGCTGATCAG ACCCATTTTC AGCGCACCGT AAGCGCGGAT

301 TTTCTCGAAT TTTTCCAAAG CTGCGGCATC GTTGTTGATG TCGTCTTGCA

351 ACTCTTTGCC CGTGTAGCCC AAGTCGGCGG CATTCAGGAA AACGGTCGGA

401 ATGCCCGCGT TGATGAGCGT GGCTTTCAAA CGGCCTATAT TCGGCACATC

451 AATTTCATCG ACCAAATTGC CGGTTGGGAA CATACTGCCT TCGCCGTCGG

501 CTGGATCAAG AAATTCGATT TGTACTTCGG CTGCCGGGAA CGTTACGCCG

551 TCGAGCTCAA AATCGCCTGT TTCCAAAACT GCGCCGTTTT GCATCGGTAC

601 ATGGGCAATA ATGGTTTTGC CGATGTTTTT CTGCCAGATT TTGACTGTGC

651 AGATGCCGTC TGA
```

This corresponds to the amino acid sequence <SEQ ID 1906; ORF 604.a>:

a604.pep

```
  1 MPEAHFFTRS AACGKVDQRT GHGGGGRNGN RGGTHHRVVQ FAHAQGAYQQ

 51 IDVGGIHGFA TGGGVIGGGR DEGDFRRVRA GGSFGYVADQ THFQRTVSAD

101 FLEFFQSCGI VVDVVLQLFA RVAQVGGIQE NGRNARVDER GFQTAYIRHI

151 NFIDQIAGWE HTAFAVGWIK KFDLYFGCRE RYAVELKIAC FQNCAVLHRY

201 MGNNGFADVF LPDFDCADAV *
```

m604/a604 97.0% identity in 169 aa overlap

```
                    10        20        30        40        50        60
m604.pep    MPEAHFFTRSAACGKVDQRTGYGGGGRNGNRGGTHHRVVQFAHAQGAYQQIDVGGVHGFA
            |||||||||||||||||||||:|||||||||||||||||||||||||||||||||:||||
a604        MPEAHFFTRSAACGKVDQRTGHGGGGRNGNRGGTHHRVVQFAHAQGAYQQIDVGGIHGFA
                    10        20        30        40        50        60

                    70        80        90       100       110       120
m604.pep    TGGGVIGGGRDEGDFRRVRASGSFGYVADQTHFQRTVSADFLEFFQSRGIVVDVVLQLFA
            ||||||||||||||||||||:|||||||||||||||||||||||||| ||||||||||||
a604        TGGGVIGGGRDEGDFRRVRAGGSFGYVADQTHFQRTVSADFLEFFQSCGIVVDVVLQLFA
                    70        80        90       100       110       120

                   130       140       150       160      169
m604.pep    CVAQVGGIQENGRNARVDERGFQTAYIRHINFIDQIAGWEHTAFAVGWI
             ||||||||||||||||||||||||||||||||||||||||||||||||
a604        RVAQVGGIQENGRNARVDERGFQTAYIRHINFIDQIAGWEHTAFAVGWIKKFDLYFGCRE
                   130       140       150       160       170       180

a604        RYAVELKIACFQNCAVLHRYMGNNGFADVFLPDFDCADAVX
                   190       200       210       220
```

The following partial DNA sequence was identified in *N. gonorrhoeae* <SEQ ID 1907>:

g605.seq

```
  1 ATGATGACCG AAATGCAACA ACGCGCCCAA CTGCACCGCC AAATTTGGAA

 51 AATCGCCGAC GAAGTACGCG GCGCGGTGGA TGGCTGGGAC TTTAAACAAT

101 ACGTTCTCGG CACACTTTTC TACCGCTTTA TCAGCGAAAA CTTCACCGAC

151 TATATGCAGG CCGGCGACAG CAGCATTGAT TACGCCGCta tGCCGGACAG
```

-continued

```
 201 CATCATCACG CCCGAAATCA AAGACGATgc cgtcaaagtc aaAGGCTATT
 251 TCATCtacCc cgGCCAGCTT TTTTgcaata ttgccgccga agcCCATCAA
 301 AACGAAGAGC TCAACACCAA GCTGAAAGAa atCTTTACCG CGATTGAAAG
 351 CTCCGCCTCC GGCTAcccgT CCGAACAAGG CATCAAAGGC TTGTTTGACG
 401 ACTTCgACAC CACCAGCAGC CGGCTCGGCA GCACCGTTGC CGACAAAAAC
 451 AAACGCCTTG CCGCCGTCCT TAAAGGCGTG GCGGAACTCG ATTTCGGCAA
 501 TTTTGAAGAC CACCGCATCG ACCTTTTCGG TGATGCCTAC GAATACCTGA
 551 TTTCCAACTA CGCcgcCAAC GCAGGCAAAT CCGGCGGCGA ATTTTTCACC
 601 CCGCAAAGCG TCTCCAAGCT GATTGCGCGG CTGGCGGTGC ACGGGCAGGA
 651 GAAAGTCAAC AAAATCTACG ACCCCGCCTG CGGCTCGGGC AGCCTGCTCT
 701 TGCAGGCGAA AAAACAGTTT GACGAACACA TCATCGAAGA AGGCTTCTTC
 751 GGGCAGGAAA TCAACCACAC CACCTACAAC CTCGCCCGCA TGAATATGTT
 801 TCTGCACAAC GTCAATTACA ACAAATTCCA CATCGAATTG GGCGACACGC
 851 TGACCAACCC CAAACTCAAA GACAGCAAAC CCTTTGATGC CGTCGTCTCC
 901 AATCCGCCCT ATTCCATCGA CTGGATAGGC AGCGACGACC CCACCTtgaT
 951 CAACGACGAC CGCTTTGCCC CCGCAGGCGT ACTCGCACCG AAATCCAAAG
1001 CCGATTTTGC CTTCATCCTG CACGCACTGA ACTACCTTTC CGGCAGAGGC
1051 CGCGCCGCTA TCGTCTCATT CCCCGGCATT TTCTATCGCG GCGGCGCAGA
1101 GCAGAAAATc CGCCAATATC TGGTGGAGGG CAACTATGTG GAAACCGTGA
1151 TTGCCCTTGC GCCCAATCTC TTTTACGGCA CCTGCATCGC CGTCAATATC
1201 CTGGTTTTGT CCAAACACAA AGACAATACC GACATCCAAT TCATCGACGC
1251 AAGCGGCTTC TTTAAAAAAG AAACCAACAA CAACGTCTTA ACCGAAGAAC
1301 ACATTGCCGA AATCGTCAAA CTCTTCGCCG ACAAAGCCGA TGTGCCGCAT
1351 ATCGCCCAAA ACGCCGCCCA GCAAACCGTC AAAGACAACG GCTACAACCT
1401 CGCCGTCAGC AGCTATGTCG AAGCCGAAGA CACCCGCGAG GTCATCGACA
1451 TCAGACAGCT CAACGCCGAA ATCAGCGAAA CCgtcgCcaa AATCGAACGG
1501 CTGCGGCGTG AAATTGACGA AGTGATTGCA GAGATTGAAA CCTAG
```

This corresponds to the amino acid sequence <SEQ ID 1908; ORF 605.ng>:

g605.pep

```
  1 MMTEMQQRAQ LHRQIWKIAD EVRGAVDGWD FKQYVLGTLF YRFISENFTD
 51 YMQAGDSSID YAAMPDSIIT PEIKDDAVKV KGYFIYPGQL FCNIAAEAHQ
101 NEELNTKLKE IFTAIESSAS GYPSEQGIKG LFDDFDTTSS RLGSTVADKN
151 KRLAAVLKGV AELDFGNFED HRIDLFGDAY EYLISNYAAN AGKSGGEFFT
201 PQSVSKLIAR LAVHGQEKVN KIYDPACGSG SLLLQAKKQF DEHIIEEGFF
251 GQEINHTTYN LARMNMFLHN VNYNKFHIEL GDTLTNPKLK DSKPFDAVVS
301 NPPYSIDWIG SDDPTLINDD RFAPAGVLAP KSKADFAFIL HALNYLSGRG
351 RAAIVSFPGI FYRGGAEQKI RQYLVEGNYV ETVIALAPNL FYGTCIAVNI
401 LVLSKHKDNT DIQFIDASGF FKKETNNNVL TEEHIAEIVK LFADKADVPH
```

-continued

```
451 IAQNAAQQTV KDNGYNLAVS SYVEAEDTRE VIDIRQLNAE ISETVAKIER

501 LRREIDEVIA EIET*
```

The following partial DNA sequence was identified in *N. meningitidis* <SEQ ID 1909>:

m605.seq

```
   1 ATGATGACCG AAATGCAACA ACGCGCCCAA CTGCACCGCC AAATTTGGAA
  51 AATTGCCGAC GAAGTACGCG GCGCGGTGGA TGGCTGGGAC TTTAAACAAT
 101 ACGTTCTCGG CACACTTTTC TACCGCTTTA TCAGCGAAAA CTTCACCGAC
 151 TATATGCAGG CAGGCGACAG CAGTATTGAT TACGCCGCTA TGCCGGACAG
 201 CATCATCACG CCCGAAATCA AAGACGATGC CGTCAAAGTT AAAGGCTATT
 251 TCATCTACCC CGGCCAGCTT TTTTGCAATA TTGCCGCCGA AGCCCATCAA
 301 AACGAAGAGC TCAACACCAA GCTGAAAGAA ATTTTTACCG CGATTGAAAG
 351 CTCCGCCTCC GGCTATCCGT CCGAACAGGA CATCAAAGGC CTGTTTGACG
 401 ACTTCGACAC CACCAGCAGC CGGCTCGGCA GCACTGTTGC CGACAAGAAC
 451 AAACGCCTTG CCGCCGTCCT CAAAGGCGTG GCGGAACTCG ATTTCGGCAA
 501 TTTTGAAAAC CACCACATCG ACCTTTTCGG CGATGCCTAC GAATACCTGA
 551 TTTCCAACTA CGCTGCCAAC GCAGGCAAAT CCGGCGGCGA ATTTTTCACC
 601 CCGCAAAGCG TATCCAAGCT GATTGCGCGG CTGGCGGTGC ACGGACAGGA
 651 GAAAGTCAAC AAAATCTACG ACCCAGCTTG CGGCTCGGGC AGTCTGCTCT
 701 TGCAGGCGAA AAAACAGTTT GACGAGCACA TCATCGAAGA AGGCTTCTTC
 751 GGGCAGGAAA TCAACCACAC CACCTACAAC CTCGCCCGCA TGAACATGTT
 801 CCTGCACAAC GTCAATTACA ACCAATTCCA CATCGAATTG GGCGACACAC
 851 TGACCAACCC AAAGCTCAAA GACAGCAAAC CCTTTGATGC CATCGTTTCC
 901 AATCCGCCTT ATTCCATCAA CTGGATAGGC AGCGACGACC CCACCTTAAT
 951 CAACGACGAC CGCTTTGCCC CCGCAGGCGT ACTTGCCCCG AAATCCAAAG
1001 CCGATTTTGC CTTCATCCTG CACGCACTGA ACTACCTTTC CGGCAGAGGC
1051 CGCGCCGCCA TCGTCTCATT CCCCGGCATT TTCTATCGCG GCGGCGCAGA
1101 ACAGAAAATC CGCCAATATC TGGTGGAGGG CAACTACGTG GAAACCGTGA
1151 TTGCCCTTGC GCCCAATCTC TTTTACGGCA CCGGCATCGC CGTCAATATC
1201 CTGGTTTTGT CCAAACACAA AGACAATACC GACATCCAAT TCATCGACGC
1251 AAGCGGCTTC TTTAAAAAAG AAACCAACAA CAACGTCTTA ATCGAAGAAC
1301 ACATTGCTGA AATCGTCAAA CTCTTCGCCG ATAAAGCCGA TGTGCCGCAT
1351 ATCGCCCAAA ACGCTGCCCA GCAAACCGTC AAAGACAACG GCTACAACCT
1401 CGCCGTCAGC AGCTATGTCG AAGCCGAAGA CACACGCGAA ATTATCGACA
1451 TCAAACAGCT CAACGCCGAA ATCGGCGAAA CCGTCGCCAA AATCGAACGG
1501 CTGCGGCGTG AAATTGACGA AGTGATTGCA GAGATTGAAG CATGA
```

This corresponds to the amino acid sequence <SEQ ID 1910; ORF 605>:

m605.pep

```
  1 MMTEMQQRAQ LHRQIWKIAD EVRGAVDGWD FKQYVLGTLF YRFISENFTD
 51 YMQAGDSSID YAAMPDSIIT PEIKDDAVKV KGYFIYPGQL FCNIAAEAHQ
101 NEELNTKLKE IFTAIESSAS GYPSEQDIKG LFDDFDTTSS RLGSTVADKN
151 KRLAAVLKGV AELDFGNFEN HHIDLFGDAY EYLISNYAAN AGKSGGEFFT
201 PQSVSKLIAR LAVHGQEKVN KIYDPACGSG SLLLQAKKQF DEHIIEEGFF
251 GQEINHTTYN LARMNMFLHN VNYNQFHIEL GDTLTNPKLK DSKPFDAIVS
301 NPPYSINWIG SDDPTLINDD RFAPAGVLAP KSKADFAFIL HALNYLSGRG
351 RAAIVSFPGI FYRGGAEQKI RQYLVEGNYV ETVIALAPNL FYGTGIAVNI
401 LVLSKHKDNT DIQFIDASGF FKKETNNNVL IEEHIAEIVK LFADKADVPH
451 IAQNAAQQTV KDNGYNLAVS SYVEAEDTRE IIDIKQLNAE IGETVAKIER
501 LRREIDEVIA EIEA*
```

Computer analysis of this amino acid sequence gave the following results:

Homology with a predicted ORF from *N. gonorrhoeae*

ORF 605 shows 97.9% identity over a 513 aa overlap with a predicted ORF (ORF 605.ng) from *N. gonorrhoeae.* m605/g605

```
                   10        20        30        40        50        60
m605.pep   MMTEMQQRAQLHRQIWKIADEVRGAVDGWDFKQYVLGTLFYRFISENFTDYMQAGDSSID
           ||||||||||||||||||||||||||||||||||||||||||||||||||||||||||||
g605       MMTEMQQRAQLHRQIWKIADEVRGAVDGWDFKQYVLGTLFYRFISENFTDYMQAGDSSID
                   10        20        30        40        50        60

                   70        80        90       100       110       120
m605.pep   YAAMPDSIITPEIKDDAVKVKGYFIYPGQLFCNIAAEAHQNEELNTKLKEIFTAIESSAS
           ||||||||||||||||||||||||||||||||||||||||||||||||||||||||||||
g605       YAAMPDSIITPEIKDDAVKVKGYFIYPGQLFCNIAAEAHQNEELNTKLKEIFTAIESSAS
                   70        80        90       100       110       120

                  130       140       150       160       170       180
m605.pep   GYPSEQDIKGLFDDFDTTSSRLGSTVADKNKRLAAVLKGVAELDFGNFENHHIDLFGDAY
           |||||| ||||||||||||||||||||||||||||||||||||||||||:|:||||||||
g605       GYPSEQGIKGLFDDFDTTSSRLGSTVADKNKRLAAVLKGVAELDFGNFEDHRIDLFGDAY
                  130       140       150       160       170       180

                  190       200       210       220       230       240
m605.pep   EYLISNYAANAGKSGGEFFTPQSVSKLIARLAVHGQEKVNKIYDPACGSGSLLLQAKKQF
           ||||||||||||||||||||||||||||||||||||||||||||||||||||||||||||
g605       EYLISNYAANAGKSGGEFFTPQSVSKLIARLAVHGQEKVNKIYDPACGSGSLLLQAKKQF
                  190       200       210       220       230       240

                  250       260       270       280       290       300
m605.pep   DEHIIEEGFFGQEINHTTYNLARMNMFLHNVNYNQFHIELGDTLTNPKLKDSKPFDAIVS
           ||||||||||||||||||||||||||||||||||:||||||||||||||||||||||:||
g605       DEHIIEEGFFGQEINHTTYNLARMNMFLHNVNYNKFHIELGDTLTNPKLKDSKPFDAVVS
                  250       260       270       280       290       300

                  310       320       330       340       350       360
m605.pep   NPPYSINWIGSDDPTLINDDRFAPAGVLAPKSKADFAFILHALNYLSGRGRAAIVSFPGI
           ||||||:|||||||||||||||||||||||||||||||||||||||||||||||||||||
g605       NPPYSIDWIGSDDPTLINDDRFAPAGVLAPKSKADFAFILHALNYLSGRGRAAIVSFPGI
                  310       320       330       340       350       360

                  370       380       390       400       410       420
m605.pep   FYRGGAEQKIRQYLVEGNYVETVIALAPNLFYGTGIAVNILVLSKHKDNTDIQFIDASGF
           |||||||||||||||||||||||||||||||||| |||||||||||||||||||||||||
g605       FYRGGAEQKIRQYLVEGNYVETVIALAPNLFYGTCIAVNILVLSKHKDNTDIQFIDASGF
                  370       380       390       400       410       420

                  430       440       450       460       470       480
m605.pep   FKKETNNNVLIEEHIAEIVKLFADKADVPHIAQNAAQQTVKDNGYNLAVSSYVEAEDTRE
           |||||||||| |||||||||||||||||||||||||||||||||||||||||||||||||
g605       FKKETNNNVLTEEHIAEIVKLFADKADVPHIAQNAAQQTVKDNGYNLAVSSYVEAEDTRE
                  430       440       450       460       470       480

                  490       500       510
m605.pep   IIDIKQLNAEIGETVAKIERLRREIDEVIAEIEAX
           :|||:||||||:|||||||||||||||||||||:
g605       VIDIRQLNAEISETVAKIERLRREIDEVIAEIETX
                  490       500       510
```

The following partial DNA sequence was identified in *N. meningitidis* <SEQ ID 1911>:

a605.seq

```
   1 ATGATGACCG AAATACAACA ACGCGCCCAA CTGCACCGCC AAATTTGGAA
  51 AATTGCCGAC GAAGTACGCG GCGCGGTGGA TGGCTGGGAC TTCAAACAAT
 101 ACGTTCTCGG CACACTTTTC TACCGCTTTA TCAGCGAAAA CTTTACCGAC
 151 TATATGCAGG CAGGCGACAG CAGTATTGAT TACGCCGCTA TGCCGGACAG
 201 CATCATCACG CCCGAAATCA AAGACGATGC CGTCAAAGTC AAAGGCTATT
 251 TCATCTACCC CGGCCAGCTT TTTTGCAATA TTGCCGCCGA AGCCCATCAA
 301 AACGAAGAGC TCAACACCAA GCTGAAAGAA ATTTTTACCG CGATTGAAAG
 351 CTCCGCCTCC GGCTATCCGT CCGAACAAGA CATTAAAGGC CTGTTTGACG
 401 ACTTCGACAC CACCAGCAGC CGGCTCGGCA GCACCGTTGC CGACAAGAAC
 451 AAACGCCTTG CCGCCGTCCT AAAAGGCGTG GCGGAACTCG ATTTCGGCAG
 501 TTTTGAAGAC CACCACATCG ACCTTTTCGG CGATGCCTAC GAATACCTGA
 551 TTTCCAACTA CGCTGCCAAC GCAGGCAAAT CCGGCGGCGA ATTTTTCACC
 601 CCGCAAAGCG TATCCAAGCT GATTGCGCGG CTGGCGGTGC ACGGGCAGGA
 651 GAAAGTAAAC AAAATCTACG ACCCAGCTTG CGGCTCGGGC AGCCTGCTCT
 701 TGCAGGCGAA AAAACAGTTT GACGAGCACA TCATCGAAGA AGGCTTCTTC
 751 GGGCAGGAAA TCAACCACAC CACCTACAAC CTCGCCCGCA TGAATATGTT
 801 TCTGCACAAC GTCAATTACA ACAAATTCCA CATCGAATTG GGCGACACAC
 851 TGACCAATCC CAAACTCAAA GACAGCAAAC CCTTTGATGC CGTCGTTTCC
 901 AATCCGCCCT ATTCCATCAA CTGGATAGGC AGCGGCGACC CCACCTTAAT
 951 CAACGACGAC CGCTTTGCCC CTGCAGGCGT ACTCGCCCCG AAATCCAAAG
1001 CCGATTTTGC CTTCATTCTG CACGCACTGA ACTACCTTTC CGGCAGAGGC
1051 CGCGCCGCCA TCGTCTCATT CCCCGGCATT TTCTATCGCG GCGGCGCAGA
1101 GCAGAAAATC CGCCAATATC TGGTGGAGGG CAACTACGTG GAAACCGTCA
1151 TCGCCCTTGC GCCCAATCTC TTTTACGGCA CCGGCATCGC CGTCAATATA
1201 CTGGTTTTGT CCAAACACAA AGACAATACC GACATCCAAT TCATCGACGC
1251 AGGCGGCTTC TTTAAAAAAG AAACCAACAA CAACGTCTTA ACCGAAGAAC
1301 ACATTGCCGA AATCGTCAAA CTCTTCGCCG ATAAAGCCGA TGTGCCGCAT
1351 ATCGCCCAAA ACGCCGCCCA GCAAACCGTC AAAGACAACG GCTACAACCT
1401 CGCCGTCAGC AGCTATGTTG AACCCGAAGA CACCCGCGAA ATTATCGACA
1451 TCAAACAGCT TAACGCCGAA ATCAGCGAAA CCGTTGCCAA AATCGAACGG
1501 CTGCGGCGTG AAATTGACGA AGTGATTGCA GAGATTGAAG CATGA
```

This corresponds to the amino acid sequence <SEQ ID 1912; ORF 605.a>:

a605.pep

```
 1 MMTEIQQRAQ LHRQIWKIAD EVRGAVDGWD FKQYVLGTLF YRFISENFTD
51 YMQAGDSSID YAAMPDSIIT PEIKDDAVKV KGYFIYPGQL FCNIAAEAHQ
```

-continued

```
101 NEELNTKLKE IFTAIESSAS GYPSEQDIKG LFDDFDTTSS RLGSTVADKN

151 KRLAAVLKGV AELDFGSFED HHIDLFGDAY EYLISNYAAN AGKSGGEFFT

201 PQSVSKLIAR LAVHGQEKVN KIYDPACGSG SLLLQAKKQF DEHIIEEGFF

251 GQEINHTTYN LARMNMFLHN VNYNKFHIEL GDTLTNPKLK DSKPFDAVVS

301 NPPYSINWIG SGDPTLINDD RFAPAGVLAP KSKADFAFIL HALNYLSGRG

351 RAAIVSFPGI FYRGGAEQKI RQYLVEGNYV ETVIALAPNL FYGTGIAVNI

401 LVLSKHKDNT DIQFIDAGGF FKKETNNNVL TEEHIAEIVK LFADKADVPH

451 IAQNAAQQTV KDNGYNLAVS SYVEPEDTRE IIDIKQLNAE ISETVAKIER

501 LRREIDEVIA EIEA*
```

m605/a605 98.1% identity in 514 aa overlap

```
                   10        20        30        40        50        60
m605.pep   MMTEMQQRAQLHRQIWKIADEVRGAVDGWDFKQYVLGTLFYRFISENFTDYMQAGDSSID
           ||||:|||||||||||||||||||||||||||||||||||||||||||||||||||||||
a605       MMTEIQQRAQLHRQIWKIADEVRGAVDGWDFKQYVLGTLFYRFISENFTDYMQAGDSSID
                   10        20        30        40        50        60

                   70        80        90       100       110       120
m605.pep   YAAMPDSIITPEIKDDAVKVKGYFIYPGQLFCNIAAEAHQNEELNTKLKEIFTAIESSAS
           ||||||||||||||||||||||||||||||||||||||||||||||||||||||||||||
a605       YAAMPDSIITPEIKDDAVKVKGYFIYPGQLFCNIAAEAHQNEELNTKLKEIFTAIESSAS
                   70        80        90       100       110       120

                  130       140       150       160       170       180
m605.pep   GYPSEQDIKGLFDDFDTTSSRLGSTVADKNKRLAAVLKGVAELDFGNFENHHIDLFGDAY
           ||||||||||||||||||||||||||||||||||||||||||||||:||:||||||||||
a605       GYPSEQDIKGLFDDFDTTSSRLGSTVADKNKRLAAVLKGVAELDFGSFEDHHIDLFGDAY
                  130       140       150       160       170       180

                  190       200       210       220       230       240
m605.pep   EYLISNYAANAGKSGGEFFTPQSVSKLIARLAVHGQEKVNKIYDPACGSGSLLLQAKKQF
           ||||||||||||||||||||||||||||||||||||||||||||||||||||||||||||
a605       EYLISNYAANAGKSGGEFFTPQSVSKLIARLAVHGQEKVNKIYDPACGSGSLLLQAKKQF
                  190       200       210       220       230       240

                  250       260       270       280       290       300
m605.pep   DEHIIEEGFFGQEINHTTYNLARMNMFLHNVNYNQFHIELGDTLTNPKLKDSKPFDAIVS
           ||||||||||||||||||||||||||||||||||:||||||||||||||||||||||:||
a605       DEHIIEEGFFGQEINHTTYNLARMNMFLHNVNYNKFHIELGDTLTNPKLKDSKPFDAVVS
                  250       260       270       280       290       300

                  310       320       330       340       350       360
m605.pep   NPPYSINWIGSDDPTLINDDRFAPAGVLAPKSKADFAFILHALNYLSGRGRAAIVSFPGI
           ||||||||||| ||||||||||||||||||||||||||||||||||||||||||||||||
a605       NPPYSINWIGSGDPTLINDDRFAPAGVLAPKSKADFAFILHALNYLSGRGRAAIVSFPGI
                  310       320       330       340       350       360

                  370       380       390       400       410       420
m605.pep   FYRGGAEQKIRQYLVEGNYVETVIALAPNLFYGTGIAVNILVLSKHKDNTDIQFIDASGF
           |||||||||||||||||||||||||||||||||||||||||||||||||||||||||:||
a605       FYRGGAEQKIRQYLVEGNYVETVIALAPNLFYGTGIAVNILVLSKHKDNTDIQFIDAGGF
                  370       380       390       400       410       420

                  430       440       450       460       470       480
m605.pep   FKKETNNNVLIEEHIAEIVKLFADKADVPHIAQNAAQQTVKDNGYNLAVSSYVEAEDTRE
           |||||||||| ||||||||||||||||||||||||||||||||||||||||||| |||||
a605       FKKETNNNVLTEEHIAEIVKLFADKADVPHIAQNAAQQTVKDNGYNLAVSSYVEPEDTRE
                  430       440       450       460       470       480

                  490       500       510
m605.pep   IIDIKQLNAEIGETVAKIERLRREIDEVIAEIEAX
           |||||||||||:|||||||||||||||||||||||
a605       IIDIKQLNAEISETVAKIERLRREIDEVIAEIEAX
                  490       500       510
```

The following partial DNA sequence was identified in *N. gonorrhoeae* <SEQ ID 1913>:

g606.seq

```
  1 ATGTCCAAAT TTATCGCCAA ACAATCGGTC GGTGCGGAAG TCATCGACAC

 51 GCCGcgCACC GAAGAAGAAG CCTGGCTTCT GAACACTGTC GAAGCCCAAg
```

-continued

```
101 cgcGGCAATG GAATCTGAAA ACGCCAGAAG TCGCCATCTA CCACTCCCCC
151 GAACCCAATG CCTTTGCCAC GGGCGCATCG AGAAACAGCT CCCTGATCGC
201 CGTCAGCacc ggtttgctcg accaTAtgaC GCGCGACgaa gtggaagccg
251 tgTTGGCGCA CGAAATGGCG CACGTCGGCA ACGGCGACAT GGTTACGCTG
301 ACGCTGAtTC AAGGCGTGGT CAATACCTTT GTCGTGTTCC TGTCGCGCAT
351 TATTGCCAAC CTGATTGCCC GAAACAACGA CGGCAGCCAG TCCCAGGGAA
401 CTTATTTCCT AGTCAGCATG GTATTCCAAA TCCTGTTCGG CTTCCTTGCC
451 AGCCTGATTG TCATGTGGTT CAGCCGCCAA CGCGAATACC GCGCCGAcgc
501 gggCGcggCA AAACTGGTCG GCGCACCGAA AATGATTTCC GCCCTGCAAA
551 GGCTTAAAGG CAACCCGGTC GATTTGCCCG AAGAAATGAA CGCAATGGGC
601 ATCGCCGGAG ATACGCGCGA CTCCCTGCTC AGCACCCACC CTTCGCTGGA
651 CAACCGAATC GCCCGCCTCA AATCGCTTTA A
```

This corresponds to the amino acid sequence <SEQ ID 1914; ORF606.ng>:

g606.pep

```
  1 MSKFIAKQSV GAEVIDTPRT EEEAWLLNTV EAQARQWNLK TPEVAIYHSP
 51 EPNAFATGAS RNSSLIAVST GLLDHMTRDE VEAVLAHEMA HVGNGDMVTL
101 TLIQGVVNTF VVFLSRIIAN LIARNNDGSQ SQGTYFLVSM VFQILFGFLA
151 SLIVMWFSRQ REYRADAGAA KLVGAPKMIS ALQRLKGNPV DLPEEMNAMG
201 IAGDTRDSLL STHPSLDNRI ARLKSL*
```

The following partial DNA sequence was identified in *N. meningitidis* <SEQ ID 1915>:

m606.seq

```
  1 ATGTCCAAAT TTATCGCCAA ACAATCGGTC GGCGCGGAAG TTATCGACAC
 51 GCCGCGCACC GAAGAAGAAG CCTGGCTTTT GAACACTGTC GAAGCCCAAG
101 CGCGGCAATG GAACCTGAAA ACGCCCGAAG TCGCCATCTA CCACTCCCCC
151 GAACCCAATG CCTTTGCCAC GGGCGCATCG AGAAACAGCT CCCTGATCGC
201 CGTCAGCACC GGTTTGCTCG ACCATATGAC GCGTGACGAA GTGGAAGCCG
251 TATTGGCGCA CGAAATGGCA CACGTCGGCA ACGGCGATAT GGTTACGCTG
301 ACGCTGATTC AAGGCGTGGT CAATACCTTT GTCGTGTTCC TGTCGCGCAT
351 TATTGCCAAC CTGATTGCCC GAAACAACGA CGGCAGCCAG TCCCAGGGAA
401 CTTATTTCCT GGTCAGCATG GTATTCCAAA TCCTGTTCGG CTTCCTTGCC
451 AGCTTAATTG TCATGTGGTT CAGCCGACAA CGCGAATACC GCGCCGATGC
501 GGGCGCGGCA AAACTGGTCG GCGCGCCGAA AATGATTTCC GCCCTGCAAA
551 GGCTCAAAGG CAACCCGGTC GATTTGCCCG AAGAAATGAA CGCAATGGGC
601 ATCGCCGGAG ATACGCGCGA CTCCCTGCTC AGCACCCACC CTTCGCTGGA
651 CAACCGTATC GCCCGCCTCA AATCGCTTTA A
```

This corresponds to the amino acid sequence <SEQ ID 1916; ORF 606>:

m606.pep

```
  1 MSKFIAKQSV GAEVIDTPRT EEEAWLLNTV EAQARQWNLK TPEVAIYHSP
 51 EPNAFATGAS RNSSLIAVST GLLDHMTRDE VEAVLAHEMA HVGNGDMVTL
101 TLIQGVVNTF VVFLSRIIAN LIARNNDGSQ SQGTYFLVSM VFQILFGFLA
151 SLIVMWFSRQ REYRADAGAA KLVGAPKMIS ALQRLKGNPV DLPEEMNAMG
201 IAGDTRDSLL STHPSLDNRI ARLKSL*
```

Computer analysis of this amino acid sequence gave the following results:

Homology with a predicted ORF from *N. gonorrhoeae*

ORF 606 shows 100.0% identity over a 225 aa overlap with a predicted ORF (ORF 606.ng) from *N. gonorrhoeae*:

m606/g606

```
                  10        20        30        40        50        60
m606.pep  MSKFIAKQSVGAEVIDTPRTEEEAWLLNTVEAQARQWNLKTPEVAIYHSPEPNAFATGAS
          ||||||||||||||||||||||||||||||||||||||||||||||||||||||||||||
g606      MSKFIAKQSVGAEVIDTPRTEEEAWLLNTVEAQARQWNLKTPEVAIYHSPEPNAFATGAS
                  10        20        30        40        50        60

                  70        80        90       100       110       120
m606.pep  RNSSLIAVSTGLLDHMTRDEVEAVLAHEMAHVGNGDMVTLTLIQGVVNTFVVFLSRIIAN
          ||||||||||||||||||||||||||||||||||||||||||||||||||||||||||||
g606      RNSSLIAVSTGLLDHMTRDEVEAVLAHEMAHVGNGDMVTLTLIQGVVNTFVVFLSRIIAN
                  70        80        90       100       110       120

                 130       140       150       160       170       180
m606.pep  LIARNNDGSQSQGTYFLVSMVFQILFGFLASLIVMWFSRQREYRADAGAAKLVGAPKMIS
          ||||||||||||||||||||||||||||||||||||||||||||||||||||||||||||
g606      LIARNNDGSQSQGTYFLVSMVFQILFGFLASLIVMWFSRQREYRADAGAAKLVGAPKMIS
                 130       140       150       160       170       180

                 190       200       210       220
m606.pep  ALQRLKGNPVDLPEEMNAMGIAGDTRDSLLSTHPSLDNRIARLKSLX
          |||||||||||||||||||||||||||||||||||||||||||||||
g606      ALQRLKGNPVDLPEEMNAMGIAGDTRDSLLSTHPSLDNRIARLKSLX
                 190       200       210       220
```

The following partial DNA sequence was identified in *N. meningitidis* <SEQ ID 1917>:

a606.seq

```
  1 ATGTCCAAAT TCATCGCCAA ACAATCGGTC GGCGCGGAAG TTATCGACAC
 51 GCCGCGCACC GAAGAAGAAG CCTGGCTTTT GAACACTGTC GAAGCCCAAG
101 CGCGGCAATG GAACCTGAAA ACGCCCGAAG TCGCCATCTA CCACTCCCCC
151 GAACCCAATG CCTTTGCCAC GGGCGCATCG AGAAACAGCT CCCTGATCGC
201 CGTCAGCACC GGTTTGCTCG ACCATATGAC GCGTGACGAA GTGGAAGCCG
251 TATTGGCGCA CGAAATGGCA CACGTCGGCA ACGGCGATAT GGTTACGCTG
301 ACGCTGATTC AAGGCGTGGT CAATACCTTT GTCGTGTTCC TGTCGCGCAT
351 TATTGCCAAC CTGATTGCCC GAAACAACGA CGGCAGCCAG TCCCAGGGAA
401 CTTATTTCCT GGTCAGCATG GTATTCCAAA TCCTGTTCGG CTTCCTTGCC
451 AGCTTAATTG TCATGTGGTT CAGCCGACAA CGCGAATACC GCGCCGACGC
501 GGGCGCGGCA AAACTGGTCG GCGCGCCGAA AATGATTTCC GCCCTGCAAA
```

-continued

```
551 GGCTTAAAGG CAACCCGGTC GATTTGCCCG AAGAAATGAA CGCAATGGGC
601 ATCGCCGGAG ATACGCGCGA CTCCCTGCTC AGCACCCACC CTTCGCTGGA
651 CAACCGAATC GCCCGCCTCA AATCGCTTTA A
```

This corresponds to the amino acid sequence <SEQ ID 1918; ORF 606.a>:

a606.pep

```
  1 MSKFIAKQSV GAEVIDTPRT EEEAWLLNTV EAQARQWNLK TPEVAIYHSP
 51 EPNAFATGAS RNSSLIAVST GLLDHMTRDE VEAVLAHEMA HVGNGDMVTL
101 TLIQGVVNTF VVFLSRIIAN LIARNNDGSQ SQGTYFLVSM VFQILFGFLA
151 SLIVMWFSRQ REYRADAGAA KLVGAPKMIS ALQRLKGNPV DLPEEMNAMG
201 IAGDTRDSLL STHPSLDNRI ARLKSL*
```

m606/a606 100.0% identity in 226 aa overlap

```
                   10        20        30        40        50        60
m606.pep   MSKFIAKQSVGAEVIDTPRTEEEAWLLNTVEAQARQWNLKTPEVAIYHSPEPNAFATGAS
           ||||||||||||||||||||||||||||||||||||||||||||||||||||||||||||
a606       MSKFIAKQSVGAEVIDTPRTEEEAWLLNTVEAQARQWNLKTPEVAIYHSPEPNAFATGAS
                   10        20        30        40        50        60

                   70        80        90       100       110       120
m606.pep   RNSSLIAVSTGLLDHMTRDEVEAVLAHEMAHVGNGDMVTLTLIQGVVNTFVVFLSRIIAN
           ||||||||||||||||||||||||||||||||||||||||||||||||||||||||||||
a606       RNSSLIAVSTGLLDHMTRDEVEAVLAHEMAHVGNGDMVTLTLIQGVVNTFVVFLSRIIAN
                   70        80        90       100       110       120

                  130       140       150       160       170       180
m606.pep   LIARNNDGSQSQGTYFLVSMVFQILFGFLASLIVMWFSRQREYRADAGAAKLVGAPKMIS
           ||||||||||||||||||||||||||||||||||||||||||||||||||||||||||||
a606       LIARNNDGSQSQGTYFLVSMVFQILFGFLASLIVMWFSRQREYRADAGAAKLVGAPKMIS
                  130       140       150       160       170       180

                  190       200       210       220
m606.pep   ALQRLKGNPVDLPEEMNAMGIAGDTRDSLLSTHPSLDNRIARLKSLX
           |||||||||||||||||||||||||||||||||||||||||||||||
a606       ALQRLKGNPVDLPEEMNAMGIAGDTRDSLLSTHPSLDNRIARLKSLX
                  190       200       210       220
```

The following partial DNA sequence was identified in *N. gonorrhoeae* <SEQ ID 1919>:

g607.seq

```
  1 ATGCTGCTCG accTcgaCCG CTTTTCCTtt tccGTCTTCC TGAAAGAAAT
 51 CCGCCTGCTG ACCGCCCTTG CCCTGCCCAT GCTGTTGGCG CAGGTCGCGC
101 AGGTGGGCAT CGGTTTCGTC GATACCGTGA TGGCGGGCGG TGCGGGCAAG
151 GAAGATTTGG CGGCGGTGGC TTTGGGCAGC AGCGCGTTTG CCACGGTTTA
201 TATTACCTTT ATGGGCATTA TGGCGGCGCT GAACCCGATG ATTGCCCAGC
251 TTTACGGCGC GGGTAAAACC GgtgAAGCAG GCGAAACGGG GCGGCAGGGG
301 ATTTGGTTCG GCTGATTTT GGGGATTTTC GGCATGATTT TGATGTGGGC
351 GGCGATTACG CCGTTCCGCA ACTGGCTGAC TTTGAGCGAT TATGTGGAAG
401 gcacAAtggc gcAGTATATG CTGTTCACCA GCTTGGCGAT GCCGGCGGCA
451 ATGGTACACC GCGCACTGCA CGCCTACGCT TCCAGCCTGA ACCGCCCGCG
```

-continued

```
 501 CCTGATTATG TTGGTCAGCT TTGCGGCGTT TGTGTTGAAC GTGCCGCTGA
 551 ACTATATTTT CGTTTACGGC AAATTCGGTA TGCCCGCTTT GGGTGGCGCA
 601 GGTTGCGGCG TGGCGACAAT GGCGGTGTTT TGGTTCAGCG CGCTGGCATT
 651 GTGGATTTAT ATCGCCAAGG AAAAATTCTT CCGCCCGTTC GGACTGACAG
 701 CGAAATTCGg caaACCGGat tGGgcGGTGT TCAAACAGAT TtGGAAAATC
 751 gGcgcgCCCA TCGGGCTGTC TTATTTTTTG GAAgccaGcg cGTTTTCGTT
 801 TATCGTGTTT TTGATTGCGC CTttcggCGA GGATTATGTG GCGGCGCAGC
 851 AGGTCGGCAT CAGTTTGTCG GGGATTCTCT ATATGATTCC GCAAAGCGTC
 901 GGCTCGGCAG GGACGGTGCG CATCGGCTTT TCGCTTGGGC GGCGCGAATT
 951 TTCGCGGGCG CGTTATATTT CAGGAGTGTC GCTGGTGTCG GGCTGGGTGC
1001 TCGCCGTGAT TACCGTGCTT TCCTTGGTAT TATTCCGTTC GCCGCTGGCA
1051 AGCATGTACA ACGATGaTCC GGCAGTTTTA AGCATCGCCT CCACCGTCCT
1101 GCTGTTCGCC GGCCTGTtcc aACCGGCAGA CTTCACCCAA TGTATCGCGT
1151 CCTATGCCCT GCGCGGCTAC AAAGTCACCA AGGTGCCGAT GTTCATCCAC
1201 GCCGCCGCCT TCTGGGGCTG CGGCCTGCTG CCGGGCTATC TGCTCGCCTA
1251 CCGTTTCGAT ATGGGCATTT ACGGCTTCTG GACGGCATTG ATTGCCTCGC
1301 TCACCATCGC AGCCGTCGCC TTGGTGTGGT GCTTGGAAAA ATACAGTATG
1351 GAGTTGGTCA AATCACACAA GGCCGTCTGA
```

This corresponds to the amino acid sequence <SEQ ID 1920; ORF 607.ng>:

g607.pep

```
  1 MLLDLDRFSF SVFLKEIRLL TALALPMLLA QVAQVGIGFV DTVMAGGAGK
 51 EDLAAVALGS SAFATVYITF MGIMAALNPM IAQLYGAGKT GEAGETGRQG
101 IWFGLILGIF GMILMWAAIT PFRNWLTLSD YVEGTMAQYM LFTSLAMPAA
151 MVHRALHAYA SSLNRPRLIM LVSFAAFVLN VPLNYIFVYG KFGMPALGGA
201 GCGVATMAVF WFSALALWIY IAKEKFFRPF GLTAKFGKPD WAVFKQIWKI
251 GAPIGLSYFL EASAFSFIVF LIAPFGEDYV AAQQVGISLS GILYMIPQSV
301 GSAGTVRIGF SLGRREFSRA RYISGVSLVS GWVLAVITVL SLVLFRSPLA
351 SMYNDDPAVL SIASTVLLFA GLFQPADFTQ CIASYALRGY KVTKVPMFIH
401 AAAFWGCGLL PGYLLAYRFD MGIYGFWTAL IASLTIAAVA LVWCLEKYSM
451 ELVKSHKAV*
```

The following partial DNA sequence was identified in *N. meningitidis* <SEQ ID 1921>:

m607.seq

```
  1 ATGCTGCTCG ACCTCAACCG CTTTTCCTTT CCCGTCTTCC TGAAAGAAGT
 51 CCGCCTGCTG ACCACTCTTG CCCTGCCCAT GCTGTTGGCG CAGGTCGCGC
101 AGGTGGGCAT CGGTTTTGTC GATACTGTGA TGGCGGGCGG TGCGGGCAAG
```

-continued

```
 151 GAAGACTTGG CGGCGGTGGC TTTGGGCAGC AGCGCGTTTG CCACGGTTTA
 201 TATTACCTTT ATGGGCATTA TGGCGGCGCT GAACCCGATG ATTGCCCAGC
 251 TTTACGGCGC GGGTAAAACC GACGAAGTGG GCGAAACGGG GCGGCAGGGG
 301 ATTTGGTTCG GGCTGTTTTT GGGCGTGTTC GGCATGGTCT TGATGTGGGC
 351 GGCGATTACG CCGTTCCGCA ACTGGCTGAC CTTGAGCGAT TATGTGGAAG
 401 GCACGATGGC GCAGTATATG TTGTTCACCA GCTTGGCGAT GCCGGCGGCA
 451 ATGGTACACC GCGCGCTGCA CGCCTACACT TCCAGCCTGA ACCGCCCGCG
 501 CCTGATTATG TTGGTCAGCT TTGCGGCGTT TGTGTTGAAC GTGCCGCTGA
 551 ACTATATTTT CGTTTACGGC AAATTCGGTA TGCCCGCTTT GGGCGGCGCA
 601 GGCTGCGGAC TGGCGACGAT GGCGGTGTTT TGGTTCAGCG CGCTGGCATT
 651 GTGGATTTAT ATCGCCAAGG AAAATTTCTT CCGCCCATTC GGACTGACGG
 701 CGAAATTCGG CAAACCGGAT TGGGCGGTGT TCAAACAGAT TTGGAAAATC
 751 GGCGCACCCA TCGGGCTGTC TTATTTTTTG GAAGCCAGCG CGTTTTCGTT
 801 TATCGTGTTT TTGATTGCGC CTTTCGGCGA GGATTATGTG GCGGCGCAGC
 851 AGGTCGGCAT CAGTTTGTCG GGGATTCTCT ATATGATTCC GCAAAGCGTC
 901 GGCTCGGCGG GGACGGTGCG CATCGGCTTT TCGCTTGGGC GGCGCGAATT
 951 TTCGCGGGCG CGTTATATTT CGGGCGTGTC ACTGGTGTTA GGATGGATGC
1001 TCGCCGTGAT TACCGTGCTT TCCTTGGTAT TATTCCGTTC GCCGCTGGTA
1051 AGTATGTACA ACAATGATCC GGCGGTTTTA AGCATCGCCG CCACCGTCTT
1101 ACTGTTCGCC GGCTTGTTCC AACCGGCAGA CTTCACCCAA TGTATCGCCT
1151 CCTACGCCTT GCGCGGCTAC AAAGTTACAA AGGTGCCGAT GTTCATCCAC
1201 GCCGCCGCCT TTTGGGGCTG CGGCCTGCTG CCGGGCTATC TGCTCGCCTA
1251 CCGTTTCAAT ATGGGCATTT ACGGCTTCTG GACGGCATTG ATTGCCTCGC
1301 TCACCATCGC CGCCATCGCC TTGGTGTGGT GCTTGGAATT GTGCAGTAGG
1351 GAGATGGTCA GATCGCATAA GGCCGTCTGA
```

This corresponds to the amino acid sequence <SEQ ID 1922; ORF 607>:

m607.pep

```
  1 MLLDLNRFSF PVFLKEVRLL TTLALPMLLA QVAQVGIGFV DTVMAGGAGK
 51 EDLAAVALGS SAFATVYITF MGIMAALNPM IAQLYGAGKT DEVGETGRQG
101 IWFGLFLGVF GMVLMWAAIT PFRNWLTLSD YVEGTMAQYM LFTSLAMPAA
151 MVHRALHAYT SSLNRPRLIM LVSFAAFVLN VPLNYIFVYG KFGMPALGGA
201 GCGLATMAVF WFSALALWIY IAKENFFRPF GLTAKFGKPD WAVFKQIWKI
251 GAPIGLSYFL EASAFSFIVF LIAPFGEDYV AAQQVGISLS GILYMIPQSV
301 GSAGTVRIGF SLGRREFSRA RYISGVSLVL GWMLAVITVL SLVLFRSPLV
351 SMYNNDPAVL SIAATVLLFA GLFQPADFTQ CIASYALRGY KVTKVPMFIH
401 AAAFWGCGLL PGYLLAYRFN MGIYGFWTAL IASLTIAAIA LVWCLELCSR
451 EMVRSHKAV*
```

Computer analysis of this amino acid sequence gave the following results:

Homology with a predicted ORF from *N. gonorrhoeae*

ORF 607 shows 94.8% identity over a 459 aa overlap with a predicted ORF (ORF 607.ng) from *N. gonorrhoeae*:

m607/g607

```
                   10         20         30         40         50         60
m607.pep   MLLDLNRFSFPVFLKEVRLLTTLALPMLLAQVAQVGIGFVDTVMAGGAGKEDLAAVALGS
           |||||:|||| |||||:||||:||||||||||||||||||||||||||||||||||||||
g607       MLLDLDRFSFSVFLKEIRLLTALALPMLLAQVAQVGIGFVDTVMAGGAGKEDLAAVALGS
                   10         20         30         40         50         60

                   70         80         90        100        110        120
m607.pep   SAFATVYITFMGIMAALNPMIAQLYGAGKTDEVGETGRQGIWFGLFLGVFGMVLMWAAIT
           |||||||||||||||||||||||||||||| |:||||||||||||:||:|||:|||||||
g607       SAFATVYITFMGIMAALNPMIAQLYGAGKTGEAGETGRQGIWFGLILGIFGMILMWAAIT
                   70         80         90        100        110        120

                  130        140        150        160        170        180
m607.pep   PFRNWLTLSDYVEGTMAQYMLFTSLAMPAAMVHRALHAYTSSLNRPRLIMLVSFAAFVLN
           |||||||||||||||||||||||||||||||||||||||:||||||||||||||||||||
g607       PFRNWLTLSDYVEGTMAQYMLFTSLAMPAAMVHRALHAYASSLNRPRLIMLVSFAAFVLN
                  130        140        150        160        170        180

                  190        200        210        220        230        240
m607.pep   VPLNYIFVYGKFGMPALGGAGCGLATMAVFWFSALALWIYIAKENFFRPFGLTAKFGKPD
           |||||||||||||||||||||||:||||||||||||||||||||:|||||||||||||||
g607       VPLNYIFVYGKFGMPALGGAGCGVATMAVFWFSALALWIYIAKEKFFRPFGLTAKFGKPD
                  190        200        210        220        230        240

                  250        260        270        280        290        300
m607.pep   WAVFKQIWKIGAPIGLSYFLEASAFSFIVFLIAPFGEDYVAAQQVGISLSGILYMIPQSV
           ||||||||||||||||||||||||||||||||||||||||||||||||||||||||||||
g607       WAVFKQIWKIGAPIGLSYFLEASAFSFIVFLIAPFGEDYVAAQQVGISLSGILYMIPQSV
                  250        260        270        280        290        300

                  310        320        330        340        350        360
m607.pep   GSAGTVRIGFSLGRREFSRARYISGVSLVLGWMLAVITVLSLVLFRSPLVSMYNNDPAVL
           ||||||||||||||||||||||||||||| ||:||||||||||||||||:||||:|||||
g607       GSAGTVRIGFSLGRREFSRARYISGVSLVSGWVLAVITVLSLVLFRSPLASMYNDDPAVL
                  310        320        330        340        350        360

                  370        380        390        400        410        420
m607.pep   SIAATVLLFAGLFQPADFTQCIASYALRGYKVTKVPMFIHAAAFWGCGLLPGYLLAYRFN
           |||:|||||||||||||||||||||||||||||||||||||||||||||||||||||||:
g607       SIASTVLLFAGLFQPADFTQCIASYALRGYKVTKVPMFIHAAAFWGCGLLPGYLLAYRFD
                  370        380        390        400        410        420

                  430        440        450        460
m607.pep   MGIYGFWTALIASLTIAAIALVWCLELCSREMVRSHKAVX
           ||||||||||||||||||:|||||||  | |:|:||||||
g607       MGIYGFWTALIASLTIAAVALVWCLEKYSMELVKSHKAVX
                  430        440        450        460
```

The following partial DNA sequence was identified in *N. meningitidis* <SEQ ID 1923>:

a607.seq

```
  1 ATGCTGCTCG ACCTCAACCG CTTTTCCTTT TCCGTCTTCC TGAAAGAAGT

 51 CCGCCTGCTG ACCGCTCTTG CCCTGCCCAT GCTGTTGGCG CAGGTCGCGC

101 AGGTGGGCAT CGGTTTTGTC GATACCGTGA TGGCGGGCGG TGCGGGCAAG

151 GAAGACTTGG CGGCGGTGGC TTTGGGCAGC AGCGCGTTTG CCACGGTTTA

201 TATTACCTTT ATGGGCATTA TGGCGGCGCT GAACCCGATG ATTGCCCAGC

251 TTTACGGCGC GGGTAAAACC GACGAAGTGG GCGAAACGGG ACGGCAGGGG

301 ATTTGGTTCG GGCTGTTTTT GGGCGTGTTC GGCATGGTCT TGATGTGGGC

351 GGCGATTACG CCGTTCCGCA ACTGGCTGAC CTTGAGCGAT TATGTGGAAG

401 GCACAATGGC GCAGTATATG CTGTTCACCA GCTTGGCGAT GCCGGCGGCA

451 ATGGTACACC GCGCACTGCA CGCCTACGCC TCCAGCCTGA ACCGCCCGCG

501 CCTGATTATG TTGGTCAGCT TTGCGGCGTT TGTGTTGAAC GTGCCGCTGA
```

-continued

```
 551 ACTATATTTT CGTTTACGGC AAATTCGGTA TGCCCGCTTT GGGCGGCGCA

 601 GGCTGCGGAC TGGCGACGAT GGCGGTGTTT TGGTTCAGCG CGCTGGCATT

 651 GTGGATTTAT ATCGCCAAGG AAAATTTCTT CCGCCCATTC GGACTGACGG

 701 CGAAATTCGG CAAACCGGAT TGGGCGGTGT TCAAACAGAT TTGGAAAATC

 751 GGCGCACCCA TCGGGCTGTC TTATTTTTTG GAAGCCAGCG CGTTTTCGTT

 801 TATCGTGTTT TTGATTGCGC CTTTCGGCGA GGATTATGTG GCGGCGCAGC

 851 AGGTCGGCAT CAGTTTGTCG GGGATTCTCT ATATGATTCC GCAAAGCGTC

 901 GGCTCGGCGG GGACGGTGCG CATCGGCTTT TCGCTTGGGC GGCGCGAATT

 951 TTCGCGGGCG CGTTATATTT CGGGCGTGTC ACTGGTGTCA GGATGGATGC

1001 TCGCCGTGAT TACCGTGCTT TCCTTGGTAT TATTCCGTTC GCCGCTGGTA

1051 AGTATGTACA ACAATGATCC GGCGGTTTTA AGCATCGCCG CCACCGTCTT

1101 ACTGTTCGCC GGCTTGTTCC AACCGGCAGA CTTCACCCAA TGTATCGCCT

1151 CCTACGCCTT GCGCGGCTAC AAAGTTACAA AGGTGCCGAT GTTCATCCAC

1201 GCCGCCGCCT TTTGGGGCTG CGGTCTGCTG CCGGGCTACC TGCTCGCCTA

1251 CCGTTTCGAT ATGGGCATTT ACGGCTTCTG GACGGCATTG ATTGCCTCGC

1301 TCACCATCGC CGCCATCGCC TTGGTGTGGT GCTTGGAATT GTGCAGTAGG

1351 GAGATGGTCA GATCGCATAA GGCTGTCTGA
```

This corresponds to the amino acid sequence <SEQ ID 1924; ORF 607.a>:

a607.pep

```
  1 MLLDLNRFSF SVFLKEVRLL TALALPMLLA QVAQVGIGFV DTVMAGGAGK

 51 EDLAAVALGS SAFATVYITF MGIMAALNPM IAQLYGAGKT DEVGETGRQG

101 IWFGLFLGVF GMVLMWAAIT PFRNWLTLSD YVEGTMAQYM LFTSLAMPAA

151 MVHRALHAYA SSLNRPRLIM LVSFAAFVLN VPLNYIFVYG KFGMPALGGA

201 GCGLATMAVF WFSALALWIY IAKENFFRPF GLTAKFGKPD WAVFKQIWKI

251 GAPIGLSYFL EASAFSFIVF LIAPFGEDYV AAQQVGISLS GILYMIPQSV

301 GSAGTVRIGF SLGRREFSRA RYISGVSLVS GWMLAVITVL SLVLFRSPLV

351 SMYNNDPAVL SIAATVLLFA GLFQPADFTQ CIASYALRGY KVTKVPMFIH

401 AAAFWGCGLL PGYLLAYRFD MGIYGFWTAL IASLTIAAIA LVWCLELCSR

451 EMVRSHKAV*
```

m607/a607 98.9% identity in 459 aa overlap

```
                  10        20        30        40        50        60
m607.pep  MLLDLNRFSFPVFLKEVRLLTTLALPMLLAQVAQVGIGFVDTVMAGGAGKEDLAAVALGS
          |||||||||| |||||||||:||||||||||||||||||||||||||||||||||||||
a607      MLLDLNRFSFSVFLKEVRLLTALALPMLLAQVAQVGIGFVDTVMAGGAGKEDLAAVALGS
                  10        20        30        40        50        60

                  70        80        90       100       110       120
m607.pep  SAFATVYITFMGIMAALNPMIAQLYGAGKTDEVGETGRQGIWFGLFLGVFGMVLMWAAIT
          ||||||||||||||||||||||||||||||||||||||||||||||||||||||||||||
a607      SAFATVYITFMGIMAALNPMIAQLYGAGKTDEVGETGRQGIWFGLFLGVFGMVLMWAAIT
                  70        80        90       100       110       120
```

-continued

```
              130       140       150       160       170       180
m607.pep  PFRNWLTLSDYVEGTMAQYMLFTSLAMPAAMVHRALHAYTSSLNRPRLIMLVSFAAFVLN
          ||||||||||||||||||||||||||||||||||||||||:|||||||||||||||||||
a607      PFRNWLTLSDYVEGTMAQYMLFTSLAMPAAMVHRALHAYASSLNRPRLIMLVSFAAFVLN
              130       140       150       160       170       180

              190       200       210       220       230       240
m607.pep  VPLNYIFVYGKFGMPALGGAGCGLATMAVFWFSALALWIYIAKENFFRPFGLTAKFGKPD
          ||||||||||||||||||||||||||||||||||||||||||||||||||||||||||||
a607      VPLNYIFVYGKFGMPALGGAGCGLATMAVFWFSALALWIYIAKENFFRPFGLTAKFGKPD
              190       200       210       220       230       240

              250       260       270       280       290       300
m607.pep  WAVFKQIWKIGAPIGLSYFLEASAFSFIVFLIAPFGEDYVAAQQVGISLSGILYMIPQSV
          ||||||||||||||||||||||||||||||||||||||||||||||||||||||||||||
a607      WAVFKQIWKIGAPIGLSYFLEASAFSFIVFLIAPFGEDYVAAQQVGISLSGILYMIPQSV
              250       260       270       280       290       300

              310       320       330       340       350       360
m607.pep  GSAGTVRIGFSLGRREFSRARYISGVSLVLGWMLAVITVLSLVLFRSPLVSMYNNDPAVL
          ||||||||||||||||||||||||||||||| ||||||||||||||||||||||||||||
a607      GSAGTVRIGFSLGRREFSRARYISGVSLVSGWMLAVITVLSLVLFRSPLVSMYNNDPAVL
              310       320       330       340       350       360

              370       380       390       400       410       420
m607.pep  SIAATVLLFAGLFQPADFTQCIASYALRGYKVTKVPMFIHAAAFWGCGLLPGYLLAYRFN
          |||||||||||||||||||||||||||||||||||||||||||||||||||||||||||:
a607      SIAATVLLFAGLFQPADFTQCIASYALRGYKVTKVPMFIHAAAFWGCGLLPGYLLAYRFD
              370       380       390       400       410       420

              430       440       450       460
m607.pep  MGIYGFWTALIASLTIAAIALVWCLELCSREMVRSHKAVX
          ||||||||||||||||||||||||||||||||||||||||
a607      MGIYGFWTALIASLTIAAIALVWCLELCSREMVRSHKAVX
              430       440       450       460
```

The following partial DNA sequence was identified in *N. gonorrhoeae* <SEQ ID 1925>:

g608.seq

```
  1 ATGTCCGCCC TCCTCCCCAT CATCAACCGC CTGATTCTGC AAAGCCCGGA
 51 CAGCCGCTCG GAACTTACCT CCTTTGCAGG CAAAACACTG ACCCTGAACA
101 TTGCCGGGCT GAAACTGGCG GGACGCATCA CAGAAGACGG TTTGCTCTCG
151 GCGGGAAACG GCTTTGCAGA CACCGAAATT ACCTTCCGCA ACAGCGCGAT
201 ACGGAAAATC CTCCAAGGCG GCGAACCCGG GGCTGGCGAC ATCAGGCTCG
251 AAGGCGACCT CATCCTCGGC ATcGCGGTAC TGTCCCTGCT CGGCAGCCTG
301 CGTTCCCGCG CATCGGacgA ATTGGCACGG ATTTTCGGCA CGCAGGCAGg
351 catcggcagc CGTGCCACCG ACATCGGACA CGGCaTCaaa cAAATCGGCA
401 GGAACATCGC CGAACAAATC GGCGGATTTT CCCGCGAACC CGAGTCcgCa
451 aacaccggca acgaagccct tgccgactgc ctCGACGAAA TAAGCAGACT
501 GCGCGACGGC GTGGAACGCC TCAACGAACG CCTCGACAGG CTCGAACGCG
551 ACATTTGGAT AGACTAA
```

This corresponds to the amino acid sequence <SEQ ID 1926; ORF 608.ng>:

g608.pep

```
  1 MSALLPIINR LILQSPDSRS ELTSFAGKTL TLNIAGLKLA GRITEDGLLS
 51 AGNGFADTEI TFRNSAIRKI LQGGEPGAGD IRLEGDLILG IAVLSLLGSL
101 RSRASDELAR IFGTQAGIGS RATDIGHGIK QIGRNIAEQI GGFSREPESA
151 NTGNEALADC LDEISRLRDG VERLNERLDR LERDIWID*
```

The following partial DNA sequence was identified in *N. meningitidis* <SEQ ID 1927>:

m608.seq

```
  1 ATGTCCGCCC TCCTCCCCAT CATCAACCGC CTGATTCTGC AAAGCCCGGA
 51 CAGCCGCTCG GAACTTGCCG CCTTTGCAGG CAAAACACTG ACCCTGAACA
101 TTGCCGGGCT GAAACTGGCG GGACGCATCA CGGAAGACGG TTTGCTCTCG
151 GCGGGAAACG GCTTTGCAGA CACCGAAATT ACCTTCCGCA ACAGCGCGGT
201 ACAGAAAATC CTCCAAGGAG GCGAACCCGG GGCGGGCGAC ATCGGGCTCG
251 AAGGCGACCT CATCCTCGGC ATCGCGGTAC TGTCCCTGCT CGGCAGCCTG
301 CGTTCCCGCG CATCGGACGA ATTGGCACGG ATTTTCGGCA CGCAGGCAGA
351 CATCGGCAGC CGTGCCGCCG ACATCGGACA CGGCATCAAA CAAATCGGCA
401 GGAACATCGC CGAACAAATC GGCGGATTTT CCCGCGAATC CGAGTCCGCA
451 AACATCGGCA ACGAAGCCCT TGCCGACTGC CTCGACGAAA TAAGCAGACT
501 GCGCGACGGC GTGGAACGCC TCAACGAACG CCTCGACCGG CTCGAACGCG
551 ACATTTGGAT AGACTAA
```

This corresponds to the amino acid sequence <SEQ ID 1928; ORF 608>:

m608.pep

```
  1 MSALLPIINR LILQSPDSRS ELAAFAGKTL TLNIAGLKLA GRITEDGLLS
 51 AGNGFADTEI TFRNSAVQKI LQGGEPGAGD IGLEGDLILG IAVLSLLGSL
101 RSRASDELAR IFGTQADIGS RAADIGHGIK QIGRNIAEQI GGFSRESESA
151 NIGNEALADC LDEISRLRDG VERLNERLDR LERDIWID*
```

Computer analysis of this amino acid sequence gave the following results:

Homology with a predicted ORF from *N. gonorrhoeae*

ORF 608 shows 95.2% identity over a 188 aa overlap with a predicted ORF (ORF 608.ng) from *N. gonorrhoeae*:

m608/g608

```
                     10        20        30        40        50        60
m608.pep     MSALLPIINRLILQSPDSRSELAAFAGKTLTLNIAGLKLAGRITEDGLLSAGNGFADTEI
             ||||||||||||||||||||||::||||||||||||||||||||||||||||||||||||
g608         MSALLPIINRLILQSPDSRSELTSFAGKTLTLNIAGLKLAGRITEDGLLSAGNGFADTEI
                     10        20        30        40        50        60

                     70        80        90       100       110       120
m608.pep     TFRNSAVQKILQGGEPGAGDIGLEGDLILGIAVLSLLGSLRSRASDELARIFGTQADIGS
             ||||||::||||||||||||| |||||||||||||||||||||||||||||||||| |||
g608         TFRNSAIRKILQGGEPGAGDIRLEGDLILGIAVLSLLGSLRSRASDELARIFGTQAGIGS
                     70        80        90       100       110       120

                    130       140       150       160       170       180
m608.pep     RAADIGHGIKQIGRNIAEQIGGFSRESESANIGNEALADCLDEISRLRDGVERLNERLDR
             ||:||||||||||||||||||||||| |||| ||||||||||||||||||||||||||||
g608         RATDIGHGIKQIGRNIAEQIGGFSREPESANTGNEALADCLDEISRLRDGVERLNERLDR
                    130       140       150       160       170       180

                    189
m608.pep     LERDIWIDX
             |||||||||
g608         LERDIWIDX
```

The following partial DNA sequence was identified in *N. meningitidis* <SEQ ID 1929>:

a608.seq

```
  1 ATGTCCGCCC TCCTCCCCAT CATCAACCGC CTGATTCTGC AAAGCCCGGA
 51 CAGCCGCTCG GAACTTGCCG CCTTCGCAGG CAAAACACTG ACCCTGAACA
101 TTGCCGGGTT GAAACTGGCG GGACGCATCA CGGAAGACGG TTTGCTCTCG
151 GCGGGAAACG GCTTTGCAGA CACCGAAATC ACCTTCCGCA ACAGCGCGGT
201 ACAGAAAATC CTCCAAGGCG GCGAACCCGG GGCGGGCGAC ATCGGGCTCG
251 AAGGCGACCT CATCCTCGGC ATCGCGGTAC TGTCCCTGCT CGGCAGCCTG
301 CGTTCCCGCG CATCGGACGA ATTGGCACGG ATTTTCGGCA CGCAGGCAGA
351 CATCGGCAGC CGTGCCGCCG ACATCGGACA CGGCATCAAA CAAATCGGCA
401 GGAACATCGC CGAACAAATC GGCACATTTT CCCGCGAACC CGAGTCCGCA
451 AACATCGGCA ACGAAGCCCT TGCCGACTGC CTCGACGAAA TAAGCAGACT
501 GCGCGACGGC GTGGAACGCC TCAACGAACG CCTCGACCGG CTCGAACGCG
551 ACATTTGGAT AGACTAA
```

This corresponds to the amino acid sequence <SEQ ID 1930; ORF 608.a>:

a608.pep

```
  1 MSALLPIINR LILQSPDSRS ELAAFAGKTL TLNIAGLKLA GRITEDGLLS
 51 AGNGFADTEI TFRNSAVQKI LQGGEPGAGD IGLEGDLILG IAVLSLLGSL
101 RSRASDELAR IFGTQADIGS RAADIGHGIK QIGRNIAEQI GRFSREPESA
151 NIGNEALADC LDEISRLRDG VERLNERLDR LERDIWID*
```

m608/a608 98.9% identity in 188 aa overlap

```
                   10        20        30        40        50        60
m608.pep    MSALLPIINRLILQSPDSRSELAAFAGKTLTLNIAGLKLAGRITEDGLLSAGNGFADTEI
            ||||||||||||||||||||||||||||||||||||||||||||||||||||||||||||
a608        MSALLPIINRLILQSPDSRSELAAFAGKTLTLNIAGLKLAGRITEDGLLSAGNGFADTEI
                   10        20        30        40        50        60

                   70        80        90       100       110       120
m608.pep    TFRNSAVQKILQGGEPGAGDIGLEGDLILGIAVLSLLGSLRSRASDELARIFGTQADIGS
            ||||||||||||||||||||||||||||||||||||||||||||||||||||||||||||
a608        TFRNSAVQKILQGGEPGAGDIGLEGDLILGIAVLSLLGSLRSRASDELARIFGTQADIGS
                   70        80        90       100       110       120

                  130       140       150       160       170       180
m608.pep    RAADIGHGIKQIGRNIAEQIGGFSRESESANIGNEALADCLDEISRLRDGVERLNERLDR
            |||||||||||||||||||| |||| ||||||||||||||||||||||||||||||||||
a608        RAADIGHGIKQIGRNIAEQIGRFSREPESANIGNEALADCLDEISRLRDGVERLNERLDR
                  130       140       150       160       170       180

                189
m608.pep    LERDIWIDX
            |||||||||
a608        LERDIWIDX
```

The following partial DNA sequence was identified in *N. gonorrhoeae* <SEQ ID 1931>:

g609.seq

```
  1 ATGGTTGTGG ATAGACTCGA AATTCTCGCT CTCGACGACG AAACTCTTGA
 51 TGCGTTTGTC GGCAATCAGC GAAGTAGCGA CATCGCGCAC CATATCTTCC
```

-continued

```
101 ACGAATTTCG GGTTTTCGTA GGCCTTTTCG GTAACGTATT TTTCATCGGG

151 GCGTTTGAGC AGGCCGTAGA GTTGGCAGCT CGCCTGCGTT TCCACATAAT

201 CGATAACTTC CTCGATACCG ACTTCGGCAT CGGAAGTCAG GCTGACGGTA

251 ACGTGCGAAC GCTGATTATG CGCGCCATAT TGGGAAATTT CTTTGGAACA

301 CGGGCAAAGC GAGGTTACGG GAATCATGAC CTTCATACTG TGGCCGTATG

351 CCCCGTCTTT CATTTCACCC GTGAGGCTGA CATCATAATC CAGtaa
```

This corresponds to the amino acid sequence <SEQ ID 1932; ORF 609.ng>:

g609.pep

```
  1 MVVDRLEILA LDDETLDAFV GNQRSSDIAH HIFHEFRVFV GLFGNVFFIG

 51 AFEQAVELAA RLRFHIIDNF LDTDFGIGSQ ADGNVRTLIM RAILGNFFGT

101 RAKRGYGNHD LHTVAVCPVF HFTREADIII Q*
```

The following partial DNA sequence was identified in *N. meningitidis* <SEQ ID 1933>:

m609.seq

```
  1 ATGGTTGTGG ATAGACTCGA AATTCTCGCT CTCGACGACG AAACTCTTGA

 51 TGCGTTTGTC GGCAATCAGC GAAGTAGCGA CATCGCGCAC CATATCTTCC

101 ACGAATTTCG GGTTTTCGTA GGCTTTTTCG GTAACGTATT TTTCATCGGG

151 GCGTTTGAGC AGGCCGTAGA GTTGGCAGCT CGCCTGCGCC TCCACATAAT

201 CGATGACTTC CTCGATACCG ACTTCGGCAT CGGCAGTCAG GCTGACGGTA

251 ACGTGCGAAC GCTGGTTGTG CGCGCCGTAT TGGGAAATTT CTTTGGAACA

301 CGGGCAAAGC GAGGTTACGG GAATCATGAC CTTCATACTG TGGCCGTATG

351 CCCCGTCTTT GATTTCGCCC GTGAGACAGA CATCATAATC CAGTAA
```

This corresponds to the amino acid sequence <SEQ ID 1934; ORF 609>:

m609.pep

```
  1 MVVDRLEILA LDDETLDAFV GNQRSSDIAH HIFHEFRVFV GFFGNVFFIG

 51 AFEQAVELAA RLRLHIIDDF LDTDFGIGSQ ADGNVRTLVV RAVLGNFFGT

101 RAKRGYGNHD LHTVAVCPVF DFARETDIII Q*
```

m609/g609 93.1% identity in 131 aa overlap

```
                    10        20        30        40        50        60
m609.pep   MVVDRLEILALDDETLDAFVGNQRSSDIAHHIFHEFRVFVGFFGNVFFIGAFEQAVELAA
           |||||||||||||||||||||||||||||||||||||||||:||||||||||||||||||
g609       MVVDRLEILALDDETLDAFVGNQRSSDIAHHIFHEFRVFVGLFGNVFFIGAFEQAVELAA
                    10        20        30        40        50        60
```

-continued

```
                  70        80        90       100       110       120
m609.pep  RLRLHIIDDFLDTDFGIGSQADGNVRTLVVRAVLGNFFGTRAKRGYGNHDLHTVAVCPVF
          |||:||||:|||||||||||||||||||::||:|||||||||||||||||||||||||||
g609      RLRFHIIDNFLDTDFGIGSQADGNVRTLIMRAILGNFFGTRAKRGYGNHDLHTVAVCPVF
                  70        80        90       100       110       120

                 130
m609.pep  DFARETDIIIQX
           |:||:||||||
g609      HFTREADIIIQX
                 130
```

The following partial DNA sequence was identified in *N. meningitidis* <SEQ ID 1935>:

```
a609.seq
  1 ATGGTTGTGG ATAGACTCGA AATTCTCGCT CTCGACGACG AAACTCTTGA
 51 TGCGTTTGTC GGCAATCAGC GAAGTAGCGA CATCGCGCAC CATATCTTCC
101 ACGAATTTCG GGTTTTCGTA GGCTTTTTCG GTAACGTATT TTTCATCGGG
151 GCGTTTGAGC AGGCCGTAGA GTTGGCAGCT CGCCTGCGCC TCCACATAAT
201 CGATGACTTC CTCGATACCG ACTTCGGCAT CGGCAGTCAG GCTGACGGTA
251 ACGTGCGAAC GCTGGTTGTG CGCGCCATAT TGGGAAATTT CTTTGGAACA
301 CGGGCAAAGC GAGGTTACGG GAATCATGAC CTTCATACTG TGGCCGTATG
351 CACCGTCTTT CATTTCGCCC GTGAGGCTGA CATCATAATC CAGTAA
```

This corresponds to the amino acid sequence <SEQ ID 1936; ORF 609.a>:

```
a609.pep
  1 MVVDRLEILA LDDETLDAFV GNQRSSDIAH HIFHEFRVFV GFFGNVFFIG
 51 AFEQAVELAA RLRLHIIDDF LDTDFGIGSQ ADGNVRTLVV RAILGNFFGT
101 RAKRGYGNHD LHTVAVCTVF HFAREADIII Q*
```

m609/a609 96.9% identity in 131 aa overlap

```
                  10        20        30        40        50        60
m609.pep  MVVDRLEILALDDETLDAFVGNQRSSDIAHHIFHEFRVFVGFFGNVFFIGAFEQAVELAA
          ||||||||||||||||||||||||||||||||||||||||||||||||||||||||||||
a609      MVVDRLEILALDDETLDAFVGNQRSSDIAHHIFHEFRVFVGFFGNVFFIGAFEQAVELAA
                  10        20        30        40        50        60
                  70        80        90       100       110       120
m609.pep  RLRLHIIDDFLDTDFGIGSQADGNVRTLVVRAVLGNFFGTRAKRGYGNHDLHTVAVCPVF
          ||||||||||||||||||||||||||||||||:|||||||||||||||||||||||| ||
a609      RLRLHIIDDFLDTDFGIGSQADGNVRTLVVRAILGNFFGTRAKRGYGNHDLHTVAVCTVF
                  70        80        90       100       110       120
                 130
m609.pep  DFARETDIIIQX
           ||||:||||||
a609      HFAREADIIIQX
                 130
```

The following partial DNA sequence was identified in *N. gonorrhoeae* <SEQ ID 1937>:

g610.seq

```
   1 ATGATTGGAG GGCTTATGCA ATTTCCTTAC CGCAATGTTC CGGCTTCGCG
  51 TATGCGCCGT ATGCGCAGGG ATGATTTTTC ACGCCGCCTG ATGCGCGAGC
 101 ATATGCTGAC CGCCGATGAT TTGATTTATC CGGTGTTCGT ATTGGAGGGG
 151 GCGGCGCGCG AGGAGGATGT GCCTTCTATG CCGGGCGTGA AGCGTCAGAG
 201 TTTGGACAGG CTGCTGTTTA CGGCGGAAGA GGCGGTGAAG CTCGGTATTC
 251 CGATGTTGGC ACTCTTTCCC GTGGTTACGG CAAACAAAAC CGGGCGTGCG
 301 CAGGAGGCGT ACAATCCCGA AGGACTCGTG CCGTCAACTG tccgagccTT
 351 GCGCGAGAGG TttcCcgaac tggggattat gacggatgtc gcgctcgAtc
 401 cttatacggt gcacGGTCAG GACGGACTGA CGGACgaaaa cggttaCGTG
 451 ATGAatgATg aaaCCGTAGA AGTCTTGGTG AAACAGGCTT TATGTCATGC
 501 AGAGGCGGGC ACGCAGGTCG TTGCTCCTTC CGATATGATG GACGGGCGTA
 551 TCGGCGCCAT CCGCGAGGCT TTGGAGGATG CCGGACATAT CCATACGCGG
 601 ATTATGGCAT ATTCCGCCAA ATATGCTTCT GCATTCTACG GCCCTTTCCG
 651 TGATGCGGTA GGCAGTTCGG GCAATTTGGG AAAGGCAGAT AAAAAGACCT
 701 ATCAGATGGA TCCTGCAAAT ACCGATGAGG CGCTGCATGA AGTGGCGCTC
 751 GATATTCAGG AAGGTGCGGA TATGGTGATG GTGAAGCCCG GTTTGCCGTA
 801 TTTGGACGTT GTCCGCCGCG TGAAGGACGA GTTCGGCGTA CCGACTTATG
 851 CCTATCAGGT TTCGGGCGAA TATGCGATGT TGCAGGCGGC GGTTGCCAAC
 901 GGCTGGCTGG ACGGCGGCAA AGTGGTTTTG GAAAGCCTGC TGGCATTCAA
 951 ACGTGCGGGT GCGGACGGGA TTTTGACCTA TTACGCCATT GAGGCGGCAA
1001 AGATGCTGAA GCGTTGA
```

This corresponds to the amino acid sequence <SEQ ID 1938; ORF 610.ng>:

g610.pep

```
   1 MIGGLMQFPY RNVPASRMRR MRRDDFSRRL MREHMLTADD LIYPVFVLEG
  51 AAREEDVPSM PGVKRQSLDR LLFTAEEAVK LGIPMLALFP VVTANKTGRA
 101 QEAYNPEGLV PSTVRALRER FPELGIMTDV ALDPYTVHGQ DGLTDENGYV
 151 MNDETVEVLV KQALCHAEAG TQVVAPSDMM DGRIGAIREA LEDAGHIHTR
 201 IMAYSAKYAS AFYGPFRDAV GSSGNLGKAD KKTYQMDPAN TDEALHEVAL
 251 DIQEGADMVM VKPGLPYLDV VRRVKDEFGV PTYAYQVSGE YAMLQAAVAN
 301 GWLDGGKVVL ESLLAFKRAG ADGILTYYAI EAAKMLKR*
```

The following partial DNA sequence was identified in *N. meningitidis* <SEQ ID 1939>:

m610.seq

```
   1 ATGATTGGAG GGCTTATGCA GTTTCCTTAC CGCAATGTTC CGGCTTCGCG
  51 TATGCGCCGT ATGCGCAGGG ACGATTTTTC ACGCCGCCTG ATGCGCGAAC
 101 ACACGCTGAC CGCCGATGAT TTGATTTATC CGGTGTTCGT ATTGGAGGGG
```

-continued

```
 151 TCGGCGCGCG AGGAGGATGT GCCTTCTATG CCGGGTGTGA AGCGTCAAAG

 201 TTTGGACAGG CTGCTGTTTA CGGCGGAAGA GGCGGTAAAG CTCGGTATTC

 251 CGATGTTGGC ACTGTTCCCC GTGGTTACGG CAAACAAAAC CGAGCGTGCG

 301 CAGGAGGCGT ACAATCCCGA AGGACTCGTG CCGTCAACTG TCCGCGCCTT

 351 GCGCGAGAGG TTTCCCGAAC TGGGCATTAT GACGGATGTC GCGCTCGATC

 401 CTTATACGGT TCACGGTCAG GACGGGCTGA CGGACGAAAA CGGTTATGTG

 451 ATGAACGATG AAACCGTAGA GGTTTTGGTC AAGCAGGCTT TGTGCCACGC

 501 TGAAGCGGGC GCGCAGGTGG TTGCCCCTTC CGATATGATG GACGGGCGTA

 551 TCGGTGCGAT TCGCGAGGCG TTGGAGGATG CCGGGCATAT CCATACGCGG

 601 ATTATGGCGT ATTCCGCCAA ATATGCTTCT GCATTTTACG GCCCTTTCCG

 651 TGATGCGGTA GGCAGTTCGG GCAATTTGGG CAAGGCAGAT AAAAAGACCT

 701 ACCAGATGGA TCCGGCAAAT ACCGATGAGG CGTTGCACGA AGTGGCGTTG

 751 GACATTCAGG AAGGTGCGGA TATGGTAATG GTCAAGCCCG GTTTGCCGTA

 801 TTTGGACGTT GTCCGCCGCG TAAAGGACGA GTTCGGTGTG CCGACTTATG

 851 CCTATCAGGT TTCGGGAGAA TACGCGATGT TGCAGGCAGC GATTGCCAAC

 901 GGCTGGCTGG ACGGCGGCAA AGTGGTTTTG GAAAGCCTGC TGGCATTCAA

 951 ACGTGCGGGT GCGGACGGGA TTTTGACCTA TTACGCTATT GAGGCGGCAA

1001 AGATGTTGAA GCGTTGA
```

This corresponds to the amino acid sequence <SEQ ID 1940; ORF 610>:

m610.pep

```
  1 MIGGLMQFPY RNVPASRMRR MRRDDFSRRL MREHTLTADD LIYPVFVLEG

 51 SAREEDVPSM PGVKRQSLDR LLFTAEEAVK LGIPMLALFP VVTANKTERA

101 QEAYNPEGLV PSTVRALRER FPELGIMTDV ALDPYTVHGQ DGLTDENGYV

151 MNDETVEVLV KQALCHAEAG AQVVAPSDMM DGRIGAIREA LEDAGHIHTR

201 IMAYSAKYAS AFYGPFRDAV GSSGNLGKAD KKTYQMDPAN TDEALHEVAL

251 DIQEGADMVM VKPGLPYLDV VRRVKDEFGV PTYAYQVSGE YAMLQAAIAN

301 GWLDGGKVVL ESLLAFKRAG ADGILTYYAI EAAKMLKR*
```

m610/g610 98.5% identity in 338 aa overlap

```
                  10        20        30        40        50        60
m610.pep  MIGGLMQFPYRNVPASRMRRMRRDDFSRRLMREHTLTADDLIYPVFVLEGSAREEDVPSM
          |||||||||||||||||||||||||||||||||| |||||||||||||||:|||||||||
g610      MIGGLMQFPYRNVPASRMRRMRRDDFSRRLMREHMLTADDLIYPVFVLEGAAREEDVPSM
                  10        20        30        40        50        60

                  70        80        90       100       110       120
m610.pep  PGVKRQSLDRLLFTAEEAVKLGIPMLALFPVVTANKTERAQEAYNPEGLVPSTVRALRER
          ||||||||||||||||||||||||||||||||||||| ||||||||||||||||||||||
g610      PGVKRQSLDRLLFTAEEAVKLGIPMLALFPVVTANKTGRAQEAYNPEGLVPSTVRALRER
                  70        80        90       100       110       120

                 130       140       150       160       170       180
m610.pep  FPELGIMTDVALDPYTVHGQDGLTDENGYVMNDETVEVLVKQALCHAEAGAQVVAPSDMM
          ||||||||||||||||||||||||||||||||||||||||||||||||||:|||||||||
g610      FPELGIMTDVALDPYTVHGQDGLTDENGYVMNDETVEVLVKQALCHAEAGTQVVAPSDMM
                 130       140       150       160       170       180
```

-continued

```
                190       200       210       220       230       240
m610.pep  DGRIGAIREALEDAGHIHTRIMAYSAKYASAFYGPFRDAVGSSGNLGKADKKTYQMDPAN
          ||||||||||||||||||||||||||||||||||||||||||||||||||||||||||||
g610      DGRIGAIREALEDAGHIHTRIMAYSAKYASAFYGPFRDAVGSSGNLGKADKKTYQMDPAN
                190       200       210       220       230       240

                250       260       270       280       290       300
m610.pep  TDEALHEVALDIQEGADMVMVKPGLPYLDVVRRVKDEFGVPTYAYQVSGEYAMLQAAIAN
          |||||||||||||||||||||||||||||||||||||||||||||||||||||||||:||
g610      TDEALHEVALDIQEGADMVMVKPGLPYLDVVRRVKDEFGVPTYAYQVSGEYAMLQAAVAN
                250       260       270       280       290       300

                310       320       330      339
m610.pep  GWLDGGKVVLESLLAFKRAGADGILTYYAIEAAKMLKRX
          |||||||||||||||||||||||||||||||||||||||
g610      GWLDGGKVVLESLLAFKRAGADGILTYYAIEAAKMLKRX
                310       320       330
```

The following partial DNA sequence was identified in *N. meningitidis* <SEQ ID 1941>:

a610.seq

```
   1 ATGATTGGAG GGCTTATGCA GTTTCCTTAC CGCAATGTTT CGGCTTCGCG
  51 TATGCGCCGT ATGCGCAGGG ACGATTTTTC ACGCCGCCTG ATGCGCGAGC
 101 ATACGCTGAC TGCCGATGAT TTGATTTATC CGGTGTTCGT ATTGGAGGGG
 151 TCGGCGCGCG AGGAGGATGT GCCTTCTATG CCGGGCGTGA AGCGTCAGAG
 201 TTTGGACAGG CTGCTGTTTA CGGCGGAAGA GGCGGTAAAG CTCGGTATTC
 251 CGATGTTGGC ACTGTTCCCC GTGGTTACGG CAAACAAAAC CGAGCGTGCG
 301 CAGGAGGCGT ACAATCCCGA AGGACTCGTG CCGTCAACTG TCCGCGCCTT
 351 GCGCGAGAGG TTTCCCGAAC TGGGCATTAT GACGGATGTC GCGCTCGATC
 401 CTTATACGGT GCACGGTCAG GACGGGCTGA CGGACGAAAA CGGTTATGTG
 451 ATGAACGATG AAACCGTAGA GGTTTTGGTC AAGCAGGCTT TGTGTCATGC
 501 AGAGGCAGGC GCACAGGTCG TTGCTCCTTC CGATATGATG GATGGGCGTA
 551 TCGGTGCGAT TCGCGAGGCG TTGGAGGATG CCGGGCATAT CCATACGCGG
 601 ATTATGGCGT ATTCCGCCAA ATATGCTTCT GCATTTTACG GCCCTTTCCG
 651 TGATGCGGTA GGCAGTTCGG GCAATTTGGG CAAGGCAGAT AAAAAGACCT
 701 ACCAGATGGA TCCGGCAAAT ACCGATGAGG CGTTGCACGA AGTGGCGTTG
 751 GACATTCAGG AAGGTGCGGA TATGGTGATG GTCAAGCCCG GTTTGCCGTA
 801 TTTGGACGTT GTCCGCCGCG TGAAGGACGA GTTCGGCGTG CCGACTTATG
 851 CCTATCAGGT TTCGGGAGAA TACGCGATGC TGCAGGCGGC GGTTGCCAAC
 901 GGCTGGCTGG ACGGCGGCAA AGTGGTTTTG GAAAGCCTGC TGGCATTCAA
 951 ACGTGCGGGT GCGGATGGGA TTTTGACCTA TTACGCCATT GAGGCGGCAA
1001 AGATGCTGAA GCGTTGA
```

This corresponds to the amino acid sequence <SEQ ID 1942; ORF 610.a>:

a610.pep

```
   1 MIGGLMQFPY RNVSASRMRR MRRDDFSRRL MREHTLTADD LIYPVFVLEG
  51 SAREEDVPSM PGVKRQSLDR LLFTAEEAVK LGIPMLALFP VVTANKTERA
```

-continued

```
101 QEAYNPEGLV PSTVRALRER FPELGIMTDV ALDPYTVHGQ DGLTDENGYV

151 MNDETVEVLV KQALCHAEAG AQVVAPSDMM DGRIGAIREA LEDAGHIHTR

201 IMAYSAKYAS AFYGPFRDAV GSSGNLGKAD KKTYQMDPAN TDEALHEVAL

251 DIQEGADMVM VKPGLPYLDV VRRVKDEFGV PTYAYQVSGE YAMLQAAVAN

301 GWLDGGKVVL ESLLAFKRAG ADGILTYYAI EAAKMLKR*
```

m610/a610 99.4% identity in 338 aa overlap

```
                    10        20        30        40        50        60
m610.pep    MIGGLMQFPYRNVPASRMRRMRRDDFSRRLMREHTLTADDLIYPVFVLEGSAREEDVPSM
            ||||||||||||| ||||||||||||||||||||||||||||||||||||||||||||||
a610        MIGGLMQFPYRNVSASRMRRMRRDDFSRRLMREHTLTADDLIYPVFVLEGSAREEDVPSM
                    10        20        30        40        50        60

                    70        80        90       100       110       120
m610.pep    PGVKRQSLDRLLFTAEEAVKLGIPMLALFPVVTANKTERAQEAYNPEGLVPSTVRALRER
            ||||||||||||||||||||||||||||||||||||||||||||||||||||||||||||
a610        PGVKRQSLDRLLFTAEEAVKLGIPMLALFPVVTANKTERAQEAYNPEGLVPSTVRALRER
                    70        80        90       100       110       120

                   130       140       150       160       170       180
m610.pep    FPELGIMTDVALDPYTVHGQDGLTDENGYVMNDETVEVLVKQALCHAEAGAQVVAPSDMM
            ||||||||||||||||||||||||||||||||||||||||||||||||||||||||||||
a610        FPELGIMTDVALDPYTVHGQDGLTDENGYVMNDETVEVLVKQALCHAEAGAQVVAPSDMM
                   130       140       150       160       170       180

                   190       200       210       220       230       240
m610.pep    DGRIGAIREALEDAGHIHTRIMAYSAKYASAFYGPFRDAVGSSGNLGKADKKTYQMDPAN
            ||||||||||||||||||||||||||||||||||||||||||||||||||||||||||||
a610        DGRIGAIREALEDAGHIHTRIMAYSAKYASAFYGPFRDAVGSSGNLGKADKKTYQMDPAN
                   190       200       210       220       230       240

                   250       260       270       280       290       300
m610.pep    TDEALHEVALDIQEGADMVMVKPGLPYLDVVRRVKDEFGVPTYAYQVSGEYAMLQAAIAN
            |||||||||||||||||||||||||||||||||||||||||||||||||||||||||:||
a610        TDEALHEVALDIQEGADMVMVKPGLPYLDVVRRVKDEFGVPTYAYQVSGEYAMLQAAVAN
                   250       260       270       280       290       300

                   310       320       330      339
m610.pep    GWLDGGKVVLESLLAFKRAGADGILTYYAIEAAKMLKRX
            |||||||||||||||||||||||||||||||||||||||
a610        GWLDGGKVVLESLLAFKRAGADGILTYYAIEAAKMLKRX
                   310       320       330
```

The following partial DNA sequence was identified in *N. gonorrhoeae* <SEQ ID 1943>:

<u>g611.seq</u>

```
  1 ATGCCGTCTG AAAACGGGAT GGGAAAACGG CAGCTTGCGG GCTGCCGTTT

 51 GTTCGGGAAG TTAAGCCTTG TTTTCAGGCT GCTGCCCGGA CTCTGTCGAG

101 GCGGTGTCTG CCGGGGCAGG TGCTTCGGTT TTTTCCCGAG TCGGAGCGTG

151 CGGCGCGTTA TCTTCCGCCG CGTCCGCATT Ctcgcgcagg ttgtGGCtgt

201 tatcctTGGG CGGGCTGggt tgtttgcccg ccataaTTtc cagtacctgA

251 TcgcgGTCta tggtttcCCa ttCcatcagg gctttgcaca TCGTTTCCAT

301 cttgTCGCGG TTTTcatcga ggaTTTTGTA ggcaacCTGA TACTgctcgt

351 ccaaaAtccg Gcggatttcc gcgtcgAtgt cctgctgggt tTTCTCGGAA

401 ATGTTTTGCG AACGGgttac gctGCGCCCC AAGAAGACTT CGCCTTCGTT

451 TTCCGCATAA ACCATCACGC CCATTTTGtc gCTCAtgcCG TAGCGCGTTA

501 CCATTTCGCG TGCCATTTGG GTTGCGCGTT CAAAGTCGTT TGA
```

This corresponds to the amino acid sequence <SEQ ID 1944; ORF 611.ng>:

g611.pep

```
  1 MPSENGMGKR QLAGCRLFGK LSLVFRLLPG LCRGGVCRGR CFGFFPSRSV
 51 RRVIFRRVRI LAQVVAVILG RAGLFARHNF QYLIAVYGFP FHQGFAHRFH
101 LVAVFIEDFV GNLILLVQNP ADFRVDVLLG FLGNVLRTGY AAPQEDFAFV
151 FRINHHAHFV AHAVARYHFA CHLGCAFKVV *
```

The following partial DNA sequence was identified in *N. meningitidis* <SEQ ID 1945>:

m611.seq

```
  1 ATGCCGTCTG AAAACGGGAT GGGAAAACGG CAGCTTGCGG GCTGCCGTTT
 51 GTTCGGGAAG TTAAGCCTTG TTTTCAGGCT GCTGCTCGGA CTCTGTCGAA
101 GCGGTGTCTG CCGGGGCAGG TGCTTCGGTT TCTTCCCGAG TCGGAGCGTG
151 CGGCGCGTTA TCTTCCGCCG CGTCCGCATT CTCGCGCAGG TTGTGGCTGT
201 AATCTTTGGG CGGGCTGGGT TGTTTGCCCG CCATGATTTC CAGTACCTGA
251 TCGCGGTCGA TGGTTTCCCA TTCCATCAGG GCTTTGCACA TCGTTTCCAT
301 CTTGTCGCGG TTTTCATCGA GGATTTTGTA GGCAACCTGA TATTGCTCGT
351 CCAAAATCCG GCGGATTTCC GCGTCGATGT CCTGCTGGGT TTTCTCGGAA
401 ATGTTTTGCG AACGGGTTAC GCTGCGTCCC AAGAAGACTT CGCCTTCGTT
451 TTCCGCATAA ACCATCACGC CCATTTTGTC GCTCATGCCG TAGCGCGTTA
501 CCATTTCGCG CGCCATTTGG GTTGCGCGTT CAAAGTCGTT TGA
```

This corresponds to the amino acid sequence <SEQ ID 1946; ORF 611>:

m611.pep

```
  1 MPSENGMGKR QLAGCRLFGK LSLVFRLLLG LCRSGVCRGR CFGFFPSRSV
 51 RRVIFRRVRI LAQVVAVIFG RAGLFARHDF QYLIAVDGFP FHQGFAHRFH
101 LVAVFIEDFV GNLILLVQNP ADFRVDVLLG FLGNVLRTGY AASQEDFAFV
151 FRINHHAHFV AHAVARYHFA RHLGCAFKVV *
```

m611/g611 96.1% identity in 180 aa overlap

```
                      10        20        30        40        50        60
m611.pep      MPSENGMGKRQLAGCRLFGKLSLVFRLLLGLCRSGVCRGRCFGFFPSRSVRRVIFRRVRI
              |||||||||||||||||||||||||||| ||||:||||||||||||||||||||||||||
g611          MPSENGMGKRQLAGCRLFGKLSLVFRLLPGLCRGGVCRGRCFGFFPSRSVRRVIFRRVRI
                      10        20        30        40        50        60

                      70        80        90       100       110       120
m611.pep      LAQVVAVIFGRAGLFARHDFQYLIAVDGFPFHQGFAHRFHLVAVFIEDFVGNLILLVQNP
              ||||||||:||||||||:||||||| ||||||||||||||||||||||||||||||||||
g611          LAQVVAVILGRAGLFARHNFQYLIAVYGFPFHQGFAHRFHLVAVFIEDFVGNLILLVQNP
                      70        80        90       100       110       120

                     130       140       150       160       170       180
m611.pep      ADFRVDVLLGFLGNVLRTGYAASQEDFAFVFRINHHAHFVAHAVARYHFARHLGCAFKVV
              |||||||||||||||||||||| |||||||||||||||||||||||||||| ||||||||
g611          ADFRVDVLLGFLGNVLRTGYAAPQEDFAFVFRINHHAHFVAHAVARYHFACHLGCAFKVV
                     130       140       150       160       170       180
```

-continued

```
m611.pep    X
            |
g611        X
```

The following partial DNA sequence was identified in *N. meningitidis* <SEQ ID 1947>:

a611.seq

```
  1 ATGCCGTCTG AAAACAGGAT GGGAAAACGG CAGCTTGCGG GCTGCCGTTT
 51 GTTCGGGAAG TTAAGCCTTG TTTTCAGGCT GCTGCTCGGA CTCTGTCGAA
101 GCGGTGTCTG CCGGGGCAGG TGCTTCGGTT TCTTCCCGAG TCGGAGCGTG
151 CGGCGCGTTA TCTTCCGCCG CGTCCGCATT CTCGCGCAGG TTGTGGCTGT
201 AATCTTTGGG CGGGCTGGGT TGTTTGCCCG CCATGATTTC CAGTACCTGA
251 TCGCGGTCGA TGGTTTCCCA TTCCATCAGG GCTTTGCACA TCGTTTCCAT
301 CTTGTCGCGG TTTTCATCGA GGATTTTGTA GGCAACCTGA TACTGCTCGT
351 CCAAAATCCG GCGGATTTCC GCATCGATGT CCTGCTGGGT TTTCTCGGAA
401 ATGTTTTGCG AACGGGTTAC GCTGCGTCCC AAGAAGACTT CGCCTTCGTT
451 TTCCGCATAA ACCATCACGC CCATTTTGTC GCTCATGCCG TAGCGCGTTA
501 CCATTTCGCG CGCCATTTGG GTTGCGCGTT CAAAGTCGTT TGA
```

This corresponds to the amino acid sequence <SEQ ID 1948; ORF 611.a>:

a611.pep

```
  1 MPSENRMGKR QLAGCRLFGK LSLVFRLLLG LCRSGVCRGR CFGFFPSRSV
 51 RRVIFRRVRI LAQVVAVIFG RAGLFARHDF QYLIAVDGFP FHQGFAHRFH
101 LVAVFIEDFV GNLILLVQNP ADFRIDVLLG FLGNVLRTGY AASQEDFAFV
151 FRINHHAHFV AHAVARYHFA RHLGCAFKVV *
```

m611/a611 98.9% identity in 180 aa overlap

```
                    10        20        30        40        50        60
m611.pep    MPSENGMGKRQLAGCRLFGKLSLVFRLLLGLCRSGVCRGRCFGFFPSRSVRRVIFRRVRI
            ||||| ||||||||||||||||||||||||||||||||||||||||||||||||||||||
a611        MPSENRMGKRQLAGCRLFGKLSLVFRLLLGLCRSGVCRGRCFGFFPSRSVRRVIFRRVRI
                    10        20        30        40        50        60
                    70        80        90       100       110       120
m611.pep    LAQVVAVIFGRAGLFARHDFQYLIAVDGFPFHQGFAHRFHLVAVFIEDFVGNLILLVQNP
            ||||||||||||||||||||||||||||||||||||||||||||||||||||||||||||
a611        LAQVVAVIFGRAGLFARHDFQYLIAVDGFPFHQGFAHRFHLVAVFIEDFVGNLILLVQNP
                    70        80        90       100       110       120
                   130       140       150       160       170       180
m611.pep    ADFRVDVLLGFLGNVLRTGYAASQEDFAFVFRINHHAHFVAHAVARYHFARHLGCAFKVV
            ||||:|||||||||||||||||||||||||||||||||||||||||||||||||||||||
a611        ADFRIDVLLGFLGNVLRTGYAASQEDFAFVFRINHHAHFVAHAVARYHFARHLGCAFKVV
                   130       140       150       160       170       180

m611.pep    X
            |
a611        X
```

The following partial DNA sequence was identified in *N. gonorrhoeae* <SEQ ID 1949>:

g612.seq

```
  1 ATGGgcttcg gcggcaatat tgcAAAAAAG CTGGCcggGg taGATGAAAT
 51 AGCCTttgac tttgacggcA TCGTCTTTGA TTTCGGGCGT GATGATGCTG
101 TCCGGCataG CGGCGTAATC AATGCTGCTG TCGCCGGCCT GCATATAGTC
151 GGTGAAGTTT TCGCTGATAA AGCGGTAGAA AAGTGTGCCG AGAACGTATT
201 GTTTAAAGTC CCAGCCATCC ACCGCGCCGC GTACTTCGTC GGCGATTTTC
251 CAAATTTGGC GGTGCAGTTG GGCGCGTTGT TGCATTTCGG TCATCATCGA
301 AATCCATATA TAAAGTTAAA CAAATCAAAA TCGCCTGATA TTTTCAGACG
351 ATTTTTTTAC GGGCATTCAA ATTAA
```

This corresponds to the amino acid sequence <SEQ ID 1950; ORF 612.ng>:

g612.pep

```
  1 MGFGGNIAKK LAGVDEIAFD FDGIVFDFGR DDAVRHSGVI NAAVAGLHIV
 51 GEVFADKAVE KCAENVLFKV PAIHRAAYFV GDFPNLAVQL GALLHFGHHR
101 NPYIKLNKSK SPDIFRRFFY GHSN*
```

The following partial DNA sequence was identified in *N. meningitidis* <SEQ ID 1951>:

m612.seq

```
  1 ATGGGCTTCG GCGGCAATAT TGCAAAAAAG CTGGCCGGGG TAGATGAAAT
 51 AGCCTTTAAC TTTGACGGCA TCGTCTTTGA TTTCGGGCGT GATGATGCTG
101 TCCGGCATAG CGGCGTAATC AATACTGCTG TCGCCTGCCT GCATATAGTC
151 GGTGAAGTTT TCGCTGATAA AGCGGTAGAA AAGTGTGCCG AGAACGTATT
201 GTTTAAAGTC CCAGCCATCC ACCGCGCCGC GTACTTCGTC GGCAATTTTC
251 CAAATTTGGC GGTGCAGTTG GGCGCGTTGT TGCATTTCGG TCATCATCGA
301 AATCCATATA .AAAGTTAAA CAAATCAAAA TCGCCTGATA TTTTCAGACG
351 ATTTTTTTAC GGGCATTCAA ATTAA
```

This corresponds to the amino acid sequence <SEQ ID 1952; ORF 612>:

m612.pep

```
  1 MGFGGNIAKK LAGVDEIAFN FDGIVFDFGR DDAVRHSGVI NTAVACLHIV
 51 GEVFADKAVE KCAENVLFKV PAIHRAAYFV GNFPNLAVQL GALLHFGHHR
101 NPYXKLHKSK SPDIFRRFFY GHSN*
```

m612/g612 96.0% identity in 124 aa overlap

```
                    10        20        30        40        50        60
m612.pep    MGFGGNIAKKLAGVDEIAFNFDGIVFDFGRDDAVRHSGVINTAVACLHIVGEVFADKAVE
            |||||||||||||||||||:|||||||||||||||||||||:||| ||||||||||||||
g612        MGFGGNIAKKLAGVDEIAFDFDGIVFDFGRDDAVRHSGVINAAVAGLHIVGEVFADKAVE
                    10        20        30        40        50        60
                    70        80        90       100       110       120
m612.pep    KCAENVLFKVPAIHRAAYFVGNFPNLAVQLGALLHFGHHRNPYXKLNKSKSPDIFRRFFY
            |||||||||||||||||||||:||||||||||||||||||||| ||||||||||||||||
g612        KCAENVLFKVPAIHRAAYFVGDFPNLAVQLGALLHFGHHRNPYIKLNKSKSPDIFRRFFY
                    70        80        90       100       110       120

m612.pep    GHSNX
            |||||
g612        GHSNX
```

The following partial DNA sequence was identified in *N. meningitidis* <SEQ ID 1953>:

a612.seq

```
  1 ATGGGCTTCG GCGGCAATAT TGCAAAAAAG CTGGCCGGGG TAGATGAAAT
 51 AGCCTTTGAC TTTGACGGCA TCGTCTTTGA TTTCGGGCGT GATGATGCTG
101 TCCGGCATAG CGGCGTAATC AATACTGCTG TCGCCTGCCT GCATATAGTC
151 GGTAAAGTTT TCGCTGATAA AGCGGTAGAA AAGTGTGCCG AGAACGTATT
201 GTTTGAAGTC CCAGCCATCC ACCGCGCCGC GTACTTCGTC GGCAATTTTC
251 CAAATTTGGC GGTGCAGTTG GGCGCGTTGT TGTATTTCGG TCATCATCGA
301 AATCCATAT. AAAAGTTAAA CAAATCAAAA TCGCCTGATA TTTTCAGACG
351 ATTTTTT.AC GGGCATTCAA ATTAA
```

This corresponds to the amino acid sequence <SEQ ID 1954; ORF 612.a>:

a612.pep

```
  1 MGFGGNIAKK LAGVDEIAFD FDGIVFDFGR DDAVRHSGVI NTAVACLHIV
 51 GKVFADKAVE KCAENVLFEV PAIHRAAYFV GNFPNLAVQL GALLYFGHHR
101 NPYXKLNKSK SPDIFRRFFX GHSN*
```

m612/a612 96.0% identity in 124 aa overlap

```
                    10        20        30        40        50        60
m612.pep    MGFGGNIAKKLAGVDEIAFNFDGIVFDFGRDDAVRHSGVINTAVACLHIVGEVFADKAVE
            |||||||||||||||||||:|||||||||||||||||||||||||||||||:||||||||
a612        MGFGGNIAKKLAGVDEIAFDFDGIVFDFGRDDAVRHSGVINTAVACLHIVGKVFADKAVE
                    10        20        30        40        50        60
                    70        80        90       100       110       120
m612.pep    KCAENVLFKVPAIHRAAYFVGNFPNLAVQLGALLHFGHHRNPYXKLNKSKSPDIFRRFFY
            ||||||||:|||||||||||||||||||||||||:||||||||||||||||||||||||
a612        KCAENVLFEVPAIHRAAYFVGNFPNLAVQLGALLYFGHHRNPYXKLNKSKSPDIFRRFFX
                    70        80        90       100       110       120

m612.pep    GHSNX
            |||||
a612        GHSNX
```

The following partial DNA sequence was identified in *N. gonorrhoeae* <SEQ ID 1955>:

g613.seq

```
  1 ATGTCGCGTT CGAGCCTGTC GAGGCGTTCG TTGAGGCGTT CCACGCCGTC
 51 GCGCAGTCTG CTTATTTCGT CGaggcagtc ggcaagggct tcgttgccgg
101 tgtttGcgGA CTCGGGTTCG CGGGAAAATC CGCCGATTTG TTCGGCGATG
151 TTCCTGCCGA TTTgtttGAt GCCGTGTCCG ATGTCGGTGG CACGgctgcc
201 gatgcCTGCC TGCGTGCCGA AAATCCGTGC CAATTcgtCC GATGCGCGGG
251 AACGCAGGCT GCCGAGCAGG GACAGTACCG CgATGCCGAG GATGAGGTCG
301 CCTTCGAGCC TGATGTCGCC AGCCCCGGGT TCGCCGCCTT GGAGGATTTT
351 CCGTATCGCG CTGTTGCGGA AGGTAATTTC GGTGTCTGCA AAGCCGTTTC
401 CCGCCGAGAG CAAACCGTCT TCTGTGATGC GTCCCGCCAG TTTCAGCCCG
451 GCAATGTTCA GGGTCAGTGT TTTGCCTGCA AAGGAGGTAA GTTCCGAGCG
501 GCTGTCCGGG CTTTGCAGAA TCAGGCGGTT GATGATGGGG AGGAGGGCGG
551 ACATATTTTC TGATTGGGGC GGAGAATGCC TGTTGTTGCT GTTGCCGCTT
601 ATTTTACAGG CTTAA
```

This corresponds to the amino acid sequence <SEQ ID 1956; ORF 613.ng>:

g613.pep

```
  1 MSRSSLSRRS LRRSTPSRSL LISSRQSARA SLPVFADSGS RENPPICSAM
 51 FLPICLMPCP MSVARLPMPA CVPKIRANSS DARERRLPSR DSTAMPRMRS
101 PSSLMSPAPG SPPWRIFRIA LLRKVISVSA KPFPAESKPS SVMRPASFSP
151 AMFRVSVLPA KEVSSERLSG LCRIRRLMMG RRADIFSDWG GECLLLLLPL
201 ILQA*
```

The following partial DNA sequence was identified in *N. meningitidis* <SEQ ID 1957>:

m613.seq

```
  1 ATGTCGCGTT CGAGCCGGTC GAGGCGTTCG TTGAGGCGTT CCACGCCGTC
 51 GCGCAGTCTG CTTATTTCGT CGAGGCAGTC GGCAAGGGCT TCGTTGCCGA
101 TGTTTGCGGA CTCGGATTCG CGGGAAAATC CGCCGATTTG TTCGGCGATG
151 TTCCTGCCGA TTTGTTTGAT GCCGTGTCCG ATGTCGGCGG CACGGCTGCC
201 GATGTCTGCC TGCGTGCCGA AAATCCGTGC CAATTCGTCC GATGCGCGGG
251 AACGCAGGCT GCCGAGCAGG GACAGTACCG CGATGCCGAG GATGAGGTCG
301 CCTTCGAGCC CGATGTCGCC CGCCCCGGGT TCGCCTCCTT GGAGGATTTT
351 CTGTACCGCG CTGTTGCGGA AGGTAATTTC GGTGTCTGCA AAGCCGTTTC
401 CCGCCGAGAG CAAACCGTCT TCCGTGATGC GTCCCGCCAG TTTCAGCCCG
451 GCAATGTTCA GGGTCAGTGT TTTGCCTGCA AAGGCGGCAA GTTCCGAGCG
501 GCTGTCCGGG CTTTGCAGAA TCAGGCGGTT GATGATGGGG AGGAGGGCGG
551 ACATATTTTC TGATCGGGGC GGAGAATGCC TGTTGTTGCT GTTGCCGCTT
601 ATTTTACAGG CTTAA
```

This corresponds to the amino acid sequence <SEQ ID 1958; ORF 613>:

m613.pep

```
  1 MSRSSRSRRS LRRSTPSRSL LISSRQSARA SLPMFADSDS RENPPICSAM

 51 FLPICLMPCP MSAARLPMSA CVPKIRANSS DARERRLPSR DSTAMPRMRS

101 PSSPMSPAPG SPPWRIFCTA LLRKVISVSA KPFPAESKPS SVMRPASFSP

151 AMFRVSVLPA KAASSERLSG LCRIRRLMMG RRADIFSDRG GECLLLLLPL

201 ILQA*
```

Computer analysis of this amino acid sequence gave the following results:

Homology with a predicted ORF from *N. gonorrhoeae* m613/g613 94.6% identity in 204 aa overlap

```
                    10        20        30        40        50        60
m613.pep    MSRSSRSRRSLRRSTPSRSLLISSRQSARASLPMFADSDSRENPPICSAMFLPICLMPCP
            ||||| ||||||||||||||||||||||||||||:|||| ||||||||||||||||||||
g613        MSRSSLSRRSLRRSTPSRSLLISSRQSARASLPVFADSGSRENPPICSAMFLPICLMPCP
                    10        20        30        40        50        60

                    70        80        90       100       110       120
m613.pep    MSAARLPMSACVPKIRANSSDARERRLPSRDSTAMPRMRSPSSPMSPAPGSPPWRIFCTA
            ||:||||| |||||||||||||||||||||||||||||||||| |||||||||||||  |
g613        MSVARLPMPACVPKIRANSSDARERRLPSRDSTAMPRMRSPSSLMSPAPGSPPWRIFRIA
                    70        80        90       100       110       120

                   130       140       150       160       170       180
m613.pep    LLRKVISVSAKPFPAESKPSSVMRPASFSPAMFRVSVLPAKAASSERLSGLCRIRRLMMG
            ||||||||||||||||||||||||||||||||||||||||| :|||||||||||||||||
g613        LLRKVISVSAKPFPAESKPSSVMRPASFSPAMFRVSVLPAKEVSSERLSGLCRIRRLMMG
                   130       140       150       160       170       180

                   190       200
m613.pep    RRADIFSDRGGECLLLLLPLILQAX
            |||||||| ||||||||||||||||
g613        RRADIFSDWGGECLLLLLPLILQAX
                   190       200
```

The following partial DNA sequence was identified in *N. meningitidis* <SEQ ID 1959>:

a613.seq

```
  1 ATGTCGCGTT CGAGCCGGTC GAGGCGTTCG TTGAGGCGTT CCACGCCGTC

 51 GCGCAGTCTG CTTATTTCGT CGAGGCAGTC GGCAAGGGCT TCGTTGCCGA

101 TGTTTGCGGA CTCGGGTTCG CGGGAAAATC TGCCGATTTG TTCGGCGATG

151 TTCCTGCCGA TTTGTTTGAT GCCGTGTCCG ATGTCGGCGG CACGGCTGCC

201 GATGTCTGCC TGCGTGCCGA AAATCCGTGC CAATTCGTCC GATGCGCGGG

251 AACGCAGGCT GCCGAGCAGG GACAGTACCG CGATGCCGAG GATGAGGTCG

301 CCTTCGAGCC CGATGTCGCC CGCCCCGGGT TCGCCGCCTT GGAGGATTTT

351 CTGTACCGCG CTGTTGCGGA AGGTGATTTC GGTGTCTGCA AAGCCGTTTC

401 CCGCCGAGAG CAAACCGTCT TCCGTGATGC GTCCCGCCAG TTTCAACCCG

451 GCAATGTTCA GGGTCAGTGT TTTGCCTGCG AAGGCGGCAA GTTCCGAGCG

501 GCTGTCCGGG CTTTGCAGAA TCAGGCGGTT GATGATGGGG AGGAGGGCGG

551 ACATATTTTC TGATCGGGGC GGAGAATGCC TGTTGTTGCT GTTGACGCTT

601 ATTTTACAGG CTTAA
```

This corresponds to the amino acid sequence <SEQ ID 1960; ORF 613.a>:

a613.pep

```
  1 MSRSSRSRRS LRRSTPSRSL LISSRQSARA SLPMFADSGS RENLPICSAM

 51 FLPICLMPCP MSAARLPMSA CVPKIRANSS DARERRLPSR DSTAMPRMRS

101 PSSPMSPAPG SPPWRIFCTA LLRKVISVSA KPFPAESKPS SVMRPASFNP

151 AMFRVSVLPA KAASSERLSG LCRIRRLMMG RRADIFSDRG GECLLLLLTL

201 ILQA*
```

m613/a613 98.0% identity in 204 aa overlap

```
                    10        20        30        40        50        60
m613.pep    MSRSSRSRRSLRRSTPSRSLLISSRQSARASLPMFADSDSRENPPICSAMFLPICLMPCP
            ||||||||||||||||||||||||||||||||||||| |||| |||||||||||||||||
a613        MSRSSRSRRSLRRSTPSRSLLISSRQSARASLPMFADSGSRENLPICSAMFLPICLMPCP
                    10        20        30        40        50        60

                    70        80        90       100       110       120
m613.pep    MSAARLPMSACVPKIRANSSDARERRLPSRDSTAMPRMRSPSSPMSPAPGSPPWRIFCTA
            ||||||||||||||||||||||||||||||||||||||||||||||||||||||||||||
a613        MSAARLPMSACVPKIRANSSDARERRLPSRDSTAMPRMRSPSSPMSPAPGSPPWRIFCTA
                    70        80        90       100       110       120

                   130       140       150       160       170       180
m613.pep    LLRKVISVSAKPFPAESKPSSVMRPASFSPAMFRVSVLPAKAASSERLSGLCRIRRLMMG
            ||||||||||||||||||||||||||||:|||||||||||||||||||||||||||||||
a613        LLRKVISVSAKPFPAESKPSSVMRPASFNPAMFRVSVLPAKAASSERLSGLCRIRRLMMG
                   130       140       150       160       170       180

                   190       200
m613.pep    RRADIFSDRGGECLLLLLPLILQAX
            ||||||||||||||||| ||||||
a613        RRADIFSDRGGECLLLLLTLILQAX
                   190       200
```

The following partial DNA sequence was identified in *N. gonorrhoeae* <SEQ ID 1961>:

g614.seq

```
  1 AtggcTgcgt tcAacgcttt ggacggcaaa aaagaagaca acgggcaaat

 51 cgaaTATTCT CAGTTCATCC GACAGGTCAA CAACGGCGAA GTATCCGGCG

101 TCAACATCGA AGGATCCGTC GTCAGCGGTT ACCTGATTAA AGGCGAGCGC

151 ACCGACAAAA GCACCTTCTT CACCAACGCG CCCTTGGATG ACAACCTGAT

201 TCAAACCCTT TTGAACAAAA ACGTCCGCGT AAAAGTAACG CCGGAAGAAA

251 AACCGAGCGC GCTGACTGCC CTGTTTTACA GCCTGCTGCC CGTCCTGCTG

301 CTGATTGGCG CATGGTTCTA CTTTATGCGT ATGCAGGCGG GCGGCGGCGG

351 AAAAGGCGGC GCATTCTCCT TCGGCAAAAG CCGCGCCCGC CTGCTGGACA

401 AAGATGCCAA CAAAGTTACC TTTGCCGATG TCGCCGGCTG CGACGAAGCC

451 AAAGAAGAAG TGCAGGAAAT CGTCGATTAC CTCAAAGCAC CGAACCGCta

501 tcaAAGcctc ggcggccgtg ttcCGCGCGG CATCCtgCtg gcgGgcagcc

551 CGGGAaccgg taaAACACTC TTGGCGAAAG CCATTGCAGG CGAGGCCGGC

601 GTGCCGTTCT TCAGCATTTC CGGTTCCGAT TTTGTCGAAA TGTTCGTCGG

651 TGTCGGTGCA AGCCGCGTCC GCGATATGTT CGAGCAGGCA AAGAAAAACG

701 CCCCATGCAT TATCTTTATC GACGAGATTG ACGCGGTAGG CCGCCAACGC
```

-continued

```
 751 GGCGCAGgTT TGGGCGGCGG CAATGATGAG CGCGAGCAAA CATTAAACCA

 801 ATTATTGGTT GAAATGGACG GTTTTGAGAG CAATCAGACT GTAATTGTGA

 851 TTGCGGCAAC CAACCGCCCC GACGTACTCG ATCCTGCGCT GCAACGCCCC

 901 GGCCGCTTCG ACCGCCAAGT CGTCGTCCCC CTGCCGGACA TCCGGGGGCG

 951 CGAACAGatn ttGAACGTCC ATTCtaaAAA AGTGCcttTG gacgaATCTg

1001 tggaTTTATT GTCCCTCGCG CGCGGCACGC ccggtttTTc cggcgcggat

1051 tTggcgaaac tggtcaacga agcccccctg tttgccggcc gccgcaacaa

1101 agtgaaagtc gatcaaagcg attTGAAGAC GCCAAAGACA AAATCTATAT

1151 GGGTCCGGAA CGCCGCAGTA TGGTGA
```

This corresponds to the amino acid sequence <SEQ ID 1962; ORF 614.ng>:

g614.pep

```
  1 MAAFNALDGK KEDNGQIEYS QFIRQVNNGE VSGVNIEGSV VSGYLIKGER

 51 TDKSTFFTNA PLDDNLIQTL LNKNVRVKVT PEEKPSALTA LFYSLLPVLL

101 LIGAWFYFMR MQAGGGGKGG AFSFGKSRAR LLDKDANKVT FADVAGCDEA

151 KEEVQEIVDY LKAPNRYQSL GGRVPRGILL AGSPGTGKTL LAKAIAGEAG

201 VPFFSISGSD FVEMFVGVGA SRVRDMFEQA KKNAPCIIFI DEIDAVGRQR

251 GAGLGGGNDE REQTLNQLLV EMDGFESNQT VIVIAATNRP DVLDPALQRP

301 GRFDRQVVVP LPDIRGREQX LNVHSKKVPL DESVDLLSLA RGTPGFSGAD

351 LAKLVNEAPL FAGRRNKVKV DQSDLKTPKT KSIWVRNAAV W*
```

The following partial DNA sequence was identified in *N. meningitidis* <SEQ ID 1963>:

m614.seq

```
  1 ATGGCTGCGT TCAACGCTTT AGACGGTAAA AAAGAAGACA ACGGGCAAAT

 51 CGAATACTCT CAGTTCATCC AACAGGTCAA CAACGGCGAA GTATCCGGCG

101 TCAACATCGA AGGATCCGTC GTCAGCGGCT ACCTGATTAA GGGCGAGCGC

151 ACCGACAAAA GCACTTTCTT CACCAACGCG CCTTTGGACG ACAACCTAAT

201 TAAAACACTG CTCGACAAAA ACGTCCGCGT AAAAGTAACG CCGGAAGAAA

251 AACCGAGCGC GCTGGCTGCC CTGTTTTACA GCCTGCTGCC CGTCCTGCTG

301 CTGATTGGCG CATGGTTCTA CTTCATGCGT ATGCAGACGG GCGGCGGCGG

351 AAAAGGCGGC GCATTCTCAT TCGGTAAAAG CCGCGCCCGC CTGCTGGACA

401 AAGATGCCAA CAAAGTGACC TTTGCCGATG TCGCCGGCTG CGACGAAGCC

451 AAAGAAGAAG TACAGGAAAT CGTCGATTAC CTCAAAGCGC CGAACCGCTA

501 TCAAAGCCTG GGCGGGCGCG TGCCGCGCGG CATCCTGCTG GCGGGCAGCC

551 CGGGTACGGG TAAGACGCTT TTGGCGAAAG CGATTGCAGG CGAAGCCGGC

601 GTGCCGTTCT TCAGCATTTC AGGTTCCGAC TTTGTCGAAA TGTTCGTCGG

651 TGTCGGTGCG AGCCGCGTCC GCGATATGTT CGAGCAGGCG AAGAAAAACG

701 CCCCCTGCAT CATCTTTATC GACGAGATTG ACGCAGTCGG CCGCCAACGC
```

-continued

```
 751 GGCGCAGGTT TGGGCGGCGG CAATGATGAG CGCGAGCAAA CATTAAACCA

 801 ATTGTTGGTT GAAATGGACG GTTTTGAGAG CAATCAGACT GTAATTGTGA

 851 TTGCGGCAAC CAACCGCCCC GACGTACTCG ATCCTGCGCT GCAACGCCCC

 901 GGCCGTTTCG ACCGCCAAGT GGTTGTCCCC CTGCCGGACA TCCGAGGGCG

 951 CGAACAGATT TTGAACGTCC ATTCTAAAAA AGTGCCTTTG GACGAATCTG

1001 TGGATTTATT GTCCCTCGCG CGCGGCACGC CGGGTTTTTC CGGCGCGGAT

1051 TTGGCGAACT TGGTCAACGA AGCCGCCCTG TTTGCCGGCC GCCGCAATAA

1101 AGTCAAAGTC GATCAGAGCG ATTTGAAGAC GCCAAAGACA AAATCTATAT

1151 GGGTCCGGAA CGCCGCAGTA TGGTGA
```

This corresponds to the amino acid sequence <SEQ ID 1964; ORF 614>:

m614.pep

```
  1 MAAFNALDGK KEDNGQIEYS QFIQQVNNGE VSGVNIEGSV VSGYLIKGER

 51 TDKSTFFTNA PLDDNLIKTL LDKNVRVKVT PEEKPSALAA LFYSLLPVLL

101 LIGAWFYFMR MQTGGGGKGG AFSFGKSRAR LLDKDANKVT FADVAGCDEA

151 KEEVQEIVDY LKAPNRYQSL GGRVPRGILL AGSPGTGKTL LAKAIAGEAG

201 VPFFSISGSD FVEMFVGVGA SRVRDMFEQA KKNAPCIIFI DEIDAVGRQR

251 GAGLGGGNDE REQTLNQLLV EMDGFESNQT VIVIAATNRP DVLDPALQRP

301 GRFDRQVVVP LPDIRGREQI LNVHSKKVPL DESVDLLSLA RGTPGFSGAD

351 LANLVNEAAL FAGRRNKVKV DQSDLKTPKT KSIWVRNAAV W*
```

Computer analysis of this amino acid sequence gave the following results:

Homology with a predicted ORF from *N. gonorrhoeae* m614/g614 98.0% identity in 391 aa overlap

```
                      10        20        30        40        50        60
m614.pep      MAAFNALDGKKEDNGQIEYSQFIQQVNNGEVSGVNIEGSVVSGYLIKGERTDKSTFFTNA
              |||||||||||||||||||||||:||||||||||||||||||||||||||||||||||||
g614          MAAFNALDGKKEDNGQIEYSQFIRQVNNGEVSGVNIEGSVVSGYLIKGERTDKSTFFTNA
                      10        20        30        40        50        60

                      70        80        90       100       110       120
m614.pep      PLDDNLIKTLLDKNVRVKVTPEEKPSALAALFYSLLPVLLLIGAWFYFMRMQTGGGGKGG
              |||||||:|||:||||||||||||||||:|||||||||||||||||||||||:|||||||
g614          PLDDNLIQTLLNKNVRVKVTPEEKPSALTALFYSLLPVLLLIGAWFYFMRMQAGGGGKGG
                      70        80        90       100       110       120

                     130       140       150       160       170       180
m614.pep      AFSFGKSRARLLDKDANKVTFADVAGCDEAKEEVQEIVDYLKAPNRYQSLGGRVPRGILL
              ||||||||||||||||||||||||||||||||||||||||||||||||||||||||||||
g614          AFSFGKSRARLLDKDANKVTFADVAGCDEAKEEVQEIVDYLKAPNRYQSLGGRVPRGILL
                     130       140       150       160       170       180

                     190       200       210       220       230       240
m614.pep      AGSPGTGKTLLAKAIAGEAGVPFFSISGSDFVEMFVGVGASRVRDMFEQAKKNAPCIIFI
              ||||||||||||||||||||||||||||||||||||||||||||||||||||||||||||
g614          AGSPGTGKTLLAKAIAGEAGVPFFSISGSDFVEMFVGVGASRVRDMFEQAKKNAPCIIFI
                     190       200       210       220       230       240

                     250       260       270       280       290       300
m614.pep      DEIDAVGRQRGAGLGGGNDEREQTLNQLLVEMDGFESNQTVIVIAATNRPDVLDPALQRP
              ||||||||||||||||||||||||||||||||||||||||||||||||||||||||||||
g614          DEIDAVGRQRGAGLGGGNDEREQTLNQLLVEMDGFESNQTVIVIAATNRPDVLDPALQRP
                     250       260       270       280       290       300
```

-continued

```
                310         320         330         340         350         360
m614.pep   GRFDRQVVVPLPDIRGREQILNVHSKKVPLDESVDLLSLARGTPGFSGADLANLVNEAAL
           ||||||||||||||||||||||||||||||:||||||||||||||||||||:|||||||
g614       GRFDRQVVVPLPDIRGREQILNVHSKKVPLDKSVDLLSLARGTPGFSGADLAKLVNEAAL
                310         320         330         340         350         360

                370         380         390
m614.pep   FAGRRNKVKVDQSDLKTPKTKSIWVRNAAVWX
           ||||||||||||||||||||||||||||||||
g614       FAGRRNKVKVDQSDLKTPKTKSIWVRNAAVWX
                370         380         390
```

The following partial DNA sequence was identified in *N. meningitidis* <SEQ ID 1965>:

a614.seq

```
   1 ATGGCTGCGT TCAACGCTTT AGACGGTAAA AAAGAAGACA ACGGGCAAAT
  51 CGAATATTCT CAGTTCATCC AACAGGTCAA CAACGGCGAA GTATCCGGCG
 101 TCAACATCGA AGGATCCGTC GTCAGCGGCT ACCTGATTAA GGGCGAGCGC
 151 ACCGACAAAA GCACCTTCTT CACCAACGCG CCTTTGGACG ACAACCTGAT
 201 TAAAACACTG CTCGACAAAA ACGTCCGTGT AAAAGTAACG CCGGAAGAAA
 251 AACCGAGCGC GCTGGCTGCC CTGTTTTACA GCCTGCTGCC CGTCCTGCTG
 301 CTGATTGGCG CGTGGTTCTA CTTTATGCGT ATGCAGACGG GCGGCGGCGG
 351 AAAAGGCGGC GCATTCTCAT TCGGCAAAAG CCGCGCCCGC CTACTGGACA
 401 AAGATGCCAA CAAAGTTACC TTTGCCGATG TCGCCGGCTG CGACGAAGCC
 451 AAAGAAGAAG TGCAGGAAAT CGTCGATTAC CTCAAAGCGC CGAACCGCTA
 501 TCAAAGCCTG GGCGGGCGCG TGCCGCGCGG CATCCTGCTG GCGGGCAGCC
 551 CGGGTACGGG TAAGACGCTT TTGGCGAAAG CGATTGCAGG CGAAGCCGGC
 601 GTGCCGTTCT TCAGCATTTC AGGTTCCGAC TTTGTCGAAA TGTTCGTCGG
 651 TGTCGGTGCA AGCCGCGTCC GCGATATGTT CGAGCAGGCG AAGAAAAACG
 701 CCCCCTGCAT CATCTTTATC GACGAGATTG ACGCAGTCGG CCGCCAACGC
 751 GGCGCAGGTT TGGGCGGCGG TAATGATGAG CGCGAGCAAA CATTAAACCA
 801 ATTGTTGGTT GAAATGGACG GTTTTGAGAG CAATCAGACT GTAATTGTGA
 851 TTGCGGCAAC CAACCGCCCC GACGTACTCG ATCCTGCGCT GCAACGCCCC
 901 GGCCGTTTCG ACCGCCAAGT GGTTGTCCCC CTGCCGGACA TCCGGGGGCG
 951 CGAACAGATT TTGAACGTCC ACTCTAAAAA AGTGCCTTTG GACAAATCTG
1001 TGGATTTATT GTCCCTCGCG CGCGGCACGC CGGGTTTTTC CGGCGCGGAT
1051 TTGGCGAACT TGGTCAACGA AGCCGCCCTG TTTGCCGGCC GCCGCAATAA
1101 AGTCAAAGTC GATCAGAGCG ATTTGAAGAC GCCAAAGACA AAATCTATAT
1151 GGGTCCGGAA CGCCGCAGTA TGGTGA
```

This corresponds to the amino acid sequence <SEQ ID 1966; ORF 614.a>:

a614.pep

```
  1 MAAFNALDGK KEDNGQIEYS QFIQQVNNGE VSGVNIEGSV VSGYLIKGER
 51 TDKSTFFTNA PLDDNLIKTL LDKNVRVKVT PEEKPSALAA LFYSLLPVLL
```

-continued

```
101 LIGAWFYFMR MQTGGGGKGG AFSFGKSRAR LLDKDANKVT FADVAGCDEA

151 KEEVQEIVDY LKAPNRYQSL GGRVPRGILL AGSPGTGKTL LAKAIAGEAG

201 VPFFSISGSD FVEMFVGVGA SRVRDMFEQA KKNAPCIIFI DEIDAVGRQR

251 GAGLGGGNDE REQTLNQLLV EMDGFESNQT VIVIAATNRP DVLDPALQRP

301 GRFDRQVVVP LPDIRGREQI LNVHSKKVPL DKSVDLLSLA RGTPGFSGAD

351 LANLVNEAAL FAGRRNKVKV DQSDLKTPKT KSIWVRNAAV W*
```

m614/a614 99.7% identity in 391 aa overlap

```
                    10        20        30        40        50        60
m614.pep    MAAFNALDGKKEDNGQIEYSQFIQQVNNGEVSGVNIEGSVVSGYLIKGERTDKSTFFTNA
            ||||||||||||||||||||||||||||||||||||||||||||||||||||||||||||
a614        MAAFNALDGKKEDNGQIEYSQFIQQVNNGEVSGVNIEGSVVSGYLIKGERTDKSTFFTNA
                    10        20        30        40        50        60
                    70        80        90       100       110       120
m614.pep    PLDDNLIKTLLDKNVRVKVTPEEKPSALAALFYSLLPVLLLIGAWFYFMRMQTGGGGKGG
            ||||||||||||||||||||||||||||||||||||||||||||||||||||||||||||
a614        PLDDNLIKTLLDKNVRVKVTPEEKPSALAALFYSLLPVLLLIGAWFYFMRMQTGGGGKGG
                    70        80        90       100       110       120
                   130       140       150       160       170       180
m614.pep    AFSFGKSRARLLDKDANKVTFADVAGCDEAKEEVQEIVDYLKAPNRYQSLGGRVPRGILL
            ||||||||||||||||||||||||||||||||||||||||||||||||||||||||||||
a614        AFSFGKSRARLLDKDANKVTFADVAGCDEAKEEVQEIVDYLKAPNRYQSLGGRVPRGILL
                   130       140       150       160       170       180
                   190       200       210       220       230       240
m614.pep    AGSPGTGKTLLAKAIAGEAGVPFFSISGSDFVEMFVGVGASRVRDMFEQAKKNAPCIIFI
            ||||||||||||||||||||||||||||||||||||||||||||||||||||||||||||
a614        AGSPGTGKTLLAKAIAGEAGVPFFSISGSDFVEMFVGVGASRVRDMFEQAKKNAPCIIFI
                   190       200       210       220       230       240
                   250       260       270       280       290       300
m614.pep    DEIDAVGRQRGAGLGGGNDEREQTLNQLLVEMDGFESNQTVIVIAATNRPDVLDPALQRP
            ||||||||||||||||||||||||||||||||||||||||||||||||||||||||||||
a614        DEIDAVGRQRGAGLGGGNDEREQTLNQLLVEMDGFESNQTVIVIAATNRPDVLDPALQRP
                   250       260       270       280       290       300
                   310       320       330       340       350       360
m614.pep    GRFDRQVVVPLPDIRGREQILNVHSKKVPLDESVDLLSLARGTPGFSGADLANLVNEAAL
            ||||||||||||||||||||||||||||||||:|||||||||||||||||||||||||||
a614        GRFDRQVVVPLPDIRGREQILNVHSKKVPLDKSVDLLSLARGTPGFSGADLANLVNEAAL
                   310       320       330       340       350       360
                   370       380       390
m614.pep    FAGRRNKVKVDQSDLKTPKTKSIWVRNAAVWX
            ||||||||||||||||||||||||||||||||
a614        FAGRRNKVKVDQSDLKTPKTKSIWVRNAAVWX
                   370       380       390
```

The following partial DNA sequence was identified in *N. gonorrhoeae* <SEQ ID 1967>:

g615.seq

```
  1 ATGTGGAAAC GGCGGCGGCG CGGTGtcggC AGCTTtgaag agcagcGaAT

 51 agatgCCGCC GGCAAACCAC AATGCGGAAa gcaggCtgaa gcGGTTgcgC

101 GGCagcTTca tGCCGCCTCC TcGTCCaGCC ACGtttGgca gattttggac

151 aggcgcAGga ATTTGCcgCc gcgtgcggCA agtatgtcgc gcCAttgtgc

201 cacttcttcg gcggacggTG cttcgtcgaT gctgCATTCG TACagcagga

251 aatcgagggt ttcttcgatg acggGgatgg AttccgTTTG GataAgCTgc

301 ttgagttcgt tcatgactGt TCgGATAcgg aaatcgggaa aatgccgtct

351 gAaagggctt CAGACGGCat tggATTATTT GCTGTGCAGG AAgcgcgttg

401 cctcttccca tttgcCGGAA AtgATGTCGg gtacggcctg cAGGGATttg
```

-continued

```
 451 gCGACGGcat cgtcgatttg ccgGcggtgc ttCcgcgctc ggtttGTTca

 501 agacgtagcc gaCGACGagg ttgcggtcGC CGGGGtggcC GATGCCGAGG

 551 CGCAGGCGGt aatagtctgC CGTGCCGAGT TTTGCctgAA TGTCTTTCAA

 601 GCCGTTGTGT CcgcCGttgc cgcCGCCGAG TTTGAATTTg ATCCGTCCGC

 651 AAGGGATGTC GAGTTCGTCG TGGACGACGA GGATTTCTTC GGGTTTGATT

 701 TTGTAGAACT GTGCAAGCGC GGCAACCGCC TGTCCGGAAC GGTTCATGAA

 751 CGTGGCCGGT TTGAGCAGCC AAACATCGCC GTCGGGCAGG GCGGCGCGGG

 801 CAACTTCGCC GAAGAATTTT TTTTCTTCTT TAAACGAAGC CTTCCATTTC

 851 CACGCCAGTT CGTCGAGGAA CCAAAAGCCC GCATTGTGGC GGGTCTGTTC

 901 GTATTCTTTG CCCGGGTTGC CCAAGCCGAC AACCATTTTG ATTGTGttcg

 951 acatgataTT TtccgtgTTT CTgTCGaatg cggtCtgaAG GCTTCAGacg

1001 gcatggTtaT TCTTCTTgaT TTtgaACgcg tgtgcggCGC GCTTCTTTGG

1051 GGTCGATCAA CAGCGGGCGG TACACTTCGA TGCGGTCGCC GTCGCGCAGC

1101 GGCGTGTCGT CTTTGA
```

This corresponds to the amino acid sequence <SEQ ID 1968; ORF 615.ng>:

g615.pep

```
  1 MWKRRRRGVG SFEEQRIDAA GKPQCGKQAE AVARQLHAAS SSSHVWQILD

 51 RRRNLPPRAA SMSRHCATSS ADGASSMLHS YSRKSRVSSM TGMDSVWISC

101 LSSFMTVRIR KSGKCRLKGL QTALDYLLCR KRVASSHLPE MMSGTACRDL

151 ATASSICRRC FRARFVQDVA DDEVAVAGVA DAEAQAVIVC RAEFCLNVFQ

201 AVVSAVAAAE FEFDPSARDV EFVVDDEDFF GFDFVELCKR GNRLSGTVHE

251 RGRFEQPNIA VGQGGAGNFA EEFFFFFKRS LPFPRQFVEE PKARIVAGLF

301 VFFARVAQAD NHFDCVRHDI FRVSVECGLK ASDGMVILLD FERVCGALLW

351 GRSTAGGTLR CGRRRAAACR L*
```

The following partial DNA sequence was identified in *N. meningitidis* <SEQ ID 1969>:

m615.seq Length: 1116

```
  1 ATGCGGAAAA GGCGGTGGCG CGGTTTCGGC AGCTTTGAAA AGCAGTGAGT

 51 AAATGCTGCC TGCAAACCAC AATGCCGAGA GCAGGATAAA GCGGTTGCGT

101 GGCAGATTCA TGCTTGTTCC TCTTCAAGCC ATGTCTGGCA TAGTTTGGAT

151 AGGCGCAGGA ATTTTCCGCC GCGTGCGGCC AGCATATCGC GCCAAACGGC

201 AATTTCTTCG GCGGAGGGGG CATCGTCTAT GCTGCATTCG TAGAGCAGGA

251 AATCGAGGGT TTCTTCGATG ACGGGGATGG ATTCGGTTTG GATAAGCTGC

301 TTGAGTTCGG TCATGACTGT TCGGATATGG AAATCGGGAA CATGCCGTCT

351 GAAAGGGCTT CAGACGGCAT CGGGTCATTT GCTGTGCAGG AAGCGGGTTG

401 CTTCTTCCCA TTTGCCGGCA AGGATGTCGG GTATGGCTTG CAGGGATTTG

451 GCGACGGCAT CGTCAATCTG TCGGCGGTGT .TCCGTACTG GGTTTGTTCA
```

-continued

```
 501 GGACATAGCC GACGACGAGG TTGCGGTCGC CCGGGTGGCC GATGCCGAGG
 551 CGCAGGCGGT AATAGTCTGC CGTGCCGAGT TTTGCCTGAA TGTCTTTCAA
 601 GCCGTTGTGT CCGCCGTTGC CGCCGCCGAG TTTGAATTTG ATCCGTCCGC
 651 AGGGAATGTC GAGTTCGTCG TGGACGACGA GGATTTCTTC GGGTTTGATT
 701 TTGTAGAACT GTGCAAGCGC GGCAACTGCC TGTCCGGAAC GGTTCATGAA
 751 CGTGGCAGGT TTGAGCAGCC AAACGTCGCC GTCGGGCAGG GCGGCACGGG
 801 CGACTTCGCC GAAGAATTTT TTTTCTTCTT TAAATGAAGC CTTCCATTTC
 851 CACGCCAGTT CGTCGAGGAA CCAAAAACCC GCATTGTGGC GTGTCTGTTC
 901 GTATTCTTTG CCCGGGTTGC CCAAGCCGAC AACCATTTTG ATTGTGTTTG
 951 ACATGATATT TTCCGTGTTT CTGTCGAATG CTGTCTGAAG GCTTCAGACG
1001 GCATGGTTAT TCTTCTTGAT TTTGAACGCG TTTGCGGCGC GCTTCTTTGG
1051 GGTCGATCAA CAGCGGGCGG TACACTTCGA TGCGGTCGCC GTCGCGCAGC
1101 GGCGTGTCGT CTTTGA
```

This corresponds to the amino acid sequence <SEQ ID 1970; ORF 615>:

```
m615.pep Length: 372

  1 MRKRRWRGFG SFEKQXVNAA CKPQCREQDK AVAWQIHACS SSSHVWHSLD
 51 RRRNFPPRAA SISRQTAISS AEGASSMLHS XSRKSRVSSM TGMDSVWISC
101 LSSVMTVRIW KSGTCRLKGL QTASGHLLCR KRVASSHLPA RMSGMACRDL
151 ATASSICRRC XRTGFVQDIA DDEVAVARVA DAEAQAVIVC RAEFCLNVFQ
201 AVVSAVAAAE FEFDPSAGNV EFVVDDEDFF GFDFVELCKR GNCLSGTVHE
251 RGRFEQPNVA VGQGGTGDFA EEFFFFFKXS LPFPRQFVEE PKTRIVACLF
201 VFFARVAQAD NHFDCVXHDI FRVSVECCLK ASDGMVILLD FERVCGALLW
351 GRSTAGGTLR CGRRRAAACR L*
```

Computer analysis of this amino acid sequence gave the following results:

Homology with a predicted ORF from *N. gonorrhoeae* m615/g615 86.8% identity in 371 aa overlap

```
                    10        20        30        40        50        60
m615.pep    MRKRRWRGFGSFEKQXVNAACKPQCREQDKAVAWQIHACSSSSHVWHSLDRRRNFPPRAA
            | ||| || ||||:| ::|| |||| :| :||| |:|| |||||||: ||||||:|||||
g615        MwKRRRRGVGSFEEQRIDAAGKPQCGKQAEAVARQLHAASSSSHVWQILDRRRNLPPRAA
                    10        20        30        40        50        60

                    70        80        90       100       110       120
m615.pep    SISRQTAISSAEGASSMLHSXSRKSRVSSMTGMDSVWISCLSSVMTVRIWKSGTCRLKGL
            |:||: | |||:|||||||| |||||||||||||||||||||| ||||| ||| ||||||
g615        SMSRHCATSSADGASSMLHSYSRKSRVSSMTGMDSVWISCLSSFMTVRIRKSGKCRLKGL
                    70        80        90       100       110       120

                   130       140       150       160       170       180
m615.pep    QTASGHLLCRKRVASSHLPARMSGMACRDLATASSICRRCXRTGFVQDIADDEVAVARVA
            |||  :|||||||||||||  ||| ||||||||||||||| |: ||||:|||||||| ||
g615        QTALDYLLCRKRVASSHLPEMMSGTACRDLATASSICRRCFRARFVQDVADDEVAVAGVA
                   130       140       150       160       170       180

                   190       200       210       220       230       240
m615.pep    DAEAQAVIVCRAEFCLNVFQAVVSAVAAAEFEFDPSAGNVEFVVDDEDFFGFDFVELCKR
            ||||||||||||||||||||||||||||||||||||| :|||||||||||||||||||||
g615        DAEAQAVIVCRAEFCLNVFQAVVSAVAAAEFEFDPSARDVEFVVDDEDFFGFDFVELCKR
                   190       200       210       220       230       240
```

-continued

```
                 250       260       270       280       290       300
m615.pep   GNCLSGTVHERGRFEQPNVAVGQGGTGDFAEEFFFFFKXSLPFPRQFVEEPKTRIVACLF
           || |||||||||||||||:||||||:|:|||||||||| |||||||||||||:|||| ||
g615       GNRLSGTVHERGRFEQPNIAVGQGGAGNFAEEFFFFFKRSLPFPRQFVEEPKARIVAGLF
                 250       260       270       280       290       300

                 310       320       330       340       350       360
m615.pep   VFFARVAQADNHFDCVXHDIFRVSVECCLKASDGMVILLDFERVCGALLWGRSTAGGTLR
           |||||||||||||||| |||||||||| ||||||||||||||||||||||||||||||||
g615       VFFARVAQADNHFDCVRHDIFRVSVECGLKASDGMVILLDFERVCGALLWGRSTAGGTLR
                 310       320       330       340       350       360

                 370
m615.pep   CGRRRAAACRLX
           ||||||||||||
g615       CGRRRAAACRLX
                 370
```

The following partial DNA sequence was identified in *N. meningitidis* <*SEQ ID* 1971>:

a615.seq

```
   1 ATGCGGAAAC GGCGGCGGCG CGGTGTCGGC AGCTTTGAAG AGCAGCGAAT
  51 AGATGCCGCC GGCAAACCAC AATGCGGAAA GCAGGCTGAA GCGGTTGCGC
 101 GGCAGCTTCA TGCCGCCTCC TCGTCCAGCC ACGTTTGGCA GATTTTGGAC
 151 AGGCGCAGGA ATTTGCCGCC GCGTGCGGCA AGTATGTCGC GCCATTGTGC
 201 CACTTCTTCG GCGGATGGTG CGTCGTCGAT GCTGCATTCG TACAGCAGGA
 252 AATCGAGGGT TTCTTCGATG ACGGGGATGG ATTCGGTTTG GATAAGCTGC
 301 TTGAGTTCGG TCATGACTGT TCGGATATGG AAATCGGGAA CATGCCGTCT
 351 GAAAGGGCTT CAGACGGCAT CGGGTCATTT GCTGTGCAGG AAGCGGGTTG
 401 CCTCTTCACA TTTGCCGGCA AGGATGTCGG GTATGGCTTG CAGGGATTTG
 451 GCGACGGCAT CGTCAATCTG TCGGCGGTG. TTCCGTACTG GGTTTGTTCA
 501 GGACATAGCC GACGACGAGG TTGCGGTCGC CCGGGTGGCC GATGCCGAGG
 551 CGCAGGCGGT AATAGTCTGC CGTGCCGAGT TTTGCCTGAA TGTCTTTCAA
 601 GCCGTTGTGT CCACCGTTGC CGCCGCCGAG TTTGAATTTG ATCCGTCCGC
 651 AGGGAATGTC GAGTTCGTCG TGGACGACGA GGATTTCTTC GGGTTTGATT
 701 TTATAAAACT GCGCAAGGGC GGCAACTGCC TGTCCGGAAC GGTTCATGAA
 751 CGTGGTCGGC TTGAGCAGCC AGACATCGCC GTCGGGCAGG GTAGCACGGG
 801 CGACTTCGCC GAAGAATTTT TTTTCTTCTT TAAATGAAGC CTTCCATTTC
 851 CACGCCAGTT CGTCGAGGAA CCAAAAACCC GCATTGTGGC GTGTCTGTTC
 901 GTATTCTTTG CCCGGGTTGC CCAAGCCGAC AACCATTTTG ATTGTGTTTG
 951 ACATGATATT TTCCGTGTTT CTGCCGAATG CCGTCTGAAG GCTTCAGACG
1001 GCATGGTTAT TCTTCTTGAT TTTGAACGCG TTTGCGGCGC GCTTCTTTGG
1051 GGTCGATCAA CAGCGGGCGG TACACTTCGA TGCGGTCGCC GTCGCGCAGC
1101 GGCGTGTCGT CTTTGA
```

This corresponds to the amino acid sequence <SEQ ID 1972; ORF 615.a>:

a615.pep

```
  1 MRKRRRRGVG SFEEQRIDAA GKPQCGKQAE AVARQLHAAS SSSHVWQILD
 51 RRRNLPPRAA SMSRHCATSS ADGASSMLHS YSRKSRVSSM TGMDSVWISC
101 LSSVMTVRIW KSGTCRLKGL QTASGHLLCR KRVASSHLPA RMSGMACRDL
151 ATASSICRRX FRTGFVQDIA DDEVAVARVA DAEAQAVIVC RAEFCLNVFQ
201 AVVSTVAAAE FEFDPSAGNV EFVVDDEDFF GFDFIKLRKG GNCLSGTVHE
251 RGRLEQPDIA VGQGSTGDFA EEFFFFFK*S LPFPRQFVEE PKTRIVACLF
301 VFFARVAQAD NHFDCV*HDI FRVSAECRLK ASDGMVILLD FERVCGALLW
351 GRSTAGGTLR CGRRRAAACR L*
```

m615/a615 90.3% identity in 371 aa overlap

```
                    10        20        30        40        50        60
m615.pep    MRKRRWRGFGSFEKQXVNAACKPQCREQDKAVAWQIHACSSSSHVWHSLDRRRNFPPRAA
            ||||| || ||||:| ::|| |||| :| :||| |:|| |||||||: ||||||:|||||
a615        MRKRRRRGVGSFEEQRIDAAGKPQCGKQAEAVARQLHAASSSSHVWQILDRRRNLPPRAA
                    10        20        30        40        50        60

                    70        80        90       100       110       120
m615.pep    SISRQTAISSAEGASSMLHSXSRKSRVSSMTGMDSVWISCLSSVMTVRIWKSGTCRLKGL
            |:||: | |||:|||||||| |||||||||||||||||||||||||||||||||||||||
a615        SMSRHCATSSADGASSMLHSYSRKSRVSSMTGMDSVWISCLSSVMTVRIWKSGTCRLKGL
                    70        80        90       100       110       120

                   130       140       150       160       170       180
m615.pep    QTASGHLLCRKRVASSHLPARMSGMACRDLATASSICRRCXRTGFVQDIADDEVAVARVA
            |||||||||||||||||||||||||||||||||||||||  |||||||||||||||||||
a615        QTASGHLLCRKRVASSHLPARMSGMACRDLATASSICRRXFRTGFVQDIADDEVAVARVA
                   130       140       150       160       170       180

                   190       200       210       220       230       240
m615.pep    DAEAQAVIVCRAEFCLNVFQAVVSAVAAAEFEFDPSAGNVEFVVDDEDFFGFDFVELCKR
            ||||||||||||||||||||||||:|||||||||||||||||||||||||||||::| | 
a615        DAEAQAVIVCRAEFCLNVFQAVVSTVAAAEFEFDPSAGNVEFVVDDEDFFGFDFIKLRKG
                   190       200       210       220       230       240

                   250       260       270       280       290       300
m615.pep    GNCLSGTVHERGRFEQPNVAVGQGGTGDFAEEFFFFFKXSLPFPRQFVEEPKTRIVACLF
            |||||||||||||:|||::|||||:|||||||||||||||||||||||||||||||||||
a615        GNCLSGTVHERGRLEQPDIAVGQGSTGDFAEEFFFFFKXSLPFPRQFVEEPKTRIVACLF
                   250       260       270       280       290       300

                   310       320       330       340       350       360
m615.pep    VFFARVAQADNHFDCVXHDIFRVSVECCLKASDGMVILLDFERVCGALLWGRSTAGGTLR
            ||||||||||||||||||||||||:|| ||||||||||||||||||||||||||||||||
a615        VFFARVAQADNHFDCVXHDIFRVSAECRLKASDGMVILLDFERVCGALLWGRSTAGGTLR
                   310       320       330       340       350       360

                   370
m615.pep    CGRRRAAACRLX
            ||||||||||||
a615        CGRRRAAACRLX
                   370
```

The following partial DNA sequence was identified in *N. gonorrhoeae* <SEQ ID 1973>:

g616.seq

```
  1 atgtcgaaCA CAATCAAAAT GGTTGTCGGC TTGGGCAACC CGGGCAAAGA
 51 ATACGAACAG ACCCGCCACA ATGCGGGCTT TTGGTTCCTC GACGAACTGG
101 CGTGGAAATG GAAGGCTTCG TTTAAAGAAG AAAAAAAATT CTTCGGCGAA
151 GTTGCCCGCG CCGCCCTGCC CGACGGCGAT GTTTGGCTGC TCAAACCGGC
201 CACGTTCATG AACCGTTCCG GACAGGCGGT TGCCGCGCTT GCACAGTTCT
251 ACAAAATCAA ACCCGAAGAA ATCCTCGTCG TCCACGACGA ACTCGACATC
301 CCTTGCGGAC GGATcAAATT CAAACTCGGC GgcggcaaCG gcgGACACAA
```

-continued

```
 351 CGGCTTGAAA GACATTcagG CAAAACTCGG CACGGcagac tattaCCGCC
 401 TGCGCCTCGG CATCGgccaC CCCGGCgacc gcaacctCGT CGtcggctac
 451 gtcttgAACa aaccgagcgc gGaagcaccg Ccggcaaatc gacgatgCCG
 501 TCGccaaATC CCTgcaggcc gtacccGACA TcaTTTCCGg caaatgggaa
 551 gaggcaacgc gcTTCCTGCA CAGCAAATAA TccaatGCCG TCTGaagccc
 601 ttTcagacgg cattttcccg atttccgTAT CcGAaCagtc atgaacgaac
 651 tcaagcAGcT tatCCAAAcg gaaTccatcC ccgtcatcga agaaaccctc
 701 gatttcctgc tGTACGAATG cagcAtcgac gaagCAccgt ccgccgaaga
 751 agtggcacaa TGgcgcgaca tactTGccgc acgcgGcgGC AAATtcCTgc
 801 gcctgtccaa aatctgcCaa aCGTGGCtGG ACgAGGAGGC GGCatgAAgc
 851 tGCCGcgcAA CCgcttcaGc ctgctTTCCG CATTGTGGTT TGCCGGCGGc
 901 atctATtCgc tgctcttcaA AGCTGccgaC ACCGCGCCGC CGCCGTTTCC
 951 ACATTtcgaC AAAGCAGCAC ACCTTGCCCT GTTTTTCGCA CAaatCTTgt
1001 tTctGGCCAA AGCATTCAAA ACCGGAAAAC TTCCCATCCC CTACCGCAGC
1051 CTGATTGCGT TCGCCTTCTG TTTTGCCGTC GGCAGCGAAT GCGCGCAGGC
1101 ATGGTTTACC GCAACGCGAA CCGGCAGTTT GGGCGATGTC CTTGCCgACC
1151 TGACGGGCGC AGCCCTTGCC CTCTTTGCCG CGCGTTCTGC CTGCCGcccg
1201 gactaa
```

This corresponds to the amino acid sequence <SEQ ID 1974; ORF 616.ng>:

g616.pep

```
  1 MSNTIKMVVG LGNPGKEYEQ TRHNAGFWFL DELAWKWKAS FKEEKKFFGE
 51 VARAALPDGD VWLLKPATFM NRSGQAVAAL AQFYKIKPEE ILVVHDELDI
101 PCGRIKFKLG GGNGGHNGLK DIQAKLGTAD YYRLRLGIGH PGDRNLVVGY
151 VLNKPSAEAP PANRRCRRQI PAGRTRHHFR QMGRGNALPA QQIIQCRLKP
201 FQTAFSRFPY PNSHERTQAA YPNGIHPRHR RNPRFPAVRM QHRRSTVRRR
251 SGTMARHTCR TRRQIPAPVQ NLPNVAGRGG GMKLPRNRFS LLSALWFAGG
301 IYSLLFKAAD TAPPPFPHFD KAAHLALFFA QILFLAKAFK TGKLPIPYRS
351 LIAFAFCFAV GSECAQAWFT ATRTGSLGDV LADLTGAALA LFAARSACRP
401 D*
```

The following partial DNA sequence was identified in *N. meningitidis* <SEQ ID 1975>:

m616.seq

```
  1 ATGTCAAACA CAATCAAAAT GGTTGTCGGC TTGGGCAACC CGGGCAAAGA
 51 ATACGAACAG ACACGCCACA ATGCGGGTTT TTGGTTCCTC GACGAACTGG
101 CGTGGAAATG GAAGGCTTCA TTTAAAGAAG AAAAAAAATT CTTCGGCGAA
151 GTCGCCCGTG CCGCCCTGCC CGACGGCGAC GTTTGGCTGC TCAAACCTGC
```

-continued

```
 201 CACGTTCATG AACCGTTCCG GACAGGCAGT TGCCGCGCTT GCACAGTTCT

 251 ACAAAATCAA ACCCGAAGAA ATCCTCGTCG TCCACGACGA ACTCGACATT

 301 CCCTGCGGAC GGATCAAATT CAAACTCGGC GGCGGCAACG GCGGACACAA

 351 CGGCTTGAAA GACATTCAGG CAAAACTCGG CACGGCAGAC TATTACCGCC

 401 TGCGCCTCGG CATCGGCCAC CCGGGCGACC GCAACCTCGT CGTCGGCTAT

 451 GTCCTGAACA AACCCAGTAC GGAACA.CCG CCGACAGATT GACGATGCCG

 501 TCGCCAAATC CCTGCAAGCC ATACCCGACA TCCTTGCCGG CAAATGGGAA

 551 GAAGCAACCC GCTTCCTGCA CAGCAAATGA CCCGATGCCG TCTGAAGCCC

 601 TTTCAGACGG CATGTTCCCG ATTTCCATAT CCGAACAGTC ATGACCGAAC

 651 TCAAGCAGCT TATCCAAACC GAATCCATCC CCGTCATCGA AGAAACCCTC

 701 GATTTCCTGC TCTACGAATG CAGCATAGAC GATGCCCCCT CCGCCGAAGA

 751 AATTGCCGTT TGGCGCGATA TGCTGGCCGC ACGCGGCGGA AAATTCCTGC

 801 GCCTATCCAA ACTATGCCAG ACATGGCTTG AAGAGGAACA AGCATGAATC

 851 TGCCACGCAA CCGCTTTATC CTGCTCTCGG CATTGTGGTT TGCAGGCAGC

 901 ATTTACTCAC TGCTTTTCAA AGCTGCCGAA ACCGCGCCAC CGCCTTTTCC

 951 GCATTTTGAC AAAGTGGCGC ACCTCGCCCT GTTTTTCGCA CAAATCTGGC

1001 TTCTGACCAA AGCATTCAGA ACCGACAACC GCCCCATCCC CTATCGCAGC

1051 CTGATGGTCT TTGCCCTCTG TTTCGCCCTC TTCAGCGAAT GCGCGCAGGC

1101 ATGGTTTACC GCAACGAGAA CCGGCAGTTT GGGCGATGTC CTTGCCGACC

1151 TGACGGGCGC AGCCCTTGCC CTCTTTACCG CGCGAGCTGC CTGCCGCCCG

1201 GACTAA
```

This corresponds to the amino acid sequence <SEQ ID 1976; ORF 616>:

m616.pep

```
  1 MSNTIKMVVG LGNPGKEYEQ TRHNAGFWFL DELAWKWKAS FKEEKKFFGE

 51 VARAALPDGD VWLLKPATFM NRSGQAVAAL AQFYKIKPEE ILVVHDELDI

101 PCGRIKFKLG GGNGGHNGLK DIQAKLGTAD YYRLRLGIGH PGDRNLVVGY

151 VLNKPSTEXP PTDXRCRRQI PASHTRHPCR QMGRSNPLPA QQMTRCRLKP

201 FQTACSRFPY PNSHDRTQAA YPNRIHPRHR RNPRFPALRM QHRRCPLRRR

251 NCRLARYAGR TRRKIPAPIQ TMPDMAXRGT SMNLPRNRFI LLSALWFAGS

301 IYSLLFKAAE TAPPPFPHFD KVAHLALFFA QIWLLTKAFR TDNRPIPYRS

351 LMVFALCFAL FSECAQAWFT ATRTGSLGDV LADLTGAALA LFTARAACRP

401 D*
```

m616/g616 86.0% identity in 401 aa overlap

```
                    10        20        30        40        50        60
m616.pep    MSNTIKMVVGLGNPGKEYEQTRHNAGFWFLDELAWKWKASFKEEKKFFGEVARAALPDGD
            ||||||||||||||||||||||||||||||||||||||||||||||||||||||||||||
g616        MSNTIKMVVGLGNPGKEYEQTRHNAGFWFLDELAWKWKASFKEEKKFFGEVARAALPDGD
                    10        20        30        40        50        60
```

-continued

```
                 70        80        90       100       110       120
m616.pep  VWLLKPATFMNRSGQAVAALAQFYKIKPEEILVVHDELDIPCGRIKFKLGGGNGGHNGLK
          ||||||||||||||||||||||||||||||||||||||||||||||||||||||||||||
g616      VWLLKPATFMNRSGQAVAALAQFYKIKPEEILVVHDELDIPCGRIKFKLGGGNGGHNGLK
                 70        80        90       100       110       120

                130       140       150       160       170       180
m616.pep  DIQAKLGTADYYRLRLGIGHPGDRNLVVGYVLNKPSTEXPPTDXRCRRQIPASHTRHPCR
          ||||||||||||||||||||||||||||||||||||:| ||:: ||||||||::|||  |
g616      DIQAKLGTADYYRLRLGIGHPGDRNLVVGYVLNKPSAEAPPANRRCRRQIPAGRTRHHFR
                130       140       150       160       170       180

                190       200       210       220       230       240
m616.pep  QMGRSNPLPAQQMTRCRLKPFQTACSRFPYPNSHDRTQAAYPNRIHPRHRRNPRFPALRM
          ||||:| |||||: :||||||||| |||||||||:|||||||| |||||||||||||:||
g616      QMGRGNALPAQQIIQCRLKPFQTAFSRFPYPNSHERTQAAYPNGIHPRHRRNPRFPAVRM
                190       200       210       220       230       240

                250       260       270       280       290       300
m616.pep  QHRRCPLRRRNCRLARYAGRTRRKIPAPIQTMPDMAXRGTSMNLPRNRFILLSALWFAGS
          ||||  :|||:  :||:: ||||:||||:|::|::| || :|:|||||| |||||||||:
g616      QHRRSTVRRRSGTMARHTCRTRRQIPAPVQNLPNVAGRGGGMKLPRNRFSLLSALWFAGG
                250       260       270       280       290       300

                310       320       330       340       350       360
m616.pep  IYSLLFKAAETAPPPFPHFDKVAHLALFFAQIWLLTKAFRTDNRPIPYRSLMVFALCFAL
          |||||||||:|||||||||||:|||||||||| :|:|||:| : |||||||::||:|||:
g616      IYSLLFKAADTAPPPFPHFDKAAHLALFFAQILFLAKAFKTGKLPIPYRSLIAFAFCFAV
                310       320       330       340       350       360

                370       380       390       400
m616.pep  FSECAQAWFTATRTGSLGDVLADLTGAALALFTARAACRPDX
           |||||||||||||||||||||||||||||||:||:||||||
g616      GSECAQAWFTATRTGSLGDVLADLTGAALALFAARSACRPDX
                370       380       390       400
```

The following partial DNA sequence was identified in *N. meningitidis* <SEQ ID 1977>:

a616.seq

```
   1 ATGTCAAACA CAATCAAAAT GGTTGTCGGC TTGGGCAACC CGGGCAAAGA
  51 ATACGAACAG ACACGCCACA ATGCGGGTTT TTGGTTCCTC GACGAACTGG
 101 CGTGGAAATG GAAGGCTTCA TTTAAAGAAG AAAAAAAATT CTTCGGCGAA
 151 GTCGCCCGTG CTACCCTGCC CGACGGCGAT GTCTGGCTGC TCAAGCCGAC
 201 CACGTTCATG AACCGTTCCG GACAGGCAGT TGCCGCCCTT GCGCAGTTTT
 251 ATAAAATCAA ACCCGAAGAA ATCCTCGTCG TCCACGACGA ACTCGACATT
 301 CCCTGCGGAC GGATCAAATT CAAACTCGGC GGCGGCAACG GTGGACACAA
 351 CGGCTTGAAA GACATTCAGG CAAAACTCGG CACGGCAGAC TATTACCGCC
 401 TGCGCCTCGG CATCGGCCAC CCGGGCGACC GCAACCTCGT CGTCGGCTAT
 451 GTCCTGAACA AACCCAGTAC GGAA.CACCG CCGACAGATT GACGATGCCG
 501 TCGCCAAATC CCTGCAAGCC ATACCCGACA TCCTTGCCGG CAAATGTGAA
 551 GAGGCAACCC GCTTCCTGCA CAGCAAATGA CCCGATGCCG TCTGAAGCCC
 601 TTTCAGACGG CATGTTCCCG ATTTCCATAT CCGAACAGTC ATGACCGAAC
 651 TCAAGCAGCT TATCCAAACC GAATCCATCC CCGTCATCGA AGAAACCCTC
 701 GATTTCCTGC TGTACGAATG CAGCATCGAC GACGCACCAT CCGCCGAAGA
 751 AGTGGCACAA TGGCGCGACA TACTTGCCGC ACGCGGCGGC AAATTCCTGC
 801 GCCTGTCCAA AATCTGCCAA ACGTGGCTGG ACGAGGAGGC GGCATGAAGC
 851 TGCCGCGCAA CCGCTTCAGC CTGCTTTCCG CATTGTGGTT TGCCGGCGGC
 901 ATCTATTCGC TGCTCTTCAA AGCTGCCGAC ACCGCGCCGC CGCCGTTTCC
 951 GCATTTCGAC AAAGCAGCAC ACCTTGCCCT GTTTTTCGCA CAAATCTGGC
1001 TTTTGACCAA AGCATTCAAA ACCGGAAAAC TTCCCATCCC CTACCGCAGC
```

-continued

```
1051 CTGATGGTCT TTGCCCTCTG TTTCGCCCTC TTCAGCGAAT GCGCGCAGGC

1101 ATGATTTACC GCAACGAGAA CCGGCAGTTT GGGCGATGTT CTTGCCGATA

1151 TGGCAGGTAC GGTTCTCGCA CTCTTTGCCG CCCGCGCCGC CGACCGCCCG

1201 GACTGA
```

This corresponds to the amino acid sequence <SEQ ID 1978; ORF 616.a>:

a616.pep

```
  1 MSNTIKMVVG LGNPGKEYEQ TRHNAGFWFL DELAWKWKAS FKEEKKFFGE

 51 VARATLPDGD VWLLKPTTFM NRSGQAVAAL AQFYKIKPEE ILVVHDELDI

101 PCGRIKFKLG GGNGGHNGLK DIQAKLGTAD YYRLRLGIGH PGDRNLVVGY

151 VLNKPSTEXP PTD*RCRRQI PASHTRHPCR QM*RGNPLPA QQMTRCRLKP

201 FQTACSRFPY PNSHDRTQAA YPNRIHPRHR RNPRFPAVRM QHRRRTIRRR

251 SGTMARHTCR TRRQIPAPVQ NLPNVAGRGG GMKLPRNRFS LLSALWFAGG

301 IYSLLFKAAD TAPPPFPHFD KAAHLALFFA QIWLLTKAFK TGKLPIPYRS

351 LMVFALCFAL FSECAQA*FT ATRTGSLGDV LADMAGTVLA LFAARAADRP

401 D*
```

m616/a616 90.0% identity in 401 aa overlap

```
                    10        20        30        40        50        60
m616.pep    MSNTIKMVVGLGNPGKEYEQTRHNAGFWFLDELAWKWKASFKEEKKFFGEVARAALPDGD
            ||||||||||||||||||||||||||||||||||||||||||||||||||||||:|||||
a616        MSNTIKMVVGLGNPGKEYEQTRHNAGFWFLDELAWKWKASFKEEKKFFGEVARATLPDGD
                    10        20        30        40        50        60

                    70        80        90       100       110       120
m616.pep    VWLLKPATFMNRSGQAVAALAQFYKIKPEEILVVHDELDIPCGRIKFKLGGGNGGHNGLK
            ||||||:|||||||||||||||||||||||||||||||||||||||||||||||||||||
a616        VWLLKPTTFMNRSGQAVAALAQFYKIKPEEILVVHDELDIPCGRIKFKLGGGNGGHNGLK
                    70        80        90       100       110       120

                   130       140       150       160       170       180
m616.pep    DIQAKLGTADYYRLRLGIGHPGDRNLVVGYVLNKPSTEXPPTDXRCRRQIPASHTRHPCR
            ||||||||||||||||||||||||||||||||||||||||||||||||||||||||||||
a616        DIQAKLGTADYYRLRLGIGHPGDRNLVVGYVLNKPSTEXPPTDXRCRRQIPASHTRHPCR
                   130       140       150       160       170       180

                   190       200       210       220       230       240
m616.pep    QMGRSNPLPAQQMTRCRLKPFQTACSRFPYPNSHDRTQAAYPNRIHPRHRRNPRFPALRM
            || |:||||||||||||||||||||||||||||||||||||||||||||||||||||:||
a616        QMXRGNPLPAQQMTRCRLKPFQTACSRFPYPNSHDRTQAAYPNRIHPRHRRNPRFPAVRM
                   190       200       210       220       230       240

                   250       260       270       280       290       300
m616.pep    QHRRCPLRRRNCRLARYAGRTRRKIPAPIQTMPDMAXRGTSMNLPRNRFILLSALWFAGS
            ||||  :|||:  :||:: ||||:||||:|::|::| || :|:|||||| |||||||||:
a616        QHRRRTIRRRSGTMARHTCRTRRQIPAPVQNLPNVAGRGGGMKLPRNRFSLLSALWFAGG
                   250       260       270       280       290       300

                   310       320       330       340       350       360
m616.pep    IYSLLFKAAETAPPPFPHFDKVAHLALFFAQIWLLTKAFRTDNRPIPYRSLMVFALCFAL
            |||||||||:|||||||||||:|||||||||||||||||:| : ||||||||||||||||
a616        IYSLLFKAADTAPPPFPHFDKAAHLALFFAQIWLLTKAFKTGKLPIPYRSLMVFALCFAL
                   310       320       330       340       350       360

                   370       380       390       400
m616.pep    FSECAQAWFTATRTGSLGDVLADLTGAALALFTARAACRPDX
            ||||||| |||||||||||||||::|::||||:|||| ||||
a616        FSECAQAXFTATRTGSLGDVLADMAGTVLALFAARAADRPDX
                   370       380       390       400
```

The following partial DNA sequence was identified in *N. gonorrhoeae* <SEQ ID 1979>:

g619.seq

```
  1 ATGCCGTCTG AAAAAAATAT CGGTTTTATG GCAGGAAGCA GCCGTCCGTT
 51 GCGGGTCGCC TTTGCGCTGT TGCTGGTTTC CTGCATCCTG TTTATGACGC
101 TCAACGTCAA AGGAGATTGG GACTTTGTCT TGCACCTGCG CCTGACCAAG
151 CTTGCCGCGC TGCTGATGGT CGCCTATGCG GTCGGCGTGT CCACTCAACT
201 CTTCCAAACG CTGACCAACA ACCCGATTCT GACCCCTTCG ATTTTGGGTT
251 TCGATTCGCT GTATGTGTTT TTGCAGACCT TGCTGgtGTT TACGTtcgGC
301 GGCGTGGGCT ATAcatccct gccgttgacg gGCAAATTCG GCTTTGAACT
351 GGTTGTTATG ATGGGCGGCT CGCTGCTGCT GTTTTACACG CTCATCCGTC
401 AGGGCGGGCG CGATTTGCCG CACATGATTT TAATCGGCGT GATTTTCGGG
451 ATTTTGTTCC GCAGCCTTTC CTCGCTGCTT TCGCGCATGA TAGACCCCGA
501 AGAATTTACC GCCGCGCAGG CGAATATGTT TGCCGGATTC AATACCGTCC
551 GCAGCGAGCT TTTAGGCATA GGCGCGCTGG TCCTGCTCGT CAGCGCGGCG
601 GTCGTTTGGC ACGAACGCTA CCGCTCGGAC GTACACCTTT TGGGGCGCGA
651 CCAAGCCGTC AATTTGGGCA TCAGCTACAC GCGCAACACC TTATGGATAC
701 TGCTTTGGAT TGCCGCATTG GTGGCGACGG CGACCGCCGT TGTCGGCCCG
751 GTGAGCTTTT TCGGGCTTCT CGCCGCCTCG CTTGCCAACC ACTTTTCCCc
801 gtCCGTGCGC CATTCCGTCC GCCTGCcgat gacggtttGC gtcgGcggCA
851 TCCTCTTGgt cggCggacaA ACCGTATTCG AACACTTCTT GGGCATGAag
901 gCggTATTAA GCGTGGTGGt cgAATTTGCG ggcggactcG TTTTCCTCTA
951 TCTCGTTTTA AAACACAAAA AATGA
```

This corresponds to the amino acid sequence <SEQ ID 1980; ORF 619.a>:

g619.pep

```
  1 MPSEKNIGFM AGSSRPLRVA FALLLVSCIL FMTLNVKGDW DFVLHLRLTK
 51 LAALLMVAYA VGVSTQLFQT LTNNPILTPS ILGFDSLYVF LQTLLVFTFG
101 GVGYTSLPLT GKFGFELVVM MGGSLLLFYT LIRQGGRDLP HMILIGVIFG
151 ILFRSLSSLL SRMIDPEEFT AAQANMFAGF NTVRSELLGI GALVLLVSAA
201 VVWHERYRSD VHLLGRDQAV NLGISYTRNT LWILLWIAAL VATATAVVGP
251 VSFFGLLAAS LANHFSPSVR HSVRLPMTVC VGGILLVGGQ TVFEHFLGMK
301 AVLSVVVEFA GGLVFLYLVL KHKK*
```

The following partial DNA sequence was identified in *N. meningitidis* <SEQ ID 1981>:

m619.seq

```
  1 ATGCCGTCTG AAAAAAATAT CGGTTTTATG GCAGGAAGCA GCCGCCCGTT
 51 GTGGGTCGCC TTTGCGCTGT TGCTGGTTTC CTGCGTCCTG TTTATGACGC
101 TCAACGTCAA AGGCGATTGG GATTTTGTTT TGCAACTGCG GCTGACCAAA
151 CTTGCCGCGC TGCTGATGGT CGCCTATGCG GTCGGCGTGT CCACGCAACT
```

-continued

```
201 CTTCCAAACG CTGACCAATA ATCCGATTCT GACCCCTTCA ATTTTGGGTT

251 TCGATTCGCT GTATGTGTTT TTGCAGACCT TGCTGGTGTT TACGTTCGGC

301 GGCGTGGGCT ATGCTTCCCT GCCGTTGACG GGCAAATTCG GCTTTGAACT

351 GGTCGTCATG ATGGGCGGCT CGCTGCTGCT GTTCTACACG CTCATCAAAC

401 AGGGCGGACG CGATTTGTCG CGCATGATTT TAATCGGCGT GATTTTCGGG

451 ATTTTGTTCC GCAGCCTGTC GTCGCTGCTT TCGCGCATGA TCGATCCCGA

501 AGAATTTACC GCCGCGCAGG CGAATATGTT TGCCGGATTC AATACCGTCC

551 ACAGCGAGCT TTTGGGCATA GGCGCGCTGA TTCTGCTCGT CAGCGCGGCG

601 GTCGTTTGGC GCGAACGCTA CCGCTTGGAC GTTTACCTTT TGGGGCGTGA

651 CCAAGCCGTC AATTTGGGCA TCAGCTACAC GCGCAACACC TTATGGATAC

701 TGCTTTGGAT TGCCGCATTG GTGGCGACGG CGACCGCCGT GGTCGGCCCC

751 GTAAGCTTTT TCGGGCTTCT CGCCGCCTCG CTTGCCAACC ACTTTTCCCC

801 GTCGGTCAAA CATTCCGTCC GCCTGCCGAT GACGGTTTGT ATCGGCGGCA

851 TCCTCTTGGT CGGCGGACAG ACCGTGTTCG AACACCTGCT CGGTATGCAG

901 GCAGTGTTGA GCGTAGTAGT AGAATTTGCC GGCGGACTCG TTTTCCTCTA

951 TCTCGTTTTA AAACACAAAA AATGA
```

This corresponds to the amino acid sequence <SEQ ID 1982; ORF 619>:

```
m619.pep

  1 MPSEKNIGFM AGSSRPLWVA FALLLVSCVL FMTLNVKGDW DFVLQLRLTK

 51 LAALLMVAYA VGVSTQLFQT LTNNPILTPS ILGFDSLYVF LQTLLVFTFG

101 GVGYASLPLT GKFGFELVVM MGGSLLLFYT LIKQGGRDLS RMILIGVIFG

151 ILFRSLSSLL SRMIDPEEFT AAQANMFAGF NTVHSELLGI GALILLVSAA

201 VVWRERYRLD VYLLGRDQAV NLGISYTRNT LWILLWIAAL VATATAVVGP

251 VSFFGLLAAS LANHFSPSVK HSVRLPMTVC IGGILLVGGQ TVFEHLLGMQ

301 AVLSVVVEFA GGLVFLYLVL KHKK*
```

m619/g619 95.1% identity in 324 aa overlap

```
                    10        20        30        40        50        60
m619.pep    MPSEKNIGFMAGSSRPLWVAFALLLVSCVLFMTLNVKGDWDFVLQLRLTKLAALLMVAYA
            |||||||||||||||| ||||||||||:|||||||||||||||:||||||||||||||||
g619        MPSEKNIGFMAGSSRPLRVAFALLLVSCILFMTLNVKGDWDFVLHLRLTKLAALLMVAYA
                    10        20        30        40        50        60

                    70        80        90       100       110       120
m619.pep    VGVSTQLFQTLTNNPILTPSILGFDSLYVFLQTLLVFTFGGVGYASLPLTGKFGFELVVM
            |||||||||||||||||||||||||||||||||||||||||||:||||||||||||||||
g619        VGVSTQLFQTLTNNPILTPSILGFDSLYVFLQTLLVFTFGGVGYTSLPLTGKFGFELVVM
                    70        80        90       100       110       120

                   130       140       150       160       170       180
m619.pep    MGGSLLLFYTLIKQGGRDLSRMILIGVIFGILFRSLSSLLSRMIDPEEFTAAQANMFAGF
            ||||||||||||||:||||| :||||||||||||||||||||||||||||||||||||||
g619        MGGSLLLFYTLIRQGGRDLPHMILIGVIFGILFRSLSSLLSRMIDPEEFTAAQANMFAGF
                   130       140       150       160       170       180

                   190       200       210       220       230       240
m619.pep    NTVHSELLGIGALILLVSAAVVWRERYRLDVYLLGRDQAVNLGISYTRNTLWILLWIAAL
            |||:|||||||||:||||||||||||:|| ||:|||||||||||||||||||||||||||
g619        NTVRSELLGIGALVLLVSAAVVWREHYRSDVHLLGRDQAVNLGISYTRNTLWILLWIAAL
                   190       200       210       220       230       240
```

-continued

```
                250       260       270       280       290       300
m619.pep   VATATAVVGPVSFFGLLAASLANHFSPSVKHSVRLPMTVCIGGILLVGGQTVFEHLLGMQ
           |||||||||||||||||||||||||||||:|||||||||:|||||||||||||||:|||:
g619       VATATAVVGPVSFFGLLAASLANHFSPSVRHSVRLPMTVCVGGILLVGGQTVFEHFLGMK
                250       260       270       280       290       300

                310       320
m619.pep   AVLSVVVEFAGGLVFLYLVLKHKKX
           ||||||||||||||||||||||||
g619       AVLSVVVEFAGGLVFLYLVLKHKKX
                310       320
```

The following partial DNA sequence was identified in *N. meningitidis* <SEQ ID 1983>:

a619.seq

```
  1 ATGCCGTCTG AAAAAAATAT CGGTTTTATG GCAGGAAGCA GCCGTCCGTT

 51 GTGGGTTGCC TTTGCGCTGT TGCTGGTTTC CTGCATCCTG TTTATGACGC

101 TCAACGTCAA AGGCGATTGG GATTTTGTTT TGCACCTGCG CCTGACCAAG

151 CTTGCCGCGC TGCTGATGGT CGCCTATGCG GTCGGCGTTT CGACCCAGCT

201 TTTTCAAACG CTGACCAACA ATCCGATTCT GACCCCTTCG ATTTTGGGTT

251 TCGATTCGCT GTATGTGTTT TTGCAGACCT TGCTGGTGTT TACGTTCGGC

301 GGCGTGGGCT ATGCTTCCCT GCCGTTGACG GGCAAATTCG GCTTTGAACT

351 GGTCGTTATG ATGGGCGGCT CGCTGCTGCT GTTTTACACG CTCATCAAAC

401 AGGGCGGGCG CGATTTGCCG CGTATGATTT TAATCGGCGT GATTTTCGGG

451 ATTTTGTTCC GCAGCCTGTC GTCGCTGCTT TCGCGCATGA TCGACCCCGA

501 AGAATTTACG GCGGCGCAGG CGAATATGTT TGCCGGATTC AATACCGTCC

551 ACAGCGAGCT TTTAGGCATA GGCGCGCTGA TTCTGCTCGT CAGCGCGGCG

601 GTCGTTTGGC GCGAACGCTA CCGCTTGGAC GTACACCTTT TGGGGCGCGA

651 CCAAGCCATA AATTTGGGCA TCAGCTACAC GCGCAACACC TTATGGATAC

701 TGCTTTGGAT TGCCGCGCTG GTGGCGACGG CGACCGCCGT TGTCGGCCCG

751 GTAAGCTTTT TCGGGCTTCT CGCCGCCTCG CTTGCCAACC ACTTTTCCCC

801 GTCGGTCAAA CATTCCGTCC GCCTGCCGAT GACGGTTTGT GTCGGCGGCA

851 TCCTCTTGGT CGGCGGACAG ACCGTATTCG AACACTTCTT GGGCATGAAG

901 GCGGTATTAA GCGTGGTGGT CGAATTTGCG GGCGGACTCG TTTTCCTCTA

951 TCTCGTTTTA AGACACAAAA AATGA
```

This corresponds to the amino acid sequence <SEQ ID 1984; ORF 619.a>:

a619.pep

```
  1 MPSEKNIGFM AGSSRPLWVA FALLLVSCIL FMTLNVKGDW DFVLHLRLTK

 51 LAALLMVAYA VGVSTQLFQT LTNNPILTPS ILGFDSLYVF LQTLLVFTFG

101 GVGYASLPLT GKFGFELVVM MGGSLLLFYT LIKQGGRDLP RMILIGVIFG

151 ILFRSLSSLL SRMIDPEEFT AAQANMFAGF NTVHSELLGI GALILLVSAA

201 VVWRERYRLD VHLLGRDQAI NLGISYTRNT LWILLWIAAL VATATAVVGP

251 VSFFGLLAAS LANHFSPSVK HSVRLPMTVC VGGILLVGGQ TVFEHFLGMK

301 AVLSVVVEFA GGLVFLYLVL RHKK*
```

m619/a619 97.2% identity in 324 aa overlap

```
                  10        20        30        40        50        60
m619.pep  MPSEKNIGFMAGSSRPLWVAFALLLVSCVLFMTLNVKGDWDFVLQLRLTKLAALLMVAYA
          ||||||||||||||||||||||||||||:|||||||||||||||:|||||||||||||||
a619      MPSEKNIGFMAGSSRPLWVAFALLLVSCILFMTLNVKGDWDFVLHLRLTKLAALLMVAYA
                  10        20        30        40        50        60

                  70        80        90       100       110       120
m619.pep  VGVSTQLFQTLTNNPILTPSILGFDSLYVFLQTLLVFTFGGVGYASLPLTGKFGFELVVM
          ||||||||||||||||||||||||||||||||||||||||||||||||||||||||||||
a619      VGVSTQLFQTLTNNPILTPSILGFDSLYVFLQTLLVFTFGGVGYASLPLTGKFGFELVVM
                  70        80        90       100       110       120

                 130       140       150       160       170       180
m619.pep  MGGSLLLFYTLIKQGGRDLSRMILIGVIFGILFRSLSSLLSRMIDPEEFTAAQANMFAGF
          ||||||||||||||||||| ||||||||||||||||||||||||||||||||||||||||
a619      MGGSLLLFYTLIKQGGRDLPRMILIGVIFGILFRSLSSLLSRMIDPEEFTAAQANMFAGF
                 130       140       150       160       170       180

                 190       200       210       220       230       240
m619.pep  NTVHSELLGIGALILLVSAAVVWRERYRLDVYLLGRDQAVNLGISYTRNTLWILLWIAAL
          |||||||||||||||||||||||||||||||:|||||||:||||||||||||||||||||
a619      NTVHSELLGIGALILLVSAAVVWRERYRLDVHLLGRDQAINLGISYTRNTLWILLWIAAL
                 190       200       210       220       230       240

                 250       260       270       280       290       300
m619.pep  VATATAVVGPVSFFGLLAASLANHFSPSVKHSVRLPMTVCIGGILLVGGQTVFEHLLGMQ
          ||||||||||||||||||||||||||||||||||||||||:||||||||||||||:|||:
a619      VATATAVVGPVSFFGLLAASLANHFSPSVKHSVRLPMTVCVGGILLVGGQTVFEHFLGMK
                 250       260       270       280       290       300

                 310       320
m619.pep  AVLSVVVEFAGGLVFLYLVLKHKKX
          ||||||||||||||||||||:||||
a619      AVLSVVVEFAGGLVFLYLVLRHKKX
                 310       320
```

The following partial DNA sequence was identified in *N. gonorrhoeae* <SEQ ID 1985>:

g620.seq

```
  1 ATGAAGAAAA CCCTGTTGGC AATTGTTGCc gtTTTCGCCT TAAGTGCCTG
 51 CCGGCaggcg gaAGaggcac cgccgCCTTT ACCCCGGCAG AtTAGCGacc
101 gttcggtcgg aCACTAttgC Agtatgaacc tgaccgaaca caacggcccc
151 aaagcccaga tttttttgaa cGGCAAACCC GATCAGCCCG TTTGGTTCTC
201 CACCGTcaag cagatgttcg GCTATACCAA GCTGCCCGAA GAGCCCAAAG
251 GCATCCGCGT GATTTACGTT ACCGATATGG GCAATGTTAC CGATTGGACG
301 AATCCTAATG CCGACACGGA GTGGATAGAT GCGAAAAAAG CCTTTTACGT
351 CATCGACAGC GGCTTTATCG GCGGTATGGG CGCGGAAGAC GCGCTGCCGT
401 TCGGCAACAA GGAGCAGGCT GAAAAATTTG CAAAGGATAA AGGCGGCAAG
451 GTCGTCGGTT TTGACGATAT GCCCGATGCT TACATTTTCA AGTAA
```

This corresponds to the amino acid sequence <SEQ ID 1986; ORF 620.ng>:

g620.pep

```
  1 MKKTLLAIVA VFALSACRQA EEAPPPLPRQ ISDRSVGHYC SMNLTEHNGP
 51 KAQIFLNGKP DQPVWFSTVK QMFGYTKLPE EPKGIRVIYV TDMGNVTDWT
101 NPNADTEWID AKKAFYVIDS GEIGGMGAED ALPFGNKEQA EKFAKDKGGK
151 VVGFDDMPDA YIFK*
```

The following partial DNA sequence was identified in *N. meningitidis* <SEQ ID 1987>:

m620.seq

```
  1 ATGAAAAAAA CCCTGTTGGC AATTGTTGCC GTTTCCGCCT TAAGTGCCTG
 51 CCGGCAGGCG GAAGAGGGAC CGCCGCCTTT ACCCCGGCAG ATTAGCGACC
101 GTTCGGTCGG ACACTATTGC AGTATGAACC TGACCGAACA CAACGGCCCC
151 AAAGCCCAGA TTTTCTTGAA CGGCAAACCC GATCAGCCCG TTTGGTTCTC
201 CACCATCAAG CAGATGTTCG GCTATACCAA GCTGCCCGAA GAGCCTAAAG
251 GCATCCGCGT GATTTACGTT ACCGATATGG GCAATGTTAC CGATTGGACG
301 AATCCCAATG CCGACACGGA GTGGATGGAT GCGAAAAAAG CCTTTTACGT
351 CATCGACAGC GGCTTTATCG GCGGTATGGG TGCGGAAGAC GCGCTGCCGT
401 TCGGCAACAA AGAGCAGGCT GAGAAATTTG CAAAGGATAA AGGCGGTAAG
451 GTTGTCGGTT TCGACGATAT GCCTGATACC TATATTTTCA AATAA
```

This corresponds to the amino acid sequence <SEQ ID 1988; ORF 620>:

m620.pep

```
  1 MKKTLLAIVA VSALSACRQA EEGPPPLPRQ ISDRSVGHYC SMNLTEHNGP
 51 KAQIFLNGKP DQPVWFSTIK QMFGYTKLPE EPKGIRVIYV TDMGNVTDWT
101 NPNADTEWMD AKKAFYVIDS GFIGGMGAED ALPFGNKEQA EKFAKDKGGK
151 VVGFDDMPDT YIFK*
```

m620/g620 97.0% identity in 164 aa overlap

```
                    10        20        30        40        50        60
m620.pep    MKKTLLAIVAVSALSACRQAEEGPPPLPRQISDRSVGHYCSMNLTEHNGPKAQIFLNGKP
            ||||||||||| ||||||||||:|||||||||||||||||||||||||||||||||||||
g620        MKKTLLAIVAVFALSACRQAEEAPPPLPRQISDRSVGHYCSMNLTEHNGPKAQIFLNGKP
                    10        20        30        40        50        60

                    70        80        90       100       110       120
m620.pep    DQPVWFSTIKQMFGYTKLPEEPKGIRVIYVTDMGNVTDWTNPNADTEWMDAKKAFYVIDS
            ||||||||:|||||||||||||||||||||||||||||||||||||||:|||||||||||
g620        DQPVWFSTVKQMFGYTKLPEEPKGIRVIYVTDMGNVTDWTNPNADTEWIDAKKAFYVIDS
                    70        80        90       100       110       120

                   130       140       150       160
m620.pep    GFIGGMGAEDALPFGNKEQAEKDKGGKGGKVVGFDDMPDTYIFKKX
            |||||||||||||||||||||||||||||||||||||||:||||||
g620        GFIGGMGAEDALPFGNKEQAEKDKGGKGGKVVGFDDMPDAYIFKKX
                   130       140       150       160
```

The following partial DNA sequence was identified in *N. meningitidis* <SEQ ID 1989>:

a620.seq

```
  1 ATGAAAAAAA CCCTGTTGGC AATTGTTGCC GTTTCCGCCT TAAGTGCCTG
 51 CCGGCAGGCG GAAGAGGGAC CGCCGCCTTT ACCCCGGCAG ATTAGCGACC
101 GTTCGGTCGG ACACTATTGC AGTATGAACC TGACCGAACA CAACGGCCCC
151 AAAGCCCAGA TTTTCTTGAA CGGCAAACCC GATCAGCCCG TTTGGTTCTC
201 CACCATCAAG CAGATGTTCG GCTATACCAA GCTGCCCGAA GAGCCTAAAG
251 GCATCCGCGT GATTTACGTT ACCGATATGG GCAATGTTAC CGATTGGACG
```

-continued

```
301 AATCCCAATG CCGACACGGA GTGGATGGAT GCGAAAAAAG CCTTTTACGT

351 CATCGACAGC GGCTTTATCG GCGGTATGGG TGCGGAAGAC GCGCTGCCGT

401 TCGGCAACAA AGAGCAGGCT GAGAAATTTG CAAAGGATAA AGGCGGTAAG

451 GTTGTCGGTT TCGACGATAT GCCTGATACC TATATTTTCA AATAA
```

This corresponds to the amino acid sequence <SEQ ID 1990; ORF 620.a>:

a620.pep

```
  1 MKKTLLAIVA VSALSACRQA EEGPPPLPRQ ISDRSVGHYC SMNLTEHNGP

 51 KAQIFLNGKP DQPVWFSTIK QMFGYTKLPE EPKGIRVIYV TDMGNVTDWT

101 NPNADTEWMD AKKAFYVIDS GFIGGMGAED ALPFGNKEQA EKFAKDKGGK

151 VVGFDDMPDT YIFK*
```

m620/a620 100.0% identity in 164 aa overlap

```
                    10        20        30        40        50        60
m620.pep    MKKTLLAIVAVSALSACRQAEEGPPPLPRQISDRSVGHYCSMNLTEHNGPKAQIFLNGKP
            ||||||||||||||||||||||||||||||||||||||||||||||||||||||||||||
a620        MKKTLLAIVAVSALSACRQAEEGPPPLPRQISDRSVGHYCSMNLTEHNGPKAQIFLNGKP
                    10        20        30        40        50        60

                    70        80        90       100       110       120
m620.pep    DQPVWFSTIKQMFGYTKLPEEPKGIRVIYVTDMGNVTDWTNPNADTEWMDAKKAFYVIDS
            ||||||||||||||||||||||||||||||||||||||||||||||||||||||||||||
a620        DQPVWFSTIKQMFGYTKLPEEPKGIRVIYVTDMGNVTDWTNPNADTEWMDAKKAFYVIDS
                    70        80        90       100       110       120

                   130       140       150       160
m620.pep    GFIGGMGAEDALPFGNKEQAEKFAKDKGGKVVGFDDMPDTYIFKX
            |||||||||||||||||||||||||||||||||||||||||||||
a620        GFIGGMGAEDALPFGNKEQAEKFAKDKGGKVVGFDDMPDTYIFKX
                   130       140       150       160
```

The following partial DNA sequence was identified in *N. gonorrhoeae* <SEQ ID 1991>:

g622.seq

```
  1 ATGCAactta ccgctgtcgg ACTCAATCAT CAAACCGCAC CTTTAAGCAT

 51 ACGGGAAAag ctggCGTTTG CCGCCGCCGC CCTGCCAGAA gccgTccgCA

101 ATCTTGCCCG AAGCAATGCG GCAACGGAGG CGGTAATCCT TTCTACCTGC

151 AACCGCACCG AGCTTTACTG CGTCGGCGAT TCGGAAgaaa TCATCCGATG

201 GCTTGCCGAT TACCACAGTT TGCCGATTGA AGAAATCCGT CCGTATCTGT

251 ACACGCTGGA TATGCAGGAA ACCGTGCGCC ACGCCTTCCG CGTTGCCTGC

301 GGCTTGGATT CGATGGTTTT GGGCGAGCCG CAGATTTTGG GGCAGATTAA

351 AGATGCGGTG CGTGCGGCTC AAGAACAGGA AAGTATGGGG GCAAAACTCA

401 ATGCCCTGTT CCAAAAAACC TTTTCCGTTG CTAAAGAAGT CCGTACCGAT

451 ACCGCTGTCG GCGAAAATTC GGTTTCGATG GCTTCCGCGT CCGTCAAGTT

501 GGCGGAACAG ATTTTTCCCG ACATCGGCGA TTTGAACGTA TTGTTTATCG

551 GCGCAGGCGA AATGATTGAG CTGGTTGCCA CTTATTTTGC CGCCAAAAAT
```

-continued

```
 601 CCCCGGCTGA TGACGGTTGC CAACCGGACG CTGGCGCGTG CACAGGAGTT
 651 GTGCGACAAG CTCGGTGTTA ACGCCGAACC GTGCCTGCTG TCCGATCTGC
 701 CTGCCATTCT GCACGATTAC GACGTGGTGG TTTCTTCAAC GGCGAGCCAG
 751 CTTCCGATAG TCGGCAAAGG CATGGTCGAA CGCGCATTGA AACAGCGTCA
 801 GAGTATGCCG TTGTTCATGC TTGACTTGGC CGTGCCGCGC GATATTGAAG
 851 CGGAAGTCGG CGATTTGAAC GATGCGTATC TTTATACGGT GGACGATATG
 901 GTCAACATCG TCCAAAGCGg caaggaggca aggcagaaag ccgccgcCgc
 951 cgccgaaacg ctggTGTCCG AAAAGGTTGC CGAATTTGTC AGGCAGCAGC
1001 AGGGCAGGCA GagcgttccG CTGATTAAGG CCTTGCGGGA CGAGGGCGAG
1051 AAAGCGCGCA AGCAGGTGTT GGAAAATGCG ATGAAACAGC TTGCCAAAGG
1101 CGcaaCGGCG GAAGaggttt TGgaacggct gtccgtcCAA CTGACCAACA
1151 AGCTGCTGCA TTCGCCAACT CAAACCTTGA ATAAGGCGGG GGAAGAAGAT
1201 AAAGatttGG TTCATGCCgt cGCGCAGATt tatcatttGG ACAAATAA
```

This corresponds to the amino acid sequence <SEQ ID 1992; ORF 622.ng>:

g622.pep

```
  1 MQLTAVGLNH QTAPLSIREK LAFAAAALPE AVRNLARSNA ATEAVILSTC
 51 NRTELYCVGD SEEIIRWLAD YHSLPIEEIR PYLYTLDMQE TVRHAFRVAC
101 GLDSMVLGEP QILGQIKDAV RAAQEQESMG AKLNALFQKT FSVAKEVRTD
151 TAVGENSVSM ASASVKLAEQ IFPDIGDLNV LFIGAGEMIE LVATYFAAKN
201 PRLMTVANRT LARAQELCDK LGVNAEPCLL SDLPAILHDY DVVVSSTASQ
251 LPIVGKGMVE RALKQRQSMP LFMLDLAVPR DIEAEVGDLN DAYLYTVDDM
301 VNIVQSGKEA RQKAAAAAET LVSEKVAEFV RQQQGRQSVP LIKALRDEGE
351 KARKQVLENA MKQLAKGATA EEVLERLSVQ LTNKLLHSPT QTLNKAGEED
401 KDLVHAVAQI YHLDK*
```

The following partial DNA sequence was identified in *N. meningitidis* <SEQ ID 1993>:

m622.seq

```
  1 ATGCAACTTA CCGCTGTCGG ACTCAATCAT CAAACCGCAC CTTTAAGCAT
 51 ACGGGAAAAG CTGGCGTTTG CCGCCGCCGC CCTGCCTAAA GCCGTCCGCA
101 ATCTTGCCCG AAGCAATGCG GCAACGGAGG CGGTAATCCT TTCTACCTGC
151 AACCGCACCG AGCTTTACTG CGTCGGTGAT TCGGAAGAAA TCATCCGATG
201 GCTTGCCGAT TACCACAGTT TGCCGATTGA AGAAATCCGT CCGTATCTGT
251 ACGCGCTGGA TATGCAGGAG ACTGTGCGCC ATGCTTTCCG CGTCGCCTGC
301 GGGCTGGATT CGATGGTGTT GGGCGAGCCG CAGATTTTAG GACAGATTAA
351 GGATGCCGTT AGGGTTGCTC AAGAGCAGGA AAGTATGGGT AAGAAACTCA
401 ATGCCCTGTT CCAAAAAACC TTTTCCGTTG CTAAAGAGGT CCGTACCGAT
451 ACTGCCGTCG GCGAAAACTC GGTTTCCATG GCTTCCGCTT CCGTCAAATT
```

-continued

```
 501 GGCGGAACAG ATTTTTCCCG ACATCGGCGA TTTGAATGTC TTGTTTATCG

 551 GCGCAGGCGA AATGATTGAG CTGGTTGCCA CTTATTTTGC CGCCAAAAGT

 601 CCCCGGCTGA TGACGGTTGC CAACCGGACG CTGGCGCGTG CACAGGAGTT

 651 GTGCGACAAG CTCGGTGTCA ACGCCGAACC GTGCCTGCTG TCCGATCTGC

 701 CTGCCATTCT GCACGATTAC GACGTAGTGG TTTCTTCAAC GGCAAGCCAG

 751 TTGCCCATTG TCGGCAAAGG CATGGTGGAG CGTGCATTGA AACAAAGGCA

 801 GAGTATGCCG TTGTTCATGC TTGATTTGGC AGTGCCGCGT GACATTGAAG

 851 CGGAAGTCGG CGATTTGAAT GATGCCTATC TTTATACGGT GGACGATATG

 901 GTCAATATCG TCCAAAGCGG CAAGGAGGCA AGGCAGAAGG CCGCCGCCGC

 951 CGCCGAAACG CTGGTGTCCG AGAAAGTTGC CGAATTTGTC AGGCAGCAGC

1001 AGGGCAGGCA GAGTGTCCCC TTGATTAAGG CGTTGCGGGA CGAGGGCGAG

1051 AAAGCGCGCA AACAGGTGTT GGAAAATGCC ATGAAACAGC TTGCCAAAGG

1101 CGCAACGGCA GAAGAGGTTT TGGAACGGCT GTCCGTCCAA CTGACCAACA

1151 AGCTGCTGCA TTCGCCGACC CAAACCTTGA ATAAGGCGGG GGAAGAAGAT

1201 AAAGATTTGG TTCATGCCGT CGCGCAGATT TATCATTTGG ACAAATAA
```

This corresponds to the amino acid sequence <SEQ ID 1994; ORF 622>:

m622.pep

```
  1 MQLTAVGLNH QTAPLSIREK LAFAAAALPK AVRNLARSNA ATEAVILSTC

 51 NRTELYCVGD SEEIIRWLAD YHSLPIEEIR PYLYALDMQE TVRHAFRVAC

101 GLDSMVLGEP QILGQIKDAV RVAQEQESMG KKLNALFQKT FSVAKEVRTD

151 TAVGENSVSM ASASVKLAEQ IFPDIGDLNV LFIGAGEMIE LVATYFAAKS

201 PRLMTVANRT LARAQELCDK LGVNAEPCLL SDLPAILHDY DVVVSSTASQ

251 LPIVGKGMVE RALKQRQSMP LFMLDLAVPR DIEAEVGDLN DAYLYTVDDM

301 VNIVQSGKEA RQKAAAAAET LVSEKVAEFV RQQQGRQSVP LIKALRDEGE

351 KARKQVLENA MKQLAKGATA EEVLERLSVQ LTNKLLHSPT QTLNKAGEED

401 KDLVHAVAQI YHLDK*
```

m622/g622 98.8% identity in 415 aa overlap

```
                   10        20        30        40        50        60
m622.pep   MQLTAVGLNHQTAPLSIREKLAFAAAALPKAVRNLARSNAATEAVILSTCNRTELYCVGD
           |||||||||||||||||||||||||||||:||||||||||||||||||||||||||||||
g622       MQLTAVGLNHQTAPLSIREKLAFAAAALPEAVRNLARSNAATEAVILSTCNRTELYCVGD
                   10        20        30        40        50        60

                   70        80        90       100       110       120
m622.pep   SEEIIRWLADYHSLPIEEIRPYLYALDMQETVRHAFRVACGLDSMVLGEPQILGQIKDAV
           ||||||||||||||||||||||||:|||||||||||||||||||||||||||||||||||
g622       SEEIIRWLADYHSLPIEEIRPYLYTLDMQETVRHAFRVACGLDSMVLGEPQILGQIKDAV
                   70        80        90       100       110       120

                  130       140       150       160       170       180
m622.pep   RVAQEQESMGKKLNALFQKTFSVAKEVRTDTAVGENSVSMASASVKLAEQIEPDIGDLNV
           |:||||||| ||||||||||||||||||||||||||||||||||||||||||||||||||
a622       RAAQEQESMGAKLNALFQKTFSVAKEVRTDTAVGENSVSMASASVKLAEQIEPDIGDLNV
                  130       140       150       160       170       180
```

-continued

```
             190        200        210        220        230        240
m622.pep  LFIGAGEMIELVATYFAAKSPRLMTVANRTLARAQELCDKLGVNAEPCLLSDLPAILHDY
          ||||||||||||||||||:|||||||||||||||||||||||||||||||||||||||||
a622      LFIGAGEMIELVATYFAAKNPRLMTVANRTLARAQELCDKLGVNAEPCLLSDLPAILHDY
             190        200        210        220        230        240

             250        260        270        280        290        300
m622.pep  DVVVSSTASQLPIVGKGMVERALKQRQSMPLFMLDLAVPRDIEAEVGDLNDAYLYTVDDM
          ||||||||||||||||||||||||||||||||||||||||||||||||||||||||||||
a622      DVVVSSTASQLPIVGKGMVERALKQRQSMPLFMLDLAVPRDIEAEVGDLNDAYLYTVDDM
             250        260        270        280        290        300

             310        320        330        340        350        360
m622.pep  VNIVQSGKEARQKAAAAAETLVSEKVAEFVRQQQGRQSVPLIKALRDEGEKARKQVLENA
          ||||||||||||||||||||||||||||||||||||||||||||||||||||||||||||
a622      VNIVQSGKEARQKAAAAAETLVSEKVAEFVRQQQGRQSVPLIKALRDEGEKARKQVLENA
             310        320        330        340        350        360

             370        380        390        400        410
m622.pep  MKQLAKGATAEEVLERISVQLTNKLLHSPTQTLNKAGEEDKDLVHAVAQIYHLDKX
          ||||||||||||||||||||||||||||||||||||||||||||||||||||||||
a622      MKQLAKGATAEEVLERISVQLTNKLLHSPTQTLNKAGEEDKDLVHAVAQIYHLDKX
             370        380        390        400        410
```

The following partial DNA sequence was identified in *N. meningitidis* <SEQ ID 1995>:

a622.seq

```
   1 ATGCAACTTA CCGCTGTCGG ACTCAATCAT CAAACCGCAC CTTTAAGCAT
  51 ACGGGAAAAG CTGGCGTTTG CCGCGGCCTG CCTGCCCGAA GCCGTCCGCA
 101 ATCTTGCCCG AAGCAATGCG GCAACGGAGG CGGTAATCCT TTCTACCTGC
 151 AACCGTACCG AGCTTTACTG TGTAGGTGAT TCGGAAGAAA TCATCCGTTG
 201 GCTCGCAGAC TATCACAGCC TTCCCATAGA AGAAATCAGC CCCTACCTTT
 251 ATACTTTGGG GATGCAGGAG ACTGTGCGCC ATGCTTTCCG CGTCGCCTGC
 301 GGCTTGGATT CGATGGTGTT GGGCGAGCCG CAGATTTTAG GACAGATTAA
 351 GGATGCGGTC AGGGTTGCTC AAGAGCAGGA AAGTATGGGT AAGAAACTCA
 401 ATGCCCTGTT CCAAAAAACC TTTTCTGTTG CTAAAGAGGT CCGTACCGAT
 451 ACTGCCGTCG GCGAAAACTC GGTTTCCATG GCTTCCGCTT CCGTCAAGTT
 501 GGCAGAGCAG ATTTTCCCCG ACATCGGCGA TTTGAATGTC TTGTTTATCG
 551 GTGCGGGTGA GATGATTGAG CTGGTTGCCA CTTATTTTGC CGCCAAAAGT
 601 CCCCGGCTGA TGACGGTTGC CAACCGGACG CTGGCGCGTG CACAGGAGTT
 651 GTGCGACAAG CTCGGTGTCA ACGCCGAACC GTGCCTGCTG TCCGATCTGC
 701 CTGCCATTTT GCATGAGTAC GACGTGGTGG TTTCTTCAAC GGCAAGCCAG
 751 TTGCCCATTG TCGGCAAAGG TATGGTGGAG CGCGCATTGA AACAAAGGCA
 801 GAGTATGCCG TTGTTTATGC TTGACTTGGC CGTGCCGCGA GACATTGAGG
 851 CGGAAGTCGG AGATTTGAAC GATGCCTATC TTTATACGGT GGACGATATG
 901 GTCAATATCG TCCAAAGCGG CAAGGAGGCA AGGCAGAAGG CCGCCGCCGC
 951 CGCCGAAACG CTGGTGTCCG AGAAGGTTGC CGAATTTGTC AGGCAGCAGC
1001 AGGGCAGGCA GAGTGTCCCG TTAATCAGGG CATTGAGGGA TGAGGGAGAG
1051 AAAGCGCGCA AACAGGTCTT GGAAAATGCG ATGAAACAGC TTGCCAAAGG
1101 CGCAACGGCA GAAGAGGTTT TGGAAAGGCT GTCGATCCAA CTGACCAACA
1151 AGCTGCTGCA TTCGCCGACC CAAACCTTGA ATAAGGCGGG GGAAGAAGAT
1201 AAAGATTTGG TTCACGCCGT CGCGCAGATT TATCATTTGG ACAAATAA
```

This corresponds to the amino acid sequence <SEQ ID 1996; ORF 622.a>:

```
a622.pep

  1 MQLTAVGLNH QTAPLSIREK LAFAAACLPE AVRNLARSNA ATEAVILSTC

 51 NRTELYCVGD SEEIIRWLAD YHSLPIEEIS PYLYTLGMQE TVRHAFRVAC

101 GLDSMVLGEP QILGQIKDAV RVAQEQESMG KKLNALFQKT FSVAKEVRTD

151 TAVGENSVSM ASASVKLAEQ IFPDIGDLNV LFIGAGEMIE LVATYFAAKS

201 PRLMTVANRT LARAQELCDK LGVNAEPCLL SDLPAILHEY DVVVSSTASQ

251 LPIVGKGMVE RALKQRQSMP LFMLDLAVPR DIEAEVGDLN DAYLYTVDDM

301 VNIVQSGKEA RQKAAAAAET LVSEKVAEFV RQQQGRQSVP LIRALRDEGE

351 KARKQVLENA MKQLAKGATA EEVLERLSIQ LTNKLLHSPT QTLNKAGEED

401 KDLVHAVAQI YHLDK*
```

m622/a622 98.1% identity in 415 aa overlap

```
                   10        20        30        40        50        60
m622.pep   MQLTAVGLNHQTAPLSIREKLAFAAAALPKAVRNLARSNAATEAVILSTCNRTELYCVGD
           |||||||||||||||||||||||||| ||:||||||||||||||||||||||||||||||
a622       MQLTAVGLNHQTAPLSIREKLAFAAACLPEAVRNLARSNAATEAVILSTCNRTELYCVGD
                   10        20        30        40        50        60

                   70        80        90       100       110       120
m622.pep   SEEIIRWLADYHSLPIEEIRPYLYALDMQETVRHAFRVACGLDSMVLGEPQILGQIKDAV
           ||||||||||||||||||| ||||:| |||||||||||||||||||||||||||||||||
a622       SEEIIRWLADYHSLPIEEISPYLYTLGMQETVRHAFRVACGLDSMVLGEPQILGQIKDAV
                   70        80        90       100       110       120

                  130       140       150       160       170       180
m622.pep   RVAQEQESMGKKLNALFQKTFSVAKEVRTDTAVGENSVSMASASVKLAEQIEPDIGDLNV
           ||||||||||||||||||||||||||||||||||||||||||||||||||||||||||||
a622       RVAQEQESMGKKLNALFQKTFSVAKEVRTDTAVGENSVSMASASVKLAEQIEPDIGDLNV
                  130       140       150       160       170       180

                  190       200       210       220       230       240
m622.pep   LFIGAGEMIELVATYFAAKSPRLMTVANRTLARAQELCDKLGVNAEPCLLSDLPAILHDY
           ||||||||||||||||||||||||||||||||||||||||||||||||||||||||||:|
a622       LFIGAGEMIELVATYFAAKSPRLMTVANRTLARAQELCDKLGVNAEPCLLSDLPAILHEY
                  190       200       210       220       230       240

                  250       260       270       280       290       300
m622.pep   DVVVSSTASQLPIVGKGMVERALKQRQSMPLFMLDLAVPRDIEAEVGDLNDAYLYTVDDM
           ||||||||||||||||||||||||||||||||||||||||||||||||||||||||||||
a622       DVVVSSTASQLPIVGKGMVERALKQRQSMPLFMLDLAVPRDIEAEVGDLNDAYLYTVDDM
                  250       260       270       280       290       300

                  310       320       330       340       350       360
m622.pep   VNIVQSGKEARQKAAAAAETLVSEKVAEFVRQQQGRQSVPLIKALRDEGEKARKQVLENA
           ||||||||||||||||||||||||||||||||||||||||||:|||||||||||||||||
a622       VNIVQSGKEARQKAAAAAETLVSEKVAEFVRQQQGRQSVPLIRALRDEGEKARKQVLENA
                  310       320       330       340       350       360

                  370       380       390       400       410
m622.pep   MKQLAKGATAEEVLERISVQLTNKLLHSPTQTLNKAGEEDKDLVHAVAQIYHLDKX
           ||||||||||||||||||:|||||||||||||||||||||||||||||||||||||
a622       MKQLAKGATAEEVLERISIQLTNKLLHSPTQTLNKAGEEDKDLVHAVAQIYHLDKX
                  370       380       390       400       410
```

The following partial DNA sequence was identified in *N. gonorrhoeae* <SEQ ID 1997>:

```
g624.seq

  1 ATGATCCGTT ATCTTTTAAT TGCCTGCGGC GGCATCTCCC TGCTGTTGGG

 51 GATAATCGGC ATTTTTTTGC CGCTGTTGCC GACCACGCCG TTCGTACTAC

101 TCTCCGCCGC CTGCTGGGCA AAGGCAtccc cgcgcTTTCa ccgCTGGCTG

151 CACcgGCacc gCTATTTCGG CCCGATGGTT CATAACTGGG AACAAAACGG
```

-continued

```
201 CGCAGTGCCG CGCAAAGCCA AGATTTTCGC CATCAGCATG AtaaccgcAt

251 cctgcctcat gatctTTtgg CattTTCccc aacnctggtg ggtcGGGGCG

301 GTTTCATCGG TTTTTTGTTC CCTTGTcacC ATacggatgt gGcacAGacC

351 cgaatCTTGA
```

This corresponds to the amino acid sequence <SEQ ID 1998; ORF 624.ng>:

g624.pep

```
  1 MIRYLLIACG GISLLLGIIG IFLPLLPTTP FVLLSAACWA KASPRFHRWL

 51 HRHRYFGPMV HNWEQNGAVP RKAKIFAISM ITASCLMIFW HFPQXWWVGA

101 VSSVFCSLVT IRMWHRPES*
```

The following partial DNA sequence was identified in *N. meningitidis* <SEQ ID 1999>:

m624.seq

```
  1 ATGATACGTT ATCTTTTAAT TGCCTGCGGC TGCATTTCCC TACTGTTGGG

 51 TATCATCGGC ATTTTTTTGC CGCTGTTGCC GACCACGCCG TTCGTACTGC

101 TCTCCGCCGC CTGCTGGGCA AAGGCATCCC CGCGCTTTTA CCGCTGGCTG

151 CACCGGCACC GCTATTTCGG CCCGATGGTT CATAACTGGG AACAAAACGG

201 CGCAGTGCCG CGCAAAGCCA AAATATTCGC CATCAGTATG ATGACCGCAT

251 CCTGCCTGAT AATGTTTTGG CAGTTTCCCC AACGCTGGTG GGTCGGGGCG

301 GTTTCATCGG TTTTTTGTTC CCTTGTCGCC ATATGGATGT GGCGCAGGCC

351 CGAATCTTGA
```

This corresponds to the amino acid sequence <SEQ ID 2000; ORF 624>:

m624.pep

```
  1 MIRYLLIACG CISLLLGIIG IFLPLLPTTP FVLLSAACWA KASPRFYRWL

 51 HRHRYFGPMV HNWEQNGAVP RKAKIFAISM MTASCLIMFW QFPQRWWVGA

101 VSSVFCSLVA IWMWRRPES*
```

m624/g624 91.6% identity in 119 aa overlap

```
                   10        20        30        40        50        60
m624.pep   MIRYLLIACGCISLLLGIIGIFLPLLPTTPFVLLSAACWAKASPRFYRWLHRHRYFGPMV
           |||||||||| |||||||||||||||||||||||||||||||||||||:||||||||||||
g624       MIRYLLIACGGISLLLGIIGIFLPLLPTTPFVLLSAACWAKASPRFHRWLHRHRYFGPMV
                   10        20        30        40        50        60

                   70        80        90       100       110       120
m624.pep   HNWEQNGAVPRKAKIFAISMMTASCLIMFWQFPQRWWVGAVSSVFCSLVAIWMWRRPESX
           ||||||||||||||||||||:|||||::||:||| |||||||||||||||:| ||:|||||
g624       HNWEQNGAVPRKAKIFAISMITASCLMIFWHFPQXWWVGAVSSVFCSLVTIRMWHRPESX
                   70        80        90       100       110       120
```

The following partial DNA sequence was identified in *N. meningitidis* <SEQ ID 2001>:

a624.seq

```
  1 ATGATACGTT ATCTTTTAAT TGCCTGCGGC TGCATTTCCC TGCTGTTGGG
 51 TATCATCGGC ATTTTTTTGC CGCTGTTGCC GACCACGCCG TTCGTACTGC
101 TCTCCGCCGC CTGCTGGGCA AAGGCATCCC CGCGCTTTCA CCGCTGGCTG
152 CACCGGCACC GCTATTTCGG TCCGATGGTT CATAACTGGG AACAAAACGG
201 CGCAGTGCCG CGCAAAGCCA AAATATTCGC CATCAGTATG ATGACCGCAT
251 CCTGCCTGAT AATGTTTTGG CAGTTTCCCC AACGCTGGTG GGTCGGGGCG
301 GTTTCATCGG TTTTTTGTTC CCTTGTCGCC ATATGGATGT GGCGCAGGCC
351 CGAATCTTGA
```

This corresponds to the amino acid sequence <SEQ ID 2002; ORF 624.a>:

a624.pep

```
  1 MIRYLLIACG CISLLLGIIG IFLPLLPTTP FVLLSAACWA KASPRFHRWL
 51 HRHRYFGPMV HNWEQNGAVP RKAKIFAISM MTASCLIMFW QFPQRWWVGA
101 VSSVFCSLVA IWMWRRPES*
``` m624/a624 99.2% identity in 119 aa overlap

```
                   10        20        30        40        50        60
m624.pep   MIRYLLIACGCISLLLGIIGIFLPLLPTTPFVLLSAACWAKASPRFYRWLHRHRYFGPMV
           ||||||||||||||||||||||||||||||||||||||||||||||:|||||||||||||
a624       MIRYLLIACGCISLLLGIIGIFLPLLPTTPFVLLSAACWAKASPRFHRWLHRHRYFGPMV
                   10        20        30        40        50        60

70        80        90       100       110       120
m624.pep   HNWEQNGAVPRKAKIFAISMMTASCLIMFWQFPQRWWVGAVSSVFCSLVAIWMWRRPESX
           ||||||||||||||||||||||||||||||||||||||||||||||||||||||||||||
a624       HNWEQNGAVPRKAKIFAISMMTASCLIMFWQFPQRWWVGAVSSVFCSLVAIWMWRRPESX
                   70        80        90       100       110       120
```

The following partial DNA sequence was identified in *N. meningitidis* <SEQ ID 2003>:

a625.seq

```
  1 ATGTTTGCAA CCAGGAAAAT GAAGAAGATG ACGATGTGCA CGCGGCGGGT
 51 ACGGTTTTGG TTGGCTTTCA GCAGCGGACG AATCATCAGC ATTGCTGCGC
101 CGGTCGTTCC CATGATAGAG GCAAGTGCCG TACCGACGGC AAGCAGGGCG
151 GTGTTGAGCT TGGGTGTGCC GTTCAAGTCG CCCCAAACCA AAATGCCGCC
201 TGAAATGGTG TACAGGGCAA GCAGCAGCAG GATGAAAGGG ATGTATTCTT
251 CAACGAGTGC GTGTGCGACG GTATGGATAC CGGCGGACGC GCCAAAAACC
301 AAACTGAACG GGATGAGGAA GAGCAATGTC CAAAAGGCGG TAATTTTGCC
351 GTAA
```

The following partial DNA sequence was identified in *N. gonorrhoeae* <SEQ ID 2004>:

g625.seq

```
  1 atGTTTGCAA CCAGGAAAAT GAAGAAGATG ACGATGTGCA CGCGGCGGGT
 51 ACGGtCTTGG TTGGCTTTCA GCAGCGGACG AATCATCAGC AttgCCGCGC
101 CGGtcgttcC CATGATAGAG GCAAGTGCCG TACCGACGGC AAGCAGGGCG
151 GTGTTGAGCT TGGGTGTGCC GTTCAAGTCG CCCCAAACCA AAATGCCGCC
201 TGAAATGGTG TACAGGGCAA GCAGCAGCAG GATGAAGGGG ATATATTCTT
251 CAACGAGTGC GTGTGCGACG GTATGGATAC CGGCGGACGC GCCAAAAACC
301 AAACTGAACG GGATGAGGAA GAGCAATGTC CAAAAGGCGG TGATTTTGCc
351 gtAA
```

This corresponds to the amino acid sequence <SEQ ID 2005; ORF 625.ng>:

g625.pep

```
  1 MFATRKMKKM TMCTRRVRSW LAFSSGRIIS IAAPVVPMIE ASAVPTASRA
 51 VLSLGVPFKS PQTKMPPEMV YRASSSRMKG IYSSTSACAT VWIPADAPKT
101 KLNGMRKSNV QKAVILP*
```

The following partial DNA sequence was identified in *N. meningitidis* <SEQ ID 2006>:

m625.seq

```
  1 ATGTTTGCAA CCAGGAAAAT GAAGAAGATG ACGATGTGCA CGCGGCGGGT
 51 ACGGTTTTGG TTGGCTTTCA GCAGCGGACG AATCATCAGC ATTGCTGCGC
101 CGGTCGTTCC CATGATAGAG GCAAGTGCCG TACCGACGGC AAGCAGGGCG
151 GTGTTGAGCT TGGGTGTGCC GTTCAAGTCG CCCCAAACCA AAATGCCGCC
201 TGAAATGGTG TACAGGGCAA GCAGCAGCAG GATGAAAGGG ATGTATTCTT
251 CAACGAGTGC GTGTGCGACG GTATGGATAC CGGCGGACGC GCCAAAAACC
301 AAACTGAACG GGATGAGGAA GAGCAATGTC CAAAAGGCGG TAATTTTGCC
351 GTAA
```

This corresponds to the amino acid sequence <SEQ ID 2007; ORF 625>:

m625.pep

```
  1 MFATRKMKKM TMCTRRVRFW LAFSSGRIIS IAAPVVPMIE ASAVPTASRA
 51 VLSLGVPFKS PQTKMPPEMV YRASSSRMKG MYSSTSACAT VWIPADAPKT
101 KLNGMRKSNV QKAVILP*
```

m625/g625 98.3% identity in 117 aa overlap

```
                10         20         30         40         50         60
m625.pep  MFATRKMKKMTMCTRRVRFWLAFSSGRIISIAAPVVPMIEASAVPTASRAVLSLGVPFKS
          |||||||||||||||||| |||||||||||||||||||||||||||||||||||||||||||
g625      MFATRKMKKMTMCTRRVRSWLAFSSGRIISIAAPVVPMIEASAVPTASRAVLSLGVPFKS
                10         20         30         40         50         60
                70         80         90        100        110
m625.pep  PQTKMPPEMVYRASSSRMKGMYSSTSACATVWIPADAPKTKLNGMRKSNVQKAVILPX
          ||||||||||||||||||||:||||||||||||||||||||||||||||||||||||
g625      PQTKMPPEMVYRASSSRMKGIYSSTSACATVWIPADAPKTKLNGMRKSNVQKAVILPX
                70         80         90        100        110
```

This corresponds to the amino acid sequence <SEQ ID 2008; ORF 625.a>:

a625.pep

```
  1 MFATRKMKKM TMCTRRVRFW LAFSSGRIIS IAAPVVPMIE ASAVPTASRA
 51 VLSLGVPFKS PQTKMPPEMV YRASSSRMKG MYSSTSACAT VWIPADAPKT
101 KLNGMRKSNV QKAVILP*
```

m625/a625 100.0% identity in 117 aa overlap

```
                10         20         30         40         50         60
m625.pep  MFATRKMKKMTMCTRRVRFWLAFSSGRIISIAAPVVPMIEASAVPTASRAVLSLGVPFKS
          ||||||||||||||||||||||||||||||||||||||||||||||||||||||||||||
a625      MFATRKMKKMTMCTRRVRFWLAFSSGRIISIAAPVVPMIEASAVPTASRAVLSLGVPFKS
                10         20         30         40         50         60
                70         80         90        100        110
m625.pep  PQTKMPPEMVYRASSSRMKGMYSSTSACATVWIPADAPKTKLNGMRKSNVQKAVILPX
          |||||||||||||||||||||||||||||||||||||||||||||||||||||||||
a625      PQTKMPPEMVYRASSSRMKGMYSSTSACATVWIPADAPKTKLNGMRKSNVQKAVILPX
                70         80         90        100        110
```

The following partial DNA sequence was identified in *N. gonorrhoeae* <SEQ ID 2009>:

g627.seq

```
  1 ATGTCCGGCC TTTGGAAACC CGAACACCCG GGATTTGAAA TCCTCGGCAG
 51 CCGTTACGCC CTGCAAAACC TTGTCCGCGA TGTCATCCTG ATTACATTGA
101 CCGCCGTATC TATGGCAATC ACGCCCAAAC AAGTCCGCGC AGGCAACGAA
151 TTCAACTTTG AACCCATCGC CGAAGTGGGC AAACTCTTCC TCGGCATCTT
201 CATCACCATC TTCCCCGTCC TGAGCATTCT GAAAGCAGGC GAGGCAGGCG
251 CGCTGGGCGG GGTGGTATCG CTGGTTCACG ATACGGCAGG TCATCCGATT
301 AATACGATGT ATTTCTGGAT GAGCGGCATA TTGTCGGCAT TCTTGGATAA
351 CGCGCCCACT TATCTCGTGT TTTTCAATAT GGCGGGCGGC GATGCCCAAG
401 CCTTAATGAC GGGTCCCCTG TTTCATTcgc TGCTGGCGGT TTCTAtgggT
451 tCGGTATTCA TGGGCGCACT GaccTACATc gGCAAcgcac cgaactTCAT
501 GGTcaaggcc aTTGCCGaaC agcgcgGCgt accgaTGCcg actTTCTTcc
551 ggtaTAtgat gtggtcggtc gcCTTCCTGa caCCCGTCTT CAtcgTACAT
601 ACCCTcgtCT TTTTcgTTtt cAAACTACTg taa
```

This corresponds to the amino acid sequence <SEQ ID 2010; ORF 627.ng>:

g627.pep

```
  1 MSGLWKPEHP GFEILGSRYA LQNLVRDVIL ITLTAVSMAI TPKQVRAGNE
 51 FNFEPIAEVG KLFLGIFITI FPVLSILKAG EAGALGGVVS LVHDTAGHPI
101 NTMYFWMSGI LSAFLDNAPT YLVFFNMAGG DAQALMTGPL FHSLLAVSMG
151 SVFMGALTYI GNAPNFMVKA IAEQRGVPMP TFFRYMMWSV AFLTPVFIVH
201 TLVFFVFKLL *
```

The following partial DNA sequence was identified in *N. meningitidis* <SEQ ID 2011>:

m627.seq

```
  1 ATGTCCGGCC TTTGGAAACC CGAACACCCG GGATTTGAAA TCCTCGGCAG
 51 CCGTTACGCC CTGCAAAACC TCGTCCGCGA TGTCATCCTG ATTGCATTGA
101 CCGCCGTATC TATGGCAATC ACGCCCAAAC AAGTCCGCGC AGGCAACGAA
151 TTCAACTTTG AACCCATGGC CGAAGTGGGC AAACTCTTCC TCGGCATCTT
201 CATCACCATC TTTCCCGTCC TGAGCATTCT GAAAGCAGGC GAGGCAGGCG
251 CGCTGGGCGG GGTGGTATCG CTGGTTCACG ATACGGCAGG TCATCCGATT
301 AATGTGATGT ATTTTTGGAT GAGCGGCATA TTGTCGGCAT TCTTGGATAA
351 CGCGCCCACT TATCTCGTTT TTTTCAATAT GGCGGGCGGC GATGCCCAAG
401 CCTTGATGAC GGGTACCCTG TTTCATTCGC TGCTGGCGGT TTCTATGGGT
451 TCGGTATTCA TGGGCGCACT GACCTACATC GGCAACGCAC CGAACTTCAT
501 GGTCAAGGCC ATTGCCGAAC AGCGCGGCGT ACCGATGCCG ACTTTCTTCG
551 GCTATATGAT GTGGTCGGTC GCCTTCCTGA CACCCGTCTT CATCGTACAT
601 ACCCTTATCT TTTTCGTTTT CAAACTGCTG TAA
```

This corresponds to the amino acid sequence <SEQ ID 2012; ORF 627>:

m627.pep

```
  1 MSGLWKPEHP GFEILGSRYA LQNLVRDVIL IALTAVSMAI TPKQVRAGNE
 51 FNFEPIAEVG KLFLGIFITI FPVLSILKAG EAGALGGVVS LVHDTAGHPI
101 NVMYFWMSGI LSAFLDNAPT YLVFFNMAGG DAQALMTGTL FHSLLAVSMG
151 SVFMGALTYI GNAPNFMVKA IAEQRGVPMP TFFGYMMWSV AFLTPVFIVH
201 TLIFFVFKLL *
```

Computer analysis of this amino acid sequence gave the following results:

Homology with a predicted ORF from *N. gonorrhoeae* m627/g627 97.6% identity in 210 aa overlap

```
                    10        20        30        40        50        60
m627.pep   MSGLWKPEHPGFEILGSRYALQNLVRDVILIALTAVSMAITPKQVRAGNEFNFEPIAEVG
           |||||||||||||||||||||||||||||||:||||||||||||||||||||||||||||
g627       MSGLWKPEHPGFEILGSRYALQNLVRDVILITLTAVSMAITPKQVRAGNEFNFEPIAEVG
                    10        20        30        40        50        60
```

-continued

```
                70        80        90        100       110       120
m627.pep  KLFLGIFITIFPVLSILKAGEAGALGGVVSLVHDTAGHPINVMYFWMSGILSAFLDNAPT
          ||||||||||||||||||||||||||||||||||||||||:|||||||||||||||||||
g627      KLFLGIFITIFPVLSILKAGEAGALGGVVSLVHDTAGHPINTMYFWMSGILSAFLDNAPT
                70        80        90        100       110       120

                130       140       150       160       170       180
m627.pep  YLVFFNMAGGDAQALMTGTLFHSLLAVSMGSVFMGALTYIGNAPNFMVKAIAEQRGVPMP
          |||||||||||||||||| |||||||||||||||||||||||||||||||||||||||||
g627      YLVFFNMAGGDAQALMTGPLFHSLLAVSMGSVFMGALTYIGNAPNFMVKAIAEQRGVPMP
                130       140       150       160       170       180

                190       200       210
m627.pep  TFFGYMMWSVAFLTPVFIVHTLIFFVFKLLX
          ||| |||||||||||||||||||:||||||||
g627      TFFRYMMWSVAFLTPVFIVHTLVFFVFKLLX
                190       200       210
```

The following partial DNA sequence was identified in *N. meningitidis* <SEQ ID 2013>:

a627.seq

```
  1 ATGTCCGGCC TTTGGAAACC CGAACACCCG GGATTTGAAA TCCTCGGCAG
 51 CCGTTACGCC CTGCAAAACC TCGTCCGCGA TGTCATCCTG ATTGCATTGA
101 CCGCCGTATC TATGGCAATC ACGCCCAAAC AAGTCCGCGC AGGCAACGAA
151 TTCAACTTTG AACCCATCGC CGAAGTGGGC AAACTCTTCC TCGGCATCTT
201 CATCACCATC TTTCCCGTCC TGAGCATTCT GAAAGCAGGC GAGGCAGGCG
251 CGCTGGGCGG GGTGGTATCG CTGGTTCACG ATACGGCAGG TCATCCGATT
301 AATGTGATGT ATTTTTGGAT GAGCGGCATA TTGTCGGCAT TCTTGGATAA
351 CGCGCCCACT TATCTCGTTT TTTTCAATAT GGCGGGCGGC GATGCCCAAG
401 CCTTGATGAC GGGTTCCCTG TTTCATTCGC TGCTGGCGGT TTCTATGGGT
451 TCGGTATTCA TGGGCGCACT GACCTACATC GGCAACGCAC CGAACTTCAT
501 GGTCAAGGCC ATTGCCGAAC AGCGCGGCGT ACCGATGCCG ACTTTCTTCG
551 GCTATATGAT GTGGTCGGTC GCCTTCCTGA CACCCGTCTT CATCGTACAT
601 ACCCTTATCT TTTTCGTTTT CAAACTGCTG TAA
```

This corresponds to the amino acid sequence <SEQ ID 2014; ORF 627.a>:

a627.pep

```
  1 MSGLWKPEHP GFEILGSRYA LQNLVRDVIL IALTAVSMAI TPKQVRAGNE
 51 FNFEPIAEVG KLFLGIFITI FPVLSILKAG EAGALGGVVS LVHDTAGHPI
101 NVMYFWMSGI LSAFLDNAPT YLVFFNMAGG DAQALMTGSL FHSLLAVSMG
151 SVFMGALTYI GNAPNFMVKA IAEQRGVPMP TFFGYMMWSV AFLTPVFIVH
201 TLIFFVFKLL *
```

m627/a627 99.5% identity in 210 aa overlap

```
                10        20        30        40        50        60
m627.pep  MSGLWKPEHPGFEILGSRYALQNLVRDVILIALTAVSMAITPKQVRAGNEFNFEPIAEVG
          ||||||||||||||||||||||||||||||||||||||||||||||||||||||||||||
a627      MSGLWKPEHPGFEILGSRYALQNLVRDVILIALTAVSMAITPKQVRAGNEFNFEPIAEVG
                10        20        30        40        50        60
```

-continued

```
                 70        80        90       100       110       120
m627.pep  KLFLGIFITIFPVLSILKAGEAGALGGVVSLVHDTAGHPINVMYFWMSGILSAFLDNAPT
          ||||||||||||||||||||||||||||||||||||||||||||||||||||||||||||
a627      KLFLGIFITIFPVLSILKAGEAGALGGVVSLVHDTAGHPINVMYFWMSGILSAFLDNAPT
                 70        80        90       100       110       120

                130       140       150       160       170       180
m627.pep  YLVFFNMAGGDAQALMTGTLFHSLLAVSMGSVFMGALTYIGNAPNFMVKAIAEQRGVPMP
          ||||||||||||||||||:|||||||||||||||||||||||||||||||||||||||||
a627      YLVFFNMAGGDAQALMTGSLFHSLLAVSMGSVFMGALTYIGNAPNFMVKAIAEQRGVPMP
                130       140       150       160       170       180

                190       200       210
m627.pep  TFFGYMMWSVAFLTPVFIVHTLIFFVFKLLX
          ||||||||||||||||||||||||||||||
a627      TFFGYMMWSVAFLTPVFIVHTLIFFVFKLLX
                190       200       210
```

The following partial DNA sequence was identified in *N. gonorrhoeae* <SEQ ID 2015>:

g628.seq

```
  1 ATGTGCGTGC CACTCAAGCC GGCAGGATGC GGGCCGCCAA ATTCATGTGT
 51 TTCGATATTG GCAGCATTTT CAGACGGCAC GTCTGCGCCT GCTGCTTTAC
101 ACACATGGAT TTTACGTTCG GTCAGGCGGC TCAATACCAA CAGGCCGCGT
151 TTGAAGTCTT CGGCGGCTTC TTTGATGATG ACCGTAGGGT CGGCAGCCAG
201 CGGATTGGTG TCCATCGCAT TGACGAAGAT GGCGAACGGC TCGGCATCTA
251 CGGCAGGGAT TTTGCTGAAC GGACGGGTGC GAAGCGCAGT CCATAAGCCT
301 GATTGAATCA GGTTGCGGCG CACTTTTTCG CTGCTCAATT TTGCCAGCGC
351 TTCAGGTacg TAG
```

This corresponds to the amino acid sequence <SEQ ID 2016; ORF 628.ng>:

g628.pep

```
  1 MCVPLKPAGC GPPNSCVSIL AAFSDGTSAP AALHTWILRS VRRLNTNRPR
 51 LKSSAASLMM TVGSAASGLV SIALTKMANG SASTAGILLN GRVRSAVHKP
101 D*IRLRRTFS LLNFASASGT *
```

The following partial DNA sequence was identified in *N. meningitidis* <SEQ TD 2017>:

m628.seq

```
  1 ATGTGCGTGC CACTCAAACC GGCAGGATGC GGGCCGCCGA ATTCATGTGT
 51 TTCGATGTTG GCAGCATTTT CAGACGGCAC GTCTGCGCCA GCTGCCTTAC
101 AAACATGGAT TTTGCGTTCG GTCAAACGGC TCAATACCAA CAGGCCGCGT
151 TTGAAATCCT CGGCGGCTTC TTTGATAATG ACCGTAGGGT CGGCAGCCAG
201 CGGATTGGTG TCCATCGCAT TGACGAAGAT GGCGAACGGC TCGGCATCGA
251 CGGCAGGAAT TTTGCTGAAC GGACGGGTGC GCAGCGCAGT CCACAAACCG
301 GATTGGATCA GGTTGCGGCG CACTTCTTCG CCGCTTAAGT TTGCCAGCGC
351 TTCAGGTGCG TAG
```

This corresponds to the amino acid sequence <SEQ ID 2018; ORF 628>:

```
m628.pep

  1 MCVPLKPAGC GPPNSCVSML AAFSDGTSAP AALQTWILRS VKRLNTNRPR

 51 LKSSAASLIM TVGSAASGLV SIALTKMANG SASTAGILLN GRVRSAVHKP

101 DWIRLRRTSS PLKFASASGA *
```

Computer analysis of this amino acid sequence gave the following results:

Homology with a predicted ORF from *N. gonorrhoeae* m628/g628 93.3% identity in 119 aa overlap

```
                   10        20        30        40        50        60
m628.pep   MCVPLKPAGCGPPNSCVSMLAAFSDGTSAPAALQTWILRSVKRLNTNRPRLKSSAASLIM
           |||||||||||||||||||:||||||||||||||:|||||||:|||||||||||||||:|
g628       MCVPLKPAGCGPPNSCVSILAAFSDGTSAPAALHTWILRSVRRLNTNRPRLKSSAASLMM
                   10        20        30        40        50        60

                   70        80        90       100       110       120
m628.pep   TVGSAASGLVSIALTKMANGSASTAGILLNGRVRSAVHKPDWIRLRRTSSPLKFASASGA
           |||||||||||||||||||||||||||||||||||||||| |||||| | |:||||||:
g628       TVGSAASGLVSIALTKMANGSASTAGILLNGRVRSAVHKPDXIRLRRTFSLLNFASASGT
                   70        80        90       100       110       120

m628.pep   X

g628       X
```

The following partial DNA sequence was identified in *N. meningitidis* <SEQ ID 2019>:

```
a628.seq

  1 ATGTGCGTGC CACTCAAACC GGCCGGATGC GGGCCGCCGA ATTCATGTGT

 51 TTCGATGTTG GCAGCATTTT CAGACGGCAC GTCTGCGCCA GCTGCCTTAC

101 ACACATGGAT TTTACGCTCG GTCAAACGGC TCAATACCAG CAAACCTCGT

151 CTGAAATCCT CGGCGGCTTC TTTGATCACA ACCACAGGGT CTGCCGCCAG

201 CGGATTGGTG TCCATCGCAT TGACGAAGAT GGCGAACGGC TCGGCATCGA

251 CGGCAGGGAT TTTGCTGAAC GGACGGGTAC GCAGCGCAGT CCACAAACCG

301 GATTGGATCA GATTGCGGCG CACTTCTTCG CCGCTTAAGT TTGCCAACGC

351 TTCGGGCGCG TAG
```

This corresponds to the amino acid sequence <SEQ ID 2020; ORF 628.a>:

```
a628.pep

  1 MCVPLKPAGC GPPNSCVSML AAFSDGTSAP AALHTWILRS VKRLNTSKPR

 51 LKSSAASLIT TTGSAASGLV SIALTKMANG SASTAGILLN GRVRSAVHKP

101 DWIRLRRTSS PLKFANASGA *
```

m628/a628 95.0% identity in 120 aa overlap

```
                 10        20        30        40        50        60
m628.pep  MCVPLKPAGCGPPNSCVSMLAAFSDGTSAPAALQTWILRSVKRLNTNRPRLKSSAASLIM
          ||||||||||||||||||||||||||||||||:||||||||||||::|||||||||||
a628      MCVPLKPAGCGPPNSCVSMLAAFSDGTSAPAALHTWILRSVKRLNTSKPRLKSSAASLIT
                 10        20        30        40        50        60

                 70        80        90       100       110       120
m628.pep  TVGSAASGLVSIALTKMANGSASTAGILLNGRVRSAVHKPDWIRLRRTSSPLKFASASGA
          |:|||||||||||||||||||||||||||||||||||||||||||||||||||||:||||
a628      TTGSAASGLVSIALTKMANGSASTAGILLNGRVRSAVHKPDWIRLRRTSSPLKFANASGA
                 70        80        90       100       110       120

m628.pep  X
          |
a628      X
```

The following partial DNA sequence was identified in *N. gonorrhoeae* <SEQ ID 2021>:

g629.seq

```
  1 ATGACTGCca aacCTTTTTC CCTCAACCTG GCcaaCCTCC TGCTGCCggc
 51 ggtatTGTTT GCCGTCAGcc tGtcggTCGG cattgccgaT TTCCGCTGGT
101 CGGATGTGTT TTCGCTGTCC GACAGCCAGC AAGTGATGTT CATCAGCCGC
151 CTGCCGCGCA CGTTTGcgaT TGTGTTGACG GGCgcgtcga tagcgGtggc
201 gGGGAtgatt atgcagATTC TGATGCGCAA CcgtTTTGTC GAGCCTtcta
251 tggcgGGTGC GGGCCAAAGt gcgGCTTTGG GTttgcttct gAtgtccctg
301 ctgctgcctg CcgcGccgct gccggtcaAA ATGTCGGtag Ccgccgttgc
351 CGCGCTGATC GGGATGTTGG tctTtatgct gctaatccgC Cgcctgccac
401 cgacggcgca gctgatgGTg ccgCTGGTGG Gg.ttATTTT CGGCGGCGTG
451 GttgaGGCGG TGGCGACGTT TGTCGCGTAT GAGTTTGAGA TGCTGCAAAT
501 GTTGGGCGTG TGGCAGCAGG GCGACTTTTC AAGCGTGCTG CTGGGGCGGT
551 ACGAGCTGCT TGGATTACG GGCGGTTTGG CGGTGTTTGC CTACCTGATT
601 GCCGACCGGC TGACGATTTT GGGGCTGGGC GAGACGGTGA GCGTGAATTT
651 GGGTTTGAAC CGGACGGCGG TGTTGTGGTC GGGTTTGATT ATTGTGGCAC
701 TGATTACATC GCTGGTCATT GTAACGGTCG GCAATATTCC GTTTATCGGG
751 CTGGTCGTGC CGAATATCGT CAGCCGCCTG ATGGGCGACA GGCTGCGCCA
801 AAGCCTGCCT GCGGTCGCCC TCTTGGGCGC GTCTTTGGTT TTATTGTGCG
851 ACATTATCGG ACGCATGATT GTGTTTCCGT TTGAAATTCC GGTCTCCACG
901 GTTTTTGGTG TGTTGGGTAC GGCTTTGTTT TTGTGGCTTT TGTTGAGGAA
951 ACCCGCCTAT GCCGTCTGA
```

This corresponds to the amino acid sequence <SEQ ID 2022; ORF 629.ng>:

g629.pep

```
  1 MTAKPFSLNL ANLLLPAVLF AVSLSVGIAD FRWSDVFSLS DSQQVMFISR
 51 LPRTFAIVLT GASIAVAGMI MQILMRNRFV EPSMAGAGQS AALGLLLMSL
101 LLPAAPLPVK MSVAAVAALI GMLVFMLLIR RLPPTAQLMV PLVGXIFGGV
151 VEAVATFVAY EFEMLQMLGV WQQGDFSSVL LGRYELLWIT GGLAVFAYLI
```

-continued

```
201 ADRLTILGLG ETVSVNLGLN RTAVLWSGLI IVALITSLVI VTVGNIPFIG
251 LVVPNIVSRL MGDRLRQSLP AVALLGASLV LLCDIIGRMI VFPFEIPVST
301 VFGVLGTALF LWLLLRKPAY AV*
```

The following partial DNA sequence was identified in *N. meningitidis* <SEQ ID 2023>:

m629.seq

```
  1 ATGACTGCCA AACCTTTTTC CCTCAACCTG ACCAACCTGC TGCTGCTGGC
 51 GGTGTTGTTT GCCGTCAGCC TGTCGGTGGG CGTTGCCGAT TTCCGCTGGT
101 CTGATGTGTT TTCACTGTCC GACAGCCAGC AGGTCATGTT CATCAGCCGC
151 CTGCCGCGCA CGTTTGCGAT TGTGCTGACG GGCGCGTCGA TGGCGGTGGC
201 CGGCATGATT ATGCAGATTT TGATGCGCAA CCGTTTTGTC GAACCGTCGA
251 TGGTGGGCGC AAGCCAAAGC GCGGCTTTAG GTTTGCTGCT GATGACCCTG
301 CTGCTGCCGG CCGCGCCGCT GCCGGCGAAA ATGTCGGTTG CCGCCGTTGC
351 CGCGCTGATC GGGATGTTGG TCTTTATGCT GCTGATCCGC CGCCTGCCGC
401 CGACCGCGCA ACTGATGGTG CCTTTGGTCG GGATTATTTT CGGCGGTGTG
451 ATTGAGGCGG TAGCCACCTT TATCGCGTAT GAAAACGAAA TGCTGCAAAT
501 GCTCGGCGTG TGGCAGCAGG GCGATTTTTC GAGCGTGCTG CTGGGGCGGT
551 ACGAGCTGCT TTGGATTACG GGCGGTTTGG CGGTGTTTGC CTATCTGATT
601 GCCGACCGGC TGACGATTTT GGGGCTGGGC GAAACGGTAA GCGTGAATTT
651 GGGTTTGAAC CGGACGGCGG TGTTGTGGTC GGGTTTGATT ATTGTGGCTT
701 TGATTACGTC GCTGGTTATC GTTACGGTCG GCAATATTCC GTTTATCGGG
751 CTGGTCGTGC CGAACATCAT CAGCCGCCTG ATGGGCGACA GGTTGCGCCA
801 AAGCCTGCCT GCGGTGGCCT TGCTGGGCGC ATCTTTGGTG TTGCTGTGCG
851 ACATTATCGG ACGCGTGATT GTGTTTCCGT TTGAAATTCC GGTCTCTACG
901 GTTTTTGGTG TATTGGGTAC GGCTTTGTTT TTGTGGCTTT TGTTGAGGAA
951 ACCCGCCTAT GCCGTCTGA
```

This corresponds to the amino acid sequence <SEQ ID 2024; ORF 629>:

m629.pep

```
  1 MTAKPFSLNL TNLLLLAVLF AVSLSVGVAD FRWSDVFSLS DSQQVMFISR
 51 LPRTFAIVLT GASMAVAGMI MQILMRNRFV EPSMVGASQS AALGLLLMTL
101 LLPAAPLPAK MSVAAVAALI GMLVFMLLIR RLPPTAQLMV PLVGIIFGGV
151 IEAVATFIAY ENEMLQMLGV WQQGDFSSVL LGRYELLWIT GGLAVFAYLI
201 ADRLTILGLG ETVSVNLGLN RTAVLWSGLI IVALITSLVI VTVGNIPFIG
251 LVVPNIISRL MGDRLRQSLP AVALLGASLV LLCDIIGRVI VFPFEIPVST
301 VFGVLGTALF LWLLLRKPAY AV*
```

Computer analysis of this amino acid sequence gave the following results:

Homology with a predicted ORF from *N. gonorrhoeae* m629/g629 95.7% identity in 322 aa overlap

```
                  10        20        30        40        50        60
m629.pep  MTAKPFSLNLTNLLLLAVLFAVSLSVGVADFRWSDVFSLSDSQQVMFISRLPRTFAIVLT
          ||||||||||:|||| |||||||||||:||||||||||||||||||||||||||||||||
g629      MTAKPFSLNLANLLLPAVLFAVSLSVGIADFRWSDVFSLSDSQQVMFISRLPRTFAIVLT
                  10        20        30        40        50        60

                  70        80        90       100       110       120
m629.pep  GASMAVAGMIMQILMRNRFVEPSMVGASQSAALGLLLMTLLLPAAPLPAKMSVAAVAALI
          |||:||||||||||||||||||||:||:||||||||||:||||||||||:||||||||||
g629      GASIAVAGMIMQILMRNRFVEPSMAGAGQSAALGLLLMSLLLPAAPLPVKMSVAAVAALI
                  70        80        90       100       110       120

                 130       140       150       160       170       180
m629.pep  GMLVFMLLIRRLPPTAQLMVPLVGIIFGGVIEAVATFIAYENEMLQMLGVWQQGDFSSVL
          |||||||||||||||||||||||| |||||:||||||:||| ||||||||||||||||||
g629      GMLVFMLLIRRLPPTAQLMVPLVGXIFGGVVEAVATFVAYEFEMLQMLGVWQQGDFSSVL
                 130       140       150       160       170       180

                 190       200       210       220       230       240
m629.pep  LGRYELLWITGGLAVFAYLIADRLTILGLGETVSVNLGLNRTAVLWSGLIIVALITSLVI
          ||||||||||||||||||||||||||||||||||||||||||||||||||||||||||||
g629      LGRYELLWITGGLAVFAYLIADRLTILGLGETVSVNLGLNRTAVLWSGLIIVALITSLVI
                 190       200       210       220       230       240

                 250       260       270       280       290       300
m629.pep  VTVGNIPFIGLVVPNIISRLMGDRLRQSLPAVALLGASLVLLCDIIGRVIVFPFEIPVST
          ||||||||||||||||:|||||||||||||||||||||||||||||||:|||||||||||
g629      VTVGNIPFIGLVVPNIVSRLMGDRLRQSLPAVALLGASLVLLCDIIGRMIVFPFEIPVST
                 250       260       270       280       290       300

                 310       320
m629.pep  VFGVLGTALFLWLLLRKPAYAVX
          ||||||||||||||||||||||
g629      VFGVLGTALFLWLLLRKPAYAVX
                 310       320
```

The following partial DNA sequence was identified in *N. meningitidis* <SEQ ID 2025>:

a629.seq

```
  1 ATGACTGCCA AACCTTTTTC CCTCAACCTG ACTAACCTCC TGCTGCTGGC
 51 GGTGTTGTTT GCCGTCAGCC TGTCGGTGGG CGTTGCCGAT TTCCGCTGGT
101 CGGATGTGTT TTCGCTGTCG GACAGCCAGC AGGTTATGTT CATCAGCCGC
151 CTGCCGCGCA CGTTTGCGAT TGTGTTGACG GGCGCGTCGA TGGCGGTGGC
201 GGGGATGATT ATGCAGATTC TGATGCGTAA CCGTTTTGTC GAGCCTTCTA
251 TGGCGGGCGC GGCTCAGAGT GCGGCTTTGG GTTTGCTTCT GATGTCCCTG
301 CTGCTGCCTG CCGCGCCGCT GCCGGTCAAA ATGTCGGTTG CCGCCGTTGC
351 CGCGTTAATC GGCATGTTGG TGTTTATGAT GCTTATCCGC CGCCTGCCGC
401 CGACGGCGCA ACTGATGGTG CCTTTGGTCG GGATTATTTT CGGCGGCGTG
451 GTTGAGGCGG TGGCCACCTT TATTGCGTAT GAAAACGAAA TGCTGCAAAT
501 GCTGGGCGTG TGGCAACAGG GCGATTTTTC CGGCGTGTTG CTCGGACGGT
551 ATGAACTGTT GTGGGCAACG GGGATTTTGG CTTTGTTTGC CTATTTGATT
601 GCCGACCAGC TGACGATTTT GGGTTTGGGC GAAACGGTAA GCGTGAACTT
651 GGGGCTGAAC CGGACGGCGA TTCTGTGGTC GGGGCTGATT ATTGTGGCTT
701 TGATTACGTC GCTGGTTATC GTTACGGTCG GCAATATTCC GTTTATCGGG
751 CTGGTCGTGC CGAACATCAT CAGCCGCCTG ATAGGCGACA GGCTGCGCCA
801 AAGCCTGCCT GCGGTGGCTT TGCTGGGTGC GTCTTTGGTT TTATTGTGCG
```

-continued

```
851 ACATTATCGG ACGAGTGATT GTGTTTCCGT TTGAAATTCC GGTATCGACC

901 GTCTTCGGCG TATTGGGTAC GGCGTTGTTT TTATGGCTTT TGTTAAGGAA

951 ACCTGCTCAT GCCGTCTGA
```

This corresponds to the amino acid sequence <SEQ ID 2026; ORF 629.a>:

```
a629.pep

  1 MTAKPFSLNL TNLLLLAVLF AVSLSVGVAD FRWSDVFSLS DSQQVMFISR

 51 LPRTFAIVLT GASMAVAGMI MQILMRNRFV EPSMAGAGQS AALGLLLMSL

101 LLPAAPLPVK MSVAAVAALI GMLVFMMLIR RLPPTAQLMV PLVGIIFGGV

151 VEAVATFIAY ENEMLQMLGV WQQGDFSGVL LGRYELLWAT GILALFAYLI

201 ADQLTILGLG ETVSVNLGLN RTAILWSGLI IVALITSLVI VTVGNIPFIG

251 LVVPNIISRL IGDRLRQSLP AVALLGASLV LLCDIIGRVI VFPFEIPVST

301 VFGVLGTALF LWLLLRKPAH AV*
```

m629/a629 95.7% identity in 322 aa overlap

```
                   10        20        30        40        50        60
m629.pep   MTAKPFSLNLTNLLLLAVLFAVSLSVGVADFRWSDVFSLSDSQQVMFISRLPRTFAIVLT
           ||||||||||||||||||||||||||||||||||||||||||||||||||||||||||||
a629       MTAKPFSLNLTNLLLLAVLFAVSLSVGVADFRWSDVFSLSDSQQVMFISRLPRTFAIVLT
                   10        20        30        40        50        60

                   70        80        90       100       110       120
m629.pep   GASMAVAGMIMQILMRNRFVEPSMVGASQSAALGLLLMTLLLPAAPLPAKMSVAAVAALI
           ||||||||||||||||||||||||:||:||||||||||:|||||||||:|||||||||||
a629       GASMAVAGMIMQILMRNRFVEPSMAGAGQSAALGLLLMSLLLPAAPLPVKMSVAAVAALI
                   70        80        90       100       110       120

                  130       140       150       160       170       180
m629.pep   GMLVFMLLIRRLPPTAQLMVPLVGIIFGGVIEAVATFIAYENEMLQMLGVWQQGDFSSVL
           ||||||:|||||||||||||||||||||||:||||||||||||||||||||||||||:||
a629       GMLVFMMLIRRLPPTAQLMVPLVGIIFGGVVEAVATFIAYENEMLQMLGVWQQGDFSGVL
                  130       140       150       160       170       180

                  190       200       210       220       230       240
m629.pep   LGRYELLWITGGLAVFAYLIADRLTILGLGETVSVNLGLNRTAVLWSGLIIVALITSLVI
           |||||||| || ||:|||||||:|||||||||||||||||||||:||||||||||||||||
a629       LGRYELLWATGILALFAYLIADQLTILGLGETVSVNLGLNRTAILWSGLIIVALITSLVI
                  190       200       210       220       230       240

                  250       260       270       280       290       300
m629.pep   VTVGNIPFIGLVVPNIISRLMGDRLRQSLPAVALLGASLVLLCDIIGRVIVFPFEIPVST
           ||||||||||||||||||||:|||||||||||||||||||||||||||||||||||||||
a629       VTVGNIPFIGLVVPNIISRLIGDRLRQSLPAVALLGASLVLLCDIIGRVIVFPFEIPVST
                  250       260       270       280       290       300

                  310       320
m629.pep   VFGVLGTALFLWLLLRKPAYAVX
           |||||||||||||||||||:|||
a629       VFGVLGTALFLWLLLRKPAHAVX
                  310       320
```

The following partial DNA sequence was identified in *N. gonorrhoeae* <SEQ ID 2027>:

```
g630.seq (partial)

  1 aTgatGATTT TGGTGTGGCT ggctttgttt ccccccatgt tttacggcat

 51 gtacaacgtc GGCGCACAGG CATTCGGTGC CTTAACGCCC GAtttgctgc

101 aacaaagcat cgcccacgac ggcaattacg ccctcgccaa cgctttgggc

151 atcaatatgt cccccgaaGc gggcgtgtTg ggcaaaatgc tgttcgGCGC
```

-continued

```
201 GATttacttc ctgccgattt acgcgaccgt aTTTATTGTG GGcggcttct
251 ggGaagtCTT GTTCGCATCc gtACGCAAAC ACGAAATCAA CGAAGGTTTC
301 TTCGTTACTT CGATTCTGTT TGCCTTAATC GTTCCGCCCA CGCTGCCGCT
351 GTGGCAGGCG GCTTTGGGTA TTTCTTTCGG CGTTGTGGTT GCGAAAGAAG
401 TATTCGGCGG TACAGGTAAA AACTTCATGA ACCCTGCGCT GGCAGGCCGC
451 GCCTTCCTGT TCTTCGCCTA CCCCGCCAAC TTGAGCGGCG ATGCGGTTTG
501 GACGGCGGTT GACGGCTATT CCGGCGCAAC CGCGCTGGCG CAATGGGCGG
551 CACACGGTGC AGACGGCCTG AAAAACGCCG TAACCGGTCA AACCATCACT
601 TGGATGGACG CGTTTATCGG CAAACTGCCC GGCTCCATCG GCGAAGTCTC
651 CACTTTGGCA CTCTTAATCG GCGGCGCGTT TATCGTGTTT GCCCGCATCG
701 CTtcttgGCG CATTATTGCc ggCGTGATGA TCGGTatGat tGcgatgTCT
751 tcgctgatta acttcatCGg ttctgacacc aaagctatgt ttgctatgca
801 cttggtacat ggcacttggt GGAaagatGa ttAtcactca ctgtacatta
851 aa.....
```

This corresponds to the amino acid sequence <SEQ ID 2028; ORF 630.ng>:

g630.pep

```
  1 MMILVWLALF PPMFYGMYNV GAQAFGALTP DLLQQSIAHD GNYALANALG
 51 INMSPEAGVL GKMLFGAIYF LPIYATVFIV GGFWEVLFAS VRKHEINEGF
101 FVTSILFALI VPPTLPLWQA ALGISFGVVV AKEVFGGTGK NFMNPALAGR
151 AFLFFAYPAN LSGDAVWTAV DGYSGATALA QWAAHGADGL KNAVTGQTIT
201 WMDAFIGKLP GSIGEVSTLA LLIGGAFIVF ARIASWRIIA GVMIGMIAMS
251 SLINFIGSDT KAMFAMHLVH GTWWKDDYHS LYIK....
```

The following partial DNA sequence was identified in *N. meningitidis* <SEQ ID 2029>:

m630.seq

```
  1 ATGATGATTT TGGTGTGGCT GGCTTTGTTC CCTGCCATGT TCTACGGTAT
 51 GTACAACGTC GGCGCGCAGG CATTCGGTGC GTTAACGCCT GATTTGCTGC
101 AACAAAACAT CGCCAACGAC TGGCATTACG CCTTTGCCAA CGCTTTGGGC
151 ATCAATATGT CGTCTGAAGC GGGCGTGTCG GACAAAATGC TGTTTGGCGC
201 GATTTACTTC CTGCCGATTT ACGCGACTGT ATTTGTTGTG GGCGGTTTCT
251 GGGAAGTTTT GTTCGCCACC GTGCGCAAAC ACGAAATCAA CGAAGGTTTC
301 TTCGTTACTT CGATTCTGTT TGCCTTAATC GTTCCGCCCA CGCTGCCGCT
351 GTGGCAGGCG GCTTTGGGTA TTTCTTTCGG CGTTGTGGTT GCGAAAGAAG
401 TATTCGGCGG TACAGGTAAA AACTTCATGA ACCCTGCGCT GGCAGGCCGT
451 GCTTTCCTGT TCTTCGCCTA CCCTGCCAAC TTGAGCGGCG ATGCGGTTTG
501 GACGGCGGTT GACGGCTATT CCGGCGCAAC CGCACTGGCG CAATGGGCGG
```

-continued

```
 551 CACACGGTGC AGACGGCCTG AAAAACGCCG TAACCGGTCA AACCATCACT

 601 TGGATGGACG CGTTTATCGG CAAACTGCCC GGCTCCATTG GCGAAGTCTC

 651 CACTTTGGCA CTCTTAATCG GCGGCGCGTT TATCGTGTTT GCCCGCATCG

 701 CTTCTTGGCG CATTATTGCC GGCGTGATGA TCGGTATGAT TGCGATGTCT

 751 TCGCTGTTCA ACTTCATCGG TTCGGACACC AACGCTATGT TTGCTATGCC

 801 TTGGTACTGG CACTTGGTGG TCGGCGGCTT CGCCATCGGT ATGCTGTTTA

 851 TGGCGACCGA CCCTGTTTCC GCTTCCTTTA CCAATGTCGG CAAATGGTGG

 901 TACGGCGCAC TGATCGGTGT GATGTGCGTA TTAATCCGCG TGGTCAATCC

 951 GGCTTACCCC GAAGGCATGA TGTTGGCGAT TCTGTTTGCC AACCTGTTTG

1001 CCCCGATTTT CGACTATTTC GTCGCACAAG CGAACATCAA ACGCAGAAAG

1051 GCGCGCAGCA ATGGCTAA
```

This corresponds to the amino acid sequence <SEQ ID 2030; ORF 630>:

```
m630.pep

  1 MMILVWLALF PAMFYGMYNV GAQAFGALTP DLLQQNIAND WHYAFANALG

 51 INMSSEAGVS DKMLFGAIYF LPIYATVFVV GGFWEVLFAT VRKHEINEGF

101 FVTSILFALI VPPTLPLWQA ALGISFGVVV AKEVFGGTGK NFMNPALAGR

151 AFLFFAYPAN LSGDAVWTAV DGYSGATALA QWAAHGADGL KNAVTGQTIT

201 WMDAFIGKLP GSIGEVSTLA LLIGGAFIVF ARIASWRIIA GVMIGMIAMS

251 SLFNFIGSDT NAMFAMPWYW HLVVGGFAIG MLFMATDPVS ASFTNVGKWW

301 YGALIGVMCV LIRVVNPAYP EGMMLAILFA NLFAPIFDYF VAQANIKRRK

351 ARSNG*
```

m630/g630 93.5% identity in 275 aa overlap

```
                   10        20        30        40        50        60
m630.pep   MMILVWLALFPAMFYGMYNVGAQAFGALTPDLLQQNIANDWHYAFANALGINMSSEAGVS
           ||||||||||| |||||||||||||||||||||||:||:| :||:||||||||| |||| 
g630       MMILVWLALFPPMFYGMYNVGAQAFGALTPDLLQQSIAHDGNYALANALGINMSPEAGVL
                   10        20        30        40        50        60

                   70        80        90       100       110       120
m630.pep   DKMLFGAIYFLPIYATVFVVGGFWEVLFATVRKHEINEGFFVTSILFALIVPPTLPLWQA
            |||||||||||||||||:||||||||||:||||||||||||||||||||||||||||||
g630       GKMLFGAIYFLPIYATVFIVGGFWEVLFASVRKHEINEGFFVTSILFALIVPPTLPLWQA
                   70        80        90       100       110       120

                  130       140       150       160       170       180
m630.pep   ALGISFGVVVAKEVFGGTGKNFMNPALAGRAFLFFAYPANLSGDAVWTAVDGYSGATALA
           ||||||||||||||||||||||||||||||||||||||||||||||||||||||||||||
g630       ALGISFGVVVAKEVFGGTGKNFMNPALAGRAFLFFAYPANLSGDAVWTAVDGYSGATALA
                  130       140       150       160       170       180

                  190       200       210       220       230       240
m630.pep   QWAAHGADGLKNAVTGQTITWMDAFIGKLPGSIGEVSTLALLIGGAFIVFARIASWRIIA
           ||||||||||||||||||||||||||||||||||||||||||||||||||||||||||||
g630       QWAAHGADGLKNAVTGQTITWMDAFIGKLPGSIGEVSTLALLIGGAFIVFARIASWRIIA
                  190       200       210       220       230       240

                  250       260       270       280       290       300
m630.pep   GVMIGMIAMSSLFNFIGSDTNAMFAMPWYWHLVVGGFAIGMLFMATDPVSASFTNVGKWW
           ||||||||||||:|||||||:|||||    ||| |
g630       GVMIGMIAMSSLINFIGSDTKAMFAM----HLVHGTWWKDDYHSLYIK.
                  250       260           270       280

                  310       320       330       340       350
m630.pep   YGALIGVMCVLIRVVNPAYPEGMMLAILFANLFAPIFDYFVAQANIKRRKARSNGX
```

The following partial DNA sequence was identified in *N. meningitidis* <SEQ ID 2031>:

a630.seq

```
   1 ATGATGATTT TGGTGTGGCT GGCTTTGTTC CCTGCCATGT TCTACGGTAT
  51 GTACAACGTC GGCGCACAGG CATTCGGTGC GTTAACGCCC GATTTGCTGC
 101 AACAAAGCAT CGCCAACGAC TGGCATTACG CCCTTGCCAA CGCTTTGGGC
 151 ATCAATATGT CGTCTGAAGC GGGCGTGTTG GGCAAAATGC TGTTCGGCGC
 201 GATTTACTTC CTGCCGATTT ACGCGACCGT ATTTATTGTC GGCGGTTTCT
 251 GGGAAGTTTT GTTCGCCACC GTGCGCAAAC ATGAAATCAA CGAAGGTTTC
 301 TTTGTTACCT CGATTCTGTT TGCCTTAATC GTTCCGCCCA CGCTGCCGCT
 351 GTGGCAGGCA GCTTTGGGTA TTTCTTTCGG CGTTGTGGTT GCGAAAGAAG
 401 TATTCGGCGG TACAGGTAAA AACTTCATGA ACCCTGCGCT GGCAGGCCGT
 451 GCCTTCCTGT TCTTCGCCTA CCCTGCCAAC TTGAGCGGCG ATGCGGTTTG
 501 GACGGCGGTT GACGGCTATT CCGGCGCAAC CGCGCTGGCG CAATGGGCGG
 551 CACACGGTGC AGACGGCCTG AAAAACGCCA TAACCGGTCA AACCATCACT
 601 TGGATGGATG CGTTTATCGG CAAACTGCCC GGCTCCATCG GCGAAGTCTC
 651 CACTTTGGCA CTCTTAATCG GCGGCGCGTT TATCGTGTTT GCCCGCATCG
 701 CTTCTTGGCG CATTATTGCC GGCGTGATGA TCGGTATGAT TGCCATGTCT
 751 TCGCTGTTCA ACTTCATCGG TTCGGACACC AACGCTATGT TTGCTATGCC
 801 TTGGTACTGG CATTTGGTCG TCGGCGGCTT CGCCATCGGT ATGCTGTTTA
 851 TGGCGACCGA CCCCGTTTCC GCTTCCTTTA CCAATGTCGG CAAATGGTGG
 901 TACGGCGCAC TGATCGGTGT GATGTGCGTA TTAATCCGCG TGGTCAATCC
 951 GGCTTACCCC GAAGGCATGA TGTTGGCGAT TCTGTTTGCC AACCTGTTTG
1001 CCCCGATTTT CGACTATTTC GTCGCACAAG CGAACATCAA ACGCAGAAAG
1051 GCGCGCAGCA ATGGCTAA
```

This corresponds to the amino acid sequence <SEQ ID 2032; ORF 630.a>:

a630.pep

```
   1 MMILVWLALF PAMFYGMYNV GAQAFGALTP DLLQQSIAND WHYALANALG
  51 INMSSEAGVL GKMLFGAIYF LPIYATVFIV GGFWEVLFAT VRKHEINEGF
 101 FVTSILFALI VPPTLPLWQA ALGISFGVVV AKEVFGGTGK NFMNPALAGR
 151 AFLFFAYPAN LSGDAVWTAV DGYSGATALA QWAAHGADGL KNAITGQTIT
 201 WMDAFIGKLP GSIGEVSTLA LLIGGAFIVF ARIASWRIIA GVMIGMIAMS
 251 SLFNFIGSDT NAMFAMPWYW HLVVGGFAIG MLFMATDPVS ASFTNVGKWW
 301 YGALIGVMCV LIRVVNPAYP EGMMLAILFA NLFAPIFDYF VAQANIKRRK
 351 ARSNG*
```

m630/a630 98.3% identity in 355 aa overlap

```
                10         20         30         40         50         60
m630.pep  MMILVWLALFPAMFYGMYNVGAQAFGALTPDLLQQNIANDWHYAFANALGINMSSEAGVS
          ||||||||||||||||||||||||||||||||||||:||||||||:||||||||||||||
a630      MMILVWLALFPAMFYGMYNVGAQAFGALTPDLLQQSIANDWHYALANALGINMSSEAGVL
                10         20         30         40         50         60

                70         80         90        100        110        120
m630.pep  DKMLFGAIYFLPIYATVFVVGGFWEVLFATVRKHEINEGFFVTSILFALIVPPTLPLWQA
           ||||||||||||||||:|||||||||||||||||||||||||||||||||||||||||||
a630      GKMLFGAIYFLPIYATVFIVGGFWEVLFATVRKHEINEGFFVTSILFALIVPPTLPLWQA
                70         80         90        100        110        120

               130        140        150        160        170        180
m630.pep  ALGISFGVVVAKEVFGGTGKNFMNPALAGRAFLFFAYPANLSGDAVWTAVDGYSGATALA
          ||||||||||||||||||||||||||||||||||||||||||||||||||||||||||||
a630      ALGISFGVVVAKEVFGGTGKNFMNPALAGRAFLFFAYPANLSGDAVWTAVDGYSGATALA
               130        140        150        160        170        180

               190        200        210        220        230        240
m630.pep  QWAAHGADGLKNAVTGQTITWMDAFIGKLPGSIGEVSTLALLIGGAFIVFARIASWRIIA
          |||||||||||||:||||||||||||||||||||||||||||||||||||||||||||||
a630      QWAAHGADGLKNAITGQTITWMDAFIGKLPGSIGEVSTLALLIGGAFIVFARIASWRIIA
               190        200        210        220        230        240

               250        260        270        280        290        300
m630.pep  GVMIGMIAMSSLFNFIGSDTNAMFAMPWYWHLVVGGFAIGMLFMATDPVSASFTNVGKWW
          ||||||||||||||||||||||||||||||||||||||||||||||||||||||||||||
a630      GVMIGMIAMSSLFNFIGSDTNAMFAMPWYWHLVVGGFAIGMLFMATDPVSASFTNVGKWW
               250        260        270        280        290        300

               310        320        330        340        350
m630.pep  YGALIGVMCVLIRVVNPAYPEGMMLAILFANLFAPIFDYFVAQANIKRRKARSNGX
          ||||||||||||||||||||||||||||||||||||||||||||||||||||||||
a630      YGALIGVMCVLIRVVNPAYPEGMMLAILFANLFAPIFDYFVAQANIKRRKARSNGX
               310        320        330        340        350
```

The following partial DNA sequence was identified in *N. gonorrhoeae* <SEQ ID 2033>:

g635.seq

```
  1 ATGACCCGGC GACGGGTCGG CAAGCAAAAC CGTATTGCCA TCCACTCCGC
 51 GCAATACCGA AAAATGGTCG TCTTTGCGGT ATTTCAGATA CACGATGACG
101 GGGATTTTCA ACTGCGCGAG CTGTTCGAAA GACAGGGCAT AGCCTTTCGC
151 CTCAAAACCC AAATCGGGCA TAATGCGCCG CATATCCTCA AACGACGCGC
201 GCATCTGTTC CTTACCCAGT TTTTCCAACA CTTCTTCTTC CGTCAGCTTT
251 TGCCCGTAAA AATTGTTCAA AAGCGTCGCC ACCGAAGCCG CCCCGCAGGA
301 AAAATCCAAA TCCTGCTTTA CAATATTGAA ATCCCGCCGC GCTTTCCAAC
351 TCTGCAATTT GATTTTTCCG TAAACAACAG GATTATCGTT AAACATCGGT
401 GCAGCATTCA AACGATAAGA CAAGGGTCTG TACCAGATTA G
```

This corresponds to the amino acid sequence <SEQ ID 2034; ORF 635.ng>:

g635.pep

```
  1 MTRRRVGKQN RIAIHSAQYR KMVVFAVFQI HDDGDFQLRE LFERQGIAFR
 51 LKTQIGHNAP HILKRRAHLF LTQFFQHFFF RQLLPVKIVQ KRRHRSRPAG
101 KIQILLYNIE IPPRFPTLQF DFSVNNRIIV KHRCSIQTIR QGSVPD*
```

The following partial DNA sequence was identified in *N. meningitidis* <SEQ ID 2035>:

m635.seq

```
  1 ATGACCCAGC GACGGGTCGG CAAGCAAAAC CGTATTGCCG TCTATACCGC
 51 GCAATACCGA GAAATGATCA TCCTTGCGGT ATTTCAGATA CACGATGACG
101 GGGATTTGCA ACTGTGCAAG CTGCTCGAAA GACAGGGCAT AGCCTTTCGC
151 TTCAAAACCC AAATCAGGCA TAATGCGCCG CATATCCTCA AACGACGCGG
201 GCATCTGCTC CTTATCCAGT TTTTTAACA CGTCCTCTTC CGTCAGCTTT
251 TGCCCGTAAA AATTGTTCAA AAGCGTCACC ACCGAAGCCG CCCCGCAGGA
301 AAAATCCAAA TCCTGCTTTA CAATATTGAA ATCGCGCCTT TCTTTCCAAC
351 TCTGCACTTT GATTTTTCCA TAAGCAACAG GATTATAGTG GATTAA
```

This corresponds to the amino acid sequence <SEQ ID 2036; ORF 635>:

m635.pep

```
  1 MTQRRVGKQN RIAVYTAQYR EMIILAVFQI HDDGDLQLCK LLERQGIAFR
 51 FKTQIRHNAP HILKRRGHLL LIQFF*HVLF RQLLPVKIVQ KRHHRSRPAG
101 KIQILLYNIE IAPFFPTLHF DFSISNRIIV D*
```

m635/g635 80.0% identity in 130 aa overlap

```
                   10        20        30        40        50        60
m635.pep   MTQRRVGKQNRIAVYTAQYREMIILAVFQIHDDGDLQLCKLLERQGIAFRFKTQIRHNAP
           ||:|||||||||:::||||:|:::||||||||||:||  :|:||||||||:|||| ||||
g635       MIRGQFIVVGIVGIHSLARFKDVVFAVFQIHDDGDFQLRELFERQGIAFRLKTQIGHNAP
                   10        20        30        40        50        60

                   70        80        90       100       110       120
m635.pep   HILKRRGHLLLIQFFXHVLFRQLLPVKIVQKRHHRSRPAGKIQILLYNIEIAPFFPTLHF
           ||||||:||:| ||| | :|||||||||||||:|||||||||||||||||| | ||||:|
g635       HILKRRAHLFLTQFFQHFFFRQLLPVKIVQKRRHRSRPAGKIQILLYNIEIPPRFPTLQF
                   70        80        90       100       110       120

                  130
m635.pep   DFSISNRIIVDX
           |||::|||||
g635       DFSVNNRIIVKHRCSIQTIRQGSVPDX
                  130       140
```

The following partial DNA sequence was identified in *N. meningitidis* <SEQ ID 2037>:

a635.seq

```
  1 ATGACCCAGC GACGGGTCGG CAAGCAAAAC CGTATTGCCG TCTATACCGC
 51 GCAATACCGA GAAATGATCA TCCTTGCGGT ATTTCAGATA CACGATGACG
101 GGGATTTGCA ACTGTGCAAG CTGCTCGAAA GACAGGGCAT AGCCTTTCGC
151 CTCAAAACCC AAATCAGGCA TGATGCGCCG CATATCCTCA AACGACGCGC
201 GCATCTGCTC CTTATCCAGC TTTTTCAACA CGTCCTCTTC CGTCAGCTTT
251 TGCCCGTGAA AATTGTTCAA AAGCGTCGCC ACCGAAGCCG CCCCGCAGGA
301 AAAATCCAAA TCCTGCTTTA CAATATTGAA ATCGCGCCTT TCTTTCCAAC
351 TCTGCACTTT GATTTTTCCA TAAGCAACAG GATTATAGTG GATTAA
```

This corresponds to the amino acid sequence <SEQ ID 2038; ORF 635.a>:

a635.pep

```
  1 MTQRRVGKQN RIAVYTAQYR EMIILAVFQI HDDGDLQLCK LLERQGIAFR

 51 LKTQIRHDAP HILKRRAHLL LIQLFQHVLF RQLLPVKIVQ KRRHRSRPAG

101 KIQILLYNIE IAPFFPTLHF DFSISNRIIV D*
```

m635/a635 95.4% identity in 131 aa overlap

```
                    10        20        30        40        50        60
m635.pep    MTQRRVGKQNRIAVYTAQYREMIILAVFQIHDDGDLQLCKLLERQGIAFRFKTQIRHNAP
            ||||||||||||||||||||||||||||||||||||||||||||||||||:||||||:||
a635        MTQRRVGKQNRIAVYTAQYREMIILAVFQIHDDGDLQLCKLLERQGIAFRLKTQIRHDAP
                    10        20        30        40        50        60

                    70        80        90       100       110       120
m635.pep    HILKRRGHLLLIQFFXHVLFRQLLPVKIVQKRHHRSRPAGKIQILLYNIEIAPFFPTLHF
            ||||||:||||||:| ||||||||||||||||:|||||||||||||||||||||||||||
a635        HILKRRAHLLLIQLFQHVLFRQLLPVKIVQKRRHRSRPAGKIQILLYNIEIAPFFPTLHF
                    70        80        90       100       110       120

                   130
m635.pep    DFSISNRIIVDX
            ||||||||||||
a635        DFSISNRIIVDX
                   130
```

The following partial DNA sequence was identified in *N. gonorrhoeae* <SEQ ID 2039>:

g638.seq

```
  1 ATGATTGGCG GACAGTTTAT CGTAGttgGc atTGTAGGCA AAAACGCACT

 51 TGCCCGCTTT GTTGATAATA ttgtcGTGAA TAtcGGAATA GTTGACATAG

101 TTGAGCATGA TGCCCTAATC GCGGCTGCCG ACGGCGATAT TGTCGAACAC

151 TTTGAGCCGT TCGGAAAACA TCAGCACATA GCCCATATTG TtgcCCACGG

201 AAATATTGCC GCTGacttcg ctgtcgTTGG TGTACATATA GTGGACGGCG

251 AAACGCAGGT CGCTGAAGCG GTTGTTTTTA TAGGTGTTGT GCGTGCTGGT

301 ATTGGAAAAA ATGCCGTCCC GCCCTTTGGA AATGTCGTTG ccgACGACCT

351 GCGCgccggg CgcgtTCCAA ACGGTAACGC CATTGCCGCG CTCATTCACG

401 CGCAAGGTcg catcgCCGAC GATTTTATTC TCGCGCACCA TCGCATCGGC

451 AGAACCATGA AGGTATACGC CGAACGAATT ATCAAAAATA TTGTTGTGTT

501 CAACCAGGGC GCGCGGGGCG GCTTTTTCGA GATAAATACC GGCATCCATT

551 GCTGGCAGGC TCATACCGGA ACGGGTAACG GTCAGGTTGC GGAGCGTTAC

601 GTCCGGCGCG TGTACGGCTA TGGTACGCCC GCTCTTGTCC CCTTCGATGG

651 TTGCGGAACG GTCGGCAGGC CCTTCAATCG TAATCGGTTT GTCGATATAA

701 AGTTTGGTTT GATATACGCC GGAAGCCAGT TTGATCGTAT CGCCCGCCCG

751 GGCGCGGGCA AAAATTTCGG CAAGGTTGTC TTGCGGGGAA ACGTGGACGA

801 CGGCTGCCGA TGCCGTCTGA AAAATGCTGC CGGCGGCAAG TATCAGCACG

851 GCCTTCAGCC ATATACGGAG CGCGGATGTG TGCATAGTGT CCCTCTGTTT

901 CGTTCGGTAT GGCCGAACAA AATAAAGCAT CATTCAAATG TGCCTGTTTT

951 TATAGCGAAA CCGCCTGAAA CGGTACGGCA AGCGGTTTGG CTATAA
```

This corresponds to the amino acid sequence <SEQ ID 2040: ORF 638.ng>:

g638.pep

```
  1 MIGGQFIVVG IVGKNALARF VDNIVVNIGI VDIVEHDALI AAADGDIVEH
 51 FEPFGKHQHI AHIVAHGNIA ADFAVVGVHI VDGETQVAEA VVFIGVVRAG
101 IGKNAVPPFG NVVADDLRAG RVPNGNAIAA LIHAQGRIAD DFILAHHRIG
151 RTMKVYAERI IKNIVVFNQG ARGGFFEINT GIHCWQAHTG TGNGQVAERY
201 VRRVYGYGTP ALVPFDGCGT VGRPFNRNRF VDIKFGLIYA GSQFDRIARP
251 GAGKNFGKVV LRGNVDDGCR CRLKNAAGGK YQHGLQPYTE RGCVHSVPLF
301 RSVWPNKIKH HSNVPVFIAK PPETVRQAVW L*
```

The following partial DNA sequence was identified in *N. meningitidis* <SEQ ID 2041>:

m638.seq

```
  1 ATGATTGGCG AAAAGTTTAT CGTAGTTGGC ATTATAGGCA AATACGCACT
 51 TGCCTGCCTT GTTGATAATG TTGTCGTGAA TATCGGAATA GTTGACATAG
101 TTGAGCATAA TGCCCTGATC GCGGCTGCCG ACGGCGATAT TGTCGAATAC
151 TTTGAGCCGC TCGGAAAACA TCAGCACATA GCCCATATTG TTGCCCACGG
201 AAATATTGCC GCTGATTTCG CTGTCGTTGG TGTACATATA GTGGACGGCG
251 AAACGCAAAT CGCTGAAGCG GTTGTTTTTG TAGGTGTTGT GCGTGCTGGT
301 ATTGGAAAAA ATGCCGTCCC GCCCTTTGGA AATGTCGTTG CCGACGACCT
351 GCGCACCGGG TGCGTTCCAA ACGGTAACGC CGTTGCCGCG CTCGTTCACG
401 CGCAAAGTCG CGTCGCCGAC GATTTTATTC TCGCGCACCA TCGCATCGGC
451 AGAACCATGC AGATATACGC CGACCGAATT ATCCAAAATA TTGTTGTGTT
501 CAATCAGGGC GCGCGGGGCA GTTTCTTCGA GATAAATACC GGCATCCATT
551 GCGGGCAGGC TCATACCGGA ACGGGTAACG GTCAGGTTGC GGAGCGTTAC
601 GTCCGGCGCG TGTACGGCTA TGGTACGCCC GCTCCTGTCG CCTTCGATGG
651 TTGCGGAACG GTCGGCAGGC CCTTCAATCG TAATCGGTTT GTCAATGTGA
701 AGTTTGGTTT TATATACGCC GGAAGCCAGT TTGAGCGTAT CGCCCGCCCG
751 GGCGCGGGCA AATGCGGGAT ACCGATCAGC ATAATCGGTT CGTGA
```

This corresponds to the amino acid sequence <SEQ ID 2042; ORF 638>:

m638.pep

```
  1 MIGEKFIVVG IIGKYALACL VDNVVVNIGI VDIVEHNALI AAADGDIVEY
 51 FEPLGKHQHI AHIVAHGNIA ADFAVVGVHI VDGETQIAEA VVFVGVVRAG
101 IGKNAVPPFG NVVADDLRTG CVPNGNAVAA LVHAQSRVAD DFILAHHRIG
151 RTMQIYADRI IQNIVVFNQG ARGSFFEINT GIHCGQAHTG TGNGQVAERY
201 VRRVYGYGTP APVAFDGCGT VGRPFNRNRF VNVKFGFIYA GSQFERIARP
251 GAGKCGIPIS IIGS*
```

m638/g638 88.2% identity in 254 aa overlap

```
                     10        20        30        40        50        60
m638.pep    MIGEKFIVVGIIGKYALACLVDNVVVNIGIVDIVEHNALIAAADGDIVEYFEPLGKHQHI
            ||| :||||||:|| ||| :|||:||||||||||||:||||||||||||:|||:||||||
g638        MIGGQFIVVGIVGKNALARFVDNIVVNIGIVDIVEHDALIAAADGDIVEHFEPFGKHQHI
                     10        20        30        40        50        60

                     70        80        90       100       110       120
m638.pep    AHIVAHGNIAADFAVVGVHIVDGETQIAEAVVFVGVVRAGIGKNAVPPFGNVVADDLRTG
            ||||||||||||||||||||||||||:|||||||:|||||||||||||||||||||||:|
g638        AHIVAHGNIAADFAVVGVHIVDGETQVAEAVVFIGVVRAGIGKNAVPPFGNVVADDLRAG
                     70        80        90       100       110       120

                    130       140       150       160       170       180
m638.pep    CVPNGNAVAALVHAQSRVADDFILAHHRIGRTMQIYADRIIQNIVVFNQGARGSFFEINT
             ||||||:|||:|||:|:|||||||||||||||::||:|||:|||||||||||:||||||
g638        RVPNGNAIAALIHAQGRIADDFILAHHRIGRTMKVYAERIIKNIVVFNQGARGGFFEINT
                    130       140       150       160       170       180

                    190       200       210       220       230       240
m638.pep    GIHCGQAHTGTGNGQVAERYVRRVYGYGYPAPVAFDGCGTVGRPFNRNRFVNVKFGFIYA
            |||| |||||||||||||||||||||||||| | |||||||||||||||||::|||:|||
g638        GIHCWQAHTGTGNGQVAERYVRRVYGYGYPALVPFDGCGTVGRPFNRNRFVDIKFGLIYA
                    190       200       210       220       230       240

                    250       260
m638.pep    GSQFERIARPGAGKCGIPISIIGSX
            ||||:|||||||||
g638        GSQFDRIARPGAGKNFGKVVLRGNVDDGCRCRLKNAAGGKYQHGLQPYTERGCVHSVPLF
                    250       260       270       280       290       300
```

The following partial DNA sequence was identified in *N. meningitidis* <SEQ ID 2043>:

a638.seq

```
  1 ATGATTGGCG GACAGTTTAT CGTAGTTGGC ATTGTAGGCA AAAACGCACT

 51 TGCCCGCTTT GTTGATAATG TTGTCGTGAA TATCGGAATA GTTGACATAG

101 TTGAGCATGA TGCCTTGGTC GCGGCTGCCG ACGGCGATAT TGTCAAACAC

151 TTTGAGCCGC TCGGAAAACA TCAGCACATA GCCCATATTG TTGCCCACGG

201 AAATATTGCC GCTGATTTCG CTGTCGTTGG TGTACATATA GTGGACGGCG

251 AAACGCAAAT CGCTGAAGCG GTTGTTTTTA TAGGTGTTGT GCGTGCTGGT

301 ATTGGAAAAA ATGCCGTCCC GCCCTTTGGA AATATCGTTG CCGACGACCT

351 GCGCGCCGGG CGCGTTCCAA ACGGTAACGC CATTGCCGCG CTCGTTCACG

401 CGCAAAGTCG CGTCGCCGAC GATTTTATTC TCCCGCACCA TCGCATCGGC

451 AGAACCATGC AGATAGACGC CGACCGAATT ATCCAAAATA TTATTGTGTT

501 CAATCAGGGC GCGCGGGGCA GTTTCTTCGA GATAAATACC GGCATCCATT

551 GCGGGCAGGC TCATACCGGA ACGGGTAACG GTCAGGTTGC GGAGCGTTAC

601 GTCCGGCGCG TGTACGGCTA TGGTACGCCC GCTCCTGTCT CCTTCGATGG

651 TTGCAGAACG GTCGGCAGGC CCTTCAATCG TAATCGGTTT GTCGATGTGA

701 AGTTTGGTTT GATATACGCC GGAAGCCAGT TTGAGCGTAT CGCCCGCCCG

751 GGCGCGGGCA AATGCGGGAT ACCGATCAGC ATAATCGACT CATGGTGA
```

This corresponds to the amino acid sequence <SEQ ID 2044; ORF 638.a>:

a638.pep

```
  1 MIGGQFIVVG IVGKNALARF VDNVVVNIGI VDIVEHDALV AAADGDIVKH

 51 FEPLGKHQHI AHIVAHGNIA ADFAVVGVHI VDGETQIAEA VVFIGVVRAG
```

-continued

```
101 IGKNAVPPFG NIVADDLRAG RVPNGNAIAA LVHAQSRVAD DFILPHHRIG

151 RTMQIDADRI IQNIIVFNQG ARGSFFEINT GIHCGQAHTG TGNGQVAERY

201 VRRVYGYGTP APVSFDGCRT VGRPFNRNRF VDVKFGLIYA GSQFERIARP

251 GAGKCGIPIS IIDSW*
```

m638/a638 91.3% identity in 264 aa overlap

```
                  10        20        30        40        50        60
m638.pep  MIGEKFIVVGIIGKYALACLVDNVVVNIGIVDIVEHNALIAAADGDIVEYFEPLGKHQHI
          ||| :||||||:|| ||| :||||||||||||||||:||:||||||||::||||||||||
a638      MIGGQFIVVGIVGKNALARFVDNVVVNIGIVDIVEHDALVAAADGDIVKHFEPLGKHQHI
                  10        20        30        40        50        60

                  70        80        90       100       110       120
m638.pep  AHIVAHGNIAADFAVVGVHIVDGETQIAEAVVFVGVVRAGIGKNAVPPFGNVVADDLRTG
          |||||||||||||||||||||||||||||||||:|||||||||||||||||:||||||:|
a638      AHIVAHGNIAADFAVVGVHIVDGETQIAEAVVFIGVVRAGIGKNAVPPFGNIVADDLRAG
                  70        80        90       100       110       120

                 130       140       150       160       170       180
m638.pep  CVPNGNAVAALVHAQSRVADDFILAHHRIGRTMQIYADRIIQNIVVFNQGARGSFFEINT
           ||||||:|||||||||||||||| |||||||||| ||||||||:|||||||||||||||
a638      RVPNGNAIAALVHAQSRVADDFILPHHRIGRTMQIDADRIIQNIIVFNQGARGSFFEINT
                 130       140       150       160       170       180

                 190       200       210       220       230       240
m638.pep  GIHCGQAHTGTGNGQVAERYVRRVYGYGYPAPVAFDGCGTVGRPFNRNRFVNVKFGFIYA
          |||||||||||||||||||||||||||||||||:|||| ||||||||||||:||||:|||
a638      GIHCGQAHTGTGNGQVAERYVRRVYGYGYPAPVSFDGCRTVGRPFNRNRFVDVKFGLIYA
                 190       200       210       220       230       240

                 250       260
m638.pep  GSQFERIARPGAGKCGIPISIIGSX
          |||||||||||||||||||||| |
a638      GSQFERIARPGAGKCGIPISIIDSWX.
                 250       260
```

The following partial DNA sequence was identified in *N. gonorrhoeae* <SEQ ID 2045>:

g639-1.seq

```
  1 ATGAGCCTGC CAGCAATGGA TGCCGGTATT TATCTCGAAA AAGCCGCCCC

 51 GCGCGCCCTG GTTGAACACA ACAATATTTT TGATAATTCG TTCGGCGTAT

101 ACCTTCATGG TTCTGCCGAT GCGATGGTGC GCGAGAATAA AATCGTCGGC

151 GATGCGACCT TGCGCGTGAA TGAGCGCGGC AATGGCGTTA CCGTTTGGAA

201 CGCGCCCGGC GCGCAGGTCG TCGGCAACGA CATTTCCAAA GGGCGGGACG

251 GCATTTTTTC CAATACCAGC ACGCACAACA CCTATAAAAA CAACCGCTTC

301 AGCGACCTGC GTTTCGCCGT CCACTATATG TACACCAACG ACAGCGAAGT

351 CAGCGGCAAT ATTTCCGTGG GCAACAATAT GGGCTATGTG CTGATGTTTT

401 CCGAACGGCT CAAAGTGTTC GACAATATCG CCGTCGGCAG CCGCGATTAG

451 GGCATCATGC TCAACTATGT CAACTATTCC GATATTCACG ACAATATTAT

501 CAACAAAGCG GGCAAGTGCG TTTTTGCCTA CAATGCCAAC TACGATAAAC

551 TGTCCGCCAA TCATTTTGAA AACTGCCAAA TCGGCATGCA CTTTACCGCC

601 GCCATCGAAG GCACGTCCCT GCACGACAAT TCCTTTATCA ACAACGGAAG

651 CCAGGTCAAA TATGTCAGTA CGCGCTTTCT CGACTGGAGC GAGGGCGGAC

701 ACGGCAACTA CTGGAGCGAC AACAGCCCGT TCGATTTGAA CGGCGACGGC

751 TTCGGAGACA GCGCGTACCG TCCCGACGGC ATCATCGACC AAATCATCTG
```

-continued

```
 801 GCGCGCGCCC GTATCGCGCC TCTTGATGAA CAGTCCCGCA ATCAGCATCG

 851 TCAAATGGGC GCAGGCGCAG TTTCCCGCCG TTCTGCCCGG CGGCGTGGTG

 901 GACAGCAAAC CGCTGATGAA GCCTTATGCC CCCAAAATTC AAACCCGTTA

 951 TCAGGCGATG AAGGACGAGT TGCTCAAAGA AGCCGAAACG CGGCAGTCGG

1001 AACGGGGCAG GGCGGAAAAC GGTTCTTTGA ACTAG
```

This corresponds to the amino acid sequence <SEQ ID 2046: ORF 639-1.ng>:

g639-1.pep

```
  1 MSLPAMDAGI YLEKAAPRAL VEHNNIFDNS FGVYLHGSAD AMVRENKIVG

 51 DATLRVNERG NGVTVWNAPG AQVVGNDISK GRDGIFSNTS THNTYKNNRF

101 SDLRFAVHYM YTNDSEVSGN ISVGNNMGYV LMFSERLKVF DNIAVGSRD*

151 GIMLNYVNYS DIHDNIINKA GKCVFAYNAN YDKLSANHFE NCQIGMHFTA

201 AIEGTSLHDN SFINNGSQVK YVSTRFLDWS EGGHGNYWSD NSPFDLNGDG

251 FGDSAYRPDG IIDQIIWRAP VSRLLMNSPA ISIVKWAQAQ FPAVLPGGVV

301 DSKPLMKPYA PKIQTRYQAM KDELLKEAET RQSERGRAEN GSLN*
```

The following partial DNA sequence was identified in *N. meningitidis* <SEQ ID 2047>:

m639-1.seq

```
  1 ATGAGCCTGC CCGCAATGGA TGCCGGTATT TATCTCGAAG AAACTGCCCC

 51 GCGCGCCCTG ATTGAACACA ACAATATTTT GGATAATTCG GTCGGCGTAT

101 ATCTGCATGG TTCTGCCGAT GCGATGGTGC GCGAGAATAA AATCGTCGGC

151 GACGCGACTT TGCGCGTGAA CGAGCGCGGC AACGGCGTTA CCGTTTGGAA

201 CGCACCCGGT GCGCAGGTCG TCGGCAACGA CATTTCCAAA GGGCGGGACG

251 GCATTTTTTC CAATACCAGC ACGCACAACA CCTACAAAAA CAACCGCTTC

301 AGCGATTTGC GTTTCGCCGT CCACTATATG TACACCAACG ACAGCGAAAT

351 CAGCGGCAAT ATTTCCGTGG GCAACAATAT GGGCTATGTG CTGATGTTTT

401 CCGAGCGGCT CAAAGTATTC GACAATATCG CCGTCGGCAG CCGCGATCAG

451 GGCATTATGC TCAACTATGT CAACTATTCC GATATTCACG ACAACATTAT

501 CAACAAGGCA GGCAAGTGCG TATTTGCCTA TAATGCCAAC TACGATAAAC

551 TTTTCGCCAA TCATTTTGAA AACTGTCAAA TCGGCATACA CTTTACCGCC

601 GCCATCGAAG GCACGTCCTT GCATGACAAT TCCTTTATCA ACAACGAAAG

651 CCAGGTCAAA TACGTCAGCA CGCGCTTTCT CGATTGGAGC GAGGGCGGAC

701 ACGGCAACTA TTGGAGCGAC AACAGCGCGT TCGATTTGAA CGGCGACGGC

751 TTCGGAGACA GCGCGTACCG CCCCAACGGC ATCATCGACC AAATCATCTG

801 GCGCGCGCCC GTATCGCGCC TTTTGATGAA CAGTCCCGCA ATCAGCATCG

851 TCAAATGGGC GCAGGCGCAG TTTCCCGCCG TTCTGCCTGG CGGCGTGGTG

901 GACAGCAAAC CGCTGATGAA GCCTTATGCC CCCAAAATTC AAACCCGTTA
```

-continued

```
 951 TCAGGCGATG AAGGACGAGC TACTCAAAGA AGTCGAAACG CGGCAGTCGG

1001 AATGGGGCAG GGCGGAAAAC GGTTCTTTGA ACTAG
```

This corresponds to the amino acid sequence <SEQ ID 2048; ORF 639-1>:

m639-1.pep

```
  1 MSLPAMDAGI YLEETAPRAL IEHNNILDNS VGVYLHGSAD AMVRENKIVG

 51 DATLRVNERG NGVTVWNAPG AQVVGNDISK GRDGIFSNTS THNTYKNNRF

101 SDLRFAVHYM YTNDSEISGN ISVGNNMGYV LMFSERLKVF DNIAVGSRDQ

151 GIMLNYVNYS DIHDNIINKA GKCVFAYNAN YDKLFANHFE NCQIGIHFTA

201 AIEGTSLHDN SFINNESQVK YVSTRFLDWS EGGHGNYWSD NSAFDLNGDG

251 FGDSAYRPNG IIDQIIWRAP VSRLLMNSPA ISIVKWAQAQ FPAVLPGGVV

301 DSKPLMKPYA PKIQTRYQAM KDELLKEVET RQSEWGRAEN GSLN*
```

g639-1/m639-1 95.9% identity in 344 aa overlap

```
                     10        20        30        40        50        60
g639-1.pep   MSLPAMDAGIYLEKAAPRALVEHNNIFDNSFGVYLHGSADAMVRENKIVGDATLRVNERG
             ||||||||||||::|||||:|||||:||| ||||||||||||||||||||||||||||||
m639-1       MSLPAMDAGIYLEETAPRELIEHNNILDNSVGVYLHGSADAMVRENKIVGDATLRVNERG
                     10        20        30        40        50        60

                     70        80        90       100       110       120
g639-1.pep   NGVTVWNAPGAQVVGNDISKGRDGIFSNTSTHNTYKNNRFSDLRFAVHYMYTNDSEVSGN
             |||||||||||||||||||||||||||||||||||||||||||||||||||||||:|||
m639-1       NGVTVWNAPGAQVVGNDISKGRDGIFSNTSTHNTYKNNRFSDLRFAVHYMYTNDSEISGN
                     70        80        90       100       110       120

                    130       140       150       160       170       180
a639-1.pep   ISVGNNMGYVLMFSERLKVFDNIAVGSRDXGIMLNYVNYSDIHDNIINKAGKCVFAYNAN
             ||||||||||||||||||||||||||||| ||||||||||||||||||||||||||||||
m639-1       ISVGNNMGYVLMFSERLKVFDNIAVGSRDQGIMLNYVNYSDIHDNIINKAGKCVFAYNAN
                    130       140       150       160       170       180

                    190       200       210       220       230       240
g639-1.pep   YDKLSANHFENCQIGMHFTAAIEGTSLHDNSFINNGSQVKYVSTRFLDWSEGGHGNYWSD
             |||| ||||||||||:||||||||||||||||||| ||||||||||||||||||||||||
m639-1       YDKLFANHFENCQIGIHFTAAIEGTSLHDNSFINNESQVKYVSTRFLDWSEGGHGNYWSD
                    190       200       210       220       230       240

                    250       260       270       280       290       300
g639-1.pep   NSPFDLNGDGFGDSAYRPDGIIDQIIWRAPVSRLLMNSPAISIVKWAQAQFPAVLPGGVV
             || ||||||||||||||:||||||||||||||||||||||||||||||||||||||||||
m639-1       NSAFDLNGDGFGDSAYRPNGIIDQIIWRAPVSRLLMNSPAISIVKWAQAQFPAVLPGGVV
                    250       260       270       280       290       300

                    310       320       330       340
a639-1.pep   DSKPLMKPYAPKIQTRYQAMKDGLLKKAETRQLERGRAENGSLNX
             ||||||||||||||||||||||:|||||| ||||||||||
m639-1       DSKPLMKPYAPKIQTRYQAMKDELLKEVETRQSEWGRAENGSLNX
                    310       320       330       340
```

The following partial DNA sequence was identified in *N. meningitidis* <SEQ ID 2049>:

a639-1.seq

```
  1 ATGAGCCTGC CCGCAATGGA TGCCGGTATT TATCTCGAAG AAACTGCCCC

 51 GCGCGCCCTG ATTGAACACA ATAATATTTT GGATAATTCG GTCGGCGTCT

101 ATCTGCATGG TTCTGCCGAT GCGATGGTGC GGGAGAATAA AATCGTCGGC

151 GACGCGACTT TGCGCGTGAA CGAGCGCGGC AATGGCGTTA CCGTTTGGAA
```

-continued

```
 201 CGCGCCCGGC GCGCAGGTCG TCGGCAACGA TATTTCCAAA GGGCGGGACG

 251 GCATTTTTTC CAATACCAGC ACGCACAACA CCTATAAAAA CAACCGCTTC

 301 AGCGATTTGC GTTTCGCCGT CCACTATATG TACACCAACG ACAGCGAAAT

 351 CAGCGGCAAT ATTTCCGTGG GCAACAATAT GGGCTATGTG CTGATGTTTT

 401 CCGAGCGGCT CAAAGTGTTT GACAATATCG CCGTCGGCAG CCGCGACCAA

 451 GGCATCATGC TCAACTATGT CAACTATTCC GATATTCACG ACAACATTAT

 501 CAACAAAGCG GGCAAGTGCG TTTTTGCCTA CAATGCCAAC TACGATAAAC

 551 TGTCCGCCAA TCATTTTGAA AACTGCCAAA TCGGCATACA CTTTACCGCC

 601 GCCATCGAAG GCACGTCCCT GCACGACAAT TCCTTTATCA ACAACGAAAG

 651 CCAGGTCAAA TACGTCAGCA CGCGCTTTCT CGACTGGAGC GAGGGCGGAC

 701 ACGGCAACTA TTGGAGCGAC AACAGCGCGT TCGATTTGAA CGGCGACGGC

 751 TTCGGAGACA GCGCGTACCG TCCCAACGGC ATCATCGACC AAATCATCTG

 801 GCGCGCACCC GTATCGCGCC TCTTGATGAA CAGTCCCGCA ATCAGCATCG

 851 TCAAATGGGC GCAGGCGCAA TTTCCCGCCG TTTTGCCTGG CGGCGTGGTG

 901 GACAGCAAAC CGCTGATGAA GCCTTATGCC CCCAAAATTC AAACCCGTTA

 951 TCAGGCGATG AAGGACGGGC TGCTCAAAAA AGTCGAAACG CGGCAGTTGG

1001 AATGGGGCAG GGCGGAAAAC GGTTCTTTGA ACTAG
```

This corresponds to the amino acid sequence <SEQ ID 2050; ORF 639-1.a>:

```
a639-1.pep

  1 MSLPAMDAGI YLEETAPRAL IEHNNILDNS VGVYLHGSAD AMVRENKIVG

 51 DATLRVNERG NGVTVWNAPG AQVVGNDISK GRDGIFSNTS THNTYKNNRF

101 SDLRFAVHYM YTNDSEISGN ISVGNNMGYV LMFSERLKVF DNIAVGSRDQ

151 GIMLNYVNYS DIHDNIINKA GKCVFAYNAN YDKLSANHFE NCQIGIHFTA

201 AIEGTSLHDN SFINNESQVK YVSTRFLDWS EGGHGNYWSD NSAFDLNGDG

251 FGDSAYRPNG IIDQIIWRAP VSRLLMNSPA ISIVKWAQAQ FPAVLPGGVV

301 DSKPLMKPYA PKIQTRYQAM KDGLLKKVET RQLEWGRAEN GSLN*
```

a639-1/m639-1 98.8% identity in 344 aa overlap

```
                    10        20        30        40        50        60
a639-1.pep  MSLPAMDAGIYLEETAPRALIEHNNILDNSVGVYLHGSADAMVRENKIVGDATLRVNERG
            ||||||||||||||||||||||||||||||||||||||||||||||||||||||||||||
m639-1      MSLPAMDAGIYLEETAPRALIEHNNILDNSVGVYLHGSADAMVRENKIVGDATLRVNERG
                    10        20        30        40        50        60

                    70        80        90       100       110       120
a639-1.pep  NGVTVWNAPGAQVVGNDISKGRDGIFSNTSTHNTYKNNRFSDLRFAVHYMYTNDSEISGN
            ||||||||||||||||||||||||||||||||||||||||||||||||||||||||||||
m639-1      NGVTVWNAPGAQVVGNDISKGRDGIFSNTSTHNTYKNNRFSDLRFAVHYMYTNDSEISGN
                    70        80        90       100       110       120

                   130       140       150       160       170       180
a639-1.pep  ISVGNNMGYVLMFSERLKVFDNIAVGSRDQGIMLNTVNYSDIHDNIINKAGKCVFAYNAN
            ||||||||||||||||||||||||||||||||||||||||||||||||||||||||||||
m639-1      ISVGNNMGYVLMFSERLKVFDNIAVGSRDQGIMLNTVNYSDIHDNIINKAGKCVFAYNAN
                   130       140       150       160       170       180
```

-continued

```
                190        200        210        220        230        240
a639-1.pep  YDKLSANHFENCQIGIHFTAAIEGTSLHDNSFINNESQVKYVSTRFLDWSEGGHGNYWSD
            |||| |||||||||||||||||||||||||||||||||||||||||||||||||||||||
m639-1      YDKLFANHFENCQIGIHFTAAIEGTSLHDNSFINNESQVKYVSTRFLDWSEGGHGNYWSD
                190        200        210        220        230        240

                250        260        270        280        290        300
a639-1.pep  NSAFDLNGDGFGDSAYRPNGIIDQIIWRAPVSRLLMNSPAISIVKWAQAQFPAVLPGGVV
            ||||||||||||||||||||||||||||||||||||||||||||||||||||||||||||
m639-1      NSAFDLNGDGFGDSAYRPNGIIDQIIWRAPVSRLLMNSPAISIVKWAQAQFPAVLPGGVV
                250        260        270        280        290        300

                310        320        330        340
a639-1.pep  DSKPLMKPYAPKIQTRYQAMKDGLLKKVETRQLEWGRAENGSLNX
            ||||||||||||||||||||| |||:||||| |||||||||||||
m639-1      DSKPLMKPYAPKIQTRYQAMKDELLKEVETRQSEWGRAENGSLNX
                310        320        330        340
```

The following partial DNA sequence was identified in *N. gonorrhoeae* <SEQ ID 2051>:

g640.seq

```
   1 ATGATTCATA TAATATCAAT ATTAAAGAGT ATCGGTATAT CGGGGATAGC
  51 TATGTCCTGT TTTTCAATCC GGCGTATGTC TGCGTTTCGG GCGCGGATAA
 101 CGGCGTTTTT TACCGCCTTT GTCTTTTTGA CGGcggcACT GCCCGCTTAT
 151 GcggAgcgTc tgcctGATTT TCTGgcgAAA ATacAgcctT CGGAAATTTT
 201 TCCGGGTGCG GATCGTTACG GCAAGCCGGA aggcAAGCCT AtggtTGCCC
 251 GCgtttACAA AGgcgATGAG CAGCTCGGTT TGGTTTATAT CACGACCGAT
 301 GCGGTCAATA CGCGCGGTTA TTCGAGCAAA CCGATCGATA CGCTGATGGC
 351 TTTGGCAAAC GACGGCACGA TAGCCGGGGC GAAACTGGTC GATCATCACG
 401 AACCGATTAT GCTGATCGGT ATCCCGCAAT CGCGTGTCGA TAAGTTCATC
 451 GACAAATATA TCGGTCTGAA TTTTATTAAA AATCCGCCGA CCCCGAGCGT
 501 GGCGCCGGGC GACATCATCA GcggtGCGAC TgttaCACTG ATGGTGGTTA
 551 ACGACAGCAT CCAGCGTTCG TACAAGGTCA TTGCCAACCA ATACCGTCTG
 601 GGTTCGGACA AGGCCCTTCA GACGGCATCC GCTTCCGATG TTCGGGAAGC
 651 CGCGCCTGCG TCAGAAACCC GTCCGCGCCG TATGGCAAAT CCCGACAAGC
 701 AGGATATTTT GTCTTGGGAC GAACTTTTGA AACAAAAGGC CGTCGGCCAT
 751 CTGCATATCA CGCTCGATCA AATCAACAAA CTGTTTGAGA AAGGCGGCAA
 801 GGCCGGCGTG GCCGATCACG CCGAACAGGG CGATCCTGAC GATACCTTTA
 851 TTGATTTGTA TGTTGCCTTG GTCAGCCAGC CTTCCATCGG TAAAAGCCTG
 901 CTGGGTGAGG ACGGCTGGGC GCATCTGCAA AAACGGCTGA AACCCGGGCA
 951 GCAGGCGGTT TTGGTTGCCG GAGAGGGCCG TTATTCTTGG AAAGGTTCGG
1001 GCTATGTGCG CGGCGGTATT TTCGACCGTA TCGAGATGAT TCAGGGGGAG
1051 AACAGCTTCC GTTTTACCGA TGCCCAACAC GAACGCGTCG TCGAGCTGTC
1101 TGCCCCCGAT GCGCCGCGTT TTAAAGAAGT TTCTTGGTTT ACCATCCCTG
1151 AAGGCGTAGC GTTTGACGGT GCGGAGCCGT GGCGGCTGTA A
```

This corresponds to the amino acid sequence <SEQ ID 2052; ORF 640.ng>:

g640.pep

```
  1 MIHIISILKS IGISGIAMSC FSIRRMSAFR ARITAFFTAF VFLTAALPAY
 51 AERLPDFLAK IQPSEIFPGA DRYGKPEGKP MVARVYKGDE QLGLVYITTD
101 AVNTRGYSSK PIDTLMALAN DGTIAGAKLV DHHEPIMLIG IPQSRVDKFI
151 DKYIGLNFIK NPPTPSVAPG DIISGATVTL MVVNDSIQRS YKVIANQYRL
201 GSDKALQTAS ASDVREAAPA SETRPRRMAN PDKQDILSWD ELLKQKAVGH
251 LHITLDQINK LFEKGGKAGV ADHAEQGDPD DTFIDLYVAL VSQPSIGKSL
301 LGEDGWAHLQ KRLKPGQQAV LVAGEGRYSW KGSGYVRGGI FDRIEMIQGE
351 NSFRFTDAQH ERVVELSAAD APRFKEVSWF TIPEGVAFDG AEPWRL*
```

The following partial DNA sequence was identified in *N. meningitidis* <SEQ ID 2053>:

m640.seq (partial)

```
  1 ATGATTCATA TAATATCAAT ATTAAAGAGT ATCGGTATAT CGGGGATAGT
 51 CATGTCCTGT TTTTCAATCA AACGTATGTC CGCGTTTCGG GCGCGGATAA
101 CGGCGTTTTT TGCCGCCTTT GTCTTTTTGA CGGCGGCACT GCCCGCTTAT
151 GCGGAGCGTC TGCCTGATTT TCTGGCGAAA ATACAGCCTT CGGAAATTTT
201 TCCGGGTGCG GACCGTTACG GCAAGCCCGA AGGTAAGCCT ATGGTTGCCC
251 GCGTTTACAA AGGCGATGAG CAGTTGGGCT TGGTCTATAT CACGACCGAT
301 GCGGTCAATA CGCGCGGTTA TTCGAGCAAA CCGATTGATA CGCTGATGGT
351 GTTGGCAAAC GACGGCACGA TAGCCGGGGC GAAACTGGTC GACCATCACG
401 AACCGATTAT GCTGATCGGT ATCCCGCAT . . .
```

This corresponds to the amino acid sequence <SEQ ID 2054; ORF 640>:

m640.pep (partial)

```
  1 MIHIISILKS IGISGIVMSC FSIKRMSAFR ARITAFFAAF VFLTAALPAY
 51 AERLPDFLAK IQPSEIFPGA DRYGKPEGKP MVARVYKGDE QLGLVYITTD
101 AVNTRGYSSK PIDTLMVLAN DGTIAGAKLV DHHEPIMLIG IPH . . .
```

m640/g640 96.5% identity in 143 aa overlap

```
                   10        20        30        40        50        60
m640.pep   MIHIISILKSIGISGIVMSCFSIKRMSAFRARITAFFAAFVFLTAALPAYAERLPDFLAK
           |||||||||||||||:||||||:||||||||||||||:||||||||||||||||||||||
g640       MIHIISILKSIGISGIAMSCFSIRRMSAFRARITAFFTAFVFLTAALPAYAERLPDFLAK
                   10        20        30        40        50        60

                   70        80        90       100       110       120
m640.pep   IQPSEIFPGADRYGKPEGKPMVARVYKGDEQLGLVYITTDAVNTRGYSSKPIDTLMVLAN
           ||||||||||||||||||||||||||||||||||||||||||||||||||||||||:|||
g640       IQPSEIFPGADRYGKPEGKPMVARVYKGDEQLGLVYITTDAVNTRGYSSKPIDTLMALAN
                   70        80        90       100       110       120

                  130       140
m640.pep   DGTIAGAKLVDHHEPIMLIGIPH
           ||||||||||||||||||||||:
g640       DGTIAGAKLVDHHESIMLIGIPQSRVDKFIDKYIGLNFIKNPPTPSVAPGDIISGATVTL
                  130       140       150       160       170       180
```

The following partial DNA sequence was identified in *N. meningitidis* <SEQ ID 2055>:

```
a640.seq (partial)

  1 ATGATTCATA TAATATCAAT ATTAAACAGT ATCGGTATAT CGGGGATAGT

 51 CATGTCCTGT TTTTCAATCA AACGTATGTC CGCGTTTCGG GCGCGGATAA

101 CGGCGTTTTT TGCCGCCTTT GTCTTTTTGA CGGCGGCACT GCCCGCTTAT

151 GCGGAGCGTC TGCCTGATTT TCTGGCGAAA ATACAGCCTT CGGAAATTGT

201 TCCGGGTGCG GACCGTTACA GCAAGCCGGA AGGTAAGCCT ATGGTTGCCC

251 GCGTTTACAA AGGCGATGAG CAGTTGGGCT TGGTCTATAT CACGACCGAT

301 GCGGTCAATA CGCGCGGTTA TTCGAGCAAA CCGATTGATA CGCTGATGGC

351 GTTGGCTAAA GACGGTACGA TAGCCGGAGC GAAATTGGTT GATCACCATG

401 AGTCGATTAT GCTGATCGGT ATCCCGCAT . . .
```

This corresponds to the amino acid sequence <SEQ ID 2056; ORF 640.a>:

```
a640.pep (partial) Length: 143

  1 MIHIISILKS IGISGIVMSC FSIKRMSAFR ARITAFFAAF VFLTAALPAY

 51 AERLPDFLAK IQPSEIVPGA DRYSKPEGKP MVARVYKGDE QLGLVYITTD

101 AVNTRGYSSK PIDTLMALAK DGTIAGAKLV DHHESIMLIG IPH...
```

m640/a640 96.5% identity in 143 aa overlap

```
                   10        20        30        40        50        60
m640.pep   MIHIISILKSIGISGIVMSCFSIKRMSAFRARITAFFAAFVFLTAALPAYAERLPDFLAK
           ||||||||||||||||||||||||||||||||||||||||||||||||||||||||||||
a640       MIHIISILKSIGISGIVMSCFSIKRMSAFRARITAFFAAFVFLTAALPAYAERLPDFLAK
                   10        20        30        40        50        60

                   70        80        90       100       110       120
m640.pep   IQPSEIFPGADRYGKPEGKPMVARVYKGDEQLGLVYITTDAVNTRGYSSKPIDTLMVLAN
           |||||| ||||||:||||||||||||||||||||||||||||||||||||||||||:||:
a640       IQPSEIVPGADRYSKPEGKPMVARVYKGDEQLGLVYITTDAVNTRGYSSKPIDTLMALAK
                   70        80        90       100       110       120

                  130       140
m640.pep   DGTIAGAKLVDHHEPIMLIGIPH
           |||||||||||||| ||||||||
a640       DGTIAGAKLVDHHESIMLIGIPH
                  130       140
```

The following partial DNA sequence was identified in *N. gonorrhoeae* <SEQ ID 2057>:

```
g642.seq

  1 ATGCGGTATC CGCCGCAATC GGCGGTTTTG CAGAATGCCG CGCGTTGCCT

 51 TTTGCGCCGC CCGAAATCTG CCTGCCGCCG TATTTGCCCG CTATCCGCAA

101 TATCGGCAGT CCAATATATC TTTGCGGATG TCGTTCAGCA GGAAGGCTGT

151 GGTGTCTTCG TGTTCCTCCT GTACGAAGAC AAAAAGTCGG GCGATGATTT

201 TGCCGATGAA GACTTTTTGC AGGGCGCAGG CGTCGGTCAG GGTGTGTTCC

251 TGCAGGAAGC TGCGGATGTC TTCGGGCAAA GCGTAgtCgc gGGCAACGGC
```

-continued

```
 301 GGcaaagcgG ACatcggtTT Gcacggcgtc gagCAGGGtt tggtTTTTGT
 351 CCAACTTAAT GCCTGCTTCT TTTTCTTCGG CGGTGGCGCG GACGAACTGG
 401 TCGTAAATTT CGGCATAAAG CATATCGTTC GGGCCTTCAA AAATCGTGAA
 451 GGGGCGGATA TCGATGGCGA TATTGCCGGC TGGGTGTCCG CGTTCAAAAC
 501 CCTTCGCGCC CAAGAGTTTT TGCAACATTT GCGCGGCGgc gTAAGTGTAT
 551 TCCGTGGCGa ggGTTTTGAc gatgTTCGCC TCCATCAATT GATGGGCGAc
 601 ggGCGcgacg ggCGAAACGG AATGGCAGAC GTAGCGGTAA AGGATTTCGG
 651 AAACCTGATG GCGGCGTTGG ATTTCGCGGC GTTCGTAATC GACGAATCTG
 701 ATATCGTTGC GGACATATCG GTTCAGGTTG TCAAGGATGT ATTCCATAAT
 751 GCCGTGCGTC ATGCCGATCA GTTGCAGGCG GCTGCGGATA AAGATGTTTT
 801 GGAACGCGCG CAAACCGGCA GCGTCGCCCC GGGAGAGTTT CATCACGGCG
 851 GTTGCAGGCA TTTCGGCATC GATGCGGTTG ACGGCGTAAC GGACGGCGCG
 901 CAGGCCTTCG GATGCGAGGG TTTCGCAGCG GATGTATGTT TTGGGGACGA
 951 GCAGCAGGTC GATGactttg gcgagtttgC Cgtttttgcg ctctttggcg
1001 gcaacgaggA GGAAGTCGCT TTGCGAATTG CCCTGCCAGT ATTTCGCGGC
1051 GttgACGTAA ATGGTTtgtt cgtcggtata ttcgtagcag gactgcaTTT
1101 CGCGTGCAAt cgCcgcgccg gaggtTtcgg gttcggtaAc gcccaaacgg
1151 cggctttcgc ctTTGAAAAT CATGTCCAAA CCTTGTGCGA CTTGCgcttc
1201 gccgccgaac tCTTGCAGAG GCTGCAACAC CAGCGCGCCT TCGATGCCGG
1251 TACGCAGCGT AACGGGCACG CCGTAATGCC CCGCAATCCT TAG
```

This corresponds to the amino acid sequence <SEQ ID 2058; ORF 642.ng>:

g642.pep

```
  1 MRYPPQSAVL QNAARCLLRR PKSACRRICP LSAISAVQYI FADVVQQEGC
 51 GVFVFLLYED KKSGDDFADE DFLQGAGVGQ GVFLQEAADV FGQSVVAGNG
101 GKADIGLHGV EQGLVFVQLN ACFFFFGGGA DELVVNFGIK HIVRAFKNRE
151 GADIDGDIAG WVSAFKTLRA QEFLQHLRGG VSVFRGEGFD DVRLHQLMGD
201 GRDGRNGMAD VAVKDFGNLM AALDFAAFVI DESDIVADIS VQVVKDVFHN
251 AVRHADQLQA AADKDVLERA QTGSVAPGEF HHGGCRHFGI DAVDGVTDGA
301 QAFGCEGFAA DVCFGDEQQV DDFGEFAVFA LFGGNEEEVA LRIALPVFRG
351 VDVNGLFVGI FVAGLHFACN RRAGGFGFGN AQTAAFAFEN HVQTLCDLRF
401 AAELLQRLQH QRAFDAGTQR NGHAVMPRNP *
```

The following partial DNA sequence was identified in *N. meningitidis* <SEQ ID 2059>:

m642.seq (partial)

```
  1 GCCTGCCGCC GTATTTGCCC GCTACCCGCA ATATCGGCAG TCCAATATAT
 51 CTTTGCGGAT GTCGTTCAGC AGGAAGGCTG CGGTGTCTTC GTGTTTCGCC
101 TGTACGAAGA CAAAGAGTCG GGCGATGATT TTGCCGATAA AGACTTTTTG
```

-continued

```
 151 CAGGGCGCAG GCATCGGTCA GGGTGTGTTC CTGCAGGAAG CTGCGGATGT
 201 CTTCAGGCAA AGTGTAGTCG CGGGCGACGG CGGCAAAGCG GGCATCGGTT
 251 TGCAGGCGGT CGAGCAGGGT TTGGTTTTTG TCCAACTTCA TGCCTGCTTC
 301 TTTTTCTTCG GCGGTGGCGC GGACAAACTG GTCGTAAATT TCGGCATAAA
 351 GCATATCGTT CGGGCCTTCA AAAATCGTGA AGGGGCGGAT GTCGATAGCG
 401 ATATTGCCGG CGGTGTGTCC GCGTTCAAAA CCCTTCGCAC CCAAGAGTTT
 451 TTGCAACATT TGCGCGGCGG CGTAAGTGTA TTCCGTGGCG AGGGTTTTGA
 501 CGATGTTCGC CTCCATCAGC TGATGGGCGA CGGGGGCAAC AGGCGAAACG
 551 GAATGGCAGA CGTAGCGGTA AAGAATCTCG GAAACCTGAT GGCGGCGCCG
 601 GATTTCGCGG CGTTCGTAAT CGACGAATTT GATGTCGTTG CGGACGTATC
 651 GTTCCAGATT TTCAAGGATG TATTCCATAA TGCCGTGCGT CATGCCGATC
 701 AGTTGCAGGC GGCTGCGGAT AAAGATGTTT TGGAACGCGC GCAAACCGGC
 751 AGCGTCGCTC TGGGAGAGTT TCATCACGGC GGTTGCAGGC ATTTCGGCAT
 801 CGATGCGGTT GACGGCGTAA CGGACGGCGC GCAAGCCTTC GGATGCGAGG
 851 GTTTCGCAGC GGATGTATGT TTTGGGGACG AGCAGCAGGT CGATGACTTT
 901 GGCGAGTTTG CCGTTTTTGC GCTCTTTGGC GGCAACGAGG AGGAAGTCGC
 951 TTTGCGAGTT GCCCTGCCAG TATTTCGCGG CGTTGACGTA AATGGTTTGT
1001 CCGTCGATAT ATTCGTAGTA GGACTGCATT TCGCGTGCAA TCGCCGCGCC
1051 GGAGGTTTCG GGTTCGGTAA CACCCAAACC GCCGCCCTCG CCTTTGAAAA
1101 TCATCTCCAA ACCTTGCGCG ACTTGCGCTT CATCGCCGAA CTCTTGCAGT
1151 GGCTGCAACA CCAGCGCGCC TTCGATGCCG GTACGCAGCG TAACGGGCAC
1201 GCCGTAATGC CCCGCAATCC G
```

This corresponds to the amino acid sequence <SEQ ID 2060; ORF 642>:

m642.pep (partial)

```
  1 ACRRICPLPA ISAVQYIFAD VVQQEGCGVF VFRLYEDKES GDDFADKDFL
 51 QGAGIGQGVF LQEAADVFRQ SVVAGDGGKA GIGLQAVEQG LVFVQLHACF
101 FFFGGGADKL VVNFGIKHIV RAFKNREGAD VDSDIAGGVS AFKTLRTQEF
151 LQHLRGGVSV FRGEGFDDVR LHQLMGDGGN RRNGMADVAV KNLGNLMAAP
201 DFAAFVIDEF DVVADVSFQI FKDVFHNAVR HADQLQAAAD KDVLERAQTG
251 SVALGEFHHG GCRHFGIDAV DGVTDGAQAF GCEGFAADVC FGDEQQVDDF
301 GEFAVFALFG GNEEEVALRV ALPVFRGVDV NGLSVDIFVV GLHFACNRRA
351 GGFGFGNTQT AALAFENHLQ TLRDLRFIAE LLQWLQHQRA FDAGTQRNGH
401 AVMPRNP
```

m642/g642 90.4% identity in 407 aa overlap

```
                               10        20        30
m642.pep                       ACRRICPLPAISAVQYIFADVVQQEGCGVFVFRLYED
                               |||||||| ||||||||||||||||||||||| ||||
g642      MRYPPQSAVLQNAARCLLRRPKSACRRICPLSAISAVQYIFADVVQQEGCGVFVFLLYED
                  10        20        30        40        50        60

            40        50        60        70        80        90
m642.pep  KESGDDFADKDFLQGAGIGQGVFLQEAADVFRQSVVAGDGGKAGIGLQAVEQGLVFVQLH
          |:|||||||:|||||||:||||||||||||| ||||||:|||| |||::||||||||||:
g642      KKSGDDFADEDFLQGAGVGQGVFLQEAADVFGQSVVAGNGGKADIGLHGVEQGLVFVQLN
                  70        80        90       100       110       120

          100       110       120       130       140       150
m642.pep  ACFFFFGGGADKLVVNFGIKHIVRAFKNREGADVDSDIAGGVSAFKTLRTQEFLQHLRGG
          |||||||||||:|||||||||||||||||||||:|:|||| ||||||||:||||||||||
g642      ACFFFFGGGADELVVNFGIKHIVRAFKNREGADIDGDIAGWVSAFKTLRAQEFLQHLRGG
                 130       140       150       160       170       180

          160       170       180       190       200       210
m642.pep  VSVFRGEGFDDVRLHQLMGDGGNRRNGMADVAVKNLGNLMAAPDFAAFVIDEFDVVADVS
          ||||||||||||||||||||| :  |||||||||||||::||| ||||||||| |:|||:|
g642      VSVFRGEGFDDVRLHQLMGDGRDGRNGMADVAVKNLGDFMAALDFAAFVIDESDIVADIS
                 190       200       210       220       230       240

          220       230       240       250       260       270
m642.pep  FQIFKDVFHNAVRHADQLQAAADKDVLERAQTGSVALGEFHHGGCRHFGIDAVDGVTDGA
           |: ||||||||||||||||||||||||||||||||| |||||||||||||||||||||||
g642      VQVVKDVFHNAVRHADQLQAAADKDVLERAQTGSVAPGEFHHGGCRHFGIDAVDGVTDGA
                 250       260       270       280       290       300

          280       290       300       310       320       330
m642.pep  QAFGCECFAADVCFGDEQQVDDFGEFAVFALFGGNEEEVALRVALPVFRGVDVNGLSVDI
          ||||||||||||||||||||||||||||||||||||||||||:||||||||||||| | |
g642      QAFGCECFAADVCFGDEQQVDDFGEFAVFALFGGNEEEVALRIALPVFRGVDVNGLFVGI
                 310       320       330       340       350       360

          340       350       360       370       380       390
m642.pep  FVVGLHFACNRRAGGFGFGNTQTAALAFENHLQTLRDLRFIAELLQWLQHQRAFDAGTQR
          ||:|||||||||||||||||:||||:|||||:||| |||| ||||| |||||||||||||
g642      FVAGLHFACNRRAGGFGFGNAQTAAFAFENHVQTLCDLRFAAELLQRLQHQRAFDAGTQR
                 310       320       330       340       350       360

          400
m642.pep  NGHAVMPRNP
          ||||||||||
g642      NGHAVMPRNPX
                 430
```

The following partial DNA sequence was identified in *N. meningitidis* <SEQ ID 2061>:

<u>a642.seq (partial)</u>

```
  1 GCCTGCCGCC GTATTTGCCC GCTATCCGCA ATATCGGCAG TCCAATATGT
 51 CTTTGCGGAT GTCGTTCAGC AGGAAGGCTG CGGTGTCTTC GTGTTCCGCC
101 TGTACGAAGA CAAAGAGTCG GGCGATGATT TTGCCGATAA AGACTTTTTG
151 CAGGGCGCAG GCATCGGTCA GGGTGTGTTC CTGCAGGAAG CTGCGGATGT
201 CTTCGGGCAA AGTGTAGTCG CGGGCGACGG CGGCAAAGCG GGCATCGGTT
251 TGCAGGCGGT CGAGCAGGGT TTGGTTTTTG TCCAACTTCA TGCCTGCTTC
301 TTTTTCTTCG GCGGTGGCGC GGACAAACTG GTCGTAAATT TCGGCATAAA
351 GCATATCGTT CGGGCCTTCA AAAATCGTGA AGGGGCGGAT GTCGATAGCG
401 ATATTGCCGG CGGTGTGTCC GCGTTCAAAA CCCTTCGCGC CCAAGAGTTT
451 TTGCAACATT TGCGCGGCGG CGTAAGTGTA TTCCGTGGCG AGGGTTTTGA
501 CGATGTTCGC CTCCATCAGT TGATGGGCGA CGGGTGCAAC GGGCGAAACG
551 GAATGGCAGA CGTAGCGGTA AAGAATCTCG GAAACCTGAT GGCGGCGCCG
601 GATTTCGCGG CGTTCGTAAT CGACGAATCT GATGTCGTTG CGGACGTATC
651 GTTCCAGGTT TTCAAGGGTG TATTCCATAA TGCCGTGCGT CATGCCGATC
701 AGTTGCAGGC GGCTGCGGAT AAAGATGTTT TGGAACGCGC GCAAACCGGC
751 AGCGTCGCTC TGGGAGAGTT TCATCACGGC GGTTGCAGGC ATTTCGGCAT
```

-continued

```
 801 CGATGCGGTT GACGGCGTAA CGGACGGCGC GCAAGCCTTC GGATGCGAGG

 851 GTTTCGCAGC GGATGTATGT TTTGGGGACG AGCAGCAGGT CGATGACTTT

 901 GGCGAGTTTG CCGTTTTTGC GCTCTTTGGC GGCAACGAGG AGGAAGTCGC

 951 TTTGCGAGTT GCCCTGCCAG TATTTCGCGG CGTTGACGTA AATGGTTTGT

1001 CCGTCGGTAT ATTCGTAGTA AGACTGCATT TCTCGGGCAA TCGCCGCGCC

1051 GGAGGTTTCG GGTTCGGTAA CGCCTAAACC GCCGCCCTCG CCTTTGAAAA

1101 CCATGTCCAA ACCCTGTGCG ATTTGCGCTT CATCGCCGAA CTCTTGCAGT

1151 GGCTGCAACA CCAGCGCGCC TTCGATGCCG GTACGCAGCG TAACGGGCAC

1201 GCCGTAATGC CCCGCAATCC G
```

This corresponds to the amino acid sequence <SEQ ID 2062; ORF 642.a>:

```
a642.pep Length: 407

  1 ACRRICPLSA ISAVQYVFAD VVQQEGCGVF VFRLYEDKES GDDFADKDFL

 51 QGAGIGQGVF LQEAADVFGQ SVVAGDGGKA GIGLQAVEQG LVFVQLHACF

101 FFFGGGADKL VVNFGIKHIV RAFKNREGAD VDSDIAGGVS AFKTLRAQEF

151 LQHLRGGVSV FRGEGFDDVR LHQLMGDGCN GRNGMADVAV KNLGNLMAAP

201 DFAAFVIDES DVVADVSFQV FKGVFHNAVR HADQLQAAAD KDVLERAQTG

251 SVALGEFHHG GCRHFGIDAV DGVTDGAQAF GCEGFAADVC FGDEQQVDDF

301 GEFAVFALFG GNEEEVALRV ALPVFRGVDV NGLSVGIFVV RLHFSGNRRA

351 GGFGFGNA*T AALAFENHVQ TLCDLRFIAE LLQWLQHQRA FDAGTQRNGH

401 AVMPRNP
```

m642/a642 95.8% identity in 407 aa overlap

```
                  10        20        30        40        50        60
m642.pep  ACRRICPLPAISAVQYIFADVVQQEGCGVFVFRLYEDKESGDDFADKDFLQGAGIGQGVF
          |||||||| |||||||:|||||||||||||||||||||||||||||||||||||||||||
a642      ACRRICPLSAISAVQYVFADVVQQEGCGVFVFRLYEDKESGDDFADKDFLQGAGIGQGVF
                  10        20        30        40        50        60

                  70        80        90       100       110       120
m642.pep  LQEAADVFRQSVVAGDGGKAGIGLQAVEQGLVFVQLHACFFFFGGGADKLVVNFGIKHIV
          |||||||| |||||||||||||||||||||||||||||||||||||||||||||||||||
a642      LQEAADVFGQSVVAGDGGKAGIGLQAVEQGLVFVQLHACFFFFGGGADKLVVNFGIKHIV
                  70        80        90       100       110       120

                 130       140       150       160       170       180
m642.pep  RAFKNREGADVDSDIAGGVSAFKTLRTQEFLQHLRGGVSVFRGEGFDDVRLHQLMGDGGN
          |||||||||||||||||||||||||||:|||||||||||||||||||||||||||||| |
a642      RAFKNREGADVDSDIAGGVSAFKTLRAQEFLQHLRGGVSVFRGEGFDDVRLHQLMGDGCN
                 130       140       150       160       170       180

                 190       200       210       220       230       240
m642.pep  RRNGMADVAVKNLGNLMAAPDFAAFVIDEFDVVADVSFQIFKDVFHNAVRHADQLQAAAD
          ||||||||||||||||||||||||||| ||||||||||||:|| ||||||||||||||||
a642      RRNGMADVAVKNLGNLMAAPDFAAFVIDESDVVADVSFQVFKGVFHNAVRHADQLQAAAD
                 190       200       210       220       230       240

                 250       260       270       280       290       300
m642.pep  KDVLERAQTGSVALGEFHHGGCRHFGIDAVDGVTDGAQAFGCEGFAADVCFGDEQQVDDF
          ||||||||||||||||||||||||||||||||||||||||||||||||||||||||||||
a642      KDVLERAQTGSVALGEFHHGGCRHFGIDAVDGVTDGAQAFGCEGFAADVCFGDEQQVDDF
                 250       260       270       280       290       300

                 310       320       330       340       350       360
m642.pep  GEFAVFALFGGNEEEVALRVALPVFRGVDVNGLSVDIFVVGLHFACNRRAGGFGFGNTQT
          ||||||||||||||||||||||||||||||||||| |||| |||: |||||||||||: |
a642      GEFAVFALFGGNEEEVALRVALPVFRGVDVNGLSVGIFVVRLHFSGNRRAGGFGFGNAXT
                 310       320       330       340       350       360
```

-continued

```
                370        380        390        400
m642.pep  AALAFENHLQTLRDLRFIAELLQWLQRAFDAGTQRNGHAVMPRNP
          |||||||||||||||||||||||||||||||||||||||||||||
a642      AALAFENHLQTLRDLRFIAELLQWLQRAFDAGTQRNGHAVMPRNP
                370        380        390        400
```

The following partial DNA sequence was identified in *N. gonorrhoeae* <SEQ ID 2063>:

g643.seq

```
  1 ATGGTGTTGC CTTTGATGTT GTTGGCGACA ATCAGgTcgg CTACGCTGAc
 51 gttgtancGt TTGGcaATGt tGaaCAgggt gtcgccTTCT ACAACGCGGT
101 GGATGCTGGC ATGGagcGGG GAGGTTTCGG CTTCGCCGTC GGCAGCTTTG
151 GCTACGCGCG TTTCCAAACG TGCCCGGCGT TtgCCGTCGG CGGCAACGGT
201 ATGTTGCGGA GATGAGGAAA TGTTGTGTTC GGCAACTGTG TCAGGCGTGC
251 CGATGACGGC GGagaTGGTT TCTTCAGCCT GCCGGCGCag gTTGTTTCGG
301 GCAACAAGCT GCATGAGTTC CTCTGCCGCC TGCATGTCGT TTGGGGGGAt
351 GACCTGCGCg aGTGtTGCGG TTTGGGTTTC agacgGCATG GCAGTCTGTT
401 TTTcggTTTG a
```

This corresponds to the amino acid sequence <SEQ ID 2064; ORF 643>:

g643.pep

```
  1 MVLPLMLLAT IRSATLTLXR LAMLNRVSPS TTRWMLAWSG EVSASPSAAL
 51 ATRVSKRARR LPSAATVCCG DEEMLCSATV SGVPMTAEMV SSACRRRLFR
101 ATSCMSSSAA CMSFGGMTCA SVAVWVSDGM AVCFSV*
```

The following partial DNA sequence was identified in *N. meningitidis* <SEQ ID 2065>:

m643.seq

```
  1 ATGGTGTTGC CTTTGATGTT GTTGGCGACA ATCAGGTCGG CTACACTGAC
 51 GTTGTAGCGT TTGGCAATGT TGAACAGGGT GTCGCCTTCT ACAACGCGGT
101 GGATGCTGGC ATGGAGCGGG GAGATTTCGG CTTCGCCGTC GGCAGCTTTG
151 GCTACGCGCG TTTCCAAACG TACCCGGCGT TTGCCGTCGG CGGCAGCGGT
201 ATGTTGCGGA GATGCGGAAA TTTTGTGTTC GGCAACTGTG TCAGGCGTGC
251 CGATGACGGC GGAGATGGTT TCTTCAGCCT GTCGGCGCAG GTTGTTTCGG
301 GCAACAAGCT GCATGAGTTC GTCTGCCGCC TGCATGTCGT TTTGGGGGAT
351 GATCTGCGCG AGTGTTGCGG TTTGGGTTTC AGACGGCATG GCGGTCTGTT
401 TTTCGGTTTG A
```

This corresponds to the amino acid sequence <SEQ ID 2066; ORF 643>:

m643.pep

```
  1 MVLPLMLLAT IRSATLTL*R LAMLNRVSPS TTRWMLAWSG EISASPSAAL
 51 ATRVSKRTRR LPSAAAVCCG DAEILCSATV SGVPMTAEMV SSACRRRLFR
101 ATSCMSSSAA CMSFWGMICA SVAVWVSDGM AVCFSV*
```

Computer analysis of the amino acid sequences gave the following results:

Homology with a predicted ORF from *N. meningitidis* menA with menB

ORF 643 shows 94.9% identity over a 136 aa overlap with a predicted ORF (ORF643.a) from *N. gonorrhoeae*:

m643/g643

```
                   10        20        30        40        50        60
m643.pep   MVLPLMLLATIRSATLTLXRLAMLNRVSPSTTRWMLAWSGEISASPSAALATRVSKRTRR
           ||||||||||||||||||||||||||||||||||||||||:|||||||||||||||:||
g643       MVLPLMLLATIRSATLTLXRLAMLNRVSPSTTRWMLAWSGEVSASPSAALATRVSKRARR
                   10        20        30        40        50        60

                   70        80        90       100       110       120
m643.pep   LPSAAAVCCGDAEILCSATVSGVPMTAEMVSSACRRRLFRATSCMSSSAACMSFWGMICA
           |||||:||||| |:||||||||||||||||||||||||||||||||||||||||| || ||
g643       LPSAATVCCGDEEMLCSATVSGVPMTAEMVSSACRRRLFRATSCMSSSAACMSFGGMTCA
                   70        80        90       100       110       120

                  130
m643.pep   SVAVWVSDGMAVCFSVX
           ||||||||||||||||
g643       SVAVWVSDGMAVCFSVX
                  130
```

The following partial DNA sequence was identified in *N. meningitidis* <SEQ ID 2067>:

a643.seq

```
  1 ATGGTGTTGC CTTTGATGTT GTTGGCGACA ATCAGGTCGG CTACACTGAC
 51 GTTGTAGCGT TTGGCAATGT TGAACAGGGT GTCGCCTTCT ACAACGCGGT
101 GGATGCTGGC ATGGAGCGGG GAGATTTCGG CTTCGCCGTC GGCAGCTTTG
151 GCTACGCGCG TTTCCAAACG TACCCGGCGT TTGCCGTCGG CGGCAACGGT
201 ATGTTGCGGA GATGAGGAAA TGTTGTGTTC GGCAACTGTG TCAGGCGTGC
251 CGATGACGGC AGAGATGGTT TCTTCAGCCT GTCGGCGCAG GTTGTTTCGG
301 GCAACAAGCT GCATGAGTTC GTCTGCCGCC TGCATGTCGT TTTGGGGGAC
351 GATCTGCGCG AGTGTTGCGG TTTGGGTTTC AGACGGCATG GCGGTCTGTT
401 TTTCGGTTTG A
```

This corresponds to the amino acid sequence <SEQ ID 2068; ORF 643.a>:

a643.pep

```
  1 MVLPLMLLAT IRSATLTL*R LAMLNRVSPS TTRWMLAWSG EISASPSAAL
 51 ATRVSKRTRR LPSAATVCCG DEEMLCSATV SGVPMTAEMV SSACRRRLFR
101 ATSCMSSSAA CMSFWGTICA SVAVWVSDGM AVCFSV*
```

m643/a643 97.1% identity in 136 aa overlap

```
               10        20        30        40        50        60
m643.pep  MVLPLMLLATIRSATLTLXRLAMLNRVSPSTTRWMLAWSGEISASPSAALATRVSKRTRR
          ||||||||||||||||||||||||||||||||||||||||||||||||||||||||||||
a643      MVLPLMLLATIRSATLTLXRLAMLNRVSPSTTRWMLAWSGEISASPSAALATRVSKRTRR
               10        20        30        40        50        60

               70        80        90       100       110       120
m643.pep  LPSAAAVCCGDAEILCSATVSGVPMTAEMVSSACRRRLFRATSCMSSSAACMSFWGMICA
          |||||:||||| |:||||||||||||||||||||||||||||||||||||||||| |||
a643      LPSAATVCCGDEEMLCSATVSGVPMTAEMVSSACRRRLFRATSCMSSSAACMSFWGTICA
               70        80        90       100       110       120

              130
m643.pep  SVAVWVSDGMAVCFSVX
          ||||||||||||||||
a643      SVAVWVSDGMAVCFSVX
              130
```

The following partial DNA sequence was identified in *N. gonorrhoeae* <SEQ ID 2069>:

<u>g644.seq</u>

```
   1 ATGCCGTCTG AAAGGccgGC GGATTGTTGC CCGGTGCACT TTGTGGTAAA
  51 GTTTAGAAAA TTAACTCTAA ACTGTGGCAG GCGGTTTGAC CGGCCGCCGA
 101 TTAATGGGAA CCGACAGAGG AAGCCGATGA TACACACCGA ACCGAGCGCG
 151 CAGCCGTCAA CCATGGACAC GGCTGCTTTT TTAAagcaca tcgaatCCGC
 201 ATTcCCCCGC ATTTTTTCAG ACGGCATCGA CCTGATGCGA TACCTGCCCG
 251 AAGACAAATG GCTTGCCTTG AAGCAGGCGG GTTTGCTGTT GCCCTTCCTC
 301 GACAAAAAAC ACGGCGGGCG CAAGGGCAGT CAGTTTGAAA TCCAAGAAGT
 351 CCTAAGGATT GCGGGGCATT ACGGCGTGCC CGTTACGCTG CGTACCGGCA
 401 TCGAAGGCGC GCTGGTGTTG CAGCCTCTGC AAGagttcgg cggcgaagcG
 451 CAAGTCGCAC AAGGTTTGGA CATGATTTTC AAaggcgaaa gccgccgttt
 501 gggcgTtacc gaacccgaAa cctccggcgc gGcgaTTGCA CGCGAAAtgc
 551 agtcctgcta cgaatatacc gacgaacaAA CCATTTACGT caaCGCCGCG
 601 AAATACTGGC AGGGCAATTC GCAAAGCGAC TTCCTcctcg ttgccgccaa
 651 agagcgcaaa aacGGcaaac tcgccaaagt CATCGACCTG CTGCTCGTCC
 701 CCAAAACATA CATCCGCTGC GAAACCCTCG CATCCGAAGG CCTGCGCGCC
 751 GTCCGTTACG CCGTCAACCG CATCGATGCC GAAATGCCTG CAACCGCCGT
 801 GATGAAACTC TCCCGGGGCG ACGCTGCCGG TTTGCGCGCG TTCCAAAACA
 851 TCTTTATCCG CAGCCGCCTG CAACTGATCG GCATGACGCA CGGCATTATG
 901 GAATACATCC TTGACAACCT GAACCGATAT GTCCGCAACG ATATCAGATT
 951 CGTCGATTAC GAACGCCGCG AAATCCAACG CCGCCATCAG GTTTCCGAAA
1001 TCCTTTACCG CTACGTCTGC CATTCCGTTT CGcccgtcgC GCccgTCGCC
1051 CATCAATTGA TGGAGGCGAA catcgTCAAA ACcctCGCCA CGGAATACAC
1101 TTAcgcCGCC GCGCAAATGT TGCAAAAACT CTTGGGCGCG AAGGGTTTTG
1151 AACGCGGACA CCCAGCCGGC AATATCGCCA TCGATATCCG CCCCTTCACG
1201 ATTTTTGAAG GCCCGAACGA TATGCTTTAT GCCGAAATTT ACGACCAGTT
1251 CGTCCGCGCC ACCGCCGAAG AAAAAGAAGC AGGCATTAAG TTGGACAAAA
1301 accaaaCCCT Gctcgacgcc gtgCAAaccg atGTCcgctt tgCCGCCGTT
1351 GCCcgcGacT ACGCTTTGCC CGAAGACATC CGCAGCTTCC TGCAGGAACA
```

-continued

```
1401 CACCCTGACC GACGCCTGCG CCCTGCAAAA AGTCTTCATC GGCAAAATCA

1451 TCGCCCGACT TTTTGTCTTC GTACAGGAGG AACACGAAGA CACCACAGCC

1501 TTCCTGCTGA ACGACATCCG CAAAGATATA TTGGACTGCC GATATTGCGG

1551 ATAG
```

This corresponds to the amino acid sequence <SEQ ID 2070; ORF 644.ng>:

g644.pep

```
  1 MPSERPADCC PVHFVVKFRK LTLNCGRRFD RPPINGNRQR KPMIHTEPSA

 51 QPSTMDTAAF LKHIESAFPR IFSDGIDLMR YLPEDKWLAL KQAGLLLPFL

101 DKKHGGRKGS QFEIQEVLRI AGHYGVPVTL RTGIEGALVL QPLQEFGGEA

151 QVAQGLDMIF KGESRRLGVT EPETSGAAIA REMQSCYEYT DEQTIYVNAA

201 KYWQGNSQSD FLLVAAKERK NGKLAKVIDL LLVPKTYIRC ETLASEGLRA

251 VRYAVNRIDA EMPATAVMKL SRGDAAGLRA FQNIFIRSRL QLIGMTHGIM

301 EYILDNLNRY VRNDIRFVDY ERREIQRRHQ VSEILYRYVC HSVSPVAPVA

351 HQLMEANIVK TLATEYTYAA AQMLQKLLGA KGFERGHPAG NIAIDIRPFT

401 IFEGPNDMLY AEIYDQFVRA TAEEKEAGIK LDKNQTLLDA VQTDVRFAAV

451 ARDYALPEDI RSFLQEHTLT DACALQKVFI GKIIARLFVF VQEEHEDTTA

501 FLLNDIRKDI LDCRYCG*
```

The following partial DNA sequence was identified in *N. meningitidis* <SEQ ID 2071>:

m644.seq

```
  1 ATGCCGTCTG AAAGGTCGGC GGATTGTTGC CCGGCGCACT TTGTGGTAAA

 51 GTTTAGAAAA TCAACTCTAA ACTGTGGCAG GCGGTTTGAC CGGCCGCCGA

101 TTAATGGGAA CCGACAGAGG AAGCCGATGA TACACACCGA ACCGAGCGCG

151 CAGCCGTCAA CTATGGACAC GGCTGCTTTT TTAAAGCACA TCGAATCCGC

201 ATTCCGCCGC ATTTTTTCAG ACGGTATCGA CCTGATGCGA TACCTGCCCG

251 AAGACAAATG GCTTGCCTTG AAGCAGGCGG GTTTGCTGTT GCCCTTCCTC

301 GACAAAAAAT ACGGCGGGCG CAAGGGCAGC CAGTTTGAAA TCCAAGAAGT

351 CcTGCGGATT GCGGGGCATT ACGGCGTGCC CGTTACGCTG CGTACCGGCA

401 TCGAAGGCGC GCTGGTGTTG CAGCCACTGC AAGAGTTCGG CGATGAAGCG

451 CAAGTCGCGC AAGGTTTGGA GATGATTTTC AAAGGCGAGG GCGGCGGTTT

501 GGGTGTTACC GAACCCGAAA CCTCCGGCGC GGCGATTGCA CGCGAAATGC

551 AGTCCTACTA CGAATATATC GACGGACAAA CCATTTACGT CAACGCCGCG

601 AAATACTGGC AGGGCAACTC GCAAAGCGAC TTCCTCCTCG TTGCCGCCAA

651 AGAGCGCAAA AACGGCAAAC TCGCCAAAGT CATCGACCTG CTGCTCGTCC

701 CCAAAACATA CATCCGCTGC GAAACCCTCG CATCCGAAGG CTTGCGCGCC

751 GTCCGTTACG CCGTCAACCG CATCGATGCC GAAATGCCTG CAACCGCCGT
```

-continued

```
 801 GATGAAACTC TCCCAGAGCG ACGCTGCCGG TTTGCGCGCG TTCCAAAACA

 851 TCTTTATCCG CAGCCGCCTG CAACTGATCG GCATGACGCA CGGCATTATG

 901 GAATACATCC TTGAAAATCT GGAACGATAC GTCCGCAACG ACATCAAATT

 951 CGTCGATTAC GAACGCCGCG AAATCCGGCG CCGCCATCAG GTTTCCGAGA

1001 TTCTTTACCG CTACGTCTGC CATTCCGTTT CGCCTGTTGC CCCCGTCGCC

1051 CATCAGCTGA TGGAGGCGAA CATCGTCAAA ACCCTCGCCA CGGAATACAC

1101 TTACGCCGCC GCGCAAATGT TGCAAAAACT CTTGGGTGCG AAGGGTTTTG

1151 AACGCGGACA CACCGCCGGC AATATCGCTA TCGACATCCG CCCCTTCACG

1201 ATTTTTGAAG GCCCGAACGA TATGCTTTAT GCCGAAATTT ACGACCAGTT

1251 TGTCCGCGCC ACCGCCGAAG AAAAAGAAGC AGGCATGAAG TTGGACAAAA

1301 ACCAAACCCT GCTCGACCGC CTGCAAACCG ATGCCCGCTT TGCCGCCGTC

1351 GCCCGCGACT ACACTTTGCC TGAAGACATC CGCAGCTTCC TGCAGGAACA

1401 CACCCTGACC GATGCCTGCG CCCTGCAAAA AGTCTTTATC GGCAAAATCA

1451 TCGCCCGACT CTTTGTCTTC GTACAGGCGA AACACGAAGA CACCGCAGCC

1501 TTCCTGCTGA ACGACATCCG CAAAGATATA TTGGACTGCC GATATTGCGG

1551 GTAG
```

This corresponds to the amino acid sequence <SEQ ID 2072; ORF 644>:

m644.pep

```
  1 MPSERSADCC PAHFVVKFRK STLNCGRRFD RPPINGNRQR KPMIHTEPSA

 51 QPSTMDTAAF LKHIESAFRR IFSDGIDLMR YLPEDKWLAL KQAGLLLPFL

101 DKKYGGRKGS QFEIQEVLRI AGHYGVPVTL RTGIEGALVL QPLQEFGDEA

151 QVAQGLEMIF KGEGGGLGVT EPETSGAAIA REMQSYYEYI DGQTIYVNAA

201 KYWQGNSQSD FLLVAAKERK NGKLAKVIDL LLVPKTYIRC ETLASEGLRA

251 VRYAVNRIDA EMPATAVMKL SQSDAAGLRA FQNIFIRSRL QLIGMTHGIM

301 EYILENLERY VRNDIKFVDY ERREIRRRHQ VSEILYRYVC HSVSPVAPVA

351 HQLMEANIVK TLATEYTYAA AQMLQKLLGA KGFERGHTAG NIAIDIRPFT

401 IFEGPNDMLY AEIYDQFVRA TAEEKEAGMK LDKNQTLLDR LQTDARFAAV

451 ARDYTLPEDI RSFLQEHTLT DACALQKVFI GKIIARLFVF VQAKHEDTAA

501 FLLNDIRKDI LDCRYCG*
```

m644/g644 94.61 identity in 517 aa overlap

```
                   10        20        30        40        50        60
m644.pep   MPSERSADCCPAHFVVKFRKSTLNCGRRFDRPPINGNRQRKPMIHTEPSAQPSTMDTAAF
           ||||| |||||:||||||||| ||||||||||||||||||||||||||||||||||||||
g644       MPSERPADCCPVHFVVKFRKLTLNCGRRFDRPPINGNRQRKPMIHTEPSAQPSTMDTAAF
                   10        20        30        40        50        60

                   70        80        90       100       110       120
m644.pep   LKHIESAFRRIFSDGIDLMRYLPEDKWLALKQAGLLLPFLDKKYGGRKGSQFEIQEVLRI
           |||||||| |||||||||||||||||||||||||||||||||:|||||||||||||||||
g644       LKHIESAFPRIFSDGIDLMRYLPEDKWLALKQAGLLLPFLDKKHGGRKGSQFEIQEVLRI
                   70        80        90       100       110       120
```

-continued

```
                130       140       150       160       170       180
m644.pep  AGHYGVPVTLRTGIEGALVLQPLQEFGDEAQVAQGLEMIFKGEGGGLGVTEPETSGAAIA
          ||||||||||||||||||||||||||| ||||||||:||||||:  ||||||||||||||
g644      AGHYGVPVTLRTGIEGALVLQPLQEFGGEAQVAQGLDMIFKGESRRLGVTEPETSGAAIA
                130       140       150       160       170       180

                190       200       210       220       230       240
m644.pep  REMQSYYEYIDGQTIYVNAAKYWQGNSQSDFLLVAAKERKNGKLAKVIDLLLVPKTYIRC
          ||||| ||| ||||||||||||||||||||||||||||||||||||||||||||||||||
g644      REMQSCYEYTDGQTIYVNAAKYWQGNSQSDFLLVAAKERKNGKLAKVIDLLLVPKTYIRC
                190       200       210       220       230       240

                250       260       270       280       290       300
m644.pep  ETLASEGLRAVRYAVNRIDAEMPATAVMKLSQSDAAGLRAFQNIFIRSRLQLIGMTHGIM
          |||||||||||||||||||||||||||||||::|||||||||||||||||||||||||||
g644      ETLASEGLRAVRYAVNRIDAEMPATAVMKLSRGDAAGLRAFQNIFIRSRLQLIGMTHGIM
                250       260       270       280       290       300

                310       320       330       340       350       360
m644.pep  EYILENLERYVRNDIKFVDYERREIRRRHQVSEILYRYVCHSVSPVSPVSHQLMEANINK
          ||||:||:|||||||:|||||||||:||||||||||||||||||||||||||||||||||
g644      EYILDNLNRYVRNDIRFVDYERREIQRRHQVSEILYRYVCHSVSPVSPVSHQLMEANINK
                310       320       330       340       350       360

                370       380       390       400       410       420
m644.pep  TLATEYTYAAAQMLQKLLGAKGFERGHTAGNIAIDIRPFTIFEGPNDMLYAEIYDQFVRA
          ||||||||||||||||||||||||||| ||||||||||||||||||||||||||||||||
g644      TLATEYTYAAAQMLQKLLGAKGFERGHPAGNIAIDIRPFTIFEGPNDMLYAEIYDQFVRA
                370       380       390       400       410       420

                430       440       450       460       470       480
m644.pep  TAEEKEAGMKLDKNQTLLDRLQTDARFAAVARDYTLPEDIRSFLQEHTLTDACALQKVFI
          ||||||||:|||||||||| :|||:|||||||||:|||||||||||||||||||||||||
a644      TAEEKEAGIKLDKNQTLLDAVQTDVRFAAVARDYALPEDIRSFLQEHTLTDACALQKVFI
                430       440       450       460       470       480

                490       500       510
m644.pep  GKIIARLFVFVQAKHEDTAAFLLNDIRKDILDCRYCGX
          |||||||||||| :||||:|||||||||||||||||||
g644      GKIIARLFVFVQEEHEDTTAFLLNDIRKDILDCRYCGX
                490       500       510
```

The following partial DNA sequence was identified in *N. meningitidis* <SEQ ID 2073>:

a644.seq

```
  1 ATGCCGTCTG AAAGGTCGGC GGATTGTTGC CCGGCGCACT TTGTGGTAAA
 51 GTTTAGAAAA TCAACTCTAA ACTGTGGCAG GCGGTTTGAC CGGCCGCCGA
101 TTAATGGGAA CCGACAGAGG AAGCCGATGA TACACACCGA ACCGAGCGCG
151 CAGCCGTCAA CTATGGACAC GGCTGCTTTT TTAAAGCACA TCGAATCCGC
201 ATTCCGCCGC ATTTTTGCAG ACGGTATCGA CCTGATGCGA TACCTGCCCG
251 AAGACAAATG GCTTGCCTTG AAGCAGGCGG GTTTGCTGTT GCCCTTCCTC
301 GACAAAAAAT ACGGCGGGCG CAAGGGCAGC CAGTTTGAAA TTCAGGAAGT
351 CTTGCGGATT GCGGGGCATT ACGGCGTGCC CGTTANNNNN NNNNNNNNNN
401 NNGAAGGCGC GCTGGTGTTG CAGCCACTGC AAGAGTTCGG CGATGAAGCG
451 CAAATCGCAC AGGGTTTGGA CATGGTTTTC AAAGGCGAGG GCGGCGGTTT
501 AGGCGTTACC GAACCCGAAA CCTCCGGCGC GGCGATTGCC CGAGAAATGC
551 AGTCTTACTA CGAATATACC GACGGACAAA CCATTTACGT CAACGCCGCG
601 AAATACTGGC AGGGCAACTC GCAAAGCGAC TTCCTCCTCG TTGCCGCCAA
651 AGAGCGCAAA AACGGCAAAC TCGCCAAAGT CATCGACCTG CTGCTCGTCC
701 CCAAAACATA CATCCGCTGC GAAACCCTCG CATCCGAAGG CTTGCGCGCC
705 GTCCGTTACG CCGTCAACCG CATCGATGCC GAAATGCCTG CAACCGCCGT
801 GATGAAACTC TCCCAGAGCG ACGCTGCCGG TTTGCGCGCG TTCCAAAACA
851 TCTTTATCCG CAGCCGCCTG CAACTGATCG GCATGACGCA CGGCATTATG
```

-continued

```
 901 GAATACACCC TTGAAAACCT GGAACGATAC GTCCGCAACG ACATCAGATT

 951 CGTCGATTAC GAACGCCGCG AAATCCGGCG CCGCCATCAG GTTTCCGAGA

1001 TTCTTTACCG CTACGTCTGC CATTCCGTTT CGCCCGTTGC ACCCGTCGCC

1051 CATCAACTGA TGGAGGCGAA CATCGTCAAA ACCCTCGCCA CGGAATACAC

1101 TTACGCCGCC GCGCAAATGT TGCAAAAACT CTTGGGCGCG AAGGGTTTTG

1151 AACGCGGACA CACCGCCGGC AATATCGCTA TCGACATCCG CCCCTTCACG

1201 ATTTTTGAAG GCCCGAACGA TATGCTTTAT GCCGAAATTT ACGACCAGTT

1251 TGTCCGCGCC ACCGCCGAAG AAAAAGAAGC AGGCATGAAG TTGGACAAAA

1301 ACCAAACCCT GCTCGACCGC CTGCAAACCG ATGCCCGCTT TGCCGCCGTC

1351 GCCCGCGACT ACACTTTGCC CGAAGACATC CGCAGCTTCC TGCAGGAACA

1401 CACCCTGACC GATGCCTGCG CCCTGCAAAA AGTCTTTATC GGCAAAATCA

1451 TCGCCCGACT CTTTGTCTTC GTACAGGCGG AACACGAAGA CACCGCAGCC

1501 TTCCTGCTGA ACGACATCCG CAAAGACATA TTGGACTGCC GATATTGCGG

1551 ATAG
```

This corresponds to the amino acid sequence <SEQ ID 2074; ORF 644.a>:

a644.pep

```
  1 MPSERSADCC PAHFVVKFRK STLNCGRRFD RPPINGNRQR KPMIHTEPSA

 51 QPSTMDTAAF LKHIESAFRR IFADGIDLMR YLPEDKWLAL KQAGLLLPFL

101 DKKYGGRKGS QFEIQEVLRI AGHYGVPVXX XXXXEGALVL QPLQEFGDEA

151 QIAQGLDMVF KGEGGGLGVT EPETSGAAIA REMQSYYEYT DGQTIYVNAA

201 KYWQGNSQSD FLLVAAKERK NGKLAKVIDL LLVPKTYIRC ETLASEGLRA

251 VRYAVNRIDA EMPATAVMKL SQSDAAGLRA FQNIFIRSRL QLIGMTHGIM

301 EYTLENLERY VRNDIRFVDY ERREIRRRHQ VSEILYRYVC HSVSPVAPVA

351 HQLMEANIVK TLATEYTYAA AQMLQKLLGA KGFERGHTAG NIAIDIRPFT

401 IFEGPNDMLY AEIYDQFVRA TAEEKEAGMK LDKNQTLLDR LQTDARFAAV

451 ARDYTLPEDI RSFLQEHTLT DACALQKVFI GKIIARLFVF VQAEHEDTAA

501 FLLNDIRKDI LDCRYCG*
```

m644/a644 97.3% identity in 517 aa overlap

```
                    10        20        30        40        50        60
m644.pep    MPSERSADCCPAHFVVKFRKSTLNCGRRFDRPPINGNRQRKPMIHTEPSAQPSTMDTAAF
            ||||||||||||||||||||||||||||||||||||||||||||||||||||||||||||
a644        MPSERSADCCPAHFVVKFRKSTLNCGRRFDRPPINGNRQRKPMIHTEPSAQPSTMDTAAF
                    10        20        30        40        50        60

                    70        80        90       100       110       120
m644.pep    LKHIESAFRRIFSDGIDLMRYLPEDKWLALKQAGLLLPFLDKKYGGRKGSQFEIQEVLRI
            ||||||||||||:|||||||||||||||||||||||||||||||||||||||||||||||
a644        LKHIESAFRRIFADGIDLMRYLPEDKWLALKQAGLLLPFLDKKYGGRKGSQFEIQEVLRI
                    70        80        90       100       110       120

                   130       140       150       160       170       180
m644.pep    AGHYGVPVTLRTGIEGALVLQPLQEFGDEAQVAQGLEMIFKGEGGGLGVTEPETSGAAIA
            ||||||||:  :  |||||||||||||||||:||||:|:|||||||||||||||||||||
a644        AGHYGVPVXXXXXXEGALVLQPLQEFGDEAQIAQGLDMVFKGEGGGLGVTEPETSGAAIA
                   130       140       150       160       170       180
```

-continued

```
                190         200         210         220         230         240
m644.pep  REMQSYYEYIDGQTIYVNAAKYWQGNSQSDFLLVAAKERKNGKLAKVIDLLLVPKTYIRC
          ||||||||| ||||||||||||||||||||||||||||||||||||||||||||||||||
a644      REMQSYYEYTDGQTIYVNAAKYWQGNSQSDFLLVAAKERKNGKLAKVIDLLLVPKTYIRC
                190         200         210         220         230         240

                250         260         270         280         290         300
m644.pep  ETLASEGLRAVRYAVNRIDAEMPATAVMKLSQSDAAGLRAFQNIFIRSRLQLIGMTHGIM
          ||||||||||||||||||||||||||||||||||||||||||||||||||||||||||||
a644      ETLASEGLRAVRYAVNRIDAEMPATAVMKLSQSDAAGLRAFQNIFIRSRLQLIGMTHGIM
                250         260         270         280         290         300

                310         320         330         340         350         360
m644.pep  EYILENLERYVRNDIKFVDYERREIRRRHQVSEILYRYVCHSVSPVSPVSHQLMEANINK
          || ||||||||||||:||||||||||||||||||||||||||||||||||||||||||||
a644      EYTLENLERYVRNDIRFVDYERREIRRRHQVSEILYRYVCHSVSPVSPVSHQLMEANINK
                310         320         330         340         350         360

                370         380         390         400         410         420
m644.pep  TLATEYTYAAAQMLQKLLGAKGFERGHTAGNIAIDIRPFTIFEGPNDMLYAEIYDQFVRA
          ||||||||||||||||||||||||||||||||||||||||||||||||||||||||||||
a644      TLATEYTYAAAQMLQKLLGAKGFERGHTAGNIAIDIRPFTIFEGPNDMLYAEIYDQFVRA
                370         380         390         400         410         420

                430         440         450         460         470         480
m644.pep  TAEEKEAGMKLDKNQTLLDRLQTDARFAAVARDYTLPEDIRSFLQEHTLTDACALQKVFI
          ||||||||||||||||||||||||||||||||||||||||||||||||||||||||||||
a644      TAEEKEAGMKLDKNQTLLDRLQTDARFAAVARDYTLPEDIRSFLQEHTLTDACALQKVFI
                430         440         450         460         470         480

                490         500         510
m644.pep  GKIIARLFVFVQAKHEDTAAFLLNDIRKDILDCRYCGX
          |||||||||||||:||||||||||||||||||||||||
a644      GKIIARLFVFVQAEHEDTAAFLLNDIRKDILDCRYCGX
                490         500         510
```

The following partial DNA sequence was identified in *N. gonorrhoeae* <SEQ ID 2075>:

g645.seq

```
  1 ATGATGATGG TGTTGGCGTT GGGGATGTCG ATGCCGGTTT CGATGATGGT
 51 GGAACAGAGC AACACATTGA ATCTTTGCTG CAAAAAGTCG CGCATGACTT
101 GTTCCAGCTC GCGCTCACGC AGTTGTCCGT GCGCCACGCC GATACGGGCT
151 TCGGGCAGCA GGGTTTCCAG CCGCTCGCGC ATATTCTCAA TCGTATCTAC
201 TTCATTGTGC AGGAAAAata cCTGTCCTCC GCGTTTGAGT TCGCGCAACA
251 CGGCTTCGCG CACGCTGCCT TCGCTGAACG GTTTGACAAA GGTTTTCACG
301 GCGAGGCGGC GGCTCGGTGC AGTGGTAATC AGCGAGAAGT CGCGCAGACC
351 TTCGAGCGCC ATGCTGAGGG TGCGCGGAAT CGGCGTGGCG GTCATGGTTA
401 GGATGTCGAC ATTGGCGCGC AGGCGTTTGA GCTGCTCTTT CTGTCGCACG
451 CCGAAGCGGT GTTCTTCATC GATAATCAAT AAACCTAAGT TTTTGAATTT
501 TATGTCGTCC TGCACCAATT TGTGCGTACC GATAACGATA TCGACAGTAC
551 CGTCCGCCAT GCCTTCGAGC GTGGCTTTGG TGGCTTTGCT GTTGTTGAAA
601 CGCGAAAGGC TGGCGACTTT CACGGGGAAA TCGGCGAAAC GGTCGGCGAA
651 GTTTTGCGCG TGCTGCTCGA CCAGAAGCGT GGTCGGGGCG AGTACGGCGA
701 CCTGTTTGCC GCCCATCACC GCCACAAACG CGGCGCGAAG GGCGACTTCG
751 GTTTTGCCGA AACCGACATC GCCGCACACA AGTCGGTCCA TCGGCTTCGC
801 CTGCGTCAAA TCTTTAATCA CGGcggcgat ggcggcggcC TGGTCTTCGG
851 TTTCCTCGTA G
```

This corresponds to the amino acid sequence <SEQ ID 2076; ORF 645.ng>:

g645.pep

```
  1 MMMVLALGMS MPVSMMVEQS NTLNLCCKKS RMTCSSSRSR SCPCATPIRA
 51 SGSRVSSRSR IFSIVSTSLC RKNTCPPRLS SRNTASRTLP SLNGLTKVFT
101 ARRRLGAVVI SEKSRRPSSA MLRVRGIGVA VMVRMSTLAR RRLSCSFCRT
151 PKRCSSSIIN KPKFLNFMSS CTNLCVPITI STVPSAMPSS VALVALLLLK
201 RERLATFTGK SAKRSAKFCA CCSTRSVVGA STATCLPPIT ATNAARRATS
251 VLPKPTSPHT SRSIGFACVK SLITAAMAAA WSSVSS*
```

The following partial DNA sequence was identified in *N. meningitidis* <SEQ ID 2077>:

m645.seq

```
  1 ATGATGATGG TGTTGGCGTT GGGGATATCG ATACCGGTTT CGATGATGGT
 51 GGAACAGAGC AACACGTTAA ATCGTTGCTG CAAAAAGTCG CGCATGACTT
101 GTTCCAGCTC GCGCTCGCGC AGTTGTCCGT GCGCCACGCC GATGCGGGCT
151 TCGGGCAGCA GGGTTTCCAG CCGCTCGCGC ATATTTTCAA TCGTATCTAC
201 TTCATTGTGC AGGAAAAATA CCTGTCCTCC GCGTTTGAGT TCGCGCAACA
251 CGGCTTCGCG CACGCTGCCT TCGCTAAAGG GTTTGACAAA GGTTTTGACG
301 GCGAGGCGGC GGCTGGGCGC GGTGGTAATC AGCGAGAAGT CGCGCAGTCC
351 TTCCAACGCC ATACTTAAAG TACGCGGAAT CGGCGTGGCG GTCATGGTAA
401 GGATATCAAC ATTGGCGCGC AGGCGTTTGA GCTGCTCTTT CTGACGCACG
451 CCGAAGCGGT GTTCTTCGTC GATAATCACT AAACCTAAGT TTTTGAATTT
501 GATGTCGTCC TGCACCAGTT TGTGCGTACC GATAACAATA TCGACCGTGC
551 CGTCTGCCAT GCCTTCCAGC GCGGCTTTGG TGGCTTTGCT GTTGTTGAAA
601 CGCGAAAGGC TGGCGACTTT CACGGGGAAA TCGGCGAAAC GGTCGGCGAA
651 GTTTTGCGCG TGCTGCTCGA CCAAAAGCGT GGTCGGAGCA AGTACGGCGA
701 CCTGTTTGCC GCCCATCACC GCCACAAACG CGGCGCGCAG GGCGACTTCG
751 GTTTTGCCGA AGCCGACATC GCCGCACACA AGGCGATCCA TCGGCTTCGC
801 TTGCGTCAAA TCTTTAATCA CGGCGGCGAT GGCGGCGGCC TGGTCTTCGG
851 TTTCCTCGTA G
```

This corresponds to the amino acid sequence <SEQ ID 2078; ORF 645>:

m645.pep

```
  1 MMMVLALGIS IPVSMMVEQS NTLNRCCKKS RMTCSSSRSR SCPCATPMRA
 51 SGSRVSSRSR IFSIVSTSLC RKNTCPPRLS SRNTASRTLP SLKGLTKVLT
101 ARRRLGAVVI SEKSRSPSNA ILKVRGIGVA VMVRISTLAR RRLSCSF*RT
151 PKRCSSSIIT KPKFLNLMSS CTSLCVPITI STVPSAMPSS AALVALLLLK
201 RERLATFTGK SAKRSAKFCA CCSTKSVVGA STATCLPPIT ATNAARRATS
251 VLPKPTSPHT RRSIGFACVK SLITAAMAAA WSSVSS*
```

m645/g645 93.7% identity in 286 aa overlap

```
                   10        20        30        40        50        60
m645.pep   MMMVLALGISIPVSMMVEQSNTLNRCCKKSRMTCSSSRSRSCPCATPMRASGSRVSSRSR
           ||||||||:|:|||||||||||||| |||||||||||||||||||||||:|||||||||||
g645       MMMVLALGMSMPVSMMVEQSNTLNLCCKKSRMTCSSSRSRSCPCATPIRASGSRVSSRSR
                   10        20        30        40        50        60

                   70        80        90       100       110       120
m645.pep   IFSIVSTSLCRKNTCPPRLSSRNTASRTLPSLKGLTKVLTARRRLGAVVISEKSRSPSNA
           ||||||||||||||||||||||||||||||||:|||||:|||||||||||||||| ||:|
g645       IFSIVSTSLCRKNTCPPRLSSRNTASRTLPSLNGLTKVFTARRRLGAVVISEKSRRPSSA
                   70        80        90       100       110       120

                  130       140       150       160       170       180
m645.pep   ILKVRGIGVAVMVRISTLARRRLSCSFXRTPKRCSSSIITKPKFLNLMSSCTSLCVPITI
           :|:|||||||||||:|||||||||||| |||||||||||:||||||:|||||:|||||||
g645       MLRVRGIGVAVMVRMSTLARRRLSCSFCRTPKRCSSSIINKPKFLNFMSSCTNLCVPITI
                  130       140       150       160       170       180

                  190       200       210       220       230       240
m645.pep   STVPSAMPSSAALVALLLLKRERLATFTGKSAKRSAKFCACCSTKSVVGASTATCLPPIT
           ||||||||||:|||||||||||||||||||||||||||||||||:|||||||||||||||
g645       STVPSAMPSSVALVALLLLKRERLATFTGKSAKRSAKFCACCSTRSVVGASTATCLPPIT
                  190       200       210       220       230       240

                  250       260       270       280
m645.pep   ATNAARRATSVLPKPTSPHTRRSIGFACVKSLITAAMAAAWSSVSSX
           |||||||||||||||||||| ||||||||||||||||||||||||||
g645       ATNAARRATSVLPKPTSPHTSRSIGFACVKSLITAAMAAAWSSVSSX
                  250       260       270       280
```

The following partial DNA sequence was identified in *N. meningitidis* <SEQ ID 2079>:

a645.seq

```
  1 ATGATGATGG TGTTGGCGTT GGGAATGTCG ATACCGGTTT CGATGATGGT
 51 GGAACAGAGC AACACGTTAA ATCGTTGCTG CAAAAAGTCG CGCATGACTT
101 GTTCCAGCTC GCGCTCGCGC AGTTGTCCGT GCGCCACGCC GATGCGGGCT
151 TCGGGCAGCA GGGTTTCCAG CCGCTCACGC ATGTTTTCGA TGGTATCCAC
201 TTCATTGTGC AGGAAAAATA CTTGCCCGCC GCGTTTGAGT TCGCGCAATA
251 CGGCTTCGCG CACGCTGCCT TCGCTGAACG GTTTGACAAA GGTTTTGACG
301 GCGAGGCGGC GGCTGGGCGC AGTGGTAATC AGCGAGAAGT CGCGCAGTCC
351 TTCCAGCGCC ATACTTAAAG TACGCGGAAT CGGCGTAGCG GTCATGGTAA
401 GGATGTCGAC ATTGGCGCGC AGGCGTTTGA GCTGCTCTTT CTGACGCACG
451 CCGAAGCGGT GTTCTTCGTC GATAATCACT AAACCTACGT TTTTGAATTT
501 TATGTCGTCC TGCACCAGTT TGTGCGTACC GATAACAATA TCGACCGTGC
551 CGTCCGCCAT GCCTTCCAGC GCGGCTTTGG TGGCTTTGCT GTTGTTGAAA
601 CGCGAAAGGC TGGCGACTTT CACGGGGAAA TCGGCGAAGC GGTCGGCAAA
651 ATTTTGCGCG TGCTGCTCGA CCAGAAGCGT GGTCGGTGCG AGTACGGCAA
701 CTTGTTTGCC ACCCATTACC GCCACAAACG CGGCGCGCAG GGCGACTTCG
751 GTTTTGCCGA AACCGACATC GCCGCACACG AGGCGGTCCA TCGGCTTCGC
801 CTGCGTCAAA TCTTTAATCA CGGCGGCGAT GGCGGCTGCC TGGTCTTCGG
851 TTTCTTCGTA G
```

This corresponds to the amino acid sequence <SEQ ID 2080; ORF 645.a>:

a645.pep

```
  1 MMMVLALGMS IPVSMMVEQS NTLNRCCKKS RMTCSSSRSR SCPCATPMRA
 51 SGSRVSSRSR MFSMVSTSLC RKNTCPPRLS SRNTASRTLP SLNGLTKVLT
```

-continued

```
101 ARRRLGAVVI SEKSRSPSSA ILKVRGIGVA VMVRMSTLAR RRLSCSF*RT

151 PKRCSSSIIT KPTFLNFMSS CTSLCVPITI STVPSAMPSS AALVALLLLK

201 RERLATFTGK SAKRSAKFCA CCSTRSVVGA STATCLPPIT ATNAARRATS

251 VLPKPTSPHT RRSIGFACVK SLITAAMAAA WSSVSS*
```

m645/a645 96.9% identity in 286 aa overlap

```
                   10        20        30        40        50        60
m645.pep   MMMVLALGISIPVSMMVEQSNTLNRCCKKSRMTCSSSRSRSCPCATPMRASGSRVSSRSR
           |||||||:||||||||||||||||||||||||||||||||||||||||||||||||||||
a645       MMMVLALGMSIPVSMMVEQSNTLNRCCKKSRMTCSSSRSRSCPCATPMRASGSRVSSRSR
                   10        20        30        40        50        60

                   70        80        90       100       110       120
m645.pep   IFSIVSTSLCRKNTCPPRLSSRNTASRTLPSLKGLTKVLTARRRLGAVVISEKSRSPSNA
           :||:||||||||||||||||||||||||||||:||||||||||||||||||||||||||:|
a645       MFSMVSTSLCRKNTCPPRLSSRNTASRTLPSLNGLTKVLTARRRLGAVVISEKSRSPSSA
                   70        80        90       100       110       120

                  130       140       150       160       170       180
m645.pep   ILKVRGIGVAVMVRISTLARRRLSCSFXRTPKRCSSSIITKPKFLNLMSSCTSLCVPITI
           ||||||||||||||:|||||||||||||||||||||||||||| |||:|||||||||||||
a645       ILKVRGIGVAVMVRMSTLARRRLSCSFXRTPKRCSSSIITKPTFLNFMSSCTSLCVPITI
                  130       140       150       160       170       180

                  190       200       210       220       230       240
m645.pep   STVPSAMPSSAALVALLLLKRERLATFTGKSAKRSAKFCACCSTKSVVGASTATCLPPIT
           ||||||||||||||||||||||||||||||||||||||||||||||:||||||||||||||
a645       STVPSAMPSSAALVALLLLKRERLATFTGKSAKRSAKFCACCSTRSVVGASTATCLPPIT
                  190       200       210       220       230       240

                  250       260       270       280
m645.pep   ATNAARRATSVLPKPTSPHTRRSIGFACVKSLITAAMAAAWSSVSSX
           |||||||||||||||||||||||||||||||||||||||||||||||
a645       ATNAARRATSVLPKPTSPHTRRSIGFACVKSLITAAMAAAWSSVSSX
                  250       260       270       280
```

The following partial DNA sequence was identified in *N. gonorrhoeae* <SEQ ID 2081>:

g647.seq

```
  1 ATGCAAAGGC TCGCCGCAGA CGGCATCCAA ATCTTTTTTG TAGGTGTCGA

 51 TGGGCAGTTT GCCTTGCGAA TAAACGGTTT GGTTAAAGAG CGTGCACGCT

101 CCGTATTCTT TGGCAAGGTT TGCCGATGCT TTGAGCAGGT AATACTGTAT

151 GGCTTCAAAG GTACGGTGGG TCAGACCGAG CGCGGAACCG TCGCTGTAGC

201 GGACACCGTT TTTCGCCAGA TAGTAGGCGT AGTTGATGAC ACCGATGCCG

251 AGCGAACGGC GGTCCATAGT AGAGGTACGC GCGGCTTCTA CCGGATATCC

301 CTGATAATCT AA
```

This corresponds to the amino acid sequence <SEQ ID 2082; ORF 647.ng>:

g647.pep

```
  1 MQRLAADGIQ IFFVGVDGQF ALRINGLVKE RARSVFFGKV CRCFEQVILY

 51 GFKGTVGQTE RGTVAVADTV FRQIVGVVDD TDAERTAVHS RGTRGFYRIS

101 LII*
```

The following partial DNA sequence was identified in *N. meningitidis* <SEQ ID 2083>:

m647.seq

```
  1 ATGCAAAGGC TCGCCGCAGA CGGCATCCAA ATCTTTTTTG TAAGTGTCGA
 51 TGGGCAGTTT GCCTTGCGAA TAAACGGTTT GGTTAAAGAG CGTGCACGCA
101 CCGTATTCTT TGGCAAGGTT TGCCGATGCT TTGAGCAGGT AATACTGTAT
151 GGCTTCAAAG GTACGGTGGG TCAGACCGAG CGCGGAACCG TCGCTGTAGC
201 GGACACCGTT TTTCGCCAGA TAATAAGCAT AGTTAATCAC GCCGATGCCG
251 AGCGAACGGC GGCCCATAGT AGAGGTACGC GCGGCTTCTA CCGGATATCC
301 CTGATAATCT AA
```

This corresponds to the amino acid sequence <SEQ ID 2084; ORF 647>:

m647.pep

```
  1 MQRLAADGIQ IFFVSVDGQF ALRINGLVKE RARTVFFGKV CRCFEQVILY
 51 GFKGTVGQTE RGTVAVADTV FRQIISIVNH ADAERTAAHS RGTRGFYRIS
101 LII*
```

m647/g647 91.3% identity in 103 aa overlap

```
                   10        20        30        40        50        60
m647.pep    MQRLAADGIQIFFVSVDGQFALRINGLVKERARTVFFGKVCRCFEQVILYGFKGTVGQTE
            ||||||||||||||:||||||||||||||||||:||||||||||||||||||||||||||
g647        MQRLAADGIQIFFVGVDGQFALRINGLVKERARSVFFGKVCRCFEQVILYGFKGTVGQTE
                   10        20        30        40        50        60

                   70        80        90       100
m647.pep    RGTVAVADTVFRQIISIVNHADAERTAAHSRGTRGFYRISLIIX
            ||||||||||||||:::|: :||||||:||||||||||||||||
g647        RGTVAVADTVFRQIVGVVDDTDAERTAVHSRGTRGFYRISLIIX
                   70        80        90       100
```

The following partial DNA sequence was identified in *N. meningitidis* <SEQ ID 2085>:

a647.seq

```
  1 GTGCAAAGGC TCGTTACACA CAGCGTCCAA GTCTTTTTTG TAGGTGTCGA
 51 TGGGCAGTTT GCCTTGCGAA TAAACGGTTT GGTTAAAGAG CGTGCACGCA
101 CCGTATTCTT TGGCAAGGTT TGCCGATGCT TTGAGCAGGT AATACTGTAT
151 GGCTTCAAAG GTACGGTGGG TCAGACCGAG CGCGGAGCCG TCGCTGTAGC
201 GGACACCGTT TTTCGCCAAA TAATACGCAT AGTTGATCAC GCCGATACCG
251 AGCGAACGGC GGCCCATAGT GGAGGTACGC GCGGCTTCTA CCGGATATCC
301 CTGATAATCT AA
```

This corresponds to the amino acid sequence <SEQ ID 2086; ORF 647.a>:

a647.pep

```
  1 VQRLVTHSVQ VFFVGVDGQF ALRINGLVKE RARTVFFGKV CRCFEQVILY
 51 GFKGTVGQTE RGAVAVADTV FRQIIRIVDH ADTERTAAHS GGTRGFYRIS
101 LII*
```

m647/a647 87.4% identity in 103 aa overlap

```
                   10        20        30        40        50        60
m647.pep   MQRLAADGIQIFFVSVDGQFALRINGLVKERARTVFFGKVCRCFEQVILYGFKGTVGQTE
           :|||:: ::|:|||:|||||||||||||||||||||||||||||||||||||||||||||
a647       VQRLVTHSVQVFFVGVDGQFALRINGLVKERARTVFFGKVCRCFEQVILYGFKGTVGQTE
                   10        20        30        40        50        60

                   70        80        90       100
m647.pep   RGTVAVADTVFRQIISIVNHADAERTAAHSRGTRGFYRISLIIX
           ||:|||||||||||| ||:|||:||||||| |||||||||||||
a647       RGAVAVADTVFRQIIRIVDHADTERTAAHSGGTRGFYRISLIIX
                   70        80        90       100
```

The following partial DNA sequence was identified in *N. gonorrhoeae* <SEQ ID 2087>:

<u>g648.seq</u>

```
  1 ATGAACAGGC GCAACGCGCG GATCGAACGG GCTGTGCGTA TTGCAGTGAT
 51 CGACGTTTTG AATGTAGATG CGCCCGGTCC CGGCACGCTC CTGCATCAGC
101 GTGGAAAACA GGTCGGCAGC CGGAATGATA CGCTTGCGTA TGTTCGGGTC
151 TTGCTCGTAT TTCGTATAGA GCCGCTCAAA TTCGTCTTGG TCGGCAAAAA
201 ACGCTTCGTA CAACCCCGAA ACCTCGTTGG GCGAAAACAG CGTAATGTTG
251 CCGCCCTTAA TCAGGCGGGT GTACAGCAGG CGGTTGATTT GCACGCCATA
301 ATCAAGCTGG CGGATACGGT TGTCTTCCAC GCCCCGGTTG TTTTTCAACA
351 CCAGCAGGCT TTCGGCTTCA ATATGCCACA AGGGGTAGAA CAAGGTTGCC
401 GCGCCGCCGC GCACGCCACC TTGCGAACAA GATTTGACCG CCGCCTGAAA
451 CATCTTAAAG AAGGGAATGC AGCCGGTATG CCGGGCTTCA CCGCCCCGGA
501 TTTCGCTGTC CAGCCCGCGG ATACGTCCGG CATTGATGCC GATGCCCGCG
551 CGTTGGGAAA CGTATTTCAC AATCGCGCTG GTAGTGGCAT TGATGGAATC
601 CAAACTATCG TCGCATTCAA TCAGCACACA GCTTGA
```

This corresponds to the amino acid sequence <SEQ ID 2088; ORF 648.ng>:

<u>g648.pep</u>

1 MNRRNARIER AVRIAVIDVL NVDAPGPGTL LHQRGKQVGS RNDTLAY<u>VRV</u>

51 <u>LLVFRIEPLK FVLV</u>GKKRFV QPRNLVGRKQ RNVAALNQAG VQQAVDLHAI

101 <u>IKLADTVVFH APVVF</u>QHQQA FGFNMPQGVE QGCRAAAHAT LRTRFDRRLK

151 HLKEGNAAGM PGFTAPDFAV QPADTSGIDA DARALGNVFH NRAGSGIDGI

201 QTIVAFNQHT A*

The following partial DNA sequence was identified in *N. meningitidis* <SEQ ID 2089>:

<u>m648.seq</u>

```
  1 ATGAACAGGC GCGACGCGCG GATCGAACGG GCTGTGCGTA TTGCAGTGAT
 51 CGACGTTTTG AATGTAGATG CGCCCGGTTC CGGCACGCTC CTGCATCAGC
101 GTGGAAAACA GGTCGGCAGC CGGAATGATG CGCTTGCGGA TATCAGGGTC
```

-continued

```
151 TTGCTCGTAT TTCGTATAGA GCCGCTCAAA TTCGTCTTGG TCGGCAAAAA

201 ACGCTTCGTA CAATCCCGGA ACCTCGTTGG GCGAAAACAG CGTAATGTTG

251 CCGCCCTTAA TCAGGCGGGT GTACAGCAGG CGGTTGATTT GCACGCCGTA

301 ATCAAGCTGA CGGATACGGT TGTCTTCCAC ACCGCGGTTG TTTTTCAACA

351 CCAGCAGGCT TTCGGCTTCG ATATGCCACA AGGGGTAGAA CAAGGTTGCC

401 GCGCCGCCGC GCACGCCGCC TTGCGAACAG GATTTGACCG CCGCCTGAAA

451 CATTTTAAAG AAGGGAATGC AGCCGGTATG CCGCGCTTCG CCGCCCCGGA

501 TTTCGCTGTC CAAACCGCGG ATACGTCCGG CATTGATGCC GATGCCCGCA

551 CGCTGGGAAA CGTATTTCAC AATCGCGCTG GTAGTGGCAT TGATGGAATC

601 CAAACTATCG TCGCATTCAA TCAGCACACA GCTTGA
```

This corresponds to the amino acid sequence <SEQ ID 2090; ORF 648>:

m648.pep

```
  1 MNRRDARIER AVRIAVIDVL NVDAPGSGTL LHQRGKQVGS RNDALADIRV

 51 LLVFRIEPLK FVLVGKKRFV QSRNLVGRKQ RNVAALNQAG VQQAVDLHAV

101 IKLTDTVVFH TAVVFQHQQA FGFDMPQGVE QGCRAAAHAA LRTGFDRRLK

151 HFKEGNAAGM PRFAAPDFAV QTADTSGIDA DARTLGNVFH NRAGSGIDGI

201 QTIVAFNQHT A*
```

m648/g648 91.5% identity in 211 aa overlap

```
                   10        20        30        40        50        60
m648.pep   MNRRDARIERAVRIAVIDVLNVDAPGSGTLLHQRGKQVGSRNDALADIRVLLVFRIEPLK
           ||||:||||||||||||||||||||| ||||||||||||||||:|| :||||||||||||
g648       MNRRNARIERAVRIAVIDVLNVDAPGPGTLLHQRGKQVGSRNDTLAYVRVLLVFRIEPLK
                   10        20        30        40        50        60

                   70        80        90       100       110       120
m648.pep   FVLVGKKRFVQSRNLVGRKQRNVAALNQAGVQQAVDLHAVIKLTDTVVFHTAVVFQHQQA
           ||||||||||| |||||||||||||||||||||||||||:|||:||||||: ||||||||
g648       FVLVGKKRFVQPRNLVGRKQRNVAALNQAGVQQAVDLHAIIKLADTVVFHAPVVFQHQQA
                   70        80        90       100       110       120

                  130       140       150       160       170       180
m648.pep   FGFDMPQGVEQGCRAAAHAALRTGFDRRLKHFKEGNAAGMPRFAAPDFAVQTADTSGIDA
           |||:|||||||||||||||:||| |||||||:||||||||| |:||||||| ||||||||
g648       FGFNMPQGVEQGCRAAAHATLRTRFDRRLKHLKEGNAAGMPGFTAPDFAVQPADTSGIDA
                  130       140       150       160       170       180

                  190       200       210
m648.pep   DARTLGNVFHNRAGSGIDGIQTIVAFNQHTAX
           |||:||||||||||||||||||||||||||||
g648       DARALGNVFHNRAGSGIDGIQTIVAFNQHTAX
                  190       200       210
```

The following partial DNA sequence was identified in *N. meningitidis* <SEQ ID 2091>:

a648.seq

```
  1 ATGAACAGGC GCAACGCGCG GATCGAACGG GCTGTGCGTA TTGCAGTGAT

 51 CGACGTTTTG AATGTAGATG CGCCCGGTTC CGGCACGCTC CTGCATCAGC

101 GTGGAAAACA GGTCGGCAGC CGGAATGATG CGCTTGCGGA TATCAGGGTC
```

-continued

```
151 TTGCTCGTAT TTCGTATAGA GCCGCTCAAA TTCGTCTTGG TCGGCAAAAA

201 ACGCTTCGTA CAATCCCGGA ACCTCGTTGG GCGAAAACAG CGTAATGTTG

251 CCGCCCTTAA TCAGGCGGGT GTACAGCAGG CGGTTGATTT GCACGCCGTA

301 ATCAAGCTGA CGGATACGGT TGTCTTCCAC GCCCCGGTTG TTTTTCAACA

351 CCAGCAGGCT TTCGGCTTCG ATATGCCACA AGGGGTAGAA CAAGGTTGCC

401 GCGCCGCCGC GCACGCCACC TTGCGAACAG GATTTGACTG CCGCCTGAAA

451 CATTTTAAAG AAGGGAATGC AGCCGGTATG CCGTGCTTCG CCGCCCCGGA

501 TTTCGCTGTC CAGTCCGCGG ATACGTCCGG CATTGATGCC GATGCCCGCA

551 CGCTGGGAAA CGTATTTCAC AATCGCGCTG GTAGTGGCGT TGATGGAATC

601 CAGGCTGTCG TCGCATTCGA TCAATACGCA GCTTGA
```

This corresponds to the amino acid sequence <SEQ ID 2092; ORF 648.a>:

a648.pep

```
  1 MNRRNARIER AVRIAVIDVL NVDAPGSGTL LHQRGKQVGS RNDALADIRV

 51 LLVFRIEPLK FVLVGKKRFV QSRNLVGRKQ RNVAALNQAG VQQAVDLHAV

101 IKLTDTVVFH APVVFQHQQA FGFDMPQGVE QGCRAAAHAT LRTGFDCRLK

151 HFKEGNAAGM PCFAAPDFAV QSADTSGIDA DARTLGNVFH NRAGSGVDGI

201 QAVVAFDQYA A*
```

m648/a648 93.8% identity in 211 aa overlap

```
                       10        20        30        40        50        60
m648.pep      MNRRDARIERAVRIAVIDVLNVDAPGSGTLLHQRGKQVGSRNDALADIRVLLVFRIEPLK
              ||||:|||||||||||||||||||||||||||||||||||||||||||||||||||||||
a648          MNRRNARIERAVRIAVIDVLNVDAPGSGTLLHQRGKQVGSRNDALADIRVLLVFRIEPLK
                       10        20        30        40        50        60

                       70        80        90       100       110       120
m648.pep      FVLVGKKRFVQSRNLVGRKQRNVAALNQAGVQQAVDLHAVIKLTDTVVFHTAVVFQHQQA
              ||||||||||||||||||||||||||||||||||||||||||||||||||: ||||||||
a648          FVLVGKKRFVQSRNLVGRKQRNVAALNQAGVQQAVDLHAVIKLTDTVVFHAPVVFQHQQA
                       70        80        90       100       110       120

                      130       140       150       160       170       180
m648.pep      FGFDMPQGVEQGCRAAAHAALRTGFDRRLKHFKEGNAAGMPRFAAPDFAVQTADTSGIDA
              |||||||||||||||||||:|||||| |||||||||||||| |||||||||:||||||||
a648          FGFDMPQGVEQGCRAAAHATLRTGFDCRLKHFKEGNAAGMPCFAAPDFAVQSADTSGIDA
                      130       140       150       160       170       180

                      190       200       210
m648.pep      DARTLGNVFHNRAGSGIDGIQTIVAFNQHTAX
              ||||||||||||||||:||||::|||:|::||
a648          DARTLGNVFHNRAGSGVDGIQAVVAFDQYAAX
                      190       200       210
```

The following partial DNA sequence was identified in *N. gonorrhoeae* <SEQ ID 2093>:

g649.seq

```
  1 ATGCTTGCCA TACTGTTGTC TGCAATACTG GGACTGGTAT CAACAACTGC

 51 CGCTGCCGGT ACGTCAGAAC CCGCCCACCG ACATACCAAA CATATCAGCA

101 AGGCAAACAA GCAGATGCTG CACCCCGAAT GCAGGAAATA TTTGGAACGC
```

-continued

```
151 CGTGCCGCGT GGTACCGATC GCAAGGCAAC GTGCAGGAAT TGCGCGAAAA
201 CAAAAAGGCG CGCAAAGCAT TCCGCACCCT GCCTTATGCG GAACAGAAAA
251 TCCAATGCCG GGCGGCTTAT GAGGCTTTCG ATGATTTCGA CGGCGGCAGG
301 TTCCGCCGTT AA
```

This corresponds to the amino acid sequence <SEQ ID 2094; ORF 649.ng>:

g649.pep

```
  1 MLAILLSAIL GLVSTTAAAG TSEPAHRHTK HISKANKQML HPECRKYLER
 51 RAAWYRSQGN VQELRENKKA RKAFRTLPYA EQKIQCRAAY EAFDDFDGGR
101 FRR*
```

The following partial DNA sequence was identified in *N. meningitidis* <SEQ ID 2095>:

m649.seq

```
  1 ATGCTTGCCA TACTGTTGTC TGCAATATTG GGACTGGTAT CGACAACTGC
 51 CGCTGCCGGT ACGTCAGAAC CCGCCCACCG CGATACCAAA CATATCCGCA
101 AGGCAAACAA GCAGATGCTG CACCCCGAAT GCAGGAAATA TTTGGAACGC
151 CGTGCCGCGT GGTACCGATC GCAAGGCAAC GTGCAGGAAT TGCGCGAAAA
201 CAAAAAGGCG CGCAAAGCAT TCCGCTCCCT GCCTTATGCG GAACAGAAAA
251 TCCAATGCCG GGCGGCTTAT GAGGCTTTCG ATGATTTCGA CGGCGGCAGT
301 TTCCGCCGTT AA
```

This corresponds to the amino acid sequence <SEQ ID 2096; ORF 649>:

m649.pep

```
  1 MLAILLSAIL GLVSTTAAAG TSEPAHRDTK HIRKANKQML HPECRKYLER
 51 RAAWYRSQGN VQELRENKKA RKAFRSLPYA EQKIQCRAAY EAFDDFDGGS
101 FRR*
```

m649/g649 96.1% identity in 103 aa overlap

```
                    10        20        30        40        50        60
m649.pep    MLAILLSAILGLVSTTAAAGTSEPAHRDTKHIRKANKQMLHPECRKYLERRAAWYRSQGN
            |||||||||||||||||||||||||||| |||| ||||||||||||||||||||||||||
g649        MLAILLSAILGLVSTTAAAGTSEPAHRHTKHISKANKQMLHPECRKYLERRAAWYRSQGN
                    10        20        30        40        50        60

                    70        80        90       100
m649.pep    VQELRENKKARKAFRSLPYAEQKIQCRAAYEAFDDFDGGSFRRX
            |||||||||||||||||:||||||||||||||||||||| ||||
g649        VQELRENKKARKAFRTLPYAEQKIQCRAAYEAFDDFDGGRFRRX
                    70        80        90       100
```

The following partial DNA sequence was identified in *N. meningitidis* <SEQ ID 2097>:

a649.seq

```
  1 ATGCTTGCCA TACTGTTGTC TGCAATATTG GGACTGGTAT CGACAACTGC
 51 CGCTGCCGGT ACGTCAGAAC CCGCCCACCG CGATACCAAA CATATCCGCA
101 AGGCAAACAA GCAGATGCTG CACCCCGAAT GCAGGAAATA TTTGGAACGC
151 CGTGCCGCGT GGTACCGATC GCAAGGCAAC CTGCAGGAAT TGCGCGAAAA
201 CAAAAAGGCG CGCAAAGCAT TCCGCTCCCT GCCTTATAAG GAACAGAAAA
251 CCCAATGCCG GGCGGCTTAT GAGGCTTTCG ATGATTTCGA CGGCAGCAGG
301 TTCCGCCGTT AA
```

This corresponds to the amino acid sequence <SEQ ID 2098; ORF 649.a>:

a649.pep

```
  1 MLAILLSAIL GLVSTTAAAG TSEPAHRDTK HIRKANKQML HPECRKYLER
 51 RAAWYRSQGN VQELRENKKA RKAFRSLPYK EQKTQCRAAY EAFDDFDGSR
101 FRR*
```

m649/a649 96.1% identity in 103 aa overlap

```
                    10        20        30        40        50        60
m649.pep    MLAILLSAILGLVSTTAAAGTSEPAHRDTKHIRKANKQMLHPECRKYLERRAAWYRSQGN
            ||||||||||||||||||||||||||||||||||||||||||||||||||||||||||||
a649        MLAILLSAILGLVSTTAAAGTSEPAHRDTKHIRKANKQMLHPECRKYLERRAAWYRSQGN
                    10        20        30        40        50        60

                    70        80        90       100
m649.pep    VQELRENKKARKAFRSLPYAEQKIQCRAAYEAFDDFDGGSFRRX
            ||||||||||||||||||| ||| ||||||||||||||: ||||
a649        VQELRENKKARKAFRSLPYKEQKTQCRAAYEAFDDFDGSRFRRX
                    70        80        90       100
```

The following partial DNA sequence was identified in *N. gonorrhoeae* <SEQ ID 2099>:

g650.seq

```
  1 ATGTCCAAAC TCAAAACCAT CGCCCTGACC GCATCAGGTC TGTCCGTTTG
 51 TCCGGGTTTC CTATATGCCC AAAACACCTC ATCACACCAA GTCGGTTTAG
101 CGATTATGCG GTTAAACTCT TCAATACTCG ACCTGCCACC GACAAAACAA
151 TATTTCCAAT CCGGCAGCCT GTGGGACGAG CTGCGCCAAG GCTTCCGGAT
201 GGGCGAAGTC AATCCCGAAC TGGTACGCCG CCACGAAAGC AAATTCATCG
251 CAAGCCGCAG CTATTTCGAC AGGGTCGTCA ACCGGAGCCG ACCCTATATG
301 TACCATATCG CCAACGAAGT CAAAAAACGC AATATGCCCG CCGAAGCCGC
351 CCTGCTTCCC TTCATCGAAA GCGCGTTCGT CACCAAAGCC AAATCACACG
401 TCGGCGCATC GGGCCTGTGG CAGTTCATGC CCGCTACCGG CAGGCATTAC
451 GGCTTGGAAA AAACaccgGT TTACGacggc aggcacGacg TTtacgcaGc
501 taccgatgcc gcacTCAACT AtctGcAATA TCTCTAtggA CTGTTCGGCG
551 ACTGGCCGCT CGCCTTTGCC GCCTACAACT GGGGTGAAGG CAACGTCGGA
```

-continued

```
 601 CGCGCCGTCA ACCGCGCCCG CGACCAAGGG CTCGAACCGA CCTACGAAAA
 651 CCTGCGTATG CCCAACGAAA CGCGCAACTA TGTCCCCAAG CTGCTCGCCG
 701 TGCGCAACAT TATTGCCACC CCCCAATCTT TCGGCATGAA TATCAGCGAC
 751 ATAGACAACA AACCCTATTT TCAGGCAGTC GAACCGGGCC GTCCGCTCGA
 801 caacGAagcC ATCGCCCGGC TTGCCGGCAT CACGCAAAGC GAGCTGCTCG
 851 CCCTGAATCC TGCATTCAAC GTCCCCGCgt tcatCCCCAA AAAcaaacgc
 901 aaacTGCTGC TTCCTGTCGC GTCCGTCCAA ACCTTccaaa gcaACTACCT
 951 CAACGCCGCA CCCGACAGCC TGTTTTCATG GGAAGTCTAT ACGCCTGCCG
1001 CCAAAACCAG CCTGTCCGAC ATCTCGACGG CAACCGGCAT GAGCATTGCC
1051 GACATCAAAC GCCTCAACAA CCTGAACGGC AACCTTGTCA ACGCAGGACG
1101 CAGCATCCTT GTCGCCAAGA ACGGCAAGAC CCTTCATACG GCATCGGAat
1151 ccGTCGTTTC CATCGACATC GACAATACGC CcgacacCTa ccgttccaaT
1201 ATGCcggcag gcaCGGTGAA CGTCAGCATt gccCgaatcc aacCCgccgc
1251 cgcaCAGACA gcggacatta ccgtcgcacc tttgccgcaa gaaaccgtcc
1301 gtacgggaac ccgatcccct tgtccgcaTt accgaacccg ccctTGCGAC
1351 AGCCGCAGCg CaacctCAAA ccgAAAAACA GACTGCCATG CcgtctGA
```

This corresponds to the amino acid sequence <SEQ ID 2100; ORF 650.ng>:

g650.pep

```
  1 MSKLKTIALT ASGLSVCPGF LYAQNTSSHQ VGLAIMRLNS SILDLPPTKQ
 51 YFQSGSLWDE LRQGFRMGEV NPELVRRHES KFIASRSYFD RVVNRSRPYM
101 YHIANEVKKR NMPAEAALLP FIESAFVTKA KSHVGASGLW QFMPATGRHY
151 GLEKTPVYDG RHDVYAATDA ALNYLQYLYG LFGDWPLAFA AYNWGEGNVG
201 RAVNRARDQG LEPTYENLRM PNETRNYVPK LLAVRNIIAT PQSFGMNISD
251 IDNKPYFQAV EPGRPLDNEA IARLAGITQS ELLALNPAFN VPAFIPKNKR
301 KLLLPVASVQ TFQSNYLNAA PDSLFSWEVY TPAAKTSLSD TSTATGMSIA
351 DIKRLNNLNG NLVNAGRSIL VAKNGKTLHT ASESVVSIDI DNTPDTYRSN
401 MPAGTVNVSI ARIQPAAAQT ADITVAPLPQ ETVRTGTRSP CPHYRTRPCD
451 SRSATSNRKT DCHAV*
```

The following partial DNA sequence was identified in *N. meningitidis* <SEQ ID 2101>:

m650.seq

```
  1 ATGTCCAAAC TCAAAACCAT CGCTCTGACC GCATCAGGTC TGTCCGTTTG
 51 TCCGGGTTTC CTATACGCCC AAAACACCTC ATCACACCAA ATCGGTTTGG
101 CGATTATGCG CTTAAACTCT TCAATACTCG ACCTGCCCCC GACAAAACAA
151 TATTTCCAAT CCGGCAGCCT GTGGGGCGAG CTGCGCCAAG GCTTCCGGAT
201 GGGCGAAGTC AATCCCGAAC TGGTACGCCG CCACGAAAGC AAATTCATCG
251 CAAGCCACAG CTATTTCAAC AGGGTCATCA ACCGGAGTAG ACCCTATATG
```

-continued

```
 301 TACCATATCG CCAACGAAGT CAAAAAACGC AATATGCCCG CCGAAGCCGC
 351 CCTGCTTCCC TTCATCGAAA GCGCGTTCGT CACCAAAGCC AAATCACACG
 401 TCGGCGCATC AGGATTATGG CAGTTTATGC CCGCTACCGG CAGGCATTAC
 451 GGCCTGGAAA AAACACCGGT TTACGACGGC AGGCACGACG TTTACGCCGC
 501 CACCGATGCC GCACTCAACT ATCTGCAATA CCTCTATGGA CTGTTCGGCG
 551 ACTGGCCGCT TGCCTTTGCC GCCTACAACT GGGGTGAAGG CAACGTCGGA
 601 CGCGCCATCA ACCGCGCCCG CGCCCAAGGG CTCGAACCGA CCTACGAAAA
 651 CCTGCGTATG CCCAACGAAA CGCGCAACTA TGTCCCCAAG CTGCTCGCCG
 701 TGCGCAACAT TATTGCCACT CCCCAATCTT TCGGCATGAA TATCAGCGAC
 751 ATAGACAACA AACCCTATTT TCAGGCAGTC GAACCGGATC GTCCGCTCGA
 801 CAACGAAGCC ATCGCCCGGC TTGCCGGCAT CACGCAAAGC GAGCTGCTCG
 851 CCCTAAACCC CGCATTCAAC GTCCCCGCGT TTATCCCCAA AAGCAAACGC
 901 AAACTGCTGC TTCCTGTCGC GTCCGTACAA ACCTTCCAAA GCAACTACCT
 951 CAACGCCGCA CCCGACAGCC TGTTTTCATG GGAAGTCTAT ACGCCTGCCG
1001 CCAAAACCAG CCTGTCCGAC ATCTCGACGG CAACCGGCAT GAGCATTGCC
1051 GACATCAAAC GCCTCAACAA CCTGAACGGC AACCTTGTCA ACGCAGGACG
1101 CAGCATCCTT GTCGCCAAGA ACGGCAAAAC CCTTCAGACG GCATCGGAAT
1151 CCGTCGTTTC CATCGACATC GACAATACGC CCGACACCTA CCGTTCCAAT
1201 ATGCCGGCAG GCACGGTGAA CGTCGGCATT GCCCGAATCC GACCCGCCGC
1251 CGCACAGACA GCGGACATTA CCGTCGCACC TTTGCCGCAG AAAACCGTCC
1301 GTACGG.AAC CCGATCCCCT TGTCCGTATT GCCGAACCTG CCCTTGCGAC
1351 AGCCGCAGCG CAACCTCAAA CCGAAAAACA GACCGCCATG CCGTCTGA
```

This corresponds to the amino acid sequence <SEQ ID 2102; ORF 650>:

m650.pep

```
  1 MSKLKTIALT ASGLSVCPGF LYAQNTSSHQ IGLAIMRLNS SILDLPPTKQ
 51 YFQSGSLWGE LRQGFRMGEV NPELVRRHES KFIASHSYFN RVINRSRPYM
101 YHIANEVKKR NMPAEAALLP FIESAFVTKA KSHVGASGLW QFMPATGRHY
151 GLEKTPVYDG RHDVYAATDA ALNYLQYLYG LFGDWPLAFA AYNWGEGNVG
201 RAINRARAQG LEPTYENLRM PNETRNYVPK LLAVRNIIAT PQSFGMNISD
251 IDNKPYFQAV EPDRPLDNEA IARLAGITQS ELLALNPAFN VPAFIPKSKR
301 KLLLPVASVQ TFQSNYLNAA PDSLFSWEVY TPAAKTSLSD ISTATGMSIA
351 DIKRLNNLNG NLVNAGRSIL VAKNGKTLQT ASESVVSIDI DNTPDTYRSN
401 MPAGTVNVGI ARIRPAAAQT ADITVAPLPQ KTVRTXTRSP CPYCRTCPCD
451 SRSATSNRKT DRHAV*
```

m650/g650 96.1% identity in 465 aa overlap

```
                    10        20        30        40        50        60
m650.pep    MSKLKTIALTASGLSVCPGFLYAQNTSSHQIGLAIMRLNSSILDLPPTKQYFQSGSLWGE
            ||||||||||||||||||||||||||||||:||||||||||||||||||||||||||| |
g650        MSKLKTIALTASGLSVCPGFLYAQNTSSHQVGLAIMRLNSSILDLPPTKQYFQSGSLWDE
                    10        20        30        40        50        60

                    70        80        90       100       110       120
m650.pep    LRQGFRMGEVNPELVRRHESKFIASHSYFNRVINRSRPYMYHIANEVKKRNMPAEAALLP
            |||||||||||||||||||||||||:|||:|||:||||||||||||||||||||||||||
g650        LRQGFRMGEVNPELVRRHESKFIASRSYFDRVVNRSRPYMYHIANEVKKRNMPAEAALLP
                    70        80        90       100       110       120

                   130       140       150       160       170       180
m650.pep    FIESAFVTKAKSHVGASGLWQFMPATGRHYGLEKTPVYDGRHDVYAATDAALNYLQYLYG
            ||||||||||||||||||||||||||||||||||||||||||||||||||||||||||||
g650        FIESAFVTKAKSHVGASGLWQFMPATGRHYGLEKTPVYDGRHDVYAATDAALNYLQYLYG
                   130       140       150       160       170       180

                   190       200       210       220       230       240
m650.pep    LFGDWPLAFAAYNWGEGNVGRAINRARAQGLEPTYENLRMPNETRNYVPKLLAVRNIIAT
            ||||||||||||||||||||||:||||| |||||||||||||||||||||||||||||||
g650        LFGDWPLAFAAYNWGEGNVGRAVNRARDQGLEPTYENLRMPNETRNYVPKLLAVRNIIAT
                   190       200       210       220       230       240

                   250       260       270       280       290       300
m650.pep    PQSFGMNISDIDNKPYFQAVEPDRPLDNEAIARLAGITQSELLALNPAFNVPAFIPKSKR
            ||||||||||||||||||||||| |||||||||||||||||||||||||||||||||:||
g650        PQSFGMNISDIDNKPYFQAVEPGRPLDNEAIARLAGITQSELLALNPAFNVPAFIPKNKR
                   250       260       270       280       290       300

                   310       320       330       340       350       360
m650.pep    KLLLPVASVQTFQSNYLNAAPDSLFSWEVYTPAAKTSLSDISTATGMSIADIKRLNNLNG
            ||||||||||||||||||||||||||||||||||||||||||||||||||||||||||||
g650        KLLLPVASVQTFQSNYLNAAPDSLFSWEVYTPAAKTSLSDISTATGMSIADIKRLNNLNG
                   310       320       330       340       350       360

                   370       380       390       400       410       420
m650.pep    NLVNAGRSILVAKNGKTLQTASESVVSIDIDNTPDTYRSNMPAGTVNVGIARIRPAAAQT
            ||||||||||||||||||:|||||||||||||||||||||||||||||:||||:||||||
g650        NLVNAGRSILVAKNGKTLHTASESVVSIDIDNTPDTYRSNMPAGTVNVSIARIQPAAAQT
                   370       380       390       400       410       420

                   430       440       450       460
m650.pep    ADITVAPLPQKTVRTXTRSPCPYCRTCPCDSRSATSNRKTDRHAVX
            ||||||||||:|||| ||||||: || |||||||||||||| ||||
g650        ADITVAPLPQETVRTGTRSPCPHYRTRPCDSRSATSNRKTDCHAVX
                   430       440       450       460
```

The following partial DNA sequence was identified in *N. meningitidis* <SEQ ID 2103>:

a650.seq

```
  1 ATGTCCAAAC TCAAAACCAT CGCCCTGACC GCGTCAGGTC TGTCCGTTTG

 51 TCCGGGTTTC CTATACGCCC AAAACACCTC ATCACACCAA ATCGGTTTGG

101 CGATTATGCG CTTAAACTCT TCAATACTCG ACCTGCCACC GACAAAACAA

151 TATTTCCAAT CCGGCAGCCT GTGGAGCGAG CTGCGCCAAG GCTTCCGGAT

201 GGGCGAAGTC AATCCCGAAC TGGTACGCCG CCACGAAAGC AAATTCATCG

251 CAAGCCACAG CTATTTCAAC AGGGTCATCA ACCGGAGTAG ACCCTATATG

301 TACCATATCG CCAACGAAGT CAAAAAACGC AATATGCCCG CCGAAGCCGC

351 CCTGCTTCCC TTCATCGAAA GCGCGTTCGT CACCAAAGCC AAATCACACG

401 TCGGCGCATC GGGCCTGTGG CAGTTCATGC CCGCTACCGG CAGGCATTAC

451 GGCCTGGAAA AAACACCGGT TTACGACGGC AGGCACGACA TTTACGCCGC

501 CACCGATGCC GCACTCAACT ATCTGCAATA CCTCTATGGA CTGTTCGGCG

551 ACTGGCCGCT CGCCTTTGCC GCCTACAACT GGGGTGAAGG CAACGTCGGA

601 CGCGCCATCA ACCGCGCCCG CGCCCAAGGG CTCGAACCGA CCTACGAAAA

651 CCTGCGTATG CCCAACGAAA CGCGCAACTA TGTTCCCAAG CTGCTCGCCG

701 TGCGCAACAT CATTGCCGCC CCCCAATCTT TCGGCATGAA TATCAGCGAC

751 ATAGACAACA AACCGTATTT TCAGGCAGTC GAACCGGACC GTCCGCTCGA
```

-continued

```
 801 CAACGAAGCC ATCGCCCGGC TTGCCGGCAT CACGCAAAGC GAGCTGCTCG

 851 CCCTAAACCC CGCATTCAAC GTCCCCGCGT TCATCCCCAA AAGCAAACGC

 901 AAACTGCTGC TTCCTGTCGC GTCCGTACAA ACCTTCCAAA GCAACTACCT

 951 CAACGCCGCA CCCGACAGCC TGTTTTCATG GGAAGTCTAT ACGCCTGCCG

1001 CCAAAACCAG CTTGTCCGAC ATCTCGACGG CAACCGGCAT GAGCATTGCC

1051 GACATCAAAC GCCTCAACAA CCTGAACGGC AACCTTGTCA ACGCAGGACG

1101 CAGCATCCTT GTCGCCAAGA ACGGCAAAAC CCTTCAGACG GCATCGGAAT

1151 CCGTCGTTTC CATCGACATC GACAATACGC CCAACACCTA CCGTTCCAAT

1201 ATGCCGGCAG GCACGGTGAA CGTCGGCATT GCCCGAATCC GACCCGCCGC

1251 CGCACAGACA GCGGACATTA CCGTCGCACC TTTGCCGCAG AAAACCGTCC

1301 GTACGG.AAC CCGATCCCCT TGTCCGTATT GCCGAACCTG CCCTTGCGAC

1351 AGCCGCAGCG CAACCTCAAA CCGAAAAACA GACCGCCATG CCGTCTGA
```

This corresponds to the amino acid sequence <SEQ ID 2104; ORF 650.a>:

a650.pep

```
  1 MSKLKTIALT ASGLSVCPGF LYAQNTSSHQ IGLAIMRLNS SILDLPPTKQ

 51 YFQSGSLWSE LRQGFRMGEV NPELVRRHES KFIASHSYFN RVINRSRPYM

101 YHIANEVKKR NMPAEAALLP FIESAFVTKA KSHVGASGLW QFMPATGRHY

151 GLEKTPVYDG RHDIYAATDA ALNYLQYLYG LFGDWPLAFA AYNWGEGNVG

201 RAINRARAQG LEPTYENLRM PNETRNYVPK LLAVRNIIAA PQSFGMNISD

251 IDNKPYFQAV EPDRPLDNEA IARLAGITQS ELLALNPAFN VPAFIPKSKR

301 KLLLPVASVQ TFQSNYLNAA PDSLFSWEVY TPAAKTSLSD ISTATGMSIA

351 DIKRLNNLNG NLVNAGRSIL VAKNGKTLQT ASESVVSIDI DNTPNTYRSN

401 MPAGTVNVGI ARIRPAAAQT ADITVAPLPQ KTVRTXTRSP CPYCRTCPCD

451 SRSATSNRKT DRHAV*
```

m650/a650 99.1% identity in 465 aa overlap

```
                  10        20        30        40        50        60
m650.pep   MSKLKTIALTASGLSVCPGFLYAQNTSSHQIGLAIMRLNSSILDLPPTKQYFQSGSLWGE
           ||||||||||||||||||||||||||||||||||||||||||||||||||||||||||:|
a650       MSKLKTIALTASGLSVCPGFLYAQNTSSHQIGLAIMRLNSSILDLPPTKQYFQSGSLWSE
                  10        20        30        40        50        60

                  70        80        90       100       110       120
m650.pep   LRQGFRMGEVNPELVRRHESKFIASHSYFNRVINRSRPYMYHIANEVKKRNMPAEAALLP
           ||||||||||||||||||||||||||||||||||||||||||||||||||||||||||||
a650       LRQGFRMGEVNPELVRRHESKFIASHSYFNRVINRSRPYMYHIANEVKKRNMPAEAALLP
                  70        80        90       100       110       120

                 130       140       150       160       170       180
m650.pep   FIESAFVTKAKSHVGASGLWQFMPATGRHYGLEKTPVYDGRHDVYAATDAALNYLQYLYG
           |||||||||||||||||||||||||||||||||||||||||||:||||||||||||||||
a650       FIESAFVTKAKSHVGASGLWQFMPATGRHYGLEKTPVYDGRHDIYAATDAALNYLQYLYG
                 130       140       150       160       170       180

                 190       200       210       220       230       240
m650.pep   LFGDWPLAFAAYNWGEGNVGRAINRARAQGLEPTYENLRMPNETRNYVPKLLAVRNIIAT
           |||||||||||||||||||||||||||||||||||||||||||||||||||||||||||:
a650       LFGDWPLAFAAYNWGEGNVGRAINRARAQGLEPTYENLRMPNETRNYVPKLLAVRNIIAA
                 190       200       210       220       230       240
```

-continued

```
              250        260        270        280        290        300
m650.pep      PQSFGMNISDIDNKPYFQAVEPDRPLDNEAIARLAGITQSELLALNPAFNVPAFIPKSKR
              ||||||||||||||||||||||||||||||||||||||||||||||||||||||||||||
a650          PQSFGMNISDIDNKPYFQAVEPDRPLDNEAIARLAGITQSELLALNPAFNVPAFIPKSKR
              250        260        270        280        290        300

              310        320        330        340        350        360
m650.pep      KLLLPVASVQTFQSNYLNAAPDSLFSWEVYTPAAKTSLSDISTATGMSIADIKRLNNLNG
              ||||||||||||||||||||||||||||||||||||||||||||||||||||||||||||
a650          KLLLPVASVQTFQSNYLNAAPDSLFSWEVYTPAAKTSLSDISTATGMSIADIKRLNNLNG
              310        320        330        340        350        360

              370        380        390        400        410        420
m650.pep      NLVNAGRSILVAKNGKTLQTASESVVSIDIDNTPDTYRSNMPAGTVNVGIARIRPAAAQT
              |||||||||||||||||||||||||||||||||| :||||||||||||||||||||||||
a650          NLVNAGRSILVAKNGKTLQTASESVVSIDIDNTPNTYRSNMPAGTVNVGIARIRPAAAQT
              370        380        390        400        410        420

              430        440        450        460
m650.pep      ADITVAPLPQKTVRTXTRSPCPYCRTCPCDSRSATSNRKTDRHAVX
              ||||||||||||||||||||||||||||||||||||||||||||||
a650          ADITVAPLPQKTVRTXTRSPCPYCRTCPCDSRSATSNRKTDRHAVX
              430        440        450        460
```

The following partial DNA sequence was identified in *N. gonorrhoeae* <SEQ ID 2105>:

```
g652.seq

  1  ATGATCGAAT TGGACGGTAC TGAAAACAAA GGCAATTTGG GTGCGAATGC

 51  GACTTTGGCG GTCTCTATGG CGGTTGCACG CGCCGCTGCC GAAGACTCAG

101  GCCTGCCGCT TTACCGCTAC TTGGGGGGCG CAGGTCCGAT GTCCCTGCCC

151  GTACCGATGA TGAACGTCAT CAACGGCGGC GAACACGCCA ACAACAGCCT

201  GAACATCCAA GAGTTTATGA TTATGCCCGT CGGCGCAAAA TCTTTCCGCG

251  AAGCGTTGCG CTGCGGTGCG GAAATTTTCC ACGCCTTGAA AAAACTGTGC

301  GACAGTAAAG GCTTCCCGAC CACAGTCGGC GACGAAGGCG GTTTCGCCCC

351  CAACCTGAAC AGCCACAAAG AAGCCCTGCA ACTGATGGTC GAAGCGGCCG

401  AAGCCGCCGG CTACAAGGCG GGCGAAGACG TATTATTCGC ATTGGACTGC

451  GCGTCCAGCG AGTTCTACAA AGACGGCAAA TACCACTTGG AAGCCGAAGG

501  CCGCTCCTAC ACCAACGCGG AATTTGCCGA ATACTTGGAA GGCTTGGTTA

551  ACGAATTCCC GATTATTTCC ATTGAAGACG GGATGGACGA AAACGACTGG

601  GAAGGCTGGA AACTGCTGAC CGAAAAATTG GGCAAAAAAG TTCAATTGGT

651  CGGCGACGAC TTGTTCGTAA CCAATCCGAA AATTCTTGCC GAAGGCATCG

701  AAAAAGGCGT AGCAAACGCA TTGCTGGTCA AAGTCAACCA AATCGGTACT

751  TTAAGCGAAA CCCTGAAAGc cgtcgatctg gCAAAATGCA accgctacGc

801  cagCGTGATG AGCCAccgct ccggCGAAAC CGAAGACAGT Accattgccg

851  ACTTGGCAGT CGCCACCAAC TGTATGCAGA TTAAAAccgG TTCTTTGAGc
```

-continued

```
 901 cgTTCCGACC GCATGGCGAA ATACAACCAa ctGCTGCGTA TCGAGGAAGA

 951 ATTGGCGGAA GCcgcctACT ACCCCGGCAA AGCCGCATTC TACCAACTGG

1001 GCAAATAA
```

This corresponds to the amino acid sequence <SEQ ID 2106; ORF 652.ng>:

g652.pep

```
  1 MIELDGTENK GNLGANATLA VSMAVARAAA EDSGLPLYRY LGGAGPMSLP

 51 VPMMNVINGG EHANNSLNIQ EFMIMPVGAK SFREALRCGA EIFHALKKLC

101 DSKGFPTTVG DEGGFAPNLN SHKEALQLMV EAAEAAGYKA GEDVLFALDC

151 ASSEFYKDGK YHLEAEGRSY TNAEFAEYLE GLVNEFPIIS IEDGMDENDW

201 EGWKLLTEKL GKKVQLVGDD LFVTNPKILA EGIEKGVANA LLVKVNQIGT

251 LSETLKAVDL AKCNRYASVM SHRSGETEDS TIADLAVATN CMQIKTGSLS

301 RSDRMAKYNQ LLRIEEELAE AAYYPGKAAF YQLGK*
```

The following partial DNA sequence was identified in *N. meningitidis* <SEQ ID 2107>:

m652.seq

```
   1 ATGATCGAAT TGGACGGTAC TGAAAACAAA GGCAATTTGG GTGCGAATGC

  51 GACTTTGGCG GTTTCTATGG CGGTTGCACG CGCCGCTGCC GAAGACTCAG

 101 GCCTGCCGCT TTACCGCTAC TTGGGCGGCG CAGGCCCGAT GTCCCTGCCC

 151 GTACCGATGA TGAACGTCAT CAACGGCGGC GAACACGCCA ACAACAGCCT

 201 GAACATCCAA GAGTTTATGA TTATGCCCGT CGGCGCAAAA TCTTTCCGCG

 251 AAGCGTTGCG CTGCGGTGCG GAAATTTTCC ACGCCTTGAA AAAACTGTGC

 301 GACAGCAAAG GCTTCCCGAC CACAGTCGGC GACGAAGGCG GTTTCGCCCC

 351 CAACCTGAAC AGCCACAAAG AAGCCCTGCA ACTGATGGTC GAGGCGACCG

 401 AAGCCGCCGG CTACAAAGCG GGCGAAGACG TATTATTCGC ATTGGACTGC

 451 GCCTCCAGCG AGTTCTACAA AGACGGCAAA TACCACTTGG AAGCCGAAGG

 501 CCGCTCCTAC ACCAACGCGG AATTTGCCGA ATATCTGGAA GGCCTGGTCA

 551 ACGAGTTCCC CATCATCTCC ATCGAAGACG GCATGGATGA AAACGACTGG

 601 GAAGGCTGGA AACTGCTGAC CGAAAAACTG GGCGGTAGAG TTCAATTGGT

 651 TGGCGACGAC TTGTTCGTAA CCAATCCAAA AATCTTGGCC GAAGGCATCG

 701 AAAAAGGCGT AGCAAACGCA TTGCTGGTCA AAGTCAATCA AATCGGTACT

 751 TTGAGCGAGA CCCTGAAAGC CGTCGACTTA GCCAAACGCA ACCGCTACGC

 801 CAGCGTAATG AGCCACCGCT CCGGCGAAAC CGAAGACAGC ACCATTGCCG

 851 ACTTGGCAGT CGCCACCAAC TGTATGCAGA TCAAAACCGG TTCTTTGAGC

 901 CGTTCCGACC GCATGGCGAA ATACAACCAA CTGCTGCGTA TCGAGGAAGA

 951 ATTGGCGGAA GCCGCCGACT ACCCCAGCAA AGCCGCATTC TACCAACTGG

1001 GCAAATAA
```

This corresponds to the amino acid sequence <SEQ ID 2108; ORF 652>:

m652.pep

```
  1 MIELDGTENK GNLGANATLA VSMAVARAAA EDSGLPLYRY LGGAGPMSLP
 51 VPMMNVINGG EHANNSLNIQ EFMIMPVGAK SFREALRCGA EIFHALKKLC
101 DSKGFPTTVG DEGGFAPNLN SHKEALQLMV EATEAAGYKA GEDVLFALDC
151 ASSEFYKDGK YHLEAEGRSY TNAEFAEYLE GLVNEFPIIS IEDGMDENDW
201 EGWKLLTEKL GGRVQLVGDD LFVTNPKILA EGIEKGVANA LLVKVNQIGT
251 LSETLKAVDL AKRNRYASVM SHRSGETEDS TIADLAVATN CMQIKTGSLS
301 RSDRMAKYNQ LLRIEEELAE AADYPSKAAF YQLGK*
```

m652/g652 98.2% identity in 335 aa overlap

```
                       10        20        30        40        50        60
m652.pep      MIELDGTENKGNLGANATLAVSMAVARAAAEDSGLPLYRYLGGAGPMSLPVPMMNVINGG
              ||||||||||||||||||||||||||||||||||||||||||||||||||||||||||||
g652          MIELDGTENKGNLGANATLAVSMAVARAAAEDSGLPLYRYLGGAGPMSLPVPMMNVINGG
                       10        20        30        40        50        60

                       70        80        90       100       110       120
m652.pep      EHANNSLNIQEFMIMPVGAKSFREALRCGAEIFHALKKLCDSKGFPTTVGDEGGFAPNLN
              ||||||||||||||||||||||||||||||||||||||||||||||||||||||||||||
g652          EHANNSLNIQEFMIMPVGAKSFREALRCGAEIFHALKKLCDSKGFPTTVGDEGGFAPNLN
                       70        80        90       100       110       120

                      130       140       150       160       170       180
m652.pep      SHKEALQLMVEATEAAGYKAGEDVLFALDCASSEFYKDGKYHLEAEGRSYTNAEFAEYLE
              ||||||||||||:|||||||||||||||||||||||||||||||||||||||||||||||
g652          SHKEALQLMVEAAEAAGYKAGEDVLFALDCASSEFYKDGKYHLEAEGRSYTNAEFAEYLE
                      130       140       150       160       170       180

                      190       200       210       220       230       240
m652.pep      GLVNEFPIISIEDGMDENDWEGWKLLTEKLGGRVQLVGDDLFVTNPKILAEGIEKGVANA
              ||||||||||||||||||||||||||||||| :|||||||||||||||||||||||||||
g652          GLVNEFPIISIEDGMDENDWEGWKLLTEKLGKKVQLVGDDLFVTNPKILAEGIEKGVANA
                      190       200       210       220       230       240

                      250       260       270       280       290       300
m652.pep      LLVKVNQIGTLSETLKAVDLAKRNRYASVMSHRSGETEDSTIADLAVATNCMQIKTGSLS
              |||||||||||||||||||||| |||||||||||||||||||||||||||||||||||||
g652          LLVKVNQIGTLSETLKAVDLAKCNRYASVMSHRSGETEDSTIADLAVATNCMQIKTGSLS
                      250       260       270       280       290       300

                      310       320       330
m652.pep      RSDRMAKYNQLLRIEEELAEAADYPSKAAYQLGKX
              |||||||||||||||||||||| ||:|||||||||
g652          RSDRMAKYNQLLRIEEELAEAAYYPGKAAYQLGKX
                      310       320       330
```

The following partial DNA sequence was identified in *N. meningitidis* <SEQ ID 2109>:

a652.seq

```
  1 ATGATCGAAT TGGACGGTAC TGAAAACAAA GGCAATTTGG GTGCGAATGC
 51 GACTTTGGCG GTTTCTATGG CGGTTGCACG CGCCGCTGCC GAAGACTCAG
101 GCCTGCCGCT TTACCGCTAC TTGGGCGGCG CAGGCCCGAT GTCCCTGCCC
151 GTACCGATGA TGAACGTCAT CAACGGCGGC GAACACGCCA ACAACAGCCT
201 GAACATCCAA GAGTTTATGA TTATGCCCGT CGGCGCAAAA TCTTTCCGCG
251 AAGCGTTGCG CTGCGGTGCG GAAATTTTCC ACGCCTTGAA AAAACTGTGC
301 GACAGCAAAG GCTTCCCGAC CACAGTCGGC GACGAAGGCG GTTTCGCCCC
351 CAACCTGAAC AGCCACAAAG AAGCCCTGCA ACTGATGGTC GAGGCGACCG
```

-continued

```
 401 AAGCCGCCGG CTACAAAGCG GGCGAAGACG TATTATTCGC ATTGGACTGC

 451 GCGTCCAGCG AGTTCTACAA AGACGGCAAA TACCACTTGG AAGCCGAAGG

 501 CCGCTCCTAC ACCAACGCGG AATTTGCCGA ATATCTGGAA GGCCTGGTCA

 551 ACGAGTTCCC CATCATCTCC ATCGAAGACG GGATGGATGA AAACGACTGG

 601 GAAGGCTGGA AACTGCTGAC CGAAAAACTG GGCGGCAAAG TCCAACTCGT

 651 TGGCGACGAC CTCTTCGTTA CCAACCCGAA AATCCTTGCC GAAGGCATTG

 701 AAAAAGGCGT GGCAAACGCA CTATTGGTCA AAGTCAACCA AATCGGTACT

 751 TTGAGTGAAA CCCTGAAAGC CGTCGACTTA GCCAAACGCA ACCGCTACGC

 801 CAGCGTAATG AGCCACCGCT CCGGCGAAAC CGAAGACAGC ACCATTGCCG

 851 ACTTGGCAGT CGCCACCAAC TGTATGCAGA TCAAAACCGG TTCTTTGAGC

 901 CGTTCCGACC GCATGGCGAA ATACAACCAA CTGCTGCGTA TCGAGGAAGA

 951 ATTGGCGGAA GCCGCCGACT ACCCCAGCAA AGCCGCATTC TACCAACTGG

1001 GCAAATAA
```

This corresponds to the amino acid sequence <SEQ ID 2110: ORF 652.a>:

a652.pep

```
  1 MIELDGTENK GNLGANATLA VSMAVARAAA EDSGLPLYRY LGGAGPMSLP

 51 VPMMNVINGG EHANNSLNIQ EFMIMPVGAK SFREALRCGA EIFHALKKLC

101 DSKGFPTTVG DEGGFAPNLN SHKEALQLMV EATEAAGYKA GEDVLFALDC

151 ASSEFYKDGK YHLEAEGRSY TNAEFAEYLE GLVNEFPIIS IEDGMDENDW

201 EGWKLLTEKL GGKVQLVGDD LFVTNPKILA EGIEKGVANA LLVKVNQIGT

251 LSETLKAVDL AKRNRYASVM SHRSGETEDS TIADLAVATN CMQIKTGSLS

301 RSDRMAKYNQ LLRIEEELAE AADYPSKAAF YQLGK*
```

m652/a652 99.7% identity in 335 aa overlap

```
                   10        20        30        40        50        60
m652.pep   MIELDGTENKGNLGANATLAVSMAVARAAAEDSGLPLYRYLGGAGPMSLPVPMMNVINGG
           ||||||||||||||||||||||||||||||||||||||||||||||||||||||||||||
a652       MIELDGTENKGNLGANATLAVSMAVARAAAEDSGLPLYRYLGGAGPMSLPVPMMNVINGG
                   10        20        30        40        50        60

                   70        80        90       100       110       120
m652.pep   EHANNSLNIQEFMIMPVGAKSFREALRCGAEIFHALKKLCDSKGFPTTVGDEGGFAPNLN
           ||||||||||||||||||||||||||||||||||||||||||||||||||||||||||||
a652       EHANNSLNIQEFMIMPVGAKSFREALRCGAEIFHALKKLCDSKGFPTTVGDEGGFAPNLN
                   70        80        90       100       110       120

                  130       140       150       160       170       180
m652.pep   SHKEALQLMVEATEAAGYKAGEDVLFALDCASSEFYKDGKYHLEAEGRSYTNAEFAEYLE
           ||||||||||||||||||||||||||||||||||||||||||||||||||||||||||||
a652       SHKEALQLMVEATEAAGYKAGEDVLFALDCASSEFYKDGKYHLEAEGRSYTNAEFAEYLE
                  130       140       150       160       170       180

                  190       200       210       220       230       240
m652.pep   GLVNEFPIISIEDGMDENDWEGWKLLTEKLGGRVQLVGDDLFVTNPKILAEGIEKGVANA
           ||||||||||||||||||||||||||||||||:|||||||||||||||||||||||||||
a652       GLVNEFPIISIEDGMDENDWEGWKLLTEKLGGKVQLVGDDLFVTNPKILAEGIEKGVANA
                  190       200       210       220       230       240

                  250       260       270       280       290       300
m652.pep   LLVKVNQIGTLSETLKAVDLAKRNRYASVMSHRSGETEDSTIADLAVATNCMQIKTGSLS
           ||||||||||||||||||||||||||||||||||||||||||||||||||||||||||||
a652       LLVKVNQIGTLSETLKAVDLAKRNRYASVMSHRSGETEDSTIADLAVATNCMQIKTGSLS
                  250       260       270       280       290       300
```

-continued

```
                310        320        330
m652.pep    RSDRMAKYNQLLRIEEELAEAADYPSKAAYQLGKX
            |||||||||||||||||||||||||||||||||||
a652        RSDRMAKYNQLLRIEEELAEAADYPSKAAYQLGKX
                310        320        330
```

The following partial DNA sequence was identified in *N. gonorrhoeae* <SEQ ID 2111>:

g652-1.seq

```
   1 ATGAGCGCAA TCGTTGATAT TTTCGCCCGC GAAATTTTGG ACTCACGCGG
  51 CAACCCCACA GTCGAGTGTG ATGTATTGCT CGAATCCGGC GTAATGGGAC
 101 GTGCGGCCGT ACCGAGCGGC GCATCCACCG GTCAGAAAGA AGCTTTGGAA
 151 CTTCGCGACG GCGACAAATC CCGCTATTCC GGCAAAGGCG TATTGAAGGC
 201 CGTCGAACAC GTCAACAACC AAATCGCCCA AGCCCTCATC GGTATCGATG
 251 CCAACGAGCA ATCTTATATC GACCAAATCA TGATCGAATT GGACGGTACT
 301 GAAAACAAAG GCAATTTGGG TGCGAATGCG ACTTTGGCGG TCTCTATGGC
 351 GGTTGCACGC GCCGCTGCCG AAGACTCAGG CCTGCCGCTT TACCGCTACT
 401 TGGGGGGCGC AGGTCCGATG TCCCTGCCCG TACCGATGAT GAACGTCATC
 451 AACGGCGGCG AACACGCCAA CAACAGCCTG AACATCCAAG AGTTTATGAT
 501 TATGCCCGTC GGCGCAAAAT CTTTCCGCGA AGCGTTGCGC TGCGGTGCGG
 551 AAATTTTCCA CGCCTTGAAA AAACTGTGCG ACAGTAAAGG CTTCCCGACC
 601 ACAGTCGGCG ACGAAGGCGG TTTCGCCCCC AACCTGAACA GCCACAAAGA
 651 AGCCCTGCAA CTGATGGTCG AAGCGGCCGA AGCCGCCGGC TACAAGGCGG
 701 GCGAAGACGT ATTATTCGCA TTGGACTGCG CGTCCAGCGA GTTCTACAAA
 751 GACGGCAAAT ACCACTTGGA AGCCGAAGGC CGCTCCTACA CCAACGCGGA
 801 ATTTGCCGAA TACTTGGAAG GCTTGGTTAA CGAATTCCCG ATTATTTCCA
 851 TTGAAGACGG GATGGACGAA AACGACTGGG AAGGCTGGAA ACTGCTGACC
 901 GAAAAATTGG GCAAAAAAGT TCAATTGGTC GGCGACGACT TGTTCGTAAC
 951 CAATCCGAAA ATTCTTGCCG AAGGCATCGA AAAAGGCGTA GCAAACGCAT
1001 TGCTGGTCAA AGTCAACCAA ATCGGTACTT TAAGCGAAAC CCTGAAAGCC
1051 GTCGATCTGG CAAAATGCAA CCGCTACGCC AGCGTGATGA GCCACCGCTC
1101 CGGCGAAACC GAAGACAGTA CCATTGCCGA CTTGGCAGTC GCCACCAACT
1151 GTATGCAGAT TAAAACCGGT TCTTTGAGCC GTTCCGACCG CATGGCGAAA
1201 TACAACCAAC TGCTGCGTAT CGAGGAAGAA TTGGCGGAAG CCGCCTACTA
1251 CCCCGGCAAA GCCGCATTCT ACCAACTGGG CAAATAA
```

This corresponds to the amino acid sequence <SEQ ID 2112; ORF 652-1.ng>:

g652-1.pep

```
 1 MSAIVDIFAR EILDSRGNPT VECDVLLESG VMGRAAVPSG ASTGQKEALE
51 LRDGDKSRYS GKGVLKAVEH VNNQIAQALI GIDANEQSYI DQIMIELDGT
```

-continued

```
101 ENKGNLGANA TLAVSMAVAR AAAEDSGLPL YRYLGGAGPM SLPVPMMNVI
151 NGGEHANNSL NIQEFMIMPV GAKSFREALR CGAEIFHALK KLCDSKGFPT
201 TVGDEGGFAP NLNSHKEALQ LMVEAAEAAG YKAGEDVLFA LDCASSEFYK
251 DGKYHLEAEG RSYTNAEFAE YLEGLVNEFP IISIEDGMDE NDWEGWKLLT
301 EKLGKKVQLV GDDLFVTNPK ILAEGIEKGV ANALLVKVNQ IGTLSETLKA
351 VDLAKCNRYA SVMSHRSGET EDSTIADLAV ATNCMQIKTG SLSRSDRMAK
401 YNQLLRIEEE LAEAAYYPGK AAFYQLGK*
```

The following partial DNA sequence was identified in *N. meningitidis* <SEQ ID 2113>:

m652-1.seq

```
   1 ATGAGCGCAA TCGTTGATAT TTTCGCCCGC GAAATTTTGG ACTCACGCGG
  51 CAACCCCACA GTCGAGTGTG ATGTATTGCT CGAATCCGGC GTAATGGGAC
 101 GCGCAGCCGT ACCGAGCGGC GCGTCCACCG GTCAAAAAGA GGCTTTGGAA
 151 CTTCGCGACG GCGACAAATC CCGTTATTCG GGCAAGGGCG TATTGAAGGC
 201 GGTCGAACAC GTCAACAACC AAATCGCCCA AGCCCTCATT GGTATCGATG
 251 CCAACGAGCA ATCTTATATC GACCAAATCA TGATCGAATT GGACGGTACT
 301 GAAAACAAAG GCAATTTGGG TGCGAATGCG ACTTTGGCGG TTTCTATGGC
 351 GGTTGCACGC GCCGCTGCCG AAGACTCAGG CCTGCCGCTT TACCGCTACT
 401 TGGGCGGCGC AGGCCCGATG TCCCTGCCCG TACCGATGAT GAACGTCATC
 451 AACGGCGGCG AACACGCCAA CAACAGCCTG AACATCCAAG AGTTTATGAT
 501 TATGCCCGTC GGCGCAAAAT CTTTCCGCGA AGCGTTGCGC TGCGGTGCGG
 551 AAATTTTCCA CGCCTTGAAA AAACTGTGCG ACAGCAAAGG CTTCCCGACC
 601 ACAGTCGGCG ACGAAGGCGG TTTCGCCCCC AACCTGAACA GCCACAAAGA
 651 AGCCCTGCAA CTGATGGTCG AGGCGACCGA AGCCGCCGGC TACAAAGCGG
 701 GCGAAGACGT ATTATTCGCA TTGGACTGCG CCTCCAGCGA GTTCTACAAA
 751 GACGGCAAAT ACCACTTGGA AGCCGAAGGC CGCTCCTACA CCAACGCGGA
 801 ATTTGCCGAA TATCTGGAAG GCCTGGTCAA CGAGTTCCCC ATCATCTCCA
 851 TCGAAGACGG CATGGATGAA AACGACTGGG AAGGCTGGAA ACTGCTGACC
 901 GAAAAACTGG GCGGTAGAGT TCAATTGGTT GGCGACGACT TGTTCGTAAC
 951 CAATCCAAAA ATCTTGGCCG AAGGCATCGA AAAAGGCGTA GCAAACGCAT
1001 TGCTGGTCAA AGTCAATCAA ATCGGTACTT TGAGCGAGAC CCTGAAAGCC
1051 GTCGACTTAG CCAAACGCAA CCGCTACGCC AGCGTAATGA GCCACCGCTC
1101 CGGCGAAACC GAAGACAGCA CCATTGCCGA CTTGGCAGTC GCCACCAACT
1151 GTATGCAGAT CAAAACCGGT TCTTTGAGCC GTTCCGACCG CATGGCGAAA
1201 TACAACCAAC TGCTGCGTAT CGAGGAAGAA TTGGCGGAAG CCGCCGACTA
1251 CCCCAGCAAA GCCGCATTCT ACCAACTGGG CAAATAA
```

This corresponds to the amino acid sequence <SEQ ID 2114; ORF 652-1>:

m652-1.pep

```
  1 MSAIVDIFAR EILDSRGNPT VECDVLLESG VMGRAAVPSG ASTGQKEALE

 51 LRDGDKSRYS GKGVLKAVEH VNNQIAQALI GIDANEQSYI DQIMIELDGT

101 ENKGNLGANA TLAVSMAVAR AAAEDSGLPL YRYLGGAGPM SLPVPMMNVI

151 NGGEHANNSL NIQEFMIMPV GAKSFREALR CGAEIFHALK KLCDSKGFPT

201 TVGDEGGFAP NLNSHKEALQ LMVEATEAAG YKAGEDVLFA LDCASSEFYK

251 DGKYHLEAEG RSYTNAEFAE YLEGLVNEFP IISIEDGMDE NDWEGWKLLT

301 EKLGGRVQLV GDDLFVTNPK ILAEGIEKGV ANALLVKVNQ IGTLSETLKA

351 VDLAKRNRYA SVMSHRSGET EDSTIADLAV ATNCMQIKTG SLSRSDRMAK

401 YNQLLRIEEE LAEAADYPSK AAFYQLGK*
```

m652-1/g652-1 98.6% identity in 428 aa overlap

```
                 10        20        30        40        50        60
m652-1   MSAIVDIFAREILDSRGNPTVECDVLLESGVMGRAAVPSGASTGQKEALELRDGDKSRYS
         ||||||||||||||||||||||||||||||||||||||||||||||||||||||||||||
g652-1   MSAIVDIFAREILDSRGNPTVECDVLLESGVMGRAAVPSGASTGQKEALELRDGDKSRYS
                 10        20        30        40        50        60

                 70        80        90       100       110       120
m652-1   GKGVLKAVEHVNNQIAQALIGIDANEQSYIDQIMIELDGTENKGNLGANATLAVSMAVAR
         ||||||||||||||||||||||||||||||||||||||||||||||||||||||||||||
g652-1   GKGVLKAVEHVNNQIAQALIGIDANEQSYIDQIMIELDGTENKGNLGANATLAVSMAVAR
                 70        80        90       100       110       120

                130       140       150       160       170       180
m652-1   AAAEDSGLPLYRYLGGAGPMSLPVPMMNVINGGEHANNSLNIQEFMIMPVGAKSFREALR
         ||||||||||||||||||||||||||||||||||||||||||||||||||||||||||||
g652-1   AAAEDSGLPLYRYLGGAGPMSLPVPMMNVINGGEHANNSLNIQEFMIMPVGAKSFREALR
                130       140       150       160       170       180

                190       200       210       220       230       240
m652-1   CGAEIFHALKKLCDSKGFPTTVGDEGGFAPNLNSHKEALQLMVEATEAAGYKAGEDVLFA
         |||||||||||||||||||||||||||||||||||||||||||||:||||||||||||||
g652-1   CGAEIFHALKKLCDSKGFPTTVGDEGGFAPNLNSHKEALQLMVEAAEAAGYKAGEDVLFA
                190       200       210       220       230       240

                250       260       270       280       290       300
m652-1   LDCASSEFYKDGKYHLEAEGRSYTNAEFAEYLEGLVNEFPIISIEDGMDENDWEGWKLLT
         ||||||||||||||||||||||||||||||||||||||||||||||||||||||||||||
g652-1   LDCASSEFYKDGKYHLEAEGRSYTNAEFAEYLEGLVNEFPIISIEDGMDENDWEGWKLLT
                250       260       270       280       290       300

                310       320       330       340       350       360
m652-1   EKLGGRVQLVGDDLFVTNPKILAEGIEKGVANALLVKVNQIGTLSETLKAVDLAKRNRYA
         |||| :||||||||||||||||||||||||||||||||||||||||||||||||| ||||
g652-1   EKLGKKVQLVGDDLFVTNPKILAEGIEKGVANALLVKVNQIGTLSETLKAVDLAKCNRYA
                310       320       330       340       350       360

                370       380       390       400       410       420
m652-1   SNMSHRSGETEDSTIADLAVATNCMQIKTGSLSRSDRMAKYNQLLRIEEELAEAADYPSK
         ||||||||||||||||||||||||||||||||||||||||||||||||||||||| ||:|
g652-1   SNMSHRSGETEDSTIADLAVATNCMQIKTGSLSRSDRMAKYNQLLRIEEELAEAAYYPGK
                370       380       390       400       410       420

                429
m652-1   AAFYQLGKX
         |||||||||
g652-1   AAFYQLGKX
```

The following partial DNA sequence was identified in *N. meningitidis* <SEQ ID 2115>:

a652-1.seq

```
  1 ATGAGCGCAA TCGTTGATAT TTTCGCCCGC GAAATTTTGG ACTCACGCGG

 51 CAACCCCACA GTCGAGTGTG ATGTATTGCT CGAATCCGGC GTAATGGGAC

101 GCGCAGCCGT ACCGAGCGGC GCGTCCACCG GTCAAAAAGA GGCTTTGGAA
```

-continued

```
 151 CTTCGCGACG GCGACAAATC CCGTTATTCG GGCAAGGGCG TATTGAAGGC

 201 GGTCGAACAC GTCAACAACC AAATCGCCCA AGCCCTCATT GGTATCGATG

 251 CCAACGAGCA ATCTTATATC GACCAAATCA TGATCGAATT GGACGGTACT

 301 GAAAACAAAG GCAATTTGGG TGCGAATGCG ACTTTGGCGG TTTCTATGGC

 351 GGTTGCACGC GCCGCTGCCG AAGACTCAGG CCTGCCGCTT TACCGCTACT

 401 TGGGCGGCGC AGGCCCGATG TCCCTGCCCG TACCGATGAT GAACGTCATC

 451 AACGGCGGCG AACACGCCAA CAACAGCCTG AACATCCAAG AGTTTATGAT

 501 TATGCCCGTC GGCGCAAAAT CTTTCCGCGA AGCGTTGCGC TGCGGTGCGG

 551 AAATTTTCCA CGCCTTGAAA AAACTGTGCG ACAGCAAAGG CTTCCCGACC

 601 ACAGTCGGCG ACGAAGGCGG TTTCGCCCCC AACCTGAACA GCCACAAAGA

 651 AGCCCTGCAA CTGATGGTCG AGGCGACCGA AGCCGCCGGC TACAAAGCGG

 701 GCGAAGACGT ATTATTCGCA TTGGACTGCG CGTCCAGCGA GTTCTACAAA

 751 GACGGCAAAT ACCACTTGGA AGCCGAAGGC CGCTCCTACA CCAACGCGGA

 801 ATTTGCCGAA TATCTGGAAG GCCTGGTCAA CGAGTTCCCC ATCATCTCCA

 851 TCGAAGACGG GATGGATGAA AACGACTGGG AAGGCTGGAA ACTGCTGACC

 901 GAAAAACTGG GCGGCAAAGT CCAACTCGTT GGCGACGACC TCTTCGTTAC

 951 CAACCCGAAA ATCCTTGCCG AAGGCATTGA AAAAGGCGTG GCAAACGCAC

1001 TATTGGTCAA AGTCAACCAA ATCGGTACTT TGAGTGAAAC CCTGAAAGCC

1051 GTCGACTTAG CCAAACGCAA CCGCTACGCC AGCGTAATGA GCCACCGCTC

1101 CGGCGAAACC GAAGACAGCA CCATTGCCGA CTTGGCAGTC GCCACCAACT

1151 GTATGCAGAT CAAAACCGGT TCTTTGAGCC GTTCCGACCG CATGGCGAAA

1201 TACAACCAAC TGCTGCGTAT CGAGGAAGAA TTGGCGGAAG CCGCCGACTA

1251 CCCCAGCAAA GCCGCATTCT ACCAACTGGG CAAATAA
```

This corresponds to the amino acid sequence <SEQ ID 2116; ORF 652-1.a>:

<u>a652-1.pep</u>

```
  1 MSAIVDIFAR EILDSRGNPT VECDVLLESG VMGRAAVPSG ASTGQKEALE

 51 LRDGDKSRYS GKGVLKAVEH VNNQIAQALI GIDANEQSYI DQIMIELDGT

101 ENKGNLGANA TLAVSMAVAR AAAEDSGLPL YRYLGGAGPM SLPVPMMNVI

151 NGGEHANNSL NIQEFMIMPV GAKSFREALR CGAEIFHALK KLCDSKGFPT

201 TVGDEGGFAP NLNSHKEALQ LMVEATEAAG YKAGEDVLFA LDCASSEFYK

251 DGKYHLEAEG RSYTNAEFAE YLEGLVNEFP IISIEDGMDE NDWEGWKLLT

301 EKLGGKVQLV GDDLFVTNPK ILAEGIEKGV ANALLVKVNQ IGTLSETLKA

351 VDLAKRNRYA SVMSHRSGET EDSTIADLAV ATNCMQIKTG SLSRSDRMAK

401 YNQLLRIEEE LAEAADYPSK AAFYQLGK*
```

m652-1/a652-1 99.8% identity in 428 aa overlap

```
             10         20         30         40         50         60
m652-1  MSAIVDIFAREILDSRGNPTVECDVLLESGVMGRAAVPSGASTGQKEALEIRDGDKSRYS
        ||||||||||||||||||||||||||||||||||||||||||||||||||||||||||||
a652-1  MSAIVDIFAREILDSRGNPTVECDVLLESGVMGRAAVPSGASTGQKEALEIRDGDKSRYS
             10         20         30         40         50         60

             70         80         90        100        110        120
m652-1  GKGVLKAVEHVNNQIAQALIGIDANEQSYIDQIMIELDGTENKGNLGANATLAVSMAVAR
        ||||||||||||||||||||||||||||||||||||||||||||||||||||||||||||
a652-1  GKGVLKAVEHVNNQIAQALIGIDANEQSYIDQIMIELDGTENKGNLGANATLAVSMAVAR
             70         80         90        100        110        120

            130        140        150        160        170        180
m652-1  AAAEDSGLPLYRYLGGAGPMSLPVPMMNVINGGEHANNSLNIQEFMIMPVGAKSFREALR
        ||||||||||||||||||||||||||||||||||||||||||||||||||||||||||||
a652-1  AAAEDSGLPLYRYLGGAGPMSLPVPMMNVINGGEHANNSLNIQEFMIMPVGAKSFREALR
            130        140        150        160        170        180

            190        200        210        220        230        240
m652-1  CGAEIFHALKKLCDSKGFPTTVGDEGGFAPNLNSHKEALQLMVEATEAAGYKAGEDVLFA
        ||||||||||||||||||||||||||||||||||||||||||||||||||||||||||||
a652-1  CGAEIFHALKKLCDSKGFPTTVGDEGGFAPNLNSHKEALQLMVEATEAAGYKAGEDVLFA
            190        200        210        220        230        240

            250        260        270        280        290        300
m652-1  LDCASSEFYKDGKYHLEAEGRSYTNAEFAEYLEGLVNEFPIISIEDGMDENDWEGWKLLT
        ||||||||||||||||||||||||||||||||||||||||||||||||||||||||||||
a652-1  LDCASSEFYKDGKYHLEAEGRSYTNAEFAEYLEGLVNEFPIISIEDGMDENDWEGWKLLT
            250        260        270        280        290        300

            310        320        330        340        350        360
m652-1  EKLGGRVQLVGDDLFVTNPKILAEGIEKGVANALLVKVNQIGTLSETLKAVDLAKRNRYA
        |||||:||||||||||||||||||||||||||||||||||||||||||||||||||||||
a652-1  EKLGGKVQLVGDDLFVTNPKILAEGIEKGVANALLVKVNQIGTLSETLKAVDLAKRNRYA
            310        320        330        340        350        360

            370        380        390        400        410        420
m652-1  SNMSHRSGETEDSTIADLAVATNCMQIKTGSLSRSDRMAKYNQLLRIEEELAEAADYPSK
        ||||||||||||||||||||||||||||||||||||||||||||||||||||||||||||
a652-1  SNMSHRSGETEDSTIADLAVATNCMQIKTGSLSRSDRMAKYNQLLRIEEELAEAADYPSK
            370        380        390        400        410        420

            429
m652-1  AAFYQLGKX
        |||||||||
a652-1  AAFYQLGKX
```

The following partial DNA sequence was identified in *N. gonorrhoeae* <SEQ ID 2117>:

g653.seq

```
  1 ATGGCGGcgg aaccgatgcg gAtgccggag gtaAcgtaCG GTTTTTCCGG

 51 ATCGTTCGGG ATGGCGTTTT TGTtgacggT GATGTGCGCt ttgcccaAAG

101 CGGCTtcggc ggctttgcCg gtgaTTTTCA TCGGTTGCAG GtcgacgaGG

151 AAaacgTGGC TTTCGGTGCG GCCGGAAacg atgcgCaaac cgCGTttaac

201 caactcttcc gcCATGACGG CAGCATTGAT TTTCACTTGT TTTGCGTATT

251 GTTTGAactC GGGTTGcaac gcttctTTAA acgctACGGC TttgGCGGCG

301 ATAACGTgca tcaACGGAcc gCCTTGCAGG CTTGGGAAGA TGGAAGAGTT

351 CAGCGCTTTT TCGTGGGTAT TGTCACGGCA CAAAATCACA CCGCCGCGAG

401 GGCCGCGTAG GGTTTTGTGG GTGGTAGTGg ttACgaaGTc GCAGAatggc

451 ACGGGgttag gatattcgcc gccGGCAACC AgtccgGCAT Ag
```

This corresponds to the amino acid sequence <SEQ TD 2118; ORF 653.ng>:

g653.pep

```
  1 MAAEPMRMPE VTYGFSGSFG MAFLLTVMCA LPKAASAALP VIFIGCRSTR

 51 KTWLSVRPET MRKPRLTNSS AMTAALIFTC FAYCLNSGCN ASLNATALAA
```

-continued

```
101 ITCINGPPCR LGKMEEFSAF SWVLSRHKIT PPRGPRRVLW VVVVTKSQNG

151 TGLGYSPPAT SPA*
```

The following partial DNA sequence was identified in *N. meningitidis* <SEQ ID 2119>:

m653.seq

```
  1 ATGGCAGCGG AGCCGATGCG GATGCCGGAG GTAACGAAGG GTTTTTCCGG

 51 ATCGTTCGGA ATGGCGTTTT TGTTGACGGT GATGTGCGCT TTGCCCAAAG

101 CGGCTTCGGC GGCTTTGCCG GTAATTTTCA TCGGTTGCAG GTCAACGAGG

151 AAAACGTGGC TTTCGGTGCG GCCGGAAACG ATGCGCAAAC CGCGTTTAAC

201 CAACTCTTCC GCCATGGCGG CTGCATTGAT TTTCACTTGT TTTGCGTATT

251 GTTTGAACTC GGGTTGCAAT GCTTCTTTAA ACGCCACGGC TTTGGCGGCG

301 ATAACGTGCA TCAGCGGACC GCCTTGCAGG CTTGGGAAGA TGGAAGAGTT

351 CAACGCTTTT TCGTGGGTAT TGTCGCGGCA CAAAATTACG CCGCCGCGAG

401 GACCGCGCAG GGTTTTGTGG GTGGTGGTGG TCACGAAGTC GCAGAACGGC

451 ACCGGGTTGG GATATTCGCC GCCGGCAACC AGACCGGCAT AG
```

This corresponds to the amino acid sequence <SEQ ID 2120; ORF 653>:

m653.pep

```
  1 MAAEPMRMPE VTKGFSGSFG MAFLLTVMCA LPKAASAALP VIFIGCRSTR

 51 KTWLSVRPET MRKPRLTNSS AMAAALIFTC FAYCLNSGCN ASLNATALAA

101 ITCISGPPCR LGKMEEFNAF SWVLSRHKIT PPRGPRRVLW VVVVTKSQNG

151 TGLGYSPPAT RPA*
```

m653/g653 96.9% identity in 163 aa overlap

```
                    10        20        30        40        50        60
m653.pep    MAAEPMRMPEVTKGFSGSFGMAFLLTVMCALPKAASAALPVIFIGCRSTRKTWLSVRPET
            |||||||||||| |||||||||||||||||||||||||||||||||||||||||||||||
g653        MAAEPMRMPEVTYGFSGSFGMAFLLTVMCALPKAASAALPVIFIGCRSTRKTWLSVRPET
                    10        20        30        40        50        60

                    70        80        90       100       110       120
m653.pep    MRKPRLTNSSAMAAALIFTCFAYCLNSGCNASLNATALAAITCISGPPCRLGKMEEFNAF
            ||||||||||||:|||||||||||||||||||||||||||||||:||||||||||||:||
g653        MRKPRLTNSSAMTAALIFTCFAYCLNSGCNASLNATALAAITCINGPPCRLGKMEEFSAF
                    70        80        90       100       110       120

                   130       140       150       160
m653.pep    SWVLSRHKITPPRGPRRVLWVVVVTKSQNGTGLGYSPPATRPAX
            |||||||||||||||||||||||||||||||||||||||| |||
g653        SWVLSRHKITPPRGPRRVLWVVVVTKSQNGTGLGYSPPATSPAX
                   130       140       150       160
```

The following partial DNA sequence was identified in *N. meningitidis* <SEQ ID 2121>:

a653.seq

```
  1 ATGGCGGCGG AACCGATGCG GATGCCGGAG GTAACGAAGG GTTTTTCCGG
 51 ATCATTCGGG ATGGCGTTTT TGTTGACAGT GATGTGCGCT TTGCCCAAAG
101 CAGCTTCGGC GGCTTTGCCG GTAATTTTCA TCGGTTGCAG GTCAACGAGG
151 AAAACGTGGC TTTCGGTGCG GCCGGAAACG ATGCGCAAAC CGCGTTTAAC
201 CAACTCTTCC GCCATGGCGG CTGCATTGAT TTTCACTTGT TTTGCGTATT
251 GTTTGAACTC GGGTTGCAAT GCTTCTTTAA ACGCCACGGC TTTGGCGGCG
301 ATAACGTGCA TCAGCGGGCC ACCTTGCAGG CTTGGGAAGA TGGAAGAGTT
351 CAACGCTTTT TCGTGGGTAT TGTCGCGGCA CAAAATTACG CCGCCGCGAG
401 GACCGCGCAG GGTTTTGTGG GTGGTGGTGG TAACGAAGTC GCAGAACGGC
451 ACGGGATTGG GATATTCGCC GCCGGCAACC AGACCGGCAT AG
```

This corresponds to the amino acid sequence <SEQ ID 2122; ORF 653.a>:

a653.pep

```
  1 MAAEPMRMPE VTKGFSGSFG MAFLLTVMCA LPKAASAALP VIFIGCRSTR
 51 KTWLSVRPET MRKPRLTNSS AMAAALIFTC FAYCLNSGCN ASLNATALAA
101 ITCISGPPCR LGKMEEFNAF SWVLSRHKIT PPRGPRRVLW VVVVTKSQNG
151 TGLGYSPPAT RPA*
```

m653/a653 100.0% identity in 163 aa overlap

```
                    10        20        30        40        50        60
m653.pep    MAAEPMRMPEVTKGFSGSFGMAFLLTVMCALPKAASAALPVIFIGCRSTRKTWLSVRPET
            ||||||||||||||||||||||||||||||||||||||||||||||||||||||||||||
a653        MAAEPMRMPEVTKGFSGSFGMAFLLTVMCALPKAASAALPVIFIGCRSTRKTWLSVRPET
                    10        20        30        40        50        60

                    70        80        90       100       110       120
m653.pep    MRKPRLTNSSAMAAALIFTCFAYCLNSGCNASLNATALAAITCISGPPCRLGKMEEFNAF
            ||||||||||||||||||||||||||||||||||||||||||||||||||||||||||||
a653        MRKPRLTNSSAMAAALIFTCFAYCLNSGCNASLNATALAAITCISGPPCRLGKMEEFNAF
                    70        80        90       100       110       120

                   130       140       150       160
m653.pep    SWVLSRHKITPPRGPRRVLWVVVVTKSQNGTGLGYSPPATRPAX
            ||||||||||||||||||||||||||||||||||||||||||||
a653        SWVLSRHKITPPRGPRRVLWVVVVTKSQNGTGLGYSPPATRPAX
                   130       140       150       160
```

The following partial DNA sequence was identified in *N. gonorrhoeae* <SEQ ID 2123>:

g656.seq

```
  1 ATGCCGCGTT TCTCCGGTTC GATTTCTTCG ATGATTTCCA TCGCGCGGAC
 51 TTTtggcGCG CCGGAGAGTG TGCcggcagg gAAGGTGGCG GCGAGGATGT
101 CCATATTGGT AACGCCCTCT TTCAAACAGc ctTCGACGTT GGAAACGATG
151 TGCATCACAT GGGACTATTT TTCAATCACC ATTTTGTCGG TGACTTTGAC
201 TTCGCCTGTT TTGCTGATGC GTCCGACATC GTTGCGCCCC AAATCGATAA
251 GCATAACGTG TTCGGCgatt TCTTTGGCGT CGCTTAACAA ATCTTGTTCG
```

-continued

```
301 TTGGCAAGGT CTTCGGCGGG GGTTTTGCCG CGCAGGCGCG TGCCGGCGAT

351 GGGGCGGACG ATGACGTcat CGCGTTCGCG GCGGACGAGG ATTTCGGGCG

401 AGGAACCGAC GATGTGGAAA TCGCCGAAAT CGTAG
```

This corresponds to the amino acid sequence <SEQ ID 2124; ORF 656.ng>:

g656.pep

```
  1 MPRFSGSISS MISIARTFGA PESVPAGKVA ARMSILVTPS FKQPSTLETM

 51 CITWEYFSIT ILSVTLTSPV LLMRPTSLRP KSISITCSAI SLASLNKSCS

101 LARSSAGVLP RRRVPAMGRT MTSSRSRRTR ISGEEPTMWK SPKS*
```

The following partial DNA sequence was identified in *N. meningitidis* <SEQ ID 2125>:

m656.seq

```
  1 ATGCCGCGTT TGCTCGGTTC GACTTCTTCG ATGATTTCCA TGGCGCGGAC

 51 TTTGGGTGCG CCGGAGAGTG TGCCGGCAGG GAAGGTAGCG GCGAGGATGT

101 CCATGTTGGT CATGCCGTCT TTCAGACGGC CTTCGACGTT GGAAACGATG

151 TGCATTACAT GGGAGTATTT TTCAATCACC ATTTTGTCGG TAACTTTGAC

201 TTCGCCGGTT TTACTGATGC GGCCGACGTC GTTGCGTCCT AAGTCAATCA

251 ACATGACGTG TTCGGCGATT TCTTTGGCAT CGCTTAACAA ATCTTGTTCG

301 TTGGCAAGGT CTTCGGCGGG GGTTTTGCCG CGCAGGCGCG TGCCGGCGAT

351 GGGGCGGACG ATAACGTCGT TGCGTTCGCG TCGGACGAGG ATTTCGGGCG

401 AGGAGCCGAC GATGTGGAAA TCGCCGAAAT CGTAG
```

This corresponds to the amino acid sequence <SEQ ID 2126; ORF 656>:

m656.pep

```
  1 MPRLLGSTSS MISMARTLGA PESVPAGKVA ARMSMLVMPS FRRPSTLETM

 51 CITWEYFSIT ILSVTLTSPV LLMRPTSLRP KSINMTCSAI SLASLNKSCS

101 LARSSAGVLP RRRVPAMGRT ITSLRSRRTR ISGEEPTMWK SPKS*
```

Computer analysis of this amino acid sequence gave the following results:

Homology with a predicted ORF from *N. gonorrhoeae*
m656/g656 91.0% identity in 144 aa overlap

```
                    10        20        30        40        50        60
m656.pep    MPRLLGSTSSMISMARTLGAPESVPAGKVAARMSMLVMPSFRRPSTLETMCITWEYFSIT
            |||:  || |||||:|||:||||||||||||||||:|| |||::||||||||||||||||
g656        MPRFSGSISSMISIARTFGAPESVPAGKVAARMSILVTPSFKQPSTLETMCITWEYFSIT
                    10        20        30        40        50        60

                    70        80        90       100       110       120
m656.pep    ILSVTLTSPVLLMRPTSLRPKSINMTCSAISLASLNKSCSLARSSAGVLPRRRVPAMGRT
            ||||||||||||||||||||||::||||||||||||||||||||||||||||||||||||
g656        ILSVTLTSPVLLMRPTSLRPKSISITCSAISLASLNKSCSLARSSAGVLPRRRVPAMGRT
                    70        80        90       100       110       120
```

-continued

```
               130       140
m656.pep  ITSLRSRRTRISGEEPTMWKSPKSX
          :|| |||||||||||||||||||||
g656      MTSSRSRRTRISGEEPTMWKSPKSX
               130       140
```

The following partial DNA sequence was identified in *N. meningitidis* <SEQ ID 2127>:

a656.seq

```
  1 ATGCCGCGTT TGCTCGGTTC GACTTCTTCG ATGATTTCCA TGGCGCGGAC
 51 TTTGGGTGCG CCGGAGAGTG TGCCGGCAGG GAAGGTAGCG GCGAGGATGT
101 CCATGTTGGT CATGCCGTCT TTCAGACGGC CTTCGACGTT GGAAACGATG
151 TGCATTACAT GGGAGTATTT TTCAATCACC ATTTTGTCGG TAACTTTGAC
201 TTCGCCGGTT TTACTGATGC GGCCGACGTC GTTGCGTCCT AAGTCAATCA
251 ACATGACGTG TTCGGCGATT TCTTTGGCAT CGCTTAACAA ATCTTGTTCG
301 TTGGCAAGGT CTTCGGCGGG GGTTTTGCCG CGCAGGCGCG TGCCGGCGAT
351 GGGGCGGACG ATGACATCGT CGCGTTCGCG GCGGACGAGG ATTTCGGGCG
401 AGGAGCCGAC GATGTGGAAA TCGCCGAAAT CGTAG
```

This corresponds to the amino acid sequence <SEQ ID 2128; ORF 656.a>:

a656.pep

```
  1 MPRLLGSTSS MISMARTLGA PESVPAGKVA ARMSMLVMPS FRRPSTLETM
 51 CITWEYFSIT ILSVTLTSPV LLMRPTSLRP KSINMTCSAI SLASLNKSCS
101 LARSSAGVLP RRRVPAMGRT MTSSRSRRTR ISGEEPTMWK SPKS*
```

m656/a656 98.6% identity in 144 aa overlap

```
                  10        20        30        40        50        60
m656.pep  MPRLLGSTSSMISMARTLGAPESVPAGKVAARMSMLVMPSFRRPSTLETMCITWEYFSIT
          ||||||||||||||||||||||||||||||||||||||||||||||||||||||||||||
a656      MPRLLGSTSSMISMARTLGAPESVPAGKVAARMSMLVMPSFRRPSTLETMCITWEYFSIT
                  10        20        30        40        50        60

                  70        80        90       100       110       120
m656.pep  ILSVTLTSPVLLMRPTSLRPKSINMTCSAISLASLNKSCSLARSSAGVLPRRRVPAMGRT
          ||||||||||||||||||||||||||||||||||||||||||||||||||||||||||||
a656      ILSVTLTSPVLLMRPTSLRPKSINMTCSAISLASLNKSCSLARSSAGVLPRRRVPAMGRT
                  70        80        90       100       110       120

               130       140
m656.pep  ITSLRSRRTRISGEEPTMWKSPKSX
          :|| ||||||||||||||||||||
a656      MTSSRSRRTRISGEEPTMWKSPKSX
               130       140
```

The following partial DNA sequence was identified in *N. gonorrhoeae* <SEQ ID 2129>:

g657.seq

```
  1 ATGAACACAC CCCCCATCCT TCCTCCCGCC ATGCTCGGCA TCCTCGGCGG
 51 CGGACAATTa ggcagAATGT TTGCCGTTGC CGCTAAAACC ATGGGCTACA
```

-continued

```
 101 AAGTAACCGT TCTCGATCCC GACCCGAATG CGCCGGCGGC GGAATTTGCC
 151 GACCGCCATT TGTGCGCGCC GTTTGACGAC CGGGCCGCGT TGGACGAATT
 201 GGCAAAATGC GCGGCGGTta cgACCGAATT TGAAAacgtc aaTGCCGACG
 251 CGATGCGCTC TCTGGCAAAG CATACCAACG TTTCCCCCAG CGGCGACTGC
 301 GTGTCCATTG CACAAAACCG CATTCAGGAA AAAGCGTGGA TACGCAAAGC
 351 AGGCTTGCAA ACCGCGCCGT ATCAGGCGGT TTGCAAGGCC GAAGACATTA
 401 CTGAAGCAAG CGCGCAATTT TTGCCCGGCA TCCTGAAAAC GGCTACGTTG
 451 GGCTACGACG GCAAAGGTCA AATCCGCGTC AAAACGTTGG ACGAACTCAA
 501 AGCCGCGTTT GCCGAACACG GCGGCGTGGA TTGCGTTTTG GAAAAAATGG
 551 TGGACTTGCG CGGCGAGATT TCCGTGATCG TATGCCGTCT GAACGATGAA
 601 AACGTGCAAA CCTTCGACCC CGCCGAAAAC ATCCACGAAA ACGGCATCTT
 651 GGCTTattcC ATCGTCcccg CGCGGCTGAG TGCCGACGTG CAGCAACAGG
 701 CGCGGCAGAC GGCGCAACgc tTGGCGGACG AATTGGATTA TGTCGGCgta
 751 TTGGCGGTAG AAATGTTTGT TGTCGGCGAC ACACATGAAT TGCTCGTCAA
 801 TGAAACCGCC CCGCGCACGC ACAATTCCGG CCACCATACG ATAGATGCCT
 851 GCGCCGCAGA CCAGTTCCAA CAGCAGGTAC GCATTATGTG CAAcctGCCG
 901 cccGccgACA CCAAATTATT aTCCCCttgC TGTATGGCGA ATATTTTGGg
 951 CGACGTTTGG CAGGAAGATG GCGGCGAACC GGATTGGCTG CCGTTGCAAA
1001 GCCGGCCGAA TGCACACCTG CACCTATACG GAAAAAAAAC CGCACAGAAA
1051 GGTCGGAAAA TGGGACACTT TaccgTTTTG ACCACCGATT CGGACaccgC
1101 ATTTCAAGAA GCAAAAAAAC TGCATCAGTC CCTATAA
```

This corresponds to the amino acid sequence <SEQ ID 2130; ORF 657.ng>:

g657.pep

```
  1 MNTPPILPPA MLGILGGGQL GRMFAVAAKT MGYKVTVLDP DPNAPAAEFA
 51 DRHLCAPFDD RAALDELAKC AAVTTEFENV NADAMRSLAK HTNVSPSGDC
101 VSIAQNRIQE KAWIRKAGLQ TAPYQAVCKA EDITEASAQF LPGILKTATL
151 GYDGKGQIRV KTLDELKAAF AEHGGVDCVL EKMVDLRGEI SVIVCRLNDE
201 NVQTFDPAEN IHENGILAYS IVPARLSADV QQQARQTAQR LADELDYVGV
251 LAVEMFVVGD THELLVNETA PRTHNSGHHT IDACAADQFQ QQVRIMCNLP
301 PADTKLLSPC CMANILGDVW QEDGGEPDWL PLQSRPNAHL HLYGKKTAQK
351 GRKMGHFTVL TTDSDTAFQE AKKLHQSL*
```

The following partial DNA sequence was identified in *N. meningitidis* <SEQ ID 2131>:

m657.seq

```
  1 ATGAAAAACA TATCTCTTTC TCCGCCCGCC ATGCTTGGCA TCCTCGGCGG
 51 CGGACAATTA GGCAGAATGT TTACCGTTGC CGCCAAAACC ATGGGCTACA
101 AAGTAACCGT TCTCGACCCC GATCCGGACG CGCCGGCAGC AGAATTTGCC
```

-continued

```
 151 GACCGCCATT TGTGCGCGCC GTTTAACGAC CAAGCTGCTT TGGACGAATT
 201 GGCAAAATGC GCGGCGGTGA CCACTGAATT TGAAAACGTC AATGCCGATG
 251 CGATGCGCTT TTTGGCAAAA CATACCAATG TTTCCCCTAG CGGCGATTGT
 301 GTGGCGATTG CACAAAACCG CATTCAGGAA AAGGCATGGA TACGCAAAGC
 351 GGGATTGCAA ACCGCGCCGT ATCAAGTGGT TTGTAAGGCT GAAGACATCA
 401 CTGAAGCAAG CGCGCAATTT TTGCCCGGCA TCCTGAAAAC GGCTACGTTG
 451 GGCTACGACG GCAAAGGTCA AATCCGCGTA AAAACATTGG ATGAACTCAA
 501 AGCCGCGTTT GCCGAACACG GCGGCGTGGA TTGCGTTTTG GAAAAAATGG
 551 TGGATTTGCG CAGTGAAATT TCCGTAATCG TATGCCGTTT GAACAATGAC
 601 AACGTGCAAA CTTTCGACCC TGCCGAAAAC ATCCACGAAA ACGGCATCTT
 651 GGCTTATTCC ATCGTCCCCG CGCGACTGAG TGCCGACGTG CAGCAACAGG
 701 CGCGGCAGAT GGCGCAACGC TTGGCGGACG AATTGGATTA TGTCGGCGTA
 751 TTGGCGGTAG AAATGTTTGT TGTCGGTGAC ACGCATGAAT TGGTCGTCAA
 801 CGAAATCGCC CCGCGCCCGC ACAATTCCGG ACACCATACG ATAGATGCCT
 851 GCGCAGCAGA CCAGTTCCAG CAGCAGGTAC GCATTATGTG CAACCTGCCG
 901 CCTGCCGATA CCAAATTACT GAGTTCTTGC TGTATGGCAA ATATTTTGGG
 951 CGACGTTTGG CAGGAAGACG GCGGCGAACC GGATTGGCTG CCCTTGCAAA
1001 GCCATCCGAA TGCACACCTG CACCTTTACG GCAAAAAAAC CGCGCACAAA
1051 GGGCGGAAAA TGGGACACTT TACCGTTTTA ACCACCGATT CGGACACCGC
1101 ATTTCAAGAA GCAAAAAAAC TGCATCAGTC CCTATAA
```

This corresponds to the amino acid sequence <SEQ ID 2132; ORF 657>:

m657.pep

```
  1 MKNISLSPPA MLGILGGGQL GRMFTVAAKT MGYKVTVLDP DPDAPAAEFA
 51 DRHLCAPFND QAALDELAKC AAVTTEFENV NADAMRFLAK HTNVSPSGDC
101 VAIAQNRIQE KAWIRKAGLQ TAPYQVVCKA EDITEASAQF LPGILKTATL
151 GYDGKGQIRV KTLDELKAAF AEHGGVDCVL EKMVDLRSEI SVIVCRLNND
201 NVQTFDPAEN IHENGILAYS IVPARLSADV QQQARQMAQR LADELDYVGV
251 LAVEMFVVGD THELVVNEIA PRPHNSGHHT IDACAADQFQ QQVRIMCNLP
301 PADTKLLSSC CMANILGDVW QEDGGEPDWL PLQSHPNAHL HLYGKKTAHK
351 GRKMGHFTVL TTDSDTAFQE AKKLHQSL*
```

Computer analysis of this amino acid sequence gave the following results:

Homology with a predicted ORF from *N. gonorrhoeae* m657/g657 93.9% identity in 378 aa overlap

```
                    10        20        30        40        50        60
m657.pep   MKNISLSPPAMLGILGGGQLGRMFTVAAKTMGYKVTVLDPDPDAPAAEFADRHLCAPFND
           |::  :  ||||||||||||||||:||||||||||||||||:|||||||||||||||||:|
g657       MNTPPILPPAMLGILGGGQLGRMFAVAAKTMGYKVTVLDPDPNAPAAEFADRHLCAPFDD
                    10        20        30        40        50        60
```

-continued

```
                  70        80        90       100       110       120
m657.pep  QAALDELAKCAAVTTEFENVNADAMRFLAKHTNVSPSGDCVAIAQNRIQEKAWIRKAGLQ
          :||||||||||||||||||||||||| ||||||||||||||:||||||||||||||||||
g657      RAALDELAKCAAVTTEFENVNADAMRSLAKHTNVSPSGDCVSIAQNRIQEKAWIRKAGLQ
                  70        80        90       100       110       120

                 130       140       150       160       170       180
m657.pep  TAPYQVVCKAEDITEASAQFLPGILKTATLGYDGKGQIRVKTLDELKAAFAEHGGVDCVL
          |||||:||||||||||||||||||||||||||||||||||||||||||||||||||||||
g657      TAPYQAVCKAEDITEASAQFLPGILKTATLGYDGKGQIRVKTLDELKAAFAEHGGVDCVL
                 130       140       150       160       170       180

                 190       200       210       220       230       240
m657.pep  EKMVDLRSEISVIVCRLNNDNVQTFDPAENIHENGILAYSIVPARLSADVQQQARQMAQR
          |||||||:||||||||||::|||||||||||||||||||||||||||||||||||| |||
g657      EKMVDLRGEISVIVCRLNDENVQTFDPAENIHENGILAYSIVPARLSADVQQQARQTAQR
                 190       200       210       220       230       240

                 250       260       270       280       290       300
m657.pep  LADELDYVGVLAVEMFVVGDTHELVVNEIAPRPHNSGHHTIDACAADQFQQQVRIMCNLP
          ||||||||||||||||||||||||:||| ||| |||||||||||||||||||||||||||
g657      LADELDYVGVLAVEMFVVGDTHELLVNETAPRTHNSGHHTIDACAADQFQQQVRIMCNLP
                 250       260       270       280       290       300

                 310       320       330       340       350       360
m657.pep  PADTKLLSSCCMANILGDVWQEDGGEPDWLPLQSHPNAHLHLYGKKTAHKGRKMGHFTVL
          |||||||| |||||||||||||||||||||||||:||||||||||||||:||||||||||
g657      PADTKLLSPCCMANILGDVWQEDGGEPDWLPLQSRPNAHLHLYGKKTAQKGRKMGHFTVL
                 310       320       330       340       350       360

                 370      379
m657.pep  TTDSDTAFQEAKKLHQSLX
          ||||||||||||||||||
g657      TTDSDTAFQEAKKLHQSLX
                 370
```

The following partial DNA sequence was identified in *N. meningitidis* <SEQ ID 2133>:

a657.seq

```
  1 ATGAAAAACA TATCTCTTTC TCCGCCCGCC ATGCTCGGCA TTCTTGGCGG
 51 CGGACAATTA GGCAGAATGT TTACTGTTGC TGCCAAAACC ATGGGCTACA
101 AAGTAACCGT ACTCGATCCC AACCCGAATG CGCCGGCAGC GGAATTTGCC
151 GACCGCCATT TGTGTGCGCC GTTTGACAAC CAAACCGCTT TGGAAGAATT
201 GGCAAAATGT GCGGCTGTTA CGACCGAGTT CGAAAACGTC AATGCCGATG
251 CGATGCGTTT TCTCGCCAAA CATACCAATG TTTCCCCCAG CGGCGACTGC
301 GTTGCCATCG CGCAAAACCG CATTCAGGAA AAGGCATGGA TACGCAAAGC
351 AGGCCTGCAA ACCGCGCCGT ATCAAGCAAT TTGCAAAGCC GAAGACATCA
401 CTGAAGAAAG CATACAATTT CTGCCCGGCA TCCTGAAAAC CGCTACATTG
451 GGCTATGACG GCAAAGGCCA AATCCGCGTC AAAACGGTGG ATGAACTCAA
501 AGCCGCGTTT GCCGAACACC GCGGCGTGGA TTGCGTTTTG GAAAAAATGG
551 TGGACTTGCG CGGCGAAATT TCCGTTATCG TATGCCGTCT GAACAATGAC
601 AACGTGCAAA CTTTCGATCC TGCCGAAAAC ATTCACGAAA ACGGTATCCT
651 CGCCTACTCC ATCGTCCCAG CCCGACTGAG TGCCGACATT CAGCAACAGG
701 CGCGACAAAT GGCGCAGCGT TTGGCCGATG AATTGAACTA CGTCGGCGTA
751 TTGGCGGTAG AAATGTTTGT TGTCGGCGAC ACGCATGAAT TGGTCGTCAA
801 CGAAATCGCG CCGCGTCCGC ACAATTCCGG CCACCATACC GTCGACGCCT
851 GCGCGGCAGA CCAATTCCAG CAACAGGTCC GCCTGATGTG CAACCTGCCA
901 CCTGCTGACA CCAAATTGCT GAGTTCTTGC TGTATGGCGA ATATTTTGGG
951 CGACGTTTGG CAGGAAGACG GCGGCGAACC GGATTGGTTT CCCCTGCAAA
```

-continued

```
1001 GCCGGCCGGA CGCGCACCTG CACCTTTACG GCAAAAAAAC CGCGCACAAA

1051 GGGCGGAAAA TGGGACACTT TACCATTTTA AGCACCGATT CGGACACCGC

1101 ATTTCAAGAA GCAAAAAAAC TGCATCAGTC CCTATAA
```

This corresponds to the amino acid sequence <SEQ ID 2134; ORF 657.a>:

```
a657.pep

  1 MKNISLSPPA MLGILGGGQL GRMFTVAAKT MGYKVTVLDP NPNAPAAEFA

 51 DRHLCAPFDN QTALEELAKC AAVTTEFENV NADAMRFLAK HTNVSPSGDC

101 VAIAQNRIQE KAWIRKAGLQ TAPYQAICKA EDITEESIQF LPGILKTATL

151 GYDGKGQIRV KTVDELKAAF AEHRGVDCVL EKMVDLRGEI SVIVCRLNND

201 NVQTFDPAEN IHENGILAYS IVPARLSADI QQQARQMAQR LADELNYVGV

251 LAVEMFVVGD THELVVNEIA PRPHNSGHHT VDACAADQFQ QQVRLMCNLP

301 PADTKLLSSC CMANILGDVW QEDGGEPDWF PLQSRPDAHL HLYGKKTAHK

351 GRKMGHFTIL STDSDTAFQE AKKLHQSL*
```

m657/a657 94.2% identity in 378 aa overlap

```
                  10        20        30        40        50        60
m657.pep   MKNISLSPPAMLGILGGGQLGRMFTVAAKTMGYKVTVLDPDPDAPAAEFADRHLCAPFND
           ||||||||||||||||||||||||||||||||||||||||:|:|||||||||||||||::
a657       MKNISLSPPAMLGILGGGQLGRMFTVAAKTMGYKVTVLDPNPNAPAAEFADRHLCAPFDN
                  10        20        30        40        50        60

                  70        80        90       100       110       120
m657.pep   QAALDELAKCAAVTTEFENVNADAMRFLAKHTNVSPSGDCVAIAQNRIQEKAWIRKAGLQ
           |:||:|||||||||||||||||||||||||||||||||||||||||||||||||||||||
a657       QTALEELAKCAAVTTEFENVNADAMRFLAKHTNVSPSGDCVAIAQNRIQEKAWIRKAGLQ
                  70        80        90       100       110       120

                 130       140       150       160       170       180
m657.pep   TAPYQVVCKAEDITEASAQFLPGILKTATLGYDGKGQIRVKTLDELKAAFAEHGGVDCVL
           |||||::||||||||| |||||||||||||||||||||||||:|||||||||| ||||||
a657       TAPYQAICKAEDITEESIQFLPGILKTATLGYDGKGQIRVKTVDELKAAFAEHRGVDCVL
                 130       140       150       160       170       180

                 190       200       210       220       230       240
m657.pep   EKMVDLRSEISVIVCRLNNDNVQTFDPAENIHENGILAYSIVPARLSADVQQQARQMAQR
           |||||||:||||||||||||||||||||||||||||||||||||||||||:|||||||||
a657       EKMVDLRGEISVIVCRLNNDNVQTFDPAENIHENGILAYSIVPARLSADIQQQARQMAQR
                 190       200       210       220       230       240

                 250       260       270       280       290       300
m657.pep   LADELDYVGVLAVEMFVVGDTHELVVNEIAPRPHNSGHHTIDACAADQFQQQVRIMCNLP
           |||||:|||||||||||||||||||||||||||||||||||:||||||||||||:|||||
a657       LADELNYVGVLAVEMFVVGDTHELVVNEIAPRPHNSGHHTVDACAADQFQQQVRLMCNLP
                 250       260       270       280       290       300

                 310       320       330       340       350       360
m657.pep   PADTKLLSSCCMANILGDVWQEDGGEPDWLPLQSHPNAHLHLYGKKTAHKGRKMGHFTVL
           |||||||||||||||||||||||||||||:||||:|:|||||||||||||||||||||:|
a657       PADTKLLSSCCMANILGDVWQEDGGEPDWFPLQSRPDAHLHLYGKKTAHKGRKMGHFTIL
                 310       320       330       340       350       360

                 370      379
m657.pep   TTDSDTAFQEAKKLHQSLX
           :||||||||||||||||||
a657       STDSDTAFQEAKKLHQSLX
                 370
```

The following partial DNA sequence was identified in *N. gonorrhoeae* <SEQ ID 2135>:

g658.seq

```
  1 ATGGTGGCCG GAATTGTGCG TGCGCGGGGC GGTTTCATTG ACGAGCAATT
 51 CATGTGTGTC GCCGACAACA AACATTTCTA CCGCCAAtac GCCGACATAA
101 TCCAATTCGT CCGCCAagcG TTGCGCCGTC TGCCGCGCCT GTTGCTGCAC
151 GTCGGCACTC AGCCGCGcgg gGACGATGga atAAGCCAAG ATGCCGTTTT
201 CGTGGATGTT TTCGGCGGGG TCGAAGGTTT GCACGTTTTC ATCGTTCAGA
251 CGGCATACGA TCACGGAAAT CTCGCCGCGC AAGTCCACCA TTTTTTCCAA
301 AACGCAATCC ACGCCGCCGT GTTCGGCAAA CGCGGCTTTG AGTTCGTCCA
351 ACGTTTTGAC GCGGATTTGA CCTTTGCCGT CGTAGCCCAA CGTAGCCGTT
401 TTCAGGATGC CGGGCAAAAA TTGCGCGCTT GCTTCAGTAA TGTCTTCGGC
451 CTTGCAAACC GCCTGATACG GCGCGGTTTG CAAGCCTGCT TTGCGTATCC
501 ACGCTTTTTC CTGAATGCGG TTTTGTGCAA TGGACACGCA GTCGCCGCTG
551 GGGGAAACGT TGGTATGCTT TGCCAGAGAG CGCATCGCGT CGGCAttgac
601 gtTTTCAAAT TCGGTcgtaA CCGCCGCGCA TTTTGCCAAT TCGTCCAACG
651 CGGCCCGGTC GTCAAACGGC GCGCACAAAT GGCGGTCGGC AAATTCCGCC
701 GCCGGCGCAT TCGGGTCGGG ATCGAGAACG GTTACTTTGT AGCCCATGGT
751 TTTAGCGGCA ACGGCAAACA TTctgcctAA
```

This corresponds to the amino acid sequence <SEQ ID 2136; ORF 658.ng>:

g658.pep

```
  1 MVAGIVRARG GFIDEQFMCV ADNKHFYRQY ADIIQFVRQA LRRLPRLLLH
 51 VGTQPRGDDG ISQDAVFVDV FGGVEGLHVF IVQTAYDHGN LAAQVHHFFQ
101 NAIHAAVFGK RGFEFVQRFD ADLTFAVVAQ RSRFQDAGQK LRACFSNVFG
151 LANRLIRRGL QACFAYPRFF LNAVLCNGHA VAAGGNVGML CQRAHRVGID
201 VFKFGRNRRA FCQFVQRGPV VKRRAQMAVG KFRRRRIRVG IENGYFVAHG
251 FSGNGKHSA*
```

The following partial DNA sequence was identified in *N. meningitidis* <SEQ ID 2137>:

m658.seq

```
  1 ATGGTGTCCG GAATTGTGCG GGCGCGGGGC GATTTCGTTG ACGACCAATT
 51 CATGCGTGTC ACCGACAACA AACATTTCTA CCGCCAATAC GCCGACATAA
101 TCCAATTCGT CCGCCAAGCG TTGCGCCATC TGCCGCGCCT GTTGCTGCAC
151 GTCGGCACTC AGTCGCGCGG GGACGATGGA ATAAGCCAAG ATGCCGTTTT
201 CGTGGATGTT TTCGGCAGGG TCGAAAGTTT GCACGTTGTC ATTGTTCAAA
251 CGGCATACGA TTACGGAAAT TTCACTGCGC AAATCCACCA TTTTTTCCAA
301 AACGCAATCC ACGCCGCCGT GTTCGGCAAA CGCGGCTTTG AGTTCATCCA
351 ATGTTTTTAC GCGGATTTGA CCTTTGCCGT CGTAGCCCAA CGTAGCCGTT
401 TTCAGGATGC CGGGCAAAAA TTGCGCGCTT GCTTCAGTGA TGTCTTCAGC
```

-continued

```
451 CTTACAAACC ACTTGATACG GCGCGGTTTG CAATCCCGCT TTGCGTATCC

501 ATGCCTTTTC CTGAATGCGG TTTTGTGCAA TCGCCACACA ATCGCCGCTA

551 GGGGAAACAT TGGTATGTTT TGCCAAAAAG CGCATCGCAT CGGCATTGAC

601 GTTTTCAAAT TCAGTGGTCA CCGCCGCGCA TTTTGCCAAT TCGTCCAAAG

651 CAGCTTGGTC GTTAAACGGC GCGCACAAAT GGCGGTCGGC AAATTCTGCT

701 GCCGGCGCGT CCGGATCGGG GTCGAGAACG GTTACTTTGT AGCCCATGGT

751 TTTGGCGGCA ACGGTAAACA TTCTGCCTAA
```

This corresponds to the amino acid sequence <SEQ ID 2138; ORF 658>:

m658.pep

```
  1 MVSGIVRARG DFVDDQFMRV TDNKHFYRQY ADIIQFVRQA LRHLPRLLLH

 51 VGTQSRGDDG ISQDAVFVDV FGRVESLHVV IVQTAYDYGN FTAQIHHFFQ

101 NAIHAAVFGK RGFEFIQCFY ADLTFAVVAQ RSRFQDAGQK LRACFSDVFS

151 LTNHLIRRGL QSRFAYPCLF LNAVLCNRHT IAARGNIGMF CQKAHRIGID

201 VFKFSGHRRA FCQFVQSSLV VKRRAQMAVG KFCCRRVRIG VENGYFVAHG

251 FGGNGKHSA*
```

Computer analysis of this amino acid sequence gave the following results:

Homology with a predicted ORF from *N. gonorrhoeae*
m658/g658 82.2% identity in 259 aa overlap

```
                    10        20        30        40        50        60
m658.pep    MVSGIVRARGDFVDDQFMRVTDNKHFYRQYADIIQFVRQALRHLPRLLLHVGTQSRGDDG
            ||:||||||| |:|:||| |:|||||||||||||||||||||:||||||||||| |||||
g658        MVAGIVRARGGFIDEQFMCVADNKHFYRQYADIIQFVRQALRRLPRLLLHVGTQPRGDDG
                    10        20        30        40        50        60

                    70        80        90       100       110       120
m658.pep    ISQDAVFVDVFGRVESLHVVIVQTAYDYGNFTAQIHHFFQNAIHAAVFGKRGFEFIQCFY
            |||||||||||| ||:||| |||||||:||::||:|||||||||||||||||||||:| | 
g658        ISQDAVFVDVFGGVEGLHVFIVQTAYDHGNLAAQVHHFFQNAIHAAVFGKRGFEFVQRFD
                    70        80        90       100       110       120

                   130       140       150       160       170       180
m658.pep    ADLTFAVVAQRSRFQDAGQKLRACFSDVFSLTNHLIRRGLQSRFAYPCLFLNAVLCNRHT
            ||||||||||||||||||||||||||:||:|:|:|||||||: |||| :|||||||| |:
g658        ADLTFAVVAQRSRFQDAGQKLRACFSNVFGLANRLIRRGLQACFAYPRFFLNAVLCNGHA
                   130       140       150       160       170       180

                   190       200       210       220       230       240
m658.pep    IAARGNIGMFCQKAHRIGIDVFKFSGHRRAFCQFVQSSLVVKRRAQMAVGKFCCRRVRIG
            :|| ||:||:||:|||:|||||||: :||||||||| : |||||||||||||  ||:|:|
g658        VAAGGNVGMLCQRAHRVGIDVFKFGRNRRAFCQFVQRGPVVKRRAQMAVGKFRRRRIRVG
                   190       200       210       220       230       240

                   250       260
m658.pep    VENGYFVAHGFGGNGKHSAX
            :||||||||||:||||||||
g658        IENGYFVAHGFSGNGKHSAX
                   250       260
```

The following partial DNA sequence was identified in *N. meningitidis* <SEQ ID 2139>:

a658.seq

```
  1 ATGGTGGCCG GAATTGTGCG GACGCGGCGC GATTTCGTTG ACGACCAATT

 51 CATGCGTGTC GCCGACAACA AACATTTCTA CCGCCAATAC GCCGACGTAG
```

-continued

```
101 TTCAATTCAT CGGCCAAACG CTGCGCCATT TGTCGCGCCT GTTGCTGAAT

151 GTCGGCACTC AGTCGGGCTG GGACGATGGA GTAGGCGAGG ATACCGTTTT

201 CGTGAATGTT TTCGGCAGGA TCGAAAGTTT GCACGTTGTC ATTGTTCAGA

251 CGGCATACGA TAACGGAAAT TTCGCCGCGC AAGTCCACCA TTTTTTCCAA

301 AACGCAATCC ACGCCGCGGT GTTCGGCAAA CGCGGCTTTG AGTTCATCCA

351 CCGTTTTGAC GCGGATTTGG CCTTTGCCGT CATAGCCCAA TGTAGCGGTT

401 TTCAGGATGC CGGGCAGAAA TTGTATGCTT TCTTCAGTGA TGTCTTCGGC

451 TTTGCAAATT GCTTGATACG GCGCGGTTTG CAGGCCTGCT TTGCGTATCC

501 ATGCCTTTTC CTGAATGCGG TTTTGCGCGA TGGCAACGCA GTCGCCGCTG

551 GGGGAAACAT TGGTATGTTT GGCGAGAAAA CGCATCGCAT CGGCATTGAC

601 GTTTTCGAAC TCGGTCGTAA CAGCCGCACA TTTTGCCAAT TCTTCCAAAG

651 CGGTTTGGTT GTCAAACGGC GCACACAAAT GGCGGTCGGC AAATTCCGCT

701 GCCGGCGCAT TCGGGTTGGG ATCGAGTACG GTTACTTTGT AGCCCATGGT

751 TTTGGCAGCA ACAGTAAACA TTCTGCCTAA
```

This corresponds to the amino acid sequence <SEQ ID 2140; ORF 658.a>:

a658.pep

```
  1 MVAGIVRTRR DFVDDQFMRV ADNKHFYRQY ADVVQFIGQT LRHLSRLLLN

 51 VGTQSGWDDG VGEDTVFVNV FGRIESLHVV IVQTAYDNGN FAAQVHHFFQ

101 NAIHAAVFGK RGFEFIHRFD ADLAFAVIAQ CSGFQDAGQK LYAFFSDVFG

151 FANCLIRRGL QACFAYPCLF LNAVLRDGNA VAAGGNIGMF GEKTHRIGID

201 VFELGRNSRT FCQFFQSGLV VKRRTQMAVG KFRCRRIRVG IEYGYFVAHG

251 FGSNSKHSA*
```

m658/a658 75.3% identity in 259 aa overlap

```
                   10        20        30        40        50        60
m658.pep   MVSGIVRARGDFVDDQFMRVTDNKHFYRQYADIIQFVRQALRHLPRLLLHVGTQSRGDDG
           ||:||||:| ||||||||||:|||||||||||::||: |:|||| ||||:|||||  |||
a658       MVAGIVRTRRDFVDDQFMRVADNKHFYRQYADVVQFIGQTLRHLSRLLLNVGTQSGWDDG
                   10        20        30        40        50        60

                   70        80        90       100       110       120
m658.pep   ISQDAVFVDVFGRVESLHVVIVQTAYDYGNFTAQIHHFFQNAIHAAVFGKRGFEFIQCFY
           :::|:|||:||||:||||||||||||| |||:||:|||||||||||||||||||||: | 
a658       VGEDTVFVNVFGRIESLHVVIVQTAYDNGNFAAQVHHFFQNAIHAAVFGKRGFEFIHRFD
                   70        80        90       100       110       120

                  130       140       150       160       170       180
m658.pep   ADLTFAVVAQRSRFQDAGQKLRACFSDVFSLTNHLIRRGLQSRFAYPCLFLNAVLCNRHT
           |||:|||:|| | |||||||| | |||||:::| |||||||: |||||||||||| : ::
a658       ADLAFAVIAQCSGFQDAGQKLYAFFSDVFGFANCLIRRGLQACFAYPCLFLNAVLRDGNA
                  130       140       150       160       170       180

                  190       200       210       220       230       240
m658.pep   IAARGNIGMFCQKAHRIGIDVFKFSGHRRAFCQFVQSSLVVKRRAQMAVGKFCCRRVRIG
           :|| |||||| :|:||||||||::: : |:|||| ||:||||||:||||||| |||:|:|
a658       VAAGGNIGMFGEKTHRIGIDVFELGRNSRTFCQFFQSGLVVKRRTQMAVGKFRCRRIRVG
                  190       200       210       220       230       240

                  250       260
m658.pep   VENGYFVAHGFGGNGKHSAX
           :| |||||||||:|:|||||
a658       IEYGYFVAHGFGSNSKHSAX
                  250       260
```

The following partial DNA sequence was identified in *N. gonorrhoeae* <SEQ ID 2141>:

```
g661.seq

  1 ATGCACATCG GCGGTTATTT TATCGACAAC CCCATCGCAC TTGCGCCGAT
 51 GGCGGGCATT GCCGACAAAC CCTTCCGCCG CCTCTGTCGG GCGTTTGGCG
101 CAGGTTGGGC GGTGTGCGAA ATGCTGGCCA GCGATCCGAC GCTCAGGAAT
151 ACCGGAAAAA CCCtgcaccg cagtgaTTTt gccgatgaag gCGGCATCGT
201 TGCCGTGCAG ATTGCCGGCA GCGACCccga acaGATGGCG Gatgcggcgc
251 gttacAACGT CGGACTCGGG GCGCAGGTCA TCGACATcaa TATGGGCTGC
301 cccgccaaGA AAGTGTGCAA CGTCCAAGCC GGTAGCGCgc tGATGCAGGA
351 CGAGccgctg gttgcCgcca tTTtggaggc ggtggtcAAG GCGGCGGgcg
401 TACCCGTTAC cctCAAAACc cgtTtgggtt ggcacgacga cgatcaaaac
451 ctgcCcgccg tcgccaaaat cgccgaagat tgcggcattg ccgccCttgc
501 cgttccacgg gcgCGCgcgC ACGCAAATGT ACAAAGGCGA GGCgcGTTAC
551 Gaactcatcg CCGAGACCAA AAGccgTCTG AACATCCCGG cctGggtCAA
601 CGGCGACATC actTCgccgc AAAAAGCCGC CGccgTCCTC AAACAAACCG
651 CCGCCGACGG CATCATGATA GGGCGCGGCG CGCAAGGCAG GCCGTGGTTT
701 TTCCGCGATT TGAAGCATTA TGCCGAACAC GGCGTTTTAC CGCCTGCCTT
751 GAGTTTGGCA GAATGCAGAG CCGCCATTTT GAACCACATC CGCGCCATGC
801 ACGCGTTTTA TGGTGAGACC GTCGGTGTGC GCATCGCACG CAAACACATA
851 GGCTGGTACA TCGGCGAAAT GCCCGACGGC GAACAGGCGC GGCGTGA
```

This corresponds to the amino acid sequence <SEQ ID 2142; ORF 661.ng>:

```
g661.pep

  1 MHIGGYFIDN PIALAPMAGI ADKPFRRLCR AFGAGWAVCE MLASDPTLRN
 51 TGKTLHRSDF ADEGGIVAVQ IAGSDPEQMA DAARYNVGLG AQVIDINMGC
101 PAKKVCNVQA GSALMQDEPL VAAILEAVVK AAGVPVTLKT RLGWHDDDQN
151 LPAVAKIAED CGIAALAVPR ARAHANVQRR GALRTHRRDQ KFSEHPGLGQ
201 RRHHFAAKSR RRPQTNRRRR HHDRARRARQ AVVFPRFEAL CRTRRFTACL
251 EFGRMQSRHF EPHPRHARVL WXDRRCAHRT QTHRLVHRRN ARRRTGAA*
```

The following partial DNA sequence was identified in *N. meningitidis* <SEQ ID 2143>:

```
m661.seq

  1 ATGCACATCG GCGGCTATTT TATCGACAAC CCCATCGCAC TTGCGCCGAT
 51 GGCGGGCATT ACCGACAAAC CGTTCCGCCG ACTTTGCCGA GATTTTGGCG
101 CAGGTTGGGC GGTGTGCGAA ATGCTGACCA GCGACCCGAC GCTCAGAAAT
151 ACTAGAAAAA CCTTGCACCG CAGCGATTTT GCCGATGAAG GCGGCATTGT
201 TGCCGTGCAG ATTGCCGGAA GCGATCCGCA GCAGATGGCG GATGCCGCGC
```

-continued

```
251 GTTACAACGT CAGCCTTGGG GCGCAGCTTA TCGACATCAA CATGGGCTGT

301 CCCGCTAAAA AAGTCTGCAA TGTCCAAGCC GGTAGCGCGC TGATGCAGAA

351 CGAGCCGCTG GTTGCCGCCA TTTTGGAAGC CGTCGTCCGT GCGGCAGGCG

401 TACCCGTTAC CCTCAAAACC CGTTTGGGTT GGCACGACGA CCATCAAAAC

451 CTGCCCGTCA TCGCCAAAAT CGCCGAAGAT TGCGGCATCG CCGCCCTTGC

501 CGTCC.ACGG ACGCACGCGT ACGCAAATGT ACAAAGGCGA AGCGCGTTAC

551 GAACTCATCG CCGAAACCAA ATGCCGTCTG AACATCCCGG TCTGGGTCAA

601 CGGCGACATT ACTTCGCCGC AAAAAGCCCA AGCCGTCCTC AAACAAACCG

651 CCGCCGACGG CATTATGATA GGGCGCGGCG CGCAAGGCAG GCCGTGGTTC

701 TTCCGCGATT TGAAACATTA TGCCGAACAC GGTGTTTTGC CGCCTGCCTT

751 GAGTTTGGCA GAATGCGCCG CCGCTATTTT GAACCACATC CGCGCCATAC

801 ACGCGTTTTA CGGCGACACC GCCGGTGTGC GCATCGCACG CAAACACATA

851 GGCTGGTACA TCGACGAAAT GCCCGACGGC GAACAGACAC GTCGTGA
```

This corresponds to the amino acid sequence <SEQ ID 2144; ORF 661>:

m661.pep

```
  1 MHIGGYFIDN PIALAPMAGI TDKPFRRLCR DFGAGWAVCE MLTSDPTLRN

 51 TRKTLHRSDF ADEGGIVAVQ IAGSDPQQMA DAARYNVSLG AQLIDINMGC

101 PAKKVCNVQA GSALMQNEPL VAAILEAVVR AAGVPVTLKT RLGWHDDHQN

151 LPVIAKIAED CGIAALAVXR THAYANVQRR SALRTHRRNQ MPSEHPGLGQ

201 RRHYFAAKSP SRPQTNRRRR HYDRARRARQ AVVLPRFETL CRTRCFAACL

251 EFGRMRRRYF EPHPRHTRVL RRHRRCAHRT QTHRLVHRRN ARRRTDTS*
```

Computer analysis of this amino acid sequence gave the following results:

Homology with a predicted ORF from *N. gonorrhoeae* m661/g661 88.5% identity in 295 aa overlap

```
                   10        20        30        40        50        60
m661.pep   MHIGGYFIDNPIALAPMAGITDKPFRRLCRDFGAGWAVCEMLTSDPTLRNTRKTLHRSDF
           ||||||||||||||||||||:||||||||| |||||||||||:|||||||| ||||||||
g661       MHIGGYFIDNPIALAPMAGIADKPFRRLCRAFGAGWAVCEMLASDPTLRNTGKTLHRSDF
                   10        20        30        40        50        60

                   70        80        90       100       110       120
m661.pep   ADEGGIVAVQIAGSDPQQMADAARYNVSLGAQLIDINMGCPAKKVCNVQAGSALMQNEPL
           ||||||||||||||||:||||||||||:||||:|||||||||||||||||||||||:|||
g661       ADEGGIVAVQIAGSDPEQMADAARYNVGLGAQVIDINMGCPAKKVCNVQAGSALMQDEPL
                   70        80        90       100       110       120

                  130       140       150       160       170       180
m661.pep   VAAILEAVVRAAGVPVTLKTRLGWHDDHQNLPVIAKIAEDCGIAALAVXRTHAYANVQRR
           |||||||||:||||||||||||||||| ||||::|||||||||||||| |::|:||||||
g661       VAAILEAVVKAAGVPVTLKTRLGWHDDDQNLPAVAKIAEDCGIAALAVPRARAHANVQRR
                  130       140       150       160       170       180

                  190       200       210       220       230       240
m661.pep   SALRTHRRNQMPSEHPGLGQRRHYFAAKSPSRPQTNRRRRHYDRARRARQAVVLPRFETL
           :|||||||:| ||||||||||||:|||||  ||||||||||:|||||||||||:||||:|
g661       GALRTHRRDQKPSEHPGLGQRRHHFAAKSRRRPQTNRRRRHHDRARRARQAVVFPRFEAL
                  190       200       210       220       230       240

                  250       260       270       280       290      299
m661.pep   CRTRCFAACLEFGRMRRRYFEPHPRHTRVLRRHRRCAHRTQTHRLVHRRNARRRTDTSX
           |||| |:||||||||: |:|||||||:|||   ||||||||||||||||||||||
g661       CRTRRFTACLEFGRMQSRHFEPHPSHARVLWXDRRCAHRTQTHRLVHRRNARRRTGAAX
                  250       260       270       280       290
```

The following partial DNA sequence was identified in *N. meningitidis* <SEQ ID 2145>:

a661.seq

```
  1 ATGCACATCG GCGGCTATTT TATCGACAAC CCCATCGCAC TTGCGCCGAT
 51 GGCGGGCATT ACCGACAAAC CGTTCCGCCG ACTTTGCCGA GATTTTGGCG
101 CAGGTTGGGC GGTGTGCGAA ATGCTGACCA GCGACCCGAC GCTCAGAAAT
151 ACTAGAAAAA CCTTGCACCG CAGCGATTTT GCCGATGAAG GCGGCATTGT
201 TGCCGTGCAG ATTGCCGGAA GCGATCCGCA GCAGATGGCG GATGCCGCGC
251 GTTACAACGT CAGCCTTGGG GCGCAGCTTA TCGACATCAA CATGGGCTGT
301 CCCGCTAAAA AAGTCTGCAA TGTCCAAGCC GGTAGCGCGC TGATGCAGAA
351 CGAGCCGCTG GTTGCCGCCA TTTTGGAGGC GGTGGTCAAA GCGGCGGGCG
401 TACCCGTTAC CCTCAAAACC CGTTTGGGTT GGCACGACGA CCATCAAAAC
451 CTGCCCGTCA TCGCCAAAAT CGCCGAAGAT TGCGGCATTG CCGCCCTTGC
501 CG.TCCACGG ACGCACGCGC ACGCAAATGT ACAAAGGCGA AGCGGCTTAC
551 GACCTGATTG CCGAAACCAA ATGCCGTCTG AACATCCCGG TCTGGGTCAA
601 CGGCGACATT ACCTCGCCGC AAAAAGCCCA AGCCGTCCTC AAACAAACCG
651 CCGCAGACGG CATTATGATA GGGCGCGGCG CGCAAGGCAG ACCGTGGTTC
701 TTCCGCGATT TGAAACATTA CGCCGAACAC GGTGTTTTAC CGCCTGCCTT
751 GAGTTTGGCA GAATGTACCG CCACTATTTT GAACCACATC CGAGCCATGC
801 ACGCGTTTTA CGGCGACACC GCCGGTGTGC GCATCGCACG CAAACACATA
851 GGCTGGTACA TCGACGAAAT GCCCGACGGC GAACAGACAC GTCGTGA
```

This corresponds to the amino acid sequence <SEQ ID 2146; ORF 661.a>:

a661.pep

```
  1 MHIGGYFIDN PIALAPMAGI TDKPFRRLCR DFGAGWAVCE MLTSDPTLRN
 51 TRKTLHRSDF ADEGGIVAVQ IAGSDPQQMA DAARYNVSLG AQLIDINMGC
101 PAKKVCNVQA GSALMQNEPL VAAILEAVVK AAGVPVTLKT RLGWHDDHQN
151 LPVIAKIAED CGIAALAXPR THAHANVQRR SGLRPDCRNQ MPSEHPGLGQ
201 RRHYLAAKSP SRPQTNRRRR HYDRARRARQ TVVLPRFETL RRTRCFTACL
251 EFGRMYRHYF EPHPSHARVL RRHRRCAHRT QTHRLVHRRN ARRRTDTS*
```

m661/a661 94.6% identity in 298 aa overlap

```
                    10        20        30        40        50        60
m661.pep    MHIGGYFIDNPIALAPMAGITDKPFRRLCRDFGAGWAVCEMLTSDPTLRNTRKTLHRSDF
            ||||||||||||||||||||||||||||||||||||||||||||||||||||||||||||
a661        MHIGGYFIDNPIALAPMAGITDKPFRRLCRDFGAGWAVCEMLTSDPTLRNTRKTLHRSDF
                    10        20        30        40        50        60

                    70        80        90       100       110       120
m661.pep    ADEGGIVAVQIAGSDPQQMADAARYNVSLGAQLIDINMGCPAKKVCNVQAGSALMQNEPL
            ||||||||||||||||||||||||||||||||||||||||||||||||||||||||||||
a661        ADEGGIVAVQIAGSDPQQMADAARYNVSLGAQLIDINMGCPAKKVCNVQAGSALMQNEPL
                    70        80        90       100       110       120
```

-continued

```
                   130       140       150       160       170       180
m661.pep    VAAILEAVVRAAGVPVTLKTRLGWHDDHQNLPVIAKIAEDCGIAALAVXRTHAYANVQRR
            |||||||||:|||||||||||||||||||||||||||||||||||||  ||||:||||||
a661        VAAILEAVVKAAGVPVTLKTRLGWHDDHQNLPVIAKIAEDCGIAALAXPRTHAHANVQRR
                   130       140       150       160       170       180

                   190       200       210       220       230       240
m661.pep    SALRTHRRNQMPSEHPGLGQRRHYFAAKSPSRPQTNRRRRHYDRARRARQAVVLPRFETL
            |:||   |||||||||||||||||:||||||||||||||||||||||||:||||||||||
a661        SGLRPDCRNQMPSEHPGLGQRRHYLAAKSPSRPQTNRRRRHYDRARRARQTVVLPRFETL
                   190       200       210       220       230       240

                   250       260       270       280       290      299
m661.pep    CRTRCFAACLEFGRMRRRYFEPHPRHTRVLRRHRRCAHRTQTHRLVHRRNARRRTDTSX
             |||||:|||||||| |:|||||| |:||||||||||||||||||||||||||||||||
a661        RRTRCFTACLEFGRMYRHYFEPHPSHARVLRRHRRCAHRTQTHRLVHRRNARRRTDTSX
                   250       260       270       280       290
```

The following partial DNA sequence was identified in *N. gonorrhoeae* <SEQ ID 2147>:

g663.seq

```
  1 ATGTGTACCG AGATGAAATT TATATTTTTT GTACTGTATG TTTTGCAGTT
 51 TCTGCCGTTT GCGCTGCTGC ACAAGATTGC CGGCCTGATC GGTTCGCTTG
101 CCTACCTTCT GGTCAAACCG CGCCGCCGTA TCGGCGAAAT CAATTTGGCA
151 AAATGTTTTC CCGAATGGGA CGAAGAAAAG CGTAAAACCG TGTTGAAACA
201 GCATTTCAAA CACATGGCAA AACTGATGCT CGAATACGGC TTATATTGGT
251 ACGCGtctGC CAAATGCCTG AAATCGCTGG TGCGCTACCG CAATAAGCAT
301 TATTTGGACG ACGCGCTGGC GGCGGGGGAA AAAGTCATCA TCCTGTACCC
351 GCACTTTACC GCGTTCGAGA TGGCGGTGTA CGCGCTTAAT CAGGATGTCC
401 CGCTGATCAG TATGTATTCC CACCAAAAAA ACAAGATATT GGACGAACAG
451 ATTTTGAAAg gccgcaACCG CTATCACAAC GTCTTCCTTA TCGGGCGCAC
501 CGAagggctg cgCGCCCtcg TCAAACAGTT CCGCAAAAGC AGTGCGCCGT
551 TCCTGTATCT GCCCGATCAG GATTTCGGAC GCAACAATTC GGTTTTTGTG
601 GATTTTTTCG GCATtcagaC GGCAACGATT ACCGGCTTGA GCCGCATTGC
651 CGCGCTTGCA AATGCAAAAG TGATACCCGC CATTCCCGTC CGCGAGGCGG
701 ACAATACGGT TACATTGCAA TTCTATCCCG CTTGGAAATC CTTTCCGAGT
751 GAAGACGCGC AAGCCGACGC GCAACGTATG AACCGCTTTA TCGAAGAACG
801 CGTGCGCGAA CACCCGGAAC AATATTTCTG GCTGCACAAG CGTTTCAAAA
851 CCCGTCCGGA AGGCAGCCCC GATTTTTACT GA
```

This corresponds to the amino acid sequence <SEQ ID 2148; ORF 663.ng>:

g663.pep

```
  1 MCTEMKFIFF VLYVLQFLPF ALLHKIAGLI GSLAYLLVKP RRRIGEINLA
 51 KCFPEWDEEK RKTVLKQHFK HMAKLMLEYG LYWYASAKCL KSLVRYRNKH
101 YLDDALAAGE KVIILYPHFT AFEMAVYALN QDVPLISMYS HQKNKILDEQ
151 ILKGRNRYHN VFLIGRTEGL RALVKQFRKS SAPFLYLPDQ DFGRNNSVFV
201 DFFGIQTATI TGLSRIAALA NAKVIPAIPV READNTVTLQ FYPAWKSFPS
251 EDAQADAQRM NRFIEERVRE HPEQYFWLHK RFKTRPEGSP DFY*
```

The following partial DNA sequence was identified in *N. meningitidis* <SEQ ID 2149>:

m663.seq

```
  1 ATGTGTATCG AGATGAAATT TATATTTTTT GTACTGTATG TTTTGCAGTT
 51 TCTGCCGTTT GCGCTGCTGC ACAAGATTGC CGACCTGACG GGTTTGCTTG
101 CCTACCTTCT GGTCAAACCG CGCCGCCGTA TCGGCGAAAT CAATTTGGCA
151 AAATGTTTTT CCGAATGGAG TGAGGAAAAG CGTAAAACCG TGTTGAAACA
201 GCATTTCAAA CACATGGCGA AACTGATGTT GGAATACGGT TTATATTGGT
251 ACGCGCCTGC CGGACGTTTG AAATCGCTGG TGCGCTACCG CAATAAGCAT
301 TATTTGGACG ACGCGCTGGC GGCGGGGGAA AAAGTCATCA TCCTGTATCC
351 GCACTTCACC GCGTTCGAGA TGGCGGTGTA CGCGCTTAAT CAGGATATCC
401 CGCTGATCAG TATGTATTCC CATCAAAAAA ACAAGATATT GGACGAACAG
451 ATTTTGAAAG GCCGCAACCG CTATCACAAC GTCTTCCTTA TCGGGCGCAC
501 CGAAGGGCTG CGCGCCCTCG TCAAACAGTT CCGCAAAAGC AGCGCGCCGT
551 TTCTGTATCT GCCCGATCAG GATTTCGGAC GCAACGATTC GGTTTTTGTG
601 GATTTTTTCG GTATTCAGAC GGCAACGATT ACCGGATTGA GCCGCATTGC
651 CGCGCTTGCA AATGCAAAAG TGATACCCGC CATTCCCGTC CGCGAGGCAG
701 ACAATACGGT TACATTGCAT TTCTACCCTG CTTGGAAATC CTTTCCGGGT
751 GAAGACGCGA AAGCCGACGC GCAGCGCATG AACCGTTTTA TCGAAGACAG
801 GGTGCGCGAA CATCCGGAAC AATATTTTTG GCTGCACAAG CGTTTTAAAA
851 CCCGTCCGGA AGGCAGCCCC GATTTTTACT GA
```

This corresponds to the amino acid sequence <SEQ ID 2150; ORF 663>:

m663.pep

```
  1 MCIEMKFIFF VLYVLQFLPF ALLHKIADLT GLLAYLLVKP RRRIGEINLA
 51 KCFSEWSEEK RKTVLKQHFK HMAKLMLEYG LYWYAPAGRL KSLVRYRNKH
101 YLDDALAAGE KVIILYPHFT AFEMAVYALN QDIPLISMYS HQKNKILDEQ
151 ILKGRNRYHN VFLIGRTEGL RALVKQFRKS SAPFLYLPDQ DFGRNDSVFV
201 DFFGIQTATI TGLSRIAALA NAKVIPAIPV READNTVTLH FYPAWKSFPG
251 EDAKADAQRM NRFIEDRVRE HPEQYFWLHK RFKTRPEGSP DFY*
```

Computer analysis of this amino acid sequence gave the following results:

Homology with a predicted ORF from *N. gonorrhoeae* m663/g663 94.9% identity in 293 aa overlap

```
                      10        20        30        40        50        60
m663.pep      MCIEMKFIFFVLYVLQFLPFALLHKIADLTGLLAYLLVKPRRRIGEINLAKCFSEWSEEK
              || |||||||||||||||||||||||| | | ||||||||||||||||||||| ||:|||
g663          MCTEMKFIFFVLYVLQFLPFALLHKIAGLIGSLAYLLVKPRRRIGEINLAKCFPEWDEEK
                      10        20        30        40        50        60

                      70        80        90       100       110       120
m663.pep      RKTVLKQHFKHMAKLMELYGLYWYAPAGRLKSLVRYRNKHYLDDALAAGEKVIILYPHFT
              ||||||||||||||||||||||||| |  |||||||||||||||||||||||||||||||
g663          RKTVLKQHFKHMAKLMELYGLYWYASAKCLKSLVRYRNKHYLDDALAAGEKVIILYPHFT
                      70        80        90       100       110       120
```

-continued

```
                 130       140       150       160       170       180
m663.pep  AFEMAVYALNQDIPLISMYSHQKNKILDEQILKGRNRYHNVFLIGRTEGLRALVKQFRKS
          |||||||||||:||||||||||||||||||||||||||||||||||||||||||||||||
g663      AFEMAVYALNQDVPLISMYSHQKNKILDEQILKGRNRYHNVFLIGRTEGLRALVKQFRKS
                 130       140       150       160       170       180

                 190       200       210       220       230       240
m663.pep  SAPFLYLPDQDFGRNDSVFVDFFGIQTATITGLSRIAALANAKVIPAIPVREADNTVTLH
          |||||||||||||||:|||||||||||||||||||||||||||||||||||||||||||:
g663      SAPFLYLPDQDFGRNNSVFVDFFGIQTATITGLSRIAALANAKVIPAIPVREADNTVTLQ
                 190       200       210       220       230       240

                 250       260       270       280       290
m663.pep  FYPAWKSFPGEDAKADAQRMNRFIEDRVREHPEQYFWLHKRFKTRPEGSPDFYX
          |||||||||:|||:|||||||||||:||||||||||||||||||||||||||||
g663      FYPAWKSFPSEDAQADAQRMNRFIEERVREHPEQYFWLHKRFKTRPEGSPDFYX
                 250       260       270       280       290
```

The following partial DNA sequence was identified in *N. meningitidis* <SEQ ID 2151>:

a663.seq

```
  1 ATGTGTATCG AGATGAAATT TATATTTTTT GTACTGTATG TTTTGCAGTT
 51 TCTGCCGTTT GCGCTGCTGC ACAAACTTGC TGATCTGACA GGCTTGCTCG
101 CCTACCTTTT GGTCAAACCC CGCCGCCGTA TCGGCGAAAT CAATTTGGCA
151 AAATGCTTTC CCGAGTGGGA CGGAAAAAAG CGTAAAACCG TGTTGAAACA
201 GCATTTCAAA CATATGGCGA AACTGATGTT GGAATACGGT TTATATTGGT
251 ACGCGCCCGC CGGGCGTTTG AAATCACTGG TGCGCTACCG CAACAAACAT
301 TATTTGGACG ACGCTCTGGC GGCAGGGGAA AAAGTCATCA TCCTGTATCC
351 GCACTTCACC GCGTTCGAGA TGGCGGTGTA CGCGCTCAAT CAGGATGTTC
401 CGCTGATCAG TATGTATTCC CACCAAAAAA ACAAGATATT GGACGAACAG
451 ATTTTGAAAG GCCGCAACCG CTATCACAAC GTTTTCCTTA TCGGGCGCAC
501 CGAAGGGCTG CGCGCCCTCG TCAAACAGTT CCGCAAAAGC AGCGCGCCGT
551 TTCTGTATCT GCCCGATCAG GATTTCGGAC GCAACGATTC GGTTTTTGTC
601 GATTTCTTCG GTATTCGGAC GGCAACGATT ACCGGCTTGA GCCGCATTGC
651 CGCGCTTGCA AATGCAAAAG TGATACCCGC CATCCCTGTC CGCGAGGCGG
701 ACAATACGGT TACATTGCAT TTCTACCCTG CTTGGGAATC CTTTCCGAGT
751 GAAGATGCGC AGGCCGACGC GCAGCGCATG AACCGTTTTA TCGAGGAACG
801 CGTGCGCGAA CATCCCGAGC AGTATTTTTG GCTGCACAAG CGTTTCAAAA
851 CCCGTCCGGA AGGCAGCCCC GATTTTTACT GA
```

This corresponds to the amino acid sequence <SEQ ID 2152; ORF 663.a>:

a663.pep

```
  1 MCIEMKFIFF VLYVLQFLPF ALLHKLADLT GLLAYLLVKP RRRIGEINLA
 51 KCFPEWDGKK RKTVLKQHFK HMAKLMLEYG LYWYAPAGRL KSLVRYRNKH
101 YLDDALAAGE KVIILYPHFT AFEMAVYALN QDVPLISMYS HQKNKILDEQ
151 ILKGRNRYHN VFLIGRTEGL RALVKQFRKS SAPFLYLPDQ DFGRNDSVFV
201 DFFGIRTATI TGLSRIAALA NAKVIPAIPV READNTVTLH FYPAWESFPS
251 EDAQADAQRM NRFIEERVRE HPEQYFWLHK RFKTRPEGSP DFY*
```

m663/a663 96.2% identity in 293 aa overlap

```
                    10        20        30        40        50        60
m663.pep    MCIEMKFIFFVLYVLQFLPFALLHKIADLTGLLAYLLVKPRRRIGEINLAKCFSEWSEEK
            |||||||||||||||||||||||||:|||||||||||||||||||||||||||| ||: :|
a663        MCIEMKFIFFVLYVLQFLPFALLHKLADLTGLLAYLLVKPRRRIGEINLAKCFPEWDGKK
                    10        20        30        40        50        60

                    70        80        90       100       110       120
m663.pep    RKTVLKQHFKHMAKLMELYGLYWYAPAGRLKSLVRYRNKHYLDDALAAGEKVIILYPHFT
            ||||||||||||||||||||||||||||||||||||||||||||||||||||||||||||
a663        RKTVLKQHFKHMAKLMELYGLYWYAPAGRLKSLVRYRNKHYLDDALAAGEKVIILYPHFT
                    70        80        90       100       110       120

                   130       140       150       160       170       180
m663.pep    AFEMAVYALNQDIPLISMYSHQKNKILDEQILKGRNRYHNVFLIGRTEGLRALVKQFRKS
            ||||||||||||:|||||||||||||||||||||||||||||||||||||||||||||||
a663        AFEMAVYALNQDVPLISMYSHQKNKILDEQILKGRNRYHNVFLIGRTEGLRALVKQFRKS
                   130       140       150       160       170       180

                   190       200       210       220       230       240
m663.pep    SAPFLYLPDQDFGRNDSVFVDFFGIQTATITGLSRIAALANAKVIPAIPVREADNTVTLH
            |||||||||||||||||||||||||:||||||||||||||||||||||||||||||||||
a663        SAPFLYLPDQDFGRNDSVFVDFFGIRTATITGLSRIAALANAKVIPAIPVREADNTVTLH
                   190       200       210       220       230       240

                   250       260       270       280       290
m663.pep    FYPAWKSFPGEDAKADAQRMNRFIEDRVREHPEQYFWLHKRFKTRPEGSPDFYX
            |||||:|||:|||:|||||||||||:|||||||||||||||||||||||||||||
a663        FYPAWESFPSEDAQADAQRMNRFIEERVREHPEQYFWLHKRFKTRPEGSPDFYX
                   250       260       270       280       290
```

The following partial DNA sequence was identified in *N. gonorrhoeae* <SEQ ID 2153>:

g664.seq

```
  1 ATGATACATC CGCACCACTT CCGCGCCTTT TTCATAAACG GTCATGGTGT
 51 AGAAATTGTT CATCTCCTCA TAGCTGAcgg gGCGCACCGG ATGGGCGGTC
101 GGGCCTGCGT CTTCGGGGAA CTGGTTCTGG CGCAGCAGGC GGATGTTCTC
151 GATGCGGCGC ACGGCGCGGC CGGCGCGGTC GCCGGAAAAC TCTTGGTCGC
201 GGAACACGGT CAGCCCTTCC TTCAGCGAAA GCTGGAACCA GTCGCGGCAG
251 GTTACGCGGT TGCCCGTCCA GTTGTGGAAA TATTCGTGTC CGACCACGGA
301 TTCAATGCCT TCGAAATCGG TATCGGTGGC GGTGCGGCTG TCGGCGAGGA
351 CGAACTTGGT GTTAAAAATG TTCAAACCCT TGTTTTCCAT CGCGCCCATA
401 TTGAAATCGC CTACGGCGAC GACCATGAaa atatccaagt cataTTCcaa
451 cCcgaagcgc gtttcgtcCc acttcatcgC gtTTTTTCAA cgaTTCCACG
501 GCAAAGCCGA CCTTGGGTTT GTCCGCTTCG GTGGTGTAAA ACTCGATTTT
551 GA
```

This corresponds to the amino acid sequence <SEQ ID 2154; ORF 664.ng>:

g664.pep

```
  1 MIHPHHFRAF FINGHGVEIV HLLIADGAHR MGGRACVFGE LVLAQQADVL
 51 DAAHGAAGAV AGKLLVAEHG QPFLQRKLEP VAAGYAVARP VVEIFVSDHG
101 FNAFEIGIGG GAAVGEDELG VKNVQTLVFH RAHIEIAYGD DHENIQVIFQ
151 PEARFVPLHR VFSTIPRQSR PWVCPLRWCK TRF*
```

The following partial DNA sequence was identified in *N. meningitidis* <SEQ ID 2155>:

m664.seq

```
  1 GTGATACATC CGCACTACTT CCGCGCCTTT TTCATAAACG GTCATGGTGT
 51 AGAAATTGTT CATCTCCTCA TAGCTGGCGG GGCGCACCGG ATGGGCGGTC
101 GGGCCTGCGT CTTCGGGGAA CTGGTGCTGG CGCAGCAGGC GGATGTTTTC
151 GATGCGGCGC ACGGCGCGGC TGGCGCGGTC GCCGGAAAAT TCTTGGTCGC
201 GGAACACGGT CAGCCCTTCC TTCAGCGAAA GCTGGAACCA GTCGCGGCAG
251 GTTACGCGGT TGCCCGTCCA GTTGTGGAAA TACTCGTGTC CGACCACGGA
301 TTCGATGCCT TCGAAATCGG TATCGGTGGC GGTGCGGCTG TCGGCAAGGA
351 CGAACTTGGT GTTAAAGATG TTCAAACCCT TGTTTTCCAT CGCGCCCATA
401 TTGAAATCGC CCACGGCGAC GACCATGAAA ATATCCAAGT CGTATTCCAA
451 ACCGAAGCGC GTTTCGTCCC ATTTCATCGC GTTTTT.CAA CGATTCCACG
501 GCAAAGCCGA CCTTGGGCTT GTCCGCTTCG GTGGTGTAAA ACTCGATTTT
551 GA
```

This corresponds to the amino acid sequence <SEQ ID 2156; ORF 664>:

m664.pep

```
  1 VIHPHYFRAF FINGHGVEIV HLLIAGGAHR MGGRACVFGE LVLAQQADVF
 51 DAAHGAAGAV AGKFLVAEHG QPFLQRKLEP VAAGYAVARP VVEILVSDHG
101 FDAFEIGIGG GAAVGKDELG VKDVQTLVFH RAHIEIAHGD DHENIQVVFQ
151 TEARFVPFHR VFXTIPRQSR PWACPLRWCK TRF*
```

Computer analysis of this amino acid sequence gave the following results:

Homology with a predicted ORF from *N. gonorrhoeae*
m664/g664 91.8% identity in 183 aa overlap

```
                       10        20        30        40        50        60
m664.pep       VIHPHYFRAFFINGHGVEIVHLLIAGGAHRMGGRACVFGELVLAQQADVFDAAHGAAGAV
               :||||:||||||||||||||||||| |||||||||||||||||||||||:||||||||||
g664           MIHPHHFRAFFINGHGVEIVHLLIADGAHRMGGRACVFGELVLAQQADVLDAAHGAAGAV
                       10        20        30        40        50        60

                       70        80        90       100       110       120
m664.pep       AGKFLVAEHGQPFLQRKLEPVAAGYAVARPVVEILVSDHGFDAFEIGIGGGAAVGKDELG
               |||:||||||||||||||||||||||||||||||:||||||:|||||||||||||:||||
g664           AGKLLVAEHGQPFLQRKLEPVAAGYAVARPVVEIFVSDHGFNAFEIGIGGGAAVGEDELG
                       70        80        90       100       110       120

                      130       140       150       160       170       180
m664.pep       VKDVQTLVFHRAHIEIAHGDDHENIQVVFQTEARFVPFHRVFXTIPRQSRPWACPLRWCK
               ||:|||||||||||||||:|||||||||:|| ||||||:|||| |||||||||:||||||
g664           VKNVQTLVFHRAHIEIAYGDDHENIQVIFQPEARFVPLHRVFSTIPRQSRPWVCPLRWCK
                      130       140       150       160       170       180

m664.pep       TRFX
               ||||
g664           TRFX
```

The following partial DNA sequence was identified in *N. meningitidis* <SEQ ID 2157>:

a664.seq

```
  1 GTGATACATC CGCACCACTT CCGCGCCTTT TTCATAAACG GTCATGGTGT
51  AGAAATTGTT CATCTCCTCA TATCGGGCGG GGCGCACCGG ATGTGCGGTC
```

-continued

```
101 GGACCTGCGT CTTCGGGGAA CTGGTGCTGG CGCAGCAGGC GGATGTTTTC
151 GATACGGCGC ACGGCGCGGC TGGCGCGGTC GCCGGAAAAT TCTTGGTCGC
201 GGAACACGGT CAACCCTTCC TTCAGCGAAA GCTGGAACCA GTCGCGGCAG
251 GTCACGCGGT TGCCCGTCCA GTTGTGGAAA TATTCGTGTC CGACCACGGA
301 TTCGATGCCT TCAAAATCGG TATCGGTGGC GGTACGGCTG TCGGCAAGGA
351 CGAACTTGGT GTTAAAGATG TTCAAACCCT TGTTTTCCAT CGCACCCATA
401 TTGAAATCGC CCACGGCGAC GACCATGAAA ATATCCAAGT CGTATTCCAA
451 ACCGAAGCGC GTTTCGTCCC ACTTCATTGC GTTTTT.CAG CGATTCCACG
501 GCAAAGCCGA CCTTGGGCTT GTCCGCTTCG GTGGTGTAAA ACTCGATTTT
551 GA
```

This corresponds to the amino acid sequence <SEQ ID 2158; ORF 664.a>:

a664.pep

```
  1 VIHPHHFRAF FINGHGVEIV HLLISGGAHR MCGRTCVFGE LVLAQQADVF
 51 DTAHGAAGAV AGKFLVAEHG QPFLQRKLEP VAAGHAVARP VVEIFVSDHG
101 FDAFKIGIGG GTAVGKDELG VKDVQTLVFH RTHIEIAHGD DHENIQVVFQ
151 TEARFVPLHC VFXAIPRQSR PWACPLRWCK TRF*
```

m664/a664 92.9% identity in 183 aa overlap

```
                    10        20        30        40        50        60
m664.pep   VIHPHYFRAFFINGHGVEIVHLLIAGGAHRMGGRACVFGELVLAQQADVFDAAHGAAGAV
           |||||:||||||||||||||||||:||||||| |:||||||||||||||||:||||||||
a664       VIHPHHFRAFFINGHGVEIVHLLISGGAHRMCGRTCVFGELVLAQQADVFDTAHGAAGAV
                    10        20        30        40        50        60

                    70        80        90       100       110       120
m664.pep   AGKFLVAEHGQPFLQRKLEPVAAGYAVARPVVEILVSDHGFDAFEIGIGGGAAVGKDELG
           ||||||||||||||||||||||||:|||||||||:|||||||||:|||||||:|||||||
a664       AGKFLVAEHGQPFLQRKLEPVAAGHAVARPVVEIFVSDHGFDAFKIGIGGGTAVGKDELG
                    70        80        90       100       110       120

                   130       140       150       160       170       180
m664.pep   VKDVQTLVFHRAHIEIAHGDDHENIQVVFQTEARFVPFHRVFXTIPRQSRPWACPLRWCK
           |||||||||||:||||||||||||||||||||||||||:| |||:|||||||||||||||
a664       VKDVQTLVFHRTHIEIAHGDDHENIQVVFQTEARFVPLHCVFXAIPRQSRPWACPLRWCK
                   130       140       150       160       170       180

m664.pep   TRFX
           ||||
a664       TRFX
```

The following partial DNA sequence was identified in *N. gonorrhoeae* <SEQ ID 2159>:

g665.seq

```
  1 atgaagtgGg acgaaacgcg cttcgGgttg GAAtatgact tggatatttT
 51 CATGGTCGTC GCCGTAGGCG ATTTCAATAT GGGCGCGATG GAAAACAAGG
101 GTTTGAACAT TTTTAACACC AAGTTCGTCC TCGCCGACAG CCGCACCGCC
151 ACCGATACCG ATTTCGAAGG CATTGAATCC GTGGTCGGAC ACGAATATTT
201 CCACAACTGG ACGGGCAACC GCGTAACCTG CCGCGACTGG TTCCAGCTTT
251 CGCTGAAGGA AGGGCTGACC GTGTTCCGCG ACCAAGAGTT TTCCGGCGAC
```

-continued

```
 301 CGCGCCGGCC GCGCCGTGCG CCGCATCGAG AACATCCGCC TGCTGCGCCA
 351 GAACCAGTTC CCCGAAGACG CAGGCCCGAC CGCCCATCCG GTGCGCcccg
 401 TCAGCTATGA GGAGATGAAC AATTTCTACA CCATGACCGT TTATGAAAAA
 451 GGCGCGGAAG TGGTGCGGAT GTATCATACC CTGCTCGGCG AAGAGGGCTT
 501 CCAAAAAGGC ATGAAGCTAT ATTTCcaacg CCACGACGGA CAGGCAGTGA
 551 CCTGCGACGA TTTCCGCGCG GCGatggcgg ATGCGAACGG CATCAATCTC
 601 GACCAGTTCG CCTTGTGGTA CAGCCAGGCG GGCACGCCCG TTTTGGAAGC
 651 CGAAGGCCGT CTGAAAAACA ATGTTTTCGA GTTAACCATT AAACAAACCG
 701 TGCCGCCCAC GCCCGATATG GCGGACAAAC AGCCGATGAT GATTCCCGTC
 751 AAAGTCGGGC TTCTGAACCG CAACGGCGAA GCGGTGGCAT TCGATTATCA
 801 GGGCAAACGC GCAACCGAAG CCGTGTTGCT GATGACCGAA GCCGAACagg
 851 CCTTCCCGCT CGAAGGTGTA ACCGAAGCCG TCGTTCCCTC GCTGCTGCGC
 901 GGGTTCAGCG CGCCAGTGTA TCTGAACTAT CCGTACAGCG ACGACGACCT
 951 GCTGCTCCTG CTCGCCCACG ACAGCGACGC TTTCACGTGC TGGGAAGCCG
1001 CCCAAACGCT CTACCGTCGC GCCGTCGCCG CCAACCTTGC CGCGCTTTCA
1051 GACGGCATCG GGTTGCCGAA ACACGAAAAA CTGCTTGCCG CCGTCGAAAA
1101 AGTCATTTCA GACGACCTCT TGGACAACGC CTTCAAAGCC CTGCTTTTGG
1151 GCGTGCCGTC CGAAGCCGAa ctGTGGGACG GCACGGAAAA CATcgaCCCG
1201 CTGCGCTACC ATCAGGCGCG CGAAGCCTTG TTGGATACGC TTGCCGtcCG
1251 CttcctgcCG AAATGGCACG AATTGGaccg tcaggcggcg aagCAggaaa
1301 accaaagtTA CGAATACAGC CCCGAAACCG CCGACTGGCG CACGCTGCGC
1351 AACGTCTGCC GCGCCTtcgt cctGCGCGCC GACCCCGCGC acatcgAAAC
1401 TGTTGCCGAA Aaatacggcg AAATGGCGCA AAACATGACC CACGAATGGG
1451 GCATCCTGTC CGCCGTCAAC GGCAACGAAA GCGATACGCG CAACTGCCTG
1501 CTGGCGCAGT TTGCCGAcaa gTtttcAGAC GACGCGCTGG TGATGGACAA
1551 ATATTTCGCC CTTATCGGCT CAAGccgccg cagCGACACC CTGCAACAGG
1601 TTCAAACCGC CTTGCAGCAT CCGAAATTCA GTCTCGAAAA CCCCAACAAA
1651 GCCCGTTCGC TCATCGGCAG CTTCAGCCGC AACGTCCCGC ATTTTCACGC
1701 ACAAGACGGC AGCGGCTACC GCTTCATCGC CGACAAAGTC ATCGAAATCG
1751 ACCGCTTCAA cCCGCAggtc gccGCCCGCC TGGTGCAGGC GTTCAACCTC
1801 TGCAACAAGC TCGAGCCGCA CCGCAAAAAC TTgGTGAAAC AAGAATTGCA
1851 GTGCATTCGG GCGCAGGAAG GATTGTCGAA AGacGTGGGC GAaatcgtCG
1901 GCAAGATTTT GGGTTGA
```

This corresponds to the amino acid sequence <SEQ ID 2160; ORF 665.ng>:

g665.pep

```
 1 MKWDETRFGL EYDLDIFMVV AVGDFNMGAM ENKGLNIFNT KFVLADSRTA
51 TDTDFEGIES VVGHEYFHNW TGNRVTCRDw FQLSLKEGLT VFRDQEFSGD
```

-continued

```
101 RAGRAVRRIE NIRLLRQNQF PEDAGPTAHP VRPVSYEEMN NFYTMTVYEK

151 GAEVVRMYHT LLGEEGFQKG MKLYFQRHDG QAVTCDDFRA AMADANGINL

201 DQFALWYSQA GTPVLEAEGR LKNNVFELTI KQTVPPTPDM ADKQPMMIPV

251 KVGLLNRNGE AVAFDYQGKP ATEAVLLMTE AEQAFPLEGV TEAVVPSLLR

301 GFSAPVYLNY PYSDDDLLLL LAHDSDAFTC WEAAQTLYRR AVAANLAALS

351 DGIGLPKHEK LLAAVEKVIS DDLLDNAFKA LLLGVPSEAE LWDGTENIDP

401 LRYHQAREAL LDTLAVRFLP KWHELDRQAA KQENQSYEYS PETADWRTLR

451 NVCRAFVLRA DPAHIETVAE KYGEMAQNMT HEWGILSAVN GNESDTRNCL

501 LAQFADKFSD DALVMDKYFA LIGSSRRSDT LQQVQTALQH PKFSLENPNK

551 ARSLIGSFSR NVPHFHAQDG SGYRFIADKV IEIDRFNPQV AARLVQAFNL

601 CNKLEPHRKN LVKQELQCIR AQEGLSKDVG EIVGKILG*
```

The following partial DNA sequence was identified in *N. meningitidis* <SEQ ID 2161>:

m665.seq

```
   1 ATGAAATGGG ACGAAACGCG CTTCGGTTTG GAATACGACT TGGATATTTT

  51 CATGGTCGTC GCCGTGGGCG ATTTCAATAT GGGCGCGATG GAAAACAAGG

 101 GTTTGAACAT CTTTAACACC AAGTTCGTCC TTGCCGACAG CCGCACCGCC

 151 ACCGATACCG ATTTCGAAGG CATCGAATCC GTGGTCGGAC ACGAGTATTT

 201 CCACAACTGG ACGGGCAACC GCGTAACCTG CCGCGACTGG TTCCAGCTTT

 251 CGCTGAAGGA AGGGCTGACC GTGTTCCGCG ACCAAGAATT TTCCGGCGAC

 301 CGCGCCAGCC GCGCCGTGCG CCGCATCGAA AACATCCGCC TGCTGCGCCA

 351 GCACCAGTTC CCCGAAGACG CAGGCCCGAC CGCCCATCCG GTGCGCCCCG

 401 CCAGCTATGA GGAGATGAAC AATTTCTACA CCATGACCGT TTATGAAAAA

 451 GGCGCGGAAG TAGTGCGGAT GTATCACACC CTGCTCGGCG AAGAGGGCTT

 501 CCAGAAAGGC ATGAAGCTCT ATTTCCAACG CCACGACGGA CAGGCCGTTA

 551 CCTGCGACGA TTTCCGCGCG GCGATGGCGG ACGCGAACGG CATCAATCTC

 601 GACCAGTTCG CCTTGTGGTA CAGCCAGGCG GGCACGCCCG TTTTGGAAGC

 651 GGAAGGTCGT CTGAAAAACA ATATTTTCGA GTTGACCGTC AAACAAACCG

 701 TGCCGCCCAC GCCCGATATG ACGGATAAAC AGCCGATGAT GATTCCCGTC

 751 AAGGTCGGGC TGCTGAACCG CAACGGCGAA GCGGTGGCAT TCGACTATCA

 801 GGGCAAACGC GCGACCGAAG CCGTGTTGCT GCTGACCGAA GCCGAACAGA

 851 CCTTCCTGCT CGAAGGCGTA ACCGAAGCCG TCGTTCCCTC GCTGCTGCGC

 901 GGGTTCAGCG CGCCGGTGCA TCTGAACTAT CCGTACAGCG ACGACGACCT

 951 GCTGCTCCTG CTCGCCCATG ACAGCGACGC CTTCACGCGC TGGGAAGCCG

1001 CCCAAACGCT CTACCGCCGC GCCGTCGCCG CCAACCTTGC CACGCTTTCA

1051 GACGGCGTTG AGCTGCCGAA ACACGAAAAA CTGCTTGCCG CCGTCGAAAA

1101 AGTCATTTCA GACGACCTCT TAGACAACGC CTTCAAAGCC CTGCTTTTGG

1151 GCGTGCCATC CGAAGCCGAG CTGTGGGACG GCGCAGAAAA CATCGACCCG

1201 CTGCGCTACC ATCAGGCGCG CGAAGCCTTG TTGGATACGC TTGCCGTCCA
```

-continued

```
1251 CTTCCTGCCG AAATGGCACG AATTGAACCG TCAGGCGGCG AAGCAGGAAA

1301 ACCAAAGCTA CGAATACAGC CCCGAAGCCG CCGGCTGGCG CACGCTGCGC

1351 AACGTCTGCC GCGCCTTTGT CCTGCGCGCC GACCCCGCGC ACATCGAAAC

1401 CGTTGCCGAA AAATACGGCG AAATGGCGCA AAACATGACC CACGAATGGG

1451 GCATCCTGTC CGCCGTCAAC GGCAACGAAA GCGATACGCG CAACCGCCTG

1501 CTGGCGCAGT TTGCCGACAA GTTTTCAGAC GACGCGCTGG TGATGGACAA

1551 ATATTTTGCC CTCGTCGGCT CAAGCCGCCG CAGCGACACC CTGCAACAGG

1601 TTCGAACCGC CTTGCAGCAT CCGAAATTCA GCCTCGAAAA CCCCAACAAA

1651 GCCCGTTCGC TCATCGGCAG CTTCAGCCGC AACGTCCCGC ATTTCCACGC

1701 AGAAGACGGC AGCGGCTACC GCTTCATCGC CGACAAAGTC ATCGAAATCG

1751 ACCGCTTCAA CCCGCAGGTC GCCGCCCGCT TAGTGCAGGC GTTCAACCTC

1801 TGCAACAAGC TCGAGCCGCA CCGCAAAAAC TTGGTGAAAC AAGCATTGCA

1851 GCGCATTCGG GCGCAGGAAG GATTGTCGAA AGACGTGGGC GAAATCGTCG

1901 GCAAAATTTT GGATTGA
```

This corresponds to the amino acid sequence <SEQ ID 2162; ORF 665>:

m665.pep

```
  1 MKWDETRFGL EYDLDIFMVV AVGDFNMGAM ENKGLNIFNT KFVLADSRTA

 51 TDTDFEGIES VVGHEYFHNW TGNRVTCRDW FQLSLKEGLT VFRDQEFSGD

101 RASRAVRRIE NIRLLRQHQF PEDAGPTAHP VRPASYEEMN NFYTMTVYEK

151 GAEVVRMYHT LLGEEGFQKG MKLYFQRHDG QAVTCDDFRA AMADANGINL

201 DQFALWYSQA GTPVLEAEGR LKNNIFELTV KQTVPPTPDM TDKQPMMIPV

251 KVGLLNRNGE AVAFDYQGKR ATEAVLLLTE AEQTFLLEGV TEAVVPSLLR

301 GFSAPVHLNY PYSDDDLLLL LAHDSDAFTR WEAAQTLYRR AVAANLATLS

351 DGVELPKHEK LLAAVEKVIS DDLLDNAFKA LLLGVPSEAE LWDGAENIDP

401 LRYHQAREAL LDTLAVHFLP KWHELNRQAA KQENQSYEYS PEAAGWRTLR

451 NVCRAFVLRA DPAHIETVAE KYGEMAQNMT HEWGILSAVN GNESDTRNRL

501 LAQFADKFSD DALVMDKYFA LVGSSRRSDT LQQVRTALQH PKFSLENPNK

551 ARSLIGSFSR NVPHFHAEDG SGYRFIADKV IEIDRFNPQV AARLVQAFNL

601 CNKLEPHRKN LVKQALQRIR AQEGLSKDVG EIVGKILD*
```

Computer analysis of this amino acid sequence gave the following results:

Homology with a predicted ORF from *N. gonorrhoeae* m665/g665 96.1% identity in 637 aa overlap

```
                   10        20        30        40        50        60
m665.pep   MKWDETRFGLEYDLDIFMVVAVGDFNMGAMENKGLNIFNTKFVLADSRTATDTDFEGIES
           ||||||||||||||||||||||||||||||||||||||||||||||||||||||||||||
g665       MKWDETRFGLEYDLDIFMVVAVGDFNMGAMENKGLNIFNTKFVLADSRTATDTDFEGIES
                   10        20        30        40        50        60
```

-continued

```
                  70        80        90       100       110       120
m665.pep  VVGHEYFHNWTGNRVTCRDWFQLSLKEGLTVFRDQEFSGDRASRAVRRIENIRLLRQHQF
          ||||||||||||||||||||||||||||||||||||||||||:||||||||||||||:||
g665      VVGHEYFHNWTGNRVTCRDWFQLSLKEGLTVFRDQEFSGDRAGRAVRRIENIRLLRQNQF
                  70        80        90       100       110       120

                 130       140       150       160       170       180
m665.pep  PEDAGPTAHPVRPASYEEMNNFYTMTVYEKGAEVVRMYHTLLGEEGFQKGMKLYFQRHDG
          |||||||||||||:||||||||||||||||||||||||||||||||||||||||||||||
g665      PEDAGPTAHPVRPVSYEEMNNFYTMTVYEKGAEVVRMYHTLLGEEGFQKGMKLYFQRHDG
                 130       140       150       160       170       180

                 190       200       210       220       230       240
m665.pep  QAVTCDDFRAAMADANGINLDQFALWYSQAGTPVLEAEGRLKNNIFELTVKQTVPPTPDM
          ||||||||||||||||||||||||||||||||||||||||||||:||||:||||||||||
g665      QAVTCDDFRAAMADANGINLDQFALWYSQAGTPVLEAEGRLKNNVFELTIKQTVPPTPDM
                 190       200       210       220       230       240

                 250       260       270       280       290       300
m665.pep  TDKQPMMIPVKVGLLNRNGEAVAFDYQGKRATEAVLLLTEAEQTFLLEGVTEAVVSPLLR
          :||||||||||||||||||||||||||||||||||||:|||||:| ||||||||||||||
g665      ADKQPMMIPVKVGLLNRNGEAVAFDYQGKRATEAVLLMTEAEQAFPLEGVTEAVVSPLLR
                 250       260       270       280       290       300

                 310       320       330       340       350       360
m665.pep  GFSAPVHLNYPYSDDDLLLLLAHDSDAFTRWEAAQTLYRRAVAANLATLSDGVELPKHEK
          ||||||:|||||||||||||||||||||| |||||||||||||||||:||||: ||||||
g665      GFSAPVYLNYPYSDDDLLLLLAHDSDAFTCWEAAQTLYRRAVAANLAALSDGIGLPKHEK
                 310       320       330       340       350       360

                 370       380       390       400       410       420
m665.pep  LLAAVEKVISDDLLDNAFKALLLGVPSEAELWDGAENIDPLRYHQAREALLDTLAVHFLP
          ||||||||||||||||||||||||||||||||||:|||||||||||||||||||||:|||
g665      LLAAVEKVISDDLLDNAFKALLLGVPSEAELWDGTENIDPLRYHQAREALLDTLAVRFLP
                 370       380       390       400       410       420

                 430       440       450       460       470       480
m665.pep  KWHELNRQAAKQENQSYEYSPEAAGWRTLRNVCRAFVLRADPAHIETVAEKYGEMAQNMT
          |||||:||||||||||||||||:| |||||||||||||||||||||||||||||||||||
g665      KWHELDRQAAKQENQSYEYSPETADWRTLRNVCRAFVLRADPAHIETVAEKYGEMAQNMT
                 430       440       450       460       470       480

                 490       500       510       520       530       540
m665.pep  HEWGILSAVNGNESDTRNRLLAQFADKFSDDALVMDKYFALVGSSRRSDTLQQVRTALQH
          |||||||||||||||||| ||||||||||||||||||||||:||||||||||||:|||||
g665      HEWGILSAVNGNESDTRNCLLAQFADKFSDDALVMDKYFALIGSSRRSDTLQQVQTALQH
                 490       500       510       520       530       540

                 550       560       570       580       590       600
m665.pep  PKFSLENPNKARSLIGSFSRNVPHFHAEDGSGYRFIADKNIEIDRFNPQVAARLVQAFNL
          |||||||||||||||||||||||||||:||||||||||||||||||||||||||||||||
g665      PKFSLENPNKARSLIGSFSRNVPHFHAQDGSGYRFIADKNIEIDRFNPQVAARLVQAFNL
                 550       560       570       580       590       600

                 610       620       630      639
m665.pep  CNKLEPHRKNLVKQALQRIRAQEGLSKDVGEIVGKILDX
          |||||||||||||| || |||||||||||||||||||
g665      CNKLEPHRKNLVKQELQCIRAQEGLSKDVGEIVGKILGX
                 610       620       630
```

The following partial DNA sequence was identified in *N. meningitidis* <SEQ ID 2163>:

a665.seq

```
  1 ATGAAGTGGG ACGAAACGCG CTTCGGTTTG GAATACGACT TGGATATTTT
 51 CATGGTCGTC GCCGTGGGCG ATTTCAATAT GGGTGCGATG GAAAACAAGG
101 GTTTGAACAT CTTTAACACC AAGTTCGTCC TTGCCGACAG CCGTACCGCC
151 ACCGATACCG ATTTTGAAGG CATCGAATCC GTGGTCGGAC ACGAATATTT
201 CCACAACTGG ACGGGCAACC GCGTGACCTG CCGCGACTGG TTCCAGCTTT
251 CGCTGAAGGA AGGGTTGACC GTGTTCCGCG ACCAAGAATT TTCCGGCGAC
301 CGCGCCAGCC GCGCCGTGCG CCGTATCGAA AACATCCGCC TGCTGCGCCA
351 GCACCAGTTC CCCGAAGACG CAGGTCCGAC CGCACATCCG GTGCGCCCCG
401 CCCGATATGA GGAGATGAAC AATTTCTACA CCATGACCGT TTATGAAAAA
451 GGCGCGGAAG TGGTGCGGAT GTATCACACC TTGCTCGGCG AAGAGGGCTT
501 CCAAAAAGGT ATGAAGCTCT ATTTCCAACG CCACGACGGA CAGGCTGTTA
```

-continued

```
 551 CCTGCGACGA TTTCCGCGCG GCGATGGTGG ACGCGAACGG CATCAACCTC
 601 GACCAATTCG CCTTGTGGTA CAGCCAAGCA GGTACGCCGG TTTTAGATGC
 651 TCAAGGGCGT CTGAAAAACA ATGTGTTCGA GTTAACCATC AAACAAACCG
 701 TGCCGCCCAC GCCCGATATG GCGGACAAAC AGCCGATGAT GATTCCCGTC
 751 AAAATCGGGC TGCTGAACTG CAACGGCGAA GCGGTGGCAT TTGATTATCA
 801 GGGCAAACGC GCGACCGAAG CCGTGTTGCT GCTGACCGAA GCCGAACAGA
 851 CCTTCCAGTT CGAAAGCGTA ACCGAAGCCG TCGTTCCCTC GCTGCTGCGC
 901 GGGTTCAGCG CGCCGGTGCA TCTGAACTAT CCGTACAGCG ACGACGACCT
 951 GCTGCTTCTG CTCGCCCATG ACAGCGACGC CTTCACGCGC TGGGAAGCCG
1001 CACAAACGCT CTACCGCCGT GCCGTCGCCG CCAACCTTGC CGCGCTTTCA
1051 GACGGCGTCG AGTTGCCGAA ACACGAAAAA CTGCTTGCCG CCGTCGAAAA
1101 AGTCATTTCA GACGACCTCT TAGACAACGC TTTCAAAGCC CTGCTTTTGG
1151 GTGTGCCGTC TGAAGCCGAG CTGTGGGACG GCGCGGAAAA CATCGACCCG
1201 CTGCGCTACC ATCAGGCGCG CGAAGCCTTG TTGGATATAC TTGCCGTCCG
1251 CTTTCTGCCG AAATGGCACG AATTGAACCG TCAGGCGGCG AAGCAGGAAA
1301 ACCAAAGCTA CGAGTACAGC CCCGAAGCCG CCGGTTGGCG CACGCTGCGC
1351 AATGTCTGCC GCGCCTTCGT CCTGCGCGCC GATCCCGCGC ACATCGAAAC
1401 CGTTGCCGAG AAATACGCCG AAATGGCGCA AAACATGACC CACGAATGGG
1451 GCATCCTGTC CGCCGTCAAC GGCAACGAAA GCGATACGCG CAACCGCCTG
1501 CTGGCGCAGT TTGCCGACAA GTTTTCAGAC GACGCGCTGG TGATGGACAA
1551 ATATTTCGCC CTCGTCGGCT CAAGCCGCCG CAGCGACACC CTGCAACAGG
1601 TTCAAACCGC CTTGCAGCAT CCGAAGTTCA GCCTCGAAAA TCCCAACAAA
1651 GCCCGCTCGC TCATCGGCAG CTTCAGCCGC AACGTCCCGC ATTTCCACGC
1701 AGAAGACGGC AGCGGCTACC GCTTCATCGC CGACAAAGTC ATCGAAATCG
1751 ACCGCTTTAA CCCGCAGGTC GCCGCCCGCC TGGTGCAGGC GTTCAACCTC
1801 TGCAACAAGC TCGAGCCGCA CCGCAAAAAC TTGGTGAAAC AAGCATTGCA
1851 GCGCATTCGG GCGCAGGAAG GATTGTCGAA AGACGTGGGC GAAATCGTCG
1901 GCAAAATTTT GGATTGA
```

This corresponds to the amino acid sequence <SEQ ID 2164; ORF 665.a>:

a665.pep

```
  1 MKWDETRFGL EYDLDIFMVV AVGDFNMGAM ENKGLNIFNT KFVLADSRTA
 51 TDTDFEGIES VVGHEYFHNW TGNRVTCRDW FQLSLKEGLT VFRDQEFSGD
101 RASRAVRRIE NIRLLRQHQF PEDAGPTAHP VRPARYEEMN NFYTMTVYEK
151 GAEVVRMYHT LLGEEGFQKG MKLYFQRHDG QAVTCDDFRA AMVDANGINL
201 DQFALWYSQA GTPVLDAQGR LKNNVFELTI KQTVPPTPDM ADKQPMMIPV
251 KIGLLNCNGE AVAFDYQGKR ATEAVLLLTE AEQTFQFESV TEAVVPSLLR
301 GFSAPVHLNY PYSDDDLLLL LAHDSDAFTR WEAAQTLYRR AVAANLAALS
```

-continued

```
351 DGVELPKHEK LLAAVEKVIS DDLLDNAFKA LLLGVPSEAE LWDGAENIDP

401 LRYHQAREAL LDILAVRFLP KWHELNRQAA KQENQSYEYS PEAAGWRTLR

451 NVCRAFVLRA DPAHIETVAE KYAEMAQNMT HEWGILSAVN GNESDTRNRL

501 LAQFADKFSD DALVMDKYFA LVGSSRRSDT LQQVQTALQH PKFSLENPNK

551 ARSLIGSFSR NVPHFHAEDG SGYRFIADKV IEIDRFNPQV AARLVQAFNL

601 CNKLEPHRKN LVKQALQRIR AQEGLSKDVG EIVGKILD*
```

m665/a665 97.3% identity in 638 aa overlap

```
                  10        20        30        40        50        60
m665.pep  MKWDETRFGLEYDLDIFMVVAVGDFNMGAMENKGLNIFNTKFVLADSRTATDTDFEGIES
          ||||||||||||||||||||||||||||||||||||||||||||||||||||||||||||
a665      MKWDETRFGLEYDLDIFMVVAVGDFNMGAMENKGLNIFNTKFVLADSRTATDTDFEGIES
                  10        20        30        40        50        60

                  70        80        90       100       110       120
m665.pep  VVGHEYFHNWTGNRVTCRDWFQLSLKEGLTVFRDQEFSGDRASRAVRRIENIRLLRQHQF
          ||||||||||||||||||||||||||||||||||||||||||||||||||||||||||||
a665      VVGHEYFHNWTGNRVTCRDWFQLSLKEGLTVFRDQEFSGDRASRAVRRIENIRLLRQHQF
                  70        80        90       100       110       120

                 130       140       150       160       170       180
m665.pep  PEDAGPTAHPVRPASYEEMNNFYTMTVYEKGAEVVRMYHTLLGEEGFQKGMKLYFQRHDG
          |||||||||||||| |||||||||||||||||||||||||||||||||||||||||||||
a665      PEDAGPTAHPVRPARYEEMNNFYTMTVYEKGAEVVRMYHTLLGEEGFQKGMKLYFQRHDG
                 130       140       150       160       170       180

                 190       200       210       220       230       240
m665.pep  QAVTCDDFRAAMADANGINLDQFALWYSQAGTPVLEAEGRLKNNIFELTVKQTVPPTPDM
          ||||||||||||:||||||||||||||||||||||:|:||||||:||||:||||||||||
a665      QAVTCDDFRAAMVDANGINLDQFALWYSQAGTPVLDAQGRLKNNVFELTIKQTVPPTPDM
                 190       200       210       220       230       240

                 250       260       270       280       290       300
m665.pep  TDKQPMMIPVKVGLLNRNGEAVAFDYQGKRATEAVLLLTEAEQTFLLEGVTEAVVSPLLR
          :||||||||||:|||| |||||||||||||||||||||||||||| :|:|||||||||||
a665      ADKQPMMIPVKIGLLNCNGEAVAFDYQGKRATEAVLLLTEAEQTFQFESVTEAVVSPLLR
                 250       260       270       280       290       300

                 310       320       330       340       350       360
m665.pep  GFSAPVHLNYPYSDDDLLLLLAHDSDAFTRWEAAQTLYRRAVAANLATLSDGVELPKHEK
          |||||||||||||||||||||||||||||||||||||||||||||||:||||||||||||
a665      GFSAPVHLNYPYSDDDLLLLLAHDSDAFTRWEAAQTLYRRAVAANLAALSDGVELPKHEK
                 310       320       330       340       350       360

                 370       380       390       400       410       420
m665.pep  LLAAVEKVISDDLLDNAFKALLLGVPSEAELWDGAENIDPLRYHQAREALLDTLAVHFLP
          |||||||||||||||||||||||||||||||||||||||||||||||||||| |||:|||
a665      LLAAVEKVISDDLLDNAFKALLLGVPSEAELWDGAENIDPLRYHQAREALLDILAVRFLP
                 370       380       390       400       410       420

                 430       440       450       460       470       480
m665.pep  KWHELNRQAAKQENQSYEYSPEAAGWRTLRNVCRAFVLRADPAHIETVAEKYGEMAQNMT
          ||||||||||||||||||||||||||||||||||||||||||||||||||||:|||||||
a665      KWHELNRQAAKQENQSYEYSPEAAGWRTLRNVCRAFVLRADPAHIETVAEKYAEMAQNMT
                 430       440       450       460       470       480

                 490       500       510       520       530       540
m665.pep  HEWGILSAVNGNESDTRNRLLAQFADKFSDDALVMDKYFALVGSSRRSDTLQQVRTALQH
          ||||||||||||||||||||||||||||||||||||||||||||||||||||||:|||||
a665      HEWGILSAVNGNESDTRNRLLAQFADKFSDDALVMDKYFALVGSSRRSDTLQQVQTALQH
                 490       500       510       520       530       540

                 550       560       570       580       590       600
m665.pep  PKFSLENPNKARSLIGSFSRNVPHFHAEDGSGYRFIADKNIEIDRFNPQVAARLVQAFNL
          ||||||||||||||||||||||||||||||||||||||||||||||||||||||||||||
a665      PKFSLENPNKARSLIGSFSRNVPHFHAEDGSGYRFIADKNIEIDRFNPQVAARLVQAFNL
                 550       560       570       580       590       600

                 610       620       630      639
m665.pep  CNKLEPHRKNLVKQALQRIRAQEGLSKDVGEIVGKILDX
          ||||||||||||||||||||||||||||||||||||||
a665      CNKLEPHRKNLVKQALQRIRAQEGLSKDVGEIVGKILDX
                 610       620       630
```

The following partial DNA sequence was identified in *N. gonorrhoeae* <SEQ ID 2165>:

g665-1.seq

```
   1 ATGAGCAAAA CCGTCCGTTA TCTGAAAGAT TACCAAACGC CTGCCTACCG
  51 CATTCTTGAA ACCGAACTGC ATTTCGACAT TGCCGAACCG CAAACCGTCG
 101 TGAAGTCGCG TTTGACGGTC GAGCCGCAGA GGGCGGGCGA GCCGCTGGTG
 151 TTGGACGGTT CGGCAAAACT CTTGTCCGTC AAAATCAACG GCGCGGCGGC
 201 GGATTATGTG TTGGAAGGCG AGACGCTGAC GATTGCAGAC GTACCGTCCG
 251 AACGCTTCAC CGTCGAAGTG GAAACCGAAA TCCTGCCGGC GGAAAACAAA
 301 TCGCTGATGG GCTGTATGC TTCCGGCGGC AATCTGTTTA CCCAGTGCGA
 351 GCCGGAGGGC TTCCGCAAAA TCACGTTCTA CATCGACCGT CCGGATGTGA
 401 TGTCCAAGTT CACGACCACC ATCGTCGCGG ACAAAAAACG CTATCCCGTT
 451 TTGCTTTCCA ACGGCAACAA AATCGACGGC GGCGAGTTTT CAGACGGCCG
 501 CCATTGGGTG AAATGGGAAG ACCCGTTTGC CAAACCGAGT TATCTGTTTG
 551 CTTTGGTCGC GGGCGATTTG GCGGTAACGG AAGACCGTTT CACCACCATG
 601 AGCGGCAGAA ACGTCAAAAT CGAGTTTTAC ACCACCGAAG CGGACAAACC
 651 CAAGGTCGGC TTTGCCGTGG AATCGTTGAA AAACGCGATG AAGTGGGACG
 701 AAACGCGCTT CGGGTTGGAA TATGACTTGG ATATTTTCAT GGTCGTCGCC
 751 GTAGGCGATT TCAATATGGG CGCGATGGAA AACAAGGGTT TGAACATTTT
 801 TAACACCAAG TTCGTCCTCG CCGACAGCCG CACCGCCACC GATACCGATT
 851 TCGAAGGCAT TGAATCCGTG GTCGGACACG AATATTTCCA CAACTGGACG
 901 GGCAACCGCG TAACCTGCCG CGACTGGTTC CAGCTTTCGC TGAAGGAAGG
 951 GCTGACCGTG TTCCGCGACC AAGAGTTTTC CGGCGACCGC GCCGGCCGCG
1001 CCGTGCGCCG CATCGAGAAC ATCCGCCTGC TGCGCCAGAA CCAGTTCCCC
1051 GAAGACGCAG GCCCGACCGC CCATCCGGTG CGCCCCGTCA GCTATGAGGA
1101 GATGAACAAT TTCTACACCA TGACCGTTTA TGAAAAAGGC GCGGAAGTGG
1151 TGCGGATGTA TCATACCCTG CTCGGCGAAG AGGGCTTCCA AAAAGGCATG
1201 AAGCTATATT TCCAACGCCA CGACGGACAG GCAGTGACCT GCGACGATTT
1251 CCGCGCGGCG ATGGCGGATG CGAACGGCAT CAATCTCGAC CAGTTCGCCT
1301 TGTGGTACAG CCAGGCGGGC ACGCCCGTTT TGGAAGCCGA AGGCCGTCTG
1351 AAAAACAATG TTTTCGAGTT AACCATTAAA CAAACCGTGC CGCCCACGCC
1401 CGATATGGCG GACAAACAGC CGATGATGAT TCCCGTCAAA GTCGGGCTTC
1451 TGAACCGCAA CGGCGAAGCG GTGGCATTCG ATTATCAGGG CAAACGCGCA
1501 ACCGAAGCCG TGTTGCTGAT GACCGAAGCC GAACAGGCCT TCCCGCTCGA
1551 AGGTGTAACC GAAGCCGTCG TTCCCTCGCT GCTGCGCGGG TTCAGCGCGC
1601 CAGTGTATCT GAACTATCCG TACAGCGACG ACGACCTGCT GCTCCTGCTC
1651 GCCCACGACA GCGACGCTTT CACGTGCTGG GAAGCCGCCC AAACGCTCTA
1701 CCGTCGCGCC GTCGCCGCCA ACCTTGCCGC GCTTTCAGAC GGCATCGGGT
1751 TGCCGAAACA CGAAAAACTG CTTGCCGCCG TCGAAAAAGT CATTTCAGAC
1801 GACCTCTTGG ACAACGCCTT CAAAGCCCTG CTTTTGGGCG TGCCGTCCGA
1851 AGCCGAACTG TGGGACGGCA CGGAAAACAT CGACCCGCTG CGCTACCATC
1901 AGGCGCGCGA AGCCTTGTTG GATACGCTTG CCGTCCGCTT CCTGCCGAAA
```

-continued

```
1951 TGGCACGAAT TGGACCGTCA GGCGGCGAAG CAGGAAAACC AAAGTTACGA
2001 ATACAGCCCC GAAACCGCCG ACTGGCGCAC GCTGCGCAAC GTCTGCCGCG
2051 CCTTCGTCCT GCGCGCCGAC CCCGCGCACA TCGAAACTGT TGCCGAAAAA
2101 TACGGCGAAA TGGCGCAAAA CATGACCCAC GAATGGGGCA TCCTGTCCGC
2151 CGTCAACGGC AACGAAAGCG ATACGCGCAA CTGCCTGCTG GCGCAGTTTG
2201 CCGACAAGTT TTCAGACGAC GCGCTGGTGA TGGACAAATA TTTCGCCCTT
2251 ATCGGCTCAA GCCGCCGCAG CGACACCCTG CAACAGGTTC AAACCGCCTT
2301 GCAGCATCCG AAATTCAGTC TCGAAAACCC CAACAAAGCC CGTTCGCTCA
2351 TCGGCAGCTT CAGCCGCAAC GTCCCGCATT TTCACGCACA AGACGGCAGC
2401 GGCTACCGCT TCATCGCCGA CAAAGTCATC GAAATCGACC GCTTCAACCC
2451 GCAGGTCGCC GCCCGCCTGG TGCAGGCGTT CAACCTCTGC AACAAGCTCG
2501 AGCCGCACCG CAAAAACTTG GTGAAACAAG AATTGCAGTG CATTCGGGCG
2551 CAGGAAGGAT TGTCGAAAGA CGTGGGCGAA ATCGTCGGCA AGATTTTGGG
2601 TTGA
```

This corresponds to the amino acid sequence <SEQ ID 2166; ORF 665-1.ng>:

g665-1.pep

```
  1 MSKTVRYLKD YQTPAYRILE TELHFDIAEP QTVVKSRLTV EPQRAGEPLV
 51 LDGSAKLLSV KINGAAADYV LEGETLTIAD VPSERFTVEV ETEILPAENK
101 SLMGLYASGG NLFTQCEPEG FRKITFYIDR PDVMSKFTTT IVADKKRYPV
151 LLSNGNKIDG GEFSDGRHWV KWEDPFAKPS YLFALVAGDL AVTEDRFTTM
201 SGRNVKIEFY TTEADKPKVG FAVESLKNAM KWDETRFGLE YDLDIFMVVA
251 VGDFNMGAME NKGLNIFNTK FVLADSRTAT DTDFEGIESV VGHEYFHNWT
301 GNRVTCRDWF QLSLKEGLTV FRDQEFSGDR AGRAVRRIEN IRLLRQNQFP
351 EDAGPTAHPV RPVSYEEMNN FYTMTVYEKG AEVVRMYHTL LGEEGFQKGM
401 KLYFQRHDGQ AVTCDDFRAA MADANGINLD QFALWYSQAG TPVLEAEGRL
451 KNNVFELTIK QTVPPTPDMA DKQPMMIPVK VGLLNRNGEA VAFDYQGKRA
501 TEAVLLMTEA EQAFPLEGVT EAVVPSLLRG FSAPVYLNYP YSDDDLLLLL
551 AHDSDAFTCW EAAQTLYRRA VAANLAALSD GIGLPKHEKL LAAVEKVISD
601 DLLDNAFKAL LLGVPSEAEL WDGTENIDPL RYHQAREALL DTLAVRFLPK
651 WHELDRQAAK QENQSYEYSP ETADWRTLRN VCRAFVLRAD PAHIETVAEK
701 YGEMAQNMTH EWGILSAVNG NESDTRNCLL AQFADKFSDD ALVMDKYFAL
751 IGSSRRSDTL QQVQTALQHP KFSLENPNKA RSLIGSFSRN VPHFHAQDGS
801 GYRFIADKVI EIDRFNPQVA ARLVQAFNLC NKLEPHRKNL VRQELQCIRA
851 QEGLSKDVGE IVGKILG*
```

The following partial DNA sequence was identified in *N. meningitidis* <SEQ ID 2167>:

m665-1.seq

```
   1 ATGAGCAAAA CCGTGCATTA TCTCAAAGAC TATCAAACGC CCGCCTACCA
  51 TATTCTCAAA ACCGATTTAC ATTTTGATAT TAATGAACCG CAAACCGTCG
 101 TGAAGTCGCG TTTGACGGTT GAGCCGCAGA GGGTAGGGGA GCCGCTGGTG
 151 TTGGACGGTT CGGCGAAACT CTTGTCCGTC AAAATCAACG GGGCGGCGGC
 201 GGATTATGTG TTGGAAGGAG AGACGCTGAC GATTGCGGGC GTGCCGTCCG
 251 AACGCTTCAC CGTCGAAGTG GAAACCGAAA TCCTGCCGGC GGAAAACAAA
 301 TCGCTGATGG GGCTGTATGC TTCCGGCGGC AATTTGTTTA CCCAGTGCGA
 351 GCCGGAGGGC TTCCGCAAAA TCACATTTTA CATCGACCGT CCGGATGTGA
 401 TGTCCAAGTT CACCACCACC ATCGTCGCCG ACAAAAAACG CTATCCCGTT
 451 TTGCTTTCCA ACGGCAACAA AATCGACGGC GGCGAGTTTT CAGACGGCCG
 501 CCATTGGGTG AAATGGGAAG ACCCGTTTTC CAAACCGAGC TATCTGTTTG
 551 CTTTGGTCGC GGGCGATTTG GCGGTAACGG AAGACTATTT CACCACCATG
 601 AGCGGCAGAA ACGTCAAAAT CGAGTTTTAC ACCACCGAAG CGGACAAGCC
 651 CAAGGTCGGC TTTGCCGTGG AATCGTTGAA AAACGCGATG AAATGGGACG
 701 AAACGCGCTT CGGTTTGGAA TACGACTTGG ATATTTTCAT GGTCGTCGCC
 751 GTGGGCGATT TCAATATGGG CGCGATGGAA AACAAGGGTT TGAACATCTT
 801 TAACACCAAG TTCGTCCTTG CCGACAGCCG CACCGCCACC GATACCGATT
 851 TCGAAGGCAT CGAATCCGTG GTCGGACACG AGTATTTCCA CAACTGGACG
 901 GGCAACCGCG TAACCTGCCG CGACTGGTTC CAGCTTTCGC TGAAGGAAGG
 951 GCTGACCGTG TTCCGCGACC AAGAATTTTC CGGCGACCGC GCCAGCCGCG
1001 CCGTGCGCCG CATCGAAAAC ATCCGCCTGC TGCGCCAGCA CCAGTTCCCC
1051 GAAGACGCAG GCCCGACCGC CCATCCGGTG CGCCCCGCCA GCTATGAGGA
1101 GATGAACAAT TTCTACACCA TGACCGTTTA TGAAAAAGGC GCGGAAGTAG
1151 TGCGGATGTA TCACACCCTG CTCGGCGAAG AGGGCTTCCA GAAAGGCATG
1201 AAGCTCTATT TCCAACGCCA CGACGGACAG GCCGTTACCT GCGACGATTT
1251 CCGCGCGGCG ATGGCGGACG CGAACGGCAT CAATCTCGAC CAGTTCGCCT
1301 TGTGGTACAG CCAGGCGGGC ACGCCCGTTT TGGAAGCGGA AGGTCGTCTG
1351 AAAAACAATA TTTTCGAGTT GACCGTCAAA CAAACCGTGC CGCCCACGCC
1401 CGATATGACG GATAAACAGC CGATGATGAT TCCCGTCAAG GTCGGGCTGC
1451 TGAACCGCAA CGGCGAAGCG GTGGCATTCG ACTATCAGGG CAAACGCGCG
1501 ACCGAAGCCG TGTTGCTGCT GACCGAAGCC GAACAGACCT TCCTGCTCGA
1551 AGGCGTAACC GAAGCCGTCG TTCCCTCGCT GCTGCGCGGG TTCAGCGCGC
1601 CGGTGCATCT GAACTATCCG TACAGCGACG ACGACCTGCT GCTCCTGCTC
1651 GCCCATGACA GCGACGCCTT CACGCGCTGG GAAGCCGCCC AAACGCTCTA
1701 CCGCCGCGCC GTCGCCGCCA ACCTTGCCAC GCTTTCAGAC GGCGTTGAGC
1751 TGCCGAAACA CGAAAAACTG CTTGCCGCCG TCGAAAAAGT CATTTCAGAC
1801 GACCTCTTAG ACAACGCCTT CAAAGCCCTG CTTTTGGGCG TGCCATCCGA
1851 AGCCGAGCTG TGGGACGGCG CAGAAAACAT CGACCCGCTG CGCTACCATC
1901 AGGCGCGCGA AGCCTTGTTG GATACGCTTG CCGTCCACTT CCTGCCGAAA
```

-continued

```
1951 TGGCACGAAT TGAACCGTCA GGCGGCGAAG CAGGAAAACC AAAGCTACGA
2001 ATACAGCCCC GAAGCCGCCG GCTGGCGCAC GCTGCGCAAC GTCTGCCGCG
2051 CCTTTGTCCT GCGCGCCGAC CCCGCGCACA TCGAAACCGT TGCCGAAAAA
2101 TACGGCGAAA TGGCGCAAAA CATGACCCAC GAATGGGGCA TCCTGTCCGC
2151 CGTCAACGGC AACGAAAGCG ATACGCGCAA CCGCCTGCTG GCGCAGTTTG
2201 CCGACAAGTT TTCAGACGAC GCGCTGGTGA TGGACAAATA TTTTGCCCTC
2251 GTCGGCTCAA GCCGCCGCAG CGACACCCTG CAACAGGTTC GAACCGCCTT
2301 GCAGCATCCG AAATTCAGCC TCGAAAACCC CAACAAAGCC CGTTCGCTCA
2351 TCGGCAGCTT CAGCCGCAAC GTCCCGCATT TCCACGCAGA AGACGGCAGC
2401 GGCTACCGCT TCATCGCCGA CAAAGTCATC GAAATCGACC GCTTCAACCC
2451 GCAGGTCGCC GCCCGCTTAG TGCAGGCGTT CAACCTCTGC AACAAGCTCG
2501 AGCCGCACCG CAAAAACTTG GTGAAACAAG CATTGCAGCG CATTCGGGCG
2551 CAGGAAGGAT TGTCGAAAGA CGTGGGCGAA ATCGTCGGCA AAATTTTGGA
2601 TTGA
```

This corresponds to the amino acid sequence <SEQ ID 2168; ORF 665-1>:

m665-1.pep

```
  1 MSKTVHYLKD YQTPAYHILK TDLHFDINEP QTVVKSRLTV EPQRVGEPLV
 51 LDGSAKLLSV KINGAAADYV LEGETLTIAG VPSERFTVEV ETEILPAENK
101 SLMGLYASGG NLFTQCEPEG FRKITFYIDR PDVMSKFTTT IVADKKRYPV
151 LLSNGNKIDG GEFSDGRHWV KWEDPFSKPS YLFALVAGDL AVTEDYFTTM
201 SGRNVKIEFY TTEADKPKVG FAVESLKNAM KWDETRFGLE YDLDIFMVVA
251 VGDFNMGAME NKGLNIFNTK FVLADSRTAT DTDFEGIESV VGHEYFHNWT
301 GNRVTCRDWF QLSLKEGLTV FRDQEFSGDR ASRAVRRIEN IRLLRQHQFP
351 EDAGPTAHPV RPASYEEMNN FYTMTVYEKG AEVVRMYHTL LGEEGFQKGM
401 KLYFQRHDGQ AVTCDDFRAA MADANGINLD QFALWYSQAG TPVLEAEGRL
451 KNNIFELTVK QTVPPTPDMT DKQPMMIPVK VGLLNRNGEA VAFDYQGKRA
501 TEAVLLLTEA EQTFLLEGVT EAVVPSLLRG FSAPVHLNYP YSDDDLLLLL
551 AHDSDAFTRW EAAQTLYRRA VAANLATLSD GVELPKHEKL LAAVEKVISD
601 DLLDNAFKAL LLGVPSEAEL WDGAENIDPL RYHQAREALL DTLAVHFLPK
651 WHELNRQAAK QENQSYEYSP EAAGWRTLRN VCRAFVLRAD PAHIETVAEK
701 YGEMAQNMTH EWGILSAVNG NESDTRNRLL AQFADKFSDD ALVMDKYFAL
751 VGSSRRSDTL QQVRTALQHP KFSLENPNKA RSLIGSFSRN VPHFHAEDGS
801 GYRFIADKVI EIDRFNPQVA ARLVQAFNLC NKLEPHRKNL VKQALQRIRA
851 QEGLSKDVGE IVGKILD*
```

m665-1/a665-1 96.1% identity in 866 aa overlap

```
                      10        20        30        40        50        60
m665-1.pep    MSKTVHYLKDYQTPAYHILKTDLHFDINEPQTVVKSRLTVEPQRVGEPLVLDGSAKLLSV
              |||||:||||||||||:||:|:||||| ||||||||||||||||:|||||||||||||||
g665-1        MSKTVRYLKDYQTPAYRILETELHFDIAEPQTVVKSRLTVEPQRAGEPLVLDGSAKLLSV
                      10        20        30        40        50        60

                      70        80        90       100       110       120
m665-1.pep    KINGAAADYVLEGETLTIAGVPSERFTVEVETEILPAENKSLMGLYASGGNLFTQCEPEG
              ||||||||||||||||||| ||||||||||||||||||||||||||||||||||||||||
g665-1        KINGAAADYVLEGETLTIADVPSERFTVEVETEILPAENKSLMGLYASGGNLFTQCEPEG
                      70        80        90       100       110       120

                     130       140       150       160       170       180
m665-1.pep    FRKITFYIDRPDVMSKFTTTIVADKKRYPVLLSNGNKIDGGEFSDGRHWVKWEDPFSKPS
              ||||||||||||||||||||||||||||||||||||||||||||||||||||||||:|||
g665-1        FRKITFYIDRPDVMSKFTTTIVADKKRYPVLLSNGNKIDGGEFSDGRHWVKWEDPFAKPS
                     130       140       150       160       170       180

                     190       200       210       220       230       240
m665-1.pep    YLFALVAGDLAVTEDYFTTMSGRNVKIEFYTTEADKPKVGFAVESLKNAMKWDETRFGLE
              ||||||||||||||| ||||||||||||||||||||||||||||||||||||||||||||
g665-1        YLFALVAGDLAVTEDRFTTMSGRNVKIEFYTTEADKPKVGFAVESLKNAMKWDETRFGLE
                     190       200       210       220       230       240

                     250       260       270       280       290       300
m665-1.pep    YDLDIFMVVAVGDFNMGAMENKGLNIFNTKFVLADSRTATDTDFEGIESVVGHEYFHNWT
              ||||||||||||||||||||||||||||||||||||||||||||||||||||||||||||
g665-1        YDLDIFMVVAVGDFNMGAMENKGLNIFNTKFVLADSRTATDTDFEGIESVVGHEYFHNWT
                     250       260       270       280       290       300

                     310       320       330       340       350       360
m665-1.pep    GNRVTCRDWFQLSLKEGLTVFRDQEFSGDRASRAVRRIENIRLLRQHQFPEDAGPTAHPV
              |||||||||||||||||||||||||||||||:|||||||||||||:||||||||||||||
g665-1        GNRVTCRDWFQLSLKEGLTVFRDQEFSGDRAGRAVRRIENIRLLRQNQFPEDAGPTAHPV
                     310       320       330       340       350       360

                     370       380       390       400       410       420
m665-1.pep    RPASYEEMNNFYTMTVYEKGAEVVRMYHTLLGEEGFQKGMKLYFQRHDGQAVTCDDFRAA
              ||:|||||||||||||||||||||||||||||||||||||||||||||||||||||||||
g665-1        RPVSYEEMNNFYTMTVYEKGAEVVRMYHTLLGEEGFQKGMKLYFQRHDGQAVTCDDFRAA
                     310       320       330       340       350       360

                     430       440       450       460       470       480
m665-1.pep    MADANGINLDQFALWYSQAGTPVLEAEGRLKNNIFELTVKQTVPPTPDMTDKQPMMIPVK
              |||||||||||||||||||||||||||||||||:||||:||||||||||:||||||||||
g665-1        MADANGINLDQFALWYSQAGTPVLEAEGRLKNNVFELTIKQTVPPTPDMADKQPMMIPVK
                     430       440       450       460       470       480

                     490       500       510       520       530       540
m665-1.pep    VGLLNRNGEAVAFDYQGKRATEAVLLLTEAEQTFLLEGVTEAVVPSLLRGFSAPVHLNYP
              ||||||||||||||||||||||||||:|||||:| ||||||||||||||||||||:||||
g665-1        VGLLNRNGEAVAFDYQGKRATEAVLLMTEAEQAFPLEGVTEAVVPSLLRGFSAPVYLNYP
                     490       500       510       520       530       540

                     550       560       570       580       590       600
m665-1.pep    YSDDDLLLLLAHDSDAFTRWEAAQTLYRRAVAANLATLSDGVELPKHEKLLAAVEKVISD
              |||||||||||||||||| |||||||||||||||||:||||: |||||||||||||||||
g665-1        YSDDDLLLLLAHDSDAFTCWEAAQTLYRRAVAANLAALSDGIGLPKHEKLLAAVEKVISD
                     490       500       510       520       530       540

                     610       620       630       640       650       660
m665-1.pep    DLLDNAFKALLLGVPSEAELWDGAENIDPLRYHQAREALLDTLAVHFLPKWHELNRQAAK
              |||||||||||||||||||||||:||||||||||||||||||||:||||||||:||||||
g665-1        DLLDNAFKALLLGVPSEAELWDGTENIDPLRYHQAREALLDTLAVRFLPKWHELDRQAAK
                     610       620       630       640       650       660

                     670       680       690       700       710       720
m665-1.pep    QENQSYEYSPEAAGMRTLRNVCRAFVLRADPAHIETVAEKYGEMAQNMTHEWGILSAVNG
              |||||||||||:| ||||||||||||||||||||||||||||||||||||||||||||||
g665-1        QENQSYEYSPETADMRTLRNVCRAFVLRADPAHIETVAEKYGEMAQNMTHEWGILSAVNG
                     670       680       690       700       710       720

                     730       740       750       760       770       780
m665-1.pep    NESDTRNRLLAQFADKFSDDALVMDKYFALVGSSRRSDTLQQVRTALQHPKFSLENPNKA
              ||||||| ||||||||||||||||||||||:||||||||||||:||||||||||||||||
g665-1        NESDTRNCLLAQFADKFSDDALVMDKYFALIGSSRRSDTLQQVQTALQHPKFSLENPNKA
                     730       740       750       760       770       780

                     790       800       810       820       830       840
m665-1.pep    RSLIGSFSRNVPHFHAEDGSGYRFIADKVIEIDRFNPQVAARLVQAFNLCNKLEPHRKNL
              ||||||||||||||||:|||||||||||||||||||||||||||||||||||||||||||
g665-1        RSLIGSFSRNVPHFHAQDGSGYRFIADKVIEIDRFNPQVAARLVQAFNLCNKLEPHRKNL
                     790       800       810       820       830       840

                     850       860
m665-1.pep    VKQALQRIRAQEGLSKDVGEIVGKILDX
              ||| || |||||||||||||||||||
g665-1        VKQELQCIRAQEGLSKDVGEIVGKILGX
                     850       860
```

The following partial DNA sequence was identified in *N. meningitidis* <SEQ ID 2169>:

a665-1.seq

1 ATGAGCAAAA CCGTGCATTA TCTCAAAGAC TATCAAACGC CCGCCTACCA
51 TATTCTCAAA ACCGATTTAC ATTTTGATAT TAACGAACCG CAAACCATTG
101 TGAAGTCGCG TTTGACGGTC GAGCCGAAGA GGGTGGGAGA GCCGCTGGTG
151 TTGGACGGTT CGGCGAAACT CTTGTCCGTC AAAATCAACG GCGTGGCGGC
201 GGATTATGTG TTGGAAGGCG AGACGCTGAC GATTGCGGAC GTGCCGTCCG
251 AACGCTTCAC CGTCGAAGTG GAAACCGAAA TCCTGCCGGC GGAAAACAAA
301 TCGCTGATGG GGCTGTATGC GTCCGCCGGT AACCTGTTTA CCCAGTGCGA
351 GCCGGAGGGC TTCCGCAAAA TCACGTTCTA TATCGACCGT CCGGATGTCA
401 TGTCCAAGTT CACGACCACC ATCGTCGCGG ACAAAAAACG CTATCCCGTT
451 TTGCTCTCCA ACGGCAACAA AATCGACGGC GGCGAGTATT CAGACGGCCG
501 CCATTGGGTG AAATGGGAAG ACCCGTTTGC CAAACCGAGT TATCTGTTTG
551 CTTTGGTCGC GGGCGATTTG GCGGTCACGG AAGACTATTT CACCACCATG
601 AGCGGCAGAA ACGTCAAAAT CGAGTTTTAC ACCACCGAAG CGGACAAGCC
651 CAAGGTCGGC TTTGCCGTGG AATCGCTGAA AAACGCAATG AAGTGGGACG
701 AAACGCGCTT CGGTTTGGAA TACGACTTGG ATATTTTCAT GGTCGTCGCC
751 GTGGGCGATT TCAATATGGG TGCGATGGAA AACAAGGGTT TGAACATCTT
801 TAACACCAAG TTCGTCCTTG CCGACAGCCG TACCGCCACC GATACCGATT
851 TTGAAGGCAT CGAATCCGTG GTCGGACACG AATATTTCCA CAACTGGACG
901 GGCAACCGCG TGACCTGCCG CGACTGGTTC CAGCTTTCGC TGAAGGAAGG
951 GTTGACCGTG TTCCGCGACC AAGAATTTTC CGGCGACCGC GCCAGCCGCG
1001 CCGTGCGCCG TATCGAAAAC ATCCGCCTGC TGCGCCAGCA CCAGTTCCCC
1051 GAAGACGCAG GTCCGACCGC ACATCCGGTG CGCCCCGCCC GATATGAGGA
1101 GATGAACAAT TTCTACACCA TGACCGTTTA TGAAAAAGGC GCGGAAGTGG
1151 TGCGGATGTA TCACACCTTG CTCGGCGAAG AGGGCTTCCA AAAAGGTATG
1201 AAGCTCTATT TCCAACGCCA CGACGGACAG GCTGTTACCT GCGACGATTT
1251 CCGCGCGGCG ATGGTGGACG CGAACGGCAT CAACCTCGAC CAATTCGCCT
1301 TGTGGTACAG CCAAGCAGGT ACGCCGGTTT TAGATGCTCA AGGGCGTCTG
1351 AAAAACAATG TGTTCGAGTT AACCATCAAA CAAACCGTGC CGCCCACGCC
1401 CGATATGGCG GACAAACAGC CGATGATGAT TCCCGTCAAA ATCGGGCTGC
1451 TGAACTGCAA CGGCGAAGCG GTGGCATTTG ATTATCAGGG CAAACGCGCG
1501 ACCGAAGCCG TGTTGCTGCT GACCGAAGCC GAACAGACCT TCCAGTTCGA
1551 AAGCGTAACC GAAGCCGTCG TTCCCTCGCT GCTGCGCGGG TTCAGCGCGC
1601 CGGTGCATCT GAACTATCCG TACAGCGACG ACGACCTGCT GCTTCTGCTC
1651 GCCCATGACA GCGACGCCTT CACGCGCTGG GAAGCCGCAC AAACGCTCTA
1701 CCGCCGTGCC GTCGCCGCCA ACCTTGCCGC GCTTTCAGAC GGCGTCGAGT
1751 TGCCGAAACA CGAAAAACTG CTTGCCGCCG TCGAAAAAGT CATTTCAGAC
1801 GACCTCTTAG ACAACGCTTT CAAAGCCCTG CTTTTGGGTG TGCCGTCTGA
1851 AGCCGAGCTG TGGGACGGCG CGGAAAACAT CGACCCGCTG CGCTACCATC
1901 AGGCGCGCGA AGCCTTGTTG GATATACTTG CCGTCCGCTT TCTGCCGAAA

-continued

```
1951 TGGCACGAAT TGAACCGTCA GGCGGCGAAG CAGGAAAACC AAAGCTACGA
2001 GTACAGCCCC GAAGCCGCCG GTTGGCGCAC GCTGCGCAAT GTCTGCCGCG
2051 CCTTCGTCCT GCGCGCCGAT CCCGCGCACA TCGAAACCGT TGCCGAGAAA
2101 TACGCCGAAA TGGCGCAAAA CATGACCCAC GAATGGGGCA TCCTGTCCGC
2151 CGTCAACGGC AACGAAAGCG ATACGCGCAA CCGCCTGCTG GCGCAGTTTG
2201 CCGACAAGTT TTCAGACGAC GCGCTGGTGA TGGACAAATA TTTCGCCCTC
2251 GTCGGCTCAA GCCGCCGCAG CGACACCCTG CAACAGGTTC AAACCGCCTT
2301 GCAGCATCCG AAGTTCAGCC TCGAAAATCC CAACAAAGCC CGCTCGCTCA
2351 TCGGCAGCTT CAGCCGCAAC GTCCCGCATT TCCACGCAGA AGACGGCAGC
2401 GGCTACCGCT TCATCGCCGA CAAAGTCATC GAAATCGACC GCTTTAACCC
2451 GCAGGTCGCC GCCCGCCTGG TGCAGGCGTT CAACCTCTGC AACAAGCTCG
2501 AGCCGCACCG CAAAAACTTG GTGAAACAAG CATTGCAGCG CATTCGGGCG
2551 CAGGAAGGAT TGTCGAAAGA CGTGGGCGAA ATCGTCGGCA AAATTTTGGA
2601 TTGA
```

This corresponds to the amino acid sequence <SEQ ID 2170; ORF 665-1.a>:

a665-1.pep

```
  1 MSKTVHYLKD YQTPAYHILK TDLHFDINEP QTIVKSRLTV EPKRVGEPLV
 51 LDGSAKLLSV KINGVAADYV LEGETLTIAD VPSERFTVEV ETEILPAENK
101 SLMGLYASAG NLFTQCEPEG FRKITFYIDR PDVMSKFTTT IVADKKRYPV
151 LLSNGNKIDG GEYSDGRHWV KWEDPFAKPS YLFALVAGDL AVTEDYFTTM
201 SGRNVKIEFY TTEADKPKVG FAVESLKNAM KWDETRFGLE YDLDIFMVVA
251 VGDFNMGAME NKGLNIFNTK FVLADSRTAT DTDFEGIESV VGHEYFHNWT
301 GNRVTCRDWF QLSLKEGLTV FRDQEFSGDR ASRAVRRIEN IRLLRQHQFP
351 EDAGPTAHPV RPARYEEMNN FYTMTVYEKG AEVVRMYHTL LGEEGFQKGM
401 KLYFQRHDGQ AVTCDDFRAA MVDANGINLD QFALWYSQAG TPVLDAQGRL
451 KNNVFELTIK QTVPPTPDMA DKQPMMIPVK IGLLNCNGEA VAFDYQGKRA
501 TEAVLLLTEA EQTFQFESVT EAVVPSLLRG FSAPVHLNYP YSDDDLLLLL
551 AHDSDAFTRW EAAQTLYRRA VAANLAALSD GVELPKHEKL LAAVEKVISD
601 DLLDNAFKAL LLGVPSEAEL WDGAENIDPL RYNQAREALL DILAVRFLPK
651 WHELNRQAAK QENQSYEYSP EAAGWRTLRN VCRAFVLRAD PAHIETVAEK
701 YAEMAQNMTH EWGILSAVNG NESDTRNRLL AQFADKFSDD ALVMDKYFAL
751 VGSSRRSDTL QQVQTALQHP KFSLENPNKA RSLIGSFSRN VPHFHAEDGS
801 GYRFIADKVI EIDRFNPQVA ARLVQAFNLC NKLEPHRKNL VKQALQRIRA
851 QEGLSKDVGE IVGKILD*
```

a665-1/m665-1 97.2% identity in 867 aa overlap

```
                   10        20        30        40        50        60
a665-1.pep MSKTVHYLKDYQTPAYHILKTDLHFDINEPQTIVKSRLTVEPKRVGEPLVLDGSAKLLSV
           ||||||||||||||||||||||||||||||||:|||||||||:|||||||||||||||||
m665-1     MSKTVHYLKDYQTPAYHILKTDLHFDINEPQTVVKSRLTVEPQRVGEPLVLDGSAKLLSV
                   10        20        30        40        50        60

                   70        80        90       100       110       120
a665-1.pep KINGVAADYVLEGETLTIADVPSERFTVEVETEILPAENKSLMGLYASAGNLFTQCEPEG
           ||||:|||||||||||||| |||||||||||||||||||||||||||||:||||||||||
m665-1     KINGAAADYVLEGETLTIAGVPSERFTVEVETEILPAENKSLMGLYASGGNLFTQCEPEG
                   70        80        90       100       110       120

                  130       140       150       160       170       180
a665-1.pep FRKITFYIDRPDVMSKFTTTIVADKKRYPVLLSNGNKIDGGEYSDGRHWVKWEDPFAKPS
           ||||||||||||||||||||||||||||||||||||||||||:|||||||||||||:|||
m665-1     FRKITFYIDRPDVMSKFTTTIVADKKRYPVLLSNGNKIDGGEFSDGRHWVKWEDPFSKPS
                  130       140       150       160       170       180

                  190       200       210       220       230       240
a665-1.pep YLFALVAGDLAVTEDYFTTMSGRNVKIEFYTTEADKPKVGFAVESLKNAMKWDETRFGLE
           ||||||||||||||||||||||||||||||||||||||||||||||||||||||||||||
m665-1     YLFALVAGDLAVTEDYFTTMSGRNVKIEFYTTEADKPKVGFAVESLKNAMKWDETRFGLE
                  190       200       210       220       230       240

                  250       260       270       280       290       300
a665-1.pep YDLDIFMVVAVGDFNMGAMENKGLNIFNTKFVLADSRTATDTDFEGIESVVGHEYFHNWT
           ||||||||||||||||||||||||||||||||||||||||||||||||||||||||||||
m665-1     YDLDIFMVVAVGDFNMGAMENKGLNIFNTKFVLADSRTATDTDFEGIESVVGHEYFHNWT
                  250       260       270       280       290       300

                  310       320       330       340       350       360
a665-1.pep GNRVTCRDWFQLSLKEGLTVFRDQEFSGDRASRAVRRIENIRLLRQHQFPEDAGPTAHPV
           ||||||||||||||||||||||||||||||||||||||||||||||||||||||||||||
m665-1     GNRVTCRDWFQLSLKEGLTVFRDQEFSGDRASRAVRRIENIRLLRQHQFPEDAGPTAHPV
                  310       320       330       340       350       360

                  370       380       390       400       410       420
a665-1.pep RPARYEEMNNFYTMTVYEKGAEVVRMYHTLLGEEGFQKGMKLYFQRHDGQAVTCDDFRAA
           ||| ||||||||||||||||||||||||||||||||||||||||||||||||||||||||
m665-1     RPASYEEMNNFYTMTVYEKGAEVVRMYHTLLGEEGFQKGMKLYFQRHDGQAVTCDDFRAA
                  370       380       390       400       410       420

                  430       440       450       460       470       480
a665-1.pep MVDANGINLDQFALWYSQAGTPVLDAQGRLKNNVFELTIKQTVPPTPDMADKQPMMIPVK
           |:||||||||||||||||||||||:|:|||||||:||||:||||||||||:|||||||||
m665-1     MADANGINLDQFALWYSQAGTPVLEAEGRLKNNIFELTVKQTVPPTPDMTDKQPMMIPVK
                  430       440       450       460       470       480

                  490       500       510       520       530       540
a665-1.pep IGLLNCNGEAVAFDYQGKRATEAVLLLTEAEQTFQFESVTEAVVPSLLRGFSAPVHLNYP
           :|||| |||||||||||||||||||||||||||| :|:||||||||||||||||||||||
m665-1     VGLLNRNGEAVAFDYQGKRATEAVLLLTEAEQTFLLEGVTEAVVPSLLRGFSAPVHLNYP
                  490       500       510       520       530       540

                  550       560       570       580       590       600
a665-1.pep YSDDDLLLLLAHDSDAFTRWEAAQTLYRRAVAANLAALSDGVELPKHEKLLAAVEKVISD
           |||||||||||||||||||||||||||||||||||||:||||||||||||||||||||||
m665-1     YSDDDLLLLLAHDSDAFTRWEAAQTLYRRAVAANLATLSDGVELPKHEKLLAAVEKVISD
                  550       560       570       580       590       600

                  610       620       630       640       650       660
a665-1.pep DLLDNAFKALLLGVPSEAELWDGAENIDPLRYHQAREALLDILAVRFLPKWHELNRQAAK
           ||||||||||||||||||||||||||||||||||||||||| |||:||||||||||||||
m665-1     DLLDNAFKALLLGVPSEAELWDGAENIDPLRYHQAREALLDTLAVHFLPKWHELNRQAAK
                  610       620       630       640       650       660

                  670       680       690       700       710       720
a665-1.pep QENQSYEYSPEAAGWRTLRNVCRAFVLRADPAHIETVAEKYAEMAQNMTHEWGILSAVNG
           |||||||||||||||||||||||||||||||||||||||||:||||||||||||||||||
m665-1     QENQSYEYSPEAAGWRTLRNVCRAFVLRADPAHIETVAEKYGEMAQNMTHEWGILSAVNG
                  670       680       690       700       710       720

                  730       740       750       760       770       780
a665-1.pep NESDTRNRLLAQFADKFSDDALVMDKYFALVGSSRRSDTLQQVQTALQHPKFSLENPNKA
           |||||||||||||||||||||||||||||||||||||||||||:||||||||||||||||
m665-1     NESDTRNRLLAQFADKFSDDALVMDKYFALVGSSRRSDTLQQVRTALQHPKFSLENPNKA
                  730       740       750       760       770       780

                  790       800       810       820       830       840
a665-1.pep RSLIGSFSRNVPHFHAEDGSGYRFIADKVIEIDRFNPQVAARLVQAFNLCNKLEPHRKNL
           ||||||||||||||||||||||||||||||||||||||||||||||||||||||||||||
m665-1     RSLIGSFSRNVPHFHAEDGSGYRFIADKVIEIDRFNPQVAARLVQAFNLCNKLEPHRKNL
                  790       800       810       820       830       840

                  850       860
a665-1.pep VKQALQRIRAQEGLSKDVGEIVGKILDX
           ||||||||||||||||||||||||||||
m665-1     VKQALQRIRAQEGLSKDVGEIVGKILDX
                  850       860
```

The following partial DNA sequence was identified in *N. gonorrhoeae* <SEQ ID 2171>:

g666.seq

```
  1 ATGCTTTGTA TGAATTATCA ATCAAACTCA GGCGAAGGAG TGCTTGTAGC
 51 TAAAACATAT TTATTGACTG CATTGATAAT GTCTATGGTA ATCTCCGGAT
101 GTCAAGTCAT CCATGCCAAT CAAGGTAAGG TTAATACTAA TTCTGCTGTC
151 ATCGCAGGTG CAGACGCTCA CACGCCTGAA CATGTAACGG GACTGACCGA
201 ACAAAAGCAG GTGATTGCAA GTGATTTTAT AGTAGCGTCA GCCAATCCAT
251 TAGCAACACA AGCTGGCTAT GATATCTTAA AGCAAGGCGG TAGCGCTGCA
301 GATGCGATGG TGGCGGTGCA GACGACACTA AGCTTGGTAG AGCCACAGTC
351 GTCAGGCTTG GGCGGTGGTG CATTTGTGTT GTATTGGGAC AATACCGCCA
401 AAACATTGAC CACATTTGAT GGGCGTGAGA CGGCACCGAT GCGTGCGACG
451 CCAGAATTAT TTTTGGATAA AGATGGTTAA CCATTGAAAT TTATGGAAGC
501 GGTGGTCGCT CGGTAGGTAC GCCTGCTATC CCTAAACTGA
```

This corresponds to the amino acid sequence <SEQ ID 2172; ORF 666.ng>:

g666.pep

```
  1 MLCDMYQSNS GEGVLVAKTY LLTALIMSMV ISGCQVIHAN QGKVNTNSAV
 51 IAGADAHTPE HVTGLTEQKQ VIASDFIVAS ANPLATQAGY DILKQGGSAA
101 DAMVAVQTTL SLVEPQSSGL GGGAFVLYWD NTAKTLTTFD GRETAPMRAT
151 PELFLDKDGX PLKFMEAVVA RXVRLLSLN*
```

The following partial DNA sequence was identified in *N. meningitidis* <SEQ ID 2173>:

m666.seq

```
  1 ATGCCTTGTA TGAATCATCA ATCAAACTCA GGCGAAGGAG TGCTTGTGGC
 51 TAAAACATAT TTATTGACTG CATTGATAAT GTCTATGACA ATCTCTGGAT
101 GTCAAGTCAT CCATGCCAAT CAAGGTAAGG TTAATACTCA TTCTGCTGTC
151 ATCACAGGTG CAGACGCTCA CACGCCTGAA CATGCAACGG GACTGACCGA
201 ACAAAAGCAG GTGATTGCAA GTGATTTTAT GGTAGCGTCA GCCAATCCAT
251 TAGCAACACA AGCTGGCTAT GATATCTTAA AGCAAGGCGG TAGCGCTGCA
301 GATGCGATGG TGGCGGTGCA GACGACACTA AGCTTGGTAG AGCCACAGTC
351 GTCAGGCTTG GGCGGTGGTG CATTTGTGTT GTATTGGGAT AATACCGCCA
401 AAACATTGAC CACATTTGAT GGGCGTGAGA CGGCACCGAT GCGTGCGACG
451 CCGGAATTAT TTTTGGATAA AGATGGTCAA CCATTGAAAT TTATGGAAGC
501 GGTGGTCGTG GTCGCTCGGT GGGTACGCCT GCTATCCCTA AACTGA
```

This corresponds to the amino acid sequence <SEQ ID 2174; ORF 666>:

m666.pep

```
  1 MPCMNHQSNS GEGVLVAKTY LLTALIMSMT ISGCQVIHAN QGKVNTHSAV
 51 ITGADAHTPE HATGLTEQKQ VIASDFMVAS ANPLATQAGY DILKQGGSAA
101 DAMVAVQTTL SLVEPQSSGL GGGAFVLYWD NTAKTLTTFD GRETAPMRAT
151 PELFLDKDGQ PLKFMEAVVV VARWVRLLSL N*
```

Computer analysis of this amino acid sequence gave the following results:

Homology with a predicted ORF from *N. gonorrhoeae*
m666/g666 93.9% identity in 181 aa overlap

```
                   10        20        30        40        50        60
m666.pep    MPCMNHQSNSGEGVLVAKTYLLTALIMSMTISGCQVIHANQGKVNTHSAVITGADAHTPE
            | |||:||||||||||||||||||||||:|||||||||||||||:||||:||||||||
g666        MLCMNYQSNSGEGVLVAKTYLLTALIMSMVISGCQVIHANQGKVNTNSAVIAGADAHTPE
                   10        20        30        40        50        60

                   70        80        90       100       110       120
m666.pep    HATGLTEQKQVIASDFMVASANPLATQAGYDILKQGGSAADAMVAVQTTLSLVEPQSSGL
            |:||||||||||||||:|||||||||||||||||||||||||||||||||||||||||||
g666        HVTGLTEQKQVIASDFIVASANPLATQAGYDILKQGGSAADAMVAVQTTLSLVEPQSSGL
                   70        80        90       100       110       120

                  130       140       150       160       170       180
m666.pep    GGGAFVLYWDNTAKTLTTFDGRETAPMRATPELFLDKDGQPLKFMEAVVVVARWVRLLSL
            |||||||||||||||||||||||||||||||||||||| |||||||||  || ||||||
g666        GGGAFVLYWDNTAKTLTTFDGRETAPMRATPELFLDKDGXPLKFMEAVV--ARXVRLLSL
                  130       140       150       160       170

m666.pep    NX
            ||
g666        NX
           180
```

The following partial DNA sequence was identified in *N. meningitidis* <SEQ ID 2175>:

a666.seq

```
  1 ATGCCTTGTA TGAATCATCA ATCAAACTCA GGCGAAGGAG TGCTTGTGGC
 51 TAAAACATAT TTATTGACTG CATTGATAAT GTCTATGACA ATCTCTGGAT
101 GTCAAGTCAT CCATGCCAAT CAAGGTAAGG TTAATACTCA TTCTGCTGTC
151 ATCACAGGTG CAGACGCTCA CACGCCTGAA CATGCAACGG GACTGACCGA
201 ACAAAAGCAG GTGATTGCAA GTGATTTTAT GGTAGCGTCA GCCAATCCAT
251 TAGCAACACA AGCTGGCTAT GATATCTTAA AGCAAGGCGG TAGCGCTGCA
301 GATGCGATGG TGGCGGTGCA GACGACACTA AGCTTGGTAG AGCCACAGTC
351 GTCAGGCTTG GGCGGTGGTG CATTTGTGTT GTATTGGGAT AATACCGCCA
401 AAACATTGAC CACATTTGAT GGGCGTGAGA CGGCACCGAT GCGTGCGACG
451 CCGGAATTAT TTTTGGATAA AGATGGTCAA CCATTGAAAT TTATGGAAGC
501 GGTGGTCGTG GTCGCTCGGT GGGTACGCCT GCTATCCCTA AACTGA
```

This corresponds to the amino acid sequence <SEQ ID 2176; ORF 666.a>:

a666.pep

```
  1 MPCMNHQSNS GEGVLVAKTY LLTALIMSMT ISGCQVIHAN QGKVNTHSAV
 51 ITGADAHTPE HATGLTEQKQ VIASDFMVAS ANPLATQAGY DILKQGGSAA
```

-continued

```
101 DAMVAVQTTL SLVEPQSSGL GGGAFVLYWD NTAKTLTTFD GRETAPMRAT

151 PELFLDKDGQ PLKFMEAVVV VARWVRLLSL N*
```

m666/a666 100.0% identity in 181 aa overlap

```
                   10        20        30        40        50        60
m666.pep    MPCMNHQSNSGEGVLVAKTYLLTALIMSMTISGCQVIHANQGKVNTHSAVITGADAHTPE
            ||||||||||||||||||||||||||||||||||||||||||||||||||||||||||||
a666        MPCMNHQSNSGEGVLVAKTYLLTALIMSMTISGCQVIHANQGKVNTHSAVITGADAHTPE
                   10        20        30        40        50        60

                   70        80        90       100       110       120
m666.pep    HATGLTEQKQVIASDEMVASANPLATQAGYDILKQGGSAADAMVAVQTTLSLVEPQSSGL
            ||||||||||||||||||||||||||||||||||||||||||||||||||||||||||||
a666        HATGLTEQKQVIASDFMVASANPLATQAGYDILKQGGSAADAMVAVQTTLSLVEPQSSGL
                   70        80        90       100       110       120

                  130       140       150       160       170       180
m666.pep    GGGAFVLYWDNTAKTLTTFDGRETAPMRATPELFLDKDGQPLKFMEAVVVVARWVRLLSL
            ||||||||||||||||||||||||||||||||||||||||||||||||||||||||||||
a666        GGGAFVLYWDNTAKTLTTFDGRETAPMRATPELFLDKDGQPLKFMEAVVVVARWVRLLSL
                  130       140       150       160       170       180

m666.pep    NX
            ||
a666        NX
```

The following partial DNA sequence was identified in *N. gonorrhoeae* <SEQ ID 2177>:

g667.seq

```
  1 atgcggtttg tcttctgttt gggcgGAGAG ATAGtttctg atccgtgtga

 51 tttccAtttg gtattcgtcc gcgtcgaatc tgccgctgAc CAGAcagaaa

101 cgCAGataca tCaaatacgt attcacggca tcggtttcgc aatAAttgcg

151 GAtttccttc agcgtgcccg cgtgGAacgc ttcccacact ttgctgccgt

201 ccataCCCAg ctTGCCCGGA AAGCCGCACA GTTTcgcCat atcgtccagC

251 GGCACATTcg ccctcggctG GTAAAGCGCG AGCAAATCCA TCAAATCGCA

301 GTGGCGTTGG TGATAACGGC TGATGTAGTT GTTCCActtg AAATCGCGGC

351 tgtcgccgAA ATCGccgTCG CCCGTATCCC AATAGCGCGC GGCGTTGATG

401 CCGTATATCA GGGAGCGGTA ATGCAGTACG GGCAGGTCGA AACCGCCGCC

451 GTTCCAGCTG ACCAGTTGCG GCGTATGTTT TTCAACCAAT TCGAAAAACT

501 TGGCAATCAC GACTTCTTCG CCATCGTCCA TCTCGCCGAT GGTGCCGACA

551 TGAACCTTGT CCTGCCCCCA GCGCATACAG CAGGAAACCG CCACAACCTG

601 ATGGAGGTGG TGCTGCATAA AATCGCCGCC GGTCTGTGCG CGGCGTTTCT

651 GCTGCGCGAA CAGCACCACT TCGTCATCCG GCAGGGAAGA CGGCAAGTCA

701 TACAACGTAC GGATACCCTG CACATCGGGT ACGGTTTCAA TATCGAAAGC

751 CAAAATCGTA TTCATGGCAg tACCTTGCAT tcaAAAACAG ACtTGCGCCT

801 ATTgTgtcaT TAA
```

This corresponds to the amino acid sequence <SEQ ID 2178; ORF 667.ng>:

g667.pep

```
  1 MRFVFCLGGE IVSDPCDFHL VFVRVESAAD QTETQIHQIR IHGIGFAIIA
 51 DFLQRARVER FPHFAAVHTQ LARKAAQFRH IVQRHIRPRL VKREQIHQIA
101 VALVITADVV VPLEIAAVAE IAVARIPIAR GVDAVYQGAV MQYGQVETAA
151 VPADQLRRMF FNQFEKLGNH DFFAIVHLAD GADMNLVLPP AHTAGNRHNL
201 MEVVLHKIAA GLCAAFLLRE QHHFVIRQGR RQVIQRTDTL HIGYGFNIES
251 QNRIHGSTLH SKTDLRLLCH *
```

The following partial DNA sequence was identified in *N. meningitidis* <SEQ ID 2179>:

m667.seq (PARTIAL)

```
  1 ATGCGGCTTT TCCCCGGCTT GTGCGGACAG GTAATTCCGC ATCCGTTTGA
 51 TTTCCATTTC GTATTCGTCC GCATCCAGCC TGCCGCTGAC CAGACAGAAA
101 CGCAGGTACA TCAGATAAGT GTTTGCCGCG TCGGTTTCGC AATAATTGCG
151 GATTTCCTTC AGCCTGCCCG TATGGAATGC CTCCCAAACC TTGCTGCCGT
201 CCATACCCAG CTTGCCCGGA AAACCGCACA GTTTCGCCAT ATCGTCCAGC
251 GGCACGTTTG CCCTCGGCTG GTAAAGCGCG AGCAAATCCA TCAAATCGCA
301 GTGGCGTTGG TGATAACGGC TGATGTAGTT GTTCCACTTG AAATCGCGGC
351 TGTCGCCGAA ATCGCCGTCG CCCATATCCC AATAGCGCGC GGCGTTGATG
401 CCGTATATCA GGGAGCGGTA ATGCAGTACG GGCAGATCGA AACCGCCGCC
451 GTTCCAACTG ACCAGTTGCG GCGTATGTTT TTCAATCAAT TCGAAAAATT
501 TAGCAATGAC CACTTCCTCG CCGTCATCCA TCTCGCCGAT GGTGCCGACA
551 TGTACTTTAT CCTGCCCCCA ACGCATGCAG CACGAAATCG CCACAACCTG
601 ATGAAGATGA TGCTGCATAA AATCGCCGCC CGTCTGAGCA CGGCGTTTGT
651 GCTGGGCAAT CAGCACCACT TG...
```

This corresponds to the amino acid sequence <SEQ ID 2180; ORF 667>:

m667.pep (partial)

```
  1 MRLFPGLCGQ VIPHPFDFHF VFVRIQPAAD QTETQVHQIS VCRVGFAIIA
 51 DFLQPARMEC LPNLAAVHTQ LARKTAQFRH IVQRHVCPRL VKREQIHQIA
101 VALVITADVV VPLEIAAVAE IAVAHIPIAR GVDAVYQGAV MQYGQIETAA
151 VPTDQLRRMF FNQFEKFSND HFLAVIHLAD GADMYFILPP THAARNRHNL
201 MKMMLHKIAA RLSTAFVLGN QHHL...
```

Computer analysis of this amino acid sequence gave the following results:

Homology with a predicted ORF from *N. gonorrhoeae* m667/g667 75.0% identity in 224 aa overlap

```
                  10        20        30        40        50        60
m667.pep  MRLFPGLCGQVIPHPFDFHFVFVRIQPAADQTETQVHQISVCRVGFAIIADFLQPARMEC
          ||:   | |:::  | |||:||||:: ||||||||:||| :  :|||||||||||| ||:|
g667      MRFVFCLGGEIVSDPCDFHLVFVRVESAADQTETQIHQIRIHGIGFAIIADFLQRARVER
                  10        20        30        40        50        60

70        80        90       100       110       120
m667.pep  LPNLAAVHTQLARKTAQFRHIVQRHVCPRLVKREQIHQIAVALVITADVVVPLEIAAVAE
          :|::||||||||||:||||||||||: |||||||||||||||||||||||||||||||||
g667      FPHFAAVHTQLARKAAQFRHIVQRHIRPRLVKREQIHQIAVALVITADVVVPLEIAAVAE
                  70        80        90       100       110       120

130       140       150       160       170       180
m667.pep  IAVAHIPIARGVDAVYQGAVMQYGQIETAAVPTDQLRRMFFNQFEKFSNDHFLAVIHLAD
          ||||:||||||||||||||||||||:||||||:|||||||||||||::|  |:|::||||
g667      IAVARIPIARGVDAVYQGAVMQYGQVETAAVPADQLRRMFFNQFEKLGNHDFFAIVHLAD
                 130       140       150       160       170       180

190       200       210       220
m667.pep  GADMYFILPPTHAARNRHNLMKMMLHKIAARLSTAFVLGNQHHL
          |||| ::|||:|:| ||||||:::|||||| | :||:| :|||:
g667      GADMNLVLPPAHTAGNRHNLMEVVLHKIAAGLCAAFLLREQHHFVIRQGRRQVIQRTDTL
                 190       200       210       220       230       240 g667      HIGYGFNIESQNRIHGSTLHSKTDLRLLCHX
                 250       260       270
```

The following partial DNA sequence was identified in *N. meningitidis* <SEQ ID 2181>:

<u>a667.seq</u>

```
  1 ATGCGGTTTG TCTTCTGTTT GGGCGGAGAG ATAGTTTCTG ATCCGCTTGA
 51 TTTCCATTTC GTATTCGTCT GCGTCGAATC TGCCGCTGAC CAGACAGAAA
101 CGCAGATACA TCAGATAGGT ATTTACCGCA TCGGTTTCGC AATAATTGCG
151 GATTTCCTTC AGCCTGCCCG CGTGGAACGC CTCCCACACC TTGCTGCCGT
201 CCATACCCAG CTTGCCCGGA AAACCGCACA GTTTCGCCAT ATCGTCCAAC
251 GGCACATTCG CCCTCGGCTG GTAAAGCGCG AGCAAATCCA TCAAATCGCA
301 ATGACGTTGG TGGTAGCGGC TGATGTAGTT GTTCCACTTG AAATCGCGGC
351 TGTCGCCGAA ATCGCCGTCG CCCATATCCC AATAGCGCGC GGCGTTGATG
401 CCGTGTAGCA GCGAACGGTA ATGCAGAACC GGCAGGTCGA AACCGCCGCC
451 GTTCCAACTG ACCAGTTGCG GCGTATGTTT TTCAATCAAC TCGAAAAATT
501 TGGCGATAAC CACTTCCTCG CCGTCATCCA TCTCGCCGAT TGTACCGACA
551 TGGACTTTAT CCTGCCCCCA ACGCATGCAG CACGAAATCG CCACAATCTG
601 ATGAAGATGA TGCTGCATAA AATCCCCACC CGTCTGAGCA CGGCGTTTTT
651 GCTGGGCAAA CAGCACCACT TCATCGTCGG GCAGCGAGGA CGGCAAGTCA
701 TACAGCGTAC GGATACACTG CACATCGGGT ACGGTTTCAA TATCGAAAGC
751 CAAAATCGTG GTCATGACAG CACCTTGTAT TTAAAA.CAG ACTTGCGCCT
801 ATTGTGTCAT TAA
```

This corresponds to the amino acid sequence <SEQ ID 2182; ORF 667.a>:

<u>a667.pep</u>

```
  1 MRFVFCLGGE IVSDPLDFHF VFVCVESAAD QTETQIHQIG IYRIGFAIIA
 51 DFLQPARVER LPHLAAVHTQ LARKTAQFRH IVQRHIRPRL VKREQIHQIA
```

-continued

101 MTLVVAADVV VPLEIAAVAE IAVAHIPIAR GVDAV*QRTV MQNRQVETAA

151 VPTDQLRRMF FNQLEKFGDN HFLAVIHLAD CTDMDFILPP THAARNRHNL

201 MKMMLHKIPT RLSTAFLLGK QHHFIVGQRG RQVIQRTDTL HIGYGFNIES

251 QNRGHDSTLY LKXDLRLLCH * m667/a667 79.0% identity in 224 aa overlap

```
                   10        20        30        40        50        60
m667.pep   MRLFPGLCGQVIPHPFDFHFVFVRIQPAADQTETQVHQISVCRVGFAIIADFLQPARMEC
           ||:   | |:::  |:||||||| :: ||||||||:|||:: |:|||||||||||||:| 
a667       MRFVFCLGGEIVSDPLDFHFVFVCVESAADQTETQIHQIGIYRIGFAIIADFLQPARVER
                   10        20        30        40        50        60

                   70        80        90       100       110       120
m667.pep   LPNLAAVHTQLARKTAQFRHIVQRHVCPRLVKREQIHQIAVALVITADVVVPLEIAAVAE
           ||:||||||||||||||||||||||: |||||||||||||::||::||||||||||||||
a667       LPHLAAVHTQLARKTAQFRHIVQRHIRPRLVKREQIHQIAMTLVAAADVVVPLEIAAVAE
                   70        80        90       100       110       120

                  130       140       150       160       170       180
m667.pep   IAVAHIPIARGVDAVYQGAVMQYGQIETAAVPTDQLRRMFFNQFEKFSNDHFLAVIHLAD
           ||||||||||||||| | :|||  |:|||||||||||||||||:|||:::||||||||||
a667       IAVAHIPIARGVDAVXQRTVMQNRQVETAAVPTDQLRRMFFNQLEKFGDNHFLAVIHLAD
                  130       140       150       160       170       180

                  190       200       210       220
m667.pep   GADMYFILPPTHAARNRHNLMKMMLHKIAARLSTAFVLGNQHHL
            :|| ||||||||||||||||||||||| :||||||:||:|||:
a667       CTDMDFILPPTHAARNRHNLMKMMLHKIPTRLSTAFLLGKQHHFIVGQRGRQVIQRTDTL
                  190       200       210       220       230       240


a667       HIGYGFNIESQNRGHDSTLYLKXDLRLLCHX
                  250       260       270
```

The following partial DNA sequence was identified in *N. gonorrhoeae* <SEQ ID 2183>:

g669.seq

1 ATGCGCCGCA TCGTTAAAAA ACACCAGCCC GTAAACGCGC CACATATCGT

51 TTTGGAAATT CGGATAATGA AACTGCATCG CGCGTTTGTC TTCCTTGGGC

101 GGAAACGTCC CCATCATCAT GACCGCAGCC TTCGGCGGCA ACACGGGATC

151 GAAGGGATGG GTTTCGATTT CAAGCAGATT TTCAGACACG TTCAATCCTC

201 CAACAGGCAA AGCGGCAGAC AGCCGGTTTG CACCAAACCG CCAAACACGG

251 CAAGCCTTCA AACAGCATTA TCACGCCCTG CCGTTTTCGG TTACAATGCC

301 GACATCAAAC GGATACTGTA A

This corresponds to the amino acid sequence <SEQ ID 2184; ORF 669.ng>:

g669.pep

1 MRRIVKKHQP VNAPHIVLEI RIMKLHRAFV FLGRKRPHHH DRSLRRQHGI

51 EGMGFDFKQI FRHVQSSNRQ SGRQPVCTKP PNTASLQTAL SRPAVFGYNA

101 DIKRIL*

The following partial DNA sequence was identified in *N. meningitidis* <SEQ ID 2185>:

m669.seq

```
  1 ATGCGCCGCA TCATTAAAAA ACACCAGCCC ATAAACGCGC CACATATCGT
 51 TTTGGAAATT CGGATAATGA AACTGCATCG CGCGTTTGTC TTCCTTGGGC
101 GGAAACGTCC CCATCATCAT GACAGCAGCC TTCGGCGGCA ACACGGGATC
151 GAAGGGATGG GTTTCGATTT CAAGCAGATT TTCAGACACG TTCAATCCTC
201 CAACAGGCAA AACGGCAGAC AGCCGGTTTG CACCAAACCG CCAAACACGG
251 CAAGCCTTCA AACAGCATTA TCACGCCCTG CCGTTTTCGG TTACAATGCC
301 GACATCAAAC GGATACTGTA A
```

This corresponds to the amino acid sequence <SEQ ID 2186; ORF 669>:

m669.pep

```
  1 MRRIIKKHQP INAPHIVLEI RIMKLHRAFV FLGRKRPHHH DSSLRRQHGI
 51 EGMGFDFKQI FRHVQSSNRQ NGRQPVCTKP PNTASLQTAL SRPAVFGYNA
101 DIKRIL*
```

Computer analysis of this amino acid sequence gave the following results:

Homology with a predicted ORF from *N. gonorrhoeae*
m669/g669 96.2% identity in 106 aa overlap

```
                   10        20        30        40        50        60
m669.pep   MRRIIKKHQPINAPHIVLEIRIMKLHRAFVFLGRKRPHHHDSSLRRQHGIEGMGFDFKQI
           ||||:|||||:||||||||||||||||||||||||||||||| |||||||||||||||||
g669       MRRIVKKHQPVNAPHIVLEIRIMKLHRAFVFLGRKRPHHHDRSLRRQHGIEGMGFDFKQI
                   10        20        30        40        50        60

                   70        80        90       100
m669.pep   FRHVQSSNRQNGRQPVCTKPPNTASLQTALSRPAVFGYNADIKRILX
           ||||||||||:||||||||||||||||||||||||||||||||||||
g669       FRHVQSSNRQSGRQPVCTKPPNTASLQTALSRPAVFGYNADIKRILX
                   70        80        90       100
```

The following partial DNA sequence was identified in *N. meningitidis* <SEQ ID 2187>:

a669.seq

```
  1 ATGCGCCGCA TCATTAAAAA ACACCAGCCC GTAAACGCGC CACATATCGT
 51 TTTGGAAATT CGGATAATGA AACTGCATCG CGCGTTTGTC TTCCTTGGGC
101 GGAAACGTCC CCATCATCAT GACCGCAGCC TTCGGCGGCA ACACGGAATC
151 GAAGGGATGG GTTTCGATTT CAAGCAGATT TTCAGACACG TTCAATCCTC
201 CAACAGGCAA AACGGCAGAC AGCCGGTTTG CACCAAACCG CCAAACACGG
251 CAAGCCTTCA AACAGCATTA TCACGCCCTG CCGTTTTCGG TTACAATCCC
301 GACATCAAAC GGATACTGTA A
```

This corresponds to the amino acid sequence <SEQ ID 2188; ORF 669.a>:

a669.pep

```
  1 MRRIIKKHQP VNAPHIVLEI RIMKLHRAFV FLGRKRPHHH DRSLRRQHGI

 51 EGMGFDFKQI FRHVQSSNRQ NGRQPVCTKP PNTASLQTAL SRPAVFGYNA

101 DIKRIL*
```

m669/a669 98.1% identity in 106 aa overlap

```
                   10        20        30        40        50        60
m669.pep   MRRIIKKHQPINAPHIVLEIRIMKLHRAFVFLGRKRPHHHDSSLRRQHGIEGMGFDFKQI
           ||||||||||:|||||||||||||||||||||||||||||| ||||||||||||||||||
a669       MRRIIKKHQPVNAPHIVLEIRIMKLHRAFVFLGRKRPHHHDRSLRRQHGIEGMGFDFKQI
                   10        20        30        40        50        60

                   70        80        90       100
m669.pep   FRHVQSSNRQNGRQPVCTKPPNTASLQTALSRPAVFGYNADIKRILX
           |||||||||||||||||||||||||||||||||||||||||||||||
a669       FRHVQSSNRQNGRQPVCTKPPNTASLQTALSRPAVFGYNADIKRILX
                   70        80        90       100
```

The following partial DNA sequence was identified in *N. gonorrhoeae* <SEQ ID 2189>:

g670.seq

```
  1 ATGACTTGTT GCAGGAACTG CTTGGCGCGT TCGTGTTTCG GGTTGGTGAA

 51 AAACGCTTCC GGCGTTTCGT CTTCAAGGAT TTGCCCTTTA TCGACGAAAA

101 TCACGCGGTC GGCAACTTCG CGGGCAAACC CCATTTCGTG GGTTACGCAC

151 ATCATCGTCA TGCCGCTTTC CGCCAAGTCT TTCATCACTT TCAACACTTC

201 GCCGACCATT TCGGGGTCGA GTGCGGAAGT CGGCTCGTCA AACAGCATCA

251 CGCGCGGCTC CATCGCCAGC CCGCGCGCAA TCGCCACGCG TTGCTGCTGG

301 CCGCCGGAAA GTTGGGAAGG GAAGGCGTCT TTTTTGTGTG CCAGTCCGAC

351 GCGTTCCAAA AGCTCCATTG CCTTTTTCTC CGCCTGTTCC GCATTTTGCC

401 CCTTAACCTT CATCGGTGCG AGGGTGATGT TGTCCAACAC GGTCAGGTGC

451 GGGTAG
```

This corresponds to the amino acid sequence <SEQ ID 2190; ORF 670.ng>:

g670.pep

```
  1 MTCCRNCLAR SCFGLVKNAS GVSSSRICPL STKITRSATS RANPISWVTH

 51 IIVMPLSAKS FITFNTSPTI SGSSAEVGSS NSITRGSIAS PRAIATRCCW

101 PPESWEGKAS FLCASPTRSK SSIAFFSACS AFCPLTFIGA RVMLSNTVRC

151 G*
```

The following partial DNA sequence was identified in *N. meningitidis* <SEQ ID 2191>:

m670.seq

```
  1 ATGACCTGTT GCAGGAACTG CTTGGCGCGT TCGTGTTTCG GGTTGGTAAA

 51 AAACGCTTCG GGCGTTTCGT CTTCGAGGAT TTGCCCTTTA TCGACGAAAA
```

-continued

```
101 TCACGCGGTC GGCAACTTCG CGGGCAAACC CCATTTCGTG GGTTACGCAC

151 ATCATCGTCA TGCCGCTTTC TGCCAAGTCT TTCATCACTT TCAACACTTC

201 GCCGACCATT TCGGGGTCGA GTGCGGAGGT CGGTTCGTCA AACAACATTA

251 CGCGCGGTTC CATCGCCAAA CCGCGTGCAA TCGCCACGCG TTGCTGCTGG

301 CCGCCGGAAA GTTGGGAAGG GAAGGCGTCT TTTTTGTGTG CCAGTCCGAC

351 GCGTTCCAAA AGCTCCATTG CCTTTTTCTC CGCCTGTTCC GCATTTTGCC

401 CCTTAACCTT CATCGGTGCG AGGGTAATGT TTTCCAACAC GGTCAGGTGC

451 GGGTAG
```

This corresponds to the amino acid sequence <SEQ ID 2192; ORF 670>:

m670.pep

```
  1 MTCCRNCLAR SCFGLVKNAS GVSSSRICPL STKITRSATS RANPISWVTH

 51 IIVMPLSAKS FITFNTSPTI SGSSAEVGSS NNITRGSIAK PRAIATRCCW

101 PPESWEGKAS FLCASPTRSK SSIAFFSACS AFCPLTFIGA RVMFSNTVRC

151 G*
```

Computer analysis of this amino acid sequence gave the following results:

Homology with a predicted ORF from *N. gonorrhoeae* m670/g670 98.0% identity in 151 aa overlap

```
                   10        20        30        40        50        60
m670.pep  MTCCRNCLARSCFGLVKNASGVSSSRICPLSTKITRSATSRANPISWVTHIIVMPLSAKS
          ||||||||||||||||||||||||||||||||||||||||||||||||||||||||||||
g670      MTCCRNCLARSCFGLVKNASGVSSSRICPLSTKITRSATSRANPISWVTHIIVMPLSAKS
                   10        20        30        40        50        60

                   70        80        90       100       110       120
m670.pep  FITFNTSPTISGSSAEVGSSNNITRGSIAKPRAIATRCCWPPESWEGKASFLCASPTRSK
          |||||||||||||||||||||:|||||||:||||||||||||||||||||||||||||||
g670      FITFNTSPTISGSSAEVGSSNSITRGSIASPRAIATRCCWPPESWEGKASFLCASPTRSK
                   70        80        90       100       110       120

                  130       140       150
m670.pep  SSIAFFSACSAFCPLTFIGARVMFSNTVRCGX
          ||||||||||||||||||||||||:|||||||
g670      SSIAFFSACSAFCPLTFIGARVMLSNTVRCGX
                  130       140       150
```

The following partial DNA sequence was identified in *N. meningitidis* <SEQ ID 2193>:

a670.seq

```
  1 ATGACCTGTT GCAGGAACTG CTTGGCGCGT TCGTGTTTCG GGTTGGTAAA

 51 AAACGCTTCC GGCGTTTCGT CTTCGAGGAT TTGCCCTTTA TCGACGAAAA

101 TCACGCGGTC GGCAACTTCG CGGGCAAACC CCATTTCGTG GGTTACGCAC

151 ATCATGGTCA TACCGCTTTC CGCCAAGTCT TTCATCACTT TCAACACTTC

201 GCCGACCATT TCGGGGTCGA GTGCGGAGGT CGGTTCGTCA AACAACATTA

251 CGCGCGGTTC CATCGCCAAA CCGCGTGCAA TCGCCACGCG TTGCTGCTGG
```

-continued

```
301 CCGCCGGAAA GTTGGGAAGG GAAGGCGTCT TTTTTGTGTG CCAGTCCGAC

351 GCGTTCCAAA AGTTCCATCG CTTTTTTCTC TGCCTGTTCC GCATTTTGAC

401 CTTTAACCTT CATCGGTGCG AGGGTAATGT TTTCCAACAC GGTCAGGTGC

451 GGGTAG
```

This corresponds to the amino acid sequence <SEQ ID 2194; ORF 670.a>:

a670.pep

```
  1 MTCCRNCLAR SCFGLVKNAS GVSSSRICPL STKITRSATS RANPISWVTH

 51 IMVIPLSAKS FITFNTSPTI SGSSAEVGSS NNITRGSIAK PRAIATRCCW

101 PPESWEGKAS FLCASPTRSK SSIAFFSACS AF*PLTFIGA RVMFSNTVRC

151 G*
```

m670/a670 98.0% identity in 151 aa overlap

```
                    10        20        30        40        50        60
m670.pep    MTCCRNCLARSCFGLVKNASGVSSSRICPLSTKITRSATSRANPISWVTHIIVMPLSAKS
            ||||||||||||||||||||||||||||||||||||||||||||||||||:|:||||||
a670        MTCCRNCLARSCFGLVKNASGVSSSRICPLSTKITRSATSRANPISWVTHIMVIPLSAKS
                    10        20        30        40        50        60

                    70        80        90       100       110       120
m670.pep    FITFNTSPTISGSSAEVGSSNNITRGSIAKPRAIATRCCWPPESWEGKASFLCASPTRSK
            ||||||||||||||||||||||||||||||||||||||||||||||||||||||||||||
a670        FITFNTSPTISGSSAEVGSSNNITRGSIAKPRAIATRCCWPPESWEGKASFLCASPTRSK
                    70        80        90       100       110       120

                   130       140       150
m670.pep    SSIAFFSACSAFCPLTFIGARVMFSNTVRCGX
            ||||||||||| ||||||||||||||||||||
a670        SSIAFFSACSAFXPLTFIGARVMFSNTVRCGX
                   130       140       150
```

The following partial DNA sequence was identified in *N. gonorrhoeae* <SEQ ID 2195>:

g671.seq

```
  1 ATGATCAGCA GGGTAACAAT CAAAACGCCT TTCAATGCAC CGAATACACC

 51 GCCCAAAATG CGGTTGGCAA AGCCCAGACC GACCGCCGAA ACTGCGCCGG

101 TCAGCAGCGA ACGGAGCATT TTCTGGATCA GACAGGCAAT GACGAACAGG

151 GAAATGAATG ACAGagccaa TGCAAACAgg cggggTTGGA ACGaggCAAA

201 GGCGAGGTcg gcgaaggGTG CGGCaaAGAG TTTggcaaAA AAGAaggAAA

251 ccacccATGC cACCATCgaa ccTGCTTCCG CAATCACGCC GCGCATCGTG

301 GAAATGACGA TGCAGGCGGC GATGACGGcg gAGGCGAGGA GGTCGGCAAT

351 GGGGAGGCTA TTCATTCGTT ACCTGGCCGG CGATGCCGTG CACGCGCAGT

401 TTGTTCAAAT CGCGTTCGGC ATCCCTTGCG TTTTTATAGT TGCTTGA
```

This corresponds to the amino acid sequence <SEQ ID 2196; ORF 671.ng>:

g671.pep

```
  1 MISRVTIKTP FNAPNTPPKM RLAKPRPTAE TAPVSSERSI FWIRQAMTNR

 51 EMNDRANANR RGWNEAKARS AKGAAKSLAK KKETTHATIE PASAITPRIV

101 EMTMQAAMTA EARRSAMGRL FIRYLAGDAV HAQFVQIAFG IPCVFIVA*
```

The following partial DNA sequence was identified in *N. meningitidis* <SEQ ID 2197>:

m671.seq

```
  1 ATGACCAGCA GGGTAACAAT CAAAACGCCT TTCAATGCAC CGAATACGCC

 51 GCCCAAAATG CGGTTGGCAA AGCCCAAACC GACCGCCGAA ACTGCGCTGG

101 TCAGCAGCGA ACGGAGCATT TTCTGGATCA GACAGGCAAT GACGAACAGG

151 GAAATGAACG ACAGAGCCAA TGCAAACAGG CGGGGTTGGA ACGAGGCAAA

201 GGCGAGGTCG GCGAAGGAGG CGGCAAAGAG TTTGGCGAAA AAGAAGGAAA

251 CCACCCATGC CGCCATTGAG CCTGCCTCCG CAATCACGCC GCGCATCGCG

301 GATAGCACGA TGCAGGCGGC GATGACGGCG GAGACGAGGA GGTCGGCAAT

351 GGGGAGGCTA TTCATTCGTT ACCTGACCGG CGATACCGTG TACGCGCAAT

401 TTGTTCAAAT CGCGTTCGGC ATCCCTTGCG TTTTTATAGT TGCTTGA
```

This corresponds to the amino acid sequence <SEQ ID 2198; ORF 671>:

m671.pep

```
  1 MTSRVTIKTP FNAPNTPPKM RLAKPKPTAE TALVSSERSI FWIRQAMTNR

 51 EMNDRANANR RGWNEAKARS AKEAAKSLAK KKETTHAAIE PASAITPRIA

101 DSTMQAAMTA ETRRSAMGRL FIRYLTGDTV YAQFVQIAFG IPCVFIVA*
```

Computer analysis of this amino acid sequence gave the following results:

Homology with a predicted ORF from *N. gonorrhoeae*
m671/g671 91.9% identity in 148 aa overlap

```
                    10        20        30        40        50        60
m671.pep    MTSRVTIKTPFNAPNTPPKMRLAKPKPTAETALVSSERSIFWIRQAMTNREMNDRANANR
            | |||||||||||||||||||||||:|||||| |||||||||||||||||||||||||||
g671        MISRVTIKTPFNAPNTPPKMRLAKPRPTAETAPVSSERSIFWIRQAMTNREMNDRANANR
                    10        20        30        40        50        60

                    70        80        90       100       110       120
m671.pep    RGWNEAKARSAKEAAKSLAKKKETTHAAIEPASAITPRIADSTMQAAMTAETRRSAMGRL
            |||||||||||| ||||||||||||||:|||||||||||:: |||||||||:||||||||
g671        RGWNEAKARSAKGAAKSLAKKKETTHATIEPASAITPRIVEMTMQAAMTAEARRSAMGRL
                    70        80        90       100       110       120

                   130       140      149
m671.pep    FIRYLTGDTVYAQFVQIAFGIPCVFIVAX
            |||||:||:|:||||||||||||||||||
g671        FIRYLAGDAVHAQFVQIAFGIPCVFIVAX
                   130       140
```

The following partial DNA sequence was identified in *N. meningitidis* <SEQ ID 2199>:

a671.seq

```
  1 ATGACCAGCA GGGTAATAAT CAAAATGCCT TTCAATGCAC CGAATACGCC
 51 GCCCAAAATG CGGTTGGCAA AGCCCAAACC GACCGCCGAA ACTGCCCCGG
101 TCAGCAGCGA GCGGAGTATT TTCTGGATCA GACAGGCAAT GACGAATAGG
151 GAAATGAACG ACAGAGCCAA TGCAAACAGG CGGGGTTGGA ACGATGCAAA
201 GGCGATGTCG GCGAAGGGTG CGGCAAAGAG TTTGGCGAAA AAAAAGGCAA
251 CCACCCATGC CGCCATTGAG CCAGCCTCCG CAATCACGCC GCGCATCGCG
301 GATAGCACGA TGCAGGCGGC GATGATGGCG GAGACGAGGA GGTCGGCAAC
351 GGGGAGGTTA TTCATTCGTT ACCTGACCGG CGATACCGTG TACGCGCAAT
401 TTGTTCAAAT CGCGTTCGGC ATCCCTTGCG TTTTTATAGT TGCTTGA
```

This corresponds to the amino acid sequence <SEQ ID 2200; ORF 671.a>:

a671.pep

```
  1 MTSRVIIKMP FNAPNTPPKM RLAKPKPTAE TAPVSSERSI FWIRQAMTNR
 51 EMNDRANANR RGWNDAKAMS AKGAAKSLAK KKATTHAAIE PASAITPRIA
101 DSTMQAAMMA ETRRSATGRL FIRYLTGDTV YAQFVQIAFG IPCVFIVA*
                                                   30
```

m671/a671 93.9% identity in 148 aa overlap

```
                   10        20        30        40        50        60
m671.pep   MTSRVTIKTPFNAPNTPPKMRLAKPKPTAETALVSSERSIFWIRQAMTNREMNDRANANR
           ||||| || |||||||||||||||||||||||| ||||||||||||||||||||||||||
a671       MTSRVIIKMPFNAPNTPPKMRLAKPKPTAETAPVSSERSIFWIRQAMTNREMNDRANANR
                   10        20        30        40        50        60

                   70        80        90       100       110       120
m671.pep   RGWNEAKARSAKEAAKSLAKKKETTHAAIEPASAITPRIADSTMQAAMTAETRRSAMGRL
           ||||:||| ||| ||||||||| ||||||||||||||||||||||||| ||||||| |||
a671       RGWNDAKAMSAKGAAKSLAKKKATTHAAIEPASAITPRIADSTMQAAMMAETRRSATGRL
                   70        80        90       100       110       120

                  130       140      149
m671.pep   FIRYLTGDTVYAQFVQIAFGIPCVFIVAX
           ||||||||||||||||||||||||||||
a671       FIRYLTGDTVYAQFVQIAFGIPCVFIVAX
                  130       140
```

The following partial DNA sequence was identified in *N. gonorrhoeae* <SEQ ID 2201>:

g672.seq

```
  1 ATGAGGAAAA TCCGCACCAA AATCTGCGGC ATCACCACAC CGGAAGACGC
 51 ACTGTATGCC GCCCACGCCG GCGCAGACGC ATTGGGACTG GTTTTTTACC
101 CCCAAAGCCC CCGCGCTATC GACATCATTA AAGCACAAAA AATCGCCGCC
151 GCACTGCCGC CGTTTGTCAG CGTTGTCGCC CTTTTCGTCA ACGAAAGCGC
201 GCAAAACATC CGCCGCATCC TTGCCGAAGT GCCGATACAC ATCATCCAAT
251 TCCACGGCGA CGAAGACGAT GCATTCTGCC GGCAGTTCGA CCGCCCCTAT
301 ATTAAAGCCA TTCGTGTTCA GACGGCATCA GACATCCGAA ACGCCGCCAC
351 GCGCTTCCCC AACGCTCAGG CACTGCTGTT CGATGCCTAT CTCCCTTCGG
```

-continued

401 AATACGGCGG CACCGGACAC CGCTTCGact GGacgctgtt ggcggAATAT

451 TCGGGCAAGC CGTGGGTGCT TGCCGGCGGG CTGACCCCTG AAAACGTCGG

501 CGAAGCCGTC CGCATCACCG GAGCGGAAGC GGTCGACGTA TCCGGCGGCG

551 TGGAAGCGTC TAAAGGCAAA AAAGACCCCG CCAAAGTCGC CGCCTTTATC

601 GCAACCGCCA ACCGCCTATC CCGTTAA

This corresponds to the amino acid sequence <SEQ ID 2202; ORF 672.ng>:

g672.pep

1 MRKIRTKICG ITTPEDALYA AHAGADALGL VFYPQSPRAI DIIKAQKIAA

51 ALPPFVSVVA LFVNESAQNI RRILAEVPIH IIQFHGDEDD AFCRQFDRPY

101 IKAIRVQTAS DIRNAATRFP NAQALLFDAY HPSEYGGTGH RFDWTLLAEY

151 SGKPWVLAGG LTPENVGEAV RITGAEAVDV SGGVEASKGK KDPAKVAAFI

201 ATANRLSR*

The following partial DNA sequence was identified in *N. meningitidis* <SEQ ID 2203>:

m672.seq

1 ATGAGGAAAA TCCGCACCAA AATCTGCGGC ATCACCACAC CGGAAGACGC

51 AGCTGCCGCC GCAGCGGCAG GTGCGGATGC CGTCGGGCTG GTCTTTTTCC

101 AAGGCAGCAG CCGGGCCGTC GATATTGCCC GCGCCAAAAA AATCACCGCC

151 GCACTGCCGC CGTTTGTCAG CGTTGTCGCC CTTTTCGTCA ACGAAAGCGC

201 GCAAAACATC CGCCGCATCC TTGCCGAAGT GCCGATACAC ATCATCCAAT

251 TCCACGGCGA CGAAGACGAC GCATTCTGCC GCCAGTTCCA CCGCCCCTAT

301 ATCAAAGCCA TTCGTGTTCA GACGGCATCA GACATCCGAA ACGCCGCCAC

351 GCGCTTCCCC GACGCTCAGG CACTGCTGTT CGATGCCTAC CATCCTTCGG

401 AATACGGCGG CACCGGAAAC CGCTTCGACT GGACGCTGCT GGCGGAATAT

451 TCGGGCAAAC CGTGGGTGCT TGCCGGCGGG CTGACCCCTG AAAACGTCGG

501 CGAAGCCGTC CGCATCACCG GAGCGGAATC GGTCGATGTA TCCGGCGGTG

551 TGGAAGCGTC TAAAGGCAAA AAAGATGCCG CCAAAGTCGC CGCCTTTATC

601 GCAACCGCCA ACCGCCTATC CCGTTAA

This corresponds to the amino acid sequence <SEQ ID 2204; ORF 672>:

m672.pep

1 MRKIRTKICG ITTPEDAAAA AAAGADAVGL VFFQGSSRAV DIARAKKITA

51 ALPPFVSVVA LFVNESAQNI RRILAEVPIH IIQFHGDEDD AFCRQFHRPY

101 IKAIRVQTAS DIRNAATRFP DAQALLFDAY HPSEYGGTGN RFDWTLLAEY

151 SGKPWVLAGG LTPENVGEAV RITGAESVDV SGGVEASKGK KDAAKVAAFI

201 ATANRLSR*

Computer analysis of this amino acid sequence gave the following results:

Homology with a predicted ORF from *N. gonorrhoeae* m672/g672 91.3% identity in 208 aa overlap

```
                      10        20        30        40        50        60
m672.pep      MRKIRTKICGITTPEDAAAAAAAGADAVGLVFFQGSSRAVDIARAKKITAALPPFVSVVA
              ||||||||||||||||  || |||||:||||:  | ||:|| :|:||:||||||||||||
g672          MRKIRTKICGITTPEDALYAAHAGADALGLVFYPQSPRAIDIIKAQKIAAALPPFVSVVA
                      10        20        30        40        50        60

                      70        80        90       100       110       120
m672.pep      LFVNESAQNIRRILAEVPIHIIQFHGDEDDAFCRQFHRPYIKAIRVQTASDIRNAATRFP
              |||||||||||||||||||||||||||||||||||| |||||||||||||||||||||||
g672          LFVNESAQNIRRILAEVPIHIIQFHGDEDDAFCRQFDRPYIKAIRVQTASDIRNAATRFP
                      70        80        90       100       110       120

                     130       140       150       160       170       180
m672.pep      DAQALLFDAYHPSEYGGTGNRFDWTLLAEYSGKPWVLAGGLTPENVGEAVRITGAESVDV
              :||||||||||||||||||:||||||||||||||||||||||||||||||||||||:|||
g672          NAQALLFDAYHPSEYGGTGHRFDWTLLAEYSGKPWVLAGGLTPENVGEAVRITGAEAVDV
                     130       140       150       160       170       180

                     190       200      209
m672.pep      SGGVEASKGKKDAAKVAAFIATANRLSRX
              |||||||||||| ||||||||||||||||
g672          SGGVEASKGKKDPAKVAAFIATANRLSRX
                     190       200
```

The following partial DNA sequence was identified in *N. meningitidis* <SEQ ID 2205>:

<u>a672.seq</u>

```
  1 ATGAGGAAAA TCCGCACCAA AATCTGCGGC ATCACCACAC CGGAAGACGC
 51 ACTGTATGCC GCCCACGCCG GCGCAGACGC ATTGGGACTG GTTTTTTACC
101 CCCAAAGCCC CCGCGCTGTC GACATCATTA AAGCACAAAA AATCACCGCC
151 GCACTGCCGC CGTTTGTCAG CGTTGTCGCC CTTTTCGTCA ACGAAAGCGC
201 GCAAAACATC CGCCGCATCC TTGCCGAAGT ACCGATACAC ATCATCCAAT
251 TCCACGGCGA CGAAGACGAC GCATTCTGCC GCCAGTTCCA CCGCCCCTAT
301 ATCAAGGCCA TTCGTGTTCA GACGGCATCA GACATCCGAA ACGCCGCCGA
351 CCGCTTCCCC GACGCTCAGG CACTGCTGTT CGATGCCTAC CATCCTTCGG
401 AATACGGCGG CACCGGACAC CGCTTCGACT GGACGCTGTT GGCGGAATAT
451 TCGGGCAAAC CGTGGGTGCT TGCCGGCGGG CTGACCCCTG AAAACGTCGA
501 CGAAGCCATC CGCATCACCG GAGCGGAAGC GGTCGATGTA TCCGGCGGCG
551 TGGAAGCGTC TAAAGGCAAA AAAGACCCAG CCAAAGTTGC CGCCTTTATC
601 GCAACCGCCA ACCGCCTATC CCGTTAA
```

This corresponds to the amino acid sequence <SEQ ID 2206; ORF 672.a>:

<u>a672.pep</u>

1 MRKIRTKICG ITTPEDALYA AHAGADALGL VFYPQSPRAV DIIKAQK<u>ITA</u>

51 <u>ALPPFVSVVA LFVN</u>ESAQNI RRILAEVPIH IIQFHGDEDD AFCRQFHRPY

101 IKAIRVQTAS DIRNAADRFP DAQALLFDAY HPSEYGGTGH RFDWTLLAEY

151 SGKPWVLAGG LTPENVDEAI RITGAEAVDV SGGVEASKGK KDPAKVAAFI

201 ATANRLSR* m672/a672 91.8% identity in 208 aa overlap

```
                   10        20        30        40        50        60
m672.pep   MRKIRTKICGITTPEDAAAAAAAGADAVGLVFFQGSSRAVDIARAKKITAALPPFVSVVA
           |||||||||||||||||  ||  |||||:||||:  | ||||| :|:||||||||||||||
a672       MRKIRTKICGITTPEDALYAAHAGADALGLVFYPQSPRAVDIIKAQKITAALPPFVSVVA
                   10        20        30        40        50        60

                   70        80        90       100       110       120
m672.pep   LFVNESAQNIRRILAEVPIHIIQFHGDEDDAFCRQFHRPYIKAIRVQTASDIRNAATRFP
           ||||||||||||||||||||||||||||||||||||||||||||||||||||||||| ||
a672       LFVNESAQNIRRILAEVPIHIIQFHGDEDDAFCRQFHRPYIKAIRVQTASDIRNAADRFP
                   70        80        90       100       110       120

                  130       140       150       160       170       180
m672.pep   DAQALLFDAYHPSEYGGTGNRFDWTLLAEYSGKPWVLAGGLTPENVGEAVRITGAESVDV
           |||||||||||||||||||:|||||||||||||||||||||||||| ||:||||||:|||
a672       DAQALLFDAYHPSEYGGTGHRFDWTLLAEYSGKPWVLAGGLTPENVDEAIRITGAEAVDV
                  130       140       150       160       170       180

                  190       200      209
m672.pep   SGGVEASKGKKDAAKVAAFIATANRLSRX
           |||||||||||| ||||||||||||||||
a672       SGGVEASKGKKDPAKVAAFIATANRLSRX
                  190       200
```

The following partial DNA sequence was identified in *N. gonorrhoeae* <SEQ ID 2207>:

g673.seq

```
  1 ATGGATATTG AAACCTTCCT TGCAGGGGAA CGCGCCGCCG GCGGATACCG
 51 TTGCGGCTTC GTGGCGATTG TCGGTCGTCC GAACGTGGGC AAATCAACGC
101 TGATGAACCA TCTCATCGGT CAGAAAATCA GTATTACCAG CAAAAAGGCG
151 CAGACGACGC GCAACCGCGT AACGGGGATT TATACCGACG ATACCGCGCA
201 GTTCGTGTTT GTCGATACGC CGGGCTTTCA AACCGACCAC CGCAACGCGC
251 TCAACGACAG GCTGAATCAA AATGTTACCG AGGCGCTCGG CGGTGTGGAT
301 GTGGTGGTTT TCGTCGTGGA GGCGATGCGC CTTACCGATG CCGACCGCGT
351 CGTGTTGAAA CAACTGCCCA AGCACACGCC GGTCATTTTA GTGATCAACA
401 AAATCGACAA GGACAAGGCG AAAGACCGTT ACGCGCTGGA GGCGTTTGTT
451 GCCCAAGTGC GCGCCGAATT TGAATTTGCG GCGGCGGAGG CGGTCAGTGC
501 GAAACACGGT TTGCGGATTG CCAACCTGTT GGAGCTGCTC AAGCCGTATC
551 TGCCCGAAAG CGTACCGATG TATCCCGAAG ACATGGTTAC GGACAAATCG
601 GCGCGTTTTT TGGCGATGGA AATCGTGCGT GAAAAACTCT TCCGCTATTT
651 GGGCGAGGAG CTGCCTTATG CGATGAACGT CGAAGTGGAG CAGTTTGAAG
701 AGGGAGACGG TTTGAACCGC ATCTACatcg cCGTTTTGGT CGACAAAGAA
751 AGCCAAAAGG CGATTTTGAT CGGTAAAGGC GGGGAGCGTT TGAAAAAAAT
801 TTCCACCGAA GCGCGGCTGG ATATGGAAAA ACTGTTTGAT AACAAAGTAT
851 TTTTGAAGGT CTGGGTCAAA GTCAAATCCG GTTGGGCAGA CGACATTCGC
901 TTCCTGCGCG AGCTGGGTTT GTAG
```

This corresponds to the amino acid sequence <SEQ ID 2208; ORF 673.ng>:

g673.pep

```
  1 MDIETFLAGE RAAGGYRCGF VAIVGRPNVG KSTLMNHLIG QKISITSKKA
 51 QTTRNRVTGI YTDDTAQFVF VDTPGFQTDH RNALNDRLNQ NVTEALGGVD
```

-continued

```
101 VVVFVVEAMR LTDADRVVLK QLPKHTPVIL VINKIDKDKA KDRYALEAFV
151 AQVRAEFEFA AAEAVSAKHG LRIANLLELL KPYLPESVPM YPEDMVTDKS
201 ARFLAMEIVR EKLFRYLGEE LPYAMNVEVE QFEEGDGLNR IYIAVLVDKE
251 SQKAILIGKG GERLKKISTE ARLDMEKLFD NKVFLKVWVK VKSGWADDIR
301 FLRELGL*
```

The following partial DNA sequence was identified in *N. meningitidis* <SEQ ID 2209>:

m673.seq

```
  1 ATGGATATTG AAACCTTCCT TGCAGGGGAA CGCGCCGCCG GCGGATACCG
 51 TTGCGGCTTC GTAGCGATTG TCGGCCGTCC GAACGTGGGC AAATCAACGC
101 TGATGAACCA TCTCATCGGT CAGAAAATCA GTATTACCAG CAAAAAGGCG
151 CAGACGACGC GCAACCGCGT AACGGGGATT TATACCGACG ATACCGCGCA
201 GTTCGTGTTT GTCGATACGC CCGGCTTTCA AACCGACCAC CGCAACGCGC
251 TCAACGACAG GCTGAATCAA AATGTTACCG AGGCGCTCGG CGGCGTGCAT
301 GTGGTGGTTT TCGTCGTGGA GGCGATGCGC TTTACCGATG CCGACCGCGT
351 CGTGTTGAAA CAACTGCCCA AGCACACGCC GGTCATTTTA GTGGTCAACA
401 AAATCGACAA GGACAAGGCG AAAGACCGTT ACGCGCTGGA GGCGTTTGTT
451 GCCCAAGTGC GCGCCGAATT TGAATTTGCG GCGGCGGAGG CGGTCAGCGC
501 GAAACACGGA TTGCGGATTG CCAACCTGTT GGAGCTGATT AAGCCGTATC
551 TGCCCGAAAG CGTGCCGATG TATCCCGAAG ATATGGTTAC GGACAAATCG
601 GCGCGTTTTT TGGCGATGGA AATCGTGCGT GAAAAATTGT TCCGCTATTT
651 GGGCGAGGAA TTGCCTTATG CGATGAACGT CGAAGTGGAG CAGTTTGAAG
701 AGGAAGACGG TTTGAACCGC ATCTATATCG CCGTTTTGGT CGATAAGGAA
751 AGCCAAAAGG CAATTTTAAT CGGTAAAGCC GGAGAACGTT TGAAGAAAAT
801 TTCCACCGAA GCGCGGTTGG ATATGGAAAA ACTGTTTGAT ACCAAAGTAT
851 TTTTGAAGGT CTGGGTCAAA GTCAAATCCG GTTGGGCGGA CGACATCCGC
901 TTCCTGCGCG AGCTGGGTTT GTAG
```

This corresponds to the amino acid sequence <SEQ ID 2210; ORF 673>:

m673.pep

```
  1 MDIETFLAGE RAAGGYRCGF VAIVGRPNVG KSTLMNHLIG QKISITSKKA
 51 QTTRNRVTGI YTDDTAQFVF VDTPGFQTDH RNALNDRLNQ NVTEALGGVD
101 VVVFVVEAMR FTDADRVVLK QLPKHTPVIL VVNKIDKDKA KDRYALEAFV
151 AQVRAEFEFA AAEAVSAKHG LRIANLLELI KPYLPESVPM YPEDMVTDKS
201 ARFLAMEIVR EKLFRYLGEE LPYAMNVEVE QFEEEDGLNR IYIAVLVDKE
251 SQKAILIGKG GERLKKISTE ARLDMEKLFD TKVFLKVWVK VKSGWADDIR
301 FLRELGL*
```

Computer analysis of this amino acid sequence gave the following results:

Homology with a predicted ORF from *N. gonorrhoeae*
m673/g673 98.4% identity in 307 aa overlap

```
                      10        20        30        40        50        60
m673.pep      MDIETFLAGERAAGGYRCGFVAIVGRPNVGKSTLMNHLIGQKISITSKKAQTTRNRVTGI
              ||||||||||||||||||||||||||||||||||||||||||||||||||||||||||||
g673          MDIETFLAGERAAGGYRCGFVAIVGRPNVGKSTLMNHLIGQKISITSKKAQTTRNRVTGI
                      10        20        30        40        50        60

                      70        80        90       100       110       120
m673.pep      YTDDTAQFVFVDTPGFQTDHRNALNDRLNQNVTEALGGVDVVVFVVEAMRFTDADRVVLK
              |||||||||||||||||||||||||||||||||||||||||||||||||||:||||||||
g673          YTDDTAQFVFVDTPGFQTDHRNALNDRLNQNVTEALGGVDVVVFVVEAMRLTDADRVVLK
                      70        80        90       100       110       120

                     130       140       150       160       170       180
m673.pep      QLPKHTPVILVVNKIDKDKAKDRYALEAFVAQVRAEFEFAAAEAVSAKHGLRIANLLELI
              |||||||||||:|||||||||||||||||||||||||||||||||||||||||||||||:
g673          QLPKHTPVILVINKIDKDKAKDRYALEAFVAQVRAEFEFAAAEAVSAKHGLRIANLLELL
                     130       140       150       160       170       180

                     190       200       210       220       230       240
m673.pep      KPYLPESVPMYPEDMVTDKSARFLAMEIVREKLFRYLGEELPYAMNVEVEQFEEEDGLNR
              |||||||||||||||||||||||||||||||||||||||||||||||||||||| |||||
g673          KPYLPESVPMYPEDMVTDKSARFLAMEIVREKLFRYLGEELPYAMNVEVEQFEEGDGLNR
                     190       200       210       220       230       240

                     250       260       270       280       290       300
m673.pep      IYIAVLVDKESQKAILIGKGGERLKKISTEARLDMEKLFDTKVFLKVWVKVKSGWADDIR
              ||||||||||||||||||||||||||||||||||||||||:|||||||||||||||||||
g673          IYIAVLVDKESQKAILIGKGGERLKKISTEARLDMEKLFDNKVFLKVWVKVKSGWADDIR
                     250       260       270       280       290       300

m673.pep      FLRELGLX
              ||||||||
g673          FLRELGLX
```

The following partial DNA sequence was identified in *N. meningitidis* <SEQ ID 2211>:

a673.seq

```
  1 ATGGATATTG AAACCTTCCT TGCAGGGGAA CGCGCCGCCG ACGGATACCG
 51 TTGCGGCTTC GTAGCGATTG TCGGCCGTCC GAACGTGGGC AAATCAACGC
101 TGATGAATCA TCTCATCGGT CAGAAAATCA GTATTACCAG CAAAAAGGCG
151 CAGACGACGC GCAACCGCGT AACGGGGATT TATACCGACG ATACCGCGCA
201 GTTTGTGTTT GTCGATACGC CCGGTTTTCA AACCGACCAC CGCAACGCGC
251 TCAACGACCG TTTGAATCAA AACGTTACCG AGGCACTCGG CGGCGTGGAT
301 GTGGTGGTTT TCGTCGTGGA AGCGATGCGT TTTACCGATG CCGACCGCGT
351 CGTGTTGAAA CAACTGCCCA AGCACACGCC GGTCATTTTA GTGGTCAACA
401 AAATCGATAA GGACAAGGCG AAAGACCGTT ACGCGCTGGA GGCGTTTGTT
451 GCCCAGGTGC GCGCCGAATT TGAATTTGCG GCGGCGGAGG CGGTCAGCGC
501 GAAACACGGA TTGCGGATTG CCAACCTGTT GGAGCTGATT AAGCCGTATC
551 TGCCCGAAAG CGTGCCGATG TATCCCGAAG ATATGGTTAC GGACAAATCG
601 GCGCGTTTTT TAGCGATGGA AATCGTGCGT GAAAAATTGT TCCGCTATTT
651 GGGCGAGGAA TTGCCTTATG CGATGAACGT CGAAGTGGAG CAGTTTGAAG
701 AGGAAGACGG TTTGAACCGC ATCTATATCG CCGTTTTGGT CGATAAGGAA
751 AGCCAAAAGG CGATTTTAAT CGGCAAAGGC GGGGAGCGTT TGAAGAAAAT
801 TTCCACCGAA GCGCGGTTGG ATATGGAAAA ACTGTTTGAT ACCAAAGTAT
851 TTTTGAAGGT CTGGGTCAAA GTCAAATCCG GTTGGGCGGA CGACATCCGC
901 TTCCTGCGCG AGCTGGGTTT GTAG
```

This corresponds to the amino acid sequence <SEQ ID 2212; ORF 673.a>:

a673.pep

```
  1 MDIETFLAGE RAADGYRCGF VAIVGRPNVG KSTLMNHLIG QKISITSKKA
 51 QTTRNRVTGI YTDDTAQFVF VDTPGFQTDH RNALNDRLNQ NVTEALGGVD
101 VVVFVVEAMR FTDADRVVLK QLPKHTPVIL VVNKIDKDKA KDRYALEAFV
151 AQVRAEFEFA AAEAVSAKHG LRIANLLELI KPYLPESVPM YPEDMVTDKS
201 ARFLAMEIVR EKLFRYLGEE LPYAMNVEVE QFEEEDGLNR IYIAVLVDKE
251 SQKAILIGKG GERLKKISTE ARLDMEKLFD TKVFLKVWVK VKSGWADDIR
301 FLRELGL*
```

m673/a673 99.7% identity in 307 aa overlap

```
                    10        20        30        40        50        60
m673.pep    MDIETFLAGERAAGGYRCGFVAIVGRPNVGKSTLMNHLIGQKISITSKKAQTTRNRVTGI
            ||||||||||||| ||||||||||||||||||||||||||||||||||||||||||||||
a673        MDIETFLAGERAADGYRCGFVAIVGRPNVGKSTLMNHLIGQKISITSKKAQTTRNRVTGI
                    10        20        30        40        50        60

                    70        80        90       100       110       120
m673.pep    YTDDTAQFVFVDTPGFQTDHRNALNDRLNQNVTEALGGVDVVVFVVEAMRFTDADRVVLK
            ||||||||||||||||||||||||||||||||||||||||||||||||||||||||||||
a673        YTDDTAQFVFVDTPGFQTDHRNALNDRLNQNVTEALGGVDVVVFVVEAMRFTDADRVVLK
                    70        80        90       100       110       120

                   130       140       150       160       170       180
m673.pep    QLPKHTPVILVVNKIDKDKAKDRYALEAFVAQVRAEFEFAAAEAVSAKHGLRIANLLELI
            ||||||||||||||||||||||||||||||||||||||||||||||||||||||||||||
a673        QLPKHTPVILVVNKIDKDKAKDRYALEAFVAQVRAEFEFAAAEAVSAKHGLRIANLLELI
                   130       140       150       160       170       180

                   190       200       210       220       230       240
m673.pep    KPYLPESVPMYPEDMVTDKSARFLAMEIVREKLFRYLGEELPYAMNVEVEQFEEEDGLNR
            ||||||||||||||||||||||||||||||||||||||||||||||||||||||||||||
a673        KPYLPESVPMYPEDMVTDKSARFLAMEIVREKLFRYLGEELPYAMNVEVEQFEEEDGLNR
                   190       200       210       220       230       240

                   250       260       270       280       290       300
m673.pep    IYIAVLVDKESQKAILIGKGGERLKKISTEARLDMEKLFDTKVFLKVWVKVKSGWADDIR
            ||||||||||||||||||||||||||||||||||||||||||||||||||||||||||||
a673        IYIAVLVDKESQKAILIGKGGERLKKISTEARLDMEKLFDTKVFLKVWVKVKSGWADDIR
                   250       260       270       280       290       300

m673.pep    FLRELGLX
            ||||||||
a673        FLRELGLX
```

The following partial DNA sequence was identified in *N. gonorrhoeae* <SEQ ID 2213>:

g674.seq

```
  1 ATGAAAACAG CCCGCCGCCG TTCCCGCGAG CTTGCCGTAC AAGCCGTTTA
 51 CCAATCCCTT ATCAACCGCA CCGCCGCGCC CGAAATTGCT AAAAACATCC
101 GCGAAATGTC CGACTTTGCC AAAGCGGACG AAGAATTGTT CAACAAACTC
151 TTCTTCGGCA CACAAACCAA TGCAGCGGAC TACATCCAAA AAATCCGCCC
201 GCTGCTCGAC AGGGACGAAA AAGACCTCAA CCCCATCGAA CGCGCCGTTT
251 TGCTGACCGC CTGCCACGAG CTTTCCGCTA TGCCCGAAAC GCCCTACCCC
301 GTCATTATCA ACGAAGCCAT CGAAGTTACC AAAACCTTCG GCGGCACGGA
351 CGGGCACAAA TTCGTCAACG GCATCCTCGA CAAACTCGCC GCCCAAATCC
401 GCCCAGACGA GCCCAAACGC CGTTGA
```

This corresponds to the amino acid sequence <SEQ ID 2214; ORF 674.ng>:

g674.pep

```
  1 MKTARRRSRE LAVQAVYQSL INRTAAPEIA KNIREMSDFA KADEELFNKL
 51 FFGTQTNAAD YIQKIRPLLD RDEKDLNPIE RAVLLTACHE LSAMPETPYP
101 VIINEAIEVT KTFGGTDGHK FVNGILDKLA AQIRPDEPKR R*
```

The following partial DNA sequence was identified in *N. meningitidis* <SEQ ID 2215>:

m674.seq

```
  1 ATGAAAACAG CCCGCCGCCG TTCCCGCGAG CTTGCCGTAC AAGCCGTTTA
 51 CCAATCCCTT ATCAACCGCA CCGCCGCGCC CGAAATTGCT AAAAACATCC
101 GCGAAATGTC CGACTTTGCC AAGGCAGACG AAGAATTGTT CAACAAACTT
151 TTCTTCGGCA CGCAAACCAA TGCGGCAGAG TATATCCGAC AAATCCGCCC
201 GCTACTTGAC AGGGACGAAA AAGACCTCAA CCCCATCGAA CGCGCCGTTT
251 TGCTGACCGC CTGCCACGAG CTGTCCGCCA TGCCCGAAAC GCCCTACCCC
301 GTCATTATCA ACGAAGCCAT CGAAGTTACC AAAACCTTCG GCGGCACGGA
351 CGGGCACAAA TTCGTCAACG GCATCCTCGA CAAACTCGCC GCCCAAATCC
401 GCCCCGACGA GCCCAAACGC CGTTGA
```

This corresponds to the amino acid sequence <SEQ ID 2216; ORF 674>:

m674.pep

```
  1 MKTARRRSRE LAVQAVYQSL INRTAAPEIA KNIREMSDFA KADEELFNKL
 51 FFGTQTNAAE YIRQIRPLLD RDEKDLNPIE RAVLLTACHE LSAMPETPYP
101 VIINEAIEVT KTFGGTDGHK FVNGILDKLA AQIRPDEPKR R*
```

Computer analysis of this amino acid sequence gave the following results:

Homology with a predicted ORF from *N. gonorrhoeae* m674/g674 97.9% identity in 141 aa overlap

```
                   10        20        30        40        50        60
m674.pep   MKTARRRSRELAVQAVYQSLINRTAAPEIAKNIREMSDFAKADEELFNKLFFGTQTNAAE
           |||||||||||||||||||||||||||||||||||||||||||||||||||||||||||:
g674       MKTARRRSRELAVQAVYQSLINRTAAPEIAKNIREMSDFAKADEELFNKLFFGTQTNAAD
                   10        20        30        40        50        60

                   70        80        90       100       110       120
m674.pep   YIRQIRPLLDRDEKDLNPIERAVLLTACHELSAMPETPYPVIINEAIEVTKTFGGTDGHK
           ||::||||||||||||||||||||||||||||||||||||||||||||||||||||||||
g674       YIQKIRPLLDRDEKDLNPIERAVLLTACHELSAMPETPYPVIINEAIEVTKTFGGTDGHK
                   70        80        90       100       110       120

                  130       140
m674.pep   FVNGILDKLAAQIRPDEPKRRX
           ||||||||||||||||||||||
g674       FVNGILDKLAAQIRPDEPKRRX
                  130       140
```

The following partial DNA sequence was identified in *N. meningitidis* <SEQ ID 2217>:

a674.seq

```
  1 ATGAAAACAG CCCGCCGCCG TTCCCGCGAG CTTGCCGTAC AAGCCGTTTA
 51 CCAATCCCTT ATCAACCGCA CCGCCGCGCC CGAGATTGCT AAAAACATCC
101 GCGAAATGCC CGACTTTGCC AAGGCAGACG AAGAATTGTT CAACAAACTT
151 TTCTTCGGCA CGCAAACCAA TGCGGCAGAG TACATCCGAC AAATCCGCCC
201 CCTGCTCGAC CGCGACGAAA AAGACCTCAA CCCCATCGAA CGCGCCGTCC
251 TGCTGACCGC CTGCCACGAG CTGTCCGCCA TGCCCGAAAC GCCCTACCCC
301 GTCATCATCA ACGAAGCCAT CGAAGTAACC AAAACCTTCG GCGGCACGGA
351 CGGGCACAAA TTCGTCAACG GCATCCTCGA CAAACTCGCC GCCCAAATCC
401 GTCCCGACGA GCCCAAACGC CGTTGA
```

This corresponds to the amino acid sequence <SEQ ID 2218; ORF 674.a>:

a674.pep

```
  1 MKTARRRSRE LAVQAVYQSL INRTAAPEIA KNIREMPDFA KADEELFNKL
 51 FFGTQTNAAE YIRQIRPLLD RDEKDLNPIE RAVLLTACHE LSAMPETPYP
101 VIINEAIEVT KTFGGTDGHK FVNGILDKLA AQIRPDEPKR R*
```

m674/a674 99.3% identity in 141 aa overlap

```
                  10        20        30        40        50        60
m674.pep  MKTARRRSRELAVQAVYQSLINRTAAPEIAKNIREMSDFAKADEELFNKLFFGTQTNAAE
          |||||||||||||||||||||||||||||||||||| |||||||||||||||||||||||
a674      MKTARRRSRELAVQAVYQSLINRTAAPEIAKNIREMPDFAKADEELFNKLFFGTQTNAAE
                  10        20        30        40        50        60

                  70        80        90       100       110       120
m674.pep  YIRQIRPLLDRDEKDLNPIERAVLLTACHELSAMPETPYPVIINEAIEVTKTFGGTDGHK
          ||||||||||||||||||||||||||||||||||||||||||||||||||||||||||||
a674      YIRQIRPLLDRDEKDLNPIERAVLLTACHELSAMPETPYPVIINEAIEVTKTFGGTDGHK
                  70        80        90       100       110       120

                 130       140
m674.pep  FVNGILDKLAAQIRPDEPKRRX
          |||||||||||||||||||||
a674      FVNGILDKLAAQIRPDEPKRRX
                 130       140
```

The following partial DNA sequence was identified in *N. gonorrhoeae* <SEQ ID 2219>:

g675.seq

```
  1 ATGAACACCA TCGCCCCcaa cctcgacgGC AAACACCTCC GCATCGGCAT
 51 CGTACAGGCA CGCTTCACCA ACGAAATCGG CAGCCAAATG CTCAAAGTCT
101 GCTGCCGCAC CCTCCAAGAA TTGGGCGTAG CAGACGAAAa catcaccgtc
151 gCCACCGTAC CCGGCGCGCT TGAAATCCCC ATCGCGCTGA TGAACTTTGC
201 CTCTTCCGAA AAATTTGACG CACTGATTGC CATCGGCGTC GTCATCCGTG
251 GCGAAACCTA CCATTTCGAG CTGGTTGCCA ACGAATCCGG CGCAGGGATC
301 GGCCGCGTCG CACTCGACTA CAACATCCCG ATTGCCAACG CCGTCCTGAC
351 CACCGAAAAC GACGCGCAGG CAATTGAACG GATTGGAGAA AAAGCCTCGG
```

-continued

```
401 ATGCCGCCAA AGTCGCCGTA GAATGCGCCA ACCTCGTCAA CCTTCTGCTC

451 GAAGAACAGT TTGAAGACGA AGAATAA
```

This corresponds to the amino acid sequence <SEQ ID 2220; ORF 675.ng>:

g675.pep

```
  1 MNTIAPNLDG KHLRIGIVQA RFTNEIGSQM LKVCCRTLQE LGVADENITV

 51 ATVPGALEIP IALMNFASSE KFDALIAIGV VIRGETYHFE LVANESGAGI

101 GRVALDYNIP IANAVLTTEN DAQAIERIGE KASDAAKVAV ECANLVNLLL

151 EEQFEDEE*
```

The following partial DNA sequence was identified in *N. meningitidis* <SEQ ID 2221>:

m675.seq

```
  1 ATGAACACCA TCGCCCCCAA CCTCGACGGC AAACACCTCC GCATCGGCAT

 51 CGTACAGGCA CGCTTCACCA ACGAAATCGG CAGCGAAATG CTCAAAGTCT

101 GCTGCCGCAC CCTCCAAGAA TTGGGCGTGG CAGACGAAAA CATTACCGTC

151 GCCACCGTAC CCGGCGCGCT TGAAATCCCC ATCGCGCTGA TGAACTTTGC

201 CTCTTCCGAA AAGTTTGACG CACTGATTGC CATCGGCGTC GTCATCCGTG

251 GCGAAACCTA CCATTTCGAG CTGGTTTCCA ACGAATCCGG AGCAGGCGTC

301 AGCCGCGTCG CACTCGACTA CAATATCCCG ATTGCCAATG CCGTCCTAAC

351 CACCGAAAAC GACGCGCAGG CAATCGAACG GATTGAAGAA AAAGCCTCGG

401 ATGCCGCCAA AGTCGCCGTC GAATGCGCCA ACCTCGTCAA CCTGCTGCTC

451 GAAGAACAGT TTGAAGACGA AGAATAA
```

This corresponds to the amino acid sequence <SEQ ID 2222; ORF 675>:

m675.pep

```
  1 MNTIAPNLDG KHLRIGIVQA RFTNEIGSEM LKVCCRTLQE LGVADENITV

 51 ATVPGALEIP IALMNFASSE KFDALIAIGV VIRGETYHFE LVSNESGAGV

101 SRVALDYNIP IANAVLTTEN DAQAIERIEE KASDAAKVAV ECANLVNLLL

151 EEQFEDEE*
```

Computer analysis of this amino acid sequence gave the following results:

Homology with a predicted ORF from *N. gonorrhoeae*
m675/g675 96.8% identity in 158 aa overlap

```
                  10        20        30        40        50        60
m675.pep   MNTIAPNLDGKHLRIGIVQARFTNEIGSEMLKVCCRTLQELGVADENITVATVPGALEIP
           ||||||||||||||||||||||||||||:|||||||||||||||||||||||||||||||
g675       MNTIAPNLDGKHLRIGIVQARFTNEIGSQMLKVCCRTLQELGVADENITVATVPGALEIP
                  10        20        30        40        50        60
```

-continued

```
                   70        80        90       100       110       120
m675.pep   IALMNFASSEKFDALIAIGVVIRGETYHFELVSNESGAGVSRVALDYNIPIANAVLTTEN
           ||||||||||||||||||||||||||||||||:||||||::|||||||||||||||||||
g675       IALMNFASSEKFDALIAIGVVIRGETYHFELVANESGAGIGRVALDYNIPIANAVLTTEN
                   70        80        90       100       110       120

                  130       140       150      159
m675.pep   DAQAIERIEEKASDAAKVAVECANLVNLLLEEQFEDEEX
           |||||||| ||||||||||||||||||||||||||||||
g675       DAQAIERIGEKASDAAKVAVECANLVNLLLEEQFEDEEX
                  130       140       150
```

The following partial DNA sequence was identified in *N. meningitidis* <SEQ ID 2223>:

a675.seq

```
  1 ATGAACACCA TCGCCCCCAA CCTCGACGGC AAACACCTCC GCATCGGCAT
 51 CGTACAGGCA CGCTTCACCA ACGAAATCGG CAGCGAAATG CTCAAAGTCT
101 GCTGCCGCAC CCTCCAAGAA TTGGGCGTGG CAGACGAAAA CATTACCGTC
151 GCCACCGTAC CCGGCGCGCT TGAAATCCCC ATCGCGCTGA TGAACTTTGC
201 CTCTTCTGAA AAATTTGACG CACTGATTGC CATCGGCGTC GTTATCCGTG
251 GCGAAACCTA CCATTTCGAG CTGGTTTCCA ACGAATCCGG AGCAGGGGTC
301 AGCCGCGTCG CACTCGACTA CAACATCCCG ATTGCCAATG CCGTCCTGAC
351 CACGGAAAAC GACGCACAGG CAATCGAACG GATTGAAGAA AAAGCCTCGG
401 ATGCCGCCAA AGTCGCCGTA GAATGCGCCA ACCTCGTCAA CCTCCTGCTC
451 GAAGAACAGT TTGAAGACGA AGAATAA
```

This corresponds to the amino acid sequence <SEQ ID 2224; ORF 675.a>:

a675.pep

```
  1 MNTIAPNLDG KHLRIGIVQA RFTNEIGSEM LKVCCRTLQE LGVADENITV
 51 ATVPGALEIP IALMNFASSE KFDALIAIGV VIRGETYHFE LVSNESGAGV
101 SRVALDYNIP IANAVLTTEN DAQAIERIEE KASDAAKVAV ECANLVNLLL
151 EEQFEDEE*
```

m675/a675 100.0% identity in 158 aa overlap

```
                   10        20        30        40        50        60
m675.pep   MNTIAPNLDGKHLRIGIVQARFTNEIGSEMLKVCCRTLQELGVADENITVATVPGALEIP
           ||||||||||||||||||||||||||||||||||||||||||||||||||||||||||||
a675       MNTIAPNLDGKHLRIGIVQARFTNEIGSEMLKVCCRTLQELGVADENITVATVPGALEIP
                   10        20        30        40        50        60

                   70        80        90       100       110       120
m675.pep   IALMNFASSEKFDALIAIGVVIRGETYHFELVSNESGAGVSRVALDYNIPIANAVLTTEN
           ||||||||||||||||||||||||||||||||||||||||||||||||||||||||||||
a675       IALMNFASSEKFDALIAIGVVIRGETYHFELVSNESGAGVSRVALDYNIPIANAVLTTEN
                   70        80        90       100       110       120

                  130       140       150      159
m675.pep   DAQAIERIEEKASDAAKVAVECANLVNLLLEEQFEDEEX
           |||||||||||||||||||||||||||||||||||||||
a675       DAQAIERIEEKASDAAKVAVECANLVNLLLEEQFEDEEX
                  130       140       150
```

The following partial DNA sequence was identified in *N. gonorrhoeae* <SEQ ID 2225>:

g677.seq

```
  1 ATGCCGCAGA TTTTGGTGCG GATTTTCCTC ATTCGGTATT CCTTTATTtg
 51 ggAAACGGTG CGCTTGTGCC GTTTCAGACG GCATTCCCGA TCAGTCGATT
101 TTGATGTATT CGACAGAAAG GATTTCAATT TCCTCACGGC CTTCCGGCGT
151 GTTCAAAACC ACTTCGTCGC CTTCGCGCGC TTTAATCAGG CAACGCGCCA
201 ACGGCGAAAT CCAAGAAATT TTGTTTTGCG CGGTATCGAT TTCATCGACG
251 CCGACGATTT TGACGGTTTG CTCGCGCCCG TCGCCGCGCA ACAGACCGAC
301 GGTCGCGCCG AAAAATACTT GGTCGGTCGC TTCGCGCAAT TCGGGATCGA
351 CGACGACGGC AGCCTCCAAA CGTTTGGTCA GGAAACGGAT GCGGCGGTCG
401 ATTTCGCGCA TACGGCGTTT GCCGTAAAGA TAGTCGCCGT TTTCGCTGCG
451 GTCGCCGTTG CCTGCCGCCC AGTTGACGAT TTGGACGATT TCGGGGCGTT
501 CTTTATTGAC CAGTTGATAA AGCTCGTCTT TCAATGCCTG CCATCCGGCG
551 GGCGTAATGT AGTTTTTGGT TTCGGTACTC ATATTGTGTG CGGATGA
```

This corresponds to the amino acid sequence <SEQ ID 2226; ORF 677.ng>:

g677.pep

```
  1 MPQILVRIFL IRYSFIWETV RLCRFRRHSR SVDFDVFDRK DFNFLTAFRR
 51 VQNHFVAFAR FNQATRQRRN PRNFVLRGID FIDADDFDGL LAPVAAQQTD
101 GRAEKYLVGR FAQFGIDDDG SLQTFGQETD AAVDFAHTAF AVKIVAVFAA
151 VAVACRPVDD LDDFGAFFID QLIKLVFQCL PSGGRNVVFG FGTHIVCG*
```

The following partial DNA sequence was identified in *N. meningitidis* <SEQ ID 2227>:

m677.seq

```
  1 ATGCCGCAGA TTTTGGTGCG GATTTTCCTC ATTCGGTATT CCTTTATTTG
 51 GGAAACGGCG CGCTTTTGCC GTTTCAGACG GCATTCCCGA TCAGTCGATT
101 TTGATGTATT CGACAGAAAG GATTTCAATT TCCTCACGCC CTTCCGGCGT
151 GTTCAAAACC ACTTCGTCGC CTTCGCGCGC TTTAATCAGA CAACGAGCCA
201 GCGGCGAAAT CCAAGAAATT TTGTTTTGCG CGGTATCGAT TTCATCGATG
251 CCGACGATTT TGACGGTTTG CTCGCGCCCG TCGTCGCGCA ACAGTCCGAC
301 CGTCGCGCCG AAAAACACTT GGTCGGTCGC TTCGCGCAAT TCGGGATCGA
351 CGACGACGGC AGCCTCCAAA CGTTTGGTCA GGAAACGGAT GCGGCGGTCG
401 ATTTCGCGCA TACGGCGTTT GCCGTAAAGA TAGTCGCCGT TTTCGCTGCG
451 GTCGCCGTTG CCTGCCGCCC AGTTGACGAT TTGGACGATT TCGGGGCGTT
501 CTTTGTTGAC CAGTTGATAA AGCTCGTCTT TCAATGCCTG CCATCCGGCG
551 GGCGTAATGT AGTTTTTGGT TTCGGTACTC ATATTGTGTG CGGATGA
```

This corresponds to the amino acid sequence <SEQ ID 2228; ORF 677>:

m677.pep

```
  1 MPQILVRIFL IRYSFIWETA RFCRFRRHSR SVDFDVFDRK DFNFLTPFRR
 51 VQNHFVAFAR FNQTTSQRRN PRNFVLRGID FIDADDFDGL LAPVVAQQSD
101 RRAEKHLVGR FAQFGIDDDG SLQTFGQETD AAVDFAHTAF AVKIVAVFAA
151 VAVACRPVDD LDDFGAFFVD QLIKLVFQCL PSGGRNVVFG FGTHIVCG*
```

Computer analysis of this amino acid sequence gave the following results:

Homology with a predicted ORF from *N. gonorrhoeae* m677/g677 94.9% identity in 198 aa overlap

```
                   10        20        30        40        50        60
m677.pep   MPQILVRIFLIRYSFIWETARFCRFRRHSRSVDFDVFDRKDFNFLTPFRRVQNHFVAFAR
           ||||||||||||||||||:|:||||||||||||||||||||||| ||||||||||||
g677       MPQILVRIFLIRYSFIWETVRLCRFRRHSRSVDFDVFDRKDFNFLTAFRRVQNHFVAFAR
                   10        20        30        40        50        60

                   70        80        90       100       110       120
m677.pep   FNQTTSQRRNPRNFVLRGIDFIDADDFDGLLAPVVAQQSDRRAEKHLVGRFAQFGIDDDG
           |||:| ||||||||||||||||||||||||||:|||:| ||||:|||||||||||||
g677       FNQATRQRRNPRNFVLRGIDFIDADDFDGLLAPVAAQQTDGRAEKYLVGRFAQFGIDDDG
                   70        80        90       100       110       120

                  130       140       150       160       170       180
m677.pep   SLQTFGQETDAAVDFAHTAFAVKIVAVFAAVAVACRPVDDLDDFGAFFVDQLIKLVFQCL
           ||||||||||||||||||||||||||||||||||||||||||||||||:||||||||||
g677       SLQTFGQETDAAVDFAHTAFAVKIVAVFAAVAVACRPVDDLDDFGAFFIDQLIKLVFQCL
                  130       140       150       160       170       180

                  190      199
m677.pep   PSGGRNVVFGFGTHIVCGX
           |||||||||||||||||||
g677       PSGGRNVVFGFGTHIVCGX
                  190
```

The following partial DNA sequence was identified in *N. meningitidis* <SEQ ID 2229>:

a677.seq

```
  1 ATGCCGCAGA TTTTGGTGCG GATTTTCCTC ATTCGGTATT CCTTTATTTG
 51 GGAAACGGCG CGTTTGTGCC GTTTCAGACG GCATTCCCGA TCAGTCGATT
101 TTGATGTATT CGACAGAAAG GATTTCAATT TCCTCACGCC CTTCCGGCGT
151 GTTTAAAACC ACTTCGTCGC CTTCACGCGC TTTAATCAGA CAACGAGCCA
201 GCGGCGAAAT CCAAGAAATT TTGTTTTGCG CGGTATCGAT TTCATCGATG
251 CCGACGATTT TGACGGTTTG CTCGCGCCCG TCGCCGCGCA ACAGACCGAC
301 GGTCGCGCCG AAAAACACTT GGTCGGTCGC TTCGCGCAAT TCGGGATCAA
351 CGACGACGGC GGCTTCCAAA CGCTTGGTCA GGAAACGGAT GCGGCGGTCG
401 ATTTCGCGCA TACGGCGTTT GCCGTAAAGG TAGTCGCCGT TTTCGCTGCG
451 GTCGCCGTTG CCTGCCGCCC AGTTGACGAT TTGGACGATT TCGGGGCGTT
501 CTTTATTAAC CAGTTGATAA AGCTCGTCTT TCAATGCCTG CCATCCGGCG
551 GGCGTAATGT AGTTTTTGGT TTCGGTACTC ATATTGTGTG CGGATGA
```

This corresponds to the amino acid sequence <SEQ ID 2230; ORF 677.a>:

a677.pep

```
  1 MPQILVRIFL IRYSFIWETA RLCRFRRHSR SVDFDVFDRK DFNFLTPFRR

 51 V*NHFVAFTR FNQTTSQRRN PRNFVLRGID FIDADDFDGL LAPVAAQQTD

101 GRAEKHLVGR FAQFGINDDG GFQTLGQETD AAVDFAHTAF AVKVVAVFAA

151 VAVACRPVDD LDDFGAFFIN QLIKLVFQCL PSGGRNVVFG FGTHIVCG*
```

m677/a677 93.4% identity in 198 aa overlap

```
                    10        20        30        40        50        60
m677.pep    MPQILVRIFLIRYSFIWETARFCRFRRHSRSVDFDVFDRKDFNFLTPFRRVQNHFVAFAR
            |||||||||||||||||||||:||||||||||||||||||||||||||||| ||||||:|
a677        MPQILVRIFLIRYSFIWETARLCRFRRHSRSVDFDVFDRKDFNFLTPFRRVXNHFVAFTR
                    10        20        30        40        50        60

                    70        80        90       100       110       120
m677.pep    FNQTTSQRRNPRNFVLRGIDFIDADDFDGLLAPVVAQQSDRRAEKHLVGRFAQFGIDDDG
            ||||||||||||||||||||||||||||||||||:|||:| |||||||||||||||:|||
a677        FNQTTSQRRNPRNFVLRGIDFIDADDFDGLLAPVAAQQTDGRAEKHLVGRFAQFGINDDG
                    70        80        90       100       110       120

                   130       140       150       160       170       180
m677.pep    SLQTFGQETDAAVDFAHTAFAVKIVAVFAAVAVACRPVDDLDDFGAFFVDQLIKLVFQCL
            ::||:||||||||||||||||||:||||||||||||||||||||||||::||||||||||
a677        GFQTLGQETDAAVDFAHTAFAVKVVAVFAAVAVACRPVDDLDDFGAFFINQLIKLVFQCL
                   130       140       150       160       170       180

                   190       199
m677.pep    PSGGRNVVFGFGTHIVCGX
            ||||||||||||||||||
a677        PSGGRNVVFGFGTHIVCGX
                   190
```

The following partial DNA sequence was identified in *N. gonorrhoeae* <SEQ ID 2231>:

g678.seq

```
  1 ATGAATAGCC TCCCCATTGC CGACCTCCTC GCCTccgCCG TCATCGCCGC

 51 CTGCATCGTC ATTTCCACGA TGCGCGGCGT GATTGCGGAA GCAggttcGA

101 TGGTgGCATG ggtggTTTcc tTCTTTTttg ccAAACTCTt tGCCGCACcc

151 ttcgccgACC TCGCCTTTGc ctCGTTCCAA ccccgccTGT TTGCAttggc

201 tCTGTCATTC ATTTCCCTGT TCGTCATTGC CTGTCTGATC CAGAAAATGC

251 TCCGTTCGCT GCTGACCGGC GCAGTTTCGG CGGTCGGTCT GGGCTTTGCC

301 AACCGCATTT TGGGCGGTGT ATTCGGTGCA TTGAAAGGCG TTTTGATTGT

351 TACCCTGCTG ATCATGCTTG CTTCAAAAAC CGACCTGCCC GATACCGAAG

401 AATGGCAACA GTCCTATACC GTACCGTTTT TCGTATCGCT TTCCGAAGCG

451 GTGTTAAACC atacggaCAA CGCacccgaa tCCCtcgacg acgactaa
```

This corresponds to the amino acid sequence <SEQ ID 2232; ORF 678.ng>:

g678.pep

```
  1 MNSLPIADLL ASAVIAACIV ISTMRGVIAE AGSMVAWVVS FFFAKLFAAP

 51 FADLAFASFQ PRLFALALSF ISLFVIACLI QKMLRSLLTG AVSAVGLGFA

101 NRILGGVFGA LKGVLIVTLL IMLASKTDLP DTEEWQQSYT VPFFVSLSEA

151 VLNHTDNAPE SLDDD*
```

The following partial DNA sequence was identified in *N. meningitidis* <SEQ ID 2233>:

m678.seq

```
  1 ATGAATAGCC TCCCCATTGC CGACCTCCTC GTCTCCGCCG TCATCGCCGC
 51 CTGCATCGTG CTATCCGCGA TGCGCGGCGT GATTGCGGAG GCAGGCTCAA
101 TGGCGGCATG GGTGGTTTCC TTCTTTTTCG CCAAACTCTT TGCCGCCTCC
151 TTCGCCGACC TCGCCTTTGC CTCGTTCCAA CCCCGCCTGT TTGCATTGGC
201 TCTGTCGTTC ATTTCCCTGT TCGTCATTGC CTGTCTGATC CAGAAAATGC
251 TCCGTTCGCT GCTGACCAGC GCAGTTTCGG CGGTCGGTTT GGGCTTTGCC
301 AACCGCATTT TGGGCGGCGT ATTCGGTGCA TTGAAAGGCG TTTTGATTGT
351 TACCCTGCTG GTCATGCTTG CTTCAAAAAC CGACCTGCCC GATACCGAAG
401 AATGGCGGCA ATCTTACACA CTGCCGTTTT TCGTATCGCT TTCCGAAGCC
451 GTGTTGAACC ATAGCGGCGG CACGGCGGAA ACTCCGGAAG ACGATTGA
```

This corresponds to the amino acid sequence <SEQ ID 2234; ORF 678>:

m678.pep

```
  1 MNSLPIADLL VSAVIAACIV LSAMRGVIAE AGSMAAWVVS FFFAKLFAAS
 51 FADLAFASFQ PRLFALALSF ISLFVIACLI QKMLRSLLTS AVSAVGLGFA
101 NRILGGVFGA LKGVLIVTLL VMLASKTDLP DTEEWRQSYT LPFFVSLSEA
151 VLNHSGGTAE TPEDD*
```

Computer analysis of this amino acid sequence gave the following results:

Homology with a predicted ORF from *N. gonorrhoeae* m678/g678 89.7% identity in 165 aa overlap

```
                   10        20        30        40        50        60
m678.pep   MNSLPIADLLVSAVIAACIVLSAMRGVIAEAGSMAAWVVSFFFAKLFAASFADLAFASFQ
           ||||||||||:|||||||||:|:|||||||||||:||||||||||||||| |||||||||
g678       MNSLPIADLLASAVIAACIVISTMRGVIAEAGSMVAWVVSFFFAKLFAAPFADLAFASFQ
                   10        20        30        40        50        60

                   70        80        90       100       110       120
m678.pep   PRLFALALSFISLFVIACLIQKMLRSLLTSAVSAVGLGFANRILGGVFGALKGVLIVTLL
           |||||||||||||||||||||||||||||:||||||||||||||||||||||||||||||
g678       PRLFALALSFISLFVIACLIQKMLRSLLTGAVSAVGLGFANRILGGVFGALKGVLIVTLL
                   70        80        90       100       110       120

                  130       140       150       160
m678.pep   VMLASKTDLPDTEEWRQSYTLPFFVSLSEAVLNHSGGTAETPEDDX
           :||||||||||||||:||||:|||||||||||||| :: |: :|||
g678       VMLASKTDLPDTEEWQQSYTVPFFVSLSEAVLNHTDNAPESLDDDX
                  130       140       150       160
```

The following partial DNA sequence was identified in *N. meningitidis* <SEQ ID 2235>:

a678.seq

```
  1 ATGAATAACC TCCCCGTTGC CGACCTCCTC GTCTCCGCCA TCATCGCCGC
 51 CTGCATCGTG CTATCCGCGA TGCGCGGCGT GATTGCGGAG GCTGGCTCAA
101 TGGCGGCATG GGTGGTTGCC TTTTTTTTCG CCAAACTCTT TGCCGCACCC
```

-continued

```
151 TTCGCCGACA TCGCCTTTGC ATCGTTCCAA CCCCGCCTGT TTGCATTGGC

201 TCTGTCGTTC ATTTCCCTAT TCGTCATTGC CTGTCTGATC CAGAAAATAC

251 TCCGCTCGCT GCTGACCGGG GCAGTTTCGG CGGTCGGTTT GGGCTTTGCC

301 AACCGCATTT TGGGCGGCGT ATTCGGTGCA TTGAAAGGCA TTTTGATTAT

351 TACCCTGCTG GTCATGCTCG CTTCAAAAAC CGACCTGCCC GATACCGAAG

401 AATGGCGGCA ATCTTACACA CTGCCGTTTT TCGTATCGCT TTCCGAAGCC

451 GTGTTGAACC ATAGCGGCGG CACGGCGGAA ACTCCGGAAG ACGATTGA
```

This corresponds to the amino acid sequence <SEQ ID 2236; ORF 678.a>:

a678.pep

```
  1 MNNLPVADLL VSAIIAACIV LSAMRGVIAE AGSMAAWVVA FFFAKLFAAP

 51 FADIAFASFQ PRL
MNNLPVADLL VSAIIAACIV LSAMRGVIAE AGSMAAWVVA FFFAKLFAFALALSF ISLFVIACLI
MNNLPVADLL VSAIIAACIV LSAMRGVIAE AGSMAAWVVA FFFAKLFA QKILRSLLTG
AVSAVGLGFA

101 NRILGGVFGA LKGILIITLL VMLASKTDLP DTEEWRQSYT LPFFVSLSEA

151 VLNHSGGTAE TPEDD*
```

m678/a678 93.9% identity in 165 aa overlap

```
                    10        20        30        40        50        60
m678.pep    MNSLPIADLLVSAVIAACIVLSAMRGVIAEAGSMAAWVVSFFFAKLFAASFADLAFASFQ
            ||:||:|||||||:|||||||||||||||||||||||||:||||||||| |||:||||||
a678        MNNLPVADLLVSAIIAACIVLSAMRGVIAEAGSMAAWVVAFFFAKLFAAPFADIAFASFQ
                    10        20        30        40        50        60

                    70        80        90       100       110       120
m678.pep    PRLFALALSFISLFVIACLIQKMLRSLLTSAVSAVGLGFANRILGGVFGALKGVLIVTLL
            ||||||||||||||||||||||:||||||:|||||||||||||||||||||||:||:|||
a678        PRLFALALSFISLFVIACLIQKILRSLLTGAVSAVGLGFANRILGGVFGALKGILIITLL
                    70        80        90       100       110       120

                   130       140       150       160
m678.pep    VMLASKTDLPDTEEWRQSYTLPFFVSLSEAVLNHSGGTAETPEDDX
            |||||||||||||||||||||||||||||||||||||||||||||
a678        VMLASKTDLPDTEEWRQSYTLPFFVSLSEAVLNHSGGTAETPEDDX
                   130       140       150       160
```

The following partial DNA sequence was identified in *N. gonorrhoeae* <SEQ ID 2237>:

g680.seq

```
  1 ATGACGAAGG GCAGTTCGGC GATGTCCAGC CCACGCGCGG CGATATCGGT

 51 GGCGACGAGG ACGCGCAGGC TGCCGTCTTT GAAGGCGTTG AGTGTTTCGA

101 GCCTGCTTTG TTGGGAACGG TCGCCGTGTA TCGCCTGTGC GGACAGGTTG

151 CGGCGCACCA GTTCGCGCGT TACGCGGTCG ACGCTTTGTT TGGTtttgCA

201 AAAGACGATA ACTTGGTTCA TATGCAGATC GACAATCAGC CGTTCGAGCA

251 GGTTGCGCTT TTGGAAGGTA TCGACGGCGA TGATGTgttg ttcGACGTTG

301 GCGTTGGTGG TGTTTTGGGC GGCAACCTCG ACGGTTTCGG GCGCGTTCAT

351 GAAGTCTTGC GCCAGTTTGC GTATCGGTGC GGAGAAGGTG GCGGAAAAGA
```

-continued

```
401 GCAGGGTTTG GCGTTGGCGG GGCAGCATCT GCATGATTTT GCGGATGTCG
451 TCGATAAACC CCATATCCAA CATGCGGTCT GCTTCGTCCA GAACGACGAT
501 TTCGGCTTTG TTTAAACTGA TGTTTTTCTG TTTCACATGG TCGAGCAGCC
551 GTCCGACGGT GGCGACGACT ATTTCGCAGC CGGCACGCAG GTCGGCGGTT
601 TGTTTGTCCA TGTTGACACC GCCGAAGAGG ACGGTATGCC GCAGCGGCAG
651 GTTTTTAATg tag
```

This corresponds to the amino acid sequence <SEQ ID 2238; ORF 680.ng>:

g680.pep

```
  1 MTKGSSAMSS PRAAISVATR TRRLPSLKAL SVSSLLCWER SPCIACADRL
 51 RRTSSRVTRS TLCLVLQKTI TWFICRSTIS RSSRLRFWKV STAMMCCSTL
101 ALVVFWAATS TVSGAFMKSC ASLRIGAEKV AEKSRVWRWR GSICMILRMS
151 SINPISNMRS ASSRTTISAL FKLMFFCFTW SSSRPTVATT ISQPARRSAV
201 CLSMLTPPKR TVCRSGRFLM *
```

The following partial DNA sequence was identified in *N. meningitidis* <SEQ ID 2239>:

m680.seq

```
  1 ATGACGAAGG GCAGTTCGGC AATGTCCAGC CCGCGCGCGG CGATGTCGGT
 51 GGCGACGAGG ACGCGCAGGT TGCCGTCTTT GAAGGCGTTG AGTGTTTCGA
101 GCCGGCTTTG TTGGGAACGG TCGCCGTGTA TCGCCTGTGC GGACAGGTTG
151 CGGCGCACCA GTTCGCGCGT TACGCGGTCG ACGCTTTGTT TGGTTTTGCA
201 GAACACGATG ACCTGGTTCA TATGCAAATC GACAATCAGC CGTTCGAGCA
251 GGTTGCGCTT CTGAATGGTA TCGACGGCGA TGATGTGCTG CTCGACGTTG
301 GCGTTGGTGG TGTTTTGCGC GGCGACTTCG ACGGTTTCGG GCGCGTTCAT
351 GAAGTCTTGC GCCAGTTTGC GTATCGGGGC GGAGAAGGTG GCGGAAAAGA
401 GCAGGGTTTG GCGTTGGCGG GGCAGCATCT GCATGATTTT GCGGATGTCG
451 TCGATAAAAC CCATATCCAG CATACGGTCG GCTTCGTCCA AAACGACGAT
501 TTCGACTTTG TTCAAATGGA TGTTTTTCTG TTTCACGTGG TCGAGCAGCC
551 GTCCGACGGT GGCGACGACG ATTTCGCAGC CGGCACGCAG GTCGGCGGTC
601 TGTTTGTCCA TATTCATACC GCCGAACAAG ACGGTGTGGC GCAGCGGCAG
651 GTTTTTGATG TAG
```

This corresponds to the amino acid sequence <SEQ ID 2240; ORF 680>:

m680.pep

```
  1 MTKGSSAMSS PRAAMSVATR TRRLPSLKAL SVSSRLCWER SPCIACADRL
 51 RRTSSRVTRS TLCLVLQNTM TWFICKSTIS RSSRLRF*MV STAMMCCSTL
```

-continued

```
101 ALVVFCAATS TVSGAFMKSC ASLRIGAEKV AEKSRVWRWR GSICMILRMS

151 SIKPISSIRS ASSKTTISTL FKWMFFCFTW SSSRPTVATT ISQPARRSAV

201 CLSIFIPPNK TVWRSGRFLM *
```

Computer analysis of this amino acid sequence gave the following results:

Homology with a predicted ORF from *N. gonorrhoeae* m680/g680 90.9% identity in 220 aa overlap

```
                   10        20        30        40        50        60
m680.pep   MTKGSSAMSSPRAAMSVATRTRRLPSLKALSVSSRLCWERSPCIACADRLRRTSSRVTRS
           ||||||||||||||:||||||||||||||||||||| ||||||||||||||||||||||||
g680       MTKGSSAMSSPRAAISVATRTRRLPSLKALSVSSLLCWERSPCIACADRLRRTSSRVTRS
                   10        20        30        40        50        60

                   70        80        90       100       110       120
m680.pep   TLCLVLQNTMTWFICKSTISRSSRLRFXMVSTAMMCCSTLALVVFCAATSTVSGAFMKSC
           |||||||:|:|||||:|||||||||||  ||||||||||||||||| |||||||||||||
g680       TLCLVLQKTITWFICRSTISRSSRLRFWKVSTAMMCCSTLALVVFWAATSTVSGAFMKSC
                   70        80        90       100       110       120

                  130       140       150       160       170       180
m680.pep   ASLRIGAEKVAEKSRVWRWRGSICMILRMSSIKPISSIRSASSKTTISTLFKWMFFCFTW
           ||||||||||||||||||||||||||||||||:|||::|||||:||||:||| |||||||
g680       ASLRIGAEKVAEKSRVWRWRGSICMILRMSSINPISNMRSASSRTTISALFKLMFFCFTW
                  130       140       150       160       170       180

                  190       200       210       220
m680.pep   SSSRPTVATTISQPARRSAVCLSIFIPPNKTVWRSGRFLMX
           ||||||||||||||||||||||:: ||::|| ||||||||
g680       SSSRPTVATTISQPARRSAVCLSMLTPPKRTVCRSGRFLMX
                  190       200       210       220
```

The following partial DNA sequence was identified in *N. meningitidis* <SEQ ID 2241>:

a680.seq

```
  1 ATGACGAAGG GCAGTTCGGC AATATCCAGC CCCCGCGCGG CGATATCGGT

 51 GGCGACGAGG ACGCGCAGGT TGCCGTCTTT GAAGGCGTTG AGTGTTTCGA

101 GCCGGCTTTG TTGGGAACGG TCGCCGTGTA TCGCCTGTGC GGACAGGTTG

151 CGGCGCACCA GTTCGCGCGT TACGCGGTCG ACGCTTTGTT TGGTTTTGCA

201 GAACACGATG ACCTGGTTCA TATGCAAATC GACAATCAGC CGTTCGAGCA

251 GGTTGCGCTT CTGAATGGTA TCGACGGCGA TGATGTGCTG CTCGACGTTG

301 GCGTTGGTGG TGTCTTGCGC GGCGACTTCG ACGGTTTCGG GCGCGTTCAT

351 GAAGTCTTGC GCCAGTTTGC GTATCGGGGC GGAGAAGGTG GCGGAAAAGA

401 GCAGGGTTTG GCGTTGGCGG GGCAGCATCT GCATGATTTT GCGGATGTCG

451 TCGATAAAAC CCATATCCAG CATACGGTCG GCTTCGTCCA AAACGACGAT

501 TTCGACTTTG TTCAAATGGA TGTTTTTCTG TTTCACGTGG TCGAGCAGCC

551 GTCCGACGGT GGCGACGACG ATTTCGCAGC CGGCACGCAG GTCGGCGGTC

601 TGTTTGTCCA TATTCATACC GCCGAACAAG ACGGTGTGGC GCAGCGGCAG

651 GTTTTTGATG TAG
```

This corresponds to the amino acid sequence <SEQ ID 2242; ORF 680.a>:

a680.pep

```
  1 MTKGSSAISS PRAAISVATR TRRLPSLKAL SVSSRLCWER SPCIACADRL
```

-continued

```
 51 RRTSSRVTRS TLCLVLQNTM TWFICKSTIS RSSRLRF*MV STAMMCCSTL

101 ALVVSCAATS TVSGAFMKSC ASLRIGAEKV AEKSRVWRWR GSICMILRMS

151 SIKPISSIRS ASSKTTISTL FKWMFFCFTW SSSRPTVATT ISQPARRSAV

201 CLSIFIPPNK TVWRSGRFLM *
```

m680/a680 98.6% identity in 220 aa overlap

```
                 10        20        30        40        50        60
m680.pep  MTKGSSAMSSPRAAMSVATRTRRLPSLKALSVSSRLCWERSPCIACADRLRRTSSRVTRS
          |||||||:||||||:|||||||||||||||||||||||||||||||||||||||||||||
a680      MTKGSSAISSPRAAISVATRTRRLPSLKALSVSSRLCWERSPCIACADRLRRTSSRVTRS
                 10        20        30        40        50        60

                 70        80        90       100       110       120
m680.pep  TLCLVLQNTMTWFICKSTISRSSRLRFXMVSTAMMCCSTLALVVFCAATSTVSGAFMKSC
          |||||||||||||||||||||||||||||||||||||||||||||| ||||||||||||||
a680      TLCLVLQNTMTWFICKSTISRSSRLRFXMVSTAMMCCSTLALVVSCAATSTVSGAFMKSC
                 70        80        90       100       110       120

                130       140       150       160       170       180
m680.pep  ASLRIGAEKVAEKSRVWRWRGSICMILRMSSIKPISSIRSASSKTTISTLFKWMFFCFTW
          ||||||||||||||||||||||||||||||||||||||||||||||||||||||||||||
a680      ASLRIGAEKVAEKSRVWRWRGSICMILRMSSIKPISSIRSASSKTTISTLFKWMFFCFTW
                130       140       150       160       170       180

                190       200       210       220
m680.pep  SSSRPTVATTISQPARRSAVCLSIFIPPNKTVWRSGRFLMX
          ||||||||||||||||||||||||||||||||||||||||
a680      SSSRPTVATTISQPARRSAVCLSIFIPPNKTVWRSGRFLMX
                190       200       210       220
```

The following partial DNA sequence was identified in *N. gonorrhoeae* <SEQ ID 2243>:

g681.seq

```
  1 ATGACGACGC CGATGGCAAT CAGTGCGTCA AATTTTTCGG AAGAGGCAAA

 51 GTTCATCAGC GCGATGGGGA TTTCAAGCGC GCCGGGTACG GTGGcgacgg

101 tgatgtTTTC GTCTGCTACG CCCAATTCTT GGAGGGTGCG GCAGCAGACT

151 TTGAGCATTT GGCTGCCGAT TTCGTTGGTG AAGCGTGCCT GTACGATGCC

201 GATGCGGAGG TGTTTGCcgt cgaggttgGG GGCGATGGTG TTCATTGGGT

251 GTCCTTTGGT ATTCGGGGTT TCGGAATGCC GTCTGAAGGT TTCAGTCTTG

301 CGGCTGCCAG TCGGCAACGG TTTGGAATGT GCCGTCTTCG GCAAGCTCCC

351 ACGCGCTGCC TTCGGGTTGG GAAAGCAGTG CGGCGGTTTC AGGGTTGGTT

401 TTGGTGATGT CGGCGAGGCT GACGATGCTG AAGTTGTCGG GGTCGTCGGT

451 GTATTCGTCG GTTTCGTCGC CGCTGAAGAA ACGCCAGCCG CTGTCGTTTT

501 CAAAAACGGG GGCTTCGCGG TAAAGGAAGC CGACGGGCCG GTTTTGTTTG

551 GCGACGGTGT TGGTGGCGAT GCAGCGGTCG AGTGCCGAGG AAAGTGCTTG

601 TGCAAATGCG TTCATTGCGG GAATACGTTG GGGGGGGGGA AACTTGCGGA

651 TTTTACCACG ATTCCCGCGT TGTCGGCAGA CGGCGGCGGT TTGGTGGTAC

701 AATGTGCGCC GTTTGCAGCC TTAAGGTGTT TCTGTATTTT TGGAGTATGG

751 AAACGCATTC GGGCTGTTTT TTGCGGAAGA CGGTAA
```

This corresponds to the amino acid sequence <SEQ ID 2244; ORF 681>:

g681.pep

```
  1 MTTPMAISAS NFSEEAKFIS AMGISSAPGT VATVMFSSAT PNSWRVRQQT
 51 LSIWLPISLV KRACTMPMRR CLPSRLGAMV FIGCPLVFGV SECRLKVSVL
101 RLPVGNGLEC AVFGKLPRAA FGLGKQCGGF RVGFGDVGEA DDAEVVGVVG
151 VFVGFVAAEE TPAAVVFKNG GFAVKEADGP VLFGDGVGGD AAVECRGKCL
201 CKCVHCGNTL GGGKLADFTT IPALSADGGG LVVQCAPFAA LRCFCIFGVW
251 KRIRAVFCGR R*
```

The following partial DNA sequence was identified in *N. meningitidis* <SEQ ID 2245>:

m681.seq

```
  1 ATGACGACGC CGATGGCAAT CAGTGCGTCA AACTTTTCGG AAGAGGCAAA
 51 GTTCATCAGC GCGATGGGGA TTTCAAGCGC GCCGGGTACG GTGGCGACGG
101 TAATGTTTTC GTCTGCCACG CCCAATTCTT GGAGGGTGCG GCAGCAGACT
151 TTGAGCATTT CGCTGCCGAT TTCGTTGGTG AAGCGTGCCT GTACGATGCC
201 GATGCGGAGG TGTTTGCCGT CGAGGTTGGG GGCGATGGTG TTCATTGGGT
251 GTCCTTTGGT ATTCGGAGTT TCGGAATGCC GTCTGAAGGT TTCAGTCTTG
301 CGGCTGCCAG TCGGCGACGG TTTGGAATGT GCCGTCTTCG GCAAGCTCCC
351 ATGCGCTGCC TTCGGGTTGG GAGAGCAGTG CGGCGGTTTC AGGGTTGGTT
401 TTGGCGATGT CGGCGAGGCT GACGATGCTG AAGTTGTCCG GATCGTCGGT
451 GTATTCGTCG GTCTCGTCGC CGCTGAAGAA ACGCCAGCCG CTGTCGTTTT
501 CAAAAACGGG GGCTTCGCGG TAGAGGAAGC CGACGGGCCG GTTTTGTTTG
551 GCGACGGTGT TGGTGGCGAT ACAGCGGTCG AGTGCCGAGG AAAGTGCTTG
601 TGCAAATGCG TTCATTACGG GAATACGTTG GGGG.AAAAC TTACGGATTT
651 TACCACGATT CGTGCGTTGT CGGCAGACGG CGGCGGTTTG GTGGTACAAT
701 GTGCGCCGTT TGCAGCCTTA AGGTGTTTCT GTATTTTTGG AGTATGGAAA
751 CGCATTCGGG CTGTTTTTTG CGGAAGACGG TAA
```

This corresponds to the amino acid sequence <SEQ ID 2246; ORF 681>:

m681.pep

```
  1 MTTPMAISAS NFSEEAKFIS AMGISSAPGT VATVMFSSAT PNSWRVRQQT
 51 LSISLPISLV KRACTMPMRR CLPSRLGAMV FIGCPLVFGV SECRLKVSVL
101 RLPVGDGLEC AVFGKLPCAA FGLGEQCGGF RVGFGDVGEA DDAEVVRIVG
151 VFVGLVAAEE TPAAVVFKNG GFAVEEADGP VLFGDGVGGD TAVECRGKCL
201 CKCVHYGNTL GXKLTDFTTI RALSADGGGL VVQCAPFAAL RCFCIFGVWK
251 RIRAVFCGRR *
```

Computer analysis of the amino acid sequences gave the following results:

Homology with a predicted ORF from *N. meningitidis* menA with menB

ORF 681 shows 94.6% identity over a 261 aa overlap with a predicted ORF (ORF681.a) from *N. gonorrhoeae*:

```
m681/g681

                      10        20        30        40        50        60
m681.pep      MTTPMAISASNFSEEAKFISAMGISSAPGTVATVMFSSATPNSWRVRQQTLSISLPISLV
              ||||||||||||||||||||||||||||||||||||||||||||||||||||| ||||||
g681          MTTPMAISASNFSEEAKFISAMGISSAPGTVATVMFSSATPNSWRVRQQTLSIWLPISLV
                      10        20        30        40        50        60

                      70        80        90       100       110       120
m681.pep      KRACTMPMRRCLPSRLGAMVFIGCPLVFGVSECRLKVSVLRLPVGDGLECAVFGKLPCAA
              |||||||||||||||||||||||||||||||||||||||||||||:||||||||||| ||
g681          KRACTMPMRRCLPSRLGAMVFIGCPLVFGVSECRLKVSVLRLPVGNGLECAVFGKLPRAA
                      70        80        90       100       110       120

                     130       140       150       160       170       180
m681.pep      FGLGEQCGGFRVGFGDVGEADDAEVVRIVGVFVGLVAAEETPAAVVFKNGGFAVEEADGP
              ||||:||||||||||||||||||||| :||||||:|||||||||||||||||||:|||||
g681          FGLGKQCGGFRVGFGDVGEADDAEVVGVVGVFVGFVAAEETPAAVVFKNGGFAVKEADGP
                     130       140       150       160       170       180

                     190       200       210        220       230      239
m681.pep      VLFGDGVGGDTAVECRGKCLCKCVHYGNTLGX-KLTDFTTIRALSADGGGLVVQCAPFAA
              ||||||||||:|||||||||||||| |||||  ||:||||| ||||||||||||||||||
g681          VLFGDGVGGDAAVECRGKCLCKCVHCGNTLGGGKLADFTTIPALSADGGGLVVQCAPFAA
                     190       200       210       220       230       240

            240       250       260
m681.pep      LRCFCIFGVWKRIRAVFCGRRX
              |||||||||||||||||||||
g681          LRCFCIFGVWKRIRAVFCGRRX
                     250       260
```

The following partial DNA sequence was identified in *N. meningitidis* <SEQ ID 2247>:

```
a681.seq

  1 ATAACGACGC CGATGGCAAT CAGTGCGTCA AATTTTTCAG AAGAGGCAAA
 51 GTTCATCAGC GCGATGGGGA TTTCAAGCGC GCCGGGTACG GTGGCGACGG
101 TAATGTTTTC GTCTGCCACG CCCAATTCTT GGAGGGTGCG GCAGCAGACT
151 TTGAGCATTT CGCTGCCGAT TTCGTTGGTG AAGCGTGCCT GTACGATGCC
201 GATGCGGAGG TGTTTGCCGT CGAGGTTGGG GGCGATGGTG TTCATTGAGT
251 GTCCTTTGGT ATTCGGAGGT TTCGGAATGC CGTCTGAAGG GTCAGTCCTT
301 AGGTTGCCAG TCGGCGACGG TTTGGAATGT GCCGTCTTCT GCCAATTCCC
351 ACGCGCTGCC TTCAGGTTGG GAGAGCAGTG CGGCGGTTTC AGGGTTGGTT
401 TTGGTGATAT CGGCGAGGCT GACGATGCTG AAGTTGTCCG GGTCGTCGGT
451 GTATTCGTCG GTCTCGTCGC CGCTGAAGAA ACGCCAGCCG CTGTCGTTTT
501 CAAAAACGGG GGCTTCGCGG TAGAGGAAGC CGACGGGCTG GTTTTGTTTG
551 GCGACGGTGT TGGTGGCGAT GCAGCGGTCG AGTGCCGAGG AAAGTGCTTG
601 TGCAAATGCG TTCATTGCGG GAATACGTT. GGGGGAAAAC TTGCGGATTT
651 TACCACGATT CTTGCGTTGT CGGCAGACGG CGGCGGTTTG GTGGTACAAT
701 GTGCGCCGTT TGCAGCCTTA AGGTGTTTCT GTATTTTTGG AGTATGGAAA
751 CGCATTCGGG CTGTTTTTTG CGGAAGACGG TAA
```

This corresponds to the amino acid sequence <SEQ ID 2248; ORF 681.a>:

a681.pep

```
  1 ITTPMAISAS NFSEEAKFIS AMGISSAPGT VATVMFSSAT PNSWRVRQQT
 51 LSISLPISLV KRACTMPMRR CLPSRLGAMV FIECPLVFGG FGMPSEGSVL
101 RLPVGDGLEC AVFCQFPRAA FRLGEQCGGF RVGFGDIGEA DDAEVVRVVG
151 VFVGLVAAEE TPAAVVFKNG GFAVEEADGL VLFGDGVGGD AAVECRGKCL
201 CKCVHCGNTX GGKLADFTTI LALSADGGGL VVQCAPFAAL RCFCIFGVWK
251 RIRAVFCGRR *
```

m681/a681 90.8% identity in 260 aa overlap

```
                   10        20        30        40        50        60
m681.pep   MTTPMAISASNFSEEAKFISAMGISSAPGTVATVMFSSATPNSWRVRQQTLSISLPISLV
           :|||||||||||||||||||||||||||||||||||||||||||||||||||||||||||
a681       ITTPMAISASNFSEEAKFISAMGISSAPGTVATVMFSSATPNSWRVRQQTLSISLPISLV
                   10        20        30        40        50        60

                   70        80        90       100       110       120
m681.pep   KRACTMPMRRCLPSRLGAMVFIGCPLVFGVSECRLKVSVLRLPVGDGLECAVFGKLPCAA
           |||||||||||||||||||||| ||||||      : |||||||||||||||| ::| ||
a681       KRACTMPMRRCLPSRLGAMVFIECPLVFGGFGMPSEGSVLRLPVGDGLECAVFCQFPRAA
                   70        80        90       100       110       120

                  130       140       150       160       170       180
m681.pep   FGLGEQCGGFRVGFGDVGEADDAEVVRIVGVFVGLVAAEETPAAVVFKNGGFAVEEADGP
           | ||||||||||||||:||||||||||:||||||||||||||||||||||||||||||| 
a681       FRLGEQCGGFRVGFGDIGEADDAEVVRVVGVFVGLVAAEETPAAVVFKNGGFAVEEADGL
                  130       140       150       160       170       180

                  190       200       210       220       230       240
m681.pep   VLFGDGVGGDTAVECRGKCLCKCVHYGNTLGXKLTDFTTIRALSADGGGLVVQCAPFAAL
           ||||||||||:|||||||||||||| ||| | ||:||||| |||||||||||||||||||
a681       VLFGDGVGGDAAVECRGKCLCKCVHCGNTXGGKLADFTTILALSADGGGLVVQCAPFAAL
                  190       200       210       220       230       240

                  250       260
m681.pep   RCFCIFGVWKRIRAVFCGRRX
           ||||||||||||||||||||
a681       RCFCIFGVWKRIRAVFCGRRX
                  250       260
```

The following partial DNA sequence was identified in *N. gonorrhoeae* <SEQ ID 2249>:

g682.seq

```
  1 ATGCGCGATT TCGCCGTATG GGTGCCTTAC GGGGAACGGC GGAAAAATTG
 51 GGACATAAGG TATTGCCTCC CGCACCTTAT TCGCCTGAGC CCAACCCGAT
101 TGAGAAAGTG TGGGCGAATA TTAAGCGGTA TCTGCGAACC GTTTTGTCTG
151 ATTACGCCCG ATTTGACGAT GCACTACTGT CCTATTTTGA TTTTAATTGA
201 CTATATTTGT GTGAATGATG AAATAAAAAT GCCGTCTGAA CCCGATTGGA
251 TTCAGACGGC ATTTTGTATG GCAGGATTTA TTCGCTTTCC AACTGACCGA
301 CCCATTCTGA CAAGGCAGTC AGGCGTTGTT CGGATTTCGC CACGAACGGG
351 TTTTCGGTAT CCCACGCGTA GCCTGCCAAA ATCGAAGAAA GCATACGGCT
401 GA
```

This corresponds to the amino acid sequence <SEQ ID 2250; ORF 682>:

g682.pep

```
  1 MRDFAVWVPY GERRKNWDIR YCLPHLIRLS PTRLRKCGRI LSGICEPFCL
 51 ITPDLTMHYC PILILIDYIC VNDEIKMPSE PDWIQTAFCM AGFIRFPTDR
101 PILTRQSGVV RISPRTGFRY PTRSLPKSKK AYG*
```

The following partial DNA sequence was identified in *N. meningitidis* <SEQ ID 2251>:

m682.seq

```
  1 ATGCGTGATT TCACCGTATG GGTGTCTTAC GGGAAATGGC GGAAAAATTG
 51 GGACATAAGG TATTGCCTCT TGCACCTTAT TCACCTGAGC TCAACCCGAT
101 TGAGAAAGTG TGGGCGAATA TTAAGCGGTA TCTGCGAACC GTTTTGTCTG
151 ATTACGCCCG ATTTGACGAT GCACTACTGT CCTATTTTGA TTTTAATTGA
201 CTAT...... ......GAAA TGGCAATGCC GTCTGAACCC GATTGGATTC
251 AGACGGCATT TTGTATGGCG TACGGATTTA TTCGGTTTCC AACTGACCGA
301 CCCATTCGGA CAAGGCAGTC AGGCGTTGTT CGGATTTCGC CACGAACGGG
351 TTTTCGGTAT CCCACGCGTA GCCTGCCAAA ATCGAAGAAA GCATACGGCT
401 GA
```

This corresponds to the amino acid sequence <SEQ ID 2252; ORF 682>:

m682.pep

```
  1 MRDFTVWVSY GKWRKNWDIR YCLLHLIHLS STRLRKCGRI LSGICEPFCL
 51 ITPDLTMHYC PILILIDY.. ..EMAMPSEP DWIQTAFCMA YGFIRFPTDR
101 PIRTRQSGVV RISPRTGFRY PTRSLPKSKK AYG*
```

Computer analysis of the amino acid sequences gave the following results:

Homology with a predicted ORF from *N. meningitidis* menA with menB

ORF 682 shows 88.1% identity over a 134 aa overlap with a predicted ORF (ORF682.a) from *N. gonorrhoeae*:

m682/g682

```
                   10        20        30        40        50        60
m682.pep    MRDFTVWVSYGKWRKNWDIRYCLLHLIHLSSTRLRKCGRILSGICEPFCLITPDLTMHYC
            ||||:||| ||: ||||||||| |||:|| ||||||||||||||||||||||||||||||
g682        MRDFAVWVPYGERRKNWDIRYCLPHLIRLSPTRLRKCGRILSGICEPFCLITPDLTMHYC
                   10        20        30        40        50        60

                        70        80        90       100       110
m682.pep    PILILIDY-----EMAMPSEPDWIQTAFCMAYGFIRFPTDRPIRTRQSGVVRISPRTGFR
            ||||||||     |: |||||||||||||| |||||||||||| ||||||||||||||||
g682        PILILIDYICVNDEIKMPSEPDWIQTAFCMA-GFIRFPTDRPILTRQSGVVRISPRTGFR
                   70        80        90       100       110

              120       130
m682.pep    YPTRSLPKSKKAYGX
            |||||||||||||||
g682        YPTRSLPKSKKAYGX
          120       130
```

The following partial DNA sequence was identified in *N. meningitidis* <SEQ ID 2253>:

a682.seq

```
  1 ATGCGCGATT TTACCGTATG GGTGTCTTAC GGGAAATGGC GGAAAAATTG
 51 GGACATAAGG TATTGCCTCT TGCACCTTAT TCACCTGAGC TCAACCCGAT
101 TGAGAAAGTG TGGGCGAATA TTAAGCGGTA TCTGCGAACC GTTTTGTCTG
151 ATTACGCCCG ATTTGACGAT GCACTACTGT CCTATTTTGA TTTTAATTGA
201 ATAT...... .......... .......... .......... ..........
251 .......... .......... ......TATA TTCGGTTTCC AACTGACCGA
301 CCCATTCTGA CAAGGCCGAC AGGCGTTGTT CGGATTTCGC CACGAACGGG
351 TTTTCGGTAT CCCACGCGTA GCCTGCCAAA ATCGAAGAAA GCATACGGCT
401 GA
```

This corresponds to the amino acid sequence <SEQ ID 2254; ORF 682.a>:

a682.pep

```
  1 MRDFTVWVSY GKWRKNWDIR YCLLHLIHLS STRLRKCGRI LSGICEPFCL
 51 ITPDLTMHYC PILILIEY.. .......... .......... ..YIRFPTDR
101 PILTRPTGVV RISPRTGFRY PTRSLPKSKK AYG*
```

m682/a682 80.6% identity in 129 aa overlap

```
                   10         20         30         40         50         60
m682.pep   MRDFTVWVSYGKWRKNWDIRYCLLHLIHLSSTRLRKCGRILSGICEPFCLITPDLTMHYC
           ||||||||||||||||||||||||||||||||||||||||||||||||||||||||||||
a682       MRDFTVWVSYGKWRKNWDIRYCLLHLIHLSSTRLRKCGRILSGICEPFCLITPDLTMHYC
                   10         20         30         40         50         60

                   70         80         90        100        110        120
m682.pep   PILILIDYEMAMPSEPDWIQTAFCMAYGFIRFPTDRPIRTRQSGVVRISPRTGFRYPTRS
           ||||||:|                    :||||||||| || :||||||||||||||||
a682       PILILIEY--------------------YIRFPTDRPILTRPTGVVRISPRTGFRYPTRS
                                       70         80         90        100

                  130
m682.pep   LPKSKKAYGX
           ||||||||||
a682       LPKSKKAYGX
                  110
```

The following partial DNA sequence was identified in *N. gonorrhoeae* <SEQ ID 2255> g683.seq

```
  1 ATGATTAAGG AAACCCTAAT GCGCCCAATC TTCCTATCTT TCGTTTTACT
 51 CCCTATTTTG ATAACCGCCT GCAGCACACC GGACAAGTCT GCCCGATGGG
101 AAAATATCGG CACAATCTCA AACGGCAATA TTCATACATA TATTAATAAA
151 GACAGTGTGA GAAAAAACGG AAATCTGATG ATTTTCCAAG ATAAAAAAGT
201 TGTTACCAAT CTGAAACAAG AACGTTTTGC CAACACCCCC GCATACAAGA
251 CTGCCATTGC CGAGTGGGAA ATCCACTGCA ACAACAAAAC ATACCGCTTA
301 AGTTCGCTAC AGTTATTTGA TACAAAAAAC ACGGAAATTT CCACACAAAA
351 CTACACAGCC TCTTCCCTCC GCCCGATGAG CATCCTGTCC GGGACATTAA
401 CTGAAAAACA ATATGAAACC GTATGCGGGA AAAAACTCTG A
```

This corresponds to the amino acid sequence <SEQ ID 2256; ORF 683>:

g683.pep

```
  1 MIKETLMRPI FLSFVLLPIL ITACSTPDKS ARWENIGTIS NGNIHTYINK

 51 DSVRKNGNLM IFQDKKVVTN LKQERFANTP AYKTAIAEWE IHCNNKTYRL

101 SSLQLFDTKN TEISTQNYTA SSLRPMSILS GTLTEKQYET VCGKKL*
```

The following partial DNA sequence was identified in *N. meningitidis* <SEQ ID 2257>:

m683.seq..

```
  1 ATGATTAAGG AAACCCTAAT GCGCCCAATC TTCCTATCTT TCGTTTTATT

 51 CCCTATTTTG ATAACCGCCT GCAGCACACC GGACAAGTCT GCCCGATGGG

101 AAAATATCGG CACAATCTCA AACGGCAATA TTCATACATA TATCAATAAA

151 GACAGCGTGA GAAAAAACGG AAATCTGATG ATTTTCCAAG ATAAAAAAGT

201 TGTTACCAAT CTAAAACAAG AACGTTTTGC CAACACCCCC GCATACAAGA

251 CTGCCATTGC CGAGTGGGAA ATCCACTGCA ACAACAAAAC ATACCGCTTA

301 AGTTCGCTAC AGTTGTTTGA TACAAAAAAC ACGGAAATTT CCACACAAAA

351 CTACACAGCC TCTTCCCTCC GCCCGATGAG CATCCTGTCC GGGACATTAA

401 CCGAAAAACA ATATGAAACC GTATGCGGAA AAAAACTCTG A
```

This corresponds to the amino acid sequence <SEQ ID 2258; ORF 683>:

m683.pep..

```
  1 MIKETLMRPI FLSFVLFPIL ITACSTPDKS ARWENIGTIS NGNIHTYINK

 51 DSVRKNGNLM IFQDKKVVTN LKQERFANTP AYKTAIAEWE IHCNNKTYRL

101 SSLQLFDTKN TEISTQNYTA SSLRPMSILS GTLTEKQYET VCGKKL*
```

Computer analysis of this amino acid sequence gave the following results:

Homology with a predicted ORF from *N. gonorrhoeae*

ORF 683 shows 99.3% identity over a 146 aa overlap with a predicted ORF (ORF 683) from *N. gonorrhoeae:* m683/g683 99.3% identity in 146 aa overlap

```
                10        20        30        40        50        60
m683.pep  MIKETLMRPIFLSFVLFPILITACSTPDKSARWENIGTISNGNIHTYINKDSVRKNGNLM
          ||||||||||||||||:|||||||||||||||||||||||||||||||||||||||||||
g683      MIKETLMRPIFLSFVLLPILITACSTPDKSARWENIGTISNGNIHTYINKDSVRKNGNLM
                10        20        30        40        50        60

                70        80        90       100       110       120
m683.pep  IFQDKKVVTNLKQERFANTPAYKTAIAEWEIHCNNKTYRLSSLQLFDTKNTEISTQNYTA
          ||||||||||||||||||||||||||||||||||||||||||||||||||||||||||||
g683      IFQDKKVVTNLKQERFANTPAYKTAIAEWEIHCNNKTYRLSSLQLFDTKNTEISTQNYTA
                70        80        90       100       110       120

               130       140
m683.pep  SSLRPMSILSGTLTEKQYETVCGKKLX
          |||||||||||||||||||||||||||
g683      SSLRPMSILSGTLTEKQYETVCGKKLX
               130       140
```

The following partial DNA sequence was identified in *N. meningitidis* <SEQ ID 2259> a683.seq

```
  1 ATGATTAAGG AAACCCTAAT GCGCCCAATC TTCCTATCTT TCGTTTTATT
 51 CCCTATTTTG ATAACCGCCT GCAGCACACC GGACAAGTCT GCCCGATGGG
101 AAAATATCGG CACAATCTCA AACGGCAATA TTCATACATA TATCAATAAA
151 GACAGCGTGA GAAAAAACGG AAATCTGATG ATTTTCCNAG ATAAAAAAGT
201 TGTTACCAAT CTAAAACAAG AACGTTTTGC CNACACCCCC GCATACAAGA
251 CTGCCATTGC CGAGTGGGAA ATCCACTGCA ACAACAAAAC ATACCGCTTA
301 AGTTCGCTAC AATTGTTTGA TACAAAAAAC ACGGAAATTT CCACACAAAA
351 NTACACAGCC TCTTCCCTCC GCCCGATGAG CATCCTGTCC GGGACATTAA
401 CCGAAAAACA ATATGAAACC GTATGCGGAA AAAAACTCTG A
```

This corresponds to the amino acid sequence <SEQ ID 2260; ORF 683.a>:

a683.pep

```
  1 MIKETLMRPI FLSFVLFPIL ITACSTPDKS ARWENIGTIS NGNIHTYINK
 51 DSVRKNGNLM IFXDKKVVTN LKQERFAXTP AYKTAIAEWE IHCNNKTYRL
101 SSLQLFDTKN TEISTQXYTA SSLRPMSILS GTLTEKQYET VCGKKL*
```

Computer analysis of this amino acid sequence gave the following results:

Homology with a predicted ORF from *N. meningitidis*

ORF 683 shows 97.9% identity over a 146 aa overlap with a predicted ORF (ORF 683) from *N. meningitidis:* m683/a683 97.9% identity in 146 aa overlap

```
                  10        20        30        40        50        60
m683.pep   MIKETLMRPIFLSFVLFPILITACSTPDKSARWENIGTISNGNIHTYINKDSVRKNGNLM
           ||||||||||||||||||||||||||||||||||||||||||||||||||||||||||||
a683       MIKETLMRPIFLSFVLFPILITACSTPDKSARWENIGTISNGNIHTYINKDSVRKNGNLM
                  10        20        30        40        50        60

                  70        80        90       100       110       120
m683.pep   IFQDKKVVTNLKQERFANTPAYKTAIAEWEIHCNNKTYRLSSLQLFDTKNTEISTQNYTA
           || |||||||||||||| |||||||||||||||||||||||||||||||||||||| |||
a683       IFXDKKVVTNLKQERFAXTPAYKTAIAEWEIHCNNKTYRLSSLQLFDTKNTEISTQXYTA
                  70        80        90       100       110       120

                 130       140
m683.pep   SSLRPMSILSGTLTEKQYETVCGKKLX
           |||||||||||||||||||||||||||
a683       SSLRPMSILSGTLTEKQYETVCGKKLX
                 130       140
```

The following partial DNA sequence was identified in *N. gonorrhoeae* <SEQ ID 2261> g684.seq

```
  1 ATGCGCCTTT TCCCCATCGC CGCCGCCCTG ACGCTTGCCG CCTGCGGTAC
 51 TGTGCAAAGC ACACAATATT TCGTGTTGCC CGACAGCCGC TACATCCGTC
101 CTGCAACGCA AGGCGGCGAA ACCGCCGTCG AAGTCCGTCT TGCCGAACCG
151 CTCAAACGCG GCGGACTGGT CTATCAAACC GACCCCTACC GCATCAACAC
```

-continued

```
201 CGCACAAAAC CATGTTTGGG CAGACACCTT GGACGATATG CTCGAAGCGG
251 CGTTGAGCAA TGCATTCAAC CGTTTGGACA GCACACGCAC CTTTGTTCCT
301 GCCTCACGCA GCGGCAGTAC CGACAAATGG ACGGTCTATA TCGACGCATT
351 CCAAGGCAGC TACACGGGCA AAACCCTCAT CAGCGGCTAC GCCGTCCTAC
401 CCGACGGTAC GAACAGACCC TTCCATATCG AAACCGAACA GCAGGGTGAC
451 GGCTACGCCG CCATGACCGC CGCACTCGAA CAGGGACTGA AACAGGCGGC
501 GCAACAGATG GTCGAGTAA
```

This corresponds to the amino acid sequence <SEQ ID 2262; ORF 684>:

g684.pep

```
  1 MRLFPIAAAL TLAACGTVQS TQYFVLPDSR YIRPATQGGE TAVEVRLAEP
 51 LKRGGLVYQT DPYRINTAQN HVWADTLDDM LEAALSNAFN RLDSTRTFVP
101 ASRSGSTDKW TVYIDAFQGS YTGKTLISGY AVLPDGTNRP FHIETEQQGD
151 GYAAMTAALE QGLKQAAQQM VE*
```

The following partial DNA sequence was identified in *N. meningitidis* <SEQ ID 2263>:

m684.seq

```
  1 ATGCGCCTTT TCCCGATTGC CGCCGCCCTG TCGCTTGCCG CCTGCGGTAC
 51 TGTGCAAAGC ACACAATATT TCGTGTTGCC CGACAGCCGC TACATCCGTC
101 CTGCAACGCA AGGCGGCGAA ACTGCCGTCG AAGTCCGTCT TGCCGAACCG
151 CTCAAACGCG GCGGACTGGT CTATCAAACC GACCCCTACC GCCTCAACAC
201 CGCACAAAAC CACGTCTGGG CAGACACCTT GGACGATATG CTCGAAGCGG
251 CGTTGAGCAA TGCATTCAAC CGTTTGGACA GCACACGCAT CTTTGTTCCT
301 GCCTCACGCA GCGGCAGTAC CGAAAAATGG ACGGTCTATA TCGACGCATT
351 CCAAGGCAGC TACACGGGCA AAACCCTCAT CAGCGGCTAC GCCGTCCTAC
401 CCGACGGTAC GAACAGACCC TTCCATATCG AAACCGAACA GCAGGGTGAC
451 GGCTACGCCG CGATGACCGC CGCACTCGAA CAGGGACTGA AACAGGCGGC
501 GCAACAGATG GTCGAGTAA
```

This corresponds to the amino acid sequence <SEQ ID 2264; ORF 684>:

m684.pep

```
  1 MRLFPIAAAL SLAACGTVQS TQYFVLPDSR YIRPATQGGE TAVEVRLAEP
 51 LKRGGLVYQT DPYRLNTAQN HVWADTLDDM LEAALSNAFN RLDSTRIFVP
101 ASRSGSTEKW TVYIDAFQGS YTGKTLISGY AVLPDGTNRP FHIETEQQGD
151 GYAAMTAALE QGLKQAAQQM VE*
```

Computer analysis of this amino acid sequence gave the following results:

Homology with a predicted ORF from *N. gonorrhoeae*

ORF 684 shows 97.7% identity over a 172 aa overlap with a predicted ORF (ORF 684) from *N. gonorrhoeae:* m684/g684 97.7% identity in 172 aa overlap

```
                   10        20        30        40        50        60
m684.pep   MRLFPIAAALSLAACGTVQSTQYFVLPDSRYIRPATQGGETAVEVRLAEPLKRGGLVYQT
           ||||||||||:|||||||||||||||||||||||||||||||||||||||||||||||||
g684       MRLFPIAAALTLAACGTVQSTQYFVLPDSRYIRPATQGGETAVEVRLAEPLKRGGLVVQT
                   10        20        30        40        50        60

                   70        80        90       100       110       120
m684.pep   DPYRLNTAQNHVWADTLDDMLEAALSNAFNRLDSTRIFVPASRSGSTEKWTVYIDAFQGS
           ||||:||||||||||||||||||||||||||||||| ||||||||||:||||||||||||
g684       DPYRINTAQNHVWADTLDDMLEAALSNAFNRLDSTRTFVPASRSGSTDKWTVYIDAFQGS
                   70        80        90       100       110       120

                  130       140       150       160       170
m684.pep   YTGKTLISGYAVLPDGTNRPFHIETEQQGDGYAAMTAALEQGLKQAAQQMVEX
           |||||||||||||||||||||||||||||||||||||||||||||||||||||
g684       YTGKTLISGYAVLPDGTNRPFHIETEQQGDGYAAMTAALEQGLKQAAQQMVEX
                  130       140       150       160       170
```

The following partial DNA sequence was identified in *N. meningitidis* <SEQ ID 2265>

<u>a684.seq</u>

```
  1 ATGCGCCTCT TCCCGATTGC CGCCGCCCTG ACGCTTGCCG CCTGCGGTAC
 51 TGTGCAAAGC ACACAATATT TCGTGTTGCC CGACAGCCGC TACATCCGTC
101 CTGCAACGCA AGGCGGCGAA ACTGCCGTCG AAGTCCGTCT TGCCGAACCG
151 CTCAAACGCG GCGGACTGGT CTATCAAACC GACCCCTACC GCCTCAACAC
201 CGCACAAAAC CACGTCTGGG CAGACACCTT GGACGATATG CTCGAAGCGG
251 CGTTGAGCAA TGCATTCAAC CGTTTGGACA GCACACGCAT CTTTGTTCCT
301 GCCTCACGCA GCGGCAGTAC CGAAAAATGG ACGGTCTATA TCGACGCATT
351 CCAAGGCAGC TACACGGGCA AAACCCTCAT CAGCGGCTAC GCCGTCCTAC
401 CCGACGGTAC GAACAGACCC TTCCATATCG AAACCGAACA GCAGGGTGAC
451 GGCTACGCCG CCATGACCGC CGCACTCGAA CAGGGACTGA AACAGGCGGC
501 GCAACAGATG GTCGAGTAA
```

This corresponds to the amino acid sequence <SEQ ID 2266; ORF 684.a>:

<u>a684.pep</u>

```
  1 MRLFPIAAAL TLAACGTVQS TQYFVLPDSR YIRPATQGGE TAVEVRLAEP
 51 LKRGGLVYQT DPYRLNTAQN HVWADTLDDM LEAALSNAFN RLDSTRIFVP
101 ASRSGSTEKW TVYIDAFQGS YTGKTLISGY AVLPDGTNRP FHIETEQQGD
151 GYAAMTAALE QGLKQAAQQM VE*
```

Computer analysis of this amino acid sequence gave the following results:

Homology with a predicted ORF from *N. meningitidis*

ORF 684 shows 99.4% identity over a 172 aa overlap with a predicted ORF (ORF 684) from *N. meningitidis* m684/a684 99.4% identity in 172 aa overlap

```
                  10         20         30         40         50         60
m684.pep   MRLFPIAAALSLAACGTVQSTQYFVLPDSRYIRPATQGGETAVEVRLAEPLKRGGLVYQT
           ||||||||||:|||||||||||||||||||||||||||||||||||||||||||||||||
a684       MRLFPIAAALTLAACGTVQSTQYFVLPDSRYIRPATQGGETAVEVRLAEPLKRGGLVVQT
                  10         20         30         40         50         60

                  70         80         90        100        110        120
m684.pep   DPYRLNTAQNHVWADTLDDMLEAALSNAFNRLDSTRIFVPASRSGSTEKWTVYIDAFQGS
           ||||||||||||||||||||||||||||||||||||||||||||||||||||||||||||
a684       DPYRLNTAQNHVWADTLDDMLEAALSNAFNRLDSTRIFVPASRSGSTEKWTVYIDAFQGS
                  70         80         90        100        110        120

                 130        140        150        160        170
m684.pep   YTGKTLISGYAVLPDGTNRPFHIETEQQGDGYAAMTAALEQGLKQAAQQMVEX
           |||||||||||||||||||||||||||||||||||||||||||||||||||||
a684       YTGKTLISGYAVLPDGTNRPFHIETEQQGDGYAAMTAALEQGLKQAAQQMVEX
                 130        140        150        160        170
```

The following partial DNA sequence was identified in *N. gonorrhoeae* <SEQ ID 2267> g685.seq

```
   1 TTGTTTTGCC GTATCGGGAA TTTTGCGTTT TGCGGCGTGG TTTCTGCAGG
  51 TTGTTTGCTT AATAATAAAC ATTCTTATTC GTATGCAAAG GAACCGCACA
 101 CCGTGAAACC GCGTTTTTAT TGGGCAGcct GCGCCGTCCT GCCGGCCGCC
 151 TGTTCGCCCG AACCTGCCGC CGAAAAAACT GTATccgCCG CATCCCAAGC
 201 CGCATCCACA CCTGTCGCCA CGCTGACCGT GCCGACCGCG CGGGGCGATG
 251 CCGTTGTGCC GAAGAATCCC GAACgcgtcg ccgtgtAcga CtggGCGGCG
 301 TtggaTACGC TGACCGAGCC GGGCGTGAAT GTGGGCGCAA CCACCGCGCC
 351 GGTGCGCGTG GACTATTTGC AGCCTGCATT TGACAAGGCG GCAACGGTGG
 401 GGACGCTGTT TGAGCCCGAT TGCGAATCCC TGCACCGCCA CAATCCGCAG
 451 TTTGTCATTA CCGGCGGGCC GGGTGCGGAA GCGTATGAAC AGTTGGCGAA
 501 AAACGCGACC ACCATAGATT TGACGGTGGA CAACGGCAAT ATCCGCACCA
 551 GCGGCGAGAA GCAGATGGAG ACCCTGTCGC GGATTTTCGG TAAGGAAGCG
 601 CGCGTGGCGG AATTGAATGC GCAGATTGAC GCGCTGTTCG CCCAAAAGCG
 651 CGAAGCCGCC AAAGGCAAAG GACGCGGGCT GGTGCTGTCG GTTACAGGCA
 701 ACAAGGTGTC CGCCTTCGGC ACGCAATCGC GGTTGGCAAG TTGGATACAC
 751 GGCGACATCG GCCTGCCGCC CGTGGACGAA TCTTTACGCA ACGAAGGGCA
 801 CGGGCAGCCC GTTTCCTTCG AATACATCAA AGAGAAAAAC CCCGGCTGGA
 851 TTTTCATCAT CGACCGCACC GCCGCCATCG GGCAGGAAGG GCCGGCTGCC
 901 GTGGAAGTGT TGGATAACGC GCTGGTATGC GGCACGAACG CTTGGAAGCG
 951 CAAGCAAATC ATCGTCATGC CTGCCGCGAA CTACATTGTC GCGGGCGGCG
1001 CGCGGCAGTT GATACAGGCG GCGGAACAGT TGAAGGCGGC GTTTGAAAAG
1051 GCAGAACCCG TTGCGGCGCA GTAG
```

This corresponds to the amino acid sequence <SEQ ID 2268; ORF 685>:

g685.pep

```
  1 LFCRIGNFAF CGVVSAGCLL NNKHSYSYAK EPHTVKPRFY WAACAVLPAA
 51 CSPEPAAEKT VSAASQAAST PVATLTVPTA RGDAVVPKNP ERVAVYDWAA
```

-continued

101 LDTLTEPGVN VGATTAPVRV DYLQPAFDKA ATVGTLFEPD CESLHRHNPQ

151 FVITGGPGAE AYEQLAKNAT TIDLTVDNGN IRTSGEKQME TLSRIFGKEA

201 RVAELNAQID ALFAQKREAA KGKGRGLVLS VTGNKVSAFG TQSRLASWIH

251 GDIGLPPVDE SLRNEGHGQP VSFEYIKEKN PGWIFIIDRT AAIGQEGPAA

301 VEVLDNALVC GTNAWKRKQI IVMPAANYIV AGGARQLIQA AEQLKAAFEK

351 AEPVAAQ*

The following partial DNA sequence was identified in *N. meningitidis* <SEQ ID 2269>:

m685.seq

1 TTGTTTTGCC GTATCGGGAA TTTTGCGTTT TGCGGCGTGG TTTCTGCAGG

51 TTGTTTGCTT AATAATAAAC ATTCTTATTC GTATGCAAAG GAACCGCACA

101 CCGTGAAACC GCGTTTTTAT TGGGCAGCCT GCGCCGTCCT GCTGACCGCC

151 TGTTCGCCCG AACCTGCCGC CGAAAAAACT GTATCCGCCG CATCCGCATC

201 TGCCGCCACG CTGACCGTGC CGACCGCGCG GGGCGATGCC GTTGTGCCGA

251 AGAATCCCGA ACGCGTCGCC GTGTACGACT GGGCGGCGTT GGATACGCTG

301 ACCGAATTGG GCGTGAATGT GGGCGCAACC ACCGCGCCGG TGCGCGTGGA

351 TTATTTGCAG CCTGCATTTG ACAAGGCGGC AACGGTGGGG ACGCTGTTCG

401 AGCCCGATTA CGAAGCCCTG CACCGCTACA ATCCTCAGCT TGTCATTACC

451 GGCGGGCCGG GCGCGGAAGC GTATGAACAG TTAGCGAAAA ACGCGACCAC

501 CATAGATCTG ACGGTGGACA ACGGCAATAT CCGCACCAGC GGCGAAAAGC

551 AGATGGAGAC CTTGGCGCGG ATTTTCGGCA AGGAAGCGCG CGCGGCGGAA

601 TTGAAGGCGC AGATTGACGC GCTGTTCGCC CAAACGCGCG AAGCCGCCAA

651 AGGCAAAGGA CGCGGGCTGG TGCTGTCGGT TACGGGCAAC AAGGTGTCCG

701 CCTTCGGCAC GCAGTCGCGG TTGGCAAGTT GGATACACGG CGACATCGGC

751 CTACCGCCTG TAGACGAATC TTTACGCAAC GAGGGGCACG GGCAGCCTGT

801 TTCCTTCGAA TACATCAAAG AGAAAAACCC CGATTGGATT TTCATCATCG

851 ACCGTACCGC CGCCATCGGG CAGGAAGGGC CGGCGGCTGT CGAAGTATTG

901 GATAACGCGC TGGTACGCGG CACGAACGCT TGGAAGCGCA AGCAAATCAT

951 CGTCATGCCT GCCGCGAACT ACATTGTCGC GGGCGGCGCG CGGCAGTTGA

1001 TTCAGGCGGC GGAGCAGTTG AAGGCGGCGT TTAAAAAGGC AGAACCCGTT

1051 GCGGCGGGGA AAAAGTAG

This corresponds to the amino acid sequence <SEQ ID 2270; ORF 685>:

m685.pep

1 LFCRIGNFAF CGVVSAGCLL NNKHSYSYAK EPHTVKPRFY WAACAVLLTA

51 CSPEPAAEKT VSAASASAAT LTVPTARGDA VVPKNPERVA VYDWAALDTL

101 TELGVNVGAT TAPVRVDYLQ PAFDKAATVG TLFEPDYEAL HRYNPQLVIT

151 GGPGAEAYEQ LAKNATTIDL TVDNGNIRTS GEKQMETLAR IFGKEARAAE

-continued

```
201 LKAQIDALFA QTREAAKGKG RGLVLSVTGN KVSAFGTQSR LASWIHGDIG

251 LPPVDESLRN EGHGQPVSFE YIKEKNPDWI FIIDRTAAIG QEGPAAVEVL

301 DNALVRGTNA WKRKQIIVMP AANYIVAGGA RQLIQAAEQL KAAFKKAEPV

351 AAGKK*
```

Computer analysis of this amino acid sequence gave the following results:

Homology with a predicted ORF from *N. gonorrhoeae*

ORF 685 shows 94.4% identity over a 356 aa overlap with a predicted ORF (ORF 685) from *N. gonorrhoeae:* m685/g685 94.4% identity in 356 aa overlap

```
                   10        20        30        40        50        60
m685.pep   LFCRIGNFAFCGVVSAGCLLNNKHSYSYAKEPHTVKPRFYWAACAVLLTACSPEPAAEKT
           |||||||||||||||||||||||||||||||||||||||||||||||| :|||||||||||
g685       LFCRIGNFAFCGVVSAGCLLNNKHSYSYAKEPHTVKPRFYWAACAVLPAACSPEPAAEKT
                   10        20        30        40        50        60

                       70        80        90       100       110
m685.pep   VSAASASA----ATLTVPTARGDAVVPKNPERVAVYDWAALDTLTELGVNVGATTAPVRV
           |||||  :|     ||||||||||||||||||||||||||||||||||| |||||||||||||
g685       VSAASQAASTPVATLTVPTARGDAVVPKNPERVAVYDWAALDTLTEPGVNVGATTAPVRV
                   70        80        90       100       110       120

            120       130       140       150       160       170
m685.pep   DYLQPAFDKAATVGTLFEPDYEALHRYNPQLVITGGPGAEAYEQLAKNATTIDLTVDNGN
           ||||||||||||||||||| |:|||:|||:||||||||||||||||||||||||||||||
g685       DYLQPAFDKAATVGTLFEPDCESLHRHNPQFVITGGPGAEAYEQLAKNATTIDLTVDNGN
                  130       140       150       160       170       180

            180       190       200       210       220       230
m685.pep   IRTSGEKQMETLARIFGKEARAAELKAQIDALFAQTREAAKGKGRGLVLSVTGNKVSAFG
           ||||||||||||:||||||||:|||:||||||||| ||||||||||||||||||||||||
g685       IRTSGEKQMETLSRIFGKEARVAELNAQIDALFAQKREAAKGKGRGLVLSVTGNKVSAFG
                  190       200       210       220       230       240

            240       250       260       270       280       290
m685.pep   TQSRLASWIHGDIGLPPVDESLRNEGHGQPVSFEYIKEKNPDWIFIIDRTAAIGQEGPAA
           |||||||||||||||||||||||||||||||||||||||| ||||||||||||||||||
g685       TQSRLASWIHGDIGLPPVDESLRNEGHGQPVSFEYIKEKNPGWIFIIDRTAAIGQEGPAA
                  250       260       270       280       290       300

            300       310       320       330       340       350
m685.pep   VEVLDNALVRGTNAWKRKQIIVMPAANYIVAGGARQLIQAAEQLKAAFKKAEPVAAGKKX
           |||||||||| |||||||||||||||||||||||||||||||||||||||:|||||||
g685       VEVLDNALVCGTNAWKRKQIIVMPAANYIVAGGARQLIQAAEQLKAAFEKAEPVAAQX
                  310       320       330       340       350
```

The following partial DNA sequence was identified in *N. meningitidis* <SEQ ID 2271> a685.seq

```
  1 TTGTTTTGCC GTATCGGGAA TTTTGCGTTT TGCGGCGTGG TTTCTGCAGG

 51 TTGTTTGCTT AATAATAAAC ATTCTTATTC GTATGCAAAG GAACCGCACA

101 CCGTGAAACC GCGTTTTTAT TGGGCAGCCT GCGCCGTCCT GCTGACCGCC

151 TGTTCGCCCG AACCTGCCGC CGAAAAAACT GTATCCGCCG CATCCGCATC

201 TGCCGCCACA CTGACCGTGC CGACCGCGCG GGGCGATGCC GTTGTGCCGA

251 AGAATCCCGA ACGCGTCGCC GTGTACGACT GGGCGGCGTT GGATACGCTG

301 ACCGAATTGG GTGTGAATGT GGGCGCAACC ACCGCGCCGG TGCGCGTGGA

351 TTATTTGCAG CCTGCATTTG ACAAGGCGGC AACGGTGGGG ACGCTGTTCG

401 AGCCCGATTA CGAAGCCCTG CACCGCTACA ATCCTCAGCT TGTCATTACC
```

-continued

```
 451 GGCGGGCCGG GCGCGGAAGC GTATGAACAG TTGGCGAAAA ACGCGACCAC

 501 CATAGATCTG ACGGTGGACA ACGGCAATAT CCGCACCAGC GGCGAAAAGC

 551 AGATGGAGAC CTTGGCGCGG ATTTTCGGCA AGGAAGCGCG CGCGGCGGAA

 601 TTGAAGGCGC AGATTGACGC GCTGTTCGCC CAAACGCGCG AAGCCGCCAA

 651 AGGCAAAGGA CGCGGGCTGG TGCTGTCGGT TACGGGCAAC AAGGTGTCCG

 701 CCTTCGGCAC GCAGTCGCGG TTGGCAAGTT GGATACACGG CGACATCGGC

 751 CTACCGCCTG TAGACGAATC TTTACGCAAC GAGGGGCACG GGCAGCCTGT

 801 TTCCTTCGAA TACATCAAAG AGAAAAACCG CGATTGGATT TTCATCATCG

 851 ACCGTACCGC CGCCATCGGG CAGGAAGGGC CGGCGGCTGT CGAAGTATTG

 901 GATAACGCGC TGGTACGCGG CACGAACGCT TGGAAGCGCA AGCAAATCAT

 951 CGTCATGCCT GCCGCGAACT ACATTGTCGC GGGCGGCTCG CGGCAGTTGA

1001 TTCAGGCGGC GGAGCAGTTG AAGGAGGCGT TTGAAAAGGC AGAACCCGTT

1051 GCGGCGGGGA AAGAGTAG
```

This corresponds to the amino acid sequence <SEQ ID 2272; ORF 685.a>:

```
a685.pep

  1 LFCRIGNFAF CGVVSAGCLL NNKHSYSYAK EPHTVKPRFY WAACAVLLTA

 51 CSPEPAAEKT VSAASASAAT LTVPTARGDA VVPKNPERVA VYDWAALDTL

101 TELGVNVGAT TAPVRVDYLQ PAFDKAATVG TLFEPDYEAL HRYNPQLVIT

151 GGPGAEAYEQ LAKNATTIDL TVDNGNIRTS GEKQMETLAR IFGKEARAAE

201 LKAQIDALFA QTREAAKGKG RGLVLSVTGN KVSAFGTQSR LASWIHGDIG

251 LPPVDESLRN EGHGQPVSFE YIKEKNPDWI FIIDRTAAIG QEGPAAVEVL

301 DNALVRGTNA WKRKQIIVMP AANYIVAGGS RQLIQAAEQL KEAFEKAEPV

351 AAGKE*
```

Computer analysis of this amino acid sequence gave the following results:

Homology with a predicted ORF from *N. meningitidis*

ORF 685 shows 98.9% identity over a 355 aa overlap with a predicted ORF (ORF 685) from *N. meningitidis:* m685/a685 98.9% identity in 355 aa overlap

```
                    10        20        30        40        50        60
m685.pep    LFCRIGNFAFCGVVSAGCLLNNKHSYSYAKEPHTVKPRFYWAACAVLLTACSPEPAAEKT
            ||||||||||||||||||||||||||||||||||||||||||||||||||||||||||||
a685        LFCRIGNFAFCGVVSAGCLLNNKHSYSYAKEPHTVKPRFYWAACAVLLTACSPEPAAEKT
                    10        20        30        40        50        60

                    70        80        90       100       110       120
m685.pep    VSAASASAATLTVPTARGDAVVPKNPERVAVYDWAALDTLTELGVNVGATTAPVRVDYLQ
            ||||||||||||||||||||||||||||||||||||||||||||||||||||||||||||
a685        VSAASASAATLTVPTARGDAVVPKNPERVAVYDWAALDTLTELGVNVGATTAPVRVDYLQ
                    70        80        90       100       110       120

                   130       140       150       160       170       180
m685.pep    PAFDKAATVGTLFEPDYEALHRYNPQLVITGGPGAEAYEQLAKNATTIDLTVDNGNIRTS
            ||||||||||||||||||||||||||||||||||||||||||||||||||||||||||||
a685        PAFDKAATVGTLFEPDYEALHRYNPQLVITGGPGAEAYEQLAKNATTIDLTVDNGNIRTS
                   130       140       150       160       170       180
```

-continued

```
                 190        200        210        220        230        240
m685.pep  GEKQMETLARIFGKEARAAELKAQIDALFAQTREAAKGKGRGLVLSVTGNKVSAFGTQSR
          ||||||||||||||||||||||||||||||||||||||||||||||||||||||||||||
a685      GEKQMETLARIFGKEARAAELKAQIDALFAQTREAAKGKGRGLVLSVTGNKVSAFGTQSR
                 190        200        210        220        230        240

                 250        260        270        280        290        300
m685.pep  LASWIHGDIGLPPVDESLRNEGHGQPVSFEYIKEKNPDWIFIIDRTAAIGQEGPAAVEVL
          ||||||||||||||||||||||||||||||||||||||||||||||||||||||||||||
a685      LASWIHGDIGLPPVDESLRNEGHGQPVSFEYIKEKNPDWIFIIDRTAAIGQEGPAAVEVL
                 250        260        270        280        290        300

                 310        320        330        340        350
m685.pep  DNALVRGTNAWKRKQIIVMPAANYIVAGGARQLIQAAEQLKAAFKKAEPVAAGKKX
          |||||||||||||||||||||||||||||:||||||||||| ||:|||||||||:|
a685      DNALVRGTNAWKRKQIIVMPAANYIVAGGSRQLIQAAEQLKEAFEKAEPVAAGKEX
                 310        320        330        340        350
```

The following partial DNA sequence was identified in *N. gonorrhoeae* <SEQ ID 2273> g686.seq (partial)

```
  1  ..AATTTCTCCT GCCGCGCCGA TGATGTTTTT GACGATATCT GCAGTGCCGT
 51    TGAAGGCTTC ggcgGCATTG CCCGATCTGT CCAGCTCGGG GCTGTATCGG
101    GTGGCGCGTT TGAATCCGTC GCCTACTCCT TGCGTCAGCA TAGCGCCGGC
151    ATTGTGGAAA CGGTCGGCAA GCCGTTGTCC GGTGCTGCGG TTGTCGGTCA
201    GGTTGAGGCG GATATTTTGG GCAACGCCTT TTATGTCGTA GCTGTATATA
251    TCCCTCGCGC CTTTGGGAGC GGGATAGCCG CCGCCCTGTG GCCCGTCATA
301    GCCGTCGGCG GGATGGTGTT CGTATCCGTC CCAATGGATG CGGTAAAGGC
351    TGAATCCGTC AACGGGACTA CCGGCTTCGT CAGAATCGGA ATGTGA
```

This corresponds to the amino acid sequence <SEQ ID 2274; ORF 686>:

g686.pep (partial)

```
  1  ..NFSCRADDVF DDICSAVEGF GGIARSVQLG AVSGGAFESV AYSLRQHSAG
 51    IVETVGKPLS GAAVVGQVEA DILGNAFYVV AVYIPRAFGS GIAAALWPVI
101    AVGGMVFVSV PMDAVKAESV NGTTGFVRIG M*
```

The following partial DNA sequence was identified in *N. meningitidis* <SEQ ID 2275>:

m686.seq..

```
  1 ATGATGTTGA AAAAATTCGT ACTCGGCGGT ATTGCCGCAT TGGTTTTGGC
 51 GGCCTGCGGC GGTTCGGAAG GCGGCAGCGG AGCGNNNNNN NNNNNNAATT
101 TCTCCTGCAG CGCCGATGAT GTTTTTAACG ATATCTGCAG TGCCGTTGAA
151 GGCTTCGGCG GCATTGCCCG ATCTGTCCAG CTCGGGGCTG TATCGGGTGG
201 CGCGTTTGAA TCCGTCGCCT ACTCCTTGCG TCAGCATACT ACCGGCATTG
251 TGGAAACGGT CGGCAAGCCG TTGTCCGGTG CTGCGGTTGT CGGTCAGGTT
301 GAGGCGGATA TTTTGGGCAA CGCCTTTTAT GTCGTAGCTG TATATATCCC
351 TCGCGCCTTT GGGAGCGGGA TAGCCGCCGC CCTGTGGCCC GTCATAGCCG
```

-continued

```
401 TCGGCGGGAT GGTGTTCGTA TCCGTCCCAA TGGATGCGGT AAAGGCTAAA

451 TCCGTCAACG GGACTACCGG CTTCATCAGA ATCGGAATGT GA
```

This corresponds to the amino acid sequence <SEQ ID 2276; ORF 686>:

m686.pep

```
  1 MMLKKFVLGG IAALVLAACG GSEGGSGAXX XXNFSCSADD VFNDICSAVE

 51 GFGGIARSVQ LGAVSGGAFE SVAYSLRQHT TGIVETVGKP LSGAAVVGQV

101 EADILGNAFY VVAVYIPRAF GSGIAAALWP VIAVGGMVFV SVPMDAVKAK

151 SVNGTTGFIR IGM*
```

Computer analysis of this amino acid sequence gave the following results:

Homology with a predicted ORF from *N. gonorrhoeae*

ORF 686 shows 95.4% identity over a 131 aa overlap with a predicted ORF (ORF 686) from *N. gonorrhoeae* g686/m686 95.4% identity in 131 aa overlap

```
                                              10        20        30
g686.pep                                  NFSCRADDVFDDICSAVEGFGGIARSVQLG
                                          |||| |||||:|||||||||||||||||||
m686       LKKFVLGGIAALVLAACGGSEGGSGAXXXXNFSCSADDVFNDICSAVEGFGGIARSVQLG
                  10        20        30        40        50        60

                  40        50        60        70        80        90
g686.pep   AVSGGAFESVAYSLRQHSAGIVETVGKPLSGAAVVGQVEADILGNAFYVVAVYIPRAFGS
           ||||||||||||||||::||||||||||||||||||||||||||||||||||||||||||
m686       AVSGGAFESVAYSLRQHTTGIVETVGKPLSGAAVVGQVEADILGNAFYVVAVYIPRAFGS
                  70        80        90       100       110       120

                 100       110       120       130
g686.pep   GIAAALWPVIAVGGMVFVSVPMDAVKAESVNGTTGFVRIGMX
           ||||||||||||||||||||||||||:||||||||:|||||
m686       GIAAALWPVIAVGGMVFVSVPMDAVKAKSVNGTTGFIRIGMX
                130       140       150       160
```

The following partial DNA sequence was identified in *N. meningitidis* <SEQ ID 2277> a686.seq (partial)

```
  1 ..AATTTCTCCT GCCGCGCCGA TGATGTTTTT GACGATATCT GCAGTGCCGT

 51   TGAAAGCTTC GGCGGCATTG CCCGATCTGT CCAGCTCGGG GCTGTATCGG

101   GTGGCGCGTT TGAATCCGTC GCCTACTCCT TGCGTCAGCA TACTACCGGT

151   ATTGTGGAAA CGGTCGACAA GCCGTTGTCC GGTGCTGCGG TTGTCGGTCA

201   GGTTGAGGCG GATATTTTGG GCAACGCCTT TTATGTCGTA GCTGTATATA

251   TCCCTCGCGC CTTTGGGAGC GGGATAGCCG CCGCCCTGTG GCCCGTCATA

301   GCCGTCGGCG GGATGGTGTT CGTATCCGTC CCAATGGATG CGGTAAAGGC

351   TGAATCCGTC AACGGGACTA CCGGCTTCAT CAGAATCGGA ATGTGA
```

This corresponds to the amino acid sequence <SEQ ID 2278; ORF 686.a>:

a686.pep (partial)

```
  1 ..NFSCRADDVF DDICSAVESF GGIARSVQLG AVSGGAFESV AYSLRQHTTG
 51   IVETVDKPLS GAAVVGQVEA DILGNAFYVV AVYIPRAFGS GIAAALWPVI
101   AVGGMVFVSV PMDAVKAESV NGTTGFIRIG M*
```

Computer analysis of this amino acid sequence gave the following results:

Homology with a predicted ORF from *N. meningitidis*

ORF 686 shows 96.2% identity over a 131 aa overlap with a predicted ORF (ORF 686) from *N. meningitidis:* m686/a686 96.2% identity in 131 aa overlap

```
                10        20        30        40        50        60
m686.pep  LKKFVLGGIAALVLAACGGSEGGSGAXXXXNFSCSADDVFNDICSAVEGFGGIARSVQLG
                                        |||| |||||:|||||||:||||||||||
a686                                    NFSCRADDVFDDICSAVESFGGIARSVQLG
                                                10        20        30

                70        80        90       100       110       120
m686.pep  AVSGGAFESVAYSLRQHTTGIVETVGKPLSGAAVVGQVEADILGNAFYVVAVYIPRAFGS
          |||||||||||||||||||||||| |||||||||||||||||||||||||||||||||||
a686      AVSGGAFESVAYSLRQHTTGIVETVDKPLSGAAVVGQVEADILGNAFYVVAVYIPRAFGS
                  40        50        60        70        80        90

               130       140       150       160
m686.pep  GIAAALWPVIAVGGMVFVSVPMDAVKAKSVNGTTGFIRIGMX
          ||||||||||||||||||||||||||:|||||||||||||||
a686      GIAAALWPVIAVGGMVFVSVPMDAVKAESVNGTTGFIRIGMX
                130       140       150       160
```

The following partial DNA sequence was identified in *N. gonorrhoeae* <SEQ ID 2279> g687.seq

```
  1 ATGAAATCCA GACACCTCGC CCTCGCCCTC GGCGTTGCCG CCCTGTTCGC
 51 CCTTGCCGCG TGCGACAGCA AAGTCCAAAC CAGCGTCCCC GCCGACAGCG
101 CGCCTGCCGC TTCGGCAGCC GCCGCCCCGG CAGGACTGGT CGAAGGGCAA
151 AACTACACCG TCCTTGCCAA CCCGATTCCC CAACAGCAGG CAGGCAAGGT
201 TGAAGTGCTT GAGTTTTTCG GCTATTTTTG TCCGCACTGC GCCCGCCTcg
251 AACCTGTTTT GAGCAAACAC GCCAAGTCTT TTAAAGACGA TATGTACCTG
301 CGTACCGAAC ACGTCGTCTG GCAGAAAGAA ATGCTGCCGC TGGCACGCct
351 cGCCGCCGCC GTCGATATGG CTGCCGCCGA AAGCAAAGAT GTGGCGAACA
401 GCCATATTTT CGATGCGATG GTCAACCAAA AAATCAAGCT GCAAGAGCCG
451 GAAGTCCTCA AAAAATGGCT GGGCGAACAa ACcgcctTTG ACGGCAAAAA
501 AGTCCTTGCC GCCTACGAAT CCCCCGAAAG TCAGGCGCGC GCcggcAAAA
551 TGCAGGAGCT GACCGAAACC TTCCAAATCG ACGGTACGCC CACGGTTATC
601 GTCGGCGGCA AATATAAAGT CGAATTTGCC GACTGGGAGT CCGGTATGAA
651 CACCATCGAC CTTTTGGCGG ACAAAGTACG TGAAGAACAA AAAGCCGCGC
701 AGTAG
```

This corresponds to the amino acid sequence <2280 ID 724; ORF 687>:

g687.pep

```
  1 MKSRHLALAL GVAALFALAA CDSKVQTSVP ADSAPAASAA AAPAGLVEGQ
 51 NYTVLANPIP QQQAGKVEVL EFFGYFCPHC ARLEPVLSKH AKSFKDDMYL
101 RTEHVVWQKE MLPLARLAAA VDMAAAESKD VANSHIFDAM VNQKIKLQEP
151 EVLKKWLGEQ TAFDGKKVLA AYESPESQAR AGKMQELTET FQIDGTPTVI
201 VGGKYKVEFA DWESGMNTID LLADKVREEQ KAAQ*
```

The following partial DNA sequence was identified in *N. meningitidis* <SEQ ID 2281>:

m687.seq

```
  1 ATGAAATCCA GACACCTTGC CCTCgGCGTT GCCGCCCTGT TCGCCCTTGC
 51 CGCGTGCGAC AGCAAAGTCC AAACCAGCGT CCCCGCCGAC AGCGCGCCTG
101 CCGCTTCGGC AGCCGCCGCC CCGGCAGGGC TGGTCGAAGG GCAAAACTAT
151 ACCGTCCTTG CCAACCCGAT TCCCCAACAG CAGGCAGGCA AAGTCGAAGT
201 CCTTGAGTTT TTCGGCTATT TCTGTCCGCA CTGCGCCCAC CTCGAACCTG
251 TTTTAAGCAA ACACGCCAAG TCTTTTAAAG ACGATATGTA CCTGCGTACC
301 GAACACGTCG TCTGGCAGAA AGAAATGCTG ACGCTGGCAC GCCTCGCCGC
351 CGCCGTCGAT ATGGCTGCCG CCGACAGCAA AGATGTGGCG AACAGCCATA
401 TTTTCGATGC GATGGTCAAC CAAAAAATCA AGCTGCAAAA TCCGGAAGTC
451 CTCAAAAAAT GGCTGGGCGA ACAAACCGCC TTTGACGGCA AAAAAGTCCT
501 TGCCGCCTAC GAGTCCCCCG AAAGCCAGGC GCGCGCCGAC AAAATGCAGG
551 AGCTGACCGA AACCTTCCAA ATCGACGGTA CGCCCACGGT TATCGTCGGC
601 GGTAAATATA AAGTTGAATT TGCCGACTGG GAGTCCGGTA TGAACACCAT
651 CGACCTTTTG GCGGACAAAG TACGCGAAGA ACAAAAAGCC GCGCAGTAA
```

This corresponds to the amino acid sequence <SEQ ID 2282; ORF 687>:

m697.pep

```
  1 MKSRHLALGV AALFALAACD SKVQTSVPAD SAPAASAAAA PAGLVEGQNY
 51 TVLANPIPQQ QAGKVEVLEF FGYFCPHCAH LEPVLSKHAK SFKDDMYLRT
101 EHVVWQKEML TLARLAAAVD MAAADSKDVA NSHIFDAMVN QKIKLQNPEV
151 LKKWLGEQTA FDGKKVLAAY ESPESQARAD KMQELTETFQ IDGTPTVIVG
201 GKYKVEFADW ESGMNTIDLL ADKVREEQKA AQ*
```

Computer analysis of this amino acid sequence gave the following results:

Homology with a predicted ORF from *N. gonorrhoeae*

ORF 687 shows 97.0% identity over a 234 aa overlap with a predicted ORF (ORF 687) from *N. gonorrhoeae:* m687/g687 97.0% identity in 234 aa overlap

```
                      10        20        30        40        50
m687.pep    MKSRHLAL--GVAALFALAACDSKVQTSVPADSAPAASAAAAPAGLVEGQNYTVLANPIP
            ||||||||  ||||||||||||||||||||||||||||||||||||||||||||||||||
g687        MKSRHLALALGVAALFALAACDSKVQTSVPADSAPAASAAAAPAGLVEGQNYTVLANPIP
                    10        20        30        40        50        60

            60        70        80        90        100       110
m687.pep    QQQAGKVEVLEFFGYFCPHCAHLEPVLSKHAKSFKDDMYLRTEHVVWQKEMLTLARLAAA
            |||||||||||||||||||||:|||||||||||||||||||||||||||||| |||||||
g687        QQQAGKVEVLEFFGYFCPHCARLEPVLSKHAKSFKDDMYLRTEHVVWQKEMLPLARLAAA
                    70        80        90        100       110       120

           120       130       140       150       160       170
m687.pep    VDMAAADSKDVANSHIFDAMVNQKIKLQNPEVLKKWLGEQTAFDGKKVLAAYESPESQAR
            ||||||:|||||||||||||||||||||:|||||||||||||||||||||||||||||||
g687        VDMAAAESKDVANSHIFDAMVNQKIKLQEPEVLKKWLGEQTAFDGKKVLAAYESPESQAR
                   130       140       150       160       170       180

           180       190       200       210       220       230
m687.pep    ADKMQELTETFQIDGTPTVIVGGKYKVEFADWESGMNTIDLLADKVREEQKAAQX
            | |||||||||||||||||||||||||||||||||||||||||||||||||||||
g687        AGKMQELTETFQIDGTPTVIVGGKYKVEFADWESGMNTIDLLADKVREEQKAAQX
                   190       200       210       220       230
```

The following partial DNA sequence was identified in *N. meningitidis* <SEQ ID 2283> a687.seq

```
  1 ATGAAATCCA AACACCTCGC CCTCGGCGTT GCCGCCCTGT TCGCACTTGC
 51 CGCGTGCGAC AGCAAAGTCC AAACCAGCGT CCCCGCCGAC AGCGCGCCTG
101 CCGCTTCGGC AGCCGCCGCC CCGGCAGGGC TGGTCGAAGG GCAAAACTAT
151 ACTGTCCTTG CCAACCCGAT TCCCCAACAG CAGGCAGGCA AAGTCGAAGT
201 CCTTGAGTTT TTCGGCTATT TCTGTCCGCA CTGCGCCCAC CTCGAACCTG
251 TTTTAAGCAA ACACGCCAAG TCTTTTAAAG ACGATATGTA CCTGCGTACC
301 GAACACGTCG TCTGGCAGAA AGAAATGCTG ACGCTCGCAC GCCTCGCCGC
351 CGCCGTCGAT ATGGCTGCCG CCGACAGCAA AGATGTGGCG AACAGCCATA
401 TTTTCGATGC GATGGTCAAC CAAAAAATCA AGCTGCAAGA GCCGGAAGTC
451 CTCAAAAAAT GGCTGGGCGA ACAAACCGCC TTTGACGGCA AAAAAGTCCT
501 TGCCGCTTAC GAATCTCCCG AAAGCCAGGC GCGCGCCGAC AAAATGCAGG
551 AGCTGACCGA AACCTTCCAA ATCGACGGTA CGCCCACGGT TATCGTCGGC
601 GGCAAATATA AAGTCGAATT TGCCGACTGG GAGTCCGGTA TGAACACCAT
651 CGACCTTTTG GCGGACAAAG TACGCGAAGA ACAAAAAGCC GCGCACTAA
```

This corresponds to the amino acid sequence <SEQ ID 2284; ORF 687.a>:

a687.pep

```
  1 MKSKHLALGV AALFALAACD SKVQTSVPAD SAPAASAAAA PAGLVEGQNY
 51 TVLANPIPQQ QAGKVEVLEF FGYFCPHCAH LEPVLSKHAK SFKDDMYLRT
101 EHVVWQKEML TLARLAAAVD MAAADSKDVA NSHIFDAMVN QKIKLQEPEV
151 LKKWLGEQTA FDGKKVLAAY ESPESQARAD KMQELTETFQ IDGTPTVIVG
201 GKYKVEFADW ESGMNTIDLL ADKVREEQKA AH*
```

Computer analysis of this amino acid sequence gave the following results:

Homology with a predicted ORF from *N. meningitidis*

ORF 687 shows 98.7% identity over a 232 aa overlap with a predicted ORF (ORF 687) from *N meningitidis:* m687/a687 98.7% identity in 232 aa overlap

```
                   10        20        30        40        50        60
m687.pep   MKSRHLALGVAALFALAACDSKVQTSVPADSAPAASAAAAPAGLVEGQNYTVLANPIPQQ
           |||:||||||||||||||||||||||||||||||||||||||||||||||||||||||||
a687       MKSKHLALGVAALFALAACDSKVQTSVPADSAPAASAAAAPAGLVEGQNYTVLANPIPQQ
                   10        20        30        40        50        60

                   70        80        90       100       110       120
m687.pep   QAGKVEVLEFFGYFCPHCAHLEPVLSKHAKSFKDDMYLRTEHVVWQKEMLTLARLAAAVD
           ||||||||||||||||||||||||||||||||||||||||||||||||||||||||||||
a687       QAGKVEVLEFFGYFCPHCAHLEPVLSKHAKSFKDDMYLRTEHVVWQKEMLTLARLAAAVD
                   70        80        90       100       110       120

                  130       140       150       160       170       180
m687.pep   MAAADSKDVANSHIFDAMVNQKIKLQNPEVLKKWLGEQTAFDGKKVLAAYESPESQARAD
           ||||||||||||||||||||||||||:|||||||||||||||||||||||||||||||||
a687       MAAADSKDVANSHIFDAMVNQKIKLQEPEVLKKWLGEQTAFDGKKVLAAYESPESQARAD
                  130       140       150       160       170       180

                  190       200       210       220       230
m687.pep   KMQELTETFQIDGTPTVIVGGKYKVEFADWESGMNTIDLLADKVREEQKAAQX
           |||||||||||||||||||||||||||||||||||||||||||||||||||:|
a687       KMQELTETFQIDGTPTVIVGGKYKVEFADWESGMNTIDLLADKVREEQKAAHX
                  190       200       210       220       230
```

The following partial DNA sequence was identified in *N. gonorrhoeae* <SEQ ID 2285> g688.seq

```
  1 GTGCTACACT AGACATCCCG ATTTGCACAG AAAGGTTCTC CCGTGAACAA

 51 AACCCTCATC CTCGCCCTTT CCGCCCTGTT CAGCCTGACC GCGTGCAGCG

101 TCGAACGCGT CTCGCTGTTT CCCTCCTACA AACTCAAAAT CATCCAAGGC

151 AACGAACTCG AACCGCGCGC CGTTGCCGCC CTGCGCCCCG GCATGACCAA

201 AGACCAAGTC CTGCTCCTGC TCGGCAGCCC CATACTGCGC GACGCTTTCC

251 ATACCGACCG CTGGGACTAT ACCTTCAACA CCTCCCGCAA CGGCATCATC

301 AAAGAACGCA GCAACCTGAC CGTCTATTTT GAAAACGGCG TACTCGTCCG

351 CACCGAAGGC GACGCCCTCC AAAATGCCGC CGAAGCCCTC CGCGCGAAAC

401 AAAACGCAGA CAAACAATAA
```

This corresponds to the amino acid sequence <SEQ ID 2286; ORF 688>:

g688.pep

```
  1 VLH*TSRFAQ KGSPVNKTLI LALSALFSLT ACSVERVSLF PSYKLKIIQG

 51 NELEPRAVAA LRPGMTKDQV LLLLGSPILR DAFHTDRWDY TFNTSRNGII

101 KERSNLTVYF ENGVLVRTEG DALQNAAEAL RAKQNADKQ*
```

The following partial DNA sequence was identified in *N. meningitidis* <SEQ ID 2287>:

m688.seq

```
  1 GTGTTACACT ACCCATCCCG ATTTGCACAG AAAGGCATTT CCGTGAACAA

 51 AACCCTCATC CTCGCCCTTT CCGCCCTCCT CGGCCTTGCC GCGTGCAGTG

101 CCGAACGCGT TTCACTGTTC CCCTCGTACA AACTCAAAAT CATACAGGGC

151 AACGAACTCG AACCGCGCGC CGTTGCCGCC CTCCGCCCCG GCATGACCAA

201 AGACCAAGTC CTGCTCCTGC TCGGCAGCCC CATACTGCGC GACGCATTCC

251 ATACCGACCG CTGGGACTAT ACCTTCAACA CCTCCCGCAA CGGCATCATC

301 AAAGAACGCA GCAATCTGAC CGTCTATTTT GAAAACGGCG TACTCGTCCG

351 CACCGAAGGC GACGTCCTGC AAAACGCTGC CGAAGCCCTC AAAGACCGCC

401 AAAACACAGA CAAACCATAA
```

This corresponds to the amino acid sequence <SEQ ID 2288; ORF 688>:

m688.pep

```
  1 VLHYPSRFAQ KGISVNKTLI LALSALLGLA ACSAERVSLF PSYKLKIIQG

 51 NELEPRAVAA LRPGMTKDQV LLLLGSPILR DAFHTDRWDY TFNTSRNGII

101 KERSNLTVYF ENGVLVRTEG DVLQNAAEAL KDRQNTDKP*
```

Computer analysis of this amino acid sequence gave the following results:

Homology with a predicted ORF from *N. gonorrhoeae*

ORF 688 shows 90.6% identity over a 138 aa overlap with a predicted ORF (ORF 688) from *N. gonorrhoeae:* m688/g688 90.6% identity in 138 aa overlap

```
                    10        20        30        40        50        60
m688.pep    VLHYPSRFAQKGISVNKTLILALSALLGLAACSAERVSLFPSYKLKIIQGNELEPRAVAA
            |||  |||||||  ||||||||||||::|:|||:||||||||||||||||||||||||||
g688        VLHXTSRFAQKGSPVNKTLILALSALFSLTACSVERVSLFPSYKLKIIQGNELEPRAVAA
                    10        20        30        40        50        60

                    70        80        90       100       110       120
m688.pep    LRPGMTKDQVLLLLGSPILRDAFHTDRWDYTFNTSRNGIIKERSNLTVYFENGVLVRTEG
            ||||||||||||||||||||||||||||||||||||||||||||||||||||||||||||
g688        LRPGMTKDQVLLLLGSPILRDAFHTDRWDYTFNTSRNGIIKERSNLTVYFENGVLVRTEG
                    70        80        90       100       110       120

                   130       140
m688.pep    DVLQNAAEALKDRQNTDKPX
            |:||||||||: :||:||
g688        DALQNAAEALRAKQNADKQX
                   130       140
```

The following partial DNA sequence was identified in *N. meningitidis* <SEQ ID 2289> a688.seq

```
  1 GTGTTACACT ACCCATCCCG ATTTGCACAG AAAGGCATTT CCGTGAACAA

 51 AACCCTCATC CTCGCCCTTT CCGCCCTCCT CGGCCTTGCC GCGTGCAGCG

101 TCGAACGCGT TTCACTGTTC CCCTCGTACA AACTCAAAAT CATACAGGGC

151 AACGAACTCG AACCTCGCGC CGTCGCCTCC CTCCGCCCCG GTATGACCAA
```

-continued

```
201 AGACCAAGTC CTGCTCCTGC TCGGCAGCCC CATACTGCGC GACGCATTCC

251 ATACCGACCG CTGGGACTAT ACCTTCAACA CCTCCCGCAA CGGCATCATC

301 AAAGACCGAA GCAATCTGAC CGTCTATTTT GAAAACGGCG TGCTCGTCCG

351 CACCGAAGGC AACGCCCTGC AAAATGCCGC CGAAGCCCTC CGCGTAAAAC

401 AAAACGCAGA CAAACAATAA
```

This corresponds to the amino acid sequence <SEQ ID 2290; ORF 688.a>:

a688.pep

```
  1 VLHYPSRFAQ KGISVNKTLI LALSALLGLA ACSVERVSLF PSYKLKIIQG

 51 NELEPRAVAS LRPGMTKDQV LLLLGSPILR DAFHTDRWDY TFNTSRNGII

101 KDRSNLTVYF ENGVLVRTEG NALQNAAEAL RVKQNADKQ*
```

Computer analysis of this amino acid sequence gave the following results:

Homology with a predicted ORF from *N. meningitidis*

ORF 688 shows 93.5% identity over a 138 aa overlap with a predicted ORF (ORF 688) from *N. meningitidis* m688/a688 93.5% identity in 138 aa overlap

```
                  10        20        30        40        50        60
m688.pep   VLHYPSRFAQKGISVNKTLILALSALLGLAACSAERVSLFPSYKLKIIQGNELEPRAVAA
           ||||||||||||||||||||||||||||||||||||:||||||||||||||||||||||:
a688       VLHYPSRFAQKGISVNKTLILALSALLGLAACSVERVSLFPSYKLKIIQGNELEPRAVAS
                  10        20        30        40        50        60

                  70        80        90       100       110       120
m688.pep   LRPGMTKDQVLLLLGSPILRDAFHTDRWDYTFNTSRNGIIKERSNLTVYFENGVLVRTEG
           ||||||||||||||||||||||||||||||||||||||||||:|||||||||||||||||
a688       LRPGMTKDQVLLLLGSPILRDAFHTDRWDYTFNTSRNGIIKDRSNLTVYFENGVLVRTEG
                  70        80        90       100       110       120

                 130       140
m688.pep   DVLQNAAEALKDRQNTDKPX
           ::||||||||: :||:||
a688       NALQNAAEALRVKQNADKQX
                 130       140
```

The following partial DNA sequence was identified in *N. gonorrhoeae* <SEQ ID 2291> g689.seq (partial)

```
  1 ..TCTCCGCCCC TTCCTCCGAT GAGCGGAAAA CTGATGGCGG TTTTGATGGC

 51   GGTACTGGTC GCGCTGATGC CGTTTTCCAT CGATGCCTAC CTGCCCGCGA

101   TTCCCGAAAT GGCGCAGCCG CTGAACGCGG ATATCCACCG TATCGAATAG

151   AGTCTGAGTT TGTTTATGTT CGGCACGGCG TTCGGGCAAG TGGCCGGCGG

201   CGCGGTGTCC GACATCAAAG GGCGCAAACC CGTCGCCCTG ACCGGTTTGA

251   TTGTATATTG CCTTGCCGTT GCCGCCATCG TATTTGCTTC GAGTACCGAA

301   CAGCTCCTTA ACCTGCGTGC GGTACAGGCG TTCGGCGCAG GCATGGCTGT

351   AGTCATCGTc ggtgcgatgg tgcgcgatTA TTATTCCGGA CGCAAAGCCG
```

-continued

```
 401  cgcAGATGTT TGCCCTTATC GGCATCATTC TGATGGTTGT GCCGCTGGCC
 451  GCACCCATGG TCGGCGCATT GTTGCAGGGA TTGGGCGGAT GGCGGGCGAT
 501  TTTCGTTTTC ttggcGgcgT ATTCGCCGGT GCTGCCCGGT TTGGTACAGT
 551  ATTTCCTGCC CAATCCCGCC GTCGGCGGCA AAATCGGCAG GGATGTGTTC
 601  GGGCTGGTGG CGGGGCGGTT CAAGCGCGTA TTGAAAACCC GTGCCGCGAT
 651  GGGTtatCTG TTTTTTCAGG CATTCAGCTT CGGTTCGATG TTCGCCTTTC
 701  TGACCGAATC TTCCTTCGTG TACCGGCAGC TCTACCACGT TACGCCGCAC
 751  CGGTACGCAT GGGTGTTTGC ACTCAACATC ATCACGATGA TGTTTTTCAG
 801  CCGCGTTACC GCGTGGCGGC TTAAAACCGG CGCGCATCCG CAAAGCATCC
 851  TGCTGCGGGG GATTGTCGTC CAATTTGCCG CCAACCCGTC CCAACTCGCC
 901  GCCGTGCTGT TTTTCGGGTT GCCCCCGTTT TGGCTGCCGG TCGCGTGCGT
 951  GATGTTTTCC GTCGGTACGC AGGGCCTGGT CGGTGCGGAC ACGCAGGCAT
1001  GCTTTATGTC TTATTTCAAA GAAGAGGGCG GCAGCGCGAA CGCCGTCTCG
1051  GGTGTATTCC GGTCCTTAAT CGGCGCGGGC GTGGTCATGG CGGCAACCGT
1101  GATGGCGGCA ACCATGACCG CGTCCGCCTC TTGCGGCATT GCGCTTTTGT
1151  GGCTCTGCTC GCACAAGGCG TGGAAGGAAA ACGAAAAAAA GCGAATACTT
```

This corresponds to the amino acid sequence <SEQ ID 2292; ORF 689>:

g689.pep (partial)

```
  1 ..SPPLPPMSGK LMAVLMAVLV ALMPFSIDAY LPAIPEMAQP LNADIHRIE*
 51   SLSLFMFGTA FGQVAGGAVS DIKGRKPVAL TGLIVYCLAV AAIVFASSTE
101   QLLNLRAVQA FGAGMAVVIV GAMVRDYYSG RKAAQMFALI GIILMVVPLA
151   APMVGALLQG LGGWRAIFVF LAAYSPVLPG LVQYFLPNPA VGGBIGRDVF
201   GLVAGRFKRV LKTRAAMGYL FFQAFSFGSM FAFLTESSFV YRQLYHVTPH
251   RYAWVFALNI ITMMFFSRVT AWRLKTGAHP QSILLRGIVV QFAANPSQLA
301   AVLFFGLPPF WLPVACVMFS VGTQGLVGAD TQACFMSYFK EEGGSANAVS
351   GVFRSLIGAG VVMAATVMAA TMTASASCGI ALLWLCSHKA WKENEKKRIL
```

The following partial DNA sequence was identified in *N. meningitidis* <SEQ ID 2293>:

m689.seq

```
  1 TTGTTAATCC ACTATATCGT TCCGGTTCGT CCGGTTTTGC CGGGGCTTTT
 51 GTTGCCGCCT GTTTGTGCCG GTGTGTTAAA ATTTTCCGTT TCCGCGTATT
101 GTGTTTTCCG CCGCCGGGCG GTTTGTTTGC GAATCGGACG AGAATTTATG
151 CCTTCTGCCC ATTATCCTGA AATGAGCGAA AAACTGATGG CGGTTTTGAT
201 GGCGATGCTG GTTACGCTGA TGCCGTTTTC CATCGATGCC TACCTGCCCG
251 CGATTCCCGA AATGGCGCAA TCGCTGAACG CGGATGTTCA CCGCATCGAA
301 CAGAGTTTGA GTTTGTTTAT GTTCGGCACG GCGTTCGGAC AGGTGGTCGG
351 CGGTTCGGTG TCCGACATCA AAGGGCGCAA ACCCGTCGCC CTGACCGGTT
```

-continued

```
 401 TGATTGTATA TTGCCTTGCC GTTGCCGCCA TCGTATTTGT TTCGAGTGCC
 451 GAACAGCTCC TCAACCTGCG CGTCGTGCAG GCATTCGGTG CGGGCATGAC
 501 TGTGGTCATC GTCGGCGCAA TGGTGCGCGA TTATTATTCC GGACGCAAAG
 551 CCGCCCAGAT GTTTGCCCTT ATCGGCATCA TTTTGATGGT TGTGCCGCTG
 601 GTCGCACCCA TGGTCGGCGC ATTGTTGCAG GGCTTGGGTG GCTGGCAGGC
 651 GATTTTTGTT TTTCTGGCGG CGTATTCGCT GGTGCTGCTC GGTTTGGTAC
 701 AGTATTTCCT GCCCAAGCCC GCCGTCGGCG GCAAAATCGG ACGGGACGTG
 751 TTCGGGCTGG TGGCGGGGCG GTTCAAGCGC GTATTGAAAA CCCGTGCTGC
 801 GATGGGTTAT CTGTTTTTTC AGGCATTCAG CTTCGGTTCG ATGTTCGCCT
 851 TTCTGACCGA ATCTTCCTTC GTGTACCAGC AGCTCTACCG TGTTACGCCT
 901 CATCAATACG CTTGGGCGTT TGCACTCAAC ATCATCACGA TGATGTTTTT
 951 CAACCGCGTT ACCGCGTGGC GGCTCAAAAC CGGCGTGCAT CCGCAAAGCA
1001 TCCTGCTGTG GGGGATTGTC GTCCAGTTTG CCGCCAACCT GTCCCAACTC
1051 GCCGCCGTGC TGTTTTTCGG GTTGCCCCCG TTTTGGCTGC TGGTCGCGTG
1101 CGTGATGTTT TCCGTCGGTA CGCAGGGCTT GGTCGGTGCA AACACGCAGG
1151 CGTGTTTTAT GTCCTATTTC AAAGAAGAGG GCGGCAGCGC AAACGCCGTA
1201 TTGGGTGTAT TCCAATCTTT AATCGGCGCG GGGGTGGGTA TGGCGGCGAC
1251 CTTCTTGCAC GACGGTTCGG CAACCGTGAT GGCGGCAACG ATGACCGCGT
1301 CCACCTCTTG CGGCATTGCG CTTCTGTGGC TCTGCTCGCA TCGTGCGTGG
1351 AAAGAAAACG GGCAAAGCGA ATACCTTTAA
```

This corresponds to the amino acid sequence <SEQ ID 2294; ORF 689>:

m689.pep

```
  1 LLIHYIVPVR PVLPGLLLPP VCAGVLKFSV SAYCVFRRRA VCLRIGREFM
 51 PSAHYPEMSE KLMAVLMANL VTLMPFSIDA YLPAIPEMAQ SLNADVHRIE
101 QSLSLFMFGT AFGQVVGGSV SDIKGRKPVA LTGLIVYCLA VAAIVFVSSA
151 EQLLNLRVVQ AFGAGMTVVI VGAMVRDYYS GRKAAQMFAL IGIILMVVPL
201 VAPMVGALLQ GLGGWQAIFV FLAAYSLVLL GLVQYFLPKP AVGGKIGRDV
251 FGLVAGRFKR VLKTRAAMGY LFFQAFSFGS MFAFLTESSF VYQQLYRVTP
301 HQYAWAFALN IITMMFFNRV TAWRLKTGVH PQSILLWGIV VQFAANLSQL
351 AAVLFFGLPP FWLLVACVMF SVGTQGLVGA NTQACFMSYF KEEGGSANAV
401 LGVFQSLIGA GVGMAATFLH DGSATVMAAT MTASTSCGIA LLWLCSHRAW
451 KENGQSEYL*
```

Computer analysis of this amino acid sequence gave the following results:

Homology with a predicted ORF from *N. gonorrhoeae*

ORF 689 shows 88.0% identity over a 408 aa overlap with a predicted ORF (ORF 689) from *N. gonorrhoeae:* m689/a689 88.0% identity in 408 aa overlap

```
                30        40        50        60        70        80
m689.pep  CAGVLKFSVSAYCVFRRRAVCLRIGREEMPSAHYPEMSEKLMAVLMAMLVTLMPFSIDAY
                                            |   |  ||  |||||||:||:||||||||
g689                                        SPPLPPMSGKLMAVLMAVLVALMPFSIDAY
                                                    10        20        30

                90       100       110       120       130       140
m689.pep  LPAIPEMAQSLNADVHRIEQSLSLFMFGTAFGQVVGGSVSDIKGRKPVALTGLIVYCLAV
          |||||||| ||||:|||| |||||||||||||:||:||||||||||||||||||||||||
g689      LPAIPEMAQPLNADIHRIEXSLSLFMFGTAFGQVAGGAVSDIKGRKPVALTGLIVYCLAV
                  40        50        60        70        80        90

                150       160       170       180       190       200
m689.pep  AAIVFVSSAEQLLNLRVVQAFGAGMTVVIVGAMVRDYYSGRKAAQMFALIGIILMVVPLV
          |||||:||:|||||||:|||||||:||||||||||||||||||||||||||||||||||:
g689      AAIVFASSTEQLLNLRAVQAFGAGMAVVIVGAMVRDYYSGRKAAQMFALIGIILMVVPLA
                 100       110       120       130       140       150

                210       220       230       240       250       260
m689.pep  APMVGALLQGLGGWQAIFVFLAAYSLVLLGLVQYFLPKPAVGGKIGRDVFGLVAGRFKRV
          |||||||||||||:||||||||||| || ||||||||:||||||||||||||||||||||
g689      APMVGALLQGLGGWRAIFVFLAAYSPVLPGLVQYFLPNPAVGGKIGRDVFGLVAGRFKRV
                 160       170       180       190       200       210

              270       280       290      3000       310       320
m689.pep  LKTRAAMGYLFFQAFSFGSMFAFLTESSFVYQQLYRVTPHQYAWAFALNIITMMFFNRVT
          ||||||||||||||||||||||||||||||:|||:||||:|||:|||||||||||:|||
g689      LKTRAAMGYLFFQAFSFGSMFAFLTESSFVYRQLYHVTPHRYAWVFALNIITMMFFSRVT
                 220       230       240       250       260       270

                330       340       350       360       370       380
m689.pep  AWRLKTGVHPQSILLWGIVVQFAANLSQLAAVLFFGLPPFWLLVACVMFSVGTQGLVGAN
          ||||||:||||||| ||||||||| ||||||||||||||| |||||||||||||||:
g689      AWRLKTGAHPQSILLRGIVVQFAANPSQLAAVLFFGLPPFWLPVACVMFSVGTQGLVGAD
                 280       290       300       310       320       330

                390       400       410       420       430       440
m689.pep  TQACFMSYFKEEGGSANAVLGVFQSLIGAGVGMAATFLHDGSATVMAATMTASTSCGIAL
          |||||||||||||||||| |||:||||||| ||||        |||||||||:||||||
g689      TQACFMSYFKEEGGSANAVSGVFRSLIGAGVVMAAT--------VMAATMTASASCGIAL
                 340       350       360                 370       380

              450       460
m689.pep  LWLCSHRAWKENGQSEYLX
          ||||||:||||| ::: |
g689      LWLCSHKAWKENEKKRIL
              390       400
```

The following partial DNA sequence was identified in *N. meningitidis* <SEQ ID 2295> a689.seq

```
  1 TTGTTAATCC ACTATATCGT TCCGGTTCGT CCGGTTTTGC CGGGGCTTTT
 51 GTTGCCGCCT GTTTGTGCCG GTGTGTTAAA ATTTTCCGTT TCCGCGTATT
101 GTGTTTTCCG CCGCCGGGCG GTTTGTTTGC GAATCGGACG AGAATTTATG
151 CCTTCTGCCC ATTATCCTGA AATGAGCGAA AAACTGATGG CGGTTTTGAT
201 GGCGATGCTG GTTACGCTGA TGCCGTTTTC CATCGATGCC TACCTGCCCG
251 CGATTCCCGA AATGGCGCAG TCGCTGAACG CGGATGTCCA CCGCATCGAA
301 CAGAGCCTGA GTTTGTTTAT GTTCGGCACG GCGTTCGGAC AGGTGGTCGG
351 CGGTTCGGTG TCCGACATCA AAGGGCGCAA ACCCGTCGCG CTGACCGGAC
401 TGGCCGTCTA CTGCCTTGCC GTTGCCGCCA TCGTATTTGC TTCGAGTGCC
451 GAACAGCTCC TCAACCTGCG CGTCGTGCAG GCATTCGGTG CGGGCATGAC
501 TGTGGTCATC GTCGGCGCAA TGGTGCGCGA TTATTATTCC GGACGCAAAG
551 CCGCCCAGAT GTTTGCCCTT ATCGGCATCA TTTTGATGGT TGTGCCGCTG
601 GTCGCACCCA TGGTCGGCGC ATTGTTGCAG GGCTTGGGTG GCTGGCAGGC
651 GATTTTTGTT TTTCTGGCGG CGTATTCGCT GGTGCTGCTC GGTTTGGTAC
701 AGTATTTCCT GCCCAAGCCC GCCGTCGGCG GCAAAATCGG CAGGGATGTG
751 TTCGGGCTGG TGGCTGGGCG GTTCAAACGC GTATTGAAAA CCCGTGCCGC
```

-continued

```
 801 GATGGGTTAT CTGTTTTTTC AGGCATTCAG CTTCGGTTCG ATGTTCGCCT

 851 TTCTGACCGA ATCTTCCTTC GTGTACCAGC AGCTCTACCA CGTTACGCCG

 901 CACCAGTACG CTTGGGCGTT TGCACTCAAC ATCATCACGA TGATGTTTTT

 951 CAACCGTATT ACCGCGTGGC GGCTCAAAAC CGGCGTGCAT CCGCAAAGCA

1001 TCCTGCTGTG GGGGATTGTC GTCCAGTTTG CCGCCAACCT GTCCCAACTC

1051 GCCGCCGTGC TGTTTTTCGG GTTGCCCCCG TTTTGGCTGC TGGTCGCGTG

1101 CGTGATGTTT TCCGTCGGTA CGCAGGGCTT GGTCGGTGCA AACACGCAGG

1151 CGTGTTTTAT GTCCTATTTC AAAGAAGAGG GCGGCAGCGC AAACGCCGTA

1201 TTGGGTGTAT TCCAATCTTT AATCGGCGCG GGGGTGGGTA TGGCGGCGAC

1251 CTTCTTGCAC GACGGTTCGG CAACCGTGAT GGCGGCAACC ATGACCGCGT

1301 CTACCTCTTG CGGCATTGCG CTTTTGTGGC TCTGCTCGCA TCGTGCGTGG

1351 AAAGAAAACG GGCAAAGCGA ATACCTTTAA
```

This corresponds to the amino acid sequence <SEQ ID 2296; ORF 689.a>:

```
a689.pep

  1 LLIHYIVPVR PVLPGLLLPP VCAGVLKFSV SAYCVFRRRA VCLRIGREFM

 51 PSAHYPEMSE KLMAVLMAML VTLMPFSIDA YLPAIPEMAQ SLNADVHRIE

101 QSLSLFMFGT AFGQVVGGSV SDIKGRKPVA LTGLAVYCLA VAAIVFASSA

151 EQLLNLRVVQ AFGAGMTVVI VGAMVRDYYS GRKAAQMFAL IGIILMVVPL

201 VAPMVGALLQ GLGGWQAIFV FLAAYSLVLL GLVQYFLPKP AVGGKIGRDV

251 FGLVAGRFKR VLKTRAAMGY LFFQAFSFGS MFAFLTESSF VYQQLYHVTP

301 HQYAWAFALN IITMMFFNRI TAWRLKTGVH PQSILLWGIV VQFAANLSQL

351 AAVLFFGLPP FWLLVACVMF SVGTQGLVGA NTQACFMSYF KEEGGSANAV

401 LGVFQSLIGA GVGMAATFLH DGSATVMAAT MTASTSCGIA LLWLCSHRAW

451 KENGQSEYL*
```

Computer analysis of this amino acid sequence gave the following results:

Homology with a predicted ORF from *N. meningitidis*

ORF 689 shows 99.1% identity over a 459 aa overlap with a predicted ORF (ORF 689) from *N. meningitidis:* m689/a689 99.1% identity in 459 aa overlap

```
                   10        20        30        40        50        60
m689.pep   LLIHYIVPVRPVLPGLLLPPVCAGVLKFSVSAYCVFRRRAVCLRIGREEMPSAHYPEMSE
           |||||||||||||||||||||||||||||||||||||||||||||||||||||||||||||
a689       LLIHYIVPVRPVLPGLLLPPVCAGVLKFSVSAYCVFRRRAVCLRIGREFMPSAHYPEMSE
                   10        20        30        40        50        60

                   70        80        90       100       110       120
m689.pep   KLMAVLMAMLVTLMPFSIDAYLPAIPEMAQSLNADVHRIEQSLSLFMFGTAFGQVVGGSV
           ||||||||||||||||||||||||||||||||||||||||||||||||||||||||||||
a689       KLMAVLMAMLVTLMPFSIDAYLPAIPEMAQSLNADVHRIEQSLSLFMFGTAFGQVVGGSV
                   70        80        90       100       110       120
```

-continued

```
                   130       140       150       160       170       180
m689.pep    SDIKGRKPVALTGLIVYCLAVAAIVFVSSAEQLLNLRVVQAFGAGMTVVIVGAMVRDYYS
            |||||||||||||| |||||||||||:||||||||||||||||||||||||||||||||
a689        SDIKGRKPVALTGLAVYCLAVAAIVFASSAEQLLNLRVVQAFGAGMTVVIVGAMVRDYYS
                   130       140       150       160       170       180

                   190       200       210       220       230       240
m689.pep    GRKAAQMFALIGIILMVVPLVAPMVGALLQGLGGWQAIFVFLAAYSLVLLGLVQYFLPKP
            ||||||||||||||||||||||||||||||||||||||||||||||||||||||||||||
a689        GRKAAQMFALIGIILMVVPLVAPMVGALLQGLGGWQAIFVFLAAYSLVLLGLVQYFLPKP
                   190       200       210       220       230       240

                   250       260       270       280       290       300
m689.pep    AVGGKIGRDVFGLVAGRFKRVLKTRAAMGYLFFQAFSFGSMFAFLTESSFVYQQLYRVTP
            |||||||||||||||||||||||||||||||||||||||||||||||||||||||:||||
a689        AVGGKIGRDVFGLVAGRFKRVLKTRAAMGYLFFQAFSFGSMFAFLTESSFVYQQLYHVTP
                   250       260       270       280       290       300
                   310       320       330       340       350       360
m689.pep    HQYAWAFALNIITMMFFNRVTAWRLKTGVHPQSILLWGIVVQFAANLSQLAAVLFFGLPP
            |||||||||||||||||||:||||||||||||||||||||||||||||||||||||||||
a689        HQYAWAFALNIITMMFFNRITAWRLKTGVHPQSILLWGIVVQFAANLSQLAAVLFFGLPP
                   310       320       330       340       350       360
                   370       380       390       400       410       420
m689.pep    FWLLVACVMFSVGTQGLVGANTQACFMSYFKEEGGSANAVLGVFQSLIGAGVGMAATFLH
            ||||||||||||||||||||||||||||||||||||||||||||||||||||||||||||
a689        FWLLVACVMFSVGRQGLVGANTQACFMSYFKEEGGSANAVLGVFQSLIGAGVGMAATFLH
                   370       380       390       400       410       420
                   430       440       450       460
m689.pep    DGSATVMAATMTASTSCGIALLWLCSHRAWKENGQSEYLX
            |||||||||||||||||||||||||||||||||||||||
a689        DGSATVMAATMTASTSCGIALLWLCSHRAWKENGQSEYLX
                   430       440       450       460
```

The following partial DNA sequence was identified in *N. gonorrhoeae* <SEQ ID 2297> g690.seq (partial)

```
  1 ATGAAAAACA AAACGTCATC ACTTCCCTTA TGGCTTGCCG CAATCATGCT
 51 GGCCGCGCGT TCCCCGAGCA AAGAAGATAA AACGAAAGAA AACGGCGCAT
101 CCGCCGCTTC GTCTTCCGCG TCATCGGCTT CTTCCCAAAC CGATTTGCAA
151 CCGGCCGCAT CCGCCCCTGA TAACGTCAAG CAGGCAGAAA GCGCGCCACT
201 GTGAAATTGC ACCGGCCTGC ACCCCGCCGC CGGCATTGGC GATCTCATAC
251 AGCAAATCGC CGAACACATC GACTCGGACT GTCTGTTTGC CCTTTCCCAT
301 AACGAACTGG AAACCCGTTT CGGCTTACCC GGCGGCGGCT ATGACAACAT
351 ACAGCGGctG CTgtttCCCG ACATCCGCCC TGAAGATCCC GACTACCATC
401 AGAAAATCAT GCTGGCAATC GAAGACTTGC GTTACGGAAC GCGCACCATC
451 AGccgGCAGG CACAAGATGC CATAATGGAA CAGGAACGCC gcctccGaGa
501 agCGACGCTG ATGCTGACAC AGGGCAGTCA AAAAACCCGC GGaCAAGGCG
551 AGGAACCGAA ACGCGCACGT TATTTTGAAG TTTCGGCAAC ATCtgCCtaT
601 TTgaaccggC ACAAcaacGG ACTTggcgGC AATTTCCAAT ACATCGGCCA
651 ATTGCCCGGC TATCTGAAAA TGCACGGAGA AATGCTTGAA AACCAATCAC
701 TCTTCCGGCT GTCCAACCGT GAACGCAATC CCGACAAACC GTTTTTAGAC
751 ATCCATTTTG ACGAAAATGG CAAAATCACG CGTATTGTCG TTTACGAAAA
801 AAATATCTAT...
```

This corresponds to the amino acid sequence <SEQ ID 2298; ORF 690>:

g690.pep (partial)

```
  1 MKNKTSSLPL WLAAIMLAAR SPSKEDKTKE NGASAASSSA SSASSQTDLQ
 51 PAASAPDNVK QAESAPL*NC TGLHPAAGIG DLIQQIAEHI DSDCLFALSH
101 NELETRFGLP GGGYDNIQRL LFPDIRPEDP DYHQKIMLAI EDLRYGTRTI
151 SRQAQDAIME QERRLREATL MLTQGSQKTR GQGEEPKRAR YFEVSATSAY
201 LNRHNNGLGG NFQYIGQLPG YLKMHGEMLE NQSLFRLSNR ERNPDKPFLD
251 IHFDENGKIT RIVVYEKNIY ...
```

The following partial DNA sequence was identified in *N. meningitidis* <SEQ ID 2299>:

m690.seq..

```
  1 ATGAAAAACA AAACCTCATC ACTTCTCTTA TGGCTTACCG CAATCATGCT
 51 GACCGCGTGT TCTCCGAGCA AAGACGATAA AACCAAAGAA GTCGGTGCAT
101 CCGCTGCTTC GTCCTCCGCG TCATCAGCTC CTTCCCAAAC CGATTTGCAA
151 CCGACCGCAT CCGCCCCTGA TAACGTCAAG CAGGCAGAAA GCGCGCCGCC
201 GTCAAATTGC ACCAGCCTGC ACCCCGCCAC CGGCATTGAC GATCTCATGC
251 AGCAAATCGC CGAACACATT GACTCGGACT GTCTGTTTGC CCTTTCCCAT
301 CACGAACTGG AAACCCGTTT CGGCTTACCC GACGGTGGCT ATGACAACAT
351 ACAGCGGCTG CTGTTTCCCG ACATCCGCCC TGAAGATCCC GACTACCATC
401 AGAAAATCAT ACTGGCAATT GAAGACTTGC GTTACGGAAA GCGCACGATC
451 AGCCGGCAGG CACAAAATGC CTTGATGGAA CAGGAACGCC GCCTCCGAGA
501 AGCGACGCTG TTGCTGATAC AGGGCAGTCA AGAAACCCGC GGACAAGGCG
551 AGGAGCCGAA ACGCACGCGT TATTTTGAAG TTTCGGCAAC CCCTGCCTAT
601 TCGAGCCGGC ACAACAACGG ACTTGGCGGC AATTTCCAAT ACATCAGCCA
651 ATTGCCCGGC TATCTGAAAA TACACGGAGA AATGCTTGAA AACCAATCAC
701 TCTTCCGGCT GTCCAACCGT GAACGCAATC CCGACAAACC GTTTTTAGAC
751 ATCCATTTTG ACGAAAATGG CAAAATCACG CGTATTGTCG TTTACGAAAA
801 AAACATCTAC TTCAATCCAA ACACGGGGCG AATATAA
```

This corresponds to the amino acid sequence <SEQ ID 2300; ORF 690>:

m690.pep

```
  1 MKNKTSSLLL WLTAIMLTAC SPSKDDKTKE VGASAASSSA SSAPSQTDLQ
 51 PTASAPDNVK QAESAPPSNC TSLHPATGID DLMQQIAEHI DSDCLFALSH
101 HELETRFGLP DGGYDNIQRL LFPDIRPEDP DYHQKIILAI EDLRYGKRTI
151 SRQAQNALME QERRLREATL LLIQGSQETR GQGEEPKRTR YFEVSATPAY
201 SSRHNNGLGG NFQYISQLPG YLKIHGEMLE NQSLFRLSNR ERNPDKPFLD
251 IHFDENGKIT RIVVYEKNIY FNPNTGRI*
```

Computer analysis of this amino acid sequence gave the following results:

Homology with a predicted ORF from *N. gonorrhoeae*

ORF 690 shows 89.3% identity over a 408 aa overlap with a predicted ORF (ORF 690) from *N. gonorrhoeae:* m690/g690 89.3% identity in 408 aa overlap

```
                   10        20        30        40        50        60
m690.pep   MKNKTSSLLLWLTAIMLTACSPSKDDKTKEVGASAASSSASSAPSQTDLQPTASAPDNVK
           |||||||| |||:||||:| ||||:||||| |||||||||||| |||||||:||||||||
g690       MKNKTSSLPLWLAAIMLAARSPSKEDKTKENGASAASSSASSASSQTDLQPAASAPDNVK
                   10        20        30        40        50        60

                   70        80        90       100       110       120
m690.pep   QAESAPPSNCTSLHPATGIDDLMQQIAEHIDSDCLFALSHHELETRFGLPDGGYDNIQRL
           ||||||  |||:||||:|| ||:|||||||||||||||||:||||||||| |||||||||
g690       QAESAPLXNCTGLHPAAGIGDLIQQIAEHIDSDCLFALSHNELETRFGLPGGGYDNIQRL
                   70        80        90       100       110       120

                  130       140       150       160       170       180
m690.pep   LFPDIRPEDPDYHQKIILAIEDLRYGKRTISRQAQNALMEQERRLREATLLLIQGSQETR
           ||||||||||||||||:||||||||| ||||||||:|:||||||||||||:| ||||:||
g690       LFPDIRPEDPDYHQKIMLAIEDLRYGTRTISRQAQDAIMEQERRLREATLMLTQGSQKTR
                  130       140       150       160       170       180

                  190       200       210       220       230       240
m690.pep   GQGEEPKRTRYFEVSATPAYSSRHNNGLGGNFQYISQLPGYLKIHGEMLENQSLFRLSNR
           ||||||||:|||||||| || :|||||||||||||:|||||||:||||||||||||||||
g690       GQGEEPKRARYFEVSATSAYLNRHNNGLGGNFQYIGQLPGYLKMHGEMLENQSLFRLSNR
                  190       200       210       220       230       240

                  250       260       270      279
m690.pep   ERNPDKPFLDIHFDENGKITRIVVYEKNIYFNPNTGRIX
           ||||||||||||||||||||||||||||||
g690       ERNPDKPFLDIHFDENGKITRIVVYEKNIY
                  250       260       270
```

The following partial DNA sequence was identified in *N. meningitidis* <SEQ ID 2301> a690.seq

```
  1 ATGAAAAACA AAACCTCATC ACTTCTCTTA TGGCTTGCCG CAATGATGCT
 51 GACCGCGTGT TCCCCGAGCA AAGAAGATAA AACGAAAGAA AACGGCGCAT
101 CCGCCGCCTC GTCCACGGCA TCCGCCGCTT CGTCTTCCGC GCCCCAAACC
151 GATTTGCAAC CGGCCGCATC CGCCCCTGAT AACGTCAAGC AGGCAGAAAG
201 CGTGCCGCCG TCAAATTGCA CCGACCTGCA CCCCGCCACC GGCATTGACG
251 ATCTCATGCA GCAAATCGCC GAACACATTG ACTCGGACTG TCTGTTTGCC
301 CTTTCCCATC ACGAACTGGA AACCCGTTTC GGCTTACCCG GCGGCGGCTA
351 TGACAACATA CAGCGGCTGC TGTTTCCCGA CATCCGCCCT GAAGATCCCG
401 ACTACCATCA GAAAATCATA CTGGCAATTG AAGACTTGCG TTACGGAAAG
451 CGCACGATCA GCCGGCAGGC ACAAGATGCC TTGATGGAAC AGGAACGCCG
501 CCTCCGAGAA GCGACGCTGT TGCTGATACA GGGCAGTCAA GAAACCCGCG
551 GACAAGGCGA GGAGCCGAAA CGCACGCGTT ATTTTGAAGT TTCGGCAACC
601 CCTGCCTATT CGAGCCGGCA CAACAACGGA CTTGGCGGCA ATTTCCAATA
651 CATCGGCCAA TTGCCCGGCT ATCTGAAAAT ACACGGAGAA ATGCTTGAAA
701 ACCAATCACT CTTCCGGCTG TCCAACCGTG AACGCAATCC CGACAAACCG
751 TTTTTAGACA TCCATTTTGA CGAAAATGGC AAAATCACGC GTATTGTCGT
801 TTACGAAAAA AACATCTACT TCAATCCAAA CTTGGGGCGA AGATAA
```

This corresponds to the amino acid sequence <SEQ ID 2302; ORF 690.a>:

a690.pep

```
  1 MKNKTSSLLL WLAAMMLTAC SPSKEDKTKE NGASAASSTA SAASSSAPQT

 51 DLQPAASAPD NVKQAESVPP SNCTDLHPAT GIDDLMQQIA EHIDSDCLFA

101 LSHHELETRF GLPGGGYDNI QRLLFPDIRP EDPDYHQKII LAIEDLRYGK

151 RTISRQAQDA LMEQERRLRE ATLLLIQGSQ ETRGQGEEPK RTRYFEVSAT

201 PAYSSRHNNG LGGNFQYIGQ LPGYLKIHGE MLENQSLFRL SNRERNPDKP

251 FLDIHFDENG KITRIVVYEK NIYFNPNLGR R*
```

Computer analysis of this amino acid sequence gave the following results:

Homology with a predicted ORF from *N. meningitidis*

ORF 690 shows 93.9% identity over a 280 aa overlap with a predicted ORF (ORF 690) from *N. meningitidis:* m690/a690 93.9% identity in 280 aa overlap

```
                        10        20        30        40           50
m690.pep        MKNKTSSLLLWLTAIMLTACSPSKDDKTKEVGASAASSSASSAPS---QTDLQPTASAPD
                ||||||||||||:|:|||||||||:||||| |||||||:||:| |   ||||||:|||||
a690            MKNKTSSLLLWLAAMMLTACSPSKEDKTKENGASAASSTASAASSSAPQTDLQPAASAPD
                        10        20        30        40        50        60

                60        70        80        90        100       110
m690.pep        NVKQAESAPPSNCTSLHPATGIDDLMQQIAEHIDSDCLFALSHHELETRFGLPDGGYDNI
                |||||||:||||||:|||||||||||||||||||||||||||||||||||||| ||||||
a690            NVKQAESVPPSNCTDLHPATGIDDLMQQIAEHIDSDCLFALSHHELETRFGLPGGGYDNI
                        70        80        90       100       110       120

                120       130       140       150       160       170
m690.pep        QRLLFPDIRPEDPDYHQKIILAIEDLRYGKRTISRQAQNALMEQERRLREATLLLIQGSQ
                ||||||||||||||||||||||||||||||||||||||:|||||||||||||||||||||
a690            QRLLFPDIRPEDPDYHQKIILAIEDLRYGKRTISRQAQDALMEQERRLREATLLLIQGSQ
                       130       140       150       160       170       180

                180       190       200       210       220       230
m690.pep        ETRGQGEEPKRTRYFEVSATPAYSSRHNNGLGGNFQYISQLPGYLKIHGEMLENQSLFRL
                ||||||||||||||||||||||||||||||||||||||:|||||||||||||||||||||
a690            ETRGQGEEPKRTRYFEVSATPAYSSRHNNGLGGNFQYIGQLPGYLKIHGEMLENQSLFRL
                       190       200       210       220       230       240

                240       250       260       270      279
m690.pep        SNRERNPDKPFLDIHFDENGKITRIVVYEKNIYFNPNTGRIX
                ||||||||||||||||||||||||||||||||||||| ||
a690            SNRERNPDKPFLDIHFDENGKITRIVVYEKNIYFNPNLGRRX
                       250       260       270       280
```

The following partial DNA sequence was identified in *N. gonorrhoeae* <SEQ ID 2303> g691.seq

```
  1 GTGCCGCTGC CTGCTCCCTG CCGTTTTGCC AAACCTGCCG CCTCTTTTTT

 51 AAGTATGGCT TTGCTTTCCT GCCAGCTTTC CCACGCCGCC ACGGCTTATA

101 TCCCCCCGAA CGATTTTCAA CCGAACTGCG ACATACGCCG GCTCGGGCTG

151 ACACAGGGTC AGCACAATGA GCTGCGTAAA ATCCGCGCCG CCTTCAAAAT

201 GGCGGGCGAC AGGGCGCGTT TGAAGGTTAT GCATTCCGAA CACAGCCGCC

251 GCCGCTCTGT CGTCGAAATC ATTTCTTCGG ATGTTTTTAA TCGGAACGAG

301 GCGCGCGATT ATGTCGAAAG CCGCTACCAC TCCAGCATGG ATTTTGCGGT

351 GGACGAATTG GAAATCCAAC ACCGCTTCTT CCATATTCTC ACACCGCAAC

401 AGCAGCAAAT GTGGCTTTCT TCCTGCCTCA AATAA
```

This corresponds to the amino acid sequence <SEQ ID 2304; ORF 691>:

g691.pep

```
  1 VPLPAPCRFA KPAASFLSMA LLSCQLSHAA TAYIPPNDFQ PNCDIRRLGL
 51 TQGQHNELRK IRAAFKMAGD RARLKVMHSE HSRRRSVVEI ISSDVFNRNE
101 ARDYVESRYH SSMDFAVDEL EIQHRFFHIL TPQQQQMWLS SCLK*
```

The following partial DNA sequence was identified in *N. meningitidis* <SEQ ID 2305>:

m691.seq

```
  1 GTGCCACTGC CTGCTCCCTG CCGTTTTGCC AAACCTGCCG CCTCTTTTTT
 51 AAGTATGGCT TTGCTTTCCT GTCAGCTTTC CCACGCCGCC ACGGCTTATA
101 TCCCCCCGAA CGATTTTCAA CCGAACTGCG ACATACGCCG ACTCGGGCTG
151 ACCCAAAGTC AGCACAATGA GCTGCGTAAA ATCCGCACCG CCTTCAAAAT
201 GGCGGGCGAC AGGGCGCGTT TGAAGGTTAT GCATTCCGAA CACAGCCGCC
251 GCCGGTCTGT CGTCGAAATC ATTTCCTCGG ATGTTTTTAA TCGGAACGAG
301 GCGCGCGATT ATGTCGAAAG CCGCTATTTG TCCGGTATGG ATTTTGCGGT
351 GGACGAATTG GAAATCCAAC ACCGGTTCTT CCATATCCTC ACACCGCAAC
401 AGCAGCAAAT GTGGCTTTCT TCCTGCCTCA AATAA
```

This corresponds to the amino acid sequence <SEQ ID 2306; ORF 691>:

m691.pep

```
  1 VPLPAPCRFA KPAASFLSMA LLSCQLSHAA TAYIPPNDFQ PNCDIRRLGL
 51 TQSQHNELRK IRTAFKMAGD RARLKVMHSE HSRRRSVVEI ISSDVFNRNE
101 ARDYVESRYL SGMDFAVDEL EIQHRFFHIL TPQQQQMWLS SCLK*
```

Computer analysis of this amino acid sequence gave the following results:

Homology with a predicted ORF from *N. gonorrhoeae*

ORF 691 shows 97.2% identity over a 144 aa overlap with a predicted ORF (ORF 691) from *N. gonorrhoeae:* m691/g691 97.2% identity in 144 aa overlap

```
                  10        20        30        40        50        60
m691.pep  VPLPAPCRFAKPAASFLSMALLSCQLSHAATAYIPPNDFQPNCDIRRLGLTQSQHNELRK
          ||||||||||||||||||||||||||||||||||||||||||||||||||||:|||||||
g691      VPLPAPCRFAKPAASFLSMALLSCQLSHAATAYIPPNDFQPNCDIRRLGLTQGQHNELRK
                  10        20        30        40        50        60

                  70        80        90       100       110       120
m691.pep  IRTAFKMAGDRARLKVMHSEHSRRRSVVEIISSDVFNRNEARDYVESRYLSGMDFAVDEL
          ||:||||||||||||||||||||||||||||||||||||||||||||||| |:|||||||
g691      IRAAFKMAGDRARLKVMHSEHSRRRSVVEIISSDVFNRNEARDYVESRYHSSMDFAVDEL
                  70        80        90       100       110       120

                 130       140
m691.pep  EIQHRFFHILTPQQQQMWLSSCLKX
          ||||||||||||||||||||||||
g691      EIQHRFFHILTPQQQQMWLSSCLKX
                 130       140
```

The following partial DNA sequence was identified in *N. meningitidis* <SEQ ID 2307> a691.seq

```
  1 GTGCCACTGC NTGCTCCCTG CCGTTTTGCC AAACCTGCCG CCTCTTTTTT

 51 AAGTATGGCT TTGCTTTCCT GCCAGCTTTC CCACGCCGCC ACGGCTTATA

101 TCCCCCTGAA CGATTTTCAA CCGAACTGCG ACATACGCCG GCTCGGACTG

151 ACACAGGGTC AGCACAATGA ACTGCGTAAA ATCCGCGCCG CCTTCAAAAT

201 GGCGGGCGAC AGGGCGCGTT TGAAGGTTAT GCATTCCGAA CACAGCCGCC

251 GTCGGTCTGT CGTCGAAATC ATTTCCTCGG ATGTTTTTAA TCGGAACGAG

301 GCGCGCGATT ATGTCGAAAG CCGCTATTTG TCCGGTATGG ATTTTGCGGT

351 GGACGAATTG GAAATCCAAC ACCGGTTCTT CCATATCCTC ACACCGCAAC

401 AGCAGCAAAT GTGGCTTTCT TCCTGCCTCA AATAA
```

This corresponds to the amino acid sequence <SEQ ID 2308; ORF 691.a>:

a691.pep

```
  1 VPLXAPCRFA KPAASFLSMA LLSCQLSHAA TAYIPLNDFQ PNCDIRRLGL

 51 TQGQHNELRK IRAAFKMAGD RARLKVMHSE HSRRRSVVEI ISSDVFNRNE

101 ARDYVESRYL SGMDFAVDEL EIQHRFFHIL TPQQQQMWLS SCLK*
```

Computer analysis of this amino acid sequence gave the following results:

Homology with a predicted ORF from *N. meningitidis*

ORF 691 shows 97.2% identity over a 144 aa overlap with a predicted ORF (ORF 691) from *N. meningitidis:* m691/a691 97.2% identity in 144 aa overlap

```
                   10        20        30        40        50        60
m691.pep   VPLPAPCRFAKPAASFLSMALLSCQLSHAATAYIPPNDFQPNCDIRRLGLTQSQHNELRK
           ||| ||||||||||||||||||||||||||||| |||||||||||||||||:||||||||
a691       VPLXAPCRFAKPAASFLSMALLSCQLSHAATAYIPLNDFQPNCDIRRLGLTQGQHNELRK
                   10        20        30        40        50        60

                   70        80        90       100       110       120
m691.pep   IRTAFKMAGDRARLKVMHSEHSRRRSVVEIISSDVFNRNEARDYVESRYLSGMDFAVDEL
           ||:|||||||||||||||||||||||||||||||||||||||||||||||||||||||||
a691       IRAAFKMAGDRARLKVMHSEHSRRRSVVEIISSDVFNRNEARDYVESRYLSGMDFAVDEL
                   70        80        90       100       110       120

                  130       140
m691.pep   EIQHRFFHILTPQQQQMWLSSCLKX
           ||||||||||||||||||||||||
a691       EIQHRFFHILTPQQQQMWLSSCLKX
                  130       140
```

The following partial DNA sequence was identified in *N. gonorrhoeae* <SEQ ID 2309> g692.seq

```
  1 GTATCGCACA CACGCTGTCG CTGTTCGGAA TCGAtacGCC GGATTTGGCG

 51 GAATGGCAGG GAATGGCGGA TTAAAGGACA AAAATGCCGT CTGAACACGG

101 ATGCGGTTCA GACGGCATCA TTTTATACGA CTGCCTTATT TGGCTGCGCC

151 TTCATTCCAT GCGGCAGGGT ATTTGTAGCC CTCGAAGCGT TTGTGCGCGT
```

-continued

```
 201 AGGCTTTGAA CGCGTCGGAG TTATAGGCCT CGGTTACGTC TTTAAGCCAT
 251 TGGCTGTCTT TGTCGGCGGT TTTgacGGCA GACCAGTTGA CATAGGCAAA
 301 GCTCGGCTCT TGGAACAGGG CTTCGGTCAG CTTCATGCCG CTGCTTATGG
 351 CGTAGTTGCC GTTGACGACG GCAAAATCCA CGTCGGCGCG GCTGCGCGGC
 401 AGTTGTGCGG CTTCAAGCTC GACGATTTTG ATGTTTTTCA GGTTTTCCGC
 451 GATGTCGGCT TTGGATGCGG TCAGCGGATT GATGCCGTCT TTGAGTTTGA
 501 TCCAACCCAG TTCGTTCAGC ATCACCAAGG CGCGTGCGAA GTTGGAcggG
 551 TcgtTGGGCG CGGATACGGT GCTGCCGTCT TTGACTTCTT CCAGCGATTT
 601 CAGTTTGCCC GGATACAGTC CCAAAGGCGC GGTCGGCACT TGGAAGGCTT
 651 CGGTGATGTC CAGGTTGTGT TCTTTTTTGA AATCGTCAAG ATAGGGTTTG
 701 TGTTGGAAGA CGTTGATGTC CAACTCGCCC TCCGCCAATG CCAGATTCGG
 751 GCGCACATAG TCggTAAATT cgaccaatTT gacgGTGTag cCTTTTTTCT
 801 CCAGCTCGgc tTGGATTTGT TCTTTGACCA TATcgccgaa gtcgcccacg
 851 gTCGTGCCGA agacgaTTTC TTTTTTCGCc GcgcCGTTAT CGGCAGAAGG
 901 GGCGGCGgca gaggctgcGG GCGCGCTGTC TTTTtgaccG ccgCAGGCTG
 951 CGAGGATGAG CGCGAGtgcg gcggcggaaa ggGTTTTGAA GAAGGTTTTc
1001 atATTTTCTc ctga
```

This corresponds to the amino acid sequence <SEQ ID 2310; ORF 692>:

g692.pep

```
  1 VSHTRCRCSE SIRRIWRNGR EWRIKGQKCR LNTDAVQTAS FYTTALFGCA
 51 FIPCGRVFVA LEAFVRVGFE RVGVIGLGYV FKPLAVFVGG FDGRPVDIGK
101 ARLLEQGFGQ LHAAAYGVVA VDDGKIHVGA AARQLCGFKL DDFDVFQVFR
151 DVGFGCGQRI DAVFEFDPTQ FVQHHQGACE VGRVVGRGYG AAVFDFFQRF
201 QFARIQSQRR GRHLEGFGDV QVVFFFEIVK IGFVLEDVDV QLALRQCQIR
251 AHIVGKFDQF DGVAFFLQLG LDLFFDHIAE VAHGRAEDDF FFRRAVIGRR
301 GGGRGCGRAV FLTAAGCEDE RECGGGKGFE EGFHIFS*
```

The following partial DNA sequence was identified in *N. meningitidis* <SEQ ID 2311>:

m692.seq

```
  1 GTGTTGCACA CGCTTTGTCG CTGTTCGGAA TCGATACGCC GGATTCGGCG
 51 GAATGGCAGG GAATGGCGGA TTAAAGGACA AAAATGCCGT CTGAACACGG
101 ATACAGTTCA GACGGCATCA TTTTATACGA CTGCCTTATT TGGCTGCGCC
151 TTCATTCCAT GCGGCAGGGG ATTTGTAGCC CTCGAAGCGT TTGTGCGCGT
201 AGGCTTTGAA CGCGTCGGAG TTATAGGCCT CGGTTACGTC TTTAAGCCAT
251 TGGCTGTCTT TGTCGGCGGT TTTGACGGCA GACCAGTTGA CATAGGCAAA
301 GCTCGGTTCT TGGAACAGGG CTTCGGTCAG CTTCATGCCG CTGCTTATGG
```

-continued

```
 351 CGTAGTTGCC GTTGACGACG GCAAAATCCA CGTCGGCGCG GCTACGCGGC

 401 AGTTGCGCGG CTTCAAGCTC GACGATTTTG ATGTTTTTCA GGTTCTCGGC

 451 GATGTCCGCT TTGGATGCGG TCAACGGATT GATGCCGTCT TTGAGTTTGA

 501 TCCAACCCAG TTCGTCGAGC ATCACCAAGA CGCGGGCGAA GTTGGACGGG

 551 TCGTTGGGCG CGGATACGGT GCTGCCGTCT TTGACTTCTT CCAGCGATTT

 601 CAGCTTGCCC GGGTACAGTC CCAAAGGCGC GGTCGGCACT TGGAAGACTT

 651 CGGTGATGTC CAGATTGTGT TCTTTTTTGA AGTCGTCAAG ATAGGGTTTG

 701 TGTTGGAAGA CGTTGATGTC CAACTCGCCC TCAGCCAATG CCAGATTCGG

 751 GCGTACATAG TCGGTAAACT CGACCAGTTT GACGGTGTAG CCTTTTTTCT

 801 CCAGCTCGGC TTGGATTTGT TCTTTGACCA TATCGCCGAA GTCGCCGACG

 851 GTCGTGCCGA AGACGATTTC TTTTTTCGCC GCGCCGTTGT CGGCGGCGGC

 901 AGAAGCGGAT GCGGCGGGCG CGCTGTCTTT TTGACCGCCG CAGGCGGCGA

 951 GGATGAGCGC GAGTGCGGCG GCGGAAAGGG TTTTGAAGAA GGTTTTCATA

1001 TTTTCTCCTG A
```

This corresponds to the amino acid sequence <SEQ ID 2312; ORF 692>:

m692.pep

```
  1 VLHTLCRCSE SIRRIRRNGR EWRIKGQKCR LNTDTVQTAS FYTTALFGCA

 51 FIPCGRGFVA LEAFVRVGFE RVGVIGLGYV FKPLAVFVGG FDGRPVDIGK

101 ARFLEQGFGQ LHAAAYGVVA VDDGKIHVGA ATRQLRGFKL DDFDVFQVLG

151 DVRFGCGQRI DAVFEFDPTQ FVEHHQDAGE VGRVVGRGYG AAVFDFFQRF

201 QLARVQSQRR GRHLEDFGDV QIVFFFEVVK IGFVLEDVDV QLALSQCQIR

251 AYIVGKLDQF DGVAFFLQLG LDLFFDHIAE VADGRAEDDF FFRRAVVGGG

301 RSGCGGRAVF LTAAGGEDER ECGGGKGFEE GFHIFS*
```

Computer analysis of this amino acid sequence gave the following results:

Homology with a predicted ORF from *N. gonorrhoeae*

ORF 692 shows 91.1% identity over a 338 aa overlap with a predicted ORF (ORF 692) from *N. gonorrhoeae:* m692/g692 91.1% identity in 338 aa overlap

```
                    10        20        30        40        50        60
m692.pep    VLHTLCRCSESIRRIRRNGREWRIKGQKCRLNTDTVQTASFYTTALFGCAFIPCGRGFVA
            | ||  ||||||| |||||||||||||||||||||:||||||||||||||||||||| |||
g692        VSHTRCRCSESIWRIRRNGREWRIKGQKCRLNTDAVQTASFYTTALFGCAFIPCGRVFVA
                    10        20        30        40        50        60

                    70        80        90       100       110       120
m692.pep    LEAFVRVGFERVGVIGLGYVFKPLAVFVGGFDGRPVDIGKARFLEQGFGQLHAAAYGVVA
            |||||||||||||||||||||||||||||||||||||||||||:||||||||||||||||
g692        LEAFVRVGFERVGVIGLGYVFKPLAVFVGGFDGRPVDIGKARLLEQGFGQLHAAAYGVVA
                    70        80        90       100       110       120

                   130       140       150       160       170       180
m692.pep    VDDGKIHVGAATRQLRGFKLDDFDVFQVLGDVRFGCGQRIDAVFEFDPTQFVEHHQDAGE
            |||||||||||:||| ||||||||||||: || |||||||||||||||||||:||| | |
g692        VDDGKIHVGAAARQLCGFKLDDFDVFQVFRDVGFGCGQRIDAVFEFDPTQFVQHHQGACE
                   130       140       150       160       170       180
```

-continued

```
                190       200       210       220       230       240
m692.pep   VGRVVGRGYGAAVFDFFQRFQLARVQSQRRGRHLEDFGDVQIVFFFEVVKIGFVLEDVDV
           |||||||||||||||||||||:||:||||||||| |||||:|||||:|||||||||||
g692       VGRVVGRGYGAAVFDFFQRFQFARIQSQRRGRHLEGFGDVQVVFFFEIVKIGFVLEDVDV
                190       200       210       220       230       240

                250       260       270       280       290
m692.pep   QLALSQCQIRAYIVGKLDQFDGVAFFLQLGLDLFFDHIAEVADGRAEDDFFFRRAVVG--
           |||| ||||||:||||:||||||||||||||||||||||||| |||||||||||||:|
g692       QLALRQCQIRAHIVGKFDQFDGVAFFLQLGLDLFFDHIAEVAHGRAEDDFFFRRAVIGRR
                250       260       270       280       290       300

      300       310       320       330
m692.pep   GGRSGCGGRAVFLTAAGGEDERECGGGKGFEEGFHIFSX
           ||  ||| |||||||| |||||||||||||||||||
g692       GGGRGCG-RAVFLTAAGCEDERECGGGKGFEEGFHIFSX
                 310       320       330
```

The following partial DNA sequence was identified in *N. meningitidis* <SEQ ID 2313> a692.seq

```
   1 GTGTTGCACA CGCTTTGTCG CTGTTCGGAA TCGATACGCC GGATTCGGCG

  51 GAATGGCAGG GAATGGCGGA TTAAAGGACA AAAATGCCGT CTGAACACGG

 101 ATACGGTTCA GACGGCATCA TTTTATACGA CTGCCTTATT TGGCTGCGCC

 151 TTCATTCCAT GCGGCAGGGG ATTTGTAGCC CTCGAAGCGT TTGTGCGCGT

 201 AGGCTTTGAA CGCGTCGGAG TTATAGGCCT CGGTTACGTC TTTAAGCCAT

 251 TGGCTGTCTT TGTCGGCGGT TTTGACGGCA GACCAGTTGA CATAGGCAAA

 301 GCTCGGTTCT TGGAACAGGG CTTCGGTCAG CTTCATGCCG CTGCTTATGG

 351 CGTAGTTGCC GTTGACGACG GCAAAATCCA CGTCGGCGCG GCTACGCGGC

 401 AGTTGCGCGG CTTCAAGCTC GACGATTTTG ATGTTTTTCA GGTTTTCGGC

 451 AATGTCCGCT TTGGATGCGG TCAGCGGATT GATGCCGTCT TTGAGTTTGA

 501 TCCAACCCAG TTCGTCGAGC ATCACCAAGA CGCGGGCGAA GTTGGACGGG

 551 TCGTTGGGCG CGGATACGGT GCTGCCGTCT TTGACTTCTT CCAGCGATTT

 601 CAGCTTGCCC GGGTACAGTC CCAAAGGCGC GGTCGGCACT TGGAAGACTT

 651 CGGTGATGTC CAGATTGTGT TCTTTTTTGA AGTCGTCAAG ATAGGGTTTG

 701 TGTTGGAAGA CGTTGATGTC CAACTCGCCC TCAGCCAATG CCAGATTCGG

 751 GCGCACATAG TCGGTAAACT CGACCAGTTT GACGGTGTAG CCTTTTTTCT

 801 CCAGCTCGGG TTGGATTTGT TCTTTGACCA TATCGCCGAA GTCGCCGACG

 851 GTCGTGCCGA AGACGATTTC TTTTTTCGCC GCGCCGTTGT CGGCGGCGGC

 901 AGAAGCGGAT GCGGCGGGCG CGCTATCTTT TTGACCGCCG CAGGCGGCGA

 951 GGATGAGCGC GAGTGCGGCG GCGGAAAGGG TTTTGAAGAA GGTTTTCATA

1001 TTTTCTCCTG A
```

This corresponds to the amino acid sequence <SEQ ID 2314; ORF 692.a>:

a692.pep

```
  1 VLHTLCRCSE SIRRIRRNGR EWRIKGQKCR LNTDTVQTAS FYTTALFGCA

 51 FIPCGRGFVA LEAFVRVGFE RVGVIGLGYV FKPLAVFVGG FDGRPVDIGK
```

-continued

```
101 ARFLEQGFGQ LHAAAYGVVA VDDGKIHVGA ATRQLRGFKL DDFDVFQVFG

151 NVRFGCGQRI DAVFEFDPTQ FVEHHQDAGE VGRVVGRGYG AAVFDFFQRF

201 QLARVQSQRR GRHLEDFGDV QIVFFFEVVK IGFVLEDVDV QLALSQCQIR

251 AHIVGKLDQF DGVAFFLQLG LDLFFDHIAE VADGRAEDDF FFRRAVVGGG

301 RSGCGGRAIF LTAAGGEDER ECGGGKGFEE GFHIFS*
```

Computer analysis of this amino acid sequence gave the following results:

Homology with a predicted ORF from *N. meningitidis*

ORF 692 shows 98.8% identity over a 336 aa overlap with a predicted ORF (ORF 692) from *N. meningitidis:* m692/a692 98.8% identity in 336 aa overlap

```
                    10        20        30        40        50        60
m692.pep    VLHTLCRCSESIRRIRRNGREWRIKGQKCRLNTDTVQTASFYTTALFGCAFIPCGRGFVA
            ||||||||||||||||||||||||||||||||||||||||||||||||||||||||||||
a692        VLHTLCRCSESIRRIRRNGREWRIKGQKCRLNTDTVQTASFYTTALFGCAFIPCGRGFVA
                    10        20        30        40        50        60

                    70        80        90       100       110       120
m692.pep    LEAFVRVGFERVGVIGLGYVFKPLAVFVGGFDGRPVDIGKARFLEQGFGQLHAAAYGVVA
            ||||||||||||||||||||||||||||||||||||||||||||||||||||||||||||
a692        LEAFVRVGFERVGVIGLGYVFKPLAVFVGGFDGRPVDIGKARFLEQGFGQLHAAAYGVVA
                    70        80        90       100       110       120

                   130       140       150       160       170       180
m692.pep    VDDGKIHVGAATRQLRGFKLDDFDVFQVLGDVRFGCGQRIDAVFEFDPTQFVEHHQDAGE
            ||||||||||||||||||||||||||||:|:|||||||||||||||||||||||||||||
a692        VDDGKIHVGAATRQLRGFKLDDFDVFQVFGNVRFGCGQRIDAVFEFDPTQFVEHHQDAGE
                   130       140       150       160       170       180

                   190       200       210       220       230       240
m692.pep    VGRVVGRGYGAAVFDFFQRFQLARVQSQRRGRHLEDFGDVQIVFFFEVVKIGFVLEDVDV
            ||||||||||||||||||||||||||||||||||||||||||||||||||||||||||||
a692        VGRVVGRGYGAAVFDFFQRFQLARVQSQRRGRHLEDFGDVQIVFFFEVVKIGFVLEDVDV
                   190       200       210       220       230       240

                   250       260       270       280       290       300
m692.pep    QLALSQCQIRAYIVGKLDQFDGVAFFLQLGLDLFFDHIAEVADGRAEDDFFFRRAVVGGG
            ||||||||||:|||||||||||||||||||||||||||||||||||||||||||||||||
a692        QLALSQCQIRAHIVGKLDQFDGVAFFLQLGLDLFFDHIAEVADGRAEDDFFFRRAVVGGG
                   250       260       270       280       290       300

                   310       320       330
m692.pep    RSGCGGRAVFLTAAGGEDERECGGGKGFEEGFHIFSX
            ||||||||:||||||||||||||||||||||||||||
a692        RSGCGGRAIFLTAAGGEDERECGGGKGFEEGFHIFSX
                   310       320       330
```

The following partial DNA sequence was identified in *N. gonorrhoeae* <SEQ ID 2315>:

g694.seq

```
  1 TCGGCATTTG TGTTGCCCAA ACATCCGATG CCTGCGTTAA CGCCTGCGTC

 51 AACGTTTGCA CAAATCGGGT TTGGTTTCGC CCTCGCGGCG CAGCTCCTTG

101 GGCAGGACGA ACACGATGCT TTCTTCCGCG CCCCCCCCTT CGCGCACGGT

151 TTCATGCCCC CATCCGCGTA TGGTTGCCAA TACTTCCCGC ACCAACACTT

201 CGGGCGCGGA CGCGCCTGCC GTTACGCCGA CTTTGCTTTT GCCTTCAAAC

251 CACGTGCGTT GCaggTAGGA CGCGTTGTCC ACCATATACG CATCGATTCC

301 GCGCGATGCC GCCACTTCGC GCAGGCGGTT GCTGTTGGAC GAATTGGGCG

351 AACCGACCAC AATCACGATG TCGCACTGTT CCGCCAGCTC TTTGACGGCG

401 GTTTGCCGGT TGGTCGTCGC ATAGCAGATG TCTTCCTTGT GCGGATTGCG
```

-continued

```
 451 GATATTGGGG AAACGCGCGT TCAGCGCGGC GATGATGTCT TTGGTTTCAT
 501 CGACCGAGAG CGTGGTTTGG CTGACATAGG CGAGTTTGTC GGGGTTTCTG
 551 ACTTCGAGTT TTGCCACATC TCCGACCGTT TCGACCAAAA GCATTTTGCC
 601 CGGTGCAAGC TGCCCCATCG TGCCTTCGAC CTCGGCGTGC CCCTTATGCC
 651 CGATCATGAT GATTTCACAG TCTTGGGCAT CCAGTCGGGC GACTTCCTTA
 701 TGCACTTTCG TCACCAGCGG GCAAGTCGCA TCAAATACCC GGAAACCGCG
 751 CTCCGCCGCT TCCTGCTGCA CCGCCTTCGA TACGCCGTGT GCCGAATAAA
 801 CCAGTGTCGC GCCCGGCGGC ACTTCCGCCA AGTCTTCGAT AAACACCGCG
 851 CCTTTTTCGC GCAGGTTGTC CACGACGAAT TTGTTGTGGA CGACTTCGTG
 901 GCGCACATAA ACCGGCGCGC CGAATTCTTC CAAAGCACGT TCGACAATAC
 951 TGATTGCCCG ATCCACACCG GCGCAGAAGC CGCGCGGATT GGCAAGGATG
1001 ATGGTTTTTC CGTTCATAAG TTTTGCATTC CGTGTTCAGA CGGCATTCAC
1051 GTTTTTTTGC TNNATCTTTG CGATGGACGA TATTGTCAAG CACCGCCAAC
1101 ACCGCACCGA CGCAGATAA
```

This corresponds to the amino acid sequence <SEQ ID 2316: ORF 694>:

g694.pep (partial)

```
  1 SAFVLPKHPM PALTPASTFA QIGFGFALAA QLLGQDEHDA FFRAPPFAHG
 51 FMPPSAYGCQ YFPHQHFGRG RACRYADFAF AFKPRALQVG RVVHHIRIDS
101 ARCRHFAQAV AVGRIGRTDH NHDVALFRQL FDGGLPVGRR IADVFLVRIA
151 DIGETRVQRG DDVFGFIDRE RGLADIGEFV GVSDFEFCHI SDRFDQKHFA
201 RCKLPHRAFD LGVPLMPDHD DFTVLGIQSG DFLMHFRHQR ASRIKYPETA
251 LRRFLLHRLR YAVCRINQCR ARRHFRQVFD KHRAFFAQVV HDEFVVDDFV
301 AHINRRAEFF QSTFDNTDCP IHTGAEAARI GKDDGFSVHK FCIPCSDGIH
351 VFLLXLCDGR YCQAPPTPHR RR*
```

The following partial DNA sequence was identified in *N. meningitidis* <SEQ ID 2317>:

m694.seq

```
  1 TTGGTTTCCG CATCCGGCAC ACGGCAAAAA TGCCGTCTGA AGCCTGTTCA
 51 GACGGCATTT GTGTTGCCCA AACATTCAAC GCCTGCGTCA ACGTTTGCAC
101 AAATCGGGTT TGGTTTCGCC CTCGCGGCGC AACTCTTTGG GCAGGACGAA
151 CACAATGCTT TCTTCCGCAC CCTCGCCTTC GCGTACGGTT TCGTGCCCCC
201 ATCCGCGTAT GGTTGCCAGT ACTTCCCGCA CCAACACTTC GGGCGCGGAC
251 GCGCCTGCCG TTACGCCGAC TTTGTTTTTG CCCTCAAACC ATGCGCGTTG
301 CAGGTAGCCT GCATTATCCA CCATATACGC ATCGATTCCG CGCGATGCCG
351 CCACTTCGCG CAAGCGGTTG CTGTTGGACG AATTGGGCGA ACCGACCACA
401 ATCACGATGT CGCACTGTTC TGCCAACTCT TTGACGGCGG TTTGCCGGTT
```

-continued

```
 451 GGTCGTCGCA TAGCAGATAT CTTCCTTGTG CGGATTGCGG ATATTGGGGA

 501 AACGCGCGTT CAGCGCGGCG ATGATGTCTT TGGTTTCATC GACCGAGAGC

 551 GTGGTTTGGC TGACATAGGC GAGTTTGTCG GGGTTTCTGA CTTCGAGTTT

 601 TGCCACATCT CCGACCGTTT CGACCAAAAG CATTTTGCCC GGCGCAAGCT

 651 GCCCCATCGT TCCTTCGACC TCGACGTGCC CCTTATGCCC GATCATGATG

 701 ATTTCACAGT CTTGGGCATC CAGTCGGGCG ACTTCCTTAT GCACTTTCGT

 751 CACCAGCGGG CAAGTCGCAT CAAACACGCG GAAACCGCgC TCCGCCGCTT

 801 CTTGCCGCAC CGCCTTCGAT ACGCCGTGTG CCGAATAAAC CAGTGTCGCG

 851 CCCGGCGGCA CTTCCGCCAA GTCTTCAATA AACACCGCAC CTTTTTCACG

 901 CAGGTTGTCC ACGACGAATT TGTTGTGAAC GACTTCGTGG CGCACATAAA

 951 TCGGCGCGCC GAACTCTTCC AAAGCACGTT CGACAATACT GATT GCCCGA

1001 TCCACACCAG CGCAGAAGCC GCGCGGATTG GCAAGGATGA TGGTTTTCTC

1051 GTTCATAAGC CCGGTATTTC GTTTTCAGAC GGCATCAATA TTTTTCTTCT

1101 TGGGTTTTAC GGTGGACGAT GTTGTCCAAC ACCGCCAACA CCGCACCGAC

1151 GCAGATAA
```

This corresponds to the amino acid sequence <SEQ ID 2318; ORF 694>:

```
m694.pep

  1 LVSASGTRQK CRLKPVQTAF VLPKHSTPAS TFAQIGFGFA LAAQLFGQDE

 51 HNAFFRTLAF AYGFVPPSAY GCQYFPHQHF GRGRACRYAD FVFALKPCAL

101 QVACIIHHIR IDSARCRHFA QAVAVGRIGR TDHNHDVALF CQLFDGGLPV

151 GRRIADIFLV RIADIGETRV QRGDDVFGFI DRERGLADIG EFVGVSDFEF

201 CHISDRFDQK HFARRKLPHR SFDLDVPLMP DHDDFTVLGI QSGDFLMHFR

251 HQRASRIKHA ETALRRFLPH RLRYAVCRIN QCRARRHFRQ VFNKHRTFFT

301 QVVHDEFVVN DFVAHINRRA ELFQSTFDNT DCPIHTSAEA ARIGKDDGFL

351 VHKPGISFSD GINIFLLGFY GGRCCPTPPT PHRRR*
```

Computer analysis of this amino acid sequence gave the following results:

Homology with a predicted ORF from *N. gonorrhoeae*

ORF 694 shows 86.8% identity over a 372 aa overlap with a predicted ORF (ORF 694) from *N. gonorrhoeae:* m694/g694 86.8% identity in 372 aa overlap

```
                  10        20            30        40        50
m694.pep  LVSASGTRQKCRLKPVQTAFVLPKHS----TPASTFAQIGFGFALAAQLFGQDEHNAFER
                           :|||||||     |||||||||||||||||||:|||||:||||
g694                       SAFVLPKHPMPALTPASTFAQIGFGFALAAQLLGQDEHDAFFR
                                   10        20        30        40

           60        70        80        90       100       110
m694.pep  TLAFAYGFVPPSAYGCQYFPHQHFGRGRACRYADFVFALKPCALQVACIIHHIRIDSARC
          :  ||:||:||||||||||||||||||||||||||:||:|| ||||: ::||||||||||
g694      APPFAHGFMPPSAYGCQYFPHQHFGRGRACRYADFAFAFKPRALQVGRVVHHIRIDSARC
               50        60        70        80        90       100
```

-continued

```
               120       130       140       150       160       170
m694.pep      RHFAQAVAVGRIGRTDHNHDVALFCQLFDGGLPVGRRIADIFLVRIADIGETRVQRGDDV
              |||||||||||||||||||||||| ||||||||||||||||:||||||||||||||||||
g694          RHFAQAVAVGRIGRTDHNHDVALFRQLFDGGLPVGRRIADVFLVRIADIGETRVQRGDDV
                   110       120       130       140       150       160

180       190       200       210       220       230
m694.pep      FGFIDRERGLADIGEFVGVSDFEFCHISDRFDQKHFARRKLPHRSFDLDVPLMPDHDDFT
              |||||||||||||||||||||||||||||||||||||| |||||:||| |||||||||||
g694          FGFIDRERGLADIGEFVGVSDFEFCHISDRFDQKHFARCKLPHRAFDLGVPLMPDHDDFT
                   170       180       190       200       210       220

240       250       260       270       280       290
m694.pep      VLGIQSGDFLMHFRHQRASRIKHAETALRRFLPHRLRYAVCRINQCRARRHFRQVFNKHR
              ||||||||||||||||||||||: |||||||| |||||||||||||||||||||||:|||
g694          VLGIQSGDFLMHFRHQRASRIKYPETALRRFLLHRLRYAVCRINQCRARRHFRQVFDKHR
                   230       240       250       260       270       280

300       310       320       330       340       350
m694.pep      TFFTQVVHDEFVVNDFVAHINRRAELFQSTFDNTDCPIHTSAEAARIGKDDGFLVHKPGI
              :||:|||||||||:|||||||||||:||||||||||||||:|||||||||||| |||  |
g694          AFFAQVVHDEFVVDDFVAHINRRAEFFQSTFDNTDCPIHTGAEAARIGKDDGFSVHKFCI
                   290       300       310       320       330       340

360       370       380
m694.pep      SFSDGINIFLLGFYGGRCCPTPPTPHRRRX
                ||||::||  :  || | :|||||||||
g694          PCSDGIHVFLXXLCDGRYCQAPPTPHRRRX
                   350       360       370
```

The following partial DNA sequence was identified in *N. meningitidis* <SEQ ID 2319>:

a694.seq

```
   1 TTGGTTTCCG CATCCGGCAC ACGGCAAAAA TGCCGTCTGA AGCCTGTTCA
  51 GACGGCATTT GTGTTGCCCA AACATTCAAC GCCTGCGTCA ACGTTTGCAC
 101 AAATCGGGTT TGGTTTCGCC CTCGCGGCGC AACTCTTTGG GCAGGACGAA
 151 CACAATGCTT TCTTCCGCAC CCTCGCCTTC GCGTACGGTT TCGTGCCCCC
 201 ATCCGCGTAT GGTTGCCAGT ACTTCCCGCA CCAACACTTC GGGCGCGGAC
 251 GCGCCTGCCG TTACGCCGAC TTTGTTTTTG CCCTCAAACC ATGCGCGTTG
 301 CAGGTAGCCT GCATTATCCA CCATATACGC ATCGATTCCG CGCGATGCCG
 351 CCACTTCGCG CAAGCGGTTG CTGTTGGACG AATTGGGCGA ACCGACCACA
 401 ATCACGATGT CGCACTGTTC TGCCAACTCT TTGACGGCGG TTTGCCGGTT
 451 GGTCGTCGCA TAGCAGATAT CTTCCTTGTG CGGATTGCGG ATATTGGGGA
 501 AACGCGCGTT CAGCGCGGCG ATGATGTCTT TGGTTTCATC GACCGAGAGC
 551 GTGGTTTGGC TGACATAGGC GAGTTTGTCG GGGTTTCTGA CTTCGAGTTT
 601 TGCCACATCT CCGACCGTTT CGACCAAAAG CATTTTGCCC GGCGCAAGCT
 651 GCCCCATCGT TCCTTCGACC TCGACGTGCC CCTTATGCCC GATCATGATG
 701 ATTTCACAGT CTTGGGCATC CAGTCGGGCG ACTTCCTTAT GCACTTTCGT
 751 CACCAGCGGG CAAGTCGCAT CAAACACGCG GAAACCGCGC TCCGCCGCTT
 801 CTTGCCGCAC CGCCTTCGAT ACGCCGTGTG CCGAATAAAC CAGTGTCGCG
 851 CCCGGCGGCA CTTCCGCCAA GTCTTCAATA AACACCGCAC CTTTTTCACG
 901 CAGGTTGTCC ACGACGAATT TGTTGTGAAC GACTTCGTGG CGCACATAAA
 951 TCGGCGCGCC GAACTCTTCC AAAGCACGTT CGACAATACT GATTGCCCGA
1001 TCCACACCAG CGCAGAAGCC GCGCGGATTG GCAAGGATGA TGGTTTTCTC
```

-continued

```
1051 GTTCATAAGC CCGGTATTTC GTTTTCAGAC GGCATCAATA TTTTTCTTCT

1101 TGGGTTTTAC GGTGGACGAT GTTGTCCAAC ACCGCCAACA CCGCACCGAC

1151 GCAGATAA
```

This corresponds to the amino acid sequence <SEQ ID 2320; ORF 694.a>:

```
a694.pep

  1 LVSASGTRQK CRLKPVQTAF VLPKHSTPAS TFAQIGFGFA LAAQLFGQDE

 51 HNAFFRTLAF AYGFVPPSAY GCQYFPHQHF GRGRACRYAD FVFALKPCAL

101 QVACIIHHIR IDSARCRHFA QAVAVGRIGR TDHNHDVALF CQLFDGGLPV

151 GRRIADIFLV RIADIGETRV QRGDDVFGFI DRERGLADIG EFVGVSDFEF

201 CHISDRFDQK HFARRKLPHR SFDLDVPLMP DHDDFTVLGI QSGDFLMHFR

251 HQRASRIKHA ETALRRFLPH RLRYAVCRIN QCRARRHFRQ VFNKHRTFFT

301 QVVHDEFVVN DFVAHINRRA ELFQSTFDNT DCPIHTSAEA ARIGKDDGFL

351 VHKPGISFSD GINIFLLGFY GGRCCPTPPT PHRRR*
```

Computer analysis of this amino acid sequence gave the following results:

Homology with a predicted ORF from *N. meningitidis*

ORF 694 shows 100% identity over a 385 aa overlap with a predicted ORF (ORF 694) from *N. meningitidis:* m694/a694 100.0% identity in 385 aa overlap

```
                   10        20        30        40        50        60
m694.pep   LVSASGTRQKCRLKPVQTAFVLPKHSTPASTFAQIGFGFALAAQLFGQDEHNAFFRTLAF
           ||||||||||||||||||||||||||||||||||||||||||||||||||||||||||||
a694       LVSASGTRQKCRLKPVQTAFVLPKHSTPASTFAQIGFGFALAAQLFGQDEHNAFFRTLAF
                   10        20        30        40        50        60

                   70        80        90       100       110       120
m694.pep   AYGFVPPSAYGCQYFPHQHFGRGRACRYADFVFALKPCALQVACIIHHIRIDSARCRHFA
           ||||||||||||||||||||||||||||||||||||||||||||||||||||||||||||
a694       AYGFVPPSAYGCQYFPHQHFGRGRACRYADFVFALKPCALQVACIIHHIRIDSARCRHFA
                   70        80        90       100       110       120

                  130       140       150       160       170       180
m694.pep   QAVAVGRIGRTDHNHDVALFCQLFDGGLPVGRRIADIFLVRIADIGETRVQRGDDVFGFI
           ||||||||||||||||||||||||||||||||||||||||||||||||||||||||||||
a694       QAVAVGRIGRTDHNHDVALFCQLFDGGLPVGRRIADIFLVRIADIGETRVQRGDDVFGFI
                  130       140       150       160       170       180

                  190       200       210       220       230       240
m694.pep   DRERGLADIGEFVGVSDFEFCHISDRFDQKHFARRKLPHRSFDLDVPLMPDHDDFTVLGI
           ||||||||||||||||||||||||||||||||||||||||||||||||||||||||||||
a694       DRERGLADIGEFVGVSDFEFCHISDRFDQKHFARRKLPHRSFDLDVPLMPDHDDFTVLGI
                  190       200       210       220       230       240

                  250       260       270       280       290       300
m694.pep   QSGDFLMHFRHQRASRIKHAETALRRFLPHRLRYAVCRINQCRARRHFRQVFNKHRTFFT
           ||||||||||||||||||||||||||||||||||||||||||||||||||||||||||||
a694       QSGDFLMHFRHQRASRIKHAETALRRFLPHRLRYAVCRINQCRARRHFRQVFNKHRTFFT
                  250       260       270       280       290       300

                  310       320       330       340       350       360
m694.pep   QVVHDEFVVNDFVAHINRRAELFQSTFDNTDCPIHTSAEAARIGKDDGFLVHKPGISFSD
           ||||||||||||||||||||||||||||||||||||||||||||||||||||||||||||
a694       QVVHDEFVVNDFVAHINRRAELFQSTFDNTDCPIHTSAEAARIGKDDGFLVHKPGISFSD
                  310       320       330       340       350       360

                  370       380
m694.pep   GINIFLLGFYGGRCCPTPPTPHRRRX
           ||||||||||||||||||||||||||
a694       GINIFLLGFYGGRCCPTPPTPHRRRX
                  370       380
```

The following partial DNA sequence was identified in *N. gonorrhoeae* <SEQ ID 2321>:

g695.seq

```
  1 TTGCCTCAAA CTCGTCCGGC AAGGCGGCAT CATCGCCATC GACAATATTT
 51 TGTTGAACGG AAGGGTGATG CGCGAAGCGG CTTTTGATGC GCCGCCCAGT
101 GTCAAAATTC TCAAAGATTT CAATCAAAAC CTGCCGAACG ATACGCGGAT
151 TGTCCCCATC ACCCTGCCCG TCGGCGACGG TTTGACCCTG CTTCTGAAAA
201 AATAATGAAG ACCAAATTAC CGCTTTTTAT CATTTGGCTG TCTGTGTCTG
251 CCTCCTGTGC TTCCGTTTTA CCCGTTCCGG AGGGCAGCCG AACCGAAATG
301 CCGACACAGG AAAATGCTTC AGACGGCATT CCCTATCCCG TTCCCACTCT
351 GCAAGACCGT TTGGACTATC TGGAAGGCAA AATCGTCCGG CTGTCGAACG
401 AAGTGGAAAT GTTAAACGGG AAAGTCAAAG CATTGGAGCA TACGAAAATA
451 CACCCTTCCG GCAGGACATA CGTCCAAAAA CTCGACGACC GCAAATTGAA
501 AGAGCATTAC CTCAATACCG AAGGCGGCAG CGCATCCGCA CATACCGTCG
551 AAACCGCACA AAACCTCTAC AATCAGGCAC TCAAACACTA TCAAAACGGC
601 AGGTTTTCTG CCGCAGCCGC CTTGTTGAAG GGGGCGGACG GCGGAGACGG
651 CGGCAGCATC GCGCAACGCA GTATGTACCT GTTGCTGCAA AGCAGGGCGC
701 GTATGGGGAA CTGTGAATCT GTCATCGAAA TCGGAGGGCG TTACGCCAAC
751 CGTTTCAAAG ACAGCCCAAC CGCGCCCGAA GTCATATTCA AAATCGGCGA
801 ATGCCAATAC AGGCTTCAGC AAAAAGACAT TGCAAGGGCG ACTTGGCGCA
851 GCCTGATACA GACCTATCCC GGCAGCCCGG CGGCAAAACG CGCCGCCGCA
901 GCCGTACGCA AACGATAG
```

This corresponds to the amino acid sequence <SEQ ID 2322; ORF 695>:

g695.pep

```
  1 LPQTRPARRH HRHRQYFVER KGDARSGF*C AAQCQNSQRF QSKPAERYAD
 51 CPHHPARRRR FDPASEKIMK TKLPLFIIWL SVSASCASVL PVPEGSRTEM
101 PTQENASDGI PYPVPTLQDR LDYLEGKIVR LSNEVEMLNG KVKALEHTKI
151 HPSGRTYVQK LDDRKLKEHY LNTEGGSASA HTVETAQNLY NQALKHYQNG
201 RFSAAAALLK GADGGDGGSI AQRSMYLLLQ SRARMGNCES VIEIGGRYAN
251 RFKDSPTAPE VIFKIGECQY RLQQKDIARA TWRSLIQTYP GSPAAKRAAA
301 AVRKR*
```

The following partial DNA sequence was identified in *N. meningitidis* <SEQ ID 2323>:

m695.seq

```
  1 TTGCCTCAAA CTCGTCCGTC AAGGCGGCAT CATCGCCATC GACAATATTT
 51 TGCTGAACGG AAGGGTGATG CGCGAAGCGG CTTCCGATGC GCCGCCCAGC
101 GTCGGCATCC TCAAAGATTT CAATCAAAAC CTGCCGAACG ACCCGCGCAT
```

-continued

```
151 CGTCCCCATC ACCCTGCCCG TCGGCGACGG CTTGACCCTG CTTCTGAAAA
201 AATAATGAAG ATCAAATTAC CGCTTTTTAT CATTTGGCTG TCTGTGTCCG
251 CCTCCTGTGC TTCCGTTTCA CCCGTTCCGG CAGGCAGCCA AACCGAAATG
301 TCGACACGGG AAAATGCTTC AGACGGCATT CCCTATCCCG TTCCGACCTT
351 GCAAGACCGT TTGGACTATC TGGAAGGCAA AATCGTCCGG CTGTCGAACG
401 AAGTGGAAAC CTTAAACGGC AAAGTCAAAG CACTGGAACA CGCAAAAACA
451 CATTCTTCCG GCAGGGCATA CGTCCAAAAA CTCGACGACC GCAAGTTGAA
501 AGAGCATTAC CTCAATACCG AAGGCGGCAG CGCATCCGCA CATACTGTCG
551 AAACCGCACA AAACCTCTAC AATCAGGCAC TCAAACACTA TAAAAGCGGC
601 AAGTTTTCTG CCGCTGCCTC CCTGTTGAAA GGCGCGGACG GAGGCGACGG
651 CGGCAGCATC GCGCAACGCA GTATGTACCT GTTGCTGCAA AGCAGGGCGC
701 GTATGGGCAA CTGCGAATCC GTCATCGAAA TCGGAGGGCG TTACGCCAAC
751 CGTTTCAAAG ACAGCCCAAC CGCGCCTGAA GCCATGTTCA AAATCGGCGA
801 ATGCCAATAC AGGCTTCAGC AAAAAGACAT TGCAAGGGCG ACTTGGCGCA
851 GCCTGATACA GACCTATCCC GGCAGCCCGG CGGCAAAACG CGCCGCCGCA
901 GCCGTGCGCA AACGATAG
```

This corresponds to the amino acid sequence <SEQ ID 2324; ORF 695>:

<u>m695.pep</u>

```
  1 LPQTRPSRRH HRHRQYFAER KGDARSGFRC AAQRRHPQRF QSKPAERPAH
 51 RPHHPARRRR LDPASEKIMK IKLPLFIIWL SVSASCASVS PVPAGSQTEM
101 STRENASDGI PYPVPTLQDR LDYLEGKIVR LSNEVETLNG KVKALEHAKT
151 HSSGRAYVQK LDDRKLKEHY LNTEGGSASA HTVETAQNLY NQALKHYKSG
201 KFSAAASLLK GADGGDGGSI AQRSMYLLLQ SRARMGNCES VIEIGGRYAN
251 RFKDSPTAPE AMFKIGECQY RLQQKDIARA TWRSLIQTYP GSPAAKRAAA
301 AVRKR*
```

Computer analysis of this amino acid sequence gave the following results:

Homology with a predicted ORF from *N. gonorrhoeae*

ORF 694 shows 90.8% identity over a 305 aa overlap with a predicted ORF (ORF 695) from *N. gonorrhoeae:* m695/g695 90.8% identity in 305 aa overlap

```
                       10        20        30        40        50        60
m695.pep       LPQTRPSRRHHRHRQYFAERKGDARSGFRCAAQRRHPQRFQSKPAERPAHRPHHPARRRR
               ||||||:||||||||||:|||||||||| ||| :: ||||||||||| |  |||||||||
g695           LPQTRPARRHHRHRQYFVERKGDARSGFXCAAQCQNSQRFQSKPAERYADCPHHPARRRR
                       10        20        30        40        50        60

                       70        80        90       100       110       120
m695.pep       LDPASEKIMKIKLPLFIIWLSVSASCASVSPVPAGSQTEMSTRENASDGIPYPVPTLQDR
               :||||||||| |||||||||||||||||| ||| ||:||| |:|||||||||||||||||
g695           FDPASEKIMKTKLPLFIIWLSVSASCASVLPVPEGSRTEMPTQENASDGIPYPVPTLQDR
                       70        80        90       100       110       120
```

-continued

```
                130       140       150       160       170       180
m695.pep  LDYLEGKIVRLSNEVETLNGKVKALEHAKTHSSGRAYVQKLDDRKLKEHYLNTEGGSASA
          |||||||||||||||| ||||||||||:| | |||:|||||||||||||||||||||||||
g695      LDYLEGKIVRLSNEVEMLNGKVKALEHTKIHPSGRTYVQKLDDRKLKEHYLNTEGGSASA
                130       140       150       160       170       180

                190       200       210       220       230       240
m695.pep  HTVETAQNLYNQALKHYKSGKFSAAASLLKGADGGDGGSIAQRSMYLLLQSRARMGNCES
          |||||||||||||||||::|:|||||:|||||||||||||||||||||||||||||||||
g695      HTVETAQNLYNQALKHYQNGRFSAAAALLKGADGGDGGSIAQRSMYLLLQSRARMGNCES
                190       200       210       220       230       240

                250       260       270       280       290       300
m695.pep  VIEIGGRYANRFKDSPTAPEAMFKIGECQYRLQQKDIARATWRSLIQTYPGSPAAKRAAA
          ||||||||||||||||||||::||||||||||||||||||||||||||||||||||||||
g695      VIEIGGRYANRFKDSPTAPEVIFKIGECQYRLQQKDIARATWRSLIQTYPGSPAAKRAAA
                250       260       270       280       290       300

m695.pep  AVRKRX
          ||||||
g695      AVRKRX
```

The following partial DNA sequence was identified in *N. meningitidis* <SEQ ID 2325>:

a695.seq

```
  1 TTGCCTCAAG CTTGTCCGGC AAGGCGGCAT CATTGCCATC GACAATATTT

 51 TGTTGAACGG AAGGGTGATG CGCGAAGCGG CTTCCGATGC GCCGCCCAGC

101 GTCGGCATCC TCAAAGATTT TAATCAAAAC CTGCCGAACG ATACGCGGAT

151 TGTCCCCATC ACCCTGCCCG TCGGCGACGG TTTGACCCTG CTTCTGAAAA

201 AATAATGAAG ACCAAATTAC CGCTTTTTAT CATTTGGCTG TCCGTATCCG

251 CCGCCTGTTC TTCCCCTGTT TCCCGCAATA TTCAGGATAT GCGGCTCGAA

301 CCGCAGGCAG AGGCAGGTAG TTCGGACGCT ATTCCCTATC CCGTTCCCAC

351 TCTGCAAGAC CGTTTGGATT ATCTGGAAGG CACACTCGTC CGCCTGTCGA

401 ACGAAGTGGA AACCTTAAAC GGCAAAGTCA AAGCACTGGA GCATGCGAAA

451 ACACACCCTT CCAGCAGGGC ATACGTCCAA AAACTCGACG ACCGCAAGTT

501 GAAAGAGCAT TACCTCAATA CCGAAGGCGG CAGCGCATCC GCACATACCG

551 TCGAAACCGC ACAAAACCTC TACAATCAGG CACTCAAACA CTATAAAAGC

601 GGCAGGTTTT CTGCCGCTGC CTCCCTGTTG AAAGGCGCGG ACGGAGGCGA

651 CGGCGGCAGC ATCGCGCAAC GCAGTATGTA CCTGTTGCTG CAAAGCAGGG

701 CGCGTATGGG CAACTGCGAA TCCGTCATCG AAATCGGAGG GCGTTACGCC

751 AACCGTTTCA AAGACAGCCC AACCGCGCCT GAAGCCATGT TCAAAATCGG

801 CGAATGCCAA TACAGGCTTC AGCAAAAAGA CATTGCAAGG GCGACTTGGC

851 GCAGCCTGAT ACAGACCTAT CCCGGCAGCC CGGCGGCAAA ACGCGCCGCC

901 GCAGCCGTGC GCAAACGATA G
```

This corresponds to the amino acid sequence <SEQ ID 2326; ORF 695.a>:

a695.pep

```
  1 LPQACPARRH HCHRQYFVER KGDARSGFRC AAQRRHPQRF *SKPAERYAD

 51 CPHHPARRRR FDPASEKIMK TKLPLFIIWL SVSAACSSPV SRNIQDMRLE
```

-continued

```
101 PQAEAGSSDA IPYPVPTLQD RLDYLEGTLV RLSNEVETLN GKVKALEHAK

151 THPSSRAYVQ KLDDRKLKEH YLNTEGGSAS AHTVETAQNL YNQALKHYKS

201 GRFSAAASLL KGADGGDGGS IAQRSMYLLL QSRARMGNCE SVIEIGGRYA

251 NRFKDSPTAP EAMFKIGECQ YRLQQKDIAR ATWRSLIQTY PGSPAAKRAA

301 AAVRKR*
```

Computer analysis of this amino acid sequence gave the following results:

Homology with a predicted ORF from *N. meningitidis*

ORF 695 shows 88.3% identity over a 308 aa overlap with a predicted ORF (ORF 695) from *N. meningitidis:* m695/a695 88.3% identity in 308 aa overlap

```
                      10        20        30        40        50        60
m695.pep      LPQTRPSRRHHRHRQYFAERKGDARSGFRCAAQRRHPQRFQSKPAERPAHRPHHPARRRR
              |||: |:|||| |||||:|||||||||||||||||||||| |||||| |  |||||||||
a695          LPQACPARRHHCHRQYFVERKGDARSGFRCAAQRRHPQRFXSKPAERYADCPHHPARRRR
                      10        20        30        40        50        60

                      70        80        90       100       110
m695.pep      LDPASEKIMKIKLPLFIIWLSVSASCASVSPVPAGSQT---EMSTRENASDGIPYPVPTL
              :||||||||| |||||||||||||||:|:|  ||  : |    | ::: ::||:||||||||
a695          FDPASEKIMKTKLPLFIIWLSVSAACSS--PVSRNIQDMRLEPQAEAGSSDAIPYPVPTL
                      70        80          90       100       110

              120       130       140       150       160       170
m695.pep      QDRLDYLEGKIVRLSNEVETLNGKVKALEHAKTHSSGRAYVQKLDDRKLKEHYLNTEGGS
              ||||||||| :||||||||||||||||||||||| |:|||||||||||||||||||||||
a695          QDRLDYLEGTLVRLSNEVETLNGKVKALEHAKTHPSSRAYVQKLDDRKLKEHYLNTEGGS
             120       130       140       150       160       170

              180       190       200       210       220       230
m695.pep      ASAHTVETAQNLYNQALKHYKSGKFSAAASLLKGADGGDGGSIAQRSMYLLLQSRARMGN
              |||||||||||||||||||||||:||||||||||||||||||||||||||||||||||||
a695          ASAHTVETAQNLYNQALKHYKSGRFSAAASLLKGADGGDGGSIAQRSMYLLLQSRARMGN
             180       190       200       210       220       230

              240       250       260       270       280       290
m695.pep      CESVIEIGGRYANRFKDSPTAPEAMFKIGECQYRLQQKDIARATWRSLIQTYPGSPAAKR
              ||||||||||||||||||||||||||||||||||||||||||||||||||||||||||||
a695          CESVIEIGGRYANRFKDSPTAPEAMFKIGECQYRLQQKDIARATWRSLIQTYPGSPAAKR
             240       250       260       270       280       290

              300
m695.pep      AAAAVRKRX
              |||||||||
a695          AAAAVRKRX
             300
```

The following partial DNA sequence was identified in *N. gonorrhoeae* g696.seq: not found

This corresponds to the amino acid sequence <ORF 696.ng>:

g696.pep: not found

The following partial DNA sequence was identified in *N. meningitidis* <SEQ ID 2327>:

m696.seq

```
  1 TTGGGTTGCC GGCAGGCGGC ATCCCATCAT TTTTGCCAAG GCAACAAATT

 51 ATTTGGCGGC ATCTTTCATT TTGTCTGCCG CTTCCTGAGT CGCGTCGGCA

101 GCTTTGTTCA AAGTATCTTT AGCTGCTTCA GTTACAGCTT CTTTGGCTTC

151 AGTTACAGCT TCCTCGGCAC TTGCCTTTGC ATCAGCCGCA GCATCTTTGA
```

-continued

```
201 CTTGGTCTTT CGCTTCTTCG ACGGCAGAAG CGGCAGACTC GGCGGCAGAA

251 GCCGCAGTGT CTTTAACATC GGACTCAACG GCTTGAACCG CTTCCTTAAC

301 CTCCTGTTTG GCTTCTTGCG AACAAGCTGC CAAGGCAGCC GCCATCATTG

351 CGGCAATCAA TAA
```

This corresponds to the amino acid sequence <SEQ ID 2328; ORF 696>:

m696.pep

```
  1 LGCRQAASHH FCQGNKLFGG IFHFVCRFLS RVGSFVQSIF SCFSYSFFGF

 51 SYSFLGTCLC ISRSIFDLVF RFFDGRSGRL GGRSRSVFNI GLNGLNRFLN

101 LLFGFLRTSC QGSRHHCGNQ *
```

The following partial DNA sequence was identified in *N. meningitidis* <SEQ ID 2329>:

a696.seq

```
  1 TTGGGTTGCC GGCAGGCGGC ATCCCATCAT TTTTGCCAAG GCAACAAATT

 51 ATTTGGCGGC ATCTTTCATT TTGTCTGCCG CTTCCTGAGT CGCGTCGGCA

101 GCTTTGTTCA AAGTATCTTT AGCTGCTTCA GTTACAGCTT CTTTGGCTTC

151 AGTTACAGCT TCCTCGGCAC TTGCCTTTGC ATCAGCCGCA GCATCTTTGA

201 CTTGGTCTTT CGCTTCTTCG ACGGCAGAAG CGGCAGACTC GGCGGCAGAA

251 GCCGCAGTGT CTTTAACATC GGACTCAACG GCTTGAACCG CTTCCTTAAC

301 CTCCTGTTTG GCTTCTTGCG AACAAGCTGC CAAGGCAGCC GCCATCATTG

351 CGGCAATCAA TAA
```

This corresponds to the amino acid sequence <SEQ ID 2330; ORF 696.a>:

a696.pep

```
  1 LGCRQAASHH FCQGNKLFGG IFHFVCRFLS RVGSFVQSIF SCFSYSFFGF

 51 SYSFLGTCLC ISRSIFDLVF RFFDGRSGRL GGRSRSVFNI GLNGLNRFLN

101 LLFGFLRTSC QGSRHHCGNQ *
```

Computer analysis of this amino acid sequence gave the following results:

Homology with a predicted ORF from *N meningitidis*

ORF 696 shows 100.0% identity over a 120 aa overlap with a predicted ORF (ORF 696.a) from *N. meningitidis:* m696/a696 100.0% identity in 120 aa overlap

```
                  10        20        30        40        50        60
m696.pep  LGCRQAASHHFCQGNKLFGGIFHFVCRFLSRVGSFVQSIFSCFSYSFFGFSYSFLGTCLC
          ||||||||||||||||||||||||||||||||||||||||||||||||||||||||||||
a696      LGCRQAASHHFCQGNKLFGGIFHFVCRFLSRVGSFVQSIFSCFSYSFFGFSYSFLGTCLC
                  10        20        30        40        50        60
```

-continued

```
                   70        80        90        100       110       120
m696.pep  ISRSIFDLVFRFFDGRSGRLGGRSRSVFNIGLNGLNRFLNLLFGFLRTSCQGSRHHCGNQ
          ||||||||||||||||||||||||||||||||||||||||||||||||||||||||||||
a696      ISRSIFDLVFRFFDGRSGRLGGRSRSVFNIGLNGLNRFLNLLFGFLRTSCQGSRHHCGNQ
                   70        80        90        100       110       120

m696.pep  X
          |
a696      X
```

The following partial DNA sequence was identified in *N. gonorrhoeae* <SEQ ID 2331>:

g700.seq

```
  1 ATGAGCAGCC TGATGACGTT GTTTTCGGTA TTGGTACCGA TGTTTGCCGG
 51 ATTTTTTATC CGTGTTCCCA AGCCTTACCT GCCCGCTTCG GACAAGGTGC
101 TGTCGGTTTT GGTGTATGCC GTGCTGCTGC TGATCGGCGT ATCGTTGTCG
151 CGCGTGGAGG ATTTGGGTTC GCGGTTGGGC GATATGGCGT TGACGGTTCT
201 GTGGCTGTTT GTTTGTACGG TAGGGGCGAA CCTGCTTGCC TTGGCAGTGT
251 TGGGAAAGTT GTCCCCGTGG CGGATAGGGG GAAAAGGGAA GGGCGTTTCG
301 GTCGGCGTGT CGGGCAGTGT GAGGCAGCTC GGATGCGTAC TGCTCGGTTT
351 TGTGTCCGGC AAATTGATGT GCGATATTTG GATGCCGTCT GAAAACGCGG
401 GTATGTACTG CCTGATGCTG CTGGTGTTCC TCATCGGCGT ACAGCTCAAA
451 AGTAGCGGCG TATCGTTGCG GCAGGTTTTG CTTAACCGGC GGGGCATCCG
501 GCTGTCGGTT TGGTTTATAT TGTCATCTCT TTCAGGCGGG CTGCTGTTTG
551 CCGCATCGGC AGATGGTGTG TCGTGGACGA AAGGTTTGGC GATGGCTTCC
601 GGCTTCGGTT GGTATTCCCT CTCGGGTTTG GTAATGACCG AGGCTTACGG
651 GGCGGTATGG GGCAGCATCA TGCTGCTGAA CGATTTGGCA CGAGAGCTGT
701 TTGCACTGGC ATTTATTCCG CTGCTGATGA AGCGTTTTCC GGATGCGGCG
751 GTGGGGGTCG GCGGCGCGAC CAGTATGGAT TTCACATTGC CCGTAATTCA
801 GGGTGCGGGC GGTTTGGAAG TCGTGCCGGT AGCGGTCAGC TTCGGCGTGG
851 TGGTCAATAT CGCCGCCCCG TTTCTGATGG TGGTGTTTTC CACGCTGGGC
901 TGA
```

This corresponds to the amino acid sequence <SEQ ID 2332; ORF 700>:

g700.pep

```
  1 MSSLMTLFSV LVPMFAGFFI RVPKPYLPAS DKVLSVLVYA VLLLIGVSLS
 51 RVEDLGSRLG DMALTVLWLF VCTVGANLLA LAVLGKLSPW RIGGKGKGVS
101 VGVSGSVRQL GCVLLGFVSG KLMCDIWMPS ENAGMYCLML LVFLIGVQLK
151 SSGVSLRQVL LNRRGIRLSV WFILSSLSGG LLFAASADGV SWTKGLAMAS
201 GFGWYSLSGL VMTEAYGAVW GSIMLLNDLA RELFALAFIP LLMKRFPDAA
251 VGVGGATSMD FTLPVIQGAG GLEVVPVAVS FGVVVNIAAP FLMVVFSTLG
301 *
```

The following partial DNA sequence was identified in *N. meningitidis* <SEQ ID 2333>:

m700.seq

```
  1 ATGGACAGCC TGATGACGTT GCTTTCGGTA TTGATACCGA TGTTTGCCGG
 51 ATTTTTTATC CGTGTGCCCA AGCCTTACCT GCCCGCTTTG GATAAGGTGC
101 TATCGGTCTT GGTGTATGCT GTGCTGCTGC TGATCGGCGT CTCGTTGTCG
151 CGCGTGGAGG ATTTGGGTTC GCGGTTGGAC GATATGGCGT TGACGGTTCT
201 GTGGCTGTTT GTTTGTACGG TCGGGGCGAA CCTGCTTGCT TTGGCAGTGT
251 TGGGAAAGTT ATTCCCGTGG CGGATAAAGG GGAAAGGGAA GGGCGTTTCG
301 GTCGGCGTGT CGGGCAGTGT GGGGCAGCTC GGATGCGTGC TGCTCGGATT
351 TGCATTCGGC AAACTGATGC GCGATATTTG GATGCCGTCT GAAAGCGCGG
401 GCATGTATTG TCTGATGCTG CTGGTGTTCC TCATCGGCGT ACAGCTCAAA
451 AGCAGCGGCG TATCGTTGCG GCAGGTTTTG GTCAACCGCA GGGGTATTCG
501 GTTGTCGGTC TGGTTTATGC TTTCATCTCT TTCGGGCGGG CTGCTGTTTG
551 CCGCATCGAC AGACGGTGTG TCGTGGACGA AAGGTTTGGC GATGGCTTCC
601 GGCTTCGGTT GGTATTCCCT CTCGGGTTTG GTCATGACCG AGGCTTACGG
651 CGCGGTATGG GGCAGCATCA TGCTGCTGAA CGATTTGGCA CGAGAGCTGT
701 TTGCACTGGC ATTTATCCCG CTGCTGATGA AGCGTTTTCC AGATGCGGCG
751 GTGGGGGTTG GCGGTGCGAC CAGTATGGAT TTTACATTGC CCGTGATTCA
801 GGGTGCGGGC GGTTTGGAAG TCGTGCCGGT AGCGGTCAGC TTCGGCGTGG
851 TGGTCAATAT CGCCGCCCCG TTTCTGATGG TGGTGTTTTC CGCTTTGGGT
901 TGA
```

This corresponds to the amino acid sequence <SEQ ID 2334; ORF 700>:

m700.pep

```
  1 MDSLMTLLSV LIPMFAGFFI RVPKPYLPAL DKVLSVLVYA VLLLIGVSLS
 51 RVEDLGSRLD DMALTVLWLF VCTVGANLLA LAVLGKLFPW RIKGKGKGVS
101 VGVSGSVGQL GCVLLGFAFG KLMRDIWMPS ESAGMYCLML LVFLIGVQLK
151 SSGVSLRQVL VNRRGIRLSV WFMLSSLSGG LLFAASTDGV SWTKGLAMAS
201 GFGWYSLSGL VMTEAYGAVW GSIMLLNDLA RELFALAFIP LLMKRFPDAA
251 VGVGGATSMD FTLPVIQGAG GLEVVPVAVS FGVVVNIAAP FLMVVFSALG
301 *
```

Computer analysis of the amino acid sequences gave the following results:

Homology with a predicted ORF from *N. gonorrhoeae* with menB

ORF 700 shows 94.7% identity over a 300 aa overlap with a predicted ORF (ORF700.ng) from *N. gonorrhoeae*:

m700/g700

```
                   10        20        30        40        50        60
m700.pep   MDSLMTLLSVLIPMFAGFFIRVPKPYLPALDKVLSVLVYAVLLLIGVSLSRVEDLGSRLD
           |:|||||:|||:||||||||||||||||| ||||||||||||||||||||||||||||| 
g700       MSSLMTLFSVLVPMFAGFFIRVPKPYLPASDKVLSVLVYAVLLLIGVSLSRVEDLGSRLG
                   10        20        30        40        50        60

                   70        80        90       100       110       120
m700.pep   DMALTVLWLFVCTVGANLLALAVLGKLFPWRIKGKGKGVSVGVSGSVGQLGCVLLGFAFG
           ||||||||||||||||||||||||||| |||| |||||||||||||| |||||||||: |
g700       DMALTVLWLFVCTVGANLLALAVLGKLSPWRIGGKGKGVSVGVSGSVRQLGCVLLGFVSG
                   70        80        90       100       110       120

                  130       140       150       160       170       180
m700.pep   KLMRDIWMPSESAGMYCLMLLVFLIGVQLKSSGVSLRQVLVNRRGIRLSVWFMLSSLSGG
           ||| |||||||:||||||||||||||||||||||||||||:|||||||||||:|||||||
g700       KLMCDIWMPSENAGMYCLMLLVFLIGVQLKSSGVSLRQVLLNRRGIRLSVWFILSSLSGG
                  130       140       150       160       170       180

                  190       200       210       220       230       240
m700.pep   LLFAASTDGVSWTKGLAMASGFGWYSLSGLVMTEAYGAVWGSIMLLNDLARELFALAFIP
           ||||||:|||||||||||||||||||||||||||||||||||||||||||||||||||||
g700       LLFAASADGVSWTKGLAMASGFGWYSLSGLVMTEAYGAVWGSIMLLNDLARELFALAFIP
                  190       200       210       220       230       240

                  250       260       270       280       290       300
m700.pep   LLMKRFPDAAVGVGGATSMDFTLPVIQGAGGLEVVPVAVSFGVVVNIAAPFLMVVFSALG
           |||||||||||||||||||||||||||||||||||||||||||||||||||||||||:||
g700       LLMKRFPDAAVGVGGATSMDFTLPVIQGAGGLEVVPVAVSFGVVVNIAAPFLMVVFSTLG
                  250       260       270       280       290       300

m700.pep   X
           |
g700       X
```

The following partial DNA sequence was identified in *N. meningitidis* <SEQ ID 2335>:

a700.seq

```
  1 ATGGACAGCC TGATGACGTT GCTTTCGGTA TTGATACCGA TGTTTGCCGG
 51 ATTTTTTATC CGTGTGCCCA AGCCTTACCT GCCCGCTTTG GATAAGGTGC
101 TATCGGTCTT GGTGTATGCT GTGCTGCTGC TGATCGGCGT CTCGTTGTCG
151 CGCGTGGAGG ATTTGGGTTC GCGGTTGGAC GATATGGCGT TGACGGTTCT
201 GTGGCTGTTT GTTTGTACGG TCGGGGCGAA CCTGCTTGCT TTGGCAGTGT
251 TGGGAAAGTT ATTCCCGTGG CGGATAAAGG GGAAAGGGAA GGGCGTTTCG
301 GTCGGTGTGT CGGGCAGTGT GGGGCAGCTC GGATGCGTGC TGCTCGGATT
351 TGCATCCGGC AAACTGATGC GCGATATTTG GATGCCGTCT GAAAACGCGG
401 GTATGTATTG TCTGATGCTG CTGGTGCTCN TCATCGGCGT ACAGCTCAAA
451 AGCAGCGGCG TATCGTTGCG GCAGGTTTTG GTCAACCGCA GGGGTATTCG
501 GTTGTCGGTC TGGTTTATGC TTTCATCTCT TTCAGGCGGG CTGCTGTTTG
551 CCGCATCGGC AGACGGTGTG TCGTGGGTGA AAGGTTTGGC GATGGCTTCC
601 GGCTTCGGTT GGTATTCCCT CTCGGGTTTG GTGATGACCG AGGCTTACGG
651 CGCGGTATGG GGCAGTATCG CGCTTTTGAA CGATTTGGCA CGAGAGCTGT
701 TCGCGCTGGC ATTTATTCCG CTGCTGATGA AGCGTTTTCC CGATGCGGCA
751 GTGGGGGTCG GCGGCGCGAC CAGTATGGAT TTCACATTGC CCGTGATTCG
801 GGGTGCGGGC GGCTTGGAAG CCGTACCGGT AGCGGTCAGC TTCGGCGTGG
851 TGGTCAATAT CGCCGCTCCG TTTCTGATGG TGGTGTTTTC CGCTTTGGGC
901 TGA
```

This corresponds to the amino acid sequence <SEQ ID 2336; ORF 700.a>:

a700.pep

```
  1 MDSLMTLLSV LIPMFAGFFI RVPKPYLPAL DKVLSVLVYA VLLLIGVSLS
 51 RVEDLGSRLD DMALTVLWLF VCTVGANLLA LAVLGKLFPW RIKGKGKGVS
101 VGVSGSVGQL GCVLLGFASG KLMRDIWMPS ENAGMYCLML LVLXIGVQLK
151 SSGVSLRQVL VNRRGIRLSV WFMLSSLSGG LLFAASADGV SWVKGLAMAS
201 GFGWYSLSGL VMTEAYGAVW GSIALLNDLA RELFALAFIP LLMKRFPDAA
251 VGVGGATSMD FTLPVIRGAG GLEAVPVAVS FGVVVNIAAP FLMVVFSALG
301 *
```

m700/a700 97.0% identity in 300 aa overlap

```
                   10        20        30        40        50        60
m700.pep   MDSLMTLLSVLIPMFAGFFIRVPKPYLPALDKVLSVLVYAVLLLIGVSLSRVEDLGSRLD
           ||||||||||||||||||||||||||||||||||||||||||||||||||||||||||||
a700       MDSLMTLLSVLIPMFAGFFIRVPKPYLPALDKVLSVLVYAVLLLIGVSLSRVEDLGSRLD
                   10        20        30        40        50        60

                   70        80        90       100       110       120
m700.pep   DMALTVLWLFVCTVGANLLALAVLGKLFPWRIKGKGKGVSVGVSGSVGQLGCVLLGFAFG
           |||||||||||||||||||||||||||||||||||||||||||||||||||||||||| |
a700       DMALTVLWLFVCTVGANLLALAVLGKLFPWRIKGKGKGVSVGVSGSVGQLGCVLLGFASG
                   70        80        90       100       110       120

                  130       140       150       160       170       180
m700.pep   KLMRDIWMPSESAGMYCLMLLVFLIGVQLKSSGVSLRQVLVNRRGIRLSVWFMLSSLSGG
           ||||||||||:|||||||||: |||||||||||||||||||||||||||||||||||||
a700       KLMRDIWMPSENAGMYCLMLLVLXIGVQLKSSGVSLRQVLVNRRGIRLSVWFMLSSLSGG
                  130       140       150       160       170       180

                  190       200       210       220       230       240
m700.pep   LLFAASTDGVSWTKGLAMASGFGWYSLSGLVMTEAYGAVWGSIMLLNDLARELFALAFIP
           ||||||:|||||:||||||||||||||||||||||||||||||| |||||||||||||||
a700       LLFAASADGVSWVKGLAMASGFGWYSLSGLVMTEAYGAVWGSIALLNDLARELFALAFIP
                  190       200       210       220       230       240

                  250       260       270       280       290       300
m700.pep   LLMKRFPDAAVGVGGATSMDFTLPVIQGAGGLEVVPVAVSFGVVVNIAAPFLMVVFSALG
           ||||||||||||||||||||||||||:||||||:||||||||||||||||||||||||||
a700       LLMKRFPDAAVGVGGATSMDFTLPVIRGAGGLEAVPVAVSFGVVVNIAAPFLMVVFSALG
                  250       260       270       280       290       300

m700.pep   X
           |
a700       X
```

The following partial DNA sequence was identified in *N. gonorrhoeae* <SEQ ID 2337>:

g701.seq

```
  1 ATGTCTTGGC ACATATTCCA AGTTGCAGGG ATACCGACCG CTTCGATGGC
 51 ACAATCTACG CCGTCTTCGC CCACGATGGC GAAAACTTGT TTGGAGACGT
101 CGCCGGAAGC GGGGCTGATG GTATGGGTCG CGCCCAACTC TTTCGCCGGT
151 TTCAAACGGT TTTCGTCCAT ATCGCACACG ATAATGGCGG CAGGGCTATA
201 CAGTTGGGCG GTCAACAAGG CGGACATACC GACAGGGCCG GCACCTGCGA
251 TGAATACGGT ATCGCCGGGT TTCACATCGC CGTATTGCAC GCCGATTTCG
301 TGGGCGGTCG GTAAAGCGTC GCTCAACAGC AGGGCGATTT CTTCGTTGAC
351 GTTGTCGTGC GGCGGCACGA GGCTGTTGTC GGCATAA
```

This corresponds to the amino acid sequence <SEQ ID 2338; ORF 701>:

g701.pep

```
  1 MSWHIFQVAG IPTASMAQST PSSPTMAKTC LETSPEAGLM VWVAPNSFAG

 51 FKRFSSISHT IMAAGLYSWA VNKADIPTGP APAMNTVSPG FTSPYCTPIS

101 WAVGKASLNS RAISSLTLSC GGTRLLSA*
```

The following partial DNA sequence was identified in *N. meningitidis* <SEQ ID 2339>:

m701.seq

```
  1 ATGTCTTGGC ACATATTCCA TGTAGCAGGG ATACCGACGG CTTCGATGGC

 51 GCAATCCACG CCGTCTTCGC CGACGATGGC AAAGACTTGT TTGGATACTT

101 CGCCGGAAGC AGGGTTAATG GTATGGGTCG CACCCAATTC TTTCGCCAGT

151 TTCAAACGGT TTTCGTCCAT ATCGCAAACG ATGATGGCGG CGGGACTGTA

201 CAGTTGGGCG GTCAACAGGG CGGACATACC GACAGGGCCT GCCCCAGCGA

251 TGAATACGGT GTCGCCGGGT TTGACATCGC CGTATTGCAC GCCGATTTCG

301 TGGGCGGTCG GCAAAGCGTC GCTCAACAAC AGGGCGATTT CTTCGTTGAC

351 ATTATCGGGC AGCGGAACGA GGCTGTTGTC GGCATAA
```

This corresponds to the amino acid sequence <SEQ ID 2340; ORF 701>:

m701.pep

```
  1 MSWHIFHVAG IPTASMAQST PSSPTMAKTC LDTSPEAGLM VWVAPNSFAS

 51 FKRFSSISQT MMAAGLYSWA VNRADIPTGP APAMNTVSPG LTSPYCTPIS

101 WAVGKASLNN RAISSLTLSG SGTRLLSA*
```

Computer analysis of the amino acid sequences gave the following results:

Homology with a predicted ORF from *N. gonorrhoeae* with menB

ORF 701 shows 92.2% identity over a 128 aa overlap with a predicted ORF (ORF701.ng) from *N. gonorrhoeae*:

m701/g701

```
                   10        20        30        40        50        60
m701.pep    MSWHIFHVAGIPTASMAQSTPSSPTMAKTCLDTSPEAGLMVWVAPNSFASFKRFSSISQT
            ||||||:|||||||||||||||||||||||:|||||||||||||||||:||||||||:|
g701        MSWHIFQVAGIPTASMAQSTPSSPTMAKTCLETSPEAGLMVWVAPNSFAGFKRFSSISHT
                   10        20        30        40        50        60

                   70        80        90       100       110       120
m701.pep    MMAAGLYSWAVNRADIPTGPAPAMNTVSPGLTSPYCTPISWAVGKASLNNRAISSLTLSG
            :|||||||||||:|||||||||||||||||:||||||||||||||||||:|||||||||
g701        IMAAGLYSWAVNKADIPTGPAPAMNTVSPGFTSPYCTPISWAVGKASLNSRAISSLTLSC
                   70        80        90       100       110       120

                  129
m701.pep    SGTRLLSAX
            :||||||||
g701        GGTRLLSAX
```

The following partial DNA sequence was identified in *N. meningitidis* <SEQ ID 2341>:

a701.seq

```
  1 ATGTCTTGGC ACATATTCCA AGTTGCAGGG ATACCGACGG CTTCGATCGC
 51 GCAGTCCACG CCGTCTTCGC CGACGATAGC GGCAACTTGC TTGCTTACAT
101 CGCCGGAAGC AGGGTTAATG GTATGGGTTG CGCCCAACTC TTTCGCCAGT
151 TTCAAACGGT TTTCGTCCAT ATCGCAAACA ATGATGGCGG CGGGGCTGTA
201 CAGTTGGGCG GTCGGCAAGG CGGACATACC GACAGGAGCG GCACCTGCGA
251 TGAATACGGT GTCGCCGGGT TTGACATCGC CGTATTGCAC GCCGATTTCG
301 TGTGCGGTCG GCAAAGCGTC GCTCAACAAC AGGGCGACTT CTTCGTTGAC
351 GTTGTCGGGC AGCGGCACGA GGCTGTTGTC GGCATAA
```

This corresponds to the amino acid sequence <SEQ ID 2342; ORF 701.a>:

a701.pep

```
  1 MSWHIFQVAG IPTASIAQST PSSPTIAATC LLTSPEAGLM VWVAPNSFAS
 51 FKRFSSISQT MMAAGLYSWA VGKADIPTGA APAMNTVSPG LTSPYCTPIS
101 CAVGKASLNN RATSSLTLSG SGTRLLSA*
```

m701/a701 92.2% identity in 128 aa overlap

```
                    10        20        30        40        50        60
m701.pep   MSWHIFHVAGIPTASMAQSTPSSPTMAKTCLDTSPEAGLMVWVAPNSFASFKRFSSISQT
           ||||||:||||||||:|||||||||:| ||| ||||||||||||||||||||||||||||
a701       MSWHIFQVAGIPTASIAQSTPSSPTIAATCLLTSPEAGLMVWVAPNSFASFKRFSSISQT
                    10        20        30        40        50        60

                    70        80        90       100       110       120
m701.pep   MMAAGLYSWAVNRADIPTGPAPAMNTVSPGLTSPYCTPISWAVGKASLNNRAISSLTLSG
           ||||||||||::|||||| |||||||||||||||||||| ||||||||||| |||||||
a701       MMAAGLYSWAVGKADIPTGAAPAMNTVSPGLTSPYCTPISCAVGKASLNNRATSSLTLSG
                    70        80        90       100       110       120

                129
m701.pep   SGTRLLSAX
           |||||||||
a701       SGTRLLSAX
```

The following partial DNA sequence was identified in *N. gonorrhoeae* <SEQ ID 2343>:

g702.seq

```
  1 ATGCCGTGTt ccaAAGCCAG TTGGACTTCG CCCGGAGtgg cAACGCCGGG
 51 AATCAGGGGA ATGCCGCTGT TGCGGCCGGC TCTGGCGAGG GATTCGTGCA
101 AACCCGGGCT GATGGCGAAA ACCGCGCCTG CGTCTTCGAC GGCTTTGAGC
151 TGTTCGGGAT TGGTTACCGT ACCTGCGCCG ATGATGGCGT TGGGCATTTC
201 TTTGGCAATC AGGCGGATGG CCTCGAGTCC GACGGGGGTG CGCAAGGTAA
251 TTTCGAGGGT GGGGATGCCG CCTTCGACAA GGGCGCGGGA CAAATCGACG
301 GCGGTGCTTA AGTCGTCAAt cgCCATCACA GGCACAACTG CGCCGGCGGT
351 CAGGATTTCG cggggggtca gttga
```

This corresponds to the amino acid sequence <SEQ ID 2344; ORF 702>:

g702.pep

```
  1 MPCSKASWTS PGVATPGIRG MPLLRPALAR DSCKPGLMAK TAPASSTALS
 51 CSGLVTVPAP MMALGISLAI RRMASSPTGV RKVISRVGMP PSTRARDKST
101 AVLKSSIAIT GTTAPAVRIS RGVS*
```

The following partial DNA sequence was identified in *N. meningitidis* <SEQ ID 2345>:

m702.seq

```
  1 ATGCCGTGTT CCAAAGCCAG TTGGATTTCG CCCGGGGTGG CAACACCGGG
 51 AATCAGGGGG ATGCCGCTGT TGTGGCCGGC TTTGGCGAGG GATTCATGCA
101 GCCCCGGGCT GATGGCGAAA ACCGCGCCTG CGTCTTCGAC GGCTTTGAGC
151 TGTTCGGGAT TGGTTACCGT ACCTGCGCCG ACGATGGCGT TGGGCACTTC
201 TTTGGCAATC AGGCGGATGG CATCGAGGCC GACAGGGGTG CGCAGGGTGA
251 TTTCGAGGGT AGGGATGCCG CCTTCGACAA GGGCGTGGGA CAAATCGATG
301 GCGGTGCTTA AGTCGTCAAT CGCCATTACC GGCACAACTG CGCCGGCGGT
351 CAAAATTTCG CGGGGGGTCA GTTTGGACAT TTCGGTTCTC CGGGTGGAAT
401 GGGGTATTTT ATTAAGATGG GACAGGTTGT AG
```

This corresponds to the amino acid sequence <SEQ ID 2346; ORF 702>:

m702.pep

```
  1 MPCSKASWIS PGVATPGIRG MPLLWPALAR DSCSPGLMAK TAPASSTALS
 51 CSGLVTVPAP TMALGTSLAI RRMASRPTGV RRVISRVGMP PSTRAWDKSM
101 AVLKSSIAIT GTTAPAVKIS RGVSLDISVL RVEWGILLRW DRL*
```

ORF 702 shows 91.9% identity over a 124 aa overlap with a predicted ORF (ORF702.ng) from *N. gonorrhoeae*:

m702/g702

```
                   10        20        30        40        50        60
m702.pep   MPCSKASWISPGVATPGIRGMPLLWPALARDSCSPGLMAKTAPASSTALSCSGLVTVPAP
           |||||||| ||||||||||||||| ||||||||:||||||||||||||||||||||||||
g702       MPCSKASWTSPGVATPGIRGMPLLRPALARDSCKPGLMAKTAPASSTALSCSGLVTVPAP
                   10        20        30        40        50        60

                   70        80        90       100       110       120
m702.pep   TMALGTSLAIRRMASRPTGVRRVISRVGMPPSTRAWDKSMAVLKSSIAITGTTAPAVKIS
            |||| ||||||||| |||||:||||||||||||| ||| |||||||||||||||||:||
g702       MMALGISLAIRRMASSPTGVRKVISRVGMPPSTRARDKSTAVLKSSIAITGTTAPAVRIS
                   70        80        90       100       110       120

                  130       140
m702.pep   RGVSLDISVLRVEWGILLRWDRLX
           ||||
g702       RGVSX
```

The following partial DNA sequence was identified in *N. meningitidis* <SEQ ID 2347>:

a702.seq

```
  1 ATGCCGTGTT CCAAAGCCAG TTGGATTTCG CCCGGGGTGG CAACACCGGG
 51 AATCAGGGGG ATGCCGCTGT TGTGGCCGGC TTTGGCGAGG GATTCATGCA
101 GCCCCGGGCT GATGGCGAAA ACCGCGCCTG CGTCTTCGAC GGCTTTGAGC
151 TGTTCGGGAT TGGTTACCGT ACCTGCGCCG ACGATGGCGT TGGGCACTTC
201 TTTGGCAATC AGGCGGATGG CATCGAGGCC GACAGGGGTG CGCAGGGTGA
251 TTTCGAGGGT AGGGATGCCG CCTTCGACAA GGGCGTGGGA CAAATCGATG
301 GCGGTGCTTA AGTCGTCAAT CGCCATTACC GGCACAACTG CGCCGGCGGT
351 CAAAATTTCG CGGGGGGTCA GTTTGGACAT TTCGGTTCTC CGGGTGGAAT
401 GGGGTATTTT ATTAAGATGG GACAGGTTGT AG
```

This corresponds to the amino acid sequence <SEQ ID 2348; ORF 702.a>:

a702.pep

```
  1 MPCSKASWIS PGVATPGIRG MPLLWPALAR DSCSPGLMAK TAPASSTALS
 51 CSGLVTVPAP TMALGTSLAI RRMASRPTGV RRVISRVGMP PSTRAWDKSM
101 AVLKSSIAIT GTTAPAVKIS RGVSLDISVL RVEWGILLRW DRL*
```

m702/a702 100.0% identity in 143 aa overlap

```
                   10        20        30        40        50        60
m702.pep   MPCSKASWISPGVATPGIRGMPLLWPALARDSCSPGLMAKTAPASSTALSCSGLVTVPAP
           ||||||||||||||||||||||||||||||||||||||||||||||||||||||||||||
a702       MPCSKASWISPGVATPGIRGMPLLWPALARDSCSPGLMAKTAPASSTALSCSGLVTVPAP
                   10        20        30        40        50        60

                   70        80        90       100       110       120
m702.pep   TMALGTSLAIRRMASRPTGVRRVISRVGMPPSTRAWDKSMAVLKSSIAITGTTAPAVKIS
           ||||||||||||||||||||||||||||||||||||||||||||||||||||||||||||
a702       TMALGTSLAIRRMASRPTGVRRVISRVGMPPSTRAWDKSMAVLKSSIAITGTTAPAVKIS
                   70        80        90       100       110       120

                  130       140
m702.pep   RGVSLDISVLRVEWGILLRWDRLX
           ||||||||||||||||||||||||
a702       RGVSLDISVLRVEWGILLRWDRLX
                  130       140
```

The following partial DNA sequence was identified in *N. gonorrhoeae* <SEQ ID 2349>:

g703.seq

```
  1 ATGAAAGCAA AAATCCTGAC TTCCGTTGCG CTGCTTGCCT GTTCCGGCAG
 51 CCTGTTTGCC CAAACGCTGG CAACCGTTAA CGGTCAGAAA ATCGACAGTT
101 CCGTCATCGA TGCGCAGGTT GCCGCATTCC GTGCGGAAAA CAGCCGTGCC
151 GAAGACACGC CGCAACTGCG CCAATCCCTG CTGGAAAACG AAGTGGTCAA
201 CACCGTGGTC GCACAGGAAG TGAAACGCCT GAAACTCGAC CGGTCGGCAG
251 AGTTTAAAGA TGCGCTTGCC AAATTGCGTG CCGAAGCGAA AAAGTCGGGC
301 GACGACAAGA AACCGTCCTT CAAAACCGTT TGGCAGGCGG TAAAATATGG
351 CTTGAACGGC GAGGCATACG CACTGCATAT CGCCAAAACC CAACCGGTTT
```

-continued

```
401 CCGAGCAGGA AGTAAAAGCC GTTTACGACA ATATCAGCGG TTTTTATAAA
451 GGCACGCAGG AAGTCCAGTT GGGCGAAATC CTGACCGACA AGGAAGAAAA
501 TGCGAAAAAA GCGGTTGCCG ATTTGAAGGC GAAAAAAGGT TTTGATGCCG
551 TTTTGAAACA ATACTCGCTC AACGACCGCA CCAAACGGAC CGGCGCGCCG
601 GACGGATATG TGCCGCTGAA AGATTTGGAA CAGGGTGTTC CGCCGCTTTA
651 TCAGGCAATT AAGGACTTGA AAAAAGGCGA ATTTACGGCA ACGCCGCTGA
701 AAAACGGCGA TTTCTACGGC GTTTATTATG TCAACGACAG CCGcgaggTG
751 AAAGTGCCTT CTTTTGACGA AATGAAAGGA CAGATTGCCG GCAACCTTCA
801 GGCGGAACGG ATTGACCGTG CCGTctgTGc gcTGTTgggt aaggCAAACA
851 TCAAACCTGC AAAATAA
```

This corresponds to the amino acid sequence <SEQ ID 2350; ORF 703>:

g703.pep

```
  1 MKAKILTSVA LLACSGSLFA QTLATVNGQK IDSSVIDAQV AAFRAENSRA
 51 EDTPQLRQSL LENEVVNTVV AQEVKRLKLD RSAEFKDALA KLRAEAKKSG
101 DDKKPSFKTV WQAVKYGLNG EAYALHIAKT QPVSEQEVKA VYDNISGFYK
151 GTQEVQLGEI LTDKEENAKK AVADLKAKKG FDAVLKQYSL NDRTKRTGAP
201 DGYVPLKDLE QGVPPLYQAT KDLKKGEFTA TPLKNGDFYG VYYVNDSREV
251 KVPSFDEMKG QIAGNLQAER IDRAVCALLG KANIKPAK*
```

The following partial DNA sequence was identified in *N. meningitidis* <SEQ ID 2351>:

m703.seq

```
  1 ATGAAAGCAA AAATCCTGAC TTCCGTTGCA CTGCTTGCCT GTTCCGGCAG
 51 CCTGTTTGCC CAAACGCTGG CAACCGTCAA CGGTCAGAAA ATCGACAGTT
101 CCGTCATCGA TGCGCAGGTT GCCGCATTCC GTGCGGAAAA CAGCCGTGCC
151 GAAGACACGC CGCAACTGCG CCAATCCCTG CTGGAAAACG AAGTGGTCAA
201 TACCGTGGTC GCACAGGAAG TGAAACGCCT GAAACTCGAC CGGTCGGCAG
251 AGTTTAAAAA TGCGCTTGCC AAATTGCGTG CCGAAGCGAA AAAGTCGGGC
301 GACGACAAGA AACCGTCCTT CAAAACCGTT TGGCAGGCGG TAAAATATGG
351 CTTGAACGGC GAGGCATACG CATTGCATAT CGCCAAAACC CAACCGGTTT
401 CCGAGCAGGA AGTAAAAGCC GCATATGACA ATATCAGCGG TTTTTACAAA
451 GGTACGCAGG AAGTCCAGTT GGGCGAAATC CTGACCGACA AGGAAGAAAA
501 TGCAAAAAAA GCGGTTGCCG ACTTGAAGGC GAAAAAAGGT TTCGATGCCG
551 TCTTGAAACA ATATTCCCTC AACGACCGTA CCAAACAGAC CGGTGCGCCG
601 GTCGGATATG TGCCGCTGAA AGATTTGGAA CAGGGTGTTC CGCCGCTTTA
651 TCAGGCAATT AAGGACTTGA AAAAAGGCGA ATTTACGGCA ACGCCGCTGA
701 AAAACGGCGA TTTCTACGGC GTTTATTATG TCAACGACAG CCGCGAGGTA
```

-continued

```
751 AAAGTGCCTT CTTTTGATGA AATGAAAGGA CAGATTGCGG GCAACCTTCA

801 GGCGGAACGG ATTGACCGTG CCGTCGGTGC ACTGTTGGGC AAGGCAAACA

851 TCAAACCTGC AAAATAA
```

This corresponds to the amino acid sequence <SEQ ID 2352; ORF 703>:

m703.pep

```
  1 MKAKILTSVA LLACSGSLFA QTLATVNGQK IDSSVIDAQV AAFRAENSRA

 51 EDTPQLRQSL LENEVVNTVV AQEVKRLKLD RSAEFKNALA KLRAEAKKSG

101 DDKKPSFKTV WQAVKYGLNG EAYALHIAKT QPVSEQEVKA AYDNISGFYK

151 GTQEVQLGEI LTDKEENAKK AVADLKAKKG FDAVLKQYSL NDRTKQTGAP

201 VGYVPLKDLE QGVPPLYQAI KDLKKGEFTA TPLKNGDFYG VYYVNDSREV

251 KVPSFDEMKG QIAGNLQAER IDRAVGALLG KANIKPAK*
```

ORF 703 shows 98.3% identity over a 288 aa overlap with a predicted ORF (ORF703.ng) from *N. gonorrhoeae*:

m703/g703

```
                   10        20        30        40        50        60
m703.pep  MKAKILTSVALLACSGSLFAQTLATVNGQKIDSSVIDAQVAAFRAENSRAEDTPQLRQSL
          ||||||||||||||||||||||||||||||||||||||||||||||||||||||||||||
g703      MKAKILTSVALLACSGSLFAQTLATVNGQKIDSSVIDAQVAAFRAENSRAEDTPQLRQSL
                   10        20        30        40        50        60

                   70        80        90       100       110       120
m703.pep  LENEVVNTVVAQEVKRLKLDRSAEFKNALAKLRAEAKKSGDDKKPSFKTVWQAVKYGLNG
          ||||||||||||||||||||||||||:|||||||||||||||||||||||||||||||||
g703      LENEVVNTVVAQEVKRLKLDRSAEFKDALAKLRAEAKKSGDDKKPSFKTVWQAVKYGLNG
                   70        80        90       100       110       120

                  130       140       150       160       170       180
m703.pep  EAYALHIAKTQPVSEQEVKAAYDNISGFYKGTQEVQLGEILTDKEENAKKAVADLKAKKG
          |||||||||||||||||||||:||||||||||||||||||||||||||||||||||||||
g703      EAYALHIAKTQPVSEQEVKAVYDNISGFYKGTQEVQLGEILTDKEENAKKAVADLKAKKG
                  130       140       150       160       170       180

                  190       200       210       220       230       240
m703.pep  FDAVLKQYSLNDRTKQTGAPVGYVPLKDLEQGVPPLYQAIKDLKKGEFTATPLKNGDFYG
          |||||||||||||||:|||| |||||||||||||||||||||||||||||||||||||||
g703      FDAVLKQYSLNDRTKRTGAPDGYVPLKDLEQGVPPLYQAIKDLKKGEFTATPLKNGDFYG
                  190       200       210       220       230       240

                  250       260       270       280      289
m703.pep  VYYVNDSREVKVPSFDEMKGQIAGNLQAERIDRAVGALLGKANIKPAKX
          ||||||||||||||||||||||||||||||||||| |||||||||||||
g703      VYYVNDSREVKVPSFDEMKGQIAGNLQAERIDRAVCALLGKANIKPAKX
                  250       260       270       280
```

The following partial DNA sequence was identified in *N. meningitidis* <SEQ ID 2353>:

a703.seq

```
  1 ATGAAAGCAA AAATCCTGAC TTCCGTTGCA CTGCTTGCCT GTTCCGGCAG

 51 CCTGTTTGCC CAAACGCTGG CAACCGTCAA CGGTCAGAAA ATCGACAGTT

101 CCGTCATTGA TGCGCAGGTT GCCGCATTCC GTGCGGAAAA CAGCCGTGCC

151 GAAGACACGC CGCAACTGCG CCAATCCCTG CTGGAAAACG AAGTGGTCAA

201 CACCGTGGTC GCACAGGAAG TGAAACGCCT GAAACTCGAC CGGTCGGCAG
```

-continued

```
251 AGTTTAAAAA TGCGCTTGCC AAATTGCGTG CCGAAGCGAA AAAGTCGGGC

301 GACGACAAGA AACCGTCCTT CAAAACCGTT TGGCAGGCGG TAAAATATGG

351 CTTGAACGGC GAGGCATACG CGCTGCATAT CGCCAAAACC CAACCGGTTT

401 CCGAGCAGGA AGTAAAAGCC GCATATGACA ATATCAGCGG TTTTTACAAA

451 GGTACGCAGG AAGTCCAGTT GGGCGAAATC CTGACCGACA AGGAAGAAAA

501 TGCAAAAAAA GCGGTTGCCG ACTTGAAGGC GAAAAAAGGT TTCGATGCCG

551 TCTTGAAACA ATATTCCCTC AACGACCGTA CCAAACAGAC CGGTGCGCCG

601 GTCGGATATG TGCCCGTGAA AGATTTGGAA CAGGGTGTTC CGCCGCTTTA

651 TCAGGCAATT AAGGACTTGA AAAAAGGCGA ATTTACGGCA ACGCCGCTGA

701 AAAACGGCGA TTTCTACGGC GTTTATTATG TCAACGACAG CCGCGAGGTA

751 AAAGTGCCTT CTTTTGATGA AATGAAAGGA CAGATTGCGG GCAACCTTCA

801 GGCGGAACGG ATTGACCGTG CCGTCGGTGC ACTGTTGGGC AAGGCAAACA

851 TCAAACCTGC AAAATAA
```

This corresponds to the amino acid sequence <SEQ ID 2354; ORF 703.a>:

```
a703.pep

  1 MKAKILTSVA LLACSGSLFA QTLATVNGQK IDSSVIDAQV AAFRAENSRA

 51 EDTPQLRQSL LENEVVNTVV AQEVKRLKLD RSAEFKNALA KLRAEAKKSG

101 DDKKPSFKTV WQAVKYGLNG EAYALHIAKT QPVSEQEVKA AYDNISGFYK

151 GTQEVQLGEI LTDKEENAKK AVADLKAKKG FDAVLKQYSL NDRTKQTGAP

201 VGYVPLKDLE QGVPPLYQAI KDLKKGEFTA TPLKNGDFYG VYYVNDSREV

251 KVPSFDEMKG QIAGNLQAER IDRAVGALLG KANIKPAK*
```

m703/a703 100.0% identity in 288 aa overlap

```
                    10        20        30        40        50        60
m703.pep    MKAKILTSVALLACSGSLFAQTLATVNGQKIDSSVIDAQVAAFRAENSRAEDTPQLRQSL
            ||||||||||||||||||||||||||||||||||||||||||||||||||||||||||||
a703        MKAKILTSVALLACSGSLFAQTLATVNGQKIDSSVIDAQVAAFRAENSRAEDTPQLRQSL
                    10        20        30        40        50        60

                    70        80        90       100       110       120
m703.pep    LENEVVNTVVAQEVKRLKLDRSAEFKNALAKLRAEAKKSGDDKKPSFKTVWQAVKYGLNG
            ||||||||||||||||||||||||||||||||||||||||||||||||||||||||||||
a703        LENEVVNTVVAQEVKRLKLDRSAEFKNALAKLRAEAKKSGDDKKPSFKTVWQAVKYGLNG
                    70        80        90       100       110       120

                   130       140       150       160       170       180
m703.pep    EAYALHIAKTQPVSEQEVKAAYDNISGFYKGTQEVQLGEILTDKEENAKKAVADLKAKKG
            ||||||||||||||||||||||||||||||||||||||||||||||||||||||||||||
a703        EAYALHIAKTQPVSEQEVKAAYDNISGFYKGTQEVQLGEILTDKEENAKKAVADLKAKKG
                   130       140       150       160       170       180

                   190       200       210       220       230       240
m703.pep    FDAVLKQYSLNDRTKQTGAPVGYVPLKDLEQGVPPLYQAIKDLKKGEFTATPLKNGDFYG
            ||||||||||||||||||||||||||||||||||||||||||||||||||||||||||||
a703        FDAVLKQYSLNDRTKQTGAPVGYVPLKDLEQGVPPLYQAIKDLKKGEFTATPLKNGDFYG
                   190       200       210       220       230       240

                   250       260       270       280      289
m703.pep    VYYVNDSREVKVPSFDEMKGQIAGNLQAERIDRAVGALLGKANIKPAKX
            |||||||||||||||||||||||||||||||||||||||||||||||||
a703        VYYVNDSREVKVPSFDEMKGQIAGNLQAERIDRAVGALLGKANIKPAKX
                   250       260       270       280
```

The following partial DNA sequence was identified in *N. meningitidis* <SEQ ID 2355>:

a704.seq

```
   1 ATGAAAAAAA CCTGTTTCCA CTGCGGGCTG GACGTTCCCG AAAACCTGCA
  51 TCTGACCGTC CGTTACGAAA ACGAAGACCG CGAAACCTGC TGCGCCGGTT
 101 GTCAGGCAGT CGCACAAAGC ATTATTGACG CGGGCTTGGG CAGTTATTAC
 151 AAACAACGCA CCGCCGACGC GCAAAAAACC GAGCTGCCGC CCCAAGAAAT
 201 CCTCGACCAA ATCCGCCTGT ACGACCTGCC CGAAGTCCAG TCCGACTTTG
 251 TGGAAACCCA CGGCGGCACG CGCGAGGCGG TTTTAATGCT CGGCGGCATC
 301 ACCTGCGCCG CCTGCGTCTG GCTGATCGAA CAGCAGCTTT TGCGTACAGA
 351 CGGCATCGTC CGCATCGACC TCAATTACAG CACGCACCGC TGCCGCGTCG
 401 TCTGGGACGA CGGCAAAATC CGCCTTTCCG ACATTCTGTT GAAAATCAGG
 451 CAGATAGGCT ACACCGCCGC ACCCTATGAC GCGCAAAAAA TCGAAGCCGC
 501 CAACCAAAAA GAACGCAAAC AATACATCGT CCGCCTCGCC GTTGCCGGGC
 551 TGGGGATGAT GCAGACGATG ATGTTCGCGC TGCCGACCTA CCTTTACGGC
 601 GGCGACATCG AACCCGATTT CCTGCAAATC CTCCATTGGG GCGGCTTTTT
 651 AATGGTGCTG CCCGTCGTAT TCTATTGCGC CGTCCCGTTT TATCAAGGCG
 701 CGCTGCGCGA CTTGAAAAAC CGCCGCGTCG GCATGGATAC GCCGATTACC
 751 GTCGCCATCA TCATGACCTT TATCGCCGGC GTTTACAGCC TTGCGACAAA
 801 TGCGGGGCAG GGGATGTATT TCGAATCCAT CGCGATGCTG CTGTTTTTCC
 851 TGCTGGGCGG ACGCTTTATG GAACACATTG CCCGCCGTAA GGCAGGCGAT
 901 GCCGCCGAGA GGCTGGTGAA GCTGATTCCT GCGTTTTGCC ATCATATGCC
 951 CGATTACCCC GATACGCAGG AAACCTGCGA GGCAGCTGTC GTCAAATTGA
1001 AGGCGGGCGA TATCGTGCTG GTCAAACCGG GCGAAACCAT CCCCGTTGAC
1051 GGCACGGTGC TGGAAGGAAG CAGTGCCGTC AACGAATCTA TGCTGACCGG
1101 CGAGAGCCTG CCCGTCGCCA AAATGCCGTC TGAAAAAGTA ACCGCCGGCA
1151 CACTCAACAC GCAAAGCCCC CTGATTATAC GCACCGACCG CACCGGCGGC
1201 GGCACGCGAC TGTCGCACAT CGTCCGCCTG CTCGACCGCG CCTTAGCGCA
1251 AAAACCGCGC ACTGCCGAGT TGGCGGAACA ATACGCCTCG TCTTTCATAT
1301 TCGGCGAACT CCTGCTTGCC GTCCCCGTCT TCATCGGCTG GACGCTGTAC
1351 GCCGACGCGC ACACCGCATT GTGGATTACC GTCGCCCTGC TGGTCATTAC
1401 CTGCCCCTGC GCCTTATCGC TTGCCACGCC GACCGCGCTG GCAGCTTCTA
1451 CCGGTACGCT GGCGCGCGAA GGTATTTTAA TCGGCGGAAA GCAGGCAATC
1501 GAAACCCTCG CCCAAACCAC CGACATCATC TTCGACAAAA CCGGCACGCT
1551 GACCCAAGGC AAACCCGCCG TCCGCCGTAT CTCATTGTTG AGAGGCACAG
1601 ACGAAGCCTT TGTTCTCGCG GTGGCGCAGG CTTTAGAACA ACAGTCCGAA
1651 CATCCCCTTG CCCGCGCCAT CCTCAACTGC CGCATTTCAG ACGGCAGCGT
1701 CCCCGACATC GCTATTAAAC AACGCCTCAA CCGCATCGGC GAAGGCGTGG
1751 GCGCGCAACT GACCGTCAAC GGCGAAACAC AGGTTTGGGC ATTGGGCAGG
1801 GCATCCTATG TCGCCGAAAT TTCAGGTAAA GAACCGCAAA CAGAAGGCGG
1851 CGGCAGCGCG GTTTACCTCG GCAGTCAAAG CGGTTTCCAA GCCGTGTTCT
1901 ACCTGCAAGA CCCGCTCAAA GACAGCGCGG CGGAGGCGGT GCGGCAGTTG
```

-continued

```
1951 GCAGGCAAAA ACCTGACGCT GCACATTCTC AGCGGCGACC GTGAAACCGC

2001 CGTTGCCGAA ACCGCACGCG CCCTGGGTGT CGCGCACTAC CGCGCCCAAG

2051 CCATGCCCGA GGACAAACTG GAATACGTCA AAGCCTTGCA AAAAGAAGGG

2101 AAAAAAGTGC TGATGATAGG CGACGGCATC AACGACGCGC CCGTTTTGGC

2151 GCAGGCAGAC GTATCCGCCG CCGCAGCGGG CGGGACGGAT ATTGCGAGGG

2201 ACGGCGCGGA CATTGTGTTA TTGAACGAAG ATTTGCGTAC CGTCGCCCAC

2251 CTGCTCGATC AGGCGCGGCG CACCCGCCAT ATTATCCGGC AAAACCTGAT

2301 ATGGGCGGGC GCGTACAATA TCATTGCCGT ACCGCTTGCC GTTTTGGGCT

2351 ATGTCCAACC GTGGATAGCC GCACTGGGTA TGAGCTTCAG TTCGCTGGCG

2401 GTTTTGGGCA ACGCCCTGCG CCTTCACAAA CGGGGGAAAA TGCAGTCTGA

2451 AAAAATGCCG TCCGAACAAT GA
```

This corresponds to the amino acid sequence <SEQ ID 2356; ORF 703>:

a704.pep

```
  1 MKKTCFHCGL DVPENLHLTV RYENEDRETC CAGCQAVAQS IIDAGLGSYY

 51 KQRTADAQKT ELPPQEILDQ IRLYDLPEVQ SDFVETHGGT REAVLMLGGI

101 TCAACVWLIE QQLLRTDGIV RIDLNYSTHR CRVVWDDGKI RLSDILLKIR

151 QIGYTAAPYD AQKIEAANQK ERKQYIVRLA VAGLGMMQTM MFALPTYLYG

201 GDIEPDFLQI LHWGGFLMVL PVVFYCAVPF YQGALRDLKN RRVGMDTPIT

251 VAIIMTFIAG VYSLATNAGQ GMYFESIAML LFFLLGGRFM EHIARRKAGD

301 AAERLVKLIP AFCHHMPDYP DTQETCEAAV VKLKAGDIVL VKPGETIPVD

351 GTVLEGSSAV NESMLTGESL PVAKMPSEKV TAGTLNTQSP LIIRTDRTGG

401 GTRLSHIVRL LDRALAQKPR TAELAEQYAS SFIFGELLLA VPVFIGWTLY

451 ADAHTALWIT VALLVITCPC ALSLATPTAL AASTGTLARE GILIGGKQAI

501 ETLAQTTDII FDKTGTLTQG KPAVRRISLL RGTDEAFVLA VAQALEQQSE

551 HPLARAILNC RISDGSVPDI AIKQRLNRIG EGVGAQLTVN GETQVWALGR

601 ASYVAEISGK EPQTEGGGSA VYLGSQSGFQ AVFYLQDPLK DSAAEAVRQL

651 AGKNLTLHIL SGDRETAVAE TARALGVAHY RAQAMPEDKL EYVKALQKEG

701 KKVLMIGDGI NDAPVLAQAD VSAAAAGGTD IARDGADIVL LNEDLRTVAH

751 LLDQARRTRH IIRQNLIWAG AYNIIAVPLA VLGYVQPWIA ALGMSFSSLA

801 VLGNALRLHK RGKMQSEKMP SEQ*
```

m704/a704 99.8% identity in 823 aa overlap

```
                    10        20        30        40        50        60
m704.pep    MKKTCFHCGLDVPEHLHLTVRYENEDRETCCAGCQAVAQSIIDAGLGSYYKQRTADAQKT
            ||||||||||||||:|||||||||||||||||||||||||||||||||||||||||||||
a704        MKKTCFHCGLDVPENLHLTVRYENEDRETCCAGCQAVAQSIIDAGLGSYYKQRTADAQKT
                    10        20        30        40        50        60

                    70        80        90       100       110       120
m704.pep    ELPPQEILDQIRLYDLPEVQSDFVETHGGTREAVLMLGGITCAACVWLIEQQLLRTDGIV
            ||||||||||||||||||||||||||||||||||||||||||||||||||||||||||||
a704        ELPPQEILDQIRLYDLPEVQSDFVETHGGTREAVLMLGGITCAACVWLIEQQLLRTDGIV
                    70        80        90       100       110       120
```

-continued

```
              130       140       150       160       170       180
m704.pep  RIDLNYSTHRCRVVWDDGKIRLSDILLKIRQIGYTAAPYDAQKIEAANQKERKQYIVRLA
          ||||||||||||||||||||||||||||||||||||||||||||||||||||||||||||
a704      RIDLNYSTHRCRVVWDDGKIRLSDILLKIRQIGYTAAPYDAQKIEAANQKERKQYIVRLA
              130       140       150       160       170       180

              190       200       210       220       230       240
m704.pep  VAGLGMMQTMMFALPTYLYGGDIEPDFLQILHWGGFLMVLPVVFYCAVPFYQGALRDLKN
          ||||||||||||||||||||||||||||||||||||||||||||||||||||||||||||
a704      VAGLGMMQTMMFALPTYLYGGDIEPDFLQILHWGGFLMVLPVVFYCAVPFYQGALRDLKN
              190       200       210       220       230       240

              250       260       270       280       290       300
m704.pep  RRVGMDTPITVAIIMTFIAGVYSLATNAGQGMYFESIAMLLFFLLGGRFMEHIARRKAGD
          ||||||||||||||||||||||||||||||||||||||||||||||||||||||||||||
a704      RRVGMDTPITVAIIMTFIAGVYSLATNAGQGMYFESIAMLLFFLLGGRFMEHIARRKAGD
              250       260       270       280       290       300

              310       320       330       340       350       360
m704.pep  AAERLVKLIPAFCHHMPDYPDTQETCEAAVVKLKAGDIVLVKPGETIPVDGTVLEGSSAV
          ||||||||||||||||||||||||||||||||||||||||||||||||||||||||||||
a704      AAERLVKLIPAFCHHMPDYPDTQETCEAAVVKLKAGDIVLVKPGETIPVDGTVLEGSSAV
              310       320       330       340       350       360

              370       380       390       400       410       420
m704.pep  NESMLTGESLPVAKMPSEKVTAGTLNTQSPLIIRTDRTGGGTRLSHIVRLLDRALAQKPR
          ||||||||||||||||||||||||||||||||||||||||||||||||||||||||||||
a704      NESMLTGESLPVAKMPSEKVTAGTLNTQSPLIIRTDRTGGGTRLSHIVRLLDRALAQKPR
              370       380       390       400       410       420

              430       440       450       460       470       480
m704.pep  TAELAEQYASSFIFGELLLAVPVFIGWTLYADAHTALWITVALLVITCPCALSLATPTAL
          ||||||||||||||||||||||||||||||||||||||||||||||||||||||||||||
a704      TAELAEQYASSFIFGELLLAVPVFIGWTLYADAHTALWITVALLVITCPCALSLATPTAL
              430       440       450       460       470       480

              490       500       510       520       530       540
m704.pep  AASTGTLAREGILIGGKQAIETLAQTTDIIFDKTGTLTQGKPAVRRISLLRGTDEAFVLA
          ||||||||||||||||||||||||||||||||||||||||||||||||||||||||||||
a704      AASTGTLAREGILIGGKQAIETLAQTTDIIFDKTGTLTQGKPAVRRISLLRGTDEAFVLA
              490       500       510       520       530       540

              550       560       570       580       590       600
m704.pep  VAQALEQQSEHPLARAILNCRISDGSVPDIAIKQRLNRIGEGVGAQLTVNGETQVWALGR
          ||||||||||||||||||||||||||||||||||||||||||||||||||||||||||||
a704      VAQALEQQSEHPLARAILNCRISDGSVPDIAIKQRLNRIGEGVGAQLTVNGETQVWALGR
              550       560       570       580       590       600

              610       620       630       640       650       660
m704.pep  ASYVAEISGKEPQTEGGGSAVYLGSQSGFQAVFYLTDPLKDSAAEAVRQLAGKNLTLHIL
          |||||||||||||||||||||||||||||||||||| |||||||||||||||||||||||
a704      ASYVAEISGKEPQTEGGGSAVYLGSQSGFQAVFYLQDPLKDSAAEAVRQLAGKNLTLHIL
              610       620       630       640       650       660

              670       680       690       700       710       720
m704.pep  SGDRETAVAETARALGVAHYRAQAMPEDKLEYVKALQKEGKKVLMIGDGINDAPVLAQAD
          ||||||||||||||||||||||||||||||||||||||||||||||||||||||||||||
a704      SGDRETAVAETARALGVAHYRAQAMPEDKLEYVKALQKEGKKVLMIGDGINDAPVLAQAD
              670       680       690       700       710       720

              730       740       750       760       770       780
m704.pep  VSAAAAGGTDIARDGADIVLLNEDLRTVAHLLDQARRTRHIIRQNLIWAGAYNIIAVPLA
          ||||||||||||||||||||||||||||||||||||||||||||||||||||||||||||
a704      VSAAAAGGTDIARDGADIVLLNEDLRTVAHLLDQARRTRHIIRQNLIWAGAYNIIAVPLA
              730       740       750       760       770       780

              790       800       810       820
m704.pep  VLGYVQPWIAALGMSFSSLAVLGNALRLHKRGKMQSEKMPSEQX
          |||||||||||||||||||||||||||||||||||||||||||
a704      VLGYVQPWIAALGMSFSSLAVLGNALRLHKRGKMQSEKMPSEQX
              790       800       810       820
```

50

The following partial DNA sequence was identified in *N. gonorrhoeae* <SEQ ID 2357>:

```
g705.seq

  1 GTGTTCAATA ATTTCCttgC CTCTCTGCCG TTTATGACGG AAACACGCGC

 51 TGATATGCTC ATCAGCGCGT TTTGGCCCAT GGTTAAAGCC GGCTTTACAG

101 TGTCTTtgcC TTTGGCGATC GCTTCTTTCG TTATCGCCAT GATTATTGCC

151 GTAGCCGTTG CTTTGGTAAG AATCATGCCT TCCGGCGGTA TTTTCCAAAA

201 ATGCTTGTTG AAGCTGGTGG AATTTTATAT TTCCGTCGTT CGCGGTACGC

251 CGCTGTTGGT TCAGCTTGTG ATTGTGTTTT ACGGGCTGCC GTCCGTCGGC
```

-continued

```
301 ATCTATATCA ATCCGATTCC CGCCGCCATC ATCGGCTTTT CGCTCAATGT

351 CGGCGCATAC GCTTCCGAAA CCATACGCGC GGCGATTTTG TCCGTGCCGA

401 AAGGGCAGTG GGAAGCAGGT TTCTCCATCG GTATGACCTA TATGCAGACG

451 TTCCGCCGCA TCGTCGCACC GCAGGCATTC CGCGTCGCCG TTCCGCCGTT

501 GAGCAACGAG TTTATCGGCT TGTTCAAAAA CACCTCGCTT GCCGCCGTGG

551 TAACGGTAAC GGAGCTTTTC CGTGTCGCAC AGGAAACGGC AAACCGCACT

601 TATGACTTTT TGCCTGTCTA TATCGAAGCT GCATTGGTTT ATTGGTGTTT

651 CTGTAAAGTG CTGTTTTTGA TTCAGGCGCG TTTGGAAAAA CGTTTCGACC

701 GTTATGTCGC CAAATAA
```

This corresponds to the amino acid sequence <SEQ ID 2358; ORF 705>:

g705.pep

```
  1 VFNNFLASLP FMTETRADML ISAFWPMVKA GFTVSLPLAI ASFVIGMIIA

 51 VAVALVRIMP SGGIFQKCLL KLVEFYISVV RGTPLLVQLV IVFYGLPSVG

101 IYINPIPAAI IGFSLNVGAY ASETIRAAIL SVPKGQWEAG FSIGMTYMQT

151 FRRIVAPQAF RVAVPPLSNE FIGLFKNTSL AAVVTVTELF RVAQETANRT

201 YDFLPVYIEA ALVYWCFCKV LFLIQARLEK RFDRYVAK*
```

The following partial DNA sequence was identified in *N. meningitidis* <SEQ ID 2359>:

m705.seq

```
  1 GTGTTCAATA ATTTCCTTGC TTCGCTGCCG TTTATGACGG AAACACGCGC

 51 CGATATGATT GTCAGCGCGT TTTTGCCTAT GGTCAAAGCC GGCTTCGCGG

101 TCTCTCTGCC TTTGCCGGCA GCTTCTTTCG TTATCGGTAT GATGATTGCG

151 GTAGCCGTGG CTTTGGTGCG GATTATGCCC GCCGGCGGCA TCGTGCGGAA

201 AATCCTGCTG AAATTGGTGG AATTTTATAT TTCCGTCATT CGCGGTACGC

251 CGCTGTTGGT TCAGCTTGTG ATTGTGTTTT ACGGGCTGCC TTCCGTCGGC

301 ATCTATATCG ACCCGATTCC TGCCGCCATC ATCGGCTTTT CGCTCAATGT

351 CGGCGCATAC GCTTCCGAAA CCATACGCGC GGCAATTTTG TCCGTACCTA

401 AAGGCCAATG GGAAGCAGGT TTCTCCATCG GCATGACCTA TATGCAGACG

451 TTCCGCCGCA TTGTCGCGCC GCAGGCATTC CGCGTTGCCG TGCCGCCTTT

501 GAGCAACGAG TTTATCGGTT TGTTTAAAAA CACCTCGCTC GCGGCAGTCG

551 TGACGGTAAC GGAATTATTC CGCGTCGCGC AGGAAACGGC AAACCGCACT

601 TATGACTTTT TGCCCGTCTA TATCGAAGCC GCTTTGGTTT ACTGGTGTTT

651 TTGTAAAGTG CTGTTCCTGA TTCAGGCGCG TTTGGAAAAA CGTTTCGACC

701 GCTACGTCGC CAAATAA
```

This corresponds to the amino acid sequence <SEQ ID 2360; ORF 705>:

m705.pep

```
  1 VFNNFLASLP FMTETRADMI VSAFLPMVKA GFAVSLPLAA ASFVIGMMIA

 51 VAVALVRIMP AGGIVRKILL KLVEFYISVI RGTPLLVQLV IVFYGLPSVG

101 IYIDPIPAAI IGFSLNVGAY ASETIRAAIL SVPKGQWEAG FSIGMTYMQT

151 FRRIVAPQAF RVAVPPLSNE FIGLFKNTSL AAVVTVTELF RVAQETANRT

201 YDFLPVYIEA ALVYWCFCKV LFLIQARLEK RFDRYVAK*
```

Computer analysis of this amino acid sequence gave the following results:

Homology with a predicted ORF from *N. gonorrhoeae*

ORF 705 shows 95.0% identity over a 238 aa overlap with a predicted ORF (ORF 705) from *N. gonorrhoeae*:

m705/g705 95.0% identity in 238 aa overlap

```
                 10         20         30         40         50         60
m705.pep  VFNNFLASLPFMTETRADMIVSAFLPMVKAGFAVSLPLAAASFVIGMMIAVAVALVRIMP
          ||||||||||||||||||||:|||||||||:||||||||||||:||||||||||||||||
g705      VFNNFLASLPFMTETRADMLISAFWPMVKAGFTVSLPLAIASFVIGMIIAVAVALVRIMP
                 10         20         30         40         50         60
m705.pep          70         80         90        100        110        120
          AGGIVRKILLKLVEFYISVIRGTPLLVQLVIVFYGLPSVGIYIDPIPAAIIGFSLNVGAY
          :|||:|||||||||||||||:|||||||||||||||||||||:|||||||||||||||||
g705      SGGIFQKCLLKLVEFYISVVRGTPLLVQLVIVFYGLPSVGIYINPIPAAIIGFSLNVGAY
                  70         80         90        100        110        120
m705.pep         130        140        150        160        170        180
          ASETIRAAILSVPKGQWEAGFSIGMTYMQTFRRIVAPQAFRVAVPPLSNEFIGLFKNTSL
          ||||||||||||||||||||||||||||||||||||||||||||||||||||||||||||
g705      ASETIRAAILSVPKGQWEAGFSIGMTYMQTFRRIVAPQAFRVAVPPLSNEFIGLFKNTSL
                 130        140        150        160        170        180
                 190        200        210        220        230        239
m705.pep  AAVVTVTELFRVAQETANRTYDFLPVYIEAALVYWCFCKVLFLIQARLEKRFDRYVAKX
          |||||||||||||||||||||||||||||||||||||||||||||||||||||||||||
g705      AAVVTVTELFRVAQETANRTYDFLPVYIEAALVYWCFCKVLFLIQARLEKRFDRYVAKX
                 190        200        210        220        230
```

The following partial DNA sequence was identified in *N. meningitidis* <SEQ ID 2361>:

a705.seq

```
  1 GTGTTCAATA ATTTCCTTGC TTCGCTGCCG TTTATGACGG AAACACGCGC

 51 CGATATGATT GTCAGCGCGT TTTTGCCTAT GGTCAAAGCC GGCTTCGCGG

101 TCTCTCTGCC TTTGGCGGCA GCTTCTTTCG TTATCGGTAT GATGATTGCG

151 GTAGCCGTGG CTTTGGTGCG GATTATGCCC GCCGGCGGCA TCGTGCGGAA

201 AATCCTGCTG AAATTGGTGG AATTTTATAT TTCCGTCATT CGCGGTACGC

251 CGCTGTTGGT TCAGCTTGTG ATTGTGTTTT ACGGGCTGCC TTCCGTCGGC

301 ATCTATATCG ACCCGATTCC TGCCGCCATC ATCGGCTTTT CGCTCAATGT

351 CGGCGCATAT GCTTCCGAAA CCATACGCGC GGCAATTTTG TCCGTACCGA

401 AAGGCCAATG GGAAGCAGGT TTCTCCATCG GCATGACCTA TATGCAGACG

451 TTCCGCCGCA TCGTCGCGCC GCAGGCATTT CGCGTTGCCG TGCCGCCTTT

501 GAGCAACGAG TTTATCGGTT TGTTTAAAAA CACCTCGCTC GCGGCAGTCG

551 TGACGGTAAC GGAATTATTC CGCGTCGCGC AGGAAACGGC AAACCGCACT

601 TATGACTTTT TGCCCGTCTA TATCGAAGCC GCTTTGGTTT ACTGGTGTTT
```

-continued

```
651 TTGTAAAGTG CTGTTCCTGA TTCAGGCGCG TTTGGAAAAA CGTTTCGACC

701 GCTACGTCGC CAAATAA
```

This corresponds to the amino acid sequence <SEQ ID 2362: ORF 705.a>:

```
a705.pep

  1 VFNNFLASLP FMTETRADMI VSAFLPMVKA GFAVSLPLAA ASFVIGMMIA

 51 VAVALVRIMP AGGIVRKILL KLVEFYISVI RGTPLLVQLV IVFYGLPSVG

101 IYIDPIPAAI IGFSLNVGAY ASETIRAAIL SVPKGQWEAG FSIGMTYMQT

151 FRRIVAPQAF RVAVPPLSNE FIGLFKNTSL AAVVTVTELF RVAQETANRT

201 YDFLPVYIEA ALVYWCFCKV LFLIQARLEK RFDRYVAK*
```

Computer analysis of this amino acid sequence gave the following results:

Homology with a predicted ORF from *N meningitidis*

ORF 705 shows 100.0% identity over a 238 aa overlap with a predicted ORF (ORF 705) from *N. meningitidis:* a705/m705 100.0% identity in 238 aa overlap

```
                  10        20        30        40        50        60
a705.pep  VFNNFLASLPFMTETRADMIVSAFLPMVKAGFAVSLPLAAASFVIGMMIAVAVALVRIMP
          ||||||||||||||||||||||||||||||||||||||||||||||||||||||||||||
m705      VFNNFLASLPFMTETRADMIVSAFLPMVKAGFAVSLPLAAASFVIGMMIAVAVALVRIMP
                  10        20        30        40        50        60

                  70        80        90       100       110       120
a705.pep  AGGIVRKILLKLVEFYISVIRGTPLLVQLVIVFYGLPSVGIYIDPIPAAIIGFSLNVGAY
          ||||||||||||||||||||||||||||||||||||||||||||||||||||||||||||
m705      AGGIVRKILLKLVEFYISVIRGTPLLVQLVIVFYGLPSVGIYIDPIPAAIIGFSLNVGAY
                  70        80        90       100       110       120

                 130       140       150       160       170       180
a705.pep  ASETIRAAILSVPKGQWEAGFSIGMTYMQTFRRIVAPQAFRVAVPPLSNEFIGLFKNTSL
          ||||||||||||||||||||||||||||||||||||||||||||||||||||||||||||
m705      ASETIRAAILSVPKGQWEAGFSIGMTYMQTFRRIVAPQAFRVAVPPLSNEFIGLFKNTSL
                 130       140       150       160       170       180

                 190       200       210       220       230      239
a705.pep  AAVVTVTELFRVAQETANRTYDFLPVYIEAALVYWCFCKVLFLIQARLEKRFDRYVAKX
          |||||||||||||||||||||||||||||||||||||||||||||||||||||||||||
m705      AAVVTVTELFRVAQETANRTYDFLPVYIEAALVYWCFCKVLFLIQARLEKRFDRYVAKX
                 190       200       210       220       230
```

The following partial DNA sequence was identified in *N. gonorrhoeae* <SEQ ID 2363>:

```
g706.seq

  1 ATGAACTCCT CGCAACGCAA ACGCCTTTCC GgccGCTGGC TCAACTCCTA

 51 CGAACGCTac cGCCaccGCC GCCTCATACA TGCCGTGCGG CTCGGCggaa

101 ccgtCCTGTT CGCCACCGCA CTCGCCCGgc tACTCCACCT CCAacacggc

151 gAATGGATAG GGAtgaCCGT CTTCGTCGTC CTCGGCATGC TCCAGTTCCA

201 AGGCgcgatt tActccaacg cggtgGAacg taTGctcggt acggtcatcg

251 ggctgGGCGC GGGTTTGGgc gTTTTATGGc TGAACCAGCA TTAtttccac

301 ggcaacCTcc tcttctacct gaccatcggc acggcaagcg cactggccgg
```

-continued

```
 351 ctGGGCGGCG GTCGGCAAAA acggctacgt ccctatgctg GCGGGGctgA

 401 CGATGTGCAT gctcatcggc gACAACGGCA GCGAATGGCT CGACAGCGGC

 451 CTGATGCGCG CGATGAACGT CCTCATCGGC GCCGCCATCG CCATTGCCGC

 501 CGCCAAACTG CTGCCGCTGA AATCCACACT GATGTGGCGT TTCATGCTTG

 551 CCGACAACCT GGCCGACTGC AGCAAAATGA TTGCCGAAAT CAGCAACGGC

 601 AGGCGTATGA CGCGCGAACG TTTGGAGCAG AATATGGTCA AAATGCGCCA

 651 AATCAACGCA CGCATGGTCA AAAGCCGCAG CCACCTCGCC GCCACATCGG

 701 GCGAAAGCCG CATCAGCCCC TCCATGATGG AAGCCATGCA GCACGCCCAC

 751 CGCAAAATCG TCAACACCAC CGAGCTGCTC CTGACCACCG CCGCCAAGCT

 801 GCAATCTCCC AAACTCAACG GCAGCGAAAT CCGGCTGCTC GACCGCCACT

 851 TCACACTGCT CCAAACCGAC CTGCAACAAA CCGCCGCCCT CATCAACGGC

 901 AGACACGCCC GCCGCATCCG CATCGACACC GCCATCAACC CCGAACTGGA

 951 AGCCCTCGCC GAACACCTCC ACTACCAATG GCAGGGCTTC CTCTGGCTCA

1001 GCACCAATAT GCGTCAGGAA ATTTCCGCCC TCGTCATCCT GCTGCAACGC

1051 ACCCGCCGCA AATGGCTGGA TGCCCACGAA CGCCAACACC TGCGCCAAAG

1101 CCTGCTTGAA ACACGGGAAC ACGGCTGA
```

This corresponds to the amino acid sequence <SEQ ID 2364: ORF 706.ng>:

g706.pep

```
  1 MNSSQRKRLS GRWLNSYERY RHRRLIHAVR LGGTVLFATA LARLLHLQHG

 51 EWIGMTVFVV LGMLQFQGAI YSNAVERMLG TVIGLGAGLG VLWLNQHYFH

101 GNLLFYLTIG TASALAGWAA VGKNGYVPML AGLTMCMLIG DNGSEWLDSG

151 LMRAMNVLIG AAIAIAAAKL LPLKSTLMWR FMLADNLADC SKMIAEISNG

201 RRMTRERLEQ NMVRMKQINA RMVKSRSHLA ATSGESRISP SMMEAMQHAH

251 RKIVNTTELL LTTAAKLQSP KLNGSEIRLL DRHFTLLQTD LQQTAALING

301 RHARRIRIDT AINPELEALA EHLHYQWQGF LWLSTNMRQE ISALVILLQR

351 TRRKWLDAHE RQHLRQSLLE TREHG*
```

The following partial DNA sequence was identified in *N. meningitidis* <SEQ ID 2365>:

m706.seq

```
  1 ATGAACACCT CGCAACGCAA CCGCCTCGTC AGCCGCTGGC TCAACTCCTA

 51 CGAACGCTAC CGCTACCGCC GCCTCATCCA CGCCGTCCGG CTCGGCGGGG

101 CCGTCCTGTT CGCCACCGCC TCCGCCCGGC TGCTCCACCT CCAACACGGC

151 GAGTGGATAG GGATGACCGT CTTCGTCGTC CTCGGCATGC TCCAGTTTCA

201 AGGGGCGATT TACTCCAAGG CGGTGGAACG TATGCTCGGC ACGGTCATCG

251 GGCTGGGCGC GGGTTTGGGC GTTTTATGGC TGAACCAGCA TTATTTCCAC

301 GGCAACCTCC TCTTCTACCT CACCGTCGGC ACGGCAAGCG CACTGGCCGG
```

-continued

```
 351 CTGGGCGGCG GTCGGCAAAA ACGGCTACGT CCCTATGCTG GCAGGGCTGA

 401 CGATGTGTAT GCTCATCGGC GACAACGGCA GCGAATGGCT CGACAGCGGA

 451 CTCATGCGCG CCATGAACGT CCTCATCGGC GCGGCCATCG CCATCGCCGC

 501 CGCCAAACTG CTGCCGCTGA AATCCACACT GATGTGGCGT TTCATGCTTG

 551 CCGACAACCT GGCCGACTGC AGCAAAATGA TTGCCGAAAT CAGCAACGGC

 601 AGGCGCATGA CCCGCGAACG CCTCGAGGAG AACATGGCGA AAATGCGCCA

 651 AATCAACGCA CGCATGGTCA AAAGCCGCAG CCATCTCGCC GCCACATCGG

 701 GCGAAAGCCG CATCAGCCCC GCCATGATGG AAGCCATGCA GCACGCCCAC

 751 CGTAAAATCG TCAACACCAC CGAGCTGCTC CTGACCACCG CCGCCAAGCT

 801 GCAATCTCCC AAACTCAACG GCAGCGAAAT CCGGCTGCTT GACCGCCACT

 851 TCACACTGCT CCAAACCGAC CTGCAACAAA CCGTCGCCCT TATCAACGGC

 901 AGACACGCCC GCCGCATCCG CATCGACACC GCCATCAACC CCGAACTGGA

 951 AGCCCTCGCC GAACACCTCC ACTACCAATG GCAGGGCTTC CTCTGGCTCA

1001 GCACCAATAT GCGTCAGGAA ATTTCCGCCC TCGTCATCCT GCTGCAACGC

1051 ACCCGCCGCA AATGGCTGGA TGCCCACGAA CGCCAACACC TGCGCCAAAG

1101 CCTGCTTGAA ACACGGGAAC ACGGCTGA
```

This corresponds to the amino acid sequence <SEQ ID 2366: ORF 706>:

m706.pep

```
  1 MNTSQRNRLV SRWLNSYERY RYRRLIHAVR LGGAVLFATA SARLLHLQHG

 51 EWIGMTVFVV LGMLQFQGAI YSKAVERMLG TVIGLGAGLG VLWLNQHYFH

101 GNLLFYLTVG TASALAGWAA VGKNGYVPML AGLTMCMLIG DNGSEWLDSG

151 LMRAMNVLIG AAIAIAAAKL LPLKSTLNWR FMLADNLADC SKMIAEISNG

201 RRMTRERLEE NMAKMRQINA RMVKSRSHLA ATSGESRISP AMMEAMQHAH

251 RKIVNTTELL LTTAAKLQSP KLNGSEIRLL DRHFTLLQTD LQQTVALING

301 RHARRIRIDT AINPELEALA EHLHYQWQGF LWLSTNMRQE ISALVILLQR

351 TRRKWLDAHE RQHLRQSLLE TREHG*
```

m706/g706 96.5% identity in 375 aa overlap

```
                     10        20        30        40        50        60
m706.pep    MNTSQRNRLVSRWLNSYERYRYRRLIHAVRLGGAVLFATASARLLHLQHGEWIGMTVFVV
            ||:|||:|| :||||||||||:|||||||||||:|||||| |||||||||||||||||||
g706        MNSSQRKRLSGRWLNSYERYRHRRLIHAVRLGGTVLFATALARLLHLQHGEWIGMTVFVV
                     10        20        30        40        50        60

                     70        80        90       100       110       120
m706.pep    LGMLQFQGAIYSKAVERMLGTVIGLGAGLGVLWLNQHYFHGNLLFYLTVGTASALAGWAA
            ||||||||||||:|||||||||||||||||||||||||||||||||||:|||||||||||
g706        LGMLQFQGAIYSNAVERMLGTVIGLGAGLGVLWLNQHYFHGNLLFYLTIGTASALAGWAA
                     70        80        90       100       110       120

                    130       140       150       160       170       180
m706.pep    VGKNGYVPMLAGLTMCMLIGDNGSEWLDSGLMRAMNVLIGAAIAIAAAKLLPLKSTLMWR
            ||||||||||||||||||||||||||||||||||||||||||||||||||||||||||||
g706        VGKNGYVPMLAGLTMCMLIGDNGSEWLDSGLMRAMNVLIGAAIAIAAAKLLPLKSTLMWR
                    130       140       150       160       170       180
```

-continued

```
              190        200        210        220        230        240
m706.pep  FMLADNLADCSKMIAEISNGRRMTRERLEENMAKMRQINARMVKSRSHLAATSGESRISP
          ||||||||||||||||||||||||||||||:||:||||||||||||||||||||||||||
g706      FMLADNLADCSKMIAEISNGRRMTRERLEQNMVKMRQINARMVKSRSHLAATSGESRISP
              190        200        210        220        230        240

              250        260        270        280        290        300
m706.pep  AMMEAMQHAHRKIVNTTELLLTTAAKLQSPKLNGSEIRLLDRHFTLLQTDLQQTVALING
          :||||||||||||||||||||||||||||||||||||||||||||||||||||:|||||
g706      SMMEAMQHAHRKIVNTTELLLTTAAKLQSPKLNGSEIRLLDRHFTLLQTDLQQTAALING
              250        260        270        280        290        300

              310        320        330        340        350        360
m706.pep  RHARRIRIDTAINPELEALAEHLHYQWQGFLWLSTNMRQEISALVILLQRTRRKWLDAHE
          ||||||||||||||||||||||||||||||||||||||||||||||||||||||||||||
g706      RHARRIRIDTAINPELEALAEHLHYQWQGFLWLSTNMRQEISALVILLQRTRRKWLDAHE
              310        320        330        340        350        360

              370
m706.pep  RQHLRQSLLETREHGX
          ||||||||||||||||
g706      RQHLRQSLLETREHGX
              370
```

The following partial DNA sequence was identified in *N. meningitidis* <SEQ ID 2367>:

a706.seq

```
   1 ATGAACACCT CGCAACGCAA CCGCCTCGTC AGCCGCTGGC TCAACTCCTA
  51 CGAACGCTAC CGCTACCGCC GCCTCATCCA CGCCGTCCGG CTCGGCGGGG
 101 CCGTCCTGTT CGCCACCGCC TCCGCCCGGC TGCTCCACCT CCAACACGGC
 151 GAGTGGATAG GGATGACCGT CTTCGTCGTC CTCGGCATGC TCCAGTTTCA
 201 AGGGGCGATT TACTCCAAGG CGGTGGAACG TATGCTCGGC ACGGTCATCG
 251 GGCTGGGCGC GGGTTTGGGC GTTTTATGGC TGAACCAGCA TTATTTCCAC
 301 GGCAACCTCC TCTTCTACCT CACCGTCGGC ACGGCAAGCG CACTGGCCGG
 351 CTGGGCGGCG GTCGGCAAAA ACGGCTACGT CCCTATGCTG GCGGGGCTGA
 401 CGATGTGCAT GCTCATCGGC GACAACGGCA GCGAATGGTT CGACAGCGGC
 451 CTGATGCGCG CGATGAACGT CCTCATCGGC GCGGCCATCG CCATCGCCGC
 501 CGCCAAACTG CTGCCGCTGA AATCCACACT GATGTGGCGT TTCATGCTTG
 551 CCGACAACCT GACCGACTGC AGCAAAATGA TTGCCGAAAT CAGCAACGGC
 601 AGGCGCATGA CCCGCGAACG CCTCGAAGAG AACATGGCGA AAATGCGCCA
 651 AATCAACGCA CGCATGGTCA AAAGCCGCAG CCACCTCGCC GCCACATCGG
 701 GCGAAAGCCG CATCAGCCCC GCCATGATGG AAGCCATGCA GCACGCCCAC
 751 CGTAAAATTG TCAACACCAC CGAGCTGCTC CTGACCACCG CCGCCAAGCT
 801 GCAATCTCCC AAACTCAACG GCAGCGAAAT CCGGCTGCTT GACCGCCACT
 851 TCACACTGCT CCAAACCGAC CTGCAACAAA CCGTCGCCCT TATCAACGGC
 901 AGACACGCCC GCCGCATCCG CATCGACACC GCCATCAACC CCGAACTGGA
 951 AGCCCTCGCC GAACACCTCC ACTACCAATG GCAGGGCTTC CTCTGGCTCA
1001 GCACCAATAT GCGTCAGGAA ATTTCCGCCC TCGTCATCCT GCTGCAACGC
1051 ACCCGCCGCA AATGGCTGGA TGCCCACGAA CGCCAACACC TGCGCCAAAG
1101 CCTGCTTGAA ACACGGGAAC ACAGTTGA
```

This corresponds to the amino acid sequence <SEQ ID 2368; ORF 706.a>:

a706.pep

```
  1 MNTSQRNRLV SRWLNSYERY RYRRLIHAVR LGGAVLFATA SARLLHLQHG
 51 EWIGMTVFVV LGMLQFQGAI YSKAVERMLG TVIGLGAGLG VLWLNQHYFH
101 GNLLFYLTVG TASALAGWAA VGKNGYVPML AGLTMCMLIG DNGSEWFDSG
151 LMRAMNVLIG AAIAIAAAKL LPLKSTLMWR FMLADNLTDC SKMIAEISNG
201 RRMTRERLEE NMAKMRQINA RMVKSRSHLA ATSGESRISP AMMEAMQHAH
251 RKIVNTTELL LTTAAKLQSP KLNGSEIRLL DRHFTLLQTD LQQTVALING
301 RHARRIRIDT AINPELEALA EHLHYQWQGF LWLSTNMRQE ISALVILLQR
351 TRRKWLDAHE RQHLRQSLLE TREHS*
```

a706/m706 99.5% identity in 374 aa overlap

```
                   10        20        30        40        50        60
a706.pep    MNTSQRNRLVSRWLNSYERYRYRRLIHAVRLGGAVLFATASARLLHLQHGEWIGMTVFVV
            ||||||||||||||||||||||||||||||||||||||||||||||||||||||||||||
m706        MNTSQRNRLVSRWLNSYERYRYRRLIHAVRLGGAVLFATASARLLHLQHGEWIGMTVFVV
                   10        20        30        40        50        60

                   70        80        90       100       110       120
a706.pep    LGMLQFQGAIYSKAVERMLGTVIGLGAGLGVLWLNQHYFHGNLLFYLTVGTASALAGWAA
            ||||||||||||||||||||||||||||||||||||||||||||||||||||||||||||
m706        LGMLQFQGAIYSKAVERMLGTVIGLGAGLGVLWLNQHYFHGNLLFYLTVGTASALAGWAA
                   70        80        90       100       110       120

                  130       140       150       160       170       180
a706.pep    VGKNGYVPMLAGLTMCMLIGDNGSEWFDSGLMRAMNVLIGAAIAIAAAKLLPLKSTLMWR
            |||||||||||||||||||||||||:||||||||||||||||||||||||||||||||||
m706        VGKNGYVPMLAGLTMCMLIGDNGSEWLDSGLMRAMNVLIGAAIAIAAAKLLPLKSTLMWR
                  130       140       150       160       170       180

                  190       200       210       220       230       240
a706.pep    FMLADNLTDCSKMIAEISNGRRMTRERLEENMAKMRQINARMVKSRSHLAATSGESRISP
            |||||||:||||||||||||||||||||||||||||||||||||||||||||||||||||
m706        FMLADNLADCSKMIAEISNGRRMTRERLEENMAKMRQINARMVKSRSHLAATSGESRISP
                  190       200       210       220       230       240

                  250       260       270       280       290       300
a706.pep    AMMEAMQHAHRKIVNTTELLLTTAAKLQSPKLNGSEIRLLDRHFTLLQTDLQQTVALING
            ||||||||||||||||||||||||||||||||||||||||||||||||||||||||||||
m706        AMMEAMQHAHRKIVNTTELLLTTAAKLQSPKLNGSEIRLLDRHFTLLQTDLQQTVALING
                  250       260       270       280       290       300

                  310       320       330       340       350       360
a706.pep    RHARRIRIDTAINPELEALAEHLHYQWQGFLWLSTNMRQEISALVILLQRTRRKWLDAHE
            ||||||||||||||||||||||||||||||||||||||||||||||||||||||||||||
m706        RHARRIRIDTAINPELEALAEHLHYQWQGFLWLSTNMRQEISALVILLQRTRRKWLDAHE
                  310       320       330       340       350       360

                  370
a706.pep    RQHLRQSLLETREHSX
            ||||||||||||||:
m706        RQHLRQSLLETREHGX
                  370
```

g707.seq not found g707.pep not found

The following partial DNA sequence was identified in *N. meningitidis* <SEQ ID 2369>:

m707.seq

```
  1 ATGGAAATTA TTAACGATGC AGAACTTATC CGTTCCATGC AGCGTCAGCA
 51 GCACATAGAT GCTGAATTGT TAACTGATGC AAATGTCCGT TTCGAGCAAC
101 CATTGGAGAA GAACAATTAT GTCCTGAGTG AAGATGAAAC ACCGTGTACT
151 CGGGTAAATT ACATTAGTTT AGATGATAAG ACGGTGCGCA AATTTTCTTT
201 TCTTCCTTCT GTGCTCATGA AAGAAACAGC TTTTAAAACT GGGATGTGTT
```

-continued

```
 251 TAGGTTCCAA TAATTTGAGC AGGCTACAAA AAGCCGCGCA ACAGATACTG
 301 ATCGTGCGTG GCTACCTCAC TTCCCAAGCT ATTATCCAAC CACAGAATAT
 351 GGATTCGGGA ATTCTGAAAT TACGGGTATC AGCAGGCGAA ATAGGGGATA
 401 TCCGCTATGA AGAAAAACGG GATGGGAAGT CTGCCGAGGG CAGTATTAGT
 451 GCATTCAATA ACAAATTTCC CTTATATAGG AACAAAATTC TCAATCTTCG
 501 CGATGTAGAG CAGGGCTTGG AAAACCTGCG TCGTTTGCCG AGTGTTAAAA
 551 CAGATATTCA GATTATACCG TCCGAAGAAG AAGGCAAAAG CGATTTACAG
 601 ATCAAATGGC AGCAGAATAA ACCCATACGG TTCAGTATCG GTATAGATGA
 651 TGCGGGCGGC AAAACGACCG GCAAATATCA AGGAAATGTC GCTTTATCGT
 701 TCGATAACCC TTTGGGCTTA AGCGATTTGT TTTATGTTTC ATATGGACGC
 751 GGTTTGGCGC ACAAAACGGA CTTGACTGAT GCCACCGGTA CGGAAACTGA
 801 AAGCGGATCC AGAAGTTACA GCGTGCATTA TTCGGTGCCC GTAAAAAAAT
 851 GGCTGTTTTC TTTTAATCAC AATGGACATC GTTACCACGA AGCAACCGAA
 901 GGCTATTCCG TCAATTACGA TTACAACGGC AAACAATATC AGAGCAGCCT
 951 GGCCGCCGAG CGCATGCTTT GGCGTAACAG ACTTCATAAA ACTTCAGTCG
1001 GAATGAAATT ATGGACACGC CAAACCTATA AATACATCGA CGATGCCGAA
1051 ATCGAAGTAC AACGCCGCCG CTCTGCAGGC TGGGAAGCCG AATTGCGCCA
1101 CCGTGCTTAC CTCAACCGTT GGCAGCTTGA CGGCAAGTTG TCTTACAAAC
1151 GCGGGACCGG CATGCGCCAA AGTATGCCTG CACCGGAAGA AAACGGCGGC
1201 GATATTCTTC CAGGTACATC TCGTATGAAA ATCATTACTG CCAGTTTGGA
1251 CGCAGCCGCC CCATTTATTT TAGGCAAACA GCAGTTTTTC TACGCAACCG
1301 CCATTCAAGC TCAATGGAAC AAAACGCCGT TGGTTGCCCA AGATAAATTG
1351 TCAATCGGCA GCCGCTACAC CGTTCGCGGA TTTGATGGGG AGCAGAGTCT
1401 TTTCGGAGAG CGAGGTTTCT ACTGGCAGAA TACTTTAACT TGGTATTTTC
1451 ATCCGAACCA TCAGTTCTAT CTCGGTGCGG ACTATGGCCG CGTATCTGGC
1501 GAAAGTGCAC AATATGTATC GGGCAAGCAG CTGATGGGTG CAGTGGTCGG
1551 CTTCAGAGGA GGGCATAAAG TAGGCGGTAT GTTTGCTTAT GATCTGTTTG
1601 CCGGCAAGCC GCTTCATAAA CCCAAAGGCT TTCAGACGAC CAACACCGTT
1651 TACGGCTTCA ACTTGAATTA CAGTTTCTAA
```

This corresponds to the amino acid sequence <SEQ ID 2370; ORF 707>:

m707.pep

```
  1 MEIINDAELI RSMQRQQHID AELLTDANVR FEQPLEKNNY VLSEDETPCT
 51 RVNYISLDDK TVRKFSFLPS VLMKETAFKT GMCLGSNNLS RLQKAAQQIL
101 IVRGYLTSQA IIQPQNMDSG ILKLRVSAGE IGDIRYEEKR DGKSAEGSIS
151 AFNNKFPLYR NKILNLRDVE QGLENLRRLP SVKTDIQIIP SEEEGKSDLQ
201 IKWQQNKPIR FSIGIDDAGG KTTGKYQGNV ALSFDNPLGL SDLFYVSYGR
251 GLAHKTDLTD ATGTETESGS RSYSVHYSVP VKKWLFSFNH NGHRYHEATE
```

-continued

```
301 GYSVNYDYNG KQYQSSLAAE RMLWRNRLHK TSVGMKLWTR QTYKYIDDAE

351 IEVQRRRSAG WEAELRHRAY LNRWQLDGKL SYKRGTGMRQ SMPAPEENGG

401 DILPGTSRMK IITASLDAAA PFILGKQQFF YATAIQAQWN KTPLVAQDKL

451 SIGSRYTVRG FDGEQSLFGE RGFYWQNTLT WYFHPNHQFY LGADYGRVSG

501 ESAQYVSGKQ LMGAVVGFRG GHKVGGMFAY DLFAGKPLHK PKGFQTTNTV

551 YGFNLNYSF*
```

The following partial DNA sequence was identified in *N. meningitidis* <SEQ ID 2371>:

a707.seq

```
   1 NTGAAAGAAA CAGCTTTTAA AACTGGGATG TGTTTAGGTT CCAATAATTT

  51 GAGCAGGCTA CAAAAAGCCG CGCAACAGAT ACTGATTGTG CGTGGCTACC

 101 TCACTTCCCA AGCTATTATC CAACCACAGA ATATGGATTC GGGAATTCTG

 151 AAATTACGGG TATCAGCAGG CGAAATAGGN GATATCCGCT ATGAAGAAAA

 201 ACGGGATGNG AAGTCTGCCG AGGGCAGTAT TAGTGCATTC AATAACAAAN

 251 TTCCCTTATA TAGGAACAAA ATTCTCAATC TTCGCGATGT AGAGCAGGGC

 301 TTGGAAAACC TGCGTCGTTT GCCGAGTGTT AAAACAGATA TTCAGATTAT

 351 ACCGTCCGAA GAAGAAGGCA AAAGCGATTT ACAGATCAAA TGGCAGCAGA

 401 ATAAACCCAT ACGGTTCAGT ATCGGTATAG ATGATGCGGG CGGCAAAACG

 451 ACCGGCAAAT ATCAAGGAAA TGTCGCTTTA TCGTNCGATA ACCCTTTGGG

 501 NTTAAGCGAT TNGTTTTATG TTTCATATGG ACGCGGTTTG GTGCACAAAA

 551 CGGACTTGAC TGNTGCCACC GGTACGGAAA CTGAAAGCGG ATCCAGAAGT

 601 TACAGCGTGC ATTATTCGGT GNNCGTAAAA AAATGGCTGT TTTCTTTTAA

 651 TCACAATGGA CATCGTTACC ACGAAGCAAC CGAAGGCTAT TCCGTCAATT

 701 ACGATTACAA CGGCAAACAA TATCAGAGCA GCCTGGCCGC CGAGCGCATG

 751 CTTTGGNNNN NNAGNTTTCN TNAAACTTCA GTCNGAATGA AATTATGGAC

 801 ACGCCAAACC TATAAATACA TCGACGATGC CGAAATCGAA GTGCAACGCC

 851 GCCGCTCTGC AGGCTGGGAA GCCGAATTGC GCCACCGTGC TTACCTCNAC

 901 CGTTGGCAGC TTGACGGCAA GTTGTCTTAC AAACGCGGGA CCGGCATGCG

 951 CCAAAGTATG CCCGCACCTG AAGAAAACGG CGGCGGTACT ATTCCAGNCA

1001 NATCCCGTAT GAAAATCATA ACCGCCGGAT TGGATGCAGC GGCCCCGTNT

1051 ATGTTGGGCA AACAGCAGTT TTTCTACGCA ACCGCCATTC AAGCTCAATG

1101 GAACAAAACG CCTTTGGTTG CCCAAGACAA GTTGTCTATC GGCAGCCGCT

1151 ACACCGTTCG CGGATTTGAT GGGGAGCAGA GTCTTTTCGG AGAGCGAGGT

1201 TTCTACTGGC AGAATACTTT AACTTGGTAT TTTCATCCGA ACCATCAGTT

1251 CTATCTCGGT GCGGACTATG GCCGCGTATC TGGCGAAAGT GCACAATATG

1301 TATCGGGCAA GCAGCTGATG GGTGCAGTGG TCGGCTTCAG AGGAGGGCAT

1351 AAAGTAGGCG GTATGTTTGC TTATGATCTG TTTGCCGGCA AGCCGCTTCA

1401 TAAACCCAAA GGCTTTCAGA CGACCAACAC CGTTTACGGC TTCAACTTGA

1451 ATTACAGTTT CTAA
```

This corresponds to the amino acid sequence <SEQ ID 2372; ORF 707.a>:

```
a707.pep

  1 XKETAFKTGM CLGSNNLSRL QKAAQQILIV RGYLTSQAII QPQNMDSGIL

 51 KLRVSAGEIG DIRYEEKRDX KSAEGSISAF NNKXPLYRNK ILNLRDVEQG

101 LENLRRLPSV KTDIQIIPSE EEGKSDLQIK WQQNKPIRFS IGIDDAGGKT

151 TGKYQGNVAL SXDNPLGLSD XFYVSYGRGL VHKTDLTXAT GTETESGSRS

201 YSVHYSVXVK KWLFSFNHNG HRYHEATEGY SVNYDYNGKQ YQSSLAAERM

251 LWXXXFXXTS VXMKLWTRQT YKYIDDAEIE VQRRRSAGWE AELRHRAYLX

301 RWQLDGKLSY KRGTGMRQSM PAPEENGGGT IPXXSRMKII TAGLDAAAPX

351 MLGKQQFFYA TAIQAQWNKT PLVAQDKLSI GSRYTVRGFD GEQSLFGERG

401 FYWQNTLTWY FHPNHQFYLG ADYGRVSGES AQYVSGKQLM GAVVGFRGGH

451 KVGGMFAYDL FAGKPLHKPK GFQTTNTVYG FNLNYSF*
```

a707/m707 95.3% identity in 486 aa overlap

```
                                                    10        20        30
a707.pep                                 XKETAFKTGMCLGSNNLSRLQKAAQQILIVR
                                          ||||||||||||||||||||||||||||||
m707      EDETPCTRVNYISLDDKTVRKFSFLPSVLMKETAFKTGMCLGSNNLSRLQKAAQQILIVR
              50        60        70        80        90       100

              40        50        60        70        80        90
a707.pep  GYLTSQAIIQPQNMDSGILKLRVSAGEIGDIRYEEKRDXKSAEGSISAFNNKXPLYRNKI
          |||||||||||||||||||||||||||||||||||||| ||||||||||||| |||||||
m707      GYLTSQAIIQPQNMDSGILKLRVSAGEIGDIRYEEKRDGKSAEGSISAFNNKFPLYRNKI
             110       120       130       140       150       160

             100       110       120       130       140       150
a707.pep  LNLRDVEQGLENLRRLPSVKTDIQIIPSEEEGKSDLQIKWQQNKPIRFSIGIDDAGGKTT
          ||||||||||||||||||||||||||||||||||||||||||||||||||||||||||||
m707      LNLRDVEQGLENLRRLPSVKTDIQIIPSEEEGKSDLQIKWQQNKPIRFSIGIDDAGGKTT
             170       180       190       200       210       220

             160       170       180       190       200       210
a707.pep  GKYQGNVALSXDNPLGLSDXFYVSYGRGLVHKTDLTXATGTETESGSRSYSVHYSVXVKK
          |||||||||| |||||||| |||||||||:|||||| |||||||||||||||||||| ||
m707      GKYQGNVALSFDNPLGLSDLFYVSYGRGLAHKTDLTDATGTETESGSRSYSVHYSVPVKK
             230       240       250       260       270       280

             220       230       240       250       260       270
a707.pep  WLFSFNHNGHRYHEATEGYSVNYDYNGKQYQSSLAAERMLWXXXFXXTSVXMKLWTRQTY
          |||||||||||||||||||||||||||||||||||||||||   :  ||| |||||||||
m707      WLFSFNHNGHRYHEATEGYSVNYDYNGKQYQSSLAAERMLWRNRLHKTSVGMKLWTRQTY
             290       300       310       320       330       340

             280       290       300       310       320       330
a707.pep  KYIDDAEIEVQRRRSAGWEAELRHRAYLXRWQLDGKLSYKRGTGMRQSMPAPEENGGGTI
          |||||||||||||||||||||||||||| ||||||||||||||||||||||||||||  :
m707      KYIDDAEIEVQRRRSAGWEAELRHRAYLNRWQLDGKLSYKRGTGMRQSMPAPEENGGDIL
             350       360       370       380       390       400

             340       350       360       370       380       390
a707.pep  PXXSRMKIITAGLDAAAPXMLGKQQFFYATAIQAQWNKTPLVAQDKLSIGSRYTVRGFDG
          | :||||||||:|||||| :||||||||||||||||||||||||||||||||||||||||
m707      PGTSRMKIITASLDAAAPFILGKQQFFYATAIQAQWNKTPLVAQDKLSIGSRYTVRGFDG
             410       420       430       440       450       460

             400       410       420       430       440       450
a707.pep  EQSLFGERGFYWQNTLTWYFHPNHQFYLGADYGRVSGESAQYVSGKQLMGAVVGFRGGHK
          ||||||||||||||||||||||||||||||||||||||||||||||||||||||||||||
m707      EQSLFGERGFYWQNTLTWYFHPNHQFYLGADYGRVSGESAQYVSGKQLMGAVVGFRGGHK
             470       480       490       500       510       520

             460       470       480
a707.pep  VGGMFAYDLFAGKPLHKPKGFQTTNTVYGFNLNYSFX
          |||||||||||||||||||||||||||||||||||||
m707      VGGMFAYDLFAGKPLHKPKGFQTTNTVYGFNLNYSFX
             530       540       550       560
```

The following partial DNA sequence was identified in *N. gonorrhoeae* <SEQ ID 2373>:

g708.seq

```
  1 ATGCCTTTTA AGCCATCCAA ACGAATCTCT TTATTACTTG TTCTTGCCTT
 51 GGGCGCGTGC AGCACTTCCT ACCGCCCCTC GCGGGCAGAA AAAGCCAATC
101 AGGTTTCCAA TATCAAAACC CAGTTGGCGA TGGAATATAT GCGCGGTCAG
151 GACTACCGTC AGGCAACGGC AAGTATTGAA GATGCCTTGA AATCGAACCC
201 TAAAAACGAA CTTGCCTGGC TGGTCCGTGC CGAAATCTAT CAATACCTGA
251 AAGTTAACGA CAAGGCGCAG GAAAGTTTCC GGCAAGCCCT CTCCATCAAA
301 CCCGACAGTG CCGAAATCAA CAACAACTAC GGCTGGTTCC TGTGCGGCAG
351 GCTCAACCGC CCTGCCGAAT CTATGGCATA TTTCGACAAA GCCCTGGCCG
401 ACCCCACCTA CCCGACCCCT TATATTGCCA ACCTGAATAA AGGTATATGC
451 AGCGCAAAAC AGGGGCAATT CGGATTGGCG GAAGCCTATT TGAAACGTTC
501 CCTCGCCGCC CAGCCGCAGT TCCCACCCGC ATTTAAAGAA CTGGCGCGCA
551 CCAAAATGCT GGCCGGGCAG TTGGGCGATG CCGATTACTA CTTTAAAAAA
601 TACCAAAGCA GGGTAGAAGT CCTTCAGGCC GATGATTTGC TGCTAGGCTG
651 GAAAATTGCC AAAGCCCTCG GCAACGTGCA GGCGGCATAC GAATATGAAG
701 CACAATTGCA GGCAAATTTC CCCTACTCGG AAGAATTGCA AACCGTCCTC
751 ACCGGTCAAT AA
```

This corresponds to the amino acid sequence <SEQ ID 2374; ORF 708.ng>:

g708.pep

```
  1 MPFKPSKRIS LLLVLALGAC STSYRPSRAE KANQVSNIKT QLAMEYMRGQ
 51 DYRQATASIE DALKSNPKNE LAWLVRAEIY QYLKVNDKAQ ESFRQALSIK
101 PDSAEINNNY GWFLCGRLNR PAESMAYFDK ALADPTYPTP YIANLNKGIC
151 SAKQGQFGLA EAYLKRSLAA QPQFPPAFKE LARTKMLAGQ LGDADYYFKK
201 YQSRVEVLQA DDLLLGWKIA KALGNVQAAY EYEAQLQANF PYSEELQTVL
251 TGQ*
```

The following partial DNA sequence was identified in *N. meningitidis* <SEQ ID 2375>:

m708.seq

```
  1 ATGCCTTTTA AGCCATCCAA ACGAATCTCT TTATTACTCG TTCTTGCCTT
 51 GGGCGCGTGC AGCACTTCCT ACCGCCCCTC GCGGGCAGAA AAAGCCAATC
101 AGGTTTCCAA TATCAAAACC CAGTTGGCAA TGGAATATAT GCGCGGTCAG
151 GACTACCGTC AGGCGACGGC AAGTATTGAA GACGCCCTGA AATCGGACCC
201 TAAAAACGAG CTTGCCTGGC TGGTCCGTGC CGAAATCTAT CAATACCTGA
251 AAGTTAACGA CAAGGCGCAG GAAAGTTTCC GGCAAGCCCT CTCCATCAAA
301 CCCGACAGTG CCGAAATCAA CAACAACTAC GGTTGGTTCC TATGCGGCAG
351 GCTCAACCGC CCTGCCGAAT CTATGGCATA TTTCGACAAA GCTCTGGCCG
401 ACCCCACCTA CCCGACCCCT TATATTGCCA ACCTGAATAA AGGCATATGC
```

-continued

```
451 AGCGCAAAAC AGGGGCAATT CGGATTGGCG GAAGCCTATT TGAAACGTTC

501 CCTCGCCGCC CAGCCGCAGT TCCCACCCGC ATTTAAAGAA CTGGCGCGCA

551 CCAAAATGCT GGCCGGGCAG TTGGGCGATG CCGATTACTA CTTTAAAAAA

601 TACCAAAGCA GGGTAGAAGT CCTTCAGGCC GATGATTTGC TGCTAGGCTG

651 GAAAATTGCC AAAGCCCTCG GCAACGCACA GGCGGCATAC GAATATGAAG

701 CACAATTGCA GGCGAATTTC CCCTACTCGG AAGAATTGCA AACCGTCCTC

751 ACCGGTCAAT AA
```

This corresponds to the amino acid sequence <SEQ ID 2376; ORF 708>:

m708.pep

```
  1 MPFKPSKRIS LLLVLALGAC STSYRPSRAE KANQVSNIKT QLAMEYMRGQ

 51 DYRQATASIE DALKSDPKNE LAWLVRAEIY QYLKVNDKAQ ESFRQALSIK

101 PDSAEINNNY GWFLCGRLNR PAESMAYFDK ALADPTYPTP YIANLNKGIC

151 SAKQGQFGLA EAYLKRSLAA QPQFPPAFKE LARTKMLAGQ LGDADYYFKK

201 YQSRVEVLQA DDLLLGWKIA KALGNAQAAY EYEAQLQANF PYSEELQTVL

251 TGQ*
```

m708/g708 99.2% identity in 253 aa overlap

```
                   10        20        30        40        50        60
m708.pep   MPFKPSKRISLLLVLALGACSTSYRPSRAEKANQVSNIKTQLAMEYMRGQDYRQATASIE
           ||||||||||||||||||||||||||||||||||||||||||||||||||||||||||||
g708       MPFKPSKRISLLLVLALGACSTSYRPSRAEKANQVSNIKTQLAMEYMRGQDYRQATASIE
                   10        20        30        40        50        60

                   70        80        90       100       110       120
m708.pep   DALKSDPKNELAWLVRAEIYQYLKVNDKAQESFRQALSIKPDSAEINNNYGWFLCGRLNR
           |||||:||||||||||||||||||||||||||||||||||||||||||||||||||||||
g708       DALKSNPKNELAWLVRAEIYQYLKVNDKAQESFRQALSIKPDSAEINNNYGWFLCGRLNR
                   70        80        90       100       110       120

                  130       140       150       160       170       180
m708.pep   PAESMAYFDKALADPTYPTPYIANLNKGICSAKQGQFGLAEAYLKRSLAAQPQFPPAFKE
           ||||||||||||||||||||||||||||||||||||||||||||||||||||||||||||
g708       PAESMAYFDKALADPTYPTPYIANLNKGICSAKQGQFGLAEAYLKRSLAAQPQFPPAFKE
                  130       140       150       160       170       180

                  190       200       210       220       230       240
m708.pep   LARTKMLAGQLGDADYYFKKYQSRVEVLQADDLLLGWKIAKALGNAQAAYEYEAQLQANF
           |||||||||||||||||||||||||||||||||||||||||||||:||||||||||||||
g708       LARTKMLAGQLGDADYYFKKYQSRVEVLQADDLLLGWKIAKALGNVQAAYEYEAQLQANF
                  190       200       210       220       230       240

                  250
m708.pep   PYSEELQTVLTGQX
           ||||||||||||||
g708       PYSEELQTVLTGQX
                  250
```

The following partial DNA sequence was identified in *N. meningitidis* <SEQ ID 2377>:

a708.seq

```
  1 ATGCCTTTTA AGCCATCCAA ACGAATCTCT TTATTACTTG TCCTTGCCTT

 51 GGGCGCGTGC AGCACTTCCT ACCGCCCCTC GCGGGCAGAA AAAGCCAATC
```

-continued

```
101 AGGTTTCCAA TATCAAAACC CAGTTGGCAA TGGAATATAT GCGCGGTCAG

151 GACTACCGTC AGGNGACGGC AAGTATTGAA GACGCCTTGA AATCAGACCC

201 TAAAAACGAG CTTGCCTGGC TGGTCCGTGC CGAAATCTAT CAATACCTGA

251 AAGTTAACGA CAAGGCGCAG GAAAGTTTCC GGCAAGNCCT CTCCATCAAA

301 CCCGACAGTG CCGAAATCAA CAACAACTAC NGCTGGTTCC TGTGCGGCAG

351 GCTCAACCGC CCTGCCGAAT CTATGGCATA TTTCGACAAA GCCCTGGCCG

401 ACCCCACNTA CCCGANCCCT TATATTGCCA ACCTGAATAA AGGCATATGC

451 AGCGCAAAAC AGGGGCAATT CGGATTGGCG GAAGCCTATT TGAAACGTTC

501 CCTCGCCGCC CAGCCGCAGT TCCCACCCGC ATTTAAAGAA CTGGCGCGCA

551 CCAAAATGCT GGCCGGGCAG TTGGGCGATG CCGATTACTA CTTTAAAAAA

601 TACCAAAGCA GGGTAGAAGT CCTTCAGGCC GATGATTTGC TGCTAGGCTG

651 GAAAATTGCC AAAGCCCTCG GCAACGCACA GGCGGCATAC GAATATGAAG

701 CACAATTGCA GGCGAATTTC CCCTACTCGG AAGAATTGCA AACCGTCCTC

751 ATCGGTCAAT AA
```

This corresponds to the amino acid sequence <SEQ ID 2378; ORF 708.a>:

a708.pep

```
  1 MPFKPSKRIS LLLVLALGAC STSYRPSRAE KANQVSNIKT QLAMEYMRGQ

 51 DYRQXTASIE DALKSDPKNE LAWLVRAEIY QYLKVNDKAQ ESFRQXLSIK

101 PDSAEINNNY XWFLCGRLNR PAESMAYFDK ALADPTYPXP YIANLNKGIC

151 SAKQGQFGLA EAYLKRSLAA QPQFPPAFKE LARTKMLAGQ LGDADYYFKK

201 YQSRVEVLQA DDLLLGWKIA KALGNAQAAY EYEAQLQANF PYSEELQTVL

251 IGQ*
```

a708/m708 98.0% identity in 253 aa overlap

```
                   10        20        30        40        50        60
a708.pep    MPFKPSKRISLLLVLALGACSTSYRPSRAEKANQVSNIKTQLAMEYMRGQDYRQXTASIE
            |||||||||||||||||||||||||||||||||||||||||||||||||||||| |||||
m708        MPFKPSKRISLLLVLALGACSTSYRPSRAEKANQVSNIKTQLAMEYMRGQDYRQATASIE
                   10        20        30        40        50        60

                   70        80        90       100       110       120
a708.pep    DALKSDPKNELAWLVRAEIYQYLKVNDKAQESFRQXLSIKPDSAEINNNYXWFLCGRLNR
            |||||||||||||||||||||||||||||||||| ||||||||||||||| |||||||||
m708        DALKSDPKNELAWLVRAEIYQYLKVNDKAQESFRQALSIKPDSAEINNNYGWFLCGRLNR
                   70        80        90       100       110       120

                  130       140       150       160       170       180
a708.pep    PAESMAYFDKALADPTYPXPYIANLNKGICSAKQGQFGLAEAYLKRSLAAQPQFPPAFKE
            |||||||||||||||||:||||||||||||||||||||||||||||||||||||||||||
m708        PAESMAYFDKALADPTYPTPYIANLNKGICSAKQGQFGLAEAYLKRSLAAQPQFPPAFKE
                  130       140       150       160       170       180

                  190       200       210       220       230       240
a708.pep    LARTKMLAGQLGDADYYFKKYQSRVEVLQADDLLLGWKIAKALGNAQAAYEYEAQLQANF
            ||||||||||||||||||||||||||||||||||||||||||||||||||||||||||||
m708        LARTKMLAGQLGDADYYFKKYQSRVEVLQADDLLLGWKIAKALGNAQAAYEYEAQLQANF
                  190       200       210       220       230       240

                  250
a708.pep    PYSEELQTVLIGQX
            |||||||||| |||
m708        PYSEELQTVLTGQX
                  250
```

The following partial DNA sequence was identified in *N. gonorrhoeae* <SEQ ID 2379>:

g709.seq

```
   1 ATGTTTGCTT TCAAATCCTT ACTCGATATG CCGCGCGGTG AGGCACTTGC
  51 CGTCGTCGTC GCTCTGATTG CCGCAATGGG CTATACCATC ATTTCATTGG
 101 AGTGGCTGCC GCATATGTCC ATTATTGCCG CCATCGTCGT GCTGATTTTG
 151 TACGGCTTGG CGCGCGGTTT GAAATACAAC GATATGCAGG CAGGGATGAT
 201 AGGCGCGTTG AATCAGGGTA TGGGCGCGGT TTACCTGTTT TTCTTCATCG
 251 GGCTGATGGT CAGCGCGCTG ATGATGAGCG GCGCGATTCC GACGCTGATG
 301 TATTACGGTT TCGGGCTGAT TTCCCCGACT TATTTTTATT TTTCCGCCTT
 351 CGCGCTGTGT TCCGTCATCG GCGTGTCCAT CGGCAGCAGC CTGACCGCCT
 401 GCGCCACTGT CGGCGTTGCC TTTATGGGGA TGGCGGCGGC GTTTCAGGCC
 451 GATATGGCGA TGACGgcggg cgcgattgTT tccggTGTGT TTTTCGGCGA
 501 TAAAATGTCC CCGCTTTCCG ACACCACGGG CATTTCCGCG TCCATCGTCG
 551 GTATCGACCT GTTTGAACAC ATCAAAAACA TGATGTACAC CACCATCCCT
 601 GCGTGGCTTA TCAGCGCGGC ACTGATGCTT TGGCTTCTTC CCAGCGTCGC
 651 CGCGCAGGAT TTGAACAGCG TCGAATCCTT CCGCAGCCAG CTTGAAGCCA
 701 CGGGATTGGT GCACGGCTAT TCGCTGATTC CGTTTGCACT GTTGGTCGTT
 751 TTGGCATTGA TGCGCGTCAA TGCCGTGGTC GCCATGCTCT TTACCGTCAT
 801 TGCCGCCGTT GCCGTAACGT ATCTGCACAG CACGCCCGAT CTGCGTCAGC
 851 TCGGCGCGTG GTTTTATGGC GGCTACAAAC TCGAAGGCGA AGCGTTTAAA
 901 GACATTGCCA AACTGATTTC GCGCGGCGGC TTGGAGAGTA TGTTCTTTAC
 951 GCAGACCATC GTTATCCTCG GTATGAGTTT GGGCGGGCTG CTGTTTGCGC
1001 TCGGTGTGAT TCCTTCCTTG CTGGAGGCCG TCCGTACCTT CTTGACGAAT
1051 GCCGGACGCG CGACGTTCAG CGTTGCCATG ACTTCGGTCG GGGTCAATTT
1101 CCTGATTGGA GAGCAATATT TGAGCATCCT GCTTTCGGGA GAAACGTTCA
1151 AACCCGTTTA CGACAAACTC GGCCTGCATT CGTGCAACCT GTCGCGGACT
1201 CTGGAAGATG CGGGGACGGT GATTAACCCG CTCGTGCCGT GGAGCGTGTG
1251 CGGCGTATTT ATCAGCCACG CCCTTGGCGT ACCCGTTTGG GAATATCTGC
1301 CTTATGCCTT TTTCTGCTAT TTGAGTTTGG CTTTAACCCT GTTATTCGGC
1351 TGGACGGGGC TGACTTTGAG CAAAAAATAA
```

This corresponds to the amino acid sequence <SEQ ID 2380; ORF 709.ng>:

g709.pep

```
   1 MFAFKSLLDM PRGEALAVVV ALIAAMGYTI ISLEWLPHMS IIAAIVVLIL
  51 YGLARGLKYN DMQAGMIGAL NQGMGAVYLF FFIGLMVSAL MMSGAIPTLM
 101 YYGFGLISPT YFYFSAFALC SVIGVSIGSS LTACATVGVA FMGMAAAFQA
 151 DMAMTAGAIV SGVFFGDKMS PLSDTTGISA SIVGIDLFEH IKNMMYTTIP
 201 AWLISAALML WLLPSVAAQD LNSVESFRSQ LEATGLVHGY SLIPFALLVV
```

-continued

```
251 LALMRVNAVV AMLFTVIAAV AVTYLHSTPD LRQLGAWFYG GYKLEGEAFK
301 DIAKLISRGG LESMFFTQTI VILGMSLGGL LFALGVIPSL LEAVRTFLTN
351 AGRATFSVAN TSVGVNFLIG EQYLSILLSG ETFKPVYDKL GLHSCNLSRT
401 LEDAGTVINP LVPWSVCGVF ISHALGVPVW EYLPYAFFCY LSLALTLLFG
451 WTGLTLSKK*
```

The following partial DNA sequence was identified in *N. meningitidis* <SEQ ID 2381>:

m709.seq

```
   1 ATGTTCGCTT TCAAATCCTT ACTCGATATG CCGCGCGGTG AGGCACTTGC
  51 CGTCGTCGTC GCTCTGATTG CCGCGATGGG CTATACCATC ATTTCATTGG
 101 AGTGGTTGCC GCATATGTCC ATTATTGCCG CCATCGTCGT GCTGATTTTG
 151 TACGGCTTGG CGCGCGGTTT GAAATACAAC GATATGCAGC AGGGCATGAT
 201 AGGCGCGTTG AATCAGGGTA TGGGCGCGAT TTACCTGTTT TTCTTCATCG
 251 GGCTGATGGT CAGCGCGCTG ATGATGAGCG GCGCGATTCC GACGCTGATG
 301 TATTACGGTT TCGGACTGAT TTCCCCGACT TATTTTTATT TTTCCTCCTT
 351 CGCGCTGTGT TCCGTCATCG GCGTGTCCAT CGGCAGCAGC CTGACCACCT
 401 GCGCCACTGT CGGCGTTGCC TTTATGGGGA TGGCGGCGGC GTTTCAGGCC
 451 GATATGGCGA TGACGGCGGG CGCGATTGTT TCGGGCGCAT TTTTTGGCGA
 501 CAAAATGTCC CCGCTTTCGG ATACGACGGG TATTTCCGCG TCCATCGTCG
 551 GCATCGACTT GTTTGAGCAC ATCAAAAATA TGATGTACAC CACCATCCCC
 601 GCGTGGCTCA TTAGTGCGGC ACTGATGCTT TGGCTTTTGC CGAATGTCGC
 651 CGCGCAGGAT TTGAACAGCG TCGAATCCTT CCGCAGCCAG CTTGAAGCCA
 701 CGGGATTGGT GCACGGCTAT TCGCTGATTC CGTTTGCGCT GTTGGTCATT
 751 TTGGCATTGA TGCGCATCAA CGCCGTCGTC GCCATGCTCT TTACCGTCAT
 801 GGTTGCCGTT GCTGTAACGT ATCTGCACAG CACGCCCGAT CTGCGTCAGC
 851 TCGGTGCGTG GTTTTACGGC GGCTACAAAC TCGAAGGCGA AGCGTTTAAA
 901 GATGTTGTCA AACTGATTTC GCGCGGCGGT TTGGAAAGTA TGTTTTTCAC
 951 GCAAACCATC GTGATTCTCG GGATGAGTTT GGGCGGACTG TTGTTTGCGC
1001 TCGGTGTGAT TCCTTCCCTG TTGGAGGCCA TCCGTACCTT CTTGACGAAT
1051 GCCGGACGCG CGACGTTCAG CGTTGCCATG ACTTCGGTCG GGGTTAATTT
1101 CCTGATCGGC GAGCAATATT TGAGTATTTT GTTGTCGGGT GAAACGTTCA
1151 AACCCGTTTA CGATAAGCTC GGTCTGCATT CGCGCAATCT GTCGCGGACG
1201 CTGGAAGATG CGGGGACGGT GATTAACCCG CTCGTACCGT GGAGCGTATG
1251 CGGCGTGTTC ATCAGCCACG CGCTGGGCGT GCCGGTTTGG GAATATCTGC
1301 CGTATGCCTT TTTCTGCTAT TTGAGTTTGG CTTTGACCCT GTTATTCGGT
1351 TGGACGGGGC TGACTTTGAG CAAAAAATAA
```

This corresponds to the amino acid sequence <SEQ ID 2382; ORF 709>:

m709.pep

1 MFAFKSLLDM PRGEALAVVV ALIAAMGYTI ISLEWLPHMS IIAAIVVLIL

51 YGLARGLKYN DMQQGMIGAL NQGMGAIYLF FFIGLMVSAL MMSGAIPTLM

101 YYGFGLISPT YFYFSSFALC SVIGVSIGSS LTTCATVGVA FMGMAAAFQA

151 DMAMTAGAIV SGAFFGDKMS PLSDTTGISA SIVGIDLFEH IKNMMYTTIP

201 AWLISAALML WLLPNVAAQD LNSVESFRSQ LEATGLVHGY SLIPFALLVI

251 LALMRINAVV AMLFTVMVAV AVTYLHSTPD LRQLGAWFYG GYKLEGEAFK

301 DVVKLISRGG LESMFFTQTI VILGMSLGGL LFALGVIPSL LEAIRTFLTN

351 AGRATFSVAM TSVGVNFLIG EQYLSILLSG ETFKPVYDKL GLHSRNLSRT

401 LEDAGTVINP LVPWSVCGVF ISHALGVPVW EYLPYAFFCY LSLALTLLFG

451 WTGLTLSKK* m709/g709 96.9% identity in 459 aa overlap

```
                  10        20        30        40        50        60
m709.pep  MFAFKSLLDMPRGEALAVVVALIAAMGYTIISLEWLPHMSIIAAIVVLILYGLARGLKYN
          ||||||||||||||||||||||||||||||||||||||||||||||||||||||||||||
g709      MFAFKSLLDMPRGEALAVVVALIAAMGYTIISLEWLPHMSIIAAIVVLILYGLARGLKYN
                  10        20        30        40        50        60

                  70        80        90       100       110       120
m709.pep  DMQQGMIGALNQGMGAIYLFFFIGLMVSALMMSGAIPTLMYYGFGLISPTYFYFSSFALC
          ||| ||||||||||||:||||||||||||||||||||||||||||||||||||||:||||
g709      DMQQGMIGALNQGMGAVYLFFFIGLMVSALMMSGAIPTLMYYGFGLISPTYFYFSAFALC
                  70        80        90       100       110       120

                 130       140       150       160       170       180
m709.pep  SVIGVSIGSSLTTCATVGVAFMGMAAAFQADMAMTAGAIVSGAFFGDKMSPLSDTTGISA
          ||||||||||||:|||||||||||||||||||||||||||||:|||||||||||||||||
g709      SVIGVSIGSSLTACATVGVAFMGMAAAFQADMAMTAGAIVSGVFFGDKMSPLSDTTGISA
                 130       140       150       160       170       180

                 190       200       210       220       230       240
m709.pep  SIVGIDLFEHIKNMMYTTIPAWLISAALMLWLLPNVAAQDLNSVESFRSQLEATGLVHGY
          ||||||||||||||||||||||||||||||||||:|||||||||||||||||||||||||
g709      SIVGIDLFEHIKNMMYTTIPAWLISAALMLWLLPSVAAQDLNSVESFRSQLEATGLVHGY
                 190       200       210       220       230       240

                 250       260       270       280       290       300
m709.pep  SLIPFALLVILALMRINAVVAMLFTVMVAVAVTYLHSTPDLRQLGAWFYGGYKLEGEAFK
          |||||||||:|||||:||||||||||::||||||||||||||||||||||||||||||||
g709      SLIPFALLVVLALMRVNAVVAMLFTVIAAVAVTYLHSTPDLRQLGAWFYGGYKLEGEAFK
                 250       260       270       280       290       300

                 310       320       330       340       350       360
m709.pep  DVVKLISRGGLESMFFTQTIVILGMSLGGLLFALGVIPSLLEAIRTFLTNAGRATFSVAM
          |::||||||||||||||||||||||||||||||||||||||||:||||||||||||||||
g709      DIAKLISRGGLESMFFTQTIVILGMSLGGLLFALGVIPSLLEAVRTFLTNAGRATFSVAM
                 310       320       330       340       350       360

                 370       380       390       400       410       420
m709.pep  TSVGVNFLIGEQYLSILLSGETFKPVYDKLGLHSRNLSRTLEDAGTVINPLVPWSVCGVF
          |||||||||||||||||||||||||||||||||| |||||||||||||||||||||||||
g709      TSVGVNFLIGEQYLSILLSGETFKPVYDKLGLHSCNLSRTLEDAGTVINPLVPWSVCGVF
                 370       380       390       400       410       420

                 430       440       450       460
m709.pep  ISHALGVPVWEYLPYAFFCYLSLALTLLFGWTGLTLSKKX
          ||||||||||||||||||||||||||||||||||||||||
g709      ISHALGVPVWEYLPYAFFCYLSLALTLLFGWTGLTLSKKX
                 430       440       450       460
```

The following partial DNA sequence was identified in *N. meningitidis* <SEQ ID 2383>:

a709.seq

1 ATGTTCGCTT TCNAATCCTT ACTCGATATG CCGCGCGGTG AGGCNCTTGC

51 CGTCGTCGTC GCTCTGATTG CCGCGATGGG CTATACCATC ATTTNNTTGG

101 AGTGGCTGCC GCATATGTCC ATTATTGCCG CCATCGTNGT GCTGATTTTG

-continued

```
 151 TACGGCTTGG CGCGCGGTTT GAAATACAAC GATATGCAGC AGGGCATGAT
 201 AGGCGCGTTG AATCAGGGTA TGGGCGCGAT TTACCTNTTT TTCTTCATCG
 251 GGCTGATGGT CAGCGCGCTG ATGATGAGCG GCGCGATTCC GACGCTGATG
 301 TATTACGGTT TCGGACTGAT TTCCCCGACT TATTTTTATT TTTCCGCCTT
 351 CGCGCTGTGT TCCGTCATCG GCGTGTCCAT CGGCAGCAGC CTGACCACCT
 401 GCGCCACTGT CGGCGTTGCC TTNATGGGTA TNNNGNCGGC GTTTCNGGCC
 451 NANATGGNGN NGNNGNNGGN CNNGATTGTN NNGGNCGCAT TNTTNGGCGN
 501 CAAAATGTCN CCGCTTTCCG ATACGNCGGG CATNTCCGCG TCCATTGTCG
 551 GTATCGACCT GTTTGAACAC ATCAAAAATA TGATGTACAC NACCATTCCC
 601 GCGTGGCTCA TCAGTGNNNC ACTGATGCTG TNGCTTCTTC CCAGCGTCGC
 651 CGCGCAGGAT TTGAACAGCG TCGAATCCTT CCGCAGCCAG CTTGAAGCCA
 701 CGGGATTGGT GCACTGCTAT TCGCTGATTC CGTTTGCGCT GTTGGTCGTT
 751 TTGGCATTGA TGCGCGTCAA TGCCGTGGTC GCTATGCTCT TTACCGTCAT
 801 TGCCGCCGTT GCCGTAACGT ATCTGCACAG CACGCCCGAT CTGCGTCAGC
 851 TCGGCGCGTG GTTTTACGGC GGCTACAAAC TCGAAGGCGA AGCGTNTANA
 901 GACATTGCCA AACTCATTTC TCGCGGCGGT TTGGAAAGTA TGTTTTTCAC
 951 GCAGACCATC GTGATTCTTG GGATGAGCCT TGGCGGGCTG CTGTTTGCAC
1001 TGGGCGCGAT TCCTTCCCTG CTGGATGCCG TCCGCAGCTT TTTGACGAAT
1051 GCCGGGCGTN CCACATTCAG CGTTGCCATG ACTTCGGTCG GGGTTAATTT
1101 CCTGATCGGC GAGCAATATT TGAGTATTTT GTTGTCNGGT GAAACGTTCA
1151 AACCTGTTTA CGATAAGCTC GGTCTGCATT CGCGCAATCT GTCGCGGACG
1201 CTGGAAGATG CGGGGACGGT CATCAACCCG CTCGTACCGT GGAGCGTATG
1251 CGGCGTGTTC ATCANCCACG CGCTGGGCGT GCCGGTTTGG GAATATCTGC
1301 CGTATGCCTT TTTCTGCTAT TTGAGTTTGG CTTTGACCCT GTTATTCGGT
1351 TGGACGGGGC TGACTTTGAG CAAAAAATAA
```

This corresponds to the amino acid sequence <SEQ ID 2384; ORF 709.a>:

a709.pep

```
  1 MFAFXSLLDM PRGEALAVVV ALIAAMGYTI IXLEWLPHMS IIAAIVVLIL
 51 YGLARGLKYN DMQQGMIGAL NQGMGAIYLF FFIGLMVSAL MMSGAIPTLM
101 YYGFGLISPT YFYFSAFALC SVIGVSIGSS LTTCATVGVA XMGXXXAFXA
151 XMXXXXXXIV XXAXXGXKMS PLSDTXGXSA SIVGIDLFEH IKNMMYTTIP
201 AWLISXXLML XLLPSVAAQD LNSVESFRSQ LEATGLVHCY SLIPFALLVV
251 LALMRVNAVV AMLFTVIAAV AVTYLHSTPD LRQLGAWFYG GYKLEGEAXX
301 DIAKLISRGG LESMFFTQTI VILGMSLGGL LFALGAIPSL LDAVRSFLTN
351 AGRXTFSVAM TSVGVNFLIG EQYLSILLSG ETFKPVYDKL GLHSRNLSRT
401 LEDAGTVINP LVPWSVCGVF IXHALGVPVW EYLPYAFFCY LSLALTLLFG
451 WTGLTLSKK*
```

a709/m709 91.1% identity in 459 aa overlap

```
                  10        20        30        40        50        60
a709.pep  MFAFXSLLDMPRGEALAVVVALIAAMGYTIIXLEWLPHMSIIAAIVVLILYGLARGLKYN
          |||| |||||||||||||||||||||||||| ||||||||||||||||||||||||||||
m709      MFAFKSLLDMPRGEALAVVVALIAAMGYTIISLEWLPHMSIIAAIVVLILYGLARGLKYN
                  10        20        30        40        50        60

                  70        80        90       100       110       120
a709.pep  DMQQGMIGALNQGMGAIYLFFFIGLMVSALMMSGAIPTLMYYGFGLISPTYFYFSAFALC
          |||||||||||||||||||||||||||||||||||||||||||||||||||||||:||||
m709      DMQQGMIGALNQGMGAIYLFFFIGLMVSALMMSGAIPTLMYYGFGLISPTYFYFSSFALC
                  70        80        90       100       110       120

                 130       140       150       160       170       180
a709.pep  SVIGVSIGSSLTTCATVGVAXMGXXXAFXAXMXXXXXXIVXXAXXGXKMSPLSDTXGXSA
          |||||||||||||||||||| ||   || | |  :   ||  |  | ||||||||:| ||
m709      SVIGVSIGSSLTTCATVGVAFMGMAAAFQADMAMTAGAIVSGAFFGDKMSPLSDTTGISA
                 130       140       150       160       170       180

                 190       200       210       220       230       240
a709.pep  SIVGIDLFEHIKNMMYTTIPAWLISXXLMLXLLPSVAAQDLNSVESFRSQLEATGLVHCY
          |||||||||||||||||||||||||  ||| |||:||||||||||||||||||||||| |
m709      SIVGIDLFEHIKNMMYTTIPAWLISAALMLWLLPNVAAQDLNSVESFRSQLEATGLVHGY
                 190       200       210       220       230       240

                 250       260       270       280       290       300
a709.pep  SLIPFALLVVLALMRVNAVVAMLFTVIAAVAVTYLHSTPDLRQLGAWFYGGYKLEGEAXX
          |||||||||:|||||:||||||||||::||||||||||||||||||||||||||||||
m709      SLIPFALLVILALMRINAVVAMLFTVMVAVAVTYLHSTPDLRQLGAWFYGGYKLEGEAFK
                 250       260       270       280       290       300

                 310       320       330       340       350       360
a709.pep  DIAKLISRGGLESMFFTQTIVILGMSLGGLLFALGAIPSLLDAVRSFLTNAGRXTFSVAM
          |::||||||||||||||||||||||||||||||||:|||||:|:|:||||||| ||||||
m709      DVVKLISRGGLESMFFTQTIVILGMSLGGLLFALGVIPSLLEAIRTFLTNAGRATFSVAM
                 310       320       330       340       350       360

                 370       380       390       400       410       420
a709.pep  TSVGVNFLIGEQYLSILLSGETFKPVYDKLGLHSRNLSRTLEDAGTVINPLVPWSVCGVF
          ||||||||||||||||||||||||||||||||||||||||||||||||||||||||||||
m709      TSVGVNFLIGEQYLSILLSGETFKPVYDKLGLHSRNLSRTLEDAGTVINPLVPWSVCGVF
                 370       380       390       400       410       420

                 430       440       450       460
a709.pep  IXHALGVPVWEYLPYAFFCYLSLALTLLFGWTGLTLSKKX
          | ||||||||||||||||||||||||||||||||||||||
m709      ISHALGVPVWEYLPYAFFCYLSLALTLLFGWTGLTLSKKX
                 430       440       450       460
```

g710.seq not found g710.pep not found

The following partial DNA sequence was identified in *N. meningitidis* <SEQ ID 2385>:

m710.seq

```
  1 ATGGAAACCC ACGAAAAAAT CCGCCTGATG CGCGAATTGA ATAAATGGTC

 51 CCAGGAGGAT ATGGCGGAAA AGCTGGCGAT GTCGGCAGGC GGGTATGCCA

101 AAATCGAACG GGGCGAAACG CAGTTAAATA TCCCGCGTTT GGAGCAGTTG

151 GCTCAGATTT TCAAAATCGA TATGTGGGAC TTGCTCAAAT CGGGCGGTGG

201 TGGGATGGTG TTTCAGATTA ATGAAGGTGA TAGTGGTGGC GATATTGCGT

251 TGTATGCGTC GGGTGATGTT TCGATGAAAA TAGAATTTTT AAAAATGGAG

301 TTGAAACACT GCAAAGAAAT GTTGGAACAA AAAGACAAAG AAATCGAGCT

351 GCTCCGCAAG CTGACCGAAA CCGTTTAA
```

This corresponds to the amino acid sequence <SEQ ID 2386; ORF 710>:

m710.pep

```
  1 METHEKIRLM RELNKWSQED MAEKLAMSAG GYAKIERGET QLNIPRLEQL
 51 AQIFKIDMWD LLKSGGGGMV FQINEGDSGG DIALYASGDV SMKIEFLKME
101 LKHCKEMLEQ KDKEIELLRK LTETV*
```

The following partial DNA sequence was identified in *N. meningitidis* <SEQ ID 2387>:

a710.seq

```
  1 ATGGAAACCC ACGAAAAAAT CCGCCTGATG CGCGAATTGA ATAAATGGTC
 51 CCAGGAGGAT ATGGCGGAAA AGCTGGCGAT GTCGGCAGGC GGGTATGCCA
101 AAATCGAACG AGGCGAAACG CAGTTGAATA TCCCGCGTTT GGAGCAGTTG
151 GCGCAGATTT TCAAAATTGA TATGTGGGAC TTGCTCAAAT CGGGCGGCGG
201 CGGGATGGTG TTGCAGATTA ACGATGTGGA TACCAACAGC GGGGAATTTG
251 CAATCTATAC CGCTCAGGAT GCATCNGGTA AAGCTGGATT TGTTAAAATG
301 GAATTAAAAC ACTGTAAAGA AATGTTGGAA CACAAAGACA AAGAAATCGA
351 GCTGCTCCGC AAGCTGACCG AAACCGTTTA A
```

This corresponds to the amino acid sequence <SEQ ID 2388; ORF 710.a>:

a710.pep

```
  1 METHEKIRLM RELNKWSQED MAEKLAMSAG GYAKIERGET QLNIPRLEQL
 51 AQIFKIDMWD LLKSGGGGMV LQINDVDTNS GEFAIYTAQD ASGKAGFVKM
101 ELKHCKEMLE HKDKEIELLR KLTETV*
```

a710/m710 85.7% identity in 126 aa overlap

```
                    10        20        30        40        50        60
a710.pep    METHEKIRLMRELNKWSQEDMAEKLAMSAGGYAKIERGETQLNIPRLEQLAQIFKIDMWD
            ||||||||||||||||||||||||||||||||||||||||||||||||||||||||||||
m710        METHEKIRLMRELNKWSQEDMAEKLAMSAGGYAKIERGETQLNIPRLEQLAQIFKIDMWD
                    10        20        30        40        50        60

                    70        80        90       100       110       120
a710.pep    LLKSGGGGMVLQINDVDTNSGEFAIYTAQDASGKAGFVKMELKHCKEMLEHKDKEIELLR
            ||||||||||:|||: |:: |::|:|:: |:| |  |:||||||||||||:|||||||||
m710        LLKSGGGGMVFQINEGDSG-GDIALYASGDVSMKIEFLKMELKHCKEMLEQKDKEIELLR
                    70        80        90       100       110

a710.pep    KLTETVX
            |||||||
m710        KLTETVX
          120
```

g711.seq not found g711.pep not found

The following partial DNA sequence was identified in *N. meningitidis* <SEQ ID 2389>:

m711.seq

```
  1 ATGCCCGCGC CTGATTTGGG ATTTGCCTTA AGTCTGCCGC CAAAAAAGGC
 51 AATCGAGTGG CTGGAAAGTA AAAAGGTTAC GGCGGAGAGC TACCGCAATC
```

-continued

```
 101 TGACAGCCTC CGAAATTGCC AAAGTCTATA CGATTGCCCG CATGACCGAC
 151 TTGGATATGC TCAACGACAT CAAAACTTCG ATGGTTGAAT CGGCAAAAAG
 201 TGGACAGTCG TTTGACGATT GGCGAAAAGG TATCTTGAAT CTGCTCAGCA
 251 ACAAGGGCTG GCTGCATCCG AACGGGCATA ACGGTAAGGA TATCATCGAC
 301 CCAGCCACCG GCGAGGTATT CGGTTCGCCG CGGAGGTTGG AGACGATTTA
 351 CCGTACCAAT ATGCAAACTG CCTACAACGC CGGTCAATAT CAAGGATATA
 401 TGGCAAATAT TGATGCACGA CCTTATTGGA TGTATGACGC GGTAGGCGAC
 451 AGCCGCACCC GTCCGGCGCA TTCGGCAATA GACGGGCTGG TGTACCGCTA
 501 CGACGACCCG TTTTGGGCAA CGTTTTACCC GCCCAACGGC TACAACTGCC
 551 GCTGCTCGGT CATCGCGCTG TCGGAGCGGG ATGTGGAACG CCAGGGGCGG
 601 ATTGTTGGGC AAAGCACGGC GGACAATCTG GTCGAGACCC ATAAAATCTA
 651 CAACAAAAAA GGCGATACTT ATCTGACCCT TGCCTATAAA GCACCGGATG
 701 GCAGTCTGTA CACGACCGAT CGAGGATTTG ATTACAACGC CGGACGAATG
 751 AACTACCGCC CCGATTTAGA CAAGTACGAC CGTGCGTTGG CGCATCAATT
 801 TGCCAAAGCG GAAATGGGTG GTGCGGATTT TAAAACCAGC TTTAAACAGC
 851 TTGAAAAAGA GTTTTATGAA GTCAAGCAAC GTTTGGATAT TGATGGCAAG
 901 CCCGATAAAG AGCAGAAAAT CAAAATCCGA AATGCGCTAT CAAGACAGCT
 951 TAAATTTGCT GCGGGTGTAT TGAGCAAGGA AACGCAAGAA TTGGCAGGTA
1001 TGACACGAGC GACGGTGTGG CTGTCTGATG ATACGTTGGT TAAACAGGTA
1051 GACAGCCGTG AGGGGCAGAA TTTCGATGAC TCCTACTATG CTTTTTTGCC
1101 GGATATGCTG CAAAACCCTG AACATGTCAT CCGCGACAAT CGTGAATTGA
1151 TTTTCACAGC TCGCTATAAA GGCTCGGCAT TGTGGGCAGT TTTAAAATAT
1201 ATTAAGGAGG TGGATGAGAT TTATCTACAG TCGTACCGAA TCAGTAACGA
1251 CAAAGAGATT GCCAAATTTA TGGCGAAGAA GAAAGTATTG AAATAG
```

This corresponds to the amino acid sequence <SEQ ID 2390; ORF 711>:

m711.pep

```
  1 MPAPDLGFAL SLPPKKAIEW LESKKVTAES YRNLTASEIA KVYTIARMTD
 51 LDMLNDIKTS MVESAKSGQS FDDWRKGILN LLSNKGWLHP NGHNGKDIID
101 PATGEVFGSP RRLETIYRTN MQTAYNAGQY QGYMANIDAR PYWMYDAVGD
151 SRTRPAHSAI DGLVYRYDDP FWATFYPPNG YNCRCSVIAL SERDVERQGR
201 IVGQSTADNL VETHKIYNKK GDTYLTLAYK APDGSLYTTD RGFDYNAGRM
251 NYRPDLDKYD RALAHQFAKA EMGGADFKTS FKQLEKEFYE VKQRLDIDGK
301 PDKEQKIKIR NALSRQLKFA AGVLSKETQE LAGMTRATVW LSDDTLVKQV
351 DSREGQNFDD SYYAFLPDML QNPEHVIRDN RELIFTARYK GSALWAVLKY
401 IKEVDEIYLQ SYRISNDKEI AKFMAKKKVL K*
```

The following partial DNA sequence was identified in *N. meningitidis* <SEQ ID 2391>:

a711.seq

```
   1 ATGCCCGCGC CTGATTTGGG ATTTGCCTTA AGTCTGCCGC CAAAAAAGGC
  51 AATCGAGTGG CTGGAAAGTA AAAAGGTTAC GGCGGAGAGC TACCGCAATC
 101 TGACAGCCTC CGAAATTGCC AAAGTCTATA CGATTGCCCG CATGACCGAC
 151 TTGGATATGC TCAACGACAT CAAAACTTCG ATGGTTGAAT CGGCAAAAAG
 201 TGGACAGTCG TTTGACGATT GGCGAAAAGG TATCTTGAAT CTGCTCAGCA
 251 ACAAGGGCTG GCTGCATCCG AACGGGCATA ACGGTAAGGA TATCATCGAC
 301 CCAGCCACCG GCGAGGTATT CGGTTCGCCG CGGAGGTTGG AGACGATTTA
 351 CCGTACCAAC ATGCAAACTG CCTACAACGC CGGTCAATAT CAAGGATATA
 401 TGGCAAATAT TGATGCACGA CCTTATTGGA TGTATGACGC GGTAGGCGAC
 451 AGCCGCACCC GTCCGGCGCA TTCGGCAATA GACGGGCTGG TGTACCGCTA
 501 CGACGACCCG TTTTGGGCAA CGTTTTACCC GCCCAACGGC TACAACTGCC
 551 GTTGCTCGGT CATCGCGCTG TCGGAGCGGG ATGTGGAACG CCAGGGGCGG
 601 ATTGTCGGGC AAAGCACGTC GGACAATCTT GTTGAGACCC ATAAAATCTA
 651 CAACAAAAAA GGCGATACTT ATCTGACCCT TGCCTATAAA GCACCGGATG
 701 GCAGTCTGTA CACGACCGAT CGAGGATTTG ATTACAACGC CGGACGAATG
 751 AACTACCGCC CCGATTTAGA CAAGTACGAC CGTGCGTTGG CGCATCAATT
 801 TGCCAAAGCG GAAATGGGTG GTGCGGATTT TAAAACCAGC TTTAAACAGC
 851 TTGAAAAAGA GTTTTATGAA GTCAAGCAAC GTTTGGATAT TGATGGCAAG
 901 CCCGATAAAG AGCAGAAAAT CAAAATCCGA AATGCGCTAT CAAGACAGCT
 951 TAAATTTGCT GCGGGTGTAT TGAGCAAGGA AACGCAAGAA TTGGCAGGTA
1001 TGACACGAGC GACGGTGTGG CTGTCTGATG ATACGTTGGT TAAACAGGTA
1051 GACAGCCGTG AAGGGCAGAA TTTCGATGAC TCCTACTATG CTTTTTTGCC
1101 GGATATGCTG CAAAACCCTG AACATGTCAT CCGCGACAAT CGTGAATTGA
1151 TTTTCACAGC TCGCTATAAA GGCTCGGCAT TGTGGGCAGT TTTAAAATAT
1201 ATTAAGGAGG TGGATGAGAT TTATCTACAG TCGTACCGAA TCAGTAACGA
1251 CAAAGAGATT GCCAAATTTA TGGCGAAGAA GAAAGTATTG AAATAG
```

This corresponds to the amino acid sequence <SEQ ID 2392; ORF 711.a>:

a711.pep

```
   1 MPAPDLGFAL SLPPKKAIEW LESKKVTAES YRNLTASEIA KVYTIARMTD
  51 LDMLNDIKTS MVESAKSGQS FDDWRKGILN LLSNKGWLHP NGHNGKDIID
 101 PATGEVFGSP RRLETIYRTN MQTAYNAGQY QGYMANIDAR PYWMYDAVGD
 151 SRTRPAHSAI DGLVYRYDDP FWATFYPPNG YNCRCSVIAL SERDVERQGR
 201 IVGQSTSDNL VETHKIYNKK GDTYLTLAYK APDGSLYTTD RGFDYNAGRM
 251 NYRPDLDKYD RALAHQFAKA EMGGADFKTS FKQLEKEFYE VKQRLDIDGK
 301 PDKEQKIKIR NALSRQLKFA AGVLSKETQE LAGMTRATVW LSDDTLVKQV
 351 DSREGQNFDD SYYAFLPDML QNPEHVIRDN RELIFTARYK GSALWAVLKY
 401 IKEVDEIYLQ SYRISNDKEI AKFMAKKKVL K*
```

a711/m711 99.8% identity in 431 aa overlap

```
                    10        20        30        40        50        60
a711.pep    MPAPDLGFALSLPPKKAIEWLESKKVTAESYRNLTASEIAKVYTIARMTDLDMLNDIKTS
            ||||||||||||||||||||||||||||||||||||||||||||||||||||||||||||
m711        MPAPDLGFALSLPPKKAIEWLESKKVTAESYRNLTASEIAKVYTIARMTDLDMLNDIKTS
                    10        20        30        40        50        60
                    70        80        90       100       110       120
a711.pep    MVESAKSGQSFDDWRKGILNLLSNKGWLHPNGHNGKDIIDPATGEVFGSPRRLETIYRTN
            ||||||||||||||||||||||||||||||||||||||||||||||||||||||||||||
m711        MVESAKSGQSFDDWRKGILNLLSNKGWLHPNGHNGKDIIDPATGEVFGSPRRLETIYRTN
                    70        80        90       100       110       120
                   130       140       150       160       170       180
a711.pep    MQTAYNAGQYQGYMANIDARPYWMYDAVGDSRTRPAHSAIDGLVYRYDDPFWATFYPPNG
            ||||||||||||||||||||||||||||||||||||||||||||||||||||||||||||
m711        MQTAYNAGQYQGYMANIDARPYWMYDAVGDSRTRPAHSAIDGLVYRYDDPFWATFYPPNG
                   130       140       150       160       170       180
                   190       200       210       220       230       240
a711.pep    YNCRCSVIALSERDVERQGRIVGQSTSDNLVETHKIYNKKGDTYLTLAYKAPDGSLYTTD
            |||||||||||||||||||||||||:||||||||||||||||||||||||||||||||||
m711        YNCRCSVIALSERDVERQGRIVGQSTADNLVETHKIYNKKGDTYLTLAYKAPDGSLYTTD
                   190       200       210       220       230       240
                   250       260       270       280       290       300
a711.pep    RGFDYNAGRMNYRPDLDKYDRALAHQFAKAEMGGADFKTSFKQLEKEFYEVKQRLDIDGK
            ||||||||||||||||||||||||||||||||||||||||||||||||||||||||||||
m711        RGFDYNAGRMNYRPDLDKYDRALAHQFAKAEMGGADFKTSFKQLEKEFYEVKQRLDIDGK
                   250       260       270       280       290       300
                   310       320       330       340       350       360
a711.pep    PDKEQKIKIRNALSRQLKFAAGVLSKETQELAGMTRATVWLSDDTLVKQVDSREGQNFDD
            ||||||||||||||||||||||||||||||||||||||||||||||||||||||||||||
m711        PDKEQKIKIRNALSRQLKFAAGVLSKETQELAGMTRATVWLSDDTLVKQVDSREGQNFDD
                   310       320       330       340       350       360
                   370       380       390       400       410       420
a711.pep    SYYAFLPDMLQNPEHVIRDNRELIFTARYKGSALWAVLKYIKEVDEIYLQSYRISNDKEI
            ||||||||||||||||||||||||||||||||||||||||||||||||||||||||||||
m711        SYYAFLPDMLQNPEHVIRDNRELIFTARYKGSALWAVLKYIKEVDEIYLQSYRISNDKEI
                   370       380       390       400       410       420
                   430
a711.pep    AKFMAKKKVLKX
            ||||||||||||
m711        AKFMAKKKVLKX
                   430
```

g712.seq not found yet g712.pep not found yet

The following partial DNA sequence was identified in *N. meningitidis* <SEQ ID 2393>:

m712.seq

```
  1 ATGATGCCCC ATATTGATTT TGACACGATT CCGGGCAGCA TCCGCGTGCC
 51 CGGGCAGTAT ATTGAATTTA ACACCCGCAA TGCCGTACAA GGTTTGCCGC
101 AAAATCCGCA AAAGGTATTG ATGGTTGCAC CCATGCTGAC CGCGGGCATA
151 CAGCCCGCCT TAGAGCCGGT GCAACTATTT AGCGATGCCG AGGCGGCCGA
201 TTTGTTCGGA CAAGGCTCGC TGGCGCATTT GATGGTGCGC CAAGCATTTG
251 CCAACAACCC TTATTTGGAT TTGACCGTTA TCGGTATTGC CGACCACAGC
301 GCAGGCGTGC AGGCAACCGC AACCGTTACC CTTTCCGGCA CGGCCACCGC
351 GCCGGGCGTG GTGGAAATCA CGATTGGCGG CAAGCAGGTA AGCACGGCCG
401 TTAACACCGG CGAGACCGCC GCCACAGTGG CAGACCGTCT GAAAACCGCC
451 ATCACTGCCG CCGATGTAAC CGTTACCGCA TCCGGCAGCG GCGCAGCCGT
501 TACGCTGACG GCCAAACACA AAGGCGAGAT CGGCAACGAG AGCGGCTTAA
551 CCGTGAGCAC CGGCAATACC GGCCTAACTT ATCAAGCCAA TGCCTTTACC
601 GGCGGTGCCA AAAATGCGGA CATTGCCACG GCCTTGTCCA AAGTGGCGGG
```

-continued

```
 651 CAAGCATTAT CACATTATTT GCAGCCCGTT TAGCGATGAC GCCAACGCCA

 701 AAGCCTTGAG CAACCATATT ACCAACGTAT CCAACGCCAT CGAGCAGCGC

 751 GGCTGTATCG GCGTATTGGG TATGAGTGCG GCCTTGAGCA CGGCCACCAC

 801 CGCTACCGGC GAAATCAACG ACGGCCGCAT GACCTGTGCT TGGTACAAAG

 851 GTGCGGTAGA GCCAAACGGC ATCATCGCCG CAGGTTATGC GGCGGTGTTG

 901 GCCTTTGAAG AAGACCCTGC CAAGCCGCTG AACACGCTGG AAATCAAAGG

 951 GCTGGCCGTT ACACCTGATG CGCAATGGCC GCTGTTTGCA GAATGCAACA

1001 ATGCGCTGTA CAACGGCTTG ACCCCGCTCA CAGTGGTCAA CAACCGCGTG

1051 CAGATTATGC GTGCCGTATC CACCTATACC AAGTCGGCCA ACAACACCGA

1101 CGACCCGGCA CTACTCGACA TTACCACCAT CCGCACGCTG GATTATGTGC

1151 GCCGCAGCGT TAAAGAGCGC ATTGCCCTGC GTTTTCCGCG CGACAAATTG

1201 AGCGACCGCC TGCTGCCCAA GGTTAAGAGC GAGATTTTGG ACGTGCTGAT

1251 TAAGCTCGAC CAAGCCGAAA TCATCGAAAA CGCCGAGGCC AACAAAGGCA

1301 AGCTGGTGGT GGCGCGTGCG CAAAACGACC CCAACCGTGT TAATGCCATT

1351 ATCCCCGCCG ATGTGGTCAA CGGCCTGCAC GTCTTTGCCG GGCGCATTGA

1401 TTTGATTTTG TAA
```

This corresponds to the amino acid sequence <SEQ ID 2394; ORF 712>:

m712.pep

```
  1 MMPHIDFDTI PGSIRVPGQY IEFNTRNAVQ GLPQNPQKVL MVAPMLTAGI

 51 QPALEPVQLF SDAEAADLFG QGSLAHLMVR QAFANNPYLD LTVIGIADHS

101 AGVQATATVT LSGTATAPGV VEITIGGKQV STAVNTGETA ATVADRLKTA

151 ITAADVTVTA SGSGAAVTLT AKHKGEIGNE SGLTVSTGNT GLTYQANAFT

201 GGAKNADIAT ALSKVAGKHY HIICSPFSDD ANAKALSNHI TNVSNAIEQR

251 GCIGVLGMSA ALSTATTATG EINDGRMTCA WYKGAVEPNG IIAAGYAAVL

301 AFEEDPAKPL NTLEIKGLAV TPDAQWPLFA ECNNALYNGL TPLTVVNNRV

351 QIMRAVSTYT KSANNTDDPA LLDITTIRTL DYVRRSVKER IALRFPRDKL

401 SDRLLPKVKS EILDVLIKLD QAEIIENAEA NKGKLVVARA QNDPNRVNAI

451 IPADVVNGLH VFAGRIDLIL *
```

a712.seq not found yet
a712.pep not found yet
g713.seq not found yet
g713.pep not found yet The following partial DNA sequence was identified in *N. meningitidis* <SEQ ID 2395>:

m713.seq

```
  1 ATGCAAAATA ATTCATACGG CTATGCCGTG TCGGTGCGCG TGGGCGGTAA

 51 AGAGCACCGC CACTGGGAGC GCTACGACAT CGACAGCGAC TTTTTAATCC

101 CTGCCGACAG CTTCGATTTT GTCATCGGCA GGTTGGGACC GGAGGCGGCC
```

-continued

151 ATACCCGATT TAAGCGGAGA GAGCTGCGAG GTAGTGATAG ACGGGCAAAT

201 CGTGATGACG GGCATCATCG GCAGCCAGCG CCACGGCAAA AGCAAGGGCA

251 GCCGCGAGTT GAGCTTGAGC GGGCGTGATT TGGCCGGTTT TTTGGTGGAT

301 TGCTCCGCGC CGCAGCTCAA TGTAAAGGGC ATGACGGTAT TGGATGCAGC

351 CAAAAAGCTG GCCGCGCCGT GGCCGCAGAT TAAAGCGGTG GTGCTTAAGG

401 CCGAAAACAA CCCCGCTTTG GGCAAAATCG ACATCGAGCC GGGCGAAACC

451 GTATGGCAGG CATTAACCCA TATTGCCAAC TCGGTCGGGC TGCATCCGTG

501 GCTGGAGCCG GACGGCACGT TGGTGGTGGG CGGTGCGGAT TACAGCAGCC

551 CGCCGGTGGC GACATTGTGT TGGAGCCGCA CCGACAGCCG CTGCAATATC

601 GAGCGCATGG ACATTGAGTG GGATACCGAC AACCGCTTTT CCGAGGTTAC

651 TTTTTTGGCG CAATCGCACG GCCGCAGCGG CGACAGCGCC AAACACGATT

701 TAAAGTGGGT GTACAAAGAC CCGACGATGA CGCTGCACCG CCCTAAAACG

751 GTGGTGGTGT CCGATGCCGA CAATTTGGCC GCATTGCAAA AGCAGGCTAA

801 AAAGCAGCTG GCCGACTGGC GGCTGGAGGG ATTTACACTC ACGATAACCG

851 TGGGCGGCCA TAAAACCCGC GACGGCGTAT TGTGGCAACC TGGCCTGCGT

901 GTGCATGTGA TCGACGACGA GCACGGTATC GATGCGGTGT TTTTTCTGAT

951 GGGGCGGCGG TTTATGCTAT CCCGCATGGA TGGTACGCAA ACCGAGCTGC

1001 GGCTCAAAGA GGACGGTATT TGGACACCCG ACGCTTACCC CAAAAAGGCC

1051 GAGGCGGCGC GCAAGCGCAA AGGCAAACGC AAAGGCGTGA GCCATAAGGG

1101 CAAAAAAGGC GGCAAAAAAC AAGCAGAAAC GGCGGTGTTT GAATGA

This corresponds to the amino acid sequence <SEQ ID 2396; ORF 713>:

m713.pep

1 MQNNSYGYAV SVRVGGKEHR HWERYDIDSD FLIPADSFDF VIGRLGPEAA

51 IPDLSGESCE VVIDGQIVMT GIIGSQRHGK SKGSRELSLS GRDLAGFLVD

101 CSAPQLNVKG MTVLDAAKKL AAPWPQIKAV VLKAENNPAL GKIDIEPGET

151 VWQALTHIAN SVGLHPWLEP DGTLVVGGAD YSSPPVATLC WSRTDSRCNI

201 ERMDIEWDTD NRFSEVTFLA QSHGRSGDSA KHDLKWVYKD PTMTLHRPKT

251 VVVSDADNLA ALQKQAKKQL ADWRLEGFTL TITVGGHKTR DGVLWQPGLR

301 VHVIDDEHGI DAVFFLMGRR FMLSRMDGTQ TELRLKEDGI WTPDAYPKKA

351 EAARKRKGKR KGVSHKGKKG GKKQAETAVF E*

The following partial DNA sequence was identified in *N. meningitidis* <SEQ ID 2397>:

a713.seq

1 ATGCAAAATA ATTCATACGG CTATGCCGTG TCGGTGCGCG TGGGCGGTAA

51 AGAGCACCGC CACTGGGAGC GCTACGACAT CGACAGCGAC TTTTTAATCC

101 CTGCCGACAG CTTCGATTTT GTCATCGGCA GGTTGGGGCC GGAGGCGGCC

-continued

```
 151 ATACCCGATT TAAGCGGAGA GAGCTGCGAG GTAGTGATAG ACGGGCAAAT

 201 CGTGATGACG GGCATCATCG GCAGCCAGCG CCACGGCAAA AGCAAGGGCG

 251 GCCGCGAGTT GAGCTTGAGC GGGCGTGATT TGGCCGGTTT TTTGGTGGAT

 301 TGCTCCGCGC CGCAGCTCAA TGTAAAGGGC ATGACGGTAT TGGATGCAGC

 351 CAAAAAGCTG GCCGCGCCGT GGCCGCAGAT TAAAGCGGTG GTGCTTAAGG

 401 TCGAAAACAA CCCCGCTTTG GACAAAATCG ACATCGAGCC GGGCGAAACC

 451 GTATGGCAGG CATTAACCCA TATTGCCAAC TCGGTCGGGC TGCATCCGTG

 501 GCTGGAGCCG GACGGCACGT TGGTGGTGGG CGGTGTGGAT TACAGCAGCC

 551 CGCCGGTGGC GACATTGTGT TGGAGCCGCA CCGACAGCCG CCGCAATATC

 601 GAGCGCATGG ACATTGAGTG GGATACCGAC AACCGCTTTT CTGAGGTTAC

 651 TTTTTTGGCG CAATCGCACG GCCGCAGCGG CGACAGCGCC AAACACGATT

 701 TAAAGTGGGT GTACAAAGAC CCGACGATGA CGCTGCACCG CCCTAAAACG

 751 GTGGTGGTGT CCGATGCCGA CAATTTGGCC GCATTGCAAA AGCAGGCTAA

 801 AAAGCAGCTG GCCGACTGGC GGCTGGAGGG ATTTACACTC ACGATAACCG

 851 TGGGCGGCCA TAAAACCCGC GACGGCGTAT TGTGGCAACC TGGCCAGCGT

 901 GTGCATGTGA TCGACGACGA GCACGGTATC GATGCGGTGT TTTTTCTGAT

 951 GGGGCGGCGG TTTATGCTAT CTCGCATGGA TGGCACGCAA ACCGAGCTGC

1001 GGCTCAAAGA GGACGGTATT TGGACACCCG ACGCTTACCC CAAAAAGGCC

1051 GAGGCGGCGC GCAAGCGCAA AGGCAAACGC AAAGGCGTGA GCCATAAGGG

1101 CAAAAAAGGC GGCAAAAAAC AAGCAGAAAC GGCGGTGTTT GAATGA
```

This corresponds to the amino acid sequence <SEQ ID 2398; ORF 713.a>:

a713.pep

```
  1 MQNNSYGYAV SVRVGGKEHR HWERYDIDSD FLIPADSFDF VIGRLGPEAA

 51 IPDLSGESCE VVIDGQIVMT GIIGSQRHGK SKGGRELSLS GRDLAGFLVD

101 CSAPQLNVKG MTVLDAAKKL AAPWPQIKAV VLKVENNPAL DKIDIEPGET

151 VWQALTHIAN SVGLHPWLEP DGTLVVGGVD YSSPPVATLC WSRTDSRRNI

201 ERMDIEWDTD NRFSEVTFLA QSHGRSGDSA KHDLKWVYKD PTMTLHRPKT

251 VVVSDADNLA ALQKQAKKQL ADWRLEGFTL TITVGGHKTR DGVLWQPGQR

301 VHVIDDEHGI DAVFFLMGRR FMLSRMDGTQ TELRLKEDGI WTPDAYPKKA

351 EAARKRKGKR KGVSHKGKKG GKKQAETAVF E*
```

a713/m713 98.4% identity in 381 aa overlap

```
                    10        20        30        40        50        60
a713.pep    MQNNSYGYAVSVRVGGKEHRHWERYDIDSDFLIPADSFDFVIGRLGPEAAIPDLSGESCE
            ||||||||||||||||||||||||||||||||||||||||||||||||||||||||||||
m713        MQNNSYGYAVSVRVGGKEHRHWERYDIDSDFLIPADSFDFVIGRLGPEAAIPDLSGESCE
                    10        20        30        40        50        60

                    70        80        90       100       110       120
a713.pep    VVIDGQIVMTGIIGSQRHGKSKGGRELSLSGRDLAGFLVDCSAPQLNVKGMTVLDAAKKL
            ||||||||||||||||||||||||:|||||||||||||||||||||||||||||||||||
m713        VVIDGQIVMTGIIGSQRHGKSKGSRELSLSGRDLAGFLVDCSAPQLNVKGMTVLDAAKKL
                    70        80        90       100       110       120
```

-continued

```
              130        140        150        160        170        180
a713.pep  AAPWPQIKAVVLKVENNPALDKIDIEPGETVWQALTHIANSVGLHPWLEPDGTLVVGGVD
          ||||||||||||:|||||| |||||||||||||||||||||||||||||||||||||:|
m713      AAPWPQIKAVVLKAENNPALGKIDIEPGETVWQALTHIANSVGLHPWLEPDGTLVVGGAD
              130        140        150        160        170        180

              190        200        210        220        230        240
a713.pep  YSSPPVATLCWSRTDSRRNIERMDIEWDTDNRFSEVTFLAQSHGRSGDSAKHDLKWVYKD
          |||||||||||||||| |||||||||||||||||||||||||||||||||||||||||||
m713      YSSPPVATLCWSRTDSRCNIERMDIEWDTDNRFSEVTFLAQSHGRSGDSAKHDLKWVYKD
              190        200        210        220        230        240

              250        260        270        280        290        300
a713.pep  PTMTLHRPKTVVVSDADNLAALQKQAKKQLADWRLEGFTLTITVGGHKTRDGVLWQPGQR
          |||||||||||||||||||||||||||||||||||||||||||||||||||||||||| |
m713      PTMTLHRPKTVVVSDADNLAALQKQAKKQLADWRLEGFTLTITVGGHKTRDGVLWQPGLR
              250        260        270        280        290        300

              310        320        330        340        350        360
a713.pep  VHVIDDEHGIDAVFFLMGRREMLSRMDGTQTELRLKEDGIWTPDAYPKKAEAARKRKGKR
          ||||||||||||||||||||||||||||||||||||||||||||||||||||||||||||
m713      VHVIDDEHGIDAVFFLMGRRFMLSRMDGTQTELRLKEDGIWTPDAYPKKAEAARKRKGKR
              310        320        330        340        350        360

              370        380
a713.pep  KGVSHKGKKGGKKQAETAVFEX
          ||||||||||||||||||||||
m713      KGVSHKGKKGGKKQAETAVFEX
              370        380
```

g714.seq not found yet g714.pep not found yet

The following partial DNA sequence was identified in *N. meningitidis* <SEQ ID 2399>:

m714.seq

```
  1 ATGAGCTATC AAGACATCTT GCGGGGCCTG TTGCCCCCCG TGTCGTATGC
 51 CCGCAATGCC CCGCGTGTGC GGGCGCAGGC AGAAATAGAC GGCGCAGCGC
101 TGGATGCGGT GGCGGAATCG GCTCAAAGCG TTGCCGATGC CGTCGACCCG
151 CGCAGCGCCG GCCAAATGCT GGCCGATTGG GAGCGCGTAT TAGGTTTGGA
201 CGGTACGGGC AAAAACCGCC AGCACCGTGT GTTGGCCGTC ATGGCCAAGC
251 TAAACGAAAC AGGCGGCTTG AGTATTCCTT ATTTTGTGCG TTTGGCCGAG
301 GCGGCGGGCT ATCAAATCCA AATCGACGAA CCGCAGCCGT TCCGCGCCGG
351 TGTAAACCGC GCCGGCGACC GTCTTGCGCC GCAGGAAATC ATGTGGGTGT
401 GGCACGTTAA CGTGCGCGGC GGCAACAACC GCATTACCCG ATTCCGCGCC
451 GGTATCTCGG CGGCGGGCGA CAGGCTGACC GATTACAGCG ATGCCGTGAT
501 CGAGAGCCTG TTCAACCGCC TCAAGCCCGC CCACACCGCT ATCCGATTTA
551 CCTACCGCTA A
```

This corresponds to the amino acid sequence <SEQ ID 2400; ORF 714>:

m714.pep

```
  1 MSYQDILRGL LPPVSYARNA PRVRAQAEID GAALDAVAES AQSVADAVDP
 51 RSAGQMLADW ERVLGLDGTG KNRQHRVLAV MAKLNETGGL SIPYFVRLAE
101 AAGYQIQIDE PQPFRAGVNR AGDRLAPQEI MWVWHVNVRG GNNRITRFRA
151 GISAAGDRLT DYSDAVIESL FNRLKPAHTA IRFTYR*
```

The following partial DNA sequence was identified in *N. meningitidis* <SEQ ID 2401>:

a714.seq

```
  1 ATGAGCTATC AAGACATCTT GCGGGGTCTG TTGCCCCCCG TGTCGTATGC
 51 CCGCAATGCC CCGCGTGTGC GGGCGCAGGC AGAAATAGAC GGCGCAGCGC
101 TGGATGCGGT GGCGGAATCG GCTCAAAGCG TTGCCGATGC CGTCGACCCG
151 AGCAGCGCCG GCCAAATGCT GGCCGATTGG GAGCGCGTAT TAGGTTTGGA
201 CGGTACGGGC AAAAACCGCC AGCGCCGTGT GTTGGCCGTC ATGGCCAAGC
251 TAAACGAAAC AGGCGGCTTG AGTATTCCTT ATTTTGTGCG TTTGGCCGAG
301 GCGGCGGGCT ATCAAATCCA AATCGACGAA CCGCAGCCGT TCCGCGCCGG
351 TGTAAACCGC GCCGGCGACC GTCTTGCGCC GCAGGAAATC ATGTGGGTGT
401 GGCACGTTAA CGTGCGCGGC GGCAACAACC GCATTACCCG ATTCCGCGCC
451 GGTATCTCGG CGGCGGGCGA CAGGCTGACC GATTACAGCG ATGCCGTGAT
501 CGAGAGCCTG TTCAACCGCC TCAAGCCCGC CCACACCGCT ATCCGATTTA
551 CCTACCGATA A
```

This corresponds to the amino acid sequence <SEQ ID 2402; ORF 714.a>:

a714.pep

```
  1 MSYQDILRGL LPPVSYARNA PRVRAQAEID GAALDAVAES AQSVADAVDP
 51 SSAGQMLADW ERVLGLDGTG KNRQRRVLAV MAKLNETGGL SIPYFVRLAE
101 AAGYQIQIDE PQPFRAGVNR AGDRLAPQEI MWVWHVNVRG GNNRITRFRA
151 GISAAGDRLT DYSDAVIESL FNRLKPAHTA IRFTYR*
```

a714/m714 98.9% identity in 186 aa overlap

```
                   10        20        30        40        50        60
a714.pep   MSYQDILRGLLPPVSYARNAPRVRAQAEIDGAALDAVAESAQSVADAVDPSSAGQMLADW
           |||||||||||||||||||||||||||||||||||||||||||||||||| |||||||||
m714       MSYQDILRGLLPPVSYARNAPRVRAQAEIDGAALDAVAESAQSVADAVDPRSAGQMLADW
                   10        20        30        40        50        60
                   70        80        90       100       110       120
a714.pep   ERVLGLDGTGKNRQRRVLAVMAKLNETGGLSIPYFVRLAEAAGYQIQIDEPQPFRAGVNR
           ||||||||||||||:|||||||||||||||||||||||||||||||||||||||||||||
m714       ERVLGLDGTGKNRQHRVLAVMAKLNETGGLSIPYFVRLAEAAGYQIQIDEPQPFRAGVNR
                   70        80        90       100       110       120
                  130       140       150       160       170       180
a714.pep   AGDRLAPQEIMWVWHVNVRGGNNRITRFRAGISAAGDRLTDYSDAVIESLFNRLKPAHTA
           ||||||||||||||||||||||||||||||||||||||||||||||||||||||||||||
m714       AGDRLAPQEIMWVWHVNVRGGNNRITRFRAGISAAGDRLTDYSDAVIESLFNRLKPAHTA
                  130       140       150       160       170       180

a714.pep   IRFTYRX
           |||||||
m714       IRFTYRX
```

g715.seq not found yet g715.pep not found yet

The following partial DNA sequence was identified in *N. meningitidis* <SEQ ID 2403>:

m715.seq

```
  1 ATGATTGATG TCAAAATAGA CAATATCTTT GTCGTCCTAA ACCAAATCGA
 51 GCGGCTTGGC AACGGGATCG AAAACCGCTA CCTGCTGATG CGCCGACTGT
101 CCGAAACCAT GCACACGGCG GTCAAGCTCA ATTTCCGCTA CGCAGGCCGT
151 CCGAAATGGG TTGGGCTAAA ATACCGCGAC GGCAAGCCGC TTTCGGATTC
201 GGGTCGTCTG AAAGACAGTT TTTCCACACT GTCAGACAAC GATACAGCCC
251 TTGTCGGTAC GAATATCGTC TATGCCGCCA TCCACAACTT CGGCGGTATG
301 GCGGGGCGCA ACCGCAAAGT TCGGATTCCG CAACGGGAAT TTTTGACGCT
351 GACGGACGAC GACAAACAGG CTTTGATGGA CGATGTGCAG GATTATTTTT
401 CGGGTCTGAT ACCGTGA
```

This corresponds to the amino acid sequence <SEQ ID 2404; ORF 715>:

m715.pep

```
  1 MIDVKIDNIF VVLNQIERLG NGIENRYLLM RRLSETMHTA VKLNFRYAGR
 51 PKWVGLKYRD GKPLSDSGRL KDSFSTLSDN DTALVGTNIV YAAIHNFGGM
101 AGRNRKVRIP QREFLTLTDD DKQALMDDVQ DYFSGLIP*
```

The following partial DNA sequence was identified in *N. meningitidis* <SEQ ID 2405>:

a715.seq

```
  1 ATGATTGATG TCAAAATAGA CAATATCTTT GTCGTCCTAA ACCAAATCGA
 51 GCGGCTTGGC AACGGGATCG AAAACCGCTA CCTGCTGATG CGCCGACTGT
101 CCGAAACCAT GCACACGGCG GTCAAGCTCA ATTTCCGCTA CGCAGGCCGT
151 CCGAAATGGT TGGGGCTAAA ATACCGCGAC GGCAAGCCGC TTTCGGATTC
201 GGGTCGTCTG AAAGACAGTT TTTCCACACT GTCAGACAAC GATACAGCCC
251 TTGTCGGTAC GAATATCGTC TATGCCGCCA TCCACAACTT CGGCGGTATG
301 GCGGGGCGCA ACCGCAAAGT TCGGATTCCG CAACGGGAAT TTTTGACGCT
351 GACGGACGAC GACAAACAGG CTTTGATGGA CGATGTGCAG GATTATTTTT
451 CGGGTCTGAT ACCGTGA
```

This corresponds to the amino acid sequence <SEQ ID 2406; ORF 715.a> a715.pep

```
  1 MIDVKIDNIF VVLNQIERLG NGIENRYLLM RRLSETMHTA VKLNFRYAGR
 51 PKWLGLKYRD GKPLSDSGRL KDSFSTLSDN DTALVGTNIV YAAIHNFGGM
101 AGRNRKVRIP QREFLTLTDD DKQALMDDVQ DYFSGLIP*
```

The following partial DNA sequence was identified in *N. gonorrhoeae* <SEQ ID 2407>:

g716.seq

```
  1 ATGAACAAAA ATATTGCTGC CGCACTCGCC GGTGCTTTAT CCCTGTCTCT
 51 GGCCGCCGGC GCCGTTGCCG CCCACAAACC GGCAAGCAAC GCAACAGGCG
101 TTCAAAAATC CGCCCAAGGC TCTTGCGGCG CATCCAAATC TGCCGAAGGT
151 TCGTGCGGCG CATCCAAATC TGCCGAAGGT TCGTGCGGCG CGGCTGCTTC
201 TAAAGCAGGC GAAGGCAAAT GCGGCGAGGG CAAATGCGGT GCAACTGTAA
251 AAAAAGCCCA CAAACACACC AAAGCATCTA AAGCCAAAGC CAAATCTGCC
301 GAAGGCAAAT GCGGCGAAGG CAAATGCGGT TCTAAATAA
```

This corresponds to the amino acid sequence <SEQ ID 2408; ORF 716.ng>:

g716.pep

```
  1 MNKNIAAALA GALSLSLAAG AVAAHKPASN ATGVQKSAQG SCGASKSAEG
 51 SCGASKSAEG SCGAAASKAG EGKCGEGKCG ATVKKAHKHT KASKAKAKSA
101 EGKCGEGKCG SK*
```

The following partial DNA sequence was identified in *N. meningitidis* <SEQ ID 2409>:

m716.seq

```
  1 ATGAACAAAA ACATTGCTGC CGCTCTCGCC GGTGCTTTAT CCCTGTCTTT
 51 GGCCGCCGGT GCAGTTGCTG CCAACAAACC GGCAAGCAAC GCAACAGGCG
101 TTCATAAATC CGCCCATGGC TCTTGCGGCG CGTCCAAATC TGCCGAAGGT
151 TCGTGCGGCG CGGCTGGTTC TAAAGCAGGC GAAGGCAAAT GCGGCGAGGG
201 CAAATGCGGT GCGACCGTAA AAAAAACCCA CAAACACACC AAAGCATCTA
251 AAGCCAAGGC CAAATCTGCC GAAGGCAAAT GCGGCGAAGG CAAATGCGGT
301 TCTAAATAA
```

This corresponds to the amino acid sequence <SEQ ID 2410; ORF 716>:

m716.pep

```
  1 MNKNIAAALA GALSLSLAAG AVAANKPASN ATGVHKSAHG SCGASKSAEG
 51 SCGAAGSKAG EGKCGEGKCG ATVKKTHKHT KASKAKAKSA EGKCGEGKCG
101 SK*
```

m716/g716 86.6% identity in 112 aa overlap

```
                   10        20        30        40        50        60
m716.pep   MNKNIAAALAGALSLSLAAGAVAANKPASNATGVHKSAHGSCGASKSAEGSCGA------
           ||||||||||||||||||||||||:|||||||||:|||:||||||||||||||
g716       MNKNIAAALAGALSLSLAAGAVAAHKPASNATGVQKSAQGSCGASKSAEGSCGASKSAEG
                   10        20        30        40        50        60
```

-continued

```
              60        70        80        90       100
m716.pep  ----AGSKAGEGKCGEGKCGATVKKTHKHTKASKAKAKSAEGKCGEGKCGSKX
          |:||||||||||||||||||||:|||||||||||||||||||||||||||
g716      SCGAAASKAGEGKCGEGKCGATVKKAHKHTKASKAKAKSAEGKCGEGKCGSKX
              70        80        90       100       110
```

The following partial DNA sequence was identified in *N. meningitidis* <SEQ ID 2411>:

a716.seq

```
  1 ATGAACAAAA ACATTGCTGC CGCACTCGCC GGTGCTTTAT CCCTGTCTTT

 51 GGCCGCCGGT GCAGTTGCTG CCAACAAACC GGCAAGCAAC GCAACAGGCG

101 TTCATAAATC CGCCCATGGC TCTTGCGGCG CGTCCAAATC TGCCGAAGGT

151 TCGTGCGGCG CGGCTGGTTC TAAAGCAGGC GAAGGCAAAT GCGGCGAGGG

201 CAAATGCGGT GCGACCGTAA AAAAAACCCA CAAACACACC AAAGCATCTA

251 AAGCCAAGGC CAAATCTGCC GAAGGCAAAT GCGGCGAAGG CAAATGCGGT

301 TCTAAATAA
```

The following partial DNA sequence was identified in *N. meningitidis* <SEQ ID 2412.a>:

a716.pep

```
  1 MNKNIAAALA GALSLSLAAG AVAANKPASN ATGVHKSAHG SCGASKSAEG

 51 SCGAAGSKAG EGKCGEGKCG ATVKKTHKHT KASKAKAKSA EGKCGEGKCG

101 SK*
```

a716/m716 100.0% identity in 102 aa overlap

```
              10        20        30        40        50        60
m716.pep  MNKNIAAALAGALSLSLAAGAVAANKPASNATGVHKSAHGSCGASKSAEGSCGAAGSKAG
          ||||||||||||||||||||||||||||||||||||||||||||||||||||||||||||
g716      MNKNIAAALAGALSLSLAAGAVAANKPASNATGVHKSAHGSCGASKSAEGSCGAAGSKAG
              10        20        30        40        50        60
              70        80        90       100
m716.pep  EGKCGEGKCGATVKKTHKHTKASKAKAKSAEGKCGEGKCGSKX
          ||||||||||||||||||||||||||||||||||||||||||
g716      EGKCGEGKCGATVKKTHKHTKASKAKAKSAEGKCGEGKCGSKX
              70        80        90       100
```

The following partial DNA sequence was identified in *N. gonorrhoeae* <SEQ ID 2413>:

g717.seq

```
  1 ATGGACACAA AAGAAATCCT CGGCTACGCG GCAGGCTCGA TCGGCAGCGC

 51 GGTTTTAGCC GTCATCATCC TGCCGCTGCT GTCGTGGTAT TTCcccgCCG

101 ACGACATCGG GCGCATCGTG CTGATGCAGA CGGCGGCGGG ACTGACGGTG

151 TCGGTATTGT GCCTCGGGCT GGATCAGGCA TACGTCCGCG AATACTATGC

201 CGCCGCCGAC AAAGACACTT TGTTCAAAAC CCTGTTCCTG CCGCCGCTGC
```

-continued

```
 251 TGTTTTCCGC CGCGATAGCC GCCCTGCTGC TTTCCCGCCC GTCCCTGCCG
 301 TCTGAAATCC TGTTTTCGCT CGACGATGCC GCCGCCGGCA TCGGGCTGGT
 351 GCTGTTTGAA CTGAGCTTCC TGCCCATCCG CTTTCTCTTA CTGGTTTTGC
 401 GTATGGAAGG GCGCGCCCTT GCCTTTTCGT CCGCGCAACT CGTGCCCAAA
 451 CTCGCCATTC TGCTGCTGTT GCCGCTGACG GTCGGGCTGC TGCACTTTCC
 501 GGCGAACACC TCCGTCCTGA CCGCCGTTTA CGCGCTGGCA AACCTTGCCG
 551 CCGCCGCCTT TTTGCTGTTT CAAAACCGAT GCCGTCTGAA GGCCGTCCGG
 601 CGCGCGCCGT TTTCGCCCGC CGTCCTGCAC CGGGGGCTGC GCTACGGCAT
 651 ACCGCTCGCA CTGAGCAGCC TTGCCTATTG GGGGCTGGCA TCCGCCGACC
 701 GTTTGTTCCT GAAAAAATAT GCGGGCCTGG AACAGCTCGG CGTTTATTCG
 751 ATGGGTATTT CGTTCGGCGG GGCGGCATTA TTGCTCCAAA GCATCTTTTC
 801 AACGGTCTGG ACACCGTATA TTTTCCGTGC AATCGAAGAA AACGCCACGC
 851 CCGCCCGCCT CTCGGCAACG GCAGAATCCG CCGCCGCCCT GCTTGCCTCC
 901 GCCCTCTGCC TGACCGGAAT TTTCTCGCCC CTCGCCTCCC TCCTGCTGCC
 951 GGAAAACTAC GCCGCCGTCC GGTTTACCGT CGTATCGTGT ATGCTGccgc
1001 cgctGTTTTA CACGCTGACC GAAATCAGCG GCATCGGTTT GAACGTCGTC
1051 CGCAAAACGC GTCCGATCGC GCTTGCCACC TTGGGCGCGC TGGCGGCAAA
1101 CCTGCTGCTG CTGGGGCTTG CCGTACCGTC CGGCGGCACG CGCGGCGCGG
1151 CGGTTGCCTG TGCCGCCTCA TTCTGGTTGT TTTTTGTTTT CAAGACAGAA
1201 AGCTCCTGCC GCCTGTGGCA GCCGCTCAAA CGCCTGCCGC TTTATATGCA
1251 CACATTGTTC TGCCTgGCCT CCTCGGCGGC CTACACCTGC TTCGGCACAC
1301 CGGCAAACTA CCCcctgttt gccggcgtAT GGGCGGCATA TCTGGCAGGC
1351 TGCATCCTGC GCCACCGGAA AAATTTGCAC AAACTGTTTC ATTATTTGAA
1401 AAAACAAGGT TTCCCATTAT GA
```

This corresponds to the amino acid sequence <SEQ ID 2414; ORF 717.ng>:

```
g717.pep

  1 MDTKEILGYA AGSIGSAVLA VIILPLLSWY FPADDIGRIV LMQTAAGLTV
 51 SVLCLGLDQA YVREYYAAAD KDTLFKTLFL PPLLFSAAIA ALLLSRPSLP
101 SEILFSLDDA AAGIGLVLFE LSFLPIRFLL LVLRMEGRAL AFSSAQLVPK
151 LAILLLLPLT VGLLHFPANT SVLTAVYALA NLAAAAFLLF QNRCRLKAVR
201 RAPFSPAVLH RGLRYGIPLA LSSLAYWGLA SADRLFLKKY AGLEQLGVYS
251 MGISFGGAAL LLQSIFSTVW TPYIFRAIEE NATPARLSAT AESAAALLAS
301 ALCLTGIFSP LASLLLPENY AAVRFTVVSC MLPPLFYTLT EISGIGLNVV
351 RKTRPIALAT LGALAANLLL LGLAVPSGGT RGAAVACAAS FWLFFVFKTE
401 SSCRLWQPLK RLPLYMHTLF CLASSAAYTC FGTPANYPLF AGVWAAYLAG
451 CILRHRKNLH KLFHYLKKQG FPL*
```

The following partial DNA sequence was identified in *N. meningitidis* <SEQ ID 2415>:

m717.seq

```
   1 ATGGACACAA AAGAAATCCT CGGCTACGCG GCAGGCTCGA TCGGCAGCGC
  51 GGTTTTAGCC GTCATCATCC TGCCGCTGCT GTCGTGGTAT TTCCCCGCCG
 101 ACGACATCGG GCGCATCGTG CTGATGCAGA CGGCGGCGGG GCTGACGGTG
 151 TCGGTGTTGT GCCTCGGGCT GGATCAGGCA TACGTCCGCG AATACTATGC
 201 CACCGCCGAC AAAGACACCT TGTTCAAAAC CCTGTTCCTG CCGCCGCTGC
 251 TGTCTGCCGC CGCGATAGCC GCCCTGCTGC TTTCCCGCCC GTCCCTGCCG
 301 TCTGAAATCC TGTTTTCACT CGACGATGCC GCCGCCGGCA TCGGGCTGGT
 351 GCTGTTTGAA CTGAGCTTCC TGCCCATCCG CTTTCTCTTA CTGGTTTTGC
 401 GTATGGAAGG ACGCGCCCTT GCCTTTTCGT CCGCGCAACT CGTGCCCAAG
 451 CTCGCCATCC TGCTGCTGCT GCCGCTGACG GTCGGGCTGC TGCACTTTCC
 501 AGCGAACACC GCCGTCCTGA CCGCCGTTTA CGCGCTGGCA AACCTTGCCG
 551 CCGCCGCCTT TTTGCTGTTT CAAAACCGAT GCCGTCTGAA GGCCGTCCGG
 601 CACGCACCGT TTTCGCCCGC CGTCCTGCAC CGGGGGCTGC GCTACGGCAT
 651 ACCGATCGCA CTGAGCAGCA TCGCCTATTG GGGGCTGGCA TCCGCCGACC
 701 GTTTGTTCCT GAAAAAATAT GCCGGCCTGG AACAGCTCGG CGTTTATTCG
 751 ATGGGTATTT CGTTCGGCGG GGCGGCATTA TTGTTCCAAA GCATCTTTTC
 801 AACGGTCTGG ACACCGTATA TTTTCCGCGC AATCGAAGAA AACGCCCCGC
 851 CCGCCCGCCT CTCGGCAACG GCAGAATCCG CCGCCGCCCT GCTTGCCTCC
 901 GCCCTCTGCC TGACCGGCAT TTTCTCGCCC CTTGCCTCCC TCCTGCTGCC
 951 GGAAAACTAC GCCGCCGTCC GGTTTATCGT CGTATCGTGT ATGCTGCCGC
1001 CGCTGTTTTG CACGCTGGCG GAAATCAGCG GCATCGGTTT GAACGTCGTC
1051 CGCAAAACGC GCCCGATCGC GCTCGCCACC TTGGGCGCGC TGGCGGCAAA
1101 CCTGCTGCTG CTGGGGCTTG CCGTGCCGTC CGGCGGCGCG CGCGGCGCGG
1151 CGGTTGCCTG TGCCGCCTCA TTCTGGCTGT TTTTTGCCTT CAAGACCGAA
1201 AGCTCCTGCC GCCTGTGGCA GCCGCTCAAA CGCCTGCCGC TTTATCTGCA
1251 CACATTGTTC TGCCTGACCT CCTCGGCGGC CTACACCTGC TTCGGCACGC
1301 CGGCAAACTA TCCCCTGTTT GCCGGCGTAT GGGCGGCATA TCTGGCAGGC
1351 TGCATCCTGC GCCACCGGAA AGATTTGCAC AAACTGTTTC ATTATTTGAA
1401 AAAACAAGGT TTCCCATTAT GA
```

This corresponds to the amino acid sequence <SEQ ID 2416; ORF 717>:

m717.pep

```
  1 MDTKEILGYA AGSIGSAVLA VIILPLLSWY FPADDIGRIV LMQTAAGLTV
 51 SVLCLGLDQA YVREYYATAD KDTLFKTLFL PPLLSAAAIA ALLLSRPSLP
101 SEILFSLDDA AAGIGLVLFE LSFLPIRFLL LVLRMEGRAL AFSSAQLVPK
151 LAILLLLPLT VGLLHFPANT AVLTAVYALA NLAAAAFLLF QNRCRLKAVR
201 HAPFSPAVLH RGLRYGIPIA LSSIAYWGLA SADRLFLKKY AGLEQLGVYS
251 MGISFGGAAL LFQSIFSTVW TPYIFRAIEE NAPPARLSAT AESAAALLAS
```

-continued

```
301 ALCLTGIFSP LASLLLPENY AAVRFIVVSC MLPPLFCTLA EISGIGLNVV

351 RKTRPIALAT LGALAANLLL LGLAVPSGGA RGAAVACAAS FWLFFAFKTE

401 SSCRLWQPLK RLPLYLHTLF CLTSSAAYTC FGTPANYPLF AGVWAAYLAG

451 CILRHRKDLH KLFHYLKKQG FPL*
```

m717/g717 96.4% identity in 473 aa overlap

```
                   10        20        30        40        50        60
m717.pep   MDTKEILGYAAGSIGSAVLAVIILPLLSWYFPADDIGRIVLMQTAAGLTVSVLCLGLDQA
           ||||||||||||||||||||||||||||||||||||||||||||||||||||||||||||
g717       MDTKEILGYAAGSIGSAVLAVIILPLLSWYFPADDIGRIVLMQTAAGLTVSVLCLGLDQA
                   10        20        30        40        50        60

                   70        80        90       100       110       120
m717.pep   YVREYYATADKDTLFKTLFLPPLLSAAAIAALLLSRPSLPSEILFSLDDAAAGIGLVLFE
           |||||||:|||||||||||||||| :||||||||||||||||||||||||||||||||||
g717       YVREYYAAADKDTLFKTLFLPPLLFSAAIAALLLSRPSLPSEILFSLDDAAAGIGLVLFE
                   70        80        90       100       110       120

                  130       140       150       160       170       180
m717.pep   LSFLPIRFLLLVLRMEGRALAFSSAQLVPKLAILLLLPLTVGLLHFPANTAVLTAVYALA
           |||||||||||||||||||||||||||||||||||||||||||||||||:||||||||||
g717       LSFLPIRFLLLVLRMEGRALAFSSAQLVPKLAILLLLPLTVGLLHFPANTSVLTAVYALA
                  130       140       150       160       170       180

                  190       200       210       220       230       240
m717.pep   NLAAAAFLLFQNRCRLKAVRHAPFSPAVLHRGLRYGIPIALSSIAYWGLASADRLFLKKY
           ||||||||||||||||||||:|||||||||||||||||:||||:||||||||||||||||
g717       NLAAAAFLLFQNRCRLKAVRRAPFSPAVLHRGLRYGIPLALSSLAYWGLASADRLFLKKY
                  190       200       210       220       230       240

                  250       260       270       280       290       300
m717.pep   AGLEQLGVYSMGISFGGAALLFQSIFSTVWTPYIFRAIEENAPPARLSATAESAAALLAS
           |||||||||||||||||||||:|||||||||||||||||||| |||||||||||||||||
g717       AGLEQLGVYSMGISFGGAALLLQSIFSTVWTPYIFRAIEENATPARLSATAESAAALLAS
                  250       260       270       280       290       300

                  310       320       330       340       350       360
m717.pep   ALCLTGIFSPLASLLLPENYAAVRFIVVSCMLPPLFCTLAEISGIGLNVVRKTRPIALAT
           ||||||||||||||||||||||||| |||||||||| ||:||||||||||||||||||||
g717       ALCLTGIFSPLASLLLPENYAAVRFTVVSCMLPPLFYTLTEISGIGLNVVRKTRPIALAT
                  310       320       330       340       350       360

                  370       380       390       400       410       420
m717.pep   LGALAANLLLLGLAVPSGGARGAAVACAASFWLFFAFKTESSCRLWQPLKRLPLYLHTLF
           |||||||||||||||||||:|||||||||||||||:|||||||||||||||||||:||||
g717       LGALAANLLLLGLAVPSGGTRGAAVACAASFWLFFVFKTESSCRLWQPLKRLPLYMHTLF
                  370       380       390       400       410       420

                  430       440       450       460       470
m717.pep   CLTSSAAYTCFGTPANYPLFAGVWAAYLAGCILRHRKDLHKLFHYLKKQGFPLX
           ||:||||||||||||||||||||||||||||||||||:|||||||||||||||
g717       CLASSAAYTCFGTPANYPLFAGVWAAYLAGCILRHRKNLHKLFHYLKKQGFPLX
                  430       440       450       460       470
```

The following partial DNA sequence was identified in *N. meningitidis* <SEQ ID 2417>:

a717.seq

```
  1 ATGGACACAA AAGAAATCCT CGGCTACGCG GCAGGCTCGA TCGGCAGCGC

 51 GGTTTTAGCC GTCATCATCC TGCCGCTGCT GTCGTGGTAT TTCCCTGCCG

101 ACGACATCGG ACGCATCGTG CTGATGCAGA CGGCGGCGGG GCTGACGGTG

151 TCGGTGTTGT GCCTCGGGCT GGATCAGGCA TACGTCCGCG AATACTATGC

201 CGCCGCCGAC AAAGACACTT TGTTCAAAAC CCTGTTCCTG CCGCCGCTGC

251 TGTCTGCCGC CGCGATAGCC GCCCTGCTGC TTTCCCGCCC ATCCCTGCCG

301 TCTGAAATCC TGTTTTCGCT CGACGATGCC GCCGCCGGCA TCGGGCTGGT

351 GCTGTTTGAA CTGAGCTTCC TGCCCATCCG CTTTCTCTTA CTGGTTTTGC

401 GTATGGAAGG ACGCGCCCTT GCCTTTTCGT CCGCGCAACT CGTGTCCAAG

451 CTCGCCATCC TGCTGCTGCT GCCGCTGACG GTCGGGCTGC TGCACTTTCC
```

-continued

```
 501 GGCGAACACC GCCGTCCTGA CCGCCGTTTA CGCGCTGGCA AACCTTGCCG
 551 CCGCCGCCTT TTTGCTGTTT CAAAACCGAT GCCGTCTGAA GGCCGTCCGG
 601 CGCGCACCGT TTTCATCCGC CGTCCTGCAT CGCGGCCTGC GCTACGGCAT
 651 ACCGATCGCA CTAAGCAGCA TCGCCTATTG GGGGCTGGCA TCCGCCGACC
 701 GTTTGTTCCT GAAAAAATAT GCCGGCCTAG AACAGCTCGG CGTTTATTCG
 751 ATGGGTATTT CGTTCGGCGG AGCGGCATTA TTGTTCCAAA GCATCTTTTC
 801 AACGGTCTGG ACACCGTATA TTTTCCGCGC AATCGAAGCA AACGCCCCGC
 851 CCGCCCGCCT CTCGGCAACG GCAGAATCCG CCGCCGCCCT GCTTGCCTCC
 901 GCCCTCTGCC TGACCGGCAT TTTCTCGCCC CTCGCCTCCC TCCTGCTGCC
 951 GGAAAACTAC GCCGCCGTCC GGTTTATCGT CGTATCGTGT ATGCTGCCTC
1001 CGCTGTTTTG CACGCTGGTA GAAATCAGCG GCATCGGTTT GAACGTCGTC
1051 CGAAAAACAC GCCCGATCGC GCTCGCCACC TTGGGCGCGC TGGCGGCAAA
1101 CCTGCTGCTG CTGGGGCTTG CCGTACCGTC CGGCGGCGCG CGCGGCGCGG
1151 CGGTTGCCTG TGCCGCCTCA TTTTGGCTGT TTTTTGTTTT CAAGACCGAA
1201 AGCTCCTGCC GCCTGTGGCA GCCGCTCAAA CGCCTGCCGC TTTATATGCA
1251 CACATTGTTC TGCCTGGCCT CCTCGGCGGC CTACACCTGC TTCGGCACTC
1301 CGGCAAACTA CCCCCTGTTT GCCGGCGTAT GGGCGGTATA TCTGGCAGGC
1351 TGCATCCTGC GCCACCGGAA AGATTTGCAC AAACTGTTTC ATTATTTGAA
1401 AAAACAAGGT TTCCCATTAT GA
```

This corresponds to the amino acid sequence <SEQ ID 2418; ORF 717.a>:

a717.pep

```
  1 MDTKEILGYA AGSIGSAVLA VIILPLLSWY FPADDIGRIV LMQTAAGLTV
 51 SVLCLGLDQA YVREYYAAAD KDTLFKTLFL PPLLSAAAIA ALLLSRPSLP
101 SEILFSLDDA AAGIGLVLFE LSFLPIRFLL LVLRMEGRAL AFSSAQLVSK
151 LAILLLLPLT VGLLHFPANT AVLTAVYALA NLAAAAFLLF QNRCRLKAVR
201 RAPFSSAVLH RGLRYGIPIA LSSIAYWGLA SADRLFLKKY AGLEQLGVYS
251 MGISFGGAAL LFQSIFSTVW TPYIFRAIEA NAPPARLSAT AESAAALLAS
301 ALCLTGIFSP LASLLLPENY AAVRFIVVSC MLPPLFCTLV EISGIGLNVV
351 RKTRPIALAT LGALAANLLL LGLAVPSGGA RGAAVACAAS FWLFFVFKTE
401 SSCRLWQPLK RLPLYMHTLF CLASSAAYTC FGTPANYPLF AGVWAVYLAG
451 CILRHRKDLH KLFHYLKKQG FPL*
```

a717/m717 97.9% identity in 473 aa overlap

```
                   10        20        30        40        50        60
a717.pep    MDTKEILGYAAGSIGSAVLAVIILPLLSWYFPADDIGRIVLMQTAAGLTVSVLCLGLDQA
            ||||||||||||||||||||||||||||||||||||||||||||||||||||||||||||
m717        MDTKEILGYAAGSIGSAVLAVIILPLLSWYFPADDIGRIVLMQTAAGLTVSVLCLGLDQA
                   10        20        30        40        50        60
```

-continued

```
                70        80        90        100       110       120
a717.pep  YVREYYAAADKDTLFKTLFLPPLLSAAAIAALLLSRPSLPSEILFSLDDAAAGIGLVLFE
          |||||||:||||||||||||||||||||||||||||||||||||||||||||||||||||
m717      YVREYYATADKDTLFKTLFLPPLLSAAAIAALLLSRPSLPSEILFSLDDAAAGIGLVLFE
                70        80        90        100       110       120

                130       140       150       160       170       180
a717.pep  LSFLPIRFLLLVLRMEGRALAFSSAQLVSKLAILLLLPLTVGLLHFPANTAVLTAVYALA
          |||||||||||||||||||||||||||| |||||||||||||||||||||||||||||||
m717      LSFLPIRFLLLVLRMEGRALAFSSAQLVPKLAILLLLPLTVGLLHFPANTAVLTAVYALA
                130       140       150       160       170       180

                190       200       210       220       230       240
a717.pep  NLAAAAFLLFQNRCRLKAVRRAPFSSAVLHRGLRYGIPIALSSIAYWGLASADRLFLKKY
          ||||||||||||||||||||:|||| ||||||||||||||||||||||||||||||||||
m717      NLAAAAFLLFQNRCRLKAVRHAPFSPAVLHRGLRYGIPIALSSIAYWGLASADRLFLKKY
                190       200       210       220       230       240

                250       260       270       280       290       300
a717.pep  AGLEQLGVYSMGISFGGAALLFQSIFSTVWTPYIFRAIEANAPPARLSATAESAAALLAS
          ||||||||||||||||||||||||||||||||||||||| ||||||||||||||||||||
m717      AGLEQLGVYSMGISFGGAALLFQSIFSTVWTPYIFRAIEENAPPARLSATAESAAALLAS
                250       260       270       280       290       300

                310       320       330       340       350       360
a717.pep  ALCLTGIFSPLASLLLPENYAAVRFIVVSCMLPPLFCTLVEISGIGLNVVRKTRPIALAT
          |||||||||||||||||||||||||||||||||||||||:||||||||||||||||||||
m717      ALCLTGIFSPLASLLLPENYAAVRFIVVSCMLPPLFCTLAEISGIGLNVVRKTRPIALAT
                310       320       330       340       350       360

                370       380       390       400       410       420
a717.pep  LGALAANLLLLGLAVPSGGARGAAVACAASFWLFFVFKTESSCRLWQPLKRLPLYMHTLF
          ||||||||||||||||||||||||||||||||||:||||||||||||||||||||:||||
m717      LGALAANLLLLGLAVPSGGARGAAVACAASFWLFFAFKTESSCRLWQPLKRLPLYLHTLF
                370       380       390       400       410       420

                430       440       450       460       470
a717.pep  CLASSAAYTCFGTPANYPLFAGVWAVYLAGCILRHRKDLHKLFHYLKKQGFPLX
          ||:||||||||||||||||||||||:||||||||||||||||||||||||||||
m717      CLTSSAAYTCFGTPANYPLFAGVWAAYLAGCILRHRKDLHKLFHYLKKQGFPLX
                430       440       450       460       470
```

g718.seq not found yet g718.pep not found yet

The following partial DNA sequence was identified in *N. meningitidis* <SEQ ID 2419>:

m718.seq

```
  1 TCAGACGGCC TTTACGTACC CCGAAACTTT ATCCACCGCC CGCAAAGCTG
 51 GTTCAAATGG GACAAAGACA ACGGGCTGCT GCTGCGTACC CGCGAAAATC
101 CGGAAGGCGA AGCGTTGTGG CCGCTGGGCT GGGTCGTTCA TACCCAAAAA
151 TCGCGCAGCG TCCAGCAGGC GCGCAACGGG CTTTTCCGCA CGCTTTCCTG
201 GCTGTATATG TTCAAACACT ACGCCGTCCA CGATTTTGCC GAGTTTTTGG
251 AGCTGTACGG CATGCCCATC CGTATCGGCA AATACGGCGC GGGCGCAACC
301 AAAGAGGAAA AAAACACCCT GCTTCGAGCG GTGGCGGAAA TCGGTCACAA
351 CGCGGCAGGC ATCATGCCAG AAGGTATGGA AATAGAGCTC CACAACGCGG
401 CAAACGGTAC GACGGCAACC AGCAATCCGT TTTTGCAGAT GGCCGACTGG
451 TGCGAAAAAT CGGCGGCGCG GCTGATTTTG GGGCAAACGC TGACCAGCGG
501 TGCGGACGGA AAATCCAGCA CCAACGCGCT GGGCAATATC CACAACGAGG
551 TACGCCGCGA TTTGCTGGTG TCGGACGCAA AACAGGTGGC GCAAACCATC
601 ACAAGCCAAA TCATCGGACC GTTCCTGCAA ATCAACTATC CCCATGCCGA
651 CCCAAACCGC GTGCCGAAAT TTGAATTTGA CACGCGCGAG CCGAAAGACA
701 TCGCGGTCTT TGCCGACGCT ATCCCGAAAC TGGTGGATGT CGGCGTACAA
751 ATCCCCGAAA GCTGGGTGCG CGACAAACTG GTCATTCCAG ATGTGCAGGA
801 GGGTGAGGCT GTGTTGGTGC GGCAGGTACC GGACAATCCG GTAAACAGAA
```

-continued

```
 851 CTGCATTGGC GGCTTTATCC GCCCACACCG TACCATCTAA GGCTACGGGC
 901 AGGCATCAGG AAATATTGGA CGGCGCGTTG GATGACGCGC TGGTTGAGCC
 951 CGATTTCAAT TCTCAGCTCA ACCCGATGGT GCGTCAGGCG GTTGCCGCAC
1001 TTAATGCTTG CAACAGCTAC GAGGAGGCAG ATGCCGCACT GAATGCGCTT
1051 TATCCGAATT TGGACAACGC GAAACTGCGT ACCTATATGC AGCAGGCCTT
1101 GTTTATCAGC GATATTTTGG GACAAGACCA TGCCCGCGCC TGA
```

This corresponds to the amino acid sequence <SEQ ID 2420; ORF 718>:

m718.pep

```
  1 SDGLYVPRNF IHRPQSWFKW DKDNGLLLRT RENPEGEALW PLGWVVHTQK
 51 SRSVQQARNG LFRTLSWLYM FKHYAVHDFA EFLELYGMPI RIGKYGAGAT
101 KEEKNTLLRA VAEIGHNAAG IMPEGMEIEL HNAANGTTAT SNPFLQMADW
151 CEKSAARLIL GQTLTSGADG KSSTNALGNI HNEVRRDLLV SDAKQVAQTI
201 TSQIIGPFLQ INYPHADPNR VPKFEFDTRE PKDIAVFADA IPKLVDVGVQ
251 IPESWVRDKL VIPDVQEGEA VLVRQVPDNP VNRTALAALS AHTVPSKATG
301 RHQEILDGAL DDALVEPDFN SQLNPMVRQA VAALNACNSY EEADAALNAL
351 YPNLDNAKLR TYMQQALFIS DILGQDHARA *
```

The following partial DNA sequence was identified in *N. meningitidis* <SEQ ID 2421>:

a718.seq

```
  1 ATGGAGCCGA TAATGGCAAA AAAGAACAAT AAAACTAAAA TCCAAAAGCC
 51 CGAAGCTGCA TTGCAGACGG ACGTGGCTCA AATTACAGCG ACCGGTCGAG
101 TTATCGCCGA GCATCCATCC AATTTTATTA CGCCGCAAAA GATGCGCGCC
151 CTCTTCGAGG ACGCAGAAAG CGGTGACATC CGCGCCCAAC ACGAGCTTTT
201 CGCGGACATT GAGGAGCGCG ACAGCGACAT CGCGGCAAAT ATGGGGACGC
251 GCAAACGCGC GCTGCTGACG CTCAACTGGC GCGTCGCCCC GCCGCGAAAT
301 GCGACGCCCG AAGAAGAAAA GCTGTCCGAC CAAGCCTACG AAATGATGGA
351 CAGCCTGCCT ACCCTCGAAG ACCTGATTAT GGATTTGATG GACGCGGTAG
401 GGCACGGATT TTCTGCGTTG GAGGTCGAGT GGGTATTTTC AGACGGCCTT
451 TACCTACCCC GAAACTTTAT CCACCGCCCG CAAAGCTGGT TCAAATGGGA
501 CAAAGACAAC GGGCTGCTGC TGCGTACCCG CGAAAATCCG GAAGGCGAAG
551 CGTTGTGGCC GCTGGGCTGG GTCGTTCATA CCCAAAAATC GCGCAGCGTC
601 CAGCAGGCGC GCAACGGGCT TTTCCGCACG CTTTCCTGGC TGTATATGTT
651 CAAACACTAC GCCGTCCACG ATTTTGCCGA GTTTTTGGAG CTGTACGGCA
701 TGCCCATCCG TATCGGCAAA TACGGCGCGG GCGCAACCAA AGAGGAAAAA
751 AACACCCTGC TTCGAGCGGT GGCGGAAATC GGTCACAACG CGGCAGGCAT
801 CATGCCAGAA GGTATGGAAA TCGAGCTGCA CAACGCGGCA AACGGCATGA
```

-continued

```
 851 CTTCCGCCGG CAATCCGTTT TTGCAGATGG CCGACTGGTG CGAAAAATCG

 901 GCGGCGCGGC TGATTTTGGG GCAAACGCTA ACCAGCGGTG CGGACGGAAA

 951 ATCCAGCACC AACGCGCTGG GCAATATCCA CAACGAGATA CGCCGCGATT

1001 TGCTGGTGTC GGACGCAAAA CAGGTGGCGC AAACCATCAC AAGCCAAATC

1051 ATCGGACCGT TCCTGCAAAT CAACTATCCC CATGCCGACC CAAACCGCGT

1101 GCCGAAATTT GAATTTGACA CGCGCGAGCC GAAAGACATC GCGGTCTTTG

1151 CCGACGCTAT CCCGAAACTG GTGGATGTCG GCGTACAAAT CCCCGAAAGC

1201 TGGGTGCGCG ACAAACTGGT CATTCCAGAT GTGCAGGAGG GTGAGGCTGT

1251 GTTGGTGCGG CAGGTACCGG ACAATCCGGT AAACAGAACT GCATTGGCGG

1301 CTTTATCCGC CCACACCGTA CCATCTAAGG CTACGGGCAG GCATCAGGAA

1351 ATATTGGACG GCGCGTTGGA TGACGCGCTG GTTGAGCCCG ATTTCAATTC

1401 TCAGCTCAAC CCGATGGTGC GTCAGGCGGT TGCCGCACTT AATGCTTGCA

1451 ACAGCTACGA GGAGGCAGAT GCCGCACTGA ATGCGCTTTA TCCGAATTTG

1501 GACAACGCGA AACTGCGTAC CTATATGCAG CAGGCCTTGT TTATCAGCGA

1551 TATTTTGGGA CAAGACCATG CCCGCGCCTG A
```

This corresponds to the amino acid sequence <SEQ ID 2422; ORF 718.a>:

a718.pep

```
  1 MEPIMAKKNN KTKIQKPEAA LQTDVAQITA TGRVIAEHPS NFITPQKMRA

 51 LFEDAESGDI RAQHELFADI EERDSDIAAN MGTRKRALLT LNWRVAPPRN

101 ATPEEEKLSD QAYEMMDSLP TLEDLIMDLM DAVGHGFSAL EVEWVFSDGL

151 YLPRNFIHRP QSWFKWDKDN GLLLRTRENP EGEALWPLGW VVHTQKSRSV

201 QQARNGLFRT LSWLYMFKHY AVHDFAEFLE LYGMPIRIGK YGAGATKEEK

251 NTLLRAVAEI GHNAAGIMPE GMEIELHNAA NGMTSAGNPF LQMADWCEKS

301 AARLILGQTL TSGADGKSST NALGNIHNEI RRDLLVSDAK QVAQTITSQI

351 IGPFLQINYP HADPNRVPKF EFDTREPKDI AVFADAIPKL VDVGVQIPES

401 WVRDKLVIPD VQEGEAVLVR QVPDNPVNRT ALAALSAHTV PSKATGRHQE

451 ILDGALDDAL VEPDFNSQLN PMVRQAVAAL NACNSYEEAD AALNALYPNL

501 DNAKLRTYMQ QALFISDILG QDHARA*
```

a718/m718 98.4% identity in 380 aa overlap

```
                 120       130       140       150       160       170
a718.pep    DSLPTLEDLIMDLMDAVGHGFSALEVEWVFSDGLYLPRNFIHRPQSWFKWDKDNGLLLRT
                                          |||||:||||||||||||||||||||||||
m718                                      SDGLYVPRNFIHRPQSWFKWDKDNGLLLRT
                                                  10        20        30

                 180       190       200       210       220       230
a718.pep    RENPEGEALWPLGWVVHTQKSRSVQQARNGLFRTLSWLYMFKHYAVHDFAEFLELYGMPI
            ||||||||||||||||||||||||||||||||||||||||||||||||||||||||||||
m718        RENPEGEALWPLGWVVHTQKSRSVQQARNGLFRTLSWLYMFKHYAVHDFAEFLELYGMPI
                    40        50        60        70        80        90

                 240       250       260       270       280       290
a718.pep    RIGKYGAGATKEEKNTLLRAVAEIGHNAAGIMPEGMEIELHNAANGMTSAGNPFLQMADW
            |||||||||||||||||||||||||||||||||||||||||||||| |:::|||||||||
m718        RIGKYGAGATKEEKNTLLRAVAEIGHNAAGIMPEGMEIELHNAANGTTATSNPFLQMADW
                   100       110       120       130       140       150
```

-continued

```
           300       310       320       330       340       350
a718.pep   CEKSAARLILGQTLTSGADGKSSTNALGNIHNEIRRDLLVSDAKQVAQTITSQIIGPFLQ
           |||||||||||||||||||||||||||||||||:||||||||||||||||||||||||||
m718       CEKSAARLILGQTLTSGADGKSSTNALGNIHNEVRRDLLVSDAKQVAQTITSQIIGPFLQ
                  160       170       180       190       200       210

           360       370       380       390       400       410
a718.pep   INYPHADPNRVPKFEEDTREPKDIAVFADAIPKLVDVGVQIPESWVRDKLVIPDVQEGEA
           ||||||||||||||||||||||||||||||||||||||||||||||||||||||||||||
m718       INYPHADPNRVPKFEFDTREPKDIAVFADAIPKLVDVGVQIPESWVRDKLVIPDVQEGEA
                  220       230       240       250       260       270

           420       430       440       450       460       470
a718.pep   VLVRQVPDNPVNRTALAALSAHTVPSKATGRHQEILDGALDDALVEPDFNSQLNPMVRQA
           ||||||||||||||||||||||||||||||||||||||||||||||||||||||||||||
m718       VLVRQVPDNPVNRTALAALSAHTVPSKATGRHQEILDGALDDALVEPDFNSQLNPMVRQA
                  280       290       300       310       320       330

           480       490       500       510       520
a718.pep   VAALNACNSYEEADAALNALYPNLDNAKLRTYMQQALFISDILGQDHARAX
           |||||||||||||||||||||||||||||||||||||||||||||||||||
m718       VAALNACNSYEEADAALNALYPNLDNAKLRTYMQQALFISDILGQDHARAX
                  340       350       360       370       380
```

The following partial DNA sequence was identified in *N. meningitidis* <SEQ ID 2423>:

m718-1.seq

```
   1 ATGGAGCCGA TAATGGCAAA AAAGAACAAT AAAACTAAAA TCCAAAAGCC
  51 CGAAGCTGCA TTGCAGACGG ACGTGGCTCA AATTACGGCG ACCGGTCGGG
 101 TTATCGCCGA GCATCCGTCC AATTTTATTA CGCCGCAAAA GATGCGGGCC
 151 CTCTTCGAGG ACGCAGAAAG CGGCGACATC CGCGCCCAAC ACGAGCTTTT
 201 CGCGGACATT GAGGAGCGCG ACAGCGACAT CGCGGCAAAT ATGGGGACGC
 251 GCAAACGCGC GCTGCTGACG CTCAACTGGC GCGTCGCCCC GCCGCGAAAT
 301 GCGACGCCCG AAGAAGAAAA GCTGTCCGAC CAAGCCTACG AAATGATGGA
 351 CAGCCTGCCT ACCCTCGAAG ACCTGATTAT GGATTTGATG GACGCGGTAG
 401 GGCACGGATT TTCTGCGTTG GAGGTCGAGT GGGTATTTTC AGACGGCCTT
 451 TACCTACCCC GAAACTTTAT CCACCGCCCG CAAAGCTGGT TCAAATGGGA
 501 CAAAGACAAC GGGCTGCTGC TGCGTACCCG CGAAAATCCG GAAGGCGAAG
 551 CGTTGTGGCC GCTGGGCTGG GTCGTTCATA CCCAAAAATC GCGCAGCGTC
 601 CAGCAGGCGC GCAACGGGCT TTTCCGCACG CTTTCCTGGC TGTATATGTT
 651 CAAACACTAC GCCGTCCACG ATTTTGCCGA GTTTTTGGAG CTGTACGGCA
 701 TGCCCATCCG TATCGGCAAA TACGGCGCGG GCGCAACCAA AGAGGAAAAA
 751 AACACCCTGC TTCGAGCGGT GGCGGAAATC GGTCACAACG CGGCAGGCAT
 801 CATGCCAGAA GGTATGGAAA TAGAGCTCCA CAACGCGGCA AACGGTACGA
 851 CGGCAACCAG CAATCCGTTT TTGCAGATGG CCGACTGGTG CGAAAAAATCG
 901 GCGGCGCGGC TGATTTTGGG GCAAACGCTG ACCAGCGGTG CGGACGGAAA
 951 ATCCAGCACC AACGCGCTGG GCAATATCCA CAACGAGGTA CGCCGCGATT
1001 TGCTGGTGTC GGACGCAAAA CAGGTGGCGC AAACCATCAC AAGCCAAATC
1051 ATCGGACCGT TCCTGCAAAT CAACTATCCC CATGCCGACC CAAACCGCGT
1101 GCCGAAATTT GAATTTGACA CGCGCGAGCC GAAAGACATC GCGGTCTTTG
1151 CCGACGCTAT CCCGAAACTG GTGGATGTCG GCGTACAAAT CCCCGAAAGC
1201 TGGGTGCGCG ACAAACTGGT CATTCCAGAT GTGCAGGAGG GTGAGGCTGT
```

-continued

```
1251 GTTGGTGCGG CAGGTACCGG ACAATCCGGT AAACAGAACT GCATTGGCGG
1301 CTTTATCCGC CCACACCGTA CCATCTAAGG CTACGGGCAG GCATCAGGAA
1351 ATATTGGACG GCGCGTTGGA TGACGCGCTG GTTGAGCCCG ATTTCAATTC
1401 TCAGCTCAAC CCGATGGTGC GTCAGGCGGT TGCCGCACTT AATGCTTGCA
1451 ACAGCTACGA GGAGGCAGAT GCCGCACTGA ATGCGCTTTA TCCGAATTTG
1501 GACAACGCGA AACTGCGTAC CTATATGCAG CAGGCCTTGT TTATCAGCGA
1551 TATTTTGGGA CAAGACCATG CCCGCGCCTG A
```

This corresponds to the amino acid sequence <SEQ ID 2424; ORF 718-1>:

m718-1.pep.

```
  1 MEPIMAKKNN KTKIQKPEAA LQTDVAQITA TGRVIAEHPS NFITPQKMRA
 51 LFEDAESGDI RAQHELFADI EERDSDIAAN MGTRKRALLT LNWRVAPPRN
101 ATPEEEKLSD QAYEMMDSLP TLEDLIMDLM DAVGHGFSAL EVEWVFSDGL
151 YLPRNFIHRP QSWFKWDKDN GLLLRTRENP EGEALWPLGW VVHTQKSRSV
201 QQARNGLFRT LSWLYMFKHY AVHDFAEFLE LYGMPIRIGK YGAGATKEEK
251 NTLLRAVAEI GHNAAGIMPE GMEIELHNAA NGTTATSNPF LQMADWCEKS
301 AARLILGQTL TSGADGKSST NALGNIHNEV RRDLLVSDAK QVAQTITSQI
351 IGPFLQINYP HADPNRVPKF EFDTREPKDI AVFADAIPKL VDVGVQIPES
401 WVRDKLVIPD VQEGEAVLVR QVPDNPVNRT ALAALSAHTV PSKATGRHQE
451 ILDGALDDAL VEPDFNSQLN PMVRQAVAAL NACNSYEEAD AALNALYPNL
501 DNAKLRTYMQ QALFISDILG QDHARA*
```

The following partial DNA sequence was identified in *N. meningitidis* <SEQ ID 2425>:

a718.seq

```
  1 ATGGAGCCGA TAATGGCAAA AAAGAACAAT AAAACTAAAA TCCAAAAGCC
 51 CGAAGCTGCA TTGCAGACGG ACGTGGCTCA AATTACAGCG ACCGGTCGAG
101 TTATCGCCGA GCATCCATCC AATTTTATTA CGCCGCAAAA GATGCGCGCC
151 CTCTTCGAGG ACGCAGAAAG CGGTGACATC CGCGCCCAAC ACGAGCTTTT
201 CGCGGACATT GAGGAGCGCG ACAGCGACAT CGCGGCAAAT ATGGGGACGC
251 GCAAACGCGC GCTGCTGACG CTCAACTGGC GCGTCGCCCC GCCGCGAAAT
301 GCGACGCCCG AAGAAGAAAA GCTGTCCGAC CAAGCCTACG AAATGATGGA
351 CAGCCTGCCT ACCCTCGAAG ACCTGATTAT GGATTTGATG GACGCGGTAG
401 GGCACGGATT TTCTGCGTTG GAGGTCGAGT GGGTATTTTC AGACGGCCTT
451 TACCTACCCC GAAACTTTAT CCACCGCCCG CAAAGCTGGT TCAAATGGGA
501 CAAAGACAAC GGGCTGCTGC TGCGTACCCG CGAAAATCCG GAAGGCGAAG
551 CGTTGTGGCC GCTGGGCTGG GTCGTTCATA CCCAAAAATC GCGCAGCGTC
601 CAGCAGGCGC GCAACGGGCT TTTCCGCACG CTTTCCTGGC TGTATATGTT
651 CAAACACTAC GCCGTCCACG ATTTTGCCGA GTTTTTGGAG CTGTACGGCA
```

-continued

```
 701 TGCCCATCCG TATCGGCAAA TACGGCGCGG GCGCAACCAA AGAGGAAAAA
 751 AACACCCTGC TTCGAGCGGT GGCGGAAATC GGTCACAACG CGGCAGGCAT
 801 CATGCCAGAA GGTATGGAAA TCGAGCTGCA CAACGCGGCA AACGGCATGA
 851 CTTCCGCCGG CAATCCGTTT TTGCAGATGG CCGACTGGTG CGAAAAATCG
 901 GCGGCGCGGC TGATTTTGGG GCAAACGCTA ACCAGCGGTG CGGACGGAAA
 951 ATCCAGCACC AACGCGCTGG GCAATATCCA CAACGAGATA CGCCGCGATT
1001 TGCTGGTGTC GGACGCAAAA CAGGTGGCGC AAACCATCAC AAGCCAAATC
1051 ATCGGACCGT TCCTGCAAAT CAACTATCCC CATGCCGACC CAAACCGCGT
1101 GCCGAAATTT GAATTTGACA CGCGCGAGCC GAAAGACATC GCGGTCTTTG
1151 CCGACGCTAT CCCGAAACTG GTGGATGTCG GCGTACAAAT CCCCGAAAGC
1201 TGGGTGCGCG ACAAACTGGT CATTCCAGAT GTGCAGGAGG GTGAGGCTGT
1251 GTTGGTGCGG CAGGTACCGG ACAATCCGGT AAACAGAACT GCATTGGCGG
1301 CTTTATCCGC CCACACCGTA CCATCTAAGG CTACGGGCAG GCATCAGGAA
1351 ATATTGGACG GCGCGTTGGA TGACGCGCTG GTTGAGCCCG ATTTCAATTC
1401 TCAGCTCAAC CCGATGGTGC GTCAGGCGGT TGCCGCACTT AATGCTTGCA
1451 ACAGCTACGA GGAGGCAGAT GCCGCACTGA ATGCGCTTTA TCCGAATTTG
1501 GACAACGCGA AACTGCGTAC CTATATGCAG CAGGCCTTGT TTATCAGCGA
1551 TATTTTGGGA CAAGACCATG CCCGCGCCTG A
```

This corresponds to the amino acid sequence <SEQ ID 2426; ORF 718-1.a>:

a718.pep

```
  1 MEPIMAKKNN KTKIQKPEAA LQTDVAQITA TGRVIAEHPS NFITPQKMRA
 51 LFEDAESGDI RAQHELFADI EERDSDIAAN MGTRKRALLT LNWRVAPPRN
101 ATPEEEKLSD QAYEMMDSLP TLEDLIMDLM DAVGHGFSAL EVEWVFSDGL
151 YLPRNFIHRP QSWFKWDKDN GLLLRTRENP EGEALWPLGW VVHTQKSRSV
201 QQARNGLFRT LSWLYMFKHY AVHDFAEFLE LYGMPIRIGK YGAGATKEEK
251 NTLLRAVAEI GHNAAGIMPE GMEIELHNAA NGMTSAGNPF LQMADWCEKS
301 AARLILGQTL TSGADGKSST NALGNIHNEI RRDLLVSDAK QVAQTITSQI
351 IGPFLQINYP HADPNRVPKF EFDTREPKDI AVFADAIPKL VDVGVQIPES
401 WVRDKLVIPD VQEGEAVLVR QVPDNPVNRT ALAALSAHTV PSKATGRHQE
451 ILDGALDDAL VEPDFNSQLN PMVRQAVAAL NACNSYEEAD AALNALYPNL
501 DNAKLRTYMQ QALFISDILG QDHARA*
```

a718/m718-1 99.0% identity in 526 aa overlap

```
                    10        20        30        40        50        60
a718.pep   MEPIMAKKNNKTKIQKPEAALQTDVAQITATGRVIAEHPSNFITPQKMRALFEDAESGDI
           ||||||||||||||||||||||||||||||||||||||||||||||||||||||||||||
m718       MEPIMAKKNNKTKIQKPEAALQTDVAQITATGRVIAEHPSNFITPQKMRALFEDAESGDI
                    10        20        30        40        50        60
```

-continued

```
                  70        80        90       100       110       120
a718.pep  RAQHELFADIEERDSDIAANMGTRKRALLTLNWRVAPPRNATPEEEKLSDQAYEMMDSLP
          ||||||||||||||||||||||||||||||||||||||||||||||||||||||||||||
m718      RAQHELFADIEERDSDIAANMGTRKRALLTLNWRVAPPRNATPEEEKLSDQAYEMMDSLP
                  70        80        90       100       110       120

                 130       140       150       160       170       180
a718.pep  TLEDLIMDLMDAVGHGFSALEVEWVFSDGLYLPRNFIHRPQSWFKWDKDNGLLLRTRENP
          ||||||||||||||||||||||||||||||||||||||||||||||||||||||||||||
m718      TLEDLIMDLMDAVGHGFSALEVEWVFSDGLYLPRNFIHRPQSWFKWDKDNGLLLRTRENP
                 130       140       150       160       170       180

                 190       200       210       220       230       240
a718.pep  EGEALWPLGWVVHTQKSRSVQQARNGLFRTLSWLYMFKHYAVHDFAEFLELYGMPIRIGK
          ||||||||||||||||||||||||||||||||||||||||||||||||||||||||||||
m718      EGEALWPLGWVVHTQKSRSVQQARNGLFRTLSWLYMFKHYAVHDFAEFLELYGMPIRIGK
                 190       200       210       220       230       240

                 250       260       270       280       290       300
a718.pep  YGAGATKEEKNTLLRAVAEIGHNAAGIMPEGMEIELHNAANGMTSAGNPFLQMADWCEKS
          |||||||||||||||||||||||||||||||||||||||||| |:::|||||||||||||
m718      YGAGATKEEKNTLLRAVAEIGHNAAGIMPEGMEIELHNAANGTTATSNPFLQMADWCEKS
                 250       260       270       280       290       300

                 310       320       330       340       350       360
a718.pep  AARLILGQTLTSGADGKSSTNALGNIHNEIRRDLLVSDAKQVAQTITSQIIGPFLQINYP
          |||||||||||||||||||||||||||||:||||||||||||||||||||||||||||||
m718      AARLILGQTLTSGADGKSSTNALGNIHNEVRRDLLVSDAKQVAQTITSQIIGPFLQINYP
                 310       320       330       340       350       360

                 370       380       390       400       410       420
a718.pep  HADPNRVPKFEFDTREPKDIAVFADAIPKLVDVGVQIPESWVRDKLVIPDVQEGEAVLVR
          ||||||||||||||||||||||||||||||||||||||||||||||||||||||||||||
m718      HADPNRVPKFEEDTREPKDIAVFADAIPKLVDVGVQIPESWVRDKLVIPDVQEGEAVLVR
                 370       380       390       400       410       420

                 430       440       450       460       470       480
a718.pep  QVPDNPVNRTALAALSAHTVPSKATGRHQEILDGALDDALVEPDFNSQLNPMVRQAVAAL
          ||||||||||||||||||||||||||||||||||||||||||||||||||||||||||||
m718      QVPDNPVNRTALAALSAHTVPSKATGRHQEILDGALDDALVEPDFNSQLNPMVRQAVAAL
                 430       440       450       460       470       480

                 490       500       510       520
a718.pep  NACNSYEEADAALNALYPNLDNAKLRTYMQQALFISDILGQDHARAX
          ||||||||||||||||||||||||||||||||||||||||||||||
m718      NACNSYEEADAALNALYPNLDNAKLRTYMQQALFISDILGQDHARAX
                 490       500       510       520
```

g719.seq not found yet g719.pep not found yet

The following partial DNA sequence was identified in *N. meningitidis* <SEQ ID 2427>:

m719.seq

```
  1 ATGGCAAACG GGAACATGAA ACTGTCGTTG GTGTTAACCG CCCGAGATGA
 51 CGGAGCGAGA CGGCTACTGG CTGATACTCA ACGACAATTA GATCGTACCG
101 CGAAATCGCG GGCGCAACTT GAACGGCAAA GCCATACTTA TGCGTTGACC
151 GGCATCCGCT CAGAAAAACA GATTCAACGC GAAATCATGC TGACACAGGC
201 TGCGTTTAAC CGTTTGGCGC GCAGCGGCAA GGCATCACAA AATGATTTGG
251 CACGGGCGGC GGTCGCTACG CGTAACCGAA TTCGCGAGCT GAACGCGGAA
301 CTGAAACAGG GCACGGGATT TGCGGACAAG ATGGGAAAAA TCGGAAGATT
351 CGGTGCAGCT GCGGTGGCTG GTGGCGCGGC AGCGTATACG GTGCTTAAGC
401 CTGCTATGGA CAACAGAAAG CAGCTTGATG AGAACATCAA CCGCGTGTCC
451 AGACAGGCAT TTATTGAGGA TAACAGTAAA TCGGCAGCGT GGATTGCAAC
501 TGAAGGTGCG CAACAGATCA AGGATTTGGC ACTTGAACTT GTCGAGAAAA
551 ATGGCGGGAC CCACGATAAG GCTTTGGATT TAATCAGCGG CATGATGACC
601 ACCGGTCTGA ATTTTGCCCA AACCAAGAAT GAAGCGCAGG CGGCATATGC
651 TTTTGCACTT GCCTCAGAAG GCAGTGGCGA GGATACGGCA AAACTGATTA
```

-continued

701 AAACCCTGAA AGATGGCGGC ATGAGCGGTA AAGACCTGCA ACTCGGGCTT

751 GAGCACGTCT TGCAATCGGG TTTAGACGGC ACTTTCGAGG TGCGGGATAT

801 GGTTCGGGAG CTGCCGAGCC TGCTCTCTGC CGCGCAACAG GCAGGGATGA

851 ATGGTGTCGG CGGTTTGGAC TACCTGCTCT CACTCTTACA ATCTGCGGCG

901 AATAAATCGG GCAGTCCTGC CGAAGCGGCG ACTAATGTGC AAAATCTTTT

951 GAGTAAAACT CTGTCGCCTG ACACGATAGG TCGTCTGAAG AAGATGGCAA

1001 ATCCGAATGA CCCGAAGAAA GGTGTCGATT GGATAGGCTC GGTTGTGCAA

1051 GGCAAGCAAA ACGGCGAAAA CGCAGTGCAG GTGTTGTCCC GTCTTGCCGA

1101 TGCCATGCTA GTAAAGGATA AGCAATACCA AGATTATAAG AAACGCGCGG

1151 CTGCAGGCGA TAAGACGGCG GCGGAGCAGG CAAATATGCT TAAGGGCGCG

1201 CTTTTGGCGC AACTGCTGCC TGATTTGCAG GCAAAACAAG GTTTGCTGGC

1251 TGCAACGGAT ATGACGCAAA TCCGTGAATA TATGGCTTCG TTGGCTGGCG

1301 TAACGTTGGA TAACGGAAAA ATTGCTAAGA ACAACGAGGC GCGAATGTTG

1351 TCGGCAGCGG CGCAACAAGA GCAACAGGAA TCGCTGGCAA TGTTGCGGGA

1401 AAGTCTGACG GGAACATTGG TGGATATGGA AACCTCGTTT AAAAAGCTGG

1451 CAGCGGAATA CCCTAATGCC ACTCTAGCCC TGCAAGCATT GACGACGGCG

1501 GCAACAGCGG CGTCTGCCGC AATGTTATTA ACCGCCGGTG GCGGTAAAGG

1551 TGCAGGCTTT CTGAAAGATG TAGGTAGTAA AGCGTTGGGA TGGGGTAAGG

1601 CTTCCGCAGG CGGCGTGGCA GCAGGTGCCA CAGCGGCAGG CGGTAAGTTG

1651 CTGTCATGGG GAAAATCTGC CGGTAGCGGG CTCATGAATA ATCCAGCGTT

1701 AGTTAAACGG GCGGGTTTGT TAGGTATGTT GCTGTATTCC GAGTCTTTGG

1751 GTGACGGCAC ATTGCCAAAG GGTTTGCGTG GTACCAAGAC AACTCCTGAA

1801 ATGATTAATC GTCTGAAAAA CAACGGTATC CGATTTGAAC CTGCGCCGAA

1851 GCGGGAACAG GCGCGGGGTG GTGTCCCTCA GTATTTGGCT GCTCCGTCAG

1901 CGCAGCCTAC CGATAAGATG TTGTCTCCGT TGTTTTCAAC TCAGACGGCG

1951 GCGTATCAGG CAGCCATTCA GCAGCAGACG GCGGCGTATC AGGCAGCATT

2001 GGCGCAGGAT ACGGCTGCAG TTACAACAGG TTTGGCACAA GTGCAAAGTG

2051 CGATGGCGTC GGCAAGTCAG ACCATCAATA CCAATGTGAG CCTGAATATC

2101 GACGGACGTG TTATCGCGAA TGAGGTATCG CGGTATCAAG TGGCCATGTT

2151 CGGCCGTGGA GCGGGTCAAT AA

This corresponds to the amino acid sequence <SEQ ID 2428; ORF 719>:

m719.pep

1 MANGNMKLSL VLTARDDGAR RLLADTQRQL DRTAKSRAQL ERQSHTYALT

51 GIRSEKQIQR EIMLTQAAFN RLARSGKASQ NDLARAAVAT RNRIRELNAE

101 LKQGTGFADK MGKIGRFGAA AVAGGAAAYT VLKPAMDNRK QLDENINRVS

151 RQAFIEDNSK SAAWIATEGA QQIKDLALEL VEKNGGTHDK ALDLISGMMT

201 TGLNFAQTKN EAQAAYAFAL ASEGSGEDTA KLIKTLKDGG MSGKDLQLGL

251 EHVLQSGLDG TFEVRDMVRE LPSLLSAAQQ AGMNGVGGLD YLLSLLQSAA

-continued

```
301 NKSGSPAEAA TNVQNLLSKT LSPDTIGRLK KMANPNDPKK GVDWIGSVVQ
351 GKQNGENAVQ VLSRLADAML VKDKQYQDYK KRAAAGDKTA AEQANMLKGA
401 LLAQLLPDLQ AKQGLLAATD MTQIREYMAS LAGVTLDNGK IAKNNEARML
451 SAAAQQEQQE SLAMLRESLT GTLVDMETSF KKLAAEYPNA TLALQALTTA
501 ATAASAAMLL TAGGGKGAGF LKDVGSKALG WGKASAGGVA AGATAAGGKL
551 LSWGKSAGSG LMNNPALVKR AGLLGMLLYS ESLGDGTLPK GLRGTKTTPE
601 MINRLKNNGI RFEPAPKREQ ARGGVPQYLA APSAQPTDKM LSPLFSTQTA
651 AYQAAIQQQT AAYQAALAQD TAAVTTGLAQ VQSAMASASQ TINTNVSLNI
701 DGRVIANEVS RYQVAMFGRG AGQ*
```

a719.seq not found yet
a719.pep not found yet
g720.seq not found yet
g720.pep not found yet The following partial DNA sequence was identified in *N. meningitidis* <SEQ ID 2429>:

m720.seq

```
   1 ATGAGCGGAT GGCATACCTT ATTGCAGGAC GCATCTTACA AGGGCGTCGG
  51 CTTTGATATT GAGGTGGTGG ACGAGAGCAA CGGCAAGGCA TTGGCCGAGC
 101 ATGCGCGGCC GTTTGTGCAG GGTATCGACC TTGAAGACAT GGGCATGACC
 151 GGGCGGCAGG TGCAGATTAA TGCGGTGTTT TGGGGCAAGG GCTATGCAGG
 201 CCGTCTGAAA AAGCTGCTGG ATGCGCTGGA GCAGCCGGGC GGCGGCGTGC
 251 TGGTGCACCC TGTTTGGGGG CGGATGCACA ACATGATTGC GGCATCATGG
 301 AGTTACCGAC ATGAGGCCGA TTATGTGGAT TATGCGGGCA TCGATATTAC
 351 TTTCCGCGAG GCGGCCGAAG CGCAGGAAAT CTTTGTTTTT GAAAACGCCT
 401 TTTTGGTCGA GCTTGAGGCG TTGATTGCTA ATATCGACAC CTACCGCGAG
 451 GCGGCTATCG GCTTTGTTGA TGCGGTGTTG GCGGTGGATG CGGGCGTATC
 501 AGCTTTATGG GGCAGCGCGC TGGGCATTTG GAGTGCGGCA TCGGGTACGT
 551 TTGGCGCGGT GCGCCGTTTG TTTGATTTGG ACAAAATTGC CTTTCCCGAT
 601 CGGGGCGGAT ACAGTGCAGC GGCGTTTAAA AACGGCTCGG CCAAGCTGTT
 651 TGCGGATATA TCGGTCATGG TAGATACTGG CATACGCCGT GAGGCGGGTT
 701 TGGCCGATAA TGCCATGCAC CATGCCGGTT GGTCGCCGCG ACAGCGGTTT
 751 GACGGGGCTG CGGCTGTTGC CGACCGCGCC GCCGCTATCC CTGATAATTT
 801 GCTGACCGGC CGCTTTTCAG ACGGCCTGCA AAACCGCCTG AACCGGTTAA
 851 CCGCCAAACA GGTGCAGCCG GTAGCGCAGG CGGTGCGCCT GTTATCCACG
 901 TCATCGCTGT TGTCGGTGGC AACGGCATTA ATCGAGGCGC ATGGCGAAGA
 951 GATGACCGCG CCCGATTTGA TTGAGGTTAA CCGCGCCATG CGCCGCCGTA
1001 TGCAGGCCGA GATTGCCGCC TTGCGGGCGG TGCAGACGGC TGCTGCCGAG
1051 TCTGGTGGGC TGACGGCCAA CGCCGTGTAT ACCGAGGCTT ACCAAACGGC
1101 AGAATCCCTG CGCGCGGCGG CAGGCCGTCT GAATGCGTTG GTTGCGGCGG
1151 TCATCAACCA AAAGCCGCCG CTGATTGTGC GCCAAGCCCC AATCGACGGT
```

-continued

```
1201 ACGATACACC AAATCGCCCA CGAGTTTTAC GGCGATATAG CCCGCGCAGC
1251 AGAGCTGGTG CGGCTCAATC CCCATATCCA CCACCCCGCG TTTATCAAGC
1301 GCGGCACTTT GGTCAACAGC TATGCAAAAT AA
```

This corresponds to the amino acid sequence <SEQ ID 2430; ORF 720>:

m720.pep

```
  1 MSGWHTLLQD ASYKGVGFDI EVVDESNGKA LAEHARPFVQ GIDLEDMGMT
 51 GRQVQINAVF WGKGYAGRLK KLLDALEQPG GGVLVHPVWG RMHNMIAASW
101 SYRHEADYVD YAGIDITFRE AAEAQEIFVF ENAFLVELEA LIANIDTYRE
151 AAIGFVDAVL AVDAGVSALW GSALGIWSAA SGTFGAVRRL FDLDKIAFPD
201 RGGYSAAAFK NGSAKLFADI SVMVDTGIRR EAGLADNAMH HAGWSPRQRF
251 DGAAAVADRA AAIPDNLLTG RFSDGLQNRL NRLTAKQVQP VAQAVRLLST
301 SSLLSVATAL IEAHGEEMTA PDLIEVNRAM RRRMQAEIAA LRAVQTAAAE
351 SGGLTANAVY TEAYQTAESL RAAAGRLNAL VAAVINQKPP LIVRQAPIDG
401 TIHQIAHEFY GDIARAAELV RLNPHIHHPA FIKRGTLVNS YAK*
```

The following partial DNA sequence was identified in *N. meningitidis* <SEQ ID 2431>:

a720.seq (partial)

```
  1 GGCCTGCAAA ACCGCCTGAA CCGGTTAACC GCCAAACAGG TGCAGCCGGT
 51 AGCGCAGGCG GTGCGCCTGT TATCCACGTC ATCGCTGTTG TCGGTGGCAA
101 CGGCATTAAT CGAGGCGCAT GGCGAAGAGA TGACCGCGCC CGATTTGATT
151 GAGGTTAACC GCGCCATGCG CCGCCGTATG CAGGCCGAGA TTGCCGCCTT
201 ACGGGCGGTG CAGACGGCTG CTGCCGAGTC TGGTGGGCTG ACGGCCAACG
251 CCGTGTATAC CGAGGCTTAC CAAACGGCAG AATCCCTGCG CGCGGCGGCA
301 GGCCGTCTGA ATGCGTTGGT TGCGGCGGTC ATCAACCAAA AGCCGCCGCT
351 GATTGTGCGC CAAGCCCCAA TCGACGGTAC GATACACCAA ATCGCCCACG
401 AGTTTTACGG CGATATAGCC CGCGCAGCAG AGCTGGTGCG GCTCAATCCC
451 CATATCCACC ACCCCGCGTT TATCAAGCGC GGCACTTTGG TCAACAGCTA
501 TGCAAAATAA
```

This corresponds to the amino acid sequence <SEQ ID 2432; ORF 720.a>:

a720.pep (partial)

```
  1 GLQNRLNRLT AKQVQPVAQA VRLLSTSSLL SVATALIEAH GEEMTAPDLI
 51 EVNRAMRRRM QAEIAALRAV QTAAAESGGL TANAVYTEAY QTAESLRAAA
101 GRLNALVAAV INQKPPLIVR QAPIDGTIHQ IAHEFYGDIA RAAELVRLNP
151 HIHHPAFIKR GTLVNSYAK*
```

m720/a720 100.0% identity in 169 aa overlap

```
                250       260       270       280       290       300
m720.pep   SPRQRFDGAAAVADRAAAIPDNLLTGRFSDGLQNRLNRLTAKQVQPVAQAVRLLSTSSLL
                                             |||||||||||||||||||||||||||||
a720                                         GLQNRLNRLTAKQVQPVAQAVRLLSTSSLL
                                                     10        20        30

                310       320       330       340       350       360
m720.pep   SVATALIEAHGEEMTAPDLIEVNRAMRRRMQAEIAALRAVQTAAAESGGLTANAVYTEAY
           ||||||||||||||||||||||||||||||||||||||||||||||||||||||||||||
a720       SVATALIEAHGEEMTAPDLIEVNRAMRRRMQAEIAALRAVQTAAAESGGLTANAVYTEAY
                   40        50        60        70        80        90

                370       380       390       400       410       420
m720.pep   QTAESLRAAAGRLNALVAAVINQKPPLIVRQAPIDGTIHQIAHEFYGDIARAAELVRLNP
           |||||||||||||||||||||||||||||||||||||||||| ||||||||||||||||
a720       QTAESLRAAAGRLNALVAAVINQKPPLIVRQAPIDGTIHQIAHEFYGDIARAAELVRLNP
                  100       110       120       130       140       150

                430       440
m720.pep   HIHHPAFIKRGTLVNSYAKX
           ||||||||||||||||||||
a720       HIHHPAFIKRGTLVNSYAKX
                  160       170
```

g721.seq not found g721.pep not found

The following partial DNA sequence was identified in *N. meningitidis* <SEQ ID 2433>:

m721.seq

```
   1 ATGTCCAAAA ATGCACAAAA AACCCTACTT GCCGTGTGCA GTTTCGAGGT
  51 GCAGCCAAAA GACGGGCGAA TCCAACTGCT GCCATATGGC GAATTTCGCG
 101 CAGTAGACGG TCGTCCGACT GATGTCCCTG CGTGGTATCT GACCGAAGAA
 151 AACGGTCATG ATGTCGCGTT GTTGGCCAAC AGCTCGCGCA ATCAGTTGGT
 201 TGTCGATTAT GAACACCAGA CGCTCTACAA AGAGAAAAAC GGACAACCTG
 251 CACCTGCCGC CGGTTGGATG CGTTGGCTGG AGTTCACGCC TAAAGGCATG
 301 TTTGCCGAAG TGGAGTGGAC GGACAAGGCG GCTGCGGCAA TTGCCGCAAA
 351 AGAGTATCGC TACATCTCTG CTGTGTTTTC CTATGACACA AAGGGATATG
 401 TAAGCAAAAT TTTTCACGCC GCGCTGACAA ATTTCCCCGC GTTGGACGGT
 451 ATGGACGAGG TGCTGGCGGC AGCGTCGGCG CAAATTTTAA AACCGGAAAC
 501 GGAGCAAAAC CCTATGAAAG AGTTGTTACA GCAACTGTTC GACCTGCCTG
 551 ATGCGGGCGA AGAAGAACTG AAGGCGGCAT TGTCCGCGCT CGTGGAAGCC
 601 AAGCCGAAAG ACGTGGCATT GTCTGCCGAC GTGTTCGCGC AGCTGGCGGA
 651 AAAAGACAGC CGCATCGCGG CATTGACGGC GCAAACCGCC AAGCCTGATT
 701 TGACTAAATA CGCGCCTATC TCAGTGGTTC AAGAGCTGCA AAGCAAAGTC
 751 GCCGCGCTGA CTGCCAAGCA GGAAGCAGAC AAAGGCAACG AATTGATTAC
 801 CGCCGCGCTG ACTTCAGGCA AATTGCTGCC TGCTCAGAAG GAGTGGGCAA
 851 AAGGCGTATT GAAACAGCCG GGCGGCTTGG CATTTTTGAC CGGCTTTATT
 901 GAAAACGCCC AGCCGGTCGC TGCACTGGCA GGCTCGCAAA CGGGCGGCAA
 951 AGCACCCGAC GAACGCGTCG CCGCACTGAC TGCGGAAGAG GCAGCCGCAG
1001 CAAAAATGCT GGGCATGTCC GGCGAAGAAT TTGTAAAAAT CAAAGAAAGC
1051 GAAGGTAAGT AA
```

This corresponds to the amino acid sequence <SEQ ID 2434; ORF 721>:

m721.pep

```
  1 MSKNAQKTLL AVCSFEVQPK DGRIQLLPYG EFRAVDGRPT DVPAWYLTEE
 51 NGHDVALLAN SSRNQLVVDY EHQTLYKEKN GQPAPAAGWM RWLEFTPKGM
101 FAEVEWTDKA AAAIAAKEYR YISAVFSYDT KGYVSKIFHA ALTNFPALDG
151 MDEVLAAASA QILKPETEQN PMKELLQQLF DLPDAGEEEL KAALSALVEA
201 KPKDVALSAD VFAQLAEKDS RIAALTAQTA KPDLTKYAPI SVVQELQSKV
251 AALTAKQEAD KGNELITAAL TSGKLLPAQK EWAKGVLKQP GGLAFLTGFI
301 ENAQPVAALA GSQTGGKAPD ERVAALTAEE AAAAKMLGMS GEEFVKIKES
351 EGK*
```

The following partial DNA sequence was identified in *N. meningitidis* <SEQ ID 2435>:

a721.seq

```
   1 ATGTCCAAAA ATGCACAAAA AACCCTACTT GCCGTGTGCA GTTTCGAGGT
  51 GCAGCCAAAA GACGGGCGAA TCCAACTGCT GCCATATGGC GAATTTCGCG
 101 CAGTAGACGG TCGTCCGACT GATGTCCCTG CGTGGTATCT GACCGAAGAA
 151 AACGGTCATG ATGTCGCGTT GTTGGCCAAC AGCTCGCGCA ATCAGTTGGT
 201 TGTCGATTAT GAACACTAGA CGCTCTACAA AGAGAAAAAC GGACAACCTG
 251 CACCTGCCGC CGGTTGGATG CGTTGGCTGG AGTTCACGCC TAAAGGCATG
 301 TTTGCCGAAG TGGAGTGGAC GGACAAGGCG GCTGCGGCAA TTGCCGCAAA
 351 AGAGTATCGC TACATCTCTG CTGTGTTTTC CTATGACACA AAGGGATATG
 401 TAAGCAAAAT TTTTCACGCC GCGCTGACAA ATTTCCCCGC GTTGGACGGT
 451 ATGGACGAGG TGCTGGCGGC AGCGTCGGCG CAAATTTTAA AACCGGAAAC
 501 GGAGCAAAAC CCTATGAAAG AGTTGTTACA GCAACTGTTC GGTCTGCCTG
 551 ATGCGGGCGA AGAAGAACTG AAGGCGGCAT TGTCCGCGCT CGTGGAAGCC
 601 AAGCCGAAAG ACGTGGCATT GTCTGCCGAC GTGTTCGCGC AGCTGGCGGA
 651 AAAAGACAGC CGCATCGCGG CATTGACGGC GCAAACCGCC AAGCCTGATT
 701 TGACTAAATA CGCGCCTATC TCAGTGGTTC AAGAGCTGCA AAGCAAAGTC
 751 GCCGCGCTGA CTGCCAAGCA GGAAGCAGAC AAAGGCAACG AATTGATTAC
 801 CGCCGCGCTG ACTTCAGGCA AATTGCTGCC TGCTCAGAAG GAGTGGGCAG
 851 AAGGCGTATT GAAACAGCCG GGCGGCTTGG CATTTTTGAC CGGCTTTATT
 901 GAAAACGCCC AGCCGGTCGC TGCACTGGCA GGCTCGCAAA CGGGCGGTAA
 951 AGCACCCGAC GAACGCGTCG CCGCACTGAC TGCGGAAGAG GCAGCCGCAG
1001 CAAAAATGCT GGGCATGTCC GGCGAAGAAT TTGTAAAAAT CAAAGAAAGC
1051 GAAGGTAAGT AA
```

This corresponds to the amino acid sequence <SEQ ID 2436; ORF 721.a>:

a721.pep

```
  1 MSKNAQKTLL AVCSFEVQPK DGRIQLLPYG EFRAVDGRPT DVPAWYLTEE
 51 NGHDVALLAN SSRNQLVVDY EH*TLYKEKN GQPAPAAGWM RWLEFTPKGM
```

-continued

```
101 FAEVEWTDKA AAAIAAKEYR YISAVFSYDT KGYVSKIFHA ALTNFPALDG

151 MDEVLAAASA QILKPETEQN PMKELLQQLF GLPDAGEEEL KAALSALVEA

201 KPKDVALSAD VFAQLAEKDS RIAALTAQTA KPDLTKYAPI SVVQELQSKV

251 AALTAKQEAD KGNELITAAL TSGKLLPAQK EWAEGVLKQP GGLAFLTGFI

301 ENAQPVAALA GSQTGGKAPD ERVAALTAEE AAAAKMLGMS GEEFVKIKES

351 EGK*
```

a721/m721 99.2% identity in 353 aa overlap

```
                 10        20        30        40        50        60
a721.pep  MSKNAQKTLLAVCSFEVQPKDGRIQLLPYGEFRAVDGRPTDVPAWYLTEENGHDVALLAN
          ||||||||||||||||||||||||||||||||||||||||||||||||||||||||||||
m721      MSKNAQKTLLAVCSFEVQPKDGRIQLLPYGEFRAVDGRPTDVPAWYLTEENGHDVALLAN
                 10        20        30        40        50        60

                 70        80        90       100       110       120
a721.pep  SSRNQLVVDYEHXTLYKEKNGQPAPAAGWMRWLEFTPKGMFAEVEWTDKAAAAIAAKEYR
          |||||||||||| |||||||||||||||||||||||||||||||||||||||||||||||
m721      SSRNQLVVDYEHQTLYKEKNGQPAPAAGWMRWLEFTPKGMFAEVEWTDKAAAAIAAKEYR
                 70        80        90       100       110       120

                130       140       150       160       170       180
a721.pep  YISAVFSYDTKGYVSKIFHAALTNFPALDGMDEVLAAASAQILKPETEQNPMKELLQQLF
          ||||||||||||||||||||||||||||||||||||||||||||||||||||||||||||
m721      YISAVFSYDTKGYVSKIFHAALTNFPALDGMDEVLAAASAQILKPETEQNPMKELLQQLF
                130       140       150       160       170       180

                190       200       210       220       230       240
a721.pep  GLPDAGEEELKAALSALVEAKPKDVALSADVFAQLAEKDSRIAALTAQTAKPDLTKYAPI
           |||||||||||||||||||||||||||||||||||||||||||||||||||||||||||
m721      DLPDAGEEELKAALSALVEAKPKDVALSADVFAQLAEKDSRIAALTAQTAKPDLTKYAPI
                190       200       210       220       230       240

                250       260       270       280       290       300
a721.pep  SVVQELQSKVAALTAKQEADKGNELITAALTSGKLLPAQKEWAEGVLKQPGGLAFLTGFI
          |||||||||||||||||||||||||||||||||||||||||||:||||||||||||||||
m721      SVVQELQSKVAALTAKQEADKGNELITAALTSGKLLPAQKEWAKGVLKQPGGLAFLTGFI
                250       260       270       280       290       300

                 310       320       330       340       350
a721.pep   ENAQPVAALAGSQTGGKAPDERVAALTAEEAAAAKMLGMSGEEFVKIKESEGKX
          |||||||||||||||||||||||||||||||||||||||||||||||||||||||
m721       ENAQPVAALAGSQTGGKAPDERVAALTAEEAAAAKMLGMSGEEFVKIKESEGKX
                 310       320       330       340       350
```

g722.seq not found yet
g722.pep not found yet

The following partial DNA sequence was identified in *N. meningitidis* <SEQ ID 2437>:

m722.seq

```
  1 GTGTTTGAAA CGCCGACATT TGAGCAAATC CGCGAGCGTA TCCTGCGCGA

 51 TACCAAAAGC CTGTGGCCGG ATGCCGATAT CAGCCCCGAC AGCGACCATT

101 ATGTGCACGC CAGCCGTTTG GCCAGCTGCG CCGAAGGGCA ATATGCGCAT

151 CAAAGCTGGA TTGTGCGGCA GATTTTCCCT GATACCGCCG ACCGCGAGTA

201 TTTGGAGCGG CATGCCTCCA TGCGCGGCTT GAGCCGCCGC AATCCTACCA

251 CGGCCAGCGG CACGCTGACC GTAAGCGGTA TTGCGCAATC CATGCTTTCA

301 GACGACCTGC AAGTGCGTAT CGGCCAGCGT TTTTACCGCA CTACCGCCCG

351 CGCCGTTATC GGCAGCGGCG GCACGGCGGA AATACCGGCA ATCGCCGACG

401 AGCCGGGCGC GGCCGCCAAT GTGGGCGACG GCGAGGCGCA ACTGATGGCC

451 GCCCCCGCCG GTGTGGCCAC CGAATGCCGC CTTACCGTAC AAGGCGGCAC
```

-continued

```
 501 CGACCGAGAA AGCGATGCCT CACTGCTGGC GCGTCTGTTG GAAATCATCC

 551 GCCGACCGCC CGCAGGCGGC AACCGTTACG ACTATAAAAA CTGGGCGTTG

 601 AGTGTTGACG GCGTAACCAG CGCATATGTT TATCCGCTGC GCCGCGGCTT

 651 GGGTACGGTG GATATTGCCA TTACCTCCGC CGACGGTGTG TCGTCGGAAG

 701 AAACTGTGCG CCGCGTACAG GCTTATATCG ACGAGATGCG CCCGGTAACG

 751 GCAAAAAATG CGCTGGTACT CAAGCCAACC GTAACGGCGG TGCCTGTTAC

 801 CGTGCAAGTC AAGCTCGACG GTATCGACTT GGACGAGGCC AAGCGCCGCA

 851 TACGGACGGC CCTAAAAGAA TATTTCGACA CCCTGATCCC CGGCGACGGC

 901 CTGACTGTGT CGCAAATCGA GGCTGCTATC AGCAATGTGG ATGGTGTGAT

 951 CGACCGCCGT CTGACTGCGC CGACGGCCAA CCGTGCCGCC GATACGGTTA

1001 ACCGCATCGA GTGGTTTAAA GCGGGCGCGA TTAATGTAAC GGAGATGCCG

1051 TCATGA
```

This corresponds to the amino acid sequence <SEQ ID 2438; ORF 722>:

m722.pep

```
  1 VFETPTFEQI RERILRDTKS LWPDADISPD SDHYVHASRL ASCAEGQYAH

 51 QSWIVRQIFP DTADREYLER HASMRGLSRR NPTTASGTLT VSGIAQSMLS

101 DDLQVRIGQR FYRTTARAVI GSGGTAEIPA IADEPGAAAN VGDGEAQLMA

151 APAGVATECR LTVQGGTDRE SDASLLARLL EIIRRPPAGG NRYDYKNWAL

201 SVDGVTSAYV YPLRRGLGTV DIAITSADGV SSEETVRRVQ AYIDEMRPVT

251 AKNALVLKPT VTAVPVTVQV KLDGIDLDEA KRRIRTALKE YFDTLIPGDG

301 LTVSQIEAAI SNVDGVIDRR LTAPTANRAA DTVNRIEWFK AGAINVTEMP

351 S*
```

The following partial DNA sequence was identified in *N. meningitidis* <SEQ ID 2439>:

a722.seq

```
  1 GTGTTTGAAA CGCCGACATT TGAGCAAATC CGCGAGCGTA TCCTGCGCGA

 51 TACCAAAAGC CTGTGGCCGG ATGCCGATAT CAGCCCCGAC AGCGACCATT

101 ATGTGCACGC CAGCCGTTTG GCCAGCTGCG CCGAAGGGCA ATATGCGCAT

151 CAAAGCTGGA TTGTGCGGCA GATTTTCCCT GATACCGCCG ACCGCGAGTA

201 TTTGGAGCGG CATGCCTCCA TGCGCGGCTT GCGCCGCCGC AATCCTACCA

251 CGGCCAGCGG CACGCTGACC GTAAGCGGTA TTGCGCAATC CATGCTTTCA

301 GACGGCCTGC AAGTGCGTAT CGGCCAGCGT TTTTACCGCA CTACCGCCCG

351 CGCCGTTATC GGCAGCGGCG GCACGGCGGA AATACCGGCA ATCGCCGACG

401 AGCCGGGCGC GGCCGCCAAT GTGCGCGACG GCGAGGCGCA ACTGATGGCC

451 GCCCCCGCCG GTGTGTCCAC CGAATGCCGC CTTACCGTAC AAGGCGGCAC

501 CGACCGAGAA AGCGATGCCT CACTGCTGGC GCGTCTGTTG GAAATCATCC
```

-continued

```
 551 GCCGACCGCC CGCAGGCGGC AACCGTTACG ACTATAAAAA CTGGGCGTTG

 601 AGTGTTGACG GCGTAACCAG CGCATATGTT TATCCGCTGC GCCGCGGCTT

 651 GGGTACGGTG GATATTGCCA TTACCTCCGC CGACGGTGTG CCATCGGAAG

 701 AAACTGTGCG CCGCGTACAG GCTTATATCG ACGAGATGCG CCCGGTAACG

 751 GCAAAAAATG CGCTGGTACT CAAGCCAACC GTAACGGCGG TGCCTGTTAC

 801 CGTGCAAGTC AAGCTCGACG GCATCGACTT GGACGAGGCC AAGCGCCGCA

 851 TACGGACGGC CCTAAAAGAA TATTTCGACA CCCTGATCCC CGGCGACGGC

 901 CTGACTGTGT CGCAAATCGA GGCGGCTATC AGCAATGTGG ATGGTGTGAT

 951 CGACCTCCGT CTGACTGCGC CGACGGCCAA CCGTGCCGCC GATACGGTTA

1001 ACCGCATCGA GTGGTTTAAA GCGGGCGCGA TTAATGTAAC GGAGATGCCG

1051 TCATGA
```

This corresponds to the amino acid sequence <SEQ ID 2440; ORF 722.a>:

a722.pep

```
  1 VFETPTFEQI RERILRDTKS LWPDADISPD SDHYVHASRL ASCAEGQYAH

 51 QSWIVRQIFP DTADREYLER HASMRGLRRR NPTTASGTLT VSGIAQSMLS

101 DGLQVRIGQR FYRTTARAVI GSGGTAEIPA IADEPGAAAN VRDGEAQLMA

151 APAGVSTECR LTVQGGTDRE SDASLLARLL EIIRRPPAGG NRYDYKNWAL

201 SVDGVTSAYV YPLRRGLGTV DIAITSADGV PSEETVRRVQ AYIDEMRPVT

251 AKNALVLKPT VTAVPVTVQV KLDGIDLDEA KRRIRTALKE YFDTLIPGDG

301 LTVSQIEAAI SNVDGVIDLR LTAPTANRAA DTVNRIEWFK AGAINVTEMP

351 S*
```

g723.seq not found yet g723.pep not found yet

The following partial DNA sequence was identified in *N. meningitidis* <SEQ ID 2441>:

m723.seq

```
  1 ATGCGACCCA AGCCCCGTTT CAGACGGTCT GTTATCGCTT GCTCAATATC

 51 AGTGATCACG CCCGAACACC TTATTTTTAC CGTTTACAAA CACAATACCG

101 TCTTCGCCCG CGGCCACTTC TTCGCCGCTA TCATCCACGC CCAGCTGCAC

151 TTCGCCTTTG GCCATAGCAC GCAGCAGGTC GAGCACGTCG ATTTTGTAGC

201 GGTTGCGGAT TTCGTCGGTA ATCAACACGC CCTGAGCCGC CGTCAGACGG

251 TAGCGGGCAA TGTCGCAGCA AAGGCGCACC AAGATGGGCG GCAGATCCTC

301 AAAAGGTCGT CTGAACCGCC CCAGATACGC GTCGATTTCG GCAGTGGCGT

351 CCACCAGCGC GGTTTGTGCG ACCTCGCGGT CAATCAGCCC CTCGTTGTTG

401 CGGTCGGTGA GCTGCAAGAC TTCCAGCTCA CCGAAACGCG CAACCATATC

451 CTCAACCGTC GCGTATGCCA TTACTCGACC GCCTTGCGTT GCAGCATAGG

501 CTCGGCGCAG ATTGCCTTCC ACACCGCTTC GCCGACTTCG GCGCGCTTCA
```

-continued

```
551 CTTCGCGCCA GCCGCCGTCA AACAGCAGGC CGCCGCGCCA AAATTCTTTG

601 CCGTCTGCGC CGGTACTGAC GAGCATCACA TCGCGGCTGT CCGCCAAAGC

651 GTCGGCGGCA CGTTGCGTAT GCTGCACTTT GAGTTCGGCA AGTTCGGCGG

701 ACAGTGCCTT TTTGTCGTCT TCGGCTTTTT CCAAGGCTGT GGTCAGCATT

751 TCGACATCGT TTCGGGCGGC GGCAAGCTCT GCCTGCACGG CGTCCAATTC

801 GGCTTTGATG TCTTCAAACG ACGGGGCGGC GGTTTCGGCG GTTTCTGGTT

851 TGTTGTTGGT TTTTGCCATG ATGACTCCTT GTTTCAGACG GCGGCGGATT

901 CGCATTTGA
```

This corresponds to the amino acid sequence <SEQ ID 2442; ORF 723>:

m723.pep

```
  1 MRPKPRFRRS VIACSISVIT PEHLIFTVYK HNTVFARGHF FAAIIHAQLH

 51 FAFGHSTQQV EHVDFVAVAD FVGNQHALSR RQTVAGNVAA KAHQDGRQIL

101 KRSSEPPQIR VDFGSGVHQR GLCDLAVNQP LVVAVGELQD FQLTETRNHI

151 LNRRVCHYST ALRCSIGSAQ IAFHTASPTS ARFTSRQPPS NSRPPRQNSL

201 PSAPVLTSIT SRLSAKASAA RCVCCTLSSA SSADSAFLSS SAFSKAVVSI

251 STSFRAAASS ACTASNSALM SSNDGAAVSA VSGLLLVFAM MTPCFRRRRI

301 RI*
```

a723.seq not found yet
a723.pep not found yet
g724.seq not found yet
g724.pep not found yet The following partial DNA sequence, shown with its encoded amino acid sequence, was identified in *N. meningitidis* <SEQ ID 2443>:

m724.map

```
       ATGAGTTTGAGTAAATTGGCGAAAAAAACGGCACAAACTGCTAAAAATATCGGCGAAACC
   1   ---------+---------+---------+---------+---------+---------+  60
       TACTCAAACTCATTTAACCGCTTTTTTTGCCGTGTTTGACGATTTTTATAGCCGCTTTGG
a      M  S  L  S  K  L  A  K  K  T  A  Q  T  A  K  N  I  G  E  T   -

       CTGCGCGCGGCCTTTCGGGGAAAAATCACGCTGGTGGTGTCGTCCGAGCCGATACAGCGC
  61   ---------+---------+---------+---------+---------+---------+  120
       GACGCGCGCCGGAAAGCCCCTTTTTAGTGCGACCACCACAGCAGGCTCGGCTATGTCGCG
a      L  R  A  A  F  R  G  K  I  T  L  V  V  S  S  E  P  I  Q  R   -

       GTGCAGTTGAGCGGCTTGGCCGACGAAACCCTGCAAGACCTTGAACATTTGCAGGAATAC
 121   ---------+---------+---------+---------+---------+---------+  180
       CACGTCAACTCGCCGAACCGGCTGCTTTGGGACGTTCTGGAACTTGTAAACGTCCTTATG
a      V  Q  L  S  G  L  A  D  E  T  L  Q  D  L  E  H  L  Q  E  Y   -

       GGCTTTGCCAGCCATCCGCCCGACGGCAGCGAAGCGGTAGTGATACCGCTGGGCGGCAAT
 181   ---------+---------+---------+---------+---------+---------+  240
       CCGAAACGGTCGGTAGGCGGGCTGCCGTCGCTTCGCCATCACTATGGCGACCCGCCGTTA
a      G  F  A  S  H  P  P  D  G  S  E  A  V  V  I  P  L  G  G  N   -

       ACTTCGCACGGTGTGATTGTGTGCAGCCAGCACGGCAGCTACCGCATCAAAAACCTTAAG
 241   ---------+---------+---------+---------+---------+---------+  300
       TGAAGCGTGCCACACTAACACACGTCGGTCGTGCCGTCGATGGCGTAGTTTTTGGAATTC
a      T  S  H  G  V  I  V  C  S  Q  H  G  S  Y  R  I  K  N  L  K   -

       CCCGGCGAGACGGCGATTTTTAATCATGAGGGTGCAAAAATCGTGATTAAGCAAGGCAAA
 301   ---------+---------+---------+---------+---------+---------+  360
       GGGCCGCTCTGCCGCTAAAAATTAGTACTCCCACGTTTTTAGCACTAATTCGTTCCGTTT
a      P  G  E  T  A  I  F  N  H  E  G  A  K  I  V  I  K  Q  G  K   -
```

-continued

```
         ATCATTGAGGCCGATTGCGACGTGTACCGGGTTAACTGCAAACAATACGAGGTTAATGCG
    361  ---------+---------+---------+---------+---------+---------+  420
         TAGTAACTCCGGCTAACGCTGCACATGGCCCAATTGACGTTTGTTATGCTCCAATTACGC
a        I  I  E  A  D  C  D  V  Y  R  V  N  C  K  Q  Y  E  V  N  A   -

         GCCACGGATGCCAAATTTAACGCTCCGTTGGTGGAGACCAGTGCAGTGTTGACGGCGCAA
    421  ---------+---------+---------+---------+---------+---------+  480
         CGGTGCCTACGGTTTAAATTGCGAGGCAACCACCTCTGGTCACGTCACAACTGCCGCGTT
a        A  T  D  A  K  F  N  A  P  L  V  E  T  S  A  V  L  T  A  Q   -

         GGCCAAATCAACGGCAACGGCGGCATGGCCGTCGAGGGCGGCGACGGAGCCACCTTTAGC
    481  ---------+---------+---------+---------+---------+---------+  540
         CCGGTTTAGTTGCCGTTGCCGCCGTACCGGCAGCTCCCGCCGCTGCCTCGGTGGAAATCG
a        G  Q  I  N  G  N  G  G  M  A  V  E  G  G  D  G  A  T  F  S   -

         GGCGATGTTAACCAAACGGGCGGCAGCTTTAACACCGACGGCGACGTGGTGGCCGGCAAT
    541  ---------+---------+---------+---------+---------+---------+  600
         CCGCTACAATTGGTTTGCCCGCCGTCGAAATTGTGGCTGCCGCTGCACCACCGGCCGTTA
a        G  D  V  N  Q  T  G  G  S  F  N  T  D  G  D  V  V  A  G  N   -

         ATATCGTTGCGCCAGCACCCGCATACCGACAGCATCGGCGGCAAAACCTTACCGGCGGAA
    601  ---------+---------+---------+---------+---------+---------+  660
         TATAGCAACGCGGTCGTGGGCGTATGGCTGTCGTAGCCGCCGTTTTGGAATGGCCGCCTT
a        I  S  L  R  Q  H  P  H  T  D  S  I  G  G  K  T  L  P  A  E   -

         CCGGCATAG
    661  ---------  669
         GGCCGTATC
a        P  A  *    -
```

Enzymes that do cut: NONE

Enzymes that do not cut: BamHI BglII EcoRI HindIII KpnI NdeI NheI PstI SacI SalI SmaI SphI XbaI XhoI This corresponds to the amino acid sequence <SEQ ID 2444; ORF 724>:

m724.pep

```
  1 MSLSKLAKKT AQTAKNIGET LRAAFRGKIT LVVSSEPIQR VQLSGLADET
 51 LQDLEHLQEY GFASHPPDGS EAVVIPLGGN TSHGVIVCSQ HGSYRIKNLK
101 PGETAIFNHE GAKIVIKQGK IIEADCDVYR VNCKQYEVNA ATDAKFNAPL
151 VETSAVLTAQ GQINGNGGMA VEGGDGATFS GDVNQTGGSF NTDGDVVAGN
201 ISLRQHPHTD SIGGKTLPAE PA*
```

The following partial DNA sequence was identified in *N. meningitidis* <SEQ ID 2445>:

a724.seq

```
  1 ATGAGTTTGA GTAAATTGGC GAAAAAAACG GCACAAACTG CTAAAAATAT
 51 CGGCGAAACC CTGCGCGCGG CCTTTCGGGG AAAAATCACG CTGGTGGTGT
101 CGTCCGAGCC GATACAGCGC GTGCAGTTGA GCGGCTTGGC CGACGAAACC
151 CTGCAAGACC TTGAACATTT GCAGGAATAC GGCTTTGCCA GCCATCCGCC
201 CGACGGCAGC GAAGCGGTAG TGATACCGCT GGGCGGCAAT ACTTCGCACG
251 GTGTGATTGT GTGCAGCCAG CACGGCAGCT ACCGCATCAA AAACCTTAAG
301 CCCGGCGAGA CGGCGATTTT TAATCATGAG GGTGCAAAAA TCGTGATTAA
351 GCAAGGCAAA ATCATTGAGG CCGATTGCGA CGTGTACCGG GTTAACTGCA
401 AACAATACGA GGTTAATGCG GCCACGGATG CCAAATTTAA CGCTCCGTTG
451 GTGGAGACCA GTGCAGTGTT GACGGCGCAA GGCCAAATCA ACGGCAACGG
501 CGGCATGGCC GTCGAGGGCG GCGACGGAGC CACCTTTAGC GGCGATGTTA
551 ACCAAACGGG CGGCAGCTTT AACACCGACG GCGACGTGGT GGCCGGCAAT
```

-continued

```
601 ATATCGTTGC GCCAGCACCC GCATACCGAC AGCATCGGCG GCAAAACCTT

651 ACCGGCGGAA CCGGCATAG
```

This corresponds to the amino acid sequence <SEQ ID 2446; ORF 724.a>:

a724.pep

```
  1 MSLSKLAKKT AQTAKNIGET LRAAFRGKIT LVVSSEPIQR VQLSGLADET

 51 LQDLEHLQEY GFASHPPDGS EAVVIPLGGN TSHGVIVCSQ HGSYRIKNLK

101 PGETAIFNHE GAKIVIKQGK IIEADCDVYR VNCKQYEVNA ATDAKFNAPL

151 VETSAVLTAQ GQINGNGGMA VEGGDGATFS GDVNQTGGSF NTDGDVVAGN

201 ISLRQHPHTD SIGGKTLPAE PA*
```

a724/m724 100.0% identity in 222 aa overlap

```
                  10        20        30        40        50        60
a724.pep  MSLSKLAKKTAQTAKNIGETLRAAFRGKITLVVSSEPIQRVQLSGLADETLQDLEHLQEY
          ||||||||||||||||||||||||||||||||||||||||||||||||||||||||||||
m724      MSLSKLAKKTAQTAKNIGETLRAAFRGKITLVVSSEPIQRVQLSGLADETLQDLEHLQEY
                  10        20        30        40        50        60
a724.pep          70        80        90       100       110       120
          GFASHPPDGSEAVVIPLGGNTSHGVIVCSQHGSYRIKNIKPGETAIFNHEGAKIVIKQGK
m724      ||||||||||||||||||||||||||||||||||||||||||||||||||||||||||||
          GFASHPPDGSEAVVIPLGGNTSHGVIVCSQHGSYRIKNLKPGETAIFNHEGAKIVIKQGK
                  70        80        90       100       110       120
                 130       140       150       160       170       180
a724.pep  IIEADCDVYRVNCKQYEVNAATDAKFNAPLVETSAVLTAQGQINGNGGMAVEGGDGATFS
          ||||||||||||||||||||||||||||||||||||||||||||||||||||||||||||
m724      IIEADCDVYRVNCKQYEVNAATDAKFNAPLVETSAVLTAQGQINGNGGMAVEGGDGATFS
                 130       140       150       160       170       180
                 190       200       210       220
a724.pep  GDVNQTGGSFNTDGDVVAGNISLRQHPHTDSIGGKTLPAEPAX
          ||||||||||||||||||||||||||||||||||||||||||
m724      GDVNQTGGSFNTDGDVVAGNISLRQHPHTDSIGGKTLPAEPAX
                 190       200       210       220
```

g725.seq not found yet
g725.pep not found yet

The following partial DNA sequence was identified in *N. meningitidis* <SEQ ID 2447>:

m725.seq

```
  1 ATGGTGCGCA CGGTTAAAAG CTACAACGGC GAGGCCGACG ATTTGGCGGG

 51 GCAAATCCAT ACGCTGCCTG CGGTTTGGGT AACGTATGGC GGCAGCAAAG

101 TTGAGCCTGC CAGCACCGGC GGCGTATGCG GACGTTATCA GGATACCGCC

151 GAATTTGTGG TGATGGTGGC GGCCCGCAAT CTGCGCAACG AGCAGGCGCA

201 GCGGCAAGGC GGCATCGACA GCCGCGAAAT CGGCAGCAAC GATTTAATCC

251 GCGCTGTTCG CCGCCTGCTT GACGGCCAGC GGCTCGGTTT TGCCGATAGC

301 CGCGGCTTGG TGCCCAAAGC GGTGCGCGCG ATTGCCAATC ATGTGCTGGT

351 GCAAAACGCC GCAGTAAGCA TATATGCGGT TGAGTATGCC ATCCGCTTTA

401 ACACCTGCGG GTTGGAAAAT GACCGCTACC CCGAACGCAC CGACAATCCC
```

-continued

```
451 GACGACCCCA ACCATATCTT TACCAAGTAT CAGGGTACAT TGAGCGAGCC

501 GTGGCCTGAT TTCGAGGGGT TGGACGGCAC AATTTACGAC CCGCAATCCG

551 CCGATGAAAT ACCTGTAAAC CTAACCCTTA AGGATAAGCA ATGA
```

This corresponds to the amino acid sequence <SEQ ID 2448; ORF 725>:

m725.pep

```
  1 MVRTVKSYNG EADDLAGQIH TLPAVWVTYG GSKVEPASTG GVCGRYQDTA

 51 EFVVMVAARN LRNEQAQRQG GIDSREIGSN DLIRAVRRLL DGQRLGFADS

101 RGLVPKAVRA IANHVLVQNA AVSIYAVEYA IRFNTCGLEN DRYPERTDNP

151 DDPNHIFTKY QGTLSEPWPD FEGLDGKIYD PQSADEIPVN LTLKDKQ*
```

a725.seq not found yet
a725.pep not found yet
g726.seq not found yet
g726.pep not found yet The following partial DNA sequence was identified in *N. meningitidis* <SEQ ID 2449>:

m726.seq

```
  1 ATGACCATCT ATTTCAAAAA CGGCTTTTAC GACGACACAT TGGGCGGCAT

 51 CCCCGAAGGC GCGGTTGCCG TCCGCGCCGA AGAATACGCC GCCCTTTTGG

101 CAGGACAGGC GCAGGGCGGG CAGATTGCCG CAGATTCCGA CGGCCGCCCC

151 GTTTTAACCC CGCCGCGCCC GTCCGATTAC CACGAATGGG ACGGCAAAAA

201 ATGGAAAATC AGCAAAGCCG CCGCCGCCGC CCGTTTCGCC AAACAAAAAA

251 CCGCCTTGGC ATTCCGCCTC GCGGAAAAGG CGGACGAACT CAAAAACAGC

301 CTCTTGGCGG GCTATCCCCA AGTGGAAATC GACAGCTTTT ACAGGCAGGA

351 AAAAGAAGCC CTCGCGCGGC AGGCGGACAA CAACGCCCCG ACCCCGATGC

401 TGGCGCAAAT CGCCGCCGCA AGGGGCGTGG AATTGGACGT TTTGATTGAA

451 AAAGTTATCG AAAAATCCGC CCGCCTGGCT GTTGCCGCCG GCGCGATTAT

501 CGGAAAGCGT CAGCAGCTCG AAGACAAATT GAACACCATC GAAACCGCGC

551 CCGGATTGGA CGCGCTGGAA AAGGAAATCG AAGAATGGAC GCTAAACATC

601 GGCTGA
```

This corresponds to the amino acid sequence <SEQ ID 2450; ORF 726>:

m726.pep

```
  1 MTIYFKNGFY DDTLGGIPEG AVAVRAEEYA ALLAGQAQGG QIAADSDGRP

 51 VLTPPRPSDY HEWDGKKWKI SKAAAAARFA KQKTALAFRL AEKADELKNS

101 LLAGYPQVEI DSFYRQEKEA LARQADNNAP TPMLAQIAAA RGVELDVLIE

151 KVIEKSARLA VAAGAIIGKR QQLEDKLNTI ETAPGLDALE KEIEEWTLNI

201 G*
```

The following partial DNA sequence was identified in *N. meningitidis* <SEQ ID 2451>:

a726.seq

```
  1 ATGACCATCT ATTTCAAAAA CGGCTTTTAC GACGACACCT TGGGCAGCAT
 51 CCCCGAAGGC GCGGTTGCCG TCCGCGCCGA AGAATACGCC GCCCTTTTGG
101 CAGGACAGGC GCAGGGCGGG CAGATTGCCG CAGATTCCGA CGGCCGCCCC
151 GTTTTAACCC CGCCGCGCCC GTCCGAATAC CACGAATGGG ACGGCAAGAA
201 ATGGGAAATC GGCGAAGCCG CTGCCGCCGC CCGTTTCGCC GAACAAAAAA
251 CCGCCACGGC ATTCCGCCTC GCGGCAAAGG CGGACGAACT CAAAAACAGC
301 CTCTTGGCGG GCTATCCCCA AGTGGAAATC GACAGCTTTT ACAGGCAGGA
351 AAAAGAAGCC CTCGCGCGGC AGGCGGACAA CAACGCCCCG ACCCCGATGC
401 TGGCGCAAAT CGCCGCCGCA AGGGGCGTGG AATTGGACGT TTTGATTGAA
451 AAAGTTGTCG AAAAATCCGC CCGCCTGGCC GTTGCCGCCG GCGCGATTAT
501 CGGAAAGCGG CAGCAGCTCG AAGACAAATT GAACACCATC GAAACCGCGC
551 CAGGATTGGA CGCGCTGGAA AAGGAAATCG AAGAATGGAC GCTAAACATC
601 GGCTGA
```

This corresponds to the amino acid sequence <SEQ ID 2452; ORF 726.a>:

a726.pep

```
  1 MTIYFKNGFY DDTLGSIPEG AVAVRAEEYA ALLAGQAQGG QIAADSDGRP
 51 VLTPPRPSEY HEWDGKKWEI GEAAAAARFA EQKTATAFRL AAKADELKNS
101 LLAGYPQVEI DSFYRQEKEA LARQADNNAP TPMLAQIAAA RGVELDVLIE
151 KVVEKSARLA VAAGAIIGKR QQLEDKLNTI ETAPGLDALE KEIEEWTLNI
201 G*
```

a726/m726 95.5% identity in 201 aa overlap

```
                   10        20        30        40        50        60
a726.pep   MTIYFKNGFYDDTLGSIPEGAVAVRAEEYAALLAGQAQGGQIAADSDGRPVLTPPRPSEY
           |||||||||||||||:||||||||||||||||||||||||||||||||||||||||||:|
m726       MTIYFKNGFYDDTLGGIPEGAVAVRAEEYAALLAGQAQGGQIAADSDGRPVLTPPRPSDY
                   10        20        30        40        50        60
a726.pep           70        80        90       100       110       120
           HEWDGKKWEIGEAAAAARFAEQKTATAFRLAAKADELKNSLLAGYPQVEIDSFYRQEKEA
m726       ||||||||:|::||||||||:|||| ||||| ||||||||||||||||||||||||||||
           HEWDGKKWKISKAAAAARFAKQKTALAFRLAEKADELKNSLLAGYPQVEIDSFYRQEKEA
                   70        80        90       100       110       120

                  130       140       150       160       170       180
a726.pep   LARQADNNAPTPMLAQIAAARGVELDVLIEKVVEKSARLAVAAGAIIGKRQQLEDKLNTI
           ||||||||||||||||||||||||||||||||:|||||||||||||||||||||||||||
m726       LARQADNNAPTPMLAQIAAARGVELDVLIEKVIEKSARLAVAAGAIIGKRQQLEDKLNTI
                  130       140       150       160       170       180

                  190       200
a726.pep   ETAPGLDALEKEIEEWTLNIGX
           ||||||||||||||||||||||
m726       ETAPGLDALEKEIEEWTLNIGX
                  190       200
```

g727.seq not found yet g727.pep not found yet

The following partial DNA sequence was identified in *N. meningitidis* <SEQ ID 2453>:

m727.seq

```
  1 ATGAATCTCG TGAAACTGCT GGCGAATAAC TGGCAACCGA TTGCCATTAT
 51 CGCGCTTGTC GGCACGGGCT TGGCTGTGTC GCACCATCAA GGCTACAAGT
101 CGGCATTTGC GAAGCAGCAG GCGGTCATCG ACAAGATGGA GCGCGACAAG
151 GCGCAAGCCC TGCTGTTGTC GGCTCAAAAC TATGCGCGCG AACTGGAACT
201 GGCACGCGCG GAAGCTAAAA AATATGAAGT CAAGGCGCAC GCTGTCGGCA
251 TGGCTTTGGC GAAAAAACAG GCGGAAGTCA GCCGTCTGAA AACGGAAAGA
301 GACCTTTGCA AAATTCCTTT CCCTCCCGAC AGCCGAAACC CAAACACAGG
351 TTTTCGGCTG TTTTCGCCCC AAATACCGCC TAATTTTACC CAAATACCCC
401 CTTAA
```

This corresponds to the amino acid sequence <SEQ ID 2454; ORF 727>:

m727.pep

```
  1 MNLVKLLANN WQPIAIIALV GTGLAVSHHQ GYKSAFAKQQ AVIDKMERDK
 51 AQALLLSAQN YARELELARA EAKKYEVKAH AVGMALAKKQ AEVSRLKTER
101 DLCKIPFPPD SRNPNTGFRL FSPQIPPNFT QIPP*
```

The following partial DNA sequence was identified in *N. meningitidis* <SEQ ID 2455>:

a727.seq

```
  1 ATGAATCTCG TGAAACTGCT GGCGAATAAC TGGCAACCGA TTGCCATCAT
 51 CGCGCTTGTC GGCACGGGTT TGGCGGTGTC GCACCATCAA GGCTACAAGT
101 CGGCTTTTGC GAAGCAGCAG GCGGTCATTG AGAAAATGAA GCGCGACAAG
151 GCGCAAGCCC TGCTGTTGTC GGCTCAAAAC TACGCCCGCG AACTGGAACA
201 GGCGCGTGCG GAAGCTAAAA AATATGAAGT CAAGGCGCAC GCCGTCGGCA
251 TGGCTTTGGC GAAAAAACAG GCGGAAGTCA GCCGTCTGAA AACGGAAAAT
301 AAAAAGGAAA TCGAAAATGT CCTTACTCAA GACCGTAAAA ATGCAGGCGG
351 CGGTTGTATT GACGGCTTTG GCCATCACGG CTTGCAGCTC TACAAGCGCG
401 CCCTCGGCTA CGGAAATTAA
```

This corresponds to the amino acid sequence <SEQ ID 2456; ORF 727.a>:

a727.pep

```
  1 MNLVKLLANN WQPIAIIALV GTGLAVSHHQ GYKSAFAKQQ AVIEKMKRDK
 51 AQALLLSAQN YARELEQARA EAKKYEVKAH AVGMALAKKQ AEVSRLKTEN
101 KKEIENVLTQ DRKNAGGGCI DGFGHHGLQL YKRALGYGN*
```

a727/m727 83.2% identity in 119 aa overlap

```
                      10        20        30        40        50        60
a727.pep      MNLVKLLANNWQPIAIIALVGTGLAVSHHQGYKSAFAKQQAVIEKMKRDKAQALLLSAQN
              |||||||||||||||||||||||||||||||||||||||||||:||:|||||||||||||
m727          MNLVKLLANNWQPIAIIALVGTGLAVSHHQGYKSAFAKQQAVIDKMERDKAQALLLSAQN
                      10        20        30        40        50        60

                      70        80        90       100       110       119
a727.pep      YARELEQARAEAKKYEVKAHAVGMALAKKQAEVSRLKTENKKEIENV-LTQDRKNAGGGC
              |||||| ||||||||||||||||||||||||||||||||  ::: :: :  | :| : |
m727          YARELELARAEAKKYEVKAHAVGMALAKKQAEVSRLKTE--RDLCKIPFPPDSRNPNTGF
                      70        80        90         100       110

            120       130       140
a727.pep      IDGFGHHGLQLYKRALGYGNX

m727          RLFSPQIPPNETQIPPX
             120       130
```

The following partial DNA sequence was identified in *N. gonorrhoeae* <SEQ ID 2457>:

g728.seq

```
   1 ATGTTTAAAA AATTCAAACC GGTACTGTTG TCATTTTTTG CACTTGTATT
  51 TGCCTTTTGG CTGGGAACAG GTATTGCCTA TGAGATTAAT CCGCGTTGGT
 101 TTTTGAGCGA TACGGCAACT GAAGTACCTG AAAATCCGAA TGCTTTTGTG
 151 GCGAAACTTG CCCGCCTGTT CCGAAATGCC GACAGGGCGG TTGTCATCGT
 201 GAAGGAATCG ATGAGGACGG AGGAAAGCCT TGCCGGAGCT GTGGATGACG
 251 GTCCGTTGCA GTCGGAGAAG GATTATCTCG CGCTCGCTAT CCGGCTCAGT
 301 CGTTTGAAAG AAAAGGCGAA ATGGTTTCAC GTAACGGAGC AGGAACATGG
 351 GGAAGAGGTT TGGCTGGATT ACTATATCGG CGAGGGCGGT TTGGTTGCGG
 401 TTTCGCTTTC GCAACGCTCG CCGGAAGCGT TTGTTAATGC CGAATATCTG
 451 TATCGGAACG ATCGTCCGTT TTCTGTAAAT GTGTACGGCG GAACGGCTCA
 501 CGGGGAAAAT TATGAAACGA CAGGAGAATA TCGGGTTGTT TGGCAACCGG
 551 ACGGTTCGGT ATTTGATGCG GCGGGGCGCG GGAAAATCGG GGAAGATGTT
 601 TATGAGCATT GCCTCGGGTG TTATCAGATG GCCCAGGTAT ATTTGGCGAA
 651 ATACCGGGAT GTCGCGAATG ACGAGCAGAA GGTTTGGGAC TTCCGCGAAG
 701 AGAGCAACCG GATTGCATCG GACTCGCGCG ATTATGTGTT TTATCAGAAT
 751 ATGCGGGAAT TGATGCCCCG GGGGATGAAG GCGAACAGTC TTGTGGTCGG
 801 CTATGATGCG GACGGTCTGC CGCAAAAAGT CTATTGGAGT TTCGACAATG
 851 GAAAAAAACG CCAGAGTTTC GAATATTATT TGAAAAACGG AAATCTTTTT
 901 ATTGCACAAT CTTCGACGGT AGCATTGAAA GCGGATGGCG TAACGGCGGA
 951 TATGCAGACC TATCATGCGC AACAGACGTG GTATTTGGAT GGCGGGCGGA
1001 TTATCCGCGA AGAGAAACAG GGAGACAGAC TGCCTGATTT TCCTTTGAAC
1051 TTGGAAGATT TGGAAAAAGA GGTGAGCCGT TATGCAGAGG CTGCGGCGAG
1101 ACGTTCGGGC GGCAGGCGCG GCCTTTCTCA CTGA
```

This corresponds to the amino acid sequence <SEQ ID 2458; ORF 728>:

g728.pep

```
  1 MFKKFKPVLL SFFALVFAFW LGTGIAYEIN PRWFLSDTAT EVPENPNAFV
 51 AKLARLFRNA DRAVVIVKES MRTEESLAGA VDDGPLQSEK DYLALAIRLS
101 RLKEKAKWFH VTEQEHGEEV WLDYYIGEGG LVAVSLSQRS PEAFVNAEYL
151 YRNDRPFSVN VYGGTAHGEN YETTGEYRVV WQPDGSVFDA AGRGKIGEDV
201 YEHCLGCYQM AQVYLAKYRD VANDEQKVWD FREESNRIAS DSRDYVFYQN
251 MRELMPRGMK ANSLVVGYDA DGLPQKVYWS FDNGKKRQSF EYYLKNGNLF
301 IAQSSTVALK ADGVTADMQT YHAQQTWYLD GGRIIREEKQ GDRLPDFPLN
351 LEDLEKEVSR YAEAAARRSG GRRGLSH*
```

The following partial DNA sequence was identified in *N. meningitidis* <SEQ ID 2459>:

m728.seq

```
   1 ATGTTTAAAA AATTCAAACC GGTACTGTTG TCATTTTTTG CACTTGTATT
  51 TGCCTTTTGG CTGGGAACGG GTATTGCCTA TGAGATTAAT CCGCGTTGGT
 101 TTTTGAGCGA TACGGCAACT GAAGTACCTA AAAATCCGAA TGCTTTTGTG
 151 GCGAAACTTG CCCGCCTGTT CCGAAATGCC GACAGGGCGG TTGTCATCGT
 201 GAAGGAATCG ATAAGGACGG AGGAAAATCT TGCCGGAACT GTGGATGACG
 251 GTCCGTTGCA GTCGGAGAAG GATTATCTCG CGCTCGCTAT CCGGCTCAGT
 301 CGTTTGAAAG AAAAGGCGAA ATGGTTTCAC GTAACGGAGC AGGAACATGG
 351 GAAAGAGGTT TGGCTGGATT ACCATATCGG CGAGGGCGGT TTGGTTGCGG
 401 TTTCGCTTTC GCAACGCTCG CCGGAAGCAT TTGTTAATGC CGAATATCTG
 451 TATCGGAACG ATCGTCCGTT TTCTGTAAAT GTGTACGGCG GAACGGTTCA
 501 CGGGGAAAAT TATGAAACGA CAGGAGAATA TCGGGTTGTT TGGCAACCAG
 551 ACGGTTCGGT ATTTGATGCG GCGGGGCGCG GGAAAATCGG GGAAGATGTT
 601 TATGAGCATT GCCTCGGGTG TTATCAGATG GCCCAGGTAT ATTTGGCGAA
 651 ATACCGGGAT GTCGCGAATG ACGAGCAGAA GGTTTGGGAC TTCCGCAAAG
 701 AGAGCAACCG AATTGCGTCG GACTCGCGCA ATTCTGTGTT TTATCAGAAT
 751 ATGCGGGAAT TGATGCCCCG AGGGATGAAG GCGAACAGTC TTGTGGTCGG
 801 CTATGATGCG GACGGTCTGC CGCAAAAAGT CTATTGGAGT TTCGACAATG
 851 GAAAAAAACG CCAGAGTTTC GAATATTATT TGAAAAACGG AAATCTTTTT
 901 ATTGCACAAT CTTCGACGGT AGCATTGAAA GCGGATGGCG TAACGGCGGA
 951 TATGCAGACC TATCATGCGC AACAGACGTG GTATTTGGAT GGCGGGCGGA
1001 TTGTCCGCGA AGAGAAACAG GGAGACAGAC TGCCTGATTT TCCTTTGAAC
1051 TTGGAAAATT TGGAAAAAGA GGTGCGCCGT TATGCAGAGG CTGCGGCGAG
1101 ACGTTCGGGC GGCAGGCGCG ACCTTTCTCA CTGA
```

This corresponds to the amino acid sequence <SEQ ID 2460; ORF 728>:

m728.pep

```
  1 MFKKFKPVLL SFFALVFAFW LGTGIAYEIN PRWFLSDTAT EVPKNPNAFV

 51 AKLARLFRNA DRAVVIVKES IRTEENLAGT VDDGPLQSEK DYLALAIRLS

101 RLKEKAKWFH VTEQEHGKEV WLDYHIGEGG LVAVSLSQRS PEAFVNAEYL

151 YRNDRPFSVN VYGGTVHGEN YETTGEYRVV WQPDGSVFDA AGRGKIGEDV

201 YEHCLGCYQM AQVYLAKYRD VANDEQKVWD FRKESNRIAS DSRNSVFYQN

251 MRELMPRGMK ANSLVVGYDA DGLPQKVYWS FDNGKKRQSF EYYLKNGNLF

301 IAQSSTVALK ADGVTADMQT YHAQQTWYLD GGRIVREEKQ GDRLPDFPLN

351 LENLEKEVRR YAEAAARRSG GRRDLSH*
```

Computer analysis of the amino acid sequences gave the following results:

Homology with a predicted ORF from *N. meningitidis* menA with menB

ORF 728 shows 96.3% identity over a 377 aa overlap with a predicted ORF (ORF728.a) from *N. gonorrhoeae*:

m728/g728

```
                    10        20        30        40        50        60
m728.pep    MFKKFKPVLLSFFALVFAFWLGTGIAYEINPRWFLSDTATEVPKNPNAFVAKLARLFRNA
            |||||||||||||||||||||||||||||||||||||||||||:||||||||||||||||
g728        MFKKFKPVLLSFFALVFAFWLGTGIAYEINPRWFLSDTATEVPENPNAFVAKLARLFRNA
                    10        20        30        40        50        60

                    70        80        90       100       110       120
m728.pep    DRAVVIVKESIRTEENLAGTVDDGPLQSEKDYLALAIRLSRLKEKAKWFHVTEQEHGKEV
            ||||||||||:||||:||||:||||||||||||||||||||||||||||||||||||:||
g728        DRAVVIVKESMRTEESLAGAVDDGPLQSEKDYLALAIRLSRLKEKAKWFHVTEQEHGEEV
                    70        80        90       100       110       120

                   130       140       150       160       170       180
m728.pep    WLDYHIGEGGLVAVSLSQRSPEAFVNAEYLYRNDRPFSVNVYGGTVHGENYETTGEYRVV
            ||||:||||||||||||||||||||||||||||||||||||||||:||||||||||||||
g728        WLDYYIGEGGLVAVSLSQRSPEAFVNAEYLYRNDRPFSVNVYGGTAHGENYETTGEYRVV
                   130       140       150       160       170       180

                   190       200       210       220       230       240
m728.pep    WQPDGSVFDAAGRGKIGEDVYEHCLGCYQMAQVYLAKYRDVANDEQKVWDFRKESNRIAS
            ||||||||||||||||||||||||||||||||||||||||||||||||||||:|||||||
g728        WQPDGSVFDAAGRGKIGEDVYEHCLGCYQMAQVYLAKYRDVANDEQKVWDFREESNRIAS
                   190       200       210       220       230       240

                   250       260       270       280       290       300
m728.pep    DSRNSVFYQNMRELMPRGMKANSLVVGYDADGLPQKVYWSFDNGKKRQSFEYYLKNGNLF
            |||: |||||||||||||||||||||||||||||||||||||||||||||||||||||||
g728        DSRDYVFYQNMRELMPRGMKANSLVVGYDADGLPQKVYWSFDNGKKRQSFEYYLKNGNLF
                   250       260       270       280       290       300

                   310       320       330       340       350       360
m728.pep    IAQSSTVALKADGVTADMQTYHAQQTWYLDGGRIVREEKQGDRLPDFPLNLENLEKEVRR
            ||||||||||||||||||||||||||||||||||:||||||||||||||:|||||||| |
g728        IAQSSTVALKADGVTADMQTYHAQQTWYLDGGRIIREEKQGDRLPDFPLNLENLEKEVSR
                   310       320       330       340       350       360

                   370
m728.pep    YAEAAARRSGGRRDLSHX
            ||||||||||||| ||||
g728        YAEAAARRSGGRRGLSHX
                   370
```

The following partial DNA sequence was identified in *N. meningitidis* <SEQ ID 2461>:

a728.seq

```
  1 ATGTTTAAAA AATTCAAACC GGTACTGTTG TCATTTTTTG CACTTGTATT

 51 TGCCTTTTGG CTGGGAACGG GTATTGCCTA TGAGATTAAT CCGCGTTGGT

101 TTTTGAGCGA TACGGCAACT GAAAATCCGA ATGCTTTTGT GGCGAAACTT
```

-continued

```
 151 GCCCGCCTGT TCCGAAATGC CGACAGGGCG GTTGTCATCG TGAAGGAATC

 201 GATGAGGACG GAGGAAAGTC TTGCCGGAGC TGTGGATGAC GGTCCGTTGC

 251 AGTCGGAGAA GGATTATCTT GCACTCGCTG TCCGGCTCAG TCGTTTGAAA

 301 GAAAAGGCGA AATGGTTTCA CGTAACGGAG CAGGAACATG GGGAAGAGGT

 351 TTGGCTGGAT TACTATATCG GCGAGGGCGG TTTGGTTGCG GTTTCGCTTT

 401 CGCAACGCTC GCCGGAAGCG TTTGTTAATG CCGAATATCT GTATCGGAAC

 451 GATCGTCCGT TTTCTGTAAA TGTGTACGGC GGAACGGTTC ACGGGGAAAA

 501 TTATGAAACG ACAGGAGAAT ATCGGGTTGT TTGGCAACCG GACGGTTCGG

 551 TATTTGATGC GTCGGGGCGC GGGAAAATCG GGGAAGATGT TTATGAGCAT

 601 TGCCTCGGGT GTTATCAGAT GGCCCAGGTA TATTTGGCGA AATATCGGGA

 651 TGTCGCGAAT GATGAGCAGA AGGTTTGGGA CTTCCGCGAA GAGAGTAACC

 701 GGATTGCGTC GGACTCGCGC GATTCTGTGT TTTATCAGAA TATGCGGGAA

 751 TTGATGCCCC GAGGGATGAA GGCAAACAGT CTTGTGGTCG GCTATGATGC

 801 GGACGGTCTG CCGCAGAAAG TCTATTGGAG TTTCGACAAT GGGAAAAAAC

 851 GCCAGAGTTT CGAATATTAT TTGAAAAACG GAAATCTTTT TATTGCACAA

 901 TCTTCGACGG TAGCATTGAA AGCGGATGGC GTAACGGCGG ATATGCAGAC

 951 CTATCATGCG CAACAGACGT GGTATTTAGA TGGCGGGCGG ATTGTCCGCG

1001 AAGAGAAACA GGGGGACAGA CTGCCTGATT TTCCTTTGAA CTTGGAAGAT

1051 TTGGAAAAAG AGGTGAGCCG TTATGCAGAG GCTGCGGCGA GACGTTCGGG

1101 CGGCAGGCGC GACCTTTCTC ACTGA
```

This corresponds to the amino acid sequence <SEQ ID 2462; ORF 728.a>:

```
a728.pep

  1 MFKKFKPVLL SFFALVFAFW LGTGIAYEIN PRWFLSDTAT ENPNAFVAKL

 51 ARLFRNADRA VVIVKESMRT EESLAGAVDD GPLQSEKDYL ALAVRLSRLK

101 EKAKWFHVTE QEHGEEVWLD YYIGEGGLVA VSLSQRSPEA FVNAEYLYRN

151 DRPFSVNVYG GTVHGENYET TGEYRVVWQP DGSVFDASGR GKIGEDVYEH

201 CLGCYQMAQV YLAKYRDVAN DEQKVWDFRE ESNRIASDSR DSVFYQNMRE

251 LMPRGMKANS LVVGYDADGL PQKVYWSFDN GKKRQSFEYY LKNGNLFIAQ

301 SSTVALKADG VTADMQTYHA QQTWYLDGGR IVREEKQGDR LPDFPLNLED

351 LEKEVSRYAE AAARRSGGRR DLSH*
```

a728/m728 96.3% identity in 377 aa overlap

```
                   10        20        30        40           50
a728.pep   MFKKFKPVLLSFFALVFAFWLGTGIAYEINPRWFLSDTATE---NPNAFVAKLARLFRNA
           |||||||||||||||||||||||||||||||||||||||||   ||||||||||||||||
m728       MFKKFKPVLLSFFALVFAFWLGTGIAYEINPRWFLSDTATEVPKNPNAFVAKLARLFRNA
                   10        20        30        40        50        60

            60        70        80        90       100       110
a728.pep   DRAVVIVKESMRTEESLAGAVDDGPLQSEKDYLALAVRLSRLKEKAKWFHVTEQEHGEEV
           ||||||||||:||||:|||:||||||||||||||||:||||||||||||||||||||:||
m728       DRAVVIVKESIRTEENLAGTVDDGPLQSEKDYLALAIRLSRLKEKAKWFHVTEQEHGKEV
                   70        80        90       100       110       120
```

-continued

```
          120       130       140       150       160       170
a728.pep  WLDYYIGEGGLVAVSLSQRSPEAFVNAEYLYRNDRPFSVNVYGGTVHGENYETTGEYRVV
          ||||:|||||||||||||||||||||||||||||||||||||||||||||||||||||||
m728      WLDYHIGEGGLVAVSLSQRSPEAFVNAEYLYRNDRPFSVNVYGGTVHGENYETTGEYRVV
                 130       140       150       160       170       180

          180       190       200       210       220       230
a728.pep  WQPDGSVFDASGRGKIGEDVYEHCLGCYQMAQVYLAKYRDVANDEQKVWDFREESNRIAS
          ||||||||||:|||||||||||||||||||||||||||||||||||||||||:|||||||
m728      WQPDGSVFDAAGRGKIGEDVYEHCLGCYQMAQVYLAKYRDVANDEQKVWDFRKESNRIAS
                 190       200       210       220       230       240

          240       250       260       270       280       290
a728.pep  DSRDSVFYQNMRELMPRGMKANSLVVGYDADGLPQKVYWSFDNGKKRQSFEYYLKNGNLF
          |||:||||||||||||||||||||||||||||||||||||||||||||||||||||||||
m728      DSRNSVFYQNMRELMPRGMKANSLVVGYDADGLPQKVYWSFDNGKKRQSFEYYLKNGNLF
                 250       260       270       280       290       300

          300       310       320       330       340       350
a728.pep  IAQSSTVALKADGVTADMQTYHAQQTWYLDGGRIVREEKQGDRLPDFPLNLEDLEKEVSR
          ||||||||||||||||||||||||||||||||||||||||||||||||||||:||||| |
m728      IAQSSTVALKADGVTADMQTYHAQQTWYLDGGRIVREEKQGDRLPDFPLNLENLEKEVRR
                 310       320       330       340       350       360

          360       370
a728.pep  YAEAAARRSGGRRDLSHX
          ||||||||||||||||||
m728      YAEAAARRSGGRRDLSHX
                 370
```

The following partial DNA sequence was identified in *N. gonorrhoeae* <SEQ ID 2463>:

g729.seq

```
   1 ATGAATACTA CATTGAAAAC TACCTTGACC TCTGTTGCAG CAGCCTTTGC
  51 ATTGTCTGCC TGCACCATGA TTCCTCAATA CGAGCAGCCC AAAGTCGAAG
 101 TTGCGGAAAC CTTCCAAAAC GACACATCGG TTTCTTCCAT CCGCGCGGTT
 151 GATTTGGGTT GGCATGACTA TTTTGCCGAC CCGCGCCTGC AAAAGCTGAT
 201 CGACATCGCA CTCGAGCGCA ATACCAGTTT GCGTACAGCC GTATTGAACA
 251 GCGAAATCTA CCGCAAACAA TACATGATCG AGCGCAACAA CCTCCTGCCC
 301 ACGCTTGCCG CCAATGCGAA CGGCTCGCGC CAAGGCAGCT TGAGCGGCgg
 351 caaTGTCAGC AGCAGCTACA ATGTCGGACT GGGTGcGGca tCTTACGAAC
 401 TCGATCTGTT CgGGCGCGTG CGCagcaacA GcgaagcAGC ACTGcaggGC
 451 tATTTTGCCA GCGTTGCCAA CcgcGATGCG GCACATTTGa ttCtGATTGC
 501 CACCGTTGCC AAAGCCTATT TCAAcgaGcG TTATGCCGAA AAAGcgatgT
 551 CTTTGGCGCa gcGTGTCTTG AAAACGCGCG AGGAAACCTA CAAGCTGTCC
 601 GAATTGCGGT ACAAGGCAGG CGTGATTTCC GCCGTCGCCC TGCGCCAGCA
 651 GGAAGCCTTG ATTGAATCTG CCAAAGCCGA TTATGCCCAT GCCGCGCGCa
 701 gcCGCGAACA GGCGCGCAAT GCCTTGGCAA CCTTGATTAA ccGTCCGATA
 751 CCCGAagaCC TGCCCGCCGG TTTGCCGTTG GACAagcAGT TTTTTGTTGA
 801 AAAACTGCCT GCCGGTTTGA GTTCCGAAGT ATTGCTCGAC CGTCCCGACA
 851 TCCGCGCCGC CGAACACGCG CTCAAACAGG CAAACGCCAA TATCGGTGCG
 901 gcgCGCGCCg ccTTTTTCCC GTCCATCCGC CTGACCGGAA GCGTCGGTAC
 951 GGGTTCTGTC GAATTGGGCG GGCTGTTCAA AAGCGGCACG GGCGTTTGGG
1001 CGTTCGCTCC GTCTATTACC CTGCCGATTT TTACTTGGGG AACGAACAAG
1051 GCGAACCTTG ATGTGGCAAA ACTGCGCCAA CAGGCACAAA TTGTTGCCTA
1101 TGAATCCGCC GTCCAATCCG CCTTTCAAGA CGTGGCAAAC GCATTGGCGG
```

-continued

```
1151 CGCGCGAGCA GCTGGATAAA GCCTATGACG CTTTAAGCAA ACAAAGCCGC
1201 GCCTCTAAAG AAGCGTTGCG CTTGGTCGGA CTGCGTTACA AACACGGCGT
1251 ATCCGGCGCG CTCGATTTGC TCGATGCGGA ACGCATCAGC TATTCGGCGG
1301 AAGGTGCGGC TTTGTCGGCA CAACTGACCC GCGCCGAAAA CCTTGCCGAT
1351 TTGTACAAGG CGCTCgacGG CGGATTGAAA CGGGATACCC AAACCGGCAA
1401 ATAA
```

This corresponds to the amino acid sequence <SEQ ID 2464: ORF 729>:

g729.pep

```
  1 MNTTLKTTLT SVAAAFALSA CTMIPQYEQP KVEVAETFQN DTSVSSIRAV
 51 DLGWHDYFAD PRLQKLIDIA LERNTSLRTA VLNSEIYRKQ YMIERNNLLP
101 TLAANANGSR QGSLSGGNVS SSYNVGLGAA SYELDLFGRV RSNSEAALQG
151 YFASVANRDA AHLILIATVA KAYFNERYAE KAMSLAQRVL KTREETYKLS
201 ELRYKAGVIS AVALRQQEAL IESAKADYAH AARSREQARN ALATLINRPI
251 PEDLPAGLPL DKQFFVEKLP AGLSSEVLLD RPDIRAAEHA LKQANANIGA
301 ARAAFFPSIR LTGSVGTGSV ELGGLFKSGT GVWAFAPSIT LPIFTWGTNK
351 ANLDVAKLRQ QAQIVAYESA VQSAFQDVAN ALAAREQLDK AYDALSKQSR
401 ASKEALRLVG LRYKHGVSGA LDLLDAERIS YSAEGAALSA QLTRAENLAD
451 LYKALDGGLK RDTQTGK*
```

The following partial DNA sequence was identified in *N. meningitidis* <SEQ ID 2465>:

m729.seq

```
  1 ATGGATACTA CATTGAAAAC CACCTTGACT TCTGTTGCAG CAGCCTTTGC
 51 ATTGTCTGCC TGCACCATGA TTCCCCAATA CGAGCAGCCC AAAGTCGAAG
101 TTGCCGAAAC GTTCAAAAAC GATACCGCCG ACAGCGGCAT CCGCGCCGTC
151 GATTTAGGTT GGCATGACTA TTTTGCCGAC CCGCGCCTGC AAAAGCTGAT
201 CGACATCGCA CTCGAGCGCA ATACCAGTTT GCGTACCGCC GTATTGAACA
251 GCGAAATCTA CCGCAAACAA TACATGATTG AGCGCAACAA CCTCCTGCCC
301 ACGCTTGCCG CCAATGCGAA CGACTCGCGC CAAGGCAGCT TGAGCGGCGG
351 CAATGTAAGC AGCAGCTACA AAGTCGGACT GGGTGCGGCA TCTTACGAAC
401 TCGATCTGTT CGGGCGTGTA CGCAGCAGCA GCGAGGCGGC ACTGCAAGGC
451 TATTTCGCCA GCACCGCCAA CCGCGATGCG GCACATTTGA GCCTGATTGC
501 CACCGTTGCC AAAGCCTATT TCAACGAACG TTACGCCGAA GAAGCGATGT
551 CTTTGGCGCA ACGTGTTTTG AAAACGCGCG AGGAAACCTA CAAGCTGTCC
601 GAATTACGTT ACAAGGCAGG CGTGATTTCC GCCGTCGCCC TACGTCAGCA
651 GGAAGCCCTG ATCGAATCTG CCAAAGCCGA TTATGCCCAT GCCGCGCGCA
701 GCCGCGAACA GGCGCGCAAT GCCTTGGCAA CCTTGATTAA CCAACCGATA
```

-continued

```
 751 CCCGAAGACC TGCCTGCCGG TTTGCCGCTG GACAAGCAGT TTTTTGTTGA

 801 AAAACTGCCG GCCGGTTTGA GTTCCGAAGT ATTGCTCGAC CGTCCCGATA

 851 TCCGTGCTGC CGAACACGCG CTCAAACAGG CAAACGCCAA TATCGGTGCG

 901 GCACGCGCCG CCTTTTTCCC ATCCATCCGC CTGACCGGAA CCGTCGGTAC

 951 GGGTTCTGCC GAATTGGGTG GGTTGTTCAA AAGCGGCACG GGCGTTTGGT

1001 CGTTCGCGCC GTCTATTACC CTGCCGATTT TTACCTGGGG TACGAACAAG

1051 GCGAACCTTG ATGTAGCCAA GCTGCGCCAA CAGGTACAAA TCGTTGCCTA

1101 TGAATCCGCC GTCCAATCCG CATTTCAAGA CGTGGCAAAC GCATTGGCGG

1151 CGCGCGAGCA GCTGGATAAA GCCTATGACG CTTTAAGCAA ACAAAGCCGC

1201 GCCTCTAAAG AAGCGTTGCG CTTGGTCGGC CTGCGTTACA AGCACGGCGT

1251 ATCCGGCGCG CTCGACTTGC TCGATGCGGA ACGCAGCAGC TATGCGGCGG

1301 AGGGTGCGGC TTTGTCGGCA CAACTGACCC GCGCCGAAAA CCTTGCCGAT

1351 TTGTACAAGG CACTCGGCGG CGGATTGAAA CGGGATACCC AAACCGACAA

1401 ATAA
```

This corresponds to the amino acid sequence <SEQ ID 2466; ORF 729>:

m729.pep

```
  1 MDTTLKTTLT SVAAAFALSA CTMIPQYEQP KVEVAETFKN DTADSGIRAV

 51 DLGWHDYFAD PRLQKLIDIA LERNTSLRTA VLNSEIYRKQ YMIERNNLLP

101 TLAANANDSR QGSLSGGNVS SSYKVGLGAA SYELDLFGRV RSSSEAALQG

151 YFASTANRDA AHLSLIATVA KAYFNERYAE EAMSLAQRVL KTREETYKLS

201 ELRYKAGVIS AVALRQQEAL IESAKADYAH AARSREQARN ALATLINQPI

251 PEDLPAGLPL DKQFFVEKLP AGLSSEVLLD RPDIRAAEHA LKQANANIGA

301 ARAAFFPSIR LTGTVGTGSA ELGGLFKSGT GVWSFAPSIT LPIFTWGTNK

351 ANLDVAKLRQ QVQIVAYESA VQSAFQDVAN ALAAREQLDK AYDALSKQSR

401 ASKEALRLVG LRYKHGVSGA LDLLDAERSS YAAEGAALSA QLTRAENLAD

451 LYKALGGGLK RDTQTDK*
```

Computer analysis of the amino acid sequences gave the following results:

Homology with a predicted ORF from *N. meningitidis* menA with menB

ORF 729 shows 95.7% identity over a 467 aa overlap with a predicted ORF (ORF729.a) from *N. gonorrhoeae:* m729/g729 95.7% identity in 467 aa overlap

```
                    10        20        30        40        50        60
m729.pep    MDTTLKTTLTSVAAAFALSACTMIPQYEQPKVEVAETFKNDTADSGIRAVDLGWHDYFAD
            |:||||||||||||||||||||||||||||||||||||:|||: |:||||||||||||||
g729        MNTTLKTTLTSVAAAFALSACTMIPQYEQPKVEVAETFQNDTSVSSIRAVDLGWHDYFAD
                    10        20        30        40        50        60

                    70        80        90       100       110       120
m728.pep    PRLQKLIDIALERNTSLRTAVLNSEIYRKQYMIERNNLLPTLAANANDSRQGSLSGGNVS
            |||||||||||||||||||||||||||||||||||||||||||||||| |||||||||||
g729        PRLQKLIDIALERNTSLRTAVLNSEIYRKQYMIERNNLLPTLAANANGSRQGSLSGGNVS
                    70        80        90       100       110       120
```

-continued

```
                130        140        150        160        170        180
m729.pep  SSYKVGLGAASYELDLFGRVRSSSEAALQGYFASTANRDAAHLSLIATVAKAYFNERYAE
          |||:||||||||||||||||||:|||||||||||:|||||||| ||||||||||||||||
g729      SSYNVGLGAASYELDLFGRVRSNSEAALQGYFASVANRDAAHLILIATVAKAYFNERYAE
                130        140        150        160        170        180

                190        200        210        220        230        240
m729.pep  EAMSLAQRVLKTREETYKLSELRYKAGVISAVALRQQEALIESAKADYAHAARSREQARN
          :|||||||||||||||||||||||||||||||||||||||||||||||||||||||||||
g729      KAMSLAQRVLKTREETYKLSELRYKAGVISAVALRQQEALIESAKADYAHAARSREQARN
                190        200        210        220        230        240

                250        260        270        280        290        300
m729.pep  ALATLINQPIPEDLPAGLPLDKQFFVEKLPAGLSSEVLLDRPDIRAAEHALKQANANIGA
          |||||||:||||||||||||||||||||||||||||||||||||||||||||||||||||
g729      ALATLINRPIPEDLPAGLPLDKQFFVEKLPAGLSSEVLLDRPDIRAAEHALKQANANIGA
                250        260        270        280        290        300

                310        320        330        340        350        360
m729.pep  ARAAFFPSIRLTGTVGTGSAELGGLFKSGTGVWSFAPSITLPIFTWGTNKANLDVAKLRQ
          |||||||||||||:|||||:|||||||||||||:||||||||||||||||||||||||||
g729      ARAAFFPSIRLTGSVGTGSVELGGLFKSGTGVWAFAPSITLPIFTWGTNKANLDVAKLRQ
                310        320        330        340        350        360

                370        380        390        400        410        420
m729.pep  QVQIVAYESAVQSAFQDVANALAAREQLDKAYDALSKQSRASKEALRLVGLRYKHGVSGA
          |:||||||||||||||||||||||||||||||||||||||||||||||||||||||||||
g729      QAQIVAYESAVQSAFQDVANALAAREQLDKAYDALSKQSRASKEALRLVGLRYKHGVSGA
                370        380        390        400        410        420

                430        440        450        460
m729.pep  LDLLDAERSSYAAEGAALSAQLTRAENLADLYKALGGGLKRDTQTDKX
          |||||||| ||:||||||||||||||||||||||| ||||||||| ||
g729      LDLLDAERISYSAEGAALSAQLTRAENLADLYKALDGGLKRDTQTGKX
                430        440        450        460
```

The following partial DNA sequence was identified in *N. meningitidis* <SEQ ID 2467>:

a729.seq

```
  1 ATGGATACTA CATTGAAAAC CACCTTGACT TCTGTTGCAG CAGCCTTCGC
 51 ATTATCCGCC TGCACCATGA TTCCCCAATA CGAGCAGCCC AAAGTCGAAG
101 TTGCCGAAAC GTTCAAAAAC GATACCGCCG ACAGCGGCAT CCGTGCGGTC
151 GATTTGGGTT GGCATGACTA TTTTGCCGAC CCGCGCCTGC AAAAGCTGAT
201 CGACATCGCA CTCGAGCGCA ATACCAGTTT GCGTACCGCC GTATTGAACA
251 GCGAAATCTA CCGCAAACAA TACATGATTG AGCGCAACAA CCTCCTGCCC
301 ACGCTTGCCG CCAATGCGAA CGACTCGCGC CAAGGCAGCT TGAGCGGCGG
351 CAATGTAAGC AGCAGCTACA AAGTCGGACT GGGTGCGGCA TCTTACGAAC
401 TCGATCTGTT CGGGCGTGTA CGCAGCAGCA GCGAGGCGGC ACTGCAAGGC
451 TATTTCGCCA GCACCGCCAA CCGCGATGCG GCACATTTGA GCCTGATTGC
501 CACCGTTGCC AAAGCCTATT TCAACGAACG TTATGCCGAA GAAGCGATGT
551 CTTTGGCGCA ACGTGTTTTG AAAACGCGCG AGGAAACCTA CAAGCTGTCC
601 GAATTACGTT ACAAGGCAGG CGTGATTTCC GCCGTCGCCC TACGTCAGCA
651 GGAAGCCCTA ATCGAATCTG CCAAAGCCGA TTATGCCCAT GCCGCGCGCA
701 GCCGCGAACA GGCGCGCAAT GCCTTGGCAA CCCTGATTAA CCAACCGATA
751 CCCGACGACC TGCCCGCCGG TTTGCCGTTG GACAAGCAGT TTTTTGTTGA
801 GAAGCTGCCG GCCGGTTTGA GTTCCGAAGT ATTGCTCGAC CGTCCCGATA
851 TCCGTGCTGC CGAACACGCG CTCAAACAGG CAAACGCCAA TATCGGTGCG
901 GCACGCGCCG CCTTTTTCCC ATCCATCCGC CTGACCGGAA GCGTCGATAC
951 GCATTCTGCC GAATTGGGCG GGCTGTTCAA AAGCGGCACC GGCGTTTGGT
```

-continued

```
1001 TGTTCGCACC TTCCATTACC CTGCCGATTT TTACCTGGGG TACGAACAAG

1051 GCGAACCTCG ATGTAGCCAA GCTGCGCCAA CAGGCACAAA TCGTTGCCTA

1101 TGAAGCCGCC GTCCAATCCG CATTTCAAGA CGTGGCAAAC GCATTGACCG

1151 CGCGCGAGCA GTTGGATAAA GCCTATGACG CTTTAAGCAA ACAAAGCCGC

1201 GCCTCTAAAG AAGCGTTGCG TTTGGTCGGT CTGCGTTACA AACACGGCGT

1251 ATCCGGCGCG CTCGACTTGC TCGATGCGGA ACGCAGCAGC TATTCGGCGG

1301 AAGGTGCGGC TTTGTCGGCA CAACTGACCC GCGCCGAAAA CCTTGCCGAT

1351 TTGTACAAGG CACTCGGCGG CGGATTGAAA CGGGATACCC AAACCGACAA

1401 ATAA
```

This corresponds to the amino acid sequence <SEQ ID 2468; ORF 729.a>:

```
a729.pep

  1 MDTTLKTTLT SVAAAFALSA CTMIPQYEQP KVEVAETFKN DTADSGIRAV

 51 DLGWHDYFAD PRLQKLIDIA LERNTSLRTA VLNSEIYRKQ YMIERNNLLP

101 TLAANANDSR QGSLSGGNVS SSYKVGLGAA SYELDLFGRV RSSSEAALQG

151 YFASTANRDA AHLSLIATVA KAYFNERYAE EAMSLAQRVL KTREETYKLS

201 ELRYKAGVIS AVALRQQEAL IESAKADYAH AARSREQARN ALATLINQPI

251 PDDLPAGLPL DKQFFVEKLP AGLSSEVLLD RPDIRAAEHA LKQANANIGA

301 ARAAFFPSIR LTGSVDTHSA ELGGLFKSGT GVWLFAPSIT LPIFTWGTNK

351 ANLDVAKLRQ QAQIVAYEAA VQSAFQDVAN ALTAREQLDK AYDALSKQSR

401 ASKEALRLVG LRYKHGVSGA LDLLDAERSS YSAEGAALSA QLTRAENLAD

451 LYKALGGGLK RDTQTDK*
```

a729/m729 98.1% identity in 467 aa overlap

```
                   10        20        30        40        50        60
a729.pep    MDTTLKTTLTSVAAAFALSACTMIPQYEQPKVEVAETFKNDTADSGIRAVDLGWHDYFAD
            ||||||||||||||||||||||||||||||||||||||||||||||||||||||||||||
m729        MDTTLKTTLTSVAAAFALSACTMIPQYEQPKVEVAETFKNDTADSGIRAVDLGWHDYFAD
                   10        20        30        40        50        60

                   70        80        90       100       110       120
a729.pep    PRLQKLIDIALERNTSLRTAVLNSEIYRKQYMIERNNLLPTLAANANDSRQGSLSGGNVS
            ||||||||||||||||||||||||||||||||||||||||||||||||||||||||||||
m729        PRLQKLIDIALERNTSLRTAVLNSEIYRKQYMIERNNLLPTLAANANDSRQGSLSGGNVS
                   70        80        90       100       110       120

                  130       140       150       160       170       180
a729.pep    SSYKVGLGAASYELDLFGRVRSSSEAALQGYFASTANRDAAHLSLIATVAKAYFNERYAE
            ||||||||||||||||||||||||||||||||||||||||||||||||||||||||||||
m729        SSYKVGLGAASYELDLFGRVRSSSEAALQGYFASTANRDAAHLSLIATVAKAYFNERYAE
                  130       140       150       160       170       180

                  190       200       210       220       230       240
a729.pep    EAMSLAQRVLKTREETYKLSELRYKAGVISAVALRQQEALIESAKADYAHAARSREQARN
            ||||||||||||||||||||||||||||||||||||||||||||||||||||||||||||
m729        EAMSLAQRVLKTREETYKLSELRYKAGVISAVALRQQEALIESAKADYAHAARSREQARN
                  190       200       210       220       230       240

                  250       260       270       280       290       300
a729.pep    ALATLINQPIPDDLPAGLPLDKQFFVEKLPAGLSSEVLLDRPDIRAAEHALKQANANIGA
            ||||||||||:|||||||||||||||||||||||||||||||||||||||||||||||||
m729        ALATLINQPIPEDLPAGLPLDKQFFVEKLPAGLSSEVLLDRPDIRAAEHALKQANANIGA
                  250       260       270       280       290       300
```

-continued

```
                310        320        330        340        350        360
a729.pep  ARAAFFPSIRLTGSVDTHSAELGGLFKSGTGVWLFAPSITLPIFTWGTNKANLDVAKLRQ
          |||||||||||||:| | ||||||||||||||| ||||||||||||||||||||||||||
m729      ARAAFFPSIRLTGTVGTGSAELGGLFKSGTGVWSFAPSITLPIFTWGTNKANLDVAKLRQ
                310        320        330        340        350        360

                370        380        390        400        410        420
a729.pep  QAQIVAYEAAVQSAFQDVANALTAREQLDKAYDALSKQSRASKEALRLVGLRYKHGVSGA
          |:||||||:||||||||||||||:||||||||||||||||||||||||||||||||||||
m729      QVQIVAYESAVQSAFQDVANALAAREQLDKAYDALSKQSRASKEALRLVGLRYKHGVSGA
                370        380        390        400        410        420

                430        440        450        460
a729.pep  LDLLDAERSSYSAEGAALSAQLTRAENLADLYKALGGGLKRDTQTDKX
          |||||||||||:||||||||||||||||||||||||||||||||||||
m729      LDLLDAERSSYAAEGAALSAQLTRAENLADLYKALGGGLKRDTQTDKX
                430        440        450        460
```

The following partial DNA sequence was identified in *N. gonorrhoeae* <SEQ ID 2469>:

<u>g730.seq</u>

```
   1 GTGAAACCGC TGCGCAGACT GACAAACCTC CTTGCCGCCT GCGCCGTAGC
  51 GGCGGTCGCA CTCATACAGC CCGCCCTCGC GGCGGACTTG GCGCAAGACC
 101 CGTTCATTAC CGATAACACC CAACGGCAGC ACTACGAACC CGGCGGCAAA
 151 TACCACCTCT TCGGcgaCCC GCGCGGCAGC GTTTCCGACC GCACCGGCAA
 201 AATCAACGTC ATCCAAGACT ATACCCACCA GATGGGCAAC CTGCTCATCC
 251 AACAGGCGGC AATCCAAGGC AATCTTGGTT ACACCGTCCG CTTTTCCGGA
 301 CACGGACACG AAGAACACGC CCCCTTCGAC AACCACGCCG CCGACAGCGC
 351 AAGCGAAGAA AAAGGCAACG TTGACGACGG CTTTACCGTG TACCGGCTCA
 401 ACTGGGAAGG ACACGAACAT CATCCCGCCG ATGCCTACGA CGGCCCGAAG
 451 GGCGGCAATT ACCCCAAACC TACGGGCGCA CGAGACGAAT ACACCTATCA
 501 CGTCAACGGC ACAGCCCGCA GTATCAAACT CAATCCGACC GACACCCGCA
 551 GCATCCGGCA ACGCATATTC GACAACTACA ACAACCTCGG CAGCAATTTC
 601 TCCGACCGCG CCGATGAAGC CAACAGAAAA ATGTTCGAGC ACAATGCCAA
 651 GCTCGACCGC TGGGGCAACA GCATGGAGTT TGTCAACGGC GTCGCCGCCG
 701 GCGCGCTCAA CCCCTTTATC AGCGCGGGCG AAGCCTTGGG CATAGGCGAC
 751 ATACTGTACG GAACGCGCTA TGCCATAGAC AAAGCCGCGA TGCGCAACAT
 801 CGCCCCCTTA CCCGCCGAGG GCAAATTCGC CGCCATCGGC GGCTTGGGCA
 851 GCGCGGCGGG CTTTGAAAAA AATACGCGCG AAGCCGTTGA CCGGTGGATA
 901 CAGGAAAACC CCAATGCCGC CGAAACCGTC GAAGCCCTGG TCAACGTCCT
 951 GCCGTTTGCC AAAGTCAAAA ACCTGACAAA GGCGGCAAAA CCGGGGAAGG
1001 CTGCGGTTAG TGGGGATTTT TCTAAATCCT ACACCTGCTC CTTCCACGGC
1051 AGCACCTTGG TCAAAACGGC AGACGGCTAC AAAGCCATTG CCCATATTCA
1101 AGCCGGAGAC CGCGTCCTTT CCAAGGACGA GGCAAGCGGA GAAACGGGAT
1151 ACAAACCCGT TACCGCCCGA TACGGCAATC CGTATCAAGA AACCGTTTAC
1201 ATTGAAGTTT CAGACGGCAT CGGCAACAGC CAAACCCTGA TTTCCAACCG
1251 CATCCACCCG TTTTATTCGG ACGGCAAATG GATTAAGGCG GAAGATTTAA
1301 AAGCGGGAAG CCGGCTGTTA TCCGAAAGCG GCAAAACCCA AACCGTCCGC
1351 AACATCGTTG TCAAACCAAA ACCGCTCAAA GCCTACAATC TGACCGTTGC
```

-continued

```
1401 CGATTGGCAT ACCTACTTCG TCAAGGGTAA TCAGGCGGAA ACGGAAGGGG
1451 TTTGGGTTCA TAATGATTGT CCGCCTAAAC CAAAACCAAC CAATCATGCC
1501 CAACAAAGAA AAGAAGAAGC TAAAAACGAT TCTCATCGAA GTGTGGGAGA
1551 TTCCAATCGT GTCGTTCGCG AAGGAAAGCA ATATTTAGAT TCCGACACAG
1601 GAAACCATGT TTATGTAAAA GGAGATAAAG TGGTTATTCT AACTCCTGAT
1651 GGAAGACAGG TAACTCAATT TAAGAACTCG AAAGCCAATA CGTCAAAAAG
1701 GGTAAAAAAT GGGAAATGGA CACCAAAATA A
```

This corresponds to the amino acid sequence <SEQ ID 2470; ORF 730.ng>:

g730.pep

```
  1 VKPLRRLTNL LAACAVAAVA LIQPALAADL AQDPFITDNT QRQHYEPGGK
 51 YHLFGDPRGS VSDRTGKINV IQDYTHQMGN LLIQQAAIQG NLGYTVRFSG
101 HGHEEHAPFD NHAADSASEE KGNVDDGFTV YRLNWEGHEH HPADAYDGPK
151 GGNYPKPTGA RDEYTYHVNG TARSIKLNPT DTRSIRQRIF DNYNNLGSNF
201 SDRADEANRK MFEHNAKLDR WGNSMEFVNG VAAGALNPFI SAGEALGIGD
251 ILYGTRYAID KAAMRNIAPL PAEGKFAAIG GLGSAAGFEK NTREAVDRWI
301 QENPNAAETV EALVNVLPFA KVKNLTKAAK PGKAAVSGDF SKSYTCSFHG
351 STLVKTADGY KAIAHIQAGD RVLSKDEASG ETGYKPVTAR YGNPYQETVY
401 IEVSDGIGNS QTLISNRIHP FYSDGKWIKA EDLKAGSRLL SESGKTQTVR
451 NIVVKPKPLK AYNLTVADWH TYFVKGNQAE TEGVWVHNDC PPKPKPTNHA
501 QQRKEEAKND SHRSVGDSNR VVREGKQYLD SDTGNHVYVK GDKVVILTPD
551 GRQVTQFKNS KANTSKRVKN GKWTPK*
```

The following partial DNA sequence was identified in *N. meningitidis* <SEQ ID 2471>:

m730.seq

```
  1 GTGAAACCGC TGCGCAGACT GACAAACCTC CTTGCCGCCT GCGCCGTAGC
 51 GGCGGCCGCA CTCATACAGC CCGCCCTCGC GGCGGACTTG GCGCAAGACC
101 CGTTCATTAC CGATAACGCC CAACGGCAGC ACTACGAACC CGGCGGCAAA
151 TACCACCTCT TCGGCGACCC GCGCGGCAGC GTTTCCGACC GCACCGGCAA
201 AATCAACGTC ATCCAAGACT ATACCCACCA GATGGGCAAC CTGCTCATCC
251 AACAGGCAAA CATCAACGGC ACAATCGGCT ACCACACCCG CTTTTCCGGA
301 CACGGACACG AAGAACACGC CCCCTTCGAC AACCACGCCG CCGACAGCGC
351 GAGCGAAGAA AAAGGCAACG TTGACGAAGG CTTTACCGTA TACCGGCTCA
401 ACTGGGAAGG ACACGAACAT CATCCCGCCG ATGCCTACGA CGGCCCGAAG
451 GGCGGCAATT ACCCCAAACC TACGGGCGCA CGAGACGAAT ACACCTATCA
501 CGTCAACGGC ACAGCCCGCA GTATCAAACT CAATCCGACC GACACCCGCA
551 GCATCCGGCA ACGCATATCC GACAATTACA GCAACCTCGG CAGCAATTTC
```

-continued

```
 601 TCCGACCGCG CCGATGAAGC CAACAGAAAA ATGTTCGAGC ACAATGCCAA

 651 GCTCGACCGC TGGGGCAACA GCATGGAGTT TATCAACGGC GTCGCCGCCG

 701 GCGCGCTCAA CCCCTTTATC AGCGCGGGCG AAGCCTTGGG CATAGGCGAC

 751 ATACTGTACG GAACGCGCTA TGCCATAGAC AAAGCCGCAA TGCGCAACAT

 801 CGCCCCCTTG CCCGCCGAGG GCAAATTCGC CGTCATCGGC GGCTTGGGCA

 851 GCGTGGCGGG CTTTGAAAAG AATACGCGCG AAGCCGTTGA CCGGTGGATA

 901 CAGGAAAATC CCAATGCCGC CGAAACCGTC GAAGCCGTCT TCAACGTTGC

 951 CGCAGCAGCC AAAGTCGCGA AGTTGGCAAA GGCGGCAAAA CCAGGGAAGG

1001 CTGCGGTTAG CGGGGATTTT GCTGATTCTT ATAAAAAGAA ATTGGCTTTG

1051 TCTGATAGTG CGAGACAGTT ATATCAAAAT GCAAAGTATA GAGAAGCTCT

1101 AGATATACAT TATGAAGATT TAATTAGAAG AAAAACTGAT GGTTCATCAA

1151 AATTTATTAA CGGCAGAGAA ATTGACGCTG TTACGAATGA TGCTTTAATA

1201 CAAGCCAAAA GAACAATTTC AGCAATAGAT AAACCTAAAA ATTTCTTAAA

1251 TCAAAAAAAT AGAAAGCAAA TTAAAGCAAC CATCGAAGCA GCAAACCAAC

1301 AGGGAAAACG TGCAGAATTT TGGTTTAAAT ACGGTGTTCA TTCACAAGTT

1351 AAGTCATATA TTGAATCAAA AGGCGGCATT GTTAAAACAG GTTTAGGAGA

1401 TTAA
```

This corresponds to the amino acid sequence <SEQ ID 2472; ORF 730>:

```
m730.pep

  1 VKPLRRLTNL LAACAVAAAA LIQPALAADL AQDPFITDNA QRQHYEPGGK

 51 YHLFGDPRGS VSDRTGKINV IQDYTHQMGN LLIQQANING TIGYHTRFSG

101 HGHEEHAPFD NHAADSASEE KGNVDEGFTV YRLNWEGHEH HPADAYDGPK

151 GGNYPKPTGA RDEYTYHVNG TARSIKLNPT DTRSIRQRIS DNYSNLGSNF

201 SDRADEANRK MFEHNAKLDR WGMSNEFING VAAGALNPFI SAGEALGIGD

251 ILYGTRYAID KAAMRNIAPL PAEGKFAVIG GLGSVAGFEK NTREAVDRWI

301 QENPNAAETV EAVFNVAAAA KVAKLAKAAK PGKAAVSGDF ADSYKKKLAL

351 SDSARQLYQN AKYREALDIH YEDLIRRKTD GSSKFINGRE IDAVTNDALI

401 QAKRTISAID KPKNFLNQKN RKQIKATIEA ANQQGKRAEF WFKYGVHSQV

451 KSYIESKGGI VKTGLGD*
```

g730/m730 93.0% identity in 344 aa overlap

```
                   10        20        30        40        50        60
g730.pep   VKPLRRLTNLLAACAVAAVALIQPALAADLAQDPFITDNTQRQHYEPGGKYHLFGDPRGS
           ||||||||||||||||||:|||||||||||||||||||||:|||||||||||||||||||
m730       VKPLRRLTNLLAACAVAAAALIQPALAADLAQDPFITDNAQRQHYEPGGKYHLFGDPRGS
                   10        20        30        40        50        60

                   70        80        90       100       110       120
g730.pep   VSDRTGKINVIQDYTHQMGNLLIQQAAIQGNLGYTVRFSGHGHEEHAPFDNHAADSASEE
           |||||||||||||||||||||||||| |:|::|| :||||||||||||||||||||||||
m730       VSDRTGKINVIQDYTHQMGNLLIQQANINGTIGYHTRFSGHGHEEHAPFDNHAADSASEE
                   70        80        90       100       110       120
```

-continued

```
                130       140       150       160       170       180
g730.pep  KGNVDDGFTVYRLNWEGHEHHPADAYDGPKGGNYPKPTGARDEYTYHVNGTARSIKLNPT
          |||||:||||||||||||||||||||||||||||||||||||||||||||||||||||||
m730      KGNVDEGFTVYRLNWEGHEHHPADAYDGPKGGNYPKPTGARDEYTYHVNGTARSIKLNPT
                130       140       150       160       170       180

                190       200       210       220       230       240
g730.pep  DTRSIRQRIFDNYNNLGSNFSDRADEANRKMFEHNAKLDRWGNSMEFVNGVAAGALNPFI
          ||||||||| ||||:|||||||||||||||||||||||||||||||||:|||||||||||
m730      DTRSIRQRISDNYSNLGSNFSDRADEANRKMFEHNAKLDRWGNSMEFINGVAAGALNPFI
                190       200       210       220       230       240

                250       260       270       280       290       300
g730.pep  SAGEALGIGDILYGTRYAIDKAAMRNIAPLPAEGKFAAIGGLGSAAGFEKNTREAVDRWI
          |||||||||||||||||||||||||||||||||||||:||||||:|||||||||||||||
m730      SAGEALGIGDILYGTRYAIDKAAMRNIAPLPAEGKFAVIGGLGSVAGFEKNTREAVDRWI
                250       260       270       280       290       300

                310       320       330       340       350       360
g730.pep  QENPNAAETVEALVNVLPFAKVKNLTKAAKPGKAAVSGDFSKSYTCSFHGSTLVKTADGY
          ||||||||||||: ||   ||| :|:||||||||||||||: ||
m730      QENPNAAETVEAVFNVAAAAKVAKLAKAAKPGKAAVSGDFADSYKKKLALSDSARQLYQN
                310       320       330       340       350       360

                370       380       390       400       410       420
g730.pep  KAIAHIQAGDRVLSKDEASGETGYKPVTARYGNPYQETVYIEVSDGIGNSQTLISNRIHP

m730      AKYREALDIHYEDLIRRKTDGSSKFINGREIDAVTNDALIQAKRTISAIDKPKNFLNQKN
                370       380       390       400       410       420
```

The following partial DNA sequence was identified in *N. meningitidis* <SEQ ID 2473>:

<u>a730.seq</u>

```
   1 GTGAAACCGC TGCGAAGACT CATCAAGCTC CTTGCCGCCT GTGCCGTAGC
  51 GGCGGCCGCA CTCATACAGC CCGCCCTCGC GGCGGACTTG GCGCAACACC
 101 CGTTCATTAC CGATAACGCC CAACGGCAGC ACTACGAACC CGGAGGCAAA
 151 TACCACCTCT TCGGCGACCC GCGCGGCAGC GTCTCCGACC GCACCGGTCA
 201 AATCAACGTC ATCCAAGACT ATACCCACCG GATGGGCAAC CTGCTCATCC
 251 AGCAGGCAAA CATCAACGGC ACAATCGGCT ACCACACCCG CTTTTCCGGA
 301 CACGGATACG AAGAACACGC CCCCTTCGAC AACCACGCCG CCGACAGCGC
 351 GAGCGAAGAA AAAGGCAACG TTGACGAAGG CTTTACCGTA TACCGGCTCA
 401 ACTGGGAAGG ACACGAACAT CATCCCGCCG ATGCCTACGA CGGCCCGAAG
 451 GGCGGCAATT ACCCCAAACC TACGGGTGCA CGCGACGAAT ACACCTATCA
 501 CGTCAACGGC ACAGCACGCA GCATCAAACT CAATCCGACC GACACCCGCA
 551 GCATCCGGCA ACGCATATCC GACAATTACA GCAACCTCGG CAGCAATTTC
 601 TCCGACCGCG CCGATGAAGC CAACAGAAAA ATGTTCGAGC ACAATGCCAA
 651 GCTCGACCGC TGGGGCAACA GCATGGAGTT TATCAACGGC GTCGCCGCCG
 701 GCGCGCTCAA CCCCTTTATC AGCGCGGGCG AAGCCTTGGG CATAGGCGAC
 751 ATACTGTACG GAACGCGCTA TGCCATAGAC AAAGCCGCAA TGCGCAACAT
 801 CGCCCCCTTG CCCGCCGAGG GCAAATTCGC CGTCATCGGC GGCTTGGGCA
 851 GCGTGGCGGG CTTTGAAAAA AATACGCGCG AAGCCGTTGA CCGGTGGATA
 901 CAGGAAAACC CCAATGCCGC CGAAACCGTC GAAGCCCTGG TCAACGTCCT
 951 GCCGTTTGCC AAAGTCAAAA ACCTGACAAA GGCGGCAAAA CCGGGGAAGG
1001 CTGCGGTTAG CGGGGATTTT TCTGCTGCAT ACAATACAAG AACAACTAGA
1051 AAAGTTACTA CAGAAACAGA GGGGTTAAAT AGAATCAGAC AGAACCAGAA
1101 AAATAGTAAT ATACATGAGA AAAATTATGG AAGAGATAAT CCTAATCATA
```

-continued

```
1151 TTAATGTTTT ATCTGGAAAT TCTATACAAC ATATACTGTA TGGAGATGAA

1201 GCAGGAGGTG GGCATCTTTT TCCTGGCAAA CCTGGTAAGA CAACATTCCC

1251 CCAACATTGG TCAGCCAGTA AAATAACTCA TGAAATTAGT GATATCGTTA

1301 CATCCCCAAA AACGCAATGG TATGCACAGA CTGGAACAGG CGGCAAATAT

1351 ATTGCTAAAG GAAGACCAGC TAGGTGGGTA TCATATGAAA CGAGAGATGG

1401 AATTCGTATC AGAACAGTTT ATGAACCTGC AACAGGAAAA GTGGTAACTG

1451 CATTCCCCGA TAGAACCTCT AATCCCAAAT ATAACCCTGT AAAATAA
```

This corresponds to the amino acid sequence <SEQ ID 2474; ORF 730.a>:

```
a730.pep

  1 VKPLRRLIKL LAACAVAAAA LIQPALAADL AQDPFITDNA QRQHYEPGGK

 51 YHLFGDPRGS VSDRTGQINV IQDYTHRMGN LLIQQANING TIGYHTRFSG

101 HGYEEHAPFD NHAADSASEE KGNVDEGFTV YRLNWEGHEH HPADAYDGPK

151 GGNYPKPTGA RDEYTYHVNG TARSIKLNPT DTRSIRQRIS DNYSNLGSNF

201 SDRADEANRK MFEHNAKLDR WGNSMEFING VAAGALNPFI SAGEALGIGD

251 ILYGTRYAID KAAMRNIAPL PAEGKFAVIG GLGSVAGFEK NTREAVDRWI

301 QENPNAAETV EALVNVLPFA KVKNLTKAAK PGKAAVSGDF SAAYNTRTTR

351 KVTTETEGLN RIRQNQKNSN IHEKNYGRDN PNHINVLSGN SIQHILYGDE

401 AGGGHLFPGK PGKTTFPQHW SASKITHEIS DIVTSPKTQW YAQTGTGGKY

451 IAKGRPARWV SYETRDGIRI RTVYEPATGK VVTAFFDRTS NPKYNPVK*
```

a730/m730 88.6% identity in 376 aa overlap

```
                   10        20        30        40        50        60
a730.pep  VKPLRRLIKLLAACAVAAAALIQPALAADLAQDPFITDNAQRQHYEPGGKYHLFGDPRGS
          ||||||| :|||||||||||||||||||||||||||||||||||||||||||||||||||
m730      VKPLRRLTNLLAACAVAAAALIQPALAADLAQDPFITDNAQRQHYEPGGKYHLFGDPRGS
                   10        20        30        40        50        60

                   70        80        90       100       110       120
a730.pep  VSDRTGQINVIQDYTHRMGNLLIQQANINGTIGYHTRFSGHGYEEHAPFDNHAADSASEE
          ||||||:||||||||||:|||||||||||||||||||||||||:||||||||||||||||
m730      VSDRTGKINVIQDYTHQMGNLLIQQANINGTIGYHTRFSGHGHEEHAPFDNHAADSASEE
                   70        80        90       100       110       120

                  130       140       150       160       170       180
a730.pep  KGNVDEGFTVYRLNWEGHEHHPADAYDGPKGGNYPKPTGARDEYTYHVNGTARSIKLNPT
          ||||||||||||||||||||||||||||||||||||||||||||||||||||||||||||
m730      KGNVDEGFTVYRLNWEGHEHHPADAYDGPKGGNYPKPTGARDEYTYHVNGTARSIKLNPT
                  130       140       150       160       170       180

                  190       200       210       220       230       240
a730.pep  DTRSIRQRISDNYNNLGSNFSDRADEANRKMFEHNAKLDRWGNSMEFINGVAAGALNPFI
          ||||||||||||||||||||||||||||||||||||||||||||||||||||||||||||
m730      DTRSIRQRISDNYNNLGSNFSDRADEANRKMFEHNAKLDRWGNSMEFINGVAAGALNPFI
                  190       200       210       220       230       240

                  250       260       270       280       290       300
a730.pep  SAGEALGIGDILYGTRYAIDKAAMRNIAPLPAEGKFAVIGGLGSVAGFEKNTREAVDRWI
          ||||||||||||||||||||||||||||||||||||||||||||||||||||||||||||
m730      SAGEALGIGDILYGTRYAIDKAAMRNIAPLPAEGKFAVIGGLGSVAGFEKNTREAVDRWI
                  250       260       270       280       290       300

                  310       320       330       340       350       360
a730.pep  QENPNAAETVEALVNVLPFAKVKNLTKAAKPGKAAVSGDFSAAYNTRTTRKVTTETEGLN
          ||||||||||||: ||   ||| :|:||||||||||||||: :|     :|  : :::  
m730      QENPNAAETVEAVFNVAAAAKVAKLAKAAKPGKAAVSGDFADSY-----KKKLALSDSAR
                  310       320       330       340            350
```

-continued

```
                370       380       390       400       410       420
a730.pep  RIRQNQKNSNIHEKNYGRDNPNHINVLSGNSIQHILYGDEAGGGHLFPGKPGKTTFPQHW
           :: || |   :   : :|
m730      QLYQNAKYREALDIHYEDLIRRKTDGSSKFINGREIDAVTNDALIQAKRTISAIDKPKNF
            360       370       380       390       400       410
```

The following partial DNA sequence was identified in *N. gonorrhoeae* <SEQ ID 2475>:

g732.seq

```
  1 gattttcgag cgttttcatG CGAGAACGGT TTGTCTGTGC GCGTCCGCAA
 51 TTTGGACGGC GGCAAAATCG CGTTGCGGCT GGACGGCAGG CGTGCCGTCC
102 TCTCTTCCGA CGTTGCCGCA TCCGGCGAAC GCTATACCGC CGAACACGGT
151 TTGTTCGGAA ACGGAACCGA GTGGCACCAG AAAGGCGGCG AAGCCTTTTT
201 CGGCTTTACC GATGCCTACG GCAATTCGGT CGAAACTTCC TGCCGCGCCC
251 GTTAA
```

This corresponds to the amino acid sequence <SEQ ID 2476; ORF 731.ng>:

g731.pep

```
 1 DFRAFSCENG LSVRVRNLDG GKIALRLDGR RAVLSSDVAA SGERYTAEHG
51 LFGNGTEWHQ KGGEAFFGFT DAYGNSVETS CRAR*
```

The following partial DNA sequence was identified in *N. meningitidis* <SEQ ID 2477>:

m731.seq

```
  1 ATGAATATCA GGTTTTTCGC GCTGACCGTA CCGGTTTTGT CTTTGGCGGC
 51 CTGTGCCGTG CCGGAGGCGT ATGATGACGG CGGACGCGGG CATATGCCGC
101 CCGTTCAAAA CCAAGCCGGC ACGGACGATT TTCGGGCGTT TTCCTGCGAG
151 AACGGTTTGT CTGTGCGCGT CCGCCATTTG GACAGCGGCA AAGTCGCGTT
201 GCGGCTGGAC GGCAGGCGTG CCGTCCTCTC TTCCGACGTT GCCGCATCCG
251 GCGAACGCTA TACCGCCGAA CACGGTTTGT TCGGAAACGC AACCGAGTGG
301 CACCAGAAAG GCGGCGAAGC CTTTTTCGGC TTTACCGATG CCTACGGCAA
351 TTCGGTCGAA ACTTCCTGCC GCGCCCGTTA A
```

This corresponds to the amino acid sequence <SEQ ID 2478; ORF 731>:

m731.pep

```
  1 MNIRFFALTV PVLSLAACAV PEAYDDGGRG HMPPVQNQAG TDDFRAFSCE
 51 NGLSVRVRHL DSGKVALRLD GRRAVLSSDV AASGERYTAE HGLFGNATEW
101 HQKGGEAFFG FTDAYGNSVE TSCRAR*
```

g731/m731 95.2% identity in 84 aa overlap

```
                     10        20        30
g731.pep                     DRAFSCENGLSVRVRNLDGGKIALRLDGR
                             ||||||||||||||:|||||||||||||
m731      LSLAACAVPEAYDDGGRGHMPPVQNQAGTADDRAFSCENGLSVRVRHLDSGKVALRLDGR
                 20        30        40        50        60        70

                40        50        60        70        80
g731.pep  RAVLSSDVAASGERYTAEHGLFGNGTEWHQKGGEAFFGFTDAYGNSVETSCRARX
          |||||||||||||||||||||||:||||||||||||||||||||||||||||||
m731      RAVLSSDVAASGERYTAEHGLFGNATEWHQKGGEAFFGFTDAYGNSVETSCRARX
                80        90       100       110       120
```

The following partial DNA sequence was identified in *N. meningitidis* <SEQ ID 2479>:

```
a731.seq

  1 ATGAATATCA GGTTTTTCGC GCTGACCGTA CCGGTTTTGT CTTTGGCGGC

 51 CTGTGCCGTG CCGGAGGCGT ATGATGACGG CGGACGAGGG CATATGCCGC

101 CCGTTCAAAA CCAAGCCGGC ACGGCAGATT TTCGGGCATT TTCCTGCGAG

151 AACGGTTTGT CTGTGCACGT CCGCCGTTTG ACGGCGGCA GAATCGCGTT

201 GCGGTTGGAC GGCAGGCGTG CCGTCCTCTC TTCCGACGTT GCCGCATCCG

251 GCGAACGCTA TACCGCCGAA CACGGTTTGT TCGGAAACGG AACCGAGTGG

301 CATCAGAAAG GCGGCGAAGC CTTTTTCGGC TTTACCGATG CCTACGGCAA

351 TTCGGTCGAA ACCTCCTGCC GCGCCCGCTA A
```

This corresponds to the amino acid sequence <SEQ ID 2480; ORF 731.a>:

```
a731.pep

  1 MNIRFFALTV PVLSLAACAV PEAYDDGGRG HMPPVQNQAG TADFRAFSCE

 51 NGLSVHVRRL DGGRIALRLD GRRAVLSSDV AASGERYTAE HGLFGNGTEW

101 HQKGGEAFFG FTDAYGNSVE TSCRAR*
```

a731/m731 94.4% identity in 126 aa overlap

```
                10        20        30        40        50        60
a731.pep  MNIRFFALTVPVLSLAACAVPEAYDDGGRGHMPPVQNQAGTADFRAFSCENGLSVHVRRL
          |||||||||||||||||||||||||||||||||||||||||:|||||||||||||:||:|
m731      MNIRFFALTVPVLSLAACAVPEAYDDGGRGHMPPVQNQAGTDDFRAFSCENGLSVRVRHL
                10        20        30        40        50        60

                70        80        90       100       110       120
a731.pep  DGGRIALRLDGRRAVLSSDVAASGERYTAEHGLFGNGTEWHQKGGEAFFGFTDAYGNSVE
          |:|::|||||||||||||||||||||||||||||||:|||||||||||||||||||||||
m731      DSGKVALRLDGRRAVLSSDVAASGERYTAEHGLFGNATEWHQKGGEAFFGFTDAYGNSVE
                70        80        90       100       110       120

a731.pep  TSCRARX
          |||||||
m731      TSCRARX
```

The following partial DNA sequence was identified in *N. gonorrhoeae* <SEQ ID 2481>:

g732.seq

```
   1 ATGTCGAAAC CTGTTTTTAA GAAAATCGCA CTTTATACTT TGGGTGCAAT
  51 CAGCGGCGTG GCCGTAAGTC TGGCGGTGCA GGGTTTTGCC GCCGagaagg
 101 ACGGgcgGGA TAACGAagtC CTGCCGGTGC AATCCATCCG TACGATGGCG
 151 GAGGTTTACG GTCAGATTAA GGCAAACTAC TATCATGACA AACCCGATGC
 201 CGATTTGTTT GAAGGTGCGA TGAAGGGTAT GGTGGCCGGT TTGGATCCGC
 251 ATTCCGAATA TATGGATAAA AAAGGTTATG CCGAGATAAA GGAGTCCACC
 301 AGCGGCGAAT TTGGCGGCTT GGGGATGGAA ATCGGGCAGG AAGACGGTTT
 351 TGTCAAAGTG GTTTCGCCGA TTGAGGACAC GCCTGCCGAA CGGGCGGAGG
 401 TGAAAAGCGG CGATTTCATT GTGAAAATCG ATAATGTTTC GACGCGCGGT
 451 ATGACGGTCA GCGAAGCGGT GAAAAAAATG CGGGGCAAGC CGGGTACGAA
 501 GATTACTTTG ACGTTGTCGC GCAAAAATGC CGACAAGCCG ATAGTCGTCA
 551 ACCTGACCCG TGCCATTATT AAAGTGAAAA GCGTCCGCCA TCACCTGATC
 601 GAACCCGATT ACGGCTATAT CCGCGTGTCG CAGTTCCAAG AGCGGACGGT
 651 CGAAAGCGTC AATACCGCCG CAAAAGAGCT GGTAAAGGAA AATAAAGGAA
 701 AACCGCTCAA GGGGCTGGTG TTGGATTTGC GCGACGACCC CGGCGGGCTT
 751 TTGACCGGCG CGGTCGGCGT GTCGGCGGCG TTTCTGCCGT CTGAAGCGGT
 801 CGTCGTCAGC ACCAAGGGAC GCGACGGCAA AGACGGCATG GTACTGAAAG
 851 CCGTTCCCGA GGATTATGTG TACGGTATGG GCGGCGACCC TTTGGCGGGT
 901 ATTCCTGCCG AGTTGAAAAC GATTCCGATG ACGgtaTTGG TcaaTTCCGG
 951 TTCggcttCC GCGTCGGAGA TTGtcgCCGG CGCATTGCAG GACCACAAAC
1001 GCGCGGTCAT CGTCGGTACG CAGAGCTTCG GTAAAGGTTC GGTTCAGACT
1051 TTGATTCCTT TGTCCAACGG CAGCGCGGTC AAGTTGACGA CCGCCCTGTA
1101 TTACACGCCG AACGACCGTT CCATTCAGGC ACAGGGGATT GTTCCCGATG
1151 TCgaaGTAAA AGATAAGGAA CGTACTTTTG AAAGCCGCGA GGCGGACCTG
1201 GTCGGACACA TCGGCAATCC CTTgggcGGC GAGGATGTGA ACAGTGAAAC
1251 CCttgcCGTA CCGCTTGAAA AAGATGCGGA TAAGCCCGCT GCAAAAGAAA
1301 AAGGTAAAAA GAAAAAGGAC GAGGATTTGT CTTCAAGGCG GATTCCGAAC
1351 CCTGCGAAAG ACGATCAGTT GCGTAAGGCT TTGGATTTGG TCAAGTCGCC
1401 CGAGCAGTGG CAGAAGTCTT TGGGGCTGGC GGCCAAAAAA CCGGTTTCAA
1451 ATAAAGATAA AAAAGATAAG AAGTAG
```

This corresponds to the amino acid sequence <SEQ ID 2482: ORF 732>:

g732.pep

```
   1 MSKPVFKKIA LYTLGAISGV AVSLAVQGFA AEKDGRDNEV LPVQSIRTMA
  51 EVYGQIKANY YHDKPDADLF EGAMKGMVAG LDPHSEYMDK KGYAEIKEST
 101 SGEFGGLGME IGQEDGFVKV VSPIEDTPAE RAEVKSGDFI VKIDNVSTRG
 151 MTVSEAVKKM RGKPGTKITL TLSRKNADKP IVVNLTRAII KVKSVRHHLI
 201 EPDYGYIRVS QFQERTVESV NTAAKELVKE NKGKPLKGLV LDLRDDPGGL
```

-continued

```
251 LTGAVGVSAA FLPSEAVVVS TKGRDGKDGM VLKAVPEDYV YGMGGDPLAG
301 IPAELKTIPM TVLVNSGSAS ASEIVAGALQ DHKRAVIVGT QSFGKGSVQT
351 LIPLSNGSAV KLTTALYYTP NDRSIQAQGI VPDVEVKDKE RTFESREADL
401 VGHIGNPLGG EDVNSETLAV PLEKDADKPA AKEKGKKKKD EDLSSRRIPN
451 PAKDDQLRKA LDLVKSPEQW QKSLGLAAKK PVSNKDKKDK K*
```

The following partial DNA sequence was identified in *N. meningitidis* <*SEQ ID* 2483>:

m732.seq

```
   1 ATGTCGAAAC CTGTTTTTAA GAAAATCGCA CTTTATACTT TGGGTGCAAT
  51 CAGCGGCGTG GCCGTCAGTC TGGCGGTGCA GGGTTTTGCC GCCGAGAAGG
 101 ACAGGCGGGA TAACGAAGTC CTGCCGGTGC AATCCATCCG CACAATGGCG
 151 GAGGTTTACG GTCAAATCAA GGCAAACTAC TATCAGGACA AACCCGATGC
 201 CGATTTGTTT GAAGGTGCGA TGAAGGGTAT GGTGGCCGGT TTGGATCCGC
 251 ATTCCGAATA TATGGATAAA AAAGGTTATG CCGAGATAAA GGAGTCCACC
 301 AGCGGCGAAT TTGGCGGCTT GGGGATGGAA ATCGGGCAGG AAGACGGATT
 351 TGTCAAAGTG GTTTCGCCGA TTGAGGACAC GCCTGCGGAA CGGGCGGGGG
 401 TGAAAAGCGG CGATTTCATT GTGAAAATCG ATAATGTTTC GACACGCGGC
 451 ATGACGGTCA GCGAAGCGGT GAAGAAAATG CGGGGCAAGC CGGGTACGAA
 501 GATTACTTTG ACGCTGTCGC GCAAAAATGC CGACAAGCCG ATAGTCGTCA
 551 ACCTGACCCG TGCCATTATT AAAGTGAAAA GCGTCCGCCA TCACCTGATC
 601 GAACCCGATT ACGGCTATAT CCGCGTGTCG CAGTTCCAAG AGCGGACGGT
 651 CGAAAGCGTC AATACCGCCG CAAAAGAGCT GGTAAAGGAA AATAAAGGAA
 701 AACCGCTCAA GGGGCTGGTG TTGGATTTGC GCGACGACCC CGGCGGGCTT
 751 TTGACTGGCG CGGTCGGCGT GTCGGCGGCA TTTCTGCCGT CTGAAGCAGT
 801 CGTCGTCAGC ACCAAGGGAC GCGACGGCAA AGACCGCATG GTACTGAAAG
 851 CCATTCCTGA AGATTATGTG TACGGGATGG GCGGCGATTC GTTGGCGGGC
 901 ATTCCTGCCG AGTTGAAAAC CATACCGATG ACGGTATTGG TCAATTCCGG
 951 TTCGGCTTCC GCGTCGGAGA TTGTCGCAGG TGCATTGCAG GATCATAAAC
1001 GCGCGGTCAT CGTCGGTACG CAGAGCTTCG GCAAAGGTTC GGTTCAGACT
1051 TTGATTCCTT TGTCCAACGG CAGCGCGGTC AAGCTGACAA CGGCACTGTA
1101 TTATACGCCG AACGACCGTT CTATTCAGGC GCAGGGGATT CTTCCCGATG
1151 TCGAAGTAAA AGATAAGGAA CGCATTTTTG AAAGCCGCGA GGCGGATTTG
1201 GTCGGACACA TCGGCAATCC CTTGGGCGGC GAGGATGTGA ACGGTGAAAC
1251 CCTTGCCGTG CCGCTTGAAA AAGATGCGGA TAAGCCCGCT GTAAAAGAAA
1301 AAGGTAAAAA GAAAAAGGAC GAGGATTTGT CTTCAAGGCG GATTCCCAAC
1351 CCTGCCAAAG ACGACCAGTT GCGGAAAGCT TTGGATTTAG TCAAGTCGCC
1401 CGAGCAGTGG CAGAAGTCTT TGGGGCTGGC GGCGAAAAAG CCGGTTTCAA
1451 ATAAAGATAA GAAAGATAAA AAAGATAAGA AGTAG
```

This corresponds to the amino acid sequence <SEQ ID 2484; ORF 732>:

```
m732.pep

  1 MSKPVFKKIA LYTLGAISGV AVSLAVQGFA AEKDRRDNEV LPVQSIRTMA
 51 EVYGQIKANY YQDKPDADLF EGAMKGMVAG LDPHSEYMDK KGYAEIKEST
101 SGEFGGLGME IGQEDGFVKV VSPIEDTPAE RAGVKSGDFI VKIDNVSTRG
151 MTVSEAVKKM RGKPGTKITL TLSRKNADKP IVVNLTRAII KVKSVRHHLI
201 EPDYGYIRVS QFQERTVESV NTAAKELVKE NKGKPLKGLV LDLRDDPGGL
251 LTGAVGVSAA FLPSEAVVVS TKGRDGKDRM VLKAIPEDYV YGMGGDSLAG
301 IPAELKTIPM TVLVNSGSAS ASEIVAGALQ DHKRAVIVGT QSFGKGSVQT
351 LIPLSNGSAV KLTTALYYTP NDRSIQAQGI VPDVEVKDKE RIFESREADL
401 VGHIGNPLGG EDVNGETLAV PLEKDADKPA VKEKGKKKKD EDLSSRRIPN
451 PAKDDQLRKA LDLVKSPEQW QKSLGLAAKK PVSNKDKKDK KDKK*
```

Computer analysis of the amino acid sequences gave the following results:

Homology with a predicted ORF from *N. meningitidis* menA with menB

ORF 732 shows 98.2% identity over a 491 aa overlap with a predicted ORF (ORF732.a) from *N. gonorrhoeae:* m732/g732 98.2% identity in 491 aa overlap

```
                  10        20        30        40        50        60
m732.pep  MSKPVFKKIALYTLGAISGVAVSLAVQGFAAEKDRRDNEVLPVQSIRTMAEVYGQIKANY
          |||||||||||||||||||||||||||||||||| |||||||||||||||||||||||||
g732      MSKPVFKKIALYTLGAISGVAVSLAVQGFAAEKDGRDNEVLPVQSIRTMAEVYGQIKANY
                  10        20        30        40        50        60

                  70        80        90       100       110       120
m732.pep  YQDKPDADLFEGAMKGMVAGLDPHSEYMDKKGYAEIKESTSGEFGGLGMEIGQEDGFVKV
          |:||||||||||||||||||||||||||||||||||||||||||||||||||||||||||
g732      YHDKPDADLFEGAMKGMVAGLDPHSEYMDKKGYAEIKESTSGEFGGLGMEIGQEDGFVKV
                  70        80        90       100       110       120

                 130       140       150       160       170       180
m732.pep  VSPIEDTPAERAGVKSGDFIVKIDNVSTRGMTVSEAVKKMRGKPGTKITLTLSRKNADKP
          ||||||||||| ||||||||||||||||||||||||||||||||||||||||||||||||
g732      VSPIEDTPAERAEVKSGDFIVKIDNVSTRGMTVSEAVKKMRGKPGTKITLTLSRKNADKP
                 130       140       150       160       170       180

                 190       200       210       220       230       240
m732.pep  IVVNLTRAIIKVKSVRHHLIEPDYGYIRVSQFQERTVESVNTAAKELVKENKGKPLKGLV
          ||||||||||||||||||||||||||||||||||||||||||||||||||||||||||||
g732      IVVNLTRAIIKVKSVRHHLIEPDYGYIRVSQFQERTVESVNTAAKELVKENKGKPLKGLV
                 190       200       210       220       230       240

                 250       260       270       280       290       300
m732.pep  LDLRDDPGGLLTGAVGVSAAFLPSEAVVVSTKGRDGKDRMVLKAIPEDYVYGMGGDSLAG
          |||||||||||||||||||||||||||||||||||||| |||||:|||||||||| |||
g732      LDLRDDPGGLLTGAVGVSAAFLPSEAVVVSTKGRDGKDGMVLKAVPEDYVYGMGGDPLAG
                 250       260       270       280       290       300

                 310       320       330       340       350       360
m732.pep  IPAELKTIPMTVLVNSGSASASEIVAGALQDHKRAVIVGTQSFGKGSVQTLIPLSNGSAV
          ||||||||||||||||||||||||||||||||||||||||||||||||||||||||||||
g732      IPAELKTIPMTVLVNSGSASASEIVAGALQDHKRAVIVGTQSFGKGSVQTLIPLSNGSAV
                 310       320       330       340       350       360

                 370       380       390       400       410       420
m732.pep  KLTTALYYTPNDRSIQAQGIVPDVEVKDKERIFESREADLVGHIGNPLGGEDVNGETLAV
          |||||||||||||||||||||||||||||| ||||||||||||||||||||||:|||||
g732      KLTTALYYTPNDRSIQAQGIVPDVEVKDKERTFESREADLVGHIGNPLGGEDVNSETLAV
                 370       380       390       400       410       420

                 430       440       450       460       470       480
m732.pep  PLEKDADKPAVKEKGKKKKDEDLSSRRIPNPAKDDQLRKALDLVKSPEQWQKSLGLAAKK
          ||||||||:|||||||||||||||||||||||||||||||||||||||||||||||||||
g732      PLEKDADKPAAKEKGKKKKDEDLSSRRIPNPAKDDQLRKALDLVKSPEQWQKSLGLAAKK
                 430       440       450       460       470       480

                 490
m732.pep  PVSNKDKKDKKDKKX
          |||||||||||
g732      PVSNKDKKDKKX
                 490
```

The following partial DNA sequence was identified in *N. meningitidis* <SEQ ID 2485>:

a732.seq

```
   1 ATGTCGAAAC CTGTTTTTAA GAAAATCGCA CTTTATACTT TGGGTGCAAT
  51 CAGCGGCGTG GCCGTCAGTC TGGCGGTGCA GGGTTTTGCC GCCGAGAAGG
 101 ACAGGCGGGA TAACGAAGTC CTGCCGGTGC AATCCATCCG CACAATGGCG
 151 GAGGTTTACG GTCAAATCAA GGCAAACTAC TATCAGGACA AACCCGATGC
 201 CGATTTGTTT GAAGGTGCGA TGAAGGGTAT GGTGGCCGGT TTGGATCCGC
 251 ATTCCGAATA TATGGATAAA AAAGGTTATG CCGAGATAAA GGAGTCCACC
 301 AGCGGCGAAT TTGGCGGCTT GGGGATGGAA ATCGGGCAGG AAGACGGATT
 351 TGTCAAAGTG GTTTCGCCGA TTGAGGACAC GCCTGCGGAA CGGGCGGGGG
 401 TGAAAAGCGG CGATTTCATT GTGAAAATCG ATAATGTTTC GACACGCGCC
 451 ATGACGGTCA GCGAAGCGGT GAAGAAAATG CGGGGCAAGC CGGGTACGAA
 501 GATTACTTTG ACGCTGTCGC GCAAAAATGC CGACAAGCCG ATAGTCGTCA
 551 ACCTGACCCG TGCCATTATT AAAGTGAAAA GCGTCCGCCA TCACCTGATC
 601 GAACCCGATT ACGGCTATAT CCGCGTGTCG CAGTTCCAAG AGCGGACGGT
 651 CGAAAGCGTC AATACCGCCG CAAAAGAGCT GGTAAAGGAA AATAAAGGAA
 701 AACCGCTCAA GGGGCTGGTG TTGGATTTGC GCGACGACCC CGGCGGGCTT
 751 TTGACTGGCG CGGTCGGCGT GTCGGCGGCA TTTCTGCCGT CTGAAGCAGT
 801 CGTCGTCAGC ACCAAGGGAC GCGACGGCAA AGACCGCATG GTACTGAAAG
 851 CCGTTCCTGA AGATTATGTG TACGGGATGG GCGGCGATTC GTTGGCGGGC
 901 ATTCCTGCCG AGTTGAAAAC CATACCGATG ACGGTATTGG TCAATTCCGG
 951 TTCGGCTTCC GCGTCGGAGA TTGTCGCAGG TGCATTGCAG GATCATAAAC
1001 GCGCGGTCAT CGTCGGTACG CAGAGCTTCG GCAAAGGTTC GGTTCAGACT
1051 TTGATTCCTT TGTCCAACGG CAGCGCGGTC AAGCTGACAA CGGCACTGTA
1101 TTATACGCCG AACGACCGTT CTATTCAGGC GCAGGGGATT GTTCCCGATG
1151 TCGAAGTAAA AGATAAGGAA CGCATTTTTG AAAGCCGCGA GGCGGATTTG
1201 GTCGGACACA TCGGCAATCC TTTGGGCGGC GAGGATGTGA ACAGTGAAAC
1251 CCTTGCCGTG CCGCTTGAAA AAGATGCGGA TAAGCCCGCT GTAAAAGAAA
1301 AAGGTAAAAA GAAAAAGGAC GAGGATTTGT CTTCAAGGCG GATTCCCAAC
1351 CCTGCCAAAG ACGACCAGTT GCGGAAAGCT TTGGATTTAG TCAAGTCGCC
1401 CGAGCAGTGG CAGAAGTCTT TGGGGCTGGC GGCGAAAAAG CCGGTTTCAA
1451 ATAAAGATAA GAAAGATAAA AAAGATAAGA AGTAG
```

This corresponds to the amino acid sequence <SEQ ID 2486; ORF 732.a>:

a732.pep

```
  1 MSKPVFKKIA LYTLGAISGV AVSLAVQGFA AEKDRRDNEV LPVQSIRTMA
 51 EVYGQIKANY YQDKPDADLF EGAMKGMVAG LDPHSEYMDK KGYAEIKEST
101 SGEFGGLGME IGQEDGFVKV VSPIEDTPAE RAGVKSGDFI VKIDNVSTRG
```

-continued

```
151 MTVSEAVKKM RGKPGTKITL TLSRKNADKP IVVNLTRAII KVKSVRHHLI

201 EPDYGYIRVS QFQERTVESV NTAAKELVKE NKGKPLKGLV LDLRDDPGGL

251 LTGAVGVSAA FLPSEAVVVS TKGRDGKDRM VLKAVPEDYV YGMGGDSLAG

301 IPAELKTIPM TVLVNSGSAS ASEIVAGALQ DHKRAVIVGT QSFGKGSVQT

351 LIPLSNGSAV KLTTALYYTP NDRSIQAQGI VPDVEVKDKE RIFESREADL

401 VGHIGNPLGG EDVNSETLAV PLEKDADKPA VKEKGKKKKD EDLSSRRIPN

451 PAKDDQLRKA LDLVKSPEQW QKSLGLAAKK PVSNKDKKDK KDKK*
```

a732/m732 99.6% identity in 494 aa overlap

```
                   10        20        30        40        50        60
a732.pep    MSKPVFKKIALYTLGAISGVAVSLAVQGFAAEKDRRDNEVLPVQSIRTMAEVYGQIKANY
            ||||||||||||||||||||||||||||||||||||||||||||||||||||||||||||
m732        MSKPVFKKIALYTLGAISGVAVSLAVQGFAAEKDRRDNEVLPVQSIRTMAEVYGQIKANY
                   10        20        30        40        50        60

                   70        80        90       100       110       120
a732.pep    YQDKPDADLFEGAMKGMVAGLDPHSEYMDKKGYAEIKESTSGEFGGLGMEIGQEDGFVKV
            ||||||||||||||||||||||||||||||||||||||||||||||||||||||||||||
m732        YQDKPDADLFEGAMKGMVAGLDPHSEYMDKKGYAEIKESTSGEFGGLGMEIGQEDGFVKV
                   70        80        90       100       110       120

                  130       140       150       160       170       180
a732.pep    VSPIEDTPAERAGVKSGDFIVKIDNVSTRGMTVSEAVKKMRGKPGTKITLTLSRKNADKP
            ||||||||||||||||||||||||||||||||||||||||||||||||||||||||||||
m732        VSPIEDTPAERAGVKSGDFIVKIDNVSTRGMTVSEAVKKMRGKPGTKITLTLSRKNADKP
                  130       140       150       160       170       180

                  190       200       210       220       230       240
a732.pep    IVVNLTRAIIKVKSVRHHLIEPDYGYIRVSQFQERTVESVNTAAKELVKENKGKPLKGLV
            ||||||||||||||||||||||||||||||||||||||||||||||||||||||||||||
m732        IVVNLTRAIIKVKSVRHHLIEPDYGYIRVSQFQERTVESVNTAAKELVKENKGKPLKGLV
                  190       200       210       220       230       240

                  250       260       270       280       290       300
a732.pep    LDLRDDPGGLLTGAVGVSAAFLPSEAVVVSTKGRDGKDRMVLKAVPEDYVYGMGGDSLAG
            |||||||||||||||||||||||||||||||||||||||||||:||||||||||||||||
m732        LDLRDDPGGLLTGAVGVSAAFLPSEAVVVSTKGRDGKDRMVLKAIPEDYVYGMGGDSLAG
                  250       260       270       280       290       300

                  310       320       330       340       350       360
a732.pep    IPAELKTIPMTVLVNSGSASASEIVAGALQDHKRAVIVGTQSFGKGSVQTLIPLSNGSAV
            ||||||||||||||||||||||||||||||||||||||||||||||||||||||||||||
m732        IPAELKTIPMTVLVNSGSASASEIVAGALQDHKRAVIVGTQSFGKGSVQTLIPLSNGSAV
                  310       320       330       340       350       360

                  370       380       390       400       410       420
a732.pep    KLTTALYYTPNDRSIQAQGIVPDVEVKDKERIFESREADLVGHIGNPLGGEDVNSETLAV
            ||||||||||||||||||||||||||||||||||||||||||||||||||||||:|||||
m732        KLTTALYYTPNDRSIQAQGIVPDVEVKDKERIFESREADLVGHIGNPLGGEDVNGETLAV
                  370       380       390       400       410       420

                  430       440       450       460       470       480
a732.pep    PLEKDADKPAVKEKGKKKKDEDLSSRRIPNPAKDDQLRKALDLVKSPEQWQKSLGLAAKK
            ||||||||||||||||||||||||||||||||||||||||||||||||||||||||||||
m732        PLEKDADKPAVKEKGKKKKDEDLSSRRIPNPAKDDQLRKALDLVKSPEQWQKSLGLAAKK
                  430       440       450       460       470       480

                  490
a732.pep    PVSNKDKKDKKX
            ||||||||||||
m732        PVSNKDKKDKKX
                  490
```

The following partial DNA sequence was identified in *N. gonorrhoeae* <SEQ ID 2487>:

g733.seq

```
  1 ATGATGAATC CGAAAACCTT GGGCCGTTTG TCGCTGTGTG CGGCGGTCTT

 51 GGCTCTGACC GCCTGCGCCG GCGGCGGGCA TAAAAACCTG TATTATTACG

101 GCGGTTATCC CGATACCGTC TATGAAGGTT TGAAAAACGa cgACACTTCG

151 TTGGGCAAGC AGACCGAAAA GATGGAAAAA TACTTTGCGG AAGCCGCCAA
```

-continued

```
201 CAAAAAAATG AATGCCGCCC CGGGTGCGCA CGCCCATTTG GGACTGCTGC
251 TTTCCCGTTC GGGAGACAAA GAGGGCGCGT TCCGCCAATT TGAAGAAGAG
301 AAAAGGCTGT TTCCCGAATC GGGCGTATTT ATGGACTTCC TGATGAAAAC
351 CGGtaaAGGA GGCAAGCGAT GA
```

This corresponds to the amino acid sequence <SEQ ID 2488; ORF 733>:

g733.pep

```
  1 MMNPKTLGRL SLCAAVLALT ACAGGGHKNL YYYGGYPDTV YEGLKNDDTS
 51 LGKQTEKMEK YFAEAANKKM NAAPGAHAHL GLLLSRSGDK EGAFRQFEEE
101 KRLFPESGVF MDFLMKTGKG GKR*
```

The following partial DNA sequence was identified in *N. meningitidis* <SEQ ID 2489>:

m733.seq

```
  1 ATGATGAATC CGAAAACCTT GAGCCGTTTG TCGCTGTGTG CGGCGGTCTT
 51 GGCTCTGACC GCCTGCGGCG GCAACGGGCA AAAATCCCTG TATTATTACG
101 GCGGCTATCC CGATACCGTC TATGAAGGTT TGAAAAACGA CGACACTTCG
151 TTGGGCAAGC AGACCGAAAA GATGGAAAAA TACTTTGTGG AAGCCGGCAA
201 CAAAAAAATG AATGCCGCCC CGGGTGCGCA CGCCCATCTG GGACTGCTGC
251 TTTCCCGTTC GGGAGACAAA GAGGGCGCGT TCCGCCAGTT TGAAGAAGAG
301 AAAAGGCTGT TTCCCGAATC GGGCGTATTT ATGGACTTCC TGATGAAAAC
351 CGGTAAAGGA GGCAAGCGAT GA
```

This corresponds to the amino acid sequence <SEQ ID 2490; ORF 733>:

m733.pep

```
  1 MMNPKTLSRL SLCAAVLALT ACGGNGQKSL YYYGGYPDTV YEGLKNDDTS
 51 LGKQTEKMEK YFVEAGNKKM NAAPGAHAHL GLLLSRSGDK EGAFRQFEEE
101 KRLFPESGVF MDFLMKTGKG GKR*
```

Computer analysis of the amino acid sequences gave the following results:

Homology with a predicted ORF from *N. meningitidis* menA with menB

ORF 733 shows 94.3% identity over a 123 aa overlap with a predicted ORF (ORF733.a) from *N. gonorrhoeae*:

m733/g733

```
                   10        20        30        40        50        60
m733.pep   MMNPKTLSRLSLCAAVLALTACGGNGQKSLYYYGGYPDTVYEGLKNDDTSLGKQTEKMEK
           |||||||:||||||||||||||:|:|:|:|||||||||||||||||||||||||||||||
g733       MMNPKTLGRLSLCAAVLALTACAGGGHKNLYYYGGYPDTVYEGLKNDDTSLGKQTEKMEK
                   10        20        30        40        50        60
```

-continued

```
                  70        80        90       100       110       120
m733.pep  YFVEAGNKKMNAAPGAHAHLGLLLSRSGDKEGAFRQFEEEKRLFPESGVFMDFLMKTGKG
          ||:||:||||||||||||||||||||||||||||||||||||||||||||||||||||||
g733      YFAEAANKKMNAAPGAHAHLGLLLSRSGDKEGAFRQFEEEKRLFPESGVFMDFLMKTGKG
                  70        80        90       100       110       120

m733.pep  GKRX
          ||||
g733      GKRX
```

The following partial DNA sequence was identified in *N. meningitidis* <SEQ ID 2491>:

a733.seq

```
  1 ATGATGAATC CGAAAACCTT GAGCCGTTTG TCGCTGTGTG CGGCGGTCTT
 51 GGCTCTGACC GCCTGCGGCG GCAACGGGCA AAAATCCCTG TATTATTACG
101 GCGGCTATCC CGATACCGTC TATGAAGGTT TGAAAAACGA CGACACTTCG
151 TTGGGCAAGC AGACCGAAAA GATGGAAAAA TACTTTGTGG AAGCCGGCAA
201 CAAAAAAATG AATGCCGCCC CGGGTGCGCA CGCCCATCTG GGACTGCTGC
251 TTTCCCGTTC GGGAGACAAA GAGGGCGCGT TCCGCCAGTT TGAAGAAGAG
301 AAAAGGCTGT TTCCCGAATC GGGCGTATTT ATGGACTTCC TGATGAAAAC
351 CGGTAAAGGA GGCAAGCGAT GA
```

This corresponds to the amino acid sequence <SEQ ID 2492; ORF 733.a>:

a733.pep

```
  1 MMNPKTLSRL SLCAAVLALT ACGGNGQKSL YYYGGYPDTV YEGLKNDDTS
 51 LGKQTEKMEK YFVEAGNKKM NAAPGAHAHL GLLLSRSGDK EGAFRQFEEE
101 KRLFPESGVF MDFLMKTGKG GKR*
```

a733/m733 100.0% identity in 123 aa overlap

```
                  10        20        30        40        50        60
a733.pep  MMNPKTLSRLSLCAAVLALTACGGNGQKSLYYYGGYPDTVYEGLKNDDTSLGKQTEKMEK
          ||||||||||||||||||||||||||||||||||||||||||||||||||||||||||||
m733      MMNPKTLSRLSLCAAVLALTACGGNGQKSLYYYGGYPDTVYEGLKNDDTSLGKQTEKMEK
                  10        20        30        40        50        60
                  70        80        90       100       110       120
a733.pep  YFVEAGNKKMNAAPGAHAHLGLLLSRSGDKEGAFRQFEEEKRLFPESGVFMDFLMKTGKG
          ||||||||||||||||||||||||||||||||||||||||||||||||||||||||||||
m733      YFVEAGNKKMNAAPGAHAHLGLLLSRSGDKEGAFRQFEEEKRLFPESGVFMDFLMKTGKG
                  70        80        90       100       110       120

a733.pep  GKRX
          ||||
m733      GKRX
```

The following partial DNA sequence was identified in *N. gonorrhoeae* <SEQ ID 2493>:

g734.seq

```
  1 ATGATGAAAA AGATACTGGC AGTATCGGCA CTATGCCTGA TGACTGCGGC
 51 GGCACAGGCT GCCGATACTT ACGGCTATCT CGCCGTTTGG CAGAATCCGC
```

-continued

```
101 AGGATGCAAA CGATGTTTTG CAGGTTAAAA CCACAAAAGA AGATTCGGCG

151 AAAAGCGAAG CGTTTGCCGA GTTGGAAGCC TTTTGCAAAG GTCAGGACAC

201 GCTTGCGGGC ATTGCCGAAG ACGAGCCGAC CGGATGCCGG TCGGTCGTGT

251 CGCTGAACAA TACCTGTGTC TCGCTGGCAT ACCCGAAAGC CTTGGGCGCG

301 ATGCGCGTTG AAAACGCCGT CGTGATTACT TCTCCGCGTT TTACGAGCGT

351 TCATCAGCTC GCACTCAACC AGTGCATAAA AAAATACGGC GCACAGGGAC

401 AATGCGGCTT GGAAACAGTG TATTGCACGT CATCTTCTTA TTACGGCGGG

451 GCTGTTCGCT CCTTAATCCA ACACCTGAAA TAA
```

This corresponds to the amino acid sequence <SEQ ID 2494; ORF 734.ng>:

g734.pep

```
  1 MMKKILAVSA LCLMTAAAQA ADTYGYLAVW QNPQDANDVL QVKTTKEDSA

 51 KSEAFAELEA FCKGQDTLAG IAEDEPTGCR SVVSLNNTCV SLAYPKALGA

101 MRVENAVVIT SPRFTSVHQV ALNQCIKKYG AQGQCGLETV YCTSSSYYGG

151 AVRSLIQHLK *
```

The following partial DNA sequence was identified in *N. meningitidis* <SEQ ID 2495>:

m734.seq (partial)

```
  1 TCGGGCATTG CTGAAGACGA GCCGACCGGA TGCCGGTCGG TCGTGTCGCT

 51 GAACAATACC TGTGTCGCGC TGGCATACCC GAAAGCCTTG GGCGCGCTGC

101 GTGTCGACAA CGCCGTCGTG ATTACTTCTC CGCGTTTTAC GAGCGTTCAT

151 CAGGTCGCAC TCAACCAGTG CATCAAAAAA TACGGCGTAC AGGGACAATG

201 CGGCTTGGAA ACAGTGTATT GCACATCTTC TTCTTATTAC GGCGGAACTG

251 TGCGCTCTTT GATTCAAAAT CTCAAATAA
```

This corresponds to the amino acid sequence <SEQ ID 2496; ORF 734>:

m734.pep (partial)

```
 1 SGIAEDEPTG CRSVVSLNNT CVALAYPKAL GALRVDNAVV ITSPRFTSVH

51 QVALNQCIKK YGVQGQCGLE TVYCTSSSYY GGTVRSLIQN LK*
```

m734/g734 92.4% identity in 92 aa overlap

```
                                                    10        20        30
m734.pep                                     SGIAEDEPTGCRSVVSLNNTCVALAYPKAL
                                             :|||||||||||||||||||||:|||||||
g734       VLQVKTTKEDSAKSEAFAELEAFCKGQDTLAGIAEDEPTGCRSVVSLNNTCVSLAYPKAL
           40        50        60        70        80        90
```

-continued

```
                 40        50        60        70        80        90
m734.pep     GALRVDNAVVITSPRFTSVHQVALNQCIKKYGVQGQCGLETVYCTSSSYYGGTVRSLIQN
             ||:||:|||||||||||||||||||||||||:|||||||||||||||||:||||||:
g734         GAMRVENAVVITSPRFTSVHQVALNQCIKKYGAQGQCGLETVYCTSSSYYGGAVRSLIQH
            100       110       120       130       140       150

m734.pep     LKX
             |||
g734         LKX
            160
```

The following partial DNA sequence was identified in *N. meningitidis* <SEQ ID 2497>:

a734.seq

```
  1 ATGATGAAAA AGATACTGGC CGTATCGGCA CTATGCCTGA TGACTGCGGC
 51 GGCACGGGCT GCCGATACTT ACGGCTATCT CGCCGTTTGG CAGAATCCGC
101 AGAATGCAAA CGATGTTTTG CAGGTTAAAA CCACAAAAGA AGATTCGACG
151 AAAAGCGAAG CGTTTGCCGA GTTGGAAGCT TTCTGCAAAG GTCAGGACAC
201 GCTTGCGGGC ATTGCCGAAG ACGAGCCGAC CGGATGCCGG TCGGTCGTGT
251 CGCTGAACAA TACCTGTGTC GCGCTGGCAT ACCCGAAAGC CTTGGGCGCG
301 ATGCGCGTTG AAAACGCCGT TGTGATTACT TCTCCGCGTT TTACGAGCGT
351 TTATCAGGTC GCACTCAACC AGTGCATCAA AAAATACGCC GCACAGGGAC
401 AATGCGGCTT GGAAACAGTG TATTGCACGT CTTCTTCTTA TTACGGGGGA
451 ACTGTGCGCT CTTTGATTCA AAATCTCAAA TAA
```

This corresponds to the amino acid sequence <SEQ ID 2498; ORF 734.a>:

a734.pep

```
  1 MMKKILAVSA LCLMTAAARA ADTYGYLAVW QNPQNANDVL QVKTTKEDST
 51 KSEAFAELEA FCKGQDTLAG IAEDEPTGCR SVVSLNNTCV ALAYPKALGA
101 MRVENAVVIT SPRFTSVYQV ALNQCIKKYG AQGQCGLETV YCTSSSYYGG
151 TVRSLIQNLK *
```

a734/g734 95.6% identity in 160 aa overlap

```
                    10        20        30        40        50        60
a734.pep     MMKKILAVSALCLMTAAARAADTYGYLAVWQNPQNANDVLQVKTTKEDSTKSEAFAELEA
             |||||||||||||||||:||||||||||||||||:||||||||||||||:||||||||||
g734         MMKKILAVSALCLMTAAAQAADTYGYLAVWQNPQDANDVLQVKTTKEDSAKSEAFAELEA
                    10        20        30        40        50        60
                    70        80        90       100       110       120
a734.pep     FCKGQDTLAGIAEDEPTGCRSVVSLNNTCVALAYPKALGAMRVENAVVITSPRFTSVYQV
             ||||||||||||||||||||||||||||||:|||||||||||||||||||||||||:||
g734         FCKGQDTLAGIAEDEPTGCRSVVSLNNTCVSLAYPKALGAMRVENAVVITSPRFTSVHQV
                    70        80        90       100       110       120
                   130       140       150       160
a734.pep     ALNQCIKKYGAQGQCGLETVYCTSSSYYGGTVRSLIQNLKX
             ||||||||||||||||||||||||||||||:||||||:|||
g734         ALNQCIKKYGAQGQCGLETVYCTSSSYYGGAVRSLIQHLKX
                   130       140       150       160
```

g735.seq not found yet g735.pep not found yet

The following partial DNA sequence was identified in *N. meningitidis* <SEQ ID 2499>:

m735.seq

```
  1 ATGAATCTCG TGAAACTGCT GGCGAATAAC TGGCAACCGA TTGCCATTAT
 51 CGCGCTTGTC GGCACGGGCT TGGCTGTGTC GCACCATCAA GGCTACAAGT
101 CGGCATTTGC GAAGCAGCAG GCGGTCATCG ACAAGATGGA GCGCGACAAG
151 GCGCAAGCCC TGCTGTTGTC GGCTCAAAAC TATGCGCGCG AACTGGAACT
201 GGCACGCGCG GAAGCTAAAA AATATGAAGT CAAGGCGCAC GCTGTCGGCA
251 TGGCTTTGGC GAAAAAACAG GCGGAAGTCA GCCGTCTGAA AACGGAAAAT
301 AAAAAGGAAA TCGAAAATGT CCTTACTCAA GACCGTAAAA ATGCAAGCGG
351 CGGTTGCATT GACGGCTTTG GCTCTCACGG CCTGCAGCTC TACAACCGCG
401 CCCTCGGCTA CGGAAATTAA
```

This corresponds to the amino acid sequence <SEQ ID 2500; ORF 735>:

m735.pep

```
  1 MNLVKLLANN WQPIAIIALV GTGLAVSHHQ GYKSAFAKQQ AVIDKMERDK
 51 AQALLLSAQN YARELELARA EAKKYEVKAH AVGMALAKKQ AEVSRLKTEN
101 KKEIENVLTQ DRKNASGGCI DGFGSHGLQL YNRALGYGN*
```

The following partial DNA sequence was identified in *N. meningitidis* <SEQ ID 2501>:

a735.seq

```
  1 ATGAATCTCG TGAAACTGCT GGCGAATAAC TGGCAACCGA TTGCCATCAT
 51 CGCGCTTGTC GGCACGGGTT TGGCGGTGTC GCACCATCAA GGCTACAAGT
101 CGGCTTTTGC GAAGCAGCAG GCGGTCATTG AGAAAATGAA GCGCGACAAG
151 GCGCAAGCCC TGCTGTTGTC GGCTCAAAAC TACGCCCGCG AACTGGAACA
201 GGCGCGTGCG GAAGCTAAAA AATATGAAGT CAAGGCGCAC GCCGTCGGCA
251 TGGCTTTGGC GAAAAAACAG GCGGAAGTCA GCCGTCTGAA AACGGAAAAT
301 AAAAAGGAAA TCGAAAATGT CCTTACTCAA GACCGTAAAA ATGCAGGCGG
351 CGGTTGTATT GACGGCTTTG GCCATCACGG CTTGCAGCTC TACAAGCGCG
401 CCCTCGGCTA CGGAAATTAA
```

This corresponds to the amino acid sequence <SEQ ID 2502; ORF 735.a>:

a735.pep

```
  1 MNLVKLLANN WQPIAIIALV GTGLAVSHHQ GYKSAFAKQQ AVIEKMKRDK
 51 AQALLLSAQN YARELEQARA EAKKYEVKAH AVGMALAKKQ AEVSRLKTEN
101 KKEIENVLTQ DRKNAGGGCI DGFGHHGLQL YKRALGYGN*
```

a735/m735 95.7% identity in 139 aa overlap

```
                10         20         30         40         50         60
a735.pep  MNLVKLLANNWQPIAIIALVGTGLAVSHHQGYKSAFAKQQAVIEKMKRDKAQALLLSAQN
          |||||||||||||||||||||||||||||||||||||||||||:||:|||||||||||||
m735      MNLVKLLANNWQPIAIIALVGTGLAVSHHQGYKSAFAKQQAVIDKMERDKAQALLLSAQN
                10         20         30         40         50         60
                70         80         90        100        110        120
a735.pep  YARELEQARAEAKKYEVKAHAVGMALAKKQAEVSRLKTENKKEIENVLTQDRKNAGGGCI
          |||||| ||||||||||||||||||||||||||||||||||||||||||||||||:||||
m735      YARELELARAEAKKYEVKAHAVGMALAKKQAEVSRLKTENKKEIENVLTQDRKNASGGCI
                70         80         90        100        110        120
               130        140
a735.pep  DGFGHHGLQLYKRALGYGNX
          |||| ||||||:||||||||
m735      DGFGSHGLQLYNRALGYGNX
               130        140
```

The following partial DNA sequence was identified in *N. gonorrhoeae* <SEQ ID 2503>:

g736.seq

```
  1 ATGAATTTTA TCCGTTCCGT CGGGGCGAAA ACCCTCGGCC TTATTCAATC
 51 CTTCGGCAGT ATCACGCTGT TTCTGCTGAA CATTTTGGCG AAATCCGGCA
101 CGGCTTTCGC CCGTCCGCGC CTGAGCGTGC GCCAAGTGTA TTTTGCCGGC
151 GTGCTGTCGG TGCTGATTGT TGCCGTTTCG GGGCTGTTCG TCGGTATGGT
201 TTTGGGTTTG CAGGGCTATA CGCAGTTGTC GAAATTCAAA TCCGCCGATA
251 TTTTGGGCTA TATGGTCGCG GCTTCTCTGT TGCGCGAACT GGGTCCCGTG
301 TTGGCGGCGA TTCTGTTTGC CAGCAGCGCG GGCGGTGCGA TGACCAGCGA
351 AATCGGTTTG ATGAAAACGA CCGGACAGCT CGAAGCGATG AACGTGATGG
401 CGGTCAACCC CGTCGCCCGC GTGGTTGCCC CGCGTTTTTG GGCGGGCGTG
451 TTTTCTATGC CGCTTTTGGC TTCGATTTTC AACGTCGCGG GCATTTTCGG
501 CGCGTATTTG GTCGGCGTGA GCTGGCTGGG TTTGGACAGC GGTATTTTCT
551 GGCCGCAGAT GCAGAACAAC ATTACGATAC ATTACGATGT AATCAACGGT
601 TTGATCAAAT CCGCCGCGTT CGGCGTGGCG GTAACGCTGA TTGCCGTGCA
651 TCAGGGCTTC CACTGCATCC CGACTTCGGA AGGCATTTTG CGCGCCAGCA
701 CGCGCACGGT GGTTTCGTCC GCCCTGACGA TTTTGGCGGT CGATTTTATA
751 TTGACCGCGT GGATGTTTAC AGATTGA
```

This corresponds to the amino acid sequence <SEQ ID 2504, ORF 736>:

g736.pep

```
  1 MNFIRSVGAK TLGLIQSFGS ITLFLLNILA KSGTAFARPR LSVRQVYFAG
 51 VLSVLIVAVS GLFVGMVLGL QGYTQLSKFK SADILGYMVA ASLLRELGPV
101 LAAILFASSA GGAMTSEIGL MKTTGQLEAN NVMAVNPVAR VVAPRFWAGV
151 FSMPLLASIF NVAGIFGAYL VGVSWLGLDS GIFWPQMQNN ITIHYDVING
201 LIKSAAFGVA VTLIAVHQGF HCIPTSEGIL RASTRTVVSS ALTILAVDFI
251 LTAWMFTD*
```

The following partial DNA sequence was identified in *N. meningitidis* <SEQ ID 2505>:

m736.seq

```
  1 ATGAATTTTA TCCGTTCCGT CGGGGCGAAA ACCCTCGGCC TTATTCAATC
 51 CTTCGGCAGT ATCACGCTGT TTCTGCTGAA CATTTTGGCG AAATCCGGCA
101 CGGCTTTCGC CCGTCCGCGC CTGAGCGTGC GCCAAGTGTA TTTTGCCGGC
151 GTGCTGTCGG TGCTGATTGT TGCCGTTTCG GGGCTGTTCG TCGGTATGGT
201 TTTGGGTTTG CAGGGCTATA CGCAGTTGTC GAAATTCAAA TCCGCCGATA
251 TTTTGGGCTA TATGGTCGCG GCTTCTCTGT TGCGCGAACT GGGTCCCGTG
301 TTGGCGGCGA TTCTGTTTGC CAGCAGCGCG GGCGGTGCGA TGACCAGCGA
351 AATCGGTTTG ATGAAAACGA CCGGACAGCT CGAAGCGATG AACGTGATGG
401 CGGTCAACCC CGTCGCCCGC GTGGTTGCCC CGCGTTTTTG GGCGGGCGTG
451 TTTTCTATGC CGCTTTTGGC TTCGATTTTC AACGTCGCGC GCATTTTCGG
501 CGCGTATTTG GTCGGCGTGA GCTGGCTGGG TTTGGACAGC GGTATTTTCT
551 GGCCGCAGAT GCAGAACAAC ATTACGATAC ATTACGATGT AATCAACGGT
601 TTGATCAAAT CCGCCGCGTT CGGCGTGGCG GTAACGCTGA TTGCCGTGCA
651 TCAGGGCTTC CACTGCATCC CGACTTCGGA AGGCATTTTG CGCGCCAGCA
701 CGCGCACGGT GGTTTCGTCC GCCCTGACGA TTTTGGCGGT CGATTTTATA
751 TTGACCGCGT GGATGTTTAC AGATTGA
```

This corresponds to the amino acid sequence <SEQ ID 2506; ORF 736>:

m736.pep

```
  1 MNFIRSVGAK TLGLIQSLGS ITLFLLNILA KSGTAFVRPR LSVRQVYFAG
 51 VLSVLIVAVS GLFVGMVLGL QGYTQLSKFK SADILGYMVA ASLLRELGPV
101 LAAILFASSA GGAMTSEIGL MKTTEQLEAM NVMAVNPVAR VVAPRFWAGV
151 FSMPLLASIF NVAGIFGAYL VGVTWLGLDS GIFWSQMQNN ITIHYDVING
201 LIKSAAFGVA VTLIAVHQGF HCVPTSEGIL RASTRTVVSS ALTILAVDFI
251 LTAWMFTD*
```

Computer analysis of the amino acid sequences gave the following results:

Homology with a predicted ORF from *N. meningitidis* menA with menB

ORF 736 shows 97.7% identity over a 258 aa overlap with a predicted ORF (ORF736.ng) from *N. gonorrhoeae*:

m736/g736

```
                  10        20        30        40        50        60
m736.pep  MNFIRSVGAKTLGLIQSLGSITLFLLNILAKSGTAFVRPRLSVRQVYFAGVLSVLIVAVS
          ||||||||||||||||:||||||||||||||||||||:||||||||||||||||||||||
g736      MNFIRSVGAKTLGLIQSFGSITLFLLNILAKSGTAFARPRLSVRQVYFAGVLSVLIVAVS
                  10        20        30        40        50        60

                  70        80        90       100       110       120
m736.pep  GLFVGMVLGLQGYTQLSKFKSADILGYMVAASLLRELGPVLAAILFASSAGGAMTSEIGL
          ||||||||||||||||||||||||||||||||||||||||||||||||||||||||||||
g736      GLFVGMVLGLQGYTQLSKFKSADILGYMVAASLLRELGPVLAAILFASSAGGAMTSEIGL
                  70        80        90       100       110       120
```

-continued

```
                 130       140       150       160       170       180
m736.pep  MKTTEQLEAMNVMAVNPVARVVAPRFWAGVFSMPLLASIFNVAGIFGAYLVGVTWLGLDS
          |||| |||||||||||||||||||||||||||||||||||||||||||||||||:||||||
g736      MKTTGQLEAMNVMAVNPVARVVAPRFWAGVFSMPLLASIFNVAGIFGAYLVGVSWLGLDS
                 130       140       150       160       170       180

                 190       200       210       220       230       240
m736.pep  GIFWSQMQNNITIHYDVINGLIKSAAFGVAVTLIAVHQGFHCVPTSEGILRASTRTVVSS
          |||| |||||||||||||||||||||||||||||||||||||:|||||||||||||||||
g736      GIFWPQMQNNITIHYDVINGLIKSAAFGVAVTLIAVHQGFHCIPTSEGILRASTRTVVSS
                 190       200       210       220       230       240

                 250      259
m736.pep  ALTILAVDFILTAWMFTDX
          ||||||||||||||||||
g736      ALTILAVDFILTAWMFTDX
                 250
```

The following partial DNA sequence was identified in *N. meningitidis* <SEQ ID 2507>:

a736.seq

```
  1 ATGAATTTTA TCCGTTCCGT CGGGGCGAAA ACCCTCGGCC TTATTCAATC
 51 TCTCGGCAGT ATCACGCTGT TTCTGCTGAA TATTCTGGCG AAATCCGGTA
101 CGGCTTTCGT CCGTCCGCGC CTGAGCGTGC GCCAAGTGTA TTTTGCCGGC
151 GTGCTGTCGG TGTTGATTGT TGCCGTTTCA GGGCTGTTTG TCGGCATGGT
201 CTTGGGTTTG CAGGGCTATA CGCAGTTGTC GAAATTCAAA TCCGCCGATA
251 TTTTGGGCTA TATGGTCGCG GCTTCGCTGT TGCGCGAACT GGGTCCGGTG
301 TTGGCGGCGA TTCTGTTTGC CAGCAGCGCG GGCGGTGCGA TGACCAGCGA
351 AATCGGTTTG ATGAAAACGA CCGAACAGCT CGAAGCGATG AACGTGATGG
401 CGGTAAACCC CGTCGCCCGA GTGGTTGCGC CGCGCTTTTG GGCGGGCGTG
451 TTTTCCATGC CGCTTTTGGC TTCGATTTTC AACGTGGCGG GTATTTTCGG
501 CGCGTATTTG GTCGGTGTAA CCTGGCTGGG CTTGGACAGC GGTATTTTCT
551 GGTCGCAAAT GCAGAACAAC ATCACGATAC ATTACGATGT AATCAACGGT
601 CTGATCAAAT CCGCCGCGTT CGGCGTGGCG GTAACGCTGA TTGCCGTGCA
651 TCAGGGCTTC CACTGCGTCC CGACCTCGGA AGGCATTTTG CGCGCCAGCA
701 CGCGCACGGT GGTTTCGTCC GCCCTGACGA TTTTGGCGGT CGATTTTATA
751 TTGACCGCGT GGATGTTTAC AGATTGA
```

This corresponds to the amino acid sequence <SEQ ID 2508; ORF 736.a>:

a736.pep

```
  1 MNFIRSVGAK TLGLIQSLGS ITLFLLNILA KSGTAFVRPR LSVRQVYFAG
 51 VLSVLIVAVS GLFVGMVLGL QGYTQLSKFK SADILGYMVA ASLLRELGPV
101 LAAILFASSA GGAMTSEIGL MKTTEQLEAM NVMAVNPVAR VVAPRFWAGV
151 FSMPLLASIF NVAGIFGAYL VGVTWLGLDS GIFWSQMQNN ITIHYDVING
201 LIKSAAFGVA VTLIAVHQGF HCVPTSEGIL RASTRTVVSS ALTILAVDFI
251 LTAWMFTD*
```

a736/m736 100.0% identity in 258 aa overlap

```
               10         20         30         40         50         60
a736.pep   MNFIRSVGAKTLGLIQSLGSITLFLLNILAKSGTAFVRPRLSVRQVYFAGVLSVLIVAVS
           ||||||||||||||||||||||||||||||||||||||||||||||||||||||||||||
m736       MNFIRSVGAKTLGLIQSLGSITLFLLNILAKSGTAFVRPRLSVRQVYFAGVLSVLIVAVS
               10         20         30         40         50         60

               70         80         90        100        110        120
a736.pep   GLFVGMVLGLQGYTQLSKFKSADILGYMVAASLLRELGPVLAAILFASSAGGAMTSEIGL
           ||||||||||||||||||||||||||||||||||||||||||||||||||||||||||||
m736       GLFVGMVLGLQGYTQLSKFKSADILGYMVAASLLRELGPVLAAILFASSAGGAMTSEIGL
               70         80         90        100        110        120

              130        140        150        160        170        180
a736.pep   MKTTEQLEAMNVMAVNPVARVVAPRFWAGVFSMPLLASIFNVAGIFGAYLVGVTWLGLDS
           ||||||||||||||||||||||||||||||||||||||||||||||||||||||||||||
m736       MKTTEQLEAMNVMAVNPVARVVAPRFWAGVFSMPLLASIFNVAGIFGAYLVGVTWLGLDS
              130        140        150        160        170        180

              190        200        210        220        230        240
a736.pep   GIFWSQMQNNITIHYDVINGLIKSAAFGVAVTLIAVHQGFHCVPTSEGILRASTRTVVSS
           ||||||||||||||||||||||||||||||||||||||||||||||||||||||||||||
m736       GIFWSQMQNNITIHYDVINGLIKSAAFGVAVTLIAVHQGFHCVPTSEGILRASTRTVVSS
              190        200        210        220        230        240

              250      259
a736.pep   ALTILAVDFILTAWMFTDX
           |||||||||||||||||||
m736       ALTILAVDFILTAWMFTDX
              250
```

The following partial DNA sequence was identified in *N. gonorrhoeae* <SEQ ID 2509>:

g737.seq

```
  1 atgaACATCA AACACCTTCT CTTGACCGCC GCCGCAACCG CACTGTTGGG
 51 CATTTCCGCC CCCGCACTCG CCCACCACGA CGGACACGGC GATGACGACC
101 ACGGACACGC CGCACACCAA CACGGCAAAC AAGACAAAAT CATCAGCCGC
151 GCCCAAGCCG AAAAAGCGGC TTGGGCGCGT GTCGGCGGCA AAATCACCGA
201 CATCGATCTC GAACACGACG ACGGCCGTCC GCACTATGAT GTCGAAATCG
251 TCAAAAACGG ACAGGAATAC AAAGTCGTTG TCGATGCCCG TACCGGCCGC
301 GTGATTTCCT CCCGCCGCGA CGACTGA
```

This corresponds to the amino acid sequence <SEQ ID 2510; ORF 737>:

g737.pep

```
  1 MNIKHLLLTA AATALLGISA PALAHHDGHG DDDHGHAAHQ HGKQDKIISR
 51 AQAEKAAWAR VGGKITDIDL EHDDGRPHYD VEIVKNGQEY KVVVDARTGR
101 VISSRRDD*
```

The following partial DNA sequence was identified in *N. meningitidis* <SEQ ID 2511>:

m737.seq..

```
  1 ATGAACATCA AACACCTTCT CTTGACCTCC GCCGCAACCG CACTGCTGAG
 51 CATTTCCGCC CCCGCGCTCG CCCACCACGA CGGACACGGC GATGACGACC
101 ACGGACACGC CGCACACCAA CACAACAAAC AAGACAAAAT CATCAGCCGC
151 GCCCAAGCCG AAAAAGCAGC GTTGGCGCGT GTCGGCGGCA AAATCACCGA
```

-continued

```
201 CATCGATCTC GAACACGACA ACGGCCGTCC GCACTATGAT GTCGAAATCG

251 TCAAAAACGG ACAGGAATAC AAAGTCGTTG TCGATGCCCG TACCGGCCGC

301 GTGATTTCCT CCCGCCGCGA CGACTGA
```

This corresponds to the amino acid sequence <SEQ ID 2512; ORF 737>:

m737.pep

```
  1 MNIKHLLLTS AATALLSISA PALAHHDGHG DDDHGHAAHQ HNKQDKIISR

 51 AQAEKAALAR VGGKITDIDL EHDNGRPHYD VEIVKNGQEY KVVVDARTGR

101 VISSRRDD*
```

Computer analysis of the amino acid sequences gave the following results:

Homology with a predicted ORF from *N. meningitidis* menA with menB

ORF 737 shows 95.4% identity over a 108 aa overlap with a predicted ORF (ORF737.a) from *N. gonorrhoeae*:

m737/g737

```
                  10        20        30        40        50        60
m737.pep   MNIKHLLLTSAATALLSISAPALAHHDGHGDDDHGHAAHQHNKQDKIISRAQAEKAALAR
           ||||||||:||||||:|||||||||||||||||||||||:|||||||||||||||| ||
g737       MNIKHLLLTAAATALLGISAPALAHHDGHGDDDHGHAAHQHGKQDKIISRAQAEKAAWAR
                  10        20        30        40        50        60

                  70        80        90       100       109
m737.pep   VGGKITDIDLEHDNGRPHYDVEIVKNGQEYKVVVDARTGRVISSRRDDX
           ||||||||||||:||||||||||||||||||||||||||||||||||||
g737       VGGKITDIDLEHDDGRPHYDVEIVKNGQEYKVVVDARTGRVISSRRDDX
                  70        80        90       100
```

The following partial DNA sequence was identified in *N. meningitidis* <SEQ ID 2513>:

a737.seq

```
  1 ATGAACTTCA AACGCCTTCT CTTGACCGCC GCCGCAACCG CACTGATGGG

 51 CATTTCCGCC CCCGCACTCG CCCACCACGA CGGACACGGC GATGACGACC

101 ACGGACACGC CGCACACCAA CACAGCAAAC AAGACAAAAT CATCAGCCGC

151 GCCCAAGCCG AAAAAGCAGC GTTGGCGCGT GTCGGCGGCA AAATCACCGA

201 CATCGATCTC GAACACGACA ACGGCCGTCC GCACTATGAT GTCGAAATCG

251 TCAAAAACGG ACAGGAATAC AAAGTCGTTG TCGATGCCCG TACCGGCCGC

301 GTGATTTCCT CCCGCCGCGA CGACTGA
```

This corresponds to the amino acid sequence <SEQ ID 2514; ORF 737.a>:

a737.pep

```
  1 MNFKRLLLTA AATALMGISA PALAHHDGHG DDDHGHAAHQ HSKQDKIISR

 51 AQAEKAALAR VGGKITDIDL EHDNGRPHYD VEIVKNGQEY KVVVDARTGR

101 VISSRRDD*
```

a737/m737 94.4% identity in 108 aa overlap

```
                   10        20        30        40        50        60
a737.pep   MNFKRLLLTAAATALMGISAPALAHHDGHGDDDHGHAAHQHSKQDKIISRAQAEKAALAR
           ||:|:||||:|||||::||||||||||||||||||||||||:||||||||||||||||||
m737       MNIKHLLLTSAATALLSISAPALAHHDGHGDDDHGHAAHQHNKQDKIISRAQAEKAALAR
                   10        20        30        40        50        60

                   70        80        90       100       109
a737.pep   VGGKITDIDLEHDNGRPHYDVEIVKNGQEYKVVVDARTGRVISSRRDDX
           |||||||||||||||||||||||||||||||||||||||||||||||||
m737       VGGKITDIDLEHDNGRPHYDVEIVKNGQEYKVVVDARTGRVISSRRDDX
                   70        80        90       100
```

The following partial DNA sequence was identified in *N. gonorrhoeae* <SEQ ID 2515>:

g738.seq

```
   1 ATGTCCGCTG AAACGACCGT ATCCGGCGCG CGCCCCGCCG CCAAACTGCC
  51 GATTTACATC CTGCCCTGCT TCCTTTGGAT AGGCATCATC CCCTTTACCT
 101 TCGCACTCAG GCTGAAACCG TCGCCCGACT TTTACCACGA TGCCGCCGCC
 151 GCGGCCGGCC TGATTGTCCT GTTGTTCCTC ACGGCAGGAA AAAAGCTGTT
 201 TGATGTCAAA ATCCCCGCCA TCAGCTTCCT CCTGTTTGCA ATGGCGGCAT
 251 TTTGGTGGCT TCAGGCACGC CTGATGAACC TGATTTATCC CGGAATGAAC
 301 GACATCGCCT CTTGGGTTTT CATCTTGCTC GCCGTCAGCG CGTGGGCCTG
 351 CAAGAGTTTG GTCGCACACT ACGGACAAGA ACGCAtcgtT ACCCTGTTTG
 401 CCTGGTCGCT GCTTATCGGC TCCCTGCTTC AATCCTGCAT CGTcgtCATC
 451 CAGTTTGCCG GCTGGGAAAA CACCCCCCTG CTTCAAAACA TCATCGTTCA
 501 CAGAGGGCAA GGCGTAATCG GACACATCGG GCAGCGCAAC AACCTCGGAC
 551 ACTACCTCAT GTGGGGCATA CTCGCCTCCG CCTACCTCAA CGGACAACGA
 601 AAAATCCCCG CAGCCCTCGG CGCAATCTGC CTGATTATGC AGACCGCCGT
 651 TTTAGGTTTG GTCAATTCGC GCACCATCTT GACCTACATA GCCGCCATCG
 701 CCCTCATCCT TCCCTTCTGG TATTTCCGTT CGGACAAATC CAACAGACGG
 751 ACGATGCTCG GCATAGCCGC AGCCGTATTC CTTACCGCGC TGTTCCAATT
 801 TTCCATGAAC GCCATTCTGG AAACCTTTAC AGGCATCCGC TACGAAACTG
 851 CCGTCGAACG CGTCGCCAAC GGCGGTTTCA CAGACTTGCC GCGCCAAAGC
 901 GAATGGAATA AAGCCCTTGC CGCCTTCCAG TCCGCCCCGA TATTCGGGCA
 951 CGGCTGGAAC AGTTTTGCCC AACAAACCTT CCTGATCAAT GCCGAACAGC
1001 ACACCATACA CGACAACTTC CTCAGCACCT TGTTCACCCA TTCCCACAAC
1051 ATCATCCTCC AACTCCTTGC AGAAATGGGG ATCAGCGGCA CGCTTCTGGT
1101 TGCCGCAACC CTGCTGACGG GCATTGCCGG GCTGCTGAAA CGCTCCCTGA
1151 CCCCCGCATC ACTTTTCCTG CTGTGCGCGC TTGCCGTCAG TATGTGCCAC
1201 AGTATGCTCG AATATCCTTT GTGGTATGTC TATTTCCTCA TCCCCTTCGG
1251 ACTGATGCTC TTTCTGTCCC CCGCAGAGGC TTCAGACGGC ATCGCCTTCA
1301 AAAAAGCCGC CAATCTCGGC ATACTGACCG CCTCCGCCGC CATATTCGCA
1351 GGATTGCTGC ACTTGGACTG GACATACACC CGGCTGGTTA ACTCCTTTTC
1401 CCCCGCCGCT GACGACAGTG CCAAAACCCT CAACCGGAAA ATCAACGAAC
```

-continued

1451 TGCGCTATAT TTCCGCAAAC AGCCCGATGC TGTCCTTTTA TGCCGACTTC

1501 TCCCTCGTAA ACTTCGCCCT GCCGGAATAC CCCGAAACCC AGACTTGGGC

1551 GGAAGAAGCA ACCCTCAAAG CACTAAAATA CCGCCCCTAC TCCGCCACCT

1601 ACCGCATCGC CCTCTACTTG ATGCGGCAAG GCAAAGTTGC AGAAGCAAAA

1651 CAATGGATGC GGGCAACACA GTCCTATTAC CCCTACCTGA TGCCCCGATA

1701 CGCCGACGAA ATCCGCAAAC TGCCCGTATG GGCACCGCTG CTGCCCGAAC

1751 TGCTCAAAGA CTGCAAAGCC TTCGCCGCCG CTCCCGGCCA TCCGGAAACA

1801 AAACCCTGCA AATGA

This corresponds to the amino acid sequence <SEQ ID 2516; ORF 738>:

g738.pep

1 MSAETTVSGA RPAAKLPIYI LPCFLWIGII PFTFALRLKP SPDFYHDAAA

51 AAGLIVLLFL TAGKKLFDVK IPAISFLLFA MAAFWWLQAR LMNLIYPGMN

101 DIASWVFILL AVSAWACKSL VAHYGQERIV TLFAWSLLIG SLLQSCIVVI

151 QFAGWENTPL LQNIIVHRGQ GVIGHIGQRN NLGHYLMWGI LASAYLNGQR

201 KIPAALGAIC LIMQTAVLGL VNSRTILTYI AAIALILPFW YFRSDKSNRR

251 TMLGIAAAVF LTALFQFSMN AILETFTGIR YETAVERVAN GGFTDLPRQS

301 EWNKALAAFQ SAPIFGHGWN SFAQQTFLIN AEQHTIHDNF LSTLFTHSHN

351 IILQLLAEMG ISGTLLVAAT LLTGIAGLLK RSLTPASLFL LCALAVSMCH

401 SMLEYPLWYV YFLIPFGLML FLSPAEASDG IAFKKAANLG ILTASAAIFA

451 GLLHLDWTYT RLVNSFSPAA DDSAKTLNRK INELRYISAN SPMLSFYADF

501 SLVNFALPEY PETQTWAEEA TLKALKYRPY SATYRIALYL MRQGKVAEAK

551 QWMRATQSYY PYLMPRYADE IRKLPVWAPL LPELLKDCKA FAAAPGHPET

601 KPCK*

The following partial DNA sequence was identified in *N. meningitidis* <SEQ ID 2517>:

m738.seq

1 ATGCCCGCTG AAACGACCGT ATCCGGCGCG CACCCCGCCG CCAAACTGCC

51 GATTTACATC CTGCCCTGCT TCCTTTGGAT AGGCATCGTC CCCTTTACCT

101 TCGCGCTCAA ACTGAAACCG TCGCCCGACT TTTACCACGA TGCCGCCGCC

151 GCAGCCGGCC TGATTGTCCT GTTGTTCCTC ACGGCAGGAA AAAAACTGTT

201 TGATGTCAAA ATCCCCGCCA TCAGCTTCCT TCTGTTTGCA ATGGCGGCGT

251 TTTGGTATCT TCAGGCACGC CTGATGAACC TGATTTACCC CGGTATGAAC

301 GACATCGTCT CTTGGATTTT CATCTTGCTC GCCGTCAGCG CGTGGGCCTG

351 CCGGAGCTTG GTCGCACACT TCGGACAAGA ACGCATCGTG ACCCTGTTTG

401 CCTGGTCGCT GCTTATCGGC TCCCTGCTTC AATCCTGCAT CGTCGTCATC

451 CAGTTTGCCG GCTGGGAAGA CACCCCTCTG TTTCAAAACA TCATCGTTTA

-continued

```
 501 CAGCGGGCAA GGCGTAATCG GACACATCGG GCAGCGCAAC AACCTCGGAC
 551 ACTACCTCAT GTGGGGCATA CTCGCCGCCG CCTACCTCAA CGGACAACGA
 601 AAAATCCCCG CCGCCCTCGG CGTAATCTGC CTGATTATGC AGACCGCCGT
 651 TTTAGGTTTG GTCAACTCGC GCACCATCTT GACCTACATA GCCGCCATCG
 701 CCCTCATCCT TCCCTTCTGG TATTTCCGTT CGGACAAATC CAACAGGCGG
 751 ACGATGCTCG GCATAGCCGC AGCCGTATTC CTTACCGCGC TGTTCCAATT
 801 TTCCATGAAC ACCATTCTGG AAACCTTTAC TGGCATCCGC TACGAAACTG
 851 CCGTCGAACG CGTCGCCAAC GGCGGTTTCA CAGACTTGCC GCGCCAAATC
 901 GAATGGAATA AAGCCCTTGC CGCCTTCCAG TCCGCCCCGA TATTCGGGCA
 951 CGGCTGGAAC AGTTTTGCCC AACAAACCTT CCTCATCAAT GCCGAACAGC
1001 ACAACATATA CGACAACCTC CTCAGCAACT TGTTCACCCA TTCCCACAAC
1051 ATCGTCCTCC AACTCCTTGC AGAGATGGGA ATCAGCGGCA CGCTTCTGGT
1101 TGCCGCAACC CTGCTGACGG GCATTGCCGG GCTGCTTAAA CGCCCCCTGA
1151 CCCCCGCATC GCTTTTCCTA ATCTGCACGC TTGCCGTCAG TATGTGCCAC
1201 AGTATGCTCG AATATCCTTT GTGGTATGTC TATTTCCTCA TCCCTTTCGG
1251 ACTGATGCTC TTCCTGTCCC CCGCAGAGGC TTCAGACGGC ATCGCCTTCA
1301 AAAAAGCCGC CAATCTCGGC ATACTGACCG CCTCCGCCGC CATATTCGCA
1351 GGATTGCTGC ACTTGGACTG GACATACACC CGGCTGGTTA ACGCCTTTTC
1401 CCCCGCCACT GACGACAGTG CCAAAACCCT CAACCGGAAA ATCAACGAGT
1451 TGCGCTATAT TTCCGCAAAC AGTCCGATGC TGTCCTTTTA TGCCGACTTC
1501 TCCCTCGTAA ACTTCGCCCT GCCGGAATAC CCCGAAACCC AGACTTGGGC
1551 GGAAGAAGCA ACCCTCAAAT CACTAAAATA CCGCCCCCAC TCCGCCACCT
1601 ACCGCATCGC CCTCTACCTG ATGCGGCAAG GCAAAGTTGC AGAAGCAAAA
1651 CAATGGATGC GGGCGACACA GTCCTATTAC CCgTACCTGA TGCCCCGATA
1701 CGCCGACGAA ATCCGCAAAC TGCCCGTATG GGCGCCGCTG CTACCCGAAC
1751 TGCTCAAAGA CTGCAAAGCC TTCGCCGCCG CGCCCGGTCA TCCGGAAGCA
1801 AAACCCTGCA AATGA
```

This corresponds to the amino acid sequence <SEQ ID 2518; ORF 738>:

m738.pep

```
  1 MPAETTVSGA HPAAKLPIYI LPCFLWIGIV PFTFALKLKP SPDFYHDAAA
 51 AAGLIVLLFL TAGKKLFDVK IPAISFLLFA MAAFWYLQAR LMNLIYPGMN
101 DIVSWIFILL AVSAWACRSL VAHFGQERIV TLFAWSLLIG SLLQSCIVVI
151 QFAGWEDTPL FQNIIVYSGQ GVIGHIGQRN NLGHYLMWGI LAAAYLNGQR
201 KIPAALGVIC LIMQTAVLGL VNSRTILTYI AAIALILPFW YFRSDKSNRR
251 TMLGIAAAVF LTALFQFSMN TILETFTGIR YETAVERVAN GGFTDLPRQI
301 EWNKALAAFQ SAPIFGHGWN SFAQQTFLIN AEQHNIYDNL LSNLFTHSHN
351 IVLQLLAEMG ISGTLLVAAT LLTGIAGLLK RPLTPASLFL ICTLAVSMCH
401 SMLEYPLWYV YFLIPFGLML FLSPAEASDG IAFKKAANLG ILTASAAIFA
```

-continued

```
451 GLLHLDWTYT RLVNAFSPAT DDSAKTLNRK INELRYISAN SPMLSFYADF

501 SLVNFALPEY PETQTWAEEA TLKSLKYRPH SATYRIALYL MRQGKVAEAK

551 QWMRATQSYY PYLMPRYADE IRKLPVWAPL LPELLKDCKA FAAAPGHPEA

601 KPCK*
```

Computer analysis of the amino acid sequences gave the following results:

Homology with a predicted ORF from *N. meningitidis* menA with menB

ORF 738 shows 95.0% identity over a 604 aa overlap with a predicted ORF (ORF738.a) from *N. gonorrhoeae*:

```
m738/g738

                     10        20        30        40        50        60
m738.pep    MPAETTVSGAHPAAKLPIYILPCFLWIGIVPFTFALKLKPSPDFYHDAAAAAGLIVLLFL
            | ||||||||:|||||||||||||||||||:||||||:||||||||||||||||||||||
g738        MSAETTVSGARPAAKLPIYILPCFLWIGIIPFTFALRLKPSPDFYHDAAAAAGLIVLLFL
                     10        20        30        40        50        60

                     70        80        90       100       110       120
m738.pep    TAGKKLFDVKIPAISFLLFAMAAFWYLQARLMNLIYPGMNDIVSWIFILLAVSAWACRSL
            |||||||||||||||||||||||||:||||||||||||||||:||:|||||||||||:||
g738        TAGKKLFDVKIPAISFLLFAMAAFWWLQARLMNLIYPGMNDIASWVFILLAVSAWACKSL
                     70        80        90       100       110       120

                    130       140       150       160       170       180
m738.pep    VAHFGQERIVTLFAWSLLIGSLLQSCIVVIQFAGWEDTPLFQNIIVYSGQGVIGHIGQRN
            |||:||||||||||||||||||||||||||||||||:|||:|||||: ||||||||||||
g738        VAHYGQERIVTLFAWSLLIGSLLQSCIVVIQFAGWENTPLLQNIIVHRGQGVIGHIGQRN
                    130       140       150       160       170       180

                    190       200       210       220       230       240
m738.pep    NLGHYLMWGILAAAYLNGQRKIPAALGVICLIMQTAVLGLVNSRTILTYIAAIALILPFW
            ||||||||||||:||||||||||||||:||||||||||||||||||||||||||||||||
g738        NLGHYLMWGILASAYLNGQRKIPAALGAICLIMQTAVLGLVNSRTILTYIAAIALILPFW
                    190       200       210       220       230       240

                    250       260       270       280       290       300
m738.pep    YFRSDKSNRRTMLGIAAAVFLTALFQFSMNTILETFTGIRYETAVERVANGGFTDLPRQI
            ||||||||||||||||||||||||||||||:||||||||||||||||||||||||||||
g738        YFRSDKSNRRTMLGIAAAVFLTALFQFSMNAILETFTGIRYETAVERVANGGFTDLPRQS
                    250       260       270       280       290       300

                    310       320       330       340       350       360
m738.pep    EWNKALAAFQSAPIFGHGWNSFAQQTFLINAEQHNIYDNLLSNLFTHSHNIVLQLLAEMG
            ||||||||||||||||||||||||||||||||||:|:||:||:||||||||:||||||||
g738        EWNKALAAFQSAPIFGHGWNSFAQQTFLINAEQHTIHDNFLSTLFTHSHNIILQLLAEMG
                    310       320       330       340       350       360

                    370       380       390       400       410       420
m738.pep    ISGTLLVAATLLTGIAGLLKRPLTPASLFLICTLAVSMCHSMLEYPLWYVYFLIPFGLML
            ||||||||||||||||||||||||||||||:|:|||||||||||||||||||||||||||
g738        ISGTLLVAATLLTGIAGLLKRPLTPASLFLLCALAVSMCHSMLEYPLWYVYFLIPFGLML
                    370       380       390       400       410       420

                    430       440       450       460       470       480
m738.pep    FLSPAEASDGIAFKKAANLGILTASAAIFAGLLHLDWTYTRLVNAFSPATDDSAKTLNRK
            ||||||||||||||||||||||||||||||||||||||||||||:||||:||||||||||
g738        FLSPAEASDGIAFKKAANLGILTASAAIFAGLLHLDWTYTRLVNSFSPAADDSAKTLNRK
                    430       440       450       460       470       480

                    490       500       510       520       530       540
m738.pep    INELRYISANSPMLSFYADFSLVNFALPEYPETQTWAEEATLKSLKYRPHSATYRIALYL
            |||||||||||||||||||||||||||||||||||||||||||:|||||:||||||||||
g738        INELRYISANSPMLSFYADFSLVNFALPEYPETQTWAEEATLKALKYRPYSATYRIALYL
                    490       500       510       520       530       540

                    550       560       570       580       590       600
m738.pep    MRQGKVAEAKQWMRATQSYYPYLMPRYADEIRKLPVWAPLLPELLKDCKAFAAAPGHPEA
            |||||||||||||||||||||||||||||||||||||||||||||||||||||||||||:
g738        MRQGKVAEAKQWMRATQSYYPYLMPRYADEIRKLPVWAPLLPELLKDCKAFAAAPGHPET
                    550       560       570       580       590       600

m738.pep    KPCKX
            |||||
g738        KPCKX
```

The following partial DNA sequence was identified in *N. meningitidis* <SEQ ID 2519>:

a738.seq

```
   1 ATGCCCGCTG AAACGACCGT ATCCGGCGCG CACCCCGCCG CCAAACTGCC
  51 GATTTACATC CTGCCCTGCT TCCTTTGGAT AGGCATCGTC CCCTTTACCT
 101 TTGCGCTCAG GCTGCAACCG TCGCCCGACT TTTACCACGA TGCCGCCGCC
 151 GCAGCCGGCC TGATTGTCCT GTTGTTCCTC ACGGCAGGAA AAAAGCTGTT
 201 TGATGTCAAA ATCCCACCTA TCAGCTTCCT TCTGTTTGCA ATGGCGGCGT
 251 TTTGGTATCT TCAGGCACGC CTGATGAACC TGATTTACCC CGGTATGAAC
 301 GACATCGTCT CTTGGATTTT CATCTTACTC GCCGTCAGCG CGTGGGCCTG
 351 CCGGAGCTTG GTCGCACACT ACGGACAAGA ACGCATCGTT ACCCTGTTTG
 401 CCTGGTCGCT GCTTATCGGC TCCCTGCTTC AATCCTGCAT CGTCGTCATC
 451 CAGTTTGCCG GCTGGGAAGA CACCCCTCTG TTTCAAAACA TCATTGTTTA
 501 CAGCGGGCAA GGCGTAATCG GACACATCGG ACAGCGCAAC AACCTCGGAC
 551 ACTACCTCAT GTGGGGCATA CTCGCCGCCG CCTACCTCAA CGGACAACGA
 601 AAAATCCCGC CCGCCTTGGG TGCAATCTGC CTGATTATGC AGACCGCCGT
 651 TTTAGGTTTG GTCAATTCGC GCACCATCTT GACCTACATA GCCGCCATCG
 701 CCCTCATCCT TCCCTTCTGG TATTTCCGTT CGGACAAATC CAACAGGCGG
 751 ACGATACTCG GCATAGCCGC AGCCGTATTC CTTACCGCGC TGTTCCAATT
 801 TTCCATGAAC ACCATTCTGG AAACCTTTAC CGGCATCCGC TACGAAACCG
 851 CCGTCGAACG CGTCGCCAAC GGCGGTTTCA CAGACCTGCC GCGCCAAATC
 901 GAATGGCGCA AAGCCCTCGC CGCCTTCCAG TCCGCCCCGA TATTCGGGCA
 951 CGGCTGGAAC AGTTTTGCCC AACAAACCTT CCTCATCAAT GCCGAACAGC
1001 ACAACATACA CGACAACCTC CTCAGCAACT TGTTCACCCA TTCCCACAAC
1051 ATCGTTCTCC AACTCCTTGC AGAGATGGGG ATCAGCGGCA CGCTTCTGGT
1101 TGCCGCAACC CTGCTGACGG GCATTGCCGG GCTGCTGAAA CGCCCCCTGA
1151 CCCCCGCATC GCTTTTCCTG ATCTGCACAC TTGCCGTCAG TATGTGCCAC
1201 AGTATGCTCG AATATCCTTT GTGGTATGTC TATTTCCTCA TCCCCTTCGG
1251 ACTGATGCTC TTTCTGTCCC CCGCAGAGGC TTCAGACGGC ATCGCCTTCA
1301 AAAAAGCCGC CAATCTCGGC ATACTAACCG CCTCCGCCGC CATATTCGCA
1351 GGATTGCTGC ACTTGGACTG GACATACACC CGGATGGTTA ACGCCTTTTC
1401 CCCCGCCACT GACGACAGTG CCAAAACCCT CAACCGGAAA ATCAACGAGT
1451 TGCGCTATAT TTCCGCAAAC AGTCCGATGC TGTCCTTTTA TGCCGACTTC
1501 TCCCTCGTAA ACTTCGCCCT GCCGGAATAC CCCGAAACCC AGACTTGGGC
1551 GGAAGAAGCA ACCCTCAAAT CACTAAAATA CCGCCCCCAC TCCGCCACCT
1601 ACCGCATCGC CCTCTACCTG ATGCGGCAAG GCAAAGTTGC AGAAGCAAAA
1651 CAATGGATGC GGGCGACACA GTCCTATTAC CCCTACCTGA TGCCCCGATA
1701 CGCCGACGAA ATCCGCAAAC TGCCCGTATG GGCGCCGCTG CTACCCGAAC
1751 TGCTCAAAGA CTGCAAAGCC TTCGCCGCCG CGCCCGGTCA TCCGGAAGCA
1801 AAACCCTGCA AATGA
```

This corresponds to the amino acid sequence <SEQ ID 2520; ORF 738.a>:

a738.pep

```
  1 MPAETTVSGA HPAAKLPIYI LPCFLWIGIV PFTFALRLQP SPDFYHDAAA
 51 AAGLIVLLFL TAGKKLFDVK IPPISFLLFA MAAFWYLQAR LMNLIYPGMN
101 DIVSWIFILL AVSAWACRSL VAHYGQERIV TLFAWSLLIG SLLQSCIVVI
151 QFAGWEDTPL FQNIIVYSGQ GVIGHIGQRN NLGHYLMWGI LAAAYLNGQR
201 KIPPALGAIC LIMQTAVLGL VNSRTILTYI AAIALILPFW YFRSDKSNRR
251 TILGIAAAVF LTALFQFSMN TILETFTGIR YETAVERVAN GGFTDLPRQI
301 EWRKALAAFQ SAPIFGHGWN SFAQQTFLIN AEQHNIHDNL LSNLFTHSHN
351 IVLQLLAEMG ISGTLLVAAT LLTGIAGLLK RPLTPASLFL ICTLAVSMCH
401 SMLEYPLWYV YFLIPFGLML FLSPAEASDG IAFKKAANLG ILTASAAIFA
451 GLLHLDWTYT RMVNAFSPAT DDSAKTLNRK INELRYISAN SPMLSFYADF
501 SLVNFALPEY PETQTWAEEA TLKSLKYRPH SATYRIALYL MRQGKVAEAK
551 QWMRATQSYY PYLMPRYADE IRKLPVWAPL LPELLKDCKA FAAAPGHPEA
601 KPCK*
```

a738/m738 98.3% identity in 604 aa overlap

```
                    10        20        30        40        50        60
a738.pep    MPAETTVSGAHPAAKLPIYILPCFLWIGIVPFTFALRLQPSPDFYHDAAAAAGLIVLLFL
            ||||||||||||||||||||||||||||||||||||||:|:|||||||||||||||||||
m738        MPAETTVSGAHPAAKLPIYILPCFLWIGIVPFTFALKLKPSPDFYHDAAAAAGLIVLLFL
                    10        20        30        40        50        60

                    70        80        90       100       110       120
a738.pep    TAGKKLFDVKIPPISFLLFAMAAFWYLQARLMNLIYPGMNDIVSWIFILLAVSAWACRSL
            ||||||||||| ||||||||||||||||||||||||||||||||||||||||||||||||
m738        TAGKKLFDVKIPAISFLLFAMAAFWYLQARLMNLIYPGMNDIVSWIFILLAVSAWACRSL
                    70        80        90       100       110       120

                   130       140       150       160       170       180
a738.pep    VAHYGQERIVTLFAWSLLIGSLLQSCIVVIQFAGWEDTPLFQNIIVYSGQGVIGHIGQRN
            |||:||||||||||||||||||||||||||||||||||||||||||||||||||||||||
m738        VAHFGQERIVTLFAWSLLIGSLLQSCIVVIQFAGWEDTPLFQNIIVYSGQGVIGHIGQRN
                   130       140       150       160       170       180

                   190       200       210       220       230       240
a738.pep    NLGHYLMWGILAAAYLNGQRKIPPALGAICLIMQTAVLGLVNSRTILTYIAAIALILPFW
            ||||||||||||||||||||||| |||:||||||||||||||||||||||||||||||||
m738        NLGHYLMWGILAAAYLNGQRKIPAALGVICLIMQTAVLGLVNSRTILTYIAAIALILPFW
                   190       200       210       220       230       240

                   250       260       270       280       290       300
a738.pep    YFRSDKSNRRTILGIAAAVFLTALFQFSMNTILETFTGIRYETAVERVANGGFTDLPRQI
            |||||||||||:||||||||||||||||||||||||||||||||||||||||||||||||
m738        YFRSDKSNRRTMLGIAAAVFLTALFQFSMNTILETFTGIRYETAVERVANGGFTDLPRQI
                   250       260       270       280       290       300

                   310       320       330       340       350       360
a738.pep    EWRKALAAFQSAPIFGHGWNSFAQQTFLINAEQHNIHDNLLSNLFTHSHNIVLQLLAEMG
            || |||||||||||||||||||||||||||||||||:|||||||||||||||||||||||
m738        EWNKALAAFQSAPIFGHGWNSFAQQTFLINAEQHNIYDNLLSNLFTHSHNIVLQLLAEMG
                   310       320       330       340       350       360

                   370       380       390       400       410       420
a738.pep    ISGTLLVAATLLTGIAGLLKRPLTPASLFLICTLAVSMCHSMLEYPLWYVYFLIPFGLML
            ||||||||||||||||||||||||||||||||||||||||||||||||||||||||||||
m738        ISGTLLVAATLLTGIAGLLKRPLTPASLFLICTLAVSMCHSMLEYPLWYVYFLIPFGLML
                   370       380       390       400       410       420

                   430       440       450       460       470       480
a738.pep    FLSPAEASDGIAFKKAANLGILTASAAIFAGLLHLDWTYTRMVNAFSPATDDSAKTLNRK
            ||||||||||||||||||||||||||||||||||||||||:|||||||||||||||||||
m738        FLSPAEASDGIAFKKAANLGILTASAAIFAGLLHLDWTYTRLVNAFSPATDDSAKTLNRK
                   430       440       450       460       470       480

                   490       500       510       520       530       540
a738.pep    INELRYISANSPMLSFYADFSLVNFALPEYPETQTWAEEATLKSLKYRPHSATYRIALYL
            ||||||||||||||||||||||||||||||||||||||||||||||||||||||||||||
m738        INELRYISANSPMLSFYADFSLVNFALPEYPETQTWAEEATLKSLKYRPHSATYRIALYL
                   490       500       510       520       530       540
```

-continued

```
                  550       560       570       580       590       600
a738.pep    MRQGKVAEAKQWMRATQSYYPYLMPRYADEIRKLPVWAPLLPELLKDCKAFAAAPGHPEA
            ||||||||||||||||||||||||||||||||||||||||||||||||||||||||||||
m738        MRQGKVAEAKQWMRATQSYYPYLMPRYADEIRKLPVWAPLLPELLKDCKAFAAAPGHPEA
                  550       560       570       580       590       600
a738.pep    KPCKX
            |||||
m738        KPCKX
```

The following partial DNA sequence was identified in *N. gonorrhoeae* <SEQ ID 2521>:

g739.seq

```
  1 ATGGCAAAAA AACCGAACAA ACCCTTCAGG CTGACCCCCA AACTCCTGAT
 51 ACGCGCCGTA TTGCTCATCT GTATCACCGC CATCGGCGCA TTGGCAGTAG
101 GCATCGTCAG CACATTCAAC CCGAACGGCG ACAAAACCCT CCAAACCGAA
151 CCGCAACACA CCGACAGCCC CCGCGAAACC GAATTCTGGC TGCCAAACGG
201 CGCCGTCGGA CAAGATGCCG CCCAACCCGA ACACCACCAC GCCGCCTCAT
251 CCGAACCCGC ACAGCCGGAC GGCACAGAAG AAAGCGGCAG CGGACTGCCG
301 TCCCCTGCCG CACCCAAGAA AAACCGGGTc AAACCGCGCC CTTCGGATGC
351 GGCCCGGGCA GCCGATTCGT TAACCGGCAC CGGAACACAA GCTGAAAACA
401 CACTCAAAGA AACCCCCGTA CTGCCCACAA ACGCCCCCCA TCCCGAACCC
451 CGAAAAGAAA CACCCGAAAA ACAGGCGCAG CCCAAAGAAA CACCCAAAGA
501 AAAAGAAACG CCCAAAGAAA ACCATACCAA ACCGGACACC CCGAAAAACA
551 CGCCGGCCAA ACCCCATAAA GAGATTCTCG ACAACCTCTT TTGA
```

This corresponds to the amino acid sequence <SEQ ID 2522; ORF 739>:

g739.pep

```
  1 MAKKPNKPFR LTPKLLIRAV LLICITAIGA LAVGIVSTFN PNGDKTLQTE
 51 PQHTDSPRET EFWLPNGAVG QDAAQPEHHH AASSEPAQPD GTEESGSGLP
101 SPAAPKKNRV KPRPSDAARA ADSLTGTGTQ AENTLKETPV LPTNAPHPEP
151 RKETPEKQAQ PKETPKEKET PKENHTKPDT PKNTPAKPHK EILDNLF*
```

The following partial DNA sequence was identified in *N. meningitidis* <SEQ ID 2523>:

m739.seq

```
  1 ATGGCAAAAA AACCGAACAA ACCCTTCAGG CTGACCCCCA AACTCCTGAT
 51 ACGCGCCGTA TTGCTCATCT GTATCGCCGC CATCGGCGCA TTGGCAATAG
101 GCATCGTCAG CACATTCAAC CCGAACGGCG ACAAAACCCT TCAAGCCGAA
151 CCGCAACACA CCGACAGCCC CCGCGAAACC GAATTCTGGC TGCCAAACGG
201 CGTAGTCGGA CAAGATGCCG CCCAACCCGA ACACCACCAC GCCGCCTCAT
251 CCGAACCCGC ACAGCCGGAC GGCACAGACG AAAGCGGCAG CGGACTGCCG
```

-continued

```
301 TCCCCTGCCG CACCCAAGAA AAACCGGGTC AAACCGCAAC CTGCCGACAC

351 AGCTCAAACC GACAGGCAGC CGGACGACGC CGGAACACAA GCTGAAAACA

401 CACTCAAAGA AACCCCCGTA CTGCCCACAA ACGTCCCCCG TCCCGAACCC

451 CGAAAAGAAA CACCCGAAAA ACAGGCGCAG CCCAAAGAAA CGCCCAAAGA

501 AAACCATACC AAACCGGACA CCCCGAAAAA CACGCCGCCC AAACCCCATA

551 AAGAAATTCT CGACAAACTC TTC
```

This corresponds to the amino acid sequence <SEQ ID 2524: ORF 739>:

m739.pep

```
  1 MAKKPNKPFR LTPKLLIRAV LLICIAAIGA LAIGIVSTFN PNGDKTLQAE

 51 PQHTDSPRET EFWLPNGVVG QDAAQPEHHH AASSEPAQPD GTDESGSGLP

101 SPAAPKKNRV KPQPADTAQT DRQPDDAGTQ AENTLKETPV LPTNVPRPEP

151 RKETPEKQAQ PKETPKENHT KPDTPKNTPP KPHKEILDKL F
```

Computer analysis of the amino acid sequences gave the following results:

Homology with a predicted ORF from *N. meningitidis* menA with menB

ORF 739 shows 86.3% identity over a 197 aa overlap with a predicted ORF (ORF739.a) from *N. gonorrhoeae*:

m739/g739

```
                    10        20        30        40        50        60
m739.pep    MAKKPNKPFRLTPKLLIRAVLLICIAAIGALAIGIVSTFNPNGDKTLQAEPQHTDSPRET
            |||||||||||||||||||||||||:||||||:||||||||||||||||:||||||||||
g739        MAKKPNKPFRLTPKLLIRAVLLICITAIGALAVGIVSTFNPNGDKTLQTEPQHTDSPRET
                    10        20        30        40        50        60

                    70        80        90       100       110       120
m739.pep    EFWLPNGVVGQDAAQPEHHHAASSEPAQPDGTDESGSGLPSPAAPKKNRVKPQPADTAQT
            |||||||:||||||||||||||||||||||||:|||||||||||||||||||:|:|:|::
g739        EFWLPNGAVGQDAAQPEHHHAASSEPAQPDGTEESGSGLPSPAAPKKNRVKPRPSDAARA
                    70        80        90       100       110       120

                   130       140       150       160             170
m739.pep    DRQPDDAGTQAENTLKETPVLPTNVPRPEPRKETPEKQAQPKETPKE------NHTKPDT
             :    :|||||||||||||||||:|:||||||||||||||||||||      |||||||
g739        ADSLTGTGTQAENTLKETPVLPTNAPHPEPRKETPEKQAQPKETPKEKETPKENHTKPDT
                   130       140       150       160       170       180

                 180       190
m739.pep    PKNTPPKPHKEILDKLF
            ||||| ||||||||:||
g739        PKNTPAKPHKEILDNLFX
                   190
```

The following partial DNA sequence was identified in *N. meningitidis* <SEQ ID 2525>:

a739.seq

```
  1 ATGGCAAAAA AACCGAACAA ACCCTTCAGG CTGACCCCCA AACTCCTGAT

 51 ACGCGCCGTA TTGCTCATCT GTATCACCGC CATCGGCGCA TTGGCAATAG

101 GCATCGTCAG CACATTCAAC CCGAACGGCG ACAAAACCCT CCAAACCGAA

151 CCGCAACACA CCGACAGCCC CCGCGAAACC GAATTCTGGC TGCCAAACGG

201 CGTAGTCGGA CAAGATGCCG CCCAACCCGA ACACCACCAC GCCTCCTCAT
```

-continued

```
251 CCGCACCCGC ACAGCCGGAC GGCACAGACG AAAGCGGCAG CGGACTGCCG

301 TCCCCTGCCG CACCCAAGAA AAACCGGGTC AAACCGCAAC CTGCCGACAC

351 AGCTCAAACC GACAGGCAGC CGGACGACGC CGGAGCACAA GCTGAAAACA

401 CACTCAAAGA AACCCCCGTA CTGCCCACAA ACGTCCCCCG TCCCGAACCC

451 CGAAAAGAAA CACCCGAAAA ACAGGCACAG CCCAAAGAAA CACCCAAAGA

501 AAAAGAAACG CCCAAAGAAA ACCATACCAA ACCGGACACC CCGAAAAACA

551 CGCCGCCTAA ACCCCATAAA GAAATTCTCG ACAACCTCTT CTGA
```

This corresponds to the amino acid sequence <SEQ ID 2526: ORF 739.a>:

a739.pep

```
  1 MAKKPNKPFR LTPKLLIRAV LLICITAIGA LAIGIVSTFN PNGDKTLQTE

 51 PQHTDSPRET EFWLPNGVVG QDAAQPEHHH ASSSAPAQPD GTDESGSGLP

101 SPAAPKKNRV KPQPADTAQT DRQPDDAGAQ AENTLKETPV LPTNVPRPEP

151 RKETPEKQAQ PKETPKEKET PKENHTKPDT PKNTPPKPHK EILDNLF*
```

a739/m739 93.9% identity in 197 aa overlap

```
                    10        20        30        40        50        60
a739.pep    MAKKPNKPFRLTPKLLIRAVLLICITAIGALAIGIVSTFNPNGDKTLQTEPQHTDSPRET
            |||||||||||||||||||||||||:|||||||||||||||||||||||:||||||||||
m739        MAKKPNKPFRLTPKLLIRAVLLICIAAIGALAIGIVSTFNPNGDKTLQAEPQHTDSPRET
                    10        20        30        40        50        60

                    70        80        90       100       110       120
a739.pep    EFWLPNGVVGQDAAQPEHHHASSSAPAQPDGTDESGSGLPSPAAPKKNRVKPQPADTAQT
            ||||||||||||||||||||:|| ||||||||||||||||||||||||||||||||||||
m739        EFWLPNGVVGQDAAQPEHHHAASSEPAQPDGTDESGSGLPSPAAPKKNRVKPQPADTAQT
                    70        80        90       100       110       120

                   130       140       150       160       170       180
a739.pep    DRQPDDAGAQAENTLKETPVLPTNVPRPEPRKETPEKQAQPKETPKEKETPKENHTKPDT
            ||||||||:||||||||||||||||||||||||||||||||||||||      ||||||||
m739        DRQPDDAGTQAENTLKETPVLPTNVPRPEPRKETPEKQAQPKETPK------ENHTKPDT
                   130       140       150       160             170

                   190
a739.pep    PKNTPPKPHKEILDNLFX
            ||||||||||||||:||
m739        PKNTPPKPHKEILDKLF
                 180       190
```

The following partial DNA sequence was identified in *N. gonorrhoeae* <SEQ ID 2527>:

g740.seq

```
  1 ATGTCCCGAA ACCTGCTTGT CCGCTGGCTC GCCGTCTGCC TCATCCCCTT

 51 GgcgACGCTT GCCGTTTTCG CCGCCAATcc gcCCGAAGAC AAACCCCAGC

101 ATCTGATCAA CGGCATCATC CTTGCCTGCG AAGCGACGTT TTTGTTTAAa

151 ttcgtgctCT TTGAAACCAT CAAGCATCAT CTTAaacaag gGTTTGATTT

201 GAAACgtcaa ACCATGTTTC TGTTTATTCC GATTGTTTTG CTGGTTGTGT

251 ATTTGTTCCA CTATTTCGGC GCGTTTTag
```

This corresponds to the amino acid sequence <SEQ ID 2528; ORF 740.ng>:

g740.pep

```
 1 MSRNLLVRWL AVCLIPLATL AVFAANPPED KPQHLINGII LACEATFLFK
51 FVLFETIKHH LKQGFDLKRQ TMFLFIPIVL LVVYLFHYFG AF*
```

The following partial DNA sequence was identified in *N. meningitidis* <SEQ ID 2529>:

m740.seq

```
  1 ATGTCCCGAA ACCTGCTTGT CCGCTGGCTT GCCGTCTGCC TCATCCCGTT
 51 GGCGACGCTT GCCGTTTTCG CCGCCAATCC GCCCGAAGAC AAACTCCAGC
101 ATCTGATCAA CGGCATCATC CTTGCCTGCG AAGCGACGTT TTTGTTTAAA
151 TTCGTCCTTT TCGACACCAT CAAGCATCAT TTGAAACAAG AGTTTGATTT
201 GAAACGTCAA ACTATGTTGC TGTTTATTCC GATTATTTTG CTGATTGTGT
251 ATTTGTTCCA CTATTTTGGC GCGTTTTAG
```

This corresponds to the amino acid sequence <SEQ ID 2530; ORF 740>:

m740.pep

```
 1 MSRNLLVRWL AVCLIPLATL AVFAANPPED KLQHLINGII LACEATFLFK
51 FVLFDTIKHH LKQEFDLKRQ TMLLFIPIIL LIVYLFHYFG AF*
```

m740/g740 93.5% identity in 92 aa overlap

```
                   10        20        30        40        50        60
m740.pep   MSRNLLVRWLAVCLIPLATLAVFAANPPEDKLQHLINGIILACEATFLFKFVLFDTIKHH
           ||||||||||||||||||||||||||||||| ||||||||||||||||||||||:|||||
g740       MSRNLLVRWLAVCLIPLATLAVFAANPPEDKPQHLINGIILACEATFLFKFVLFETIKHH
                   10        20        30        40        50        60

                   70        80        90
m740.pep   LKQEFDLKRQTMLLFIPIILLIVYLFHYFGAFX
           ||| ||||||||:|||||:||:|||||||||||
g740       LKQGFDLKRQTMFLFIPIVLLVVYLFHYFGAFX
                   70        80        90
```

The following partial DNA sequence was identified in *N. meningitidis* <SEQ ID 2531>:

a740.seq

```
  1 ATGTCCCGAA ACCTGCTTGT CCGCTGGCTT GTCGTCTGCC TGATACCCTT
 51 GGCGACGCTT GCCGTTTTCG CCGCCAATCC GCCCGAAGAC AAACCCCAGC
101 ATCTGATTAA CGGCATCATC CTTGCCTGCG AAGCGACGTT TTTGTTCAAA
151 TTCGTCCTTT TCGACACCAT CAAGCATCAT TTGAAACAAG AGTTTGATTT
201 GAAACGTCAA ACTATGTTGC TGTTTATTCC GATTATTTTG CTGATTGTGT
251 ATTTGTTCCA CTATTTTGGC GCGTTTTAG
```

This corresponds to the amino acid sequence <SEQ ID 2532; ORF 740.a>:

a740.pep

```
 1 MSRNLLVRWL VVCLIPLATL AVFAANPPED KPQHLINGII LACEATFLFK

51 FVLFDTIKHH LKQEFDLKRQ TMLLFIPIIL LIVYLFHYFG AF*
```

a740/m740 97.8% identity in 92 aa overlap

```
                    10        20        30        40        50        60
a740.pep    MSRNLLVRWLVVCLIPLATLAVFAANPPEDKPQHLINGIILACEATFLFKFVLFDTIKHH
            ||||||||||:|||||||||||||||||||| ||||||||||||||||||||||||||||
m740        MSRNLLVRWLAVCLIPLATLAVFAANPPEDKLQHLINGIILACEATFLFKFVLFDTIKHH
                    10        20        30        40        50        60

                    70        80        90
a740.pep    LKQEFDLKRQTMLLFIPIILLIVYLFHYFGAFX
            ||||||||||||||||||||||||||||||||
m740        LKQEFDLKRQTMLLFIPIILLIVYLFHYFGAFX
                    70        80        90
```

The following partial DNA sequence was identified in *N. gonorrhoeae* <SEQ ID 2533>:

g741.seq

```
  1 GTGAACCGAA CTACCTTCTG CTGCCTTTCT TTGACCGCCG GCCCTGATTC

 51 TGACCGCCTG CAGCAGCGGA GGGGCGGAGG CGGTGGTGTC GCCGCCGACA

101 TCGGCACGGG GCTTGCCGAT GCATTAACCG CGCCGCTCGA CCATAAAGAC

151 AAAGGTTTGA AATCCCTAAC ATTGGAAGCC TCCATTCCCC AAAACGGAAC

201 ACTGACCCTG TCGGCACAAG GTGCGGAAAA AACTTTCAAA GCCGGCGGCA

251 AAGACAACAG CCTCAACACG GGCAAACTGA AGAACGACAA AATCAGCCGC

301 TTCGACTTCG TGCAAAAAAT CGAAGTGGAC GGACAAACCA TCACACTGGC

351 AAGCGGCGAA TTTCAAATAT ACAAACAGGA TCACTCCGcc gtcgtTgcCC

401 TacgGATTGA AAAAATCAAC AACCCCGACA AAATCGACAG CCTGATAAAC

451 CAACGCTCCT TCCTTGTCAG CGATTTGGGC GGAGAACATA CCGCCTTCAA

501 CCAACTGCCT GACGGCAAAG CCGAGTATCA CGGCAAAGCA TTCAGCTCCG

551 ACGATGCCGA CGGAAAACTG ACCTATACCA TAGATTTCGC CGCCAAACAG

601 GGACACGGCA AAATCGAACA CCTGAAAACA CCCGAGCAGA ATGTTGAGCT

651 TGCCTCCGCC GAACTCAAAG CAGATGAAAA ATCACACGCC GTCATTTTGG

701 GCGACACGCG CTACGGCGGC GAAGAGAAAG GCACTTACCG CCTCGCCCTT

751 TTCGGCGACC GCGCCCAAGA AATCGCTGGC TCGGCAACCG TGAAGATAGG

801 GGAAAAGGTT CACGAAATCG GCATCGCCGA CAAACAGTAG
```

This corresponds to the amino acid sequence <SEQ ID 2534; ORF 741.ng>:

g741.pep

```
  1 VNRTTFCCLS LTAGPDSDRL QQRRGGGGGV AADIGTGLAD ALTAPLDHKD

 51 KGLKSLTLEA SIPQNGTLTL SAQGAEKTFK AGGKDNSLNT GKLKNDKISR

101 FDFVQKIEVD GQTITLASGE FQIYKQDHSA VVALRIEKIN NPDKIDSLIN
```

-continued

```
151 QRSFLVSDLG GEHTAFNQLP DGKAEYHGKA FSSDDADGKL TYTIDFAAKQ

201 GHGKIEHLKT PEQNVELASA ELKADEKSHA VILGDTRYGG EEKGTYRLAL

251 FGDRAQEIAG SATVKIGEKV HEIGIADKQ*
```

The following partial DNA sequence was identified in *N. meningitidis* <SEQ ID 2535>:

m741.seq

```
  1 GTGAATCGAA CTGCCTTCTG CTGCCTTTCT CTGACCACTG CCCTGATTCT

 51 GACCGCCTGC AGCAGCGGAG GGGGTGGTGT CGCCGCCGAC ATCGGTGCGG

101 GGCTTGCCGA TGCACTAACC GCACCGCTCG ACCATAAAGA CAAAGGTTTG

151 CAGTCTTTGA CGCTGGATCA GTCCGTCAGG AAAAACGAGA AACTGAAGCT

201 GGCGGCACAA GGTGCGGAAA AAACTTATGG AAACGGTGAC AGCCTCAATA

251 CGGGCAAATT GAAGAACGAC AAGGTCAGCC GTTTCGACTT TATCCGCCAA

301 ATCGAAGTGG ACGGGCAGCT CATTACCTTG GAGAGTGGAG AGTTCCAAGT

351 ATACAAACAA AGCCATTCCG CCTTAACCGC CTTTCAGACC GAGCAAATAC

401 AAGATTCGGA GCATTCCGGG AAGATGGTTG CGAAACGCCA GTTCAGAATC

451 GGCGACATAG CGGGCGAACA TACATCTTTT GACAAGCTTC CCGAAGGCGG

501 CAGGGCGACA TATCGCGGGA CGGCGTTCGG TTCAGACGAT GCCGGCGGAA

551 AACTGACCTA CACCATAGAT TTCGCCGCCA AGCAGGGAAA CGGCAAAATC

601 GAACATTTGA AATCGCCAGA ACTCAATGTC GACCTGGCCG CCGCCGATAT

651 CAAGCCGGAT GGAAAACGCC ATGCCGTCAT CAGCGGTTCC GTCCTTTACA

701 ACCAAGCCGA GAAAGGCAGT TACTCCCTCG GTATCTTTGG CGGAAAAGCC

751 CAGGAAGTTG CCGGCAGCGC GGAAGTGAAA ACCGTAAACG GCATACGCCA

801 TATCGGCCTT GCCGCCAAGC AATAA
```

This corresponds to the amino acid sequence <SEQ ID 2536; ORF 741>:

m741.pep

```
  1 VNRTAFCCLS LTTALILTAC SSGGGGVAAD IGAGLADALT APLDHKDKGL

 51 QSLTLDQSVR KNEKLKLAAQ GAEKTYGNGD SLNTGKLKND KVSRFDFIRQ

101 IEVDGQLITL ESGEFQVYKQ SHSALTAFQT EQIQDSEHSG KMVAKRQFRI

151 GDIAGEHTSF DKLPEGGRAT YRGTAFGSDD AGGKLTYTID FAAKQGNGKI

201 EHLKSPELNV DLAAADIKPD GKRHAVISGS VLYNQAEKGS YSLGIFGGKA

251 QEVAGSAEVK TVNGIRHIGL AAKQ*
```

m741/g741 61.4% identity in 280 aa overlap

```
                       10             20          30          40          50
m741.pep    VNRTAFCCLSLTT---ALILTACSSGGGGVAADIGAGLADALTAPLDHKDKGLQSLTLDQ
            ||||:|||||||:   :  |    :||||||||||:|||||||||||||||||:||||:
g741        VNRTTFCCLSLTAGPDSDRLQQRRGGGGGVAADIGTGLADALTAPLDHKDKGLKSLTLEA
                       10          20          30          40          50          60
```

-continued

```
                 60        70           80        90       100       110
m741.pep       SVRKNEKLKLAAQGAEKTY---GNGDSLNTGKLKNDKVSRFDFIRQIEVDGQLITLESGE
               |: :|  | |:|||||||:   |: :|||||||||||:|||||:::|||||| ||| |||
g741           SIPQNGTLTLSAQGAEKTFKAGGKDNSLNTGKLKNDKISRFDFVQKIEVDGQTITLASGE
                       70        80        90        100       110       120

                  120       130       140       150       160       170
m741.pep       FQVYKQSHSALTAFQTEQIQDSEHSGKMVAKRQFRIGDIAGEHTSFDKLPEGGRATYRGT
               ||:|||:|||::|:: |:|:: ::   ::::|:| ::|::||||:|::||:| :| |:| 
g741           FQIYKQDHSAVVALRIEKINNPDKIDSLINQRSFLVSDLGGEHTAFNQLPDG-KAEYHGK
                      130       140       150       160       170

                  180       190       200       210       220       230
m741.pep       AFGSDDAGGKLTYTIDFAAKQGNGKIEHLKSPELNVDLAAADIKPDGKRHAVISGSVLYN
               ||:|||| ||||||||||||||:|||||||:|| ||:||:|::| | | |||| |:: |:
g741           AFSSDDADGKLTYTIDFAAKQGHGKIEHLKTPEQNVELASAELKADEKSHAVILGDTRYG
             180       190       200       210       220       230

                  240       250       260       270
m741.pep       QAEKGSYSLGIFGGKAQEVAGSAEVKTVNGIRHIGLAAKQX
                 |||:| |::|| :||||:||||  ||   : :::||:| |||
g741           GEEKGTYRLALFGDRAQEIAGSATVKIGEKVHEIGIADKQX
             240       250       260       270       280
```

The following partial DNA sequence was identified in *N. meningitidis* <SEQ ID 2537>:

a741.seq

```
  1 GTGAACCGAA CTGCCTTCTG CTGCCTTTCT TTGACCGCCG CCCTGATTCT
 51 GACCGCCTGC AGCAGCGGAG GCGGCGGTGT CGCCGCCGAC ATCGGCGCGG
101 TGCTTGCCGA TGCACTAACC GCACCGCTCG ACCATAAAGA CAAAAGTTTG
151 CAGTCTTTGA CGCTGGATCA GTCCGTCAGG AAAAACGAGA AACTGAAGCT
201 GGCGGCACAA GGTGCGGAAA AAACTTATGG AAACGGCGAC AGCCTCAATA
251 CGGGCAAATT GAAGAACGAC AAGGTCAGCC GCTTCGACTT TATCCGTCAA
301 ATCGAAGTGG ACGGGCAGCT CATTACCTTG GAGAGCGGAG AGTTCCAAGT
351 GTACAAACAA AGCCATTCCG CCTTAACCGC CCTTCAGACC GAGCAAGTAC
401 AAGATTCGGA GCATTCAGGG AAGATGGTTG CGAAACGCCA GTTCAGAATC
451 GGCGATATAG CGGGTGAACA TACATCTTTT GACAAGCTTC CCGAAGGCGG
501 CAGGGCGACA TATCGCGGGA CGGCATTCGG TTCAGACGAT GCCAGTGGAA
551 AACTGACCTA CACCATAGAT TTCGCCGCCA AGCAGGGACA CGGCAAAATC
601 GAACATTTGA AATCGCCAGA ACTCAATGTT GACCTGGCCG CCTCCGATAT
651 CAAGCCGGAT AAAAAACGCC ATGCCGTCAT CAGCGGTTCC GTCCTTTACA
701 ACCAAGCCGA GAAAGGCAGT TACTCTCTAG GCATCTTTGG CGGGCAAGCC
751 CAGGAAGTTG CCGGCAGCGC AGAAGTGGAA ACCGCAAACG GCATACGCCA
801 TATCGGTCTT GCCGCCAAGC AGTAA
```

This corresponds to the amino acid sequence <SEQ ID 2538; ORF 741.a>:

a741.pep

```
  1 VNRTAFCCLS LTAALILTAC SSGGGGVAAD IGAVLADALT APLDHKDKSL
 51 QSLTLDQSVR KNEKLKLAAQ GAEKTYGNGD SLNTGKLKND KVSRFDFIRQ
101 IEVDGQLITL ESGEFQVYKQ SHSALTALQT EQVQDSEHSG KMVAKRQFRI
151 GDIAGEHTSF DKLPEGGRAT YRGTAFGSDD ASGKLTYTID FAAKQGBGKI
```

-continued

```
201 EHLKSPELNV DLAASDIKPD KKRHAVISGS VLYNQAEKGS YSLGIFGGQA

251 QEVAGSAEVE TANGIRHIGL AAKQ*
```

a741/m741 95.6% identity in 274 aa overlap

```
                  10        20        30        40        50        60
a741.pep   VNRTAFCCLSLTAALILTACSSGGGGVAADIGAVLADALTAPLDHKDKSLQSLTLDQSVR
           |||||||||||:||||||||||||||||||| |||||||||||||:|||||||||||
m741       VNRTAFCCLSLTTALILTACSSGGGGVAADIGAGLADALTAPLDHKDKGLQSLTLDQSVR
                  10        20        30        40        50        60

                  70        80        90       100       110       120
a741.pep   KNEKLKLAAQGAEKTYGNGDSLNTGKLKNDKVSRFDFIRQIEVDGQLITLESGEFQVYKQ
           ||||||||||||||||||||||||||||||||||||||||||||||||||||||||||||
m741       KNEKLKLAAQGAEKTYGNGDSLNTGKLKNDKVSRFDFIRQIEVDGQLITLESGEFQVYKQ
                  70        80        90       100       110       120

                 130       140       150       160       170       180
a741.pep    SHSALTALQTEQVQDSEHSGKMVAKRQFRIGDIAGEHTSFDKLPEGGRATYRGTAFGSDD
            |||||||:||||:|||||||||||||||||||||||||||||||||||||||||||||||
m741        SHSALTAFQTEQIQDSEHSGKMVAKRQFRIGDIAGEHTSFDKLPEGGRATYRGTAFGSDD
                 130       140       150       160       170       180

                 190       200       210       220       230       240
a741.pep    ASGKLTYTIDFAAKQGHGKIEHLKSPELNVDLAASDIKPDKKRHAVISGSVLYNQAEKGS
            |:|||||||||||||:||||||||||||||||:||||| ||||||||||||||||||
m741        AGGKLTYTIDFAAKQGNGKIEHLKSPELNVDLAAADIKPDGKRHAVISGSVLYNQAEKGS
                 190       200       210       220       230       240

                 250       260       270
a741.pep    YSLGIFGGQAQEVAGSAEVETANGIRHIGLAAKQX
            ||||||||:||||||||||:|:|||||||||||||
m741        YSLGIFGGKAQEVAGSAEVKTVNGIRHIGLAAKQX
                 250       260       270
```

g742.seq not found yet g742.pep not found yet

The following partial DNA sequence was identified in *N. meningitidis* <SEQ ID 2539>:

m742.seq

```
  1 ATGGTTTACG GCATTGCCGA AGCCGATGCG GGCGACAGCA GTGTGCTTAC

 51 TTTGGGCGGC ATGTATCAGA AGAGTAGGGA GGTTCCTGAT TTTTCGGGCA

101 TTATTTTGCC CTGTGAAAAT CAGAAAACTG CCCCGTTCAG TTCAACGCCT

151 GCCTGCAACC GGCCTTTGCA ACTGCCGCGC AACACTTATT TGGGGGAGGA

201 TTGGTCGCGG TTAAGTGCCG ACAAATACAA CCTTTTCTCA GGATTCAAAC

251 ATGTGTTTGA CAACGGTTGG CAGCTCAATG CCGAAGTGTC TTATACCAAG

301 AATGAATCCG ATGCGAAGGT GGGGCAGTTT TTTCTGAAAA ACGAATATGC

351 GGCGGGTTTG TCGGGTGAGG ATGCGGTAGG CTTTTTGACT GAAAAAAACG

401 AAGTCATCCC GTTCGAGCCG AAAGATAAGG CATTGGAGAA ACTGAAAGCA

451 TATCGTGATG AAACCGCCAA GGAATACCGG GAGCGCAAAG ACGATTTTGT

501 TAAAAACCGT TTCGATAATA CTGCTTTCGA ACAGTATCGC AGCCGCCGTG

551 CCGCAGAACG CAAAGCCGGT TTTGACAAGT GTATGAGTGA CCCTTTCGCG

601 CTGGACTTTA TCTGTCAAGG TTCTTGGGGG GATCCGGGCG TTGATGCCGA

651 CAAGGCGGAA TTTGTCGATA AAGCCCTTGC GAAGGAGGGC ATCTTTAATA

701 ATGCGGCACA ACGTTTTCCA AACAGCCTGT ATGACTCTTC CTTTAATCGG

751 AAGGCTACCG CCAACCGACG ATACAGTTAT ATGCCGTTGC GGCATACCAA

801 AGACGACCGC CAATGGGGAA TTAAACTTGA CCTGACCGGC ACATATGGGC
```

-continued

```
 851 TGTTCGGGCG GGAGCATGAT TTCTTTGTCG GCTATGCCTA CGGTGATGAA
 901 AAGATACGTT CGGAATATCT AGAAATCTAC GAACGCCGCT ACAGAGTACG
 951 TCCGAATACG GGGGCAACGC ACGGCGTGTA TGCGGGAAGT TGTCAGGAGG
1001 AGCCGGACGG CGATTTGTCG TCTCCTTTGG TCAGGGGGCA TAAAGAACCC
1051 GATTGGCAGG CGTACGATGA AAAAGGCAAC CGTACCGTTT ATGCCGAAGA
1101 ATGCAGGAAC GCCAAGAAAA TAAAAACCGA GCCCAAGCTC GATGCCGAAG
1151 GCAAGCAGGT GTATTACTAT GACGAATACA GCGGCAGCCG GACACCGGTA
1201 TATGTCGATG TATATGAGCT GGACGAAAAA GGCAACAAGA TTCAGGAGAC
1251 CAATCCCGAC GGCACGCCTG CCTTTACCGG TTTTTCCGGT ACGGTGCCGG
1301 TTTGGAAAAC CGTCAAAGTG GCAGACGACC ATGTTCCTGC GCTGTATAAC
1351 TACGCCAAAT ACCTCAACAC CAACAAAACC CATTCGCTGA CTGCCAGCAC
1401 GCGTTTCAAC GTAACCGGCC GACTGCACCT TTTGGGCGGG CTGCACTACA
1451 CGCGCTATGA GACTTCGCAA ACCAAAGATA TGCCTGTCCG CTATGGGCAG
1501 CCGGCAAGCG ATTTTCAGAC GGCATCGAGC ATTAGGGCGG ATCAGGACCA
1551 TTACACGGCC AAGATGCAAG GTCATAAATT GACGCCCTAT GCAGGCATTA
1601 CCTATGACTT GACACCGCAA CAGAGTATTT ACGGAAGTTA TACCAAAATC
1651 TTCAAACAGC AGGATAATGT CGATGTCAGT GCCAAAACCG TTTTACCGCC
1701 TTTGGTCGGC ACAAACTATG AGGTAGGCTG GAAAGGCGCG TTCTTGCAAG
1751 GACGGCTGAA TGCTTCGTTC GCATTGTTTT ACCTCGAACA GAAAAACCGC
1801 ACGGTCGTCG ATTTCGGCTA TGTTCCCGGA GCAGGCGGCA AGCAGGGGTC
1851 GTTCCAAACC GTTGCCAAAC CGATAGGCAA AGTGGTCAGC AGGGGTGCGG
1901 AATTCGAGTT GTCGGGTGAC TTGAACGAAG ATTGGAAAGT CTTTGCGGGT
1951 TACACCTACA ACAAGAGCCG CTACAAAAAC GCCGCCGAAG TCAACGCCGA
2001 ACGCCTTGCC AAAAATTCCA GTGCAGACCC GTACAACTTC AGCAATTTCA
2051 CACCCGTGCA CATATTCCGT TTCGGAACGA GCTTCCATAT ACCGAATACG
2101 GGGCTGACCG TCGGCGGCGG CGTGTCCGCA CAAAGCGGCA CAAGCAGTCT
2151 GTATAACATC AGGCAGGGCG GCTACGGGCT GATAGACGGT TTCGTCCGTT
2201 ACGAATTGGG CAAACACGCC AAATTGAGCC TCATCGGTAC GAACTTAAAC
2251 GGACGCACTT ATTTTGAGAA CAACTACAAC CGTACGCGCG GCGCAAACAA
2301 CTTCTACGGA GAGCCGCGCA CTGTCAGCAT GAAACTGGAT TGGCAGTTTT
2351 AA
```

This corresponds to the amino acid sequence <SEQ ID 2540; ORF 742>:

m742.pep

```
  1 MVYGIAEADA GDSSVLTLGG MYQKSREVPD FSGIILPCEN QKTAPFSSTP
 51 ACNRPLQLPR NTYLGEDWSR LSADKYNLFS GFKHVFDNGW QLNAEVSYTK
101 NESDAKVGQF FLKNEYAAGL SGEDAVGFLT EKNEVIPFEP KDKALEKLKA
151 YRDETAKEYR ERKDDFVKNR FDNTAFEQYR SRRAAERKAG FDKCMSDPFA
```

-continued

```
201 LDFICQGSWG DPGVDADKAE FVDKALAKEG IFNNAAQRFP NSLYDSSFNR

251 KATANRRYSY MPLRHTKDDR QWGIKLDLTG TYGLFGREHD FFVGYAYGDE

301 KIRSEYLEIY ERRYRVRPNT GATHGVYAGS CQEEPDGDLS SPLVRGHKEP

351 DWQAYDEKGN RTVYAEECRN AKKIKTEPKL DAEGKQVYYY DEYSGSRTPV

401 YVDVYELDEK GNKIQETNPD GTPAFTGFSG TVPVWKTVKV ADDHVPALYN

451 YAKYLNTNKT HSLTASTRFN VTGRLHLLGG LHYTRYETSQ TKDMPVRYGQ

501 PASDFQTASS IRADQDHYTA KMQGHKLTPY AGITYDLTPQ QSIYGSYTKI

551 FKQQDNVDVS AKTVLPPLVG TNYEVGWKGA FLQGRLNASF ALFYLEQKNR

601 TVVDFGYVPG AGGKQGSFQT VAKPIGKVVS RGAEFELSGE LNEDWKVFAG

651 YTYNKSRYKN AAEVNAERLA KNSSADPYNF SNFTPVHIFR FGTSFHIPNT

701 GLTVGGGVSA QSGTSSLYNI RQGGYGLIDG FVRYELGKHA KLSLIGTNLN

751 GRTYFENNYN RTRGANNFYG EPRTVSMKLD WQF*
```

The following partial DNA sequence was identified in *N. meningitidis* <SEQ ID 2541>:

a742.seq

```
   1 ATGGTTTACG GCATTGCCGA AGCCGATGCG GGCGACAGCA GTGTGCTTAC

  51 TTTGGGCGGC ATGTATCAGA AGAGTAGGGA GGTTCCTGAT TTTTCGGGCA

 101 TTATTTTGTC CTGTGAAAAT CAGAAAACTG CCCCGTTCAG TTCAACGCCT

 151 GCCTGCAACC GGCCTTTGCA ACTGCCGCGC AACACTTATT TGGGGGAGGA

 201 TTGGTCGCGG TTGAGTGCTG ACAAATACAA CCTTTTCTCA GGTTTCAAAC

 251 ATGTGTTTGA CAACGGTTGG CAGCTCAATG CCGAAGTGTC TTATACCAAG

 301 AATGAATCCG ATGCGAAGGT GGGGCAGTTT TTTCTGAAAA ACGAACATGC

 351 GGCGGGTTTG TCAGATGAGG ATGCGGTAGG CTTTTTGACC GAAAAAAACG

 401 AAGTCATCCC GTTCGAGCCG AAAGATAAGG CATTGGAGAA ACTGAAAGCA

 451 TATCGTGACG AAACCGCCAA GGAATACCGT GAGCGCAAAG ACGATTTTGT

 501 TAAAAACCGT TTCGATAATA CTGCTTTCGA GCAGTACCGC AGCCGCCGTG

 551 CCGCAGAACG CAAAGCCGGT TTTGACGAGT GTATGAGTGC CCCTTTTGCG

 601 CTGGACTTTA TCTGTCAAGG TTCTTGGGGG GATCCGGGTG TTGATGCCGA

 651 CAAGTCGGAA TTTGTCGATA AAGCCCTTGC GAAGGAAGGC ATCTTTAATA

 701 ATGCGGCACA ACGTTTTCCA AACAGCCTGT ATGACTCTTC CTTTAATCGG

 751 AAGGCTACCG CCAACCGACG ATACAGTTAT ATGCCGTTGC GGCATACCAA

 801 AGACGACCGC CAATGGGGAA TTAAACTTGA CCTGACCGGC ACATATGGGC

 851 TGTTCGGGCG GGAGCATGAT TTCTTTGTCG GCTATGCCTA CGGCGATGAA

 901 AAGATACGTT CCGAATATCT GGAAATCTAC GAACGCCGCC ACAGAGTACG

 951 TCCGAATACA GGGGCAACGC ACGGCGTGTA TGCGGGAAGT TGTCAGGGGG

1001 AGCCGGACGG TGATTTGTCT TCTCCTTTGG TCAGGGGGCA TAAAGAACCC

1051 GATTGGCAGG CGTACGATGA AAAAGGCAAC CGTACCGTTT ATGCCGAAGA

1101 ATGCAGGAAT GCCAAGAAAA TAAAAACCGA GCCCAAGCTC GATGCCGAAG

1151 GCAAGCAGGT GTATTACTAT GACGAATACA GCGGCAGCCG GACGCCAGTA
```

-continued

1201 TATGTCGATG TATATGAACT GGATGAAAAA GGCAATAAGA TTCAGGAGAC

1251 CAATCCCGAC GGCACGCCTG CCTTTACCGG TTTTTCCGGT ACGGTGCCGG

1301 TTTGGAAAAC CGTCAAAGTG GCCGACGACC ATGTTCCTGC GCTGTATAAC

1351 TACGCCAAAT ACCTCAACAC CAACAAAACC CATTCGCTGA CTGCCGGCAC

1401 GCGTTTCAAC GTAACCGGCC GACTGCATCT TTTGGGCGGG CTGCACTACA

1451 CGCGCTATGA AACCTCGCAA ACCAAAGATA TGCCTGTCCG CTATGGGCAG

1501 CCGGCAAGCG ATTTTCAGAC GGCATCGAGC ATTAAGGCGG ATCAGGACCA

1551 TTATACGGCC AAGATGCAAG GTCATAAATT GACGCCCTAT GCAGGCATTA

1601 CCTATGATTT GACACCGCAA CAGAGTATTT ACGGAAGTTA TACCAAAATC

1651 TTCAAACAGC AGGATAATGT CGATGTCAGT GCCAAAACCG TTTTACCGCC

1701 TTTGGTCGGC ACAAACTATG AGGTAGGCTG GAAAGGCGCG TTCTTGCAAG

1751 GACGGCTGAA TGCTTCGTTC GCATTGTTTT ACCTCGAACA GAAAAACCGC

1801 ACGGTCGTCG ATTTTGGCTA TGTTCCCGGA GCAGGCGGCA AGCAGGGGTC

1851 GTTCCAAACC GTTGCCAAAC CGATAGGCAA AGTGGTCAGC AGGGGTGCGG

1901 AATTCGAGTT GTCGGGTGAG TTGAACGAAG ATTGGAAAGT CTTTGCGGGT

1951 TACACCTACA ACAAGAGCCG CTACAAAAAC GCCGCCGAAG TCAACGCCGA

2001 ACGCCTCGCC AAAAACACAG GCGCAGACCC GTACAACTTC AGCAATTTCA

2051 CACCCGTGCA CATATTCCGT TTCGGAACGA GCTTCCATAT ACCGAATACG

2101 GGGCTGACCG TCGGCGGCGG CGTGTCCGCA CAAAGCGGCA CAAGCAGTCT

2151 GTATAACATC AGGCAGGGCG GCTACGGGCT GATAGACGGT TTCGTCCGTT

2201 ACGAATTGGG CAAACACGCT AAATTGAGCC TCATCGGTAC GAACTTAAAC

2251 GGACGCACTT ATTTTGAGAA CAACTACAAC CGTACGCGCG GCGCAAACAA

2301 CTTCTATGGA GAGCCGCGCA CTGTCAGCAT GAAACTGGAT TGGCAGTTTT

2351 AA

This corresponds to the amino acid sequence <SEQ ID 2542; ORF 742.a>:

a742.pep

1 MVYGIAEADA GDSSVLTLGG MYQKSREVPD FSGIILSCEN QKTAPFSSTP

51 ACNRPLQLPR NTYLGEDWSR LSADKYNLFS GFKHVFDNGW QLNAEVSYTK

101 NESDAKVGQF FLKNEHAAGL SDEDAVGFLT EKNEVIPFEP KDKALEKLKA

151 YRDETAKEYR ERKDDFVKNR FDNTAFEQYR SRRAAERKAG FDECMSAPFA

201 LDFICQGSWG DPGVDADKSE FVDKALAKEG IFNNAAQRFP NSLYDSSFNR

251 KATANRRYSY MPLRHTKDDR QWGIKLDLTG TYGLFGREHD FFVGYAYGDE

301 KIRSEYLEIY ERRHRVRPNT GATHGVYAGS CQGEPDGDLS SPLVRGHKEP

351 DWQAYDEKGN RTVYAEECRN AKKIKTEPKL DAEGKQVYYY DEYSGSRTPV

401 YVDVYELDEK GNKIQETNPD GTPAFTGFSG TVPVWKTVKV ADDHVPALYN

451 YAKYLNTNKT HSLTAGTRFN VTGRLHLLGG LHYTRYETSQ TKDMPVRYGQ

501 PASDFQTASS IKADQDHYTA KMQGHKLTPY AGITYDLTPQ QSIYGSYTKI

-continued

```
551 FKQQDNVDVS AKTVLPPLVG TNYEVGWKGA FLQGRLNASF ALFYLEQKNR

601 TVVDFGYVPG AGGKQGSFQT VAKPIGKVVS RGAEFELSGE LNEDWKVFAG

651 YTYNKSRYKN AAEVNAERLA KNTGADPYNF SNFTPVHIFR FGTSFHIPNT

701 GLTVGGGVSA QSGTSSLYNI RQGGYGLIDG FVRYELGKHA KLSLIGTNLN

751 GRTYFENNYN RTRGANNFYG EPRTVSMKLD WQF*
```

a742/m742 98.5% identity in 783 aa overlap

```
                   10        20        30        40        50        60
a742.pep   MVYGIAEADAGDSSVLTLGGMYQKSREVPDFSGIILSCENQKTAPFSSTPACNRPLQLPR
           |||||||||||||||||||||||||||||||||||| |||||||||||||||||||||||
m742       MVYGIAEADAGDSSVLTLGGMYQKSREVPDFSGIILPCENQKTAPFSSTPACNRPLQLPR
                   10        20        30        40        50        60

                   70        80        90       100       110       120
a742.pep   NTYLGEDWSRLSADKYNLFSGFKHVFDNGWQLNAEVSYTKNESDAKVGQFFLKNEHAAGL
           |||||||||||||||||||||||||||||||||||||||||||||||||||||||:||||
m742       NTYLGEDWSRLSADKYNLFSGFKHVFDNGWQLNAEVSYTKNESDAKVGQFFLKNEYAAGL
                   70        80        90       100       110       120

                   130       140       150       160       170       180
a742.pep    SDEDAVGFLTEKNEVIPFEPKDKALEKLKAYRDETAKEYRERKDDFVKNRFDNTAFEQYR
            | ||||||||||||||||||||||||||||||||||||||||||||||||||||||||||
m742        SGEDAVGFLTEKNEVIPFEPKDKALEKLKAYRDETAKEYRERKDDFVKNRFDNTAFEQYR
                   130       140       150       160       170       180

                   190       200       210       220       230       240
a742.pep    SRRAAERKAGFDECMSAPFALDFICQGSWGDPGVDADKSEFVDKALAKEGIFNNAAQRFP
            ||||||||||||:||| |||||||||||||||||||||:|||||||||||||||||||||
m742        SRRAAERKAGFDKCMSDPFALDFICQGSWGDPGVDADKAEFVDKALAKEGIFNNAAQRFP
                   190       200       210       220       230       240

                   250       260       270       280       290       300
a742.pep    NSLYDSSFNRKATANRRYSYMPLRHTKDDRQWGIKLDLTGTYGLFGREHDFFVGYAYGDE
            ||||||||||||||||||||||||||||||||||||||||||||||||||||||||||||
m742        NSLYDSSFNRKATANRRYSYMPLRHTKDDRQWGIKLDLTGTYGLFGREHDFFVGYAYGDE
                   250       260       270       280       290       300

                   310       320       330       340       350       360
a742.pep    KIRSEYLEIYERRHRVRPNTGATHGVYAGSCQGEPDGDLSSPLVRGHKEPDWQAYDEKGN
            |||||||||||||:|||||||||||||||||| |||||||||||||||||||||||||||
m742        KIRSEYLEIYERRYRVRPNTGATHGVYAGSCQEEPDGDLSSPLVRGHKEPDWQAYDEKGN
                   310       320       330       340       350       360

                   370       380       390       400       410       420
a742.pep    RTVYAEECRNAKKIKTEPKLDAEGKQVYYYDEYSGSRTPVYVDVYELDEKGNKIQETNPD
            ||||||||||||||||||||||||||||||||||||||||||||||||||||||||||||
m742        RTVYAEECRNAKKIKTEPKLDAEGKQVYYYDEYSGSRTPVYVDVYELDEKGNKIQETNPD
                   370       380       390       400       410       420

                   430       440       450       460       470       480
a742.pep    GTPAFTGFSGTVPVWKTVKVADDHVPALYNYAKYLNTNKTHSLTAGTRFNVTGRLHLLGG
            |||||||||||||||||||||||||||||||||||||||||||||:||||||||||||||
m742        GTPAFTGFSGTVPVWKTVKVADDHVPALYNYAKYLNTNKTHSLTASTRFNVTGRLHLLGG
                   430       440       450       460       470       480

                   490       500       510       520       530       540
a742.pep    LHYTRYETSQTKDMPVRYGQPASDFQTASSIKADQDHYTAKMQGHKLTPYAGITYDLTPQ
            |||||||||||||||||||||||||||||||:||||||||||||||||||||||||||||
m742        LHYTRYETSQTKDMPVRYGQPASDFQTASSIRADQDHYTAKMQGHKLTPYAGITYDLTPQ
                   490       500       510       520       530       540

                   550       560       570       580       590       600
a742.pep    QSIYGSYTKIFKQQDNVDVSAKTVLPPLVGTNYEVGWKGAFLQGRLNASFALFYLEQKNR
            ||||||||||||||||||||||||||||||||||||||||||||||||||||||||||||
m742        QSIYGSYTKIFKQQDNVDVSAKTVLPPLVGTNYEVGWKGAFLQGRLNASFALFYLEQKNR
                   550       560       570       580       590       600

                   610       620       630       640       650       660
a742.pep    TVVDFGYVPGAGGKQGSFQTVAKPIGKVVSRGAEFELSGELNEDWKVFAGYTYNKSRYKN
            ||||||||||||||||||||||||||||||||||||||||||||||||||||||||||||
m742        TVVDFGYVPGAGGKQGSFQTVAKPIGKVVSRGAEFELSGELNEDWKVFAGYTYNKSRYKN
                   610       620       630       640       650       660

                   670       680       690       700       710       720
a742.pep    AAEVNAERLAKNTGADPYNFSNFTPVHIFRFGTSFHIPNTGLTVGGGVSAQSGTSSLYNI
            ||||||||||||::||||||||||||||||||||||||||||||||||||||||||||||
m742        AAEVNAERLAKNSSADPYNFSNFTPVHIFRFGTSFHIPNTGLTVGGGVSAQSGTSSLYNI
                   670       680       690       700       710       720

                   730       740       750       760       770       780
a742.pep    RQGGYGLIDGFVRYELGKHAKLSLIGTNLNGRTYFENNYNRTRGANNFYGEPRTVSMKLD
            ||||||||||||||||||||||||||||||||||||||||||||||||||||||||||||
m742        RQGGYGLIDGFVRYELGKHAKLSLIGTNLNGRTYFENNYNRTRGANNFYGEPRTVSMKLD
                   730       740       750       760       770       780
```

-continued

```
a742.pep    WQFX
            ||||
m742        WQFX
```

sp|P25184|PUPA_PSEPU FERRIC-PSEUDOBACTIN 358 RECEPTOR PRECURSOR >gi|94923|pir||S15169 ferric-pseudobactin receptor precursor-*Pseudomonas putida* >gi|45723 (X56605) pseudobactin uptake protein [*Pseudomonas putida*] Length=819
    Score=152 bits (381), Expect=6e-36
    Identities=110/356 (30%), Positives=170/356 (46%), Gaps=55/356 (15%)

```
Query: 436 KTVKVADDHV-PALYNYAKYLNTNKTHSLTAGTRFNVTGRLHLLGGLHYTRYETSQTKDM 494
           +T K  DD + P +   +Y  +N+      +RFN+T  LHL+ G    + Y
Sbjct: 511 QTPKPGDDEIIPGI----QYNISNRQSGYFVASRFNLTDDLHLILGARASNYRFDYAL-- 564

Query: 495 PVRYGQPASDFQTASSIKADQDHYTAKMQGHKLTPYAGITYDLTPQQSIYGSYTKIFKQQ 554
              R G   + ++           ++    +TPYAGI YDLT +QS+Y  SYT IFK Q
Sbjct: 565 -WRIGNEPAPYKM--------------VERGVVTPYAGIVYDLTNEQSVYASYTDIFKPQ 609

Query: 555 DNVDVSAKTVLPPLVGTNYEVGWKGAFLQGRLNASFALFYLEQKNRTVVDEGYVPGAGGK 614
           +NVD++ K  L P VG NYE+GWKG FL+GRLNA+ AL+ +++ N        VP +GG
Sbjct: 610 NNVDITGKP-LDPEVGKNYELGWKGEFLEGRLNANIALYMVKRDNLAESTNEVVPDSGGL 668

Query: 615 QGSFQTVAKPIGKVVSRGAEFELSGELNEDWKVFAGYTYNKSRYKNAAEVNAERLAKNTG 674
             S     + +    ++G +  ELSGE+    W VF GY++ ++
Sbjct: 669 IAS-----RAVDGAETKGVDVELSGEVLPGWNVFTGYSHTRTE----------------D 707

Query: 675 ADPYNFSNFTPVHIFRFGTSFHIPN--TGLTVGGGVSAQSGTS---SLYN--IRQGGYGL 727
           AD    +    P+  FRF ++ +P       LT+GGGV+ S ++    + YN  + Q  Y +
Sbjct: 708 ADGKRLTPQLPMDTFRFWNTYRLPGEWEKLTLGGGVNWNSKSTLNFARYNSHVTQDDYFV 767

Query: 728 IDGFVRYELGKHAKLSLIGTNLNGRTYFENNYNRTRGANNFYGEPRTVSMKLDWQF     783
               RY + +    +L    N+ + Y     Y     G+      YG PR ++ L + F
Sbjct: 768 TSLMARYRINESLAATLNVNNIFDKKY----YAGMAGSYGHYGAPRNATVTLRYDF     819
```

g743.seq not found yet
g743.pep not found yet

The following partial DNA sequence was identified in *N. meningitidis* <SEQ ID 2543>:

```
m743.seq

  1 ATGAATCAAA ATCATTTTTC ACTTAAAATT CTGACCGTTA TGCTGTTATC

 51 GGCTTACGGT GGTTCTTTTG CAGACGGTGT TGTGCCTGTT TCAGACGGCA

101 ATACCGTCAG TCTGGATACG GTCAATGTAC GCGGCTCTCA TGCTTTGTTG

151 GGCAAGACCG AAAAGACCCG TTCTTATACG ATAGATCGGA TGTCCACCGC

201 CACAGGTATG AGGATTGCGG GCAAGGATAC GCCGCAGTCG GTCAGCGTCA

251 TCACGCGCAG CCGCCTTGAC GATAAGGCGG TGCATACGCT TGAAGAGGCA

301 ATGAAAAACA CGACGGGTGT CAACGTTGTG CGCGATTCAG GCTTGCAGAC

351 GCGGTTTTTG TCACGCGGTT TCTATATTGA TCAGATTGGT GAAGACGGTA

401 TGACCGTCAA TGTTGCAGGC CGTTCGGGAT ATACGGCGAA AATCGACGTG

451 TCTCCGAGTA CCGATTTGGC GGTTTATGAC CATATTGAAG TTGTACGGGG

501 TGCAACGGGG TTGACCCAAT CCAATTCAGA GCCGGGAGGA ACCGTCAATT

551 TGATCCGTAA GTGA
```

This corresponds to the amino acid sequence <SEQ ID 2544; ORF 743>:

m743.pep

```
  1 MNQNHFSLKI LTVMLLSAYG GSFADGVVPV SDGNTVSLDT VNVRGSHALL
 51 GKTEKTRSYT IDRMSTATGM RIAGKDTPQS VSVITRSRLD DKAVHTLEEA
101 MKNTTGVNVV RDSGLQTRFL SRGFYIDQIG EDGMTVNVAG RSGYTAKIDV
151 SPSTDLAVYD HIEVVRGATG LTQSNSEPGG TVNLIRK*
```

The following partial DNA sequence was identified in *N. meningitidis* <SEQ ID 2545>:

a743.seq

```
  1 ATGAATCAAA ATCATTTTTC ACTTAAAATT CTGACCGTTA TGCTGTTATC
 51 GGCTTACGGT GGTTCTTTTG CAGACGGTGT TGTGCCTGTT TCAGACGGCA
101 ATACCGTCAG TTTGGATACG GTCAATGTAC GCGGCTCTCA TGCTCTGTCG
151 GGCAAGACCG AGAAGACCCG TTCTTATACG ATAGATCGGA TGTCCACCGC
201 CACAGGTATG AGGATTGCGG GCAAGGATAC GCCGCAGTCG GTCAGCGTCA
251 TCACGCGCAG CCGCCTTGAC GATAAGGCGG TGCATACGCT TGAAGAGGCA
301 ATGAAAAACA CGACGGGTGT CAACGTTGTG CGCGATTCAG GCTTGCAGAC
351 GCGGTTTTTG TCACGCGGTT TCTATATTGA TCAGATTGGT GAAGACGGTA
401 TTACCGTCAA TGTTGCAGGC CGTTCGGGAT ATACGGCGAA AATCGACGTG
451 TCTCCGAGTA CCGATTTGGC GGTTTATGAC CATATTGAAG TTGTACGGGG
501 TGCAACGGGG TTGACCCAAT CCAATTCAGA GCCGGGTGGA ACCGTCAATT
551 TGATCCGTAA GCGA
```

This corresponds to the amino acid sequence <SEQ ID 2546; ORF 743.a>:

a743.pep

```
  1 MNQNHFSLKI LTVMLLSAYG GSFADGVVPV SDGNTVSLDT VNVRGSHALS
 51 GKTEKTRSYT IDRMSTATGM RIAGKDTPQS VSVITRSRLD DKAVHTLEEA
101 MKNTTGVNVV RDSGLQTRFL SRGFYIDQIG EDGITVNVAG RSGYTAKIDV
151 SPSTDLAVYD HIEVVRGATG LTQSNSEPGG TVNLIRKR
```

a743/m743 98.9% identity in 187 aa overlap

```
                    10        20        30        40        50        60
a743.pep    MNQNHFSLKILTVMLLSAYGGSFADGVVPVSDGNTVSLDTVNVRGSHALSGKTEKTRSYT
            ||||||||||||||||||||||||||||||||||||||||||||||||| ||||||||||
m743        MNQNHFSLKILTVMLLSAYGGSFADGVVPVSDGNTVSLDTVNVRGSHALLGKTEKTRSYT
                    10        20        30        40        50        60

                    70        80        90       100       110       120
a743.pep    IDRMSTATGMRIAGKDTPQSVSVITRSRLDDKAVHTLEEAMKNTTGVNVVRDSGLQTRFL
            ||||||||||||||||||||||||||||||||||||||||||||||||||||||||||||
m743        IDRMSTATGMRIAGKDTPQSVSVITRSRLDDKAVHTLEEAMKNTTGVNVVRDSGLQTRFL
                    70        80        90       100       110       120

                   130       140       150       160       170       180
a743.pep     SRGFYIDQIGEDGITVNVAGRSGYTAKIDVSPSTDLAVYDHIEVVRGATGLTQSNSEPGG
             |||||||||||||:||||||||||||||||||||||||||||||||||||||||||||||
m743         SRGFYIDQIGEDGMTVNVAGRSGYTAKIDVSPSTDLAVYDHIEVVRGATGLTQSNSEPGG
                   130       140       150       160       170       180
```

-continued

```
a743.pep    TVNLIRKR
            |||||||
m743        TVNLIRKX
```

g744.seq not found yet g744.pep not found yet

The following partial DNA sequence was identified in *N. meningitidis* <SEQ ID 2547>:

m744.seq

```
   1 ATGAAACCGT TAAAAACATT AGAATTTGGA TTTGTGGATG CTGCAAACTA
  51 CAGAAGAAGA GAAAATAAAG ATTTATTTAA CCGAATATTT GTAAAAGGAG
 101 AATATTTGGA TGAATTATGT GAACCAAATA TTTCGTTTTT AATCGGAGAA
 151 AAGGGAACTG GAAAGACAGC ATATGCTGTT TATTTAACTA ATAACTTCTA
 201 TAAAAACATA CATGCCACTA CTAAGTTTGT TCGTGAAACC GATTATTCAA
 251 AATTTATTCA GCTAAAGAAA GCAAGACACT TAACTGTTTC AGATTTTACA
 301 AGTATTTGGA AAGTCATTTT ATATCTGTTG ATATCAAATC AAATCAAATG
 351 TAAAGAAAAC GGAATATTAT CTTCAATATT TAATAAATTT AAAGCCTTAG
 401 ATGAGGCTAT AAATGAATAT TATTATGGCG CTTTTGATCC GGAAATTGTA
 451 CAAGCAATAA CTTTAATAGA AAATTCAAAA GAAGCTGCGG AAATGATTTT
 501 TGGAAAATTT GTTAAACTAG GTGAAGAGGA ATCCCAACAA ATAACTTTTA
 551 CAGAAAGTAA ATTCCAAGCA AATTTAGGTT TTATTGAAAG AAAATTTAAA
 601 GATGCTTTAT CTCAGTTAAA GCTAAAAGAT AATCATATTT TGTTTATTGA
 651 TGGGATAGAT ATTAGACCAT CACAGATTCC ATTTGATGAA TATCATGAGT
 701 GTGTAAAAGG TCTTGCTAAC GCCATATGGA TGTTAAATAA TGATATCTTC
 751 CCTTCCATTA AAGATAGTAA GGGAAGGATG AGAGTTGTGT TATTGATTAG
 801 ACCTGATATC TTTGATTCAT TAGGTTTACA AAATCAAAAT ACCAAACTTC
 851 AAGATAATTC AGTATTTTTA GACTGGAGGA CGGATTATAA ATCTTATAGA
 901 AGTTCAAAGA TTTTTGGCGT TTTTGATCAT CTTTTGAGAA CCCAGCAAGA
 951 AAAACAAGAT AGTTTAGAAA AAGGCAACTC ATGGGATTAT TATTTTCCAT
1001 GGAATGCTCC TAATTTACAT GATGAGTATA AAAATTTAAC TTCATTTATT
1051 AGCTTCCTAA GAAAATCGTA TTATCGACCT CGCGATATTC TTCAGATGCT
1101 TACTTTGCTA CAAAAAAATA AGAAAAGTAA GGAAGATTAT GTCGTAGCAG
1151 AAGATTTTGA TAATACTTCT TTTCAAAGAG AATACTCGAT ATATTTACTT
1201 GGTGAAATCA AAGATCATCT TTTGTTTTAT TATAGTCAAA GTGATTATCA
1251 AAATTTCCTG AAATTTTTTG AATTTTTAAA CGGGAAAGAT AGATTTAAAT
1301 ATAGTGATTT TTTAAAAGCA TTTGAACGTT TGAAAAAGCA CTTACAAACA
1351 ACATCAGTGG AAATACCTAA ATTTATGAGT ACTGCTAATG AGTTTTTGCA
1401 ATTTTTATTT GACTTGAATG TTATTGCTTA TTTAGATAAC CCAGAAGATG
1451 AAACGAAACC ATATATCCAT TGGTGCTTTA AAGATAGAAA TTATGCAAAT
1501 ATTTCTCCTA AAATAAAAAC TGAAACTGAA TATTTAATAT TTTCAGGATT
1551 ATCAAAAGCC CTTGATGTTG GTACTCCATT TAAGAACAAA CAGTAA
```

This corresponds to the amino acid sequence <SEQ ID 2548; ORF 744>:

m744.pep

```
  1 MKPLKTLEFG FVDAANYRRR ENKDLFNRIF VKGEYLDELC EPNISFLIGE
 51 KGTGKTAYAV YLTNNFYKNI HATTKFVRET DYSKFIQLKK ARHLTVSDFT
101 SIWKVILYLL ISNQIKCKEN GILSSIFNKF KALDEAINEY YYGAFDPEIV
151 QAITLIENSK EAAEMIFGKF VKLGEEESQQ ITFTESKFQA NLGFIERKFK
201 DALSQLKLKD NHILFIDGID IRPSQIPFDE YHECVKGLAN AIWMLNNDIF
251 PSIKDSKGRM RVVLLIRPDI FDSLGLQNQN TKLQDNSVFL DWRTDYKSYR
301 SSKIFGVFDH LLRTQQEKQD SLEKGNSWDY YFPWNAPNLH DEYKNLTSFI
351 SFLRKSYYRP RDILQMLTLL QKNKKSKEDY VVAEDFDNTS FQREYSIYLL
401 GEIKDHLLFY YSQSDYQNFL KFFEFLNGKD RFKYSDFLKA FERLKKHLQT
451 TSVEIPKFMS TANEFLQFLF DLNVIAYLDN PEDETKPYIH WCFKDRNYAN
501 ISPKIKTETE YLIFSGLSKA LDVGTPFKNK Q*
```

g745.seq not found yet g745.pep not found yet

The following partial DNA sequence was identified in *N. meningitidis* <SEQ ID 2549>:

m745.seq

```
  1 ATGTTTTGGC AACTGACCGT TGTTTCAGTA ACCGCCGTCA TTGCACTGGG
 51 GACAATATTC ATCAATAAGA AAACTTCAAA GCAAAAGGCG ACATTAGATG
101 TTATTTTGAA TGATTACCAA GATGCACAAT TTGTAGAAGC CGACAATCAT
151 ATTTCGCCTT ATATTCGCGG CACGGCAGTT GACGACAACA ACGCGCGGAT
201 CGACCTGTAT GAAATTTATC AAAATAAGGG CGGACAATGG GAAAAAGAGA
251 GAGGGCATTT ACTTACCGTA ATCAATCGGC ACGAGTTTTA TGCGTGCGCA
301 ATCAACTCGG GAGTATTGGA TGAGGATTTG TTTAAACGGC TGCATTGCAC
351 CAACTTCATA AAATTGTGGA ATGCAGTTTC GCCTCTTGTT ATGAAAATAC
401 GCGAAGAAGA ACGCAAAGAC ACAATATTTA GAGAGTTGGA AATTTTGGTT
451 GCATTATGGA AAGCAAACCC CCTAAAGGCA TCTGATTTGT GA
```

This corresponds to the amino acid sequence <SEQ ID 2550; ORF 745>:

m745.pep

```
  1 MFWQLTVVSV TAVIALGTIF INKKTSKQKA TLDVILNDYQ DAQFVEADNH
 51 ISPYIRGTAV DDNNARIDLY EIYQNKGGQW EKERGHLLTV INRHEFYACA
101 INSGVLDEDL FKRLHCTNFI KLWNAVSPLV MKIREEERKD TIFRELEILV
151 ALWKANPLKA SDL*
```

a745.seq not found yet a745.pep not found yet

The following partial DNA sequence was identified in *N. gonorrhoeae* <SEQ ID 2551>:

g746.seq

```
   1 ATGTCCGAAA ACAAACAAAA CGAAGTCCTG ACCGGTTACG AACAGCTGAA
  51 ACGGCGCAAC CGCCGCCGCC TCGTAACGGC AAGCTCCCTG GTTGCCGCCT
 101 CCTGCATCCT GCTGGCAGCC GCACTCAGTT CCGATCCTGC CGACAGCAAT
 151 CCCGCACCGC AGGCCGGCGA AACCGGCGCA ACGGAAAGCC AAACGGCAAA
 201 CACGGCACAA ACCCCTGCCT TGAAATCCGC CGCCGAAAAC GGGGAAACCG
 251 CCGCCGACAA ACCGCAGGAC TTGGCAGGCG AAGACAAGCC TTCTGCCGCC
 301 GACAGCGAAA TCAGCGAGCC TGAAAACGTA GGCGCGCCGC TGGTGCTGAT
 351 TAACGACCGG CTCGAAGACA GCAACATCAA AGGTTTGGAA GAATCCGAGA
 401 AACTGCAACA GGCAGAAACC GCCAAAACCG AACCGAAGCA GGCAAAACAA
 451 CGCGCTGCCG AAAAAGTGTC GGCAACTGCC GACAGTACGG ATACGGTAGC
 501 GGTTGAAAAA CCGAAACGCA CTGCCGAACC CAAACCGCAA AAAGCGGAAC
 551 GCACTGCCGA AGCCAAGCCC AAAGCCAAAG AAACCAAAAC CGCCGAAAAA
 601 GTTGCCGACA AACCGAAAAC TGCTGCCGAA AAAACCAAAC CGGATACGGC
 651 AAAATCCGAC AGCGCGGTAA AAGAAGCGAA AAAAGCCGAC AAGGCTGAAG
 701 GCAAAAAGAC AGCCGAAAAA GACCGTTCGG ACGGCAAAAA ACACGAAACG
 751 GCGCAAAAAA CCGACAAAGC GGACAAAACC AAAACCGCCG AGAAGGAAAA
 801 ATCCGGCAAG GCGGGCAAAA AAGCCGCCAT TCAGGCAGGT TATGCCGAAA
 851 AAGAACGCGC CTTGAGCCTC CAGCGCAAAA TGAAGGCGGC GGGTATCGAT
 901 TCGACCATCA CCGAAATCAT GACCGACAAC GGCAAAGTTT ACCGCGTCAA
 951 ATCAAGCAAC TATAAAAACG CAAGGGATGC CGAACGCGAT TTGAACAAAC
1001 TGCGCGTGCA CGGCATCGCC GGCCAGGTAA CGAATGAATA G
```

This corresponds to the amino acid sequence <SEQ ID 2552; ORF 746.ng>:

g746.pep

```
  1 MSENKQNEVL TGYEQLKRRN RRRLVTASSL VAASCILLAA ALSSDPADSN
 51 PAPQAGETGA TESQTANTAQ TPALKSAAEN GETAADKPQD LAGEDKPSAA
101 DSEISEPENV GAPLVLINDR LEDSNIKGLE ESEKLQQAET AKTEPKQAKQ
151 RAAEKVSATA DSTDTVAVEK PKRTAEPKPQ KAERTAEAKP KAKETKTAEK
201 VADKPKTAAE KTKPDTAKSD SAVKEAKKAD KAEGKKTAEK DRSDGKKHET
251 AQKTDKADKT KTAEKEKSGK AGKKAAIQAG YAEKERALSL QRKMKAAGID
301 STITEIMTDN GKVYRVKSSN YKNARDAERD LNKLRVHGIA GQVTNE*
```

The following partial DNA sequence was identified in *N. meningitidis* <SEQ ID 2553>:

m746.seq

```
  1 ATGTCCGAAA ACAAACAAAA CGAAGTCCTG AGCGGTTACG AACAACTCAA
 51 ACGGCGCAAC CGCCGCCGCC TCGTAACGGC AAGTTGCCTG GTTGCCGCCT
101 CCTGCATCCT GCTGGCAGCC GCCCTCAGTT CCGGCCCTGC CGAACAGACT
```

-continued

```
151 GCCGGCGAAA CAAGCGGCGT AGAAAACAAA GCGGCAGGTG CGGCACAAAC
201 CCCTGCCTTG AAATCCGCCG CCGACAAACC GCAGGACTTG GCAGGCGAAG
251 ACAAGCCTTC TGCCGCCGAC AGCGAAATCA GCGAGCCTGA AAACGTAGGC
301 GCGCCGCTGG TGCTGATTAA CGAGCGCCTC GAAGACAGCA ACATCAAAGG
351 TTTGGAAGCA TCCGAGAAAC TGCAACAGGC AGAAACCGCC AAAACCGCAC
401 CGAAGCAGGC AAAACAACGC GCTGCCGAAA AAGTGCCGGC AACTGCCGAC
451 AGTACGGATA CGGTAGCGGT TGAAAAACCG AAACGCACTG CCGAAACAAA
501 ACCGCAAAAA GCGGAACGCA CTGCCAAAGC CAAGCCCAAA GCCAAAGAAA
551 CCAAAACCGC CGAAAAAGTT GCCGACAAAC CGAAAACTGC CGCCGAAAAA
601 ACCAAACCGG ATACGGCAAA ATCCGACAGC GCGGTAAAAG AAGCGAAAAA
651 AGCCGACAAG GCTGAAAGCA AAAAAACAGC CGAAAAAGAC CGTTCGGACG
701 GCAAAAAACA CGAAACGGCA CAAAAAACCG ACAAAGCGGA CAAGACCAAA
751 ACCGCCGAGA AGGAAAAATC CGGTAAAAAA GCCGCCATTC AGGCAGGTTA
801 TGCCGAAAAA GAACGCGCCT TAAGCCTCCA GCGCAAAATG AAGGCGGCGG
851 GTATCGATTC GACCATCACC GAAATTATGA CCGACAACGG CAAAGTTTAC
901 CGCGTCAAAT CAAGCAACTA TAAAAACGCA AGGGATGCCG AACGCGATTT
951 GAACAAATTG CGCGTACACG GTATCGCCGG TCAGGTAACG AATGAATAG
```

This corresponds to the amino acid sequence <SEQ ID 2554: ORF 746>:

m746.pep

```
  1 MSENKQNEVL SGYEQLKRRN RRRLVTASCL VAASCILLAA ALSSGPAEQT
 51 AGETSGVENK AAGAAQTPAL KSAADKPQDL AGEDKPSAAD SEISEPENVG
101 APLVLINERL EDSNIKGLEA SEKLQQAETA KTAPKQAKQR AAEKVPATAD
151 STDTVAVEKP KRTAETKPQK AERTAKAKPK AKETKTAEKV ADKPKTAAEK
201 TKPDTAKSDS AVKEAKKADK AESKKTAEKD RSDGKKHETA QKTDKADKTK
251 TAEKEKSGKK AAIQAGYAEK ERALSLQRKM KAAGIDSTIT EIMTDNGKVY
301 RVKSSNYKNA RDAERDLNKL RVHGIAGQVT NE*
```

Computer analysis of this amino acid sequence gave the following results:

Homology with a predicted ORF from *N. gonorrhoeae*

ORF 746 shows 89.9% identity over a 346 aa overlap with a predicted ORF (ORF 746) from *N. gonorrhoeae:* m746/g746 89.9% identity in 346 aa overlap

```
                      10        20        30        40        50
m746.pep      MSENKQNEVLSGYEQLKRRNRRRLVTASCLVAASCILLAAALSSGPAEQT----AGETSG
              ||||||||||:||||||||||||||||| ||||||||||||||| ||:::    ||||::
g746          MSENKQNEVLTGYEQLKRRNRRRLVTASSLVAASCILLAAALSSDPADSNPAPQAGETGA
                      10        20        30        40        50        60

                60        70               80        90       100      109
m746.pep      VENKAAGAAQTPALKSAA-------DKPQDLAGEDKPSAADSEISEPENVGAPLVLINER
              :|:::|::||||||||||       |||||||||||||||||||||||||||||||||:|
g746          TESQTANTAQTPALKSAAENGETAADKPQDLAGEDKPSAADSEISEPENVGAPLVLINDR
                      70        80        90       100       110       120
```

-continued

```
                110       120       130       140       150       160      169
m746.pep     LEDSNIKGLEASEKLQQAETAKTAPKQAKQRAAEKVPATADSTDTVAVEKPKRTAETKPQ
             ||||||||| ||||||||||| ||||||||||| ||||||||||||||||| |||
g746         LEDSNIKGLEESEKLQQAETAKTEPKQAKQRAAEKVSATADSTDTVAVEKPKRTAEPKPQ
                    130       140       150       160       170       180

                170       180       190       200       210       220      229
m746.pep     KAERTAKAKPKAKETKTAEKVADKPKTAAEKTKPDTAKSDSAVKEAKKADKAESKKTAEK
             ||||||:||||||||||||||||||||||||||||||||||||||||||||:||||||
g746         KAERTAEAKPKAKETKTAEKVADKPKTAAEKTKPDTAKSDSAVKEAKKADKAEGKKTAEK
                    190       200       210       220       230       240

                230       240       250        260       270       280
m746.pep     DRSDGKKHETAQKTDKADKTKTAEKEKSGK---KAAIQAGYAEKERALSLQRKMKAAGID
             ||||||||||||||||||||||||||||||   ||||||||||||||||||||||||||
g746         DRSDGKKHETAQKTDKADKTKTAEKEKSGKAGKKAAIQAGYAEKERALSLQRKMKAAGID
                    250       260       270       280       290       300

                  290       300       310       320       330
m746.pep     STITEIMTDNGKVYRVKSSNYKNARDAERDLNKLRVHGIAGQVTNEX
             ||||||||||||||||||||||||||||||||||||||||||||||
g746         STITEIMTDNGKVYRVKSSNYKNARDAERDLNKLRVHGIAGQVTNEX
                    310       320       330       340
```

The following partial DNA sequence was identified in *N. meningitidis* <SEQ ID 2555>:

a746.seq

```
  1 ATGTCCGAAA ACAAACAAAA CGAAGTCCTG AGCGGTTACG AACAACTCAA
 51 ACGGCGCAAC CGCCGCCGCC TCGTAACGGC AAGTTGCCTG GTTGCCGCCT
101 CCTGCATCCT GCTGGCAGCC GCCCTCAGTT CCGGCCCTGC CGAACAGACT
151 GCCGGCGAAA CAAGCGGCGT AGAAAACAAA GCGGCAGGTG CGGCACAAAC
201 CCCTGCCTTG AAATCCGCCG CCGACAAACC GCAGGACTTG GCAGGCGAAG
251 ACAAGCCTTC TGCCGCCGAC AGCGAAATCA GCGAGCCTGA AAACGTAGGC
301 GCGCCGCTGG TGCTGATTAA CGACCGCCTC GAAGACAGCA ACATCAAAGG
351 TTTGGAAGCA TCCGAGAAAC TGCAACAGGC AGAAACCGCC AAAACCGCAC
401 CGAAGCAGGC AAAACAACGC GCTGCCGAAA AAGTGCCGGC AACTGCCGAC
451 AGTACGGATA CGGTAGCGGT TGAAAAACCG AAACGCACTG CCGAAACAAA
501 ACCGCAAAAA GCGGAACGCA CTGCCAAAGC CAAGCCCAAA GCCAAAGAAA
551 CCAAAACCGC CGAAAAAGTT GCCGACAAAC CGAAAACTGC CGCCGAAAAA
601 ACCAAACCGG ATACGGCAAA ATCCGACAGC GCGGTAAAAG AAGCGAAAAA
651 AGCCGACAAG GCTGAAAGCA AAAAAACAGC CGAAAAAGAC CGTTCGGACG
701 GCAAAAAACA CGAAACGGCA CAAAAAACCG ACAAAGCGGA CAAGACCAAA
751 ACCGCCGAGA AGGAAAAATC CGGTAAAAAA GCCGCCATTC AGGCAGGTTA
801 TGCCGAAAAA GAACGCGCCT TAAGCCTCCA GCGCAAAATG AAGGCGGCGG
851 GTATCGATTC GACCATCACC GAAATTATGA CCGACAACGG CAAAGTTTAC
901 CGCGTCAAAT CAAGCAACTA TAAAAACGCA AGGGATGCCG AACGCGATTT
951 GAACAAATTG CGCGTACACG GTATCGCCGG TCAGGTAACG AATGAATAA
```

This corresponds to the amino acid sequence <SEQ ID 2556; ORF 746.a>:

a746.pep

```
  1 MSENKQNEVL SGYEQLKRRN RRRLVTASCL VAASCILLAA ALSSGPAEQT
 51 AGETSGVENK AAGAAQTPAL KSAADKPQDL AGEDKPSAAD SEISEPENVG
```

-continued

```
101 APLVLINDRL EDSNIKGLEA SEKLQQAETA KTAPKQAKQR AAEKVPATAD

151 STDTVAVEKP KRTAETKPQK AERTAKAKPK AKETKTAEKV ADKPKTAAEK

201 TKPDTAKSDS AVKEAKKADK AESKKTAEKD RSDGKKHETA QKTDKADKTK

251 TAEKEKSGKK AAIQAGYAEK ERALSLQRKM KAAGIDSTIT EIMTDNGKVY

301 RVKSSNYKNA RDAERDLNKL RVHGIAGQVT NE*
```

Computer analysis of this amino acid sequence gave the following results:

Homology with a predicted ORF from *N. meningitidis*

ORF 746 shows 99.7% identity over a 332 aa overlap with a predicted ORF (ORF 746) from *N. meningitidis:* a746/m746; 99.7% identity in 332 aa overlap

```
                10        20        30        40        50        60
a746.pep    MSENKQNEVLSGYEQLKRRNRRRLVTASCLVAASCILLAAALSSGPAEQTAGETSGVENK
            ||||||||||||||||||||||||||||||||||||||||||||||||||||||||||||
m746        MSENKQNEVLSGYEQLKRRNRRRLVTASCLVAASCILLAAALSSGPAEQTAGETSGVENK
                10        20        30        40        50        60

                70        80        90       100       110       120
a746.pep    AAGAAQTPALKSAADKPQDLAGEDKPSAADSEISEPENVGAPLVLINDRLEDSNIKGLEA
            |||||||||||||||||||||||||||||||||||||||||||||||:||||||||||||
m746        AAGAAQTPALKSAADKPQDLAGEDKPSAADSEISEPENVGAPLVLINERLEDSNIKGLEA
                70        80        90       100       110       120

                130       140       150       160       170       180
a746.pep    SEKLQQAETAKTAPKQAKQRAAEKVPATADSTDTVAVEKPKRTAETKPQKAERTAKAKPK
            ||||||||||||||||||||||||||||||||||||||||||||||||||||||||||||
m746        SEKLQQAETAKTAPKQAKQRAAEKVPATADSTDTVAVEKPKRTAETKPQKAERTAKAKPK
                130       140       150       160       170       180

                190       200       210       220       230       240
a746.pep    AKETKTAEKVADKPKTAAEKTKPDTAKSDSAVKEAKKADKAESKKTAEKDRSDGKKHETA
            ||||||||||||||||||||||||||||||||||||||||||||||||||||||||||||
m746        AKETKTAEKVADKPKTAAEKTKPDTAKSDSAVKEAKKADKAESKKTAEKDRSDGKKHETA
                190       200       210       220       230       240

                250       260       270       280       290       300
a746.pep    QKTDKADKTKTAEKEKSGKKAAIQAGYAEKERALSLQRKMKAAGIDSTITEIMTDNGKVY
            ||||||||||||||||||||||||||||||||||||||||||||||||||||||||||||
m746        QKTDKADKTKTAEKEKSGKKAAIQAGYAEKERALSLQRKMKAAGIDSTITEIMTDNGKVY
                250       260       270       280       290       300

                310       320       330
a746.pep    RVKSSNYKNARDAERDLNKLRVHGIAGQVTNEX
            |||||||||||||||||||||||||||||||||
m746        RVKSSNYKNARDAERDLNKLRVHGIAGQVTNEX
                310       320       330
```

g747.seq not found yet g747.pep not found yet

The following partial DNA sequence was identified in *N. meningitidis* <SEQ ID 2557>:

m747.seq

```
  1 CTGACCCCTT GGGCGGATGC ATATGCAGAT TTGCGCGGCA AAACCAAAGT

 51 GATGACGACC CAGATGGGTG CTTCCCGCGA TGTCAGCAAA AGCGCCAAAG

101 GTTGGAGTGT CGGTATCGGT CTGAATGTAG GCAAACAGTT GACCGACAGC

151 GTCGGTCTCG AGTTTGATCC ATACTACCGT CACAAAACAA TCTACAAACC

201 CCGTGAGATT GTCTTGGACG GTGACAAAAC CAAAATGGGC CGCTCCAAAT

251 CCAACGAGTA CGGCTTCCGC GTAGCCGCAA CGTTCTATAG TCAATTAAAA

301 TCAAAATAG
```

This corresponds to the amino acid sequence <SEQ ID 2558; ORF 747>:

m747.pep

```
  1 LTPWADAYAD LRGKTKVMTT QMGASRDVSK SAKGWSVGIG LNVGKQLTDS
 51 VGLEFDPYYR HKTIYKPREI VLDGDKTKMG RSKSNEYGFR VAATFYSQLK
101 SK*
```

The following partial DNA sequence was identified in *N. meningitidis* <SEQ ID 2559>:

a747.seq

```
  1 CTAACCCCTT GGGCGGATGC ATATGCAGAT TTGCGCGGCA AAACCAAAGT
 51 GATGACGACC CAGATGTGTG CTTCCCGCGA TGTCAGCAAA AGCGCCAAAG
101 GTTGGAGTGT CGGTATCGGT CTGAATGTAG GCAAACAGTT GACCGACAGC
151 GTCGGTCTCG AGTTTGATCC ATACTACCGT CACAAAACAA TCTGCAAACC
201 CCGTGAGATT GTTTTGGACG GCGACAAAAC CAAAATGGGC CGCTCCAAAT
251 CCAACGAGTA CGGCTTCCGC GTAACCGCAA CGTTCTATAG TCAATTAAAA
301 TCAAAGTAG
```

This corresponds to the amino acid sequence <SEQ ID 2560; ORF 747.a>:

a747.pep

```
  1 LTPWADAYAD LRGKTKVMTT QMCASRDVSK SAKGWSVGIG LNVGKQLTDS
 51 VGLEFDPYYR HKTICKPREI VLDGDKTKMG RSKSNEYGFR VTATFYSQLK
101 SK*
```

Computer analysis of this amino acid sequence gave the following results:

Homology with a predicted ORF from *N. meningitidis*

ORF 747 shows 97.1% identity over a 102 aa overlap with a predicted ORF (ORF 746) from *N. meningitidis:* a747/m747 97.1% identity in 102 aa overlap

```
                    10        20        30        40        50        60
a747.pep    LTPWADAYADLRGKTKVMTTQMCASRDVSKSAKGWSVGIGLNVGKQLTDSVGLEFDPYYR
            |||||||||||||||||||||| |||||||||||||||||||||||||||||||||||||
m747        LTPWADAYADLRGKTKVMTTQMGASRDVSKSAKGWSVGIGLNVGKQLTDSVGLEFDPYYR
                    10        20        30        40        50        60

                    70        80        90       100
a747.pep    HKTICKPREIVLDGDKTKMGRSKSNEYGFRVTATFYSQLKSKX
            |||| |||||||||||||||||||||||||:||||||||||||
m747        HKTIYKPREIVLDGDKTKMGRSKSNEYGFRVAATFYSQLKSKX
                    70        80        90       100
```

a747/m80195 gi|150271 (M80195) outer membrane protein [*Neisseria meningitidis*] Length=272
Score=59.3 bits (141), Expect=6e-09
Identities=29/99 (29%), Positives=51/99 (51%), Gaps=4/99 (4%)

```
Query:   1 LTPWADAYADLRGKTKVMTTQMCASRDVSKSAKGWSVGIGLNVGKQLTDSVGLEFDPYYR  60
             + PW++   DL   + K+ T       +D+++    GW   G+G N+GK+L +S   +E   P+Y+
Sbjct: 174 INPWSEVKFDLNSRYKLNTGVTNLKKDINQKTNGWGFGLGANIGKKLGESASIEAGPFYK 233

Query:  61 HKTICKPREIVL---DGD-KTKMGRSKSNEYGFRVTATF                      95
              +T   +   E   +     GD     + ++     EYG RV    F
Sbjct: 234 QRTYKESGEFSVTTKSGDVSLTIPKTSIREYGLRVGIKF                      272
```

The following partial DNA sequence was identified in *N. gonorrhoeae* <SEQ ID 2561>:

g748.seq

```
   1 ATGAGTCAAA ACCAACCCGC ACAACCGACC AAACGCAATC TGTTCAAAAC
  51 CGCCCTTGCC GTCGGCGCAA TCGGCGCAAT CGGAGGTTAT TTCGGCGGCA
 101 AAAAACAGGG CGAAACCGCC GAACGCACCG CCGAAAGCCA ACACTCGCCC
 151 CAAGCCTATC CCTGCTACGG CGAACATCAG GCAGGTATCG TTACGCCGCG
 201 GCAGGCGTTT TCCATTATGT GCGCCTTCGA CGTAACCGCG CAAAGTGCCA
 251 AGCAGCTGGA AAACCTGTTC CGCACACTGA CCGCCCGCAT CGAGTTTCTC
 301 ACCCAAGGCG GAGAATACCA AGACGGCGAC GACAAACTCC CGTCAGCCGG
 351 CAGCGGCATT TTGGGTAAAG CCTTCAACCC CGACGGATTG ACCGTTACCG
 401 TGGGGGTGGG CAGCAGCCTG TTTGACGGCC GGTTCGGACT CAAAGACAAA
 451 AAAACGGTTC ATTTGCAGGA AATGCGCGAC TTCCCCAACG ATAAGCTGCA
 501 AAAAAGCTGG TGCGACGGCG ATTTGAGCCT GCAAATCTGC GCCTTCACCC
 551 CCGAAACCTG CCAAACCGCC CTGCGCGACA TCATCAAACA CACCGCCCAA
 601 ACCGCCGTCA TCCGCTGGAG TATCGACGGG TGGCAGCCTA AATCCGAACC
 651 CGGCGCGATG GCGGCGCGCA ACCTGTTGGG CTTCCGAGAC GGCACGGGCA
 701 ACCCCAAGGT TTCCGATCCC AAAACCGCCG ACGAGGTTTT ATGGACGGGC
 751 GTGGCCGCCA ACAGCCTCGA CGAACCGGAG TGGGCGAAAA ACGGCAGCTA
 801 TCAGGCAGTC CGCCTTATCC GCCGCTTTGT CGAGTTTTGG GACAGGACGC
 851 CGCTTCAAGA GCAAACCGAC ATTTTCGGGC GGCGAAAATA CAGCGGGGCG
 901 CCGATGGACG GCAAAAAAGA AGCCGACCAA CCGGATTTCG CCAAAGACCC
 951 CGAGGGTGAT ATCACGCCCA AAGACAGCCA TATGCGCCTG GCGAATCCGC
1001 GCGATCCCGA ATTCCTCAAA AAACACTGCC TCTTCCGCCG CGCCTACAGC
1051 TATTCTCGCG GACCCGCCTC AAGCGGACAG CTTGATGTCG GGCTGGTGTT
1101 CGTCTGCTAT CAGGCAAATC TTGCCGACGG TTTCATCTTC GTGCAAAACC
1151 TCCTCAACGG CGAACCGCTG GAAGAATACA TCAGCCCCTT CGGCGGCGGC
1201 TATTTCTTCG TCTTGCCCGG CGTGGGAAAA GGCGGATTCT TGGGACAAGG
1251 GCTGCCGGGC GTATAA
```

This corresponds to the amino acid sequence <SEQ ID 2562; ORF 748.ng>:

g748.pep

```
  1 MSQNQPAQPT KRNLFKTALA VGAIGAIGGY FGGKKQGETA ERTAESQHSP
 51 QAYPCYGEHQ AGIVTPRQAF SIMCAFDVTA QSAKQLENLF RTLTARIEFL
101 TQGGEYQDGD DKLPSAGSGI LGKAFNPDGL TVTVGVGSSL FDGRFGLKDK
151 KTVHLQEMRD FPNDKLQKSW CDGDLSLQIC AFTPETCQTA LRDIIKHTAQ
201 TAVIRWSIDG WQPKSEPGAM AARNLLGFRD GTGNPKVSDP KTADEVLWTG
251 VAANSLDEPE WAKNGSYQAV RLIRRFVEFW DRTPLQEQTD IFGRRKYSGA
301 PMDGKKEADQ PDFAKDPEGD ITPKDSHMRL ANPRDPEFLK KHCLFRRAYS
351 YSRGPASSGQ LDVGLVFVCY QANLADGFIF VQNLLNGEPL EEYISPFGGG
401 YFFVLPGVGK GGFLGQGLPG V*
```

The following partial DNA sequence was identified in *N. meningitidis* <SEQ ID 2563>:

m748.seq

```
   1 ATGAGCAAAA AACAACCCGC ACAACCGACC AGGCGCACTC TTTTTAAAAC
  51 CGCGATCGCA GCCGGAGCAG TCGGCGCAAT CGGAGGTTAT CTCGGCGGCA
 101 AAAAACAGGG CGAAACCGCC GAACGCACCG CCGAAAGCCA ACACTCGCCC
 151 CAAGCCTATC CCTGCTACGG CGAACATCAG GCAGGCATCG TTACGCCGCA
 201 GCAGGCGTTT TCGATTATGT GCGCCTTCGA CGTAACCGCG CAAAGTGCCA
 251 AGCAGCTGGA AAACCTGTTC CGCACGCTGA CCGCCCGCAT CGAGTTTCTC
 301 ACCCAAGGCG GCGAATACCA AGACGGCGAC GACAAACTTC CGCCAGCCGG
 351 CAGCGGCATT TTGGGCAAAG CCTTCAACCC CGACGGGTTG ACCGTTACCG
 401 TGGGGGTGGG CAGCAGCCTG TTTGACGGCC GGTTCGGACT CAAAGACAAA
 451 AAACCGATTC ATTTGCAGGA AATGCGCGAC TTCTCCAACG ATAAGCTGCA
 501 AAAAAGCTGG TGCGACGGCG ATTTGAGCCT GCAAATCTGT GCCTTCACCC
 551 CCGAAACCTG CCAAGCCGCC CTGCGCGACA TCATCAAACA CACCGTCCAA
 601 ACCGCCGTTA TCCGTTGGAG TATCGACGGG TGGCAGCCCA AATCCGAACC
 651 CGGCGCGATG GCGGCGCGCA ACCTGTTGGG CTTCAGGGAC GGCACGGGCA
 701 ACCCCAAAGT TTCCGATCCC AAAACTGCCG ACGAGGTTTT GTGGACGGGG
 751 GTGGCCGCCA ACAGCCTCGA CGAACCGGAG TGGGCGAAAA ACGGCAGCTA
 801 TCAGGCAGTC CGCCTTATCC GCCACTTTGT CGAGTTTTGG GACAGGACGC
 851 CGCTTCAAGA GCAAACCGAC ATTTTCGGGC GGCGCAAATA CAGCGGTGCG
 901 CCGATGGACG GCAAAAAAGA AGCCGACCAA CCGGATTTTG CCAAAGACCC
 951 CGAGGGTGAT ATCACGCCCA AAGACAGCCA TATACGCCTG GCGAATCCGC
1001 GCGATCCCGA ATTCCTCAAA AAACACCGCC TCTTCCGCCG CGCCTACAGC
1051 TATTCGCGCG GACTCGCCTC AAGCGGACAG CTTGATGTCG GGCTGGTGTT
1101 CGTCTGCTAT CAGGCAAACC TTGCCGACGG ATTCATCTTC GTGCAAAACC
1151 TCCTCAACGG CGAACCGCTG GAAGAATACA TCAGCCCCTT CGGCGGCGGC
1201 TATTTCTTCG TCTTGCCCGG CGTGGAAAAA GGCGGCTTTT TGGGGCAAGG
1251 GCTGCTGGGC GTATAA
```

This corresponds to the amino acid sequence <SEQ ID 2564; ORF 748>:

m748.pep

```
  1 MSKKQPAQPT RRTLFKTAIA AGAVGAIGGY LGGKKQGETA ERTAESQHSP

 51 QAYPCYGEHQ AGIVTPQQAF SIMCAFDVTA QSAKQLENLF RTLTARIEFL

101 TQGGEYQDGD DKLPPAGSGI LGKAFNPDGL TVTVGVGSSL FDGRFGLKDK

151 KPIHLQEMRD FSNDKLQKSW CDGDLSLQIC AFTPETCQAA LRDIIKHTVQ

201 TAVIRWSIDG WQPKSEPGAM AARNLLGFRD GTGNPKVSDP KTADEVLWTG

251 VAANSLDEPE WAKNGSYQAV RLIRHFVEFW DRTPLQEQTD IFGRRKYSGA

301 PMDGKKEADQ PDFAKDPEGD ITPKDSHIRL ANPRDPEFLK KHRLFRRAYS

351 YSRGLASSGQ LDVGLVFVCY QANLADGFIF VQNLLNGEPL EEYISPFGGG

401 YFFVLPGVEK GGFLGQGLLG V*
```

Computer analysis of this amino acid sequence gave the following results:

Homology with a predicted ORF from *N. gonorrhoeae*

ORF 748 shows 95.0% identity over a 421 aa overlap with a predicted ORF (ORF 748) from *N. gonorrhoeae* m748/g748 95.0% identity in 421 aa overlap

```
                     10        20        30        40        50        60
m748.pep     MSKKQPAQPTRRTLFKTAIAAGAVGAIGGYLGGKKQGETAERTAESQHSPQAYPCYGEHQ
             ||::||||||:|:|||||:|:||:||||||:|||||||||||||||||||||||||||||
g748         MSQNQPAQPTKRNLFKTALAVGAIGAIGGYFGGKKQGETAERTAESQHSPQAYPCYGEHQ
                     10        20        30        40        50        60

                     70        80        90       100       110       120
m748.pep     AGIVTPQQAFSIMCAFDVTAQSAKQLENLFRTLTARIEFLTQGGEYQDGDDKLPPAGSGI
             ||||||:||||||||||||||||||||||||||||||||||||||||||||||| |||||
g748         AGIVTPRQAFSIMCAFDVTAQSAKQLENLFRTLTARIEFLTQGGEYQDGDDKLPSAGSGI
                     70        80        90       100       110       120

                     130       140       150       160       170       180
m748.pep      LGKAFNPDGLTVTVGVGSSLFDGRFGLKDKKPIHLQEMRDFSNDKLQKSWCDGDLSLQIC
              ||||||||||||||||||||||||||||||| :|||||||| ||||||||||||||||||
g748          LGKAFNPDGLTVTVGVGSSLFDGRFGLKDKKTVHLQEMRDFPNDKLQKSWCDGDLSLQIC
                     130       140       150       160       170       180

                     190       200       210       220       230       240
m748.pep      AFTPETCQAALRDIIKHTVQTAVIRWSIDGWQPKSEPGAMAARNLLGFRDGTGNPKVSDP
              ||||||||:|||||||||:|||||||||||||||||||||||||||||||||||||||||
g748          AFTPETCQTALRDIIKHTAQTAVIRWSIDGWQPKSEPGAMAARNLLGFRDGTGNPKVSDP
                     190       200       210       220       230       240

                     250       260       270       280       290       300
m748.pep      KTADEVLWTGVAANSLDEPENAKNGSYQAVRLIRHFVEFWDRTPLQEQTDIFGRRKYSGA
              ||||||||||||||||||||||||||||||||||:|||||||||||||||||||||||||
g748          KTADEVLWTGVAANSLDEPENAKNGSYQAVRLIRRFVEFWDRTPLQEQTDIFGRRKYSGA
                     250       260       270       280       290       300

                     310       320       330       340       350       360
m748.pep      PMDGKKEADQPDFAKDPEGDITPKDSHIRLANPRDPEFLKKHRLFRRAYSYSRGLASSGQ
              |||||||||||||||||||||||||||:|||||||||||||| ||||||||||| |||||
g748          PMDGKKEADQPDFAKDPEGDITPKDSHMRLANPRDPEFLKKHCLFRRAYSYSRGPASSGQ
                     310       320       330       340       350       360

                     370       380       390       400       410       420
m748.pep      LDVGLVFVCYQANLADGFIFVQNLLNGEPLEEYISPFGGGYFFVLPGVEKGGFLGQGLLG
              |||||||||||||||||||||||||||||||||||||||||||||||| ||||||||| |
g748          LDVGLVFVCYQANLADGFIFVQNLLNGEPLEEYISPFGGGYFFVLPGVGKGGFLGQGLPG
                     370       380       390       400       410       420

m748.pep      VX
              ||
g748          VX
```

The following partial DNA sequence was identified in *N. meningitidis* <SEQ ID 2565>:

a748.seq

```
   1 ATGAGCAAAA ACCAACCCGC ACAACCGACC AGGCGCACTC TTTTTAAAAC
  51 CGCGATCGCA GCTGGAGCAG TCGGCGCAAT CGGAGGTTAT CTCGGCGGCA
 101 AAAAACGGGG CGAAACCGCC GAACGCACCG CCGAAAGCCA ACACTCGCCC
 151 CAAGCCTATC CCTGCTACGG CGAACATCAG GCAGGCATCG TTACGCCGCA
 201 GCAGGCGTTT TCGATTATGT GCGCCTTCGA CGTAACCGCG CAAAGTGCCA
 251 AGCAGCTGGA AAACCTGTTC CGCACGCTGA CCGCCCGCAT CGAGTTTCTC
 301 ACCCAAGGCG GCGAATACCA AGACGGCGAC GACAAACTTC CGCCAGCCGG
 351 CAGCGGCATT TTGGGCAAAG CCTTCAACCC CGACGGGTTG ACCGTTACCG
 401 TGGGGGTGGG CAGCAGCCTG TTTGACGGCC GGTTCGGACT CAAAGACAAA
 451 AAACCGATTC ATTTGCAGGA AATGCGCGAC TTCTCCAACG ATAAGCTGCA
 501 AAAAAGCTGG TGCGACGGCG ATTTGAGCCT GCAAATCTGT GCCTTCACCC
 551 CCGAAACCTG CCAAGCCGCC CTGCGCGACA TCATCAAACA CACCGTCCAA
 601 ACCGCCGTTA TCCGCTGGAG TATCGACGGG TGGCAGCCTA AATCCGAACC
 651 CGGCGCGATG GCGGCGCGCA ACCTGTTGGG CTTCCGCGAC GGCACGGGCA
 701 ACCCCAAAGT TTCCGACCCC AAAACTGCCG ACGAGGTTTT GTGGACGGGG
 751 GTGGCCGCCA ACAGCCTCGA CGAACCGGAG TGGGCGAAAA ACGGCAGCTA
 801 TCAGGCAGTC CGCCTTATCC GCCACTTTGT TGAGTTTTGG GACAGGACGC
 851 CGCTTCAAGA GCAAACCGAC ATTTTCGGGC GGCGCAAATA CAGCGGCGCG
 901 CCGATGGACG GCAAAAAAGA AGCCGACCAA CCGGATTTTG CCAAAGACCC
 951 CGAGGGGAAT ACCACGCCCA AAGACAGCCA TATACGCCTG GCGAATCCGC
1001 GCGATCCCGA GTTCCTTAAA AAACACCGCC TCTTCCGCCG CGCCTACAGC
1051 TATTCGCGCG GACTCGCCTC AAGCGGACAG CTTGATGTCG GGCTGGTGTT
1101 CGTCTGCTAT CAGGCAAACC TTGCCGACGG ATTCATCTTC GTGCAAAACC
1151 TCCTCAACGG CGAACCGCTG GAAGAATACA TCAGCCCCTT CGGCGGCGGC
1201 TATTTCTTCG TCTTGCCCGG CGTGGAAAAA GGCGGCTTTT TGGGGCAAGG
1251 GCTGCTGGGC GTATAA
```

This corresponds to the amino acid sequence <SEQ ID 2566; ORF 748.a>:

a748.pep

```
   1 MSKNQPAQPT RRTLFKTAIA AGAVGAIGGY LGGKKRGETA ERTAESQHSP
  51 QAYPCYGEHQ AGIVTPQQAF SIMCAFDVTA QSAKQLENLF RTLTARIEFL
 101 TQGGEYQDGD DKLPPAGSGI LGKAFNPDGL TVTVGVGSSL FDGRFGLKDK
 151 KPIHLQEMRD FSNDKLQKSW CDGDLSLQIC AFTPETCQAA LRDIIKHTVQ
 201 TAVIRWSIDG WQPKSEPGAM AARNLLGFRD GTGNPKVSDP KTADEVLWTG
 251 VAANSLDEPE WAKNGSYQAV RLIRHFVEFW DRTPLQEQTD IFGRRKYSGA
 301 PMDGKKEADQ PDFAKDPEGN TTPKDSHIRL ANPRDPEFLK KHRLFRRAYS
 351 YSRGLASSGQ LDVGLVFVCY QANLADGFIF VQNLLNGEPL EEYISPFGGG
 401 YFFVLPGVEK GGFLGQGLLG V*
```

Computer analysis of this amino acid sequence gave the following results:

Homology with a predicted ORF from *N meningitidis*

ORF 748 shows 99.0% identity over a 421 aa overlap with a predicted ORF (ORF 748) from *N. meningitidis:* a748/m748 99.0% identity in 421 aa overlap

```
                    10        20        30        40        50        60
a748.pep    MSKNQPAQPTRRTLFKTAIAAGAVGAIGGYLGGKKRGETAERTAESQHSPQAYPCYGEHQ
            |||:|||||||||||||||||||||||||||||||:||||||||||||||||||||||||
m748        MSKKQPAQPTRRTLFKTAIAAGAVGAIGGYLGGKKQGETAERTAESQHSPQAYPCYGEHQ
                    10        20        30        40        50        60

                    70        80        90       100       110       120
a748.pep    AGIVTPQQAFSIMCAFDVTAQSAKQLENLFRTLTARIEFLTQGGEYQDGDDKLPPAGSGI
            ||||||||||||||||||||||||||||||||||||||||||||||||||||||||||||
m748        AGIVTPQQAFSIMCAFDVTAQSAKQLENLFRTLTARIEFLTQGGEYQDGDDKLPPAGSGI
                    70        80        90       100       110       120

                   130       140       150       160       170       180
a748.pep    LGKAFNPDGLTVTVGVGSSLFDGRFGLKDKKPIHLQEMRDFSNDKLQKSWCDGDLSLQIC
            ||||||||||||||||||||||||||||||||||||||||||||||||||||||||||||
m748        LGKAFNPDGLTVTVGVGSSLFDGRFGLKDKKPIHLQEMRDFSNDKLQKSWCDGDLSLQIC
                   130       140       150       160       170       180

                   190       200       210       220       230       240
a748.pep    AFTPETCQAALRDIIKHTVQTAVIRWSIDGWQPKSEPGAMAARNLLGFRDGTGNPKVSDP
            ||||||||||||||||||||||||||||||||||||||||||||||||||||||||||||
m748        AFTPETCQAALRDIIKHTVQTAVIRWSIDGWQPKSEPGAMAARNLLGFRDGTGNPKVSDP
                   190       200       210       220       230       240

                   250       260       270       280       290       300
a748.pep    KTADEVLWTGVAANSLDEPEWAKNGSYQAVRLIRHFVEFWDRTPLQEQTDIFGRRKYSGA
            ||||||||||||||||||||||||||||||||||||||||||||||||||||||||||||
m748        KTADEVLWTGVAANSLDEPEWAKNGSYQAVRLIRHFVEFWDRTPLQEQTDIFGRRKYSGA
                   250       260       270       280       290       300

                   310       320       330       340       350       360
a748.pep    PMDGKKEADQPDFAKDPEGNTTPKDSHIRLANPRDPEFLKKHRLFRRAYSYSRGLASSGQ
            |||||||||||||||||||: |||||||||||||||||||||||||||||||||||||||
m748        PMDGKKEADQPDFAKDPEGDITPKDSHIRLANPRDPEFLKKHRLFRRAYSYSRGLASSGQ
                   310       320       330       340       350       360

                   370       380       390       400       410       420
a748.pep    LDVGLVFVCYQANLADGFIFVQNLLNGEPLEEYISPFGGGYFFVLPGVEKGGFLGQGLLG
            ||||||||||||||||||||||||||||||||||||||||||||||||||||||||||||
m748        LDVGLVFVCYQANLADGFIFVQNLLNGEPLEEYISPFGGGYFFVLPGVEKGGFLGQGLLG
                   370       380       390       400       410       420

a748.pep    VX
            ||
m748        VX
```

The following partial DNA sequence was identified in *N. gonorrhoeae* <SEQ ID 2567>:

<u>g749.seq</u>

```
  1 ATGAGAAAAT TCAATTTGAC CGCATTGTCC GTGATGCTTG CCTTGGGTTT
 51 GACCGCGTGC CAGCCGCCGG AGGCGGAGAA AGCCGCGCCG GCCGCGTCCG
101 GTGAGACCCA ATCCGCCAAC GAAGGCGGTT CGGTCGGTAT CGCCGTCAAC
151 GACAATGCCT GCGAACCGAT GAATCTGACC GTGCCGAGCG GACAGGTTGT
201 GTTCAATATT AAAAACAACA GCGGCCGCAA GCTCGAATGG GAAATCCTGA
251 AGGGCGTGAT GGTGGTGGAC GAACGCGAAA ATATCGCCCC GGGGCTTTCC
301 GACAAAATGA CCGTAAccct GCTGCCGGGC GAATACGAAA TGACCTGCGG
351 CCTTTTGACC AATCCGCGCG GCAAGCTGGT GGTAGCCGAC AGCGGCTTTA
401 AAGACACCGC CAACGAAGCG GATTTGGAAA AACTGCCCCA ACCGCTCGCC
451 GACTATAAAG CCTACGTTCA AGGCGAGGTT AAAGAGCTGG CGGCGAAAAC
501 CAAAACCTTT ACCGAAGCCG TCAAAGCAGG CGACATTGAA AAGGCGAAAT
```

-continued

```
 551 CCCTGTTTGC CGCCACCCGC GTCCATTACG AACGCATCGA ACCGATTGCC
 601 GAGCTTTTCA GCGAACTCGA CCCCGTCATC GATGCGTGTG AAGACGACTT
 651 CAAAGACGGT GCGAAAGATG CCGGGTTTAC CGGCTTCCAC CGTATCGAAC
 701 ACGCCCTTTG GGTGGAAAAA GACGTATCCG GCGTGAAGGA AACCGCGGCC
 751 AAACTGATGA CCGATGTCGA AGCCCTGCAA AAAGAAATCG ACGCATTGGC
 801 GttccctCCG GGCAAAGTGG TCGGCGGCGC GTCCGAACTG ATTGAAGAAG
 851 CGGCGGGCAG TAAAATCAGC GGCGAAGAAG ACCgttaCAG CCACACCGAT
 901 TTGAGCGACT TCCAAGCTAA TGCGGACGGA TCTAAAAAAA TCGTCGATTT
 951 GTTCCGTCCG TTGATTGAGG CCAAAAACAA AGCCTTGTTG GAAAAAACCG
1001 ATACCAACTT CAAACAGGTC AACGAAATTC TGGCGAAATA CCGCACCAAA
1051 GACGGTTTTG AAACCTACGA CAAGCTGAGC GAAGCCGACC GCAAAGCATT
1101 ACAGGCTCCT ATTAACGCGC TTGCCGAAGA CCTTGCCCAA CTTCGCGGCA
1151 TACTCGGCTT GAAATAA
```

This corresponds to the amino acid sequence <SEQ ID 2568; ORF 749.ng>:

g749.pep

```
  1 MRKFNLTALS VMLALGLTAC QPPEAEKAAP AASGETQSAN EGGSVGIAVN
 51 DNACEPMNLT VPSGQVVFNI KNNSGRKLEW EILKGVMVVD ERENIAPGLS
101 DKMTVTLLPG EYEMTCGLLT NPRGKLVVAD SGFKDTANEA DLEKLPQPLA
151 DYKAYVQGEV KELAAKTKTF TEAVKAGDIE KAKSLFAATR VHYERIEPIA
201 ELFSELDPVI DACEDDFKDG AKDAGFTGFH RIEHALWVEK DVSGVKETAA
251 KLMTDVEALQ KEIDALAFPP GKVVGGASEL IEEAAGSKIS GEEDRYSHTD
301 LSDFQANADG SKKIVDLFRP LIEAKNKALL EKTDTNFKQV NEILAKYRTK
351 DGFETYDKLS EADRKALQAP INALAEDLAQ LRGILGLK*
```

The following partial DNA sequence was identified in *N. meningitidis* <SEQ ID 2569>:

m749.seq

```
  1 ATGAGAAAAT TCAATTTGAC CGCATTGTCC GTGATGCTTG CCTTAGGTTT
 51 GACCGCGTGC CAGCCGCCGG AGGCGGAGAA AGCTGCGCCG GCAGCGTCCG
101 GTGAGGCGCA AACCGCCAAC GAGGGCGGTT CGGTCAGTAT CGCCGTCAAC
151 GACAATGCCT GCGAACCGAT GGAACTGACC GTGCCGAGCG GACAGGTTGT
201 GTTCAATATT AAAAACAACA GCGGCCGCAA GCTCGAATGG GAAATCCTGA
251 AAGGCGTGAT GGTGGTGGAC GAGCGCGAAA ACATCGCCCC CGGACTTTCC
301 GATAAAATGA CCGTCACCCT GTTGCCGGGC GAATACGAAA TGACTTGCGG
351 TCTTTTGACC AATCCGCGCG GCAAGCTGGT GGTAACCGAC AGCGGCTTTA
401 AAGACACCGC CAACGAAGCG GATTTGGAAA AACTGTCCCA ACCGCTCGCC
451 GACTATAAAG CCTACGTTCA AGGCGAGGTT AAAGAGCTGG TGGCGAAAAC
501 CAAAACTTTT ACCGAAGCCG TCAAAGCAGG CGACATTGAA AAGGCGAAAT
```

-continued

```
 551 CCCTGTTTGC CGACACCCGC GTCCATTACG AACGCATCGA ACCGATTGCC

 601 GAGCTTTTCA GCGAACTCGA CCCCGTCATC GATGCGCGTG AAGACGACTT

 651 CAAAGACGGC GCGAAAGATG CCGGATTTAC CGGCTTTCAC CGTATCGAAT

 701 ACGCCCTTTG GGTGGAAAAA GACGTGTCCG GCGTGAAGGA AATTGCAGCG

 751 AAACTGATGA CCGATGTCGA AGCCCTGCAA AAAGAAATCG ACGCATTGGC

 801 GTTTCCTCCG GGCAAGGTGG TCGGCGGCGC GTCCGAACTG ATTGAAGAAG

 851 TGGCGGGCAG TAAAATCAGC GGCGAAGAAG ACCGGTACAG CCACACCGAT

 901 TTGAGCGACT TCCAAGCCAA TGTGGACGGA TCTAAAAAAA TCGTCGATTT

 951 GTTCCGTCCG CTGATCGAGG CCAAAAACAA AGCCTTGTTG GAAAAAACCG

1001 ATACCAACTT CAAACAGGTC AACGAAATTC TGGCGAAATA CCGGACTAAA

1051 GACGGTTTTG AAACCTACGA CAAGCTGGGC GAAGCCGACC GCAAAGCGTT

1101 ACAGGCCTCT ATTAACGCGC TTGCCGAAGA CCTTGCCCAA CTTCGCGGCA

1151 TACTCGGCTT GAAATAA
```

This corresponds to the amino acid sequence <SEQ ID 2570; ORF 749>:

```
m749.pep

  1 MRKFNLTALS VMLALGLTAC QPPEAEKAAP AASGEAQTAN EGGSVSIAVN

 51 DNACEPMELT VPSGQVVFNI KNNSGRKLEW EILKGVMVVD ERENIAPGLS

101 DKMTVTLLPG EYEMTCGLLT NPRGKLVVTD SGFKDTANEA DLEKLSQPLA

151 DYKAYVQGEV KELVAKTKTF TEAVKAGDIE KAKSLFADTR VHYERIEPIA

201 ELFSELDPVI DAREDDFKDG AKDAGFTGFH RIEYALWVEK DVSGVKEIAA

251 KLMTDVEALQ KEIDALAFPP GKVVGGASEL IEEVAGSKIS GEEDRYSHTD

301 LSDFQANVDG SKKIVDLFRP LIEAKNKALL EKTDTNFKQV NEILAKYRTK

351 DGFETYDKLG EADRKALQAS INALAEDLAQ LRGILGLK*
```

Computer analysis of this amino acid sequence gave the following results:

Homology with a predicted ORF from *N. gonorrhoeae*

ORF 749 shows 96.1% identity over a 388 aa overlap with a predicted ORF (ORF 749) from *N. gonorrhoeae* m749/g749 96.1% identity in 388 aa overlap

```
                            10        20        30        40        50        60
m749.pep           MRKFNLTALSVMLALGLTACQPPEAEKAAPAASGEAQTANEGGSVSIAVNDNACEPMELT
                   |||||||||||||||||||||||||||||||||||:|:|||||||:|||||||||||:||
g749               MRKFNLTALSVMLALGLTACQPPEAEKAAPAASGETQSANEGGSVGIAVNDNACEPMNLT
                            10        20        30        40        50        60

                            70        80        90       100       110       120
m749.pep           VPSGQVVFNIKNNSGRKLEWEILKGVMVVDERENIAPGLSDKMTVTLLPGEYEMTCGLLT
                   ||||||||||||||||||||||||||||||||||||||||||||||||||||||||||||
g749               VPSGQVVFNIKNNSGRKLEWEILKGVMVVDERENIAPGLSDKMTVTLLPGEYEMTCGLLT
                            70        80        90       100       110       120

                           130       140       150       160       170       180
m749.pep           NPRGKLVVTDSGFKDTANEADLEKLSQPLADYKAYVQGEVKELVAKTKTFTEAVKAGDIE
                   ||||||||:|||||||||||||||| |||||||||||||||||:||||||||||||||||
g749               NPRGKLVVADSGFKDTANEADLEKLPQPLADYKAYVQGEVKELAAKTKTFTEAVKAGDIE
                           130       140       150       160       170       180
```

-continued

```
                       190       200       210       220       230       240
m749.pep        KAKSLFADTRVHYERIEPIAELFSELDPVIDAREDDFKDGAKDAGFTGFHRIEYALWVEK
                ||||||| ||||||||||||||||||||||||| |||||||||||||||||||:||||||
g749            KAKSLFAATRVHYERIEPIAELFSELDPVIDACEDDFKDGAKDAGFTGFHRIEHALWVEK
                       190       200       210       220       230       240

                       250       260       270       280       290       300
m749.pep        DVSGVKEIAAKLMTDVEALQKEIDALAFPPGKVVGGASELIEEVAGSKISGEEDRYSHTD
                ||||||| |||||||||||||||||||||||||||||||||||:||||||||||||||||
g749            DVSGVKETAAKLMTDVEALQKEIDALAFPPGKVVGGASELIEEAAGSKISGEEDRYSHTD
                       250       260       270       280       290       300

                       250       260       270       280       290       300
m749.pep        LSDFQANVDGSKKIVDLFRPLIEAKNKALLEKTDTNFKQVNEILAKYRTKDGFETYDKLG
                |||||||:|||||||||||||||||||||||||||||||||||||||||||||||||||:
g749            LSDFQANADGSKKIVDLFRPLIEAKNKALLEKTDTNFKQVNEILAKYRTKDGFETYDKLS
                       250       260       270       280       290       300

                       370       380      389
m749.pep        EADRKALQASINALAEDLAQLRGILGLKX
                ||||||||| |||||||||||||||||||
g749            EADRKALQAPINALAEDLAQLRGILGLKX
                       370       380
```

The following partial DNA sequence was identified in *N. meningitidis* <SEQ ID 2571>:

a749.seq

```
   1 ATGAGAAAAT TCAATTTGAC CGCATTGTCC GTGATGCTTG CCTTAGGTTT
  51 GACCGCGTGC CAGCCGCCGG AGGCGGAGAA AGCTGCGCCG GCAGCGTCCG
 101 GTGAGGCGCA AACCGCCAAC GAGGGCGGTT CGGTCAGTAT CGCCGTCAAC
 151 GACAATGCCT GCGAACCGAT GGAACTGACC GTGCCGAGCG GACAGGTTGT
 201 GTTCAATATT AAAAACAACA GCGGCCGCAA GCTCGAATGG GAAATCCTGA
 251 AAGGCGTGAT GGTGGTGGAC GAGCGCGAAA ACATCGCCCC CGGACTTTCC
 301 GATAAAATGA CCGTCACCCT GTTGCCGGGC GAATACGAAA TGACTTGCGG
 351 TCTTTTGACC AATCCGCGCG GCAAGCTGGT GGTAACCGAC AGCGGCTTTA
 401 AAGACACCGC CAACGAAGCG GATTTGGAAA AACTGTCCCA ACCGCTCGCC
 451 GACTATAAAG CCTATGTTCA AGGCGAAGTC AAAGAGCTGG TGGCGAAAAC
 501 CAAAACCTTT ACCGAAGCCG TCAAAGCAGG CGACATTGAA AAGGCGAAAT
 551 CCCTGTTTGC CGACACCCGC GTCCATTACG AACGCATCGA ACCGATTGCC
 601 GAGCTTTTCA GCGAACTCGA CCCCGTCATC GATGCGCGTG AAGACGACTT
 651 CAAAGACGGC GCGAAAGATG CCGGATTTAC CGGCTTCCAC CGTATCGAAT
 701 ACGCCCTTTG GGTGGAAAAA GACGTGTCCG GCGTGAAGGA AATTGCAGCG
 751 AAACTGATGA CCGATGTCGA AGCCCTGCAA AAAGAAATCG ACGCATTGGC
 801 GTTTCCTCCG GGCAAGGTGG TCGGCGGCGC GTCCGAACTG ATTGAAGAAG
 851 TGGCGGGCAG TAAAATCAGC GGCGAAGAAG ACCGGTACAG CCACACCGAT
 901 TTGAGCGACT TCCAAGCCAA TGTGGACGGA TCGAAAAAAA TCGTCGATTT
 951 GTTCCGTCCG TTGATCGAGA CCAAAAACAA AGCCTTGTTG GAAAAAACCG
1001 ATACCAACTT CAAACAGGTC AACGAAATTC TGGCGAAATA CCGGACTAAA
1051 GACGGTTTTG AAACCTACGA CAAGCTGGGC GAAGCCGACC GCAAAGCGTT
1101 ACAGGCCTCT ATTAACGCGC TTGCCGAAGA CCTTGCCCAA CTTCGCGGCA
1151 TACTCGGCTT GAAATAA
```

This corresponds to the amino acid sequence <SEQ ID 2572; ORF 749.a>:

a749.pep

```
  1 MRKFNLTALS VMLALGLTAC QPPEAEKAAP AASGEAQTAN EGGSVSIAVN

 51 DNACEPMELT VPSGQVVFNI KNNSGRKLEW EILKGVMVVD ERENIAPGLS

101 DKMTVTLLPG EYEMTCGLLT NPRGKLVVTD SGFKDTANEA DLEKLSQPLA

151 DYKAYVQGEV KELVAKTKTF TEAVKAGDIE KAKSLFADTR VHYERIEPIA

201 ELFSELDPVI DAREDDFKDG AKDAGFTGFH RIEYALWVEK DVSGVKEIAA

251 KLMTDVEALQ KEIDALAFPP GKVVGGASEL IEEVAGSKIS GEEDRYSHTD

301 LSDFQANVDG SKKIVDLFRP LIETKNKALL EKTDTNFKQV NEILAKYRTK

351 DGFETYDKLG EADRKALQAS INALAEDLAQ LRGILGLK*
```

Computer analysis of this amino acid sequence gave the following results:

Homology with a predicted ORF from *N meningitidis*

ORF 749 shows 99.7% identity over a 388 aa overlap with a predicted ORF (ORF 749) from *N. meningitidis:* a749/m749 99.7% identity in 388 aa overlap

```
                    10        20        30        40        50        60
a749.pep    MRKFNLTALSVMLALGLTACQPPEAEKAAPAASGEAQTANEGGSVSIAVNDNACEPMELT
            ||||||||||||||||||||||||||||||||||||||||||||||||||||||||||||
m749        MRKFNLTALSVMLALGLTACQPPEAEKAAPAASGEAQTANEGGSVSIAVNDNACEPMELT
                    10        20        30        40        50        60

                    70        80        90       100       110       120
a749.pep    VPSGQVVFNIKNNSGRKLEWEILKGVMVVDERENIAPGLSDKMTVTLLPGEYEMTCGLLT
            ||||||||||||||||||||||||||||||||||||||||||||||||||||||||||||
m749        VPSGQVVFNIKNNSGRKLEWEILKGVMVVDERENIAPGLSDKMTVTLLPGEYEMTCGLLT
                    70        80        90       100       110       120

                   130       140       150       160       170       180
a749.pep    NPRGKLVVTDSGFKDTANEADLEKLSQPLADYKAYVQGEVKELVAKTKTFTEAVKAGDIE
            ||||||||||||||||||||||||||||||||||||||||||||||||||||||||||||
m749        NPRGKLVVTDSGFKDTANEADLEKLSQPLADYKAYVQGEVKELVAKTKTFTEAVKAGDIE
                   130       140       150       160       170       180

                   190       200       210       220       230       240
a749.pep    KAKSLFADTRVHYERIEPIAELFSELDPVIDAREDDFKDGAKDAGFTGFHRIEYALWVEK
            ||||||||||||||||||||||||||||||||||||||||||||||||||||||||||||
m749        KAKSLFADTRVHYERIEPIAELFSELDPVIDAREDDFKDGAKDAGFTGFHRIEYALWVEK
                   190       200       210       220       230       240

                   250       260       270       280       290       300
a749.pep    DVSGVKEIAAKLMTDVEALQKEIDALAFPPGKVVGGASELIEEVAGSKISGEEDRYSHTD
            ||||||||||||||||||||||||||||||||||||||||||||||||||||||||||||
m749        DVSGVKEIAAKLMTDVEALQKEIDALAFPPGKVVGGASELIEEVAGSKISGEEDRYSHTD
                   250       260       270       280       290       300

                   310       320       330       340       350       360
a749.pep    LSDFQANVDGSKKIVDLFRPLIETKNKALLEKTDTNFKQVNEILAKYRTKDGFETYDKLG
            ||||||||||||||||||||||:|||||||||||||||||||||||||||||||||||||
m749        LSDFQANVDGSKKIVDLFRPLIEAKNKALLEKTDTNFKQVNEILAKYRTKDGFETYDKLG
                   310       320       330       340       350       360

                   370       380      389
a749.pep    EADRKALQASINALAEDLAQLRGILGLKX
            |||||||||||||||||||||||||||||
m749        EADRKALQASINALAEDLAQLRGILGLKX
                   370       380
```

The following partial DNA sequence was identified in *N. gonorrhoeae* <SEQ ID 2573>:

g750.seq

```
  1 GTGAAACCGC GTTTTTATTG GGCAGcctGC GCCGTCCTGC CGGCCGCCTG

 51 TTCGCCCGAA CCTGCCCCCG AAAAAACTGT ATccgCCGCA TCCCAAGCCG

101 CATCCACACC TGTCGCCACG CTGACCGTGC CGACCGCGCG GGGCGATGCC

151 GTTGTGCCGA AGAATCCCGA ACgcgtcgcc gtgtAcgaCt ggGCGGCGTt
```

-continued

```
201 ggaTACGCTG ACCGAGCCGG GCGTGAATGT GGGCGCAACC ACCGCGCCGG
251 TGCGCGTGGA CTATTTGCAG CCTGCATTTG ACAAGGCGGC AACGGTGGGG
301 ACGCTGTTTG AGCCCGATTG CGAATCCCTG CACCGCCACA ATCCGCAGTT
351 TGTCATTACC GGCGGGCCGG GTGCGGAAGC GTATGAACAG TTGGCGAAAA
401 ACGCGACCAC CATAGATTTG ACGGTGGACA ACGGCAATAT CCGCACCAGC
451 GGCGAGAAGC AGATGGAGAC CCTGTCGCGG ATTTTCGGTA AGGAAGCGCG
501 CGTGGCGGAA TTGAATGCGC AGATTGACGC GCTGTTCGCC CAAAAGCGCG
551 AAGCCGCCAA AGGCAAAGGA CGCGGGCTGG TGCTGTCGGT TACAGGCAAC
601 AAGGTGTCCG CCTTCGGCAC GCAATCGCGG TTGGCAAGTT GGATACACGG
651 CGACATCGGC CTGCCGCCCG TGGACGAATC TTTACGCAAC GAAGGGCACG
701 GGCAGCCCGT TTCCTTCGAA TACATCAAAG AGAAAAACCC CGGCTGGATT
751 TTCATCATCG ACCGCACCGC CGCCATCGGG CAGGAAGGGC CGGCTGCCGT
801 GGAAGTGTTG GATAACGCGC TGGTATGCGG CACGAACGCT TGGAAGCGCA
851 AGCAAATCAT CGTCATGCCT GCCGCGAACT ACATTGTCGC GGGCGGCGCG
901 CGGCAGTTGA TACAGGCGGC GGAACAGTTG AAGGCGGCGT TTGAAAAGGC
951 AGAACCCGTT GCGGCGCAGT AG
```

This corresponds to the amino acid sequence <SEQ ID 2574; ORF 750.ng>:

g750.pep

```
  1 VKPRFYWAAC AVLPAACSPE PAAEKTVSAA SQAASTPVAT LTVPTARGDA
 51 VVPKNPERVA VYDWAALDTL TEPGVNVGAT TAPVRVDYLQ PAFDKAATVG
101 TLFEPDCESL HRHNPQFVIT GGPGAEAYEQ LAKNATTIDL TVDNGNIRTS
151 GEKQMETLSR IFGKEARVAE LNAQIDALFA QKREAAKGKG RGLVLSVTGN
201 KVSAFGTQSR LASWIHGDIG LPPVDESLRN EGHGQPVSFE YIKEKNPGWI
251 FIIDRTAAIG QEGPAAVEVL DNALVCGTNA WKRKQIIVMP AANYIVAGGA
301 RQLIQAAEQL KAAFEKAEPV AAQ*
```

The following partial DNA sequence was identified in *N. meningitidis* <SEQ ID 2575>:

m750.seq

```
  1 GTGAAACCGC GTTTTTATTG GGCAGCCTGC GCCGTCCTGC TGACCGCCTG
 51 TTCGCCCGAA CCTGCCGCCG AAAAAACTGT ATCCGCCGCA TCCGCATCTG
101 CCGCCACGCT GACCGTGCCG ACCGCGCGGG GCGATGCCGT TGTGCCGAAG
151 AATCCCGAAC GCGTCGCCGT GTACGACTGG GCGGCGTTGG ATACGCTGAC
201 CGAATTGGGC GTGAATGTGG GCGCAACCAC CGCGCCGGTG CGCGTGGATT
251 ATTTGCAGCC TGCATTTGAC AAGGCGGCAA CGGTGGGGAC GCTGTTCGAG
301 CCCGATTACG AAGCCCTGCA CCGCTACAAT CCTCAGCTTG TCATTACCGG
351 CGGGCCGGGC GCGGAAGCGT ATGAACAGTT AGCGAAAAAC GCGACCACCA
```

-continued

```
401 TAGATCTGAC GGTGGACAAC GGCAATATCC GCACCAGCGG CGAAAAGCAG

451 ATGGAGACCT TGGCGCGGAT TTTCGGCAAG GAAGCGCGCG CGGCGGAATT

501 GAAGGCGCAG ATTGACGCGC TGTTCGCCCA AACGCGCGAA GCCGCCAAAG

551 GCAAAGGACG CGGGCTGGTG CTGTCGGTTA CGGGCAACAA GGTGTCCGCC

601 TTCGGCACGC AGTCGCGGTT GGCAAGTTGG ATACACGGCG ACATCGGCCT

651 ACCGCCTGTA GACGAATCTT TACGCAACGA GGGGCACGGG CAGCCTGTTT

701 CCTTCGAATA CATCAAAGAG AAAAACCCCG ATTGGATTTT CATCATCGAC

751 CGTACCGCCG CCATCGGGCA GGAAGGGCCG GCGGCTGTCG AAGTATTGGA

801 TAACGCGCTG GTACGCGGCA CGAACGCTTG GAAGCGCAAG CAAATCATCG

851 TCATGCCTGC CGCGAACTAC ATTGTCGCGG GCGGCGCGCG GCAGTTGATT

901 CAGGCGGCGG AGCAGTTGAA GGCGGCGTTT AAAAAGGCAG AACCCGTTGC

951 GGCGGGGAAA AAGTAG
```

This corresponds to the amino acid sequence <SEQ ID 2576; ORF 750>:

m750.pep

```
  1 VKPRFYWAAC AVLLTACSPE PAAEKTVSAA SASAATLTVP TARGDAVVPK

 51 NPERVAVYDW AALDTLTELG VNVGATTAPV RVDYLQPAFD KAATVGTLFE

101 PDYEALHRYN PQLVITGGPG AEAYEQLAKN ATTIDLTVDN GNIRTSGEKQ

151 METLARIFGK EARAAELKAQ IDALFAQTRE AAKGKGRGLV LSVTGNKVSA

201 FGTQSRLASW IHGDIGLPPV DESLRNEGHG QPVSFEYIKE KNPDWIFIID

251 RTAAIGQEGP AAVEVLDNAL VRGTNAWKRK QIIVMPAANY IVAGGARQLI

301 QAAEQLKAAF KKAEPVAAGK K*
```

Computer analysis of this amino acid sequence gave the following results:

Homology with a predicted ORF from *N. gonorrhoeae*

ORF 750 shows 93.8% identity over a 322 aa overlap with a predicted ORF (ORF 750) from *N. gonorrhoeae* m750/g750 93.8% identity in 322 aa overlap

```
                    10        20        30            40        50
m750.pep    VKPRFYWAACAVLLTACSPEPAAEKTVSAASASA----ATLTVPTARGDAVVPKNPERVA
            |||||||||||| :|||||||||||||||| :|     ||||||||||||||||||||||
g750        VKPRFYWAACAVLPAACSPEPAAEKTVSAASQAASTPVATLTVPTARGDAVVPKNPERVA
                    10        20        30        40        50        60

              60        70        80        90       100       110
m750.pep    VYDWAALDTLTELGVNVGATTAPVRVDYLQPAFDKAATVGTLFEPDYEALHRYNPQLVIT
            |||||||||||| |||||||||||||||||||||||||||||||||| |:|||:|||:|||
g750        VYDWAALDTLTEPGVNVGATTAPVRVDYLQPAFDKAATVGTLFEPDCESLHRHNPQFVIT
                    70        80        90       100       110       120

             120       130       140       150       160       170
m750.pep    GGPGAEAYEQLAKNATTIDLTVDNGNIRTSGEKQMETLARIFGKEARAAELKAQIDALFA
            ||||||||||||||||||||||||||||||||||||:|||||||||:|||:|||||||
g750        GGPGAEAYEQLAKNATTIDLTVDNGNIRTSGEKQMETLSRIFGKEARVAELNAQIDALFA
                   130       140       150       160       170       180

             180       190       200       210       220       230
m750.pep    QTREAAKGKGRGLVLSVTGNKVSAFGTQSRLASWIHGDIGLPPVDESLRNEGHGQPVSFE
            | ||||||||||||||||||||||||||||||||||||||||||||||||||||||||||
g750        QKREAAKGKGRGLVLSVTGNKVSAFGTQSRLASWIHGDIGLPPVDESLRNEGHGQPVSFE
                   190       200       210       220       230       240
```

-continued

```
            240       250       260       270       280       290
m750.pep    YIKEKNPDWIFIIDRTAAIGQEGPAAVEVLDNALVRGTNAWKRKQIIVMPAANYIVAGGA
            ||||||| |||||||||||||||||||||||||||| |||||||||||||||||||||||
g750        YIKEKNPGWIFIIDRTAAIGQEGPAAVEVLDNALVCGTNAWKRKQIIVMPAANYIVAGGA
                   250       260       270       280       290       300

            300       310       320
m750.pep    RQLIQAAEQLKAAFKKAEPVAAGKKX
            ||||||||||||||:|||||||
g750        RQLIQAAEQLKAAFEKAEPVAAQX
                   310       320
```

The following partial DNA sequence was identified in *N. meningitidis* <SEQ ID 2577>:

a750.seq

```
  1 GTGAAACCGC GTTTTTATTG GGCAGCCTGC GCCGTCCTGC TGACCGCCTG
 51 TTCGCCCGAA CCTGCCGCCG AAAAAACTGT ATCCGCCGCA TCCGCATCTG
101 CCGCCACACT GACCGTGCCG ACCGCGCGGG GCGATGCCGT TGTGCCGAAG
151 AATCCCGAAC GCGTCGCCGT GTACGACTGG GCGGCGTTGG ATACGCTGAC
201 CGAATTGGGT GTGAATGTGG GCGCAACCAC CGCGCCGGTG CGCGTGGATT
251 ATTTGCAGCC TGCATTTGAC AAGGCGGCAA CGGTGGGGAC GCTGTTCGAG
301 CCCGATTACG AAGCCCTGCA CCGCTACAAT CCTCAGCTTG TCATTACCGG
351 CGGGCCGGGC GCGGAAGCGT ATGAACAGTT GGCGAAAAAC GCGACCACCA
401 TAGATCTGAC GGTGGACAAC GGCAATATCC GCACCAGCGG CGAAAAGCAG
451 ATGGAGACCT TGGCGCGGAT TTTCGGCAAG GAAGCGCGCG CGGCGGAATT
501 GAAGGCGCAG ATTGACGCGC TGTTCGCCCA AACGCGCGAA GCCGCCAAAG
551 GCAAAGGACG CGGGCTGGTG CTGTCGGTTA CGGGCAACAA GGTGTCCGCC
601 TTCGGCACGC AGTCGCGGTT GGCAAGTTGG ATACACGGCG ACATCGGCCT
651 ACCGCCTGTA GACGAATCTT TACGCAACGA GGGGCACGGG CAGCCTGTTT
701 CCTTCGAATA CATCAAAGAG AAAAACCCCG ATTGGATTTT CATCATCGAC
751 CGTACCGCCG CCATCGGGCA GGAAGGGCCG GCGGCTGTCG AAGTATTGGA
801 TAACGCGCTG GTACGCGGCA CGAACGCTTG GAAGCGCAAG CAAATCATCG
851 TCATGCCTGC CGCGAACTAC ATTGTCGCGG GCGGCTCGCG GCAGTTGATT
901 CAGGCGGCGG AGCAGTTGAA GGAGGCGTTT GAAAAGGCAG AACCCGTTGC
951 GGCGGGGAAA GAGTAG
```

This corresponds to the amino acid sequence <SEQ ID 2578; ORF 750.a>:

a750.pep

```
  1 VKPRFYWAAC AVLLTACSPE PAAEKTVSAA SASAATLTVP TARGDAVVPK
 51 NPERVAVYDW AALDTLTELG VNVGATTAPV RVDYLQPAFD KAATVGTLFE
101 PDYEALHRYN PQLVITGGPG AEAYEQLAKN ATTIDLTVDN GNIRTSGEKQ
151 METLARIFGK EARAAELKAQ IDALFAQTRE AAKGKGRGLV LSVTGNKVSA
201 FGTQSRLASW IHGDIGLPPV DESLRNEGHG QPVSFEYIKE KNPDWIFIID
251 RTAAIGQEGP AAVEVLDNAL VRGTNAWKRK QIIVMPAANY IVAGGSRQLI
301 QAAEQLKEAF EKAEPVAAGK E*
```

Computer analysis of this amino acid sequence gave the following results:

Homology with a predicted ORF from *N. meningitidis*

ORF 750 shows 98.8% identity over a 321 aa overlap with a predicted ORF (ORF 750) from *N. meningitidis:* a750/m750 98.8% identity in 321 aa overlap

```
                    10        20        30        40        50        60
a750.pep    VKPRFYWAACAVLLTACSPEPAAEKTVSAASASAATLTVPTARGDAVVPKNPERVAVYDW
            ||||||||||||||||||||||||||||||||||||||||||||||||||||||||||||
m750        VKPRFYWAACAVLLTACSPEPAAEKTVSAASASAATLTVPTARGDAVVPKNPERVAVYDW
                    10        20        30        40        50        60
                    70        80        90       100       110       120
a750.pep    AALDTLTELGVNVGATTAPVRVDYLQPAFDKAATVGTLFEPDYEALHRYNPQLVITGGPG
            ||||||||||||||||||||||||||||||||||||||||||||||||||||||||||||
m750        AALDTLTELGVNVGATTAPVRVDYLQPAFDKAATVGTLFEPDYEALHRYNPQLVITGGPG
                    70        80        90       100       110       120
                   130       140       150       160       170       180
a750.pep    AEAYEQLAKNATTIDLTVDNGNIRTSGEKQMETLARIFGKEARAAELKAQIDALFAQTRE
            ||||||||||||||||||||||||||||||||||||||||||||||||||||||||||||
m750        AEAYEQLAKNATTIDLTVDNGNIRTSGEKQMETLARIFGKEARAAELKAQIDALFAQTRE
                   130       140       150       160       170       180
                   190       200       210       220       230       240
a750.pep    AAKGKGRGLVLSVTGNKVSAFGTQSRLASWIHGDIGLPPVDESLRNEGHGQPVSFEYIKE
            ||||||||||||||||||||||||||||||||||||||||||||||||||||||||||||
m750        AAKGKGRGLVLSVTGNKVSAFGTQSRLASWIHGDIGLPPVDESLRNEGHGQPVSFEYIKE
                   190       200       210       220       230       240
                   250       260       270       280       290       300
a750.pep    KNPDWIFIIDRTAAIGQEGPAAVEVLDNALVRGTNAWKRKQIIVMPAANYIVAGGSRQLI
            |||||||||||||||||||||||||||||||||||||||||||||||||||||||:||||
m750        KNPDWIFIIDRTAAIGQEGPAAVEVLDNALVRGTNAWKRKQIIVMPAANYIVAGGARQLI
                   250       260       270       280       290       300
                   310       320
a750.pep    QAAEQLKEAFEKAEPVAAGKEX
            ||||||| ||:|||||||||:|
m750        QAAEQLKAAFKKAEPVAAGKKX
                   310       320
```

g751.seq not found yet g751.pep not found yet

The following partial DNA sequence was identified in *N. meningitidis* <SEQ ID 2579>:

```
m751.seq..

  1 ATGGCTTGGA GTATGTTTGC CACAACCCAA GCCGATAGAG CGGTAAGGTC

 51 TGCAACTGCA CCTAAAGAAA TGTGGTTCCA TAAGAAGATA ATAGATGAAA

101 AAACAGGTAA AGTATCCTTT GATACCAGAC AAATTTGGTC ATTGAATGAT

151 TTAAGCAAGG AAGAACTGGC AAGCATTCAA GACACAAATG GCAAAGTTAT

201 TACTGTGTCT AATCCTGGTA TTTTCAATAA TCGAGAAGAT TCATTAAGCA

251 ACGCAGCAAA ACAAAATCGT AATAGTACAA ACGGTAGTGG TGTTATTGCA

301 GTCATGAATC CTCCAACAGG GAAATATAAA TCTGATTCTA ATAACAAAAT

351 AAAAGATTTT TTATGGCTCG GTTCAAGTCT TGTTTCTGAA CTGATGTATG

401 TCGGTTACGA CCAATTAAAT AATAAAGTGT TCCAAGGCTA TTTACCCAAA

451 ACCAATTCAG AAAAACTGAA TCAAGATATT TATCGAGAGG TTCAAAAAAT

501 GGGTAACGGC TGGTCGGTTG ATACCAGTAA TCACAGTCGT GGGGGAATTA

551 CAGCAAGCGT TTCCTTAAAA GATTGGGTAA ACAATCAAAA ACAAAATGGC

601 ATTGCCCCAA TCAGAAAAGC ACGTTTCTAT GGTACAGCCA CAAATGTGCA

651 GAATGATTAC GCCGATGTTT TACAGAAAAA CGGCTATACC TATACGGGTG
```

-continued

```
 701 CAGACGGCAA AACTTATAAC AGCGGATCCT ACTCAATCGT GCATGATAAA

 751 GATTTTGTGG GGAACAAATG GATACCTTTC TTGCTAGGAA CCAATGACAC

 801 CACACAAGGT ACATGTAAGG GGTTGTGCTA TTCGCATAGC AGTTATTTTG

 851 CGGAGGTGCC AAAAGCAGGT ACAAAAGAAT TTGATGACTA TGTAAAAATA

 901 TGGGGTGAAG TTGAATATGA CGCTCAAGGT AAGCCAATTA ACAAATCTAA

 951 ACCCATACTG GTAGAACCAA ACAAAACAAA AGATAATGAA AAATATGAAA

1001 AAGAAGCTTT CTAA
```

This corresponds to the amino acid sequence <SEQ ID 2580; ORF 751>:

m751.pep..

```
  1 MAWSMFATTQ ADRAVRSATA PKEMWFHKKI IDEKTGKVSF DTRQIWSLND

 51 LSKEELASIQ DTNGKVITVS NPGIFNNRED SLSNAAKQNR NSTNGSGVIA

101 VMNPPTGKYK SDSNNKIKDF LWLGSSLVSE LMYVGYDQLN NKVFQGYLPK

151 TNSEKLNQDI YREVQKMGNG WSVDTSNHSR GGITASVSLK DWVNNQKQNG

201 IAPIRKARFY GTATNVQNDY ADVLQKNGYT YTGADGKTYN SGSYSIVHDK

251 DFVGNKWIPF LLGTNDTTQG TCKGLCYSHS SYFAEVPKAG TKEFDDYVKI

301 WGEVEYDAQG KPINKSKPIL VEPNKTKDNE KYEKEAF*
```

a751.seq not found yet a751.pep not found yet g752.seq not found yet g752.pep not found yet The following partial DNA sequence was identified in *N. meningitidis* <SEQ ID 2581>:

m752.seq..

```
  1 ATGAAAATTT CCAGACCTCC GGAATTTACC CTGTTGCAAC AGGAATATAT

 51 GCAGCATCTC ACTGAAAGAA TGACGCAAAT TGCCAAGCTG CTGAATTCTT

101 CCGCAAACAA TCCTGATATA GACATTCCCG ATTTTCTTAC TGAAATCAAA

151 GATTATTCAG AATTTTCCGT GACAGATGAA AATGGAACCT ACCTGCATTG

201 GGACAAATTC CGCCGGATTC ACACGGAAGA TACGCGGATG AAATGGCGCG

251 CCGTTAAGGA AAGCCGCAAA AAAATCCAAA AACCAATTGA TTTCCCGTTT

301 GAACATCAGT TTTGGTTCTG CATTCCCGAC TCTTTGCAGG CACGGCTTCA

351 TTTGATTGAC AAAAGCTGCG GCAGTTCTAT CGGCACGTCT AGCTTGGGTG

401 GCTTCGGCAG AAGCGAGCAA AACAGATTCT TGCTCAAGTC TCTGATTATG

451 GAAGAAGCGA TTACATCCGC CCAACTGGAA GGTGCGGCTA CCACGCGTAA

501 AGTGGCCAAG GATATGCTCA AATCGCAGCG TAAACCCAAA ACAAAAGACG

551 AAATCATGAT AGTGAACAAC TATCACTTGA TGAAAAAAGC GGTAGAATTG

601 AAAAATACGC CGTTAAGTGT TGAAATGATT TTGGATTTGC ACCGCATTGC

651 TACCAGTAAC GCTATTGAAA ACAAGGCCGA GCCCGGACAA TTCAGGCAGG
```

-continued

```
 701 ATGACGAAAT CTTTATCGCC GATATCAATG GTAACAGCCT GTATCAACCA
 751 CCGCCGCACG GACAGGTTCA TACGCTGATG GAAGAGGTGT GTGCGTTTGC
 801 CAATAATACC TATGACGGCG TGGAAAATCC GTTTATCCAT CCGGTTGTCC
 851 AAGCTATTAT CTTGCATTTC CTCATCGGCT ACATCCACCC ATTTGGTGAT
 901 GGCAACGGGC GGACAGCGCG GGCTTTGTTC TATTGGTTTA TGCTCAAAAA
 951 CGGCTACTGG CTATTTGAAT ACATATCCAT CAGCCGTCTT CTGAAAAACG
1001 CTCCTGCCCA ATACGCCAAA TCCTATTTGT ATGCGGAAAC TGACGATTTA
1051 GATTTAACCT ATTTCATCTA TTACCAATGC GATATTATCA AGCGGGCGGT
1101 TGCCGATTTG GAGCACTACA TTTCCGACAA ACAAAAACAC CAACAGGAAT
1151 TCAAAGCAGC GATTGCCCAA TATACTGAAA AGATAGGAAA GTTGAACCAA
1201 CGGCAAATTG GTATCCTGCA AAAAGCAGTG GAAGAAAGCG GAAAAATCTT
1251 TACTGCACAA GAAATTGCCA ACCAATACGG CATCTCCCTG AATACTGCCC
1301 GTAGCGATTT GAGTAAACTG GGAGAATATA GATTCCTAGT GCCGTTCAAA
1351 TCAGGAAATG CTTTAGAGTA TGTTGCTCCT CAGGATTTAT TGGAAAGGTT
1401 AGAAAAAAAA TAG
```

This corresponds to the amino acid sequence <SEQ ID 2582; ORF 752>:

m752.pep

```
  1 MKISRPPEFT LLQQEYMQHL TERMTQIAKL LNSSANNPDI DIPDFLTEIK
 51 DYSEFSVTDE NGTYLHWDKF RRIHTEDTRM KWRAVKESRK KIQKPIDFPF
101 EHQFWFCIPD SLQARLHLID KSCGSSIGTS SLGGFGRSEQ NRFLLKSLIM
151 EEAITSAQLE GAATTRKVAK DMLKSQRKPK TKDEIMIVNN YHLMKKAVEL
201 KNTPLSVEMI LDLHRIATSN AIENKAEPGQ FRQDDEIFIA DINGNSLYQP
251 PPHGQVHTLM EEVCAFANNT YDGVENPFIH PVVQAIILHF LIGYIHPFGD
301 GNGRTARALF YWFMLKNGYW LFEYISISRL LKNAPAQYAK SYLYAETDDL
351 DLTYFIYYQC DIIKRAVADL EHYISDKQKH QQEFKAAIAQ YTEKIGKLNQ
401 RQIGILQKAV EESGKIFTAQ EIANQYGISL NTARSDLSKL GEYRFLVPFK
451 SGNALEYVAP QDLLERLEKK *
```

The following partial DNA sequence was identified in *N. meningitidis* <SEQ ID 2583>:

m752-1.seq

```
  1 ATGAAAATTT CCAGACCTCC GGAATTTACC CTGTTGCAAC AGGAATATAT
 51 GCAGCATCTC ACTGAAAGAA TGACGCAAAT TGCCAAGCTG CTGAATTCTT
101 CCGCAAACAA TCCTGATATA GACATTCCCG ATTTTCTTAC TGAAATCAAA
151 GATTATTCAG AATTTTCCGT GACAGATGAA AATGGAACCT ACCTGCATTG
201 GGACAAATTC CGCCGGATTC ACACGGAAGA TACGCGGATG AAATGGCGCG
251 CCGTTAAGGA AAGCCGCAAA AAAATCCAAA AACCAATTGA TTTCCCGTTT
```

-continued

```
 301 GAACATCAGT TTTGGTTCTG CATTCCCGAC TCTTTGCAGG CACGGCTTCA

 351 TTTGATTGAC AAAAGCTGCG GCAGTTCTAT CGGCACGTCT AGCTTGGGTG

 401 GCTTCGGCAG AAGCGAGCAA AACAGATTCT TGCTCAAGTC TCTGATTATG

 451 GAAGAAGCGA TTACATCCGC CCAACTGGAA GGTGCGGCTA CCACGCGTAA

 501 AGTGGCCAAG GATATGCTCA AATCGCAGCG TAAACCCAAA ACAAAAGACG

 551 AAATCATGAT AGTGAACAAC TATCACTTGA TGAAAAAAGC GGTAGAATTG

 601 AAAAATACGC CGTTAAGTGT TGAAATGATT TTGGATTTGC ACCGCATTGC

 651 TACCAGTAAC GCTATTGAAA ACAAGGCCGA GCCCGGACAA TTCAGGCAGG

 701 ATGACGAAAT CTTTATCGCC GATATCAATG GTAACAGCCT GTATCAACCA

 751 CCGCCGCACG GACAGGTTCA TACGCTGATG GAAGAGGTGT GTGCGTTTGC

 801 CAATAATACC TATGACGGCG TGGAAAATCC GTTTATCCAT CCGGTTGTCC

 851 AAGCTATTAT CTTGCATTTC CTCATCGGCT ACATCCACCC ATTTGGTGAT

 901 GGCAACGGGC GGACAGCGCG GGCTTTGTTC TATTGGTTTA TGCTCAAAAA

 951 CGGCTACTGG CTATTTGAAT ACATATCCAT CAGCCGTCTT CTGAAAAACG

1001 CTCCTGCCCA ATACGCCAAA TCCTATTTGT ATGCGGAAAC TGACGATTTA

1051 GATTTAACCT ATTTCATCTA TTACCAATGC GATATTATCA AGCGGGCGGT

1101 TGCCGATTTG GAGCACTACA TTTCCGACAA ACAAAAACAC CAACAGGAAT

1151 TCAAAGCAGC GATTGCCCAA TATACTGAAA AGATAGGAAA GTTGAACCAA

1201 CGGCAAATTG GTATCCTGCA AAAAGCAGTG GAAGAAAGCG GAAAAATCTT

1251 TACTGCACAA GAAATTGCCA ACCAATACGG CATCTCCCTG AATACTGCCC

1301 GTAGCGATTT GAGTAAACTG GGAGAATATA GATTCCTAGT GCCGTTCAAA

1351 TCAGGAAATG CTTTAGAGTA TGTTGCTCCT CAGGATTTAT TGGAAAGGTT

1401 AGAAAAAAAA TAG
```

This corresponds to the amino acid sequence <SEQ ID 2584; ORF 752-1>:

m752-1.pep

```
  1 MKISRPPEFT LLQQEYMQHL TERMTQIAKL LNSSANNPDI DIPDFLTEIK

 51 DYSEFSVTDE NGTYLHWDKF RRIHTEDTRM KWRAVKESRK KIQKPIDFPF

101 EHQFWFCIPD SLQARLHLID KSCGSSIGTS SLGGFGRSEQ NRFLLKSLIM

151 EEAITSAQLE GAATTRKVAK DMLKSQRKPK TKDEIMIVNN YHLMKKAVEL

201 KNTPLSVEMI LDLHRIATSN AIENKAEPGQ FRQDDEIFIA DINGNSLYQP

251 PPHGQVHTLM EEVCAFANNT YDGVENPFIH PVVQAIILHF LIGYIHPFGD

301 GNGRTARALF YWFMLKNGYW LFEYISISRL LKNAPAQYAK SYLYAETDDL

351 DLTYFIYYQC DIIKRAVADL EHYISDKQKH QQEFKAAIAQ YTEKIGKLNQ

401 RQIGILQKAV EESGKIFTAQ EIANQYGISL NTARSDLSKL GEYRFLVPFK

451 SGNALEYVAP QDLLERLEKK *
```

a7S2.seq not found yet a752.pep not found yet
g753.seq not found yet
g753.pep not found yet The following partial DNA sequence was identified in *N. meningitidis* <SEQ ID 2585>:

m753.seq

```
  1 ATGCCCATCA CTCCACCCTT AAACATCATC TCTCCTAAAC TCTACCCCAA
 51 TGAACAATGG AACGAAAGCG AAGCACTCGG TGCCATCACT TGGCTATGGT
101 ATCAGTCGCC TACGCATCGC CAAGTACCTA TTGTGGAGAT GATGACGTAT
151 ATATTGCCTG TGTTAAAAAA CGGGCAGTTC GCTTTGTTTT GCAAGGGTAC
201 CCAACCAATC GGTTATATCT CATGGGCTTA TTTTGATGAA GTGGCGCAGG
251 CGCATTATTT AGAATCTGAC CGCCATTTGC GTGACAACAG CGATTGGAAC
301 TGTGGCGACA ATATTTGGCT GATTCAATGG TTTGCGCCAT TGGGACACAG
351 TCATCAAATG CGCTCAGCTG TGCGCCAGTT ATTTCCTAGT ACGACAGTAC
401 GCGCCTTGTA TCATAAAGGG AGCGATAAGG GTTTGAGAAT TTTAACTTTT
451 AAAACTTGA
```

This corresponds to the amino acid sequence <SEQ ID 2586; ORF 753>:

m753.pep

```
  1 MPITPPLNII SPKLYPNEQW NESEALGAIT WLWYQSPTHR QVPIVEMMTY
 51 ILPVLKNGQF ALFCKGTQPI GYISWAYFDE VAQAHYLESD RHLRDNSDWN
101 CGDNIWLIQW FAPLGHSHQM RSAVRQLFPS TTVRALYHKG SDKGLRILTF
151 KT*
```

a753.seq not found yet
a753.pep not found yet
g754.seq not found yet
g754.pep not found yet The following partial DNA sequence was identified in *N. meningitidis* <SEQ ID 2587>:

m754.seq

```
  1 ATGATGAAGT CTATCCTCAC CGTATCCGGA AATCGTATGC GTAAACCCAG
 51 AATCACCTAT TTGGATGTTT GGGCAAACGA TGAAAGAATC GGTACTTTGG
101 AAAAGGGGGC CATGTATCGG TTCGCATACG ACAATCCCAA TTCTTCGTTG
151 CTGGGCCTGC ATTATCAAGA CAGAAGCAAG GTATATATCA GCAACAATAT
201 GCCGCATATC TTTGCACAGT ATTTTCCGGA AGGCTTTTTG GATGCACACA
251 TCACAAGCAA ATATGCTTTT CATGATGCGC CTTTTGAAGA CAATGAGATG
301 CTGCGCTTGG CAATTCTGTG CAGAGAGACT TTGGGTCGGA TACATGTGCG
351 CTGTAATGAC CCGCTTTTTA ATGAATGGAT TGACGGGTTG GAGATGAAAA
401 ATCCAAGAAT ATTGACTGAA CGGGATTTGC TGGGCATAAA TGCCCGACAG
```

-continued

```
 451 GTTTTTCAGC AATATATGGC AGAAATCTTC CATCACGGCC GTTTCGTCAG
 501 TGTATCCGGG ATACAGCAGA AGATGTCCTT AGATGCCATC CGCAGAAATA
 551 CCAAGCAAAC TGCCTCATAT ATTGCCAAAG GTTTTGATGC ATCCGAATAT
 601 CCTTGCTTGG CTGCCAATGA ATTTTTATGC ATGCAGACCA TCAAACAAGC
 651 CGGCATTGCC GTTGCACAGA CCAGCCTGTC GGAAGATTCA TCAGTCTTAT
 701 TGGTACGTCG GTTTGATGTC AGTGAACAGG GTTATTTTTT AGGGATGGAA
 751 GACTTTACCA GTCTGCGCCA GTATTCGGTA GAAGATAAAT ATAAAGGCAG
 801 TTATGCGGCT ATTGCACAGA TTATCCGACA GATATCCGGC AGACCAGATG
 851 AAGATTTAAT CCATTTCTTT AATCAGCTTG CTGCCAGTTG CATATTGAAA
 901 AACGGCGATG CACACCTCAA AAATTTTTCA GTACTCTATC ATGACGAATA
 951 CGATGTTCGT CTTGCACCTG TCTATGATGT ATTGGATACA TCAATATACA
1001 GGGTTGGAAC ACAAGGAATT TTTGATGCTT ATGACGATAC GCTGGCATTA
1051 AACCTGACTA ACCACGGTAA GAAAACATAT CCTTCCAAGA ATACATTGTT
1101 GGATTTTGCT GAGAAATATT GCGATTTGGG AAGAGAAGAT GCATCCTTTA
1151 TGATAGATAC AATCGTTCAA GCTAAAGAAC AGGTTCTTGT TAAATACTCG
1201 GATGTATTGC GTGAGAATGA ATGGTTGGCG CAGAAGTGGC ATTTTATCCC
1251 GGATGAAAAT GAAGAAGGTC TACCGTTTAC ATTCCGGTAG
```

This corresponds to the amino acid sequence <SEQ ID 2588; ORF 754>:

m754.pep

```
  1 MMKSILTVSG NRMRKPRITY LDVWANDERI GTLEKGAMYR FAYDNPNSSL
 51 LGLHYQDRSK VYISNNMPHI FAQYFPEGFL DAHITSKYAF HDAPFEDNEM
101 LRLAILCRET LGRIHVRCND PLFNEWIDGL EMKNPRILTE RDLLGINARQ
151 VFQQYMAEIF HHGRFVSVSG IQQKMSLDAI RRNTKQTASY IAKGFDASEY
201 PCLAANEFLC MQTIKQAGIA VAQTSLSEDS SVLLVRRFDV SEQGYFLGME
251 DFTSLRQYSV EDKYKGSYAA IAQIIRQISG RPDEDLIHFF NQLAASCILK
301 NGDAHLKNFS VLYHDEYDVR LAPVYDVLDT SIYRVGTQGI FDAYDDTLAL
351 NLTNHGKKTY PSKNTLLDFA EKYCDLGRED ASFMIDTIVQ AKEQVLVKYS
401 DVLRENEWLA QKWHFIPDEN EEGLPFTFR*
```

a754.seq not found yet
a754.pep not found yet
g755.seq not found yet
g755.pep not found yet The following partial DNA sequence was identified in *N. meningitidis* <SEQ ID 2589>:

m755.seq..

```
  1 ATGAGCCGTT ACCTGATTAC CTTTGATATG GATACCAACT GCCTGAAAGA
 51 CAATTACCAC GGAAATAACT ATACCAATGC CTACTCCGAT ATTAAAACCA
101 TCTTGGCTAG ACATGGATTT GAGAACATTC AGGGCAGTGT TTATCTAGGC
```

-continued

```
151 CGTGAAGGCA TCAGTGAAGC ACACGGAACA ATAGCCATTC AGGAACTGAC

201 CGCTCGGTTT GATTGGTTTT ACTCCTGTAT TTCAAACATT AAGTTTTACC

251 GCCTTGAAAG TGATTTGAAC GCACAATTTA TCGCTGATGG TGTGTATCAA

301 GCCAAACAGG CTTTCCTTCA ACGTGTTGAA CAACTTCGTA TATCCCTAAC

351 AGAAGCTGGA TTGTCTGATG AGCAAATCAA TCAGGTTCTG GAAAAACAGA

401 AATTTGAATT GGAAAGTCCT AACCTGAAAT TAAATTAA
```

This corresponds to the amino acid sequence <SEQ ID 2590; ORF 755>:

m755.pep..

```
  1 MSRYLITFDM DTNCLKDNYH GNNYTNAYSD IKTILARHGF ENIQGSVYLG

 51 REGISEAHGT IAIQELTARF DWFYSCISNI KFYRLESDLN AQFIADGVYQ

101 AKQAFLQRVE QLRISLTEAG LSDEQINQVL EKQKFELESP NLKLN*
```

a755.seq not found yet a755.pep not found yet g756.seq not found yet g756.pep not found yet The following partial DNA sequence was identified in *N. meningitidis* <SEQ ID 2591>:

m756.seq

```
  1 ATGACCGCCA ACTTTGCACA GACGCTGGTC GAAATACAGG ACAGTCTGTA

 51 CAGGGTTGTG TCAACCGTCC AATACGGGGA TGACAACCTC AAGCGGTTGA

101 CAGCGGACAA ACGGAAGCAG TATGAGTTGA ACTTCAAGAT TTCCGAGGGT

151 TCTACGCGTG TAGAGTCCGA CTTTAAAGAG ACTTTGGTTC GGTTCGGTAG

201 AGATATGCTT CAAGATATGC CCCCTAAAAT CCGTTCGGCA ACGCTGGTAG

251 CGTTGACGAC CCTGCTTGTC GGAGGGGCGT TGGGTTACGG TTATTTGGAA

301 TACCTGAAGC AGGTTGCTTC GGAAGGGTAT CAGACCGAGC GTCTGTATAA

351 TGCCGTCGAC CGTCTTGCAG AATCCCAAGA ACGGATAACG TCCGCCATCC

401 TGAAGGGTGC TAGAGGTGCC GATTTCGTGC AAATCGGCAG ACGTTCCTAC

451 AGTAGGGAGG ATATATCGGA GGCAAATAGA CGTGCAGAGC GTGTCCCGTA

501 TGGCGCAGAG TTGGTTTCAG ACGGCAATTT TACCGCTGTT TTATCTGATA

551 TAGGGGATTA A
```

This corresponds to the amino acid sequence <SEQ ID 2592; ORF 756>:

m756.pep

```
  1 MTANFAQTLV EIQDSLYRVV STVQYGDDNL KRLTADKRKQ YELNFKISEG

 51 STRVESDFKE TLVRFGRDML QDMPPKIRSA TLVALTTLLV GGALGYGYLE

101 YLKQVASEGY QTERLYNAVD RLAESQERIT SAILKGARGA DFVQIGRRSY

151 SREDISEANR RAERVPYGAE LVSDGNFTAV LSDIGD*
```

The following partial DNA sequence was identified in *N. meningitidis* <SEQ ID 2593>:

a756.seq

```
  1 ATGACCGCCA ACTTTGCACA GACGCTGGTC GAAATACAGG ACAGTCTGTA
 51 NAGGGTTGTG TCAACCGTCC AATACGGGGA TGACAACCTC AAGCGGTTGA
101 CAGCGGACAA ACGGAAGCAG TATGAGTTGA ACTTCAAGAT TTCCGAGGGT
151 TCTACGCGTG TAGAGTCCGA CTTTAAAGAG ACTTTGGTTC GGTTCGGTAG
201 AGATATGCTT CAAGATATGC CCCCTAAAAT CCGTTCGGCA ACGCTGGTAG
251 CGTTGACGAC CCTGCTTGTC GGAGGGGCGT TGGGTTACGG TTATTTGGAA
301 TACCTGAAGC AGGTTGCTTC GGAAGGGTAT CAGACCGAGC GTCTGTATAA
351 TGCCGTCGAC CGTCTTGCAG AATCCCAAGA ACGGATAACG TCCGCCATCC
401 TGAAGGGTGC TAGAGGTGCC GATTTCGTGC AAATCGGCAG ACGTTCCTAC
451 AGTAGGGAGG ATATATCGGA GGCAAATAGA CGTGCAGAGC GTGTCCCGTA
501 TGGCGCAGAG TTGGTTTCAG ACGGCAATTT TACCGCTGTT TTATCTGATA
551 TAGGGGATTA A
```

This corresponds to the amino acid sequence <SEQ ID 2594; ORF 756.a>:

a756.pep

```
  1 MTANFAQTLV EIQDSLXRVV STVQYGDDNL KRLTADKRKQ YELNFKISEG
 51 STRVESDFKE TLVRFGRDML QDMPPKIRSA TLVALTTLLV GGALGYGYLE
101 YLKQVASEGY QTERLYNAVD RLAESQERIT SAILKGARGA DFVQIGRRSY
151 SREDISEANR RAERVPYGAE LVSDGNFTAV LSDIGD*
```

m756/a756 99.5% identity in 186 aa overlap

```
                    10        20        30        40        50        60
m756.pep    MTANFAQTLVEIQDSLYRVVSTVQYGDDNLKRLTADKRKQYELNFKISEGSTRVESDFKE
            |||||||||||||||| |||||||||||||||||||||||||||||||||||||||||||
a756        MTANFAQTLVEIQDSLXRVVSTVQYGDDNLKRLTADKRKQYELNFKISEGSTRVESDFKE
                    10        20        30        40        50        60
                    70        80        90       100       110       120
m756.pep    TLVRFGRDMLQDMPPKIRSATLVALTTLLVGGALGYGYLEYLKQVASEGYQTERLYNAVD
            ||||||||||||||||||||||||||||||||||||||||||||||||||||||||||||
a756        TLVRFGRDMLQDMPPKIRSATLVALTTLLVGGALGYGYLEYLKQVASEGYQTERLYNAVD
                    70        80        90       100       110       120
                   130       140       150       160       170       180
m756.pep    RLAESQERITSAILKGARGADFVQIGRRSYSREDISEANRRAERVPYGAELVSDGNFTAV
            ||||||||||||||||||||||||||||||||||||||||||||||||||||||||||||
a756        RLAESQERITSAILKGARGADFVQIGRRSYSREDISEANRRAERVPYGAELVSDGNFTAV
                   130       140       150       160       170       180
m756.pep    LSDIGDX
            |||||||
a756        LSDIGDX
```

g757.seq not found yet g757.pep not found yet

The following partial DNA sequence was identified in *N. meningitidis* <SEQ ID 2595>:

m757.seq

1 ATGAAAATAC TCGCTTTATT AATTGCCGCT ACCTGTGCTT TATCTGCGTG

51 TGGCAGCCAA TCTGAAGAAC AACCGGCATC TGCACAACCC CAAGAGCAGG

101 CACAATCCGA ATTAAAAACC ATGCCGGTAA GCTATACCGA CTATCAATCA

151 GCAGCCAATA AAGGGCTGAA TGACCAAAAA ACCGGTCTGA CCCTTCCTGA

201 ACATGTTGTC CCTATCGACA ATGCGGAAGG AAAGAATCTG CTGCATGACT

251 TTTCAGACGG CCTCACAATC TTAACCGTTG ATACCGATAA AGCCGACAAA

301 ATTACTGCTG TCCGAGTAGT CTGGAATACA GATGCAATGC CTCAAAAAGC

351 GGAAAAACTG TCCAAAGCTG CCGCAGCCTT GATTGCGGCA ACCGCTCCGG

401 AAGACCGCAC AATGCTGCGT GATACCGGCG ACCAAATCGA AATGGCGATT

451 GACAGCCATA ATGCGCAAAA AGAGCCAACC CGAGAATGGG CGCGTGGTGG

501 GATTGCTTAT AAAGTCACTG TTACCAATTT ACCGAGCGTG GTTTTGACGG

551 CAAAAGCTGA GTAA

This corresponds to the amino acid sequence <SEQ ID 2596; ORF 757>:

m757.pep (lipoprotein)

1 MKILALLIAA TCALSACGSQ SEEQPASAQP QEQAQSELKT MPVSYTDYQS

51 AANKGLNDQK TGLTLPEHVV PIDNAEGKNL LHDFSDGLTI LTVDTDKADK

101 ITAVRVVWNT DAMPQKAEKL SKAAAALIAA TAPEDRTMLR DTGDQIEMAI

151 DSHNAQKEPT REWARGGIAY KVTVTNLPSV VLTAKAE* a757.seq not found yet
a757.pep not found yet
g758.seq not found yet
g758.pep not found yet The following partial DNA sequence was identified in *N. meningitidis* <SEQ ID 2597>:

m758.seq

1 ATGAACAATC TGACCGTGTT TACCCGTTTC GATACCGATT TGGCGACGCT

51 TGGCGATGAA TTGCAATATG TGTGGGAACA CACCGCCGTT ACAGACCATC

101 AGCGCAAACT GGTGGAAATT CCCGTCTGCT ACGGCGGCGA ATACGGCCCG

151 GATTTGGCGG AAGTCGCTGC TTTCCATCAG ACGGTTATTT CCGAAATCGT

201 CCGCCGCCAT ACGGCGCAAA CTTATACCGT ATTTATGATG GGCTTCCAGC

251 CCGGTTTCCC TTATCTGGGC GGCTTGCCCG AAGCATTGCA CACGCCCCGC

301 CGTGCCGTGC CGAGAACGTC CGTTCCTGCC GGTTCGGTCG GTATCGGCGG

351 CAGTCAGACC GGTGTGTATC CGTTCGCTTC GCCCGGCGGC TGGCAGATTA

401 TCGGCAGAAC CGAATTACCC TTGTTCCGAG CCGATTTGAA TCCGCCGACC

451 CTGCTGGCGG CGGGTGACCA AGTCCGCTTT GTTGCAGAAA GGATTGAGCC

501 ATGA

This corresponds to the amino acid sequence <SEQ ID 2598; ORF 758>:

m758.pep

```
  1 MNNLTVFTRF DTDLATLADE LQYVWEHTAV TDHQGKLVEI PVCYGGEYGP
 51 DLAEVAAFHQ TVISEIVRRH TAQTYTVFMM GFQPGFPYLG GLPEALHTPR
101 RAVPRTSVPA GSVGIGGSQT GVYPFASPGG WQIIGRTELP LFRADLNPPT
151 LLAAGDQVRF VAERIEP*
```

The following partial DNA sequence was identified in *N. meningitidis* <SEQ ID 2599>:

a758.seq

```
  1 ATGAACAATC TGACCGTGTT CACCCGTTTC GATACCGATT TGGCGACGCT
 51 TGCCGATGAA TTGCAATATG TGTGGGAACA CACCGCCGTT ACAGACCATC
101 AGGGCAAACT GGTGGAAATT CCCGTCTGCT ACGGCGGCGA ATACGGCCCG
151 GATTTGGCGG AAGTCGCTGC TTTCCATCAG ACGGTTATTT CCGAAATCGT
201 CCGCCGCCAT ACGGCGCAAA CTTATACCGT ATTTATGATG GGCTTCCAGC
251 CTGGTTTCCC TTATCTGGGC GGCTTGCCCG AAGCATTGCA CACGCCCCGC
301 CGTGCCGTGC CGAGAACGTC CGTTCCTGCC GGTTCGGTCG GTATCGGCGG
351 CAGTCAGACC GGTGTGTATC CGTTCGCTTC GCCCGGCGGC TGGCAGATTA
401 TCGGCAGAAC CGAATTACCC TTGTTCCGAG CCGATTTGAA TCCGCCGACC
451 CTGCTGGCGG CGGGTGACCA AGTCCGCTTT GTTGCAGAAA GGATTGAGCC
501 ATGA
```

This corresponds to the amino acid sequence <SEQ ID 2600; ORF 758.a>:

a758.pep..

```
  1 MNNLTVFTRF DTDLATLADE LQYVWEHTAV TDHQGKLVEI PVCYGGEYGP
 51 DLAEVAAFHQ TVISEIVRRH TAQTYTVFMM GFQPGFPYLG GLPEALHTPR
101 RAVPRTSVPA GSVGIGGSQT GVYPFASPGG WQIIGRTELP LFRADLNPPT
151 LLAAGDQVRF VAERIEP*
```

m758/a758 100.0% identity in 167 aa overlap

```
                    10        20        30        40        50        60
m758.pep    MNNLTVFTRFDTDLATLADELQYVWEHTAVTDHQGKLVEIPVCYGGEYGPDLAEVAAFHQ
            ||||||||||||||||||||||||||||||||||||||||||||||||||||||||||||
a758        MNNLTVFTRFDTDLATLADELQYVWEHTAVTDHQGKLVEIPVCYGGEYGPDLAEVAAFHQ
                    10        20        30        40        50        60
                    70        80        90       100       110       120
m758.pep    TVISEIVRRHTAQTYTVFMMGFQPGFPYLGGLPEALHTPRRAVPRTSVPAGSVGIGGSQT
            ||||||||||||||||||||||||||||||||||||||||||||||||||||||||||||
a758        TVISEIVRRHTAQTYTVFMMGFQPGFPYLGGLPEALHTPRRAVPRTSVPAGSVGIGGSQT
                    70        80        90       100       110       120
                   130       140       150       160
m758.pep    GVYPFASPGGWQIIGRTELPLFRADLNPPTLLAAGDQVRFVAERIEPX
            ||||||||||||||||||||||||||||||||||||||||||||||||
a758        GVYPFASPGGWQIIGRTELPLFRADLNPPTLLAAGDQVRFVAERIEPX
                   130       140       150       160
```

g759.seq not found yet g759.pep not found yet

The following partial DNA sequence was identified in *N. meningitidis* <SEQ ID 2601>:

m759.seq

```
   1 ATGCGCTTCA CACACACCAC CCCATTTTGT TCCGTATTGT CCACCCTCGG
  51 TCTTTTTGCC GTTTCCCCTG CTTACTCATC CATTGTCCGC AACGATGTCG
 101 ATTACCAATA TTTTCGCGAC TTTGCCGAAA ATAAAGGCGC GTTCACCGTA
 151 GGTGCAAGCA ATATTTCCAT CCAAGACAAG CAAGGCAAAA TATTAGGCAG
 201 GGTTCTCAAC GGCATCCCCA TGCCCGACTT CCGCGTCAGC AACCGCCAAA
 251 CCGCCATCGC CACCCTGGTT CACCCCCAAT ACGTCAACAG TGTCAAACAC
 301 AACGTCGGCT ACGGTTCCAT ACAATTCGGC AACGACACCC AAAATCCAGA
 351 AGAACAAGCC TATACCTACC GCCTCGTATC ACGCAACCCG CACCCGGACT
 401 ACGACTACCA CCTTCCCCGC CTCAACAAAC TGGTTACCGA AATCTCACCT
 451 ACCGCACTCA GCAGCGTACC CTTGCTTGGA AACGGCCAGC CAAAGGCCAA
 501 TGCCTACCTC GATACCGACC GCTTCCCCTA CTTTGTACGA CTCGGCTCAG
 551 GCACGCAACA AGTCCGCAAA GCAGACGGCA CGCGTACACG AACCGCCCCG
 601 GCATACCAAT ACCTGACCGG CGGCACGCCG CTGAAAGTAT TGGGGTTCCA
 651 AAACCACGGC TTACTCGTCG GCGGCAGCCT GACCGACCAA CCCCTTAACA
 701 CCTACGCAAT CGCCGGAGAC AGCGGTTCCC CCCTGTTTGC CTTCGACAAG
 751 CATGAAAACC GCTGGGTGCT TGCGGGCGTA CTCAGCACCT ACGCCGGCTT
 801 CGATAATTTC TTCAACAAAT ACATCGTCAC GCAACCCGAA TTCATCCGTT
 851 CCACCATCCG CCAATACGAA ACCCGGCTGG ATGTCGGGCT GACCACCAAC
 901 GAACTCATAT GGCGCGACAA CGGTAATGGC AACAGCACCC TGCAAGGGCT
 951 CAACGAACGC ATCACCCTGC CCATTGCAAA CCCTTCGCTT GCCCCACAAA
1001 ACGACAGCAG GCACATGCCG TCTGAAGATG CCGGCAAAAC GCTCATCCTA
1051 TCCAGCAGGT TCGACAACAA AACACTGATG CTGGCAGACA ATATCAACCA
1101 AGGCGCAGGC GCATTGCAGT TCGACAGCAA CTTCACCGTC GTCGGTAAAA
1151 ACCACACATG GCAAGGTGCA GGCGTTATCG TAGCCGACGG CAAACGCGTC
1201 TTCTGGCAAG TCAGCAACCC CAAAGGCGAC CGGCTCTCCA AACTGGGCGC
1251 AGGCACGCTT ATCGCCAACG GACAAGGCAT CAACCAGGGC GACATCAGCA
1301 TCGGGGAAGG CACTGTCGTA CTCGCCCAAA AAGCTGCTTC AGACGGCAGC
1351 AAACAAGCAT TCAACCAAGT CGGCATCACC AGCGGCAGGG GCACGGCCGT
1401 CCTCGCCGAC AGCCAGCAAA TCAAACCCGA AAACCTCTAT TTCGGCTTCA
1451 GGGGCGGACG GCTCGACCTC AACGGCAACA ACCTTGCCTT TACCCATATC
1501 CGCCATGCGG ACGGCGGCGC GCAAATCGTC AATCACAACC CTGACCAAGC
1551 CGCGACACTG ACGCTGACCG GCAACCCCGT CCTCAGTCCC GAGCATGTCG
1601 AGTGGGTGCA ATGGGGCAAC CGTCCGCAAG GCAACGCGGC GGTTTACGAA
1651 TACATCAACC CGCACCGCAA CCGTCGGACC GACTACTTCA TACTCAAACC
1701 CGGCGGCAAC CCGCGCGAAT TTTTCCCGTT AAATATGAAA AACTCAACAA
1751 GCTGGCAATT TATCGGCAAC AACAGGCAAC AGGCCGCCGA ACAAGTCGCC
```

-continued

```
1801 CAAGCCGAAA ATGCCCGCCC CGACCTGATT ACCTTCGGCG GATACTTGGG
1851 TGAAAACGCG CAAACGGGCA AAGCCGCGCC GAGTTACAGC AAAACCAATG
1901 AAGCAGCCAT AGAAAAAACC CGCCATATCG CAAATGCCGC CGTATACGGC
1951 CGGCCCGAAT ACCGTTACAA CGGCGCACTC AACCTGCACT ATCGTCCCAA
2001 ACGCACCGAC AGCACGCTGT TGCTCAACGG CGGCATGAAC CTTAACGGGG
2051 AAGTCTTGAT TGAGGGCGGC AATATGATTG TGTCAGGCAG GCCCGTACCC
2101 CATGCCTACG ACCACCAGGC CAAACGCGAA CCCGTTCTTG AAAACGAATG
2151 GACCGACGGC AGCTTCAAGG CTGCACGGTT CACCCTGCGA AACCATGCCC
2201 GACTGACGGC AGGGCGCAAT ACCGCGCATC TGGACGGCGA CATAACCGCA
2251 TACGATCTGT CCGGCATCGA CCTCGGCTTT ACCCAAGGCA AAACACCGGA
2301 ATGCTACCGC TCCTACCATA GCGGCAGCAC CCACTGCACA CCCAACGCCG
2351 TTTTAAAAGC CGAAAACTAT CGTGCACTAC CTGCAACGCA AGTACGCGGC
2401 GACATTACCC TTAACGACCG TTCAGAGCTC CGCCTGGGCA AAGCACACCT
2451 GTACGGCAGC ATCCGTGCCG GCAAAGACAC CGCAGTCCGC ATGGAAGCAG
2501 ACAGCAACTG GACACTTTCC CAGTCCAGCC ACACCGGCGC ACTGACGCTT
2551 GACGGCGCAC AAATTACCCT GAACCCCGAT TTCGCCAATA ATACACACAA
2601 CAACCGCTTC AACACACTGA CCGTCAACGG CACACTTGAC GGGTTCGGCA
2651 CATTCCGATT CCTGACCGGC ATCGTCCGAA AACAAAATGC CCCCCCCCTC
2701 AAACTGGAAG GGGACAGCCG CGGCGCATTC CAAATCCACG TCAAAAACAC
2751 CGGACAAGAA CCTCAAACAA CCGAATCGCT TGCACTTGTG AGCCTCAATC
2801 CGAAACACAG CCACCAAGCC CGATTCACCC TCCAAAACGG CTATGCCGAT
2851 TTGGGTGCCT ACCGCTACAT CCTCCGCAAA AACAACAACG GATACAGCCT
2901 GTACAACCCG CTCAAAGAGG CCGAACTTCA AATTGAAGCC ACGCGTGCGG
2951 AACATGAGCG CAACCAACAG GCATACAACC AATTACAGGC AACCGACATC
3001 AGCAGACAGG TTCAACATGA CTCTGACGCG ACCAGGCAGG CACTACAGGC
3051 CTGGCAGAAC AGTCAAACCG AACTTGCCCG CATCGACAGC CAAGTCCAAT
3101 ATCTGTCCGC CCAATTGAAA CAGACAGACC CGCTGACCGG CATTCTGACG
3151 CGTGCCCAAA ACCTGTGTGC CGCACAAGGA TACAGTGCCG ATATCTGCCG
3201 TCAGGTTGCC AAAGCCGCCG ACACGAACGA CCTGACACTC TTCGAAACCG
3251 AACTGGATAC GTATATAGAA CGTGTAGAAA TGGCCGAATC CGAACTTGAC
3301 AAAGCACGGC AAGGCGGCGA TGCGCAAGCC GTCGAAACAG CCCGGCACGC
3351 CTACCTGAAC GCACTCAACC GTCTGTCCCG ACAAATCCAC AGTTTGAAAA
3401 CCGGCGTTGC CGGCATCCGT ATGCCGAACC TGGCCGAACT GATCAGCCGG
3451 TCGGCCAACA CCGCCGTTTC CGAACAGGCC GCCTACAATA CCGGCCGGCA
3501 ACAGGCGGGA CGCCGCATCG ACCGCCACCT TACCGATCCG CAGCAGCAAA
3551 ACATCTGGCT GGAAACCGGT ACGCAACAAA CCGACTACCA TAGCGGCACA
3601 CACCGTCCCT ACCAACAAAC TACCAACTAT GCACATATCG GCATCCAAAC
3651 CGGCATCACC GACCGTCTCA GTGTCGGTAC GATTTTAACC GATGAGCGCA
3701 CAAACAACCG TTTTGATGAA GGCGTATCCG CCCGAAACCG CAGCAACGGC
3751 GCACATCTGT TCGTCAAAGG GGAAAACGGC GCACTCTTTG CCGCGGCAGA
```

-continued

```
3801 TTTAGGCTAC AGCAACAGCC GTACCCGATT TACCGATTAT GACGGGGCTG
3851 CCGTCCGCCG CCACGCATGG GATGCAGGCA TCAACACCGG CATCAAAATC
3901 GATACCGGCA TCAACCTCAG ACCCTATGCC GGCATCCGTA TAAACCGCAG
3951 CAACGGCAAC CGGTACGTAC TCGACGGCGC AGAGATAAAC AGCCCGGCGC
4001 AAATCCAAAC CACATGGCAT GCCGGCATCC GTCTCGATAA AACCGTCGAA
4051 CTGGGTCAAG CCAAGCTGAC CCCCGCCTTC AGCAGCGATT ACTACCATAC
4101 CCGCCAAAAC AGCGGTTCCG CCCTCAGCGT CAACGACCGT ACCTTACTGC
4151 AGCAAGCCGC CCACGGCACA CTGCATACCC TGCAAATCGA CGCCGGATAC
4201 AAAGGCTGGA ACGCCAAACT TCATGCCGCT TACGGCAAAG ACAGCAACAC
4251 CGCCCGCCAC AAACAGGCAG GAATCAAAAT AGGCTACAAC TGGTAA
```

This corresponds to the amino acid sequence <SEQ ID 2602; ORF 759>:

m759.pep

```
   1 MRFTHTTPFC SVLSTLGLFA VSPAYSSIVR NDVDYQYFRD FAENKGAFTV
  51 GASNISIQDK QGKILGRVLN GIPMPDFRVS NRQTAIATLV HPQYVNSVKH
 101 NVGYGSIQFG NDTQNPEEQA YTYRLVSRNP HPDYDYHLPR LNKLVTEISP
 151 TALSSVPLLG NGQPKANAYL DTDRFPYFVR LGSGTQQVRK ADGTRTRTAP
 201 AYQYLTGGTP LKVLGFQNHG LLVGGSLTDQ PLNTYAIAGD SGSPLFAFDK
 251 HENRWVLAGV LSTYAGFDNF FNKYIVTQPE FIRSTIRQYE TRLDVGLTTN
 301 ELIWRDNGNG NSTLQGLNER ITLPIANPSL APQNDSRHMP SEDAGKTLIL
 351 SSRFDNKTLM LADNINQGAG ALQFDSNFTV VGKNHTWQGA GVIVADGKRV
 401 FWQVSNPKGD RLSKLGAGTL IANGQGINQG DISIGEGTVV LAQKAASDGS
 451 KQAFNQVGIT SGRGTAVLAD SQQIKPENLY FGFRGGRLDL NGNNLAFTHI
 501 RHADGGAQIV NHNPDQAATL TLTGNPVLSP EHVEWVQWGN RPQGNAAVYE
 551 YINPHRNRRT DYFILKPGGN PREFFPLNMK NSTSWQFIGN NRQQAAEQVA
 601 QAENARPDLI TFGGYLGENA QTGKAAPSYS KTNEAAIEKT RHIANAAVYG
 651 RPEYRYNGAL NLHYRPKRTD STLLLNGGMN LNGEVLIEGG NMIVSGRPVP
 701 HAYDHQAKRE PVLENEWTDG SFKAARFTLR NHARLTAGRN TAHLDGDITA
 751 YDLSGIDLGF TQGKTPECYR SYHSGSTHCT PNAVLKAENY RALPATQVRG
 801 DITLNDRSEL RLGKAHLYGS IRAGKDTAVR MEADSNWTLS QSSHTGALTL
 851 DGAQITLNPD FANNTHNNRF NTLTVNGTLD GFGTFRFLTG IVRKQNAPPL
 901 KLEGDSRGAF QIHVKNTGQE PQTTESLALV SLNPKHSHQA RFTLQNGYAD
 951 LGAYRYILRK NNNGYSLYNP LKEAELQIEA TRAEHERNQQ AYNQLQATDI
1001 SRQVQHDSDA TRQALQAWQN SQTELARIDS QVQYLSAQLK QTDPLTGILT
1051 RAQNLCAAQG YSADICRQVA KAADTNDLTL FETELDTYIE RVEMAESELD
1101 KARQGGDAQA VETARHAYLN ALNRLSRQIH SLKTGVAGIR MPNLAELISR
1151 SANTAVSEQA AYNTGRQQAG RRIDRHLTDP QQQNIWLETG TQQTDYHSGT
1201 HRPYQQTTNY AHIGIQTGIT DRLSVGTILT DERTNNRFDE GVSARNRSNG
1251 AHLFVKGENG ALFAAADLGY SNSRTRFTDY DGAAVRRHAW DAGINTGIKI
```

-continued

```
1301 DTGINLRPYA GIRINRSNGN RYVLDGAEIN SPAQIQTTWH AGIRLDKTVE

1351 LGQAKLTPAF SSDYYHTRQN SGSALSVNDR TLLQQAAHGT LHTLQIDAGY

1401 KGWNAKLHAA YGKDSNTARH KQAGIKIGYN W*
```

The following partial DNA sequence was identified in *N. gonorrhoeae* <SEQ ID 2603>:

g760.seq (partial)

```
  1 AACAACCGCA ACACCCGTTA CGCCGCATTG GGCAAACGCG TGATGGAAGG

 51 CGTTGAGACC GAAATCAGCG GTGCGATTAC ACCGAAATGG CAAATCCATG

101 CAGGTTACAG CTATCTGCAC AGCCAAATCA AAACCGCCGC CAATCCACGC

151 GACGACGGCA TCTTCCTGCT GGTGCCCAAA CACAGCGCAA ACCTGTGGAC

201 GACTTACCAA GTTACGCCCG GGCTGACCGT CGGCGGCGGC GTGAACGCGA

251 TGAGCGGCAT TACTTCATCT GCAGGGATGC ATGCAGGCGG TTATGCCACG

301 TTCGATGCGA TGGCGGCATA CCGCTTCACG CCCAAGCTGA AGCTGCAAAT

351 CAATGCCGAC AACATCTTCA ACCGCCATTA CTACGCCCGC GTCGGCGGCA

401 CGAACACCTT TAACATTCCC GGTTCGGAGC GCAGCCTGAC GGCAAACCTG

451 CGTTACAGTT TTTAA
```

This corresponds to the amino acid sequence <SEQ ID 2604; ORF 760.ng>:

g760.pep (partial)

```
  1 NNRNTRYAAL GKRVMEGVET EISGAITPKW QIHAGYSYLH SQIKTAANPR

 51 DDGIFLLVPK HSANLWTTYQ VTPGLTVGGG VNAMSGITSS AGMHAGGYAT

101 FDAMAAYRFT PKLKLQINAD NIFNRHYYAR VGGTNTFNIP GSERSLTANL

151 RYSF*
```

The following partial DNA sequence was identified in *N. meningitidis* <SEQ ID 2605>:

m760.seq

```
  1 ATGGGACAGT TTATGTCAGT TTTCCGCATC AATATGACCG CCGCCACGGT

 51 TTTGGCAGCA CTCTCGTCTT CGGTTTTTGC CGCACAAACG GAAGGTTTGG

101 AAACCGTCCA TATTAAGGGT CAGCGTTCTT ACAACGCGAT TGCCACCGAG

151 AAAAACGGCG ATTACAGCTC GTTTGCCGCC ACCGTCGGTA CAAAAATCCC

201 CGCTTCTTTG CGCGAAATTC CGCAATCCGT CAGCATCATT ACCAACCAGC

251 AGGTCAAAGA CCGCAATGTT GATACGTTTG ACCAGTTGGC ACGCAAAACG

301 CCCGGCCTGC GCGTGTTGAG CAACGACGAC GGACGCTCTT CGGTTTACGC

351 GCGCGGTTAC GAATACAGCG AATACAACAT CGACGGCCTG CCCGCGCAGA

401 TGCAGAGTAT GAACGGCACG CTGCCCAACC TGTTCGCCTT CGACCGCGTG

451 GAAGTGATGC GCGGGCCGAG CGGACTGTTC GACAGCAGCG GCGAGATGGG
```

-continued

```
 501 CGGCATCGTG AATCTGGTGC GCAAACGCCC GACCAAAGCG TTCCAAGGTC
 551 ATGCGGCGGC AGGGTTCGGT ACGCACAAAC AATATAAAGC CGAGGCGGAC
 601 GTATCGGGCA GCCTCAATTC AGACGGCAGC GTGCGCGGCC GCGTGATGGC
 651 GCAGACCGTC GGCGCGTCTC CGCGTCCCGC CGAGAAAAAC AACCGGCGCG
 701 AAACCTTCTA CGCGGCGGCG GATTGGGACA TCAACCCCGA TACGGTTTTG
 751 GGCGCGGGCT ATCTTTACCA GCAACGCCGC CTCGCGCCGT ACAACGGCCT
 801 GCCTGCCGAT GCCAATAACA AATTACCGTC CCTGCCGCAA CACGTATTTG
 851 TCGGCGCGGA TTGGAACAAA TTTAAAATGC ACAGCCACGA CGTCTTCGCC
 901 GATTTGAAAC ATTACTTCGG CAACGGCGGC TACGGCAAAG TCGGTATGCG
 951 CTATTCCGAT CGGAAAGCCG ATTCCAATTA TACGTTTGCG GGCAGCAAAC
1001 TCAACAATAC CGGACAAGCC GACGTAGCGG GTTTGGGTAC GGACATTAAA
1051 CAAAAAGCCT TTGCGGTTGA CGCAAGTTAC AGCCGTCCGT TTGCCTTGGG
1101 CAACACCGCC AACGAATTTG TGATTGGTGC AGACTACAAC CGCTTGCGCA
1151 GTACTAATGA ACAAGGGCGT TCGACTTTGT CAAAAAGCGT CGCTTTAGAT
1201 GGTTTCCGCG CTTTGCCTTA TAACGGCATA CTTCAGAACG CCCGCGCCGG
1251 AAACAAAGGT TTCAATCACT CCGTTACCGA AGAAAACCTC GACGAAACCG
1301 GTTTGTATGC CAAGACGGTG TTCCGTCCTC TGGAAGGTTT GTCGTTGATT
1351 GCAGGCGGAC GTGTAGGACA TCACAAAATC GAGTCGGGCG ACGGCAAAAC
1401 CCTGCATAAA GCTTCGAAAA CCAAATTTAC AAGCTACGCC GGCGCGGTTT
1451 ACGATATAGA CGGCAGCAAC AGCCTGTACG CTTCCGCCTC CCAACTCTAC
1501 ACACCGCAAA CCAGCATCGG CACCGACGGC AAGCTGCTCA AACCGCGCGA
1551 AGGCAACCAG TTTGAAATCG GCTACAAAGG CAGCTACATG GACGACCGCC
1601 TCAATACCCG GGTTTCGTTC TACCGCATGA AGGATAAAAA CGCCCCCGCA
1651 CCGCTGGACT CAAACAACAA AAAAACCCGT TACGCCGCAT TGGGCAAACG
1701 CGTGATGGAA GGTGTTGAGA CCGAAATCAG CGGCGCGATG ACACCGAAAT
1751 GGCAAATCCA TGCAGGTTAC AGCTACCTGC ACAGCCAAAT CAAAACCGCC
1801 TCCAATTCGC GCGACGAAGG CATCTTCCTG CTGATGCCCA AACACAGCGC
1851 AAACCTGTGG ACGACTTACC AAGTTACGTC CGGGCTGACC ATCGGCGGCG
1901 GCGTGAACGC GATGAGCGGC ATTACTTCAT CTGCAGGGAT ACATGCAGGC
1951 GGTTATGCCA CGTTCGATGC GATGGCGGCA TACCGCTTCA CGCCCAAACT
2001 GAAGCTGCAA ATCAACGCCG ACAACATCTT CAACCGCCAT TACTACGCCC
2051 GCGTCGGCAG CGAGAGCACC TTTAACATTC CCGGTTCGGA GCGCAGCCTG
2101 ACGGCAAACC TGCGTTACAG TTTTTAA
```

This corresponds to the amino acid sequence <SEQ ID 2606; ORF 760>:

m760.pep

```
 1 MGQFMSVFRI NMTAATVLAA LSSSVFAAQT EGLETVHIKG QRSYNAIATE
51 KNGDYSSFAA TVGTKIPASL REIPQSVSII TNQQVKDRNV DTFDQLARKT
```

-continued

```
101 PGLRVLSNDD GRSSVYARGY EYSEYNIDGL PAQMQSINGT LPNLFAFDRV

151 EVMRGPSGLF DSSGEMGGIV NLVRKRPTKA FQGHAAAGFG THKQYKAEAD

201 VSGSLNSDGS VRGRVMAQTV GASPRPAEKN NRRETFYAAA DWDINPDTVL

251 GAGYLYQQRR LAPYNGLPAD ANNKLPSLPQ HVFVGADWNK FKMHSHDVFA

301 DLKHYFGNGG YGKVGMRYSD RKADSNYTFA GSKLNNTGQA DVAGLGTDIK

351 QKAFAVDASY SRPFALGNTA NEFVIGADYN RLRSTNEQGR STLSKSVALD

401 GFRALPYNGI LQNARAGNKG FNHSVTEENL DETGLYAKTV FRPLEGLSLI

451 AGGRVGHHKI ESGDGKTLHK ASKTKFTSYA GAVYDIDGSN SLYASASQLY

501 TPQTSIGTDG KLLKPREGNQ FEIGYKGSYM DDRLNTRVSF YRMKDKNAAA

551 PLDSNNKKTR YAALGKRVME GVETEISGAM TPKWQIHAGY SYLHSQIKTA

601 SNSRDEGIFL LMPKHSANLW TTYQVTSGLT IGGGVNAMSG ITSSAGIHAG

651 GYATFDAMAA YRFTPKLKLQ INADNIFNRH YYARVGSEST FNIPGSERSL

701 TANLRYSF*
```

m760/g760 91.6% identity in 154 aa overlap

```
                530       540       550       560       570       580
m760.pep    YKGSYMDDRLNTRVSFYRMKDKNAAAPLDSNNKKTRYAALGKRVMEGVETEISGAMTPKW
                                          ||::|||||||||||||||||||||:||||
g760                                      NNRNTRYAALGKRVMEGVETEISGAITPKW
                                                   10        20        30

                590       600       610       620       630       640
m760.pep    QIHAGYSYLHSQIKTASNSRDEGIFLLMPKHSANLWTTYQVTSGLTIGGGVNAMSGITSS
            ||||||||||||||||:| ||:|||||:|||||||||||||| |||:|||||||||||||
g760        QIHAGYSYLHSQIKTAANPRDDGIFLLVPKHSANLWTTYQVTPGLTVGGGVNAMSGITSS
                    40        50        60        70        80        90

                650       660       670       680       690       700
m760.pep    AGIHAGGYATFDAMAAYRFTPKLKLQINADNIFNRHYYARVGSESTFNIPGSERSLTANL
            ||:||||||||||||||||||||||||||||||||||||||: :|||||||||||||||
g760        AGMHAGGYATFDAMAAYRFTPKLKLQINADNIFNRHYYARVGGTNTFNIPGSERSLTANL
                   100       110       120       130       140       150

                709
m760.pep    RYSFX
            |||||
g760        RYSFX
```

g761.seq not found yet g761.pep not found yet

The following partial DNA sequence was identified in *N. meningitidis* <SEQ ID 2607>:

m761.seq

```
  1 ATGAAAATAT CATTTCATTT AGCTTTATTA CCCACGCTGA TTATTGCTTC

 51 CTTCCCTGTT GCTGCCGCCG ATACGCAGGA CAATGGTGAA CATTACACCG

101 CCACTCTGCC CACCGTTTCC GTGGTCGGAC AGTCCGACAC CAGCGTACTC

151 AAAGGCTACA TCAACTACGA CGAAGCCGCC GTTACCCGCA ACGGACAGCT

201 CATCAAAGAA ACGCCGCAAA CCATCGATAC GCTCAATATC CAGAAAAACA

251 AAAATTACGG TACGAACGAT TTGAGTTCCA TCCTCGAAGG CAATGCCGGC

301 ATCGACGCTG CCTACGATAT GCGCGGTGAA AGCATTTTCC TGCGCGGTTT

351 TCAAGCCGAC GCATCCGATA TTTACCGCGA CGGCGTGCGC GAAAGCGGAC

401 AAGTGCGCCG CAGTACTGCC AACATCGAGC GCGTGGAAAT CCTGAAAGGC
```

-continued

```
 451 CCGTCTTCCG TGCTTTACGG CCGCACCAAC GGCGGCGGCG TCATCAACAT
 501 GGTCAGCAAA TACGCCAACT TCAAACAAAG CCGCAACATC GGAGCGGTTT
 551 ACGGCTCATG GGCAAACCGC AGCCTGAATA TGGACATTAA CGAAGTGCTG
 601 AACAAAAACG TCGCCATCCG TCTCACCGGC GAAGTCGGGC GCGCCAATTC
 651 GTTCCGCAGC GGCATAGACA GCAAAAATGT CATGGTTTCG CCCAGCATTA
 701 CCGTCAAACT CGACAACGGC TTGAAGTGGA CGGGGCAATA CACCTACGAC
 751 AATGTGGAGC GCACGCCCGA CCGCAGTCCG ACCAAGTCCG TGTACGACCG
 801 CTTCGGACTG CCTTACCGCA TGGGGTTCGC CCACCGGAAC GATTTTGTCA
 851 AAGACAAGCT GCAAGTTTGG CGTTCCGACC TTGAATACGC CTTCAACGAC
 901 AAATGGCGTG CCCAATGGCA GCTCGCCCAC CGCACGGCGG CGCAGGATTT
 951 TGATCATTTC TATGCAGGCA GCGAAAATGG CAACTTAATC AAACGTAACT
1001 ACGCCTGGCA GCAGACCGAC AACAAAACCC TGTCGTCCAA CTTAACGCTC
1051 AACGGCGACT ACACCATCGG CCGTTTTGAA AACCACCTGA CCGTAGGCAT
1101 GGATTACAGC CGCGAACACC GCAACCCGAC ATTGGGTTTC AGCAGCGCCT
1151 TTTCCGCCTC CATCAACCCC TACGACCGCG CAAGCTGGCC GGCTTCGGGC
1201 AGATTGCAGC CTATTCTGAC CCAAAACCGC CACAAAGCCG ACTCCTACGG
1251 CATCTTTGTG CAAAACATCT TCTCCGCCAC GCCCGATTTG AAATTCGTCC
1301 TCGGCGGCCG TTACGACAAA TACACCTTTA ATTCCGAAAA CAAACTCACC
1351 GGCAGCAGCC GCCAATACAG CGGACACTCG TTCAGCCCCA ACATCGGCGC
1401 AGTGTGGAAC ATCAATCCCG TCCACACACT TTACGCCTCG TATAACAAAG
1451 GCTTCGCGCC TTATGGCGGA CGCGGCGGCT ATTTGAGCAT CGATACGTTG
1501 TCTTCCGCCG TGTTCAACGC CGACCCCGAG TACACCCGCC AATACGAAAC
1551 CGGCGTGAAA AGCAGTTGGC TGGACGACCG CCTCAGCACT ACGTTGTCTG
1601 CCTACCAAAT CGAACGCTTC AATATCCGCT ACCGCCCCGA TCCAAAAAAC
1651 AACCCTTATA TTTATGCGGT TAGCGGCAAA CACCGTTCGC GCGGCGTGGA
1701 ATTGTCCGCC ATCGGGCAAA TCATCCCCAA AAAACTCTAT CTGCGCGGTT
1751 CGTTGGGCGT GATGCAGGCG AAAGTCGTTG AAGACAAAGA AAATCCCGAC
1801 CGAGTGGGCA TCCATTTGAA TAATACCAGC AACGTTACCG GCAACCTGTT
1851 TTTCCGTTAT ACCCCGACCG AAAACCTCTA CGGCGAAATC GGCGTAACCG
1901 GTACAGGCAA ACGCTACGGT TACAACTCAA GAAATAAAGA AGTGACTACG
1951 CTTCCAGGCT TTGCCCGAGT TGATGCCATG CTTGGCTGGA ACCATAAAAA
2001 TGTTAACGTT ACCTTTGCCG CAGCCAATCT GCTCAATCAA AAATATTGGC
2051 GTTCGGACTC TATGCCGGGT AATCCGCGCG GCTATACTGC CCGGGTAAAT
2101 TACCGTTTCT GA
```

This corresponds to the amino acid sequence <SEQ ID 2608; ORF 761>:

m761.pep

```
 1 MKISFHLALL PTLIIASFPV AAADTQDNGE HYTATLPTVS VVGQSDTSVL
51 KGYINYDEAA VTRNGQLIKE TPQTIDTLNI QKNKNYGTND LSSILEGNAG
```

-continued

```
101 IDAAYDMRGE SIFLRGFQAD ASDIYRDGVR ESGQVRRSTA NIERVEILKG
151 PSSVLYGRTN GGGVINMVSK YANFKQSRNI GAVYGSWANR SLNMDINEVL
201 NKNVAIRLTG EVGRANSFRS GIDSKNVMVS PSITVKLDNG LKWTGQYTYD
251 NVERTPDRSP TKSVYDRFGL PYRMGFAHRN DFVKDKLQVW RSDLEYAFND
301 KWRAQWQLAH RTAAQDFDHF YAGSENGNLI KRNYAWQQTD NKTLSSNLTL
351 NGDYTIGRFE NHLTVGMDYS REHRNPTLGF SSAFSASINP YDRASWPASG
401 RLQPILTQNR HKADSYGIFV QNIFSATPDL KFVLGGRYDK YTFNSENKLT
451 GSSRQYSGHS FSPNIGAVWN INPVHTLYAS YNKGFAPYGG RGGYLSIDTL
501 SSAVFNADPE YTRQYETGVK SSWLDDRLST TLSAYQIERF NIRYRPDPKN
551 NPYIYAVSGK HRSRGVELSA IGQIIPKKLY LRGSLGVMQA KVVEDKENPD
601 RVGIHLNNTS NVTGNLFFRY TPTENLYGEI GVTGTGKRYG YNSRNKEVTT
651 LPGFARVDAM LGWNHKNVNV TFAAANLLNQ KYWRSDSMPG NPRGYTARVN
701 YRF*
```

The following partial DNA sequence was identified in *N. meningitidis* <SEQ ID 2609>:

a761.seq

```
   1 ATGAAAATAT CATTTCATTT AGCTTTATTA CCCACGCTGA TTATTGCTTC
  51 CTTCCCTGTT GCTGCCGCCG ATACGCAGGA CAATGGTGAA CATTACACCG
 101 CCACTCTGCC CACCGTTTCC GTGGTCGGAC AGTCCGACAC CAGCGTACTC
 151 AAAGGCTACA TCAACTACGA CGAAGCCGCC GTTACCCGCA ACGGACAGCT
 201 CATCAAAGAA ACGCCGCAAA CCATCGATAC GCTCAATATC CAGAAAAACA
 251 AAAATTACGG CACGAACGAT TTGAGTTCCA TCCTCGAAGG CAATGCCGGC
 301 ATCGACGCCG CCTACGATAT GCGCGGCGAA AGCATTTTCC TGCGCGGCTT
 351 TCAAGCCGAC GCATCTGATA TTTACCGCGA CGGCGTACGC GAAAGCGGGC
 401 AGGTGCGCCG TAGCACCGCC AACATCGAGC GCGTGGAAAT CCTGAAAGGT
 451 CCGTCCTCCG TGCTTTATGG GCGTACCAAC GGCGGCGGTG TCATCAACAT
 501 GGTCAGCAAA TACGCCAACT TCAAACAAAG CCGTAATATC GGTACGGTTT
 551 ATGGTTCGTG GGCAAACCGC AGCCTGAATA TGGACATCAA CGAAGTCCTG
 601 AACAAAAACG TCGCCATCCG TCTCACCGGC GAAGTCGGGC GCGCCAATTC
 651 GTTCCGCAGC GGCATAGACA GCAAAAATGT CATGGTTTCG CCCAGCATTA
 701 CCGTCAAACT CGACAACGGC TTGAAGTGGA CGGGGCAATA CACCTACGAC
 751 AATGTGGAGC GCACGCCCGA CCGCAGTCCG ACCAAGTCCG TGTACGACCG
 801 CTTCGGACTG CCTTACCGCA TGGGGTTCGC CCACCGGAAC GATTTTGTCA
 851 AAGACAAGCT GCAAGTTTGG CGTTCCGACC TTGAATACGC CTTCAACGAC
 901 AAATGGCGTG CCCAATGGCA GCTCGCCCAC CGCACGGCGG CGCAGGATTT
 951 TGATCATTTC TATGCAGGCA GCGAAAATGG CAACTTAATC AAACGTAACT
1001 ACGCCTGGCA GCAGACCGAC AACAAAACCC TGTCGTCCAA CTTAACGCTC
1051 AACGGCGACT ACACCATCGG CCGTTTTGAA AACCACCTGA CCGTAGGCAT
```

-continued

```
1101 GGATTACAGC CGCGAACACC GCAACCCGAC ATTGGGTTTC AGCAGCGCCT
1151 TTTCCGCCTC CATCAACCCC TACGACCGCG CAAGCTGGCC GGCTTCGGGC
1201 AGATTGCAGC CTATTCTGAC CCAAAACCGC CACAAAGCCG ACTCCTACGG
1251 CATCTTTGTG CAAAACATCT TCTCCGCCAC GCCCGATTTG AAATTCGTCC
1301 TCGGCGGCCG TTACGACAAA TACACCTTTA ATTCCGAAAA CAAACTCACC
1351 GGCAGCAGCC GCCAATACAG CGGACACTCG TTCAGCCCCA ACATCGGCGC
1401 AGTGTGGAAC ATCAATCCCG TCCACACACT TTACGCCTCG TATAACAAAG
1451 GCTTCGCGCC TTATGGCGGA CGCGGCGGCT ATTTGAGCAT CGATACGTTG
1501 TCTTCCGCCG TGTTCAACGC CGACCCCGAG TACACCCGCC AATACGAAAC
1551 CGGCGTGAAA AGCAGTTGGC TGGACGACCG CCTCAGCACT ACGTTGTCTG
1601 CCTACCAAAT CGAACGCTTC AATATCCGCT ACCGCCCCGA TCCAAAAAAC
1651 AACCCTTATA TTTATGCGGT TAGCGGCAAA CACCGTTCGC GCGGCGTGGA
1701 ATTGTCCGCC ATCGGGCAAA TCATCCCCAA AAAACTCTAT CTGCGCGGTT
1751 CGTTGGGCGT GATGCAGGCG AAAGTCGTTG AAGACAAAGA AAATCCCGAC
1801 CGAGTGGGCA TCCATTTGAA TAACACCAGC AACGTTACCG GCAACCTGTT
1851 TTTCCGTTAT ACCCCGACCG AAAACCTCTA CGGCGAAATC GGCGTAACCG
1901 GTACAGGCAA ACGCTACGGT TACGACTCAA GAAATAAAGA AGTGACTACG
1951 CTTCCAGGCT TTGCCCGAGT TGATGCCATG CTTGGCTGGA ACCATAAAAA
2001 TGTTAACGTT ACCTTTGCCG CAGCCAATCT GTTCAATCAA AAATATTGGC
2051 GTTCGGACTC TATGCCGGGT AATCCGCGCG GCTATACTGC CCGGGTAAAT
2101 TACCGTTTCT GA
```

This corresponds to the amino acid sequence <SEQ ID 2610; ORF 761.a>:

a761.pep

```
  1 MKISFHLALL PTLIIASFPV AAADTQDNGE HYTATLPTVS VVGQSDTSVL
 51 KGYINYDEAA VTRNGQLIKE TPQTIDTLNI QKNKNYGTND LSSILEGNAG
101 IDAAYDMRGE SIFLRGFQAD ASDIYRDGVR ESGQVRRSTA NIERVEILKG
151 PSSVLYGRTN GGGVINMVSK YANFKQSRNI GTVYGSWANR SLNMDINEVL
201 NKNVAIRLTG EVGRANSFRS GIDSKNVMVS PSITVKLDNG LKWTGQYTYD
251 NVERTPDRSP TKSVYDRFGL PYRMGFAHRN DFVKDKLQVW RSDLEYAFND
301 KWRAQWQLAH RTAAQDFDHF YAGSENGNLI KRNYAWQQTD NKTLSSNLTL
351 NGDYTIGRFE NHLTVGMDYS REHRNPTLGF SSAFSASINP YDRASWPASG
401 RLQPILTQNR HKADSYGIFV QNIFSATPDL KFVLGGRYDK YTFNSENKLT
451 GSSRQYSGHS FSPNIGAVWN INPVHTLYAS YNKGFAPYGG RGGYLSIDTL
501 SSAVFNADPE YTRQYETGVK SSWLDDRLST TLSAYQIERF NIRYRPDPKN
551 NPYIYAVSGK HRSRGVELSA IGQIIPKKLY LRGSLGVMQA KVVEDKENPD
601 RVGIHLNNTS NVTGNLFFRY TPTENLYGEI GVTGTGKRYG YDSRNKEVTT
651 LPGFARVDAM LGWNHKNVNV TFAAANLFNQ KYWRSDSMPG NPRGYTARVN
701 YRF*
```

m761/a761 99.6% identity in 703 aa overlap

```
                    10        20        30        40        50        60
m761.pep    MKISFHLALLPTLIIASFPVAAADTQDNGEHYTATLPTVSVVGQSDTSVLKGYINYDEAA
            ||||||||||||||||||||||||||||||||||||||||||||||||||||||||||||
a761        MKISFHLALLPTLIIASFPVAAADTQDNGEHYTATLPTVSVVGQSDTSVLKGYINYDEAA
                    10        20        30        40        50        60

                    70        80        90       100       110       120
m761.pep    VTRNGQLIKETPQTIDTLNIQKNKNYGTNDLSSILEGNAGIDAAYDMRGESIFLRGFQAD
            ||||||||||||||||||||||||||||||||||||||||||||||||||||||||||||
a761        VTRNGQLIKETPQTIDTLNIQKNKNYGTNDLSSILEGNAGIDAAYDMRGESIFLRGFQAD
                    70        80        90       100       110       120

                   130       140       150       160       170       180
m761.pep    ASDIYRDGVRESGQVRRSTANIERVEILKGPSSVLYGRTNGGGVINMVSKYANFKQSRNI
            ||||||||||||||||||||||||||||||||||||||||||||||||||||||||||||
a761        ASDIYRDGVRESGQVRRSTANIERVEILKGPSSVLYGRTNGGGVINMVSKYANFKQSRNI
                   130       140       150       160       170       180

                   190       200       210       220       230       240
m761.pep    GAVYGSWANRSLNMDINEVLNKNVAIRLTGEVGRANSFRSGIDSKNVMVSPSITVKLDNG
            |:||||||||||||||||||||||||||||||||||||||||||||||||||||||||||
a761        GTVYGSWANRSLNMDINEVLNKNVAIRLTGEVGRANSFRSGIDSKNVMVSPSITVKLDNG
                   190       200       210       220       230       240

                   250       260       270       280       290       300
m761.pep    LKWTGQYTYDNVERTPDRSPTKSVYDRFGLPYRMGFAHRNDFVKDKLQVWRSDLEYAFND
            ||||||||||||||||||||||||||||||||||||||||||||||||||||||||||||
a761        LKWTGQYTYDNVERTPDRSPTKSVYDRFGLPYRMGFAHRNDFVKDKLQVWRSDLEYAFND
                   250       260       270       280       290       300

                   310       320       330       340       350       360
m761.pep    KWRAQWQLAHRTAAQDFDHFYAGSENGNLIKRNYAWQQTDNKTLSSNLTLNGDYTIGRFE
            ||||||||||||||||||||||||||||||||||||||||||||||||||||||||||||
a761        KWRAQWQLAHRTAAQDFDHFYAGSENGNLIKRNYAWQQTDNKTLSSNLTLNGDYTIGRFE
                   310       320       330       340       350       360

                   370       380       390       400       410       420
m761.pep    NHLTVGMDYSREHRNPTLGFSSAFSASINPYDRASWPASGRLQPILTQNRHKADSYGIFV
            ||||||||||||||||||||||||||||||||||||||||||||||||||||||||||||
a761        NHLTVGMDYSREHRNPTLGFSSAFSASINPYDRASWPASGRLQPILTQNRHKADSYGIFV
                   370       380       390       400       410       420

                   430       440       450       460       470       480
m761.pep    QNIFSATPDLKFVLGGRYDKYTFNSENKLTGSSRQYSGHSFSPNIGAVWNINPVHTLYAS
            ||||||||||||||||||||||||||||||||||||||||||||||||||||||||||||
a761        QNIFSATPDLKFVLGGRYDKYTFNSENKLTGSSRQYSGHSFSPNIGAVWNINPVHTLYAS
                   430       440       450       460       470       480

                   490       500       510       520       530       540
m761.pep    YNKGFAPYGGRGGYLSIDTLSSAVFNADPEYTRQYETGVKSSWLDDRLSTTLSAYQIERF
            ||||||||||||||||||||||||||||||||||||||||||||||||||||||||||||
a761        YNKGFAPYGGRGGYLSIDTLSSAVFNADPEYTRQYETGVKSSWLDDRLSTTLSAYQIERF
                   490       500       510       520       530       540

                   550       560       570       580       590       600
m761.pep    NIRYRPDPKNNPYIYAVSGKHRSRGVELSAIGQIIPKKLYLRGSLGVMQAKVVEDKENPD
            ||||||||||||||||||||||||||||||||||||||||||||||||||||||||||||
a761        NIRYRPDPKNNPYIYAVSGKHRSRGVELSAIGQIIPKKLYLRGSLGVMQAKVVEDKENPD
                   550       560       570       580       590       600

                   610       620       620       640       650       660
m761.pep    RVGIGLNNTSNVTGNLFFRYTPTENLYGEIGVTGTGKRYGYNSRNKEVTTLPGFARVDAM
            |||||||||||||||||||||||||||||||||||||||||:||||||||||||||||||
a761        RVGIGLNNTSNVTGNLFFRYTPTENLYGEIGVTGTGKRYGYDSRNKEVTTLPGFARVDAM
                   610       620       630       640       650       660

                   670       680       690       700
m761.pep    LGWNHKNVNVTFAAANLLNQKYWRSDSMPGNPRGYTARVNYRFX
            ||||||||||||||||:|||||||||||||||||||||||||||
a761        LGWNHKNVNVTFAAANLFNQKYWRSDSMPGNPRGYTARVNYRFX
                   670       680       690       700
```

g762.seq Not yet found g762.pep Not yet found

The following partial DNA sequence was identified in *N. meningitidis* <SEQ ID 2611>:

m762.seq

```
  1 ATGAAGTGGT TATTAAATAT GATAATGAGA CCTATTAAAT TTAGTATGGT

 51 AAATACGTTA TTATTTATTG TTATATGTAG TTCATTTTTT GATCTGCTCG

101 TTCAATTATG TACAATTTTA TTTCATAGCC AAAAAATATA CTTTATTACA

151 TTATTTTTAT TATTTATTTT TAATTTTGTT ACAAAATCTA TCTATATGGC
```

-continued

```
201 AATTATTTAT CCTATTTTAT ATTTTTTTAC GATAAAAAAA TATTATCCTT

251 ACTCTAGGAA AGTGATAATT CTATTATCAT TAGCATTATC TATATATTTT

301 AGTTTTATGG ACTTTTACTT TTTTTCCATA TATTCAGATA ACCTTAGCTA

351 TGAAACGGAG CCTTTACATT TATACATCCC TATTATTATT AATTTTTTCT

401 CACTTTTAGT TTCTAATTTT ATTTTATCTT TTATCAACAA GTAA
```

This corresponds to the amino acid sequence <SEQ ID 2612; ORF 762>:

m762.pep

```
  1 MKWLLNMIMR PIKFSMVNTL LFIVICSSFF DLLVQLCTIL FHSQKIYFIT

 51 LFLLFIFNFV TKSIYMAIIY PILYFFTIKK YYPYSRKVII LLSLALSIYF

101 SFMDFYFFSI YSDNLSYETE PLHLYIPIII NFFSLLVSNF ILSFINK*
```

The following partial DNA sequence was identified in *N. meningitidis* <SEQ ID 2613>:

a762.seq

```
  1 ATGAAGTGGT TATTAAATAT GATAATGAGA CCTATTAAAT TTAGTATGGT

 51 AAATACGTTA TTATTTATTG TTATATGTAG TTCATTTTTT GATCTGCTCG

101 TTCAATTATG TACAATTTTA TTTCATAGCC AAAAAATATA CTTTATTACA

151 TTATTTTTAT TATTTATTTT TAATTTTGTT ACAAAATCTA TCTATATGGC

201 AATTATTTAT CCTATTTTAT ATTTTTTTAC GATAAAAAAA TATTATCCTT

251 ACTCTAGGAA AGTGATAATT CTATTATCAT TAGCATTATC TATATATTTT

301 AGTTTTATGG ACTTTTACTT TTTTTCCATA TATTCAGATA ACCTTAGCTA

351 TGAAACGGAG CCTTTACATT TATACATCCC TATTATTATT AATTTTTTCT

401 CACTTTTAGT TTCTAATTTT ATTTTATCTT TTATCAACAA GTAA
```

This corresponds to the amino acid sequence <SEQ ID 2614; ORF 762.a>:

a762.pep

```
  1 MKWLLNMIMR PIKFSMVNTL LFIVICSSFF DLLVQLCTIL FHSQKIYFIT

 51 LFLLFIFNFV TKSIYMAIIY PILYFFTIKK YYPYSRKVII LLSLALSIYF

101 SFMDFYFFSI YSDNLSYETE PLHLYIPIII NFFSLLVSNF ILSFINK*
```

m762/a762 100.0% identity in 147 aa overlap

```
                    10        20        30        40        50        60
m762.pep    MKWLLNMIMRPIKFSMVNTLLFIVICSSFFDLLVQLCTILFHSQKIYFITLFLLFIFNFV
            ||||||||||||||||||||||||||||||||||||||||||||||||||||||||||||
a762        MKWLLNMIMRPIKFSMVNTLLFIVICSSFFDLLVQLCTILFHSQKIYFITLFLLFIFNFV
                    10        20        30        40        50        60
```

-continued

```
                 70        80        90       100       110       120
m762.pep    TKSIYMAIIYPILYFFTIKKYYPYSRKVIILLSLALSIYFSFMDFYFFSIYSDNLSYETE
            ||||||||||||||||||||||||||||||||||||||||||||||||||||||||||||
a762        TKSIYMAIIYPILYFFTIKKYYPYSRKVIILLSLALSIYFSFMDFYFFSIYSDNLSYETE
                 70        80        90       100       110       120

                130       140
m762.pep    PLHLYIPIIINFFSLLVSNFILSFINKX
            ||||||||||||||||||||||||||||
a762        PLHLYIPIIINFFSLLVSNFILSFINKX
                130       140
```

g763.seq not yet found g763.pep not yet found

The following partial DNA sequence was identified in *N. meningitidis* <SEQ ID 2615>:

m763.seq

```
m763.seq

   1 ATGACATTGC TCAATCTAAT GATAATGCAA GATTACGGTA TTTCCGTTTG
  51 CCTGACACTG ACGCCCTATT TGCAACATGA ACTATTTTCG GCTATGAAAT
 101 CCTATTTTTC CAAATATATC CTACCCGTTT CACTTTTTAC CTTGCCACTA
 151 TCCCTTTCCC CATCCGTTTC GGCTTTTACG CTGCCTGAAG CATGGCGGGC
 201 GGCGCAGCAA CATTCGGCTG ATTTTCAAGC GTCCCATTAC CAGCGTGATG
 251 CAGTGCGCGC ACGGCAACAA CAAGCCAAGG CCGCATTCCT TCCCCATGTA
 301 TCCGCCAATG CCAGCTACCA GCGCCAGCCG CCATCGATTT CTTCCACCCG
 351 CGAAACACAG GGATGGAGCG TGCAGGTGGG ACAAACCTTA TTTGACGCTG
 401 CCAAATTTGC ACAATACCGC CAAAGCAGGT TCGATACGCA GGCTGCAGAA
 451 CAGCGTTTCG ATGCGGCACG CGAAGAATTG CTGTTGAAAG TTGCCGAAAG
 501 TTATTTCAAC GTTTTACTCA GCCGAGACAC CGTTGCCGCC CATGCGGCGG
 551 AAAAAGAGGC TTATGCCCAG CAGGTAAGGC AGGCGCAGGC TTTATTCAAT
 601 AAAGGTGCTG CCACCGCGCT GGATATTCAC GAAGCCAAAG CCGGTTACGA
 651 CAATGCCCTG GCCCAAGAAA TCGCCGTATT GGCTGAGAAA CAAACCTATG
 701 AAAACCAGTT GAACGACTAC ACCGACCTGG ATAGCAAACA AATCGAGGCC
 751 ATAGATACCG CCAACCTGTT GGCACGCTAT CTGCCCAAGC TGGAACGTTA
 801 CAGTCTGGAT GAATGGCAGC GCATTGCCTT ATCCAACAAT CATGAATACC
 851 GGATGCAGCA GCTTGCCCTG CAAAGCAGCG GACAGGCGCT TCGGGCAGCA
 901 CAGAACAGCC GCTATCCCAC CGTTTCTGCC CATGTCGGCT ATCAGAATAA
 951 CCTCTACACT TCATCTGCGC AGAATAATGA CTACCACTAT CGGGGCAAAG
1001 GGATGAGCGT CGGCGTACAG TTGAATTTGC CGCTTTATAC CGGCGGAGAA
1051 TTGTCGGGCA AAATCCATGA AGCCGAAGCG CAATACGGGG CCGCCGAAGC
1101 ACAGCTGACC GCAACCGAGC GGCACATCAA ACTCGCCGTA CGCCAGGCTT
1151 ATACCGAAAG CGGTGCGGCG CGTTACCAAA TCATGGCGCA AGAACGGGTT
1201 TTGGAAAGCA GCCGTTTGAA ACTGAAATCG ACCGAAACCG GCCAACAATA
1251 CGGCATCCGC AACCGGCTGG AAGTAATACG GGCGCGGCAG GAAGTCGCCC
```

-continued

1301 AAGCAGAACA GAAACTGGCT CAAGCACGGT ATAAATTCAT GCTGGCTTAT

1351 TTGCGCTTGG TGAAAGAGAG CGGGTTAGGG TTGGAAACGG TATTTGCGGA

1401 ATAA

This corresponds to the amino acid sequence <SEQ ID 2616; ORF 763>:

m763.pep

1 MTLLNLMIMQ DYGISVCLTL TPYLQHELFS AMKSYFSKYI LPVSLFTLPL

51 SLSPSVSAFT LPEAWRAAQQ HSADFQASHY QRDAVRARQQ QAKAAFLPHV

101 SANASYQRQP PSISSTRETQ GWSVQVGQTL FDAAKFAQYR QSRFDTQAAE

151 QRFDAAREEL LLKVAESYFN VLLSRDTVAA HAAEKEAYAQ QVRQAQALFN

201 KGAATALDIH EAKAGYDNAL AQEIAVLAEK QTYENQLNDY TDLDSKQIEA

251 IDTANLLARY LPKLERYSLD EWQRIALSNN HEYRMQQLAL QSSGQALRAA

301 QNSRYPTVSA HVGYQNNLYT SSAQNNDYHY RGKGMSVGVQ LNLPLYTGGE

351 LSGKIHEAEA QYGAAEAQLT ATERHIKLAV RQAYTESGAA RYQIMAQERV

401 LESSRLKLKS TETGQQYGIR NRLEVIRARQ EVAQAEQKLA QARYKFMLAY

451 LRLVKESGLG LETVFAE*

The following partial DNA sequence was identified in *N. meningitidis* <SEQ ID 2617>:

a763.seq

1 ATGACATTGC TCAATCTAAT GATAATGCAA GATTACGGTA TTTCCGTTTG

51 CCTGACACTG ACGCCCTATT TGCAACATGA ACTATTTTCG GCTATGAAAT

101 CCTATTTTTC CAAATATATC CTACCCGTTT CACTTTTTAC CTTGCCACTA

151 TCCCTTTCCC CATCCGTTTC GGCTTTTACG CTGCCTGAAG CATGGCGGGC

201 GGCGCAGCAA CATTCGGCTG ATTTTCAAGC GTCCCATTAC CAGCGTGATG

251 CAGTGCGCGC ACGGCAACAA CAAGCCAAGG CCGCATTCCT TCCCCATGTA

301 TCCGCCAATG CCAGCTACCA GCGCCAGCCG CCATCGATTT CTTCCACCCG

351 CGAAACACAG GGATGGAGCG TGCAGGTGGG ACAAACCTTA TTTGACGCTG

401 CCAAATTTGC ACAATACCGC CAAAGCAGGT TCGATACGCA GGCTGCAGAA

451 CAGCGTTTCG ATGCGGCACG CGAAGAATTG CTGTTGAAAG TTGCCGAAAG

501 TTATTTCAAC GTTTTACTCA GCCGAGACAC CGTTGCCGCC CATGCGGCGG

551 AAAAAGAGGC TTATGCCCAG CAGGTAAGGC AGGCGCAGGC TTTATTCAAT

601 AAAGGTGCTG CCACCGCGCT GGATATTCAC GAAGCCAAAG CCGGTTACGA

651 CAATGCCCTG GCCCAAGAAA TCGCCGTATT GGCTGAGAAA CAAACCTATG

701 AAAACCAGTT GAACGACTAC ACCGGCCTGG ACAGCAAACA AATCGAGGCC

751 ATAGATACCG CCAACCTGTT GGCACGCTAT CTGCCCAAGC TGGAACGTTA

801 CAGTCTGGAT GAATGGCAGC GCATTGCCTT ATCCAACAAT CATGAATACC

851 GGATGCAGCA GCTTGCCCTG CAAAGCAGCG GACAGGCGCT TCGGGCAGCA

901 CAGAACAGCC GCTATCCCAC CGTTTCTGCC CATGTCGGCT ATCAGAATAA

-continued

```
 951 CCTCTACACT TCATCTGCGC AGAATAATGA CTACCACTAT CGGGGCAAAG

1001 GGATGAGCGT CGGCGTACAG TTGAATTTGC CGCTTTATAC CGGCGGAGAA

1051 TTGTCGGGCA AAATCCATGA AGCCGAAGCG CAATACGGGG CTGCCGAAGC

1101 ACAGCTGACC GCAACCGAGC GGCACATCAA ACTCGCCGTA CGCCAGGCTT

1151 ATACCGAAAG CGGTGCGGCG CGTTACCAAA TCATGGCGCA AGAACGGGTT

1201 TTGGAAAGCA GCCGTTTGAA ACTGAAATCG ACCGAAACCG GCCAACAATA

1251 CGGCATCCGC AACCGGCTGG AAGTAATACG GGCGCGGCAG GAAGTCGCCC

1301 AAGCAGAACA GAAACTGGCT CAAGCACGGT ATAAATTCAT GCTGGCTTAT

1351 TTGCGCTTGG TGAAAGAGAG CGGGTTAGGG TTGGAAACGG TATTTGCGGA

1401 ATAA
```

This corresponds to the amino acid sequence <SEQ ID 2618; ORF 763.a>:

a763.pep

```
  1 MTLLNLMIMQ DYGISVCLTL TPYLQHELFS AMKSYFSKYI LPVSLFTLPL

 51 SLSPSVSAFT LPEAWRAAQQ HSADFQASHY QRDAVRARQQ QAKAAFLPHV

101 SANASYQRQP PSISSTRETQ GWSVQVGQTL FDAAKFAQYR QSRFDTQAAE

151 QRFDAAREEL LLKVAESYFN VLLSRDTVAA HAAEKEAYAQ QVRQAQALFN

201 KGAATALDIH EAKAGYDNAL AQEIAVLAEK QTYENQLNDY TGLDSKQIEA

251 IDTANLLARY LPKLERYSLD EWQRIALSNN HEYRMQQLAL QSSGQALRAA

301 QNSRYPTVSA HVGYQNNLYT SSAQNNDYHY RGKGMSVGVQ LNLPLYTGGE

351 LSGKIHEAEA QYGAAEAQLT ATERHIKLAV RQAYTESGAA RYQIMAQERV

401 LESSRLKLKS TETGQQYGIR NRLEVIRARQ EVAQAEQKLA QARYKFMLAY

451 LRLVKESGLG LETVFAE*
```

m763/a763 99.8% identity in 467 aa overlap

```
                    10        20        30        40        50        60
m763.pep    MTLLNLMIMQDYGISVCLTLTPYLQHELFSAMKSYFSKYILPVSLFTLPLSLSPSVSAFT
            ||||||||||||||||||||||||||||||||||||||||||||||||||||||||||||
a763        MTLLNLMIMQDYGISVCLTLTPYLQHELFSAMKSYFSKYILPVSLFTLPLSLSPSVSAFT
                    10        20        30        40        50        60

                    70        80        90       100       110       120
m763.pep    LPEAWRAAQQHSADFQASHYQRDAVRARQQQADAAFLPHVSANASYQRQPPSISSTRETQ
            ||||||||||||||||||||||||||||||||||||||||||||||||||||||||||||
a763        LPEAWRAAQQHSADFQASHYQRDAVRARQQQAKAAFLPHVSANASYQRQPPSISSTRETQ
                    70        80        90       100       110       120

                   130       140       150       160       170       180
m763.pep    GWSVQVGQTLFDAAKFAQYRQSRFDTQAAEQRFDAAREELLLKVAESYFNVLLSRDTVAA
            ||||||||||||||||||||||||||||||||||||||||||||||||||||||||||||
a763        GWSVQVGQTLFDAAKFAQYRQSRFDTQAAEQRFDAAREELLLKVAESYFNVLLSRDTVAA
                   130       140       150       160       170       180

                   190       200       210       220       230       240
m763.pep    HAAEKEAYAQQVRQAQALFNKGAATALDIHEAKAGYDNALAQEIAVLAEKQTYENQLNDY
            ||||||||||||||||||||||||||||||||||||||||||||||||||||||||||||
a763        HAAEKEAYAQQVRQAQALFNKGAATALDIHEAKAGYDNALAQEIAVLAEKQTYENQLNDY
                   190       200       210       220       230       240

                   250       260       270       280       290       300
m763.pep    TDLDSKQIEAIDTANLLARYLPKLERYSLDEWQRIALSNNHEYRMQQLALQSSGQALRAA
            | ||||||||||||||||||||||||||||||||||||||||||||||||||||||||||
a763        TGLDSKQIEAIDTANLLARYLPKLERYSLDEWQRIALSNNHEYRMQQLALQSSGQALRAA
                   250       260       270       280       290       300
```

-continued

```
                 310       320       330       340       350       360
m763.pep    QNSRYPTVSAHVGYQNNLYTSSAQNNDYHYRGKGMSVGVQLNLPLYTGGELSGKIHEAEA
            ||||||||||||||||||||||||||||||||||||||||||||||||||||||||||||
a763        QNSRYPTVSAHVGYQNNLYTSSAQNNDYHYRGKGMSVGVQLNLPLYTGGELSGKIHEAEA
                 310       320       330       340       350       360

                 370       380       390       400       410       420
m763.pep    QYGAAEAQLTATERHIKLAVRQAYTESGAARYQIMAQERVLESSRLKLKSTETGQQYGIR
            ||||||||||||||||||||||||||||||||||||||||||||||||||||||||||||
a763        QYGAAEAQLTATERHIKLAVRQAYTESGAARYQIMAQERVLESSRLKLKSTETGQQYGIR
                 370       380       390       400       410       420

                 430       440       450       460
m763.pep    NRLEVIRARQEVAQAEQKLAQARYKFMLAYLRLVKESGLGETVFAEX
            |||||||||||||||||||||||||||||||||||||||||||||||
a763        NRLEVIRARQEVAQAEQKLAQARYKFMLAYLRLVKESGLGETVFAEX
                 430       440       450       460
```

g764.seq not found yet g764.pep not found yet

The following partial DNA sequence was identified in *N. meningitidis* <SEQ ID 2619>:

m764.seq

```
   1 ATGTTTTTCT CCGCCCTGAA ATCCTTTCTT TCTCGATACA TTACTGTATG
  51 GCGCAATGTT TGGGCGGTGC GCGACCAGTT GAAACCGCCC AAACGCACGG
 101 CGGAAGAACA GGCGTTTTTG CCCGCGCATT TGGAACTGAC CGATACGCCG
 151 GTCTCTGCCG CTCCGAAATG GGCGGCGCGT TTTATTATGG CGTTTGCGCT
 201 TTTGGCTTTG TTGTGGTCCT GGTTCGGCAA AATCGATATT GTGGCGGCGG
 251 CTTCGGGCAA AACGGTGTCG GGCGGGCGCA GCAAAACCAT CCAGCCGCTG
 301 GAAACGGCGG TGGTTAAGGC GGTACATGTG CGCGACGGGC AGCATGTGAA
 351 ACAGGGAGAA ACGCTGGCGG AACTGGAGGC TGTGGGAACA GACAGCGATG
 401 TGGTGCAGTC GGAGCAGGCT TTGCAGGCTG CCCAATTGTC CAAACTGCGT
 451 TATGAAGCGG TATTGGCGGC ATTGGAAAGC CGTACCGTGC CGCATATCGA
 501 TATGGCGCAA GCACGGTCTT TAGGTCTCTC CGATGCCGAT GTGCAATCGG
 551 CGCAGGTGTT GGCGCAGCAC CAGTATCAGG CATGGGCGGC GCAGGATGCG
 601 CAATTGCAGT CGGCTTTGCG CGGCCATCAG GCGGAATTGC AGTCGGCCAA
 651 GGCGCAGGAG CAGAAGCTGG TTTCGGTGGG GGCGATCGAG CAGCAGAAAA
 701 CAGCAGACTA CCGCCGTTTG CGGGCCGACA ATTTTATTTC GGAACATGCG
 751 TTTTTGGAGC AGCAGAGCAA ATCGGTCAGC AATTGGAACG ATTTGGAAAG
 801 TACGCGCGGT CAGATGAGGC AGATTCAGGC GGCCATTGCA CAGGCGGAGC
 851 AGAATCGGGT GCTGAATACG CAGAACCTGA AACGCGATAC GCTGGATGCG
 901 CTGCGCCAGG CAAACGAACA GATTGACCAA TACCGCGGCC AAACGGATAA
 951 GGCAAAGCAG CGGCAGCAGC TGATGACAAT ACAGTCGCCT GCGGACGGCA
1001 CGGTGCAGGA ATTGGCTACC TATACGGTGG GCGGTGTGGT GCAGGCTGCC
1051 CAAAAAATGA TGGTGATTGC GCCCGATGAC GACAAAATGG ACGTGGAAGT
1101 TTTGGTATTG AACAAAGACA TCGGTTTTGT GGAACAGGGA CAGGATGCGG
1151 TGGTGAAGAT TGAGAGCTTT CCCTATACGC GCTACGGTTA TCTGACGGGC
1201 AAGGTGAAAA GTGTCAGCCA TGATGCGGTA AGCCACGAAC AGTTGGGCTT
1251 GGTTTATACG GCGGTGGTGT CGCTGGACAA ACATACCTTG AATATTGACG
```

-continued

```
1301 GCAAAGCAGT GAATCTGACG GCGGGCATGA ATGTCACGGC GGAGATTAAA
1351 ACGGGTAAAC GGCGGGTGCT GGATTATCTG TTAAGCCCGC TGCAAACCAA
1401 ATTGGACGAA AGCTTTAGGG AGCGATAG
```

This corresponds to the amino acid sequence <SEQ ID 2620; ORF 764>:

m764.pep

```
  1 MFFSALKSFL SRYITVWRNV WAVRDQLKPP KRTAEEQAFL PAHLELTDTP
 51 VSAAPKWAAR FIMAFALLAL LWSWFGKIDI VAAASGKTVS GGRSKTIQPL
101 ETAVVKAVHV RDGQHVKQGE TLAELEAVGT DSDVVQSEQA LQAAQLSKLR
151 YEAVLAALES RTVPHIDMAQ ARSLGLSDAD VQSAQVLAQH QYQAWAAQDA
201 QLQSALRGHQ AELQSAKAQE QKLVSVGAIE QQKTADYRRL RADNFISEHA
251 FLEQQSKSVS NWNDLESTRG QMRQIQAAIA QAEQNRVLNT QNLKRDTLDA
301 LRQANEQIDQ YRGQTDKAKQ RQQLMTIQSP ADGTVQELAT YTVGGVVQAA
351 QKMMVIAPDD DKMDVEVLVL NKDIGFVEQG QDAVVKIESF PYTRYGYLTG
401 KVKSVSHDAV SHEQLGLVYT AVVSLDKHTL NIDGKAVNLT AGMNVTAEIK
451 TGKRRVLDYL LSPLQTKLDE SFRER*
```

The following partial DNA sequence was identified in *N. meningitidis* <SEQ ID 2621>:

a764.seq (partial)

```
  1 ATGTTTTTCT CCGCCCTGAA ATCCTTTCTT TCCCGCTACA TTACCGTATG
 51 GCGCAATGTT TGGGCGGTGC GCGACCAGTT GGAACCGCCC AAACGCACGG
101 CGGAAGAACA GGCGTTTTTG CCCGCGCATT TGGAACTGAC CGATACGCCG
151 GTCTCTGCCG CTCCGAAATG GGCGGCGCGT TTTATTATGG CGTTTGCGCT
201 TTTGGCTTTG TTGTGGTCCT GGTTCGGCAA AATCGATATT GTGGCGGCGG
251 CTTCGGGCAA AACGGTGTCG GGCGGGCGCA GCAAAACCAT CCAGCCGCTG
301 GAAACGGTGG TGGTTAAGGC GGTACATGTG CGCGACGGGC AGCATGTGAA
351 ACAGGGAGAA ACGCTGGCGG AACTGGAGGC TGTGGGAACA GACAGCGATG
401 TGGTGCAGTC GGAGCAGGCT TTGCAGGCTG CCCAATTGTC CAAACTGCGT
451 TATGAAGCGG TATTGGCGGC ATTGGAAAGC CGTACCGTGC CGCATATCGA
501 TATGGCGCAA GCACGGTCTT TAGGTCTCTC CGATGCCGAT GTGCAATCGG
551 CGCAGGTGTT GGCGCAGCAC CAGTATCAGG CATGGGCGGC GCAGGATGCG
601 CAATTGCAGT CGGCTTTGCG CGGCCATCAG GCGGAATTGC AGTCGGCCAA
651 GGCGCAGGAG CAGAAGCTGG TTTCGGTGGG GGCGATCGAG CAGCAGAAAA
701 CAGCAGACTA CCGCCGTTTG CGGGCCGACA ATTTTATTTC GGAACATGCG
751 TTTTTGGAGC AGCAGAGCAA ATCGGTCAGC AATTGGAACG ATTTGGAAAG
801 TACGCGCGGT CAGATGAGGC AGATTCAGGC GGCCATTGCA CAGGCGGAGC
851 AGAATCGGGT GCTGAATACG CAGAACCTGA AACGCGATAC GCTGGATGCG
901 CTGCGCCAGG CAAACGAACA GATTGACCAA TACCGCGGCC AAACGGATAA
```

-continued

```
 951 GGCAAAGCAG CGGCAGCAGC TGATGACAAT ACAGTCGCCT GCGGACGGCA

1001 CGGTGCAGGA ATTGGCCACC TATACGGTGG GCGGTGTGGT GCAGGCTGCC

1051 CAAAAAATGA TGGTGGTTGC GCCCGATGAC GACAAAATGG ACGTGGAAGT

1101 TTTGGTATTG AACAAAGACA TCGGTTTTGT GGAACAGGGA CAGGATGCGG

1151 TGGTGAAGAT TGAGAGTTTT CCCTATACGC GCTACGGTTA TCTGACGGGC

1201 AAGGTGAAAA GTGTCAGCCA TGATGCGGTA AGCCACGAAC AGTTGGGCTT

1251 GGTTTATACG GCGGTGGTGT CGCTGGACAA ACATACCTTG AATATTGACG

1301 GCAAA
```

This corresponds to the amino acid sequence <SEQ ID 2622; ORF 764.a>:

a764.pep (partial)

```
  1 MFFSALKSFL SRYITVWRNV WAVRDQLEPP KRTAEEQAFL PAHLELTDTP

 51 VSAAPKWAAR FIMAFALLAL LWSWFGKIDI VAAASGKTVS GGRSKTIQPL

101 ETVVVKAVHV RDGQHVKQGE TLAELEAVGT DSDVVQSEQA LQAAQLSKLR

151 YEAVLAALES RTVPHIDMAQ ARSLGLSDAD VQSAQVLAQH QYQAWAAQDA

201 QLQSALRGHQ AELQSAKAQE QKLVSVGAIE QQKTADYRRL RADNFISEHA

251 FLEQQSKSVS NWNDLESTRG QMRQIQAAIA QAEQNRVLNT QNLKRDTLDA

301 LRQANEQIDQ YRGQTDKAKQ RQQLMTIQSP ADGTVQELAT YTVGGVVQAA

351 QKMMVVAPDD DKMDVEVLVL NKDIGFVEQG QDAVVKIESF PYTRYGYLTG

401 KVKSVSHDAV SHEQLGLVYT AVVSLDKHTL NIDGK
```

m764/a764 99.3% identity in 435 aa overlap

```
                    10        20        30        40        50        60
m764.pep    MFFSALKSFLSRYITVWRNVWAVRDQLKPPKRTAEEQAFLPAHLELTDTPVSAAPKWAAR
            |||||||||||||||||||||||||||:||||||||||||||||||||||||||||||||
a764        MFFSALKSFLSRYITVWRNVWAVRDQLEPPKRTAEEQAFLPAHLELTDTPVSAAPKWAAR
                    10        20        30        40        50        60

                    70        80        90       100       110       120
m764.pep    FIMAFALLALLWSWFGKIDIVAAASGDTVSGGRSDTIQPLETAVVKAVHVRDGQHVKQGE
            ||||||||||||||||||||||||||||||||||||||||||:|||||||||||||||||
a764        FIMAFALLALLWSWFGKIDIVAAASGKTVSGGRSKTIQPLETVVVKAVHVRDGQHVKQGE
                    70        80        90       100       110       120

                   130       140       150       160       170       180
m764.pep    TLAELEAVGTDSDVVQSEQALQAAQLSKLRYEAVLAALESRTVPHIDMAQARSLGLSDAD
            ||||||||||||||||||||||||||||||||||||||||||||||||||||||||||||
a764        TLAELEAVGTDSDVVQSEQALQAAQLSKLRYEAVLAALESRTVPHIDMAQARSLGLSDAD
                   130       140       150       160       170       180

                   190       200       210       220       230       240
m764.pep    VQSAQVLAQHQYQAWAAQDAQLQSALRGHQAELQSAKAQEQKLVSVGAIEQQKTADYRRL
            ||||||||||||||||||||||||||||||||||||||||||||||||||||||||||||
a764        VQSAQVLAQHQYQAWAAQDAQLQSALRGHQAELQSAKAQEQKLVSVGAIEQQKTADYRRL
                   190       200       210       220       230       240

                   250       260       270       280       290       300
m764.pep    RADNFISEHAFLEQQSKSVSNWNDLESTRGQMRQIQAAIAQAEQNRVLNTQNLKRDTLDA
            ||||||||||||||||||||||||||||||||||||||||||||||||||||||||||||
a764        RADNFISEHAFLEQQSKSVSNWNDLESTRGQMRQIQAAIAQAEQNRVLNTQNLKRDTLDA
                   250       260       270       280       290       300

                   310       320       330       340       350       360
m764.pep    LRQANEQIDQYRGQTDKAKQRQQLMTIQSPADGTVQELATYTVGGVVQAAQKMMVIAPDD
            |||||||||||||||||||||||||||||||||||||||||||||||||||||||:||||
a764        LRQANEQIDQYRGQTDKAKQRQQLMTIQSPADGTVQELATYTVGGVVQAAQKMMVVAPDD
                   310       320       330       340       350       360
```

-continued

```
                 370       380       390       400       410       420
m764.pep     DKMDVEVLVLNKDIGFVEQGQDAVVKIESFPYTRYGYLTGKVKSVSHDAVSHEQLGLVYT
             ||||||||||||||||||||||||||||||||||||||||||||||||||||||||||||
a764         DKMDVEVLVLNKDIGFVEQGQDAVVKIESFPYTRYGYLTGKVKSVSHDAVSHEQLGLVYT
                 370       380       390       400       410       420

                 430       440       450       460       470
m764.pep     AVVSLDKHTLNIDGKAVNLTAGMNVTAEIKTGKRRVLDYLLSPLQTKLDESFRERX
             ||||||||||||||
a764         AVVSLDKHTLNIDGK
                 430
```

g765.seq not yet found g765.pep not yet found

The following partial DNA sequence was identified in *N. meningitidis* <SEQ ID 2623>:

m765.seq

```
  1 ATGTTAAGAT GCCGTCCGAA ATCCGTTTTG GATTCAGACG GCATTTTTTT
 51 GAAATTTAAT TTTTTAAGGA GTAAACCTAA ATATGAAATT TCCTTCCTTC
101 CTTCCTTTAA ACGGATACTC TGCCTGTCGG CAGTAATCTC GGTATTGGGG
151 GCTTGTGCGG TCGTTGCTGA TGTTTACGGT CATGATTCCG CCACAATGAA
201 CGCTGCGGCT GCCAAAGATT ATATGAAAAC GGTTGAGTTA AACAAGTCTG
251 CCGGCAATGT CGATACCACA TCCAGAACAG CCCGCAGGGT GCAGGCAGTA
301 TTTCGACGTA TGCTGCCTTA TGCCGATGCG GCAAATAATA CCAGCCATAA
351 GTTTGACTGG AAAATGACGG TTTTCAAAAA CGATGAGCTG AACGCGTGGG
401 CAATGCCCGG TGGAAAAATG GCGTTTTATA CGGGGATAGT CGACAAACTC
451 AAGCTGACCG ATGACGAAAT TGCCGCCATT ATGGGGCATG AAATGACGCA
501 CGCCCTGCAT GAACACGGTA AAAATAAGGT CGGGCAGCAA ATCTTGACCA
551 ATACGGCGGC GCAGATAGGC ACGCAGATTA TATTAGACAA AAAACCGGAT
601 ACTAATCCGG AATTGGTCGG ATTGGGTATG GATATTTTGG GGACGTACGG
651 TCTTACCTTG CCTTATAGCC GCAGCTTGGA AGAAGAAGCC GATGAGGGGG
701 GAATGATGTT GATGGCGCAG GCAGGCTATC ATCCGGCGGC CGCTGTCAGG
751 GTTTGGGAAA AAATGAATCA GGAAAACGAC CAAAACGGCT TTATTTATGC
801 TATTACCTCT ACTCATCCGA CAAACAATGC CCGTATAGAA AATCTAAAAC
851 GGTTGTTGCC GACCGTTATG CCGGTTTATG AGCAAAGTGT CAGAAATAAG
901 GGGCGCGTTA ATAAAAAACG TCGGCGTTAA
```

This corresponds to the amino acid sequence <SEQ ID 2624; ORF 765>:

m765.pep

```
  1 MLRCRPKSVL DSDGIFLKFN FLRSKPKYEI SFLPSFKRIL CLSAVISVLG
 51 ACAVVADVYG HDSATMNAAA AKDYMKTVEL NKSAGNVDTT SRTARRVQAV
101 FRRMLPYADA ANNTSHKFDW KMTVFKNDEL NAWAMPGGKM AFYTGIVDKL
151 KLTDDEIAAI MGHEMTHALH EHGKNKVGQQ ILTNTAAQIG TQIILDKKPD
201 TNPELVGLGM DILGTYGLTL PYSRSLEEEA DEGGMMLMAQ AGYHPAAAVR
```

-continued

```
251 VWEKMNQEND QNGFIYAITS THPTNNARIE NLKRLLPTVM PVYEQSVRNK

301 GRVNKKRRR*
```

The following partial DNA sequence was identified in *N. meningitidis* <SEQ ID 2625>:

a765.seq

```
  1 ATGTTAAGAT GCCGTCCGAA ATCCGTTTTG GATTCAGACG GCATTTTTTT

 51 GAAATTTAAT TTTTTAAGGA GTAAACCTAA ATATGAAATT TCCTTCCTTC

101 CTTCCTTTAA ACGGATACTC TGCCTGTCGG CAGTAATCTC GGTATTGGGG

151 GCTTGTACGG TCGTTGCTGA TGTTTACGGT CAGGATTCCG CCACAATGAA

201 TGCTGCGGCT GCCGAAGATT ATATGAAAAC GGTTGAGTTG AACAAGTCTG

251 CCGGCAATGT CGATACTACA TCCAAAACAG CCCGTAGGGT GCAGGCAGTA

301 TTTCGACGTA TGTTGCCTTA TGCCGATGCG GCAAATAATA CCGGCCATAA

351 GTTTGACTGG AAAATGACGG TTTTCAAAAA CGATGAGCTG AACGCGTGGG

401 CAATGCCCGG CGGGAAAATG GCGTTTTATA CGGGGATAGT CGATAAACTT

451 AAGCTGACCG ATGGCGAAAT TGCCGCCATT ATGGGGCATG AAATGACGCA

501 TGCCCTGCAT GAACACGGTA AAAATAAGGT CGGGCAGAAA ATCTTGACTA

551 ATATGGCGGC GCAGATAGGC ACGCAGATTA TATTAGACAA AAAACCGGAC

601 ACTAATCCGG AATTGGTCGG ATTGGGTATG GATATTTTGG GGATGTACGG

651 CATTACCTTG CCTTATAGCC GCAGCTTGGA AGAAGAAGCC GATGAGGGGG

701 GAATGATGTT GATGGCGCAG GCAGGCTATC ATCCGGCAGC CGCTGTCAGG

751 GTTTGGGAAA AAATGAATCA GGAAAACGAC CAAAACGGCT TTATTTATGC

801 TATTACCTCT ACTCATCCGA CAAACAATGC CCGTATAGAA AATCTAAAAC

851 GGTTGTTGCC GACCGTTATG CCGGTTTATG AGCACAGTGT TAGAAATAAG

901 GGGCGCGTTA ATAAAAACCG TCGGCGTTAA
```

This corresponds to the amino acid sequence <SEQ ID 2626; ORF 765.a>:

a765.pep

```
  1 MLRCRPKSVL DSDGIFLKFN FLRSKPKYEI SFLPSFKRIL CLSAVISVLG

 51 ACTVVADVYG QDSATMNAAA AEDYMKTVEL NKSAGNVDTT SKTARRVQAV

101 FRRMLPYADA ANNTGHKFDW KMTVFKNDEL NAWAMPGGKM AFYTGIVDKL

151 KLTDGEIAAI MGHEMTHALH EHGKNKVGQK ILTNMAAQIG TQIILDKKPD

201 TNPELVGLGM DILGMYGITL PYSRSLEEEA DEGGMMLMAQ AGYHPAAAVR

251 VWEKMNQEND QNGFIYAITS THPTNNARIE NLKRLLPTVM PVYEHSVRNK

301 GRVNKNRRR*
```

Computer analysis of this amino acid sequence gave the following results:

Homology with a predicted ORF from *N meningitidis*

ORF 765 shows 96.18% identity over a 309 aa overlap with a predicted ORF (ORF 765) from *N. meningitidis:* m765/a765 96.1% identity in 309 aa overlap

```
                       10        20        30        40        50        60
m765.pep       MLRCRPKSVLDSDGIFLKFNFLRSKPKYEISFLPLFKRILCLSAVISVLGACAVVADVYG
               |||||||||||||||||||||||||||||||||||||||||||||||||||||:||||||
a765           MLRCRPKSVLDSDGIFLKFNFLRSKPKYEISFLPSFKRILCLSAVISVLGACTVVADVYG
                       10        20        30        40        50        60

                       70        80        90       100       110       120
m765.pep       HDSATMNAAAAKDYMKTVELNKSAGNVDTTSRTARRVQAVFRRMLPYADAANNTSHKFDW
               :||||||||||:|||||||||||||||||||:||||||||||||||||||||||:|||||
a765           QDSATMNAAAAEDYMKTVELNKSAGNVDTTSKTARRVQAVFRRMLPYADAANNTGHKFDW
                       70        80        90       100       110       120

                      130       140       150       160       170       180
m765.pep       KMTVFKNDELNAWAMPGGKMAFYTGIVDKLKLTDDEIAAIMGHEMTHALHEHGKNKVGQQ
               |||||||||||||||||||||||||||||||||| ||||||||||||||||||||||||:
a765           KMTVFKNDELNAWAMPGGKMAFYTGIVDKLKLTDGEIAAIMGHEMTHALHEHGKNKVGQK
                      130       140       150       160       170       180

                      190       200       210       220       230       240
m765.pep       ILTNTAAQIGTQIILDKKPDTNPELVGLGMDILGTYGLTLPYSRSLEEEADEGGMMLMAQ
               |||| ||||||||||||||||||||||||||||| ||:||||||||||||||||||||||
a765           ILTNMAAQIGTQIILDKKPDTNPELVGLGMDILGMYGITLPYSRSLEEEADEGGMMLMAQ
                      190       200       210       220       230       240

                      250       260       270       280       290       300
m765.pep       AGYHPAAAVRVWEKMNQENDQNGFIYAITSTHPTNNARIENLKRLLPTVMPVYEQSVRNK
               ||||||||||||||||||||||||||||||||||||||||||||||||||||||:|||||
a765           AGYHPAAAVRVWEKMNQENDQNGFIYAITSTHPTNNARIENLKRLLPTVMPVYEHSVRNK
                      250       260       270       280       290       300

                      310
m765.pep       GRVNKKRRRX
               |||||:||||
a765           GRVNKNRRRX
                      310
```

The following partial DNA sequence was identified in *N. gonorrhoeae* <SEQ ID 2627>:

g767.seq

```
  1 ATGAAGTTTA AACATCTGTT GCCGCTGCTG CTGTCGGCAG TGTTGTCCGC
 51 GCAGGCATAT GCCCTGACGG AAGGGGAAGA CTATCTTGTG TTGGATAAAC
101 CCATTCCTCA AGAACAGCCG GGAAAAATTG AGGTTTTGGA ATTTTTCGGC
151 TATTTTTGCG TACATTGCCA TCATTTCGAT CCTTTGTTAT TGAAACTGGG
201 CAAGGCATTG CCGTCTGATA CTTATCTGCG GACGGAGCAC GTGGTCTGGC
251 GGCCTGAAAT GCTCGGTCTG GCAAGAATGG CTGCTGCGGT CAAGCTGTCG
301 GGTTTGAAAT ATCAGGCAAA CTCTGCTGTG TTTAAAGCAG TTTACGAACA
351 AAAAATCCGT TTGGAAAACA GGGCTGTTGC CGGGAAATGG GCTTTATCTC
401 AAAAAGGTTT TGACGGCAAA AAACTGATGC GCGCCTATGA TTCCCCCGAA
451 GCTGCCGCCG TCGCATTAAA AATGCAGAAA CTGACGGAAC AATACGGTAT
501 TGACAGCACG CCGACCGTTA TTGTCGGCGG AAAATACCGC GTTATCTTCA
551 ATAATGGCTT TGATGGCGGC GTTCATACGA TTAAAGAATT GGTTGCCAAA
601 GTCAGGGAAG AACGCAAGCG TCAGACCCCT GCTGTACAGA AATAG
```

This corresponds to the amino acid sequence <SEQ ID 2628; ORF 767.ng>:

g767.pep

```
  1 MKFKHLLPLL LSAVLSAQAY ALTEGEDYLV LDKPIPQEQP GKIEVLEFFG
 51 YFCVHCHHFD PLLLKLGKAL PSDTYLRTEH VVWRPEMLGL ARMAAAVKLS
101 GLKYQANSAV FKAVYEQKIR LENRAVAGKW ALSQKGFDGK KLMRAYDSPE
```

```
151 AAAVALKMQK LTEQYGIDST PTVIVGGKYR VIFNNGFDGG VHTIKELVAK

201 VREERKRQTP AVQK*
```

The following partial DNA sequence was identified in N. meningitidis <SEQ ID 2629>:

```
m767.seq

  1 ATGAAGCTCA AACATCTGTT GCCGCTGCTG CTGTCGGCAG TGTTGTCCGC

 51 GCAGGCATAT GCCCTGACGG AAGGGGAAGA CTATCTTGTG TTGGATAAAC

101 CCATTCCTCA AGAACAGTCG GGTAAAATTG AGGTTTTGGA ATTTTTCGGC

151 TATTTCTGCG TACATTGCCA TCATTTCGAT CCTTTGTTAT TGAAACTGGG

201 CAAGGCATTG CCGTCTGATG CCTATTTGAG GACGGAGCAC GTGGTCTGGC

251 AGCCTGAAAT GCTCGGTTTG GCTAGGATGG CGGCTGCCGT CAATTTGTCG

301 GGTTTGAAAT ATCAGGCAAA CCCTGCTGTG TTTAAAGCAG TTTACGAACA

351 AAAAATCCGC TTGGAAAACA GGTCGGTTGC CGGAAAATGG GCTTTGTCTC

401 AAAAAGGCTT TGACGGCAAA AAACTGATGC GCGCCTATGA TTCCCCCGAA

451 GCTGCCGCCG CCGCATTAAA AATGCAGAAA CTGACGGAAC AATACCGCAT

501 CGACAGCACG CCGACCGTTA TTGTCGGCGG AAAATACCGC GTTATCTTCA

551 ATAACGGCTT TGACGGCGGC GTTCATACGA TTAAAGAATT GGTTGCCAAA

601 GTCAGGGAAG AACGCAAGCG TCAGACCCCT GCTGTACAGA AATAG
```

This corresponds to the amino acid sequence <SEQ ID 2630; ORF 767>:

```
m767.pep

  1 MKLKHLLPLL LSAVLSAQAY ALTEGEDYLV LDKPIPQEQS GKIEVLEFFG

 51 YFCVHCHHFD PLLLKLGKAL PSDAYLRTEH VVWQPEMLGL ARMAAAVNLS

101 GLKYQANPAV FKAVYEQKIR LENRSVAGKW ALSQKGFDGK KLMRAYDSPE

151 AAAAALKMQK LTEQYRIDST PTVIVGGKYR VIFNNGFDGG VHTIKELVAK

201 VREERKRQTP AVQK*
```

Computer analysis of this amino acid sequence gave the following results:

Homology with a predicted ORF from N. gonorrhoeae

ORF 767 shows 95.8% identity over a 214 aa overlap with a predicted ORF (ORF 767) from N. gonorrhoeae m767/g767 95.8% identity in 214 aa overlap

```
                    10         20         30         40         50         60
g767.pep    MKFKHLLPLLLLSAVLSAQAYALTEGEDYLVLDKPIPQEQPGKIEVLEFFGYFCVHCHHFD
            ||:|||||||| |||||||||||||||||||||||||| |||||||||||||||||||||
m767        MKLKHLLPLLLLSAVLSAQAYALTEGEDYLVLDKPIPQEQSGKIEVLEFFGYFCVHCHHFD
                    10         20         30         40         50         60

                    70         80         90        100        110        120
g767.pep    PLLLKLGKALPSDTYLRTEHVVWRPEMLGLARMAAAVKLSGLKYQANSAVFKAVYEQKIR
            |||||||||||||:||||||||||:|||||||||||||:||||||||||:|||||||||
m767        PLLLKLGKALPSDAYLRTEHVVWQPEMLGLARMAAAVNLSGLKYQANPAVFKAVYEQKIR
                    70         80         90        100        110        120
```

-continued

```
                 130       140       150       160       170       180
g767.pep   LENRAVAGKWALSQKGFDGKKLMRAYDSPEAAAVALKMQKLTEQYGIDSTPTVIVGGKYR
           ||||:||||||||||||||||||||||||||||:|||||||||| ||||||||||||||
m767       LENRSVAGKWALSQKGFDGKKLMRAYDSPEAAAAALKMQKLTEQYRIDSTPTVIVGGKYR
                 130       140       150       160       170       180

                 190       200       210
g767.pep   VIFNNGFDGGVHTIKELVAKVREERKRQTPAVQKX
           |||||||||||||||||||||||||||||||||||
m767       VIFNNGFDGGVHTIKELVAKVREERKRQTPAVQKX
                 190       200       210
```

The following partial DNA sequence was identified in *N. meningitidis* <SEQ ID 2631>:

a767.seq

```
  1 ATGAAGCTCA AACATCTGTT GCCGCTGCTG CTGTCGGCAG TGTTGTCCGC
 51 GCAGGCATAT GCCCTGACGG AAGGGGAAGA CTATCTTGTG TTGGATAAAC
101 CCATTCCTCA AAAACAGTCG GGCAAAATTG AGGTTTTGGA ATTTTTCGGC
151 TATTTCTGCG TACATTGCCA TCATTTCGAT CCTTTGTTAT TGAAATTGGG
201 CAAGGCATTG CCGTCTGATG CCTATTTAAG GACGGAGCAC GTGGTCTGGC
251 AGCCTGAAAT GCTCGGTCTG GCAAGAATGG CTGCTGCGGT CAAGCTGTCA
301 GGTTTGAAAT ATCAGGCAAA CCCTGCCGTG TTTAAAGCAG TTTACGAACA
351 AAAAATCCGC TTGGAAAACA GGTCGGTTGC CGAAAAATGG GCTTTGTCTC
401 AAAAAGGCTT TGACGGCAAA AAACTGATGC GCGCCTACGA CTCTCCTGCG
451 GCAGCGGCTG CTGCATCAAA AATGCAGCAA TTGACGGAAC AGTACCGCAT
501 CGACAGTACG CCGACCGTTG TCGTCGGCGG AAAATACCGC GTTATCTTCA
551 ATAATGGCTT TGACGGCGGT GTTCATACGA TTAAAGAATT GGTTGCCAAA
601 GTCAGGGAAG AACGCAAGCG TCAGACCCCT GCTGTACAGA AATAG
```

This corresponds to the amino acid sequence <SEQ ID 2632; ORF 767.a>:

a767.pep

```
  1 MKLKHLLPLL LSAVLSAQAY ALTEGEDYLV LDKPIPQKQS GKIEVLEFFG
 51 YFCVHCHHFD PLLLKLGKAL PSDAYLRTEH VVWQPEMLGL ARMAAAVKLS
101 GLKYQANPAV FKAVYEQKIR LENRSVAEKW ALSQKGFDGK KLMRAYDSPA
151 AAAAASKMQQ LTEQYRIDST PTVVVGGKYR VIFNNGFDGG VHTIKELVAK
201 VREERKRQTP AVQK*
```

Computer analysis of this amino acid sequence gave the following results:

Homology with a predicted ORF from *N. meningitidis*

ORF 767 shows 96.7% identity over a 214 aa overlap with a predicted ORF (ORF 767) from *N. meningitidis:* m767/a767 96.7% identity in 214 aa overlap

```
                  10        20        30        40        50        60
a767.pep   MKLKHLLPLLLSAVLSAQAYALTEGEDYLVLDKPIPQKQSGKIEVLEFFGYFCVHCHHFD
           ||||||||||||||||||||||||||||||||||||:|||||||||||||||||||||||
m767       MKLKHLLPLLLSAVLSAQAYALTEGEDYLVLDKPIPQEQSGKIEVLEFFGYFCVHCHHFD
                  10        20        30        40        50        60
```

-continued

```
                       70        80        90       100       110       120
a767.pep       PLLLKLGKALPSDAYLRTEHVVWQPEMLGLARMAAAVKLSGLKYQANPAVFKAVYEQKIR
               ||||||||||||||||||||||||||||||||||||||||:|||||||||||||||||||
m767           PLLLKLGKALPSDAYLRTEHVVWQPEMLGLARMAAAVNLSGLKYQANPAVFKAVYEQKIR
                       70        80        90       100       110       120

                      130       140       150       160       170       180
a767.pep       LENRSVAEKWALSQKGFDGKKLMRAYDSPAAAAAASKMQQLTEQYRIDSTPTVVVGGKYR
               ||||||| ||||||||||||||||||||| ||||| |||:|||||||||||||:||||||
m767           LENRSVAGKWALSQKGFDGKKLMRAYDSPEAAAAALKMQKLTEQYRIDSTPTVIVGGKYR
                      130       140       150       160       170       180

                      190       200       210
a767.pep       VIFNNGFDGGVHTIKELVAKVREERKRQTPAVQKX
               |||||||||||||||||||||||||||||||||||
m767           VIFNNGFDGGVHTIKELVAKVREERKRQTPAVQKX
                      190       200       210
```

The following partial DNA sequence was identified in *N. gonorrhoeae* <SEQ ID 2633>:

g768.seq

```
  1 ATGAATATCA AACAATTGAT TACCGCCGCA CTCATTGCCT CAGCCGCCTT

 51 TGCCACGCAG GCAGCCCCGC AAAAACCCGT ATCCGCCGCC CAAACCGCGC

101 AACATTCAGC CGTTTGGATC GATGTCCGTT CCGAACAGGA ATTTAGCGAA

151 GGTCATTTGC ACAACGCGGT CAACATCCCC GTCGACCAAA TCGTCCGCCG

201 CATATACGAA GCCGCGCCCG ACAAAGACAC GCCGGTCAAC CTCTACTGCC

251 GCAGCGGACG GCGTGCCGAA GCCGCCCTTC AAGAGCTGAA AAAAGCAGGT

301 TATACAAATG TTGCCAATCA CGGCGGTTAT GAAGACCTGC TCAAAAAAGG

351 GATGAAATGA
```

This corresponds to the amino acid sequence <SEQ ID 2634; ORF 768.ng>:

g768.pep

```
  1 MNIKQLITAA LIASAAFATQ AAPQKPVSAA QTAQHSAVWI DVRSEQEFSE

 51 GHLHNAVNIP VDQIVRRIYE AAPDKDTPVN LYCRSGRRAE AALQELKKAG

101 YTNVANHGGY EDLLKKGMK*
```

The following partial DNA sequence was identified in *N. meningitidis* <SEQ ID 2635>:

m768.seq

```
  1 ATGAATATCA AACACCTGAT TACCGCCGCA CTCATTGCCT CAGCCGCCTT

 51 TGCCGCGCAG GCAGCCCCGC AAAAACCCGT ATCCGCCGCC CAAACCGCGC

101 AACATCCGGC CGTTTGGATC GATGTCCGTT CCGAACAGGA ATTTAGCGAA

151 GGGCATTTGC ACAACGCGGT CAACATCCCC GTCGACCAAA TCGTCCGCCG

201 CATACACGAA GCCGCGCCCG ACAAAGACAC GCCGGTCAAC CTCTACTGCC

251 GCAGCGGACG GCGTGCCGAA GCCGCCCTTC AAGAGCTGAA AAAAGCAGGT

301 TATACAAATG TTGCCAATCA CGGCGGTTAT GAAGACCTGC TCAAAAAAGG

351 GATGAAATGA
```

This corresponds to the amino acid sequence <SEQ ID 2636; ORF 768>:

m768.pep

```
  1 MNIKHLITAA LIASAAFAAQ AAPQKPVSAA QTAQHPAVWI DVRSEQEFSE
 51 GHLHNAVNIP VDQIVRRIHE AAPDKDTPVN LYCRSGRRAE AALQELKKAG
101 YTNVANHGGY EDLLKKGMK*
```

Computer analysis of this amino acid sequence gave the following results:

Homology with a predicted ORF from *N. gonorrhoeae*

ORF 768 shows 96.6% identity over a 119 aa overlap with a predicted ORF (ORF 768) from *N. gonorrhoeae* m768/g768 96.6% identity in 119 aa overlap

```
                    10        20        30        40        50        60
g768.pep    MNIKQLITAALIASAAFATQAAPQKPVSAAQTAQHSAVWIDVRSEQEFSEGHLHNAVNIP
            ||||:|||||||||||||:||||||||||||||| |||||||||||||||||||||||||
m768        MNIKHLITAALIASAAFAAQAAPQKPVSAAQTAQHPAVWIDVRSEQIFSEGHLHNAVNIP
                    10        20        30        40        50        60
                    70        80        90       100       110       120
g768.pep    VDQIVRRIYEAAPDKDTPVNLYCRSGRRAEAALQELKKAGYTNVANHGGYEDLLKKGMKX
            ||||||||:|||||||||||||||||||||||||||||||||||||||||||||||||||
m768        VDQIVRRIHEAAPDKDTPVNLYCRSGRRAEAALQELKKAGYTNVANHGGYEDLLKKGMKX
                    70        80        90       100       110       120
```

The following partial DNA sequence was identified in *N. meningitidis* <SEQ ID 2637>:

a768.seq

```
  1 ATGAATATCA AACACCTGAT TACCGCCGCA CTCATTGCCT CAGCCGCCTT
 51 TGCCGCGCAG GCAGCCCCGC AAAAACCCGT ATCCGCCGCC CAAACCGCGC
101 AACATTCAGC CGTTTGGATC GATGTCCGCA GCGAACAGGA ATTTAGCGAA
151 GGTCATTTGC ACAACGCGGT CAACATCCCC GTCGACCAAA TCGTCCGCCG
201 CATACACGAA GCCGCGCCCG ACAAAGACAC GCCGGTCAAC CTCTACTGCC
251 GCAGCGGACG GCGTGCCGAA GCCGCCCTTC AAGAACTGAA AAAAGCAGGC
301 TATACGAATG TTGCCAATCA CGGCGGTTAT GAAGACCTGC TCAAAAAAGG
351 GATGAAATGA
```

This corresponds to the amino acid sequence <SEQ ID 2638: ORF 768.a>:

a768.pep

```
  1 MNIKHLITAA LIASAAFAAQ AAPQKPVSAA QTAQHSAVWI DVRSEQEFSE
 51 GHLHNAVNIP VDQIVRRIHE AAPDKDTPVN LYCRSGRRAE AALQELKKAG
101 YTNVANHGGY EDLLKKGMK*
```

Computer analysis of this amino acid sequence gave the following results:

Homology with a predicted ORF from *N meningitidis*

ORF 768 shows 99.2% identity over a 119 aa overlap with a predicted ORF (ORF 768) from *N. meningitidis:* m766/a768 99.2% identity in 119 aa overlap

```
                    10        20        30        40        50        60
a768.pep    MNIKHLITAALIASAAFAAQAAPQKPVSAAQTAQHSAVWIDVRSEQEFSEGHLHNAVNIP
            |||||||||||||||||||||||||||||||||||| |||||||||||||||||||||||
m768        MNIKHLITAALIASAAFAAQAAPQKPVSAAQTAQHPAVWIDVRSEQEFSEGHLHNAVNIP
                    10        20        30        40        50        60
                    70        80        90       100       110       120
a768.pep    VDQIVRRIHEAAPDKDTPVNLYCRSGRRAEAALQELKKAGYTNVANHGGYEDLLKKGMKX
            ||||||||||||||||||||||||||||||||||||||||||||||||||||||||||||
m768        VDQIVRRIHEAAPDKDTPVNLYCRSGRRAEAALQELKKAGYTNVANHGGYEDLLKKGMKX
                    70        80        90       100       110       120
```

The following partial DNA sequence was identified in *N. gonorrhoeae* <SEQ ID 2639>:

g769.seq

```
   1 TTGATAATGG TTATTTTTTA TTTTTATTTT TGTGGGAAGA CATTTATGCC
  51 TGCACGAAAC AGATGGATGC TGCTGCCTTT ATTGGCAAGC GCGGCATACG
 101 CCGAAgaAAC ACCgtgCGAA CCGGATTTGA GAAGCCGTCC CGAGTTCAGG
 151 CTTCATGAAG CGGAGGTCAA ACCGATCGAC AGGGAGAAGG TACCGGGGCA
 201 GGTGCGGGAA AAAGGAAAAG TTTTGCAGGT TGACGgcGAA ACCCTGCTGA
 251 AAAATCCCGA ATTGTTGTCG CGTGCCATGT ATTCCGCAGT GGTCTCAAAC
 301 AATATTGCCG GTATCCGCGT GATTTTGCCG ATTTACCTAC AACAGGCGCG
 351 GCAGGATAAG ATGTTGGCAC TTTATGCACA AGGGATTTTG GCGCAGGCAG
 401 AGGGCAGGGT GAAGGAGGCG GTTTCCCATT ACCGGGAATT GATTGCCGCC
 451 CAACCCGACG CGCCCGCCGT CCGTATGCGT TTGGCGGCGG CATTGTTTGA
 501 AGACAGGCAG AACGAGGCGG CGGCAGACCA GTTCGACCGC CTGAAAACAG
 551 AAGATCTGCC GCCGCAGCTT ATGGAGCAGG TCGAGCTGTA CCGCAAGGCA
 601 TTGCGCGAAC GCGATGCGTG GAAGGTAAAC GGCGGTTTCA GCGTTACCCG
 651 CGAACACAAT ATCAACCAAG CCCCGAAACA GCAGCAGTAC GGCAATTGGA
 701 CTTTCCCGAA ACAGGTGGAC GGCACGGCAG TCAATTACCG GTTCGGCGCG
 751 GAGAAAAAAT GGTCGCTGAA AAACGGCTGG TACACGACGG CGGGCGGCGA
 801 CGTGTCCGGC AGGGTTTATC CGGGGAATAA GAAATTCAAC GATATGACGG
 851 CAGGTGTTTC CGGCGGCATC GGTTTTGCCG ACCGGCGTAA AGATGTCGGG
 901 CTGGCAGTGT TCCACGAACG CCGCACCTAC GGCAACGACG CTTATTCTTA
 951 CGCCAACGGC GCACGCCTTT ATTTCAACCG TTGGCAAACC CCGAGATGGC
1001 AAACGCTGTC TTCGGCGGAG TGGGGGCGTT TGAAGAATAC GCGCCGGGCG
1051 CGTTCCGACA ATACCCATTT GCAAATTTCC AATTCGCTGG TGTTTTACCG
1101 GAATGCGCGC CAATATTGGA CGGGCGGTTT GGATTTTTAC CGCGAGCGCA
1151 ACCCCGCCGA CCGTGGCGAC AATTTCAACC GTTACGGCCT GCGCTTTGCC
1201 TGGGGGCAGG AATGGGGCGG CAGCGGCCTG TCTTCGCTGT TCCGCCTCGG
```

-continued

```
1251 CGTGGCGAAA CGGCATTATG AAAAACCCGG CTTCTTCAGC AGTTTTAAAG
1301 GGGAAAGGCG CAGGGATAAA GAATCGGACA CATCCTTGAG CCTTTGGCAC
1351 CGGGCATTGC ATTTCAAAGG CATCACGCCG CGCCTGACGC TGTCGCACCG
1401 CGAAACGTGG AGCAACGATG TGTTTAACGA ATACGAGAAA AACAGGGCGT
1451 TTGTCGAGTT TAACAAAACG TTCTGA
```

This corresponds to the amino acid sequence <SEQ ID 2640; ORF 769.ng>:

g769.pep

```
  1 LIMVIFYFYF CGKTFMPARN RWMLLPLLAS AAYAEETPCE PDLRSRPEFR
 51 LHEAEVKPID REKVPGQVRE KGKVLQVDGE TLLKNPELLS RAMYSAVVSN
101 NIAGIRVILP IYLQQARQDK MLALYAQGIL AQAEGRVKEA VSHYRELIAA
151 QPDAPAVRMR LAAALFEDRQ NEAAADQFDR LKTEDLPPQL MEQVELYRKA
201 LRERDAWKVN GGFSVTREHN INQAPKQQQY GNWTFPKQVD GTAVNYRFGA
251 EKKWSLKNGW YTTAGGDVSG RVYPGNKKFN DMTAGVSGGI GFADRRKDVG
301 LAVFHERRTY GNDAYSYANG ARLYFNRWQT PRWQTLSSAE WGRLKNTRRA
351 RSDNTHLQIS NSLVFYRNAR QYWTGGLDFY RERNPADRGD NFNRYGLRFA
401 WGQEWGGSGL SSLFRLGVAK RHYEKPGFFS SFKGERRRDK ESDTSLSLWH
451 RALHFKGITP RLTLSHRETW SNDVFNEYEK NRAFVEFNKT F*
```

The following partial DNA sequence was identified in *N. meningitidis* <SEQ ID 2641>:

m769.seq

```
  1 TTGATAATGG TTATTTTTTA TTTTTGTGGG AAGACATTTA TGCCTGCACG
 51 AAACAGATGG ATGCTGCTGC TGCCTTTATT GGCAAGCGCG GCATATGCCG
101 AAGAAACACC GCGCGAACCG GATTTGAGAA GCCGTCCCGA GTTCAGGCTT
151 CATGAAGCGG AGGTCAAACC GATCGACAGG GAGAAGGTGC CGGGGCAGGT
201 GCGGGAAAAA GGAAAAGTTT TGCAGATTGA CGGCGAAACC CTGCTGAAAA
251 ATCCCGAATT GTTGTCCCGC GCGATGTATT CCGCAGTGGT CTCAAACAAT
301 ATTGCCGGTA TCCGCGTTAT TTTGCCGATT TACCTACAAC AGGCGCAGCA
351 GGATAAGATG TTGGCACTTT ATGCACAAGG GATTTTGGCG CAGGCAGACG
401 GTAGGGTGAA GGAGGCGATT TCCCATTACC GGGAATTGAT TGCCGCCCAA
451 CCCGACGCGC CCGCCGTCCG TATGCGTTTG GCGGCAGCAT TGTTTGAAAA
501 CAGGCAGAAC GAGGCGGCGG CAGACCAGTT CGACCGCCTG AAGGCGGAAA
551 ACCTGCCGCC GCAGCTGATG GAGCAGGTCG AGCTGTACCG CAAGGCATTG
601 CGCGAACGCG ATGCGTGGAA GGTAAATGGC GGCTTCAGCG TCACCCGCGA
651 ACACAATATC AACCAAGCCC CGAAACGGCA GCAGTACGGC AAATGGACTT
701 TCCCGAAACA GGTGGACGGC ACGGCGGTCA ATTACCGGCT CGGCGCGGAG
751 AAAAAATGGT CGCTGAAAAA CGGCTGGTAC ACGACGGCGG GCGGCGACGT
801 GTCCGGCAGG GTTTATCCGG GGAATAAGAA ATTCAACGAT ATGACGGCAG
```

-continued

```
 851 GCGTTTCCGG CGGCATCGGT TTTGCCGACC GGCGCAAAGA TGCCGGGCTG

 901 GCAGTGTTCC ACGAACGCCG CACCTACGGC AACGACGCTT ATTCTTACAC

 951 CAACGGCGCA CGCCTTTATT TCAACCGTTG GCAAACCCCG AAATGGCAAA

1001 CGTTGTCTTC GGCGGAGTGG GGGCGTTTGA AGAATACGCG CCGGGCGCGT

1051 TCCGACAATA CCCATTTGCA AATTTCCAAT TCGCTGGTGT TTTACCGGAA

1101 TGCGCGCCAA TATTGGATGG GCGGTTTGGA TTTTTACCGC GAGCGCAACC

1151 CCGCCGACCG GGGCGACAAT TTCAACCGTT ACGGCCTGCG CTTTGCCTGG

1201 GGGCAGGAAT GGGGCGGCAG CGGCCTGTCT TCGCTGTTGC GCCTCGGCGC

1251 GGCGAAACGG CATTATGAAA AACCCGGCTT TTTCAGCGGT TTTAAAGGGG

1301 AAAGGCGCAG GGATAAAGAA TTGAACACAT CCTTGAGCCT TTGGCACCGG

1351 GCATTGCATT TCAAAGGCAT CACGCCGCGC CTGACGTTGT CGCACCGCGA

1401 AACGCGGAGT AACGATGTGT TCAACGAATA CGAGAAAAAT CGGGCGTTTG

1451 TCGAGTTTAA TAAAACGTTC TGA
```

This corresponds to the amino acid sequence <SEQ ID 2642; ORF 769>:

m769.pep

```
  1 LIMVIFYFCG KTFMPARNRW MLLLPLLASA AYAEETPREP DLRSRPEFRL

 51 HEAEVKPIDR EKVPGQVREK GKVLQIDGET LLKNPELLSR AMYSAVVSNN

101 IAGIRVILPI YLQQAQQDKM LALYAQGILA QADGRVKEAI SHYRELIAAQ

151 PDAPAVRMRL AAALFENRQN EAAADQFDRL KAENLPPQLM EQVELYRKAL

201 RERDAWKVNG GFSVTREHNI NQAPKRQQYG KWTFPKQVDG TAVNYRLGAE

251 KKWSLKNGWY TTAGGDVSGR VYPGNKKFND MTAGVSGGIG FADRRKDAGL

301 AVFHERRTYG NDAYSYTNGA RLYFNRWQTP KWQTLSSAEW GRLKNTRRAR

351 SDNTHLQISN SLVFYRNARQ YWMGGLDFYR ERNPADRGDN FNRYGLRFAW

401 GQEWGGSGLS SLLRLGAAKR HYEKPGFFSG FKGERRRDKE LNTSLSLWHR

451 ALHFKGITPR LTLSHRETRS NDVFNEYEKN RAFVEENKTF *
```

Computer analysis of this amino acid sequence gave the following results:

Homology with a predicted ORF from *N. gonorrhoeae*

ORF 769 shows 95.1% identity over a 492 aa overlap with a predicted ORF (ORF 769) from *N. gonorrhoeae* m769/g769 95.1% identity in 492 aa overlap

```
                       10        20        30        40        50        59
g769.pep       LIMVIFYFYFCGKTFMPARNRWMLL-PLLASAAYAEETPCEPDLRSRPEFRLHEAEVKPI
               |||||||  |||||||||||||||| ||||||||||||| ||||||||||||||||||||
m769           LIMVIFY--FCGKTFMPARNRWMLLLPLLASAAYAEETPREPDLRSRPEFRLHEAEVKPI
                         10        20        30        40        50

             60        70        80        90       100       110      119
g769.pep       DREKVPGQVREKGKVLQVDGETLLKNPELLSRAMYSAVVSNNIAGIRVILPIYLQQARQD
               |||||||||||||||||:|||||||||||||||||||||||||||||||||||||||:||
m769           DREKVPGQVREKGKVLQIDGETLLKNPELLSRAMYSAVVSNNIAGIRVILPIYLQQAQQD
               60        70        80        90       100       110
```

-continued

```
          120       130       140       150       160       170      179
g769.pep    KMLALYAQGILAQAEGRVKEAVSHYRELIAAQPDAPAVRMRLAAALFEDRQNEAAADQFD
            ||||||||||||||:||||||:||||||||||||||||||||||||||:|||||||||||
m769        KMLALYAQGILAQADGRVKEAISHYRELIAAQPDAPAVRMRLAAALFENRQNEAAADQFD
           120       130       140       150       160       170

          180       190       200       210       220       230      239
g769.pep    RLKTEDLPPQLMEQVELYRKALRERDAWKVNGGFSVTREHNINQAPKQQQYGNWTFPKQV
            |||:|:|||||||||||||||||||||||||||||||||||||||||:||||:|||||||
m769        RLKAENLPPQLMEQVELYRKALRERDAWKVNGGFSVTREHNINQAPKRQQYGKWTFPKQV
           180       190       200       210       220       230

          240       250       260       270       280       290      299
g769.pep    DGTAVNYRFGAEKKWSLKNGWYTTAGGDVSGRVYPGNKKFNDMTAGVSGGIGFADRRKDV
            ||||||||:||||||||||||||||||||||||||||||||||||||||||||||||||:
m769        DGTAVNYRLGAEKKWSLKNGWYTTAGGDVSGRVYPGNKKFNDMTAGVSGGIGFADRRKDA
           240       250       260       270       280       290

          300       310       320       330       340       350      359
g769.pep    GLAVFHERRTYGNDAYSYANGARLYFNRWQTPRWQTLSSAEWGRLKNTRRARSDNTHLQI
            ||||||||||||||||||:||||||||||||||:||||||||||||||||||||||||||
m769        GLAVFHERRTYGNDAYSYTNGARLYFNRWQTPKWQTLSSAEWGRLKNTRRARSDNTHLQI
           300       310       320       330       340       350

          360       370       380       390       400       410      419
g769.pep    SNSLVFYRNARQYWTGGLDFYRERNPADRGDNFNRYGLRFAWGQEWGGSGLSSLFRLGVA
            |||||||||||||| |||||||||||||||||||||||||||||||||||||||:|||:|
m769        SNSLVFYRNARQYWMGGLDFYRERNPADRGDNFNRYGLRFAWGQEWGGSGLSSLLRLGAA
           360       370       380       390       400       410

          420       430       440       450       460       470      479
g769.pep    KRHYEKPGFFSSFKGERRRDKESDTSLSLWHRALHFKGITPRLTLSHRETWSNDVENEYE
            |||||||||||:|||||||||| :|||||||||||||||||||||||||| |||||||||
m769        KRHYEKPGFFSGFKGERRRDKELNTSLSLWHRALHFKGITPRLTLSHRETRSNDVFNEYE
           420       430       440       450       460       470

          420       430
g769.pep    KNRAFVEFNKTFX
            |||||||||||||
m769        KNRAFVEFNKTFX
           420       430
```

The following partial DNA sequence was identified in *N. meningitidis* <SEQ ID 2643>:

a769.seq

```
  1 TTGATAATGG TTATTTTTTA TTTTTGTGGG AAGACATTTA TGCCTGCACG

 51 AAACAGATGG ATGCTGCTGC TGCCTTTATT GGCAAGCGCG GCATATGCCG

101 AAGAAACACC GCGCGAACCG GATTTGAGAA GCCGTCCCGA GTTCAGGCTT

151 CATGAAGCGG AGGTCAAACC AATCGACAGG GAGAAGGTAC CGGGGCAGGT

201 GCGGGAAAAA GGAAAAGTTT TGCAGATTGA CGGCGAAACC CTGCTGAAAA

251 ATCCCGAATT GCTGTCCCGC GCGATGTATT CCGCAGTGGT CTCAAACAAT

301 ATTGCCGGTA TCCGCGTTAT TTTGCCGATT TACCTACAAC AGGCGCAGCA

351 GGATAAGATG TTGGCACTTT ATGCACAAGG GATTTTGGCG CAGGCAGACG

401 GTAGGGTGAA GGAGGCGATT TCCCATTACC GGGAATTGAT TGTCGCCCAA

451 CCCGACGCGC CCGCCGTCCG TATGCGTTTG GCGGCGGCAT TGTTTGAAAA

501 CAGGCAGAAC GAGGCGGCGG CAGACCAGTT CGACCGCCTG AAGGCGGAAA

551 ACCTGCCGCC GCAGCTGATG GAGCAGGTCG AGCTGTACCG CAAGGCATTG

601 CGCGAACGCG ATGCGTGGAA GGTAAATGGC GGCTTCAGCG TTACCCGCGA

651 ACACAATATC AACCAAGCCC CGAAACGGCA GCAGTACGGC AAATGGACTT

701 TCCCGAAACA GGTGGACGGC ACGGCGGTCA ATTACCGGCT CGGCGCGGAG

751 AAAAAATGGT CGCTGAAAAA CGGCTGGTAC ACGACGGCGG GCGGCGACGT

801 GTCCGGCAGG GTTTATCCGG GGAATAAGAA ATTCAACGAT ATGACGGCAG

851 GCGTTTCCGG CGGCATCGGT TTTGCCGACC GGCGCAAAGA TGCCGGGCTG
```

-continued

```
 901 GCAGTGTTCC ACGAACGCCG CACCTACGGC AACGACGCTT ATTCTTACAC

 951 CAACGGCGCA CGCCTTTATT TCAACCGTTG GCAAACCCCG AAATGGCAAA

1001 CGTTGTCTTC GGCGGAGTGG GGGCGTTTGA AGAATACGCG CCGGGCGCGT

1051 TCCGACAATA CCCATTTGCA AATTTCCAAT TCGCTGGTGT TTTACCGGAA

1101 TGCGCGCCAA TATTGGATGG GCGGTTTGGA TTTTTACCGC GAGCGCAACC

1151 CCGCCGACCG GGGCGACAAT TTCAACCGTT ACGGCCTGCG CTTTGCCTGG

1201 GGGCAGGAAT GGGGCGGCAG CGGCCTGTCT TCGCTGTTGC GCCTCGGCGC

1251 GGCGAAACGG CATTATGAAA AACCCGGCTT TTTCAGCGGT TTTAAAGGGG

1301 AAAGGCGCAG GGATAAAGAA TTGAACACAT CCTTGAGCCT TTGGCACCGG

1351 GCATTGCATT TCAAAGGCAT CACGCCGCGC CTGACGTTGT CGCACCGCGA

1401 AACGCGGAGT AACGATGTGT TCAACGAATA CGAGAAAAAT CGGGCGTTTG

1451 TCGAGTTTAA TAAAACGTTC TGA
```

This corresponds to the amino acid sequence <SEQ ID 2644; ORF 769.a>:

a769.pep

```
  1 LIMVIFYFCG KTEMPARNRW MLLLPLLASA AYAEETPREP DLRSRPEFRL

 51 HEAEVKPIDR EKVPGQVREK GKVLQIDGET LLKNPELLSR AMYSAVVSNN

101 IAGIRVILPI YLQQAQQDKM LALYAQGILA QADGRVKEAI SHYRELIVAQ

151 PDAPAVRMRL AAALFENRQN EAAADQFDRL KAENLPPQLM EQVELYRKAL

201 RERDAWKVNG GFSVTREHNI NQAPKRQQYG KWTFPKQVDG TAVNYRLGAE

251 KKWSLKNGWY TTAGGDVSGR VYPGNKKFND MTAGVSGGIG FADRRKDAGL

301 AVFHERRTYG NDAYSYTNGA RLYFNRWQTP KWQTLSSAEW GRLKNTRRAR

351 SDNTHLQISN SLVFYRNARQ YWMGGLDFYR ERNPADRGDN FNRYGLRFAW

401 GQEWGGSGLS SLLRLGAAKR HYEKPGFFSG FKGERRRDKE LNTSLSLWHR

451 ALHFKGITPR LTLSHRETRS NDVFNEYEKN RAFVEFNKTF *
```

Computer analysis of this amino acid sequence gave the following results:

Homology with a predicted ORF from *N. meningitidis*

ORF 769 shows 99.8% identity over a 490 aa overlap with a predicted ORF (ORF 769) from *N. meningitidis:* m769/a769 99.8% identity in 490 aa overlap

```
                  10        20        30        40        50        60
a769.pep   LIMVIFYFCGKTFMPARNRWMLLLPLLASAAYAEETPREPDLRSRPEFRLHEAEVKPIDR
           ||||||||||||||||||||||||||||||||||||||||||||||||||||||||||||
m769       LIMVIFYFCGKTFMPARNRWMLLLPLLASAAYAEETPREPDLRSRPEFRLHEAEVKPIDR
                  10        20        30        40        50        60

                  70        80        90       100       110       120
a769.pep   EKVPGQVREKGKVLQIDGETLLKNPELLSRAMYSAVVSNNIAGIRVILPIYLQQAQQDKM
           ||||||||||||||||||||||||||||||||||||||||||||||||||||||||||||
m769       EKVPGQVREKGKVLQIDGETLLKNPELLSRAMYSAVVSNNIAGIRVILPIYLQQAQQDKM
                  70        80        90       100       110       120
```

-continued

```
                 130       140       150       160       170       180
a769.pep   LALYAQGILAQADGRVKEAISHYRELIVAQPDAPAVRMRLAAALFENRQNEAAADQFDRL
           |||||||||||||||||||||||||||:||||||||||||||||||||||||||||||||
m769       LALYAQGILAQADGRVKEAISHYRELIAAQPDAPAVRMRLAAALFENRQNEAAADQFDRL
                 130       140       150       160       170       180

                 190       200       210       220       230       240
a769.pep   KAENLPPQLMEQVELYRKALRERDAWKVNGGFSVTREHNINQAPKRQQYGKWTFPKQVDG
           ||||||||||||||||||||||||||||||||||||||||||||||||||||||||||||
m769       KAENLPPQLMEQVELYRKALRERDAWKVNGGFSVTREHNINQAPKRQQYGKWTFPKQVDG
                 190       200       210       220       230       240

                 250       260       270       280       290       300
a769.pep   TAVNYRLGAEKKWSLKNGWYTTAGGDVSGRVYPGNKKFNDMTAGVSGGIGFADRRKDAGL
           ||||||||||||||||||||||||||||||||||||||||||||||||||||||||||||
m769       TAVNYRLGAEKKWSLKNGWYTTAGGDVSGRVYPGNKKFNDMTAGVSGGIGFADRRKDAGL
                 250       260       270       280       290       300

                 310       320       330       340       350       360
a769.pep   AVFHERRTYGNDAYSYTNGARLYFNRWQTPKWQTLSSAEWGRLKNTRRARSDNTHLQISN
           ||||||||||||||||||||||||||||||||||||||||||||||||||||||||||||
m769       AVFHERRTYGNDAYSYTNGARLYFNRWQTPKWQTLSSAEWGRLKNTRRARSDNTHLQISN
                 310       320       330       340       350       360

                 370       380       390       400       410       420
a769.pep   SLVFYRNARQYWMGGLDFYRERNPADRGDNFNRYGLRFAWGQEWGGSGLSSLLRLGAAKR
           ||||||||||||||||||||||||||||||||||||||||||||||||||||||||||||
m769       SLVFYRNARQYWMGGLDFYRERNPADRGDNFNRYGLRFAWGQEWGGSGLSSLLRLGAAKR
                 370       380       390       400       410       420

                 430       440       450       460       470       480
a769.pep   HYEKPGFFSGFKGERRRDKELNTSLSLWHRALHFKGITPRLTLSHRETRSNDVFNEYEKN
           ||||||||||||||||||||||||||||||||||||||||||||||||||||||||||||
m769       HYEKPGFFSGFKGERRRDKELNTSLSLWHRALHFKGITPRLTLSHRETRSNDVFNEYEKN
                 430       440       450       460       470       480

                 490
a769.pep   RAFVEFNKTFX
           |||||||||||
m769       RAFVEFNKTFX
                 490
```

The following partial DNA sequence was identified in *N. gonorrhoeae* <SEQ ID 2645>:

g770.seq

```
  1 ATGAACAGAC TGCTACTGCT GTCTGCCGCC GTCCTGCCGA CTGCCTGCGG
 51 CAGCGGCGAA ACCGATAAAA TCGGACGGGC AAGTACCGTT TTCAACATGT
101 TGGGCAAAAA CGACCGTATC GAAGTGGAAG GATTCGACGA TCCCGACGTT
151 CAAGGGGTTG CCTGTTATAT TTCGTATGCA AAAAAAGGCG GCTTGAAGGA
201 AATGGTCAAT TTGGAAGAGG ACGCGTCCGA CGCATCGGTT TCGTGCGTTC
251 AGACGGCATC TTCGATTTCT TTTGACGAAA CCGCCGTGCG CAAACCGAAA
301 GAAGTTTTCA AGCGCGGTAC GGGCTTCGCG TTCAAGAGCC GGCAGATTGT
351 CCGTTATTAC GACCCCAAAC GCAAAGCCTT CGCCTATTTG GTTTACAGCG
401 ATAAAATCGT CCAAGGATCG CCGAAAAATT CCTTAAGCGC GGTTTCCTGT
451 TTCGGCAGCG GCATACCGCA AACCGACGGG GTGCAAGCCG ATACTTCCGG
501 CAAACTGCTT GCCGGCGCCT GCATTATTTC CAACCCGATA AAAAATCCCG
551 ACAAACGCTG A
```

This corresponds to the amino acid sequence <SEQ ID 2646; ORF 770.ng>:

g770.pep

```
  1 MNRLLLLSAA VLPTACGSGE TDKIGRASTV FNMLGKNDRI EVEGFDDPDV
 51 QGVACYISYA KKGGLKEMVN LEEDASDASV SCVQTASSIS FDETAVRKPK
```

-continued

```
101 EVFKRGTGFA FKSRQIVRYY DPKRKAFAYL VYSDKIVQGS PKNSLSAVSC

151 FGSGIPQTDG VQADTSGKLL AGACIISNPI KNPDKR*
```

The following partial DNA sequence was identified in *N. meningitidis* <SEQ ID 2647>:

m770.seq

```
  1 ATGAACAGAC TGCTACTGCT GTCTGCCGCC GTCCTGCTGA CTGCCTGCGG
 51 CAGCGGCGAA ACCGATAAAA TCGGACGGGC AAGTACCGTT TTCAACATAC
101 TGGGCAAAAA CGACCGTATC GAAGTGGAAG GATTCGACGA TCCCGACGTT
151 CAAGGGGTTG CCTGTTATAT TTCGTATGCA AAAAAAGGCG GCTTGAAGGA
201 AATGGTCAAT TTGGAAGAGG ACGCGTCCGA CGCATCGGTT TCGTGCGTTC
251 AGACGGCATC TTCGATTTCT TTTGACGAAA CCGCCGTGCG CAAACCGAAA
301 GAAGTTTTCA AACACGGTGC GAGCTTCGCG TTCAAGAGCC GGCAGATTGT
351 CCGTTATTAC GACCCCAAAC GCAAAACCTT CGCCTATTTG GTGTACAGCG
401 ATAAAATCAT CCAAGGCTCG CCGAAAAATT CCTTAAGCGC GGTTTCCTGT
451 TTCGGCGGCG GCATACCGCA AACCGATGGG GTGCAAGCCG ATACTTCCGG
501 CAACCTGCTT GCCGGCGCCT GCATGATTTC CAACCCGATA GAAAATCTCG
551 ACAAACGCTG A
```

This corresponds to the amino acid sequence <SEQ ID 2648; ORF 770>:

m770.pep

```
  1 MNRLLLLSAA VLLTACGSGE TDKIGRASTV FNILGKNDRI EVEGFDDPDV
 51 QGVACYISYA KKGGLKEMVN LEEDASDASV SCVQTASSIS FDETAVRKPK
101 EVFKHGASFA FKSRQIVRYY DPKRKTFAYL VYSDKIIQGS PKNSLSAVSC
151 FGGGIPQTDG VQADTSGNLL AGACMISNPI ENLDKR*
```

Computer analysis of this amino acid sequence gave the following results:

Homology with a predicted ORF from *N. gonorrhoeae*

ORF 770 shows 93.5% identity over a 186 aa overlap with a predicted ORF (ORF 770) from *N. gonorrhoeae* m770/g770 93.5% identity in 186 aa overlap

```
                  10        20        30        40        50        60
g770.pep    MNRLLLLSAAVLPTACGSGETDKIGRASTVFNMLGKNDRIEVEGFDDPDVQGVACYISYA
            |||||||||||| |||||||||||||||||||:|||||||||||||||||||||||||||
m770        MNRLLLLSAAVLLTACGSGETDKIGRASTVFNNLGKNDRIEVEGFDDPDVQGVACYISYA
                  10        20        30        40        50        60

                  70        80        90       100       110       120
g770.pep    KKGGLKEMVNLEEDASDASVSCVQTASSISFDETAVRKPKEVFKRGTGFAFKSRQIVRYY
            ||||||||||||||||||||||||||||||||||||||||||||:|::||||||||||||
m770        KKGGLKEMVNLEEDASDASVSCVQTASSISFDETAVRKPKEVFKHGASFAFKSRQIVRYY
                  70        80        90       100       110       120

                 130       140       150       160       170       180
g770.pep    DPKRKAFAYLVYSDKIVQGSPKNSLSAVSCFGSGIPQTDGVQADTSGKLLAGACIISNPI
            |||||:||||||||||:|||||||||||||||:|||||||||||||||:||||||:||||
m770        DPKRKTFAYLVYSDKIIQGSPKNSLSAVSCFGGGIPQTDGVQADTSGNLLAGACMISNPI
                 130       140       150       160       170       180
```

-continued

```
g770.pep       KNPDKRX
               :| ||||
m770           ENLDKRX
```

The following partial DNA sequence was identified in *N. meningitidis* <SEQ ID 2649>:

a770.seq

```
  1 ATGAACAGAC TGCTACTGCT GTCTGCCGCC GTCCTGCTGA CTGCCTGCGG
 51 CAGCGGCGAA ACCGATAAAA TCGGACGGGC AAGTACCGTT TTCAACATAC
101 TGGGCAAAAA CGACCGTATC GAAGTGGAAG GATTCGACGA TCCCGACGTT
151 CAAGGGGTTG CCTGTTATAT TTCGTATGCA AAAAAAGGCG GCTTGAAGGA
201 AATGGTCAAT TTGGAAGAGG ACGCGTCCGA CGCATCGGTT TCGTGCGTTC
251 AGACGGCATC TTCGATTTCT TTTGACGAAA CCGCCGTGCG CAAACCGAAA
301 GAAGTTTTCA AACACGGTGC GAGCTTCGCG TTCAAGAGCC GGCAGATTGT
351 CCGTTATTAC GACCCCAAAC GCAAAACCTT CGCCTATTTG GTGTACAGCG
401 ATAAAATCAT CCAAGGCTCG CCGAAAAATT CCTTAAGCGC GGTTTCCTGT
451 TTCGGCGGCG GCATACCGCA AACCGATGGG GTGCAAGCCG ATACTTCCGG
501 CAACCTGCTT GCCGGCGCCT GCATGATTTC CAACCCGATA GAAAATCCCG
551 ACAAACGCTG A
```

This corresponds to the amino acid sequence <SEQ ID 2650; ORF 770.a>:

a770.pep

```
  1 MNRLLLLSAA VLLTACGSGE TDKIGRASTV FNILGKNDRI EVEGFDDPDV
 51 QGVACYISYA KKGGLKEMVN LEEDASDASV SCVQTASSIS FDETAVRKPK
101 EVFKHGASFA FKSRQIVRYY DPKRKTFAYL VYSDKIIQGS PKNSLSAVSC
151 PGGGIPQTDG VQADTSGNLL AGACMISNPI ENPDKR*
```

Computer analysis of this amino acid sequence gave the following results:

Homology with a predicted ORF from *N. meningitidis*

ORF 770 shows 99.5% identity over a 186 aa overlap with a predicted ORF (ORF 770) from *N. meningitidis:* m770/a770 99.5% identity in 186 aa overlap

```
                       10        20        30        40        50        60
a770.pep       MNRLLLLSAAVLLTACGSGETDKIGRASTVFNILGKNDRIEVEGFDDPDVQGVACYISYA
               ||||||||||||||||||||||||||||||||||||||||||||||||||||||||||||
m770           MNRLLLLSAAVLLTACGSGETDKIGRASTVFNILGKNDRIEVEGFDDPDVQGVACYISYA
                       10        20        30        40        50        60

                       70        80        90       100       110       120
a770.pep       KKGGLKEMVNLEEDASDASVSCVQTASSISFDETAVRKPKEVFKHGASFAFKSRQIVRYY
               ||||||||||||||||||||||||||||||||||||||||||||||||||||||||||||
m770           KKGGLKEMVNLEEDASDASVSCVQTASSISFDETAVRKPKEVFKHGASFAFKSRQIVRYY
                       70        80        90       100       110       120

                      130       140       150       160       170       180
a770.pep       DPKRKTFAYLVYSDKIIQGSPKNSLSAVSCFGGGIPQTDGVQADTSGNLLAGACMISNPI
               ||||||||||||||||||||||||||||||||||||||||||||||||||||||||||||
m770           DPKRKTFAYLVYSDKIIQGSPKNSLSAVSCFGGGIPQTDGVQADTSGNLLAGACMISNPI
                      130       140       150       160       170       180
```

-continued

```
a770.pep     ENPDKRX
             || ||||
m770         ENLDKRX
```

The following partial DNA sequence was identified in *N. gonorrhoeae* <SEQ ID 2651>:

g771.seq

```
   1 ATGGATTTAT TATCGGTTTT CCACAAATAC CGTCTGAAAT ATGCGGTGGC
  51 GGTGCTGACG ATGCTGCTTT TGGCGGCAGT CGGGCTGCAC GCTTCCGTAT
 101 ATCGCACCTT CACGCCCGAA AACATCCGCA GCCGCCTCCA ACAAAGCATT
 151 GCCCATACCC ACCGGAAAAT CTCGTTTGAT GCGGATATAC GGCGCAGGCT
 201 TCTGCCCCGC CCGACCGTCA TCCTGAAAAA CCTGACCATT ACCGAACCCG
 251 ACGGCGGCCG GGTCGCCGTT TCCGTCAAAG AAACCAAAAT CGGATTGAGC
 301 TGGAAAAACC TGTGGTCGGA TCGGATACAG GTTGAAAAAT GGGTGGTTTC
 351 GGGTGCGGAT CTTGCCCTGA CGCGCGACAG AAACGGCGCT TGGAACATCC
 401 AAGACCTGTT CGACGGCGCG AAACACTCCG CCTCAGTCAA CCGCATTATC
 451 GTCGAAAACA GCACCGTCCG CCTCAATTTC CTGCAGCAAC AGCTTATCCT
 501 GAAGGAAATC AGCCTCAACC TGCAATCCCC CGATTCGTCG GGGCAGCAGT
 551 TTGAAAGTTC GGGCATACTG GTTTGGAGAA AGCTGTCCGT CCCGTGGAAA
 601 AGCAGGGGGC TGTTCCTTTC AGACGGCATC GGCACGCCCG AAATCTCACC
 651 GTTCCATTTT GAAGCTTCCA CTTCGCTGGA CGGACACGGC ATCACCATTT
 701 CCACCACCGG CAGCCCTTCT GTCCGCTTCA ACGCCGGCGG AGCGGATGCC
 751 GCCGGCCTCG GCCTGCGTGC AGACACTTCC TTCCGCAACC TCCACCTGAC
 801 CGCGCAAATC CCCGCACTGG CACTCAAAAA CAACAGCATC AAAACCGGCA
 851 CGGTCAACGG CACGTTTACC GCCGGCGGCG AATATGCCCG ATGGGACGGT
 901 TCGTTCAAAC TCGACAAAGC CAACCTGCAC TCCGGCATCG CCAACATCGG
 951 CAACGCCGAA ATCTCCGGCA GCTTCAAAAC ACCGCGCCTT CAAACCAATT
1001 TCTCCCTCGG CTCGCCGTTG GTTTGGAGTC GGGACAACGG GCTGGACGCC
1051 CCGCGCCTGC ACATATCGAC CCTTCAGGAT ACCGTCGACC GCCTGCCGCA
1101 ACCCCGTTTC ATCAGCCGGC TCGACGGTTC GCTGTCCATA CCGAATCTGC
1151 AAAATTGGAA TGCCGAATTA AACGGCACAT TCGACCGCCA ACCCGTTGCC
1201 GCAAAATTCA AATATACGCG GGAAGGCGCA CCGCACCTGG AAGCCGCCGC
1251 CGCGCTGCAA AAATTAAACC TCGCCCCCTA TCTTGACGAA TTTCGGCAAC
1301 AAAACGGCAA AATATTCCCC GACATCCTCG GCAGGCTGTC CGGCAACGTC
1351 GAGGCACACC TCAAAATCGG CAGCATCCAA CTCCCCGGCT TGCAACTGGA
1401 CGATATGGAA ACCTACCTCC ACGCCGACAA AGACCATATC GCGCTCAGCC
1451 GTTTCAAGTC AGGGCTTTAC GGCGGCCATA CCGAAGGCGG CATCAGCATC
1501 GCCAACACCC GTCCCGCCAC TTACCGCCTG CAACAGAATG CAAGCAACAT
1551 CCAAATCCAA CCGCTGCTGC AAGACCTGTT CGGCTTCCAC AGCTTCAGCG
1601 GCAACGGCGA TGCGGTCATC GACCTGACCG CAAGCGGCGA AAACCGCAAA
```

-continued

```
1651 CAGCTTATCC GCTCGCTGCA AGGCAGCCTG TCGCTGAATA TTTCCAACGG

1701 CGCGTGGCAC GGCATCGATA TGGACAGCAT TTTAAAAAAC GGCCTTTCCG

1751 GGAAAATCTC GGGCAGCACA CCCTTCTACC GATTCACGCT CAACAGCGAA

1801 ATTTCAGACG GCATCAGCCG CCACATCGAT ACCGAACTCT TCTCCGACAG

1851 CCTCTATGTT ACCAGCAACG GCTATACCAA TCTGGATACG CAGGAATTGT

1901 CTGAAGATGT CCTTATCCGC AACGCCGTCC ATCCGAAAAA CAAACCGATT

1951 CCCCTGAAAA TCACCGGTAC GGTGGACAAG CCGTCCATTA CCGTCGATTA

2001 CGGCAGGCTG ACCGGCGGCA TCAATTCGCG CAAAGAGAAA CAGAAAATCC

2051 TCGAAGACAC CCTGCTGGAA CAATGGCAGT GGCTCAAACC TAAAGAACCG

3051 TAA
```

This corresponds to the amino acid sequence <SEQ ID 2652; ORF 771.ng>:

g771.pep

```
  1 MDLLSVFHKY RLKYAVAVLT MLLLAAVGLH ASVYRTFTPE NIRSRLQQSI

 51 AHTHRKISFD ADIRRRLLPR PTVILKNLTI TEPDGGRVAV SVKETKIGLS

101 WKNLWSDRIQ VEKWVVSGAD LALTRDRNGA WNIQDLFDGA KHSASVNRII

151 VENSTVRLNF LQQQLILKEI SLNLQSPDSS GQQFESSGIL VWRKLSVPWK

201 SRGLFLSDGI GTPEISPFHF EASTSLDGHG ITISTTGSPS VRFNAGGADA

251 AGLGLRADTS FRNLHLTAQI PALALKNNSI KTGTVNGTFT AGGEYARWDG

301 SFKLDKANLH SGIANIGNAE ISGSFKTPRL QTNFSLGSPL VWSRDNGLDA

351 PRLHISTLQD TVDRLPQPRF ISRLDGSLSI PNLQNWNAEL NGTFDRQPVA

401 AKFKYTREGA PHLEAAAALQ KLNLAPYLDE FRQQNGKIFP DILGRLSGNV

451 EAHLKIGSIQ LPGLQLDDME TYLHADKDHI ALSRFKSGLY GGHTEGGISI

501 ANTRPATYRL QQNASNIQIQ PLLQDLFGFH SFSGNGDAVI DLTASGENRK

551 QLIRSLQGSL SLNISNGAWH GIDMDSILKN GLSGKISGST PFYRFTLNSE

601 ISDGISRHID TELFSDSLYV TSNGYTNLDT QELSEDVLIR NAVHPKNKPI

651 PLKITGTVDK PSITVDYGRL TGGINSRKEK QKILEDTLLE QWQWLKPKEP

701 *
```

The following partial DNA sequence was identified in *N. meningitidis* <SEQ ID 2653>:

m771.seq

```
  1 ATGGATTTAT TATCGGTTTT CCACAAATAC CGTCTGAAAT ATGCGGTGGC

 51 CGTGCTGACG ATACTGCTTT TGGCGGCAGT CGGGCTGCAC GCTTCCGTAT

101 ATCGCACCTT CACGCCTGAA AACATCCGCA GCCGCCTACA ACAAAGCATT

151 GCACACACAC ACCGGAAAAT CTCGTTTGAT GCGGACATTC AGCGCAGGCT

201 CCTGCCCCGG CCGACCGTCA TCCTGAAAAA CCTGACCATT ACCGAACCCG

251 GCGGCGACCA GACTGCCGTT TCCGTCCAAG AAACCAAAAT CGGATTGAGC

301 TGGAAAAACC TGTGGTCGGA TCAGATACAG ATTGAAAAAT GGGTGGTTTC
```

-continued

```
 351 GAGTGCGGAA CTTGCCCTGA CGCGCGACGG GAAAGGTGTT TGGAACATCC
 401 AAGACCTGAT CGACAGCCAA AAACGCCAAG CCTCAGTCAA CCGCATTATC
 451 GTCGAAAACA GCACCGTCCG CCTCAATTTC CTGCAGGAAC AGCTTATCCT
 501 GAAGGAAATC AACCTCAACC TGCAATCCCC CGATTCGTCG GGGCAGCCGT
 551 TTGAAAGTTC GGGCATACTG GTTTGGGGAA AGCTGTCCGT CCCGTGGAAA
 601 AGCAGGGGGC TGTTCCTTTC AAACGGCATC GGCCCGCCCG AAATCTCACC
 651 GTTCCATTTT GAAGCTTCCA CTTCGCTGGA CGGACACGGC ATTACCATTT
 701 CCACCACCGG CAGCCCTTCT GTCCGCTTCA ACGCCGGCGG AGCGGATGCC
 751 GCCGGCCTCG GCCTGCGTGC AGACACTTCC TTCCGCAACC TCCACCTGAC
 801 CGCCCAAATC CCCGCGCTGG CACTCAGGAA CAACAGCATT AAAATTGAAA
 851 CCGTCAACGG CGCATTTACC GCCGGCGGCG AATATGCCCG ATGGGACGGT
 901 TCGTTCAAAC TCGACAAAGC CAACCTGCAC TCCGGCATCG CCAACATCGG
 951 CAACGCCGAA ATCTCCGGCA GCTTCAAAAC ACCGCGCCAC CAGACCAACT
1001 TCTCCCTCAA TTCGCCGCTC GTATGGACGG AAAACAAAGG GCTGGACGCG
1051 CCGCGCCTGT ATGTATCGAC CCTTCAGGAT ACCGTCAACC GCCTGCCGCA
1101 ACCCCGTTTC ATCAGCCGGC TCGACGGTTC GCTGTCCGTA CCGAATCTGC
1151 AAAATTGGAA TGCCGAATTA AACGGCACAT TCGACCGCCA AACCGTTGCC
1201 GCGAAATTCA GATACACACA TGAAGACGCA CCGCATCTGG AAGCCGCCGT
1251 CGCACTGCAA AAATTGAACC TGACCCCCTA TCTTGACGAC GTGCGGCAAC
1301 AAAACGGCAA AATATTTCCC GACACCCTCG CCAAGCTGTC CGGCGACATC
1351 GAGGCGCACC TGAAAATCGG AAAAGTCCAA CTTCCCGGCC TGCAACTGGA
1401 CGATATGGAA ACCTACCTCC ACGCCGACAA AGGCCATATC GCGCTCAGCC
1451 GTTTCAAGTC AGGGCTTTAC GGCGGCCATA CCGAAGGCGG CATCAGCATC
1501 GCCAACACCC GTCCCGCCAC TTACCGCCTG CAACAGAATG CAAGCAACAT
1551 CCAAATCCAA CCGCTGCTGC AAGACCTGTT CGGCTTCCAC AGCTTCAGCG
1601 GCAACGGCGA CGCGGTCATC GACCTGACCG CGGGCGGCGA AACCCGAAAA
1651 GAGCTTATCC GCTCGCTTCA GGGCAGCCTG TCGCTAAATA TTTCCAACGG
1701 TGCATGGCAC GGTATCGACA TGGACAATAT CCTGAAAAAC GGCATTTCGG
1751 GCAAAACTGC CGACAATGCC GCACCCAGCA CACCCTTCCA CCGATTCACG
1801 CTCAACAGCG AAATTTCAGA CGGCATCAGC CGCCACATCG ATACCGAACT
1851 CTTCTCCGAC AGCCTCTATG TTACCAGCAA CGGCTATACC AATCTGGATA
1901 CGCAGGAATT GTCTGAAGAT GTCCTTATCC GCAACGCCGT CCATCCGAAA
1951 AACAAACCGA TTCCCCTGAA AATCACCGGC ACGGTGGACA AACCGTCCAT
2001 TACCGTCGAT TACGGCAGGC TGACCGGCGG CATCAATTCG CGCAAAGAGA
2051 AACAGAAAAT CCTCGAAGAC ACCCTGCTGG AACAATGGCA GTGGCTCAAA
2101 CCTAAAGAAC CGTA
```

This corresponds to the amino acid sequence <SEQ ID 2654; ORF 771>:

m771.pep

```
  1 MDLLSVFHKY RLKYAVAVLT ILLLAAVGLH ASVYRTFTPE NIRSRLQQSI
 51 AHTHRKISFD ADIQRRLLPR PTVILKNLTI TEPGGDQTAV SVQETKIGLS
101 WKNLWSDQIQ IEKWVVSSAE LALTRDGKGV WNIQDLIDSQ KRQASVNRII
151 VENSTVRLNF LQEQLILKEI NLNLQSPDSS GQPFESSGIL VWGKLSVPWK
201 SRGLFLSNGI GPPEISPFHF EASTSLDGHG ITISTTGSPS VRFNAGGADA
251 AGLGLRADTS FRNLHLTAQI PALALRNNSI KIETVNGAFT AGGEYARWDG
301 SFKLDKANLH SGIANIGNAE ISGSFKTPRH QTNFSLNSPL VWTENKGLDA
351 PRLYVSTLQD TVNRLPQPRF ISRLDGSLSV PNLQNWNAEL NGTFDRQTVA
401 AKFRYTHEDA PHLEAAVALQ KLNLTPYLDD VRQQNGKIFP DTLAKLSGDI
451 EAHLKIGKVQ LPGLQLDDME TYLHADKGHI ALSRFKSGLY GGHTEGGISI
501 ANTRPATYRL QQNASNIQIQ PLLQDLFGFH SFSGNGDAVI DLTAGGETRK
551 ELIRSLQGSL SLNISNGAWH GIDMDNILKN GISGKTADNA APSTPFHRFT
601 LNSEISDGIS RHIDTELFSD SLYVTSNGYT NLDTQELSED VLIRNAVHPK
651 NKPIPLKITG TVDKPSITVD YGRLTGGINS RKEKQKILED TLLEQWQWLK
701 PKEP*
```

Computer analysis of this amino acid sequence gave the following results:

Homology with a predicted ORF from *N. gonorrhoeae*

ORF 771 shows 90.3% identity over a 704 aa overlap with a predicted ORF (ORF 771) from *N. gonorrhoeae* m771/g771 90.3% identity in 704 aa overlap

```
                        10        20        30        40        50        60
g771.pep    MDLLSVFHKYRLKYAVAVLTMLLLAAVGLHASVYRTFTPENIRSRLQQSIAHTHRKISFD
            ||||||||||||||||||||:|||||||||||||||||||||||||||||||||||||||
m771        MDLLSVFHKYRLKYAVAVLTILLLAAVGLHASVYRTFTPENIRSRLQQSIAHTHRKISFD
                        10        20        30        40        50        60

                        70        80        90       100       110       120
g771.pep    ADIRRRLLPRPTVILKNLTITEPDGGRVAVSVKETKIGLSWKNLWSDRIQVEKWVVSGAD
            |||:||||||||||||||||||| | ::||||:||||||||||||||:||:||||||:|:
m771        ADIQRRLLPRPTVILKNLTITEPGGDQTAVSVQETKIGLSWKNLWSDQIQIEKWVVSSAE
                        70        80        90       100       110       120

                       130       140       150       160       170       180
g771.pep    LALTRDRNGAWNIQDLFDGAKHSASVNRIIVENSTVRLNFLQQQLILKEISLNLQSPDSS
            |||||| :||||||||:|: |::|||||||||||||||||||:|||||||:|||||||||
m771        LALTRDGKGVWNIQDLIDSQKRQASVNRIIVENSTVRLNFLQEQLILKEINLNLQSPDSS
                       130       140       150       160       170       180

                       190       200       210       220       230       240
g771.pep    GQQFESSGILVWRKLSVPWKSRGLFLSDGIGTPEISPFHFEASTSLDGHGITISTTGSPS
            || ||||||||| ||||||||||||||:||| ||||||||||||||||||||||||||||
m771        GQPFESSGILVWGKLSVPWKSRGLFLSNGIGPPEISPFHFEASTSLDGHGITISTTGSPS
                       190       200       210       220       230       240

                       250       260       270       280       290       300
g771.pep    VRFNAGGADAAGLGLRADTSFRNLHLTAQIPALALKNNSIKTGTVNGTFTAGGEYARWDG
            |||||||||||||||||||||||||||||||||||:|||||  ||||:||||||||||||
m771        VRFNAGGADAAGLGLRADTSFRNLHLTAQIPALALRNNSIKIETVNGAFTAGGEYARWDG
                       250       260       270       280       290       300

                       310       320       330       340       350       360
g771.pep    SFKLDKANLHSGIANIGNAEISGSFKTPRLQTNFSLGSPLVWSRDNGLDAPRLHISTLQD
            ||||||||||||||||||||||||||||| ||||||:|||||::::|||||||::|||||
m771        SFKLDKANLHSGIANIGNAEISGSFKTPRHQTNGSLNSPLVWTENKGLDAPRLYVSTLQD
                       310       320       330       340       350       360

                       370       380       390       400       410       420
g771.pep    TVDRLPQPRFISRLDGSLSIPNLQNWNAELNGTFDRQPVAAKFKYTREGAPHLEAAAALQ
            ||:||||||||||||||||:||||||||||||||||| |||||:||:| ||||||||:|||
m771        TVNRLPQPRFISRLDGSLSVPNLQNWNAELNGTFDRQTVAAKFRYTHEGAPHLEAAAALQ
                       370       380       390       400       410       420
```

-continued

```
                430       440       450       460       470       780
g771.pep  KLNLAPYLDEFRQQNGKIFPDILGRLSGNVEAHLKIGSIQLPGLQLDDMETYLHADKDHI
          ||||:||||: |||||||||| |::|||::|||||||::|||||||||||||||||| ||
m771      KLNLTPYLDDVRQQNGKIFPDTLAKLSGKIEAHLKIGKVQLPGLQLDDMETYLHADKGHI
                430       440       450       460       470       780

                490       500       510       520       530       540
g771.pep  ALSRFKSGLYGGHTEGGISIANTRPATYRLQQNASNIQIQPLLQDLFGFHSFSGNGDAVI
          ||||||||||||||||||||||||||||||||||||||||||||||||||||||||||||
m771      ALSRFKSGLYGGHTEGGISIANTRPATYRLQQNASNIQIQPLLQDLFGFHSFSGNGDAVI
                490       500       510       520       530       540

                550       560       570       580           590
g771.pep  DLTASGENRKQLIRSLQGSLSLNISNGAWHGIDMDSILKNGLSGKISG----STPFYRFT
          ||||:||:||:|||||||||||||||||| |||||:|||||:||| :     ||||:|||
m771      DLTAGGETRKELIRSLQGSLSLNISNGAWHGIDMDNILKNGISGKTADNAAPSTPFHRFT
                550       560       570       580       590       600

            600       610       620       630       640       650
g771.pep  LNSEISDGISRHIDTELFSDSLYVTSNGYTNLDTQELSEDVLIRHAVHPKNKPIPLKITG
          ||||||||||||||||||||||||||||||||||||||||||||||||||||||||||||
m771      LNSEISDGISRHIDTELFSDSLYVTSNGYTNLDTQELSEDVLIRHAVHPKNKPIPLKITG
                610       620       630       640       650       660

            660       670       680       690       700
g771.pep  TVDKPSITVDYGRLTGGINSRKEKQKILEDTLLEQWQWLKPKEPX
          |||||||||||||||||||||||||||||||||||||||||||||
m771      TVDKPSITVDYGRLTGGINSRKEKQKILEDTLLEQWQWLKPKEPX
                670       680       690       700
```

The following partial DNA sequence was identified in *N. meningitidis* <SEQ ID 2655>:

<u>a771.seq</u>

```
   1 ATGGATTTAT TATCGGTCTT CCACAAATAC CGTCTGAAAT ATGCGGTAGC
  51 CGTGCTGACG ATACTGCTTT TGGCGGCAAT CGGGCTGCAC GCTTCCGTAT
 101 ATCGCATCTT CACACCTGAA AACATCCGAA GCCGCCTCCA ACAAAGCATT
 151 GCCCATACGC ACCGGAAAAT CTCGTTTGAT GCGGATATAC AGCGCAGGCT
 201 TCTGCCCCGG CCGACCGTCA TCCTGAAAAA CCTGACCATT ACCGAACCCG
 251 GCGGCGACCG GACTGCCGTT TCCGTCCAAG AAACCAAAAT CGGATTGAGC
 301 TGGAAAAACC TGTGGTCGGA TCAGATACAG ATTGAAAAAT GGGTGGTTTC
 351 GAGTGCGGAA CTTGCCCTGA CGCGCGACGG GAAAGGTGTT TGGAACATCC
 401 AAGACCTGAT CGACAGCCAA AAACGCCAAG CCTCAGTCAA CCGCATTATC
 451 GTCGAAAACA GCACCGTCCG CCTCAATTTC CTGCAGGAAC AGCTTATCCT
 501 GAAGGAAATC AACCTCAACC TGCAATCCCC CGATTCGTCG GGGCAGCCGT
 551 TTGAAAGTTC GGGCATACTG GTTTGGGGAA AGCTGTCCGT CCCGTGGAAA
 601 AGCAGGGGGC TGTTCCTTTC AGACGGCATC GGCACGCCCA AAATCTCACC
 651 GTTCCATTTT GAAGCTTCCA CTTCGCTGGA CGGACACGGC ATTACCATTT
 701 CCACCACCGG CAGCCCTTCT GTCCGCTTCA ACGCCGGCGG AGCGGATGCC
 751 GCCGGCCTCG GCCTGCGTGC AGACACTTCC TTCCGCAACC TCCACCTGAC
 801 CGCCCAAATC CCTACGCTGG CACTCAGGAA CAACAGCATT AAAATTGAAA
 851 CCGTCAACGG CGCATTTACC GCCGGCGGCG AATATGCCCA ATGGGACGGT
 901 TCGTTCAAAC TCGACAAAGC CAACCTGCAC TCCGGCATCG CCAACATCGG
 951 CAACGCCGAA ATCTCCGGCA GCTTCAAAAC ACCGCGCCAC CAGACCAACT
1001 TCTCCCTCAA TTCGCCGCTC GTATGGACGG AAAACAAAGG GCTGGACGCG
1051 CCGCGCCTGT ATGTATCGAC CCTTCAGGAT ACCGTCAACC GCCTGCCGCA
1101 ACCCCGTTTC ATCAGCCGGC TCGACGGTTC GCTGTCCGTA CCGAATCTGC
```

-continued

```
1151 AAAATTGGAA TGCCGAATTA AACGGCACAT TCGACCGCCA AACCGTTGCC

1201 GCGAAATTCA GATACACACA TGAAGACGCA CCGCATCTGG AAGCCGCCGT

1251 CGCACTGCAA AAATTGAACC TGACCCCCTA TCTTGACGAC GTGCGGCAAC

1301 AAAACGGCAA AATATTTCCC GACACCCTCG CCAAGCTGTC CGGCGACATC

1351 GAGGCGCACC TGAAAATCGG AAAAGTCCAA CTTCCCGGCC TGCAACTGGA

1401 CGATATGGAA ACCTACCTCC ACGCCGACAA AGGCCATATC GCGCTCAGCC

1451 GTTTCAAGTC AGGGCTTTAC GGCGGCCATA CCGAAGGCGG CATCAGCATC

1501 GCCAACACCC GTCCCGCCAC TTACCGCCTG CAACAGAATG CAAGCAACAT

1551 CCAAATCCAA CCGCTGCTGC AAGACCTGTT CGGCTTCCAC AGCTTCAGCG

1601 GCAACGGCGA CGCGGTCATC GACCTGACCG CGGGCGGCGA AACCCGAAAA

1651 GAGCTTATCC GCTCGCTTCA GGGCAGCCTG TCGCTAAATA TTTCCAACGG

1701 TGCATGGCAC GGTATCGACA TGGACAATAT CCTGAAAAAC GGCATTTCGG

1751 GCAAAACTGC CGACAATGCC GCACCCAGCA CACCCTTCCA CCGATTCACG

1801 CTCAACAGCG AAATTTCAGA CGGCATCAGC CGCCACATCG ATACCGAACT

1851 CTTCTCCGAC AGCCTCTATG TTACCAGCAA CGGCTATACC AATCTGGATA

1901 CGCAGGAATT GTCTGAAGAT GTCCTTATCC GCAACGCCGT CCATCCGAAA

1951 AACAAACCGA TTCCCCTGAA AATCACCGGT ACGGTGGACA AACCGTCCAT

2001 TACCGTCGAT TACGGCAGGC TGACCGGCGG CATCAATTCG CGCAAAGAGA

2051 AACAGAAAAT CCTCGAAGAC ACCCTGCTGG AACAATGGCA GTGGCTCAAA

2101 CCTAAAGAAC CGTAA
```

This corresponds to the amino acid sequence <SEQ ID 2656; ORF 771.a>:

a771.pep

```
  1 MDLLSVFHKY RLKYAVAVLT ILLLAAIGLH ASVYRIFTPE NIRSRLQQSI

 51 AHTHRKISFD ADIQRRLLPR PTVILKNLTI TEPGGDRTAV SVQETKIGLS

101 WKNLWSDQIQ IEKWVVSSAE LALTRDGKGV WNIQDLIDSQ KRQASVNRII

151 VENSTVRLNF LQEQLILKEI NLNLQSPDSS GQPFESSGIL VWGKLSVPWK

201 SRGLFLSDGI GTPKISPFHF EASTSLDGHG ITISTTGSPS VRFNAGGADA

251 AGLGLRADTS FRNLHLTAQI PTLALRNNSI KIETVNGAFT AGGEYAQWDG

301 SFKLDKANLH SGIANIGNAE ISGSFKTPRH QTNFSLNSPL VWTENKGLDA

351 PRLYVSTLQD TVNRLPQPRF ISRLDGSLSV PNLQNWNAEL NGTFDRQTVA

401 AKFRYTHEDA PHLEAAVALQ KLNLTPYLDD VRQQNGKIFP DTLAKLSGDI

451 EAHLKIGKVQ LPGLQLDDME TYLHADKGHI ALSRFKSGLY GGHTEGGISI

501 ANTRPATYRL QQNASNIQIQ PLLQDLFGFH SFSGNGDAVI DLTAGGETRK

551 ELIRSLQGSL SLNISNGAWH GIDMDNILKN GISGKTADNA APSTPFHRFT

601 LNSEISDGIS RHIDTELFSD SLYVTSNGYT NLDTQELSED VLIRNAVHPK

651 NKPIPLKITG TVDKPSITVD YGRLTGGINS RKEKQKILED TLLEQWQWLK

701 PKEP*
```

Computer analysis of this amino acid sequence gave the following results:

Homology with a predicted ORF from *N. meningitidis*

ORF 771 shows 98.9% identity over a 704 aa overlap with a predicted ORF (ORF 771) from *N. meningitidis* m771/a771 98.9% identity in 704 aa overlap

```
                   10        20        30        40        50        60
a771.pep   MDLLSVFHKYRLKYAVAVLTILLLAAIGLHASVYRIFTPENIRSRLQQSIAHTHRKISFD
           ||||||||||||||||||||||||||:|||||||| ||||||||||||||||||||||||
m771       MDLLSVFHKYRLKYAVAVLTILLLAAVGLHASVYRTFTPENIRSRLQQSIAHTHRKISFD
                   10        20        30        40        50        60

                   70        80        90       100       110       120
a771.pep   ADIQRRLLPRPTVILKNLTITEPGGDRTAVSVQETKIGLSWKNLWSDQIQIEKWVVSSAE
           ||||||||||||||||||||||||||:|||||||||||||||||||||||||||||||||
m771       ADIQRRLLPRPTVILKNLTITEPGGDQTAVSVQETKIGLSWKNLWSDQIQIEKWVVSSAE
                   70        80        90       100       110       120

                  130       140       150       160       170       180
a771.pep   LALTRDGKGVWNIQDLIDSQKRQASVNRIIVENSTVRLNFLQEQLILKEINLNLQSPDSS
           ||||||||||||||||||||||||||||||||||||||||||||||||||||||||||||
m771       LALTRDGKGVWNIQDLIDSQKRQASVNRIIVENSTVRLNFLQEQLILKEINLNLQSPDSS
                  130       140       150       160       170       180

                  190       200       210       220       230       240
a771.pep   GQPFESSGILVWGKLSVPWKSRGLFLSDGIGTPKISPFHFEASTSLDGHGITISTTGSPS
           |||||||||||||||||||||||||||:||| |:||||||||||||||||||||||||||
m771       GQPFESSGILVWGKLSVPWKSRGLFLSNGIGPPEISPFHFEASTSLDGHGITISTTGSPS
                  190       200       210       220       230       240

                  250       260       270       280       290       300
a771.pep   VRFNAGGADAAGLGLRADTSFRNLHLTAQIPTLALRNNSIKIETVNGAFTAGGEYAQWDG
           |||||||||||||||||||||||||||||||:||||||||||||||||||||||||:|||
m771       VRFNAGGADAAGLGLRADTSFRNLHLTAQIPALALRNNSIKIETVNGAFTAGGEYARWDG
                  250       260       270       280       290       300

                  310       320       330       340       350       360
a771.pep   SFKLDKANLHSGIANIGNAEISGSFKTPRHQTNFSLNSPLVWTENKGLDAPRLYVSTLQD
           ||||||||||||||||||||||||||||||||||||||||||||||||||||||||||||
m771       SFKLDKANLHSGIANIGNAEISGSFKTPRHQTNFSLNSPLVWTENKGLDAPRLYVSTLQD
                  310       320       330       340       350       360

                  370       380       390       400       410       420
a771.pep   TVNRLPQPRFISRLDGSLSVPNLQNWNAELNGTFDRQTVAAKFRYTHEDAPHLEAAVALQ
           ||||||||||||||||||||||||||||||||||||||||||||||||||||||||||||
m771       TVNRLPQPRFISRLDGSLSVPNLQNWNAELNGTFDRQTVAAKFRYTHEDAPHLEAAVALQ
                   370       380       390       400       410      420

                  430       440       450       460       470       480
a771.pep   KLNLTPYLDDVRQQNGKIFPDTLAKLSGDIEAHLKIGKVQLPGLQLDDMETYLHADKGHI
           ||||||||||||||||||||||||||||||||||||||||||||||||||||||||||||
m771       KLNLTPYLDDVRQQNGKIFPDTLAKLSGDIEAHLKIGHVQLPGLQLDDMETYLHADKGHI
                  430       440       450       460       470       480

                  490       500       510       520       530       540
a771.pep   ALSRFKSGLYGGHTEGGISIANTRPATYRLQQNASNIQIQPLLQDLFGFHSFSGNGDAVI
           ||||||||||||||||||||||||||||||||||||||||||||||||||||||||||||
m771       ALSRFKSGLYGGHTEGGISIANTRPATYRLQQNASNIQIQPLLQDLFGFHSFSGNGDAVI
                  490       500       510       520       530       540

                  550       560       570       580       590       600
a771.pep   DLTAGGETRKELIRSLQGSLSLNISNGAWHGIDMDNILKNGISGKTADNAAPSTPFHRFT
           ||||||||||||||||||||||||||||||||||||||||||||||||||||||||||||
m771       DLTAGGETRKELIRSLQGSLSLNISNGAWHGIDMDNILKNGISGKTADNAAPSTPFHRFT
                  550       560       570       580       590       600

                  610       620       630       640       650       660
a771.pep   LNSEISDGISRHIDTELFSDSLYVTSNGYTNLDTQELSEDVLIRNAVHPKNKPIPLKITG
           ||||||||||||||||||||||||||||||||||||||||||||||||||||||||||||
m771       LNSEISDGISRHIDTELFSDSLYVTSNGYTNLDTQELSEDVLIRNAVHPKNKPIPLKITG
                  610       620       630       640       650       660

                  670       680       690       700
a771.pep   TVDKPSITVDYGRLTGGINSRKEKQKILEDTLLEQWQWLKPKEPX
           ||||||||||||||||||||||||||||||||||||||||||||
m771       TVDKPSITVDYGRLTGGINSRKEKQKILEDTLLEQWQWLKPKEPX
                  670       680       690       700
```

The following partial DNA sequence was identified in *N. gonorrhoeae* <SEQ ID 2657>:

g772.seq

```
  1 GTGTTCGGCA CGGTCTTGCG GACTGATGCC GACTGCCTGC AAATCATCGT

 51 CGTCGGCAAG TTCTTTCAGG TTGTTGCGTA TGGTTTTGCG GCGTTGGCGG
```

-continued

```
101 AAGGCGAGTT TCACCAGTTT GGCGAAATGA TCGAAATCGT CCGCCTTGCC
151 GATACGGTGT TTCACCGGAA TCATGCGCAC CACTGCGGAA TCGATTTTCG
201 GCGCGGGATC GAACGATTCG GGCGGCACGT CAATCAGCAG CTCCATATCG
251 AAAAAATATT GCAGCATCAC ACCCAAGCGA CCGTAGTCGT TGCTTTTCGG
301 CGCGGCAACC ATGCGCTCGA CCACTTCTTT TTGCAACATA AAGTGCATAT
351 CGGCGACATC GTCCGCCACC TCCGCCAGTT TGAACAAAAG CGGCGTGGAG
401 ATGTTATACG GCAGGTTGCC GACGATTTTC TTTTTGCCTG AGATGCCGTT
451 GAAATCAAAC TGCAACACGT CGCCTTCGTG AATCACCAGT TTATCCGCAA
501 ACGGCAGCGT TTTCAGACGG CATACGATGT CGCGGTCGAT TTCGACAACG
551 TGCAGGCGGT TCAGCTTTTT CGCCAAAGGT TCGGTAATTG CCGCCAAACC
601 CGGGCCGATT TCAATCACGA CATCATCCGC CTGCGGGCGC ACGGCGTTGA
651 CAATATCGCC GATAATCCGC GTGTCCTGCA AAAAATTCTG CCCGAAACGC
701 TTGCGGGCTT TGTGTTCTTT CATCGTGTTT CCTCTTCGGT TGAAACCCCG
751 CCCTTTAGGG CGGCAGGATC AGACTCTGTT TGGGCGGGGC GTAACCCCTT
801 CCAAATCAGG ACGACACATA GGGCGGTGCT TTATGTGTCG TCCTGTGTGT
851 TGGAACATAA ATGTGTTTAC AGTATCCGTT TGATGTCGGC ATTGTAA
```

This corresponds to the amino acid sequence <SEQ ID 2658; ORF 772.ng>:

g772.pep

```
  1 VFGTVLRTDA DCLQIIVVGK FFQVVAYGFA ALAEGEFHQF GEMIEIVRLA
 51 DTVFHRNHAH HCGIDFRRGI ERFGRHVNQQ LHIEKILQHH TQATVVVAFR
101 RGNHALDHFF LQHKVHIGDI VRHLRQFEQK RRGDVIRQVA DDFLFA*DAV
151 EIKLQHVAFV NHQFIRKRQR FQTAYDVAVD FDNVQAVQLF RQRFGNCRQT
201 RADFNHDIIR LRAHGVDNIA DNPRVLQKIL PETLAGFVFF HRVSSSVETP
251 PFRAAGSDSV WAGRNPFQIR TTHRAVLYVS SCVLEHKCVY SIRLMSAL*
```

The following partial DNA sequence was identified in *N. meningitidis* <SEQ ID 2659>:

m772.seq

```
  1 ATGTTCGGCG CGGTCTTGCG GATTGATGCC GACTGCCTGC AAATCATCGT
 51 CGCCTGCAAG CTCTTTCAGA TTGTTGCGTA TGGTTTTGCG GCGTTGGTGG
101 AAGGCGAGTT TCACGAGTTT GGCAAAATGC TCGAAATCGT CCGCCTTGCC
151 GATGCGGTGT TTCACCGGAA TCATACGGAC GACGGCGGAA TCCACTTTCG
201 GCGCAGGGTC GAACGATTCG GGCGGTACGT CAATCAGCAT TTCCATATCG
251 AAAAAATATT GCAGCATCAC GCCCAAGCGG CCGTAGTCGT TGCTTTTCGG
301 CGCGGCAACC ATACGCTCGA CCACTTCTTT TTGCAGCATA AAGTGCATAT
351 CGACGACATC GTCCGCCACC TCCGCCAGCT TGAACAAAAG CGGTGTGGAA
401 ATGTTGTACG GGAGGTTGCC GACGATTTTC TTTTTGCCTG CGATGCCGTT
```

-continued

```
451 GAAATCAAAC TGCAATACAT CGCCTTCGTG AATCACCAGT TTATCCGCAA
501 ACGGCAGCGT TTTCAGACGG CATACGATGT CGCGGTCGAT TTCGACAACG
551 TGCAGGCGGT TCAGCTTTTT CGCCAAAGGT TCGGTAATCG CCGCCAAACC
601 CGGGCCGATT TCAATCACGA CATCATCCGC CTGCGGGCGC ACGGCGTTGA
651 CAATATCGCT GATAATCCGC GTGTCCTGCA AAAAATTCTG CCCGAAACGC
701 TTGCGGGCTT TGTGTTCTTT CATCGTGTTT CCTTTTCGGT TGAAACCCCG
751 CCCTTTAGGG CGGTAGAATC AGACTCTATT TGGGAGGGGC GTAACTCTTT
801 CCAAATCAGG ATGGCACATA GGGCGGTGCT TTATGTGTCG TCCTGTGTGT
851 TGAAACATAA ATGTGTTTAC AGTATCCGTT TGATGTCGGC ATTGTAA
```

This corresponds to the amino acid sequence <SEQ ID 2660; ORF 772>:

m772.pep

```
  1 MFGAVLRIDA DCLQIIVACK LFQIVAYGFA ALVEGEFHEF GKMLEIVRLA
 51 DAVFHRNHTD DGGIHFRRRV ERFGRYVNQH FHIEKILQHH AQAAVVVAFR
101 RGNHTLDHFF LQHKVHIDDI VRHLRQLEQK RCGNVVREVA DDFLFACDAV
151 EIKLQYIAFV NHQFIRKRQR FQTAYDVAVD FDNVQAVQLF RQRFGNRRQT
201 RADFNHDIIR LRAHGVDNIA DNPRVLQKIL PETLAGFVFF HRVSFSVETP
251 PFRAVESDSI WEGRNSFQIR MAHRAVLYVS SCVLKHKCVY SIRLMSAL*
```

Computer analysis of this amino acid sequence gave the following results:

Homology with a predicted ORF from *N. gonorrhoeae*

ORF 772 shows 85.2% identity over a 298 aa overlap with a predicted ORF (ORF 772) from *N. gonorrhoeae* m772/g772 85.2% identity in 298 aa overlap

```
                      10        20        30        40        50        60
g772.pep      VFGTVLRTDADCLQIIVVGKFFQVVAYGFAALAEGEFHQFGEMIEIVRLADTVFHRNHAH
              :||:||| |||||||||: |:||:||||||||:|||||:||:|:|||||||:|||||| :
m772          MFGAVLRIDADCLQIIVACKLFQIVAYGFAALVEGEFHEFGKMLEIVRLADAVFHRNHTD
                      10        20        30        40        50        60

                      70        80        90       100       110       120
g772.pep      HCGIDFRRGIERFGRHVNQQLHIEKILQHHTQATVVVAFRRGNHALDHFFLQHKVHIGDI
                || |||  :|||||:|||::|||||||||:||:||||||||||:|||||||||||| ||
m772          DGGIHFRRRVERFGRYVNQHFHIEKILQHHAQAAVVVAFRRGNHTLDHFFLQHKVHIDDI
                      70        80        90       100       110       120

                     130       140       150       160       170       180
g772.pep      VRHLRQFEQKRRGDVIRQVADDFLFAXDAVEIDLQHVAFVNHQFIRKRQRFQTAYDVAVD
              ||||||:|||| |:|:|:|||||||| ||||||||::|||||||||||||||||||||||
m773          VRGLRQLEQKRCGNVVREVADDFLFACDAVEIKLQYIAFVNHQFIRKRQRFQTAYDVAVD
                     130       140       150       160       170       180

                     190       200       210       220       230       240
g772.pep      FDNVQAVQLFRQRFGNCRQTRADFNHDIIRLRAHGVDNIADNPRVLQKILPETLAGFVFF
              |||||||||||||||| |||||||||||||||||||||||||||||||||||||||||||
m772          FDNVQAVQLFRQRFGNRRQTRADFNHDIIRLRAHGVDNIADNPRVLQKILPETLAGFVFF
                     190       200       210       220       230       240

                     250       260       270       280       290      299
g772.pep      HRVSSSVETPPFRAAGSDSVWAGRNPFQIRTTHRAVLYVSSCVLEHKCVYSIRLMSALX
              |||| |||||||||: |||:| ||| |||| :||||||||||||:||||||||||||||
m772          HRVSFSVETPPFRAVESDSIWEGRNSFQIRMAHRAVLYVSSCVLKHKCVYSIRLMSALX
                     250       260       270       280       290
```

The following partial DNA sequence was identified in *N. meningitidis* <SEQ ID 2661>:

a772.seq

```
  1 ATGTTCGGCG CGGTCTTGCG GATTGATGCC GACTGCCTGC AAATCATCGT
 51 CGCCTGCAAG CTCTTTCAGA TTGTTGCGTA TGGTTTTGCG GCGTTGGTGG
101 AAGGCGAGTT TCACGAGTTT GGCGAAATGC TCGAAATCGT CCGCCTTGCC
151 GATACGGTGT TTCACCGGAA TCATGCGGAC GACGGCCGAA TCCACTTTCG
201 GCGCGGGGTC GAACGATTCG GGCGGCACGT CAATCAGCAT TTCCATATCG
251 AAGAAATATT GCAGCATCAC GCCCAAGCGG CCGTAGTCGT TGCTTTTCGG
301 CGCGGCAACC ATACGATCGA CCACTTCTTT TTGCAGCATA AAGTGCATAT
351 CGACGACATC GTCCGCCACC TCCGCCAGCT TGAACAAAAG CGGCGTGGAA
401 ATGTTGTAGG GCAGGTTGCC GACGATTTTC TTTTTGCCTG CGATGCCGTT
451 GAAATCAAAC TGCAATACAT CGCCTTCGTG AATCACCAGT TTATCCGCAA
501 ACGGCAGCGT TTTCAGACGG CATACGATGT CGCGGTCGAT TTCGACAACG
551 TGCAGGCGGT TCAGCTTTTT CGCCAAAGGT TCGGTAATCG CCGCCAAACC
601 CGGACCGATT TCAATCACGA CATCATCCGC CTGCGGGCGC ACGGCGTTGA
651 CAATATCGCT GATAATCCGC GTGTCCTGCA AAAAATTCTG CCCGAAACGC
701 TTGCGGGCTT TGTGTTCTTT CATCGTGTTT CCTTTTCGGT TGAAACCCCG
751 CCCTTTAGGG CGGTAGAATC AGACTCTATT TGGGAGGGGC GTAACTCCTT
801 CCAAATCAGG ACGGCACATA GGGCGGTGCT TTATGTGTCG TCCTGTGTGT
851 TGAAACATAA ATGTGTTTAC AGTATCCGTT TGATGTCGGC ATTGTAA
```

This corresponds to the amino acid sequence <SEQ ID 2662; ORF 772.a>:

a772.pep

```
  1 MFGAVLRIDA DCLQIIVACK LFQIVAYGFA ALVEGEFHEF GEMLEIVRLA
 51 DTVFHRNHAD DGRIHFRRGV ERFGRHVNQH FHIEEILQHH AQAAVVVAFR
101 RGNHTIDHFF LQHKVHIDDI VRHLRQLEQK RRGNVVGQVA DDFLFACDAV
151 EIKLQYIAFV NHQFIRKRQR FQTAYDVAVD FDNVQAVQLF RQRFGNRRQT
201 RTDFNHDIIR LRAHGVDNIA DNPRVLQKIL PETLAGFVFF HRVSFSVETP
251 PFRAVESDSI WEGRNSFQIR TAHRAVLYVS SCVLKHKCVY SIRLMSAL*
```

Computer analysis of this amino acid sequence gave the following results:

Homology with a predicted ORF from *N. meningitidis*

ORF 772 shows 95.6% identity over a 298 aa overlap with a predicted ORF (ORF 772) from *N. meningitidis* m772/a772 95.6% identity in 298 aa overlap

```
                       10        20        30        40        50        60
a772.pep      MFGAVLRIDADCLQIIVACKLFQIVAYGFAALVEGEFHEFGEMLEIVRLADTVFHRNHAD
              |||||||||||||||||||||||||||||||||||||||||:|||||||||:||||||:|
m772          MFGAVLRIDADCLQIIVACKLFQIVAYGFAALVEGEFHEFGKMLEIVRLADAVFHRNHTD
                       10        20        30        40        50        60

                       70        80        90       100       110       120
a772.pep      DGRIHFRRGVERFGRHVNQHFHIEEILQHHAQAAVVVAFRRGNGTIDHFELQHKVHIDDI
              || ||||| ||||||:||||||||:||||||||||||||||||||:||||||||||||||
m772          DGGIHFRRRVERFGRYVNQHFHIEKILQHHAQAAVVVAFRRGNHTLDHFFLQHKVHIDDI
                       70        80        90       100       110       120
```

-continued

```
                         130       140       150       160       170       180
a772.pep        VRHLRQLEQKRRGNVVGQVADDFLFACDAVEIKLQYIAFVNHQFIRKRQRFQTAYDVAVD
                ||||||||||| |||| :||||||||||||||||||||||||||||||||||||||||||
m772            VRHLRQLEQKRCGNVVREVADDFLFACDAVEIKLQYIAFVNHQFIRKRQRFQTAYDVAVD
                         130       140       150       160       170       180

                         190       200       210       220       230       240
a772.pep        FDNVQAVQLFRQRFGNRRQTRTDFNHDIIRLRAHGVDNIADNPRVLQKILPETLAGFVFF
                |||||||||||||||||||||:||||||||||||||||||||||||||||||||||||||
m772            FDNVQAVQLFRQRFGNRRQTRADFNHDIIRLRAHGVDNIADNPRVLQKILPETLAGFVFF
                         190       200       210       220       230       240

                         250       260       270       280       290      299
a772.pep        HRVSFSVETPPFRAVESDSIWEGRNSFQIRTAHRAVLYVSSCVLKHKCVYSIRLMSALX
                |||||||||||||||||||||||||||||| ||||||||||||||||||||||||||||
m772            HRVSFSVETPPFRAVESDSIWEGRNSFQIRMAHRAVLYVSSCVLKHKCVYSIRLMSALX
                         250       260       270       280       290
```

g773.seq not found yet g773.pep not found yet

The following partial DNA sequence was identified in *N. meningitidis* <SEQ ID 2663>:

m773.seq

```
  1 ATGGGATTGG GTGCAACGAC TTTTGTCGGT TCGGGTGCTA TAGGCGGAGG
 51 TCTGTGCAGT ACCGGGATTG GCTGTGCGGC CGGTGGACTT ATTGCAACGG
101 CAGGTATGAC CGGTGGTTAT ACACAGGCCT CAGAAGGAAG CCGGCAATTG
151 TTTGGCACTT ACCAGTCCGA TTTTGGTAAA AAAGTTGTCC TATCTTTGGG
201 TACACCAATA GAATACGAAT CGCCGTTAGT ATCTGATGCG AAAAATCTAG
251 CCGTATGGGG ATTGGAAACG CTGATTACGC GCAAATTGGG AAACTTGGCA
301 ACGGGTGTGA AAACTTCCTT GACTCCGAAA ACTGCTGACG TACAGCGAAA
351 TATCCTGTCC CAATCCGAAG TCGGTATCAA GTGGGGCAAG GGGATTGAAG
401 GACAGGGAAT GCCTTGGGAG GATTATGTCG GTAAGGGCTT GTCTGCCAAT
451 GCAAGGTTAC CTAAAAATTT TAAAACATTT GATTATTTTG ATCGTGGTAC
501 AGGCACGGCA ATCAGTGCCA AAACTCTGGA TACGCAAACT ACGGCACGCC
551 TGTCCAAACC CGAACAGCTT TACAGTACCA TGAAAGGGTA CATCGATAAG
601 ACGGCAAATT TCAAAAGTTA TGAATTATCA GAAGTACCGT TAAGGGCAGA
651 CATGATCAAA CAGCGCGAAA TCCATCTGGC CATACCCGCA CAAACTAATA
701 AGGAGCAAAG ATTGCAGTTG CAACGTGTGG TAGAGTATGG CAAAAGTCAA
751 AACATTACAG TCAAAATTAC GGAGATCGAA TAA
```

This corresponds to the amino acid sequence <SEQ ID 2664; ORF 773>:

m773.pep

```
  1 MGLGATTFVG SGAIGGGLCS TGIGCAAGGL IATAGMTGGY TQASEGSRQL
 51 FGTYQSDFGK KVVLSLGTPI EYESPLVSDA KNLAVWGLET LITRKLGNLA
101 TGVKTSLTPK TADVQRNILS QSEVGIKWGK GIEGQGMPWE DYVGKGLSAN
```

-continued

```
151 ARLPKNFKTF DYFDRGTGTA ISAKTLDTQT TARLSKPEQL YSTMKGYIDK

201 TANFKSYELS EVPLRADMIK QREIHLAIPA QTNKEQRLQL QRVVEYGKSQ

251 NITVKITEIE *
```

a773.seq not found yet a773.pep not found yet

The following partial DNA sequence was identified in *N. gonorrhoeae* <SEQ ID 2665>:

g774.seq

```
  1 ATGAAGACCA AATTACCGCT TTTTATCATT TGGCTGTCTG TGTCTGCCTC

 51 CTGTGCTTCC GTTTTACCCG TTCCGGAGGG CAGCCGAACC GAAATGCCGA

101 CACAGGAAAA TGCTTCAGAC GGCATTCCCT ATCCCGTTCC CACTCTGCAA

151 GACCGTTTGG ACTATCTGGA AGGCAAAATC GTCCGGCTGT CGAACGAAGT

201 GGAAATGTTA AACGGGAAAG TCAAAGCATT GGAGCATACG AAAATACACC

251 CTTCCGGCAG GACATACGTC CAAAAACTCG ACGACCGCAA ATTGAAAGAG

301 CATTACCTCA ATACCGAAGG CGGCAGCGCA TCCGCACATA CCGTCGAAAC

351 CGCACAAAAC CTCTACAATC AGGCACTCAA ACACTATCAA AACGGCAGGT

401 TTTCTGCCGC AGCCGCCTTG TTGAAGGGGG CGGACGGCGG AGACGGCGGC

451 AGCATCGCGC AACGCAGTAT GTACCTGTTG CTGCAAAGCA GGGCGCGTAT

501 GGGGAACTGT GAATCTGTCA TCGAAATCGG AGGGCGTTAC GCCAACCGTT

551 TCAAAGACAG CCCAACCGCG CCCGAAGTCA TATTCAAAAT CGGCGAATGC

601 CAATACAGGC TTCAGCAAAA AGACATTGCA AGGGCGACTT GGCGCAGCCT

651 GATACAGACC TATCCCGGCA GCCCGGCGGC AAAACGCGCC GCCGCAGCCG

701 TACGCAAACG ATAG
```

This corresponds to the amino acid sequence <SEQ ID 2666; ORF 774.ng>:

g774.pep

```
  1 MKTKLPLFII WLSVSASCAS VLPVPEGSRT EMPTQENASD GIPYPVPTLQ

 51 DRLDYLEGKI VRLSNEVEML NGKVKALEHT KIHPSGRTYV QKLDDRKLKE

101 HYLNTEGGSA SAHTVETAQN LYNQALKHYQ NGRFSAAAAL LKGADGGDGG

151 SIAQRSMYLL LQSRARMGNC ESVIEIGGRY ANRFKDSPTA PEVIFKIGEC

201 QYRLQQKDIA RATWRSLIQT YPGSPAAKRA AAAVRKR*
```

The following partial DNA sequence was identified in *N. meningitidis* <SEQ ID 2667>:

m774.seq

```
  1 ATGAAGATCA AATTACCGCT TTTTATCATT TGGCTGTCTG TGTCCGCCTC

 51 CTGTGCTTCC GTTTCACCCG TTCCGGCAGG CAGCCAAACC GAAATGTCGA
```

-continued

```
101 CACGGGAAAA TGCTTCAGAC GGCATTCCCT ATCCCGTTCC GACCTTGCAA

151 GACCGTTTGG ACTATCTGGA AGGCAAAATC GTCCGGCTGT CGAACGAAGT

201 GGAAACCTTA AACGGCAAAG TCAAAGCACT GGAACACGCA AAAACACATT

251 CTTCCGGCAG GGCATACGTC CAAAAACTCG ACGACCGCAA GTTGAAAGAG

301 CATTACCTCA ATACCGAAGG CGGCAGCGCA TCCGCACATA CTGTCGAAAC

351 CGCACAAAAC CTCTACAATC AGGCACTCAA ACACTATAAA AGCGGCAAGT

401 TTTCTGCCGC TGCCTCCCTG TTGAAAGGCG CGGACGGAGG CGACGGCGGC

451 AGCATCGCGC AACGCAGTAT GTACCTGTTG CTGCAAAGCA GGGCGCGTAT

501 GGGCAACTGC GAATCCGTCA TCGAAATCGG AGGGCGTTAC GCCAACCGTT

551 TCAAAGACAG CCCAACCGCG CCTGAAGCCA TGTTCAAAAT CGGCGAATGC

601 CAATACAGGC TTCAGCAAAA AGACATTGCA AGGGCGACTT GGCGCAGCCT

651 GATACAGACC TATCCCGGCA GCCCGGCGGC AAAACGCGCC GCCGCAGCCG

701 TGCGCAAACG ATAG
```

This corresponds to the amino acid sequence <SEQ ID 2668; ORF 774>:

m774.pep

```
  1 MKIKLPLFII WLSVSASCAS VSPVPAGSQT EMSTRENASD GIPYPVPTLQ

 51 DRLDYLEGKI VRLSNEVETL NGKVKALEHA KTHSSGRAYV QKLDDRKLKE

101 HYLNTEGGSA SAHTVETAQN LYNQALKHYK SGKFSAAASL LKGADGGDGG

151 SIAQRSMYLL LQSRARMGNC ESVIEIGGRY ANRFKDSPTA PEAMFKIGEC

201 QYRLQQKDIA RATWRSLIQT YPGSPAAKRA AAAVRKR*
```

Computer analysis of this amino acid sequence gave the following results:

Homology with a predicted ORF from *N. gonorrhoeae*

ORF 774 shows 92.8% identity over a 237 aa overlap with a predicted ORF (ORF 774) from *N. gonorrhoeae* m774/g774 92.8% identity in 237 aa overlap

```
                    10        20        30        40        50        60
g774.pep    MKTKLPLFIIWLSVSASCASVLPVPEGSRTEMPTQENASDGIPYPVPTLQDRLDYLEGKI
            || |||||||||||||||||| ||| ||:||| |:|||||||||||||||||||||||||
m774        MKIKLPLFIIWLSVSASCASVSPVPAGSQTEMSTRENASDGIPYPVPTLQDRLDYLEGKI
                    10        20        30        40        50        60

                    70        80        90       100       110       120
g774.pep    VRLSNEVEMLNGKVKALEHTKIHPSGRTYVQKLDDRKLKEHYLNTEGGSASAHTVETAQN
            |||||||| ||||||||||:| | |||:||||||||||||||||||||||||||||||||
m774        VRLSNEVETLNGKVKALEHAKTHSSGRAYVQKLDDRKLKEHYLNTEGGSASAHTVETAQN
                    70        80        90       100       110       120

                   130       140       150       160       170       180
g774.pep    LYNQALKHYQNGRFSAAAALLKGADGGDGGSIAQRSMYLLLQSRARMGNCESVIEIGGRY
            |||||||||::|:|||||:|||||||||||||||||||||||||||||||||||||||||
m774        LYNQALKHYKSGKFSAAASLLKGADGGDGGSIAQRSMYLLLQSRARMGNCESVIEIGGRY
                   130       140       150       160       170       180

                   190       200       210       220       230
g744.pep    ANRFKDSPTAPEVIFKIGECQYRLQQKDIARATWRSLIQTYPGSPAAKRAAAAVRKRX
            ||||||||||||::||||||||||||||||||||||||||||||||||||||||||||
m774        ANRFKDSPTAPEAMFKIGECQYRLQQKDIARATWRSLIQTYPGSPAAKRAAAAVRKRX
                   190       200       210       220       230
```

The following partial DNA sequence was identified in *N. meningitidis* <SEQ ID 2669>:

a774.seq

```
  1 ATGAAGACCA AATTACCGCT TTTTATCATT TGGCTGTCCG TATCCGCCGC
 51 CTGTTCTTCC CCTGTTTCCC GCAATATTCA GGATATGCGG CTCGAACCGC
101 AGGCAGAGGC AGGTAGTTCG GACGCTATTC CCTATCCCGT TCCCACTCTG
151 CAAGACCGTT TGGATTATCT GGAAGGCACA CTCGTCCGCC TGTCGAACGA
201 AGTGGAAACC TTAAACGGCA AAGTCAAAGC ACTGGAGCAT GCGAAAACAC
251 ACCCTTCCAG CAGGGCATAC GTCCAAAAAC TCGACGACCG CAAGTTGAAA
301 GAGCATTACC TCAATACCGA AGGCGGCAGC GCATCCGCAC ATACCGTCGA
351 AACCGCACAA AACCTCTACA ATCAGGCACT CAAACACTAT AAAAGCGGCA
401 GGTTTTCTGC CGCTGCCTCC CTGTTGAAAG GCGCGGACGG AGGCGACGGC
451 GGCAGCATCG CGCAACGCAG TATGTACCTG TTGCTGCAAA GCAGGGCGCG
501 TATGGGCAAC TGCGAATCCG TCATCGAAAT CGGAGGGCGT TACGCCAACC
551 GTTTCAAAGA CAGCCCAACC GCGCCTGAAG CCATGTTCAA AATCGGCGAA
601 TGCCAATACA GGCTTCAGCA AAAAGACATT GCAAGGGCGA CTTGGCGCAG
651 CCTGATACAG ACCTATCCCG GCAGCCCGGC GGCAAAACGC GCCGCCGCAG
701 CCGTGCGCAA ACGATAG
```

This corresponds to the amino acid sequence <SEQ ID 2670; ORF 774.a>:

a774.pep

```
  1 MKTKLPLFII WLSVSAACSS PVSRNIQDMR LEPQAEAGSS DAIPYPVPTL
 51 QDRLDYLEGT LVRLSNEVET LNGKVKALEH AKTHPSSRAY VQKLDDRKLK
101 EHYLNTEGGS ASAHTVETAQ NLYNQALKHY KSGRFSAAAS LLKGADGGDG
151 GSIAQRSMYL LLQSRARMGN CESVIEIGGR YANRFKDSPT APEAMFKIGE
201 CQYRLQQKDI ARATWRSLIQ TYPGSPAAKR AAAAVRKR*
```

Computer analysis of this amino acid sequence gave the following results:

Homology with a predicted ORF from *N. meningitidis*

ORF 774 shows 89.5% identity over a 238 aa overlap with a predicted ORF (ORF 774) from *N. meningitidis* m774/a774 89.5% identity in 238 aa overlap

```
                    10        20        30        40        50        60
a774.pep    MKTKLPLFIIWLSVSAACSSPVSRNIQDMRLEPQAEAGSSDAIPYPVPTLQDRLDYLEGT
            || ||||||||||||:|:| ||      : | ::: ::||:||||||||||||||||
m774        MKIKLPLFIIWLSVSASCAS-VSPVPAGSQTEMSTRENASDGIPYPVPTLQDRLDYLEGK
                    10        20        30        40        50

                    70        80        90       100       110       120
a774.pep    LVRLSNEVETLNGKVKALEHAKTHPSSRAYVQKLDDRKLKEHYLNTEGGSASAHTVETAQ
            :|||||||||||||||||||||| |:||||||||||||||||||||||||||||||||||
m774        IVRLSNEVETLNGKVKALEHAKTHSSGRAYVQKLDDRKLKEHYLNTEGGSASAGTVETAQ
           60        70        80        90       100       110

                   130       140       150       160       170       180
a774.pep    NLYNQALKHYKSGRFSAAASLLKGADGGDGGSIAQRSMYLLLQSRARMGNCESVIEIGGR
            ||||||||||||:|||||||||||||||||||||||||||||||||||||||||||||||
m774        NLYNQALKHYKSGKFSAAASLLKGADGGDGGSIAQRSMYLLLQSRARMGNCESVIEIGGR
          120       130       140       150       160       170
```

-continued

```
                 190        200        210        220        230       239
a774.pep      YANRFKDSPTAPEAMFKIGECQYRLQQKDIARATWRSLIQTYPGSPAAKRAAAAVRKRX
              ||||||||||||||||||||||||||||||||||||||||||||||||||||||||||||
m774          YANRFKDSPTAPEAMFKIGECQYRLQQKDIARATWRSLIQTYPGSPAAKRAAAAVRKRX
            180       190        200        210        220        230
```

g790.seq not found yet g790.pep not found yet

The following partial DNA sequence was identified in *N. meningitidis* <SEQ ID 2671>:

m790.seq

```
   1 ATGGCAAGAA GGTCAAAAAC ATTTGAAGAA GCTGCTGCTG AGGTTGAGGA
  51 ACGTTTCGGT CATCGTGGCA TTAAGTTGGT CGAGTTTGAG GGTACAGCCA
 101 AGCCGTGTGT AATCAACTGC CCTAAACATG GAAACCAAAC CTGTTCGAGG
 151 TACTCCAATA TGTTCATAGG AAGTAGCTGG GGTTGCCCCT CTTGTGGTAA
 201 TGAGCAAGCT GCAAAAGCCG GTATAGCGAC CCTTAGGAAG AATCACATAG
 251 CGTTAGAAAT GCTGAAACAG GCTGTAACAG GTATGACCAA GCAAGAGCGC
 301 ATCACGACGC AAGCCTACAA TGAGATGACC AAATCCGTGG CAGGTTCAAA
 351 CAGCATAGTC CTTAACGATG TCCAAGGCGA TACGACCATC AACAACCATC
 401 ATACGCATAC GCACAACCAC AGCGATGCCG ATGGCAAAGC ACTGTCGATG
 451 AGGCTCACAC CCCGTCCTTT GTTGTCAGAC CGTCAGGCGG CGGCTTTCGC
 501 CCGTACAGGC AAACTCACGG GCAGTTTCGA CCTGTTTGCT TCGGTGgTCG
 551 CCCCCTCGCA GTACACGTTT GCCGTTGCCA TGCCCGACAC GTCCATGTCG
 601 CCGGTTATCG AAAAGGGAGA CTTGCTGGTG GTCGAGCCGC GTATGTGCCC
 651 TGCGGACGAA GACATCGCGC TGATTGAACT GTCCGACAAG CGGCTGGTCG
 701 TCGCGCACCT TGTTATCGAT ATTGCGGGCA GGATGCTGAT TTATCAGACG
 751 GGCAGGCCGT CTGAAGCCTT TGACCTGCCC GAAGGCAGCA CGATTTTAGG
 801 TGTGGTGCTG GAGTCAAAAA ACGGTTTATG TCCGCCGCAC AGGCAAGAAG
 851 GCGTGTTGAT TCGGATTACC GCCCCTGATG TGTGGACGGT TGGTATGATT
 901 TCCGCTTCCA AAACGTCGTG TACGCGCCCG ACCGCAGCCC GGAAATCAGC
 951 CGTATGCTTT CTTCGATTTT GGCAGGCTAC GCGTGGGATA CCGAAAACCC
1001 GTTCGTGGCG AAATCCGAAC AACGCCTGA
```

This corresponds to the amino acid sequence <SEQ ID 2672; ORF 790>:

m790.pep

```
   1 MARRSKTFEE AAAEVEERFG HRGIKLVEFE GTAKPCVINC PKHGNQTCSR
  51 YSNMFIGSSW GCPSCGNEQA AKAGIATLRK NHIALEMLKQ AVTGMTKQER
 101 ITTQAYNEMT KSVAGSNSIV LNDVQGDTTI NNHHTHTHNH SDADGKALSM
 151 RLTPRPLLSD RQAAAFARTG KLTGSFDLFA SVVAPSQYTF AVAMPDTSMS
 201 PVIEKGDLLV VEPRMCPADE DIALIELSDK RLVVAHLVID IAGRMLIYQT
```

-continued

```
251 GRPSEAFDLP EGSTILGVVL ESKNGLCPPH RQEGVLIRIT APDVWTVGMI
301 SASKTSCTRP TAARKSAVCF LRFWQATRGI PKTRSWRNPN NA*
```

The following partial DNA sequence was identified in *N. meningitidis* <SEQ ID 2673>:

a790.seq

```
   1 ATGGCAAGAA GGTCAAAAAC ATTTGAAGAA GCTGCTGCTG AGGTTGAGGA
  51 ACGTTTCGGT CATCGTGGCA TTAAGTTGGT CGAGTTTGAG GGTACAGCCA
 101 AGCCGTGTGT AATCAACTGC CCTAAACATG GAAACCAAAC CTGTTCGAGG
 151 TACTCCAATA TGTTCATAGG AAGTAGCTGG GGTTGCCCCT CTTGTGGTAA
 201 TGAGCAAGCT GCAAAAGCCG GTATAGCGAC CCTTAGGAAG AATCACATAG
 251 CGTTAGAAAT GCTGAAACAG GCTGTAACAG GTATGACCAA GCAAGAGCGC
 301 ATCACGACGC AAGCCTACAA TGAGATGACC AAATCCGTGG CAGGTTCAAA
 351 CAGCATAATC CTTAACGATG TCCAAGGCGA TACGACCATC AACAACCATC
 401 ATACGCATAC GCACAACCAC AGCGATGCCG ACGGCAAAGC ACTGTCGATG
 451 AGGCTCACAC CCCGTCCTTT GTTGTCAGAC CGTCAGGCGG CGGCTTTCGC
 501 CCGTACAGGC AAACTCACGG GCAGTTTCGA CCTGTTTGCT TCGGTGGTCG
 551 CCCCTTCACA ATATACGTTT GCCGTTGCCA TGCCCGACAC GTCCATGTCG
 601 CCGGTTATCG AAAAGGGGGA TTTGCTGGTG GTCGAGCCGC GTATGCGCCC
 651 TGCGGACGAA GACATCGTAC TGATTGAACT GTCCGACAAG CGGCTGGTCG
 701 TCGCGCACCT TGTTATCGAT ATTGCGGGCA GGATGCTGAT TTATCAGACG
 751 GGCAGGCCGT CTGAAGCCCT CGACCTGCCC GAAGGCAGCG TGATTTTAGG
 801 TGTGGTGCTG GAGTCAAAAA ACGGTTTATG TCCGCCGCAC AGGCAAGAAG
 851 GCGTGTTGAT TCGGATTACC GCCCCTGATG TGTGGACGGT TGGTACGATT
 901 TCCGCTTCCA AAACGTCGTG TACGCGCCCG ACCGCAGCCC GGAAATCAGC
 951 CGTATGCTTT CTTCGATTTT GGCAGGCTAC GCGTGGGATA CCGAAAACCC
1001 GTTCGTGGCG AAATCCGAAC AACGCCTGT
```

This corresponds to the amino acid sequence <SEQ ID 2674; ORF 790.a>:

a790.pep

```
  1 MARRSKTFEE AAAEVEERFG HRGIKLVEFE GTAKPCVINC PKHGNQTCSR
 51 YSNMFIGSSW GCPSCGNEQA AKAGIATLRK NHIALEMLKQ AVTGMTKQER
101 ITTQAYNEMT KSVAGSNSII LNDVQGDTTI NNHHTHTHNH SDADGKALSM
151 RLTPRPLLSD RQAAAFARTG KLTGSFDLFA SVVAPSQYTF AVAMPDTSMS
201 PVIEKGDLLV VEPRMRPADE DIVLIELSDK RLVVAHLVID IAGRMLIYQT
251 GRPSEALDLP EGSVILGVVL ESKNGLCPPH RQEGVLIRIT APDVWTVGTI
301 SASKTSCTRP TAARKSAVCF LRFWQATRGI PKTRSWRNPN NAC
```

Computer analysis of this amino acid sequence gave the following results:

Homology with a predicted ORF from *N. meningitidis*

ORF 790 shows 98.2% identity over a 342 aa overlap with a predicted ORF (ORF 790) from *N. meningitidis* a790/m790 98.2% identity in 342 aa overlap

```
                   10        20        30        40        50        60
a790.pep    MARRSKTFEEAAAEVEERFGHRGIKLVEFEGTAKPCVINCPKHGNQTCSRYSNMFIGSSW
            ||||||||||||||||||||||||||||||||||||||||||||||||||||||||||||
m791        MARRSKTFEEAAAEVEERFGHRGIKLVEFEGTAKPCVINCPKHGNQTCSRYSNMFIGSSW
                   10        20        30        40        50        60
                   70        80        90       100       110       120
a790.pep    GCPSCGNEQAAKAGIATLRKNHIALEMLKQAVTGMTKQERITTQAYNEMTKSVAGSNSII
            |||||||||||||||||||||||||||||||||||||||||||||||||||||||||||:
m790        GCPSCGNEQAAKAGIATLRKNHIALEMLKQAVTGMTKQERITTQAYNEMTKSVAGSNSIV
                   70        80        90       100       110       120
                  130       140       150       160       170       180
a790.pep    LNDVQGDTTINNHHTHTHNHSDADGKALSMRLTPRPLLSDRQAAAFARTGKLTGSFDLFA
            ||||||||||||||||||||||||||||||||||||||||||||||||||||||||||||
m790        LNDVQGDTTINNHHTHTHNHSDADGKALSMRLTPRPLLSDRQAAAFARTGKLTGSFDLFA
                  130       140       150       160       170       180
                  190       200       210       220       230       240
a790.pep    SVVAPSQYTFAVAMPDTSMSPVIEKGDLLVVEPRMRPADEDIVLIELSDKRLVVAHLVID
            |||||||||||||||||||||||||||||||||| ||||||:||||||||||||||||||
m790        SVVAPSQYTFAVAMPDTSMSPVIEKGDLLVVEPRMCPADEDIALIELSDKRLVVAHLVID
                  190       200       210       220       230       240
                  250       260       270       280       290       300
a790.pep    IAGRMLIYQTGRPSEALDLPEGSVILGVVLESKNGLCPPHRQEGVLIRITAPDVWTVGTI
            ||||||||||||||:||||||:||||||||||||||||||||||||||||||||||||| |
m790        IAGRMLIYQTGRPSEAFDLPEGSTILGVVLESKNGLCPPHRQEGVLIRITAPDVWTVGMI
                  250       260       270       280       290       300
                  310       320       330       340
a790.pep    SASKTSCTRPTAARKSAVCFLRFWQATRGIPKTRSWRNPNNAC
            ||||||||||||||||||||||||||||||||||||||||||
m790        SASKTSCTRPTAARKSAVCFLRFWQATRGIPKTRSWRNPNNAX
                  310       320       330       340
```

The following partial DNA sequence was identified in *N. gonorrhoeae* <SEQ ID 2675>:

<u>g791.seq</u>

```
  1 ATGGTAAATT ATTATTCAGC TATGATTAAA AAGATTTTAA CTACTTGTTT
 51 TGGTTTGTTT TTTGGTTTTT GTGTATTTGG AGTGGGTCTG GTTGCCATTG
101 CTATTTTGGT AACGTATCCG AAACTGCCGT CTTTGGATTC TTTGCAGCAT
151 TACCAGCCTA AAATGCCGTT GACTATTTAT TCGGCGGATG GAGAAGTCAT
201 CGGTATGTAT GGGGAGCAGC GGCGCGAATT TACAAAAATC GGCGATTTCC
251 CCGAGGTGTT GCGGAATGCG GTTATTGCCG CCGAGGATAA ACGCTTTTAC
301 CGGCATTGGG GGGTGGATGT TTGGGGTGTT GCCCGCGCTG CCGTCGGCAA
351 TGTCGTGTCC GGCAGCGTGC AGTCGGGTGC GAGTACGATT ACACAGCAGG
401 TGGCGAAAAA TTTTTATTTG AGCAGTGAAA AAACGTTCAC ACGCAAATTC
451 AATGAGGTGT TGCTTGCCTA TAAAATCGAG CAGTCTTTAA GCAAAGACAA
501 AATCCTTGAG TTGTATTTCA ATCAGATTTA CCTCGGTCAG CGCGCCTATG
551 GTTTTGCATC TGCCGCGCAA ATCTATTTCA ATAAGAATGT CCGAGATTTG
601 ACTTTGGCGG AAGCCGCCAT GCTTGCGGGA CTGCCCAAGG CTCCGTCTGC
651 CTATAATCCG ATTGTTAATC CGGAGCGTGC CAAGTTGCGC CAGAAGTATA
701 TTTTGAACAA TATGCTCGAG GAGAAGATGA TTACCGTGCA ACAGCGCGAT
```

-continued

751 CAGGCATTGA ATGAGGAACT GCATTATGAG CGGTTTGTTC GGAAAATCGA

801 TCAGAGTGCT TTATATGTGG CGGAAATGGT GCGTCGGGAA CTGTATGAGA

851 AATATGGTGA AGATGCCTAT ACGCAGGGTT TTAAGGTTTA TACCACGGTC

901 CGCACCGATC ATCAGAAGGC GGCAACCGAG GCATTGCGCA AGGCTCTACG

951 GAATTTCGAT CGCGGCAGCA GCTACCGCGG TGCGGAAAAC TATATCGATT

1001 TGAGTAAGAG TGAAGATGTC GAGGAGACTG TCAGCCAGTA TCTGTCGGGA

1051 CTCTATACCG TCGATAAAAT GGTTCCCGCC GTTGTGTTGG ATGTTACTAA

1101 AAAGAAAAAT GTCGTCATAC AGCTGCCCGG CGGCAGGCGG GTTGCGCTTG

1151 ACAGGCGCGC CTTGGGTTTT GCGGCCCGAG CGGTCGATAA TGAGAAAATG

1201 GGGGAGGACC GTATCCGCAG GGGCGCGGTC ATCCGTGTCA AAAACAACGG

1251 CGGGCGTTGG GCGGTGGTTC AAGAGCCGTT GCTGCAGGGG GCTTTGGTTT

1301 CGCTGGATGC AAAAACCGGA GCTGTGCGCG CGCTGGTCGG CGGTTATGAT

1351 TTTCACAGCA AAACATTCAA TCGTGCCGTT CAGGCAATGC GGCAGCCGGG

1401 TTCGACCTTT AAGCCGTTTG TCTATTCGGC GGCATTATCT AAGGGGATGA

1451 CCGCGTCCAC AGTGGTTAAC GATGCGCCGA TTTCCCTGCC GGGGAAAGGG

1501 CCGAACGGTT CGGTTTGGAC ACCTAAAAAT TCAGACGGCA GATATTCCGG

1551 CTACATTACT TTGAGACAGG CTCTGACGGC TTCCAAGAAT ATGGTTTCCA

1601 TCCGTATTTT GATGTCTATC GGTGTCGGTT ACGCGCAACA GTATATCCGG

1651 CGTTTCGGCT TCAGGCCGTC CGAGCTGCCG GCAAGCCTGT CTATGGCTTT

1701 AGGTACGGGC GAGACGACGC CGTTGAAAGT GGCGGAGGCA TATAGTGTAT

1751 TTGCGAACGG CGGATATAGG GTTTCTTCGC ACGTGATCGA TAAGATTTAT

1801 GACAGAGACG GCAGGTTGCG CGCCCAAATG CAACCTTTGG TGGCAGGGCA

1851 AAATGCGCCT CAGGCAATCG ATCCGCGCAA TGCCTATATT ATGTATAAGA

1901 TTATGCAGGA TGTGGTCCGT GTCGGTACGG CAAGGGGGGC AGCTGCGTTG

1951 GGAAGAACGG ATATTGCCGG TAAAACGGGT ACGACCAACG ACAATAAAGA

2001 TGCGTGGTTT GTCGGTTTTA ACCCTGATGT GGTTACTGCC GTATATATCG

2051 GCTTCGACAA ACCTAAGAGT ATGGGGCGTG CCGGCTACGG CGGTACGATT

2101 GCGGTGCCGG TTTGGGTGGA CTATATGCGT TTTGCGTTGA AAGGAAAGCA

2151 GGGCAAAGGG ATGAAAATGC CTGAAGGTGT GGTCAGCAGC AATGGCGAAT

2201 ACTATATGAA GGAACGTATG GTAACCGATC CGGGCTTGAT GCTGGACAAC

2251 AGCGGTATTG CGCCGCAACC TTCCCGACGG GCAAAAGAAG ATGATGAAGC

2301 GGCAGTAGAA AACGAACAGC AGGGAAGGTC TGACGAAACG CGTCAGGACG

2351 TACAGGAAAC GCCGGTGCTT CCGAGCAATA CGGATTCCAA ACAGCAGCAG

2401 TTGGATTCCC TGTTTTAA

This corresponds to the amino acid sequence <SEQ ID 2676; ORF 791.ng>:

g791.pep

1 MVNYYSAMIK KILTTCFGLF FGFCVFGVGL VAIAILVTYP KLPSLDSLQH

51 YQPKMPLTIY SADGEVIGMY GEQRREFTKI GDFPEVLRNA VIAAEDKRFY

-continued

```
101 RHWGVDVWGV ARAAVGNVVS GSVQSGASTI TQQVAKNFYL SSEKTFTRKF
151 NEVLLAYKIE QSLSKDKILE LYFNQIYLGQ RAYGFASAAQ IYFNKNVRDL
201 TLAEAAMLAG LPKAPSAYNP IVNPERAKLR QKYILNNMLE EKMITVQQRD
251 QALNEELHYE RFVRKIDQSA LYVAEMVRRE LYEKYGEDAY TQGFKVYTTV
301 RTDHQKAATE ALRKALRNFD RGSSYRGAEN YIDLSKSEDV EETVSQYLSG
351 LYTVDKMVPA VVLDVTKKKN VVIQLPGGRR VALDRRALGF AARAVDNEKM
401 GEDRIRRGAV IRVKNNGGRW AVVQEPLLQG ALVSLDAKTG AVRALVGGYD
451 FHSKTFNRAV QAMRQPGSTF KPFVYSAALS KGMTASTVVN DAPISLPGKG
501 PNGSVWTPKN SDGRYSGYIT LRQALTASKN MVSIRILMSI GVGYAQQYIR
551 RFGFRPSELP ASLSMALGTG ETTPLKVAEA YSVFANGGYR VSSHVIDKIY
601 DRDGRLRAQM QPLVAGQNAP QAIDPRNAYI MYKIMQDVVR VGTARGAAAL
651 GRTDIAGKTG TTNDNKDAWF VGFNPDVVTA VYIGFDKPKS MGRAGYGGTI
701 AVPVWVDYMR FALKGKQGKG MKMPEGVVSS NGEYYMKERM VTDPGLMLDN
751 SGIAPQPSRR AKEDDEAAVE NEQQGRSDET RQDVQETPVL PSNTDSKQQQ
801 LDSLF*
```

The following partial DNA sequence was identified in *N. meningitidis* <SEQ ID 2677>:

m791.seq

```
  1 ATGGTAAATT ATTATTCAGC TATGATTAAA AAGATTTTAA CGACTTGTTT
 51 TGGTTTGGTT TTTGGGTTTT GTGTATTTGG AGTGGGTTTG GTTGCCATTG
101 CTATTTTGGT AACGTATCCG AAACTGCCGT CTTTGGATTC TTTGCAGCAT
151 TACCAGCCTA AAATGCCGTT GACTATTTAT TCGGCGGATG GGGAAGTCAT
201 CGGTATGTAT GGGGAGCAGC GGCGCGAATT TACAAAAATC GGCGATTTCC
251 CAGAGGTGTT GCGGAATGCG GTTATCGCCG CCGAGGATAA ACGCTTTTAC
301 CGGCATTGGG GGGTGGATGT TTGGGGTGTT GCCCGCGCTG CCGTCGGCAA
351 TGTCGTGTCC GGCAGCGTGC AGTCGGGTGC GAGTACGATT ACGCAGCAGG
401 TGGCGAAAAA TTTTTATTTG AGCAGTGAAA AAACGTTCAC ACGCAAATTC
451 AATGAGGTGT TGCTTGCCTA TAAAATCGAG CAGTCTTTAA GCAAAGACAA
501 AATCCTCGAG TTGTATTTCA ATCAGATTTA CCTCGGTCAG CGCGCCTATG
551 GTTTTGCATC TGCCGCGCAA ATCTATTTCA ATAAGAATGT CCGAGATTTG
601 ACTTTGGCGG AAGCCGCCAT GCTTGCGGGA CTGCCCAAGG CTCCGTCTGC
651 CTATAATCCG ATTGTTAATC CAGAACGTGC CAAGTTGCGC CAGAAGTATA
701 TTTTGAACAA TATGCTCGAG GAGAAGATGA TTACCGTGCA ACAGCGCGAT
751 CAGGCGTTGA ATGAGGAACT GCATTACGAG CGGTTTGTTC GGAAAATCGA
801 TCAGAGTGCG TTATATGTGG CGGAAATGGT GCGTCAGGAA CTGTATGAGA
851 AATACGGTGA AGATGCCTAT ACGCAGGGTT TTAAGGTTTA TACCACGGTC
901 CGCGCCGATC ATCAGAAGGT GGCAACCGAG GCATTGCGCA AGGCTCTACG
951 GAATTTCGAT CGCGGCAGCA GCTACCGCGG TGCGGAAAAC TATATCGATT
```

-continued

```
1001 TGAGTAAGAG TGAAGATGTC GAGGAGACTG TCAGCCAGTA TCTGTCGGGA
1051 CTCTATACCG TCGATAAAAT GGTTCCCGCC GTTGTGTTGG ATGTGACTAA
1101 AAAGAAAAAT GTCGTCATAC AGCTGCCCGG CGGCAGGCGG GTTACGCTTG
1151 ACAGGCGCGC CTTGGGTTTT GCGGCCCGCG CGGTCAATAA TGAAAAAATG
1201 GGGGAGGACC GTATCCGCAG GGGCGCGGTC ATCCGTGTCA AAAACAACGG
1251 CGGGCGTTGG GCGGTGGTTC AAGAGCCGTT GCTGCAGGGG GCTTTGGGTT
1301 CGCTGGATGC AAAAACCGGA GCTGTGCGCG CGCTGGTCGG CGGTTATGAT
1351 TTTCACAGCA AAACATTCAA TCGTGCCGTT CAGGCAATGC GGCAGCCGGG
1401 TTCGACCTTT AAGCCGTTTG TCTATTCGGC GGCATTATCT AAGGGGATGA
1451 CCGCGTCCAC AGTGGTTAAC GATGCGCCGA TTTCCCTGCC GGGGAAAGGG
1501 CCGAACGGTT CGGTTTGGAC ACCTAAAAAT TCAGACGGCA GATATTCCGG
1551 CTACATTACT TTGAGACAGG CTCTGACGGC TTCCAAGAAT ATGGTTTCCA
1601 TCCGTATTTT GATGTCTATC GGTGTCGGTT ACGCGCAACA GTATATCCGG
1651 CGTTTCGGCT TCAGGTCGTC CGAGCTGCCG GCAAGCCTGT CTATGGCTTT
1701 AGGTACGGGC GAGACAACGC CGTTGAAAGT GGCGGAGGCA TATAGCGTAT
1751 TTGCGAACGG CGGATATAGG GTTTCTTCGC ACGTAATCGA TAAGATTTAT
1801 GACAGAGACG GCAGGTTGCG CGCCCAAATG CAACCTTTGG TGGCTGGGCA
1851 AAATGCGCCT CAGGCAATCG ATCCGCGCAA TGCCTATATT ATGTATAAGA
1901 TTATGCAGGA TGTGGTCCGT GTTGGTACGG CAAGGGGGGC AGCTGCGTTG
1951 GGAAGAACGG ATATTGCCGG TAAAACGGGT ACGACCAATG ACAATAAGGA
2001 TGCGTGGTTT GTCGGTTTTA ACCCTGATGT GGTTACTGCC GTATATATCG
2051 GCTTCGACAA ACCTAAGAGT ATGGGGCGTG TCGGCTACGG CGGTACGATT
2101 GCGGTGCCGG TTTGGGTGGA CTATATGCGT TTTGCGTTGA AAGGAAAGCA
2151 GGGCAAGGGG ATGAAAATGC CTGAAGGTGT GGTCAGCAGC AATGGCGAAT
2201 ACTATATGAA GGAACGTATG GTAACCGATC CGGGCTTGAC GCTGGACAAC
2251 AGCGGTATTG CGCCGCAACC TTCCCGACGG GCAAAAGAAG ATGACGGGGG
2301 CGCGGCAGAA GGCGGACGGC AGGCGGCGGA TGACGAAGTC CGCCAAGATA
2351 TGCAGGAAAC GCCGGTGCTT CCGAGTAATA CTGGTTCCAA ACAGCAGCAG
2401 TTGGATTCTC TGTTTTAA
```

This corresponds to the amino acid sequence <SEQ ID 2678; ORF 791>:

m791.pep

```
  1 MVNYYSAMIK KILTTCFGLV FGFCVFGVGL VAIAILVTYP KLPSLDSLQH
 51 YQPKMPLTIY SADGEVIGMY GEQRREFTKI GDFPEVLRNA VIAAEDKRFY
101 RHWGVDVWGV ARAAVGNVVS GSVQSGASTI TQQVAKNFYL SSEKTFTRKF
151 NEVLLAYKIE QSLSKDKILE LYFNQIYLGQ RAYGFASAAQ IYFNKNVRDL
201 TLAEAAMLAG LPKAPSAYNP IVNPERAKLR QKYILNNMLE ERMITVQQRD
251 QALNEELHYE RFVRKIDQSA LYVAEMVRQE LYEKYGEDAY TQGFKVYTTV
301 RADHQKVATE ALRKALRNFD RGSSYRGAEN YIDLSKSEDV EETVSQYLSG
```

-continued

```
351 LYTVDKMVPA VVLDVTKKKN VVIQLPGGRR VTLDRRALGF AARAVNNEKM

401 GEDRIRRGAV IRVKNNGGRW AVVQEPLLQG ALGSLDAKTG AVRALVGGYD

451 FHSKTFNRAV QAMRQPGSTF KPFVYSAALS KGMTASTVVN DAPISLPGKG

501 PNGSVWTPKN SDGRYSGYIT LRQALTASKN MVSIRILMSI GVGYAQQYIR

551 RFGFRSSELP ASLSMALGTG ETTPLKVAEA YSVFANGGYR VSSHVIDKIY

601 DRDGRLRAQM QPLVAGQNAP QAIDPRNAYI MYKIMQDVVR VGTARGAAAL

651 GRTDIAGKTG TTNDNKDAWF VGFNPDVVTA VYIGFDKPKS MGRVGYGGTI

701 AVPVWVDYMR FALKGKQGKG MKMPEGVVSS NGEYYMKERM VTDPGLTLDN

751 SGIAPQPSRR AKEDDGGAAE GGRQAADDEV RQDMQETPVL PSNTGSKQQQ

801 LDSLF*
```

g791/m791 97.3% identity in 805 aa overlap

```
                        10        20        30        40        50        60
g791.pep       MVNYYSAMIKKILTTCFGLFFGFCVFGVGLVAIAILVTYPKLPSLDSLQHYQPKMPLTIY
               ||||||||||||||||||| ||||||||||||||||||||||||||||||||||||||||
m791           MVNYYSAMIKKILTTCFGLVFGFCVFGVGLVAIAILVTYPKLPSLDSLQHYQPKMPLTIY
                        10        20        30        40        50        60

                        70        80        90       100       110       120
g791.pep       SADGEVIGMYGEQRREFTKIGDFPEVLRNAVIAAEDKRFYRHWGVDVWGVARAAVGNVVS
               ||||||||||||||||||||||||||||||||||||||||||||||||||||||||||||
m791           SADGEVIGMYGEQRREFTKIGDFPEVLRNAVIAAEDKRFYRHWGVDVWGVARAAVGNVVS
                        70        80        90       100       110       120

                       130       140       150       160       170       180
g791.pep       GSVQSGASTITQQVAKNFYLSSEKTFTRKFNEVLLAYKIEQSLSKDKILELYFNQIYLGQ
               ||||||||||||||||||||||||||||||||||||||||||||||||||||||||||||
m791           GSVQSGASTITQQVAKNFYLSSEKTFTRKFNEVLLAYKIEQSLSKDKILELYFNQIYLGQ
                       130       140       150       160       170       180

                       190       200       210       220       230       240
g791.pep       RAYGFASAAQIYFNKNVRDLTLAEAAMLAGLPKAPSAYNPIVNPERAKLRQKYILNNMLE
               ||||||||||||||||||||||||||||||||||||||||||||||||||||||||||||
m791           RAYGFASAAQIYFNKNVRDLTLAEAAMLAGLPKAPSAYNPIVNPERAKLRQKYILNNMLE
                       190       200       210       220       230       240

                       250       260       270       280       290       300
g791.pep       EKMITVQQRDQALNEELHYERFVRKIDQSALYVAEMVRRELYEKYGEDAYTQGFKVYTTV
               ||||||||||||||||||||||||||||||||||||||:|||||||||||||||||||||
m791           EKMITVQQRDQALNEELHYERFVRKIDQSALYVAEMVRQELYEKYGEDAYTQGFKVYTTV
                       250       260       270       280       290       300

                       310       320       330       340       350       360
g791.pep       RTDHQKAATEALRKALRNFDRGSSYRGAENYIDLSKSEDVEETVSQYLSGLYTVDKMVPA
               |:||||:|||||||||||||||||||||||||||||||||||||||||||||||||||||
m791           RADHQKVATEALRKALRNFDRGSSYRGAENYIDLSKSEDVEETVSQYLSGLYTVDKMVPA
                       310       320       330       340       350       360

                       370       380       390       400       410       420
g791.pep       VVLDVTKKKNVVIQLPGGRRVALDRRALGFAARAVDNEKMGEDRIRRGAVIRVKNNGGRW
               |||||||||||||||||||||:|||||||||||||:||||||||||||||||||||||||
m791           VVLDVTKKKNVVIQLPGGRRVTLDRRALGFAARAVNNEKMGEDRIRRGAVIRVKNNGGRW
                       370       380       390       400       410       420

                       430       440       450       460       470       480
g791.pep       AVVQEPLLQGALVSLDAKTGAVRALVGGYDFHSKTFNRAVQAMRQPGSTFKPFVYSAALS
               |||||||||||| |||||||||||||||||||||||||||||||||||||||||||||||
m791           AVVQEPLLQGALGSLDAKTGAVRALVGGYDFHSKTFNRAVQAMRQPGSTFKPFVYSAALS
                       430       440       450       460       470       480

                       490       500       510       520       530       540
g791.pep       KGMTASTVVNDAPISLPGKGPNGSVWTPKNSDGRYSGYITLRQALTASKNMVSIRILMSI
               ||||||||||||||||||||||||||||||||||||||||||||||||||||||||||||
m791           KGMTASTVVNDAPISLPGKGPNGSVWTPKNSDGRYSGYITLRQALTASKNMVSIRILMSI
                       490       500       510       520       530       540

                       550       560       570       580       590       600
g791.pep       GVGYAQQYIRRFGFRPSELPASLSMALGTGETTPLKVAEAYSVFANGGYRVSSHVIDKIY
               ||||||||||||||| ||||||||||||||||||||||||||||||||||||||||||||
m791           GVGYAQQYIRRFGFRSSELPASLSMALGTGETTPLKVAEAYSVFANGGYRVSSHVIDKIY
                       550       560       570       580       590       600

                       610       620       630       640       650       660
g791.pep       DRDGRLRAQMQPLVAGQNAPQAIDPRNAYIMYKIMQDVVRVGTARGAAALGRTDIAGKTG
               ||||||||||||||||||||||||||||||||||||||||||||||||||||||||||||
m791           DRDGRLRAQMQPLVAGQNAPQAIDPRNAYIMYKIMQDVVRVGTARGAAALGRTDIAGKTG
                       610       620       630       640       650       660
```

-continued

```
                670       680       690       700       710       720
g791.pep    TTNDNKDAWFVGFNPDVVTAVYIGFDKPKSMGRAGYGGTIAVPVWVDYMRFALKGKQGKG
            ||||||||||||||||||||||||||||||||:|||||||||||||||||||||||||||
m791        TTNDNKDAWFVGFNPDVVTAVYIGFDKPKSMGRVGYGGTIAVPVWVDYMRFALKGKQGKG
                670       680       690       700       710       720

                730       740       750       760       770       780
g791.pep    MKMPEGVVSSNGEYYMKERMVTDPGLMLDNSGIAPQPSRRAKEDDEAAVENEQQGRSDET
            |||||||||||||||||||||||||| ||||||||||||||||| :|:|: :|: :||:
m791        MKMPEGVVSSNGEYYMKERMVTDPGLTLDNSGIAPQPSRRAKEDDGGAAEGGRQAADDEV
                730       740       750       760       770       780

                790       800
g791.pep    RQDVQETPVLPSNTDSKQQQLDSLFX
            |||:|||||||||| ||||||||||
m791        RQDMQETPVLPSNTGSKQQQLDSLFX
                790       800
```

The following partial DNA sequence was identified in *N. meningitidis* <SEQ ID 2679>:

a791.seq

```
   1 ATGGTAAATT ATTATTCAGC TATGATTAAA AAGATTTTAA CGACTTGTTT
  51 TGGTTTGGTT TTTGGGTTTT GTGTATTTGG AGTGGGTTTG GTTGCCATTG
 101 CTATTTTGGT AACGTATCCG AAACTGCCGT CTTTGGATTC TTTGCAGCAT
 151 TACCAGCCTA AAATGCCGTT GACTATTTAT TCGGCGGATG GGGAAGTCAT
 201 CGGTATGTAT GGGGAGCAGC GGCGCGAATT TACAAAAATC GGCGATTTCC
 251 CAGAGGTGTT GCGGAATGCG GTTATCGCCG CCGAGGATAA ACGCTTTTAC
 301 CGGCATTGGG GGGTGGATGT TTGGGGTGTT GCCCGCGCTG CCGTCGGCAA
 351 TGTCGTGTCC GGCAGCGTGC AGTCGGGTGC GAGTACGATT ACGCAGCAGG
 401 TGGCGAAAAA TTTTTATTTG AGCAGTGAAA AAACGTTCAC ACGCAAATTC
 451 AATGAGGTGT TGCTTGCCTA TAAAATCGAG CAGTCTTTAA GCAAAGACAA
 501 AATCCTCGAG TTGTATTTCA ATCAGATTTA CCTCGGTCAG CGCGCCTATG
 551 GTTTTGCATC TGCCGCGCAA ATCTATTTCA ATAAGAATGT CCGAGATTTG
 601 ACTTTGGCGG AAGCCGCCAT GCTTGCGGGA CTGCCCAAGG CTCCGTCTGC
 651 CTATAATCCG ATTGTTAATC CAGAACGTGC CAAGTTGCGC CAGAAGTATA
 701 TTTTGAACAA TATGCTCGAG GAGAAGATGA TTACCGTGCA ACAGCGCGAT
 751 CAGGCGTTGA ATGAGGAACT GCATTACGAG CGGTTTGTTC GGAAAATCGA
 801 TCAGAGTGCT TTATATGTGG CGGAAATGGT GCGTCAGGAA CTGTATGAGA
 851 AATACGGTGA AGATGCCTAT ACGCAGGGTT TTAAGGTTTA TACCACGGTC
 901 CGCGCCGATC ATCAGAAGGT GGCAACCGAG GCATTGCGCA AGGCTCTACG
 951 GAATTTCGAT CGCGGCAGCA GCTACCGCGG TGCGGAAAAC TATATCGATT
1001 TGAGTAAGAG TGAAGATGTC GAGGAGACTG TCAGCCAGTA TCTGTCGGGA
1051 CTCTATACCG TCGATAAAAT GGTTCCCGCC GTTGTGTTGG ATGTGACTAA
1101 AAAGAAAAAT GTCGTCATAC AGCTGCCCGG CGGCAGGCGG GTTACGCTTG
1151 ACAGGCGCGC CTTGGGTTTT GCGGCCCGCG CGGTCAATAA TGAAAAAATG
1201 GGGGAGGACC GTATCCGCAG GGGCGCGGTC ATCCGTGTCA AAAACAACGG
1251 CGGGCGTTGG GCGGTGGTTC AAGAGCCGTT GCTGCAGGGG GCTTTGGTTT
1301 CGCTGGATGC AAAAACCGGA GCTGTGCGCG CGCTGGTCGG CGGTTATGAT
1351 TTTCACAGCA AAACATTCAA TCGTGCCGTT CAGGCAATGC GGCAGCCGGG
```

-continued

```
1401 TTCGACCTTT AAGCCGTTTG TCTATTCGGC GGCATTATCT AAGGGGATGA
1451 CCGCGTCCAC AGTGGTTAAC GATGCGCCGA TTTCCCTGCC GGGGAAAGGG
1501 CCGAACGGTT CGGTTTGGAC ACCTAAAAAT TCAGACGGCA GATATTCCGG
1551 CTACATTACT TTGAGACAGG CTCTGACGGC TTCCAAGAAT ATGGTTTCCA
1601 TCCGTATTTT GATGTCTATC GGTGTCGGTT ACGCGCAACA GTATATCCGG
1651 CGTTTCGGCT TCAGGTCGTC CGAGCTGCCG GCAAGCCTGT CTATGGCTTT
1701 AGGTACGGGC GAGACAACGC CGTTGAAAGT GGCGGAGGCA TATAGCGTAT
1751 TTGCGAACGG CGGATATAGG GTTTCTTCGC ACGTAATCGA TAAGATTTAT
1801 GACAGAGACG GCAGGTTGCG CGCCCAAATG CAACCTTTGG TGGCCGGGCA
1851 AAATGCGCCT CAGGCAATCG ATCCGCGCAA TGCCTATATT ATGTATAAGA
1901 TTATGCAGGA TGTGGTCCGT GTTGGTACGG CAAGGGGGGC AGCTGCGTTG
1951 GGAAGAACGG ATATTGCCGG TAAAACGGGT ACGACCAATG ACAATAAGGA
2001 TGCGTGGTTT GTCGGTTTTA ACCCTGATGT GGTTACTGCC GTATATATCG
2051 GCTTCGACAA ACCTAAGAGT ATGGGGCGTG TCGGCTACGG CGGTACGATT
2101 GCGGTGCCGG TTTGGGTGGA CTATATGCGT TTTGCGTTGA AAGGAAAGCA
2151 GGGCAAGGGG ATGAAAATGC CTGAAGGTGT GGTCAGCAGC AATGGCGAAT
2201 ACTATATGAA GGAACGTATG GTAACCGATC CGGGCTTGAC GCTGGACAAC
2251 AGCGGTATTG CGCCGCAACC TTCCCGACGG GCAAAAGAAG ATGACGGGGG
2301 CGCGGCAGAA GGCGGACGGC AGGCGGCGGA TGACGAAGTC CGCCAAGATA
2351 TGCAGGAAAC GCCGGTGCTT CCGAGTAATA CTGGTTCCAA ACAGCAGCAG
2401 TTGGATTCTC TGTTTTAA
```

This corresponds to the amino acid sequence <SEQ ID 2680; ORF 791.a>:

a791.pep

```
  1 MVNYYSAMIK KILTTCFGLV FGFCVFGVGL VAIAILVTYP KLPSLDSLQH
 51 YQPKMPLTIY SADGEVIGMY GEQRREFTKI GDFPEVLRNA VIAAEDKRFY
101 RHWGVDVWGV ARAAVGNVVS GSVQSGASTI TQQVAKNFYL SSEKTFTRKF
151 NEVLLAYKIE QSLSKDKILE LYFNQIYLGQ RAYGFASAAQ IYFNKNVRDL
201 TLAEAAMLAG LPKAPSAYNP IVNPERAKLR QKYILNNMLE EKMITVQQRD
251 QALNEELHYE RFVRKIDQSA LYVAEMVRQE LYEKYGEDAY TQGFKVYTTV
301 RADHQKVATE ALRKALRNFD RGSSYRGAEN YIDLSKSEDV EETVSQYLSG
351 LYTVDKMVPA VVLDVTKKKN VVIQLPGGRR VTLDRRALGF AARAVNNEKM
401 GEDRIRRGAV IRVKNNGGRW AVVQEPLLQG ALVSLDAKTG AVRALVGGYD
451 FHSKTFNRAV QAMRQPGSTF KPFVYSAALS KGMTASTVVN DAPISLPGKG
501 PNGSVWTPKN SDGRYSGYIT LRQALTASKN MVSIRILMSI GVGYAQQYIR
551 RFGFRSSELP ASLSMALGTG ETTPLKVAEA YSVFANGGYR VSSHVIDKIY
601 DRDGRLRAQM QPLVAGQNAP QAIDPRNAYI MYKIMQDVVR VGTARGAAAL
651 GRTDIAGKTG TTNDNKDAWF VGFNPDVVTA VYIGFDKPKS MGRVGYGGTI
```

-continued

```
701 AVPVWVDYMR FALKGKQGKG MRMPEGVVSS NGEYYMKERM VTDPGLTLDN

751 SGIAPQPSRR AKEDDGGAAE GGRQAADDEV RQDMQETPVL PSNTGSKQQQ

801 LDSLF*
```

a791/m791 99.9% identity in 805 aa overlap

```
                      10        20        30        40        50        60
a791.pep      MVNYYSAMIKKILTTCFGLVFGFCVFGVGLVAIAILVTYPKLPSLDSLQHYQPKMPLTIY
              ||||||||||||||||||||||||||||||||||||||||||||||||||||||||||||
m791          MVNYYSAMIKKILTTCFGLVFGFCVFGVGLVAIAILVTYPKLPSLDSLQHYQPKMPLTIY
                      10        20        30        40        50        60

                      70        80        90       100       110       120
a791.pep      SADGEVIGMYGEQRREFTKIGDFPEVLRNAVIAAEDKRFYRHWGVDVWGVARAAVGNVVS
              ||||||||||||||||||||||||||||||||||||||||||||||||||||||||||||
m791          SADGEVIGMYGEQRREFTKIGDFPEVLRNAVIAAEDKRFYRHWGVDVWGVARAAVGNVVS
                      70        80        90       100       110       120

                     130       140       150       160       170       180
a791.pep      GSVQSGASTITQQVAKNFYLSSEKTFTRKFNEVLLAYKIEQSLSKDKILELYFNQIYLGQ
              ||||||||||||||||||||||||||||||||||||||||||||||||||||||||||||
m791          GSVQSGASTITQQVAKNFYLSSEKTFTRKFNEVLLAYKIEQSLSKDKILELYFNQIYLGQ
                     130       140       150       160       170       180

                     190       200       210       220       230       240
a791.pep      RAYGFASAAQIYFNKNVRDLTLAEAAMLAGLPKAPSAYNPIVNPERAKLRQKYILNNMLE
              ||||||||||||||||||||||||||||||||||||||||||||||||||||||||||||
m791          RAYGFASAAQIYFNKNVRDLTLAEAAMLAGLPKAPSAYNPIVNPERAKLRQKYILNNMLE
                     190       200       210       220       230       240

                     250       260       270       280       290       300
a791.pep      EKMITVQQRDQALNEELHYERFVRKIDQSALYVAEMVRQELYEKYGEDAYTQGFKVYTTV
              ||||||||||||||||||||||||||||||||||||||||||||||||||||||||||||
m791          EKMITVQQRDQALNEELHYERFVRKIDQSALYVAEMVRQELYEKYGEDAYTQGFKVYTTV
                     250       260       270       280       290       300

                     310       320       330       340       350       360
a791.pep      RADHQKVATEALRKALRNFDRGSSYRGAENYIDLSKSEDVEETVSQYLSGLYTVDKMVPA
              ||||||||||||||||||||||||||||||||||||||||||||||||||||||||||||
m791          RADHQKVATEALRKALRNFDRGSSYRGAENYIDLSKSEDVEETVSQYLSGLYTVDKMVPA
                     310       320       330       340       350       360

                     370       380       390       400       410       420
a791.pep      VVLDVTKKKNVVIQLPGGRRVTLDRRALGFAARAVNNEKMGEDRIRRGAVIRVKNNGGRW
              ||||||||||||||||||||||||||||||||||||||||||||||||||||||||||||
m791          VVLDVTKKKNVVIQLPGGRRVTLDRRALGFAARAVNNEKMGEDRIRRGAVIRVKNNGGRW
                     370       380       390       400       410       420

                     430       440       450       460       470       480
a791.pep      AVVQEPLLQGALVSLDAKTGAVRALVGGYDFHSKTFNRAVQAMRQPGSTFKPFVYSAALS
              ||||||||||| ||||||||||||||||||||||||||||||||||||||||||||||||
m791          AVVQEPLLQGALGSLDAKTGAVRALVGGYDFHSKTFNRAVQAMRQPGSTFKPFVYSAALS
                     430       440       450       460       470       480

                     490       500       510       520       530       540
a791.pep      KGMTASTVVNDAPISLPGKGPNGSVWTPKNSDGRYSGYITLRQALTASKNMVSIRILMSI
              ||||||||||||||||||||||||||||||||||||||||||||||||||||||||||||
m791          KGMTASTVVNDAPISLPGKGPNGSVWTPKNSDGRYSGYITLRQALTASKNMVSIRILMSI
                     490       500       510       520       530       540

                     550       560       570       580       590       600
a791.pep      GVGYAQQYIRRFGFRSSELPASLSMALGTGETTPLKVAEAYSVFANGGYRVSSHVIDKIY
              ||||||||||||||||||||||||||||||||||||||||||||||||||||||||||||
m791          GVGYAQQYIRRFGFRSSELPASLSMALGTGETTPLKVAEAYSVFANGGYRVSSHVIDKIY
                     550       560       570       580       590       600

                     610       620       630       640       650       660
a791.pep      DRDGRLRAQMQPLVAGQNAPQAIDPRNAYIMYKIMQDVVRVGTARGAAALGRTDIAGKTG
              ||||||||||||||||||||||||||||||||||||||||||||||||||||||||||||
m791          DRDGRLRAQMQPLVAGQNAPQAIDPRNAYIMYKIMQDVVRVGTARGAAALGRTDIAGKTG
                     610       620       630       640       650       660

                     670       680       690       700       710       720
a791.pep      TTNDNKDAWFVGFNPDVVTAVYIGFDKPKSMGRVGYGGTIAVPVWVDYMRFALKGKQGKG
              ||||||||||||||||||||||||||||||||||||||||||||||||||||||||||||
m791          TTNDNKDAWFVGFNPDVVTAVYIGFDKPKSMGRVGYGGTIAVPVWVDYMRFALKGKQGKG
                     670       680       690       700       710       720

                     730       740       750       760       770       780
a791.pep      MKMPEGVVSSNGEYYMKERMVTDPGLTLDNSGIAPQPSRRAKEDDGGAAEGGRQAADDEV
              ||||||||||||||||||||||||||||||||||||||||||||||||||||||||||||
m791          MKMPEGVVSSNGEYYMKERMVTDPGLTLDNSGIAPQPSRRAKEDDGGAAEGGRQAADDEV
                     730       740       750       760       770       780

                     790       800
a791.pep      RQDMQETPVLPSNTGSKQQQLDSLFX
              |||||||||||||||||||||||||
m791          RQDMQETPVLPSNTGSKQQQLDSLFX
                     790       800
```

The following partial DNA sequence was identified in *N. gonorrhoeae* <SEQ ID 2681>:

g792.seq

```
  1 ATGTTCCGCA TCGTCAAATG GCTGATTGCC CTGCCCGTCG GCATCTTTAT
 51 CTTTTTCAAT GCCTATGTGT ACGGCAACAT CATCACCTAC CGCGCCGTCG
101 CGCCCCATCG GACTGCCTTT ATGTCGATGC GGATGAAGCA GTTTGAACAA
151 GAAGGTCGCG ATGTCGCACT GGATTACCGC TGGGTGCCCT ACAACCGCAT
201 TTCCACCAAC CTGAAAAAAG CCCTGATTGC TTCCGAAGAT GTCCGTTTTG
251 CCggacacgg gggcttcGat GGGGACGGCa tTCAAAACGC CATCAGGCGC
301 AACCGGAACA GCGGCGAAGT GAAGGCGGGC GGATCGACCA TCAGCCAGCA
351 GCTTGCCAAA AACCTCTTCC TCAACGAAAG CCGCAACTAT CTGCGCAAAG
401 GGGAAGAGGC GGCCATTACG GCAATGATGG AAGCTGTTAC CGACAAAAAC
451 AGGATTTTCG AACTGTATTT AAACTCAATC GAATGGCACT ACGGCgtTTT
501 CGGCGCGGAA GCTGCGTCCC GGtatTttTA TAAAAAACCG GCcgcaGACC
551 TGACcAAACA GCAggcggcG aaactgacgg tactcgtccc cgccccgttt
601 tactactctg accatccaaa aagcaaacgg ctgcgcaaca aaaccaatat
651 cgtgctcaga cgcatgggtt cggcaaatta ccccaaagcg aaacggactg
701 attgttccag atatggaaat gccgcctgaa ctggggttcg aacggcatat
751 gttttctggg acttataa
```

This corresponds to the amino acid sequence <SEQ ID 2682; ORF 792.ng>:

g792.pep

```
  1 MFRIVKWLIA LPVGIFIFFN AYVYGNIITY RAVAPHRTAF MSMRMKQFEQ
 51 EGRDVALDYR WVPYNRISTN LKKALIASED VRFAGHGGFD GDGIQNAIRR
101 NRNSGEVKAG GSTISQQLAK NLFLNESRNY LRKGEEAAIT AMMEAVTDKN
151 RIFELYLNSI EWHYGVFGAE AASRYFYKKP AADLTKQQAA KLTVLVPAPF
201 YYSDHPKSKR LRNRTNIVLR RMGSANYPKA KRTDCSRYGN AA*TGVRTAY
251 VFWDL*
```

The following partial DNA sequence was identified in *N. meningitidis* <SEQ ID 2683>:

m792.seq

```
  1 ATGTTCCGCA TCATCAAATG GCTGATTGCC CTGCCCGTCG GCATCTTTAT
 51 CTTTTTCAAT GCCTATGTGT ACGGCAACAT CATTACCTAC CGCGCCGTCG
101 CGCCCCATCG GACTGCCTTT ATGTCGATGC GGATGAAGCA GTTTGAACAG
151 GAAGGTCGCG ATGTCGCACT GGATTACCGC TGGATGCCCT ACAAACGCAT
201 TTCCACCAAC CTGAAAAAAG CCCTGATTGC TTCCGAAGAT GCCCGTTTCG
251 CCGGGCACGG CGGCTTCGAT TGGGGCGGCA TTCAAAACGC CATCAGGCGC
301 AACCGGAACA GCGGCAAAGT GAAGGCGGGC GGCTCGACCA TCAGCCAGCA
```

-continued

```
351 GCTTGCCAAA AACCTGTTTT TAAACGAAAG CCGCAGCTAT ATCCGCAAAG

401 GCGAAGAAGC GGCGATTACC GCGATGATGG AAGCCGTTAC CGACAAAGAC

451 AGGATTTTTG AACTGTATTT AAACTCAATC GAATGGCACT ACGGCGTTTT

501 CGGCGCGGAA GCCGCGTCCC GGTATTTTTA TCAAATACCC GCCGCCAAGC

551 TGACCAAACA GCAGGCGGCA AAACTGACGG CGCGCGTCCC CGCCCCGCTC

601 TACTACGCCG ACCATCCGAA AAGCAAACGG CTCCGCAACA AAACCAATAT

651 CGTGCTCAAA CGCATGGGTT CGGCAGAGTT GCCTGAAAGC GACACGGACT

701 GA
```

This corresponds to the amino acid sequence <SEQ ID 2684; ORF 792>:

m792.pep

```
  1 MFRIIKWLIA LPVGIFIFFN AYVYGNIITY RAVAPHRTAF MSMRMKQFEQ

 51 EGRDVALDYR WMPYKRISTN LKKALIASED ARFAGHGGFD WGGIQNAIRR

101 NRNSGKVKAG GSTISQQLAK NLFLNESRSY IRKGEEAAIT AMMEAVTDKD

151 RIFELYLNSI EWHYGVFGAE AASRYFYQIP AAKLTKQQAA KLTARVPAPL

201 YYADHPKSKR LRNKTNIVLK RMGSAELPES DTD*
```

g792/m792 90.4% identity in 230 aa overlap

```
                    10        20        30        40        50        60
g792.pep    MFRIVKWLIALPVGIFIFFNAYVYGNIITYRAVAPHRTAFMSMRMKQFEQEGRDVALDYR
            ||||:|||||||||||||||||||||||||||||||||||||||||||||||||||||||
m792        MFRIIKWLIALPVGIFIFFNAYVYGNIITYRAVAPHRTAFMSMRMKQFEQEGRDVALDYR
                    10        20        30        40        50        60

                    70        80        90       100       110       120
g792.pep    WVPYNRISTNLKKALIASEDVRFAGHGGFDGDGIQNAIRRNRNSGEVKAGGSTISQQLAK
            |:||:|||||||||||||||:|||||||||  |||||||||||||:||||||||||||||
m792        WMPYDRISTNLKKALIASEDARFAGHGGFDWGGIQNAIRRNRNSGKVKAGGSTISQQLAK
                    70        80        90       100       110       120

                   130       140       150       160       170       180
g792.pep    NLFLNESRNYLRKGEEAAITAMMEAVTDKNRIFELYLNSIEWHYGVFGAEAASRYFYKKP
            ||||||||:|:||||||||||||||||||:|||||||||||||||||||||||||||: |
m792        NLFLNESRSYIRKGEEAAITAMMEAVTDKDRIFELYLNSIEWHYGVFGAEAASRYFYQIP
                   130       140       150       160       170       180

                   190       200       210       220       230       240
g792.pep    AADLTQQAAKLTVLVAPAPFYYSDHPKSKRLRNKTNIVLRRMGSANYPKAKRTDCSRYGN
            ||  |||||||||:  |||||:||:||||||||||||||||:|||||:  |::
m792        AAKLTDQQAAKLTARVPAP;YYADHPKSKRLRNKTNIVLKRMGSAELPESDTDX
                   190       200       210       220       230

                   250
g792.pep    AAXTGVRTAYVFWDLX
```

The following partial DNA sequence was identified in *N. meningitidis* <SEQ ID 2685>:

a792.seq

```
  1 ATGTTCCGCA TCATCAAATG GCTGATTGCC CTGCCCGTCG GCATCTTTAT

 51 CTTTTTCAAT GCCTATGTGT ACGGCAACAT CATTACCTAC CGCGCCGTCG

101 CGCCCCATCG GACTGCCTTT ATGTCGATGC GGATGAAGCA GTTTGAACAG

151 GAAGGTCGCG ATGTCGCACT GGATTACCGC TGGATGCCCT ACAAACGCAT
```

-continued

```
201 TTCCACCAAC CTGAAAAAAG CCCTGATTGC TTCCGAAGAT GCCCGTTTCG

251 CCGGGCACGG CGGCTTCGAT TGGGGCGGCA TTCAAAACGC CATCAGGCGC

301 AACCGGAACA GCGGCAAAGT GAAGGCGGGC GGCTCGACCA TCAGCCAGCA

351 GCTTGCCAAA AACCTGTTTT TAAACGAAAG CCGCAGCTAT ATCCGCAAAG

401 GCGAAGAAGC GGCGATTACC GCGATGATGG AAGCCGTTAC CGACAAAGAC

451 AGGATTTTTG AACTGTATTT AAACTCAATC GAATGGCACT ACGGCGTTTT

501 CGGCGCGGAA GCCGCGTCCC GGTATTTTTA TCAAATACCC GCCGCCAAGC

551 TGACCAAACA GCAGGCGGCA AAACTGACGG CGCGCGTCCC CGCCCCGCTC

601 TACTACGCCG ACCATCCGAA AAGCAAACGG CTCCGCAACA AAACCAATAT

651 CGTGCTCAGA CGCATGGGTT CGGCAGAGTT GCCTGAAAGC GACACGGACT

701 GA
```

This corresponds to the amino acid sequence <SEQ ID 2686; ORF 792.a>:

a792.pep

```
  1 MFRIIKWLIA LPVGIFIFFN AYVYGNIITY RAVAPHRTAF MSMRMKQFEQ

 51 EGRDVALDYR WMPYKRISTN LKKALIASED ARFAGHGGFD WGGIQNAIRR

101 NRNSGKVKAG GSTISQQLAK NLFLNESRSY IRKGEEAAIT AMMEAVTDKD

151 RIFELYLNSI EWHYGVFGAE AASRYFYQIP AAKLTKQQAA KLTARVPAPL

201 YYADHPKSKR LRNKTNIVLR RMGSAELPES DTD*
```

m792/a792 99.6% identity in 233 aa overlap

```
                    10        20        30        40        50        60
a792.pep    MFRIIKWLIALPVGIFIFFNAYVYGNIITYRAVAPHRTAFMSMRMKQFEQEGRDVALDYR
            ||||||||||||||||||||||||||||||||||||||||||||||||||||||||||||
m792        MFRIIKWLIALPVGIFIFFNAYVYGNIITYRAVAPHRTAFMSMRMKQFEQEGRDVALDYR
                    10        20        30        40        50        60

                    70        80        90       100       110       120
a792.pep    WMPYKRISTNLKKALIASEDARFAGHGGFDWGGIQNAIRRNRNSGKVKAGGSTISQQLAK
            ||||||||||||||||||||||||||||||||||||||||||||||||||||||||||||
m792        WMPYKRISTNLKKALIASEDARFAGHGGFDWGGIQNAIRRNRNSGKVKAGGSTISQQLAK
                    70        80        90       100       110       120

                   130       140       150       160       170       180
a792.pep    NLFLNESRSYIRKGEEAAITAMMEAVTDKDRIFELYLNSIEWHYGVFGAEAASRYFYQIP
            ||||||||||||||||||||||||||||||||||||||||||||||||||||||||||||
m792        NLFLNESRSYIRKGEEAAITAMMEAVTDKDRIFELYLNSIEWHYGVFGAEAASRYFYQIP
                   130       140       150       160       170       180

                   130       140       150       160       170
a792.pep    AAKLTKQQAAKLTARVPAPLYYADHPKSKRLRNKTNIVLRRMGSAELPESDTDX
            ||||||||||||||||||||||||||||||||||||||:||||||||||||||
m792        AAKLTKQQAAKLTARVPAPLYYADHPKSKRLRNKTNIVLKRMGSAELPESDTDX
                   130       140       150       160       170
```

The following partial DNA sequence was identified in N gonorrhoeae <SEQ ID 2687>:

g793.seq

```
 1 ATGTTGATTA AAAGCGAATA TAAGCCCCGG ATGCTGCCCA AAGAAGAGCA

51 GGTCAAAAAG CCGATGACCA GTAACGGACG GATTAGCTTC GTCCTGATGG
```

-continued

```
 101 CAATGGCGGT CTTGTTTGCC TGTCTGATTG CCCGCGGGCT GTATCTGCAG
 151 ACGGTAACGT ATAACTTTTT GAAAGAACAG GGCGACAACC GGATTGTGCG
 201 GACTCAAGCA TTGCCGGCTA CACGCGGTAC GGTTTCGGAC CGGAACGGTG
 251 CGGTTTTGGC GTTGAGCGCG CCGACGGACT CCCTGTTTGC CGTGCCTAAA
 301 GATATGAAGG AAATGCCGTC TGCCGCCCAA TTGGAACGCC TGTCCGAGCT
 351 TGTCGATGTG CCGGTCGATC TTTTGAGGAA CAAACTCGAA CAGAAAGGCA
 401 AGTCGTTTAT TTGGATCAAG CGGCAGCTCG ATCCCAAGGT TGCCGAAGAG
 451 GTCAAAGCCT TGGGTTTGGA AAACTTTGTA TTTGAAAAAG AATTAAAACG
 501 CCATTACCCG ATGGGCAACC TGTTTGCACA CGTCATCGGA TTTACCGATA
 551 TTGACGGCAA AGGTCAGGAA GGTTTGGAAC TTTCGCTTGA AGACAGCCTG
 601 TATGGCGAAG ACGGCGCGGA AGTTGTTTTG CGGGACCGGC AGGGCAATAT
 651 TGTGGACAGC TTGGACTCCC CGCGCAATAA AGCACCGCAA AACGGCAAAG
 701 ACATCATCCT TTCCCTCGAT CAGAGGATTC AGACCTTGGC CTATGAAGAG
 751 TTGAACAAGG CGGTCGAATA CCATCAGGCA AAAGCCGGAA CGGTGGTGGT
 801 TTTGGATGCC CGCACGGGGG AAATCCTCGC CTTGGCCAAT ACGCCCGCCT
 851 ACGATCCCAA CAGACCCGGC CGGGCAGACA GCGAACAGCG GCGCAACCGT
 901 GCCGTAACCG ATATGATCGA ACCTGGTTCG GCAATCAAAC CGTTCGTGAT
 951 TGCGAAGGCA TTGGATGCGG GCAAAACCGA TTTGAACGAA CGGCTGAATA
1001 CGCAGCCTTA TAAAATCGGA CCGTCTCCCG TGCGCGATGA TACCCATGTT
1051 TACCCCTCTT TGGATGTGCG CGGCATTATG CAGAAATCGT CCAACGTCGG
1101 CACAAGCAAA CTGTCTGCGC GTTTCGGCGC CGAAGAAATG TATGACTTCT
1151 ATCATGAATT GGGCATCGGT GTGCGTATGC ACTCGGGCTT TCCGGGGGAA
1201 ACTGCAGGTT TGTTGAGAAA TTGGCGCAGG TGGCGGCCCA TCGAACAGGC
1251 GACGATGTCT TTCGGTTACG GTCTGCAATT GAGCCTGCTG CAATTGGCGC
1301 GCGCCTATAC CGCACTGACG CACGACGGCG TTTTGCTGCC GCTCAGCTTT
1351 GAGAAGCAGG CGGTTGCGCC GCAAGGCAAA CGCATATTCA AAGAATCGAC
1401 CGCGCGCGAG GTACGCAATC TGATGGTTTC CGTAACCGAG CCGGGCGGCA
1451 CCGGTACGGC GGGTGCGGTG GACGGTTTCG ATGTCGGCGC TAAAACCGGC
1501 ACGGCGCGCA AGTTCGTCAA CGGGCGTTAT GCCGACAACA AACACGTCGC
1551 TACCTTTATC GGTTTTGCCC CCGCCAAAAA CCCCCGTGTG ATTGTGGCGG
1601 TAACCATCGA CGAACCGACT GCCCACGGCT ATTACGGCGG CGTAGTGGCA
1651 GGGCCGCCCT TCAAAAAAAT TATGGGCGGC AGCCTGAACA TCTTGGGCAT
1701 TTCCCCGACC AAGCCACTGA CCGCCGCAGC CGTCAAAACA CCGTCTTAA
```

This corresponds to the amino acid sequence <SEQ ID 2688; ORF 793.ng>:

g793.pep

```
 1 MLIKSEYKPR MLPKEEQVKK PMTSNGRISF VLMAMAVLFA CLIARGLYLQ
51 TVTYNFLKEQ GDNRIVRTQA LPATRGTVSD RNGAVLALSA PTESLFAVPK
```

-continued

```
101 DMKEMPSAAQ LERLSELVDV PVDVLRNKLE QKGKSFIWIK RQLDPKVAEE

151 VKALGLENFV FEKELKRHYP MGNLFAHVIG FTDIDGKGQE GLELSLEDSL

201 YGEDGAEVVL RDRQGNIVDS LDSPRNKAPQ NGKDIILSLD QRIQTLAYEE

251 LNKAVEYHQA KAGTVVVLDA RTGEILALAN TPAYDPNRPG RADSEQRRNR

301 AVTDMIEPGS AIKPFVIAKA LDAGKTDLNE RLNTQPYKIG PSPVRDDTHV

351 YPSLDVRGIM QKSSNVGTSK LSARFGAEEM YDFYHELGIG VRMHSGFPGE

401 TAGLLRNWRR WRPIEQATMS FGYGLQLSLL QLARAYTALT HDGVLLPLSF

451 EKQAVAPQGK RIFKESTARE VRNLMVSVTE PGGTGTAGAV DGFDVGAKTG

501 TARKFVNGRY ADNKHVATFI GFAPAKNPRV IVAVTIDEPT AHGYYGGVVA

551 GPPFKKIMGG SLNILGISPT KPLTAAAVKT PS*
```

The following partial DNA sequence was identified in *N. meningitidis* <SEQ ID 2689>:

m793.seq

```
   1 ATGTTGATTA AGAGCGAATA TAAGCCTCGG ATGCTGCCCA AAGAAGAGCA

  51 GGTCAAAAAG CCGATGACCA GTAACGGACG GATCAGCTTC GTCCTGATGG

 101 CAATAGCGGT CTTGTTTGCC GGTCTGATTG CTCGCGGACT GTATCTGCAG

 151 ACGGTAACGT ATAACTTTTT GAAAGAACAG GGCGACAACC GGATTGTGCG

 201 GACTCAAACA TTGCCGGCTA CACGCGGTAC GGTTTCGGAC CGGAACGGTG

 251 CGGTTTTGGC GTTGAGTGCG CCGACGGAGT CCCTGTTTGC CGTGCCTAAA

 301 GAGATGAAGG AAATGCCGTC TGCCGCACAA TTGGAACGCC TGTCCGAGCT

 351 TGTCGATGTG CCGGTTGATG TTTTGAGGAA CAAGCTCGAA CAGAAAGGCA

 401 AGTCGTTTAT CTGGATTAAG CGGCAGCTCG ATCCCAAGGT TGCCGAAGAG

 451 GTCAAAGCCT TGGGTTTGGA AAACTTTGTA TTTGAAAAAG AATTAAAACG

 501 CCATTACCCG ATGGGCAACC TGTTTGCACA CGTCATCGGA TTTACCGATA

 551 TTGACGGCAA AGGTCAGGAA GGTTTGGAAC TTTCGCTTGA AGACAGCCTG

 601 CATGGCGAAG ACGGCGCGGA AGTCGTTTTG CGGGACCGGC AGGGCAATAT

 651 TGTGGACAGC TTGGACTCCC CGCGCAATAA AGCCCCGAAA AACGGCAAAG

 701 ACATCATCCT TTCCCTCGAT CAGAGGATTC AGACCTTGGC CTATGAAGAG

 751 TTGAACAAGG CGGTCGAATA CCATCAGGCA AAAGCCGGAA CGGTGGTGGT

 801 TTTGGATGCC CGCACGGGGG AAATCCTCGC CTTGGCCAAT ACGCCCGCCT

 851 ACGATCCCAA CAGGCCCGGC CGGGCAGACA GCGAACAGCG GCGCAACCGT

 901 GCCGTAACCG ATATGATCGA ACCCGGTTCG GCAATCAAAC CGTTTGTGAT

 951 TGCGAAGGCA TTGGATGCGG GCAAAACCGA TTTGAACGAA CGGCTGAATA

1001 CGCAGCCTTA TAAAATCGGA CCGTCTCCCG TGCGCGATAC CCATGTTTAC

1051 CCCTCTTTGG ATGTGCGCGG CATCATGCAG AAATCGTCCA ACGTCGGCAC

1101 AAGCAAACTG TCTGCGCGTT TCGGTGCCGA AGAAATGTAT GACTTCTATC

1151 ATGAGTTGGG CATCGGTGTG CGTATGCACT CGGGCTTTCC GGGCGAAACT

1201 GCAGGTTTGT TGAGAAATTG GCGCAGGTGG CGGCCTATCG AACAGGCGAC

1251 GATGTCTTTC GGTTACGGCC TGCAATTGAG CCTGCTGCAA TTGGCGCGCG
```

-continued

```
1301 CCTATACCGC ACTGACGCAC GACGGCGTTT TACTGCCGGT CAGCTTTGAA

1351 AAACAGGCGG TTGCGCCGCA AGGCAAACGC ATATTCAAAG AATCGACCGC

1401 GCGCGAGGTA CGCAATCTGA TGGTTTCCGT AACCGAGCCG GGCGGCACCG

1451 GTACGGCGGG TGCGGTGGAC GGTTTCGATG TCGGCGCGAA AACCGGCACG

1501 GCGCGCAAGT TCGTCAACGG GCGTTATGCC GACAACAAAC ACATCGCTAC

1551 CTTTATCGGT TTTGCCCCCG CCAAAAATCC CCGTGTGATT GTGGCGGTAA

1601 CCATTGACGA ACCGACTGCC CACGGTTATT ACGGCGGCGT AGTGGCAGGG

1651 CCGCCCTTCA AAAAAATTAT GGGCGGCAGC CTGAACATCT TGGGCATTTC

1701 CCCGACCAAG CCACTGACCG CCGCAGCCGT CAAAACACCG TCTTAA
```

This corresponds to the amino acid sequence <SEQ ID 2690; ORF 793>:

m793.pep

```
  1 MLIKSEYKPR MLPKEEQVKK PMTSNGRISF VLMAIAVLFA GLIARGLYLQ

 51 TVTYNFLKEQ GDNRIVRTQT LPATRGTVSD RNGAVLALSA PTESLFAVPK

101 EMKEMPSAAQ LERLSELVDV PVDVLRNKLE QKGKSFIWIK RQLDPKVAEE

151 VKALGLENFV FEKELKRHYP MGNLFAHVIG FTDIDGKGQE GLELSLEDSL

201 HGEDGAEVVL RDRQGNIVDS LDSPRNKAPK NGKDIILSLD QRIQTLAYEE

251 LNKAVEYHQA KAGTVVVLDA RTGEILALAN TPAYDPNRPG RADSEQRRNR

301 AVTDMIEPGS AIKPFVIAKA LDAGKTDLNE RLNTQPYKIG PSPVRDTHVY

351 PSLDVRGIMQ KSSNVGTSKL SARFGAEEMY DFYHELGIGV RMHSGFPGET

401 AGLLRNWRRW RPIEQATMSF GYGLQLSLLQ LARAYTALTH DGVLLPVSFE

451 KQAVAPQGKR IFKESTAREV RNLMVSVTEP GGTGTAGAVD GFDVGAKTGT

501 ARKFVNGRYA DNKHIATFIG FAPAKNPRVI VAVTIDEPTA HGYYGGVVAG

551 PPFKKIMGGS LNILGISPTK PLTAAAVKTP S*
```

g793/m793 98.5% identity in 582 aa overlap

```
                         10        20        30        40        50        60
g793.pep         MLIKSEYKPRMLPKEEQVKKPMTSNGRISFVLMAMAVLFACLIARGLYLQTVTYNFLKEQ
                 ||||||||||||||||||||||||||||||||||:||||| |||||||||||||||||||
m793             MMLIKSEYKPRMLPKEEQVKKPMTSNGRISFVLMAIAVLFAGLIARGLYLQTVTNFLKEQ
                         10        20        30        40        50        60

                         70        80        90       100       110       120
g793.pep         GDNRIVRTQALPATRGTVSDRNGAVLALSAPTESLFAVPKDMKEMPSAAQLERLSELVDV
                 |||||||||:|||||||||||||||||||||||||||||||:||||||||||||||||||
m793             GDNRIVRTQTLPATRGTVSDRNGAVLALSAPTESLFAVPKEMKEMPSAAQLERLSELVDV
                         70        80        90       100       110       120

                        130       140       150       160       170       180
g793.pep         PVDVLRNKLEQKGKSFIWIKRQLDPKVAEEVKALGLENFVFEKELKRHYPMGNLFAHVIG
                 ||||||||||||||||||||||||||||||||||||||||||||||||||||||||||||
m793             PVDVLRNKLEQKGKSFIWIKRQLDPKVAEEVKALGLENFVFEKELKRHYPMGNLFAHVIG
                        130       140       150       160       170       180

                        190       200       210       220       230       240
g793.pep         FTDIDGKGQEGLELSLEDSLYGEDGAEVVLRDRQGNIVDSLDSPRNKAPQNGKDIILSLD
                 |||||||||||||||||||||:||||||||||||||||||||||||||||:|||||||||
m793             FTDIDGKGQEGLELSLEDSLHGEDGAEVVLRDRQGNIVDSLDSPRNKAPKNGKDIILSLD
                        190       200       210       220       230       240
```

-continued

```
                 250       260       270       280       290       300
g793.pep   QRIQTLAYEELNKAVEYHQAKAGTVVVLDARTGEILALANTPAYDPNRPGRADSEQRRNR
           ||||||||||||||||||||||||||||||||||||||||||||||||||||||||||||
m793       QRIQTLAYEELNKAVEYHQAKAGTVVVLDARTGEILALANTPAYDPNRPGRADSEQRRNR
                 250       260       270       280       290       300

                 310       320       330       340       350       360
g793.pep   AVTDMIEPGSAIKPFVIAKALDAGKTDLNERLNTQPYKIGPSPVRDDTHVYPSLDVRGIM
           |||||||||||||||||||||||||||||||||||||||||||||| |||||||||||||
m793       AVTDMIEPGSAIKPFVIAKALDAGKTDLNERLNTQPYKIGPSPVRD-THVYPSLDVRGIM
                 310       320       330       340       350       360

                 370       380       390       400       410       420
g793.pep   QKSSNVGTSKLSARFGAEEMYDFYHELGIGVRMHSGFPGETAGLLRNWRRWRPIEQATMS
           ||||||||||||||||||||||||||||||||||||||||||||||||||||||||||||
m793       QKSSNVGTSKLSARFGAEEMYDFYHELGIGVRMHSGFPGETAGLLRNWRRWRPIEQATMS
         360       370       380       390       400       410

                 430       440       450       460       470       480
g793.pep   FGYGLQLSLLQLARAYTALTHDGVLLPLSFEKQAVAPQGKRIFKESTAREVRNLMVSVTE
           ||||||||||||||||||||||||||:|||||||||||||||||||||||||||||||||
m793       FGYGLQLSLLQLARAYTALTHDGVLLPVSFEKQAVAPQGKRIFKESTAREVRNLMVSVTE
         420       430       440       450       460       470

                  490       500       510       520       530       540
g793.pep    PGGTGTAGAVDGFDVGAKTGTARKFVNGRYADNKHVATFIGFAPAKNPRVIVAVTIDEPT
            ||||||||||||||||||||||||||||||||||:|||||||||||||||||||||||||
m793        PGGTGTAGAVDGFDVGAKTGTARKFVNGRYADNKHIATFIGFAPAKNPRVIVAVTIDEPT
          480       490       500       510       520       530

                  550       560       570       580
g793.pep    AHGYYGGVVAGPPFKKIMGGSLNILGISPTKPLTAAAVKTPSX
            |||||||||||||||||||||||||||||||||||||||||||
m793        AHGYYGGVVAGPPFKKIMGGSLNILGISPTKPLTAAAVKTPSX
          540       550       560       510       580
```

The following partial DNA sequence was identified in *N. meningitidis* <SEQ ID 2691>:

a793.seq

```
  1 ATGTTGATTA AGAGCGAATA TAAGCCTCGG ATGCTGCCCA AAGAAGAGCA
 51 GGTCAAAAAG CCGATGACCA GTAACGGACG GATCAGCTTC GTCCTGATGG
101 CAATAGCGGT CTTGTTTGCC GGTCTGATTG CTCGCGGACT GTATCTGCAG
151 ACGGTAACGT ATAACTTTTT GAAAGAACAG GGCGACAACC GGATTGTGCG
201 GACTCAAACA TTGCCGGCTA CACGCGGTAC GGTTTCGGAC CGGAACGGTG
251 CGGTTTTGGC GTTGAGTGCG CCGACGGAGT CCCTGTTTGC CGTGCCTAAA
301 GAGATGAAGG AAATGCCGTC TGCCGCACAA TTGGAACGCC TGTCCGAGCT
351 TGTCGATGTG CCGGTTGATG TTTTGAGGAA CAAGCTCGAA CAGAAAGGCA
401 AGTCGTTTAT CTGGATTAAG CGGCAGCTCG ATCCCAAGGT TGCCGAAGAG
451 GTCAAAGCCT TGGGTTTGGA AAACTTTGTA TTTGAAAAAG AATTAAAACG
501 CCATTACCCG ATGGGCAACC TGTTTGCACA CGTCATCGGA TTTACCGATA
551 TTGACGGCAA AGGTCAGGAA GGTTTGGAAC TTTCGCTTGA AGACAGCCTG
601 CATGGCGAAG ACGGCGCGGA AGTCGTTTTG CGGGACCGGC AGGGCAATAT
651 TGTGGACAGC TTGGACTCCC CGCGCAATAA AGCCCCGAAA AACGGCAAAG
701 ACATCATCCT TTCCCTCGAT CAGAGGATTC AGACCTTGGC CTATGAAGAG
751 TTGAACAAGG CGGTCGAATA CCATCAGGCA AAAGCCGGAA CGGTGGTGGT
801 TTTGGATGCC CGCACGGGGG AAATCCTCGC CTTGGCCAAT ACGCCCGCCT
851 ACGATCCCAA CAGGCCCGGC CGGGCAGACA GCGAACAGCG GCGCAACCGT
901 GCCGTAACCG ATATGATCGA ACCCGGTTCG GCAATCAAAC CGTTTGTGAT
951 TGCGAAGGCA TTGGATGCGG GCAAAACCGA TTTGAACGAA CGGCTGAATA
```

-continued

```
1001 CGCAGCCTTA TAAAATCGGA CCGTCTCCCG TGCGCGATAC CCATGTTTAC

1051 CCCTCTTTGG ATGTGCGCGG CATCATGCAG AAATCGTCCA ACGTCGGCAC

1101 AAGCAAACTG TCTGCGCGTT TCGGTGCCGA AGAAATGTAT GACTTCTATC

1151 ATGAGTTGGG CATCGGTGTG CGTATGCACT CGGGCTTTCC GGGCGAAACT

1201 GCAGGTTTGT TGAGAAATTG GCGCAGGTGG CGGCCTATCG AACAGGCGAC

1251 GATGTCTTTC GGTTACGGCC TGCAATTGAG CCTGCTGCAA TTGGCGCGCG

1301 CCTATACCGC ACTGACGCAC GACGGCGTTT TACTGCCGGT CAGCTTTGAA

1351 AAACAGGCGG TTGCGCCGCA AGGCAAACGC ATATTCAAAG AATCGACCGC

1401 GCGCGAGGTA CGCAATCTGA TGGTTTCCGT AACCGAGCCG GGCGGCACCG

1451 GTACGGCGGG TGCGGTGGAC GGTTTCGATG TCGGCGCGAA AACCGGCACG

1501 GCGCGCAAGT TCGTCAACGG GCGTTATGCC GACAACAAAC ACATCGCTAC

1551 CTTTATCGGT TTTGCCCCCG CCAAAAATCC CCGTGTGATT GTGGCGGTAA

1601 CCATTGACGA ACCGACTGCC CACGGTTATT ACGGCGGCGT AGTGGCAGGG

1651 CCGCCCTTCA AAAAAATTAT GGGCGGCAGC CTGAACATCT TGGGCATTTC

1701 CCCGACCAAG CCACTGACCG CCGCAGCCGT CAAAACACCG TCTTAA
```

This corresponds to the amino acid sequence <SEQ ID 2692; ORF 793.a>:

a793.pep

```
  1 MLIKSEYKPR MLPKEEQVKK PMTSNGRISF VLMAIAVLFA GLIARGLYLQ

 51 TVTYNFLKEQ GDNRIVRTQT LPATRGTVSD RNGAVLALSA PTESLFAVPK

101 EMKEMPSAAQ LERLSELVDV PVDVLRNKLE QKGKSFIWIK RQLDPKVAEE

151 VKALGLENFV FEKELKRHYP MGNLFAHVIG FTDIDGKGQE GLELSLEDSL

201 HGEDGAEVVL RDRQGNIVDS LDSPRNKAPK NGKDIILSLD QRIQTLAYEE

251 LNKAVEYHQA KAGTVVVLDA RTGEILALAN TPAYDPNRPG RADSEQRRNR

301 AVTDMIEPGS AIKPFVIAKA LDAGKTDLNE RLNTQPYKIG PSPVRDTHVY

351 PSLDVRGIMQ KSSNVGTSKL SARFGAEEMY DFYHELGIGV RMHSGFPGET

401 AGLLRNWRRW RPIEQATMSF GYGLQLSLLQ LARAYTALTH DGVLLPVSFE

451 KQAVAPQGKR IFKESTAREV RNLMVSVTEP GGTGTAGAVD GFDVGAKTGT

501 ARKFVNGRYA DNKHIATFIG FAPAKNPRVI VAVTIDEPTA HGYYGGVVAG

551 PPFKKIMGGS LNILGISPTK PLTAAAVKTP S*
```

a793/m793 100.0% identity in 581 aa overlap

```
                    10        20        30        40        50        60
a793.pep    MLIKSEYKPRMLPKEEQVKKPMTSNGRISFVLMAIAVLFAGLIARGLYLQTVTYNFLKEQ
            ||||||||||||||||||||||||||||||||||||||||||||||||||||||||||||
m793        MLIKSEYKPRMLPKEEQVKKPMTSNGRISFVLMAIAVLFAGLIARGLYLQTVTYNFLKEQ
                    10        20        30        40        50        60

                    70        80        90       100       110       120
a793.pep    GDNRIVRTQTLPATRGTVSDRNGAVLALSAPTESLFAVPKEMKEMPSAAQLERLSELVDV
            ||||||||||||||||||||||||||||||||||||||||||||||||||||||||||||
m793        GDNRIVRTQTLPATRGTVSDRNGAVLALSAPTESLFAVPKEMKEMPSAAQLERLSELVDV
                    70        80        90       100       110       120
```

-continued

```
                 130       140       150       160       170       180
a793.pep   PVDVLRNKLEQKGKSFIWIKRQLDPKVAEEVKALGLENFVFEKELKRHYPMGNLFAHVIG
           ||||||||||||||||||||||||||||||||||||||||||||||||||||||||||||
m793       PVDVLRNKLEQKGKSFIWIKRQLDPKVAEEVKALGLENFVFEKELKRHYPMGNLFAHVIG
                 130       140       150       160       170       180

                 190       200       210       220       230       240
a793.pep   FTDIDGKGQEGLELSLEDSLHGEDGAEVVLRDRQGNIVDSLDSPRNKAPKNGKDIILDLD
           ||||||||||||||||||||||||||||||||||||||||||||||||||||||||||||
m793       FTDIDGKGQEGLELSLEDSLHGEDGAEVVLRDRQGNIVDSLDSPRNKAPKNGKDIILDLD
                 190       200       210       220       230       240

                 250       260       270       280       290       300
a793.pep   QRIQTLAYEELNKAVEYHQAKAGTVVVLDARTGEILALANTPAYDPNRPGRADSEQRRNR
           ||||||||||||||||||||||||||||||||||||||||||||||||||||||||||||
m793       QRIQTLAYEELNKAVEYHQAKAGTVVVLDARTGEILALANTPAYDPNRPGRADSEQRRNR
                 250       260       270       280       290       300

                 310       320       330       340       350       360
a793.pep   AVTDMIEPGSAIKPFVIAKALDAGKTDLNERLNTQPYKIGPSPVRDTHVYPSLDVRGIMQ
           ||||||||||||||||||||||||||||||||||||||||||||||||||||||||||||
m793       AVTDMIEPGSAIKPFVIAKALDAGKTDLNERLNTQPYKIGPSPVRDTHVYPSLDVRGIMQ
                 310       320       330       340       350       360

                 370       380       390       400       410       420
a793.pep   KSSNVGTSKLSARFGAEEMYDFYHELGIGVRMHSGFPGETAGLLRNWRRWRPIEQATMSF
           ||||||||||||||||||||||||||||||||||||||||||||||||||||||||||||
m793       KSSNVGTSKLSARFGAEEMYDFYHELGIGVRMHSGFPGETAGLLRNWRRWRPIEQATMSF
                 370       380       390       400       410       420

                 430       440       450       460       470       480
a793.pep   GYGLQLSLLQLARAYTALTHDGVLLPVSFEKQAVAPQGKRIFKESTAREVRNLMVSVTEP
           ||||||||||||||||||||||||||||||||||||||||||||||||||||||||||||
m793       GYGLQLSLLQLARAYTALTHDGVLLPVSFEKQAVAPQGKRIFKESTAREVRNLMVSVTEP
                 430       440       450       460       470       480

                  490       500       510       520       530       540
a793.pep    GGTGTAGAVDGFDVGAKTGTARKFVNGRYADNKHIATFIGFAPAKNPRVIVAVTIDEPTA
            ||||||||||||||||||||||||||||||||||||||||||||||||||||||||||||
m793        GGTGTAGAVDGFDVGAKTGTARKFVNGRYADNKHIATFIGFAPAKNPRVIVAVTIDEPTA
                  490       500       510       520       530       540

                  550       560       570       580
a793.pep    HGYYGGVVAGPPFKKIMGGSLNILGISPTKPLTAAAVKTPSX
            ||||||||||||||||||||||||||||||||||||||||||
m793        HGYYGGVVAGPPFKKIMGGSLNILGISPTKPLTAAAVKTPSX
                  550       560       510       580
```

The following partial DNA sequence was identified in *N. gonorrhoeae* <SEQ ID 2693>:

g794.seq

```
  1 gtgcgtttca ATCATTTCAT AATGGTAACG ATTATTATAT ATGTGATTTC

 51 CCCTGCAAAC AAGCCGGTCC GCCGCCCCGG CGTTCCCACT TATCCGGCTT

101 TGCCTTATAA TTGCTTTTTT TATGTAACAG ATTCACCTAT GAATTTCCCC

151 AAAACAGCGG CCTCCCTGCT GCTGCTTCTC GCCTCCCTCG CCGCACACGC

201 GCTCGATACC GGCCGCATTC CGCAAAACGA AATCGCTGTA TATGTCCAAG

251 AGCTTGACAG CGGAAAAGTC ATCATTGACC ACCGTGCCGG CATACCCGTC

301 AATCCCGCGT CCACGATGAA GCTCGTTACC GCGTTTGCCG CCTTCAAAAC

351 CTTCGGCAGC AATTACCGCT GGGCGACCGA GTTTAAAAGC AACGGTACGG

401 TAAACGACGG CACGCTTGAC GGAAACCTGT ATTGGGCGGG CAGCGGCGAC

451 CCCGTTTTCA ATCAGGAAAA CCTGCTTGCC GTCCAACGCC AGTTGCGCGA

501 CAAAGGCATC CGCAATATCA CGGGGCGCCT GATGCTCGAC CACAGCCTGT

551 GGGGCGAAGT CGGCAGTCCC GACCATTTTG AAGCCGACAG CGGTTCGCCG

601 TTTATGACGC CCCCAAATCC GACTATGCTG TCTGCCGGTA TGGTTATGGT

651 GCGCGCCGAA CGCAATGCCG CCGGCAGTAC CGACATCCTC ACCGATCCGC

701 CTTTGCCGCA TATTTTTGCC CAAAACAACT TGAAAATTAC CGCCTCCCAA

751 GCTGCCTGCC CTTCGGTCAA AAAACTGATG CGCGCATCTT TTTCGGGCAA
```

-continued

801 TACGCTGAAA TTGCGCGGCA ATATTCCCGA AAGCTGTTTG GGCAACCCTG
851 TCGGTGTCCG GATGTTCGCG CTTGACGAAC TGATCCGCCA AAGTTTTACC
901 AACCGCTGGC TGCTCGGCGG CGGACGGATT TCAGACGGCA TCGGCATAGC
951 CGACACACCG GAAGGCGCGC AGACGCTTGC CGTTGCACAC TCCAAACCGA
1001 TGAAGGAAAT TTTGACCGAC ATGAACAAGC GTTCGGACAA TCTGATTGCG
1051 CGTTCCGTCT TCCTCAAACT CGGCGGCGAC GGCAAACTGC CCGCCGTTTC
1101 CGAACAGGCG GCGTCTGCCG TCCGGCGAGA ACTTGCCGTA TCGGGCATCG
1151 ATGTTGCGGA TTTGGTTTTG GAAAACGGTT CGGGTCTGTC CAGAAAAGAA
1201 AGGGTAACGG CGAGAATGAT GGCGCAAATG TTGGAAACGG CTTATTTCAG
1251 CCCGTTTGCA CAAGATTTCA TCGACACGGT GCCCATCGCC GGCACAGACG
1301 GGACTTTACG CAACCGCTTC AAACAAAGCG GCGGGCTGTT GCGCTTAAAA
1351 ACCGGCACGC TCAACAATGT CCGCGCCCTT GCAGGTTATT GGCTGGGCGA
1401 CAAACCGATG GCGGTGGTCG TCATCATCAA CAGCGGCCGC GCCGTTTCCC
1451 TGCTGCCCGA CTTGGACAAC TTCGTTGCCA AAAACATCAT CTCCGGCGGC
1501 GACGGCTGGC TGGATGCGAA ACTGATGTGC AAAGAACGCC GCGCCTGA

This corresponds to the amino acid sequence <SEQ ID 2694; ORF 794.ng>:

g794.pep

1 VRFNHFIMVTIIIYVISPAN KPVRRPGVPT YPALPYNCFF YVTDSPMNFP
51 KTAASLLLLLASLAAHALDT GRIPQNEIAV YVQELDSGKV IIDHRAGIPV
101 NPASTMKLVT AFAAFKTFGS NYRWATEFKS NGTVNDGTLD GNLYWAGSGD
151 PVFNQENLLA VQRQLRDKGI RNITGRLMLD HSLWGEVGSP DHFEAOSGSP
201 FMTPPNPTML SAGMVMVRAE RNAAGSTDIL TDPPLPHIFA QNNLKITASQ
251 AACPSVRKLM RASFSGNTLK LRGNIPESCL GKPVGVHIFA LDELIRQSFT
301 NRWLLGGGRI SDGIGIADTP EGAQTLAVAH SKPMKEILTD MNKRSDNLIA
351 RSVFLKLGGD GKLPAVSEQA ASAVRRELAV SGIDVADLVL ENGSGLSRKE
401 RVTARMMAQM LETAYESPFA QDFIDTLPIA GTDGTLRNRF KQSGGLLRLK
451 TGTLNNVRAL AGYWLGDKPMAVVVIINSGRAVSLLPDLDN FVAKNIISGG
501 DGWLDAKLMC KERRA*

The following partial DNA sequence was identified in *N. meningitidis* <SEQ ID 2695>:

m794.seq

1 GTGCGTCTCA ATCATTTCAT AATGATAGCG ATTATTATAT ATGTGATTTC
51 CCCTGCAAAC AAGCCGGCCC GCCGCCACAG CGTTCCCACT TATCCGGCTT
101 TGCCTTATAA TTGCTTTTTT TATGTAACAG ATTTACCTAT GAATTTCCCC
151 AAAACAGCGG CCTCCCTGCT GCTGCTTCTC GCCTCCCTCG CCGCACACGC
201 GCTCGATACC GGCCGCATTC CGCAAAACGA AATCGCCGTA TATCTCCAAG
251 AGCTTGACAG CGGAAAAGTC ATCATTGACC ACCGCTCGGA TGTCCCCGTC

-continued

```
 301 AACCCCGCCT CCACAATGAA ACTCGTTACC GCGTTTGCCG CCTTCAAAAC
 351 CTTCGGCAGC AATTACCGCT GGGCGACCGA GTTTAAAAGC AACGGTACGG
 401 TAAACGACGG CACGCTTGAC GGAAACCTAT ATTGGGCGGG CAGCGGCGAC
 451 CCCGTTTTCA ATCAGGAAAA CCTGCTTGAT GCTCAAAAAC AGTTGCGCGA
 501 ACAAGGCATA CTCAATATCA CGGGACACCT GATGCTCGAC CACAGCCTGT
 551 GGGGCGAAGT CGGCAGCCCC GACGATTTCG AAGCCGACAG CGGTTCGCCG
 601 TTTATGACGC CCCCCAATCC AACTATGCTG TCTGCCGGTA TGGTTATGGT
 651 GCGCGCCGAA CGCAATGCCG CCGGCAGTAC CGACATCCTC ACCGATCCGC
 701 CTTTGCCGCA TATTTTCGCC CAAAACAACT TGAAAATTAC CGCCTCCCAA
 751 GCTGCCTGCC CTTCGATCAA AAAACTGATG CGTGCATCTT TTTCGGACAA
 801 TACGCTGAAA TTGCGCGGCA ATATTCCCGA GAGCTGTTTG GGCAAGCCTG
 851 TCGGTGTCCG GATGTTCGCG CTTGACGAAC TGATCCGGCA AAGTTTTACC
 901 AACCACTGGC TGCTCGGCGG CGGACGGATT TCAGACGGTA TCGGCATAGC
 951 CGACACGCCG GAAGGCGCGC AGACACTTGC CGTTGCACAC GCCAAACCGA
1001 TGAAAGAAAT TTTGACGGAC ATGAACAAGC GTTCGGACAA TCTAATTGCG
1051 CGTTCCGTCT TCCTCAAACT CGGCGGCGAC GGCAAACTGC CCGCCGTTTC
1101 CGAACAGGCG GCGTCTGCCG TCCGGCGCGA ACTTGCCGTA TCGGGCATCG
1151 ATGTTGCGGA TTTGGTTTTG GAAAACGGTT CGGGCCTGTC CAGAAAAGAA
1201 AGGGTAACGG CGAGAATGAT GGCGCAAATG TTGGAAACGG CTTATTTCAG
1251 CCCGTTTGCA CAAGATTTCA TCGACACGCT ACCCATCGCC GGCACAGACG
1301 GAACTTTACG CAACCGCTTC AAACAAAGCG GCGGGCTGTT GCGCTTAAAA
1351 ACCGGCACGC TCAACAATGT CCGCGCCCTT GCAGGTTATT GGCTGGGCGA
1401 CAAACCGATG GCGGTGGTCG TCATCATCAA CAGCGGCCGC GCCGTTTCCC
1451 TGCTGCCAGA CTTGGACAAC TTCGTTGCCA ACAACATCAT CTCCGGCGGC
1501 GATGGCTGGC TGGATGCGAA ACTGATGTGC AAAGAACGCC GAGCCTGA
```

This corresponds to the amino acid sequence <SEQ ID 2696; ORF 794>:

m794.pep

```
  1 VRLNHFIMIAIIIYVISPAN KPARRHSVPT YPALPYNCFF YVTDLPMNFP
 51 KTAASLLLLLASLAAHALDT GRIPQNEIAV YVQELDSGKV IIDHRSDVPV
101 NPASTMKLVT AFAAFKTFGS NYRWATEFKS NGTVNDGTLD GNLYWAGSGD
151 PVFNQENLLD AQKQLREQGI LNITGHLMLD HSLWGEVGSP DDFEADSGSP
201 FMTPPNPTML SAGMVMVRAE RNAAGSTDIL TDPPLPHIFA QNNLKITASQ
251 AACPSIKKLM RASFSDNTLK LRGNIPESCL GKPVGVRMFA LDELIRQSFT
301 NHWLLGGGRI SDGIGIADTP EGAQTLAVAH AKPMKEILTD MNKRSDNLIA
351 RSVFLKLGGD GKLFAVSEQA ASAVRRELAV SGIDVADLVL ENGSGLSRKE
401 RVTARMMAQM LETAYFSPFA QDFIDTLPIA GTDGTLRNRF KQSGGLLRLK
451 TGTLNNVRAL AGYWLGDKPMAVVVIINSGRAVSLLPDLDN FVANNIISGG
501 DGWLDAKLMC KERRA*
```

g794/m794 95.5% identity in 515 aa overlap

```
                    10        20        30        40        50        60
g794.pep    VRFNHFIMVTIIIYVISPANKPVRRPGVPTYPALPYNCFFYVTDSPMNFPKTAASLLLLL
            ||:|||||::||||||||||||:|| :||||||||||||||||| |||||||||||||||
m794        VRFNHFIMVTIIIYVISPANKPVRRPGVPTYPALPYNCFFYVTDSPMNFPKTAASLLLLL
                    10        20        30        40        50        60

                    70        80        90       100       110       120
g794.pep    ASLAAHALDTGRIPQNEIAVYVQELDSGKVIIDHRAGIPVNPASTMKLVTAFAAFKTFGS
            |||||||||||||||||||||||||||||||||||: :||||||||||||||||||||||
m794        ASLAAHALDTGRIPQNEIAVYVQELDSGKVIIDHRSDVPVNPASTMKLVTAFAAFKTFGS
                    70        80        90       100       110       120

                   130       140       150       160       170       180
g794.pep    NYRWATEFKSNGTVNDGTLDGNLYWAGSGDPVFNQENLLAVQRQLRDKGIRNITGRLMLD
            ||||||||||||||||||||||||||||||||||||||| :|:|||::|| ||||:||||
m794        NYRWATEFKSNGTVNDGTLDGNLYWAGSGDPVFNQENLLDAQKQLREQGILNITGHLMLD
                   130       140       150       160       170       180

                   190       200       210       220       230       240
g794.pep    HSLWGEVGSPDHFEADSGSPFMTPPNPTMLSAGMVMVRAERNAAGSTDILTDPPLPHIFA
            ||||||||||| |||||||||||||||||||||||||||||||| |||||||||||||||
m794        HSLWGEVGSPDDFEADSGSPFMTPPNPTMLSAGMVMVRAERNAAGSTDILTDPPLPHIFA
                   190       200       210       220       230       240

                   250       260       270       280       290       300
g794.pep    QNNLKITASQAACPSVKKLMRASFSGNTLKLRGNIPESCLGKPVGVRMFALDELIRQSFT
            |||||||||||||||:||||||||| ||||||||||||||||||||||||||||||||||
m794        QNNLKITASQAACPSIKKLMRASFSDNTLKLRGNIPESCLGKPVGVRMFALDELIRQSFT
                   250       260       270       280       290       300

                   310       320       330       340       350       360
g794.pep    NRWLLGGGRISDGIGIADTPEGAQTLAVAHSKPMKEILTDMNKRSDNLIARSVFLKLGGD
            |:||||||||||||||||||||||||||||:|||||||||||||||||||||||||||||
m794        NHWLLGGGRISDGIGIADTPEGAQTLAVAHAKPMKEILTDMNKRSDNLIARSVFLKLGGD
                   310       320       330       340       350       360

                   370       380       390       400       410       420
g794.pep    GKLPAVSEQAASAVRRELAVSGIDVADLVLENGSGLSRKERVTARMMAQMLETAYFSPFA
            ||||||||||||||||||||||||||||||||||||||||||||||||||||||||||||
m794        GKLPAVSEQAASAVRRELAVSGIDVADLVLENGSGLSRKERVTARMMAQMLETAYFSPFA
                   370       380       390       400       410       420

                   430       440       450       460       470       480
g794.pep    QDFIDTLPIAGTDGTLRNRFKQSGGLLRLKTGTLNNVRALAGYWLGDKPMAVVVIINSGR
            ||||||||||||||||||||||||||||||||||||||||||||||||||||||||||||
m794        QDFIDTLPIAGTDGTLRNRFKQSGGLLRLKTGTLNNVRALAGYWLGDKPMAVVVIINSGR
                   430       440       450       460       470       480

                   490       500       510
g794.pep    AVSLLPDLDNFVAKNIISGGDGWLDAKLMCKERRAX
            |||||||||||||:||||||||||||||||||||||
m794        AVSLLPDLDNFVANNIISGGDGWLDAKLMCKERRAX
                   490       500       510
```

The following partial DNA sequence was identified in *N. meningitidis* <SEQ ID 2697>:

a794.seq

```
  1 GTGCGTCTCA ATCATTTCAT AATGATAGCG ATTATTATAT ATGTGATTTC
 51 CCCTGCAAAC AAGCCGGCCC GCCGCCACAG CGTTCCCACT TATCCGGCTT
101 TGCCTTATAA TTGCTTTTTT TATGTAACAG ATTTACCTAT GAATTTCCCC
151 AAAACAGCGG CCTCCCTGCT GCTGCTTCTC GCCTCCCTCG CCGCACACGC
201 GCTCGATACA GGTCGCATTC CGCAAAACGA AATCGCCGTA TATGTCCAAG
251 AGCTTGACAG CGGAAAAGTC ATCATTGACC ACCGCTCGGA TGTCCCCGTC
301 AACCCCGCCT CCACAATGAA ACTCGTTACC GCGTTTGCCG CCTTCAAAAC
351 CTTCGGCAGC AATTACCGCT GGGCGACCGA GTTTAAAAGC AACGGTACGG
401 TAAACGACGG CACGCTTGAC GGAAACCTGT ATTGGGCGGG CAGCGGCGAC
451 CCCGTTTTCA ATCAGGAAAP CCTGCTTGCC GTCCAACGCC AGTTGCGCGA
501 ACAAGGCATA CGCAATATCA CGGGACACCT GATGCTCGAC CACAGCCTGT
551 GGGGCGAAGT CGGCAGCCCC GACGATTTCG AAGCCGACAG CGCTTCGCCG
```

-continued

```
 601 TTTATGACGC CCCCCAATCC AACTATGCTG TCTGCCGGTA TGGTTATCGT

 651 GCGCGCCGAA CGCAATGCCG CCGACAGTAC CGACATCCTC ACCGATCCGC

 701 CTTTGCCGCA TATTTTCGCC CAAAACAACT TGAAAATTAC CGCCTCCCAA

 151 GCTGCCTGCC CTTCGATCAA AAAACTGATG CGTGCATCTT TTTCGGACAA

 801 TACGCTGAAA TTGCGCGGCA ATATTCCCGA GAGCTGTTTG GGCAAGCCTG

 851 TCGGTGTCCG GATCTTCGCG CTTGACGAAC TGATCCGGCA AAGTTTTACC

 901 AACCACTGGC TGCTCGGCGG CGGACGGATT TCAGACGGCA TCGGCATATC

 951 CGACACGCCG GAAGGCGCGC AGACGCTTGC CGTTGCACAC TCAAAGCCGA

1001 TGAAGGAAAT TTTGACGGAC ATGAACAAGC GTTCGGACAA TCTAATTGCG

1051 CGTTCCGTCT TCCTCAAACT CGGCGGCGAC GGCAAACTGC CCGCCGTTTC

1101 CGAACAGGCA GCGTCTGCCG TCCGGCGTGA ACTTGCCGTG TCGGGCATCG

1151 ATGTTGCGGA TTTGGTTTTG GAAAACGGTT CAGGTCTGTC CAGAAAAGAA

1201 AGGGTAACGG CGAGAATGAT GGCGCAAATG TTGGAAACGG CTTATTTCAG

1251 CCCGTTTGCA CAAGATTTCA TCGATACGCT GCCCATCGCC GGCACAGACG

1301 GGACTTTACG CAACCGCTTC AAACAAAGCG GCGGGCTGTT GCGCPTAAAA

1351 ACCGGCACGC TCAACAATGT CCGCGCCCTT GCAGGTTATT GGCTGGGCGA

1401 CAAACCGATG GCGGTGGTCG TCATCATCAA CAGCGGCCGC GCCGTTTCCC

1451 TGCTGCCCGA CTTGGACAAC TTCGTTGCCA ACAACATCAT CTCCGGCGGC

1501 GATGGCTGGC TGGATGCGAA ACTGATGTGC AAAGAACGCC GAGCCTGA
```

This corresponds to the amino acid sequence <SEQ ID 2698; ORF 794.a>:

```
a794.pep

  1 VRLNHFIMIAIIIYVISPAN KPARRHSVPT YPALPYNCFF YVTDLPMNFP

 51 KTAASLLLLLASLAAHALDT GRIPQNEIAV YVQELDSGKV IIDHRSDVPV

101 NPASTMKLVT AFAAFKTFGS NYRWATEFKS NGTVNDGTLD GNLYWAGSGD

151 PVFNQENLLA VQRQLREQGI RNITGHLMLD HSLWGEVGSP DDFEADSGSP

201 FMTPPNPTML SAGMVMVRAE RNAADSTDIL TDPPLPHIFA QNNLKITASQ

251 AACPSIKKLM RASFSDNTLK LRGNIPESCL GKPVGVRMFA LDELIRQSFT

301 NHWLLGGGRI SDGIGISDTP EGAQTLAVAH SKPMKEILTD MNKRSDNLIA

351 RSVFLKLGGD GKLPAVSEQA ASAVRRELAV SGIDVADLVL ENGSGLSRKE

401 RVTARMMAQM LETAYFSPFA QDFIDTLPIA GTDGTLRNRF KQSGGLLRLK

451 TGTLNNVRAL AGYWLGDKPMAVVVIINSGRAVSLLPDLDN FVANNIISGG

501 DGWLDAKLMC KERRA*
```

a794/m794 98.6% identity in 515 aa overlap

```
                   10        20        30        40        50        60
a794.pep    VRLNHFIMIAIIIYVISPANKPARRHSVPTYPALPYNCFFYVTDLPMNFPKTAASLLLLL
            ||||||||||||||||||||||||||||||||||||||||||||||||||||||||||||
m794        VRLNHFIMIAIIIYVISPANKPARRHSVPTYPALPYNCFFYVTDLPMNFPKTAASLLLLL
                   10        20        30        40        50        60
```

-continued

```
                   70        80        90       100       110       120
a794.pep     ASLAAHALDTGRIPQNEIAVYVQELDSGKVIIDHRSDVPVNPASTMKLVTAFAAFKTFGS
             ||||||||||||||||||||||||||||||||||||||||||||||||||||||||||||
m794         ASLAAHALDTGRIPQNEIAVYVQELDSGKVIIDHRSDVPVNPASTMKLVTAFAAFKTFGS
                   70        80        90       100       110       120

                  130       140       150       160       170       180
a794.pep     NYRWATEFKSNGTVNDGTLDGNLYWAGSGDPVFNQENLLAVQRQLREQGIRNITGHLMLD
             ||||||||||||||||||||||||||||||||||||||| :|:||||||| |||||||||
m794         NYRWATEFKSNGTVNDGTLDGNLYWAGSGDPVFNQENLLDAQKQLREQGILNITGHLMLD
                  130       140       150       160       170       180

                  190       200       210       220       230       240
a794.pep     HSLWGEVGSPDDFEADSGSPFMTPPNPTMLSAGMVMVRAERNAADSTDILTDPPLPHIFA
             |||||||||||||||||||||||||||||||||||||||||||| |||||||||||||||
m794         HSLWGEVGSPDDFEADSGSPFMTPPNPTMLSAGMVMVRAERNAAGSTDILTDPPLPHIFA
                  190       200       210       220       230       240

                  250       260       270       280       290       300
a794.pep     QNNLKITASQAACPSIKKLMRASFSDNTLKLRGNIPESCLGKPVGVRMFALDELIRQSFT
             ||||||||||||||||||||||||||||||||||||||||||||||||||||||||||||
m794         QNNLKITASQAACPSIKKLMRASFSDNTLKLRGNIPESCLGKPVGVRMFALDELIRQSFT
                  250       260       270       280       290       300

                  310       320       330       340       350       360
a794.pep     NHWLLGGGRISDGIGISDTPEGAQTLAVAHSKPMKEILTDMNKRSDNLIARSVFLKLGGD
             ||||||||||||||||:|||||||||||||:|||||||||||||||||||||||||||||
m794         NHWLLGGGRISDGIGIADTPEGAQTLAVAHAKPMKEILTDMNKRSDNLIARSVFLKLGGD
                  310       320       330       340       350       360

                  370       380       390       400       410       420
a794.pep     GKLPAVSEQAASAVRRELAVSGIDVADLVLENGSGLSRKERVTARMMAQMLETAYFSPFA
             ||||||||||||||||||||||||||||||||||||||||||||||||||||||||||||
m794         GKLPAVSEQAASAVRRELAVSGIDVADLVLENGSGLSRKERVTARMMAQMLETAYFSPFA
                  370       380       390       400       410       420

                  430       440       450       460       470       480
a794.pep     QDFIDTLPIAGTDGTLRNRFKQSGGLLRLKTGTLNNVRALAGYWLGDKPMAVVVIINSGR
             ||||||||||||||||||||||||||||||||||||||||||||||||||||||||||||
m794         QDFIDTLPIAGTDGTLRNRFKQSGGLLRLKTGTLNNVRALAGYWLGDKPMAVVVIINSGR
                  430       440       450       460       470       480

                  490       500       510
a794.pep     AVSLLPDLDNFVANNIISGGDGWLDAKLMCKERRAX
             ||||||||||||||||||||||||||||||||||||
m794         AVSLLPDLDNFVANNIISGGDGWLDAKLMCKERRAX
                  490       500       510
```

The following partial DNA sequence was identified in *N. gonorrhoeae* <SEQ ID 2699>:

g900.seq

```
  1 ATGccgTCTG AAATGCCGTC TGAAACGTGG CAGGCGGAGG TTCGGACGGC
 51 ATTGGGTTTA TTTCAACGGG CGGATGCCGA CCGCATCGCG TACTTTATCC
101 AACAATTCGC GCGCTTCTTT GCGCGCTTTT TGCGCGcctg cctGCAAAAT
151 CTCTTCGATT TGCGAAGGAT TAGAGGTCAA TGCGTTGTAG CGTTCGCGCA
201 GTTCTGCCAA TTCGGCGTTG ATTTTCGCCG CCGAAAGTTT TTTCGCCTCG
251 CCCCAAGCCA AGCCGTCGGC AAGCATTTGC GTAAATTCCG CCGTTTCAGA
301 CGGCGTGGAG AAGGCTTTAT AGATTTCAAA CAAAGGGCTT TCGTCGGGCT
351 GTTTCGGCTC GCCCGGCTCT TTCATGTTGG TAATGATTTT GTTGACCGAT
401 TTTTGGGTTT TTTTGTCGTT TTCCCAAAGC GGAATGGTAT TGCCGTAGGA
451 TTTGGACATT TTGCGTCCGT CCAAACCGAC CAAGAGTTCG ACGTTTTCGT
501 CGATTTTCAC TTCGGGCagg GTGaagagtt cTTGGAaacc gtgggtgaag
551 cggccggcAa tgtcgcgcgc cATTTcgacg tgttgGATTT GGTCGCGCCC
601 GACGGGGACT TCGTTGGCGT TGAACATCAA AATGTCGGCA GTCATCAGAA
651 TCGGATAACT GAACAAACCC ATTTCCACAC CGAAATCGGG GTCTTCCTGC
701 CCGTTTTCCG CATTGGCTTG AACGGCGGCT TTGTAGGCGT GGGCGCGGTT
751 CATCAAACCC TTGGCGGTGA TGCAGGTCAG AATCCAGTTC AACTCCATCA
```

-continued

```
 801 CTTCGGGAAT GTCGCTTTGG CGGTAGAAGG TGGTGCGCTC GGGGTCGAGT
 851 CCGCAGGCAA GCCAAGTGGC GGCAACGGCt tgGGTGGATT GGTGAATCAT
 901 CTCCTGCTCG TGGCATTTGA TGATGCCGTG GTAATCGGCG AGGAAGAGGA
 951 AGGATTCGGT ATCGGGGTTT TGCGCCGCGC GGACGGCGGG GCGGATGGCG
1001 CCGACGTAGT TGCCCAGATG CGGGGTGCCG GTGGTGGTTA CGCCGGTCAG
1051 AACTCGTTTT TTGCTCATAA AAATGTCCTT ACGGCAGCAA TGCCGTCTGA
1101 AAGGGAAAa. gatgcgCCGA TTATACCCGA TTTGCCACAT ACATCCAGCC
1151 GacaACagaC TTTTCCATAT TAA
```

This corresponds to the amino acid sequence <SEQ ID 2700; ORF 900.ng:

g900.pep

```
  1 MPSEMPSETW QAEVRTALGL FQRADADRIA YFIQQFARFF ARFLRACLQN
 51 LFDLRRIRGQ CVVAFAQFCQ FGVDFRRRKF FRLAPSQAVG KNLRKFRRFR
101 RRGEGFIDFK QRAFVGLFRL ARLFHVGNDF VDRFLGFFVV FPKRNGIAVG
151 FGHFASVQTD QEFDVFVDFH FGQGEEFLET VGEAAGNVAR HFDVLDLVAP
201 DGDFVGVEHQ NVGSHQNRIT EQTHFHTEIG VFLPVFRIGL NGGFVGVGAV
251 HQTLGGDAGQ NPVQLHHFGN VALAVEGGAL GVESAGKPSG GNGLGGLVNH
301 LLLVAFDDAVVIGEEEEGFG IGVLRRADGG ADGADVVAQM RGAGGGYAGQ
351 NSFFAHKNVL TAAMPSEREK DAPIIPDLPH TSSRQQTFPY *
```

The following partial DNA sequence was identified in *N. meningitidis* <SEQ ID 2701>:

m900.seq

```
  1 ATGCCGTCTG AAACGCGGCA GGCGGAGGTT CGGACGGCAT CGGGTTCATT
 51 TCAACGGGCG GATGcCGACC GCATCgG.TA CTTTGTCCAA TAATTCGCGT
101 GCTTCTTTAC GCGCTTTCGC CGCGCCTGCC TGCAAAATCT CTTCGATTTG
151 CGAAGGGTCG GCGGTCAGCT CGTTGTAGCG TTCGCGCGGT TCGGCGAGTT
201 CGGCGTTGAT TTTCGCCGCC AAAAGTTTTT TGGCTTCACC CCACGCCAAG
251 CCGTCGGCAA GCATTTTCGT AAATTCCACC GTTTCAGACG GCGTGGAGAA
301 GGCTTTGTAG ATTTCAAACA ATGGGCTTTC GTCGGGCTGT TTCGGCTCGC
351 CCGGCTCTTT CATATTGGTG ATGATTTTGT TGACCGATTT TTGGGTTTTT
401 tTGTCGTTTT CCCAAAGCGG AATGGTGTTG CCGTAGGATT TGGACATTTT
451 GCGTCCGTCC AAACCGACCA AGAGTTCGAC GTTTTCATCG ATTTTCACTT
501 CGGGCAGGGT GAAGAGTTCC CGGAAGCGGT GGTTGAAGCG GCCGGCGATG
551 TCGCGCGCCA TTTCGACGTG TTGGATTTGG TCGCGCCCGA CgGGCaCTTC
601 GTTGGCGTTG AACATCAGAA TATCGGCAGT CATCAGAATC GGATAACTGA
651 ACAAACCCAT TTCCACACCG AAATCAGGGT CTTCCTGCCC GTTTTCTGCA
701 TTTGCCTGCA CGGCGGCTTT GTAGGCATGG GCGCGGTTCA TCAAACCCTT
```

-continued

```
 751 GGCAGTGATG CAGGTCAGAA TCCAGTTCAA TTCCATCACT TCgGGAGTGT

 801 CGCTTTGGCG GTAGAAGGTG GTGCGCTCGG GGTCGAGTCC GCAgGCAAGC

 851 CAAGTGGCGG CAACGGCTTG GGTGGATTGG TGAATCATCT CCGGCTCGTG

 901 GCATTTGATG ATACCGTGGT AATCGGCGAG GAAGAGGAAG GATTCGGTAT

 951 CGAGGTTTTG CGCCGCGCGG ACGGCGGGGC GGATGGCGCC GACGTAGTTG

1001 CCCAGATGCG GGATGCCGGT GGTGGTTACG CCGGTCAGAA CTCGTTTTTT

1051 GCTCATAAAA ATGTCCTTGC GGCATCAATG CCGTCTGAAA GGGAAAAAGA

1101 TGTGCCGATT ATACCCGATT TGCCACCTAC ATCCAGCCGA CAACAGACTT

1151 TTCCATATTA A
```

This corresponds to the amino acid sequence <SEQ ID 2702; ORF 900>:

m900.pep

```
  1 MPSETRQAEV RTASGSFQRA DADRIXYFVQ *FACFFTRFR RACLQNLFDL

 51 RRVGGQLVVA FARFGEFGVD FRRQKFFGFT PRQAVGKHFR KFHRFRRRGE

101 GFVDFKQWAF VGLFRLARLF HIGDDFVDRF LGFFVVFPKR NGVAVGFGHF

151 ASVQTDQEFD VFIDFHFGQG EEFPEAVVEA AGDVARHFDV LDLVAPDGHF

201 VGVEHQNIGS HQNRITEQTH FHTEIRVFLP VFCICLHGGF VGMGAVHQTL

251 GSDAGONPVQ FHHFGSVALA VEGGALGVES AGKPSGGNGL GGLVNHLRLV

301 AFDDTVVIGE EEEGFGIEVL RRADGGADGA DVVAQMRDAG GGYAGQNSFF

351 AHKNVLAASM PSEREKDVPI IPDLPPTSSR QQTFPY*
```

Computer analysis of this amino acid sequence gave the following results:

Homology with a predicted ORF from *N. gonorrhoeae*

ORF 900 shows 87.0% identity over a 386 aa overlap with a predicted ORF (ORF 900.ng) from *N. gonorrhoeae*:

m900/g900

```
                            10        20        30        40        50        60
m900.pep            MPSETRQAEVRTASGSFQRADADRIGYFVQXFACFFTRFRRACLQNLFDLRRVGGQ
                    ||||| ||||||| | |||||||||:||:| || ||:|| ||||||||||||: ||
g900            MPSEMPSETWQAEVRTALGLFQRADADRIAYFIQQFARFFARFLRACLQNLFDLRRIRGQ
                        10        20        30        40        50        60

                  60        70        80        90       100       110
m900.pep        LVVAFARFGEFGVDFRRQKFFGFTPRQAVGKHFRKFHRFRRRGEGFVDFKQWAFVGLFRL
                 |||||:| :|||||||:||| ::| ||||||:|||:|||||||||:|||| ||||||||
g900            CVVAFAQFCQFGVDFRRRKFFRLAPSQAVGKHLRKFRRFRRRGEGFIDFKQRAFVGLFRL
                        70        80        90       100       110       120

                 120       130       140       150       160       170
m900.pep        ARLFHIGDDFVDRFLGFFVVFPKRNGVAVGFGHFASVQTDQEFDVFIDFHFGQGEEEPEA
                |||||:|:||||||||||||||||||:|||||||||||||||||||:|||||||||  |:
g900            ARLFHVGNDFVDRFLGFFVVFPKRNGIAVGFGHFASVQTDQEFDVFVDFHFGQGEEFLET
                       130       140       150       160       170       180

                 180       190       200       210       220       230
m900.pep        VVEAAGDVARHFDVLDLVAPDGHFVGVEHQNIGSHQNRITEQTHFHTEIRVFLPVFCICL
                | ||||:||||||||||||||| ||||||||:||||||||||||||||| |||||| | |
g900            VGEAAGNVARHFDVLDLVAPDGDFVGVEHQNVGSHQNRITEQTHFHTEIGVFLPVFRIGL
                       190       200       210       220       230       240

                 240       250       260       270       280       290
m900.pep        HGGFVGMGAVGQTLGSDAGQNPVQFHHFGSVALAVEGGALGVESAGKPSGGNGLGGLVNH
                :|||||:||||||||:||||||||:||||:||||||||||||||||||||||||||||||
g900            NGGFVGVGAVHQTLGGDAGQNPVQLHHFGNVALAVEGGALGVESAGKPSGGNGLGGLVNH
                       250       260       270       280       290       290
```

-continued

```
               300        310        320        330        340        350
m900.pep      LRLVAFDDTVVIGEEEEGFGIEVLRRADGGADGADVVAQMRDAGGGYAGQNSFFAHKNVL
              | ||||||:||||||||||| |||||||||||||||||| ||||||||||||||||||
g900          LLLVAFDDAVVIGEEEEGFGIGVLRRADGGADGADVVAQMRGAGGGYAGQNSFFAHKNVL
                     310        320        330        340        350        360

               360        370        380
m900.pep      AASMPSEREKDVPIIPDLPPTSSRQQTFPYX
              :|:||||||||:||||||| |||||||||||
g900          TAAMPSEREKDAPIIPDLPHTSSRQQTFPYX
                     370        380        390
```

The following partial DNA sequence was identified in *N. meningitidis* <SEQ ID 2703>:

a900.seq (partial)

```
   1 GAGGTTCGGA CGGCATTGGG TTTATTTCAA CGCGCGGATA CCGACCGCAT
  51 CACGTACTTT GCCCAATAAT TCGCGTGCTT CTTTACGCGC TTTTTGCGCG
 101 CCTGCCTGCA AAATCTCTTC GATTTGCGAA GGGTCGGCGG TCAGCTCGTT
 151 GTAGCGTTCG CGCGGTTCGG CGAGTTCGGC GTTGATTTTC GCCGCCAAAA
 201 GTTTTTTTGC CTCGCCCCAA GCCAAGCCGT CGGCAAGCAT TTTCGTAAAT
 251 TCTGCCGTTT CAGACGGCGT GGAGAAAGCT TTGTAGATTT CAAACAGAGG
 301 GCTTTCGTCG GGCTTCTTCG GCTCGCCCGG CTCTTTCATA TTGGTGATGA
 351 TTTTGTTGAC CGATTTTTGG GTTTTTTTGT CGTTTTCCCA AAGCGGAATG
 401 GTGTTGCCGT AGGATTTGGA CATTTTGCGT CCGTCCAAAC CAACCAAGAG
 451 TTCGACGTTT TCGTCGATTT TCACTTCGGG CAGTGTGAAG AGTTCCCGGA
 501 AGCGGTGGTT GAAGCGGCCG GCAATATCGC GTGCCATTTC AACGTGTTGG
 551 ATTTGGTCGC GACCGACTGG AACTTCATGC GCATTGAACA TGAGAATGTC
 601 GGCAGTCATG AGGATAGGGT AGCTGTACAA ACCCATTTCC ACGCCGAAAT
 651 CGGGGTCTTC CTCCCCGTTT TCCGCATTTG CCTGCACGGC GGCTTTGTAG
 701 GCGTGGGCGC GGTTCATCAA ACCCTTGGCG GTGATGCAGG TCAGAATCCA
 751 GTTCAATTCC ATCACTTCGG GAATGTCGCT TTGACGGTAG AAGGTGGTGC
 801 CCTCGGGGTC GAGTCCGCAG GCAAGCCAAG TGGCGGCAAC GGCTTGGGTG
 851 GATTGGTGAA TCATCTCCGG CTCGTGGCAT TTGATGATAC CGTGGTAATC
 901 GGCGAGGAAG AGGAAGGATT CGGTATCAGG GTTTTGCGCC GCGCGGACGG
 951 CGGGGCGGAT AGCACCGACG TAGTTGCCCA GATGCGGGAT GCCGGTGGTG
1001 GTTACGCCGG TCAGAACTCG TTTTTTGCTC ATAAAAATGT CCTTGCGGCA
1051 TCAATGCCGT CTGAAAGGGA AAAAGATGCG CCGATTATAC CCGATTTGCC
1101 ACCTACATCC AGCCGACAAC AGACTTTTCC ATATTAA
```

This corresponds to the amino acid sequence <SEQ ID 2704; ORF 900.a>:

a900.pep (partial)

```
  1 EVRTALGLFQ RADTDRITYF AQ*FACFFTR FLRACLQNLF DLRRVGGQLV
 51 VAFARFGEFG VDFRRQKFFC LAPSQAVGKH FRKFCRFRRR GESFVDFKQR
101 AFVGLLRLAR LFHIGDDFVD RFLGFFVVFP KRNGVAVGFG HFASVQTNQE
```

-continued

151 FDVFVDFHFG QCEEFPEAVV EAAGNIACHF NVLDLVATDW NFMGIEHENV

201 GSHEDRVAVQ THFHAEIGVF LPVFRICLHG GFVGVGAVHQ TLGGDAGQNP

251 VQFHHFGNVA LTVEGGALGV ESAGKPSGGN GLGGLVNHLR LVAFDDTVVI

301 GEEEEGFGIR VLRRADGGAD STDVVAQMRD AGGGYAGQNS FFAHKNVLAA

351 SMPSEREKDA PIIPDLPPTS SRQQTFPY* m900/a900 88.4% identity in 378 aa overlap

```
                       10        20        30        40        50        60
m900.pep       MPSETRQAEVRTASGSFQRADADRIXYFVQXFACFFTRFRRACLQNLFDLRRVGGQLVVA
                       ||||| | |||||:|||:||:|||||||||| |||||||||||||||||||
a900                   EVRTALGLFQRADTDRITYFAQXFACFFTRFLRACLQNLFDLRRVGGQLVVA
                               10        20        30        40        50

                       70        80        90       100       110       120
m900.pep       FARFGEFGVDFRRQKFFGFTPRQAVGKHFRKFHRFRRRGEGFVDFKQWAFVGLFRLARLF
               ||||||||||||||||| ::| |||||||||| |||||||:|||||| |||||:||||||
a900           FARFGEFGVDFRRQKFFCLAPSQAVGKHFRKFCRFRRRGESFVDFKQRAFVGLLRLARLF
                     60        70        80        90       100       110

                      130       140       150       160       170       180
m900.pep       HIGDDFVDRFLGFFVVFPKRNGVAVGFGHFASVQTDQEFDVFIDFHFGQGEEFPEAVVEA
               |||||||||||||||||||||||||||||||||||:||||||:|||||| ||||||||||
a900           HIGDDFVDRFLGFFVVFPKRNGVAVGFGHFASVQTNQEFDVFVDFHFGQCEEFPEAVVEA
                    120       130       140       150       160       170

                      190       200       210       220       230       240
m900.pep       AGDVARHFDVLDLVAPDGHFVGVEHQNIGSHQNRITEQTHFHTEIRVFLPVFCICLHGGF
               ||::| ||:|||||| | :|:|:||:|:|||::|:: |||||;|| |||||| |||||||
a900           AGNIACHFNVLDLVATDWNFMGIEHENVGSHEDRVAVQTHFHAEIGVFLPVFRICLHGGF
                    180       190       200       210       220       230

                      250       260       270       280       290       300
m900.pep       VGMGAVHQTLGSDAGQNPVQFHHFGSVALAVEGGALGVESAGKPSGGNGLGGLVNHLRLV
               ||:||||||||:|||||||||||||:|||:||||||||||||||||||||||||||||||
a900           VGVGAVHQTLGGDAGQNPVQFHHFGNVALTVEGGALGVESAGKPSGGNGLGGLVNHLRLV
                    240       250       260       270       280       290

                      310       320       330       340       350       360
m900.pep       AFDDTVVIGEEEEGFGIEVLRRADGGADGADVVAQMRDAGGGYAGQNSFFAHKNVLAASM
               |||||||||||||||||:||||||||||::||||||||||||||||||||||||||||||
a900           AFDDTVVIGEEEEGFGIRVLRRADGGADSTDVVAQMRDAGGGYAGQNSFFAHKNVLAASM
                    300       310       320       330       340       350

                      370       380
m900.pep       PSEREKDVPIIPDLPPTSSRQQTFPYX
               |||||||:|||||||||||||||||||
a900           PSEREKDAPIIPDLPPTSSRQQTFPYX
                    360       370
```

g901.seq not found yet g901.pep not found yet

The following partial DNA sequence was identified in *N. meningitidis* <SEQ ID 2705>:

m901.seq

1 ATGCCCGATT TTTCGATGTC CAATTTGGCC GTTGCCTTTT CCATCACATT

51 GGCTGCCGGT TTGTTTACCG TATTAkGyAG TGGCTTGGTG ATGTTTTCCA

101 AAACGCCCAA TCCGCGTGTG TTGTCGTTTG GTTTGGCGTT TGCCGGCGGT

151 GCGATGGTAT ATGTTTCCCT GACGGAGATT TTCAGTAAGT CCAGCGAGGC

201 GTTCGCTGAA ATTTATGATA AAGACCACGC GTTTGCGGCG GCGACCATGG

251 CATTTTTGGC CGGGATGGGC GGCATTGCGC TGATTGACCG TCTGGTGCCG

301 AACCCGCATG AAACTTTAGA CGCGCAAGAC CCGTCGTTTC AAGAAAGCAA

351 ACGCCGCCAT ATCGCGCGAG TCGGCATGAT GGCGGCGTTT GCGATTACTG

-continued

```
401 CGCACAATTT CCCCGAAGGC TTGGCGACGT TTTTTGCCAC ATTGGAAAAT
451 CCAGCAGTCG GGATGCCTTT GGCCTTGGCG ATTGCCATCC ATAATATTCC
501 GGAGGGCATT TCCATCGCCG CGCCGGTTTA TTTTGCCACC CGCAGCCGTA
551 AGAAAACGGT GTGGGCGTGT CTGCTATCCG GCTTGGCCGA GCCGTTGGGG
601 GCGGCTTTGG GCTATTTGGT TTTGCAGCCG TTTTTGTCGC CTGCCGTGTT
651 TGGTTCGGTA TTCGGCGTGA TAGCCGGTGT GATGGTGTTT TTGGCGTTGG
701 ACGAGCTGnt GCCGGCTGCC AAACGCTATT CAGACGGCCA TGAAACCGTT
751 TACGGCCTGA CAACGGGTAT GGCGGTGATT GCCGTCAGCC TGGTATTGTT
801 CCATTTTTAA
```

This corresponds to the amino acid sequence <SEQ ID 2706; ORF 901>:

m901.pep

```
  1 MPDFSMSNLA VAFSITLAAG LFTVLXSGLV MFSKTPNPRV LSFGLAFAGG
 51 AMVYVSLTEI FSKSSEAFAE IYDKDHAFAA ATMAFLAGMG GIALIDRLVP
101 NPHETLDAQD PSFQESKRRH IARVGMMAAF AITAHNFPEG LATFFATLEN
151 PAVGMPLALA IAIHNIPEGI SIAAPVYFAT RSRKKTVWAC LLSGLAEPLG
201 AALGYLVLQP FLSPAVFGSV FGVIAGVMVF LALDELXPAA KRYSDGHETV
251 YGLTTGMAVI AVSLVLFHF*
```

The following partial DNA sequence was identified in *N. meningitidis* <SEQ ID 2707>:

a901.seq

```
  1 ATGCCCGATT TTTCGATGTC CAATTTGGCC GTTGCCTTTT CCATTACGTT
 51 GGCTGCCGGT TTGTTTACCG TATTAGGCAG CGGCTTGGTG ATGTTTTCCA
101 AAACGCCCAA TCCGCGCGTG TTGTCGTTTG GTTTGGCATT TGCCGGCGGT
151 GCGATGGTGT ATGTTTCCCT GACGGAGATT TTCAGTAAGT CCAGCGAGGC
201 GTTCGCTGAA ATTTATGATA AAGACCACGC GTTTGCGGCG GCGACGATGG
251 CATTTTTGGC AGGGATGGGC GGCATTGCGC TGATTGACCG TCTGGTGCCG
301 AACCCGCATG AAACTTTAGA CGCGCAAGAC CCGTCGTTTC AAGAAAGCAA
351 ACGCCGCCAT ATCGCGCGAG TCGGCATGAT GGCGGCGTTT GCGATTACTG
401 CGCACAATTT CCCCGAAGGC TTGGCGACGT TTTTTGCCAC ATTGGAAAAT
451 CCAGCAGTCG GGATGCCTTT GGCCTTGGCG ATTGCCATCC ATAATATTCC
501 GGAGGGCATT TCCATCGCCG CGCCGGTTTA TTTTGCCACC CGCAGCCGTA
551 AGAAAACGGT GTGGGCGTGT CTGCTATCCG GCTTGGCCGA GCCGTTGGGG
601 GCGGCTTTGG GCTATTTGGT TTTGCAGCCG TTTTTGTCGC CTGCCGTGTT
651 TGGTTCGGTA TTCGGCGTGA TAGCCGGTGT GATGGTGTTT TTGGCGTTGG
701 ACGAGCTGCT GCCGGCTGCC AAACGCTATT CAGACGGCCA TGAAACCGTT
751 TACGGCCTGA CAATGGGCAT GGCGGTGATT GCCGTCAGCC TGGTATTGTT
801 CCATTTTTAA
```

This corresponds to the amino acid sequence <SEQ ID 2708; ORF 901.a>:

a901.pep

```
  1 MPDFSMSNLA VAFSITLAAG LFTVLGSGLV MFSKTPNPRV LSFGLAFAGG
 51 AMVYVSLTEI FSKSSEAFAE IYDKDHAFAA ATMAFLAGMG GIALIDRLVP
101 NPHETLDAQD PSFQESKRRH IARVGMMAAF AITAHNFPEG LATFFATLEN
151 PAVGMPLALA IAIHNIPEGI SIAAPVYFAT RSRKKTVWAC LLSGLAEPLG
201 AALGYLVLQP FLSPAVFGSV FGVIAGVMVF LALDELLPAA KRYSDGHETV
251 YGLTMGMAVI AVSLVLFHF*
```

m901/a901 98.9% identity in 269 aa overlap

```
                   10        20        30        40        50        60
m901.pep    MPDFSMSNLAVAFSITLAAGLFTVLXSGLVMFSKTPNPRVLSFGLAFAGGAMVYVSLTEI
            |||||||||||||||||||||||| |||||||||||||||||||||||||||||||||||
a901        MPDFSMSNLAVAFSITLAAGLFTVLGSGLVMFSKTPNPRVLSFGLAFAGGAMVYVSLTEI
                   10        20        30        40        50        60
                   70        80        90       100       110       120
m901.pep    FSKSSEAFAEIYDKDHAFAAATMAFLAGMGGIALIDRLVPNPHETLDAQDPDFQESKRRH
            ||||||||||||||||||||||||||||||||||||||||||||||||||||||||||||
a901        FSKSSEAFAEIYDKDHAFAAATMAFLAGMGGIALIDRLVPNPHETLDAQDPDFQESKRRH
                   70        80        90       100       110       120
                  130       140       150       160       170       180
m901.pep    IARVGMMAAFAITAHNFPEGLATFFATLENPAVGMPLALAIAIHNIPEGISIAAPVYFAT
            ||||||||||||||||||||||||||||||||||||||||||||||||||||||||||||
a901        IARVGMMAAFAITAHNFPEGLATFFATLENPAVGMPLALAIAIHNIPEGISIAAPVYFAT
                  130       140       150       160       170       180
                  190       200       210       220       230       240
m901.pep    RSRKKTVWACLLSGLAEPLGAALGYLVLQPFLSPAVFGSVFGVIAGVMVFLALDELXPAA
            |||||||||||||||||||||||||||||||||||||||||||||||||||||||| |||
a901        RSRKKTVWACLLSGLAEPLGAALGYLVLQPFLSPAVFGSVFGVIAGVMVFLALDELXPAA
                  190       200       210       220       230       240
                  250       260       270
m901.pep    KRYSDGHETVYGLTTGMAVIAVSLVLFHFX
            |||||||||||||| |||||||||||||||
a901        KRYSDGHETVYGLTMGMAVIAVSLVLFHFX
                  250       260       270
```

The following partial DNA sequence was identified in *N. gonorrhoeae* <SEQ ID 2709>:

g902.seq

```
  1 ATGCCGTCCG AACCCGAACG GCGGCATGGC AATACTGCCC TACCCTTCCC
 51 GATAGCCGCA CGCCCAACGG TCGGTTTTTC CGGCAAGCCT TTCAAGATAA
101 CCGGCAAGTG TGTCGTATTG CGCCGCCGCA TTGTCCAAGC GGTTGATTTC
151 ACGCCGCGCC TGTTCGCCGT CGGGCATTTC GCCGATGTAC CAGCCTATGT
201 GTTTGCGTGC GATGCGCACA CCGACGGTCT CACCATAAAA CGCGTGCATG
251 GCGCGGATGT GGTTCAAAAT GGCGGCTCTG CATTCTGCCA AACTCAAGGC
301 AGGCGGTAAA ACGCCGTGTT CGGCATAATG CTTCAAATCG CGGAAAAACC
351 ACGGCCTGCC TTGCGCGCCG CGCCCTATCA TGATGCCGTC GGCGGCGGTT
401 TGTTTGAGGA cggCGGCGGC TTTTTgcggc GAagtGATGT CGCCGTTGac
451 cCaggCCGGG ATGTTCAGAc ggCTTTTGGT CTCGGcgatg agttCGTAAC
501 gcGCCTCGCC TTTGTACATT TGCGTGcgcG CGCgcccgtg aacggcaaGg
551 gcggcaatgc cgcaatcttc ggcgattttg gcgacggcgG gcaggttttg
```

-continued

```
 601 atcgtcgtcg tgccaaccca AacggGTTTT GaggGTAACG GGTACgcCCG
 651 CCGCCTTgaC caccgcctcc aAAatggcGg caaccagcgg CTCGTCCTGC
 701 ATCagcGCGC TACCGGCTTG GACGTTGCAC ACTTTCttgg cgggGCAGCC
 751 CATAttgATG TCGATGACCT GCGCCCCGAG TCCGACGTTg taacgcgccg
 801 catCCGCCAT CtgttcggGG TCGCTGCCGG CAATCTGCAC GGCAACGATG
 851 CCGccttcat cggcaAAAtc actgcggtgc aGGGTTTTTC CGGTATTCCT
 901 GAGCGTCGGA TCGCTGGCCA GCATTTCGCA CACCGCCCAA CCTGCGCCAA
 951 ACGCCCGACA GAGGCGGCGG AAGGGTTTGT CGGCAATGCC CGCCATCGGC
1001 GCAAGTGCGA TGGGGTTGTC GATAAAATAA CCGCCGATGT GCATAATGGG
1051 CCCGCGTTTC AAAAAAGTGC GCCATTGTAC ATTTTTTAA
```

This corresponds to the amino acid sequence <SEQ ID 2710; ORF 902.ng>:

g902.pep

```
  1 MPSEPERRHG NTALPFPIAA RPTVGFSGKP FKITGKCVVL RRRIVQAVDF
 51 TPRLFAVGHF ADVPAYVFAC DAHTDGLTIK RVHGADVVQN GGSAFCQTQG
101 RR*NAVFGIM LQIAEKPRPA LRAAPYHDAV GGGLFEDGGG FLRRSDVAVD
151 PGRDVQTAFG LGDEFVTRLA FVHLRARAPV NGKGGNAAIF GDFGDGGQVL
201 IVVVPTQTGF EGNGYARRLD HRLQNGGNQR LVLHQRATGL DVAHFLGGAA
251 HIDVDDLRPE SDVVTRRIRH LFGVAAGNLH GNDAAFIGKI TAVQGFSGIP
301 ERRIAGQHFA HRPTCAKRPT EAAEGFVGNA RHRRKCDGVV DKITADVHNG
351 PAFQKSAPLY IF*
```

The following partial DNA sequence was identified in *N. meningitidis* <SEQ ID 2711>:

m902.seq

```
  1 TTGCACTTTC AAAGGATAAT CAAGTGTTCA GAAGGCATTT GGGCGGTAGG
 51 CGCACGCCCA ACTGTCGGTT TTTTCGGCAA GTCTTTCAAG ATAACCTGCA
101 AGCATGTCGT ATTGCGCCGC CGCACTGTCC AAGCGGTTGA TTTCACGACG
151 TgTCTgTTCG CCGTcGGGCA TTTCGTCGAT GTACCAGCCT ATGTGTTTGC
201 GTGCGATGCG CACACCGGCG GTGTCGCCGT AAAACGCGTG TATGGCGCGG
251 ATGTGGTTCA AAATAGCGGC GGCGCATTCT GCCAAACTCA AGGCAGGCGG
301 CAAAACACCG TGTTCGGCAT AATGTTTCAA ATCGCGGAAG AACCACGGCC
351 TGCCTTGCGC GCCGCGCCCT ATCATAATGC CGTCGGCGGC GGTTTGTTTG
401 AGGACGGCTT GGGCTTTTTG CGGCGAAGTA ATGTCGCCGT TGACCCAGAC
451 CGGGATGTTC AGACGGCATT TGGTTTCGGC GATGAGTTCG TAACGCGCTT
501 CGCCTTTGTA CATTTGCGTA CGCGTGCGTC CGTGGACGGC AAGGGCGGCG
551 ATGCCGCAAT CTTCGGCGAT TTTGGCGATG ACGGGCAGGT TTTGATGGTC
601 GTCGTGCCAA CCCAAACGGG TTTTGAGGGT AACGGGTACG CCTGCCGCAC
```

-continued

```
 651 GGACGACGGC TTCCAAAATG GCGGCAACCA GCGGCTCGTT CTGCATCAGC

 701 GCGCTACCGG CTTGGACATT GCAGACTTTT TTAGCGGGAC AGCCCATGTT

 751 GATGTCGATA AGCTGCGCCC CAAGGCTGAC GTTGTAACGC GCGGCATCCG

 801 CCATCTGCTG CGGATCGCTT CCGGCAATCT GCACGGCAAC AATGCCGCCT

 851 TCATCGGCAA AATCGCTGCG GTGCAAGGTT TTTCTAGTAT TTCTGAGCGT

 901 CGGGTCGCTG GTCAGCATTT CGCACACCGC CCAACCTGCG CCAAAATCTC

 951 GGCAAAGTCG GCGGAACGGT TTGTCGGTAA TGCCCGCCAT CGGcGCaAGT

1001 GCGATGGGGT TGTCGATAAA ATAGCCGCCG ATGTGCATAA TGGATCCGCG

1051 TTTCAAAAAA GTACGCCATT GTACATTTTT TAA
```

This corresponds to the amino acid sequence <SEQ ID 2712; ORF 902>:

m902.pep

```
  1 LHFQRIIKCS EGIWAVGARP TVGFFGKSFK ITCKHVVLRR RTVQAVDFTT

 51 CLFAVGHFVD VPAYVFACDA HTGGVAVKRV YGADVVQNSG GAFCQTQGRR

101 QNTVFGIMFQ IAEEPRPALR AAPYHNAVGG GLFEDGLGFL RRSNVAVDPD

151 RDVQTAFGFG DEFVTRFAFV HLRTRASVDG KGGDAAIFGD FGDDGQVLMV

201 VVPTQTGFEG NGYACRTDDG FQNGGNQRLV LHQRATGLDI ADFFSGTAHV

251 DVDKLRPKAD VVTRGIRHLL RIASGNLHGN NAAFIGKIAA VQGFSSISER

301 RVAGQHFAHR PTCAKISAKS AERFVGNARH RRKCDGVVDK IAADVHNGSA

351 FQKSTPLYIF *
```

Computer analysis of this amino acid sequence gave the following results:

Homology with a predicted ORF from *N. gonorrhoeae*

ORF 902 shows 80.9% identity over a 345 aa overlap with a predicted ORF (ORF 902.ng) from *N. gonorrhoeae*:

m902/g902

```
                   10        20        30        40        50        60
m902.pep      LHFQRIIKCSEGIWAVGARPTVGFFGKSFKITCKHVVLRRRTVQAVDFTTCLFAVGHF
                              ::||||||| || |||| | |||||| ||||||| |||||||
g902          MPSEPERRHGNTALPFPIAARPTVGFSGKPFKITGKCVVLRRRIVQAVDFTPRLFAVGHF
                   10        20        30        40        50        60

             60        70        80        90       100       110
m902.pep      VDVPAYVFACDAHTGGVAVKRVYGADVVQNSGGAFCQTQGRRQNTVFGIMFQIAEEPRPA
              :||||||||||||| |:::|||:|||||||:|:||||||||| |:|||||:||||:||||
g902          ADVPAYVFACDAHTDGLTIKRVHGADVVQNGGSAFCQTQGRRXNAVFGIMLQIAEKPRPA
                   70        80        90       100       110       120

             120       130       140       150       160       170
m902.pep      LRAAPYHNAVGGGLFEDGLGFLRRSNVAVDPDRDVQTAFGFGDEFVTRFAFVHLRTRASV
              |||||||:|||||||||| ||||||:||||| ||||||||:|||||||:||||||:|| |
g902          LRAAPYHDAVGGGLFEDGGGFLRRSDVAVDPGRDVQTAFGLGDEFVTRLAFVHLRARAPV
                  130       140       150       160       170       180

             180       190       200       210       220       230
m902.pep      DGKGGDAAIFGDFGDDGQVLMVVVPTQTGFEGNGYACRTDDGFQNGGNQRLVLHQRATGL
              :||||:|||||||| ||||:||||||||||||||| | |   :||||||||||||||||
g902          NGKGGNAAIFGDFGDGGQVLIVVVPTQTGFEGNGYARRLDHRLQNGGNQRLVLHQRATGL
                  190       200       210       220       230       240

             240       250       260       270       280       290
m902.pep      DIADFFSGTAHVDVDKLRPKADVVTRGIRGLLRIASGNLHGNNAAFIGKIAAVQGFSSIS
              |:| |::|:||:||| |||::||||| ||||:  :|:||||||:|||||||:||||||:|
g902          DVAHFLGGAAGIDVDDLRPESDVVTRRIRHLFGVAAGNLHGNDAAFIGKITAVQGFSGIP
                  250       260       270       280       290       300
```

-continued

```
              300        310        320        330        340        350
m902.pep      ERRVAGQHFAHRPTCAKISAKSAERFVGNARHRRKCDGVVDKIAADVHNGSAFQKSTPLY
              |||:|||||||||||||  :::|| |||||||||||||||||:|||||| |||||:|||
g902          ERRIAGQHFAHRPTCAKRPTEAAEGFVGNARHRRKCDGVVDKITADVHNGPAFQKSAPLY
                    310        320        330        340        350        360

              360
m902.pep      IFX
              |||
g902          IFX
```

The following partial DNA sequence was identified in *N. meningitidis* <SEQ ID 2713>:

a902.seq

```
   1 TTGCACTTTC AAAGGATAAT CAAGTGTTCA GAAGGCATTT GGGCGGTAGG
  51 CGCACGCCCA ACTGTCGGTT TTTTCGGCAA GTCTTTCAAG ATAACCTGCA
 101 AACATGTCGT ATTGCGCCGC CGCACTGTCC AAGCGGTTGA TTTCACGACG
 151 TGTCTGTTCG CCGTCGGGCA TTTCGTCGAT GTACCAGCCT ATGTGTTTGC
 201 GTGCGATGCG CACACCGGCG GTGTCGCCGT AAAACGCGTG CATGGCTCGG
 251 ATGTGGTTCA AAATAGTGGC GGTACATTCT GCCAAACTCA AGGCAGGCGG
 301 TAAAACACCG TGTTCGGCGT AATGTTTCAA ATCGCGGAAG AACCACGGTC
 351 TGCCTTGCGC GCCGCGCCCT ATCATAATGC CGTCTGCGGC GGTTTGTTTG
 401 AGGACGGCTT GGGCTTTTTG CGGCGAGGTA ATGTCGCCGT TGACCCAGAC
 451 CGGGATGTTC AGACGGCATT TGGTTTCGGC AATCAGGTCG TAAGCCGCTT
 501 CGCCTTTGTA CATTTGCGTG CGCGTGCGTC CGTGGACGGC AAGGGCGGCA
 551 ATGCCGCAAT CTTCGGCGAT TTTGGCGATG ACGGGCAGCT TTTGATGGTC
 601 GTCGTGCCAA CCCAAACGGG TTTTGAGGGT AACGGGTACG CCCGCCGCTT
 651 TGACCACCGC CTCCAAAATG GCGGCAACCA GCGGCTCGTT CTGCATCAGC
 701 GCGCTACCGG CTTGGACATT GCAGACTTTT TTAGCGGGAC AGCCCATGTT
 751 GATGTCGATA AGCTGCGCCC CAAGGCTGAC GTTGTAACGC GCGGCATCCG
 801 CCATCTGCTG CGGATCGCTT CCGGCAATCT GCACGGCAAC AATGCCGCCT
 851 TCATCGGCAA AATCGCTGCG GTGCAAGGTT TTTCTAGTAT TTCTGAGCGT
 901 CGGGTCGCTG GTCAGCATTT CGCACACCGC CCAACCTGCG CCAAAATCTC
 951 GGCAAAGTCG GCGGAACGGT TTGTCGGTAA TGCCCGCCAT CGGCGCAAGT
1001 GCGATGGGGT TGTCGATAAA ATAGCCGCCG ATGTGCATAA TGGATCCGCG
1051 TTTCAAAAAA GTACGCCATT GTACATTTTT TAA
```

This corresponds to the amino acid sequence <SEQ ID 2714; ORF 902.a>:

a902.pep

```
   1 LHFQRIIKCS EGIWAVGARP TVGFFGKSFK ITCKHVVLRR RTVQAVDFTT
  51 CLFAVGNFVD VPAYVFACDA HTGGVAVKRV HGSDVVQNSG GTFCQTQGRR
 101 *NTVFGVMFQ IAEEPRSALR AAPYHNAVCG GLFEDGLGFL RRGNVAVDPD
 151 RDVQTAFGFG NQVVSRFAFV HLRARASVDG KGGNAAIFGD FGDDGQVLMV
```

-continued

```
201 VVPTQTGFEG NGYARRFDHR LQNGGNQRLV LHQRATGLDI ADFFSGTAHV

251 DVDKLRPKAD VVTRGIRHLL RIASGNLHGN NAAFIGKIAA VQGFSSISER

301 RVAGQHFAHR PTCAKISAKS AERFVGNARH RRKCDGVVDK IAADVHNGSA

351 FQKSTPLYIF *
```

m902/a902 94.7% identity in 360 aa overlap

```
                    10        20        30        40        50        60
m902.pep    LHFQRIIKCSERIWAVGARPTVGFFGKSFKITCKHVVLRRRTVQAVDFTTCLFAVGHFVD
            ||||||||||||||||||||||||||||||||||||||||||||||||||||||||||||
a902        LHFQRIIKCSERIWAVGARPTVGFFGKSFKITCKHVVLRRRTVQAVDFTTCLFAVGHFVD
                    10        20        30        40        50        60

                    70        80        90       100       110       120
m902.pep    VPAYVFACDAHTGGVAVKRVYGADVVQNSGGAFCQTQGRRQNTVFGIMFQIAEEPRPALR
            ||||||||||||||||||||:|:|||||||||:||||||| |||||:||||||||| |||
a902        VPAYVFACDAHTGGVAVKRVHGSDVVQNSGGTFCQTQGRRXNTVFGVMFQIAEEPRSALR
                    70        80        90       100       110       120

                   130       140       150       160       170       180
m902.pep    AAPYHNAVGGGLFEDGLGFLRRSNVAVDPDRDVQTAFGFGDEFVTRFAFVHLRTRASVDG
            ||||||| |||||||||||||:|||||||||||||||||:: |:|||||||:||||||
a902        AAPYHNAVCGGLFEDGLGFLRRGNVAVDPDRDVQTAFGFGNQVVSRFAFVHLRARASVDG
                   130       140       150       160       170       180

                   190       200       210       220       230       240
m902.pep    KGGDAAIFGDFGDDGQVLMVVVPTQTGFEGNGYACRTDDGFQNGGNQRLVLHQRATGLDI
            |||:||||||||||||||||||||||||||||| | :||||||||||||||||||
a902        KGGNAAIFGDFGDDGQVLMVVVPTQTGFEGNGYARRFDHRLQNGGNQRLVLHQRATGLDI
                   190       200       210       220       230       240

                   250       260       270       280       290       300
m902.pep    ADFFSGTAHVDVDKLRPKADVVTRGIRHLLRIASGNLHGNNAAFIGKIAAVQGFSSISER
            ||||||||||||||||||||||||||||||||||||||||||||||||||||||||||||
a902        ADFFSGTAHVDVDKLRPKADVVTRGIRHLLRIASGNLHGNNAAFIGKIAAVQGFSSISER
                   250       260       270       280       290       300

                   310       320       330       340       350       360
m902.pep    RVAGQHFAHRPTCAKISAKSAERFVGNARHRRKCDGVVDKIAADVHNGSAFQKSTPLYIF
            ||||||||||||||||||||||||||||||||||||||||||||||||||||||||||||
a902        RVAGQHFAHRPTCAKISAKSAERFVGNARHRRKCDGVVDKIAADVHNGSAFQKSTPLYIF
                   310       320       330       340       350       360

m902.pep    X
            |
a902        X
```

The following partial DNA sequence was identified in *N. gonorrhoeae* <SEQ ID 2715>:

g903.seq

```
  1 ATGGCAACAC AGGTAGGCGG TGCAAattcG gatgaggCAA GCCCCTGCTT

 51 TCCTATTTCT GAGGTGGAaT TGGTGGGTGA aGaaacggct aAATTCCGgt

101 tTGCGCTcaa ccaTGCCTTG tgccAAACAC ATTTTGtttc cGgcaagtgt

151 CTGcATGcgg gcgacatTAA TCAAAtcaTG TCCTTAGCAC AAAATGCTTT

201 GATCGGCAGG GGATATACCA CGACCCGTAT CTTGGCTGCG CCACAGGATT

251 TGAATAGTGG caaGCTTCAA TTAAccctga tgccggGCTA TCtgcgctcC

301 ATAcgaATCG atcggtccaa cgatgatcaa ACCCATgcAG GACGTATTGC

351 AGCATTCCAA AACAAATTTC CCACCCGCTC GAACGATCTG TTGAATCTGC

401 GTGATTTGGA ACAAGGACTG GAAAATCTCA AATGTCTCCC GACTGCGGAA

451 GCCGATCTCC AAATCgttcc cgtaGAGAGA GAACcAAACC AAAGTGATGT

501 CGTGGTGCAA TGGCGGTAAC GTCTGCTGCC CTACTGTGTG AGTGTGGGGA

551 TGGATAATTC GGGTAGTGAG GCGACAGGAA AATACCAAGG AAATATCACT
```

-continued

```
 601 TTCTCTGCCG ACAATCCTTT TggactgAGT GATATGTTCT ATGTAAATTA
 651 TGGACGTTCA ATTGGCGGTA CGcccgATGA GGAAAATTTT GACGGCCATC
 701 GCAAAGAAGG CGGATCAAAC AATTACGCCG TACATTATTC AGCCCCTTTC
 751 GGTAAATGGA CATGGGCATT CAATCACAAT GGCTACCGTT ACCATCAGGC
 801 GGTTTCCGGA TTATCGGAAG TCTATGACTA TAATGGAAAA AGTTACAACA
 851 CTGATTTCGG CTTCAACCGC CTGTTGTATC GTGATGCCAA ACGCAAAACC
 901 TATCTCAGTG TAAAACTGTG GACGAGGGAA ACAAAAAGTT ACATTGATGA
 951 TGCCGAACTG ACTGTACAAC GGCGTAAAAC CACAGGTTGG TTGGCAGAAC
1001 TTTCCCACAA AGGATATATC GGTCGCAGTA CGGCAGATTT TAAGTTGAAA
1051 TATAAACACG GCACCGGCAT GAAAGATGCT CTGCGCGCGC CTGAAGAAGC
1101 CTTTGGCGAA GGCACGTCAC GTATGAAAAT TTGGACGGCA TCGGCTGATG
1151 TAAATACTCC TTTTCAAATC GGTAAACAGC TATTTGCCTA TGACACATCC
1201 GTTCATGCAC AATGGAACAA AACCCCGCTA ACATCGCAAG ACAAACTGGC
1251 TATCGGCGGA CACCACACCG TACGTGGCTT CGACGGTGAA ATGAGTTTGC
1301 CTGCCGAGCG GGGATGGTAT TGGCGCAACG ATTTGAGCTG GCAATTTAAA
1351 CCAGGCCATC AGCTTTATCT TGGGGCTGAT GTAGGACATG TTTCAGGACA
1401 ATCCGCCAAA TGGTTATCGG GCCAAACTCT AGCCGGCACA GCAATTGGGA
1451 TACGCGGGCA GATAAAGCTT GGCGGCAACC TGCATTACGA TATATTTACC
1501 GGCCGTGCAT TGAAAAAGCC cgaatatttt cAGACGAAGA Aatgggtaac
1551 ggggtTTCAG gtgggttatt cgTTTTGA
```

This corresponds to the amino acid sequence <SEQ ID 2716; ORF 903.ng>:

g903.pep

```
  1 MATQVGGANS DEASPCFPIS EVELVGEETA KFRFALNHAL CQTHFVSGKC
 51 LHAGDINQIM SLAQNALIGR GYTTTRILAA PQDLNSGKLQ LTLMPGYLRS
101 IRIDRSNDDQ THAGRIAAFQ NKFPTRSNDL LNLRDLEQGL ENLKCLPTAE
151 ADLQIVPVER EPNQSDVVVQ WRXRLLPYCV SVGMDNSGSE ATGKYQGNIT
201 FSADNPFGLS DMFYVNYGRS IGGTPDEENF DGHRKEGGSN NYAVHYSAPF
251 GKWTWAFNHN GYRYHQAVSG LSEVYDYNGK SYNTDFGFNR LLYRDAKRKT
301 YLSVKLWTRE TKSYIDDAEL TVQRRKTTGW LAELSHKGYI GRSTADFKLK
351 YKHGTGMKDA LRAPEEAFGE GTSRMKIWTA SADVNTPFQI GKQLFAYDTS
401 VHAQWNKTPL TSQDKLAIGG HHTVRGFDGE MSLPAERGWY WRNDLSWQFK
451 PGHQLYLGAD VGHVSGQSAK WLSGQTLAGT AIGIRGQIKL GGNLHYDIFT
501 GRALKKPEYF QTKKWVTGFQ VGYSF*
```

The following partial DNA sequence was identified in *N. meningitidis* <SEQ ID 2717>:

m903.seq

```
   1 ATGCAGCGTC AGCAGCACAT AGATGCTGAA TTGTTAACTG ATGCAAATGT
  51 CCGTTTCGAG CAACCATTGG AGAAGAACAA TTATGTCCTG AGTGAAGATG
 101 AAACACCGTG TACTCGGGTA AATTACATTA GTTTAGATGA TAAGACGGTG
 151 CGCAAATTTT CTTTTCTTCC TTCTGTGCTC ATGAAAGAAA CAGCTTTTAA
 201 AACTGGGATG TGTTTAGGTT CCAATAATTT GAGCAGGCTA CAAAAAGCCG
 251 CGCAACAGAT ACTGATCGTG CGTGGCTACC TCACTTCCCA AGCTATTATC
 301 CAaCCACAGA ATATGGATTC GGGAATTCTG AAATTACGGG TATCAGCAGG
 351 CGAAATAGGG GATATCCGCT ATGAAGAAAA ACGGGATGGG AAGTCTGCCG
 401 AGGGCAGTAT TAGTGCATTC AATAACAAAT TTCCCTTATA TAGGAACAAA
 451 ATTCTCAATC TTCGCGATGT AGAGCAGGGC TTGGAAAACC TGCGTCGTTT
 501 GCCGAGTGTT AAAACAGATA TTCAGATTAT ACCGTCCGAA GAAGAAGGCA
 551 AAAGCGATTT ACAGATCAAA TGGCAGCAGA ATAAACCCAT ACGGTTCAGT
 601 ATCGGTATAG ATGATGCGGG CGGCAAAACG ACCGGCAAAT ATCAAGGAAA
 651 TGTCGCTTTA TCGTTCGATA ACCCTTTGGG CTTAAGCGAT TTGTTtTATG
 701 TTTCATATGG ACGCGGTTTG GCGCACAAAA CGGACTTGAC TGATGCCACC
 751 GGTACGGAAA CTGAAAGCGG ATCCAGAAGT TACAGCGTGC ATTATTCGGT
 801 GCCCGTAAAA AAATGGCTGT TTTCTTTTAA TCACAATGGA CATCGTTACC
 851 ACGAAGCAAC CGAAGGCTAT TCCGTCAATT ACGATTACAA CGGCAAACAA
 901 TATCAGAGCA GCCTGGCCGC CGAGCGCATG CTTTGGCGTA ACAGACTTCA
 951 TAAAACTTCA GTCGGAATGA AATTATGGAC ACGCCAAACC TATAAATACA
1001 TCGACGATGC CGAAATCGAA GTACAACGCC GCCGCTCTGC AGGCTGGGAA
1051 GCCGAATTGC GCCACCGTGC TTACCTCAAC CGTTGGCAGC TTGACGGCAA
1101 GTTGTCTTAC AAACGCGGGA CCGGCATGCG CCAAAGTATG CCTGCACCGG
1151 AAGAAAACGG CGGCGATATT CTTCCAGGTA CATCTCGTAT GAAAATCATT
1201 ACTGCCAGTT TGGACGCAGC CGCCCCATTT AyTTTAGGCA AACAGCAGTT
1251 TTTCTACGCA ACCGCCATTC AAGCTCAATG GAACAAAACG CCGTTGGTTG
1301 CCCAAGATAA ATTGTCAATC GGCAGCCGCT ACACCGTTCG CGGATTTGAT
1351 GGGGAGCAGA GTCTTTTCGG AGAGCGAGGT TTCTACTGGC AGAATACTTT
1401 AACTTGGTAT TTTCATCCGA ACCATCAGTT CTATCTCGGT GCGGACTATG
1451 GCCGCGTATC TGGCGAAAGT GCACAATATG TATCGGGCAA GCAGCTGATG
1501 GGTGCAGTGG TCGGCTTCAG AGGAGGGCAT AAAGTAGGCG GTATGTTTGC
1551 TTATGATCTG TTTGCCGGCA AGCCGCTTCA TAAACCCAAA GGCTTTCAGA
1601 CGACCAACAC CGTTTACGGC TTCAACTTGA ATTACAGTTT CTAA
```

This corresponds to the amino acid sequence <SEQ ID 2718; ORF 903>:

m903.pep

```
 1 MQRQQHIDAE LLTDANVRFE QPLEKNNYVL SEDETPCTRV NYISLDDKTV
51 RKFSFLPSVL MKETAFKTGM CLGSNNLSRL QKAAQQILIV RGYLTSQAII
```

-continued

```
101 QPQNMDSGIL KLRVSAGEIG DIRYEEKRDG KSAEGSISAF NNKFPLYRNK

151 ILNLRDVEQG LENLRRLPSV KTDIQIIPSE EEGKSDLQIK WQQNKPIRFS

201 IGIDDAGGKT TGKYQGNVAL SFDNPLGLSD LFYVSYGRGL AHKTDLTDAT

251 GTETESGSRS YSVHYSVPVK KWLFSFNHNG HRYHEATEGY SVNYDYNGKQ

301 YQSSLAAERM LWRNRLHKTS VGMKLWTRQT YKYIDDAEIE VQRRRSAGWE

351 AELRHRAYLN RWQLDGKLSY KRGTGMRQSM PAPEENGGDI LPGTSRMKII

401 TASLDAAAPF XLGKQQFFYA TAIQAQWNKT PLVAQDKLSI GSRYTVRGFD

451 GEQSLFGERG FYWQNTLTWY FHPNHQFYLG ADYGRVSGES AQYVSGKQLM

501 GAVVGFRGGH KVGGMFAYDL FAGKPLHKPK GFQTTNTVYG FNLNYSF*
```

Computer analysis of this amino acid sequence gave the following results:

Homology with a predicted ORF from *N. gonorrhoeae*

ORF 903 shows 48.9% identity over a 519 aa overlap with a predicted ORF (ORF 903.ng) from *N. gonorrhoeae*:

```
m903/g903

                     10        20        30        40        50        60
m903.pep     MQRQQHIDAELLTDANVRFEQPLEKNNYVLSEDETPCTRVNYISLDDKTVRKFSFLPSVL
                                           |:: :||  :: : |  : : || |  :
g903                              MATQVGGANSDEASPCFPISEVELVGEETAKFRFALNHA
                                          10        20        30

                     70        80        90       100       110       120
m903.pep     MKETAFKTGMCLGSNNLSRLQKAAQQILIVRGYLTSQAIIQPQNMDSGILKLRVSAGEIG
             : :| | :| || ::::::::: ||: || ||| |:: :  ||:::|| |:| :  | :
g903         LCQTHFVSGKCLHAGDINQIMSLAQNALIGRGYTTTRILAAPQDLNSGKLQLTLMPGYLR
            40        50        60        70        80        90

                    130       140       150       160       170       180
m903.pep     DIRYEEKRDGKSAEGSISAFNNKFPLYRNKILNLRDVEQGLENLRRLPSVKTDIQIIPSE
             :|| ::: | ::  | |:||:||||   | :|||||:||||||| : ||::::|:||:| |
g903         SIRIDRSNDDQTHAGRIAAFQNKFPTRSNDLLNLRDLEQGLENLKCLPTAEADLQIVPVE
           100       110       120       130       140       150

                     190        200       210       220       230
m903.pep     EE-GKSDLQIKWQQNK-PIRFSIGIDDAGGKTTGKYQGNVALSFDNPLGLSDLFYVSYGR
             :| ::||: ::|:    |   |:|:|::|:::|||||||:::| |||:||||:|||:|||
g903         REPNQSDVVVQWRXRLLPYCVSVGMDNSGSEATGKYQGNITFSADNPFGLSDMFYVNYGR
           160       170       180       190       200       210

            240       250       260       270       280       290
m903.pep     GLAGKTDLTDATGTETESGSRSYSVHYSVPVKKWLFSFNHNGHRYHEATEGYSVNYDYNG
             :::   |  :  | : |:|| :|:||||:|  || ::|||||:|||:|: | |  |||||
g903         SIGGTPDEENFDGHRKEGGSNNYAVHYSAPFGKWTWAFNHNGYRYHQAVSGLSEVYDYNG
           220       230       240       250       260       270

           300      310       320       330       340       350
m903.pep     KQYQSSLAAERMLWRNRLHKTSVGMKLWTRQTYKYIDDAEIEVQRRRSAGWEAELRHRAY
             |:|::::: :|:|:|:  :|| :::|||||:| :||||||: ||||:::|| ||| |::|
g903         KSYNTDFGFNRLLYRDAKRKTYLSVKLWTRETKSYIDDAELTVQRRKTTGWLAELSHKGY
           280       290       300       310       320       330

            360       370       380       390       400       410
m903.pep     LNRWQLDGKLSYKRGTGMRQSMPAPEENGGDILPGTSRMKIITASLDAAAPFXLGKQQFF
             ::|   | ||:||:||||:::: ||||  |:   ||||||| ||| |: :|| :||| |
g903         IGRSTADFKLKYKHGTGMKDALRAPEEAFGE---GTSRMKIWTASADVNTPFQIGKQLFA
           340      350        360       370          380       390

            420       430       440       450       460       470
m903.pep     YATAIQAQWNKTPLVAQDKLSIGSRYTVRGFDGEQSLFGERGFYWQNTLTWYFHPNHQFY
             | |:::||||||||::||||:||:::||||||||:|| :|||:||:| |:| |:|:||:|
g903         YDTSVHAQWNKTPLTSQDKLAIGGHHTVRGFDGEMSLPAERGWYWRNDLSWQFKPGHQLY
              400       410       420       430       440       450

            480       490       500       510       520       530
m903.pep     LGADYGRVSGESAQYVSGKQLMGAVVGFRGGHKVGGMFAYDLFAGKPLHKPKGFQTTNTV
             |||| |:|||:||:::||: | |:::|:||  |:|| : ||:|:|: |:||: ||| : |
g903         LGADVGHVSGQSAKWLSGQTLAGTAIGIRGQIKLGGNLHYDIFTGRALKKPEYFQTKKWV
              460       470       480       490       500       510

            540
m903.pep     YGFNLNYSFX
              ||:::||||
g903         TGFQVGYSFX
              520
```

The following partial DNA sequence was identified in *N. meningitidis* <SEQ ID 2719>:

a903.seq

```
   1 ATGCAGCGTC AGCAGCACAT AGATGCTGAA TTGTTAACTG ATGCAAATGT
  51 CCGTTTCGAG CAACCATTGG AGAAGAACAA TTATGTCCTG AGTGAAGATG
 101 AAACACCGTG TACTCGGGTA AATTACATTA GTTTAGATGA TAAGACGGCG
 151 CGCAAATTTT CTTTTCTTCC TTCTGTGCTC ATGAAAGAAA CAGCTTTTAA
 201 AACTGGGATG TGTTTAGGTT CCAATAATTT GAGCAGGCTA CAAAAAGCCG
 251 CGCAACAGAT ACTGATTGTG CGTGGCTACC TCACTTCCCA AGCTATTATC
 301 CAACCACAGA ATATGGATTC GGGAATTCTG AAATTACGGG TATCAGCAGG
 351 CGAAATAGGG GATATCCGCT ATGAAGAAAA ACGGGATGGG AAGTCTGCCG
 401 AGGGCAGTAT TAGTGCATTC AATAACAAAT TTCCCTTATA TAGGAACAAA
 451 ATTCTCAATC TTCGCGATGT AGAGCAGGGC TTGGAAAACC TGCGTCGTTT
 501 GCCGAGTGTT AAAACAGATA TTCAGATTAT ACCGTCCGAA GAAGAAGGCA
 551 AAAGCGATTT ACAGATCAAA TGGCAGCAGA ATAAACCCAT ACGGTTCAGT
 601 ATCGGTATAG ATGATGCGGG CGGCAAAACG ACCGGCAAAT ATCAAGGAAA
 651 TGTCGCTTTA TCGTTCGATA ACCCTTTGGG CTTAAGCGAT TTGTTTTATG
 701 TTTCATATGG ACGCGGTTTG GTGCACAAAA CGGACTTGAC TGATGCCACC
 751 GGTACGGAAA CTGAAAGCGG ATCCAGAAGT TACAGCGTGC ATTATTCGGT
 801 GCCCGTAAAA AAATGGCTGT TTTCTTTTAA TCACAATGGA CATCGTTACC
 851 ACGAAGCAAC CGAAGGCTAT TCCGTCAATT ACGATTACAA CGGCAAACAA
 901 TATCAGAGCA GCCTGGCCGC CGAGCGCATG CTTTGGCGTA ACAGGTTTCA
 951 TAAAACTTCA GTCGGAATGA AATTATGGAC ACGCCAAACC TATAAATACA
1001 TCGACGATGC CGAAATCGAA GTGCAACGCC GCCGCTCTGC AGGCTGGGAA
1051 GCCGAATTGC GCCACCGTGC TTACCTCAAC CGTTGGCAGC TTGACGGCAA
1101 GTTGTCTTAC AAACGCGGGA CCGGCATGCG CCAAAGTATG CCCGCACCTG
1151 AAGAAAACGG CGGCGGTACT ATTCCAGGCA CATCCCGTAT GAAAATCATA
1201 ACCGCCGGAT TGGATGCAGC GGCCCCGTTT ATGTTGGGCA AACAGCAGTT
1251 TTTCTACGCA ACCGCCATTC AAGCTCAATG GAACAAAACG CCTTTGGTTG
1301 CCCAAGACAA GTTGTCTATC GGCAGCCGCT ACACCGTTNG CGGATTTGAT
1351 GGGGAGCAGA GTCTTTTCGG AGAGCGAGGT TTCTACTGGC AGAATACTTT
1401 AACTTGGTAT TTTCATCCGA ACCATCAGTT CTATCTCGGT GCGGACTATG
1451 GCCGCGTATC TGGCGAAAGT GCACAATATG TATCGGGCAA GCAGCTGATG
1501 GGTGCAGTGG TCGGNTTCAG AGGAGGNCAT AAAGTAGGCG GTATGTTTGC
1551 TTATGATCTG TTTGCCGGCA AGCCGCTTCA TAAACCCAAA GGCTTTCAGA
1601 CGACCAACAC CGTTTACGGC TTCAACTTGA ATTACAGTTT CTAA
```

This corresponds to the amino acid sequence <SEQ ID 2720; ORF 903.a>:

a903.pep

```
  1 MQRQQHIDAE LLTDANVRFE QPLEKNNYVL SEDETPCTRV NYISLDDKTA

 51 RKFSFLPSVL MKETAFKTGM CLGSNNLSRL QKAAQQILIV RGYLTSQAII

101 QPQNMDSGIL KLRVSAGEIG DIRYEEKRDG KSAEGSISAF NNKFPLYRNK

151 ILNLRDVEQG LENLRRLPSV KTDIQIIPSE EEGKSDLQIK WQQNKPIRFS

201 IGIDDAGGKT TGKYQGNVAL SFDNPLGLSD LFYVSYGRGL VHKTDLTDAT

251 GTETESGSRS YSVHYSVPVK KWLFSFNHNG HRYHEATEGY SVNYDYNGKQ

301 YQSSLAAERM LWRNRFHKTS VGMKLWTRQT YKYIDDAEIE VQRRRSAGWE

351 AELRHRAYLN RWQLDGKLSY KRGTGMRQSM PAPEENGGGT IPGTSRMKII

401 TAGLDAAAPF MLGKQQFFYA TAIQAQWNKT PLVAQDKLSI GSRYTVXGFD

451 GEQSLFGERG FYWQNTLTWY FHPNHQFYLG ADYGRVSGES AQYVSGKQLM

501 GAVVGFRGGH KVGGMFAYDL FAGKPLHKPK GFQTTNTVYG FNLNYSF*
```

m903/a903 98.4% identity in 547 aa overlap

```
                   10        20        30        40        50        60
m903.pep   MQRQQHIDAELLTDANVRFEQPLEKNNYVLSEDETPCTRVNYISLDDKTVRKFSFLPSVL
           |||||||||||||||||||||||||||||||||||||||||||||||||:||||||||||
a903       MQRQQHIDAELLTDANVRFEQPLEKNNYVLSEDETPCTRVNYISLDDKTARKFSFLPSVL
                   10        20        30        40        50        60
                   70        80        90       100       110       120
m903.pep   MKETAFKTGMCLGSNNLSRLQKAAQQILIVRGYLTSQAIIQPQNMDSGILKLRVSAGEIG
           ||||||||||||||||||||||||||||||||||||||||||||||||||||||||||||
a903       MKETAFKTGMCLGSNNLSRLQKAAQQILIVRGYLTSQAIIQPQNMDSGILKLRVSAGEIG
                   70        80        90       100       110       120
                  130       140       150       160       170       180
m903.pep   DIRYEEKRDGKSAEGSISAFNNKFPLYRNKILNLRDVEQGLENLRRLPSVKTDIQIIPSE
           ||||||||||||||||||||||||||||||||||||||||||||||||||||||||||||
a903       DIRYEEKRDGKSAEGSISAFNNKFPLYRNKILNLRDVEQGLENLRRLPSVKTDIQIIPSE
                  130       140       150       160       170       180
                  190       200       210       220       230       240
m903.pep   EEGKSDLQIKWQQNKPIRFSIGIDDAGGKTTGKYQGNVALSFDNPLGLSDLFYVSYGRGL
           ||||||||||||||||||||||||||||||||||||||||||||||||||||||||||||
a903       EEGKSDLQIKWQQNKPIRFSIGIDDAGGKTTGKYQGNVALSFDNPLGLSDLFYVSYGRGL
                  190       200       210       220       230       240
                  250       260       270       280       290       300
m903.pep   AHKTDLTDATGTETESGSRSYSVHYSVPVKKWLFSFNHNGHRYHEATEGYSVNYDYNGKQ
           :|||||||||||||||||||||||||||||||||||||||||||||||||||||||||||
a903       VHKTDLTDATGTETESGSRSYSVHYSVPVKKWLFSFNHNGHRYHEATEGYSVNYDYNGKQ
                  250       260       270       280       290       300
                  310       320       330       340       350       360
m903.pep   YQSSLAAERMLWRNRLHKTSVGMKLWTRQTYKYIDDAEIEVQRRRSAGWEAELRHRAYLN
           |||||||||||||||:||||||||||||||||||||||||||||||||||||||||||||
a903       YQSSLAAERMLWRNRFHKTSVGMKLWTRQTYKYIDDAEIEVQRRRSAGWEAELRHRAYLN
                  310       320       330       340       350       360
                  370       380       390       400       410       420
m903.pep   RWQLDGKLSYKRGTGMRQSMPAPEENGGDILPGTSRMKIITASLDAAAPFXLGKQQFFYA
           ||||||||||||||||||||||||||||  :||||||||||:||||||| ||||||||||
a903       RWQLDGKLSYKRGTGMRQSMPAPEENGGGTIPGTSRMKIITAGLDAAAPFMLGKQQFFYA
                  370       380       390       400       410       420
                  430       440       450       460       470       480
m903.pep   TAIQAQWNKTPLVAQDKLSIGSRYTVRGFDGEQSLFGERGFYWQNTLTWYFHPNHQFYLG
           |||||||||||||||||||||||||| |||||||||||||||||||||||||||||||||
a903       TAIQAQWNKTPLVAQDKLSIGSRYTVXGFDGEQSLFGERGFYWQNTLTWYFHPNHQFYLG
                  430       440       450       460       470       480
                  490       500       510       520       530       540
m903.pep   ADYGRVSGESAQYVSGKQLMGAVVGFRGGHKVGGMFAYDLFAGKPLHKPKGFQTTNTVYG
           ||||||||||||||||||||||||||||||||||||||||||||||||||||||||||||
a903       ADYGRVSGESAQYVSGKQLMGAVVGFRGGHKVGGMFAYDLFAGKPLHKPKGFQTTNTVYG
                  490       500       510       520       530       540

m903.pep   FNLNYSFX
           ||||||||
a903       FNLNYSFX
```

The following partial DNA sequence was identified in *N. gonorrhoeae* <SEQ ID 2721>:

g904.seq

```
   1 ATGATGCAGC ACAATCGTTT CTTCGCGGTC GGGGCCGGTg gaGACGATGG
  51 CGACCGGCGC GCCGCAGACT TCTTCAATCC GTTTCAAATA TGCTTTGGCA
 101 TTGGCAGGCA ATGCGTCGTA GCTTTTCACG CCGACAGTCG ATTCGCGCCA
 151 GCCGGGCATG GTTTCGTAAA TCGGTTTGCA GGTTTCCACC GCATCCGAAC
 201 CGCAAGGCAG GATGTCGGTT TTGCCGCCGC CTGGCAATTC GTAGCCGACG
 251 CAGATATTGA TGGTTTCAAC GCCGTCCATT ACATCGAGTT TGGTAATGCA
 301 CATACCGGAA ATGCCGTTGA TTTGGATGGA GCGTTTCAGG GCGGCGGCAT
 351 CAAACCAGCC GCAGCGGCGC GCGCGGCCGG TTACCGAACC GAATTCGTGT
 401 CCGCGCTCCG CCAAACCTGC GCCTACTTCG TCGAACAATT CGGTCGGGAA
 451 CGGGCCCGAA CCGACGCGCG TGGTATAGGC TTTGACGATG CCCAAAACAT
 501 AATCCAGCAT TTGAGGACCT ACGCCCGCGC CTGCCGAAGC CGCGCCGGCG
 551 AGACAGTTGG ACGAGGTAAC GAAGGGGTAA GTGCCGTAGT CGATGTCCAA
 601 CAACGCACCT TGCGCGCCTT CAAACAGCAG TTTTTCGCCG TTTTTGTTTT
 651 TTTCGTTCAA CACGCgggaC acgtcgGCAA TCATCGGCGC AATGCGCGGC
 701 GCGACTTTTT CGATAACCGC CATCACGTCT TCCGCTTTAA CCGGTCCGGC
 751 GTTATGCAGG TATTGGAGTT GGACGTTGTA ATAGGCAAGG ACGGCATCCA
 801 GTTTTTCACG CAGTTTTTCA GGATGCAGCA AATCGGCGGC GCGAATGGCG
 851 CGGCGTGCCA CTTTGTCTTC GTAGGCAGGG CCGATGCCGC GGCCGGTCGT
 901 GCCGATTTTG CCTTTGCCGC GCGATGCTTC GCGGGCTTGG TCGAGCGCGA
 951 TGTGGTAAGG CAGGATCAGC GGGCAGGTCG GCGCGATTTT CAGACGGCCT
1001 TCGACGTTTT TCACGCCTGC CGCGTTCAAC TCGTCGATTT CGCCCAACAG
1051 GGCTTCGGGg gaaacgAcaa cGCCCGAACC gatGAAGCAA TCCAATCCTT
1101 CGTGCAGGAT ACCGCTCGGA ATCAGGCGCA AAATGGTTTT TTTGCCGCCG
1151 ACGACCAAGG TATGGCCCGC ATTGTGGCCG CCTTGGAAGC GCACgacGct
1201 gCCGGCTTCT TCCGCCAGCC AGTCAACGAT TTTACCTTTA CCCTCGTCGC
1251 CCCACTGTgc gccGATTACT ACAACATTTT TAGCCATAGC CATATAACCT
1301 ATCGatatTA A
```

This corresponds to the amino acid sequence <SEQ ID 2722; ORF 904.ng>:

g904.pep

```
   1 MMQHNRFFAV GAGGDDGDRR AADFFNPFQI CFGIGRQCVV AFHADSRFAP
  51 AGHGFVNRFA GFHRIRTARQ DVGFAAAWQF VADADIDGFN AVHYIEFGNA
 101 HTGNAVDLDG AFQGGGIKPA AAARAAGYRT EFVSALRQTC AYFVEQFGRE
 151 RARTDARGIG FDDAQNIIQH LRTYARACRS RAGETVGRGN EGVSAVVDVQ
 201 QRTLRAFKQQ FFAVFVFFVQ HAGHVGNHRR NARRDFFDNR HHVFRFNRSG
 251 VMQVLELDVV IGKDGIQFFT QFFRMQQIGG ANGAACHFVF VGRADAAAGR
 301 ADFAFAARCF AGLVERDVVR QDQRAGRRDF QTAFDVFHAC RVQLVDFAQQ
 351 GFGGNDNART DEAIQSFVQD TARNQAQNGF FAADDQGMAR IVAALEAHDA
 401 AGFFRQPVND FTFTLVAPLC ADYYNIFSHS HITYRY*
```

The following partial DNA sequence was identified in *N. meningitidis* <SEQ ID 2723>:

m904.seq

```
   1 ATGATGCAGC ACAATCGTTT CTTCTCGGTC GGGGCCGgTG GAGACGATGG
  51 CGACCGGCGC GCCGCAGACT TCTTCAATCC GTTTCAAATA TGCTTTGGCG
 101 TTTTCGGGCA ATGCGCCGTA GTCCTTCACG CCGAAAGTGG ATTCGCGCCA
 151 GCCGGGCATG GTTTCGTAAA TCGGCTTGCA GGTTTCCACC GCATCGGAAC
 201 CGCAAGGCAG GATGTCGGTT TTGCCGCCGT CGGGCAATTC ATAGCCGACG
 251 CAGATATTGA TGGTTTCAAC GCCGTCCATT ACATCGAGTT TAGTAATACA
 301 CATACCGGAA ATGCCGTTGA TTTGGATGGA GCGTTTCAGG GCGGCGGCAT
 351 CAAACCAGCC GCAGCGGCGT GCGCGTCCGG TTACCGAACC GAATTCGTGT
 401 CCGCGTTCTG CCAAACCTAC GCCTACTTCG TCGAACAATT CGGTCGGGAA
 451 CGGGCCCGAA CCGACGCGCG TGGTATAGGC TTTGACGATG CCCAAAACAT
 501 AATCCAGCAT TTGAGGACCT ACGCCCGCGC CTGCCGAAGC TGCGCCCGCC
 551 AGACAGTTGG ACGAGGTAAC GAAGGGATAA GTGCCGTAGT CGATGTCCAA
 601 CAACGCACCT TGCGCGCCTT CAAACAGCAG TTTTTCGCCG TTTTTGTTTT
 651 TCTCGTTCAA CACGCGGGAC ACGTCGGTAA TCATCGGCGC AATGCGCGGC
 701 GCGACTTTTT CGATAACCGC CATCACGTCT TCCGCTTTAA CCGGCTCGGC
 751 ATTGTGCAGA TGTTGCAGTT GGACATTGTA ATAGGCAAGG ACGGCATCCA
 801 GTTTTTCACG CAGTTTyTCA GGATGCAGCA AATCGGCGGC GCGAATGGCG
 851 CGGCGTGCCA CTTTGTCTTC GTAGGCAGGG CCGATGCCGC GGCCGGTCGT
 901 GCCGATTTTG CCTTTGCCGC GCG.ATcTTC GCGGGCTTGG TCGAGCGCGA
 951 TGTGGTAAGG CAGGATCAGC GGGCAGGTCG GCGCGATTTT CAGACGGCCT
1001 TCGACGTTTT TCACGCCTGC CGCGTTCAAC TCGTCGATTT CGCCCAACAG
1051 GGCTTCGGGG GAGACGACAA CGCCCGAACC GATGAAGCAG TCCAAACTTT
1101 CATGCAGGAT GCCGCTCGGA ATCAGGCGCA AAATGGTTTT TTTGCCGCCG
1151 ACAACCAAGG TATGGCCCGC ATTGTGGCCG CCTTGGAAGC GCACCaCGCC
1201 GCCGGCTTCT TCCGCCAGCC AGTCAACGAT TTTACCTTTA CCCTCGTCGC
1251 CCCACTGTGC GCCGATTAsT ACAACATTTT TAGCCATAGC CATATAACCT
1301 ATCGATATTA A
```

This corresponds to the amino acid sequence <SEQ ID 2724; ORF 904>:

m904.pep

```
   1 MMQHNRFFSV GAGGDDGDRR AADFFNPFQI CFGVFGQCAV VLHAESGFAP
  51 AGHGFVNRLA GFHRIGTARQ DVGFAAVGQF IADADIDGFN AVHYIEFSNT
 101 HTGNAVDLDG AFQGGGIKPA AAACASGYRT EFVSAFCQTY AYFVEQFGRE
 151 RARTDARGIG FDDAQNIIQH LRTYARACRS CARQTVGRGN EGISAVVDVQ
 201 QRTLRAFKQQ FFAVFVFLVQ HAGHVGNHRR NARRDFFDNR HHVFRFNRLG
 251 IVQMLQLDIV IGKDGIQFFT QFXRMQQIGG ANGAACHFVF VGRADAAAGR
```

-continued

```
301 ADFAFAAXIF AGLVERDVVR QDQRAGRRDF QTAFDVFHAC RVQLVDFAQQ

351 GFGGDDNART DEAVQTFMQD AARNQAQNGF FAADNQGMAR IVAALEAHHA

401 AGFFRQPVND FTFTLVAPLC ADXYNIFSHS HITYRY*
```

Computer analysis of this amino acid sequence gave the following results:

Homology with a predicted ORF from *N. gonorrhoeae*

ORF 904 shows 90.4% identity over a 436 aa overlap with a predicted ORF (ORF 904.ng) from *N. gonorrhoeae*:

```
m904/g904

                    10        20        30        40        50        60
m904.pep    MMQHNRFFSVGAGGDDGDRRAADFFNPFQICFGVFGQCAVVLHAESGFAPAGHGFVNRLA
            ||||||||:||||||||||||||||||||||||:  ||:|::||:| |||||||||||:|
g904        MMQHNRFFAVGAGGDDGDRRAADFFNPFQICFGIGRQCVVAFHADSRFAPAGHGFVNRFA
                    10        20        30        40        50        60

                    70        80        90       100       110       120
m904.pep    GFHRIGTARQDVGFAAVGQFIADADIDGFNAVHYIEFSNTHTGNAVDLDGAFQGGGIKPA
            ||||| ||||||||||: ||:||||||||||||||||:|:||||||||||||||||||||
g904        GFHRIRTARQDVGFAAAWQFVADADIDGFNAVHYIEFGNAHTGNAVDLDGAFQGGGIKPA
                    70        80        90       100       110       120

                   130       140       150       160       170       180
m904.pep    AAACASGYRTEFVSAFCQTYAYFVEQFGRERARTDARGIGFDDAQNIIQHLRTYARACRS
            ||| |:|||||||||: || ||||||||||||||||||||||||||||||||||||||||
g904        AAARAAGYRTEFVSALRQTCAYFVEQFGRERARTDARGIGFDDAQNIIQHLRTYARACRS
                   130       140       150       160       170       180

                   190       200       210       220       230       240
m904.pep    CARQTVGRGNEGISAVVDVQQRTLRAFKQQFFAVFVFLVQHAGHVGNHRRNARRDFFDNR
             | :||||||||:||||||||||||||||||||||||:||||||||||||||||||||||
g904        RAGETVGRGNEGVSAVVDVQQRTLRAFKQQFFAVFVFFVQHAGHVGNHRRNARRDFFDNR
                   190       200       210       220       230       240

                   250       260       270       280       290       300
m904.pep    HHVFRFNRLGIVQMLQLDIVIGKDGIQFFTQFXRMQQIGGANGAACHFVFVGRADAAAGR
            |||||||| |::|:|:||:||||||||||||| |||||||||||||||||||||||||||
g904        HHVFRFNRSGVMQVLELDVVIGKDGIQFFTQFFRMQQIGGANGAACHFVFVGRADAAAGR
                   250       260       270       280       290       300

                   310       320       330       340       350       360
m904.pep    ADFAFAARIFAGLVERDVVRQDQRAGRRDFQTAFDVFHACRVQLVDFAQQGFGGDDNART
            |||||||| |||||||||||||||||||||||||||||||||||||||||||||:|||||
g904        ADFAFAARCFAGLVERDVVRQDQRAGRRDFQTAFDVFHACRVQLVDFAQQGFGGNDNART
                   310       320       330       340       350       360

                   370       380       390       400       410       420
m904.pep    DEAVQTFMQDAARNQAQNGFFAADNQGMARIVAALEAHHAAGFFRQPVNDFTFTLVAPLC
            |||:|:|:||:|||||||||||||:||||||||||||| |||||||||||||||||||||
g904        DEAIQSFVQDTARNQAQNGFFAADDQGMARIVAALEAHDAAGFFRQPVNDFTFTLVAPLC
                   370       380       390       400       410       420

                   430
m904.pep    ADXYNIFSHSHITYRYX
            || ||||||||||||||
g904        ADYYNIFSHSHITYRYX
                   370
```

The following partial DNA sequence was identified in *N. meningitidis* <SEQ ID 2725>:

```
a904.seq

  1 ATGATGCAGC ACAATCGTTT CTTCGCGGTC GGGGCCGGTG GAGACGATGG

 51 CGACCGGCGC ACCGCAGACT TCTTCAATCC GTTTCAAATA TGCTTTGGCA

101 TTGGCAGGTA ATGCGTCGTA GCTTTTCACG CCGAAAGTGG ATTCGCTCCA

151 ACCGGGCATG GTTTCGTAAA TCGGCTTGCA GGCTTCTACC GCATCAGAGC

201 CGCAAGGCAG GATGTCGGTT TTGCCGCCGT CGGGCAATTC GTAGCCGACG

251 CAGATATTGA TGGTTTCAAC GCCGTCCATT ACATCGAGTT TGGTAATACA
```

-continued

```
 301 CATACCGGAA ATGCCGTTGA TTTGGATGGA GCGTTTCAGG GCGGCGGCAT
 351 CAAACCAGCC GCAGCGGCGT GCGCGTCCGG TTACCGAACC GAATTCGTGT
 401 CCGCGTTCTG CCAAACCTGC TCCGACTTCG TCGAACAATT CGGTCGGGAA
 451 CGGGCCCGAA CCGACGCGCG TGGTATAGGC TTTGACGATG CCCAAAACAT
 501 AATCCAGCAT TTGAGGGCCT ACGCCCGCGC CTGCCGAAGC CGCGCCGGCG
 551 AGGCAGTTGG ACGAAGTAAC GAAGGGGTAA GTGCCGTAGT CGATGTCCAA
 601 CAACGCACCT TGCGCGCCTT CAAACAGCAG TTTTTCGCCG TTTTTGTTTT
 651 TTTCGTTCAA CACGCGGGAC ACGTCGGTAA TCATCGGCGT AATGCGCGGC
 701 GCGACTTTTT CGATAACCGC CATCACGTCT TCCGCTTTCA CCGACTCGGC
 751 ATTGTGCAGA TGTTGCAGTT GGACGTTGTA ATAAGCAAAG ACGGCATCCA
 801 GTTTTTCACG CAGTTTTTCA GGATGCAGCA AATCGGCGGC GCGAATGGCG
 851 CGGCGTGCCA CTTTGTCTTC GTAGGCAGGG CCGATGCCGC GGCCGGTCGT
 901 GCCGATTTTG CCTTTGCCGC GCGATGCTTC TCGGGCTTGG TCGAGCGCGA
 951 TGTGATAAGG CAGGATCAGC GGGCAGGTCG GCGCGATTTT CAGACGGCCT
1001 TCGACGTTTT TCACGCCTGC CGCGTTCAAC TCGTCGATTT CGCCCAACAG
1051 GGCTTCGGGG GAGACGACAA CGCCCGAACC GATGAAGCAG TCCAGACTTT
1101 CATGCAGGAT GCCGCTCGGA ATCAGGCGCA AAATGGTTTT TTTGCCGCCG
1151 ACAACCAAGG TATGACCCGC ATTGTGGCCG CCTTGGAAGC GCACCACGCC
1201 TCCGGCTTCT TCCGCCAGCC AGTCAACGAT TTTACCTTTA CCCTCGTCGC
1251 CCCACTGTGC GCCGATTACT ACAACATTTT TAGCCATAGC CATATAACCT
1301 .TCGATATTA A
```

This corresponds to the amino acid sequence <SEQ ID 2726; ORF 904.a>:

a904.pep

```
  1 MMQHNRFFAV GAGGDDGDRR TADFFNPFQI CFGIGR*CVV AFHAESGFAP
 51 TGHGFVNRLA GFYRIRAARQ DVGFAAVGQF VADADIDGFN AVHYIEFGNT
101 HTGNAVDLDG AFQGGGIKPA AAACASGYRT EFVSAFCQTC SDFVEQFGRE
151 RARTDARGIG FDDAQNIIQH LRAYARACRS RAGEAVGRSN EGVSAVVDVQ
201 QRTLRAFKQQ FFAVFVFFVQ HAGHVGNHRR NARRDFFDNR HHVFRFHRLG
251 IVQMLQLDVV ISKDGIQFFT QFFRMQQIGG ANGAACHFVF VGRADAAAGR
301 ADFAFAARCF SGLVERDVIR QDQRAGRRDF QTAFDVFHAC RVQLVDFAQQ
351 GFGGDDNART DEAVQTFMQD AARNQAQNGF FAADNQGMTR IVAALEAHHA
401 SGFFRQPVND FTFTLVAPLC ADYYNIFSHS HITXRY*
```

m904/a904 91.3% identity in 436 aa overlap

```
                   10        20        30        40        50        60
m904.pep    MMQHNRFFSVGAGGDDGDRRAADFFNPFQICFGVFGQCAVVLHAESGFAPAGHGFVNRLA
            ||||||||:||||||||||||:||||||||||||:    |:|::||||||:|||||||||||
a904        MMQHNRFFAVGAGGDDGDRRTADFFNPFQICFGLGRXCVVAFHAESGFTPAGHGFVNRLA
                   10        20        30        40        50        60
```

-continued

```
                   70        80        90       100       110       120
m904.pep    GFHRIGTARQDVGFAAVGQFIADADIDGFNAVHYIEFSNTHTGNAVDLDGAFQGGGIKPA
            ||:|| :|||||||||||||:||||||||||||||||:||||||||||||||||||||||
a904        GFYRIRAARQDVGFAAVGQFVADADIDGFNAVHYIEFGNTHTGNAVDLDGAFQGGGIKPA
                   70        80        90       100       110       120

                  130       140       150       160       170       180
m904.pep    AAACASGYRTEFVSAFCQTYAYFVEQFGRERARTDARGIGFDDAQNIIQHLRTYARACRS
            ||||||||||||||||||| : |||||||||||||||||||||||||||||||:||||||
a904        AAACASGYRTEFVSAFCQTCSDFVEQFGRERARTDARGIGFDDAQNIIQHLRAYARACRS
                  130       140       150       160       170       180

                  190       200       210       220       230       240
m904.pep    CARQTVGRGNEGISAVVDVQQRTLRAFKQQFFAVFVFLVQHAGHVGNHRRNARRDFFDNR
             | ::|||:|||:||||||||||||||||||||||||:||||||||||||||||||||||
a904        RAGEAVGRSNEGVSAVVDVQQRTLRAFKQQFFAVFVFFVQHAGHVGNHRRNARRDFFDNR
                  190       200       210       220       230       240

                  250       260       270       280       290       300
m904.pep    HHVFRFNRLGIVQMLQLDIVIGKDGIQFFTQFXRMQQIGGANGAACHFVFVGRADAAAGR
            ||||||:|||||||||||:||:|||||||||| |||||||||||||||||||||||||||
a904        HHVFRFHRLGIVQMLQLDVVISKDGIQFFTQFFRMQQIGGANGAACHFVFVGRADAAAGR
                  250       260       270       280       290       300

                  310       320       330       340       350       360
m904.pep    ADFAFAAXIFAGLVERDVVRQDQRAGRRDFQTAFDVFHACRVQLVDFAQQGFGGDDNART
            |||||||  |:|||||||:|||||||||||||||||||||||||||||||||||||||||
a904        ADFAFAAXIFSGLVERDVIRQDQRAGRRDFQTAFDVFHACRVQLVDFAQQGFGGDDNART
                  310       320       330       340       350       360

                  370       380       390       400       410       420
m904.pep    DEAVQTFMQDAARNQAQNGFFAADNQGMARIVAALEAHHAAGFFRQPVNDFTFTLVAPLC
            ||||||||||||||||||||||||||||:|||||||||||:|||||||||||||||||||
a904        DEAVQTFMQDAARNQAQNGFFAADNQGMARIVAALEAHHAAGFFRQPVNDFTFTLVAPLC
                  370       380       390       400       410       420

m904.pep    ADXYNIFSHSHITYRYX
            || |||||||||| |||
a904        ADYYNIFSHSHITXRYX
                  430
```

g906.seq not found yet g906.pep not found yet

The following partial DNA sequence was identified in *N. meningitidis* <SEQ ID 2727>:

m906.seq

```
  1 ATGAAATATA TCGTATCAAT CTCTCTGGCT ATGGGATTGG CTGCCTGTTC
 51 GTTTGGGGGA TTTAAACCAA ATCCGTGGGA CGCCGCGTCA TTTTGGGAAT
101 TGAAAAATTA CGCCAATCCC TATCCGGGAT CAGCCTCGGC GGCACTTGAC
151 CAATATCCAT CGAAAGCAAG ACGAAGGCAA CTGAAAGACA TGCAAGAGTG
201 CGGCTATGAC CCAATAGACG GCGGAAAGTC TGAAGCAGAT GCCTGCCTGA
251 GGAAAAAAGG CTGGTGTCGT AAGGGTTTCG ACCCTTATCC CGAAAACAAA
301 AAATACGAAT GGCCTCGAGA AGAAGGAAAA ACAAAATGA
```

This corresponds to the amino acid sequence <SEQ ID 2728; ORF 906>:

m906.pep

```
  1 MKYIVSISLA MGLAACSFGG FKPNPWDAAS FWELKNYANP YPGSASAALD
 51 QYPSKARRRQ LKDMQECGYD PIDGGKSEAD ACLRKKGWCR KGFDPYPENK
101 KYEWPREEGK TK*
```

The following partial DNA sequence was identified in *N. gonorrhoeae* <SEQ ID 2729>:

g907.seq (partial)

```
  1 ATGAAAAAAC CGACCGATAC CCTACCCGTC AATCTgcaAC GCCGCCGCCT
 51 GCTGTGTGCC GCCGGCGCGC TGTTGATCAG CCCGCTGGCG CACGCCGGCG
101 CGCAACGTGA AGAAACGCtt gCCGACGATG TGGCTTCCGT GATGAGGAGT
151 TCTGTCGGCA GCGTCAATCC GCCGAGGCTG GTGTTCGACA ATCCGAAAGA
201 GGGCGAACGT TGGTTGTCCG CGATGTCGGC ACGTTTGGCA AGATTCGTCC
251 CCGACGAGGG GGAGCGGCGC AGGCTGCTGG TCAATATCCA ATACGAAAGC
301 AGCCGGGCCG GTTTGGATAC GCAGATTGTG TTGGGGCTGa ttgaagtgga
351 aagcgggtac cgagctcgaa tcatatca..
```

This corresponds to the amino acid sequence <SEQ ID 2730; ORF 907.ng>:

g907.pep (partial)

```
  1 MKKPTDTLPV NLQRRRLLCA AGALLISPLA HAGAQREETL ADDVASVMRS
 51 SVGSVNPPRL VFDNPKEGER WLSAMSARLA RFVPDEGERR RLLVNIQYES
101 SRAGLDTQIV LGLIEVESGY RARIIS...
```

The following partial DNA sequence was identified in *N. meningitidis* <SEQ ID 2731>:

m907.seq

```
  1 ATGAGAAAAC CGACCGATAC CCTACCCGTT AATCTGCAAC GCCGCCGCCT
 51 GTTGTGTGCC GCCGGTGCGT TGTTGCTCAG TCCTCTGGCG CACGCCGGCG
101 CGCAACGTGA GGAAACGCTT GCCGACGATG TGGCTTCCGT GATGAGGAGT
151 TCTGTCGGCA GCGTCAATCC GCCGAGGCTG GTGTTTGACA ATCCGAAAGA
201 GGGCGAGCGT TGGTTGTCTG CCATGTCGGC ACGTTTGGCA AGGTTCGTCC
251 CCGAGGAGGA GGAGCGGCGC AGGCTGCTGG TCAATATCCA GTACGAAAGC
301 AGCCGGGCCG GTTTGGATAC GCAGATTGTG TTGGGGCTGA TTGAGGTGGA
351 AAGCGCGTTC CGCCAGTATG CAATCAGCGG TGTCGGCGCG CGCGGCCTGA
401 TGCAGGTTAT GCCGTTkTGG AAAAACTACA TCGGCAAACC GGCGCACAAC
451 CTGTTCGACA TCCGCACCAA CCTGCGTTAC GGCTGTACCA TCCTGCGCCA
501 TTACCGGAAT CTTGAAAAAG GCAACATCGT CCGCGCGCTT GCCCGCTTTA
551 ACGGCAGCTT GGGCAGCAAT AAATATCCGA ACGCCGTTTT GGgCGCGTGG
601 CGCAACCGCT GGCAGTGGCG TTGA
```

This corresponds to the amino acid sequence <SEQ ID 2732; ORF 907>:

m907.pep

```
  1 MRKPTDTLPV NLQRRRLLCA AGALLLSPLA HAGAQREETL ADDVASVMRS
 51 SVGSVNPPRL VFDNPKEGER WLSAMSARLA RFVPEEEERR RLLVNIQYES
```

-continued

```
101 SRAGLDTQIV LGLIEVESAF RQYAISGVGA RGLMQVMPXW KNYIGKPAHN

151 LFDIRTNLRY GCTILRHYRN LEKGNIVRAL ARFNGSLGSN KYPNAVLGAW

201 RNRWQWR*
```

Computer analysis of this amino acid sequence gave the following results:

Homology with a predicted ORF from *N. gonorrhoeae*

ORF 907 shows 92.9% identity over a 126 aa overlap with a predicted ORF (ORF 907.ng) from *N. gonorrhoeae*:

g907/m907

```
                  10        20        30        40        50        60
m907.pep  MKKPTDTLPVNLQRRRLLCAAGALLISPLAHAGAQREETLADDVASVMRSSVGSVNPPRL
          |:||||||||||||||||||||||||:|||||||||||||||||||||||||||||||||
g907      MRKPTDTLPVNLQRRRLLCAAGALLLSPLAHAGAQREETLADDVASVMRSSVGSVNPPRL
                  10        20        30        40        50        60

                  70        80        90       100       110       120
m907.pep  VFDNPKEGERWLSAMSARLARFVPDEGERRRLLVNIQYESSRAGLDTQIVLGLIEVESGY
          ||||||||||||||||||||||||:| ||||||||||||||||||||||||||||||||::
g907      VFDNPKEGERWLSAMSARLARFVPEEEERRRLLVNIQYESSRAGLDTQIVLGLIEVESAF
                  70        80        90       100       110       120

m907.pep  RARIIS
          |   ||
g907      RQYAISGVGARGLMQVMPXWKNYIGKPAHNLFDIRTNLRYGCTILRHYRNLEKGNIVRAL
                 130       140       150       160       170       180
```

The following partial DNA sequence was identified in *N. meningitidis* <SEQ ID 2733>:

a907.seq

```
  1 ATGAAAAAAC CGACCGATAC CCTACCCGTC AATCTGCAAC GCCGCCGCCT

 51 ATTGTGTGCT GCCGGCGCGC TGTTGCTCAG CCCGCTGGCA CAAGCCGGCG

101 CGCAACGTGA AGAAACGCTT GCCGACGATG TGGCTTCCGT GATGAGGAGC

151 TCTGTCGGCA GCATAAATCC GCCGAGGCTG GTGTTCGACA ATCCGAAAGA

201 GGGCGAGCGT TGGCTGTCCG CGATGTCTGC TCGGTTGGCA AGGTTCGTCC

251 CCGATGAGGA GGAGCGGCGC AGGCTGCTGG TCAATATCCA GTACGAAAGC

301 AGCCGGGCCG GTTTGGATAC GCAGATTGTG TTGGGGCTGA TTGAGGTGGA

351 AAGCGCGTTC CGCCAGTATG CAATCAGCGG TGTCGGCGCG CGCGGCCTGA

401 TGCAGGTTAT GCCGTTTTGG AAAAACTACA TCGGCAAACC GGCGCACAAC

451 CTGTTCGACA TCCGCACCAA CCTGCGTTAC GGCTGTACCA TCCTGCGCCA

501 TTACCGGAAT CTTGAAAAAG GCAACATCGT CCGCGCACTC GCCCGTTTTA

551 ACGGTAGCCT CGGCAGCAAT AAATATCCGA ACGCCGTTTT GGGCGCGTGG

601 CGCAACCGCT GGCAGTGGCG TTGA
```

This corresponds to the amino acid sequence <SEQ ID 2734; ORF 907.a>:

a907.pep

```
  1 MKKPTDTLPV NLQRRRLLCA AGALLLSPLA QAGAQREETL ADDVASVMRS

 51 SVGSINPPRL VFDNPKEGER WLSAMSARLA RFVPDEEERR RLLVNIQYES
```

-continued

```
101 SRAGLDTQIV LGLIEVESAF RQYAISGVGA RGLMQVMPFW KNYIGKPAHN

151 LFDIRTNLRY GCTILRHYRN LEKGNIVRAL ARFNGSLGSN KYPNAVLGAW

201 RNRWQWR*
```

m907/a907 97.6% identity in 207 aa overlap

```
                    10        20        30        40        50        60
m907.pep    MRKPTDTLPVNLQRRRLLCAAGALLLSPLAHAGAQREETLADDVASVMRSSVGSVNPPRL
            |:|||||||||||||||||||||||||||:||||||||||||||||||||||||:|||||
a907        MKKPTDTLPVNLQRRRLLCAAGALLLSPLAQAGAQREETLADDVASVMRSSVGSINPPRL
                    10        20        30        40        50        60

                    70        80        90       100       110       120
m907.pep    VFDNPKEGERWLSAMSARLARFVPEEEERRRLLVNIQYESSRAGLDTQIVLGLIEVESAF
            ||||||||||||||||||||||||:|||||||||||||||||||||||||||||||||||
a907        VFDNPKEGERWLSAMSARLARFVPDEEERRRLLVNIQYESSRAGLDTQIVLGLIEVESAF
                    70        80        90       100       110       120

                   130       140       150       160       170       180
m907.pep    RQYAISGVGARGLMQVMPXWKNYIGKPAHNLFDIRTNLRYGCTILRHYRNLEKGNIVRAL
            |||||||||||||||||| |||||||||||||||||||||||||||||||||||||||||
a907        RQYAISGVGARGLMQVMPFWKNYIGKPAHNLFDIRTNLRYGCTILRHYRNLEKGNIVRAL
                   130       140       150       160       170       180

                   190       200
m907.pep    ARFNGSLGSNKYPNAVLGAWRNRWQWRX
            ||||||||||||||||||||||||||||
a907        ARFNGSLGSNKYPNAVLGAWRNRWQWRX
                   190       200
```

The following partial DNA sequence was identified in *N. gonorrhoeae* <SEQ ID 2735>:

g908.seq

```
  1 ATGAG.AAAA GCCGTCTAAG CCGGTATAAA CAAAATAAAC TCATTGGGCT

 51 ATTTGTCGCA GGTGTAACTG CAAGAACAGC GGCAGAGTTG GTAGGCATTA

101 ATAAAAATAC CGCAGCCTAT GATTTTCATC GTTTACGATG ACTGATTTAT

151 CAAAACGGTC CGCATTTAGA AATGTTTGAT GGCGAAGTAG AAGCAGATGA

201 AAGTTATTTT GGCGGACAAC GCAAAGGCAA ACGCGGTCGC GGTGCTGCCG

251 GTAAAGTCGC CGTATTCGGT CTTTTGAAGC GAAATGGTAA GGTTTATACG

301 GTTACAGTAC CGAATACTCA AACCGCTACT TTATTTCCTA TTATCCGTGA

351 acaagtgaaa cctgacagta ttgtttatac ggattgttat CgTAGCTATG

401 ATGTATTAGA Tgtgagcgaa tttagccatT TTagcttcgc tgaaacttcg

451 ttttcgtaTC AATCACAGCA CACATTTTGC CGAACGACAA AACCATATTA

501 A
```

This corresponds to the amino acid sequence <SEQ ID 2736; ORF 908.ng>:

g908.pep

```
  1 MXKSRLSRYK QNKLIGLFVA GVTARTAAEL VGINKNTAAY DFHRLR*LIY

 51 QNGPHLEMFD GEVEADESYF GGQRKGKRGR GAAGKVAVFG LLKRNGKVYT

101 VTVPNTQTAT LFPIIREQVK PDSIVYTDCY RSYDVLDVSE FSHFSFAETS

151 FSYQSQHTFC RTTKPY*
```

The following partial DNA sequence was identified in *N. meningitidis* <SEQ ID 2737>:

m908.seq

```
  1 ATGAGAAAAA GTCGTCTAAG CCAGTATAAA CAAAmTAAAC TCATTGAACT
 51 GTTTGTCACA GGTGTAACTG CAAGAACGGC AGCAGAGTTA GTAGGCGTTA
101 ATAAAAATAC CGCAGCCTAT TATTTTCATC GTTTACGATT ACTTATTTAT
151 CAAAACAGTC CGCATTTGGA AATGTTTGAT GGCGAAGTAG AAGCAGATGA
201 AAGTTATTTT GGCGGACAAC GCAAAGGCAA ACGCGGTCGC GGTGCTGCCG
251 GTAAAGTCGC CGTATTCGGT CTTTTGAAGC GAAATGGTAA GGTTTATACG
301 GTTACAGTAC CGAATACTCA AACCGCTACT TTATTTCCTA TTATCCGTGA
351 ACAAGTGAAA CCTGACAGCA TTTTTTATAC GGATTGTTAT CGTAGCTATG
401 ATGTATTAGA TGTGCGCGAA TTTAGCCATT TTAGCTTCGC TGAAACTTCG
451 TTTTCGTATC AATCACAGCA CACATTTTGC CGAACGACAA AACCATATTA
501 A
```

This corresponds to the amino acid sequence <SEQ ID 2738; ORF 908>:

m908.pep

```
  1 MRKSRLSQYK QXKLIELFVT GVTARTAAEL VGVNKNTAAY YFHRLRLLIY
 51 QNSPHLEMFD GEVEADESYF GGQRKGKRGR GAAGKVAVFG LLKRNGKVYT
101 VTVPNTQTAT LFPIIREQVK PDSIFYTDCY RSYDVLDVRE FSHFSFAETS
151 FSYQSQHTFC RTTKPY*
```

Computer analysis of this amino acid sequence gave the following results:

Homology with a predicted ORF from *N. gonorrhoeae*

ORF 908 shows 93.4% identity over a 166 aa overlap with a predicted ORF (ORF 908.ng) from *N. gonorrhoeae*:

g908/m908

```
                   10        20        30        40        50        60
g908.pep   MXKSRLSRYKQNKLIGLFVAGVTARTAAELVGINKNTAAYDFHRLRXLIYQNGPHLEMFD
           | |||||:||| ||| |||:||||||||||||:||||||| ||||| |||||:|||||||
m908       MRKSRLSQYKQXKLIELFVTGVTARTAAELVGVNKNTAAYYFHRLRLLIYQNSPHLEMFD
                   10        20        30        40        50        60

                   70        80        90       100       110       120
g908.pep   GEVEADESYFGGQRKGKRGRGAAGKVAVFGLLKRNGKVYTVTVPNTQTATLFPIIREQVK
           ||||||||||||||||||||||||||||||||||||||||||||||||||||||||||||
m908       GEVEADESYFGGQRKGKRGRGAAGKVAVFGLLKRNGKVYTVTVPNTQTATLFPIIREQVK
                   70        80        90       100       110       120

                  130       140       150       160
g908.pep   PDSIVYTDCYRSYDVLDVSEFSHFSFAETSFSYQSQHTFCRTTKPYX
           |||| ||||||||||||| |||||||||||||||||||||||||||
m908       PDSIFYTDCYRSYDVLDVREFSHFSFAETSFSYQSQHTFCRTTKPYX
                  130       140       150       160
```

The following partial DNA sequence was identified in *N. meningitidis* <SEQ ID 2739>:

a908.seq

```
  1 ATGAGAAAAA GTCGTCTAAG CCAGTATAAA CAAAATAAAC TCATTGAGCT

 51 ATTTGTCGCA GGTGTAACTG CAAGAACGGC AGCAGAGTTA GTAGGCGTTA

101 ATAAAAATAC CGCAGCCTAT TATTTTCATC GTTTACGATT ACTTATTTAT

151 CAAAACAGTC CGCATTTGGA AATGTTTGAT GGCGAAGTAG AAGCAGATGA

201 AAGTTATTTT GGCGGACAAC GCAAAGGCAA ACGCGGTCGC GGTGCTGCCG

251 GTAAAGTCGC CGTATTCGGT CTTTTGAAGC GAAATGGTAA GGTTTATACG

301 GTTACAGTAC CGAATACTCA AACCGCTACT TTATTTCCTA TTATCCGTGA

351 ACAAGTGAAA CCTGACAGCA TTGTTTATAC GGATTGTTAT CGTAGCTATG

401 ATGTATTAGA TGTGCGCGAA TTTAGCCATT TTAGCTTCGC TGAAACTTCG

451 TTTTCGTATC AATCACAGCA CACATTTTGC CGAACGACAA AACCATATTA

501 A
```

This corresponds to the amino acid sequence <SEQ ID 2740; ORF 908.a>:

a908.pep

```
  1 MRKSRLSQYK QNKLIELFVA GVTARTAAEL VGVNKNTAAY YFHRLRLLIY

 51 QNSPHLEMFD GEVEADESYF GGQRKGKRGR GAAGKVAVFG LLKRNGKVYT

101 VTVPNTQTAT LFPIIREQVK PDSIVYTDCY RSYDVLDVRE FSHFSFAETS

151 FSYQSQHTFC RTTKPY*
```

m908/a908 98.2% identity in 166 aa overlap

```
                    10        20        30        40        50        60
m908.pep    MRKSRLSQYKQXKLIELFVTGVTARTAAELVGVNKNTAAYYFHRLRLLIYQNSPHLEMFD
            ||||||||||| ||||||| :||||||||||||||||||||||||||||||||||||||||
a908        MRKSRLSQYKQNKLIELFVAGVTARTAAELVGVNKNTAAYYFHRLRLLIYQNSPHLEMFD
                    10        20        30        40        50        60

                    70        80        90       100       110       120
m908.pep    GEVEADESYFGGQRKGKRGRGAAGKVAVFGLLKRNGKVYTVTVPNTQTATLFPIIREQVK
            ||||||||||||||||||||||||||||||||||||||||||||||||||||||||||||
a908        GEVEADESYFGGQRKGKRGRGAAGKVAVFGLLKRNGKVYTVTVPNTQTATLFPIIREQVK
                    70        80        90       100       110       120

                   130       140       150       160
m908.pep    PDSIFYTDCYRSYDVLDVREFSHFSFAETSFSYQSQHTFCRTTKPYX
            |||| ||||||||||||||||||||||||||||||||||||||||
a908        PDSIVYTDCYRSYDVLDVREFSHFSFAETSFSYQSQHTFCRTTKPYX
                   130       140       150       160
```

The following partial DNA sequence was identified in *N. gonorrhoeae* <SEQ ID 2741>:

g909.seq (partial)

```
  1 atgcgtaaaa ccgtacttat cCTgaccatc tccgccgccc ttttgtcggg

 51 ctgcacatgG gaaacttatc aagacggcag cggcaaaacc gccgtccgtg

101 caaaatgttc caccggcacg ccgctgtgtt ggcaagacgg gcgcggctcg

151 aaaaaggtgg actgcgacga gtacggtggc gaacgccggg ccgtgttgcg

201 caaccaaaag cgggggaagc ccgcgacgag gagagccgca acgctgggga
```

-continued

```
251 aaccgagttt ccgggcgagg gacggggggg ggcgggtgaa cagggcagaa

301 acgggggagg ggaagcgatc ggcgagg..
```

This corresponds to the amino acid sequence <SEQ ID 2742; ORF 909.ng>:

g909.pep (partial)

```
  1 MRKTVLILTI SAALLSGCTW ETYQDGSGKT AVRAKCSTGT PLCWQDGRGS

 51 KKVDCDEYGG ERRAVLPNQK RGKPATRRAA TLGKPSFRAR DGGGRVNRAE

101 TGEGKRSAR..
```

The following partial DNA sequence was identified in *N. meningitidis* <SEQ ID 2743>:

m909.seq

```
  1 ATGCGTAAAA CCTTCCTCTT CCTGACCGCT GCCGCCGCCC TTTTGTCGGG

 51 CTGCGCGTGG GAAACTTATC AAGACGGCAA CGGCAAGACC GCCGTCCGTC

101 AAAAATATCC CGCCGGCACG CCCGTTTATT ACCAAGACGG CAGCTACTCG

151 AAAAATATGA ACTACAACCA ATACCGTCCC GAACGCCATG CCGTGTTACC

201 CAATCAAACC GGCAACAACG CCGACGAAGA GCATCGCCAA CACTGGCAAA

251 AACCAAAGTT TCAAAACCGA TAA
```

This corresponds to the amino acid sequence <SEQ ID 2744; ORF 909>:

m909.pep

```
  1 MRKTFLFLTA AAALLSGCAW ETYQDGNGKT AVRQKYPAGT PVYYQDGSYS

 51 KNMNYNQYRP ERHAVLPNQT GNNADEEHRQ HWQKPKFQNR *
```

Computer analysis of this amino acid sequence gave the following results:

Homology with a predicted ORF from *N. gonorrhoeae*

ORF 909 shows 53.3% identity over a 90 aa overlap with a predicted ORF (ORF 909.ng) from *N. gonorrhoeae*:

m909/g909

```
                   10        20        30        40        50        60
m909.pep  MRKTFLFLTAAAALLSGCAWETYQDGNGKTAVRQKYPAGTPVYYQDGSYSKNMNYNQYRP
          |||| |:|| :|||||||:|||||||:|||||| |  :|||: :|||  ||::: ::|  
g909      MRKTVLILTISAALLSGCTWETYQDGSGKTAVRAKCSTGTPLCWQDGRGSKKVDCDEYGG
                   10        20        30        40        50        60

                   70        80        90
m909.pep  ERHAVLPNQTGNNADEEHRQHWQKPKFQNRX
          ||:||| ||  ::   ::     ||:|: |
g909      ERRAVLRNQKRGKPATRRAATLGKPSFRARDGGGRVNRAETGEGKRSAR
                   70        80        90       100
```

The following partial DNA sequence was identified in *N. meningitidis* <SEQ ID 2745>:

a909.seq

```
  1 ATGCGTAAAA CCTTCCTTAT CCTGATGACT GCCGCCGCCC TTTTGTCGGG
 51 CTGCGCGTGG GAAACTTATC AAGACGGCAA CGGCAAGACC GCCGTCCGTC
101 AAAAATATCC CGCCGGCACG CCCGTTTATT ACCAAGACGG CAGCTACTCG
151 AAAAATATGA ACTACAACCA ATACCGTCCC GAACGCCATG CCGTGTTACC
201 CAACCAAACC GGCAACAACG CCGACGAAGA GCATCGCCAA CACTGGCAAA
251 AGCCCAAATT TCAAAACCGA TAA
```

This corresponds to the amino acid sequence <SEQ ID 2746; ORF 909.a>:

a909.pep

```
 1 MRKTFLILMT AAALLSGCAW ETYQDGNGKT AVRQKYPAGT PVYYQDGSYS
51 KNMNYNQYRP ERHAVLPNQT GNNADEEHRQ HWQKPKFQNR *
```

m909/a909 96.7% identity in 90 aa overlap

```
                    10        20        30        40        50        60
m909.pep    MRKTFLFLTAAAALLSGCAWETYQDGNGKTAVRQKYPAGTPVYYQDGSYSKNMNYNQYRP
            ||||||:| :||||||||||||||||||||||||||||||||||||||||||||||||||
a909        MRKTFLILMTAAALLSGCAWETYQDGNGKTAVRQKYPAGTPVYYQDGSYSKNMNYNQYRP
                    10        20        30        40        50        60

                    70        80        90
m909.pep    ERHAVLPNQTGNNADEEHRQHWQKPKFQNRX
            |||||||||||||||||||||||||||||||
a909        ERHAVLPNQTGNNADEEHRQHWQKPKFQNRX
                    70        80        90
```

The following partial DNA sequence was identified in *N. gonorrhoeae* <SEQ ID 2747>:

g910.seq

```
  1 ATGAAAAAAC TGTTATTGGC CGCCGTTGTT TCCCTAAATG CCGCAACCGC
 51 ATTTGCCGGC GACTCTGCCG AGCGTCAGAT TTACGGCGAT CCCCATTTTG
101 AACAAAACCG CACAAAAGCC GTGAAAATGT TGGAACAGCG CGGTTATCAG
151 GTTTACGATG TCGATGCCGA CGACTACTGG GGCAAACCTG TTTTGGAAGT
201 GGAAGCCTAT AAAGACGGCC GCGAATACGA CATCGTGTTG TCTTACCCCG
251 ACCTGAAAAT CATCAAAGAG CAGCTCGATC GCTGA
```

This corresponds to the amino acid sequence <SEQ ID 2748; ORF 910.ng>:

g910.pep

```
 1 MKKLLLAAVV SLNAATAFAG DSAERQIYGD PHFEQNRTKA VKMLEQRGYQ
51 VYDVDADDYW GKPVLEVEAY KDGREYDIVL SYPDLKIIKE QLDR*
```

The following partial DNA sequence was identified in *N. meningitidis* <SEQ ID 2749>:

m910.seq

```
  1 ATGAAAAAAC TGTTATTGGC TGCCGTTGTT TCTCTGAGTG CCGCTGCCGC
 51 ATTTGCCGGC GACTCTGCCG AGCGTCAGAT TTACGGCGAT CCCCATTTTG
101 AACAAAACCG CACAAAAGCT GTGAAAATGT TGGAGCAGCG CGGTTATCAG
151 GTTTACGATG TCGATGCCGA CGACCATTGG GGTAAGCCTG TGCTGGAAGT
201 GGAAGCCTAT AAAGACGGCC GCGAATACGA CATCGTGTTG TCTTACCCCG
251 ACCTGAAAAT CATCAAAGAG CAGCTCGATC GCTGA
```

This corresponds to the amino acid sequence <SEQ ID 2750; ORF 910>:

m910.pep

```
  1 MKKLLLAAVV SLSAAAAFAG DSAERQIYGD PHFEQNRTKA VKMLEQRGYQ
 51 VYDVDADDHW GKPVLEVEAY KDGREYDIVL SYPDLKIIKE QLDR*
```

Computer analysis of this amino acid sequence gave the following results:

Homology with a predicted ORF from *N. gonorrhoeae*

ORF 910 shows 96.8% identity over a 94 aa overlap with a predicted ORF (ORF 910.ng) from *N. gonorrhoeae*:

g910/m910

```
                   10        20        30        40        50        60
g910.pep   MKKLLLAAVVSLNAATAFAGDSAERQIYGDPHFEQNRTKAVKMLEQRGYQVYDVDADDYW
           ||||||||||||:||:||||||||||||||||||||||||||||||||||||||||||:|
m910       MKKLLLAAVVSLSAAAAFAGDSAERQIYGDPHFEQNRTKAVKMLEQRGYQVYDVDADDHW
                   10        20        30        40        50        60
                   70        80        90
g910.pep   GKPVLEVEAYKDGREYDIVLSYPDLKIIKEQLDRX
           ||||||||||||||||||||||||||||||||||
m910       GKPVLEVEAYKDGREYDIVLSYPDLKIIKEQLDRX
                   70        80        90
```

The following partial DNA sequence was identified in *N. meningitidis* <SEQ ID 2751>:

a910.seq

```
  1 ATGAAAAAAC TGTTATTGGT CGCCGTTGTT TCCTTGAGTG CCGCAACCGC
 51 ATTTGCCGGC GACTCTGCCG AGCGTCAGAT TTACGGCGAT CCCTATTTTG
101 AACAAAACCG CACAAAAGCC GTGAAAATGT TGGAACAGCG CGGTTATCAG
151 GTTCACGATG TCGATGCCGA CGACCATTGG GGCAAACCTG TTTTGGAAGT
201 GGAAGCCTAT AAAGACGGCC GCGAATACGA CATTGTGTTG TCTTACCCCG
251 ACCTGAAAAT CATCAAAGAG CAGCTCGATC GCTGA
```

This corresponds to the amino acid sequence <SEQ ID 2752; ORF 910.a>:

a910.pep

```
  1 MKKLLLVAVV SLSAATAFAG DSAERQIYGD PYFEQNRTKA VKMLEQRGYQ
 51 VHDVDADDHW GKPVLEVEAY KDGREYDIVL SYPDLKIIKE QLDR*
```

m910/a910 95.7% identity in 94 aa overlap

```
                10        20        30        40        50        60
m910.pep  MKKLLLAAVVSLSAAAAFAGDSAERQIYGDPHFEQNRTKAVKMLEQRGYQVYDVDADDHW
          ||||||:||||||||:|||||||||||||||:||||||||||||||||||:|||||||||
a910      MKKLLLVAVVSLSAATAFAGDSAERQIYGDPYFEQNRTKAVKMLEQRGYQVHDVDADDHW
                10        20        30        40        50        60

                70        80        90
m910.pep  GKPVLEVEAYKDGREYDIVLSYPDLKIIKEQLDRX
          |||||||||||||||||||||||||||||||||||
a910      GKPVLEVEAYKDGREYDIVLSYPDLKIIKEQLDRX
                70        80        90
```

The following partial DNA sequence was identified in *N. gonorrhoeae* <SEQ ID 2753>:

g911.seq

```
  1 ATGAAAAAGA ACATATTGGA ATTTTGGGTC GGACTGTTCG TCTTGATCGG
 51 CGCGGCGGCG GTTGCCTTTC TCGCTTTCCG CGTGGCGGGC GGCGCGGCGT
101 TCGGCGGTTC GGACAAAACT TACGCCGTTT ATGCCGATTT CGGCGACATC
151 GGCGGTTTGA AGGTCAATGC CCCCGTCAAA TCCGCAGGCG TATTGGTCGG
201 GCGCGTCGGC GCTATCGGGC TTGACCCGAA ATCCTATCAG GCGAGGGTGC
251 GCCTTGATTT GGACGGCAAG TATCAGTTCA GCAGTGACGT TTCCGCGCAA
301 ATCCTGACTT CGGGACTTTT GGGCGAACAG TACATCGGGC TGCAGCAGGG
351 CGGCGATACG GAAAACCTTG CTGCCGGCGA CACCATCTCC GTAACCAGTT
401 CTGCAATGGT TCTGGAAAAC CTGATCGGTA AATTCATGAC CAGCTTCGCC
451 GAGAAAAACG CTGAGGGCGG CAATGCGGAA AAAGCCGcag aAtaa
```

This corresponds to the amino acid sequence <SEQ ID 2754; ORF 911.ng>:

g911.pep

```
  1 MKKNILEFWV GLFVLIGAAA VAFLAFRVAG GAAFGGSDKT YAVYADFGDI
 51 GGLKVNAPVK SAGVLVGRVG AIGLDPKSYQ ARVRLDLDGK YQFSSDVSAQ
101 ILTSGLLGEQ YIGLQQGGDT ENLAAGDTIS VTSSAMVLEN LIGKFMTSFA
151 EKNAEGGNAE KAAE*
```

The following partial DNA sequence was identified in *N. meningitidis* <SEQ ID 2755>:

m911.seq

```
  1 ATGAAGAAGA ACATATTGGA ATTTTGGGTC GGACTGTTCG TCCTGATTGG
 51 CGCGGCGGCG GTTGCCTTTC TCGCTTTCCG CGTGGCCGGC GGTGCGGCGT
101 TCGGCGGTTC GGACAAAACT TACGCCGTTT ATGCCGATTT CGGCGACATC
151 GGCGGTTTGA AGGTCAATGC CCCCGTCAAA TCCGCAGGCG TATTGGTCGG
201 GCGCGTCGGC GCTATCGGAC TTGACCCGAA ATCCTATCAG GCGAGGGTGC
251 GCCTCGATTT GGACGGCAAG TATCAGTTCA GCAGCGACGT TTCCGCGCAA
301 ATCCTGACTT CGGGACTTTT GGGCGAGCAG TACATCGGGC TGCAGCAGGG
```

-continued

```
351 CGGCGACACG GAAAACCTTG CTGCCGGCGA CACCATCTCC GTAACCAGTT

401 CTGCAATGGT TCTGGAAAAC CTTATCGGCA AATTCATGAC GAGTTTTGCC

451 GAGAAAAATG CCGACGGCGG CAATGCGGAA AAAGCCGCCG AATAA
```

This corresponds to the amino acid sequence <SEQ ID 2756; ORF 911>:

m911.pep

```
  1 MKKNILEFWV GLFVLIGAAA VAFLAFRVAG GAAFGGSDKT YAVYADFGDI

 51 GGLKVNAPVK SAGVLVGRVG AIGLDPKSYQ ARVRLDLDGK YQFSSDVSAQ

101 ILTSGLLGEQ YIGLQQGGDT ENLAAGDTIS VTSSAMVLEN LIGKFMTSFA

151 EKNADGGNAE KAAE*
```

Computer analysis of this amino acid sequence gave the following results:

Homology with a predicted ORF from *N. gonorrhoeae*

ORF 911 shows 99.4% identity over a 164 aa overlap with a predicted ORF (ORF 911.ng) from *N. gonorrhoeae*:

g911/m911

```
                   10        20        30        40        50        60
g911.pep   MKKNILEFWVGLFVLIGAAAVAFLAFRVAGGAAFGGSDKTYAVYADFGDIGGLKVNAPVK
           ||||||||||||||||||||||||||||||||||||||||||||||||||||||||||||
m911       MKKNILEFWVGLFVLIGAAAVAFLAFRVAGGAAFGGSDKTYAVYADFGDIGGLKVNAPVK
                   10        20        30        40        50        60
                   70        80        90       100       110       120
g911.pep   SAGVLVGRVGAIGLDPKSYQARVRLDLDGKYQFSSDVSAQILTSGLLGEQYIGLQQGGDT
           ||||||||||||||||||||||||||||||||||||||||||||||||||||||||||||
m911       SAGVLVGRVGAIGLDPKSYQARVRLDLDGKYQFSSDVSAQILTSGLLGEQYIGLQQGGDT
                   70        80        90       100       110       120
                  130       140       150       160
g911.pep   ENLAAGDTISVTSSAMVLENLIGKFMTSFAEKNAEGGNAEKAAEX
           ||||||||||||||||||||||||||||||||||:||||||||||
m911       ENLAAGDTISVTSSAMVLENLIGKFMTSFAEKNADGGNAEKAAEX
                  130       140       150       160
```

The following partial DNA sequence was identified in *N. meningitidis* <SEQ ID 2757>:

a911.seq

```
  1 ATGAAAAAGA ACATATTGGA ATTTTGGGTC GGACTGTTCG TCCTGATTGG

 51 CGCGGCGGCG GTTGCCTTTC TCGCTTTCCG CGTGGCCGGC GGTGCGGCGT

101 TCGGCGGTTC GGACAAAACT TACGCCGTTT ATGCCGATTT CGGCGACATC

151 GGCGGTTTGA AGGTCAATGC CCCCGTCAAA TCCGCAGGCG TATTGGTCGG

201 GCGCGTCGGC GCTATCGGAC TTGACCCGAA ATCCTATCAG GCGAGGGTGC

251 GCCTCGATTT GGACGGCAAG TATCAGTTCA GCAGCGACGT TTCCGCGCAA

301 ATCCTGACTT CGGGACTTTT GGGCGAGCAG TACATCGGGC TGCAGCAGGG

351 CGGCGACACG GAAAACCTTG CTGCCGGCGA CACCATCTCC GTAACCAGTT

401 CTGCAATGGT TCTGGAAAAC CTTATCGGCA AATTCATGAC GAGTTTTGCC

451 GAGAAAAATG CCGACGGCGG CAATGCGGAA AAAGCCGCCG AATAA
```

This corresponds to the amino acid sequence <SEQ ID 2758; ORF 911.a>:

a911.pep

```
  1 MKKNILEFWV GLFVLIGAAA VAFLAFRVAG GAAFGGSDKT YAVYADFGDI
 51 GGLKVNAPVK SAGVLVGRVG AIGLDPKSYQ ARVRLDLDGK YQFSSDVSAQ
101 ILTSGLLGEQ YIGLQQGGDT ENLAAGDTIS VTSSAMVLEN LIGKFMTSFA
151 EKNADGGNAE KAAE*
```

m911/a911 100.0% identity in 164 aa overlap

```
                   10        20        30        40        50        60
m911.pep    MKKNILEFWVGLFVLIGAAAVAFLAFRVAGGAAFGGSDKTYAVYADFGDIGGLKVNAPVK
            ||||||||||||||||||||||||||||||||||||||||||||||||||||||||||||
a911        MKKNILEFWVGLFVLIGAAAVAFLAFRVAGGAAFGGSDKTYAVYADFGDIGGLKVNAPVK
                   10        20        30        40        50        60

                   70        80        90       100       110       120
m911.pep    SAGVLVGRVGAIGLDPKSYQARVRLDLDGKYQFSSDVSAQILTSGLLGEQYIGLQQGGDT
            ||||||||||||||||||||||||||||||||||||||||||||||||||||||||||||
a911        SAGVLVGRVGAIGLDPKSYQARVRLDLDGKYQFSSDVSAQILTSGLLGEQYIGLQQGGDT
                   70        80        90       100       110       120

                  130       140       150       160
m911.pep    ENLAAGDTISVTSSAMVLENLIGKFMTSFAEKNADGGNAEKAAEX
            |||||||||||||||||||||||||||||||||||||||||||||
a911        ENLAAGDTISVTSSAMVLENLIGKFMTSFAEKNADGGNAEKAAEX
                  130       140       150       160
```

The following partial DNA sequence was identified in *N. gonorrhoeae* <SEQ ID 2759>:

g912.seq

```
  1 gtgAAAAaat cctcctTcat cagcGCATTG GGCATCGgtA TTTTGAGCAT
 51 CGGCATGGCA TTTGCCTCCC CGGCCGACGC AGTGGGACAA ATCCGCCAAA
101 ACGCCACACA GGTTTTGACC ATCCTCAAAA GCGGCGACGC GGCTTCTGCA
151 CGCCCAAAAG CCGAAGCCTA TGCGGTTCCC TATTTCGATT TCCAACGTAT
201 GACCGCATTG GCGGTCGGCA ACCCTTGGCG TACCGCGTCC GACGCGCAAA
251 AACAAGCGTT GGCCAAAGAA TTTCAAACCC TGCTGATCCG CACCTATTCC
301 GGCACGATGC TGAAATTCAA AAACGCGACC GTCAACGTCA AAGACAATCC
351 CATCGTCAAT AAGGGCGGCA AGGAAATCGT CGTCCGTGCC GAAGTCGGCA
401 TCCCCGGTCA GAAGCCCGTC AATATGGACT TTACCACCTA CCAAAGCGGC
451 GGCAAATACC GTACCTACAA CGTCGCCATC GAAGGCACGA GCCTGGTTAC
501 CGTGTACCGC AACCAATTCG GCGAAATCAT CAAAGCCAAA GGCATCGACG
551 GGCTGATTGC CGAGTTGAAA GCCAAAAACG GCGGCAAATA A
```

This corresponds to the amino acid sequence <SEQ ID 2760; ORF 912.ng>:

g912.pep

```
  1 VKKSSFISAL GIGILSIGMA FASPADAVGQ IRQNATQVLT ILKSGDAASA
 51 RPKAEAYAVP YFDFQRMTAL AVGNPWRTAS DAQKQALAKE FQTLLIRTYS
```

-continued

```
101 GTMLKFKNAT VNVKDNPIVN KGGKEIVVRA EVGIPGQKPV NMDFTTYQSG

151 GKYRTYNVAI EGTSLVTVYR NQFGEIIKAK GIDGLIAELK AKNGGK*
```

The following partial DNA sequence was identified in *N. meningitidis* <SEQ ID 2761>:

m912.seq

```
  1 ATGAAAAAAT CCTCCCTCAT CAGCGCATTG GGCATCGGTA TTTTGAGCAT

 51 CGGCATGGCA TTTGCCGCCC CTGCCGACGC GGTAAGCCAA ATCCGTCAAA

101 ACGCCACTCA AGTATTGAGC ATCTTAAAAA ACGGCGATGC CAACACCGCT

151 CGCCAAAAAG CCGAAGCCTA TGCGATTCCC TATTTCGATT TCCAACGTAT

201 GACCGCATTG GCGGTCGGCA ACCCTTGGCG CACCGCGTCC GACGCGCAAA

251 AACAAGCGTT GGCCAAAGAA TTTCAAACCC TGCTGATCCG CACCTATTCC

301 GGCACGATGC TGAAATTAAA AAACGCCAAC GTCAACGTCA AAGACAATCC

351 CATCGTCAAT AAAGGCGGCA AAGAAATCAT CGTCCGCGCC GAAGTCGGCG

401 TACCCGGGCA AAAACCCGTC AACATGGACT TCACCACCTA CCAAAGCGGC

451 GGTAAATACC GTACCTACAA CGTCGCCATC GAAGGCGCGA GCCTGGTTAC

501 CGTGTACCGC AACCAATTCG GCGAAATTAT CAAAGCGAAA GGCGTGGACG

551 GACTGATTGC CGAGTTGAAA GCCAAAAACG GCGGCAAATA A
```

This corresponds to the amino acid sequence <SEQ ID 2762; ORF 912>:

m912.pep

```
  1 MKKSSLISAL GIGILSIGMA FAAPADAVSQ IRQNATQVLS ILKNGDANTA

 51 RQKAEAYAIP YFDFQRMTAL AVGNPWRTAS DAQKQALAKE FQTLLIRTYS

101 GTMLKLKNAN VNVKDNPIVN KGGKEIIVRA EVGVPGQKPV NMDFTTYQSG

151 GKYRTYNVAI EGASLVTVYR NQFGEIIKAK GVDGLIAELK AKNGGK*
```

Computer analysis of this amino acid sequence gave the following results:

Homology with a predicted ORF from *N. gonorrhoeae*

ORF 912 shows 91.8% identity over a 196 aa overlap with a predicted ORF (ORF 912.ng) from *N. gonorrhoeae*:

g912/m912

```
                    10        20        30        40        50        60
g912.pep    VKKSSFISALGIGILSIGMAFASPADAVGQIRQNATQVLTILKSGDAASARPKAEAYAVP
            :||||:||||||||||||||||:|||||:||||||||||:|||:||| :|| ||||||:|
m912        MKKSSLISALGIGILSIGMAFAAPADAVSQIRQNATQVLSILKNGDANTARQKAEAYAIP
                    10        20        30        40        50        60

                    70        80        90       100       110       120
g912.pep    YFDFQRMTALAVGNPWRTASDAQKQALAKEFQTLLIRTYSGTMLKFKNATVNVKDNPIVN
            |||||||||||||||||||||||||||||||||||||||||||||:|||:||||||||||
m912        YFDFQRMTALAVGNPWRTASDAQKQALAKEFQTLLIRTYSGTMLKLKNANVNVKDNPIVN
                    70        80        90       100       110       120
```

-continued

```
                130       140       150       160       170       180
g912.pep  KGGKEIVVRAEVGIPGQKPVNMDFTTYQSGGKYRTYNVAIEGTSLVTVYRNQFGEIIKAK
          ||||||:||||||:||||||||||||||||||||||||||||:|||||||||||||||||
m912      KGGKEIIVRAEVGVPGQKPVNMDFTTYQSGGKYRTYNVAIEGASLVTVYRNQFGEIIKAK
                130       140       150       160       170       180

                190
g912.pep  GIDGLIAELKAKNGGKX
          |:|||||||||||||||
m912      GVDGLIAELKAKNGGKX
                190
```

The following partial DNA sequence was identified in *N. meningitidis* <SEQ ID 2763>:

a912.seq

```
  1 ATGAAAAAAT CCTCCTTCAT CAGCGCATTG GGCATCGGTA TTTTGAGCAT
 51 CGGCATGGCA TTTGCCGCCC CTGCCGACGC GGTAAACCAA ATCCGTCAAA
101 ACGCCACTCA AGTATTGAGC ATCTTAAAAA GCGGTGATGC CAACACCGCC
151 CGCCAAAAAG CCGAAGCCTA TGCGATTCCC TATTTCGATT TCCAACGTAT
201 GACCGCATTG GCGGTCGGCA ACCCTTGGCG CACCGCGTCC GACGCGCAAA
251 AACAAGCGTT GGCCAAAGAA TTTCAAACCC TGCTGATCCG CACCTATTCC
301 GGCACGATGC TGAAATTAAA AAACGCCAAC GTCAACGTCA AAGACAATCC
351 CATCGTCAAT AAAGGCGGCA AAGAAATCAT CGTCCGCGCC GAAGTCGGCG
401 TACCCGGGCA AAAACCCGTC AACATGGACT TCACCACCTA CCAAAGCGGC
451 GGTAAATACC GTACCTACAA CGTCGCCATC GAAGGCGCGA GCCTGGTTAC
501 CGTGTACCGC AACCAATTCG GCGAAATTAT CAAAGCGAAA GGCGTGGACG
551 GACTGATTGC CGAGTTGAAG GCTAAAAACG GCAGCAAGTA A
```

This corresponds to the amino acid sequence <SEQ ID 2764; ORF 912.a>:

a912.pep

```
  1 MKKSSFISAL GIGILSIGMA FAAPADAVNQ IRQNATQVLS ILKSGDANTA
 51 RQKAEAYAIP YFDFQRMTAL AVGNPWRTAS DAQKQALAKE FQTLLIRTYS
101 GTMLKLKNAN VNVKDNPIVN KGGKEIIVRA EVGVPGQKPV NMDFTTYQSG
151 GKYRTYNVAI EGASLVTVYR NQFGEIIKAK GVDGLIAELK AKNGSK*
```

m912/a912 98.0% identity in 196 aa overlap

```
                10        20        30        40        50        60
m912.pep  MKKSSLISALGIGILSIGMAFAAPADAVSQIRQNATQVLSILKNGDANTARQKAEAYAIP
          |||||:|||||||||||||||||||||||:|||||||||||||:||||||||||||||||
a912      MKKSSFISALGIGILSIGMAFAAPADAVNQIRQNATQVLSILKSGDANTARQKAEAYAIP
                10        20        30        40        50        60

                70        80        90       100       110       120
m912.pep  YFDFQRMTALAVGNPWRTASDAQKQALAKEFQTLLIRTYSGTMLKLKNANVNVKDNPIVN
          ||||||||||||||||||||||||||||||||||||||||||||||||||||||||||||
a912      YFDFQRMTALAVGNPWRTASDAQKQALAKEFQTLLIRTYSGTMLKLKNANVNVKDNPIVN
                70        80        90       100       110       120
```

-continued

```
               130        140        150        160        170        180
m912.pep  KGGKEIIVRAEVGVPGQKPVNMDFTTYQSGGKYRTYNVAIEGASLVTVYRNQFGEIIKAK
          ||||||||||||||||||||||||||||||||||||||||||||||||||||||||||||
a912      KGGKEIIVRAEVGVPGQKPVNMDFTTYQSGGKYRTYNVAIEGASLVTVYRNQFGEIIKAK
               130        140        150        160        170        180

               190
m912.pep  GVDGLIAELKAKNGGKX
          ||||||||||||||:||
a912      GVDGLIAELKAKNGSKX
               190
```

The following partial DNA sequence was identified in *N. gonorrhoeae* <SEQ ID 2765>:

g913.seq

```
  1 atGAAAAAAA CCGCCTACGC CATCCTCCTG CTGATCGGGT TCGCTTCCGC
 51 CCCTGCATTT GCAGAAACCC GCCCCGCCGA CCCTTATGAA GGCTACAACC
101 GCGCCGTTTC CAAATTCAAC GACCAAGCCG ACCGCTACAT TTTCGCCCCT
151 GCCGCGCGCG GCTACCGCAA AGTTACGCCG AAACCCGTCC GCGCCGGCGT
201 GTCCAATTTT TTTAACAACC TGCGCGACGT GGTCAGTTTC GGCAGCAATA
251 TCTTGCGTTT GGAcatCAAA cgcgcAAGcg aAGACCtcgT CCGcgtcggc
301 atCAATACCA CCTTCGGTTT GGgcgGGCTC ATTGATATTG CCGGcgcGGg
351 cggcgttccc gacaataaaa AcacTttgGg cgacacgttt gcctcgtGGG
401 GctgGAAAaa cagcaATTAT TTCGTgttgc CCGtcttagg cccgtccacc
451 gtccgcgacg cgctcggcac gggcattacc tCTGTTTATC CGCccaagaa
501 tatcgttttc catacccctg ccggacgctg GGgcacgact gCCGCTGCCG
551 CCGTcagtac gcgcgaaggc ctcctcgatt tgaccgacag TCtggacgaa
601 gccgccatCG ACAAATACAG CTACACGCGc gacctctata tgAAAGTCCG
651 CGcacgGCag AccgGTGCAA CACCTGCCGA AGgtacggaa gataacatcg
701 acatcgacat cgACGAATTG GTCGAAAGTG CCGAAACCGG CGCGGCAGAG
751 CCCGCCGTTC ACGAAGATTC CGTATCCGAA ACACAGGCAG AAGCAGCAGG
801 GGAAGCCGAA ACGCAACCTG GAACACAACC CTAA
```

This corresponds to the amino acid sequence <SEQ ID 2766; ORF 913.ng>:

g913.pep

```
  1 MKKTAYAILL LIGFASAPAF AETRPADPYE GYNRAVSKFN DQADRYIFAP
 51 AARGYRKVTP KPVRAGVSNF FNNLRDVVSF GSNILRLDIK RASEDLVRVG
101 INTTFGLGGL IDIAGAGGVP DNKNTLGDTF ASWGWKNSNY FVLPVLGPST
151 VRDALGTGIT SVYPPKNIVF HTPAGRWGTT AAAAVSTREG LLDLTDSLDE
201 AAIDKYSYTR DLYMKVRARQ TGATPAEGTE DNIDIDIDEL VESAETGAAE
251 PAVHEDSVSE TQAEAAGEAE TQPGTQP*
```

The following partial DNA sequence was identified in *N. meningitidis* <SEQ ID 2767>:

m913.seq

```
  1 ATGAAAAAAA CCGCCTATGC CTTCCTCCTG CTGATCGGGT TCGCTTCCGC
 51 CCCTGCATTT GCCGAAACCC GCCCCGCCGA CCCTTATGAA GGCTACAACC
101 GCGCCGTTTT CAAATTCAAC GACCAAGCCG ACCGCTACAT TTTCGCCCCT
151 GCCGCGCGCG GCTACCGCAA AGTTGCGCCG AAACCCGTCC GCGCCGGCGT
201 GTCCAATTTT TTTAACAACC TGTGCGACGT GGTCAGCTTC GGCAGCAATA
251 TCTTGCGCTT GGACATCAAA CGCGCAAGCG AAGACCTTGT CCGCGTCGGC
301 ATCAACACCA CTTTCGGTTT GGGCGGGCTT ATCGACATCG CCGGCGCGGG
351 CGGCATTCCC GACAATAAAA ACACCTTGGG CGACACGTTT GCCTCGTGGG
401 GATGGAAAAA CAGCAATTAT TTCGTGTTGC CCGTCTTAGG GCCGTCCACC
451 GTCCGCGACG CGCTCGGCAC GGGTATTACC TCCGTTTATT CGCCCAAGAA
501 TATCGTCTTC CGCACCCCTG TCGGACGCTG GGGCACGACT GCCGTATCCG
551 CCGTCAGTAC GCGCGAAGGC CTgCTCGATT TGACCGACAG TCTGGACGAA
601 GCCGCCATCG ACAAATACAG CTACACGCGC GACCTCTATA TGAAAGTCCG
651 TGCGCGGCAG ACCGGTGCAA CACCTGCCGA AGgTACGGAA GATAACATCG
701 ACATCGACGA ATTGGTCGAA AGTGCCGAAA CCGGCGCGGC GGAAACTGCC
751 GTTCAAGAAG ATTCCGTATC CGAAACACAG GCAGAAGCAG CAGGGGAAGC
801 CGAAACGCAA CCTGGAACAC AACCTTAA
```

This corresponds to the amino acid sequence <SEQ ID 2768; ORF 913>:

m913.pep

```
  1 MKKTAYAFLL LIGFASAPAF AETRPADPYE GYNRAVFKFN DQADRYIFAP
 51 AARGYRKVAP KPVRAGVSNF FNNLCDVVSF GSNILRLDIK RASEDLVRVG
101 INTTFGLGGL IDIAGAGGIP DNKNTLGDTF ASWGWKNSNY FVLPVLGPST
151 VRDALGTGIT SVYSPKNIVF RTPVGRWGTT AVSAVSTREG LLDLTDSLDE
201 AAIDKYSYTR DLYMKVRARQ TGATPAEGTE DNIDIDELVE SAETGAAETA
251 VQEDSVSETQ AEAAGEAETQ PGTQP*
```

Computer analysis of this amino acid sequence gave the following results:

Homology with a predicted ORF from *N. gonorrhoeae*

ORF 913 shows 94.9% identity over a 277 aa overlap with a predicted ORF (ORF 913.ng) from *N. gonorrhoeae*:

g913/m913

```
                   10        20        30        40        50        60
g913.pep   MKKTAYAILLLIGFASAPAFAETRPADPYEGYNRAVSKFNDQADRYIFAPAARGYRKVTP
           ||||||||:||||||||||||||||||||||||||||| ||||||||||||||||||||:|
m913       MKKTAYAFLLLIGFASAPAFAETRPADPYEGYNRAVFKFNDQADRYIFAPAARGYRKVAP
                   10        20        30        40        50        60

                   70        80        90       100       110       120
g913.pep   KPVRAGVSNFFNNLRDVVSFGSNILRLDIKRASEDLVRVGINTTFGLGGLIDIAGAGGVP
           |||||||||||||| |||||||||||||||||||||||||||||||||||||||||||:|
m913       KPVRAGVSNFFNNLCDVVSFGSNILRLDIKRASEDLVRVGINTTFGLGGLIDIAGAGGIP
                   70        80        90       100       110       120
```

-continued

```
                130        140        150        160        170        180
g913.pep   DNKNTLGDTFASWGWKNSNYFVLPVLGPSTVRDALGTGITSVYPPKNIVFHTPAGRWGTT
           |||||||||||||||||||||||||||||||||||||||||||| ||||||:||:||||||
m913       DNKNTLGDTFASWGWKNSNYFVLPVLGPSTVRDALGTGITSVYSPKNIVFRTPVGRWGTT
                130        140        150        160        170        180

                190        200        210        220        230        240
g913.pep   AAAAVSTREGLLDLTDSLDEAAIDKYSYTRDLYMKVRARQTGATPAEGTEDNIDIDIDEL
           |::|||||||||||||||||||||||||||||||||||||||||||||||||||||  |||
m913       AVSAVSTREGLLDLTDSLDEAAIDKYSYTRDLYMKVRARQTGATPAEGTEDNIDI--DEL
                190        200        210        220        230

                250        260        270
g913.pep   VESAETGAAEPAVHEDSVSETQAEAAGEAETQPGTQPX
           |||||||||| ||:|||||||||||||||||||||||
m913       VESAETGAAETAVQEDSVSETQAEAAGEAETQPGTQPX
          240        250        260        270
```

The following partial DNA sequence was identified in *N. meningitidis* <SEQ ID 2769>:

a913.seq

```
  1 ATGAAAAAAA CCGCCTATGC CTTCCTCCTG CTGATCGGGT TCGCTTCCGC
 51 CCCTGCATTT GCCGAAACCC GCCCCGCCGA CCCTTATGAA GGCTACAACC
101 GCGCCGTTTT CAAATTCAAC GACCAAGCCG ACCGCTACAT TTTCGCCCCT
151 GCCGCGCGCG GCTACCGCAA AGTTGCGCCG AAACCCGTCC GCGCCGGCGT
201 GTCCAATTTT TTTAACAACC TGTGCGACGT GGTCAGCTTC GGCAGCAATA
251 TCTTGCGCTT AGACATCAAA CGCGCAAGCG AAGACCTTGT CCGCGTCGGT
301 ATCAACACCA CTTTCGGTTT GGGCGGGCTT ATCGACATCG CCGGCGCGGG
351 CGGCATTCCC GACAATAAAA ACACCTTGGG CGACACGTTT GCTTCGTGGG
401 GATGGAAAAA CAGCAATTAT TTCGTGTTGC CCGTCTTAGG GCCGTCCACC
451 GTCCGCGACG CGCTCGGCAC GGGTATTACC TCCGTTTATT CGCCCAAGAA
501 TATCGTCTTC CGCACCCCTG TCGGACGCTG GGGCACGACT GCCGTATCCG
551 CCGTCAGTAC GCGCGAAGGC CTGCTCGATT TGACCGACAG TCTGGACGAA
601 GCCGCCATCG ACAAATACAG CTACACGCGC GACCTCTATA TGAAAGTCCG
651 TGCGCGGCAG ACCGGTGCAA CACCTGCCGA AGGTACGGAA GATAACATCG
701 ACATCGACGA ATTGGTCGAA AGTGCCGAAA CCGGCGCGGC GGAAACTGCC
751 GTTCAAGAAG ATTCCGTATC CGAAACACAG GCAGAAGCAG CAGGGGAAGC
801 CGAAACGCAA CCTGGAACAC AACCTGGAAC ACAACCTTAA
```

This corresponds to the amino acid sequence <SEQ ID 2770; ORF 913.a>:

a913.pep

```
  1 MKKTAYAFLL LIGFASAPAF AETRPADPYE GYNRAVFKFN DQADRYIFAP
 51 AARGYRKVAP KPVRAGVSNF FNNLCDVVSF GSNILRLDIK RASEDLVRVG
101 INTTFGLGGL IDIAGAGGIP DNKNTLGDTF ASWGWKNSNY FVLPVLGPST
151 VRDALGTGIT SVYSPKNIVF RTPVGRWGTT AVSAVSTREG LLDLTDSLDE
201 AAIDKYSYTR DLYMKVRARQ TGATPAEGTE DNIDIDELVE SAETGAAETA
251 VQEDSVSETQ AEAAGEAETQ PGTQPGTQP*
```

m913/a913 100.0% identity in 275 aa overlap

```
                  10        20        30        40        50        60
m913.pep  MKKTAYAFLLLIGFASAPAFAETRPADPYEGYNRAVFKFNDQADRYIFAPAARGYRKVAP
          ||||||||||||||||||||||||||||||||||||||||||||||||||||||||||||
a913      MKKTAYAFLLLIGFASAPAFAETRPADPYEGYNRAVFKFNDQADRYIFAPAARGYRKVAP
                  10        20        30        40        50        60

                  70        80        90       100       110       120
m913.pep  KPVRAGVSNFFNNLCDVVSFGSNILRLDIKRASEDLVRVGINTTFGLGGLIDIAGAGGIP
          ||||||||||||||||||||||||||||||||||||||||||||||||||||||||||||
a913      KPVRAGVSNFFNNLCDVVSFGSNILRLDIKRASEDLVRVGINTTFGLGGLIDIAGAGGIP
                  70        80        90       100       110       120

                 130       140       150       160       170       180
m913.pep  DNKNTLGDTFASWGWKNSNYFVLPVLGPSTVRDALGTGITSVYSPKNIVFRTPVGRWGTT
          ||||||||||||||||||||||||||||||||||||||||||||||||||||||||||||
a913      DNKNTLGDTFASWGWKNSNYFVLPVLGPSTVRDALGTGITSVYSPKNIVFRTPVGRWGTT
                 130       140       150       160       170       180

                 190       200       210       220       230       240
m913.pep  AVSAVSTREGLLDLTDSLDEAAIDKYSYTRDLYMKVRARQTGATPAEGTEDNIDIDELVE
          ||||||||||||||||||||||||||||||||||||||||||||||||||||||||||||
a913      AVSAVSTREGLLDLTDSLDEAAIDKYSYTRDLYMKVRARQTGATPAEGTEDNIDIDELVE
                 190       200       210       220       230       240

                 250       260       270
m913.pep  SAETGAAETAVQEDSVSETQAEAAGEAETQPGTQPX
          |||||||||||||||||||||||||||||||||||
a913      SAETGAAETAVQEDSVSETQAEAAGEAETQPGTQPGTQPX
                 250       260       270       280
```

The following partial DNA sequence was identified in *N. gonorrhoeae* <SEQ ID 2771>:

g914.seq

```
  1 ATGAAAAAAT GTATTTTGGG CATTTTGACC GCGTGTGCCG CCATGCCTGC

 51 ATTTGCCGAC AGAATCAGCG ATTTGGAAGC ACGTCTGGCG CAGTTGGAAC

101 ACCGTGTCGC CGTATTGGAA AGCGGCGGCA ATACCGTCAA AATCGACCTT

151 TTCGGTTCAA ATTCCACCAT GTATGTATGC AGCGTTACGC CTTTTCAGAA

201 GacgtttGag gCAAGCGATC GGAATGAAGG CGTGGCGCGG CAGAAAGTGC

251 GTCAGGCGTG CAACCGCGAA ACTTCGGCAA TGTTTTGCGG AGATGAGGCA

301 ATCCGATGCA GAAAATTCGA TTGATGTATC GGTTGGACGG ATAAAGAAAC

351 GGATACGGAG CTTGGCTTCC GTCTCTGTTT TTCTCTGCCC GATTTTCCAT

401 GCATCGGGTT TCAGACGGCA TTGGAGTGTC AGTCGTGTTC TGCCGATTCG

451 taggctTCGA CGATTTTTTG CACCAGAGGA TGCCGGACAA CGTCTTCGCC

501 GGTGAAGGTA TGGAAATACA GTCCTGCCAC GCCGTGCAGT TTCTCACGTG

551 CGTCTTTCAA TCCCGATTTG ATGTTTTTGG GCAGGTcgaT TTGGCTGGTG

601 TCGCCGGTAA TGACGGCTTT CGCgccgaag ccGATGCGGG TCAGGAACAT

651 TTTCATTTGT TCGGGCGTGg tgTtttGcgC TTCGTCGAGG ATGATGTATG

701 CGCCGTTGAg cgTCCTGCCG CGCATATAG
```

This corresponds to the amino acid sequence <SEQ ID 2772; ORF 914.ng>:

g914.pep

```
  1 MKKCILGILT ACAAMPAFAD RISDLEARLA QLEHRVAVLE SGGNTVKIDL

 51 FGSNSTMYVC SVTPFQKTFE ASDRNEGVAR QKVRQACNRE TSAMFCGDEA

101 IRCRKFD*CI GWTDKETDTE LGFRLCFSLP DFPCIGFQTA LECQSCSADS
```

-continued

```
151 *ASTIFCTRG CRTTSSPVKV WKYSPATPCS FSRASFNPDL MFLGRSIWLV

201 SPVMTAFAPK PMRVRNIFIC SGVVFCASSR MMYAPLSVLP RI*
```

The following partial DNA sequence was identified in *N. meningitidis* <SEQ ID 2773>:

m914.seq

```
  1 ATGAAAAAAT GTATTTTGGG CATTTTGACC GCGTGTGCCG CCATGCCTGC

 51 ATTTGCCGAC AGAATCGGCG ATTTGGAAGC ACGTCTGGCG CAGTTGGAAC

101 ACCGTGTCGC CGTATTGGAA AGCGGCGGCA ATACCGTCAA AATCGACCTT

151 TTCGGTTCAA ATTCCACCAT GTATGTATGC AGCGTTACGC CTTTTCAGAA

201 GACGTTTGAG GCAAGCGATC GGAATGAAGG CGTGGCGCGG CAGAAAGTGC

251 GTCAGGCGTG CAACCGCGAA ACTTCGGCAA TGTTTTGCGA AGATGAGGCA

301 ATCCGATGCA GAAAATTCGA TTGATGTATC GGTTGGACGG ATAAAGAAAC

351 GGATACGGAT ACGGAGCTTG GCTTCCGTAT CTGTTTTTCT CTGCCTGATT

401 TTCCATGCAT CGGGTTTCAG ACGGCATTGG AATGTCAGTC GTGTTCTGCC

451 GATTCGTAGG CTTCGACGAT TTTTTGCACC AAAGGATGCC GGACAACGTC

501 TTCGCCGGTA AAGGTGTGGA AATACAGCCC TTCCACGTTG TGCAGTTTCT

551 CACGCGCATC TTTTAATCCC GATTTGATGT TTTTGGGCAG GTCGATTTGG

601 CTGGTGTCGC CGGTAATGAC GGCTTTCGCG CCGAAGCCGA TGCGGGTCAG

651 GAACATTTTC ATTTGTTCGG GCGTGGTGTT TTGCGCTTCG TCGAGGATGA

701 TGTATGCGCC GTTGAGCGTC CTGCCGCGCA TATAG
```

This corresponds to the amino acid sequence <SEQ ID 2774; ORF 914>:

m914.pep

```
  1 MKKCILGILT ACAAMPAFAD RIGDLEARLA QLEHRVAVLE SGGNTVKIDL

 51 FGSNSTMYVC SVTPFQKTFE ASDRNEGVAR QKVRQACNRE TSAMFCEDEA

101 IRCRKFDXCI GWTDKETDTD TELGFRICFS LPDFPCIGFQ TALECQSCSA

151 DSXASTIFCT KGCRTTSSPV KVWKYSPSTL CSFSRASFNP DLMFLGRSIW

201 LVSPVMTAFA PKPMRVRNIF ICSGVVFCAS SRMMYAPLSV LPRI*
```

Computer analysis of this amino acid sequence gave the following results:

Homology with a predicted ORF from *N. gonorrhoeae*

ORF 914 shows 96.7% identity over a 244 aa overlap with a predicted ORF (ORF 914.ng) from *N. gonorrhoeae*:

g914/m914

```
                    10        20        30        40        50        60
g914.pep    MKKCILGILTACAAMPAFADRISDLEARLAQLEHRVAVLESGGNTVKIDLFGSNSTMYVC
            ||||||||||||||||||||||:|||||||||||||||||||||||||||||||||||||
m914        MKKCILGILTACAAMPAFADRIGDLEARLAQLEHRVAVLESGGNTVKIDLFGSNSTMYVC
                    10        20        30        40        50        60
```

-continued

```
                   70        80        90       100       110      119
g914.pep   SVTPFQKTFEASDRNEGVARQKVRQACNRETSAMFCGDEAIRCRKFDXCIGWTDKETDT-
           |||||||||||||||||||||||||||||||||||| ||||||||||||||||||||||
m914       SVTPFQKTFEASDRNEGVARQKVRQACNRETSAMFCEDEAIRCRKFDXCIGWTDKETDTD
                   70        80        90       100       110       120

          120       130       140       150       160       170
g914.pep   -ELGFRLCFSLPDFPCIGFQTALECQSCSADSXASTIFCTRGCRTTSSPVKVWKYSPATP
            |||||:|||||||||||||||||||||||||||||||||:||||||||||||||||:|
m914       TELGFRICFSLPDFPCIGFQTALECQSCSADSXASTIFCTKGCRTTSSPVKVWKYSPSTL
                  130       140       150       160       170       180

          180       190       200       210       220       230
g914.pep   CSFSRASFNPDLMFLGRSIWLVSPVMTAFAPKPMRVRNIFICSGVVFCASSRMMYAPLSV
           ||||||||||||||||||||||||||||||||||||||||||||||||||||||||||||
m914       CSFSRASFNPDLMFLGRSIWLVSPVMTAFAPKPMRVRNIFICSGVVFCASSRMMYAPLSV
                  190       200       210       220       230       240

          240
g914.pep   LPRIX
           |||||
m914       LPRIX
```

The following partial DNA sequence was identified in *N. meningitidis* <SEQ ID 2775>:

a914.seq

```
  1 ATGAAAAAAT GTATTTTGGG CATTTTGACC GCGTGTGCCG CCATGCCTGC
 51 ATTTGCCGAC AGAATCGGCG ATTTGGAAGC ACGTCTGGCG CAGTTGGAAC
101 ACCGTGTCGC CGTATTGGAA AGCGGCAGCA ATACCGTCAA AATCGACCTT
151 TTCGGTTCAA ATTCCACCAT GTATGTATGC AGCGTTACGC CTTTTCAGAA
201 GACGTTTGAG GCAAGCGATC GGAATGAAGG CGTGGCGCGG CAGAAAGTGC
251 GTCAGGCGTG CAACCGCGAA ACTTCGGCAA TGTTTTGCGA AGATGAGGCA
301 ATCCGATGCA GAAAATTCGA TTGATGTATC GGTTGGACGG ATAAAGAAAC
351 GGATACGGAG CTTGGCTTCC GTATCTGTTT TTCTCTGCCC GATTTTCCAT
401 GCATCGGGTT TCAGACGGCA TTGGAATGTC AGTCGTGTTC TGCCGATTCG
451 TAGGCTTCGA CGATTTTTTG CACCAAAGGA TGCCGGACAA CGTCTTCGCC
501 GGTAAAGGTG TGGAAATACA GCCCTTCCAC GCCGTGCAGT TTCTCACGCG
551 CATCTTTTAA TCCCGATTTG ATGTTTTTGG GCAGGTCGAT TTGGCTGGTG
601 TCGCCGGTAA TGACGGCTTT CGCGCCGAAG CCGATGCGGG TCAGGAACAT
651 TTTCATTTGT TCGGGCGTGG TGTTTTGCGC TTCGTCGAGG ATGATGTATG
701 CGCCGTTGAG CGTCCTGCCG CGCATATAG
```

This corresponds to the amino acid sequence <SEQ ID 2776; ORF 914.a>:

a914.pep

```
  1 MKKCILGILT ACAAMPAFAD RIGDLEARLA QLEHRVAVLE SGSNTVKIDL
 51 FGSNSTMYVC SVTPFQKTFE ASDRNEGVAR QKVRQACNRE TSAMFCEDEA
101 IRCRKFD*CI GWTDKETDTE LGFRICFSLP DFPCIGFQTA LECQSCSADS
151 *ASTIFCTKG CRTTSSPVKV WKYSPSTPCS FSRASFNPDL MFLGRSIWLV
201 SPVMTAFAPK PMRVRNIFIC SGVVFCASSR MMYAPLSVLP RI*
```

m914/a914 98.4% identity in 244 aa overlap

```
              10         20         30         40         50         60
m914.pep  MKKCILGILTACAAMPAFADRIGDLEARLAQLEHRVAVLESGGNTVKIDLFGSNSTMYVC
          ||||||||||||||||||||||||||||||||||||||||:|||||||||||||||||||
a914      MKKCILGILTACAAMPAFADRIGDLEARLAQLEHRVAVLESGSNTVKIDLFGSNSTMYVC
              10         20         30         40         50         60
              70         80         90        100        110        120
m914.pep  SVTPFQKTFEASDRNEGVARQKVRQACNRETSAMFCEDEAIRCRKFDXCIGWTDKETDTD
          ||||||||||||||||||||||||||||||||||||||||||||||||||||||||||
a914      SVTPFQKTFEASDRNEGVARQKVRQACNRETSAMFCEDEAIRCRKFDXCIGWTDKETD--
              70         80         90        100        110
             130        140        150        160        170        180
m914.pep  TELGFRICFSLPDFPCIGFQTALECQSCSADSXASTIFCTKGCRTTSSPVKVWKYSPSTL
          |||||||||||||||||||||||||||||||||||||||||||||||||||||||||||
a914      TELGFRICFSLPDFPCIGFQTALECQSCSADSXASTIFCTKGCRTTSSPVKVWKYSPSTP
             120        130        140        150        160        170
             190        200        210        220        230        240
m914.pep  CSFSRASFNPDLMFLGRSIWLVSPVMTAFAPKPMRVRNIFICSGVVFCASSRMMYAPLSV
          ||||||||||||||||||||||||||||||||||||||||||||||||||||||||||||
a914      CSFSRASFNPDLMFLGRSIWLVSPVMTAFAPKPMRVRNIFICSGVVFCASSRMMYAPLSV
             180        190        200        210        220        230

m914.pep  LPRIX
          |||||
a914      LPRIX
          240
```

The following partial DNA sequence was identified in *N. gonorrhoeae* <SEQ ID 2777>:

g915.seq

```
  1 ATGAAGAAAA CCCTGTTGGc AATTGTTGCC gtTTTCGCCT TAAGTGCCTG

 51 CCGGCaggcg gaAGaggcac cgccgCCTTT ACCCCGGCAG AtTAGCGacc

101 gttcggtcgg aCACTAttgC Agtatgaacc tgaccgaaca caacggcccc

151 aaagcccaga tttttttgaa cGGCAAACCC GATCAGCCCG TTTGGTTCTC

201 CACCGTcaag cagatgttcg GCTATACCAA GCTGCCCGAA GAGCCCAAAG

251 GCATCCGCGT GATTTACGTT ACCGATATGG GCAATGTTAC CGATTGGACG

301 AATCCTAATG CCGACACGGA GTGGATAGAT GCGAAAAAAG CCTTTTACGT

351 CATCGACAGC GGCTTTATCG GCGGTATGGG CGCGGAAGAC GCGCTGCCGT

401 TCGGCAACAA GGAGCAGGCT GAAAAATTTG CAAAGGATAA AGGCGGCAAG

451 GTCGTCGGTT TTGACGATAT GCCCGATGCT TACATTTTCA AGTAA
```

This corresponds to the amino acid sequence <SEQ ID 2778; ORF 915.ng>:

g915.pep

```
  1 MKKTLLAIVA VFALSACRQA EEAPPPLPRQ ISDRSVGHYC SMNLTEHNGP

 51 KAQIFLNGKP DQPVWFSTVK QMFGYTKLPE EPKGIRVIYV TDMGNVTDWT

101 NPNADTEWID AKKAFYVIDS GFIGGMGAED ALPFGNKEQA EKFAKDKGGK

151 VVGFDDMPDA YIFK*
```

The following partial DNA sequence was identified in *N. meningitidis* <SEQ ID 2779>:

m915.seq

```
  1 ATGAAAAAAA CCCTGTTGGC AATTGTTGCC GTTTCCGCCT TAAGTGC.tG

 51 CCGGCAGGCG GAAGAGGGAC CGCCGCCTTT ACCcCGGCAG ATTAGCGACC
```

-continued

```
101 GTTCGGTCGG ACACTATTGC AGTATGAACC TGACCGAACA CAACGGCCCC

151 AAAGCCCAGA TTTTCTTGAA CGGCAAACCC GATCAGCCCG TtTGGTTCTC

201 CACCATCAAG CAGATGTTCG GCTATACCAA GCTGCCCGAA GAGCCTAAAG

251 GCATCCGCGT GATTTACGTT ACCGATATGG GCAATGTTAC CGATTGGACG

301 AATCCCAATG CCGACACGGA GTGGATGGAT GCGAAAAAAG CCTTTTACGT

351 CATCGACAGC GGCTTTATCG GCGGTATGGG TGCGGAAGAC GCGCTGCCGT

401 TCGGCAACAA AGAGCAGGCT GAGAAATTTG CAAAGGATAA AGGCGGTAAG

451 GTTGTCGGTT TCGACGATAT GCCTGATACC TATATTTTCA AATAA
```

This corresponds to the amino acid sequence <SEQ ID 2780; ORF 915>:

m915.pep

```
  1 MKKTLLAIVA VSALSXCRQA EEGPPPLPRQ ISDRSVGHYC SMNLTEHNGP

 51 KAQIFLNGKP DQPVWFSTIK QMFGYTKLPE EPKGIRVIYV TDMGNVTDWT

101 NPNADTEWMD AKKAFYVIDS GFIGGMGAED ALPFGNKEQA EKFAKDKGGK

151 VVGFDDMPDT YIFK*
```

Computer analysis of this amino acid sequence gave the following results:

Homology with a predicted ORF from *N. gonorrhoeae*

ORF 915 shows 97.0% identity over a 164 aa overlap with a predicted ORF (ORF 915.ng) from *N. gonorrhoeae*:

m915/g915

```
                  10        20        30        40        50        60
m915.pep   MKKTLLAIVAVSALSACRQAEEGPPPLPRQISDRSVGHYCSMNLTEHNGPKAQIFLNGKP
           ||||||||||| ||||||||||:|||||||||||||||||||||||||||||||||||||
g915       MKKTLLAIVAVFALSACRQAEEAPPPLPRQISDRSVGHYCSMNLTEHNGPKAQIFLNGKP
                  10        20        30        40        50        60

                  70        80        90       100       110       120
m915.pep   DQPVWFSTIKQMFGYTKLPEEPKGIRVIYVTDMGNVTDWTNPNADTEWMDAKKAFYVIDS
           ||||||||:|||||||||||||||||||||||||||||||||||||||:|||||||||||
g915       DQPVWFSTVKQMFGYTKLPEEPKGIRVIYVTDMGNVTDWTNPNADTEWIDAKKAFYVIDS
                  70        80        90       100       110       120

                 130       140       150       160
m915.pep   GFIGGMGAEDALPFGNKEQAEKFAKDKGGKVVGFDDMPDTYIFKX
           |||||||||||||||||||||||||||||||||||||||:|||||
g915       GFIGGMGAEDALPFGNKEQAEKFAKDKGGKVVGFDDMPDAYIFKX
                 130       140       150       160
```

The following partial DNA sequence was identified in *N. meningitidis* <SEQ ID 2781>:

a915.seq

```
  1 ATGAAAAAAA CCCTGTTGGC AATTGTTGCC GTTTCCGCCT TAAGTGCCTG

 51 CCGGCAGGCG GAAGAGGGAC CGCCGCCTTT ACCCCGGCAG ATTAGCGACC

101 GTTCGGTCGG ACACTATTGC AGTATGAACC TGACCGAACA CAACGGCCCC

151 AAAGCCCAGA TTTTCTTGAA CGGCAAACCC GATCAGCCCG TTTGGTTCTC

201 CACCATCAAG CAGATGTTCG GCTATACCAA GCTGCCCGAA GAGCCTAAAG
```

-continued

```
251 GCATCCGCGT GATTTACGTT ACCGATATGG GCAATGTTAC CGATTGGACG

301 AATCCCAATG CCGACACGGA GTGGATGGAT GCGAAAAAAG CCTTTTACGT

351 CATCGACAGC GGCTTTATCG GCGGTATGGG TGCGGAAGAC GCGCTGCCGT

401 TCGGCAACAA AGAGCAGGCT GAGAAATTTG CAAAGGATAA AGGCGGTAAG

451 GTTGTCGGTT TCGACGATAT GCCTGATACC TATATTTTCA AATAA
```

This corresponds to the amino acid sequence <SEQ ID 2782; ORF 915.a>:

a915.pep

```
  1 MKKTLLAIVA VSALSACRQA EEGPPPLPRQ ISDRSVGHYC SMNLTEHNGP

 51 KAQIFLNGKP DQPVWFSTIK QMFGYTKLPE EPKGIRVIYV TDMGNVTDWT

101 NPNADTEWMD AKKAFYVIDS GFIGGMGAED ALPFGNKEQA EKFAKDKGGK

151 VVGFDDMPDT YIFK*
```

m915/a915 99.4% identity in 164 aa overlap

```
                   10        20        30        40        50        60
m915.pep   MKKTLLAIVAVSALSXCRQAEEGPPPLPRQISDRSVGHYCSMNLTEHNGPKAQIFLNGKP
           |||||||||||||||| ||||||||||||||||||||||||||||||||||||||||||||
a915       MKKTLLAIVAVSALSACRQAEEGPPPLPRQISDRSVGHYCSMNLTEHNGPKAQIFLNGKP
                   10        20        30        40        50        60

                   70        80        90       100       110       120
m915.pep   DQPVWFSTIKQMFGYTKLPEEPKGIRVIYVTDMGNVTDWTNPNADTEWMDAKKAFYVIDS
           ||||||||||||||||||||||||||||||||||||||||||||||||||||||||||||
a915       DQPVWFSTIKQMFGYTKLPEEPKGIRVIYVTDMGNVTDWTNPNADTEWMDAKKAFYVIDS
                   70        80        90       100       110       120

                  130       140       150       160
m915.pep   GFIGGMGAEDALPFGNKEQAEKFAKDKGGKVVGFDDMPDTYIFKX
           |||||||||||||||||||||||||||||||||||||||||||||
a915       GFIGGMGAEDALPFGNKEQAEKFAKDKGGKVVGFDDMPDTYIFKX
                  130       140       150       160
```

The following partial DNA sequence was identified in *N. gonorrhoeae* <SEQ ID 2783>:

g917.seq

```
  1 ATGGTCAAac atctgccacT cgcCGTCctg actgctTtgc tgcttgcagc

 51 gtgcGGCGGT Tcggacaaac cgcctgccga Aaaaccggca ccggcgGaAA

101 accaaAacgt atTgaAAATT TataACTGGT CGGAATACGT CGATCCGGAA

151 ACCGTTGCCG ATTTTGAAAA GAAAAACGGC ATCAAGGTTA CTTATGATGT

201 GTACGACAGT GATGAAACGC TGGAAAGCAA GGTGCTGACC GGAAAATCCG

251 GTTACGACAT TGTCGCGCCG TCCAATGCGT TTGTGGGCAG GCAGATTAAG

301 GCAGGTGCGT ATCAGAAAAT CGATAAGTCG ATGATTCCCA ATTATAAACA

351 TCTCAACCCT GAAATGATGA GGCTGATGGA CGGGGTCGAT CCCGACCACG

401 AATACGCCGT GCCGTTTTAT TGGGGGACAA ATACCTTCGC CATCAATACC

451 GAACGCGTGA AAAAGGCTTT GGGTACGGAC AAGCTGCCGG ACAACCAGTG

501 GGATTTGGTG TTCAACCCCG AATACACGTT CAAACTCAAA CAATGCGGCA
```

-continued

```
 551 TCAGCTATTT GGACAGCGCG GCGGAAATTT ATCCCATGGT GTTGAACTAT
 601 TTGGGCAAAA ACCCGAACAG CAGCAATACG GAAGACATCA GGGAGGCAAC
 651 CGCCCTGCTC AAGAAAAACC GCCCCAATAT CAAACGCTTT ACTTCGTCCG
 701 GCTTTATCGA TGATTTGGCG CGCGGCGATA CCTGCGTAAC AATCGGTTTC
 751 GGCGGAGATT TGAACATCGC CAAACGCCGT GCCGAAGAAG CGGGCGGCAA
 801 GGAAAAAATC CGCGTGATGA TGCCGAAAGA GGGCGTGGGG ATTTGGGTGG
 851 ATTCTTTCGT GATTCCGAAA GATGCGAAAA ACGTCGCCAA CGCGCACAAA
 901 TACATCAACG ACTTCCTCGA TCCGGAAGTG TCGGCGAAAA ACGGCAATTT
 951 cgttacCTAC GCGCCTTCGA GCAAGCCGGC GCGCGATTTG ATGGAGGACG
1001 AATTTAAAAA CGACAATACG ATTTTCCCGA GCGGGGAAGA TTTGAAAAAC
1051 AGCTTTATCA TGGTGCCTAT CCGGCCGGCG GCATTGAAGT TTATGGTGCG
1101 CCAGTGGCAG GATGTGAAGG CGGGGAAATA A
```

This corresponds to the amino acid sequence <SEQ ID 2784; ORF 917.ng>:

g917.pep

```
  1 MVKHLPLAVL TALLLAACGG SDKPPAEKPA PAENQNVLKI YNWSEYVDPE
 51 TVADFEKKNG IKVTYDVYDS DETLESKVLT GKSGYDIVAP SNAFVGRQIK
101 AGAYQKIDKS MIPNYKHLNP EMMRLMDGVD PDHEYAVPFY WGTNTFAINT
151 ERVKKALGTD KLPDNQWDLV FNPEYTFKLK QCGISYLDSA AEIYPMVLNY
201 LGKNPNSSNT EDIREATALL KKNRPNIKRF TSSGFIDDLA RGDTCVTIGF
251 GGDLNIAKRR AEEAGGKEKI RVMMPKEGVG IWVDSFVIPK DAKNVANAHK
301 YINDFLDPEV SAKNGNFVTY APSSKPARDL MEDEFKNDNT IFPSGEDLKN
351 SFIMVPIRPA ALKFMVRQWQ DVKAGK*
```

The following partial DNA sequence was identified in *N. meningitidis* <SEQ ID 2785>:

m917.seq

```
  1 ATGACCAAAC ATCTGCCCCT GGCCGTCCTG ACTGCTTTGC TGCTTGCAGC
 51 GTGCGGCGGT TCGGACAAAC CGCCTGCCGA AAAACCGGCA CCGGCGGAAA
101 ACCAAAACGT ATTGAAAATT TACAACTGGT CGGAATATGT CGATCCGGAA
151 ACCGTTGCCG ATTTTGAAAA GAAAAACGGC ATCAAGGTTA CTTATGATGT
201 GTACGACAGC GATGAAACGC TGGAAAGCAA GGTGCTGACA GGCAAGTCCG
251 GTTACGACAT TGTCGCGCCG TCCAATGCGT TTGTGGGCAG GCAGATTAAG
301 GCAGGTGCGT ATCAGAAAAT CGATAAGTCG CTGATTCCCA ATTATAAACA
351 CCTCAACCCC GAAATGATGA GGCTGATGGA CGGGGTCGAT CCCGGCCACG
401 AATACGCCGT GCCGTTTTAT TGGGGGACAA ATACCTTCGC CATCAATACC
451 GAACGCGTGA AAAAGGCTTT GGGTACGGAC AAGCTGCCGG ACAACCAGTG
501 GGATTTGGTG TTCGACCCCG AATACACGTC CAAACTCAAG CAATGCGGCA
551 TCAGCTATTT GGACAGCGCG GCGGAAATCT ATCCTATGGT GTTGAACTAT
```

-continued

```
 601 TTGGGTAAAA ACCCGAACAG CAGCAATACG GAAGACATCA GGGAGGCAAC

 651 CGCCCTACTC AAGAAAAACC GCCCCAATAT CAAACGCTTT ACTTCGTCCG

 701 GCTTTATCGA TGATTTGGCG CGCGGCGATA CCTGCGTAAC AATCGGTTTC

 751 GGCGGCGATT TGAACATCGC CAAACGCCGT GCCGAAGAAG CGGGCGGCAA

 801 GGAAAAAATC CGCGTGATGA TGCCCAAAGA GGGCGTGGGG ATTTGGGTGG

 851 ATTCTTTCGT GATTCCGAAA GATGCGAAAA ACGTCGCCAA CGCGCACAAA

 901 TACATCAACG ACTTCCTCGA CCCGGAAGTG TCGGCGAAAA ACGGCAATTT

 951 CGTTACTTAC GCGCCTTCGA GCAAGCCTGC GCGTGAGCTG ATGGAAGACG

1001 AATTTAAAAA CGACAATACG ATTTTCCCAA CCGAGGAGGA TTTGAAAAAC

1051 AGCTTTATCA TGGTGCCTAT CCAGCCGGCG GCATTGAAGT TTATGGTGCG

1101 CCAGTGGCAG GATGTGAAGG CGGGGAAATA A
```

This corresponds to the amino acid sequence <SEQ ID 2786; ORF 917>:

m917.pep

```
  1 MTKHLPLAVL TALLLAACGG SDKPPAEKPA PAENQNVLKI YNWSEYVDPE

 51 TVADFEKKNG IKVTYDVYDS DETLESKVLT GKSGYDIVAP SNAFVGRQIK

101 AGAYQKIDKS LIPNYKHLNP EMMRLMDGVD PGHEYAVPFY WGTNTFAINT

151 ERVKKALGTD KLPDNQWDLV FDPEYTSKLK QCGISYLDSA AEIYPMVLNY

201 LGKNPNSSNT EDIREATALL KKNRPNIKRF TSSGFIDDLA RGDTCVTIGF

251 GGDLNIAKRR AEEAGGKEKI RVMMPKEGVG IWVDSFVIPK DAKNVANAHK

301 YINDFLDPEV SAKNGNFVTY APSSKPAREL MEDEFKNDNT IFPTEEDLKN

351 SFIMVPIQPA ALKFMVRQWQ DVKAGK*
```

Computer analysis of this amino acid sequence gave the following results:

Homology with a predicted ORF from *N. gonorrhoeae*

ORF 917 shows 97.6% identity over a 376 aa overlap with a predicted ORF (ORF 917.ng) from *N. gonorrhoeae*:

m917/g917

```
                   10        20        30        40        50        60
m917.pep  MTKHLPLAVLTALLLAACGGSDKPPAEKPAPAENQNVLKIYNWSEYVDPETVADFEKKNG
          |:||||||||||||||||||||||||||||||||||||||||||||||||||||||||||
g917      MVKHLPLAVLTALLLAACGGSDKPPAEKPAPAENQNVLKIYNWSEYVDPETVADFEKKNG
                   10        20        30        40        50        60

                   70        80        90       100       110       120
m917.pep  IKVTYDVYDSDETLESKVLTGKSGYDIVAPSNAFVGRQIKAGAYQKIDKSLIPNYKHLNP
          ||||||||||||||||||||||||||||||||||||||||||||||||||:|||||||||
g917      IKVTYDVYDSDETLESKVLTGKSGYDIVAPSNAFVGRQIKAGAYQKIDKSMIPNYKHLNP
                   70        80        90       100       110       120

                  130       140       150       160       170       180
m917.pep  EMMRLMDGVDPGHEYAVPFYWGTNTFAINTERVKKALGTDKLPDNQWDLVFDPEYTSKLK
          ||||||||||| |||||||||||||||||||||||||||||||||||||||:|||| |||
g917      EMMRLMDGVDPDHEYAVPFYWGTNTFAINTERVKKALGTDKLPDNQWDLVFNPEYTFKLK
                  130       140       150       160       170       180

                  190       200       210       220       230       240
m917.pep  QCGISYLDSAAEIYPMVLNYLGKNPNSSNTEDIREATALLKKNRPNIKRFTSSGFIDDLA
          ||||||||||||||||||||||||||||||||||||||||||||||||||||||||||||
g917      QCGISYLDSAAEIYPMVLNYLGKNPNSSNTEDIREATALLKKNRPNIKRFTSSGFIDDLA
                  190       200       210       220       230       240
```

-continued

```
                 250       260       270       280       290       300
m917.pep  RGDTCVTIGFGGDLNIAKRRAEEAGGKEKIRVMMPKEGVGIWVDSFVIPKDAKNVANAHK
          ||||||||||||||||||||||||||||||||||||||||||||||||||||||||||||
g917      RGDTCVTIGFGGDLNIAKRRAEEAGGKEKIRVMMPKEGVGIWVDSFVIPKDAKNVANAHK
                 250       260       270       280       290       300

                 310       320       330       340       350       360
m917.pep  YINDFLDPEVSAKNGNFVTYAPSSKPARELMEDEFKNDNTIFPTEEDLKNSFIMVPIQPA
          ||||||||||||||||||||||||||||:||||||||||||||: ||||||||||||:||
g917      YINDFLDPEVSAKNGNFVTYAPSSKPARDLMEDEFKNDNTIFPSGEDLKNSFIMVPIRPA
                 310       320       330       340       350       360

                 370
m917.pep  ALKFMVRQWQDVKAGKX
          ||||||||||||||||
g917      ALKFMVRQWQDVKAGKX
                 370
```

The following partial DNA sequence was identified in *N. meningitidis* <SEQ ID 2787>:

<u>a917.seq</u>

```
   1 ATGACCAAAC ATCTGCCCCT GGCCGTCCTG ACTGCTTTGC TGCTTGCAGC
  51 GTGCGGCGGT TCGGACAAAC CGCCTGCCGA AAAACCGGCG CCGGCGGAAA
 101 ACCGAAACGT ATTGAAAATT TACAACTGGT CGGAATACGT CGATCCGGAA
 151 ACCGTTGCCG ATTTTGAAAA GAAAAACGGC ATCAAGGTTA CTTATGATGT
 201 GTACGACAGC GATGAAACGC TGGAAAGCAA GGTGCTGACC GGAAAATCTG
 251 GTTACGACAT TGTCGCGCCG TCCAATGCGT TTGTGGGCAG GCAGATTAAG
 301 GCAGGTGCGT ATCAGAAAAT CGATAAGTCG CTGATTCCCA ATTATAAACA
 351 CCTCAACCCC GAAATGATGA GGCTGATGGA CGGGGTCGAT CCCGGCCACG
 401 AATACGCCGT GCCGTTTTAT TGGGGGACAA ATACCTTCGC CATCAATACC
 451 GAACGCGTGA AAAAGGCTTT GGGTACGGAC AAGCTGCCGG ACAACCAGTG
 501 GGATTTGGTG TTCGACCCCG AATACACGTC CAAACTCAAG CAATGCGGCA
 551 TCAGCTATTT GGACAGCGCG GCGGAAATCT ATCCTATGGT GTTGAACTAT
 601 TTGGGTAAAA ACCCGAACAG CAGCAATACG GAAGACATCA GGGAGGCAAC
 651 CGCCCTACTC AAGAAAAACC GCCCCAATAT CAAACGCTTT ACTTCGTCCG
 701 GCTTTATCGA TGATTTGGCG CGCGGCGATA CCTGCGTAAC AATCGGTTTC
 751 GGCGGCGATT TGAACATCGC CAAACGCCGT GCCGAAGAAG CGGGCGGCAA
 801 GGAAAAAATC CGCGTGATGA TGCCCAAAGA GGGCGTGGGG ATTTGGGTGG
 851 ATTCTTTCGT GATTCCGAAA GATGCGAAAA ACGTCGCCAA CGCGCACAAA
 901 TACATCAACG ACTTCCTCGA CCCGGAAGTG TCGGCGAAAA ACGGCAATTT
 951 CGTTACTTAC GCGCCTTCGA GCAAGCCTGC GCGTGAGCTG ATGGAAGACG
1001 AATTTAAAAA CGACAATACG ATTTTCCCAA CCGAGGAGGA TTTGAAAAAC
1051 AGCTTTATCA TGGTGCCTAT CCAGCCGGCG GCATTGAAGT TTATGGTGCG
1101 CCAGTGGCAG GATGTGAAGG CGGGGAAATA A
```

This corresponds to the amino acid sequence <SEQ ID 2788; ORF 917.a>:

a917.pep

```
  1 MTKHLPLAVL TALLLAACGG SDKPPAEKPA PAENRNVLKI YNWSEYVDPE

 51 TVADFEKKNG IKVTYDVYDS DETLESKVLT GKSGYDIVAP SNAFVGRQIK

101 AGAYQKIDKS LIPNYKHLNP EMMRLMDGVD PGHEYAVPFY WGTNTFAINT

151 ERVKKALGTD KLPDNQWDLV FDPEYTSKLK QCGISYLDSA AEIYPMVLNY

201 LGKNPNSSNT EDIREATALL KKNRPNIKRF TSSGFIDDLA RGDTCVTIGF

251 GGDLNIAKRR AEEAGGKEKI RVMMPKEGVG IWVDSFVIPK DAKNVANAHK

301 YINDFLDPEV SAKNGNFVTY APSSKPAREL MEDEFKNDNT IFPTEEDLKN

351 SFIMVPIQPA ALKFMVRQWQ DVKAGK*
```

m917/a917 99.7% identity in 376 aa overlap

```
                   10        20        30        40        50        60
m917.pep   MTKHLPLAVLTALLLAACGGSDKPPAEKPAPAENQNVLKIYNWSEYVDPETVADFEKKNG
           ||||||||||||||||||||||||||||||||||:|||||||||||||||||||||||||
a917       MTKHLPLAVLTALLLAACGGSDKPPAEKPAPAENRNVLKIYNWSEYVDPETVADFEKKNG
                   10        20        30        40        50        60
                   70        80        90       100       110       120
m917.pep   IKVTYDVYDSDETLESKVLTGKSGYDIVAPSNAFVGRQIKAGAYQKIDKSLIPNYKHLNP
           ||||||||||||||||||||||||||||||||||||||||||||||||||||||||||||
a917       IKVTYDVYDSDETLESKVLTGKSGYDIVAPSNAFVGRQIKAGAYQKIDKSLIPNYKHLNP
                   70        80        90       100       110       120
                  130       140       150       160       170       180
m917.pep   EMMRLMDGVDPGHEYAVPFYWGTNTFAINTERVKKALGTDKLPDNQWDLVFDPEYTSKLK
           ||||||||||||||||||||||||||||||||||||||||||||||||||||||||||||
a917       EMMRLMDGVDPGHEYAVPFYWGTNTFAINTERVKKALGTDKLPDNQWDLVFDPEYTSKLK
                  130       140       150       160       170       180
                  190       200       210       220       230       240
m917.pep   QCGISYLDSAAEIYPMVLNYLGKNPNSSNTEDIREATALLKKNRPNIKRFTSSGFIDDLA
           ||||||||||||||||||||||||||||||||||||||||||||||||||||||||||||
a917       QCGISYLDSAAEIYPMVLNYLGKNPNSSNTEDIREATALLKKNRPNIKRFTSSGFIDDLA
                  190       200       210       220       230       240
                  250       260       270       280       290       300
m917.pep   RGDTCVTIGFGGDLNIAKRRAEEAGGKEKIRVMMPKEGVGIWVDSFVIPKDAKNVANAHK
           ||||||||||||||||||||||||||||||||||||||||||||||||||||||||||||
a917       RGDTCVTIGFGGDLNIAKRRAEEAGGKEKIRVMMPKEGVGIWVDSFVIPKDAKNVANAHK
                  250       260       270       280       290       300
                  310       320       330       340       350       360
m917.pep   YINDFLDPEVSAKNGNFVTYAPSSKPARELMEDEFKNDNTIFPTEEDLKNSFIMVPIQPA
           ||||||||||||||||||||||||||||||||||||||||||||||||||||||||||||
a917       YINDFLDPEVSAKNGNFVTYAPSSKPARELMEDEFKNDNTIFPTEEDLKNSFIMVPIQPA
                  310       320       330       340       350       360
                  370
m917.pep   ALKFMVRQWQDVKAGKX
           ||||||||||||||||
a917       ALKFMVRQWQDVKAGKX
                  370
```

The following partial DNA sequence was identified in *N. gonorrhoeae* <SEQ ID 2789>:

g919.seq

```
  1 ATGAAAAAAC ACCTGCTCCG CTCCGCCCTG TACGGcatCG CCGCCgccAT

 51 CctcgCCGCC TGCCAAAgca gGAGCATCCA AACCTTTCCG CAACCCGACA

101 CATCCGTCAT CAACGGCCCG GACCGGCCGG CCGGCATCCC CGACCCCGCC

151 GGAACGACGG TTGCCGGCGG CGGGGCCGTC TATACCGTTG TGCCGCACCT

201 GTCCATGCCC CACTGGGCGG CGCaggATTT TGCCAAAAGC CTGCAATCCT

251 TCCGCCTCGG CTGCGCCAAT TTGAAAAACC GCCAAGGCTG GCAGGATGTG
```

-continued
```
 301 TGCGCCCAAG CCTTTCAAAC CCCCGTGCAT TCCTTTCAGG CAAAGcGgTT
 351 TTTTGAACGC TATTTCACGC cgtGGCaggt tgcaggcaAC GGAAGcCTTG
 401 Caggtacggt TACCGGCTAT TACGAACCGG TGCTGAAGGG CGACGGCAGG
 451 CGGACGGAAC GGGCCCGCTT CCCGATTTAC GGTATTCCCG ACGATTTTAT
 501 CTCCGTCCCG CTGCCTGCCG GTTTGCGGGG CGGAAAAAAC CTTGTCCGCA
 551 TCAGGCAGac ggGGAAAAAC AGCGGCACGA TCGACAATGC CGGCGGCACG
 601 CATACCGCCG ACCTCTCCCG ATTCCCCATC ACCGCGCGCA CAACGGcaat
 651 caaaGGCAGG TTTGAaggAA GCCGCTTCCT CCCTTACCAC ACGCGCAACC
 701 AAAtcaacGG CGGCgcgcTT GACGGCAAag cccCCATCCT CggttacgcC
 751 GAagaccCcG tcgaacttTT TTTCATGCAC AtccaaggCT CGGGCCGCCT
 801 GAAAACCCcg tccggcaaat acatCCGCAt cggaTacgcc gacAAAAACG
 851 AACAtccgTa tgtttccatc ggACGctaTA TGGCGGACAA AGGCTACCTC
 901 AAGctcgggc agACCTCGAT GCAGGgcatc aaagcCTATA TGCGGCAAAA
 951 TCCGCAACGC CTCGCCGAAG TTTTGGGTCA AACCCCAGC TATATCTTTT
1001 TCCGCGAGCT TGCCGGAAGC GGCAATGAGG GCCCCGTCGG CGCACTGGGC
1051 ACGCCACTGA TGGGGAATA CGCCGGCGCA ATCGACCGGC ACTACATTAC
1101 CTTGGGCGCG CCCTTATTTG TCGCCACCGC CCATCCGGTT ACCCGCAAAG
1151 CCCTCAACCG CCTGATTATG GCGCAGGATA CAGGCAGCGC GATCAAAGGC
1201 GCGGTGCGCG TGGATTATTT TTGGGGTTAC GGCGACGAAG CCGGCGAACT
1251 TGCCGGCAAA CAGAAAACCA CGGGATACGT CTGGCAGCTC CTGCCCAACG
1301 GCATGAAGCC CGAATACCGC CCGTGA
```

This corresponds to the amino acid sequence <SEQ ID 2790; ORF 919.ng>:

g919.pep
```
  1 MKKHLLRSAL YGIAAAILAA CQSRSIQTFP QPDTSVINGP DRPAGIPDPA
 51 GTTVAGGGAV YTVVPHLSMP HWAAQDFAKS LQSFRLGCAN LKNRQGWQDV
101 CAQAFQTPVH SFQAKRFFER YFTPWQVAGN GSLAGTVTGY YEPVLKGDGR
151 RTERARFPIY GIPDDFISVP LPAGLRGGKN LVRIRQTGKN SGTIDNAGGT
201 HTADLSRFPI TARTTAIKGR FEGSRFLPYH TRNQINGGAL DGKAPILGYA
251 EDPVELFFMH IQGSGRLKTP SGKYIRIGYA DKNEHPYVSI GRYMADKGYL
301 KLGQTSMQGI KAYMRQNPQR LAEVLGQNPS YIFFRELAGS GNEGPVGALG
351 TPLMGEYAGA IDRHYITLGA PLFVATAHPV TRKALNRLIM AQDTGSAIKG
401 AVRVDYFWGY GDEAGELAGK QKTTGYVWQL LPNGMKPEYR P*
```

The following partial DNA sequence was identified in *N. meningitidis* <SEQ ID 2791>:

m919.seq

```
  1 ATGAAAAAAT ACCTATTCCG CGCCGCCCTG TACGGCATCG CCGCCGCCAT

51 CCTCGCCGCC TGCCAAAGCA AGAGCATCCA AACCTTTCCG CAACCCGACA
```

-continued

```
 101 CATCCGTCAT CAACGGCCCG GACCGGCCGG TCGGCATCCC CGACCCCGCC
 151 GGAACGACGG TCGGCGGCGG CGGGGCCGTC TATACCGTTG TACCGCACCT
 201 GTCCCTGCCC CACTGGGCGG CGCAGGATTT CGCCAAAAGC CTGCAATCCT
 251 TCCGCCTCGG CTGCGCCAAT TTGAAAAACC GCCAAGGCTG GCAGGATGTG
 301 TGCGCCCAAG CCTTTCAAAC CCCCGTCCAT TCCTTTCAGG CAAAACAGTT
 351 TTTTGAACGC TATTTCACGC CGTGGCAGGT TGCAGGCAAC GGAAGCCTTG
 401 CCGGTACGGT TACCGGCTAT TACGAACCGG TGCTGAAGGG CGACGACAGG
 451 CGGACGGCAC AAGCCCGCTT CCCGATTTAC GGTATTCCCG ACGATTTTAT
 501 CTCCGTCCCC CTGCCTGCCG GTTTGCGGAG CGGAAAAGCC CTTGTCCGCA
 551 TCAGGCAGAC GGGAAAAAAC AGCGGCACAA TCGACAATAC CGGCGGCACA
 601 CATACCGCCG ACCTCTCCcG ATTCCCCATC ACCGCGCGCA CAACAGCAAT
 651 CAAAGGCAGG TTTGAAGGAA GCCGCTTCCT CCCCTACCAC ACGCGCAACC
 701 AAATCAACGG CGGCGCGCTT GACGGCAAAG CCCCGATACT CGGTTACGCC
 751 GAAGACCCTG TCGAACTTTT TTTTATGCAC ATCCAAGGCT CGGGCCGTCT
 801 GAAAACCCCG TCCGGCAAAT ACATCCGCAT CGGCTATGCC GACAAAAACG
 851 AACATCCyTA CGTTTCCATC GGACGCTATA TGGCGGATAA GGGCTACCTC
 901 AAACTCGGAC AAACCTCCAT GCAGGGCATT AAGTCTTATA TGCGGCAAAA
 951 TCCGCAACGC CTCGCCGAAG TTTTGGGTCA AAACCCCAGC TATATCTTTT
1001 TCCGCGAGCT TGCCGGAAGC AGCAATGACG GCCCTGTCGG CGCACTGGGC
1051 ACGCCGCTGA TGGGGGAATA TGCCGGCGCA GTCGACCGGC ACTACATTAC
1101 CTTGGGTGCG CCCTTATTTG TCGCCACCGC CCATCCGGTT ACCCGCAAAG
1151 CCCTCAACCG CCTGATTATG GCGCAGGATA CCGGCAGCGC GATTAAAGGC
1201 GCGGTGCGCG TGGATTATTT TTGGGGATAC GGCGACGAAG CCGGCGAACT
1251 TGCCGGCAAA CAGAAAACCA CGGGATATGT CTGGCAGCTC CTACCCAACG
GTATGAAGCC CGAATACCGc CCGTAA
```

This corresponds to the amino acid sequence <SEQ ID 2792; ORF 919>:

<u>m919.pep</u>

```
  1 MKKYLFRAAL YGIAAAILAA CQSKSIQTFP QPDTSVINGP DRPVGIPDPA
 51 GTTVGGGGAV YTVVPHLSLP HWAAQDFAKS LQSFRLGCAN LKNRQGWQDV
101 CAQAFQTPVH SFQAKQFFER YFTPWQVAGN GSLAGTVTGY YEPVLKGDDR
151 RTAQARFPIY GIPDDFISVP LPAGLRSGKA LVRIRQTGKN SGTIDNTGGT
201 HTADLSRFPI TARTTAIKGR FEGSRFLPYH TRNQINGGAL DGKAPILGYA
251 EDPVELFFMH IQGSGRLKTP SGKYIRIGYA DKNEHPYVSI GRYMADKGYL
301 KLGQTSMQGI KSYMRQNPQR LAEVLGQNPS YIFFRELAGS SNDGPVGALG
351 TPLMGEYAGA VDRHYITLGA PLFVATAHPV TRKALNRLIM AQDTGSAIKG
401 AVRVDYFWGY GDEAGELAGK QKTTGYVWQL LPNGMKPEYR P*
```

Computer analysis of this amino acid sequence gave the following results:

Homology with a predicted ORF from *N. gonorrhoeae*

ORF 919 shows 95.9% identity over a 441 aa overlap with a predicted ORF (ORF 919.ng) from *N. gonorrhoeae*:

m919/g919

```
                  10        20        30        40        50        60
m919.pep  MKKYLFRAALYGIAAAILAACQSKSIQTFPQPDTSVINGPDRPVGIPDPAGTTVGGGGAV
          |||:|:|:|||||||||||||||:|||||||||||||||||||:||||||||||:|||||
g919      MKKHLLRSALYGIAAAILAACQSRSIQTFPQPDTSVINGPDRPAGIPDPAGTTVAGGGAV
                  10        20        30        40        50        60

                  70        80        90       100       110       120
m919.pep  YTVVPHLSLPHWAAQDFAKSLPSFRLGCANLKNRQGWQDVCAQAFQTPVHSFQAKQFFER
          ||||||||:||||||||||||||||||||||||||||||||||||||||||||||:||||
g919      YTVVPHLSMPHWAAQDFAKSLPSFRLGCANLKNRQGWQDVCAQAFQTPVHSFQAKRFFER
                  70        80        90       100       110       120

                 130       140       150       160       170       180
m919.pep  YFTPWQVAGNGSLAGTVTGYYEPVLKGDDRRTAQARFPIYGIPDDFISVPLPAGLRSGKA
          |||||||||||||||||||||||||||| ||| :||||||||||||||||||||||:|| 
g919      YFTPWQVAGNGSLAGTVTGYYEPVLKGDGRRTERARFPIYGIPDDFISVPLPAGLRGGKN
                 130       140       150       160       170       180

                 190       200       210       220       230       240
m919.pep  LVRIRQTGKNSGTIDNTGGTHTADLSRFPITARTTAIKGRFEGSRFLPYHTRNQINGGAL
          ||||||||||||||||:|||||||||||||||||||||||||||||||||||||||||||
g919      LVRIRQTGKNSGTIDNAGGTHTADLSRFPITARTTAIKGRFEGSRFLPYHTRNQINGGAL
                 190       200       210       220       230       240

                 250       260       270       280       290       300
m919.pep  DGKAPILGYAEDPVELFFMHIQGSGRLKTPSGKYIRIGYADKNEHPYVSIGRYMADKGYL
          ||||||||||||||||||||||||||||||||||||||||||||||||||||||||||||
g919      DGKAPILGYAEDPVELFFMHIQGSGRLKTPSGKYIRIGYADKNEHPYVSIGRYMADKGYL
                 250       260       270       280       290       300

                 310       320       330       340       350       360
m919.pep  KLGQTSMQGIKSYMRQNPQRLAEVLGQNPSYIFFRELAGSSNDGPVGALGTPLMGEYAGA
          |||||||||||:||||||||||||||||||||||||||||:|:|||||||||||||||||
g919      KLGQTSMQGIKAYMRQNPQRLAEVLGQNPSYIFFRELAGSGNEGPVGALGTPLMGEYAGA
                 310       320       330       340       350       360

                 370       380       390       400       410       420
m919.pep  VDRHYITLGAPLFVATAHPVTRKALNRLIMAQDTGSAIKGAVRVDYFWGYGDEAGELAGK
          :|||||||||||||||||||||||||||||||||||||||||||||||||||||||||||
g919      IDRHYITLGAPLFVATAHPVTRKALNRLIMAQDTGSAIKGAVRVDYFWGYGDEAGELAGK
                 370       380       390       400       410       420

                 430       440
m919.pep  QKTTGYVWQLLPNGMKPEYRPX
          ||||||||||||||||||||||
g919      QKTTGYVWQLLPNGMKPEYRPX
                 430       440
```

The following partial DNA sequence was identified in *N. meningitidis* <SEQ ID 2793>:

a919.seq

```
  1 ATGAAAAAAT ACCTATTCCG CGCCGCCCTG TGCGGCATCG CCGCCGCCAT
 51 CCTCGCCGCC TGCCAAAGCA AGAGCATCCA AACCTTTCCG CAACCCGACA
101 CATCCGTCAT CAACGGCCCG GACCGGCCGG TCGGCATCCC CGACCCCGCC
151 GGAACGACGG TCGGCGGCGG CGGGGCCGTT TATACCGTTG TGCCGCACCT
201 GTCCCTGCCC CACTGGGCGG CGCAGGATTT CGCCAAAAGC CTGCAATCCT
251 TCCGCCTCGG CTGCGCCAAT TTGAAAAACC GCCAAGGCTG GCAGGATGTG
301 TGCGCCCAAG CCTTTCAAAC CCCCGTCCAT TCCGTTCAGG CAAAACAGTT
351 TTTTGAACGC TATTTCACGC CGTGGCAGGT TGCAGGCAAC GGAAGCCTTG
401 CCGGTACGGT TACCGGCTAT TACGAGCCGG TGCTGAAGGG CGACGACAGG
451 CGGACGGCAC AAGCCCGCTT CCCGATTTAC GGTATTCCCG ACGATTTTAT
501 CTCCGTCCCC CTGCCTGCCG GTTTGCGGAG CGGAAAAGCC CTTGTCCGCA
```

-continued

```
 551 TCAGGCAGAC GGGAAAAAAC AGCGGCACAA TCGACAATAC CGGCGGCACA

 601 CATACCGCCG ACCTCTCCCA ATTCCCCATC ACTGCGCGCA CAACGGCAAT

 651 CAAAGGCAGG TTTGAAGGAA GCCGCTTCCT CCCCTACCAC ACGCGCAACC

 701 AAATCAACGG CGGCGCGCTT GACGGCAAAG CCCCGATACT CGGTTACGCC

 751 GAAGACCCCG TCGAACTTTT TTTTATGCAC ATCCAAGGCT CGGGCCGTCT

 801 GAAAACCCCG TCCGGCAAAT ACATCCGCAT CGGCTATGCC GACAAAAACG

 851 AACATCCCTA CGTTTCCATC GGACGCTATA TGGCGGACAA AGGCTACCTC

 901 AAGCTCGGGC AGACCTCGAT GCAGGGCATC AAAGCCTATA TGCAGCAAAA

 951 CCCGCAACGC CTCGCCGAAG TTTTGGGGCA AAACCCCAGC TATATCTTTT

1001 TCCGAGAGCT TACCGGAAGC AGCAATGACG GCCCTGTCGG CGCACTGGGC

1051 ACGCCGCTGA TGGGCGAGTA CGCCGGCGCA GTCGACCGGC ACTACATTAC

1101 CTTGGGCGCG CCCTTATTTG TCGCCACCGC CCATCCGGTT ACCCGCAAAG

1151 CCCTCAACCG CCTGATTATG GCGCAGGATA CCGGCAGCGC GATTAAAGGC

1201 GCGGTGCGCG TGGATTATTT TTGGGGATAC GGCGACGAAG CCGGCGAACT

1251 TGCCGGCAAA CAGAAAACCA CGGGATATGT CTGGCAGCTT CTGCCCAACG

1301 GTATGAAGCC CGAATACCGC CCGTAA
```

This corresponds to the amino acid sequence <SEQ ID 2794; ORF 919.a>:

```
a919.pep

  1 MKKYLFRAAL CGIAAAILAA CQSKSIQTFP QPDTSVINGP DRPVGIPDPA

 51 GTTVGGGGAV YTVVPHLSLP HWAAQDFAKS LQSFRLGCAN LKNRQGWQDV

101 CAQAFQTPVH SVQAKQFFER YFTPWQVAGN GSLAGTVTGY YEPVLKGDDR

151 RTAQARFPIY GIPDDFISVP LPAGLRSGKA LVRIRQTGKN SGTIDNTGGT

201 HTADLSQFPI TARTTAIKGR FEGSRFLPYH TRNQINGGAL DGKAPILGYA

251 EDPVELFFMH IQGSGRLKTP SGKYIRIGYA DKNEHPYVSI GRYMADKGYL

301 KLGQTSMQGI KAYMQQNPQR LAEVLGQNPS YIFFRELTGS SNDGPVGALG

351 TPLMGEYAGA VDRHYITLGA PLFVATAHPV TRKALNRLIM AQDTGSAIKG

401 AVRVDYFWGY GDEAGELAGK QKTTGYVWQL LPNGMKPEYR P*
```

m919/a919 98.6% identity in 441 aa overlap

```
                   10        20        30        40        50        60
m919.pep  MKKYLFRAALYGIAAAILAACQSKSIQTFPQPDTSVINGPDRPVGIPDPAGTTVGGGGAV
          |||||||||| |||||||||||||||||||||||||||||||||||||||||||||||||
a919      MKKYLFRAALCGIAAAILAACQSKSIQTFPQPDTSVINGPDRPVGIPDPAGTTVGGGGAV
                   10        20        30        40        50        60

                   70        80        90       100       110       120
m919.pep  YTVVPHLSLPHWAAQDFAKSLQSFRLGCANLKNRQGWQDVCAQAFQTPVHSFQAKQFFER
          ||||||||||||||||||||||||||||||||||||||||||||||||||| ||||||||
a919      YTVVPHLSLPHWAAQDFAKSLQSFRLGCANLKNRQGWQDVCAQAFQTPVHSVQAKQFFER
                   70        80        90       100       110       120

                  130       140       150       160       170       180
m919.pep  YFTPWQVAGNGSLAGTVTGYYEPVLKGDDRRTAQARFPIYGIPDDFISVPLPAGLRSGKA
          ||||||||||||||||||||||||||||||||||||||||||||||||||||||||||||
a919      YFTPWQVAGNGSLAGTVTGYYEPVLKGDDRRTAQARFPIYGIPDDFISVPLPAGLRSGKA
                  130       140       150       160       170       180
```

-continued

```
              190       200       210       220       230       240
m919.pep   LVRIRQTGKNSGTIDNTGGTHTADLSRFPITARTTAIKGRFEGSRFLPYHTRNQINGGAL
           ||||||||||||||||||||||||:|||||||||||||||||||||||||||||||||||
a919       LVRIRQTGKNSGTIDNTGGTHTADLSQFPITARTTAIKGRFEGSRFLPYHTRNQINGGAL
              190       200       210       220       230       240

              250       260       270       280       290       300
m919.pep   DGKAPILGYAEDPVELFFMHIQGSGRLKTPSGKYIRIGYADKNEHPYVSIGRYMADKGYL
           ||||||||||||||||||||||||||||||||||||||||||||||||||||||||||||
a919       DGKAPILGYAEDPVELFFMHIQGSGRLKTPSGKYIRIGYADKNEHPYVSIGRYMADKGYL
              250       260       270       280       290       300

              310       320       330       340       350       360
m919.pep   KLGQTSMQGIKSYMRQNPQRLAEVLGQNPSYIFFRELAGSSNDGPVGALGTPLMGEYAGA
           ||||||||||:||:||||||||||||||||||||||:|||||||||||||||||||||||
a919       KLGQTSMQGIKAYMQQNPQRLAEVLGQNPSYIFFRELTGSSNDGPVGALGTPLMGEYAGA
              310       320       330       340       350       360

              370       380       390       400       410       420
m919.pep   VDRHYITLGAPLFVATAHPVTRKALNRLIMAQDTGSAIKGAVRVDYFWGYGDEAGELAGK
           ||||||||||||||||||||||||||||||||||||||||||||||||||||||||||||
a919       VDRHYITLGAPLFVATAHPVTRKALNRLIMAQDTGSAIKGAVRVDYFWGYGDEAGELAGK
              370       380       390       400       410       420

              430       440
m919.pep   QKTTGYVWQLLPNGMKPEYRPX
           ||||||||||||||||||||||
a919       QKTTGYVWQLLPNGMKPEYRPX
              430       440
```

Expression of ORF 919

The primer described in Example 1 for ORF 919 was used to locate and clone ORF 919. This sequence was purified and expressed in *E. coli* as provided in FIG. 1 #. The hydrophilicity plots, antigenic index, and amphipatic regions of ORF 919 is provided in FIG. 5 #. The AMPHI program is used to predict putative T-cell epitopes (Gao et al 1989, *J. Immunol* 143:3007; Roberts et al. 1996, *AIDS Res Human Retroviruses* 12:593; Quakyi et al. 1992, *Scand J Immunol Suppl* 11:9). The nucleic acid sequence of ORF 919 is provided in Exhibit C #.

The following partial DNA sequence was identified in *N. gonorrhoeae* <SEQ ID 2795>:

g920.seq (partial)

```
  1 ..ccgatgcagc tggttaccga aaaAGGTAAG GAAAACATGA TTCAACGCGG
 51   CACATACAAC TACCAATACC GCAGCAACCG TCCCGTCAAA GACGGCAGCT
101   ACCTCGTTAC CGCCGAATAT CAGCCTACTT TCCGGTCAAA AAACAAAGCA
151   GGCTGGAAAC AGGCTGGCAT CAAAGAAATG CCTGACGCAA GCTATTGCGA
201   ACAAACCCGT ATGTTCGGTA AAAACATTGT CAACGTGGGA CACGAAAGCG
251   CGGACACCGC CATCATCACC AAACCGGTCG GACAAAACTT GGAAATCGTC
301   CCGCTGGACA ATCccgccga caTTCACgtg ggctaacgCt tcaaaGTccg
351   cgttCtgttc cgtGGCgaac cgCTGcccaa tgccACCgtt accgCtacAT
401   TTGacggctt cGAcaccagc gaccgcagca aaacgcacaa Aaccgaagcc
451   caagcctTCT ccgacaccac cgacggcgaa ggcgaagtgg acatcatCCC
501   CTTGCgccaa GGCTTttgga aAgcGAGTGT CGAATAcaaa gccgAtttcc
551   CCGATcaaAG CCTGTGccga AAACAggcgA ACTACaCaac TTtaaccttc
601   caaatcgccc attctCacca tTAa
```

This corresponds to the amino acid sequence <SEQ ID 2796; ORF 920.ng>:

g920.pep (partial)

```
  1 ..PMQLVTEKGK ENMIQRGTYN YQYRSNRPVK DGSYLVTAEY QPTFRSKNKA
 51   GWKQAGIKEM PDASYCEQTR MFGKNIVNVG HESADTAIIT KPVGQNLEIV
```

-continued

```
101   PLDNPADIHV GXRFKVRVLF RGEPLPNATV TATFDGFDTS DRSKTHKTEA
151   QAFSDTTDGE GEVDIIPLRQ GFWKASVEYK ADFPDQSLCR KQANYTTLTF
201   QIAHSHH*
```

The following partial DNA sequence was identified in *N. meningitidis* <SEQ ID 2797>:

m920.seq

```
  1 ATGAAGAAAA CATTGACACT GCTCTCCGTT TCCGCCCTAT TTGCCACATC
 51 CGCCCACGCC CACCGmGTCT GGGTCGAAAC CGCCCACACG CACGGCGGCG
101 AATACCTTAA AGCCGACTTG GGCTACGGCG AATTTCCCGA ACTCGAACCC
151 ATCGCCAAAG ACCGCCTGCA CATCTTCAGC AAACCGATGC AGCTGGTTAC
201 CGAAAAAGGC AAGGAAAACA TGATTCAACG CGGCACATAC AACTACCAGT
251 ACCGAAGCAA CCGTCCCGTT AAGGACGGCA GTTACCTCGT CATCGCCGAA
301 TATCAGCCTA CTTTCTGGTC AAAAwACAAA GCAGGCTGGA AACAGGCGGG
351 CATCAAAGAA ATGCCTGACG CAAGCTATTG CGAACAAACC CGAATGTTCG
401 GCAAAAACAT CGTCAACGTC GGACACGAAA GCGCGGACAC CGCCATCATC
451 ACCAArCCGG TCGGACAAAA CTTGGAAATC GTCCCGCTGG ACAATCCCGC
501 CAACATTCAC GTAGGCGAAC GCTTCAAAGT CCGCGTTCTG TTCCGTGGCG
551 AACCGCTGCC CAATGCCACC GTTACCGCCA CCTTTGACGG CTTCGACACC
601 AGCGACCGCA GCAAAACGCA CAAwmCCGAA GCACAGGCTT TCTCCGACAG
651 CACAGACGAC AAAGGCGAAG TGGACATCAT CmCCTTGCGC CAAGGCTTCT
701 GGAAAGCCAA TGTCGAACAC AAAACCGACT TCCCCGATCA AAGCGTGTGC
751 CAAAAACAGG CGAACTACTC GACTTTAACC TTCCAAATCG GTCATTCGCA
801 CCATTAA
```

This corresponds to the amino acid sequence <SEQ ID 2798; ORF 920>:

m320.pep

```
  1 MKKTLTLLSV SALFATSAHA HRVWVETAHT HGGEYLKADL GYGEFPELEP
 51 IAKDRLHIFS KPMQLVTEKG KENMIQRGTY NYQYRSNRPV KDGSYLVIAE
101 YQPTFWSKXK AGWKQAGIKE MPDASYCEQT RMFGKNIVNV GHESADTAII
151 TKPVGQNLEI VPLDNPANIH VGERFKVRVL FRGEPLPNAT VTATFDGFDT
201 SDRSKTHXXE AQAFSDSTDD KGEVDIIXLR QGFWKANVEH KTDFPDQSVC
251 QKQANYSTLT FQIGHSHH*
```

Computer analysis of this amino acid sequence gave the following results:

Homology with a predicted ORF from *N. gonorrhoeae*

ORF 920 shows 91.3% identity over a 207 aa overlap with a predicted ORF (ORF 920.ng) from *N. gonorrhoeae*:

g920/m920

```
                                                  10        20        30
g920.pep                                PMQLVTEKGKENMIQRGTYNYQYRSNRPVK
                                        ||||||||||||||||||||||||||||||
m920          GGEYLKADLGYGEFPELEPIAKDRLHIFSKPMQLVTEKGKENMIQRGTYNYQYRSNRPVK
                      40        50        60        70        80        90

                      40        50        60        70        80        90
g920.pep      DGSYLVTAEYQPTFRSKNKAGWKQAGIKEMPDASYCEQTRMFGKNIVNVGHESADTAIIT
              |||||| ||||||| || ||||||||||||||||||||||||||||||||||||||||||
m920          DGSYLVIAEYQPTFWSKXKAGWKQAGIKEMPDASYCEQTRMFGKNIVNVGHESADTAIIT
                    100       110       120       130       140       150

                     100       110       120       130       140       150
g920.pep      KPVGQNLEIVPLDNPADIHVGXRFKVRVLFRGEPLPNATVTATFDGFDTSDRSKTHKTEA
              ||||||||||||||||:|||| |||||||||||||||||||||||||||||||||| :||
m920          KPVGQNLEIVPLDNPANIHVGERFKVRVLFRGEPLPNATVTATFDGFDTSDRSKTHXXEA
                    160       170       180       190       200       210

                     160       170       180       190       200
g920.pep      QAFSDTTDGEGEVDIIPLRQGFWKASVEYKADFPDQSLCRKQANYTTLTFQIAHSHHX
              |||||:|| :|||||| ||||||||:||:|:||||||:|:|||||:||||||:|||||
m920          QAFSDSTDDKGEVDIIXLRQGFWKANVEHKTDFPDQSVCQKQANYSTLTFQIGHSHHX
                    220       230       240       250       260
```

The following partial DNA sequence was identified in *N. meningitidis* <SEQ ID 2799>:

a920.seq

```
  1 TGAAAGAAAA CATTGACACT GCTCGCCGTT TCCGCCCTAT TTGCCGCATC

 51 CGCCCACGCC CACCGCGTCT GGGTCGAAAC CGCCCACACG CACGGCGGCG

101 AATACCTTAA AGCCGACTTG GGCTACGGCG AATTTCCCGA ACTCGAACCC

151 ATCGCCAAAG ACCGCCTGCA CATCTTCAGC AAACCGATGC AGCTGGTTAC

201 CGAAAAAGGC AAGGAAAACA TGATTCAACG CGGCACATAC AACTACCAGT

251 ACCGAAGCAA CCGTCCCGTT AAGGACGGCA GTTACCTCGT CATCGCCGAA

301 TATCAGCCTA CTTTCTGGTC AAAAAACAAA GCAGGCTGGA AACAGGCGGG

351 CATCAAACAA ATGCCTGACG CAAGCTATTG CGAACAAACC CGAATGTTCG

401 GCAAAAACAT CGTCAACGTC GGACACGAAA GCGCGGACAC CGCCATCATC

451 ACCAAACCGG TCGGACAAAA CTTGGAAATC GTCCCGCTGG ACAATCCCGC

501 CAACATTCAC GTAGGCGAAC GCTTCAAAGT CCGCGTTCTG TTCCGTGGCG

551 AACCGCTGCC CAATGCCACC GTTACCGCCA CCTTTGACGG CTTCGACACC

601 AGCGACCGCA GCAAAACGCA CAAAACCGAA GCACAGGCTT TCTCCGACAG

651 CACAGACGAC AAAGGCGAAG TGGACATCAT CCCCTTGCGC CAAGGCTTCT

701 GGAAAGCCAA TGTCGAACAC AAAGCCGACT TCCCCGATCA AAGCGTGTGC

751 CAAAAACAGG CGAACTACTC GACTTTAACC TTCCAAATCG GCCATTCGCA

801 CCATTAA
```

This corresponds to the amino acid sequence <SEQ ID 2800; ORF 920.a>:

a920.pep

```
  1 *KKTLTLLAV SALFAASAHA HRVWVETAHT HGGEYLKADL GYGEFPELEP

 51 IAKDRLHIFS KPMQLVTEKG KENMIQRGTY NYQYRSNRPV KDGSYLVIAE

101 YQPTFWSKNK AGWKQAGIKQ MPDASYCEQT RMFGKNIVNV GHESADTAII
```

-continued

```
151 TKPVGQNLEI VPLDNPANIH VGERFKVRVL FRGEPLPNAT VTATFDGFDT

201 SDRSKTHKTE AQAFSDSTDD KGEVDIIPLR QGFWKANVEH KADFPDQSVC

251 QKQANYSTLT FQIGHSHH*
```

m920/a920 97.0% identity in 267 aa overlap

```
                   10        20        30        40        50        60
m920.pep   MKKTLTLLSVSALFATSAHAHRVWVETAHTHGGEYLKADLGYGEFPELEPIAKDRLHIFS
            |||||||:||||||:||||||||||||||||||||||||||||||||||||||||||||
a920       XKKTLTLLAVSALFAASAHAHRVWVETAHTHGGEYLKADLGYGEFPELEPIAKDRLHIFS
                   10        20        30        40        50        60

                   70        80        90       100       110       120
m920.pep   KPMQLVTEKGKENMIQRGTYNYQYRSNRPVKDGSYLVIAEYQPTFWSKXKAGWKQAGIKE
           |||||||||||||||||||||||||||||||||||||||||||||||| ||||||||||:
a920       KPMQLVTEKGKENMIQRGTYNYQYRSNRPVKDGSYLVIAEYQPTFWSKNKAGWKQAGIKQ
                   70        80        90       100       110       120

                  130       140       150       160       170       180
m920.pep   MPDASYCEQTRMFGKNIVNVGHESADTAIITKPVGQNLEIVPLDNPANIHVGERFKVRVL
           ||||||||||||||||||||||||||||||||||||||||||||||||||||||||||||
a920       MPDASYCEQTRMFGKNIVNVGHESADTAIITKPVGQNLEIVPLDNPANIHVGERFKVRVL
                  130       140       150       160       170       180

                  190       200       210       220       230       240
m920.pep   FRGEPLPNATVTATFDGFDTSDRSKTHXXEAQAFSDSTDDKGEVDIIXLRQGFWKANVEH
           ||||||||||||||||||||||||||| :|||||||||||||||||| ||||||||||||
a920       FRGEPLPNATVTATFDGFDTSDRSKTHKTEAQAFSDSTDDKGEVDIIPLRQGFWKANVEH
                  190       200       210       220       230       240

                  250       260      269
m920.pep   KTDFPDQSVCQKQANYSTLTFQIGHSHHX
           |:|||||||||||||||||||||||||||
a920       KADFPDQSVCQKQANYSTLTFQIGHSHHX
                  250       260
```

The following partial DNA sequence was identified in *N. gonorrhoeae* <SEQ ID 2801>:

g920-1.seq

```
  1 ATGAAGAAAA CATTGACACT GCTCGCcgtt TcCGCACTAT TTGCCACATc

 51 cgCaCACCCC CACCgCGTCT GGGTCGAAAC CgccCACACg cAcgGCGGCG

101 AATACCTTAA AGCCGACTTG GGCTACGGCG AATTCCCCGA ACTCGAACCC

151 ATCGccAAAG ACCgccTGCA CATCTTCAGC AAACCGATGC AGCTGGTTAC

201 CGAAAAAGGT AAGGAAAACA TGATTCAACG CGGCACATAC AACTACCAAT

251 ACCGCAGCAA CCGTCCCGTC AAAGACGGCA GCTACCTCGT TACCGCCGAA

301 TATCAGCCTA CTTTCCGGTC AAAAAACAAA GCAGGCTGGA AACAGGCTGG

351 CATCAAAGAA ATGCCTGACG CAAGCTATTG CGAACAAACC CGTATGTTCG

401 GTAAAAACAT TGTCAACGTG GGACACGAAA GCGCGGACAC CGCCATCATC

451 ACCAAACCGG TCGGACAAAA CTTGGAAATC GTCCCGCTGG ACAATCCCGC

501 CAACATTCAC GTAGGCGAAC GCTTCAAAGT CCGCGTTCTG TTCCGTGGCG

551 AACCGCTGCC CAATGCCACC GTTACCGCTA CATTTGACGG CTTCGACACC

601 AGCGACCGCA GCAAAACGCA CAAAACCGAA GCCCAAGCCT TCTCCGACAC

651 CACCGACGGC AAAGGCGAAG TGGACATCAT CCCCTTGCGC CAAGGCTTTT

701 GGAAAGCGAG TGTCGAATAC AAAGCCGATT TCCCCGATCA AAGCCTGTGC

751 CAAAAACAGG CGAACTACAC AACTTTAACC TTCCAAATCG GCCATTCTCA

801 CCATTAA
```

This corresponds to the amino acid sequence <SEQ ID 2802; ORF 920-1.ng>:

g920-1.pep

```
  1 MKKTLTLLAV SALFATSAHP HRVWVETAHT HGGEYLKADL GYGEFPELEP
 51 IAKDRLHIFS KPMQLVTEKG KENMIQRGTY NYQYRSNRPV KDGSYLVTAE
101 YQPTFRSKNK AGWKQAGIKE MPDASYCEQT RMFGKNIVNV GHESADTAII
151 TKPVGQNLEI VPLDNPANIH VGERFKVRVL FRGEPLPNAT VTATFDGFDT
201 SDRSKTHKTE AQAFSDTTDG KGEVDIIPLR QGFWKASVEY KADFPDQSLC
251 QKQANYTTLT FQIGHSHH*
```

The following partial DNA sequence was identified in *N. meningitidis* <SEQ ID 2803>:

m920-1.seq

```
  1 ATGAAGAAAA CATTGACACT GCTCGCCGTT TCCGCCCTAT TTGCCACATC
 51 CGCCCACGCC CACCGCGTCT GGGTCGAAAC CGCCCACACG CACGGCGGCG
101 AATACCTTAA AGCCGACTTG GGCTACGGCG AATTTCCCGA ACTCGAACCC
151 ATCGCCAAAG ACCGCCTGCA CATCTTCAGC AAACCGATGC AGCTGGTTAC
201 CGAAAAAGGC AAGGAAAACA TGATTCAACG CGGCACATAC AACTACCAGT
251 ACCGAAGCAA CCGTCCCGTT AAGGACGGCA GTTACCTCGT CATCGCCGAA
301 TATCAGCCTA CTTTCTGGTC AAAAAACAAA GCAGGCTGGA AACAGGCGGG
351 CATCAAAGAA ATGCCTGACG CAAGCTATTG CGAACAAACC CGAATGTTCG
401 GCAAAAACAT CGTCAACGTC GGACACGAAA GCGCGGACAC CGCCATCATC
451 ACCAAACCGG TCGGACAAAA CTTGGAAATC GTCCCGCTGG ACAATCCCGC
501 CAACATTCAC GTAGGCGAAC GCTTCAAAGT CCGCGTTCTG TTCCGTGGCG
551 AACCGCTGCC CAATGCCACC GTTACCGCCA CCTTTGACGG CTTCGACACC
601 AGCGACCGCA GCAAAACGCA CAAAACCGAA GCACAGGCTT TCTCCGACAG
651 CACAGACGAC AAAGGCGAAG TGGACATCAT CCCCTTGCGC CAAGGCTTCT
701 GGAAAGCCAA TGTCGAACAC AAAACCGACT TCCCCGATCA AAGCGTGTGC
751 CAAAAACAGG CGAACTACTC GACTTTAACC TTCCAAATCG GTCATTCGCA
801 CCATTAA
```

This corresponds to the amino acid sequence <SEQ ID 2804; ORF 920-1>:

m920-1.pep

```
  1 MKKTLTLLAV SALFATSAHA HRVWVETAHT HGGEYLKADL GYGEFPELEP
 51 IAKDRLHIFS KPMQLVTEKG KENMIQRGTY NYQYRSNRPV KDGSYLVIAE
101 YQPTFWSKNK AGWKQAGIKE MPDASYCEQT RMFGKNIVNV GHESADTAII
151 TKPVGQNLEI VPLDNPANIH VGERFKVRVL FRGEPLPNAT VTATFDGFDT
201 SDRSKTHKTE AQAFSDSTDD KGEVDIIPLR QGFWKANVEH KTDFPDQSVC
251 QKQANYSTLT FQIGHSHH*
```

m920-1/g920-1 96.3% identity in 268 aa overlap

```
                    10        20        30        40        50        60
m920-1.pep  MKKTLTLLAVSALFATSAHAHRVWVETAHTHGGEYLKADLGYGEFPELEPIAKDRLHIFS
            ||||||||||||||||||| ||||||||||||||||||||||||||||||||||||||||
g920-1      MKKTLTLLAVSALFATSAHPHRVWVETAHTHGGEYLKADLGYGEFPELEPIAKDRLHIFS
                    10        20        30        40        50        60

                    70        80        90       100       110       120
m920-1.pep  KPMQLVTEKGKENMIQRGTYNYQYRSNRPVKDGSYLVIAEYQPTFWSKNKAGWKQAGIKE
            ||||||||||||||||||||||||||||||||||||| ||||||| ||||||||||||||
g920-1      KPMQLVTEKGKENMIQRGTYNYQYRSNRPVKDGSYLVTAEYQPTFRSKNKAGWKQAGIKE
                    70        80        90       100       110       120

                   130       140       150       160       170       180
m920-1.pep  MPDASYCEQTRMFGKNIVNVGHESADTAIITKPVGQNLEIVPLDNPANIHVGERFKVRVL
            ||||||||||||||||||||||||||||||||||||||||||||||||||||||||||||
g920-1      MPDASYCEQTRMFGKNIVNVGHESADTAIITKPVGQNLEIVPLDNPANIHVGERFKVRVL
                   130       140       150       160       170       180

                   190       200       210       220       230       240
m920-1.pep  FRGEPLPNATVTATFDGFDTSDRSKTHKTEAQAFSDSTDDKGEVDIIPLRQGFWKANVEH
            ||||||||||||||||||||||||||||||||||||:|| ||||||||||||||||:||:
g920-1      FRGEPLPNATVTATFDGFDTSDRSKTHKTEAQAFSDTTDGKGEVDIIPLRQGFWKASVEY
                   190       200       210       220       230       240

                   250       260      269
m920-1.pep  KTDFPDQSVCQKQANYSTLTFQIGHSHHX
            |:||||||:|||||||:||||||||||||
g920-1      KADFPDQSLCQKQANYTTLTFQIGHSHHX
                   250       260
```

The following partial DNA sequence was identified in *N. meningitidis* <SEQ ID 2805>:

a920.seq

1 TGAAAGAAAA CATTGACACT GCTCGCCGTT TCCGCCCTAT TTGCCGCATC

51 CGCCCACGCC CACCGCGTCT GGGTCGAAAC CGCCCACACG CACGGCGGCG

101 AATACCTTAA AGCCGACTTG GGCTACGGCG AATTTCCCGA ACTCGAACCC

151 ATCGCCAAAG ACCGCCTGCA CATCTTCAGC AAACCGATGC AGCTGGTTAC

201 CGAAAAAGGC AAGGAAAACA TGATTCAACG CGGCACATAC AACTACCAGT

251 ACCGAAGCAA CCGTCCCGTT AAGGACGGCA GTTACCTCGT CATCGCCGAA

301 TATCAGCCTA CTTTCTGGTC AAAAAACAAA GCAGGCTGGA AACAGGCGGG

351 CATCAAACAA ATGCCTGACG CAAGCTATTG CGAACAAACC CGAATGTTCG

401 GCAAAAACAT CGTCAACGTC GGACACGAAA GCGCGGACAC CGCCATCATC

451 ACCAAACCGG TCGGACAAAA CTTGGAAATC GTCCCGCTGG ACAATCCCGC

501 CAACATTCAC GTAGGCGAAC GCTTCAAAGT CCGCGTTCTG TTCCGTGGCG

551 AACCGCTGCC CAATGCCACC GTTACCGCCA CCTTTGACGG CTTCGACACC

601 AGCGACCGCA GCAAAACGCA CAAAACCGAA GCACAGGCTT TCTCCGACAG

651 CACAGACGAC AAAGGCGAAG TGGACATCAT CCCCTTGCGC CAAGGCTTCT

701 GGAAAGCCAA TGTCGAACAC AAAGCCGACT TCCCCGATCA AAGCGTGTGC

751 CAAAAACAGG CGAACTACTC GACTTTAACC TTCCAAATCG GCCATTCGCA

801 CCATTAA

This corresponds to the amino acid sequence <SEQ ID 2806; ORF 920-1.a>:

a920.pep

1 *KKTLTLLAV SALFAASAHA HRVWVETAHT HGGEYLKADL GYGEFPELEP

51 IAKDRLHIFS KPMQLVTEKG KENMIQRGTY NYQYRSNRPV KDGSYLVIAE

-continued

```
101 YQPTFWSKNK AGWKQAGIKQ MPDASYCEQT RMFGKNIVNV GHESADTAII

151 TKPVGQNLEI VPLDNPANIH VGERFKVRVL FRGEPLPNAT VTATFDGFDT

201 SDRSKTHKTE AQAFSDSTDD KGEVDIIPLR QGFWKANVEH KADFPDQSVC

251 QKQANYSTLT FQIGHSHH*
```

m920-1/a920 98.9% identity in 267 aa overlap

```
                    10        20        30        40        50        60
m920-1.pep  MKKTLTLLAVSALFATSAHAHRVWVETAHTHGGEYLKADLGYGEFPELEPIAKDRLHIFS
             ||||||||||||||:||||||||||||||||||||||||||||||||||||||||||||
a920        XKKTLTLLAVSALFAASAHAHRVWVETAHTHGGEYLKADLGYGEFPELEPIAKDRLHIFS
                    10        20        30        40        50        60

                    70        80        90       100       110       120
m920-1.pep  KPMQLVTEKGKENMIQRGTYNYQYRSNRPVKDGSYLVIAEYQPTFWSKNKAGWKQAGIKE
            |||||||||||||||||||||||||||||||||||||||||||||||||||||||||||:
a920        KPMQLVTEKGKENMIQRGTYNYQYRSNRPVKDGSYLVIAEYQPTFWSKNKAGWKQAGIKQ
                    70        80        90       100       110       120

                   130       140       150       160       170       180
m920-1.pep  MPDASYCEQTRMFGKNIVNVGHESADTAIITKPVGQNLEIVPLDNPANIHVGERFKVRVL
            ||||||||||||||||||||||||||||||||||||||||||||||||||||||||||||
a920        MPDASYCEQTRMFGKNIVNVGHESADTAIITKPVGQNLEIVPLDNPANIHVGERFKVRVL
                   130       140       150       160       170       180

                   190       200       210       220       230       240
m920-1.pep  FRGEPLPNATVTATFDGFDTSDRSKTHKTEAQAFSDSTDDKGEVDIIPLRQGFWKANVEH
            ||||||||||||||||||||||||||||||||||||||||||||||||||||||||||||
a920        FRGEPLPNATVTATFDGFDTSDRSKTHKTEAQAFSDSTDDKGEVDIIPLRQGFWKANVEH
                   190       200       210       220       230       240

                   250       260      269
m920-1.pep  KTDFPDQSVCQKQANYSTLTFQIGHSHHX
            |:||||||||||||||||||||||||||
a920        KADFPDQSVCQKQANYSTLTFQIGHSHHX
                   250       260
```

The following partial DNA sequence was identified in *N. gonorrhoeae* <SEQ ID 2807>:

<u>g921.seq</u>

```
  1 ATGAAAAAAT ACCTTATCCC TCTTTCCATT GCGGCAGTCC TTTCCGggtG

 51 Ccagtctatt tatGtgccca cattgacggA aatccccgTg aatcccatca

101 ataCCgtcaa aacggaagCA CCTGCAAAAG GTTTTCGCCT CGCCCCTTCG

151 CATTGGGCGG ATGTTGCCAA AATCAGCGAT GAAGCGACGC GCTTGGGCTA

201 TCAGGTGGGT ATCGGTAAAA TGACCAAGGT TCAGGcgGCG CAATATCTGA

251 ACAACTTCAG AAAACGCCTG GTCGGACGCA ATGCCGTCGA TGACAGTATG

301 TATGAAATCT ACCTGCGTTC GGCGGTAGAC AGCCAGCGCG GCGAAATCAA

351 TACGGAACAG TCCAAGCTGT ATATCGAGAA TGCCTTGCGC GGCTGGCAGC

401 AGCGTtggAA AAATATGGAT GCCAAACCCG ATAATCCCGC ATTTACCAAC

451 TTTTTGATGG AAGTGATGAA GATGCAGCCC TTGAAATGA
```

This corresponds to the amino acid sequence <SEQ ID 2808; ORF 921.ng>:

<u>g921.pep</u>

```
  1 MKKYLIPLSI AAVLSGCQSI YVPTLTEIPV NPINTVKTEA PAKGFRLAPS

 51 HWADVAKISD EATRLGYQVG IGKMTKVQAA QYLNNFRKRL VGRNAVDDSM
```

-continued

```
101 YEIYLRSAVD SQRGEINTEQ SKLYIENALR GWQQRWKNMD AKPDNPAFTN

151 FLMEVMKMQP LK*
```

The following partial DNA sequence was identified in *N. meningitidis* <SEQ ID 2809>:

m921.seq

```
  1 ATGAAAAAAT ACCTTATCCC TCTTTCCATT GCGGCAGTTC TTTCCGGCTG

 51 CCAGTCTATT TATGTGCCCA CATTGACGGA AATCCCCGTG AATCCTATCA

101 ATACCGTCAA AACGGAAGCA CCTGCAAAAG GTTTCCGCCT TGCCTCTTCG

151 CATTGGACGG ATGTTGCCAA AATCAGCGAT GAAGCGACGC GCTTGGGCTA

201 TCAGGTGGGT ATCGGTAAAA TGACCAAGGT TCAGGCGGCG CAATATCTGA

251 ACAACTTCAG AAAACGCCTG GTCGGACGCA ATGCCGTCGA TGACAGTATG

301 TATGAAATCT ACCTGCGTTC GGCGATAGAC AGCCAGCGGG GCGCAATCAA

351 TACGGAACAG TCCAAGCTGT ATATCCAGAA TGCCTTGCGC GGCTGGCAGC

401 AGCGTTGGAA AAATATGGAT GTCAAACCCA ACAACCCCGC ATTTACCAAC

451 TTTTTGATGG AAGTGATGAA GATGCAGCCC TTGAAATGA
```

This corresponds to the amino acid sequence <SEQ ID 2810; ORF 921>:

m921.pep

```
  1 MKKYLIPLSI AAVLSGCQSI YVPTLTEIPV NPINTVKTEA PAKGFRLASS

 51 HWTDVAKISD EATRLGYQVG IGKMTKVQAA QYLNNFRKRL VGRNAVDDSM

101 YEIYLRSAID SQRGAINTEQ SKLYIQNALR GWQQRWKNMD VKPNNPAFTN

151 FLMEVMKMQP LK*
```

Computer analysis of this amino acid sequence gave the following results:

Homology with a predicted ORF from *N. gonorrhoeae*

ORF 921 shows 95.7% identity over a 162 aa overlap with a predicted ORF (ORF 921.ng) from *N. gonorrhoeae*:

m921/g921

```
                  10        20        30        40        50        60
m921.pep   MKKYLIPLSIAAVLSGCQSIYVPTLTEIPVNPINTVKTEAPAKGFRLASSHWTDVAKISD
           |||||||||||||||||||||||||||||||||||||||||||||||| |||:||||||
g921       MKKYLIPLSIAAVLSGCQSIYVPTLTEIPVNPINTVKTEAPAKGFRLAPSHWADVAKISD
                  10        20        30        40        50        60

                  70        80        90       100       110       120
m921.pep   EATRLGYQVGIGKMTKVQAAQYLNNFRKRLVGRNAVDDSMYEIYLRSAIDSQRGAINTEQ
           |||||||||||||||||||||||||||||||||||||||||||||||:||||| |||||
g921       EATRLGYQVGIGKMTKVQAAQYLNNFRKRLVGRNAVDDSMYEIYLRSAVDSQRGEINTEQ
                  70        80        90       100       110       120

                 130       140       150       160
m921.pep   SKLYIQNALRGWQQRWKNMDVKPNNPAFTNFLMEVMKMQPLKX
           |||||:||||||||||||||:||:||||||||||||||||||
g921       SKLYIENALRGWQQRWKNMDAKPDNPAFTNFLMEVMKMQPLKX
                 130       140       150       160
```

The following partial DNA sequence was identified in *N. meningitidis* <SEQ ID 2811>:

a921.seq

```
  1 ATGAAAAAAT ACCTTATCCC TCTTTCCATT GTGGCAGTTC TTTCCGGCTG
 51 CCAGTCTATT TATGTGCCCA CATTGACGGA AATCCCCGTG AATCCTATCA
101 ATACCGTCAA AACGGAAGCA CCTGCAAAAG GTTTCCGCCT TGCCTCTTCG
151 CATTGGACGG ATGTTGCCAA AATCAGCGAT GAAGCGACGC GCTTGGGCTA
201 TCAGGTGGGT ATCGGTAAAA TGACCAAGGT TCAGGCGGCG CAATATCTGA
251 ACAACTTCAG AAAACGCCTG GTCGGACGCA ATGCCGTCGA TGACAGTATG
301 TATGAAATCT ACCTGCGTTC GGCGATAGAC AGCCAGCGGG GCGCAATCAA
351 TACGGAACAG TCCAAGCTGT ATATCCAGAA TGCCTTGCGC GGCTGGCAGC
401 AGCGTTGGAA AAATATGGAT GTCAAACCCA ACAACCCCGC ATTTACCAAC
451 TTTTTGATGG AAGTGATGAA GATGCAGCCC TTGAAATGA
```

This corresponds to the amino acid sequence <SEQ ID 2812; ORF 921.a>:

a921.pep

```
  1 MKKYLIPLSI VAVLSGCQSI YVPTLTEIPV NPINTVKTEA PAKGFRLASS
 51 HWTDVAKISD EATRLGYQVG IGKMTKVQAA QYLNNFRKRL VGRNAVDDSM
101 YEIYLRSAID SQRGAINTEQ SKLYIQNALR GWQQRWKNMD VKPNNPAFTN
151 FLMEVMKMQP LK*
```

m921/a921 99.4% identity in 162 aa overlap

```
                   10        20        30        40        50        60
m921.pep   MKKYLIPLSIAAVLSGCQSIYVPTLTEIPVNPINTVKTEAPAKGFRLASSHWTDVAKISD
           ||||||||||:|||||||||||||||||||||||||||||||||||||||||||||||||
a921       MKKYLIPLSIVAVLSGCQSIYVPTLTEIPVNPINTVKTEAPAKGFRLASSHWTDVAKISD
                   10        20        30        40        50        60

                   70        80        90       100       110       120
m921.pep   EATRLGYQVGIGKMTKVQAAQYLNNFRKRLVGRNAVDDSMYEIYLRSAIDSQRGAINTEQ
           ||||||||||||||||||||||||||||||||||||||||||||||||||||||||||||
a921       EATRLGYQVGIGKMTKVQAAQYLNNFRKRLVGRNAVDDSMYEIYLRSAIDSQRGAINTEQ
                   70        80        90       100       110       120

                  130       140       150       160
m921.pep   SKLYIQNALRGWQQRWKNMDVKPNNPAFTNFLMEVMKMQPLKX
           |||||||||||||||||||||||||||||||||||||||||||
a921       SKLYIQNALRGWQQRWKNMDVKPNNPAFTNFLMEVMKMQPLKX
                  130       140       150       160
```

The following partial DNA sequence was identified in *N. gonorrhoeae* <SEQ ID 2813>:

g922.seq

```
  1 ATGGAAAAGA GAAAAATACT GCCGCTGGCA ATTTGTTTGG CGGCTTTGTC
 51 TGCCTGTACG GCGATGGAGG CCCGCACACC CCGGGCAAAT GAAGCCCAAG
101 CCCCCCGCGC GGATGAAATG AAAAAAGAAA GCCGCCCCGC GTTTGACGCG
151 GCAGCCGTAC CGGTATCCGA CAGCGGGTTT GCCGCCAATG CAAATGTCCG
201 CCGTTTTGTG GACGATGAAG TCGGGAAAGG GGATTTTTCC CAGGCGGAAT
251 GGCAGGATTT TTTTGACAAA GCGGCTTACA AGGCGGACAT CGTCAAGATt
```

-continued

```
 301 ATGCACCGAC CCTCCACATC GCGtCCGTGG TATGtgttcc gCacggGAAa
 351 ttcGGgcagg gcgaaAtttc ACggcgCGCG Caggttttat GcggaaAacc
 401 gcgcggttat cgatgatgtg gcgCAAAAat acggcgtGCC TGCCGAGCTT
 451 ATCGTGGCGA TTATCGGGAT TGAAACGAAT TACGGCAAAA ATACGGGCAG
 501 TTTCCGTGTG GCGGACGCAT TGGCGACTTT AGGCTTTGAT TATCCCCGCC
 551 GCGCCGGGTT TTTCCAAAAA GAATTGGTCG AGCTTTTAAA GCTGGCAAAA
 601 GAAGAAGGCG GTGATGTTTT CGCCTTTAAG GGCagcTATG CGGGTGCAAT
 651 GGGTATGCCG CAATTTATGC CTTCGAGCTA CCGGAAATGG GCGGTGGATT
 701 ATGAcgggga cggacatCGG GATATAtggg GCAACGTcgg tgatgtcgcg
 751 gcatcggTTG CCAATTAtat gaagCAGCAC GGTTGGCGCA CgggcggtAA
 801 AATGTTGGTG TCGGCGAcgt tggcgccggg tgcggATGTT CAggcAATCA
 851 TTGGCGAAAA AACCGCCCTG ACGCGGACGG TGGCGGATTT GAaggCGTAc
 901 ggcatcatcc ccggggaaaC GCTCGCAGAT GATGAAAAGg cgGTTTTGTT
 951 CAAACTGGAA ACCGCACCCG GCGTGTTTGA ATATTATTTG GGCTTGAACA
1001 ATTTTTATAC GGTATGGCAG TACAACCACA GCCGGATGTA TGTAACGgcg
1051 gtcaggGACA TTGCCAATTC GCTCGGCGGC CCGGGATTGT Aa
```

This corresponds to the amino acid sequence <SEQ ID 2814; ORF 922.ng>:

g922.pep

```
   1 MEKRKILPLA ICLAALSACT AMEARTPRAN EAQAPRADEM KKESRPAFDA
  51 AAVPVSDSGF AANANVRRFV DDEVGKGDFS QAEWQDFFDK AAYKADIVKI
 101 MHRPSTSRPW YVFRTGNSGR AKFHGARRFY AENRAVIDDV AQKYGVPAEL
 151 IVAIIGIETN YGKNTGSFRV ADALATLGFD YPRRAGFFQK ELVELLKLAK
 201 EEGGDVFAFK GSYAGAMGMP QFMPSSYRKW AVDYDGDGHR DIWGNVGDVA
 251 ASVANYMKQH GWRTGGKMLV SATLAPGADV QAIIGEKTAL TRTVADLKAY
 301 GIIPGETLAD DEKAVLFKLE TAPGVFEYYL GLNNFYTVWQ YNHSRMYVTA
 351 VRDIANSLGG PGL*
```

The following partial DNA sequence was identified in *N. meningitidis* <SEQ ID 2815>:

m922.seq

```
   1 ATGAAAAAGA GAAAAATACT GCCGCTGGCA ATTTGTTTGG CGGCTTTGTC
  51 TGCCTGTACG GCGATGGAGG CACGCCCACC CCGGGCAAAT GAAGCCCAAG
 101 CCCCCCGCGC GGTTGAAATG AAAAAAGAAA GCCGCCCCGC GTTTGACGCG
 151 GCAGCCGTAT TTGACGCGGC AGCCGTACCG GTATCCGACA GCGGGTTTGC
 201 CGCCAATGCA AATGTCCGCC GTTTTGTGGA CGATGAAGTC GGGAAAGGGG
 251 ATTTTTCCCG GGCGGAATGG CAGGATTTTT TTGACAAAGC GGCTTACAAG
 301 GCGGACATCG TCAAGATTAT GCACCGCCCC TCCACATCGC GTCCGTGGTA
```

-continued

```
 351 TGTGTTCCGC ACGGGAAATT CGGGCAAGGC GAAATTTCGC GGCGCGCGCC

 401 GGTTTTATGC GGAAAACCGC GCGCTTATCG ATGATGTGGC GCAAAAATAC

 451 GGCGTGCCTG CCGAACTTAT CGTGGCGGTT ATCGGGATTG AAACGAATTA

 501 CGGCAAAAAT ACGGGCAGTT TCCGTGTGGC GGACGCATTG GCGACCTTAG

 551 GCTTTGATTA CCCCCGCCGC GCCGGGTTTT TCCAAAAAGA ATTGGTCGAG

 601 CTTTTAAAGC TGGCAAAAGA AGAAGGCGGC GATGTTTTCG CCTTTAAAGG

 651 CAGCTATGCG GGCGCAATGG GGATGCCGCA ATTTATGCCT TCGAGCTACC

 701 GGAAATGGGC GGTGGATTAT GACGGGGACG GACATCGGGA CATATGGGGC

 751 AACGTCGGCG ATGTCGCGGC ATCGGTTGCC AATTATATGA AGCAGCACGG

 801 TTGGCGCACG GGCGGGAAAA TGCTGGTGTC TGCAACATTG GCGCCGGGTG

 851 CGGATGTTCA GGCAATCATT GGCGAAAAAA CCGCCCTGAC GCGGACGGTG

 901 GCGGATTTGA AGGCGTACGG CATCATCCCC GGCGAAGAGC TTGCAGATGA

 951 TGAAAAGGCG GTTTTGTTCA AACTGGAAAC CGCACCGGGC GTGTTTGAAT

1001 ATTATTTGGG CTTGAACAAT TTTTATACGG TATGGCAGTA CAACCACAGC

1051 CGGATGTATG TAACGGCGGT CAGGGACATT GCCAATTCGC TTGGCGGCCC

1101 GGGATTGTAA
```

This corresponds to the amino acid sequence <SEQ ID 2816; ORF 922>:

m922.pep

```
  1 MKKRKILPLA ICLAALSACT AMEARPPRAN EAQAPRAVEM KKESRPAFDA

 51 AAVFDAAAVP VSDSGFAANA NVRRFVDDEV GKGDFSRAEW QDFFDKAAYK

101 ADIVKIMHRP STSRPWYVFR TGNSGKAKFR GARRFYAENR ALIDDVAQKY

151 GVPAELIVAV IGIETNYGKN TGSFRVADAL ATLGFDYPRR AGFFQKELVE

201 LLKLAKEEGG DVFAFKGSYA GAMGMPQFMP SSYRKWAVDY DGDGHRDIWG

251 NVGDVAASVA NYMKQHGWRT GGKMLVSATL APGADVQAII GEKTALTRTV

301 ADLKAYGIIP GEELADDEKA VLFKLETAPG VFEYYLGLNN FYTVWQYNHS

351 RMYVTAVRDI ANSLGGPGL*
```

Computer analysis of this amino acid sequence gave the following results:

Homology with a predicted ORF from *N. gonorrhoeae*

ORF 922 shows 95.9% identity over a 369 aa overlap with a predicted ORF (ORF 922.ng) from *N. gonorrhoeae*:

m922/g922

```
                   10        20        30        40        50        60
m922.pep   MKKRKILPLAICLAALSACTAMEARPPRANEAQAPRAVEMKKESRPAFDAAAVFDAAAVP
           |:||||||||||||||||||||||| |||||||||| ||||||||||||      |||
g922       MEKRKILPLAICLAALSACTAMEARTPRANEAQAPRADEMKKESRPAFDAA------AVP
                   10        20        30        40        50

                   70        80        90       100       110       120
m922.pep   VSDSGFAANANVRRFVDDEVGKGDFSRAEWQDFFDKAAYKADIVKIMHRPSTSRPWYVFR
           ||||||||||||||||||||||||||:|||||||||||||||||||||||||||||||||
g922       VSDSGFAANANVRRFVDDEVGKGDFSQAEWQDFFDKAAYKADIVKIMHRPSTSRPWYVFR
               60        70        80        90       100       110
```

-continued

```
                130       140       150       160       170       180
m922.pep  TGNSGKAKFRGARRFYAENRALIDDVAQKYGVPAELIVAVIGIETNYGKNTGSFRVADAL
          |||||:|||:||||||||||:||||||||||||||||:||||||||||||||||||||
g922      TGNSGRAKFHGARRFYAENRAVIDDVAQKYGVPAELIVAIIGIETNYGKNTGSFRVADAL
              120       130       140       150       160       170

                190       200       210       220       230       240
m922.pep  ATLGFDYPRRAGFFQKELVELLKLAKEEGGDVFAFKGSYAGAMGMPQFMPSSYRKWAVDY
          ||||||||||||||||||||||||||||||||||||||||||||||||||||||||||||
g922      ATLGFDYPRRAGFFQKELVELLKLAKEEGGDVFAFKGSYAGAMGMPQFMPSSYRKWAVDY
              180       190       200       210       220       230

                250       260       270       280       290       300
m922.pep  DGDGHRDIWGNVGDVAASVANYMKQHGWRTGGKMLVSATLAPGADVQAIIGEKTALTRTV
          ||||||||||||||||||||||||||||||||||||||||||||||||||||||||||||
g922      DGDGHRDIWGNVGDVAASVANYMKQHGWRTGGKMLVSATLAPGADVQAIIGEKTALTRTV
              240       250       260       270       280       290

                310       320       330       340       350       360
m922.pep  ADLKAYGIIPGEELADDEKAVLFKLETAPGVFEYYLGLNNFYTVWQYNHSRMTVTAVRDI
          |||||||||||| ||||||||||||||||||||||||||||||||||||||| |||||||
g922      ADLKAYGIIPGETLADDEKAVLFKLETAPGVFEYYLGLNNFYTVWQYNHSRMYVTAVRDI
              300       310       320       330       340       350

                370
m922.pep  ANSLGGPGLX
          ||||||||||
g922      ANSLGGPGLX
              360
```

The following partial DNA sequence was identified in *N. meningitidis* <SEQ ID 2817>:

a922.seq

```
   1 ATGAAAAACA GAAAAATACT GCCGCTGGCA ATTTGTTTGG CGGCTTTGTC
  51 TGCCTGTACG GCGATGGAGG CACGCCCGCC CCGGGCAAAT GAAGCCCAAG
 101 CCCCCCGCGC GGATGAAATG AAAAAAGAAA GCCGCCCCGC GTTTGACGCG
 151 GCAGCCGTAT TTGACGCGGC AGCCGTACCG GTATCCGACA GCGGGTTTGC
 201 CGCCAATGCA AATGTCCGCC GTTTTGTGGA CGATGAAGTC GGGAAAGGGG
 251 ATTTTTCCCG GGCGGAATGG CAGGATTTTT TTGACAAAGC GGCTTACAAG
 301 GCGGACATCG TCAAGATTAT GCACCGCCCC TCCACATCGC GTCCGTGGTA
 351 TGTGTTCCGC ACGGGAAATT CGGGCAAGGC GAAATTTCGC GGCGCGCGCC
 401 GGTTTTATGC GGAAAACCGC GCGCTTATCG ATGATGTGGC GCAAAAATAC
 451 GGCGTGCCTG CCGAACTTAT CGTGGCGGTT ATCGGGATTG AAACGAATTA
 501 CGGCAAAAAT ACGGGCAGTT TCCGTGTGGC GGACGCATTG GCGACCTTAG
 551 GCTTTGATTA CCCCCGCCGC GCCGGGTTTT TCCAAAAAGA ATTGGTCGAG
 601 CTTTTAAAGC TGGCAAAAGA AGAAGGCGGC GATGTTTTCG CCTTTAAAGG
 651 CAGCTATGCG GGCGCAATGG GGATGCCGCA ATTTATGCCT TCGAGCTACC
 701 GGAAATGGGC GGTGGATTAT GACGGGGACG GACATCGGGA CATATGGGGC
 751 AATGTTGGCG ATGTCGCGGC ATCGATTGCC AATTATATGA AGCAGCACGG
 801 TTGGCGCACG GGCGGGAAAA TACTGGTGTC TGCAACATTG GCGCCGGGTG
 851 CGGATGTTCA GGCAATCATT GGCGAAAAAA CCGCCCTGAC GCGGACGGTG
 901 GCGGATTTGA AGGCGTACGG CATCATCCCC GGCGAAGAGC TTGCCGATGA
 951 TGAAAAGGCG GTTTTGTTCA AACTGGAAAC CGCACCCGGC GTGTTTGAAT
1001 ATTATTTGGG CTTGAACAAT TTTTATACGG TATGGCAGTA CAATCACAGT
1051 CGGATGTATG TAACGGCGGT CAGGGACATT GCCAATTCGC TTGGCGGCCC
1101 GGGATTGTAA
```

This corresponds to the amino acid sequence <SEQ ID 2818; ORF 922.a>:

```
a922.pep

  1 MKNRKILPLA ICLAALSACT AMEARPPRAN EAQAPRADEM KKESRPAFDA

 51 AAVFDAAAVP VSDSGFAANA NVRRFVDDEV GKGDFSRAEW QDFFDKAAYK

101 ADIVKIMHRP STSRPWYVFR TGNSGKAKFR GARRFYAENR ALIDDVAQKY

151 GVPAELIVAV IGIETNYGKN TGSFRVADAL ATLGFDYPRR AGFFQKELVE

201 LLKLAKEEGG DVFAFKGSYA GAMGMPQFMP SSYRKWAVDY DGDGHRDIWG

251 NVGDVAASIA NYMKQHGWRT GGKILVSATL APGADVQAII GEKTALTRTV

301 ADLKAYGIIP GEELADDEKA VLFKLETAPG VFEYYLGLNN FYTVWQYNHS

351 RMYVTAVRDI ANSLGGPGL*
```

m922/a922 98.9% identity in 369 aa overlap

```
                    10        20        30        40        50        60
m922.pep    MKKRKILPLAICLAALSACTAMEARPPRANEAQAPRAVEMKKESRPAFDAAAVFDAAAVP
            ||:|||||||||||||||||||||||||||||||||| ||||||||||||||||||||||
a922        MKNRKILPLAICLAALSACTAMEARPPRANEAQAPRADEMKKESRPAFDAAAVFDAAAVP
                    10        20        30        40        50        60

                    70        80        90       100       110       120
m922.pep    VSDSGFAANANVRRFVDDEVGKGDFSRAEWQDFFDKAAYKADIVKIMHRPSTSRPWYVFR
            ||||||||||||||||||||||||||||||||||||||||||||||||||||||||||||
a922        VSDSGFAANANVRRFVDDEVGKGDFSRAEWQDFFDKAAYKADIVKIMHRPSTSRPWYVFR
                    70        80        90       100       110       120

                   130       140       150       160       170       180
m922.pep    TGNSGKAKFRGARRFYAENRALIDDVAQKYGVPAELIVAVIGIETNYGKNTGSFRVADAL
            ||||||||||||||||||||||||||||||||||||||||||||||||||||||||||||
a922        TGNSGKAKFRGARRFYAENRALIDDVAQKYGVPAELIVAVIGIETNYGKNTGSFRVADAL
                   130       140       150       160       170       180

                   190       200       210       220       230       240
m922.pep    ATLGFDYPRRAGFFQKELVELLKLAKEEGGDVFAFKGSYAGAMGMPQFMPSSYRKWAVDY
            ||||||||||||||||||||||||||||||||||||||||||||||||||||||||||||
a922        ATLGFDYPRRAGFFQKELVELLKLAKEEGGDVFAFKGSYAGAMGMPQFMPSSYRKWAVDY
                   190       200       210       220       230       240

                   250       260       270       280       290       300
m922.pep    DGDGHRDIWGNVGDVAASVANYMKQHGWRTGGKMLVSATLAPGADVQAIIGEKTALTRTV
            ||||||||||||||||||:||||||||||||||:||||||||||||||||||||||||||
a922        DGDGHRDIWGNVGDVAASIANYMKQHGWRTGGKILVSATLAPGADVQAIIGEKTALTRTV
                   250       260       270       280       290       300

                   310       320       330       340       350       360
m922.pep    ADLKAYGIIPGEELADDEKAVLFKLETAPGVFEYYLGLNNFYTVWQYNHSRMYVTAVRDI
            ||||||||||||||||||||||||||||||||||||||||||||||||||||||||||||
a922        ADLKAYGIIPGEELADDEKAVLFKLETAPGVFEYYLGLNNFYTVWQYNHSRMYVTAVRDI
                   310       320       330       340       350       360

                   370
m922.pep    ANSLGGPGLX
            ||||||||||
a922        ANSLGGPGLX
                   370
```

The following partial DNA sequence was identified in *N. gonorrhoeae* <SEQ ID 2819>:

```
g923.seq

  1 ATGAAGCGGC AGGCTTTCTT CAAACCGATG GCGTGTGCGG CATTTCTGTC

 51 CGCCGTTTCG CTGCGCCTCC CCGTATTGGG CGCGTGTTAC GCAATATTGT

101 CCCTCTATGC GTTTGCACTT TACGGCATCG ACAAACGGCG TGCCGTGCGG

151 GGAAAACGCC GCATTCCCGA ACACCGCCTG CTCCTGCCTG CCTTGTTCGG

201 CGGTTGGACG GGCGCATACT TGGGTAGTAG GATGTTCAGG CATAAAACGG
```

-continued

```
251 CGAAAAAGCG TTTTGTTGTG CTGTTCCGTC TGACTGTTTC GGGCAATGTC

301 CTGGCGACCT GCATCCTGAT TGATTATTTC GTTCCGCCCG AACTTTTTGT

351 AAAACTCGGG CAACATCTCT GA
```

This corresponds to the amino acid sequence <SEQ ID 2820; ORF 923.ng>:

g923.pep

```
  1 MKRQAFFKPM ACAAFLSAVS LRLPVLGACY AILSLYAFAL YGIDKRRAVR
 51 GKRRIPEHRL LLPALFGGWT GAYLGSRMFR HKTAKKRFVV LFRLTVSGNV
101 LATCILIDYF VPPELFVKLG QHL*
```

The following partial DNA sequence was identified in *N. meningitidis* <SEQ ID 2821>:

m923.seq

```
  1 ATGAAGCGGC AGGCTTTCTT CAAACTGATG GCGTGTGCGG CATTTCTGTC
 51 TGCCGTTTCG CTGCGCCTCC CCGTATTGGG CGCGTGTTAC GCAATATTGT
101 CCCTCTATGC GTTTGCACTT TACGGCATCG ACAAACGGTG CGCCATACGG
151 GGGCAACGCC GCATTCCCGA ACACCGCCTG CTGCTGCCTG CATTGCTCGG
201 CGGCTGGGTG GGCGCGTATT TCGGCAGCAT GACATTCAAA CATAAGACAG
251 CGAAAAAGCG TTTTGTTGTG CTGTTCCGTC TGACTGTTTC AGGTAATGTC
301 TTGGCGACCC TCATCCTGAT TTATAGTGGA TTAAATTTAA ACCAGTACGG
351 CGTTGCCTCG CCTTGCCGTA CTATTTGTAC TGTCTGCGGC TTCGTCGCCT
401 TGTCCTGATT TTTGTTAATC CACTATAT.T ATTTTGTCCC GCCTGAATTT
451 TTCGTAAAAC TCGGGCAGAA TACCTGA
```

This corresponds to the amino acid sequence <SEQ ID 2822; ORF 923>:

m923.pep

```
  1 MKRQAFFKLM ACAAFLSAVS LRLPVLGACY AILSLYAFAL YGIDKRCAIR
 51 GQRRIPEHRL LLPALLGGWV GAYFGSMTFK HKTAKKRFVV LFRLTVSGNV
101 LATLILIYSG LNLNQYGVAS PCRTICTVCG FVALS*FLLI HYXYFVPPEF
151 FVKLGQNT*
```

Computer analysis of this amino acid sequence gave the following results:

Homology with a predicted ORF from *N. gonorrhoeae*

ORF 923 shows 68.8% identity over a 157 aa overlap with a predicted ORF (ORF 923.ng) from *N. gonorrhoeae*:

g923/m923

```
                    10        20        30        40        50        60
g923.pep   MKRQAFFKPMACAAFLSAVSLRLPVLGACYAILSLYAFALYGIDKRRAVRGKRRIPEHRL
           |||||||| ||||||||||||||||||||||||||||||||||||| |:||:||||||||
m923       MKRQAFFKLMACAAFLSAVSLRLPVLGACYAILSLYAFALYGIDKRCAIRGQRRIPEHRL
                    10        20        30        40        50        60

                    70        80        90       100
g923.pep   LLPALFGGWTGAYLGSRMFRHKTAKKRFVVLFRLTVSGNVLATCILID------------
           |||||:|||:|||:||  |:||||||||||||||||||||||| |||
m923       LLPALLGGWVGAYFGSMTFKHKTAKKRFVVLFRLTVSGNVLATLILIYSGLNLNQYGVAS
                    70        80        90       100       110       120

                                  110       120
g923.pep   -----------------------YFVPPELFVKLGQHLX
                                  ||||||:||||||:
m923       PCRTICTVCGFVALSXFLLIHYIYFVPPEFFVKLGQNTX
                  130       140       150
```

The following partial DNA sequence was identified in *N. meningitidis* <SEQ ID 2823>:

a923.seq

```
  1 ATGAAGCGGC AGGCTTTCTT CAAACTGATG GCGTGTGCGG CATTTCTGTC
 51 TGCCGTTTCG CTGCGCCTCC CCGTATTGGG CGCGTGTTAC GCAATATTGT
101 CCCTCTATGC GTTTGCACTT TACGGCATCG ACAAACGGCG TGCCGTGCGG
151 GGAAAACGCC GCATTCCCGA ACACCGCCTG CTGCTGCCTG CCTTGTTCGG
201 CGGTTGGGCG GGCGCATACT TGGGCAGCAG GATATTCAGG CATAAAACGG
251 CGAAAAAGCG TTTTGTTGTG CTGTTCCGTC TGACTGTTTC GGGCAATGTC
301 CTGGCGACCC TCATCCTGAT TTATAGTGGA TTAAATTTAA ACCAGTACGG
351 CGTTGCCTCG CCTTA.GCTC AAAGAGAACG ATTCTCTAAG GTGCTGAAGC
401 ACCAAGTGAA TCGGTTCCGT ACTATTTGTA CTGTCTGCGG CTTCGTCGCC
451 TTGTCCTGAT TTTTGTTAAT CCACTAT.AT TATTTTGTCC CGCCTGAATT
501 TTTCGTAAAA CTCGGGCAGA ATACCTGA
```

This corresponds to the amino acid sequence <SEQ ID 2824; ORF 923.a>:

a923.pep

```
  1 MKRQAFFKLM ACAAFLSAVS LRLPVLGACY AILSLYAFAL YGIDKRRAVR
 51 GKRRIPEHRL LLPALFGGWA GAYLGSRIFR HKTAKKRFVV LFRLTVSGNV
101 LATLILIYSG LNLNQYGVAS PXAQRERFSK VLKHQVNRFR TICTVCGFVA
151 LS*FLLIHYX YFVPPEFFVK LGQNT*
```

m923/a923 84.6% identity in 175 aa overlap

```
                    10        20        30        40        50        60
m923.pep   MKRQAFFKLMACAAFLSAVSLRLPVLGACYAILSLYAFALYGIDKRCAIRGQRRIPEHRL
           |||||||||||||||||||||||||||||||||||||||||||||| |:||:||||||||
a923       MKRQAFFKLMACAAFLSAVSLRLPVLGACYAILSLYAFALYGIDKRRAVRGKRRIPEHRL
                    10        20        30        40        50        60
```

-continued

```
                    70        80        90       100       110       120
m923.pep    LLPALLGGWVGAYFGSMTFKHKTAKKRFVVLFRLTVSGNVLATLILIYSGLNLNQYGVAS
            |||||:|||:|||:||  |:||||||||||||||||||||||||||||||||||||||||
a923        LLPALFGGWAGAYLGSRIFRHKTAKKRFVVLFRLTVSGNVLATLILIYSGLNLNQYGVAS
                    70        80        90       100       110       120

                                    130       140       150      159
m923.pep    PC-----------------RTICTVCGFVALSXFLLIHYXYFVPPEFFVKLGQNTX
            |                  |||||||||||||||||||||||||||||||||||||
a923        PXAQRERFSKVLKHQVNRFRTICTVCGFVALSXFLLIHYXYFVPPEFFVKLGQNTX
                   130       140       150       160       170
```

The following partial DNA sequence was identified in *N. gonorrhoeae* <SEQ ID 2825>:

g925.seq

```
  1 ATGAAACAAA TGCTTTTGGC cgtcggcgtg ggcGCGGTGT TGGCGGGCTG
 51 CGGCAaggat gcCGGCGGtt acgagggtTA TTGGCGCGAA AAGTCGGACA
101 AAAAagaggG CGTGATTGCC GTCAAAAAAA AAGGCAATTA CTTCCTTAAT
151 AAAATCAACG TGTTTACAGG CAAGGAGGAG TCTTTGCTTT TGTCTGAAAA
201 AGACGGCGCG CTTTCGATAA ACACGGGGAT AGGGGAAATC CCGATCAAAC
251 TTTCCGACGA CGGGAAAGAG CTGTATGTCG AACGCAGGCG GTATGTGAAA
301 ACCGATGCGG CGATGAAGGA CAAAATCATC GCCCACCAGA AAAAGTGCGG
351 ACAAACGGCA CAGGCATACC TCGACGCGCG AAATGCGTTG CCGTCAAACC
401 AAACGTATCA GCAGCGTCAG GCGGCGATCG AGCAATTGAA ACGGCGGTTT
451 GAAGCCGAGT TTGACGAATT GGAAAAAGAA ATCAAATGCA ACGGCAAACC
501 GACATTGTTG TTTTAG
```

This corresponds to the amino acid sequence <SEQ ID 2826; ORF 925.ng>:

g925.pep

```
  1 MKQMLLAVGV GAVLAGCGKD AGGYEGYWRE KSDKKEGVIA VKKKGNYFLN
 51 KINVFTGKEE SLLLSEKDGA LSINTGIGEI PIKLSDDGKE LYVERRRYVK
101 TDAAMKDKII AHQKKCGQTA QAYLDARNAL PSNQTYQQRQ AAIEQLKRRF
151 EAEFDELEKE IKCNGKPTLL F*
```

The following partial DNA sequence was identified in *N. meningitidis* <SEQ ID 2827>:

m925.seq (partial)

```
  1 ATGAAACAAA TGCTTTTAGC CGTCGGCGTG GTGGCGGTGT TGGCGGGCTG
 51 CGGCAAGGAT GCCGGCGGTT ACGAGGGTTA TTGGCGCGAA AAGTCGGACA
101 AAAAAGAGGG TATGATTGCC GTCAAAAAAG AAAAAGGCAA TTACTTCCTT
    .......
```

This corresponds to the amino acid sequence <SEQ ID 2828; ORF 925>:

m925.pep (partial)

```
1 MKQMLLAVGV VAVLAGCGKD AGGYEGYWRE KSDKKEGMIA VKKEKGNYFL..
```

Computer analysis of this amino acid sequence gave the following results:

Homology with a predicted ORF from *N. gonorrhoeae*

ORF 925 shows 94.0% identity over a 50 aa overlap with a predicted ORF (ORF 925.ng) from *N. gonorrhoeae*.

m925/g925

```
                   10        20        30        40        50
m925.pep  MKQMLLAVGVVAVLAGCGKDAGGYEGYWREKSDKKEGMIAVKKEKGNYFL
          |||||||||| |||||||||||||||||||||||||:||||| ||||||
g925      MKQMLLAVGVGAVLAGCGKDAGGYEGYWREKSDKKEGVIAVKK-KGNYFLNKINVFTGKE
                   10        20        30        40         50
g925      ESLLLSEKDGALSINTGIGEIPIKLSDDGKELYVERRRYVKTDAAMKDKIIAHQKKCGQT
        60        70        80        90       100       110
```

The following partial DNA sequence was identified in *N. gonorrhoeae* <SEQ ID 2829>:

g925-1.seq

```
  1 ATGAAACAAA TGCTTTTGGC CGTCGGCGTG GCGGCGGTGT TGGCGGGCTG
 51 CGGCAAGGAT GCCGGCGGTT ACGAGGGTTA TTGGCGCGAA AAGTCGGACA
101 AAAAAGAGGG CGTGATTGCC GTCAAAAAAA AAGGCAATTA CTTCCTTAAT
151 AAAATCAACG TGTTTACAGG CAAGGAGGAG TCTTTGCTTT TGTCTGAAAA
201 AGACGGCGCG CTTTCGATAA ACACGGGGAT AGGGGAAATC CCGATCAAAC
251 TTTCCGACGA CGGGAAAGAG CTGTATGTCG AACGCAGGCG GTATGTGAAA
301 ACCGATGCGG CGATGAAGGA CAAAATCATC GCCCACCAGA AAAAGTGCGG
351 ACAAACGGCA CAGGCATACC TCGACGCGCG AAATGCGTTG CCGTCAAACC
401 AAACGTATCA GCAGCGTCAG GCGGCGATCG AGCAATTGAA ACGGCGGTTT
451 GAAGCCGAGT TTGACGAATT GGAAAAAGAA ATCAAATGCA ACGGCAAACC
501 GACATTGTTG TTTTAG
```

This corresponds to the amino acid sequence <SEQ ID 2830; ORF 925-1.ng>:

g925-1.pep

```
  1 MKQMLLAVGV AAVLAGCGKD AGGYEGYWRE KSDKKEGVIA VKKKGNYFLN
 51 KINVFTGKEE SLLLSEKDGA LSINTGIGEI PIKLSDDGKE LYVERRRYVK
101 TDAAMKDKII AHQKKCGQTA QAYLDARNAL PSNQTYQQRQ AAIEQLKRRF
151 EAEFDELEKE IKCNGKPTLL F*
```

The following partial DNA sequence was identified in *N. meningitidis* <SEQ ID 2831>:

m925-1.seq

```
  1 ATGAAACAAA TGCTTTTAGC CGTCGGCGTG GTGGCGGTGT TGGCGGGCTG
 51 CGGCAAGGAT GCCGGCGGTT ACGAGGGTTA TTGGCGCGAA AAGTCGGACA
101 AAAAAGAGGG TATGATTGCC GTCAAAAAAG AAAAAGGCAA TTACTTCCTT
151 AATAAAATCC ACGTGGTTAC AGGCAAGGAA GAGTCCTTGC TTTTGTCTGA
201 AAAAGACGGC GCGCTTTCGA TAAACACAGG GATAGGGGAA ATCCCGATCA
251 AACTTTCCGA CGACGGGAAA GAGCTGTATG TCGAACGTAG GCAGTATGTC
301 AAAACCGATG CGGCGATGAA GGACAAAATC ATCGCCCATC AGAAAAAGTG
351 CGGACAAACA GCACAGGCAT ACCGCGACGC GCGAAATGCG TTGCCGTCAA
401 ACCAGACGTA TCAGCAGCAT CTGGCGGCGA TCGAGCAATT GAAACGGCGG
451 TTTGAAGCCG AGTTTGACGA ATTGGAAAAA GAAATCAAAT GCAACGGCAG
501 AAGCCCGGCA TTGTTGCTTT AG
```

This corresponds to the amino acid sequence <SEQ ID 2832; ORF 925-1>:

m925-1.pep..

```
  1 MKQMLLAVGV VAVLAGCGKD AGGYEGYWRE KSDKKEGMIA VKKEKGNYFL
 51 NKIHVVTGKE ESLLLSEKDG ALSINTGIGE IPIKLSDDGK ELYVERRQYV
101 KTDAAMKDKI IAHQKKCGQT AQAYRDARNA LPSNQTYQQH LAAIEQLKRR
151 FEAEFDELEK EIKCNGRSPA LLL*
```

m925/g925 92.5% identity in 173 aa overlap

```
                    10        20        30        40        50        60
m925-1.pep  MKQMLLAVGVVAVLAGCGKDAGGYEGYWREKSDKKEGMIAVKKEKGNYFLNKIHVVTGKE
            ||||||||||:||||||||||||||||||||||||||:||||| |||||||||:| ||||
g925-1      MKQMLLAVGVAAVLAGCGKDAGGYEGYWREKSDKKEGVIAVKK-KGNYFLNKINVFTGKE
                    10        20        30        40         50
                    70        80        90       100       110       120
m925-1.pep  ESLLLSEKDGALSINTGIGEIPIKLSDDGKELYVERRQYVKTDAAMKDKIIAHQKKCGQT
            ||||||||||||||||||||||||||||||||||||||:|||||||||||||||||||||
g925-1      ESLLLSEKDGALSINTGIGEIPIKLSDDGKELYVERRRYVKTDAAMKDKIIAHQKKCGQT
           60        70        80        90       100       110
                   130       140       150       160       170
m925-1.pep  AQAYRDARNALPSNQTYQQHLAAIEQLKRRFEAEFDELEKEIKCNGRSPALLLX
            |||| ||||||||||||||: ||||||||||||||||||||||||||: |:||:|
g925-1      AQAYLDARNALPSNQTYQQRQAAIEQLKRRFEAEFDELEKEIKCNGK-PTLLFX
          120       130       140       150       160        170
```

The following partial DNA sequence was identified in *N. meningitidis* <SEQ ID 2833>:

a925-1.seq

```
  1 AATAAAATCA ACGTGTTTAC AGGTAAGGAA GAATCTATGC TTTTGTCTGA
 51 AAAAGACGGC GCGCTTTCGA TAAACACGGG GATAGGGGAA ATCCCGATCA
101 AACTTTCCGA CGACGGGAAA GAGCTGTATG TCGAACGCAG GCAGTATGTC
151 AAAACCGATG CGGCGATGAA GGACAAAATC ATCGCCCATC AGAAAAAGTG
201 CGGACAAACG GCACAGGCAT ATCTCGACGC GCGAAATGCG TTGCCGTCAA
```

-continued

```
251 ACCAGACGTA TCAGCAGCAT CAGGCGGCGA TCGAGCAGTT GAAACGGCGG

301 TTTGAAGCCG AGTTTGACGA ATTGGAAAAA GAAATCAAAT GCAACGGCAA

351 ACCGACATTG TTGTTTTAG
```

This corresponds to the amino acid sequence <SEQ ID 2834; ORF 925-1.a>:

a925-1.pep

```
  1 NKINVFTGKE ESMLLSEKDG ALSINTGIGE IPIKLSDDGK ELYVERRQYV

 51 KTDAAMKDKI IAHQKKCGQT AQAYLDARNA LPSNQTYQQH QAAIEQLKRR

101 FEAEFDELEK EIKCNGKPTL LF*
```

a925-1/m925-1 92.7% identity in 123 aa overlap

```
                                                 10        20        30
a925-1.pep                                 NKINVFTGKEESMLLSEKDGALSINTGIGE
                                           |||:| ||||||:||||||||||||||||
m925-1      AGGYEGYWREKSDKKEGMIAVKKEKGNYFLNKIHVVTGKEESLLLSEKDGALSINTGIGE
                    30        40        50        60        70        80

                    40        50        60        70        80        90
a925-1.pep  IPIKLSDDGKELYVERRQYVKTDAAMKDKIIAHQKKCGQTAQAYLDARNALPSNQTYQQH
            |||||||||||||||||||||||||||||||||||||||||||| ||||||||||||||
m925-1      IPIKLSDDGKELYVERRQYVKTDAAMKDKIIAHQKKCGQTAQAYRDARNALPSNQTYQQH
                    90       100       110       120       130       140

                   100       110       120
a925-1.pep  QAAIEQLKRRFEAEFDELEKEIKCNGK-PTLLFX
             |||||||||||||||||||||||||:  |:||:|
m925-1      LAAIEQLKRRFEAEFDELEKEIKCNGRSPALLLX
                   150       160       170
```

The following partial DNA sequence was identified in *N. gonorrhoeae* <SEQ ID 2835>:

g926.seq (partial)

```
  1 ATGAAACACA CCGTATCCGC ATCGGTCATC CTGCTTTTGA CCGCTTGCGC

 51 GCAATTACCT CAAAATAACG AAAACCTGTG GCAGCCGTCC GAACACATCA

101 GCAGTTTTGC AGCGGAAGGG CGGTTGGCAG TCAAAGCGGA AGGGAAAGGT

151 TCGTATGCAA ATTTCGATTG GACATACCAA CCGCCCGTGG AAACCATCAA

201 TATCAACACC CCTTTGGGCA GTACGCTCGG ACAGTTGTGT CAAGacAGGG

251 ACGGCGCATT GGCAGTGGAC GGCAAAGGAA ATGTCTATCA GGCAGAGGGT

301 ACGgaagact tGAGCAGGCA GCTGGTCGGT TTCAAACTGC CAATCCAATA

351 TCTGCATATC TGGGCGGAAG GCAGGCGTGT GGCGGGCGCG CCTtaccGCA

401 TCCGTTCAGA CGGCATATTG GAACAATAcg GttggACAAT cgggCagaac

451 tgcCGACAGT GGGGGGCaag tccgaacgtt gcaactGAa...
```

This corresponds to the amino acid sequence <SEQ ID 2836; ORF 926.ng>:

g926.pep (partial)

```
  1 MKHTVSASVI LLLTACAQLP QNNENLWQPS EHISSFAAEG RLAVKAEGKG
 51 SYANFDWTYQ PPVETININT PLGSTLGQLC QDRDGALAVD GKGNVYQAEG
101 TEDLSRQLVG FKLPIQYLHI WAEGRRVAGA PYRIRSDGIL EQYGWTIGQN
151 CRQWGASPNV ATE...
```

The following partial DNA sequence was identified in *N. meningitidis* <SEQ ID 2837>:

m926.seq

```
  1 ATGAAACACA CCGTATCCGC ATCGGTCATC CTGCTTTTGA CCGCTTGCGC
 51 GCAATTACCT CAAAATAACG AAAACCTGTG GCAGCCGTCC GAACACATCA
101 GCAGTTTTGC AGCAGAAGGG CGGTTGGCAG TGAAAGCGGA AGGGAAAGGT
151 TCGTATGCAA ATTTCGATTG GACATACCAA CCGCCCGTGG AAACCATCAA
201 TATCAATACC CCTTTGGGCA GTACGCTCGG GCAGTTGTGT CAAGACAGGG
251 ACGGCGCATT GGCAGTGGAC GGCAAAGGAA ATGTCTATCA GGCGGAAAGT
301 GCGGAAGAAT TGAGCAGGCA GCTGGTCGGT TTCAAACTGC CAATCCAATA
351 TCTGCATATC TGGGCAGATG GCAGGCGTGT GGCGGGCGCG CCTTACCGCA
401 TCCTGCCGGA CGGCATATTG GAACAATACG GTTGGACTGT CGGCAGAACC
451 GCCGACAGTG GGGGGCAAGT CCGAACGTTG CAACTGAATA ACGGAAATTT
501 GAACATCAGG CTGGTTTTCA CCGAAATCGG TATGCCGTCT GAAACCGAAA
551 CCCCGGAACG CTGTGCGGCG CGCACGAGAT AA
```

This corresponds to the amino acid sequence <SEQ ID 2838; ORF 926>:

m926.pep

```
  1 MKHTVSASVI LLLTACAQLP QNNENLWQPS EHISSFAAEG RLAVKAEGKG
 51 SYANFDWTYQ PPVETININT PLGSTLGQLC QDRDGALAVD GKGNVYQAES
101 AEELSRQLVG FKLPIQYLHI WADGRRVAGA PYRILPDGIL EQYGWTVGRT
151 ADSGGQVRTL QLNNGNLNIR LVFTEIGMPS ETETPERCAA RTR*
```

g926/m926 91.6% identity in 155 aa overlap

```
                   10        20        30        40        50        60
g926.pep   MKHTVSASVILLLTACAQLPQNNENLWQPSEHISSFAAEGRLAVKAEGKGSYANFDWTYQ
           ||||||||||||||||||||||||||||||||||||||||||||||||||||||||||||
m926       MKHTVSASVILLLTACAQLPQNNENLWQPSEHISSFAAEGRLAVKAEGKGSYANFDWTYQ
                   10        20        30        40        50        60

                   70        80        90       100       110       120
g926.pep   PPVETININTPLGSTLGQLCQDRDGALAVDGKGNVYQAEGTEDLSRQLVGFKLPIQYLHI
           |||||||||||||||||||||||||||||||||||||||::|:|||||||||||||||||
m926       PPVETININTPLGSTLGQLCQDRDGALAVDGKGNVYQAESAEELSRQLVGFKLPIQYLHI
                   70        80        90       100       110       120

                  130       140       150       160
g926.pep   WAEGRRVAGAPYRIRSDGILEQYGWTIGQNCRQWGASPNVATE
           ||:|||||||||||  ||||||||||:|::  : |
m926       WADGRRVAGAPYRILPDGILEQYGWTVGRTADSGGQVRTLQLNNGNLNIRLVFTEIGMPS
                  130       140       150       160       170       180
```

a926.seq

```
  1 ATGAAACACA CTGTATCCGC ATCGGTCATC CTGCTTTTGA CCGCTTGCGC
 51 GCAATTACCT CAAAATAACG AAAACCTGTG GCAGCCGTCC GAACACACCC
101 GCAGTTTCAC GGCGGAAGGG CGGTTGGCAG TGAAAGCGGA AGGGAAAGGT
151 TCGTATGCAA ATTTCGATTG GACATACCAA CCGCCCGTGG AAACCATCAA
201 TATCAACACC CCTTTGGGCA GTACGCTCGG GCAGTTGTGT CAAGACAGGG
251 ACGGCGCATT GGCAGTGGAC GGCAAAGGAA ATGTCTATCA GGCGGAAAGT
301 GCGGAAGAAT TGAGCAGGCA GCTGGTCGGT TTCAAACTGC CAATCCAATA
351 TCTGCATATC TGGGCAGATG GCAGGCCTGT GGCGGGCGCG CCTTACCGCA
401 TCCTGCCGGA CGGCATATTG GAACAATACG GTTGGACTGT CGGCAGAACC
451 GCCGACAGTG GGGGGCAAGT CCGAACGTTG CAACTGAATA ACGGAAATTT
501 GAACATCAGG CTGGTTTTCA CCGAGATTGG TATGCCGTCT GAAACCGAAA
551 CCCAAGAACA ATGCGCGGCA CGCATACAGT AA
```

a926.pep

```
  1 MKHTVSASVI LLLTACAQLP QNNENLWQPS EHTRSFTAEG RLAVKAEGKG
 51 SYANFDWTYQ PPVETININT PLGSTLGQLC QDRDGALAVD GKGNVYQAES
101 AEELSRQLVG FKLPIQYLHI WADGRPVAGA PYRILPDGIL EQYGWTVGRT
151 ADSGGQVRTL QLNNGNLNIR LVFTEIGMPS ETETQEQCAA RIQ*
```

m926/a926 96.9% identity in 191 aa overlap

```
                    10        20        30        40        50        60
m926.pep    MKHTVSASVILLLTACAQLPQNNENLWQPSEHISSFAAEGRLAVKAEGKGSYANFDWTYQ
            ||||||||||||||||||||||||||||||||  ||:|||||||||||||||||||||||
a926        MKHTVSASVILLLTACAQLPQNNENLWQPSEHTRSFTAEGRLAVKAEGKGSYANFDWTYQ
                    10        20        30        40        50        60

                    70        80        90       100       110       120
m926.pep    PPVETININTPLGSTLGQLCQDRDGALAVDGKGNVYQAESAEELSRQLVGFKLPIQYLHI
            ||||||||||||||||||||||||||||||||||||||||||||||||||||||||||||
a926        PPVETININTPLGSTLGQLCQDRDGALAVDGKGNVYQAESAEELSRQLVGFKLPIQYLHI
                    70        80        90       100       110       120

                   130       140       150       160       170       180
m926.pep    WADGRRVAGAPYRILPDGILEQYGWTVGRTADSGGQVRTLQLNNGNLNIRLVFTEIGMPS
            ||||| ||||||||||||||||||||||||||||||||||||||||||||||||||||||
a926        WADGRPVAGAPYRILPDGILEQYGWTVGRTADSGGQVRTLQLNNGNLNIRLVFTEIGMPS
                   130       140       150       160       170       180

                   190
m926.pep    ETETPERCAARTRX
            |||| |:||||
a926        ETETQEQCAARIQX
                   190
```

The following partial DNA sequence was identified in *N. gonorrhoeae* <SEQ ID 2839>:

g927.seq

```
  1 atgaaaacct acGCAcAggC ACTCTATacc GCAGCCCTGC TCACCGCCTG
 51 CAGCCCCcgca GCcgatTcaa accaTCCGTC CGGAcAaAAT GCCCCGGCCA
101 ATACCGAATC cgacGgaaAA AACATtaccC TGctcaatgc cTcgtacgat
151 gtGACACGGT ATTTttacaa agaatacgac cacTtgtttg tcggaaCATA
```

-continued

```
201 CCAATCCGAA CACCCCGGCA CATCCGTCAG CATCCAACAA TCCCACGGCG
251 GCTTCAGCAA ACAGGCATTA TCCGTAGCCA ACGGCCTTCA AGCCGATGTC
301 GTAACCATGA ACCAATCTTC CGACATCGAC CTGCTCGAAA AAAA.GGACT
351 GGTAGAAAAA GGCTGGCAAC AAGCCCTCCC CGATCACGCC GCACCCTACA
401 CCAGCACTAT GGTTTTCCTT GTCCGAAAAA ACAACCCcaa ACAGAtccgC
451 GATTGGAACG ACCTTGCCAA AGACGGCGTT AACATCGTCA TCGCCAAGAC
501 CTCGGGCAAC GGACGCTACG CCTTCCTCGG CGCATACGGT TACGGTCTGA
551 AAGCCAACAA CGGcaaCGAG CAGGAAGCCC AAAAACTCGT CGCATCCATC
601 CTCAAAAACA CACCCGTTTT TGAAAACGGC GGACGCGc.C CGCCGCCACC
651 ACCTTCACAC AACGCAACAT CGGCGACGTA CTCATCACTT TTGAAAACga
701 agCcaactac gtCAGCAAAA AACTGA
```

This corresponds to the amino acid sequence <SEQ ID 2840; ORF 927.ng>:

g927.pep

```
  1 MKTYAQALYT AALLTACSPA ADSNHPSGQN APANTESDGK NITLLNASYD
 51 VTRYFYKEYD HLFVGTYQSE HPGTSVSIQQ SHGGFSKQAL SVANGLQADV
101 VTMNQSSDID LLEKXGLVEK GWQQALPDHA APYTSTMVFL VRKNNPKQIR
151 DWNDLAKDGV NIVIAKTSGN GRYAFLGAYG YGLKANNGNE QEAQKLVASI
201 LKNTPVFENG GRXPPPPPSH NATSATYSSL LKTKPTTSAK N*
```

The following partial DNA sequence was identified in *N. meningitidis* <SEQ ID 2841>:

m927.seq

```
  1 ATGAAAACCT ACGCACCGGC ACTCTATACC GCAGCCCTGC TCACCGCCTG
 51 CAGCCCCGCA GCCGATTCAA ACCATCCGTC CGGACAAAAT GCCCCGGCCA
101 ATACCGAATC CGACGGAAAA AACATTACCC TGCTCAACGC CTCATACGAT
151 GTGGCACGGG ATTTTTACAA AGAATACAAC CCCTTATTTA TCAAAACATA
201 CCAATCCGAA CACCCCGGCA CATCCGTCAG CATCCAACAG TCCCACGGCG
251 GCTCCAGCAA ACAGGCATTA TCCGTAGCCA ACGGCCTTCA AGCCGATGTC
301 GTAACCATGA ACCAATCCTC CGACATCGAC CTGCTCGAAA AAAAAGGACT
351 GGTAGAAAAA GGCTGGCAAC AAGCCCTCCC CGACCACGCC GCGCCCTACA
401 CCAGCACTAT GGTTTTCCTT GTCCGAAAAA ACAACCCCAA ACAGATCCGC
451 GATTGGAACG ACCTTGCCAA AGACGGCGTT AACATCGTCA TCGCCAATCC
501 CAAAACCTCG GGCAACGGAC GCTACGCCTT CCTCGGCGCA TACGGTTACG
551 GTCTGAAAAC CACCAACGGC AACGAACAGG AAGCCCAAAA ACTCGTCGCA
601 TCCATCCTCA AAAACACCCC CGTTTTTGAA AACGGCGGAC GCkCgCCACC
651 ACCACCTTCA CACAACGCAA CATCGGCGAC GTACTCATCA CTTTTGAAAA
701 CGAAGCCAAC TACGTCAGCr AAAAACtGA
```

This corresponds to the amino acid sequence <SEQ ID 2842; ORF 927>:

m927.pep

```
  1 MKTYAPALYT AALLTACSPA ADSNHPSGQN APANTESDGK NITLLNASYD
 51 VARDFYKEYN PLFIKTYQSE HPGTSVSIQQ SHGGSSKQAL SVANGLQADV
101 VTMNQSSDID LLEKKGLVEK GWQQALPDHA APYTSTMVFL VRKNNPKQIR
151 DWNDLAKDGV NIVIANPKTS GNGRYAFLGA YGYGLKTTNG NEQEAQKLVA
201 SILKNTPVFE NGGRXPPPPS HNATSATYSS LLKTKPTTSA KN*
```

Computer analysis of this amino acid sequence gave the following results:

Homology with a predicted ORF from *N. gonorrhoeae*

ORF 927 shows 94.2% identity over a 243 aa overlap with a predicted ORF (ORF 927.ng) from *N. gonorrhoeae*:

```
g927/m927

                        10        20        30        40        50        60
g927.pep        MKTYAQALYTAALLTACSPAADSNHPSGQNAPANTESDGKNITLLNASYDVTRYFYKEYD
                ||||| ||||||||||||||||||||||||||||||||||||||||||||||:| ||||:
m927            MKTYAPALYTAALLTACSPAADSNHPSGQNAPANTESDGKNITLLNASYDVARDFYKEYN
                        10        20        30        40        50        60

                        70        80        90       100       110       120
g927.pep        HLFVGTYQSEHPGTSVSIQQSHGGFSKQALSVANGLQADVVTMNQSSDIDLLEKXGLVEK
                 ||: ||||||||||||||||||| ||||||||||||||||||||||||||||| |||||
m927            PLFIKTYQSEHPGTSVSIQQSHGGSSKQALSVANGLQADVVTMNQSSDIDLLEKKGLVEK
                        70        80        90       100       110       120

                       130       140       150       160         170
g927.pep        GWQQALPDHAAPYTSTMVFLVRKNNPKQIRDWNDLAKDGVNIVIA--KTSGNGRYAFLGA
                |||||||||||||||||||||||||||||||||||||||||||||  |||||||||||||
m927            GWQQALPDHAAPYTSTMVFLVRKNNPKQIRDWNDLAKDGVNIVIANPKTSGNGRYAFLGA
                       130       140       150       160       170       180

              180       190       200       210       220       230
g927.pep        YGYGLKANNGNEQEAQKLVASILKNTPVFENGGRXPPPPPSHNATSATYSSLLKTKPTTS
                ||||||::||||||||||||||||||||||||||||||| ||||||||||||||||||||
m927            YGYGLKTTNGNEQEAQKLVASILKNTPVFENGGRXPPPP-SHNATSATYSSLLKTKPTTS
                       190       200       210          220       230

              240
g927.pep        AKNX
                ||||
m927            AKNX
             240
```

The following partial DNA sequence was identified in *N. meningitidis* <SEQ ID 2843>:

a927.seq

```
  1 ATGAAAACCT ACGCACCGGC ACTCTATACC GCAGCCCTGC TCAGCGCCTG
 51 CAGCCCCGCA GCCGATTCAA ACCATCCGTC CGGACAAAAT GCCCCGGCCA
101 ATACCGAATC CGACGGAAAA AACATTACCC TGCTCAACGC CTCATACGAT
151 GTGGCACGGG ATTTTTACAA AGAATACAAC CCCTTATTTA TCAAAACATA
201 CCAATCCGAA CACCCCGGCA CATCCGTCAG CATCCAACAG TCCCACGGCG
251 GCTCCAGCAA ACAGGCATTA TCCGTAGCCA ACGGCCTTCA AGCCGATGTC
301 GTAACCATGA ACCAATCCTC CGACATCGAC CTGCTCGAAA AAAAAGGACT
351 GGTAGAAAAA GGCTGGCAAC AAGCCCTCCC CGACCACGCC GCGCCCTACA
```

-continued

```
401 CCAGCACTAT GGTTTTCCTT GTCCGAAAAA ACAACCCCAA ACAGATCCGC

451 GATTGGAACG ACCTTGCCAA AGACGGCGTT AACATCGTCA TCGCCAATCC

501 CAAAACCTCG GGCAACGGAC GCTACGCCTT CCTCGGCGCA TACGGTTACG

551 GTCTGAAAAC CACCAACGGC AACGAACAGG AAGCCCAAAA ACTCGTCGCA

601 TCCATCCTCA AAAACACCCC CGTTTTTGAA AACGGCGGAC GCGCGCCACC

651 ACCACCTTCA CACAACGCAA CATCGGCGAC GTACTCATCA CTTTTGAAAA

701 CGAAGCCAAC TACGTCAGCA AAAAACTGA
```

This corresponds to the amino acid sequence <SEQ ID 2844; ORF 927.a>:

a927.pep

```
  1 MKTYAPALYT AALLSACSPA ADSNHPSGQN APANTESDGK NITLLNASYD

 51 VARDFYKEYN PLFIKTYQSE HPGTSVSIQQ SHGGSSKQAL SVANGLQADV

101 VTMNQSSDID LLEKKGLVEK GWQQALPDHA APYTSTMVFL VRKNNPKQIP

151 DWNDLAKDGV NIVIANPKTS GNGRYAFLGA YGYGLKTTNG NEQEAQKLVA

201 SILKNTPVFE NGGRAPPPPS HNATSATYSS LLKTKPTTSA KN*
```

m927/a927 99.2% identity in 242 aa overlap

```
                 10        20        30        40        50        60
m927.pep  MKTYAPALYTAALLTACSPAADSNHPSGQNAPANTESDGKNITLLNASYDVARDFYKEYN
          ||||||||||||||:|||||||||||||||||||||||||||||||||||||||||||||
a927      MKTYAPALYTAALLSACSPAADSNHPSGQNAPANTESDGKNITLLNASYDVARDFYKEYN
                 10        20        30        40        50        60

                 70        80        90       100       110       120
m927.pep  PLFIKTYQSEHPGTSVSIQQSHGGSSKQALSVANGLQADVVTMNQSSDIDLLEKKGLVEK
          ||||||||||||||||||||||||||||||||||||||||||||||||||||||||||||
a927      PLFIKTYQSEHPGTSVSIQQSHGGSSKQALSVANGLQADVVTMNQSSDIDLLEKKGLVEK
                 70        80        90       100       110       120

                130       140       150       160       170       180
m927.pep  GWQQALPDHAAPYTSTMVFLVRKNNPKQIRDWNDLAKDGVNIVIANPKTSGNGRYAFLGA
          ||||||||||||||||||||||||||||||||||||||||||||||||||||||||||||
a927      GWQQALPDHAAPYTSTMVFLVRKNNPKQIRDWNDLAKDGVNIVIANPKTSGNGRYAFLGA
                130       140       150       160       170       180

                190       200       210       220       230       240
m927.pep  YGYGLKTTNGNEQEAQKLVASILKNTPVFENGGRXPPPPSHNATSATYSSLLKTKPTTSA
          |||||||||||||||||||||||||||||||||| |||||||||||||||||||||||||
a927      YGYGLKTTNGNEQEAQKLVASILKNTPVFENGGRAPPPPSHNATSATYSSLLKTKPTTSA
                190       200       210       220       230       240

m927.pep  KNX
          |||
a927      KNX
```

The following partial DNA sequence was identified in *N. gonorrhoeae* <SEQ ID 2845>:

g929.seq

```
  1 ATGAAATTGG GTTTCAAACC GATACCCCTC GCCATTGCCG CAGTATTGTG

 51 CGCCCTGGTT TTGGCACTGC CCGTACccga CGGGGTCAAG CCTCAGGCTT

101 GGACGCTGCT GGCTATGTTT GTCGGTGTGA TTGCCGCCAT TATCGGCAAG

151 GTTATGCCGT TGGGCGCGCT GTCGATTATT GCCGTCGGGT TGGTCGCAGT

201 AACCGGCGTA ACCGCCGACA AACCGGGCGC GGCGATGAGC GATGCGTTGA
```

-continued

```
 251 GTGCGTTCGC CAATCCGTTG ATTTGGCTGA TTGCCATCGC AGTTATGATT
 301 TCGCGCGGTT TGCTCAAAAC AGGGCTGGGG ATGCGTATCG GATATTTGTT
 351 TATCGCCGTT TTTGGAAGAA AAAcgctggG CATCGGTTAC AGTCTCGCTC
 401 TTTCCGAACT GCTGCTGGCT CCCGTTACCC CTTCCAATAC CGCGCGCGGC
 451 GGCGGCATTA TACATCcgaT TATGCagtcg attgCcggCA GttacggctC
 501 caatCCCGCA AAAGGCACag aaggcaagat gggtaAATAT TtggcTTtgg
 551 tcaattaTCA TTCcaaTCCC atttcgtcgg ctAtggctat taCTGcaact
 601 gCCCCcaaCC CTTTAATcgt caacttgatt gccGaaaaTt taggcagtag
 651 tttccgtCTT TCttgggggg cgTGGGcgtg ggcaaTGGCT Gttcccggcg
 701 ttatcgcctt TTtcgTTATG CCTTTGATTT TATATTTTTT GTATCCGCCT
 751 GAAATTAAAG AAACGCCCAA TGCTGttcAA TTTGCCAAAG ACCGTCTGAG
 801 CGAGATGGGT AAAATGtcgg CAGACGAAAT CATTATGGCG GTCATTTTCG
 851 GTATCTTGCT GCTGTTGTGG GCAGATGTTC CCGCCCTTAT TACCGGCAAT
 901 CACGCTTTTA GTATCAacgc caccGCCACC GCATTTATCG GATTAAGCCT
 951 GCTTTTGCTT TCCGGTGTAT TGACTTGGGA CGATGTTTTG AAAGAAAAAA
1001 GCGCGTGGGA TACGATTATT TGGTTTGGCG CATTGATTAT GATGGCCGCA
1051 TTTTTaAATA AActcggact gattaaatGG TTCTCCGGAG TGTTGGCGGA
1101 AagtgtcggC GGTTTGGGCG TTAGCGGCAC GGCTGCGGGC GTAATCCTCG
1151 TGCTTGCtta TATGTATGCG CATTATATGT TTGCCAGTAC TACTGCACAT
1201 ATTACCGCTA TGTTCGGCGC ATTTCTCGCT GCTGCCGTTT CACTGAATGC
1251 CCCGGCGATG CCGACTGCGC TGATGATGGC GGCCGCATCC AACATTATGA
1301 TGACCCTCAC TCATTATGCG ACCGGTACTT CACCTGTGAT TTTCGGCTCG
1351 GGCTACACCA CAATGGGAGA ATGGTGGAAG GCGGGTTTTA TCATGAGCGT
1401 AGTCAATTTT CTGATTTTTT CCGTTATCGG CAGCATTTGG TGGAAAGTTC
1451 TGGGATATTG GTAA
```

This corresponds to the amino acid sequence <SEQ ID 2846; ORF 929.ng>:

g929.pep

```
  1 MKLGFKPIPL AIAAVLCALV LALPVPDGVK PQAWTLLAMF VGVIAAIIGK
 51 VMPLGALSII AVGLVAVTGV TADKPGAAMS DALSAFANPL IWLIAIAVMI
101 SRGLLKTGLG MRIGYLFIAV FGRKTLGIGY SLALSELLLA PVTPSNTARG
151 GGIIHPIMQS IAGSYGSNPA KGTEGKMGKY LALVNYHSNP ISSAMAITAT
201 APNPLIVNLI AENLGSSFRL SWGAWAWAMA VPGVIAFFVM PLILYFLYPP
251 EIKETPNAVQ FAKDRLSEMG KMSADEIIMA VIFGILLLLW ADVPALITGN
301 HAFSINATAT AFIGLSLLLL SGVLTWDDVL KEKSAWDTII WFGALIMMAA
351 FLNKLGLIKW FSGVLAESVG GLGVSGTAAG VILVLAYMYA HYMFASTTAH
401 ITAMFGAFLA AAVSLNAPAM PTALMMAAAS NIMMTLTHYA TGTSPVIFGS
451 GYTTMGEWWK AGFIMSVVNF LIFSVIGSIW WKVLGYW*
```

The following partial DNA sequence was identified in *N. meningitidis* <SEQ ID 2847>:

m929.seq

```
   1 ATGAAATTGG GTTTCAAACC GATACCCCTC GCCATTGCCG CAGTATTGTG
  51 CGCCCTGGTT TTGGCACTGC CCGTACCCGA CGGGGTCAAG CCTCAGGCTT
 101 GGACGCTGCT GGCCATGTTT GTCGGTGTGA TTGCCGCCAT TATCGGCAAG
 151 GCCATGCCGT TGGGCGCGCT GTCGATTATT GCCGTCGGGT TGGTCGCAGT
 201 AACCGGCGTA ACCGCCGACA AACCGGGCGC GGCGATGAGC GATGCGTTGA
 251 GTGCGTTCGC CAATCCGTTG ATTTGGCTGA TTGCCATCGC AGTTATGATT
 301 TCGCGCGGTT TGCTCAAAAC AGGGCTGGGG ATGCGTATCG GATATTTGTT
 351 TATCGCCGTT TTTGGAAGAA AAACGCTGGG CATCGGTTAC AGTCTCGCTC
 401 TTTCCGAACT GCTGCTGGCT CCCGTTACCC CTTCCAATAC CGCGCGCGGC
 451 GGCGGCATTA TACATCCGAT TATGCAGTCG ATTGCCGGCA GTTACGGCTC
 501 CAATCCCGCA AAAGGCACAG AAGGCAAGAT GGGTAAATAT TTGGCTTTGG
 551 TCAACTATCA TTCCAATCCC ATTTCGTCGG CTATGTTTAT TACTGCAACT
 601 GCCCCCAACC CTTTAATCGT CAACTTGATT GCCGAAAATT TAGGCAGTAG
 651 TTTCCGTCTT TCTTGGGGGG CGTGGGCGTG GGCAATGGCT GTTCCCGGCG
 701 TTATCGCCTT TTTCGTTATG CCTTTGATTT TATATTTwyT GTATCCGCCT
 751 GAAATTAAAG AAACGCCCAA TGCCGTTCAA TTTGCCAAAG ACCGTCTGAG
 801 GGAGATGGGT AAAATGTCGG CAGACGAAAT CATTATGGCG GTCATTTTCG
 851 GTATCTTGCT GCTGTTGTGG GCAGATGTTC CCGCCCTTAT TACCGGCAAT
 901 CACGCTTTTA GTATCAACGC CACCGCCACC GCATTTATCG GATTAAGCCT
 951 GCTTTTGCTT TCCGGTGTAT TGACTTGGGA CGATGTTTTG AAAGAAAAAA
1001 GCGCGTGGGA TACGATTATT TGGTTTGGCG CATTGATTAT GATGGCCGCA
1051 TTTTTAAATA AACTCGGACT GATTAAATGG TTCTCCGGAG TGTTGGCGGA
1101 AAGTGTCGGC GGTTTGGGCG TTAGCGGCAC GGCTGCGGGC GTAATCCTCG
1151 TGCTTGCTTA TATGTATGCG CATTATATGT TTGCCAGTAC TACTGCACAT
1201 ATTACCGCTA TGTTCGGCGC ATTTTTCGCT GCTGCCGTTT CACTGAATGC
1251 CCCGGCGATG CCGACCGCGC TGATGATGGC GgCCGCATCC AACATTATGA
1301 TGACCCTCAC TCATTATGCG ACCGGTACTT CGCCTGTGAT TTTCGGTTCG
1351 GGCTACACCA CAATGGGAGA ATGGTGGAAG GCGGGTTTTA TCATGAGCGT
1401 AGTCAATTTT CTGATTTTTT TCGTTATCGG CAGCATTTGG TGGAAAGTTC
1451 TGGGGTATTG GTAA
```

This corresponds to the amino acid sequence <SEQ ID 2848; ORF 929>:

m929.pep

```
   1 MKLGFKPIPL AIAAVLCALV LALPVPDGVK PQAWTLLAMF VGVIAAIIGK
  51 AMPLGALSII AVGLVAVTGV TADKPGAAMS DALSAFANPL IWLIAIAVMI
 101 SRGLLKTGLG MRIGYLFIAV FGRKTLGIGY SLALSELLLA PVTPSNTARG
```

-continued

```
151 GGIIHPIMQS IAGSYGSNPA KGTEGKMGKY LALVNYHSNP ISSAMFITAT

201 APNPLIVNLI AENLGSSFRL SWGAWAWAMA VPGVIAFFVM PLILYXLYPP

251 EIKETPNAVQ FAKDRLREMG KMSADEIIMA VIFGILLLLW ADVPALITGN

301 HAFSINATAT AFIGLSLLLL SGVLTWDDVL KEKSAWDTII WFGALIMMAA

351 FLNKLGLIKW FSGVLAESVG GLGVSGTAAG VILVLAYMYA HYMFASTTAH

401 ITAMFGAFFA AAVSLNAPAM PTALMMAAAS NIMMTLTHYA TGTSPVIFGS

451 GYTTMGEWWK AGFIMSVVNF LIFFVIGSIW WKVLGYW*
```

Computer analysis of this amino acid sequence gave the following results:

Homology with a predicted ORF from *N. gonorrhoeae*

ORF 929 shows 98.8% identity over a 487 aa overlap with a predicted ORF (ORF 929.ng) from *N. gonorrhoeae*:

```
g929/m929

                         10        20        30        40        50        60
g929.pep    MKLGFKPIPLAIAAVLCALVLALPVPDGVKPQAWTLLAMFVGVIAAIIGKVMPLGALSII
            ||||||||||||||||||||||||||||||||||||||||||||||||||:|||||||||
m929        MKLGFKPIPLAIAAVLCALVLALPVPDGVKPQAWTLLAMFVGVIAAIIGKAMPLGALSII
                    10        20        30        40        50        60

                    70        80        90       100       110       120
g929.pep    AVGLVAVTGVTADKPGAAMSDALSAFANPLIWLIAIAVMISRGLLKTGLGMRIGYLFIAV
            ||||||||||||||||||||||||||||||||||||||||||||||||||||||||||||
m929        AVGLVAVTGVTADKPGAAMSDALSAFANPLIWLIAIAVMISRGLLKTGLGMRIGYLFIAV
                    70        80        90       100       110       120

                   130       140       150       160       170       180
g929.pep    FGRKTLGIGYSLALSELLLAPVTPSNTARGGGIIHPIMQSIAGSYGSNPAKGTEGKMGKY
            ||||||||||||||||||||||||||||||||||||||||||||||||||||||||||||
m929        FGRKTLGIGYSLALSELLLAPVTPSNTARGGGIIHPIMQSIAGSYGSNPAKGTEGKMGKY
                   130       140       150       160       170       180
                   190       200       210       220       230       240
g929.pep    LALVNYHSNPISSAMAITATAPNPLIVNLIAENLGSSFRLSWGAWAWAMAVPGVIAFFVM
            ||||||||||||||| ||||||||||||||||||||||||||||||||||||||||||||
m929        LALVNYHSNPISSAMFITATAPNPLIVNLIAENLGSSFRLSWGAWAWAMAVPGVIAFFVM
                   190       200       210       220       230       240
                   250       260       270       280       290       300
g929.pep    PLILYFLYPPEIKETPNAVQFAKDRLSEMGKMSADEIIMAVIFGILLLLWADVPALITGN
            ||||| ||||||||||||||||||||| ||||||||||||||||||||||||||||||||
m929        PLILYXLYPPEIKETPNAVQFAKDRLREMGKMSADEIIMAVIFGILLLLWADVPALITGN
                   250       260       270       280       290       300
                   310       320       330       340       350       360
g929.pep    HAFSINATATAFIGLSLLLLSGVLTWDDVLKEKSAWDTIIWFGALIMMAAFLNKLGLIKW
            ||||||||||||||||||||||||||||||||||||||||||||||||||||||||||||
m929        HAFSINATATAFIGLSLLLLSGVLTWDDVLKEKSAWDTIIWFGALIMMAAFLNKLGLIKW
                   310       320       330       340       350       360
                   370       380       390       400       410       420
g929.pep    FSGVLAESVGGLGVSGTAAGVILVLAYMYAHYMFASTTAHITAMFGAFLAAAVSLNAPAM
            ||||||||||||||||||||||||||||||||||||||||||||||||:|||||||||||
m929        FSGVLAESVGGLGVSGTAAGVILVLAYMYAGYMFASTTAHITAMFGAFFAAAVSLNAPAM
                   370       380       390       400       410       420
                   430       440       450       460       470       480
g929.pep    PTALMMAAASNIMMTLTHYATGTSPVIFGSGYTTMGEWWKAGFIMSVVNFLIFSVIGSIW
            ||||||||||||||||||||||||||||||||||||||||||||||||||||| ||||||
m929        PTALMMAAASNIMMTLTHYATGTSPVIFGSGYTTMGEWWKAGFIMSVVNFLIFFVIGSIW
                   430       440       450       460       470       480

g929.pep    WKVLGYWX
            ||||||||
m929        WKVLGYWX
```

The following partial DNA sequence was identified in *N. meningitidis* <SEQ ID 2849>:

a929.seq

```
   1 ATGAAATTGG GTTTCAAACC GATACCCCTC GCCATTGCCG CAGTATTGTG
  51 CGCCTTGGTT TTGGCACTGC CCGTACCCGA CGGGGTCAAG CCTCAGGCTT
 101 GGACGCTGCT GGCCATGTTT ATCGGTGTGA TTGCCGCCAT TATCGGCAAG
 151 GCCATGCCGT TGGGTGCGCT GTCGATTATT GCCGTCGGGT TGGTCGCAGT
 201 AACCGGCGTA ACCGCCGACA AACCGGGTGC GGCGATGAGC GATGCGTTGA
 251 GTGCGTTCGC CAATCCGTTG ATTTGGCTGA TTGCCATCGC AGTTATGATT
 301 TCGCGCGGTT TGCTCAAAAC AGGGCTGGGG ATGCGTATCG GATATTTGTT
 351 TATCGCCGTT TTTGGAAGAA AAACGCTGGG CATCGGTTAC AGTCTCGCTC
 401 TTTCCGAACT GCTGCTGGCT CCCGTTACCC CTTCCAATAC CGCGCGCGGC
 451 GGCGGCATTA TACATCCGAT TATGCAGTCG ATTGCCGGCA GTTACGGCTC
 501 CAATCCCGCA AAAGGCACAG AAGGCAAGAT GGGTAAATAT TTGGCTTTGG
 551 TCAACTATCA TTCCAATCCC ATTTCGTCGG CTATGTTTAT TACTGCAACT
 601 GCCCCCAACC CTTTAATCGT CAACTTGATT GCCGAAAATT TAGGCAGTAG
 651 TTTCCGTCTT TCTTGGGGGG CGTGGGCGTG GGCAATGGCT GTTCCCGGCG
 701 TTATCGCCTT TTTCGTTATG CCTTTGATTT TATATTTTTT GTATCCGCCT
 751 GAAATTAAAG AAACGCCCAA TGCCGTTCAA TTTGCCAAAG ACCGTCTGAG
 801 GGAGATGGGT AAAATGTCGG CAGACGAAAT CATTATGGCG GTCATTTTCG
 851 GTATCTTGTT GCTGTTGTGG GCAGATGTTC CCGCCCTTAT TACCGGCAAT
 901 CACGCTTTTA GTATCAACGC CACCGCCACC GCATTTATCG GATTAAGCCT
 951 GCTTTTGCTT TCCGGTGTAT TGACTTGGGA CGATGTTTTG AAAGAAAAAA
1001 GCGCGTGGGA TACGATTATT TGGTTTGGCG CATTGATTAT GATGGCCGCA
1051 TTTTTAAATA AACTCGGACT GATTAAATGG TTCTCCGGAG TGTTGGCGGA
1101 AAGTGTCGGC GGTTTGGGCG TTAGCGGCAC GGCTGCGGGC GTAATCCTCG
1151 TGCTTGCTTA TATGTATGCG CATTATATGT TTGCCAGTAC TACTGCACAT
1201 ATTACCGCTA TGTTCGGCGC ATTTTTCGCT GCTGCCGTTT CACTGAATGC
1251 CCCGGCGATG CCGACCGCGC TGATGATGGC GGCCGCATCT AACATTATGA
1301 TGACCCTCAC TCATTATGCG ACCGGTACTT CGCCTGTGAT TTTCGGTTCG
1351 GGCTACACCA CAATGGGAGA ATGGTGGAAG GCGGGTTTTA TCATGAGCGT
1401 AGTCAATTTT CTGATTTTTT TCGTTATCGG CAGCATTTGG TGGAAAGTTC
1451 TGGGGTATTG GTAA
```

This corresponds to the amino acid sequence <SEQ ID 2850; ORF 929.a>:

a929.pep

```
  1 MKLGFKPIPL AIAAVLCALV LALPVPDGVK PQAWTLLAMF IGVIAAIIGK

 51 AMP
MKLGFKPIPL AIAAVLCALV LALPVPDGVK PQAWTLLAMF IGVIALGALSII AVGLVAVTGV
MKLGFKPIPL AIAAVLCALV LALPVPDGVK PQAWTLLAMF IGVIA TADKPGAAMS
DALSAFANPL IWLIAIAVMI

101 SRGLLKTGLG MRIGYLFIAV FGRKTLGIGY SLALSELLLA PVTPSNTARG
```

-continued

```
151 GGIIHPIMQS IAGSYGSNPA KGTEGKMGKY LALVNYHSNP ISSAMFITAT

201 APNPLIVNLI AENLGSSFRL SWGAWAWAMA VPGVIAFFVM PLILYFLYPP

251 EIKETPNAVQ FAKDRLREMG KMSADEIIMA VIFGILLLLW ADVPALITGN

301 HAFSINATAT AFIGLSLLLL SGVLTWDDVL KEKSAWDTII WFGALIMMAA

351 FLNKLGLIKW FSGVLAESVG GLGVSGTAAG VILVLAYMYA HYMFASTTAH

401 ITAMFGAFFA AAVSLNAPAM PTALMMAAAS NIMMTLTHYA TGTSPVIFGS

451 GYTTMGEWWK AGFIMSVVNF LIFFVIGSIW WKVLGYW*
```

m929/a929 99.6% identity in 487 aa overlap

```
                   10        20        30        40        50        60
m929.pep   MKLGFKPIPLAIAAVLCALVLALPVPDGVKPQAWTLLAMFVGVIAAIIGKAMPLGALSII
           ||||||||||||||||||||||||||||||||||||||||:|||||||||||||||||||
a929       MKLGFKPIPLAIAAVLCALVLALPVPDGVKPQAWTLLAMFIGVIAAIIGKAMPLGALSII
                   10        20        30        40        50        60

                   70        80        90       100       110       120
m929.pep   AVGLVAVTGVTADKPGAAMSDALSAFANPLIWLIAIAVMISRGLLKTGLGMRIGYLFIAV
           ||||||||||||||||||||||||||||||||||||||||||||||||||||||||||||
a929       AVGLVAVTGVTADKPGAAMSDALSAFANPLIWLIAIAVMISRGLLKTGLGMRIGYLFIAV
                   70        80        90       100       110       120

                  130       140       150       160       170       180
m929.pep   FGRKTLGIGYSLALSELLLAPVTPSNTARGGGIIHPIMQSIAGSYGSNPAKGTEGKMGKY
           ||||||||||||||||||||||||||||||||||||||||||||||||||||||||||||
a929       FGRKTLGIGYSLALSELLLAPVTPSNTARGGGIIHPIMQSIAGSYGSNPAKGTEGKMGKY
                  130       140       150       160       170       180

                  190       200       210       220       230       240
m929.pep   LALVNYHSNPISSAMFITATAPNPLIVNLIAENLGSSFRLSWGAWAWAMAVPGVIAFFVM
           ||||||||||||||||||||||||||||||||||||||||||||||||||||||||||||
a929       LALVNYHSNPISSAMFITATAPNPLIVNLIAENLGSSFRLSWGAWAWAMAVPGVIAFFVM
                  190       200       210       220       230       240

                  250       260       270       280       290       300
m929.pep   PLILYXLYPPEIKETPNAVQFAKDRLREMGKMSADEIIMAVIFGILLLLWADVPALITGN
           ||||| ||||||||||||||||||||||||||||||||||||||||||||||||||||||
a929       PLILYFLYPPEIKETPNAVQFAKDRLREMGKMSADEIIMAVIFGILLLLWADVPALITGN
                  250       260       270       280       290       300

                  310       320       330       340       350       360
m929.pep   HAFSINATATAFIGLSLLLLSGVLTWDDVLKEKSAWDTIIWFGALIMMAAFLNKLGLIKW
           ||||||||||||||||||||||||||||||||||||||||||||||||||||||||||||
a929       HAFSINATATAFIGLSLLLLSGVLTWDDVLKEKSAWDTIIWFGALIMMAAFLNKLGLIKW
                  310       320       330       340       350       360

                  370       380       390       400       410       420
m929.pep   FSGVLAESVGGLGVSGTAAGVILVLAYMYAHYMFASTTAHITAMFGAFFAAAVSLNAPAM
           ||||||||||||||||||||||||||||||||||||||||||||||||||||||||||||
a929       FSGVLAESVGGLGVSGTAAGVILVLAYMYAHYMFASTTAHITAMFGAFFAAAVSLNAPAM
                  370       380       390       400       410       420

                  430       440       450       460       470       480
m929.pep   PTALMMAAASNIMMTLTHYATGTSPVIFGSGYTTMGEWWKAGFIMSVVNFLIFFVIGSIW
           ||||||||||||||||||||||||||||||||||||||||||||||||||||||||||||
a929       PTALMMAAASNIMMTLTHYATGTSPVIFGSGYTTMGEWWKAGFIMSVVNFLIFFVIGSIW
                  430       440       450       460       470       480

m929.pep   WKVLGYWX
           ||||||||
a929       WKVLGYWX
```

g930.seq not found yet g930.pep not found yet

The following partial DNA sequence was identified in *N. meningitidis* <SEQ ID 2851>:

m930.seq

```
  1 ATGAAACTTC CTTTATCCTA TTTGCCTAAT ATTCGCTTTT TGTCTTGGTG

 51 CTGCTTATTG GCAGGTATCA TTGCTCCTGC TACTTTGTTG GCCTCCCCCA

101 ACCCTGCCGA AATCCGTATG CAGCAAGATA TTCAGCAACG CCAACGCGAA
```

-continued

```
151 GAGCAGTTGC GCCAAACCAT GCAGCCTGAA AGCGATGTGC GTTTGCATCA
201 AAAAAACACG GGGGAAACGG TTAATCAGTT GATGGGCGAT GACAGCAGCC
251 AACCGTGTTT TGCCATTAAC GAAtGGGTGT TGGAAGGCGA ACACCATGCT
301 CGGTTTCAGT TTGCCCTAAA ACGTGCCTTG CGCGAAACGG GTTTTCAGGC
351 TGGCAAGTGT CTGCATGCGG GCAACATTAA TCAAATCATG TCCTTAGCAC
401 AAAATGCTTT GATCGGCAGG GGATATACCA CGACCCGTAT CTTGGCTGCG
451 CCACAGGATT TGAATAgTGG aAGCTTCAAT TAA
```

This corresponds to the amino acid sequence <SEQ ID 2852; ORF 930>:

m930.pep

```
  1 MKLPLSYLPN IRFLSWCCLL AGIIAPATLL ASPNPAEIRM QQDIQQRQRE
 51 EQLRQTMQPE SDVRLHQKNT GETVNQLMGD DSSQPCFAIN EWVLEGEHHA
101 RFQFALKRAL RETGFQAGKC LHAGNINQIM SLAQNALIGR GYTTTRILAA
151 PQDLNSGSFN *
```

The following partial DNA sequence was identified in *N. gonorrhoeae* <SEQ ID 2853>:

g930-1.seq (partial)

```
   1 GGCAAGTGTC TGCATGCGGG CGACATTAAT CAAATCATGT CCTTAGCACA
  51 AAATGCTTTG ATCGGCAGGG GATATACCAC GACCCGTATC TTGGCTGCGC
 101 CACAGGATTT GAATAGTGGC AAGCTTCAAT TAACCCTGAT GCCGGGCTAT
 151 CTGCGCTCCA TACGAATCGA TCGGTCCAAC GATGATCAAA CCCATGCAGG
 201 ACGTATTGCA GCATTCCAAA ACAAATTTCC CACCCGCTCG AACGATCTGT
 251 TGAATCTGCG TGATTTGGAA CAAGGACTGG AAAATCTCAA ATGTCTCCCG
 301 ACTGCGGAAG CCGATCTCCA AATCGTTCCC GTAGAGAGAG AACCAAACCA
 351 AAGTGATGTC GTGGTGCAAT GGCGGTAACG TCTGCTGCCC TACTGTGTGA
 401 GTGTGGGGAT GGATAATTCG GGTAGTGAGG CGACAGGAAA ATACCAAGGA
 451 AATATCACTT TCTCTGCCGA CAATCCTTTT GGACTGAGTG ATATGTTCTA
 501 TGTAAATTAT GGACGTTCAA TTGGCGGTAC GCCCGATGAG GAAAATTTTG
 551 ACGGCCATCG CAAAGAAGGC GGATCAAACA ATTACGCCGT ACATTATTCA
 601 GCCCCTTTCG GTAAATGGAC ATGGGCATTC AATCACAATG GCTACCGTTA
 651 CCATCAGGCG GTTTCCGGAT TATCGGAAGT CTATGACTAT AATGGAAAAA
 701 GTTACAACAC TGATTTCGGC TTCAACCGCC TGTTGTATCG TGATGCCAAA
 751 CGCAAAACCT ATCTCAGTGT AAAACTGTGG ACGAGGGAAA CAAAAAGTTA
 801 CATTGATGAT GCCGAACTGA CTGTACAACG GCGTAAAACC ACAGGTTGGT
 851 TGGCAGAACT TTCCCACAAA GGATATATCG GTCGCAGTAC GGCAGATTTT
 901 AAGTTGAAAT ATAAACACGG CACCGGCATG AAAGATGCTC TGCGCGCGCC
 951 TGAAGAAGCC TTTGGCGAAG GCACGTCACG TATGAAAATT TGGACGGCAT
1001 CGGCTGATGT AAATACTCCT TTTCAAATCG GTAAACAGCT ATTTGCCTAT
```

-continued

```
1051 GACACATCCG TTCATGCACA ATGGAACAAA ACCCCGCTAA CATCGCAAGA
1101 CAAACTGGCT ATCGGCGGAC ACCACACCGT ACGTGGCTTC GACGGTGAAA
1151 TGAGTTTGCC TGCCGAGCGG GGATGGTATT GGCGCAACGA TTTGAGCTGG
1201 CAATTTAAAC CAGGCCATCA GCTTTATCTT GGGGCTGATG TAGGACATGT
1251 TTCAGGACAA TCCGCCAAAT GGTTATCGGG CCAAACTCTA GCCGGCACAG
1301 CAATTGGGAT ACGCGGGCAG ATAAAGCTTG GCGGCAACCT GCATTACGAT
1351 ATATTTACCG GCCGTGCATT GAAAAAGCCC GAATATTTTC AGACGAAGAA
1401 ATGGGTAACG GGGTTTCAGG TGGGTTATTC GTTTTGA
```

This corresponds to the amino acid sequence <SEQ ID 2854; ORF 930-1.ng>:

g930-1.pep (partial)

```
  1 GKCLHAGDIN QIMSLAQNAL IGRGYTTTRI LAAPQDLNSG KLQLTLMPGY
 51 LRSIRIDRSN DDQTHAGRIA AFQNKFPTRS NDLLNLRDLE QGLENLKCLP
101 TAEADLQIVP VEREPNQSDV VVQWR*RLLP YCVSVGMDNS GSEATGKYQG
151 NITFSADNPF GLSDMFYVNY GRSIGGTPDE ENFDGHRKEG GSNNYAVHYS
201 APFGKWTWAF NHNGYRYHQA VSGLSEVYDY NGKSYNTDFG FNRLLYRDAK
251 RKTYLSVKLW TRETKSYIDD AELTVQRRKT TGWLAELSHK GYIGRSTADF
301 KLKYKHGTGM KDALRAPEEA FGEGTSRMKI WTASADVNTP FQIGKQLFAY
351 DTSVHAQWNK TPLTSQDKLA IGGHHTVRGF DGEMSLPAER GWYWRNDLSW
401 QFKPGHQLYL GADVGHVSGQ SAKWLSGQTL AGTAIGIRGQ IKLGGNLHYD
451 IFTGRALKKP EYFQTKKWVT GFQVGYSF*
```

The following partial DNA sequence was identified in *N. meningitidis* <SEQ ID 2855>:

m930-1.seq

```
  1 ATGAAACTTC CTTTATCCTA TTTGCCTAAT ATTCGCTTTT TGTCTTGGTG
 51 CTGCTTATTG GCAGGTATCA TTGCTCCTGC TACTTTGTTG GCCTCCCCCA
101 ACCCTGCCGA AATCCGTATG CAGCAAGATA TTCAGCAACG CCAACGCGAA
151 GAGCAGTTGC GCCAAACCAT GCAGCCTGAA AGCGATGTGC GTTTGCATCA
201 AAAAAACACG GGGGAAACGG TTAATCAGTT GATGGGCGAT GACAGCAGCC
251 AACCGTGTTT TGCCATTAAC GAAGTGGTGT TGGAAGGCGA ACACCATGCT
301 CGGTTTCAGT TTGCCCTAAA ACGTGCCTTG CGCGAAACGG GTTTTCAGGC
351 TGGCAAGTGT CTGCATGCGG GCAACATTAA TCAAATCATG TCCTTAGCAC
401 AAAATGCTTT GATCGGCAGG GGATATACCA CGACCCGTAT CTTGGCTGCG
451 CCACAGGATT TGAATAGTGG CAAGCTTCAA TTAACCCTGA TACCGAGCTA
501 TCTGCGCTCC ATACGAATCG ATCGGTCTAA CGATGATCAA ACCCATGCAG
551 GACGTATTGC AGCATTCCAG AACAAATTTC CCACCCGCTC GAACGATCTG
601 TTGAATCTGC GTGATTTGGA ACAAGGACTG GAAAATCTCA AACGTCTCCC
```

-continued

```
 651 GACTGCGGAA GCCGATCTCC AAATCGTTCC CGTAGAGGGA GAACCAAACC
 701 AAAGTGATGT CGTGGTGCAA TGGCGGCAAC GTCTGCTGCC CTACCGTGTG
 751 AGTGTGGGGA TGGATAATTC GGGTAGTGAG GCGACAGGAA AATACCAAGG
 801 AAATATCACT TTCTCTGCCG ACAATCCTTT GGGACTGAGT GATATGTTCT
 851 ATGTAAATTA TGGACGTTCG ATTGGCGGTA CGCCCGATGA GGAAAGTTTT
 901 GACGGCCATC GCAAAGAAGG CGGATCAAAC AATTACGCCG TACATTATTC
 951 AGCCCCTTTC GGTAAATGGA CATGGGCATT CAATCACAAT GGCTACCGTT
1001 ACCATCAGGC AGTTTCCGGA TTATCGGAAG TCTATGACTA TAATGGAAAA
1051 AGTTACAATA CTGATTTCGG CTTCAACCGC CTGTTGTATC GTGATGCCAA
1101 ACGCAAAACC TATCTCGGTG TAAAACTGTG GATGAGGGAA ACAAAAAGTT
1151 ACATTGATGA TGCCGAACTG ACTGTACAAC GGCGTAAAAC TGCGGGTTGG
1201 TTGGCAGAAC TTTCCCACAA AGAATATATC GGTCGCAGTA CGGCAGATTT
1251 TAAGTTGAAA TATAAACGCG GCACCGGCAT GAAAGATGCT CTGCGCGCGC
1301 CTGAAGAAGC CTTTGGCGAA GGCACGTCAC GTATGAAAAT TTGGACGGCA
1351 TCGGCTGATG TAAATACTCC TTTTCAAATC GGTAAACAGC TATTTGCCTA
1401 TGACACATCC GTTCATGCAC AATGGAACAA AACCCCGCTA ACATCGCAAG
1451 ACAAACTGGC TATCGGCGGA CACCACACCG TACGTGGCTT CGACGGTGAA
1501 ATGAGTTTGT CTGCCGAGCG GGGATGGTAT TGGCGCAACG ATTTGAGCTG
1551 GCAATTTAAA CCAGGCCATC AGCTTTATCT TGGGGCTGAT GTAGGACATG
1601 TTTCAGGACA ATCCGCCAAA TGGTTATCGG GCCAAACTCT AGTCGGCACA
1651 GCAATTGGGA TACGCGGGCA GATAAAGCTT GGCGGCAACC TGCATTACGA
1701 TATATTTACC GGCCGCGCAT TGAAAAAGCC CGAATTTTTC CAATCAAGGA
1751 AATGGGCAAG CGGTTTTCAG GTAGGCTATA CGTTTTAA
```

This corresponds to the amino acid sequence <SEQ ID 2856; ORF 930-1>:

m930-1.pep

```
  1 MKLPLSYLPN IRFLSWCCLL AGIIAPATLL ASPNPAEIRM QQDIQQRQRE
 51 EQLRQTMQPE SDVRLHQKNT GETVNQLMGD DSSQPCFAIN EVVLEGEHHA
101 RFQFALKRAL RETGFQAGKC LHAGNINQIM SLAQNALIGR GYTTTRILAA
151 PQDLNSGKLQ LTLIPSYLRS IRIDRSNDDQ THAGRIAAFQ NKFPTRSNDL
201 LNLRDLEQGL ENLKRLPTAE ADLQIVPVEG EPNQSDVVVQ WRQRLLPYRV
251 SVGMDNSGSE ATGKYQGNIT FSADNPLGLS DMFYVNYGRS IGGTPDEESF
301 DGHRKEGGSN NYAVHYSAPF GKWTWAFNHN GYRYHQAVSG LSEVYDYNGK
351 SYNTDFGFNR LLYRDAKRKT YLGVKLWMRE TKSYIDDAEL TVQRRKTAGW
401 LAELSHKEYI GRSTADFKLK YKRGTGMKDA LRAPEEAFGE GTSRMKIWTA
451 SADVNTPFQI GKQLFAYDTS VHAQWNKTPL TSQDKLAIGG HHTVRGFDGE
501 MSLSAERGWY WRNDLSWQFK PGHQLYLGAD VGHVSGQSAK WLSGQTLVGT
551 AIGIRGQIKL GGNLHYDIFT GRALKKPEFF QSRKWASGFQ VGYTF*
```

m930-1/g930-1 95.4% identity in 478 aa overlap

```
             90       100       110       120       130       140
m930-1.pep  AINEVVLEGEHHARFQFALKRALRETGFQAGKCLHAGNINQIMSLAQNALIGRGYTTTRI
                                          |||||||:||||||||||||||||||||||
g930-1.pep                                GKCLHAGDINQIMSLAQNALIGRGYTTTRI
                                                  10        20        30

            150       160       170       180       190       200
m930-1.pep  LAAPQDLNSGKLQLTLIPSYLRSIRIDRSNDDQTHAGRIAAFQNKFPTRSNDLLNLRDLE
            ||||||||||||||||:|:|||||||||||||||||||||||||||||||||||||||||
g930-1.pep  LAAPQDLNSGKLQLTLMPGYLRSIRIDRSNDDQTHAGRIAAFQNKFPTRSNDLLNLRDLE
                    40        50        60        70        80        90

            210       220       230       240       250       260
m930-1.pep  QGLENLKRLPTAEADLQIVPVEGEPNQSDVVVQWRQRLLPYRVSVGMDNSGSEATGKYQG
            ||||||| |||||||||||||| |||||||||||| ||||| ||||||||||||||||||
g930-1.pep  QGLENLKCLPTAEADLQIVPVEREPNQSDVVVQWRXRLLPYCVSVGMDNSGSEATGKYQG
                   100       110       120       130       140       150

            270       280       290       300       310       320
m930-1.pep  NITFSADNPLGLSDMFYVNYGRSIGGTPDEESFDGHRKEGGSNNYAVHYSAPFGKWTWAF
            |||||||||:|||||||||||||||||||||:||||||||||||||||||||||||||||
g930-1.pep  NITFSADNPFGLSDMFYVNYGRSIGGTPDEENFDGHRKEGGSNNYAVHYSAPFGKWTWAF
                   160       170       180       190       200       210

            330       340       350       360       370       380
m930-1.pep  NHNGYRYHQAVSGLSEVYDYNGKSYNTDFGFNRLLYRDAKRKTYLGVKLWMRETKSYIDD
            |||||||||||||||||||||||||||||||||||||||||||||:|||| |||||||||
g930-1.pep  NHNGYRYHQAVSGLSEVYDYNGKSYNTDFGFNRLLYRDAKRKTYLSVKLWTRETKSYIDD
                   220       230       240       250       260       270

            390       400       410       420       430       440
m930-1.pep  AELTVQRRKTAGWLAELSHKEYIGRSTADFKLKYKRGTGMKDALRAPEEAFGEGTSRMKI
            ||||||||||:||||||||| ||||||||||||||:||||||||||||||||||||||||
g930-1.pep  AELTVQRRKTTGWLAELSHKGYIGRSTADFKLKYKHGTGMKDALRAPEEAFGEGTSRMKI
                   280       290       300       310       320       330

            450       460       470       480       490       500
m930-1.pep  WTASADVNTPFQIGKQLFAYDTSVHAQWNKTPLTSQDKLAIGGHHTVRGFDGEMSLSAER
            |||||||||||||||||||||||||||||||||||||||||||||||||||||||| |||
g930-1.pep  WTASADVNTPFQIGKQLFAYDTSVHAQWNKTPLTSQDKLAIGGHHTVRGFDGEMSLPAER
                   340       350       360       370       380       390

            510       520       530       540       550       560
m930-1.pep  GWYWRNDLSWQFKPGHQLYLGADVGHVSGQSAKWLSGQTLVGTAIGIRGQIKLGGNLHYD
            ||||||||||||||||||||||||||||||||||||||||:|||||||||||||||||||
g930-1.pep  GWYWRNDLSWQFKPGHQLYLGADVGHVSGQSAKWLSGQTLAGTAIGIRGQIKLGGNLHYD
                   400       410       420       430       440       450

            570       580       590
m930-1.pep  IFTGRALKKPEFFQSRKWASGFQVGYTF
            |||||||||||:||::||::||||||:|
g930-1.pep  IFTGRALKKPEYFQTKKWVTGFQVGYSFX
                   460       470
```

a930-1.seq not yet found a930-1.pep not yet found

The following partial DNA sequence was identified in *N. gonorrhoeae* <SEQ ID 2857>:

g931.seq

```
  1 ATGAAACCCA AATTCAAAAC CGTTTTAACC GCGCTGCTTT TGGCGGTTTC

 51 CCTGCCGTCT ATGGCGGCAA CCCGCGTCCT GATGGAAACC GATATGGGCA

101 ATATCCGTTT GGTTTTGGAC GAATCCAAAG CCTCCAAAAC CGTTGCCAAT

151 TTCGTGCGCT ATGCCCGAAA AGGCTTTTAC GACAACACGA TTTTCCACCG

201 CGTcatCGGC GGCTTCGTCA TCCAAGGCGA CGGATTGACC GAGGACTTGG

251 TGCAAAAGGC AACCGATAAG GCCGTTGCCA ACGAATCCGG caacgGCTTG

301 AAAAACACCG TCGGCACCAT CGCAATGGCG CGGACGGCAG CCCCCGATTC

351 CGCCGCCGCC CAATTCTTTA TCAATCTGGC GGACAACGGT TCGCTCGACT

401 ACAAAAACGG ACAATACGGC TACACCGTTT TCGGCAGGGT AGAAAGCGGA

451 ATGGACACCG TTTCCAAAAT CGCCCGCGTC AAAACCGCCA CGCGCGGCTT

501 TTATCAAAAC GTACCCGTAC AGCCCGTCAA AATCCGTCGC GTTGTTGTCG

551 GGCAGTAACA CGCAGACAGA CGTTCAGACG GCGTCGCCCG TTTCCCAAAA

601 AACGCCGTTT AA
```

This corresponds to the amino acid sequence <SEQ ID 2858; ORF 931.ng>:

g931.pep

```
  1 MKPKFKTVLT ALLLAVSLPS MAATRVLMET DMGNIRLVLD ESKASKTVAN

 51 FVRYARKGFY DNTIFHRVIG GFVIQGDGLT EDLVQKATDK AVANESGNGL

101 KNTVGTIAMA RTAAPDSAAA QFFINLADNG SLDYKNGQYG YTVFGRVESG

151 MDTVSKIARV KTATRGFYQN VPVQPVKIRR VVVGQ*
```

The following partial DNA sequence was identified in *N. meningitidis* <SEQ ID 2859>:

m931.seq

```
  1 ATGAAACCCA AATTCAAAAC CGTTTTAACC GCGCTGCTTT TGGCGGTTTC

 51 CCTGCCGTCT ATGGCGGCAA CCCATGTTTT GATGGAAACC GATATGGGCA

101 ATATCCGTTT GGTTTTGGAC GAATCCAAAG CCCCCAAAAC CGTTGCTAAT

151 TTCGTGCGCT ATGCCCGAAA AGGCTTTTAC GACGACACCG TTTTTCACCG

201 CGTTATCGAC GGTTTTGTTA TCCAGGGCGG TGGATTGACC GAGGACTTGG

251 CACAAAAGGC AAGCGATAAG GCCGTTGCCA ACGAATCCGG CAACGGCTTG

301 AAAAACACCG CCGGCACCAT CGCCATGGCG CGGACGACAG CCCCCGATTC

351 CGCCACCAGC CAATTCTTTA TCAATCTGGC GGACCcA.kCT TCGCTCGACT

401 ACAAAAACGG ACAATACGGC TATACCGTTT TCGGCAGGGT CGAAAGCGGC

451 ATGAACACCG TTTCCAAAAT CGCCCGCGTC AAAACCGCCA CGCGCGGCTT

501 TTATCAAAAC GTACCCGTAC AGCCCGTCAA AATCCGTCGC GTTGTTGTCG

551 GGCAGTAA
```

This corresponds to the amino acid sequence <SEQ ID 2860; ORF 931>:

m931.pep..

```
  1 MKPKFKTVLT ALLLAVSLPS MAATHVLMET DMGNIRLVLD ESKAPKTVAN

 51 FVRYARKGFY DDTVFHRVID GFVIQGGGLT EDLAQKASDK AVANESGNGL

101 KNTAGTIAMA RTTAPDSATS QFFINLADXX SLDYKNGQYG YTVFGRVESG

151 MNTVSKIARV KTATRGFYQN VPVQPVKIRR VVVGQ*
```

Computer analysis of this amino acid sequence gave the following results:

Homology with a predicted ORF from *N. gonorrhoeae*

ORF 931 shows 91.9% identity over a 185 aa overlap with a predicted ORF (ORF 931.ng) from *N. gonorrhoeae*.

g931/m931

```
                    10        20        30        40        50        60
g931.pep   MKPKFKTVLTALLLAVSLPSMAATRVLMETDMGNIRLVLDESKASKTVANFVRYARKGFY
           ||||||||||||||||||||||||:||||||||||||||||||| |||||||||||||||
m931       MKPKFKTVLTALLLAVSLPSMAATHVLMETDMGNIRLVLDESKAPKTVANFVRYARKGFY
                    10        20        30        40        50        60
```

-continued

```
                     70        80        90       100       110       120
g931.pep    DNTIFHRVIGGFVIQGDGLTEDLVQKATDKAVANESGNGLKNTVGTIAMARTAAPDSAAA
            |:|:||||| |||||| ||||||:|||:|||||||||||||||:||||||||:|||||::
m931        DDTVFHRVIDGFVIQGGGLTEDLAQKASDKAVANESGNGLKNTAGTIAMARTTAPDSATS
                     70        80        90       100       110       120

                    130       140       150       160       170       180
g931.pep    QFFINLADNGSLDYKNGQYGYTVFGRVESGMDTVSKIARVKTATRGFYQNVPVQPVKIRR
            ||||||||  |||||||||||||||||||||:||||||||||||||||||||||||||||
m931        QFFINLADXXSLDYKNGQYGYTVFGRVESGMNTVSKIARVKTATRGFYQNVPVQPVKIRR
                    130       140       150       160       170       180

g931.pep    VVVGQX
            ||||||
m931        VVVGQX
```

The following partial DNA sequence was identified in *N. meningitidis* <SEQ ID 2861>:

a931.seq

```
  1 ATGAAACCCA AATTCAAAAC CGTTTTAACC GCGCTGCTTT TGGCGGTTTC
 51 CCTGCCGTCT ATGGCGGCAA CCCATGTTTT GATGGAAACC GATATGGGCA
101 ATATCCGTTT GGTTTTGGAC GAATCCAAAG CACCCAAAAC CGTTGCCAAT
151 TTCGTGCGCT ATGCCCGAAA AGGCTTTTAC GACAATACGA TTTTTCACCG
201 CGTCATCGGC GGCTTCGTTA TCCAAGGCGG CGGATTGACC GAGGACTTGG
251 CACAAAAGGC AAGCGATAAG GCCGTTGCCA ACGAATCCGG CAACGGCTTG
301 AAAAACACTG TCGGCACCAT CGCCATGGCG CGGACGGCCG ATCCGGATTC
351 CGCCACCAGC CAATTCTTTA TCAATCTGGT GGACAATGAT TCGCTCAACT
401 ACAAAAACGG ACAATACGGC TATACCGTTT TCGGCAGGGT CGAAAGCGGC
451 ATGAACACCG TTTCCAAAAT CGCCCGCGTC AAAACCGCCA CGCGCGGCTT
501 TTATCAAAAC GTACCCGTAC AGCCCGTCAA AATCCGTCGC GTTGTTGTCG
551 GGCAGTAA
```

This corresponds to the amino acid sequence <SEQ ID 2862; ORF 931.a>:

a931.pep

```
  1 MKPKFKTVLT ALLLAVSLPS MAATHVLMET DMGNIRLVLD ESKAPKTVAN
 51 FVRYARKGFY DNTIFHRVIG GFVIQGGGLT EDLAQKASDK AVANESGNGL
101 KNTVGTIAMA RTADPDSATS QFFINLVDND SLNYKNGQYG YTVFGRVESG
151 MNTVSKIARV KTATRGFYQN VPVQPVKIRR VVVGQ*
```

m931/a931 94.6% identity in 185 aa overlap

```
                     10        20        30        40        50        60
m931.pep    MKPKFKTVLTALLLAVSLPSMAATHVLMETDMGNIRLVLDESKAPKTVANFVRYARKGFY
            ||||||||||||||||||||||||||||||||||||||||||||||||||||||||||||
a931        MKPKFKTVLTALLLAVSLPSMAATHVLMETDMGNIRLVLDESKAPKTVANFVRYARKGFY
                     10        20        30        40        50        60

                     70        80        90       100       110       120
m931.pep    DDTVFHRVIDGFVIQGGGLTEDLAQKASDKAVANESGNGLKNTAGTIAMARTTAPDSATS
            |:|:||||| |||||||||||||||||||||||||||||||||:||||||||: ||||||
a931        DNTIFHRVIGGFVIQGGGLTEDLAQKASDKAVANESGNGLKNTVGTIAMARTADPDSATS
                     70        80        90       100       110       120
```

-continued

```
                130       140       150       160       170       180
m931.pep  QFFINLADXXSLDYKNGQYGYTVFGRVESGMNTVSKIARVKTATRGFYQNVPVQPVKIRR
          ||||||:|  ||:|||||||||||||||||||||||||||||||||||||||||||||||
a931      QFFINLVDNDSLNYKNGQYGYTVFGRVESGMNTVSKIARVKTATRGFYQNVPVQPVKIRR
                130       140       150       160       170       180

m931.pep  VVVGQX
          ||||||
a931      VVVGQX
```

g932.seq not found yet g932.pep not found yet

The following partial DNA sequence was identified in *N. meningitidis* <SEQ ID 2863>:

m932.seq

```
  1 ATGAAATATA TCGTATCAAT CTCTCTGGCT ATGGGATTGG CTGCCTGTTC
 51 GTTTGGGGGA TTTAAACCAA ATCCGTGGGA CGCCGCGTCA TTTTGGGAAT
101 TGAAAAATTA CGCCAATCCC TATCCGGGAT CAGCCTCGGC GGCACTTGAC
151 CAATATCCAT CGAAAGCAAG ACGAAGGCAA CTGAAAGACA TGCAAGAGTG
201 CGGCTATGAC CCAATAGACG GCGGAAAGTC TGAAGCAGAT GCCTGCCTGA
251 GGAAAAAAGG CTGGTGTCGT AAGGGTTTCG ACCCTTATCC CGAAAACAAA
301 AAATACGAAT GGCCTCGAGA AGAAGGAAAA ACAAAATGA
```

This corresponds to the amino acid sequence <SEQ ID 2864; ORF 932>:

m932.pep

```
  1 MKYIVSISLA MGLAACSFGG FKPNPWDAAS FWELKNYANP YPGSASAALD
 51 QYPSKARRRQ LKDMQECGYD PIDGGKSEAD ACLRKKGWCR KGFDPYPENK
101 KYEWPREEGK TK*
```

Computer analysis of this amino acid sequence gave the following results:

Homology with a predicted ORF from *N. gonorrhoeae*

ORF 932 shows % identity over a aa overlap with a predicted ORF (ORF 932.ng) from *N. gonorrhoeae:*

The following partial DNA sequence was identified in *N. gonorrhoeae* <SEQ ID 2865>:

g934.seq

```
  1 ATGAAAAAAA TCATCGCCTC CGCGCTTATC GCAACATTCG CACTCACCGC
 51 CTGCCAAGAC GACACGCAGG CGCGGCTCGA ACGGCAGCAG AAACAGATTG
101 AAGCCCTGCA ACAGCAGCTC GCACAGCAGG CAGACGATAC GGTTTACCAA
151 CTGACTCCCG AAGCAGTCAA AGACACCATT CCTGCCCAGG CGCAGGCAAA
201 CGGCAACAAC GGTCAGCCCG TTACCGGCAA .AGAcggGCA GCAGTATATT
251 TACGACCAAT CGACAGGAAG CTGGCTGCTG CAAAGCCTGA TTGGCGCGGC
301 GGCAGGCGCG TTTATCGGCA ACGCGCTGGC AAACAAATTC ACACGGGCGG
351 GCAACCAAGA CAGCCCCGTC GCCCGTCGCG CGCGTGCTGC CTACCATCAG
```

-continued

```
401 TCCGCACGCC CCAATGCGCG CACCAGCAGG GATTTGAACA CGCGCAGCCT
451 CCGTGCAAAA CAACAGGCGG CGCAGGCGCA GCGTTACCGC CCGACAACGC
501 GCCCGCCCGT CAAttaccgc catcgcgcta tgcGCGGTTT CGgcagAagg
551 cggtaaaCCC GGCGCGTCAA TGCCGTCTGA AGGGCTTTCA GACGGCATTT
601 TTGTATTTGT TAGGGGCATT GTTATGTTGC CGTTTGATTT TCAGACGGCA
651 TTTTGTTTCC AAGCGTTTGA TGTcggGATG GCAATTCTGA
```

This corresponds to the amino acid sequence <SEQ ID 2866; ORF 934.ng>:

g934.pep

```
  1 MKKIIASALI ATFALTACQD DTQARLERQQ KQIEALQQQL AQQADDTVYQ
 51 LTPEAVKDTI PAQAQANGNN GQPVTGKRRA AVYLRPIDRK LAAAKPDWRG
101 GRRVYRQRAG KQIHTGGQPR QPRRPSRACC LPSVRTPQCA HQQGFEHAQP
151 PCKTTGGAGA ALPPDNAPAR QLPPSRYARF RQKAVNPARQ CRLKGFQTAF
201 LYLLGALLCC RLIFRRHFVS KRLMSGWQF*
```

The following partial DNA sequence was identified in *N. meningitidis* <SEQ ID 2867>:

m934.seq (partial)

```
  1 ..CGGCTCGAAC AGCAGCAGAA ACAGATTGAA GCCCTGCAAC AGCAGCTCGC
 51   ACAGCAGGCA GACGATACGG TTTACCAACT GACTCCCGAA GCAGTCAAAG
101   ACACCATTCC TGCCGAAGCA CAGGCAAACG GCAACAACgG GCAACCCGTT
151   ACCGGTAA.A GACGGGCAGC AGTATATTTA CGACCAATCG ACAGGAAGCT
201   GGCTGCTGCA AAGCCTGGTC GGCGCGGCGG CAGGCGCGTT TATCGGCAAC
251   GCGCTGGCAA ACAAATTCAC ACGGGCAGGC AACCAAGACA GTCCCGTCGC
301   CCGGCGCGCG CGTGCAGCCT ACCATCAGTC CGCACGCCCC AATGCGCGCA
351   yCAGCAGGGA TTTGAACACG CGCAGCCTCC GTGCAAAACA ACAGGCGGCG
401   CAkGCGCAGC GTTACCGCCC GACAACGCGC CCGsCCGsCA ATTACCGCCG
451   CCCCGCTATG CGCGGTTTCG GCAGGAGGCG GTAAACCCGG CGCGCCAATG
501   CCGTCTGAAG AGCTTTCAGA CGGCATTTnT GCATTTGTTA GGGACATTGT
551   TATGTTGCCG TTTGATTTTC AGACGGCATT TTGTTTCCAA GCGTTTGATG
601   TCGGGATGGC AATTCTGA
```

This corresponds to the amino acid sequence <SEQ ID 2868, ORF 934>:

m934.pep (partial)

```
  1 ..RLEQQQKQIE ALQQQLAQQA DDTVYQLTPE AVKDTIPAEA QANGNNGQPV
 51   TGXRRAAVYL RPIDRKLAAA KPGRRGGRRV YRQRAGKQIH TGRQPRQSRR
101   PARACSLPSV RTPQCAHQQG FEHAQPPCKT TGGAXAALPP DNAPXRQLPP
```

-continued

```
151   PRYARFRQEA VNPARQCRLK SFQTAFXHLL GTLLCCRLIF RRHFVSKRLM

201   SGWQF*
```

Computer analysis of this amino acid sequence gave the following results:

Homology with a predicted ORF from *N. gonorrhoeae*

ORF 934 shows 91.7% identity over a 205 aa overlap with a predicted ORF (ORF 934.ng) from *N. gonorrhoeae*:

m934/g934

```
                                           10        20        30
m934.pep                           RLEQQQKQIEALQQQLAQQADDTVYQLTPEAVKDTI
                                   |||:||||||||||||||||||||||||||||||||
g934       MKKIIASALIATFALTACQDDTQARLERQQKQIEALQQQLAQQADDTVYQLTPEAVKDTI
                   10        20        30        40        50        60

             40        50        60        70        80        90
m934.pep   PAEAQANGNNGQPVTGXRRAAVYLRPIDRKLAAAKPGRRGGRRVYRQRAGKQIHTGRQPR
           ||:||||||||||||| |||||||||||||||||||  |||||||||||||||||| |||
g934       PAQAQANGNNGQPVTGKRRAAVYLRPIDRKLAAAKPDWRGGRRVYRQRAGKQIHTGGQPR
                   70        80        90       100       110       120

            100       110       120       130       140       150
m934.pep   QSRRPARACSLPSVRTPQCAHQQGFEHAQPPCKTTGGAXAALPPDNAPXRQLPPPRYARF
           | |||:||| |||||||||||||||||||||||||||| ||||||||| ||||| |||||
g934       QPRRPSRACCLPSVRTPQCAHQQGFEHAQPPCKTTGGAGAALPPDNAPARQLPPSRYARF
                  130       140       150       160       170       180

            160       170       180       190       200
m934.pep   RQEAVNPARQCRLKSFQTAFXHLLGTLLCCRLIFRRHFVSKRLMSGWQFX
           ||:|||||||||||:||||| :|||:||||||||||||||||||||||||
g934       RQKAVNPARQCRLKGFQTAFLYLLGALLCCRLIFRRHFVSKRLMSGWQFX
                  190       200       210       220       230
```

The following partial DNA sequence was identified in *N. meningitidis* <SEQ ID 2869>:

a934.seq

```
  1 ATGAAAAAAA TCATCGCCTC CGCGCTTATC GCAACATTCG CACTCGCCGC

 51 CTGCCAAGAC GACGCGCAGG CGCGGCTCGA ACAGCAGCAG AAACAGATTG

101 AAGCCCTGCA ACAGCAGCTC GCACAGCAGG CAGACGATAC GGTTTACCAA

151 CTGACTCCCG AAGCAGTCAA AGACACCATT CCTGCCGAAG CACAGGCAAA

201 CGGCAACAAC GGGCAACCCG TTACCGG.TA AAGACGGGCA GCAGTATATT

251 TACGACCAAT CGACAGGAAG CTGGCTGCTG CAAAGCCTGG TCGGCGCGGC

301 GGCAGGCGCG TTTATCGGCA ACGCGCTGGC AAACAAATTC ACACGGGCAG

351 GCAACCAAGA CAGTCCCGTC GCCCGGCGCG CGCGTGCCGC CTACCATCAG

401 TCCGCACATC CCAATGCGCG CACCAGCAGG GATTTGAACA CGCGCAGCCT

451 CCGTGCAAAA CAACAGGCGG CGCAGGCGCA GCGTTACCGC CCGACAACGC

501 GCCCGCCCGC CAATTACCGC CGCCCCGCCA TGCGCGGTTT CGGCAGAAGG

551 CGGTAAATCC GGCGTGCCAA TGCCGTCTGA AGGGCTTTCA GACGGCATTT

601 TTGTATTTGT TAGGGACATT GTTATGTTGC CGTTTGATTT TTAGACGGCA

651 TTTTGTTTCC AAGAGTTTGA TGTCGGGATG GCAATTCTGA
```

This corresponds to the amino acid sequence <SEQ ID 2870; ORF 934.a>:

a934.pep

```
  1 MKKIIASALI ATFALAACQD DAQARLEQQQ KQIEALQQQL AQQADDTVYQ
 51 LTPEAVKDTI PAEAQANGNN GQPVTX*RRA AVYLRPIDRK LAAAKPGRRG
101 GRRVYRQRAG KQIHTGRQPR QSRRPARACR LPSVRTSQCA HQQGFEHAQP
151 PCKTTGGAGA ALPPDNAPAR QLPPPRHARF RQKAVNPACQ CRLKGFQTAF
201 LYLLGTLLCC RLIFRRHFVS KSLMSGWQF*
``` m934/a934 94.1% identity in 205 aa overlap

```
                                          10        20        30
m934.pep                          RLEQQQKQIEALQQQLAQQADDTVYQLTPEAVKDTI
                                  ||||||||||||||||||||||||||||||||||||
a934      MKKIIASALIATFALAACQDDAQARLEQQQKQIEALQQQLAQQADDTVYQLTPEAVKDTI
                  10        20        30        40        50        60

40        50        60        70        80        90
m934.pep  PAEAQANGNNGQPVTGXRRAAVYLRPIDRKLAAAKPGRRGGRRVYRQRAGKQIHTGRQPR
          ||||||||||||||| ||||||||||||||||||||||||||||||||||||||||||||
a934      PAEAQANGNNGQPVTXXRRAAVYLRPIDRKLAAAKPGRRGGRRVYRQRAGKQIHTGRQPR
                  70        80        90       100       110       120

100       110       120       130       140       150
m934.pep  QSRRPARACSLPSVRTPQCAHQQGFEHAQPPCKTTGGAXAALPPDNAPXRQLPPPRYARF
          ||||||||| |||||| ||||||||||||||||||||| ||||||||| |||||||:|||
a934      QSRRPARACRLPSVRTSQCAHQQGFEHAQPPCKTTGGAGAALPPDNAPARQLPPPRHARF
                 130       140       150       160       170       180

160       170       180       190       200
m934.pep  RQEAVNPARQCRLKSFQTAFXHLLGTLLCCRLIFRRHFVSKRLMSGWQFX
          ||:||||| |||||:||||| :||||||||||||||||||| ||||||||
a934      RQKAVNPACQCRLKGFQTAFLYLLGTLLCCRLIFRRHFVSKSLMSGWQFX
                 190       200       210       220       230
``` g935.seq not found yet g935.pep not found yet

The following partial DNA sequence was identified in *No. Meningitidis* <SEQ ID 2871>:

m935.seq

```
  1 ATGTTGTATT TCAGATACGG CTTTTTGGTT GTTTGGTGTG CGGCAGGTGT
 51 TTCTGCCGCC TATGGGGCGG ATGCGCCCGC GATTTTGGAT GACAAGGCAT
101 TGTTGCAGGT GCAGCGGTCG GTGTCGGATA AGTGGGCGGA ATCAGATTGG
151 AAAGTTGAAA ATGATGCCCC GCGCGTGGTT GACGGGGATT TTTTGTTGGC
201 GCATCCGAAA ATGTTGGAAC ATAGTTTGCG CGACGCGCTC AACGGCAATC
251 AGGCGGATTT AATCGCTTCG TTGGCGGATT TGTATGCCAA GCTGCCGGAT
301 TATGACGCGG TTTTGTACGG CAGGGCGCGG GCTTTGCTGG CGAAATTGGC
351 GGGAAGGCCG GCGGAGGCGG TGGCGCGGTA TCGGGAACTG CACGGGGAAA
401 ATGCGGCAGA CGAGCGGATT TTGCTGGATT TGGCGGCGGC GGAGTTTGAC
451 GATTTCCGGC TGAAGTCGGC AGAAAGGCAT TTTGCGGAGG CGGCAAAATT
501 GGATTTGCCG GCACCGGTTT TGGAAAATGT GGGGCGTTTT CGGAAAAAAA
551 CGGAGGGGCT GACGGGCTGG CGTTTTTCGG GCGGCATCAG TCCGGCGGTC
601 AATAGAAATG CCAATAATGC CGCGCCGCAA TATTGCCGGC AAAACGGAGG
651 CCGGCAGATA TGCAGTGTCA GCCGGGCGGA GCGGGCGGCA GGGTTGAATT
701 ATGAAATCGA GGCGGAAAAG CTGACGCCGT TGGCAGATAA TCATTATTTG
```

-continued

```
 751 TTGTTCCGTT CCAATATCGG CGGCACGAGC TATTATTTCA GTAAAAAATC
 801 AGCTTATGAT GACGGGTTCG GCAGGGCGTA TTTGGGTTGG CAGTATAAAA
 851 ATGCACGGCA GACGGCGGGG ATTTTGCCGT TTTATCAGGT GCAGTTGTCG
 901 GGCAGCGACG GCTTTGATGC GAAAACAAAA CGGGTAAACA ACCGCCGCCT
 951 GCCGCCGTAT ATGCTGGCGC ACGGAGTCGG CGTGCAGCTG TCCCATACTT
1001 ACCGCCCAAA CCCGGGATGG CAATTTTCGG TCGCGCTGGA ACATTACCGC
1051 CAACGCTACC GCGAACAGGA TAGGGCGGAA TACAATAACG GCAGGCAGGA
1101 CGGGTTTTAT GTTTCGTCGG CAAAACGTTT GGGCGAATCG GCAACTGTGT
1151 TCGGCGGCTG GCAGTTTGTG CGGTTTGTGC CGAAACGCGA AACGGTGGGC
1201 GGCGCGGTCA ATAATGCCGC CTACCGGCGC AACGGTGTTT ATGCCGGTTG
1251 GGCGCAGGAG TGGCGGCAGT TGGGCGGTTT GAACAGTCGG GTTTCCGCGT
1301 CTTATGCCCG CCGCAACTAT AAGGGCATTG CGGCTTTCTC GACAGAGGCG
1351 CAACGCAACC GCGAATGGAA TGTCTCGCTG GCTTTGAGCC ACGACAAGTT
1401 GTCGTACAAA GGTATCGTGC CGGCGTTGAA TTATCGTTTC GGCAGGACGG
1451 AAAGTAATGT GCCGTATGCG AAACGCCGCA ACAGCGAGGT GTTTGTGTCG
1501 GCGGATTGGC GGTTTTGA
```

This corresponds to the amino acid sequence <SEQ ID 2872; ORF 935>:

m935.pep

```
  1 MLYFRYGFLV VWCAAGVSAA YGADAPAILD DKALLQVQRS VSDKWAESDW
 51 KVENDAPRVV DGDFLLAHPK MLEHSLRDAL NGNQADLIAS LADLYAKLPD
101 YDAVLYGRAR ALLAKLAGRP AEAVARYREL HGENAADERI LLDLAAAEFD
151 DFRLKSAERH FAEAAKLDLP APVLENVGRF RKKTEGLTGW RFSGGISPAV
201 NRNANNAAPQ YCRQNGGRQI CSVSRAERAA GLNYEIEAEK LTPLADNHYL
251 LFRSNIGGTS YYFSKKSAYD DGFGRAYLGW QYKNARQTAG ILPFYQVQLS
301 GSDGFDAKTK RVNNRRLPPY MLAHGVGVQL SHTYRPNPGW QFSVALEHYR
351 QRYREQDRAE YNNGRQDGFY VSSAKRLGES ATVFGGWQFV RFVPKRETVG
401 GAVNNAAYRR NGVYAGWAQE WRQLGGLNSR VSASYARRNY KGIAAFSTEA
451 QRNREWNVSL ALSHDKLSYK GIVPALNYRF GRTESNVPYA KRRNSEVFVS
501 ADWRF*
```

The following partial DNA sequence was identified in *N. meningitidis* <SEQ ID 2873>:

a935.seq

```
  1 ATGTTGTATT TCAGATACGG TTTTTTGGTT GTTTGGTGTG CGGCAGGTGT
 51 TTCTGCCGCC TATGGGGCGG ATGCGCCCGC GATTTTGGAT GACAAGGCAT
101 TGTTGCAGCT GCAGCGGTCG GTGTCGGATA AGTGGGCGGA ATCGGATTGG
151 AAAGTTGACA ATGATGCCCC GCGCGTCGTT GACGGGGATT TTTTGTTGGC
```

-continued

```
 201 GCATCCGAAA ATGTTGGAAC ATAGTTTGCG CGACGTGCTC AACGGCAATC
 251 AGGCGGATTT GATCGCTTCG TTGGCGGATT TGTATGCCAA GCTGCCGGAT
 301 TATGACGCGG TTTTGTACGG CAGGGCGCGG GCTTTCCTGG CGAAATTGGC
 351 GGGAAGGCCG GCGGAGGCGG TGGCGCGGTA TCGGGAACTG CACGGGGAAA
 401 ATGCGGCAGA CGAGCGGATT TTGCTGGATT TGGCGGCGGC GGAGTTTGAC
 451 GATTTCCGGC TGAAGTCGGC AGAAAGGCAT TTTGCCGAGG CGGAAAAATT
 501 GGATTTGCCG GCGCCGGTTT TGGAAAATGT GGGGCGTTTT CGGAAAAAAG
 551 CGGAGGGGCT GACGGGCTGG CGTTTTTCGG GCGGCATCAG TCCGGCGGTC
 601 AATAGAAATG CCAATAATGC CGCGCCGCAG TATTGCCGGC AAAACGGAGG
 651 CCGGCAGATA TGCAGTGTCA GCCGGGCGGA GCGGGCGGCA GGCTTGAATT
 701 ATGAAATCGA GGCGGAAAAA CTGACGGCGT TGGCAGATAA TCATTATTTG
 751 TTGTTCCGTT CCAATATCGG CGGCACGAGC TATTATTTCA GTAAAAAATC
 801 AGCTTATGAC GACGGGTTCG GCAGAGCGTA TTTGGGTTGG CAGTATAAAA
 851 ATGCACGGCA GACGGCGGGG ATTTTGCCGT TTTATCAGGT GCAGTTGTCG
 901 GGCAGCGACG GCTTTGATGC GAAAACAAAA CGGGTAAACA ACCGCCGCCT
 951 GCCGCCGTAT ATGCTGGCGC ACGGAGTCGG CGTGCAGTTG TCCCATACTT
1001 ACCGCCCAAA CCCGGGATGG CAATTTTCGG TCGCGCTGGA ACATTACCGC
1051 CAACGCTACC GCGAACAGGA TAGGGCGGAA TACAATAACG GTCGGCAGGA
1101 CGGGTTTTAT GTTTCGTCGG CAAAACGTTT GGGCGAATCG GCAACTGTGT
1151 TCGGCGGCTG GCAGTTTGTG CGGTTTGTGC CGAAACGCGA AACGGTGGGC
1201 GGCGCGGTCA ATAATGCCGC CTACCGGCGC AACGGTGTTT ATGCCGGCTG
1251 GGCGCAGGAG TGGCGGCAGT TGGGCGGTTT GAACAGTCGG GTTTCCGCGT
1301 CTTATGCCCG CCGCAACTAT AAGGGCGTTG CGGCTTTCTC GACAGAGGCG
1351 CAACGCAACC GCGAATGGAA TGTCTCGCTG GCTTTGAGCC ACGACAAGTT
1401 GTCGTACAAA GGTATCGTGC CCGCGTTGAA TTATCGTTTC GGCAGGACGG
1451 AAAGTAATGT GCCGTATGCG AAACGCCGCA ACAGCGAGGT GTTTGTGTCG
1501 GCGGATTGGC GGTTTTGA
```

This corresponds to the amino acid sequence <SEQ ID 2874; ORF 935.a>:

a935.pep

```
  1 MLYFRYGFLV VWCAAGVSAA YGADAPAILD DKALLQVQRS VSDKWAESDW
 51 KVDNDAPRVV DGDFLLAHPK MLEHSLRDVL NGNQADLIAS LADLYAKLPD
101 YDAVLYGRAR ALLAKLAGRP AEAVARYREL HGENAADERI LLDLAAAEFD
151 DFRLKSAERH FAEAEKLDLP APVLENVGRF RKKAEGLTGW RFSGGISPAV
201 NRNANNAAPQ YCRQNGGRQI CSVSRAERAA GLNYEIEAEK LTALADNHYL
251 LFRSNIGGTS YYFSKKSAYD DGFGRAYLGW QYKNARQTAG ILPFYQVQLS
301 GSDGFDAKTK RVNNRRLPPY MLAHGVGVQL SHTYRPNPGW QFSVALEHYR
351 QRYREQDRAE YNNGRQDGFY VSSAKRLGES ATVFGGWQFV RFVPKRETVG
401 GAVNNAAYRR NGVYAGWAQE WRQLGGLNSR VSASYARRNY KGVAAFSTEA
```

-continued

```
451 QRNREWNVSL ALSHDKLSYK GIVPALNYRF GRTESNVPYA KRRNSEVFVS

501 ADWRF*
```

m935/a935 98.8% identity in 505 aa overlap

```
                   10        20        30        40        50        60
m935.pep  MLYFRYGFLVVWCAAGVSAAYGADAPAILDDKALLQVQRSVSDKWAESDWKVENDAPRVV
          ||||||||||||||||||||||||||||||||||||||||||||||||||||:|||||||
a935      MLYFRYGFLVVWCAAGVSAAYGADAPAILDDKALLQVQRSVSDKWAESDWKVDNDAPRVV
                   10        20        30        40        50        60

                   70        80        90       100       110       120
m935.pep  DGDFLLAHPKMLEHSLRDALNGNQADLIASLADLYAKLPDYDAVLYGRARALLAKLAGRP
          ||||||||||||||||||:|||||||||||||||||||||||||||||||||||||||||
a935      DGDFLLAHPKMLEHSLRDVLNGNQADLIASLADLYAKLPDYDAVLYGRARALLAKLAGRP
                   70        80        90       100       110       120

                  130       140       150       160       170       180
m935.pep  AEAVARYRELHGENAADERILLDLAAAEFDDFRLKSAERHFAEAAKLDLPAPVLENVGRF
          |||||||||||||||||||||||||||||||||||||||||||| |||||||||||||||
a935      AEAVARYRELHGENAADERILLDLAAAEFDDFRLKSAERHFAEAEKLDLPAPVLENVGRF
                  130       140       150       160       170       180

                  190       200       210       220       230       240
m935.pep  RKKTEGLTGWRFSGGISPAVNRNANNAAPQYCRQNGGRQICSVSRAERAAGLNYEIEAEK
          |||:||||||||||||||||||||||||||||||||||||||||||||||||||||||||
a935      RKKAEGLTGWRFSGGISPAVNRNANNAAPQYCRQNGGRQICSVSRAERAAGLNYEIEAEK
                  190       200       210       220       230       240

                  250       260       270       280       290       300
m935.pep  LTPLADNHYLLFRSNIGGTSYYFSKKSAYDDGFGRAYLGWQYKNARQTAGILPFYQVQLS
          || |||||||||||||||||||||||||||||||||||||||||||||||||||||||||
m935      LTALADNHYLLFRSNIGGTSYYFSKKSAYDDGFGRAYLGWQYKNARQTAGILPFYQVQLS
                  250       260       270       280       290       300

                  310       320       330       340       350       360
m935.pep  GSDGFDAKTKRVNNRRLPPYMLAHGVGVQLSHTYRPNPGWQFSVALEHYRQRYREQDRAE
          ||||||||||||||||||||||||||||||||||||||||||||||||||||||||||||
a935      GSDGFDAKTKRVNNRRLPPYMLAHGVGVQLSHTYRPNPGWQFSVALEHYRQRYREQDRAE
                  310       320       330       340       350       360

                  370       380       390       400       410       420
m935.pep  YNNGRQDGFYVSSAKRLGESATVFGGWQFVRFVPKRETVGGAVNNAAYRRNGVYAGWAQE
          ||||||||||||||||||||||||||||||||||||||||||||||||||||||||||||
a935      YNNGRQDGFYVSSAKRLGESATVFGGWQFVRFVPKRETVGGAVNNAAYRRNGVYAGWAQE
                  370       380       390       400       410       420

                  430       440       450       460       470       480
m935.pep  WRQLGGLNSRVSASYARRNYKGIAAFSTEAQRNREWNVSLALSHDKLSYKGIVPALNYRF
          ||||||||||||||||||||||:|||||||||||||||||||||||||||||||||||||
a935      WRQLGGLNSRVSASYARRNYKGVAAFSTEAQRNREWNVSLALSHDKLSYKGIVPALNYRF
                  430       440       450       460       470       480

                  490       500
m935.pep  GRTESNVPYAKRRNSEVFVSADWRFX
          |||||||||||||||||||||||||
a935      GRTESNVPYAKRRNSEVFVSADWRFX
                  490       500
```

The following partial DNA sequence was identified in *N. gonorrhoeae* <SEQ ID 2875>:

g936.seq

```
  1 ATGAAACCCA AACCACACAC CGTCCGCACC CTGATTGCCG CCGTCCTCAG

 51 CCTTGCCCTC GGCGGCTGCT TCAGCGCAGT CGTCGGCGGG GCCGCCGTCG

101 GCGCAAAATC CGTCATCGAC CGcCgAACCA CCGgcgcgca AACCGATGac

151 aACGTTATGG CGTTGCGTAT CGAAACCACC GCCCGTTCCT ACCTGCGCCA

201 AAACAACCAA ACCAAAGGCT ACACGCCCCA AATCTCCGTC GTCGGCTACA

251 ACCGCCACCT GCTGCTGCTC GGACAAGTCG CCACCGAAGG CGAAAAACAG
```

-continued

```
301 TTCGTCGGTC AGATTGCACG TTCCGAACAG GCCGCCGAAG GCGTATACAA

351 CTACATTACC GTCGCCTCCC TGCCGCGCAC TGCGGGCGAC ATCGCCGGCG

401 ACACTTGGAA CACGTCCAAA GTCCGCGCca cgCTGCTGGG CATCAGCCCC

451 GCTACACAGG CGCGCGTCAA AATCATTACC TACGGCAATG TAACCTACGT

501 TATGGGCATC CTCACCCCCG AAGAACAGGC GCAGATTACC CAAAAAGTCA

551 GCACCAccgT CGGCGTACAA AAAGTCATTA CCCTCTACCA AAACTACGTC

601 CAACGCTGA
```

This corresponds to the amino acid sequence <SEQ ID 2876; ORF 936.ng>:

g936.pep

```
  1 MKPKPHTVRT LIAAVLSLAL GGCFSAVVGG AAVGAKSVID RRTTGAQTDD

 51 NVMALRIETT ARSYLRQNNQ TKGYTPQISV VGYNRHLLLL GQVATEGEKQ

101 FVGQIARSEQ AAEGVYNYIT VASLPRTAGD IAGDTWNTSK VRATLLGISP

151 ATQARVKIIT YGNVTYVMGI LTPEEQAQIT QKVSTTVGVQ KVITLYQNYV

201 QR*
```

The following partial DNA sequence was identified in *N. meningitidis* <SEQ ID 2877>:

m936.seq (partial)

```
  1 ATGAAACCCA AACCGCACAC CGTCCGCACC CTGATTGCCG CCATTTTCAG

 51 CCTTGCCCTT AGCGGCTGCG TCAGCGCAGT AATCGGAAGC GCCGCCGTCG

101 GCGCGAAATC CGCCGTCGAC CGCCGAACCA CCGGCGCGCA AACCGACGAC

151 AACGTTATGG CGTTGCGTAT CGAAACCACC GCCCGTTCCT ATCTGCGCCA

201 AAACAACCAA ACCAAAGGCT ACACGCCCCA AATCTCCGTC GTCGGCTACA

251 ACCGCCACCT GCTGCTGCTC GGACAAGTCG CCACCGAAGG CGAAAAACAG

301 TTCGTCGGTC AGATTGCACG TTCCGAACAG GCCGCCGAAG GCGTGTACAA

351 CTATATTACC GTCGCCTCCC TGCCGCGCAC TGCC...
```

This corresponds to the amino acid sequence <SEQ ID 2878; ORF 936>:

m936.pep (partial)

```
  1 MKPKPHTVRT LIAAIFSLAL SGCVSAVIGS AAVGAKSAVD RRTTGAQTDD

 51 NVMALRIETT ARSYLRQNNQ TKGYTPQISV VGYNRHLLLL GQVATEGEKQ

101 FVGQIARSEQ AAEGVYNYIT VASLPRTA...
```

Computer analysis of this amino acid sequence gave the following results:

Homology with a predicted ORF from *N. gonorrhoeae*

ORF 936 shows 93.8% identity over a 128 aa overlap with a predicted ORF (ORF 936.ng) from *N. gonorrhoeae*.

m936/g936

```
                    10        20        30        40        50        60
m936.pep    MKPKPHTVRTLIAAIFSLALSGCVSAVIGSAAVGAKSAVDRRTTGAQTDDNVMALRIETT
            ||||||||||||||::||||:|| |||:|:|||||||::|||||||||||||||||||||
g936        MKPKPHTVRTLIAAVLSLALGGCFSAVVGGAAVGAKSVIDRRTTGAQTDDNVMALRIETT
                    10        20        30        40        50        60

                    70        80        90       100       110       120
m936.pep    ARSYLRQNNQTKGYTPQISVVGYNRHLLLLGQVATEGEKQFVGQIARSEQAAEGVYNYIT
            ||||||||||||||||||||||||||||||||||||||||||||||||||||||||||||
g936        ARSYLRQNNQTKGYTPQISVVGYNRHLLLLGQVATEGEKQFVGQIARSEQAAEGVYNYIT
                    70        80        90       100       110       120

                   130
m936.pep    VASLPRTAXXX
            ||||||||
g936        VASLPRTAGDIAGDTWNTSKVRATLLGISPATQARVKIITYGNVTYVMGILTPEEQAQIT
                   130       140       150       160       170       180
```

The following partial DNA sequence was identified in *N. meningitidis* <SEQ ID 2879>:

a936.seq

```
  1 ATGAAACCCA AACCGCACAC CGTCCGCACC CTGACTGCCG CCGTCCTCAG
 51 CCTTGCCCTC GGCGGCTGCG TCAGCGCAGT CGTCGGCGGC GCGGCGGTCG
101 GCGCGAAATC CGCCGTCGAC CGCCGAACCA CCGGCGCGCA AACCGACGAC
151 AACGTAATGG CGCTGCGTAT CGAAACCACC GCCCGCTCCT ATCTGCGCCA
201 AAACAACCAA ACCAAAGGCT ACACGCCCCA AATCTCCGTT GTCGGCTACA
251 ACCGCCACCT GCTGCTGCTC GGACAAGTCG CCACCGAAGG CGAGAAACAG
301 TTCGTCGGTC AGATTGCACG TTCCGAACAG GCCGCCGAAG GCGTGTACAA
351 CTACATTACC GTCGCCTCCC TGCCGCGCAC TGCCGGCGAC ATCGCCGGCG
401 ACACTTGGAA CACATCCAAA GTCCGCGCCA CGCTGTTGGG CATCAGCCCC
451 GCCACACAGG CGCGCGTCAA AATCGTTACC TACGGCAACG TAACCTACGT
501 TATGGGCATC CTCACCCCCG AAGAACAGGC GCAGATTACC CAAAAAGTCA
551 GCACCACCGT CGGCGTACAA AAAGTCATCA CCCTCTACCA AAACTACGTC
601 CAACGCTGA
```

This corresponds to the amino acid sequence <SEQ ID 2880; ORF 936.a>:

a936.pep

```
  1 MKPKPHTVRT LTAAVLSLAL GGCVSAVVGG AAVGAKSAVD RRTTGAQTDD
 51 NVMALRIETT ARSYLRQNNQ TKGYTPQISV VGYNRHLLLL GQVATEGEKQ
101 FVGQIARSEQ AAEGVYNYIT VASLPRTAGD IAGDTWNTSK VRATLLGISP
151 ATQARVKIVT YGNVTYVMGI LTPEEQAQIT QKVSTTVGVQ KVITLYQNYV
201 QR*
```

m936/a936 95.3% identity in 128 aa overlap

```
           10         20         30         40         50         60
m936.pep   MKPKPHTVRTLIAAIFSLALSGCVSAVIGSAAVGAKSAVDRRTTGAQTDDNVMALRIETT
           |||||||||||  ::||||:|||||||:|:||||||||||||||||||||||||||||||
a936       MKPKPHTVRTLTAAVLSLALGGCVSAVVGGAAVGAKSAVDRRTTGAQTDDNVMALRIETT
           10         20         30         40         50         60
           70         80         90        100        110        120
m936.pep   ARSYLRQNNQTKGYTPQISVVGYNRHLLLLGQVATEGEKQFVGQIARSEQAAEGVYNYIT
           ||||||||||||||||||||||||||||||||||||||||||||||||||||||||||||
a936       ARSYLRQNNQTKGYTPQISVVGYNRHLLLLGQVATEGEKQFVGQIARSEQAAEGVYNYIT
           70         80         90        100        110        120

m936.pep   VASLPRTA
           ||||||||
a936       VASLPRTAGDIAGDTWNTSKVRATLLGISPATQARVKIVTYGNVTYVMGILTPEEQAQIT
           130        140        150        160        170        180
```

The following partial DNA sequence was identified in *N. gonorrhoeae* <SEQ ID 2881>:

```
g936-1.seq

  1 ATGAAACCCA AACCACACAC CGTCCGCACC CTGATTGCCG CCGTCCTCAG

 51 CCTTGCCCTC GGCGGCTGCT TCAGCGCAGT CGTCGGCGGG GCCGCCGTCG

101 GCGCAAAATC CGTCATCGAC CGccgAACCA CCGgcgcgca AACCGATGac

151 aACGTTATGG CGTTGCGTAT CGAAACCACC GCCCGTTCCT ACCTGCGCCA

201 AAACAACCAA ACCAAAGGCT ACACGCCCCA AATCTCCGTC GTCGGCTACA

251 ACCGCCACCT GCTGCTGCTC GGACAAGTCG CCACCGAAGG CGAAAAACAG

301 TTCGTCGGTC AGATTGCACG TTCCGAACAG GCCGCCGAAG GCGTATACAA

351 CTACATTACC GTCGCCTCCC TGCCGCGCAC TGCGGGCGAC ATCGCCGGCG

401 ACACTTGGAA CACGTCCAAA GTCCGCGCca cgCTGCTGGG CATCAGCCCC

451 GCTACACAGG CGCGCGTCAA AATCATTACC TACGGCAATG TAACCTACGT

501 TATGGGCATC CTCACCCCCG AAGAACAGGC GCAGATTACC CAAAAAGTCA

551 GCACCAccgT CGGCGTACAA AAAGTCATTA CCCTCTACCA AAACTACGTC

601 CAACGCTGA
```

This corresponds to the amino acid sequence <SEQ ID 2882; ORF 936-1.ng>:

```
g936-1.pep

  1 MKPKPHTVRT LIAAVLSLAL GGCFSAVVGG AAVGAKSVID RRTTGAQTDD

 51 NVMALRIETT ARSYLRQNNQ TKGYTPQISV VGYNRHLLLL GQVATEGEKQ

101 FVGQIARSEQ AAEGVYNYIT VASLPRTAGD IAGDTWNTSK VRATLLGISP

151 ATQARVKIIT YGNVTYVMGI LTPEEQAQIT QKVSTTVGVQ KVITLYQNYV

201 QR*
```

The following partial DNA sequence was identified in *N. meningitidis* <SEQ ID 2883>:

```
m936-1.seq

  1 ATGAAACCCA AACCGCACAC CGTCCGCACC CTGATTGCCG CCATTTTCAG

 51 CCTTGCCCTT AGCGGCTGCG TCAGCGCAGT AATCGGAAGC GCCGCCGTCG
```

-continued

```
101 GCGCGAAATC CGCCGTCGAC CGCCGAACCA CCGGCGCGCA AACCGACGAC

151 AACGTTATGG CGTTGCGTAT CGAAACCACC GCCCGTTCCT ATCTGCGCCA

201 AAACAACCAA ACCAAAGGCT ACACGCCCCA AATCTCCGTC GTCGGCTACA

251 ACCGCCACCT GCTGCTGCTC GGACAAGTCG CCACCGAAGG CGAAAAACAG

301 TTCGTCGGTC AGATTGCACG TTCCGAACAG GCCGCCGAAG GCGTGTACAA

351 CTATATTACC GTCGCCTCCC TGCCGCGCAC TGCCGGCGAC ATCGCCGGCG

401 ACACTTGGAA CACATCCAAA GTCCGCGCCA CGCTGTTGGG CATCAGCCCC

451 GCCACACAGG CGCGCGTCAA AATCGTTACC TACGGCAACG TAACCTACGT

501 TATGGGCATC CTCACCCCCG AAGAACAGGC GCAGATTACC CAAAAAGTCA

551 GCACCACCGT CGGCGTACAA AAAGTCATCA CCCTCTACCA AAACTACGTC

601 CAACGCTGA
```

This corresponds to the amino acid sequence <SEQ ID 2884; ORF 936-1>:

m936-1.pep

```
  1 MKPKPHTVRT LIAAIFSLAL SGCVSAVIGS AAVGAKSAVD RRTTGAQTDD

 51 NVMALRIETT ARSYLRQNNQ TKGYTPQISV VGYNRHLLLL GQVATEGEKQ

101 FVGQIARSEQ AAEGVYNYIT VASLPRTAGD IAGDTWNTSK VRATLLGISP

151 ATQARVKIVT YGNVTYVMGI LTPEEQAQIT QKVSTTVGVQ KVITLYQNYV

201 QR*
```

m936-1/g936-1 95.5% identity in 202 aa overlap

```
                    10        20        30        40        50        60
m936-1.pep  MKPKPHTVRTLIAAIFSLALSGCVSAVIGSAAVGAKSAVDRRTTGAQTDDNVMALRIETT
            ||||||||||||||::||||:|| |||:|:|||||||::|||||||||||||||||||||
g936-1      MKPKPHTVRTLIAAVLSLALGGCFSAVVGGAAVGAKSVIDRRTTGAQTDDNVMALRIETT
                    10        20        30        40        50        60

                    70        80        90       100       110       120
m936-1.pep  ARSYLRQNNQTKGYTPQISVVGYNRHLLLLGQVATEGEKQFVGQIARSEQAAEGVYNYIT
            ||||||||||||||||||||||||||||||||||||||||||||||||||||||||||||
g936-1      ARSYLRQNNQTKGYTPQISVVGYNRHLLLLGQVATEGEKQFVGQIARSEQAAEGVYNYIT
                    70        80        90       100       110       120

                   130       140       150       160       170       180
m936-1.pep  VASLPRTAGDIAGDTWNTSKVRATLLGISPATQARVKIVTYGNVTYVMGILTPEEQAQIT
            ||||||||||||||||||||||||||||||||||||||:|||||||||||||||||||||
g936-1      VASLPRTAGDIAGDTWNTSKVRATLLGISPATQARVKIITYGNVTYVMGILTPEEQAQIT
                   130       140       150       160       170       180

                   190       200
m936-1.pep  QKVSTTVGVQKVITLYQNYVQRX
            ||||||||||||||||||||||
g936-1      QKVSTTVGVQKVITLYQNYVQRX
                   190       200
```

The following partial DNA sequence was identified in *N. meningitidis* <SEQ ID 2885>:

a936-1.seq

```
  1 ATGAAACCCA AACCGCACAC CGTCCGCACC CTGACTGCCG CCGTCCTCAG

 51 CCTTGCCCTC GGCGGCTGCG TCAGCGCAGT CGTCGGCGGC GCGGCGGTCG
```

-continued

```
101 GCGCGAAATC CGCCGTCGAC CGCCGAACCA CCGGCGCGCA AACCGACGAC

151 AACGTAATGG CGCTGCGTAT CGAAACCACC GCCCGCTCCT ATCTGCGCCA

201 AAACAACCAA ACCAAAGGCT ACACGCCCCA AATCTCCGTT GTCGGCTACA

251 ACCGCCACCT GCTGCTGCTC GGACAAGTCG CCACCGAAGG CGAGAAACAG

301 TTCGTCGGTC AGATTGCACG TTCCGAACAG GCCGCCGAAG GCGTGTACAA

351 CTACATTACC GTCGCCTCCC TGCCGCGCAC TGCCGGCGAC ATCGCCGGCG

401 ACACTTGGAA CACATCCAAA GTCCGCGCCA CGCTGTTGGG CATCAGCCCC

451 GCCACACAGG CGCGCGTCAA AATCGTTACC TACGGCAACG TAACCTACGT

501 TATGGGCATC CTCACCCCCG AAGAACAGGC GCAGATTACC CAAAAAGTCA

551 GCACCACCGT CGGCGTACAA AAAGTCATCA CCCTCTACCA AAACTACGTC

601 CAACGCTGA
```

This corresponds to the amino acid sequence <SEQ ID 2886; ORF 936-1.a>:

a936-1.pep

```
  1 MKPKPHTVRT LTAAVLSLAL GGCVSAVVGG AAVGAKSAVD RRTTGAQTDD

 51 NVMALRIETT ARSYLRQNNQ TKGYTPQISV VGYNRHLLLL GQVATEGEKQ

101 FVGQIARSEQ AAEGVYNYIT VASLPRTAGD IAGDTWNTSK VRATLLGISP

151 ATQARVKIVT YGNVTYVMGI LTPEEQAQIT QKVSTTVGVQ KVITLYQNYV

201 QR*
```

a936-1/m936-1 97.0% identity in 202 aa overlap

```
                    10        20        30        40        50        60
m936-1.pep  MKPKPHTVRTLIAAIFSLALSGCVSAVIGSAAVGAKSAVDRRTTGAQTDDNVMALRIETT
            |||||||||| ||::||||:||||||:|:||||||||||||||||||||||||||||||||
a936-1      MKPKPHTVRTLTAAVLSLALGGCVSAVVGGAAVGAKSAVDRRTTGAQTDDNVMALRIETT
                    10        20        30        40        50        60

                    70        80        90       100       110       120
m936-1.pep  ARSYLRQNNQTKGYTPQISVVGYNRHLLLLGQVATEGEKQFVGQIARSEQAAEGVYNYIT
            ||||||||||||||||||||||||||||||||||||||||||||||||||||||||||||
a936-1      ARSYLRQNNQTKGYTPQISVVGYNRHLLLLGQVATEGEKQFVGQIARSEQAAEGVYNYIT
                    70        80        90       100       110       120

                   130       140       150       160       170       180
m936-1.pep  VASLPRTAGDIAGDTWNTSKVRATLLGISPATQARVKIVTYGNVTYVMGILTPEEQAQIT
            ||||||||||||||||||||||||||||||||||||||||||||||||||||||||||||
a936-1      VASLPRTAGDIAGDTWNTSKVRATLLGISPATQARVKIVTYGNVTYVMGILTPEEQAQIT
                   130       140       150       160       170       180

                   190       200
m936-1.pep  QKVSTTVGVQKVITLYQNYVQRX
            ||||||||||||||||||||||
a936-1      QKVSTTVGVQKVITLYQNYVQRX
                   190       200
```

The following partial DNA sequence was identified in *N. gonorrhoeae* <SEQ ID 2887>:

g937.seq

```
  1 atGAAAAATA TTCTCTTAgt ATTTGTTAGC TTTGTGCCAT TATGTGTCCG

 51 CACTGATCTG CCGCTGAata tCGAAGACAT AATGaccgAC AAGGGAAAAT
```

-continued

```
101 GGAAactGGA AACTTccctt acctacctgA acaGCGAAAA cagCCGCGCC
151 GCACTTGCCT CACCGGTTTA CATTCAGACC GGCTCCGCTT CCTTTATCCC
201 CGTCCCGACC GAAATTCAGG AAAACGGCAG CAATACCGAT ATGCTCGCCG
251 GCACGCTCGG TTTGCGCTAC GGACTGAccg GCAataccgA CATTTACGGC
301 AGCGGCAGCT ATCTGTGGCA CGAAGAACGC AAACTCGacg GCAACGGCAA
351 AACCCGCAAC AAACGGATGT CCGACATATC CGCCGGCATC AGCCACACCT
401 TCCttaAAGa cgGCAAAAAT CCCGCACTCA TCGCTTTCCT CGAAAGCACG
451 GTTTACGAAA AATCGCGCAA CAAAGCCTCG TCGGGAAAAT CGTGGCTCAT
501 CGGCGCCACC ACCTACAAAG CCATAGATCC GATTGTCCTT TCCCTCACCG
551 CCGCCTACCG CATCAACGGC AGCAAAACCC TTTCAGACGA CGTCAAATAC
601 AAAGCAGGCA ATTACTGGAT GCTGAATCCC AACATCTCAT TTGCCGCCAA
651 CGACAGAATC AGCCTGACCG GAGGCATCCA ATGGCTGGGC AAACAGCCCG
701 ACCGCATAGA CGGCAAAAAA GAATCCGCAA GAAACACATC CACCTACGCC
751 CATTTCGGCG CAGGTTTCGG TTTCACCAAA ACCGCGGCTT TAAACGCATC
801 CGCACGTTTC AACGTTTCAG GGCAAAGCAG TTCCGAACTG AAATTGGGCG
851 TACAGCATAC ATTTTAA
```

This corresponds to the amino acid sequence <SEQ ID 2888; ORF 937.ng>:

g937.pep

```
  1 MKNILLVFVS FVPLCVRTDL PLNIEDIMTD KGKWKLETSL TYLNSENSRA
 51 ALASPVYIQT GSASFIPVPT EIQENGSNTD MLAGTLGLRY GLTGNTDIYG
101 SGSYLWHEER KLDGNGKTRN KRMSDISAGI SHTFLKDGKN PALIAFLEST
151 VYEKSRNKAS SGKSWLIGAT TYKAIDPIVL SLTAAYRING SKTLSDDVKY
201 KAGNYWMLNP NISFAANDRI SLTGGIQWLG KQPDRIDGKK ESARNTSTYA
251 HFGAGFGFTK TAALNASARF NVSGQSSSEL KLGVQHTF*
```

The following partial DNA sequence was identified in *N. meningitidis* <SEQ ID 2889>:

m937.seq

```
  1 ATGAAGCGCA TCTTTTTGCC CGCCTTGCCC GCCATCCTGC CTTTATCCAC
 51 TTATGCCGAC CTGCCCTTGA CGATTGAAGA CATAATGACC GACAAGGGAA
101 AATGGAAACT GGAAACTTCC CTTACCTACC TGAACAGCGA AAACAACCGC
151 GCCGAACTTG CCGCACCGGT TTACATTCAA ACCGGCGCAA CCTCGTTTAT
201 CCCCATTCCG ACCGAAATCC AAgAAAaCGG CAGCAATACC GATATGCTCG
251 TCGGCACGCT CGGTTTGCGC TACGGACTGA CCGGGAATAC CGACATTTAC
301 GGCAGCGGCA GCTATCTGTG GCACGAAGAA CGCAAACTCG ACGGCAACAG
351 CAAAACCCGC AACAAACGGA TGTCCGACGT ATCCCTCGGC ATCAGCCACA
401 CTTTCCTTAA AGACGACAAA AACCCCGCCC TAATCAGCTT TCTTGAAAGC
```

-continued

```
451 ACGGTTTACG AAAAATCGCG CAACAAAGCC TCGTCGGGAA AATCCTGGCT

501 CATCGGCGCC ACCACCTACA AAGCCATAGA TCCGATTGTC CTTTCCCTCA

551 CCGCCGCCTA CCGCATCAAC GGCAGCAAAA CCCTTTCAGA CGGCATCCGC

601 TACAAATCGG GCAACTACCT GCTGCTCAAC CCCAACATCT CATTTGCTGC

651 CAACGACAGA ATCAGCCTGA CCGGAGGCAT CCAATGGCTG GGCAGGCAGC

701 CCGACCGGAC GGACGGCAAA CGGGAATCCT CCAGAAACAC ATCCACCTAC

751 GCCCATTTCG GCGCAGGTTT CGGTTTCACC AAAACCACGG CTTTAAACGC

801 ATCCGCACGT TTCAACGTTT CAGGGCAAAG CAGTTCCGAA CTGAAATTTG

851 GCGTACAGCA TACATTTTAA
```

This corresponds to the amino acid sequence <SEQ ID 2890; ORF 937>:

m937.pep..

```
  1 MKRIFLPALP AILPLSTYAD LPLTIEDIMT DKGKWKLETS LTYLNSENNR

 51 AELAAPVYIQ TGATSFIPIP TEIQENGSNT DMLVGTLGLR YGLTGNTDIY

101 GSGSYLWHEE RKLDGNSKTR NKRMSDVSLG ISHTFLKDDK NPALISFLES

151 TVYEKSRNKA SSGKSWLIGA TTYKAIDPIV LSLTAAYRIN GSKTLSDGIR

201 YKSGNYLLLN PNISFAANDR ISLTGGIQWL GRQPDRTDGK RESSRNTSTY

251 AHFGAGFGFT KTTALNASAR FNVSGQSSSE LKFGVQHTF*
```

Computer analysis of this amino acid sequence gave the following results:

Homology with a predicted ORF from *N. gonorrhoeae*

ORF 937 shows 86.9% identity over a 289 aa overlap with a predicted ORF (ORF 937.ng) from *N. gonorrhoeae*:

g937/m937

```
                    10        20        30        40        50       59
g937.pep   MKNILL-VFVSFVPLCVRTDLPLNIEDIMTDKGKWKLETSLTYLNSENSRAALASPVYIQ
           || |:| :: :::|| : :||||:||||||||||||||||||||||||:|| ||:|||||
m937       MKRIFLPALPAILPLSTYADLPLTIEDIMTDKGKWKLETSLTYLNSENNRAELAAPVYIQ
                   10        20        30        40        50        60

          60        70        80        90       100       110      119
g937.pep   TGSASFIPVPTEIQENGSNTDMLAGTLGLRYGLTGNTDIYGSGSYLWHEERKLDGNGKTR
           ||::||||:||||||||||||||:||||||||||||||||||||||||||||||||:|||
m937       TGATSFIPIPTEIQENGSNTDMLVGTLGLRYGLTGNTDIYGSGSYLWHEERKLDGNSKTR
                   70        80        90       100       110       120

         120       130       140       150       160       170      179
g937.pep   NKRMSDISAGISHTFLKDGKNPALIAFLESTVYEKSRNKASSGKSWLIGATTYKAIDPIV
           ||||||:| ||||||||| ||||||:||||||||||||||||||||||||||||||||||
m937       NKRMSDVSLGISHTFLKDDKNPALISFLESTVYEKSRNKASSGKSWLIGATTYKAIDPIV
                  130       140       150       160       170       180

         180       190       200       210       220       230      239
g937.pep   LSLTAAYRINGSKTLSDDVKYKAGNYWMLNPNISFAANDRISLTGGIQWLGKQPDRIDGK
           ||||||||||||||||| ::||:||| :|||||||||||||||||||||||:|||| |||
m937       LSLTAAYRINGSKTLSDGIRYKSGNYLLLNPNISFAANDRISLTGGIQWLGRQPDRTDGK
                  190       200       210       220       230       240

         240       250       260       270       280      289
g937.pep   KESARNTSTYAHFGAGFGFTKTAALNASARFNVSGQSSSELKLGVQHTFX
           :||:||||||||||||||||||:|||||||||||||||||||:|||||||
m937       RESSRNTSTYAHFGAGFGFTKTTALNASARFNVSGQSSSELKFGVQHTFX
                  250       260       270       280
```

The following partial DNA sequence was identified in *N. meningitidis* <SEQ ID 2891>:

a937.seq

```
  1 ATGAAGCGCA TCTTTTTGCC CGCCTTGCCC GCCATCCTGC CTTTATCCGC
 51 TTATGCCGAC CTGCCCTTGA CGATTGAAGA CATAATGACC GACAAGGGCA
101 AATGGAAACT GGAAACTTCC CTTACCTACC TGAACAGCGA AAACAACCGC
151 GCCGAACTTG CCGCACCGGT TTACATCCAA ACCGGCGCAA CCTCGTTTAT
201 CCCCATTCCG ACCGAAATCC AAGAAAACGG CAGCAATACC GATATGCTCG
251 TTGGCACGCT CGGTTTGCGC TACGGACTGA CCGGGAATAC CGACATTTAC
301 GGCAGCGGCA GCTATCTGTG GCACGAAGAA CGCAAACTCG ACGGCAACGG
351 CAAAACCCGA AACAAACGGA TGTCCGACGT ATCCCTCGGC ATCAGCCACA
401 CCTTCCTTAA AGACGACAAA AACCCCGCCC TAATCAGCTT TCTTGAAAGC
451 ACGGTTTACG AAAAATCGCG CAACAAAGCC TCGTCGGGAA AATCCTGGCT
501 CATCGGCGCC ACCACCTACA AAGCCATCGA CCCCGTCGTC CTCTCATTGA
551 CCGCTGCCTA CCGTATCAAC GGCAGCAAAA CCCTTTCAAG CAACACCAAA
601 TACAAAGCAG GCAATTACTG GATGCTGAAT CCCAATATAT CCTTCGCCGC
651 CAACGACAGA ATCAGCCTCA CGGGCGGCAT CCAATGGCTG GGCAAGCAGC
701 CCGACCGTCT GGACGGCAAA AAAGAATCCG CAAGAAACAC ATCCACCTAT
751 GCCCATTTCG GCGCAGGTTT CGGTTTCACC AAAACCACGG CTTTAAACGC
801 ATCCGCACGT TTCAACGTTT CAGGGCAAAG CAGTTCCGAA CTGAAATTTG
851 GCGTACAGCA TACGTTTTAA
```

This corresponds to the amino acid sequence <SEQ ID 2892; ORF 937.a>:

a937.pep

```
  1 MKRIFLPALP AILPLSAYAD LPLTIEDIMT DKGKWKLETS LTYLNSENNR
 51 AELAAPVYIQ TGATSFIPIP TEIQENGSNT DMLVGTLGLR YGLTGNTDIY
101 GSGSYLWHEE RKLDGNGKTR NKRMSDVSLG ISHTFLKDDK NPALISFLES
151 TVYEKSRNKA SSGKSWLIGA TTYKAIDPVV LSLTAAYRIN GSKTLSSNTK
201 YKAGNYWMLN PNISFAANDR ISLTGGIQWL GKQPDRLDGK KESARNTSTY
251 AHFGAGFGFT KTTALNASAR FNVSGQSSSE LKFGVQHTF*
```

m937/a937 95.2% identity in 289 aa overlap

```
                   10        20        30        40        50        60
m937.pep   MKRIFLPALPAILPLSTYADLPLTIEDIMTDKGKWKLETSLTYLNSENNRAELAAPVYIQ
           ||||||||||||||||:|||||||||||||||||||||||||||||||||||||||||||
a937       MKRIFLPALPAILPLSAYADLPLTIEDIMTDKGKWKLETSLTYLNSENNRAELAAPVYIQ
                   10        20        30        40        50        60

                   70        80        90       100       110       120
m937.pep   TGATSFIPIPTEIQENGSNTDMLVGTLGLRYGLTGNTDIYGSGSYLWHEERKLDGNSKTR
           ||||||||||||||||||||||||||||||||||||||||||||||||||||||||:|||
a937       TGATSFIPIPTEIQENGSNTDMLVGTLGLRYGLTGNTDIYGSGSYLWHEERKLDGNGKTR
                   70        80        90       100       110       120

                  130       140       150       160       170       180
m937.pep   NKRMSDVSLGISHTFLKDDKNPALISFLESTVYEKSRNKASSGKSWLIGATTYKAIDPIV
           ||||||||||||||||||||||||||||||||||||||||||||||||||||||||||:|
a937       NKRMSDVSLGISHTFLKDDKNPALISFLESTVYEKSRNKASSGKSWLIGATTYKAIDPVV
                  130       140       150       160       170       180
```

-continued

```
                  190       200       210       220       230       240
m937.pep   LSLTAAYRINGSKTLSDGIRYKSGNYLLLNPNISFAANDRISLTGGIQWLGRQPDRTDGK
           ||||||||||||||||:: :||:||| :|||||||||||||||||||||||:|||| |||
a937       LSLTAAYRINGSKTLSSNTKYKAGNYWMLNPNISFAANDRISLTGGIQWLGKQPDRLDGK
                  190       200       210       220       230       240

                  250       260       270       280       290
m937.pep   RESSRNTSTYAHFGAGFGFTKTTALNASARFNVSGQSSSELKFGVQHTFX
           :||:||||||||||||||||||||||||||||||||||||||||||||||
a937       KESARNTSTYAHFGAGFGFTKTTALNASARFNVSGQSSSELKFGVQHTFX
                  250       260       270       280       290
```

g939.seq not found yet g939.pep not found yet

The following partial DNA sequence was identified in *N. meningitidis* <SEQ ID 2893>:

<u>m939.seq (partial)</u>

```
  1 ATGAAACGAT TGACTTTATT GGCCTTTGTT TTGGCTGCCG GTGCGGTTTC
 51 CGCCTCTCCC AAAGCAGACG TGGAAAAAGG CAAACAGGTT GCCGCAACGG
101 TTTGTGCGGC TTGCCATGCA GCAGACGGTA ACAGCGGCAT TGCGATGTAT
151 CCGCGTTTGG CGGCACAGCA TACTGCTTAC ATCTATCATC AAACTATCGG
201 CATCCGCGAC GTAAACGCAC CC...
```

This corresponds to the amino acid sequence <SEQ ID 2894; ORF 939>:

<u>m939.pep (partial)</u>

1 <u>MKRLTLLAFV LAAGAVSA</u>SP KADVEKGKQV AATVCAACHA ADGNSGIAMY

51 PRLAAQHTAY IYHQTIGIRD VNAP...

The following partial DNA sequence was identified in *N. meningitidis* <SEQ ID 2895>:

<u>a939.seq</u>

```
  1 ATGAAACGAT TGACTTTATT GGCCTTTGTT TTGGCTGCCG GTGCGGTTTC
 51 CGCATCTCCC AAAGCAGACG TGGAAAAAGG CAAACAGGTT GCCGCAACGG
101 TTTGTGCGGC TTGCCATGCA GCAGACGGTA ACAGCGGCAT TGCGATGTAT
151 CCGCGTTTGG CGGCACAGCA TACTGCTTAC ATCTATCATC AAACCATCGG
201 CATCCGCGAC GGTAAACGCA CCCACGGTTC GGCAGCTGTG ATGAAACCGG
251 TGGTAATGAA TTTGAGCGAT CAGGATATTT TGAACGTATC CGCATTCTAT
301 GCCAAACAGC AGCCCAAATC CGGTGAAGCC AATCCTAAGG AAAATCCCGA
351 ATTGGGTGCG AAAATCTATC GCGGCGGTTT GAGCGATAAA AAAGTGCCGG
401 CGTGTATGTC CTGCCACGGT CCGAGCGGTG CGGGTATGCC GGGGGGCGGA
451 AGCGAAATTC AGGCTTATCC GCGTTTGGGC GGTCAGCATC AGGCATATAT
501 TGTTGAACAG ATGAATGCCT ACAAGTCCGG TCAGCGTAAA AATACCATCA
551 TGGAAGATAT TGCAAACCGT ATGTCTGAAG AAGATTTGAA AGCGGTCGCC
601 AACTTTATCC AAGGTTTGCG TTAA
```

This corresponds to the amino acid sequence <SEQ ID 2896; ORF 939.a>:

a939.pep

```
  1 MKRLTLLAFV LAAGAVSASP KADVEKGKQV AATVCAACHA ADGNSGIAMY
 51 PRLAAQHTAY IYHQTIGIRD GKRTHGSAAV MKPVVMNLSD QDILNVSAFY
101 AKQQPKSGEA NPKENPELGA KIYRGGLSDK KVPACMSCHG PSGAGMPGGG
151 SEIQAYPRLG GQHQAYIVEQ MNAYKSGQRK NTIMEDIANR MSEEDLKAVA
201 NFIQGLR*
```

m939/a939 100.0% identity in 70 aa overlap

```
                   10        20        30        40        50        60
m939.pep   MKRLTLLAFVLAAGAVSASPKADVEKGKQVAATVCAACHAADGNSGIAMYPRLAAQHTAY
           ||||||||||||||||||||||||||||||||||||||||||||||||||||||||||||
a939       MKRLTLLAFVLAAGAVSASPKADVEKGKQVAATVCAACHAADGNSGIAMYPRLAAQHTAY
                   10        20        30        40        50        60

                   70
m939.pep   IYHQTIGIRDVNAP
           ||||||||||
a939       IYHQTIGIRDGKRTHGSAAVMKPVVMNLSDQDILNVSAFYAKQQPKSGEANPKENPELGA
                   70        80        90       100       110       120
```

The following partial DNA sequence was identified in *N. gonorrhoeae* <SEQ ID 2897>:

g950.seq

```
  1 ATGAACAAAA ATATTGCTGC CGCACTCGCC GGTGCTTTAT CCCTGTCTCT
 51 GGCCGCCGGC GCCGTTGCCG CCCACAAACC GGCAAGCAAC GCAACAGGCG
101 TTCAAAAATC CGCCCAAGGC TCTTGCGGCG CATCCAAATC TGCCGAAGGT
151 TCGTGCGGCG CATCCAAATC TGCCGAAGGT TCGTGCGGCG CGGCTGCTTC
201 TAAAGCAGGC GAAGGCAAAT GCGGCGAGGG CAAATGCGGT GCAACTGTAA
251 AAAAAGCCCA CAAACACACC AAAGCATCTA AAGCCAAAGC CAAATCTGCC
301 GAAGGCAAAT GCGGCGAAGG CAAATGCGGT TCTAAATAA
```

This corresponds to the amino acid sequence <SEQ ID 2898; ORF 950.ng>:

g950.pep

```
  1 MNKNIAAALA GALSLSLAAG AVAAHKPASN ATGVQKSAQG SCGASKSAEG
 51 SCGASKSAEG SCGAAASKAG EGKCGEGKCG ATVKKAHKHT KASKAKAKSA
101 EGKCGEGKCG SK*
```

The following partial DNA sequence was identified in *N. meningitidis* <SEQ ID 2899>:

m950.seq

```
  1 ATGAACAAAA ACATTGCTGC CGCTCTCGCC GGTGCTTTAT CCCTGTCTTT
 51 GGCCGCCGGT GCAGTTGCTG CCAACAAACC GGCAAGCAAC GCAACAGGCG
101 TTCATAAATC CGCCCATGGC TCTTGCGGCG CGTCCAAATC TGCCGAAGGT
```

-continued

```
151 TCGTGCGGCG CGGCTGGTTC TAAAGCAGGC GAAGGCAAAT GCGGCGAGGG

201 CAAATGCGGT GCGACCGTAA AAAAAACCCA CAAACACACC AAAGCATCTA

251 AAGCCAAGGC CAAATCTGCC GAAGGCAAAT GCGGCGAAGG CAAATGCGGT

301 TCTAAATAA
```

This corresponds to the amino acid sequence <SEQ ID 2900; ORF 950>:

m950.pep

```
  1 MNKNIAAALA GALSLSLAAG AVAANKPASN ATGVHKSAHG SCGASKSAEG

 51 SCGAAGSKAG EGKCGEGKCG ATVKKTHKHT KASKAKAKSA EGKCGEGKCG

101 SK
```

Computer analysis of this amino acid sequence gave the following results:

Homology with a predicted ORF from *N. gonorrhoeae*

ORF 950 shows 86.6% identity over a 112 aa overlap with a predicted ORF (ORF 950) from *N. gonorrhoeae* m950/g950 86.6% identity in 112 aa overlap

```
                   10        20        30        40        50
m950.pep   MNKNIAAALAGALSLSLAAGAVAANKPASNATGVHKSAHGSCGASKSAEGSCGA------
           ||||||||||||||||||||||||:|||||||||:|||:|||||||||||||||
g950       MNKNIAAALAGALSLSLAAGAVAAHKPASNATGVQKSAQGSCGASKSAEGSCGASKSAEG
                   10        20        30        40        50        60

                   60        70        80        90       100
m950.pep   ----AGSKAGEGKCGEGKCGATVKKTHKHTKASKAKAKSAEGKCGEGKCGSK
               |:||||||||||||||||||:||||||||||||||||||||||||||
g950       SCGAAASKAGEGKCGEGKCGATVKKAHKHTKASKAKAKSAEGKCGEGKCGSKX
                   70        80        90       100       110
```

The following partial DNA sequence was identified in *N. meningitidis* <SEQ ID 2901>:

a950.seq

```
  1 ATGAACAAAA ACATTGCTGC CGCACTCGCC GGTGCTTTAT CCCTGTCTTT

 51 GGCCGCCGGT GCAGTTGCTG CCAACAAACC GGCAAGCAAC GCAACAGGCG

101 TTCATAAATC CGCCCATGGC TCTTGCGGCG CGTCCAAATC TGCCGAAGGT

151 TCGTGCGGCG CGGCTGGTTC TAAAGCAGGC GAAGGCAAAT GCGGCGAGGG

201 CAAATGCGGT GCGACCGTAA AAAAAACCCA CAAACACACC AAAGCATCTA

251 AAGCCAAGGC CAAATCTGCC GAAGGCAAAT GCGGCGAAGG CAAATGCGGT

301 TCTAAATAA
```

This corresponds to the amino acid sequence <SEQ ID 2902; ORF 950.a>:

a950.pep

```
  1 MNKNIAAALA GALSLSLAAG AVAANKPASN ATGVHKSAHG SCGASKSAEG

 51 SCGAAGSKAG EGKCGEGKCG ATVKKTHKHT KASKAKAKSA EGKCGEGKCG

101 SK*
```

Computer analysis of this amino acid sequence gave the following results:

Homology with a predicted ORF from *N. meningitidis*

ORF 950 shows 100.0% identity over a 102 aa overlap with a predicted ORF (ORF 950) from *N. meningitidis* a950/m950 100.0% identity in 102 aa overlap

```
                10        20        30        40        50        60
a950.pep  MNKNIAAALAGALSLSLAAGAVAANKPASNATGVHKSAHGSCGASKSAEGSCGAAGSKAG
          ||||||||||||||||||||||||||||||||||||||||||||||||||||||||||||
m950      MNKNIAAALAGALSLSLAAGAVAANKPASNATGVHKSAHGSCGASKSAEGSCGAAGSKAG
                10        20        30        40        50        60

                70        80        90       100
a950.pep  EGKCGEGKCGATVKKTHKHTKASKAKAKSAEGKCGEGKCGSKX
          ||||||||||||||||||||||||||||||||||||||||||
m950      EGKCGEGKCGATVKKTHKHTKASKAKAKSAEGKCGEGKCGSK
                70        80        90       100
```

The following partial DNA sequence was identified in *N. gonorrhoeae* <SEQ ID 2903>:

```
g951.seq

   1 ATGATTATGT TACCCGCCCG TTTCACTATT TTATCTGTCC TCGCAGCAGC
  51 CCTGCTTGCC GGACAGGCGT ATGCTGCCGG CGCGGCGGAT GTGGAGCTGC
 101 CGAAGGAAGT CGGAAAGGTT TTAAGGAAAC ATCGGCGTTA CAGCGAGGAA
 151 GAAATCAAAA ACGAACGCGC ACGGCTTGCG GCAGTGGGCG AACGGGTCAA
 201 CAGGGTGTTT ACGCTGTTGG GCGGTGAAAC GGCTTTGCAG AAAGGGCAGG
 251 CGGGAACGGC TCTGGCAACC TATATGCTGA TGTTGGAACG CACAAAATCC
 301 CCCGAAGTCG CCGAACGCGC CTTGGAAATG GCCGTGTCGC TGAACGCGTT
 351 TGAACAGGCG GAAATGATTT ATCAGAAATG GCGGCAGATC GAGCCTATAC
 401 CGGGTGAGGC GCAAAAACGG GCGGGGTGGC TGCGGAACGT ATTGAGGGAA
 451 GGGGGAAATC AGCATCTGGA CGGGTTGGAA GAGGTGCTGG CGCAATCGGA
 501 CGATGTGCAA AAACGCAGGA TATTTTTGCT GCTGGTGCAA GCCGCCGTGC
 551 AGCAGGGTGG GGTGGCTCAA AAAGCATCGA AAGCGGTTCG CCGTGCGGCG
 601 TTGAAGTATG AACATCTGCC CGAAGCGGCG GTTGCCGATG CGGTGTTCGG
 651 CGTACAGGGA CGCGAAAAGG AAAAGGCAAT CGAAGCTTTG CAGCGTTTGG
 701 CGAAGCTCGA TACGGAAATA TTGCCCCCCA CTTTAATGAC GTTGCGTCTG
 751 ACTGCACGCA AATATCCCGA AATACTCGAC GGCTTTTTCG AGCAGACAGA
 801 CACCCAAAAC CTTTCGGCCG TCTGGCAGGA AATGGAAATT ATGAATCTGG
 851 TTTCCCTGCG TAAGCCGGAT GATGCCTATG CGCGTTTGAA CGTGCTGTTG
 901 GAACACAACC CGAATGCAAA CCTGTATATT CAGGCGGCGA TATTGGCGGC
 951 AAACCGAAAA GAAGGTGCGT CCGTTATCGA CGGCTACGCC GAAAAGGCAT
1001 ACGGCAGGGG GACGGGGGAA CAGCGGGGCA GGGCGGCAAT GACGGCGGCG
1051 ATGATATATG CCGACCGCAG GGATTACGCC AAAGTCAGGC AGTGGTTGAA
1101 AAAAGTGTCC GCGCCGGAAT ACCTGTTCGA CAAAGGCGTG CTGGCGGCTG
1151 CGGCGGCTGC CGAATTGGAC GGAGGCCGGG CGGCTTTGCG GCAGATCGGC
1201 AGGGTGCGGA AACTTCCCGA ACAGCAGGGG CGGTATTTTA CGGCAGACAA
```

-continued

1251 TTTGTCCAAA ATACAGATGC TCGCCCTGTC GAAGCTGCCC GACAAACGGG

1301 AAGCCCTGAT CGGGCTGAAC AACATCATCG CCAAACTTTC GGCGGCGGGA

1351 AGCACGGAAC CTTTGGCGGA AGCATTGGCA CAGCGTTCCA TTATTTACGA

1401 ACAGTTCGGC AAACGGGGAA AAATGATTGC CGACCTTGAA ACCGCGCTCA

1451 AACTTACGCC CGATAATGCA CAAATTATGA ATAATCTGGG CTACAGCCTG

1501 CTTTCCGATT CCAAACGTTT GGACGAGGGT TTCGCCCTGC TTCAGACGGC

1551 ATACCAAATC AACCCGGACG ATACCGCCGT TAACGACAGC ATAGGCTGGG

1601 CGTATTACCT GAAAGGCGAC GCGGAAAGCG CGCTGCCGTA TCTGCGGTAT

1651 TCGTTTGAAA ACGACCCCGA GCCCGAAGTT GCCGCCCATT TGGGCGAAGT

1701 GTTGTGGGCA TTGGGCGAAC GCGATCAGGC GGTTGACGTA TGGACGCAGG

1751 CGGCACACCT TAGGGGAGAC AAGAAAATAT GGCGGGAGAC GCTCAAACGC

1801 TACGGAATCG CCTTGCCCGA GCCTTCCCGA AAACCCCGGA AATAA

This corresponds to the amino acid sequence <SEQ ID 2904; ORF 951.ng>:

g951.pep

1 MIMLPARFTI LSVLAAALLA GQAYAAGAAD VELPKEVGKV LRKHRRYSEE

51 EIKNERARLA AVGERVNRVF TLLGGETALQ KGQAGTALAT YMLMLERTKS

101 PEVAERALEM AVSLNAFEQA EMIYQKWRQI EPIPGEAQKR AGWLRNVLRE

151 GGNQHLDGLE EVLAQSDDVQ KRRIFLLLVQ AAVQQGGVAQ KASKAVRRAA

201 LKYEHLPEAA VADAVFGVQG REKEKAIEAL QRLAKLDTEI LPPTLMTLRL

251 TARKYPEILD GFFEQTDTQN LSAVWQEMEI MNLVSLRKPD DAYARLNVLL

301 EHNPNANLYI QAAILAANRK EGASVIDGYA EKAYGRGTGE QRGRAAMTAA

351 MIYADRRDYA KVRQWLKKVS APEYLFDKGV LAAAAAAELD GGRAALRQIG

401 RVRKLPEQQG RYFTADNLSK IQMLALSKLP DKREALIGLN NIIAKLSAAG

451 STEPLAEALA QRSIIYEQFG KRGKMIADLE TALKLTPDNA QIMNNLGYSL

501 LSDSKRLDEG FALLQTAYQI NPDDTAVNDS IGWAYYLKGD AESALPYLRY

551 SFENDPEPEV AAHLGEVLWA LGERDQAVDV WTQAAHLRGD KKIWRETLKR

601 YGIALPEPSR KPRK*

The following partial DNA sequence was identified in *N. meningitidis* <SEQ ID 2905>:

m951.seq

1 ATGATTATGT TACCTAACCG TTTCAAAATG TTAACTGTGT TGACGGCAAC

51 CTTGATTGCC GGACAGGTAT CTGCCGCCGG AGGCGGTGCG GGGGATATGA

101 AACAGCCGAA GGAAGTCGGA AAGGTTTTCA GAAAGCAGCA GCGTTACAGC

151 GAGGAAGAAA TCAAAAACGA ACGCGCACGG CTTGCGGCAG TGGGCGAGCG

201 GGTTAATCAG ATATTTACGT TGCTGGGAGG GGAAACCGCC TTGCAAAAGG

251 GGCAGGCGGG AACGGCTCTG GCAACCTATA TGCTGATGTT GGAACGCACA

-continued

```
 301 AAATCCCCCG AAGTCGCCGA ACGCGCCTTG GAAATGGCCG TGTCGCTGAA
 351 CGCGTTTGAA CAGGCGGAAA TGATTTATCA GAAATGGCGG CAGATTGAGC
 401 CTATACCGGG TAAGGCGCAA AAACGGGCGG GGTGGCTGCG GAACGTGCTG
 451 AGGGAAAGAG GAAATCAGCA TCTGGACGGA CTGGAAGAAG TGCTGGCTCA
 501 GGCGGACGAA GGACAGAACC GCAGGGTGTT TTTATTGTTG GCACAAGCCG
 551 CCGTGCAACA GGACGGGTTG GCGCAAAAAG CATCGAAAGC GGTTCGCCGC
 601 GCGGCGTTGA AATATGAACA TCTGCCCGAA GCGGCGGTTG CCGATGTGGT
 651 GTTCAGCGTA CAGGGACGCG AAAAGGAAAA GGCAATCGGA GCTTTGCAGC
 701 GTTTGGCGAA GCTCGATACG GAAATATTGC CCCCCACTTT AATGACGTTG
 751 CGTCTGACTG CACGCAAATA TCCCGAAATA CTCGACGGCT TTTTCGAGCA
 801 GACAGACACC CAAAACCTTT CGGCCGTCTG GCAGGAAATG GAAATTATGA
 851 ATCTGGTTTC CCTGCACAGG CTGGATGATG CCTATGCGCG TTTGAACGTG
 901 CTGTTGGAAC GCAATCCGAA TGCAGACCTG TATATTCAGG CAGCGATATT
 951 GGCGGCAAAC CGAAAAGAAG GTGCTTCCGT TATCGACGGC TACGCCGAAA
1001 AGGCATACGG CAGGGGGACG GAGGAACAGC GGAGCAGGGC GGCGCTAACG
1051 GCGGCGATGA TGTATGCCGA CCGCAGGGAT TACGCCAAAG TCAGGCAGTG
1101 GCTGAAAAAA GTATCCGCGC CGGAATACCT GTTCGACAAA GGTGTGCTGG
1151 CGGCTGCGGC GGCTGTCGAG TTGGACGGCG GCAGGGCGGC TTTGCGGCAG
1201 ATCGGCAGGG TGCGGAAACT TCCCGAACAG CAGGGGCGGT ATTTTACGGC
1251 AGACAATTTG TCCAAAATAC AGATGCTCGC CCTGTCGAAG CTGCCCGATA
1301 AACGGGAGGC TTTGAGGGGG TTGGACAAGA TTATCGAAAA ACCGCCTGCC
1351 GGCAGTAATA CAGAGTTACA GGCAGAGGCA TTGGTACAGC GGTCAGTTGT
1401 TTACGATCGG CTTGGCAAGC GGAAAAAAAT GATTTCAGAT CTTGAAAGGG
1451 CGTTCAGGCT TGCACCCGAT AACGCTCAGA TTATGAATAA TCTGGGCTAC
1501 AGCCTGCTGA CCGATTCCAA ACGTTTGGAC GAAGGTTTCG CCCTGCTTCA
1551 GACGGCATAC CAAATCAACC CGGACGATAC CGCTGTCAAC GACAGCATAG
1601 GCTGGGCGTA TTACCTGAAA GGCGACGCGG AAAGCGCGCT GCCGTATCTG
1651 CGGTATTCGT TTGAAAACGA CCCCGAGCCC GAAGTTGCCG CCCATTTGGG
1701 CGAAGTGTTG TGGGCATTGG GCGAACGCGA TCAGGCGGTT GACGTATGGA
1751 CGCAGGCGGC ACACCTTACG GGAGACAAGA AAATATGGCG GGAAACGCTC
1801 AAACGTCACG GCATCGCATT GCCCCAACCT TCCCGAAAAC CTCGGAAATA
1851 A
```

This corresponds to the amino acid sequence <SEQ ID 2906; ORF 791>:

m951.pep

```
  1 MIMLPNRFKM LTVLTATLIA GQVSAAGGGA GDMKQPKEVG KVFRKQQRYS
 51 EEEIKNERAR LAAVGERVNQ IFTLLGGETA LQKGQAGTAL ATYMLMLERT
101 KSPEVAERAL EMAVSLNAFE QAEMIYQKWR QIEPIPGKAQ KRAGWLRNVL
151 RERGNQHLDG LEEVLAQADE GQNRRVFLLL AQAAVQQDGL AQKASKAVRR
```

-continued

```
201 AALKYEHLPE AAVADVVFSV QGREKEKAIG ALQRLAKLDT EILPPTLMTL

251 RLTARKYPEI LDGFFEQTDT QNLSAVWQEM EIMNLVSLHR LDDAYARLNV

301 LLERNPNADL YIQAAILAAN RKEGASVIDG YAEKAYGRGT EEQRSRAALT

351 AAMMYADRRD YAKVRQWLKK VSAPEYLFDK GVLAAAAAVE LDGGRAALRQ

401 IGRVRKLPEQ QGRYFTADNL SKIQMLALSK LPDKREALRG LDKIIEKPPA

451 GSNTELQAEA LVQRSVVYDR LGKRKKMISD LERAFRLAPD NAQIMNNLGY

501 SLLTDSKRLD EGFALLQTAY QINPDDTAVN DSIGWAYYLK GDAESALPYL

551 RYSFENDPEP EVAAHLGEVL WALGERDQAV DVWTQAAHLT GDKKIWRETL

601 KRHGIALPQP SRKPRK*
```

Computer analysis of this amino acid sequence gave the following results:

Homology with a predicted ORF from *N. gonorrhoeae*

ORF 951 shows 88.6% identity over a 616 aa overlap with a predicted ORF (ORF 951) from *N. gonorrhoeae* m951/g951 88.6% identity in 616 aa overlap

```
                  10        20        30        40        50        60
m951.pep  MIMLPNRFKMLTVLTATLIAGQVSAAGGGAGDMKQPKEVGKVFRKQQRYSEEEIKNERAR
          ||||| || :|:||:|:|:|||: ||  ||:|:: |||||||:||::|||||||||||||
g951      MIMLPARFTILSVLAAALLAGQAYAA--GAADVELPKEVGKVLRKHRRYSEEEIKNERAR
                  10        20          30        40        50

                  70        80        90       100       110       120
m951.pep  LAAVGERVNQIFTLLGGETALQKGQAGTALATYMLMLERTKSPEVAERALEMAVSLNAFE
          |||||||||::|||||||||||||||||||||||||||||||||||||||||||||||||
g951      LAAVGERVNRVFTLLGGETALQKGQAGTALATYMLMLERTKSPEVAERALEMAVSLNAFE
          60        70        80        90       100       110

                 130       140       150       160       170       180
m951.pep  QAEMIYQKWRQIEPIPGKAQKRAGWLRNVLRERGNQHLDGLEEVLAQADEGQNRRVFLLL
          |||||||||||||||||:|||||||||||||| ||||||||||||||:|: |:||:||||
g951      QAEMIYQKWRQIEPIPGEAQKRAGWLRNVLREGGNQHLDGLEEVLAQSDDVQKRRIFLLL
         120       130       140       150       160       170

                 190       200       210       220       230       240
m951.pep  AQAAVQQDGLAQKASKAVRRAALKYEHLPEAAVADVVFSVQGREKEKAIGALQRLAKLDT
          :|||||| |:|||||||||||||||||||||||||:||:|||||||||| ||||||||||
g951      VQAAVQQGGVAQKASKAVRRAALKYEHLPEAAVADAVFGVQGREKEKAIEALQRLAKLDT
         180       190       200       210       220       230

                 250       260       270       280       290       300
m951.pep  EILPPTLMTLRLTARKYPEILDGFFEQTDTQNLSAVWQEMEIMNLVSLHRLDDAYARLNV
          |||||||||||||||||||||||||||||||||||||||||||||||| :: |||||||||
g951      EILPPTLMTLRLTARKYPEILDGFFEQTDTQNLSAVWQEMEIMNLVSLRKPDDAYARLNV
         240       250       260       270       280       290

                 310       320       330       340       350       360
m951.pep  LLERNPNADLYIQAAILAANRKEGASVIDGYAEKAYGRGTEEQRSRAALTAAMMYADRRD
          |||:||||:||||||||||||||||||||||||||||||| |||:|||:||||:||||||
g951      LLEHNPNANLYIQAAILAANRKEGASVIDGYAEKAYGRGTGEQRGRAAMTAAMIYADRRD
         300       310       320       330       340       350

                 370       380       390       400       410       420
m951.pep  YAKVRQWLKKVSAPEYLFDKGVLAAAAAVELDGGRAALRQIGRVRKLPEQQGRYFTADNL
          ||||||||||||||||||||||||||||:|||||||||||||||||||||||||||||||
g951      YAKVRQWLKKVSAPEYLFDKGVLAAAAAAELDGGRAALRQIGRVRKLPEQQGRYFTADNL
         360       370       380       390       400       410

                 430       440       450       460       470       480
m951.pep  SKIQMLALSKLPDKREALRGLDKIIEKPPAGSNTELQAEALVQRSVVYDRLGKRKKMISD
          |||||||||||||||||| ||::|| |  |:::||  ||||:|||::|:::||| |||:|
g951      SKIQMLALSKLPDKREALRGLNNIIAKLSAAGSTEPLAEALAQRSIIYEQFGKRGKMIAD
         420       430       440       450       460       470

                 490       500       510       520       530       540
m951.pep  LERAFRLAPDNAQIMNNLGYSLLTDSKRLDEGFALLQTAYQINPDDTAVNDSIGWAYYLK
          || |::|:|||||||||||||||:||||||||||||||||||||||||||||||||||||
g951      LETALKLTPDNAQIMNNLGYSLLSDSKRLDEGFALLQTAYQINPDDTAVNDSIGWAYYLK
         480       490       500       510       520       530
```

-continued

```
                550        560        570        580        590        600
m951.pep  GDAESALPYLRYSFENDPEPEVAAHLGEVLWALGERDQAVDVWTQAAHLTGDKKIWRETL
          |||||||||||||||||||||||||||||||||||||||||||||||| |||||||||||
g951      GDAESALPYLRYSFENDPEPEVAAHLGEVLWALGERDQAVDVWTQAAHLRGDKKIWRETL
        540        550        560        570        580        590

                610
m951.pep  KRHGIALPQPSRKPRK
          ||:|||||:|||||||
g951      KRYGIALPEPSRKPRKX
        600        610
```

The following partial DNA sequence was identified in *N. meningitidis* <SEQ ID 2907>:

a951.seq

```
   1 ATGTTACCCG CCCGTTTCAC CATTTTATCT GTGCTCGCGG CAGCCCTGCT
  51 TGCCGGGCAG GCGTATGCCG CCGGCGCGGC GGATGCGAAG CCGCCGAAGG
 101 AAGTCGGAAA GGTTTTCAGA AAGCAGCAGC GTTACAGCGA GGAAGAAATC
 151 AAAAACGAAC GCGCACGGCT TGCGGCAGTG GGCGAGCGGG TTAATCAGAT
 201 ATTTACGTTG CTGGGAGGGG AAACCGCCTT GCAAAAGGGG CAGGCGGGAA
 251 CGGCTCTGGC AACCTATATG CTGATGTTGG AACGCACAAA ATCCCCCGAA
 301 GTCGCCGAAC GCGCCTTGGA AATGGCCGTG TCGCTGAACG CGTTTGAACA
 351 GGCGGAAATG ATTTATCAGA AATGGCGGCA GATTGAGCCT ATACCGGGTA
 401 AGGCGCAAAA ACGGGCGGGG TGGCTGCGGA ACGTGCTGAG GGAAAGAGGA
 451 AATCAGCATC TAGACGGACT GGAAGAAGTG CTGGCTCAGG CGGACGAAGG
 501 ACAGAACCGC AGGGTGTTTT TATTGTTGGC ACAAGCCGCC GTGCAACAGG
 551 ACGGGTTGGC GCAAAAAGCA TCGAAAGCGG TTCGCCGCGC GGCGTTGAGA
 601 TATGAACATC TGCCCGAAGC GGCGGTTGCC GATGTGGTGT TCAGCGTACA
 651 GGGACGCGAA AAGGAAAAGG CAATCGGAGC TTTGCAGCGT TTGGCGAAGC
 701 TCGATACGGA AATATTGCCC CCCACTTTAA TGACGTTGCG TCTGACTGCA
 751 CGCAAATATC CCGAAATACT CGACGGCTTT TTCGAGCAGA CAGACACCCA
 801 AAACCTTTCG GCCGTCTGGC AGGAAATGGA AATTATGAAT CTGGTTTCCC
 851 TGCACAGGCT GGATGATGCC TATGCGCGTT TGAACGTGCT GTTGGAACGC
 901 AATCCGAATG CAGACCTGTA TATTCAGGCA GCGATATTGG CGGCAAACCG
 951 AAAAGAAGGT GCTTCCGTTA TCGACGGCTA CGCCGAAAAG GCATACGGCA
1001 GGGGGACGGG GGAACAGCGG GGCAGGGCGG CAATGACGGC GGCGATGATA
1051 TATGCCGACC GAAGGGATTA CACCAAAGTC AGGCAGTGGT TGAAAAAAGT
1101 GTCCGCGCCG GAATACCTGT TCGACAAAGG TGTGCTGGCG GCTGCGGCGG
1151 CTGTCGAGTT GGACGGCGGC AGGGCGGCTT TGCGGCAGAT CGGCAGGGTG
1201 CGGAAACTTC CCGAACAGCA GGGGCGGTAT TTTACGGCAG ACAATTTGTC
1251 CAAAATACAG ATGTTCGCCC TGTCGAAGCT GCCCGACAAA CGGGAGGCTT
1301 TGAGGGGGTT GGACAAGATT ATCGAAAAAC CGCCTGCCGG CAGTAATACA
1351 GAGTTACAGG CAGAGGCATT GGTACAGCGG TCAGTTGTTT ACGATCGGCT
1401 TGGCAAGCGG AAAAAAATGA TTTCAGATCT TGAAAGGGCG TTCAGGCTTG
1451 CACCCGATAA CGCTCAGATT ATGAATAATC TGGGCTACAG CCTGCTTTCC
```

-continued

```
1501 GATTCCAAAC GTTTGGACGA AGGCTTCGCC CTGCTTCAGA CGGCATACCA

1551 AATCAACCCG GACGATACCG CTGTCAACGA CAGCATAGGC TGGGCGTATT

1601 ACCTGAAAGG CGACGCGGAA AGCGCGCTGC CGTATCTGCG GTATTCGTTT

1651 GAAAACGACC CCGAGCCCGA AGTTGCCGCC CATTTGGGCG AAGTGTTGTG

1701 GGCATTGGGC GAACGCGATC AGGCGGTTGA CGTATGGACG CAGGCGGCAC

1751 ACCTTACGGG AGACAAGAAA ATATGGCGGG AAACGCTCAA ACGTCACGGC

1801 ATCGCATTGC CCCAACCTTC CCGAAAACCT CGGAAATAA
```

This corresponds to the amino acid sequence <SEQ ID 2908; ORF 951.a>:

```
a951.pep

  1 MLPARFTILS VLAAALLAGQ AYAAGAADAK PPKEVGKVFR KQQRYSEEEI

 51 KNERARLAAV GERVNQIFTL LGGETALQKG QAGTALATYM LMLERTKSPE

101 VAERALEMAV SLNAFEQAEM IYQKWRQIEP IPGKAQKRAG WLRNVLRERG

151 NQHLDGLEEV LAQADEGQNR RVFLLLAQAA VQQDGLAQKA SKAVRRAALR

201 YEHLPEAAVA DVVFSVQGRE KEKAIGALQR LAKLDTEILP PTLMTLRLTA

251 RKYPEILDGF FEQTDTQNLS AVWQEMEIMN LVSLHRLDDA YARLNVLLER

301 NPNADLYIQA AILAANRKEG ASVIDGYAEK AYGRGTGEQR GRAAMTAAMI

351 YADRRDYTKV RQWLKKVSAP EYLFDKGVLA AAAAVELDGG RAALRQIGRV

401 RKLPEQQGRY FTADNLSKIQ MFALSKLPDK REALRGLDKI IEKPPAGSNT

451 ELQAEALVQR SVVYDRLGKR KKMISDLERA FRLAPDNAQI MNNLGYSLLS

501 DSKRLDEGFA LLQTAYQINP DDTAVNDSIG WAYYLKGDAE SALPYLRYSF

551 ENDPEPEVAA HLGEVLWALG ERDQAVDVWT QAAHLTGDKK IWRETLKRHG

600 IALPQPSRKP RK*
```

Computer analysis of this amino acid sequence gave the following results:

Homology with a predicted ORF from *N. meningitidis*

ORF 951 shows 96.4% identity over a 614 aa overlap with a predicted ORF (ORF 951) from *N. meningitidis* a951/m951 96.4% identity in 614 aa overlap

```
                    10        20          30        40        50
a951.pep    MLPARFTILSVLAAALLAGQAYAAG--AADAKPPKEVGKVFRKQQRYSEEEIKNERAR
              ||| || :|:||:|:|:|||: |||  |:| | |||||||||||||||||||||||||
m951      MIMLPNRFKMLTVLTATLIAGQVSAAGGGAGDMKQPKEVGKVFRKQQRYSEEEIKNERAR
                  10        20        30        40        50        60

            60        70        80        90       100       110
a951.pep  LAAVGERVNQIFTLLGGETALQKGQAGTALATYMLMLERTKSPEVAERALEMAVSLNAFE
          ||||||||||||||||||||||||||||||||||||||||||||||||||||||||||||
m951      LAAVGERVNQIFTLLGGETALQKGQAGTALATYMLMLERTKSPEVAERALEMAVSLNAFE
                  70        80        90       100       110       120

           120       130       140       150       160       170
a951.pep  QAEMIYQKWRQIEPIPGKAQKRAGWLRNVLRERGNQHLDGLEEVLAQADEGQNRRVFLLL
          ||||||||||||||||||||||||||||||||||||||||||||||||||||||||||||
m951      QAEMIYQKWRQIEPIPGKAQKRAGWLRNVLRERGNQHLDGLEEVLAQADEGQNRRVFLLL
                 130       140       150       160       170       180
```

-continued

```
             180       190       200       210       220       230
a951.pep    AQAAVQQDGLAQKASKAVRRAALRYEHLPEAAVADVVFSVQGREKEKAIGALQRLAKLDT
            |||||||||||||||||||||||:||||||||||||||||||||||||||||||||||||
m951        AQAAVQQDGLAQKASKAVRRAALKYEHLPEAAVADVVFSVQGREKEKAIGALQRLAKLDT
                   190       200       210       220       230       240

             240       250       260       270       280       290
a951.pep    EILPPTLMTLRLTARKYPEILDGFFEQTDTQNLSAVWQEMEIMNLVSLHRLDDAYARLNV
            ||||||||||||||||||||||||||||||||||||||||||||||||||||||||||||
m951        EILPPTLMTLRLTARKYPEILDGFFEQTDTQNLSAVWQEMEIMNLVSLHRLDDAYARLNV
                   250       260       270       280       290       300

             300       310       320       330       340       350
a951.pep    LLERNPNADLYIQAAILAANRKEGASVIDGYAEKAYGRGTGEQRGRAAMTAAMIYADRRD
            |||||||||||||||||||||||||||||||||||||||| |||:|||:||||:||||||
m951        LLERNPNADLYIQAAILAANRKEGASVIDGYAEKAYGRGTEEQRSRAALTAAMMYADRRD
                   310       320       330       340       350       360

             360       370       380       390       400       410
a951.pep    YTKVRQWLKKVSAPEYLFDKGVLAAAAAVELDGGRAALRQIGRVRKLPEQQGRYFTADNL
            |:||||||||||||||||||||||||||||||||||||||||||||||||||||||||||
m951        YAKVRQWLKKVSAPEYLFDKGVLAAAAAVELDGGRAALRQIGRVRKLPEQQGRYFTADNL
                   370       380       390       400       410       420

             420       430       440       450       460       470
a951.pep    SKIQMFALSKLPDKREALRGLDKIIEKPPAGSNTELQAEALVQRSVVYDRLGKRKKMISD
            |||||:||||||||||||||||||||||||||||||||||||||||||||||||||||||
m951        SKIQMLALSKLPDKREALRGLDKIIEKPPAGSNTELQAEALVQRSVVYDRLGKRKKMISD
                   430       440       450       460       470       480

             480       490       500       510       520       530
a951.pep    LERAFRLAPDNAQIMNNLGYSLLSDSKRLDEGFALLQTAYQINPDDTAVNDSIGWAYYLK
            |||||||||||||||||||||||:||||||||||||||||||||||||||||||||||||
m951        LERAFRLAPDNAQIMNNLGYSLLTDSKRLDEGFALLQTAYQINPDDTAVNDSIGWAYYLK
                   490       500       510       520       530       540

             540       550       560       570       580       590
a951.pep    GDAESALPYLRYSFENDPEPEVAAHLGEVLWALGERDQAVDVWTQAAHLTGDKKIWRETL
            ||||||||||||||||||||||||||||||||||||||||||||||||||||||||||||
m951        GDAESALPYLRYSFENDPEPEVAAHLGEVLWALGERDQAVDVWTQAAHLTGDKKIWRETL
                   550       560       570       580       590       600

             600       610
a951.pep    KRHGIALPQPSRKPRK
            ||||||||||||||||
m951        KRHGIALPQPSRKPRK
                   610
```

The following partial DNA sequence was identified in *N. gonorrhoeae* <SEQ ID 2909>:

g952.seq (partial)

```
  1 ..TTGTCTTATC GTTTGAATGC TGCACCGATG TTTAACGATA ATCCTGTTGT
 51   TTACGGAAAA ATCAAATTGC AGAGTTGGAA AGCGCGGCGG GATTTCAATA
101   TTGTAAAGCA GGATTTGGAT TTTTCCTGCG GGGCGGCTTC GGTGGCGACG
151   CTTTTGAACA ATTTTTACGG GCAAAAGCTG ACGGAAGAAG AAGTGTTGGA
201   AAAACTGGGT AAGGAACAGA TGCGCGCGTC GTTTGAGGAT ATGCGGCGCA
251   TTATGCCCGA TTTGGGTTTT GAGGCGAAAG GCTATGCCCT GTCTTTCGAA
301   CAGCTCGCGC AGTTGAAAAT CCCCGTCATC GTGTATCTGA AATACCGCAA
351   AGACGACCAT TTTTCGGTAT TGCGCGGAGT GGATGGCAAT ACGGTTTTGC
401   TTGCCGACCC GTCGCCGGGT CATGTTTCGA TGAGCAGGGC GCAGTTTTTG
451   GAGGCTTGGC AAACCCGTGA GGGAAATTTG GCAGGCAAAA TTTTGGCGGT
501   CGTGCCGAAA AAAGCGGAGG CGATTTCAAA TAAATTGTTT TTCACACATC
551   ATCCCAAGCG GCAGACGGAG TTTGCAGTCG GACAGGTAAA ATGGTGGCGT
601   GCTTATTGA
```

This corresponds to the amino acid sequence <SEQ ID 2910; ORF 952.ng>:

g952.pep (partial)

```
  1 ..LSYRLNAAPM FNDNPVVYGK IKLQSWKARR DFNIVKQDLD FSCGAASVAT
 51   LLNNFYGQKL TEEEVLEKLG KEQMRASFED MRRIMPDLGF EAKGYALSFE
101   QLAQLKIPVI VYLKYRKDDH FSVLRGVDGN TVLLADPSPG HVSMSRAQFL
151   EAWQTREGNL AGKILAVVPK KAEAISNKLF FTHHPKRQTE FAVGQVKWWR
201   AY*
```

The following partial DNA sequence was identified in *N. meningitidis* <SEQ ID 2911>:

m952.seq

```
  1 ATGATGAAGT TCAAATATGT TTTTCTGTTG GCGTGTGTTG TCGTTTCTTT
 51 ATCTTATCGT TTGAATGCTG CACCGATGTT TAACGATAAT CCTGTTGTTT
101 ACGGAAAAAT CAAAGTGCAG AGTTGGAAAG CGCGGCGGGA TTTCAATATT
151 GTAAAGCAGG ATTTGGATTT TTCCTGTGGG GCGGCTTCGG TGGCGACGCT
201 TTTGAACAAT TTTTACGGGC AAACGCTGAC GGAAGAAGAA GTGTTGAAAA
251 AGCTGGATAA GGAGCAGATG CGCGCGTCGT TTGAGGATAT GCGGCGCATT
301 ATGCCTGATT TGGGTTTTGA GGCGAAGGGC TATGCCCTGT CTTTCGAGCA
351 GCTCGCGCAG TTGAAAATCC CCGTCATCGT GTATCTGAAA TACCGCAAAG
401 ACGACCATTT TTCGGTATTG CGCGGTATAG ACGGCAATAC GGTTTTGCTT
451 GCCGACCCGT CGCTGGGGCA TGTTTCAATG AGCAGGGCGC AGTTTTTGGA
501 TGCTTGGCAA ACCCGTGAGG GAAATTTGGC AGGTAAGATT TTGGCTGTCA
551 TACCGAAAAA AGCCGAGACA ATTTCAAATA AATTGTTTTT CACACAACAC
601 CCAAAACGGC AGACGGAGTT TACAGTCGGA CAAATCAGGC AAGCACGTGC
651 AGAGTAA
```

This corresponds to the amino acid sequence <SEQ ID 2912; ORF 952>:

m952.pep

```
  1 MMKFKYVFLL ACVVVSLSYR LNAAPMFNDN PVVYGKIKVQ SWKARRDFNI
 51 VKQDLDFSCG AASVATLLNN FYGQTLTEEE VLKKLDKEQM RASFEDMRRI
101 MPDLGFEAKG YALSFEQLAQ LKIPVIVYLK YRKDDHFSVL RGIDGNTVLL
151 ADPSLGHVSM SRAQFLDAWQ TREGNLAGKI LAVIPKKAET ISNKLFFTQH
201 PKRQTEFTVG QIRQARAE*
```

Computer analysis of this amino acid sequence gave the following results:

Homology with a predicted ORF from *N. gonorrhoeae*

ORF 952 shows 92.5% identity over a 201 aa overlap with a predicted ORF (ORF 952) from *N. gonorrhoeae* g952/m952; 92.5% identity in 201 aa overlap

```
                          10         20         30         40
g952.pep                  LSYRLNAAPMFNDNPVVYGKIKLQSWKARRDFNIVKQDLDFSCG
                          |||||||||||||||||||||:||||||||||||||||||||||
m952        MMKFKYVFLLACVVVSLSYRLNAAPMFNDNPVVYGKIKVQSWKARRDFNIVKQDLDFSCG
                    10        20        30        40        50        60

                50        60        70        80        90       100
g952.pep    AASVATLLNNFYGQKLTEEEVLEKLGKEQMRASFEDMRRIMPDLGFEAKGYALSFEQLAQ
            ||||||||||||| |||||||:|| |||||||||||||||||||||||||||||||||||
m952        AASVATLLNNFYGQTLTEEEVLKKLDKEQMRASFEDMRRIMPDLGFEAKGYALSFEQLAQ
                    70        80        90       100       110       120

               110       120       130       140       150       160
g952.pep    LKIPVIVYLKYRKDDHFSVLRGVDGNTVLLADPSPGHVSMSRAQFLEAWQTREGNLAGKI
            |||||||||||||||||||||:||||||||||| |||||||||||:||||||||||||||
m952        LKIPVIVYLKYRKDDHFSVLRGIDGNTVLLADPSLGHVSMSRAQFLDAWQTREGNLAGKI
                   130       140       150       160       170       180

               170       180       190       200
g952.pep    LAVVPKKAEAISNKLFFTHHPKRQTEFAVGQVKWWRAYX
            |||:|||||:||||||||:||||||||:|||::  ||
m952        LAVIPKKAETISNKLFFTQHPKRQTEFTVGQIRQARAE
                   190       200       210
```

The following partial DNA sequence was identified in *N. meningitidis* <SEQ ID 2913>:

a952.seq

```
  1 ATGATGAAGT TCAAATATGT TTTTCTGTTG GCGTGTGTTG TCGTTTCTTT
 51 ATCTTATCGT TTGAATGCTG CACCGATGTT TAACGATAAT CCTGTTGTTT
101 ACGGAAAAAT CAAAGTGCAG AGTTGGAAAG AAAGGCGGGA TTTCAATATT
151 GTAAAGCAGG ATTTGGATTT TTCCTGCGGG GCGGCTTCGG TGGCGACGCT
201 TTTGAACAAT TTTTACGGGC AAACGCTGAC GGAAGAAGAA GTGTTGAAAA
251 AGCTGGATAA GGAGCAGATG CGCGCGTCGT TTGAGGATAT GCGGCGCATT
301 ATGCCAGATT TGGGTTTTGA AGCGAAAGGC TATGCCCTGT CTTTCGAGCA
351 GCTCGCACAG TTGAAAATCC CCGTCATCGT GTATCTGAAA TACCGCAAGG
401 ATGATCATTT CTCGGTATTG CGCGGGATAG ACGGCAATAC GGTTTTGCTT
451 GCCGACCCGT CGCTGGGTCA TGTTTCAATG AGCAGGGCGC AGTTTTNGGA
501 TGCTTGGCAA ACCCGTGAGG GAAATTTGGC AGGTAAGATT TTGGCGGTCG
551 TGCCGAAAAA AGCCGAGACA ATTTCAAATA AATTGTTTTT CACACATCAT
601 CCCAAGCGGC AGACGGAGTT TGCAGTCGGA CAAATCAGGC AAGCACGTGC
651 AGAGTAA
```

This corresponds to the amino acid sequence <SEQ ID 2914; ORF 952.a>:

a952.pep

```
  1 MMKFKYVFLL ACVVVSLSYR LNAAPMFNDN PVVYGKIKVQ SWKERRDFNI
 51 VKQDLDFSCG AASVATLLNN FYGQTLTEEE VLKKLDKEQM RASFEDMRRI
101 MPDLGFEAKG YALSFEQLAQ LKIPVIVYLK YRKDDHFSVL RGIDGNTVLL
151 ADPSLGHVSM SRAQFXDAWQ TREGNLAGKI LAVVPKKAET ISNKLFFTHH
201 PKRQTEFAVG QIRQARAE*
```

Computer analysis of this amino acid sequence gave the following results:

Homology with a predicted ORF from *N. meningitidis*

ORF 952 shows 97.7% identity over a 218 aa overlap with a predicted ORF (ORF 952) from *N. meningitidis* a952/m952 97.7% identity in 218 aa overlap

```
                10        20        30        40        50        60
a952.pep  MMKFKYVFLLACVVVSLSYRLNAAPMFNDNPVVYGKIKVQSWKERRDFNIVKQDLDFSCG
          |||||||||||||||||||||||||||||||||||||||||||| ||||||||||||||||
m952      MMKFKYVFLLACVVVSLSYRLNAAPMFNDNPVVYGKIKVQSWKARRDFNIVKQDLDFSCG
                10        20        30        40        50        60

                70        80        90       100       110       120
a952.pep  AASVATLLNNFYGQTLTEEEVLKKLDKEQMRASFEDMRRIMPDLGFEAKGYALSFEQLAQ
          ||||||||||||||||||||||||||||||||||||||||||||||||||||||||||||
m952      AASVATLLNNFYGQTLTEEEVLKKLDKEQMRASFEDMRRIMPDLGFEAKGYALSFEQLAQ
                70        80        90       100       110       120

               130       140       150       160       170       180
a952.pep  LKIPVIVYLKYRKDDHFSVLRGIDGNTVLLADPSLGHVSMSRAQFXDAWQTREGNLAGKI
          ||||||||||||||||||||||||||||||||||||||||||||| ||||||||||||||
m952      LKIPVIVYLKYRKDDHFSVLRGIDGNTVLLADPSLGHVSMSRAQFLDAWQTREGNLAGKI
               130       140       150       160       170       180

               190       200       210      219
a952.pep  LAVVPKKAETISNKLFFTHHPKRQTEFAVGQIRQARAEX
          |||:|||||||||||||:||||||||:||||||||||
m952      LAVIPKKAETISNKLFFTQHPKRQTEFTVGQIRQARAE
               190       200       210
```

The following partial DNA sequence was identified in *N. gonorrhoeae* <SEQ ID 2915>:

<u>g953.seq</u>

```
  1 ATGAAAAAAA TCATCTTCGC CGCGCTCGCA GCGGCAGCCG TCGGCACTGC
 51 CTCCGCCACC TACAAAGTGG ACGAATATCA CGCCAACGTC CGTTTCGCCA
101 TCGACCACTT CAACACCAGC ACCAACGTCG GCGGTTTTTA CGGTCTGACC
151 GGTTCCGTCG AGTTCGATCA AGCAAAACGC GACGGCAAAA TCGACATCAC
201 CATTCCCGTC GCCAACCTGC AAAGCGGTTC GCAACCCTTC ACCGGCCACC
251 TGAAATCCGC CGACATCTTC GATGCCGCTC AATATCCGGA CATCCGCTTC
301 GTTTCCACCA AATTCAACTT CAACGGCAAA AAACTTGTTT CCGTTGACGG
351 CAACCTGACC ATGCGCGGCA AAACCGCCCC CGTCAAACTC AAAGCCGAAA
401 AATTCAACTG CTACCAAAGC CCGATGGCGG AAACCGAAGT TTGCGGCGGC
451 GACTTCAGCA CCACCATCGA CCGCACCAAA TGGGGCGTGG ACTACCTCGT
501 TAACGCCGGT ATGACCAAAA ACGTCCGCAT CGACATCCAA ATCGAAGCTG
551 CAAAACAATA A
```

This corresponds to the amino acid sequence <SEQ ID 2916; ORF 953.ng>:

<u>g953.pep</u>

```
  1 MKKIIFAALA AAAVGTASAT YKVDEYHANV RFAIDHFNTS TNVGGFYGLT
 51 GSVEFDQAKR DGKIDITIPV ANLQSGSQPF TGHLKSADIF DAAQYPDIRF
101 VSTKFNFNGK KLVSVDGNLT MRGKTAPVKL KAEKFNCYQS PMAETEVCGG
151 DFSTTIDRTK WGVDYLVNAG MTKNVRIDIQ IEAAKQ*
```

The following partial DNA sequence was identified in *N. meningitidis* <SEQ ID 2917>:

```
m953.seq

  1 ATGAAAAAAA TCATCTTCGC CGCACTCGCA GCCGCCGCCA TCAGTACTGC
 51 CTCCGCCGCC ACCTACAAAG TGGACGAATA TCACGCCAAC GCCCGTTTCG
101 CCATCGACCA TTTCAACACC AGCACCAACG TCGGCGGTTT TTACGGTCTG
151 ACCGGTTCCG TCGAGTTCGA CCAAGCAAAA CGCGACGGTA AAATCGACAT
201 CACCATCCCC ATTGCCAACC TGCAAAGCGG TTCGCAACAC TTTACCGACC
251 ACCTGAAATC AGCCGACATC TTCGATGCCG CCCAATATCC GGACATCCGC
301 TTTGTTTCCA CCAAATTCAA CTTCAACGGC AAAAAACTGG TTTCCGTTGA
351 CGGCAACCTG ACCATGCACG GCAAAACCGC CCCCGTCAAA CTCAAAGCCG
401 AAAAATTCAA CTGCTACCAA AGCCCGATGG AGAAAACCGA AGTTTGTGGC
451 GGCGACTTCA GCACCACCAT CGACCGCACC AAATGGGGCA TGGACTACCT
501 CGTTAACGTT GGTATGACCA AAAGCGTCCG CATCGACATC CAAATCGAGG
551 CAGCCAAACA ATAA
```

This corresponds to the amino acid sequence <SEQ ID 2918; ORF 953>:

```
m953.pep

  1 MKKIIFAALA AAAISTASAA TYKVDEYHAN ARFAIDHFNT STNVGGFYGL
 51 TGSVEFDQAK RDGKIDITIP IANLQSGSQH FTDHLKSADI FDAAQYPDIR
101 FVSTKFNFNG KKLVSVDGNL TMHGKTAPVK LKAEKFNCYQ SPMEKTEVCG
151 GDFSTTIDRT KWGMDYLVNV GMTKSVRIDI QIEAAKQ*
```

Computer analysis of this amino acid sequence gave the following results:

Homology with a predicted ORF from *N. gonorrhoeae*

ORF 953 shows 93.0% identity over a 187 aa overlap with a predicted ORF (ORF 953) from *N. gonorrhoeae* m953/g953 93.0% identity in 187 aa overlap

```
                   10        20        30        40        50        60
m953.pep   MKKIIFAALAAAAISTASAATYKVDEYHANARFAIDHFNTSTNVGGFYGLTGSVEFDQAK
           |||||||||||||::|||| ||||||||||:|||||||||||||||||||||||||||||
g953       MKKIIFAALAAAAVGTASA-TYKVDEYHANVRFAIDHFNTSTNVGGFYGLTGSVEFDQAK
                   10         20        30        40        50

                   70        80        90       100       110       120
m953.pep   RDGKIDITIPIANLQSGSQHFTDHLKSADIFDAAQYPDIRFVSTKFNFNGKKLVSVDGNL
           ||||||||||:|||||||| || |||||||||||||||||||||||||||||||||||||
g953       RDGKIDITIPVANLQSGSQPFTGHLKSADIFDAAQYPDIRFVSTKFNFNGKKLVSVDGNL
         60        70        80        90       100       110

                  130       140       150       160       170       180
m953.pep   TMHGKTAPVKLKAEKFNCYQSPMEKTEVCGGDFSTTIDRTKWGMDYLVNVGMTKSVRIDI
           ||:|||||||||||||||||||| :||||||||||||||||||:|||||:||||:|||||
g953       TMRGKTAPVKLKAEKFNCYQSPMAETEVCGGDFSTTIDRTKWGVDYLVNAGMTKNVRIDI
        120       130       140       150       160       170

m953.pep   QIEAAKQX
           ||||||||
g953       QIEAAKQX
        180
```

The following partial DNA sequence was identified in *N. meningitidis* <SEQ ID 2919>:

a953.seq

```
  1 ATGAAAAAAA TCATCATCGC CGCGCTCGCA GCAGCCGCCA TCGGCACTGC
 51 CTCCGCCGCC ACCTACAAAG TGGACGAATA TCACGCCAAC GCCCGTTTCT
101 CTATCGACCA TTTCAACACC AGCACCAACG TCGGCGGTTT TTACGGTCTG
151 ACCGGTTCCG TTGAGTTCGA CCAAGCAAAA CGCGACGGTA AAATCGACAT
201 CACCATCCCC GTTGCCAACC TGCAAAGCGG TTCGCAACAC TTTACCGACC
251 ACCTGAAATC AGCCGACATC TTCGATGCCG CCCAATATCC GGACATCCGC
301 TTTGTTTCCA CCAAATTCAA CTTCAACGGC AAAAAACTGG TTTCCGTTGA
351 CGGCAACCTG ACCATGCACG GCAAAACCGC CCCCGTCAAA CTCAAAGCCG
401 AAAAATTCAA CTGCTACCAA AGCCCGATGT TGAAAACCGA AGTTTGCGGC
451 GGCGACTTCA GCACCACCAT CGACCGCACC AAATGGGGCA TGGACTACCT
501 CGTTAACGTT GGTATGACCA AAAGCGTCCG CATCGACATC CAAATCGAGG
551 CAGCCAAACA ATAA
```

This corresponds to the amino acid sequence <SEQ ID 2920; ORF 953.a>:

a953.pep

```
  1 MKKIIIAALA AAAIGTASAA TYKVDEYHAN ARFSIDHFNT STNVGGFYGL
 51 TGSVEFDQAK RDGKIDITIP VANLQSGSQH FTDHLKSADI FDAAQYPDIR
101 FVSTKFNFNG KKLVSVDGNL TMHGKTAPVK LKAEKFNCYQ SPMLKTEVCG
151 GDFSTTIDRT KWGMDYLVNV GMTKSVRIDI QIEAAKQ*
```

Computer analysis of this amino acid sequence gave the following results:

Homology with a predicted ORF from *N. meningitidis*

ORF 953 shows 97.3% identity over a 187 aa overlap with a predicted ORF (ORF 953) from *N. meningitidis* a953/m953 97.3% identity in 187 aa overlap

```
                   10        20        30        40        50        60
a953.pep   MKKIIIAALAAAAIGTASAATYKVDEYHANARFSIDHFNTSTNVGGFYGLTGSVEFDQAK
           |||||:||||||||:|||||||||||||||||||:|||||||||||||||||||||||||||
m953       MKKIIFAALAAAAISTASAATYKVDEYHANARFAIDHFNTSTNVGGFYGLTGSVEFDQAK
                   10        20        30        40        50        60

                   70        80        90       100       110       120
a953.pep   RDGKIDITIPVANLQSGSQHFTDHLKSADIFDAAQYPDIRFVSTKFNFNGKKLVSVDGNL
           ||||||||||:|||||||||||||||||||||||||||||||||||||||||||||||||
m953       RDGKIDITIPIANLQSGSQHFTDHLKSADIFDAAQYPDIRFVSTKFNFNGKKLVSVDGNL
                   70        80        90       100       110       120

                  130       140       150       160       170       180
a953.pep   TMHGKTAPVKLKAEKFNCYQSPMLKTEVCGGDFSTTIDRTKWGMDYLVNVGMTKSVRIDI
           |||||||||||||||||||||| |||||||||||||||||||||||||||||||||||||
m953       TMHGKTAPVKLKAEKFNCYQSPMEKTEVCGGDFSTTIDRTKWGMDYLVNVGMTKSVRIDI
                  130       140       150       160       170       180

a953.pep   QIEAAKQX
           ||||||||
m953       QIEAAKQX
```

g954.seq not found yet g954.pep not found yet

The following partial DNA sequence was identified in *N. meningitidis* <SEQ ID 2921>:

m954.seq

```
  1 ATGAAAAAGT TTTATTTTGT GCTGCTGGCG TTGGGTTTGG CAGCGTGTGG
 51 GCAAGAACAA TCGCAGAAAG CTGATGCGGA GCAGTATTTT TTTGCCAATA
101 AATATCAATT TGCAGATGAG AAACAGGCTT TTTATTTTGA ACGCGCCGCC
151 CGTTTCCGTG TATTGCAACA AGGCCTTGGC GGGGATTTTG AGAGGTTTTT
201 AAAAGGAGAA ATACCTAATC AAGAAAATCT TGCAAAGTAT CGTGAAAATA
251 TTACTCAAGC AGTCGCTTAT TATGCGGACA CGAATGGAGA TGATGACCCA
301 TACCGCGTCT GCAAACAGGC TGCGCAAGAT GCAGAAATCC TGATGAAGAG
351 TATGGTAACA AGCGGTGGAG GCGGTACAAC TGATTTAGAT AAGGAAAGTT
401 ATCAAAATTA CCGAAAATCA ATGCAAGAAT GCCGTAAAAC AATAACGGAA
451 GCTGAAGCCA ATTTGCCGAA AAAATAA
```

This corresponds to the amino acid sequence <SEQ ID 2922; ORF 954>:

m954.pep

```
  1 MKKFYFVLLA LGLAACGQEQ SQKADAEQYF FANKYQFADE KQAFYFERAA
 51 RFRVLQQGLG GDFERFLKGE IPNQENLAKY RENITQAVAY YADTNGDDDP
101 YRVCKQAAQD AEILMKSMVT SGGGGTTDLD KESYQNYRKS MQECRKTITE
151 AEANLPKK*
```

a954.seq not found yet a954.pep not found yet

The following partial DNA sequence was identified in *N. gonorrhoeae* <SEQ ID 2923>:

g957.seq (partial)

```
  1 ATGTTTAAAA AATTCAAACC GGTACTGTTG TCATTTTTTG CACTTGTATT
 51 TGCCTTTTGG CTGGGAACAG GTATTGCCTA TGAGATTAAT CCGCGTTGGT
101 TTTTGAGCGA TACGGCAACT GAAGTACCTG AAAATCCGAA TGCTTTTGTG
151 GCGAAACTTG CCCGCCTGTT CCGAAATGCC GACAGGGCGG TTGTCATCGT
201 GAAGGAATCG ATGAGGACGG AGGAAAGCCT TGCCGGAGCT GTGGATGACG
251 GTCCGTTGCA GTCGGAGAAG GATTATCTCG CGCTCGCTAT CCGGCTCAGT
301 CGTTTGAAAG AAAAGGCGAA ATGGTTTCAC GTAACGGAGC AGGAACATGG
351 GGAAGAGGTT TGGCTGGATT ACTATATCGG CGAGGGCGGT TTGGTTGCGG
401 TTTCGCTTTC GCAACGCTCG CCGGAAGCGT TTGTTAATGC CGAATATCTG
451 TATCGGAACG ATCGTCCGTT TTCTGTAAAT GTGTACGGCG GAACGGCTCA
501 CGGGGAAAAT TATGAAACGA CAGGAGAATA TCGGGTTGTT TGGCAACCGG
```

-continued

```
551 ACGGTTCGGT ATTTGATGCG GCGGGGCGCG GGAAAATCGG GGAAGATGTT

601 TATGAGCATT GCCTCGGGTG TTATCAGATG GCCCAGGTAT ATTTGGCGAA

651 ATACCGGGAT GTCGCGAATG ACGAGCAGAA GGTTTGGGAC TTCCGCGAAG

701 AGAGCAACCG GATTGCATCG GACTCGCGCG ATTATGTGTT TTATCAGAAT

751 ATGCGGGAAT TGATGCCCCG GGGGatgaaG gcgaacagtc ttgtggtcgg

801 ctatgatgcg gacggtCtgc CgcaAAAagt ctattggagt gtcgacaatg

851 gaaaaaaacc ccaaagtgtc gaatattatt tgaaaaacgg aaatcttttt

901 attgcccaat cttcgacggt aaccttgaaa acggatggcg taacggcgga

951 tatgcaaacc tatcatgcgc aacaaacgtt gtatttggat ggg...
```

This corresponds to the amino acid sequence <SEQ ID 2924; ORF 957.ng>:

g957.pep (partial)

```
  1 MFKKFKPVLL SFFALVFAFW LGTGIAYEIN PRWFLSDTAT EVPENPNAFV

 51 AKLARLFRNA DRAVVIVKES MRTEESLAGA VDDGPLQSEK DYLALAIRLS

101 RLKEKAKWFH VTEQEHGEEV WLDYYIGEGG LVAVSLSQRS PEAFVNAEYL

151 YRNDRPFSVN VYGGTAHGEN YETTGEYRVV WQPDGSVFDA AGRGKIGEDV

201 YEHCLGCYQM AQVYLAKYRD VANDEQKVWD FREESNRIAS DSRDYVFYQN

251 MRELMPRGMK ANSLVVGYDA DGLPQKVYWS VDNGKKPQSV EYYLKNGNLF

301 IAQSSTVTLK TDGVTADMQT YHAQQTLYLD G...
```

The following partial DNA sequence was identified in *N. meningitidis* <SEQ ID 2925>:

m957.seq

```
  1 ATGTTTAAAA AATTCAAACC GGTACTGTTG TCATTTTTTG CACTTGTATT

 51 TGCCTTTTGG CTGGGAACGG GTATTGCCTA TGAGATTAAT CCGCGTTGGT

101 TTTTGAGCGA TACGGCAACT GAAGTACCTA AAAATCCGAA TGCTTTTGTG

151 GCGAAACTTG CCCGCCTGTT CCGAAATGCC GACAGGGCGG TTGTCATCGT

201 GAAGGAATCG ATAAGGACGG AGGAAAATCT TGCCGGAACT GTGGATGACG

251 GTCCGTTGCA GTCGGAGAAG GATTATCTCG CGCTCGCTAT CCGGCTCAGT

301 CGTTTGAAAG AAAAGGCGAA ATGGTTTCAC GTAACGGAGC AGGAACATGG

351 GAAAGAGGTT TGGCTGGATT ACCATATCGG CGAGGGCGGT TTGGTTGCGG

401 TTTCGCTTTC GCAACGCTCG CCGGAAGCAT TTGTTAATGC CGAATATCTG

451 TATCGGAACG ATCGTCCGTT TTCTGTAAAT GTGTACGGCG GAACGGTTCA

501 CGGGGAAAAT TATGAAACGA CAGGAGAATA TCGGGTTGTT TGGCAACCAG

551 ACGGTTCGGT ATTTGATGCG GCGGGGCGCG GGAAAATCGG GGAAGATGTT

601 TATGAGCATT GCCTCGGGTG TTATCAGATG GCCCAGGTAT ATTTGGCGAA

651 ATACCGGGAT GTCGCGAATG ACGAGCAGAA GGTTTGGGAC TTCCGCAAAG

701 AGAGCAACCG AATTGCGTCG GACTCGCGCA ATTCTGTGTT TTATCAGAAT

751 ATGCGGGAAT TGATGCCCCG AGGGATGAAG GCGAACAGTC TTGTGGTCGG
```

-continued

```
 801 CTATGATGCG GACGGTCTGC CGCAAAAAGT CTATTGGAGT TTCGACAATG

 851 GAAAAAAACG CCAGAGTTTC GAATATTATT TGAAAAACGG AAATCTTTTT

 901 ATTGCACAAT CTTCGACGGT AGCATTGAAA GCGGATGGCG TAACGGCGGA

 951 TATGCAGACC TATCATGCGC AACAGACGTG GTATTTGGAT GGCGGGCGGA

1001 TTGTCCGCGA AGAGAAACAG GGAGACAGAC TGCCTGATTT TCCTTTGAAC

1051 TTGGAAAATT TGGAAAAAGA GGTGCGCCGT TATGCAGAGG CTGCGGCGAG

1101 ACGTTCGGGC GGCAGGCGCG ACCTTTCTCA CTGA
```

This corresponds to the amino acid sequence <SEQ ID 2926; ORF 957>:

```
m957.pep

  1 MFKKFKPVLL SFFALVFAFW LGTGIAYEIN PRWFLSDTAT EVPKNPNAFV

 51 AKLARLFRNA DRAVVIVKES IRTEENLAGT VDDGPLQSEK DYLALAIRLS

101 RLKEKAKWFH VTEQEHGKEV WLDYHIGEGG LVAVSLSQRS PEAFVNAEYL

151 YRNDRPFSVN VYGGTVHGEN YETTGEYRVV WQPDGSVFDA AGRGKIGEDV

201 YEHCLGCYQM AQVYLAKYRD VANDEQKVWD FRKESNRIAS DSRNSVFYQN

251 MRELMPRGMK ANSLVVGYDA DGLPQKVYWS FDNGKKRQSF EYYLKNGNLF

301 IAQSSTVALK ADGVTADMQT YHAQQTWYLD GGRIVREEKQ GDRLPDFPLN

351 LENLEKEVRR YAEAAARRSG GRRDLSH*
```

Computer analysis of this amino acid sequence gave the following results:

Homology with a predicted ORF from *N. gonorrhoeae*

ORF 957 shows 95.2% identity over a 331 aa overlap with a predicted ORF (ORF 957) from *N. gonorrhoeae* g957/m957 95.2% identity in 331 aa overlap

```
                    10        20        30        40        50        60
g957.pep    MFKKFKPVLLSFFALVFAFWLGTGIAYEINPRWFLSDTATEVPENPNAFVAKLARLFRNA
            |||||||||||||||||||||||||||||||||||||||||||:||||||||||||||||
m957        MFKKFKPVLLSFFALVFAFWLGTGIAYEINPRWFLSDTATEVPKNPNAFVAKLARLFRNA
                    10        20        30        40        50        60

                    70        80        90       100       110       120
g957.pep    DRAVVIVKESMRTEESLAGAVDDGPLQSEKDYLALAIRLSRLKEKAKWFHVTEQEHGEEV
            ||||||||||:||||:|||:|||||||||||||||||||||||||||||||||||||:||
m957        DRAVVIVKESIRTEENLAGTVDDGPLQSEKDYLALAIRLSRLKEKAKWFHVTEQEHGKEV
                    70        80        90       100       110       120

                   130       140       150       160       170       180
g957.pep    WLDYYIGEGGLVAVSLSQRSPEAFVNAEYLYRNDRPFSVNVYGGTAHGENTETTGEYRVV
            ||||:||||||||||||||||||||||||||||||||||||||||:||||||||||||||
m957        WLDYHIGEGGLVAVSLSQRSPEAFVNAEYLYRNDRPFSVNVYGGTVHGENTETTGEYRVV
                   130       140       150       160       170       180

                   190       200       210       220       230       240
g957.pep    WQPDGSVFDAAGRGKIGEDVYEHCLGCYQMAQVYLAKYRDVANDEQKVWDFREESNRIAS
            ||||||||||||||||||||||||||||||||||||||||||||||||||||:|||||||
m957        WQPDGSVFDAAGRGKIGEDVYEHCLGCYQMAQVYLAKYRDVANDEQKVWDFRKESNRIAS
                   190       200       210       220       230       240

                   250       260       270       280       290       300
g957.pep    DSRDYVFYQNMRELMPRGMKANSLVVGYDADGLPQKVYWSVDNGKKPQSVEYYLKNGNLF
            |||: ||||||||||||||||||||||||||||||||||| ||||| || ||||||||||
m957        DSRNSVFYQNMRELMPRGMKANSLVVGYDADGLPQKVYWSFDNGKKRQSFEYYLKNGNLF
                   250       260       270       280       290       300
```

-continued

```
                310       320       330
g957.pep  IAQSSTVTLKTDGVTADMQTYHAQQTLYLDG
          |||||||:||:||||||||||||||| ||||
m957      IAQSSTVALKADGVTADMQTYHAQQTWYLDGGRIVREEKQGDRLPDFPLNLENLEKEVRR
                310       320       330       340       350       360
m957      YAEAAARRSGGRRDLSHX
                370
```

The following partial DNA sequence was identified in *N. meningitidis* <SEQ ID 2927>:

a957.seq

```
   1 ATGTTTAAAA AATTCAAACC GGTACTGTTG TCATTTTTTG CACTTGTATT
  51 TGCCTTTTGG CTGGGAACGG GTATTGCCTA TGAGATTAAT CCGCGTTGGT
 101 TTTTGAGCGA TACGGCAACT GAAAATCCGA ATGCTTTTGT GGCGAAACTT
 151 GCCCGCCTGT TCCGAAATGC CGACAGGGCG GTTGTCATCG TGAAGGAATC
 201 GATGAGGACG GAGGAAAGTC TTGCCGGAGC TGTGGATGAC GGTCCGTTGC
 251 AGTCGGAGAA GGATTATCTT GCACTCGCTG TCCGGCTCAG TCGTTTGAAA
 301 GAAAAGGCGA AATGGTTTCA CGTAACGGAG CAGGAACATG GGGAAGAGGT
 351 TTGGCTGGAT TACTATATCG GCGAGGGCGG TTTGGTTGCG GTTTCGCTTT
 401 CGCAACGCTC GCCGGAAGCG TTTGTTAATG CCGAATATCT GTATCGGAAC
 451 GATCGTCCGT TTTCTGTAAA TGTGTACGGC GGAACGGTTC ACGGGGAAAA
 501 TTATGAAACG ACAGGAGAAT ATCGGGTTGT TTGGCAACCG GACGGTTCGG
 551 TATTTGATGC GTCGGGGCGC GGGAAAATCG GGGAAGATGT TTATGAGCAT
 601 TGCCTCGGGT GTTATCAGAT GGCCCAGGTA TATTTGGCGA AATATCGGGA
 651 TGTCGCGAAT GATGAGCAGA AGGTTTGGGA CTTCCGCGAA GAGAGTAACC
 701 GGATTGCGTC GGACTCGCGC GATTCTGTGT TTTATCAGAA TATGCGGGAA
 751 TTGATGCCCC GAGGGATGAA GGCAAACAGT CTTGTGGTCG GCTATGATGC
 801 GGACGGTCTG CCGCAGAAAG TCTATTGGAG TTTCGACAAT GGGAAAAAAC
 851 GCCAGAGTTT CGAATATTAT TTGAAAAACG GAAATCTTTT TATTGCACAA
 901 TCTTCGACGG TAGCATTGAA AGCGGATGGC GTAACGGCGG ATATGCAGAC
 951 CTATCATGCG CAACAGACGT GGTATTTAGA TGGCGGGCGG ATTGTCCGCG
1001 AAGAGAAACA GGGGGACAGA CTGCCTGATT TTCCTTTGAA CTTGGAAGAT
1051 TTGGAAAAAG AGGTGAGCCG TTATGCAGAG GCTGCGGCGA GACGTTCGGG
1101 CGGCAGGCGC GACCTTTCTC ACTGA
```

This corresponds to the amino acid sequence <SEQ ID 2928; ORF 957.a>:

a957.pep

```
  1 MFKKFKPVLL SFFALVFAFW LGTGIAYEIN PRWFLSDTAT ENPNAFVAKL
 51 ARLFRNADRA VVIVKESMRT EESLAGAVDD GPLQSEKDYL ALAVRLSRLK
101 EKAKWFHVTE QEHGEEVWLD YYIGEGGLVA VSLSQRSPEA FVNAEYLYRN
151 DRPFSVNVYG GTVHGENYET TGEYRVVWQP DGSVFDASGR GKIGEDVYEH
```

-continued

```
201 CLGCYQMAQV YLAKYRDVAN DEQKVWDFRE ESNRIASDSR DSVFYQNMRE

251 LMPRGMKANS LVVGYDADGL PQKVYWSFDN GKKRQSFEYY LKNGNLFIAQ

301 SSTVALKADG VTADMQTYHA QQTWYLDGGR IVREEKQGDR LPDFPLNLED

351 LEKEVSRYAE AAARRSGGRR DLSH*
```

Computer analysis of this amino acid sequence gave the following results:

Homology with a predicted ORF from *N. meningitidis*

ORF 957 shows 96.3% identity over a 377 aa overlap with a predicted ORF (ORF 957) from *N. meningitidis* a957/m957 96.3% identity in 377 aa overlap

```
                   10        20        30        40           50
a957.pep   MFKKFKPVLLSFFALVFAFWLGTGIAYEINPRWFLSDTATE---NPNAFVAKLARLFRNA
           |||||||||||||||||||||||||||||||||||||||||   ||||||||||||||||
m957       MFKKFKPVLLSFFALVFAFWLGTGIAYEINPRWFLSDTATEVPKNPNAFVAKLARLFRNA
                   10        20        30        40        50        60

            60        70        80        90       100       110
a957.pep   DRAVVIVKESMRTEESLAGAVDDGPLQSEKDYLALAVRLSRLKEKAKWFHVTEQEHGEEV
           ||||||||||:||||:|||:||||||||||||||||:||||||||||||||||||||:||
m957       DRAVVIVKESIRTEENLAGTVDDGPLQSEKDYLALAIRLSRLKEKAKWFHVTEQEHGKEV
                   70        80        90       100       110       120

           120       130       140       150       160       170
a957.pep   WLDYYIGEGGLVAVSLSQRSPEAFVNAEYLYRNDRPFSVNVYGGTVHGENYETTGEYRVV
           ||||:|||||||||||||||||||||||||||||||||||||||||||||||||||||||
m957       WLDYHIGEGGLVAVSLSQRSPEAFVNAEYLYRNDRPFSVNVYGGTVHGENYETTGEYRVV
                  130       140       150       160       170       180

           180       190       200       210       220       230
a957.pep   WQPDGSVFDASGRGKIGEDVYEHCLGCYQMAQVYLAKYRDVANDEQKVWDFREESNRIAS
           ||||||||||:|||||||||||||||||||||||||||||||||||||||||:|||||||
m957       WQPDGSVFDAAGRGKIGEDVYEHCLGCYQMAQVYLAKYRDVANDEQKVWDFRKESNRIAS
                  190       200       210       220       230       240

           240       250       260       270       280       290
a957.pep   DSRDSVFYQNMRELMPRGMKANSLVVGYDADGLPQKVYWSFDNGKKRQSFEYYLKNGNLF
           |||:||||||||||||||||||||||||||||||||||||||||||||||||||||||||
m957       DSRNSVFYQNMRELMPRGMKANSLVVGYDADGLPQKVYWSFDNGKKRQSFEYYLKNGNLF
                  250       260       270       280       290       300

           300       310       320       330       340       350
a957.pep   IAQSSTVALKADGVTADMQTYHAQQTWYLDGGRIVREEKQGDRLPDFPLNLEDLEKEVSR
           ||||||||||||||||||||||||||||||||||||||||||||||||||||:||||| |
m957       IAQSSTVALKADGVTADMQTYHAQQTWYLDGGRIVREEKQGDRLPDFPLNLENLEKEVRR
                  310       320       330       340       350       360

           360       370
a957.pep   YAEAAARRSGGRRDLSHX
           ||||||||||||||||||
m957       YAEAAARRSGGRRDLSHX
                  370
```

The following partial DNA sequence was identified in *N. gonorrhoeae* <SEQ ID 2929>:

g958.seq

```
  1 TTGGCTCGTT TATTTTCACT CAAACCACTG GTGCTGGCAT TGGGCTTCTG

 51 TTTCGGCACG CATTGCGCCG CCGATACCGT TGCGGCGGAA GAGGCGGACG

101 GGCGTGTCGC AGAAGGCGGT GCGCAGGGCG CGTCCGAATC CGCACAAGCT

151 TCCGATTTGA CCCTCGGTTC GACCTGCCTG TTTTGCAGTA ACGAAAGCGG

201 CAGCCCCGAG AGAACCGAAG CCGCCGTCCA AGGCAGCGGC GAAGCATCCG

251 TCCCCGAAGA CTATACGCGC ATTGTTGCCG ACAGGATGGA AGGACAGTCG

301 AAGGTTAAGG TGCGCGCGGA AGGAAGCGTT ATCATCGAAC GGGACGGCGC
```

-continued

```
351 AGTCCTCAAT ACCGATTGGG CGGATTACGA CCAGTCGGGC GACACCGTTA

401 CCGTAGGCGA CCGGTTCGCC CTCCAACAGG ACGGTACGCT GATTCGGGGC

451 GAAACCCTGA CCTACAATCT CGATCAGCAG ACCGGCGAAG CGCACAACGT

501 CCGTATGGAA ACCGAACAAG GCGGACGGCG GCTGCAAAGC GTCAGCCGCA

551 CCGCCGAAAT GTTGGGCGAA GGGCGTTACA AACTGACGGA AACCCAATTC

601 AACACCTGTT CCGCCGGAGA TGCCGGCTGG TATGTCAAGG CCGCCTCTGT

651 CGAAGCCGAT CGGGGAAAAG GCATAGGCGT TGCCAAACAC GCCGCCTTCG

701 TGTTCGGCGG CGTTCCCCTT TTCTATACGC CTTGGGCGGA CTTCCCGCTT

751 GACGGCAACC GCAAAAGCGG ACTGCTCGTC CCGTCCGTAT CTGCCGGTTC

801 GGACGGCGTT TCCCTTTCCG TCCCCTATTA TTTCAACCTT GCCCCCAACT

851 TCGATGCCAC TTTCGCCCCC GGCATTATCG GCGAACGCGG CGCGACGTTT

901 GACGGACAAA TCCGTTACCT GCGTCCCGAT TACAGCGGAC AGACCGACCT

951 GACCTGGTTG CCGCACGATA AGAAAAGCGG CAGGAACAAC CGCTATCAGG

1001 CAAAATGGCA GCACCGGCAC GACATTTCCG ACACGCTTCA GGCGGGTGTC

1051 GATTTCAACC AAGTCTCCGA CAGCGGCTAC TACCGCGACT TTTACGGCGG

1101 CGAAGAAATC GCCGGCAACG TCAACCTCAA CCGCCGCGTA TGGCTGGATT

1151 ATGGCGGCAG GGCGGCGGGA GGCAGCCTGA ATGCCGGCCT TTCGGTTCAG

1201 AAATACCAGA CGCTGGCAAA CCAAAGCGGC TACAAAGACG AACCTTACGC

1251 CATCATGCCC CGCCTTTCTG CCGATTGGCA TAAAAACGCA GGCAGGGCGC

1301 AAATCGGCGT GTCCGCACAA TTTACCCGCT TCAGCCACGA CGGCCGCCAA

1351 GACGGCAGCC GACTGGTCGT GTATCCCGGT ATCAAATGGG ATTTCAGCAA

1401 CAGCTGGGGC TACGTCCGCC CCAAACTCGG GCTGCACGCC ACTTATTACA

1451 GCCTCGACAG TTTCGGCGGC AAAGCATCCC GCAGCGTCGG GCGCGTTTTG

1501 CCCGTTGTCA ATATCGACGG CGGCACAACC TTCGAACGCA ATACGCGCCT

1551 GTTCGGCGGC GGAGTCGTGC AAACCATCGA GCCGCGCCTG TTCTACAACT

1601 ATATTCCTGC CAAATCTCAA AACGACCTGC CCAATTTCGA TTCGTCGGAA

1651 AGCAGCTTCG GCTACGGGCA GCTTTTCCGC GAAAACCTCT ATTACGGCAA

1701 CGACCGCATC AACGCCGCCA ACAGCCTTTC CACCGCCGTG CAGAGCCGTA

1751 TTTTGGACGG CGCGACGGGG GAGGAGCGTT TCCGCGCCGG TATCGGTCAG

1801 AAATTCTATT TCAAGGATGA TGCGGTGATG CTTGACGGCA GCGTCGGCAA

1851 AAATCCGCGC AGCCGTTCCG ACTGGGTGGC ATTCGCCTCC GGCGGCATAG

1901 GCGGGCGTTT CACCCTCGAC AGCAGCATCC ACTACAACCA AAACGACAAA

1951 CGCGCCGAAC ATTACGCCGT CGGCGCAGGC TACCGCCCCG CCCCCGGAAA

2001 AGTGTTGAAC GCCCGCTACA AATACGGGCG CAACGAAAAA ATCTACCTGC

2051 AGGCGGACGG TTCCTATTTT TACGACAAAC TCAGCCAGCT CGACCTGTCC

2101 GCACAATGGC CGCTGACGCG CAACCTGTCT GCCGTCGTCC GCTACAACTA

2151 CGGTTTTGAA GCCAAAAAAC CGATAGAAAT GCTTGCCGGT GCAGAATACA

2201 AAAGCAGTTG CGGCTGCTGG GGCGCGGGCG TGTACGCCCA ACGCTACGTT

2251 ACCGGCGAAA ACACCTACAA AAACGCCGTC TTTTTTTCAC TTCAGTTGAA

2301 AGACCTCAGC AGCGTCGGCA GAAACCCCGC AGGCAGGATG GATGTCGCCG
```

-continued

2351 TTCCCGGCTA CATCCCCGCC CACTCTCTTT CCGCCGGACG CAACAAACGG

2401 CCCTGA

This corresponds to the amino acid sequence <SEQ ID 2930; ORF 958.ng>:

g958.pep

1 LARLFSLKPL VLALGFCFGT HCAADTVAAE EADGRVAEGG AQGASESAQA

51 SDLTLGSTCL FCSNESGSPE RTEAAVQGSG EASVPEDYTR IVADRMEGQS

101 KVKVRAEGSV IIERDGAVLN TDWADYDQSG DTVTVGDRFA LQQDGTLIRG

151 ETLTYNLDQQ TGEAHNVRME TEQGGRRLQS VSRTAEMLGE GRYKLTETQF

201 NTCSAGDAGW YVKAASVEAD RGKGIGVAKH AAFVFGGVPL FYTPWADFPL

251 DGNRKSGLLV PSVSAGSDGV SLSVPYYFNL APNFDATFAP GIIGERGATF

301 DGQIRYLRPD YSGQTDLTWL PHDKKSGRNN RYQAKWQHRH DISDTLQAGV

351 DFNQVSDSGY YRDFYGGEEI AGNVNLNRRV WLDYGGRAAG GSLNAGLSVQ

401 KYQTLANQSG YKDEPYAIMP RLSADWHKNA GRAQIGVSAQ FTRFSHDGRQ

451 DGSRLVVYPG IKWDFSNSWG YVRPKLGLHA TYYSLDSFGG KASRSVGRVL

501 PVVNIDGGTT FERNTRLFGG GVVQTIEPRL FYNYIPAKSQ NDLPNFDSSE

551 SSFGYGQLFR ENLYYGNDRI NAANSLSTAV QSRILDGATG EERFRAGIGQ

601 KFYFKDDAVM LDGSVGKNPR SRSDWVAFAS GGIGGRFTLD SSIHYNQNDK

651 RAEHYAVGAG YRPAPGKVLN ARYKYGRNEK IYLQADGSYF YDKLSQLDLS

701 AQWPLTRNLS AVVRYNYGFE AKKPIEMLAG AEYKSSCGCW GAGVYAQRYV

751 TGENTYKNAV FFSLQLKDLS SVGRNPAGRM DVAVPGYIPA HSLSAGRNKR

801 P*

The following partial DNA sequence was identified in *N. meningitidis* <SEQ ID 2931>:

m958.seq

1 TTGGCTCGTT TATTTTCACT CAAACCACTG GTGCTGGCAT TGGGCCTCTG

51 CTTCGGCACG CATTGCGCCG CCGCCGATGC CGTTGCGGCG GAGGAAACGG

101 ACAATCCGAC CGCCGGAGAA AGCGTTCGGA GCGTGTCCGA ACCCATACAG

151 CCTACCAGCC TGAGCCTCGG TTCGACCTGC CTGTTTTGCA GTAACGAAAG

201 CGGCAGCCCC GAGAGAACCG AAGCCGCCGT CCAAGGCAGC GGCGAAGCAT

251 CCATCCCCGA AGACTATACG CGCATTGTTG CCGACAGGAT GGAAGGACAG

301 TCGCAGGTGC AGGTGCGTGC CGAAGGCAAC GTCGTCGTCG AACGCAACCG

351 GACGACCCTC AATACCGATT GGGCGGATTA CGACCAGTCG GGCGACACCG

401 TTACCGCAGG CGACCGGTTC GCCCTCCAAC AGGACGGTAC GCTGATTCGG

451 GGCGAAACCC TGACCTACAA TCTCGAGCAG CAGACCGGGG AAGCGCACAA

501 CGTCCGCATG GAAATCGAAC AAGGCGGACG GCGGCTGCAA AGCGTCAGCC

551 GCACCGCCGA AATGTTGGGC GAAGGGCATT ACAAACTGAC GGAAACCCAA

-continued

```
 601 TTCAACACCT GTTCCGCCGG CGATGCCGGC TGGTATGTCA AGGCAGCCTC
 651 TGTCGAAGCC GATCGGGAAA AAGGCATAGG CGTTGCCAAA CACGCCGCCT
 701 TCGTGTTCGG CGGCGTTCCC ATTTTCTACA CCCCTTGGGC GGACTTCCCG
 751 CTTGACGGCA ACCGCAAAAG CGGCCTGCTT GTTCCCTCAC TGTCCGCCGG
 801 TTCGGACGGC GTTTCCCTTT CCGTTCCCTA TTATTTCAAC CTTGCCCCCA
 851 ATCTCGATGC CACGTTCGCG CCCAGCGTGA TCGGCGAACG CGGCGCGGTC
 901 TTTGACGGGC AGGTACGCTA CCTGCGGCCG GATTATGCCG GCCAGTCCGA
 951 CCTGACCTGG CTGCCGCACG ACAAGAAAAG CGGCAGGAAT AACCGCTATC
1001 AGGCGAAATG GCAGCATCGG CACGACATTT CCGACACGCT TCAGGCGGGT
1051 GTCGATTTCA ACCAAGTCTC CGACAGCGGC TACTACCGCG ACTTTTACGG
1101 CAACAAAGAA ATCGCCGGCA ACGTCAACCT CAACCGCCGT GTATGGCTGG
1151 ATTATGGCGG CAGGGCGGCG GGCGGCAGCC TGAATGCCGG CCTTTCGGTT
1201 CTGAAATACC AGACGCTGGC AAACCAAAGC GGCTACAAAG ACAAACCGTA
1251 TGCCCTCATG CCGCGCCTTT CGGTCGAGTG GCGTAAAAAC ACCGGCAGGG
1301 CGCAAATCGG CGTGTCCGCA CAATTTACCC GATTCAGCCA CGACAGCCGC
1351 CAAGACGGCA GCCGCCTGGT CGTCTATCCC GACATCAAAT GGGATTTCAG
1401 CAACAGCTGG GGCTATGTCC GTCCCAAACT CGGACTGCAC GCCACCTATT
1451 ACAGCCTCAA CCGCTTCGGC AGCCAAGAAG CCCGACGCGT CAGCCGCACT
1501 CTGCCCATTG TCAACATCGA CAGCGGCGCA ACTTTTGAGC GGAATACGCG
1551 GATGTTCGGC GGAGAAGTCC TGCAAACCCT CGAGCCGCGC CTGTTCTACA
1601 ACTATATTCC TGCCAAATCC CAAAACGACC TGCCCAATTT CGATTCGTCG
1651 GAAAGCAGCT TCGGCTACGG GCAGCTCTTT CGCGAAAACC TCTATTACGG
1701 CAACGACAGG ATTAACACCG CAAACAGCCT TTCCGCCGCC GTGCAAAGCC
1751 GTATTTTGGA CGGCGCGACG GGGGAAGAGC GTTTCCGCGC CGGCATCGGT
1801 CAGAAATTCT ATTTCAAGGA TGATGCGGTG ATGCTTGACG GCAGCGTCGG
1851 CAAAAAACCG CGCAACCGTT CCGACTGGGT GGCATTTGCC TCCGGCAGCA
1901 TCGGCAGCCG CTTCATCCTC GACAGCAGCA TCCACTACAA CCAAAACGAC
1951 AAACGCGCCG AGAACTACGC CGTCGGTGCA AGCTACCGTC CCGCACAGGG
2001 CAAAGTGCTG AACGCCCGCT ACAAATACGG GCGCAACGAA AAAATCTACC
2051 TGAAGTCCGA CGGTTCCTAT TTTTACGACA AACTCAGCCA GCTCGACCTG
2101 TCCGCACAAT GGCCGCTGAC GCGCAACCTG TCGGCCGTCG TCCGTTACAA
2151 CTACGGTTTT GAAGCCAAAA AACCGATAGA GGTGCTGGCG GGTGCGGAAT
2201 ACAAAAGCAG TTGCGGCTGC TGGGGCGCGG GCGTGTACGC CCAACGCTAC
2251 GTTACCGGCG AAAACACCTA CAAAAACGCT GTCTTTTTCT CACTTCAGTT
2301 GAAAGACCTC AGCAGTGTCG GCAGAAACCC CGCAGACAGG ATGGATGTCG
2351 CCGTTCCCGG CTATATCACC GCCCACTCTC TTTCCGCCGG ACGCAACAAA
2401 CGACCCTGA
```

This corresponds to the amino acid sequence <SEQ ID 2932; ORF 958>:

m958.pep

```
  1 LARLFSLKPL VLALGLCFGT HCAAADAVAA EETDNPTAGE SVRSVSEPIQ
 51 PTSLSLGSTC LFCSNESGSP ERTEAAVQGS GEASIPEDYT RIVADRMEGQ
101 SQVQVRAEGN VVVERNRTTL NTDWADYDQS GDTVTAGDRF ALQQDGTLIR
151 GETLTYNLEQ QTGEAHNVRM EIEQGGRRLQ SVSRTAEMLG EGHYKLTETQ
201 FNTCSAGDAG WYVKAASVEA DREKGIGVAK HAAFVFGGVP IFYTPWADFP
251 LDGNRKSGLL VPSLSAGSDG VSLSVPYYFN LAPNLDATFA PSVIGERGAV
301 FDGQVRYLRP DYAGQSDLTW LPHDKKSGRN NRYQAKWQHR HDISDTLQAG
351 VDFNQVSDSG YYRDFYGNKE IAGNVNLNRR VWLDYGGRAA GGSLNAGLSV
401 LKYQTLANQS GYKDKPYALM PRLSVEWRKN TGRAQIGVSA QFTRFSHDSR
451 QDGSRLVVYP DIKWDFSNSW GYVRPKLGLH ATYYSLNRFG SQEARRVSRT
501 LPIVNIDSGA TFERNTRMFG GEVLQTLEPR LFYNYIPAKS QNDLPNFDSS
551 ESSFGYGQLF RENLYYGNDR INTANSLSAA VQSRILDGAT GEERFRAGIG
601 QKFYFKDDAV MLDGSVGKKP RNRSDWVAFA SGSIGSRFIL DSSIHYNQND
651 KRAENYAVGA SYRPAQGKVL NARYKYGRNE KIYLKSDGSY FYDKLSQLDL
701 SAQWPLTRNL SAVVRYNYGF EAKKPIEVLA GAEYKSSCGC WGAGVYAQRY
751 VTGENTYKNA VFFSLQLKDL SSVGRNPADR MDVAVPGYIT AHSLSAGRNK
801 RP*
```

Computer analysis of this amino acid sequence gave the following results:

Homology with a predicted ORF from *N. gonorrhoeae*

ORF 958 shows 89.3% identity over a 802 aa overlap with a predicted ORF (ORF 958) from *N. gonorrhoeae* m958/g958 89.3% identity in 802 aa overlap

```
                   10        20        30        40        50        60
m958.pep   LARLFSLKPLVLALGLCFGTHCAAADAVAAEETDNPTAGESVRSVSEPIQPTSLSLGSTC
           |||||||||||||||:|||||||| |:|||||:|: :|  :::::||  |  ::|:|||||
g958       LARLFSLKPLVLALGFCFGTHCAA-DTVAAEEADGRVAEGGAQGASESAQASDLTLGSTC
                   10        20         30        40        50

                   70        80        90       100       110       120
m958.pep   LFCSNESGSPERTEAAVQGSGEASIPEDYTRIVADRMEGQSQVQVRAEGNVVVERNRTTL
           ||||||||||||||||||||||||:|||||||||||||||||:|:|||||:|::||: ::|
g958       LFCSNESGSPERTEAAVQGSGEASVPEDYTRIVADRMEGQSKVKVRAEGSVIIERDGAVL
         60        70        80        90       100       110

                  130       140       150       160       170       180
m958.pep   NTDWADYDQSGDTVTAGDRFALQQDGTLIRGETLTYNLEQQTGEAHNVRMEIEQGGRRLQ
           |||||||||||||||:||||||||||||||||||||||:|||||||||||| ||||||||
g958       NTDWADYDQSGDTVTVGDRFALQQDGTLIRGETLTYNLDQQTGEAHNVRMETEQGGRRLQ
        120       130       140       150       160       170

                  190       200       210       220       230       240
m958.pep   SVSRTAEMLGEGHYKLTETQFNTCSAGDAGWYVKAASVEADREKGIGVAKHAAFVFGGVP
           ||||||||||||:||||||||||||||||||||||||||||| |||||||||||||||||
g958       SVSRTAEMLGEGRYKLTETQFNTCSAGDAGWYVKAASVEADRGKGIGVAKHAAFVFGGVP
        180       190       200       210       220       230

                  250       260       270       280       290       300
m958.pep   IFYTPWADFPLDGNRKSGLLVPSLSAGSDGVSLSVPYYFNLAPNLDATFAPSVIGERGAV
           :||||||||||||||||||||||:||||||||||||||||||||:||||||::||||||:
g958       LFYTPWADFPLDGNRKSGLLVPSVSAGSDGVSLSVPYYFNLAPNFDATFAPGIIGERGAT
        240       250       260       270       280       290

                  310       320       330       340       350       360
m958.pep   FDGQVRYLRPDYAGQSDLTWLPHDKKSGRNNRYQAKWQHRHDISDTLQAGVDFNQVSDSG
           ||||:|||||||:||:||||||||||||||||||||||||||||||||||||||||||||
g958       FDGQIRYLRPDYSGQTDLTWLPHDKKSGRNNRYQAKWQHRHDISDTLQAGVDFNQVSDSG
        300       310       320       330       340       350
```

-continued

```
                  370       380       390       400       410       420
m958.pep   YYRDFYGNKEIAGNVNLNRRVWLDYGGRAAGGSLNAGLSVLKYQTLANQSGYKDKPYALM
           |||||||::||||||||||||||||||||||||||||||| |||||||||||||:|||:|
g958       YYRDFYGGEEIAGNVNLNRRVWLDYGGRAAGGSLNAGLSVQKYQTLANQSGYKDEPYAIM
         360       370       380       390       400       410

                  430       440       450       460       470       480
m958.pep   PRLSVEWRKNTGRAQIGVSAQFTRFSHDSRQDGSRLVVYPDIKWDFSNSWGYVRPKLGLH
           ||||::|:||:|||||||||||||||||:||||||||||| |||||||||||||||||||
g958       PRLSADWHKNAGRAQIGVSAQFTRFSHDGRQDGSRLVVYPGIKWDFSNSWGYVRPKLGLH
         420       430       440       450       460       470

                  490       500       510       520       530       540
m958.pep   ATYYSLNRFGSQEARRVSRTLPIVNIDSGATFERNTRMFGGEVLQTLEPRLFYNYIPAKS
           ||||||: ||:: :| |:|:||:||||:|:|||||||:||| |:||:|||||||||||||
g958       ATYYSLDSFGGKASRSVGRVLPVVNIDGGTTFERNTRLFGGGVVQTIEPRLFYNYIPAKS
         480       490       500       510       520       530

                  550       560       570       580       590       600
m958.pep   QNDLPNFDSSESSFGYGQLFRENLYYGNDRINTANSLSAAVQSRILDGATGEERFRAGIG
           ||||||||||||||||||||||||||||||||:|||||:|||||||||||||||||||||
g958       QNDLPNFDSSESSFGYGQLFRENLYYGNDRINAANSLSTAVQSRILDGATGEERFRAGIG
         540       550       560       570       580       590

                  610       620       630       640       650       660
m958.pep   QKFYFKDDAVMLDGSVGKKPRNRSDWVAFASGSIGSRFILDSSIHYNQNDKRAENYAVGA
           ||||||||||||||||||:||:||||||||||:||:|| |||||||||||||||:|||||
g958       QKFYFKDDAVMLDGSVGKNPRSRSDWVAFASGGIGGRFTLDSSIHYNQNDKRAEHYAVGA
         600       610       620       630       640       650

                  670       680       690       700       710       720
m958.pep   SYRPAQGKVLNARYKYGRNEKIYLKSDGSYFYDKLSQLDLSAQWPLTRNLSAVVRYNYGF
           :|||| ||||||||||||||||||::||||||||||||||||||||||||||||||||||
g958       GYRPAPGKVLNARYKYGRNEKIYLQADGSYFYDKLSQLDLSAQWPLTRNLSAVVRYNYGF
         660       670       680       690       700       710

                  730       740       750       760       770       780
m958.pep   EAKKPIEVLAGAEYKSSCGCWGAGVYAQRYVTGENTYKNAVFFSLQLKDLSSVGRNPADR
           |||||||:|||||||||||||||||||||||||||||||||||||||||||||||||| |
g958       EAKKPIEMLAGAEYKSSCGCWGAGVYAQRYVTGENTYKNAVFFSLQLKDLSSVGRNPAGR
         720       730       740       750       760       770

                  790       800
m958.pep   MDVAVPGYITAHSLSAGRNKRP
           ||||||||| ||||||||||||
g958       MDVAVPGYIPAHSLSAGRNKRPX
         780       790       800
```

The following partial DNA sequence was identified in *N. meningitidis* <SEQ ID 2933>:

a958.seq

```
  1 TTGGCTCGTT TATTTTCACT CAAACCACTG GTGCTGGCAT TGGGCTTCTG

 51 TTTCGGCACG CATTGCGCCG CCGCCGATGC CGTTGCGGCG GAGGAAACGG

101 ACAATCCGAC CGCCGGAGGA AGCGTTCGGA GCGTGTCCGA ACCCATACAG

151 CCTACCAGCC TGAGCCTCGG TTCGACCTGC CTGTTTTGCA GTAACGAAAG

201 CGGCAGCCCC GAGAGAACCG AAGCCGCCGT CCAAGGCAGC GGCGAAGCAT

251 CCATCCCCGA AGACTATACG CGCATTGTTG CCGACAGGAT GGAAGGACAG

301 TCGCAGGTGC AGGTGCGTGC CGAAGGCAAC GTCGTCGTCG AACGCAATCG

351 GACGACCCTC AATGCCGATT GGGCGGATTA CGACCAGTCG GGCGACACCG

401 TTACCGCAGG CGACCGGTTC GCCCTCCAAC AGGACGGTAC GCTGATTCGG

451 GGCGAAACCC TGACCTACAA TCTCGAGCAG CAGACCGGGG AAGCGCACAA

501 CGTCCGTATG GAAACCGAAC ACGGCGGACG GCGGCTGCAA AGCGTCAGCC

551 GCACCGCCGA AATGTTGGGC GAAGGGCATT ACAAACTGAC GGAAACCCAA

601 TTCAACACCT GTTCCGCCGG CGATGCCGGC TGGTATGTCA AGGCCGCTTC

651 CGTCGAAGCC GATCGGGAAA AAGGCATAGG CGTTGCCAAA CACGCCGCCT

701 TCGTGTTCGG CGGCGTTCCC ATTTTCTACA CCCCTTGGGC GGACTTCCCG

751 CTTGACGGCA ACCGCAAAAG CGGCCTGCTC GTTCCCTCAC TGTCCGCCGG
```

-continued

```
 801 TTCGGACGGC GTTTCCCTTT CCGTTCCCTA TTATTTCAAC CTTGCCCCCA
 851 ATCTCGATGC CACGTTCGCG CCCGGCGTGA TCGGCGAACG CGGCGCGGTC
 901 TTTGACGGGC AGGTACGCTA CCTGCGGCCG GATTATGCCG GCCAGTCCGA
 951 CCTGACCTGG CTGCCGCACG ACAAGAAAAG CGGCAGGAAT AACCGCTATC
1001 AGGCGAAATG GCAGCACCGG CACGACATTT CCGACACGCT TCAGGCGGGT
1051 GTCGATTTCA ACCAAGTCTC CGACAGCGGC TACTACCGCG ACTTTTACGG
1101 CAACAAAGAA ATCGCCGGCA ACGTCAACCT CAACCGCCGT GTATGGCTGG
1151 ATTATGGCGG CAGGGCGGCG GGCGGCAGCC TGAATGCCGG CCTTTCGGTT
1201 CTGAAATACC AGACGCTGGC AAACCAAAGC GGCTACAAAG ACAAACCGTA
1251 TGCCCTGATG CCGCGCCTTT CCGCCGATTG GCGCAAAAAC ACCGGCAGGG
1301 CGCAAATCGG CGTGTCCGCC CAATTTACCC GCTTCAGCCA CGACAGCCGC
1351 CAAGACGGCA GCCGCCTCGT CGTCTATCCC GACATCAAAT GGGATTTCAG
1401 CAACAGCTGG GGTTACGTCC GTCCCAAACT CGGACTGCAC GCCACCTATT
1451 ACAGCCTCAA CCGCTTCGGC AGCCAAGAAG CCCGACGCGT CAGCCGCACT
1501 CTGCCCATCG TCAACATCGA CAGCGGCATG ACCTTCGAAC GCAATACGCG
1551 GATGTTCGGC GGCGGAGTCC TGCAAACCCT CGAGCCGCGC CTGTTCTACA
1601 ACTATATTCC TGCCAAATCC CAAAACGACC TGCCCAATTT CGATTCGTCG
1651 GAAAGCAGCT TCGGCTACGG GCAGCTTTTT CGTGAAAACC TCTATTACGG
1701 CAACGACAGG ATTAACACCG CAAACAGCCT TTCCGCCGCC GTGCAAAGCC
1751 GTATTTTGGA CGGCGCGACG GGGGAAGAGC GTTTCCGCGC CGGCATCGGG
1801 CAGAAATTCT ACTTCAAAAA CGACGCAGTC ATGCTTGACG GCAGTGTCGG
1851 CAAAAAACCG CGCAGCCGTT CCGACTGGGT GGCATTCGCC TCCAGCGGCA
1901 TCGGCAGCCG CTTCATCCTC GACAGCAGCA TCCACTACAA CCAAAACGAC
1951 AAACGCGCCG AGAACTACGC CGTCGGTGCA AGCTACCGTC CCGCACAGGG
2001 CAAAGTGCTG AACGCCCGCT ACAAATACGG GCGCAACGAA AAAATCTACC
2051 TGAAGTCCGA CGGTTCCTAT TTTTACGACA AACTCAGCCA GCTCGACCTG
2101 TCCGCACAAT GGCCGCTGAC GCGCAACCTG TCGGCCGTCG TCCGTTACAA
2151 CTACGGTTTT GAAGCCAAAA AACCGATAGA GGTGCTGGCG GGTGCGGAAT
2201 ACAAAAGCAG TTGCGGCTGC TGGGGCGCGG GCGTGTACGC CCAACGCTAC
2251 GTTACCGGCG AAAACACCTA CAAAAACGCT GTCTTTTTCT CACTTCAGTT
2301 GAAAGACCTC AGCAGTGTCG GCAGAAACCC CGCAGACAGG ATGGATGTCG
2351 CCGTTCCCGG CTATATCCCC GCCCACTCTC TTTCCGCCGG ACGCAACAAA
2401 CGGCCCTGA
```

This corresponds to the amino acid sequence <SEQ ID 2934; ORF 958.a>:

a958.pep

```
  1 LARLFSLKPL VLALGFCFGT HCAAADAVAA EETDNPTAGG SVRSVSEPIQ
 51 PTSLSLGSTC LFCSNESGSP ERTEAAVQGS GEASIPEDYT RIVADRMEGQ
```

-continued

```
101 SQVQVRAEGN VVVERNRTTL NADWADYDQS GDTVTAGDRF ALQQDGTLIR

151 GETLTYNLEQ QTGEAHNVRM ETEHGGRRLQ SVSRTAEMLG EGHYKLTETQ

201 FNTCSAGDAG WYVKAASVEA DREKGIGVAK HAAFVFGGVP IFYTPWADFP

251 LDGNRKSGLL VPSLSAGSDG VSLSVPYYFN LAPNLDATFA PGVIGERGAV

301 FDGQVRYLRP DYAGQSDLTW LPHDKKSGRN NRYQAKWQHR HDISDTLQAG

351 VDFNQVSDSG YYRDFYGNKE IAGNVNLNRR VWLDYGGRAA GGSLNAGLSV

401 LKYQTLANQS GYKDKPYALM PRLSADWRKN TGRAQIGVSA QFTRFSHDSR

451 QDGSRLVVYP DIKWDFSNSW GYVRPKLGLH ATYYSLNRFG SQEARRVSRT

501 LPIVNIDSGM TFERNTRMFG GGVLQTLEPR LFYNYIPAKS QNDLPNFDSS

551 ESSFGYGQLF RENLYYGNDR INTANSLSAA VQSRILDGAT GEERFRAGIG

601 QKFYFKNDAV MLDGSVGKKP RSRSDWVAFA SSGIGSRFIL DSSIHYNQND

651 KRAENYAVGA SYRPAQGKVL NARYKYGRNE KIYLKSDGSY FYDKLSQLDL

701 SAQWPLTRNL SAVVRYNYGF EAKKPIEVLA GAEYKSSCGC WGAGVYAQRY

751 VTGENTYKNA VFFSLQLKDL SSVGRNPADR MDVAVPGYIP AHSLSAGRNK

801 RP*
```

Computer analysis of this amino acid sequence gave the following results:

Homology with a predicted ORF from *N. meningitidis*

ORF 957 shows 96.3% identity over a 377 aa overlap with a predicted ORF (ORF 957) from *N. meningitidis* a958/m958 98.1% identity in 802 aa overlap

```
                   10        20        30        40        50        60
a958.pep   LARLFSLKPLVLALGFCFGTHCAAADAVAAEETDNPTAGGSVRSVSEPIQPTSLSLGSTC
           ||||||||||||||:||||||||||||||||||||||| |||||||||||||||||||||
m958       LARLFSLKPLVLALGLCFGTHCAAADAVAAEETDNPTAGESVRSVSEPIQPTSLSLGSTC
                   10        20        30        40        50        60

                   70        80        90       100       110       120
a958.pep   LFCSNESGSPERTEAAVQGSGEASIPEDYTRIVADRMEGQSQVQVRAEGNVVVERNRTTL
           ||||||||||||||||||||||||||||||||||||||||||||||||||||||||||||
m958       LFCSNESGSPERTEAAVQGSGEASIPEDYTRIVADRMEGQSQVQVRAEGNVVVERNRTTL
                   70        80        90       100       110       120

                  130       140       150       160       170       180
a958.pep   NADWADYDQSGDTVTAGDRFALQQDGTLIRGETLTYNLEQQTGEAHNVRMETEHGGRRLQ
           |:|||||||||||||||||||||||||||||||||||||||||||||||||| |:|||||
m958       NTDWADYDQSGDTVTAGDRFALQQDGTLIRGETLTYNLEQQTGEAHNVRMEIEQGGRRLQ
                  130       140       150       160       170       180

                  190       200       210       220       230       240
a958.pep   SVSRTAEMLGEGHYKLTETQFNTCSAGDAGWYVKAASVEADREKGIGVAKHAAFVFGGVP
           ||||||||||||||||||||||||||||||||||||||||||||||||||||||||||||
m958       SVSRTAEMLGEGHYKLTETQFNTCSAGDAGWYVKAASVEADREKGIGVAKHAAFVFGGVP
                  190       200       210       220       230       240

                  250       260       270       280       290       300
a958.pep   IFYTPWADFPLDGNRKSGLLVPSLSAGSDGVSLSVPYYFNLAPNLDATFAPGVIGERGAV
           ||||||||||||||||||||||||||||||||||||||||||||||||||||:|||||||
m958       IFYTPWADFPLDGNRKSGLLVPSLSAGSDGVSLSVPYYFNLAPNLDATFAPSVIGERGAV
                  250       260       270       280       290       300

                  310       320       330       340       350       360
a958.pep   FDGQVRYLRPDYAGQSDLTWLPHDKKSGRNNRYQAKWQHRHDISDTLQAGVDFNQVSDSG
           ||||||||||||||||||||||||||||||||||||||||||||||||||||||||||||
m958       FDGQVRYLRPDYAGQSDLTWLPHDKKSGRNNRYQAKWQHRHDISDTLQAGVDFNQVSDSG
                  310       320       330       340       350       360

                  370       380       390       400       410       420
a958.pep   YYRDFYGNKEIAGNVNLNRRVWLDYGGRAAGGSLNAGLSVLKYQTLANQSGYKDKPYALM
           ||||||||||||||||||||||||||||||||||||||||||||||||||||||||||||
m958       YYRDFYGNKEIAGNVNLNRRVWLDYGGRAAGGSLNAGLSVLKYQTLANQSGYKDKPYALM
                  370       380       390       400       410       420
```

```
                  430       440       450       460       470       480
a958.pep  PRLSADWRKNTGRAQIGVSAQFTRFSHDSRQDGSRLVVYPDIKWDFSNSWGYVRPKLGLH
          ||||::||||||||||||||||||||||||||||||||||||||||||||||||||||||
m958      PRLSVEWRKNTGRAQIGVSAQFTRFSHDSRQDGSRLVVYPDIKWDFSNSWGYVRPKLGLH
                  430       440       450       460       470       480

                  490       500       510       520       530       540
a958.pep  ATYYSLNRFGSQEARRVSRTLPIVNIDSGMTFERNTRMFGGGVLQTLEPRLFYNYIPAKS
          |||||||||||||||||||||||||||||||:|||||||||:||||||||||||||||||
m958      ATYYSLNRFGSQEARRVSRTLPIVNIDSGATFERNTRMFGGEVLQTLEPRLFYNYIPAKS
                  490       500       510       520       530       540

                  550       560       570       580       590       600
a958.pep  QNDLPNFDSSESSFGYGQLFRENLYYGNDRINTANSLSAAVQSRILDGATGEERFRAGIG
          ||||||||||||||||||||||||||||||||||||||||||||||||||||||||||||
m958      QNDLPNFDSSESSFGYGQLFRENLYYGNDRINTANSLSAAVQSRILDGATGEERFRAGIG
                  550       560       570       580       590       600

                  610       620       630       640       650       660
a958.pep  QKFYFKNDAVMLDGSVGKKPRSRSDWVAFASSGIGSRFILDSSIHYNQNDKRAENYAVGA
          ||||||:|||||||||||||||:|||||||||::||||||||||||||||||||||||||
m958      QKFYFKDDAVMLDGSVGKKPRNRSDWVAFASGSIGSRFILDSSIHYNQNDKRAENYAVGA
                  610       620       630       640       650       660

                  670       680       690       700       710       720
a958.pep  SYRPAQGKVLNARYKYGRNEKIYLKSDGSYFYDKLSQLDLSAQWPLYRNLSAVVRYNYGF
          ||||||||||||||||||||||||||||||||||||||||||||||||||||||||||||
m958      SYRPAQGKVLNARYKYGRNEKIYLKSDGSYFYDKLSQLDLSAQWPLYRNLSAVVRYNYGF
                  670       680       690       700       710       720

                  730       740       750       760       770       780
a958.pep  EAKKPIEVLAGAEYKSSCGCWGAGVYAQRYVTGENTYKNAVFFSLQLKDLSSVGRNPADR
          ||||||||||||||||||||||||||||||||||||||||||||||||||||||||||||
m958      EAKKPIEVLAGAEYKSSCGCWGAGVYAQRYVTGENTYKNAVFFSLQLKDLSSVGRNPADR
                  730       740       750       760       770       780

                  790       800
a958.pep  MDVAVPGYIPAHSLSAGRNKRPX
          ||||||||| |||||||||||||
m958      MDVAVPGYITAHSLSAGRNKRP
                  790       800
```

The following partial DNA sequence was identified in *N. gonorrhoeae* <SEQ ID 2935>:

```
g959.seq

  1 ATGAACATCA AACACCTTCT CTTGACCGCC GCCGCAACCG CACTGTTGGG

 51 CATTTCCGCC CCCGCACTCG CCCACCACGA CGGACACGGC GATGACGACC

101 ACGGACACGC CGCACACCAA CACGGCAAAC AAGACAAAAT CATCAGCCGC

151 GCCCAAGCCG AAAAAGCGGC TTGGGCGCGT GTCGGCGGCA AAATCACCGA

201 CATCGATCTC GAACACGACG ACGGCCGTCC GCACTATGAT GTCGAAATCG

251 TCAAAAACGG ACAGGAATAC AAAGTCGTTG TCGATGCCCG TACCGGCCGC

301 GTGATTTCCT CCCGCCGCGA CGACTGA
```

This corresponds to the amino acid sequence <SEQ ID 2936; ORF 959.ng>:

```
g959.pep

  1 MNIKHLLLTA AATALLGISA PALAHHDGHG DDDHGHAAHQ HGKQDKIISR

 51 AQAEKAAWAR VGGKITDIDL EHDDGRPHYD VEIVKNGQEY KVVVDARTGR

101 VISSRRDD*
```

The following partial DNA sequence was identified in *N. meningitidis* <SEQ ID 2937>:

m959.seq

```
  1 ATGAACATCA AACACCTTCT CTTGACCTCC GCCGCAACCG CACTGCTGAG
 51 CATTTCCGCC CCCGCGCTCG CCCACCACGA CGGACACGGC GATGACGACC
101 ACGGACACGC CGCACACCAA CACAACAAAC AAGACAAAAT CATCAGCCGC
151 GCCCAAGCCG AAAAAGCAGC GTTGGCGCGT GTCGGCGGCA AAATCACCGA
201 CATCGATCTC GAACACGACA ACGGCCGTCC GCACTATGAT GTCGAAATCG
251 TCAAAAACGG ACAGGAATAC AAAGTCGTTG TCGATGCCCG TACCGGCCGC
301 GTGATTTCCT CCCGCCGCGA CGACTGA
```

This corresponds to the amino acid sequence <SEQ ID 2938; ORF 959>:

m959.pep

```
  1 MNIKHLLLTS AATALLSISA PALAHHDGHG DDDHGHAAHQ HNKQDKIISR
 51 AQAEKAALAR VGGKITDIDL EHDNGRPHYD VEIVKNGQEY KVVVDARTGR
101 VISSRRDD*
```

Computer analysis of this amino acid sequence gave the following results:

Homology with a predicted ORF from *N. gonorrhoeae*

ORF 959 shows 95.4% identity over a 108 aa overlap with a predicted ORF (ORF 959) from *N. gonorrhoeae* m959/g959 95.4% identity in 108 aa overlap

```
                   10        20        30        40        50        60
m959.pep  MNIKHLLLTSAATALLSISAPALAHHDGHGDDDHGHAAHQHNKQDKIISRAQAEKAALAR
          |||||||||:||||||:||||||||||||||||||||||||:||||||||||||||| ||
g959      MNIKHLLLTAAATALLGISAPALAHHDGHGDDDHGHAAHQHGKQDKIISRAQAEKAAWAR
                   10        20        30        40        50        60

                   70        80        90       100      109
m959.pep  VGGKITDIDLEHDNGRPHYDVEIVKNGQEYKVVVDARTGRVISSRRDDX
          |||||||||||||:|||||||||||||||||||||||||||||||||||
g959      VGGKITDIDLEHDDGRPHYDVEIVKNGQEYKVVVDARTGRVISSRRDDX
                   70        80        90       100
```

The following partial DNA sequence was identified in *N. meningitidis* <SEQ ID 2939>:

a959.seq

```
  1 ATGAACTTCA AACGCCTTCT CTTGACCGCC GCCGCAACCG CACTGATGGG
 51 CATTTCCGCC CCCGCACTCG CCCACCACGA CGGACACGGC GATGACGACC
101 ACGGACACGC CGCACACCAA CACAGCAAAC AAGACAAAAT CATCAGCCGC
151 GCCCAAGCCG AAAAAGCAGC GTTGGCGCGT GTCGGCGGCA AAATCACCGA
201 CATCGATCTC GAACACGACA ACGGCCGTCC GCACTATGAT GTCGAAATCG
251 TCAAAAACGG ACAGGAATAC AAAGTCGTTG TCGATGCCCG TACCGGCCGC
301 GTGATTTCCT CCCGCCGCGA CGACTGA
```

This corresponds to the amino acid sequence <SEQ ID 2940; ORF 959.a>:

a959.pep

```
  1 MNFKRLLLTA AATALMGISA PALAHHDGHG DDDHGHAAHQ HSKQDKIISR

 51 AQAEKAALAR VGGKITDIDL EHDNGRPHYD VEIVKNGQEY KVVVDARTGR

101 VISSRRDD*
```

Computer analysis of this amino acid sequence gave the following results:

Homology with a predicted ORF from *N. meningitidis*

ORF 959 shows 94.4% identity over a 108 aa overlap with a predicted ORF (ORF 959) from *N. meningitidis* a959/m959 94.4% identity in 108 aa overlap

```
                 10        20        30        40        50        60
a959.pep    MNFKRLLLTAAATALMGISAPALAHHDGHGDDDHGHAAHQHSKQDKIISRAQAEKAALAR
            ||:|:||||:|||||::|||||||||||||||||||||||:|||||||||||||||||||
m959        MNIKHLLLTSAATALLSISAPALAHHDGHGDDDHGHAAHQHNKQDKIISRAQAEKAALAR
                 10        20        30        40        50        60
                 70        80        90       100      109
a959.pep    VGGKITDIDLEHDNGRPHYDVEIVKNGQEYKVVVDARTGRVISSRRDDX
            |||||||||||||||||||||||||||||||||||||||||||||||||
m959        VGGKITDIDLEHDNGRPHYDVEIVKNGQEYKVVVDARTGRVISSRRDDX
                 70        80        90       100      109
```

g960.seq not found yet g960.pep not found yet

The following partial DNA sequence was identified in *N. meningitidis* <SEQ ID 2941>:

m960.seq

```
  1 ATGCAAGTAA ATATTCAGAT TCCCTGTATG CTGTACAGAC GCGGGAGTGT

 51 TAAGCCCCCC TTGTTTGAAG CTCCGCGGCT CCTGCCGAGC TTCACCGACC

101 CCGTTGTGCC CAAGCTCTCT GCTCCCGGCG GCTACATTGT CGACATCCCC

151 AAAGGCAATC TGAAAACCGA AATCGAAAAG CTGGCCAAAC AGCCCGAGTA

201 TGCCTATCTG AAACAGCTCC AAGTAGCGAA AAACGTCAAC TGGAACCAGG

251 TGCAACTGGC TTACGATAAA TGGGACTATA AGCAGGAAGG CTTAACCAGA

301 GCCGGTGCAG CGATTATCGC GCTGGCTGTT ACCGTGGTTA CTGCGGGCGC

351 GGGAGTCGGA GCCGCACTAG GCTTAAACGG CGCAGCCGCA GCAGCGGCCG

401 ATGCCGCCTT TGCCTCACTC GCTTCTCAGG CTTCCGTATC GCTCATCAAC

451 AATAAAGGCG ATGTCGGCAA AACCCTGAAG GAACTGGGCA GAAGCCGCAC

501 GGTAAAAAAT CTGGTTGTAG CGGCGGCAAC GGCAGGCGTA TCCAACAAAC

551 TCGGTGCCTC TTCCCTTGCC ACTTGGAGCG AAACCCCTTG GGTAAACAAC

601 CTCAACGTTA ACCTGGCCAA TGCGGGCAGT GCCGCGCTGA TCAACACCGC

651 TGTTAACGGC GGCAGCCTGA AAGACAATCT GGAGGCAAAT ATCCTGGCGG

701 CATTGGTGAA TACCGCGCAT GGGGAGGCGG CGAGTAAGAT CAAAGGACTG

751 GATCAGCACT ATGTCGCCCA CAAAATCGCT CATGCCGTAG CGGGCTGTGC

801 GGCTGCAGCG GCGAATAAGG GCAAATGTCA GGACGGCGCG ATCGGTGCGG

851 CTGTGGGTGA GATTGTCGGG GAGGCTTTGG TTAAAAATAC CGATTTTAGC

901 GATATGACCC CGGAACAATT AGATCTGGAA GTTAAGAAAA TTACCGCCTA
```

-continued

```
 951 TGCCAAACTT GCGGCAGGTA CAGTTGCAGG CGTAACGGGA GGAGATGTCA

1001 ATACTGCTGC ACAAACCGCA CAAAACGCGG TAGAAAATAA TGCGGTTAAA

1051 GCTGTTGTAA CTGCTGCAAA AGTGGTTTAT AAGGTAGCCA GAAAAGGATT

1101 AAAAAACGGG AAAATCAACG TTAGAGATTT AAAACAGACG TTGAAAGACG

1151 AAGGTTATAA TTTAGCCGAC AACCTGACCA CCTTATTCGA CGAAACATTG

1201 GATTGGAACG ATGCCAAAGC CGTTATTGAT ATTGTCGTCG GAACAGAGCT

1251 GAATCGCGCT AATAAAGGGG AAGCGGCACA AAAGGTCAAG GAAGTTTTAG

1301 AAAAAAATCG TCCTTATATC CCTAATAAAG GTGCTGTACC GAATATGAGT

1351 ACATACATGA AAAATAATCC TTTTGGAAAA CAGCTGGCTC AAATTTCAGA

1401 AAAGACAACG CTTCCGACGC AGCAAGGGCA GTCTGTCTTC TTGGTAAAAA

1451 GAAACCAAGG GTTATTAAAA ACCGGTGATA GGTTTTATTT AGATGGCCAA

1501 CATAAAAATC ATTTAGAGGT TTTTGATAAA AATGGGAACT TTAAGTTTGT

1551 TCTAAATATG GATGGTTCGC TTAACCAAAT GAAAACTGGG GCAGCAAAAG

1601 GTCGTAAATT AAACTTAAAA TAG
```

This corresponds to the amino acid sequence <SEQ ID 2942; ORF 960>:

m960.pep

```
  1 MQVNIQIPCM LYRRGSVKPP LFEAPRLLPS FTDPVVPKLS APGGYIVDIP

 51 KGNLKTEIEK LAKQPEYAYL KQLQVAKNVN WNQVQLAYDK WDYKQEGLTR

101 AGAAIIALAV TVVTAGAGVG AALGLNGAAA AAADAAFASL ASQASVSLIN

151 NKGDVGKTLK ELGRSRTVKN LVVAAATAGV SNKLGASSLA TWSETPWVNN

201 LNVNLANAGS AALINTAVNG GSLKDNLEAN ILAALVNTAH GEAASKIKGL

251 DQHYVAHKIA HAVAGCAAAA ANKGKCQDGA IGAAVGEIVG EALVKNTDFS

301 DMTPEQLDLE VKKITAYAKL AAGTVAGVTG GDVNTAAQTA QNAVENNAVK

351 AVVTAAKVVY KVARKGLKNG KINVRDLKQT LKDEGYNLAD NLTTLFDETL

401 DWNDAKAVID IVVGTELNRA NKGEAAQKVK EVLEKNRPYI PNKGAVPNMS

451 TYMKNNPFGK QLAQISEKTT LPTQQGQSVF LVKRNQGLLK TGDRFYLDGQ

501 HKNHLEVFDK NGNFKFVLNM DGSLNQMKTG AAKGRKLNLK *
```

a960.seq not found yet a960.pep not found yet g961.seq not found yet g961.pep not found yet The following partial DNA sequence was identified in *N. meningitidis* <SEQ ID 2943>:

m961.seq

```
  1 ATGAGCATGA AACACTTTCC AGCCAAAGTA CTGACCACAG CCATCCTTGC

 51 CACTTTCTGT AGCGGCGCAC TGGCAGCCAC AAGCGACGAC GATGTTAAAA

101 AAGCTGCCAC TGTGGCCATT GTTGCTGCCT ACAACAATGG CCAAGAAATC
```

-continued

```
 151 AACGGTTTCA AAGCTGGAGA GACCATCTAC GACATTGGTG AAGACGGCAC
 201 AATTACCCAA AAAGACGCAA CTGCAGCCGA TGTTGAAGCC GACGACTTTA
 251 AAGGTCTGGG TCTGAAAAAA GTCGTGACTA ACCTGACCAA AACCGTCAAT
 301 GAAAACAAAC AAAACGTCGA TGCCAAAGTA AAAGCTGCAG AATCTGAAAT
 351 AGAAAAGTTA ACAACCAAGT TAGCAGACAC TGATGCCGCT TTAGCAGATA
 401 CTGATGCCGC TCTGGATGAA ACCACCAACG CCTTGAATAA ATTGGGAGAA
 451 AATATAACGA CATTTGCTGA AGAGACTAAG ACAAATATCG TAAAAATTGA
 501 TGAAAAATTA GAAGCCGTGG CTGATACCGT CGACAAGCAT GCCGAAGCAT
 551 TCAACGATAT CGCCGATTCA TTGGATGAAA CCAACACTAA GGCAGACGAA
 601 GCCGTCAAAA CCGCCAATGA AGCCAAACAG ACGGCCGAAG AAACCAAACA
 651 AAACGTCGAT GCCAAAGTAA AAGCTGCAGA AACTGCAGCA GGCAAAGCCG
 701 AAGCTGCCGC TGGCACAGCT AATACTGCAG CCGACAAGGC CGAAGCTGTC
 751 GCTGCAAAAG TTACCGACAT CAAAGCTGAT ATCGCTACGA ACAAAGCTGA
 801 TATTGCTAAA AACTCAGCAC GCATCGACAG CTTGGACAAA AACGTAGCTA
 851 ATCTGCGCAA AGAAACCCGC CAAGGCCTTG CAGAACAAGC CGCGCTCTCC
 901 GGCCTGTTCC AACCTTACAA CGTGGGTCGG TTCAATGTAA CGGCTGCAGT
 951 CGGCGGCTAC AAATCCGAAT CGGCAGTCGC CATCGGTACC GGCTTCCGCT
1001 TTACCGAAAA CTTTGCCGCC AAAGCAGGCG TGGCAGTCGG CACTTCGTCC
1051 GGTTCTTCCG CAGCCTACCA TGTCGGCGTC AATTACGAGT GGTAA
```

This corresponds to the amino acid sequence <SEQ ID 940; ORF 2944>:

m961.pep

```
  1 MSMKHFPAKV LTTAILATFC SGALAATSDD DVKKAATVAI VAAYNNGQEI
 51 NGFKAGETIY DIGEDGTITQ KDATAADVEA DDFKGLGLKK VVTNLTKTVN
101 ENKQNVDAKV KAAESEIEKL TTKLADTDAA LADTDAALDE TTNALNKLGE
151 NITTFAEETK TNIVKIDEKL EAVADTVDKH AEAFNDIADS LDETNTKADE
201 AVKTANEAKQ TAEETKQNVD AKVKAAETAA GKAEAAAGTA NTAADKAEAV
251 AAKVTDIKAD IATNKADIAK NSARIDSLDK NVANLRKETR QGLAEQAALS
301 GLFQPYNVGR FNVTAAVGGY KSESAVAIGT GFRFTENFAA KAGVAVGTSS
351 GSSAAYHVGV NYEW*
```

a961.seq not found yet a961.pep not found yet g972.seq not found yet g972.pep not found yet The following partial DNA sequence was identified in *N. meningitidis* <SEQ ID 2945>:

m972.seq

```
  1 TTGACTAACA GGGGGGGAGC GAAATTAAAA ACCArTTCCA AGAGTAGTGA
```

-continued

```
  51 ACGAATGAGT GAAGTTGAAT ATTTCTCACA CTTTATATCG GACGGAAAAG
 101 GGAAGCTTTT AGAAATTCCG CAGCGAAGAG GTAAGCAAGA CggGGTTTTT
 151 GTTGATTGGA TTTCATTCAC ATTCCATGAA GATACTTTAC TGAAAGTTTC
 201 CGGTTGCCCT TTATTTTCTG ATGCTGAATA CATGTATGTA TTAAGCAGAA
 251 AGCTGGAAGA AATTCTAGGT TTTGGCATAA CGCGCAAATG CAAATCAAGG
 301 GGCAACAAAT TCTATGAATC CATGTATAGG TTAGGTTCGG ATGATGTTGA
 351 TTATGGAGAG GTGCATTTCG GArGTCAGCG CAATACTGTT TTAGTTGAGT
 401 TGAAAGGTAC TGGTTGCAGC GTTGCAAGTC CGGGTTGGGA GTTGAGGCTA
 451 AAGCAGTTTC TCGATGATTC GATAAGGACA AGAATAACGC GAATTGACCT
 501 AGCACTTGAT TTTTTTGATG GAGAGTACAC GCCGGATCAG GCGTTGTTAG
 551 ATCACGATAA TGGTTTTTTT GATAACAGCA ATCAAAGGCC GAAATCTGAA
 601 ACGATCGGTA CGGCTTGGCG GAATGAGGAC GGGAGCGGCA AGACATTTTA
 651 TGTAGGTCGC AAGAAAAATT CTCGTTTTGT TCGTGTTTAT GAGAAAGGCA
 701 GGCAGCTTGG AGATAAAGAA AGCAAATGGG TAAGGTTCGA GATCCAGTTT
 751 AATTATGGAG ATATAGAAAT ACCCTTGGAT ATTTTAATAA ATCAGGGTTC
 801 GTATTTCTGT GGAGCTTTTC CAATTTGTAG AAAATTTAAA AATATGCCGG
 851 TTCCCGAAAG GTTTGATCAG AGAAAGAAAA AGCTTAATTT AACTTTCGAG
 901 CATAAATTGC ATTACGCGAA AAACGCGGTT GGAAAACTGG TCAATTTCAT
 951 GATTGAAATG GGTTTTGATA ATAGCGAAAT TGTGGAATCT TTAAAGGCAG
1001 ATTCGGGATT TCCCAAAGGA TTAGAACCTC AAAAATATGC TCTGGAAATG
1051 TTAAGGGACG GTTTGAAACA CGGTTTTATT CATGAACAGC CGGATATTGA
1101 TTTGGAAATT GAACTTGATG AATTGGGGGT TATTGCTTTT AAAAATTCTG
1151 ACAAATTCGA TAGGGAAAAA AGGCTTTTTA GTCCTGATTA TGATGTCGAG
1201 AAAGAAAGGA AATATCAGGA ATATTTAAGT AAAGTTTATC ATCAAAATGT
1251 AGATTATGAT TATTTTTAA
```

This corresponds to the amino acid sequence <SEQ ID 2946; ORF 972>:

m972.pep

```
  1 LTNRGGAKLK TXSKSSERMS EVEYFSHFIS DGKGKLLEIP QRRGKQDGVF
 51 VDWISFTFHE DTLLKVSGCP LFSDAEYMYV LSRKLEEILG FGITRKCKSR
101 GNKFYESMYR LGSDDVDYGE VHFGXQRNTV LVELKGTGCS VASPGWELRL
151 KQFLDDSIRT RITRIDLALD FFDGEYTPDQ ALLDHDNGFF DNSNQRPKSE
201 TIGTAWRNED GSGKTFYVGR KKNSRFVRVY EKGRQLGDKE SKWVRFEIQF
251 NYGDIEIPLD ILINQGSYFC GAFPICRKFK NMPVPERFDQ RKKKLNLTFE
301 HKLHYAKNAV GKLVNFMIEM GFDNSEIVES LKADSGFPKG LEPEKYALEM
351 LRDGLKHGFI HEQPDIDLEI ELDELGVIAF KNSDKFDREK RLFSPDYDVE
401 KERKYQEYLS KVYHQNVDYD YF*
```

The following partial DNA sequence was identified in *N. meningitidis* <SEQ ID 2947>:

a972.seq

```
   1 TTGACTAACA GGGGGGGAGC GAAATTAAAA ACCAATTCCA AGAGTAGTGA
  51 ACGAATGAGT GAAGTTGAAT ATTTCTCACA CTTTATATCG GACGGAAAAG
 101 GGAAGCTTTT AGAAATTCCG CAGCGAAGAG GTAAGCAAGA CGGGGTTTTT
 151 GTTGATTGGA TTTCATTCAC ATTCCATGAA GATACTTTAC TGAAAGTTTC
 201 CGGTTGCCCT TTATTTTCTG ATGCTGAATA CATGTATGTA TTAAGCAGAA
 251 AGCTGGAAGA AATTCTAGGT TTTGGCATAA CGCGCAAATG CAAATCAAGG
 301 GGCAACAAAT TCTATGAATC CATGTATAGG TTAGGTTCGG ATGATGTTGA
 351 TTATGGAGAG GTGCATTTCG GAGGTCAGCG CAATACTGTT TTAGTTGAGT
 401 TGAAAGGTAC TGGTTGCAGC GTTGCAAGTC CGGGTTGGGA GTTGAGGCTA
 451 AAGCAGTTTC TCGATGATTC GATAAGGACA AGAATAACGC GAATTGACCT
 501 AGCACTTGAT TTTTTTGATG GAGAGTACAC GCCGGATCAG GCGTTGTTAG
 551 ATCACGATAA TGGTTTTTTT GATAACAGCA ATCAAAGGCC GAAATCTGAA
 601 ACGATCGGTA CGGCTTGGCG GAATGAGGAC GGGAGCGGCA AGACATTTTA
 651 TGTAGGTCGC AAGAAAAATT CTCGTTTTGT TCGTGTTTAT GAGAAAGGCA
 701 GGCAGCTTGG AGATAAAGAA AGCAAATGGG TAAGGTTCGA GATCCAGTTT
 751 AATTATGGAG ATATAGAAAT ACCCTTGGAT ATTTTAATAA ATCAGGGTTC
 801 GTATTTCTGT GGAGCTTTTC CAATTTGTAG AAAATTTAAA AATATGCCGG
 851 TTCCCGAAAG GTTTGATCAG AGAAAGAAAA CGCTTAATTT AACTTTCGAC
 901 CATAAATTGC ATTACGCGAA AAACGCGGTT GGAAAACTGG TCAATTTCAT
 951 GATTGAAATG GGTTTTGATA ATAGCGAAAT TGTGGAATCT TTAAAGGCAG
1001 ATTCGGGATT TCCCAAAGGA TTAGAACCTG AAAAATATGC TCTGGAAATG
1051 TTAAGGGACG GTTTGAAACA CGGTTTTATT CATGAACAGC CGGATATTGA
1101 TTTGGAAATT GAACTTGATG AATTGGGGGT TATTGCTTTT AAAAATTCTG
1151 ACAAATTCGA TAGGGAAAAA AGGCTTTTTA GTCCTGATTA TGATGTCGAG
1201 AAAGAAAGGA AATATCAGGA ATATTTAAGT AAAGTTTATC ATCAAAATGT
1251 AGATTATGAT TATTTTTAA
```

This corresponds to the amino acid sequence <SEQ ID 2948; ORF 972.a>:

a972.pep

```
  1 LTNRGGAKLK TNSKSSERMS EVEYFSHFIS DGKGKLLEIP QRRGKQDGVF
 51 VDWISFTFHE DTLLKVSGCP LFSDAEYMYV LSRKLEEILG FGITRKCKSR
101 GNKFYESMYR LGSDDVDYGE VHFGGQRNTV LVELKGTGCS VASPGWELRL
151 KQFLDDSIRT RITRIDLALD FFDGEYTPDQ ALLDHDNGFF DNSNQRPKSE
201 TIGTAWRNED GSGKTFYVGR KKNSRFVRVY EKGRQLGDKE SKWVRFEIQF
251 NYGDIEIPLD ILINQGSYFC GAFPICRKFK NMPVPERFDQ RKKTLNLTFE
301 HKLHYAKNAV GKLVNFMIEM GFDNSEIVES LKADSGFPKG LEPEKYALEM
351 LRDGLKHGFI HEQPDIDLEI ELDELGVIAF KNSDKFDREK RLFSPDYDVE
401 KERKYQEYLS KVYHQNVDYD YF*
```

m972/a972 99.3% identity in 422 aa overlap

```
                    10        20        30        40        50        60
m972.pep    LTNRGGAKLKTXSKSSERMSEVEYFSHFISDGKGKLLEIPQRRGKQDGVFVDWISFTFHE
            ||||||||||| ||||||||||||||||||||||||||||||||||||||||||||||||
a972        LTNRGGAKLKTNSKSSERMSEVEYFSHFISDGKGKLLEIPQRRGKQDGVFVDWISFTFHE
                    10        20        30        40        50        60

                    70        80        90       100       110       120
m972.pep    DTLLKVSGCPLFSDAEYMYVLSRKLEEILGFGITRKCKSRGNKFYESMYRLGSDDVDYGE
            ||||||||||||||||||||||||||||||||||||||||||||||||||||||||||||
a972        DTLLKVSGCPLFSDAEYMYVLSRKLEEILGFGITRKCKSRGNKFYESMYRLGSDDVDYGE
                    70        80        90       100       110       120

                   130       140       150       160       170       180
m972.pep    VHFGXQRNTVLVELKGTGCSVASPGWELRLKQFLDDSIRTRITRIDLALDFFDGEYTPDQ
            |||| |||||||||||||||||||||||||||||||||||||||||||||||||||||||
a972        VHFGGQRNTVLVELKGTGCSVASPGWELRLKQFLDDSIRTRITRIDLALDFFDGEYTPDQ
                   130       140       150       160       170       180

                   190       200       210       220       230       240
m972.pep    ALLDHDNGFFDNSNQRPKSETIGTAWRNEDGSGKTFYVGRKKNSRFVRVYEKGRQLGDKE
            ||||||||||||||||||||||||||||||||||||||||||||||||||||||||||||
a972        ALLDHDNGFFDNSNQRPKSETIGTAWRNEDGSGKTFYVGRKKNSRFVRVYEKGRQLGDKE
                   190       200       210       220       230       240

                   250       260       270       280       290       300
m972.pep    SKWVRFEIQFNYGDIEIPLDILINQGSYFCGAFPICRKFKNMPVPERFDQRKKKLNLTFE
            ||||||||||||||||||||||||||||||||||||||||||||||||||||| ||||||
a972        SKWVRFEIQFNYGDIEIPLDILINQGSYFCGAFPICRKFKNMPVPERFDQRKKTLNLTFE
                   250       260       270       280       290       300

                   310       320       330       340       350       360
m972.pep    HKLHYAKNAVGKLVNFMIEMGFDNSEIVESLKADSGFPKGLEPEKYALEMLRDGLKHGFI
            ||||||||||||||||||||||||||||||||||||||||||||||||||||||||||||
a972        HKLHYAKNAVGKLVNFMIEMGFDNSEIVESLKADSGFPKGLEPEKYALEMLRDGLKHGFI
                   310       320       330       340       350       360

                   370       380       390       400       410       420
m972.pep    HEQPDIDLEIELDELGVIAFKNSDKFDREKRLFSPDYDVEKERKYQEYLSKVYHQNVDYD
            ||||||||||||||||||||||||||||||||||||||||||||||||||||||||||||
a972        HEQPDIDLEIELDELGVIAFKNSDKFDREKRLFSPDYDVEKERKYQEYLSKVYHQNVDYD
                   370       380       390       400       410       420

m972.pep    YFX
            |||
a972        YFX
```

The following partial DNA sequence was identified in *N. gonorrhoeae* <SEQ ID 2949>:

g973.seq

```
  1 ATGGACGGCG CACAACCGAA AACAAATTTT TTTGAACGCC TGATTGCCCG
 51 actCGCCCGC GAACCCGATT CCGCCGAAGA CGTATTAAAC CTGCTTCGGC
101 AGGCGCACGA ACAGGAAGTT TTTGATGCCG ACACACTGAC CCGGCTGGAA
151 AAAGTATTGG ACTTTGCCGA GCTGGAAGTG CGCGATGCGA TGATTACGCG
201 CAGCCGCATG AACGTATTGA AAGAAAACGA CAGCATCGAA CGCATCACCG
251 CCTACGTCAT CGATACCGCC CATTCGCGCT TCCCCGTCAT CGGCGAAGAC
301 AAAGACGAAG TTTTGGGCAT TTTGCACGCC AAAGACCTGC TCAAATATAT
351 GTTCAACCCC GAGCAGTTCC ACCTGAAATC CGTCTTGCGC CCTGCCGTTT
401 TCGTGCCCGA AGGCAAATCT TTGACCGCCC TTTTAAAAGA GTTCCGCGAA
451 CAGCGCAACC ATATGGCAAT CGTCATCGAC GAATACGGCG GCACGTCGGG
501 TTTGGTCACC TTTGAAGACA TCATCGAGCa aatcgtcggt gacaTCGAAG
551 ACGAGTTTGA CGAAGACGAA AGCGccgacg acatCCACTC cgTTTccgCC
601 GAACGCTGGC GCATCCacgc ggctaCCGAA ATCGAAGaca TCAACGCCTT
651 TTTCGGTACG GAatacggca gcgaagaagc cgacaccatc ggcggctTGG
701 TCATTCAGGA ATTGGGACAC CTGCCCGTGC GCGGCGAAAA AGTCCTTAtc
```

-continued

```
751 ggcgGTTTGC agttcaccgt CGCCCGCGCC GACAACCGCC GCCTGCACAC
801 GCTGATGGCG ACCCGCGTGA AGTAAGCAGA GCCTGCCcgc accgccgttT
851 CTGCacAGTT TAG
```

This corresponds to the amino acid sequence <SEQ ID 2950; ORF 973.ng>:

g973.pep

```
  1 MDGAQPKTNF FERLIARLAR EPDSAEDVLN LLRQAHEQEV FDADTLTRLE
 51 KVLDFAELEV RDAMITRSRM NVLKENDSIE RITAYVIDTA HSRFPVIGED
101 KDEVLGILHA KDLLKYMFNP EQFHLKSVLR PAVFVPEGKS LTALLKEFRE
151 QRNHMAIVID EYGGTSGLVT FEDIIEQIVG DIEDEFDEDE SADDIHSVSA
201 ERWRIHAATE IEDINAFFGT EYGSEEADTI GGLVIQELGH LPVRGEKVLI
251 GGLQFTVARA DNRRLHTLMA TRVK*
```

The following partial DNA sequence was identified in *N. meningitidis* <SEQ ID 2951>:

m973.seq

```
  1 ATGGACGGCG CACAACCGAA AACGAATTTT TTTGAACGCC TGATTGCCCG
 51 ACTCGCCCGC GAACCCGATT CCGCCGAAGA CGTATTAAAC CTGCTTCGGC
101 AGGCGCACGA GCAGGAAGTT TTTGATGCGG ATACGCTTTT AAGATTGGAA
151 AAAGTCCTCG ATTTTTCCGA TTTGGAAGTG CGCGACGCGA TGATTACGCG
201 CAGCCGTATG AACGTTTTAA AAGAAAACGA CAGCATCGAG CGCATCACCG
251 CCTACGTTAT CGATACCGCC CATTCGCGCT TCCCCGTCAT CGGCGAAGAC
301 AAAGACGAAG TTTTGGGCAT TTTGCACGCC AAAGACCTGC TCAAATATAT
351 GTTTAACCCC GAGCAGTTCC ACCTCAAATC CATTCTCCGC CCCGCCGTCT
401 TCGTCCCCGA AGGCAAATCG CTGACCGCCC TTTTAAAAGA GTTCCGCGAA
451 CAGCGCAACC ATATGGCGAT TGTCATCGAC GAATACGGCG GCACATCCGG
501 CTTGGTCACC TTTGAAGACA TCATCGAGCA AATCGTCGGC GAAATCGAAG
551 ACGAGTTTGA CGAAGACGAT AGCGCCGACA ATATCCATGC CGTTTCTTCm
601 GaACGcTGGC GCATCCATGC AGCTACCGAA ATCGAAGACA TCAACACCTT
651 CTTCGGCACG GAATACAGCA kCGAAGAACC CGACACCATT GGCGGCCTGG
701 TCATTCAAGA GTTGGGACAT CTGCCCGTGC GCGGCGAAAA AGTCCTTATC
751 GGCGGTTTGC AGTTCACCGT CGCACGCGCC GACAACCGCC GCCTGCATAC
801 GCTGATGGCG ACCCGCGTGA AGTAA
```

This corresponds to the amino acid sequence <SEQ ID 2952; ORF 973>:

m973.pep

```
  1 MDGAQPKTNF FERLIARLAR EPDSAEDVLN LLRQAHEQEV FDADTLLRLE
 51 KVLDFSDLEV RDAMITRSRM NVLKENDSIE RITAYVIDTA HSRFPVIGED
```

-continued

```
101 KDEVLGILHA KDLLKYMFNP EQFHLKSILR PAVFVPEGKS LTALLKEFRE

151 QRNHMAIVID EYGGTSGLVT FEDIIEQIVG EIEDEFDEDD SADNIHAVSS

201 ERWRIHAATE IEDINTFFGT EYSXEEADTI GGLVIQELGH LPVRGEKVLI

251 GGLQFTVARA DNRRLHTLMA TRVK*
```

Computer analysis of this amino acid sequence gave the following results:

Homology with a predicted ORF from *N. gonorrhoeae*

ORF 973 shows 95.6% identity over a 274 aa overlap with a predicted ORF (ORF 973.ng) from *N. gonorrhoeae*:

m973/g973

```
                    10        20        30        40        50        60
m973.pep    MDGAQPKTNFFERLIARLAREPDSAEDVLNLLRQAHEQEVFDADTLLRLEKVLDFSDLEV
            |||||||||||||||||||||||||||||||||||||||||||||| ||||||||::|||
g973        MDGAQPKTNFFERLIARLAREPDSAEDVLNLLRQAHEQEVFDADTLTRLEKVLDFAELEV
                    10        20        30        40        50        60

                    70        80        90       100       110       120
m973.pep    RDAMITRSRMNVLKENDSIERITAYVIDTAHSRFPVIGEDKDEVLGILHAKDLLKYMFNP
            ||||||||||||||||||||||||||||||||||||||||||||||||||||||||||||
g973        RDAMITRSRMNVLKENDSIERITAYVIDTAHSRFPVIGEDKDEVLGILHAKDLLKYMFNP
                    70        80        90       100       110       120

                   130       140       150       160       170       180
m973.pep    EDFHLKSILRPAVFVPEGKSLTALLKEFREQRNHMAIVIDEYGGTSGLVTFEDIIEQIVG
            |||||||:||||||||||||||||||||||||||||||||||||||||||||||||||||
g973        EDFHLKSVLRPAVFVPEGKSLTALLKEFREQRNHMAIVIDEYGGTSGLVTFEDIIEQIVG
                   130       140       150       160       170       180

                   190       200       210       220       230       240
m973.pep    EIEDEFDEDDSADNIHAVSSERWRIHAATEIEDINTFFGTEYSXEEADTIGGLVIQELGH
            :||||||||:|||:||:||:|||||||||||||||:||||||: ||||||||||||||||
g973        EIEDEFDEDESADDIHSVSAERWRIHAATEIEDINAFFGTEYGSEEADTIGGLVIQELGH
                   190       200       210       220       230       240

                   250       260       270
m973.pep    LPVRGEKVLIGGLQFTVARADNRRLHTLMATRVKX
            |||||||||||||||||||||||||||||||||||
g973        LPVRGEKVLIGGLQFTVARADNRRLHTLMATRVKX
                   250       260       270
```

The following partial DNA sequence was identified in *N. meningitidis* <SEQ ID 2953>:

a973.seq

```
  1 ATGGACGGCG CACAACCGAA AACAAATTTT TTTGAACGCC TGATTGCCCG

 51 ACTCGCCCGC GAACCCGATT CCGCCGAAGA CGTATTGACC CTGTTGCGCC

101 AAGCGCACGA ACAGGAAGTA TTTGATGCGG ATACGCTTTT AAGATTGGAA

151 AAAGTCCTCG ATTTTTCTGA TTTGGAAGTG CGCGACGCGA TGATTACGCG

201 CAGCCGTATG AACGTTTTAA AAGAAAACGA CAGCATCGAA CGCATCACCG

251 CCTACGTTAT CGATACCGCC CATTCGCGCT TCCCCGTCAT CGGTGAAGAC

301 AAAGACGAAG TTTTGGGTAT TTTGCACGCC AAAGACCTGC TCAAATATAT

351 GTTCAACCCC GAGCAGTTCC ACCTCAAATC GATATTGCGC CCTGCCGTCT

401 TCGTCCCCGA AGGCAAATCG CTGACCGCCC TTTTAAAAGA GTTCCGCGAA

451 CAGCGCAACC ATATGGCAAT CGTCATCGAC GAATACGGCG GCACGTCGGG

501 TTTGGTAACT TTTGAAGACA TCATCGAGCA AATCGTCGGC GACATCGAAG

551 ATGAGTTTGA CGAAGACGAA AGCGCGGACA ACATCCACGC CGTTTCCGCC
```

-continued

```
601 GAACGCTGGC GCATCCACGC GGCTACCGAA ATCGAAGACA TCAACGCCTT

651 TTTCGGCACG GAATACAGCA GCGAAGAAGC CGACACCATC GGCGGCCTGG

701 TCATTCAGGA ATTGGGACAC CTGCCCGTGC GCGGCGAAAA AGTCCTTATC

751 GGCGGTTTGC AGTTCACCGT CGCCCGCGCC GACAACCGCC GCCTGCATAC

801 GCTGATGGCG ACCCGCGTGA AGTAA
```

This corresponds to the amino acid sequence <SEQ ID 2954; ORF 973.a>:

a973.pep

```
  1 MDGAQPKTNF FERLIARLAR EPDSAEDVLT LLRQAHEQEV FDADTLLRLE

 51 KVLDFSDLEV RDAMITRSRM NVLKENDSIE RITAYVIDTA HSRFPVIGED

101 KDEVLGILHA KDLLKYMFNP EQFHLKSILR PAVFVPEGKS LTALLKEFRE

151 QRNHMAIVID EYGGTSGLVT FEDIIEQIVG DIEDEFDEDE SADNIHAVSA

201 ERWRIHAATE IEDINAFFGT EYSSEEADTI GGLVIQELGH LPVRGEKVLI

251 GGLQFTVARA DNRRLHTLMA TRVK*
```

m973/a973 97.8% identity in 274 aa overlap

```
                  10        20        30        40        50        60
m973.pep   MDGAQPKTNFFERLIARLAREPDSAEDVLNLLRQAHEQEVFDADTLLRLEKVLDFSDLEV
           |||||||||||||||||||||||||||||:||||||||||||||||||||||||||||||
a973       MDGAQPKTNFFERLIARLAREPDSAEDVLTLLRQAHEQEVFDADTLLRLEKVLDFSDLEV
                  10        20        30        40        50        60
                  70        80        90       100       110       120
m973.pep   RDAMITRSRMNVLKENDSIERITAYVIDTAHSRFPVIGEDKDEVLGILHAKDLLKYMFNP
           ||||||||||||||||||||||||||||||||||||||||||||||||||||||||||||
a973       RDAMITRSRMNVLKENDSIERITAYVIDTAHSRFPVIGEDKDEVLGILHAKDLLKYMFNP
                  70        80        90       100       110       120
                 130       140       150       160       170       180
m973.pep   EQFHLKSILRPAVFVPEGKSLTALLKEFREQRNHMAIVIDEYGGTSGLVTFEDIIEQIVG
           ||||||||||||||||||||||||||||||||||||||||||||||||||||||||||||
a973       EQFHLKSILRPAVFVPEGKSLTALLKEFREQRNHMAIVIDEYGGTSGLVTFEDIIEQIVG
                 130       140       150       160       170       180
                 190       200       210       220       230       240
m973.pep   EIEDEFDEDDSADNIHAVSSERWRIHAATEIEDINTFFGTEYSXEEADTIGGLVIQELGH
           :|||||||:|||||||||:|||||||||||||||:||||||| |||||||||||||||||
a973       DIEDEFDEDESADNIHAVSAERWRIHAATEIEDINAFFGTEYSSEEADTIGGLVIQELGH
                 190       200       210       220       230       240
                 250       260       270
m973.pep   LPVRGEKVLIGGLQFTVARADNRRLHTLMATRVKX
           |||||||||||||||||||||||||||||||||||
a973       LPVRGEKVLIGGLQFTVARADNRRLHTLMATRVKX
                 250       260       270
```

The following partial DNA sequence was identified in *N. gonorrhoeae* <SEQ ID 2955>:

g981.seq

```
  1 ATGAAAAAAT GGATTGCCGC CGCCCTTGCC TGTTCCGCAC TCGCGCTGTC

 51 TGCCTGCGGC GGTCAGGGCA AAGATGCCGC CGCGCCTGCC GCCAACCCCG

101 GCAAAGTGTA CCGCGTGCCT TCCAACGCCG AGTTTGCCCC CTTTGAATCT
```

-continued

```
151 TTAGACTCGA AAGGCAATGT CGAAGGTTTC GACGTGGATT TGATGAACGC

201 GATGGCGAAG GCGGGCAATT TTAAAATCGA ATTCAAACAC CAGCCGTGGG

251 ACAGCCTTTT CCCCGCCTTG AACAACGGCG ATGCGGACGT TGTGATGTCG

301 GGCGTAACCA TTACCGACGA CCGCAAACAG TCTATGGATT TCAGCGACCC

351 GTATTTTGAA ATCACCCAAG TCGTCCTCGT TCCGAAAGGC AAAAAAGTAT
```

-continued

```
401 CTTCTTCCGA AGATTTGAAA AAGATGAACA AAGTCGGCGT GGTTACCGGC
451 CACACGGGCG ATTTCTCCGT TTCCAAACTC TTGGGCAACG ACAATCCGAA
501 AATCGCGCGC TTCGAAAACG TCCCCCTGAT TATCAAAGAA CTGGAAAACG
551 GCGGCTTGGA TTCCGTGGTC AGCGACAGCG CGGTCATCGC CAATTATGTG
601 AAAAACAACC CGGCCAAAGG AATGGACTTC GTTACCCTGC CCGACTTCAC
651 CACCGAACAC TACGGCATCG CGGTACGCAA AGGCGACGAA GCAACCGTCA
701 AAATGCTGAA CGATGCGTTG GAAAAAGTAC GCGAAAGCGG CGAATACGAC
751 AAGATCTACG CCAAATATTT TGCCAAAGAG GGCGGACACG CTGCGAAATA
801 A
```

This corresponds to the amino acid sequence <SEQ ID 2956; ORF 981.ng>:

g981.pep

```
  1 MKKWIAAALA CSALALSACG GQGKDAAAPA ANPGKVYRVA SNAEFAPFES
 51 LDSKGNVEGF DVDLMNAMAK AGNFKIEFKH QPWDSLFPAL NNGDADVVMS
101 GVTITDDRKQ SMDFSDPYFE ITQVVLVPKG KKVSSSEDLK KMNKVGVVTG
151 HTGDFSVSKL LGNDNPKIAR FENVPLIIKE LENGGLDSVV SDSAVIANYV
201 KNNPAKGMDF VTLPDFTTEH YGIAVRKGDE ATVKMLNDAL EKVRESGEYD
251 KIYAKYFAKE GGQAAK*
```

The following partial DNA sequence was identified in *N. meningitidis* <SEQ ID 2957>:

m981.seq

```
  1 ATGAAAAAAT GGATTGCCGC CGCCCTTGCC TGTTCCGCGC TCGCGCTGTC
 51 TGCCTGCGGC GGTCAGGGCA AAGATACCGC CGCGCCTGCC GCCAACCCCG
101 ACAAAGTGTA CCGCGTGGCT TCCAACGCCG AGTTTGCCCC CTTTGAATCT
151 TTAGACTCGA AAGGCAATGT CGAAGGTTTC GATGTGGATT TGATGAACGC
201 GATGGCGAAG GCGGGCAATT TTAAAATCGA ATTCAAACAC CAGCCGTGGG
251 ACAGCCTTTT CCCCGCCTTA AACAACGGCG ATGCGGACGT TGTGATGTCG
301 GGCGTAACCA TTACCGACGA CCGCAAACAG TCTATGGACT TCAGCGACCC
351 GTATTTTGAA ATCACCCAAG TCGTCCTCGT TCCGAAAGGC AAAAAAGTAT
401 CTTCTTCCGA AGATTTGAAA AACATGAACA AAGTCGGCGT GGTAACCGGC
451 TACACGGGCG ATTTCTCCGT ATCCAAACTC TTGGGCAACG ACAATCCGAA
501 AATCGCGCGC TTTGAAAACG TTCCCCTGAT TATCAAAGAA CTGGAAAACG
551 GCGGCTTGGA TTCCGTGGTC AGCGACAGCG CGGTCATCGC CAATTATGTG
601 AAAAACAATC CGGCCAAAGG GATGGACTTC GTTACCCTGC CCGACTTCAC
651 CACCGAACAC TACGGCATCG CGGTACGCAA AGGCGACGAA GCAACCGTCA
701 AAATGCTGAA CGATGCGTTG GAAAAAGTAC GCGAAAGCGG CGAATACGAC
751 AAGATTTACG CCAAATATTT TGCAAAAGAA GACGGACAGG CCGCAAAATA
801 A
```

This corresponds to the amino acid sequence <SEQ ID 2958; ORF 981>:

m981.pep

```
  1 MKKWIAAALA CSALALSACG GQGKDTAAPA ANPDKVYRVA
SNAEFAPFES

 51 LDSKGNVEGF DVDLMNAMAK AGNFKIEFKH QPWDSLFPAL
NNGDADVVMS
```

-continued

```
101 GVTITDDRKQ SMDFSDPYFE ITQVVLVPKG KKVSSSEDLK
NMNKVGVVTG

151 YTGDFSVSKL LGNDNPKIAR FENVPLIIKE LENGGLDSVV
SDSAVIANYV

201 KNNPAKGMDF VTLPDFTTEH YGIAVRKGDE ATVKMLNDAL
EKVRESGEYD

251 KIYAKYFAKE DGQAAK*
```

m981/g981 98.1% identity in 266 aa overlap

```
                  10        20        30        40        50        60
981.pep   MKKWIAAALACSALALSACGGQGKDTAAPAANPDKVYRVASNAEFAPFESLDSKGNVEGF
          ||||||||||||||||||||||||:||||||| ||||||||||||||||||||||||||||
g981      MKKWIAAALACSALALSACGGQGKDAAAPAANPGKVYRVASNAEFAPFESLDSKGNVEGF
                  10        20        30        40        50        60

                  70        80        90       100       110       120
981.pep   DVDLMNAMAKAGNFKIEFKHQPWDSLFPALNNGDADVVMSGVTITDDRKQSMDFSDPYFE
          ||||||||||||||||||||||||||||||||||||||||||||||||||||||||||||
g981      DVDLMNAMAKAGNFKIEFKHQPWDSLFPALNNGDADVVMSGVTITDDRKQSMDFSDPYFE
                  70        80        90       100       110       120

                 130       140       150       160       170       180
981.pep   ITQVVLVPKGKKVSSSEDLKNMNKVGVVTGYTGDFSVSKLLGNDNPKIARFENVPLIIKE
          ||||||||||||||||||||:|||||||||:|||||||||||||||||||||||||||||
g981      ITQVVLVPKGKKVSSSEDLKKMNKVGVVTGHTGDFSVSKLLGNDNPKIARFENVPLIIKE
                 130       140       150       160       170       180

                 190       200       210       220       230       240
981.pep   LENGGLDSVVSDSAVIANYVKNNPAKGMDFVTLPDFTTEHYGIAVRKGDEATVKMLNDAL
          ||||||||||||||||||||||||||||||||||||||||||||||||||||||||||||
g981      LENGGLDSVVSDSAVIANYVKNNPAKGMDFVTLPDFTTEHYGIAVRKGDEATVKMLNDAL
                 190       200       210       220       230       240

                 250       260
981.pep   EKVRESGEYDKIYAKYFAKEDGQAAKX
          |||||||||||||||||||| ||||||
g981      EKVRESGEYDKIYAKYFAKEGGQAAKX
                 250       260
```

The following partial DNA sequence was identified in *N. meningitidis* <SEQ ID 2959>:

a981.seq

```
  1 ATGAAAAAAT GGATTGCCGC CGCCCTTGCC TGTTCCGCGC TCGCGCTGTC
 51 TGCCTGCGGC GGTCAGGGTA AAGATGCCGC CGCGCCCGCC GCAAATCCCG
101 ACAAAGTGTA CCGCGTGGCT TCCAACGCCG AGTTTGCCCC CTTTGAATCT
151 TTAGACTCGA AAGGCAATGT CGAAGGTTTC GATGTGGATT TGATGAACGC
201 GATGGCGAAG GCGGGCAATT TTAAAATCGA ATTCAAACAC CAGCCGTGGG
251 ACAGCCTTTT CCCCGCCTTG AACAACGGCG ATGCGGACGT TGTGATGTCG
301 GGCGTAACCA TTACCGACGA CCGCAAACAG TCTATGGACT TCAGCGACCC
351 GTATTTTGAA ATCACCCAAG TCGTCCTCGT TCCGAAAGGC AAAAAAATAT
401 CTTCTTCCGA AGATTTGAAA AACATGAACA AAGTCGGCGT GGTAACCGGC
451 TACACGGGCG ATTTCTCCGT ATCCAAACTC TTGGGCAACG ACAACCCGAA
501 AATCGCGCGC TTTGAAAACG TTCCCCTGAT TATCAAAGAA CTGGAAAACG
551 GCGGCTTGGA TTCCGTGGTC AGCGACAGCG CAGTCATCGC CAATTATGTG
601 AAAAACAATC CGACCAAAGG GATGGACTTC GTTACCCTGC CCGACTTCAC
651 CACCGAACAC TACGGCATCG CGGTACGCAA AGGCGACGAA GCAACCGTCA
701 AAATGCTGAA CGATGCGTTG AAAAAAGTAC GCGAAAGCGG CGAATACGAC
```

-continued

```
751 AAAATCTACG CCAAATATTT TGCAAAAGAA GACGGACAGG CCGCAAAATA

801 A
```

This corresponds to the amino acid sequence <SEQ ID 2960; ORF 981.a>:

a981.pep

```
  1 MKKWIAAALA CSALALSACG GQGKDAAAPA ANPDKVYRVA SNAEFAPFES

 51 LDSKGNVEGF DVDLMNAMAK AGNFKIEFKH QPWDSLFPAL NNGDADVVMS

101 GVTITDDRKQ SMDFSDPYFE ITQVVLVPKG KKISSSEDLK NMNKVGVVTG

151 YTGDFSVSKL LGNDNPKIAR FENVPLIIKE LENGGLDSVV SDSAVIANYV

201 KNNPTKGMDF VTLPDFTTEH YGIAVRKGDE ATVKMLNDAL KKVRESGEYD

251 KIYAKYFAKE DGQAAK*
```

m981/a981 98.5% identity in 266 aa overlap

```
                    10        20        30        40        50        60
m981.pep    MKKWIAAALACSALALSACGGQGKDTAAPAANPDKVYRVASNAEFAPFESLDSKGNVEGF
            |||||||||||||||||||||||||:||||||||||||||||||||||||||||||||||
a981        MKKWIAAALACSALALSACGGQGKDAAAPAANPDKVYRVASNAEFAPFESLDSKGNVEGF
                    10        20        30        40        50        60
                    70        80        90       100       110       120
m981.pep    DVDLMNAMAKAGNFKIEFKHQPWDSLFPALNNGDADVVMSGVTITDDRKQSMDFSDPYFE
            ||||||||||||||||||||||||||||||||||||||||||||||||||||||||||||
a981        DVDLMNAMAKAGNFKIEFKHQPWDSLFPALNNGDADVVMSGVTITDDRKQSMDFSDPYFE
                    70        80        90       100       110       120
                   130       140       150       160       170       180
m981.pep    ITQVVLVPKGKKVSSSEDLKNMNKVGVVTGYTGDFSVSKLLGNDNPKIARFENVPLIIKE
            ||||||||||||:|||||||||||||||||||||||||||||||||||||||||||||||
a981        ITQVVLVPKGKKISSSEDLKNMNKVGVVTGYTGDFSVSKLLGNDNPKIARFENVPLIIKE
                   130       140       150       160       170       180
                   190       200       210       220       230       240
m981.pep    LENGGLDSVVSDSAVIANYVKNNPAKGMDFVTLPDFTTEHYGIAVRKGDEATVKMLNDAL
            ||||||||||||||||||||||||:|||||||||||||||||||||||||||||||||||
a981        LENGGLDSVVSDSAVIANYVKNNPTKGMDFVTLPDFTTEHYGIAVRKGDEATVKMLNDAL
                   190       200       210       220       230       240
                   250       260
m981.pep    EKVRESGEYDKIYAKYFAKEDGQAAKX
            :|||||||||||||||||||||||||
a981        KKVRESGEYDKIYAKYFAKEDGQAAKX
                   250       260
```

The following partial DNA sequence was identified in *N. gonorrhoeae* <SEQ ID 2961>:

g982.seq

```
  1 atcgcatcgc aaaaccttcg attcgacaat cgattcctcc aaaaaatggt

 51 caacggcgTg aatattttgc cggccgcCga ttgggtagcC ttgGGcgcCA

101 AAGGCCGCAA CGTGGTGGTT GACCGCGCTT TCGGCGGCCC GCACATCACC

151 AAAGACGGCG TAACCGTCGC CAAAGAAATC GAACTGAAAG ACAAGTTTGA

201 AAATATGGGC GCGCAAATGG TAAAAGAAGT CGCGTCCAAA ACCAAcgaCg

251 tagCCGgcga cggtacgact accgCCACCG TATTGGCACA ATCCATCGTT

301 GCCGAAggcA TGAAATACGT TACCGCCGGC ATGAACCCGA CCGATCTGAA

351 ACGCGGCATC GACAAAGccg ttgCCGCTtt ggttgAAGAg cTGAAAAACA

401 TCGCCAAACC TTGCGATACT TCCAAAGAAA TCGCCCAAGT CGGCTCGATT
```

-continued

```
 451 TCCGCCAACT CCGACGAACA AGtcgGCGCG ATTATCGCCG AAGCGATGGA
 501 AAAAGTCGGC AAAGAAGgcg tgattacCGT TGAAGACGGC AAATCTTTGG
 551 AAAACGAGCT GGACGTGGTT GAAGGTATGC AGTTCGACCG CGGCTACCTG
 601 TCCCCTTACT TTATCAACGA CGCGGAAAAA CAAATCGCCG GTCTGGACAA
 651 TCCGTTTGTT TTGCTGTTCG ACAAAAAAAT CAGCAACATC CGCGACCTGC
 701 TGCCCGTGTT GGAACAAGTG GCGAAAGCCA GCCGCCCGCT GTTGATTATC
 751 GCTGAAGACG TAGAAGGCGA AGCCTTGGCG ACTTTGGTCG TGAACAACAT
 801 CCGCGGCATC CTGAAAACCG TTGCCGTCAA AGCccccggc tTCGGcGACC
 851 GCCGCAAAGC GATgctgcaa gaCATCGCCA TCCTGACcqg cggcgTagtG
 901 ATTtccGAAG Aagtcggcct GTCTTTGGAA AAAgcgactT TGgacgaCTT
 951 Gggtcaaacc aaACGcatCG AAATCGGtga agaaaacact ACCGTCATcg
1001 acgGCTTCGG CGACGcagcC CAAAtcgaag cgCGTGTTGC CGAAATCCGC
1051 CAACAAATCG AAACCGCGAC CAGCGATTAC GACAAAGAAA AACTGCAAGA
1101 GCGCGTTGCC AAACTGGCAG GAGGCGTGGC AGTGATCAAA GTCGGCGCGG
1151 CGACCGAAGT CGAAATGAAA GAGAAAAAAG ACCGCGTGGA AGACGCGCTG
1201 CACGCTACCC GCGCAGCCGT TGAAGAAGGC GTGGTTGCAG GCGGCGGCGT
1251 AGCCCTGTTG CGCGCCCGTG CCGCTTTGGA AAACCTGCAC ACCGGCAATG
1301 CCGACCAAGA CGCAGGCGTA CAAATCGTAT TGCGCGCCGT TGAGTCTCCG
1351 CTGCGCCAAA TCGTTGCCAA CGCAGGCGGA GAACCCAGCG TGGTGGTGAA
1401 CAAAGTGTTG GAAGGCAAAG GCAactacgG TTACAACGCa ggctcCGGCG
1451 AATACGgcga CATGATCGGA ATGGGCGTAC TCGACCCTGC CAAAGTAACC
1501 CGTTCCGCGC TGCAACACGC CGCGTCTAtC GCCGGTCTGA TGCTGACGAC
1551 CGACTGCATG ATTGCCGAAA TCCCTGAAGA AAAACCGGCT GTGCCCGATA
1601 TGGGGGGAAT GGGCGGTATG GGCGGCATGA TGTAA
```

This corresponds to the amino acid sequence <SEQ ID 2962; ORF 982.ng>:

<u>g982.pep</u>

```
  1 IASQNLRFDN RFLQKMVNGV NILPAADWVA LGAKGRNVVV DRAFGGPHIT
 51 KDGVTVAKEI ELKDKFENMG AQMVKEVASK TNDVAGDGTT TATVLAQSIV
101 AEGMKYVTAG MNPTDLKRGI DKAVAALVEE LKNIAKPCDT SKEIAQVGSI
151 SANSDEQVGA IIAEAMEKVG KEGVITVEDG KSLENELDVV EGMQFDRGYL
201 SPYFINDAEK QIAGLDNPFV LLFDKKISNI RDLLPVLEQV AKASRPLLII
251 AEDVEGEALA TLVVNNIRGI LKTVAVKAPG FGDRRKAMLQ DIAILTGGVV
301 ISEEVGLSLE KATLDDLGQT KRIEIGEENT TVIDGFGDAA QIEARVAEIR
351 QQIETATSDY DKEKLQERVA KLAGGVAVIK VGAATEVEMK EKKDRVEDAL
401 HATRAAVEEG VVAGGGVALL RARAALENLH TGNADQDAGV QIVLRAVESP
451 LRQIVANAGG EPSVVVNKVL EGKGNYGYNA GSGEYGDMIG MGVLDPAKVT
501 RSALQHAASI AGLMLTTDCM IAEIPEEKPA VPDMGGMGGM GGMM*
```

The following partial DNA sequence was identified in *N. meningitidis* <SEQ ID 2963>:

m982.seq

```
   1 ATGGCAGCAA AAGACGTACA GTTCGGCAAT GAAGTCCGTC AAAAAATGGT
  51 AAACGGCGTG AACATTCTGG CAAACGCCGT CCGCGTAACC TTGGGCCCCA
 101 AAGGTCGCAA CGTAGTCGTT GACCGCGCAT TCGGCGGCCC GCACATCACC
 151 AAAGACGGCG TAACCGTCGC CAAAGAAATC GAACTGAAAG ACAAGTTTGA
 201 AAATATGGGC GCGCAAATGG TGAAAGAAGT TGCGTCCAAA ACCAACGACG
 251 TGGCAGGCGA CGGTACGACT ACCGCCACCG TACTGGCGCA ATCCATCGTT
 301 GCCGAAGGTA TGAAATATGT TACCGCAGGT ATGAATCCGA CCGACCTGAA
 351 ACGCGGTATC GATAAAGCCG TCGCCGCTTT GGTTGACGAA CTGAAAAACA
 401 TCGCCAAACC TTGCGACACT TCTAAAGAAA TCGCCCAAGT CGGCTCTATT
 451 TCCGCCAACT CCGACGAACA AGTCGGCGCG ATTATCGCCG AAGCGATGGA
 501 AAAAGTCGGC AAAGAAGGCG TGATTACCGT TGAAGACGGC AAGTCTTTGG
 551 AAAACGAGCT GGACGTAGTT GAAGGTATGC AGTTCGACCG CGGCTACCTG
 601 TCTCCTTACT TCATCAACGA TGCGGAAAAA CAAATCGCTG CTTTGGACAA
 651 TCCGTTTGTA TTGTTGTTCG ACAAAAAAAT CAGCAACATC CGCGACCTGC
 701 TGCCTGTTTT GGAACAAGTG GCAAAAGCCA GCCGTCCGCT GTTGATTATC
 751 GCTGAAGACG TAGAAGGCGA AGCCTTGGCG ACTTTGGTCG TGAACAACAT
 801 CCGAGGCATC CTGAAAACCG TTGCCGTCAA AGCCCCTGGC TTCGGCGACC
 851 GCCGCAAAGC GATGTTGCAA GACATCGCCA TCCTGACCGG CGGCGTGGTG
 901 ATTTCCGAAG AAGTCGGTCT GTCTTTGGAA AAAGCGACTT TGGACGACTT
 951 GGGTCAAGCC AAACGCATCG AAATCGGTAA AGAAAACACC ACCATCATCG
1001 ACGGCTTTGG CGACGCAGCC CAAATCGAAG CGCGTGTTGC CGAAATCCGC
1051 CAACAAATCG AAACCGCAAC CAGCGATTAC GACAAAGAAA AACTGCAAGA
1101 GCGCGTGGCT AAATTGGCAG GCGGCGTGGC AGTCATCAAA GTCGGTGCCG
1151 CGACCGAAGT CGAAATGAAA GAGAAAAAAG ACCGCGTGGA AGACGCGCTG
1201 CACGCTACCC GCGCAGCCGT TGAAGAAGGC GTGGTTGCAG GCGGCGGCGT
1251 AGCCCTGTTG CGTGCCCGTG CTGCTTTGGA AAACCTGCAC ACCGGCAATG
1301 CCGACCAAGA CGCAGGCGTA CAAATCGTCT TGCGCGCCGT TGAGTCTCCG
1351 CTGCGCCAAA TCGTTGCCAA CGCAGGCGGC GAACCCAGCG TGGTTGTGAA
1401 CAAAGTATTG GAAGGCAAAG GCAACTACGG TTACAACGCT GGCAGCGGCG
1451 AATACGGCGA TATGATCGAA ATGGGCGTAC TCGACCCCGC CAAAGTAACC
1501 CGTTCTGCGC TGCAACACGC CGCATCTATC GCCGGCTTGA TGCTGACCAC
1551 TGATTGCATG ATCGCTGAAA TCCCCGAAGA CAAACCGGCT GTGCCTGATA
1601 TGGGCGGCAT GGGTGGTATG GGCGGCATGA TGTAA
```

This corresponds to the amino acid sequence <SEQ ID 2964; ORF 982>:

m982.seq

```
   1 ATGGCAGCAA AAGACGTACA GTTCGGCAAT GAAGTCCGTC AAAAAATGGT
  51 AAACGGCGTG AACATTCTGG CAAACGCCGT CCGCGTAACC TTGGGCCCCA
 101 AAGGTCGCAA CGTAGTCGTT GACCGCGCAT TCGGCGGCCC GCACATCACC
 151 AAAGACGGCG TAACCGTCGC CAAAGAAATC GAACTGAAAG ACAAGTTTGA
 201 AAATATGGGC GCGCAAATGG TGAAAGAAGT TGCGTCCAAA ACCAACGACG
 251 TGGCAGGCGA CGGTACGACT ACCGCCACCG TACTGGCGCA ATCCATCGTT
 301 GCCGAAGGTA TGAAATATGT TACCGCAGGT ATGAATCCGA CCGACCTGAA
 351 ACGCGGTATC GATAAAGCCG TCGCCGCTTT GGTTGACGAA CTGAAAAACA
 401 TCGCCAAACC TTGCGACACT TCTAAAGAAA TCGCCCAAGT CGGCTCTATT
 451 TCCGCCAACT CCGACGAACA AGTCGGCGCG ATTATCGCCG AAGCGATGGA
 501 AAAAGTCGGC AAAGAAGGCG TGATTACCGT TGAAGACGGC AAGTCTTTGG
 551 AAAACGAGCT GGACGTAGTT GAAGGTATGC AGTTCGACCG CGGCTACCTG
 601 TCTCCTTACT TCATCAACGA TGCGGAAAAA CAAATCGCTG CTTTGGACAA
 651 TCCGTTTGTA TTGTTGTTCG ACAAAAAAAT CAGCAACATC CGCGACCTGC
 701 TGCCTGTTTT GGAACAAGTG GCAAAAGCCA GCCGTCCGCT GTTGATTATC
 751 GCTGAAGACG TAGAAGGCGA AGCCTTGGCG ACTTTGGTCG TGAACAACAT
 801 CCGAGGCATC CTGAAAACCG TTGCCGTCAA AGCCCCTGGC TTCGGCGACC
 851 GCCGCAAAGC GATGTTGCAA GACATCGCCA TCCTGACCGG CGGCGTGGTG
 901 ATTTCCGAAG AAGTCGGTCT GTCTTTGGAA AAAGCGACTT TGGACGACTT
 951 GGGTCAAGCC AAACGCATCG AAATCGGTAA AGAAAACACC ACCATCATCG
1001 ACGGCTTTGG CGACGCAGCC CAAATCGAAG CGCGTGTTGC CGAAATCCGC
1051 CAACAAATCG AAACCGCAAC CAGCGATTAC GACAAAGAAA AACTGCAAGA
1101 GCGCGTGGCT AAATTGGCAG GCGGCGTGGC AGTCATCAAA GTCGGTGCCG
1151 CGACCGAAGT CGAAATGAAA GAGAAAAAAG ACCGCGTGGA AGACGCGCTG
1201 CACGCTACCC GCGCAGCCGT TGAAGAAGGC GTGGTTGCAG GCGGCGGCGT
1251 AGCCCTGTTG CGTGCCCGTG CTGCTTTGGA AAACCTGCAC ACCGGCAATG
1301 CCGACCAAGA CGCAGGCGTA CAAATCGTCT TGCGCGCCGT TGAGTCTCCG
1351 CTGCGCCAAA TCGTTGCCAA CGCAGGCGGC GAACCCAGCG TGGTTGTGAA
1401 CAAAGTATTG GAAGGCAAAG GCAACTACGG TTACAACGCT GGCAGCGGCG
1451 AATACGGCGA TATGATCGAA ATGGGCGTAC TCGACCCCGC CAAAGTAACC
1501 CGTTCTGCGC TGCAACACGC CGCATCTATC GCCGGCTTGA TGCTGACCAC
1551 TGATTGCATG ATCGCTGAAA TCCCCGAAGA CAAACCGGCT GTGCCTGATA
1601 TGGGCGGCAT GGGTGGTATG GGCGGCATGA TGTAA
```

Computer analysis of this amino acid sequence gave the following results:

Homology with a predicted ORF from *N. gonorrhoeae* m982/g982 95.8% identity in 544 aa overlap

```
                    10        20        30        40        50        60
m982.pep    MAAKDVQFGNEVRQKMVNGVNILANAVRVTLGPKGRNVVVDRAFGGPHITKDGVTVAKEI
            :|:::::| |:  |||||||||  |   |:|| ||||||||||||||||||||||||||
g982        IASQNLRFDNRFLQKMVNGVNILPAADWVALGAKGRNVVVDRAFGGPHITKDGVTVAKEI
                    10        20        30        40        50        60
```

-continued

```
                 70        80        90       100       110       120
m982.pep  ELKDKFENMGAQMVKEVASKTNDVAGDGTTTATVLAQSIVAEGMKYVTAGMNPTDLKRGI
          ||||||||||||||||||||||||||||||||||||||||||||||||||||||||||||
g982      ELKDKFENMGAQMVKEVASKTNDVAGDGTTTATVLAQSIVAEGMKYVTAGMNPTDLKRGI
                 70        80        90       100       110       120

                130       140       150       160       170       180
m982.pep  DKAVAALVDELKNIAKPCDTSKEIAQVGSISANSDEQVGAIIAEAMEKVGKEGVITVEDG
          |||||||:||||||||||||||||||||||||||||||||||||||||||||||||||||
g982      DKAVAALVEELKNIAKPCDTSKEIAQVGSISANSDEQVGAIIAEAMEKVGKEGVITVEDG
                130       140       150       160       170       180

                190       200       210       220       230       240
m982.pep  KSLENELDVVEGMQFDRGYLSPYFINDAEKQIAALDNPFVLLFDKKISNIRDLLPVLEQV
          ||||||||||||||||||||||||||||||||||:|||||||||||||||||||||||||
g982      KSLENELDVVEGMQFDRGYLSPYFINDAEKQIAGLDNPFVLLFDKKISNIRDLLPVLEQV
                190       200       210       220       230       240

                250       260       270       280       290       300
m982.pep  AKASRPLLIIAEDVEGEALATLVVNNIRGILKTVAVKAPGFGDRRKAMLQDIAILTGGVV
          ||||||||||||||||||||||||||||||||||||||||||||||||||||||||||||
g982      AKASRPLLIIAEDVEGEALATLVVNNIRGILKTVAVKAPGFGDRRKAMLQDIAILTGGVV
                250       260       270       280       290       300

                310       320       330       340       350       360
m982.pep  ISEEVGLSLEKATLDDLGQAKRIEIGKENTTIIDGFGDAAQIEARVAEIRQQIETATSDY
          |||||||||||||||||||:||||||:||||:||||||||||||||||||||||||||||
g982      ISEEVGLSLEKATLDDLGQTKRIEIGEENTTVIDGFGDAAQIEARVAEIRQQIETATSDY
                310       320       330       340       350       360

                370       380       390       400       410       420
m982.pep  DKEKLQERVAKLAGGVAVIKVGAATEVEMKEKKDRVEDALHATRAAVEEGVVAGGGVALL
          ||||||||||||||||||||||||||||||||||||||||||||||||||||||||||||
g982      DKEKLQERVAKLAGGVAVIKVGAATEVEMKEKKDRVEDALHATRAAVEEGVVAGGGVALL
                370       380       390       400       410       420

                430       440       450       460       470       480
m982.pep  RARAALENLHTGNADQDAGVQIVLRAVESPLRQIVANAGGEPSVVVNKVLEGKGNYGYNA
          ||||||||||||||||||||||||||||||||||||||||||||||||||||||||||||
g982      RARAALENLHTGNADQDAGVQIVLRAVESPLRQIVANAGGEPSVVVNKVLEGKGNYGYNA
                430       440       450       460       470       480

                490       500       510       520       530       540
m982.pep  GSGEYGDMIEMGVLDPAKVTRSALQHAASIAGLMLTTDCMIAEIPEDKPAVPDMGGMGGM
          ||||||||| ||||||||||||||||||||||||||||||||||||:|||||||||||||
g982      GSGEYGDMIGMGVLDPAKVTRSALQHAASIAGLMLTTDCMIAEIPEEKPAVPDMGGMGGM
                490       500       510       520       530       540

m982.pep  GGMMX
          |||||
g982      GGMMX
```

The following partial DNA sequence was identified in *N. meningitidis* <SEQ ID 2965>:

<u>a982.seq</u>

```
  1 ATGGCAGCAA AAGACGTACA ATTCGGCAAT GAAGTCCGCC AAAAAATGGT
 51 AAACGGCGTG AACATTTTGG CAAACGCCGT GCGCGTAACC TTGGGTCCCA
101 AAGGCCGCAA CGTGGTGGTT GACCGCGCTT TCGGCGGCCC GCACATCACC
151 AAAGACGGCG TAACCGTCGC CAAAGAAATC GAACTGAAAG ACAAGTTTGA
201 AAATATGGGC GCGCAAATGG TGAAAGAAGT CGCGTCCAAA ACCAACGACG
251 TGGCGGGCGA CGGTACGACT ACCGCCACCG TATTGGCGCA ATCCATCGTT
301 GCCGAAGGTA TGAAATACGT TACCGCCGGT ATGAACCCGA CCGACCTGAA
351 ACGCGGTATC GACAAAGCCG TCGCCGCTTT GGTTGAAGAG CTGAAAAACA
401 TCGCCAAACC TTGCGACACT TCTAAAGAAA TCGCCCAAGT CGGCTCTATT
451 TCCGCCAACT CTGACGAACA AGTCGGCGCG ATTATTGCCG AAGCGATGGA
501 AAAAGTCGGC AAAGAAGGCG TGATTACCGT TGAAGACGGC AAATCTTTGG
551 AAAACGAGCT GGACGTGGTT GAAGGTATGC AATTCGACCG CGGCTACCTG
601 TCTCCTTACT TCATCAACGA TGCGGAAAAA CAAATCGCCG GCTTGGACAA
651 TCCGTTTGTA TTGCTGTTCG ACAAAAAAAT CAGCAATATC CGCGACCTGC
```

-continued

```
 701 TGCCTGTTTT GGAACAAGTG GCCAAAGCCA GCCGTCCGCT GTTGATTATC
 751 GCTGAAGACG TAGAAGGCGA AGCCTTGGCG ACTTTGGTCG TGAACAACAT
 801 CCGCGGCATT CTGAAAACCG TTGCCGTTAA AGCTCCGGGC TTCGGCGACC
 851 GCCGCAAAGC GATGCTGCAA GACATCGCTA TCCTGACCGG CGGCACAGTG
 901 ATTTCCGAAG AAGTCGGCCT GTCTTTGGAA AAAGCGACTT TGGACGACTT
 951 GGGTCAGGCC AAACGCATCG AAATCGGTAA AGAAAACACC ACCATCATCC
1001 ACGGCTTCGG CGACGCAGCC CAAATCGAAC CGCGTGTTGC CGAAATCCGC
1051 CAACAAATCG AAACCGCAAC CAGCGATTAC GACAAAGAAA AACTGCAAGA
1101 GCGCGTTGCC AAACTGGCAG GCGGCGTGGC AGTAATCAAA GTCGGTGCCG
1151 CGACCGAAGT GGAAATGAAA GAGAAAAAAG ACCGCGTGGA AGACGCGCTG
1201 CACGCTACCC GCGCAGCCGT TGAAGAAGGC GTGGTTGCAG GCGGCGGCGT
1251 AGCCCTGTTG CGCGCCCGTG CCGCTCTGGA AAACCTGCAC ACCGGCAATG
1301 CAGACCAAGA CGCAGGCGTA CAAATCGTCT TGCGCGCCGT TGAGTCTCCG
1351 CTGCGCCAAA TCGTTGCCAA CCCAGGCGGC CAACCCAGCG TGGTTGTGAA
1401 CAAAGTGTTG GAAGGCAAAG GCAACTATGG TTACAACGCT GGCAGCGGCG
1451 AATACGGCGA CATGATCGAA ATGGGCGTAC TCGACCCCGC CAAAGTAACC
1501 CGTTCCGCGC TGCAACACGC CGCGTCTATC GCCGGCCTGA TGCTGACCAC
1551 ACACTGCATC ATTGCTGAAA TCCCTGAAGA CAAACCGGCT ATGCCTGATA
1601 TCGGCGGCAT GGGTGGTATG GGCGGCATGA TGTAA
```

This corresponds to the amino acid sequence <SEQ ID 2966; ORF 982.a>:

a982.pep

```
  1 MAAKDVQFGN EVRQKMVNGV NILANAVRVT LGPKGRNVVV DRAFGGPHIT
 51 KDGVTVAKEI ELKDKFENMG AQMVKEVASK TNDVAGDGTT TATVLAQSIV
101 AEGMKYVTAG MNPTDLKRGI DKAVAALVEE LKNIAKPCDT SKEIAQVGSI
151 SANSDEQVGA IIAEAMEKVG KEGVITVEDG KSLENELDVV EGMQFDRGYL
201 SPYFINDAEK QIAGLDNPFV LLFDKKISNI RDLLPVLEQV AKASRPLLII
251 AEDVEGEALA TLVVNNIRGI LKTVAVKAPG FGDRRKAMLQ DIAILTGGTV
301 ISEEVGLSLE KATLDDLGQA KRIEIGKENT TIIDGFGDAA QIEARVAEIR
351 QQIETATSDY DKEKLQERVA KLAGGVAVIK VGAATEVEMK EKKDRVEDAL
401 HATRAAVEEG VVAGGGVALL RARAALENLH TGNADQDAGV QIVLRAVESP
451 LRQIVANAGG EPSVVVNKVL EGKGNYGYNA GSGEYGDMIE MGVLDPAKVT
501 RSALQHAASI AGLMLTTDCM IAEIPEDKPA MPDMGGMGGM GGMM*
```

m982/a982 99.3% identity in 544 aa overlap

```
                   10        20        30        40        50        60
m982.pep   MAAKDVQFGNEVRQKMVNGVNILANAVRVTLGPKGRNVVVDRAFGGPHITKDGVTVAKEI
           ||||||||||||||||||||||||||||||||||||||||||||||||||||||||||||
a982       MAAKDVQFGNEVRQKMVNGVNILANAVRVTLGPKGRNVVVDRAFGGPHITKDGVTVAKEI
                   10        20        30        40        50        60
```

-continued

```
                 70        80        90       100       110       120
m982.pep  ELKDKFENMGAQMVKEVASKTNDVAGDGTTTATVLAQSIVAEGMKYVTAGMNPTDLKRGI
          ||||||||||||||||||||||||||||||||||||||||||||||||||||||||||||
a982      ELKDKFENMGAQMVKEVASKTNDVAGDGTTTATVLAQSIVAEGMKYVTAGMNPTDLKRGI
                 70        80        90       100       110       120

                130       140       150       160       170       180
m982.pep  DKAVAALVDELKNIAKPCDTSKEIAQVGSISANSDEQVGAIIAEAMEKVGKEGVITVEDG
          |||||||:||||||||||||||||||||||||||||||||||||||||||||||||||||
a982      DKAVAALVDELKNIAKPCDTSKEIAQVGSISANSDEQVGAIIAEAMEKVGKEGVITVEDG
                130       140       150       160       170       180

                190       200       210       220       230       240
m982.pep  KSLENELDVVEGMQFDRGYLSPYFINDAEKQIAALDNPFVLLFDKKISNIRDLLPVLEQV
          |||||||||||||||||||||||||||||||||:||||||||||||||||||||||||||
a982      KSLENELDVVEGMQFDRGYLSPYFINDAEKQIAGLDNPFVLLFDKKISNIRDLLPVLEQV
                190       200       210       220       230       240

                250       260       270       280       290       300
m982.pep  AKASRPLLIIAEDVEGEALATLVVNNIRGILKTVAVKAPGFGDRRKAMLQDIAILTGGVV
          ||||||||||||||||||||||||||||||||||||||||||||||||||||||||||:|
a982      AKASRPLLIIAEDVEGEALATLVVNNIRGILKTVAVKAPGFGDRRKAMLQDIAILTGGTV
                250       260       270       280       290       300

                310       320       330       340       350       360
m982.pep  ISEEVGLSLEKATLDDLGQAKRIEIGKENTTIIDGFGDAAQIEARVAEIRQQIETATSDY
          ||||||||||||||||||||||||||||||||||||||||||||||||||||||||||||
a982      ISEEVGLSLEKATLDDLGQAKRIEIGKENTTIIDGFGDAAQIEARVAEIRQQIETATSDY
                310       320       330       340       350       360

                370       380       390       400       410       420
m982.pep  DKEKLQERVAKLAGGVAVIKVGAATEVEMKEKKDRVEDALHATRAAVEEGVVAGGGVALL
          ||||||||||||||||||||||||||||||||||||||||||||||||||||||||||||
a982      DKEKLQERVAKLAGGVAVIKVGAATEVEMKEKKDRVEDALHATRAAVEEGVVAGGGVALL
                370       380       390       400       410       420

                430       440       450       460       470       480
m982.pep  RARAALENLHTGNADQDAGVQIVLRAVESPLRQIVANAGGEPSVVVNKVLEGKGNYGYNA
          ||||||||||||||||||||||||||||||||||||||||||||||||||||||||||||
a982      RARAALENLHTGNADQDAGVQIVLRAVESPLRQIVANAGGEPSVVVNKVLEGKGNYGYNA
                430       440       450       460       470       480

                490       500       510       520       530       540
m982.pep  GSGEYGDMIEMGVLDPAKVTRSALQHAASIAGLMLTTDCMIAEIPEDKPAVPDMGGMGGM
          ||||||||||||||||||||||||||||||||||||||||||||||||||:|||||||||
a982      GSGEYGDMIEMGVLDPAKVTRSALQHAASIAGLMLTTDCMIAEIPEDKPAMPDMGGMGGM
                490       500       510       520       530       540

m982.pep  GGMMX
          |||||
a982      GGMMX
```

The following partial DNA sequence was identified in *N. gonorrhoeae* <SEQ ID 2967>:

g986.seq

```
  1 GTGTTCAAAA AATACCAATA CTTCGCTTTG GCGGCACTGT GTGCCGCCTT
 51 GCTGGCAGGC TGGGAAAAGG CAGGCAGCTT TTTCGGTGCG GACAAAAAAG
101 AAGCATCCTT CGTAGAACGC ATCGAACACA CCAAAGACGA CGGCAGTGTC
151 AGTATGCTGC TGCCCGACTT TGCCCAACTG GTTCAAAGCG AAGGCCCGGC
201 AGTCGTCAAT ATTCAGGCAG CCCCCGCCCC GCGCACCCAA AACGGCAGCG
251 GCAATGCCGA AACCGATTCC GACCCGCTTG CCGACAGCGA CCCGTTCTAC
301 GAATTTTTCA AACGCCTCGT CCCGAACATG CCCGAAATCC CCCAAGAAGA
351 AGCAGATGAC GGCGGATTGA ACTTCGGTTC GGGCTTCATC ATCAGCAAAA
401 ACGGCTACAT CCTGACCAAT ACCCACGTCG TTGCCGGTAT GGGCAGTATC
451 AAAGTCCTGC TCAACGACAA GCGCGAATAT ACCGCCAAAC TCATCGGTTC
501 GGATGTCCAA TCCGATGTCG CCCTTCTGAA AATCGACGCA ACGGAAGAGC
551 TACCCGTCGT CAAAATCGGC AATCCCAAAA ATTTGAAACC GGGCGAATGC
601 GTCGCTGCCA TCGGCGCGCC CTTCGGCTTT GACAACAGCG TGACCCCCGG
651 CATCGTGTCC GCCAAAGGCA GAAGCCTGCC CAACGAAAgc tACACACCCT
```

-continued

```
 701 TCATCCAAAC CGACGTTGCC ATCAATCCGG GCAATTCCGG CGGCCCGCTG
 751 TTCAACTTAA AAGGACAGGt cgTCGGCATC AATTCGCAAA TATACAGCCG
 801 CAGCGgcqga ttCATGGGCA TCTCCTTTGC CATCCCGATT GACGTTGCCA
 851 TGAATGTCGC CGAACAGCTG AAAAACACCG GCAAAGTCCA ACGCGGACAA
 901 CTGGGCGTGA TTATTCAGGA AGTATCCTAC GGTTTGGCAC AGTCGTTCGG
 951 TCTGGATAAA GCCAGCGGCG CATTGATTGC CAAAATCCTT CCCGGCAGCC
1001 CCGCAGAACG TGCCGGCCTG CAGGCGGGCG ACATCGTCCT CAGCCTCGAC
1051 GGCGGAGAAA TACGTTCTTC CGGCGACCTT CCCGTCATGG TCGGCGCCAT
1101 TACGCCGGGA AAAGAAGTCA GCCTCGGCGT ATGGCGCAAA GGCGAAGAAA
1151 TCACAATCAA AGCCAAGCTG GGCAACGCCg ccgagcATAC CGGCgcatCA
1201 TCCAAAACAG ATGAAgcccc ctacaccgAA CAGCAATCCG GTACGTTCTC
1251 GGTCGAATCC GCAGGCATTA CCCTTCAGAC ACATACCGAC AGCAGCGGca
1301 aacacctcgt cgtcgtacgg gtttccgacg cggcagaacg cGCAGGCTTA
1351 AGgcgcggcg acgaaatcct cgcggtcggg caagtccccg tcaatgacga
1401 agccgGTTTC cgcaaaGCTA TGGACAAGGC AGGCAAAAAC GTCCCCCTGC
1451 TGGTCAtgcg ccgTGGCAAC ACGCTGTTCA TCGCATTAAA CCTGCAATAA
```

This corresponds to the amino acid sequence <SEQ ID 2968; ORF 986.ng>:

g986.pep

```
  1 VFKKYQYFAL AALCAALLAG CEKAGSFFGA DKKEASFVER IEHTKDDGSV
 51 SMLLPDFAQL VQSEGPAVVN IQAAPAPRTQ NGSGNAETDS DPLADSDPFY
101 EFFKRLVPNM PEIPQEEADO GGLNFGSGFI ISKNGYILTN THVVAGMGSI
151 KVLLNDKREY TAKLIGSDVQ SDVALLKIDA TEELPVVKIG NPKNLKPGEW
201 VAAIGAPFGF DNSVTAGIVS AKGRSLPNES YTPFIQTDVA INPGNSGGPL
251 FNLKGQVVGI NSQIYSRSGG FMGISFAIPI DVAMNVAEQL KNTGKVQRGQ
301 LGVIIQEVSY GLAQSFGLDK ASGALIAKIL PGSPAERAGL QAGDIVLSLD
351 GGEIRSSGDL PVMVGAITPG KEVSLGVWRK GEEITIKAKL GNAAEHTGAS
401 SKTDEAPYTE QQSGTFSVES AGITLQTHTD SSGKHLVVVR VSDAAERAGL
451 RRGDEILAVG QVPVNDEAGF RKANDKAGKN VPLLVMRRGN TLFIALNLQ*
```

The following partial DNA sequence was identified in *N. meningitidis* <SEQ ID 2969>:

m986.seq

```
  1 GTGTTCAAAA AATACCAATA CCTCGCTTTG GCAGCACTGT GTGCAGCCTC
 51 GCTGGCAGGC TGCGACAAGG CAGGCAGCTT CTTCGTGGCG GACAAAAAAG
101 AAGCATCCTT CGTAGAACGC ATCGAACACA CCAAAGACGA CGGCAGCGTC
151 AGTATGCTGC TGCCCGACTT TGCCCAACTG GTTCAAAGTG AAGGTCCGGC
201 AGTCGTCAAT ATTCAGGCAG CCCCCGCCCC GCGCACCCAA AACGGCAGCG
251 GCAATGCCGA AAACGATTCC GACCCGATTG CCGACAACGA CCCGTTCTAC
```

-continued

```
 301 GAATTTTTCA AACGCCTCGT CCCGAATATG CCCGAAATCC CCCAAGAAGA
 351 AGCAGATGAC GGCGGATTGA ACTTCGGTTC GGGCTTCATC ATCAGCAAAG
 401 ACGGCTACAT CCTGACCAAT ACCCACGTCG TTACCGGCAT GGGCAGTATC
 451 AAAGTCCTGC TCAACGACAA GCGCGAATAT ACCGCCAAAC TCATCGGTTC
 501 GGATGTCCAA TCCGATGTCG CCCTTCTGAA AATCGACGCA ACGGAAGACC
 551 TGCCCGTCGT CAAAATCGGC AATCCCAAAG ATTTGAAACC GGGCGAATGG
 601 GTCGCCGCCA TCGGCGCGCC CTTCGGCTTC GACAACAGCG TGACCGCCGG
 651 CATCGTGTCC GCCAAAGGCA GAAGCCTGCC CAACGAAACC TACACACCCT
 701 TCATCCAAAC CGACGTTGCC ATCAATCCGG GCAACTCCGG CGGCCCGCTG
 751 TTCAACTTAA AAGGACAGGT CGTCGGCATC AACTCGCAAA TATACAGCCG
 801 CACCGGCGGA TTCATGGGCA TTTCCTTCGC CATCCCGATT GACGTTGCCA
 851 TGAATGTCGC CGAACAGCTG AAAAACACCG GCAAAGTCCA ACGCGGACAA
 901 CTGGGCGTGA TTATTCAAGA AGTATCCTAC GGTTTGGCAC AATCGTTCGG
 951 TTTGGACAAA GCCGGCGGCG CACTGATTGC CAAAATCCTG CCCGGCAGCC
1001 CCGCAGAACG TGCCGGCCTG CAGGCGGGCG ACATCGTCCT CAGCCTCGAC
1051 GGCGGAGAAA TACGTTCTTC CGGCGACCTT CCCCTTATGG TCGGCGCCAT
1101 TACGCCGGGA AAAGAAGTCA GCCTCGGCGT ATGGCGCAAA GGCGAAGAAA
1151 TCACAATCAA AGTCAAGCTG GGCAACGCCG CCGAGCATAT CGGCGCATCA
1201 TCCAAAACAG ATGAAGCCCC CTACACCGAA CAGCAATCCG GTACGTTCTC
1251 GGTCGAATCC GCAGGCATTA CCCTTCAGAC ACATACCGAC AGCAGCGGCG
1301 GACACCTCGT CGTCGTACGG GTTTCCGACG CGGCAGAACG CGCAGGCTTG
1351 AGGCGCGGCG ACGAAATTCT TGCCGTCGGG CAAGTCCCCG TCAATGACGA
1401 AGCCGGTTTC CGCAAAGCTA TGGACAAGGC AGGCAAAAAC GTCCCCCTGC
1451 TGATCATGCG CCGTGGCAAC ACGCTGTTTA TCGCATTAAA CCTGCAATAA
```

This corresponds to the amino acid sequence <SEQ ID 2970; ORF 986>:

m986.pep . . .

```
  1 VFKKYQYLAL AALCAASLAG CDKAGSFFVA DKKEASFVER IEHTKDDGSV
 51 SMLLPDFAQL VQSEGPAVVN IQAAPAPRTQ NGSGNAENDS DPIADNDPFY
101 EFFKRLVPNM PEIPQEEADD GGLNFGSGFI ISKDGYILTN THVVTGMGSI
151 KVLLNDKREY TAKLIGSDVQ SDVALLKIDA TEELPVVKIG NPKDLKPGEW
201 VAAIGAPFGF DNSVTAGIVS AKGRSLPNES YTPFIQTDVA INPGNSGGPL
251 FNLKGQVVGI NSQIYSRSGG FMGISFAIPI DVAMNVAEQL KNTGKVQRGQ
301 LGVIIQEVSY GLAQSFGLDK AGGALIAKIL PGSPAERAGL QAGDIVLSLD
351 GGEIRSSGDL PVMVGAITPG KEVSLGVWRK GEEITIKVKL GNAAEHIGAS
401 SKTDEAPYTE QQSGTFSVES AGITLQTHTD SSGGHLVVVR VSDAAERAGL
451 RRGDEILAVG QVPVNDEAGF RKAMDKAGKN VPLLIMRRGN TLFIALNLQ*
```

Computer analysis of this amino acid sequence gave the following results:

Homology with a predicted ORF from *N. gonorrhoeae* m986/g986 97.0% identity in 499 aa overlap

```
                    10        20        30        40        50        60
m986.pep    VFKKYQYLALAALCAASLAGCDKAGSFFVADKKEASFVERIEHTKDDGSVSMLLPDFAQL
            |||||||:|||||||| ||||:|||||| |||||||||||||||||||||||||||||||
g986        VFKKYQYFALAALCAALLAGCEKAGSFFGADKKEASFVERIEHTKDDGSVSMLLPDFAQL
                    10        20        30        40        50        60

                    70        80        90       100       110       120
m986.pep    VQSEGPAVVNIQAAPAPRTQNGSGNAENDSDPIADNDPFYEFFKRLVPNMPEIPQEEADD
            |||||||||||||||||||||||||||:||||:||:||||||||||||||||||||||||
g986        VQSEGPAVVNIQAAPAPRTQNGSGNAETDSDPLADSDPFYEFFKRLVPNMPEIPQEEADD
                    70        80        90       100       110       120

                   130       140       150       160       170       180
m986.pep    GGLNFGSGFIISKDGYILTNTHVVTGMGSIKVLLNDKREYTAKLIGSDVQSDVALLKIDA
            |||||||||||||:||||||||||:|||||||||||||||||||||||||||||||||||
g986        GGLNFGSGFIISKNGYILTNTHVVAGMGSIKVLLNDKREYTAKLIGSDVQSDVALLKIDA
                   130       140       150       160       170       180

                   190       200       210       220       230       240
m986.pep    TEELPVVKIGNPKDLKPGEWVAAIGAPFGFDNSVTAGIVSAKGRSLPNESYTPFIQTDVA
            |||||||||||||:||||||||||||||||||||||||||||||||||||||||||||||
g986        TEELPVVKIGNPKNLKPGEWVAAIGAPFGFDNSVTAGIVSAKGRSLPNESYTPFIQTDVA
                   190       200       210       220       230       240

                   250       260       270       280       290       300
m986.pep    INPGNSGGPLFNLKGQVVGINSQIYSRSGGFMGISFAIPIDVAMNVAEQLKNTGKVQRGQ
            ||||||||||||||||||||||||||||||||||||||||||||||||||||||||||||
g986        INPGNSGGPLFNLKGQVVGINSQIYSRSGGFMGISFAIPIDVAMNVAEQLKNTGKVQRGQ
                   250       260       270       280       290       300

                   310       320       330       340       350       360
m986.pep    LGVIIQEVSYGLAQSFGLDKAGGALIAKILPGSPAERAGLQAGDIVLSLDGGEIRSSGDL
            |||||||||||||||||||||:||||||||||||||||||||||||||||||||||||||
g986        LGVIIQEVSYGLAQSFGLDKASGALIAKILPGSPAERAGLQAGDIVLSLDGGEIRSSGDL
                   310       320       330       340       350       360

                   370       380       390       400       410       420
m986.pep    PVMVGAITPGKEVSLGVWRKGEEITIKVKLGNAAEHIGASSKTDEAPYTEQQSGTFSVES
            |||||||||||||||||||||||||||:|||||||| |||||||||||||||||||||||
g986        PVMVGAITPGKEVSLGVWRKGEEITIKAKLGNAAEHTGASSKTDEAPYTEQQSGTFSVES
                   370       380       390       400       410       420

                   430       440       450       460       470       480
m986.pep    AGITLQTHTDSSGGHLVVVRVSDAAERAGLRRGDEILAVGQVPVNDEAGFRKAMDKAGKN
            ||||||||||||| ||||||||||||||||||||||||||||||||||||||||||||||
g986        AGITLQTHTDSSGKHLVVVRVSDAAERAGLRRGDEILAVGQVPVNDEAGFRKAMDKAGKN
                   430       440       450       460       470       480

                   490       500
m986.pep    VPLLIMRRGNTLFIALNLQX
            ||||:|||||||||||||||
g986        VPLLIMRRGNTLFIALNLQX
                   490       500
```

The following partial DNA sequence was identified in *N. meningitidis* <SEQ ID 2971>:

a986.seq

```
  1 GTGTTCAAAA AATACCAATA CCTCGCTTTG GCAGCACTGT GTGCCGCCTC
 51 GCTGGCAGGC TGCGACAAAG CCGGCAGCTT TTTCGGTGCG GACAAAAAAG
101 AAGCATCCTT TGTAGAACGC ATCAAACACA CCAAAGACGA CGGCAGCGTC
151 AGTATGCTGC TGCCCGACTT TGTCCAACTG GTTCAAAGCG AAGGCCCGGC
201 AGTCGTCAAT ATTCAGGCAG CCCCCGCCCC GCGCACCCAA AACGGCAGCA
251 GCAATGCCGA AACCGATTCC GACCCGCTTG CCGACAGCGA CCCGTTCTAC
301 GAATTTTTCA AACGCCTCGT CCCGAACATG CCCGAAATCC CCCAAGAAGA
351 AGCAGATGAC GGNGGATTGA ACTTCGGTTC GGGCTTCATC ATCAGCAAAG
401 ACGGCTATAT TCTGACCAAT ACGCACGTCG TTACCGGCAT GGGCAGTATC
451 AAAGTCCTGC TCAACGACAA GCGCGAATAT ACCGCCAAAC TCATCGGTTC
```

-continued

```
 501 GGATGTCCAA TCCGATGTCG CCCTTCTGAA AATCGACGCA ACGGAAGAGC

 551 TGCCCGTCGT CAAAATCGGC AATCCCAAAG ATTTGAAACC GGGCGAATGG

 601 GTCGCCGCCA TCGGCGCGCC CTTCGGCTTC GACAACAGCG TGACCGCCGG

 651 CNTCGTGTCC GCCAAAGGCA GAAGCCTGCC CAACGAAAGC TACACACCCT

 701 TCATCCAAAC CGACGTTGCC ATCAATCCGG GCAACTCCGG CGGCCCGCTG

 751 TTCAACTTAA AAGGACAGGT CGTCGGCATC AACTCGCAAA TATACAGCCG

 801 CAGCGGCGGA TTCATGGGCA TTTCCTTCGC CATCCCGATT GACGTTGCCA

 851 TGAATGTCGC CGAACAGCTG AAAAACACCG GCAAAGTCCA ACGCGGACAA

 901 CTGGGCGTGA TTATTCAAGA AGTATCCTAC GGTTTGGCAC AATCGTTCGG

 951 TTTGGACAAA GCCGGCGGCG CACTGATTGC CAAAATCCTG CCCGGCAGCC

1001 CCGCAGAACG TGCCGGCCTG CGGGCGGGCG ACATCGTCCT CAGCCTCGAC

1051 GGCGGAGAAA TACGTTCTTC CGGCGACCTT CCCGTTATGG TCGGCGCCAT

1101 TACGCCGGGA AAAGAAGTCA GCCTCGGCGT ATGGCGCAAA CGCGAAGAAA

1151 TCACAATCAA AGTCAAGCTG GGCAACGCCG CCGAGCATAT CGGCGCATCA

1201 TCCAAAACAG ATGAAGCCCC CTACACCGAA CAGCAATCCG GTACGTTCTC

1251 GGTCGAATCC GCAGGCATTA CCCTTCAGAC ACATACCGAC AGCAGCGGCG

1301 GACACCTCGT CGTCGTACGG GTTTCCGACG CCGCAGAACG CGCAGGCTTG

1351 AGGCGCGGCG ACGAAATTCT TGCCGTCCGG CAAGTCCCCG TCAATGACGA

1401 AGCCGGTTTC CGCAAAGCTA TGGACAAGGC AGGCAAAAAC GTCCCCCTCC

1451 TGATCATGCG CCGTCGCAAC ACGCTGTTTA TCGCATTAAA CCTGCAATAA
```

This corresponds to the amino acid sequence <SEQ ID 2972; ORF 986.a>:

a986.pep

```
  1 VFKKYQYLAL AALCAASLAG CDKAGSFFGA DKKEASFVER IKHTKDDGSV

 51 SMLLPDFVQL VQSEGPAVVN IQAAPAPRTQ NGSSNAETDS DPLADSDPFY

101 EFFKRLVPNM PEIPQEEADD GGLNFGSGFI ISKDGYILTN THVVTGMGSI

151 KVLLNDKREY TAKLIGSDVQ SDVALLKIDA TEELPVVKIG NPKDLKPGEW

201 VAAIGAPFGF DNSVTAGXVS AKGRSLPNES YTPFIQTDVA INPGNSGGPL

251 FNLKGQVVGI NSQIYSRSGG FMGISFAIPI DVAMNVAEQL KNTGKVQRGQ

301 LGVIIQEVSY GLAQSFGLDK AGGALIAKIL PGSPAERAGL RAGDIVLSLD

351 GGEIRSSGDL PVMVGAITPG KEVSLGVWRK GEEITIKVKL GNAAEHIGAS

401 SKTDEAPYTE QQSGTFSVES AGITLQTHTD SSGGHLVVVR VSDAAERAGL

451 RRGDEILAVG QVPVNDEAGF RKAMDKAGKN VPLLIMRRGN TLFIALNLQ*
```

m986/a986 98.2% identity in 499 aa overlap

```
                 10         20         30         40         50         60
m986.pep    VFKKYQYLALAALCAASLAGCDKAGSFFVADKKEASFVERIEHTKDDGSVSMLLPDFAQL
            ||||||||||||||||||||||||||||  ||||||||||||:|||||||||||||:||
a986        VFKKYQYLALAALCAASLAGCDKAGSFFGADKKEASFVERIKHTKDDGSVSMLLPDFVQL
                 10         20         30         40         50         60
```

-continued

```
                70        80        90       100       110       120
m986.pep  VQSEGPAVVNIQAAPAPRTQNGSGNAENDSDPIADNDPFYEFFKRLVPNMPEIPQEEADD
          |||||||||||||||||||||||:|||:||||:||:||||||||||||||||||||||||
a986      VQSEGPAVVNIQAAPAPRTQNGSSNAETDSDPLADSDPFYEFFKRLVPNMPEIPQEEADD
                70        80        90       100       110       120

               130       140       150       160       170       180
m986.pep  GGLNFGSGFIISKDGYILTNTHVVTGMGSIKVLLNDKREYTAKLIGSDVQSDVALLKIDA
          ||||||||||||||||||||||||||||||||||||||||||||||||||||||||||||
a986      GGLNFGSGFIISKDGYILTNTHVVTGMGSIKVLLNDKREYTAKLIGSDVQSDVALLKIDA
               130       140       150       160       170       180

               190       200       210       220       230       240
m986.pep  TEELPVVKIGNPKDLKPGEWVAAIGAPFGFDNSVTAGIVSAKGRSLPNESYTPFIQTDVA
          ||||||||||||||||||||||||||||||||||||| ||||||||||||||||||||||
a986      TEELPVVKIGNPKDLKPGEWVAAIGAPFGFDNSVTAGIVSAKGRSLPNESYTPFIQTDVA
               190       200       210       220       230       240

               250       260       270       280       290       300
m986.pep  INPGNSGGPLFNLKGQVVGINSQIYSRSGGFMGISFAIPIDVAMNVAEQLKNTGKVQRGQ
          ||||||||||||||||||||||||||||||||||||||||||||||||||||||||||||
a986      INPGNSGGPLFNLKGQVVGINSQIYSRSGGFMGISFAIPIDVAMNVAEQLKNTGKVQRGQ
               250       260       270       280       290       300

               310       320       330       340       350       360
m986.pep  LGVIIQEVSYGLAQSFGLDKAGGALIAKILPGSPAERAGLQAGDIVLSLDGGEIRSSGDL
          ||||||||||||||||||||||||||||||||||||||||:|||||||||||||||||||
a986      LGVIIQEVSYGLAQSFGLDKAGGALIAKILPGSPAERAGLRAGDIVLSLDGGEIRSSGDL
               310       320       330       340       350       360

               370       380       390       400       410       420
m986.pep  PVMVGAITPGKEVSLGVWRKGEEITIKVKLGNAAEHIGASSKTDEAPYTEQQSGTFSVES
          ||||||||||||||||||||||||||||||||||||||||||||||||||||||||||||
a986      PVMVGAITPGKEVSLGVWRKGEEITIKVKLGNAAEHIGASSKTDEAPYTEQQSGTFSVES
               370       380       390       400       410       420

               430       440       450       460       470       480
m986.pep  AGITLQTHTDSSGGHLVVVRVSDAAERAGLRRGDEILAVGQVPVNDEAGFRKAMDKAGKN
          ||||||||||||||||||||||||||||||||||||||||||||||||||||||||||||
a986      AGITLQTHTDSSGGHLVVVRVSDAAERAGLRRGDEILAVGQVPVNDEAGFRKAMDKAGKN
               430       440       450       460       470       480

               490       500
m986.pep  VPLLIMRRGNTLFIALNLQX
          |||||||||||||||||||
a986      VPLLIMRRGNTLFIALNLQX
               490       500
```

The following partial DNA sequence was identified in *N. gonorrhoeae* <SEQ ID 2973>:

g987.seq

```
  1 ATGAAAACAC GCAGCCTCAT TTCCCTTTTA TGCCTCCTTC TCTGTTCATG

 51 TTCTTCATGG TTGCCCCCAC TGGAAGAACG GACGGAAAGC CGTCATTTTA

101 ATACTTCCAA ACCTGTCCTC CTGGACAACA TCCTGCAAAT CCGGCACACC

151 CCTCATAACA ACGGGCTATC CGACATCTAC CTGCTCGACG ACCCCCACGA

201 AGCCTTTGCC GCCCGCGCCG CCCTTATCGA ATCTGCCGAA CACAGCCTCG

251 ATTTGCAATA CTACATTTGG CGCAACGaCA TTTCCGGCAG GCTGCTGTTC

301 AACCTCATGT ACCTTGCCGC agaacgcGGC GTGCGCGTAC GCCTGCTGTt

351 qgacqacaAC AACAcgcgcg gcttggacga tctcctGCTC GCCCTCGACA

401 GCCATCCCAA TAtctaagtG CGCCTGTTCA ACCCCTtcgt CCTACGCAAA

451 TGGCGCGCAC TCGGCTACCT GACCGACTTC CCCCGCCTCA ACCGCCGCAT

501 GCACAACAAA TCCTTTACCG CCGACAACCG CGCCACCATA CTCGGCGGAC

551 GCAATATCGG CGACGAATAC TTCAAAGTCG GTGAGGACAC CGTTTTCGCC

601 GACCTGGACA TCCTCGCCAC CGGCAGCGTC GTCGGCGAAG TATCGCACGA

651 CTTCGACCGC TACTGGGCAA GCCATTCCGC CCACAACGCC ACGCGCATCA

701 TCCGCAGCGG CAACATCGGC AAGGGTCTTC AAGCACTCGG ATACAACGAC

751 GAAACATCCA GACACGCGCT CCTGCGCTAC CGCGAAACCG TCGAACAGTC
```

-continued

```
 801 GCCCCTCTAC CAAAAAATAC AGACGGGACG CATCGACTGG CAGAGCGTCC
 851 AAACCCGCCT GATCAGCGAC AGCCCTCCAA AAGGACTCGA CCGCGACCGC
 901 CGCAAACCGC CGATTGCCGG GAGGCTGCAA GACGCGCTCA AACAGCCCGA
 951 AAAPAGCGTC TATCTGGTTT CACCCTATTT CGTCCCTACA AAATCCGGCA
1001 CAGACGCACT GGCAAAACTG GTGCAGGACG GCATAGACGT TACCGTCCTG
1051 ACCAACTCGC TACAGGCGAC CGACGTTGCC GCCGTCCATT CCGGCTACGT
1101 CAAATACCGA AAACCGCTGC TCAAAGCCGG CATCAAACTC TACGAGCTGC
1151 AACCCAACCA TGCCGTCCCC GCCACAAAAG ACAAAGGCCT GACCGGCAGC
1201 TCCGTAACCA GCCTGCATGC CAAAACCTTC ATTGTGGacg gCAAACGCAT
1251 CTTCATCGGC TCATTCAACC TCGACCCCCG TTCCGCACGG CTCAATACCG
1301 AAATGGGCGT CGTCATCGAA AGCCCCAAAA TCGCAGAACA GATGGAGCGC
1351 AccctCGCCG AtacCACACC CGAATACGCC TACCGCGTTA CCCTCGACAA
1401 ACACAACCGC CTGCAATGGC ACGATCCCGC CACCCGAAAA ACCTACCCGA
1451 ACGAACCCGA AGCCAAACTT TGGAAACGCA TCGCCGCAAA AATCCTATCC
1501 CTGCTGCCCA TCGAAGGTTT ATTATAG
```

This corresponds to the amino acid sequence <SEQ ID 2974; ORF 987.ng>:

g987.pep

```
  1 MKTRSLISLL CLLLCSCSSW LPPLEERTES RHFNTSKPVL LDNILQIRHT
 51 PHNNGLSDIY LLDDPHEAFA ARAALIESAE HSLDLQYYIW RNDISGRLLF
101 NLMYLAAERG VRVRLLLDDN NTRGLDDLLL ALDSHPNI*V RLFNPFVLRK
151 WRALGYLTDF PRLNRRNHNK SFTADNRATI LGGRNIGDEY FKVGEDTVFA
201 DLDILATGSV VGEVSHDFDR YWASHSAHNA TRIIRSGNIG KGLQALGYND
251 ETSRHALLRY RETVEQSPLY QKIQTGRIDW QSVQTRLISD SPAKGLDRDR
301 RKPPIAGRLQ DALKQPEKSV YLVSPYFVPT KSGTDALAKL VQDGIDVTVL
351 TNSLQATDVA AVHSGYVKYR KPLLKAGIKL YELQPNHAVP ATKDKGLTGS
401 SVTSLHAKTF IVDGKRIFIG SFNLDPRSAR LNTEMGVVIE SPKIAEQMER
451 TLADTTPEYA YRVTLDKHNR LQWHDPATRK TYPNEPEAKL WKRIAAKILS
501 LLPIEGLL*
```

The following partial DNA sequence was identified in *N. meningitidis* <SEQ ID 2975>:

m987.seq

```
  1 ATGAAAACAC GCAGCCTAAT TTCCCTTTTA TGCCTCCTTC TCTGTTCATG
 51 TTCTTCATGG TTGCCCCCAC TGGAAGAACG GACGGAAAGC CGTCATTTCA
101 ATACTTCCAA ACCCGTCCGC CTGGACAACA TCCTGCAAAT CCGGCACACC
151 CCTCATACCA ACGGGCTATC CGATATCTAT CTGTTGAACG ACCCCCACGA
201 AGCCTTTGCC GCCCGCGCCG CCCTTATCGA ATCTGCCGAA CACAGCCTCG
251 ATTTGCAATA CTACATCTGG CGCAACGACA TTTCCGGCAG GCTGCTGTTC
```

-continued

```
 301 AACCTCGTGT ACCTTGCCGC AGAACGCGGT GTGCGCGTAC GCCTGCTGTT
 351 GGACGACAAC AACACGCGCG GATTGGACGA CCTCCTGCTT GCCCTCGACA
 401 GCCATCCCAA TATCGAAGTG CGCCTGTTCA ACCCCTTCGT CTTACGAAAA
 451 TGGCGCGCAC TCGGCTACCT GACCGACTTC CCCCGCCTCA ACCGCCGCAT
 501 GCACAACAAA TCCTTTACCG CCGACAACCG CGCCACCATA CTCGGCGGAC
 551 GCAATATCGG CGACGAATAC TTCAAAGTCG GTGAGGACAC CGTTTTCGCC
 601 GATTTGGACA TCCTCGCCAC CGGCAGCGTC GTCGGCGAAG TATCGCACGA
 651 CTTCGACCGC TACTGGGCAA GCCATTCCGC CCACAACGCC ACGCGCATCA
 701 TCCGCAGCGG CGACATCGGC AAGGGTCTTC AAGCACTCGG ATACAACGAC
 751 GAAACGTCCA GACACGCGCT CCTGCGCTAC CGCGAAACCG TCGAACAGTC
 801 GCCCCTCTAC CAAAAAATAC AGACAGGATG CATCGACTGG CAGAGCGTCC
 851 GAACCCGCCT CATCAGCGAC GACCCTGCAA AAGGACTCGA CCGCGACCGC
 901 CGCAAACCGC CGATTGCCGG GCGGCTGCAA GACGCGCTCA AACAGCCCGA
 951 AAAAAGCGTC TATCTGGTTT CACCCTATTT CGTTCCCACA AAATCCGGCA
1001 CAGACGCACT GGCAAAACTG GTGCAGGACG GCATAGACGT TACCGTTCTG
1051 ACCAACTCGC TGCAGGCGAC CGACGTTGCC GCCGTCCATT CCGGCTATGT
1101 CAAATACCGA AAACCGCTGC TCAAAGCCGG CATCAAACTC TACGAGCTGC
1151 AACCCAACCA TGCCGTCCCC GCCACAAAAG ACAAAGGCCT GACCGGCAGC
1201 TCCGTAACCA GCCTGCACGC CAAAACCTTC ATTGTGGACG GCAAACGCAT
1251 CTTCATCGGT TCGTTCAACC TCGACCCCCG TTCCGCGCGT CTCAACACCG
1301 AAATGGGCGT TGTTATCGAA AGCCCCAAAA TCGCAGAACA GATGGAGCGC
1351 ACCCTTGCCG ATACCACACC CGCCTACGCC TACCGCGTTA CCCTCGACAG
1401 GCACAACCGC CTGCAATGGC ACGATCCCGC CACCCGAAAA ACCTACCCGA
1451 ACGAACCCGA AGCCAAACTT TGGAAACGCA TCGCCGCAAA AATCCTATCC
1501 CTGCTGCCCA TAGAAGGTTT ATTATAG
```

This corresponds to the amino acid sequence <SEQ ID 2976; ORF 987>:

m987.pep

```
  1 MKTRSLISLL CLLLCSCSSW LPPLEERTES RHFNTSKPVR LDNILQIRHT
 51 PHTNGLSDIY LLNDPHEAFA ARAALIESAE HSLDLQYYIW RNDISGRLLF
101 NLVYLAAERG VRVRLLLDDN NTRGLDDLLL ALDSHPNIEV RLFNPFVLRK
151 WRALGYLTDF PRLNRRMHNK SFTADNRATI LGGRNIGDEY FKVGEDTVFA
201 DLDILATGSV VGEVSHDFDR YWASHSAHNA TRIIRSGDIG KGLQALGYND
251 ETSRHALLRY RETVEQSPLY QKIQTGCIDW QSVRTRLISD DPAKGLDRDR
301 RKPPIAGRLQ DALKQPEKSV YLVSPYFVPT KSGTDALAKL VQDGIDVTVL
351 TNSLQATDVA AVHSGYVKYR KPLLKAGIKL YELQPNHAVP ATKDKGLTGS
401 SVTSLHAKTF IVDGKRIFIG SFNLDPRSAR LNTEMGVVIE SPKIAEQMER
451 TLADTTPAYA YRVTLDRHNR LQWHDPATRK TYPNEPEAKL WKRIAAKILS
501 LLPIEGLL*
```

Computer analysis of this amino acid sequence gave the following results:

Homology with a predicted ORF from *N. gonorrhoeae*
m987/g987 97.8% identity in 508 aa overlap

```
                   10        20        30        40        50        60
m987.pep   MKTRSLISLLCLLLCSCSSWLPPLEERTESRHFNTSKPVRLDNILQIRHTPHTNGLSDIY
           |||||||||||||||||||||||||||||||||||||||| ||||||||||||:||||||
g987       MKTRSLISLLCLLLCSCSSWLPPLEERTESRHFNTSKPVLLDNILQIRHTPHNNGLSDIY
                   10        20        30        40        50        60

                   70        80        90       100       110       120
m987.pep   LLNDPHEAFAARALIESAEHSLDLQYYIWRNDISGRLLFNLVYLAAERGVRVRLLLDDN
           ||:||||||||||||||||||||||||||||||||||||||:||||||||||||||||||
g987       LLDDPHEAFAARALIESAEHSLDLQYYIWRNDISGRLLFNLMYLAAERGVRVRLLLDDN
                   70        80        90       100       110       120

                  130       140       150       160       170       180
m987.pep   NTRGLDDLLLALDSHPNIEVRLFNPFVLRKWRALGYLTDFPRLNRRMHNKSFTADNRATI
           |||||||||||||||||||| |||||||||||||||||||||||||||||||||||||||
g987       NTRGLDDLLLALDSHPNIXVRLFNPFVLRKWRALGYLTDFPRLNRRMHNKSFTADNRATI
                  130       140       150       160       170       180

                  190       200       210       220       230       240
m987.pep   LGGRNIGDEYFKVGEDTVFADLDILATGSVVGEVSHDFDRYWASHSAHNATRIIRSGDIG
           |||||||||||||||||||||||||||||||||||||||||||||||||||||||||:||
g987       LGGRNIGDEYFKVGEDTVFADLDILATGSVVGEVSHDFDRYWASHSAHNATRIIRSGNIG
                  190       200       210       220       230       240

                  250       260       270       280       290       300
m987.pep   KGLQALGYNDETSRHALLRYRETVEQSPLYQKIQTGCIDWQSVRTRLISDDPAKGLDRDR
           ||||||||||||||||||||||||||||||||||| |||||||:||||||:|||||||||
g987       KGLQALGYNDETSRHALLRYRETVEQSPLYQKIQTGRIDWQSVQTRLISDSPAKGLDRDR
                  250       260       270       280       290       300

                  310       320       330       340       350       360
m987.pep   RKPPIAGRLQDALKQPEKSVYLVSPYFVPTKSGTDALAKLVQDGIDVTVLTNSLQATDVA
           ||||||||||||||||||||||||||||||||||||||||||||||||||||||||||||
g987       RKPPIAGRLQDALKQPEKSVYLVSPYFVPTKSGTDALAKLVQDGIDVTVLTNSLQATDVA
                  310       320       330       340       350       360

                  370       380       390       400       410       420
m987.pep   AVHSGYVKYRKPLLKAGIKLYELQPNHAVPATKDKGLTGSSVTSLHAKTFIVDGKRIFIG
           ||||||||||||||||||||||||||||||||||||||||||||||||||||||||||||
g987       AVHSGYVKYRKPLLKAGIKLYELQPNHAVPATKDKGLTGSSVTSLHAKTFIVDGKRIFIG
                  370       380       390       400       410       420

                  430       440       450       460       470       480
m987.pep   SFNLDPRSARLNTEMGVVIESPKIAEQMERTLADTTPAYAYRVTLDRHNRLQWHDPATRK
           ||||||||||||||||||||||||||||||||||||| ||||||||:|||||||||||||
g987       SFNLDPRSARLNTEMGVVIESPKIAEQMERTLADTTPAYAYRVTLDKHNRLQWHDPATRK
                  430       440       450       460       470       480

                  490       500       509
m987.pep   TYPNEPEAKLWKRIAAKILSLLPIEGLLX
           |||||||||||||||||||||||||||||
g987       TYPNEPEAKLWKRIAAKILSLLPIEGLLX
                  490       500
```

The following partial DNA sequence was identified in *N. meningitidis* <SEQ ID 2977>:

a987.seq

```
  1 ATGAAAACAC GCAGCCTAAT TTCCCTTTTA TGCCTCCTTC TCTGTTCATG
 51 TTCTTCATGG TTGCCCCCAC TGGAAGAACG GACGGAAAGC CGTCATTTCA
101 ATACTTCCAA ACCCGTCCGC CTGGACAACA TCCTGCAAAT CCGGCACACC
151 CCTCATACCA ACGGGCTATC CGATATCTAT CTGTTGAACG ACCCCCACGA
201 AGCCTTTGCC GCCCGCGCCG CCCTTATCGA ATCTGCCGAA CACAGCCTCG
251 ATTTGCAATA CTACATCTGG CGCAACGACA TTTCCGGCCG ACTGCTGTTC
301 AACCTCGTGT ACCTTGCCGC AGAACGCGGT GTGCGCGTAC GCCTGCTGTT
351 GGACGACAAC AACACGCGCG GATTGGACGA CCTCCTGCTC GCCCTCGACA
401 GCCATCCCAA TATCGAAGTG CGCCTGTTCA ACCCCTTCGT CTTACGAAAA
451 TGGCGCGCAC TCGGCTACCT GACCGACTTC CCCCGCCTCA ACCGCCGCAT
```

-continued

```
 501 GCACAACAAA TCCTTTACCG CCGACAACCG CGCCACCATA CTCGGCGGAC
 551 GCAATATCGG CGACGAATAC TTCAAAGTCG GTGAGGACAC CGTTTTCGCC
 601 GACCTGGACA TCCTCGCCAC CGGCAGCGTC GTCGGCGAAG TATCGCACGA
 651 CTTCGACCGC TACTGGGCAA GCCATTCCGC CCACAACGCC ACGCGCATCA
 701 TCCGCAGCGG CAACATCGGC AAGGGTCTTC AAGCACTCGG ATACAACGAC
 751 GAAACGTCCA GACACGCGCT CCTGCGCTAC CGCGAAACCG TCGAACAGTC
 801 GCCCCTCTAC CAAAAAATAC AGACAGGACG CATCGACTGG CAGAGCGTCC
 851 AAACCCGCCT CATCAGCGAC GACCCTGCAA AAGGACTCGA CCGCGACCGC
 901 CGCAAACCGC CGATTGCCGG GCGGCTGCAA GACGCGCTCA AACAGCCCGA
 951 AAAAAGCGTC TATCTGGTTT CACCCTATTT CGTCCCCACA AAATCCGGCA
1001 CAGACGCACT GGCAAAACTG GTGCAGGACG CCATAGACGT TACCGTCCTG
1051 ACCAACTCGC TACAGGCGAC CGACGTTGCC GCCGTCCATT CCGGCTATGT
1101 CAAATACCGA AAACCGCTGC TCAAAGCCGG CATCAAACTC TACGAGCTGC
1151 AACCCAACCA TGCCGTCCCT GCCACAAAAG ACAAAGGCCT GACCGGCAGC
1201 TCCGTAACCA GCCTGCATGC CAAAACCTTC ATTGTGGACG GCAAACGCAT
1251 CTTCATCGGC TCATTCAACC TCGACCCCCG TTCCGCACGG CTCAATACTG
1301 AAATGGGCGT TGTTATCGAA AGCCCCAAAA TCGCAGAACA GATGGAGCGC
1351 ACCCTTGCCG ATACCTCACC CGAATACGCC TACCGCGTTA CCCTCGACAG
1401 GCACAACCGC CTGCAATGGC ACGATCCCGC CACCCGAAAA ACCTACCCGA
1451 ACGAACCCGA AGCCAAACTT TGGAAACGCA TCGCCGCAAA AATCCTATCC
1501 CTGCTGCCCA TAGAAAGTTT ATTATAG
```

This corresponds to the amino acid sequence <SEQ ID 550; ORF 2978.a>:

a987.pep

```
  1 MKTRSLISLL CLLLCSCSSW LPPLEERTES RHFNTSKPVR LDNILQIRHT
 51 PHTNGLSDIY LLNDPHEAFA ARAALIESAE HSLDLQYYIW RNDISGRLLF
101 NLVYLAAERG VRVRLLLDDN NTRGLDDLLL ALDSHPNIEV RLFNPFVLRK
151 WRALGYLTDF PRLNRRMHNK SFTADNRATI LGGRNIGDEY FKVGEDTVFA
201 DLDILATGSV VGEVSHDFDR YWASHSAHNA TRIIRSGNIG KGLQALGYND
251 ETSRHALLRY RETVEQSPLY QKIQTGRIDW QSVQTRLISD DPAKGLDRDR
301 RKPPIAGRLQ DALKQPEKSV YLVSPYFVPT KSGTDALAKL VQDGIDVTVL
351 TNSLQATDVA AVHSGYVKYR KPLLKAGIKL YELQPNHAVP ATKDKGLTGS
401 SVTSLHAKTF IVDGKRIFIG SFNLDPRSAR LNTEMGVVIE SPKIAEQMER
451 TLADTSPEYA YRVTLDRHNR LQWHDPATRK TYPNEPEAKL WKRIAAKILS
501 LLPIESLL*
```

m987/a987 98.8% identity in 508 aa overlap

```
                10        20        30        40        50        60
m987.pep  MKTRSLISLLCLLLCSCSSWLPPLEERTESRHFNTSKPVRLDNILQIRHTPHTNGLSDIY
          ||||||||||||||||||||||||||||||||||||||||||||||||||||||||||||
a987      MKTRSLISLLCLLLCSCSSWLPPLEERTESRHFNTSKPVRLDNILQIRHTPHTNGLSDIY
                10        20        30        40        50        60
                70        80        90       100       110       120
m987.pep  LLNDPHEAFAARAALIESAEHSLDLQYYIWRNDISGRLLFNLVYLAAERGVRVRLLLDDN
          ||||||||||||||||||||||||||||||||||||||||||||||||||||||||||||
a987      LLNDPHEAFAARAALIESAEHSLDLQYYIWRNDISGRLLFNLVYLAAERGVRVRLLLDDN
                70        80        90       100       110       120
               130       140       150       160       170       180
m987.pep  NTRGLDDLLLALDSHPNIEVRLFNPFVLRKWRALGYLTDFPRLNRRMHNKSFTADNRATI
          ||||||||||||||||||||||||||||||||||||||||||||||||||||||||||||
a987      NTRGLDDLLLALDSHPNIEVRLFNPFVLRKWRALGYLTDFPRLNRRMHNKSFTADNRATI
               130       140       150       160       170       180
               190       200       210       220       230       240
m987.pep  LGGRNIGDEYFKVGEDTVFADLDILATGSVVGEVSHDFDRYWASHSAHNATRIIRSGDIG
          |||||||||||||||||||||||||||||||||||||||||||||||||||||||||:||
a987      LGGRNIGDEYFKVGEDTVFADLDILATGSVVGEVSHDFDRYWASHSAHNATRIIRSGDIG
               190       200       210       220       230       240
               250       260       270       280       290       300
m987.pep  KGLQALGYNDETSRHALLRYRETVEQSPLYQKIQTGCIDWQSVRTRLISDDPAKGLDRDR
          |||||||||||||||||||||||||||||||||||| ||||||:||||||||||||||||
a987      KGLQALGYNDETSRHALLRYRETVEQSPLYQKIQTGRIDWQSVQTRLISDDPAKGLDRDR
               250       260       270       280       290       300
               310       320       330       340       350       360
m987.pep  RKPPIAGRLQDALKQPEKSVYLVSPYFVPTKSGTDALAKLVQDGIDVTVLTNSLQATDVA
          ||||||||||||||||||||||||||||||||||||||||||||||||||||||||||||
a987      RKPPIAGRLQDALKQPEKSVYLVSPYFVPTKSGTDALAKLVQDGIDVTVLTNSLQATDVA
               310       320       330       340       350       360
               370       380       390       400       410       420
m987.pep  AVHSGYVKYRKPLLKAGIKLYELQPNHAVPATKDKGLTGSSVTSLHAKTFIVDGKRIFIG
          ||||||||||||||||||||||||||||||||||||||||||||||||||||||||||||
a987      AVHSGYVKYRKPLLKAGIKLYELQPNHAVPATKDKGLTGSSVTSLHAKTFIVDGKRIFIG
               370       380       390       400       410       420
               430       440       450       460       470       480
m987.pep  SFNLDPRSARLNTEMGVVIESPKIAEQMERTLADTTPAYAYRVTLDRHNRLQWHDPATRK
          ||||||||||||||||||||||||||||||||||||:| |||||||||||||||||||||
a987      SFNLDPRSARLNTEMGVVIESPKIAEQMERTLADTTPAYAYRVTLDRHNRLQWHDPATRK
               430       440       450       460       470       480
               490       500      509
m987.pep  TYPNEPEAKLWKRIAAKILSLLPIEGLLX
          ||||||||||||||||||||||||:|||
a987      TYPNEPEAKLWKRIAAKILSLLPIESLLX
               490       500
```

The following partial DNA sequence was identified in *N. gonorrhoeae* <SEQ ID 2979>:

<u>g988.seq</u>

```
  1 ATGAATAAAA ATATTAAATC TTTAAATTTA CGGGAAAAAG ACCCGTTTTT
 51 AAGTCGTGAA AAACAGCGTT ATGAACATCC TTTGCCCAGT CGGgaATGGA
101 TAATCGAATT GTTGGAGCGC AAAGGTGTGC CTTCAAAAAT CGAATCGCTT
151 GCACGCGAGC TGTCGATTAC GGAAGacgag tATGTCTTTT TTGAACGCCG
201 TCTGAaggCG atgGCGCGGG AcggtCAGGT TTTAATCAAC CGCCgaggcg
251 CagtTTGCGc gGCggacaag ctgGATTTGG TCAAATGccg Cgtcgaggcg
301 catAAgGAcg gtttcggctt cgcCGTGCCG CTCATGCCGA TGGACGAAGG
351 GGATTTCGTT TTATACGAAC GCCAgatgcg tggTGtcatG CAcggcgaca
401 ccgttACCGT CCGTCCTGCg ggtatggaCC GCAGGGGccg ccgcGAAggg
451 acgtttctGG ATATTGTCGA ACGCGCGCAA AGCAAAGTTG TCGGCCGTTT
501 CTATATGGAT AGGGGCGTGG CGATTTTGGA GCCGGAAGAC AAGCGTCTGA
551 ACCAAAGCAT CGTGTTGGAA CCGGACGGCG TGGCGCGTTT CAAACCCGAA
601 TCCGGTCAGG TTATCGTCGG CAAAATTGAG GTTTATCCCG AGCAAAACCG
651 GCCTGCAGTG GCAAAAATCA TTGAAGTTTT GGGCGATTAT GCCGACAGCG
```

-continued

```
 701 GGATGGAAAt cgAAATTGCC GTGCGCAAGC ATCATTTGCC GCAccgaTTC
 751 AGTGAagcgt gtGcCAAATC CGcgaaAAAA ATtcccgacc ATGTACGCAA
 801 AAGCGATTTG AAAGGCCGCG TCGATTTGTG CGACCTTCCT TTGGTAACGA
 851 TAGACGGCGA AACGGCGCGC GATTTCGACG ACGCGGTGTT TGCCGAAAAA
 901 GTCGGACGCA ATTACCGCCT GGTCGTGGCG ATTGCGGATG TCAGCCATTA
 951 TGTCCGCCCT GACGATGCGA TTGATGCAGA TGCTCAAGAA CGCAGTACCA
1001 GCGTGTATTT CCCGCGCCGT ATGATTCCGA TGCTGCCGGA AAACCTGTCC
1051 AACGGCATCT GCTCGCTCAA TCCCGATGTC GAGCGTTTGT GTATGGTGTG
1101 CGATATGGTC GTTACCTATG CGGGCAATAT CAAAGAATAC CGCTTCTATC
1151 CCGCCGTGAT GCGCTCTCAT GCCCGCCTGA CCTACAACCA AGTTTGGAAA
1201 TGGCTTTCAG ACGGCATCGG GAATCCGCAC AAAGCCCAAA TCGACACGCT
1251 TTACAAGCTG TTTAAAATTT TGCAGAAAAA ACGTCTGGCG CGCGGGGCGG
1301 TGGAGTTTGA AAGCGTCGAA ACCCAGATGA TTTTCGACGA CAACGGCAAA
1351 ATCGAAAAAA TTGTCCCCGT CGTCCGCAAC gatGCCCACA AGCTGATTGA
1401 AGAATGTATG CTGGCGGCGA ATGTTTGCGC GGCGGATTTT CTGTTGAAAA
1451 ACAAACATAC GGCTTTGTTC CGCAACCATT TGGGCCCCAC GCCCGAAAAA
1501 CTCGCCACCC TGCGCGAGCA GCTCGGTCTG TTGGGGCTTC AACTTGGCGG
1551 CGGCGACAAC CCGTCGCCGA AAGACTATGC CGCGCTTGCC GAACAATTCA
1601 AAGGCAGGCC GGATGCCGAA TTGCTGCAAG TCATGATGTT GCGCTCCATG
1651 CAGCAGGCGG TTTACGAACC GCATTGCGAA GGGCATTTCG GTTTGGCTTA
1701 TGAAGCATAC GCCCACTTTA CCTCGCCCAT CCGCCGCTAT CCCGACCTGA
1751 CCGTCCACCG TGCCATCAAA GCCGTATTGA ACCGGAAAAC CTACACGCCA
1801 AACAAAAGCT GGCAGGCTTT GGGCGTGCAT ACTTCGTTTT GCGAACGCCG
1851 TGCCGACGAT GCTGGCCGCG ATGTGGAAAA CTGGCTGAAA ACTTATTATA
1901 TGCGCGATAA GGTCGGTGAA ATATTTGAAG GcaaaatCtc ccggggtgtg
1951 gcaaaTtttg gaATATTTGT CACTTTGGAC GATATccata tcgacggtct
2001 ggtacaTATC AGCGatttgg gcgaAGATTA TTTCaacttc cgccccgAAA
2051 TCATGGCAAT CGAAGGCGAA CGCAGCGGCA TCCGTTTCAA TATGGGGGAC
2101 AGGGTTGCCG TCCGGGTCGC GCGTGCCGAT TTGGATGATG GAAAAATCGA
2151 CTTTGTCCTA ATTGCCGGAG AAAGCGGCAG GCGGCGGAAG GTCAAATTAT
2201 CCGCATCTGC CAAACCGGCA GGGGCGGCGG GGAAAGGGAA ATCGAAAACC
2251 ACCGCCGAGA AAAAAACAGC CCGATGCGGC AAAGTAAGGG GAAGGGGCGT
2301 GCCTGCCGTT GCCGAATCGG GGAAAAAGGC AAAGAAACCG GTTCCGATTA
2351 AGGTCAAAAA ACGGAAAGGC AAATCATAA
```

This corresponds to the amino acid sequence <SEQ ID 2980; ORF 988.ng>:

g988.pep

```
 1 MNKNIKSLNL REKDPFLSRE KQRYEHPLPS REWIIELLER KGVPSKIESL
51 ARELSITEDE YVFFERRLKA MARDGQVLIN RRGAVCAADK LDLVKCRVEA
```

-continued

```
101 HKDGFGFAVP LMPMDEGDFV LYERQMRGVM HGDTVTVRPA GMDRRGRREG

151 TFLDIVERAQ SKVVGRFYMD RGVAILEPED KRLNQSIVLE PDGVARFKPE

201 SGQVIVGKIE VYPEQNRPAV AKIIEVLGDY ADSGMEIEIA VRKHHLPHRF

251 SEACAKSAKK IPDHVRKSDL KGRVDLCDLP LVTIDGETAR DFDDAVFAEK

301 VGRNYRLVVA IADVSHYVRP DDAIDADAQE RSTSVYFPRR MIPMLPENLS

351 NGICSLNPDV ERLCMVCDMV VTYAGNIKEY RFYPAVMRSH ARLTYNQVWK

401 WLSDGIGNPH KAQIDTLYKL FKILQKKRLA RGAVEFESVE TQMIFDDNGK

451 IEKIVPVVRN DAHKLIEECM LAANVCAADF LLKNKHTALF RNHLGPTPEK

501 LATLREQLGL LGLQLGGGDN PSPKDYAALA EQFKGRPDAE LLQVMMLRSM

551 QQAVYEPHCE GHFGLAYEAY AHFTSPIRRY PDLTVHRAIK AVLNRKTYTP

601 NKSWQALGVH TSFCERRADD AGRDVENWLK TYYMRDKVGE IFEGKISRGV

651 ANFGIFVTLD DIHIDGLVHI SDLGEDYFNF RPEIMAIEGE RSGIRFNMGD

701 RVAVRVARAD LDDGKIDFVL IAGESGRRRK VKLSASAKPA GAAGKGKSKT

751 TAEKKTARCG KVRGRGVPAV AESGKKAKKP VPIKVKKRKG KS*
```

The following partial DNA sequence was identified in *N. meningitidis* <SEQ ID 2981>:

m988.seq (partial)

```
   1 ..ACAGTTCTGG ATATTGTCGA ACGCGCGCAA AGCAAAGTGG TCGGCCGTTT

  51   CTATATGGAT AGGGGCGTGG CGATTTTGGA GCCGGAAGAC AAGCGTCTGA

 101   ACCAAAGCAT CGTATTGGAA CCGGACGGCG TGGCGCGTTT CAAACCTGAA

 151   TCCGGTCAGG TCATCGTCGG CGAAATTGAG GTTTATCCTG AGCAAAACCG

 201   GCCGGCAGTG GCAAAAATCA TCGAAGTTTT GGGCGATTAT GCCGACAGCG

 251   GCATGGAGAT TGAAATTGCC GTGCGCAAGC ATCATTTGCC GCACCAATTC

 301   AGTGAAGCGT GTGCCAAAGC TGCGAAAAAA ATTCCCGTCC ATGTACGCAA

 351   AAGCGATTTG AAAGGCCGCG TCGATTTGCG CGACCTGCCT TTGGTAACGA

 401   TAGACGGCGA AACGGCGCGC GATTTCGACG ACGCGGTGTT TGCCGAAAAA

 451   GTCGGACGCA ATTACCGTCT GGTCGTGGCG ATTGCGGATG TCAGCCATTA

 501   TGTCCGCCCT GACGATGTGA TTGATGCAGA TGCTCAAGAA CGCAGTACCA

 551   GCGTATATTT CCCGCGCCGT GTGATTCCGA TGCTGCCGGA AAACCTGTCT

 601   AACGGCATTT GCTCGCTCAA TCCCGATGTC GAGCGTTTGT GTATGGTGTG

 651   CGATATGGTC GTTACCTATG CGGGCAATAT CAAAGAATAC CGCTTCTACC

 701   CCGCCGTAAT GCGCTCTCAT GCCCGCCTGA CCTACAACCA AGTTTGGAAA

 751   TGGATTTCAG ACGGCATCGA CCATCCGTAC AAAGCCCAAA TCGACACCCT

 801   TTACAAACTC TTCAAAATCC TTCAGAAAAA GCGTTTCGAA CGCGGCGCGG

 851   TGGAGTTTGA AAGCGTCGAA ACCCAGATGA TTTTCGATGA CAACGGCAAA

 901   ATCGAAAAAA TCGTCCCCGT TGTCCGCAAC GATGCCCACA AGCTGATTGA

 951   AGAATGTATG CTGGCGGCGA ATGTTTGCGC AGCGGATTTC CTGTTGAAAA

1001   ACAAGCATAC GGCTTTGTTC CGCAACCATT TGGGCCCCAC GCCCGAAAAA

1051   CTCGCCACCC TGCGCGAGCA GCTCGGTCTG TTGGGGCTTC AACTTGGCGG
```

-continued

```
1101   CGGCGACAAC CCGTCGCCGA AAGACTATGC CGCGCTTGTC GAACAATTCA
1151   AAGGCAGACC TGATGCCGAA TTGCTGCAAG TCATGATGTT GCGCTCCATG
1201   CAGCAGGCGG TTTACGAACC GCATTGCGAC GGACACTTTG GTCTTGCCTA
1251   CGAAGCATAC GCCCACTTCA CCTCGCCCAT CCGCCGCTAT CCCGACCTGA
1301   CCGTACACCG CGCCATCAAA GCCGTGTTGA ATCAGCAAAC CTACACGCCA
1351   AAAAAAAGCT GGCAGGCTTT GGGCGTGCAT ACCTCGTTCT GTGAGCGCCG
1401   TGCCGACGAC GCCAGCCGCG ACGTGGAAAA CTGGCTGAAA ACCTATTATA
1451   TGCGCGATAA GGTCGGCGAA GTATTCGAAG GTAAAATCTC CGGCATGACC
1501   AGTTTTGGTA TCTTTGTAAC ACTGGACGGC ATCCACATTG ACGGCTTGGT
1551   GCATATCAGC GATTTGGGCG AAGACTATTT CAACTTCCGC CCCGAAATCA
1601   TGGCAATCGA AGGCGAACGC AGCGGCATCC GTTTCAACAT GGGGGACAGG
1651   GTTGCCGTCC GGGTCGCCCG TGCCGATTTG GATGACGGAA AAATCGATTT
1701   TGTCCTGATT GCCGGGGGGA CCGGCAGGGG GCGGAAAGTT AAATCATCCG
1751   CGTCTGCCAA ACCGGCAGGG ACGGCGGGGA AAGGGAAGCC GAAAACCGCC
1801   GCCGAGAAAA AAACAGCCCG AGGCGGCAAA GTAAGGGGAA GGGGCGCGTC
1851   TGCCGCCGCA GAATCGAGGA AAAAGGCAAA GAAACCGGTT CCGATTAAGG
1901   TAAAAAAACG GAAAGGCAAA TCATAA
```

This corresponds to the amino acid sequence <SEQ ID 2982; ORF 988>:

m988.pep (partial)

```
  1 ..TVLDIVERAQ SKVVGRFYMD RGVAILEPED KRLNQSIVLE PDGVARFKPE
 51   SGQVIVGEIE VYPEQNRPAV AKIIEVLGDY ADSGMEIEIA VRKHHLPHQF
101   SEACAKAAKK IPVHVRKSDL KGRVDLRDLP LVTIDGETAR DFDDAVFAEK
151   VGRNYRLVVA IADVSHYVRP DDVIDADAQE RSTSVYFPRR VIPMLPENLS
201   NGICSLNPDV ERLCMVCDMV VTYAGNIKEY RFYPAVMRSH ARLTYNQVWK
251   WISDGIDHPY KAQIDTLYKL FKILQKKRFE RGAVEFESVE TQMIFDDNGK
301   IEKIVPVVRN DAHKLIEECM LAANVCAADF LLKNKHTALF RNHLGPTPEK
351   LATLREQLGL LGLQLGGGDN PSPKDYAALV EQFKGRPDAE LLQVMMLRSM
401   QQAVYEPHCD GHFGLAYEAY AHFTSPIRRY PDLTVHRAIK AVLNQQTYTP
451   KKSWQALGVH TSFCERRADD ASRDVENWLK TYYMRDKVGE VFEGKISGMT
501   SFGIFVTLDG IHIDGLVHIS DLGEDYFNFR PEIMAIEGER SGIRFNMGDR
551   VAVRVARADL DDGKIDFVLI AGGSGRGRKV KSSASAKPAG TAGKGKPKTA
601   AEKKTARGGK VRGRGASAAA ESRKKAKKPV PIKVKKRKGK S*
```

Computer analysis of this amino acid sequence gave the following results:

Homology with a predicted ORF from *N. gonorrhoeae* m988/g988 94.2% identity in 642 aa overlap

```
                                                  10        20        30
m988.pep                                TVLDIVERAQSKVVGRFYMDRGVAILEPED
                                        | ||||||||||||||||||||||||||||
g988      LYERQMRGVMHGDTVTVRPAGMDRRGRREGTFLDIVERAQSKVVGRFYMDRGVAILEPED
                 130       140       150       160       170       180
                  40        50        60        70        80        90
m988.pep  KRLNQSIVLEPDGVARFKPESGQVIVGEIEVYPEQNRPAVAKIIEVLGDYADSGMEIEIA
          |||||||||||||||||||||||||||:||||||||||||||||||||||||||||||||
g988      KRLNQSIVLEPDGVARFKPESGQVIVGKIEVYPEQNRPAVAKIIEVLGDYADSGMEIEIA
                 190       200       210       220       230       240
                 100       110       120       130       140       150
m988.pep  VRKHHLPHQFSEACAKAAKKIPVHVRKSDLKGRVDLRDLPLVTIDGETARDFDDAVFAEK
          ||||||||:|||||||:||||| ||||||||||||| |||||||||||||||||||||||
g988      VRKHHLPHRFSEACAKSAKKIPDHVRKSDLKGRVDLCDLPLVTIDGETARDFDDAVFAEK
                 250       260       270       280       290       300
                 160       170       180       190       200       210
m988.pep  VGRNYRLVVAIADVSHYVRPDDVIDADAQERSTSVYFPRRVIPMLPENLSNGICSLNPDV
          ||||||||||||||||||||||:|||||||||||||||||:|||||||||||||||||||
g988      VGRNYRLVVAIADVSHYVRPDDAIDADAQERSTSVYFPRRMIPMLPENLSNGICSLNPDV
                 310       320       330       340       350       360
                 220       230       240       250       260       270
m988.pep  ERLCMVCDMVVTYAGNIKEYRFYPAVMRSHARLTYNQVWKWISDGIDHPYKAQIDTLYKL
          |||||||||||||||||||||||||||||||||||||||||:|||| :|:||||||||||
g988      ERLCMVCDMVVTYAGNIKEYRFYPAVMRSHARLTYNQVWKWLSDGIGNPHKAQIDTLYKL
                 370       380       390       400       410       420
                 280       290       300       310       320       330
m988.pep  FKILQKKRFERGAVEFESVETQMIFDDNGKIEKIVPVVRNDAHKLIEECMLAANVCAADF
          ||||||||: ||||||||||||||||||||||||||||||||||||||||||||||||||
g988      FKILQKKRLARGAVEFESVETQMIFDDNGKIEKIVPVVRNDAHKLIEECMLAANVCAADF
                 430       440       450       460       470       480
                 340       350       360       370       380       390
m988.pep  LLKNKHTALFRNHLGPTPEKLATLREQLGLLGLQLGGGDNPSPKDYAALVEQFKGRPDAE
          |||||||||||||||||||||||||||||||||||||||||||||||||:||||||||||
g988      LLKNKHTALFRNHLGPTPEKLATLREQLGLLGLQLGGGDNPSPKDYAALAEQFKGRPDAE
                 490       500       510       520       530       540
                 400       410       420       430       440       450
m988.pep  LLQVMMLRSMQQAVYEPHCDGHFGLAYEAYAHFTSPIRRYPDLTVHRAIKAVLNQQTYTP
          |||||||||||||||||||:||||||||||||||||||||||||||||||||||::||||
g988      LLQVMMLRSMQQAVYEPHCEGHFGLAYEAYAHFTSPIRRYPDLTVHRAIKAVLNRKTYTP
                 550       560       570       580       590       600
                 460       470       480       490         500     509
m988.pep  KKSWQALGVHTSFCERRADDASRDVENWLKTYYMRDKVGEVFEGKIS-GMTSFGIFVTLD
          :|||||||||||||||||||:|||||||||||||||||||:|||||| |:::||||||||
g988      NKSWQALGVHTSFCERRADDAGRDVENWLKTYYMRDKVGEIFEGKISRGVANFGIFVTLD
                 610       620       630       640       650       660
        510       520       530       540       550       560      569
m988.pep  GIHIDGLVHISDLGEDYFNFRPEIMAIEGERSGIRFNMGDRVAVRVARADLDDGKIDFVL
           |||||||||||||||||||||||||||||||||||||||||||||||||||||||||||
g988      DIHIDGLVHISDLGEDYFNFRPEIMAIEGERSGIRFNMGDRVAVRVARADLDDGKIDFVL
                 670       680       690       700       710       720
        570       580       590       600       610       620      629
m988.pep  IAGGSGRGRKVKSSASAKPAGTAGKGKPKTAAEKKTARGGKVRGRGASAAAESRKKAKKP
          ||| ||| |||| ||||||||:||||| ||:||||||| |||||||: |:||| ||||||
g988      IAGESGRRRKVKLSASAKPAGAAGKGKSKTTAEKKTARCGKVRGRGVPAVAESGKKAKKP
                 730       740       750       760       770       780
        630       640
m988.pep  VPIKVKKRKGKSX
          |||||||||||||
g988      VPIKVKKRKGKSX
                 790
```

The following partial DNA sequence was identified in *N. meningitidis* <SEQ ID 2983>:

a988.seq

```
  1 ATGAATAAAA ATATTAAATC TTTAAATTTA CGGGAAAAAG ACCCGTTTTT
 51 AAGTCGTGAA AAACAGCGTT ATGAACATCC TTTGCCCAGT CGGGAATGGA
101 TAATCGAGCT GCTTGAACGT AAAGGCGTAC CATCCAAGAT TGAAGCTTTG
151 GTACGCGAAT TGTCGATTAA GGAAGAAGAG TACGAATTTT TCGAACGTCG
201 TCTGAAGGCG ATGGCGCGGG ACGGTCAGGT TTTAATCAAC CGTCGGGGCG
251 CGGTTTGCGC GGCGGACAAA TTGGATTTGG TCAAATGCCG TGTCAAGGCG
```

-continued

```
301 CACAAAGACC GCTTCGGTTT CGCCGTGCCG CTCACGCCCG CCAAAGACGG

351 TGATTTTGTC TTGTACGAAC GCCAGATGCG CGGCATTATG CACGGCGATA

401 TTGTCACTGT TCGTCCTGCC GGCATGGACG GTAGGGGCCG CCGCGAAGGG

451 ACGGTTCTGG ATATTGTCGA ACGCGCGCAA AGCAAAGTGG TCGGCCGTTT

501 CTANATGGAT AGGGGCGTGG CGATTTTGGA GCCGGAAGAC AAGCGTCTGA

551 ACCAAAGCAT CGTATTGGAA CCGGACGGCG TGGCGCGTTT CAAACCTGAA

601 TCCGGTCAGG TCATCGTCGG CGAAATTGAG GTTTATCCTG AGCAAAACCG

651 GCCGGCAGTG GCAAAAATCA TCGAAGTTTT GGGCGATTAT GCCGACAGCG

701 GCATGGAGAT TGAAATTGCC GTGCGCAAGC ATCATTTGCC GCACCAATTC

751 AGTGAAGCGT GTGCCAAAGC CGCGAAAAAA ATTCCCGACC ATGTACGCAA

801 AAGCGATTTG AAAGGCCGCG TCGATTTGCG CGACCTGCCT TTGGTAACGA

851 TAGACGGCGA AACGGCTCGA GATTTTGACG ATGCGGTGTT TGCCGAGAAA

901 ATCGGACGCA ATTACCGTCT GGTCGTGGCG ATTGCCGATG TCAGCCATTA

951 TGTCCGCCCC GATGACGCTA TCGACACGGA CGCTCAGGAA CGCAGCACCA

1001 GTGTTTACTT CCCGCGCCGC GTGATTCCCA TGTTGCCGGA AAACCTGTCC

1051 AACGGCATCT GCTCGCTCAA TCCTCATGTC GAGCGTTTGT GTGTGGTGTG

1101 CGATATGGTT ATCACTTACG CGGGCAATAT CAAAGAATAC CGCTTCTACC

1151 CCGCCGTGAT GCGCTCTCAT GCCCGCCTGA CCTACAACCA AGTTTGGAAA

1201 TGGCTTTCAG GCGGCATCGA GCATCCGTTC AAAACCCAAA TCGACACGCT

1251 TTACAAACTC TTCAAAATCC TTCAGAAAAA GCGTTTCGAA CGCGGGGCGG

1301 TGGAGTTTGA CAGCATCGAA ACCCAAATGC TTTTCGACGA CAACGGTAAA

1351 ATTGAAAAAA TCGTCCCCGT TGTCCGCAAC GATGCCCACA AGCTGATTGA

1401 AGAATGTATG TTGGCGGCAA ACGTTTGCGC AGCGGATTTT CTGTTGAAAA

1451 ACAAGCATAC CGCATTGTTC CGCAACCATT TGGGGCCCAC GCCCGAAAAA

1501 CTCGCCGCCT TGCGCGAGCA GCTCGGTCTG TTGGGGCTTC AACTTGGCGG

1551 CGGCGACAAC CCGTCGCCGA AAGACTATGC CGCGCTTGCC GGACAGTTCA

1601 AAGGCAGGCC GGATGCCGAA TTGCTGCAAG TCATGATGTT GCGCTCCATG

1651 CAACAGGCGG TTTACGAACC GCATTGCGAC GGACACTTTG GTCTTGCCTA

1701 CGAAGCATAC GCCCACTTCA CCTCGCCCAT CCGCCGCTAT CCCGACCTGA

1751 CCGTACACCG CGCCATCAAA GCCGTGTTGA ATCAGCAAAC CTACACGCCA

1801 AAAAAAAGCT GGCAGGCTTT GGGCGTGCAT ACCTCGTTCT GTGAGCGCCG

1851 TGCCGACGAC GCCAGCCGCG ACGTGGAAAA CTGGCTGAAA ACCTATTATA

1901 TGCGCGATAA GGTCGGCGAA GTATTCGAAG GTAAAATCTC CGGCATGACC

1951 AGTTTTGGTA TCTTTGTAAC ACTGGACGGC ATCCACATTG ACGGCTTGGT

2001 GCATATCAGC GATTTGGGCG AAGACTATTT CAACTTCCGC CCCGAAATCA

2051 TGGCAATCGA AGGCGAACGC AGCGGCATCC GTTTCAACAT GGGGGACAGG

2101 GTTGCCGTCC GGGTCGCCCG TGCCGATTTG GATGACGGAA AAATCGATTT

2151 TGTCCTGATT GCCGGGGGGA GCGGCAGGGG GCGGAAAGTT AAATCATCCG

2201 CGTCTGCCAA ACCGGCAGGG ACGGCGGGGA AAGGGAAGCC GAAAACCGCC

2251 GCCGAGAAAA AACAGCCCGA AGGCGGCAAA GTAAGGGGAA GGGGCGCGTC
```

-continued

```
2301 TGCCGCCGCA GAATCGAGGA AAAAGGCAAA GAAACCGGTT CCGATTAAGG

2351 TAAAAAAACG GAAAGGCAAA TCATAA
```

This corresponds to the amino acid sequence <SEQ ID 2984; ORF 988.a>:

```
a988.pep

  1 MNKNIKSLNL REKDPFLSRE KQRYEHPLPS REWIIELLER KGVPSKIEAL

 51 VRELSIKEEE YEFFERRLKA MARDGQVLIN RRGAVCAADK LDLVKCRVKA

101 HKDRFGFAVP LTPAKDGDFV LYERQMRGIM HGDIVTVRPA GMDGRGRREG

151 TVLDIVERAQ SKVVGRFXMD RGVAILEPED KRLNQSIVLE PDGVARFKPE

201 SGQVIVGEIE VYPEQNRPAV AKIIEVLGDY ADSGMEIEIA VRKHHLPHQF

251 SEACAKAAKK IPDHVRKSDL KGRVDLRDLP LVTIDGETAR DFDDAVFAEK

301 IGRNYRLVVA IADVSHYVRP DDAIDTDAQE RSTSVYFPRR VIPMLPENLS

351 NGICSLNPHV ERLCVVCDMV ITYAGNIKEY RFYPAVMRSH ARLTYNQVWK

401 WLSGGIEHPF KTQIDTLYKL FKILQKKRFE RGAVEFDSIE TQMLFDDNGK

451 IEKIVPVVRN DAHKLIEECM LAANVCAADF LLKNKHTALF RNHLGPTPEK

501 LAALREQLGL LGLQLGGGDN PSPKDYAALA GQFKGRPDAE LLQVMMLRSM

551 QQAVYEPHCD GHFGLAYEAY AHFTSPIRRY PDLTVHRAIK AVLNQQTYTP

601 KKSWQALGVH TSFCERRADD ASRDVENWLK TYYMRDKVGE VFEGKISGMT

651 SFGIFVTLDG IHIDGLVHIS DLGEDYFNFR PEIMAIEGER SGIRFNMGDR

701 VAVRVARADL DDGKIDFVLI AGGSGRGRKV KSSASAKPAG TAGKGKPKTA

751 AEKKTARGGK VRGRGASAAA ESRKKAKKPV PIKVKKRKGK S*
```

m988/a988 97.0% identity in 641 aa overlap

```
                                                   10        20        30
m988.pep                                 TVLDIVERAQSKVVGRFYMDRGVAILEPED
                                         ||||||||||||||||| ||||||||||||
a988      LYERQMRGIMHGDIVTVRPAGMDGRGRREGTVLDIVERAQSKVVGRFXMDRGVAILEPED
                 130       140       150       160       170       180

                  40        50        60        70        80        90
m988.pep  KRLNQSIVLEPDGVARFKPESGQVIVGEIEVYPEQNRPAVAKIIEVLGDYADSGMEIEIA
          ||||||||||||||||||||||||||||||||||||||||||||||||||||||||||||
a988      KRLNQSIVLEPDGVARFKPESGQVIVGEIEVYPEQNRPAVAKIIEVLGDYADSGMEIEIA
                 190       200       210       220       230       240

                 100       110       120       130       140       150
m988.pep  VRKHHLPHQFSEACAKAAKKIPVHVRKSDLKGRVDLRDLPLVTIDGETARDFDDAVFAEK
          |||||||||||||||||||||| |||||||||||||||||||||||||||||||||||||
a988      VRKHHLPHQFSEACAKAAKKIPDHVRKSDLKGRVDLRDLPLVTIDGETARDFDDAVFAEK
                 250       260       270       280       290       300

                 160       170       180       190       200       210
m988.pep  VGRNYRLVVAIADVSHYVRPDDVIDADAQERSTSVYFPRRVIPMLPENLSNGICSLNPDV
          :|||||||||||||||||||||:||:|||||||||||||||||||||||||||||||| |
a988      IGRNYRLVVAIADVSHYVRPDDAIDTDAQERSTSVYFPRRVIPMLPENLSNGICSLNPHV
                 310       320       330       340       350       360

                 220       230       240       250       260       270
m988.pep  ERLCMVCDMVVTYAGNIKEYRFYPAVMRSHARLTYNQVWKWISDGIDHPYKAQIDTLYKL
          ||||:|||||:||||||||||||||||||||||||||||||:| ||:||:|:||||||||
a988      ERLCVVCDMVITYAGNIKEYRFYPAVMRSHARLTYNQVWKWLSGGIEHPFKTQIDTLYKL
                 370       380       390       400       410       420

                 280       290       300       310       320       330
m988.pep  FKILQKKRFERGAVEFESVETQMIFDDNGKIEKIVPVVRNDAHKLIEECMLAANVCAADF
          ||||||||||||||||:|:||||:||||||||||||||||||||||||||||||||||||
a988      FKILQKKRFERGAVEFDSIETQMLFDDNGKIEKIVPVVRNDAHKLIEECMLAANVCAADF
                 430       440       450       460       470       480
```

-continued

```
               340       350       360       370       380       390
m988.pep  LLKNKHTALFRNHLGPTPEKLATLREQLGLLGLQLGGGDNPSPKDYAALVEQFKGRPDAE
          ||||||||||||||||||||||:|||||||||||||||||||||||||||: ||||||||
a988      LLKNKHTALFRNHLGPTPEKLAALREQLGLLGLQLGGGDNPSPKDYAALAGQFKGRPDAE
               490       500       510       520       530       540

               400       410       420       430       440       450
m988.pep  LLQVMMLRSMQQAVYEPHCDGHFGLAYEAYAHFTSPIRRYPDLTVHRAIKAVLNQQTYTP
          ||||||||||||||||||||||||||||||||||||||||||||||||||||||||||||
a988      LLQVMMLRSMQQAVYEPHCDGHFGLAYEAYAHFTSPIRRYPDLTVHRAIKAVLNQQTYTP
               550       560       570       580       590       600

               460       470       480       490       500       510
m988.pep  KKSWQALGVHTSFCERRADDASRDVENWLKTYYMRDKVGEVFEGKISGMTSFGIFVTLDG
          ||||||||||||||||||||||||||||||||||||||||||||||||||||||||||||
a988      KKSWQALGVHTSFCERRADDASRDVENWLKTYYMRDKVGEVFEGKISGMTSFGIFVTLDG
               610       620       630       640       650       660

               520       530       540       550       560       570
m988.pep  IHIDGLVHISDLGEDYFNFRPEIMAIEGERSGIRFNMGDRVAVRVARADLDDGKIDFVLI
          ||||||||||||||||||||||||||||||||||||||||||||||||||||||||||||
a988      IHIDGLVHISDLGEDYFNFRPEIMAIEGERSGIRFNMGDRVAVRVARADLDDGKIDFVLI
               670       680       690       700       710       720

               580       590       600       610       620       630
m988.pep  AGGSGRGRKVKSSASAKPAGTAGKGKPKTAAEKKTARGGKVRGRGASAAAESRKKAKKPV
          ||||||||||||||||||||||||||||||||||||||||||||||||||||||||||||
a988      AGGSGRGRKVKSSASAKPAGTAGKGKPKTAAEKKTARGGKVRGRGASAAAESRKKAKKPV
               730       740       750       760       770       780

               640
m988.pep  PIKVKKRKGKSX
          ||||||||||||
a988      PIKVKKRKGKSX
               790
```

The following partial DNA sequence was identified in *N. gonorrhoeae* <SEQ ID 2985>:

g989.seq

```
  1 ATGACCCCTT TCACACTGAA AAAAACCGTC CTGCTGCTCG GCACTGCCTT
 51 TGCCGCCGCA TCTGTCCACG CATCCGGCTA CCACTTCGGC ACACAGTCGG
101 TCAACGCGCA AAGCACGGCA AATGCCGCCG ACGCGTCGAC CATCTTCTAC
151 AATCCCGCCG GCCTGACCAA ACTCGACAGC AGCCAGATTT CCGTCAACGC
201 CAACATCGTG CTGCCCAGCA TTCATTATGA AGCAGATTCC GCCACCGACT
251 TTACCGGGCT TCCCGTCCAA GGTTCTAAAA ACGGCAAAAT CACCAAAACC
301 ACGGTCGCAC CCCACATTTA CGGCGCATAC AAAGTCAACG ACAATCTGAC
351 CGTGGGCTTG GGCGTGTACG TCCCCTTCGG CTCTGCCACC GAATACGAAA
401 AAGATTCCGT GTTGCGCCAC AACATCAACA AACTCGGTCT GACCAGCATC
451 GCCGTCGAAC CTGTCGCCGC GTGGAAACTC AACGAACGCC ATTCCTTCGG
501 CGCAGGCATC ATCGCCCAAC ATAATTCCGC CGAACTGCGC AAATATGCCG
551 ACTGAGGAAT CCCAAAAAAA GCGCAAATGC TGCAAGCAAC ACCTTCTAAT
601 CCTACTGCCG CTGCTCAAAT CAAGGCCGAC GGACACGCCG ATGTCAAAGG
651 CAGCGATTGG GGCGTCGGCT ACCAACTGGC GTGGATGTGG GACATCAACG
701 ACCGCGCGCG CGTGGGCGTG AACTACCGTT CCAAAGTTTC ACACACGCTC
751 AAAGGCGATG CCGAATGGGC GGCAGACGGC GCGGCGGCGA AACAACAGTG
801 GAATGACAAT ATGCTCACAC CGCTCGGTTA CACGGCGAAT GAAAAAGCCA
851 GTGTCAAAAT CGTAACGCCT GAGTCTTTGT CCGTACACGG CATGTACAAA
901 GTGTCCGACA AAGCCGACCT GTTCGGCGAC GTAACTTGGA CGCGCCACAG
951 CCGCTTCAAT AAGGCGGAAC TGTTTTTTGA AAAAGAAAAA AATATTGCTA
```

-continued

```
1001 ATGGCAAAAA ATCCGACCGC ACCACCATCA CCCCCAACTG GCGCAACACC

1051 TACAAAGTCG GCTTGGGCGG TTCTTATCAA ATCAGCGAAC CGCTGCAACT

1101 GCGCGTCGGC ATCGCTTTTG ACAAACCGCC TGTCCGCAAC GCCGACTacC

1151 GCATGAACAG CCTGCCCGAC GGCAACCGCA TCTGGTTCTC CGCCCGCATG

1201 AAATACCATA TCGGCAAAAA CCACGTCGTC GATGCCGCCT ACACCCACAT

1251 CCACATCAAC GACACCAGCT ACCGCACGGC GAAGGCAAGC GGCAACGATG

1301 TGGACAGCAA AGGTGCGTCT TGCGCACGTT TCAAAAACCA CGCCGACATC

1351 ATCGGCCTGC AATACACCTA CAAATTCAAA TAA
```

This corresponds to the amino acid sequence <SEQ ID 2986; ORF 989.ng>:

g989.pep

```
  1 MTPFTLKKTV LLLGTAFAAA SVHASGYHFG TQSVNAQSTA NAADASTIFY

 51 NPAGLTKLDS SQISVNANIV LPSIHYEADS ATDFTGLPVQ GSKNGKITKT

101 TVAPHIYGAY KVNDNLTVGL GVYVPFGSAT EYEKDSVLRH NINKLGLTSI

151 AVEPVAAWKL NERHSFGAGI IAQHNSAELR KYAD*GIPKK AQMLQATPSN

201 PTAAAQIKAD GHADVKGSDW GVGYQLAWMW DINDRARVGV NYRSKVSHTL

251 KGDAEWAADG AAAKQQWNDN MLTPLGYTAN EKASVKIVTP ESLSVHGMYK

301 VSDKADLFGD VTWTRHSRFN KAELFFEKEK NIANGKKSDR TTITPNWRNT

351 YKVGLGGSYQ ISEPLQLRVG IAFDKPPVRN ADYRMNSLPD GNRIWFSAGM

401 KYHIGKNHVV DAAYTHIHIN DTSYRTAKAS GNDVDSKGAS CARFKNHADI

451 IGLQYTYKFK *
```

The following partial DNA sequence was identified in *N. meningitidis* <SEQ ID 2987>:

m989.seq

```
  1 ATGACCCCTT CCGCACTGAA AAAAACCGTC CTGCTGCTCG GCACTGCCTT

 51 TGCCGCCGCA TCCGTCCACG CATCCGGCTA CCACTTCGGC ACACAGTCGG

101 TCAACGCGCA AAGCACGGCA AATGCCGCCG CCGCAGAAGC CGCCGACGCA

151 TCGACCATCT TCTACAACCC TGCCGGCCTG ACCAAACTCG ACAGCAGCCA

201 GATTTCCGTC AACGCCAACA TCGTGCTGCC CAGCATTCAT TATGAGGCGG

251 ATTCCGCCAC CGACTTTACC GGGCTTCCCG TCCAAGGTTC GAAAAGCGGC

301 AAAATCACCA AAACCACGGT CGCGCCCCAC ATCTACGGCG CATACAAAGT

351 CAACGACAAT CTGACCGTGG GCTTGGGCGT GTACGTCCCC TTCGGCTCTG

401 CCACCGAATA CGAAAAAGAT TCCGTGTTGC GCCACAACAT CAACAAACTC

451 GGTCTGACCA GCATCGCCGT CGAACCTGTC GCCGCGTGGA AACTCAACGA

501 CCGCCATTCC TTCGGCGCAG GCATCATCGC CCAACATACT TCCGCCGAAC

551 TGCGCAAATA TGCCGACTGG GGGATTAAGA GTAAAGCAGA GATATTGACG

601 GCAAAACCGC CCAAACCTAA CGGTGTAGCC GAAGCTGCAA AAATTCAGGC

651 CGACGGACAC GCCGATGTCA AAGGCAGCGA TTGGGGCTTC GGCTACCAAC
```

-continued

```
 701 TGGCGTGGAT GTGGGACATC AACGACCGTG CGCGCGTGGG CGTGAACTAC
 751 CGTTCCAAAG TCTCGCACAC GCTCAAAGGC GATGCCGAAT GGGCGGCAGA
 801 CGGCGCGGCG GCGAAAGCAA TGTGGAGTAC GATGCTTGCA GCAAACGGCT
 851 ACACGGCGAA TGAAAAAGCC CGCGTTAAAA TCGTTACGCC TGAGTCTTTG
 901 TCCGTACACG GTATGTACAA AGTGTCCGAT AAAGCCGACC TGTTCGGCGA
 951 CGTAACTTGG ACGCGCCACA GCCGCTTCGA TAAGGCGGAA CTGGTTTTTG
1001 AAAAAGAAAA AACCGTCGTC AAAGGCAAAT CCGACCGCAC CACCATCACC
1051 CCCAACTGGC GCAACACCTA CAAAGTCGGC TTCGGCGGTT CTTATCAAAT
1101 CAGCGAACCG CTGCAACTGC GCGCCGGCAT CGCTTTTGAC AAATCGCCCG
1151 TCCGCAACGC CGACTACCGC ATGAACAGCC TACCCGACGG CAACCGCATC
1201 TGGTTCTCCG CCGGTATGAA ATACCATATC GGTAAAAACC ACGTCGTCGA
1251 TGCCGCCTAC ACCCACATCC ACATCAACGA CACCAGCTAC CGCACGGCGA
1301 AGGCAAGCGG CAACGATGTG GACAGCAAAG GCGCGTCTTC CGCACGTTTC
1351 AAAAACCACG CCGACATCAT CGGTCTGCAA TACACCTACA AATTCAAATA
1401 A
```

This corresponds to the amino acid sequence <SEQ ID 2988; ORF 989>:

m989.pep

```
  1 MTPSALKKTV LLLGTAFAAA SVHASGYHFG TQSVNAQSTA NAAAAEAADA
 51 STIFYNPAGL TKLDSSQISV NANIVLPSIH YEADSATDFT GLPVQGSKSG
101 KITKTTVAPH IYGAYKVNDN LTVGLGVYVP FGSATEYEKD SVLRHNINKL
151 GLTSIAVEPV AAWKLNDRHS FGAGIIAQHT SAELRKYADW GIKSKAEILT
201 AKPPKPNGVA EAAKIQADGH ADVKGSDWGF GYQLAWMWDI NDRARVGVNY
251 RSKVSHTLKG DAEWAADGAA AKAMWSTMLA ANGYTANEKA RVKIVTPESL
301 SVHGMYKVSD KADLFGDVTW TRHSRFDKAE LVFEKEKTVV KGKSDRTTIT
351 PNWRNTYKVG FGGSYQISEP LQLRAGIAFD KSPVRNADYR MNSLPDGNRI
401 WFSAGMKYHI GKNHVVDAAY THIHINDTSY RTAKASGNDV DSKGASSARF
451 KNHADIIGLQ YTYKFK*
```

Computer analysis of this amino acid sequence gave the following results:

Homology with a predicted ORF from *N. gonorrhoeae* g989/m989 90.0% identity in 468 aa overlap

```
                  10        20        30        40             50
g989.pep  MTPFTLKKTVLLLGTAFAAASVHASGYHFGTQSVNAQSTANAA-----DASTIFYNPAGL
          ||| :||||||||||||||||||||||||||||||||||||||     ||||||||||||
m989      MTPSALKKTVLLLGTAFAAASVHASGYHFGTQSVNAQSTANAAAAEAADASTIFYNPAGL
                  10        20        30        40        50        60

             60        70        80        90       100       110
g989.pep  TKLDSSQISVNANIVLPSIHYEADSATDFTGLPVQGSKNGKITKTTVAPHIYGAYKVNDN
          ||||||||||||||||||||||||||||||||||||||:|||||||||||||||||||||
m989      TKLDSSQISVNANIVLPSIHYEADSATDFTGLPVQGSKSGKITKTTVAPHIYGAYKVNDN
                  70        80        90       100       110       120
```

-continued

```
                120       130       140       150       160       170
g989.pep      LTVGLGVYVPFGSATEYEKDSVLRHNINKLGLTSIAVEPVAAWKLNERHSFGAGIIAQHN
              ||||||||||||||||||||||||||||||||||||||||||||||:||||||||||||:
m989          LTVGLGVYVPFGSATEYEKDSVLRHNINKLGLTSIAVEPVAAWKLNDRHSFGAGIIAQHT
                     130       140       150       160       170       180

180       190       200          210       220       230
g989.pep      SAELRKYADXGIPKKAQMLQATPSNPTA---AAQIKADGHADVKGSDWGVGYQLAWMWDI
              ||||||||| || :||::| | | :|::   ||:|:||||||||||||| ||||||||||
m989          SAELRKYADWGIKSKAEILTAKPPKPNGVAEAAKIQADGHADVKGSDWGFGYQLAWMWDI
                     190       200       210       220       230       240

240       250       260       270       280       290
g989.pep      NDRARVGVNYRSKVSHTLKGDAEWAADGAAAKQQWNDNMLTPLGYTANEKASVKIVTPES
              |||||||||||||||||||||||||||||||| :|: :||:  |||||||| ||||||||
m989          NDRARVGVNYRSKVSHTLKGDAEWAADGAAAKAMWS-TMLAANGYTANEKARVKIVTPES
                     250       260       270        280       290

300       310       320       330       340       350
g989.pep      LSVHGMYKVSDKADLFGDVTWTRHSRFNKAELFFEKEKNIANGKKSDRTTITPNWRNTYK
              |||||||||||||||||||||||||||:|||| |||||::::|| |||||||||||||||
m989          LSVHGMYKVSDKADLFGDVTWTRHSRFDKAELVFEKEKTVVKGK-SDRTTITPNWRNTYK
            300       310       320       330       340        350

360       370       380       390       400       410
g989.pep      VGLGGSYQISEPLQLRVGIAFDKPPVRNADYRMNSLPDGNRIWFSAGMKYHIGKNHVVDA
              ||:|||||||||||||:|||||| ||||||||||||||||||||||||||||||||||||
m989          VGFGGSYQISEPLQLRAGIAFDKSPVRNADYRMNSLPDGNRIWFSAGMKYHIGKNHVVDA
             360       370       380       390       400       410

420       430       440       450       460
g989.pep      AYTHIHINDTSYRTAKASGNDVDSKGASCARFKNHADIIGLQTYYKFKX
              |||||||||||||||||||||||||||| ||||||||||||||||||||
m989          AYTHIHINDTSYRTAKASGNDVDSKGASSARFKNHADIIGLQYTYKFKX
             420       430       440       450       460
```

The following partial DNA sequence was identified in *N. meningitidis* <SEQ ID 2989>:

a989.seq

```
   1 ATGACCCCTT CCGCACTGAA AAAAACCGTC CTACTGCTCG GCACTGCCTT
  51 TGCCGCCGCA TCCGCACAAG CCTCCGGCTA CCACTTCGGC ACACAGTCGG
 101 TCAACGCGCA AAGCACGGCA AATGCCGCCG CCGCAGAAGC CGCCGACGCA
 151 TCGACCATCT TCTACAACCC TGCCGGCCTG ACCAAACTCG ACAGCAGCCA
 201 GATTTCCGTC AACGCCAACA TCGTGCTGCC CAGCATTCAT TATGAGGCGG
 251 ATTCCGCCAC CGACTTTACC GGGCTTCCCG TCCAAGGTTC GAAAAGCGGC
 301 AAAATCACCA AAACCACGGT CGCGCCCCAC ATCTACGGCG CATACAAAGT
 351 CAACGACAAT CTGACCGTAG GCTTGGGCGT GTACGTCCCC TTCGGTTCTG
 401 CCACCGAATA CGAAAAAGAT TCCGTGTTGC GCCACAACAT CAACAAACTC
 451 GGTCTGACCA GCATCGCCGT CGAACCTGTC GCCGCGTGGA AACTCAACGA
 501 ACGCCATTCC TTCGGCGCAG GCATCATCGC CCAACATACT TCCGCCGAGC
 551 TGCGCAAATA TGCCGACTGG GGGATTATGG AAAAAGCGAA AGCACTAAAA
 601 GAAACACCCC CCAATCCAAC TAAAGCCGCC CAAATCAAAG CCGACGGACA
 651 CGCCGATGTC AAAGGCAGCG ATTGGGGCTT CGGCTACCAA CTGGCGTGGA
 701 TGTGGGACAT CAACGACCGT GCGCGCGTGG GCGTGAACTA CCGTTCCAAA
 751 GTCTCACACA CGCTCAAAGG CGATGCCGAA TGGGCGGCAG ACGACGCAAT
 801 GGCGAAACAG TTATGGGATG CAAACAAACT CGCACTGCTC GGCTACACGC
 851 CAAGCGAAAA AGCCCGCGTT AAAATCGTTA CGCCCGAGTC TTTGTCCGTA
 901 CACGGTATGT ACAAAGTGTC CGACAAAGCC GACCTGTTCG GCGACGTAAC
 951 TTGGACGCGC CACAGCCGCT TCGATAAGGC GGAACTGGTT TTTGAAAAAG
1001 AAAAAACCAT CGTCAACGGC AAATCCGACC GCACCACCAT CACCCCCAAC
```

-continued

```
1051 TGGCGCAACA CCTACAAAGT CGGCTTCGGC GGTTCTTATC AAATCAGCGA

1101 ACCGCTGCAA CTGCGCGCCG GCATCGCTTT TGACAAATCG CCCGTCCGCA

1151 ACGCCGACTA CCGCATGAAC AGCCTGCCCG ACGGCAACCG CATCTGGTTC

1201 TCCGCCGGCA TGAAATACCA TATCGGCAAA AACCACGTCG TCGATGCCGC

1251 CTACACCCAC ATCCACATCA ACGACACCAG CTACCGCACG GCGAAGGCAA

1301 GCGGCAACGA TGTGGACAGC AAAGGCGCGT CTTCCGCACG TTTCAAAAAC

1351 CACGCCGACA TCATCGGCCT GCAATACACC TACAAATTCA AATAA
```

This corresponds to the amino acid sequence <SEQ ID 2990; ORF 989.a>:

```
a989.pep

  1 MTPSALKKTV LLLGTAFAAA SAQASGYHFG TQSVNAQSTA NAAAAEAADA

 51 STIFYNPAGL TKLDSSQISV NANIVLPSIH YEADSATDFT GLPVQGSKSG

101 KITKTTVAPH IYGAYKVNDN LTVGLGVYVP FGSATEYEKD SVLRHNINKL

151 GLTSIAVEPV AAWKLNERHS FGAGIIAQHT SAELRKYADW GIMEKAKALK

201 ETPPNPTKAA QIKADGHADV KGSDWGFGYQ LAWMWDINDR ARVGVNYRSK

251 VSHTLKGDAE WAADDAMAKQ LWDANKLALL GYTFSEKARV KIVTPESLSV

301 HGMYKVSDKA DLFGDVTWTR HSRFDKAELV FEKEKTIVNG KSDRTTITPN

351 WRNTYKVGFG GSYQISEPLQ LRAGIAFDKS PVRNADYRMN SLPDGNRIWF

401 SAGMKYHIGK NHVVDAAYTH IHINDTSYRT AKASGNDVDS KGASSARFKN

451 HADIIGLQYT YKFK*
```

m989/a989 93.1% identity in 467 aa overlap

```
                   10        20        30        40        50        60
m989.pep   MTPSALKKTVLLLGTAFAAASVHASGYHFGTQSVNAQSTANAAAAEAADASTIFYNPAGL
           |||||||||||||||||||||::|||||||||||||||||||||||||||||||||||||
a989       MTPSALKKTVLLLGTAFAAASAQASGYHFGTQSVNAQSTANAAAAEAADASTIFYNPAGL
                   10        20        30        40        50        60

                   70        80        90       100       110       120
m989.pep   TKLDSSQISVNANIVLPSIHYEADSATDFTGLPVQGSKSGKITKTTVAPHIYGAYKVNDN
           ||||||||||||||||||||||||||||||||||||||||||||||||||||||||||||
a989       TKLDSSQISVNANIVLPSIHYEADSATDFTGLPVQGSKSGKITKTTVAPHIYGAYKVNDN
                   70        80        90       100       110       120

                  130       140       150       160       170       180
m989.pep   LTVGLGVYVPFGSATEYEKDSVLRHNINKLGLTSIAVEPVAAWKLNDRHSFGAGIIAQHT
           ||||||||||||||||||||||||||||||||||||||||||||||:|||||||||||||
a989       LTVGLGVYVPFGSATEYEKDSVLRHNINKLGLTSIAVEPVAAWKLNERHSFGAGIIAQHT
                  130       140       150       160       170       180

                  190       200       210       220       230       240
m989.pep   SAELRKYADWGIKSKAEILTAKPPKPNGVAEAAKIQADGHADVKGSDWGFGYQLAWMWDI
           ||||||||||||  ||: |   ||:|:   :||:|:||||||||||||||||||||||||
a989       SAELRKYADWGIMEKAKALKETPPNPT---KAAQIKADGHADVKGSDWGFGYQLAWMWDI
                  190       200           210       220       230

                  250       260       270        280       290      299
m989.pep   NDRARVGVNYRSKVSHTLKGDAEWAADGAAAKAMW-STMLAANGYTANEKARVKIVTPES
           ||||||||||||||||||||||||||| | || :| :: ||  ||| :||||||||||||
a989       NDRARVGVNYRSKVSHTLKGDAEWAADDAMAKQLWDANKLALLGYTPSEKARVKIVTPES
            240       250       260       270       280       290

         300       310       320       330       340       350      359
m989.pep   LSVHGMYKVSDKADLFGDVTWTRHSRFDKAELVFEKEKTVVKGKSDRTTITPNWRNTYKV
           |||||||||||||||||||||||||||||||||||||||:|:||||||||||||||||||
a989       LSVHGMYKVSDKADLFGDVTWTRHSRFDKAELVFEKEKTIVNGKSDRTTITPNWRNTYKV
            300       310       320       330       340       350
```

-continued

```
         360        370        380        390        400        410       419
m989.pep  GFGGSYQISEPLQLRAGIAFDKSPVRNADYRMNSLPDGNRIWFSAGMKYHIGKNHVVDAA
          ||||||||||||||||||||||||||||||||||||||||||||||||||||||||||||
a989      GFGGSYQISEPLQLRAGIAFDKSPVRNADYRMNSLPDGNRIWFSAGMKYHIGKNHVVDAA
          360        370        380        390        400        410

420        430        440        450        460
m989.pep  YTHIHINDTSYRTAKASGNDVDSKGASSARFKHADIIGLQYTYKFKX
          |||||||||||||||||||||||||||||||||||||||||||||||
a989      YTHIHINDTSYRTAKASGNDVDSKGASSARFKHADIIGLQYTYKFKX
          420        430        440        450        460
```

The following partial DNA sequence was identified in *N. meningitidis* <SEQ ID 2991>:

m990.seq

```
   1 ATGTTCAGAG CTCAGCTTGG TTCAAATACT CGTTCTACCA AAATCGGCGA
  51 CGATGCCGAT TTTTCATTTT CAGACAAGCC GAAACCCGGC ACTTCCCATT
 101 ATTTTTCCAG CGGTAAAACC GATCAAAATT CATCCGAATA TGGGTATGAC
 151 GAAATCAATA TCCAAGGTAA AAATTACAAT AGCGGCATCC TCGCCGTCGA
 201 TAATATGCCC GTTGTCAAAA AATATATTAC AGAGAAGTAT GGGGCTGATT
 251 TAAAGCAGGC GGTTAAAAGT CAATTACAGG ATTTATACAA AACAAGACCG
 301 GAAGCTTGGG CAGAAAATAA AAAACGGACT GAGGAGGCGT ATATAGCACA
 351 GTTTGGAACA AAATTTAGTA CGCTCAAACA GACGATGCCC GATTTAATTA
 401 ATAAATTGGT AGAAGATTCC GTACTCACTC CTCATAGTAA TACATCACAG
 451 ACTAGTCTCA ACAACATCTT CAATAAAAAA TTACACGTCA AATCGAAAAA
 501 CAAATCCCAC GTCGCCGGAC AGGTGTTGGA ACTGACCAAG ATGACGCTGA
 551 AAGATTCCCT TTGGGAACCG CGCCGCCATT CCGACATCCA TACGCTGGAA
 601 ACTTCCGATA ATGCCCGCAT CCGCCTGAAC ACGAAAGATG AAAAACTGAC
 651 CGTCCATAAG GATTATGCGG GCGGCGCGGA TTTCCTGTTC GGCTACGACG
 701 TGCGGGAGTC GGACGAACCC GCCCTGACCT TTGAAGACAA AGTCAGCGGA
 751 CAATCCGGCG TGGTTTTGGA ACGCCGGCCG GAAAATCTGA AAACGCTCGA
 801 CGGGCGCAAA CTGATTGCGG CAAAAACGGC GGATTCCGGT TCGTTTGCGT
 851 TTAAACAAAA TTACCGGCAG GGACTGTACG AATTATTGCT CAAGCAATGC
 901 GAAGGCGGAT TTTGCTTGGG CGTGCAGCGT TTGGCTATCC CCGAGGCGGA
 951 AGCGGTTTTA TATGCCCAAC AGGCTTATGC GGCAAATACT TTGTTTGGGC
1001 TGCGTGCCGC CGACAGGGGC GACGACGTGT ATGCCGCCGA TCCGTCCCGT
1051 CAAAAATTGT GGCTGCGCTT CATCGGCGGC CGGTCGCATC AAAATATACG
1101 GGGCGGCGCG GCTGCGGACG GGTGGCGCAA AGGCGTGCAA ATCGGCGGCG
1151 AGGTGTTTGT ACGGCAAAAT GAAGGCAGCC GACTGGCAAT CGGCGTGATG
1201 GGCGGCAGGG CCGGCCAGCA CGCATCAGTC AACGGCAAAG GCGGTGCGGC
1251 AGGCAGTGAT TTGTATGGTT ATGGCGGGGG TGTTTATGCT GCGTGGCATC
1301 AGTTGCGCGA TAAACAAACG GGTGCGTATT TGGACGGCTG GTTGCAATAC
1351 CAACGTTTCA AACACCGCAT CAATGATGAA AACCGTGCGG AACGCTACAA
1401 AACCAAAGGT TGGACGGCTT CTGTCGAAGG CGGCTACAAC GCGCTTGTGG
1451 CGGAAGGCAT TGTCGGAAAA GGCAATAATG TGCGGTTTTA CCTACAACCG
```

-continued

```
1501 CAGGCGCAGT TTACCTACTT GGGCGTAAAC GGCGGCTTTA CCGACAGCGA
1551 GGGGACGGCG GTCGGACTGC TCGGCAGCGG TCAGTGGCAA AGCCGCGCCG
1601 GCATTCGGGC AAAAACCCGT TTTGCTTTGC GTAACGGTGT CAATCTTCAG
1651 CCTTTTGCCG CTTTTAATGT TTTGCACAGG TCAAAATCTT TCGGCGTGGA
1701 AATGGACGGC GAAAAACAGA CGCTGGCAGG CAGGACGGCA CTCGAAGGGC
1751 GGTTCGGTAT TGAAGCCGGT TGGAAAGGCC ATATGTCCGC ACGCATCGGA
1801 TATGGCAAAA GGACGGACGG CGACAAAGAA GCCGCATTGT CGCTCAAATG
1851 GCTGTTTTGA
```

This corresponds to the amino acid sequence <SEQ ID 2992; ORF 990>:

m990.pep

```
  1 MFRAQLGSNT RSTKIGDDAD FSFSDKPKPG TSHYFSSGKT DQNSSEYGYD
 51 EINIQGKNYN SGILAVDNMP VVKKYITEKY GADLKQAVKS QLQDLYKTRP
101 EAWAENKKRT EEAYIAQFGT KFSTLKQTMP DLINKLVEDS VLTPHSNTSQ
151 TSLNNIFNKK LHVKIENKSH VAGQVLELTK MTLKDSLWEP RRHSDIHTLE
201 TSDNARIRLN TKDEKLTVHK DYAGGADFLF GYDVRESDEP ALTFEDKVSG
251 QSGVVLERRP ENLKTLDGRK LIAAKTADSG SFAFKQNYRQ GLYELLLKQC
301 EGGFCLGVQR LAIPEAEAVL YAQQAYAANT LFGLRAADRG DDVYAADPSR
351 QKLWLRFIGG RSHQNIRGGA AADGWRKGVQ IGGEVFVRQN EGSRLAIGVM
401 GGRAGQHASV NGKGGAAGSD LYGYGGGVYA AWHQLRDKQT GAYLDGWLQY
451 QRFKHRINDE NRAERYKTKG WTASVEGGYN ALVAEGIVGK GNNVRFYLQP
501 QAQFTYLGVN GGFTDSEGTA VGLLGSGQWQ SRAGIRAKTR FALRNGVNLQ
551 PFAAFNVLHR SKSFGVEMDG EKQTLAGRTA LEGRFGIEAG WKGHMSARIG
601 YGKRTDGDKE AALSLKWLF*
```

The following partial DNA sequence was identified in *N. meningitidis* <SEQ ID 2993>:

a990.seq

```
  1 ATGTTCAGAG CTCAGCTTGG TTCAAATACT CGTTCTACCA AAATCGGCGA
 51 CGATGCCGAT TTTTCATTTT CAGACAAGCC GAAACCCGGC ACTTCCCATT
101 ATTTTTCCAG CGGTAAAACC GATCAAAATT CATCCGAATA TGGGTATGAC
151 GAAATCAATA TCCAAGGTAA AAACTACAAT AGCGGCATAC TCGCCGTCGA
201 TAATATGCCC GTTGTTAAGA AATATATTAC AGATACTTAC GGGGATAATT
251 TAAAGGATGC GGTTAAGAAG CAATTACAGG ATTTATACAA AACAAGACCC
301 GAAGCTTGGG AAGAAAATAA AAAACGGACT GAGGAGGCGT ATATAGAACA
351 GCTTGGACCA AAATTTAGTA TACTCAAACA GAAAAACCCC GATTTAATTA
401 ATAAATTGGT AGAAGATTCC GTACTCACTC CTCATAGTAA TACATCACAG
451 ACTAGTCTCA ACAACATCTT CAATAAAAAA TTACACGTCA AAATCGAAAA
```

-continued

```
 501 CAAATCCCAC GTCGCCGGAC AGGTGTTGGA ACTGACCAAG ATGACGCTGA
 551 AAGATTCCCT TTGGGAACCG CGCCGCCATT CCGACATCCA TATGCTGGAA
 601 ACTTCCGATA ATGCCCGCAT CCGCCTGAAC ACGAAAGATG AAAAACTGAC
 651 CGTCCATAAA GCGTATCAGG GCGGTGCGGA TTTCCTGTTC GGCTACGACG
 701 TGCGGGAGTC GGACAAACCC GCCCTGACCT TTGAAGAAAA AGTCAGCGGA
 751 CAATCCGGCG TGGTTTTGGA ACGCCGGCCG GAAAATCTGA AACGCTCGA
 801 CGGGCGCAAA CTGATTGCGG CGGAAAAGGC AGACTCTAAT TCGTTTGCGT
 851 TTAAACAAAA TTACCGGCAG GGACTGTACG AATTATTGCT CAAGCAATGC
 901 GAAGGCGGAT TTTGCTTGGG CGTGCAGCGT TTGGCTATCC CCGAGGCGGA
 951 AGCGGTTTTA TATGCCCAAC AGGCTTATGC GGCAAATACT TTGTTCGGGC
1001 TGCGTGCCGC CGACAGGGGC GACGACGTGT ATGCCGCCGA TCCGTCCCGT
1051 CAAAAATTGT GGCTGCGCTT CATCGGCGGC CGGTCGCATC AAAATATACG
1101 GGGCGGCGCG GCTGCGGACG GGCGGCGCAA AGGCGTGCAA ATCGGCGGCG
1151 AGGTGTTTGT ACGGCAAAAT GAAGGCAGCC GGCTGGCAAT CGGCGTGATG
1201 GGCGGCAGGG CTGGCCAGCA CGCATCAGTC AACGGCAAAG GCGGTGCGGC
1251 AGGCAGTTAT TTGCATGGTT ATGGCGGGGG TGTTTATGCT GCGTGGCATC
1301 AGTTGCGCGA TAAACAAACG GGTGCGTATT TGGACGGCTG GTTGCAATAC
1351 CAACGTTTCA AACACCGCAT CAATGATGAA AACCGTGCGG AACGCTACAA
1401 AACCAAAGGT TGGACGGCTT CTGTCGAAGG CGGCTACAAC GCGCTTGTGG
1451 CGGAAGGCGT TGTCGGAAAA GGCAATAATG TGCGGTTTTA CCTGCAACCG
1501 CAGGCGCAGT TTACCTACTT GGGCGTAAAC GGCGGCTTTA CCGACAGCGA
1551 GGGGACGGCG GTCGGACTGC TCGGCAGCGG TCAGTGGCAA AGCCGCGCCG
1601 GCATTCGGGC AAAAACCCGT TTTGCTTTGC GTAACGGTGT CAATCTTCAG
1651 CCTTTTGCCG CTTTTAATGT TTTGCACAGG TCAAAATCTT TCGGCGTGGA
1701 AATGGACGGC GAAAAACAGA CGCTGGCAGG CAGGACGGCG CTCGAAGGGC
1751 GGTTCGGCAT TGAAGCCGGT TGGAAAGGCC ATATGTCCGC ACGCATCGGA
1801 TACGGCAAAA GGACGGACGG CGACAAAGAA GCCGCATTGT CGCTCAAATG
1851 GCTGTTTTGA
```

This corresponds to the amino acid sequence <SEQ ID 2994; ORF 990.a>:

a990.pep

```
  1 MFRAQLGSNT RSTKIGDDAD FSFSDKPKPG TSHYFSSGKT DQNSSEYGYD
 51 EINIQGKNYN SGILAVDNMP VVKKYITDTY GDNLKDAVKK QLQDLYKTRP
101 EAWEENKKRT EEAYIEQLGP KFSILKQKNP DLINKLVEDS VLTPHSNTSQ
151 TSLNNIFNKK LHVKIENKSH VAGQVLELTK MTLKDSLWEP RRHSDIHMLE
201 TSDNARIRLN TKDEKLTVHK AYQGGADFLF GYDVRESDKP ALTFEEKVSG
251 QSGVVLERRP ENLKTLDGRK LIAAEKADSN SFAFKQNYRQ GLYELLLKQC
301 EGGFCLGVQR LAIPEAEAVL YAQQAYAANT LFGLRAADRG DDVYAADPSR
351 QKLWLRFIGG RSHQNIRGGA AADGRRKGVQ IGGEVFVRQN EGSRLAIGVM
```

-continued

```
401 GGRAGQHASV NGKGGAAGSY LHGYGGGVYA AWHQLRDKQT GAYLDGWLQY

451 QRFKHRINDE NRAERYKTKG WTASVEGGYN ALVAEGVVGK GNNVRFYLQP

501 QAQFTYLGVN GGFTDSEGTA VGLLGSGQWQ SRAGIRAKTR FALRNGVNLQ

551 PFAAFNVLHR SKSFGVEMDG EKQTLAGRTA LEGRFGIEAG WKGHMSARIG

601 YGKRTDGDKE AALSLKWLF*
```

m990/a990 96.0% identity in 619 aa overlap

```
                   10        20        30        40        50        60
m990.pep   MFRAQLGSNTRSTKIGDDADFSFSDKPKPGTSHYFSSGKTDQNSSEYGYDEINIQGKNYN
           ||||||||||||||||||||||||||||||||||||||||||||||||||||||||||||
a990       MFRAQLGSNTRSTKIGDDADFSFSDKPKPGTSHYFSSGKTDQNSSEYGYDEINIQGKNYN
                   10        20        30        40        50        60

                   70        80        90       100       110       120
m990.pep   SGILAVDNMPVVKKYITEKYGADLKQAVKSQLQDLYKTRPEAWAENKKRTEEAYIAQFGT
           |||||||||||||||||: || :||:|||:||||||||||||| ||||||||||| |:| 
a990       SGILAVDNMPVVKKYITDTYGDNLKDAVKKQLQDLYKTRPEAWEENKKRTEEAYIEQLGP
                   70        80        90       100       110       120

                  130       140       150       160       170       180
m990.pep   KFSTLKQTMPDLINKLVEDSVLTPHSNTSQTSLNNIFNKKLHVKIENKSHVAGQVLELTK
           ||| |||  |||||||||||||||||||||||||||||||||||||||||||||||||||
a990       KFSILKQKNPDLINKLVEDSVLTPHSNTSQTSLNNIFNKKLHVKIENKSHVAGQVLELTK
                  130       140       150       160       170       180

                  190       200       210       220       230       240
m990.pep   MTLKDSLWEPRRHSDIHTLETSDNARIRLNTKDEKLTVHKDYAGGADFLFGYDVRESDEP
           ||||||||||||||||| ||||||||||||||||||||||| | |||||||||||||||:|
a990       MTLKDSLWEPRRHSDIHMLETSDNARIRLNTKDEKLTVHKAYQGGADFLFGYDVRESDKP
                  190       200       210       220       230       240
                  250       260       270       280       290       300
m990.pep   ALTFEDKVSGQSGVVLERRPENLKTLDGRKLIAAKTADSGSFAFKQNYRQGLYELLLKQC
           |||||:|||||||||||||||||||||||||||: |||:||||||||||||||||||||
a990       ALTFEEKVSGQSGVVLERRPENLKTLDGRKLIAAEKADSNSFAFKQNYRQGLYELLLKQC
                  250       260       270       280       290       300
                  310       320       330       340       350       360
m990.pep   EGGFCLGVQRLAIPEAEAVLYAQQAYAANTLFGLRAADRGDDVYAADPSRQKLWLRFIGG
           ||||||||||||||||||||||||||||||||||||||||||||||||||||||||||||
a990       EGGFCLGVQRLAIPEAEAVLYAQQAYAANTLFGLRAADRGDDVYAADPSRQKLWLRFIGG
                  310       320       330       340       350       360
                  370       380       390       400       410       420
m990.pep   RSHQNIRGGAAADGWRKGVQIGGEVFVRQNEGSRLAIGVMGGRAGQHASVNGKGGAAGSD
           |||||||||||||| |||||||||||||||||||||||||||||||||||||||||||| 
a990       RSHQNIRGGAAADGRRKGVQIGGEVFVRQNEGSRLAIGVMGGRAGQHASVNGKGGAAGSY
                  370       380       390       400       410       420
                  430       440       450       460       470       480
m990.pep   LYGYGGGVYAAWHQLRDKQTGAYLDGWLQYQRFKHRINDENRAERYKTKGWTASVEGGYN
           |:||||||||||||||||||||||||||||||||||||||||||||||||||||||||||
a990       LHGYGGGVYAAWHQLRDKQTGAYLDGWLQYQRFKHRINDENRAERYKTKGWTASVEGGYN
                  430       440       450       460       470       480
                  490       500       510       520       530       540
m990.pep   ALVAEGIVGKGNNVRFYLQPQAQFTYLGVNGGFTDSEGTAVGLLGSGQWQSRAGIRAKTR
           ||||||:|||||||||||||||||||||||||||||||||||||||||||||||||||||
a990       ALVAEGVVGKGNNVRFYLQPQAQFTYLGVNGGFTDSEGTAVGLLGSGQWQSRAGIRAKTR
                  490       500       510       520       530       540
                  550       560       570       580       590       600
m990.pep   FALRNGVNLQPFAAFNVLHRSKSFGVEMDGEKQTLAGRTALEGRFGIEAGWKGHMSARIG
           ||||||||||||||||||||||||||||||||||||||||||||||||||||||||||||
a990       FALRNGVNLQPFAAFNVLHRSKSFGVEMDGEKQTLAGRTALEGRFGIEAGWKGHMSARIG
                  550       560       570       580       590       600

                  610       620
m990.pep   YGKRTDGDKEAALSLKWLFX
           ||||||||||||||||||||
a990       YGKRTDGDKEAALSLKWLFX
                  610       620
```

The following partial DNA sequence was identified in *N. gonorrhoeae* <SEQ ID 2995>:

g992.seq

```
  1 ATGTTCAGAC GGCATCGGCA TTTGAAAAAT ATGCAGATTA AAAAAATCAT
 51 GAAATGGCTT CCCGTCGCCC TGTCGCTTTT GGGCGCGTTG GGTTATACGG
101 GATATGACAG TGAGGCGGTG CGGACGGCGG TTGCCGTACT CGACGTACTC
151 GGCACTGCAG GGGACGTGGG TTTCGACGCG CCCGTTCGCC GACGGGCATC
201 GGCGAAATCC GGCCACAGCT ACACAGGCAC GGTGTCCAAA GTCTATGACG
251 GCGATACCCT TCACGTCATC GACGGCGACG GCGCGAAACA TAAAATTCGG
301 ATGGCGTATA TCGACGCACC GGAGATGAAA CAGGCTTAGG GTACACGTTC
351 GCGCGACAAC CTGCGCGCGG CGGCGGAGGG TAGGAAAGTC AGTGTACGTG
401 TGTTTGAAAC CGACCGCTAT CAGCGCGAAG TGGCGCAGGT ATCCGCCGGC
451 AAAACCGATT TGAACCTGAT GCAGGTGCAG GACGGGGCGG CGTGGCATTA
501 TAAAAGTTAT GCTAAAGAAC AGCAGGATAA GGCGGATTTT GCCGACTATG
551 CCGACGCTCA AATTCAGGCG GAAAGGGAAC GCAAAGGATT GTGGAAAGCT
601 AAAAATCCGC AAGCGCCGTG GGCGTACCGC CGGGCAGGCA GGAGCGGCGG
651 GGGCAATAAG GATTGGATGG ATTCCGTGGG CGAATGGTTG GGCATTTGGT
701 AA
```

This corresponds to the amino acid sequence <SEQ ID 2996 ORF 992.ng>:

g992.pep

```
  1 MFRRHRHLKN MQIKKIMKWL PVALSLLGAL GYTGYDSEAV RTAVAVLDVL
 51 GTAGDVGFDA PVRRRASAKS GHSYTGTVSK VYDGDTLHVI DGDGAKHKIR
101 MAYIDAPEMK QAYGTRSRDN LRAAAEGRKV SVRVFETDRY QREVAQVSAG
151 KTDLNLMQVQ DGAAWHYKSY AKEQQDKADF ADYADAQIQA ERERKGLWKA
201 KNPQAPWAYR RAGRSGGGNK DWMDSVGEWL GIW*
```

The following partial DNA sequence was identified in *N. meningitidis* <SEQ ID 2997>:

m992.seq

```
  1 ATGTTCAGAC GGCATCGGCA TTTGAAAAAT ATGCAGATTA AAAAAATCAT
 51 GAAATGGCTT CCCGTCGCCC TGTCGCTTTT GGGTGCGTTG GGTTATACGG
101 GGTACGGCAG CGAGGCGGTG CGGACGGCGG TTGCCGTACT CGACGTACTC
151 GCCGCGGCAG GGGACGCGGG TTCCGACGCG CCCGCCCGCC GCCGAGCATC
201 GGCGAAATCC GGCCACCGCT ACACAGGCAC GGTGTCCAAA GTCTATGACG
251 GCGACACCCT TCACGTTATC GACGGCGACG GCGCGAAACA CAAAATCCGG
301 ATGGCGTATA TCGACGCGCC GGAGATGAAA CAGGCTTACG GCACGCGTTC
351 GCGCGACAAC CTGCGCGCGG CGGCGGAAGG CAGGAAAGTC AGCGTGCGCG
401 TGTTCGATAC CGACCGCTAC CAGCGCGAAG TGGCGCAGGT TTCTGTCGGC
451 AAAACCGATT TGAACCTGAT GCAGGTGCAG GACGGGGCGG CGTGGCATTA
501 TAAAAGTTAT GCTAAAGAAC AGCAGGATAA GGCGGATTTT GCCGATTATG
```

-continued

```
551 CCGACGCTCA AATTCAGGCG GAAAGGGAAC GCAAAGGATT GTGGAAAGCT

601 AAAAATCCGC AAGCGCCGTG GGCGTACCGC CGAGCAGGCA GGAGCGGCGG

651 GGGCAATAAG GATTGGATGG ATGCCGTGGG CGAATGGTTG GGCATTTGGT

701 AA
```

This corresponds to the amino acid sequence <SEQ ID 2998: ORF 992>:

m992.pep

```
  1 MFRRHRHLKN MQIKKIMKWL PVALSLLGAL GYTGYGSEAV RTAVAVLDVL

 51 GAAGDAGSDA PARRRASAKS GHRYTGTVSK VYDGDTLHVI DGDGAKHKIR

101 MAYIDAPEMK QAYGTRSRDN LRAAAEGRKV SVRVFDTDRY QREVAQVSVG

151 KTDLNLMQVQ DGAAWHYKSY AKEQQDKADF ADYADAQIAQ ERERKGLWKA

201 KNPQAPWAYR RAGRSGGGNK DWMDAVGEWL GIW*
```

Computer analysis of this amino acid sequence gave the following results:

Homology with a predicted ORF from *N. gonorrhoeae*

ORF 992 shows 96.1% identity over a 233 aa overlap with a predicted ORF (ORF 992) from *N. gonorrhoeae* m992/g992 96.1% identity in 233 aa overlap

```
                  10        20        30        40        50        60
m992.pep   MFRRHRHLKNMQIKKIMKWLPVALSLLGALGYTGYGSEAVRTAVAVLDVLGAAGDAGSDA
           ||||||||||||||||||||||||||||||||||| |||||||||||||||:|||:| ||
g992       MFRRHRHLKNMQIKKIMKWLPVALSLLGALGYTGYDSEAVRTAVAVLDVLGTAGDVGFDA
                  10        20        30        40        50        60
                  70        80        90       100       110       120
m992.pep   PARRRASAKSGHRYTGTVSKVYDGDTLHVIDGDGAKHKIRMAYIDAPEMKQAYGTRSRDN
           |:|||||||||| |||||||||||||||||||||||||||||||||||||||||||||||
g992       PVRRRASAKSGHSYTGTVSKVYDGDTLHVIDGDGAKHKIRMAYIDAPEMKQAYGTRSRDN
                  70        80        90       100       110       120
                 130       140       150       160       170       180
m922.pep   LRAAAEGRKVSVRVFDTDRYQREVAQVSVGKTDLNLMQVQDGAAWHYKSYAKEQQDKADF
           ||||||||||||||:||||||||||||:||||||||||||||||||||||||||||||||
g992       LRAAAEGRKVSVRVFETDRYQREVAQVSAGKTDLNLMQVQDGAAWHYKSYAKEQQDKADF
                 130       140       150       160       170       180
                 190       200       210       220       230
m992.pep   ADYADAQIQAERERKGLWKAKNPQAPWAYRRAGRSGGGNKDWMDAVGEWLGIWX
           ||||||||||||||||||||||||||||||||||||||||||||:|||||||||
g992       ADYADAQIQAERERKGLWKAKNPQAPWAYRRAGRSGGGNKDWMDSVGEWLGIWX
                 190       200       210       220       230
```

The following partial DNA sequence was identified in *N. meningitidis* <SEQ ID 2999>:

a992.seq

```
  1 ATGTTCAGAC GGCATCGGCA TTTGAAAAAT ATGCAGATTA AAAAAATCAT

 51 GAAATGGCTT CCCGTCGCCT TGTCGCTTTT GGGTGCGTTG GGTTATACGG

101 GGTACGGCAG CGAGGCGGTG CGGACGGCGG TTGCCGTACT CGACGTACTC

151 GGCGCGGCAG GGGACGCGGG TTCCGACGCG CCCGCCCGCC GCCGAGCATC

201 GGCGAAATCC GGCCACCGCT ACACAGGCAC GGTGTCCAAA GTCTATGACG
```

-continued

```
251 GCGACACCCT TCACGTTATC GACGGCGACG GCGCGAAACA CAAAATCCGG
301 ATGGCGTATA TCGACGCGCC GGAGATGAAA CAGGCTTACG GCACGCGTTC
351 GCGCGACAAC CTGCGCGCGG CGGCGGAAGG CAGGAAAGTC AGCGTCCGCG
401 TGTTCGACAC CGACCGCTAC CAGCGCGAAG TGGCGCAGGT TTCTGTCGGC
451 AAAACCGATT TGAACCTGAT GCAGGTGCAG GACGGGGCGG CGTGGCATTA
501 TAAAAGTTAT GCTAAAGAAC AGCAGGATAA GGCGGATTTT GCCGATTATG
551 CCGACGCTCA AATTCAGGCG GAAAGGGAAC GCAAAGGATT GTGGAAAGCT
601 AAAAATCCGC AAGCGCCGTG GGCGTACCGC CGGGCAGGCA GGAGCGGCGG
651 GGGCAATAAG GATTGGATGG ATGCCGTGGG CGAATGGTTG GGCATTTGGT
701 AA
```

This corresponds to the amino acid sequence <SEQ ID 3000; ORF 992.a>:

a992.pep

```
  1 MFRRHRHLKN MQIKKIMKWL PVALSLLGAL GYTGYGSEAV RTAVAVLDVL
 51 GAAGDAGSDA PARRRASAKS GHRYTGTVSK VYDGDTLHVI DGDGAKHKIR
101 MAYIDAPEMK QAYGTRSRDN LRAAAEGRKV SVRVFDTDRY QREVAQVSVG
151 KTDLNLMQVQ DGAAWHYKSY AKEQQDKADF ADYADAQIQA ERERKGLWKA
201 KNPQAPWAYR RAGRSGGGNK DWMDAVGEWL GIW*
```

Computer analysis of this amino acid sequence gave the following results:

Homology with a predicted ORF from *N. meningitidis*

ORF 992 shows 100.0% identity over a 233 aa overlap with a predicted ORF (ORF 992) from *N. meningitidis* a992/m992 100.0% identity in 233 aa overlap

```
                   10        20        30        40        50        60
a992.pep   MFRRHRHLKNMQIKKIMKWLPVALSLLGALGYTGYGSEAVRTAVAVLDVLGAAGDAGSDA
           ||||||||||||||||||||||||||||||||||||||||||||||||||||||||||||
m992       MFRRHRHLKNMQIKKIMKWLPVALSLLGALGYTGYGSEAVRTAVAVLDVLGAAGDAGSDA
                   10        20        30        40        50        60

                   70        80        90       100       110       120
a992.pep   PARRRASAKSGHRYTGTVSKVYDGDTLHVIDGDGAKHKIRMAYIDAPEMKQAYGTRSRDN
           ||||||||||||||||||||||||||||||||||||||||||||||||||||||||||||
m992       PARRRASAKSGHRYTGTVSKVYDGDTLHVIDGDGAKHKIRMAYIDAPEMKQAYGTRSRDN
                   70        80        90       100       110       120

                  130       140       150       160       170       180
a992.pep   LRAAAEGRKVSVRVFDTDRYQREVAQVSVGKTDLNLMQVQDGAAWHYKSYAKEQQDKADF
           ||||||||||||||||||||||||||||||||||||||||||||||||||||||||||||
m992       LRAAAEGRKVSVRVFDTDRYQREVAQVSVGKTDLNLMQVQDGAAWHYKSYAKEQQDKADF
                  130       140       150       160       170       180

                  190       200       210       220       230
a992.pep   ADYADAQIQAERERKGLWKAKNPQAPWAYRRAGRSGGGNKDWMDAVGEWLGIWX
           ||||||||||||||||||||||||||||||||||||||||||||||||||||||
m992       ADYADAQIQAERERKGLWKAKNPQAPWAYRRAGRSGGGNKDWMDAVGEWLGIWX
                  190       200       210       220       230
```

The following partial DNA sequence was identified in *N. gonorrhoeae* <SEQ ID 3001>:

g993.seq

```
  1 CTGAAAGTCG TATTGGGCAG TTTTCAAGGC CCTTTGGATC TGCTGCTCTA
 51 CCTTATCCGC AAGCAGAACA TCGATGTTCT CGATATTCCG ATGGTGGAAA
101 TTACCGGGCA GTATCTGCAC TATATTGCCC AAATGGAAGC CTATCAGTTT
151 GATTTGGCGG CGGAATATCT TTTGATGGCG GCAATGCTGA TTGAAATCAA
201 ATCGCGCCTG CTGCTGCCGC GTACCGAAGC CGTCGAAGAC GAAGAGGCCG
251 ACCCGCGTGC CGAGTTGGTG CGCCGTCTGC TTGCCTACGA GCAAATGAAA
301 CTGGCGGCGC AGGGTTTGGA CGCGCTGCCG CGTGCGGGAC GGGATTTCGC
351 GTGGGCTTAC CTGCCGCTGG AAATTGCAGC CGAGACGAAG CTGCCCGAGG
401 TTTACATCGC CGATTTGATG CAGGCATGGT TGGGCATTCT TTCTCGGGCA
451 AAACATACGC GCAGCCACGA AGTAATCCAA GAAACCCTTT CCGTGCGCGC
501 GCAAATGACG GCAATCCTGC GCCGTTTGAA CGAACACGGG ATATGCAGGT
551 TTCACGCCCT GTTCAATCCC GAACAGGGCG CGGCTTACGT GATCGTCAAC
601 TTCATCGCCC TGTTGGAGCT TGCCAAAGAA GGATTGGTCG GAATCGTACA
651 GGAAGACGGT TTCGGAGAAA TCCGAATCAG CCTCAATCAT GAGGGGGCGC
701 ATTCAGACGG CATTTTCGGC ACACGGGGCG GGCGCGATGT GTTCTAA
```

This corresponds to the amino acid sequence <SEQ ID 3002 ORF 993.ng>:

g993.pep

```
  1 LKVVLGSFQG PLDLLLYLIR KQNIDVLDIP MVEITGQYLH YIAQMEAYQF
 51 DLAAEYLLMA AMLIEIKSRL LLPRTEAVED EEADPRAELV RRLLAYEQMK
101 LAAQGLDALP RAGRDFAWAY LPLEIAAETK LPEVYIADLM QAWLGILSRA
151 KHTRSHEVIQ ETLSVRAQMT AILRRLNEHG ICRFHALFNP EQGAAYVIVN
201 FIALLELAKE GLVGIVQEDG FGEIRISLNH EGAHSDGIFG TRGGRDVF*
```

The following partial DNA sequence was identified in *N. meningitidis* <SEQ ID 3003>:

m993.seq

```
  1 TTGAAAGTCG TATTGGGCAG CTTCCAAGGC CCTTTGGATC TACTGCTGTA
 51 TCTGATCCGC AAACAGAATA TCGACGTACT GGATATTCCG ATGGTGAAGA
101 TTACCGAGCA GTATCTGCAC TACATCGCCC AAATAGAAAC CTATCAGTTT
151 GATTTGGCGG CGGAATATCT TTTGATGGCA GCAATGCTGA TTGAAATCAA
201 ATCGCGCCTG CTGCTGCCGC GTACCGAAAC CGTCGAAGAC GAAGAAGCCG
251 ACCCGCGTGC CGAGTTGGTG CGCCGCCTGC TGGCTTACGA ACAGATGAAG
301 CTGGCGGCGC AGGGTTTGGA CGCGCTGCCC CGAGCCGGAC GGGATTTCGC
351 GTGGGCTTAC CTGCCGCTGG AAATTGCCGT CGAAGCCAAG CTGCCCGAAG
401 TCTATATTAC CGACTTGACG CAAGCGTGGC TGGGTATTTT GTCTCGGGCA
451 AAACACACGC GCAGCCACGA AGTAATCAAA GAAACCATCT CCGTGCGCGC
501 GCAAATGACG GCAATCCTGC GCCGTTTGAA CGGACACGGA ATATGCAGGT
```

-continued

```
551 TTCACGACCT GTTCAATCCC AAACAGGGCG CGGCTTACGT GGTCGTCAAC

601 TTCATCGCAC TGTTGGAGCT TGCCAAAGAA GGATTGGTCA GAATCGTGCA

651 GGAAGACGGT TTCGGAGAAA TCCGAATCAG CCTCAATCAT GAGGGGGCGC

701 ATTCAGACGG CATTTCCGGC ACACGAGGCG GGCGCGATGT GTTCTAA
```

This corresponds to the amino acid sequence <SEQ ID 3004; ORF 993>:

m993.pep

```
  1 LKVVLGSFQG PLDLLLYLIR KQNIDVLDIP MVKITEQYLH YIAQIETYQF

 51 DLAAEYLLMA AMLIEIKSRL LLPRTETVED EEADPRAELV RRLLAYEQMK

101 LAAQGLDALP RAGRDFAWAY LPLEIAVEAK LPEVYITDLT QAWLGILSRA

151 KHTRSHEVIK ETISVRAQMT AILRRLNGHG ICRFHDLFNP KQGAAYVVVN

201 FIALLELAKE GLVRIVQEDG FGEIRISLNH EGAHSDGISG TRGGRDVF*
```

Computer analysis of this amino acid sequence gave the following results:

Homology with a predicted ORF from *N. gonorrhoeae*

ORF 993 shows 93.1% identity over a 248 aa overlap with a predicted ORF (ORF 993) from *N. gonorrhoeae* m993/g993 93.1% identity in 248 aa overlap

```
                   10        20        30        40        50        60
m993.pep   LKVVLGSFQGPLDLLLYLIRKQNIDVLDIPMVKITEQYLHYIAQIETYQFDLAAEYLLMA
           ||||||||||||||||||||||||||||||||:|| ||||||||:|:|||||||||||||
g993       LKVVLGSFQGPLDLLLYLIRKQNIDVLDIPMVEITGQYLHYIAQMEAYQFDLAAEYLLMA
                   10        20        30        40        50        60

                   70        80        90       100       110       120
m993.pep   AMLIEIKSRLLLPRTETVEDEEADPRAELVRRLLAYEQMKLAAQGLDALPRAGRDFAWAY
           ||||||||||||||||:|||||||||||||||||||||||||||||||||||||||||||
g993       AMLIEIKSRLLLPRTEAVEDEEADPRAELVRRLLAYEQMKLAAQGLDALPRAGRDFAWAY
                   70        80        90       100       110       120

                  130       140       150       160       170       180
m993.pep   LPLEIAVEAKLPEVYITDLTQAWLGILSRAKHTRSHEVIKETISVRAQMTAILRRLNGHG
           ||||||:|:|||||||:|| |||||||||||||||||||:||:|||||||||||||| ||
g993       LPLEIAAETKLPEVYIADLMQAWLGILSRAKHTRSHEVIQETLSVRAQMTAILRRLNEHG
                  130       140       150       160       170       180

                  190       200       210       220       230       240
m993.pep   ICRFHDLFNPKQGAAYVVVNFIALLELAKEGLVRIVQEDGFGEIRISLNHEGAHSDGISG
           ||||| ||||:||||||:||||||||||||||| |||||||||||||||||||||||| |
g993       ICRFHALFNPEQGAAYVIVNFIALLELAKEGLVGIVQEDGFGEIRISLNHEGAHSDGIFG
                  190       200       210       220       230       240

                 249
m993.pep   TRGGRDVFX
           |||||||||
g993       TRGGRDVFX
```

The following partial DNA sequence was identified in *N. meningitidis* <SEQ ID 3005>:

a993.seq

```
  1 CTGAAAGTCG TATTGAGCAG TTTTCAAGGC CCTTTGGATC TGCTGCTCTA

 51 CCTTATCCGC AAGCAGAACA TCGATGTTCT CGATATTCCG ATGGTGAAGA

101 TTACCGAACA GTATCTGCAC TACATCGCCC AAATAGAAAC CTATCAGTTT

151 GATTTGGCGG CGGAATATCT TTTGATGGCA GCAATGCTGA TTGAAATCAA
```

-continued

```
201 ATCGCGCCTG CTGCTGCCGC GTACCGAAAC CGTCGAAGAC GAAGAAGCCG

251 ACCCGCGTGC CGAGTTGGTG CGCCGCCTGC TGGCTTACGA GCAGATGAAG

301 CTGGCGGCAC AAGGGTTGGA TGCGCTTCCT CGTGCGGGCC GGGATTTCGC

351 ATGGGCATAC CTGCCACTGG AAATTGCCGT CGAAGCCAAG CTGCCCGAAG

401 TCTATATTAC CGACTTGACG CAGGCGTGGC TGAGTATTTT GTCTCGGGCA

451 AAACATACGC GCAGCCACGA AGTTATCAAA GAAACCATCT CCGTGCGCGC

501 GCAAATGACG GCAATCCTGC GCCGTTTGAA CAAACACGGG ATATGCAGGT

551 TTCACGACCT GTTCAATCCC GAACAGGGCG CGGCTTACGT GGTCGTCAAC

601 TTCATCGCAC TGTTGGAGCT TGCCAAAGAA GGTTTGGTCG GAATCGTACA

651 GGAAGTCGGT TTCGGAGAAA TCCGAATCAG CCTCAATCAT GAGGGGGCGC

701 ATTCAGACGG CATTTCCGGC ACACGGGGCG GGCGCGATGT GTTCTAA
```

This corresponds to the amino acid sequence <SEQ ID 3006; ORF 993.a>:

a993.pep

```
  1 LKVVLSSFQG PLDLLLYLIR KQNIDVLDIP MVKITEQYLH YIAQIETYQF

 51 DLAAEYLLMA AMLIEIKSRL LLPRTETVED EEADPRAELV RRLLAYEQMK

101 LAAQGLDALP RAGRDFAWAY LPLEIAVEAK LPEVYITDLT QAWLSILSRA

151 KHTRSHEVIK ETISVRAQMT AILRRLNKHG ICRFHDLFNP EQGAAYVVVN

201 FIALLELAKE GLVGIVQEVG FGEIRISLNH EGAHSDGISG TRGGRDVF*
```

Computer analysis of this amino acid sequence gave the following results:

Homology with a predicted ORF from *N. meningitidis*

ORF 993 shows 97.6% identity over a 248 aa overlap with a predicted ORF (ORF 993) from *N. meningitidis* a993/m993 97.6% identity in 248 aa overlap

```
                   10        20        30        40        50        60
a903.pep   LKVVLSSFQGPLDLLLYLIRKQNIDVLDIPMVKITEQYLHYIAQIETYQFDLAAEYLLMA
           |||||:||||||||||||||||||||||||||||||||||||||||||||||||||||||
m993       LKVVLGSFQGPLDLLLYLIRKQNIDVLDIPMVKITEQYLHYIAQIETYQFDLAAEYLLMA
                   10        20        30        40        50        60

                   70        80        90       100       110       120
a993.pep   AMLIEIKSRLLLPRTETVEDEEADPRAELVRRLLAYEQMKLAAQGLDALPRAGRDFAWAY
           ||||||||||||||||||||||||||||||||||||||||||||||||||||||||||||
m993       AMLIEIKSRLLLPRTETVEDEEADPRAELVRRLLAYEQMKLAAQGLDALPRAGRDFAWAY
                   70        80        90       100       110       120

                  130       140       150       160       170       180
a993.pep   LPLEIAVEAKLPEVYITDLTQAWLSILSRAKHTRSHEVIKETISVRAQMTAILRRLNKHG
           ||||||||||||||||||||||||:|||||||||||||||||||||||||||||||| ||
m993       LPLEIAVEAKLPEVYITDLTQAWLGILSRAKHTRSHEVIKETISVRAQMTAILRRLNGHG
                  130       140       150       160       170       180

                  190       200       210       220       230       240
a993.pep   ICRFHDLFNPEQGAAYVVVNFIALLELAKEGLVGIVQEVGFGEIRISLNHGAHSDGISG
           ||||||||||:|||||||||||||||||||||| |||| |||||||||||||||||||||
m993       ICRFHDLFNPKQGAAYVVVNFIALLELAKEGLVRIVQEDGFGEIRISLNHGAHSDGISG
                  190       200       210       220       230       240

                  249
a993.pep   TRGGRDVFX
           |||||||||
m993       TRGGRDVFX
```

The following partial DNA sequence was identified in *N. gonorrhoeae* <SEQ ID 3007>:

g996.seq

```
  1 ATGAACAGAA GAACCTTCCT CCTCGGCGCA GGCGCGTTGC TTCTTACCGC
 51 CTGCGGCAGA AAATCCGCCC GAACCCACGC CAAAATTCCC GAAGGAAGCA
101 CCGTGCTTGC CTTGGGCGAT TCGCTCACCT TCGGCTACGG AGCAAACCCC
151 GGCGAATCCT ACCCCGCGCA ACTGCAAAAA CTGACGGGTT GGAATATTGT
201 CAACGGCGGC GTATCGGGCG ATACGTCCGC GCAAGCCCTA TCGCGCCTGC
251 CCGCGCTGTT GGCACGCAAA CCCAAGCTTG TGATTGTCGG CATAGGCGGC
301 AACGACTTTC TGCGCAAAGT TCCCGAGGAG CAGACCCGCG CCAATATCGC
351 GAAAATCATC GAAACCGTGC AAAAGGAAAA CATTCCCGCC GTCCTCGTCG
401 GCGTGCCGCA CATCACACTG GGCGCGTTGT TCGGGCATTT GAGCGACCAT
451 CCGCTGTATG AGGATTTGTC CGAGGAATAC GGCATTCCGT TGTTCGGCGG
501 CGCGTGGGCG GAAATTTTGG GCAATAATAA TCTGAAATCC GACCAAATCC
551 ACGCCAACGG CAAAGGCTAT CGGAAATTCG CCGAAAATTT GAATCAATTT
601 TTGAGAAAAC ATGGGTTTAG ATAA
```

This corresponds to the amino acid sequence <SEQ ID 3008 ORF 996.ng>:

g996.pep

```
  1 MNRRTFLLGA GALLLTACGR KSARTHAKIP EGSTVLALGD SLTFGYGANP
 51 GESYPAQLQK LTGWNIVNGG VSGDTSAQAL SRLPALLARK PKLVIVGIGG
101 NDFLRKVPEE QTRANIAKII ETVQKENIPA VLVGVPHITL GALFGHLSDH
151 PLYEDLSEEY GIPLFGGAWA EILGNNNLKS DQIHANGKGY RKFAENLNQF
201 LRKHGFR*
```

The following partial DNA sequence was identified in *N. meningitidis* <SEQ ID 3009>:

m996.seq

```
  1 ATGAACAGAA GAACCTTCCT CCTCGGCGCA GGCGCGTTGC TGCTTACCGC
 51 CTGCGGCAGA AAATCCGCCC GAACCCACGC CAAAATTCCC GAAGGAAGCA
101 CCGTACTTGC CTTGGGCGAT TCGCTTACCT TCGGCTACGG CGCAAACCCT
151 GGCGAATCCT ACCCCGCGCA ACTGCAAAAA CTGACGGGTT GGAATATTGT
201 CAACGGCGGC GTATCGGGCG ATACATCTGC CCAAGCCCTG TCGCGCCTGC
251 CCGCGCTGTT GGCACGCAAA CCCAAGCTTG TGATTGTCGG CATAGGCGGC
301 AACGACTTTC TGCGCAAAGT TCCCAAGGAG CAGACCCGCG CCAATATCGC
351 GAAAATCATC GAAACCGTGC AGAAGGAAAA CATCCCCGCC GTCCTCGTCG
401 GCGTGCCGCA CATCACACTG GGTGCGTTGT TCGGGCATTT GAGCGATCAT
451 CCGCTGTATG AGGATTTGTC CGAGGAATAC GGCATTCCGC TGTTCGGCGG
501 CGCGTGGGCG GAAATTTTGG GCGATAATAA TCTGAAATCC GACCAAATCC
551 ACGCCAACGG CAAAGGCTAT CGGAAATTTG CCGAAGATTT GAATCAATTT
601 TTGAGAAAAC AGGGGTTTAG ATAA
```

This corresponds to the amino acid sequence <SEQ ID 3010; ORF 996>:

```
m996.pep

  1 MNRRTFLLGA GALLLTACGR KSARTHAKIP EGSTVLALGD SLTFGYGANP

 51 GESYPAQLQK LTGWNIVNGG VSGDTSAQAL SRLPALLARK PKLVIVGIGG

101 NDFLRKVPKE QTRANIAKII ETVQKENIPA VLVGVPHITL GALFGHLSDH

151 PLYEDLSEEY GIPLFGGAWA EILGDNNLKS DQIHANGKGY RKFAEDLNQF

201 LRKQGFR
```

Computer analysis of this amino acid sequence gave the following results:

Homology with a predicted ORF from *N. gonorrhoeae*

ORF 996 shows 98.1% identity over a 207 aa overlap with a predicted ORF (ORF 996) from *N. gonorrhoeae* m996/g996 98.1% identity in 207 aa overlap

```
                   10        20        30        40        50        60
m996.pep    MNRRTFLLGAGALLLTACGRKSARTHAKIPEGSTVLALGDSLTFGYGANPGESYPAQLQK
            ||||||||||||||||||||||||||||||||||||||||||||||||||||||||||||
g996        MNRRTFLLGAGALLLTACGRKSARTHAKIPEGSTVLALGDSLTFGYGANPGESYPAQLQK
                   10        20        30        40        50        60

                   70        80        90       100       110       120
m996.pep    LTGWNIVNGGVSGDTSAQALSRLPALLARKPKLVIVGIGGNDFLRKVPKEQTRANIAKII
            |||||||||||||||||||||||||||||||||||||||||||||||||:||||||||||
g996        LTGWNIVNGGVSGDTSAQALSRLPALLARKPKLVIVGIGGNDFLRKVPEEQTRANIAKII
                   70        80        90       100       110       120

                  130       140       150       160       170       180
m996.pep    ETVQKENIPAVLVGVPHITLGALFGHLSDHPLYEDLSEEYGIPLFGGAWAEILGDNNLKS
            |||||||||||||||||||||||||||||||||||||||||||||||||||||||:||||
g996        ETVQKENIPAVLVGVPHITLGALFGHLSDHPLYEDLSEEYGIPLFGGAWAEILGNNNLKS
                  130       140       150       160       170       180

                  190       200
m996.pep    DQIHANGKGYRKFAEDLNQFLRKQGFR
            |||||||||||||||:|||||||:|||
g996        DQIHANGKGYRKFAENLNQFLRKHGFRX
                  190       200
```

The following partial DNA sequence was identified in *N. meningitidis* <SEQ ID 3011>:

```
a996.seq

  1 ATGAACAGAA GAACCTTCCT CCTCGGCGCA GGCGCGTTGC TCCTTACCGC

 51 CTGCGGCAGA AAATCCGCCC GAACCCACGC CAAAATTCCC GAAGGAAGCA

101 CCGTACTTGC CTTGGGCGAT TCGCTTACCT TCGGCTACGG CGCAAACCCC

151 GGCGAATCCT ACCCCGCGCA ACTGCAAAAA CTGACGGGTT GGAATATTGT

201 CAACGGCGGC GTATCGGGCG ATACATCCGC CCAAGCCCTG TCGCGCCTGC

251 CCGCGCTGTT GGCACGCAAA CCCAAGCTTG TGATTGTCGG CATAGGCGGC

301 AACGACTTTC TGCGCAAAGT TCCCAAGGAG CAGACCCGCG CCAATATCGC

351 GAAAATCATC GAAACCGTGC AGAAGGAAAA CATCCCCGCC GTCCTCGTCG

401 GCGTGCCGCA CATTACCTTG GGCGCGTTGT TCGGGCATTT GAGCGATCAT

451 CCGCTGTATG AGGATTTGTC CGAGGAATAC GGCATTCCGC TGTTCGGCGG

501 CGCGTGGGCG GAAATTTTGG GCGATAATAA TCTGAAATCC GACCAAATCC

551 ACGCCAACGG CAAAGGCTAT CGGAAATTTG CCGAAGATTT GAATCAATTT

601 TTGAGAAAAC AGGGGTTTAG ATAA
```

This corresponds to the amino acid sequence <SEQ ID 3012; ORF 996.a>:

```
a996.pep

  1 MNRRTFLLGA GALLLTACGR KSARTHAKIP EGSTVLALGD SLTFGYGANP

 51 GESYPAQLQK LTGWNIVNGG VSGDTSAQAL SRLPALLARK PKLVIVGIGG

101 NDFLRKVPKE QTRANIAKII ETVQKENIPA VLVGVPHITL GALFGHLSDH

151 PLYEDLSEEY GIPLFGGAWA EILGDNNLKS DQIHANGKGY RKFAEDLNQF

201 LRKQGFR*
```

Computer analysis of this amino acid sequence gave the following results:

Homology with a predicted ORF from *N. meningitidis*

ORF 996 shows 100.0% identity over a 207 aa overlap with a predicted ORF (ORF 996) from *N. meningitidis* a996/=996 100.0% identity in 207 aa overlap

```
                   10        20        30        40        50        60
a996.pep    MNRRTFLLGAGALLLTACGRKSARTHAKIPEGSTVLALGDSLTFGYGANPGESYPAQLQK
            ||||||||||||||||||||||||||||||||||||||||||||||||||||||||||||
m996        MNRRTFLLGAGALLLTACGRKSARTHAKIPEGSTVLALGDSLTFGYGANPGESYPAQLQK
                   10        20        30        40        50        60

                   70        80        90       100       110       120
a996.pep    LTGWNIVNGGVSGDTSAQALSRLPALLARKPKLVIVGIGGNDFLRKVPKEQTRANIAKII
            ||||||||||||||||||||||||||||||||||||||||||||||||||||||||||||
m996        LTGWNIVNGGVSGDTSAQALSRLPALLARKPKLVIVGIGGNDFLRKVPKEQTRANIAKII
                    70        80        90       100       110       120

                  130       140       150       160       170       180
a996.pep    ETVQKENIPAVLVGVPHITLGALFGHLSDHPLYEDLSEEYGIPLFGGAWAEILGDNNLKS
            ||||||||||||||||||||||||||||||||||||||||||||||||||||||||||||
m996        ETVQKENIPAVLVGVPHITLGALFGHLSDHPLYEDLSEEYGIPLFGGAWAEILGDNNLKS
                  130       140       150       160       170       180

                  190       200
a996.pep    DQIHANGKGYRKFAEDLNQFLRKQGFRX
            |||||||||||||||||||||||||||
m996        DQIHANGKGYRKFAEDLNQFLRKQGFR
                  190       200
```

The following partial DNA sequence was identified in *N. gonorrhoeae* <SEQ ID 3013>:

```
g997.seq (partial)

  1 ATGATGAACA CGCCGCATCC GCGCCCGAAA ATCGCCGTCA TCGGCGCAGG

 51 CTGGGCCGGC TTGTCCGCCG CCGTCACCTT GGCGCGGCAC GCCGACGTTA

101 CCCTGTTTGA AGCCGGCCGG CAGGCGGGCG GAAGGGCGCG CACACTGGCC

151 GGAAATACCG ACGGTTTCGG TTTTTTGGAC AACGGGCAGC ACATTTTGCT

201 CGGCGCATAC CGGGGCGTGT TGCGCCTGAT GAAAACCATC GGTTCAGACC

251 CCCGTGCCGC CTTTTTGCGC GTACCGCTGC ACTGGCATAT GCACGGCGGT

301 TTGCAGTTCC GCGCCCTCCC CCTGCCCGCG CCGCTGCATA TTTTGGGCGG

351 CGTGCTGCTT GCCCGGCGCG TACCGTCCGC ATTCAAAGCC AAACTGCTTG

401 CCGATATGTC CGATTTGCAG AAGTCCGCAC GCCTCGGACA GCCCGACACG

451 ACAGTTGCAC AATGGCTGAA ACAGCGGAAC GTGCCGCGTG CCGCCGTAAT

501 GCAGTTTTGG CAGCCCTTGG TCTGGGGCGC GCTCAACACG CCTTTGGAAA
```

-continued

```
 551 CCGCAAGCCT GCGCGTGTTG TGCAACGTTT TGTCCGACGG CGTGCTGACG

 601 AAAAAATCCG GCAGCGACTA TCTCCTACCC AAACAGGATT TGGGCGCAAT

 651 CGTCGCCGAA CCCGCCTTGG CGGAGCTTCA ACGGCTCGGC GCGGACATCC

 701 GCCTCGAAAC GCGCGTATGC CGTCTGAACA CCCTCCCGGA CGGAAAAGTC

 751 CTCGTCAACG GCGAAGCCTT CGATGCCGCC ATACTTGCCA CCGCGCCCTA

 801 CCACGCCGCC GCGCTCCTGC CCGAAGGCAC GCCCGAACAC GTTCAGACGG

 851 CATATCAAAA CCTTCGCTAC CACGCCATCA CCACCGTCTA TCTGCGCTAC

 901 GCCGAACCCG TCCGcCTGCc CGCCCCGCTG ACcGGCATtg CCGAcggcAC

 951 ggcaCaatgG CTGCTTTgcc cgGGGCAGGC tccggactgc CccaaAacg

1001 aagTCTCCGC cGTCAttagc GTTTCCGAcc GCGtcggcgC Gtttgcaaac

1051 cga...
```

This corresponds to the amino acid sequence <SEQ ID 3014 ORF 997.ng>:

g997.pep (partial)

```
  1 MMNTPHPRPK IAVIGAGWAG LSAAVTLARH ADVTLFEAGR QAGGRARTLA

 51 GNTDGFGFLD NGQHILLGAY RGVLRLMKTI GSDPRAAFLR VPLHWHMHGG

101 LQFRALPLPA PLHILGGVLL ARRVPSAFKA KLLADMSDLQ KSARLGQPDT

151 TVAQWLKQRN VPRAAVMQFW QPLVWGALNT PLETASLRVL CNVLSDGVLT

201 KKSGSDYLLP KQDLGAIVAE PALAELQRLG ADIRLETRVC RLNTLPDGKV

251 LVNGEAFDAA ILATAPYHAA ALLPEGTPEH VQTAYQNLRY HAITTVYLRY

301 AEPVRLPAPL TGIADGTAQW LLCPGQAPDC PQNEVSAVIS VSDRVGAFAN

351 R....
```

The following partial DNA sequence was identified in *N. meningitidis* <SEQ ID 3015>:

m997.seq

```
  1 ATGATGAACA CGCCGCATCC GCGCCCGAAA ATCGCCGTCA TCGGCGCAGG

 51 CTGGGCAGGA CTGTCCGCCG CCGTCACCTT GGCGCGGCAC GCCGACGTTA

101 CCCTGTTTGA AGCCGGCCGG CAGGCGGGCG GCAGGGCGCG CACACTGGCC

151 GGAAATACCG ACGGTTTCGG TTTTTTGGAC AACGGGCAGC ACATTTTGCT

201 CGGCGCATAC CGGGGCGTGT TGCGCCTGAT GAAAACCATC GGTTCGGATC

251 CCCGTGCCGC CTTTTTGCGC GTACCGCTGC ACTGGCATAT GCACGGCGGT

301 TTGCAGTTCC GCGCCCTCCC CCTGCCCGCG CCGCTGCATA TTTTGGGCGG

351 CGTGCTGCTT GCCCGGCGTG CACCGACTGC ATTCAAAGCC AAACTGCTTG

401 CCGATATGTC CGATTTGCAG AAGTCCGCAC GCCTCGGACA GCCCGACACG

451 ACAGTGGCGC AATGGCTGAA ACAGCGGAAC GTGCCGCGTG CCGCCGTGAT

501 GCAGTTTTGG CAGCCCTTGG TTTGGGGCGC GCTCAACACG CCTTTGGAAA

551 CCGCAAGCCT GCGCGTGTTG TGCAACGTTT TGTCCGACGG CGTGCTGACG

601 AAAAAATCCG GCAGCGACTA TCTCCTACCC AAGCAGGATT TGCGCGCAAT

651 CGTCGCCGAA CCCGCCTTGG CGGATCTTCA ACGGCTCGGC GCGGACATCC
```

-continued

```
 701 GCCTCGAAAC GCGCGTATGC CGTCTGAACA CCCTCCCGGA CGGGAAAGTG

 751 CTCGTCAACG GCGAAGCTTT CGATGCCGCC GTCCCCGCCA CCGCGCCCTA

 801 CCACGCCGCC GCGCTCCTGC CCGAAGGCAC GCCCGAACAC GTTCAGACGG

 851 CATATCAAAA CCTTCGCTAC CACGCCATCA CCACCGTCTA TCTGCGCTAC

 901 GCCGAACCCG TCCGCCTGCC CGCCCCGCTG ACCGGCCTTG CCGACGGCAC

 951 GGTGCAATGG CTGCTTTGCC GGGGCAGGCT CGGACTGCCT GAAAACGAAG

1001 TGTCCGCCGT CATCAGCGTT TCCGACCGCG TCGGCGCGTT TGCAAACCGG

1051 GCGTGGGCGG ACAAAGCCCA CGCCGACCTC AAACGCATCC TTCCGCATTT

1101 GGGCGAACCC GAAGCCGTGC GCGTCATCAC CGAAAAACGC GCCACAACCG

1151 CAGCCGATGC CCCGCCGCCG GACTTGTCGT GGTTGCACCG GCACCGCATC

1201 TTCCCCGCCG GCGACTACCT CCACCCGGAC TACCCCGCCA CGCTCGAAGC

1251 CGCCGTACAA TCAGGTTTCG CGTCGGCGGA AGCCTGCCTG CAAAGCCTGA

1301 GCGATGCCGT CTGA
```

This corresponds to the amino acid sequence <SEQ ID 3016; ORF 997>:

m997.pep

```
  1 MNNTPHPRPK IAVIGAGWAG LSAAVTLARH ADVTLFEAGR QAGGRARTLA

 51 GNTDGFGFLD NGQHILLGAY RGVLRLMKTI GSDPRAAFLR VPLHWHMHGG

101 LQFRALPLPA PLHILGGVLL ARRAPTAFKA KLLADMSDLQ KSARLGQPDT

151 TVAQWLKQRN VPRAAVMQFW QPLVWGALNT PLETASLRVL CNVLSDGVLT

201 KKSGSDYLLP KQDLGAIVAE PALADLQRLG ADIRLETRVC RLNTLPDGKV

251 LVNGEAFDAA VPATAPYHAA ALLPEGTPEH VQTAYQNLRY HAITTVYLRY

301 AEPVRLPAPL TGLADGTVQW LLCRGRLGLP ENEVSAVISV SDRVGAFANR

351 AWADKAHADL KRILPHLGEP EAVRVITEKR ATTAADAPPP DLSWLHRHRI

401 FPAGDYLHPD YPATLEAAVQ SGFASAEACL QSLSDAV*
```

Computer analysis of this amino acid sequence gave the following results:

Homology with a predicted ORF from *N. gonorrhoeae*

ORF 997 shows 96.0% identity over a 351 aa overlap with a predicted ORF (ORF 997) from *N. gonorrhoeae* g997/m997 96.0% identity in 351 aa overlap

```
                   10        20        30        40        50        60
g997.pep   MMNTPHPRPKIAVIGAGWAGLSAAVTLARHADVTLFEAGRQAGGRARTLAGNTDGFGFLD
           ||||||||||||||||||||||||||||||||||||||||||||||||||||||||||||
m997       MMNTPHPRPKIAVIGAGWAGLSAAVTLARHADVTLFEAGRQAGGRARTLAGNTDGFGFLD
                   10        20        30        40        50        60

                   70        80        90       100       110       120
g997.pep   NGQHILLGAYRGVLRLMKTIGSDPRAAFLRVPLHWHMHGGLQFRALPLPAPLHILGGVLL
           ||||||||||||||||||||||||||||||||||||||||||||||||||||||||||||
m997       NGQHILLGAYRGVLRLMKTIGSDPRAAFLRVPLHWHMHGGLQFRALPLPAPLHILGGVLL
                   70        80        90       100       110       120

                  130       140       150       160       170       180
g997.pep   ARRVPSAFKAKLLADMSDLQKSARLGQPDTTVAQWLKQRNVPRAAVMQFWQPLVWGALNT
           |||:|:||||||||||||||||||||||||||||||||||||||||||||||||||||||
m997       ARRAPTAFKAKLLADMSDLQKSARLGQPDTTVAQWLKQRNVPRAAVMQFWQPLVWGALNT
                  130       140       150       160       170       180
```

-continued

```
                    190       200       210       220       230       240
g997.pep     PLETASLRVLCNVLSDGVLTKKSGSDYLLPKQDLGAIVAEPALAELQRLGADIRLETRVC
             ||||||||||||||||||||||||||||||||||||||||||||:|||||||||||||||
m997         PLETASLRVLCNVLSDGVLTKKSGSDYLLPKQDLGAIVAEPALADLQRLGADIRLETRVC
                    190       200       210       220       230       240

                    250       260       270       280       290       300
g997.pep     RLNTLPDGKVLVNGEAFDAAILATAPYHAAALLPEGTPEHVQTAYQNLRYHAITTVYLRY
             ||||||||||||||||||||: ||||||||||||||||||||||||||||||||||||||
m997         RLNTLPDGKVLVNGEAFDAAVPATAPYHAAALLPEGTPEHVQTAYQNLRYHAITTVYLRY
                    250       260       270       280       290       300

                    310       320       330       340       350
g997.pep     AEPVRLPAPLTGIADGTAQWLLCPGQAPDCPQNEVSAVISVSDRVGAFANR
             ||||||||||||:||||:||||| |:    |:|||||||||||||||||||
m997         AEPVRLPAPLTGLADGTVQWLLCRGRL-GLPENEVSAVISVSDRVGAFANRAWADKAHAD
                    310       320        330       340       350
```

The following partial DNA sequence was identified in *N. meningitidis* <SEQ ID 3017>:

a997.seq

```
   1 ATGATGAACA CGCCGCATCC GCGCCCGAAA ATCGCCGTCA TCGGCGCAGG
  51 CTGGGCCGGC TTGTCCGCCG CCGTTACCTT GGCGCGGCAC GCCGACGTTA
 101 CCCTGTTTGA AGCCGGCCGG CAGGCGGGCG GCAGGGCGCG CGCACTGGCC
 151 GGAAATACCG ACGGTTTCGG TTTTTTGGAC AACGGGCAGC ATATTTTACT
 201 CGGCGCATAC CGGGGCGTGT TGCGCCTGAT GAAAACCATC GGTTCAGACC
 251 CCCATGCCGC CTTTTTGCGC GTACCGCTGC ACTGGCATAT GCACGGCGGT
 301 TTGCAGTTCC GCGCCCTCCC CCTGCCCGCG CCCCTGCATA TTTTGGGCGG
 351 CGTGCTGCTT GCCCGGCGCG TACCGTCCGC ATTCAAAGCC AAACTGCTTG
 401 CCGATATGTC CGATTTGCAG AAGTCCGCAC GCCTCGGACA GCCCGACACG
 451 ACAGTGGCGC AATGGCTGAA ACAGCGGAAC GTGCCGCGTG CCGCCGTAAT
 501 GCAGTTTTGG CAGCCCTTGG TTTGGGGCGC GCTCAACACG CCTTTGGAAA
 551 CCGCAAGCCT GCGCGTGTTG TGCAACGTTT TGTCCGACGG CGTGCTGACG
 601 AAAAAATCCG GCAGCGACTA TCTCCTACCC AAACAGGATT TGGGCGCAAT
 651 CGTCGCCGAA CCCGCCTTGG CGGAGCTTCA ACGGCTCGGC GCGGACATCC
 701 GCCTCGAAAC GCGCATATGC CGTCTGAACA CCCTCCCGGA CGGGAAAGTG
 751 CTCGTCAACG GCGAACCTTT CGATGCCGCC GTCCCCGCCA CCGCGCCCTA
 801 CCACGCCGCC GCGCTCCTGC CCGAAGGCAC GCCCGAACAC GTTCAGACGG
 851 CATATCAAAA CCTTCGCTAT CACGCCATCA CCACCGTCTA TCTGCGCTAT
 901 GCCGAACCCG TCCGCTTGCC TGCCCCGCTG ACCGGACTTG CCGACGGCAC
 951 GGTGCAATGG CTGCTTTGCC GGGGCAGGCT CGGACTGCCT GAAAACGAAG
1001 TGTCCGCCGT CATCAGCGTT TCCGACCGCG TCGGCGCGTT TGCAAACCGG
1051 GCGTGGGCGG ACAAAGTTCA CGCCGACCTC AAACGCATCC TTCCGCATTT
1101 GGGCGAACCC GAAGCCGTGC GCGTCATCAC CGAAAAACGC GCCACAACCG
1151 CAGCCGATGC CCCGCCGCCG GATTTGTCGT GGTTGCACCG GCACCGCATC
1201 TTCCCCGCCG GCGACTACCT CCACCCAGAC TACCCCGCCA CGCTCGAAGC
1251 CGCCGTACAA TCAGGTTTCG CGTCGGCGGA AGCCTGCCTG CAAAGCCTGA
1301 GCGATGCCGT CTGA
```

This corresponds to the amino acid sequence <SEQ ID 3018; ORF 997.a>:

a997.pep

```
  1 MMNTPHPRPK IAVIGAGWAG LSAAVTLARH ADVTLFEAGR QAGGRARALA
 51 GNTDGFGELD NGQHILLGAY RGVLRLMKTI GSDPHAAFLR VPLHWHMHGG
101 LQFRALPLPA PLHILGGVLL ARRVPSAFKA KLLADMSDLQ KSARLGQPDT
151 TVAQWLKQRN VPRAAVMQFW QPLVWGALNT PLETASLRVL CNVLSDGVLT
201 KKSGSDYLLP KQDLGAIVAE PALAELQRLG ADIRLETRIC RLNTLPDGKV
251 LVNGEPFDAA VPATAPYHAA ALLPEGTPEH VQTAYQNLRY HAITTVYLRY
301 AEPVRLPAPL TGLADGTVQW LLCRGRLGLP ENEVSAVISV SDRVGAFANR
351 AWADKVHADL KRILPHLGEP EAVRVITEKR ATTAADAPPP DLSWLHRHRI
401 FPAGDYLHPD YPATLEAAVQ SGFASAEACL QSLSDAV*
```

Computer analysis of this amino acid sequence gave the following results:

Homology with a predicted ORF from *N. meningitidis*

ORF 997 shows 98.2% identity over a 437 aa overlap with a predicted ORF (ORF 997) from *N. meningitidis* a997/m997 98.2% identity in 437 aa overlap

```
                  10        20        30        40        50        60
a997.pep  MMNTPHPRPKIAVIGAGWAGLSAAVTLARHADVTLFEAGRQAGGRARALAGNTDGFGFLD
          ||||||||||||||||||||||||||||||||||||||||||||||||:|||||||||||
m997      MMNTPHPRPKIAVIGAGWAGLSAAVTLARHADVTLFEAGRQAGGRARTLAGNTDGFGFLD
                  10        20        30        40        50        60

                  70        80        90       100       110       120
a997.pep  NGQHILLGAYRGVLRLMKTIGSDPHAAFLRVPLHWHMHGGLQFRALPLPAPLHILGGVLL
          ||||||||||||||||||||||||:|||||||||||||||||||||||||||||||||||
m997      NGQHILLGAYRGVLRLMKTIGSDPRAAFLRVPLHWHMHGGLQFRALPLPAPLHILGGVLL
                  70        80        90       100       110       120

                 130       140       150       160       170       180
a997.pep  ARRVPSAFKAKLLADMSDLQKSARLGQPDTTVAQWLKQRNVPRAAVMQFWQPLVWGALNT
          |||:|:||||||||||||||||||||||||||||||||||||||||||||||||||||||
m997      ARRAPTAFKAKLLADMSDLQKSARLGQPDTTVAQWLKQRNVPRAAVMQFWQPLVWGALNT
                 130       140       150       160       170       180

                 190       200       210       220       230       240
a997.pep  PLETASLRVLCNVLSDGVLTKKSGSDYLLPKQDLGAIVAEPALAELQRLGADIRLETRIC
          |||||||||||||||||||||||||||||||||||||||||||||:||||||||||||:|
m997      PLETASLRVLCNVLSDGVLTKKSGSDYLLPKQDLGAIVAEPALADLQRLGADIRLETRVC
                 190       200       210       220       230       240

                 250       260       270       280       290       300
a997.pep  RLNTLPDGKVLVNGEPFDAAVPATAPYHAAALLPEGTPEHVQTAYQNLRYHAITTVYLRY
          |||||||||||||| |||||||||||||||||||||||||||||||||||||||||||||
m997      RLNTLPDGKVLVNGEAFDAAVPATAPYHAAALLPEGTPEHVQTAYQNLRYHAITTVYLRY
                 250       260       270       280       290       300

                 310       320       330       340       350       360
a997.pep  AEPVRLPAPLTGLADGTVQWLLCRGRLGLPENEVSAVISVSDRVGAFANRAWADKVHADL
          ||||||||||||||||||||||||||||||||||||||||||||||||||||||:|||||
m997      AEPVRLPAPLTGLADGTVQWLLCRGRLGLPENEVSAVISVSDRVGAFANRAWADKAHADL
                 310       320       330       340       350       360

                 370       380       390       400       410       420
a997.pep  KRILPHLGEPEAVRVITEKRATTAADAPPPDLSWLHRHRIFPAGDYLHPDYPATLEAAVQ
          ||||||||||||||||||||||||||||||||||||||||||||||||||||||||||||
m997      KRILPHLGEPEAVRVITEKRATTAADAPPPDLSWLHRHRIFPAGDYLHPDYPATLEAAVQ
                 370       380       390       400       410       420

                 430
a997.pep  SGFASAEACLQSLSDAVX
          ||||||||||||||||||
m997      SGFASAEACLQSLSDAVX
                 430
```

g999.seq Not found yet g999.pep Not found yet

The following partial DNA sequence was identified in *N. meningitidis* <SEQ ID 3019>:

m999.seq

```
  1 ATGAATATGA AAAAATTGAT TTCCGCAATT TGTGTTTCAA TTGTTTTATC
 51 AGCCTGCAAC CAACAATCAA AAACGGCACA AGCCGAAGAA CCTGTCCAAA
101 GTATCCAGGC TGCTGATTGT ACCGCCCCAA TGGACATCAC AGTTGAACAA
151 TATCTCATCA ATTTGGAGCA AGCATTTAAA ACTCAGAACG TCTCAACAAA
201 AATCCATAAT AAAAATATTG TCAAGACCGA TTGTGGTTAT GACCTTACTT
251 TGGTAATGGA TTTTGGGGCG ATTGCGCTCA AACTGGACGA GCAGCAAAAA
301 ATTAGAGCTA TCTCAGTAGG CTACATTTTA AAAACCGACG GAGAGAAAGG
351 ACAAAATCTA GTCAATAATG CCATAAATGG ATTACACAGT ATTCAGGCAG
401 TTCTGTCTTT AACTACCACA GACAAATTGG GCGAATCGGA AGCAGGAAAA
451 CAACTTTTTA CAGCTTTAAC CGAAGTCGTC AAAGAATCCA ATCAGACAGG
501 AGCAACAGCG CAAAAAGACG TTCCGGCAGA TGGTATTTTA TATAGCGTTG
551 TTTTTGAAAA AGAAACAAAC ACCATTGCAA TAATCGGCAG AAAACAACCC
601 TAA
```

This corresponds to the amino acid sequence <SEQ ID 3020; ORF 999>:

m999.pep

```
  1 MNMKKLISAI CVSIVLSACN QQSKTAQAEE PVQSIQAADC TAPMDITVEQ
 51 YLINLEQAFK TQNVSTKIHN KNIVKTDCGY DLTLVMDFGA IALKLDEQQK
101 IRAISVGYIL KTDGEKGQNL VNNAINGLHS IQAVLSLTTT DKLGESEAGK
151 QLFTALTEVV KESNQTGATA QKDVPADGIL YSVVFEKETN TIAIIGRKQP
    *
```

a999.seq Not found yet a999.pep Not found yet

The foregoing examples are intended to illustrate but not to limit the invention.

SEQUENCE LISTING (3287 sequences)

SEQ ID NO: 1 - DNA, 396 bp, Neisseria gonorrhoeae
atgctgccgcaggggaaggcggcgcggagggtgtcggcgaacgaggtgtccggcagggcttgcgcccggatggtgctggtcatctgccagacgctgccgaaacgcgatactttaaacggctcgggtacgcatactttaccggtttgggcgattttgccgaggtcgttgcgcagcaaatcgacaatcatcacgttttcggcgcggtttttcgggtcggtttgtaactcggcggcgcggcgttcgtcttgtccgtcgcccaaaatcggcgcggtgcctttcatcggttcggtgctgatggtgccgtctgaagcgatgttgaggaagagttcgggcgagaaacacagcgtccacgcggattgcccggcttcatcgggcaggtgggacaatacggcatag

SEQ ID NO: 2 - protein, 131 aa, Neisseria gonorrhoeae
MLPQGKAARRVSANEVSGRACARMVLVICQTLPKRDTLNGSGTHTLPVWAILPRSLRSKSTIITFSARFFGSVCNSAARRSSCPSPKIGAVPFIGSVLMVPSEAMLRKSSGEKHSVHADCPASSGRWDNTA

SEQ ID NO: 3 - DNA, 395 bp, Neisseria meningitidis
atgctgccgcaggggaaggcggcgcggaggatgtcggcgaacgaggtgtgcggcasscttssgcttggayggtgctggtcatctgccaaacgctgccgaaacgcgatactttaaacggttcgggtacgcatactgtgccggtttgggcgattttgccgagatcgttacgcagcaaatcgacaatcatcacgttttcggcgcggtttttcgggtctgcttgcaactcggcggcgcggcgttcgtcttgtccgtcgcccaaaatcggcgcggtgcctttcatcggttcggtgctgatggtgccgtccgaaccgattttgaggaagagttcgggcgagaaacacagcgtccacgcggattgcccctccgcatcgggcaggtgggacaagacggcatag

SEQ ID NO: 4 - protein, 131 aa, Neisseria meningitidis
  misc_feature (19)..(19): Xaa can be any naturally occurring amino acid
  misc_feature (21)..(21): Xaa can be any naturally occurring amino acid
  misc_feature (24)..(24): Xaa can be any naturally occurring amino acid
MLPQGKAARRMSANEVCGXLXAWXVLVICQTLPKRDTLNGSGTHTVPVWAILPRSLRSKSTIITFSARFFGSACNSAARRSSCPSPKIGAVPFIGSVLMVPSEPILRKSSGEKHSVHADCPSASGRWDKTA

SEQ ID NO: 5 - DNA, 396 bp, Neisseria meningitidis
atgctgccgcaggggaaggcggcgcggaggatgtcggcgaacgaggtgtgcggcaaggcttgggcttggatggtgctggtcatctgccaaacgctgccgaaacgcgatactttaaacggttcgggtacgcatactgtgccggtttgggcgattttgccgaggtcgttacgcagcaaatcgacaatcatcacgttttcggcgcggtttttcgggtctgcttgcaactcggcggcgcggcgttcgtcttgtccgtcgcccaaaatcggcgcggtgcctttcatcggttcggtgctgatggtgccgtccgaaccgattttgaggaagagttcgggcgagaaacacagcgtccacgcggattgcccttgtgcatcgggcaggtgggacaaaacggcatag

SEQ ID NO: 6 - protein, 131 aa, Neisseria meningitidis
MLPQGKAARRMSANEVCGKAWAWMVLVICQTLPKRDTLNGSGTHTVPVWAILPRSLRSKSTIITFSARFFGSACNSAARRSSCPSPKIGAVPFIGSVLMVPSEPILRKSSGEKHSVHADCPCASGRWDKTA

SEQ ID NO: 7 - DNA, 663 bp, Neisseria gonorrhoeae
  misc_feature (529)..(529): n is a, c, g, or t
atggtcgtattcgtggctgaaggcgtattcggtcgcgctgttttgggtcacttggtattgctcttcggtcagggtgcgtttgagttcggcgtcactcggttttttatacgttgccgcgtcgaagcctttgccttgcggtgcggctttggttttgcccggcagcggttcgtcggctttgcggatgtcgatgtggcagtagccgttggggtttttaatcaggtagtcctgatggtattcctcggcgtcgtagaagtttttcagcggttcgttttcaacaacgaggggcagttggtatttttgctgctcgcgtttgagggcggcggcgatgacggctttttcggcggggtcggtgtagtacacgccgctgcggtattgcgtgccggtgtcgttaccctgtttgttgaggctggtcggatcaacgacgcggaaataatattgcaggatgtcgtccaggctgagtttgtcggcatcgtaggtcactttgacggtctcggcatgacccgtatggcggtaggacacttcttcgtanctcgggttttccgtgttgccgttggcgttaccggataccgcgtcaaccacgccgtcgatgcgttggaaataggcttccaagccccaaaagcagccgccggcgaagtaaatggtgcccgtgttcatgattgctga

SEQ ID NO: 8 - protein, 219 aa, Neisseria gonorrhoeae
MVVFVAEGVFGRAVLGHLVLLFGQGAFEFGVTRFFIRCRVEAFALRCGFGFARQRFVGFADVDVAVAVGVFNQVVLMVFLGVVEVFQRFVFNNEGQLVFLLLAFEGGGDDGFFGGVGVVHAAAVLRAGVVTLFVEAGRINDAEIILQDVVQAEFVGIVGHFDGLGMTRMAVGHFFVRVFRVAVGVTGYRVNHAVDALEIGFQAPKAAAGEVNGARVHDC

SEQ ID NO: 9 - DNA, 662 bp, Neisseria meningitidis
atggtcgtattcgtggctgaaggcatattcggtcgcgctgttttgggtaacttgstattgctcttcggtcagggtgcgtttgagttcggcgtcactcggttttttatacgttgccgcgtcgaagcctttgccttgcggggcggtcttggttttgcccggcagcggttcgtcagckttgcggatgtcgatgtggcagtagccgttggggtttttaatcaagtagtcctgatggtattcctcggcatcgtagaagtttttcagcggctcgttttcaacaacgaggggcagttggtatttttgctgctcgcgtttgagggcgkcggcgatgacggctttttcgkcggggtcggtgtagtacacgccgctgcggtattgcgtaccggtgtcgttgccctgtttgttgaggctggtcggatcaacgacgcggaagaaatattgcaggatgtcgtctaggctgagtttgtcggcatcgtaggtcactttgacggtttcggcgtggcccgtatggcggtaggacacgtcttcatagctcggatttttcgtgttgccgttggcgtagccggataccgcgtcaaccacgccgtcgatgcgttggaaataggcttccaagccccagaagcagcgccggcgaggtaaatggtgcgcgtgttcatgatttttga

SEQ ID NO: 10 - protein, 219 aa, Neisseria meningitidis
  misc_feature (19)..(19): Xaa can be any naturally occurring amino acid
  misc_feature (59)..(59): Xaa can be any naturally occurring amino acid
  misc_feature (107)..(107): Xaa can be any naturally occurring amino acid
  misc_feature (114)..(114): Xaa can be any naturally occurring amino acid
  misc_feature (208)..(208): Xaa can be any naturally occurring amino acid
MVVFVAEGIFGRAVLGNLXLLFGQGAFEFGVTRFFIRCRVEAFALRGGLGFARQRFVSXADVDVAVAVGVFNQVVLMVFLGIVEVFQRLVFNNEGQLVFLLLAFEGXGDDGFFXGVGVVHAAAVLRTGVVALFVEAGRINDAEEILQDVVAEFVGIVGHFDGFGVARMAVGHVFIARIFRVAVGVAGYRVNHAVDALEIGFQAPEAAXGEVNGARVHDF

SEQ ID NO: 11 - DNA, 663 bp, Neisseria meningitidis
atggtcgtattcgtggctgaaggcatattcggtcgcgctgttttgggtaacttggtattgctcttcggtcagggtgcgtttgagttcggcgtcactcggttttttatacgttgccgcgtcgaagcctttgccttgcggtgcggtcttggttttgcccggcagcggttcgtcggctttgcggatatcgatgtggcagtagccgttggggtttttaatcaagtagtcctgatggtattcctcggcatcgtagaagtttttcagcggctcgttttcaacaacgaggggcagttggtatttttgctgctcgcgtttgagggcggcggcgatgacggctttttcggcggggtcggtgtagtacacgccgctgcggtattgcgtaccggtgtcgttgccctgtttgttgaggctggtcggatcaacgacgcggaagaaatattgcaggatgtcgtctaggctgagtttgtcggcatcgtaggtcactttgacggtttcggcgtggcccgtatggcggtaggacacgtcttcatagctcggatttttcgtgttgccgttggcgtagccggataccgcgtcaaccacgccgtcgatgcgttggaaataggcttccaagccccagaagcagccgccggcgaggtagatggtgcgcgtgttcatgatttttga

SEQ ID NO: 12 - protein, 219 aa, Neisseria meningitidis
MVVFVAEGIFGRAVLGNLVLLFGQGAFEFGVTRFFIRCRVEAFALRCGLGFARQRFVGFADIDVAVAVGVFNQVVLMVFLGIVEVFQRLVFNNEGQLVFLLLAFEGGGDDGFFGGVGVVHAAAVLRTGVVALFVEAGRINDAEEILQDVVAEFVGIVGHFDGFGVARMAVGHVFIARIFRVAVGVAGYRVNHAVDALEIGFQAPEAAAGEVDGARVHDF

SEQ ID NO: 13 - DNA, 777 bp, Neisseria gonorrhoeae
atggtagaacggcatatccagcatttgcggaacggtcatcttcatttgatgcgcccatgccaacaagtgagccaaatgttcggcggcagggcctacgatttccgcgccgataaagcggccggtggctttttcggcatacaggcgcatatggcctttgtttaccagcatcacgcggctgcgaccttgatttttgaacgatacttcgccgatgacaaattcgtcggcttggtattgcgcggcaacctgcgcgtatttcaaaccgacaaagccgatttgcggactggtaaacaccacgccaatggtgctgcggcgcaaaccgctgccgatattcgggtagcggccccgcgttattgcccggcaatcttaccttggtcggcggcttcatgcagcaggggcagttggttggacgcgtcgcccgcaataaagatatgcggaatgctggtctgcatggtcagcggatcggcaacgggtacgccgcgcgcgtctttgtcgatattgatgttttccaaaccgatattgtcaacgttcggacggcgacctacggctgccaacatatattcggcaacaaatacgcctttttcgccatcctgctcccaatggacttctacattgccgtctgcgtcgagtttgacctcggttttagcatccagatgcagtttcaattcttctccgaacacggctttcgcctcgtctgaaacaacggggtcggaaatgccgccgatgattccgcccaaaccgaaaatttcaactttcacacccaaacggtgcaatgcctga

SEQ ID NO: 14 - protein, 258 aa, Neisseria gonorrhoeae
MVERHIQHLRNGHLHLMRPCQQVSQMFGGRAYDFRADKAAGGFFGIQAHMAFVYQHHAAATLIFERYFADDKFVGLVLRGNLRVFQTDKADLRTGKHHANGAAAQTAADIRVAAPRYCPAILPWSAASCSRGSWLDASPAIKICGMLVCMVSGSATGTPRASLSILMFSKPILSTFGRRPTAANIYSATNTPFSPSCSQWTSTLPSASSLTSVLASRCSFNSSPNTAFASSETTGSEMPPMIPPKPKISTFTPKRCNA

SEQ ID NO: 15 - DNA, 774 bp, Neisseria meningitidis
atggtagaacggcatatccagcatttgcggaacggtcatcttcatttgatgtgcccaagccaacaggtgcgccaaatgttcggcggcagggcctacgatttccgcgccgataaagcggccggtggctttttcggcatacaggcgcatatggcctttgttcaccagcatcacgcggctgcggccttggtttttgaacgatacttcgccgatgacaaattcgtcggcttggtattgcgcggcaacctgcgcgtatttcagaccgacaaagccgatttgcggactggtaaacaccacgccgatggtgctgcgccgcaaaccgccgccgatattcgggtagcggccgcgttatcgccggcaatcttgccttggtcggcagcttcatgcagcagaggcagttggttggacgcatcgcctgcgatgaagatatgcggaatactggtctgcatggtcagcgggtcggcaacaggtacgccgcgcgcatctttttcgatattgatattttccaaaccgatattgtcaacgttcggacggcggcccacggctgccagcatatattcggcaacaaatacgcctttttcgccatcctgctcccaatggacttctacattgccgtctgcatcgagtttgacctcggttttagcatccagatgcagtttcaattcttcgccgaacacggcgttcgcctcgtctgaaacgacggggtcggaaatgccgccgatgattccgcccaaaccgaaaatttcaactttcacgcccaaacggtgcaatgcctga

SEQ ID NO: 16 - protein, 257 aa, Neisseria meningitidis
MVERHIQHLRNGHLHLMCPSQQVRQMFGGRAYDFRADKAAGGFFGIQAHMAFVHQHHAAAALVFERYFADDKFVGLVLRGNLRVFQTDKADLRTGKHHADGAAPQTAADIRVAAALSPAILPWSAASCSRGSWLDASPAMKICGILVCMVSGSATGTPRASFSILIFSKPILSTFGRRPTAASIYSATNTPFSPSCSQWTSTLPSASSLTSVLASRCSFNSSPNTAFASSETTGSEMPPMIPPKPKISTFTPKRCNA

SEQ ID NO: 17 - DNA, 774 bp, Neisseria meningitidis
atggtagaacggcatatccagcatttgcggaacggtcatcttcatttgatgtgcccaagccaacaggtgcgccaaatgttcggcggccggacctacgatttctgcgccgatgaagcggccggtggctttttcggcatacaggcgcatatggcctttgtttaccagcatcacgcggctgcggccttggtttttgaacgatacttcgccgatgacaaattcgtcggcttggtattgcgcggcaacctgcgcgtatttcaaaccgacaaagccgatttgcggactggtgaacactacgccgatggtgctgcggcgcaaaccgccgccgatattcgggtagcggccgcgttatcgccggcaatcttgccttggtcggcggcttcatgcagcaggggcagttggttggacgcgtcgcccgcaataaagatatgcggaatactggtctgcatagtcagcggatcggcaacgggtacgccgcgcgcatctttttcgatattgatgttttccaaaccgatattgtcaacgttcggacggcggcctacggctgccagcatatattcggcaacaaatacgcctttttcgccatcctgctcccaatggacttctacattgccgtctgcgtcgagtttggcctcggttttagcatccaaatgcagtttcaattcttcaccgaacacggctttcgcctcgtctgaaacgacggggtcggaaatgccgccgatgatgccacccaaaccgaaaatttcaactttcacgcccaaacggtgcaatgcctga

SEQ ID NO: 18 - protein, 257 aa, Neisseria meningitidis
MVERHIQHLRNGHLHLMCPSQQVRQMFGGRTYDFCADEAAGGFFGIQAHMAFVYQHHAAAALVFERYFADDKFVGLVLRGNLRVFQTDKADLRTGEHYADGAAAQTAADIRVAAALSPAILPWSAASCSRGSWLDASPAIKICGILVCIVSGSATGTPRASFSILMFSKPILSTFGRRPTAASIYSATNTPFSPSCSQWTSTLPSASSLASVLASKCSFNSSPNTAFASSETTGSEMPPMMPPKPKISTFTPKRCNA

SEQ ID NO: 19 - DNA, 1107 bp, Neisseria gonorrhoeae
atggggatggacaatattgatatgttcatgcctgaacaagaggaaatccaatcaatgtggaaagaaattttactgaattacggtattttcctgctcgaactgcttaccgtgttcggcgcaattgcgctgattgtgttggctatcgtacagagtaagaaacagtcggaaagcggcagtgtcgtactgacagatttttcggaaaattataaaaaacagcggcaatcgtttgaaacattctttttaagcgaggaagagacaaaacatcaggaaaaaaaagaaaagaaaaaggaaaaggcggaagccaaagcagagaaaaagcgtttgaaggagggcggggagaaatctgccgaaacgcaaaaatcccgcctttttgtgttggattttgacggcgatttgtatgcacacgccgtagaatccttgcgtcatgagattacggcggtgcttttgattgccaagcctgaagatgaggttctgctcagattggaaagtccgggcggcgtggttcacggttacggtttggcggcttcgcagcttaggcgtttgcgcgaacgcaatattccgctgaccgtcgccgtcgataaggtcgcggcaagcggcggctatatgatggcgtgtgtggcggataaaattgtttccgctccgtttgcggtcatcggttcggtgggtgtggtggcggaagtgccgaatatccaccgcctgttgaaaaaacatgatattgatgtggatgtgatgacggcgggcgaatttaagcgcacggttacttttatgggtgaaaatacggaaaagggcaaacagaaattccggcaggaactggaggaaacgcatcagttgttcaagcagtttgtcagtgaaaaccgccccgggttggatattgaaaaaatagcgacgggcgagcattggttcggccggcaggcgttggcgttgaacttgattgacgagatttcgaccagtgatgatttgttgttgaaagcgtttgaaaacaaacaggttatcgaagtgaaatatcaggagaagcgaagcctgatccagcgcattggtttgcaggcggaagcttccgttgaaaagttgtttgccaaacttgtcaaccggcgagcggatgtgatgtag

SEQ ID NO: 20 - protein, 368 aa, Neisseria gonorrhoeae
MGMDNIDMFMPEQEEIQSMWKEILLNYGIFLLELLTVFGAIALIVLAIVQSKKQSESGSVVLTDFSENYKKQRQSFETFFLSEEETKHQEKKEKKKEKAEAKAEKKRLKEGGEKSAETQKSRLFVLDFDGDLYAHAVESLRHEITAVLLIAKPEDEVLLRLESPGGVVHGYGLAASQLRRLRERNIPLTVAVDKVAASGGYMMACVADKIVSAPFAVIGSVGVVAEVPNIHRLLKKHDIDVDVMTAGEFKRTVTFMGENTEKGKQKFRQELEETHQLFKQFVSENRPGLDIEKIATGEHWFGRQALALNLIDEISTSDDLLLKAFENKQVIEVKYQEKRSLIQRIGLQAEASVEKLFAKLVNRRADVM

SEQ ID NO: 21 - DNA, 1100 bp, Neisseria meningitidis
  misc_feature (350)..(350): n is a, c, g, or t
  misc_feature (374)..(581): n is a, c, g, or t
atggacaatattgacatgttcatgcctgaacaagaggaaatccaatcaatgtggaaagaaattttactgaattacggtattttcctgctcgaactgcttaccgtgttcggcgcaattgcgctgattgtgttggctatcgtacagagtaagaaacagtcggawagcggcagtgtcgtactgacggatttttcggaaaattataaaaaacagcggcaatcgtttgaagcattctttttaagcggggaagaggcacaacatcaggaaaaagaggaaaagaaaaaggaaaaggcggaagccaaagcagagaaaaacgtttgaaggagggtggggagaaatctgccgaaacgcanaaatcacgcctttttgtgttggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgagcggcggttatatgatggcgtgtgtggcggataaaattgcttccgctccgtttgcgattgtcggttcggtgggtgtggtggcggaagtaccgaatatccaccgcctgttgaaaaaacatgatattgatgtggatgtgatgacggcgggcgaatttaagcgcacggttacttttatgggtgaaaatacggaaaagggcaaacagaaattccgacaggaactggaggaaacgcatcagttgttcaagcagtttgtcagcgagaaccgccctcaattggatattgaggaagtggcaacgggcgagcattggttcggtcggcaggcgttggcgttgaacttgattgacgagatttcgaccagtgatgatttgttgttgaaagcgtttgaaaacaaacaggttatcgaagtgaaatatcaggagaagcaaagcctgatccagcgcattggtttgcaggcggaagcttctgttgaaaagttgtttgccaaacttgtcaaccggcgggcggatgtgatgtag

SEQ ID NO: 22 - protein, 366 aa, Neisseria meningitidis
  misc_feature (54)..(54): Xaa can be any naturally occurring amino acid
  misc_feature (104)..(104): Xaa can be any naturally occurring amino acid
  misc_feature (117)..(117): Xaa can be any naturally occurring amino acid
  misc_feature (125)..(194): Xaa can be any naturally occurring amino acid
MDNIDMFMPEQEEIQSMWKEILLNYGIFLLELLTVFGAIALIVLAIVQSKKQSXSGSVVLTDFSENYKKQRQSFEAFFLSGEEAQHQEKEEKKKEKAEAKAEKXRLKEGGEKSAETXKSRLFVLXXXXXXXXXXXXXXXXXXXXXXXXXXXXXXXXXXXXXXXXXXXXXXXXXXXXXXXXXXXXXXXXXXXXXXASGGYMMACVADKIASAPFAIVGSVGVVAEVPNIHRLLKKHDIDVDVMTAGEFKRTVTFMGENTEKGKQKFRQELEETHQLFKQFVSENRPQLDIEEVATGEHWFGRQALALNLIDEISTSDDLLLKAFENKQVIEVKYQEKQSLIQRIGLQAEASVEKLFAKLVNRRADVM

SEQ ID NO: 23 - DNA, 1101 bp, Neisseria meningitidis
atggacaatattgacatgttcatgcctgaacaagaggaaatccaatcaatgtggaaagaaattttactgaattacggtattttcctgctcgaactgcttaccgtgttcggcgcaattgcgctgattgtgttggctatcgtacagagtaagaaacagtcggaaagcggcagtgtcgtactgacggatttttcggaaaattataaaaaacagcggcaatcgtttgaagcattctttttaagcggggaagaggcaaaacatcaggaaaaagaggaaaagaaaaaggaaaaggcggaagccaaagcagagaaaaagcgtttgaaggagggtggggagaaatcttccgaaacgcaaaaatcccgcctttttgtgttggattttgacggcgatttgtatgcacacgccgtagaatccttgcgtcatgagattacggcggtgcttttgattgccaagcctgaagatgaggttctgcttagattggaaagtccgggcggcgtggttcacggttacggtttggcggcttcgcagcttaggcgtttgcgcgaacgcaatattccgctgaccgtcgccgtcgataaggtggcggcgagcggtggttatatgatggcgtgtgtggcggataaaattgtttccgctccgtttgcgattgtcggttcggtgggtgttgtagcggaagtaccgaatatccaccgcctgttgaaaaaacatgatattgatgtggatgtgatgacggcgggcgaatttaagcgcacggttacttttatgggtgaaaatacggaaaagggcaaacagaaattccgacaggaactggaggaaacgcatcagttgttcaagcagtttgtcagcgagaaccgccctcaattggatattgaggaagtggcaacgggcgagcattggttcggtcggcaggcgttggcgttgaacttgattgacgagatttcgaccagtgatgatttgttgttgaaagcgtttgaaaacaaacaggttatcgaagtgaaatatcaggagaagcaaagcctgatccagcgcattggtttgcaggcggaagcttctgttgaaaagttgtttgccaaacttgtcaaccggcgggcggatgtgatgtag

SEQ ID NO: 24 - protein, 366 aa, Neisseria meningitidis
MDNIDMFMPEQEEIQSMWKEILLNYGIFLLELLTVFGAIALIVLAIVQSKKQSESGSVVLTDFSENYKKQRQSFEAFFLSGEEAKHQEKEEKKKEKAEAKAEKKRLKEGGEKSSETQKSRLFVLDFDGDLYAHAVESLRHEITAVLLIAKPEDEVLLRLESPGGVVHGYGLAASQLRRLRERNIPLTVAVDKVAASGGYMMACVADKIVSAPFAIVGSVGVVAEVPNIHRLLKKHDIDVDVMTAGEFKRTVTFMGENTEKGKQKFRQELEETHQLFKQFVSENRPQLDIEEVATGEHWFGRQALALNLIDEISTSDDLLLKAFENKQVIEVKYQEKQSLIQRIGLQAEASVEKLFAKLVNRRADVM

SEQ ID NO: 25 - DNA, 462 bp, Neisseria gonorrhoeae
atgctgctggtgctggaattttggttcggcgtgtcggcggtgggcatacttgcgttgtttttatggcttttgccacgttttgccgccatcagcgaaaacctgtatttccgcctgaacaacagcttggaacgcgacaaccactttatccgaaaaggcgacgagcggcagctgtaccgccattacggactggtttcgcgcctgcgtgtgctgatttccaaccgcgaagccttcggctatctctgcgtcggcgcggcgatgggtattttgttcggctttgcttttgtgatgatgacgctcaaaggctacggcagcgcggggcatatttattcggtcggcacttatctgtggatgtttgccatgagtttggacgatgtgccgcgattggtcgaacaatattccaatttgaaagacatcggacaacggatagagtggtcggaacggaacatcaaagccggaacttga

SEQ ID NO: 26 - protein, 153 aa, Neisseria gonorrhoeae
MLLVLEFWFGVSAVGILALFLWLLPRFAAISENLYFRLNNSLERDNHFIRKGDERQLYRHYGLVSRLRVLISNREAFGYLCVGAAMGILFGFAFVMMTLKGYGSAGHIYSVGTYLWMFAMSLDDVPRLVEQYSNLKDIGQRIEWSERNIKAGT

SEQ ID NO: 27 - DNA, 462 bp, Neisseria meningitidis
atgctgctggtgctggaattttgggtcggcgtgtcggcggtgggcatacttgcgttgtttttatggcttttgccacgttttgccgccatcagcgaaaacctgtatttccgcctgaacaacagcttggaacgcgacaaccactttatccgaaaaggcgaccggcggcagctgtaccgccattacggactgcttgcgcgcctgcgtgtgctgatttccaaccgcgaagccttcggctatctctgcgtcggcacggcgatgggtattttgttcggctttgcttttgtgatgatgacgctcaaaggctacagcagcgcggggcatgtctattcggtcggcacttatctgtggatgtttgccatgagtttggacgacgtgccgcgattggtcgaacaatattccaatttgaaagacatcggacaacggatagagtggtcggaacggaacatcaaagccggaacttga

SEQ ID NO: 28 - protein, 153 aa, Neisseria meningitidis
MLLVLEFWVGVSAVGILALFLWLLPRFAAISENLYFRLNNSLERDNHFIRKGDRRQLYRHYGLLARLRVLISNREAFGYLCVGTAMGILFGFAFVMMTLKGYSSAGHVYSVGTYLWMFAMSLDDVPRLVEQYSNLKDIGQRIEWSERNIKAGT

SEQ ID NO: 29 - DNA, 462 bp, Neisseria meningitidis
atgctgctggtgctggaattttgggtcggcgtgtcggcggtgggcatacttgcgttgtttttatggcttttgccacgttttgccgccatcagcgaaaacctgtatttccgcctgaagaacagcttggaacgcgacaaccactttatccgaaaaggcgacgagcggcagctggaccgccattacggactgcttgcgcgcctgcgtgtgctgatttccaaccgcgaagccttcggctatctctgcgtcggcacggcgatgggtattttgttcggctttgcttttgtgatgatgacgctcaaaggctacagcagcgcggggcatgtctattcggtcggcacttatctgtggatgtttgccataagtttggacgacgtgccgcgattggtcgaacaatattccaatttgaaagacatcggacaacggatagagtggtcgaaacggaacatcaaagccggaacttga

SEQ ID NO: 30 - protein, 153 aa, Neisseria meningitidis
MLLVLEFWVGVSAVGILALFLWLLPRFAAISENLYFRLKNSLERDNHFIRKGDERQLDRHYGLLARLRVLISNREAFGYLCVGTAMGILFGFAFVMMTLKGYSSAGHVYSVGTYLWMFAISLDDVPRLVEQYSNLKDIGQRIEWSKRNIKAGT

SEQ ID NO: 31 - DNA, 867 bp, Neisseria gonorrhoeae
atgtggaaaatgttgaaacacatagccaaaacccaccgcaagcgattgattggcacattttccccggtcggactggaaaaccttttgatgctggggtatccggtgtttggcggctgggcgattaatgccgtgattgcggggagggtgtggcaggcgttgctgtacgctttggttgtatttttgatgtggctggtcggtgcggcacggcggattgccgatacgcgcacgtttacgcggatttataccgaaatcgccgtgccggttgtgttggaacaacggcagcggcaagtcccgcattcagcggtaactgcacgggttgccctgtcgcgtgaatttgtcagcttttttgaagaacacctgccgattgccgcgacatccgtcgtatccatattcggcgcgtgcatcatgctgctggtgctggaattttgggtcggcgtgtcggcggtgggcatacttgcgttgtttttatggcttttgccacgttttgccgccatcagcgaaaacctgtatttccgcctgaacaacagcttggaacgcgacaaccactttatccgaaaaggcgacgagcggcagctgtaccgccattacggactggtttcgcgcctgcgtgtgctgatttccaaccgcgaagccttcggctatctctgcgtcggcgcggcgatgggtattttgttcggctttgcttttgtgatgatgacgctcaaaggctacggcagcgcggggcatatttattcggtcggcacttatctgtggatgtttgccatgagtttggacgatgtgccgcgattggtcgaacaatattccaatttgaaagacatcggacaacggatagagtggtcggaacggaacatcaaagccggaacttga

SEQ ID NO: 32 - protein, 288 aa, Neisseria gonorrhoeae
MWKMLKHIAKTHRKRLIGTFSPVGLENLLMLGYPVFGGWAINAVIAGRVWQALLYALVVFLMWLVGAARRIADTRTFTRIYTEIAVPVVLEQRQRQVPHSAVTARVALSREFVSFFEEHLPIAATSVVSIFGACIMLLVLEFWVGVSAVGILALFLWLLPRFAAISENLYFRLNNSLERDNHFIRKGDERQLYRHYGLVSRLRVLISNREAFGYLCVGAAMGILFGFAFVMMTLKGYGSAGHIYSVGTYLWMFAMSLDDVPRLVEQYSNLKDIGQRIEWSERNIKAGT

SEQ ID NO: 33 - DNA, 867 bp, Neisseria meningitidis
atgtggaaaatgttgaaacacatagcccaaacccaccgcaagcgattgattggcacattttccctggtcggactggaaaaccttttgatgctggtgtatccggtgtttggcggccgggcgatcaatgccgtgattgcgggggaggtgtggcaggcgttgctgtacgctttggttgtgcttttgatgtggctggtcggtgcggtgcggcggattgccgatacgcgcacgtttacgcggatttataccgaaatcgccgtgccggtcgtgttggaacagcggcagcgacaagtcccgcattcggcggtaactgcgcgggttgccctgtcgcgtgagtttgtcagcttttttgaagaacacctgccgattgccgcgacatccgtcgtatccatattcggcgcgtgcatcatgctgctggtgctggaattttgggtcggcgtgtcggcggtgggcatacttgcgttgtttttatggcttttgccacgttttgccgccatcagcgaaaacctgtatttccgcctgaacaacagcttggaacgcgacaaccactttatccgaaaaggcgaccggcggcagctgtaccgccattacggactgcttgcgcgcctgcgtgtgctgatttccaaccgcgaagccttcggctatctctgcgtcggcacggcgatgggtattttgttcggctttgcttttgtgatgatgacgctcaaaggctacagcagcgcggggcatgtctattcggtcggcacttatctgtggatgtttgccatgagtttggacgacgtgccgcgattggtcgaacaatattccaatttgaaagacatcggacaacggatagagtggtcggaacggaacatcaaagccggaacttga

SEQ ID NO: 34 - protein, 288 aa, Neisseria meningitidis
MWKMLKHIAQTHRKRLIGTFSLVGLENLLMLVYPVFGGRAINAVIAGEVWQALLYALVVLLMWLVGAVRRIADTRTFTRIYTEIAVPVVLEQRQRQVPHSAVTARVALSREFVSFFEEHLPIAATSVVSIFGACIMLLVLEFWVGVSAVGILALFLWLLPRFAAISENLYFRLNNSLERDNHFIRKGDRRQLYRHYGLLARLRVLISNREAFGYLCVGTAMGILFGFAFVMMTLKGYSSAGHVYSVGTYLWMFAMSLDDVPRLVEQYSNLKDIGQRIEWSERNIKAGT

SEQ ID NO: 35 - DNA, 843 bp, Neisseria meningitidis
agccaaaaccaccgcaagcgattgattggcacattttttctggtcggactggaaaaccttttgatgctggtgtatccggtgtttggcggctgggcgattaatgccgtgattgcggggcaggcgtggcaggcgttgctgtacgctttggttgtgcttttgatgtggctggtcggtgcggcgcggcggattgccgatacgcgcacgtttacgcggatttataccgaaatcgccgtgccggttgtgttggaacagcggcagcggcaagtcccgcattcggcggtaactgcgcgggttgccctgtcgcgtgagtttgtcagcttttttgaagaacacctgccgattgccgcgacatccgtcgtatccatattcggcgcgtgcatcatgctgctggtgctggaattttgggtcggcgtgtcggcggtgggcatacttgcgttgtttttatggcttttgccacgttttgccgccatcagcgaaaacctgtatttccgcctgaagaacagcttggaacgcgacaaccactttatccgaaaaggcgacgagcggcagctggaccgccattacggactgcttgcgcgcctgcgtgtgctgatttccaaccgcgaagccttcggctatctctgcgtcggcacggcgatgggtattttgttcggctttgcttttgtgatgatgacgctcaaaggctacagcagcgcggggcatgtctattcggtcggcacttatctgtggatgtttgccataagtttggacgacgtgccgcgattggtcgaacaatattccaatttgaaagacatcggacaacggatagagtggtcgaaacggaacatcaaagccggaacttga

SEQ ID NO: 36 - protein, 280 aa, Neisseria meningitidis
SQNHRKRLIGTFFLVGLENLLMLVYPVFGGWAINAVIAGQAWQALLYALVVLLMWLVGAARRIADTRTFTRIYTEIAVPVVLEQRQRQVPHSAVTARVALSREFVSFFEEHLPIAATSVVSIFGACIMLLVLEFWVGVSAVGILALFLWLLPRFAAISENLYFRLKNSLERDNHFIRKGDERQLDRHYGLLARLRVLISNREAFGYLCVGTAMGILFGFAFVMMTLKGYSSAGHVYSVGTYLWMFAISLDDVPRLVEQYSNLKDIGQRIEWSKRNIKAGT

SEQ ID NO: 37 - DNA, 342 bp, Neisseria gonorrhoeae
atgaacacaacccgactgccgaccgccttcatcttgtgctgcctctgcgccgccgcttctgccgccgacaacagcatcatgacaaaagggcaaaaagtgtacgaatccaactgcatcgcctgccacggcaagaaaggggaagggcgcggcactgcgtttcctccgcttttccggtcggactgtattatgaacaaaccgcacgtcctgctgcacagcatggtcaaaggcatcgacgggacattcaaagtggagcggcaaaacctacgacggatttatgcccgcaaccgccatcagcgatgcggacattgccgccgtcgccacttatatcatgaacgcctttga

SEQ ID NO: 38 - protein, 113 aa, Neisseria gonorrhoeae
MNTTRLPTAFILCCLCAAASAADNSIMTKGQKVYESNCIACHGKKGEGRGTAFPPLFRSDCIMNKPHVLLHSMVKGIDGTFKVERQNLRRIYARNRHQRCGHCRRRHLYHERL

SEQ ID NO: 39 - DNA, 341 bp, Neisseria meningitidis
atgaacacaacccgactgccgaccgccctcgtcttgggctgcttctgcgccgccgcttctgccgccgacaacagcatcatgacaaaagggcaaaaagtgtacgaatccaactgcgtcgcctgccacggcaaaaagggcgaaggccgcggaaccatgtttccgccgctctaccgctccgacttcatcatgaaaaaaccgcaggtgctgctgcacagcatggtcaaaggcatcaacggtacaatcaaagtcaacggcaaaacctacaacggattcatgcccgcaaccgccatcagcgatgcggacattgccgccgtcgccacttatatcatgaacgcctttga

SEQ ID NO: 40 - protein, 113 aa, Neisseria meningitidis
  misc_feature (84)..(84): Xaa can be any naturally occurring amino acid
MNTTRLPTALVLGCFCAAASAADNSIMTKGQKVYESNCVACHGKKGEGRGTMFPPLYRSDFIMKKPQVLLHSMVKGINGTIKVXRQNLQRIHARNRHQRCGHCRRRHLYHERL

SEQ ID NO: 41 - DNA, 341 bp, Neisseria meningitidis
atgaacacaacccgactgccgaccgccctcgtcttgggctgcctctgcgccgccgcttctgccgccgacaacagcatcatgacaaaagggcaaaaagtgtacgaatccaactgcgtcgcctgccacggcaaaaagggcgaaggccgcggaaccatgtttccgccgctctaccgctccgacttcatcatgaaaaaaccgcaggtgctgctgcacagcatggtcaaaggcatcaacggtacaatcaaagtcaacggcaaaacctacaacggattcatgcccgccactgccatcagcgatgcggacattgccgccgtcgccacttatatcatgaacgcctttga

SEQ ID NO: 42 - DNA, 341 bp, Neisseria meningitidis; identical to SEQ ID NO: 41

SEQ ID NO: 43 - DNA, 399 bp, Neisseria gonorrhoeae
atgaacacaacccgactgccgaccgccttcatcttgtgctgcctctgcgccgccgcttctgccgccgacaacagcatcatgacaaaagggcaaaaagtgtacgaatccaactgcatcgcctgccacggcaagaaaggggaagggcgcggcactgcgtttcctccgcttttccggtcggactatattatgaacaaaccgcacgtcctgctgcacagcatggtcaaaggcatcaacggtacaatcaaagtcaacggcaaaacctacaacggattcatgcccgcaaccgccatcagcgatgcggacattgccgccgtcgccacttatatcatgaacgcctttgacaacggcggcggaagcgttaccgaaaaagacgtaaaacaggcaaaaggcaaaaaaaac

SEQ ID NO: 44 - protein, 133 aa, Neisseria gonorrhoeae
MNTTRLPTAFILCCLCAAASAADNSIMTKGQKVYESNCIACHGKKGEGRGTAFPPLFRSDYIMNKPHVLLHSMVKGINGTIKVNGKTYNGFMPATAISDADIAAVATYIMNAFDNGGGSVTEKDVKQAKGKKN

SEQ ID NO: 45 - DNA, 402 bp, Neisseria meningitidis
atgaacacaacccgactgccgaccgccctcgtcttgggctgcttctgcgccgccgcttctgccgccgacaacagcatcatgacaaaagggcaaaaagtgtacgaatccaactgcgtcgcctgccacggcaaaaagggcgaaggccgcggaaccatgtttccgccgctctaccgctccgacttcatcatgaaaaaaccgcaggtgctgctgcacagcatggtcaaaggcatcaacggtacaatcaaagtcaacggcaaaacctacaacggattcatgcccgcaaccgccatcagcgatgcggacattgccgccgtcgccacttatatcatgaacgcctttgacaacggcggcggaagcgttaccgaaaaagacgtaaaacaggcaaaaagcaaaaaaaactaa

SEQ ID NO: 46 - protein, 133 aa, Neisseria meningitidis
MNTTRLPTALVLGCFCAAASAADNSIMTKGQKVYESNCVACHGKKGEGRGTMFPPLYRSDFIMKKPQVLLHSMVKGINGTIKVNGKTYNGFMPATAISDADIAAVATYIMNAFDNGGGSVTEKDVKQAKSKKN

SEQ ID NO: 47 - DNA, 396 bp, Neisseria meningitidis
atgaacacaacccgactgccgaccgccctcgtcttgggctgcctctgcgccgccgcttctgccgccgacaacagcatcatgacaaaagggcaaaaagtgtacgaatccaactgcgtcgcctgccacggcaaaaagggcgaaggccgcggaaccatgtttccgccgctctaccgctccgacttcatcatgaaaaaaccgcaggtgctgctgcacagcatggtcaaaggcatcaacggtacaatcaaagtcaacggcaaaacctacaacggattcatgcccgccactgccatcagcgatgcggacattgccgccgtcgccacttatatcatgaacgcctttgacaacggcggcggaagcgttaccgaaaaagacgtaaaacaggcaaaaaacaaaaaa

SEQ ID NO: 48 - protein, 132 aa, Neisseria meningitidis
MNTTRLPTALVLGCLCAAASAADNSIMTKGQKVYESNCVACHGKKGEGRGTMFPPLYRSDFIMKKPQVLLHSMVKGINGTIKVNGKTYNGFMPATAISDADIAAVATYIMNAFDNGGGSVTEKDVKQAKNKK

SEQ ID NO: 49 - DNA, 495 bp, Neisseria gonorrhoeae
atgaacaacagacattttgccgtcatcgccttgggcagcaaccttgacaaccccgcacaacaaatacgcggcgcattagacgcgctctcgtcccatcctgacatccggcttgaacaggtttcctcactgtatatgaccgcacctgtcggttacgacaatcagcccgatttcatcaatgccgtctgcaccgtttccaccaccttggacggcattgccctgcttgccgaactcaaccgtatcgaagccgatttcggacgcgaacgcagtttccgcaatgcaccgcgcacattggatttggacattatcgactttgacggcatctccagcgacgacccccgccttaccctgccgcatccgcgcgcgcacgaacgcagtttcgtcatacgccctttggcagaaatcctccctgattttattttgggaaaatacggaaaggttgtcgaattgtcaaaacggctgggcaatcaaggcatccgtcttttaccggacaggtaa

SEQ ID NO: 50 - protein, 164 aa, Neisseria gonorrhoeae
MNNRHFAVIALGSNLDNPAQQIRGALDALSSHPDIRLEQVSSLYMTAPVGYDNQPDFINAVCTVSTTLDGIALLAELNRIEADFGRERSFRNAPRTLDLDIIDFDGISSDDPRLTLPHPRAHERSFVIRPLAEILPDFILGKYGKVVELSKRLGNQGIRLLPDR

SEQ ID NO: 51 - DNA, 497 bp, Neisseria meningitidis
atgaacaacagacattttgccgtcatcgccctgggcagtaatcttgaaaaccctgctcaacaggtacgcgccgcattggacacgctgtcgtcccatcctgacatccgtcttaaacaggcttcctcactgtatatgaccgcgcccgtcggttacgacaatcagcccgattttgtcaatgccgtctgcaccgtttccaccactctggacggcattgccytgcttgccgaactcaaccgtatcgaggctgatttcggacgcgaacgcagcttccgcaacgcgccgcgcacattgkatttggacattatcgactttgacggcatctccagcgacgacacscgactcaccttgccgcatccgcgcgcgcacgaacgcagtttcgtcatccgccctttggcagaaatcctccctgattttgttttaggaaaacacggaaaggttgccgaattgtcaaaacggytgggcaatcaaggtatccgtcttttaccggacaggtaatt

SEQ ID NO: 52 - protein, 164 aa, Neisseria meningitidis
  misc_feature (98)..(98): Xaa can be any naturally occurring amino acid
MNNRHFAVIALGSNLENPAQQVRAALDTLSSHPDIRLKQASSLYMTAPVGYDNQPDFVNAVCTVSTTLDGIALLAELNRIEADFGRERSFRNAPRTLXLDIIDFDGISSDDTRLTLPHPRAHERSFVIRPLAEILPDFVLGKHGKVAELSKRLGNQGIRLLPDR

SEQ ID NO: 53 - DNA, 495 bp, Neisseria meningitidis
atgaacaacagacattttgccgtcatcgccctgggcagtaatcttgaaaaccctgcccaacaggtacgcgccgcattggacacgctgtcgtcccatcctgacatccgtcttaaacaggcttcctcactgtatatgaccgcgcccgtcggttacgacaatcagcccgatttcgtcaatgccgtctgcaccgtttccaccaccttggacggcattgccctgcttgccgaactcaaccgtatcgaagccgatttcggacgcgaacgcagcttccgcaacgcgccgcgcacattggatttggacattatcgactttgacggcatctccagcgacgacccccgactcaccctgccgcatccgcgcgcgcacgaacgcagtttcgtcatacgccctttggcagaaatcctccctgattttattttgggaaaacacggaaaggttgccgaattgtcaaaacggctgggcaatcaaggcatccgtcttttaccggataagtaa

SEQ ID NO: 54 - protein, 164 aa, Neisseria meningitidis
MNNRHFAVIALGSNLENPAQQVRAALDTLSSHPDIRLKQASSLYMTAPVGYDNQPDFVNAVCTVSTTLDGIALLAELNRIEADFGRERSFRNAPRTLDLDIIDFDGISSDDPRLTLPHPRAHERSFVIRPLAEILPDFILGKHGKVAELSKRLGNQGIRLLPDK

SEQ ID NO: 55 - DNA, 261 bp, Neisseria gonorrhoeae
atgccccgcgctgccgtagcctttgagcgtcatcatcacaaaagcaaagccgaacaaaatacccatcgccgcgccgacgcagagatagccgaaggcttcgcggttggaaatcagcacacgcaggcgcgaaaccagtccgtaatggcggtacagctgccgctcgtcgccttttcggataaagtggttgtcgcgttccaagctgttgttcaggcggaaatacaggttttcgctgatggcggcaaaacgtggcaaaagccataa

SEQ ID NO: 56 - protein, 86 aa, Neisseria gonorrhoeae
MPRAAVAFERHHHKSKAEQNTHRRADAEIAEGFAVGNQHTQARNQSVMAVQLPLVAFSDKVVVAFQAVVQAEIQVFADGGKTWQKP

SEQ ID NO: 57 - DNA, 261 bp, Neisseria meningitidis
atgccccgcgctgctgtagcctttgagcgtcatcatcacaaaagcaaagccgaacaaaatacccatcgccgtgccgacgcagagatagccgaaggcttcgcggttggaaatcagcacacgcaggcgcgcaagcagtccgtaatggcggtacagctgccgccggtcgccttttcggataaagtggttgtcgcgttccaagctgttgttcaggcggaaatacaggttttcgctgatggcggcaaaacgtggcaaaagccataa

SEQ ID NO: 58 - protein, 86 aa, Neisseria meningitidis
MPRAAVAFERHHHKSKAEQNTHRRADAEIAEGFAVGNQHTQARKQSVMAVQLPPVAFSDKVVVAFQAVVQAEIQVFADGGKTWQKP

SEQ ID NO: 59 - DNA, 261 bp, Neisseria meningitidis
atgccccgcgctgctgtagcctttgagcgtcatcatcacaaaagcaaagccgaacaaaatacccatcgccgtgccgacgcagagatagccgaaggcttcgcggttggaaatcagcacacgcaggcgcgcaagcagtccgtaatggcggtccagctgccgctcgtcgccttttcggataaagtggttgtcgcgttccaagctgttcttcaggcggaaatacaggttttcgctgatggcggcaaaacgtggcaaaagccataa

SEQ ID NO: 60 - protein, 86 aa, Neisseria meningitidis
MPRAAVAFERHHHKSKAEQNTHRRADAEIAEGFAVGNQHTQARKQSVMAVQLPLVAFSDKVVVAFQAVLQAEIQVFADGGKTWQKP

SEQ ID NO: 61 - DNA, 1248 bp, Neisseria gonorrhoeae
atgggttttcctgttcgcaagtttgatgccgtgattgtcggcggtggcggtgcaggtttacgtgcagccctccaattatccaaatccggtttgaattgtgccgttttgtctaaagtgttcccgacccgctcgcataccgtagcggcgcagggcggtatttccgcctctctgggtaatgtgcaggaggaccgttgggactggcacatgtacgataccgtgaaaggttccgactggctgggcgaccaagatgcgattgagtttatgtgtcgcgctgcgcctgaagcggtgattgagttggaacacatgggtatgccttttgaccgcgttgaaagcggcaaaatttatcagcgtcctttcggcggacatactgccgaacatggtaaacgtgcggtagaacgtgcatgtgcggttgccgaccgtaccggtcatgcgatgttgcatactttgtaccaacaaaacgtccgtgccaatacacaattctttgtggaatggacggcgcaagatttgattcgtgatgaaaacggcgatgtcgtcggcgtaaccgccatggaaatggaaacgggcgaagtttatattttccacgccaaggccgtgatgtttgctaccggtggcggcggtcgtatttatgcttcttctaccaatgcttatatgaataccggtgacggtttgggcatttgcgcccgtgcgggcattccgttggaagatatggaattctggcaattccacccgaccggcgtggcgggtgcgggcgtgttgattaccgaaggcgtacgcggcgagggcggtattctgttgaacgccgacggcgaacgctttatggaacgctatgcgccgaccgtaaaagacttggcttctcgcgacgtggtttcacgcgcgatggcgatggaaatctatgaaggtcgcggctgtggtaaaaacaaagaccacgtcttactgaaaatcgaccatatcggtgcagaaaaaattatggaaaaactgccgggcatccgcgagatttccattcagtttgccggtatcgatccgattaaagacccgattccggttgtgccgactacccactatatgatgggcggcattccgaccaattatcacggtgaagttgttgttccgcaaggcgacgagtacgaagtacctgtaaaaggcctgtatgccgcaggtgagtgcgcctgtgcttccgtacacggtgcgaaccgtttgggtacgaactccctgctggacttggtggtgttccgcccaaccccccggtga

SEQ ID NO: 62 - protein, 415 aa, Neisseria gonorrhoeae
MGFPVRKFDAVIVGGGGAGLRAALQLSKSGLNCAVLSKVFPTRSHTVAAQGGISASLGNVQEDRWDWHMYDTVKGSDWLGDQDAIEFMCRAAPEAVIELEHMGMPFDRVESGKIYQRPFGGHTAEHGKRAVERACAVADRTGHAMLHTLYQQNVRANTQFFVEWTAQDLIRDENGDVVGVTAMEMETGEVYIFHAKAVMFATGGGGRIYASSTNAYMNTGDGLGICARAGIPLEDMEFWQFHPTGVAGAGVLITEGVRGEGGILLNADGERFMERYAPTVKDLASRDVVSRAMAMEIYEGRGCGKNKDHVLLKIDHIGAEKIMEKLPGIREISIQFAGIDPIKDPIPVVPTTHYMMGGIPTNYHGEVVVPQGDEYEVPVKGLYAAGECACASVHGANRLGTNSLLDLVVFRPTPR

SEQ ID NO: 63 - DNA, 696 bp, Neisseria meningitidis
  misc_feature (1)..(1): n is a, c, g, or t
  misc_feature (100)..(100): n is a, c, g, or t
ntccaattatccaaatccggtctgaattgtgccgttttgtctaaagtgttcccgacccgttcgcataccgtagcggcgcagggcggtatttccgcctctntgggtaatgtgcaggaagaccgttgggactggcacatgtacgataccgtgaaaggttccgactggttgggcgaccaagatgcgattgagtttatgtgccgcgccgcgcctgaagccgtaattgagttggaacacatgggtatgccttttgaccgtgtggaaagcggtaaaatttatcagcgtcctttcggcggccatactgccgaacacggtaaacgcgcggtagaacgcgyctgtgcggttgccgaccgtacaggtcatgcgatgctgcatactttgtaccaacaaaacgtccgtgccaatacgcaattctttgtggaatggacggcacaagatttgattcgtgatgaaaacggcgatgtcgtcggcgtaaccgccatggaaatggaaaccggcgaagtttatattttccacgctaaagctgtgatgtttgctaccggcggcggcggtcgtatttatgcgtcttctaccaatgcctatatgaataccggcgatggtttgggtatttgtgcgcgtgcaggtatcccgttggaagacatggaattctggcaattccagccgaccggcgtggcgggtgcgggcgtgttgattaccgaa

SEQ ID NO: 64 - protein, 202 aa, Neisseria meningitidis
  misc_feature (1)..(1): Xaa can be any naturally occurring amino acid
  misc_feature (34)..(34): Xaa can be any naturally occurring amino acid
XQLSKSGLNCAVLSKVFPTRSHTVAAQGGISASXGNVQEDRWDWHMYDTVKGSDWLGDQDAIEFMCRAAPEAVIELEHMGMPFDRVESGKIYQRPFCAVADRTGHAMLHTLYQQNVRANTQFFVEWTAQDLIRDENGDVVGVTAMEMETGEVYIFHAKAVMFATGGGGRIYASSTNGIPLEDMEFWQFQPTGVAGAGVLITE

SEQ ID NO: 65 - DNA, 1764 bp, Neisseria meningitidis
  misc_feature (67)..(67): n is a, c, g, or t
  misc_feature (408)..(408): n is a, c, g, or t
atgggctttcctgttcgcaagtttgatgccgtgattgtcggcggtggtggtgcaggtttacgcgcanccctccaattatccaaatccggtctgaattgtgccgttttgtctaaagtgttcccgacccgttcgcataccgtagcggcgcagggcggtatttccgcctctctgggtaatgtgcaggaagaccgttgggactggcacatgtacgataccgtgaaaggttccgactggttgggcgaccaagatgcgattgagtttatgtgccgcgccgcgcctgaagccgtaattgagttggaacacatgggtatgccttttgaccgtgtggaaagcggtaaaatttatcagcgtcctttcggcggccatactgccgaacacggtaaacgcgcggtagaacgcgcctgtgcngttgccgaccgtacaggtcatgcgatgctgcatactttgtaccaacaaaatgtccgtgccaatacgcaattctttgtggaatggacggcacaagatttgattcgtgatgaaaacggcgatgtcgtcggcgtaaccgccatggaaatggaaaccggcgaagtttatattttccacgctaaagctgtgatgtttgctaccggcggcggcggccgtatttatgcgtcttctaccaatgcctatatgaataccggcgatggtttgggtatttgtgcgcgtgcaggtatcccgttggaagacatggaattctggcaattccacccgaccggcgtggcaggtgcgggcgtgttgattaccgaaggcgtacgcggcgagggcggtattctgttgaatgccgacggcgaacgctttatggaacgctatgcgccgaccgtaaaagacttggcttctcgcgacgttgtttcccgcgcgatggcgatggaaatctacgaaggtcgcggctgcggtaaaaacaaagaccatgtcttactgaaaatcgaccatatcggcgcagaaaaaattatggaaaaactgccgggcatccgcgagatttccattcagttcgccggtatcgatccgattaaagacccgattcccgttgtgccgactacccactatatgatgggcggtattccgaccaactaccatggcgaagttgtcgttcctcaaggcgacgaatacgaagtgcctgtaaaaggtctgtatgcggcaggtgagtgcgcctgtgcttccgtacacggtgcgaaccgcttgggtacgaactccctgctggacttagtggtattcggtaaagctgccggcgacagcatgattaaattcatcaaagagcaaagcgactggaaacctttgcctgctaatgccggcgaactgacccgccaacgtatcgagcgtttggacaatcaaactgatggtgaaaacgttgatgcattgcgccgcgaactgcaacgctccgtacaattgcacgccggcgtgttccgtactgatgagattctgagcaaaggcgttcgagaagtcatggcgattgccgagcgtgtgaaacgtaccgaaatcaaagacaagagcaaagtgtggaataccgcgcgtatcgaggctttggaattggataacctaattgaagtggcgaaagcgactttggtgtctgccgaagcacgtaaagaatcacgcggtgcgcacgcttcagacgaccatcctgagcgcgatgatgaaaactggatgaaacatacgctgtaccattcagatgccaataccttgtcctacaaaccggtgcacaccaagcctttgagcgtggaatacatcaaaccggccaagcgcgtttattga

SEQ ID NO: 66 - protein, 587 aa, Neisseria meningitidis
  misc_feature (23)..(23): Xaa can be any naturally occurring amino acid
MGFPVRKFDAVIVGGGGAGLRAXLQLSKSGLNCAVLSKVFPTRSHTVAAQGGISASLGNVQEDRWDWHMYDTVKGSDWLGDQDAIEFMCRAAPEAVIELEHMGMPFDRVESGKIYQRPFGGHTAEHGKRAVERACAVADRTGHAMLHTLYQQNVRANTQFFVEWTAQDLIRDENGDVVGVTAMEMETGEVYIFHAKAVMFATGGGGRIYASSTNAYMNTGDGLGICARAGIPLEDMEFWQFHPTGVAGAGVLITEGVRGEGGILLNADGERFMERYAPTVKDLASRDVVSRAMAMEIYEGRGCGKNKDHVLLKIDHIGAEKIMEKLPGIREISIQFAGIDPIKDPIPVVPTTHYMMGGIPTNYHGEVVVPQGDEYEVPVKGLYAAGECACASVHGANRLGTNSLLDLVVFGKAAGDSMIKFIKEQSDWKPLPANAGELTRQRIERLDNQTDGENVDALRRELQRSVQLHAGVFRTDEILSKGVREVMAIAERVKRTEIKDKSKVWNTARIEALELDNLIEVAKATLVSAEARKESRGAHASDDHPERDDENWMKHTLYHSDANTLSYKPVHTKPLSVEYIKPAKRVY

SEQ ID NO: 67 - DNA, 1248 bp, Neisseria gonorrhoeae; identical to SEQ ID NO: 61

SEQ ID NO: 68 - protein, 415 aa, Neisseria gonorrhoeae; identical to SEQ ID NO: 62

SEQ ID NO: 69 - DNA, 1767 bp, Neisseria meningitidis
atgggttttcctgttcgcaagtttgatgccgtgattgtcggcggtggtggtgcaggtttacgcgcagccctccaattatccaaatccggtctgaattgtgccgttttgtctaaagtgttcccgacccgttcgcataccgtagcggcgcagggcggtatttccgcctctctgggtaatgtgcaggaagaccgttgggactggcacatgtacgataccgtgaaaggttccgactggttgggcgaccaagatgcgattgagtttatgtgccgcgccgcgcctgaagccgtaattgagttggaacacatgggtatgccttttgaccgtgtggaaagcggtaaaatttatcagcgtcctttcggcggccatactgccgaacacggtaaacgcgcggtagaacgcgcctgtgcggttgccgaccgtacaggtcatgcgatgctgcatactttgtaccaacaaaacgtccgtgccaatacgcaattctttgtggaatggacggcacaagatttgattcgtgatgaaaacggcgatgtcgtcggcgtaaccgccatggaaatggaaaccggcgaagtttatattttccacgctaaagctgtgatgtttgctaccggcggcggcggtcgtatttatgcgtcttctaccaatgcctatatgaataccggcgatggtttgggtatttgtgcgcgtgcaggtatcccgttggaagacatggaattctggcaattccacccgaccggcgtggcgggtgcgggcgtgttgattaccgaaggcgtacgcggcgagggcggtattctgttgaatgccgacggcgaacgctttatggaacgctatgcgccgaccgtaaaagacttggcttctcgcgacgttgtttcccgcgcgatggcgatggaaatctacgaaggtcgcggctgcggtaaaaacaaagaccatgtcttactgaaaatcgaccatatcggcgcagaaaaaattatggaaaaactgccgggcatccgcgagatttccattcagttcgccggtatcgatccgattaaagacccgattcccgttgtgccgactacccactatatgatgggcggcattccgaccaattaccacggcgaagttgtcgttccgcaaggtgaagattacgaagtgcctgtaaaaggtctgtatgcggcaggtgagtgcgcttgtgcttccgtacacggtgcgaaccgcttgggtaccaactccctgttggacttggtggtattcggtaaagctgccggcgacagcatgattaaattcatcaaagagcaaagcgactggaaacctttgcctgctaatgcaggtgagttgacccgccaacgtatcgagcgtttggacaaccaaaccgatggtgaaaacgttgatgcattgcgtcgcgaactgcaacgctctgtacaactgcacgccggcgtgttccgtactgatgagattctgagcaaaggcgttcgagaagtcatggcgattgccgagcgtgtgaaacgtaccgaaatcaaagacaagagcaaagtgtggaataccgcgcgtatcgaggctttggaattggataacctgattgaagtggcgaaagcgactttggtgtctgccgaagcacgtaaagaatcacgcggtgcgcacgcttcagacgaccatcctgagcgcgatgatgaaaactggatgaaacatacgctgtaccattcagatatcaataccttgtcctacaaaccggtgcacaccaagcctttgagcgtggaatacatcaaaccggccaagcgcgtttattgatga

SEQ ID NO: 70 - protein, 587 aa, Neisseria meningitidis
MGFPVRKFDAVIVGGGGAGLRAALQLSKSGLNCAVLSKVFPTRSHTVAAQGGISASLGNVQEDRWDWHMYDTVKGSDWLGDQDAIEFMCRAAPEAVIELEHMGMPFDRVESGKIYQRPFGGHTAEHGKRAVERACAVADRTGHAMLHTLYQQNVRANTQFFVEWTAQDLIRDENGDVVGVTAMEMETGEVYIFHAKAVMFATGGGGRIYASSTNAYMNTGDGLGICARAGIPLEDMEFWQFHPTGVAGAGVLITEGVRGEGGILLNADGERFMERYAPTVKDLASRDVVSRAMAMEIYEGRGCGKNKDHVLLKIDHIGAEKIMEKLPGIREISIQFAGIDPIKDPIPVVPTTHYMMGGIPTNYHGEVVVPQGEDYEVPVKGLYAAGECACASVHGANRLGTNSLLDLVVFGKAAGDSMIKFIKEQSDWKPLPANAGELTRQRIERLDNQTDGENVDALRRELQRSVQLHAGVFRTDEILSKGVREVMAIAERVKRTEIKDKSKVWNTARIEALELDNLIEVAKATLVSAEARKESRGAHASDDHPERDDENWMKHTLYHSDINTLSYKPVHTKPLSVEYIKPAKRVY

SEQ ID NO: 71 - DNA, 1764 bp, Neisseria meningitidis; identical to SEQ ID NO: 65
  misc_feature (67)..(67): n is a, c, g, or t
  misc_feature (408)..(408): n is a, c, g, or t

SEQ ID NO: 72 - protein, 587 aa, Neisseria meningitidis; identical to SEQ ID NO: 66
  misc_feature (23)..(23): Xaa can be any naturally occurring amino acid

SEQ ID NO: 73 - DNA, 543 bp, Neisseria gonorrhoeae
atgaagacacaccgcaagacctgctctgcggtgtgttttgcttttcagacggcatcgaaacccgccgtttccatccgacatcccagcgaggacatcatgagcctgaaaacccgccttaccgaagatatgaaaaccgcgatgcgcgccaaagatcaagtttccctcggcaccatccgcctcatcaatgccgccgtcaaacagtttgaagtagacgaacgcaccgaagccgacgatgccaaaatcaccgccatcctgaccaaaatggtcaaacagcgcaaagacggcgcgaaaatctacactgaagccggccgtcaggatttggcagacaaagaaaacgccgaaatcgacgtgctgcaccgctacctgccgcaaatgctctccgccggcgaaatccgcaccgccgtcgaagcagccgttgccgaaaccggcgcggcaggtatggcggatatgggcaaagtgatggtcgtattgaaaacccgcctcgccggcaaagccgatatgggcgaagtcaacaaaatcttgaaaaccgtactgaccgcctga

SEQ ID NO: 74 - protein, 180 aa, Neisseria gonorrhoeae
MKTHRKTCSAVCFAFQTASKPAVSIRHPSEDIMSLKTRLTEDMKTAMRAKDQVSLGTIRLINAAVKQFEVDERTEADDAKITAILTKMVKQRKDGAKIYTEAGRQDLADKENAEIDVLHRYLPQMLSAGEIRTAVEAAVAETGAAGMADMGKVMVVLKTRLAGKADMGEVNKILKTVLTA

SEQ ID NO: 75 - DNA, 497 bp, Neisseria meningitidis
atgaggacacaccgcaagacctgctctgcggtgtgttttgcttttcagacggcatcgaaacccgccgtttccatccgacatcccagcgaggacatcatgagcctgaaaatccgccttaccgaagacatgaaaaccgcgatgcgcgccaaagaccaagtttccctcggcaccatccgcctcatcaacgccgccgtcaaacagtttgaagtggacgaacgcaccgaagccgacgatgccaaaatcaccgccatcctgaccaaaatggtcaaacagcgaaaagacagcgcgaaaatctacactgaagccggccgtcaggatttggcagacaaagaaaacgccgaaatcgaggtactgcaccgctaccttccccaaatgctttccgccggcgaaatccgtaccgaggtcgaagctgccgttgccgaaaccggcgcggcaggtatggcggatatgggtaaagtcatggggctgctgaaaacccgcctcgcaggtaaagccga

SEQ ID NO: 76 - protein, 165 aa, Neisseria meningitidis
MRTHRKTCSAVCFAFQTASKPAVSIRHPSEDIMSLKIRLTEDMKTAMRAKDQVSLGTIRLINAAVKQFEVDERTEADDAKITAILTKMVKQRKDSAKIYTEAGRQDLADKENAEIEVLHRYLPQMLSAGEIRTEVEAAVAETGAAGMADMGKVMGLLKTRLAGKA

SEQ ID NO: 77 - DNA, 657 bp, Neisseria gonorrhoeae
atgctcgcccgtcgctattttttcaatatccaacccggggcggttttcactgacaaactgcttgaacaactgatgcgtttcctccagttcctgccggaatttctgtttgcccttttccgtattttcacccataaaagtaaccgtgcgcttaaattcgcccgccgtcatcacatccacatcaatatcatgttttttcaacaggcggtggatattcggcacttccgccaccacacccaccgaaccgatgaccgcaaacggagcggaaacaattttatccgccacacacgccatcatatagccgccgcttgccgcgaccttatcgacggcgacggtcagcggaatattgcgttcgcgcaaacgcctaagctgcgaagccgccaaaccgtaaccgtgaaccacgccgcccggactttccaatctgagcagaacctcatcttcaggcttggcaatcaaaagcaccgccgtaatctcatgacgcaaggattctacggcgtgtgcatacaaatcgccgtcaaaatccaacacaaaaaggcgggatttttgcgtttcggcagatttctccccgccctccttcaaacgctttttctctgctttggcttccgccttttcctttttcttttcttttttttcctgatgttttgtctcttcctcgcttaa

SEQ ID NO: 78 - protein, 218 aa, Neisseria gonorrhoeae
MLARRYFFNIQPGAVFTDKLLEQLMRFLQFLPEFLFALFRIFTHKSNRALKFARRHHIHINIMFFQQAVDIRHFRHHTHRTDDRKRSGNNFIRHTRHHIAAACRDLIDGDGQRNIAFAQTPKLRSRQTVTVNHAARTFQSEQNLIFRLGNQKHRRNLMTQGFYGVCIQIAVKIQHKKAGFLRFGRFLPALLQTLFLCFGFRLFLFLFFFFLMFCLFLA

SEQ ID NO: 79 - DNA, 657 bp, Neisseria meningitidis
  misc_feature (310)..(519): n is a, c, g, or t
  misc_feature (541)..(541): n is a, c, g, or t
atgctcgcccgttgccacttcctcaatatccaattgagggcggttctcgctgacaaactgcttgaacaactgatgcgtttcctccagttcctgtcggaatttctgtttgcccttttccgtattttcacccataaaagtaaccgtgcgcttaaattcgcccgccgtcatcacatccacatcaatatcatgttttttcaacaggcggtggatattcggtacttccgccaccacacccaccgaaccgacaatcgcaaacggagcggaagcaattttatccgccacacacgccatcatataaccgccgctcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacacaaaaaggcgtgatttntgcgtttcggcagatttctccccaccctccttcaaacgtttttcctctgctttggcttccgccttttcctttttcttttcctctttttcctgatgttgtgcctcttccccgcttaa

SEQ ID NO: 80 - protein, 217 aa, Neisseria meningitidis
  misc_feature (104)..(173): Xaa can be any naturally occurring amino acid
  misc_feature (180)..(180): Xaa can be any naturally occurring amino acid
MLARCHFLNIQLRAVLADKLLEQLMRFLQFLSEFLFALFRIFTHKSNRALKFARRHHIHINIMFFQQAVDIRYFRHHTHRTDNRKRSGSNFIRHTRHHITAARXXXXXXXXXXXXXXXXXXXXXXXXXXXXXXXXXXXXXXXXXXXXXXXXXXXXXXXXXXXXXXXXXXXXXXQHKKAFXRFGRFLPTLLQTFFLCFGFRLFLFLFLFFLMLCLFPA

SEQ ID NO: 81 - DNA, 657 bp, Neisseria meningitidis
atgctcgcccgttgccacttcctcaatatccaattgagggcggttctcgctgacaaactgcttgaacaactgatgcgtttcctccagttcctgtcggaatttctgtttgcccttttccgtattttcacccataaaagtaaccgtgcgcttaaattcgcccgccgtcatcacatccacatcaatatcatgttttttcaacaggcggtggatattcggtacttccgctacaacacccaccgaaccgacaatcgcaaacggagcggaaacaattttatccgccacacacgccatcatataaccaccgctcgccgccaccttatcgacggcgacggtcagcggaatattgcgttcgcgcaaacgcctaagctgcgaagccgccaaaccgtaaccgtgaaccacgccgcccggactttccaatctaagcagaacctcatcttcaggcttggcaatcaaaagcaccgccgtaatctcatgacgcaaggattctacggcgtgtgcatacaaatcgccgtcaaaatccaacacaaaaaggcgggatttttgcgtttcggaagatttctccccaccctccttcaaacgctttttctctgctttggcttccgccttttcctttttcttttcctctttttcctgatgttttgcctcttccccgcttaa

SEQ ID NO: 82 - protein, 218 aa, Neisseria meningitidis
MLARCHFLNIQLRAVLADKLLEQLMRFLQFLSEFLFALFRIFTHKSNRALKFARRHHIHINIMFFQQAVDIRYFRYNTHRTDNRKRSGNNFIRHTRHHITTARRHLIDGDGQRNIAFAQTPKLRSRQTVTVNHAARTFQSKQNLIFRLGNQKHRRNLMTQGFYGVCIQIAVKIQHKKAGFLRFGRFLPTLLQTLFLCFGFRLFLFLFLFFLMFCLFPA

SEQ ID NO: 83 - DNA, 657 bp, Neisseria meningitidis
atgctcgcccgttgccacttcctcaatatccaattgagggcggttctcgctgacaaactgcttgaacaactgatgcgtttcctccagttcctgtcggaatttctgtttgcccttttccgtattttcacccataaaagtaaccgtgcgcttaaattcgcccgccgtcatcacatccacatcaatatcatgttttttcaacaggcggtggatattcggtacttccgccaccacacccaccgaaccgacaatcgcaaacggagcggaagcaattttatccgccacacacgccatcatataaccgccgctcgccgccaccttatcgacggcgacggtcagcggaatattgcgttcgcgcaaacgcytaagctgcgaagccgccaaaccgtaaccgtgaaccacgccgcccggactttccaatctgagcagaacctcatcttcaggcttggcaatcaaaagcaccgccgtaatctcatgacgcaaggattctacggcgtgtgcatacaaatcgccgtcaaaatccaacacaaaaaggcgggatttttgcgtttcggcagatttctccccaccctccttcaaacgctttttctctgctttggcttccgccttttcctttttcttttcctctttttcctgatgttttgcctcttccccgcttaa

SEQ ID NO: 84 - protein, 218 aa, Neisseria meningitidis
  misc_feature (121)..(121): Xaa can be any naturally occurring amino acid
MLARCHFLNIQLRAVLADKLLEQLMRFLQFLSEFLFALFRIFTHKSNRALKFARRHHIHINIMFFQQAVDIRYFRHHTHRTDNRKRSGSNFIRHTRHHITAARRHLIDGDGQRNIAFAQTXKLRSRQTVTVNHAARTFQSEQNLIFRLGNQKHRRNLMTQGFYGVCIQIAVKIQHKKAGFLRFGRFLPTLLQTLFLCFGFRLFLFLFLFFLMFCLFPA

SEQ ID NO: 85 - DNA, 657 bp, Neisseria meningitidis; identical to SEQ ID NO: 81

SEQ ID NO: 86 - protein, 218 aa, Neisseria meningitidis; identical to SEQ ID NO: 82

SEQ ID NO: 87 - DNA, 318 bp, Neisseria gonorrhoeae
atgcctttgaccatgctgtgcagcaggacgtgcggtttgttcataatacagtccgaccggaaaagcggaggaaacgcagtgccgcgcccttcccctttcttgccgtggcaggcgatgcagttggattcgtacactttttgcccttttgtcatgatgctgttgtcggcggcagaagcggcggcgcagaggcagcacaagatgaaggcggtcggcagtcgggttgtgttcattggcgtttcccctaatgttttgaaaccttgttttttgattttgcctttacggggtgaaaagtttttttggcccaaatccggaatttag

SEQ ID NO: 88 - protein, 105 aa, Neisseria gonorrhoeae
MPLTMLCSRTCGLFIIQSDRKSGGNAVPRPSPFLPWQAMQLDSYTFCPFVMMLLSAAEAAAQRQHKMKAVGSRVVFIGVSPNVLKPCFLILPLRGEKFFWPKSGI

SEQ ID NO: 89 - DNA, 306 bp, Neisseria meningitidis
atgcctttgaccatgctgtgcagcagcacctgcggttttttcatgatgaagtcggagcggtagagcggcggaaacatggttccgcggccttcgccctttttgccgtggcaggcgacgcagttggattcgtacactttttgcccttttgtcatgatgctgttgtcggcggcagaagcggcggcgcagaagcagcccaagacgagggcggtcggcagtcgggttgtgttcattggtgtttccttcatgtttgaaaccttgttgttgattttgcgtagcgggtgaaagatttttttgccgaatcagtag

SEQ ID NO: 90 - protein, 101 aa, Neisseria meningitidis
  misc_feature (21)..(21): Xaa can be any naturally occurring amino acid
  misc_feature (94)..(94): Xaa can be any naturally occurring amino acid
MPLTMLCSSTCGFFMMKSERXSGGNMVPRPSPFLPWQATQLDSYTFCPFVMMLLSAAEAAAQKQPKTRAVGSRVVFIGVSFMFETLLLILRSGXKIFLPNQ

SEQ ID NO: 91 - DNA, 306 bp, Neisseria meningitidis
atgcctttgaccatgctgtgcagcagcacctgcggttttttcatgatgaagtcggagcggtagagcggcggaaacatggttccgcggccttcgccctttttgccgtggcaggcgacgcagttggattcgtacactttttgcccttttgtcatgatgctgttgtcggcggcagaagcggcggcgcagaggcagcccaagacgagggcggtcggcagtcgggttgtgttcattggtgtttccttaatgtttgaaaccttgttgttgattttgcgtagcgggtgaaagattttcttgccgaatcggtag

SEQ ID NO: 92 - protein, 99 aa, Neisseria meningitidis
MPLTMLCSSTCGFFMMKSERSGGNMVPRPSPFLPWQATQLDSYTFCPFVMMLLSAAEAAAQRQPKTRAVGSRVVFIGVSLMFETLLLILRSGKIFLPNR

SEQ ID NO: 93 - DNA, 375 bp, Neisseria gonorrhoeae
atgcagtatctgattgtcaaatacagccatcaaatcttcgttaccatcaccattttggtattcaacatccgttttttcctactttggaaaaatccagaaaagcccttggtcggcttttggaaagcactgccccacctcaacgacacgatgctgctgtttacgggattgtggctgatgaagattacccatttctccccgttcaacgcgccttggctcggcacaaaaatcctgctcctgttcgcctacatcgcactgggcatggtaatgatgcgcgcccgtccgcgttcgaccaagttctacaccgtttacctgctcgctatgtgttgcatcgcctgcatcgtttaccttgccaaaaccaaagtcctgccattctga

SEQ ID NO: 94 - protein, 124 aa, Neisseria gonorrhoeae
MQYLIVKYSHQIFVTITILVFNIRFFLLWKNPEKPLVGFWKALPHLNDTMLLFTGLWLMKITHFSPFNAPWLGTKILLLFAYIALGMVMMRARPRSTKFYTVYLLAMCCIACIVYLAKTKVLPF

SEQ ID NO: 95 - DNA, 285 bp, Neisseria meningitidis
aaaatcagaaaagccttggcgggcttttggaaggcactgccccaccttaacgacaccatgctgctgtttacgggattgtggctgatgaaaattacccatttctccccgttcaacgcgccttggctcggtacaaaaatcctgcttctgctcgcctatatcgcattgggtatgatgatgatgcgcgcccgtccgcgttcgaccaagttctacaccgtttacctgctcgccatgtgttgcgtcgcctgcatcgtttaccttgccaaaaccaaagtcctgcctttctga

SEQ ID NO: 96 - protein, 94 aa, Neisseria meningitidis
KIRKALAGFWKALPHLNDTMLLFTGLWLMKITHFSPFNAPWLGTKILLLLAYIALGMMMMRARPRSTKFYTVYLLAMCCVACIVYLAKTKVLPF

SEQ ID NO: 97 - DNA, 375 bp, Neisseria meningitidis
  misc_feature (79)..(79): n is a, c, g, or t
atgcagtatctgattgtcaaatacagccatcaaatcttcgttaccatcaccattttggtattcaacatccgtgttttcntactttggaaaaatccagaaaagcccttggcgggcttttggaaggcactgccccaccttaacgacaccatgctgctgtttacgggattgtggctgatgaaaattacccatttctccccgttcaacgcgccttggctcggtacaaaaatcctgcttctgctcgcctatatcgcattgggtatgatgatgatgcgcgcccgtccgcgttcgaccaagttctacaccgtttacctgctcgccatgtgttgcctcacctgcatcgtttaccttgccaaaaccaaagtcctgcctttctga

SEQ ID NO: 98 - protein, 124 aa, Neisseria meningitidis
  misc_feature (27)..(27): Xaa can be any naturally occurring amino acid
MQYLIVKYSHQIFVTITILVFNIRVFXLWKNPEKPLAGFWKALPHLNDTMLLFTGLWLMKITHFSPFNAPWLGTKILLLLAYIALGMMMMRARPRSTKFYTVYLLAMCCLTCIVYLAKTKVLPF

SEQ ID NO: 99 - DNA, 312 bp, Neisseria gonorrhoeae
atgcagcaggggcagttggttggacgcgtcgcccgcaataaagatatgcggaatgctggtctgcatggtcagcggatcggcaacgggtacgccgcgcgcgtctttgtcgatattgatgttttccaaaccgatattgtcaacgttcggacggcgacctacggctgccaacatatattcggcaacaaatacgcctttttcgccatcctgctcccaatggacttctacattgccgtctgcgtcgagtttgacctcggttttagcatccagatgcagtttcaattcttctccgaacacggctttcgcctcgtctga

SEQ ID NO: 100 - protein, 103 aa, Neisseria gonorrhoeae
MQQGQLVGRVARNKDMRNAGLHGQRIGNGYAARVFVDIDVFQTDIVNVRTATYGCQHIFGNKYAFFAILLPMDFYIAVCVEFDLGFSIQMQFQFFSEHGFRLV

SEQ ID NO: 101 - DNA, 312 bp, Neisseria meningitidis
atgcagcagaggcagttggttggacgcatcgcctgcgatgaagatatgcggaatactggtctgcatggtcagcgggtcggcaacaggtacgccgcgcgcatctttttcgatattgatattttccaaaccgatattgtcaacgttcggacggcggcccacggctgccagcatatattcggcaacaaatacgcctttttcgccatcctgctcccaatggacttctacattgccgtctgcatcgagtttgacctcggttttagcatccagatgcagtttcaattcttcgccgaacacggcgttcgcctcgtctga

SEQ ID NO: 102 - protein, 103 aa, Neisseria meningitidis
MQQRQLVGRIACDEDMRNTGLHGQRVGNRYAARIFFDIDIFQTDIVNVRTAAHGCQHIFGNKYAFFAILLPMDFYIAVCIEFDLGFSIQMQFQFFAEHGVRLV

SEQ ID NO: 103 - DNA, 312 bp, Neisseria meningitidis
atgcagcaggggcagttggttggacgcgtcgcccgcaataaagatatgcggaatactggtctgcatagtcagcggatcggcaacgggtacgccgcgcgcatctttttcgatattgatgttttccaaaccgatattgtcaacgttcggacggcggcctacggctgccagcatatattcggcaacaaatacgcctttttcgccatcctgctcccaatggacttctacattgccgtctgcgtcgagtttggcctcggttttagcatccaaatgcagtttcaattcttcaccgaacacggctttcgcctcgtctga

SEQ ID NO: 104 - protein, 103 aa, Neisseria meningitidis
MQQGQLVGRVARNKDMRNTGLHSQRIGNGYAARIFFDIDVFQTDIVNVRTAAYGCQHIFGNKYAFFAILLPMDFYIAVCVEFGLGFSIQMQFQFFTEHGFRLV

SEQ ID NO: 105 - DNA, 268 bp, Neisseria gonorrhoeae
ctgctggcggccctggtgcttgccgcgtgttcttcgacaaacacactgccagccggcaagaccccggcagacaatatagaaactgccgacctttcggcaagcgttcccacccgccctgccgaaccggaaggaaaaacgctggcagattacggcggctacccgtccgcactggatgcagtgaaacagaacaacgatgcggcagccgccgcctatttggaaaacgcaggagacagcgcgatggcggaaaatgtccgcaaggagtggctga

SEQ ID NO: 106 - protein, 89 aa, Neisseria gonorrhoeae
LLAALVLAACSSTNTLPAGKTPADNIETADLSASVPTRPAEPEGKTLADYGGYPSALDAVKQNNDAAAAAYLENAGDSAMAENVRKEWL

SEQ ID NO: 107 - DNA, 1572 bp, Neisseria meningitidis
atgtacctaccctctatgaagcattccctgccgctgctggcggccctggtgcttgccgcgtgttcttcgacaaacacactgccagccggcaagaccccggcagacaatatagaaactgccgacctttcggcaagcgttcccacccgccctgccgaacccgaaagaaaaacgctggcagattacggcggctacccgtccgcactggatgcagtgaaacagaaaaacgatgccgccgtcgccgcctatttggaaaacgccggcgacagcgcgatggcggaaaatgtccgcaacgagtggctgaagtctttgggcgcacgcagacagtggacgctgtttgcacaggaatacgccaaactcgaaccggcagggcgcgcccaagaagtcgaatgctacgccgattcgagccgcaacgactatacgcgtgccgctgaactggtcaaaaatacgggcaaactgccttcgggctgcaccaaactgttggaacaggcagccgcatccggcttgttggacggcaacgacgcctggaggcgcgtgcgcggactgctggccggccgccaaaccacagacgcacgcaaccttgccgccgcattgggcagcccgtttgacggcggtacacaaggttcgcgcgaatatgccctgttgaacgtcatcggcaaagaagcacgcaaatcgccgaatgccgccgccctgctgtccgaaatggaaagcggtttaagcctcgaacaacgcagtttcgcgtggggcgtattggggcattatcagtcgcaaaacctcaatgtgcctgccgccttggactattacggcaaggttgccgaccgccgccaactgaccgacgaccaaatcgagtggtacgcccgcgccgccttgcgcgcccgacgttgggacgagctggcctccgttatctcgcatatgcccgaaaaactgcaaaaaagcccgacctggctctactggctggcacgcagccgcgccgcaacgggcaacacgcaagaggcggaaaaactttacaaacaggcggcagcgacgggcaggaatttttatgcggtgctggcaggggaagaattgggtcggaaaatcgatacgcgcaacaatgtgcccgatgccggcaaaaacagcgtccgccgcatggcggaagacggtgcagtcaaacgcgcactggtactgttccaaaacagccaatctgccggtgatgcaaaaatgcgccgtcaggctcaggcggaatggcgttttgccacacgcggctttgacgaagacaagctgctgaccgccgcgcaaaccgcgttcgaccacggtttttacgatatggcggtcaacagcgcggaacgcaccgaccgcaaactcaactacaccttgcgctatatttcgccgtttaaagacacggtaatccgccacgcgcaaaatgttaatgtcgatccggcttgggtttatgggctgattcgtcaggaaagccgcttcgttataggcgcgcaatcccgcgtaggcgcgcaggggctgatgcaggttatgcctgccaccgcgcgcgaaatcgccggcaaaatcggtatggatgccgcacaactttacaccgccgacggg

SEQ ID NO: 108 - protein, 524 aa, Neisseria meningitidis
MYLPSMKHSLPLLAALVLAACSSTNTLPAGKTPADNIETADLSASVPTRPAEPERKTLADYGGYPSALDAVKQKNDAAVAAYLENAGDSAMAENVRNEWLKSLGARRQWTLFAQEYAKLEPAGRAQEVECYADSSRNDYTRAAELVKNTGKLPSGCTKLLEQAAASGLLDGNDAWRRVRGLLAGRQTTDARNLAAALGSPFDGGTQGSREYALLNVIGKEARKSPNAAALLSEMESGLSLEQRSFAWGVLGHYQSQNLNVPAALDYYGKVADRRQLTDDQIEWYARAALRARRWDELASVISHMPEKLQKSPTWLYWLARSRAATGNTQEAEKLYKQAAATGRNFYAVLAGEELGRKIDTRNNVPDAGKNSVRRMAEDGAVKRALVLFQNSQSAGDAKMRRQAQAEWRFATRGFDEDKLLTAAQTAFDHGFYDMAVNSAERTDRKLNYTLRYISPFKDTVIRHAQNVNVDPAWVYGLIRQESRFVIGAQSRVGAQGLMQVMPATAREIAGKIGMDAAQLYTADG

SEQ ID NO: 109 - DNA, 1851 bp, Neisseria meningitidis
  misc_feature (44)..(44): n is a, c, g, or t
  misc_feature (68)..(68): n is a, c, g, or t
  misc_feature (145)..(145): n is a, c, g, or t
  misc_feature (163)..(163): n is a, c, g, or t
  misc_feature (173)..(173): n is a, c, g, or t
  misc_feature (335)..(335): n is a, c, g, or t
  misc_feature (342)..(342): n is a, c, g, or t
  misc_feature (351)..(351): n is a, c, g, or t
  misc_feature (367)..(367): n is a, c, g, or t
  misc_feature (801)..(801): n is a, c, g, or t
  misc_feature (864)..(865): n is a, c, g, or t
  misc_feature (867)..(868): n is a, c, g, or t
  misc_feature (871)..(873): n is a, c, g, or t
  misc_feature (876)..(877): n is a, c, g, or t
  misc_feature (881)..(881): n is a, c, g, or t
  misc_feature (883)..(883): n is a, c, g, or t
  misc_feature (885)..(885): n is a, c, g, or t
  misc_feature (888)..(889): n is a, c, g, or t
  misc_feature (894)..(895): n is a, c, g, or t
  misc_feature (899)..(900): n is a, c, g, or t
  misc_feature (902)..(902): n is a, c, g, or t
  misc_feature (904)..(904): n is a, c, g, or t
  misc_feature (907)..(910): n is a, c, g, or t
  misc_feature (914)..(915): n is a, c, g, or t
  misc_feature (918)..(918): n is a, c, g, or t
  misc_feature (923)..(928): n is a, c, g, or t
  misc_feature (930)..(930): n is a, c, g, or t
  misc_feature (933)..(933): n is a, c, g, or t
  misc_feature (935)..(936): n is a, c, g, or t
  misc_feature (938)..(939): n is a, c, g, or t
  misc_feature (941)..(941): n is a, c, g, or t
  misc_feature (943)..(943): n is a, c, g, or t
  misc_feature (945)..(946): n is a, c, g, or t
  misc_feature (948)..(948): n is a, c, g, or t
  misc_feature (951)..(952): n is a, c, g, or t
  misc_feature (972)..(972): n is a, c, g, or t
  misc_feature (988)..(988): n is a, c, g, or t
  misc_feature (990)..(990): n is a, c, g, or t
  misc_feature (996)..(996): n is a, c, g, or t
  misc_feature (1002)..(1002): n is a, c, g, or t
  misc_feature (1021)..(1021): n is a, c, g, or t
  misc_feature (1028)..(1028): n is a, c, g, or t
  misc_feature (1041)..(1041): n is a, c, g, or t
  misc_feature (1048)..(1048): n is a, c, g, or t
  misc_feature (1050)..(1050): n is a, c, g, or t
  misc_feature (1070)..(1070): n is a, c, g, or t
  misc_feature (1109)..(1109): n is a, c, g, or t
  misc_feature (1205)..(1205): n is a, c, g, or t
  misc_feature (1363)..(1367): n is a, c, g, or t
  misc_feature (1369)..(1369): n is a, c, g, or t
  misc_feature (1371)..(1371): n is a, c, g, or t
atgtacccaccctctctgaagcattccctgccgctgctggtggncctggtgcttgccgcgtgttcttngacaaacacactgtcagccgacaagaccccggcagacaatatagaaactgccgacctttcggcaagcgttcccaccngccctgccgaacccgaangaaaaacgtnggcagattacggcggctacccgtccgcactggatgcagtgaaacagaaaaacgatgccgccgtcgccgcctatttggaaaacgccggcgacagcgcgatggcggaaaatgtccgcaacgagtggctgaagtctttgggcgcgcgcagacagtggacgctgtntgcacangaatatgcnaaactcgaaccggcanggcgcgcccaagaagtcgaatgctacgccgattcgagccgcaacgactatacgcgtgccgccgaactggtcaaaaatacgggcaaactgccttcgggctgcaccaaactgttggaacaggcagccgcatccggcttgttggacggcaacgacgcctggaggcgcgtgcgcggactgctggccggccgccaaaccacagacgcacgcaaccttgccgccgcattgggcagcccgtttgacggcggtacacaaggttcgcgcgaatatgccctgttgaacgtcatcggcaaagaagcacgcaaatcgccgaatgccgccgccctgctgtccgaaatggaaagcggtttaagcctcgaacaacgcagtttcgcgtggggcgtattggggcattatcagtcgcaaaacctcaatgtgcctgccgccttggactattanggcaaggttgccgaccgccgccaactgaccgacgaccaaatcgagtggtacgcccgcgccgcnntnngcnnncgnngttngnanganntggcnnccgnnancncgnnnntgcnnganaaacnnnnnnanagncnnanntngntnnantgnntggcacgcagccgcgccgcnacgggcaacacgcaanangcgganaaactntacaaacaggcggcagcancgggcangaatttttatgcngtgctgncnggggaagagttggggcgcanaatcgatacgcgcaacaatgtgcccgatgccggcaaaancagcgtcctccgtatggcggaagacggcgcgattaagcgcgcgctggtgctgttccgaaacagccgaaccgccggcgatgcgaaaatgcgccgtcnggctcaggcggaatggcgtttcgccacacgcggcttcgatgaagacaagctgctgaccgccgcgcaaaccgcgttcgaccacggtttttacgatatggcggtcaacagcgcggaacgcaccgaccgcaaactcaactacaccttgcgctacatttcgnnnnntnangacacggtaatccgccacgcgcaaaatgttaatgtcgatccggcgtgggtttacgggctgattcgtcaggaaagccgcttcgttatgggcgcgcaatcccgcgtaggcgcgcaggggctgatgcaggttatgcctgccaccgcgcgcgaaatcgccggcaaaatcggtatggatgccgcacaactttacaccgccgacggcaatatccgtatggggacgtggtatatggcggacaccaaacgccgcctgcaaaacaacgaagtcctcgccaccgcaggctataacgccggtcccggcagggcgcgccgatggcaggcggacacgcccctcgaaggcgcggtatatgccgaaaccatcccgttttccgaaacgcgcgactatgtcaaaaaagtgatggccaatgccgcctactacgcctccctcttcggcgcgccgcacatcccgctcaaacagcgtatgggcattgtccccgcccgctga

SEQ ID NO: 110 - protein, 616 aa, Neisseria meningitidis
  misc_feature (15)..(15): Xaa can be any naturally occurring amino acid
  misc_feature (23)..(23): Xaa can be any naturally occurring amino acid
  misc_feature (49)..(49): Xaa can be any naturally occurring amino acid
  misc_feature (55)..(55): Xaa can be any naturally occurring amino acid
  misc_feature (58)..(58): Xaa can be any naturally occurring amino acid
  misc_feature (112)..(112): Xaa can be any naturally occurring amino acid
  misc_feature (114)..(114): Xaa can be any naturally occurring amino acid
  misc_feature (123)..(123): Xaa can be any naturally occurring amino acid
  misc_feature (267)..(267): Xaa can be any naturally occurring amino acid
  misc_feature (289)..(291): Xaa can be any naturally occurring amino acid
  misc_feature (293)..(297): Xaa can be any naturally occurring amino acid
  misc_feature (299)..(306): Xaa can be any naturally occurring amino acid
  misc_feature (308)..(318): Xaa can be any naturally occurring amino acid
  misc_feature (330)..(330): Xaa can be any naturally occurring amino acid
  misc_feature (332)..(332): Xaa can be any naturally occurring amino acid
  misc_feature (341)..(341): Xaa can be any naturally occurring amino acid
  misc_feature (343)..(343): Xaa can be any naturally occurring amino acid
  misc_feature (350)..(350): Xaa can be any naturally occurring amino acid
  misc_feature (357)..(357): Xaa can be any naturally occurring amino acid
  misc_feature (370)..(370): Xaa can be any naturally occurring amino acid
  misc_feature (402)..(402): Xaa can be any naturally occurring amino acid
  misc_feature (455)..(457): Xaa can be any naturally occurring amino acid
MYPPSLKHSLPLLVXLVLAACSXTNTLSADKTPADNIETADLSASVPTXPAEPEXKTXADYGGYPSALDAVKQKNDAAVAAYLENAGDSAMAENVRNEWLKSLGARRQWTLXAXEYAKLEPAXRAQEVECYADSSRNDYTRAAELVKNTGKLPSGCTKLLEQAAASGLLDGNDAWRRVRGLLAGRQTTDARNLAAALGSPFDGGTQGSREYALLNVIGKEARKSPNAAALLSEMESGLSLEQRSFAWGVLGHYQSQNLNVPAALDYXGKVADRRQLTDDQIEWYARAAXXXRXXXXXAXXXXXXXXKXXXXXXXXXXXARSRAATGNTQXAXKLYKQAAAXGXNFYAVLXGEELGRXIDTRNNVPDAGKXSVLRMAEDGAIKRALVLFRNSRTAGDAKMRRXAQAEWRFATRGFDEDKLLTAAQTAFDHGFYDMAVNSAERTDRKLNYTLRYISXXXDTVIRHAQNVNVDPAWVYGLIRQESRFVMGAQSRVGAQGLMQVMPATAREIAGKIGMDAAQLYTADGNIRMGTWYMADTKRRLQNNEVLATAGYNAGPGRARRWQADTPLEGAVYAETIPFSETRDYVKKVMANAAYYASLFGAPHIPLKQRMGIVPAR

SEQ ID NO: 111 - DNA, 342 bp, Neisseria gonorrhoeae
atggtagaacgtaaattgaccggtgcccattacggtttgcgcgattgggtaatgcagcgtgcgactgcggttattatgttgatttataccgttgcacttttagtggttctatttgccctgcctaaagaatatccggcatggcaggcattttttagtcaagcttgggtaaaagtatttacccaagtgagctttatcgccgtattcttgcacgcttgggtgggtatccgcgatttgtggatggactatatcaaacccttcggcgtgcgtttgtttttgcaggttgccaccattgtctggctggtcggctgcctcgtgtattcagttaaagtgatttgggggtaa

SEQ ID NO: 112 - protein, 113 aa, Neisseria gonorrhoeae
MVERKLTGAHYGLRDWVMQRATAVIMLIYTVALLVVLFALPKEYPAWQAFFSQAWVKVFTQVSFIAVFLHAWVGIRDLWMDYIKPFGVRLFLQVATIVWLVGCLVYSVKVIWG

SEQ ID NO: 113 - DNA, 342 bp, Neisseria meningitidis
atggtagaacgtaaattgaccggtgcccattacggtttgcgcgattgggtgatgcaacgtgcgactgcggttattatgttgatttataccgttgcacttttagtggttctattttccctgcctaaagaatattcggcatggcaggcattttttagtcaaacttgggtaaaagtatttacccaagtgagcttcatcgccgtattcttgcacgcttgggtgggtatccgcgatttgtggatggactatatcaaacccttcggcgtgcgtttgtttttgcaggttgccaccatcgtttggctggtcggctgtctcgtgtattcagttaaagtgatttgggggtaa

SEQ ID NO: 114 - protein, 113 aa, Neisseria meningitidis
MVERKLTGAHYGLRDWVMQRATAVIMLIYTVALLVVLFSLPKEYSAWQAFFSQTWVKVFTQVSFIAVFLHAWVGIRDLWMDYIKPFGVRLFLQVATIVWLVGCLVYSVKVIWG

SEQ ID NO: 115 - DNA, 342 bp, Neisseria meningitidis
  misc_feature (249)..(249): n is a, c, g, or t
atggtagaacgtaaattgaccggtgcccattacggtttgcgggattgggcgatgcaacgtgcgaccgcggttattatgttgatttataccgttgcacttttagtggttctatttgctctgcctaaagaatattcggcatggcaggcattttttagtcaaacttgggtaaaagtatttacccaagtgagcttcatcgccgtattcttgcacgcttgggtgggtatccgcgatttgtggatggactatatnaaacccttcggcgtgcgtttgtttttgcaggttgccaccatcgtctggctggtcggctgcttggtgtattcaattaaagtaatttgggggtaa

SEQ ID NO: 116 - protein, 113 aa, Neisseria meningitidis
  misc_feature (83)..(83): Xaa can be any naturally occurring amino acid
MVERKLTGAHYGLRDWAMQRATAVIMLIYTVALLVVLFALPKEYSAWQAFFSQTWVKVFTQVSFIAVFLHAWVGIRDLWMDYXKPFGVRLFLQVATIVWLVGCLVYSIKVIWG

SEQ ID NO: 117 - DNA, 1014 bp, Neisseria meningitidis
atgttgaaacaaacgacacttttggcagcttgtaccgccgttgccgctctgttgggcggttgcgccacccaacagcctgctcctgtcattgcaggcaattcaggtatgcagaccgtatcgtctgcgccggtttacaatccttatggcgcaacgccgtacaatgccgctcctgccgccaacgatgcgccgtatgtgccgcccgtgcaaactgcgccggtttattcgcctcctgcttatgttccgccgtctgcacctgccgtttcgggtacatatgttccttcttacgcacccgtcgacatcaacgcggcgacgcatactattgtgcgtggcgacacggtgtacaacatttccaaacgctaccatatctctcaagacgatttccgtgcgtggaacggcatgaccgacaatacgttgagcatcggtcagattgttaaagtcaaaccggcaggatatgccgcaccgaaaaccgcagccgtagaaagcaggcccgccgtaccggctgccgcgcaaacccctgtgaaacccgccgcgcaaccgcccgttcagtccgcgccgcaacctgccgcgcccgctgcggaaaataaagcggttcccgcccccgcgcccgccccgcaatctcctgccgcttcgccttccggcacgcgttcggtcggcggcattgtttggcagcgtccgacccaaggtaaagtggttgccgatttcggcggcggcaacaagggtgtcgatattgccggcaatgccggacaacccgttttggcggcggctgacggcaaagtggtttatgccggttcaggtttgaggggatacggaaacttggtcatcatccagcacaattcctctttcctgaccgcgtacgggcacaaccaaaaattgctggtcggcgaaggtcagcaggtcaaacgcggtcagcaggttgctttgatgggtaataccgatgcttccagaacgcagcttcatttcgaggtgcgtcaaaacggcaaaccggttaacccgaacagctatatcgcgttctga

SEQ ID NO: 118 - protein, 337 aa, Neisseria meningitidis
MLKQTTLLAACTAVAALLGGCATQQPAPVIAGNSGMQTVSSAPVYNPYGATPYNAAPAANDAPYVPPVQTAPVYSPPAYVPPSAPAVSGTYVPSYAPVDINAATHTIVRGDTVYNISKRYHISQDDFRAWNGMTDNTLSIGQIVKVKPAGYAAPKTAAVESRPAVPAAAQTPVKPAAQPPVQSAPQPAAPAAENKAVPAPAPAPQSPAASPSGTRSVGGIVWQRPTQGKVVADFGGGNKGVDIAGNAGQPVLAAADGKVVYAGSGLRGYGNLVIIQHNSSFLTAYGHNQKLLVGEGQQVKRGQQVALMGNTDASRTQLHFEVRQNGKPVNPNSYIAF

SEQ ID NO: 119 - DNA, 1056 bp, Neisseria gonorrhoeae
gtgccgccggtgcaaagcgcgccggtttatacgcctcctgcttatgttccgccgtctgcacctgccgtttcgggtacatacgttccttcttacgcacccgtcgacatcaacgcggcgacgcatactattgtgcgcggcgacacggtgtacaacatttccaaacgctaccatatctctcaagacgatttccgtgcgtggaacggcatgaccgacaatacgttgagcatcggtcagattgttaaagtcaaaccggcaggatatgccgcaccgaaagccgcagccgtaaaaagcaggcccgccgtaccggctgccgcgcaaccgcccgtacagtccgcacccgtcgacattaacgcggcgacgcatactattgtgcgcggcgacacggtgtacaacatttccaaacgctaccatatctctcaagacgatttccgtgcgtggaacggcatgaccgacaatatgttgagcatcggtcagattgttaaagtcaaaccggcaggatatgccgcaccgaaaaccgcagccgtagaaagcaggcccgccgtaccggctgccgtgcaaacccctgtgaaacccgccgcgcaaccgcctgtgcagtccgcgccgcaacctgccgcgcccgctgcggaaaataaagcggttcccgcgcccgccccgcaatctcctgccgcttcgccttccggcacgcgttcggtcggcggcattgtttggcagcgtccgacgcaaggtaaagtggttgccgatttcggcggcaacaacaagggtgtcgatattgccggtaatgcgggacagcccgttttggcggcggctgacggcaaagtggtttatgccggttcaggtttgaggggatacggaaacttggtcatcatccagcataattcttctttcctgaccgcatacgggcacaaccaaaaattgctggtcggcgaggggcagcaggtcaaacgcggtcagcaggttgctttgatgggcaataccgatgcttccagaacgcagcttcatttcgaggtgcgtcaaaacggcaaaccggttaacccgaacagctatatcgcgttctga

SEQ ID NO: 120 - protein, 509 aa, Neisseria meningitidis
MAAADKQLGSDRRSVAIIGDGAMTAGQAFEALNCAGDMDVDLLVVLNDNEMSISPNVGALPKYLASNVVRDMHGLLSTVKAQTGKVLDKIPGAMEFAQKVEHKIKTLAEEAEHAKQSLSLFENFGFRYTGPVDGHNVENLVDVLEDLRGRKGPQLLHVITKKGNGYKLAENDPVKYHAVANLPKESAAQMPSEKEPKPAAKPTYTQVFGKWLCDRAAADSRLVAITPAMREGSGLVEFEQRFPDRYFDVGIAEQHAVTFAGGLACEGMKPVVAIYSTFLQRAYDQLVHDIALQNLPVLFAVDRAGIVGADGPTHAGLYDLSFLRCIPNMIVAAPSDENECRLLLSTCYQADAPAAVRYPRGTGTGVPVSDGMETVEIGKGIIRREGEKTAFIAFGSMVAPALAVAGKLNATVADMRFVKPIDEELIVRLARSHDRIVTLEENAEQGGAGSAVLEVLAKHGICKPVLLLGVADTVTGHGDPKKLLDDLGLSAEAVERRVRAWLSDRDAAN

SEQ ID NO: 121 - DNA, 1140 bp, Neisseria gonorrhoeae
atgagccgtttatggttttttgccgtaaaaaacattataatccgccttatttacctattgcccaaggagacacaaatggcactcgtatccatgcgccaactgcttgaccacgccgccgaaaacagctacggcctgcccgcgttcaacgtcaacaacctcgaacaaatgcgcgccattatggaagccgccgaccaagtcaacgcgcccgtcatcgtacaggcgagcgcaggtgcgcgcaaatacgcgggcgcgccgtttttgcgccacctgattctggcggcagtcgaagaatttccgcacatccccgtcgtgatgcaccaagaccacggcgcatcgcccgacgtgtgccaacgctccatccaactgggcttctcctccgtgatgatggacggctctttgctcgaagacggcaaaaccccttcttcttacgaatacaacgtcaacgccacccgtaccgtcgtcaacttctcccacgcctgcggcgtgtccgtcgaaggcgaaatcggcgtattgggcaacctcgaaaccggcgaagcaggcgaagaagacggagtgggcgcggcaggcaaactctcacacgaccaaatgctcaccagcgttgaagatgccgtgcgtttcgttaaagataccggcgttgacgcattggcgattgccgtcggcaccagccacggcgcatacaaattcacccgtccgcccacaggcgacgtattgcgtatcgaccgcatcaaggaaatccaccaagccctgcccaatacacacatcgtgatgcacggctccagctccgttccgcaagaatggctgaaagtcatcaacgaatacggcggcaatatcggcgaaacctacggcgtgccggttgaagaaatcgtcgaaggcatcaaacacggcgtgcgcaaagtcaacatcgataccgacctgcgcctcgcttccaccggcgcggtacgccgctaccttgccgaaaacccgtccgactttgatccgcgcaaatacttgggcaaaaccattgaagcgatgaagcaaatctgcctcgaccgttatcttgcgttcggttgcgaaggtcaggcaggcaaaatcaaacctgtttcgttggaaaaaatggcaagccgttatgccaagggcgaattgaaccaaatcgtcaaataa

SEQ ID NO: 122 - protein, 379 aa, Neisseria gonorrhoeae
MSRLWFFAVKNIIIRLIYLLPKETQMALVSMRQLLDHAAENSYGLPAFNVNNLEQMRAIMEAADQVNAPVIVQASAGARKYAGAPFLRHLILAAVEEFPHIPVVMHQDHGASPDVCQRSIQLGFSSVMMDGSLLEDGKTPSSYEYNVNATRTVVNFSHACGVSVEGEIGVLGNLETGEAGEEDGVGAAGKLSHDQMLTSVEDAVRFVKDTGVDALAIAVGTSHGAYKFTRPPTGDVLRIDRIKEIHQALPNTHIVMHGSSSVPQEWLKVINEYGGNIGETYGVPVEEIVEGIKHGVRKVNIDTDLRLASTGAVRRYLAENPSDFDPRKYLGKTIEAMKQICLDRYLAFGCEGQAGKIKPVSLEKMASRYAKGELNQIVK

SEQ ID NO: 123 - DNA, 771 bp, Neisseria meningitidis
atgagctgtttatggttttttgctgtaaaaaacattataatccgccttatttacctattgcccaaggagacacaaatggcactcgtatccatgcgccaactgcttgatcatgctgccgaawacagctacggcytgccggcgttcaacgtcaacaacctcgwacagatgcgcgccatcatggaggctgcagaccaagtcgacgcccccgtcatcgtacaggcgagtgccggtgcgcgcaaatatgcgggtgcgccgtttttacgccacctgattttggcggctgtcgaagtatttccacacatccccgtcgtcatgcaccaagaccacggcgcatcacccgacgtgtgccaacgctccatccaactgggcttctcctctgtaatgatggacggctcgctgatggaagacggcaaaaccccttcttcttacgaatacaacgtcaacgccacacgtaccgtggttaacttctcccacgcttgcggcgtatccgttgaaggcgaaatcggcgtattgggcaacctcgaaaccggcgatgcaggcgaagaagacggtgtaggcgcagtgggcaaactttcccacgaccaaatgctgaccagcgtcgaagatgccgtatgtttcgttaaagataccggcgttgacgcattggctattgccgtcggcaccagccacggcgcatacaaattcacccgtccgcccacaggcgatgtattacgtatcgaccgcatcaaagaaatccaccaagccctgcccaatacacacatcgtgatgcac

SEQ ID NO: 124 - protein, 257 aa, Neisseria meningitidis
  misc_feature (41)..(41): Xaa can be any naturally occurring amino acid
  misc_feature (54)..(54): Xaa can be any naturally occurring amino acid
MSCLWFFAVKNIIIRLIYLLPKETQMALVSMRQLLDHAAEXSYGLPAFNVNNLXQMRAIMEAADQVDAPVIVQASAGARKYAGAPFLRHLILAAVEVFPHIPVVMHQDHGASPDVCQRSIQLGFSSVMMDGSLMEDGKTPSSYEYNVNATRTVVNFSHACGVSVEGEIGVLGNLETGDAGEEDGVGAVGKLSHDQMLTSVEDAVCFVKDTGVDALAIAVGTSHGAYKFTRPPTGDVLRIDRIKEIHQALPNTHIVMH

SEQ ID NO: 125 - DNA, 1140 bp, Neisseria meningitidis
atgagccgtttatggttttttgccgcaaaaaacattataatccgccttatttacctattgcccaaggagacacaaatggcactcgtatccatgcgccaactgcttgatcatgctgccgaaaacagctacggcctgcccgcgttcaacgtcaacaacctcgaacaaatgcgcgccattatggaagccgccgaccaagtcaacgcgcccgtcatcgtacaggcgagcgcaggtgcgcgcaaatacgcgggcgcgccgtttttgcgccacctgattttggcggctgtcgaagaatttccgcacatccccgtcgtgatgcaccaagaccacggcgcatcgcccgacgtgtgccaacgctccatccaactgggcttttcctccgtgatgatggacggctcgctgatggaagacggcaaaaccccttcttcttatgaatacaacgtcaacgccacccgtaccgtggttaatttctcccacgcctgcggcgtatccgttgaaggcgaaatcggcgtattgggcaacctcgaaactggcgaagccggcgaagaagacggtgtaggcgcagtgggcaaactttcccacgaccaaatgctcaccagcgtcgaagatgccgtgcgtttcgttaaagataccggcgttgacgcattggcgattgccgtcggcaccagccacggcgcgtacaaattcacccgtccgcccacaggcgacgtgttgcgtatcgaccgcatcaaagaaatccaccaagccctgcccaatacacacatcgtgatgcacggctccagctccgttccgcaagaatggctgaaagtcatcaacgaatacggcggcaatatcggcgaaacctacggcgtgccggttgaagaaatcgtcgaaggcatcaaacacggcgtgcgtaaagtcaacatcgataccgacttgcgccttgcttccaccggcgcggtacgccgctaccttgccgaaaacccgtccgacttcgatccgcgcaaatatttgagcaaaaccattgaagcgatgaagcaaatctgcctcgaccgctacctcgcgttcggttgcgaaggtcaggcaggcaaaatcaaaccggtttccttggaaaaaatggcaaaccgttatgccaagggcgaattgaaccaaatcgtcaaataa

SEQ ID NO: 126 - protein, 379 aa, Neisseria meningitidis
MSRLWFFAAKNIIIRLIYLLPKETQMALVSMRQLLDHAAENSYGLPAFNVNNLEQMRAIMEAADQVNAPVIVQASAGARKYAGAPFLRHLILAAVEEFPHIPVVMHQDHGASPDVCQRSIQLGFSSVMMDGSLMEDGKTPSSYEYNVNATRTVVNFSHACGVSVEGEIGVLGNLETGEAGEEDGVGAVGKLSHDQMLTSVEDAVRFVKDTGVDALAIAVGTSHGAYKFTRPPTGDVLRIDRIKEIHQALPNTHIVMHGSSSVPQEWLKVINEYGGNIGETYGVPVEEIVEGIKHGVRKVNIDTDLRLASTGAVRRYLAENPSDFDPRKYLSKTIEAMKQICLDRYLAFGCEGQAGKIKPVSLEKMANRYAKGELNQIVK

SEQ ID NO: 127 - DNA, 816 bp, Neisseria gonorrhoeae
atgctgaagccgtgtttggtatacagtgcctgtgcggcggcgttgcctgcgcggacttcgagcagcaggcgttgcgtgccttcgggcagatgtgcgtaccaatattcgagcagggcggacgcaacgccccgtcggcggcattcgggcgcggtggcaatcaggtgcagttcggattcgtcgggcaggttctgccaaacgataaaggcggcaatcctgccgtctttttccgcaaggaaaacctgttcggacggcgaaacaagcgcggactcaaattggcgttgcgtccacgcggacgggttgcagacggtatcgagcgcggccagtgcggcgcagtcggacggtgaggctgggcggatgttcatgttcgtgccttccgttccgcctgttctttggcagtcagggcgattttgttgcggacgtagagcagttcggcgtgtgccgcgccagttgcgggatagccgccgccgagggcgagcgcgagaaaatcggcggcggtcggcatatcgggtttgcctgagaagggcggacggttttccagtgcgaacgcactgccgatgccgtctgaaaagacgtacccctcggggagggcaatgtctgccgccctaccgacttgataatcgctcaaacggcggcggttcagcgtgtcgaaccacgcataaaacacttcgcccatacgcgcgtccgcagcggcgagtatgcagctttgcggcggcggcagcgaggcggcggcatcgagcgtggggatgccgattaaaggcgtgtcgaacggcgttgccaaaccttgcgccacgccgatgccgatacgcagtccggtaa

SEQ ID NO: 128 - protein, 271 aa, Neisseria gonorrhoeae
MLKPCLVYSACAAALPARTSSSRRCVPSGRCAYQYSSRADATPRRRHSGAVAIRCSSDSSGRFCQTIKAAILPSFSARKTCSDGETSADSNWRCVHADGLQTVSSAASAAQSDGEAGRMFMFVPSVPPVLWQSGRFCCGRRAVRRVPRQLRDSRRRGRARENRRRSAYRVCLRRADGFPVRTHCRCRLKRRTPRGGQCLPPYRLDNRSNGGGSACRTTHKTLRPYARPQRRVCSFAAAAARRRHRAWGCRLKACRTALPNLAPRRCRYAVR

SEQ ID NO: 129 - DNA, 815 bp, Neisseria meningitidis
atgctgaagccgtgcgccgtgtacagtgcctgtgcggcggtgttgcctgcacggacttcgagcagcaggcgttgcgtgtcttcgggcagatgtgtgaaccaatattcgagcagggcggacgcaattccttggcggcggcattcgggcgcggtggcaatcaggtgcagttcggattcgtcgggcaggttctgccaaacgataaaggcggcaatcccgcgtctttttccgcaaggaaaacctgttcggacggcgaaaccagtgcggactcaaattggcgttgcgtccatgcggacgggttgcagacggcatcgagtgcggccagctcctcacaatcggcacaaacggcacggcggatgttcacgggcgcgctctccgttcggcctgttctttggcagtcagggcgattttgttgcggacgtagagcaaaccggcgtgtgcggcatggacggcaggataaccgcccttggctgccaatgcgagaaagtcggcggcagtcggcatatccggtctgcctgagaacggcggagcttcttccagcgcgaacgcgctgcctatgccgtctgaaaaggcgcatccctccggcagccggatgtctgccgcccgcccgacctgataatcgctcaaacggtggcagttcagcgtatcgaaccatgcataaaacacttcgcccatacgagcgtccgtagcggcaaggatgcagctttgcggcggcggcagcgaggcggcggcatcgagcgagggtacgccgattaagggggtatcaaacggcgttgccaaaccctgagctacaccgatgccgatacgcagtccggtaa

SEQ ID NO: 130 - protein, 270 aa, Neisseria meningitidis
  misc_feature (73)..(73): Xaa can be any naturally occurring amino acid
MLKPCAVYSACAAVLPARTSSSRRCVSSGRCVNQYSSRADAIPWRRHSGAVAIRCSSDSSGRFCQTIKAAIPXSFSARKTCSDGETSADSNWRCVHADGLQTASSAASSSQSAQTARRMFTGALSVRPVLWQSGRFCCGRRANRRVRHGRQDNRPWLPMRESRRQSAYPVCLRTAELLPARTRCLCRLKRRIPPAAGCLPPARPDNRSNGGSSAYRTMHKTLRPYERPRQGCSFAAAAARRRHRARVRRLRGYQTALPNPELHRCRYAVR

SEQ ID NO: 131 - DNA, 816 bp, Neisseria meningitidis
atgctgaagccgtgcgccgtgtacagtgcctgtgcggcggtgttgcctgcacggacttcgagcagcaggcgttgcgtgtcttcgggcagatgtgtgaaccaatattcgagcagggcggacgcaattccttggcggcggcattcgggcgcggtggcaatcaggtgcagttcggattcgtcgggcaggttctgccaaacgataaaggcggcaatcccgccgtctttttccgcaaggaaaacctgttcggacggcgaaaccagtgcggactcaaattggcgttgcgtccacgcggacgggttgcagacggcatcgagcgcggcgagtgcggcgcaatcggcataaacggcgcggcggatgttcacaggcgcgccctccgttccgcctgttctttggcagtcaaggcgattttgttgcggacgtagagcagctcggcgtgtgccgcagcgacggcgggaaaaccgccttcagccgccagattgaggaagtcggcggcggtcggcatatcgggtttgcctgagaagggcggacggttttccagcgcgaacgcattgccgatgccgtctgaaaaggcgcatccttccggcagccggatgtctgccgcccgaccgacctgataatcgctcaaacggcggcggttcagcgtgtcgaaccatgcataaaacacttcgcccatacgtgcgtccgcagcggcaaggatgcagctttgcggcggcggcagcgaggcggcggcatcgagcgagggtacgccgattaaaggagtatcaaacggcgttgccaaaccttgcgccacgccgatgccgatacgcagtcccgtaa

SEQ ID NO: 132 - protein, 269 aa, Neisseria meningitidis
MLKPCAVYSACAAVLPARTSSSRRCVSSGRCVNQYSSRADAIPWRRHSGAVAIRCSSDSSGRFCQTIKAAIPPSFSARKTCSDGETSADSNWRCVHADGLQTASSAASAAQSATARRMFTGAPSVPPVLWQSRRFCCGRRAARRVPQRRRENRLQPPDGSRRRSAYRVCLRRADGFPARTHCRCRLKRRILPAAGCLPPDRPDNRSNGGGSACRTMHKTLRPYVRPQRQGCSFAAAAARRRHRARVRRLKEYQTALPNLAPRRCRYAVP

SEQ ID NO: 133 - DNA, 687 bp, Neisseria meningitidis
atgctgaagccgtgcgccgtgtacagtgcctgtgcggcggtgttgcctgcacggacttcgagcagcaggcgttgcgtgtcttcgggcagatgtgtgaaccaatattcgagcagggcggacgcaattccttggcggcggcattcgggcgcggtggcaatcaggtgcagttcggattcgtcgggcaggttctgccaaacgataaaggcggcaatcccgccgtctttttccgcaaggaaaacctgttcggacggcgaaaccagtgcggactcaaattggcgttgcgtccatgcggacgggttgcagacggcatcgagtgcggccagctcctcacaatcggcacaaacggcacggcggatgttcacgggcgcgctctccgttcggcctgttctttggcagtcagggcgattttgttgcggacgtagagcaaaccggcgtgtgcggcatggacggcaggataaccgcccttggctgccaatgcgagaaagtcggcggcagtcggcatatccggtctgcctgagaacggcggagcttcttccagcgcgaacgcgctgcctatgccgtctgaaaaggcgcatccctccggcagccggatgtctgccgcccgcccgacctgataatcgctcaaacggtggcagttcagcgtatcgaaccatgcataaaacacttcgcccatacgagcgtccgtag

SEQ ID NO: 134 - protein, 228 aa, Neisseria meningitidis
MLKPCAVYSACAAVLPARTSSSRRCVSSGRCVNQYSSRADAIPWRRHSGAVAIRCSSDSSGRFCQTIKAAIPPSFSARKTCSDGETSADSNWRCVHADGLQTASSAASSSQSAQTARRMFTGALSVRPVLWQSGRFCCGRRANRRVRHGRQDNRPWLPMRESRRQSAYPVCLRTAELLPARTRCLCRLKRRIPPAAGCLPPARPDNRSNGGSSAYRTMHKTLRPYERP

SEQ ID NO: 135 - DNA, 642 bp, Neisseria gonorrhoeae
atgactgatttccgccaagatttcctcaaattctccctcgcccaaaatgttttgaaattcggcgaatttaccaccaaagccggacggcggtcgccctatttcttcaatgccggcctcttcaacgacggcgcgtccacgctgcaactggcaaaattctatgcacaatccatcattgaaagcggcatccgattcgatatgctgttcggccccgcctacaaaggcattattttggcggcggcaaccgcgatgatgctggcggaaaaaggcgtgaacgtcccgtttgcctacaaccgcaaagaagccaaagaccgcggcgaaggcggcgtgttggtcggcgcgccgcttaaagggcgcgtgctgattatcgacgacgtgatttccgccggcacatccgtacgcgaatcaatcaaactgattgaagcggagggtgcaacccccgccggtgtcgccatcgcgctcgaccgcatggaaaaaggcacgggtaaattgtccgccgttcaggaagtggaaaaacaatacggcctgcccgtcgcccccatcgccagcctgaacgatttgtttatcctgttgcaaaacaaccccgaattcggacagttcctcgaacccgtccgcacctaccgccggcagtacggcgtagaataa

SEQ ID NO: 136 - protein, 213 aa, Neisseria gonorrhoeae
MTDFRQDFLKFSLAQNVLKFGEFTTKAGRRSPYFFNAGLFNDGASTLQLAKFYAQSIIESGIRFDMLFGPAYKGIILAAATAMMLAEKGVNVPFAYNRKEAKDRGEGGVLVGAPLKGRVLIIDDVISAGTSVRESIKLIEAEGATPAGVAIALDRMEKGTGKLSAVQEVEKQYGLPVAPIASLNDLFILLQNNPEFGQFLEPVRTYRRQYGVE

SEQ ID NO: 137 - DNA, 642 bp, Neisseria meningitidis
atgaccgatttccgccaagatttcctcaaattctccctcgcccaaaatgttttgaaattcggcgaatttaccaccaaggcaggacggcggtcgccctatttcttcaatgccggcctctttaacgacggcttgtccacgctgcaactggcaaaattttacgcacaatccatcattgaaagcggcatccgattcgatatgctgttcggtcccgcctacaaaggcattattttggcggcggcaaccgcgatgatgctggcggaaaaaggcgtgaacgtcccgtttgcctacaaccgcaaagaagccaaagaccacggcgaaggcggcgtgttggtcggcgcgccgcttaaagggcgcgtgctgattatcgacgacgtgatttccgccggcacatccgtacgcgaatcgatcaaactgattgaagcggagggtgcaacccccgccggtgtcgccatcgcgctcgatcgcatggaaaaaggcacgggtgaattgagcgcggttcaggaagtggaraaacaatacggkctgcccgtcgcccccatcgccagcctgaacgatttgtttattctgttgcaaaacaaccccgaattcggacagttcctcgaacccgtccgagcctaccgtcggcagtacggcgtagaataa

SEQ ID NO: 138 - protein, 213 aa, Neisseria meningitidis
MTDFRQDFLKFSLAQNVLKFGEFTTKAGRRSPYFFNAGLFNDGLSTLQLAKFYAQSIIESGIRFDMLFGPAYKGIILAAATAMMLAEKGVNVPFAYNRKEAKDHGEGGVLVGAPLKGRVLIIDDVISAGTSVRESIKLIEAEGATPAGVAIALDRMEKGTGELSAVQEVEKQYGLPVAPIASLNDLFILLQNNPEFGQFLEPVRAYRRQYGVE

SEQ ID NO: 139 - DNA, 642 bp, Neisseria meningitidis
atgaccgatttccgccaagatttcctcaaattctccctcgcccaaaatgttttgaaattcggcgaattcaccaccaaagccggacggcggtcgccctatttcttcaatgccggcctctttaacgacggcttgtccacgctgcaactggcaaaattttacgcacaatccatcattgaaagcggcatccgattcgatatgctgttcggccccgcctacaaaggcattattttggcggcggcaaccgcgatgatgctggcggaaaaaggcgtgaacgtcccgtttgcctacaaccgcaaagaagccaaagaccacggcgaaggcggcgtgttggtcggcgcgccgcttaaagggcgcgtgctgattatcgacgacgtgatttccgccggcacatccgtacgcgaatcgatcaaactgattgaagcggagggtgcaacccccgccggtgtcgccatcgcgctcgaccgcatggaaaaaggcacgggtgaattgagcgcggttcaggaagtggaaaaacaatacggcctgcccgtcgcccccatcgccagcctgaacgatttgtttattctgttgcaaaacaaccccgaattcggacagttcctcgaacccgtccgagcctaccgtcggcagtacggcgtagaataa

SEQ ID NO: 140 - protein, 213 aa, Neisseria meningitidis; identical to SEQ ID NO: 138

SEQ ID NO: 141 - DNA, 492 bp, Neisseria gonorrhoeae
atgccgtccgaaccacctgccgcttcagacggcatcaaaccgacacacaccgagaaaacatcatgcccgcctgtttctgtccgcactgcaaaacccgcctctgggtcaaagaaacccagctcaacgtcgcccaaggcttcgtcgtctgccaaaaatgcgaagggctgtttaaagccaaagaccatctggcaagcacgaaagaacctatattcaacgattggcccgaagctgtttcgggatgtcaaactcgtccaccgcatcggcacgcacgccattagcaagaaacagatgtcccgcgacgaaatcgccgatatcctcaacggcggtacaaccctgcacgatacgccgcccgcaaccgccgctgccgcacctgccgccgcaccgcaggtttccgtaccgcccgcccgtcaggaagggctcaactggactattgcaaccctgttcgcacttatcgtcctcattatgcagctttcctacctcttcatcctatga

SEQ ID NO: 142 - protein, 163 aa, Neisseria gonorrhoeae
MPSEPPAASDGIKPTHTEKTSCPPVSVRTAKPASGSKKPSSTSPKASSSAKNAKGCLKPKTIWQARKNLYSTIGPKLFRDVKLVHRIGTHAISKKQMSRDEIADILNGGTTLHDTPPATAAAAPAAAPQVSVPPARQEGLNWTIATLFALIVLIMQLSYLFIL

SEQ ID NO: 143 - DNA, 513 bp, Neisseria meningitidis
  misc_feature (133)..(237): n is a, c, g, or t
atgccgtccgaaccgccttacgcctcagacggcatcaaacctgacacacacgaggaaataccatgcccgcctgtttctgcccccactgcaaaacccgtctctgggtcaaagaaacccaactcaatgtcgccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgaggctgtttcggatgtcaaactcgttcaccgtatcggcacgcgcgccatcggcaagaaacagatttcccgtgacgaaatcgccggcatcctcaacggcggtacaacccagcccgatattccgcccgcaaccgccgccacccctgctgccgcaccgcaggttaccgtaccgcccgccgcgcccgcccgtcaggatgggttcaactggacgattgcaaccctgtttgcccttatcgtcctcattatgcagctttcctacctcgtcatcctatga

SEQ ID NO: 144 - protein, 170 aa, Neisseria meningitidis
  misc_feature (45)..(79): Xaa can be any naturally occurring amino acid
MPSEPPYASDGIKPDTHEEIPCPPVSAPTAKPVSGSKKPNSMSPXXXXXXXXXXXXXXXXXXXXXXXXXXXXXXXXXXXPEAVSDVKLVHRIGTRAIGKKQISRDEIAGILNGGTTQPDIPPATAATPAAAPQVTVPPAAPARQDGFNWTIATLFALIVLIMQLSYLVIL

SEQ ID NO: 145 - DNA, 497 bp, Neisseria meningitidis
atgccgtctgaaccgccttacgcctcagacggcatcaaacctgacacacacgaggaaataccatgcccgcctgtttctgcccccactgcaaaacccgtctctgggtcaaagaaacccaactcaatgtcgcccaaggcttcgtcgtctgccaaaaatgcgaaggaatgtttaaagccaaagaccatctggcaagcacgaaagaacccatattcaacgatttgcccgaagctgtttcggatgtcaaactcgttcaccgcatcggcacgagcgccatcggcaagaaacagatttcccgtgacgaaatcgccggcatcctcaacggcggcacaacccagcccgatattccgcccgcaaccgccgccacccctgctgccgcaccgcaggttaccgtaccgcccgccgcgcccgcccgtcaggatgggttcaactggacgattgcaaccctgtttgcccttatcgtcctcattatgcagctttcctacctcgtcatcctatga

SEQ ID NO: 146 - protein, 165 aa, Neisseria meningitidis
  misc_feature (74)..(74): Xaa can be any naturally occurring amino acid
MPSEPPYASDGIKPDTHEEIPCPPVSAPTAKPVSGSKKPNSMSPKASSSAKNAKECLKPKTIWQARKNPYSTIXPEAVSDVKLVHRIGTSAIGKKQISRDEIAGILNGGTTQPDIPPATAATPAAAPQVTVPPAAPARQDGFNWTIATLFALIVLIMQLSYLVIL

SEQ ID NO: 147 - DNA, 1311 bp, Neisseria gonorrhoeae
atgaacgcgcccgacagctttgtcgcccacttccgcgaagccgccccctacatccgccaaatgcgcggcacgacactggtcgccggcatagacggccgcctgctcgaaggcggcaccttaaataagctcgccgccgacatcgggctgttgtcgcaactgggcatccgactcgtcctcatccacggcgcgtaccacttcctcgaccgcctcgccgccgcgcaaggccgcacgccgcattattgccggggtttgcgcgttaccgacgaaacctcgctcggacaggcgcagcagtttgccggcaccgtccgcagccgttttgaagccgcattgtgcggcagcgtttcaggattcgcgcgcgcgccttccgtcccgctcgtatcgggcaacttcctgaccgcccgtccgatgggcgtgattgacggaaccgatatggaatacgcgggggttatccgcaaaaccgacaccgccgccctccgtttccaactcgacgcgggcaatatcgtctggatgccgccgctcgggcattcctacggcggcaaaaccttcaatctcgatatggtgcaggccgccgcttccgtcgccgtctcgcttcaggccgaaaaactcgtttacctgaccctttcagacggcatttcccgccccgacggcacgctcgccgaaaccctctcggcacaggaagcgcaatcgctggcggaacacgccgccagcgaaacccgacgactgatttcgtccgccgttgccgcgctcgaaggcggcgtgcatcgcgtccaaatcctcaacggggccgccgacggcagcctgctgcaagaactcttcacccgcaacggcatcggcacgtccattgccaaagaagccttcgtctccatccggcaggcgcacagcggcgacatcccgcacatcgccgccctcatccgcccgctggaagaacagggcgtcctattgcaccgcagccgcgaatacctcgaaaaccacatttccgaattttccatcctcgaacacgacggcgacctgtacggctgtgccgcactcaaaacctttgccgaagccgattgcggcgaaatcgcctgccttgccgtctcgccgcaggcacaggacggcggctacggcgaacgcctgcttgcccacattatcgataaggcgcgcggcataggcataagcaggctgttcgcactgtccacaaataccggcgaatggtttgccgaacgcggctttcagacggcatcggaagacgagctgcccgaaacgcggcgcaaagactaccgcagcaacggacgaaacccgcatattctggtgcgtcgcctgcaccgctga

SEQ ID NO: 148 - protein, 436 aa, Neisseria gonorrhoeae
MNAPDSFVAHFREAAPYIRQMRGTTLVAGIDGRLLEGGTLNKLAADIGLLSQLGIRLVLIHGAYHFLDRLAAAQGRTPHYCRGLRVTDETSLGQAQQFAGTVRSRFEAALCGSVSGFARAPSVPLVSGNFLTARPMGVIDGTDMEYAGVIRKTDTAALRFQLDAGNIVWMPPLGHSYGGKTFNLDMVQAAASVAVSLQAEKLVYLTLSDGISRPDGTLAETLSAQEAQSLAEHAASETRRLISSAVAALEGGVHRVQILNGAADGSLLQELFTRNGIGTSIAKEAFVSIRQAHSGDIPHIAALIRPLEEQGVLLHRSREYLENHISEFSILEHDGDLYGCAALKTFAEADCGEIACLAVSPQAQDGGYGERLLAHIIDKARGIGISRLFALSTNTGEWFAERGFQTASEDELPETRRKDYRSNGRNPHILVRRLHR

SEQ ID NO: 149 - DNA, 1236 bp, Neisseria meningitidis
  misc_feature (1039)..(1039): n is a, c, g, or t
atgagcgcgcccgacctctttgtcgcccacttccgcgaagccgtcccctacatccgccaaatgcgcggcaaaacgctggtcgccggcatagacgaccgcctgctcgaaggtgataccttaaacaagctcgccgccgacatcgggctgttgtcgcaactgggcatcaggctcgtcctcatccacggcgcgcgccacttcctcgaccgccacgccgccgctcaaggccgcacgccgcattattgccggggcttgcgcgttaccgacgaaacctcgctcgaacaggcgcagcagtttgccggcaccgtccgcagccgttttgaagccgcattgtgcggcagcgtttccgggttcgcgcgcgcgccttccgtcccgctcgtatcgggcaacttcctgaccgcccgtccgataggtgtgattgacggaaccgatatggaatacgcgggcgttatccgcaaaaccgacaccgccgccctccgtttccaactcgacgcgggcaatatcgtctggctgccgccgctcggacattcctacagcggcaagaccttctatctcgatatgcttcaaaccgccgcctccgccgccgtctcgcttcaggccgaaaaactcgtttacctgaccctttcagacggcatttcccgccccgacggcacgctcgccgaaaccctctcggcacaggaagcgcaatcgctggcggaacacgccggcgggcaaacgcgacggctgatttcgtccgccgaactcttcacccgcaacggcatcggcacgtccattgccaaagaagccttcgtctccatccggcargcgcaywgggcgacatcccgcacatcgccgccctcatccgcccgctggaagaacagggcatcctgctgcaccgcascgcgaatacctcgaaaaccacatttccgaattttccatcctcgaacacgacggcaacctgtacggttgcgccgccctgaaaacctttgccgaagccgattgcggcgaaatcgcctgccttgccgtctcgccgcagcacaggacggcggctacggcgaacgcntgcttgcccacattatcgataaggcgcgcggcataggcataagcaggctgttcgcactgtccacaaataccggcgaatggtttgccgaacgcggctttcagacggcatcggaagacgagttgcccgaaacgcggcgcaaagactaccgcagcaacggacggaactcgcatattctggtacgtcgcctgcaccgctga

SEQ ID NO: 150 - protein, 412 aa, Neisseria meningitidis
  misc_feature (270)..(271): Xaa can be any naturally occurring amino acid
  misc_feature (293)..(293): Xaa can be any naturally occurring amino acid
  misc_feature (339)..(339): Xaa can be any naturally occurring amino acid
  misc_feature (348)..(348): Xaa can be any naturally occurring amino acid
MSAPDLFVAHFREAVPYIRQMRGKTLVAGIDDRLLEGDTLNKLAADIGLLSQLGIRLVLIHGARHFLDRHAAAQGRTPHYCRGLRVTDETSLEQAQQFAGTVRSRFEAALCGSVSGFARAPSVPLVSGNFLTARPIGVIDGTDMEYAGVIRKTDTAALRFQLDAGNIVWLPPLGHSYSGKTFYLDMLQTAASAAVSLQAEKLVYLTLSDGISRPDGTLAETLSAQEAQSLAEHAGGQTRRLISSAELFTRNGIGTSIAKEAFVSIRQAHXXDIPHIAALIRPLEEQGILLHRXREYLENHISEFSILEHDGNLYGCAALKTFAEADCGEIACLAVSPQXQDGGYGERXLAHIIDKARGIGISRLFALSTNTGEWFAERGFQTASEDELPETRRKDYRSNGRNSHILVRRLHR

SEQ ID NO: 151 - DNA, 1311 bp, Neisseria meningitidis
atgatcgtgcccgacctctttgtcgcccacttccgcgaagccgccccctacatccgccaaatgcgcggcaaaacgctggtcgccggcatagacgaccgcctgctcgaaggtgataccttaaacaagttcgccgccgacatcgggcttttgtcgcaactgggcatcaggctcgtcctcatccacggcgcgcgccacttcctcgaccgccacgccgccgcgcaaggccgcacgccgcattattgccggggcttgcgcgttaccgacgaaacctcgctcgaacaggcgcagcagtttgccggcaccgtccgcagccgttttgaagccgcattgtgcggcagcgtttccgggttcgcgcgcgcgccttccgtcccgctcgtatcgggcaacttcctgaccgcccgtccgataggtgtgattgacggaaccgatatggaatacgcgggcgttatccgcaaaaccgacaccgccgccctccgtttccaactcgacgcgggcaatatcgtctggctgccgccgctcggacattcctacagcggcaagaccttccatctcgatatgcttcaaaccgccgcctccgtcgccgtctcgcttcaggccgaaaaactcgtttacctgaccctttcagacggcatttcccgccccgacggcacgctcgccgtaaccctctcggcacaggaagcgcaatcgctggcggaacacgccggcggcgaaacgcgacggctgatttcgtccgccgttgccgcgctcgaaggcggcgtgcatcgcgtccaaatcctcaacggagccgccgacggcagcctgctgcaagaactcttcacccgcaacggcatcggcacgtccattgccaaagaagccttcgtctccatccggcaggcgcacagcggcgacatcccgcacattgccgccctcatccgcccgctggaagaacagggcatcctgctgcaccgcagccgcgaatacctcgaaaaccacatttccgaattttccatcctcgaacacgacggcaacctgtacggttgcgccgccctgaaaacctttgccgaagccgattgcggcgaaatcgcctgccttgccgtctcgccgcaggcacaggacggcggctacggcgaacgcctgcttgcccacattatcgataaggcgcgcggcataggcataagcaggctgttcgcactgtccacaaataccggcgaatggtttgccgaacgcggctttcagacggcatcggaagacgagttgcccgaaacgcggcgcaaagactaccgcagcaacggacggaactcgcatattctggtgcgtcgcctgcaccgctga

SEQ ID NO: 152 - protein, 436 aa, Neisseria meningitidis
MIVPDLFVAHFREAAPYIRQMRGKTLVAGIDDRLLEGDTLNKFAADIGLLSQLGIRLVLIHGARHFLDRHAAAQGRTPHYCRGLRVTDETSLEQAQQFAGTVRSRFEAALCGSVSGFARAPSVPLVSGNFLTARPIGVIDGTDMEYAGVIRKTDTAALRFQLDAGNIVWLPPLGHSYSGKTFHLDMLQTAASVAVSLQAEKLVYLTLSDGISRPDGTLAVTLSAQEAQSLAEHAGGETRRLISSAVAALEGGVHRVQILNGAADGSLLQELFTRNGIGTSIAKEAFVSIRQAHSGDIPHIAALIRPLEEQGILLHRSREYLENHISEFSILEHDGNLYGCAALKTFAEADCGEIACLAVSPQAQDGGYGERLLAHIIDKARGIGISRLFALSTNTGEWFAERGFQTASEDELPETRRKDYRSNGRNSHILVRRLHR

SEQ ID NO: 153 - DNA, 465 bp, Neisseria gonorrhoeae
atgagttcgcccaaacacatcggcttgcagggcggcagcaacggcggcctgattaccgccgccgccttcgtgcgcgaaccgcaaagcatcggtgcgctggtgtgcgaagtaccgctgaccgatatgatccgttatccgctgctgtccgccggttcaagttggacggacgaatacggcaatccgcagaaatacgaagcctgcaaacgccggctgggcgaattgtcgccgtatcacaatctttcagacggcatcgattatccgcccgcactcattaccaccagcctcagcgacgaccgcgtccatcccgcccacgcgctcaaattctacgccaaactgcgcgaaacctcgccgcaatcttggctctactcgcctgacggcggcggccataccggcaacggcacccaacgcgaatccgccgacaaactcgcctgcgtgttgctgtttttgaaagaatttttgggataa

SEQ ID NO: 154 - protein, 154 aa, Neisseria gonorrhoeae
MSSPKHIGLQGGSNGGLITAAAFVREPQSIGALVCEVPLTDMIRYPLLSAGSSWTDEYGNPQKYEACKRRLGELSPYHNLSDGIDYPPALITTSLSDDRVHPAHALKFYAKLRETSPQSWLYSPDGGGHTGNGTQRESADKLACVLLFLKEFLG

SEQ ID NO: 155 - DNA, 465 bp, Neisseria meningitidis
atcagttcgcccgaacacatcggcttgcagggcggcagcaacggcggactgattactgccgccgccttcgtgcgcgaaccgcaaagcatcggcgcgctggtgtgcgaagtgccgctgaccgacatgatccgttatccgctgctctccgccggttcaagctggacagacgaatacggcaatccgcaaaaatacgaagtctgcaaacgccggttgggcgaattgtcgccgtatcacaatctttcagacggcatcgattatccgcccgcgctcattaccaccagcctgtccgacgatcgcgtccatcccgcccacgcgctcaagttctacgccaaactgcgcgaaacctccgcgcaatcttggctctactcgcctgacggcggcggccataccggcaacggcacccaacgcgaatccgccgacgaactcgcctgcgtcttgctgtttttgaaagagtttttgggctaa

SEQ ID NO: 156 - protein, 154 aa, Neisseria meningitidis
ISSPEHIGLQGGSNGGLITAAAFVREPQSIGALVCEVPLTDMIRYPLLSAGSSWTDEYGNPQKYEVCKRRLGELSPYHNLSDGIDYPPALITTSLSDDRVHPAHALKFYAKLRETSAQSWLYSPDGGGHTGNGTQRESADELACVLLFLKEFLG

SEQ ID NO: 157 - DNA, 465 bp, Neisseria meningitidis
atcagttcgcccgaacacatcggcttgcagggcggcagcaacggcggactgattactgccgccgccttcgtgcgcgaaccgcaaagcataggcgcgctggtgtgcgaagtgccgctgaccgacatgatccgttatccgctgctctccgccggttcaagctggacagacgaatacggcaatccgcaaaaatacgaagtctgcaaacgccggttgggcgaattgtcgccgtatcacaatctttcagacggcatcgattatccgcccgcgctcattaccaccagcctgtccgacgatcgcgtccatcccgcccacgcgctcaagttctacgccaaactgcgcgaaacctcgccgcaatcttggctctactcgcctgacggcggcggccataccggcaacggcacgcagcgcgaagccgccgacgaactcgcctgcgtgttgctgtttttgaaagagtttttgggctaa

SEQ ID NO: 158 - protein, 154 aa, Neisseria meningitidis
ISSPEHIGLQGGSNGGLITAAAFVREPQSIGALVCEVPLTDMIRYPLLSAGSSWTDEYGNPQKYEVCKRRLGELSPYHNLSDGIDYPPALITTSLSDDRVHPAHALKFYAKLRETSPQSWLYSPDGGGHTGNGTQREAADELACVLLFLKEFLG

SEQ ID NO: 159 - DNA, 2016 bp, Neisseria gonorrhoeae
atgaaatcctaccccgacccctaccgccattttgaaaacctcgattccgccgaaacgcaaaacttcgctgctgaagcgaatgccgaaacgcgcgcgcgttttttaaacaacgacaaggcgcgcgcactttcagacggcattttgaatcaaatgcaggacacgcggcagattccgttttgtcaggaacaccgcgcgcggatgtaccatttccatcagaatgcggaatatccgaagggcgtgtaccgcatgtgtacggcggcgacctaccgttccggctatcccgagtggaaaatcctgttttcggtggcggatttcgatgagttgctcggcgacgatgtgtatttgggcggcgtgtcgcacttggtggagcagcccaaccgcgcgctgctgactttgaacaaatcgggcggcgatacggcgtatacgctggaagtggatttggaagcaggggaattggtagagggcggttttcactttccggcaggcaaaaaccatgtgtcgtggcgcgatgaaaacagcgtgtgggtgtgtccggcttgggacgaacgccagttgaccgaatcgggctatccgcgcgaagtgtggctggtggaacgcggcaagagtttcgaggaaagcctgccggcgtaccaaatcgataaaggcgcgatgatggtaaacgcgtggcgttacctcgatccgcagggttcgccgattgatttgattgaagcgtcggacggtttttacaccaagacgtatttgcaggtgtcgtccgaaggcggggcgaaaccgttgaacctgcctaatgattgcgatgtggtcggctatctggcgggacatcttttgctgacgctgcgcaaggactggcaccgcgcgaaccaaagctatccgagtggcgcgttggtggcggtgaaactgaatcggggcgaactcggggcggcgcagcttttgtttgcgcccgatgaaacgcaggcattggaaagcgtggaaacgaccaagcgttttgtggtggcaagcctgctggagaatgtacaaggccgtctgaaagcgtggcggtttgccgacagcaaatggcaggaagccgagttgccgcacctgccctcgggcgcgttggaaatgaccgaccaaccgtggggcggcgacgtggtttatcttgccgccagcgatttcaccacgccgctgacgctgtttgcgctggatttgaacgtgatggaactgaccgtcatgcgcctccagccgcagcagtttgtttcagacggcatcgaagtgcggcagttttgggcggtgtcgtccgacggcgaacgcattccttatttccacgtcggcaaaaacgccgcgcccgacacgccgaccttagtctatgcttacggaggtttcggcattcctgaattgccgcattatctgggcagcgtcggcaaatattggctggaagagggcaatgcctttgtattggcaaacatccgcggcggcggagaattcggcccgcgctggcatcaggcggcgcagggaatcagcaaacacaaaagcgttgatgatttgttggcagtcgtgcgtgatttgtccgaacgcggcatgagttcgcccaaacacatcggcttgcagggcggcagcaacggcggcctgattaccgccgccgccttcgtgcgcgaaccgcaaagcatcggtgcgctggtgtgcgaagtaccgctgaccgatatgatccgttatccgctgctgtccgccggttcaagttggacggacgaatacggcaatccgcagaaatacgaagcctgcaaacgccggctgggcgaattgtcgccgtatcacaatctttcagacggcatcgattatccgcccgcactcattaccaccagcctcagcgacgaccgcgtccatcccgcccacgcgctcaaattctacgccaaactgcgcgaaacctcgccgcaatcttggctctactcgcctgacggcggcggccataccggcaacggcacccaacgcgaatccgccgacaaactcgcctgcgtgttgctgtttttgaaagaatttttgggataa

SEQ ID NO: 160 - protein, 671 aa, Neisseria gonorrhoeae
MKSYPDPYRHFENLDSAETQNFAAEANAETRARFLNNDKARALSDGILNQMQDTRQIPFCQEHRARMYHFHQNAEYPKGVYRMCTAATYRSGYPEWKILFSVADFDELLGDDVYLGGVSHLVEQPNRALLTLNKSGGDTAYTLEVDLEAGELVEGGFHFPAGKNHVSWRDENSVWVCPAWDERQLTESGYPREVWLVERGKSFEESLPAYQIDKGAMMVNAWRYLDPQGSPIDLIEASDGFYTKTYLQVSSEGGAKPLNLPNDCDVVGYLAGHLLLTLRKDWHRANQSYPSGALVAVKLNRGELGAAQLLFAPDETQALESVETTKRFVVASLLENVQGRLKAWRFADSKWQEAELPHLPSGALEMTDQPWGGDVVYLAASDFTTPLTLFALDLNVMELTVMRLQPQQFVSDGIEVRQFWAVSSDGERIPYFHVGKNAAPDTPTLVYAYGGFGIPELPHYLGSVGKYWLEEGNAFVLANIRGGGEFGPRWHQAAQGISKHKSVDDLLAVVRDLSERGMSSPKHIGLQGGSNGGLITAAAFVREPQSIGALVCEVPLTDMIRYPLLSAGSSWTDEYGNPQKYEACKRRLGELSPYHNLSDGIDYPPALITTSLSDDRVHPAHALKFYAKLRETSPQSWLYSPDGGGHTGNGTQRESADKLACVLLFLKEFLG

SEQ ID NO: 161 - DNA, 2016 bp, Neisseria meningitidis
atgaaatcctaccccgacccctaccgccattttgaaaacctcgattccgccgaaacgcaaaacttcgctgctgaagcgaatgccgaaacgcgcgcgcgttttttagaaaacgacaaggcgcgcgcgctttcagacggcattttggcgcagttgcaggacacgcggcagattccgttttgtcaggaacaccgcgcgcggatgtaccatttccatcaggacgcggagtatccgaagggcgtgtaccgcgtgtgtaccgcggcgacgtatcgttccggctatcccgagtggaaaatcctgttttcggtggcggatttcgacgaattgcttggcgacgatgtgtatttgggcggcgtgtcgcacttggtggaacagcccaaccgcgcgttgttaacactgagcaaattgggcagcgatacggcgtacacgctggaagtggatttggaagcaggggagttggtcgaaggcggttttcactttccggcaggcaaaaaccatgtgtcgtggcgcgatgaaaacagcgtgtgggtgtgtccggcttggaacgaacgccagttgacccaatcgggctatccgcgcgaagtatggctggtggaacgcggcaagagtttcgaggaaagcctgcctgtgtatcaaatcggcgaagacggcatgatggtgaacgcgtggcgttatctcgatccgcagggttcgccgattgatttgattgaagcgtcggacggtttttacaccaaaacctatttgcgggtctcagccgaaggcgaggcgaaaccgttaaacctgcccaacgattgcgacgtggtcggctatctggcggggcatcttttgctgacgctgcgcaaggactggaaccgcgcgaaccaaagctatccgagcggcgcgctggtggcggtgaagctgaatcggggcgaactcggggcggcgcagcttttgtttgcgcccgatgaaacgcaggcattggaaagcgtggaaacgaccaagcgttttgtggtggcgagcctgttggagaacgtacaaggccgtctgaaagcatggcggtttgccgacggcaaatggcaggaagtcgaattgccgcgcctgccttcgggcgcgttggaaatgaccgaccaaccttggggcggcgacgtggtttaccttgccgccagcgatttcaccacgccgctgacgctgtttgcgctggatttgaacgtgatggaactgaccgtcatgcgccgccagccgcagcagtttgattcagacggcattaacgtgcagcagttttggacgacttcggctgacggcgagcgcattccttatttccacgtcggcaaaaacgccgcgcccgacatgccgacgctggtctatgcctacggcggtttcggcattcccgaattgccgcattatctgggcagcattggcaaatattggctggaagagggcaatgcctttgtattggcgaacatccgcggcggcggcgagttcggcccgcgctggcatcaggcggcgcagggaatcagcaaacataaaagcgttgatgatttattggcagtcgtgcgcgatttgtccgaacgcggtatcagttcgcccgaacacatcggcttgcagggcggcagcaacggcggactgattactgccgccgccttcgtgcgcgaaccgcaaagcatcggcgcgctggtgtgcgaagtgccgctgaccgacatgatccgttatccgctgctctccgccggttcaagctggacagacgaatacggcaatccgcaaaaatacgaagtctgcaaacgccggttgggcgaattgtcgccgtatcacaatctttcagacggcatcgattatccgcccgcgctcattaccaccagcctgtccgacgatcgcgtccatcccgcccacgcgctcaagttctacgccaaactgcgcgaaacctccgcgcaatcttggctctactcgcctgacggcggcggccataccggcaacggcacccaacgcgaatccgccgacgaactcgcctgcgtcttgctgtttttgaaagagtttttgggctaa

SEQ ID NO: 162 - protein, 671 aa, Neisseria meningitidis
MKSYPDPYRHFENLDSAETQNFAAEANAETRARFLENDKARALSDGILAQLQDTRQIPFCQEHRARMYHFHQDAEYPKGVYRVCTAATYRSGYPEWKILFSVADFDELLGDDVYLGGVSHLVEQPNRALLTLSKLGSDTAYTLEVDLEAGELVEGGFHFPAGKNHVSWRDENSVWVCPAWNERQLTQSGYPREVWLVERGKSFEESLPVYQIGEDGMMVNAWRYLDPQGSPIDLIEASDGFYTKTYLRVSAEGEAKPLNLPNDCDVVGYLAGHLLLTLRKDWNRANQSYPSGALVAVKLNRGELGAAQLLFAPDETQALESVETTKRFVVASLLENVQGRLKAWRFADGKWQEVELPRLPSGALEMTDQPWGGDVVYLAASDFTTPLTLFALDLNVMELTVMRRQPQQFDSDGINVQQFWTTSADGERIPYFHVGKNAAPDMPTLVYAYGGFGIPELPHYLGSIGKYWLEEGNAFVLANIRGGGEFGPRWHQAAQGISKHKSVDDLLAVVRDLSERGISSPEHIGLQGGSNGGLITAAAFVREPQSIGALVCEVPLTDMIRYPLLSAGSSWTDEYGNPQKYEVCKRRLGELSPYHNLSDGIDYPPALITTSLSDDRVHPAHALKFYAKLRETSAQSWLYSPDGGGHTGNGTQRESADELACVLLFLKEFLG

SEQ ID NO: 163 - DNA, 2016 bp, Neisseria meningitidis
atgaaatcctaccccgacccctaccgccattttgaaaacctcgattccgccgaaacgcaaaacttcgctgctgaagcgaatgccgaaacgcgcgcgcgttttttaaacaacgacaaggcacgcgcattgtctgacggcattttggcgcagttgcaggacacgcggcaaattccgttttgtcaggaacaccgcgcgcggatgtaccatttccatcaagatgcggaatatccgaaaggcgtgtaccgcgtgtgtaccgcggcgacttaccgttcgggctatcctgagtggaaaatcctgttttcggtggcggatttcgacgaattgctcggtgacgatgtatatctaggcggcgtgtcgcacctggtggaacagcccaaccgcgcgttgttaacactgagcaaatcgggcggcgataccgcgtacacgctggaagtggatttggaagcaggggagttggtagaaggcggttttcactttccggcaggcaaaaaccatgtgtcgtggcgcgatgaaaacagcgtgtgggtgtgtccggcttgggacgaacgccagttgaccgaatcgggctatccgcgcgaggtgtggctggtggaacgcggcaagagtttcgaggaaagcctgccggtgtaccaaattgctgaagacggcatgatggtgaacgcgtggcgttacctcgatccgcagggttcgccgattgatttgattgaagcgtctgacggtttttacaccaaaacctatttgcaggtctcagccgaaggcgaagcgaaaccgttaaacctgcccaacgattgcgacgtagtcggctatctggccggacatcttttgctgaccttgcgtaaagactggcaccgcgcgaaccaaagctatccgagtggcgcattggtagcagtaaaattaaaccgcggcgaattgggcgcggcgcagcttttgtttgcgcccaatgaaacgcaggcattggaaagcgtggaaacgaccaagcgttttgtcgtggcgagcctgctggaaaacgtacagggtcgtctgaaagcgtggcgttttactgatggcaaatggcaggaaaccgagttgccgcgcctgccttcgggcgcgttggaaatgaccgaccaaccgtgggggggcgacgtagtttaccttgccgccagcgatttcaccacgccgctgacgctgtttgcattggatttgaacgtgatggaactgaccgtcatgcgccgccagccgcagcagtttgattcagacggcattaacgtgcagcagttttggacgacttcggctgacggcgagcgcattccttatttccacgtcggcaaaaacgccgcgcccgacatgccgacgctggtctatgcctacggcggtttcggcattcccgaattgccgcattatctgggcagcattggcaaatattggctggaagagggcaatgcctttgtattggcgaacatccgcggcggcggcgagttcggcccgcgctggcatcaggcggcgcagggaatcagcaaacataaaagcgttgatgatttattggcagtcgtgagcgatttgtccgaacgcggtatcagttcgcccgaacacatcggcttgcagggcggcagcaacggcggactgattactgccgccgccttcgtgcgcgaaccgcaaagcataggcgcgctggtgtgcgaagtgccgctgaccgacatgatccgttatccgctgctctccgccggttcaagctggacagacgaatacggcaatccgcaaaaatacgaagtctgcaaacgccggttgggcgaattgtcgccgtatcacaatctttcagacggcatcgattatccgcccgcgctcattaccaccagcctgtccgacgatcgcgtccatcccgcccacgcgctcaagttctacgccaaactgcgcgaaacctcgccgcaatcttggctctactcgcctgacggcggcggccataccggcaacggcacgcagcgcgaagccgccgacgaactcgcctgcgtgttgctgtttttgaaagagtttttgggctaa

SEQ ID NO: 164 - protein, 671 aa, Neisseria meningitidis
MKSYPDPYRHFENLDSAETQNFAAEANAETRARFLNNDKARALSDGILAQLQDTRQIPFCQEHRARMYHFHQDAEYPKGVYRVCTAATYRSGYPEWKILFSVADFDELLGDDVYLGGVSHLVEQPNRALLTLSKSGGDTAYTLEVDLEAGELVEGGFHFPAGKNHVSWRDENSVWVCPAWDERQLTESGYPREVWLVERGKSFEESLPVYQIAEDGMMVNAWRYLDPQGSPIDLIEASDGFYTKTYLQVSAEGEAKPLNLPNDCDVVGYLAGHLLLTLRKDWHRANQSYPSGALVAVKLNRGELGAAQLLFAPNETQALESVETTKRFVVASLLENVQGRLKAWRFTDGKWQETELPRLPSGALEMTDQPWGGDVVYLAASDFTTPLTLFALDLNVMELTVMRRQPQQFDSDGINVQQFWTTSADGERIPYFHVGKNAAPDMPTLVYAYGGFGIPELPHYLGSIGKYWLEEGNAFVLANIRGGGEFGPRWHQAAQGISKHKSVDDLLAVVSDLSERGISSPEHIGLQGGSNGGLITAAAFVREPQSIGALVCEVPLTDMIRYPLLSAGSSWTDEYGNPQKYEVCKRRLGELSPYHNLSDGIDYPPALITTSLSDDRVHPAHALKFYAKLRETSPQSWLYSPDGGGHTGNGTQREAADELACVLLFLKEFLG

SEQ ID NO: 165 - DNA, 606 bp, Neisseria gonorrhoeae
atgacgatgatttgcttgcgcttccaagcgttcgtgccgcataccagcgcgttatccaacacttccacggcagccggcccttcctgcccgatggcggcggtgcggtcgatgatgaaaatccagccggggtttttctctttgatgtattcgaaggaaacgggctgcccgtgcccttcgttgcgtaaagattcgtccacgggcggcaggccgatgtcgccgtgtatccaacttgccaaccgcgattgcgtgccgaaggcggacaccttgttgcctgtaaccgacagcaccagcccgcgtcctttgcctttggcggcttcgcgcttttgggcgaacagcgcgtcaatctgcgcattcaattccgccacgcgcgcttccttaccgaaaatccgcgacagggtctccatctgcttctcgccgctggtgcggatattgccgttgtccaccgtcaaatctatggtggtcgcgtttttcgccaactgttcatacgcttccgcacccggcccgccggtaatgacaaactgcggattgtggcggtgcagggattcgcaatcgggctcaaacagcgtccccaccgttgccgccttgtcaaatgcaggctgcaaatag

SEQ ID NO: 166 - protein, 201 aa, Neisseria gonorrhoeae
MTMICLRFQAFVPHTSALSNTSTAAGPSCPMAAVRSMMKIQPGFFSLMYSKETGCPCPSLRKDSSTGGRPMSPCIQLANRDCVPKADTLLPVTDSTSPRPLPLAASRFWANSASICAFNSATRASLPKIRDRVSICFSPLVRILPLSTVKSMVVAFFANCSYASAPGPPVMTNCGLWRCRDSQSGSNSVPTVAALSNAGCK

SEQ ID NO: 167 - DNA, 606 bp, Neisseria meningitidis
atgacgatgatttgcttgcgcttccaagcgttcgtgccgcgtaccagcgcgttatccamtacttcgacagccgccggccyttcytgcccgatggcggcggtacggtcgatgatgaaaatccaatcggggtttttctctttgatgtattcgaaggaaacaggctgcccgtgcccctcgttgcgtaaagattcgtctacaggcggtaggccgatgtcgccgtgtatccaacttgccaaccgcgactgcgtgccgaaggcggacaccttgttgcccgtaaccgacagcaccagcccgcgtcctttgcctttggcggcttcgcgcgtttgggcgaacagcgcgtcaatctgcgccttcaattccgccgcgcgcgcttccttgccgaaaatccgcgccaaggtctccatctgcttttcgccgctggtgcggatattgccgttgtccaccgtcagatctatggtggtcgcgtttttcgctaactgttcatacgcttccgcgcccggcccgccggtaatgacaagctgaggattgtagcggtgcagggcttcgtaatcgggctcgaacagcgtccccaccgttgccgccttgtcaaatgcaggctgcaaataa

SEQ ID NO: 168 - protein, 201 aa, Neisseria meningitidis
  misc_feature (20)..(20): Xaa can be any naturally occurring amino acid
  misc_feature (27)..(27): Xaa can be any naturally occurring amino acid
  misc_feature (174)..(174): Xaa can be any naturally occurring amino acid
  misc_feature (177)..(177): Xaa can be any naturally occurring amino acid
  misc_feature (183)..(183): Xaa can be any naturally occurring amino acid
MTMICLRFQAFVPRTSALSXTSTAAGXSCPMAAVRSMMKIQSGFFSLMYSKETGCPCPSLRKDSSTGGRPMSPCIQLANRDCVPKADTLLPVTDSTSPRPLPLAASRVWANSASICAFNSAARASLPKIRAKVSICFSPLVRILPLSTVRSMVVAFFANCSYASAPGPPVMTSXGLXRCRASXSGSNSVPTVAALSNAGCK

SEQ ID NO: 169 - DNA, 606 bp, Neisseria meningitidis
atgacgatgatttgcttgcgcttccaagcgttcgtgccgcgtaccagcgcgttatccaatacttcgacagccgccggcccttcctgcccgatggcggcggtacggtcgatgatgaaaatccaatcggggtttttctctttgatgtattcgaaggaaacaggctgcccgtgcccctcgttgcgtaaagattcgtctacaggcggtaggccgatgtcgccgtgtatccaacttgccaaccgcgactgcgtgccgaaggcggacaccttgttgcccgtaaccgacagcaccagcccgcgtcctttgcctttggcggcttcgcgcgtttgggcgaacagcgcgtcaatctgcgccttcaattccgccgcgcgcgcttccttgccgaaaatccgcgccaaggtctccatctgcttttcgccgctggtgcggatattgccgttgtccaccgtcagatctatggtggtcgcgtttttcgccaactgttcatacgcttccgcgcccggcccgccggtaatgacaagctgaggattgtagcggtgcagggcttcgtaatcgggctcgaacagcgtccccaccgttgccgccttgtcaaatgcaggctgcaaataa

SEQ ID NO: 170 - protein, 198 aa, Neisseria meningitidis
MTMICLRFQAFVPRTSALSNTSTAAGPSCPMAAVRSMMKIQSGFFSLMYSKETGCPCPSLRKDSSTGGRPMSPCIQLANRDCVPKADTLLPVTDSTSPRPLPLAASRVWANSASICAFNSAARASLPKIRAKVSICFSPLVRILPLSTVRSMVVAFFANCSYASAPGPPVMTSGLRCRASSGSNSVPTVAALSNAGCK

SEQ ID NO: 171 - DNA, 511 bp, Neisseria meningitidis
atgacgatgatttgcttgcgcttccaagcgttcgtgccgcgtaccagcgcgttatccaatacttcgacagccgccggcccttcctgcccgatggcggcggtacggtcgatgatgaaaatccaatcggggtttttctctttgatgtattcgaaggaaacaggctgcccgtgcccctcgttgcgtaaagattcgtctacaggcggtaggccgatgtcgccgtgtatccaacttgccaaccgcgactgcgtgccgaaggcggacaccttgttgcccgtaaccgacagcaccagcccgcgtcctttgcctttggcggcttcgcgcgtttgggcgaacagcgcgtcaatctgcgccttcaattccgccgcgcgcgcttccttgccgaaaatccgcgccaaggtctccatctgcttttcgccgctggtgcggatattgccgttgtccaccgtcagatctatggtggtcgcgtttttcgctaactgttcatacgcttccgcgcccggcccgccggtaa

SEQ ID NO: 172 - protein, 173 aa, Neisseria meningitidis
MTMICLRFQAFVPRTSALSNTSTAAGPSCPMAAVRSMMKIQSGFFSLMYSKETGCPCPSLRKDSSTGGRPMSPCIQLANRDCVPKADTLLPVTDSTSPRPLPLAASRVWANSASICAFNSAARASLPKIRAKVSICFSPLVRILPLSTVRSMVVAFFANCSYASAPGPPVMTS

SEQ ID NO: 173 - DNA, 511 bp, Neisseria meningitidis
atgacgatgatttgcttgcgcttccaagcgttcgtgccgcgtaccagcgcgttatccaatacttcgacagccgccggcccttcctgcccgatggcggcggtacggtcgatgatgaaaatccaatcggggtttttctctttgatgtattcgaaggaaacaggctgcccgtgcccctcgttgcgtaaagattcgtctacaggcggtaggccgatgtcgccgtgtatccaacttgccaaccgcgactgcgtgccgaaggcggacaccttgttgcccgtaaccgacagcaccagcccgcgtcctttgcctttggcggcttcgcgcgtttgggcgaacagcgcgtcaatctgcgccttcaattccgccgcgcgcgcttccttgccgaaaatccgcgccaaggtctccatctgcttttcgccgctggtgcggatattgccgttgtccaccgtcagatctatggtggtcgcgtttttcgccaactgttcatacgcttccgcgcccggcccgccggtaa

SEQ ID NO: 174 - protein, 173 aa, Neisseria meningitidis; identical to SEQ ID NO: 172

SEQ ID NO: 175 - DNA, 387 bp, Neisseria gonorrhoeae
atggttgtttcaaatcaaaatatctatgccgtcggcccatcagcactttttcacatccgaaggcaaaaatccgtaatgccgcctgaacgcttcgttgaaccgtcccgcgtggcggtagccgcaaaagtgcatcgcggcttggatggtgctgcccgattcgatgagggcgagcgcgtgttccagccgcaggcggcgcaggcgtccggcgacggtttcgccggtttgcgctttgaaatagcgtttcaggtagcattcgttcagcccgacgcggcgggcgatttcggcgatggtcagcgggcgggcgaattcgctgttcaaaatatcggcggcttcgtctatgcgccggcggcggtagccgttgtcgtggcggcggaaggtgaagcgtaa

SEQ ID NO: 176 - protein, 128 aa, Neisseria gonorrhoeae
MVVSNQNIYAVGPSALFHIRRQKSVMPPERFVEPSRVAVAAKVHRGLDGAARFDEGERVFQPQAAQASGDGFAGLRFEIAFQVAFVQPDAAGDFGDGQRAGEFAVQNIGGFVYAPAAVAVVVAAEGEA

SEQ ID NO: 177 - DNA, 390 bp, Neisseria meningitidis
atggttgtttcaaatcaaaatatctatgccgccggcccctcagcacttcttcacatccgaaggcaaaaatccgtaatgccgtctgaacgcttcgttgaaccgtcccgcgtggcggtagccgcaaaagtgcatggcggcttggacggtgctgccggattcgatgagggcgagcgcgtgttccagccgcaggcggcgcaggcatccggcgacggtttcgccggtttgcgctttgaaatagcgtttcaggtagcattcgttcagtccgacgcggcgggcgatttcggcgatggtcagcggacgggcgaattcgtgttgcaggatgtcggcggcttcgtctatgcgccgacggcggtaaccgttgtcgtggcggcggaaggtgaagcgcaataa

SEQ ID NO: 178 - protein, 129 aa, Neisseria meningitidis
MVVSNQNIYAAGPSALLHIRRQKSVMPSERFVEPSRVAVAAKVHGGLDGAAGFDEGERVFQPQAAQASGDGFAGLRFEIAFQVAFVQSDAAGDFGDGQRTGEFVLQDVGGFVYAPTAVTVVVAAEGEAQ

SEQ ID NO: 179 - DNA, 390 bp, Neisseria meningitidis; identical to SEQ ID NO: 177

SEQ ID NO: 180 - protein, 129 aa, Neisseria meningitidis; identical to SEQ ID NO: 178

SEQ ID NO: 181 - DNA, 270 bp, Neisseria gonorrhoeae
atgctgcccgaccagagcgtcgagttcttgccacaagtcgtcgtttttgacgggctgtttggcggcggttttccagccgttgcgcttccaaccgtgtatccagttttccatgccgtttttgacgtattgcgagtcggtgcagatgatgacggtgcagcggcgtttgagcgatttcagcccttcgataacggcggtcagctccatgcggttgttggtggtttgcgcttcgccgccgaaaagttctttttcgcggctgccgtagcgcattaa

SEQ ID NO: 182 - protein, 89 aa, Neisseria gonorrhoeae
MLPDQSVEFLPQVVVFDGLFGGGFPAVALPTVYPVFHAVFDVLRVGADDDGAAAFERFQPFDNGGQLHAVVGGLRFAAEKFFFAAAVAH

SEQ ID NO: 183 - DNA, 270 bp, Neisseria meningitidis
atgccgtccgactagagcgtcgagttctttccagaagtcgtcgtttttgacgggctgtttggaggcggttttccagccgttgcgcttccaaccgtgtatccagttttccatgccatttttgacgtattgcgagtcggtgcagatgatgacggtgcagcggcgtttgagcgatttcagtccttcgatgacggcagtcagttccatgcggttgttggtggtttgcgcttcgccgccgaaaagttctttttcgtggctaccgtagcgcaytaa

SEQ ID NO: 184 - protein, 89 aa, Neisseria meningitidis
  misc_feature (5)..(5): Xaa can be any naturally occurring amino acid
MPSDXSVEFFPEVVVFDGLFGGGFPAVALPTVYPVFHAIFDVLRVGADDDGAAAFERFQSFDDGSQFHAVVGGLRFAAEKFFFVATVAH

SEQ ID NO: 185 - DNA, 270 bp, Neisseria meningitidis
gtgccgtccgaccagcgcgtcgagttctttccacaagtcgtcgtttttgacgggctgtttggcggcggttttccagccgttgcgcttccaaccgtgtatccagttttccatgccgtttttgacgtattgcgagtcggtgcagatgatgacggtgcagcggcgtttgagcgatttcagtccttcgatgacggcggtcagttccatacggttgttggtggtttgcgcttcgccgccgaaaagttctttttcgtggctgccgtagcgcattaa

SEQ ID NO: 186 - protein, 89 aa, Neisseria meningitidis
VPSDQRVEFFPQVVVFDGLFGGGFPAVALPTVYPVFHAVFDVLRVGADDDGAAAFERFQSFDDGGQFHTVVGGLRFAAEKFFFVAAVAH

SEQ ID NO: 187 - DNA, 561 bp, Neisseria gonorrhoeae
atgtcggcaatgctgcgtccgacaagcagcccgccgcgccgcgcctgtatgatgaccatccgcacgcggtcgtctgcaaaacgtaaaacctgcaatgcgcccgggcagtctatcaggccggcaagctgttcggtaacgagctgttcggggctgatggtttcggttatgccgaatatggaaaggctgccgttttcgttgttttcgagcttggggctgaggtattcgaggtattcgctggaacggacgcgcgcgatgcggccggggatgttgaacaggtcggcggcaactttgcaggcgacgatgttggtttcgtcgctgcgggagagcgcgagcagcaagtcggcatcttccgcgccggcgcgttataatgtgaagggggatgcgccgttgccgaaaacggtttggacatcgaggcggctgcctgtttcctgcaatgctttttcgtcgatgtcgataacggttacgtcgttgttggtgatggcggcaaggttttgcgcgacggtagaacctacctgcccgttgcctaaaatgaggattttcacggtatgggtcgccgggtga

SEQ ID NO: 188 - protein, 186 aa, Neisseria gonorrhoeae
MSAMLRPTSSPPRRACMMTIRTRSSAKRKTCNAPGQSIRPASCSVTSCSGLMVSVMPNMERLPFSLFSSLGLRYSRYSLERTRAMRPGMLNRSAATLQATMLVSSLRESASSKSASSAPARYNVKGDAPLPKTVWTSRRLPVSCNAFSSMSITVTSLLVMAARFCATVEPTCPLPKMRIFTVWVAG

SEQ ID NO: 189 - DNA, 559 bp, Neisseria meningitidis
atgtcggcaatgctgcgtccgacaagcastccgcrsgcgcgcctgtatgatgaccatccgcacgcggtcgtctgcaaaacgtaaaacctgcaatgcgcccgggcagtctatcaggccggcaagctgttcggtaacgagctgttcggggctgatggtttcggttatgccgaatatggaaaggctgccgttttcgttgttttcgagcttggggctgaggtattcgaggtattcgctggaacggacgcgcgcgatgcggccggggatgttgaacaggtcggcggcaactttgcaggcgacgatgttggtttcgtcgctgcgggagagcgcgagcagcaagtcggcatcttccgcgccggcgcgttctaatgtgaagggggatgcgccgttgccgaaaacggtttggacatcgaggcggctgcctgtttcctgcaatgctttttcgtcgatgtcgataacggttacgtcgttgttgggtatggcggcaaggttttgtgcgacggtagaacctacctgtccgttgcctaaaatgaggattttcacggtgtgggtcgccgagtga

SEQ ID NO: 190 - protein, 186 aa, Neisseria meningitidis
  misc_feature (10)..(10): Xaa can be any naturally occurring amino acid
  misc_feature (12)..(13): Xaa can be any naturally occurring amino acid
MSAMLRPTSXPXXRACMMTIRTRSSAKRKTCNAPGQSIRPASCSVTSCSGLMVSVMPNMERLPFSLFSSLGLRYSRYSLERTRAMRPGMLNRSAATLQATMLVSSLRESASSKSASSAPARSNVKGDAPLPKTVWTSRRLPVSCNAFSSMSITVTSLLGMAARFCATVEPTCPLPKMRIFTVWVAE

SEQ ID NO: 191 - DNA, 561 bp, Neisseria meningitidis
atgtcggcaatgctgcgtccgacaagcagtccgccgcgccgcgcctgtatgatgaccatccgcacgcggtcgtctgcaaaacgtaaaacctgcaatgcgcccgggcagtctatcaggccggcaagctgttcggtaacgagctgttcggggctgatggtttcggttatgccgaatatggaaaggctgccgttttcgttgttttcgagcttggggctgaggtattcgaggtattcgctggaacggacgcgcgcgatgcggccggggatgttgaacaggtcggcggcaactttgcaggcgacgatgttggtttcgtcgctgcgggagagcgcgagcagcaagtcggcatcttccgcgccggcgcgttctaatgtgaagggggatgcgccgttgccgaaaacggtttggacatcgaggcggctgcctgtttcctgcaatgctttttcgtcgatgtcgataacggttacgtcgttgttgggtatggcggcaaggttttgtgcgacggtagaacctacctgtccgttgcctaaaatgaggattttcacggtgtgggtcgccgagtga

SEQ ID NO: 192 - protein, 186 aa, Neisseria meningitidis
MSAMLRPTSSPPRRACMMTIRTRSSAKRKTCNAPGQSIRPASCSVTSCSGLMVSVMPNMERLPFSLFSSLGLRYSRYSLERTRAMRPGMLNRSAATLQATMLVSSLRESASSKSASSAPARSNVKGDAPLPKTVWTSRRLPVSCNAFSSMSITVTSLLGMAARFCATVEPTCPLPKMRIFTVWVAE

SEQ ID NO: 193 - DNA, 930 bp, Neisseria gonorrhoeae
atggtcatcatacaggcgcggcgcggcgggctgcttgtcggacgcagcattgccgacatcgcccaagatttgcccgacggggccgactgccaaatctgcgccgtttaccgcaacaaccgcctcatcgtccccgcgccgcaaaccgtcatcatcgaaggcgacgaaatcctgtttgccgccgccgccgaaaacatcggggcggtcatacccgaattgcgccccaaagaaaccagcacccgccgcatcatgattgccggcggcggcaacatctgctaccgcctcgccaagcagctcgaacacgcatacaacgtcaaaatcatcgaatgccggccgcgccgtgccgaatggatagccgaaaacctcgacaacaccctcgtcctgcaaggttcggcaaccgacgaaaccctgctcgacaacgaatacatcgacgaaatcgacgtattctgcgccctgaccaacgacgacgaaagcaacattatgtccgcccttttggcgaaaaacctcggcgcgaagcgcgtcatcggcatcgtcaaccgctcaagctacgtcgatttgctcgaaggcaacaaaatcgacatcgtcgtctccccccacctcatcaccatcggctcgatactcgcccacatccggcgcggcgacatcgttgccgtccaccccatccggcgcggcacggcggaagccatcgaagtcgtcgcgcacggcgacaaaaaaacttccgccatcatcggcaggcgcatcagcggcatcaaatggcccgaaggctgccacattgccgccgtcgtccgcgccggaaccggcgaaaccattatgggacaccataccgaaaccgtcatccaagacggtgaccacatcatctttttcgtctcgcgccggcgcatcctgaacgaactggagaaactcatccaagtcaaaatgggctttttcggataa

SEQ ID NO: 194 - protein, 309 aa, Neisseria gonorrhoeae
MVIIQARRGGLLVGRSIADIAQDLPDGADCQICAVYRNNRLIVPAPQTVIIEGDEILFAAAAENIGAVIPELRPKETSTRRIMIAGGGNICYRLAKQLEHAYNVKIIECRPRRAEWIAENLDNTLVLQGSATDETLLDNEYIDEIDVFCALTNDDESNIMSALLAKNLGAKRVIGIVNRSSYVDLLEGNKIDIVVSPHLITIGSILAHIRRGDIVAVHPIRRGTAEAIEVVAHGDKKTSAIIGRRISGIKWPEGCHIAAVVRAGTGETIMGHHTETVIQDGDHIIFFVSRRRILNELEKLIQVKMGFFG

SEQ ID NO: 195 - DNA, 937 bp, Neisseria meningitidis
atggtcatcatacaggcgcgcsygcggastgcttgtcggacgcagcattgccgacatcgcccaagatttgcccgacggggccgactgccaaatctgcgccgtttaccgcaacaaccgcctcatcgtccccgcgccgcaaaccgtcatcatcgaaggcgacgaaatcctatttgccgccgccgccgaaaacatcggcgcggtcatacccgaattgcgccccaaagaaacccaaagaaaccagcccmgmmgcatcatgattkccggcggcggcaacatcggctaccgtctcgccaagcagctcgaacacgcatacaacgtyaaaatcatcgaatgccggccgcgccgtgccgaatggatagccgaaaacctcgacaacaccctcgtcytgcaaggttcggcaaccgacgaaaccctgctcgacaacgaatacatcgacgaaatcgacgtattctgcgccctgaccaacgacgacgaaagcaacattatgtccgcccttttggcgaaaaacctcggcgcgaagcgcgtcatcggcatcgtcaaccgctcaagctacgtcgatttgctcgaaggcaacaaaatcgacatcgtcgtctccccccacctcatcaccatcggctcgatactcgcccacatccggcgcggcgacatcgttgccgtccaccccatccggcgcggcacggcggaagccatcgaagtcgtcgcacacggcgacaaaaaaacttccgccatcatcggcaggcgcatcagcggcatcaaatggcccgaaggctgccacattgccgccgtcgtccgcgccggaaccggcgaaaccattatgggacaccataccgaaaccgtcatccaagacggcgaccacatcatctttttcgtctcgcgccggcgcatcctgaacgaactggaaaaactcatccaggtcaaaatgggctttttcggataa

SEQ ID NO: 196 - protein, 312 aa, Neisseria meningitidis
  misc_feature (8)..(9): Xaa can be any naturally occurring amino acid
  misc_feature (11)..(11): Xaa can be any naturally occurring amino acid
  misc_feature (83)..(84): Xaa can be any naturally occurring amino acid
  misc_feature (88)..(88): Xaa can be any naturally occurring amino acid
MVIIQARXXGXLVGRSIADIAQDLPDGADCQICAVYRNNRLIVPAPQTVIIEGDEILFAAAAENIGAVIPELRPKETQRNQPXXIMIXGGGNIGYRLAKQLEHAYNVKIIECRPRRAEWIAENLDNTLVLQGSATDETLLDNEYIDEIDVFCALTNDDESNIMSALLAKNLGAKRVIGIVNRSSYVDLLEGNKIDIVVSPHLITIGSILAHIRRGDIVAVHPIRRGTAEAIEVVAHGDKKTSAIIGRRISGIKWPEGCHIAAVVRAGTGETIMGHHTETVIQDGDHIIFFVSRRRILNELEKLIQVKMGFFG

SEQ ID NO: 197 - DNA, 930 bp, Neisseria meningitidis
atggtcatcatacaggcgcggcgcggcggactgcttgtcggacgcagcattgccgacatcgcccaagatttgcccgacggggccgactgccaaatctgcgccgtttaccgcaacaaccgcctcatcgtccccgcgccgcaaaccgtcatcatcgaaggcgacgaaatcctatttgccgccgccgccgaaaacatcggcgcggtcatacccgaattgcgccccaaagaaaccagcacccgccgcatcatgattgccggcggcggcaacatcggctaccgtctcgccaagcagctcgaacacgcatacaacgtcaaaatcatcgaatgccggccgcgccgtgccgaatggatagccgaaaacctcgacaacaccctcgtcctgcaaggttcggcaaccgacgaaaccctgctcgacaacgaatacatcgacgaaatcgacgtattctgcgccctgaccaacgacgacgaaagcaacattatgtccgcccttttggcgaaaaacctcggcgcgaagcgcgtcatcggcatcgtcaaccgctcaagctacgtcgatttgctcgaaggcaacaaaatcgacatcgtcgtctccccccacctcatcaccatcggctcgatactcgcccacatccggcgcggcgacatcgttgccgtccaccccatccggcgcggcacggcggaagccatcgaagtcgtcgcacacggcgacaaaaaaacttccgccatcatcggcaggcgcatcagcggcatcaaatggcccgaaggctgccacattgccgccgtcgtccgcgccggaaccggcgaaaccattatgggacaccataccgaaaccgtcatccaagacggcgaccacatcatctttttcgtctcgcgccggcgcatcctgaacgaactggaaaaactcatccaagtcaaaatgggctttttcggataa

SEQ ID NO: 198 - protein, 309 aa, Neisseria meningitidis
MVIIQARRGGLLVGRSIADIAQDLPDGADCQICAVYRNNRLIVPAPQTVIIEGDEILFAAAAENIGAVIPELRPKETSTRRIMIAGGGNIGYRLAKQLEHAYNVKIIECRPRRAEWIAENLDNTLVLQGSATDETLLDNEYIDEIDVFCALTNDDESNIMSALLAKNLGAKRVIGIVNRSSYVDLLEGNKIDIVVSPHLITIGSILAHIRRGDIVAVHPIRRGTAEAIEVVAHGDKKTSAIIGRRISGIKWPEGCHIAAVVRAGTGETIMGHHTETVIQDGDHIIFFVSRRRILNELEKLIQVKMGFFG

SEQ ID NO: 199 - DNA, 453 bp, Neisseria gonorrhoeae
atgctcgacaaaggcgaggagttgcccgtcgatttcaccaaccgcctgatttactacgtcggccccgtcgatccggtcggcgatgaagtcgtcggtcccgcaggtccgaccacagccacccgcatggacaaatttacccgccaaatgctcaaacaaaccggcctcttgggcatgatcggcaaatccgagcgcggcgcggccacctgcgaagccatcgccgacaacaaggccgtgtacctcatggcagtcggcggcgcggcatacctcgtggcaaaagccatcaaatcttccaaagtcttggcgttccccgaattgggtatggaagccgtttacgaatttgaagtcaaagatatgcccgtaaccgtcgccgtggacagcaaaggcgaatccatccacgccaccgccccgcgcaaatggcaggcgaaaatcggcatcatccccgtcgagtcttga

SEQ ID NO: 200 - protein, 150 aa, Neisseria gonorrhoeae
MLDKGEELPVDFTNRLIYYVGPVDPVGDEVVGPAGPTTATRMDKFTRQMLKQTGLLGMIGKSERGAATCEAIADNKAVYLMAVGGAAYLVAKAIKSSKVLAFPELGMEAVYEFEVKDMPVTVAVDSKGESIHATAPRKWQAKIGIIPVES

SEQ ID NO: 201 - DNA, 453 bp, Neisseria meningitidis
atgctcaacaaaggcgaagaattgcccgtcgatttcaccaaccgcctgatttactacgtcggccccgtcgatccggtcggcgatgaagtcgtcggtccggcaggtccgaccacagccacccgcatggacaaattcacccgccaaatgctcgaacaaaccgacctcttgggcatgatcggcaaatccgagcgcggcgtggccacctgcgaagccatcgccgacaacaaagccgtgtacctcatggcagtcggcggcgcggcgtatctcgtggcaaaagccatcaaatcttccaaagtcttggcgttccccgaattgggcatggaagccatttacgaatttgaagtcaaagacatgcccgtaaccgtcgccgtagatagcaaaggcgaatccatccacgccaccgccccgcgcaaatggcaggcgaaaatcggcatcatccccgtcgaatcttga

SEQ ID NO: 202 - protein, 150 aa, Neisseria meningitidis
MLNKGEELPVDFTNRLIYYVGPVDPVGDEVVGPAGPTTATRMDKFTRQMLEQTDLLGMIGKSERGVATCEAIADNKAVYLMAVGGAAYLVAKAIKSSKVLAFPELGMEAIYEFEVKDMPVTVAVDSKGESIHATAPRKWQAKIGIIPVES

SEQ ID NO: 203 - DNA, 453 bp, Neisseria meningitidis
atgctcgacaaaggcgaagaattgcccgtcgatttcaccaaccgcctgatttactacgtcggccccgtcgatccggtcggcgacgaaatcgtcggcccagcaggtccgaccaccgccacccgcatggacaaattcacccgccaaatgctcgaacaaaccgacctcttgggcatgatcggcaaatccgagcgcggcgcggccacctgcgaagccatcgccgacaacaaagccgtgtacctcatggcagtcggcggcgcggcgtatctcgtggcaaaagccatcaaatcttccaaagtcttggcgttccccgaattgggcatggaagccatttacgaatttgaagtcaaagacatgcccgtaaccgtcgccgtagacagcaaaggcgaatccatccacgccaccgccccgccccaatggcaggcgaaaatcggcatcatccccgtcaaatcttga

SEQ ID NO: 204 - protein, 150 aa, Neisseria meningitidis
MLDKGEELPVDFTNRLIYYVGPVDPVGDEIVGPAGPTTATRMDKFTRQMLEQTDLLGMIGKSERGAATCEAIADNKAVYLMAVGGAAYLVAKAIKSSKVLAFPELGMEAIYEFEVKDMPVTVAVDSKGESIHATAPPQWQAKIGIIPVKS

SEQ ID NO: 205 - DNA, 420 bp, Neisseria gonorrhoeae
atgcgggcgcaggcgtttgatcaaccgttcggtcagctcctgttcggacaggcagaacacttcgcgccggttgacggctttcgggttcaggatattgatttggacgggcatcaacgcctcttccgcaccgccttcgccgttttccgcaaccccgtctgccgccgtaccggattctgccgcatcggcgttttccccgccctcaatctgtgcggtttcaaattcggcactgtcttttttggcatcgaaccggattctccgccgcgattcgatgtgtttttccgaaaccggcatttgcagggaagcctgcgcgttgagccagttttcctgaaggacgatcatcgggtcggtttcgacttcctcgccgcaatcggcaacggcgctgttgtgttcttcctgccatttcttcagatacgcctttaa

SEQ ID NO: 206 - protein, 139 aa, Neisseria gonorrhoeae
MRAQAFDQPFGQLLFGQAEHFAPVDGFRVQDIDLDGHQRLFRTAFAVFRNPVCRRTGFCRIGVFPALNLCGFKFGTVFFGIEPDSPPRFDVFFRNRHLQGSLRVEPVFLKDDHRVGFDFLAAIGNGAVVFFLPFLQIRL

SEQ ID NO: 207 - DNA, 417 bp, Neisseria gonorrhoeae
atgcgggcgcaggcgtttgatcagccgttcggtcagctcctgttcggacaggcagaacacttcgcgccggttgacggctttcgggttcaggatattgatttggacgggcatcaacgtttcttccgcatcgttttccccgttttccgaaaccgccggctcattcgtgccggattctgcctcgtcggcgttttccccgctttcaatctgtccggtttcaaattcgacactgtcttttttggtatcaaaccggattctccgccgcgattcgatgtgtttttccgaaaccgacatttgcagggaagcctgcgcgttgagccagttttcctgaaggacgatcatcgggtcggtttcgacttcctcgccgcaatcggcaacggcggcattgtgttcctcctgccattttttcagatacgcctt

SEQ ID NO: 208 - protein, 139 aa, Neisseria meningitidis
MRAQAFDQPFGQLLFGQAEHFAPVDGFRVQDIDLDGHQRFFRIVFPVFRNRRLIRAGFCLVGVFPAFNLSGFKFDTVFFGIKPDSPPRFDVFFRNRHLQGSLRVEPVFLKDDHRVGFDFLAAIGNGGIVFLLPFFQIRL

SEQ ID NO: 209 - DNA, 417 bp, Neisseria meningitidis
atgcgggcgcaggcgtttgatcagccgttcggtcagctcctgttcggacaggcagaacacttcgcgccggttgacggctttcgggttcagaatattgatttggacgggcatcaacgcttcttccgcaccgccttcgccgttttccgcaaccccgtctgccgccgtacccgattctgccgcatcggcgttttccccgccttcaatctgtccggtttcaaattcggcactgtcttttttggcatcaaaccggattctccgccgcgattcgatgtgtttttccgaaaccgacatttgcagggaagcctgcgcgttgagccagttttcctgaaggacgatcatcgggtcggtttcgacttcctcgccgcaatcggcaacggcggcattgtgttcctcctgccattttttcagatacgcctt

SEQ ID NO: 210 - protein, 139 aa, Neisseria meningitidis
MRAQAFDQPFGQLLFGQAEHFAPVDGFRVQNIDLDGHQRFFRTAFAVFRNPVCRRTRFCRIGVFPAFNLSGFKFGTVFFGIKPDSPPRFDVFFRNRHLQGSLRVEPVFLKDDHRVGFDFLAAIGNGGIVFLLPFFQIRL

SEQ ID NO: 211 - DNA, 384 bp, Neisseria gonorrhoeae
atgggcgcgggctggtgtcctcccggcatcttgggcatcggcatcggcggcacgcccgaaaaagccgtgttgatggcaaaagaatccctgatgagccacatcgacatccaagaattgcaggaaaaagccgcgtccggggcggaattgtccaccaccgaagccctgcgcctcgaactctttgaaaaggtcaacgcgctgggcatcggcgcgcaaggcttgggcggtctgaccaccgtgttggacgtgaaaatcctcgattacccgacccatgccgcctccaaaccgattgccatgattcccaactgtgccgccacccgccacgtcgaatttgaattggacggctcaggtcctgtcgaactcacgccgccgcgtgtcgaagactga

SEQ ID NO: 212 - protein, 127 aa, Neisseria gonorrhoeae
MGAGWCPPGILGIGIGGTPEKAVLMAKESLMSHIDIQELQEKAASGAELSTTEALRLELFEKVNALGIGAQGLGGLTTVLDVKILDYPTHAASKPIAMIPNCAATRHVEFELDGSGPVELTPPRVED

SEQ ID NO: 213 - DNA, 298 bp, Neisseria meningitidis
atgggcgcgggctggtgtcctcccggcatcttgggtatcggcatcggcggcagccgaaaaagccgtgctgatggcaaaagagtccctgatgagccacatcgacattcaagaattgcaggaaaaggccgcgtccggcgcggaattgtccaccaccgaagccctgcgcctcgaactctttgaaaaagtcaacgcgctgggcatcggcgcacaaggcttgggcggactgaccaccgtgttggacgtgaaaatcctcgattatccgacccacgccgcctccaaaccgattgccatgattccg

SEQ ID NO: 214 - protein, 130 aa, Neisseria meningitidis
  misc_feature (18)..(18): Xaa can be any naturally occurring amino acid
MGAGWCPPGILGIGIGGXAEKAVLMAKESLMSHIDIQELQEKAASGAELSTTEALRLELFEKVNALGIGAQGLGGLTTVLDVKILDYPTHAASKPIAMIPNCAATRHVEFELDGSGPVELTPPRVEDGPI

SEQ ID NO: 215 - DNA, 387 bp, Neisseria meningitidis
atgggcgcgggctggtgtcctcccggcatcttgggcatcggcatcggcggtacgcccgaaaaagccgtgttgatggcgaaagaatccctgatgagccacatcgacatccaagaattgcaggaaaaagccgcgtccggcgcggaattgtccaccaccgaagccctgcgcctcgaactctttgaaaaagtcaacgcgctaggcatcggcgcgcaaggcttgggcggtctgaccaccgtgttggacgtgaaaatcctcgattacccgacccacgccgcctccaaaccgattgccatgattccgaactgcgccgccacccgccacgtcgaatttgaattggacggctcaggccctgtcgaactcacgccgccgcgcgtcgaagactggccc

SEQ ID NO: 216 - protein, 129 aa, Neisseria meningitidis
MGAGWCPPGILGIGIGGTPEKAVLMAKESLMSHIDIQELQEKAASGAELSTTEALRLELFEKVNALGIGAQGLGGLTTVLDVKILDYPTHAASKPIAMIPNCAATRHVEFELDGSGPVELTPPRVEDWP

SEQ ID NO: 217 - DNA, 1524 bp, Neisseria gonorrhoeae
atgaccgttatcaagcaagaagactttattcaaagtatctgcgatgccttccaattcatcagctactaccatccaaaagactacatcgacgcgctttataaggcgtggcagaaggaagaaaatcccgccgccaaagacgcgatgacgcagattttggtcaacagccgtatgtgtgccgaaaacaaccgccccatctgccaagacacaggtatcgcaaccgtcttcctcaaagtcggtatggatgtgcaatgggatgcggacatgagcgtggaaaagatggttaacgaaggcgtacgccgcgcctacacttgggaaggcaacaccctgcgcgcttccgtcctcgccgatccggccggcaaacgccaaaacaccaaagacaacacccccgccgtcatccacatgagcatcgtgccgggcggtaaagtcgaagtaacctgcgcggcaaaaggcggcggctctgaaaacaaatccaaactcgctatgctcaacccttccgacaacatcgtcgattgggtattgaaaaccatcccgacgatgggcgcgggctggtgtcctcccggcatcttgggcatcggcatcggcggcacgcccgaaaaagccgtgttgatggcgaaagaatccctgatgagccacatcgacatccaagaattgcaggaaaaagccgcgtccggcgcggaattgtccaccaccgaagccctgcgcctcgaactctttgaaaaggtcaacgcgctgggcatcggcgcgcaaggcttgggcggtctgaccaccgtgttggacgtgaaaatcctcgattacccgacccatgccgcctccaaaccgattgccatgattcccaactgtgccgccacccgccacgtcgaatttgaattggacggctcaggtcctgtcgaactcacgccgccgcgcgtcgaagactgacccgatctgacttacagccccgacaacggcaaacgcgtcgatgtcgataagctgaccaaagaagaagtggcaagctggaaaaccggcgacgtattgctgttgaacggcaaaatcctcaccggccgcgatgccgcgcacaaacgcctcgtcaatatgctcgacaaaggcgaggagttgcccgtcgatttcaccaaccgcctgatttactacgtcggccccgtcgatccggtcggcgatgaagtcgtcggtcccgcaggtccgaccacagccacccgcatggacaaatttacccgccaaatgctcaaacaaaccggcctcttgggcatgatcggcaaatccgagcgcggcgcggccacctgcgaagccatcgccgacaacaaggccgtgtacctcatggcagtcggcggcgcggcatacctcgtggcaaaagccatcaaatcttccaaagtcttggcgttccccgaattgggtatggaagccgtttacgaatttgaagtcaaagatatgcccgtaaccgtcgccgtggacagcaaaggcgaatccatccacgccaccgccccgcgcaaatggcaggcgaaaatcggcatcatccccgtcgagtcttga

SEQ ID NO: 218 - protein, 506 aa, Neisseria gonorrhoeae
MTVIKQEDFIQSICDAFQFISYYHPKDYIDALYKAWQKEENPAAKDAMTQILVNSRMCAENNRPICQDTGIATVFLKVGMDVQWDADMSVEKMVNEGVRRAYTWEGNTLRASVLADPAGKRQNTKDNTPAVIHMSIVPGGKVEVTCAAKGGGSENKSKLAMLNPSDNIVDWVLKTIPTMGAGWCPPGILGIGIGGTPEKAVLMAKESLMSHIDIQELQEKAASGAELSTTEALRLELFEKVNALGIGAQGLGGLTTVLDVKILDYPTHAASKPIAMIPNCAATRHVEFELDGSGPVELTPPRVEDPDLTYSPDNGKRVDVDKLTKEEVASWKTGDVLLLNGKILTGRDAAHKRLVNMLDKGEELPVDFTNRLIYYVGPVDPVGDEVVGPAGPTTATRMDKFTRQMLKQTGLLGMIGKSERGAATCEAIADNKAVYLMAVGGAAYLVAKAIKSSKVLAFPELGMEAVYEFEVKDMPVTVAVDSKGESIHATAPRKWQAKIGIIPVES

SEQ ID NO: 219 - DNA, 1524 bp, Neisseria meningitidis
atgaccgtcatcaaacaggaagactttatccaaagcatttgcgatgccttccaattcatcagctactatcatcccaaagactacatcgacgcgctttataaggcgtggcagaaggaagaaaatcctgccgccaaagacgcgatgacgcagattttggtcaacagccgtatgtgtgcggaaaacaaccgccccatctgccaagacacaggtatcgcaaccgtcttcctcaaagtcggtatgaacgtccaatgggatgcggacatgagcgtggaagagatggttaacgaaggcgtacgccgcgcctacacttgggaaggcaatacgctgcgcgcttccgtcctcgccgatccggccggcaaacgccaaaacaccaaagacaacacccccgccgtcatccatatgagcatcgtgccgggcggtaaagtcgaagtaacctgcgcggcaaaaggcggcggctctgaaaacaaatccaaactcgccatgctcaatccttccgacaacatcgtcgattgggtattgaaaaccatcccgaccatgggcgcgggctggtgtcctcccggcatcttgggtatcggcatcggcggcacgcccgaaaaagccgtgctgatggcaaaagagtccctgatgagccacatcgacattcaagaattgcaggaaaaggccgcgtccggcgcggaattgtccaccaccgaagccctgcgcctcgaactctttgaaaaagtcaacgcgctgggcatcggcgcacaaggcttgggcggactgaccaccgtgttggacgtgaaaatcctcgattatccgacccacgccgcctccaaaccgattgccatgattccgaactgcgccgccacccgccacgtcgaatttgaattggacggctcaggccctgtcgaactcacgccgccgcgcgtcgaagactggcccgatttgacttacagccccgacaacggcaaacgcgtcgatgtcgacaagctgaccaaagaagaagtggcaagctggaaaaccggcgacgtattgctgttgaacggcaaaatcctcaccggccgcgatgccgcacacaaacgcctcgtcgatatgctcaacaaaggcgaagaattgcccgtcgatttcaccaaccgcctgatttactacgtcggccccgtcgatccggtcggcgatgaagtcgtcggtccggcaggtccgaccacagccacccgcatggacaaattcacccgccaaatgctcgaacaaaccgacctcttgggcatgatcggcaaatccgagcgcggcgtggccacctgcgaagccatcgccgacaacaaagccgtgtacctcatggcagtcggcggcgcggcgtatctcgtggcaaaagccatcaaatcttccaaagtcttggcgttccccgaattgggcatggaagccatttacgaatttgaagtcaaagacatgcccgtaaccgtcgccgtagatagcaaaggcgaatccatccacgccaccgccccgcgcaaatggcaggcgaaaatcggcatcatccccgtcgaatcttga

SEQ ID NO: 220 - protein, 507 aa, Neisseria meningitidis
MTVIKQEDFIQSICDAFQFISYYHPKDYIDALYKAWQKEENPAAKDAMTQILVNSRMCAENNRPICQDTGIATVFLKVGMNVQWDADMSVEEMVNEGVRRAYTWEGNTLRASVLADPAGKRQNTKDNTPAVIHMSIVPGGKVEVTCAAKGGGSENKSKLAMLNPSDNIVDWVLKTIPTMGAGWCPPGILGIGIGGTPEKAVLMAKESLMSHIDIQELQEKAASGAELSTTEALRLELFEKVNALGIGAQGLGGLTTVLDVKILDYPTHAASKPIAMIPNCAATRHVEFELDGSGPVELTPPRVEDWPDLTYSPDNGKRVDVDKLTKEEVASWKTGDVLLLNGKILTGRDAAHKRLVDMLNKGEELPVDFTNRLIYYVGPVDPVGDEVVGPAGPTTATRMDKFTRQMLEQTDLLGMIGKSERGVATCEAIADNKAVYLMAVGGAAYLVAKAIKSSKVLAFPELGMEAIYEFEVKDMPVTVAVDSKGESIHATAPRKWQAKIGIIPVES

SEQ ID NO: 221 - DNA, 1524 bp, Neisseria meningitidis
atgaccgtcatcaaacaggaagactttatccaaagcatttgcgatgccttccaattcatcagctactaccatcccaaagactacatcgacgcgctttataaggcgtggcagaaggaagaaaaccccgccgccaaagacgcgatgacgcagattttggtcaacagccgcatgtgtgccgaaaacaaccgccccatctgccaagataccggtatcgcgaccgtgtttttgaaagtcggtatggatgtgcaatgggatgcagacatgagcgtcgaagagatggttaacgaaggcgtgcgccgcgcctacacttgggaaggcaatacgctgcgcgcttccgttctcgccgaccccgccggcaaacgccaaaataccaaagacaacacgcccgccgtcatccatatgagcatcgtgccgggcgacaaagtcgaagtaacctgcgcggcaaaaggcggcggttctgaaaacaaatccaaactcgccatgctcaacccttccgacaacatcgtcgattgggtattgaaaaccattccgaccatgggcgcgggctggtgtcctcccggcatcttgggcatcggcatcggcggtacgcccgaaaaagccgtgttgatggcgaaagaatccctgatgagccacatcgacatccaagaattgcaggaaaaagccgcgtccggcgcggaattgtccaccaccgaagccctgcgcctcgaactctttgaaaaagtcaacgcgctaggcatcggcgcgcaaggcttgggcggtctgaccaccgtgttggacgtgaaaatcctcgattacccgacccacgccgcctccaaaccgattgccatgattccgaactgcgccgccacccgccacgtcgaatttgaattggacggctcaggccctgtcgaactcacgccgccgcgcgtcgaagactggcccgatttgacttacagccccgacaacggcaaacgcgtcgatgtcgacaagctgaccaaagaagaagtggcaagctggaaaaccggcgacgtattgctgttgaacggcaaaatcctcaccggccgcgatgccgcacacaaacgcctcgtcgatatgctcgacaaaggcgaagaattgcccgtcgatttcaccaaccgcctgatttactacgtcggccccgtcgatccggtcggcgacgaaatcgtcggcccagcaggtccgaccaccgccacccgcatggacaaattcacccgccaaatgctcgaacaaaccgacctcttgggcatgatcggcaaatccgagcgcggcgcggccacctgcgaagccatcgccgacaacaaagccgtgtacctcatggcagtcggcggcgcggcgtatctcgtggcaaaagccatcaaatcttccaaagtcttggcgttccccgaattgggcatggaagccatttacgaatttgaagtcaaagacatgcccgtaaccgtcgccgtagacagcaaaggcgaatccatccacgccaccgccccgccccaatggcaggcgaaaatcggcatcatccccgtcaaatcttga

SEQ ID NO: 222 - protein, 507 aa, Neisseria meningitidis
MTVIKQEDFIQSICDAFQFISYYHPKDYIDALYKAWQKEENPAAKDAMTQILVNSRMCAENNRPICQDTGIATVFLKVGMDVQWDADMSVEEMVNEGVRRAYTWEGNTLRASVLADPAGKRQNTKDNTPAVIHMSIVPGDKVEVTCAAKGGGSENKSKLAMLNPSDNIVDWVLKTIPTMGAGWCPPGILGIGIGGTPEKAVLMAKESLMSHIDIQELQEKAASGAELSTTEALRLELFEKVNALGIGAQGLGGLTTVLDVKILDYPTHAASKPIAMIPNCAATRHVEFELDGSGPVELTPPRVEDWPDLTYSPDNGKRVDVDKLTKEEVASWKTGDVLLLNGKILTGRDAAHKRLVDMLDKGEELPVDFTNRLIYYVGPVDPVGDEIVGPAGPTTATRMDKFTRQMLEQTDLLGMIGKSERGAATCEAIADNKAVYLMAVGGAAYLVAKAIKSSKVLAFPELGMEAIYEFEVKDMPVTVAVDSKGESIHATAPPQWQAKIGIIPVKS

SEQ ID NO: 223 - DNA, 360 bp, Neisseria gonorrhoeae
atggctttggtggcggaggaaacggaaatatccgcgccgtgtttcaaaggctgcgagccgacgggcgacagcaggctgttgtccaccaccaagagcgcgccgatgccgtgcgccaattccgccaaggcttccaagtcggccacttcgcccaaggggttggacggcgtttccaaaaacagcagtttggtgttggctttgacggcggctttccattcatttatatcagtcggcgacacgcggctcactccgatgccgaatttggtaacgatgttattgataaagccgacggtcgtgccgaacaggctgcggctggaaaccacatggtcgcccgcctgcaggaaggtgaaaaacgccgcctga

SEQ ID NO: 224 - protein, 119 aa, Neisseria gonorrhoeae
MALVAEETEISAPCFKGCEPTGDSRLLSTTKSAPMPCANSAKASKSATSPKGLDGVSKNSSLVLALTAAFHSFISVGDTRLTPMPNLVTMLLIKPTVVPNRLRLETTWSPACRKVKNAA

SEQ ID NO: 225 - DNA, 360 bp, Neisseria meningitidis; identical to SEQ ID NO: 223

SEQ ID NO: 226 - protein, 119 aa, Neisseria meningitidis; identical to SEQ ID NO: 224

SEQ ID NO: 227 - DNA, 360 bp, Neisseria meningitidis
atggctttggtcgcggaggaaacggaaatatccgcgccgtgtttcaaaggctgagagccgacaggcgacagcaggctgttgtccaccaccaagagcgcgccgatgccgtgcgccaattccgccaaggcttccaagtcggccacttctcccaagggattggacggcgtttccaaaaacagcagtttggtgttggctttgacggcggctttccattcgtttatatcagtcggcgacacgtgactcacttcgatgccgaatttggtaacgatgttattgataaagccgacggtcgtgccgaacaggctgcggctggaaatcacatggtcgcccgcctgcaaaaaggtgaaaaacgccgcctga

SEQ ID NO: 228 - protein, 117 aa, Neisseria meningitidis
MALVAEETEISAPCFKGEPTGDSRLLSTTKSAPMPCANSAKASKSATSPKGLDGVSKNSSLVLALTAAFHSFISVGDTLTSMPNLVTMLLIKPTVVPNRLRLEITWSPACKKVKNAA

SEQ ID NO: 229 - DNA, 387 bp, Neisseria gonorrhoeae
atgtgtatgccatacgcaataagggtttcagacggcatctgccgcatttttccgccgatgccgtctgaaacacgcaatcagcgcgcgagtgcctgtttcaaatcgtcaatcaaatcgccaacatattccaaaccgaccgacaggcgcaccagtccggggcggataccggcggcgagtttttcttcgggctgcatcctgccgtgcgtggttgtccacggattggtgatggtcgagcgcacgtcgccgaggttggcggtacgggaaaagagttccacgactttccacgcggctgcttggtcggcgacttcaaaaccgatgacgatgccgccgccgttttgctgtttgcggataagctccgcctgcggatggtcgggcaatccggtgtag

SEQ ID NO: 230 - protein, 128 aa, Neisseria gonorrhoeae
MCMPYAIRVSDGICRIFPPMPSETRNQRASACFKSSIKSPTYSKPTDRRTSPGRIPAASFSSGCILPCVVVHGLVMVERTSPRLAVREKSSTTFHAAAWSATSKPMTMPPPFCCLRISSACGWSGNPV

SEQ ID NO: 231 - DNA, 387 bp, Neisseria meningitidis
atgtgtatgccatataagataagggtttcagacggcatctgctgtccaatgccgtctgaaacacgcaatcagcgtgcgagtgcctgtttcaaatcgtcaatcaaatcgccaacatattccaaaccgaccgacaggcgcaccaatccggggcggatgttggcggcgagtttttcttcgggctgcatcctgccgtgcgtggttgtccacgggtgggtaatggtcgagcgcacgtcaccgaggttggcggtgcgggaaaagagttccacgccgtccacaactttccacgccgcttcttgatcggcaacttcaaagccgatgacgatgccgccgccgttttgctgtttgcggataagcgccgcctgaggatggtcggacaatccggtgtag

SEQ ID NO: 232 - protein, 128 aa, Neisseria meningitidis
  misc_feature (99)..(99): Xaa can be any naturally occurring amino acid
  misc_feature (121)..(121): Xaa can be any naturally occurring amino acid
MCMPYKIRVSDGICCPMPSETRNQRASACFKSSIKSPTYSKPTDRRTNPGRMLAASFSSGCILPCVVVHGWVMVERTSPRLAVREKSSTPSTTFHAASXSATSKPMTMPPPFCCLRISAAXGWSDNPV

SEQ ID NO: 233 - DNA, 395 bp, Neisseria meningitidis
acgtgtatgtcatataagataagggtttcagacggcatttgcggtgtttttccgccgatgccgtctgaacacgcaatcagcgcgcgagtgcctgtttcaaatcgtcaatcaaatcgccaacatattccaaaccgaccgacaggcgcaccaatccggggcggatgttggcggcgagtttttcttcgggctgcatcctgccgtgcgtggttgtccacggatgggtaatggtcgagcgcacgtcgccgaggttggcggtacgggagaaaagttcgacgccgtccacgactttccacgcggctgcttggtcggcgacttcaaagccgatgacgatgccgccgccgttttgctgtttgcggataagctccgcctgaggatggtcgggtaatccggtgtaa

SEQ ID NO: 234 - protein, 130 aa, Neisseria meningitidis
  misc_feature (24)..(24): Xaa can be any naturally occurring amino acid
TCMSYKIRVSDGICGVFPPMPSEXRNQRASACFKSSIKSPTYSKPTDRRTNPGRMLAASFSSGCILPCVVVHGWVMVERTSPRLAVREKSSTPSTTFHAAAWSATSKPMTMPPPFCCLRISSAGWSGNPV

SEQ ID NO: 235 - DNA, 414 bp, Neisseria gonorrhoeae
atgccgccttacttcatcaccctcttaacgatggaaaatacaaaaagcgcggcgaaaacgcccactacaatccaaccggcttccataccgtccgcttttgcggcttccaaagcgttttttgccgtttcgggcaacgctgcgtttgcctgtgccgccaaagccagcggggcggctgttacaacagccagttttgcgccgtatttacggcaggtgttaataaatttcatgatattttcctttacgaaatttttaaaaaaatgtgtttgcgggctttgtgaaggttttagagaccgcctgccgggcctcttaaacttaatcttctttttcgtagaatccgaaaattacaaattccccgcctatctcttccaatgccgagctaaaagcgtcttcatagctgtcatatttaccggctga

SEQ ID NO: 236 - protein, 137 aa, Neisseria gonorrhoeae
MPPYFITLLTMENTKSAAKTPTTIQPASIPSAFAASKAFFAVSGNAAFACAAKASGAAVTTASFAPYLRQVLINFMIFSFTKFLKKCVCGLCEGFRDRLPGLLNLIFFFVESENYKFPAYLFQCRAKSVFIAVIFTG

SEQ ID NO: 237 - DNA, 411 bp, Neisseria meningitidis
atgccgtcttacttcatcactctcttaacgatggaaaatacaaaaagcgcggcgaaaatgcccactacaatccaaccggcttccataccgtccgcttttgcggcttccaaagcgttttttgccgtatcgggcaacgttgcatttgcatgtgcggccaaagccaggggagcagctgttacaacagccagttttgcgccgtatttacggcaggtgttaataaatttcatgatattttccttcaaaaagtgtttggcggtaatggatggagcgtttttcagacgaccgccgaacatccgaaaatcagtctttcaaaaatccgaatacgacaaattcgtattggttgccgatttcttccaaacctgcgttaatcgcttcttcgaagtcgtagaaataatcggcattggtgattaa

SEQ ID NO: 238 - protein, 136 aa, Neisseria meningitidis
MPSYFITLLTMENTKSAAKMPTTIQPASIPSAFAASKAFFAVSGNVAFACAAKARGAAVTTASFAPYLRQVLINFMIFSFKKCLAVMDGAFFRRPPNIRKSVFQKSEYDKFVLVADFFQTCVNRFFEVVEIIGIGD

SEQ ID NO: 239 - DNA, 411 bp, Neisseria meningitidis
atgccgtcttacttcatcactctcttaacgatggaaaagacaaaaagcgcggcgaaaacgcccactacaatccaaccggcttccataccgtccgcttttgcggcttccaaagcgttttttgctgtatcgggcaacgttgcatttgcatgtgcggccaaagccaggggagcagctgttacaacagccagttttgcgccgtatttacggcaggtgttaataaatttcatgatattttccttcaaaaagtgtttggcggtaatggatggagcgtttttcagacgaccgccgaacatccgaaaatcagtctttcaaaaatccgaatacgacaaattcgtattggttgccgatttcttccaaacctgcgttaatcgcttcttcgaagtcgtagaaataatcggcattggtgattaa

SEQ ID NO: 240 - protein, 136 aa, Neisseria meningitidis
MPSYFITLLTMEKTKSAAKTPTTIQPASIPSAFAASKAFFAVSGNVAFACAAKARGAAVTTASFAPYLRQVLINFMIFSFKKCLAVMDGAFFRRPPNIRKSVFQKSEYDKFVLVADFFQTCVNRFFEVVEIIGIGD

SEQ ID NO: 241 - DNA, 828 bp, Neisseria gonorrhoeae
atgtgggataatgccgaagcgatggaacggctgacgcgctggctgcttgtcatgatggcgatgctgcttgctgcgtccgggctggtttggttttacaattcgaatcatctgcccgtcaagcaggtgtcgctgaagggcaacctggtttattccgataagaaggcattgggcagtttggcgaaagaatacatccatgggaatattttgaggacggacatcaatggcgcacaggaagcctaccgccggtatccgtggattgcgtcggtcatggtgcgccgccgttttcccgatacggttgaggtcgtcctgaccgagcgcaagccggttgcacgttggggcgaccatgccttggtggacggcgaaggcaatgtttttgaagcccgcttggacagacccggaatgccggtattcagaggcgcggaaggaacgtctgccgaaatgctccgccgttatgacgaattttcgactgttttggcaaaacagggtttgggcatcaaagagatgacctatacggcacgttcggcgtggaatgtcgttttggacaacggcatcaccgtcaggctcggacgggaaaacgagatgaaacgcctccggctttttaccgaagcgtggcagcatctgttgcgtaagaataaaaatcggttatcctatgtggatatgaggtataaggacggattttcagtcccccatgctcccgacggtttacccgaaaaagaatccgaagaatattgggaacaggtttgggacatattacggcctggcgtcggaaacggttcgacgcaaatttcaatcagttataagggcagacgaacaatggaacagcagtaa

SEQ ID NO: 242 - protein, 275 aa, Neisseria gonorrhoeae
MWDNAEAMERLTRWLLVMMAMLLAASGLVWFYNSNHLPVKQVSLKGNLVYSDKKALGSLAKEYIHGNILRTDINGAQEAYRRYPWIASVMVRRRFPDTVEVVLTERKPVARWGDHALVDGEGNVFEARLDRPGMPVFRGAEGTSAEMLRRYDEFSTVLAKQGLGIKEMTYTARSAWNVVLDNGITVRLGRENEMKRLRLFTEAWQHLLRKNKNRLSYVDMRYKDGFSVPHAPDGLPEKESEEYWEQVWDILRPGVGNGSTQISISYKGRRTMEQQ

SEQ ID NO: 243 - DNA, 729 bp, Neisseria meningitidis
atgtgggataatgccgaagcgatggaacggctgacgcgctggctgcttgtcatgatggcgatgctgcttgctgcgtccgggctggtttggttttacaattcgaatcatctgcccgtcaagcaggtgtcgctgaagggcaacctggtttattccgataagaagacattgggcagtttggcgaaagaatacatccatgggaatattttgaggacggacatcaatggcgcacaggaggcctaccgccggtatccgtggattgcgtcggtcatggtgcgccgccgttttcccgacacggttgaggtcgtcctgaccgagcgcaagccggtcgcgcgttggggcgaccatgccttggtggacggcgaaggcaatgtttttgaagcccgcttggacagacccggaatgccggtattcagaggcgcggaaggaacgtctgccgaaatgctccgccgttatgacgaattttcgactgttttggcaaaacagggtttgggcatcaaagagatgacctatacggcacgttcggcgtggattgtcgttttggacaacggcatcaccgtcaggctcggacgggaaaacgagatgaaacgcctccggctttttaccgaagcgtggcagcatctgttgcgtaaaaataaaaatcggttatcctatgtggatatgaggtataaggacggattttcagtccgctatgcttccgacggtttacccgaaaaagaatccgaagaatag

SEQ ID NO: 244 - protein, 242 aa, Neisseria meningitidis
MWDNAEAMERLTRWLLVMMAMLLAASGLVWFYNSNHLPVKQVSLKGNLVYSDKKTLGSLAKEYIHGNILRTDINGAQEAYRRYPWIASVMVRRRFPDTVEVVLTERKPVARWGDHALVDGEGNVFEARLDRPGMPVFRGAEGTSAEMLRRYDEFSTVLAKQGLGIKEMTYTARSAWIVVLDNGITVRLGRENEMKRLRLFTEAWQHLLRKNKNRLSYVDMRYKDGFSVRYASDGLPEKESEE

SEQ ID NO: 245 - DNA, 729 bp, Neisseria meningitidis
atgtgggataatgccgaagcgatggaacggctgacgcgctggctgcttgtcatgatggcgatgctgcttgctgcgtccgggctggtttggttttacaattcgaatcatctgcccgtcaagcaggtgtcgctgaagggcaacctagtttattccgataagaaagcattgggcagtttggcgaaagaatacatccatgggaatattttgaggacggacatcaatggcgcacaggaggcctaccgccggtatccgtggattgcgtcggtcatggtgcgccgccgttttcccgacacggttgaggtcgtcctgaccgagcgcaagccggtcgcgcgttggggcgaccatgccttggtggacggcgaaggcaatgtttttgaagcccgtttggacagacccggaatgccggtattcagaggcgcggaaggaacgtctgccgaaatgctccgccgttatgacgaattttcgactgttttggcaaaacagggtttgggcatcaaagagatgacctatacggcacgttcggcgtggattgtcgttttggacaacggcatcaccgtcaggctcggacgggaaaacgagatgaaacgcctccggctttttaccgaagcgtggcaacatctgttgcgtaaaaataaaaatcggttatcctatgtggatatgaggtataaggacggattttcagtccgctatgctcccgacggtttacccgaaaaagaatccgaagaatag

SEQ ID NO: 246 - protein, 242 aa, Neisseria meningitidis
MWDNAEAMERLTRWLLVMMAMLLAASGLVWFYNSNHLPVKQVSLKGNLVYSDKKALGSLAKEYIHGNILRTDINGAQEAYRRYPWIASVMVRRRFPDTVEVVLTERKPVARWGDHALVDGEGNVFEARLDRPGMPVFRGAEGTSAEMLRRYDEFSTVLAKQGLGIKEMTYTARSAWIVVLDNGITVRLGRENEMKRLRLFTEAWQHLLRKNKNRLSYVDMRYKDGFSVRYAPDGLPEKESEE

SEQ ID NO: 247 - DNA, 1359 bp, Neisseria gonorrhoeae
atgaaaccactggacctaaatttcatctgccaagccctcaagcttccgatgccgtctgaaaacaaacccgtgtcgcgcatcgtaaccgacagccgcgatattcgggaaggcgatgtgtttttcgcattggcgggcgggcggtttgacgcgcatgattttgttggaggcgtattgtctgcgggcgcggcggcggttgtggtttcgcgcgaagattgcgcggctttgggcggcgcgttgaaagtcgatgacacgcttgccgcgttgcaaacgttggcgaaggcgtggcgcgataatgtgaacccgtttgtgttcggcattaccggttcgggcggcaagacgacggtgaaggagatgctggctgcggtattgcgccgccgtttcggcgatgatgccgtttcggcgacggcaggcaacttcaacaaccacatcggattgccgctgactttattgaaattaaacgaaaaacaccgctatgccgtgattgaaatgggcatgaaccattttggcgaactggcggttttaacgcaaatcgccaaacccgatgccgctttggtcaacaacgccctgcgcgcccatgtcggatgcggtttcgacggagtgggcgatattgccaaagcgaaaagcgagatttatgcaggcttatgttcagacggcatggcactgattcctcaagaagatgccaatatggctgtcttcaaaacggcaacgtttaatttgaatacgtgcactttcggcgtcgatagcggcgatgtccgcgcggaaaatatcgtgctgaaacctttgtcgtgcgaatttgatttggtgtgcggcgacgagcgcactgccgtggtgctgcctgttcccggccgccacaatgtccacaacgccgccgctgccgccgcgctggctttggctgccggtttgagtttgaacgatgtggcggaaggtttgcaaggcttcagcaacatcaaaggccgtctgaacgtcaaagccggcatcaagggcgcaaccctgattgacgatacttataatgcgaatcccgacagtatgaaagccgcggttgacgtgttggcgcgtatgcctgcgccgcgcattttcgtgatgggcgatatgggcgaactgggcgaggacgaagccgccgccatgcacgccgaagtcggcgcgtacgcccgcgaccaaggcatcgaagcggcttattttgtcggcgacaacagcgtcgaagcggcggaaaaatttggcgcggacggtttgtggttcgccgccaaagacccgttgattcaagtgttgagccacgatttgcccgaacgcgccaccgtgttggtgaaaggttcgcgctttatgcagatggaagaagtggtcgaggcattggaggataagtga

SEQ ID NO: 248 - protein, 452 aa, Neisseria gonorrhoeae
MKPLDLNFICQALKLPMPSENKPVSRIVTDSRDIREGDVFFALAGGRFDAHDFVGGVLSAGAAAVVVSREDCAALGGALKVDDTLAALQTLAKAWRDNVNPFVFGITGSGGKTTVKEMLAAVLRRRFGDDAVSATAGNFNNHIGLPLTLLKLNEKHRYAVIEMGMNHFGELAVLTQIAKPDAALVNNALRAHVGCGFDGVGDIAKAKSEIYAGLCSDGMALIPQEDANMAVFKTATFNLNTCTFGVDSGDVRAENIVLKPLSCEFDLVCGDERTAVVLPVPGRHNVHNAAAAAALALAAGLSLNDVAEGLQGFSNIKGRLNVKAGIKGATLIDDTYNANPDSMKAAVDVLARMPAPRIFVMGDMGELGEDEAAAMHAEVGAYARDQGIEAAYFVGDNSVEAAEKFGADGLWFAAKDPLIQVLSHDLPERATVLVKGSRFMQMEEVVEALEDK

SEQ ID NO: 249 - DNA, 1368 bp, Neisseria meningitidis
atgaaaccactggacctaaatttcatctgccaagccctcaagcttccgatgccgtctgaaagcaaacccgtgtcgcgcatcgtaaccgacagccgcgacatccgcgcgggcgatgtgtttttcgcattggcgggcgagcggtttgacgcgcatgattttgttgaagacgtattggctgctggtgcggcggcggttgtggtttcgcgcgaagattgtgctgcaatggatggcgcgttgaaagtcgatgacacgcttgccgcattgcaaacgctggcaaaggcgtggcgtgaaaatgtgaatccgtttgtgttcggcattaccggttcgggcggcaagacgacggtgaaggaaatgctggctgcggtattgcgccgccgtttcggcgatgatgccgtgttggcgacggcaggcaacttcaacaaccatatcggattgccgctgactttgttgaagttaaacgaaaaacaccgctatgccgtgattgaaatgggcatgaaccatttcggcgaactggcggttttaacgcamatcgccaaaccaaatgccgcattggtcaacaacgccatgcgcgcccatgtcggctgcggtttcgacggagtgggcgatattgccaaagcgaaaagcgagatttaccaaggtttatgttcagacggcattgcactgattcctcaagaagatgccaatatggctgtcttcaaaacggcaacgcttaatttgaatacgcgcactttcggcatcgatagcggcgatgttcacgcggaaaatattgtgctgaaaccgttgtcgtgcgaatttgatttggtgtgcggcgatgagcgcgccgccgtggtgctgcctgttcccggccgccacaatgtccacaacgccgccgctgccgccgcgctggctttggctgcgggtttgagtttgaacgatgtggcggaaggtttgaaaggcttcagcaatatcaaaggccgtctgaacgtcaaatccggaatcaagggcgcaaccctgattgacgatacttataatgcgaaccctgacagcatgaaagctgcgattgacgtgttggcgcgtatgcctgcgccgcgtattttcgtgatgggcgatatgggcgaactgggcgaactgggcgaggacgaagccgccgctatgcacgccgaagtcggcgcgtatgcccgcgaccaaggcatcgaagcggcttattttgtcggcgacaacagcgtcgaagcggcggaaaaatttggcgcggacggtttgtggttcgccgccaaagacccgttgattcaagtgttgcgccacgatttgcccgaacgcgccaccgtgttggtgaaaggttcgcgctttatgcagatggaagaagtggtcgaggcattggaggataagtga

SEQ ID NO: 250 - protein, 455 aa, Neisseria meningitidis
  misc_feature (176)..(176): Xaa can be any naturally occurring amino acid
MKPLDLNFICQALKLPMPSESKPVSRIVTDSRDIRAGDVFFALAGERFDAHDFVEDVLAAGAAAVVVSREDCAAMDGALKVDDTLAALQTLAKAWRENVNPFVFGITGSGGKTTVKEMLAAVLRRRFGDDAVLATAGNFNNHIGLPLTLLKLNEKHRYAVIEMGMNHFGELAVLTXIAKPNAALVNNAMRAHVGCGFDGVGDIAKAKSEIYQGLCSDGIALIPQEDANMAVFKTATLNLNTRTFGIDSGDVHAENIVLKPLSCEFDLVCGDERAAVVLPVPGRHNVHNAAAAAALALAAGLSLNDVAEGLKGFSNIKGRLNVKSGIKGATLIDDTYNANPDSMKAAIDVLARMPAPRIFVMGDMGELGELGEDEAAAMHAEVGAYARDQGIEAAYFVGDNSVEAAEKFGADGLWFAAKDPLIQVLRHDLPERATVLVKGSRFMQMEEVVEALEDK

SEQ ID NO: 251 - DNA, 1359 bp, Neisseria meningitidis
atgaaaccactggacctaaatttcatctgccaagccctcaagcttccgatgccgtctgaaagcaaacccgtgtcgcgcatcgtaaccgacagccgcgacatccgcgcgggcgatgtgtttttcgcattggcgggcgggcggtttgatgcgcatgattttgttgaagacgtattggctgcgggtgcggcggcggttgtggtttcgcgcgaagattgcgttgcaatggatggcgcgttgaaagtcgatgacacgcttaccgcgttgcaaatgttggcgaaggcgtggcgcgagaatgtgaacccgtttgtgttcggtattaccggctcgggcggcaagacgacggtgaaggaaatgttggctgcggtattgcgccgccgtttcggcgataatgccgttttggcgacggcaggcaacttcaacaaccacatcggattgccgttgactttgttgaaattaaacgaaaaacaccgctatgccgtgattgaaatgggtatgaaccattttggcgaactggcggttttgacacaaatcgccaaacccgatgccgcattggtcaacaacgccatgcgcgcccatgtcggctgcggtttcgacggagtgggcgatattgccaaagcgaaaagcgagatttatcaaggcttatgttcagacggcatggcgctgattcctcaagaagatgccaatatggctgtcttcaaaacggcaacgcttaatttgaatacgcgcactttcggcatcgatagcggcgatgtccacgcggaaaatatcgtgctgaaaccgttgtcgtgcgaatttgatttggtgtgcggcaacgagtgcgcagccgtggttctgcccgttcccggccgccacaatgtccacaacgccgccgccgccgccgcgctgtctttggctgcaggtttgagtttgaacgatgtggcggaaggtttgaaaggcttcagcaatatcaaaggccgtctgaacgtcaaatccggaatcaagggcgcaaccctgattgacgatacttataatgcgaaccctgacagcatgaaagctgcggttgacgtgttggcgcgtatgcctgcgccgcgtattttcgtgatgggcgatatgggcgaactgggtgaggacgaagccgccgccatgcacgccgaagtcggcgcgtacgcccgcgaccaaggcatcgaagcggcttattttgtcggcgacaacagcgtcgaagcggcggaaaaatttggcgcggacggtttgtggttcgccgccaaagacccgttgattcaagtgttgcgccacgatttgcccgaacgcgccaccgtgttggtgaaaggttcgcgctttatgcagatggaagaagtggtcgaggcattggaggataagtga

SEQ ID NO: 252 - protein, 452 aa, Neisseria meningitidis
MKPLDLNFICQALKLPMPSESKPVSRIVTDSRDIRAGDVFFALAGGRFDAHDFVEDVLAAGAAAVVVSREDCVAMDGALKVDDTLTALQMLAKAWRENVNPFVFGITGSGGKTTVKEMLAAVLRRRFGDNAVLATAGNFNNHIGLPLTLLKLNEKHRYAVIEMGMNHFGELAVLTQIAKPDAALVNNAMRAHVGCGFDGVGDIAKAKSEIYQGLCSDGMALIPQEDANMAVFKTATLNLNTRTFGIDSGDVHAENIVLKPLSCEFDLVCGNECAAVVLPVPGRHNVHNAAAAAALSLAAGLSLNDVAEGLKGFSNIKGRLNVKSGIKGATLIDDTYNANPDSMKAAVDVLARMPAPRIFVMGDMGELGEDEAAAMHAEVGAYARDQGIEAAYFVGDNSVEAAEKFGADGLWFAAKDPLIQVLRHDLPERATVLVKGSRFMQMEEVVEALEDK

SEQ ID NO: 253 - DNA, 744 bp, Neisseria gonorrhoeae
atgtggttgttgaagttgcctgccgtcgccgaaacggcatcatcgccgaaacggcggcgcaataccgcagccagcatctccttcaccgtcgtcttgccgcccgaaccggtaatgccgaacacaaacgggttcacattatcgcgccacgccttcgccaacgtttgcaacgcggcaagcgtgtcatcgactttcaacgcgccgcccaaagccgcgcaatcttcgcgcgaaaccacaaccgccgccgcgcccgcagacaatacgcctccaacaaaatcatgcgcgtcaaaccgcccgcccgccaatgcgaaaaacacatcgccttcccgaatatcgcggctgtcggttacgatgcgcgacacgggtttgttttcagacggcatcggaagcttgagggcttggcagatgaaatttaggtccagtggtttcatatttgctttcgttaatattcgggcggcggacacatcggtagcggctgatttttttatcgcctgttttgctgtggtaaaacacagattattttcccattctcattcggcattttttctgtacgtatcattttttagacgtatttttagccgatttgccttttcccgcataccacggcgcggggtcgtcggactgtctgtcgataaaggcaaggttattgccttcgcccggcacatcggggacattcccccaaaaatcatagccgtcatcgggcaactcgtcggtttcgatacccgtccaactgccgaatccgcgtaa

SEQ ID NO: 254 - protein, 247 aa, Neisseria gonorrhoeae
MWLLKLPAVAETASSPKRRRNTAASISFTVVLPPEPVMPNTNGFTLSRHAFANVCNAASVSSTFNAPPKAAQSSRETTTAAAPADNTPPTKSCASNRPPANAKNTSPSRISRLSVTMRDTGLFSDGIGSLRAWQMKFRSSGFIFAFVNIRAADTSVAADFFIACFAVVKHRLFSHSHSAFFLYVSFFRRIFSRFAFSRIPRRGVVGLSVDKGKVIAFARHIGDIPPKIIAVIGQLVGFDTRPTAESA

SEQ ID NO: 255 - DNA, 744 bp, Neisseria meningitidis
  misc_feature (4)..(5): n is a, c, g, or t
atgnngttgttgaagttgcctgccgtcgccaacacggcatcatcgccgaaacggcggcgcaataccgcagccagcatttccttcaccgtcgtcttgccgcccgaaccggtaatgccgaacacaaacggattcacattttcacgccacgcctttgccagcgtttgcaatgcggcaagcgtgtcatcgactttcaacgcgccatccattgcagcacaatcttcgcgcgaaaccacaaccgccgccgcaccagcagccaatacgtcttcaacaaaatcatgcgcgtcaaaccgctcgcccgccaatgcgaaaaacacatcgcccgcgcggatgtcgcggctgtcggttacgatgcgcgacacgggtttgctttcagacggcatcggaagcttgagggcttggcagatgaaatttaggtccagtggtttcatatttactttcgttaatattcgggcggcggacacatcggtagcggctgatttttttatcgcctgttttgctgtggtaaaacacagattattttcccattctcattcggsattttttctgtacgtatcattttttagacgtatttttagtcgatttgccttttcccgcataccacggcgcggggtcgtcgggcagtccgtcgataaaggcaaggttattgccttcgccctgcacatcgggaacattcccccaaaaatcatagccgtcatcgggcaactcgtcggtttcgatacccgtccaactgccgaatccgcgtaa

SEQ ID NO: 256 - protein, 247 aa, Neisseria meningitidis
  misc_feature (2)..(2): Xaa can be any naturally occurring amino acid
  misc_feature (179)..(179): Xaa can be any naturally occurring amino acid
MXLLKLPAVANTASSPKRRRNTAASISFTVVLPPEPVMPNTNGFTFSRHAFASVCNAASVSSTFNAPSIAAQSSRETTTAAAPAANTSSTKSCASNRSPANAKNTSPARMSRLSVTMRDTGLLSDGIGSLRAWQMKFRSSGFIFTFVNIRAADTSVAADFFIACFAVVKHRLFSHSHSXFFLYVSFFRRIFSRFAFSRIPRRGVVGQSVDKGKVIAFALHIGNIPPKIIAVIGQLVGFDTRPTAESA

SEQ ID NO: 257 - DNA, 744 bp, Neisseria meningitidis
atgtggttgttgaagttgcctgccgtcgccaaaacggcattatcgccgaaacggcggcgcaataccgcagccaacatttccttcaccgtcgtcttgccgcccgagccggtaataccgaacacaaacgggttcacattctcgcgccacgccttcgccaacatttgcaacgcggtaagcgtgtcatcgactttcaacgcgccatccattgcaacgcaatcttcgcgcgaaaccacaaccgccgccgcacccgcagccaatacgtcttcaacaaaatcatgcgcatcaaaccgcccgcccgccaatgcgaaaaacacatcgcccgcgcggatgtcgcggctgtcggttacgatgcgcgacacgggtttgctttcagacggcatcggaagcttgagggcttggcagatgaaatttaggtccagtggtttcatatttactttcgttaatattcgggcggcggacacatcggtagcggctgatttttttatcgcctgttttgctgtggtaaaacacagattattttcccattctcattcggcattttttctgtacgtatcattttttagacgtatttttagtcgatttgccttttcccgcataccacggcgcggggtcgtcgggcagtccgtcgataaaggcaaggttattgccttcgccctgcacatcgggaacattcccccaaaaatcatagccgtcatcgggcaactcgtcggtttcgatacccgtccaactgccgaatccgcgtaa

SEQ ID NO: 258 - protein, 247 aa, Neisseria meningitidis
MWLLKLPAVAKTALSPKRRRNTAANISFTVVLPPEPVIPNTNGFTFSRHAFANICNAVSVSSTFNAPSIATQSSRETTTAAAPAANTSSTKSCASNRPPANAKNTSPARMSRLSVTMRDTGLLSDGIGSLRAWQMKFRSSGFIFTFVNIRAADTSVAADFFIACFAVVKHRLFSHSHSAFFLYVSFFRRIFSRFAFSRIPRRGVVGQSVDKGKVIAFALHIGNIPPKIIAVIGQLVGFDTRPTAESA

SEQ ID NO: 259 - DNA, 696 bp, Neisseria gonorrhoeae
atgaaacaatccgcccgaataaaaaatatggatcagacattaaaaaatacattgggcatttgcgcgcttttagccttttgttttggcgcggccatcgcatcaggttatcacttggaatatgaatacggctaccgttattctgccgtgggcgctttggcttcggttgtatttttattattattggcacgcggcttcccgcgcgtttcttcagttgttttactgatttacgtcggcacaaccgccctatatttgccggtcggctggctgtatggtgcgccttcttatcagatagtcggttcgatattggaaagcaatcctgccgaggcgcgtgaatttgtcggcaatcttcccgggtcgctttattttgtgcaggcattatttttcatttttggcttgacagtttggaaatattgtgtatctgtgggggtatttgctgacgtaaaaaactataaacgtcgcagcaaaatatggctgaccatattattgactttgattttgtcctgcgcggtgatggagaaaatcgccggcgataaagattggcgagaacctgatgccggcctgttgttgaatattttcgacctgtattacgacttggctttccgcgccggcacaatatgccgccaagcgcgcccacattttggaagcagcaaaaaaagcgtcaacatggcatatccgccaacttgcgcccaagtataa

SEQ ID NO: 260 - protein, 231 aa, Neisseria gonorrhoeae
MKQSARIKNMDQTLKNTLGICALLAFCFGAAIASGYHLEYEYGYRYSAVGALASVVFLLLLARGFPRVSSVVLLIYVGTTALYLPVGWLYGAPSYQIVGSILESNPAEAREFVGNLPGSLYFVQALFFIFGLTVWKYCVSVGVFADVKNYKRRSKIWLTILLTLILSCAVMEKIAGDKDWREPDAGLLLNIFDLYYDLAFRAGTICRQARPHFGSSKKSVNMAYPPTCAQV

SEQ ID NO: 261 - DNA, 694 bp, Neisseria meningitidis
  misc_feature (78)..(104): n is a, c, g, or t
  misc_feature (113)..(113): n is a, c, g, or t
atgaaacaatccgcccgaataaaaatatgaatcagacattactttatacattgggcatttgcgcgcttttaacctttnnnnnnnnnnnnnnnnnnnnnnnnnnntatcacccngaatatgaatacggctaccgttattctgccgtgggtgctttggcttcggttgtatttttattattattggcacgcggtttcccgcgcgtttcttcagttgttttactgatttacgtcggcacaaccgccctatatttgccggtcggctggctgtatggtgcgccgtcttatcagatagtcggttcgatattggaaagcaatcctgccgaggcgcgtgaatttgtcggcaatcttcccgggtcgctttattttgtgcaggcattatttttcatttttggcttgacagtttggaaatattgtgtatcggggggggtatttgctgacgtaaaaaactataaacgccgcagcaaaatatggctgactatattattgactttgattttgtcctgcgcggtgatggataaaatcgccagcgataaagatttgcgagaacctgatgccggcctgttgttgaatattttcgacctgtattacgatttggcttccgcgccggcacaatatgccgccaagcgcgcccacattttggaagcagcaaaaaaagcgtcaacatggcatatccgtcatgttgcgcccaagtataa

SEQ ID NO: 262 - protein, 231 aa, Neisseria meningitidis
  misc_feature (9)..(9): Xaa can be any naturally occurring amino acid
  misc_feature (27)..(35): Xaa can be any naturally occurring amino acid
  misc_feature (200)..(200): Xaa can be any naturally occurring amino acid
MKQSARIKXMNQTLLYTLGICALLTFXXXXXXXXXYHPEYEYGYRYSAVGALASVVFLLLLARGFPRVSSVVLLIYVGTTALYLPVGWLYGAPSYQIVGSILESNPAEAREFVGNLPGSLYFVQALFFIFGLTVWKYCVSGGVFADVKNYKRRSKIWLTILLTLILSCAVMDKIASDKDLREPDAGLLLNIFDLYYDLAXRAGTICRQARPHFGSSKKSVNMAYPSCCAQV

SEQ ID NO: 263 - DNA, 695 bp, Neisseria meningitidis
atgaaacaatccgcccgaataaaaaatatggatcagacattaaaaaatacattgggcatttgcgcgcttttagccttttgttttggcgcggccatcgcatcaggttatcacttggaatatgaatacggctaccgttattctgccgtgggtgctttggcttcggttgtatttttattattattggcacgcggtttcccgcgcgtttcttcagttgttttactgatttacgtcggcacaaccgccctatatttgccggtcggctggctgtatggtgcgccgtcttatcagatagtcggttcgatattggaaagcaatcctgccgaggcgcgtgaatttgtcggcaatcttcccgggtcgctttattttgtgcaggcattatttttcatttttggcttgacagtttggagatattgtgtatcggggggggtatttgctgacgtaaaaaactataaacgccgcagcaaaatatggctgactatattattgactttgattttgtcctgcgcggtgatggataaaatcgccagcgataaagatttgcgagaacctgatgccggcctgttgttgaatattttcgacctgtattacgatttggcttccgcgccggcacaatatgccgccaagcgcgcccacattttggaagcagcaaaaaaagcgtcaacatggcatatccgtcatgttgcgcccaagtataa

SEQ ID NO: 264 - protein, 231 aa, Neisseria meningitidis
  misc_feature (201)..(201): Xaa can be any naturally occurring amino acid
MKQSARIKNMDQTLKNTLGICALLAFCFGAAIASGYHLEYEYGYRYSAVGALASVVFLLLLARGFPRVSSVVLLIYVGTTALYLPVGWLYGAPSYQIVGSILESNPAEAREFVGNLPGSLYFVQALFFIFGLTVWRYCVSGGVFADVKNYKRRSKIWLTILLTLILSCAVMDKIASDKDLREPDAGLLLNIFDLYYDLASXAGTICRQARPHFGSSKKSVNMAYPSCCAQV

SEQ ID NO: 265 - DNA, 285 bp, Neisseria gonorrhoeae
atgggcaaagggcaggacttcacgcccctgcgcgacgcgttgaaagataaggcaaaaggcgtgttcctgatcggcgtcgatgcgccgcaaatccgccgcgatttggacggctgcggcttgaacctgaccgactgcgtcactttggaagaggcggttcagacggcatacgcccaagccgaagcgggcgatattgtcttgctcagccccgcctgcgcgagtttcgatatgtttaaaggctacgcgcaccgttcggaagtgtttatcgaagcgtttaaggctttgtga

SEQ ID NO: 266 - protein, 94 aa, Neisseria gonorrhoeae
MGKGQDFTPLRDALKDKAKGVFLIGVDAPQIRRDLDGCGLNLTDCVTLEEAVQTAYAQAEAGDIVLLSPACASFDMFKGYAHRSEVFIEAFKAL

SEQ ID NO: 267 - DNA, 285 bp, Neisseria meningitidis
atgggtaaagggcaggacttcacgcccctgcgcgatgcactggtaggcaaggcaaaaggcgtgttcttgattggtgtcgatgcgccgcaaatccgccgcgatttggacggctgcggcttgaatatgaccgactgcgccactttgggagaagccgttcagacggcatatgcccaagccgaagcaggcgatattgtgttgctcagccccgcctgcgcgagctttgatatgttcaaaggctacgcgcaccgttcggaagtgtttatcgaagcgtttaaggctttgtga

SEQ ID NO: 268 - protein, 94 aa, Neisseria meningitidis
MGKGQDFTPLRDALVGKAKGVFLIGVDAPQIRRDLDGCGLNMTDCATLGEAVQTAYAQAEAGDIVLLSPACASFDMFKGYAHRSEVFIEAFKAL

SEQ ID NO: 269 - DNA, 285 bp, Neillia sinensis
atgggcaaagggcaggacttcacgcccctgcgcgacgcgcttgccggcaaggcaaaaggcgtgttcctgatcggtgtcgatgcgccgcaaatccgccgcgatttggacggctgcgatctgaatatgaccgactgcgccactttggaagaagcggttcagaaggcatatgcccaagccgaagcgggcgatatcgtgctgctcagccccgcctgcgcgagtttcgatatgtttaaaggctacgcgcaccgttcggaagtgtttatcggggcgtttaaggctttgtga

SEQ ID NO: 270 - protein, 94 aa, Neisseria meningitidis
MGKGQDFTPLRDALAGKAKGVFLIGVDAPQIRRDLDGCDLNMTDCATLEEAVQKAYAQAEAGDIVLLSPACASFDMFKGYAHRSEVFIGAFKAL

SEQ ID NO: 271 - DNA, 1192 bp, Neisseria gonorrhoeae
atggtggtgctgatgacggcgttcggcctgctgatgatttattcggcttctgtgtatttggcatcgaaggaaggcggcgatcagtttttctatttgaccaggcaggcggggttcgtcgttgccggccttatagcgagcggttttttatggtttctttgcaggatgaggacatggcggcggcttgtgccgtggatttttgccttatccggcctgttgctggtagccgtattgattgccgggcgcgaaatcaatggcgcgacccgttggatacctttgggtccgttgaatttccagccgaccgagctgttcaagctggcagtcatcctttatttggcaagcctgttcacgcgccgtgaagaagtgttgcgcagcatggaaagtttgggttggcagtcgatttggcgggggacggccaacctgattatgtccgccaccaatccgcaggcacgtcgtgaaacattagaaatgtacggccgtttccgggcgatcatcctgccgattatgctggtggcgttcggtttggtgctgataatggtacagccggatttcggttcgtttgtcgtcattaccgtcattaccgttggaatgctgtttctggcaggattgccgtggaaatatttttttgtcctggtaggcagcgtcttgggtgggatggtgctgatgattaccgccgctccctaccgtgtgcagcgggtagtggcatttttggacccgtggaaagacccgcagggtgccggctaccagcttacccactctctgatggcaatcgggcgcggagagtggttcggtatgggtttgggtgcgagtttgagcaaacgcggctttctgccggaagcgcataccgattttatttttgccatcatcgctgaagaattcggcttcttcgggatgtgcgtgctgatattctgttacggctggctggtggtgcgggcgttttccatcggcaagcagtcgcgcgatttgggtttgactttcaacgcctatatcgcttcgggtatcggcatttggatcggtatccaaagtttcttcaatatcggtgtgaacatcggtgctttgccgaccaaaggtctgacgctgccgttgatgtcctatggcggttcgtcagtctttttcatgctgatcagcatgatgctgctgttgcgtatcgattatgaaaaccgccagaaaatgcgcggttaccgggtggagtaaa

SEQ ID NO: 272 - protein, 396 aa, Neisseria gonorrhoeae
MVVLMTAFGLLMIYSASVYLASKEGGDQFFYLTRQAGFVVAGLIASGFLWFLCRMRTWRRLVPWIFALSGLLLVAVLIAGREINGATRWIPLGPLNFQPTELFKLAVILYLASLFTRREEVLRSMESLGWQSIWRGTANLIMSATNPQARRETLEMYGRFRAIILPIMLVAFGLVLIMVQPDFGSFVVITVITVGMLFLAGLPWKYFFVLVGSVLGGMVLMITAAPYRVQRVVAFLDPWKDPQGAGYQLTHSLMAIGRGEWFGMGLGASLSKRGFLPEAHTDFIFAIIAEEFGFFGMCVLIFCYGWLVVRAFSIGKQSRDLGLTFNAYIASGIGIWIGIQSFFNIGVNIGALPTKGLTLPLMSYGGSSVFFMLISMMLLLRIDYENRQKMRGYRVE

SEQ ID NO: 273 - DNA, 1190 bp, Neisseria meningitidis
atggtggtgctgatgacggcgttcagcctgctgatgatttattcggcttctgtgtatttggcatcaaaagaaggcggcgatcagtttttctatttgaccagacaggcggggttcgtcgttgccggcttgatagcgagcggtttgttatggtttctttgcaggatgaggacatggcggcggcttgtgccgtggatttttgccctatccggcctgttgctggtagtcgtattgattgccgggcgcgaaatcaatggcgcgacccgttggatacctttgggtccgttgaatttccagccgaccgagctgttcaagctggcggtcatcctttatttggcaagcctgttcacgcgccgtgaagaagtgttgcgcagcatggaaagtttgggttggcagtcgatttggcgggggacggccaatctgatcatgtccgccaccaatccgcagrcacgtcgtgaaacattagaaatgtacggccgtwtccgggcgatcatcctgccgattatgctggtggcgttcggtttggtgctgataatggtacagccggatttcggttcgtttgtcgtcattaccgtcattgccgttggaatgctgtttttggcaggattgccgtggaaatattttttcgtcctggtaggcagcgtcttgggcgggatggtgctgatgattaccgccgctccctaccgtgtgcagcgggtagtggcatttttggacccgtggaaagacccgcagggtgccggctaccagcttacccactctctgatggcaatcgggcgcggagagtggttcggtatgggtttgggtgcgagtttgagcaaacgcggctttctgccggaagcgcataccgattttatttttgccatcatcgccgaagaattcggtttcttcggtatgtgcgtgctgatattctgttacggctggctggtggtgcgggcgttttccatcggcaagcagtcgcgcgatttgggtttgactttcaacgcctatatcgcttcgggtatcggcatttggatcggkrtccaaagtttcttcaatatcggtgtgaacatcggtgctttgccgamcaaaggyctgacgcygccgtgatgtccwatggcggttcgtcagtctttttcatgctgatcagcatgatgctgctgtkgcgtatagattatgaaaaccgccggaaaatgcgcggttatcgggtggagtaa

SEQ ID NO: 274 - protein, 396 aa, Neisseria meningitidis
  misc_feature (149)..(149): Xaa can be any naturally occurring amino acid
  misc_feature (160)..(160): Xaa can be any naturally occurring amino acid
  misc_feature (339)..(339): Xaa can be any naturally occurring amino acid
  misc_feature (354)..(354): Xaa can be any naturally occurring amino acid
  misc_feature (359)..(359): Xaa can be any naturally occurring amino acid
  misc_feature (361)..(361): Xaa can be any naturally occurring amino acid
  misc_feature (364)..(364): Xaa can be any naturally occurring amino acid
  misc_feature (380)..(380): Xaa can be any naturally occurring amino acid
MVVLMTAFSLLMIYSASVYLASKEGGDQFFYLTRQAGFVVAGLIASGLLWFLCRMRTWRRLVPWIFALSGLLLVVVLIAGREINGATRWIPLGPLNFQPTELFKLAVILYLASLFTRREEVLRSMESLGWQSIWRGTANLIMSATNPQXRRETLEMYGRXRAIILPIMLVAFGLVLIMVQPDFGSFVVITVIAVGMLFLAGLPWKYFFVLVGSVLGGMVLMITAAPYRVQRVVAFLDPWKDPQGAGYQLTHSLMAIGRGEWFGMGLGASLSKRGFLPEAHTDFIFAIIAEEFGFFGMCVLIFCYGWLVVRAFSIGKQSRDLGLTFNAYIASGIGIWIGXQSFFNIGVNIGALPXKGLTXPXMSXGGSSVFFMLISMMLLXRIDYENRRKMRGYRVE

SEQ ID NO: 275 - DNA, 1191 bp, Neisseria meningitidis
atggtggtgctgatgacggcgttcagcctgctgatgatttattcggcttctgtgtatttggcatcaaaagaaggcggcgatcagtttttctatttgaccagacaggcggggttcgtcgttgccggcttgatagcgagcggtttgttatggtttctttgcaggatgaggacatggcggcggcttgtgccgtggatttttgccctatccggcctgttgctggtagtcgtattgattgccgggcgcgaaatcaatggcgcgacccgttggatacctttgggtccgttgaatttccagccgaccgagctgttcaagctggcggtcatcctttatttggcaagcctgttcacgcgccgtgaagaagtgttgcgcagcatggaaagtttgggttggcagtcgatttggcgggggacggccaatctgatcatgtccgccaccaatccgcaggcacgtcgtgaaacattagaaatgtacggccgtttccgggcgatcatcctgccgattatgctggtggcgttcggtttggtgctgataatggtacagccggatttcggttcgtttgtcgtcattaccgtcattgccgttggaatgctgtttttggcaggattgccgtggaaatattttttcgtcctggtaggcagcgtcttgggcgggatggtgctgatgattaccgccgctccctaccgtgtgcagcgggtagtggcatttttggacccgtggaaagacccgcagggtgccggctaccagcttacccactctctgatggcaatcgggcgcggagagtggttcggtatgggtttgggtgcgagtttgagcaaacgcggctttctgccggaagcgcataccgattttatttttgccatcatcgccgaagaattcggtttcttcggtatgtgcgtgctgatattctgttacggctggctggtggtgcgggcgttttccatcggcaagcagtcgcgcgatttgggtttgactttcaacgcctatatcgcttcgggtatcggcatttggatcggtatccaaagtttcttcaatatcggtgtgaacatcggtgctttgccgaccaaaggtctgacgctgccgttgatgtcctatggcggttcgtcagtctttttcatgctgatcagcatgatgctgctgttgcgtatagattatgaaaaccgccggaaaatgcgcggttaccgggtggagtaa

SEQ ID NO: 276 - protein, 396 aa, Neisseria meningitidis
MVVLMTAFSLLMIYSASVYLASKEGGDQFFYLTRQAGFVVAGLIASGLLWFLCRMRTWRRLVPWIFALSGLLLVVVLIAGREINGATRWIPLGPLNFQPTELFKLAVILYLASLFTRREEVLRSMESLGWQSIWRGTANLIMSATNPQARRETLEMYGRFRAIILPIMLVAFGLVLIMVQPDFGSFVVITVIAVGMLFLAGLPWKYFFVLVGSVLGGMVLMITAAPYRVQRVVAFLDPWKDPQGAGYQLTHSLMAIGRGEWFGMGLGASLSKRGFLPEAHTDFIFAIIAEEFGFFGMCVLIFCYGWLVVRAFSIGKQSRDLGLTFNAYIASGIGIWIGIQSFFNIGVNIGALPTKGLTLPLMSYGGSSVFFMLISMMLLLRIDYENRRKMRGYRVE

SEQ ID NO: 277 - DNA, 1069 bp, Neisseria gonorrhoeae
atgggcggtaaaacctttatgctgatggcgggcggaacgggcggacacattttcccagctctggctgtggcggattcattgcgcgtgcgcggtcatcatgtaatttggctgggcagcaaggattcgatggaagagcgcatcgtgccgcaatacggcatacgcttggaaacgctggcgattaaaggaatacgcggcaacggcatcaaacgcaagctgatgcttccgtttactctgtacaaaaccgtccgcgaagcgcagcggattatccgcaaacaccgtgtcgagtgcgtcatcggcttcggcggttttgttacctttcccggcggtctggcggcgaaactcttgggcgtgccgattgtgattcacgagcaaaacgccgtggcaggcttgtccaaccgccacctgtcgcgctgggcgaaacgggtgttgtacgcttttccgaaagcgttcagccacgaaggcggtttggtcggcaaccccgtccgcgccgatattagcaacctgcccgtgcctgccgaacgcttccaagggcgcgaaggccgtctgaaaattttggtggtcggcggcagtttgggtgcggacgttttgaacaaaaccgtaccgcaggcgttggcactgctgcctgaagaggtgcgcccgcagatgtaccaccagtcggggcgtaacaagctgggcaatcttcaggcggattatgacgcgttgggcgtgaaagcggaatgcgtggaatttattaccgacatggtgtccgcctaccgtgatgccgatttggtgatttgccgtgccggcgcgctgacgattgccgagttgacggcggcggggctgggcgcgttgttagtgccgtatcctcacgccgttgatgaccatcaaaccgccaacgcgcgtttcatggtgcaggcagaagcggggctgctgttgccgcaaacccagttgacggcggaaaaactcgccgaaatcctcggcagcctcaaccgcgaaaaatgcctcaaatgggcggaaaacgcccgtacgttggcattgccgcacagcgcggatgacgttgccgaagccgcgattgcgtgtgcggcgtaaa

SEQ ID NO: 278 - protein, 355 aa, Neisseria gonorrhoeae
MGGKTFMLMAGGTGGHIFPALAVADSLRVRGHHVIWLGSKDSMEERIVPQYGIRLETLAIKGIRGNGIKRKLMLPFTLYKTVREAQRIIRKHRVECVIGFGGFVTFPGGLAAKLLGVPIVIHEQNAVAGLSNRHLSRWAKRVLYAFPKAFSHEGGLVGNPVRADISNLPVPAERFQGREGRLKILVVGGSLGADVLNKTVPQALALLPEEVRPQMYHQSGRNKLGNLQADYDALGVKAECVEFITDMVSAYRDADLVICRAGALTIAELTAAGLGALLVPYPHAVDDHQTANARFMVQAEAGLLLPQTQLTAEKLAEILGSLNREKCLKWAENARTLALPHSADDVAEAAIACAA

SEQ ID NO: 279 - DNA, 1008 bp, Neisseria meningitidis
  misc_feature (688)..(753): n is a, c, g, or t
atgggcggtaaaacctttatgctgawkkcgggcggaacgggcggacatattttccccgcgctggcggtggcggattcattgcgcgcgcgcggccatcatgtgatttggctgggcagcaaggattcgatggaagagcgtatcgtgccgcaatacggcatacgcttggaaacgctggcgattaaaggcgtgcgcggcaacggcatcaaacgcaaactgatgctgccggttactttgtatcaaaccgtccgcgaagcgcagcggattatccgcaaacaccgtgtcgagtgcgtcatcggcttcggcggcttcgttaccttccccggcggtttggcggcgaagctattargcgtgccgattgtgattcacgagcaaaacgccgtggcaggtttgtccaaccgccacctgtcgcgctgggcgaagcgggtgttgtacgcttttccgaaagcgttcagccacgaaggcggcttggtcggcaaccccgtccgcgccgatattagcaacctgcccgtgcctgccgaacgcttccaagggcgtgaaggccgtctgaaaattttggtggtcggcggcagtttgggcgcggacgttttgaacaaaaccgtaccgcatgcattggctttgctgcccgacaatgcgcgtccgcatatgtaccaccaatcgggacggggcaagctgggcatcttgcaggcgnnnnnnnnnnnnnnnnnnnnnnnnnnnnnnnnnnnnnnnnnnnnnnnnnnnnnnnnnnnnnnnnnngcgggattgggtgcgttgttagtgccgtatcctcacgcggttgacgatcaccaaaccgccaacgcgcgttttatggtgcaggcggaggcgggattgctgttgccgcaaacccagttgacggcggaaaaactcgccgagattctcggcggcttaaaccgcgaaaaatgcctcaaatgggcagaaaacgcccgtacgttggcactgccgcacagtgcggacgacgtggcggaagccgcgattgcgtgtgcggcgtaa

SEQ ID NO: 280 - protein, 335 aa, Neisseria meningitidis
  misc_feature (9)..(10): Xaa can be any naturally occurring amino acid
  misc_feature (116)..(116): Xaa can be any naturally occurring amino acid
  misc_feature (230)..(251): Xaa can be any naturally occurring amino acid
MGGKTFMLXXGGTGGHIFPALAVADSLRARGHHVIWLGSKDSMEERIVPQYGIRLETLAIKGVRGNGIKRKLMLPVTLYQTVREAQRIIRKHRVECVIGFGGFVTFPGGLAAKLLXVPIVIHEQNAVAGLSNRHLSRWAKRVLYAFPKAFSHEGGLVGNPVRADISNLPVPAERFQGREGRLKILVVGGSLGADVLNKTVPHALALLPDNARPHMYHQSGRGKLGILQAXXXXXXXXXXXXXXXXXXXXXXAGLGALLVPYPHAVDDHQTANARFMVQAEAGLLLPQTQLTAEKLAEILGGLNREKCLKWAENARTLALPHSADDVAEAAIACAA

SEQ ID NO: 281 - DNA, 1068 bp, Neisseria meningitidis
atgggcggtaaaacctttatgctgatggcgggcggaacgggcggacatattttccccgcgctggcggtggcggattcattgcgcgcgcgcggccatcatgtaatttggctgggcagcaaggattcgatggaagagcgcatcgtgccgcaatacgacatcctgctcgaaacgctggcgattaaaggcgtgcgcggcaacggcatcaaacgcaagctgatgctgccgtttactttgtatcaaactgtccgcgaagcgcagcagattatccgcaaacaccgtgtcgagtgcgtcatcggcttcggcggcttcgttacctttcccggcggtttggcggcgaagttattaggcgtgccgattgtgattcacgagcaaaacgccgtggcaggtttgtccaaccgccacctgtcgcgctgggcgaagcgggtgttgtacgcttttccgaaagcgttcagccacgaaggcggcttggtcggcaaccccgtccgcgccgatattagcaacctgcccgtgcctgccgaacgcttccaagggcgtgaaggccgtctgaaaattttggtggtcggcggcagtttgggcgcggacgttttgaacaaaaccgtaccgcaggcattggctttgctgcccgacaatgcgcgtccgcagatgtaccaccaatcgggacggggcaagctgggcagcttgcaggcggattacgacgcgctgggcgtgcaagcggaatgcgtggaatttattaccgatatggtgtccgcctaccgcgatgccgatttggtgatttgccgtgccggcgcgctgacgattgccgagttgacggcggcgggattgggtgcgttgttagtgccgtatcctcacgccgttgatgaccatcaaaccgccaacgcgcgttttatggtgcaggcggaggcgggattgctgttgccgcaaacccagttgacggcggaaaaactcgccgagattctcggcggcttaaaccgcgaaaaatgcctcaaatgggcagaaaacgcccgtacgttggcactgccgcacagtgcggacgacgttgccgaagccgcgattgcgtgtgcggcgtaa

SEQ ID NO: 282 - protein, 355 aa, Neisseria meningitidis
MGGKTFMLMAGGTGGHIFPALAVADSLRARGHHVIWLGSKDSMEERIVPQYDILLETLAIKGVRGNGIKRKLMLPFTLYQTVREAQQIIRKHRVECVIGFGGFVTFPGGLAAKLLGVPIVIHEQNAVAGLSNRHLSRWAKRVLYAFPKAFSHEGGLVGNPVRADISNLPVPAERFQGREGRLKILVVGGSLGADVLNKTVPQALALLPDNARPQMYHQSGRGKLGSLQADYDALGVQAECVEFITDMVSAYRDADLVICRAGALTIAELTAAGLGALLVPYPHAVDDHQTANARFMVQAEAGLLLPQTQLTAEKLAEILGGLNREKCLKWAENARTLALPHSADDVAEAAIACAA

SEQ ID NO: 283 - DNA, 1131 bp, Neisseria gonorrhoeae
atgtttttatggctcgcacatttcagcaactggttaaccggtctgaatatttttcaatacaccacattccgcgccgttatggcggcgttgaccgccttggcgttttccctgatgttcggcccgtggacgatacgcaggctgaccgcgctcaaatgcgggcaggcagtgcgtaccgacggcccgcaaacccacctcgtcaaaaacggcacgccgacgatgggcggttcgctgattctgaccgccattaccgtgtccaccctgttgtggggcaactgggcgaacccgtatatctggattctcttgggcgtactgcttgccaccggtgcgctcggtttttacgacgactggcgcaaagtcgtttataaagaccccaacggcgtgtccgccaaattcaaaatggtgtggcagtcaagcgttgccgttatcgccggtttggcattgttttaccttgccgccaattccgccaacaatattttgattgtcccgtttttcaaacaaatcgccctgccgctgggcgtggtcggctttttggtgttgtcttacctgaccatcgtcggcacatccaacgccgtcaacctcaccgacggcttggacggccttgccgccttcccgttcgtcctcgttgccgccgggctcgccattttcgcctacgtcagcggacactaccaattttcccaatacctccagcttccctatgtcgccggcgcgaacgaagtcgctatattctgcaccgccatgtgcggcgcgtgcctcggatttttgtggttcaacgcctatcccgcgcaagtctttatgggcgatgtcggcgcgctggcattgggtgccgcgctcggtaccgttgccgtcatcgtccgccaagaatttgtcctcgtcattatgggcggtctgttcgtcgtagaagccgtgtccgttatgcttcatgtcggctggtacaagaaaaccaaaaaacgcatcttcctgacggcaccgattcatcaccattaccaacttcgatgctggaaagaaacgcaagtcgtcgtccgtttctggattattaccatcgtcgtggttttgataggtttgagtaccctcaaaattcgcggaaactatgccgtccgaacacctttcagacggcatttgaacgcgcaataa

SEQ ID NO: 284 - protein, 376 aa, Neisseria gonorrhoeae
MFLWLAHFSNWLTGLNIFQYTTFRAVMAALTALAFSLMFGPWTIRRLTALKCGQAVRTDGPQTHLVKNGTPTMGGSLILTAITVSTLLWGNWANPYIWILLGVLLATGALGFYDDWRKVVYKDPNGVSAKFKMVWQSSVAVIAGLALFYLAANSANNILIVPFFKQIALPLGVVGFLVLSYLTIVGTSNAVNLTDGLDGLAAFPFVLVAAGLAIFAYVSGHYQFSQYLQLPYVAGANEVAIFCTAMCGACLGFLWFNAYPAQVFMGDVGALALGAALGTVAVIVRQEFVLVIMGGLFVVEAVSVMLHVGWYKKTKKRIFLTAPIHHHYQLRCWKETQVVVRFWIITIVVVLIGLSTLKIRGNYAVRTPFRRHLNAQ

SEQ ID NO: 285 - DNA, 1131 bp, Neisseria meningitidis
  misc_feature (29)..(29): n is a, c, g, or t
  misc_feature (49)..(513): n is a, c, g, or t
atgtttttatggctcgcacatttcagcanctggttaaccggtctgaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgtggtcggctttttggtgttgtcttacctgaccatcgtcggcacatccaatgccgtcaacctcaccgacggcttggacggccttgcgaccttccccgtcgtcctcgttgccgccggcctcgccatcttcgcctatgccagcggccactcacaatttgcccaatacctgcaattaccttacgttgccggcgcaaacgaagtggtgattttctgtaccgccatgtgcggcgcgtgcctcggtttcttgtggtttaacgcctatcccgcgcaagtctttatgggcgatgtcggtgcattggcattgggtgccgcgctcggtaccgtcgccgttatcgtccgccaagagtttgtcctcgtcattatgggcggattatttgtcgtagaagccgtatccgttatgcttcaggttggctggtataagaaaaccaaaaaacgcatcttcctgatggcgcccatccatcaccactacgaacaaaaaggctggaaagaaacccaagtcgtcgtccgcttttggattattaccatcgtcttggtgttgatcggtttgagtaccctcaaaatccgctgaacctatgccgtctgaacatctttcagacggcatttgaacgcgcaataa

SEQ ID NO: 286 - protein, 376 aa, Neisseria meningitidis
  misc_feature (361)..(361): Xaa can be any naturally occurring amino acid
  misc_feature (366)..(366): Xaa can be any naturally occurring amino acid
MFLWLAHFSNWLTGLNIFQYTTFRAVMAALTALAFSLMFGPWTIRRLTALKCGQAVRTDGPQTHLVKNGTPTMGGSLILTAITVSTLLWGNWANPYIWILLGVLLATGALGFYDDWRKVVYKDPNGVSAKFKMVWQSSVAVIAGLALFYLAANSANNILIVPFFKQIALPLGVVGFLVLSYLTIVGTSNAVNLTDGLDGLATFPVVLVAAGLAIFAYASGHSQFAQYLQLPYVAGANEVVIFCTAMCGACLGFLWFNAYPAQVFMGDVGALALGAALGTVAVIVRQEFVLVIMGGLFVVEAVSVMLQVGWYKKTKKRIFLMAPIHHHYEQKGWKETQVVVRFWIITIVLVLIGLSTLKIRXTYAVXTSFRRHLNAQ

SEQ ID NO: 287 - DNA, 1131 bp, Neisseria meningitidis
atgtttttatggctcgcacatttcagcaactggttaaccggtctgaatatttttcaatacaccacattccgcgccgtcatggcggcgttgaccgccttggcgttttccctgatgttcggcccgtggacgatacgcaggctgaccgcgctcaaatgcgggcaggcagtgcgtaccgacggtccgcaaacccacctcgtcaaaaacggcacgccgacgatgggcggttcgctgattctgaccgccattaccgtgtccaccctgttgtggggcaactgggcaaacccgtatatctggattctcttgggcgtattgctcgccacgggcgcactcggtttttacgacgactggcgcaaagtcgtctataaagaccccaacggcgtgtccgccaaattcaaaatggtgtggcagtcaagcgttgccattatcgccggtttggcattgttttaccttgccgccaattccgccaacaatattttgattgtcccgttcttcaaacaaatcgccctgccgctgggcgtggtcggctttttggtgttgtcttacctgaccatcgtcggcacatccaatgccgtcaacctcaccgacggcttggacggccttgcgaccttccccgtcgtcctcgttgccgccggcctcgccatcttcgcctatgccagcggccactcacaatttgcccaatacctgcaattaccttacgttgccggcgcaaacgaagtggtgattttctgtaccgccatgtgcggcgcgtgcctcggtttcttgtggtttaacgcctatcccgcgcaagtctttatgggcgatgtcggtgcattggcattgggtgccgcgctcggtaccgtcgccgtcatcgtccgccaagagtttgtcctcgtcattatgggcggattatttgtcgtagaagccgtatccgttatgcttcaggtcggctggtataagaaaaccaaaaaacgcatcttcctgatggcgcccatccatcaccactacgaacaaaaaggctggaaagaaacccaagtcgtcgtccgcttttggattattaccatcgtcttggtgttgatcggtttgagtaccctcaaaatccgctgaacctatgccgtctgaacacctttcagacggcatttgaacgcgcaataa

SEQ ID NO: 288 - protein, 374 aa, Neisseria meningitidis
MFLWLAHFSNWLTGLNIFQYTTFRAVMAALTALAFSLMFGPWTIRRLTALKCGQAVRTDGPQTHLVKNGTPTMGGSLILTAITVSTLLWGNWANPYIWILLGVLLATGALGFYDDWRKVVYKDPNGVSAKFKMVWQSSVAIIAGLALFYLAANSANNILIVPFFKQIALPLGVVGFLVLSYLTIVGTSNAVNLTDGLDGLATFPVVLVAAGLAIFAYASGHSQFAQYLQLPYVAGANEVVIFCTAMCGACLGFLWFNAYPAQVFMGDVGALALGAALGTVAVIVRQEFVLVIMGGLFVVEAVSVMLQVGWYKKTKKRIFLMAPIHHHYEQKGWKETQVVVRFWIITIVLVLIGLSTLKIRTYAVTPFRRHLNAQ

SEQ ID NO: 289 - DNA, 450 bp, Neisseria gonorrhoeae
atgccgcccaaaatcacgaagagcgggttttgcaaaccggcaatcgcggcggcggtcgcgccgacattcgtgcctttgctgtcgtcgatgaataccacgccgtttttctcgccgattttttccacacggtgcggcaagccttggaaggttttgacgtgttccagcaatgcttcgcgcggcaaaccgacggcctcgcacaaagccacggcagccataacgttggcggcgttgtgcaaaccttgcagcgggatgtcttgcgtagaaatcaaatcttcattgccttgttttaaacagcccgtcccgcgttccaaccaaaaatcggcttcgtgttccaaggaaaaccgtttcacttcacgccctgcccgtttcatggcgcggcagaacacgtcgtccgcattcaaaacctgcactccatcgccacggaaaatctcggctttggtatgcgcgtag

SEQ ID NO: 290 - protein, 149 aa, Neisseria gonorrhoeae
MPPKITKSGFCKPAIAAAVAPTFVPLLSSMNTTPFFSPIFSTRCGKPWKVLTCSSNASRGKPTASHKATAAITLAALCKPCSGMSCVEIKSSLPCFKQPVPRSNQKSASCSKENRFTSRPARFMARQNTSSAFKTCTPSPRKISALVCA

SEQ ID NO: 291 - DNA, 450 bp, Neisseria meningitidis
atgccgcccaaaatcackawgagcggattttgcaaaccggcaatcgcggcggcagtcgcgccgacattcgtgcctttgctgtcgtcgataaacaccacgccgtttttctcgccgattttttccacgcggtgcggcaggccttggaaggttttgacgtgttcgagcaatgcttcgcgcgacaaaccgatggcctcacacaaagccackgcagccatgacgttagcggcgttgtgcakaccttgcaacggwatgtcttgcgtgacaatcaaatcttcattgccttgtttcaggcggcctgtctcgcgttccaaccagaaatcagcttcgtgttccaacgaaaaccattttacctcgcgcccggcacgcttcatcgcgcggcagaacgcatcgtccgcattcaaaacctgcacgccgtcgccacggaaaatcttggctttggtatgcgcatag

SEQ ID NO: 292 - protein, 149 aa, Neisseria meningitidis
  misc_feature (7)..(7): Xaa can be any naturally occurring amino acid
  misc_feature (79)..(79): Xaa can be any naturally occurring amino acid
MPPKITXSGFCKPAIAAAVAPTFVPLLSSINTTPFFSPIFSTRCGRPWKVLTCSSNASRDKPMASHKATAAMTLAALCXPCNGMSCVTIKSSLPCFRRPVSRSNQKSASCSNENHFTSRPARFIARQNASSAFKTCTPSPRKILALVCA

SEQ ID NO: 293 - DNA, 450 bp, Neisseria meningitidis
atgccgcctaaaatcacgaagagcggattttgcaaaccggcaatcgcggcggcggtcgcaccgacgttcgtgcctttgctgtcgtcgatgaacaccacgccatttttctcgccgattttttccacgcggtgcggcaggccttgaaaggttttgacgtgttcgagcaatgcttcgcgcggcaaaccgacggcttcgcacaaggcaacggcagccatcacgttagtggcgttgtgcaagccttgcagcggaatatcttgcgtggcaatcaaatcttcattgccttgtttcaggcgacctgtctcacgttccaaccaaaaatcggcttcgtattccaacgaaaaccatttcacctcgcgcccggcgcgcttcatcgcacgacagaacgcatcgtccgcattcaaaacctgcacaccgtcgccacggaaaatcttggctttggtatgcgcgtag

SEQ ID NO: 294 - protein, 148 aa, Neisseria meningitidis
MPPKITKSGFCKPAIAAAVAPTFVPLLSSMNTTPFFSPIFSTRCGRPKVLTCSSNASRGKPTASHKATAAITLVALCKPCSGISCVAIKSSLPCFRRPVSRSNQKSASYSNENHFTSRPARFIARQNASSAFKTCTPSPRKILALVCA

SEQ ID NO: 295 - DNA, 356 bp, Neisseria gonorrhoeae
atgcgcgtagtcgagcaaatcgtcgtagcggtcgagatggtcttcggaaatgttcatcaccgtcgccgcagtcgggcgcaggctttcggtgttttccagttggaagctggaaagctcccacacccacacgtccgcctttttgccttcgcgctgcaattctgcctccaagacgggcgtaccgatattgcccgcaatgacggtatccagcccgcacttgatgcagagatagcggaccaggctggttaccgtggttttgccgttgctgccggtaatcgcaatcaccttgtcgccgcggcggttcacaatgtccgccagcaattggatgtcgcctagcacgcgcccgccgttttgcttga

SEQ ID NO: 296 - protein, 118 aa, Neisseria gonorrhoeae
  misc_feature (111)..(111): Xaa can be any naturally occurring amino acid
  misc_feature (114)..(114): Xaa can be any naturally occurring amino acid
MRVVEQIVVAVEMVFGNVHHRRRSRAQAFGVFQLEAGKLPHPHVRLFAFALQFCLQDGRTDIARNDGIQPALDAEIADQAGYRGFAVAAGNRNHLVAAAVHNVRQQLDVAXHAXRRFA

SEQ ID NO: 297 - DNA, 356 bp, Neisseria meningitidis
atgcgcatagtcgagcaagtcgtcgtagcggtcgagatggtcttcggaaatgttcagcaccgtcgccgcagtcggacgcaggctttcggtgttttccagttggaagctggaaagctccaacacccacacgtccgcctttttgccttcgcgctgccattccgcctccaaaaccggcgtgccgatattgcccgcgataacggtatccagcccgcacttgatacagagatagccgaccaggctcgttaccgtggttttgccgttgctgccggtaatcgcaattaccttgtcgtcccggcggttcacaatgtccgccagcaattcgatgtcgcccaacacgcgtccgccgttttgcttga

SEQ ID NO: 298 - protein, 118 aa, Neisseria meningitidis
  misc_feature (114)..(114): Xaa can be any naturally occurring amino acid
MRIVEQVVVAVEMVFGNVQHRRRSRTQAFGVFQLEAGKLQHPHVRLFAFALPFRLQNRRADIARDNGIQPALDTEIADQARYRGFAVAAGNRNYLVVPAVHNVRQQFDVAQHAXRRFA

SEQ ID NO: 299 - DNA, 356 bp, Neisseria meningitidis
atgcgcgtagtcgagcaagtcgtcgtagcggtcgagatggtcttcggaaatgttcagcactgtcgccgcagtcgggcgcaggctttcggtgttttccagttggaaactggaaagctccaacacccacacgtccgcctttttgccttcgcgctgcaattccgcctccaaaaccggcgcgccgatattgcccgcgataacggtatccagcccacacttgatgcagagatagccgaccaggctcgttaccgtggttttgccgttgctgccggtaatcgcaatcaccttgtcgccgcggcggttcacaatgtccgccagcaattcgatgtcgcccaacacgcgtccgccgtttcgcttaa

SEQ ID NO: 300 - protein, 118 aa, Neisseria meningitidis
  misc_feature (114)..(114): Xaa can be any naturally occurring amino acid
MRVVEQVVVAVEMVFGNVQHCRRSRAQAFGVFQLETGKLQHPHVRLFAFALQFRLQNRRADIARDNGIQPTLDAEIADQARYRGFAVAAGNRNHLVAAAVHNVRQQFDVAQHAXRRFA

SEQ ID NO: 301 - DNA, 1380 bp, Neisseria meningitidis
atgacggcgtttgcatttcagacggcatcacaaagccttaaacgcttcgataaacacttccgaacggtgcgcgtagcctttgaacatatcaaagctcgcgcaggcggggctgagcaacacaatatcgcctgcttcggcttgggcatatgccgtctgaacggcttctcccaaagtggcgcagtcggtcatattcaagccgcagccgtccaaatcgcggcggatttgcggcgcatcgacaccaatcaagaacacgccttttgccttgcctaccagtgcatcgcgcaggggcgtgaagtcctgccctttacccatgccgcccaaaatcacgaagagcggattttgcaaaccggcaatcgcggcggcagtcgcgccgacattcgtgcctttgctgtcgtcgataaacaccacgccgtttttctcgccgattttttccacgcggtgcggcaggccttggaaggttttgacgtgttcgagcaatgcttcgcgcgacaaaccgatggcctcacacaaagccacggcagccatgacgttagcggcgttgtgcagaccttgcaacggaatgtcttgcgtgacaatcaaatcttcattgccttgtttcaggcggcctgtctcgcgttccaaccagaaatcagcttcgtgttccaacgaaaaccattttacctcgcgcccggcacgcttcatcgcgcggcagaacgcatcgtccgcattcaaaacctgcacgccgtcgccacggaaaatcttggctttggtatgcgcatagtcgagcaagtcgtcgtagcggtcgagatggtcttcggaaatgttcagcaccgtcgccgcagtcggacgcaggctttcggtgttttccagttggaagctggaaagctccaacacccacacgtccgcctttttgccttcgcgctgccattccgcctccaaaaccggcgtgccgatattgcccgcgataacggtatccagcccgcacttgatacagagatagccgaccaggctcgttaccgtggttttgccgttgctgccggtaatcgcaattaccttgtcgtcccggcggttcacaatgtccgccagcaattcgatgtcgcccaacacgcgtccgccgttttgcttgaacgcctcaatatccggctgccgctcgctgatgccgggactgagagccagaatatcgaaaccgttgtccagcgcatctttcagacggcccgtgtaaaacaccaacccgtcaaacatcttaccgatttgcgacacgcgttccggcttcagctccgcatcatacgcagcaacctccgcgccgtttttgcgcaggtaggcaatcatggaaatacccgtaccgccgagtccggcgacgaggatttttttgttttgaaaagtcattttggtttgtcctaa

SEQ ID NO: 302 - protein, 459 aa, Neisseria meningitidis
MTAFAFQTASQSLKRFDKHFRTVRVAFEHIKARAGGAEQHNIACFGLGICRLNGFSQSGAVGHIQAAAVQIAADLRRIDTNQEHAFCLAYQCIAQGREVLPFTHAAQNHEERILQTGNRGGSRADIRAFAVVDKHHAVFLADFFHAVRQALEGFDVFEQCFARQTDGLTQSHGSHDVSGVVQTLQRNVLRDNQIFIALFQAACLAFQPEISFVFQRKPFYLAPGTLHRAAERIVRIQNLHAVATENLGFGMRIVEQVVVAVEMVFGNVQHRRRSRTQAFGVFQLEAGKLQHPHVRLFAFALPFRLQNRRADIARDNGIQPALDTEIADQARYRGFAVAAGNRNYLVVPAVHNVRQQFDVAQHASAVLLERLNIRLPLADAGTESQNIETVVQRIFQTARVKHQPVKHLTDLRHAFRLQLRIIRSNLRAVFAQVGNHGNTRTAESGDEDFFVLKSHFGLS

SEQ ID NO: 303 - DNA, 309 bp, Neisseria gonorrhoeae
atggaaatacccgtgccgccaagtccggcgacgaggatttttttgtttgaaagtcattttggttttgtcctaaaacaaatcatattgggcaggagacgtccgcccttgcccaagccgctttcagacggcatcgcgagccgattaataacccgccttcaggcgttggtcattgtcgcagctgttttggtctccgttttgacaagccttgccaagccattgttgagcgagcgcaaggtcttggcgcacgccgcgtccatcgtaatacatcaagcccaaattgtattgggcttgggcatccccttgttctga

SEQ ID NO: 304 - protein, 102 aa, Neisseria gonorrhoeae
MEIPVPPSPATRIFLFESHFGFVLKQIILGRRRPPLPKPLSDGIASRLITRLQALVIVAAVLVSVLTSLAKPLLSERKVLAHAASIVIHQAQIVLGLGIPLF

SEQ ID NO: 305 - DNA, 306 bp, Neisseria meningitidis
atggaaatacccgtaccgccgagtccggcgacgaggatttttttgtttgaaaagtcattttggtttgtcctaaaacaaatcatattgagcaggagatgtccgcccctgcccaagccgctttcagacggcatcgcgagctgttcaataacccgccttcaggcgttggtcattgtcgcagccgtcttggtctccgttttgacaagccttgccaaaccattcttgtgcaagggcgcggtcttggcgcacgccgcgtctttcggcatacatcacgcccaaattgttttgggcttgggctaccccctgcgc

SEQ ID NO: 306 - protein, 102 aa, Neisseria meningitidis
MEIPVPPSPATRIFLFEKSFWFVLKQIILSRRCPPLPKPLSDGIASCSITRLQALVIVAAVLVSVLTSLAKPFLCKGAVLAHAASFGIHHAQIVLGLGYPLR

SEQ ID NO: 307 - DNA, 288 bp, Neisseria meningitidis
atggaaatacccgtgccgccaagtccggcgacgaggatttttttgttttggaaatcattttggtttgtcctaaaacaaatcatattgagcaggggatgtctgatcctgctcaagccgctttcagacggcatcgcgagctgttcaataacccgctttcaggcgttggtcattgtcgcagctgtcttggtatccgttttgacaagccttgccaagccattcttgtgcaagggcgcggtcttggcgcacgccgcgtctttcggcatacatcacgcccaaattgttttgggc

SEQ ID NO: 308 - protein, 96 aa, Neisseria meningitidis
MEIPVPPSPATRIFLFWKSFWFVLKQIILSRGCLILLKPLSDGIASCSITRFQALVIVAAVLVSVLTSLAKPFLCKGAVLAHAASFGIHHAQIVLG

SEQ ID NO: 309 - DNA, 1521 bp, Neisseria gonorrhoeae
atgttttttatttcaatccgctatatatttgtcagaaaactatggtgcgcaaacggtcagacctttaaaataacgcctttacgcactaaaaaccaaccggaacgcaacattatgatgaaaaatcgagtaagcaacatccattttgtcggtatcggcggcgtcggcatgagcggtatcgccgaagtcttgcacaatttgggctttaaagtttccggttcggatcaggcgcgaaatgccgctaccgagcatttgagcagcctgggcattcaagtttatcccggccataccgcagaacacgttaacggtgcggatgtcgtcgttgcctctaccgccgtcaagaaagaaaatcccgaagttgtcgctgcgttggagcggcaaattcccgttattccgcgcgccttgatgctggcagagctgatgcgcttccgtgacggcatcgccattgccggtacgcacggcaaaaccacgaccaccagcctgaccgcctccatcctcggcgcggcaggactcgaccccactttcgttatcggcggcaaactcaacgccgcaggcaccaacgcccgcttgggcaaaggcgaatacatcgttgccgaagccgacgaatccgatgcctctttcctacatctgaccccgattatgtccgtcgttaccaatatcgacgaagaccatatggatacctacgggcacagcgtcgaaaaactgcatcaggcgtttatcgatttcatccaccgtatgcccttctacggcaaagcctttttgtgtgttgacagcgaacacgtccgcgcgattttgcccaaagtgagcaaaccttatgctacttacggtttggacgataccgccgacatctacgccaccgacatcgaaaacgtcggcgcgcaaatgaaattcaccgtccatgttcaaatgaaaggacatgagcaggggtcgtttgaagtcgtgctgaatatgcccggcagacacaacgtgctgaacgcattggcagccatcggcgtggcgctggaagtcggcgcatcggttgaagcgatccaaaaaggcttgctcggctttgaaggcgtcggccgccgcttccaaaaatacggcgacatcaagttgccaaacggcgggaccgctttgctggtggacgattacggacaccaccccgtcgaaatggcggcaacccttgccgctgcacgcggcgcgtatccggaaaaacgtttggtgctcgccttccagccgcaccgctatacccgcacgcgcgatttgtttgaagactttaccaaagtactcaataccgttgatgcgctggtactgaccgaagtttatgccgccggcgaagagccggttgccgccgccgactcccgcgccttggcgcgtgctatccgcgtattgggcaaacttgagccgatttactgcgaaaatgtcgccgacctgccgcaaatgctgatgaatgttttacaggatggcgatgttgtgttgaatatgggtgcgggaagcatcaaccgcgttccttccgcgctgttggaattgtcgaaacagatttga

SEQ ID NO: 310 - protein, 506 aa, Neisseria gonorrhoeae
MFFISIRYIFVRKLWCANGQTFKITPLRTKNQPERNIMMKNRVSNIHFVGIGGVGMSGIAEVLHNLGFKVSGSDQARNAATEHLSSLGIQVYPGHTAEHVNGADVVVASTAVKKENPEVVAALERQIPVIPRALMLAELMRFRDGIAIAGTHGKTTTTSLTASILGAAGLDPTFVIGGKLNAAGTNARLGKGEYIVAEADESDASFLHLTPIMSVVTNIDEDHMDTYGHSVEKLHQAFIDFIHRMPFYGKAFLCVDSEHVRAILPKVSKPYATYGLDDTADIYATDIENVGAQMKFTVHVQMKGHEQGSFEVVLNMPGRHNVLNALAAIGVALEVGASVEAIQKGLLGFEGVGRRFQKYGDIKLPNGGTALLVDDYGHHPVEMAATLAAARGAYPEKRLVLAFQPHRYTRTRDLFEDFTKVLNTVDALVLTEVYAAGEEPVAAADSRALARAIRVLGKLEPIYCENVADLPQMLMNVLQDGDVVLNMGAGSINRVPSALLELSKQI

SEQ ID NO: 311 - DNA, 1521 bp, Neisseria meningitidis
atgttttttatttcaatccgctatatatttgtcagaaaactatggcgcgcaaacggtcagccctttaaaataacgcctttacgcatcgaaaatccaccggaacgcaacattatgatgaaaaatcgagttaccaacatccattttgtcggtatcggcggcgtcggcatgagcggcatcgccgaagtcttgcacaatttgggctttaaagtttccggttcggatcaggcgcgaaatgccgctaccgagcatttgggcagcctgggcattcaagtttatcccggccataccgccgaacacgttaacggtgcggatgtcgtcgttacctctaccgccgtcaaaaaagaaaatcccgaagttgtcgctgcgttggagcagcaaattcccgttattccgcgcgccctgatgttggcggagttgatgcgcttccgtgacggcatcgccattgccggcacgcacggcaaaaccacgaccaccagcctgaccgcctccatcctcggcgcggcaggacttgacccgactttcgttatcggcggcaaactcaacgccgcaggcactaacgcccgcttgggcaaaggcgaatacatcgttgccgaagccgacgagtcggatgcatcctttctgcacctgacaccgattatgtccgtcgttaccaatatcgacgaagaccatatggatacctacgggcacagcgtcgaaaaactgcatcaggcgtttatcgatttcatccaccgtatgcccttctacggcaaagcctttttgtgtattgacagcgaacacgtccgcgcgattttgcccaaagtgagcaaaccttatgctacttacggtttggacgataccgccgacatctacgccaccgacatcgaaaacgtcggcgcgcaaatgaaattcaccgtccatgttcaaatgaaaggacatgagcaggggtcgtttgaagtcgtgctgaatatgcccggcagacacaacgtgctgaacgcattggcagccatcggcgtggcgctggaagtcggcgcatcggttgaagcgatccaaaaaggcttgctcggctttgaaggcgtcggccgccgcttccaaaaatacggcgacatcaagttgccaaacggcgggaccgcgctcttggtggacgactacggacaccaccccgtcgaaatggcggcgacccttgccgccgcacgcggcgcgtatctggaaaaacgtttggtactcgccttccagccgcaccgctatacccgcacgcgcgatttgtttgaagactttaccaaagtcctcaataccgttgacgcgctggtgctgaccgaagtttatgccgccggtgaagagccgattgccgccgccgattcccgcgctcttgcccgcgccatccgcgtgttgggcaaactcgagccgatttactgcgaaaacgttgccgatctgcccgaaatgctgttgaacgttttgcaggacggcgacatcgtgttgaatatgggcgcgggaagcatcaaccgcgtccccgccgcgctgctggcattgtcgaaacagatttga

SEQ ID NO: 312 - protein, 506 aa, Neisseria meningitidis
MFFISIRYIFVRKLWRANGQPFKITPLRIENPPERNIMMKNRVTNIHFVGIGGVGMSGIAEVLHNLGFKVSGSDQARNAATEHLGSLGIQVYPGHTAEHVNGADVVVTSTAVKKENPEVVAALEQQIPVIPRALMLAELMRFRDGIAIAGTHGKTTTTSLTASILGAAGLDPTFVIGGKLNAAGTNARLGKGEYIVAEADESDASFLHLTPIMSVVTNIDEDHMDTYGHSVEKLHQAFIDFIHRMPFYGKAFLCIDSEHVRAILPKVSKPYATYGLDDTADIYATDIENVGAQMKFTVHVQMKGHEQGSFEVVLNMPGRHNVLNALAAIGVALEVGASVEAIQKGLLGFEGVGRRFQKYGDIKLPNGGTALLVDDYGHHPVEMAATLAAARGAYLEKRLVLAFQPHRYTRTRDLFEDFTKVLNTVDALVLTEVYAAGEEPIAAADSRALARAIRVLGKLEPIYCENVADLPEMLLNVLQDGDIVLNMGAGSINRVPAALLALSKQI

SEQ ID NO: 313 - DNA, 1521 bp, Neisseria meningitidis
atgttttttatttcaatccgctatatatttgtcagaaaactatggcgcgcaaacggtcagccctttaaaataacgcctttacgcatcgaaaatccaccggaacgcaacattatgatgaaaaatcgagtgaccaacatccattttgtcggtatcggcggcgtcggcatgagcggtatcgccgaagtcttgcacaatttgggttttaaagtttccggttcggatcaggcgcgaaatgccgctaccgagcatttgggcagcctgggcattcaagtttatcccggccataccgcagaacacgttaacggtgcggatgtcgtcgttacctctaccgccgtcaaaaaagaaaatcccgaagttgtcgctgcgttggagcagcaaattcccgttattccgcgcgccctgatgttggcggagttgatgcgcttccgtgacggcatcgccattgccggcacgcacggcaaaaccacgaccaccagcctgaccgcctccatcctcggcgcggcaggacttgacccgactttcgttatcggcggcaaactcaacgccgcaggcaccaacgcccgcttgggcaaaggcgaatacatcgttgccgaagccgacgagtcggatgcatcctttctgcacctgacaccgattatgtccgtcgttaccaatatcgacgaagaccatatggatacctacgggcacagtgttgagaagctgcatcaggcgtttatcgatttcatccaccgtatgcccttctacggcaaagcctttttgtgtattgacagcgaacacgtccgcgcgattttgcccaaagtgagcaaaccttatgctacttacggtttggacgataccgccgacatctacgccaccgacatcgaaaacgtcggcgcgcaaatgaaattcaccgtccatgttcaaatgaaaggacatgagcaggggtcgtttgaagtcgtgctgaatatgcccggcagacacaacgtgctgaacgcattggcagccatcggcgtggcgctggaagtcggcgcatcggttgaagcgatccaaaaaggcttgctcggctttgaaggtgtcggccgccgcttccaaaaatacggcgacatcaagttgccaaacggtggaaccgcgctcttggtggacgactacggacaccaccccgtcgaaatggcggcgaccctttccgccgcacgcggcgcgtatccggaaaaacgtttggtactcgccttccagccgcaccgctatacccgcacgcgcgatttgtttgaagactttaccaaagtcctcaataccgttgacgcgctggtgctgaccgaagtttatgccgccggtgaagagccgattgccgccgctgattcccgcgctcttgcccgcgccatccgcgtgttgggcaaactcgagccgatttactgcgaaaacgttgccgatctgcccgaaatgctgttgaacgttttgcaggacggcgacatcgtgttgaatatgggtgcgggaagcatcaaccgcgtccccgccgcgctgctggaattgtcgaaacagatttga

SEQ ID NO: 314 - protein, 506 aa, Neisseria meningitidis
MFFISIRYIFVRKLWRANGQPFKITPLRIENPPERNIMMKNRVTNIHFVGIGGVGMSGIAEVLHNLGFKVSGSDQARNAATEHLGSLGIQVYPGHTAEHVNGADVVVTSTAVKKENPEVVAALEQQIPVIPRALMLAELMRFRDGIAIAGTHGKTTTTSLTASILGAAGLDPTFVIGGKLNAAGTNARLGKGEYIVAEADESDASFLHLTPIMSVVTNIDEDHMDTYGHSVEKLHQAFIDFIHRMPFYGKAFLCIDSEHVRAILPKVSKPYATYGLDDTADIYATDIENVGAQMKFTVHVQMKGHEQGSFEVVLNMPGRHNVLNALAAIGVALEVGASVEAIQKGLLGFEGVGRRFQKYGDIKLPNGGTALLVDDYGHHPVEMAATLSAARGAYPEKRLVLAFQPHRYTRTRDLFEDFTKVLNTVDALVLTEVYAAGEEPIAAADSRALARAIRVLGKLEPIYCENVADLPEMLLNVLQDGDIVLNMGAGSINRVPAALLELSKQI

SEQ ID NO: 315 - DNA, 831 bp, Neisseria gonorrhoeae
atgcagaattttggcaaagtggccgtattgatgggtggtttttccagcgaacgagaaatctcgctggacagcggtaccgccattttgaacgccttaaaaagcaaaggcatagacgcatacgccttcgaccctaaggaaacgccgttatccgaactgaaggagcggggctttcagacggcattcaacatccttcacggtacttacggcgaagacggggctgttcagggtgcattggaactgttgggcattccctataccggcagcggtgtcgccgcctccgccatcggcatggacaaataccgctgcaaactgatttggcaggcattgggattacccgttcccgagttcgccgtactgtacgatgataccgatttcgatgccgtcgaagaaaaattgggtctgccgatgtttgtgaagccggcggccgaaggcagcagcgtcggcgtggtaaaagtcaaagaaaaaggccgtctgaaaagcgtttacgaagaattgaaacaccttcaggggcgaaatcattgccgaacgttttatcggcggcggcgaatattcctgccccgtcctgaacggcaaagggctgcccggcatacacatcatccccgcaaccgagttttacgactacgaagccaagtacaaccgagacgacaccatttatcaatgtccttcggaagatttgaccgaagccgaagaaagcctgatgcgcgaactggcggttcgcggcgcacaggcaatcggtgcggaaggctgcgtgcgcgtcgatttcctcaaagataccgacggcaaactctatctgttggaaatcaacaccctgcccggtatgaccggccatag

SEQ ID NO: 316 - protein, 276 aa, Neisseria gonorrhoeae
MQNFGKVAVLMGGFSSEREISLDSGTAILNALKSKGIDAYAFDPKETPLSELKERGFQTAFNILHGTYGEDGAVQGALELLGIPYTGSGVAASAIGMDKYRCKLIWQALGLPVPEFAVLYDDTDFDAVEEKLGLPMFVKPAAEGSSVGVVKVKEKGRLKSVYEELKHLQGRNHCRTFYRRRRIFLPRPERQRAARHTHHPRNRVLRLRSQVQPRRHHLSMSFGRFDRSRRKPDARTGGSRRTGNRCGRLRARRFPQRYRRQTLSVGNQHPARYDRP

SEQ ID NO: 317 - DNA, 830 bp, Neisseria meningitidis
atgcagaattttggcaaagtggccgtattgatgggcggtttttccagcgaacgagaaatctcgctggacagcggcaccgccattttgaatgctttaaaaagcaaaggcatagacgcatacgccttcgatcctaaagaaaccccattgtctgaattgaaggcacaaggttttcagacggcattcaacatccttcacggtacttacggcraagacggggcggttcagggtgcattggaactgttgggcattccctataccggcagcggtgtcgccgcatccgccatcggcatggacaaataccgctgcaaactgatttggcaggcattgggattgcccgttcccgagttcgccgtcctgcacgacgacactgatttcgatgccgtcgaagaaaaattgggcctgccgatgtttgtgaaaccggcggccgaaggcagcagcgtaggcgtggtaaaagtcaaaggaaaaggccgtctgaaaagcgtttacgaagaattgaaacaccttcagggcgaaatcattgccgaacgttttatcggcggcggcgaatattcctgccccgtcctgaacggcaaagggctgcccggcatacacatcattcccgcaaccgagttttacgactacgaagccaagtacaaccgcgacgacaccatttatcaatgtccttcggaagatttgaccgaagccgaagaaagcctgatgcgcgaactggcggttcgcggcgcgcaggcaatcggtgcggaaggctgcgtgcgcgtcgatttcctcaaagataccgacggcaaactctatctgttggaaatcaacaccctgcccggtatgacgagccatag

SEQ ID NO: 318 - protein, 276 aa, Neisseria meningitidis
  misc_feature (70)..(70): Xaa can be any naturally occurring amino acid
  misc_feature (170)..(170): Xaa can be any naturally occurring amino acid
MQNFGKVAVLMGGFSSEREISLDSGTAILNALKSKGIDAYAFDPKETPLSELKAQGFQTAFNILHGTYGXDGAVQGALELLGIPYTGSGVAASAIGMDKYRCKLIWQALGLPVPEFAVLHDDTDFDAVEEKLGLPMFVKPAAEGSSVGVVKVKGKGRLKSVYEELKHLQXRNHCRTFYRRRRIFLPRPERQRAARHTHHSRNRVLRLRSQVQPRRHHLSMSFGRFDRSRRKPDARTGGSRRAGNRCGRLRARRFPQRYRRQTLSVGNQHPARYDEP

SEQ ID NO: 319 - DNA, 830 bp, Neisseria meningitidis
atgcagaattttggcaaagtggccgtattgatgggcggtttttccagcgaacgagaaatctcgctggacagcggcaccgccattttgaatgctttaaaaagcaaaggcatagacgcatacgccttcgatcccaaggaaaccccattgtctgaattgaaggcacaaggttttcagacggcattcaacatccttcacggtacttacggcgaagacggggctgttcagggtgcattggaactgttgggcattccctataccggcagcggtgtcgccgcatccgccatcggcatggacaaataccgctgcaaactgatttggcaggcattgggattgcccgttcccgagttcgccgtcctgcacgacgacactgatttcgatgccgtcgaagaaaaattgggcctgccgatgtttgtgaaaccggcggccgaaggcagcagcgtaggcgtggtaaaagtcaaaggaaaaggccgtctgaaaagcgtttacgaagaattgaaacactttcagggcgaaatcattgccgaacggtttatcggcggcggcgaatattcctgccctgtgttgaacggcaaaggcctgcccggcatacacatcatccccgcgaccgagttttatgactacgaagccaagtacaaccgcaacgacaccatttatcaatgtccttcggaagatctgaccgaagccgaagaaagcctgatgcgcgaactggcggttcgcggcgcgcaggcaatcggtgcggaaggctgcgtgcgcgtcgatttcctcaaagataccgacggcaaactctatctgttggaaatcaacaccctgcccggtatgaccggccatag

SEQ ID NO: 320 - protein, 275 aa, Neisseria meningitidis
  misc_feature (170)..(170): Xaa can be any naturally occurring amino acid
MQNFGKVAVLMGGFSSEREISLDSGTAILNALKSKGIDAYAFDPKETPLSELKAQGFQTAFNILHGTYGEDGAVQGALELLGIPYTGSGVAASAIGMDKYRCKLIWQALGLPVPEFAVLHDDTDFDAVEEKLGLPMFVKPAAEGSSVGVVKVKGKGRLKSVYEELKHFQXRNHCRTVYRRRRIFLPCVERQRPARHTHHPRDRVLLRSQVQPQRHHLSMSFGRSDRSRRKPDARTGGSRRAGNRCGRLRARRFPQRYRRQTLSVGNQHPARYDRP

SEQ ID NO: 321 - DNA, 312 bp, Neisseria gonorrhoeae
atgtattcgcctttgcccaagcgggcgttggtgcctgcggcgttgagtttgccgccgataacgaaagtggggtcgagtcctgccgcgccgaggatggaggcggtcaggctggtggtcgtggttttgccgtgcgtaccggcaatggcgatgccgtcacggaagcgcatcagctctgccagcatcaaggcgcgcggaataacgggaatttgccgctccaacgcagcgacaacttcgggattttctttcttgacggcggtagaggcaacgacgacatccgcaccgttaacgtgttctgcggtatggccgggataa

SEQ ID NO: 322 - protein, 103 aa, Neisseria gonorrhoeae
MYSPLPKRALVPAALSLPPITKVGSSPAAPRMEAVRLVVVVLPCVPAMAMPSRKRISSASIKARGITGICRSNAATTSGFSFLTAVEATTTSAPLTCSAVWPG

SEQ ID NO: 323 - DNA, 312 bp, Neisseria meningitidis
atgtattcgcctttgcccaagcgggcgttagtgcctgcggcgttgagtttgccgccgataacgaaagtcgggtcaagtcctgccgcgccgaggatggaggcggtcaggctggtggtcgtggttttgccgtgcgtgccggcaatggcgatgccgtcacggaagcgcatcaactccgccaacatcagggcgcgcggaataacgggaatttgctgctccaacgcagcgacaacttcgggattttcttttttgacggcggtagaggtaacgacgacatccgcaccgttaacgtgttcggcggtatggccgggataa

SEQ ID NO: 324 - protein, 103 aa, Neisseria meningitidis
MYSPLPKRALVPAALSLPPITKVGSSPAAPRMEAVRLVVVVLPCVPAMAMPSRKRINSANIRARGITGICCSNAATTSGFSFLTAVEVTTTSAPLTCSAVWPG

SEQ ID NO: 325 - DNA, 312 bp, Neisseria meningitidis
atgtattcgcctttgcccaagcgggcgttggtgcctgcggcgttgagtttgccgccgataacgaaagtcgggtcaagtcctgccgcgccgaggatggaggcggtcaggctggtggtcgtggttttgccgtgcgtgccggcaatggcgatgccgtcacggaagcgcatcaactccgccaacatcagggcgcgcggaataacgggaatttgctgctccaacgcagcgacaacttcgggattttcttttttgacggcggtagaggtaacgacgacatccgcaccgttaacgtgttctgcggtatggccgggataa

SEQ ID NO: 326 - protein, 103 aa, Neisseria meningitidis; identical to SEQ ID NO: 324

SEQ ID NO: 327 - DNA, 375 bp, Neisseria gonorrhoeae
atgtcctttcatttgaacatggacggtgaatttcatttgcgcgccgacgttttcgatgtcggtggcgtagatgtcggcggtatcgtccaaaccgtaagtagcataaggtttgctcactttgggcaaaatcgcgcggacgtgttcgctgtcaacacacaaaaaggctttgccgtagaagggcatacggtggatgaaatcgataaacgcctgatgcagtttttcgacgctgtgcccgtaggtatccatatggtcttcgtcgatattggtaacgacggacataatcggggtcagtgtaggaaagaggcatcggatcgtcggcttcggcaacgatgtattcgcctttgcccaagcgggcgttggtgcctgcggcgttga

SEQ ID NO: 328 - protein, 124 aa, Neisseria gonorrhoeae
MSFHLNMDGEFHLRADVFDVGGVDVGGIVQTVSSIRFAHFGQNRADVFAVNTQKGFAVEGHTVDEIDKRLMQFFDAVPVGIHMVFVDIGNDGHNRGQCRKEASDRRLRQRCIRLCPSGRWCLRR

SEQ ID NO: 329 - DNA, 375 bp, Neisseria meningitidis
atgtcctttcatttgaacatggacggtgaatttcatttgcgcgccgacgttttcgatgtcggtggcgtagatgtcggcggtatcgtccaaaccgtaagtagcataaggtttgctcactttgggcaaaatcgcgcggacgtgttcgctgtcaatacacaaaaaggctttgccgtagaagggcatacggtggatgaaatcgataaacgcctgatgcagtttttcgacgctgtgcccgtaggtatccatatggtcttcgtcgatattggtaacgacggacataatcggtgtcagtgcagaaaggatgcatccgaccgtcggcttcggcaacgatgtattcgcctttgcccaagcgggcgttagtgcctgcggcgttga

SEQ ID NO: 330 - protein, 124 aa, Neisseria meningitidis
  misc_feature (120)..(120): Xaa can be any naturally occurring amino acid
MSFHLNMDGEFHLRADVFDVGGVDVGGIVQTVSSIRFAHFGQNRADVFAVNTQKGFAVEGHTVDEIDKRLMQFFDAVPVGIHMVFVDIGNDGHNRCQCRKDASDRRLRQRCIRLCPSGRXCLRR

SEQ ID NO: 331 - DNA, 375 bp, Neisseria meningitidis
atgtcctttcatttgaacatggacggtgaatttcatttgcgcgccgacgttttcgatgtcggtggcgtagatgtcggcggtatcgtccaaaccgtaagtagcataaggtttgctcactttgggcaaaatcgcgcggacgtgttcgctgtcaatacacaaaaaggctttgccgtagaagggcatacggtggatgaaatcgataaacgcctgatgcagcttctcaacactgtgcccgtaggtatccatatggtcttcgtcgatattggtaacgacggacataatcggtgtcagtgcagaaaggatgcatccgaccgtcggcttcggcaacgatgtattcgcctttgcccaagcgggcgttggtgcctgcggcgttga

SEQ ID NO: 332 - protein, 124 aa, Neisseria meningitidis
MSFHLNMDGEFHLRADVFDVGGVDVGGIVQTVSSIRFAHFGQNRADVFAVNTQKGFAVEGHTVDEIDKRLMQLLNTVPVGIHMVFVDIGNDGHNRCQCRKDASDRRLRQRCIRLCPSGRWCLRR

SEQ ID NO: 333 - DNA, 375 bp, Neisseria gonorrhoeae
atggccggtcataccgggcagggtgttgatttccaacagatagagtttgccgtcggtatctttgaggaaatcgacgcgcacgcagccttccgcaccgattgcctgtgcgccgcgaaccgccagttcgcgcatcaggctttcttcggcttcggtcaaatcttccgaaggacattgataaatggtgtcgtctcggttgtacttggcttcgtagtcgtaaaactcggttgcggggatgatgtgtatgccgggcagccctttgccgttcaggacggggcaggaatattcgccgccgccgataaaacgttcggcaatgatttcgcccctgaaggtgtttcaattcttcgtaaacgcttttcagacggcctttttctttga

SEQ ID NO: 334 - protein, 124 aa, Neisseria gonorrhoeae
MAGHTGQGVDFQQIEFAVGIFEEIDAHAAFRTDCLCAANRQFAHQAFFGFGQIFRRTLINGVVSVVLGFVVVKLGCGDDVYAGQPFAVQDGAGIFAAADKTFGNDFAPEGVSILRKRFSDGLFL

SEQ ID NO: 335 - DNA, 374 bp, Neisseria meningitidis
atggctcgtcataccgggcagggtgttgatttccaacagatagagtttgccgtcggtatctttgaggaaatcgacgcgcacgcagccttccgcaccgattgcctgcgcgccgcgaaccgccagttcgcgcatcaggctttcttcggcttcggtcaaatcttccgaaggacattgataaatggtgtcgtcgcggttgtacttggcttcgtagtcgtaaaactcggttgcgggaatgatgtgtatgccgggcagccctttgccgttcaggacggggcaggaatattcgccgccgccgataaaacgttcggcaatgatttcgccctgaaggtgtttcaattcttcgtaaacgcttttcagacggccttttcctttga

SEQ ID NO: 336 - protein, 124 aa, Neisseria meningitidis
  misc_feature (108)..(108): Xaa can be any naturally occurring amino acid
MARHTGQGVDFQQIEFAVGIFEEIDAHAAFRTDCLRAANRQFAHQAFFGFGQIFRRTLINGVVAVVLGFVVVKLGCGNDVYAGQPFAVQDGAGIFAAADKTFGNDFAXEGVSILRKRFSDGLFL

SEQ ID NO: 337 - DNA, 374 bp, Neisseria meningitidis
atggccggtcataccgggcagggtgttgatttccaacagatagagtttgccgtcggtatctttgaggaaatcgacgcgcacgcagccttccgcaccgattgcctgcgcgccgcgaaccgccagttcgcgcatcaggctttcttcggcttcggtcagatcttccgaaggacattgataaatggtgtcgttgcggttgtacttggcttcgtagtcataaaactcggtcgcggggatgatgtgtatgccgggcaggcctttgccgttcaacacagggcaggaatattcgccgccgccgataaaccgttcggcaatgatttcgccctgaaagtgtttcaattcttcgtaaacgcttttcagacggccttttcctttga

SEQ ID NO: 338 - protein, 124 aa, Neisseria meningitidis
  misc_feature (108)..(108): Xaa can be any naturally occurring amino acid
MAGHTGQGVDFQQIEFAVGIFEEIDAHAAFRTDCLRAANRQFAHQAFFGFGQIFRRTLINGVVAVVLGFVVIKLGRGDDVYAGQAFAVQHRAGIFAAADKPFGNDFAXESVSILRKRFSDGLFL

SEQ ID NO: 339 - DNA, 1311 bp, Neisseria gonorrhoeae
atggatatttcaaaacaaacattgctggatagggtttttaacctgaaggcaaacggtacgacggtacgtaccgagttgatggcgggtttgacgacctttttgacgatgtgctacatcgttatcgtcaatcccctgattttgggcgagaccggaatggatatgggggcggtattcgtcgctacctgtatcgcatccgccatcggctgttttgtcatgggttttatcggcaactatccgattgcgcttgccccggggatggggctgaatgcctatttcacctttgccgtcgttaagggtatgggcgtgccttggcaggtggcgttgggtgcggtgttcatttccggtctgattttcatcctgttcagcttttttaaagtcagggaaatgctggtcaacgcactgcctatgggtttgaaaatgtcgattgccgccggtatcggtttgtttttggcactgatttccctgaaaggcgcaggcattatcgttgccaatccggcaaccttggtcggcttgggcgatattcatcagcccagcgcactgttggcattgttcggttttgtcatggtggtcgtattggggtatttccgcgttcaaggcgcaatcatcatcaccattctgacgattaccgtcattgccagcctgatgggtttgaacgagtttcacggcgtggtcggcgaagtaccgggcattgcgccgacctttatgcagatggattttaaaggtctgtttaccgtcagcatggtcagcgtgattttcgtcttcttcttggtcgatttgttcgacagtaccggaacgctggtcggcgtatcccaccgtgccggactgctggtggacggtaagctgccccgcctgaaacgcgcactgcttgcagactctaccgccattgtggcaggtgcggctttgggtacttcttcaaccacgccttatgtggaaagcgcggcgggcgtatcggcaggcggacggaccggcctgacggcggttaccgtcggcgtattgatgctggcgtgtctgatgttctccccattggcgaaaagtgttccggtatttgccaccgcgcccgcactgctttatgtcggcacgcagatgctccgcagtgcgagggacattgattgggacgatatgactgaagccgcgcccgcgttcctgaccattgtcttcatgccgtttacctattcgattgcagacggcatcgccttcggcttcatcagctatgccgtggtcaaacttttgtgtcgccggactggggacgtgccgcctatggtatgggttgttgccgtattgtgggcattgaaattctggtatttgggctga

SEQ ID NO: 340 - protein, 436 aa, Neisseria gonorrhoeae
MDISKQTLLDRVFNLKANGTTVRTELMAGLTTFLTMCYIVIVNPLILGETGMDMGAVFVATCIASAIGCFVMGFIGNYPIALAPGMGLNAYFTFAVVKGMGVPWQVALGAVFISGLIFILFSFFKVREMLVNALPMGLKMSIAAGIGLFLALISLKGAGIIVANPATLVGLGDIHQPSALLALFGFVMVVVLGYFRVQGAIIITILTITVIASLMGLNEFHGVVGEVPGIAPTFMQMDFKGLFTVSMVSVIFVFFLVDLFDSTGTLVGVSHRAGLLVDGKLPRLKRALLADSTAIVAGAALGTSSTTPYVESAAGVSAGGRTGLTAVTVGVLMLACLMFSPLAKSVPVFATAPALLYVGTQMLRSARDIDWDDMTEAAPAFLTIVFMPFTYSIADGIAFGFISYAVVKLLCRRTGDVPPMVWVVAVLWALKFWYLG

SEQ ID NO: 341 - DNA, 1311 bp, Neisseria meningitidis
atggacacttcaaaacaaacactgttggacgggatttttaagctgaaggcaaacggtackacggtgcgtaccgagttgatggcgggtttgacaacttttttgacgatgtgctacatcgttatcgtcaaccctcygattttgggcgagaccggcatggatatgggggcggtattcgtcgctacctgtatcgcgtctgccatcggctgttttgttatgggttttgtcggcaactatccgattgcactcgcaccggggatggggctgaatgcctatttcacctttgccgtcgttaagggtatgggcgtgccttggcaggttgcgttgggtgcggtgttcatctccggtctgatttttatcctgttcagcttttttaaagtcagggaaatgctggtcaacgcactgcctatgggtttgaaaatgtcgattgctgccggtatcggtttgtttttggcactgatttccctgaaaggcgcaggcattatcgttgccaatccggcaaccttggtcggtttgggcgatattcatcagccgtccgcgttgttggcattgttcggttttgctatggtggtcgtattgggacatttccgcgttcaaggcgcaatcatcatcaccatcttgaccattaccgtcattgccagcctgatgggtttgaatgaatttcacggcatcatcggcgaagtaccgagcattgcgccgacttttatgcagatggattttgaaggcctgtttaccgtcagcatggtcagtgtgattttcgtcttcttcttggtcgatctatttgacagtaccggaacgctggtcggcatatcccaccgtgccgggctgctggtggacggtaagctgccccgcctgaaacgcgcactgcttgcagactctaccgccattgtggcaggtgcggctttgggtacttcttccaccacgccttatgtggaaagcgcggcgggcgtatcggcaggcggacggaccggcctgacggcggttaccgtcggcgtattgatgctcgcctgcctgatgttttcacctttggcgaaaagtgttcccgcttttgccaccgcgcccgccctgctttatgtcggcacgcagatgctccgcagtgcgagggatattgattgggacgatatgacggaagccgcacctgcgttcctgaccattgttttcatgccgtttacttattcgattgcagacggcatcgctttcggcttcatcagttatgccgtggttaaacttttatgccgccgcaccaaagacgttccgcctatggtatggattgttgccgtattgtgggcactgaaattctggtatttgggctga

SEQ ID NO: 342 - protein, 436 aa, Neisseria meningitidis
  misc_feature (45)..(45): Xaa can be any naturally occurring amino acid
MDTSKQTLLDGIFKLKANGTTVRTELMAGLTTFLTMCYIVIVNPXILGETGMDMGAVFVATCIASAIGCFVMGFVGNYPIALAPGMGLNAYFTFAVVKGMGVPWQVALGAVFISGLIFILFSFFKVREMLVNALPMGLKMSIAAGIGLFLALISLKGAGIIVANPATLVGLGDIHQPSALLALFGFAMVVVLGHFRVQGAIIITILTITVIASLMGLNEFHGIIGEVPSIAPTFMQMDFEGLFTVSMVSVIFVFFLVDLFDSTGTLVGISHRAGLLVDGKLPRLKRALLADSTAIVAGAALGTSSTTPYVESAAGVSAGGRTGLTAVTVGVLMLACLMFSPLAKSVPAFATAPALLYVGTQMLRSARDIDWDDMTEAAPAFLTIVFMPFTYSIADGIAFGFISYAVVKLLCRRTKDVPPMVWIVAVLWALKFWYLG

SEQ ID NO: 343 - DNA, 1311 bp, Neisseria meningitidis
atggacacttcaaaacaaacactgttggacgggatttttaagctgaaggcaaacggtacgacggtgcgtaccgagttgatggcgggtttgacaacttttttgacgatgtgctacatcgttatcgtcaaccctctgattttgggcgagaccggcatggatatgggggcggtattcgtcgctacctgtatcgcgtctgccatcggctgttttgttatgggttttgtcggcaactatccgattgcactcgcaccggggatggggctgaatgcctatttcacctttgccgtcgttaagggtatgggcgtgccttggcaggttgcgttgggtgcggtgttcatctccggtctgattttcatcctgttcagcttttttaaagtcagggaaatgctggtcaacgcactgcctatgggtttgaaaatgtcgattgctgccggtatcggtttgtttttggcactgatttccctgaaaggcgcaggcattatcgttgccaatccggcaaccttggtcggcttgggcgatattcatcagccgtccgcgttgttggcactgttcggttttgccatggtggtcgtattgggacatttccgcgttcaaggcgcaatcatcatcaccattttgacgattaccgtcattgccagcctgatgggtttgaacgaatttcacggcatcatcggcgaagtgccgagcattgcgccgacttttatgcagatggattttaaagggttgtttaccgtcagcatggtcagcgtgattttcgtctttttcctagtcgatctgttcgacagtaccggaacactggtcggtgtatcgcatcgtgccggactgctggtggacggtaagctgccccgcctgaaacgcgcactgcttgcagactctaccgctattgtggcaggtgcggctttgggtacttcttcaaccacgccttatgtggaaagtgcggcgggcgtatcggcaggcgggcggacaggtctgacggcggttaccgtcggcgtattgatgctcgcctgcctgatgttttcacctttggcgaaaagtgttcccgcttttgccaccgcgcccgccctgctttatgtcggcacgcagatgctccgcagtgcgagggacatcgattgggacgatatgacggaagccgcacccgcattcctgaccattgtcttcatgccgtttacctattcgattgcagacggcatcgctttcggcttcatcagttatgccgtggttaaacttttatgccgccgcaccaaagacgttccgcctatggtatggattgttgccgtattgtgggcactgaaattctggtatttgggctga

SEQ ID NO: 344 - protein, 436 aa, Neisseria meningitidis
MDTSKQTLLDGIFKLKANGTTVRTELMAGLTTFLTMCYIVIVNPLILGETGMDMGAVFVATCIASAIGCFVMGFVGNYPIALAPGMGLNAYFTFAVVKGMGVPWQVALGAVFISGLIFILFSFFKVREMLVNALPMGLKMSIAAGIGLFLALISLKGAGIIVANPATLVGLGDIHQPSALLALFGFAMVVVLGHFRVQGAIIITILTITVIASLMGLNEFHGIIGEVPSIAPTFMQMDFKGLFTVSMVSVIFVFFLVDLFDSTGTLVGVSHRAGLLVDGKLPRLKRALLADSTAIVAGAALGTSSTTPYVESAAGVSAGGRTGLTAVTVGVLMLACLMFSPLAKSVPAFATAPALLYVGTQMLRSARDIDWDDMTEAAPAFLTIVFMPFTYSIADGIAFGFISYAVVKLLCRRTKDVPPMVWIVAVLWALKFWYLG

SEQ ID NO: 345 - DNA, 378 bp, Neisseria gonorrhoeae
atgaccgccgacggtctcttcgtcgctttcaacttcaatacgtttgccgttgtgcgaatattgataccagtacagcaggatgctgcccaggctggcgatcagtttgtcggcgatgtcgcgcgcttcgctgtcgggatggctttcgcgttcgggatgaacgcagccgagcatggacacgccggtacgcatcacgtccatcggatgggtatgtgcaggcaggctttccaaaactttaatcacacggataggcaggccgcgcatggatttgagcttggttttataagcggccagctcgaatttgttgggcagatggccgtgaatcagcaagtgtgcgacttcttcaaactcgcatttttgtgccaaattagaatgtcgtaa

SEQ ID NO: 346 - protein, 125 aa, Neisseria gonorrhoeae
MTADGLFVAFNFNTFAVVRILIPVQQDAAQAGDQFVGDVARFAVGMAFAFGMNAAEHGHAGTHHVHRMGMCRQAFQNFNHTDRQAAHGFELGFISGQLEFVGQMAVNQQVCDFFKLAFLCQIRMS

SEQ ID NO: 347 - DNA, 378 bp, Neisseria meningitidis
atgaccgccgatggtctcttcgtcgctttcaacctcaatgcgtttgccgttgtgcgaatattgataccagtacaagaggatgctgccgaggctggcgatcagtttgtcggcgatgtcgcgcgcttcactttccggatggctttcacgttcaggatgaacgcagcccagcatggatacgccggtacgcattacgtccatcggatgggtatgtgcaggcaggctttccaaaactttaatcacacggataggcaggccgcgcatggatttgagcttggttttataagcggccagctcgaatttgttgggcagatggccgtgaatcagcaggtgggcgacttcttcaaactcgcatttttgtgccaaatcagaatgtcgtaa

SEQ ID NO: 348 - protein, 125 aa, Neisseria meningitidis
MTADGLFVAFNLNAFAVVRILIPVQEDAAEAGDQFVGDVARFTFRMAFTFRMNAAQHGYAGTHYVHRMGMCRQAFQNFNHTDRQAAHGFELGFISGQLEFVGQMAVNQQVGDFFKLAFLCQIRMS

SEQ ID NO: 349 - DNA, 378 bp, Neisseria meningitidis; identical to SEQ ID NO: 347

SEQ ID NO: 350 - protein, 125 aa, Neisseria meningitidis; identical to SEQ ID NO: 348

SEQ ID NO: 351 - DNA, 1920 bp, Neisseria gonorrhoeae
atgctgggacgcgcgtccatgatgcgcctgcccgatattgtcggcgtggagctgacgggcaaacggcaggcgggcattactgccacagacatcgtgttggcactgaccgaattcttgcgtaaagagcgcgtggtcggggcgtttgtcgaatttttcggcgagggcgcgagaagcctgtctatcggcgaccgcgcgaccatttccaacatgacgccggagttcggcgcgactgccgccatgttcgccatcgacgcgcaaactattgattatttgaaactgaccggacgtgacgacgcgcaggtgaaattggtggaaacctacgccaaaaccgcaggcttatgggcaggtggcttgaaaaccgccgtttatccgcgcgttttgaaatttgatttgagcagcgtaacgcgcaatatggcaggcccgagcaacccgcacgcgcgttttgccaccgccgatttggcggcgaaagggctggcgaagccttacgaagagccttcagacggccaaatgcctgacggtgcagtgattattgccgcgattacttcgtgtaccaatacttccaacccgcgcaacgttgtcgccgccgcactgttggcacgcaatgccaaccgcctcggcttgaaacgcaaaccttgggtgaaatcttcgtttgccccgggttcaaaagtagccggaatctatttgaaagaagcaggcttgttgcccgaaatggaaaaactcggcttcggtatcgtcgccttcgcatgtaccacctgtaacggcatgagcggcgcgctcgacccgaaaatccaacaagaaatcatcgaccgcgatttgtacgccaccgccgtattgtcaggcaaccgcaacttcgacggccgtatccatccgtatgcgaaacaggctttcctcgcttcgcctcctttggtcgttgcctacgcattggcaggtagcatccgtttcgatattgaaaacgacgtactcggcgttgcagacggccgcgaaatccgcctgaaagatatctggccgacagacgaagaaatcgatgccatcgttgccgaatatgtgaaaccgcaacaattccgcgacatttatatcccgatgtccgacaccggcacagcgcaaaaagcaccaagcccgctgtacgactggcgaccgatgtccacctacatccgccgtccgccctattgggaaggcgcactggcaggggaacgtacattaagaggtatgcgtccgccggcgattttgcccgacaacatcaccaccgaccacatctcgccatccaatgcgattttggccggcagtgccgcaggtgaatatttggcgaaaatgggtttgcctgaagaagacttcaactcttacgcaacccaccgcggcgaccacttgaccgcccaacgcgcaaccttcgccaatccgaaactgtttaacgaaatggtgagaaacgaagacggcagcgtacgccaaggttcgttggcacgcgttgaaccagaaggccaaaccatgcgcatgtgggaagccatcgaaacctatatgaaccgcaaacagccgcttatcatcattgccggtgcggactatggtcaaggctcaagccgcgactgggcggcgaagggcgtgcggctggcgggtgtggaagccatcgccgccgaaggtttcgagcgcatccaccgcaccaacctcatcggcatgggcgtcttgccgctgcaattcaaacccggcaccaaccgccataccctgcaactggacggtacggaaacctacgacgttgtcggcgaacgcacaccgcgctgcggcctgaccctcgtgattcaccgtaaaaacggagaaaccgtcgaagttccggttacctgccgccccgataccgcagaagaagcattggtatatgaagccggcggcgtattgcaacggtttgcacaggactttttggaagggaacgcggcttag

SEQ ID NO: 352 - protein, 639 aa, Neisseria gonorrhoeae
MLGRASMMRLPDIVGVELTGKRQAGITATDIVLALTEFLRKERVVGAFVEFFGEGARSLSIGDRATISNMTPEFGATAAMFAIDAQTIDYLKLTGRDDAQVKLVETYAKTAGLWAGGLKTAVYPRVLKFDLSSVTRNMAGPSNPHARFATADLAAKGLAKPYEEPSDGQMPDGAVIIAAITSCTNTSNPRNVVAAALLARNANRLGLKRKPWVKSSFAPGSKVAGIYLKEAGLLPEMEKLGFGIVAFACTTCNGMSGALDPKIQQEIIDRDLYATAVLSGNRNFDGRIHPYAKQAFLASPPLVVAYALAGSIRFDIENDVLGVADGREIRLKDIWPTDEEIDAIVAEYVKPQQFRDIYIPMSDTGTAQKAPSPLYDWRPMSTYIRRPPYWEGALAGERTLRGMRPPAILPDNITTDHISPSNAILAGSAAGEYLAKMGLPEEDFNSYATHRGDHLTAQRATFANPKLFNEMVRNEDGSVRQGSLARVEPEGQTMRMWEAIETYMNRKQPLIIIAGADYGQGSSRDWAAKGVRLAGVEAIAAEGFERIHRTNLIGMGVLPLQFKPGTNRHTLQLDGTETYDVVGERTPRCGLTLVIHRKNGETVEVPVTCRPDTAEEALVYEAGGVLQRFAQDFLEGNAA

SEQ ID NO: 353 - DNA, 1920 bp, Neisseria meningitidis
atgctgggacgcgcgtccatgatgcgcctgcccgatattgtcggcgttgagctgaacggcaaacggcaggcgggcattacggcgacggatattgtgttggcactgaccgagtttctgcgcaaagaacgcgtggtcggggcgtttgtcgaattcttcggcgagggcgcgagaagcctgtctatcggcgaccgcgcgaccatttccaacatgacgccggagttcggcgcgactgccgcgatgttcgctattgatgagcaaaccattgattatttgaaactgaccggacgcgacgacgcgcaggtgaaattggtggaaacctacgccaaaaccgcaggcttgtgggcagatgccttgaaaaccgccgtttatcctcgcgttttgaaatttgatttgagcagcgtaacgcgcaatatggcaggcccaagtaacccgcatgcccgttttgcgaccgccgatttggcggcgaaagggctggcgaagccttacgaagagccttcggacggccaaatgcccgacggctcggtcatcatcgccgcgattaccagttgcaccaacacttccaacccgcgcaacgttgttgccgccgcgctcttggcacgcaatgccaaccgtctcggcttgaaacgcaaaccttgggtgaaatcttcgtttgccccgggttcaaaagtagccgaaatctatttgaaagaagcgggcctgttgcccgaaatggaaaaactcggcttcggtatcgtcgccttcgcctgcaccacctgcaacggcatgagtggcgcgctggatccgaaaatccagaaagaaatcatcgaccgcgatttgtacgccaccgccgtattatcaggcaaccgcaacttcgacggccgtatccacccgtatgcgaaacaggctttcctcgcttcgcctccgttggtcgttgcctacgcgctggcaggcagtatccgtttcgatattgaaaacgacgtactcggcgttgcagacggcaaggaaatccgcctgaaagacatttggcctgccgatgaagaaatcgatgccgtcgttgccgaatatgtgaaaccgcagcagttccgcgatgtgtatgtaccgatgttcgacaccggcacagcgcaaaaagcacccagtccgctgtacgattggcgtccgatgtccacctacatccgccgtccgccttactgggaaggcgcgctggcaggggaacgcacattaagaggtatgcgtccgctggcgattttgcccgacaacatcaccaccgaccacctctcgccgtccaatgcgattttggccgtcagtgccgcaggcgagtatttggcgaaaatgggtttgcctgaagaagacttcaactcttacgcaacccaccgcggcgaccacttgaccgcccaacgcgctaccttcgccaatccgaaactgtttaacgaaatggtgaaaaacgaagacggcagcgtgcgccaaggctcgttcgcccgcgtcgaacccgaaggcgaaaccatgcgcatgtgggaagccatcgaaacctatatgaaccgcaaacagccgctcatcatcattgccggtgcggactatggtcaaggctcaagccgcgactgggctgcaaaaggcgtacgcctcgccggcgtagaagcgattgttgccgaaggcttcgagcgtatccaccgcaccaaccttatcggcatgggcgtgttgccgctgcagttcaaacccgacaccaaccgccataccctgcaactggacggtacggaaacctacgacgtggtcggcgaacgcacaccgcgctgcgacctgaccctcgtgattcaccgtaaaaacggcgaaaccgttgaagttcccgttacctgctgcctcgatactgcagaagaagtattggtatatgaagccggcggcgtgttgcaacggtttgcacaggattttttggaagggaacgcggcttag

SEQ ID NO: 354 - protein, 639 aa, Neisseria meningitidis
MLGRASMMRLPDIVGVELNGKRQAGITATDIVLALTEFLRKERVVGAFVEFFGEGARSLSIGDRATISNMTPEFGATAAMFAIDEQTIDYLKLTGRDDAQVKLVETYAKTAGLWADALKTAVYPRVLKFDLSSVTRNMAGPSNPHARFATADLAAKGLAKPYEEPSDGQMPDGSVIIAAITSCTNTSNPRNVVAAALLARNANRLGLKRKPWVKSSFAPGSKVAEIYLKEAGLLPEMEKLGFGIVAFACTTCNGMSGALDPKIQKEIIDRDLYATAVLSGNRNFDGRIHPYAKQAFLASPPLVVAYALAGSIRFDIENDVLGVADGKEIRLKDIWPADEEIDAVVAEYVKPQQFRDVYVPMFDTGTAQKAPSPLYDWRPMSTYIRRPPYWEGALAGERTLRGMRPLAILPDNITTDHLSPSNAILAVSAAGEYLAKMGLPEEDFNSYATHRGDHLTAQRATFANPKLFNEMVKNEDGSVRQGSFARVEPEGETMRMWEAIETYMNRKQPLIIIAGADYGQGSSRDWAAKGVRLAGVEAIVAEGFERIHRTNLIGMGVLPLQFKPDTNRHTLQLDGTETYDVVGERTPRCDLTLVIHRKNGETVEVPVTCCLDTAEEVLVYEAGGVLQRFAQDFLEGNAA

SEQ ID NO: 355 - DNA, 1920 bp, Neisseria meningitidis
atgctgggacgcgcgtccatgatgcgcctgcccgatattgtcggcgttgagctgaacggcaaacggaaggcgggcattacggcgacggatattgtgttggcactgaccgagtttctgcgcaaagaacgcgtggtcggggcgtttgtcgaattcttcggcgagggcgcgagaagcctgtctatcggcgaccgcgcgaccatttccaacatgacgccggagttcggcgcgactgccgcgatgttcgctattgatgagcaaaccattgattatttgaaactgaccggacgcgacgacgcgcaggtgaaattggtggaaacctacgccaaaaccgcaggcttgtgggcagatgccttgaaaaccgccgtttatccgcgcgttttgaaatttgatttgagcagcgtaacgcgcaatatggcaggcccgagcaacccgcacgcgcgttttgcgaccgccgatttggccggcaaaggcttggctaaaccttacgaagagccttcagacggccaaatgcctgacggtgcagtgattattgccgcgattacttcctgtaccaatacttccaatccgcgcaacgttgtcgccgccgcgctgttggcacgcaatgccaaccgcctcggcttgcaacgcaaaccttgggtgaaatcttcgtttgccccgggttcaaaagtagccgaaatctatttgaaagaagcagatctgctgcccgaaatggaaaaactcggcttcggtatcgttgccttcgcatgtaccacctgtaacggcatgagcggcgcgctggatccgaaaatccagaaagaaatcatcgaccgcgatttgtacgccaccgccgtattgtcaggcaaccgcaactttgacggccgtatccatccgtatgcgaaacaggctttcctcgcttcgcctccgttggtcgttgcctacgcgctggcaggcagcatccgtttcgatattgaaaacgacgtactcggcgttgcagacggcaaagaaatccgcctgaaagacatttggcctaccgatgaagaaatcgatgccatcgttgccgaatatgtgaaaccgcagcaatttcgcgacgtttatatcccgatgttcgacaccggcacagcgcaaaaagcaccaagcccgctgtacgactggcgtccaatgtctacctatatccgccgcccaccttactgggaaggcgcactggcaggggaacgcacattaagcggtatgcgtccgctggcgattttgcccgacaacatcaccaccgaccatctctcgccatccaatgcgattttggcaagcagtgccgcaggcgaatatttggcaaaaatgggtttgcctgaagaagacttcaactcttacgcaacccaccgtggcgaccacttgaccgcccaacgcgcaaccttcgccaatccgaaactgtttaacgaaatggtgagaaacgaagacggcagcgtacgccaaggttcgctggcacgcgttgaacccgaaggccaaaccatgcgcatgtgggaagccatcgaaacctatatgaaccgcaaacagccgctcatcatcattgccggcgcggactacggtcaaggctcaagccgcgactgggctgcaaaaggcgtacgcctcgccggcgtggaagcgattgttgccgaaggcttcgagcgtatccaccgcaccaacttgatcggtatgggcgtgttgccgctgcagttcaaaccgggtaccaaccgccacaccctgcaactggacggtacggaaacctacgacgttgtcggcgaacgcacaccgcgctgcgacctgacccttgtgattcaccgtaaaaacggcgagaccgtcgaagtccccattacctgccgcctcgataccgcagaagaagtgttggtatatgaagccggtggcgtattgcaacggtttgcacaggattttttggaagggaacgcggcttag

SEQ ID NO: 356 - protein, 639 aa, Neisseria meningitidis
MLGRASMMRLPDIVGVELNGKRKAGITATDIVLALTEFLRKERVVGAFVEFFGEGARSLSIGDRATISNMTPEFGATAAMFAIDEQTIDYLKLTGRDDAQVKLVETYAKTAGLWADALKTAVYPRVLKFDLSSVTRNMAGPSNPHARFATADLAGKGLAKPYEEPSDGQMPDGAVIIAAITSCTNTSNPRNVVAAALLARNANRLGLQRKPWVKSSFAPGSKVAEIYLKEADLLPEMEKLGFGIVAFACTTCNGMSGALDPKIQKEIIDRDLYATAVLSGNRNFDGRIHPYAKQAFLASPPLVVAYALAGSIRFDIENDVLGVADGKEIRLKDIWPTDEEIDAIVAEYVKPQQFRDVYIPMFDTGTAQKAPSPLYDWRPMSTYIRRPPYWEGALAGERTLSGMRPLAILPDNITTDHLSPSNAILASSAAGEYLAKMGLPEEDFNSYATHRGDHLTAQRATFANPKLFNEMVRNEDGSVRQGSLARVEPEGQTMRMWEAIETYMNRKQPLIIIAGADYGQGSSRDWAAKGVRLAGVEAIVAEGFERIHRTNLIGMGVLPLQFKPGTNRHTLQLDGTETYDVVGERTPRCDLTLVIHRKNGETVEVPITCRLDTAEEVLVYEAGGVLQRFAQDFLEGNAA

SEQ ID NO: 357 - DNA, 1245 bp, Neisseria gonorrhoeae
atgtccgccaaaactccgtcgctcttcggcggcgcgatgattatcgccgggaaggttatcggcgcaggtatgttccccaaccccaccgccaacttgggggacgggttaataggctcgctgattgtgctgctgtacacctggtttccattctcctccggcgccctcatgattttggaagtcaacacccataacccccgaggggcaagttttgacaccatggtcaaagacctgctcggacgcggctggaacatcatcaacggcatcgccgtcgctttggtcctatacggctcgacctacgcgtacattttagtcggcggtgacctgaccgccaaaggcatcggcagcgcagtaggcggcaaaatttcgctcaccgtcggacaactcgtcttcttcggcatcctcgccttttgcgtatgggcatccgcacgcttggtcgaccgctttaccggcgtcctcatcggcggcatggtattaacctttatttgggcaaccggcggcctggttgccgatgccaaaccgtccgtcctcttcgacacccaagcccccgtcggcaccggctactggatttacgccgccaccgccctgcccgtctgcctcgcttccttcggcttccacggcaacgtttccagcctgctcaaatactttaaaggcgacgcgcccaaagtggcgaaatccatctgggcaggtacattggttgccttggtaatttacgtcctctggcaaaccgccatccaaagcaacctgccgcgcaacgagttcgcccccgtgattgccgccgagaggcaactctccgtcctgaatgaaaccctgtccaaattcgcccaaaccggcgatatggataaaatattgtccctatttccctacatggcaatcgccacctcctttttaggcgtaaccttaggcctgtttgacaacatcgccgacatcttcaaatggaacgacagtatgtccgggcggggcaccaaaaccgtcgcgctgaacttcctgccgcccctgatttcctggctgctcctccccaccggcttctttaccgccattggtgcgtccggcctggcggcaaccgtctgggaccaaggcatcatccccgccatgctgctctacgtttccccccaaaaaattggcgcaggcaagacttataaagtttacggcggcttgtggctgatgttagtcttccttttcggcatcgccaacatcgccgcacaggtattgagccaaatggaactcgtccccgtatttaaaggataa

SEQ ID NO: 358 - protein, 414 aa, Neisseria gonorrhoeae
MSAKTPSLFGGAMIIAGKVIGAGMFPNPTANLGDGLIGSLIVLLYTWFPFSSGALMILEVNTHNPRGASFDTMVKDLLGRGWNIINGIAVALVLYGSTYAYILVGGDLTAKGIGSAVGGKISLTVGQLVFFGILAFCVWASARLVDRFTGVLIGGMVLTFIWATGGLVADAKPSVLFDTQAPVGTGYWIYAATALPVCLASFGFHGNVSSLLKYFKGDAPKVAKSIWAGTLVALVIYVLWQTAIQSNLPRNEFAPVIAAERQLSVLNETLSKFAQTGDMDKILSLFPYMAIATSFLGVTLGLFDNIADIFKWNDSMSGRGTKTVALNFLPPLISWLLLPTGFFTAIGASGLAATVWDQGIIPAMLLYVSPQKIGAGKTYKVYGGLWLMLVFLFGIANIAAQVLSQMELVPVFKG

SEQ ID NO: 359 - DNA, 1242 bp, Neisseria meningitidis
atgcccaacaaaaccccttcactgttcggcggcgcgatgattatcgccggcacggtcatcggcgcaggcatgctcgccaacccgaccgccacatccggcgtatggtttaccggctcgctggccgtgttgctgtacacctggttttctatgctttccagcggcctgatgattttggaagtcaacacccattatccgcacggcgcaagtttcgacacgatggtcaaagacctgctcggacgcggctggaacatcatcaacggcatcgccgtcgccttcgttttatacctgcttacttacgcttatatcttcgtcggcggcgacctgaccgccaaaggcttaggcagcgcggcaggcggcgacgtttcactcaccgtcggacaactcgtcttcttcggcatcctcgccttttgcgtatgggcatccgcacgcttggtcgaccgcttcaccggcgtccttatcggcggcatggtattgacctttatttgggcggccggcgggctgattgccgatgccaagccgtccgtcctcttcgatacccaagcccccgccggcacaaactactggatttacgccgccaccgccctgcccgtctgcctcgcttccttcggcttccacggcaacgtctccagcctgctcaaatactttaaaggcgacgcgcccaaagtggctaaatccatctggacgggcacactgattgcgctggtaatttacgtcctctggcaaaccgccatccaaggcaacctgccgcgcaacgagttcgcccccgtcatcgccgccgaagggcaagtctccgtcctcatcgaaaccctgtccaaattcgcccaaaccggcaatatggacaaaatattgtccctgttttcctatatggcgatcgccacctcgtttttaggcgtaacgctcggactcttcgactacatcgccgacatcttcaaatggaacgacagcatctccggccgcaccaaaaccgccgcgctgaccttcctgccgcccctgatttcctgcctgctcttccccaccggcttcgttaccgccatcggctacgtcggcctggcggcaaccgtctggacaggcatcatccccgccatgctgctctaccgttcgcgcaaaaaattcggcgcaggcaaaacctataaagtttacggcggcttgtggctgatggtttgggtcttccttttcggcatcgtcaacatcgccgcacaggtattgagccaaatggaactcgtccccgtatttaaaggataa

SEQ ID NO: 360 - protein, 413 aa, Neisseria meningitidis
MPNKTPSLFGGAMIIAGTVIGAGMLANPTATSGVWFTGSLAVLLYTWFSMLSSGLMILEVNTHYPHGASFDTMVKDLLGRGWNIINGIAVAFVLYLLTYAYIFVGGDLTAKGLGSAAGGDVSLTVGQLVFFGILAFCVWASARLVDRFTGVLIGGMVLTFIWAAGGLIADAKPSVLFDTQAPAGTNYWIYAATALPVCLASFGFHGNVSSLLKYFKGDAPKVAKSIWTGTLIALVIYVLWQTAIQGNLPRNEFAPVIAAEGQVSVLIETLSKFAQTGNMDKILSLFSYMAIATSFLGVTLGLFDYIADIFKWNDSISGRTKTAALTFLPPLISCLLFPTGFVTAIGYVGLAATVWTGIIPAMLLYRSRKKFGAGKTYKVYGGLWLMVWVFLFGIVNIAAQVLSQMELVPVFKG

SEQ ID NO: 361 - DNA, 1242 bp, Neisseria meningitidis
  misc_feature (55)..(55): n is a, c, g, or t
  misc_feature (206)..(206): n is a, c, g, or t
  misc_feature (736)..(736): n is a, c, g, or t
  misc_feature (796)..(796): n is a, c, g, or t
  misc_feature (991)..(991): n is a, c, g, or t
  misc_feature (1038)..(1038): n is a, c, g, or t
  misc_feature (1092)..(1092): n is a, c, g, or t
  misc_feature (1183)..(1183): n is a, c, g, or t
  misc_feature (1200)..(1200): n is a, c, g, or t
atgcccaccaaaaccccttcactgttcggcggcgcgatgattatcgccggcacgntcatcggcgcaggtatgctcgccaacccgaccgccacatccggcgtatggtttaccggctcgctggccgtgttgctgtacacctggttttccatgctctccagcggcctgatgattttggaagtcaacacccactacccccacggcgcgancttcgacaccatggttaaagacctgctcggacggagctggaacatcatcaacggcatcgccgtcgccttcgttttatacctgcttacttacgcttatatcttcgtcggcggcgacctgaccgccaaaggcttaggcagcgcggcaggcggcaatgtttcactcaccgtcggacaactcgtcttcttcggcattctcgccttttgcgtatgggcatccgcacgcttggtcgaccgattcaccagcgtcctcatcggcggcatggtattaacctttatttgggcaaccggcggcctgattgccgatgccaaactgcccgtcctcttcgacacccaagcccctaccggcaccaactactggatttatgtcgccaccgccctgcccgtctgccttgcgtcattcggtttccacggcaacgtctccagcctgctcaaatactttaaaggcgacgcgcccaaagtggctaaatccatctggacgggcacactgattgcgctggtaatttacgtcctctggcaaaccgccatccaangcaacctgccgcgcaacgagttcgcccccgtgattgccgccgaagggcaagtctccgtcntgattgaaaccctgtccaaattcgcccaaaccggcaatatggacaaaatattgtccctgttttcctatatggcgatcgccacctcgtttttaggcgtaacgctcggactcttcgactacatcgccgacatcttcaaatggaacgacagcgtgtccggccgcaccaaaaccgccgcgctgaccttcctgccgcctntaatttcctgcctgctcttccccaccggctttgttaccgccatcggntacgtcggcctggcggcaaccgtctggacaggcatcatccccgccatgctgctntaccgttcgcgcaaaaaattcggcgcaggcaaaacctataaagtttacggcggcttgtggctgatggtttgggtcttccttttcggcatcntcaacatcgccgcacangtattgagccaaatggaactcgtccccgtatttaaaggataa

SEQ ID NO: 362 - protein, 413 aa, Neisseria meningitidis
  misc_feature (19)..(19): Xaa can be any naturally occurring amino acid
  misc_feature (69)..(69): Xaa can be any naturally occurring amino acid
  misc_feature (246)..(246): Xaa can be any naturally occurring amino acid
  misc_feature (266)..(266): Xaa can be any naturally occurring amino acid
  misc_feature (331)..(331): Xaa can be any naturally occurring amino acid
  misc_feature (395)..(395): Xaa can be any naturally occurring amino acid
  misc_feature (400)..(400): Xaa can be any naturally occurring amino acid
MPTKTPSLFGGAMIIAGTXIGAGMLANPTATSGVWFTGSLAVLLYTWFSMLSSGLMILEVNTHYPHGAXFDTMVKDLLGRSWNIINGIAVAFVLYLLTYAYIFVGGDLTAKGLGSAAGGNVSLTVGQLVFFGILAFCVWASARLVDRFTSVLIGGMVLTFIWATGGLIADAKLPVLFDTQAPTGTNYWIYVATALPVCLASFGFHGNVSSLLKYFKGDAPKVAKSIWTGTLIALVIYVLWQTAIQXNLPRNEFAPVIAAEGQVSVXIETLSKFAQTGNMDKILSLFSYMAIATSFLGVTLGLFDYIADIFKWNDSVSGRTKTAALTFLPPXISCLLFPTGFVTAIGYVGLAATVWTGIIPAMLLYRSRKKFGAGKTYKVYGGLWLMVWVFLFGIXNIAAXVLSQMELVPVFKG

SEQ ID NO: 363 - DNA, 870 bp, Neisseria gonorrhoeae
atgtccgcagaaacatacacacaaatcggctgggtaggcttagggcaaatgggtctgcctatggtaacgcggctcttggacggcggcatcgaagtcggcgtatacaaccgctcgcccgacaaaactgcccccatctccgccaaaggagcaaaagtttacggcagcaccgccgaactcgtccgcgcctgccccgtcattttcctgatggtttccgactatgccgccgtgtgcgacatcctgaacggagtccgcgacggattggccggcaaaatcatcgtcaacatgagcaccatctccccgaccgaaaacctcgccgtcaaagcacttgtcgaagccgcaggcggacagtttgccgaagcacccgtttccggatcggtcggacccgccaccaacggcacactgctgattctgttcggcggcagcgaagccgttttaaacccgctgcaaaaaatattttcccttgtcggcaaaaaaaccttccatttcggcgatgtcggcaaaggctcgggcgcgaaactcgtcttgaactcgctcttaggcattttcggcgaagcgtacagcgaagcgatgctgatggcgcggcagttcggcatcgataccgacaccatcgtcgaagccatcggcggctcggcaatggactcgcctatgtttcaaacaaaaaaatcactatgggcaaaccgtgagttcccccctgcctttgcactcaaacacgcttccaaagaccttaacctcgccgtcaaagagcttgaacaggcaggcaacaccctgcccgccgtcgaaaccgttgctgccagctaccgcaaagcagttgaagccggctacggcgaacaggacgtttccggcgtttacctgaaattggcagaacactga

SEQ ID NO: 364 - protein, 289 aa, Neisseria gonorrhoeae
MSAETYTQIGWVGLGQMGLPMVTRLLDGGIEVGVYNRSPDKTAPISAKGAKVYGSTAELVRACPVIFLMVSDYAAVCDILNGVRDGLAGKIIVNMSTISPTENLAVKALVEAAGGQFAEAPVSGSVGPATNGTLLILFGGSEAVLNPLQKIFSLVGKKTFHFGDVGKGSGAKLVLNSLLGIFGEAYSEAMLMARQFGIDTDTIVEAIGGSAMDSPMFQTKKSLWANREFPPAFALKHASKDLNLAVKELEQAGNTLPAVETVAASYRKAVEAGYGEQDVSGVYLKLAEH

SEQ ID NO: 365 - DNA, 864 bp, Neisseria meningitidis
atgtccgcaaacgaatacgcacaaatcggctggataggcttagggcaaatgggtctgcctatggtaacgcggctcttggacggcggcatcgaagtcggcgtatacaaccgctcgcccgacaaaactgcccccatctccgccaaaggcgcaaaagtttacggcaacaccgccgaactcgtccgcgactatcccgtcattttcctgatggtttccgactatgccgccgtgtgcgacatcctgaacggagtccgcgacggattggccggcaamatcatcgtcaacatgagcaccatctccccgaccgaaaagctcgccgtcaaagcacttgtcgaagcgcagmgacagtttgccgaagcacccgtttccggatcggtcgggcccgccaccaacggcacgctgctgattctgttcggcggcagcgaaccgttttaaacccgctgcaaaaaatattttccctcgtcggcaaaaaaaccttccatttcggcgatgtcggcaaaggttcgggcgcgaaactcgtcttgaactcgctcttgggcattttcggcgaacgtacagcgaasgmtgctgatggcgcggcagttcggcatcgataccgacaccatcgtcgaagccatcggsgactcggcaatggactcgcccatgttccaaaccaaaaaatccctgtgggcaaaccgcgaattcccgmccgmcttcgccctcaaacacgcctccaaagacctcaacctcgccgtcaaagagcttgaacaggcaggcaacaccctgcccgccgtcgaaaccgttgctgccagctaccgcaaagcagtcgaagccggctacgggacacaggacgtttccggcgtttacctgaaactggcagaacactga

SEQ ID NO: 366 - protein, 287 aa, Neisseria meningitidis
  misc_feature (90)..(90): Xaa can be any naturally occurring amino acid
  misc_feature (144)..(144): Xaa can be any naturally occurring amino acid
  misc_feature (174)..(174): Xaa can be any naturally occurring amino acid
  misc_feature (187)..(188): Xaa can be any naturally occurring amino acid
  misc_feature (229)..(230): Xaa can be any naturally occurring amino acid
MSANEYAQIGWIGLGQMGLPMVTRLLDGGIEVGVYNRSPDKTAPISAKGAKVYGNTAELVRDYPVIFLMVSDYAAVCDILNGVRDGLAGXIIVNMSTISPTEKLAVKALVEAQRQFAEAPVSGSVGPATNGTLLILFGGSEPFXTRCKKYFPSSAKKPSISAMSAKVRARNSSXTRSWAFSANVQRXXLMARQFGIDTDTIVEAIGDSAMDSPMFQTKKSLWANREFPXXFALKHASKDLNLAVKELEQAGNTLPAVETVAASYRKAVEAGYGTQDVSGVYLKLAEH

SEQ ID NO: 367 - DNA, 870 bp, Neisseria meningitidis
atgtccgcaaacgaatacacacaaatcggctggataggcttagggcaaatgggtctgcctatggtaacgcggctcttggacggcggcatcgaagtcggcgtatacaaccgctcgcccgacaaaactgcccccatctccgccaaaggcgcaaaagtttacggcaacaccgccgaactcgtccgcgactatcccgtcattttcctgatggtttccgactatgccgccgtgtgcgacatcctgaacggagtccgcgacggattggccggcaaaatcatcgtcaacatgagcaccatctccccgaccgaaaacctcgccgtcaaagcacttgtcgaagccgcaggcggacagtttgccgaagcacccgtttccggatcggtcgggcccgccaccaacggcacgctgctgattctgttcggcggcagcgaagccgttttaaacccgctgcaaaaaatattttccctcgtcggcaaaaaaaccttccatttcggcgatgtcggcaaaggttcgggcgcgaaactcgtcttgaactcgctcttgggcattttcggcgaagcgtacagcgaagcgatgctgatggcgcggcagttcggcatcgataccgacaccatcgtcgaagccatcggcggctcggcaatggactcgcccatgttccaaaccaaaaaatccctgtgggcaaaccgcgaattcccacccgccttcgccctcaaacacgcctccaaagacctcaacctcgccgtcaaagagcttgaacaggcaggcaacaccctgcccgccgtcgaaaccgttgctgccagctaccgcaaagcagtcgaagccggctacggcgaacaggacgtttccggcgtttacctgaaattggcagaacactga

SEQ ID NO: 368 - protein, 289 aa, Neisseria meningitidis
MSANEYTQIGWIGLGQMGLPMVTRLLDGGIEVGVYNRSPDKTAPISAKGAKVYGNTAELVRDYPVIFLMVSDYAAVCDILNGVRDGLAGKIIVNMSTISPTENLAVKALVEAAGGQFAEAPVSGSVGPATNGTLLILFGGSEAVLNPLQKIFSLVGKKTFHFGDVGKGSGAKLVLNSLLGIFGEAYSEAMLMARQFGIDTDTIVEAIGGSAMDSPMFQTKKSLWANREFPPAFALKHASKDLNLAVKELEQAGNTLPAVETVAASYRKAVEAGYGEQDVSGVYLKLAEH

SEQ ID NO: 369 - DNA, 870 bp, Neisseria gonorrhoeae; identical to SEQ ID NO: 363

SEQ ID NO: 370 - protein, 289 aa, Neisseria gonorrhoeae; identical to SEQ ID NO: 364

SEQ ID NO: 371 - DNA, 870 bp, Neisseria meningitidis
  misc_feature (565)..(565): n is a, c, g, or t
atgtccgcaaacgaatacgcacaaatcggctggataggcttagggcaaatgggtctgcctatggtaacgcggctcttggacggcggcatcgaagtcggcgtatacaaccgctcgcccgacaaaactgcccccatctccgccaaaggcgcaaaagtttacggcaacaccgccgaactcgtccgcgactatcccgtcattttcctgatggtttccgactatgccgccgtgtgcgacatcctgaacggagtccgcgacggattggccggcaaaatcatcgtcaacatgagcaccatctccccgaccgaaaacctcgccgtcaaagcacttgtcgaagccgcaggcggacagtttgccgaagcacccgtttccggatcggtcgggcccgccaccaacggcacgctgctgattctgttcggcggcagcgaagccgttttaaacccgctgcaaaaaatattttccctcgtcggcaaaaaaaccttccatttcggcgatgtcggcaaaggttcgggcgcgaaactcgtcttgaactcgctcttgggcattttcggcgaagcgtacagcgaancgatgctgatggcgcggcagttcggcatcgataccgacaccatcgtcgaagccatcggsgactcggcaatggactcgcccatgttccaaaccaaaaaatccctgtgggcaaaccgcgaattcccgcccgccttcgccctcaaacacgcctccaaagacctcaacctcgccgtcaaagagcttgaacaggcaggcaacaccctgcccgccgtcgaaaccgttgctgccagctaccgcaaagcagtcgaagccggctacggcgaacaggacgtttccggcgtttacctgaaactggcagaacactga

SEQ ID NO: 372 - protein, 289 aa, Neisseria meningitidis
  misc_feature (189)..(189): Xaa can be any naturally occurring amino acid
MSANEYAQIGWIGLGQMGLPMVTRLLDGGIEVGVYNRSPDKTAPISAKGAKVYGNTAELVRDYPVIFLMVSDYAAVCDILNGVRDGLAGKIIVNMSTISPTENLAVKALVEAAGGQFAEAPVSGSVGPATNGTLLILFGGSEAVLNPLQKIFSLVGKKTFHFGDVGKGSGAKLVLNSLLGIFGEAYSEXMLMARQFGIDTDTIVEAIGDSAMDSPMFQTKKSLWANREFPPAFALKHASKDLNLAVKELEQAGNTLPAVETVAASYRKAVEAGYGEQDVSGVYLKLAEH

SEQ ID NO: 373 - DNA, 870 bp, Neisseria meningitidis; identical to SEQ ID NO: 367

SEQ ID NO: 374 - protein, 289 aa, Neisseria meningitidis; identical to SEQ ID NO: 368

SEQ ID NO: 375 - DNA, 513 bp, Neisseria gonorrhoeae
atggtattaacctttatttgggcaaccggcggcctggttgccgatgccaaaccgtccgtcctcttcgacacccaagcccccgtcggcaccggctactggatttacgccgccaccgccctgcccgtctgcctcgcttccttcggcttccacggcaacgtttccagcctgctcaaatactttaaaggcgacgcgcccaaagtggcgaaatccatctgggcaggtacattggttgccttggtaatttacgtcctctggcaaaccgccatccaaagcaacctgccgcgcaacgagttcgcccccgtgattgccgccgagaggcaactctccgtcctgaatgaaaccctgtccaaattcgcccaaaccggcgatatggataaaatattgtccctatttccctacatggcaatcgccacctcctttttaggcgtaaccttaggcctgtttgacaacatcgccggacatcttcaaatggaacgacagtatgtccgggcggcaccaaaaccgtcgcgctga

SEQ ID NO: 376 - protein, 170 aa, Neisseria gonorrhoeae
MVLTFIWATGGLVADAKPSVLFDTQAPVGTGYWIYAATALPVCLASFGFHGNVSSLLKYFKGDAPKVAKSIWAGTLVALVIYVLWQTAIQSNLPRNEFAPVIAAERQLSVLNETLSKFAQTGDMDKILSLFPYMAIATSFLGVTLGLFDNIAGHLQMERQYVRAAPKPSR

SEQ ID NO: 377 - DNA, 510 bp, Neisseria meningitidis
atggtattgacctttatttgggcggccggcgggctgattgccgatgccaagccgtccgtcctcttcgatacccaagcccccgccggcacaaactactggatttacgccgscaccgccctgcccgtctgcctcgcttccttcggcttccacggcaacgtctccagcctgctcaaatactttaaaggcgacgcgcccaaagtggctaaatccatctggacgggcacactgattgcgctggtaatttacgtcctctggcaaaccgccatccaaggcaacctgccgcgcaacgagttcgcccccgtcatcgccgccgaagggcaagtctccgtcctcatcgaaaccctgtccaaattcgcccaaaccggcaatatggacaaaatattgtccctgttttcctatatggcgatcgccacctcgtttttaggcgtaacgctcggactcttcgactacatcgcccatcttcaaatggaacgacagcatctccgggccgcaccaaaaccgccgcgctga

SEQ ID NO: 378 - protein, 169 aa, Neillia sinensis
  misc_feature (37)..(37): Xaa can be any naturally occurring amino acid
MVLTFIWAAGGLIADAKPSVLFDTQAPAGTNYWIYAXTALPVCLASFGFHGNVSSLLKYFKGDAPKVAKSIWTGTLIALVIYVLWQTAIQGNLPRNEFAPVIAAEGQVSVLIETLSKFAQTGNMDKILSLFSYMAIATSFLGVTLGLFDYIAHLQMERQHLRAAPKPPR

SEQ ID NO: 379 - DNA, 777 bp, Neisseria meningitidis
atggtattaacctttatttgggcaaccggcggcctgattgccgatgccaaactgcccgtcctcttcgacacccaagcccctaccggcaccaactactggatttatgtcgccaccgccctgcccgtctgccttgcgtcattcggtttccacggcaacgtctccagcctgctcaaatactttaaaggcgacgcgcccaaagtggctaaatccatctggacgggcacactgattgcgctggtaatttacgtcctctggcaaaccgccatccaaggcaacctgccgcgcaacgagttcgcccccgtgattgccgccgaagggcaagtctccgtcctgattgaaaccctgtccaaattcgcccaaaccggcaatatggacaaaatattgtccctgttttcctatatggcgatcgccacctcgtttttaggcgtaacgctcggactcttcgactacatcgccgacatcttcaaatggaacgacagcgtgtccggccgcaccaaaaccgccgcgctgaccttcctgccgcctctaatttcctgcctgctcttccccaccggctttgttaccgccatcggctacgtcggcctggcggcaaccgtctggacaggcatcatccccgccatgctgctctaccgttcgcgcaaaaaattcggcgcaggcaaaacctataaagtttacggcggcttgtggctgatggtttgggtcttccttttcggcatcgtcaacatcgccgcacaggtattgagccaaatggaactcgtccccgtatttaaaggataa

SEQ ID NO: 380 - protein, 258 aa, Neisseria meningitidis
MVLTFIWATGGLIADAKLPVLFDTQAPTGTNYWIYVATALPVCLASFGFHGNVSSLLKYFKGDAPKVAKSIWTGTLIALVIYVLWQTAIQGNLPRNEFAPVIAAEGQVSVLIETLSKFAQTGNMDKILSLFSYMAIATSFLGVTLGLFDYIADIFKWNDSVSGRTKTAALTFLPPLISCLLFPTGFVTAIGYVGLAATVWTGIIPAMLLYRSRKKFGAGKTYKVYGGLWLMVWVFLFGIVNIAAQVLSQMELVPVFKG

SEQ ID NO: 381 - DNA, 519 bp, Neisseria gonorrhoeae
atgttgccgggcttcaaccggatattcaaacggtttgctccaacactcggaacggcgcataaaacgccgcccttcgcgttatcccgaacggggcggctaatcagatcctatcgccataaaaggcggggtttcaaccgaaaaggaattgagatgaataaaaccttgtctattttgccggcggcaatcttactcggcgggtgcgccgccggcggcaacacattcggcagcttagacggcggcacgggtatgggtggcagcatcgtcaaaatgacggtagaaagccaatgccgtgcggaattggacaggcgcagcgaatggcgtttgaccgcgctggcgatgagtgccgaaaaacaggcggaatgggaaaacaagatttgcggctgcgctaccgaagaagcacctaaccagctgaccggcaacgatgtgatgcagatgctgaaccagtccacgcgcaatcaggcacttgccgccctgaccgtcaaaacggtttccgcctgcttcaaacgcctgtaccgctaa

SEQ ID NO: 382 - protein, 172 aa, Neisseria gonorrhoeae
MLPGFNRIFKRFAPTLGTAHKTPPFALSRTGRLIRSYRHKRRGFNRKGIEMNKTLSILPAAILLGGCAAGGNTFGSLDGGTGMGGSIVKMTVESQCRAELDRRSEWRLTALAMSAEKQAEWENKICGCATEEAPNQLTGNDVMQMLNQSTRNQALAALTVKTVSACFKRLYR

SEQ ID NO: 383 - DNA, 522 bp, Neisseria meningitidis
atgttgccgggcttcaaccggatattcaaacggtttgttccaacactcggaacggcgcataaaacgccgcccttcgcgttatcccgaacggggcggctaatcagattctatcgccataaaaggcggggtttcaaccgaaaaggaattgagatgaataaaaccttgtctattttgccggtggcaatcttactcggcggctgcgccgccggaggcggtaacacattcggcagcttagacggtggcacaggcatgggcggcagcatcgtcaaaatggcggttgggagccaatgccgtgcggaattggacaaacgcagcgaatggcgtttgaccgcgctggcgatgagtgccgaaaaacaggcggagtgggaaaacaagatttgcgcttgcgtcgcccaagaagcacccgaacggatgaccggcaacgatgtgatgcagatgctggctccgtccacgcgcaatcaggcacttgccgccctgaccgccaaaacggtttccgcctgcttcaaacacctgtaccgctaa

SEQ ID NO: 384 - protein, 173 aa, Neisseria meningitidis
MLPGFNRIFKRFVPTLGTAHKTPPFALSRTGRLIRFYRHKRRGFNRKGIEMNKTLSILPVAILLGGCAAGGGNTFGSLDGGTGMGGSIVKMAVGSQCRAELDKRSEWRLTALAMSAEKQAEWENKICACVAQEAPERMTGNDVMQMLAPSTRNQALAALTAKTVSACFKHLYR

SEQ ID NO: 385 - DNA, 522 bp, Neisseria meningitidis
atgttgccgggcttcaaccggatattcaaacggtttgttccaacactcggaacggcgcataaaacgccgcccttcgcgttatcccgaacggggcggctaatcagattctatcgccataaaaggcggggtttcaaccgaaaaggaattgagatgaataaaaccttgtctattttgccggtggcaatcttactcggcggctgcgccgccgggggcggtaacacattcggcagcttagacggcggcacaggtatgggcggcagcatcgtcaaaatggcggtagaaagccaatgccgtgcggaattgaacaaacgcagcgaatggcgtttgaccgcgctggcgatgagtgccgaaaaacaggcggaatgggaaaacaagatttgcgcttgcgtcgcccaagaagcacccaaccagctgaccggcaacgatgtgatgcagatgctggatccgtccacgcgcaatcaggcacttgccgccctgaccgccaaaacggtttccgcctgcttcaaacacctgtaccgctaa

SEQ ID NO: 386 - protein, 173 aa, Neisseria meningitidis
MLPGFNRIFKRFVPTLGTAHKTPPFALSRTGRLIRFYRHKRRGFNRKGIEMNKTLSILPVAILLGGCAAGGGNTFGSLDGGTGMGGSIVKMAVESQCRAELNKRSEWRLTALAMSAEKQAEWENKICACVAQEAPNQLTGNDVMQMLDPSTRNQALAALTAKTVSACFKHLYR

SEQ ID NO: 387 - DNA, 369 bp, Neisseria gonorrhoeae
atgtattatcgccgggttgtggggctatccgatggacttggcgatttggcagccggtattgatcgtaggcgtatgcttaccgcttttggaagcgggcatggaaatgacgcgcaaaggcaaaaccacccaatccgccgccatcgtggtgttctcttccgtctggtcaatccggttttcggctgggcgttgacgatgctgttggataatttgggcttaatcggctgcaaagaacgcagcgcgcaattaggttttgtcggacgagtattgatacccgcagtaggtttcttaatcttgtgtgtggcgatgggtgcggtcgggatgctgcccggtatccctccgtttttggagcagttcaaatctttgggctag

SEQ ID NO: 388 - protein, 122 aa, Neisseria gonorrhoeae
MYYRRVVGLSDGLGDLAAGIDRRRMLTAFGSGHGNDAQRQNHPIRRHRGVLFRLVNPVFGWALTMLLDNLGLIGCKERSAQLGFVGRVLIPAVGFLILCVAMGAVGMLPGIPPFLEQFKSLG

SEQ ID NO: 389 - DNA, 381 bp, Neisseria meningitidis
atgtattatcgccgggttatggggctatccgatggacttggcgatttggcagccggtattgagcgtagccttggtcgtaggcgtatacttaccgcttttggaagcgggcatggaaatgacgcgcaaaggcaaaaccacccaatccgccgccatcgtggtgttctcttccgccttgtcaatccggttttcggctgggcgttgacgatgctgttggataatttgggcttaatcggctgcaaagagcgcagtgcgcaattaggtttcgccggacgcgtgttgatacccgcagtaggtttcttgatcttgtgtgtggcgatgggtgcggtcgggatgctgcccggtatcccgccgtttttggaacacttcaaatctttgggctag

SEQ ID NO: 390 - protein, 126 aa, Neisseria meningitidis
MYYRRVMGLSDGLGDLAAGIERSLGRRRILTAFGSGHGNDAQRQNHPIRRHRGVLFRLVNPVFGWALTMLLDNLGLIGCKERSAQLGFAGRVLIPAVGFLILCVAMGAVGMLPGIPPFLEHFKSLG

SEQ ID NO: 391 - DNA, 381 bp, Neisseria meningitidis
atgtattatcgccgggttgtggggctatccgatggacttggcgatttggcagccggtattgagcgtagccttggtcgtaggcgtatacttaccgcttttggaagcgggcatggaaatgacgcgcaaaggcaaaaccacccaatccgccgccaccgtggtgttctcttccgcttggtcaatccggttttcggctgggcgttgacgatgctgttggataatttgggcttaatcggctgcaaagagcgcagcgcgcaattaggtttcaccggacgcgtattgatacccgtagtaggtttcttgatcttgtgtgtggcgatgggtgcggtcgggatgctgcccggtatcccgccgtttttggagcacttcaaatctttgggctag

SEQ ID NO: 392 - protein, 126 aa, Neisseria meningitidis
MYYRRVVGLSDGLGDLAAGIERSLGRRRILTAFGSGHGNDAQRQNHPIRRHRGVLFRLVNPVFGWALTMLLDNLGLIGCKERSAQLGFTGRVLIPVVGFLILCVAMGAVGMLPGIPPFLEHFKSLG

SEQ ID NO: 393 - DNA, 372 bp, Neisseria gonorrhoeae
  misc_feature (280)..(280): n is a, c, g, or t
  misc_feature (302)..(302): n is a, c, g, or t
  misc_feature (311)..(311): n is a, c, g, or t
atgccgtctgaaacacgcctgccgaaccttatccgcgccttgatatttgccctgggtttcatcttcctgaacgcctgttcggaacaaaccgcgcaaaccgttaccctgcaaggcgaaacgatgggtacgacctataccgtcaaatacctttcaaataatcgggacaaactcccctcccctgccaaaatacaaaagcgcattgatgatgcgcttaaagaagtcaaccggcagatgtccacctaccagaccgattccgaaatcagccggtttatacagacanatgctggagagctcttcgcgtntcatgcagnttctataactgattccgccgaagactgtctgcctaatacgcctatctcatcggcgctctga

SEQ ID NO: 394 - protein, 120 aa, Neisseria gonorrhoeae
MPSETRLPNLIRALIFALGFIFLNACSEQTAQTVTLQGETMGTTYTVKYLSNNRDKLPSPAKIQKRIDDALKEVNRQMSTYQTDSEISRFIQTAGELFAHASITDSAEDCLPNTPISSAL

SEQ ID NO: 395 - DNA, 1056 bp, Neisseria meningitidis
atgccgtctgaaacacgcctgccgaactttatccgcgtcttgatatttgccctgggtttcatcttcctgaacgcctgttcggaacaaaccgcgcaaaccgttaccctgcaaggcgaaacgatgggcacgacctataycgtcaaatacctttcaaataatcgggacaaactcccctcacctgccgaaatacawaaacgcatcgatgacgcgcttaaagaaktcaaccggyagatgtccacctatcagcccgactccgaaatcagccggttcaaccaacacacagccggcaagcccctccgcatttcaagcgacttcgcacacgttactgccgaagccgtccgcctgaaccgcctgacacacggcgcgctggacgtaaccgtcggccccttggtcaacctttggggattcggccccgacaaatccgttacccgtgaaccgtcgccggaacaaatcaaacaggcggcatcttatacgggcatagacaaaatcattttgaaacaaggcaaagattacgcttccttgagcaaaacccaccccaaggcctatttggatttatcttcgattgccaaaggcttcggcgttgataaagttgcgggcgaactggaaaaatacggcattcaaaattatctggtcgaaatcggcggcgagttgcacggcaaaggcaaaaacgcgcgcggcgaaccgtggcgcatcggtatcgagcagcccaatatcgtccaaggcggcaatacgcagattatcgtcccgctgaacaaccgttcgcttgccacttccggcgattaccgtattttccacgtcgataaaaacggcaaacgcctctcccatatcatcaacccgaacaacaaacgacccatcagccacaacctcgcctccatcagcgtggtcgcagacagtgcgatgacggcggacggcttgtccacaggattattcgtattgggcgaaaccgaagccttaaagctggcagagcgcgaaaaactcgctgttttcctgattgtcagggataaaggcggctaccgcaccgccatgtcttccgaatttgaaaaactgctccgctaa

SEQ ID NO: 396 - protein, 351 aa, Neisseria meningitidis
  misc_feature (46)..(46): Xaa can be any naturally occurring amino acid
  misc_feature (64)..(64): Xaa can be any naturally occurring amino acid
  misc_feature (74)..(74): Xaa can be any naturally occurring amino acid
  misc_feature (77)..(77): Xaa can be any naturally occurring amino acid
MPSETRLPNFIRVLIFALGFIFLNACSEQTAQTVTLQGETMGTTYXVKYLSNNRDKLPSPAEIXKRIDDALKEXNRXMSTYQPDSEISRFNQHTAGKPLRISSDFAHVTAEAVRLNRLTHGALDVTVGPLVNLWGFGPDKSVTREPSPEQIKQAASYTGIDKIILKQGKDYASLSKTHPKAYLDLSSIAKGFGVDKVAGELEKYGIQNYLVEIGGELHGKGKNARGEPWRIGIEQPNIVQGGNTQIIVPLNNRSLATSGDYRIFHVDKNGKRLSHIINPNNKRPISHNLASISVVADSAMTADGLSTGLFVLGETEALKLAEREKLAVFLIVRDKGGYRTAMSSEFEKLLR

SEQ ID NO: 397 - DNA, 1056 bp, Neisseria meningitidis
atgccgtctgaaacacgcctgccgaactttatccgcaccttgatatttgccctgagttttatcttcctgaacgcctgttcggaacaaaccgcgcaaaccgttaccctgcaaggtgaaacgatgggcacgacctataccgtcaaatacctttcaaataatcgggacaaactcccctcacctgccgaaatacaaaagcgcatcgatgacgcgcttaaagaagtcaaccggcagatgtccacctatcagcccgactccgaaatcagccggttcaaccaacacacagccggcaagcccctccgcatttcaagcgacttcgcacacgttactgccgaagccgtccacctgaaccgcctgacacacggcgcgctggacgtaaccgtcggccccttggtcaacctttggggattcggccccgacaaatccgttacccgtgaaccgtcgccggaacaaatcaaacaagcagcatcttatacgggcatagacaaaatcattttgaaacaaggcaaagattacgcttccttgagcaaaacccaccccaaggcctatttggatttatcttcgattgccaaaggcttcggcgttgataaagttgcgggcgaactggaaaaatacggcattcaaaattatctggtcgaaatcggcggcgagttgcacggcaaaggcaaaaacgcgcgcggcgaaccttggcgcatcggcatcgaacagcccaacatcgtccaaggcggcaatacgcagattatcgtcccgctgaacaaccgttcgcttgccacttccggcgattaccgtattttccacgtcgataaaagcggcaaacgcctctcccatatcattaatccgaacaacaaacgacccatcagccacaacctcgcctccatcagcgtggtcgcagacagtgcgatgacggcggacggcttgtccacaggattattcgtattgggcgaaaccgaagccttaaagctggcagagcgcgaaaaactcgctgttttcctgattgtcagggataaaggcggctaccgcaccgccatgtcttccgaatttgaaaaactgctccgctaa

SEQ ID NO: 398 - protein, 351 aa, Neisseria meningitidis
MPSETRLPNFIRTLIFALSFIFLNACSEQTAQTVTLQGETMGTTYTVKYLSNNRDKLPSPAEIQKRIDDALKEVNRQMSTYQPDSEISRFNQHTAGKPLRISSDFAHVTAEAVHLNRLTHGALDVTVGPLVNLWGFGPDKSVTREPSPEQIKQAASYTGIDKIILKQGKDYASLSKTHPKAYLDLSSIAKGFGVDKVAGELEKYGIQNYLVEIGGELHGKGKNARGEPWRIGIEQPNIVQGGNTQIIVPLNNRSLATSGDYRIFHVDKSGKRLSHIINPNNKRPISHNLASISVVADSAMTADGLSTGLFVLGETEALKLAEREKLAVFLIVRDKGGYRTAMSSEFEKLLR

SEQ ID NO: 399 - DNA, 1056 bp, Neisseria gonorrhoeae
atgccgtctgaaacacgcctgccgaaccttatccgcgccttgatatttgccctgggtttcatcttcctgaacgcctgttcggaacaaaccgcgcaaaccgttaccctgcaaggcgaaacgatgggtacgacctataccgtcaaatacctttcaaataatcgggacaaactcccctcccctgccaaaatacaaaagcgcattgatgatgcgcttaaagaagtcaaccggcagatgtccacctaccagaccgattccgaaatcagccggttcaaccaacacacagccggcaagcccctccgcatttcaagcgatttcgcacacgttaccgccgaagccgtccgcctgaaccgcctgactcacggcgcactggacgtaaccgtcggccctttggtcaacctttgggggttcggccccgacaaatccgttacccgtgaaccgtcgccggaacaaatcaaacaggcggcatcttatacgggcatagacaaaatcattttgcaacaaggcaaagattacgcttccttgagcaaaacccaccccaaagcctatttggatttatcttcgattgccaaaggcttcggcgttgataaagttgcgggcgaactggaaaaatacggcattcaaaattatctggtcgaaatcggcggcgagttgcacggcaaaggcaaaaatgcgcacggcgaaccgtggcgcatcggtatagagcaacccaatatcatccaaggcggcaatacgcagattatcgtcccgctgaacaaccgttcgcttgccacttccggcgattaccgtattttccacgtcgataaaaacggcaaacgcctttcccacatcatcaatcccaacaacaaacgacccatcagccacaacctcgcctccatcagcgtggtctcagacagtgcaatgacggcggacggtttatccacaggattatttgttttaggcgaaaccgaagccttaaggctggcagaacaagaaaaactcgctgttttcctaattgtccgggataaggacggctaccgcaccgccatgtcttccgaatttgccaagctgctccgctaa

SEQ ID NO: 400 - protein, 351 aa, Neisseria gonorrhoeae
MPSETRLPNLIRALIFALGFIFLNACSEQTAQTVTLQGETMGTTYTVKYLSNNRDKLPSPAKIQKRIDDALKEVNRQMSTYQTDSEISRFNQHTAGKPLRISSDFAHVTAEAVRLNRLTHGALDVTVGPLVNLWGFGPDKSVTREPSPEQIKQAASYTGIDKIILQQGKDYASLSKTHPKAYLDLSSIAKGFGVDKVAGELEKYGIQNYLVEIGGELHGKGKNAHGEPWRIGIEQPNIIQGGNTQIIVPLNNRSLATSGDYRIFHVDKNGKRLSHIINPNNKRPISHNLASISVVSDSAMTADGLSTGLFVLGETEALRLAEQEKLAVFLIVRDKDGYRTAMSSEFAKLLR

SEQ ID NO: 401 - DNA, 1056 bp, Neisseria meningitidis
atgccgtctgaaacacgcctgccgaactttatccgcgtcttgatatttgccctgggtttcatcttcctgaacgcctgttcggaacaaaccgcgcaaaccgttaccctgcaaggcgaaacgatgggcacgacctataccgtcaaatacctttcaaataatcgggacaaactcccctcacctgccgaaatacaaaaacgcatcgatgacgcgcttaaagaagtcaaccggcagatgtccacctatcagcccgactccgaaatcagccggttcaaccaacacacagccggcaagcccctccgcatttcaagcgacttcgcacacgttactgccgaagccgtccgcctgaaccgcctgacacacggcgcgctggacgtaaccgtcggccccttggtcaacctttggggattcggccccgacaaatccgttacccgtgaaccgtcgccggaacaaatcaaacaggcggcatcttatacgggcatagacaaaatcattttgaaacaaggcaaagattacgcttccttgagcaaaacccaccccaaggcctatttggatttatcttcgattgccaaaggcttcggcgttgataaagttgcgggcgaactggaaaaatacggcattcaaaattatctggtcgaaatcggcggcgagttgcacggcaaaggcaaaaacgcgcgcggcgaaccgtggcgcatcggtatcgagcagcccaatatcgtccaaggcggcaatacgcagattatcgtcccgctgaacaaccgttcgcttgccacttccggcgattaccgtattttccacgtcgataaaaacggcaaacgcctctcccatatcatcaacccgaacaacaaacgacccatcagccacaacctcgcctccatcagcgtggtcgcagacagtgcgatgacggcggacggcttgtccacaggattattcgtattgggcgaaaccgaagccttaaagctggcagagcgcgaaaaactcgctgttttcctgattgtcagggataaaggcggctaccgcaccgccatgtcttccgaatttgaaaaactgctccgctaa

SEQ ID NO: 402 - protein, 351 aa, Neisseria meningitidis
MPSETRLPNFIRVLIFALGFIFLNACSEQTAQTVTLQGETMGTTYTVKYLSNNRDKLPSPAEIQKRIDDALKEVNRQMSTYQPDSEISRFNQHTAGKPLRISSDFAHVTAEAVRLNRLTHGALDVTVGPLVNLWGFGPDKSVTREPSPEQIKQAASYTGIDKIILKQGKDYASLSKTHPKAYLDLSSIAKGFGVDKVAGELEKYGIQNYLVEIGGELHGKGKNARGEPWRIGIEQPNIVQGGNTQIIVPLNNRSLATSGDYRIFHVDKNGKRLSHIINPNNKRPISHNLASISVVADSAMTADGLSTGLFVLGETEALKLAEREKLAVFLIVRDKGGYRTAMSSEFEKLLR

SEQ ID NO: 403 - DNA, 1056 bp, Neisseria meningitidis; identical to SEQ ID NO: 397

SEQ ID NO: 404 - protein, 351 aa, Neisseria meningitidis; identical to SEQ ID NO: 398

SEQ ID NO: 405 - DNA, 423 bp, Neisseria gonorrhoeae
atggcttccatcacttcgccgctgcacggggcgcagcaggaatgcagcaagacttttttatgtccgccgggcgggacgagtatggggcggtcaatgtcggtaacggtaggtttgttttgtgtttccattaacttaacaatatctgtcgaatacggtcaaagcggctattttaccagagccgccgaatgtaaaacagggtgtcagggcatcagcccgagctgcctgaacgaacggacggtttgcgaggtaacgataaaatggtcgagcagcgaaacatcaaccagcgacatggcctgtgccagccgccttgtgaacatgatgtcttcctgcgaaggttcaggcgagccgcccggatggttgtgcgcgataatcaggctgtcggcatattcgtccaatgccagtttgacgatttcgcggatgtaa

SEQ ID NO: 406 - protein, 140 aa, Neisseria gonorrhoeae
MASITSPLHGAQQECSKTFLCPPGGTSMGRSMSVTVGLFCVSINLTISVEYGQSGYFTRAAECKTGCQGISPSCLNERTVCEVTIKWSSSETSTSDMACASRLVNMMSSCEGSGEPPGWLCAIIRLSAYSSNASLTISRM

SEQ ID NO: 407 - DNA, 423 bp, Neisseria meningitidis
atggcttccatcacttcgccgctgcacggggcgcacagagaatgcagcaagacttttttatgtccaccgggcgggacgagtatagggcggtcaatgtcggtaacggtaggtttgttttgtgtttccattaacttaacaatatctgttgaatacggttgaagcggctattttatcagagccgccgcatgtaaaacagagtgtcagggcatcaacccgagctgtctgaacgaacagacgctttgcgakgtaacgataaaatggtcgagcagcgacacatcgaccagcgacattgcctgtgccagccgccttgtgaacatgatgtcttcctgcgaargttcsggcgagccgcccggatggttgtgcgcaataatcaggctgtcggcatattcgtccaatgccagtttgacgatttcgcggatgtaa

SEQ ID NO: 408 - protein, 140 aa, Neisseria meningitidis
  misc_feature (53)..(53): Xaa can be any naturally occurring amino acid
  misc_feature (82)..(82): Xaa can be any naturally occurring amino acid
  misc_feature (112)..(112): Xaa can be any naturally occurring amino acid
MASITSPLHGAHRECSKTFLCPPGGTSIGRSMSVTVGLFCVSINLTISVEYGXSGYFIRAAACKTECQGINPSCLNEQTLCXVTIKWSSSDTSTSDIACASRLVNMMSSCEXSGEPPGWLCAIIRLSAYSSNASLTISRM

SEQ ID NO: 409 - DNA, 438 bp, Neisseria gonorrhoeae
atgccggaggcaagcatcgcctccatcacttcgccgctgcacggggcgcaacaggaatgcagcaagacttttttatgtccgccgggcgggacgagtatggggcggtcaatgtcggtaacggtaggtttgttttgtgtttccattaacttaacgatatctgtcgaatacggttgaagcggctattttatcagagccgccgcatgtaaaacagggtgtcagggcatcagcccgagctgcctgaacgaacggacggtttgcgccgttacgataaaatggtcgagcagcgacacatcgaccagcgacattgcctgtgccagccgccttgtgaacatgatgtcttcctgcgaaggttcgggcgagccgcccggatggttgtgcgcgataatcaggctgtcggcatattcgtccaatgccagtttgacaatttcacggatgtaa

SEQ ID NO: 410 - protein, 144 aa, Neisseria gonorrhoeae
MPEASIASITSPLHGAQQECSKTFLCPPGGTSMGRSMSVTVGLFCVSINLTISVEYGSGYFIRAAACKTGCQGISPSCLNERTVCAVTIKWSSSDTSTSDIACASRLVNMMSSCEGSGEPPGWLCAIIRLSAYSSNASLTISRM

SEQ ID NO: 411 - DNA, 2007 bp, Neisseria gonorrhoeae
atggtcgacgaactcgacctgctgcccgatgccgtcgccgccaccctgcttgccgacatcggacgctacgtccccgattggaacctattggtttccgagcgctgcaacagcaccgtcgccgagctggtcaaaggtgtggacgaagtgcagaaacttacccacttcgcccgggtggacagcctcgccacgccggaagaacgcgcacagcaagcggaaaccatgcggaaaatgctgctggcgatggttaccgacatccgcgtcgtattaatcaaactggcgatgcgtacgcgcaccctgctatttttaagcaacgcccccgacagccctgaaaaacgcgccgtcgccaaagaaaccctcgacatcttcgccccgctcgccaaccgcttgggcgtgtggcagctcaaatggcagctcgaagatttgggcttccgccatcaagaacccgaaaaataccgcgaaatcgccctgcttttggacgaaaaacgcaccgaacgcctcgaatacatcgaaaacttcctcgatatcctgcgtacggaactcaaaaaatacaatatccactttgaagtcgccggccgtccgaaacacatctactccatttacaaaaaaatggtgaagaaaaaactcagcttcgacggcctgttcgacatccgcgccgtgcggattctggtcgataccgtccccgagtgttacaccacgctgggcatcgtccacagcctctggcagcccattcccggcgagttcgacgactacatcgccaaccccaaaggcaacggttataaaagtttgcacaccgtcatcgtcggcccggaagacaaaggtgtggaagtgcaaatccgcaccttcgatatgcaccaattcaacgaattcggtgtcgccgcccactggcgttacaaagaaggcggcaaaggcgattccgcctacgaacaaaaaatcgcctggttgcgccaactcttggactggcgcgaaaatatggcggaaagcggcaaggaagacctcgccgccgccttcaaaaccgagcttttcaacgacacgatttatgttttgaccccgcacggcaaagtcctctctctgccaacgggcgcaacccccatcgacttcgcctacgccctgcacagcagcatcggcgaccgctgccggggcgcgaaagtcgaagggcagattgtgccgctgtccaccccgctcgaaaacggacagcgcgtcgaaatcattaccgccaaagaagggcatccttccgtcaactggctttacgaaggctgggtcaaatccggcaaggccatcggcaaaatccgcgcctacatccgccagcaaaacgccgacaccgtgcgcgaagaaggccgtgtccaactcgacaagcagcttgccaaactcacgcccaaacccaacctgcaagagcttgccgaaaatctcggctacaaaaagccagaagacctctacaccgccgtcggacaaggcgaaatttccaaccgcgccatccaaaaagcctgcggcacgctgaacgaaccgccccccgtgcccgtcagcgcaaccaccatcgtcaaacagtccaaaatcaaaaaaggtggcaaaaccggcgtgctcatcgacggcgaagacggcttgatgaccacgcttgccaaatgctgcaaacccgcgccgcccgacgatattgccggcttcgttacccgcgagcgcggcatttccgtccaccgcaaaacctgcccctctttccgacaccttgccgaacacgcgcccgaaaaagtactggacgcaagttgggcggcgttgcaggaagggcaagtgttcgccgtcgatatcgaaatccgcgcccaagaccgctccgggcttttgcgcgacgtatccgacgcgctcgcccgccacaaactcaacgttaccgccgtgcaaacccagtcccgcgacttggaagccagcatgaggttcacgctcgaagtcaaacaagtcaacgacctcccgcgcgtcctcgccggcctcggcgatgtcaaaggcgtattgagcgttacccggctttaa

SEQ ID NO: 412 - protein, 668 aa, Neisseria gonorrhoeae
MVDELDLLPDAVAATLLADIGRYVPDWNLLVSERCNSTVAELVKGVDEVQKLTHFARVDSLATPEERAQQAETMRKMLLAMVTDIRVVLIKLAMRTRTLLFLSNAPDSPEKRAVAKETLDIFAPLANRLGVWQLKWQLEDLGFRHQEPEKYREIALLLDEKRTERLEYIENFLDILRTELKKYNIHFEVAGRPKHIYSIYKKMVKKKLSFDGLFDIRAVRILVDTVPECYTTLGIVHSLWQPIPGEFDDYIANPKGNGYKSLHTVIVGPEDKGVEVQIRTFDMHQFNEFGVAAHWRYKEGGKGDSAYEQKIAWLRQLLDWRENMAESGKEDLAAAFKTELFNDTIYVLTPHGKVLSLPTGATPIDFAYALHSSIGDRCRGAKVEGQIVPLSTPLENGQRVEIITAKEGHPSVNWLYEGWVKSGKAIGKIRAYIRQQNADTVREEGRVQLDKQLAKLTPKPNLQELAENLGYKKPEDLYTAVGQGEISNRAIQKACGTLNEPPPVPVSATTIVKQSKIKKGGKTGVLIDGEDGLMTTLAKCCKPAPPDDIAGFVTRERGISVHRKTCPSFRHLAEHAPEKVLDASWAALQEGQVFAVDIEIRAQDRSGLLRDVSDALARHKLNVTAVQTQSRDLEASMRFTLEVKQVNDLPRVLAGLGDVKGVLSVTRL

SEQ ID NO: 413 - DNA, 1476 bp, Neisseria meningitidis
gtgaaactcaagaaatacaatgtccatttcgaagtcgccggccgcccgaaacacatctactccatttacaaaaaaatggtgaagaaaaaactcagcttcgacggcctctttgacatccgcgccgtgcgaattctggttgataccgtccccgagtgttacaccacgctgggtatcgtccacagcctctggcagcccattcccggcgagttcgacgactacatcgccaatcccaaaggcaacggctataaaagtttgcacaccgtcatcgtcggcccggaagacaaaggcgtggaagtacaaatccgcaccttcgatatgcaccaattcaacgaattcggtgtcgccgcccactggcgttacaaagagggcggcaagggcgattccgcctacgaacagaaaatcgcctggttgcgccaactcttggactggcgcgaaaacatggcggaaagcggcaaggaagacctcgccgccgccttcaaaaccgagcttttcaacgacacgatttatgttttgaccccgcacggcaaagtcctctccctgcccacgggcgcgacccccatcgacttcgcctacgccctgcacagcagcatcggcgaccgttgccgcggtgcgaaagtcgaagggcagattgtgccgctgtccaccccgctcgaaaacggacagcgcgtcgaaatcattaccgccaaagaagggcatccttccgtcaactggctttacgaaggctgggtcaaatccaacaaggcaatcggcaaaatccgcgcctacatccgccagcaaaacgccgacaccgtgcgcgaagaaggccgcgtccaactcgacaaacagcttgccaaactcacgcccaaacccaacctgcaagagcttgccgaaaatctcggctacaaaaagccagaagacctctacaccgccgtcggacaaggcgaaatttccaaccgcgccatccaaaaagcctgcggcacgctgaacgaaccgccgcccgtacccgtcagcgaaaccaccatcgtcaaacagtccaaaatcaaaaaaggcggcaaaaacggcgtgctcatcgacggcgaagacggtctgatgaccacgcttgccaaatgctgcaaacccgcgccgcccgacgatattatcggcttcgttacccgcgagcgcggcatttcagtgcaccgcaaawyytkcycgtctttccaacacctcgccgaacacgcgcccgawaaagtgctggacgcaagctgggcggcattgcaggaaggacaagtattcgccgtcgatatcgaaatccgcgcccaagaccgctccgggcttttgcgcgacgtatccgacgcgctcgcccgccacaaactcaacgttaccgccgtgcaaacccagtcccgcgacttggaagccagcatgaggttcacgctcgaagtcaaacaagtcaacgacctcccgcgcgtcctcgccagcctcggcgacgtcaaaggcgtattgagcgttacccggctttaa

SEQ ID NO: 414 - protein, 491 aa, Neisseria meningitidis
  misc_feature (388)..(390): Xaa can be any naturally occurring amino acid
  misc_feature (401)..(401): Xaa can be any naturally occurring amino acid
VKLKKYNVHFEVAGRPKHIYSIYKKMVKKKLSFDGLFDIRAVRILVDTVPECYTTLGIVHSLWQPIPGEFDDYIANPKGNGYKSLHTVIVGPEDKGVEVQIRTFDMHQFNEFGVAAHWRYKEGGKGDSAYEQKIAWLRQLLDWRENMAESGKEDLAAAFKTELFNDTIYVLTPHGKVLSLPTGATPIDFAYALHSSIGDRCRGAKVEGQIVPLSTPLENGQRVEIITAKEGHPSVNWLYEGWVKSNKAIGKIRAYIRQQNADTVREEGRVQLDKQLAKLTPKPNLQELAENLGYKKPEDLYTAVGQGEISNRAIQKACGTLNEPPPVPVSETTIVKQSKIKKGGKNGVLIDGEDGLMTTLAKCCKPAPPDDIIGFVTRERGISVHRKXXXSFQHLAEHAPXKVLDASWAALQEGQVFAVDIEIRAQDRSGLLRDVSDALARHKLNVTAVQTQSRDLEASMRFTLEVKQVNDLPRVLASLGDVKGVLSVTRL

SEQ ID NO: 415 - DNA, 2007 bp, Neisseria meningitidis
atggttcatgaactcgacctgctccccgatgccgtcgccgccaccctgcttgccgacatcggacgctacgtccccgactggaacctattggtttccgaacgctgcaacagtaccgtcgccgagctggtcaaaggtgtggacgaagtgcagaaactcacccacttcgcccgggtggacagcctcgccacgccggaagaacgcgcccagcaggcagaaactatgcggaaaatgctgctggcgatggttaccgacatccgcgtcgtgttaatcaaactggcgatgcgtacgcgcaccctgcaatttttaagcaacgcccccgacagccccgaaaaacgcgccgtcgccaaagaaaccctcgacatcttcgccccgctcgccaaccgtttgggcgtgtggcagctcaaatggcagctcgaagatttgggcttccgccatcaagaacccgaaaaataccgcgaaatcgccctgcttttggacgaaaaacgcaccgaacgcctcgaatacatcgaaaacttccttaatatcctgcgtacggaactcaaaaaatacaatatccactttgaagtcgccggccgtccgaaacacatctactccatttacaaaaaaatggtgaagaaaaaactcagcttcgacgggttgttcgacatccgcgccgtgcggattctggttgataccgtccccgagtgttacaccacactgggcattgtccacagcctctggcagcccattcccggcgagttcgacgactacatcgccaacccgaaaggcaacggctataaaagtttgcacaccgtcatcgtcggcccggaagacaaaggcgtggaagtgcaaatccgcaccttcgatatgcaccaattcaacgaattcggtgtcgccgcgcactggcgttacaaagagggcggcaaaggcgattccgcctacgaacaaaaaatcgcctggttacgccaacttttggactggcgcgaaaacatggcggaaagcggcaaggaagacctcgccgccgccttcaaaaccgagcttttcaacgacacgatttatgttttgaccccgcacggcaaagtcctctccctgcccacaggcgcgacccccatcgacttcgcctacgccctgcacagcagcatcggcgaccgttgccgcggtgcgaaagtcgaagggcagattgtgccgctgtccaccccgctcgaaaacggacagcgtgtcgaaatcattaccgccaaagaagggcatccttccgtcaactggctttacgaaggctgggtcaaatccaacaaggcaatcggcaaaatccgcgcctacatccgccagcaaaacgccgacaccgtgcgcgaagaaggccgcgtccaactcgacaaacagcttgccaaactcacgcccaaacccaacctgcaagagcttgccgaaaatctcggctacaaaaagccagaagacctctacaccgccgtcggacaaggcgaaatttccaaccgcgccatccaaaaagcctgcggcacgctgaacgaaccgccgcccgtacccgtcagcgaaaccaccatcgtcaaacagtccaaaatcaaaaaaggcggcaaaaacggcgtgctcatcgacggcgaagacggtctgatgaccacgcttgccaaatgctgcaaacccgcgccgcccgacgacattgtcggcttcgttacccgcgatcgcggcatttcggtacaccgcaaaacctgcccctctttccgacacctcgccgaacacgcgcccgaaaaagtactggacgcaagttgggcggcgttgcaggaaggacaagtgttcgccgtcgatatcgaaatccgcgcccaagaccgctccgggcttttgcgcgacgtatccgacgcgctcgcccgccacaaactcaacgttaccgccgtgcaaacccagtcccgcgacttggaagccagcatgaggttcacgctcgaagtcaaacaagttaccgacctcccacgcgtcctcgccagcctcggcgacgtcaaaggcgtattgagcgttacccggctttaa

SEQ ID NO: 416 - protein, 668 aa, Neisseria meningitidis
MVHELDLLPDAVAATLLADIGRYVPDWNLLVSERCNSTVAELVKGVDEVQKLTHFARVDSLATPEERAQQAETMRKMLLAMVTDIRVVLIKLAMRTRTLQFLSNAPDSPEKRAVAKETLDIFAPLANRLGVWQLKWQLEDLGFRHQEPEKYREIALLLDEKRTERLEYIENFLNILRTELKKYNIHFEVAGRPKHIYSIYKKMVKKKLSFDGLFDIRAVRILVDTVPECYTTLGIVHSLWQPIPGEFDDYIANPKGNGYKSLHTVIVGPEDKGVEVQIRTFDMHQFNEFGVAAHWRYKEGGKGDSAYEQKIAWLRQLLDWRENMAESGKEDLAAAFKTELFNDTIYVLTPHGKVLSLPTGATPIDFAYALHSSIGDRCRGAKVEGQIVPLSTPLENGQRVEIITAKEGHPSVNWLYEGWVKSNKAIGKIRAYIRQQNADTVREEGRVQLDKQLAKLTPKPNLQELAENLGYKKPEDLYTAVGQGEISNRAIQKACGTLNEPPPVPVSETTIVKQSKIKKGGKNGVLIDGEDGLMTTLAKCCKPAPPDDIVGFVTRDRGISVHRKTCPSFRHLAEHAPEKVLDASWAALQEGQVFAVDIEIRAQDRSGLLRDVSDALARHKLNVTAVQTQSRDLEASMRFTLEVKQVTDLPRVLASLGDVKGVLSVTRL

SEQ ID NO: 417 - DNA, 2214 bp, Neisseria gonorrhoeae
atgaccgccatcagcccgattcaagacacgcaaagcgcgaccctgcaagaattgcgcgaatggttcgacagctactgcgccgctctgccggacaacgataaaaacctcatcggtaccgcatggtcgctggcgcaggaacattatcctgccgatgccgccacgccgtatggcgagccgctgcccgaccacttcctcggcgcggcgcaaatggtcgacgaactcgacctgctgcccgatgccgtcgccgccaccctgcttgccgacatcggacgctacgtccccgattggaacctattggtttccgagcgctgcaacagcaccgtcgccgagctggtcaaaggtgtggacgaagtgcagaaacttacccacttcgcccgggtggacagcctcgccacgccggaagaacgcgcacagcaagcggaaaccatgcggaaaatgctgctggcgatggttaccgacatccgcgtcgtattaatcaaactggcgatgcgtacgcgcaccctgcaatttttaagcaacgcccccgacagccctgaaaaacgcgccgtcgccaaagaaaccctcgacatcttcgccccgctcgccaaccgcttgggcgtgtggcagctcaaatggcagctcgaagatttgggcttccgccatcaagaacccgaaaaataccgcgaaatcgccctgcttttggacgaaaaacgcaccgaacgcctcgaatacatcgaaaacttcctcgatatcctgcgtacggaactcaaaaaatacaatatccactttgaagtcgccggccgtccgaaacacatctactccatttacaaaaaaatggtgaagaaaaaactcagcttcgacggcctgttcgacatccgcgccgtgcggattctggtcgataccgtccccgagtgttacaccacgctgggcatcgtccacagcctctggcagcccattcccggcgagttcgacgactacatcgccaaccccaaaggcaacggttataaaagtttgcacaccgtcatcgtcggcccggaagaaaaaggtgtggaagtgcaaatccgcaccttcgatatgcaccaattcaacgaattcggtgtcgccgcccactggcgttacaaagaaggcggcaaaggcgattccgcctacgaacaaaaaatcgcctggttgcgccaactcttggactggcgcgaaaatatggcggaaagcggcaaggaagacctcgccgccgccttcaaaaccgagcttttcaacgacacgatttatgttttgaccccgcacggcaaagtcctctctctgccaacgggcgcaacccccatcgacttcgcctacgccctgcacagcagcatcggcgaccgctgccggggcgcgaaagtcgaagggcagattgtgccgctgtccaccccgctcgaaaacggacagcgcgtcgaaatcattaccgccaaagaagggcatccttccgtcaactggctttacgaaggctgggtcaaatccggcaaggccatcggcaaaatccgcgcctacatccgccagcaaaacgccgacaccgtgcgcgaagaaggccgtgtccaactcgacaagcagcttgccaaactcacgcccaaacccaacctgcaagagcttgccgaaaatctcggctacaaaaagccagaagacctctacaccgccgtcggacaaggcgaaatttccaaccgcgccatccaaaaagcctgcggcacgctgaacgaaccgccgcccgtgcccgtcagcgcaaccaccatcgtcaaacagtccaaaatcaaaaaaggtggcaaaaccggcgtgctcatcgacggcgaagacggcttgatgaccacgcttgccaaatgctgcaaacccgcgccgcccgacgatattgccggcttcgttacccgcgagcgcggcatttccgtccaccgcaaaacctgcccctctttccgacaccttgccgaacacgcgcccgaaaaagtactggacgcaagttgggcggcgttgcaggaagggcaagtgttcgccgtcgatatcgaaatccgcgcccaagaccgctccgggcttttgcgcgacgtatccgacgcgctcgcccgccacaaactcaacgttaccgccgtgcaaacccagtcccgcgacttggaagccagcatgaggttcacgctcgaagtcaaacaagtcaacgacctcccgcgcgtcctcgccggcctcggcgatgtcaaaggcgtattgagcgttacccggctttaa

SEQ ID NO: 418 - protein, 737 aa, Neisseria gonorrhoeae
MTAISPIQDTQSATLQELREWFDSYCAALPDNDKNLIGTAWSLAQEHYPADAATPYGEPLPDHFLGAAQMVDELDLLPDAVAATLLADIGRYVPDWNLLVSERCNSTVAELVKGVDEVQKLTHFARVDSLATPEERAQQAETMRKMLLAMVTDIRVVLIKLAMRTRTLQFLSNAPDSPEKRAVAKETLDIFAPLANRLGVWQLKWQLEDLGFRHQEPEKYREIALLLDEKRTERLEYIENFLDILRTELKKYNIHFEVAGRPKHIYSIYKKMVKKKLSFDGLFDIRAVRILVDTVPECYTTLGIVHSLWQPIPGEFDDYIANPKGNGYKSLHTVIVGPEEKGVEVQIRTFDMHQFNEFGVAAHWRYKEGGKGDSAYEQKIAWLRQLLDWRENMAESGKEDLAAAFKTELFNDTIYVLTPHGKVLSLPTGATPIDFAYALHSSIGDRCRGAKVEGQIVPLSTPLENGQRVEIITAKEGHPSVNWLYEGWVKSGKAIGKIRAYIRQQNADTVREEGRVQLDKQLAKLTPKPNLQELAENLGYKKPEDLYTAVGQGEISNRAIQKACGTLNEPPPVPVSATTIVKQSKIKKGGKTGVLIDGEDGLMTTLAKCCKPAPPDDIAGFVTRERGISVHRKTCPSFRHLAEHAPEKVLDASWAALQEGQVFAVDIEIRAQDRSGLLRDVSDALARHKLNVTAVQTQSRDLEASMRFTLEVKQVNDLPRVLAGLGDVKGVLSVTRL

SEQ ID NO: 419 - DNA, 2214 bp, Neisseria meningitidis
atgaccgccatcagcccgattcaagacacgcaaagcgcgactctgcaagaattgcgcgaatggttcgacagctactgcgccgctctgccggacaacgataaaaacctcatcggtaccgcatggttgctggcgcaggaacattaccccgccgatgccgccacgccgtatggcgagccgctgcccgaccacttcctcggcgcggcgcaaatggttcatgaactcgacctgctccccgatgccgtcgccgccaccctgcttgccgacatcggacgctacgtccccgactggaacctattggtttccgaacgctgcaacagtaccgtcgccgagctggtcaaaggtgtggacgaagtgcagaaactcacccacttcgcccgggtggacagcctcgccacgccggaagaacgcgcccagcaggcagaaactatgcggaaaatgctgctggcgatggttaccgacatccgcgtcgtgttaatcaaactggcgatgcgtacgcgcaccctgcaatttttaagcaacgcccccgacagccccgaaaaacgcgccgtcgccaaagaaaccctcgacatcttcgccccgctcgccaaccgtttgggcgtgtggcagctcaaatggcagctcgaagatttgggcttccgccatcaaaagcccgaaaaataccgcgaaatcgcgctgcttttggacgaaaaacgcaccgaacgcctcgaatacatcgaaaacttcctcaacatcctgcgcggtgaactcaagaaatacaatgtccatttcgaagtcgccggccgcccgaaacacatctactccatttacaaaaaaatggtgaagaaaaaactcagcttcgacggcctctttgacatccgcgccgtgcgaattctggttgataccgtccccgagtgttacaccacgctgggtatcgtccacagcctctggcagcccattcccggcgagttcgacgactacatcgccaatcccaaaggcaacggctataaaagtttgcacaccgtcatcgtcggcccggaagacaaaggcgtggaagtacaaatccgcaccttcgatatgcaccaattcaacgaattcggtgtcgccgcccactggcgttacaaagagggcggcaagggcgattccgcctacgaacagaaaatcgcctggttgcgccaactcttggactggcgcgaaaacatggcggaaagcggcaaggaagacctcgccgccgccttcaaaaccgagcttttcaacgacacgatttatgttttgaccccgcacggcaaagtcctctccctgcccacgggcgcgacccccatcgacttcgcctacgccctgcacagcagcatcggcgaccgttgccgcggtgcgaaagtcgaagggcagattgtgccgctgtccaccccgctcgaaaacggacagcgcgtcgaaatcattaccgccaaagaagggcatccttccgtcaactggctttacgaaggctgggtcaaatccaacaaggcaatcggcaaaatccgcgcctacatccgccagcaaaacgccgacaccgtgcgcgaagaaggccgcgtccaactcgacaaacagcttgccaaactcacgcccaaacccaacctgcaagagcttgccgaaaatctcggctacaaaaagccagaagacctctacaccgccgtcggacaaggcgaaatttccaaccgcgccatccaaaaagcctgcggcacgctgaacgaaccgccgcccgtacccgtcagcgaaaccaccatcgtcaaacagtccaaaatcaaaaaaggcggcaaaaacggcgtgctcatcgacggcgaagacggtctgatgaccacgcttgccaaatgctgcaaacccgcgccgcccgacgatattatcggcttcgttacccgcgagcgcggcatttcagtgcaccgcaaaacctgcccgtctttccaacacctcgccgaacacgcgcccgaaaaagtgctggacgcaagctgggcggcattgcaggaaggacaagtattcgccgtcgatatcgaaatccgcgcccaagaccgctccgggcttttgcgcgacgtatccgacgcgctcgcccgccacaaactcaacgttaccgccgtgcaaacccagtcccgcgacttggaagccagcatgaggttcacgctcgaagtcaaacaagtcaacgacctcccgcgcgtcctcgccagcctcggcgacgtcaaaggcgtattgagcgttacccggctttaa

SEQ ID NO: 420 - protein, 737 aa, Neisseria meningitidis
MTAISPIQDTQSATLQELREWFDSYCAALPDNDKNLIGTAWLLAQEHYPADAATPYGEPLPDHFLGAAQMVHELDLLPDAVAATLLADIGRYVPDWNLLVSERCNSTVAELVKGVDEVQKLTHFARVDSLATPEERAQQAETMRKMLLAMVTDIRVVLIKLAMRTRTLQFLSNAPDSPEKRAVAKETLDIFAPLANRLGVWQLKWQLEDLGFRHQKPEKYREIALLLDEKRTERLEYIENFLNILRGELKKYNVHFEVAGRPKHIYSIYKKMVKKKLSFDGLFDIRAVRILVDTVPECYTTLGIVHSLWQPIPGEFDDYIANPKGNGYKSLHTVIVGPEDKGVEVQIRTFDMHQFNEFGVAAHWRYKEGGKGDSAYEQKIAWLRQLLDWRENMAESGKEDLAAAFKTELFNDTIYVLTPHGKVLSLPTGATPIDFAYALHSSIGDRCRGAKVEGQIVPLSTPLENGQRVEIITAKEGHPSVNWLYEGWVKSNKAIGKIRAYIRQQNADTVREEGRVQLDKQLAKLTPKPNLQELAENLGYKKPEDLYTAVGQGEISNRAIQKACGTLNEPPPVPVSETTIVKQSKIKKGGKNGVLIDGEDGLMTTLAKCCKPAPPDDIIGFVTRERGISVHRKTCPSFQHLAEHAPEKVLDASWAALQEGQVFAVDIEIRAQDRSGLLRDVSDALARHKLNVTAVQTQSRDLEASMRFTLEVKQVNDLPRVLASLGDVKGVLSVTRL

SEQ ID NO: 421 - DNA, 2214 bp, Neisseria meningitidis
atgaccgccatcagcccgattcaagacacgcaaagcgcgactctgcaagaattgcgcgaatggttcgacagctactgcaccgcgctgccgaacaacgataaaaaacttgtcttagccgcccgttcgctggcggaagcacattaccccgccgatgccgccacgccgtatggcgaaccgctgcccgaccacttcctcggcgcggcgcaaatggttcatgaactcgacctgctccccgatgccgtcgccgccaccctgcttgccgacatcggacgctacgtccccgactggaacctattggtttccgaacgctgcaacagtaccgtcgccgagctggtcaaaggtgtggacgaagtgcagaaactcacccacttcgcccgggtggacagcctcgccacgccggaagaacgcgcccagcaggcagaaactatgcggaaaatgctgctggcgatggttaccgacatccgcgtcgtgttaatcaaactggcgatgcgtacgcgcaccctgcaatttttaagcaacgcccccgacagccccgaaaaacgcgccgtcgccaaagaaaccctcgacatcttcgccccgctcgccaaccgtttgggcgtgtggcagctcaaatggcagctcgaagatttgggcttccgccatcaagaacccgaaaaataccgcgaaatcgccctgcttttggacgaaaaacgcaccgaacgcctcgaatacatcgaaaacttccttaatatcctgcgtacggaactcaaaaaatacaatatccactttgaagtcgccggccgtccgaaacacatctactccatttacaaaaaaatggtgaagaaaaaactcagcttcgacgggttgttcgacatccgcgccgtgcggattctggttgataccgtccccgagtgttacaccacactgggcattgtccacagcctctggcagcccattcccggcgagttcgacgactacatcgccaacccgaaaggcaacggctataaaagtttgcacaccgtcatcgtcggcccggaagacaaaggcgtggaagtgcaaatccgcaccttcgatatgcaccaattcaacgaattcggtgtcgccgcgcactggcgttacaaagagggcggcaaaggcgattccgcctacgaacaaaaaatcgcctggttacgccaacttttggactggcgcgaaaacatggcggaaagcggcaaggaagacctcgccgccgccttcaaaaccgagcttttcaacgacacgatttatgttttgaccccgcacggcaaagtcctctccctgcccacaggcgcgacccccatcgacttcgcctacgccctgcacagcagcatcggcgaccgttgccgcggtgcgaaagtcgaagggcagattgtgccgctgtccaccccgctcgaaaacggacagcgtgtcgaaatcattaccgccaaagaagggcatccttccgtcaactggctttacgaaggctgggtcaaatccaacaaggcaatcggcaaaatccgcgcctacatccgccagcaaaacgccgacaccgtgcgcgaagaaggccgcgtccaactcgacaaacagcttgccaaactcacgcccaaacccaacctgcaagagcttgccgaaaatctcggctacaaaaagccagaagacctctacaccgccgtcggacaaggcgaaatttccaaccgcgccatccaaaaagcctgcggcacgctgaacgaaccgccgcccgtacccgtcagcgaaaccaccatcgtcaaacagtccaaaatcaaaaaaggcggcaaaaacggcgtgctcatcgacggcgaagacggtctgatgaccacgcttgccaaatgctgcaaacccgcgccgcccgacgacattgtcggcttcgttacccgcgatcgcggcatttcggtacaccgcaaaacctgcccctctttccgacacctcgccgaacacgcgcccgaaaaagtactggacgcaagttgggcggcgttgcaggaaggacaagtgttcgccgtcgatatcgaaatccgcgcccaagaccgctccgggcttttgcgcgacgtatccgacgcgctcgcccgccacaaactcaacgttaccgccgtgcaaacccagtcccgcgacttggaagccagcatgaggttcacgctcgaagtcaaacaagttaccgacctcccacgcgtcctcgccagcctcggcgacgtcaaaggcgtattgagcgttacccggctttaa

SEQ ID NO: 422 - protein, 737 aa, Neisseria meningitidis
MTAISPIQDTQSATLQELREWFDSYCTALPNNDKKLVLAARSLAEAHYPADAATPYGEPLPDHFLGAAQMVHELDLLPDAVAATLLADIGRYVPDWNLLVSERCNSTVAELVKGVDEVQKLTHFARVDSLATPEERAQQAETMRKMLLAMVTDIRVVLIKLAMRTRTLQFLSNAPDSPEKRAVAKETLDIFAPLANRLGVWQLKWQLEDLGFRHQEPEKYREIALLLDEKRTERLEYIENFLNILRTELKKYNIHFEVAGRPKHIYSIYKKMVKKKLSFDGLFDIRAVRILVDTVPECYTTLGIVHSLWQPIPGEFDDYIANPKGNGYKSLHTVIVGPEDKGVEVQIRTFDMHQFNEFGVAAHWRYKEGGKGDSAYEQKIAWLRQLLDWRENMAESGKEDLAAAFKTELFNDTIYVLTPHGKVLSLPTGATPIDFAYALHSSIGDRCRGAKVEGQIVPLSTPLENGQRVEIITAKEGHPSVNWLYEGWVKSNKAIGKIRAYIRQQNADTVREEGRVQLDKQLAKLTPKPNLQELAENLGYKKPEDLYTAVGQGEISNRAIQKACGTLNEPPPVPVSETTIVKQSKIKKGGKNGVLIDGEDGLMTTLAKCCKPAPPDDIVGFVTRDRGISVHRKTCPSFRHLAEHAPEKVLDASWAALQEGQVFAVDIEIRAQDRSGLLRDVSDALARHKLNVTAVQTQSRDLEASMRFTLEVKQVTDLPRVLASLGDVKGVLSVTRL

SEQ ID NO: 423 - DNA, 378 bp, Neisseria gonorrhoeae
atgtgcgagttcaaggattttagaagaaacatcccttgttttgaagagtatgacgaaaattcatttattggcaaatggtatgatgacggggtgtgggatgatgaagaatattggaagctggagaatgatttaatcgaggttaggagaaaatatccttatccgatggatataccaagggatattgtgattggaatcggtaccattattgattttttaatggttccaaattgggagctttttgaaattaaagcttccccttggttgcctgatagcgtgggaattcatgaacgttatgaaagattcacaacgatgctccgttatatttttaccgagaaagacatagtcaacgtgcgatttgattattacaacaaaaaatag

SEQ ID NO: 424 - protein, 125 aa, Neisseria gonorrhoeae
MCEFKDFRRNIPCFEEYDENSFIGKWYDDGVWDDEEYWKLENDLIEVRRKYPYPMDIPRDIVIGIGTIIDFLMVPNWELFEIKASPWLPDSVGIHERYERFTTMLRYIFTEKDIVNVRFDYYNKK

SEQ ID NO: 425 - DNA, 378 bp, Neisseria meningitidis
atgtgtgagttcaaggatattataagaaacgttccttattttgaggggtatgacgaaaattcatttattggcaaatggtatgatgacggggtgtgggatgatgaagaatattggaagttggagaatgatttaatcgaggttagaaaaaaatatccttatccgatggacataccaagatatgttgtcattggaatcggtaccattattgatttcttaatggttccaaattggaaactttttgaaattaaagcttccccttggttgcctgatagtgtgggaattcatgaacgttatgaaagattcacaacgatgctccgttatatttttaccgagaaagacatagtcaacgtgcgatttgattattacaacaaaaaatag

SEQ ID NO: 426 - protein, 125 aa, Neisseria meningitidis
MCEFKDIIRNVPYFEGYDENSFIGKWYDDGVWDDEEYWKLENDLIEVRKKYPYPMDIPRYVVIGIGTIIDFLMVPNWKLFEIKASPWLPDSVGIHERYERFTTMLRYIFTEKDIVNVRFDYYNKK

SEQ ID NO: 427 - DNA, 378 bp, Neisseria meningitidis
atgtgtgagttcaaggattttagaagaaacatcccttgttttgaagagtatgacgaaaattcatttattggcaaatggtatgatgacggggtgtgggatgatgaagaatattggaaattggagaatgatttaatcgaggttagaaaaaaatatccttatccgatggatataccaagggatattgtgattggaatcggtaccattattgattttttaatggttccaaattgggagctttttgaaattaaagcttccccttggttgcctgatagtgtgggaattcatgaacgttatgaaagattcacaacgatgctccgttatatttttaccgagaaagacatagtcaacgtgcgatttgattattacaacaaaaaatag

SEQ ID NO: 428 - protein, 125 aa, Neisseria meningitidis
MCEFKDFRRNIPCFEEYDENSFIGKWYDDGVWDDEEYWKLENDLIEVRKKYPYPMDIPRDIVIGIGTIIDFLMVPNWELFEIKASPWLPDSVGIHERYERFTTMLRYIFTEKDIVNVRFDYYNKK

SEQ ID NO: 429 - DNA, 672 bp, Neisseria gonorrhoeae
atgatgaagacttttaaaaatatattttccgccgccattttgtccgccgccctgccgtgcgcgtatgcggcaaggctaccccaatccgccgtgctgcactattccggcagctacggcattcccgccacgatgacatttgaacgcagcggcaatgcttacaaaatcgtttcgacgattaaagtgccgctatacaatatccgtttcgaatccggcggtacggttgtcggcaataccctgcaccctgcctactataaagacatacgcaggggcaaactgtatgcggaagccaaattcgccgacggcagcgtaacctacggcaaagcgggcgagagcaaaaccgagcaaagccccaaggctatggatttgttcacgcttgcctggcagttggcggcaaatgacgcgaaactccccccgggtctgaaaatcaccaacggcaaaaaactttattccgtcggcggcctgaataaggcgggtacgggaaaatacagcataggcggcgtggaaaccgaagtcgtcaaatatcgggtgcggcgcggcgacgatacggtaacgtatttcttcgcaccgtccctgaacaatattccggcacaaatcggctataccgacgacggcaaaacctatacgctgaagctcaaatcggtgcagatcaacggacaggccgccaaaccgtaa

SEQ ID NO: 430 - protein, 223 aa, Neisseria gonorrhoeae
MMKTFKNIFSAAILSAALPCAYAARLPQSAVLHYSGSYGIPATMTFERSGNAYKIVSTIKVPLYNIRFESGGTVVGNTLHPAYYKDIRRGKLYAEAKFADGSVTYGKAGESKTEQSPKAMDLFTLAWQLAANDAKLPPGLKITNGKKLYSVGGLNKAGTGKYSIGGVETEVVKYRVRRGDDTVTYFFAPSLNNIPAQIGYTDDGKTYTLKLKSVQINGQAAKP

SEQ ID NO: 431 - DNA, 669 bp, Neisseria meningitidis
atgatgaagacttttaaaaatatattttccgccgccattttgtccgccgccctgccgtgcgcgtatgcggcagggctgccccaatccgccgtgctgmactattccggcagctacggcattcccgccacgatgacatttgaacgcagcggcaatgcttacaaaatcgtttcgacgattaaagtgccgctatacaatatccgtttcgagtccggcggtacggttgtcggcaataccctgcaccctacctactatagagacatacgcaggggcaaactgtatgcggaagccaaattcgccgacggcagcgtaacttacggcaaagcgggcgagagcaaaaccgagcaaagccccaaggctatggatttgttcacgcttgcctggcagttggcggcaaatgacgcgaaactccccccggggctgaaaatcaccaacggcaaaaaactttattccgtcggcggtttgaataaggcgggtacaggaaaatacagcataggcggcgtggaaaccgaagtcgtcaaatatcgggtgcggcgcggcgacgatgcggtaatgtatttcttcgcaccgtccctgaacaatattccggcacaaatcggctataccgacgacggcaaaacctatacgctgaaactcaaatcggtgcagatcaacggccaggcagccaaaccg

SEQ ID NO: 432 - protein, 223 aa, Neisseria meningitidis
  misc_feature (33)..(33): Xaa can be any naturally occurring amino acid
MMKTFKNIFSAAILSAALPCAYAAGLPQSAVLXYSGSYGIPATMTFERSGNAYKIVSTIKVPLYNIRFESGGTVVGNTLHPTYYRDIRRGKLYAEAKFADGSVTYGKAGESKTEQSPKAMDLFTLAWQLAANDAKLPPGLKITNGKKLYSVGGLNKAGTGKYSIGGVETEVVKYRVRRGDDAVMYFFAPSLNNIPAQIGYTDDGKTYTLKLKSVQINGQAAKP

SEQ ID NO: 433 - DNA, 672 bp, Neisseria meningitidis
atgatgaagacttttaaaaatatattttccgccgccattttgtccgccgccctgccgtgcgcgtatgcggcagggctgccccaatccgccgtgctgcactattccggcagctacggcattcccgccacgatgacatttgaacgcagcggcaatgcttacaaaatcgtttcgacgattaaagtgccgctatacaatatccgtttcgagtccggcggtacggttgtcggcaataccctgcaccctacctactatagagacatacgcaggggcaaactgtatgcggaagccaaattcgccgacggcagcgtaacctacggcaaagcgggcgagagcaaaaccgagcaaagccccaaggctatggatttgttcacgcttgcctggcagttggcggcaaatgacgcgaaactccccccggggctgaaaatcaccaacggcaaaaaactttattccgtcggcggtttgaataaggcgggtacaggaaaatacagcataggcggcgtggaaaccgaagtcgtcaaatatcgggtgcggcgcggcgacgatgcggtaatgtatttcttcgcaccgtccctgaacaatattccggcacaaatcggctataccgacgacggcaaaacctatacgctgaaactcaaatcggtgcagatcaacggccaggcagccaaaccgtaa

SEQ ID NO: 434 - protein, 223 aa, Neisseria meningitidis
MMKTFKNIFSAAILSAALPCAYAAGLPQSAVLHYSGSYGIPATMTFERSGNAYKIVSTIKVPLYNIRFESGGTVVGNTLHPTYYRDIRRGKLYAEAKFADGSVTYGKAGESKTEQSPKAMDLFTLAWQLAANDAKLPPGLKITNGKKLYSVGGLNKAGTGKYSIGGVETEVVKYRVRRGDDAVMYFFAPSLNNIPAQIGYTDDGKTYTLKLKSVQINGQAAKP

SEQ ID NO: 435 - DNA, 1101 bp, Neisseria gonorrhoeae
atggaaacacagctttacatcggcattatgtcgggaaccagtatggacggggcggatgccgtgctggtacggatggacggcggcaaatggctgggcgcggaagggcacgcctttaccccctaccctgaccggttgcgccgcaaattgctggatttgcaggacacaggcacagacgaactgcaccgcagcaggatgttgtcgcaagaactcagccgcctgtacgcgcaaaccgccgccgaactgctgtgcagtcaaaacctcgctccgtgcgacattaccgccctcggctgccacgggcaaaccgtccgacacgcgccggaacacggttacagcatacagcttgccgatttgccgctgctggcggaactgacgcggatttttaccgtcggcgacttccgcagccgcgaccttgctgccggcggacaaggtgcgccgctcgtccccgcctttcacgaagccctgttccgcgatgacagggaaacacgcgtggtactgaacatcggcgggattgccaacatcagcgtactcccccccggcgcacccgccttcggcttcgacacagggccgggcaatatgctgatggacgcgtggacgcaggcacactggcagctgccttacgacaaaaacggtgcaaaggcggcacaaggcaacatattgccgcaactgctcggcaggctgctcgcccacccgtatttctcacaaccccacccaaaaagcacggggcgcgaactgtttgccctaaattggctcgaaacctaccttgacggcggcgaaaaccgatacgacgtattgcggacgctttcccgattcaccgcgcaaaccgtttgggacgccgtctcacacgcagcggcagatgcccgtcaaatgtacatttgcggcggcggcatccgcaatcctgttttaatggcggatttggcagaatgtttcggcacacgcgtttccctgcacagcaccgccgaactgaacctcgatcctcaatgggtggaggcggccgcatttgcgtggttggcggcgtgttggattaaccgcattcccggtagtccgcacaaagcgaccggcgcatccaaaccgtgtattctgggcgcgggatattattattga

SEQ ID NO: 436 - protein, 366 aa, Neisseria gonorrhoeae
METQLYIGIMSGTSMDGADAVLVRMDGGKWLGAEGHAFTPYPDRLRRKLLDLQDTGTDELHRSRMLSQELSRLYAQTAAELLCSQNLAPCDITALGCHGQTVRHAPEHGYSIQLADLPLLAELTRIFTVGDFRSRDLAAGGQGAPLVPAFHEALFRDDRETRVVLNIGGIANISVLPPGAPAFGFDTGPGNMLMDAWTQAHWQLPYDKNGAKAAQGNILPQLLGRLLAHPYFSQPHPKSTGRELFALNWLETYLDGGENRYDVLRTLSRFTAQTVWDAVSHAAADARQMYICGGGIRNPVLMADLAECFGTRVSLHSTAELNLDPQWVEAAAFAWLAACWINRIPGSPHKATGASKPCILGAGYYY

SEQ ID NO: 437 - DNA, 1101 bp, Neisseria meningitidis
  misc_feature (364)..(606): n is a, c, g, or t
  misc_feature (995)..(995): n is a, c, g, or t
  misc_feature (1082)..(1082): n is a, c, g, or t
atggaaacacagctttacatcggcatcatgtcgggaaccagcatggacggggcggatgccgtactgatacggatggacggcggcaaatggctgggcgcggaagggcacgcctttaccccctaccccggcaggttacgccgccaattgctggatttgcaggacacaggcgcagacgaactgcaccgcagcaggattttgtcgcaagaactcagccgcctatatgcgcaaaccgccgccgaactgctgtgcagtcaaaacctcgcaccgtccgacattaccgccctcggctgccacgggcaaaccgtccgacacgcgccggaacacggttacagcatacagcttgccgatttgccgctgctggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcttccttacgacaaaaacggtgcaaagtcggcacaaggcaacatattgccgcaactgctcgacaggctgctcgcccacccgtatttcgcacaacgccaccctaaaagcacggggcgcgaactgtttgccataaattggctcgaaacctaccttgacggcggcgaaaaccgatacgacgtattgcggacgctttcccgttttaccgcgcaaaccgtttgcgacgccgtctcacacgcagcggcagatgcccgtcaaatgtacatttgcgacggcggcatccgcaatcctgttttaatggcggatttggcagaatgtttcggcacacgcgtttccctgcacagcaccgccgacctgaacctcgatccgcaatgggtggaagccgccgnatttgcgtggttggcggcgtgttggattaatcgcattcccggtagtccgcacaaagcaaccggcgcatccaaaccgtgtattctgancgcgggatattattattga

SEQ ID NO: 438 - protein, 366 aa, Neisseria meningitidis
  misc_feature (122)..(202): Xaa can be any naturally occurring amino acid
  misc_feature (332)..(332): Xaa can be any naturally occurring amino acid
  misc_feature (361)..(361): Xaa can be any naturally occurring amino acid
METQLYIGIMSGTSMDGADAVLIRMDGGKWLGAEGHAFTPYPGRLRRQLLDLQDTGADELHRSRILSQELSRLYAQTAAELLCSQNLAPSDITALGCHGQTVRHAPEHGYSIQLADLPLLAXXXXXXXXXXXXXXXXXXXXXXXXXXXXXXXXXXXXXXXXXXXXXXXXXXXXXXXXXXXXXXXXXXXXXXXXXXXXXXXXXQLPYDKNGAKSAQGNILPQLLDRLLAHPYFAQRHPKSTGRELFAINWLETYLDGGENRYDVLRTLSRFTAQTVCDAVSHAAADARQMYICDGGIRNPVLMADLAECFGTRVSLHSTADLNLDPQWVEAAXFAWLAACWINRIPGSPHKATGASKPCILXAGYYY

SEQ ID NO: 439 - DNA, 1101 bp, Neisseria meningitidis
atggaaacacagctttacatcggcatcatgtcgggaaccagcatggacggggcggatgccgtactgatacggatggacggcggcaaatggctgggcgcggaagggcacgcctttaccccctaccccggcaggttacgccgcaaattgctggatttgcaggacacaggcgcggacgaactgcaccgcagcaggatgttgtcgcaagaactcagccgcctgtacgcgcaaaccgccgccgaactgctgtgcagtcaaaacctcgcgccgtccgacattaccgccctcggctgccacgggcaaaccgtcagacacgcgccggaacacagttacagcgtacagcttgccgatttgccgctgctggcggaacggactcagatttttaccgtcggcgacttccgcagccgcgaccttgcggccggcggacaaggcgcgccgctcgtccccgcctttcacgaagccctgttccgcgacgacagggaaacacgcgcggtactgaacatcggcgggattgccaacatcagcgtactcccccccgacgcacccgccttcggcttcgacacaggaccgggcaatatgctgatggacgcgtggatgcaggcacactggcagcttccttacgacaaaaacggtgcaaaggcggcacaaggcaacatattgccgcaactgctcgacaggctgctcgcccacccgtatttcgcacaaccccaccctaaaagcacggggcgcgaactgtttgccctaaattggctcgaaacctaccttgacggcggcgaaaaccgatacgacgtattgcggacgctttcccgattcaccgcgcaaaccgttttcgacgccgtctcacacgcagcggcagatgcccgtcaaatgtacatttgcggcggcggcatccgcaatcctgttttaatggcggatttggcagaatgtttcggcacacgcgtttccctgcacagcaccgccgaactgaacctcgatccgcaatgggtagaagccgccgcgttcgcatggatggcggcgtgttgggtcaaccgcattcccggtagtccgcacaaagcaaccggcgcatccaaaccgtgtattctgggcgcgggatattattattga

SEQ ID NO: 440 - protein, 366 aa, Neisseria meningitidis
METQLYIGIMSGTSMDGADAVLIRMDGGKWLGAEGHAFTPYPGRLRRKLLDLQDTGADELHRSRMLSQELSRLYAQTAAELLCSQNLAPSDITALGCHGQTVRHAPEHSYSVQLADLPLLAERTQIFTVGDFRSRDLAAGGQGAPLVPAFHEALFRDDRETRAVLNIGGIANISVLPPDAPAFGFDTGPGNMLMDAWMQAHWQLPYDKNGAKAAQGNILPQLLDRLLAHPYFAQPHPKSTGRELFALNWLETYLDGGENRYDVLRTLSRFTAQTVFDAVSHAAADARQMYICGGGIRNPVLMADLAECFGTRVSLHSTAELNLDPQWVEAAAFAWMAACWVNRIPGSPHKATGASKPCILGAGYYY

SEQ ID NO: 441 - DNA, 1101 bp, Neisseria meningitidis
  misc_feature (995)..(995): n is a, c, g, or t
  misc_feature (1082)..(1082): n is a, c, g, or t
atggaaacacagctttacatcggcatcatgtcgggaaccagcatggacggggcggatgccgtactgatacggatggacggcggcaaatggctgggcgcggaagggcacgcctttaccccctaccccggcaggttacgccgccaattgctggatttgcaggacacaggcgcagacgaactgcaccgcagcaggattttgtcgcaagaactcagccgcctatatgcgcaaaccgccgccgaactgctgtgcagtcaaaacctcgcaccgtccgacattaccgccctcggctgccacgggcaaaccgtccgacacgcgccggaacacggttacagcatacagcttgccgatttgccgctgctggcggaacggacgcggatttttaccgtcggcgacttccgcagccgcgaccttgcggccggcggacaaggcgcgccactcgtccccgcctttcacgaagccctgttccgcgacaacagggaaacacgcgcggtactgaacatcggcgggattgccaacatcagcgtactcccccccgacgcacccgccttcggcttcgacacagggccgggcaatatgctgatggacgcgtggacgcaggcacactggcagcttccttacgacaaaaacggtgcaaaggcggcacaaggcaacatattgccgcaactgctcgacaggctgctcgcccacccgtatttcgcacaaccccaccctaaaagcacggggcgcgaactgtttgccctaaattggctcgaaacctaccttgacggcggcgaaaaccgatacgacgtattgcggacgctttcccgttttaccgcgcaaaccgtttgcgacgccgtctcacacgcagcggcagatgcccgtcaaatgtacatttgcggcggcggcatccgcaatcctgttttaatggcggatttggcagaatgtttcggcacacgcgtttccctgcacagcaccgccgacctgaacctcgatccgcaatgggtggaagccgccgnatttgcgtggttggcggcgtgttggattaatcgcattcccggtagtccgcacaaagcaaccggcgcatccaaaccgtgtattctgancgcgggatattattattga

SEQ ID NO: 442 - protein, 366 aa, Neisseria meningitidis
  misc_feature (332)..(332): Xaa can be any naturally occurring amino acid
  misc_feature (361)..(361): Xaa can be any naturally occurring amino acid
METQLYIGIMSGTSMDGADAVLIRMDGGKWLGAEGHAFTPYPGRLRRQLLDLQDTGADELHRSRILSQELSRLYAQTAAELLCSQNLAPSDITALGCHGQTVRHAPEHGYSIQLADLPLLAERTRIFTVGDFRSRDLAAGGQGAPLVPAFHEALFRDNRETRAVLNIGGIANISVLPPDAPAFGFDTGPGNMLMDAWTQAHWQLPYDKNGAKAAQGNILPQLLDRLLAHPYFAQPHPKSTGRELFALNWLETYLDGGENRYDVLRTLSRFTAQTVCDAVSHAAADARQMYICGGGIRNPVLMADLAECFGTRVSLHSTADLNLDPQWVEAAXFAWLAACWINRIPGSPHKATGASKPCILXAGYYY

SEQ ID NO: 443 - DNA, 1101 bp, Neisseria meningitidis; identical to SEQ ID NO: 439

SEQ ID NO: 444 - protein, 366 aa, Neisseria meningitidis; identical to SEQ ID NO: 440

SEQ ID NO: 445 - DNA, 732 bp, Neisseria gonorrhoeae
atggctttactgagcatccgcaagctgcacaaacaatacggcagcgtaaccgccatccaatccttagacttggacttggaaaaaggcgaagtcatcgtactgctgggcccgtccggctgcggcaaatccaccctcctgcgctgcgtcaacggtttggagccgcaccaaggcggcagcatcgtgatggacggtgtcggcgaattcggcaaagacgtttcctggcaaaccgcccggcaaaaagtcggtatggtctttcaaagtaacgaactgtttgcccacatgaccgtcatcgaaaacatcttcttaggcccggtaaaggaacaaaaccgcgaccgtgccgaagcagaggcgcaagccggcaaactgttggaacgcgtcggactgctagaccgcaaaaacgcctatccgcgcgaactttccggcggtcagaaacagcgcatcgccattgtccgcgccctgtgcctgaatccggaagtcatcctgctggacgaaatcaccgccgcacttgaccccgaaatggtgcgcgaagtcttggaagtggttttggaactcgcccgcgaagggatgagtatgctcatcgtaacccacgaaatggggttcgcacgcaaagttgccgaccgcatcgtctttatggacaaaggcggcatcgtcgaatcgtccgaccccgaaacctttttttccgcaccaaaaagcgaacgcgcccgccaatttctggcaggtatggactactga

SEQ ID NO: 446 - protein, 243 aa, Neisseria gonorrhoeae
MALLSIRKLHKQYGSVTAIQSLDLDLEKGEVIVLLGPSGCGKSTLLRCVNGLEPHQGGSIVMDGVGEFGKDVSWQTARQKVGMVFQSNELFAHMTVIENIFLGPVKEQNRDRAEAEAQAGKLLERVGLLDRKNAYPRELSGGQKQRIAIVRALCLNPEVILLDEITAALDPEMVREVLEVVLELAREGMSMLIVTHEMGFARKVADRIVFMDKGGIVESSDPETFFSAPKSERARQFLAGMDY

SEQ ID NO: 447 - DNA, 762 bp, Neisseria meningitidis
gttgtcatgattaaaatccgcaatatccataagacctttggcgaaaacactattttgcgcggcatcgatttggatgtgtgcaaagggcaggtggtcgtcatcctcgggccttccggctcaggcaaaacgacgtttctgcgatgcctaaacgcgttggaaatgcccgaagacggacaaatcgagttcgacaacgagcgaccgctgaaaatcgatttttctaaaaaaccaagcaaacacgatattttggcactgcgccgcaaatcakgcatggtgtttcaacaatacaayctctttccgcacaaaaccgccttggaaaacgtaatggaaggaccggttgccgtacagggcaagcctgccgcccaagcgcgcgaagaggctctgaaactgctggaaaaagtcggcttgggcgacaaagtggatttgtatccctaccagctttccggcggtcagcagcagcgcgtcggcattgcccgcgcattggcgattcagcctgaactgatgctgtttgacgaaccgacttccgcgctcgatcctgaattggtgcaagatgttttggatmccatgaaggaattggcgcaagaaggctggaccatggttgtcgttacgcatgaaatcaagttcgccttagaagtggcaaccaccgwcgtcgtgatggacrgcggcgttattgtcgaacaaggcagcccgcaagatttgttcgaccaccccaaacacgaacggacgcggagatttttaagccaaatccaatctaccaagatttga

SEQ ID NO: 448 - protein, 253 aa, Neisseria meningitidis
  misc_feature (89)..(89): Xaa can be any naturally occurring amino acid
  misc_feature (187)..(187): Xaa can be any naturally occurring amino acid
  misc_feature (215)..(215): Xaa can be any naturally occurring amino acid
  misc_feature (220)..(220): Xaa can be any naturally occurring amino acid
VVMIKIRNIHKTFGENTILRGIDLDVCKGQVVVILGPSGSGKTTFLRCLNALEMPEDGQIEFDNERPLKIDFSKKPSKHDILALRRKSXMVFQQYNLFPHKTALENVMEGPVAVQGKPAAQAREEALKLLEKVGLGDKVDLYPYQLSGGQQQRVGIARALAIQPELMLFDEPTSALDPELVQDVLDXMKELAQEGWTMVVVTHEIKFALEVATTXVVMDXGVIVEQGSPQDLFDHPKHERTRRFLSQIQSTKI

SEQ ID NO: 449 - DNA, 762 bp, Neisseria meningitidis
gttgtcatgattaaaatccgcaatatccataagaccttcggcaaaaataccattttgcgcggcatcaatttggatgtgtgcaaagggcaggtggtcgtcatcctcgggccttccggctcaggcaaaacgacgtttctgcgatgcctaaacgcgttggaaatgcccgaagacggacaaatcgagttcgacaacgagcgaccgctgaaaatcgatttttctaaaaaaccaagcaaacacgatattttggcactgcgccgcaaatcaggcatggtgtttcaacaatacaacctctttccgcacaaaaccgccttggaaaacgtgatggaaggaccggttgccgtacagggcaagcctgccgcccaagcgcgcgaagaggctctgaaactgctggaaaaagtcggcttgggcgacaaagtggatttgtatccctaccagctttccggcggtcagcagcagcgcgtcggcattgcccgagcattggcgattcagcccgagctgatgttgtttgacgaacccacttccgcgcttgaccccgagttggtgcaagacgtgttgaacgccatgaaggaattggcgcgggaaggttggacgatggtcgtcgttacccacgaaatcaagttcgcgctggaagttgccacgaccgttgtcgtgatggacggcggcgttatcgtagagcagggcagcccgaaagagttgttcgaccaccccaaacacgaacggacgcggagatttttaagccaaatccaatctaccaagatttga

SEQ ID NO: 450 - protein, 253 aa, Neisseria meningitidis
VVMIKIRNIHKTFGKNTILRGINLDVCKGQVVVILGPSGSGKTTFLRCLNALEMPEDGQIEFDNERPLKIDFSKKPSKHDILALRRKSGMVFQQYNLFPHKTALENVMEGPVAVQGKPAAQAREEALKLLEKVGLGDKVDLYPYQLSGGQQQRVGIARALAIQPELMLFDEPTSALDPELVQDVLNAMKELAREGWTMVVVTHEIKFALEVATTVVVMDGGVIVEQGSPKELFDHPKHERTRRFLSQIQSTKI

SEQ ID NO: 451 - DNA, 756 bp, Neisseria gonorrhoeae
atgattaaaatccgcaatatccataagacctttggcgaaaacaccattttgcgcggcatcgatttggatgtgggcaaagggcaggtggtcgtcatcctcgggccttccggctcgggtaaaacaacatttctgcgctgcctaaacgcgttggaaatgcccgaagacggacaaatcgagttcgacaacgcgcggccgttacgcattgatttttccaaaaaaacaagcaaacacgatattttggcactgcgccgcaagtccggaatggtattccaacaatacaacctcttcccgcataaaaccgtgttggaaaacgtgatggaagggccggttgccgtacagggcaagcctgccgcccaagcgcgcgaagaggctttgaaactgctggaaaaagtcggcttgggcgataaagtggatttgtatccctaccagctttccggcggtcagcagcagcgtgtcggtatcgcccgcgcactggcgattcagcctgaattgatgctgtttgacgaacccacttccgcgctggaccccgagttggtgcaagacgtgttggacgccatgaaggaattggcgcgggaaggttggacgatggtcgtcgttacccacgaaatcaagttcacgctggaagttgccacgaacgtcgtcgtgatggacggcggcgttatcgtagagcagggcagcccgaaagagttgttcgaccacctcaaacacgaacggacgcggagatttttaagccaaatccaatctgccaagatttga

SEQ ID NO: 452 - protein, 251 aa, Neisseria gonorrhoeae
MIKIRNIHKTFGENTILRGIDLDVGKGQVVVILGPSGSGKTTFLRCLNALEMPEDGQIEFDNARPLRIDFSKKTSKHDILALRRKSGMVFQQYNLFPHKTVLENVMEGPVAVQGKPAAQAREEALKLLEKVGLGDKVDLYPYQLSGGQQQRVGIARALAIQPELMLFDEPTSALDPELVQDVLDAMKELAREGWTMVVVTHEIKFTLEVATNVVVMDGGVIVEQGSPKELFDHLKHERTRRFLSQIQSAKI

SEQ ID NO: 453 - DNA, 756 bp, Neisseria meningitidis
atgattaaaatccgcaatatccataagacctttggcgaaaacactattttgcgcggcatcgatttggatgtgtgcaaagggcaggtggtcgtcatcctcgggccttccggctcaggcaaaacgacgtttctgcgatgcctaaacgcgttggaaatgcccgaagacggacaaatcgagttcgacaacgagcgaccgctgaaaatcgatttttctaaaaaaccaagcaaacacgatattttggcactgcgccgcaaatcaggcatggtgtttcaacaatacaacctctttccgcacaaaaccgccttggaaaacgtaatggaaggaccggttgccgtacagggcaagcctgccgcccaagcgcgcgaagaggctctgaaactgctggaaaaagtcggcttgggcgacaaagtggatttgtatccctaccagctttccggcggtcagcagcagcgcgtcggcattgcccgcgcattggcgattcagcctgaactgatgctgtttgacgaaccgacttccgcgctcgatcctgaattggtgcaagatgttttggataccatgaaggaattggcgcaagaaggctggaccatggttgtcgttacgcatgaaatcaagttcgccttagaagtggcaaccaccgtcgtcgtgatggacggcggcgttattgtcgaacaaggcagcccgcaagatttgttcgaccaccccaaacacgaacggacgcggagatttttaagccaaatccaatctaccaagatttga

SEQ ID NO: 454 - protein, 251 aa, Neisseria meningitidis
MIKIRNIHKTFGENTILRGIDLDVCKGQVVVILGPSGSGKTTFLRCLNALEMPEDGQIEFDNERPLKIDFSKKPSKHDILALRRKSGMVFQQYNLFPHKTALENVMEGPVAVQGKPAAQAREEALKLLEKVGLGDKVDLYPYQLSGGQQQRVGIARALAIQPELMLFDEPTSALDPELVQDVLDTMKELAQEGWTMVVVTHEIKFALEVATTVVVMDGGVIVEQGSPQDLFDHPKHERTRRFLSQIQSTKI

SEQ ID NO: 455 - DNA, 756 bp, Neisseria meningitidis
atgattaaaatccgcaatatccataagaccttcggcaaaaataccattttgcgcggcatcaatttggatgtgtgcaaagggcaggtggtcgtcatcctcgggccttccggctcaggcaaaacgacgtttctgcgatgcctaaacgcgttggaaatgcccgaagacggacaaatcgagttcgacaacgagcgaccgctgaaaatcgatttttctaaaaaaccaagcaaacacgatattttggcactgcgccgcaaatcaggcatggtgtttcaacaatacaacctctttccgcacaaaaccgccttggaaaacgtgatggaaggaccggttgccgtacagggcaagcctgccgcccaagcgcgcgaagaggctctgaaactgctggaaaaagtcggcttgggcgacaaagtggatttgtatccctaccagctttccggcggtcagcagcagcgcgtcggcattgcccgagcattggcgattcagcccgagctgatgttgtttgacgaacccacttccgcgcttgaccccgagttggtgcaagacgtgttgaacgccatgaaggaattggcgcgggaaggttggacgatggtcgtcgttacccacgaaatcaagttcgcgctggaagttgccacgaccgttgtcgtgatggacggcggcgttatcgtagagcagggcagcccgaaagagttgttcgaccaccccaaacacgaacggacgcggagatttttaagccaaatccaatctaccaagatttga

SEQ ID NO: 456 - protein, 251 aa, Neisseria meningitidis
MIKIRNIHKTFGKNTILRGINLDVCKGQVVVILGPSGSGKTTFLRCLNALEMPEDGQIEFDNERPLKIDFSKKPSKHDILALRRKSGMVFQQYNLFPHKTALENVMEGPVAVQGKPAAQAREEALKLLEKVGLGDKVDLYPYQLSGGQQQRVGIARALAIQPELMLFDEPTSALDPELVQDVLNAMKELAREGWTMVVVTHEIKFALEVATTVVVMDGGVIVEQGSPKELFDHPKHERTRRFLSQIQSTKI

SEQ ID NO: 457 - DNA, 1032 bp, Neisseria gonorrhoeae
atgtcgggcaatgcctcctctccttcatcttccgccgccatcgggctggtttggttcggcgcggcggtatcgattgccgaaatcagcacgggtacgctgctcgcccccttgggctggcagcgcggtctggcggccctgcttttgggtcatgccgtcggcggcgcgctgttttttgcggcggcgtatatcggcgcactgaccggacgcagctcgatggaaagtgtgcgcctgtcgttcggcaaatgcggttcagtgctgttttccgtggcgaatatgctgcaactggccggctggacggcggtgatgatttacgtcggcgcaacggtcagctccgctttgggcaaagtgttgtgggacggcgaatcctttgtctggtgggcattggcaaacggcgcactgatcgtgctgtggctggttttcggcgcacgcagaacgggcgggctgaaaaccgtttcgatgctgctgatgctgcttgccgtgttgtggttgagcgtcgaagtgttcgcttcgtccggcacaaacgccgcgcccgccgtttcagacggcatgaccttcggaacggcagtcgaactgtccgccgtcatgccgctttcctggctgccgctggccgccgactacacgcgccaagcacgccgcccgtttgcggcaaccctgacggcaacgctcgcctatacgctgacgggctgctggatgtatgccttgggtttggcggcggctctgtttaccggagaaaccgacgtggcgaaaatcctgttgggcgcgggcttgggcataacgggcattctggcagtcgtcctctccaccgttaccacaacgtttctcgatacctattccgccggcgcgagtgcgaacaacatttccgcgcgttttgcggaaatacccgtcgctgtcggcgttaccctgatccgcaccgtgcttgccgtcatgctgcccgttaccgaatataaaaacttcctgctgcttatccgctcggtatttgggccgatggcgggtggttttgattgccgacttttttgtcttaaaacggcgtga

SEQ ID NO: 458 - protein, 1 aa, Neisseria gonorrhoeae
C

SEQ ID NO: 459 - DNA, 1029 bp, Neisseria meningitidis
atgtcgggcaatgcctcctctccttcatcttcctccgccatcgggctgatttggttcggcgcggcggtatcgattgccgaaatcagcacgggtacgctgcttgcgcctttgggctggcagcgcggtctggcggctctacttttgggtcatgccgtcggcggcgcgctgttttttgcggcggcgtatatcggcgcactgaccggacgcagctcgatggaaagcgtgcgcctgtcgttcggcaaacgcggttcagtgctgttttccgtggcgaatatgctgcaactggccggctggacggcggtgatgatttacgccggcgcaacggtcagctccgctttgggcaaagtgttgtgggacggcgaatcttttgtctggtgggcattggcaaacggcgcgctgattgtgctgtggctggttttcggcgcacgcaaaacaggcgggctgaaaaccgtttcgatgctgctgatgctgttggcggttctgtggctgagtgccgaagtcttttccacggcaggcagcaccgccgcacaggtttcagacggcatgagtttcggaacggcagtcgagctgtccgccgtgatgccgctttcctggctgccgcttgccgccgactacacgcgccacgcgcgccgcccgtttgcggcaaccctgacggcaacgctcgcctacacgctgaccggctgctggatgtatgccttgggtttggcagcggcgttgttcaccggagaaaccgacgtggcaaaaatcctgctgggcgcargtttgggtgcggcaggcattttggcggtcgtcctctccaccgttaccacaacgtttctcgatgcctattccgccggcgcgagtgcgaacaacatttccgcgcgttttgcggaaacacccgtcgctgtcrgcgttaccctgatcggcacggtacttgccgtcatgctgcccgttaccgaatatgaaaacttcctgctgcttatcggctcggtatttgcgccgatggcgggcggttttgattgccgactttttcgtcttgaaacggcgtga

SEQ ID NO: 460 - protein, 342 aa, Neisseria meningitidis
  misc_feature (254)..(254): Xaa can be any naturally occurring amino acid
  misc_feature (297)..(297): Xaa can be any naturally occurring amino acid
MSGNASSPSSSSAIGLIWFGAAVSIAEISTGTLLAPLGWQRGLAALLLGHAVGGALFFAAAYIGALTGRSSMESVRLSFGKRGSVLFSVANMLQLAGWTAVMIYAGATVSSALGKVLWDGESFVWWALANGALIVLWLVFGARKTGGLKTVSMLLMLLAVLWLSAEVFSTAGSTAAQVSDGMSFGTAVELSAVMPLSWLPLAADYTRHARRPFAATLTATLAYTLTGCWMYALGLAAALFTGETDVAKILLGAXLGAAGILAVVLSTVTTTFLDAYSAGASANNISARFAETPVAVXVTLIGTVLAVMLPVTEYENFLLLIGSVFAPMAGGFDCRLFRLETA

SEQ ID NO: 461 - DNA, 1028 bp, Neisseria meningitidis
atgtcgggcaatgcctcctctccttcatcttccgccgccatcgggctgatttggttcggcgcggcggtatcgattgccgaaatcagcacgggtacactgcttgcgcctttgggctggcagcgcggtctggcggctctgcttttgggtcatgccgtcggcggcgcgctgttttttgcggcggcgtatatcggcgcactgaccggacgcagctcgatggaaagcgtgcgcctgtcgttcggcaaacgcggttcagtgctgttttccgtggcgaatatgctgcaactggccggctggacggcggtgatgatttacgccggcgcaacggtcagctccgctttgggcaaagtgttgtgggacggcgaatcttttgtctggtgggcattggcaaacggcgcgctgattgtgctgtggctggttttcggcgcacgcaaaacaggcgggctgaaaaccgtttcgatgctgctgatgctgttggcggttctgtggctgagtgccgaagtcttttccacggcaggcagcaccgccgcacaggtttcagacggcatgagtttcggaacggcagtcgagctgtccgccgtgatgccgctttcttggctgccgctggccgccgactacacgcgccacgcgcgccgcccgtttgcggcaaccctgacggcaacgctcgcctacacgctgaccggctgctggatgtatgccttgggtttggcagcggcgttgttcaccggagaaaccgacgtggcaaaaatcctgctgggcgcaggtttgggtgcggcaggcattttggcggtcgtcctgtcgaccgttaccaccacttttctcgatgcctactccgccggcgtaagtgccaacaatatttccgccaaactttcggaaatacccatcgccgttgccgtcgccgttgtcggcacactgcttgccgtcctcctgcccgttaccgaatatgaaaacttcctgctgcttatcggctcggtatttgcgccgatggcggcggttttgattgccgactttttcgtcttgaaacggcgtga

SEQ ID NO: 462 - protein, 342 aa, Neisseria meningitidis
  misc_feature (330)..(330): Xaa can be any naturally occurring amino acid
MSGNASSPSSSAAIGLIWFGAAVSIAEISTGTLLAPLGWQRGLAALLLGHAVGGALFFAAAYIGALTGRSSMESVRLSFGKRGSVLFSVANMLQLAGWTAVMIYAGATVSSALGKVLWDGESFVWWALANGALIVLWLVFGARKTGGLKTVSMLLMLLAVLWLSAEVFSTAGSTAAQVSDGMSFGTAVELSAVMPLSWLPLAADYTRHARRPFAATLTATLAYTLTGCWMYALGLAAALFTGETDVAKILLGAGLGAAGILAVVLSTVTTTFLDAYSAGVSANNISAKLSEIPIAVAVAVVGTLLAVLLPVTEYENFLLLIGSVFAPMAXGFDCRLFRLETA

SEQ ID NO: 463 - DNA, 867 bp, Neisseria gonorrhoeae
atgccgtctgaaaccccaaaggcacgccgccggctttcagacggcatcgcgtccgacaaccataccaaagaatccatcatgctcaccctgtacggcgaaactttcccttcgcggctgctgctcggcacggcggcctacccgacccctgaaatcctcaaacaatccgtccgaaccgcccggcccgcgatgattaccgtctcgctgcgccgcacgggatgcggcggcgaggcgcacggtcaggggttttggtcgctgcttcaagaaaccggcgttcccgtcctgccgaacacggcaggctgccaaagcgtgcaggaagcggtaacgacggcgcaaatggcgcgcgaagtgtttgaaaccgattggataaaattggaactcatcggcgacgacgacaccttgcagccggacgtgttccaactcgtcgaagcggcggaaatcctgattaaagacggcttcaaagtgctgccttattgcaccgaagacctgattgcctgccgccgcctgctcgatgcgggctgtcaggcgttgatgccgtgggcggctcccatcggcacgggtttgggggcggttcacgcctatgcgctcaaaatcctgcgcgaacgcctgcccgacacgccgctgattatcgacgcgggcttgggtttgccttcccaagcggcacaagtgatggaatggggttttgacggcgtattgttaaacaccgccgtttcccgcagcggcgaccccgtcaacatggcgcgcgccttcgcactcgccgtcgaatccggacggctggcatttgaagccgggccggtcgaagcgcgaaccaaagcccaagccagcacgccgacagtcggacaaccgttttggcattcggcggaatattga

SEQ ID NO: 464 - protein, 288 aa, Neisseria gonorrhoeae
MPSETPKARRRLSDGIASDNHTKESIMLTLYGETFPSRLLLGTAAYPTPEILKQSVRTARPAMITVSLRRTGCGGEAHGQGFWSLLQETGVPVLPNTAGCQSVQEAVTTAQMAREVFETDWIKLELIGDDDTLQPDVFQLVEAAEILIKDGFKVLPYCTEDLIACRRLLDAGCQALMPWAAPIGTGLGAVHAYALKILRERLPDTPLIIDAGLGLPSQAAQVMEWGFDGVLLNTAVSRSGDPVNMARAFALAVESGRLAFEAGPVEARTKAQASTPTVGQPFWHSAEY

SEQ ID NO: 465 - DNA, 810 bp, Neisseria gonorrhoeae
cactatacaaaggaacccattatgctcaccctatacggcgaaactttcccctcgcggctgctgctcggcacggctgcctacccgacccccgaaatcctcaaacaatccatccaaaccgcccagcctgcgatgattaccgtctcgctgcgccgcgcgggaagcggcggcgaggcgcacggtcaggggttttggtcgctgcttcaagaaaccggcgttcccgtcctgccgaacacggcaggctgccaaagcgtgcaggaagcggtaacgacggcgcaaatggcgcgcgaagtgtttgaaaccgattggataaaattggaactcatcggagatgacgacaccttgcagccggatgtgttccagcttgtcgaagcggcggaaatcctgattaaagacggcttcaaagtgctgccttattgcaccgaagacctgattgcctgccgccgcctgctcgacgcgggctgtcaggcgttgatgccgtgggcggccccgatcggcacgggtttgggcgcggttcacgcctacgcgttgaacgtcctgcgcgaacgcctgcccgacacgccgctgattatcgacgcgggcttgggtttgccctcacaggcggcacaagtgatggaatggggctttgacggcgtgcttttgaatactgccgtttcccgcagcggcgatccggtcaatatggcacgcgccttcgcactcgccgtcgaatccggacggctggcatttgaagccggaccggtcgaagcacgcgacaaagcgcaagccagcacgccgacagtcggacaaccgttttggcattcggcggaatattga

SEQ ID NO: 466 - protein, 269 aa, Neisseria meningitidis
HYTKEPIMLTLYGETFPSRLLLGTAAYPTPEILKQSIQTAQPAMITVSLRRAGSGGEAHGQGFWSLLQETGVPVLPNTAGCQSVQEAVTTAQMAREVFETDWIKLELIGDDDTLQPDVFQLVEAAEILIKDGFKVLPYCTEDLIACRRLLDAGCQALMPWAAPIGTGLGAVHAYALNVLRERLPDTPLIIDAGLGLPSQAAQVMEWGFDGVLLNTAVSRSGDPVNMARAFALAVESGRLAFEAGPVEARDKAQASTPTVGQPFWHSAEY

SEQ ID NO: 467 - DNA, 819 bp, Neisseria meningitidis
ttgttaatccactatacaaaggaacccattatgctcaccctgtacagcgaaactttcccttcgcggctgctgctcggcacagccgcctacccgacccctgaaatcctcaaacaatccgtccgaaccgcccggcccgcgatgattaccgtctcgctgcgccgcgcgggatgcggcggcgaggcgcacggtcaggggttttggtcgctgcttcaagaaaccggcgttcccgtcctgccgaacacggcaggctgccaaagcgtgcaggaagcggtaacgacggcgcaaatggcgcgcgaagtgtttgaaaccgattggattaaactcgaactcatcggcgacgacgacaccttgcagccggatgtgttccaacttgtcgaagcggcggaaatcctgattaaagacggcttcaaagtgctgccttattgcaccgaagacctgattgcctgccgccgcctgctcgacgcgggctgtcaggcgttgatgccgtgggcggccccgatcggcacgggtttgggcgcggttcacgcctacgcgttgaacgtcctgcgcgaacgcctgcccgacacgccgctgattatcgacgcgggcttgggtttgccctcacaggcggcacaagtgatggaatggggctttgacggcgtgcttttgaatactgccgtttcccgcagcggcgatccggtcaatatggcacgcgccttcgcactcgccgtcgaatccggacggctggcatttgaagccggaccggtcgaagcacgcgacaaagcgcaagccagcacgccgacagtcggacaaccgttttggcattcggcggaatattga

SEQ ID NO: 468 - protein, 272 aa, Neisseria meningitidis
LLIHYTKEPIMLTLYSETFPSRLLLGTAAYPTPEILKQSVRTARPAMITVSLRRAGCGGEAHGQGFWSLLQETGVPVLPNTAGCQSVQEAVTTAQMAREVFETDWIKLELIGDDDTLQPDVFQLVEAAEILIKDGFKVLPYCTEDLIACRRLLDAGCQALMPWAAPIGTGLGAVHAYALNVLRERLPDTPLIIDAGLGLPSQAAQVMEWGFDGVLLNTAVSRSGDPVNMARAFALAVESGRLAFEAGPVEARDKAQASTPTVGQPFWHSAEY

SEQ ID NO: 469 - DNA, 789 bp, Neisseria gonorrhoeae
atgctcaccctgtacggcgaaactttcccttcgcggctgctgctcggcacggccgcctacccgacccctgaaatcctcaaacaatccgtccgaaccgcccggcccgcgatgattaccgtctcgctgcgccgcacgggatgcggcggcgaggcgcacggtcaggggttttggtcgctgcttcaagaaaccggcgttcccgtcctgccgaacacggcaggctgccaaagcgtgcaggaagcggtaacgacggcgcaaatggcgcgcgaagtgtttgaaaccgattggataaaattggaactcatcggcgacgacgacaccttgcagccggacgtgttccaactcgtcgaagcggcggaaatcctgattaaagacggcttcaaagtgctgccttattgcaccgaagacctgattgcctgccgccgcctgctcgatgcgggctgtcaggcgttgatgccgtgggcggctcccatcggcacgggtttgggggcggttcacgcctatgcgctcaaaatcctgcgcgaacgcctgcccgacacgccgctgattatcgacgcgggcttgggtttgccttcccaagcggcacaagtgatggaatggggttttgacggcgtattgttaaacaccgccgtttcccgcagcggcgaccccgtcaacatggcgcgcgccttcgcactcgccgtcgaatccggacggctggcatttgaagccgggccggtcgaagcgcgaaccaaagcccaagccagcacgccgacagtcggacaaccgttttggcattcggcggaatattga

SEQ ID NO: 470 - protein, 262 aa, Neisseria gonorrhoeae
MLTLYGETFPSRLLLGTAAYPTPEILKQSVRTARPAMITVSLRRTGCGGEAHGQGFWSLLQETGVPVLPNTAGCQSVQEAVTTAQMAREVFETDWIKLELIGDDDTLQPDVFQLVEAAEILIKDGFKVLPYCTEDLIACRRLLDAGCQALMPWAAPIGTGLGAVHAYALKILRERLPDTPLIIDAGLGLPSQAAQVMEWGFDGVLLNTAVSRSGDPVNMARAFALAVESGRLAFEAGPVEARTKAQASTPTVGQPFWHSAEY

SEQ ID NO: 471 - DNA, 789 bp, Neisseria meningitidis
atgctcaccctatacggcgaaactttcccctcgcggctgctgctcggcacggctgcctacccgacccccgaaatcctcaaacaatccatccaaaccgcccagcctgcgatgattaccgtctcgctgcgccgcgcgggaagcggcggcgaggcgcacggtcaggggttttggtcgctgcttcaagaaaccggcgttcccgtcctgccgaacacggcaggctgccaaagcgtgcaggaagcggtaacgacggcgcaaatggcgcgcgaagtgtttgaaaccgattggataaaattggaactcatcggagatgacgacaccttgcagccggatgtgttccagcttgtcgaagcggcggaaatcctgattaaagacggcttcaaagtgctgccttattgcaccgaagacctgattgcctgccgccgcctgctcgacgcgggctgtcaggcgttgatgccgtgggcggccccgatcggcacgggtttgggcgcggttcacgcctacgcgttgaacgtcctgcgcgaacgcctgcccgacacgccgctgattatcgacgcgggcttgggtttgccctcacaggcggcacaagtgatggaatggggctttgacggcgtgcttttgaatactgccgtttcccgcagcggcgatccggtcaatatggcacgcgccttcgcactcgccgtcgaatccggacggctggcatttgaagccggaccggtcgaagcacgcgacaaagcgcaagccagcacgccgacagtcggacaaccgttttggcattcggcggaatattga

SEQ ID NO: 472 - protein, 262 aa, Neisseria meningitidis
MLTLYGETFPSRLLLGTAAYPTPEILKQSIQTAQPAMITVSLRRAGSGGEAHGQGFWSLLQETGVPVLPNTAGCQSVQEAVTTAQMAREVFETDWIKLELIGDDDTLQPDVFQLVEAAEILIKDGFKVLPYCTEDLIACRRLLDAGCQALMPWAAPIGTGLGAVHAYALNVLRERLPDTPLIIDAGLGLPSQAAQVMEWGFDGVLLNTAVSRSGDPVNMARAFALAVESGRLAFEAGPVEARDKAQASTPTVGQPFWHSAEY

SEQ ID NO: 473 - DNA, 789 bp, Neisseria meningitidis
atgctcaccctgtacagcgaaactttcccttcgcggctgctgctcggcacagccgcctacccgacccctgaaatcctcaaacaatccgtccgaaccgcccggcccgcgatgattaccgtctcgctgcgccgcgcgggatgcggcggcgaggcgcacggtcaggggttttggtcgctgcttcaagaaaccggcgttcccgtcctgccgaacacggcaggctgccaaagcgtgcaggaagcggtaacgacggcgcaaatggcgcgcgaagtgtttgaaaccgattggattaaactcgaactcatcggcgacgacgacaccttgcagccggatgtgttccaacttgtcgaagcggcggaaatcctgattaaagacggcttcaaagtgctgccttattgcaccgaagacctgattgcctgccgccgcctgctcgacgcgggctgtcaggcgttgatgccgtgggcggccccgatcggcacgggtttgggcgcggttcacgcctacgcgttgaacgtcctgcgcgaacgcctgcccgacacgccgctgattatcgacgcgggcttgggtttgccctcacaggcggcacaagtgatggaatggggctttgacggcgtgcttttgaatactgccgtttcccgcagcggcgatccggtcaatatggcacgcgccttcgcactcgccgtcgaatccggacggctggcatttgaagccggaccggtcgaagcacgcgacaaagcgcaagccagcacgccgacagtcggacaaccgttttggcattcggcggaatattga

SEQ ID NO: 474 - protein, 262 aa, Neisseria meningitidis
MLTLYSETFPSRLLLGTAAYPTPEILKQSVRTARPAMITVSLRRAGCGGEAHGQGFWSLLQETGVPVLPNTAGCQSVQEAVTTAQMAREVFETDWIKLELIGDDDTLQPDVFQLVEAAEILIKDGFKVLPYCTEDLIACRRLLDAGCQALMPWAAPIGTGLGAVHAYALNVLRERLPDTPLIIDAGLGLPSQAAQVMEWGFDGVLLNTAVSRSGDPVNMARAFALAVESGRLAFEAGPVEARDKAQASTPTVGQPFWHSAEY

SEQ ID NO: 475 - DNA, 873 bp, Neisseria gonorrhoeae
atggaaatatggaatatgttgaacacttggcccgatgccgtcccgatacgcgcggaggcggccgaatccgtggcggcggtcgcggctttgctgctggcgcgcgcccttctgttgaatatccacttcagacggcatccggatttcggcatcgaaagcaagcggcggtttttggttgccagccgcaatataacgctgcttttggtgctgttttcgctggcatttatctggtcggcgcaaattcaaacgctggctttgtcgatgtttgcggtggcggcggcggtcgtcgtggcgacaaaagaactgattatgtgtctgtcgggcagtattttaaggtctgccacccagcaatactcggtcggcgactatatcgaaatcaacggcctgcgcgggcgcgtggtcgacatcaatctgttgaacacgctgatgatgcaggtcggtccgaaccccttggtcggacagcttgcgggaaccaccgtttctttccccaacagcctgttgttgagccaccccgtgcgccgcgacaatattttgggcgactatgtcatccatacggtcgaaatccccgttcccatccatttggattcggatgaagccgtatgccgtctgaaagccgtactcgagcccttgtgcgcgccctacatccccgccattcagcggtatttggaaaacgtgcaggcggaaaaactgtttatcacgcccgccgccaggccgcgcgttacccgcgtaccgtacgacgacaaggcataccgcatcatcgtccgcttcgcctcccccgtttcaaagcggctggaaatccaacaggcggttatggacgaatttttgcgcgtacaataccgcctgttaaatcatcccgccggctccgaaacactttaa

SEQ ID NO: 476 - protein, 290 aa, Neisseria gonorrhoeae
MEIWNMLNTWPDAVPIRAEAAESVAAVAALLLARALLLNIHFRRHPDFGIESKRRFLVASRNITLLLVLFSLAFIWSAQIQTLALSMFAVAAAVVVATKELIMCLSGSILRSATQQYSVGDYIEINGLRGRVVDINLLNTLMMQVGPNPLVGQLAGTTVSFPNSLLLSHPVRRDNILGDYVIHTVEIPVPIHLDSDEAVCRLKAVLEPLCAPYIPAIQRYLENVQAEKLFITPAARPRVTRVPYDDKAYRIIVRFASPVSKRLEIQQAVMDEFLRVQYRLLNHPAGSETL

SEQ ID NO: 477 - DNA, 873 bp, Neisseria meningitidis
atggaaatatggaatatgttggacacttggctcggtgccgtcccgatacgtgcggaggcggtcgaatccgtggcggcggttgcggctttgctgctggcgcgcgcccttctgttgaatatccacttcaaacggcatccggatttcggcatcgaaagcaagcggcggtttttggttgccagccgcaatataacgctgcttttggtgctgttttcgctggcatttatctggtcggcgcaaatccaaacgctggctttgtcgatgtttgcggtggcggcggcggtcgtcgtggcgacgaaggaactgattatgtgtctgtcgggcagtattttaaggtctgccacccagcaatactcggtcggcgactatatcgaaatcaacggcctgcgcgggcgcgtggtcgacatcaacctgttgaacacgctgatgatgcaggtcggtccgaaccccttggtcggacagcttgcgggaaccaccgtttctttccccaacagcctgttgttgagccaccccgtgcgccgcgacaatattttgggcgactatgtcatccatacggtcgaaatccccgttcccatccatttggattcggatgaagccgtatgccgtctgaaagccgtactcgagcccttgtgcgcgccctacatccccgccatccaacggsatttggaaaacgtgcaggcggaaaaactgtttatcacgcccgccgccagaccgcgcgttacccgcgtgccgtacgatgacaaggcataccgcatcatcgtccgcttcgcttcccccgtttcaaagcggctggaaatccaacaggcggttatggacgaatttttgcgcgtacaataccgcctgttaaatcaccccgccggctccgaaacactttaa

SEQ ID NO: 478 - protein, 290 aa, Neisseria meningitidis
  misc_feature (220)..(220): Xaa can be any naturally occurring amino acid
MEIWNMLDTWLGAVPIRAEAVESVAAVAALLLARALLLNIHFKRHPDFGIESKRRFLVASRNITLLLVLFSLAFIWSAQIQTLALSMFAVAAAVVVATKELIMCLSGSILRSATQQYSVGDYIEINGLRGRVVDINLLNTLMMQVGPNPLVGQLAGTTVSFPNSLLLSHPVRRDNILGDYVIHTVEIPVPIHLDSDEAVCRLKAVLEPLCAPYIPAIQRXLENVQAEKLFITPAARPRVTRVPYDDKAYRIIVRFASPVSKRLEIQQAVMDEFLRVQYRLLNHPAGSETL

SEQ ID NO: 479 - DNA, 873 bp, Neisseria meningitidis
atggaaatatggaatatgttggacacttggctcggtgccgtcccgatacgtgcggaggcggtcgaatccgtggcggtggtcgcggctttgctgctggcgcgcgcccttctgttgaatatccacttcaaacggcatccggatttcggcatcgaaagcaagcggcggtttttggttgccagccgcaatataacgctgcttttggtgctgttttcgctggcatttatctggtcggcgcaaatccaaacgctggctttgtcgatgtttgcggtggcggcggcggtcgtcgtggcgacgaaggaactgattatgtgtctgtcgggcagcattttaaggtctgccacccagcaatactcggtcggcgactatatcgaaatcaacggcctgcgcgggcgcgtggtcgacatcaacctgttgaacacgctgatgatgcaggtcggtccgaaccccttggtcggacagcttgcgggaaccaccgtttctttccccaacagcctgttgttgagccaccccgtgcgccgcgacaatattttgggcgactacgtcatccatacggtcgaaatcccggttcccatccatttggattcggatgaagccgtatgccgtctgaaagccgtactcgagcccttgtgcgcgccctacatccccgccatccaacggcatttggaaaacgtgcaggcggaaaaactgtttatcacgcccgccgccaaaccgcgcgttacccgcgtgccgtacgatgacaaggcataccgcatcatcgtccgcttcgcctcccccgtttcaaagcggctggaaatccaacaggcggttatggacgaatttttgcgcgtacaataccgcctgttaaattaccccgccggctccgaaacactttaa

SEQ ID NO: 480 - protein, 290 aa, Neisseria meningitidis
MEIWNMLDTWLGAVPIRAEAVESVAVVAALLLARALLLNIHFKRHPDFGIESKRRFLVASRNITLLLVLFSLAFIWSAQIQTLALSMFAVAAAVVVATKELIMCLSGSILRSATQQYSVGDYIEINGLRGRVVDINLLNTLMMQVGPNPLVGQLAGTTVSFPNSLLLSHPVRRDNILGDYVIHTVEIPVPIHLDSDEAVCRLKAVLEPLCAPYIPAIQRHLENVQAEKLFITPAAKPRVTRVPYDDKAYRIIVRFASPVSKRLEIQQAVMDEFLRVQYRLLNYPAGSETL

SEQ ID NO: 481 - DNA, 2037 bp, Neisseria gonorrhoeae
atgattgacaacgcactgctccacttgggcgaagaaccccgttttaatcaaatccaaaccgaagacatcaaacccgccgtccaaaccgccatcgccgaagcgcgcggacaaatcgccgccgtcaaagcgcaaacgcacaccggctgggcgaacaccgtcgagcgtctgaccggcatcaccgaacgcgtcggcaggatttggggcgtcgtgtcccatctcaactccgtcgtcgacacgcccgaactgcgcgccgtctataacgaactgatgcctgaaatcaccgtcttcttcaccgaaatcggacaagacatcgaactgtacaaccgcttcaaaaccatcaaaaattcccccgaatttgcaacgctttcccccgcacaaaaaaccaagctcgatcacgacctgcgcgatttcgtattgagcggcgcggaactgccgcccgaacggcaggcagaactggcaaaactgcaaaccgaaggcgcgcaactttccgccaaattctcccaaaacgtcctagacgcgaccgacgcgttcggcatttactttgacgatgccgcaccgcttgccggcattcccgaagacgcgctcgccatgtttgccgccgccgcgcaaagcgaaggcaaaacaggttacaaaatcggcttgcagattccgcactaccttgccgttatccaatacgccggcaaccgcgaactgcgcgaacaaatctaccgcgcctacgttacccgtgccagcgaactttcaaacgacggcaaattcgacaacaccgccaacatcgaccgcacgctcgaaaacgcattgaaaaccgccaaactgctcggctttaaaaattacgccgaattgtcgctggcaaccaaaatggcggacacgcccgaacaggttttaaacttcctgcacgacctcgcccgccgcgccaaaccctacgccgaaaaagacctcgccgaagtcaaagccttcgcccgcgaacacctcggtctcgccgacccgcagccgtgggacttgagctacgccggcgaaaaactgcgcgaagccaaatacgcattcagcgaaaccgaagtcaaaaaatacttccccgtcggcaaagttctggcaggcctgttcgcccaaatcaaaaaactctacggcatcggattcgccgaaaaaaccgttcccgtctggcacaaagacgtgcgctattttgaattgcaacaaaacggcaaaaccatcggcggcgtttatatggatttgtacgcacgcgaaggcaaacgcggcggcgcgtggatgaacgactacaaaggccgccgccgctttgccgacggcacgctgcaactgcccaccgcctacctcgtctgcaacttcgccccgcccgtcggcggcaaagaagcgcgtttaagccacgacgaaatcctcaccctcttccacgaaaccggccacggactgcaccacctgcttacccaagtggacgaactgggcgtgtccggcatcaacggcgtagaatgggacgcggtcgaactgcccagccagtttatggaaaacttcgtttgggaatacaatgtattggcacaaatgtccgcccacgaagaaaccggcgagcccctgccgaaagaactcttcgacaaaatgctcgccgccaaaaacttccagcgcggtatgttcctcgtccggcaaatggagttcgccctcttcgatatgatgatttacagtgaaagcgacgaatgccgtctgaaaaactggcagcaggttttagacagcgtgcgcaaagaagtcgccgtcatccaaccgcccgaatacaaccgcttcgccaacagcttcggccacatcttcgccggcggctattccgcaggctattacagctacgcatgggccgaagtcctcagcaccgatgcctacgccgcctttgaagaaagcgacgacgtcgccgccacaggcaaacgcttctggcaagaaatccttgccgtcggcggctcccgcagcgcggcggaatccttcaaagccttccgcggacgcgaaccgagcatagacgcactgctgcgccaaagcggtttcgacaacgcggcttga

SEQ ID NO: 482 - protein, 678 aa, Neisseria gonorrhoeae
MIDNALLHLGEEPRFNQIQTEDIKPAVQTAIAEARGQIAAVKAQTHTGWANTVERLTGITERVGRIWGVVSHLNSVVDTPELRAVYNELMPEITVFFTEIGQDIELYNRFKTIKNSPEFATLSPAQKTKLDHDLRDFVLSGAELPPERQAELAKLQTEGAQLSAKFSQNVLDATDAFGIYFDDAAPLAGIPEDALAMFAAAAQSEGKTGYKIGLQIPHYLAVIQYAGNRELREQIYRAYVTRASELSNDGKFDNTANIDRTLENALKTAKLLGFKNYAELSLATKMADTPEQVLNFLHDLARRAKPYAEKDLAEVKAFAREHLGLADPQPWDLSYAGEKLREAKYAFSETEVKKYFPVGKVLAGLFAQIKKLYGIGFAEKTVPVWHKDVRYFELQQNGKTIGGVYMDLYAREGKRGGAWMNDYKGRRRFADGTLQLPTAYLVCNFAPPVGGKEARLSHDEILTLFHETGHGLHHLLTQVDELGVSGINGVEWDAVELPSQFMENFVWEYNVLAQMSAHEETGEPLPKELFDKMLAAKNFQRGMFLVRQMEFALFDMMIYSESDECRLKNWQQVLDSVRKEVAVIQPPEYNRFANSFGHIFAGGYSAGYYSYAWAEVLSTDAYAAFEESDDVAATGKRFWQEILAVGGSRSAAESFKAFRGREPSIDALLRQSGFDNAA

SEQ ID NO: 483 - DNA, 1431 bp, Neisseria meningitidis
  misc_feature (1216)..(1216): n is a, c, g, or t
  misc_feature (1334)..(1334): n is a, c, g, or t
  misc_feature (1347)..(1347): n is a, c, g, or t
atgactgacaacgcactgctccatttgggcgaagaaccccgttttgatcaaatcaaaaccgaagacatcaaacccgccctgcaaaccgccatcgccgaagcgcgcgaacaaatcgccgccatcaaagcccaaacgcacaccggctgggcaaacactgtcgaacccctgaccggcatcaccgaacgcgtcggcaggatttggggcgtggtgtcgcacctcaactgcgtcgccgacacgcccgaactgcgcgccgtctataacgaactgatgcccgaaatcaccgtcttcttcaccgaaatcggacaagacatcgagctgtacaaccgcttcaaaaccatcaaaaattcccccgaattcgacaccctctcccccgcacaaaaaaccaaactcaaccactacgccagcgaaaaactgcgcgaagccaaatacgcgttcagcgaaaccgawgtcaaaaaatayttcccygtcggcaawgtattaaacggactgttcgcccaamtcaaaaaactmtacggcatcggatttaccgaaaaaacygtccccgtctggcacaaagacgtgcgctattktgaattgcaacaaaacggcgaamccataggcggcgtttatatggatttgtacgcacgcgaaggcaaacgcggcggcgcgtggatgaacgactacaaaggccgccgccgtttttcagacggcacgctgcaaytgcccaccgcctacctcgtctgcaacttcgccccacccgtcggcggcagggaagcccgcytgagccacgacgaaatcctcatcctcttccacgaaaccggacacgggctgcaccacctgcttacccaagtggacgaactgggcgtatccggcatcaacggcgtakaatgggacgcggtcgaactgcccagccagtttatggaaaatttcgtttgggaatacaatgtcttggcacaamtgtcagcccacgaagaaaccggcgttcccytgccgaaagaactcttsgacaaawtgctcgccgccaaaaacttccaasgcggcatgttcytsgtccggcaawtggagttcgccctctttgatatgatgatttacagcgaagacgacgaaggccgtctgaaaaactggcaacaggttttagacagcgtgcgcaaaaaagtcgccgtcatccagccgcccgaatacaaccgcttcgccttgagcttcggccacatcttcgcaggcggctattccgcagctnattacagctacgcgtgggcggaagtattgagcgcggacgcatacgccgcctttgaagaaagcgacgatgtcgccgccacaggcaaacgcttttggcaggaaatcctcgccgtcggggnatcgcgcagcggngcagaatccttcaaagccttccgcggccgcgaaccgagcatagacgcactcttgcgccacagcggtttcgacaacgcggtctga

SEQ ID NO: 484 - protein, 476 aa, Neisseria meningitidis
  misc_feature (149)..(149): Xaa can be any naturally occurring amino acid
  misc_feature (158)..(158): Xaa can be any naturally occurring amino acid
  misc_feature (167)..(167): Xaa can be any naturally occurring amino acid
  misc_feature (190)..(190): Xaa can be any naturally occurring amino acid
  misc_feature (198)..(198): Xaa can be any naturally occurring amino acid
  misc_feature (289)..(289): Xaa can be any naturally occurring amino acid
  misc_feature (313)..(313): Xaa can be any naturally occurring amino acid
  misc_feature (328)..(328): Xaa can be any naturally occurring amino acid
  misc_feature (331)..(331): Xaa can be any naturally occurring amino acid
  misc_feature (339)..(339): Xaa can be any naturally occurring amino acid
  misc_feature (343)..(343): Xaa can be any naturally occurring amino acid
  misc_feature (347)..(347): Xaa can be any naturally occurring amino acid
  misc_feature (406)..(406): Xaa can be any naturally occurring amino acid
  misc_feature (445)..(445): Xaa can be any naturally occurring amino acid
MTDNALLHLGEEPRFDQIKTEDIKPALQTAIAEAREQIAAIKAQTHTGWANTVEPLTGITERVGRIWGVVSHLNCVADTPELRAVYNELMPEITVFFTEIGQDIELYNRFKTIKNSPEFDTLSPAQKTKLNHYASEKLREAKYAFSETXVKKYFPVGXVLNGLFAQXKKLYGIGFTEKTVPVWHKDVRYXELQQNGEXIGGVYMDLYAREGKRGGAWMNDYKGRRRFSDGTLQLPTAYLVCNFAPPVGGREARLSHDEILILFHETGHGLHHLLTQVDELGVSGINGVXWDAVELPSQFMENFVWEYNVLAQXSAHEETGVPLPKELXDKXLAAKNFQXGMFXVRQXEFALFDMMIYSEDDEGRLKNWQQVLDSVRKKVAVIQPPEYNRFALSFGHIFAGGYSAAXYSYAWAEVLSADAYAAFEESDDVAATGKRFWQEILAVGXSRSGAESFKAFRGREPSIDALLRHSGFDNAV

SEQ ID NO: 485 - DNA, 2037 bp, Neisseria meningitidis
atgactgacaacgcactgctccatttgggcgaagaaccccgttttgatcaaatcaaaaccgaagacatcaaacccgccctgcaaaccgccattgccgaagcgcgcgaacaaatcgccgccatcaaagcccaaacgcacaccggctgggcaaacactgtcgaacccctgaccggcatcaccgaacgcgtcggcaggatttggggcgtggtgtcgcacctcaactccgtcaccgacacgcccgaactgcgcgccgcctacaatgaattaatgcccgaaattaccgtcttcttcaccgaaatcggacaagacatcgagctgtacaaccgcttcaaaaccatcaaaaactcccccgagttcgacaccctctcccacgcgcaaaaaaccaaactcaaccacgatctgcgcgatttcgtcctcagcggcgcggaactgccgcccgaacagcaggcagaattggcaaaactgcaaaccgaaggcgcgcaactttccgccaaattctcccaaaacgtcctagacgcgaccgacgcgttcggcatttactttgacgatgccgcaccgcttgccggcattcccgaagacgcgctcgccatgtttgccgctgccgcgcaaagcgaaggcaaaacaggctacaaaatcggtttgcagattccgcactacctcgccgtcatccaatacgccgacaaccgcaaactgcgcgaacaaatctaccgcgcctacgttacccgcgccagcgagctttcagacgacggcaaattcgacaacaccgccaacatcgaccgcacgctcgaaaacgccctgcaaaccgccaaactgctcggcttcaaaaactacgccgaattgtcgctggcaaccaaaatggcggacacccccgaacaagttttaaacttcctgcacgacctcgcccgccgcgccaaaccctacgccgaaaaagacctcgccgaagtcaaagccttcgcccgcgaaagcctcggcctcgccgatttgcaaccgtgggacttgggctacgccggcgaaaaactgcgcgaagccaaatacgcattcagcgaaaccgaagtcaaaaaatacttccccgtcggcaaagtattaaacggactgttcgcccaaatcaaaaaactctacggcatcggatttaccgaaaaaaccgtccccgtctggcacaaagacgtgcgctattttgaattgcaacaaaacggcgaaaccataggcggcgtttatatggatttgtacgcacgcgaaggcaaacgcggcggcgcgtggatgaacgactacaaaggccgccgccgtttttcagacggcacgctgcaactgcccaccgcctacctcgtctgcaacttcaccccgcccgtcggcggcaaagaagcccgcttgagccatgacgaaatcctcaccctcttccacgaaaccggacacggcctgcaccacctgcttacccaagtcgacgaactgggcgtatccggcatcaacggcgtagaatgggacgcagtcgaactgcccagtcagtttatggaaaatttcgtttgggaatacaatgtcttggcgcaaatgtccgcccacgaagaaaccggcgttcccctgccgaaagaactcttcgacaaaatgctcgccgccaaaaacttccaacgcggaatgttcctcgtccgccaaatggagttcgccctctttgatatgatgatttacagcgaagacgacgaaggccgtctgaaaaactggcaacaggttttagacagcgtgcgcaaagaagtcgccgtcgtccgaccgcccgaatacaaccgcttcgccaacagcttcggccacatcttcgcaggcggctattccgcaggctattacagctacgcgtgggcggaagtattgagcgcggacgcatacgccgcctttgaagaaagcgacgatgtcgccgccacaggcaaacgcttttggcaggaaatcctcgccgtcggcggatcgcgcagcgcggcagaatccttcaaagccttccgcggacgcgaaccgagcatagacgcactcttgcgccacagcggcttcgacaacgcggcttga

SEQ ID NO: 486 - protein, 678 aa, Neisseria meningitidis
MTDNALLHLGEEPRFDQIKTEDIKPALQTAIAEAREQIAAIKAQTHTGWANTVEPLTGITERVGRIWGVVSHLNSVTDTPELRAAYNELMPEITVFFTEIGQDIELYNRFKTIKNSPEFDTLSHAQKTKLNHDLRDFVLSGAELPPEQQAELAKLQTEGAQLSAKFSQNVLDATDAFGIYFDDAAPLAGIPEDALAMFAAAAQSEGKTGYKIGLQIPHYLAVIQYADNRKLREQIYRAYVTRASELSDDGKFDNTANIDRTLENALQTAKLLGFKNYAELSLATKMADTPEQVLNFLHDLARRAKPYAEKDLAEVKAFARESLGLADLQPWDLGYAGEKLREAKYAFSETEVKKYFPVGKVLNGLFAQIKKLYGIGFTEKTVPVWHKDVRYFELQQNGETIGGVYMDLYAREGKRGGAWMNDYKGRRRFSDGTLQLPTAYLVCNFTPPVGGKEARLSHDEILTLFHETGHGLHHLLTQVDELGVSGINGVEWDAVELPSQFMENFVWEYNVLAQMSAHEETGVPLPKELFDKMLAAKNFQRGMFLVRQMEFALFDMMIYSEDDEGRLKNWQQVLDSVRKEVAVVRPPEYNRFANSFGHIFAGGYSAGYYSYAWAEVLSADAYAAFEESDDVAATGKRFWQEILAVGGSRSAAESFKAFRGREPSIDALLRHSGFDNAA

SEQ ID NO: 487 - DNA, 1473 bp, Neisseria gonorrhoeae
atgattgacaacgcactgctccacttgggcgaagaaccccgttttaatcaaatcaaaaccgaagacatcaaacccgccgtccaaaccgccatcgccgaagcgcgcggacaaatcgccgccgtcaaagcgcaaacgcacaccggctgggcgaacaccgtcgagcgtctgaccggcatcaccgaacgcgtcggcaggatttggggcgtcgtgtcccatctcaactccgtcgtcgacacgcccgaactgcgcgccgtctataacgaactgatgcctgaaatcaccgtcttcttcaccgaaatcggacaagacatcgaactgtacaaccgcttcaaaaccatcaaaaattcccccgaatttgcaacgctttcccccgcacaaaaaaccaagctcgatcacgacctgcgcgatttcgtattgagcggcgcggaactgccgcccgaacggcaggcagaactggcaaaactgcaaaccgaaggcgcgcaactttccgccaaattctcccaaaacgtcctagacgcgaccgacgcgttcggcatttactttgacgatgccgcaccgcttgccggcattcccgaagacgcgctcgccatgtttgccgccgccgcgcaaagcgaaggcaaaacaggttacaaaatcggcttgcagattccgcactaccttgccgttatccaatacgccggcaaccgcgaactgcgcgaacaaatctaccgcgcctacgttacccgtgccagcgaactttcaaacgacggcaaattcgacaacaccgccaacatcgaccgcacgctcgaaaacgcattgaaaaccgccaaactgctcggctttaaaaattacgccgaattgtcgctggcaaccaaaatggcggacacgcccgaacaggttttaaacttcctgcacgacctcgcccgccgcgccaaaccctacgccgaaaaagacctcgccgaagtcaaagccttcgcccgcgaacacctcggtctcgccgacccgcagccgtgggacttgagctacgccggcgaaaaactgcgcgaagccaaatacgcattcagcgaaaccgaagtcaaaaaatacttccccgtcggcaaagttctggcaggcctgttcgcccaaatcaaaaaactctacggcatcggattcgccgaaaaaaccgttcccgtctggcacaaagacgtgcgctattttgaattgcaacaaaacggcaaaaccatcggcggcgtttatatggatttgtacgcacgcgaaggcaaacgcggcggcgcgtggatgaacgactacaaaggccgccgccgctttgccgacggcacgctgcaactgcccaccgcctacctcgtctgcaacttcgccccgcccgtcggcggcaaagaagcgcgtttaagccacgacgaaatcctcaccctcttccacgaaaccggccacggactgcaccacctgcttacccaagtggacgaactgggcgtgtccggcatcaacggcgtaaaa

SEQ ID NO: 488 - protein, 491 aa, Neisseria gonorrhoeae
MIDNALLHLGEEPRFNQIKTEDIKPAVQTAIAEARGQIAAVKAQTHTGWANTVERLTGITERVGRIWGVVSHLNSVVDTPELRAVYNELMPEITVFFTEIGQDIELYNRFKTIKNSPEFATLSPAQKTKLDHDLRDFVLSGAELPPERQAELAKLQTEGAQLSAKFSQNVLDATDAFGIYFDDAAPLAGIPEDALAMFAAAAQSEGKTGYKIGLQIPHYLAVIQYAGNRELREQIYRAYVTRASELSNDGKFDNTANIDRTLENALKTAKLLGFKNYAELSLATKMADTPEQVLNFLHDLARRAKPYAEKDLAEVKAFAREHLGLADPQPWDLSYAGEKLREAKYAFSETEVKKYFPVGKVLAGLFAQIKKLYGIGFAEKTVPVWHKDVRYFELQQNGKTIGGVYMDLYAREGKRGGAWMNDYKGRRRFADGTLQLPTAYLVCNFAPPVGGKEARLSHDEILTLFHETGHGLHHLLTQVDELGVSGINGVK

SEQ ID NO: 489 - DNA, 2037 bp, Neisseria meningitidis
atgactgacaacgcactgctccatttgggcgaagaaccccgttttgatcaaatcaaaaccgaagacatcaaacccgccctgcaaaccgccatcgccgaagcgcgcgaacaaatcgccgccatcaaagcccaaacgcacaccggctgggcaaacactgtcgaacccctgaccggcatcaccgaacgcgtcggcaggatttggggcgtggtgtcgcacctcaactccgtcgccgacacgcccgaactgcgcgccgtctataacgaactgatgcccgaaatcaccgtcttcttcaccgaaatcggacaagacatcgagctgtacaaccgcttcaaaaccatcaaaaattcccccgaattcgacaccctctcccccgcacaaaaaaccaaactcaaccacgatctgcgcgatttcgtcctcagcggcgcggaactgccgcccgaacagcaggcagaactggcaaaactgcaaaccgaaggcgcgcaactttccgccaaattctcccaaaacgtcctagacgcgaccgacgcgttcggcatttactttgacgatgccgcaccgcttgccggcattcccgaagacgcgctcgccatgtttgccgccgccgcgcaaagcgaaagcaaaacaggctacaaaatcggcttgcagattccacactacctcgccgtcatccaatacgccgacaaccgcgaactgcgcgaacaaatctaccgcgcctacgttacccgcgccagcgaactttcagacgacggcaaattcgacaacaccgccaacatcgaccgcacgctcgcaaacgccctgcaaaccgccaaactgctcggcttcaaaaactacgccgaattgtcgctggcaaccaaaatggcggacacgcccgaacaagttttaaacttcctgcacgacctcgcccgccgcgccaaaccctacgccgaaaaagacctcgccgaagtcaaagccttcgcccgcgaaagcctgaacctcgccgatttgcaaccgtgggacttgggctacgccagcgaaaaactgcgcgaagccaaatacgcgttcagcgaaaccgaagtcaaaaaatacttccccgtcggcaaagtattaaacggactgttcgcccaaatcaaaaaactctacggcatcggatttaccgaaaaaaccgtccccgtctggcacaaagacgtgcgctattttgaattgcaacaaaacggcgaaaccataggcggcgtttatatggatttgtacgcacgcgaaggcaaacgcggcggcgcgtggatgaacgactacaaaggccgccgccgtttttcagacggcacgctgcaactgcccaccgcctacctcgtctgcaacttcgccccacccgtcggcggcagggaagcccgcctgagccacgacgaaatcctcatcctcttccacgaaaccggacacgggctgcaccacctgcttacccaagtggacgaactgggcgtatccggcatcaacggcgtagaatgggacgcggtcgaactgcccagccagtttatggaaaatttcgtttgggaatacaatgtcttggcacaaatgtcagcccacgaagaaaccggcgttcccctgccgaaagaactcttcgacaaaatgctcgccgccaaaaacttccaacgcggcatgttcctcgtccggcaaatggagttcgccctctttgatatgatgatttacagcgaagacgacgaaggccgtctgaaaaactggcaacaggttttagacagcgtgcgcaaaaaagtcgccgtcatccagccgcccgaatacaaccgcttcgccttgagcttcggccacatcttcgcaggcggctattccgcaggctattacagctacgcgtgggcggaagtattgagcgcggacgcatacgccgcctttgaagaaagcgacgatgtcgccgccacaggcaaacgcttttggcaggaaatcctcgccgtcggcggatcgcgcagcgcggcagaatccttcaaagccttccgcggccgcgaaccgagcatagacgcactcttgcgccacagcggtttcgacaacgcggtctga

SEQ ID NO: 490 - protein, 678 aa, Neisseria meningitidis
MTDNALLHLGEEPRFDQIKTEDIKPALQTAIAEAREQIAAIKAQTHTGWANTVEPLTGITERVGRIWGVVSHLNSVADTPELRAVYNELMPEITVFFTEIGQDIELYNRFKTIKNSPEFDTLSPAQKTKLNHDLRDFVLSGAELPPEQQAELAKLQTEGAQLSAKFSQNVLDATDAFGIYFDDAAPLAGIPEDALAMFAAAAQSESKTGYKIGLQIPHYLAVIQYADNRELREQIYRAYVTRASELSDDGKFDNTANIDRTLANALQTAKLLGFKNYAELSLATKMADTPEQVLNFLHDLARRAKPYAEKDLAEVKAFARESLNLADLQPWDLGYASEKLREAKYAFSETEVKKYFPVGKVLNGLFAQIKKLYGIGFTEKTVPVWHKDVRYFELQQNGETIGGVYMDLYAREGKRGGAWMNDYKGRRRFSDGTLQLPTAYLVCNFAPPVGGREARLSHDEILILFHETGHGLHHLLTQVDELGVSGINGVEWDAVELPSQFMENFVWEYNVLAQMSAHEETGVPLPKELFDKMLAAKNFQRGMFLVRQMEFALFDMMIYSEDDEGRLKNWQQVLDSVRKKVAVIQPPEYNRFALSFGHIFAGGYSAGYYSYAWAEVLSADAYAAFEESDDVAATGKRFWQEILAVGGSRSAAESFKAFRGREPSIDALLRHSGFDNAV

SEQ ID NO: 491 - DNA, 2037 bp, Neisseria meningitidis; identical to SEQ ID NO: 485

SEQ ID NO: 492 - protein, 678 aa, Neisseria meningitidis; identical to SEQ ID NO: 486

SEQ ID NO: 493 - DNA, 507 bp, Neisseria gonorrhoeae
atgctttcacctcctcggcgtaaaacggcggcacatcaatcaagccgtctttcatttgcgtgcggaaaaaatgcggcgtgttgccgtgatcaaaatcaatatcgtgcagcatccagcccaaatcgcggtttgcctcgctttccgataacgccgacggcggcagcggttcacccttatccgcgctttcgccatttgccctttcaggctgcgggcataggggcggaacaggcggcggtcgaatcctgtttcatccggacaaacgcgttggcagtcggaaaatccggccggccgtgtcaaataatgcgttactttggccgggtcttgtcctttgtaagcggcggtctttttttgcgcgccatccgcatctgtttgggcgcatggcaaacggcggctgccgtacaatcaaaatgtttggcgatttcatgcagacaggcatccggatgccgcccgacatatcgagccggtttttgcctatccgatttggcggcatttaggccggtaacttga

SEQ ID NO: 494 - protein, 168 aa, Neisseria gonorrhoeae
MLSPPRRKTAAHQSSRLSFACGKNAACCRDQNQYRAASSPNRGLPRFPITPTAAAVHPYPRFRHLPFQAAGIGAEQAAVESCFIRTNALAVGKSGRPCQIMRYFGRVLSFVSGGLFLRAIRICLGAWQTAAAVQSKCLAISCRQASGCRPTYRAGFCLSDLAAFRPVT

SEQ ID NO: 495 - DNA, 333 bp, Neisseria meningitidis
tatctgcgctttcactatttgccctttcaggctgcgggcatagggacggaacaggtagcggtcaaatcctgtttcatccaaataaacacgttggtagtcggaaaattcggccggctgtgtcaaataatgcgttactttggccgggtcttgttctttgtaagtggtggtctttttttgcgcgttatccccatctgtttgagtgcatagcaaatggtggctgccgtacaatcaaaatgtttggcgatttcatgcagataggcatccgggtgttgcccaacatattgagccggtttttgcctatccgatttgacggcatttagaccggtaacttga

SEQ ID NO: 496 - protein, 110 aa, Neisseria meningitidis
  misc_feature (69)..(69): Xaa can be any naturally occurring amino acid
  misc_feature (86)..(86): Xaa can be any naturally occurring amino acid
  misc_feature (95)..(95): Xaa can be any naturally occurring amino acid
YLRFHYLPFQAAGIGTEQVAVKSCFIQINTLVVGKFGRLCQIMRYFGRVLFFVSGGLFLRVIPICLSAXQMVAAVQSKCLAISCRXASGCCPTYXAGFCLSDLTAFRPVT

SEQ ID NO: 497 - DNA, 333 bp, Neisseria meningitidis
tatctgcgctttcactatttgccctttcaggctgcgggcatagggacggaacaggtagcggtcaaatcctgtttcatccaaataaacacgttggtagtcggaaaattcggccagctgtgtcaaataatgcgttactttggccgggtcttgttctttgtaagtggtggtctttttttgcgcgttatccccatctgtttgagtgcatagcaaatggtggctgccgtacaatcaaaatgtttggcgatttcatgcagataggcatcctggtgttgcccaacatattgagccggtttttgcctatccgatttgacggcatttagaccggtaacttga

SEQ ID NO: 498 - protein, 107 aa, Neisseria meningitidis
YLRFHYLPFQAAGIGTEQVAVKSCFIQINTLVVGKFGQLCQIMRYFGRVLFFVSGGLFLRVIPICLSAQMVAAVQSKCLAISCRASWCCPTYAGFCLSDLTAFRPVT

SEQ ID NO: 499 - DNA, 840 bp, Neisseria gonorrhoeae
atgaaacaactccgcgacaacaaagcccaaggctctgcactgtttacccttgtgagcggtatcgttattgttattgcagtcctttatttcctgattaagctggcgggcagtggatcgttcggcgatgtcgatgccactacggaagcggcaacgcagacccgcatccagcctgtcggacaattgacgatgggtgacggcatccccgtcggcgaacgccaaggcgaacagattttcggcaaaatctgtatccaatgccacgcggcggacagcaatgtgccgaacgctccgaaactggaacacaacggcgactgggcgccgcgtatcgcgcaaggcttcgataccttgttccaacacgcgctgaacggctttaacgccatgcctgccaaaggcggtgcggcagacctgaccgatcaggaactcaaacgggcgattacctacatggcgaataaaagcggcggttctttcccgaatcctgatgaggctgcgcctgccgacaatgccgcttcaggaacagcttctgctcctgccgatagtgcagctccggcagaagcgaaggcagaagacaagggtgcggcagcccctgcggtcggcgttgacggtaaaaaagtcttcgaagcaacctgtcaggtgtgccacggcggttcgattcccggtattcccggcataggcaaaaaagacgattgggcaccgcgtatcaaaaaaggcaaagaaaccttgcacaaacatgcccttgaaggctttaacgcgatgccggccaaaggcggcaatgcaggtttgagcgatgacgaagtcaaagcggctgttgactatatggcaaaccaatccggtgcaaaattctaa

SEQ ID NO: 500 - protein, 279 aa, Neisseria gonorrhoeae
MKQLRDNKAQGSALFTLVSGIVIVIAVLYFLIKLAGSGSFGDVDATTEAATQTRIQPVGQLTMGDGIPVGERQGEQIFGKICIQCHAADSNVPNAPKLEHNGDWAPRIAQGFDTLFQHALNGFNAMPAKGGAADLTDQELKRAITYMANKSGGSFPNPDEAAPADNAASGTASAPADSAAPAEAKAEDKGAAAPAVGVDGKKVFEATCQVCHGGSIPGIPGIGKKDDWAPRIKKGKETLHKHALEGFNAMPAKGGNAGLSDDEVKAAVDYMANQSGAKF

SEQ ID NO: 501 - DNA, 619 bp, Neisseria meningitidis
ggcgaacagattttcggcaaaatctgtatccaatgccacgcggcggacagcaatgtgccgaacgctccgaaactggaacacaacggcgattrggcaccgcgtatcggcaaggcttcgataccttgttccaacacgcgctgaacggctttaacgccatgcctgcaaaaggcggtgcggcagacctgaccgatcaggaacttaaacgggcgattacttacatggcgaacaaaagcggcggttctttcccgaatcctgatgaggctgcgcctgccgacaatgccgcttcaggaacagcttctgctcctgccgatagtgcagctccggcagaagcgaaggcagaagacaagggtgcggcacccctgcggtcggcgttgacggtaaaaaagtcttcgaagcaacctgtcaggtgtgccacggcggttcgattcccggtattcccggcataggcaaaaaagacgattgggcaccgcgtatcaaaaaaggcaaagaaaccttgcacaaacacgcccttgaaggctttaacgcgatgcctgccaaargcggcaatgcaggtttgagcgatgacgaagtcaaagcggctgttgactatatggcaaaccaatccggtgcaaaattctaa

SEQ ID NO: 502 - protein, 204 aa, Neisseria meningitidis
  misc_feature (31)..(31): Xaa can be any naturally occurring amino acid
  misc_feature (179)..(179): Xaa can be any naturally occurring amino acid
GEQIFGKICIQCHAADSNVPNAPKLEHNGDXAPRIQGFDTLFQHALNGFNAMPAKGGAADLTDQELKRAITYMANKSGGSFPNPDEAAPADNAASGTASAPADSAAPAEAKAEDKGAAPAVGVDGKKVFEATCQVCHGGSIPGIPGIGKKDDWAPRIKKGKETLHKHALEGFNAMPAKXGNAGLSDDEVKAAVDYMANQSGAKF

SEQ ID NO: 503 - DNA, 840 bp, Neisseria meningitidis
atgaaacaactccgcgacaacaaagcccaaggctctgcactgtttacccttgtgagcggtatcgttattgttattgcagtcctttatttcctgattaagctggcgggcagcggctcgttcggcgatgtcgatgccactacggaagcagcaacgcagacccgtatccagcctgtcggacaattgacgatgggcgacggcatccccgtcggcgaacgccaaggcgaacagattttcggcaaaatctgtatccaatgccacgcggcggacagcaatgtgccgaacgctccgaaactggaacacaacggcgattgggcgccgcgtatcgcgcaaggcttcgataccttgttccaacacgcgctgaacggctttaacgccatgcctgccaaaggcggtgcggtagacctgaccgatcaggaactcaaacgggcgattacttacatggcgaacaaaagcggcggttctttcccgaatcctgatgaggctgcgcctgccgacaatgccgcttcaggaacagcttctgctcctgccgatagtgcagctccggcagaagcgaaggcagaagacaagggtgcggcagcccctgcggtcggcgttgacggtaaaaaagtcttcgaagcaacctgtcaggtgtgccacggcggttcgattcccggtattcccggcataggcaaaaaagacgattgggcaccgcgtatcaaaaaaggcaaagaaaccttgcacaaacacgcccttgaaggctttaacgcgatgcctgccaaaggcggcaatgcaggtttgagcgatgacgaagtcaaagcggctgttgactatatggcaaaccaatccggtgcaaaattctaa

SEQ ID NO: 504 - protein, 279 aa, Neisseria meningitidis
MKQLRDNKAQGSALFTLVSGIVIVIAVLYFLIKLAGSGSFGDVDATTEAATQTRIQPVGQLTMGDGIPVGERQGEQIFGKICIQCHAADSNVPNAPKLEHNGDWAPRIAQGFDTLFQHALNGFNAMPAKGGAVDLTDQELKRAITYMANKSGGSFPNPDEAAPADNAASGTASAPADSAAPAEAKAEDKGAAAPAVGVDGKKVFEATCQVCHGGSIPGIPGIGKKDDWAPRIKKGKETLHKHALEGFNAMPAKGGNAGLSDDEVKAAVDYMANQSGAKF

SEQ ID NO: 505 - DNA, 378 bp, Neisseria gonorrhoeae
atggaagccttcaaaaccctaatttggattattaatattatttccgctttggccgtcatcgtgttagtattgctccaacacggcaaaggcgcggatgccggcgcgaccttcggatcgggaagcggcagcgcgcaaggcgtattcggctctgccggcaacgccaacttcctcagccgctcgaccgccgttgcagcaacatttttctttgcaacctgcatgggctatggtgtatattcacacccacacgacaaaacacggtttggacttcagcaacatacgacagactcagcaagcacccaaacccgtaagcaataccgaaccttctgcccctgttcctcagcagcagaaataacagtttttcaaatgccgacatggtga

SEQ ID NO: 506 - protein, 125 aa, Neisseria gonorrhoeae
MEAFKTLIWIINIISALAVIVLVLLQHGKGADAGATFGSGSGSAQGVFGSAGNANFLSRSTAVAATFFFATCMGYGVYSHPHDKTRFGLQQHTTDSASTQTRKQYRTFCPCSSAAEITVFQMPTW

SEQ ID NO: 507 - DNA, 114 bp, Neisseria meningitidis
atggaacccttcaaaaccttaatttggattgttaatttaatttccgctttggccgtcttcgtgttagtattgctccaacacggcaaaggcgcggatgccggcgcgactttcgga

SEQ ID NO: 508 - protein, 38 aa, Neisseria meningitidis
MEPFKTLIWIVNLISALAVFVLVLLQHGKGADAGATFG

SEQ ID NO: 509 - DNA, 378 bp, Neisseria meningitidis
atggaagccttcaaaaccctaatttggattgttaatataatttccgctttggccgtcatcgtgttagtattgctccaacacggcaaaggcgcggatgccggcgcgactttcggatcgggaagcggcagcgcgcaaggcgtattcggctctgccggcaacgctaacttcctcagccgctcgaccgccgttgcagcaacatttttctttgcaacctgcatgggctatggtgtatattcacacccacacgacaaaacacggtttggacttcagcaacgtacaacaaactcagcaagcacccaaacccgtaagcaataccgaaccttctgcccctgttcctcagcagcagaaataacagtttttcaaatgccgacatggtga

SEQ ID NO: 510 - protein, 125 aa, Neisseria meningitidis
MEAFKTLIWIVNIISALAVIVLVLLQHGKGADAGATFGSGSGSAQGVFGSAGNANFLSRSTAVAATFFFATCMGYGVYSHPHDKTRFGLQQRTTNSASTQTRKQYRTFCPCSSAAEITVFQMPTW

SEQ ID NO: 511 - DNA, 1596 bp, Neisseria gonorrhoeae
atgtcccaagaaatcctcgaccaagtgcgccgccgccgcacgtttgccatcatctcccaccccgatgcgggtaaaaccacgctgaccgaaaaactgctgctgttttcgggcgcgattcaaagcgcaggcacggtgaaaggtaagaaaaccggcaaattcgccacctccgactggatggacatcgagaagcagcgcggcatttccgtggcatcaagcgtgatgcagttcgactacaaagaccacaccgtcaacctcttggacacgccgggacaccaagacttctccgaagacacctaccgcgttttaaccgcagtggacagcgccttgatggtcatcgacgcggcaaaaggcgtggaagcgcaaaccatcaaactcttgaacgtctgccgcctgcgcgatacgccgattgttaccttcatgaacaaatacgaccgcgaagtgcgcgattctttggaactcttggacgaagtggaagacatcctgcaaatccgctgcgcgcccgttacctggccgatcggtatgggcaaaaacttcaagggcgtgtaccacatcctgaacgacgaaatctatctctttgaagcgggcggcgaacgcctgccgcacgagttcgacatcatcaaaggcataaacaatcccgaattggaacaacgctttccgttggaaatccagcagttgcgcgacgaaatcgaattggtgcaggcggcttccaacgaatttaatctcgacgaatttctcgccggcgaactcacgccagtgttcttcggctctgcgattaacaacttcggcattcaggaaatcctcaattcattgattgactgggcacccgcaccgaaaccgcgcgacgcgaccatgcgcatggtcgggccggacgagccgaaattttccggatttatctttaaaatccaagccaatatggacccgaaacaccgcgaccgtatcgccttcttgcgcgtctgctccggtaaattcgagcgcggcatgaagatgaaacacctgcgtatcaaccgcgaaatcgccgcctccagcgtagtaaccttcatgtcgcacgaccgcgaactggcggaagaagcctacgccggcgacatcatcggcatcccgaaccacggcaacatccaaatcggcgacagcttctccgaaggcgaacaactggcgtttaccggcatcccattcttcgcgcccgaactgttccgcagcgtccgcatcaaaaacccgctgaaaatcaaacaactgcaaaaaggtttgcaacaactcggcgaagaaggtgcggttcaagtattcaaaccgatgagcggcgcggatttgattttgggtgcggtcggcgtgttgcagtttgaagtcgtaacctcacgcctcgccaacgaatacggcgtggaagccgtgttcgacagcgcatccatctggtcggcgcgctgggtatcgtgcgacgacaagaaaaaactggcggaatttgaaaaagccaacgcaggcaacctcgccatcgacgcaggcggcaacctcgcctacctcgcccccaaccgcgtgaatttggggttgacgcaagaacgctggccggacatcgtgttccacgaaacgcgcgaacattcggtcaaactctaa

SEQ ID NO: 512 - protein, 531 aa, Neisseria gonorrhoeae
MSQEILDQVRRRRTFAIISHPDAGKTTLTEKLLLFSGAIQSAGTVKGKKTGKFATSDWMDIEKQRGISVASSVMQFDYKDHTVNLLDTPGHQDFSEDTYRVLTAVDSALMVIDAAKGVEAQTIKLLNVCRLRDTPIVTFMNKYDREVRDSLELLDEVEDILQIRCAPVTWPIGMGKNFKGVYHILNDEIYLFEAGGERLPHEFDIIKGINNPELEQRFPLEIQQLRDEIELVQAASNEFNLDEFLAGELTPVFFGSAINNFGIQEILNSLIDWAPAPKPRDATMRMVGPDEPKFSGFIFKIQANMDPKHRDRIAFLRVCSGKFERGMKMKHLRINREIAASSVVTFMSHDRELAEEAYAGDIIGIPNHGNIQIGDSFSEGEQLAFTGIPFFAPELFRSVRIKNPLKIKQLQKGLQQLGEEGAVQVFKPMSGADLILGAVGVLQFEVVTSRLANEYGVEAVFDSASIWSARWVSCDDKKKLAEFEKANAGNLAIDAGGNLAYLAPNRVNLGLTQERWPDIVFHETREHSVKL

SEQ ID NO: 513 - DNA, 1596 bp, Neisseria meningitidis
atgtcccaagaaatcctcgaccaagtgcgccgccgccgcacgtttgccatcatctcccaccctgacgcaggtaaaaccacgttgactgaaaaactcttgctgttttcgggcgcgattcagagcgcgggtacggtaaaaggcaagaaaaccggcaaattcgccacttccgactggatggaaatcgagaagcagcgcggcatttccgtggcatcaagtgtgatgcagttcgattacaaagaccacaccgtcaacctcttggacacgccgggacaccaagacttctccgaagacacctaccgcgttttaaccgccgtggacagcgcattaatggtcatcgacgcggcaaaaggcgtggaagcgcaaaccatcaagctcttaaacgtctgccgcctgcgcgatacaccgattgttacgtttatgaacaaatacgaccgcgaagtgcgcgattccctggaacttttggacgaagtggaaaacattttaaaaatccgctgcgcgcccgttacctggccgatcggtatgggcaaaaacttcaagggcgtgtaccacatcctgaacgatgaaatttatctctttgaagctggcggcgaacgcctgccgcacgagttcgacatcatcaaaggcatcgataatcctgaattggaacaacgctttccgttggaaatccagcagttgcgcgacgaaatcgaattggtgcaggcggcttccaacgagtttaatctcgacgaattcctcgccggcgaactcacgcccgtattcttcggctctgcgattaacaacttcggtattcaggaaatcctcaattcattgattgactgggcgcccgcgccgaaaccgcgcgacgcgaccgtacgtatggtcgagccggacgagccgaagttttccggatttatcttcaaaatccaagccaatatggacccgaaacaccgcgaccgtattgccttcttgcgcgtctgctccggcaaattcgagcgcggcatgaagatgaaacacctgcgtatcaaccgcgaaatcgccgcctccagcgtggttaccttcatgtcgcacgaccgcgagctggttgaagaagcctacgccggcgacattatcggcatcccgaaccacggcaacatccaaatcggcgacagcttctccgaaggcgaacaactggcgttcaccggcatcccattcttcgcacccgaactgttccgcagcgtacgcatcaaaaacccgctgaaaatcaaacaactgcaaaaaggcttgcaacagctcggcgaagaaggcgcggtgcaggtgttcaaaccgatgagcggcgcggatttgattttgggcgcggtcggcgtgttgcagtttgaagtcgttacctcgcgcctcgccaacgaatacggcgtagaagccgtgttcgacagcgcatccatctggtcggcgcgctgggtatcgtgcgacgacaagaaaaaactggctgaatttgaaaaagccaacgcgggcaacctcgccatcgacgcaggcggcaacctcgcctacctcgcccccaaccgcgtgaatttgggactcacgcaagaacgttggccggacatcgtgttccacgaaacacgcgaacattcggtcaaactgtaa

SEQ ID NO: 514 - protein, 531 aa, Neisseria meningitidis
MSQEILDQVRRRRTFAIISHPDAGKTTLTEKLLLFSGAIQSAGTVKGKKTGKFATSDWMEIEKQRGISVASSVMQFDYKDHTVNLLDTPGHQDFSEDTYRVLTAVDSALMVIDAAKGVEAQTIKLLNVCRLRDTPIVTFMNKYDREVRDSLELLDEVENILKIRCAPVTWPIGMGKNFKGVYHILNDEIYLFEAGGERLPHEFDIIKGIDNPELEQRFPLEIQQLRDEIELVQAASNEFNLDEFLAGELTPVFFGSAINNFGIQEILNSLIDWAPAPKPRDATVRMVEPDEPKFSGFIFKIQANMDPKHRDRIAFLRVCSGKFERGMKMKHLRINREIAASSVVTFMSHDRELVEEAYAGDIIGIPNHGNIQIGDSFSEGEQLAFTGIPFFAPELFRSVRIKNPLKIKQLQKGLQQLGEEGAVQVFKPMSGADLILGAVGVLQFEVVTSRLANEYGVEAVFDSASIWSARWVSCDDKKKLAEFEKANAGNLAIDAGGNLAYLAPNRVNLGLTQERWPDIVFHETREHSVKL

SEQ ID NO: 515 - DNA, 1596 bp, Neisseria meningitidis
atgtcccaagaaatcctcgaccaagtgcgccgccgccgcacgtttgccatcatctcccaccctgacgcaggtaaaaccacgttgactgaaaaactcttgctgttttcaggtgcgattcaaagcgcgggtacggtaaaaggcaagaaaaccggcaaattcgccacctccgactggatggacatcgagaagcagcgcggcatttccgtggcatcaagcgtgatgcagttcgactataaagaccacaccgtcaaccttttggacacgccgggacaccaagacttctccgaagacacctaccgcgttttgaccgccgtcgatagtgccttgatggtcatcgacgcggcaaaaggcgtggaagcgcaaaccatcaaactcttgaacgtctgccgcctgcgcaatacgccgattgttacgttcatgaacaaatacgaccgcgaagtgcgcgattccctggaattgctggacgaagtggaaaacatcctgcaaatccgctgcgcgcccgtaacctggccgatcggcatgggcaaaaacttcaaaggcgtgtaccacatcctgaacgacgaaatctatctctttgaagcgggcggcgaacgcttgccgcacgagttcgacatcatcaaaggcatcgataatcccgaattggaacaacgctttccgttagaaatacagcagttgcgcgacgaaatcgaattggtgcaggcggcttccaacgagttcaatctcgacgaattcctcgccggcgaactcacgcccgtattcttcggctctgcgattaacaacttcggtattcaggaaatcctcaattcattgattgaatgggcgcccgcgccgaaaccacgcgatgcgaccgtgcgtatggtcgagccggacgagccgaagttttccggatttatcttcaaaatccaagccaatatggacccgaaacaccgcgaccgtattgccttcttgcgcgtctgctccggcaaattcgagcgcggcatgaaaatgaaacacctgcgtatcaaccgcgaaatcgccgcctccagcgtggtaaccttcatgtcccacgaccgcgagctggttgaagaagcctacgccggcgacattatcggtatcccaaaccacggcaacatccaaatcggcgacagcttctccgaaggcgaacaactgacgtttaccggcatcccattcttcgcgcccgaactgttccgcagcgttcgcatcaaaaacccgctgaaaatcaagcaactgcaaaaaggtttgcaacagcttggcgaagaaggtgcggtgcaggtgttcaaaccaatgagcggcgcggatttgattttgggcgcggtcggcgtgttgcagtttgaagtcgttacctcgcgccttgccaacgaatacggcgtggaagccgtgttcgacaacgcatccatctggtcggcgcgctgggtatcgtgcgacgacaagaaaaaactggcggaatttgaaaaagccaacgcgggcaacctcgccatcgacgcgggcggcaacctcgcctacctcgcccctaaccgcgtgaatctgggactcacgcaagaacgctggccggacatcgtgttccacgaaacgcgcgagcattcggtcaaactttaa

SEQ ID NO: 516 - protein, 531 aa, Neisseria meningitidis
MSQEILDQVRRRRTFAIISHPDAGKTTLTEKLLLFSGAIQSAGTVKGKKTGKFATSDWMDIEKQRGISVASSVMQFDYKDHTVNLLDTPGHQDFSEDTYRVLTAVDSALMVIDAAKGVEAQTIKLLNVCRLRNTPIVTFMNKYDREVRDSLELLDEVENILQIRCAPVTWPIGMGKNFKGVYHILNDEIYLFEAGGERLPHEFDIIKGIDNPELEQRFPLEIQQLRDEIELVQAASNEFNLDEFLAGELTPVFFGSAINNFGIQEILNSLIEWAPAPKPRDATVRMVEPDEPKFSGFIFKIQANMDPKHRDRIAFLRVCSGKFERGMKMKHLRINREIAASSVVTFMSHDRELVEEAYAGDIIGIPNHGNIQIGDSFSEGEQLTFTGIPFFAPELFRSVRIKNPLKIKQLQKGLQQLGEEGAVQVFKPMSGADLILGAVGVLQFEVVTSRLANEYGVEAVFDNASIWSARWVSCDDKKKLAEFEKANAGNLAIDAGGNLAYLAPNRVNLGLTQERWPDIVFHETREHSVKL

SEQ ID NO: 517 - DNA, 888 bp, Neisseria gonorrhoeae
atgaaatacaaaagaatcgtatttaaagtcggcacatcttcgattacccgttcggacggcagcctctcgcgcggcaaaatccaaaccatcacccgccagcttgccgcattgcatcatgcgggacacgagctggtcttggtgtcttccggcgcggttgctgcagggttcggcgcgctgggtttcaaaaaacgtccggtcaaaatcgccgacaaacaggcttccgccgccgtcgggcaggggctgctgatggaagaatatacggcaaacctgtcttcagacggcatcgtgtccgcacaaatcctgctcagccgtgccgactttgccgacaaacgccgctaccaaaatgccggcggcgcactttccgtgctgctgcaacgccgcgcgattcccatcatcaatgaaaacgacacggtttcggttgaggagttgaaaatcggcgacaacgacacattgagtgcgcaagtggcggcgatgatacaggcagacctcttggtgctgctgaccgacatagacggtctttacaccggcaacccgaacagcaatcccgatgccgtacggctggacaaaatcgaacacatcaaccatgaaatcatcgaaatggcgggcggctcgggttcggcaaacggcacgggcggtatgctgaccaaaatcaaagcggcaaccatcgccgccgaatccggcgtaccggtgtatatctgttcctcactcaaacccgattcattggccgaagccgccgaacatcaggcggacggctcgtttttcgtcccccgtgccaaaggtttgcggacacagaagcaatggctggcgttctattccgaaagcgggggcagcgtttatgtggacgaaagtgcggaacacgctttgtccgaacaagggaaagcctgctga

SEQ ID NO: 518 - protein, 295 aa, Neisseria gonorrhoeae
MKYKRIVFKVGTSSITRSDGSLSRGKIQTITRQLAALHHAGHELVLVSSGAVAAGFGALGFKKRPVKIADKQASAAVGQGLLMEEYTANLSSDGIVSAQILLSRADFADKRRYQNAGGALSVLLQRRAIPIINENDTVSVEELKIGDNDTLSAQVAAMIQADLLVLLTDIDGLYTGNPNSNPDAVRLDKIEHINHEIIEMAGGSGSANGTGGMLTKIKAATIAAESGVPVYICSSLKPDSLAEAAEHQADGSFFVPRAKGLRTQKQWLAFYSESGGSVYVDESAEHALSEQGKAC

SEQ ID NO: 519 - DNA, 1110 bp, Neisseria meningitidis
atgaaatacaaaagaatcgtatttaaagtcggcacatcttcgattacccattcggacggcagtctctcgcgcggcaaaatccaaaccatcacctgccagcttgccgcattgcatcatgcgggacacgagctggtcttggtgtcttccggcgcggttgcggcagggttcggtgcgctgggtttcaaaaaacgtccggtcaaaatcgccgacaaacaggcttccgccgccgtcgggcaggggctgctgatggaagaatatacggcaaacctgtcttcagacggcatcgtgtccgcgcaaatcctgctcagccgcgccgactttgccgacaaacgccgctaccaaaatgccggcggcgcactttccgtgctgctgcaacgccgcgccgtccccatcatcaatgaaaacgatacggtttcggttgaggaattgaaaatcggcgacaacgacacattgagtgcgcaagtggcggcgatgatacaggcagacctcttggtgctgctgaccgacatagacggtctttacacgggcaacccgaacagcaatcccgatgccgtacggctggacaaaatcgaacacatcaaccatgaaatcatcgaaatggcgggcggctcgggttcggcaaacggcacgggcggtatgctgaccaaaatcaaagcggcaaccatcgccgccgaatccggcgtaccggtgtatatctgttcctcgctcaaacccgatgcacttgccgaagctgccgaacatcaggcggacggctcgtttttcgtcccccgtgccaaaggtttgcggacgcagaagcaatggctggcgttctattccgaaagccggggcagcgtttatgtggacgaaggtgcggaacacgctttgtccgaacaggggaaaagcctgctgatgtcgggcattgccggaatcgaagggcatttttcccgtatggacaccgtaaccgtgtacagcaaggcaaccaaacagcccctgggcaaagggcgcgtcctgttcggctctgccgccgccgaagacctgctcaaatcgcgtaaggcgaaaggcgtgttcatccatcgggacgactggatttccatcacgcccgaaatacgcctgcttctgaccgaattttag

SEQ ID NO: 520 - protein, 369 aa, Neisseria meningitidis
MKYKRIVFKVGTSSITHSDGSLSRGKIQTITCQLAALHHAGHELVLVSSGAVAAGFGALGFKKRPVKIADKQASAAVGQGLLMEEYTANLSSDGIVSAQILLSRADFADKRRYQNAGGALSVLLQRRAVPIINENDTVSVEELKIGDNDTLSAQVAAMIQADLLVLLTDIDGLYTGNPNSNPDAVRLDKIEHINHEIIEMAGGSGSANGTGGMLTKIKAATIAAESGVPVYICSSLKPDALAEAAEHQADGSFFVPRAKGLRTQKQWLAFYSESRGSVYVDEGAEHALSEQGKSLLMSGIAGIEGHFSRMDTVTVYSKATKQPLGKGRVLFGSAAAEDLLKSRKAKGVFIHRDDWISITPEIRLLLTEF

SEQ ID NO: 521 - DNA, 1110 bp, Neisseria meningitidis
atgaaatacaaaagaatcgtatttaaagtcggcacatcttcgattacccattcggacggcagtctctcgcgcggcaaaatccaaaccatcacccgccagcttgccgcattgcatcatgcgggacacgagctggtcttggtgtcttccggcgcggttgcggcagggttcggtgcgctgggtttcaaaaaacgtccggtcaaaatcgccgacaaacaggcttccgccgccgtcgggcaggggctgctgatggaagaatatacggcaaacctgtcttcagacggcatcgtgtccgcacaaatcctgctcagccgcgccgactttgccgacaaacgccgctaccaaaatgccggcggcgcactttccgtgctgctgcaacgccgcgccgtccccatcatcaatgaaaacgatacggtttcggttgaggaattgaaaatcggcgacaacgacacattgagtgcgcaagtggcggcgatgatacaggcagacctcttggtgctgctgaccgacatagacggtctttacaccggcaacccgaacagcaatcccgatgccgtacggctggacaaaatcgaacacatcaaccatgaaatcatcgaaatggcgggcggctcgggttcggcaaacggcacaggcggtatgctgactaaaatcaaagcggcgacgattgcgaccgagtccggcgtaccggtctatatctgttcctcgctcaaacccgatgcacttgccgaagcggcagataatcaggcggacggctcgtttttcgtcccccgtgccaaaggtttgcggacgcagaagcaatggctggcgttctattccgaaagcaggggcggcgtttatgtggacgaaggtgcggaacacgctttgtccgaacagggaaaaagcctgctgatgtcgggcattgccggaatcgaagggcatttttcccgtatggacaccgtaaccgtgtacagcaaggcaaccaaacagcctttgggcaaagggcgagtcctgttcggctctgccgccgccgaagacctgctcaaattgcgtaaggcgaaaggcgtgttcatccatcgggacgactggatttccatcacgcccgaaatacgcctgcttctgaccgaattttag

SEQ ID NO: 522 - protein, 369 aa, Neisseria meningitidis
MKYKRIVFKVGTSSITHSDGSLSRGKIQTITRQLAALHHAGHELVLVSSGAVAAGFGALGFKKRPVKIADKQASAAVGQGLLMEEYTANLSSDGIVSAQILLSRADFADKRRYQNAGGALSVLLQRRAVPIINENDTVSVEELKIGDNDTLSAQVAAMIQADLLVLLTDIDGLYTGNPNSNPDAVRLDKIEHINHEIIEMAGGSGSANGTGGMLTKIKAATIATESGVPVYICSSLKPDALAEAADNQADGSFFVPRAKGLRTQKQWLAFYSESRGGVYVDEGAEHALSEQGKSLLMSGIAGIEGHFSRMDTVTVYSKATKQPLGKGRVLFGSAAAEDLLKLRKAKGVFIHRDDWISITPEIRLLLTEF

SEQ ID NO: 523 - DNA, 672 bp, Neisseria gonorrhoeae
atggaaatccggtttcagacagcatttttacgtttggttcagatgaaaacaaacgcttcaattcttaccgcaacacgccttgtatttcctgccgctgccgcacggacagggatcgttcctgccggttttttccccttccctgcggacggtttgcggtttgttgatgaccgcctgccagtagcggtagatgtctgccagcgcgtaaggcagttcggacgcaagttccgccagctcgccttcggtgaattgcaggcggataacgccgttttcctcttcgtcgtaaatgccgcccactgccatcacggggtaaaacagctcttcaaacgcttcatcatcggcggcttcaaaccaatcggtcggcacaatgtccaaaccgtaaagataggcgttgcaccaagtgtaaaaatcgctgccgccctcgccgtcgtcgtagagccacaaatcgggcagctttttatccgacatcgcggcggttgtttccatcgccattgccaaaaccagccgttcgatttcggaacgttcggcggcggtaaattgcgattcgtcgcccaacacttcgggcagccagtcgagcggtgccaatttgtccggcccgctcaacagcgccgtcataaaaccttgaacctcgtcgcaacgcatcgtgttgccttgttcgcttttggcatccaataa

SEQ ID NO: 524 - protein, 223 aa, Neisseria gonorrhoeae
MEIRFQTAFLRLVQMKTNASILTATRLVFPAAAARTGIVPAGFFPFPADGLRFVDDRLPVAVDVCQRVRQFGRKFRQLAFGELQADNAVFLFVVNAAHCHHGVKQLFKRFIIGGFKPIGRHNVQTVKIGVAPSVKIAAALAVVVEPQIGQLFIRHRGGCFHRHCQNQPFDFGTFGGGKLRFVAQHFGQPVERCQFVRPAQQRRHKTLNLVATHRVALFAFGIQ

SEQ ID NO: 525 - DNA, 732 bp, Neisseria meningitidis
atggaaacaaacgcttcaattcttaccgcaacacgccttgtattttctgccgctgccgcacggacagggatcgttcctgcctgttttttcgccttccctgcggacggtttgcggtttgttgatgactgcctgccagtagcggtagatatccgccaatgcataaggcaactcggattccagttccgccagctcgccttctgtgaattgcagacggatagcgccgttttcctcttcgtcgtaaataccgcccaatgccatgatgggataaaacaactcttcaaacgcttcatcatcgacggcttcaaaccaatcggtcggcacaatatccaaaccgtaaagataagcattgcaccatgtgtaaaaatcgctgccgccgtcttcgttttcatacagccacaaatcgggcagttttttatccgacatcgcggcggttgtttccatcgccattgccaaaaccagccgttcgatttcggaacgttcggcggcggtaaattgcgattcgtcgcccaacacttcgggcagccagtcgagcggtgtcaatttgtccggcccgctcaacagcgccgtcataaaaccttgaacctcgtcgcaacgcatcgtgttgccttgttcgcttttggcatccaacaattcgctcaaccgccgtttggatgcttcggtaaattttcgggaatccatcattttccttttcaaatgggttttgcgccctattatcgccgcaatgccgtctga

SEQ ID NO: 526 - protein, 243 aa, Neisseria meningitidis
METNASILTATRLVFSAAAARTGIVPACFFAFPADGLRFVDDCLPVAVDIRQCIRQLGFQFRQLAFCELQTDSAVFLFVVNTAQCHDGIKQLFKRFIIDGFKPIGRHNIQTVKISIAPCVKIAAAVFVFIQPQIGQFFIRHRGGCFHRHCQNQPFDFGTFGGGKLRFVAQHFGQPVERCQFVRPAQQRRHKTLNLVATHRVALFAFGIQQFAQPPFGCFGKFSGIHHFPFQMGFAPYYRRNAV

SEQ ID NO: 527 - DNA, 837 bp, Neisseria meningitidis
atggaaacaaacgcttcaattcttaccgcaacacgccttgtattttctgccgctgccgcacggacagggatcgttcctgcctgttttttcgccttccctgcggacggtttgcggcttgttgatgaccgcctgccagtagcggtagatatccgccaatgcataaggcaactcggattccagttccgccagctcgccttctgtgaattgcagacggatagtgccgttgtcctcttcgtcgtaaataccgcccaatgccatgatgggataaaacaactcttcaaacgcttcatcatcgacggcttcaaaccaatcggtcggcacaatatccaaaccgtaaagataagcattgcaccatgtgtaaaaatcgctgccgccgtcttcgttttcatacagccacaaatcgggcagttttttatccgacatcgcggcggttgtttccatcgccattgccaaaaccagccgttcgatttcggaacgttcggcggcggtaaattgcgattcgtcgcccaacacttcgggcagccagtcgagcggtgtcaatttgtccggcccgctcaacagcgccgtcataaaaccttgaacctcgtcgcaacgcatcgtgttgccttgttcgcttttggcatccaacaattcgctcaaccgccgtttggatgcttcggtaaattttcgggaatccatcattttccttttccaatgggttttgcgccctattatagtggattaaatttaaatcaggacaaggcgacgaagccgcagacagtacaaatagtacggcaaggcgaggcaacgccgtactggtttaaatttaatccactatatcgccgcaatgccgtctga

SEQ ID NO: 528 - protein, 278 aa, Neisseria meningitidis
METNASILTATRLVFSAAAARTGIVPACFFAFPADGLRLVDDRLPVAVDIRQCIRQLGFQFRQLAFCELQTDSAVVLFVVNTAQCHDGIKQLFKRFIIDGFKPIGRHNIQTVKISIAPCVKIAAAVFVFIQPQIGQFFIRHRGGCFHRHCQNQPFDFGTFGGGKLRFVAQHFGQPVERCQFVRPAQQRRHKTLNLVATHRVALFAFGIQQFAQPPFGCFGKFSGIHHFPFPMGFAPYYSGLNLNQDKATKPQTVQIVRQGEATPYWFKFNPLYRRNAV

SEQ ID NO: 529 - DNA, 852 bp, Neisseria gonorrhoeae
atgattatccatcaccaattcgatcccgtcctcatcagtatcggcccgcttgccgtccgctggtatgccttaagctacatcctcggatttattctttttacctttctcggcagaaggcgcatcgcgcaaggcttgtccgtttttaccaaagaatcgctcgacgacttcctgacatggggcattttgggcgtgattttgggcggacgcttgggctatgtcctgttttacaaattctccgactacctcgcccatccgcttgatattttcaaggtatgggaaggcggaatgtcgttccacggcggctttttgggtgtagttattgccatatggttgttcagccgcaagcacggcatcggcttcctcaaactgatggacacggtcgcgccgctcgttccgctgggtctcgcttcgggacgtatcggcaactttatcaacggcgaactttggggacgcattaccgacattaacgcattttgggcaatgggcttcccgcaagcgcattacgaagatgccgaagccgccgcgcacaatccgctttgggcagaatggctgcaacaatacggtatgctgccgcgtcatccctcgcagctttatcagtttgcccttgaaggcatctgcctgttcgccgtcgtttggctgttttccaaaaaaccgcgcccgaccgggcagactgccgcgctttttctcggcggctacggcgtgttccgctttattgccgaatttgcgcgccaacccgacgactatctcgggctgctgaccttggggctgtcgatggggcaatggttgagcgtcccgatgattgttttgggtatcgtcggctttgtccggttcggcatgaaaaaacagcactga

SEQ ID NO: 530 - protein, 283 aa, Neisseria gonorrhoeae
MIIHHQFDPVLISIGPLAVRWYALSYILGFILFTFLGRRRIAQGLSVFTKESLDDFLTWGILGVILGGRLGYVLFYKFSDYLAHPLDIFKVWEGGMSFHGGFLGVVIAIWLFSRKHGIGFLKLMDTVAPLVPLGLASGRIGNFINGELWGRITDINAFWAMGFPQAHYEDAEAAAHNPLWAEWLQQYGMLPRHPSQLYQFALEGICLFAVVWLFSKKPRPTGQTAALFLGGYGVFRFIAEFARQPDDYLGLLTLGLSMGQWLSVPMIVLGIVGFVRFGMKKQH

SEQ ID NO: 531 - DNA, 852 bp, Neisseria meningitidis
atgattacccatccccaattcgatcccgtccttatcagtatcggcccgcttgccgtccgctggtatgccctaagctacatcctcggatttattctttttacctttctcggcagaaggcgcatcgcgcaaggcttgtccgtttttaccaaagaatcgctcgacgacttcctgacatggggcattttgggcgtaattttgggcgggcgtttgggttacgtcctgttttacaagttttccgactacctcgcccatccgcttgatattttcaaggtatgggaaggcggaatgtcgttccacggcggctttttgggtgtagttattgccatacggttgttcggccgcaaacacggcatcggcttcctcaaactgatggatacggtcgcaccgctcgttccgctgggtctcgcttcgggacgtatcggcaacttcatcaacggcgaactttggggacgcgttaccgacatcaacgcattttgggcaatgggcttcccgcaggcgcgttacgaagatgccgaagccgccgcgcacaatccgctttgggcagaatggctgcaacaatacggtatgctgccgcgtcatccctcgcagctttatcagtttgcacttgaaggcatctgcctgttcaccgtcatttggctgttctctaaaaaacagcggtcgaccggacaagtcgcctcgctcttcctcggcggctacggcatattccgcttcattgccgaattcgcacgccaacccgacgactatctcgggctgctgaccttggggctgtcgatggggcaatggttgagcgtcccgatgattgttttgggtatcgtcggctttgtccggttcggcatgaaaaaacagcactga

SEQ ID NO: 532 - protein, 283 aa, Neisseria meningitidis
MITHPQFDPVLISIGPLAVRWYALSYILGFILFTFLGRRRIAQGLSVFTKESLDDFLTWGILGVILGGRLGYVLFYKFSDYLAHPLDIFKVWEGGMSFHGGFLGVVIAIRLFGRKHGIGFLKLMDTVAPLVPLGLASGRIGNFINGELWGRVTDINAFWAMGFPQARYEDAEAAAHNPLWAEWLQQYGMLPRHPSQLYQFALEGICLFTVIWLFSKKQRSTGQVASLFLGGYGIFRFIAEFARQPDDYLGLLTLGLSMGQWLSVPMIVLGIVGFVRFGMKKQH

SEQ ID NO: 533 - DNA, 852 bp, Neisseria meningitidis
atgattacccatccccaattcgaccccgtccttatcagtatcggcccgcttgccgtccgctggtatgccctaagctacatcctcggatttattctttttacctttctcggcagaaggcgcatcgcgcaaggcttgtccgtttttaccaaagaatcgctcgacgacttcctgacatggggcattttgggcgtaattttgggcgggcgtttgggttacgtcctgttttacaagttttccgactacctcgcccatccgcttgatattttcaaggtatgggaaggcggaatgtcgttccacggcggctttttgggtgtagttattgccatatggttgttcggtcgcaaacacggcatcggcttcctcaaactgatggacacggtcgcaccgctcgttccactgggtctcgcttcgggacgtatcggcaacttcatcaacggcgaactttggggacgcgttaccgacatcaacgcattttgggcaatgggcttcccgcaggcgcgttacgaagacctcgaagccgccgcgcacaatccgctttgggcagaatggctgcaacaatacggtatgctgccgcgtcatccctcgcagctttatcagtttgcacttgaaggcatctgcctgttcgccgtcgtttggctgttctctaaaaaacagcggccgaccggacaagtcgcctcactcttcctcggcggctacggcatattccgcttcattgccgaatttgcacgccaacccgacgactatctcgggctgctgaccttggggctgtcgatggggcaatggttgagcgtcccgatgattgttttgggtatcgtcggctttgtccggttcggcatgaaaaaacagcactga

SEQ ID NO: 534 - protein, 283 aa, Neisseria meningitidis
MITHPQFDPVLISIGPLAVRWYALSYILGFILFTFLGRRRIAQGLSVFTKESLDDFLTWGILGVILGGRLGYVLFYKFSDYLAHPLDIFKVWEGGMSFHGGFLGVVIAIWLFGRKHGIGFLKLMDTVAPLVPLGLASGRIGNFINGELWGRVTDINAFWAMGFPQARYEDLEAAAHNPLWAEWLQQYGMLPRHPSQLYQFALEGICLFAVVWLFSKKQRPTGQVASLFLGGYGIFRFIAEFARQPDDYLGLLTLGLSMGQWLSVPMIVLGIVGFVRFGMKKQH

SEQ ID NO: 535 - DNA, 897 bp, Neisseria gonorrhoeae
atggagtttgaaaacattatttccgccgccgacaaggcgcgtatccttgccgaagcactgccttacatccgccggttttccggttcggtcgccgtcatcaagtatggcggcaacgcgatgaccgaacctgccttgaaagaagggtttgcccgcgatgtcgtgctgctgaagctggtcggcattcatcccgtcatcgttcacggcggcgggccgcagatcaatgcgatgcttgaaaaagtcggcaaaaagggcgaatttgtccaaggaatgcgcgttaccgacaaagagacgatggatattgtcgaaatggtattgggcgggcacgtcaacaaggaaatcgtgtcgatgattaacacatatggagggcacgcggtcggcgtgagcgggcgcgacgaccatttcattaaggcgaagaaacttttggtcgatacgcccgaacagaatagcgtggacatcggacaggtcggtacggtggaaagcatcgataccggtttggttaaagggctgatagaacgcggctgcattcccgtcgtcgcccccgtcggcgtaggtgaaaaaggcgaagcgttcaacatcaacgccgatttggtggcaggcaaattggcggaagaattgaacgccgaaaaactcttgatgatgacgaatatcgccggtgtgatggacaaaacgggcaatctgctgaccaaactcacgccgaaacggattgatgggctgattgccgacggcacgctgtatggcggtatgctgccgaaaatcgcttctgcggtcgaagccgccgtcaacggtgtgaaagccacgcacatcatcgacggcaggttgcccaacgcgcttttgctggaaatctttaccgatgccggtatcgggtcgatgattttaggcagaggggaagatgcctga

SEQ ID NO: 536 - protein, 298 aa, Neisseria gonorrhoeae
MEFENIISAADKARILAEALPYIRRFSGSVAVIKYGGNAMTEPALKEGFARDVVLLKLVGIHPVIVHGGGPQINAMLEKVGKKGEFVQGMRVTDKETMDIVEMVLGGHVNKEIVSMINTYGGHAVGVSGRDDHFIKAKKLLVDTPEQNSVDIGQVGTVESIDTGLVKGLIERGCIPVVAPVGVGEKGEAFNINADLVAGKLAEELNAEKLLMMTNIAGVMDKTGNLLTKLTPKRIDGLIADGTLYGGMLPKIASAVEAAVNGVKATHIIDGRLPNALLLEIFTDAGIGSMILGRGEDA

SEQ ID NO: 537 - DNA, 897 bp, Neisseria meningitidis
atggagtctgaaaacattatttccgccgccgacaaggcgcgtatccttgccgaagcgctgccttacatccgccggttttccggttcggtcgccgtcatcaaatacggcggcaacgcgatgaccgaacctgccttgaaagaagggtttgcccgcgatgtcgtgctgctgaagctggtcggcattcatcccgtcatcgttcacggcggcgggccgcagatcaatgcgatgcttgaaaaagtcggcaaaaagggtgagtttgtccaaggaatgcgcgttaccgacaaagaggcgatggatattgtcgaaatggtgttgggcgggcatgtcaataaagaaatcgtgtcgatgattaacacatatggcggacacgcggtcggcgtaagcggacgcgacgaccatttcattaaggcgaagaaacttttgatcgatacgcccgaacagaatggcgtggacatcggacaggtcggtacggtggaaagcatcgataccggtttggttaaagggctgatagaacgtggctgcattcccgtcgtcgcccccgtcggcgtaggtgaaaaaggcgaagcgttcaacatcaacgccgatttggtagcaggcaaattggcggaagaattgaacgccgaaaaactcttgatgatgacgaatatcgccggtgtgatggacaaaacgggcaatctgctgaccaaactcacgccgaaacggattgatgaactgattgccgacggcacgctgtatggcggtatgctgccgaaaatcgcttctgcggtcgaagccgccgtcaacggtgtgaaagccacgcatatcatcgacggcaggttgcccaacgcgcttttgctggaaatctttaccgatgccggtatcggttcgatgattttgggcggtggggaagatgcctga

SEQ ID NO: 538 - protein, 298 aa, Neisseria meningitidis
MESENIISAADKARILAEALPYIRRFSGSVAVIKYGGNAMTEPALKEGFARDVVLLKLVGIHPVIVHGGGPQINAMLEKVGKKGEFVQGMRVTDKEAMDIVEMVLGGHVNKEIVSMINTYGGHAVGVSGRDDHFIKAKKLLIDTPEQNGVDIGQVGTVESIDTGLVKGLIERGCIPVVAPVGVGEKGEAFNINADLVAGKLAEELNAEKLLMMTNIAGVMDKTGNLLTKLTPKRIDELIADGTLYGGMLPKIASAVEAAVNGVKATHIIDGRLPNALLLEIFTDAGIGSMILGGGEDA

SEQ ID NO: 539 - DNA, 897 bp, Neisseria meningitidis
atggagtctgaaaacattatttccgccgccgacaaggcgcgtatccttgccgaagcgctgccttacatccgccggttttccggttcggtcgccgtcatcaaatacggcggcaacgcgatgaccgaacctgccttgaaagaagggtttgcccgcgatgtcgtgctgctgaagctggtcggcattcatcccgtcatcgttcacggcggcgggccgcagatcaatgcgatgcttgaaaaagtcggcaaaaagggtgagtttgtccaaggaatgcgcgttaccgacaaagaggcgatggatattgtcgaaatggtgttgggcgggcatgtcaataaagaaatcgtgtcgatgattaacacatatggcggacacgcggtcggcgtaagcggacgcgacgaccatttcattaaggcgaagaaacttttgatcgatacgcccgaacagaatggcgtggacatcggacaggtcggtacggtggaaagcatcgataccggtttggttaaagggctgatagaacgtggctgcattcccgtcgtcgcccccgtcggcgtaggtgaaaaaggcgaagcgttcaacatcaacgccgatttggtagcaggcaaattggcggaagaattgaacgccgaaaaactcttgatgatgacgaatatcgccggtgtgatggacaaaacgggcaatctgctgaccaaactcacgccgaaacggattgatgaactgattgccgacggcacgctgtatggcggtatgctgccgaaaatcgcttctgcggtcgaagccgccgtcaacggcgtgaaagccacgcatatcatcgacggcagggtgcccaacgcgcttttgctggaaatctttaccgatgccggtatcggttcgatgattttgggcggtggggaagatgcctga

SEQ ID NO: 540 - protein, 298 aa, Neisseria meningitidis
MESENIISAADKARILAEALPYIRRFSGSVAVIKYGGNAMTEPALKEGFARDVVLLKLVGIHPVIVHGGGPQINAMLEKVGKKGEFVQGMRVTDKEAMDIVEMVLGGHVNKEIVSMINTYGGHAVGVSGRDDHFIKAKKLLIDTPEQNGVDIGQVGTVESIDTGLVKGLIERGCIPVVAPVGVGEKGEAFNINADLVAGKLAEELNAEKLLMMTNIAGVMDKTGNLLTKLTPKRIDELIADGTLYGGMLPKIASAVEAAVNGVKATHIIDGRVPNALLLEIFTDAGIGSMILGGGEDA

SEQ ID NO: 541 - DNA, 537 bp, Neisseria gonorrhoeae
atgcgaaccacctcaaccttccctacaaaaactttcaaaccggctgccatggcgttagctgttgcaacaacactttctgcctgcttaggcggcggcggaggcggcacttctgctcccgactttaatgcaggcggcaccggtatcggcagcaacagcagggcaacgatagcggaatcagcagcagtatcttacgccggtataaaaaacgaaatgtgcaaagacagaagcatgctctgtgccggtcgggatgacgttgcggttacagacagggatgccaaaatcaaagccccccgaatctgcataccggagacttttcaaacccaaatgaccaatattaagaatatgatcaacctcaaacctgcaattgaagcaggctatacaggacgcggggtagaggtaggtatcgtcgatacaggcgaatccgtcggcagcatatcctttcccgaactgtatggcagaaaagaacacggctataacgaaaattacaaaaacaaattacaaaaactatacggcgtatatgcggaaggaagcgcctga

SEQ ID NO: 542 - protein, 178 aa, Neisseria gonorrhoeae
MRTTSTFPTKTFKPAAMALAVATTLSACLGGGGGGTSAPDFNAGGTGIGSNSRATIAESAAVSYAGIKNEMCKDRSMLCAGRDDVAVTDRDAKIKAPRICIPETFQTQMTNIKNMINLKPAIEAGYTGRGVEVGIVDTGESVGSISFPELYGRKEHGYNENYKNKLQKLYGVYAEGSA

SEQ ID NO: 543 - DNA, 528 bp, Neisseria meningitidis
atgcgaacgaccccaaccttccctacaaaaactttcaaaccgactgccatggcgttagctgttgcaacaacactttctgcctgcttaggcggcggcggaggcggcacttctgcgcccgacttcaatgcaggcggtaccggtatcggcagcaacagcagagcaacaacagcgaaatcagcagcagtatcttacgccggtatcaagaacgaaatgtgcaaagacagaagcatgctctgtgccggtcgggatgacgttgcggttacagacagggatgccaaaatcaatgcccccccccgaatctgcataccggagactttccaaacccaaatgacgcattacaagaatttgatcaacctcaaacctgcaattgaagcaggctatacaggacgcggggtagaggtaggtatcgtcgacacaggcgaatccgtcggcagcatatcctttcccgaactgtatggcagaaaagaacacggctataacgaaaattacgaaaaactatacggcgtatatgcggaaggaagcgcctga

SEQ ID NO: 544 - protein, 175 aa, Neisseria meningitidis
MRTTPTFPTKTFKPTAMALAVATTLSACLGGGGGGTSAPDFNAGGTGIGSNSRATTAKSAAVSYAGIKNEMCKDRSMLCAGRDDVAVTDRDAKINAPPRICIPETFQTQMTHYKNLINLKPAIEAGYTGRGVEVGIVDTGESVGSISFPELYGRKEHGYNENYEKLYGVYAEGSA

SEQ ID NO: 545 - DNA, 526 bp, Neisseria meningitidis
atgcgaacgaccccaaccttccctacaaaaactttcaaaccggctgccatggcgttagctgttgcaacaacactttctgcctgcttaggcggcggcggaggcggcacttctgcgcccgacttcaatgcaggcggcaccggtatcggcagcaacagcagggcaacaacagcgaaatcagcagcaatatcttacgccggtatcaagaacgaaatgtgcaaagacagaagcatgctctgtgccggtcgggatgacgttgcggttacagacagggatgccaaaatcaatgcccccccccgaatctgcataccggagactttacaaacccaaatgacgcatacaagaatttgatcaacctcaaacctgcaattgaagcaggctatacaggacgcggggtagaggtaggtatcgtcgacacaggcgaatccgtcggcagcatatcctttcccgaactgtatggcagaaaagaacacggctataacgaaaattacaaaaactatacggcgtatatgcggaaggaagcgcctga

SEQ ID NO: 546 - protein, 175 aa, Neisseria meningitidis
  misc_feature (113)..(113): Xaa can be any naturally occurring amino acid
  misc_feature (164)..(164): Xaa can be any naturally occurring amino acid
MRTTPTFPTKTFKPAAMALAVATTLSACLGGGGGGTSAPDFNAGGTGIGSNSRATTAKSAAISYAGIKNEMCKDRSMLCAGRDDVAVTDRDAKINAPPRICIPETLQTQMTHXKNLINLKPAIEAGYTGRGVEVGIVDTGESVGSISFPELYGRKEHGYNENYXKLYGVYAEGSA

SEQ ID NO: 547 - DNA, 1365 bp, Neisseria gonorrhoeae
atgtcggcacgcggcaagggggcaggctatctcaacagtaccggacgacatgttcccttcctgagtgccgccaaaatcgggcaggattattctttcttcaaaaatatcaaaaccgacggcggtctgctggcttccctcgacagcgtcgaaaaaacagcgggcagtgaaggcgacacgccgtcctattatgtccgtcgcggcaatgcggcacggactgcttcggcagcggcacattccgcgcccgccggtctgaaacacgccgtagaacagggcggcagcaatctggaaaacctgatggtcgagctggatgcctccgaatcatccgcaacacccgagacggttgaaactgcggtcgccgaccgcacagatatgccgggcatccgcctacggcgcacaactttccgcacagcggcagccgtacagcatgcgaataccgccgacggcgtacgcatcttcaacagtctcgccgctaccgtctatgccgacagtgccgccgcccatgccgatatgcagggacgccgcctgaaagccgtatcggacgggttggaccacaacggtacgggtctgcgcgtcatcgcgcaaacccaacaggacggtggaacgtgggaacagggcggtgtcgaaggcaaaatgcgcggcagtacccaaactatcggcattgccgcgaaaaccggcgaaaatacgacagcagccgccacactgggcataggacgcagcacatggagcgaaaacagtgcaaatgcaaaaaccgacagcattagtctgtttgcaggcatacggcacgatgtgggcgatatcggctatctcaaaggcctgttctcctacggacgctacaaaaacagcatcagccgcagcaccggtgcggatgaatatgcggaaggcagcgtcaacggcacgctgatgcagctgggcgcactgggtggtgtcaacgttccgtttgccgcaacgggagatttgacggttgaaggcggtctgcgccacgacctgctcaaacaggatgcattcgccgaaaaaggcagtgctttgggctggagcggcaacagcctcactgaaggcacactggtcggactcgcgggtctgaaactgtcgcaacccttgagcgataaagccgtcctgtctgcgacggcgggcgtggaacgcgacctgaacggacgcgactacgcggtaacgggcggctttaccggcgcggctgcagcaaccggcaagacgggtgcacgcaatatgccgcacacccgccgggttgccggtctgggggtggatgtcgaattcggcaacggctggaacggcttggcacgttacagctacaccggttccaaacagtacggcaaccacagcggacaaatcggcgtaggctaccggttctga

SEQ ID NO: 548 - protein, 454 aa, Neisseria gonorrhoeae
MSARGKGAGYLNSTGRHVPFLSAAKIGQDYSFFKNIKTDGGLLASLDSVEKTAGSEGDTPSYYVRRGNAARTASAAAHSAPAGLKHAVEQGGSNLENLMVELDASESSATPETVETAVADRTDMPGIRLRRTTFRTAAAVQHANTADGVRIFNSLAATVYADSAAAHADMQGRRLKAVSDGLDHNGTGLRVIAQTQQDGGTWEQGGVEGKMRGSTQTIGIAAKTGENTTAAATLGIGRSTWSENSANAKTDSISLFAGIRHDVGDIGYLKGLFSYGRYKNSISRSTGADEYAEGSVNGTLMQLGALGGVNVPFAATGDLTVEGGLRHDLLKQDAFAEKGSALGWSGNSLTEGTLVGLAGLKLSQPLSDKAVLSATAGVERDLNGRDYAVTGGFTGAAAATGKTGARNMPHTRRVAGLGVDVEFGNGWNGLARYSYTGSKQYGNHSGQIGVGYRF

SEQ ID NO: 549 - DNA, 1365 bp, Neisseria meningitidis
atgtcggcacgcggcaagggggcaggctatctcaacagtaccggacgacgtgttcccttcctgagtgccgccaaaatcgggcaggattattctttcttcacaaacatcgaaaccgacggcggcctgctggcttccctcgacagcgtcgaaaaaacagcgggcagtgaaggcgacacgctgtcctattatgtccgtcgcggcaatgcggcacggactgcttcggcagcggcacattccgcgcccgccggtctgaaacacgccgtagaacagggcggcagcaatctggaaaacctgatggtcgaactggatgcctccgaatcatccgcaacacccgagacggttgaaactgcggcagccgaccgcacagatatgccgggcatccgcccctacggcgcaactttccgcgcagcggcagccgtacagcatgcgaatgccgccgacggtgtacgcatcttcaacagtctcgccgctaccgtctatgccgacagtaccgccgcccatgccgatatgcagggacgccgcctgaaagccgtatcggacgggttggaccacaacggcacgggtctgcgcgtcatcgcgcaaacccaacaggacggtggaacgtgggaacagggcggtgttgaaggcaaaatgcgcggcagtacccaaaccgtcggcattgccgcgaaaaccggcgaaaatacgacagcagccgccacactgggcatgggacgcagcacatggagcgaaaacagtgcaaatgcaaaaaccgacagcattagtctgtttgcaggcatacggcacgatgcgggcgatatcggctatctcaaaggcctgttctcctacggacgctacaaaaacagcatcagccgcagcaccggtgcggacgaacatgcggaaggcagcgtcaacggcacgctgatgcagctgggcgcactgggcggtgtcaacgttccgtttgccgcaacgggagatttgacggtcgaaggcggtctgcgctacgacctgctcaaacaggatgcattcgccgaaaaaggcagtgctttgggctggagcggcaacagcctcactgaaggcacgctggtcggactcgcgggtctgaagctgtcgcaacccttgagcgataaagccgtcctgtttgcaacggcgggcgtggaacgcgacctgaacggacgcgactacacggtaacgggcggctttaccggcgcgactgcagcaaccggcaagacgggggcacgcaatatgccgcacacccgtctggttgccggcctgggcgcggatgtcgaattcggcaacggctggaacggcttggcacgttacagctacgccggttccaaacagtacggcaaccacagcggacgagtcggcgtaggctaccggttctga

SEQ ID NO: 550 - protein, 454 aa, Neisseria meningitidis
MSARGKGAGYLNSTGRRVPFLSAAKIGQDYSFFTNIETDGGLLASLDSVEKTAGSEGDTLSYYVRRGNAARTASAAAHSAPAGLKHAVEQGGSNLENLMVELDASESSATPETVETAAADRTDMPGIRPYGATFRAAAAVQHANAADGVRIFNSLAATVYADSTAAHADMQGRRLKAVSDGLDHNGTGLRVIAQTQQDGGTWEQGGVEGKMRGSTQTVGIAAKTGENTTAAATLGMGRSTWSENSANAKTDSISLFAGIRHDAGDIGYLKGLFSYGRYKNSISRSTGADEHAEGSVNGTLMQLGALGGVNVPFAATGDLTVEGGLRYDLLKQDAFAEKGSALGWSGNSLTEGTLVGLAGLKLSQPLSDKAVLFATAGVERDLNGRDYTVTGGFTGATAATGKTGARNMPHTRLVAGLGADVEFGNGWNGLARYSYAGSKQYGNHSGRVGVGYRF

SEQ ID NO: 551 - DNA, 1365 bp, Neisseria meningitidis
atgtcggcaggcggtaagggggcaggctatctcaaccgtaccggacaacgtgttcccttcctgagtgccgccaaaatcgggcgggattattctttcttcacaaacatcgaaaccgacggcggtctgctggcttccctcgacagcgtcgaaaaaacagcgggtagtgaaggcgacacgctgtcctattatgtccgtcgcggcaatgcggcacggactgcttcggcagcggcacattccgcgcccgccggtctgaaacacgccgtagaacagggcggcagcaatctggaaaacctgatggtcgaactggatgcctccgaatcatccgcaacacccgagacggttgaaactgcggccgccgaccgcacagatatgccgggcatccgcccctacggcgcaactttccgcgcagcggcagccgtacagcatgcgaatgccgccgacggtgtacgcatcttcaacaatctcgccgctaccgtctatgccgacagtaccgccgcccatgccgatatgcagggacgccgcctgaaagccgtatcggacgggttggaccacaacgctacgggtctgcgcgtcatcgcgcaaacccaacaggacggtggaacgtgggaacagggcggtgttgaaggcaaaatgcgcggcagtacccaaaccgtcggcattgccgcgaaaaccggcgaaaatacgacagcagccgccacactgggcatgggacacagcacatggagcgaaaacagtgcaaatgcaaaaaccgacagcattagtctgtttgcaggcatacggcacgatgcgggcgatatcggctatctcaaaggcctgttctcctacggacgctacaaaaacagcatcagccgcagcaccggtgcggacgaacatgcggaaggcagcgtcaacggcacgctgatgcagctgggcgcactgggcggtgtcaacgttccgtttgccgcaacgggagatttgacggtcgaaggcggtctgcgctacgacctgctcaaacaggatgcattcgccgaaaaaggcagtgctttgggctggagcggcaacagcatcactgaaggcacactggtcggactcgcgggtctgaagctgtcgcaacccttgagcgataaagccgtcctgtttgcaacggcgggcgtggaacgcgacctgaacggacgcgactacacggtaacgggcggctttaccggcgcgactgcagcaaccggcaagacgggggcacgcaatatgccgcacacccgcctggttgccggtctgggcgcggatgtcgaattcggcaacggctggaacggcttggcacgttacagctacgccggttccaaacagtacggcaaccacagcggacgagtcggcgtaggctaccggttctga

SEQ ID NO: 552 - protein, 454 aa, Neisseria meningitidis
MSAGGKGAGYLNRTGQRVPFLSAAKIGRDYSFFTNIETDGGLLASLDSVEKTAGSEGDTLSYYVRRGNAARTASAAAHSAPAGLKHAVEQGGSNLENLMVELDASESSATPETVETAAADRTDMPGIRPYGATFRAAAAVQHANAADGVRIFNNLAATVYADSTAAHADMQGRRLKAVSDGLDHNATGLRVIAQTQQDGGTWEQGGVEGKMRGSTQTVGIAAKTGENTTAAATLGMGHSTWSENSANAKTDSISLFAGIRHDAGDIGYLKGLFSYGRYKNSISRSTGADEHAEGSVNGTLMQLGALGGVNVPFAATGDLTVEGGLRYDLLKQDAFAEKGSALGWSGNSITEGTLVGLAGLKLSQPLSDKAVLFATAGVERDLNGRDYTVTGGFTGATAATGKTGARNMPHTRLVAGLGADVEFGNGWNGLARYSYAGSKQYGNHSGRVGVGYRF

SEQ ID NO: 553 - DNA, 1677 bp, Neisseria gonorrhoeae
atgagcttcaaaaccgatgccgaaaccgcccaatcctccaccatgcgcccgattggcgaaattgccgccaagctgggtttgaacgttgacaacattgagccttacggtcattacaaagccaaaatcaatcctgccgaagcgttcaagctgccgcaaaaacaaggcaggctgattttggttaccgccatcaacccgactccggcgggcgaaggcaaaaccaccgtaaccatcggtttggcggacgcattgcgccatatcggcaaagactctgtgattgctttgcgcgagccttctttgggtccggtgttcggcgtgaaaggcggcgcggcaggcggcggctacgcgcaagttttgccgatggaagacatcaacctgcacttcaccggcgacttccacgccatcggtgcggcgaataacctcctcgccgccatgctcgacaaccatatctaccaaggtaacgagttgaacatcgaccccaaacgcgtgctgtggcggcgcgtggtcgatatgaacgaccgccagttgcgcaacatcatcgacggtatgggcaagcctgttgacggcgtgatgcgtcccgacggcttcgacatcaccgtcgcctccgaagtgatggcggtattctgccttgccaaagacatcagcgatttgaaagagcgttttggcaatattctcgtcgcctacgccaaagacggcagccccgtttacgccaaagatttgaaggcacacggcgcgatggcggcattgctaaaagatgcgattaagcccaatttggtgcaaaccatcgaaggcactccggcctttgtacacggcggcccgttcgccaacatcgcccacggctgcaactccgttaccgcaacccgtctggcgaaacaccttgccgattacgccgtaaccgaagcaggcttcggcgcggacttgggtgcggaaaaattctgcgacatcaaatgccgccttgccggtttgaaacctgatgcggcagtcgtcgtggcgactgtccgcgccctgaaatacaacggcggcgtggaacgcgccaaccttggtgaagaaaacctcgaagccttggcaaaaggtttgcccaacctgttgaaacacatttccaacctgaaaaacgtattcggactgcccgtcgtcgttgcgctcaaccgcttcgtgtccgactccgatgccgagttggcgatgattgaaaaagcctgtgccgaacacggcgttgaagtttccctgaccgaagtgtggggcaaaggcggcgcgggcggcgcggatttggcgcgcaaagtcgtcaatgccatcgacaaccaacctaataacttcggtttcgcctacgatgtcgagttgggcatcaaagacaaaatccgtgcgattgcccaaaaagtgtacggcgcggaagatgtcgatttcagcgcggaagcgtctgccgaaatcgcctcgctggaaaaactgggcttggacaaaatgccgatctgcatggcgaaaacccaatattcattgagcgacaacgccaaactcttgggctgccccgaaggcttccgcatcgccgtacgcggtatcactgtttccgccggcgcgggcttcatcgttgcgttgtgcggcaatatgatgaaaatgccgggcctgccgaaagttccggctgccgagaaaatcgatgtggacgaacacggcgtgattcacggcttgttctga

SEQ ID NO: 554 - protein, 558 aa, Neisseria gonorrhoeae
MSFKTDAETAQSSTMRPIGEIAAKLGLNVDNIEPYGHYKAKINPAEAFKLPQKQGRLILVTAINPTPAGEGKTTVTIGLADALRHIGKDSVIALREPSLGPVFGVKGGAAGGGYAQVLPMEDINLHFTGDFHAIGAANNLLAAMLDNHIYQGNELNIDPKRVLWRRVVDMNDRQLRNIIDGMGKPVDGVMRPDGFDITVASEVMAVFCLAKDISDLKERFGNILVAYAKDGSPVYAKDLKAHGAMAALLKDAIKPNLVQTIEGTPAFVHGGPFANIAHGCNSVTATRLAKHLADYAVTEAGFGADLGAEKFCDIKCRLAGLKPDAAVVVATVRALKYNGGVERANLGEENLEALAKGLPNLLKHISNLKNVFGLPVVVALNRFVSDSDAELAMIEKACAEHGVEVSLTEVWGKGGAGGADLARKVVNAIDNQPNNFGFAYDVELGIKDKIRAIAQKVYGAEDVDFSAEASAEIASLEKLGLDKMPICMAKTQYSLSDNAKLLGCPEGFRIAVRGITVSAGAGFIVALCGNMMKMPGLPKVPAAEKIDVDEHGVIHGLF

SEQ ID NO: 555 - DNA, 1677 bp, Neisseria meningitidis
atgagcttcaaaaccgatgccgaaatcgcccaatcctccaccatgcgcccgattggcgaaattgccgccaagcttggtctgaatgccgacaacattgagccttacggtcattacaaggcgaaaatcaatcctgccgaagcgttcaaactgccgcaaaaacagggcaggctgattttggttaccgccatcaacccgactccggcgggcgaaggcaaaaccaccgtaaccatcggtttggcggacgcgttgcgccacatcggcaaagatgccgtgattgccctgcgcgaaccttctctggggccggtgttcggcgtgaaaggcggcgcggcaggcggcggctatgcccaagttttgccgatggaagacatcaacctgcacttcaccggagattttcacgccatcggtgcggcaaataatctgcttgccgcgatgctcgacaaccatatctaccaaggcaacgagttgaacatcgaccccaaacgcgtgctgtggcggcgcgtggtcgatatgaacgaccgccagttgcgcaacatcatcgacggcatgggtaaacccgttgacggcgtgatgcgtcctgacggtttcgatattaccgttgcttccgaagtgatggcggtattctgtcttgccaaagacatcagcgatttgaaagagcgtttgggcaacatccttgtcgcctacgccaaagacggcagccccgtttacgccaaagatttgaaagcgaatggcgcgatggcggcattgcttaaagatgcgattaagcccaacttggtgcaaaccatcgaaggcacgcccgccttcgtacacggcggcccgttcgccaacatcgcccacggctgcaactccgtaaccgcaacccgtctggcgaaacaccttgccgattacgccgtaaccgaagcaggcttcggcgcggacttgggcgcggaaaaattctgcgacatcaaatgccgccttgccggtttgaaacctgatgcggctgttgtcgtggcgactgtccgcgcgttgaaatataacggcggcgtggaacgcgccaacctcggcgaagaaaatttagacgctttggaaaaaggtttgcccaacctgctgaaacacatttccaacctgaaaaacgtattcggactgcccgtcgtcgttgcgctcaaccgcttcgtgtccgacgccgatgccgagttggcgatgattgaaaaagcctgtgccgaacacggcgttgaagtttccctgaccgaagtgtggggcaaaggtggtgcgggcggcgcggatttggcgcgcaaagtcgtcaacgccattgaaagtcaaaccaataacttcggtttcgcctacgatgtcgagttgggcatcaaagacaaaatccgtgcgattgcccaaaaagtgtacggcgcggaagatgttgatttcagcgcggaagcgtctgccgaaatcgcttcactggaaaaactgggcttggacaaaatgccgatctgcatggcgaaaacccaatactctttgagcgacaacgccaaactgttgggctgccccgaagacttccgcatcgccgtgcgcggcatcaccgtttccgcaggcgcaggtttcatcgtcgccctgtgcggcaacatgatgaaaatgcccggcctgcccaaagttccggctgccgagaaaatcgatgtggacgcagaaggcgtgattcacggcttgttctga

SEQ ID NO: 556 - protein, 558 aa, Neisseria meningitidis
MSFKTDAEIAQSSTMRPIGEIAAKLGLNADNIEPYGHYKAKINPAEAFKLPQKQGRLILVTAINPTPAGEGKTTVTIGLADALRHIGKDAVIALREPSLGPVFGVKGGAAGGGYAQVLPMEDINLHFTGDFHAIGAANNLLAAMLDNHIYQGNELNIDPKRVLWRRVVDMNDRQLRNIIDGMGKPVDGVMRPDGFDITVASEVMAVFCLAKDISDLKERLGNILVAYAKDGSPVYAKDLKANGAMAALLKDAIKPNLVQTIEGTPAFVHGGPFANIAHGCNSVTATRLAKHLADYAVTEAGFGADLGAEKFCDIKCRLAGLKPDAAVVVATVRALKYNGGVERANLGEENLDALEKGLPNLLKHISNLKNVFGLPVVVALNRFVSDADAELAMIEKACAEHGVEVSLTEVWGKGGAGGADLARKVVNAIESQTNNFGFAYDVELGIKDKIRAIAQKVYGAEDVDFSAEASAEIASLEKLGLDKMPICMAKTQYSLSDNAKLLGCPEDFRIAVRGITVSAGAGFIVALCGNMMKMPGLPKVPAAEKIDVDAEGVIHGLF

SEQ ID NO: 557 - DNA, 1677 bp, Neisseria meningitidis
atgagtttcaaaaccgatgccgaaatcgcccaatcctccaccatgcgcccgattggcgaaattgccgccaagctgggtttgaacgttgacaacattgagccttacggtcattacaaagccaaaatcaatcctgccgaagcgttcaaactgccgcaaaaacagggcaggctgattttggttaccgccatcaacccgactccggcgggcgaaggtaaaaccaccgtaaccatcggtttggcggacgcattgcgccatatcggcaaagactctgtgattgctttgcgcgagccttctttgggtccggtgttcggcgtgaaaggcggcgcggcaggcggcggctatgcccaagttttgccgatggaagacatcaacctgcacttcaccggagattttcacgccatcggtgcggcaaataatctgcttgccgcgatgctcgacaaccatatctaccaaggcaacgagttgaacatcgaccccaaacgcgtgctgtggcggcgcgtggtcgatatgaacgaccgccagttgcgcaacatcatcgacggcatgggcaagcctgttgacggcgtgatgcgtcctgacggtttcgatattaccgttgcttccgaagtgatggcggtattctgtcttgccaaagacatcagcgatttgaaagagcgtttgggcaacatccttgtcgcctacgccaaagacggcagccccgtttacgccaaagatttgaaagcgaatggcgcgatggcggcattgcttaaagatgcgattaagcccaacttggtgcaaaccatcgaaggcacgcccgccttcgtacacggcggcccgttcgccaacatcgcccacggctgcaactccgtaaccgcaacccgtctggcgaaacaccttgccgattacgccgtaaccgaagcaggcttcggcgcggacttgggcgcggaaaaattctgcgacatcaaatgccgccttgccggtttgaaacctgatgcggctgttgtcgtggcgactgtccgcgcgttgaaatataacggcggcgtggaacgcgccaacctcggcgaagaaaatttagacgctttggaaaaaggtttgcccaacctgctgaaacacatttccaacctgaaaaacgtattcggactgcccgtcgtcgttgcgctcaaccgcttcgtgtccgactccgatgccgagttggcgatgattgaaaaagcctgtgccgaacacggcgttgaagtttccctgaccgaagtgtggggcaaaggtggtgcgggcggcgcggatttggcgcgcaaagtcgtcaacgccattgaaagtcaaaccaataacttcggtttcgcctacgatgtcgagttgggcatcaaagacaaaatccgtgcgattgcccaaaaagtgtacggcgcggaagatgttgatttcagcgcggaagcgtctgccgaaatcgcttcactggaaaaactgggcttggacaaaatgccgatctgcatggcgaaaacccaatactctttgagcgacaacgccaaactgttgggctgccccgaagacttccgcatcgccgtgcgcggcatcaccgtttccgcaggcgcaggtttcatcgtcgccctgtgcggcaacatgatgaaaatgcccggcctgcccaaagttccggctgccgagaaaatcgatgtggacgcagaaggcgtgattcacggcttgttctga

SEQ ID NO: 558 - protein, 558 aa, Neisseria meningitidis
MSFKTDAEIAQSSTMRPIGEIAAKLGLNVDNIEPYGHYKAKINPAEAFKLPQKQGRLILVTAINPTPAGEGKTTVTIGLADALRHIGKDSVIALREPSLGPVFGVKGGAAGGGYAQVLPMEDINLHFTGDFHAIGAANNLLAAMLDNHIYQGNELNIDPKRVLWRRVVDMNDRQLRNIIDGMGKPVDGVMRPDGFDITVASEVMAVFCLAKDISDLKERLGNILVAYAKDGSPVYAKDLKANGAMAALLKDAIKPNLVQTIEGTPAFVHGGPFANIAHGCNSVTATRLAKHLADYAVTEAGFGADLGAEKFCDIKCRLAGLKPDAAVVVATVRALKYNGGVERANLGEENLDALEKGLPNLLKHISNLKNVFGLPVVVALNRFVSDSDAELAMIEKACAEHGVEVSLTEVWGKGGAGGADLARKVVNAIESQTNNFGFAYDVELGIKDKIRAIAQKVYGAEDVDFSAEASAEIASLEKLGLDKMPICMAKTQYSLSDNAKLLGCPEDFRIAVRGITVSAGAGFIVALCGNMMKMPGLPKVPAAEKIDVDAEGVIHGLF

SEQ ID NO: 559 - DNA, 477 bp, Neisseria gonorrhoeae
atgcgtgccgatttcatgtttgccgacaatatgcccgtgcaggtgcgccaacgcgccttctatttcaagttgtcccgttttgccgcgatgccaaatatggtaggcaaaccgctcttcgggcgacaggccggtcagcccggcaaaatgttcggcaacatcctgatgttcgtccgccagcatattgatgcagaggctgccgttttccgacaggatcggaatgattcgcgcactccggtttatgcacagcatcacggtcggcggctcgtcggtaaccggcgcaaccgccgtcattgtaatgccgtaacgccctgccgcaccgtctgtcgtgatgacatgaacgcctgccgcacaggatgccatcgcatcacggaacgaagtttgaaaagttttctgcaaatccgccatttttcccctttaaaccgtcccctatataagaatgctgcacacaaggcatccccccatgtgcagcagttctga

SEQ ID NO: 560 - protein, 158 aa, Neisseria gonorrhoeae
MRADFMFADNMPVQVRQRAFYFKLSRFAAMPNMVGKPLFGRQAGQPGKMFGNILMFVRQHIDAEAAVFRQDRNDSRTPVYAQHHGRRLVGNRRNRRHCNAVTPCRTVCRDDMNACRTGCHRITERSLKSFLQIRHFSPLNRPLYKNAAHKASPHVQQF

SEQ ID NO: 561 - DNA, 477 bp, Neisseria meningitidis
atgcgtgccgatttcatgtttgccgacaatatgcccgtgcaggtgcgccaacgcgccctctatttcaagttgtcccgttttgccgcgatgccagatgtggtaggcaaaccgctcttcgggcgacaggccggtcagcccggcaaaatgttcggcaacatcctgatgttcgtccgccagcgtattgatgcagaggctgccgttttccgacaggatcggaatgattcgcgcactccggttgatgcacagcatcacggtcggcggctcgtcggtaaccggcgcgaccgccgtcattgtaatgccgtaacgccctgccgcaccgtctgtcgtgatgacatgaacgcctgccgcgcaagatgccatcgcatcacggaacgaagtttgaaaatttttctgcaaatccgccatttttcccctttaaactgtcccctatataagaatgctgcacacaaggcatccccccatgtgcagcagttttga

SEQ ID NO: 562 - protein, 158 aa, Neisseria meningitidis
MRADFMFADNMPVQVRQRALYFKLSRFAAMPDVVGKPLFGRQAGQPGKMFGNILMFVRQRIDAEAAVFRQDRNDSRTPVDAQHHGRRLVGNRRDRRHCNAVTPCRTVCRDDMNACRARCHRITERSLKIFLQIRHFSPLNCPLYKNAAHKASPHVQQF

SEQ ID NO: 563 - DNA, 948 bp, Neisseria meningitidis
atgcgtgccgatttcatgtttgccgacaatatgcccgtgcaggtgcgccaacgcgccctctatttcaagttgtcccgttttgccgcgatgccagatgtggtaggcaaaccgctcttcgggcgacaggccggtcagcccggcaaaatgttcggcaacatcctgatgttcgtccgccagcgtattgatgcagaggctgccgttttccgacaggatcggaatgattcgcgcactccggttgatgcacagcatcacggtcggcggctcgtccgtaaccggcgcaaccgccgtcattgtaatgccgtaacgccctgccgcaccgtctgtcgtgatgacatgaacgcctgccgcacaggatgccatcgcatcacggaacgaagtttgaaaagttttctgcaaatccgccatttttcccctttaaactgtcccctatataagaatgctgcacacaaggcaccccccatgtgcagcagttctgattcaaaaagccgtcggtcggacatttccgcgcgttacggcgtattacgagttcaacgcatcctcgattttggcaagttctgccaacaggtctttaagcagcagcattttctcgcggcccagcacttcctcgatagcgtcgtaacgctcgtccacttcttcgccgatttcctcatacagcttctcgccctcggcagtcagcttcagaaaaacacgtcgttggtcgttggaaggtttcaggcggacaaccaaacccgctttttcaaggcgggtcaggataccggtcaggctggggcgcaaaatgcacgcctgattcgccaaatcttgaaagtccagcgtgccgttttccgccaaaagacggataatccgccattgctgatcggtaatattcgcctgattcagaataggcctgaattgggtcatcagggcttcccttgcctgtatcagaccgatattgatagacgcatgttttga

SEQ ID NO: 564 - protein, 315 aa, Neisseria meningitidis
MRADFMFADNMPVQVRQRALYFKLSRFAAMPDVVGKPLFGRQAGQPGKMFGNILMFVRQRIDAEAAVFRQDRNDSRTPVDAQHHGRRLVRNRRNRRHCNAVTPCRTVCRDDMNACRTGCHRITERSLKSFLQIRHFSPLNCPLYKNAAHKAPPMCSSSDSKSRRSDISARYGVLRVQRILDFGKFCQQVFKQQHFLAAQHFLDSVVTLVHFFADFLIQLLALGSQLQKNTSLVVGRFQADNQTRFFKAGQDTGQAGAQNARLIRQILKVQRAVFRQKTDNPPLLIGNIRLIQNRPELGHQGFPCLYQTDIDRRMF

SEQ ID NO: 565 - DNA, 1290 bp, Neisseria gonorrhoeae
atgttgagcttcggctatctcggcgttcagacggcctttaccctgcaaagctcgcagatgagccgcatttttcaaacgctaggcgcagacccgcacaatttgggctggtttttcatcctgccgccgctggcggggatgctggttcagccgatagtgggctactactcagaccgcacttggaagccgcgcttgggcggccgccgcctgccgtatctgctttacggcacgctgattgcggtcatcgtgatgattttgatgccgaactcgggcagcttcggtttcggctatgcgtcgctggcggccttgtcgttcggcgcgctgatgattgcgctgttggacgtgtcgtcgaatatggcgatgcagccgtttaagatgatggtcggcgatatggtcaacgaggagcagaaaagctacgcctacgggattcaaagtttcttagcgaatacggacgcggttgtggcagcgattctgccgtttgtgttcgcgtatatcggtttggcgaacactgccgagaaaggcgttgtgccacaaaccgtggtcgtagcattctatgtgggtgcggcgttactgattattaccagtgcgttcacaatctccaaagtcaaagaatacgacccggaaacctacgcccgttaccacggcatcgatgtcgccgcgaatcaggaaaaagccaactggttcgaactcttaaaaaccgcgcctaaagtgttttggacggttactccggtacagtttttctgctggttcgccttccggtatatgtggacttactcggcaggcgcgattgcagaaaacgtctggcacactaccgatgcgtcttccgtaggccatcaggaggcgggcaaccggtacggcgttttggcggcggtgtagtcggttgcggcggtgatttgttcgtttattctggcaaaagtaccgaataaataccataaggcgggttatttcggctgtttggctttgggcgcgctcggtttcttctctatcttcttcatctacaatcaatacgcactcatcctgtcttatatcttaatcggcatcgcttgggcgggcattatcacttatccgctgacgattgtggccaacgctttgtcgggcaaacacatggatacttatttgggcctgtttaacggctctgtctgtatgccgcaaatcgtcgcttcgctgttgagtttcgtgcttttcccgatgctgggcggccatcaggcaaccatgttcttggttgcaggcgcagtcttgctgctgggagccttctcagtctgtctgattaaagagatccacggcggggtttga

SEQ ID NO: 566 - protein, 428 aa, Neisseria gonorrhoeae
MLSFGYLGVQTAFTLQSSQMSRIFQTLGADPHNLGWFFILPPLAGMLVQPIVGYYSDRTWKPRLGGRRLPYLLYGTLIAVIVMILMPNSGSFGFGYASLAALSFGALMIALLDVSSNMAMQPFKMMVGDMVNEEQKSYAYGIQSFLANTDAVVAAILPFVFAYIGLANTAEKGVVPQTVVVAFYVGAALLIITSAFTISKVKEYDPETYARYHGIDVAANQEKANWFELLKTAPKVFWTVTPVQFFCWFAFRYMWTYSAGAIAENVWHTTDASSVGHQEAGNRYGVLAAVSVAAVICSFILAKVPNKYHKAGYFGCLALGALGFFSIFFIYNQYALILSYILIGIAWAGIITYPLTIVANALSGKHMDTYLGLFNGSVCMPQIVASLLSFVLFPMLGGHQATMFLVAGAVLLLGAFSVCLIKEIHGGV

SEQ ID NO: 567 - DNA, 1290 bp, Neisseria meningitidis
atgctcagtttcggctttctcggcgttcagacggcctttaccctgcaaagctcgcaaatgagccgcatttttcaaacgctaggcgcagacccgcacaatttgggctggtttttcatcctgccgccgctggcggggatgctggtgcagccgattgtcggccattactccgaccgcacttggaagccgcgtttgggcggccgccgtctgccgtatctgctttatggcacgctgattgcggttattgtgatgattttgatgccgaactcgggcagcttcggtttcggctatgcgtcgctggcggctttgtcgttcggcgcgctgatgattgcgctgttagacgtgtcgtcaaatatggcgatgcagccgtttaagatgatggtcggcgacatggtcaacgaggagcagaaaggctacgcctacgggattcaaagtttcttagcaaatacgggcgcggtcgtggcggcgattctgccgtttgtgtttgcgtatatcggtttggcgaacaccgccgagaaaggcgttgtgccgcagaccgtggtcgtggcgttttatgtgggtgcggcgttgctggtgattaccagcgcgttcacgattttcaaagtgaaggaatacgatccggaaacctacgcccgttaccacggcatcgatgtcgccgcgaatcaggaaaaagccaactggatcgaactcttgaaaaccgcgcctaaggcgttttggacggttactttggtgcaattcttctgctggttcgccttccaatatatgtggacttactcggcaggcgcgattgcggaaaacgtctggcacaccaccgatgcgtcttccgtaggttatcaggaggcgggtaactggtacggcgttttggcggcggtgcagtcggttgcggcggtgatttgttcgtttgtattggcgaaagtgccgaataaataccataaggcgggttatttcggctgtttggctttgggcgcgctcggctttttctccgttttcttcatcggcaaccaatacgcgctggtgttgtcttataccttaatcggcatcgcttgggcgggcattatcacttatccgctgacgattgtgaccaacgccttgtcgggcaagcatatgggcacttacttgggcttgtttaacggctctatctgtatgcctcaaatcgtcgcttcgctgttgagtttcgtgcttttccctatgctgggcggcttgcaggccactatgttcttggtagggggcgtcgtcctgctgctgggcgcgttttccgtgttcctgattaaagaaacacacggcggggtttga

SEQ ID NO: 568 - protein, 429 aa, Neisseria meningitidis
MLSFGFLGVQTAFTLQSSQMSRIFQTLGADPHNLGWFFILPPLAGMLVQPIVGHYSDRTWKPRLGGRRLPYLLYGTLIAVIVMILMPNSGSFGFGYASLAALSFGALMIALLDVSSNMAMQPFKMMVGDMVNEEQKGYAYGIQSFLANTGAVVAAILPFVFAYIGLANTAEKGVVPQTVVVAFYVGAALLVITSAFTIFKVKEYDPETYARYHGIDVAANQEKANWIELLKTAPKAFWTVTLVQFFCWFAFQYMWTYSAGAIAENVWHTTDASSVGYQEAGNWYGVLAAVQSVAAVICSFVLAKVPNKYHKAGYFGCLALGALGFFSVFFIGNQYALVLSYTLIGIAWAGIITYPLTIVTNALSGKHMGTYLGLFNGSICMPQIVASLLSFVLFPMLGGLQATMFLVGGVVLLLGAFSVFLIKETHGGV

SEQ ID NO: 569 - DNA, 1290 bp, Neisseria meningitidis
atgctcagtttcggctttctcggcgttcagacggcctttaccctgcaaagctcgcagatgagccgcatcttccagacgctcggtgccgatccgcacagcctcggctggttctttatcctgccgccgctggcggggatgctggtgcagccgattgtcggccattactccgaccgcacttggaagccgcgtttgggcggccgccgtctgccgtatctgctttatggcacgctgattgcggttattgtgatgattttgatgccgaactcgggcagcttcggtttcggctatgcgtcgctggcggctttgtcgttcggcgcgctgatgattgcgctgttagacgtgtcgtcaaatatggcgatgcagccgtttaagatgatggtcggcgacatggtcaacgaggagcagaaaggctacgcctacgggattcaaagtttcttagcgaatacgggcgcggtcgtggcggcgattctgccgtttgtgtttgcgtatatcggtttggcgaacaccgccgagaaaggcgttgtgccgcagaccgtggtcgtggcgttttatgtgggtgcggcgttgctggtgattaccagcgcgttcacgattttcaaagtgaaggaatacaatccggaaacctacgcccgttaccacggcatcgatgtcgccgcgaatcaggaaaaagccaactggatcgaactcttgaaaaccgcgcctaaggcgttttggacggttactttggtgcaattcttctgctggttcgccttccaatatatgtggacttactcggcaggcgcgattgcggaaaacgtctggcacaccaccgatgcgtcttccgtaggttatcaggaggcgggtaactggtacggcgttttggcggcggtgcagtcggttgcggcggtgatttgttcgtttgtattggcgaaagtgccgaataaataccataaggcgggttatttcggctgtttggctttgggcgcgctcggctttttctccgttttcttcatcggcaaccaatacgcgctggtgttgtcttataccttaatcggcatcgcttgggcgggcattatcacttatccgctgacgattgtgaccaacgccttgtcgggcaagcatatgggcacttacttgggcctgtttaacggctctatctgtatgccgcaaatcgtcgcttcgctgttgagtttcgtgcttttccctatgctgggcggcttgcaggccactatgttcttggtagggggcgtcgtcctgctgctgggcgcgttttccgtgttcctgattaaagaaacacacggcggggtttga

SEQ ID NO: 570 - protein, 429 aa, Neisseria meningitidis
MLSFGFLGVQTAFTLQSSQMSRIFQTLGADPHSLGWFFILPPLAGMLVQPIVGHYSDRTWKPRLGGRRLPYLLYGTLIAVIVMILMPNSGSFGFGYASLAALSFGALMIALLDVSSNMAMQPFKMMVGDMVNEEQKGYAYGIQSFLANTGAVVAAILPFVFAYIGLANTAEKGVVPQTVVVAFYVGAALLVITSAFTIFKVKEYNPETYARYHGIDVAANQEKANWIELLKTAPKAFWTVTLVQFFCWFAFQYMWTYSAGAIAENVWHTTDASSVGYQEAGNWYGVLAAVQSVAAVICSFVLAKVPNKYHKAGYFGCLALGALGFFSVFFIGNQYALVLSYTLIGIAWAGIITYPLTIVTNALSGKHMGTYLGLFNGSICMPQIVASLLSFVLFPMLGGLQATMFLVGGVVLLLGAFSVFLIKETHGGV

SEQ ID NO: 571 - DNA, 612 bp, Neisseria gonorrhoeae
atgagcgatacccccgctacccgcgatttcggcctgatcgacgggcgggccgtaaccggctatgtgctgtccaaccggcgtggtacgtgcgtcttcgtgctggacttgggcgggattgtgcaggaattttccgttttggcagacggcgtgcgcgaaaaccccgtggtgtcgttcgacgatgcggcttcctatgcggacaatccgtttcagattaacaagcagatagggcgcgtggccggacgcatccgcggtgcggcgttcgacatcaacggtaggacttaccgcgtggaggccaacgaaggcaggaacgcgctgcacggcggttcgcacgggctggccgttacccgtttcaacgcggtggcggcagacggccgacggttatcccaacgatttggatatttcctaccgcttggacgaggacggccggcttaccgttacctatcgcgccaccgcgctcggcgacacggtgttcgacccgacgctgcacatttactggcggctggacgcgggcctgcacgatgcggttctgcatattccgcagggcggacatattccggccgatgccgaaaaactgcccgtcttaacggtttcagacggcctcgaagtatttga

SEQ ID NO: 572 - protein, 203 aa, Neisseria gonorrhoeae
MSDTPATRDFGLIDGRAVTGYVLSNRRGTCVFVLDLGGIVQEFSVLADGVRENPVVSFDDAASYADNPFQINKQIGRVAGRIRGAAFDINGRTYRVEANEGRNALHGGSHGLAVTRFNAVAADGRRLSQRFGYFLPLGRGRPAYRYLSRHRARRHGVRPDAAHLLAAGRGPARCGSAYSAGRTYSGRCRKTARLNGFRRPRSI

SEQ ID NO: 573 - DNA, 657 bp, Neisseria meningitidis
atgagcgatacccccgctacccgcgatttcggtctgatcgacgggcgtgccgtaaccggctatgtgctgtccaaccggcgtggtacgcgtgtctgcgtgctggacttgggcgggattgtgcaggaattttccgttttggcagacggcgtgcgcgaaaacctcgtggtgtcgttcgatgatgcggcttcctatgcggacaatccgtttcagattaacaaacagatagggcgcgtggccggacgcatccgcggtgcggcgttcgacatcaacggcaggacttaccgcgtggaggccaacgaaggcaggaacgcgctgcacggcggttcgcacgggctggccgttacccgtttcaacgcggtggcggcagacggccgttcggtggtgctgcgcagccgcctggcaacagtcggccgacggttatcccaacgatttggatttggatatttcctaccgcttggacgaggacgaccggcttaccgttacctatcgcgccaccgcgctcggcgacacggtgttcgacccgacgctgcacatttactggcggctggacgcgggcctgcacgatgcggttctgcatattccgcagggcggacatatgccggccgatgccgaaaaactgcccgtctcaacggtttcagacgacctcgaagtatttga

SEQ ID NO: 574 - protein, 218 aa, Neisseria meningitidis
MSDTPATRDFGLIDGRAVTGYVLSNRRGTRVCVLDLGGIVQEFSVLADGVRENLVVSFDDAASYADNPFQINKQIGRVAGRIRGAAFDINGRTYRVEANEGRNALHGGSHGLAVTRFNAVAADGRSVVLRSRLATVGRRLSQRFGFGYFLPLGRGRPAYRYLSRHRARRHGVRPDAAHLLAAGRGPARCGSAYSAGRTYAGRCRKTARLNGFRRPRSI

SEQ ID NO: 575 - DNA, 656 bp, Neisseria meningitidis
atgagcgatacccccgctacccgcgatttcggcctgatcgacgggcgtgccgtaaccggctatgtgctgtccaaccggcgtggtacgcgtgtctgcgtgctggacttgggcgggattgtgcaggaattttccgttttggcagacggcgtgcgcgaaaacctcgtggtgtcgttcgacgatgcggcttcctatgcggacaatccgtttcagattaacaagcagatagggcgcgtggccggacgcatccgcggtgcggcgttcgacatcaacggcaggacttaccgcgtggaggccaacgaaggcaggaacgcgctgcacggcggttcgcacgggctggccgttacccgtttcaacgcggtggcggcagacggccgttcggtggtgctgcgcagccgcctgcaacagtcggccgacggttatcccaacgatttggatttggatatttcctaccgcttggacgaggacgaccggcttaccgttacctatcgcgccaccgcgctcggcgacacggtgttcgacccgacgctgcacatttactggcggctggacgcgggcctgcacgatgcggttctgcatattccgcagggcggacatattccggccgatgccgaaaaactgcccgtctcaacggtttcagacgacctcgaagtatttga

SEQ ID NO: 576 - protein, 218 aa, Neisseria meningitidis
  misc_feature (134)..(134): Xaa can be any naturally occurring amino acid
MSDTPATRDFGLIDGRAVTGYVLSNRRGTRVCVLDLGGIVQEFSVLADGVRENLVVSFDDAASYADNPFQINKQIGRVAGRIRGAAFDINGRTYRVEANEGRNALHGGSHGLAVTRFNAVAADGRSVVLRSRLXTVGRRLSQRFGFGYFLPLGRGRPAYRYLSRHRARRHGVRPDAAHLLAAGRGPARCGSAYSAGRTYSGRCRKTARLNGFRRPRSI

SEQ ID NO: 577 - DNA, 639 bp, Neisseria gonorrhoeae
atgaagcaaatccccctccgccttctccaggtcgtcattgaccacgacaaagtcgaacaatacggactgttcgatttcatgccttgccttcgacagcctcctttggataacttcccgactgtccgtcccgcgccctttgaggcgcgcggcaagcacgtcgaaagaaggcggcaggataaagataccgacagcttccggcagcgcgttgcgaacctgcgccgcgccctgaacgtcgatttccaaaatcacgtcatagcctgccgccgccaacgcattcacgccctccgtgcttgtgccgtaatagttgccgaatacgtctgcgtattccaaaaaagcctcctgcgcgataagcgattcaaactcttctttggaaacaaagtgataatgtacgccgtttgcttcgccttcacgcggcgggcgcgtcgtatgcgacacggaaacgcgcaaaccgttatggtttgccaacagccgcgacaccagcgtggttttgcccgtgccggaagcggccgaaatgataaagatgttgccttttcgataagcggacatattttttacctgtatattttccaaccgattgtatcacaacggacaccctatttcatatttgccgatgcccatattttgccgctattgttttga

SEQ ID NO: 578 - protein, 212 aa, Neisseria gonorrhoeae
MKQIPLRLLQVVIDHDKVEQYGLFDFMPCLRQPPLDNFPTVRPAPFEARGKHVERRRQDKDTDSFRQRVANLRRALNVDFQNHVIACRRQRIHALRACAVIVAEYVCVFQKSLLRDKRFKLFFGNKVIMYAVCFAFTRRARRMRHGNAQTVMVCQQPRHQRGFARAGSGRNDKDVAFSISGHIFYLYIFQPIVSQRTPYFIFADAHILPLLF

SEQ ID NO: 579 - DNA, 639 bp, Neisseria meningitidis
atggcgcaaatcctcctccgctcgcgccaagtcgtcattgaccacgacaaagtcaaacaatacggactgctcgatttcatgccttgccttcgacagcctcctttggataacttcccgactgtccgtcccgcgtccgttgaggcgcgcggcaagtacgtcgaaagaaggcggcaggataaagatgccgacggcttcgggcagcgcgtcgcgaacctgcgccgcgccctgaacgtcgatttccaaaatcacgtcatagcctgccgccgccaacgcattcacaccctccgcgcctgtgccgtaatagttgccaaatacgtcggcgtattccaaaaaagcttcctgcgcgataagcgactcaaactcttctttggaaacaaagtgataatgtacgccgtttgcttcgccttcacgcggcgggcgcgtcgtgtgcgacacggaaacgcgcaaaccgttatggtttgccaacagccgcgacaccagcgtggttttgcccgtgccggaagcggccgaaatgataaagatgttgccttttcgataagcggacatattttttacctgtatattttccagccgattgtatcacaatggacacccagtttcctatttgccgatgcccatattttgccgctattgttttga

SEQ ID NO: 580 - protein, 212 aa, Neisseria meningitidis
MAQILLRSRQVVIDHDKVKQYGLLDFMPCLRQPPLDNFPTVRPASVEARGKYVERRRQDKDADGFGQRVANLRRALNVDFQNHVIACRRQRIHTLRACAVIVAKYVGVFQKSFLRDKRLKLFFGNKVIMYAVCFAFTRRARRVRHGNAQTVMVCQQPRHQRGFARAGSGRNDKDVAFSISGHIFYLYIFQPIVSQWTPSFLFADAHILPLLF

SEQ ID NO: 581 - DNA, 639 bp, Neisseria meningitidis
atggcgcaaatcctcctccgcccgcgccaagtcatcattgaccacgacaaaatcgaacaatacggactgttcgatttcatgccttgccttcgacagcctcctttggataacttcccgactgtccgtcccgcgtccgttgagacgcgcagcaagcacatcgaaagacggcggcaggataaagatgccgacggcttcgggcagcgcatctcgaacctgagccgcgccctgaacgtcgatttccaaaatcacgtcataacctgccgccgccaacgcattcacaccctccgcgcttgtgccgtaatagttgccgaacacgtccgcgtattccaaaaaagcctcctgcgcgataagcgactcaaactcttctttggaaacaaagtgataatgtacgccgtttgcttcgccttcacgcggcggacgcgtcgtgtgcgacacggaaacgcgcaaaccgttatggtttgccaacagccgcgacaccagcgtggttttgcccgtgccggaagcggccgaaatgataaagatgttgccttttcgataagcggacatattttttacctgtatattttccagccgattgtatcacaacggacacccggtttcctatttgccgatgcccatattttgccgctattgttttga

SEQ ID NO: 582 - protein, 212 aa, Neisseria meningitidis
MAQILLRPRQVIIDHDKIEQYGLFDFMPCLRQPPLDNFPTVRPASVETRSKHIERRRQDKDADGFGQRISNLSRALNVDFQNHVITCRRQRIHTLRACAVIVAEHVRVFQKSLLRDKRLKLFFGNKVIMYAVCFAFTRRTRRVRHGNAQTVMVCQQPRHQRGFARAGSGRNDKDVAFSISGHIFYLYIFQPIVSQRTPGFLFADAHILPLLF

SEQ ID NO: 583 - DNA, 522 bp, Neisseria gonorrhoeae
atgcgacgagaagccaaaatggcacaaatcacactcaaacccattgttttatcaattcttttaatcaacacacccctcctcgcccaagcgcatgaaactgagcaatcggtgggcttggaaacggtcagcgtcgtcggcaaaagccgtccgcgcgcgacttcggggctgctgcacacttcgaccgcctccgacaaaatcatctccggcgatactttgcgccaaaaagccgtcaacttgggcgacgctttggacggcgtaccgggcatccacgcttcgcaatacggcggcggcgcatccgctcccgttattcgcggtcaaacgggcagacggattaaagtattgaaccatcacggcgaaacgggcgatatggcggacttttctcccgatcacgccattatggtagataccgccttgtcgcaacaggttgaaatcctgcgcgggccggttacgctcttgtacagctcgggcaatgtggccggggctggtcaatgttgccgatggaaaaatcccccaaaaaatgcc

SEQ ID NO: 584 - protein, 174 aa, Neisseria gonorrhoeae
MRREAKMAQITLKPIVLSILLINTPLLAQAHETEQSVGLETVSVVGKSRPRATSGLLHTSTASDKIISGDTLRQKAVNLGDALDGVPGIHASQYGGGASAPVIRGQTGRRIKVLNHHGETGDMADFSPDHAIMVDTALSQQVEILRGPVTLLYSSGNVAGAGQCCRWKNPPKNA

SEQ ID NO: 585 - DNA, 2205 bp, Neisseria meningitidis
ccgcataaaactgagcaatcggtggatttggaaacggtcagcgtcgtcggcaaaagccgtccgcgcgccacgtcggggctgttgcacacttcgaccgcctccgacaaaatcatctccggcgataccttgcgccaaaaagccgtcaacttgggcgacgctttagacggcgtaccgggcatccacgcttcgcaatacggcggcggcgcgtctgctcccgtcattcgcggtcaaacaggcaggcggattaaagtgttgaaccatcacggcgaaacaggcgatatggcggatttttcgcccgatcacgccattatggtagataccgccttgtcgcaacaggtcgaaatcctgcgcgggccggttacgctcttgtacagctcgggcaatgtggcggggctggtcgatgttgccgatggcaaaatccccgaaaaaatgcctgaaaacggcgtatcgggcgaactcggattgcgtttgagcagcggcaatctggaaaaactcacgtccggcggcatcaatatcggtttgggcaaaaactttgtattgcacacggaagggctgtaccgcaaatcgggggattacgccgtaccgcgttaccgcaatctgaaacgcctgcccgacagccacgccgattcgcaaacgggcagcatcgggctgtcttgggttggcgaaaaaggttttatcggcgtagcgtacagcgaccgtcgcgaccaatatggtctgcctgcccacagccacgaatacgatgattgccacgccgacatcatctggcaaaagagcttgattaacaaacgctatttacagctttatccgcacctgttgaccgaagaagacatcgattacgacaatccgggcttgagctgcggcttccacgacgacgataatgcacacgcacacacccacagcggcagaccgtggatagacctgcgcaacaaacgctacgaactccgtgccgaatggaagcaaccgttccccggttttgaagccctgcgcgtacacctgaaccgcaacgactaccgccacgacgaaaaagcaggcgatgcagtcgaaaacttttttaacaaccaaacgcaaaacgcccgcatcgagttgcgccaccaacccataggtcgtctgaaaggcagctggggcgtgcaatatttacaacaaaaatccagtgctttatctgccatatccgaagcggttaaacaaccgatgctgcttgacaacaaagtgcaacattacagctttttcggtgtagaacaggcaaactgggacaacttcacgcttgaaggaggcgtacgcgtggaaaaacaaaaagcctccattcagtacgacaaagcattgattgatcgggaaaactactacaaccaccccctgcccgacctcggcgcgcaccgccaaaccgcccgctcattcgcactttcgggcaactggtatttcacgccacaacacaaactcagcctgaccgcctcccatcaggaacgcctgccgtcaacgcaagagctgtacgcacacggcaaacacgtcgccaccaacacctttgaagtcggcaacaaacacctcaacaaagagcgttccaacaatatcgaactcgcgctgggctacgaaggcgaccgctggcaatacaatctggcactctaccgcaaccgcttcggtaactacatttacgcccaaaccttaaacgacggacgcggccccaaatccatcgaagacgacagcgaaatgaagctcgtgcgctacaaccaatccggcgccgacttctacggcgcggaaggcgaaatctacttcaaaccgacaccgcgctaccgcatcggcgtttccggcgactatgtacgaggccgtctgaaaaacctgccttccctacccggcagagaagatgcctacggcaaccgtcctttcatcgcacaggacgaccaaaatgccccccgtgttccggctgcgcgcctcggcttccacctgaaagcctcgctgaccgaccgtatcgatgccaatttggactactaccgcgtgttcgcccaaaacaaactcgcccgctacgaaacgcgcacgcccggacaccatatgctcaacctcggcgcaaactaccgccgcaatacgcgctatggcgagtggaattggtacgtcaaagccgacaacctgctcaaccaatccgtttacgcccacagcagctttctctctgatacgccgcaaatgggccgcagctttaccggcggcgtgaacgagttttaa

SEQ ID NO: 586 - protein, 735 aa, Neisseria meningitidis
PHKTEQSVDLETVSVVGKSRPRATSGLLHTSTASDKIISGDTLRQKAVNLGDALDGVPGIHASQYGGGASAPVIRGQTGRRIKVLNHHGETGDMADFSPDHAIMVDTALSQQVEILRGPVTLLYSSGNVAGLVDVADGKIPEKMPENGVSGELGLRLSSGNLEKLTSGGINIGLGKNFVLHTEGLYRKSGDYAVPRYRNLKRLPDSHADSQTGSIGLSWVGEKGFIGVAYSDRRDQYGLPAHSHEYDDCHADIIWQKSLINKRYLQLYPHLLTEEDIDYDNPGLSCGFHDDDNAHAHTHSGRPWIDLRNKRYELRAEWKQPFPGFEALRVHLNRNDYRHDEKAGDAVENFFNNQTQNARIELRHQPIGRLKGSWGVQYLQQKSSALSAISEAVKQPMLLDNKVQHYSFFGVEQANWDNFTLEGGVRVEKQKASIQYDKALIDRENYYNHPLPDLGAHRQTARSFALSGNWYFTPQHKLSLTASHQERLPSTQELYAHGKHVATNTFEVGNKHLNKERSNNIELALGYEGDRWQYNLALYRNRFGNYIYAQTLNDGRGPKSIEDDSEMKLVRYNQSGADFYGAEGEIYFKPTPRYRIGVSGDYVRGRLKNLPSLPGREDAYGNRPFIAQDDQNAPRVPAARLGFHLKASLTDRIDANLDYYRVFAQNKLARYETRTPGHHMLNLGANYRRNTRYGEWNWYVKADNLLNQSVYAHSSFLSDTPQMGRSFTGGVNVKF

SEQ ID NO: 587 - DNA, 2295 bp, Neisseria meningitidis
atgcgacgagaagccaaaatggcacaaactacactcaaacccattgttttatcaattcttttaatcaacacacccctcctctcccaagcgcatggaactgagcaatcagtgggcttggaaacggtcagcgtcgtcggcaaaagccgtccgcgcgccacttcggggctgctgcacacttctaccgcctccgacaaaatcatcagcggcgacaccttgcgacaaaaagccgtcaacttgggtgatgctttagacggcgtaccgggcattcatgcctcgcaatacggcggcggcgcatccgctcccgttattcgcggtcaaacaggcagacggattaaagtgttgaaccatcacggcgaaacgggcgacatggcggacttctctccagaccatgcaatcatggtggacagcgccttgtcgcaacaggtcgaaatcctgcgcggtccggttacgctcttgtacagctcgggcaatgtggcggggctggtcgatgttgccgatggcaaaatccccgaaaaaatgcctgaaaacggcgtatcgggcgaactcggattgcgtttgagcagcggcaatctggaaaaactcacgtccggcggcatcaatatcggtttgggcaaaaactttgtattgcacacggaagggctgtaccgcaaatcgggggattacgccgtaccgcgttaccgcaatctgaaacgcctgcccgacagccacgccgattcgcaaacgggcagcatcgggctgtcttgggttggcgaaaaaggctttatcggcgcagcatacagcgaccgtcgcgaccaatatggtctgcctgcccacagccacgaatacgatgattgccacgccgacatcatctggcaaaagagtttgattaacaaacgctatttgcagctttatccgcacctgttgaccgaagaagacatcgattacgacaatccgggcttgagctgcggctttcacgacgacgatgatgcacacgcccatgcccacaacggcaaaccttggatagacctgcgcaacaaacgctacgaactccgcgccgaatggaagcaaccgttccccggttttgaagccctgcgcgtacacctgaaccgcaacgactaccgccacgacgaaaaagcaggcgatgcagtagaaaacttttttaacaaccaaacgcaaaacgcccgtatcgagttgcgccaccaacccataggccgtctgaaaggcagctggggcgtgcaatatttgggacaaaaatccagtgctttatctgccacatccgaagcggtcaaacaaccgatgctgcttgacaataaagtgcaacattacagctttttcggtgtagaacaggcaaactgggacaacttcacgcttgaaggcggcgtacgcgtggaaaaacaaaaagcctccatccgctacgacaaagcattgattgatcgggaaaactactacaaccatcccctgcccgacctcggcgcgcaccgccaaaccgcccgctcattcgcactttcgggcaactggtatttcacgccacaacacaaactcagcctgaccgcctcccatcaggaacgcctgccgtcaacgcaagagctgtacgcacacggcaaacacgtcgccaccaacacctttgaagtcggcaacaaacacctcaacaaagagcgttccaacaatatcgaactcgcgctgggctacgaaggcgaccgctggcaatacaatctggcactctaccgcaaccgcttcggcaactacatttacgcccaaaccttaaacgacggacgcggccccaaatccatcgaagacgacagcgaaatgaagctcgtgcgctacaaccaatccggtgcggacttctacggcgcggaaggcgaaatctacttcaaaccgacaccgcgctaccgcatcggcgtttccggcgactatgtacgaggccgtctgaaaaacctgccttccctacccggcagggaagacgcctacggcaaccgcccactcattgcccaagccgaccaaaacgcccctcgcgttccggctgcgcgcctcggcgtccacctgaaagcctcgctgaccgaccgcatcgatgccaatttggactactaccgcgtgttcgcccaaaacaaactcgcccgctacgaaacgcgcacgcccggacaccatatgctcaacctcggcgcaaactaccgccgcaatacgcgctatggcgagtggaattggtacgtcaaagccgacaacctgctcaaccaatccgtttacgcccacagcagcttcctctctgatacgccgcaaatgggccgcagctttaccggcggcgtgaacgtgaagttttaa

SEQ ID NO: 588 - protein, 764 aa, Neisseria meningitidis
MRREAKMAQTTLKPIVLSILLINTPLLSQAHGTEQSVGLETVSVVGKSRPRATSGLLHTSTASDKIISGDTLRQKAVNLGDALDGVPGIHASQYGGGASAPVIRGQTGRRIKVLNHHGETGDMADFSPDHAIMVDSALSQQVEILRGPVTLLYSSGNVAGLVDVADGKIPEKMPENGVSGELGLRLSSGNLEKLTSGGINIGLGKNFVLHTEGLYRKSGDYAVPRYRNLKRLPDSHADSQTGSIGLSWVGEKGFIGAAYSDRRDQYGLPAHSHEYDDCHADIIWQKSLINKRYLQLYPHLLTEEDIDYDNPGLSCGFHDDDDAHAHAHNGKPWIDLRNKRYELRAEWKQPFPGFEALRVHLNRNDYRHDEKAGDAVENFFNNQTQNARIELRHQPIGRLKGSWGVQYLGQKSSALSATSEAVKQPMLLDNKVQHYSFFGVEQANWDNFTLEGGVRVEKQKASIRYDKALIDRENYYNHPLPDLGAHRQTARSFALSGNWYFTPQHKLSLTASHQERLPSTQELYAHGKHVATNTFEVGNKHLNKERSNNIELALGYEGDRWQYNLALYRNRFGNYIYAQTLNDGRGPKSIEDDSEMKLVRYNQSGADFYGAEGEIYFKPTPRYRIGVSGDYVRGRLKNLPSLPGREDAYGNRPLIAQADQNAPRVPAARLGVHLKASLTDRIDANLDYYRVFAQNKLARYETRTPGHHMLNLGANYRRNTRYGEWNWYVKADNLLNQSVYAHSSFLSDTPQMGRSFTGGVNVKF

SEQ ID NO: 589 - DNA, 600 bp, Neisseria gonorrhoeae
atggcgttaaaaacatcaaacttggaacacgcaatgctggttcatcccgaagctatgagtgtcggcgcgcttgccgacaaaatccgcaaaatcgaaaactggccgcaaaaaggcatcttattccacgacatcacgcccgtcctgcaaagtgcggaatacttccgccttttggtcgatttgctggtttaccgctatatggatcagaaaatcgacatcgttgccggcttggacgcgcgcggcttcattatcggcgcggcactcgcctaccagctcaacgtcggcttcgtccccatccgcaaaaaaggcaagctgccttttgaaaccgtatcgcaaagctacgcgctcgaatacggggaagctgcggtggaaatccacaccgatgccgtcaaacccggttcgcgcgtcctgctggtcgatgatttggttgccacgggcggcacaatgcttgccgggctggaactgatccgcaaactcggcggggaaattgtcgaagccgccgccattttggaatttaccgaccttcaaggcggcaagaatatccgcgcaagtggcgcgcccttatttaccctgcttcaaaacgaaggctgcatgaaaggctga

SEQ ID NO: 590 - protein, 199 aa, Neisseria gonorrhoeae
MALKTSNLEHAMLVHPEAMSVGALADKIRKIENWPQKGILFHDITPVLQSAEYFRLLVDLLVYRYMDQKIDIVAGLDARGFIIGAALAYQLNVGFVPIRKKGKLPFETVSQSYALEYGEAAVEIHTDAVKPGSRVLLVDDLVATGGTMLAGLELIRKLGGEIVEAAAILEFTDLQGGKNIRASGAPLFTLLQNEGCMKG

SEQ ID NO: 591 - DNA, 600 bp, Neisseria meningitidis
atggcgttaaaaacatcaaacttggaacacgcaatgctggttcatcccgaagctatgagtgtcggcgcgcttgccgacaaaatccgcaaaatcgaaaactggccgcaaaaaggcatcttattccacgacatcacgcccgtccttcaaagcgcggaatacttccgccttttggttgatttattggtttaccgctatatggatcagaaaatcgacatcgttgccggtttggacgcgcgcggcttcattatcggcgcggcactcgcctaccagctcaacgtcggtttcgtccccatccgcaaaaaaggcaagctgccttttgaaaccgtatcgcaaagctacgcgctcgaatacggggaagctgcggtggaaatccacaccgatgccgtcaaactcggttcgcgcgtgctgctggtcgatgatttgattgccacgggcggcacgatgcttgccggactggaactgatccgcaaactcggcggagaaattgtcgaagccgccgccattttggaatttaccgaccttcaaggcggcaagaatatccgtgcaagcggcgcgcccttatttaccctgcttcaaaacgaaggctgtatgaagggctga

SEQ ID NO: 592 - protein, 199 aa, Neisseria meningitidis
MALKTSNLEHAMLVHPEAMSVGALADKIRKIENWPQKGILFHDITPVLQSAEYFRLLVDLLVYRYMDQKIDIVAGLDARGFIIGAALAYQLNVGFVPIRKKGKLPFETVSQSYALEYGEAAVEIHTDAVKLGSRVLLVDDLIATGGTMLAGLELIRKLGGEIVEAAAILEFTDLQGGKNIRASGAPLFTLLQNEGCMKG

SEQ ID NO: 593 - DNA, 600 bp, Neisseria meningitidis
atggcgttaaaaacatcaaacttggaacacgcaatgctggttcatcccgaagctatgagtgtcggtgcgcttgccgacaaaatccgcaaaatcgaaaactggccgcaaaaaggcatcttattccacgacatcacgcccgtcctgcaaagcgcggaatacttccgacttttggttgatttattggtttaccgctatatggatcagaaaatcgacatcgttgccggtttggacgcgcgcggcttcattatcggcgcggcactcgcctaccagctcaacgtcggtttcgtccccatccgcaaaaaaggcaagctgccttttgaaaccgtatcgcaaagctacgcgctcgaatacggggaagctgcggtggaaatccacaccgatgccgtcaaactcggttcgcgcgtgctgctggtcgatgatttggttgccacgggcggcacgatgcttgccggactggagctgatccgcaaactcggcggggaaattgtcgaagccgccgccattttggaatttaccgaccttcaaggcggcaagaatatccgtgcaagcggcgcgcccttatttaccctgcttcaaaacgaaggctgtatgaagggctga

SEQ ID NO: 594 - protein, 199 aa, Neisseria meningitidis
MALKTSNLEHAMLVHPEAMSVGALADKIRKIENWPQKGILFHDITPVLQSAEYFRLLVDLLVYRYMDQKIDIVAGLDARGFIIGAALAYQLNVGFVPIRKKGKLPFETVSQSYALEYGEAAVEIHTDAVKLGSRVLLVDDLVATGGTMLAGLELIRKLGGEIVEAAAILEFTDLQGGKNIRASGAPLFTLLQNEGCMKG

SEQ ID NO: 595 - DNA, 1020 bp, Neisseria gonorrhoeae
atgttgattgacaacaatgtccgccattacagctttttcggtgtagaacaggcaaattgggacaacttcacgcttgaaggcggcgtacgcgtggaaaaacaaaaagcctccatccggtacgacaaagcattgattgatcgagaaaactactacaaccagcccctgcccgacctcggcgcgcaccgccaaaccgcccgctcgttcgcactttcgggcaactggtatttcacgccacaccacaaactcagcctgaccgcctcccatcaggaacgcctgccgtcaacgcaagaactgtacgcacacggcaagcacgtcgccaccaacacctttgaagtcggcaacaaacacctcaacaaagagcgttccaacaatatcgaactcgcgctgggctacaaaggcgaccgctggcaatacaatctggcagcctaccgcaaccgattcggcaactacatttacgcccaaaccttaaacgacggacgcggccccaaatccatcgaagacgacagcgaaatgaagctcgtgcgctacaaccaatccggtgccgacttctacggcgcggaaggcgaaatctacttcaaaccgacaccgcgctaccgcatcggtgtttccggcgactatgtacgaggccgtctgaaaaacctgccgtccctacccggcagggaagatccctacggcaaacgtcccttcatcgcacaagccgaccaaaacgccccccgcattccggctgcgcgcctcggcttccacctgaaaacctcgctaaccgaccgtatcgatgccaatttggactactaccgcgtgttcgcccaaaacaaactcgcccgctacgaaacgcgtacgcccggacaccatatgctcaacctcggtgcaaactaccgccgcaatacgcgctatggcgagtggaattggtacgtcaaagccgacaacctgctcaaccaatccgtttacgcccacagcagcttcctctctgatacgccgcaaatgggccgcagctttgccggcggcgtaaacgtgaagttttaa

SEQ ID NO: 596 - protein, 339 aa, Neisseria gonorrhoeae
MLIDNNVRHYSFFGVEQANWDNFTLEGGVRVEKQKASIRYDKALIDRENYYNQPLPDLGAHRQTARSFALSGNWYFTPHHKLSLTASHQERLPSTQELYAHGKHVATNTFEVGNKHLNKERSNNIELALGYKGDRWQYNLAAYRNRFGNYIYAQTLNDGRGPKSIEDDSEMKLVRYNQSGADFYGAEGEIYFKPTPRYRIGVSGDYVRGRLKNLPSLPGREDPYGKRPFIAQADQNAPRIPAARLGFHLKTSLTDRIDANLDYYRVFAQNKLARYETRTPGHHMLNLGANYRRNTRYGEWNWYVKADNLLNQSVYAHSSFLSDTPQMGRSFAGGVNVKF

SEQ ID NO: 597 - DNA, 1020 bp, Neisseria meningitidis
atgctgcttgacaacaaagtgcaacattacagctttttcggtgtagaacaggcaaactgggacaacttcacgcttgaaggaggcgtacgcgtggaaaaacaaaaagcctccattcagtacgacaaagcattgattgatcgggaaaactactacaaccaccccctgcccgacctcggcgcgcaccgccaaaccgcccgctcattcgcactttcgggcaactggtatttcacgccacaacacaaactcagcctgaccgcctcccatcaggaacgcctgccgtcaacgcaagagctgtacgcacacggcaaacacgtcgccaccaacacctttgaagtcggcaacaaacacctcaacaaagagcgttccaacaatatcgaactcgcgctgggctacgaaggcgaccgctggcaatacaatctggcactctaccgcaaccgcttcggtaactacatttacgcccaaaccttaaacgacggacgcggccccaaatccatcgaagacgacagcgaaatgaagctcgtgcgctacaaccaatccggcgccgacttctacggcgcggaaggcgaaatctacttcaaaccgacaccgcgctaccgcatcggcgtttccggcgactatgtacgaggccgtctgaaaaacctgccttccctacccggcagagaagatgcctacggcaaccgtcctttcatcgcacaggacgaccaaaatgccccccgtgttccggctgcgcgcctcggcttccacctgaaagcctcgctgaccgaccgtatcgatgccaatttggactactaccgcgtgttcgcccaaaacaaactcgcccgctacgaaacgcgcacgcccggacaccatatgctcaacctcggcgcaaactaccgccgcaatacgcgctatggcgagtggaattggtacgtcaaagccgacaacctgctcaaccaatccgtttacgcccacagcagctttctctctgatacgccgcaaatgggccgcagctttaccggcggcgtgaacgtgaagttttaa

SEQ ID NO: 598 - protein, 339 aa, Neisseria meningitidis
MLLDNKVQHYSFFGVEQANWDNFTLEGGVRVEKQKASIQYDKALIDRENYYNHPLPDLGAHRQTARSFALSGNWYFTPQHKLSLTASHQERLPSTQELYAHGKHVATNTFEVGNKHLNKERSNNIELALGYEGDRWQYNLALYRNRFGNYIYAQTLNDGRGPKSIEDDSEMKLVRYNQSGADFYGAEGEIYFKPTPRYRIGVSGDYVRGRLKNLPSLPGREDAYGNRPFIAQDDQNAPRVPAARLGFHLKASLTDRIDANLDYYRVFAQNKLARYETRTPGHHMLNLGANYRRNTRYGEWNWYVKADNLLNQSVYAHSSFLSDTPQMGRSFTGGVNVKF

SEQ ID NO: 599 - DNA, 1020 bp, Neisseria meningitidis
atgctgcttgacaataaagtgcaacattacagctttttcggtgtagaacaggcaaactgggacaacttcacgcttgaaggcggcgtacgcgtggaaaaacaaaaagcctccatccgctacgacaaagcattgattgatcgggaaaactactacaaccatcccctgcccgacctcggcgcgcaccgccaaaccgcccgctcattcgcactttcgggcaactggtatttcacgccacaacacaaactcagcctgaccgcctcccatcaggaacgcctgccgtcaacgcaagagctgtacgcacacggcaaacacgtcgccaccaacacctttgaagtcggcaacaaacacctcaacaaagagcgttccaacaatatcgaactcgcgctgggctacgaaggcgaccgctggcaatacaatctggcactctaccgcaaccgcttcggcaactacatttacgcccaaaccttaaacgacggacgcggccccaaatccatcgaagacgacagcgaaatgaagctcgtgcgctacaaccaatccggtgcggacttctacggcgcggaaggcgaaatctacttcaaaccgacaccgcgctaccgcatcggcgtttccggcgactatgtacgaggccgtctgaaaaacctgccttccctacccggcagggaagacgcctacggcaaccgcccactcattgcccaagccgaccaaaacgcccctcgcgttccggctgcgcgcctcggcgtccacctgaaagcctcgctgaccgaccgcatcgatgccaatttggactactaccgcgtgttcgcccaaaacaaactcgcccgctacgaaacgcgcacgcccggacaccatatgctcaacctcggcgcaaactaccgccgcaatacgcgctatggcgagtggaattggtacgtcaaagccgacaacctgctcaaccaatccgtttacgcccacagcagcttcctctctgatacgccgcaaatgggccgcagctttaccggcggcgtgaacgtgaagttttaa

SEQ ID NO: 600 - protein, 339 aa, Neisseria meningitidis
MLLDNKVQHYSFFGVEQANWDNFTLEGGVRVEKQKASIRYDKALIDRENYYNHPLPDLGAHRQTARSFALSGNWYFTPQHKLSLTASHQERLPSTQELYAHGKHVATNTFEVGNKHLNKERSNNIELALGYEGDRWQYNLALYRNRFGNYIYAQTLNDGRGPKSIEDDSEMKLVRYNQSGADFYGAEGEIYFKPTPRYRIGVSGDYVRGRLKNLPSLPGREDAYGNRPLIAQADQNAPRVPAARLGVHLKASLTDRIDANLDYYRVFAQNKLARYETRTPGHHMLNLGANYRRNTRYGEWNWYVKADNLLNQSVYAHSSFLSDTPQMGRSFTGGVNVKF

(The sequence listing continues in the following parts.)

The invention claimed is:

1. A purified polypeptide comprising a fragment of an amino acid sequence of SEQ ID NO: 2536, wherein said fragment comprises 10 or more consecutive amino acids from said amino acid sequence.

2. The purified polypeptide of claim 1, wherein said fragment comprises 12 or more consecutive amino acids from said amino acid sequence.

3. The purified polypeptide of claim 1, wherein said fragment comprises 14 or more consecutive amino acids from said amino acid sequence.

4. The purified polypeptide of claim 1, wherein said fragment comprises 16 or more consecutive amino acids from said amino acid sequence.

5. The purified polypeptide of claim 1, wherein said fragment comprises 18 or more consecutive amino acids from said amino acid sequence.

6. The purified polypeptide of claim 1, wherein said fragment comprises 20 or more consecutive amino acids from said amino acid sequence.

7. The purified polypeptide of claim 1 further comprising a pharmaceutically acceptable carrier.

8. The purified polypeptide of claim 1, wherein the purified polypeptide is immunogenic.

* * * * *